US009205144B2

(12) United States Patent
Brusic et al.

(10) Patent No.: US 9,205,144 B2
(45) Date of Patent: Dec. 8, 2015

(54) IDENTIFICATION OF CONSERVED PEPTIDE BLOCKS IN HOMOLOGOUS POLYPEPTIDES

(75) Inventors: Vladimir Brusic, Brookline, MA (US); Lars Ronn Olsen, Copenhagen (DK); Ellis L. Reinherz, Lincoln, MA (US); Guanglan Zhang, Brighton, MA (US); Christian Simon, Cambridge, MA (US)

(73) Assignee: Dana-Farber Cancer Institute, Inc., Boston, MA (US)

( * ) Notice: Subject to any disclaimer, the term of this patent is extended or adjusted under 35 U.S.C. 154(b) by 117 days.

(21) Appl. No.: 13/507,106

(22) Filed: Jun. 4, 2012

(65) Prior Publication Data
US 2013/0064843 A1 Mar. 14, 2013

Related U.S. Application Data

(60) Provisional application No. 61/493,226, filed on Jun. 3, 2011, provisional application No. 61/493,399, filed on Jun. 3, 2011.

(51) Int. Cl.
| | |
|---|---|
| *G01N 33/48* | (2006.01) |
| *G01N 33/50* | (2006.01) |
| *G01N 31/00* | (2006.01) |
| *A61K 39/12* | (2006.01) |
| *G06F 19/16* | (2011.01) |
| *G06F 19/12* | (2011.01) |
| *C07K 7/06* | (2006.01) |
| *G01N 33/566* | (2006.01) |
| *G06F 19/18* | (2011.01) |
| *C07K 14/005* | (2006.01) |
| *G06F 19/22* | (2011.01) |
| *A61K 39/00* | (2006.01) |

(52) U.S. Cl.
CPC . *A61K 39/12* (2013.01); *C07K 7/06* (2013.01); *C07K 14/005* (2013.01); *G01N 33/505* (2013.01); *G01N 33/566* (2013.01); *G06F 19/12* (2013.01); *G06F 19/16* (2013.01); *G06F 19/18* (2013.01); *A61K 39/00* (2013.01); *C12N 2760/16122* (2013.01); *C12N 2770/24122* (2013.01); *G01N 2333/18* (2013.01); *G06F 19/22* (2013.01)

(58) Field of Classification Search
None
See application file for complete search history.

(56) References Cited

U.S. PATENT DOCUMENTS

| | | | | |
|---|---|---|---|---|
| 7,176,186 | B1 * | 2/2007 | Falo et al. | 514/44 R |
| 2005/0015232 | A1 * | 1/2005 | Reinherz et al. | 703/11 |
| 2009/0081202 | A1 * | 3/2009 | Fischer et al. | 424/130.1 |
| 2012/0014972 | A1 * | 1/2012 | Hodges et al. | 424/159.1 |
| 2012/0128684 | A1 * | 5/2012 | Marasco et al. | 424/147.1 |
| 2012/0156242 | A1 * | 6/2012 | Ikuta et al. | 424/209.1 |

OTHER PUBLICATIONS

Olsen LR, Zhang GL, Keskin DB, Reinherz EL, Brusic V. Conservation analysis of dengue virus T-cell epitope-based vaccine candidates using Peptide block entropy. Front Immunol. 2011;2:69. Epub Dec. 20, 2011.*
Khan AM, Miotto O, Nascimento EJ, Srinivasan KN, Heiny AT, Zhang GL, Marques ET, Tan TW, Brusic V, Salmon J, August JT. Conservation and variability of dengue virus proteins: implications for vaccine design. PLoS Negl Trop Dis. Aug. 13, 2008;2(8):e272.*
Zou P, Liu W, Wu F, Chen YH. Fine-epitope mapping of an antibody that binds the ectodomain of influenza matrix protein 2. FEMS Immunol Med Microbiol. Jun. 2008;53(1):79-84. Epub Apr. 9, 2008.*
Chen Y, Luo W, Song H, Yin B, Tang J, Chen Y, Ng MH, Yeo AE, Zhang J, Xia N. Mimotope ELISA for detection of broad spectrum antibody against avian H5N1 influenza virus. PLoS One. 2011;6(9):e24144. Epub Sep. 2, 2011.*
Kubota-Koketsu R, Mizuta H, Oshita M, Ideno S, Yunoki M, Kuhara M, Yamamoto N, Okuno Y, Ikuta K. Broad neutralizing human monoclonal antibodies against influenza virus from vaccinated healthy donors. Biochem Biophys Res Commun. Sep. 11, 2009;387(1):180-5. Epub Jul. 4, 2009.*
Sahini L, Tempczyk-Russell A, Agarwal R. Large-scale sequence analysis of hemagglutinin of influenza A virus identifies conserved regions suitable for targeting an anti-viral response. PLoS One. Feb. 17, 2010;5(2):e9268.*
Stoloff GA, Caparros-Wanderley W. Synthetic multi-epitope peptides identified in silico induce protective immunity against multiple influenza serotypes. Eur J Immunol. Sep. 2007;37(9):2441-9.*
Heiny AT, Miotto O, Srinivasan KN, Khan AM, Zhang GL, Brusic V, Tan TW, August JT. Evolutionarily conserved protein sequences of influenza a viruses, avian and human, as vaccine targets. PLoS One. Nov. 21, 2007;2(11):e1190.*
Niotto et al. Complete-proteome mapping of human influenza A adaptive mutations: implications for human transmissibility of zoonotic strains. PLoS One, Feb. 3, 2010, vol. 5, article e9025, pp. 1-13.*
Crooks GE, et al., "WebLogo: A Sequence Logo Generator", Genome Res 2004, 14:1188-119.
Khan AM, et al., "Conservation and Variability of Dengue Virus Proteins: Implications for Vaccine Design" PLoS Negl Trop Dis 2(8):1-15, e272. doi:10.1371/journal.pntd.0000272 (Aug. 2008).
Koo QY, et al., "Conservation and variability of West Nile virus proteins" PLoS One, 4(4)1-14 e5352 (Apr. 2009).
Schneider TD, et al., "Sequence logos: a new way to display consensus sequences", Nucleic Acids Res, 18:6097-6100 (1990).

* cited by examiner

Primary Examiner — Russell S Negin
(74) Attorney, Agent, or Firm — Fish & Richardson P.C.

(57) ABSTRACT

Methods for identifying at least one conserved peptide block in three or more homologous polypeptides are provided and compositions comprising conserved peptides are provided. More particularly, methods for selecting conserved peptides in variable viral polypeptides for use in immunogenic compositions are provided.

13 Claims, 8039 Drawing Sheets

FIG. 2-1

Species: DENV1 (8-MERS)

| protein | block starting position | block entropy | total peptides in block | peptides required to cover 99% of block | gap/X fraction | 99% of block covered w/ <= 5 peptides? | block (peptides required to cover 99% of)

FIG. 2-2

Species: DENV1 (8-MERS)

| protein | block starting position | block entropy | total peptides in block | peptides required to cover 99% of block | gap/X fraction | 99% of block covered w/ =< 5 peptides? | block peptides required to cover 99% of | frequency | block peptides required to cover 99% of | frequency | block peptides required to cover 99% of | frequency | block peptides required to cover 99% of | frequency |
|---|---|---|---|---|---|---|---|---|---|---|---|---|---|---|
| anC | 27 | 0.06 | 6 | 1 |

Species: DENV1 (8-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99%

FIG. 2-5

Species: DENV1 (8-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 118 | 0.04 | 3 | 1 | 0 | Y | TTRGGEPH | 99.59 | | | | | | |
| prM | 119 | 0.04 | 3 | 1 | 0 | Y | TRGGEPHM | 99.59 | | | | | | |
| prM | 120 | 0.11 | 4 | 2 | 0 | Y | RGGEPHMI | 98.76 | RGGEPHMV | 0.99 | | | | |
| prM | 121 | 0.12 | 5 | 2 | 0 | Y | GGEPHMIV | 98.68 | GGEPHMVV | 0.99 | | | | |
| prM | 122 | 0.71 | 7 | 3 | 0 | Y | GEPHMIVS | 85.86 | GEPHMIVT | 12.16 | GEPHMVVS | 0.99 | | |
| prM | 123 | 0.72 | 8 | 4 | 0 | Y | EPHMIVSK | 85.77 | EPHMIVTK | 12.16 | EPHMVVSK | 0.99 | EPHMIVGK | 0.58 |
| prM | 124 | 0.73 | 9 | 4 | 0 | Y | PHMIVSKQ | 85.69 | PHMIVTKQ | 12.16 | PHMVVSKQ | 0.99 | PHMIVGKQ | 0.58 |
| prM | 125 | 0.73 | 9 | 4 | 0 | Y | HMIVSKQE | 85.69 | HMIVTKQE | 12.16 | HMWSKQE | 0.99 | HMIVGKQE | 0.58 |
| prM | 126 | 0.73 | 9 | 4 | 0 | Y | MIVSKQER | 85.69 | MIVTKQER | 12.16 | MWSKQER | 0.99 | MIVGKQER | 0.58 |
| prM | 127 | 0.74 | 10 | 4 | 0 | Y | IVSKQERG | 85.53 | IVTKQERG | 12.16 | WSKQERG | 0.99 | IVGKQERG | 0.58 |
| prM | 128 | 0.65 | 8 | 4 | 0 | Y | VSKQERGK | 86.68 | VTKQERGK | 12.16 | VGKQERGK | 0.58 | | |
| prM | 129 | 0.66 | 8 | 3 | 0 | Y | SKQERGKS | 86.6 | TKQERGKS | 12.16 | GKQERGKS | 0.58 | | |
| prM | 130 | 0.06 | 6 | 1 | 0 | Y | KQERGKSL | 99.42 | | | | | | |
| prM | 131 | 0.06 | 6 | 1 | 0 | Y | QERGKSLL | 99.42 | | | | | | |
| prM | 132 | 0.05 | 5 | 1 | 0 | Y | ERGKSLLF | 99.5 | | | | | | |
| prM | 133 | 0.05 | 5 | 1 | 0 | Y | RGKSLLFK | 99.5 | |

FIG. 2-6

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency | block | frequency |
|---|---|---|---|---|---|---|---|---|---|---|---|---|---|---|---|---|
| prM | 144 | 0.22 | 6 | 2 | 0 | Y | GVNMCTLI | 97.11 | GVNMCTLI | 2.32 | | | | | | |
| prM | 145 | 0.22 | 6 | 2 | 0 | Y | VNMCTLIA | 97.11 | VNMCTLIA | 2.32 | | | | | | |
| prM | 146 | 0.06 | 5 | 1 | 0 | Y | NMCTLIAM | 99.42 | | | | | | | | |
| prM | 147 | 0.06 | 5 | 1 | 0 | Y | MCTLIAMD | 99.42 | | | | | | | | |
| prM | 148 | 0.06 | 5 | 1 | 0 | Y | CTLIAMDL | 99.42 | | | | | | | | |
| prM | 149 | 0.06 | 5 | 1 | 0 | Y | TLIAMDLG | 99.42 | | | | | | | | |
| prM | 150 | 0.05 | 4 | 1 | 0 | Y | LIAMDLGE | 99.5 | | | | | | | | |
| prM | 151 | 0.7 | 5 | 2 | 0 | Y | IAMDLGEL | 82.46 | IAMDLGEF | 17.12 | | | | | | |
| prM | 152 | 0.67 | 2 | 2 | 0 | Y | AMDLGELC | 82.63 | AMDLGEFC | 17.37 | | | | | | |
| prM | 153 | 0.76 | 3 | 3 | 0 | Y | MDLGELCE | 81.31 | MDLGEFCE | 17.37 | MDLGELCD | 1.32 | | | | |
| prM | 154 | 0.76 | 3 | 3 | 0 | Y | DLGELCED | 81.31 | DLGEFCED | 17.37 | DLGELCDD | 1.32 | | | | |
| prM | 155 | 0.77 | 4 | 3 | 0 | Y | LGELCEDT | 81.22 | LGEFCEDT | 17.37 | LGELCDDT | 1.32 | | | | |
| prM | 156 | 0.86 | 7 | 4 | 0 | Y | GELCEDTM | 80.23 | GEFCEDTM | 17.37 | GELCDDTM | 1.32 | GELCEDTI | 0.58 | | |
| prM | 157 | 0.86 | 7 | 4 | 0 | Y | ELCEDTMT | 80.23 | EFCEDTMT | 17.37 | ELCDDTMT | 1.32 | ELCEDTIT | 0.58 | | |
| prM | 158 | 0.86 | 7 | 4 | 0 | Y | LCEDTMTY | 80.23 | FCEDTMTY | 17.37 | LCDDTMTY | 1.32 | LCEDTITY | 0.58 | | |
| prM | 159 | 0.2 | 6 | 3 | 0 | Y | CEDTMTYK | 97.6 | CDDTMTYK | 1.32 | CEDTITYK | 0.58 | | | | |
| prM | 160 | 0.2 | 6 | 3 | 0 | Y | EDTMTYKC | 97.6 | DDTMTYKC | 1.32 | EDTITYKC | 0.58 | | | | |
| prM | 161 | 0.1 | 5 | 2 | 0 | Y | DTMTYKCP | 98.92 | DTIYKCP | 0.5 | | | | | | |
| prM | 162 | 0.53 | 7 | 3 | 0 | Y | TMTYKCPR | 90.32 | TMTYKCPQ | 8.6 | TITYKCPR | 0.5 | | | | |
| prM | 163 | 0.53 | 7 | 3 | 0 | Y | MTYKCPRI | 90.32 | MTYKCPQI | 8.6 | ITYKCPRI | 0.83 | | | | |
| prM | 164 | 0.51 | 5 | 2 | 0 | Y | TYKCPRIT | 90.41 | TYKCPQIT | 8.6 | | | | | | |
| prM | 165 | 0.52 | 6 | 3 | 0 | Y | YKCPRITE | 90.32 | YKCPQITE | 8.6 | YKCPRISE | 0.83 | | | | |
| prM | 166 | 1.5 | 10 | 5 | 0 | Y | KCPRITEA | 59.97 | KCPRITET | 27.38 | KCPQITEA | 8.6 | KCPRITEV | 2.89 | KCPRISEA | 0.74 |
| prM | 167 | 1.5 | 10 | 5 | 0 | Y | CPRITEAE | 59.97 | CPRITETE | 27.38 | CPQITEAE | 8.6 | CPRITEVE | 2.89 | CPRISEAE | 0.74 |
| prM | 168 | 1.5 | 10 | 5 | 0 | Y | PRITEAEP | 59.97 | PRITETEP | 27.38 | PQITEAEP | 8.6 | PRITEVEP | 2.89 | PRISEAEP | 0.74 |
| prM | 169 | 1.51 | 11 | 5 | 0 | Y | RITEAEPD | 59.88 | RITETEPD | 27.38 | QITEAEPD | 8.6 | RITEVEPD | 2.89 | RISEAEPD | 0.74 |

FIG. 2-7

Species: DENV1 (8-MERS)

| protein | block starting position | block entropy | total peptides in block | peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| prM | 170 | 1.14 | 10 | 4 | 0 | Y | ITEAEPDD | 68.49 | ITETEPDD | 27.38 | ITEVEPDD | 2.89 | ISEAEPDD | 0.74 |
| prM | 171 | 1.13 | 9 | 4 | 0 | Y | TEAEPDDV | 68.57 | TETEPDDV | 27.38 | TEVEPDDV | 2.89 | SEAEPDDV | 0.74 |
| prM | 172 | 1.06 | 7 | 3 | 0 | Y | EAEPDDVD | 69.31 | ETEPDDVD | 27.46 | EVEPDDVD | 2.89 | | |
| prM | 173 | 1.05 | 6 | 3 | 0 | Y | AEPDDVDC | 69.4 | TEPDDVDC | 27.46 | VEPDDVDC | 2.89 | | |
| prM | 174 | 0.02 | 3 | 1 | 0 | Y | EPDDVDCW | 99.83 | | | | | | |
| prM | 175 | 0.02 | 3 | 1 | 0 | Y | PDDVDCWC | 99.83 | | | | | | |
| prM | 176 | 0.02 | 3 | 1 | 0 | Y | DDVDCWCN | 99.83 | | | | | | |
| prM | 177 | 0.19 | 4 | 2 | 0 | Y | DVDCWCNA | 97.27 | DVDCWCNT | 2.56 | | | | |
| prM | 178 | 0.19 | 4 | 2 | 0 | Y | VDCWCNAT | 97.27 | VDCWCNIT | 2.56 | | | | |
| prM | 179 | 0.39 | 5 | 3 | 0 | Y | DCWCNATD | 94.13 | DCWCNATE | 3.14 | DCWCNTTD | 2.56 | | |
| prM | 180 | 0.43 | 7 | 3 | 0 | Y | CWCNATDT | 93.8 | CWCNATET | 3.14 | CWCNTTDT | 2.56 | | |
| prM | 181 | 0.43 | 7 | 3 | 0 | Y | WCNATDTW | 93.8 | WCNATETW | 3.14 | WCNTTDTW | 2.56 | | |
| prM | 182 | 0.43 | 7 | 3 | 0 | Y | CNATDTWV | 93.8 | CNATETWV | 3.14 | CNTTDTWV | 2.56 | | |
| prM | 183 | 0.43 | 7 | 3 | 0 | Y | NATDTWVT | 93.8 | NATETWVT | 3.14 | NTTDTWVT | 2.56 | | |
| prM | 184 | 0.43 | 7 | 3 | 0 | Y | ATDTWVTY | 93.8 | ATETWVTY | 3.14 | TTDTWVTY | 2.56 | | |
| prM | 185 | 0.25 | 5 | 2 | 0 | Y | TDTWVTYG | 96.44 | TETWVTYG | 3.14 | | | | |
| prM | 186 | 0.25 | 5 | 2 | 0 | Y | DTWVTYGT | 96.44 | ETWVTYGT | 3.14 | | | | |
| prM | 187 | 0.03 | 3 | 1 | 0 | Y | TWVTYGTC | 99.67 | | | | | | |
| prM | 188 | 0.05 | 3 | 1 | 0 | Y | WVTYGTCS | 99.5 | | | | | | |
| prM | 189 | 0.08 | 5 | 1 | 0 | Y | VTYGTCSQ | 99.26 | | | | | | |
| prM | 190 | 0.09 | 6 | 1 | 0 | Y | TYGTCSQT | 99.09 | | | | | | |
| prM | 191 | 0.09 | 6 | 1 | 0 | Y | YGTCSQTG | 99.09 | | | | | | |
| prM | 192 | 0.14 | 8 | 2 | 0 | Y | GTCSQTGE | 98.68 | GTCTQIGE | 0.33 | TCSQTGGH | 0.33 | | |
| prM | 193 | 0.15 | 9 | 3 | 0 | Y | TCSQTGEH | 98.59 | TCTQIGEH | 0.33 | CSQTGGHR | 0.33 | | |
| prM | 194 | 0.15 | 9 | 3 | 0 | Y | CSQTGEHR | 98.59 | CTQIGEHR | 0.33 | SQTGGHRR | 0.33 | | |
| prM | 195 | 0.15 | 9 | 3 | 0 | Y | SQTGEHRR | 98.59 | TQIGEHRR | 0.33 | | | | |

FIG. 2-8

Species: DENV1 (8-MERS)

| protein |

FIG. 2-9

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 222 | 0.03 | 3 | 1 | 0 | Y | ETWMSSEG | 99.75 | | | | | | |
| prM | 223 | 0.03 | 3 | 1 | 0 | Y | TWMSSEGA | 99.75 | | | | | | |
| prM | 224 | 0.03 | 3 | 1 | 0 | Y | WMSSEGAW | 99.75 | | | | | | |
| prM | 225 | 0.17 | 5 | 2 | 0 | Y | MSSEG

FIG. 2-10

Species: DENV1 (8-MERS)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 248 | 0.59 | 11 | 5 | 0 | Y | TVIALFLA | 91.65 | TVIAFFLA | 3.97 | TVTALFLA | 2.56 | TWIALFLA | 0.58 | TMIALFLA | 0.41 |
| prM | 249 | 0.6 | 12 | 5 | 0 | Y | VIALFLAH | 91.56 | VIAFFLAH | 3.89 | VTALFLAH | 2.56 | VMALFLAH | 0.58 | MIALFLAH | 0.41 |
| prM | 251 | 0.47 | 8 | 3 | 0 | Y | ALFLAHAI | 92.89 | AFLAHAIG | 4.38 | ALFLAHVI | 2.07 |
| prM | 252 | 0.47 | 8 | 3 | 0 | Y | LFLAHAIG | 92.89 | FLAHAIG | 4.38 | LFLAHVIG | 2.07 |
| prM | 253 | 0.2 | 5 | 2 | 0 | Y | FLAHAIGT | 97.35 | FLAHVIGT | 2.07 |
| prM | 254 | 0.2 | 5 | 2 | 0 | Y | LAHAIGTS | 97.35 | LAHVIGTS | 2.07 |
| prM | 255 | 0.21 | 6 | 2 | 0 | Y | AHAIGTSI | 97.27 | AHVIGTSI | 2.07 |
| prM | 256 | 0.22 | 7 | 2 | 0 | Y | HAIGTSIT | 97.19 | HVIGTSIT | 2.07 |
| prM | 257 | 0.2 | 6 | 2 | 0 | Y | AIGTSITQ | 97.44 | VIGTSITQ | 2.07 |
| prM | 258 | 0.03 | 4 | 1 | 0 | Y | IGTSITQK | 99.75 |
| prM | 259 | 0.03 | 4 | 1 | 0 | Y | GTSITQKG | 99.75 |
| prM | 260 | 0.07 | 6 | 1 | 0 | Y | TSITQKGI | 99.34 |
| prM | 261 | 0.09 | 7 | 1 | 0 | Y | SITQKGII | 99.17 |
| prM | 262 | 0.08 | 7 | 1 | 0 | Y | ITQKGIIF | 99.17 |
| prM | 263 | 0.08 | 6 | 1 | 0 | Y | TQKGIIFI | 99.26 |
| prM | 264 | 0.07 | 5 | 1 | 0 | Y | QKGIIFIL | 99.34 |
| prM | 265 | 0.07 | 5 | 1 | 0 | Y | KGIIFILL | 99.34 |
| prM | 266 | 0.09 | 7 | 1 | 0 | Y | GIIFILLM | 99.17 |
| prM | 267 | 0.09 | 7 | 1 | 0 | Y | IIFILLML | 99.17 |
| prM | 268 | 0.12 | 6 | 2 | 0 | Y | IFILLMLV | 98.76 | IFILLMLA | 0.83 |
| prM | 269 | 0.1 | 5 | 2 | 0 | Y | FILLMLVT | 98.92 | FILLMLAT | 0.83 |
| prM | 270 | 0.1 | 5 | 2 | 0 | Y | ILLMLVTP | 98.92 | ILLMLATP | 0.83 |
| prM | 271 | 0.1 | 5 | 2 | 0 | Y | LLMLVTPS | 98.92 | LLMLATPS | 0.83 |
| prM | 272 | 0.1 | 5 | 2 | 0 | Y | LMLVTPSM | 98.92 | LMLATPSM | 0.83 |
| prM | 273 | 0.11 | 6 | 2 | 0 | Y | MLVTPSMA | 98.84 | MLATPSMA | 0.83 |
| prM | 274 | 0.09 | 4 | 1 | 0 | Y | LVTPSMAM | 99.01 |

FIG. 2-11

Species: DENV1 (8

FIG. 2-12

Species: DENV1 (8-MERS)

| protein | block starting position | block

FIG. 2-13

Species: DENV1 (8-MERS)

| protein | block starting position | block entropy | total peptides in block | peptides required to cover 99% of block | gap/X fraction | 99% of block covered w/ =>/5 peptides? | block | frequency | block | frequency | block | frequency | block | frequency |
|---|---|---|---|---|---|---|---|---|---|---|---|---|---|---|
| E | 327 | 0.15 | 10 | 2 | 0 | Y | KTEVTNPA | 98.51 | KTEVTDPA | 0.58 | | | | |
| E | 328 | 0.7 | 11 | 3 | 0 | Y | TEVTNPAV | 85.69 | TEVTNPAI | 12.9 | TEVTDPAV | 0.58 | | |
| E | 329 | 0.7 | 11 | 3 | 0 | Y | EVTNPAVL | 85.69 | EVTNPAIL | 12.9 | EVTDPAVL | 0.58 | | |
| E | 330 | 0.72 | 13 | 3 | 0 | Y | VTNPAVLR | 85.53 | VTNPAILR | 12.9 | VTDPAVLR | 0.58 | | |
| E | 331 | 0.72 | 14 | 4 | 0 | Y | TNPAVLRK | 85.44 | TNPAILRK | 12.9 | TDPAVLRK | 0.58 | ANPAVLRK | 0.17 |
| E | 332 | 0.68 | 10 | 3 | 0 | Y | NPAVLRKL | 85.77 | NPAILRKL | 12.99 | DPAVLRKL | 0.58 | | |
| E | 333 | 0.62 | 8 | 2 | 0 | Y | PAVLRKLC | 86.35 | PAILRKLC | 13.15 | | | | |
| E | 334 | 0.63 | 9 | 2 | 0 | Y | AVLRKLCI | 86.27 | AILRKLCI | 13.15 | | | | |
| E | 335 | 0.63 | 9 | 2 | 0 | Y | VLRKLCIE | 86.27 | ILRKLCIE | 13.15 | | | | |
| E | 336 | 0.07 | 8 | 1 | 0 | Y | LRKLCIEA | 99.42 | | | | | | |
| E | 337 | 0.07 | 8 | 1 | 0 | Y | RKLCIEAK | 99.42 | | | | | | |
| E | 338 | 0.07 | 8 | 1 | 0 | Y | KLCIEAKI | 99.42 | | | | | | |
| E | 339 | 0.06 | 7 | 1 | 0 | Y | LCIEAKIS | 99.5 | | | | | | |
| E | 340 | 0.06 | 7 | 1 | 0 | Y | CIEAKISN | 99.5 | | | | | | |
| E | 341 | 0.05 | 6 | 1 | 0 | Y | IEAKISNT | 99.59 | | | | | | |
| E | 342 | 0.06 | 6 | 1 | 0 | Y | EAKISNTT | 99.59 | | | | | | |
| E | 343 | 0.06 | 7 | 1 | 0 | Y | AKISNTTD | 99.5 | | | | | | |
| E | 344 | 0.05 | 6 | 1 | 0 | Y | KISNTTDS | 99.59 | | | | | | |
| E | 345 | 0.04 | 5 | 1 | 0 | Y | ISNTTDSR | 99.67 | | | | | | |
| E | 346 | 0.03 | 4 | 1 | 0 | Y | SNTTDSRC | 99.75 | | | | | | |
| E | 347 | 0.03 | 4 | 1 | 0 | Y | NTTDSRCP | 99.75 | | | | | | |
| E | 348 | 0.03 | 4 | 1 | 0 | Y | TTDSRCPT | 99.75 | | | | | | |
| E | 349 | 0.03 | 4 | 1 | 0 | Y | TDSRCPTQ | 99.83 | | | | | | |
| E | 350 | 0.02 | 3 | 1 | 0 | Y | DSRCPTQG | 99.92 | | | | | | |
| E | 351 | 0.01 | 2 | 1 | 0 | Y | SRCPTQGE | 99.92 | | | | | | |
| E | 352 | 0.01 | 2 | 1 | 0 | Y | | | | | | | | |

FIG. 2-14

Species: DENV1 (8-MERS)

| protein | block starting position | block entropy | total peptides in block | peptides required to cover 99% of block | gap/X fraction | 99% of block covered w/ <=5 peptides? | block | frequency | peptides required to cover 99

FIG. 2-15

Species: DENV1 (8-MERS)

| protein | block starting position | block entropy | total peptides in block | peptides required to cover 99% of block | gap/X fraction | 99% of block covered w/ <= 5 pe

FIG. 2-16

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|

FIG. 2-17

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency | block | frequency |
|---|---|---|---|---|

FIG. 2-18

Species: DENV1 (8-MERS)

| protein | block starting position | block entropy | total peptides in block | peptides required to cover 99% of block | gap/X fraction | 99% of block covered w/ 5 peptides? | block | frequency | block | frequency | block | frequency | block | frequency |
|---|---|---|---|---|---|---|---|---|---|---|---|---|---|---|
| E | 457 | 0.2 | 7 | 2 | 0 | Y | DYGALTLD | 97.68 | DYGTLTLD | 1.41 | | | | |
| E | 458 | 0.19 | 6 | 2 | 0 | Y | YGALTLDC | 97.77 | YGTLTLDC | 1.41 | | | | |
| E | 459 | 0.19 | 6 | 2 | 0 | Y | GALTLDCS | 97.77 | GTLTLDCS | 1.41 | | | | |
| E | 460 | 0.19 | 6 | 2 | 0 | Y | ALTLDCSP | 97.77 | TLTLDCSP | 1.41 | | | | |
| E | 461 | 0.03 | 4 | 1 | 0 | Y | LTLDCSPR | 99.75 | | | | | | |
| E | 462 | 0.04 | 5 | 1 | 0 | Y | TLDCSPRT | 99.67 | | | | | | |
| E | 463 | 0.02 | 3 | 1 | 0 | Y | LDCSPRTG | 99.83 | | | | | | |
| E | 464 | 0.02 | 3 | 1 | 0 | Y | DCSPRTGL | 99.83 | | | | | | |
| E | 465 | 0.02 | 3 | 1 | 0 | Y | CSPRTGLD | 99.83 | | | | | | |
| E | 466 | 0.02 | 3 | 1 | 0 | Y | SPRTGLDF | 99.83 | | | | | | |
| E | 467 | 0.03 | 4 | 1 | 0 | Y | PRTGLDFN | 99.75 | | | | | | |
| E | 468 | 0.04 | 5 | 1 | 0 | Y | RTGLDFNE | 99.67 | | | | | | |
| E | 469 | 0.06 | 6 | 1 | 0 | Y | TGLDFNEM | 99.5 | | | | | | |
| E | 470 | 0.06 | 6 | 1 | 0 | Y | GLDFNEMV | 99.5 | | | | | | |
| E | 471 | 0.06 | 6 | 1 | 0 | Y | LDFNEMVL | 99.5 | | | | | | |
| E | 472 | 0.07 | 7 | 1 | 0 | Y | DFNEMVLL | 99.42 | | | | | | |
| E | 473 | 0.08 | 8 | 1 | 0 | Y | FNEMVLLT | 99.34 | | | | | | |
| E | 474 | 0.08 | 8 | 1 | 0 | Y | NEMVLLTM | 99.34 | | | | | | |
| E | 475 | 0.11 | 9 | 1 | 0 | Y | EMVLLTMK | 99.01 | | | | | | |
| E | 476 | 0.21 | 10 | 3 | 0 | Y | MVLLTMKE | 97.77 | MVLLTMKK | 0.99 | MVLLTMKG | 0.33 | | |
| E | 477 | 0.21 | 10 | 3 | 0 | Y | VLLTMKEK | 97.77 | VLLTMKKK | 0.99 | VLLTMEKK | 0.33 | | |
| E | 478 | 0.26 | 10 | 4 | 0 | Y | LLTMKEKS | 97.19 | LLTMKKKS | 0.99 | LLTMKEKA | 0.66 | LLTMKGKS | 0.33 |
| E | 479 | 0.26 | 10 | 4 | 0 | Y | LTMKEKSW | 97.19 | LTMKKKSW | 0.99 | LTMKEKAW | 0.66 | LTMEKKSW | 0.33 |
| E | 480 | 0.25 | 9 | 4 | 0 | Y | TMKEKSWL | 97.27 | TMKKKSWL | 0.99 | TMKEKAWL | 0.66 | TMKGKSWL | 0.33 |
| E | 481 | 0.25 | 10 | 4 | 0 | Y | MKEKSWLV | 97.27 | MKKKSWLV | 0.99 | MKEKAWLV | 0.66 | MEKKSWLV | 0.33 |
| E | 482 | 0.25 | 10 | 4 | 0 | Y | KEKSWLVH | 97.27 | KKKSWLVH | 0.99 | KEKAWLVH | 0.66 | EKKSWLVH | 0.33 |

FIG. 2-19

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 483 | 0.23 | 8 | 3 | 0 | Y | EKSWLVHK | 97.35 | KKSWLVHK | 1.32 | EKAWLVHK | 0.66 | | |
| E | 484 | 0.1 | 5 | 2 | 0 | Y | KSWLVHKQ | 98.92 | KAWLVHKQ | 0.66 | | | | |
| E | 485 | 0.08 | 4 | 1 | 0 | Y | SWLVHKQW | 99.09 | | | | | | |
| E | 486 | 0.03 | 3 | 1 | 0 | Y | WLVHKQWF | 99.75 | | | | | | |
| E | 487 | 0.03 | 3 | 1 | 0 | Y | LVHKQWFL | 99.75 | | | | | | |
| E | 488 | 0.03 | 3 | 1 | 0 | Y | VHKQWFLD | 99.92 | | | | | | |
| E | 489 | 0.01 | 2 | 1 | 0 | Y | HKQWFLDL | 99.92 | | | | | | |
| E | 490 | 0.01 | 2 | 1 | 0 | Y | KQWFLDLP | 99.92 | | | | | | |
| E | 491 | 0 | 1 | 1 | 0 | Y | QWFLDLPL | 100 | | | | | | |
| E | 492 | 0.01 | 2 | 1 | 0 | Y | WFLDLPLP | 99.92 | | | | | | |
| E | 493 | 0.01 | 2 | 1 | 0 | Y | FLDLPLPW | 99.92 | | | | | | |
| E | 494 | 0.02 | 3 | 1 | 0 | Y | LDLPLPWT | 99.83 | | | | | | |
| E | 495 | 0.02 | 3 | 1 | 0 | Y | DLPLPWTS | 99.83 | | | | | | |
| E | 496 | 0.02 | 3 | 1 | 0 | Y | LPLPWTSG | 99.83 | | | | | | |
| E | 497 | 0.06 | 6 | 1 | 0 | Y | PLPWTSGA | 99.5 | | | | | | |
| E | 498 | 0.26 | 8 | 3 | 0 | Y | LPWTSGAS | 96.86 | LPWTSGAT | 1.65 | LPWTSGAL | 0.99 | | |
| E | 499 | 0.28 | 11 | 3 | 0 | Y | PWTSGAST | 96.69 | PWTSGATT | 1.65 | PWTSGALT | 0.83 | | |
| E | 505 | 0.35 | 15 | 5 | 0 | Y | STSQETWN | 96.03 | TTSQETWN | 1.65 | LTSQETWN | 0.83 | STTQETWN | 0.25 |
| E | 506 | 0.17 | 13 | 4 | 0 | Y | TQETWNRK | 98.43 | TTQETWNR | 0.25 | TLQETWNR | 0.25 | ASQETWNR | 0.25 |
| E | 507 | 0.64 | 13 | 3 | 0 | Y | SQETWNRQ | 87.43 | SQETWNRK | 1.33 | TQETWNRQ | 0.25 | | |
| E | 508 | 0.59 | 10 | 2 | 0 | Y | QETWNRQD | 88.01 | QETWNRKD | 1.33 | | | | |
| E | 509 | 0.57 | 8 | 2 | 0 | Y | ETWNRQDL | 88.17 | ETWNRKDL | 1.33 | | | | |
| E | 510 | 0.58 | 9 | 2 | 0 | Y | TWNRQDLL | 88.09 | TWNRKDLL | 1.33 | | | | |
| E | 511 | 0.58 | 8 | 2 | 0 | Y | WNRQDLLV | 88.25 | WNRKDLLV | 1.33 | | | | |
| E | 512 | 0.56 | 8 | 2 | 0 | Y | NRQDLLVT | 88.25 | NRKDLLVT | 1.25 | | | | |
| E | 513 | 0.56 | 8 | 2 | 0 | Y | RQDLLVTF | 88.25 | RKDLLVTF | 1.25 | | | | |

Additional block at position 505: STLQETWN, frequency 0.25

FIG. 2-20

Species: DEN

FIG. 2-21

Species: DENV1 (8-MERS)

| protein | block starting position | block entropy | total peptides in block | peptides required to cover 99% of block | gap/X fraction | 99% of block covered w/<=5 peptides? | block | frequency | block | frequency |
|---|---|---|---|---|---|---|---|---|---|---|
| E | 540 | 0.05 | 6 | 1 | 0 | Y | MHTALTGA | 99.59 | | |
| E | 541 | 0.05 | 6 | 1 | 0 | Y | HTALTGAT | 99.59 | | |
| E | 542 | 0.04 | 5 | 1 | 0 | Y | TALTGATE | 99.67 | | |
| E | 543 | 0.03 | 4 | 1 | 0 | Y | ALTGATEI | 99.75 | | |
| E | 544 | 0.02 | 3 | 1 | 0 | Y | LTGATEIQ | 99.83 | | |
| E | 545 | 0.06 | 4 | 1 | 0 | Y | TGATEIQT | 99.42 | | |
| E | 546 | 0.09 | 4 | 1 | 0 | Y | GATEIQTS | 99.09 | | |
| E | 547 | 0.09 | 5 | 1 | 0 | Y | ATEIQTSG | 99.09 | | |
| E | 548 | 0.11 | 6 | 2 | 0 | Y | TEIQTSGT | 98.92 | TEIQTGT | 0.41 |
| E | 549 | 0.12 | 7 | 2 | 0 | Y | EIQTSGTT | 98.84 | EIQTTGTT | 0.41 |
| E | 550 | 0.14 | 8 | 2 | 0 | Y | IQTSGTTT | 98.59 | IQTTGTTT | 0.41 |
| E | 551 | 0.14 | 8 | 2 | 0 | Y | QTSGTTTI | 98.59 | QTTGTTTI | 0.41 |
| E | 552 | 0.14 | 7 | 2 | 0 | Y | TSGTTTIF | 98.59 | TGTTTIF | 0.41 |
| E | 553 | 0.13 | 6 | 2 | 0 | Y | SGTTTIFA | 98.76 | TGTTTIFA | 0.41 |
| E | 554 | 0.09 | 6 | 1 | 0 | Y | GTTTIFAG | 99.17 | | |
| E | 555 | 0.09 | 5 | 1 | 0 | Y | TTTIFAGH | 99.17 | | |
| E | 556 | 0.07 | 5 | 1 | 0 | Y | TTIFAGHL | 99.34 | | |
| E | 557 | 0.07 | 4 | 1 | 0 | Y | TIFAGHLK | 99.34 | | |
| E | 558 | 0.04 | 4 | 1 | 0 | Y | IFAGHLKC | 99.59 | | |
| E | 559 | 0.04 | 4 | 1 | 0 | Y | FAGHLKCR | 99.59 | | |
| E | 560 | 0.04 | 3 | 1 | 0 | Y | AGHLKCRL | 99.59 | | |
| E | 561 | 0.02 | 3 | 1 | 0 | Y | GHLKCRLK | 99.83 | | |
| E | 562 | 0.02 | 5 | 1 | 0 | Y | HLKCRLKM | 99.83 | | |
| E | 563 | 0.05 | 5 | 1 | 0 | Y | LKCRLKMD | 99.5 | | |
| E | 564 | 0.05 | 5 | 1 | 0 | Y | KCRLKMDK | 99.5 | | |
| E | 565 | 0.04 | 4 | 1 | 0 | Y | CRLKMDKL | 99.59 | | |

FIG. 2-22

Species: DENV1 (8-MERS)

| protein | block starting position | block entropy | total peptides in block | peptides required to cover 99% of block | block gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 566 | 0.09 | 6 | 1 | 0 | Y | RLKMDKLT | 99.17 | | | | | | |
| E | 567 | 0.09 | 6 | 1 | 0 | Y | LKMDKLTL | 99.17 | | | | | | |
| E | 568 | 0.2 | 7 | 2 | 0 | Y | KMDKLTLK | 97.6 | KMDKLTLR | 1.57 | | | | |
| E | 569 | 0.2 | 7 | 2 | 0 | Y | MDKLTLKG | 97.6 | MDKLTLRG | 1.57 | | | | |
| E | 570 | 0.85 | 10 | 5 | 0 | Y | DKLTLKGM | 84.78 | DKLTLKGT | 10.75 | DKLTLRGM | 1.57 | DKLTLKGV | 0.66 |
| E | 571 | 0.82 | 8 | 5 | 0 | Y | KLTLKGMS | 85.11 | KLTLKGTS | 10.75 | KLTLRGMS | 1.57 | KLTLKGVS | 0.66 |
| E | 572 | 0.82 | 8 | 5 | 0 | Y | LTLKGMSY | 85.11 | LTLKGTSY | 10.75 | LTLRGMSY | 1.57 | LTLKGVSY | 0.66 |
| E | 573 | 0.82 | 8 | 5 | 0 | Y | TLKGMSYV | 85.11 | TLKGTSYV | 10.75 | TLRGMSYV | 1.57 | TLKGVSYV | 0.66 |
| E | 574 | 0.79 | 7 | 4 | 0 | Y | LKGMSYVM | 85.44 | LKGTSYVM | 10.75 | LRGMSYVM | 1.57 | LKGISYVM | 1.41 |
| E | 575 | 0.79 | 7 | 4 | 0 | Y | KGMSYVMC | 85.44 | KGTSYVMC | 10.75 | RGMSYVMC | 1.57 | KGISYVMC | 1.41 |
| E | 576 | 0.68 | 7 | 3 | 0 | Y | GMSYVMCT | 87.01 | GTSYVMCT | 10.67 | GISYVMCT | 1.41 | | |
| E | 577 | 0.7 | 9 | 4 | 0 | Y | MSYVMCTG | 86.85 | TSYVMCTG | 10.67 | ISYVMCTG | 1.41 | VSYVMCTG | 0.66 |
| E | 578 | 0.16 | 8 | 3 | 0 | Y | SYVMCTGS | 98.26 | SYVMCTGL | 0.66 | SYVMCTGP | 0.66 | | |
| E | 579 | 0.16 | 8 | 3 | 0 | Y | YVMCTGSF | 98.26 | YVMCTGPF | 0.66 | YVMCTGLF | 0.66 | | |
| E | 580 | 0.17 | 9 | 3 | 0 | Y | VMCTGSFK | 98.18 | VMCTGPFK | 0.66 | VMCTGLFK | 0.66 | | |
| E | 581 | 0.17 | 9 | 3 | 0 | Y | MCTGSFKL | 98.18 | MCTGPFKL | 0.66 | MCTGLFKL | 0.66 | | |
| E | 582 | 0.17 | 9 | 3 | 0 | Y | CTGSFKLE | 98.18 | CTGPFKLE | 0.66 | CTGLFKLE | 0.66 | | |
| E | 583 | 0.17 | 9 | 3 | 0 | Y | TGSFKLEK | 98.18 | TGPFKLEK | 0.66 | TGLFKLEK | 0.66 | | |
| E | 584 | 0.17 | 9 | 3 | 0 | Y | GSFKLEKE | 98.18 | GPFKLEKE | 0.66 | GLFKLEKE | 0.66 | | |
| E | 585 | 0.51 | 8 | 3 | 0 | Y | SFKLEKEV | 91.48 | SFKLEKEL | 6.87 | PFKLEKEV | 0.66 | | |
| E | 586 | 0.4 | 6 | 2 | 0 | Y | FKLEKEVA | 92.8 | FKLEKELA | 6.87 | | | | |
| E | 587 | 0.4 | 6 | 2 | 0 | Y | KLEKEVAE | 92.8 | KLEKELAE | 6.87 | | | | |
| E | 588 | 0.39 | 5 | 2 | 0 | Y | LEKEVAET | 92.89 | LEKELAET | 6.87 | | | | |
| E | 589 | 0.39 | 5 | 2 | 0 | Y | EKEVAETQ | 92.89 | EKELAETQ | 6.87 | | | | |
| E | 590 | 0.38 | 4 | 2 | 0 | Y | KEVAETQH | 92.97 | KELAETQH | 6.87 | | | | |
| E | 591 | 0.38 | 4 | 2 | 0 | Y | EVAETQHG | 92.97 | ELAETQHG | 6.87 | | | | |

FIG. 2-23

Species: DENV1 (8-MERS)

| protein | block starting position | block entropy | total peptides in block | peptides required to cover

FIG. 2-24

Species: DENV1 (8-MERS)

| protein | block starting position | block entropy | total peptides in block | peptides required to cover 99% of block | gap/X fraction | 99% of block covered w/>=5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| E | 622 | 0.42 | 8 | 5 | 0

FIG. 2-25

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 648 | 0.75 | 4 | 2 | 0 | Y | EAEPPFGE | 79.32 | ETEPPFGE | 20.51 | | | | |
| E | 649 | 0.75 | 4 | 2 | 0 | Y | AEPPFGES | 79.32 | TEPPFGES | 20.51 | | | | |
| E | 650 | 0.04 | 4 | 1 | 0 | Y | EPPFGESY | 99.67 | | | | | | |
| E | 651 | 0.05 | 5 | 1 | 0 | Y | PPFGESYI | 99.5 | | | | | | |
| E | 652 | 0.41 | 9 | 3 | 0 | Y | PFGESYIV | 93.96 | PFGESYII | 4.71 | PFGESYIT | 0.41 | | |
| E | 653 | 1.19 | 10 | 5 | 0 | Y | FGESYIVI | 70.47 | FGESYIIV | 23.57 | FGESYIII | 4.14 | FGESYIIV | 0.58 |
| E | 654 | 1.19 | 10 | 5 | 0 | Y | GESYIVIG | 70.47 | GESYIVVG | 23.57 | GESYIIIG | 4.14 | GESYIVVG | 0.58 |
| E | 660 | 1.08 | 13 | 4 | 0 | Y | IGAGEKAL | 72.21 | VGAGEKAL | 24.4 | IGVGEKAL | 1.82 | IGAGEKTL | 0.58 |
| E | 661 | 0.28 | 10 | 3 | 0 | Y | GAGEKALK | 96.61 | GVGEKALK | 1.9 | GAGEKTLK | 0.74 | | |
| E | 662 | 0.3 | 11 | 3 | 0 | Y | AGEKALKL | 96.44 | VGEKALKL | 1.9 | AGEKTLKL | 0.74 | | |
| E | 663 | 0.16 | 10 | 2 | 0 | Y | GEKALKLS | 98.35 | GEKTLKLS | 0.74 | | | | |
| E | 664 | 0.16 | 10 | 2 | 0 | Y | EKALKLSW | 98.35 | EKTLKLSW | 0.74 | | | | |
| E | 665 | 0.15 | 9 | 2 | 0 | Y | KALKLSWF | 98.43 | KTLKLSWF | 0.74 | | | | |
| E | 666 | 0.16 | 9 | 2 | 0 | Y | ALKLSWFK | 98.35 | TLKLSWFK | 0.74 | | | | |
| E | 667 | 0.22 | 9 | 2 | 0 | Y | LKLSWFKK | 97.44 | LKLSWFKR | 1.65 | | | | |
| E | 668 | 0.21 | 8 | 2 | 0 | Y | KLSWFKKG | 97.52 | KLSWFKRG | 1.65 | | | | |
| E | 669 | 0.21 | 8 | 2 | 0 | Y | LSWFKKGS | 97.52 | LSWFKRGS | 1.65 | | | | |
| E | 670 | 0.29 | 10 | 4 | 0 | Y | SWFKKGSS | 96.61 | SWFKRGSS | 1.65 | SWFKKGST | 0.66 | SWFKKGSN | 0.25 |
| E | 671 | 0.26 | 7 | 3 | 0 | Y | WFKKGSSI | 96.86 | WFKRGSSI | 1.74 | WFKKGSTI | 0.66 | | |
| E | 672 | 0.26 | 7 | 3 | 0 | Y | FKKGSSIG | 96.86 | FKRGSSIG | 1.74 | FKKGSTIG | 0.66 | | |
| E | 673 | 0.27 | 8 | 3 | 0 | Y | KKGSSIGK | 96.77 | KRGSSIGK | 1.74 | KKGSTIGK | 0.66 | | |
| E | 674 | 0.24 | 6 | 3 | 0 | Y | KGSSIGKM | 97.02 | RGSSIGKM | 1.74 | KGSTIGKM | 0.74 | | |
| E | 675 | 0.14 | 7 | 2 | 0 | Y | GSSIGKMF | 98.51 | GSTIGKMF | 0.74 | | | | |
| E | 676 | 0.18 | 9 | 3 | 0 | Y | SSIGKMFE | 98.18 | STIGKMFE | 0.74 | SSIGKMFV | 0.25 | | |
| E | 677 | 0.19 | 10 | 3 | 0 | Y | SIGKMFEA | 98.1 | TIGKMFEA | 0.74 | NIGKMFEA | 0.25 | | |
| E | 678 | 0.12 | 10 | 2 | 0 | Y | IGKMFEAT | 98.92 | IGKMFVAT | 0.25 | | | | |

FIG. 2-26

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency |
|---|---|---|---|

FIG. 2-27

Species: DENV1 (8-MERS)

| protein | block starting position | block entropy | total peptides in block | peptides required to cover 99% of block | gap/X fraction | 99% of block covered w/ >= 5 peptides? | block | frequency | block | frequency | block | frequency | block | frequency | block | frequency |
|---|---|---|---|---|---|---|---|---|---|---|---|---|---|---|---|---|
| E | 706 | 0.39 | 8 | 5 | 0 | Y | GGVFTSVG | 95.29 | GGVFTSIG | 1.24 | GGVFTSMG | 0.99 | GGLFTSVG | 0.99 | GGVFTSAG | 0.99 |
| E | 707 | 0.39 | 8 | 5 | 0 | Y | GVFTSVGK | 95.29 | GVFTSIGK | 1.24 | GLFTSVGK | 0.99 | GVFTSMGK | 0.99 | GVFTSAGK | 0.99 |
| E | 708 | 0.41 | 11 | 5 | 0 | Y | VFTSVGKL | 95.12 | VFTSIGKL | 1.16 | LFTSVGKL | 0.99 | VFTSAGKL | 0.99 | VFTSMGKL | 0.99 |
| E | 709 | 0.52 | 11 | 5 | 0 | Y | FTSVGKLV | 92.89 | FTSVGKLI | 3.47 | FTSIGKLV | 1.16 | FTSAGKLV | 0.99 | FTSMGKLV | 0.99 |
| E | 710 | 0.52 | 10 | 5 | 0 | Y | TSVGKLVH | 92.97 | TSVGKLIH | 3.47 | TSIGKLVH | 1.16 | TSMGKLVH | 0.99 | TSAGKLVH | 0.99 |
| E | 711 | 0.51 | 9 | 5 | 0 | Y | SVGKLVHQ | 93.05 | SVGKLIHQ | 3.47 | SIGKLVHQ | 1.16 | SAGKLVHQ | 0.99 | SMGKLVHQ | 0.99 |
| E | 713 | 1 | 8 | 4 | 0 | Y | GKLVHQIF | 75.77 | GKLVHQVF | 20.43 | GKLIHQIF | 2.56 | GKLIHQVF | 0.91 | | |
| E | 714 | 1 | 8 | 4 | 0 | Y | KLVHQIFG | 75.77 | KLVHQVFG | 20.43 | KLIHQIFG | 2.56 | KLIHQYFG | 0.91 | | |
| E | 715 | 1.16 | 12 | 5 | 0 | Y | LVHQIFGT | 75.35 | LVHQVFGT | 17.95 | LIHQIFGT | 2.56 | LVHQVFGA | 2.48 | LIHQVFGT | 0.83 |
| E | 716 | 1.14 | 10 | 5 | 0 | Y | VHQIFGTA | 75.52 | VHQVFGTA | 17.95 | IHQIFGTA | 2.56 | VHQVFGAA | 2.48 | IHQVFGTA | 0.83 |
| E | 717 | 0.91 | 6 | 3 | 0 | Y | HQIFGTAY | 78.08 | HQVFGTAY | 18.86 | HQVFGAAY | 2.56 | | | | |
| E | 718 | 0.92 | 7 | 3 | 0 | Y | QIFGTAYG | 78 | QVFGTAYG | 18.86 | QVFGAAYG | 2.56 | | | | |
| E | 719 | 0.93 | 8 | 3 | 0 | Y | IFGTAYGV | 77.92 | VFGTAYGV | 18.86 | VFGAAYGV | 2.56 | | | | |
| E | 720 | 0.23 | 6 | 2 | 0 | Y | FGTAYGVL | 96.77 | FGAAYGVL | 2.89 | | | | | | |
| E | 721 | 0.23 | 6 | 2 | 0 | Y | GTAYGVLF | 96.77 | GAAYGVLF | 2.89 | | | | | | |
| E | 722 | 0.23 | 6 | 2 | 0 | Y | TAYGVLFS | 96.77 | AAYGVLFS | 2.89 | | | | | | |
| E | 723 | 0.03 | 4 | 1 | 0 | Y | AYGVLFSG | 99.75 | | | | | | | | |
| E | 724 | 0.03 | 4 | 1 | 0 | Y | YGVLFSGV | 99.75 | | | | | | | | |
| E | 725 | 0.03 | 4 | 1 | 0 | Y | GVLFSGYS | 99.75 | | | | | | | | |
| E | 726 | 0.02 | 3 | 1 | 0 | Y | VLFSGVSW | 99.83 | | | | | | | | |
| E | 727 | 0.02 | 4 | 1 | 0 | Y | LFSGVSWT | 99.75 | | | | | | | | |
| E | 728 | 0.02 | 3 | 1 | 0 | Y | FSGVSWTM | 99.83 | | | | | | | | |
| E | 729 | 0.02 | 3 | 1 | 0 | Y | SGVSWTMK | 99.83 | | | | | | | | |
| E | 730 | 0.04 | 5 | 1 | 0 | Y | GVSWTMKI | 99.67 | | | | | | | | |
| E | 731 | 0.05 | 6 | 1 | 0 | Y | VSWTMKIG | 99.59 | | | | | | | | |
| E | 732 | 0.12 | 7 | 2 | 0 | Y | SWTMKIGI | 98.68 | SWTMKIGL | 0.91 | | | | | | |

FIG. 2-28

Species: DENV1 (8-MERS)

| protein | block starting position | block entropy | total

FIG. 2-29

Species: DENV1 (8-MERS)

| protein | block starting position | block entropy | total peptides in block | pe

FIG. 2-30

Species: DENV1 (8-MERS)

| protein | block starting position | block entropy | total peptides in block | peptides required to cover 99% of block | gap/X fraction | 99% of block covered w/ >= 5 peptides? | block | frequency |
|---|---|---|---|---|---|---|---|---|
| NS1 | 785 | 0.02 | 3 | 1 | 0 | Y | GRELKCGS | 99.83 |
| NS1 | 786 | 0.02 | 3 | 1 | 0 | Y | RELKCGSG | 99.83 |
| NS1 | 787 | 0.01 | 2 | 1 | 0 | Y | ELKCGSGI | 99.92 |
| NS1 | 788 | 0 | 1 | 1 | 0 | Y | LKCGSGIF | 100 |
| NS1 | 789 |

FIG. 2-31

Species: DENV1 (8-MERS)

| protein | block starting position | block entropy | total peptides in block | peptides required to cover 99% of block | gap/X fraction | 99% of block covered w/ =>5 peptides? | peptides required to cover 99% of block | frequency | peptides required to

FIG. 2-32

Species: DENV1 (8-MERS)

| protein | block starting position | block entropy | total peptides in block | peptides required to cover 99% of block | gap/X fraction | 99% of block covered w/<=5 peptides? | block to cover 99% of block | frequency | block to cover 99% of block | frequency | block to cover 99% of block | frequency | block to cover 99% of

FIG. 2-33

Species: DENV1 (8-MERS)

| protein | block starting position | block entropy | total peptides in block | peptides required to cover 99% of block | gap/X fraction | 99% of block covered w/ =< 5 peptides? | block | frequency | block | frequency | block | frequency | block | frequency |
|---|---|---|---|---|---|---|---|---|---|---|---|---|---|---|
| NS1 | 874 | 0.25 | 10 | 4 | 0.08 | Y | QGKKMIRP | 97.19 | QGKKTIRP | 1.08 | QGKKMIRP | 0.41 | QGKKMVRP | 0.41 | | |
| NS1 | 875 | 0.25 | 10 | 4 | 0.08 | Y | GKKMIRPQ | 97.19 | GKKTIRPQ | 1.08 | GKKMIRPQ | 0.41 | GKKMVRPQ | 0.41 | | |
| NS1 | 876 | 0.25 | 10 | 4 | 0 | Y | KKMIRPQP | 97.27 | KKTIRPQP | 1.08 | KKMVRPQP | 0.41 | RKMIRPQP | 0.41 | | |
| NS1 | 877 | 0.21 | 8 | 3 | 0 | Y | KMIRPQPM | 97.68 | KTIRPQPM | 1.08 | KMVRPQPM | 0.41 | | | | |
| NS1 | 878 | 0.21 | 8 | 3 | 0 | Y | MIRPQPME | 97.68 | TIRPQPME | 1.08 | MVRPQPME | 0.41 | | | | |
| NS1 | 879 | 1.07 | 6 | 2 | 0 | Y | IRPQPMEY | 52.77 | IRPQPMEH | 46.48 | | | | | | |
| NS1 | 880 | 1.16 | 6 | 3 | 0 | Y | RPQPMEYK | 52.77 | RPQPMEHK | 44.67 | RPQPMEHR | 2.23 | | | | |
| NS1 | 881 | 1.15 | 6 | 3 | 0 | Y | PQPMEYKY | 52.69 | PQPMEHKY | 44.83 | PQPMEHRY | 2.23 | | | | |
| NS1 | 882 | 1.15 | 6 | 3 | 0 | Y | QPMEYKYS | 52.69 | QPMEHKYS | 44.83 | QPMEHRYS | 2.23 | | | | |
| NS1 | 883 | 1.15 | 6 | 3 | 0 | Y | PMEYKYSW | 52.69 | PMEHKYSW | 44.83 | PMEHRYSW | 2.23 | | | | |
| NS1 | 884 | 1.21 | 6 | 3 | 0 | Y | MEYKYSWK | 51.94 | MEHKYSWK | 44.83 | MEHRYSWK | 2.23 | | | | |
| NS1 | 885 | 1.29 | 7 | 5 | 0 | Y | EYKYSWKS | 51.12 | EHKYSWKS | 44.67 | EHRYSWKS | 2.23 | EYKYSWKI | 0.74 | EYKYSWRS | 0.74 |
| NS1 | 886 | 1.29 | 10 | 5 | 0 | Y | YKYSWKSW | 51.12 | HKYSWKSW | 44.67 | HRYSWKSW | 2.23 | YKYSWRSW | 0.74 | YKYSWKIW | 0.74 |
| NS1 | 887 | 0.33 | 10 | 4 | 0 | Y | KYSWKSWG | 95.78 | RYSWKSWG | 2.23 | KYSWRSWG | 0.74 | KYSWKIWG | 0.74 | | |
| NS1 | 888 | 0.19 | 7 | 3 | 0 | Y | YSWKSWGK | 97.93 | YSWKIWGK | 0.74 | YSWRSWGK | 0.74 | | | | |
| NS1 | 889 | 0.17 | 7 | 3 | 0 | Y | SWKSWGKA | 98.1 | SWKIWGKA | 0.74 | SWRSWGKA | 0.74 | | | | |
| NS1 | 890 | 0.18 | 6 | 3 | 0 | Y | WKSWGKAK | 98.01 | WKIWGKAK | 0.74 | WRSWGKAK | 0.74 | | | | |
| NS1 | 891 | 0.22 | 7 | 3 | 0 | Y | KSWGKAKI | 97.68 | KIWGKAKI | 0.74 | RSWGKAKI | 0.74 | | | | |
| NS1 | 892 | 0.17 | 9 | 3 | 0 | Y | SWGKAKII | 98.26 | IWGKAKII | 0.74 | | | | | | |
| NS1 | 893 | 0.09 | 9 | 2 | 0 | Y | WGKAKIIG | 99.17 | | | | | | | | |
| NS1 | 894 | 0.09 | 8 | 1 | 0 | Y | GKAKIIGA | 99.17 | | | | | | | | |
| NS1 | 895 | 0.09 | 8 | 1 | 0 | Y | KAKIIGAD | 99.17 | | | | | | | | |
| NS1 | 896 | 1.16 | 8 | 4 | 0 | Y | AKIIGADV | 72.95 | AKIIGADI | 19.69 | AKIIGADA | 5.79 | AKIIGADT | 0.83 | | |
| NS1 | 897 | 1.17 | 11 | 4 | 0 | Y | KIIGADVQ | 72.95 | KIIGADIQ | 19.6 | KIIGADAQ | 5.79 | KIIGADTQ | 0.83 | | |
| NS1 | 898 | 1.16 | 11 | 4 | 0 | Y | IIGADVQN | 73.04 | IIGADIQN | 19.6 | IIGADAQN | 5.79 | IIGADTQN | 0.83 | | |
| NS1 | 904 | 0.46 | 6 | 3 | 0 | Y | QNTTFIID | 92.89 | QNSTFIID | 4.71 | QNATFIID | 1.99 | | | | |

FIG. 2-34

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency | block | frequency |
|---|---|---|---|---|---|---|---|---|---|---|---|---|---|---|---|---|
| NS1 | 905 | 0.45 | 5 | 3 | 0 | Y | NTTFIIDG | 92.97 | NSTFIIDG | 4.71 | NATFIIDG | 1.99 | | | | |
| NS1 | 906 | 0.46 | 6 | 3 | 0 | Y | TTFIIDGP | 92.89 | STFIIDGP | 4.71 | ATFIIDGP | 1.99 | | | | |
| NS1 | 907 | 0.77 | 5 | 2 | 0 | Y | TFIIDGPN | 78.99 | TFIIDGPD | 20.68 | | | | | | |
| NS1 | 908 | 0.77 | 5 | 2 | 0 | Y | FIIDGPNT | 78.99 | FIIDGPDT | 20.68 | | | | | | |
| NS1 | 909 | 0.81 | 8 | 2 | 0 | Y | IIDGPNTP | 78.66 | IIDGPDTP | 20.6 | | | | | | |
| NS1 | 910 | 0.81 | 8 | 2 | 0 | Y | IDGPNTPE | 78.66 | IDGPDTPE | 20.6 | | | | | | |
| NS1 | 911 | 0.81 | 8 | 2 | 0 | Y | DGPNTPEC | 78.66 | DGPDTPEC | 20.6 | | | | | | |
| NS1 | 912 | 0.86 | 10 | 3 | 0 | Y | GPNTPECP | 78.33 | GPDTPECP | 20.43 | GPNTPECS | 0.33 | | | | |
| NS1 | 913 | 0.89 | 12 | 5 | 0 | Y | PNTPECPD | 78.16 | PDTPECPD | 20.18 | PNTPECSD | 0.33 | PDTPECPN | 0.25 | PNTPECPN | 0.17 |
| NS1 | 917 | 0.94 | 11 | 5 | 0 | Y | ECPDDQRA | 82.96 | ECPDNQRA | 9.93 | ECPDGQRA | 5.05 | ECPDEQRA | 0.83 | ECSDDQRA | 0.5 |
| NS1 | 918 | 0.94 | 11 | 5 | 0 | Y | CPDDQRAW | 82.96 | CPDNQRAW | 9.93 | CPDGQRAW | 5.05 | CPDEQRAW | 0.83 | CSDDQRAW | 0.5 |
| NS1 | 919 | 0.94 | 11 | 5 | 0 | Y | PDDQRAWN | 82.96 | PDNQRAWN | 9.93 | PDGQRAWN | 5.05 | PDEQRAWN | 0.83 | SDDQRAWN | 0.5 |
| NS1 | 920 | 0.9 | 9 | 4 | 0 | Y | DDQRAWNI | 83.37 | DNQRAWNI | 9.93 | DGQRAWNI | 5.05 | DEQRAWNI | 0.83 | | |
| NS1 | 921 | 0.88 | 5 | 4 | 0 | Y | DQRAWNIW | 83.54 | NQRAWNIW | 9.93 | GQRAWNIW | 5.05 | EQRAWNIW | 1.08 | | |
| NS1 | 922 | 0.04 | 4 | 1 | 0 | Y | QRAWNIWE | 99.67 | | | | | | | | |
| NS1 | 923 | 0.03 | 4 | 1 | 0 | Y | RAWNIWEV | 99.75 | | | | | | | | |
| NS1 | 924 | 0.03 | 4 | 1 | 0 | Y | AWNIWEVE | 99.75 | | | | | | | | |
| NS1 | 925 | 0.03 | 4 | 1 | 0 | Y | WNIWEVED | 99.75 | | | | | | | | |
| NS1 | 926 | 0.03 | 4 | 1 | 0 | Y | NIWEVEDY | 99.75 | | | | | | | | |
| NS1 | 927 | 0.03 | 3 | 1 | 0 | Y | IWEVEDYG | 99.75 | | | | | | | | |
| NS1 | 928 | 0.02 | 2 | 1 | 0 | Y | WEVEDYGF | 99.83 | | | | | | | | |
| NS1 | 929 | 0.01 | 5 | 1 | 0 | Y | EVEDYGFG | 99.92 | | | | | | | | |
| NS1 | 930 | 0.14 | 5 | 2 | 0 | Y | VEDYGFGI | 98.26 | VEDYGFGV | 1.49 | | | | | | |
| NS1 | 931 | 0.14 | 6 | 2 | 0 | Y | EDYGFGIF | 98.26 | EDYGFGVF | 1.49 | | | | | | |
| NS1 | 932 | 0.16 | 6 | 2 | 0 | Y | DYGFGIFT | 98.1 | DYGFGVFT | 1.49 | | | | | | |
| NS1 | 933 | 0.16 | 6 | 2 | 0 | Y | YGFGIFTT | 98.1 | YGFGVFTT | 1.49 | | | | | | |

FIG. 2-35

Species: DENV1 (8-MERS)

| protein | block starting position | block entropy | total peptides in block | peptides required to cover 99% of block | gap/X fraction | 99% of block covered w/ <=5 peptides? | block to cover 99% of | frequency | block

FIG. 2-36

Species: DENV1 (8-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to

FIG. 2-37

Species: DENV1 (8-MERS)

| protein | block starting position | block entropy | total peptides in block | peptides required to cover 99% of block | gap/X fraction | 99% of block covered w/ =>/ 5 peptides? | block | frequency | block | frequency | block | frequ

FIG. 2-38

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency |
|---|---|---|---|---|---|---|---|---|---|---|---|---|---|---|
| NS1 | 1013 | 0.14 | 3 | 2 | 0 | Y | ESEMIIPK | 98.26 | ESEMIIPK | 1.49 | | | | |
| NS1 | 1014 | 0.27 | 6 | 3 | 0 | Y | SEMIIPKI | 96.69 | SEMIIPKI | 1.49 | SEMIIPKM | 0.99 | | |
| NS1 | 1015 | 0.4 | 6 | 4 | 0 | Y | EMIIPKIY | 95.04 | EMIIPKIH | 1.65 | EMVIPKIY | 1.49 | EMIIPKMY | 0.99 |
| NS1 | 1016 | 0.4 | 8 | 4 | 0 | Y | MIIPKIYG | 95.04 | MIIPKIHG | 1.65 | MVIPKIYG | 1.49 | MIIPKMYG | 0.99 |
| NS1 | 1017 | 0.4 | 8 | 4 | 0 | Y | IIPKIYGG | 95.04 | IIPKIHGG | 1.65 | VIPKIYGG | 1.49 | IIPKMYGG | 0.99 |
| NS1 | 1018 | 0.29 | 8 | 3 | 0 | Y | IPKIYGGP | 96.53 | IPKIHGGP | 1.65 | IPKMYGGP | 0.99 | | |
| NS1 | 1019 | 0.41 | 7 | 5 | 0 | Y | PKIYGGPI | 95.12 | PKIHGGPI | 1.65 | PKIYGGPT | 0.99 | PKMYGGPI | 0.83 | PKIYGGPM | 0.58 |
| NS1 | 1020 | 0.41 | 12 | 5 | 0 | Y | KIYGGPIS | 95.12 | KIHGGPIS | 1.65 | KIYGGPTS | 0.99 | KMYGGPIS | 0.83 | KIYGGPMS | 0.58 |
| NS1 | 1021 | 0.41 | 12 | 5 | 0 | Y | IYGGPISQ | 95.12 | IHGGPISQ | 1.65 | IYGGPTSQ | 0.99 | MYGGPISQ | 0.83 | IYGGPMSQ | 0.58 |
| NS1 | 1022 | 0.29 | 12 | 3 | 0 | Y | YGGPISQH | 96.36 | HGGPISQH | 1.65 | YGGPTSQH | 1.08 | | |
| NS1 | 1023 | 0.17 | 6 | 2 | 0 | Y | GGPISQHN | 98.01 | GGPTSQHN | 1.08 | GPISQHNH | 0.91 | | |
| NS1 | 1024 | 0.24 | 5 | 3 | 0 | Y | GPISQHNY | 97.11 | GPTSQHNY | 1.08 | PISQHNHR | 0.91 | | |
| NS1 | 1025 | 0.24 | 5 | 3 | 0 | Y | PISQHNYR | 97.11 | PTSQHNYR | 1.08 | ISQHNHRP | 0.91 | | |
| NS1 | 1026 | 0.25 | 5 | 3 | 0 | Y | ISQHNYRP | 97.02 | TSQHNYRP | 1.08 | | | | |
| NS1 | 1027 | 0.08 | 6 | 1 | 0 | Y | SQHNYRPG | 99.01 | | | | | | |
| NS1 | 1028 | 0.08 | 3 | 1 | 0 | Y | QHNYRPGY | 99.01 | | | | | | |
| NS1 | 1029 | 0.15 | 3 | 2 | 0 | Y | HNYRPGYF | 98.35 | HNHRPGYF | 0.91 | | | | |
| NS1 | 1030 | 0.15 | 7 | 2 | 0 | Y | NYRPGYFT | 98.35 | NHRPGYFT | 0.91 | | | | |
| NS1 | 1031 | 0.15 | 7 | 2 | 0 | Y | YRPGYFTQ | 98.35 | HRPGYFTQ | 0.91 | | | | |
| NS1 | 1032 | 0.39 | 7 | 2 | 0 | Y | RPGYFTQT | 94.04 | RPGYFTQA | 4.96 | | | | |
| NS1 | 1033 | 0.39 | 8 | 2 | 0 | Y | PGYFTQTA | 94.04 | PGYFTQAA | 4.96 | | | | |
| NS1 | 1034 | 0.38 | 8 | 2 | 0 | Y | GYFTQTAG | 94.13 | GYFTQAAG | 4.96 | | | | |
| NS1 | 1035 | 0.38 | 7 | 2 | 0 | Y | YFTQTAGP | 94.13 | YFTQAAGP | 4.96 | | | | |
| NS1 | 1036 | 0.38 | 7 | 2 | 0 | Y | FTQTAGPW | 94.13 | FTQAAGPW | 4.96 | | | | |
| NS1 | 1037 | 0.31 | 3 | 2 | 0 | Y | TQTAGPWH | 94.79 | TQAAGPWH | 4.96 | | | | |
| NS1 | 1038 | 0.31 | 3 | 2 | 0 | Y | QTAGPWHL | 94.79 | QAAGPWHL | 4.96 | | | | |

FIG. 2-39

Species: DENV1 (8-MERS)

| protein | block starting position | block entropy | total peptides in block | peptides required to cover 99% of block | gap/X fraction | 99% of block covered w/ <=5 peptides? | block (to cover 99% of) | frequency | block (to cover 99% of) | frequency | block (to cover 99% of) | frequency | block (to cover 99% of) | frequency |
|---|---|---|---|---|---|---|---|---|---|---|---|---|---|---|
| NS1 | 1039 | 0.32 | 4 | 2 | 0 | Y | TAGPWHLG | 94.71 | AAGPWHLG | 4.96 | | | | |
| NS1 | 1040 | 0.02 | 3 | 1 | 0 | Y | AGPWHLGK | 99.83 | | | | | | |
| NS1 | 1041 | 0.02 | 3 | 1 | 0 | Y | GPWHLGKL | 99.83 | | | | | | |
| NS1 | 1042 | 0.02 | 3 | 1 | 0 | Y | PWHLGKLE | 99.83 | | | | | | |
| NS1 | 1043 | 0.03 | 4 | 1 | 0 | Y | WHLGKLEL | 99.75 | | | | | | |
| NS1 | 1044 | 0.03 | 4 | 1 | 0 | Y | HLGKLELD | 99.75 | | | | | | |
| NS1 | 1045 | 0.03 | 4 | 1 | 0 | Y | LGKLELDF | 99.75 | | | | | | |
| NS1 | 1046 | 0.2 | 7 | 2 | 0 | Y | GKLELDFD | 97.6 | GKLELDFN | 1.74 | | | | |
| NS1 | 1047 | 0.27 | 8 | 3 | 0 | Y | KLELDFDL | 96.69 | KLELDFNL | 1.74 | KLELDFDF | 0.91 | | |
| NS1 | 1048 | 0.26 | 7 | 3 | 0 | Y | LELDFDLC | 96.77 | LELDFNLC | 1.74 | LELDFDFC | 0.91 | | |
| NS1 | 1049 | 0.26 | 7 | 3 | 0 | Y | ELDFDLCE | 96.77 | ELDFNLCE | 1.74 | ELDFDFCE | 0.91 | | |
| NS1 | 1050 | 0.26 | 7 | 3 | 0 | Y | LDFDLCEG | 96.77 | LDFNLCEG | 1.74 | LDFDFCEG | 0.91 | | |
| NS1 | 1051 | 0.26 | 6 | 3 | 0 | Y | DFDLCEGT | 96.77 | DFNLCEGT | 1.74 | DFDFCEGT | 0.99 | | |
| NS1 | 1052 | 0.26 | 6 | 3 | 0 | Y | FDLCEGTT | 96.77 | FNLCEGTT | 1.74 | FDFCEGTT | 0.99 | | |
| NS1 | 1053 | 0.26 | 6 | 3 | 0 | Y | DLCEGTTV | 96.77 | NLCEGTTV | 1.74 | DFCEGTTV | 0.99 | | |
| NS1 | 1054 | 0.12 | 4 | 2 | 0 | Y | LCEGTTVV | 98.59 | FCEGTTVV | 0.99 | | | | |
| NS1 | 1055 | 0.03 | 2 | 1 | 0 | Y | CEGTTVVV | 99.67 | | | | | | |
| NS1 | 1056 | 0.04 | 3 | 1 | 0 | Y | EGTTVVVD | 99.59 | | | | | | |
| NS1 | 1057 | 0.07 | 5 | 1 | 0 | Y | GTTVVVDE | 99.34 | | | | | | |
| NS1 | 1058 | 0.1 | 7 | 1 | 0 | Y | TTVVVDEH | 99.09 | | | | | | |
| NS1 | 1059 | 0.1 | 7 | 1 | 0 | Y | TVVVDEHC | 99.09 | | | | | | |
| NS1 | 1060 | 0.1 | 7 | 1 | 0 | Y | VVVDEHCG | 99.09 | | | | | | |
| NS1 | 1061 | 0.23 | 9 | 3 | 0 | Y | VVDEHCGN | 97.44 | VVDEHCGY | 0.83 | VVDEHCGS | 0.83 | | |
| NS1 | 1062 | 0.2 | 8 | 3 | 0 | Y | VDEHCGNR | 97.77 | VDEHCGYR | 0.83 | VDEHCGSR | 0.83 | | |
| NS1 | 1063 | 0.2 | 8 | 3 | 0 | Y | DEHCGNRG | 97.77 | DEHCGYRG | 0.83 | DEHCGSRG | 0.83 | | |
| NS1 | 1064 | 0.22 | 9 | 3 | 0 | Y | EHCGNRGP | 97.6 | EHCGYRGP | 0.83 | EHCGSRGP | 0.83 | | |

FIG. 2-40

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 1065 | 0.19 | 7 | 3 | 0 | Y | HCGNRGPS | 97.85 | HCGSRGPS | 0

FIG. 2-41

Species: DENV1 (8-MERS)

| protein | block starting position | block entropy | total peptides in block | peptides required to cover 99% of block | gap/X fraction | 99% of block covered w/<=5 peptides? | block to cover 99% of |

FIG. 2-42

Species: DENV1 (8-MERS)

| protein | block starting position | block entropy | total peptides in block | peptides required to cover 99% of block | gap/X fraction | 99% of block covered w/ =/< 5 peptides? | block | frequency | block | frequency | block | frequency | block | frequency | block | frequency |
|---|---|---|---|---|---|---|---|---|---|---|---|---|---|---|---|---|
| NS1 | 1117 | 0.77 | 5 | 2 | 0 | Y | EENLVKSM | 79.24 | E

FIG. 2-43

Species: DENV1 (8-MERS)

| protein | block starting position | block entropy | total peptides in block | peptides required to cover 99% of block | gap/X fraction | 99% of block covered w/ <= 5 peptides? | block to cover 99% | frequency | block to cover 99% | frequency | block to cover 99% | frequency | block to cover 99% | frequency |
|---|---|---|---|---|---|---|---|---|---|---|---|---|---|---|
| NS2A | 1148 | 0.03 | 3 | 1 | 0 | Y | EVMRSRWS | 99.75 | | | | | | |
| NS2A | 1149 | 0.14 | 5 | 2 | 0 | Y | VMRSRWSR | 98.35 | VMRSRWSK | 1.32 | | | | |
| NS2A | 1150 | 0.43 | 6 | 3 | 0 | Y | MRSRWSRK | 93.3 | MRSRWSRR | 5.05 | MRSRWSKK | 1.32 | | | |
| NS2A | 1151 | 0.44 | 7 | 3 | 0 | Y | RSRWSRKM | 93.22 | RSRWSRRM | 5.05 | RSRWSKKM | 1.32 | | | |
| NS2A | 1152 | 0.44 | 7 | 3 | 0 | Y | SRWSRKML | 93.22 | SRWSRRML | 5.05 | SRWSKKML | 1.32 | | | |
| NS2A | 1153 | 0.45 | 9 | 3 | 0 | Y | RWSRKMLM | 93.05 | RWSRRMLM | 5.05 | RWSKKMLM | 1.32 | | | |
| NS2A | 1154 | 0.49 | 10 | 3 | 0 | Y | WSRKMLMT | 92.64 | WSRRMLMT | 5.05 | WSKKMLMT | 1.32 | | | |
| NS2A | 1155 | 0.49 | 10 | 3 | 0 | Y | SRKMLMTG | 92.64 | SRRMLMTG | 5.05 | SKKMLMTG | 1.32 | | | |
| NS2A | 1156 | 0.55 | 12 | 5 | 0 | Y | RKMLMTGT | 92.06 | RRMLMTGT | 5.05 | KKMLMTGT | 1.32 | RKMLMTGI | 0.5 | RKMLMAGT | 0.33 |
| NS2A | 1157 | 0.44 | 10 | 3 | 0 | Y | KMLMTGTL | 93.47 | RMLMTGTL | 5.05 | KMLMTGIL | 0.5 | | | |
| NS2A | 1158 | 0.26 | 10 | 3 | 0 | Y | MLMTGTLA | 97.11 | MLMTGTLV | 1.41 | MLMTGILA | 0.5 | | | |
| NS2A | 1159 | 0.26 | 10 | 3 | 0 | Y | LMTGTLAV | 97.11 | LMTGTLW | 1.41 | LMTGILAV | 0.5 | | | |
| NS2A | 1160 | 0.3 | 12 | 5 | 0 | Y | MTGTLAVF | 96.61 | MTGTLWF | 1.41 | MTGILAVF | 0.5 | MTGTLAVL | 0.41 | MAGTLAVF | 0.41 |
| NS2A | 1162 | 1.21 | 13 | 5 | 0 | Y | GTLAVFFL | 57.98 | GTLWFLL | 39.12 | GTLVFLL | 1.24 | GILAVFFL | 0.5 | GTLAVLFL | 0.5 |
| NS2A | 1163 | 1.21 | 13 | 5 | 0 | Y | TLAVFFLL | 57.98 | TLWFLLL | 39.12 | TLWFLLL | 1.24 | ILAVFFLL | 0.5 | TLAVLFLL | 0.41 |
| NS2A | 1173 | 0.18 | 6 | 2 | 0 | Y | GQLTWNDL | 98.01 | GQLTWSDL | 1.08 | QLTWNDLT | 0.99 | TWNDLTRL | 0.99 | |
| NS2A | 1174 | 0.26 | 7 | 3 | 0 | Y | QLTWNDLI | 97.02 | QLTWSDLI | 1.08 | LTWNDLTR | 0.99 | WNDLTRLC | 0.99 | |
| NS2A | 1175 | 0.26 | 7 | 3 | 0 | Y | LTWNDLIR | 97.02 | LTWSDLIR | 1.08 | TWSDLIRL | 1.08 | NDLTRLCI | 0.99 | |
| NS2A | 1176 | 0.39 | 8 | 4 | 0 | Y | TWNDLIRL | 95.04 | TWNDLIRS | 2.07 | TWSDLIRL | 1.08 | | | |
| NS2A | 1177 | 0.38 | 7 | 4 | 0 | Y | WNDLIRLC | 95.12 | WNDLIRSC | 2.07 | WSDLIRLC | 1.08 | | | |
| NS2A | 1178 | 0.38 | 5 | 4 | 0 | Y | NDLIRLCI | 95.12 | NDLIRSCI | 2.07 | SDLIRLCI | 0.99 | | | |
| NS2A | 1179 | 0.25 | 6 | 3 | 0 | Y | DLIRLCIM | 96.69 | DLIRSCIM | 2.07 | DLTRLCIM | 0.99 | | | |
| NS2A | 1180 | 0.26 | 6 | 3 | 0 | Y | LIRLCIMV | 96.61 | LIRSCIMV | 2.07 | LTRLCIM | 0.99 | | | |
| NS2A | 1181 | 0.26 | 5 | 3 | 0 | Y | IRLCIMVG | 96.61 | IRSCIMVG | 2.07 | TRLCIMVG | 0.99 | | | |
| NS2A | 1182 | 0.18 | 5 | 2 | 0 | Y | RLCIMVGA | 97.6 | RSCIMVGA | 2.07 | | | | | |
| NS2A | 1183 | 0.19 | 6 | 2 | 0 | Y | LCIMVGAN | 97.52 | SCIMVGAN | 2.07 | | | | | |

FIG. 2-44

Species: DENV1 (8-MERS)

| protein | block starting position | block entropy | total peptides in block | peptides required to cover 99% of block | gap/X fraction | 99% of block covered w/ =<5 peptides? | block to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1184 | 0.1 | 6 | 2 | 0 | Y | CIMVGANA | 98.92 | CIMVGANV | 0.66 | | | | |
| NS2A | 1185 | 0.24 | 9 | 3 | 0 | Y | IMVGANAS | 97.11 | IMVGANAF | 1.65 | IMVGANVS | 0.66 | | |
| NS2A | 1186 | 0.24 | 9 | 3 | 0 | Y | MVGANASD | 97.11 | MVGANAFD | 1.65 | MVGANVSD | 0.66 | | |
| NS2A | 1187 | 0.61 | 13 | 5 | 0 | Y | VGANASDR | 91.81 | VGANASDK | 3.56 | VGANAFDR | 1.65 | VGANASDN | 1.32 | VGANVSDR | 0.66 |
| NS2A | 1188 | 0.6 | 12 | 5 | 0 | Y | GANASDRM | 91.89 | GANASDKM | 3.56 | GANAFDRM | 1.65 | GANASDNM | 1.32 | GANVSDRM | 0.66 |
| NS2A | 1189 | 0.6 | 12 | 5 | 0 | Y | ANASDRMG | 91.89 | ANASDKMG | 3.56 | ANAFDRMG | 1.65 | ANASDNMG | 1.32 | ANVSDRMG | 0.66 |
| NS2A | 1190 | 0.61 | 13 | 5 | 0 | Y | NASDRMGM | 91.81 | NASDKMGM | 3.56 | NAFDRMGM | 1.65 | NASDNMGM | 1.32 | NVSDRMGM | 0.66 |
| NS2A | 1191 | 0.6 | 12 | 5 | 0 | Y | ASDRMGMG | 91.89 | ASDKMGMG | 3.56 | AFDRMGMG | 1.65 | ASDNMGMG | 1.32 | VSDRMGMG | 0.66 |
| NS2A | 1192 | 0.63 | 12 | 5 | 0 | Y | SDRMGMGT | 91.48 | SDKMGMGT | 3.56 | FDRMGMGT | 1.65 | SDNMGMGT | 1.32 | SDRMGMGM | 1.08 |
| NS2A | 1193 | 0.5 | 10 | 4 | 0 | Y | DRMGMGTT | 93.22 | DKMGMGTT | 3.56 | DNMGMGTT | 1.32 | DRMGMGMT | 1.08 | |
| NS2A | 1194 | 0.53 | 11 | 5 | 0 | Y | RMGMGTTY | 92.89 | KMGMGTTY | 3.56 | NMGMGTTY | 1.32 | RMGMGMTY | 1.08 | RMGMGTTH | 0.33 |
| NS2A | 1195 | 0.16 | 7 | 2 | 0 | Y | MGMGTTYL | 98.18 | MGMGMTYL | 1.08 | | | | |
| NS2A | 1196 | 0.17 | 8 | 2 | 0 | Y | GMGTTYLA | 98.1 | GMGMTYLA | 1.08 | | | | |
| NS2A | 1197 | 0.17 | 8 | 2 | 0 | Y | MGTTYLAL | 98.1 | MGMTYLAL | 1.08 | | | | |
| NS2A | 1198 | 0.19 | 8 | 2 | 0 | Y | GTTYLALM | 97.93 | GMTYLALM | 1.08 | | | | |
| NS2A | 1199 | 0.2 | 9 | 3 | 0 | Y | TTYLALMA | 97.85 | MTYLALMA | 1.08 | TTHLALMA | 0.33 | | |
| NS2A | 1200 | 0.1 | 7 | 1 | 0 | Y | TYLALMAT | 99.09 | | | | | | |
| NS2A | 1201 | 0.1 | 7 | 1 | 0 | Y | YLALMATF | 99.09 | | | | | | |
| NS2A | 1202 | 0.26 | 8 | 2 | 0 | Y | LALMATFK | 96.28 | LALMATFR | 3.14 | | | | |
| NS2A | 1203 | 0.32 | 8 | 3 | 0 | Y | ALMATFKM | 95.62 | ALMATFRM | 3.14 | ALMATFKI | 0.66 | | |
| NS2A | 1204 | 0.31 | 7 | 3 | 0 | Y | LMATFKMR | 95.7 | LMATFRMR | 3.14 | LMATFKIR | 0.66 | | |
| NS2A | 1205 | 0.31 | 7 | 3 | 0 | Y | MATFKMRP | 95.7 | MATFRMRP | 3.14 | MATFKIRP | 0.66 | | |
| NS2A | 1206 | 0.29 | 6 | 2 | 0 | Y | ATFKMRPM | 95.95 | ATFRMRPM | 3.14 | | | | |
| NS2A | 1207 | 0.4 | 7 | 4 | 0 | Y | TFKMRPMF | 94.54 | TFRMRPMF | 3.14 | TFKMRPML | 1.24 | TFKIRPMF | 0.66 | |
| NS2A | 1208 | 0.4 | 7 | 4 | 0 | Y | FKMRPMFA | 94.54 | FRMRPMFA | 3.14 | FKMRPMLA | 1.24 | FKIRPMFA | 0.66 | |
| NS2A | 1209 | 0.42 | 8 | 4 | 0 | Y | KMRPMFAV | 94.38 | RMRPMFAV | 3.14 | KMRPMLAV | 1.24 | KIRPMFAV | 0.66 | |

FIG. 2-45

Species: DENV1 (8-MERS)

| protein | block starting position | block

FIG. 2-46

Species: DENV1 (8-MERS)

| protein | block starting position | block entropy | total peptides in block | peptides required to cover 99% of block | gap/X fraction | 99% of block covered w/ <=5 peptides? | block (99% cover) | frequency | block (99% cover) | frequency | block (99% cover) | frequency | block (99% cover) | frequency | block (99% cover) | frequency |
|---|---|---|---|---|---|---|---|---|---|---|---|---|---|---|---|---|
| NS2A | 1236 | 0.17 | 13 | 4 | 0 | Y | SLVASVEL | 98.43 | SLVASVEL | 0.33 | SLVASVEI | 0.17 | SLMASMEL | 0.17 | | |
| NS2A | 1237 | 0.17 | 13 | 4 | 0 | Y | LVASVELP | 98.43 | LVAFVELP | 0.33 | LVASAELP | 0.17 | LVACVELP | 0.17 | | |
| NS2A | 1239 | 0.27 | 14 | 5 | 0 | Y | ASVELPNS |

FIG. 2-47

Species: DENV1 (8-MERS)

| protein | block starting position | block entropy | total peptides in block | peptides required to cover 99% of block | gap/X fraction | 99% of block covered w/<=5 peptides? | block | frequency | block | frequency | block | frequency | block | frequency | block | frequency |
|---|---|---|---|---|---|---|---|---|---|---|---|---|---|---|---|---|
| NS2A | 1263 | 1.13 | 9 | 4 | 0 | Y | LLTDFQSH | 74.77 | LLTEFQPH | 18.44 | LLTDFQSY | 4.3 | LLTDFQPH | 1.82 | | |
| NS2A | 1264 | 1.13 | 9 | 4 | 0 | Y | LTDFQSHQ | 74.77 | LTEFQPHQ | 18.36 | LTDFQSYQ | 4.3 | LTDFQPHQ | 1.82 | | |
| NS2A | 1265 | 1.13 | 10 | 4 | 0 | Y | TDFQSHQL | 74.77 | TEFQPHQL | 18.36 | TDFQSYQL | 4.3 | TDFQPHQL | 1.82 | | |
| NS2A | 1266 | 1.11 | 10 | 4 | 0 | Y | DFQSHQLW | 75.02 | EFQPHQLW | 18.36 | DFQSYQLW | 4.3 | DFQPHQLW | 1.82 | | |
| NS2A | 1271 | 1.01 | 9 | 5 | 0 | Y | QLWATLLS | 77.09 | QLWTLLS | 19.11 | QLWAALLS | 4.3 | QLWTLLS | 1.16 | QLWTLLS | 0.99 |
| NS2A | 1275 | 0.67 | 11 | 4 | 0 | Y | TLLSLTFI | 88.42 | TLLSLTFV | 9.02 | ALLSLTFI | 1.08 | TLLSFTFI | 0.5 | | |
| NS2A | 1276 | 0.83 | 13 | 5 | 0 | Y | LLSLTFIK | 85.86 | LLSLTFVK | 8.52 | LLSLTFIR | 3.64 | LLSFTFIK | 0.5 | LLSFTFIK | 0.5 |
| NS2A | 1277 | 0.83 | 13 | 5 | 0 | Y | LSLTFIKT | 85.86 | LSLTFVKT | 8.52 | LSLTFIRT | 3.64 | LSFTFIKT | 0.5 | LSLTFVRT | 0.5 |
| NS2A | 1287 | 0.99 | 8 | 5 | 0 | Y | SLHYAWKT | 77.75 | SLDYAWKT | 18.2 | SLDYAWRT | 2.23 | SYHYAWKT | 2.23 | SLHCAWKT | 0.66 |
| NS2A | 1289 | 1.08 | 11 | 5 | 0 | Y | HYAWKTMA | 78.33 | DYAWKTMA | 15.22 | DYAWRTMA | 2.65 | DYAWRTMA | 2.23 | HCAWKTMA | 0.74 |
| NS2A | 1290 | 0.92 | 11 | 4 | 0 | Y | YAWKTMAM | 80.98 | YAWKTMAM | 15.14 | YAWRTMAM | 2.23 | CAWKTMAM | 0.74 | | |
| NS2A | 1296 | 0.99 | 11 | 5 | 0 | Y | AMVLSVVS | 82.55 | AMALSVVS | 9.76 | AMILSVVS | 4.22 | AMYLSIAS | 1.32 | AMVLSVVS | 1.32 |
| NS2A | 1297 | 0.99 | 7 | 5 | 0 | Y | MVLSVVSL | 82.55 | MALSVVSL | 9.76 | MILSVVSL | 4.22 | MVLSIASL | 1.32 | MVLSVVSL | 1.32 |
| NS2A | 1299 | 0.6 | 8 | 5 | 0 | Y | LSVVSLFP | 91.32 | LSVVSLLP | 4.47 | LSIASLFP | 1.32 | LSVVSLFP | 1.32 | LSVVSLIP | 1.08 |
| NS2A | 1300 | 0.61 | 8 | 5 | 0 | Y | SVVSLFPL | 91.23 | SIVSLLPL | 4.47 | SIASLFPL | 1.32 | SVVSLFPL | 1.32 | SVVSLIPL | 1.08 |
| NS2A | 1301 | 0.61 | 8 | 5 | 0 | Y | VVSLFPLC | 91.23 | VVSLLPLC | 4.47 | VVSLFPLC | 1.32 | IASLFPLC | 1.32 | VVSLIPLC | 1.08 |
| NS2A | 1302 | 0.57 | 7 | 5 | 0 | Y | VSLFPLCL | 91.73 | VSLLPLCL | 4.47 | ASLFPLCL | 1.32 | VSLFPLCL | 1.32 | VSLIPLCL | 1.08 |
| NS2A | 1303 | 0.45 | 7 | 4 | 0 | Y | SLFPLCLS | 93.38 | SLLPLCLS | 4.47 | SLIPLCLS | 1.32 | SLFPLCMS | 1.08 | | |
| NS2A | 1304 | 0.45 | 7 | 4 | 0 | Y | LFPLCLST | 93.38 | LLPLCLST | 4.47 | LIPLCLST | 1.32 | LFPLCMST | 1.08 | | |
| NS2A | 1305 | 0.45 | 7 | 4 | 0 | Y | FPLCLSTT | 93.38 | LPLCLSTT | 4.47 | IPLCLSTT | 1.32 | FPLCMSTT | 1.08 | | |
| NS2A | 1306 | 0.1 | 5 | 2 | 0 | Y | PLCLSTTS | 98.92 | PLCMSTTS | 0.83 | | | | | | |
| NS2A | 1307 | 0.1 | 5 | 2 | 0 | Y | LCLSTTSQ | 98.92 | LCMSTTSQ | 0.83 | | | | | | |
| NS2A | 1308 | 0.09 | 4 | 1 | 0 | Y | CLSTTSQK | 99.01 | | | | | | | | |
| NS2A | 1309 | 0.09 | 4 | 1 | 0 | Y | LSTTSQKT | 99.01 | | | | | | | | |
| NS2A | 1310 | 0.02 | 3 | 1 | 0 | Y | STTSQKTT | 99.83 | | | | | | | | |
| NS2A | 1311 | 0.01 | 2 | 1 | 0 | Y | TTSQKTTW | 99.92 | | | | | | | | |

FIG. 2-48

Species: DENV1 (8-MERS)

| protein | block starting position | block entropy | total peptides in block | peptides required to cover 99% of block | gap/X fraction | 99% of block covered w/<=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1312 | 0.01 | 2 | 1 | 0 | Y | TSQKTTWL | 99.92 | | | | | | |
| NS2A | 1313 | 0.01 | 2 | 1 | 0 | Y | SQKTTWLP | 99.92 | | | | | | |
| NS2A | 1314 | 0.01 | 2 | 1 | 0 | Y | QKTTWLPV | 99.92 | | | | | | |
| NS2A | 1315 | 0.03 | 2 | 1 | 0 | Y | KTTWLPVL | 99.67 | | | | | | |
| NS2A | 1316 | 0.03 | 3 | 1 | 0 | Y | TTWLPVLL | 99.67 | | | | | | |
| NS2A | 1317 | 0.03 | 3 | 1 | 0 | Y | TWLPVLLG | 99.67 | | | | | | |
| NS2A | 1318 | 0.03 | 3 | 1 | 0 | Y | WLPVLLGS | 99.67 | | | | | | |
| NS2A | 1319 | 0.77 | 4 | 2 | 0 | Y | LPVLLGSL | 79.16 | LPVLLGSF | 20.51 | | | | |
| NS2A | 1320 | 0.77 | 4 | 2 | 0 | Y | PVLLGSLG | 79.16 | PVLLGSFG | 20.51 | | | | |
| NS2A | 1321 | 0.77 | 4 | 2 | 0 | Y | VLLGSLGC | 79.16 | VLLGSFGC | 20.51 | | | | |
| NS2A | 1322 | 0.77 | 4 | 2 | 0 | Y | LLGSLGCK | 79.16 | LLGSFGCK | 20.51 | | | | |
| NS2A | 1323 | 0.74 | 3 | 2 | 0 | Y | LGSLGCKP | 79.4 | LGSFGCKP | 20.51 | | | | |
| NS2A | 1324 | 0.75 | 4 | 2 | 0 | Y | GSLGCKPL | 79.4 | GSFGCKPL | 20.43 | | | | |
| NS2A | 1325 | 0.88 | 7 | 3 | 0 | Y | SLGCKPLT | 77.92 | SFGCKPLT | 20.35 | SLGCKPLP | 0.91 | | |
| NS2A | 1326 | 0.88 | 7 | 3 | 0 | Y | LGCKPLTM | 77.92 | FGCKPLTM | 20.35 | LGCKPLPM | 0.91 | | |
| NS2A | 1327 | 0.19 | 8 | 3 | 0 | Y | GCKPLTMF | 97.93 | GCKPLPMF | 0.91 | GCKPLAMF | 0.5 | | |
| NS2A | 1328 | 0.22 | 9 | 3 | 0 | Y | CKPLTMFL | 97.6 | CKPLPMFL | 0.91 | CKPLAMFL | 0.5 | | |
| NS2A | 1329 | 0.22 | 9 | 3 | 0 | Y | KPLTMFLI | 97.6 | KPLPMFLI | 0.91 | KPLAMFLI | 0.5 | | |
| NS2A | 1330 | 1.1 | 13 | 5 | 0 | Y | PLTMFLIA | 69.98 | PLPMFLIT | 27.13 | PLPMFLIT | 0.91 | PLTMFLIV | 0.5 | PLAMFLIA | 0.5 |
| NS2A | 1331 | 1.1 | 13 | 5 | 0 | Y | LTMFLIAE | 69.98 | LPMFLITE | 27.13 | LPMFLITE | 0.91 | LAMFLIAE | 0.5 | LTMFLIVE | 0.5 |
| NS2A | 1336 | 1.1 | 11 | 5 | 0 | Y | IAENKIWG | 70.55 | ITENKIWG | 26.3 | ITETKIWG | 1.16 | ITENEIWG | 0.66 | IVENKIWG | 0.5 |
| NS2A | 1337 | 1.11 | 12 | 5 | 0 | Y | AENKIWGR | 70.47 | TENKIWGR | 26.3 | TETKIWGR | 1.16 | TENEIWGR | 0.66 | VENKIWGR | 0.5 |
| NS2A | 1338 | 1.11 | 11 | 4 | 0 | Y | ENKIWGRK | 69.4 | ENKIWGRR | 27.87 | ETKIWGRK | 1.16 | ENEIWGRK | 0.66 | | |
| NS2A | 1339 | 1.09 | 11 | 4 | 0 | Y | NKIWGRKS | 69.4 | NKIWGRRS | 27.87 | TKIWGRKS | 1.16 | NEWGRKS | 0.66 | | |
| NS2A | 1340 | 1 | 9 | 3 | 0 | Y | KIWGRKSW | 70.55 | KIWGRRSW | 27.87 | EIWGRKSW | 0.83 | | | |
| NS2A | 1341 | 0.9 | 5 | 2 | 0 | Y | IWGRKSWP | 71.63 | IWGRRSWP | 27.96 | | | | | |

FIG. 2-49

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS2A | 1342 | 0.95 | 5 | 3 | 0 | Y | WGRKSWPL | 70.8 | WGRRSWPL | 27.96 | WGRKS

FIG. 2-51

Species: DENV1 (8-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| NS2B | 1394 | 0.15 | 10 | 3 | 0 | Y | ADLSLEKA | 98.59 | ADLLLEKA | 0.33 | ADLSLEKT | 0.25 | | |
| NS2B | 1395 | 0.14 | 9 | 2 | 0 | Y | DLSLEKAA | 98.68 | DLLLEKAA | 0.33 | | | | |
| NS2B | 1396 | 0.3 | 10 | 4 | 0 | Y | LSLEKAAE | 96.53 | LSLEKAAV | 1.32 | LSLEKAAK | 0.91 | LLLEKAAE | 0.33 |
| NS2B | 1397 | 0.32 | 11 | 5 | 0 | Y | SLEKAAEV | 96.36 | SLEKAAKV | 1.32 | SLEKAAVY | 0.91 | LLEKAAEV | 0.33 | SLEKTAEV | 0.25 |
| NS2B | 1398 | 0.29 | 10 | 4 | 0 | Y | LEKAAEVS | 96.69 | LEKAAVVS | 1.32 | LEKAAKVS | 0.91 | LDKAAEVS | 0.25 | | |
| NS2B | 1399 | 0.28 | 9 | 3 | 0 | Y | EKAAEVSW | 96.77 | EKAAVVSW | 1.32 | | | | | | |
| NS2B | 1400 | 0.26 | 8 | 3 | 0 | Y | KAAEVSWE | 97.02 | KAAVVSWE | 1.32 | | | | | | |
| NS2B | 1401 | 0.88 | 13 | 5 | 0 | Y | AAEVSWEE | 82.55 | AAVVSWEE | 13.98 | AAKVSWEE | 0.91 | AAEVSWEK | 0.33 | | |
| NS2B | 1402 | 0.86 | 10 | 4 | 0 | Y | AEVSWEEE | 82.63 | AVVSWEEE | 14.23 | AKVSWEEE | 0.91 | | | | |
| NS2B | 1403 | 0.87 | 11 | 5 | 0 | Y | EVSWEEEA | 82.46 | EVSWEQEA | 14.23 | VVSWEEEA | 1.32 | KVSWEEEA | 0.91 | EVSWEKEA | 0.33 |
| NS2B | 1404 | 0.7 | 9 | 3 | 0 | Y | VSWEEEAE | 84.7 | VSWEQEAE | 14.23 | VSWEKEAE | 0.33 | | | | |
| NS2B | 1405 | 0.68 | 8 | 2 | 0 | Y | SWEEEAEH | 84.86 | SWEQEAEH | 14.23 | | | | | | |
| NS2B | 1406 | 0.68 | 8 | 2 | 0 | Y | WEEEAEHS | 84.86 | WEQEAEHS | 14.23 | | | | | | |
| NS2B | 1407 | 0.68 | 8 | 2 | 0 | Y | EEEAEHSG | 84.86 | EQEAEHSG | 14.23 | | | | | | |
| NS2

FIG. 2-52

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency

FIG. 2-53

Species: DENV1 (8-MERS)

| protein | block starting position | block entropy | total peptides in block | peptides required to cover 99% of block | gap/X fraction | 99% of block covered w/ <= 5 peptides? | block |

FIG. 2-54

Species: DENV1 (8-MERS)

| protein | block starting position | block entropy | total peptides in block | peptides required to cover 99% of block | gap/X fraction | 99% of block covered w/ <= 5 peptides? | block (99%) | frequency | block (99%) | frequ

FIG. 2-55

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency |
|---|---|---|---|---|---|---|---|---|---|---|---|---|---|---|
| NS3 | 1506 | 0.06 | 4 | 1 | 0 | Y | LLGRSQVG | 99.34 | | | | | | |
| NS3 | 1507 | 0.06 | 4 | 1 | 0 | Y | LGRSQVGV | 99.34 | | | | | | |
| NS3 | 1508 | 0.06 | 4 | 1 | 0 | Y | GRSQVGVG | 99.34 | | | | | | |
| NS3 | 1509 | 0.05 | 3 | 1 | 0 | Y | RSQVGVGV | 99.42 | | | | | | |
| NS3 | 1510 | 0.02 | 3 | 1 | 0 | Y | SQVGVGVF | 99.83 | | | | | | |
| NS3 | 1511 | 0.02 | 3 | 1 | 0 | Y | QVGVGVFQ | 99.83 | | | | | | |
| NS3 | 1512 | 0.76 | 6 | 2 | 0 | Y | VGVGVFQE | 79.4 | VGVGVFQD | 20.26 | | | | |
| NS3 | 1513 | 1.01 | 7 | 3 | 0 | Y | GVGVFQEN | 75.1 | GVGVFQDG | 20.26 | GVGVFQEG | 4.3 | | |
| NS3 | 1514 | 1.01 | 7 | 3 | 0 | Y | VGVFQENV | 75.1 | VGVFQDGV | 20.26 | VGVFQEGV | 4.3 | | |
| NS3 | 1515 | 1.01 | 7 | 3 | 0 | Y | GVFQENVF | 75.1 | GVFQDGVF | 20.26 | GVFQEGVF | 4.3 | | |
| NS3 | 1516 | 1.01 | 7 | 3 | 0 | Y | VFQENVFH | 75.1 | VFQDGVFH | 20.26 | VFQEGVFH | 4.3 | | |
| NS3 | 1517 | 1 | 7 | 3 | 0 | Y | FQENVFHT | 75.1 | FQDGVFHT | 20.26 | FQEGVFHT | 4.3 | | |
| NS3 | 1518 | 1 | 6 | 3 | 0 | Y | QENVFHTM | 75.1 | QDGVFHTM | 20.35 | QEGVFHTM | 4.3 | | |
| NS3 | 1519 | 0.82 | 6 | 2 | 0 | Y | ENVFHTMW | 75.1 | DGVFHTMW | 20.35 | EGVFHTMW | 4.3 | | |
| NS3 | 1520 | 0.01 | 3 | 1 | 0 | Y | NVFHTMWH | 75.1 | GVFHTMWH | 24.81 | | | | |
| NS3 | 1521 | 0 | 2 | 1 | 0 | Y | VFHTMWHY | 99.92 | | | | | | |
| NS3 | 1522 | 0 | 1 | 1 | 0 | Y | FHTMWHYT | 100 | | | | | | |
| NS3 | 1523 | 0 | 1 | 1 | 0 | Y | HTMWHYTR | 100 | | | | | | |
| NS3 | 1524 | 0 | 1 | 1 | 0 | Y | TMWHYTRG | 100 | | | | | | |
| NS3 | 1525 | 0 | 1 | 1 | 0 | Y | MWHYTRGA | 100 | | | | | | |
| NS3 | 1526 | 0 | 1 | 1 | 0 | Y | WHYTRGAV | 100 | | | | | | |
| NS3 | 1527 | 0 | 1 | 1 | 0 | Y | HYTRGAVL | 100 | | | | | | |
| NS3 | 1528 | 0 | 1 | 1 | 0 | Y | YTRGAVLM | 100 | | | | | | |
| NS3 | 1529 | 0.02 | 2 | 1 | 0 | Y | TRGAVLMY | 99.83 | | | | | | |
| NS3 | 1530 | 0.02 | 3 | 1 | 0 | Y | RGAVLMYQ | 99.83 | | | | | | |
| NS3 | 1531 | 0.02 | 3 | 1 | 0 | Y | GAVLMYQG | 99.83 | | | | | | |

FIG. 2-56

Species: DENV1 (8-MERS)

| protein | block starting position | block entropy | total peptides in block | peptides required to cover 99% of block | gap/X fraction | 99% of block covered w/ =< 5 peptides? | block to cover 99% of peptides required | frequency | block to cover 99% of peptides required | frequency |

FIG. 2-57

Species: DENV1 (8-MERS)

| protein | block starting position | block entropy | total peptides in block | peptides required to cover 99% of block | gap/X fraction | 99% of block covered w/ =<5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|

FIG. 2-58

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency |
|---|---|---|---|---|---|---|---|---|---|---|---|---|---|---|
| NS3 | 1586 | 0.87 | 5 | 3 | 0 | Y | QTAPGT

FIG. 2-59

Species: DENV1 (8-MERS)

| protein | block starting position | block entropy | total

FIG. 2-60

Species: DENV1 (8-MERS)

| protein | block starting position | block entropy | total peptides in block | peptides required to cover 99% of block | gap/X fraction | 99% of block covered w/ >= 5 peptides? | block | frequency | block | frequency | block | frequency | block | frequency |
|---|

FIG. 2-61

Species: DENV1 (8-MERS)

| protein | block

FIG. 2-62

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1690 | 0.48 | 10 | 4 | 0 | Y | KRKLRTLI | 93.63 | KRKLRTLI | 2.48 | KRKLRTLV | 2.32 | KRKLRTLV | 0.74 |
| NS3 | 1691 | 0.47 | 9 | 4 | 0 | Y | RKLRTLIL | 93.71 | RKLRTLIL | 2.48 | RKLRTLVL | 2.32 | RKLRTLVL | 0.74 |
| NS3 | 1692 | 0.45 | 8 | 4 | 0 | Y | KLRTLILA | 93.88 | RLRTLILA | 2.48 | KLRTLVLA | 2.32 | RLRTLVLA | 0.74 |
| NS3 | 1693 | 0.25 | 5 | 2 | 0 | Y | LRTLILAP | 96.44 | LRTLVLAP | 3.06 | | | | |
| NS3 | 1694 | 0.2 | 2 | 2 | 0 | Y | RTLILAPT | 96.86 | RTLVLAPT | 3.14 | | | | |
| NS3 | 1695 | 0.2 | 2 | 2 | 0 | Y | TLILAPTR | 96.86 | TLVLAPTR | 3.14 | | | | |
| NS3 | 1696 | 0.2 | 2 | 2 | 0 | Y | LILAPTRV | 96.86 | LVLAPTRV | 3.14 | | | | |
| NS3 | 1697 | 0.2 | 2 | 2 | 0 | Y | ILAPTRVV | 96.86 | VLAPTRVV | 3.14 | | | | |
| NS3 | 1698 | 0 | 1 | 1 | 0 | Y | LAPTRVVA | 100 | | | | | | |
| NS3 | 1699 | 0.02 | 2 | 1 | 0 | Y | APTRVVAS | 99.83 | | | | | | |
| NS3 | 1700 | 0.02 | 2 | 1 | 0 | Y | PTRVVASE | 99.83 | | | | | | |
| NS3 | 1701 | 0.03 | 3 | 1 | 0 | Y | TRVVASEM | 99.75 | | | | | | |
| NS3 | 1702 | 0.03 | 4 | 1 | 0 | Y | RVVASEMA | 99.75 | | | | | | |
| NS3 | 1703 | 0.03 | 4 | 1 | 0 | Y | VVASEMAE | 99.75 | | | | | | |
| NS3 | 1704 | 0.03 | 4 | 1 | 0 | Y | VASEMAEA | 99.75 | | | | | | |
| NS3 | 1705 | 0.03 | 4 | 1 | 0 | Y | ASEMAEAL | 99.75 | | | | | | |
| NS3 | 1706 | 0.03 | 3 | 1 | 0 | Y | SEMAEALK | 99.75 | | | | | | |
| NS3 | 1707 | 0.02 | 5 | 1 | 0 | Y | EMAEALKG | 99.83 | | | | | | |
| NS3 | 1708 | 0.15 | 5 | 2 | 0 | Y | MAEALKGM | 98.26 | MAEALKGV | 0.91 | | | | |
| NS3 | 1709 | 0.14 | 4 | 2 | 0 | Y | AEALKGMP | 98.35 | AEALKGVP | 0.91 | | | | |
| NS3 | 1710 | 0.14 | 4 | 2 | 0 | Y | EALKGMPI | 98.35 | EALKGVPI | 0.91 | | | | |
| NS3 | 1711 | 0.14 | 4 | 2 | 0 | Y | ALKGMPIR | 98.35 | ALKGVPIR | 0.91 | | | | |
| NS3 | 1712 | 0.14 | 4 | 2 | 0 | Y | LKGMPIRY | 98.35 | LKGVPIRY | 0.91 | | | | |
| NS3 | 1713 | 0.14 | 4 | 2 | 0 | Y | KGMPIRYQ | 98.35 | KGVPIRYQ | 0.91 | | | | |
| NS3 | 1714 | 0.14 | 4 | 2 | 0 | Y | GMPIRYQT | 98.35 | GVPIRYQT | 0.91 | | | | |
| NS3 | 1715 | 0.14 | 4 | 2 | 0 | Y | MPIRYQTT | 98.35 | VPIRYQTT | 0.91 | | | | |

FIG. 2-63

Species: DENV1 (8-

FIG. 2-64

Species: DENV1 (8-MERS)

| protein | block starting position | block entropy | total peptides in block | pe

FIG. 2-65

Species: DENV1 (8-MERS)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|

FIG. 2-66

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency |
|---|---|---|---|---|---|---|---|---|---|---|---|---|---|---|
| NS3 | 1794 | 0.24 | 5 | 2 | 0 | Y | TPPG

FIG. 2-67

Species: DENV1 (8-MERS)

| protein | block starting position | block entropy | total peptides in block | peptides required to cover 99% of block | gap/X fraction | 99% of block covered w/ =>5 peptides? | block | frequency | block | frequency | block | frequency | block | frequency |

FIG. 2-68

Species: DENV1 (8-MERS)

| protein | block starting position | block entropy | total peptides in block | peptides required to cover 99% of block | gap/X fraction | 99% of block covered w/ =<5 peptides? | pe

FIG. 2-69

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 1872 | 0.12 | 4 | 2 | 0 | Y | QKTKNNDW | 98.51 | QKTRNNDW | 1.32 |
| NS3 | 1873 | 0.12 | 4 | 2 | 0 | Y | KTKNNDWD | 98.51 | KTRNNDWD | 1.32 |
| NS3 | 1874 | 0.12 | 4 | 2 | 0 | Y | TKNNDWDY | 98.51 | TRNNDWDY | 1.32 |
| NS3 | 1875 | 0.12 | 4 | 2 | 0 | Y | KNNDWDYV | 98.51 | RNNDWDYV | 1.32 |
| NS3 | 1876 | 0.03 | 4 | 1 | 0 | Y | NNDWDYVV | 99.75 | | |
| NS3 | 1877 | 0.02 | 3 | 1 | 0 | Y | NDWDYVVT | 99.83 | | |
| NS3 | 1878 | 0.02 | 3 | 1 | 0 | Y | DWDYVVTT | 99.83 | | |
| NS3 | 1879 | 0.02 | 3 | 1 | 0 | Y | WDYVVTTD | 99.83 | | |
| NS3 | 1880 | 0.02 | 3 | 1 | 0 | Y | DYVVTTDI | 99.83 | | |
| NS3 | 1881 | 0.01 | 2 | 1 | 0 | Y | YVVTTDIS | 99.92 | | |
| NS3 | 1882 | 0.01 | 2 | 1 | 0 | Y | VVTTDISE | 99.92 | | |
| NS3 | 1883 | 0 | 1 | 1 | 0 | Y | VTTDISEM | 100 | | |
| NS3 | 1884 | 0 | 1 | 1 | 0 | Y | TTDISEMG | 100 | | |
| NS3 | 1885 | 0 | 1 | 1 | 0 | Y | TDISEMGA | 100 | | |
| NS3 | 1886 | 0 | 1 | 1 | 0 | Y | DISEMGAN | 100 | | |
| NS3 | 1887 | 0 | 1 | 1 | 0 | Y | ISEMGANF | 100 | | |
| NS3 | 1888 | 0.01 | 2 | 1 | 0 | Y | SEMGANFR | 99.92 | | |
| NS3 | 1889 | 0.01 | 2 | 1 | 0 | Y | EMGANFRA | 99.92 | | |
| NS3 | 1890 | 0.03 | 3 | 1 | 0 | Y | MGANFRAD | 99.67 | | |
| NS3 | 1891 | 0.03 | 3 | 1 | 0 | Y | GANFRADR | 99.67 | | |
| NS3 | 1892 | 0.03 | 3 | 1 | 0 | Y | ANFRADRV | 99.67 | | |
| NS3 | 1893 | 0.04 | 4 | 1 | 0 | Y | NFRADRVI | 99.59 | | |
| NS3 | 1894 | 0.04 | 4 | 1 | 0 | Y | FRADRVID | 99.59 | | |
| NS3 | 1895 | 0.04 | 4 | 1 | 0 | Y | RADRVIDP | 99.59 | | |
| NS3 | 1896 | 0.04 | 4 | 1 | 0 | Y | ADRVIDPR | 99.59 | | |
| NS3 | 1897 | 0.04 | 4 | 1 | 0 | Y | DRVIDPRR | 99.59 | | |

FIG. 2-70

Species: DENV1 (8-MERS)

| protein | block starting position | block entropy | total peptides in block | peptides required to cover 99% of block | gap/X fraction | 99% of block covered w/ <= 5 peptides? | block | frequency |
|---|---|---|---|---|---|---|

FIG. 2-71

Species: DENV1 (8-MERS)

| protein | block starting position | block entropy | total peptides in block | peptides required to cover 99% of block | gap/K fraction | 99% of block covered w/ =

FIG. 2-72

Species: DENV1 (8-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency | block | frequency |
|---|---|---|---|---|---|---|---|---|---|---|---|---|---|---|---|---|
| NS3 |

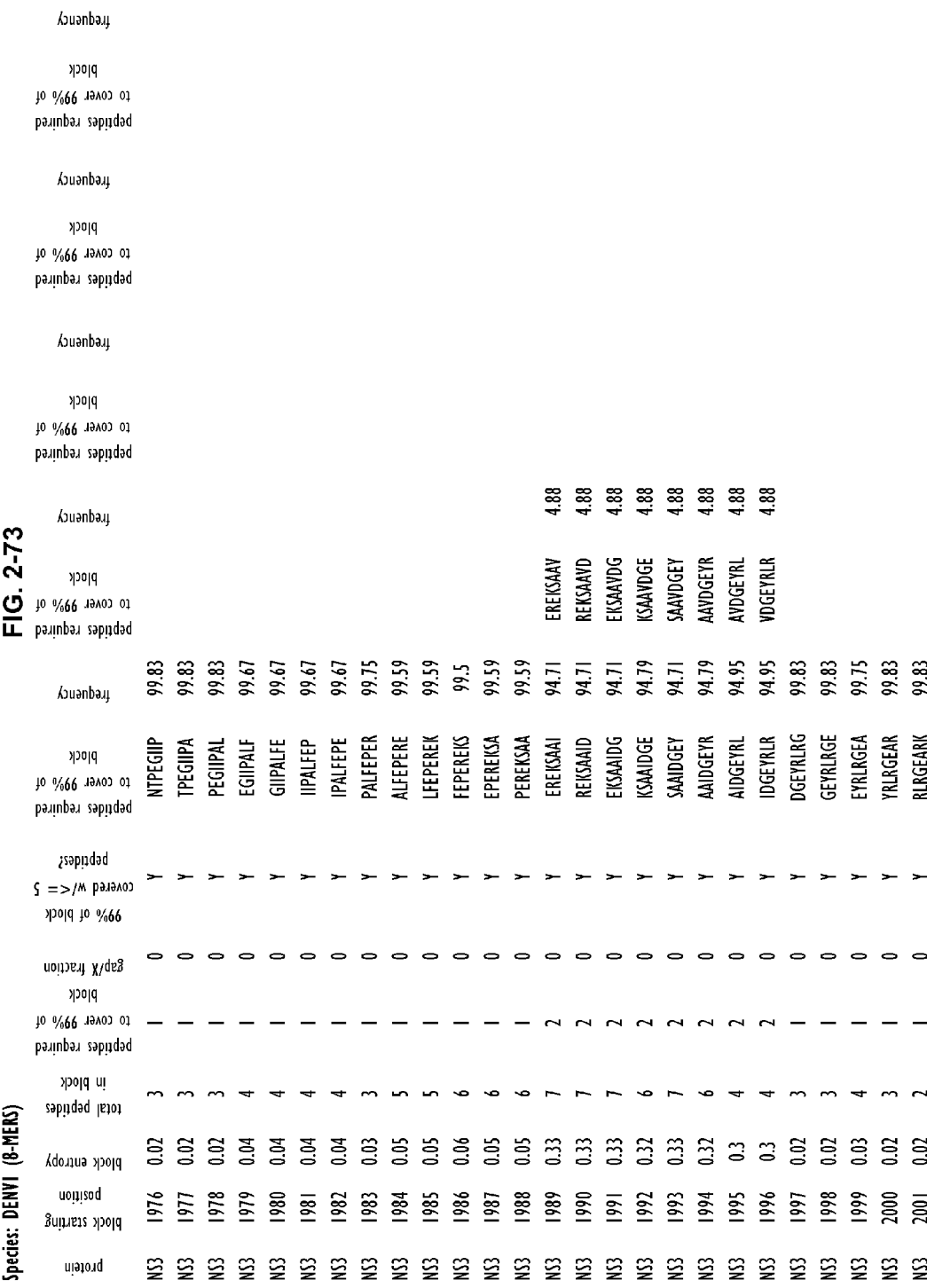

FIG. 2-74

Species: DENV1 (8-MERS)

| protein | block starting position | block

FIG. 2-75

Species: DENV1 (8-MERS)

| protein | block starting position | block entropy | total peptides in block | peptides required to cover 99% of block | gap/X fraction | 99% of block covered w/ <=5 peptides? | block | frequency | peptides required to cover 99% of block | frequency | peptides required to cover 99% of block | frequency | peptides required to cover 99% of block | frequency |
|---|---|---|---|---

FIG. 2-76

Species: DENV1 (8-MERS)

| protein | block starting position | block entropy | total peptides in block | peptides required to cover 99% of block | gap/X fraction | 99% of block covered w/ =>/ 5 peptides? | block to cover 99% of | frequency |
|---|---|---|---|---|---|---|---|---|
| NS3 | 2054 | 0.06 | 5 | — | 0 | Y | MDVEIWTK | 99.42 |
| NS3 | 2055 | 0.04 | 4 | — | 0 | Y | DVEIWTKE | 99.59 |
| NS3 | 2056 | 0.04 | 3 | — | 0 | Y | VEIWTKEG | 99.67 |
| NS3 | 2065 | 0.08 | 8 | — | 0 | Y | ERKKLRPR | 99.34 |
| NS3 | 2066 | 0.06 | 7 | — | 0 | Y | RKKLRPRW | 99.5 |
| NS3 | 2067 | 0.05 | 6 | — | 0 | Y | KKLRPRWL | 99.59 |
| NS3 | 2068 | 0.05 | 6 | — | 0 | Y | KLRPRWLD | 99.59 |
| NS3 | 2069 | 0.03 | 4 | — | 0 | Y | LRPRWLDA | 99.75 |
| NS3 | 2070 | 0.04 | 5 | — | 0 | Y | RPRWLDAR | 99.67 |
| NS3 | 2071 | 0.05 | 5 | — | 0 | Y | PRWLDART | 99.5 |
| NS3 | 2072 | 0.05 | 5 | — | 0 | Y | RWLDARTY | 99.5 |
| NS3 | 2073 | 0.05 | 5 | — | 0 | Y | WLDARTYS | 99.5 |
| NS3 | 2074 | 0.05 | 5 | — | 0 | Y | LDARTYSD | 99.5 |
| NS3 | 2075 | 0.05 | 5 | — | 0 | Y | DARTYSDP | 99.5 |
| NS3 | 2076 | 0.06 | 6 | — | 0 | Y | ARTYSDPL | 99.42 |
| NS3 | 2077 | 0.06 | 6 | — | 0 | Y | RTYSDPLA | 99.42 |
| NS3 | 2078 | 0.05 | 5 | — | 0 | Y | TYSDPLAL | 99.5 |
| NS3 | 2079 | 0.05 | 5 | — | 0 | Y | YSDPLALR | 99.59 |
| NS3 | 2080 | 0.05 | 5 | — | 0 | Y | SDPLALRE | 99.59 |
| NS3 | 2081 | 0.07 | 7 | — | 0 | Y | DPLALREF | 99.42 |
| NS3 | 2082 | 0.07 | 7 | — | 0 | Y | PLALREFK | 99.42 |
| NS3 | 2083 | 0.07 | 7 | — | 0 | Y | LALREFKE | 99.42 |
| NS3 | 2084 | 0.06 | 6 | — | 0 | Y | ALREFKEF | 99.5 |
| NS3 | 2085 | 0.05 | 5 | — | 0 | Y | LREFKEFA | 99.59 |
| NS3 | 2086 | 0.06 | 6 | — | 0 | Y | REFKEFAA | 99.5 |
| NS3 | 2087 | 0.05 | 5 | — | 0 | Y | EFKEFAAG | 99.59 |

FIG. 2-77

Species: DENV1 (8-MERS)

| protein | block starting position | block entropy | total peptides in block | peptides required to cover 99% of block | gap/X fraction | 99% of block covered w/<=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2088 | 0.05 | 5 | 1 | 0 | Y | FKEFAAGR | 99.59 | | | | | | |
| NS3 | 2089 | 0.06 | 4 | 1 | 0 | Y | KEFAAGRR | 99.42 | | | | | | |
| NS3 | 2090 | 0.06 | 4 | 1 | 0 | Y | EFAAGRRS | 99.42 | | | | | | |
| NS3 | 2091 | 0.1 | 6 | 1 | 0 | Y | FAAGRRSY | 99.01 | | | | | | |
| NS3 | 2092 | 0.11 | 7 | 2 | 0 | Y | AAGRRSYS | 98.92 | AAGRRSIS | 0.41 | | | | |
| NS3 | 2093 | 0.14 | 8 | 2 | 0 | Y | AGRRSYSG | 98.68 | AGRRSISG | 0.41 | | | | |
| NS3 | 2094 | 0.14 | 9 | 2 | 0 | Y | GRRSYSGD | 98.68 | GRRSISGD | 0.41 | | | | |
| NS3 | 2095 | 0.14 | 10 | 2 | 0 | Y | RRSYSGDL | 98.68 | RRSISGDL | 0.41 | | | | |
| NS3 | 2096 | 0.15 | 10 | 2 | 0 | Y | RSYSGDLI | 98.59 | RSISGDLI | 0.41 | | | | |
| NS3 | 2097 | 0.17 | 10 | 3 | 0 | Y | SYSGDLIL | 98.26 | SVSGDLIS | 0.5 | SISGDLIL | 0.41 | | |
| NS3 | 2098 | 0.17 | 10 | 3 | 0 | Y | VSGDLILE | 98.26 | VSGDLISE | 0.5 | ISGDLILE | 0.41 | | |
| NS3 | 2099 | 0.13 | 8 | 2 | 0 | Y | SGDLILEI | 98.76 | SGDLISEI | 0.5 | | | | |
| NS4A | 2100 | 0.12 | 7 | 2 | 0 | Y | GDLILEIG | 98.84 | GDLISEIG | 0.5 | | | | |
| NS4A | 2101 | 0.09 | 6 | 1 | 0 | Y | DLILEIGK | 99.09 | | | | | | |
| NS4A | 2102 | 0.08 | 5 | 1 | 0 | Y | LILEIGKL | 99.17 | | | | | | |
| NS4A | 2103 | 0.08 | 5 | 1 | 0 | Y | ILEIGKLP | 99.17 | | | | | | |
| NS4A | 2104 | 0.07 | 4 | 1 | 0 | Y | LEIGKLPQ | 99.26 | | | | | | |
| NS4A | 2105 | 0.01 | 2 | 1 | 0 | Y | EIGKLPQH | 99.92 | | | | | | |
| NS4A | 2106 | 0.01 | 2 | 1 | 0 | Y | IGKLPQHL | 99.92 | | | | | | |
| NS4A | 2107 | 0.04 | 5 | 1 | 0 | Y | GKLPQHLT | 99.67 | | | | | | |
| NS4A | 2108 | 0.79 | 8 | 2 | 0 | Y | KLPQHLTQ | 79.4 | KLPQHLTL | 20.02 | | | | |
| NS4A | 2109 | 0.89 | 10 | 4 | 0 | Y | LPQHLTQR | 78.66 | LPQHLTLR | 19.44 | LPQHLTQK | 0.74 | LPQHLTLK | 0.58 |
| NS4A | 2110 | 0.89 | 10 | 4 | 0 | Y | PQHLTQRA | 78.66 | PQHLTLRA | 19.44 | PQHLTQKA | 0.74 | PQHLTLKA | 0.58 |
| NS4A | 2111 | 0.89 | 10 | 4 | 0 | Y | QHLTQRAQ | 78.66 | QHLTLRAQ | 19.44 | QHLTQKAQ | 0.74 | QHLTLKAQ | 0.58 |
| NS4A | 2112 | 0.9 | 12 | 4 | 0 | Y | HLTQRAQN | 78.58 | HLTLRAQN | 19.44 | HLTQKAQN | 0.66 | HLTLKAQN | 0.58 |
| NS4A | 2113 | 0.91 | 13 | 4 | 0 | Y | LTQRAQNA | 78.58 | LTLRAQNA | 19.35 | LTQKAQNA | 0.66 | LTLKAQNA | 0.58 |

FIG. 2-78

Species: DENV1 (8-MERS)

| protein | block starting position | block entropy | total peptides in block | peptides required to cover 99% of block | gap/X fraction | 99% of block covered w/ >=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2114 | 0.91 | 13 | 4 | 0 | Y | TQRAQNAL | 78.58 | TQKAQNAL | 19.35 | TQKAQNAL | 0.66 | | |
| NS4A | 2115 | 0.89 | 10 | 4 | 0 | Y | QRAQNALD | 78.66 | LRAQNALD | 19.44 | QKAQNALD | 0.66 | TLKAQNAL | 0.58 |
| NS4A | 2116 | 0.14 | 6 | 2 | 0 | Y | RAQNALDN | 98.35 | KAQNALDN | 1.24 | | | LKAQNALD | 0.58 |
| NS4A | 2117 | 0.05 | 5 | 1 | 0 | Y | AQNALDNL | 99.59 | | | | | | |
| NS4A | 2118 | 0.06 | 6 | 1 | 0 | Y | QNALDNLV | 99.5 | | | | | | |
| NS4A | 2119 | 0.07 | 6 | 1 | 0 | Y | NALDNLVM | 99.34 | | | | | | |
| NS4A | 2120 | 0.06 | 6 | 1 | 0 | Y | ALDNLVML | 99.42 | | | | | | |
| NS4A | 2121 | 0.06 | 5 | 1 | 0 | Y | LDNLVMLH | 99.42 | | | | | | |
| NS4A | 2122 | 0.06 | 5 | 1 | 0 | Y | DNLVMLHN | 99.42 | | | | | | |
| NS4A | 2123 | 0.06 | 5 | 1 | 0 | Y | NLVMLHNS | 99.42 | | | | | | |
| NS4A | 2124 | 0.06 | 5 | 1 | 0 | Y | LVMLHNSE | 99.42 | | | | | | |
| NS4A | 2125 | 0.06 | 5 | 1 | 0 | Y | VMLHNSEQ | 99.42 | | | | | | |
| NS4A | 2126 | 0.05 | 4 | 1 | 0 | Y | MLHNSEQG | 99.5 | | | | | | |
| NS4A | 2127 | 0.03 | 3 | 1 | 0 | Y | LHNSEQGG | 99.67 | | | | | | |
| NS4A | 2128 | 0.81 | 3 | 2 | 0 | Y | HNSEQGGR | 75.35 | HNSEQGGK | 24.57 | | | | |
| NS4A | 2129 | 0.82 | 4 | 2 | 0 | Y | NSEQGGRA | 75.27 | NSEQGGKA | 24.57 | | | | |
| NS4A | 2130 | 0.82 | 4 | 2 | 0 | Y | SEQGGRAY | 75.27 | SEQGGKAY | 24.57 | | | | |
| NS4A | 2131 | 0.84 | 6 | 2 | 0 | Y | EQGGRAYR | 75.19 | EQGGKAYR | 24.48 | | | | |
| NS4A | 2132 | 0.85 | 7 | 2 | 0 | Y | QGGRAYRH | 75.1 | QGGKAYRH | 24.48 | | | | |
| NS4A | 2133 | 0.85 | 7 | 2 | 0 | Y | GGRAYRHA | 75.1 | GGKAYRHA | 24.48 | | | | |
| NS4A | 2134 | 0.93 | 10 | 3 | 0 | Y | GRAYRHAM | 74.19 | GKAYRHAM | 24.4 | GRAYRHAL | 0.74 | | |
| NS4A | 2135 | 0.93 | 10 | 3 | 0 | Y | RAYRHAME | 74.19 | KAYRHAME | 24.4 | RAYRHALE | 0.74 | | |
| NS4A | 2136 | 0.14 | 8 | 2 | 0 | Y | AYRHAMEE | 98.59 | AYRHALEE | 0.74 | | | | |
| NS4A | 2137 | 0.13 | 7 | 2 | 0 | Y | YRHAMEEL | 98.68 | YRHALEEL | 0.74 | | | | |
| NS4A | 2138 | 0.13 | 7 | 2 | 0 | Y | RHAMEELP | 98.68 | RHALEELP | 0.74 | | | | |
| NS4A | 2139 | 0.12 | 7 | 2 | 0 | Y | HAMEELPD | 98.76 | HALEELPD | 0.74 | | | | |

FIG. 2-79

Species: DENV1 (8-MERS)

| protein | block starting position | block entropy | total peptides in block | peptides required to cover 99% of block | gap/X fraction | 99% of block covered w/ >= 5 peptides? | block | frequency | block (to cover 99%) | frequency | block (to cover 99%) | frequency | block (to cover 99%) | frequency |
|---|---|---|---|---|---|---|---|---|---|---|---|---|---|---|

FIG. 2-80

Species: DENV1 (8-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency | block to cover 99% of | frequency |
|---|---|---|---|---|---|---|---|---|---|---|---|---|---|---|---|---|
| NS4A | 2166 | 0.88 | 5 | 2 | 0 | Y | LFFLSRGR | 71.79 | LFFLSGKG | 27.96 | | | | | | |
| NS4A | 2167 | 0.88 | 5 | 2 | 0 | Y | FFLSRGRL | 71.79 | FFLSGKGL | 27.96 | | | | | | |
| NS4A | 2168 | 0.87 | 4 | 2 | 0 | Y | FLSGRGLG | 71.88 | FLSGKGLG | 27.96 | | | | | | |
| NS4A | 2169 | 0.86 | 3 | 2 | 0 | Y | LSGRGLGK | 71.96 | LSGKGLGK | 27.96 | | | | | | |
| NS4A | 2170 | 0.86 | 3 | 2 | 0 | Y | SGRGLGKT | 71.96 | SGKGLGKT | 27.96 | | | | | | |
| NS4A | 2171 | 0.87 | 4 | 2 | 0 | Y | GRGLGKTS | 71.88 | GKGLGKTS | 27.96 | | | | | | |
| NS4A | 2172 | 0.87 | 4 | 2 | 0 | Y | RGLGKTSI | 71.88 | KGLGKTSI | 27.96 | | | | | | |
| NS4A | 2173 | 0.02 | 3 | 1 | 0 | Y | GLGKTSIG | 99.83 | | | | | | | | |
| NS4A | 2174 | 0.04 | 4 | 1 | 0 | Y | LGKTSIGL | 99.67 | | | | | | | | |
| NS4A | 2175 | 0.04 | 4 | 1 | 0 | Y | GKTSIGLL | 99.67 | | | | | | | | |
| NS4A | 2176 | 0.04 | 4 | 1 | 0 | Y | KTSIGLLC | 99.67 | | | | | | | | |
| NS4A | 2177 | 0.04 | 4 | 1 | 0 | Y | TSIGLLCV | 99.67 | | | | | | | | |
| NS4A | 2178 | 0.76 | 7 | 3 | 0 | Y | SIGLLCVM | 82.55 | SIGLLCVT | 16.05 | SIGLLCVI | 0.74 | | | | |
| NS4A | 2179 | 0.88 | 9 | 5 | 0 | Y | IGLLCVMA | 81.72 | IGLLCVTA | 15.22 | IGLLCVTS | 0.83 | IGLLCVIA | 0.74 | IGLLCVMS | 0.74 |
| NS4A | 2180 | 0.88 | 9 | 5 | 0 | Y | GLLCVMAS | 81.72 | GLLCVTAS | 15.22 | GLLCVTSS | 0.83 | GLLCVMSS | 0.74 | GLLCVIAS | 0.74 |
| NS4A | 2181 | 0.88 | 9 | 5 | 0 | Y | LLCVMASS | 81.72 | LLCVTASS | 15.22 | LLCVTSSS | 0.83 | LLCVMSSS | 0.74 | LLCVIASS | 0.74 |
| NS4A | 2186 | 1.04 | 13 | 4 | 0 | Y | ASSVLLWM | 71.71 | ASSALLWM | 25.72 | SSSALLWM | 1.49 | ASSALLWI | 0.17 | | |
| NS4A | 2187 | 0.95 | 12 | 2 | 0 | Y | SSVLLWMA | 71.79 | SSALLWMA | 27.21 | | | | | | |
| NS4A | 2188 | 1.06 | 13 | 3 | 0 | Y | SVLLWMAS | 71.79 | SALLWMAS | 24.98 | SALLWMAN | 2.23 | ALLWIASV | 0.17 | | |
| NS4A | 2189 | 1.07 | 14 | 4 | 0 | Y | VLLWMASV | 71.79 | ALLWMASV | 24.9 | ALLWMANV | 2.23 | | | | |
| NS4A | 2190 | 0.24 | 9 | 2 | 0 | Y | LLWMASVE | 96.94 | LLWMANVE | 2.23 | | | | | | |
| NS4A | 2191 | 0.24 | 9 | 2 | 0 | Y | LWMASVEP | 96.94 | LWMANVEP | 2.23 | | | | | | |
| NS4A | 2192 | 0.24 | 9 | 2 | 0 | Y | WMASVEPH | 96.94 | WMANVEPH | 2.23 | | | | | | |
| NS4A | 2193 | 0.25 | 10 | 2 | 0 | Y | MASVEPHW | 96.86 | MANVEPHW | 2.23 | | | | | | |
| NS4A | 2194 | 0.2 | 7 | 2 | 0 | Y | ASVEPHWI | 97.35 | ANVEPHWI | 2.23 | | | | | | |
| NS4A | 2195 | 0.18 | 5 | 2 | 0 | Y | SVEPHWIA | 97.52 | NVEPHWIA | 2.23 | | | | | | |

FIG. 2-81

Species: DENV1 (8-MERS)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS4A | 2196 | 0.03 | 4 | 1 | 0 | Y | VEPHWIAA | 99.75 |
| NS4A | 2197 | 0.02 | 3 | 1 | 0 | Y | EPHWIAAS | 99.83 |
| NS4A | 2198 | 0.01 | 2 | 1 | 0 | Y | PHWIAASI | 99.92 |
| NS4A | 2199 | 0.03 | 4 | 1 | 0 | Y | HWIAASII | 99.75 |
| NS4A | 2200 | 0.03 | 4 | 1 | 0 | Y | WIAASIIL | 99.75 |
| NS4A | 2201 | 0.04 | 5 | 1 | 0 | Y | IAASIILE | 99.67 |
| NS4A | 2202 | 0.04 | 5 | 1 | 0 | Y | AASIILEF | 99.67 |
| NS4A | 2203 | 0.04 | 5 | 1 | 0 | Y | ASIILEFF | 99.67 |
| NS4A | 2204 | 0.04 | 5 | 1 | 0 | Y | SIILEFFL | 99.67 |
| NS4A | 2205 | 0.05 | 6 | 1 | 0 | Y | IILEFFLM | 99.59 |
| NS4A | 2206 | 0.05 | 6 | 1 | 0 | Y | ILEFFLMV | 99.59 |
| NS4A | 2207 | 0.02 | 3 | 1 | 0 | Y | LEFFLMVL | 99.83 |
| NS4A | 2208 | 0.02 | 3 | 1 | 0 | Y | EFFLMVLL | 99.83 |
| NS4A | 2209 | 0.02 | 3 | 1 | 0 | Y | FFLMVLLI | 99.83 |
| NS4A | 2210 | 0.02 | 3 | 1 | 0 | Y | FLMVLLIP | 99.83 |
| NS4A | 2211 | 0.02 | 3 | 1 | 0 | Y | LMVLLIPE | 99.83 |
| NS4A | 2212 | 0.02 | 3 | 1 | 0 | Y | MVLLIPEP | 99.83 |
| NS4A | 2213 | 0.02 | 3 | 1 | 0 | Y | VLLIPEPD | 99.83 |
| NS4A | 2214 | 0.08 | 4 | 1 | 0 | Y | LLIPEPDR | 99.17 |
| NS4A | 2215 | 0.09 | 5 | 1 | 0 | Y | LIPEPDRQ | 99.09 |
| NS4A | 2216 | 0.09 | 5 | 1 | 0 | Y | IPEPDRQR | 99.09 |
| NS4A | 2217 | 0.08 | 4 | 1 | 0 | Y | PEPDRQRT | 99.17 |
| NS4A | 2218 | 0.08 | 4 | 1 | 0 | Y | EPDRQRTP | 99.17 |
| NS4A | 2219 | 0.08 | 4 | 1 | 0 | Y | PDRQRTPQ | 99.17 |
| NS4A | 2220 | 0.08 | 4 | 1 | 0 | Y | DRQRTPQD | 99.17 |
| NS4A | 2221 | 0.07 | 3 | 1 | 0 | Y | RQRTPQDN | 99.17 |

FIG. 2-82

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS4A | 2222 | 0.01 | 2 | 1 | 0 | Y | QRTPQDNQ | 99.92 | | | | | | | | |
| NS4A | 2223 | 0 | 1 | 1 | 0 | Y | RTPQDNQL | 100 | | | | | | | | |
| 2K | 2224 | 0.01 | 2 | 1 | 0 | Y | TPQDNQLA | 99.92 | | | | | | | | |
| 2K | 2225 | 0.01 | 2 | 1 | 0 | Y | PQDNQLAY | 99.92 | | | | | | | | |
| 2K | 2226 | 0.01 | 2 | 1 | 0 | Y | QDNQLAYV | 99.92 | | | | | | | | |
| 2K | 2227 | 0.02 | 3 | 1 | 0 | Y | DNQLAYVV | 99.83 | | | | | | | | |
| 2K | 2228 | 0.03 | 4 | 1 | 0 | Y | NQLAYVVI | 99.75 | | | | | | | | |
| 2K | 2229 | 0.04 | 5 | 1 | 0 | Y | QLAYVVIG | 99.67 | | | | | | | | |
| 2K | 2230 | 0.04 | 5 | 1 | 0 | Y | LAYVVIGL | 99.67 | | | | | | | | |
| 2K | 2231 | 0.04 | 5 | 1 | 0 | Y | AYVVIGLL | 99.67 | | | | | | | | |
| 2K | 2232 | 0.04 | 5 | 1 | 0 | Y | YVVIGLLF | 99.67 | | | | | | | | |
| 2K | 2233 | 0.2 | 8 | 3 | 0 | Y | VVIGLLFM | 97.77 | VVIGLLFV | 0.91 | VVIGLLFI | 0.91 | | | | |
| 2K | 2234 | 0.2 | 8 | 3 | 0 | Y | VIGLLFMI | 97.77 | VIGLLFII | 0.91 | VIGLLFVI | 0.91 | | | | |
| 2K | 2235 | 0.19 | 7 | 3 | 0 | Y | IGLLFMIL | 97.77 | IGLLFIIL | 0.99 | IGLLFVIL | 0.91 | | | | |
| 2K | 2236 | 0.2 | 7 | 3 | 0 | Y | GLLFMILT | 97.68 | GLLFIILT | 0.99 | GLLFVILT | 0.91 | | | | |
| 2K | 2237 | 0.2 | 7 | 3 | 0 | Y | LLFMILTV | 97.68 | LLFIILTV | 0.99 | LLFVILTV | 0.91 | | | | |
| 2K | 2238 | 0.2 | 7 | 3 | 0 | Y | LFMILTVA | 97.68 | LFIILTVA | 0.99 | LFVILTVA | 0.91 | | | | |
| 2K | 2239 | 0.2 | 7 | 3 | 0 | Y | FMILTVAA | 97.68 | FIILTVAA | 0.99 | FVILTVAA | 0.91 | | | | |
| 2K | 2240 | 0.21 | 8 | 3 | 0 | Y | MILTVAAN | 97.6 | IILTVAAN | 0.99 | VILTVAAN | 0.91 | | | | |
| 2K | 2241 | 0.05 | 5 | 1 | 0 | Y | ILTVAANE | 99.59 | | | | | | | | |
| 2K | 2242 | 0.05 | 5 | 1 | 0 | Y | LTVAANEM | 99.59 | | | | | | | | |
| 2K | 2243 | 0.05 | 5 | 1 | 0 | Y | TVAANEMG | 99.59 | | | | | | | | |
| 2K | 2244 | 0.03 | 4 | 1 | 0 | Y | VAANEMGL | 99.75 | | | | | | | | |
| 2K | 2245 | 0.02 | 3 | 1 | 0 | Y | AANEMGLL | 99.83 | | | | | | | | |
| 2K | 2246 | 0.02 | 3 | 1 | 0 | Y | ANEMGLLE | 99.83 | | | | | | | | |
| NS4B | 2247 | 0.02 | 3 | 1 | 0 | Y | NEMGLLET | 99.83 | | | | | | | | |

FIG. 2-83

Species: DENV1 (8-MERS)

| protein | block starting position | block entropy | total peptides in block | peptides required to cover 99% of block | gap/X fraction | 99% of block covered w/ <= 5 peptides? | block | frequency | block

FIG. 2-84

Species: DENV1 (8-MERS)

| protein | block starting position | block entropy | total peptides in block | peptides required to cover 99% of block | gap/X fraction | 99% of block covered w/ =< 5 peptides? | peptides required to cover 99% of block | frequency | peptides required to cover 99% of block | frequency | peptides

Species: DENV1 (8-MERS)

| protein | block starting position | block entropy | total peptides in block | peptides required to cover 99% of block | gap/X fraction | 99% of block covered w/<=5 peptides? | block (to cover 99% of) | frequency | peptides required to cover 99% of block | block (to cover 99% of) | frequency | peptides required to cover 99% of block | block (to cover 99% of) | frequency | peptides required to cover 99% of block | block (to cover 99% of) | frequency |
|---|---|---|---|---|---|---|---|---|---|---|---|---|---|---|---|---|---|
| NS4B | 2338 | 0.01 | 2 | 1 | 0 | Y | VPLLALGC | 99.92 | | | | | | | | | |
| NS4B | 2339 | 0.01 | 2 | 1 | 0 | Y | PLLALGCY | 99.92 | | | | | | | | | |
| NS4B | 2340 | 0.01 | 2 | 1 | 0 | Y | LLALGCYS | 99.92 | | | | | | | | | |
| NS4B | 2341 | 0.01 | 2 | 1 | 0 | Y | LALGCYSQ | 99.92 | | | | | | | | | |
| NS4B | 2342 | 0.01 | 2 | 1 | 0 | Y | ALGCYSQV | 99.92 | | | | | | | | | |
| NS4B | 2343 | 0 | 2 | 1 | 0 | Y | LGCYSQVN | 99.92 | | | | | | | | | |
| NS4B | 2344 | 0 | 1 | 1 | 0 | Y | GCYSQVNP | 100 | | | | | | | | | |
| NS4B | 2345 | 0.01 | 2 | 1 | 0 | Y | CYSQVNPL | 99.92 | | | | | | | | | |
| NS4B | 2346 | 0.01 | 2 | 1 | 0 | Y | YSQVNPLT | 99.92 | | | | | | | | | |
| NS4B | 2347 | 0.02 | 3 | 1 | 0 | Y | SQVNPLTL | 99.83 | | | | | | | | | |
| NS4B | 2348 | 0.11 | 4 | 2 | 0 | Y | QVNPLTLI | 98.68 | QVNPLTLI | | 1.16 | | | | | | |
| NS4B | 2349 | 0.12 | 5 | 2 | 0 | Y | VNPLTLTA | 98.59 | VNPLTLTA | | 1.16 | | | | | | |
| NS4B | 2350 | 0.16 | 7 | 2 | 0 | Y | NPLTLTAA | 98.18 | NPLTLTAA | | 1.16 | | | | | | |
| NS4B | 2351 | 0.18 | 9 | 2 | 0 | Y | PLTLTAAV | 98.01 | PLTLTAAV | | 1.16 | | | | | | |
| NS4B | 2352 | 0.23 | 12 | 3 | 0 | Y | LTLTAAVL | 97.6 | LTLTAAVL | | 1.16 | | LTLTATVL | 0.33 | | | |
| NS4B | 2353 | 0.23 | 12 | 3 | 0 | Y | TLTAAVLM | 97.6 | TLTAAVLM | | 1.16 | | TLTATVLM | 0.33 | | | |
| NS4B | 2354 | 0.23 | 12 | 3 | 0 | Y | LTAAVLML | 97.6 | LTAAVLML | | 1.16 | | LTATVLML | 0.33 | | | |
| NS4B | 2355 | 0.29 | 13 | 4 | 0 | Y | TAAVLMLV | 96.86 | TAAVLMLV | | 1.16 | | TAAVLMLL | 0.74 | | TATVLMLV | 0.33 |
| NS4B | 2356 | 0.2 | 12 | 3 | 0 | Y | AAVLMLVA | 98.01 | AAVLMLLA | | 1.16 | | ATVLMLVA | 0.33 | | | |
| NS4B | 2357 | 0.19 | 11 | 3 | 0 | Y | AVLMLVAH | 98.1 | AVLMLLAH | | 1.16 | | TVLMLVAH | 0.33 | | | |
| NS4B | 2358 | 0.15 | 9 | 2 | 0 | Y | VLMLVAHY | 98.51 | VLMLLAHY | | 0.74 | | | | | | |
| NS4B | 2359 | 0.13 | 7 | 2 | 0 | Y | LMLVAHYA | 98.68 | LMLLAHYA | | 0.74 | | | | | | |
| NS4B | 2360 | 0.08 | 4 | 1 | 0 | Y | MLVAHYAI | 99.09 | | | | | | | | | |
| NS4B | 2361 | 0.07 | 3 | 1 | 0 | Y | LVAHYAII | 99.17 | | | | | | | | | |
| NS4B | 2362 | 0.07 | 3 | 1 | 0 | Y | VAHYAIIG | 99.17 | | | | | | | | | |
| NS4B | 2363 | 0 | 1 | 1 | 0 | Y | AHYAIIGP | 100 | | | | | | | | | |

FIG. 2-87

Species: DENV1 (8-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG. 2-88

Species: DENV1 (8-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 2-89

Species: DENV1 (8-MERS)

| protein | block starting position | block entropy | total

FIG. 2-90

Species: DENV1 (8-MERS)

| protein | block starting position | block entropy | total peptides in block | peptides required to cover

FIG. 2-91

Species: DENV1 (8-MERS)

| protein | block starting position | block entropy | total peptides in block | peptides required to cover 99% of block | gap/X fraction | 99% of block covered w/ =< 5 peptides? | block | frequency |

FIG. 2-92

Species: DENV1 (8-MERS)

| protein | block starting position | block entropy | total peptides in block | peptides required to cover 99% of block | gap/X fraction | 99% of block covered w/ =< 5 peptides? | block to cover 99% of |

FIG. 2-93

Species: DENV1 (8-MERS)

| protein | block starting position | block entropy | total peptides in block | peptides required to cover 99% of block | gap/X fraction | 99% of block covered w/ =< 5 peptides? | block | frequency | block | frequency | block | frequency | block | frequency |
|---|---|---|---|---|---|---|---|---|---|---|---|---|---|---|
| NS5 | 2520 | 0.65 | 8 | 3 | 0 | Y | FNTYKRSG | 86.77 | FNIYKRSG | 11

FIG. 2-95

Species: DENV1 (8-MERS)

| protein | block starting position | block entropy | total

FIG. 2-96

Species: DENV1

FIG. 2-97

Species: DENV1 (8-MERS)

| protein | block starting position | block entropy | total peptides in block | peptides required to cover 99% of block | gap/X fraction | 99% of block covered w/ <= 5 pe

FIG. 2-98

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS5 | 2650 | 0.01 | 2 | 1 | 0 | Y | TIEEGRTL | 99.92 | | |
| NS5 | 2651 | 0.01 | 2 | 1 | 0 | Y | IEEGRTLR | 99.92 | | |
| NS5 | 2652 | 0.04 | 4 | 1 | 0 | Y | EEGRTLRV | 99.67 | | |
| NS5 | 2653 | 0.04 | 4 | 1 | 0 | Y | EGRTLRVL | 99.67 | | |
| NS5 | 2654 | 0.04 | 4 | 1 | 0 | Y | GRTLRVLK | 99.67 | | |
| NS5 | 2655 | 0.04 | 4 | 1 | 0 | Y | RTLRVLKM | 99.67 | | |
| NS5 | 2656 | 0.04 | 4 | 1 | 0 | Y | TLRVLKMV | 99.67 | | |
| NS5 | 2657 | 0.04 | 4 | 1 | 0 | Y | LRVLKMVE | 99.67 | | |
| NS5 | 2658 | 0.04 | 4 | 1 | 0 | Y | RVLKMVEP | 99.67 | | |
| NS5 | 2659 | 0.04 | 4 | 1 | 0 | Y | VLKMVEPW | 99.67 | | |
| NS5 | 2660 | 0.01 | 2 | 1 | 0 | Y | LKMVEPWL | 99.92 | | |
| NS5 | 2661 | 0.16 | 4 | 2 | 0 | Y | KMVEPWLR | 97.93 | KMVEPWLK | 1.9 |
| NS5 | 2662 | 0.16 | 4 | 2 | 0 | Y | MVEPWLRG | 97.93 | MVEPWLKG | 1.9 |
| NS5 | 2663 | 0.16 | 4 | 2 | 0 | Y | VEPWLRGN | 97.93 | VEPWLKGN | 1.9 |
| NS5 | 2672 | 0.03 | 2 | 1 | 0 | Y | QFCIKILN | 99.75 | | |
| NS5 | 2673 | 0.03 | 2 | 1 | 0 | Y | FCIKILNP | 99.75 | | |
| NS5 | 2674 | 0.03 | 2 | 1 | 0 | Y | CIKILNPY | 99.75 | | |
| NS5 | 2675 | 0.03 | 2 | 1 | 0 | Y | IKILNPYM | 99.75 | | |
| NS5 | 2676 | 0.03 | 2 | 1 | 0 | Y | KILNPYMP | 99.75 | | |
| NS5 | 2677 | 0.05 | 5 | 1 | 0 | Y | ILNPYMPS | 99.5 | | |
| NS5 | 2678 | 0.03 | 4 | 1 | 0 | Y | LNPYMPSV | 99.75 | | |
| NS5 | 2679 | 0.04 | 5 | 1 | 0 | Y | NPYMPSVV | 99.67 | | |
| NS5 | 2680 | 0.04 | 5 | 1 | 0 | Y | PYMPSVVE | 99.67 | | |
| NS5 | 2681 | 0.18 | 7 | 2 | 0 | Y | YMPSVVET | 97.68 | YMPSVVEA | 1.9 |
| NS5 | 2682 | 0.18 | 7 | 2 | 0 | Y | MPSVVETL | 97.68 | MPSVVEAL | 1.9 |
| NS5 | 2683 | 0.18 | 7 | 2 | 0 | Y | PSVVETLE | 97.68 | PSVVEALE | 1.9 |

FIG. 2-99

Species: DENV1 (8-MERS)

| protein | block starting position | block entropy | total peptides in block | peptides required to cover 99% of block | gap/X fraction | 99% of block covered w/ <= 5 peptides? | block (to cover 99% of block) | frequency | block (to cover 99% of block) | frequency | block (to cover 99% of

FIG. 2-101

Species: DENV1 (8-MERS)

| protein | block starting position | block entropy | total peptides in block | peptides required to cover 99% of block | gap/X fraction | 99% of block covered w/ >=5 peptides? | block | frequency | block | frequency | block | frequency | block | frequency | block | frequency |
|---|---|---|---|---|---|---|---|---|---|---|---|---|---|---|---|---|
| NS5 | 2736 | 0.19 | 5 | 2 | 0 | Y | NRFTMAHR | 97.6 | NRFTMTHR | 1.9 | | | | | | |
| NS5 | 2737 | 0.2 | 6 | 2 | 0 | Y | RFTMAHRK | 97.52 | RFTMTHRK | 1.9 | | | | | | |
| NS5 | 2738 | 0.2 | 6 | 2 | 0 | Y | FTMAHRKP | 97.52 | FTMTHRKP | 1.9 | | | | | | |
| NS5 | 2739 | 0.19 | 5 | 2 | 0 | Y | TMAHRKPT | 97.6 | TMTHRKPT | 1.9 | | | | | | |
| NS5 | 2740 | 0.3 | 6 | 3 | 0 | Y | MAHRKPTY | 96.11 | MTHRKPTY | 1.9 | MAHRKPTF | 1.49 | | | | |
| NS5 | 2741 | 0.3 | 6 | 3 | 0 | Y | AHRKPTYE | 96.11 | THRKPTYE | 1.9 | AHRKPTFE | 1.49 | | | | |
| NS5 | 2742 | 0.28 | 6 | 3 | 0 | Y | HRKPTYER | 96.36 | HRKPTYEK | 1.9 | HRKPTFER | 1.49 | | | | |
| NS5 | 2743 | 0.28 | 6 | 3 | 0 | Y | RKPTYERD | 96.36 | RKPTYEKD | 1.9 | RKPTFERD | 1.49 | | | | |
| NS5 | 2744 | 0.28 | 6 | 3 | 0 | Y | KPTYERDV | 96.36 | KPTYEKDV | 1.9 | KPTFERDV | 1.49 | | | | |
| NS5 | 2745 | 0.27 | 5 | 3 | 0 | Y | PTYERDVD | 96.44 | PTYEKDVD | 1.9 | PTFERDVD | 1.49 | | | | |
| NS5 | 2746 | 0.27 | 5 | 3 | 0 | Y | TYERDVDL | 96.44 | TYEKDVDL | 1.9 | TFERDVDL | 1.49 | | | | |
| NS5 | 2747 | 0.27 | 5 | 3 | 0 | Y | YERDVDLG | 96.44 | YEKDVDLG | 1.9 | FERDVDLG | 1.49 | | | | |
| NS5 | 2748 | 0.46 | 5 | 3 | 0 | Y | ERDVDLGA | 92.39 | ERDVDLGT | 5.54 | EKDVDLGA | 1.9 | | | | |
| NS5 | 2749 | 0.46 | 5 | 3 | 0 | Y | RDVDLGAG | 92.39 | RDVDLGTG | 5.54 | KDVDLGAG | 1.9 | | | | |
| NS5 | 2750 | 0.34 | 4 | 2 | 0 | Y | DVDLGAGT | 94.21 | DVDLGTGT | 5.54 | | | | | | |
| NS5 | 2751 | 0.33 | 5 | 2 | 0 | Y | VDLGAGTR | 94.29 | VDLGTGTR | 5.54 | | | | | | |
| NS5 | 2752 | 0.34 | 5 | 2 | 0 | Y | DLGAGTRH | 94.21 | DLGTGTRH | 5.54 | | | | | | |
| NS5 | 2753 | 0.34 | 5 | 2 | 0 | Y | LGAGTRHV | 94.21 | LGTGTRHV | 5.54 | | | | | | |
| NS5 | 2754 | 0.42 | 8 | 3 | 0 | Y | GAGTRHVA | 93.3 | GTGTRHVA | 5.54 | GAGTRHVT | 0.58 | | | | |
| NS5 | 2755 | 0.43 | 9 | 3 | 0 | Y | AGTRHVAV | 93.3 | TGTRHVAV | 5.54 | AGTRHVTV | 0.5 | | | | |
| NS5 | 2756 | 0.13 | 9 | 2 | 0 | Y | GTRHVAVE | 98.76 | GTRHVTVE | 0.5 | | | | | | |
| NS5 | 2757 | 0.13 | 9 | 2 | 0 | Y | TRHVAVEP | 98.76 | TRHVTVEP | 0.5 | | | | | | |
| NS5 | 2758 | 0.12 | 8 | 2 | 0 | Y | RHVAVEPE | 98.84 | RHVTVEPE | 0.5 | | | | | | |
| NS5 | 2759 | 0.23 | 10 | 4 | 0 | Y | HVAVEPEV | 97.52 | HVAVEPEI | 0.74 | HVAVEPEE | 0.58 | HVTVEPEV | 0.5 | | |
| NS5 | 2760 | 0.27 | 11 | 5 | 0 | Y | VAVEPEVA | 97.11 | VAVEPEIA | 0.74 | VAVEPEEA | 0.58 | VTVEPEVA | 0.5 | VAVEPEVP | 0.33 |
| NS5 | 2761 | 0.27 | 11 | 5 | 0 | Y | AVEPEVAN | 97.11 | AVEPEIAN | 0.74 | AVEPEEAN | 0.58 | TVEPEVAN | 0.5 | AVEPEVPN | 0.33 |

FIG. 2-102

Species: DENV1 (8-MERS)

| protein | block starting position | block entropy | total peptides in block | peptides required to cover 99% of block | gap/X fraction | 99% of block covered w/ =>5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS5 | 2762 | 0.23 | 9 | 4 | 0 | Y | VEPEVANL | 97.6 | VEPEIANL | 0.74 | VEPEEANL | 0.58 | VEPEVANI | 0.33 |
| NS5 | 2763 | 0.23 | 9 | 4 | 0 | Y | EPEVANLD | 97.52 | EPEIANLD | 0.74 | EPEEANLD | 0.58 | EPEVPNLD | 0.33 |
| NS5 | 2764 | 0.24 | 9 | 4 | 0 | Y | PEVANLDI | 97.44 | PEIANLDI | 0.74 | PEEANLDI | 0.58 | PEVANIDI | 0.33 |
| NS5 | 2765 | 0.24 | 8 | 4 | 0 | Y | EVANLDII | 97.44 | EIANLDII | 0.74 | EEANLDII | 0.58 | EVPNLDII | 0.41 |
| NS5 | 2766 | 0.24 | 8 | 4 | 0 | Y | VANLDIIG | 97.44 | IANLDIIG | 0.74 | EANLDIIG | 0.58 | VPNLDIIG | 0.41 |
| NS5 | 2767 | 0.13 | 7 | 2 | 0 | Y | ANLDIIGQ | 98.76 | ANIDIIGQ | 0.33 | | | | |
| NS5 | 2768 | 0.08 | 5 | 1 | 0 | Y | NLDIIGQR | 99.26 | | | | | | |
| NS5 | 2769 | 0.08 | 5 | 1 | 0 | Y | LDIIGQRI | 99.26 | | | | | | |
| NS5 | 2770 | 0.04 | 4 | 1 | 0 | Y | DIIGQRIE | 99.59 | | | | | | |
| NS5 | 2771 | 0.04 | 4 | 1 | 0 | Y | IIGQRIEN | 99.67 | | | | | | |
| NS5 | 2772 | 0.03 | 4 | 1 | 0 | Y | IGQRIENI | 99.75 | | | | | | |
| NS5 | 2773 | 0.04 | 5 | 1 | 0 | Y | GQRIENIK | 99.67 | | | | | | |
| NS5 | 2774 | 0.87 | 8 | 2 | 0 | Y | QRIENIKH | 74.77 | QRIENIKN | 24.57 | | | | |
| NS5 | 2775 | 0.88 | 9 | 2 | 0 | Y | RIENIKHE | 74.77 | RIENIKNE | 24.48 | | | | |
| NS5 | 2776 | 0.88 | 9 | 2 | 0 | Y | IENIKHEH | 74.77 | IENIKNEH | 24.48 | | | | |
| NS5 | 2777 | 0.89 | 10 | 2 | 0 | Y | ENIKHEHK | 74.69 | ENIKNEHK | 24.48 | | | | |
| NS5 | 2778 | 0.9 | 11 | 2 | 0 | Y | NIKHEHKS | 74.61 | NIKNEHKS | 24.48 | | | | |
| NS5 | 2779 | 0.89 | 10 | 2 | 0 | Y | IKHEHKST | 74.69 | IKNEHKST | 24.48 | | | | |
| NS5 | 2780 | 0.88 | 9 | 2 | 0 | Y | KHEHKSTW | 74.77 | KNEHKSTW | 24.48 | | | | |
| NS5 | 2781 | 0.88 | 9 | 2 | 0 | Y | HEHKSTWH | 74.77 | NEHKSTWH | 24.48 | | | | |
| NS5 | 2782 | 0.06 | 7 | 1 | 0 | Y | EHKSTWHY | 99.5 | | | | | | |
| NS5 | 2783 | 0.06 | 7 | 1 | 0 | Y | HKSTWHYD | 99.5 | | | | | | |
| NS5 | 2784 | 0.06 | 7 | 1 | 0 | Y | KSTWHYDE | 99.5 | | | | | | |
| NS5 | 2785 | 0.05 | 6 | 1 | 0 | Y | STWHYDED | 99.59 | | | | | | |
| NS5 | 2786 | 0.04 | 5 | 1 | 0 | Y | TWHYDEDN | 99.67 | | | | | | |
| NS5 | 2787 | 0.04 | 5 | 1 | 0 | Y | WHYDEDNP | 99.67 | | | | | | |

FIG. 2-103

Species: DENV1 (8-MERS)

| protein | block starting position | block entropy | total peptides in block | peptides required to cover 99% of block | gap/X fraction | 99% of block covered w/ <= 5 peptides? | block | frequency |

FIG. 2-104

Species: DENV1 (8-MERS)

| protein | block starting position | block entropy | total peptides in block | peptides required to cover 99% of block | gap/X fraction | 99% of block covered w/ <= 5 peptides? | block (peptides required to cover 99% of block) | frequency | block (peptides required to cover 99% of block) | frequency |
|---|---|---|---

FIG. 2-105

Species: DENV1 (8-MERS)

| protein | block starting position | block entropy | total peptides in block | peptides required to cover 99% of block | gap/X fraction | 99% of block covered w/ <= 5 peptides? | peptides required

FIG. 2-106

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS5 | 2866 | 0.79 | 8 | 4 | 0 | Y | AQIMEVTA | 83.46 | TQIMEVTA | 14.31 | VQIMEVTA | 1.08 | AQIMEMTA | 0.5 | | |
| NS5 | 2867 | 1.02 | 10 | 3 | 0 | Y | QIMEVTAK | 67.66 | QIMEVTAR | 31.1 | QIMEMTAK | 0.41 | | | | |
| NS5 | 2868 | 1.02 | 10 | 3 | 0 | Y | IMEVTAKW | 67.66 | IMEVTARW | 31.1 | IMEMTAKW | 0.41 | | | | |
| NS5 | 2869 | 0.98 | 8 | 2 | 0 | Y | MEVTAKWL | 67.82 | MEVTARWL | 31.35 | | | | | | |
| NS5 | 2870 | 0.98 | 8 | 2 | 0 | Y | EVTAKWLW | 67.82 | EVTARWLW | 31.35 | | | | | | |
| NS5 | 2871 | 1.03 | 10 | 3 | 0 | Y | VTAKWLWG | 67.49 | VTARWLWG | 31.1 | MTAKWLWG | 0.41 | | | | |
| NS5 | 2872 | — | 9 | 3 | 0 | Y | TAKWLWGF | 67.91 | TARWLWGF | 31.02 | TARWLWSF | 0.33 | | | | |
| NS5 | 2873 | — | 9 | 3 | 0 | Y | AKWLWGFL | 67.91 | ARWLWGFL | 31.02 | ARWLWSFL | 0.33 | | | | |
| NS5 | 2874 | — | 9 | 3 | 0 | Y | KWLWGFLS | 67.82 | RWLWGFLS | 31.1 | RWLWSFLS | 0.33 | | | | |
| NS5 | 2875 | 0.1 | 7 | 1 | 0 | Y | WLWGFLSR | 99.01 | | | | | | | | |
| NS5 | 2876 | 0.13 | 10 | 2 | 0 | Y | LWGFLSRN | 98.76 | LWSFLSRN | 0.33 | | | | | | |
| NS5 | 2877 | 0.13 | 10 | 2 | 0 | Y | WGFLSRNK | 98.76 | WSFLSRNK | 0.33 | | | | | | |
| NS5 | 2878 | 0.14 | 11 | 2 | 0 | Y | GFLSRNKK | 98.68 | SFLSRNKK | 0.33 | | | | | | |
| NS5 | 2879 | 0.08 | 8 | 1 | 0 | Y | FLSRNKKP | 99.34 | | | | | | | | |
| NS5 | 2880 | 0.06 | 7 | 1 | 0 | Y | LSRNKKPR | 99.5 | | | | | | | | |
| NS5 | 2881 | 0.06 | 7 | 1 | 0 | Y | SRNKKPRI | 99.5 | | | | | | | | |
| NS5 | 2882 | 0.06 | 7 | 1 | 0 | Y | RNKKPRIC | 99.5 | | | | | | | | |
| NS5 | 2883 | 0.06 | 7 | 1 | 0 | Y | NKKPRICT | 99.5 | | | | | | | | |
| NS5 | 2884 | 0.03 | 4 | 1 | 0 | Y | KKPRICTR | 99.75 | | | | | | | | |
| NS5 | 2885 | 0.03 | 4 | 1 | 0 | Y | KPRICTRE | 99.75 | | | | | | | | |
| NS5 | 2886 | 0.02 | 3 | 1 | 0 | Y | PRICTREE | 99.83 | | | | | | | | |
| NS5 | 2887 | 0.02 | 3 | 1 | 0 | Y | RICTREEF | 99.83 | | | | | | | | |
| NS5 | 2888 | 0.08 | 4 | 1 | 0 | Y | ICTREEFT | 99.09 | | | | | | | | |
| NS5 | 2889 | 0.07 | 3 | 1 | 0 | Y | CTREEFTR | 99.17 | | | | | | | | |
| NS5 | 2890 | 0.07 | 3 | 1 | 0 | Y | TREEFTRK | 99.17 | | | | | | | | |
| NS5 | 2891 | 0.07 | 3 | 1 | 0 | Y | REEFTRKW | 99.17 | | | | | | | | |

FIG. 2-108

Species: DENV1 (8-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency

FIG. 2-109

Species: DENV1 (8-MERS)

| protein | block starting position | block entropy | total peptides in block | peptides required to cover 99% of block | gap/X fraction | 99% of block covered w/ <= 5 peptides? | peptides required

FIG. 2-110

Species: DENV1 (8-MERS)

| protein | block starting position | block entropy | total peptides in block | peptides required to cover 99% of block | gap/X fraction | 99% of block covered w/ >= 5 peptides? | peptides required to cover 99% of block | frequency | peptides required to cover 99% of block | frequency |

FIG. 2-111

Species: DENV1 (8-MERS)

| protein | block starting position | block entropy | total

FIG. 2-112

Species: DENV1 (8-MERS)

| protein | block starting position | block entropy | total peptides in block | peptides required to cover 99% of block | gap/X fraction | 99% of block covered w/ >= 5 peptides? | block | frequency | block | frequency | block | frequ

FIG. 2-113

Species: DENV1 (8-MERS)

| protein | block starting position | block entropy | total peptides in block | peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3053 | 0.08 | 6 | 1 | 0 | Y | EPEHALLA | 99.26 | | | | | | |
| NS5 | 3054 | 1.16 | 10 | 3 | 0 | Y | PEHALLAK | 58.06 | PEHALLAT | 39.37 | PEHALLAR | 1.82 | | |
| NS5 | 3055 | 1.54 | 10 | 4 | 0 | Y | EHALLAKS | 47.39 | EHALLATS | 39.45 | EHALLAKA | 10.84 | EHALLARS | 1.82 |
| NS5 | 3056 | 1.54 | 10 | 4 | 0 | Y | HALLAKSI | 47.39 | HALLATSI | 39.45 | HALLAKAI | 10.84 | HALLARSI | 1.82 |
| NS5 | 3057 | 1.54 | 10 | 4 | 0 | Y | ALLAKSIF | 47.39 | ALLATSIF | 39.45 | ALLAKAIF | 10.84 | ALLARSIF | 1.82 |
| NS5 | 3058 | 1.54 | 10 | 4 | 0 | Y | LLAKSIFK | 47.39 | LLATSIFK | 39.45 | LLAKAIFK | 10.84 | LLARSIFK | 1.82 |
| NS5 | 3059 | 1.53 | 9 | 4 | 0 | Y | LAKSIFKL | 47.48 | LATSIFKL | 39.45 | LAKAIFKL | 10.84 | LARSIFKL | 1.82 |
| NS5 | 3060 | 1.53 | 9 | 4 | 0 | Y | AKSIFKLT | 47.48 | ATSIFKLT | 39.45 | AKAIFKLT | 10.84 | ARSIFKLT | 1.82 |
| NS5 | 3061 | 1.53 | 9 | 4 | 0 | Y | KSIFKLTY | 47.48 | TSIFKLTY | 39.45 | KAIFKLTY | 10.84 | RSIFKLTY | 1.82 |
| NS5 | 3062 | 0.51 | 3 | 2 | 0 | Y | SIFKLTYQ | 88.92 | AIFKLTYQ | 11 | | | | |
| NS5 | 3063 | 0.02 | 3 | 1 | 0 | Y | IFKLTYQN | 99.83 | | | | | | |
| NS5 | 3064 | 0.01 | 2 | 1 | 0 | Y | FKLTYQNK | 99.92 | | | | | | |
| NS5 | 3065 | 0.01 | 2 | 1 | 0 | Y | KLTYQNKV | 99.92 | | | | | | |
| NS5 | 3066 | 0.01 | 2 | 1 | 0 | Y | LTYQNKVV | 99.92 | | | | | | |
| NS5 | 3067 | 0.01 | 2 | 1 | 0 | Y | TYQNKVVR | 99.92 | | | | | | |
| NS5 | 3068 | 0.01 | 2 | 1 | 0 | Y | YQNKVVRV | 99.92 | | | | | | |
| NS5 | 3069 | 0.01 | 2 | 1 | 0 | Y | QNKVVRVQ | 99.92 | | | | | | |
| NS5 | 3070 | 0.03 | 3 | 1 | 0 | Y | NKVVRVQR | 99.75 | | | | | | |
| NS5 | 3071 | 0.02 | 2 | 1 | 0 | Y | KVVRVQRP | 99.83 | | | | | | |
| NS5 | 3072 | 0.13 | 5 | 2 | 0 | Y | VVRVQRPA | 98.59 | VVRVQRPT | 0.99 | | | | |
| NS5 | 3073 | 0.25 | 7 | 3 | 0 | Y | VRVQRPAK | 97.02 | VRVQRPAR | 1.57 | VRVQRPTK | 0.91 | | |
| NS5 | 3074 | 0.38 | 8 | 4 | 0 | Y | RVQRPAKN | 95.2 | RVQRPAKS | 1.82 | RVQRPARN | 1.57 | RVQRPTKN | 0.91 |
| NS5 | 3075 | 0.38 | 8 | 4 | 0 | Y | VQRPAKNG | 95.2 | VQRPAKSG | 1.82 | VQRPARNG | 1.57 | VQRPTKNG | 0.91 |
| NS5 | 3076 | 0.38 | 8 | 4 | 0 | Y | QRPAKNGT | 95.2 | QRPAKSGT | 1.82 | QRPARNGT | 1.57 | QRPTKNGT | 0.91 |
| NS5 | 3077 | 0.38 | 8 | 4 | 0 | Y | RPAKNGTV | 95.2 | RPAKSGTV | 1.82 | RPARNGTV | 1.57 | RPTKNGTV | 0.91 |
| NS5 | 3078 | 0.36 | 7 | 4 | 0 | Y | PAKNGTVM | 95.37 | PAKSGTVM | 1.82 | PARNGTVM | 1.82 | PTKNGTVM | 0.91 |

FIG. 2-115

Species: DENV1 (8-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|

FIG. 2-116

Species: DENV1 (8-MERS)

| protein | block starting position | block entropy | total peptides in block | peptides required to cover 99% of block | gap/X fraction | 99% of block covered w/ >= 5 peptides? | block (to cover 99%) | frequency | block (to cover 99%)

FIG. 2-117

Species: DENV1 (8-MERS)

| protein | block starting position | block entropy | total peptides in block | peptides required to cover 99% of block | gap/X fraction | 99% of block covered w/<=5 peptides? | block | frequency | block | frequency |
|---|---|---|---|---|---|---|---|---|---|---|
| NS5 | 3184 | 0.14 | 4 | 2 | 0 | Y | KDIPQWEP | 98.26 | KDVPQWEP | 1.57 |
| NS5 | 3185 | 0.14 | 4 | 2 | 0 | Y | DIPQWEPS | 98.26 | DVPQWEPS | 1.57 |
| NS5 | 3186 | 0.15 | 5 | 2 | 0 | Y | IPQWEPSK | 98.18 | VPQWEPSK | 1.57 |
| NS5 | 3187 | 0.02 | 3 | 1 | 0 | Y | PQWEPSKG | 99.83 | | |
| NS5 | 3188 | 0.02 | 2 | 1 | 0 | Y | QWEPSKGW | 99.83 | | |
| NS5 | 3189 | 0.02 | 2 | 1 | 0 | Y | WEPSKGWN | 99.83 | | |
| NS5 | 3190 | 0.04 | 3 | 1 | 0 | Y | EPSKGWND | 99.67 | | |
| NS5 | 3191 | 0.04 | 3 | 1 | 0 | Y | PSKGWNDW | 99.67 | | |
| NS5 | 3192 | 0.05 | 5 | 1 | 0 | Y | SKGWNDWQ | 99.59 | | |
| NS5 | 3193 | 0.05 | 5 | 1 | 0 | Y | KGWNDWQQ | 99.59 | | |
| NS5 | 3194 | 0.05 | 5 | 1 | 0 | Y | GWNDWQQV | 99.59 | | |
| NS5 | 3195 | 0.06 | 6 | 1 | 0 | Y | WNDWQQVP | 99.5 | | |
| NS5 | 3196 | 0.06 | 6 | 1 | 0 | Y | NDWQQVPF | 99.5 | | |
| NS5 | 3197 | 0.08 | 7 | 1 | 0 | Y | DWQQVPFC | 99.26 | | |
| NS5 | 3198 | 0.06 | 6 | 1 | 0 | Y | WQQVPFCS | 99.42 | | |
| NS5 | 3199 | 0.06 | 6 | 1 | 0 | Y | QQVPFCSH | 99.42 | | |
| NS5 | 3200 | 0.05 | 5 | 1 | 0 | Y | QVPFCSHH | 99.5 | | |
| NS5 | 3201 | 0.05 | 5 | 1 | 0 | Y | VPFCSHHF | 99.5 | | |
| NS5 | 3202 | 0.04 | 4 | 1 | 0 | Y | PFCSHHFH | 99.59 | | |
| NS5 | 3203 | 0.05 | 4 | 1 | 0 | Y | FCSHHFHQ | 99.59 | | |
| NS5 | 3204 | 0.04 | 3 | 1 | 0 | Y | CSHHFHQL | 99.59 | | |
| NS5 | 3205 | 0.02 | 3 | 1 | 0 | Y | SHHFHQLI | 99.83 | | |
| NS5 | 3206 | 0.02 | 3 | 1 | 0 | Y | HHFHQLIM | 99.83 | | |
| NS5 | 3207 | 0.02 | 3 | 1 | 0 | Y | HFHQLIMK | 99.83 | | |
| NS5 | 3208 | 0.02 | 3 | 1 | 0 | Y | FHQLIMKD | 99.83 | | |
| NS5 | 3209 | 0.02 | 3 | 1 | 0 | Y | HQLIMKDG | 99.83 | | |

FIG. 2-118

Species: DENV1 (8-MERS)

| protein | block starting position | block entropy | total peptides in block | peptides required to cover 99% of block | g

FIG. 2-119

Species: DENV1 (8-MERS)

| protein | block starting position | block entropy | total peptides in block | peptides required to cover 99% of block | g

FIG. 2-120

Species: DENV1 (8-MERS)

| protein | block starting position | block entropy | total peptides in block | peptides required to cover 99% of block | gap/X fraction | 99% of block covered w/ >= 5 peptides? | block | frequency | block | frequency | block | frequency | block | frequency | block | frequency |
|---|---|---|---|---|---|---|---|---|---|---|---|---|---|---|---|---|
| NS5 | 3262 | 0.02 | 3 | 1 | 0 | Y | FHRRDLRL | 99.83 | | | | | | | | |
| NS5 | 3263 | 0.02 | 3 | 1 | 0 | Y | HRRDLRLA | 99.83 | | | | | | | | |
| NS5 | 3264 | 0.04 | 5 | 1 | 0 | Y | RRDLRLAA | 99.67 | | | | | | | | |
| NS5 | 3265 | 0.03 | 4 | 1 | 0 | Y | RDLRLAAN | 99.75 | | | | | | | |

FIG. 2-121

Species: DENV1 (8-MERS)

| protein | block starting position | block entropy | total peptides in block | peptides required to cover 99% of block | gap/X fraction | 99% of block covered w/ =<5 peptides? | block | frequency | peptides required to cover 99% of block | frequency | peptides required to c

FIG. 2-122

Species: DENV1 (8-MERS)

| protein | block starting position | block entropy | total peptides in block | peptides required to cover 99% of block | gap/X fraction | 99% of block covered w/ =<5 peptides? | block | frequency | block | frequency | block | frequency | block | frequency |
|---|---|---|---|---|---|---|---|---|---|---|---|---|---|---|
| NS5 | 3318 | 1.16 | 7 | 3 | 0 | Y | WMEDKT

FIG. 2-123

Species: DENV1 (8-MERS)

| protein | block starting position | block ent

FIG. 2-124

Species: DENV1 (8-MERS)

| protein | block starting position | block

FIG. 3-1

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|

FIG. 3-2

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 27 | 0.07 | 7 | 1 | 0 | Y | SQLAKRFSK | 99.42 | | | | | | |
| anC | 28 | 0.06 | 7 | 1 | 0 | Y | QLAKRFSKG | 99.5 | | | | | | |
| anC | 29 | 0.07 | 8 | 1 | 0 | Y | LAKRFSKGL | 99.42 | | | | | | |
| anC | 30 | 0.07 | 8 | 1 | 0 | Y | AKRFSKGLL | 99.42 | | | | | | |
| anC | 31 | 0.07 | 8 | 1 | 0 | Y | KRFSKGLLS | 99.42 | | | | | | |
| anC | 32 | 0.06 | 7 | 1 | 0 | Y | RFSKGLLSG | 99.5 | | | | | | |
| anC | 33 | 0.05 | 6 | 1 | 0 | Y | FSKGLLSGQ | 99.59 | | | | | | |
| anC | 34 | 0.05 | 6 | 1 | 0 | Y | SKGLLSGQG | 99.59 | | | | | | |
| anC | 35 | 0.05 | 6 | 1 | 0 | Y | KGLLSGQGP | 99.59 | | | | | | |
| anC | 36 | 0.08 | 7 | 1 | 0 | Y | GLLSGQGPM | 99.26 | | | | | | |
| anC | 37 | 0.08 | 8 | 1 | 0 | Y | LLSGQGPMK | 99.26 | | | | | | |
| anC | 38 | 0.26 | 8 | 3 | 0 | Y | LSGQGPMKL | 96.86 | LSGQGPMKM | 1.82 | LSGQGPMKF | 0.66 | | |
| anC | 39 | 0.26 | 7 | 3 | 0 | Y | SGQGPMKLV | 96.86 | SGQGPMKMV | 1.82 | SGQGPMKFV | 0.66 | | |
| anC | 40 | 0.25 | 7 | 3 | 0 | Y | GQGPMKLVM | 96.94 | GQGPMKMVM | 1.82 | GQGPMKFVM | 0.66 | | |
| anC | 41 | 0.25 | 7 | 3 | 0 | Y | QGPMKLVMA | 96.94 | QGPMKMVMA | 1.82 | QGPMKFVMA | 0.66 | | |
| anC | 42 | 0.25 | 9 | 3 | 0 | Y | GPMKLVMAF | 96.94 | GPMKMVMAF | 1.82 | GPMKFVMAF | 0.66 | | |
| anC | 43 | 0.28 | 9 | 3 | 0 | Y | PMKLVMAFI | 96.69 | PMKMVMAFI | 1.82 | PMKFVMAFI | 0.66 | | |
| anC | 44 | 0.28 | 8 | 3 | 0 | Y | MKLVMAFIA | 96.69 | MKMVMAFIA | 1.82 | MKFVMAFIA | 0.66 | | |
| anC | 45 | 0.25 | 7 | 3 | 0 | Y | KLVMAFIAF | 96.94 | KMVMAFIAF | 1.82 | KFVMAFIAF | 0.66 | | |
| anC | 46 | 0.25 | 6 | 3 | 0 | Y | LVMAFIAFL | 96.94 | MVMAFIAFL | 1.9 | FVMAFIAFL | 0.66 | | |
| anC | 47 | 0.06 | 6 | 1 | 0 | Y | VMAFIAFLR | 99.42 | | | | | | |
| anC | 48 | 0.06 | 6 | 1 | 0 | Y | MAFIAFLRF | 99.42 | | | | | | |
| anC | 49 | 0.06 | 6 | 1 | 0 | Y | AFIAFLRFL | 99.42 | |

FIG. 3-3

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| anC | 53 | 0.04 | 4 | 1 | 0 | Y | FLRFLAIPP | 99.67 | | | | |
| anC | 54 | 0.02 | 3 | 1 | 0 | Y | LRFLAIPPT | 99.83 | | | | |
| anC | 55 | 0.02 | 3 | 1 | 0 | Y | RFLAIPPTA | 99.83 | | | | |
| anC | 56 | 0.01 | 2 | 1 | 0 | Y | FLAIPPTAG | 99.92 | | | | |

FIG. 3-4

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 79 | 0.18 | 7 | 2 | 0 | Y | KVLRGFKKE | 97.93 | KVLRGFKRE | 1.16 | | | | |
| anC | 80 | 0.31 | 6 | 3 | 0 | Y | VLRGFKKEI | 95.62 | VLRGFKREI | 2.98 | VLRGFKRE | 1.16 | | |
| anC | 81 | 0.31 | 6 | 3 | 0 | Y | LRGFKKEIS | 95.62 | LRGFKREIS | 2.98 | LRGFKKEYS | 1.16 | | |
| anC | 82 | 1.04 | 8 | 4 | 0 | Y | RGFKKEISN | 75.02 | RGFKKEISS | 20.51 | RGFKKEISN | 2.98 | RGFKREISN | 1.16 |
| anC | 83 | 1.03 | 7 | 4 | 0 | Y | GFKKEISNM | 75.1 | GFKKEISSM | 20.51 | GFKKEYSNM | 2.98 | GFKREISNM | 1.16 |
| anC | 84 | 1.02 | 6 | 4 | 0 | Y | FKKEISNML | 75.19 | FKKEISSML | 20.51 | FKKEYSNML | 2.98 | FKREISNML | 1.16 |
| anC | 85 | 1.08 | 9 | 4 | 0 | Y | KKEISNMLN | 74.61 | KKEISSMLN | 20.51 | KKEYSNMLN | 2.89 | KREISNML | 1.16 |
| anC | 91 | 0.49 | 16 | 5 | 0 | Y | MLNIMNRRK | 93.3 | MLNTMNRRK | 4.38 | MLNIINRRK | 0.66 | MLSINMRRK | 0.41 |
| anC | 95 | 0.34 | 14 | 4 | 0 | Y | MNRRKRSVT | 95.86 | MNRRKKSVT | 2.4 | INRRKRSVT | 0.66 | MNRRRKSVT | 0.17 |
| anC | 96 | 0.29 | 13 | 3 | 0 | Y | NRRKRSVTM | 96.44 | NRRKKSVTM | 2.4 | | | | |
| anC | 97 | 0.42 | 15 | 5 | 0 | Y | RRKRSVTML | 94.87 | RRKKSVTML | 2.4 | RRKRSVTMF | 0.17 | RRKRSVTMI | 0.83 |
| anC | 98 | 0.42 | 14 | 5 | 0 | Y | RKKSVTMLL | 94.87 | RKKSVTMFL | 2.4 | RKKSVTMIL | 0.83 | RKKSVTMLF | 0.74 |
| anC | 100 | 0.43 | 15 | 5 | 0 | Y | KSVTMLLML | 94.79 | RSVTMFLML | 2.48 | RSVTMLML | 0.83 | RSATMLLML | 0.74 |
| anC | 110 | 0.27 | 9 | 4 | 0 | Y | PTALAFHLT | 96.94 | PTVLTFHLT | 0.99 | PTALTFHLT | 0.83 | | |
| anC | 111 | 0.3 | 10 | 5 | 0 | Y | TALAFHLT | 96.61 | TVLTFHLT | 0.99 | TALTFHLT | 0.83 | | |
| anC | 112 | 0.28 | 8 | 4 | 0 | Y | ALAFHLTR | 96.77 | VLTFHLTR | 0.99 | ALTFHLTR | 0.83 | | |
| anC | 113 | 0.16 | 5 | 5 | 0 | Y | LAFHLTRG | 98.01 | LTFHLTRG | 1.49 | | | | |
| anC | 114 | 0.16 | 4 | 2 | 0 | Y | AFHLTRGG | 98.01 | TFHLTRGG | 1.57 | | | | |
| anC | 115 | 0.04 | 3 | 1 | 0 | Y | FHLTRGGE | 99.59 | | | | | | |
| anC | 116 | 0.04 | 3 | 1 | 0 | Y | HLTRGGEP | 99.59 | | | | | | |
| anC | 117 | 0.04 | 3 | 1 | 0 | Y | LTRGGEPH | 99.59 | | | | | | |
| anC | 118 | 0.04 | 3 | 1 | 0 | Y | TRGGEPHM | 99.59 | | | | | | |
| prM | 119 | 0.14 | 5 | 2 | 0 | Y | TRGGEPHMI | 98.43 | TRGGEPHMV | 0.99 | GGEPHMVG | 0.58 | | |
| prM | 120 | 0.12 | 5 | 2 | 0 | Y | RGGEPHMIV | 98.68 | RGGEPHMVW | 0.99 | GEPHMVGK | 0.58 | | |
| prM | 121 | 0.72 | 8 | 4 | 0 | Y | GGEPHMIVS | 85.77 | GGEPHMVWS | 12.16 | GGEPHMVG | 0.99 | | |
| prM | 122 | 0.72 | 8 | 4 | 0 | Y | GEPHMIVSK | 85.77 | GEPHMVWSK | 12.16 | GEPHMVGK | 0.99 | | |

FIG. 3-5

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 123 | 0.73 | 9 | 4 | 0 | Y | EPHMIVSKQ | 85.69 | EPHMIVTKQ | 12.16 | EPHMIVSKQ | 0.99 | EPHMIVGKQ | 0.58 |
| prM | 124 | 0.73 | 9 | 4 | 0 | Y | PHMIVSKQE | 85.69 | PHMIVTKQE | 12.16 | PHMVVSKQE | 0.99 | PHMIVGKQE | 0.58 |
| prM | 125 | 0.73 | 9 | 4 | 0 | Y | HMIVSKQER | 85.69 | HMIVTKQER | 12.16 | HMVVSKQER | 0.99 | HMIVGKQER | 0.58 |
| prM | 126 | 0.74 | 10 | 4 | 0 | Y | MIVSKQERG | 85.53 | MIVTKQERG | 12.16 | MVVSKQERG | 0.99 | MIVGKQERG | 0.58 |
| prM | 127 | 0.74 | 10 | 4 | 0 | Y | IVSKQERGK | 85.53 | IVTKQERGK | 12.16 | VVSKQERGK | 0.99 | IVGKQERGK | 0.58 |
| prM | 128 | 0.66 | 9 | 3 | 0 | Y | VSKQERGKS | 86.52 | VTKQERGKS | 12.16 | VGKQERGKS | 0.58 | | |
| prM | 129 | 0.66 | 9 | 3 | 0 | Y | SKQERGKSL | 86.6 | TKQERGKSL | 12.16 | GKQERGKSL | 0.5 | | |
| prM | 130 | 0.06 | 6 | 1 | 0 | Y | KQERGKSLL | 99.42 | | | | | | |
| prM | 131 | 0.06 | 6 | 1 | 0 | Y | QERGKSLLF | 99.42 | | | | | | |
| prM | 132 | 0.05 | 5 | 1 | 0 | Y | ERGKSLLFK | 99.5 | | | | | | |
| prM | 133 | 0.05 | 5 | 1 | 0 | Y | RGKSLLFKT | 99.5 | | | | | | |
| prM | 134 | 0.09 | 7 | 1 | 0 | Y | GKSLLFKTS | 99.17 | | | | | | |
| prM | 135 | 0.31 | 9 | 3 | 0 | Y | KSLLFKTSA | 95.95 | KSLLFKTSV | 2.73 | KSLLFKTST | 0.58 | LLFKTSTGV | 0.58 |
| prM | 136 | 0.31 | 9 | 3 | 0 | Y | SLLFKTSAG | 95.95 | SLLFKTSVG | 2.73 | SLLFKTSTG | 0.58 | LFKTSTGVN | 0.58 |
| prM | 137 | 0.45 | 10 | 4 | 0 | Y | LLFKTSAGV | 94.04 | LLFKTSVGV | 2.48 | LLFKTSAGI | 2.07 | FKTSTGVN | 0.58 |
| prM | 138 | 0.44 | 9 | 4 | 0 | Y | LFKTSAGVN | 94.13 | LFKTSVGVN | 2.48 | LFKTSAGIN | 2.07 | KTSTGVN | 0.58 |
| prM | 139 | 0.44 | 9 | 4 | 0 | Y | FKTSAGVNM | 94.13 | FKTSYGVNM | 2.48 | FKTSAGINM | 2.07 | KTSTGVNM | 0.58 |
| prM | 140 | 0.44 | 9 | 4 | 0 | Y | KTSAGVNMC | 94.13 | KTSYGVNMC | 2.48 | KTSAGINMC | 2.07 | TSTGVNMCT | 0.58 |
| prM | 141 | 0.45 | 10 | 4 | 0 | Y | TSAGVNMCT | 94.04 | TSYGVNMCT | 2.48 | TSAGINMCT | 2.07 | STGVNMCTL | 0.58 |
| prM | 142 | 0.46 | 11 | 4 | 0 | Y | SAGVNMCTL | 93.96 | SVGVNMCTL | 2.48 | SAGINMCTL | 2.07 | TGVNMCTLI | 0.58 |
| prM | 143 | 0.46 | 10 | 4 | 0 | Y | AGVNMCTLI | 93.96 | VGVNMCTLI | 2.48 | AGINMCTLI | 2.07 | | |
| prM | 144 | 0.22 | 6 | 2 | 0 | Y | GVNMCTLIA | 97.11 | GINMCTLIA | 2.32 | | | | |
| prM | 145 | 0.22 | 6 | 2 | 0 | Y | VNMCTLIAM | 97.11 | INMCTLIAM | 2.32 | | | | |
| prM | 146 | 0.06 | 5 | 1 | 0 | Y | NMCTLIAMD | 99.42 | | | | | | |
| prM | 147 | 0.06 | 5 | 1 | 0 | Y | MCTLIAMDL | 99.42 | | | | | | |
| prM | 148 | 0.06 | 5 | 1 | 0 | Y | CTLIAMDLG | 99.42 | | | | | | |

FIG. 3-6

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 149 | 0.06 | 5 | 1 | 0 | Y | TLIAMDLGE | 99.42 | TLIAMDLGEF | 17.12 | | | | |
| prM | 150 | 0.71 | 6 | 2 | 0 | Y | LIAMDLGEL | 82.38 | LIAMDLGEF | 17.12 | | | | |
| prM | 151 | 0.7 | 5 | 2 | 0 | Y | IAMDLGELC | 82.46 | IAMDLGEFC | 17.12 | | | | |
| prM | 152 | 0.76 | 3 | 3 | 0 | Y | AMDLGELCE | 81.31 | AMDLGEFCE | 17.37 | AMDLGELCD | 1.32 | | |
| prM | 153 | 0.76 | 3 | 3 | 0 | Y | MDLGELCED | 81.31 | MDLGEFCED | 17.37 | MDLGELCDD | 1.32 | | |
| prM | 154 | 0.77 | 4 | 3 | 0 | Y | DLGELCEDT | 81.22 | DLGEFCEDT | 17.37 | DLGELCDDT | 1.32 | | |
| prM | 155 | 0.86 | 7 | 4 | 0 | Y | LGELCEDTM | 80.23 | LGEFCEDTM | 17.37 | LGELCDDTM | 1.32 | LGELCEDTI | 0.58 |
| prM | 156 | 0.86 | 7 | 4 | 0 | Y | GELCEDTMT | 80.23 | GEFCEDTMT | 17.37 | GELCDDTMT | 1.32 | GELCEDTIT | 0.58 |
| prM | 157 | 0.86 | 7 | 4 | 0 | Y | ELCEDTMTY | 80.23 | EFCEDTMTY | 17.37 | ELCDDTMTY | 1.32 | ELCEDTITY | 0.58 |
| prM | 158 | 0.86 | 7 | 4 | 0 | Y | LCEDTMTYK | 80.23 | FCEDTMTYK | 17.37 | LCDDTMTYK | 1.32 | LCEDTITYK | 0.58 |
| prM | 159 | 0.2 | 7 | 3 | 0 | Y | CEDTMTYKC | 97.6 | CDDTMTYKC | 1.32 | CEDTITYKC | 0.58 | | |
| prM | 160 | 0.2 | 6 | 3 | 0 | Y | EDTMTYKCP | 97.6 | DDTMTYKCP | 1.32 | EDTITYKCP | 0.58 | | |
| prM | 161 | 0.53 | 7 | 3 | 0 | Y | DTMTYKCPR | 90.32 | DTMTYKCPQ | 8.6 | DTITYKCPR | 0.5 | | |
| prM | 162 | 0.54 | 8 | 4 | 0 | Y | TMTYKCPRI | 90.24 | TMTYKCPQI | 8.6 | TITYKCPRI | 0.5 | | |
| prM | 163 | 0.6 | 8 | 3 | 0 | Y | MTYKCPRIT | 89.5 | MTYKCPQIT | 8.6 | MTYKCPRIS | 0.83 | ITYKCPRIT | 0.5 |
| prM | 164 | 0.52 | 6 | 5 | 0 | Y | TYKCPRITE | 90.32 | TYKCPQITE | 8.6 | TYKCPRISE | 0.83 | | |
| prM | 165 | 1.5 | 10 | 5 | 0 | Y | YKCPRITET | 59.97 | YKCPQITEA | 27.38 | YKCPRITEA | 8.6 | YKCPRITEV | 2.89 | YKCPRISEA | 0.74 |
| prM | 166 | 1.5 | 10 | 5 | 0 | Y | KCPRITEAE | 59.97 | KCPQITEAE | 27.38 | KCPRITETE | 8.6 | KCPRITEVE | 2.89 | KCPRISEAE | 0.74 |
| prM | 167 | 1.5 | 10 | 5 | 0 | Y | CPRITEAEP | 59.97 | CPQITEAEP | 27.38 | CPRITETEP | 8.6 | CPRITEVEP | 2.89 | CPRISEAEP | 0.74 |
| prM | 168 | 1.51 | 11 | 5 | 0 | Y | PRITEAEPD | 59.88 | PQITEAEPD | 27.38 | PRITETEPD | 8.6 | PRITEVEPD | 2.89 | PRISEAEPD | 0.74 |
| prM | 169 | 1.51 | 11 | 5 | 0 | Y | RITEAEPDD | 59.88 | QITEAEPDD | 27.38 | RITETEPDD | 8.6 | RITEVEPDD | 2.89 | RISEAEPDD | 0.74 |
| prM | 170 | 1.14 | 10 | 4 | 0 | Y | ITEAEPDDV | 68.49 | ITEVEPDDV | 27.38 | ITETEPDDV | 2.89 | ISEAEPDDV | 0.74 | | |
| prM | 171 | 1.13 | 9 | 4 | 0 | Y | TEAEPDDVD | 68.57 | TEVEPDDVD | 27.38 | TETEPDDVD | 2.89 | SEAEPDDVD | 0.74 | | |
| prM | 172 | 1.06 | 7 | 3 | 0 | Y | EAEPDDVDC | 69.31 | EVEPDDVDC | 27.46 | ETEPDDVDC | 2.89 | | |
| prM | 173 | 1.05 | 6 | 3 | 0 | Y | AEPDDVDCW | 69.4 | VEPDDVDCW | 27.46 | TEPDDVDCW | 2.89 | | |
| prM | 174 | 0.02 | 3 | 1 | 0 | Y | EPDDVDCWC | 99.83 | | | | | | |

FIG. 3-7

Species: DENV1 (9-MERS)

| protein | block starting position | block entropy | total peptides in block | peptides required to cover 99% of block | gap/X fraction | 99% of block covered w/ >= 5 peptides? | block to cover 99% of peptides required | frequency | block to cover 99% of peptides

FIG. 3-8

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| prM | 201 | 0.28 | 6 | 2 | 0 | Y | RRDKRSVAL | 95.7 | RREKRSVAL | 3.89 |
| prM | 202 | 0.29 | 7 | 2 | 0 | Y | RDKRSVALA | 95.7 | REKRSVALA | 3.8 |
| prM | 203 | 0.29 | 7 | 2 | 0 | Y | DKRSVALAP | 95.7 | EKRSVALAP | 3.8 |
| prM | 204 | 0.06 | 6 | 1 | 0 | Y | KRSVALAPH | 99.5 | | |
| prM | 205 | 0.04 | 5 | 1 | 0 | Y | RSVALAPHV | 99.67 | | |
| prM | 206 | 0.04 | 5 | 1 | 0 | Y | SVALAPHVG | 99.67 | | |
| prM | 207 | 0.06 | 6 | 1 | 0 | Y | VALAPHVGL | 99.5 | | |
| prM | 208 | 0.05 | 5 | 1 | 0 | Y | ALAPHVGLG | 99.59 | | |
| prM | 209 | 0.05 | 5 | 1 | 0 | Y | LAPHVGLGL | 99.59 | | |
| prM | 210 | 0.05 | 5 | 1 | 0 | Y | APHVGLGLE | 99.59 | | |
| prM | 211 | 0.05 | 5 | 1 | 0 | Y | PHVGLGLET | 99.59 | | |
| prM | 212 | 0.05 | 5 | 1 | 0 | Y | HVGLGLETR | 99.59 | | |
| prM | 213 | 0.3 | 5 | 2 | 0 | Y | VGLGLETRT | 95.2 | VGLGLETRA | 4.47 |
| prM | 214 | 0.29 | 4 | 2 | 0 | Y | GLGLETRTE | 95.2 | GLGLETRAE | 4.55 |
| prM | 215 | 0.29 | 4 | 2 | 0 | Y | LGLETRTET | 95.2 | LGLETRAET | 4.55 |
| prM | 216 | 0.27 | 2 | 2 | 0 | Y | GLETRTETW | 95.45 | GLETRAETW | 4.55 |
| prM | 217 | 0.28 | 3 | 2 | 0 | Y | LETRTETWM | 95.37 | LETRAETWM | 4.55 |
| prM | 218 | 0.28 | 3 | 2 | 0 | Y | ETRTETWMS | 95.37 | ETRAETWMS | 4.55 |
| prM | 219 | 0.28 | 3 | 2 | 0 | Y | TRTETWMSS | 95.37 | TRAETWMSS | 4.55 |
| prM | 220 | 0.28 | 4 | 2 | 0 | Y | RTETWMSSE | 95.37 | RAETWMSSE | 4.55 |
| prM | 221 | 0.29 | 3 | 2 | 0 | Y | TETWMSSEG | 95.2 | AETWMSSEG | 4.55 |
| prM | 222 | 0.03 | 3 | 1 | 0 | Y | ETWMSSEGA | 99.75 | | |
| prM | 223 | 0.03 | 3 | 1 | 0 | Y | TWMSSEGAW | 99.75 | | |
| prM | 224 | 0.17 | 5 | 2 | 0 | Y | WMSSEGAWK | 97.85 | WMSSEGAWR | 1.82 |
| prM | 225 | 0.18 | 6 | 2 | 0 | Y | MSSEGAWKQ | 97.77 | MSSEGAWRQ | 1.82 |
| prM | 226 | 0.18 | 6 | 2 | 0 | Y | SSEGAWKQI | 97.68 | SSEGAWRQI | 1.9 |

FIG. 3-9

Species: DENV1 (9-MERS)

| protein | block starting position | block entropy | total peptides in block | peptides required to cover 99% of block | gap/X fraction | 99% of block covered w/ <= 5 peptides? | block peptides required to cover 99% of | frequency | block peptides required to cover 99% of | frequency | block peptides required to cover 99% of | frequency | block peptides required to cover 99% of | frequency |
|---|---|---|---|---|---|---|---|---|---|---|---|---|---|---|
| prM | 227 | 0.18 | 6 | 2 | 0 | Y | SE

FIG. 3-10

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | fr

Species: DENV1 (9-MERS)

| protein | block starting position | block entropy | total peptides in block | peptides required to cover 99% of block | gap/X fraction | 99% of block covered w/ <= 5 peptides? | block (99% cover) | frequency | block (99% cover) | frequency | block (99% cover) | frequency | block (99% cover) | frequency | block (99% cover) | frequency |
|---|---|---|---|---|---|---|---|---|---|---|---|---|---|---|---|---|
| E | 308 | 0.08 | 6 | 1 | 0 | Y | GSCVTTMAK | 99.26 | | | | | | | | |
| E | 309 | 0.79 | 8 | 2 | 0 | Y | SCVTTMAKD | 79.9 | SCVTTMAKN | 19.27 | | | | | | |
| E | 310 | 0.79 | 8 | 2 | 0 | Y | CVTTMAKDK | 79.9 | CVTTMAKNK | 19.27 | | | | | | |
| E | 311 | 0.79 | 8 | 2 | 0 | Y | VTTMAKDKP | 79.9 | VTTMAKNKP | 19.27 | | | | | |

FIG. 3-13

Species: DENV1 (9-MERS)

| protein | block starting position | block entropy | total

FIG. 3-14

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 360 | 0.87 | 6 | 4 | 0 | Y | ATLVEEQDA | 83.29 | ATLMEEQDA | 11.25 | ATLVEEQDT | 3.23 | ATLVEEQDS | 2.07 |
| E | 361 | 0.87 | 7 | 4 | 0 | Y | TLVEEQDAN | 83.29 | TLMEEQDAN | 11.17 | TLVEEQDTN | 3.23 | TLVEEQDSN | 2.07 |
| E | 362 | 0.88 | 8 | 4 | 0 | Y | LVEEQDANF | 83.29 | LMEEQDANF | 11.08 | LVEEQDTNF | 3.23 | LVEEQDSNF | 2.07 |
| E | 363 | 0.88 | 8 | 4 | 0 | Y | VEEQDANFV | 83.29 | MEEQDANFV | 11.08 | VEEQDTNFV | 3.23 | VEEQDSNFV | 2.07 |
| E | 364 | 0.38 | 6 | 3 | 0 | Y | EEQDANFVC | 94.46 | EEQDTNFVC | 3.23 | EEQDSNFVC | 2.07 | | |
| E | 365 | 0.38 | 6 | 3 | 0 | Y | EQDANFVCR | 94.46 | EQDTNFVCR | 3.23 | EQDSNFVCR | 2.07 | | |
| E | 366 | 0.38 | 6 | 3 | 0 | Y | QDANFVCRR | 94.46 | QDTNFVCRR | 3.23 | QDSNFVCRR | 2.07 | | |
| E | 367 | 0.38 | 6 | 3 | 0 | Y | DANFVCRRT | 94.46 | DTNFVCRRT | 3.23 | DSNFVCRRT | 2.07 | | |
| E | 368 | 0.47 | 8 | 4 | 0 | Y | ANFVCRRTF | 93.38 | TNFVCRRTF | 3.23 | SNFVCRRTF | 2.07 | ANFVCRRTL | 0.58 |
| E | 369 | 0.13 | 6 | 2 | 0 | Y | NFVCRRTFV | 98.68 | NFVCRRTLV | 0.58 | | | | |
| E | 370 | 0.12 | 5 | 2 | 0 | Y | FVCRRTFVD | 98.76 | FVCRRTLVD | 0.58 | | | | |
| E | 371 | 0.11 | 4 | 2 | 0 | Y | VCRRTFVDR | 98.84 | VCRRTLVDR | 0.58 | | | | |
| E | 372 | 0.11 | 4 | 2 | 0 | Y | CRRTFVDRG | 98.84 | CRRTLVDRG | 0.58 | | | | |
| E | 373 | 0.11 | 4 | 2 | 0 | Y | RRTFVDRGW | 98.84 | RRTLVDRGW | 0.58 | | | | |
| E | 374 | 0.11 | 4 | 2 | 0 | Y | RTFVDRGWG | 98.84 | RTLVDRGWG | 0.58 | | | | |
| E | 375 | 0.11 | 4 | 2 | 0 | Y | TFVDRGWGN | 98.84 | TLVDRGWGN | 0.58 | | | | |
| E | 376 | 0.11 | 4 | 2 | 0 | Y | FVDRGWGNG | 98.84 | LVDRGWGNG | 0.58 | | | | |
| E | 377 | 0 | 1 | 1 | 0 | Y | VDRGWGNGC | 100 | | | | | | |
| E | 378 | 0 | 1 | 1 | 0 | Y | DRGWGNGCG | 100 | | | | | | |
| E | 379 | 0 | 1 | 1 | 0 | Y | RGWGNGCGL | 100 | | | | | | |
| E | 380 | 0 | 1 | 1 | 0 | Y | GWGNGCGLF | 100 | | | | | | |
| E | 381 | 0 | 1 | 1 | 0 | Y | WGNGCGLFG | 100 | | | | | | |
| E | 382 | 0 | 1 | 1 | 0 | Y | GNGCGLFGK | 100 | | | | | | |
| E | 383 | 0 | 1 | 1 | 0 | Y | NGCGLFGKG | 100 | | | | | | |
| E | 384 | 0.01 | 2 | 1 | 0 | Y | GCGLFGKGS | 99.92 | | | | | | |
| E | 385 | 0.01 | 2 | 1 | 0 | Y | CGLFGKGSL | 99.92 | | | | | | |

FIG. 3-15

Species: DENV1 (9-MERS)

| protein | block starting position | block entropy | total peptides in block | peptides required to cover 99% of block | gap/X fraction | 99% of block covered w/ <= 5 peptides? | block to cover 99% of |

FIG. 3-16

Species: DENV

FIG. 3-17

Species: DENV1 (9-MERS)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| E | 438 | 0.85 | 7 | 2 | 0 | Y | HGTIATIIP | 76.1 | HGTIATIIP | 23.24 | | | | |
| E | 439 | 0.84 | 6 | 2 | 0 | Y | GTIATIIPQ | 76.18 | GTIATIIPQ | 23.24 | | | | |
| E | 440 | 0.84 | 6 | 2 | 0 | Y | TIATIIPQA | 76.18 | TIATIIPQA | 23.24 | | | | |
| E | 441 | 0.84 | 6 | 2 | 0 | Y | TATIIPQAP | 76.18 | IATIIPQAP | 23.24 | | | | |
| E | 442 | 0.76 | 6 | 2 | 0 | Y | ATIIPQAPT | 80.81 | ATIIPQAPS | 18.53 | | | | |
| E | 443 | 1.58 | 9 | 3 | 0 | Y | TIIPQAPTT | 41.6 | TIIPQAPTS | 39.12 | TIIPQAPST | 18.44 | | |
| E | 444 | 1.55 | 8 | 3 | 0 | Y | IIPQAPTTE | 41.6 | IIPQAPTSE | 39.54 | ITPQAPSTE | 18.44 | | |
| E | 445 | 1.55 | 8 | 3 | 0 | Y | TPQAPTTEI | 41.6 | TPQAPTSEI | 39.54 | TPQAPSTEI | 18.44 | | |
| E | 446 | 1.55 | 8 | 3 | 0 | Y | PQAPTTEIQ | 41.6 | PQAPTSEIQ | 39.54 | PQAPSTEIQ | 18.44 | | |
| E | 447 | 1.54 | 7 | 3 | 0 | Y | QAPTTEIQL | 41.69 | QAPTSEIQL | 39.54 | QAPSTEIQL | 18.44 | | |
| E | 448 | 1.57 | 11 | 3 | 0 | Y | APTTEIQLT | 41.6 | APTSEIQLT | 39.29 | APSTEIQLT | 18.44 | | |
| E | 449 | 1.58 | 12 | 3 | 0 | Y | PTTEIQLTD | 41.52 | PTSEIQLTD | 39.29 | PSTEIQLTD | 18.44 | | |
| E | 450 | 1.58 | 12 | 3 | 0 | Y | TTEIQLTDY | 41.52 | TSEIQLTDY | 39.29 | STEIQLTDY | 18.44 | | |
| E | 451 | 1.04 | 10 | 2 | 0 | Y | TEIQLTDYG | 60.05 | SEIQLTDYG | 39.29 | | | | |
| E | 452 | 0.22 | 9 | 2 | 0 | Y | EIQLTDYGA | 97.44 | EIQLTDYGT | 1.41 | EIQLTDYGV | 0.58 | | |
| E | 453 | 0.22 | 9 | 2 | 0 | Y | IQLTDYGAL | 97.44 | IQLTDYGTL | 1.41 | IQLTDYGVL | 0.58 | | |
| E | 454 | 0.24 | 11 | 2 | 0 | Y | QLTDYGALT | 97.27 | QLTDYGTLT | 1.41 | QLTDYGVLT | 0.58 | | |
| E | 455 | 0.24 | 11 | 2 | 0 | Y | LTDYGALTL | 97.27 | LTDYGTLTL | 1.41 | LTDYGVLTL | 0.58 | | |
| E | 456 | 0.24 | 11 | 2 | 0 | Y | TDYGALTLD | 97.27 | TDYGTLTLD | 1.41 | TDYGVLTLD | 0.58 | | |
| E | 457 | 0.2 | 7 | 2 | 0 | Y | DYGALTLDC | 97.68 | DYGTLTLDC | 1.41 | | | | |
| E | 458 | 0.19 | 6 | 2 | 0 | Y | YGALTLDCS | 97.77 | YGTLTLDCS | 1.41 | | | | |
| E | 459 | 0.19 | 6 | 2 | 0 | Y | GALTLDCSP | 97.77 | GTLTLDCSP | 1.41 | | | | |
| E | 460 | 0.19 | 6 | 2 | 0 | Y | ALTLDCSPR | 97.77 | TLTLDCSPR | 1.41 | | | | |
| E | 461 | 0.04 | 5 | 1 | 0 | Y | LTLDCSPRT | 99.67 | | | | | | |
| E | 462 | 0.04 | 5 | 1 | 0 | Y | TLDCSPRTG | 99.67 | | | | | | |
| E | 463 | 0.02 | 3 | 1 | 0 | Y | LDCSPRTGL | 99.83 | | | | | | |

FIG. 3-18

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|

FIG. 3-19

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
|

FIG. 3-21

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 549 | 0.14 | 8 | 2 | 0 | Y | EIQTSGTTT | 98.59 | EIQTGTTT | 0.41 | | | | |
| E | 550 | 0.14 | 8 | 2 | 0 | Y | IQTSGTTTI | 98.59 | I

FIG. 3-22

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG. 3-23

Species: DENV1 (9-MERS)

| protein | block starting position | block entropy | total peptides in block | peptides required to cover 99% of block | gap/X fraction | 99% of block covered w/ <=5 peptides? | block to cover 99% | frequency | block to cover 99% | frequency | block to cover 99% | frequency | block to cover 99% | frequency |
|---|---|---|---|---|---|---|---|---|---|---|---|---|---|---|
| E | 602 | 0.94 | 9 | 3 | 0 | Y | VQIKYEGTD | 73.53 | VQIKYEGTD | 25.14 | | | | |
| E | 603 | 0.96 | 9 | 3 | 0 | Y | QIKYEGTDA | 73.28 | QIKYEGTDA | 25.23 | | | | |
| E | 604 | 0.96 | 9 | 3 | 0 | Y | IKYEGTDAP | 73.28 | VKYEGTDAP | 25.23 | | | | |
| E | 605 | 0.14 | 6 | 2 | 0 | Y | KYEGTDAPC | 98.51 | RYEGTDAPC | 0.83 | | | | |
| E | 606 | 0.07 | 5 | 1 | 0 | Y | YEGTDAPCK | 99.34 | | | | | | |
| E | 607 | 0.08 | 6 | 1 | 0 | Y | EGTDAPCKI | 99.26 | | | | | | |
| E | 608 | 0.08 | 6 | 1 | 0 | Y | GTDAPCKIP | 99.26 | | | | | | |
| E | 609 | 0.1 | 7 | 1 | 0 | Y | TDAPCKIPF | 99.09 | | | | | | |
| E | 610 | 0.34 | 8 | 2 | 0 | Y | DAPCKIPFS | 94.95 | DAPCKIPFL | 4.3 | | | | |
| E | 611 | 0.7 | 11 | 4 | 0 | Y | APCKIPFST | 89.41 | APCKIPFLT | 4.3 | APCKIPFSS | 3.14 | APCKIPFSA | 2.23 |
| E | 612 | 0.68 | 10 | 4 | 0 | Y | PCKIPFSTQ | 89.66 | PCKIPFLTQ | 4.3 | PCKIPFSSQ | 3.14 | PCKIPFSAQ | 2.23 |
| E | 613 | 0.7 | 11 | 4 | 0 | Y | CKIPFSTQD | 89.41 | CKIPFLTQD | 4.3 | CKIPFSSQD | 3.14 | CKIPFSAQD | 2.23 |
| E | 614 | 0.76 | 12 | 5 | 0 | Y | KIPFSTQDE | 88.75 | KIPFLTQDE | 4.3 | KIPFSSQDE | 3.14 | KIPFSAQDE | 2.23 |
| E | 620 | 0.44 | 9 | 5 | 0.17 | Y | QDEKGVTQN | 94.46 | QDEKGVIQN | 1.9 | QDEKGATQN | 1.49 | QDGKGVTQN | 0.66 |
| E | 621 | 0.44 | 9 | 5 | 0.17 | Y | DEKGVTQNG | 94.29 | DEKGVIQNG | 1.9 | DEKGATQNG | 1.49 | DGKGVTQNG | 0.66 |
| E | 622 | 0.42 | 8 | 5 | 0.17 | Y | EKGVTQNGR | 94.54 | EKGVIQNGR | 1.9 | EKGATQNGR | 1.49 | GKGVTQNGR | 0.66 |
| E | 623 | 0.44 | 9 | 5 | 0.17 | Y | KGVTQNGRL | 94.38 | KGVIQNGRL | 1.82 | KGATQNGRL | 1.49 | KGVTQNGRL | 0.83 |
| E | 624 | 0.48 | 10 | 5 | 0.17 | Y | GVTQNGRLI | 93.8 | GVIQNGRLI | 1.82 | GATQNGRLI | 1.41 | GVTQNGRLV | 1.24 |
| E | 625 | 0.48 | 10 | 5 | 0.17 | Y | VTQNGRLIT | 93.8 | VIQNGRLIT | 1.82 | ATQNGRLIT | 1.41 | VTQNGRLVT | 1.24 |
| E | 626 | 0.35 | 9 | 4 | 0.17 | Y | TQNGRLITA | 95.45 | IQNGRLITA | 1.82 | TQNGRLVTA | 1.32 | TQNGRVITA | 0.83 |
| E | 627 | 0.21 | 7 | 3 | 0.17 | Y | QNGRLITAN | 97.27 | QNGRLVTAN | 1.32 | QNGRVITAN | 0.91 | | |
| E | 628 | 0.21 | 7 | 3 | 0.17 | Y | NGRLITANP | 97.27 | NGRLVTANP | 1.32 | NGRVITANP | 0.91 | | |
| E | 629 | 0.22 | 6 | 3 | 0.17 | Y | GRLITANPI | 97.19 | GRLVTANPI | 1.32 | GRVITANPI | 0.91 | | |
| E | 630 | 0.23 | 7 | 3 | 0 | Y | RLITANPIV | 97.27 | RLVTANPIV | 1.32 | RVITANPIV | 0.91 | | |
| E | 631 | 0.26 | 9 | 3 | 0 | Y | LITANPIVT | 97.02 | LVTANPIVT | 1.32 | VITANPIVT | 0.91 | | |
| E | 632 | 0.19 | 9 | 2 | 0 | Y | ITANPIVTD | 97.93 | VITANPIVTD | 1.32 | | | | |

FIG. 3-24

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| E | 633 | 0.13 | 10 | 2 | 0 | Y | TANPIVTDK | 98.84 | TANPIVTDR | 0.33 | | | | | | |
| E | 634 | 0.2 | 12 | 3 | 0 | Y | ANPIVTDKE | 98.01 | ANPIVTDKD | 0.74 | ANPIVTDRE | 0.33 | | | | |
| E | 635 | 0.18 | 10 | 3 | 0 | Y | NPIVTDKEK | 98.18 | NPIVTDKDK | 0.74 | NPIVTDREK | 0.33 | | | | |
| E | 636 | 0.2 | 11 | 3 | 0 | Y | PIVTDKEKP | 98.01 | PIVTDKDKP | 0.74 | PIVTDREKP | 0.33 | | | | |
| E | 637 | 0.22 | 12 | 4 | 0 | Y | IVTDKEKPV | 97.77 | IVTDKDKPV | 0.74 | IVTDKEKPI | 0.33 | IVTDKEKPI | 0.25 | | |
| E | 638 | 0.22 | 13 | 4 | 0 | Y | VTDKEKPVN | 97.77 | VTDKDKPVN | 0.74 | VTDKEKPVN | 0.33 | VTDKEKPIN | 0.25 | | |
| E | 639 | 0.21 | 12 | 4 | 0 | Y | TDKEKPVNI | 97.85 | TDKDKPVNI | 0.74 | TDKEKPVNI | 0.33 | TDKEKPINI | 0.25 | | |
| E | 640 | 0.19 | 10 | 3 | 0 | Y | DKEKPVNIE | 98.1 | DKDKPVNIE | 0.74 | DREKPVNIE | 0.33 | | | | |
| E | 641 | 0.91 | 12 | 4 | 0 | Y | KEKPVNIEA | 77.67 | KEKPVNIET | 20.43 | KDKPVNIEA | 0.74 | REKPVNIEA | 0.33 | | |
| E | 642 | 0.87 | 10 | 3 | 0 | Y | EKPVNIEAE | 78.08 | EKPVNIETE | 20.43 | DKPVNIEAE | 0.74 | | | | |
| E | 643 | 0.8 | 8 | 2 | 0 | Y | KPVNIEAEP | 78.91 | KPVNIETEP | 20.43 | | | | | | |
| E | 644 | 0.8 | 8 | 2 | 0 | Y | PVNIEAEPP | 78.91 | PVNIETEPP | 20.43 | | | | | | |
| E | 645 | 0.79 | 7 | 2 | 0 | Y | VNIEAEPPF | 79.07 | VNIETEPPF | 20.43 | | | | | | |
| E | 646 | 0.76 | 5 | 2 | 0 | Y | NIEAEPPFG | 79.24 | NIETEPPFG | 20.51 | | | | | | |
| E | 647 | 0.75 | 4 | 2 | 0 | Y | IEAEPPFGE | 79.32 | IETEPPFGE | 20.51 | | | | | | |
| E | 648 | 0.75 | 4 | 2 | 0 | Y | EAEPPFGES | 79.32 | ETEPPFGES | 20.51 | | | | | | |
| E | 649 | 0.77 | 5 | 2 | 0 | Y | AEPPFGESY | 79.16 | TEPPFGESY | 20.51 | | | | | | |
| E | 650 | 0.05 | 5 | 1 | 0 | Y | EPPFGESYI | 99.5 | | | | | | | | |
| E | 651 | 0.41 | 9 | 3 | 0 | Y | PPFGESYII | 93.96 | PPFGESYIV | 4.71 | PPFGESYIT | 0.41 | | | | |
| E | 652 | 1.2 | 11 | 5 | 0 | Y | PFGESYIVI | 70.39 | PFGESYIVV | 23.57 | PFGESYIII | 4.14 | PFGESYIIV | 0.58 | PFGESYITI | 0.41 |
| E | 653 | 1.19 | 10 | 5 | 0 | Y | FGESYIVIG | 70.47 | FGESYIVWG | 23.57 | FGESYIIIG | 4.14 | FGESYIIVG | 0.58 | FGESYITIG | 0.41 |
| E | 660 | 1.08 | 13 | 4 | 0 | Y | IGAGEKALK | 72.21 | VGAGEKALK | 24.4 | IGVGEKALK | 1.82 | IGAGEKTLK | 0.58 | | |
| E | 661 | 0.3 | 11 | 3 | 0 | Y | GAGEKALKL | 96.44 | GVGEKALKL | 1.9 | GAGEKTLKL | 0.74 | | | | |
| E | 662 | 0.31 | 12 | 3 | 0 | Y | AGEKALKLS | 96.36 | VGEKALKLS | 1.9 | AGEKTLKLS | 0.74 | | | | |
| E | 663 | 0.16 | 10 | 2 | 0 | Y | GEKALKLSW | 98.35 | GEKTLKLSW | 0.74 | | | | | | |
| E | 664 | 0.18 | 11 | 3 | 0 | Y | EKALKLSWF | 98.18 | EKTLKLSWF | 0.74 | EEALKLSWF | 0.17 | | | | |

FIG. 3-25

Species: DENV1 (9-MERS)

| protein | block starting position | block entropy | total peptides in block | peptides required to cover 99% of block | gap/X fraction | 99% of block covered w/ <= 5 peptides? | block (to cover 99% of block) | frequency | block (to cover 99% of block) | frequency | block (to cover 99% of block) | frequency | block (to cover 99% of block) | frequency |
|---|---|---|---|---|---|---|---|---|---|---|---|---|---|---|
| E | 665 | 0.19 | 11 | 3 | 0 | Y | KALKLSWFK | 98.1 | KTLKLSWFK | 0.74 | KALKLSWFR | 0.25 | | |
| E | 666 | 0.28 | 11 | 3 | 0 | Y | ALKLSWFKK | 96.69 | ALKLSWFKR | 1.65 | TLKLSWFKK | 0.74 | | |
| E | 667 | 0.22 | 10 | 2 | 0 | Y | LKLSWFKKG | 97.44 | LKLSWFKRG | 1.65 | | | | |
| E | 668 | 0.21 | 9 | 2 | 0 | Y | KLSWFKKGS | 97.52 | KLSWFKRGS | 1.65 | | | | |
| E | 669 | 0.29 | 8 | 4 | 0 | Y | LSWFKKGSS | 96.61 | LSWFKRGSS | 1.65 | LSWFKKGST | 0.66 | LSWFKKGSN | 0.25 |
| E | 670 | 0.29 | 10 | 4 | 0 | Y | SWFKKGSSI | 96.61 | SWFKRGSSI | 1.65 | SWFKKGSTI | 0.66 | SWFKKGSNI | 0.25 |
| E | 671 | 0.26 | 10 | 3 | 0 | Y | WFKKGSSIG | 96.86 | WFKRGSSIG | 1.74 | WFKKGSTIG | 0.66 | | |
| E | 672 | 0.29 | 7 | 3 | 0 | Y | FKKGSSIGK | 96.61 | FKRGSSIGK | 1.74 | FKKGSTIGK | 0.66 | | |
| E | 673 | 0.29 | 9 | 3 | 0 | Y | KKGSSIGKM | 96.77 | KRGSSIGKM | 1.74 | KKGSTIGKM | 0.66 | | |
| E | 674 | 0.27 | 8 | 3 | 0 | Y | KGSSIGKMF | 96.77 | RGSSIGKMF | 1.74 | KGSTIGKMF | 0.74 | | |
| E | 675 | 0.27 | 8 | 3 | 0 | Y | GSSIGKMFE | 98.18 | GSTIGKMFE | 0.74 | GSNIGKMFE | 0.25 | | |
| E | 676 | 0.18 | 9 | 3 | 0 | Y | SSIGKMFEA | 98.1 | STIGKMFEA | 0.74 | SNIGKMFEA | 0.25 | | |
| E | 677 | 0.19 | 10 | 4 | 0 | Y | SIGKMFEAT | 97.93 | STIGKMFEAT | 0.74 | SIGKMFVAT | 0.25 | NIGKMFEAT | 0.25 |
| E | 678 | 0.21 | 12 | 2 | 0 | Y | IGKMFEATA | 98.92 | IGKMFVATA | 0.25 | | | | |
| E | 679 | 0.12 | 10 | 2 | 0 | Y | GKMFEATAR | 98.92 | GKMFVATAR | 0.25 | | | | |
| E | 680 | 0.12 | 10 | 2 | 0 | Y | KMFEATARG | 98.92 | KMFVATARG | 0.25 | | | | |
| E | 681 | 0.12 | 10 | 1 | 0 | Y | MFEATARGA | 99.01 | | | | | | |
| E | 682 | 0.11 | 10 | 1 | 0 | Y | FEATARGAR | 99.01 | | | | | | |
| E | 683 | 0.11 | 8 | 1 | 0 | Y | EATARGARR | 99.26 | | | | | | |
| E | 684 | 0.08 | 7 | 1 | 0 | Y | ATARGARRM | 99.5 | | | | | | |
| E | 685 | 0.06 | 6 | 1 | 0 | Y | TARGARRMA | 99.59 | | | | | | |
| E | 686 | 0.05 | 4 | 1 | 0 | Y | ARGARRMAI | 99.75 | | | | | | |
| E | 687 | 0.03 | 4 | 1 | 0 | Y | RGARRMAIL | 99.75 | | | | | | |
| E | 688 | 0.03 | 4 | 1 | 0 | Y | GARRMAILG | 99.75 | | | | | | |
| E | 689 | 0.04 | 5 | 1 | 0 | Y | ARRMAILGD | 99.67 | | | | | | |
| E | 690 | 0.04 | 5 | 1 | 0 | Y | RRMAILGDT | 99.67 | | | | | | |

FIG. 3-26

Species: DENV1 (9-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency | block to cover 99% of | frequency |
|---|---|---|---|---|---|---|---|---|---|---|---|---|---|---|---|---|
| E | 691 | 0.04 | 5 | 1 | 0 | Y | RMAILGDTA | 99.67 | | | | | | | | |
| E | 692 | 0.04 | 5 | 1 | 0 | Y | MAILGDTAW | 99.67 | | | | | | | | |
| E | 693 | 0.03 | 4 | 1 | 0 | Y | AILGDTAWD | 99.75 | | | | | | | | |
| E | 694 | 0.03 | 4 | 1 | 0 | Y | ILGDTAWDF | 99.75 | | | | | | | | |
| E | 695 | 0.03 | 4 | 1 | 0 | Y | LGDTAWDFG | 99.75 | | | | | | | | |
| E | 696 | 0.03 | 4 | 1 | 0 | Y | GDTAWDFGS | 99.75 | | | | | | | | |
| E | 697 | 0.29 | 7 | 2 | 0 | Y | DTAWDFGSI | 95.7 | DTAWDFGSV | 3.89 | | | | | | |
| E | 698 | 0.28 | 6 | 2 | 0 | Y | TAWDFGSIG | 95.78 | TAWDFGSVG | 3.89 | | | | | | |
| E | 699 | 0.27 | 5 | 2 | 0 | Y | AWDFGSIGG | 95.86 | AWDFGSVGG | 3.89 | | | | | | |
| E | 700 | 0.37 | 6 | 3 | 0 | Y | WDFGSIGGV | 94.62 | WDFGSVGGV | 3.89 | WDFGSIGGL | 0.99 | | | | |
| E | 701 | 0.38 | 7 | 3 | 0 | Y | DFGSIGGVF | 94.54 | DFGSVGGVF | 3.89 | DFGSIGGLF | 0.99 | | | | |
| E | 702 | 0.39 | 8 | 3 | 0 | Y | FGSIGGVFT | 94.46 | FGSVGGVFT | 3.89 | FGSIGGLFT | 0.99 | | | | |
| E | 703 | 0.39 | 8 | 3 | 0 | Y | GSIGGVFTS | 94.46 | GSVGGVFTS | 3.89 | GSIGGLFTS | 0.99 | | | | |
| E | 706 | 0.39 | 8 | 5 | 0 | Y | GGVFTSYGK | 95.29 | GGVFTSIGK | 1.24 | GGLFTSVGK | 0.99 | GGVFTSMGK | 0.99 | GGVFTSAGK | 0.99 |
| E | 707 | 0.41 | 11 | 5 | 0 | Y | GVFTSYGKL | 95.12 | GVFTSIGKL | 1.16 | GLFTSVGKL | 0.99 | GVFTSAGKL | 0.99 | GVFTSMGKL | 0.99 |
| E | 709 | 0.52 | 11 | 5 | 0 | Y | FTSYGKLIH | 92.89 | FTSIGKLIH | 3.47 | FTSVGKLIH | 1.16 | FTSMGKLVH | 0.99 | FTSAGKLVH | 0.99 |
| E | 710 | 0.52 | 10 | 5 | 0 | Y | TSYGKLVHQ | 92.97 | TSIGKLVHQ | 3.47 | TSVGKLVHQ | 1.16 | TSAGKLVHQ | 0.99 | TSMGKLVHQ | 0.99 |
| E | 713 | 1 | 8 | 4 | 0 | Y | GKLVHQIFG | 75.77 | GKLVHQYFG | 20.43 | GKLIHQIFG | 2.56 | GKLIHQYFG | 0.91 | | |
| E | 714 | 1.16 | 12 | 5 | 0 | Y | KLVHQIFGT | 75.35 | KLVHQYFGT | 17.95 | KLIHQIFGT | 2.56 | KLVHQYFGA | 2.48 | KLIHQYFGT | 0.83 |
| E | 715 | 1.16 | 12 | 5 | 0 | Y | LVHQIFGTA | 75.35 | LVHQYFGTA | 17.95 | LIHQIFGTA | 2.56 | LVHQYFGAA | 2.48 | LIHQYFGTA | 0.83 |
| E | 716 | 1.14 | 10 | 4 | 0 | Y | VHQIFGTAY | 75.52 | VHQYFGTAY | 17.95 | IHQIFGTAY | 2.56 | VHQYFGAAY | 2.48 | IHQYFGTAY | 0.83 |
| E | 717 | 0.92 | 7 | 3 | 0 | Y | HQIFGTAYG | 78 | HQYFGTAYG | 18.86 | HQVFGAAYG | 2.56 | | | | |
| E | 718 | 0.93 | 8 | 3 | 0 | Y | QIFGTAYGV | 77.92 | QYFGTAYGV | 18.86 | QVFGAAYGV | 2.56 | | | | |
| E | 719 | 0.93 | 8 | 3 | 0 | Y | IFGTAYGVL | 77.92 | YFGTAYGVL | 18.86 | VFGAAYGVL | 2.56 | | | | |
| E | 720 | 0.23 | 6 | 2 | 0 | Y | FGTAYGVLF | 96.77 | FGAAYGVLF | 2.89 | | | | | | |
| E | 721 | 0.23 | 6 | 2 | 0 | Y | GTAYGVLFS | 96.77 | GAAYGVLFS | 2.89 | | | | | | |

FIG. 3-27

Species: DENV1 (9-MERS)

| protein | block starting position | block entropy | total peptides in block | peptides required to cover 99% of block | gap/X fraction | 99% of block covered w/ <=5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| E | 722 | 0.23 | 6 | 2 | 0 | Y | TAYGVLFSG | 96.77 | AAYGVLFSG | 2.89 | | | | |
| E | 723 | 0.03 | 4 | 1 | 0 | Y | AYGVLFSGV | 99.75 | | | | | | |
| E | 724 | 0.03 | 4 | 1 | 0 | Y | YGVLFSGVS | 99.75 | | | | | | |
| E | 725 | 0.03 | 4 | 1 | 0 | Y | GVLFSGVSW | 99.75 | | | | | | |
| E | 726 | 0.04 | 5 | 1 | 0 | Y | VLFSGVSWT | 99.67 | | | | | | |
| E | 727 | 0.03 | 4 | 1 | 0 | Y | LFSGVSWTM | 99.75 | | | | | | |
| E | 728 | 0.02 | 3 | 1 | 0 | Y | FSGVSWTMK | 99.83 | | | | | | |
| E | 729 | 0.04 | 5 | 1 | 0 | Y | SGVSWTMKI | 99.67 | | | | | | |
| E | 730 | 0.05 | 6 | 1 | 0 | Y | GVSWTMKIG | 99.59 | | | | | | |
| E | 731 | 0.12 | 7 | 2 | 0 | Y | VSWTMKIGI | 98.68 | VSWTMKIGL | 0.91 | | | | |
| E | 732 | 0.12 | 7 | 2 | 0 | Y | SWTMKIGIG | 98.68 | SWTMKIGLG | 0.91 | | | | |
| E | 733 | 0.94 | 9 | 3 | 0 | Y | WTMKIGIGV | 73.78 | WTMKIGIGI | 24.73 | WTMKIGLGV | 0.91 | | |
| E | 734 | 0.94 | 9 | 3 | 0 | Y | TMKIGIGVL | 73.78 | TMKIGIGIL | 24.81 | TMKIGLGVL | 0.91 | | |
| E | 735 | 0.95 | 8 | 3 | 0 | Y | MKIGIGVLL | 73.53 | MKIGIGILL | 24.81 | MKIGLGVLL | 0.91 | | |
| E | 736 | 0.95 | 8 | 3 | 0 | Y | KIGIGVLLT | 73.53 | KIGIGILLT | 24.81 | KIGLGVLLT | 0.91 | | |
| E | 737 | 0.95 | 8 | 3 | 0 | Y | IGIGVLLTW | 73.53 | IGIGILLTW | 24.81 | IGLGVLLTW | 0.91 | | |
| E | 738 | 0.94 | 8 | 3 | 0 | Y | GIGVLLTWL | 73.61 | GIGILLTWL | 24.9 | GLGVLLTWL | 0.91 | | |
| E | 739 | 0.94 | 6 | 3 | 0 | Y | IGVLLTWLG | 73.61 | IGILLTWLG | 24.9 | LGVLLTWLG | 0.91 | | |
| E | 740 | 0.89 | 6 | 2 | 0 | Y | GVLLTWLGL | 74.44 | GILLTWLGL | 24.73 | | | | |
| E | 741 | 0.89 | 7 | 2 | 0 | Y | VLLTWLGLN | 74.44 | ILLTWLGLN | 24.73 | | | | |
| E | 742 | 0.07 | 5 | 1 | 0 | Y | LLTWLGLNS | 99.34 | | | | | | |
| E | 743 | 0.07 | 5 | 1 | 0 | Y | LTWLGLNSR | 99.34 | | | | | | |
| E | 744 | 0.12 | 5 | 2 | 0 | Y | TWLGLNSRS | 98.68 | TWLGLNSRN | 0.99 | | | | |
| E | 745 | 0.21 | 7 | 3 | 0 | Y | WLGLNSRST | 97.52 | WLGLNSRSA | 0.99 | WLGLNSRNT | 0.99 | | |
| E | 746 | 0.21 | 7 | 3 | 0 | Y | LGLNSRSTS | 97.52 | LGLNSRSAS | 0.99 | LGLNSRNTS | 0.99 | | |
| E | 747 | 0.32 | 8 | 4 | 0 | Y | GLNSRSTSL | 96.11 | GLNSRSTSF | 1.41 | GLNSRNTSL | 0.99 | GLNSRSASL | 0.99 |

FIG. 3-28

Species: DENV1 (9-MERS)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| E | 748 | 0.32 | 8 | 4 | 0 | Y | LNSRSTSLS | 96.11 | LNSRSTSFS | 1.41 | LNSRSASLS | 0.99 | LNSRNTSLS | 0.99 |
| E | 749 | 0.3 | 7 | 4 | 0 | Y | NSRSTSLSM | 96.36 | NSRSTSFSM | 1.41 | NSRSASLSM | 0.99 | NSRNTSLSV | 0.74 |
| E | 750 | 0.3 | 8 | 4 | 0 | Y | SRSTSLSMT | 96.36 | SRSTSFSMT | 1.41 | SRSASLSMT | 0.99 | SRNTSLSVM | 0.74 |
| E | 751 | 0.3 | 8 | 4 | 0 | Y | RSTSLSMTC | 96.36 | RSTSFSMTC | 1.41 | RSASLSMTC | 0.99 | RNTSLSVMC | 0.74 |
| E | 752 | 0.31 | 8 | 4 | 0 | Y | STSLSMTCI | 96.28 | STSFSMTCI | 1.41 | SASLSMTCI | 0.99 | NTSLSVMCI | 0.74 |
| E | 753 | 0.37 | 9 | 5 | 0 | Y | TSLSMTCIA | 95.62 | TSFSMTCIA | 1.32 | ASLSMTCIA | 0.99 | TSLSMTCIV | 0.74 |
| E | 754 | 0.27 | 8 | 4 | 0 | Y | SLSMTCIAV | 96.77 | SFSMTCIAV | 1.32 | SLSVMCIAV | 0.74 | SLSMTCIVV | 0.74 |
| E | 755 | 0.27 | 8 | 4 | 0 | Y | LSMTCIAVG | 96.77 | FSMTCIAVG | 1.32 | LSVMCIAVG | 0.74 | LSMTCIVVG | 0.74 |
| E | 756 | 0.95 | 9 | 4 | 0 | Y | SMTCIAVGL | 75.1 | SMTCIAVGM | 22.99 | SVMCIAVGM | 0.74 | SMTCIVVGM | 0.5 |
| E | 757 | 1.04 | 11 | 5 | 0 | Y | MTCIAVGLV | 73.95 | MTCIAVGMV | 22.91 | MTCIAVGLI | 1.16 | VMCIAVGMV | 0.74 |
| E | 758 | 1.04 | 10 | 5 | 0 | Y | TCIAVGLVT | 73.95 | TCIAVGMVT | 22.91 | TCIAVGLIT | 1.16 | MCIAVGMVT | 0.91 |
| E | 759 | 0.98 | 9 | 4 | 0 | Y | CIAVGLVTL | 73.95 | CIAVGMVTL | 23.82 | CIAVGLITL | 1.16 | CIVVGMVTL | 0.5 |
| E | 760 | 0.98 | 9 | 4 | 0 | Y | IAVGLVTLY | 73.95 | IAVGMVTLY | 23.82 | IAVGLITLY | 1.16 | IVVGMVTLY | 0.5 |
| E | 761 | 0.97 | 8 | 3 | 0 | Y | AVGLVTLYL | 73.95 | AVGMVTLYL | 23.9 | AVGLITLYL | 1.16 | | |
| E | 762 | 0.91 | 5 | 3 | 0 | Y | VGLVTLYLG | 74.19 | VGMVTLYLG | 24.48 | VGLITLYLG | 1.16 | | |
| E | 763 | 0.95 | 6 | 3 | 0 | Y | GLVTLYLGV | 73.7 | GMVTLYLGV | 24.48 | GLITLYLGV | 1.16 | | |
| E | 764 | 0.98 | 8 | 4 | 0 | Y | LVTLYLGVM | 73.7 | MVTLYLGVM | 24.07 | LITLYLGVM | 1.16 | LVTLYLGAM | 0.5 |
| E | 765 | 0.19 | 5 | 2 | 0 | Y | VTLYLGVMV | 97.77 | ITLYLGVMV | 1.24 | | | | |
| E | 766 | 0.12 | 5 | 2 | 0 | Y | TLYLGVMVQ | 98.76 | TLYLGAMVQ | 0.5 | | | | |
| E | 767 | 0.12 | 5 | 2 | 0 | Y | LYLGVMVQA | 98.76 | LYLGAMVQA | 0.5 | | | | |
| E | 768 | 0.12 | 5 | 2 | 0 | Y | YLGVMVQAD | 98.76 | YLGAMVQAD | 0.5 | | | | |
| E | 769 | 0.13 | 6 | 2 | 0 | Y | LGVMVQADS | 98.68 | LGAMVQADS | 0.5 | | | | |
| E | 770 | 0.13 | 6 | 2 | 0 | Y | GVMVQADSG | 98.68 | GAMVQADSG | 0.5 | | | | |
| E | 771 | 0.13 | 6 | 2 | 0 | Y | VMVQADSGC | 98.68 | AMVQADSGC | 0.5 | | | | |
| E | 772 | 0.1 | 6 | 1 | 0 | Y | MVQADSGCV | 99.01 | | | | | | |
| E | 773 | 0.12 | 5 | 2 | 0 | Y | VQADSGCVI | 98.68 | VQADSGCVV | 0.83 | | | | |

FIG. 3-29

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|

FIG. 3-30

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 800 | 0.04 | 5 | 1 | 0 | Y | VHTWTEQYK | 99.67 | | | | | | |
| NS1 | 801 | 0.03 | 4 | 1 | 0 | Y | HTWTEQYKF | 99.75 | | | | | | |
| NS1 | 802 | 0.02 | 3 | 1 | 0 | Y | TWTEQYKFQ | 99.83 | | | | | | |
| NS1 | 803 | 0.03 | 4 | 1 | 0 | Y | WTEQYKFQA | 99.75 | | | | | | |
| NS1 | 804 | 0.03 | 4 | 1 | 0 | Y | TEQYKFQAD | 99.75 | | | | | | |
| NS1 | 805 | 0.03 | 4 | 1 | 0 | Y | EQYKFQADS | 99.75 | | | | | | |
| NS1 | 806 | 0.02 | 3 | 1 | 0 | Y | QYKFQADSP | 99.83 | | | | | | |
| NS1 | 807 | 0.03 | 4 | 1 | 0 | Y | YKFQADSPK | 99.75 | | | | | | |
| NS1 | 808 | 0.05 | 6 | 1 | 0 | Y | KFQADSPKR | 99.59 | | | | | | |
| NS1 | 809 | 0.04 | 5 | 1 | 0 | Y | FQADSPKRL | 99.67 | | | | | | |
| NS1 | 810 | 0.04 | 5 | 1 | 0 | Y | QADSPKRLS | 99.67 | | | | | | |
| NS1 | 811 | 0.06 | 6 | 1 | 0 | Y | ADSPKRLSA | 99.5 | | | | | | |
| NS1 | 812 | 0.06 | 7 | 1 | 0 | Y | DSPKRLSAA | 99.5 | | | | | | |
| NS1 | 813 | 0.08 | 8 | 1 | 0 | Y | SPKRLSAAI | 99.34 | | | | | | |
| NS1 | 814 | 0.08 | 8 | 1 | 0 | Y | PKRLSAAIG | 99.34 | | | | | | |
| NS1 | 815 | 0.17 | 9 | 2 | 0 | Y | KRLSAAIGK | 98.1 | KRLSAAIGR | 1.24 | | | | |
| NS1 | 816 | 0.17 | 9 | 2 | 0 | Y | RLSAAIGKA | 98.1 | RLSAAIGRA | 1.24 | | | | |
| NS1 | 817 | 0.15 | 7 | 2 | 0 | Y | LSAAIGKAW | 98.26 | LSAAIGRAW | 1.24 | | | | |
| NS1 | 818 | 0.18 | 9 | 2 | 0 | Y | SAAIGKAWE | 98.01 | SAAIGRAWE | 1.24 | | | | |
| NS1 | 819 | 0.18 | 9 | 2 | 0 | Y | AAIGKAWEE | 98.01 | AAIGRAWEE | 1.24 | | | | |
| NS1 | 820 | 0.17 | 8 | 2 | 0 | Y | AIGKAWEEG | 98.1 | AIGRAWEEG | 1.24 | | | | |
| NS1 | 821 | 0.16 | 7 | 2 | 0 | Y | IGKAWEEGV | 98.18 | IGRAWEEGV | 1.24 | | | | |
| NS1 | 822 | 0.14 | 6 | 2 | 0 | Y | GKAWEEGVC | 98.35 | GRAWEEGVC | 1.24 | | | | |
| NS1 | 823 | 0.14 | 6 | 2 | 0 | Y | KAWEEGVCG | 98.35 | RAWEEGVCG | 1.24 | | | | |
| NS1 | 824 | 0.06 | 6 | 1 | 0 | Y | AWEEGVCGI | 99.42 | | | | | | |
| NS1 | 825 | 0.05 | 5 | 1 | 0 | Y | WEEGVCGIR | 99.5 | | | | | | |

FIG. 3-31

Species: DENV1 (9-MERS)

| protein | block starting position | block entropy | total peptides in block | peptides required to cover 99% of block | gap/X f

FIG. 3-32

Species: DENV1 (9-MERS)

| protein | block starting position | block entropy | total peptides in block | peptides required to cover 99% of block | gap/X fraction | 99% of block covered w/ =>5 peptides? | block | frequency | block | frequency | block | frequency | block | frequency |
|---|---|---|---|---|---|---|---|---|---|---|---|---|---|---|
| NS1 | 852 | 0.34 | 10 | 4 | 0 | Y | HILLENDMK | 95.86 | HILLENDMK | 1.65 | YILLENDMK | 1.16 | | |
| NS1 | 853 | 0.71 | 9 | 4 | 0 | Y | ILLENDMKF | 87.1 | ILLENDMKL | 9.93 | ILLENGMKF | 1.65 | HILLENDIK | 0.74 |
| NS1 | 854 | 0.71 | 9 | 4 | 0 | Y | LLENDMKFT | 87.1 | LLENDMKLT | 9.93 | LLENGMKFT | 1.65 | ILLENDIKF | 0.83 |
| NS1 | 855 | 0.71 | 9 | 4 | 0 | Y | LENDMKFTV | 87.1 | LENDMKLTV | 9.93 | LENGMKFTV | 1.65 | LLENDIKFT | 0.83 |
| NS1 | 856 | 0.71 | 9 | 4 | 0 | Y | ENDMKFTVV | 87.18 | ENDMKLTVV | 9.76 | ENGMKFTV | 1.65 | LENDIKFTV | 0.83 |
| NS1 | 857 | 0.71 | 9 | 4 | 0 | Y | NDMKFTVVV | 87.18 | NDMKLTVVV | 9.76 | NGMKFTVV | 1.65 | ENDIKFTVV | 0.83 |
| NS1 | 858 | 0.71 | 9 | 4 | 0 | Y | DMKFTVVVG | 87.18 | DMKLTVVVG | 9.76 | GMKFTVVG | 1.65 | NDIKFTVV | 0.83 |
| NS1 | 859 | 0.61 | 10 | 3 | 0 | Y | MKFTVVVGD | 88.67 | MKLTVVVGD | 9.84 | IKFTVVGD | 0.74 | DIKFTVVG | 0.83 |
| NS1 | 860 | 1.26 | 9 | 4 | 0 | Y | KFTVVVGDV | 70.06 | KFTVVVGDA | 18.86 | KLTVVGDV | 9.51 | KFTVVGNA | 0.83 |
| NS1 | 874 | 0.25 | 10 | 4 | 0.08 | Y | QGKKMIRPQ | 97.19 | QGKKTIRPQ | 1.08 | QGRKMIRPQ | 0.41 | QGKKMVRPQ | 0.41 |
| NS1 | 875 | 0.25 | 10 | 4 | 0.08 | Y | GKKMIRPQP | 97.19 | GKKTIRPQP | 1.08 | GRKMIRPQP | 0.41 | GKKMVRPQP | 0.41 |
| NS1 | 876 | 0.25 | 10 | 4 | 0 | Y | KKMIRPQPM | 97.27 | KKTIRPQPM | 1.08 | KKMVRPQPM | 0.41 | RKMIRPQPM | 0.41 |
| NS1 | 877 | 0.21 | 8 | 3 | 0 | Y | KMIRPQPME | 97.68 | KTIRPQPME | 1.08 | KMVRPQPME | 0.41 | MVRPQPMEH | 0.41 |
| NS1 | 878 | 1.18 | 9 | 4 | 0 | Y | MIRPQPMEY | 52.77 | MIRPQPMEH | 44.91 | TIRPQPMEH | 1.08 | | |
| NS1 | 879 | 1.19 | 7 | 3 | 0 | Y | IRPQPMEYK | 52.77 | IRPQPMEH | 44.25 | IRPQPMEHR | 2.23 | | |
| NS1 | 880 | 1.18 | 8 | 4 | 0 | Y | RPQPMEYKY | 52.69 | RPQPMEHKY | 44.58 | RPQPMEHRY | 2.23 | | |
| NS1 | 881 | 1.15 | 6 | 3 | 0 | Y | PQPMEYKYS | 52.69 | PQPMEHKYS | 44.83 | PQPMEHRYS | 2.23 | | |
| NS1 | 882 | 1.15 | 6 | 3 | 0 | Y | QPMEYKYSW | 52.69 | QPMEHKYSW | 44.83 | QPMEHRYSW | 2.23 | | |
| NS1 | 883 | 1.21 | 7 | 3 | 0 | Y | PMEYKYSWK | 51.94 | PMEHKYSWK | 44.83 | PMEHRYSWK | 2.23 | | |
| NS1 | 884 | 1.29 | 10 | 5 | 0 | Y | MEYKYSWKS | 51.12 | MEHKYSWKS | 44.67 | MEHRYSWKS | 2.23 | MEYKYSWRS | 0.74 | MEYKYSWKI | 0.74 |
| NS1 | 885 | 1.29 | 10 | 5 | 0 | Y | EYKYSWKSW | 51.12 | EHKYSWKSW | 44.67 | EHRYSWKSW | 2.23 | EYKYSWKIW | 0.74 | EYKYSWRSW | 0.74 |
| NS1 | 886 | 1.29 | 10 | 5 | 0 | Y | YKYSWKSWG | 51.12 | HKYSWKSWG | 44.67 | HRYSWKSWG | 2.23 | YKYSWRSWG | 0.74 | YKYSWKIWG | 0.74 |
| NS1 | 887 | 0.34 | 8 | 3 | 0 | Y | KYSWKSWGK | 95.7 | RYSWKSWGK | 2.23 | KYSWRSWGK | 0.74 | KYSWKIWGK | 0.74 |
| NS1 | 888 | 0.19 | 7 | 3 | 0 | Y | YSWKSWGKA | 97.93 | YSWRSWGKA | 0.74 | YSWKIWGKA | 0.74 | | |
| NS1 | 889 | 0.18 | 7 | 3 | 0 | Y | SWKSWGKAK | 98.01 | SWRSWGKAK | 0.74 | SWKIWGKAK | 0.74 | | |
| NS1 | 890 | 0.22 | 9 | 3 | 0 | Y | WKSWGKAKI | 97.68 | WRSWGKAKI | 0.74 | WKIWGKAKI | 0.74 | | |

FIG. 3-33

Species: DENV1 (9-MERS)

| protein | block starting position | block entropy | total peptides in block | peptides required to cover 99% of block | gap/X fraction | 99% of block covered w/ <= 5 peptides?

FIG. 3-34

Species: DENV1 (9-MERS)

| protein | block starting position | block entropy | total peptides in block | peptides required to cover 99% of block | gap/X fraction | 99% of block covered w/ <= 5 peptides? | block (99%) | frequency | block (99%) | frequency

FIG. 3-35

Species: DENV1 (9-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency |
|

FIG. 3-36

Species: DENV1 (9-MERS)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS1 | 983 | 0.23 | 12 | 4 | 0 | Y | ETWKLARAS | 97.68 | ETWKLARAS | 0.91 | ETWKLAGAS | 0.33 | ETWKLITRAS | 0.17 |
| NS1 | 984 | 0.22 | 12 | 3 | 0 | Y | TWKLARASF | 97.77 | TWKLARASF | 0.91 | TWKLAGASF | 0.33 | | |
| NS1 | 985 | 0.2 | 11 | 3 | 0 | Y | WKLARASFI | 97.93 | WKLARASFI | 0.91 | WKLAGASFI | 0.33 | | |
| NS1 | 986 | 0.2 | 11 | 3 | 0 | Y | KLARASFIE | 97.93 | KLARASFIE | 0.91 | KLAGASFIE | 0.33 | | |
| NS1 | 987 | 0.19 | 10 | 3 | 0 | Y | LARASFIEV | 98.01 | LARASFIEV | 0.91 | LAGASFIEV | 0.33 | | |
| NS1 | 988 | 0.19 | 10 | 3 | 0 | Y | ARASFIEVK | 98.01 | ARASFIEVK | 0.91 | AGASFIEVK | 0.33 | | |
| NS1 | 989 | 0.14 | 6 | 2 | 0 | Y | RASFIEVKT | 98.51 | RASFIEVKT | 0.91 | | | | |
| NS1 | 990 | 0.03 | 4 | 1 | 0 | Y | ASFIEVKTC | 99.75 | | | | | | |
| NS1 | 991 | 0.81 | 7 | 3 | 0 | Y | SFIEVKTCI | 82.8 | SFIEVKTCT | 13.73 | SFIEVKTCV | 3.14 | | |
| NS1 | 992 | 0.8 | 6 | 3 | 0 | Y | FIEVKTCIW | 82.88 | FIEVKTCTW | 13.73 | FIEVKTCVW | 3.14 | | |
| NS1 | 993 | 0.79 | 5 | 3 | 0 | Y | IEVKTCIWP | 82.96 | IEVKTCTWP | 13.73 | IEVKTCVWP | 3.14 | | |
| NS1 | 994 | 0.84 | 6 | 3 | 0 | Y | EVKTCIWPK | 82.38 | EVKTCTWPK | 13.73 | EVKTCVWPK | 3.14 | | |
| NS1 | 995 | 0.84 | 6 | 3 | 0 | Y | VKTCIWPKS | 82.38 | VKTCTWPKS | 13.73 | VKTCVWPKS | 3.14 | | |
| NS1 | 996 | 0.84 | 6 | 3 | 0 | Y | KTCIWPKSH | 82.38 | KTCTWPKSH | 13.73 | KTCVWPKSH | 3.14 | | |
| NS1 | 997 | 0.84 | 6 | 3 | 0 | Y | TCIWPKSHT | 82.38 | TCTWPKSHT | 13.73 | TCVWPKSHT | 3.14 | | |
| NS1 | 998 | 0.84 | 6 | 3 | 0 | Y | CIWPKSHTL | 82.38 | CTWPKSHTL | 13.73 | CVWPKSHTL | 3.14 | | |
| NS1 | 999 | 0.84 | 6 | 3 | 0 | Y | IWPKSHTLW | 82.38 | TWPKSHTLW | 13.73 | VWPKSHTLW | 3.14 | | |
| NS1 | 1000 | 0.05 | 2 | 1 | 0 | Y | WPKSHTLWS | 99.42 | | | | | | |
| NS1 | 1001 | 0.06 | 3 | 1 | 0 | Y | PKSHTLWSN | 99.34 | | | | | | |
| NS1 | 1002 | 0.06 | 3 | 1 | 0 | Y | KSHTLWSNG | 99.34 | | | | | | |
| NS1 | 1003 | 0.01 | 2 | 1 | 0 | Y | SHTLWSNGV | 99.92 | | | | | | |
| NS1 | 1004 | 0.03 | 4 | 1 | 0 | Y | HTLWSNGVL | 99.75 | | | | | | |
| NS1 | 1005 | 0.03 | 4 | 1 | 0 | Y | TLWSNGVLE | 99.75 | | | | | | |
| NS1 | 1006 | 0.03 | 4 | 1 | 0 | Y | LWSNGVLES | 99.75 | | | | | | |
| NS1 | 1007 | 0.03 | 4 | 1 | 0 | Y | WSNGVLESE | 99.75 | | | | | | |
| NS1 | 1008 | 0.03 | 4 | 1 | 0 | Y | SNGVLESEM | 99.75 | | | | | | |

FIG. 3-37

Species: DENV1 (9-MERS)

| protein | block starting position | block entropy | total peptides in block | peptides required to cover 99% of block | gap/X fraction | 99% of block covered w/ <= 5 peptides? | block (to cover 99%) | frequency | block (to cover 99%) | frequency | block (to cover 99%) | frequency | block (to cover 99%) | frequency |
|---|---|---|---|---|---|---|---|---|---|---|---|---|---|---|
| NS1 | 1009 | 0.14 | 5 | 2 | 0 | Y | NGVLESEMI | 98.26 | NGVLESEMV | 1.49 | |

FIG. 3-38

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG. 3-39

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS1 | 1062 | 0.2  | 8 | 3 | 0 | Y | VDEHCGNRG | 97.77 | VDEHCGSRG | 0.83 | VDEHCGYRG | 0.83 |
| NS1 | 1063 | 0.22 | 9 | 3 | 0 | Y | DEHCGNRGP | 97.6  | DEHCGSRGP | 0.83 | DEHCGYRGP | 0.83 |
| NS1 | 1064 | 0.22 | 9 | 3 | 0 | Y | EHCGNRGPS | 97.6  | EHCGYRGPS | 0.83 | EHCGSRGPS | 0.83 |
| NS1 | 1065 | 0.2  | 8 | 3 | 0 | Y | HCGNRGPSL | 97.77 | HCGSRGPSL | 0.83 | HCGYRGPSL | 0.83 |
| NS1 | 1066 | 0.18 | 6 | 3 | 0 | Y | CGNRGPSLR | 98.01 | CGYRGPSLR | 0.83 | CGSRGPSLR | 0.83 |
| NS1 | 1067 | 0.18 | 6 | 3 | 0 | Y | GNRGPSLRT | 98.01 | GYRGPSLRT | 0.83 | GSRGPSLRT | 0.83 |
| NS1 | 1068 | 0.18 | 6 | 3 | 0 | Y | NRGPSLRTT | 98.01 | SRGPSLRTT | 0.83 | YRGPSLRTT | 0.83 |
| NS1 | 1069 | 0.04 | 4 | 1 | 0 | Y | RGPSLRTTT | 99.67 | | | | |
| NS1 | 1070 | 0.05 | 5 | 1 | 0 | Y | GPSLRTTTV | 99.5  | | | | |
| NS1 | 1071 | 0.07 | 7 | 1 | 0 | Y | PSLRTTTVT | 99.42 | | | | |
| NS1 | 1072 | 0.05 | 6 | 1 | 0 | Y | SLRTTTVTG | 99.59 | | | | |
| NS1 | 1073 | 0.05 | 6 | 1 | 0 | Y | LRTTTVTGK | 99.59 | | | | |
| NS1 | 1074 | 0.14 | 8 | 2 | 0 | Y | RTTTVTGKI | 98.43 | RTTTVTGKT | 1.08 | | |
| NS1 | 1075 | 0.14 | 8 | 2 | 0 | Y | TTTVTGKII | 98.43 | TTTVTGKTI | 1.08 | | |
| NS1 | 1076 | 0.15 | 9 | 2 | 0 | Y | TTVTGKIIH | 98.35 | TTVTGKTIH | 1.08 | | |
| NS1 | 1077 | 0.14 | 8 | 2 | 0 | Y | TVTGKIIHE | 98.43 | TVTGKTIHE | 1.08 | | |
| NS1 | 1078 | 0.14 | 8 | 2 | 0 | Y | VTGKIIHEW | 98.43 | VTGKTIHEW | 1.08 | | |
| NS1 | 1079 | 0.13 | 7 | 2 | 0 | Y | TGKIIHEWC | 98.51 | TGKTIHEWC | 1.08 | | |
| NS1 | 1080 | 0.12 | 6 | 2 | 0 | Y | GKIIHEWCC | 98.59 | GKTIHEWCC | 1.08 | | |
| NS1 | 1081 | 0.12 | 6 | 2 | 0 | Y | KIIHEWCCR | 98.59 | KTIHEWCCR | 1.08 | | |
| NS1 | 1082 | 0.14 | 7 | 2 | 0 | Y | IIHEWCCRS | 98.43 | TIHEWCCRS | 1.08 | | |
| NS1 | 1083 | 0.05 | 5 | 1 | 0 | Y | IHEWCCRSC | 99.59 | | | | |
| NS1 | 1084 | 0.04 | 4 | 1 | 0 | Y | HEWCCRSCT | 99.67 | | | | |
| NS1 | 1085 | 0.02 | 2 | 1 | 0 | Y | EWCCRSCTL | 99.83 | | | | |
| NS1 | 1086 | 0.02 | 2 | 1 | 0 | Y | WCCRSCTLP | 99.83 | | | | |
| NS1 | 1087 | 0.02 | 2 | 1 | 0 | Y | CCRSCTLPP | 99.83 | | | | |

FIG. 3-40

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---

FIG. 3-41

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 1114 | 0.87 | 7 | 3 | 0 | Y | KEKEENLVK | 78

FIG. 3-42

Species: DENV1 (9-MERS)

| protein | block starting position | block entropy | total peptides in block | peptides required to cover 99% of block | gap/X fraction | 99% of block covered w/ <= 5 peptides? | peptides required to cover

FIG. 3-43

Species: DENV1 (9-MERS)

| protein | block starting position | block entropy | total peptides in block | peptides required to cover 99% of block | gap/X fraction | 99% of block covered w/ <= 5 peptides? | block (99% cover) | frequency | block | frequency | block | frequency | block | frequency |
|---|---|---|---|---|---|---|---|---|---|---|---|---|---|---|
| NS2A | 1185 | 0.24 | 9 | 3 | 0 | Y | IMVGANASD | 97.11 | IMVGANAFD | 1.65 | IMVGANYSD | 0.66 | | |
| NS2A | 1186 | 0.61 | 13 | 5 | 0 | Y | MVGANASDR | 91.81 | MVGANASDK | 3.56 | MVGANAFDR | 1.65 | MVGANASDN | 1.32 | MVGANYSDR | 0.66 |
| NS2A | 1187 | 0.61 | 13 | 5 | 0 | Y | VGANASDRM | 91.81 | VGANASDKM | 3.56 | VGANAFDRM | 1.65 | VGANASDNM | 1.32 | GANVSDRM | 0.66 |
| NS2A | 1188 | 0.6 | 12 | 5 | 0 | Y | GANASDRMG | 91.89 | GANASDKMG | 3.56 | GANAFDRMG | 1.65 | GANASDNMG | 1.32 | GANVSDRMG | 0.66 |
| NS2A | 1189 | 0.61 | 13 | 5 | 0 | Y | ANASDRMGM | 91.81 | ANASDKMGM | 3.56 | ANAFDRMG | 1.65 | ANASDNMGM | 1.32 | ANVSDRMGM | 0.66 |
| NS2A | 1190 | 0.61 | 13 | 5 | 0 | Y | NASDRMGMG | 91.81 | NASDKMGMG | 3.56 | NAFDRMGMG | 1.65 | NASDNMGMG | 1.32 | NVSDRMGMG | 0.66 |
| NS2A | 1192 | 0.63 | 11 | 5 | 0 | Y | SDRMGMGTT | 91.4 | SDKMGMGTT | 3.56 | FDRMGMGTT | 1.65 | SDNMGMGTT | 1.32 | SDRMGMGMT | 1.08 |
| NS2A | 1193 | 0.53 | 11 | 5 | 0 | Y | DRMGMGTTY | 92.89 | DKMGMGTTY | 3.56 | DNMGMGTTY | 1.32 | DRMGMGMTY | 1.08 | DRMGMGTTH | 0.33 |
| NS2A | 1194 | 0.53 | 8 | 5 | 0 | Y | RMGMGTTYL | 92.89 | KMGMGTTYL | 3.56 | NMGMGTTYL | 1.32 | RMGMGMTYL | 1.08 | RMGMGTTHL | 0.33 |
| NS2A | 1195 | 0.17 | 8 | 2 | 0 | Y | MGMGTTYLA | 98.1 | MGMGTYLA | 1.08 | | | | | | |
| NS2A | 1196 | 0.17 | 9 | 2 | 0 | Y | GMGTTYLAL | 98.1 | GMGTYLAL | 1.08 | | | | | | |
| NS2A | 1197 | 0.2 | 9 | 3 | 0 | Y | MGTTYLALM | 97.85 | MGMTYLALM | 1.08 | MGTTHLALM | 0.33 | | | | |
| NS2A | 1198 | 0.2 | 9 | 3 | 0 | Y | GTTYLALMA | 97.85 | GMTYLALMA | 1.08 | GTTHLALMA | 0.33 | | | | |
| NS2A | 1199 | 0.2 | 8 | 3 | 0 | Y | TTYLALMAT | 97.85 | MTYLALMAT | 1.08 | TTHLALMAT | 0.33 | | | | |
| NS2A | 1200 | 0.11 | 8 | 1 | 0 | Y | TYLALMATF | 99.01 | | | | | | | | |
| NS2A | 1201 | 0.3 | 8 | 2 | 0 | Y | YLALMATFK | 95.95 | YLALMATFR | 3.14 | | | | | | |
| NS2A | 1202 | 0.32 | 7 | 3 | 0 | Y | LALMATFKM | 95.62 | LALMATFRM | 3.14 | LALMATFKI | 0.66 | | | | |
| NS2A | 1203 | 0.32 | 7 | 3 | 0 | Y | ALMATFKMR | 95.62 | ALMATFRMR | 3.14 | ALMATFKIR | 0.66 | | | | |
| NS2A | 1204 | 0.31 | 8 | 3 | 0 | Y | LMATFKMRP | 95.7 | LMATFRMRP | 3.14 | LMATFKIRP | 0.66 | | | | |
| NS2A | 1205 | 0.31 | 7 | 3 | 0 | Y | MATFKMRPM | 95.7 | MATFRMRPM | 3.14 | MATFKIRPM | 0.66 | | | | |
| NS2A | 1206 | 0.41 | 8 | 4 | 0 | Y | ATFKMRPMF | 94.46 | ATFRMRPMF | 3.14 | ATFKMRPML | 1.24 | ATFKIRPMF | 0.66 | | |
| NS2A | 1207 | 0.4 | 7 | 4 | 0 | Y | TFKMRPMFA | 94.54 | TFRMRPMFA | 3.14 | TFKMRPMLA | 1.24 | TFKIRPMFA | 0.66 | | |
| NS2A | 1208 | 0.43 | 9 | 4 | 0 | Y | FKMRPMFAV | 94.29 | FRMRPMFAV | 3.14 | FKMRPMLAV | 1.24 | FKIRPMFAV | 0.66 | | |
| NS2A | 1209 | 0.42 | 8 | 4 | 0 | Y | KMRPMFAVG | 94.38 | RMRPMFAVG | 3.14 | KMRPMLAVG | 1.24 | KIRPMFAVG | 0.66 | | |
| NS2A | 1210 | 0.23 | 8 | 3 | 0 | Y | MRPMFAVGL | 97.44 | MRPMLAVGL | 1.24 | IRPMFAVGL | 0.66 | | | | |
| NS2A | 1211 | 0.17 | 7 | 2 | 0 | Y | RPMFAVGLL | 98.1 | RPMLAVGLL | 1.24 | | | | | | |

FIG. 3-44

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS2A | 1212 | 0.27 | 10 | 4 | 0 | Y | PMFAVGLLF | 96.94 | PMLAVGLLF | 1.24 | PMFAVGLLI | 0.74 | PMFAVGLLL | 0.33 | | |
| NS2A | 1213 | 0.27 | 10 | 4 | 0 | Y | MFAVGLLFR | 96.94 | MLAVGLLFR | 1.24 | MFAVGLLIR | 0.74 | MFAVGLLLR | 0.33 | | |
| NS2A | 1214 | 0.32 | 12 | 5 | 0 | Y | FAVGLLFRR | 96.44 | LAVGLLFRR | 1.24 | FAVGLLIRR | 0.74 | FAVGLLRK | 0.41 | FAVGLLLRR | 0.33 |
| NS2A | 1215 | 0.2 | 10 | 3 | 0 | Y | AVGLLFRRL | 97.93 | AVGLLIRRL | 0.74 | AVGLLFRKL | 0.41 | | | | |
| NS2A | 1216 | 0.22 | 11 | 4 | 0 | Y | VGLLFRRLT | 97.77 | VGLLIRRLT | 0.74 | VGLLFRKLT | 0.41 | VGLLRRLT | 0.33 | | |
| NS2A | 1217 | 0.19 | 9 | 3 | 0 | Y | GLLFRRLTS | 98.01 | GLLIRRLTS | 0.74 | GLLFRKLTS | 0.41 | | | | |
| NS2A | 1218 | 0.19 | 9 | 3 | 0 | Y | LLFRRLTSR | 98.01 | LLIRRLTSR | 0.74 | LLFRKLTSR | 0.41 | | | | |
| NS2A | 1219 | 0.18 | 8 | 3 | 0 | Y | LFRRLTSRE | 98.1 | LRRLTSRE | 0.74 | LFRKLTSRE | 0.41 | | | | |
| NS2A | 1220 | 0.21 | 10 | 3 | 0 | Y | FRRLTSREV | 97.85 | IRRLTSREV | 0.74 | FRKLTSREV | 0.41 | | | | |
| NS2A | 1221 | 0.1 | 7 | 1 | 0 | Y | RRLTSREVL | 99.01 | | | | | | | | |
| NS2A | 1222 | 0.1 | 7 | 1 | 0 | Y | RLTSREVLL | 99.01 | | | | | | | | |
| NS2A | 1223 | 0.05 | 5 | 1 | 0 | Y | LTSREVLLL | 99.5 | | | | | | | | |
| NS2A | 1224 | 0.05 | 5 | 1 | 0 | Y | TSREVLLLT | 99.5 | | | | | | | | |
| NS2A | 1225 | 0.26 | 7 | 2 | 0 | Y | SREVLLLTI | 96.2 | SREVLLLTV | 3.39 | | | | | | |
| NS2A | 1226 | 0.26 | 7 | 2 | 0 | Y | REVLLLTIG | 96.2 | REVLLLTVG | 3.39 | | | | | | |
| NS2A | 1227 | 0.26 | 7 | 2 | 0 | Y | EVLLLTIGL | 96.2 | EVLLLTVGL | 3.39 | | | | | | |
| NS2A | 1228 | 0.26 | 7 | 2 | 0 | Y | VLLLTIGLS | 96.2 | VLLLTVGLS | 3.39 | | | | | | |
| NS2A | 1229 | 0.24 | 4 | 2 | 0 | Y | LLLTIGLSL | 96.36 | LLLTVGLSL | 3.47 | | | | | | |
| NS2A | 1230 | 0.27 | 6 | 2 | 0 | Y | LLTIGLSLV | 96.03 | LLTVGLSLV | 3.47 | | | | | | |
| NS2A | 1231 | 0.29 | 8 | 2 | 0 | Y | LTIGLSLVA | 95.86 | LTVGLSLVA | 3.47 | | | | | | |
| NS2A | 1232 | 0.34 | 11 | 3 | 0 | Y | TIGLSLVAS | 95.45 | TVGLSLVAS | 3.39 | TIGLSLVAF | 0.33 | | | | |
| NS2A | 1233 | 0.37 | 14 | 4 | 0 | Y | IGLSLVASV | 95.2 | VGLSLVASV | 3.39 | IGLSLVAFV | 0.33 | IGLSLVASA | 0.17 | | |
| NS2A | 1234 | 0.15 | 12 | 3 | 0 | Y | GLSLVASVE | 98.59 | GLSLVAFVE | 0.33 | GLSLVACVE | 0.17 | | | | |
| NS2A | 1235 | 0.17 | 13 | 3 | 0 | Y | LSLVASVEL | 98.43 | LSLVAFVEL | 0.33 | LSMASMEL | 0.17 | LSLVASVEI | 0.17 | | |
| NS2A | 1236 | 0.17 | 13 | 4 | 0 | Y | SLVASVELP | 98.43 | SLVAFVELP | 0.33 | SLVASAELP | 0.17 | SLVACVELP | 0.17 | | |
| NS2A | 1239 | 0.27 | 14 | 5 | 0 | Y | ASVELPNSL | 97.19 | ASVELPSSL | 1.16 | AFVELPNSL | 0.33 | ASVEIPNSL | 0.17 | ASMELPNSL | 0.17 |

FIG. 3-46

Species: DENV1 (9-MERS)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency | block to cover 99% of block | frequency |
|---|---|---|---|---|---|---|---|---|---|---|---|---|---|---|---|---|
| NS2A | 1276 | 0.83 | 13 | 5 | 0 | Y | LLSLTFIKT | 85.86 | LLSLTFVKT | 8.52 | LLSLTFIKT | 3.64 | LLSLTFVKT | 0.5 | LLSFTFIKT | 0.5 |
| NS2A | 1289 | 1.09 | 12 | 5 | 0 | Y | HYAWKTMAM | 78.33 | DYAWKTMAM | 15.14 | DYAWKTMAM | 2.65 | DYAWKTMAM | 2.23 | HCAWKTMAM | 0.74 |
| NS2A | 1296 | 0.99 | 11 | 5 | 0 | Y | AMVLSIVSL | 82.55 | AMALSIVSL | 9.76 | AMILSIVSL | 4.22 | AMVLSVVSL | 1.32 | AMVLSIASL | 1.32 |
| NS2A | 1299 | 0.61 | 8 | 5 | 0 | Y | LSIVSLFPL | 91.23 | LSIVSLFPL | 4.47 | LSIASLFPL | 1.32 | LSVVSLFPL | 1.32 | LSIVSLIPL | 1.08 |
| NS2A | 1300 | 0.61 | 8 | 5 | 0 | Y | SIVSLFPLC | 91.23 | SIVSLFPLC | 4.47 | SIASLFPLC | 1.32 | SVVSLFPLC | 1.32 | SIVSLIPLC | 1.08 |
| NS2A | 1302 | 0.58 | 9 | 5 | 0 | Y | VSLFPLCLS | 91.65 | VSLFPLCLS | 4.47 | ASLFPLCLS | 1.32 | VSLIPLCLS | 1.08 | VSLFPLCMS | 0.83 |
| NS2A | 1303 | 0.45 | 7 | 4 | 0 | Y | SLFPLCLST | 93.38 | SLFPLCLST | 4.47 | SLIPLCLST | 1.08 | SLFPLCMST | 0.83 | | |
| NS2A | 1304 | 0.45 | 7 | 4 | 0 | Y | LFPLCLSTT | 93.38 | LFPLCLSTT | 4.47 | LIPLCLSTT | 1.08 | LFPLCMSTT | 0.83 | | |
| NS2A | 1305 | 0.45 | 7 | 4 | 0 | Y | FPLCLSTTS | 93.38 | FPLCLSTTS | 4.47 | IPLCLSTTS | 1.08 | FPLCMSTTS | 0.83 | | |
| NS2A | 1306 | 0.1 | 5 | 2 | 0 | Y | PLCLSTTSQ | 98.92 | PLCMSTTSQ | 0.83 | | | | | | |
| NS2A | 1307 | 0.1 | 5 | 2 | 0 | Y | LCLSTTSQK | 98.92 | LCMSTTSQK | 0.83 | | | | | | |
| NS2A | 1308 | 0.09 | 4 | 1 | 0 | Y | CLSTTSQKT | 99.01 | | | | | | | | |
| NS2A | 1309 | 0.09 | 3 | 1 | 0 | Y | LSTTSQKTT | 99.01 | | | | | | | | |
| NS2A | 1310 | 0.02 | 2 | 1 | 0 | Y | STTSQKTTW | 99.83 | | | | | | | | |
| NS2A | 1311 | 0.01 | 2 | 1 | 0 | Y | TTSQKTTWL | 99.92 | | | | | | | | |
| NS2A | 1312 | 0.01 | 2 | 1 | 0 | Y | TSQKTTWLP | 99.92 | | | | | | | | |
| NS2A | 1313 | 0.01 | 2 | 1 | 0 | Y | SQKTTWLPV | 99.92 | | | | | | | | |
| NS2A | 1314 | 0.03 | 3 | 1 | 0 | Y | QKTTWLPVL | 99.67 | | | | | | | | |
| NS2A | 1315 | 0.03 | 3 | 1 | 0 | Y | KTTWLPVLL | 99.67 | | | | | | | | |
| NS2A | 1316 | 0.03 | 3 | 1 | 0 | Y | TTWLPVLLG | 99.67 | | | | | | | | |
| NS2A | 1317 | 0.03 | 3 | 1 | 0 | Y | TWLPVLLGS | 99.67 | | | | | | | | |
| NS2A | 1318 | 0.77 | 4 | 2 | 0 | Y | WLPVLLGSL | 79.16 | WLPVLLGSF | 20.51 | | | | | | |
| NS2A | 1319 | 0.77 | 4 | 2 | 0 | Y | LPVLLGSLG | 79.16 | LPVLLGSFG | 20.51 | | | | | | |
| NS2A | 1320 | 0.77 | 4 | 2 | 0 | Y | PVLLGSLGC | 79.16 | PVLLGSFGC | 20.51 | | | | | | |
| NS2A | 1321 | 0.77 | 4 | 2 | 0 | Y | VLLGSLGCK | 79.16 | VLLGSFGCK | 20.51 | | | | | | |
| NS2A | 1322 | 0.77 | 4 | 2 | 0 | Y | LLGSLGCKP | 79.16 | LLGSFGCKP | 20.51 | | | | | | |

FIG. 3-47

Species: DENV1 (9-MERS)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1323 | 0.75 | 4 | 2 | 0 | Y | LG

FIG. 3-48

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency

FIG. 3-49

Species: DENV1 (9-MERS)

| protein | block starting position | block entropy | total peptides in block | peptides required to cover 99% of block | gap/X fraction | 99% of block covered w/ <= 5 peptides? | block (99%) | frequency | block (99%) | frequency | block (99%) | frequency | block (99%) | frequency | block (99%) | frequency |
|---|---|---|---|---|---|---|---|---|---|---|---|---|---|---|---|---|
| NS2B | 1381 | 0.04 | 5 | 1 | 0 | Y | GMLIACYVI | 99.67 | | | | | | | | |
| NS2B | 1382 | 0.03 | 4 | 1 | 0 | Y | MLIACYVIS | 99.75 | | | | | | | | |
| NS2B | 1383 | 0.03 | 4 | 1 | 0 | Y | LIACYVISG | 99.75 | | | | | | | | |
| NS2B | 1384 | 0.04 | 5 | 1 | 0 | Y | IACYVISGS | 99.67 | | | | | | | | |
| NS2B | 1385 | 0.04 | 5 | 1 | 0 | Y | ACYVISGSS | 99.67 | | | | | | | | |
| NS2B | 1386 | 0.04 | 5 | 1 | 0 | Y | CYVISGSSA | 99.67 | | | | | | | | |
| NS2B | 1387 | 0.05 | 6 | 1 | 0 | Y | YVISGSSAD | 99.59 | | | | | | | | |
| NS2B | 1388 | 0.05 | 6 | 1 | 0 | Y | VISGSSADL | 99.59 | | | | | | | | |
| NS2B | 1389 | 0.08 | 7 | 1 | 0 | Y | ISGSSADLS | 99.26 | | | | | | | | |
| NS2B | 1390 | 0.08 | 7 | 1 | 0 | Y | SGSSADLSL | 99.26 | | | | | | | | |
| NS2B | 1391 | 0.11 | 8 | 1 | 0 | Y | GSSADLSLE | 99.01 | | | | | | | | |
| NS2B | 1392 | 0.12 | 9 | 1 | 0 | Y | SSADLSLEK | 98.84 | SSADLLLEK | 0.33 | SSADLLLEK | 0.33 | SADLSLDKA | 0.25 | | | |
| NS2B | 1393 | 0.15 | 10 | 2 | 0 | Y | SADLSLEKA | 98.59 | SADLLLEKA | 0.33 | SADLLLEKA | 0.33 | ADLSLDKAA | 0.25 | | | |
| NS2B | 1394 | 0.15 | 10 | 3 | 0 | Y | ADLSLEKAA | 98.59 | ADLLLEKAA | 0.33 | ADLLLEKAA | 0.33 | DLSLEKAAK | 0.91 | DLLLEKAAE | 0.33 | | |
| NS2B | 1395 | 0.31 | 11 | 3 | 0 | Y | DLSLEKAAE | 96.44 | DLSLEKAAV | 1.32 | DLSLEKAAV | 1.32 | LSLEKAAKV | 0.91 | LLLEKAAEV | 0.33 | LSLEKTAEV | 0.25 |
| NS2B | 1396 | 0.32 | 11 | 4 | 0 | Y | LSLEKAAEV | 96.36 | LSLEKAAV | 1.32 | LSLEKAAVV | 1.32 | SLEKAAKVS | 0.91 | LLEKAAEV | 0.33 | SLDKAAEVS | 0.25 |
| NS2B | 1397 | 0.32 | 11 | 5 | 0 | Y | SLEKAAEVS | 96.36 | SLEKAAVS | 1.32 | SLEKAAVVS | 1.32 | LEKAAKVSW | 0.91 | LLEKAAEV | 0.33 | | |
| NS2B | 1398 | 0.29 | 10 | 4 | 0 | Y | LEKAAEVSW | 96.69 | LEKAAVSW | 1.32 | LEKAAVVSW | 1.32 | EKAAKVSWE | 0.91 | LDKAAEVSW | 0.25 | | |
| NS2B | 1399 | 0.28 | 9 | 3 | 0 | Y | EKAAEVSWE | 96.77 | EKAAVSWE | 1.32 | EKAAVVSWE | 1.32 | AAKVSWEEE | 1.32 | AAKVSWEEE | 0.91 | AAEVSWEKE | 0.33 |
| NS2B | 1401 | 0.88 | 13 | 5 | 0 | Y | AAEVSWEEE | 82.55 | AAEVSWEQE | 13.98 | AAEVSWEQE | 13.98 | AAKVSWEEE | 1.32 | AKVSWEEEA | 0.91 | AEVSWEKEA | 0.33 |
| NS2B | 1402 | 0.87 | 11 | 4 | 0 | Y | AEVSWEEEA | 82.46 | AEVSWEQEA | 14.23 | AEVSWEQEA | 14.23 | AVVSWEEEA | 1.32 | | | EVSWEKEAE | 0.33 |
| NS2B | 1403 | 0.87 | 11 | 3 | 0 | Y | EVSWEEEAE | 82.46 | EVSWEQEAE | 14.23 | EVSWEQEAE | 14.23 | VVSWEEEAE | 1.32 | KVSWEEEAE | 0.91 | | |
| NS2B | 1404 | 0.7 | 10 | 5 | 0 | Y | VSWEEEAEH | 84.7 | VSWEQEAEH | 14.23 | VSWEQEAEH | 14.23 | VSWEKEAEH | 0.33 | | | | |
| NS2B | 1405 | 0.68 | 8 | 2 | 0 | Y | SWEEEAEHS | 84.86 | SWEQEAEHS | 14.23 | | | | | | | |
| NS2B | 1406 | 0.68 | 8 | 2 | 0 | Y | WEEEAEHSG | 84.86 | WEQEAEHSG | 14.23 | | | | | | | |
| NS2B | 1407 | 1.13 | 14 | 5 | 0 | Y | EEEAEHSGA | 79.32 | EQEAEHSGT | 9.18 | EEEAEHSGT | 5.38 | EEEAEHSGT | 4.96 | EQEAEHSGA | 0.33 | EKEAEHSGA | 0.33 |

FIG. 3-50

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1408 | 1.13 | 14 | 5 | 0

FIG. 3-51

Species: DENV1 (9-MERS)

| protein | block starting position | block entropy | total peptides in block | peptides required to cover 99% of block | gap/X fraction | 99% of block covered w/ <= 5 peptides? | block (99% cover) | frequency | block (99% cover) | frequency | block (99% cover) | frequency | block (99% cover) | frequency |
|---|---|---|---|---|---|---|---|---|---|---|---|---|---|---|
| NS2B | 1434 | 0.27 | 9 | 3 | 0 | Y | EERDDTLTI | 96.86 | EERDDTLTI | 1.49 | EERDDTLTI | 0.74 | | | | |
| NS2B | 1435 | 0.27 | 9 | 3 | 0 | Y | ERDDTLTIL | 96.86 | ERDDTITIL | 1.49 | EKDDTLTIL | 0.74 | | | | |
| NS2B | 1436 | 0.27 | 9 | 3 | 0 | Y | RDDTLTILL | 96.86 | RDDTLTILL | 1.49 | KDDTLTILL | 0.74 | | | | |
| NS2B | 1437 | 0.2 | 8 | 2 | 0 | Y | DDTLTILLK | 97.6 | DDTITILLK | 1.49 | | | | | | |
| NS2B | 1438 | 0.2 | 8 | 2 | 0 | Y | DTLTILLKA | 97.6 | DTITILLKA | 1.49 | | | | | | |
| NS2B | 1439 | 0.2 | 8 | 2 | 0 | Y | TLTILLKAT | 97.6 | TITILLKAT | 1.49 | | | | | | |
| NS2B | 1440 | 0.16 | 7 | 1 | 0 | Y | LTILLKATL | 98.1 | ITILLKATL | 1.49 | | | | | | |
| NS2B | 1441 | 0.04 | 5 | 1 | 0 | Y | TILLKATLL | 99.67 | | | | | | | | |
| NS2B | 1442 | 0.08 | 7 | 2 | 0 | Y | ILLKATLLA | 99.26 | | | | | | | | |
| NS2B | 1443 | 0.31 | 7 | 2 | 0 | Y | LLKATLLAV | 95.53 | LLKATLLAI | 3.64 | | | | | | |
| NS2B | 1444 | 0.31 | 7 | 2 | 0 | Y | LKATLLAVS | 95.53 | LKATLLAIS | 3.64 | | | | | | |
| NS2B | 1445 | 0.31 | 7 | 2 | 0 | Y | KATLLAVSG | 95.53 | KATLLAISG | 3.64 | | | | | | |
| NS2B | 1446 | 0.35 | 8 | 3 | 0 | Y | ATLLAVSGV | 95.12 | ATLLAISGV | 3.64 | ATLLAVSGM | 0.41 | | | | |
| NS2B | 1447 | 0.35 | 8 | 3 | 0 | Y | TLLAVSGVY | 95.12 | TLLAISGVY | 3.64 | TLLAVSGMY | 0.41 | | | | |
| NS2B | 1448 | 0.34 | 7 | 3 | 0 | Y | LLAVSGVYP | 95.2 | LLAISGVYP | 3.64 | LLAVSGMYP | 0.41 | | | | |
| NS2B | 1449 | 1.11 | 11 | 5 | 0 | Y | LAVSGVYPL | 73.86 | LAVSGVYPM | 21.09 | LAISGVYPM | 3.23 | LAISGVYPL | 0.41 | LAVSGMYPL | 0.41 |
| NS2B | 1450 | 1.11 | 11 | 5 | 0 | Y | AVSGVYPLS | 73.86 | AVSGVYPMS | 21.09 | AISGVYPMS | 3.23 | AVSGMYPLS | 0.41 | AISGVYPLS | 0.41 |
| NS2B | 1451 | 1.07 | 9 | 4 | 0 | Y | VSGVYPLSI | 74.19 | VSGVYPMSI | 21.09 | ISGVYPMSI | 3.31 | ISGVYPLSI | 0.41 | | |
| NS2B | 1452 | 0.87 | 5 | 2 | 0 | Y | SGVYPLSIP | 74.77 | SGVYPMSIP | 24.48 | | | | | | |
| NS2B | 1453 | 0.87 | 5 | 2 | 0 | Y | GVYPLSIPA | 74.77 | GVYPMSIPA | 24.48 | | | | | | |
| NS2B | 1454 | 0.87 | 5 | 2 | 0 | Y | VYPLSIPAT | 74.77 | VYPMSIPAT | 24.48 | | | | | | |
| NS2B | 1455 | 0.86 | 6 | 2 | 0 | Y | YPLSIPATL | 75.19 | YPMSIPATL | 24.23 | | | | | | |
| NS2B | 1456 | 0.86 | 6 | 2 | 0 | Y | PLSIPATLF | 75.19 | PMSIPATLF | 24.23 | | | | | | |
| NS2B | 1457 | 0.92 | 8 | 3 | 0 | Y | LSIPATLFV | 74.77 | MSIPATLFV | 23.9 | LSIPATLFL | 0.41 | | | | |
| NS2B | 1458 | 0.1 | 5 | 2 | 0 | Y | SIPATLFVW | 98.92 | SIPATLFLW | 0.74 | | | | | | |
| NS2B | 1459 | 0.3 | 7 | 3 | 0 | Y | IPATLFVWY | 95.95 | IPATLFWH | 2.81 | IPATLFWY | 0.74 | | | | |

FIG. 3-52

Species: DENV1 (9-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|

FIG. 3-53

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1496 | 0.86 | 5 | 2 | 0 | Y | DGIYRIMQR | 75.6 | DGIYRILQR | 23.66 | | | | |
| NS3 | 1497 | 0.82 | 4 | 2 | 0 | Y | GIYRIMQRG | 75.6 | GIYRILQRG | 24.15 | | | | |
| NS3 | 1498 | 0.82 | 4 | 2 | 0 | Y | IYRIMQRGL | 75.6 | IYRILQRGL | 24.15 | | | | |
| NS3 | 1499 | 0.82 | 4 | 2 | 0 | Y | YRIMQRGLL | 75.6 | YRILQRGLL | 24.15 | | | | |
| NS3 | 1500 | 0.83 | 5 | 2 | 0 | Y | RIMQRGLLG | 75.52 | RILQRGLL | 24.15 | | | | |
| NS3 | 1501 | 0.87 | 6 | 2 | 0 | Y | IMQRGLLGR | 75.52 | ILQRGLLGR | 23.66 | | | | |
| NS3 | 1502 | 0.87 | 6 | 2 | 0 | Y | MQRGLLGRS | 75.52 | LQRGLLGRS | 23.66 | | | | |
| NS3 | 1503 | 0.06 | 4 | 1 | 0 | Y | QRGLLGRSQ | 99.34 | | | | | | |
| NS3 | 1504 | 0.06 | 4 | 1 | 0 | Y | RGLLGRSQV | 99.34 | | | | | | |
| NS3 | 1505 | 0.06 | 4 | 1 | 0 | Y | GLLGRSQVG | 99.34 | | | | | | |
| NS3 | 1506 | 0.06 | 4 | 1 | 0 | Y | LLGRSQVGV | 99.34 | | | | | | |
| NS3 | 1507 | 0.06 | 4 | 1 | 0 | Y | LGRSQVGVG | 99.34 | | | | | | |
| NS3 | 1508 | 0.06 | 4 | 1 | 0 | Y | GRSQVGVGV | 99.34 | | | | | | |
| NS3 | 1509 | 0.06 | 3 | 1 | 0 | Y | RSQVGVGVF | 99.34 | | | | | | |
| NS3 | 1510 | 0.02 | 3 | 1 | 0 | Y | SQVGVGVFQ | 99.83 | | | | | | |
| NS3 | 1511 | 0.76 | 6 | 2 | 0 | Y | QVGVGVFQE | 79.4 | QVGVGVFQD | 20.26 | | | | |
| NS3 | 1512 | 1.01 | 7 | 3 | 0 | Y | VGVGVFQEN | 75.1 | VGVGVFQDG | 20.26 | VGVGVFQEG | 4.3 | | |
| NS3 | 1513 | 1.01 | 7 | 3 | 0 | Y | GVGVFQENV | 75.1 | GVGVFQDGV | 20.26 | GVGVFQEGV | 4.3 | | |
| NS3 | 1514 | 1.01 | 7 | 3 | 0 | Y | VGVFQENVF | 75.1 | VGVFQDGVF | 20.26 | VGVFQEGVF | 4.3 | | |
| NS3 | 1515 | 1.01 | 7 | 3 | 0 | Y | GVFQENVFH | 75.1 | GVFQDGVFH | 20.26 | GVFQEGVFH | 4.3 | | |
| NS3 | 1516 | 1.01 | 7 | 3 | 0 | Y | VFQENVFHT | 75.1 | VFQDGVFHT | 20.26 | VFQEGVFHT | 4.3 | | |
| NS3 | 1517 | 1.01 | 7 | 3 | 0 | Y | FQENVFHTM | 75.1 | FQDGVFHTM | 20.26 | FQEGVFHTM | 4.3 | | |
| NS3 | 1518 | — | 6 | 3 | 0 | Y | QENVFHTMW | 75.1 | QDGVFHTMW | 20.35 | QEGVFHTMW | 4.3 | | |
| NS3 | 1519 | — | 6 | 3 | 0 | Y | ENVFHTMWH | 75.1 | DGVFHTMWH | 20.35 | EGVFHTMWH | 4.3 | | |
| NS3 | 1520 | 0.82 | 3 | 2 | 0 | Y | NVFHTMWHV | 75.1 | GVFHTMWHV | 24.81 | | | | |
| NS3 | 1521 | 0.01 | 2 | 1 | 0 | Y | VFHTMWHVT | 99.92 | | | | | | |

FIG. 3-54

Species: DENV1 (9-MERS)

| protein | block starting position | block entropy | total peptides in block | peptides required to cover 99% of block | gap/X fraction | 99% of block covered w/ <= 5 peptides? | block | frequency |
|---|---|---|---|

FIG. 3-55

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |

FIG. 3-56

Species: DENV1 (9-MERS)

| protein | block starting position | block entropy | total peptides in block | peptides required to cover 99% of block | gap/X fraction | 99% of block covered w/ <= 5 peptides? | pe

FIG. 3-57

Species: DENV1 (9-MERS)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS3 | 1603 | 0.01 | 2 | 1 | 0 | Y | ALDFKPGTS | 99.92 | | |
| NS3 | 1604 | 0.01 | 2 | 1 | 0 | Y | LDFKPGTSG | 99.92 | | |
| NS3 | 1605 | 0.01 | 2 | 1 | 0 | Y | DFKPGTSGS | 99.92 | | |
| NS3 | 1606 | 0.01 | 2 | 1 | 0 | Y | FKPGTSGSP | 99.92 | | |
| NS3 | 1607 | 0.01 | 2 | 1 | 0 | Y | KPGTSGSPI | 99.92 | | |
| NS3 | 1608 | 0.01 | 2 | 1 | 0 | Y | PGTSGSPIV | 99.92 | | |
| NS3 | 1609 | 0.02 | 3 | 1 | 0 | Y | GTSGSPIVN | 99.83 | | |
| NS3 | 1610 | 0.02 | 3 | 1 | 0 | Y | TSGSPIVNR | 99.83 | | |
| NS3 | 1611 | 0.02 | 5 | 1 | 0 | Y | SGSPIVNRE | 99.83 | | |
| NS3 | 1612 | 0.06 | 6 | 1 | 0 | Y | GSPIVNREG | 99.42 | | |
| NS3 | 1613 | 0.07 | 7 | 1 | 0 | Y | SPIVNREGK | 99.34 | | |
| NS3 | 1614 | 0.1 | 8 | 1 | 0 | Y | PIVNREGKI | 99.09 | | |
| NS3 | 1615 | 0.11 | 8 | 2 | 0 | Y | IVNREGKIV | 98.92 | IVNRERKIV | 0.25 |
| NS3 | 1616 | 0.11 | 8 | 2 | 0 | Y | VNREGKIVG | 98.92 | VNRERKIVG | 0.25 |
| NS3 | 1617 | 0.11 | 7 | 2 | 0 | Y | NREGKIVGL | 98.92 | NRERKIVGL | 0.25 |
| NS3 | 1618 | 0.1 | 7 | 1 | 0 | Y | REGKIVGLY | 99.01 | | |
| NS3 | 1619 | 0.1 | 6 | 1 | 0 | Y | EGKIVGLYG | 99.01 | | |
| NS3 | 1620 | 0.1 | 4 | 1 | 0 | Y | GKIVGLYGN | 99.01 | | |
| NS3 | 1621 | 0.06 | 3 | 1 | 0 | Y | KIVGLYGNG | 99.42 | | |
| NS3 | 1622 | 0.05 | 2 | 1 | 0 | Y | IVGLYGNGV | 99.5 | | |
| NS3 | 1623 | 0.02 | 1 | 1 | 0 | Y | VGLYGNGVV | 99.83 | | |
| NS3 | 1624 | 0 | 1 | 1 | 0 | Y | GLYGNGVVT | 100 | | |
| NS3 | 1625 | 0.01 | 2 | 1 | 0 | Y | LYGNGVV

FIG. 3-58

Species: DENV1 (9-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| NS3 | 1629 | 0.03 | 4 | 1 | 0 | Y | GWTTSGTY | 99.75 | | | | | | |
| NS3 | 1630 | 0.03 | 4 | 1 | 0 | Y | WTTSGTYV | 99.75 | | | | | | |
| NS3 | 1631 | 0.03 | 4 | 1 | 0 | Y | TTSGTYWS | 99.75 | | | | | | |
| NS3 | 1632 | 0.03 | 4 | 1 | 0 | Y | TSGTYVSA | 99.75 | | | | | | |
| NS3 | 1633 | 0.04 | 4 | 1 | 0 | Y | TSGTYVSAI | 99.67 | | | | | | |
| NS3 | 1634 | 0.04 | 5 | 1 | 0 | Y | SGTYVSAIA | 99.67 | | | | | | |
| NS3 | 1635 | 0.03 | 4 | 1 | 0 | Y | GTYVSAIAQ | 99.75 | | | | | | |
| NS3 | 1636 | 0.09 | 5 | 1 | 0 | Y | TYVSAIAQA | 99.01 | | | | | | |
| NS3 | 1637 | 0.16 | 5 | 2 | 0 | Y | YVSAIAQAK | 98.1 | YVSAIAQAR | 0.99 | | | | |
| NS3 | 1638 | 0.33 | 6 | 3 | 0 | Y | VSAIAQAKT | 95.53 | VSAIAQAR | 2.56 | VSAIAQARA | 0.99 | | |
| NS3 | 1639 | 0.35 | 7 | 4 | 0 | Y | SAIAQAKTS | 95.37 | SAIAQAKTS | 2.56 | SAIAQARAS | 0.99 | SAIAQTKAS | 0.74 |
| NS3 | 1640 | 0.35 | 7 | 4 | 0 | Y | AIAQAKASQ | 95.37 | AIAQAKTSQ | 2.56 | AIAQARASQ | 0.99 | AIAQTKASQ | 0.74 |
| NS3 | 1641 | 0.39 | 9 | 4 | 0 | Y | IAQAKASQE | 95.04 | IAQAKTSQE | 2.56 | IAQARASQ | 0.99 | IAQTKASQE | 0.74 |
| NS3 | 1642 | 0.39 | 9 | 4 | 0 | Y | AQAKASQEG | 94.95 | AQAKTSQEG | 2.56 | AQARASQEG | 0.99 | AQTKASQE | 0.74 |
| NS3 | 1643 | 0.4 | 10 | 4 | 0 | Y | QAKASQEGP | 94.95 | QAKTSQEGP | 2.48 | QARASQEGP | 0.99 | QTKASQEGP | 0.74 |
| NS3 | 1644 | 0.41 | 10 | 4 | 0.08 | Y | AKASQEGPL | 94.79 | AKTSQEGPL | 2.48 | ARASQEGPL | 0.99 | TKASQEGPL | 0.74 |
| NS3 | 1645 | 0.34 | 9 | 3 | 0.08 | Y | KASQEGPLP | 95.53 | KTSQEGPLP | 2.48 | RASQEGPLP | 0.99 | | |
| NS3 | 1646 | 0.26 | 8 | 2 | 0.08 | Y | ASQEGPLPE | 96.53 | TSQEGPLPE | 2.48 | | | | |
| NS3 | 1647 | 0.1 | 7 | 1 | 0.08 | Y | SQEGPLPEI | 99.01 | | | | | | |
| NS3 | 1648 | 0.08 | 6 | 1 | 0.08 | Y | QEGPLPEIE | 99.17 | | | | | | |
| NS3 | 1649 | 0.29 | 8 | 3 | 0.08 | Y | EGPLPEIED | 96.44 | EGPLPEIEE | 1.74 | EGPLPEIEN | 0.99 | | |
| NS3 | 1650 | 0.31 | 7 | 4 | 0.08 | Y | GPLPEIEDE | 96.03 | GPLPEIEEE | 1.74 | GPLPEIENE | 0.99 | GPLPEIEDK | 0.74 |
| NS3 | 1651 | 0.3 | 6 | 3 | 0.08 | Y | PLPEIEDEV | 96.2 | PLPEIEEEV | 1.74 | PLPEIENEV | 0.99 | | |
| NS3 | 1652 | 0.29 | 5 | 3 | 0.08 | Y | LPEIEDEVF | 96.28 | LPEIEEEVF | 1.74 | LPEIENEVF | 0.99 | | |
| NS3 | 1653 | 0.95 | 6 | 4 | 0 | Y | PEIEDEVFR | 78.33 | PEIEDEVFRK | 18.11 | PEIENEVFR | 1.74 | PEIENEVFR | 0.99 |
| NS3 | 1654 | 0.95 | 6 | 4 | 0 | Y | EIEDEVFRK | 78.33 | EIEDEVFKK | 18.11 | EIEEEVFRK | 1.74 | EIENEVFRK | 0.99 |

FIG. 3-59

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover

FIG. 3-60

Species: DENV1 (9-MERS)

| protein | block starting position | block entropy | total peptides in block | peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS3 | 1681 | 0.21 | 8 | 2 | 0 | Y | LPAIVREAI | 97.52 | LPAMVREAI | 1.65 | | | | |
| NS3 | 1682 | 0.24 | 9 | 3 | 0 | Y | PAIVREAIK | 97.19 | PAMVREAIK | 1.65 | PAIVREAIR | 0.33 | | |
|

FIG. 3-61

Species: DENV1 (9-MERS)

| protein | block starting position | block entropy | total peptides in block | peptides required to cover 99% of block | gap/X fraction | 99% of block covered w/ <= 5 peptides? | block (99% cover) | frequency | block (99% cover) | frequency |
|---|---|---|---|---|---|---|---|---|---|---|
| NS3 | 1707 | 0.15 | 5 | 2 | 0 | Y | EMAEALKGM | 98.26 | EMAEALKGV

FIG. 3-62

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequ

FIG. 3-63

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 1759 | 0.02 | 3 | 1 | 0 | Y | IMDEAHFTD | 99.83 | | |
| NS3 | 1760 | 0.01 | 2 | 1 | 0 | Y | MDEAHFTDP | 99.92 | | |
| NS3 | 1761 | 0.84 | 4 | 2 | 0 | Y | DEAHFTDPS | 74.77 | DEAHFTDPA | 24.9 |
| NS3 | 1762 | 0.84 | 4 | 2 | 0 | Y | EAHFTDPSS | 74.77 | EAHFTDPAS | 24.9 |
| NS3 | 1763 | 0.85 | 5 | 2 | 0 | Y | AHFTDPSSI | 74.69 | AHFTDPASI | 24.9 |
| NS3 | 1764 | 0.85 | 5 | 2 | 0 | Y | HFTDPSSIA | 74.69 | HFTDPASIA | 24.9 |
| NS3 | 1765 | 0.88 | 7 | 2 | 0 | Y | FTDPSSIAA | 74.61 | FTDPASIAA | 24.73 |
| NS3 | 1766 | 0.88 | 7 | 2 | 0 | Y | TDPSSIAAR | 74.61 | TDPASIAAR | 24.73 |
| NS3 | 1767 | 0.88 | 7 | 2 | 0 | Y | DPSSIAARG | 74.61 | DPASIAARG | 24.73 |
| NS3 | 1768 | 0.88 | 7 | 2 | 0 | Y | PSSIAARGY | 74.61 | PASIAARGY | 24.73 |
| NS3 | 1769 | 0.88 | 7 | 2 | 0 | Y | SSIAARGYI | 74.61 | ASIAARGYI | 24.73 |
| NS3 | 1770 | 0.04 | 4 | 1 | 0 | Y | SIAARGYIS | 99.67 | | |
| NS3 | 1771 | 0.04 | 4 | 1 | 0 | Y | IAARGYIST | 99.67 | | |
| NS3 | 1772 | 0.04 | 4 | 1 | 0 | Y | AARGYISTR | 99.67 | | |
| NS3 | 1773 | 0.04 | 4 | 1 | 0 | Y | ARGYISTRV | 99.67 | | |
| NS3 | 1774 | 0.02 | 3 | 1 | 0 | Y | RGYISTRVG | 99.83 | | |
| NS3 | 1775 | 0.02 | 3 | 1 | 0 | Y | GYISTRVGM | 99.83 | | |
| NS3 | 1776 | 0.02 | 3 | 1 | 0 | Y | YISTRVGMG | 99.83 | | |
| NS3 | 1777 | 0.02 | 3 | 1 | 0 | Y | ISTRVGMGE | 99.83 | | |
| NS3 | 1778 | 0.02 | 3 | 1 | 0 | Y | STRVGMGEA | 99.83 | | |
| NS3 | 1779 | 0.03 | 4 | 1 | 0 | Y | TRVGMGEAA | 99.75 | | |
| NS3 | 1780 | 0.03 | 3 | 1 | 0 | Y | RVGMGEAAA | 99.75 | | |
| NS3 | 1781 | 0.02 | 3 | 1 | 0 | Y | VGMGEAAAI | 99.83 | | |
| NS3 | 1782 | 0.02 | 3 | 1 | 0 | Y | GMGEAAAIF | 99.83 | | |
| NS3 | 1783 | 0.02 | 3 | 1 | 0 | Y | MGEAAAIFM | 99.83 | | |
| NS3 | 1784 | 0.02 | 3 | 1 | 0 | Y | GEAAAIFMT | 99.83 | | |

FIG. 3-64

Species: DEN V1 (9-MERS)

| protein | block starting position | block entropy | total peptides in block | peptides required to cover 99% of block | gap/X fraction | 99% of block covered w/ <= 5 peptides? | block | frequency | peptides required to cover 99% of block | block | frequency | peptides required to cover 99% of block | block | frequency | peptides required to cover 99% of block | block | frequency |
|---|---|---|---|---|---|---|---|---|---|---|---|---|

FIG. 3-65

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1811 | 0.14 | 4 | 2 | 0 | Y | DEERDIPER | 98.26 | DEEKDIPER | 1.57 | | | | |
| NS3 | 1812 | 0.14 | 4 | 2 | 0 | Y | EERDIPERS | 98.26 | EEKDIPERS | 1.57 | | | | |
| NS3 | 1813 | 0.14 | 4 | 2 | 0 | Y | ERDIPERSW | 98.26 | EKDIPERSW | 1.57 | | | | |
| NS3 | 1814 | 0.15 | 5 | 2 | 0 | Y | RDIPERSWN | 98.1 | KDIPERSWN | 1.57 | | | | |
| NS3 | 1815 | 0.06 | 6 | 1 | 0 | Y | DIPERSWNS | 99.42 | | | | | | |
| NS3 | 1816 | 0.05 | 5 | 1 | 0 | Y | IPERSWNSG | 99.5 | | | | | | |
| NS3 | 1817 | 0.19 | 6 | 2 | 0 | Y | PERSWNSGY | 97.6 | PERSWNSGH | 1.9 | | | | |
| NS3 | 1818 | — | 9 | 3 | 0 | Y | ERSWNSGYE | 72.29 | ERSWNSGYD | 25.31 | ERSWNSGHE | 1.9 | | |
| NS3 | 1819 | 0.99 | 8 | 3 | 0 | Y | RSWNSGYEW | 72.37 | RSWNSGYDW | 25.31 | RSWNSGHEW | 1.9 | | |
| NS3 | 1820 | — | 9 | 3 | 0 | Y | SWNSGYEWI | 72.37 | SWNSGYDWI | 25.31 | SWNSGHEWI | 1.82 | | |
| NS3 | 1821 | — | 9 | 3 | 0 | Y | WNSGYEWIT | 72.37 | WNSGYDWIT | 25.14 | WNSGHEWIT | 1.82 | | |
| NS3 | 1822 | 1.02 | 11 | 3 | 0 | Y | NSGYEWITD | 72.29 | NSGYDWITD | 25.23 | NSGHEWITD | 1.82 | | |
| NS3 | 1823 | — | 9 | 3 | 0 | Y | SGYEWITDF | 72.37 | SGYDWITDF | 25.31 | SGHEWITDF | 1.82 | | |
| NS3 | 1824 | — | 8 | 3 | 0 | Y | GYEWITDFP | 72.29 | GYDWITDFP | 25.31 | GHEWITDFP | 1.82 | | |
| NS3 | 1825 | — | 8 | 3 | 0 | Y | YEWITDFPG | 72.29 | YDWITDFPG | 25.31 | HEWITDFPG | 1.82 | | |
| NS3 | 1826 | 0.89 | 8 | 2 | 0 | Y | EWITDFPGK | 74.11 | DWITDFPGK | 25.23 | | | | |
| NS3 | 1827 | 0.08 | 8 | 1 | 0 | Y | WITDFPGKT | 99.26 | | | | | | |
| NS3 | 1828 | 0.08 | 8 | 1 | 0 | Y | ITDFPGKTV | 99.26 | | | | | | |
| NS3 | 1829 | 0.08 | 8 | 1 | 0 | Y | TDFPGKTVW | 99.26 | | | | | | |
| NS3 | 1830 | 0.08 | 8 | 1 | 0 | Y | DFPGKTVWF | 99.42 | | | | | | |
| NS3 | 1831 | 0.07 | 7 | 1 | 0 | Y | FPGKTVWFV | 99.42 | | | | | | |
| NS3 | 1832 | 0.07 | 7 | 1 | 0 | Y | PGKTVWFVP | 99.42 | | | | | | |
| N

FIG. 3-66

Species: DENV1 (9-MERS)

| protein | block starting position | block entropy | total peptides in block | peptides required to cover 99% of block | gap/X fraction | 99% of block covered w/ <= 5 peptides? | block (to cover 99% of) | frequency | block (to cover 99% of) | frequency |
|

FIG. 3-67

Species: DENV1 (9-MERS)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1863 | 0.05 | 4 | 1 | 0 | Y | SRKTFDTEY | 99.5 | | | | | | |
| NS3 | 1864 | 0.05 | 4 | 1 | 0 | Y | RKTFDTEYQ | 99.5 | | | | | | |
| NS3 | 1865 | 0.05 | 4 | 1 | 0 | Y | KTFDTEYQK | 99.5 | | | | | | |
| NS3 | 1866 | 0.03 | 3 | 1 | 0 | Y | TFDTEYQKT | 99.75 | | | | | | |
| NS3 | 1867 | 0.13 | 4 | 2 | 0 | Y | FDTEYQKTK | 98.43 | FDTEYQKTR | 1.32 | | | | |
| NS3 | 1868 | 0.14 | 5 | 2 | 0 | Y | DTEYQKTKN | 98.35 | DTEYQKTRN | 1.32 | | | | |
| NS3 | 1869 | 0.12 | 4 | 2 | 0 | Y | TEYQKTKNN | 98.51 | TEYQKTRNN | 1.32 | | | | |
| NS3 | 1870 | 0.12 | 4 | 2 | 0 | Y | EYQKTKNND | 98.51 | EYQKTRNND | 1.32 | | | | |
| NS3 | 1871 | 0.12 | 4 | 2 | 0 | Y | YQKTKNNDW | 98.51 | YQKTRNNDW | 1.32 | | | | |
| NS3 | 1872 | 0.12 | 4 | 2 | 0 | Y | QKTKNNDWD | 98.51 | QKTRNNDWD | 1.32 | | | | |
| NS3 | 1873 | 0.12 | 4 | 2 | 0 | Y | KTKNNDWDY | 98.51 | KTRNNDWDY | 1.32 | | | | |
| NS3 | 1874 | 0.13 | 5 | 2 | 0 | Y | TKNNDWDYY | 98.51 | TRNNDWDYY | 1.32 | | | | |
| NS3 | 1875 | 0.03 | 4 | 1 | 0 | Y | KNNDWDYVT | 99.75 | RNNDWDYYV | 1.32 | | | | |
| NS3 | 1876 | 0.02 | 3 | 1 | 0 | Y | NNDWDYVWT | 99.83 | | | | | | |
| NS3 | 1877 | 0.02 | 3 | 1 | 0 | Y | NDWDYVWTT | 99.83 | | | | | | |
| NS3 | 1878 | 0.02 | 3 | 1 | 0 | Y | DWDYVWTTD | 99.83 | | | | | | |
| NS3 | 1879 | 0.02 | 3 | 1 | 0 | Y | WDYVWTTDI | 99.83 | | | | | | |
| NS3 | 1880 | 0.02 | 3 | 1 | 0 | Y | DYVWTTDIS | 99.83 | | | | | | |
| NS3 | 1881 | 0.02 | 2 | 1 | 0 | Y | YVWTTDISE | 99.92 | | | | | | |
| NS3 | 1882 | 0.01 | 1 | 1 | 0 | Y | VWTTDISEM | 99.92 | | | | | | |
| NS3 | 1883 | 0.01 | 1 | 1 | 0 | Y | WTTDISEMG | 100 | | | | | | |
| NS3 | 1884 | 0 | 1 | 1 | 0 | Y | TTDISEMGA | 100 | | | | | | |
| NS3 | 1885 | 0 | 1 | 1 | 0 | Y | TDISEMGAN | 100 | | | | | | |
| NS3 | 1886 | 0 | 1 | 1 | 0 | Y | DISEMGANF | 100 | | | | | | |
| NS3 | 1887 | 0.01 | 2 | 1 | 0 | Y | ISEMGANFR | 99.92 | | | | | | |
| NS3 | 1888 | 0.01 | 2 | 1 | 0 | Y | SEMGANFRA | 99.92 | | | | | | |

FIG. 3-68

Species: DENV1 (9-MERS)

| protein | block starting position | block entropy | total peptides in block | peptides required to cover 99% of block | gap/X f

FIG. 3-69

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required

FIG. 3-70

Species: DENV1 (9-MERS)

| protein | block starting position | block entropy | total peptides in block | peptides required to cover 99% of block | gap/X fraction | 99% of block covered w/ => 5 peptides? | block | frequency | block | frequency | block | frequency | block | frequency |
|---|---|---|---|---|---|---|---|---|---|---|---|---|---|---|
| NS3 | 1941 | 0.93 | 10 | 3 | 0 | Y | NHNKEGDQY | 73.53 | NQNKEGDQY | 25.39 | NPNKEGDQY | 0.25 | | |
| NS3 | 1942 | 1.16 | 10 | 4 | 0 | Y | HNKEGDQYI | 73.04 | QNKEGDQYV | 19.35 | QNKEGDQYI | 6.12 | HNKEGDQYV | 0.74 |
| NS3 | 1943 | 0.76 | 6 | 2 | 0 | Y | NKEGDQYIY | 79.49 | NKEGDQYVY | 20.18 | | | | |
| NS3 | 1944 | 0.76 | 5 | 2 | 0 | Y | KEGDQYIYM | 79.49 | KEGDQYVYM | 20.26 | | | | |
| NS3 | 1945 | 0.76 | 5 | 2 | 0 | Y | EGDQYIYMG | 79.49 | EGDQYVYMG | 20.26 | | | | |
| NS3 | 1946 | 0.75 | 4 | 2 | 0 | Y | GDQYIYMGQ | 79.49 | GDQYVYMGQ | 20.35 | | | | |
| NS3 | 1947 | 0.75 | 4 | 2 | 0 | Y | DQYIYMGQP | 79.49 | DQYVYMGQP | 20.35 | | | | |
| NS3 | 1948 | 0.77 | 7 | 3 | 0 | Y | QYIYMGQPL | 79.32 | QYVYMGQPL | 20.26 | | | | |
| NS3 | 1949 | 0.84 | 9 | 3 | 0 | Y | YIYMGQPLN | 78.58 | VYMGQPLNN | 20.26 | YIYMGQPLK | 0.66 | | |
| NS3 | 1950 | 0.84 | 9 | 3 | 0 | Y | IYMGQPLNN | 78.58 | YMGQPLNND | 20.26 | IYMGQPLKN | 0.66 | | |
| NS3 | 1951 | 0.11 | 7 | 2 | 0 | Y | YMGQPLNND | 98.84 | MGQPLNNDE | 0.66 | | | | |
| NS3 | 1952 | 0.11 | 7 | 2 | 0 | Y | MGQPLNNDE | 98.84 | GQPLNNDED | 0.66 | | | | |
| NS3 | 1953 | 0.11 | 7 | 2 | 0 | Y | GQPLNNDED | 98.84 | QPLNNDEDH | 0.66 | | | | |
| NS3 | 1954 | 0.11 | 7 | 2 | 0 | Y | QPLNNDEDH | 98.84 | PLNNDEDHA | 0.66 | | | | |
| NS3 | 1955 | 0.11 | 7 | 2 | 0 | Y | PLNNDEDHA | 98.84 | LNNDEDHAH | 0.66 | | | | |
| NS3 | 1956 | 0.12 | 8 | 2 | 0 | Y | LNNDEDHAH | 98.76 | | | | | | |
| NS3 | 1957 | 0.1 | 6 | 1 | 0 | Y | NNDEDHAHW | 99.01 | | | | | | |
| NS3 | 1958 | 0.03 | 4 | 1 | 0 | Y | NDEDHAHWT | 99.75 | | | | | | |
| NS3 | 1959 | 0.03 | 4 | 1 | 0 | Y | DEDHAHWTE | 99.75 | | | | | | |
| NS3 | 1960 | 0.03 | 3 | 1 | 0 | Y | EDHAHWTEA | 99.75 | | | | | | |
| NS3 | 1961 | 0.03 | 3 | 1 | 0 | Y | DHAHWTEAK | 99.75 | | | | | | |
| NS3 | 1962 | 0.03 | 3 | 1 | 0 | Y | HAHWTEAKM | 99.75 | | | | | | |
| NS3 | 1963 | 0.03 | 3 | 1 | 0 | Y | AHWTEAKML | 99.75 | | | | | | |
| NS3 | 1964 | 0.03 | 3 | 1 | 0 | Y | HWTEAKMLL | 99.75 | | | | | | |
| NS3 | 1965 | 0.02 | 3 | 1 | 0 | Y | WTEAKMLLD | 99.83 | | | | | | |
| NS3 | 1966 | 0.02 | 3 | 1 | 0 | Y | TEAKMLLDN | 99.83 | | | | | | |

FIG. 3-71

Species: DENV1 (9-MERS)

| protein | block starting position | block entropy | total peptides in block | pe

FIG. 3-72

Species: DENV1 (9-MERS)

| protein | block starting position | block entropy | total peptides in block | peptides required to cover 99% of block | gap/X fraction | covered w/ <= 5 peptides? | block peptides required to cover 99% of block | frequency | block peptides required to cover 99% of block | frequency |
|---|---|---|---|---|---|---|---|---|---|

FIG. 3-73

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS3 | 2019 | 0.11 | 3 | 2 | 0 | Y | LPWLSYKV | 98.68 | LPWLSHKV | 1.24 | | | | | | |
| NS3 | 2020 | 0.12 | 4 | 2 | 0 | Y | PWWLSYKVA | 98.59 | PWWLSHKVA | 1.24 | | | | | | |
| NS3 | 2021 | 0.12 | 4 | 2 | 0 | Y | VWLSYKVAS | 98.59 | VWLSHKVAS | 1.24 | | | | | | |
| NS3 | 2022 | 0.12 | 4 | 2 | 0 | Y | WLSYKVASE | 98.59 | WLSHKVASE | 1.24 | | | | | | |
| NS3 | 2023 | 0.12 | 4 | 2 | 0 | Y | LSYKVASEG | 98.59 | LSHKVASEG | 1.24 | | | | | | |
| NS3 | 2024 | 0.13 | 6 | 2 | 0 | Y | SYKVASEGF | 98.43 | SHKVASEGF | 1.24 | | | | | | |
| NS3 | 2025 | 0.13 | 6 | 2 | 0 | Y | YKVASEGFQ | 98.43 | HKVASEGFQ | 1.24 | | | | | | |
| NS3 | 2026 | 0.04 | 5 | 1 | 0 | Y | KVASEGFQY | 99.67 | | | | | | | | |
| NS3 | 2027 | 0.05 | 6 | 1 | 0 | Y | VASEGFQYS | 99.59 | | | | | | | | |
| NS3 | 2028 | 0.05 | 6 | 1 | 0 | Y | ASEGFQYSD | 99.59 | | | | | | | | |
| NS3 | 2029 | 0.04 | 5 | 1 | 0 | Y | SEGFQYSDR | 99.67 | | | | | | | | |
| NS3 | 2030 | 0.07 | 7 | 1 | 0 | Y | EGFQYSDRR | 99.42 | | | | | | | | |
| NS3 | 2031 | 0.07 | 7 | 1 | 0 | Y | GFQYSDRRW | 99.42 | | | | | | | | |
| NS3 | 2032 | 0.08 | 8 | 1 | 0 | Y | FQYSDRRWC | 99.34 | | | | | | | | |
| NS3 | 2033 | 0.06 | 6 | 1 | 0 | Y | QYSDRRWCF | 99.5 | | | | | | | | |
| NS3 | 2034 | 0.07 | 7 | 1 | 0 | Y | YSDRRWCFD | 99.42 | | | | | | | | |
| NS3 | 2035 | 0.07 | 7 | 1 | 0 | Y | SDRRWCFDG | 99.42 | | | | | | | | |
| NS3 | 2036 | 0.06 | 6 | 1 | 0 | Y | DRRWCFDGE | 99.5 | | | | | | | | |
| NS3 | 2037 | 0.07 | 7 | 1 | 0 | Y | RRWCFDGER | 99.42 | | | | | | | | |
| NS3 | 2038 | 0.07 | 7 | 1 | 0 | Y | RWCFDGERN | 99.42 | | | | | | | | |
| NS3 | 2039 | 0.05 | 6 | 1 | 0 | Y | WCFDGERNN | 99.59 | | | | | | | | |
| NS3 | 2040 | 0.05 | 6 | 1 | 0 | Y | CFDGERNNQ | 99.59 | | | | | | | | |
| NS3 | 2041 | 0.04 | 5 | 1 | 0 | Y | FDGERNNQV | 99.67 | | | | | | | | |
| NS3 | 2042 | 0.03 | 4 | 1 | 0 | Y | DGERNNQVL | 99.75 | | | | | | | | |
| NS3 | 2043 | 0.03 | 4 | 1 | 0 | Y | GERNNQVLE | 99.75 | | | | | | | | |
| NS3 | 2044 | 0.03 | 4 | 1 | 0 | Y | ERNNQVLEE | 99.75 | | | | | | | | |

FIG. 3-74

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides

FIG. 3-75

Species: DENV1 (9-MERS)

| protein | block starting position | block entropy | total peptides in block | peptides required to cover 99% of block | gap/X fraction | 99% of block covered w/ <= 5 pe

FIG. 3-76

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS4A | 2106 | 0.04 | 5 | 1 | 0 | Y | IGKLPQHLT | 99.67 | | | | | | |
| NS4A | 2107 | 0.79 | 8 | 2 | 0 | Y | GKLPQHLTQ | 79.4 | GKLPQHLTL | 20.02 | | | | |
| NS4A | 2108 | 0.89 | 10 | 4 | 0 | Y | KLPQHLTQR | 78.66 | KLPQHLTLR | 19.44 | KLPQHLTQK | 0.74 | KLPQHLTLK | 0.58 |
| NS4A | 2109 | 0.89 | 10 | 4 | 0 | Y | LPQHLTQRA | 78.66 | LPQHLTLRA | 19.44 | LPQHLTQKA | 0.74 | LPQHLTLKA | 0.58 |
| NS4A | 2110 | 0.89 | 10 | 4 | 0 | Y | PQHLTQRAQ | 78.66 | PQHLTLRAQ | 19.44 | PQHLTQKAQ | 0.74 | PQHLTLKAQ | 0.58 |
| NS4A | 2111 | 0.9 | 12 | 4 | 0 | Y | QHLTQRAQN | 78.58 | QHLTLRAQN | 19.44 | QHLTQKAQN | 0.66 | QHLTLKAQN | 0.58 |
| NS4A | 2112 | 0.91 | 13 | 4 | 0 | Y | HLTQRAQNA | 78.58 | HLTLRAQNA | 19.35 | HLTQKAQNA | 0.66 | HLTLKAQNA | 0.58 |
| NS4A | 2113 | 0.91 | 13 | 4 | 0 | Y | LTQRAQNAL | 78.58 | LTLRAQNAL | 19.35 | LTQKAQNAL | 0.66 | LTLKAQNAL | 0.58 |
| NS4A | 2114 | 0.91 | 13 | 4 | 0 | Y | TQRAQNALD | 78.58 | TLRAQNALD | 19.35 | TQKAQNALD | 0.66 | TLKAQNALD | 0.58 |
| NS4A | 2115 | 0.89 | 10 | 4 | 0 | Y | QRAQNALDN | 78.66 | LRAQNALDN | 19.44 | QKAQNALDN | 0.66 | LKAQNALDN | 0.58 |
| NS4A | 2116 | 0.14 | 6 | 2 | 0 | Y | RAQNALDNL | 98.35 | KAQNALDNL | 1.24 | | | | |
| NS4A | 2117 | 0.06 | 6 | 1 | 0 | Y | AQNALDNLV | 99.5 | | | | | | |
| NS4A | 2118 | 0.07 | 7 | 1 | 0 | Y | QNALDNLVM | 99.34 | | | | | | |
| NS4A | 2119 | 0.08 | 8 | 1 | 0 | Y | NALDNLVML | 99.26 | | | | | | |
| NS4A | 2120 | 0.06 | 6 | 1 | 0 | Y | ALDNLVMLH | 99.42 | | | | | | |
| NS4A | 2121 | 0.06 | 5 | 1 | 0 | Y | LDNLVMLHN | 99.42 | | | | | | |
| NS4A | 2122 | 0.06 | 5 | 1 | 0 | Y | DNLVMLHNS | 99.42 | | | | | | |
| NS4A | 2123 | 0.06 | 5 | 1 | 0 | Y | NLVMLHNSE | 99.42 | | | | | | |
| NS4A | 2124 | 0.06 | 5 | 1 | 0 | Y | LVMLHNSEQ | 99.42 | | | | | | |
| NS4A | 2125 | 0.06 | 5 | 1 | 0 | Y | VMLHNSEQG | 99.42 | | | | | | |
| NS4A | 2126 | 0.05 | 4 | 1 | 0 | Y | MLHNSEQGG | 99.5 | | | | | | |
| NS4A | 2127 | 0.83 | 4 | 2 | 0 | Y | LHNSEQGGR | 75.35 | LHNSEQGGK | 24.32 | | | | |
| NS4A | 2128 | 0.82 | 4 | 2 | 0 | Y | HNSEQGGRA | 75.27 | HNSEQGGKA | 24.57 | | | | |
| NS4A | 2129 | 0.82 | 4 | 2 | 0 | Y | NSEQGGRAY | 75.27 | NSEQGGKAY | 24.57 | | | | |
| NS4A | 2130 | 0.84 | 6 | 2 | 0 | Y | SEQGGRAYR | 75.19 | SEQGGKAYR | 24.48 | | | | |
| NS4A | 2131 | 0.85 | 7 | 2 | 0 | Y | EQGGRAYRH | 75.1 | EQGGKAYRH | 24.48 | | | | |

FIG. 3-77

Species: DENV1 (9-MERS)

| protein | block starting position | block entropy | total peptides in block | peptides required to cover 99% of block | gap/X fraction | 99% of block covered w/ <= 5 peptides? | block (peptides required to cover 99% of block) | frequency | block (peptides required to cover 99% of block) | frequency | block (peptides required to cover 99% of block) | frequency | block (peptides required to cover 99% of block) | frequency |
|---|---|---|---|---|---|---|---|---|---|---|---|---|---|---|
| NS4A | 2132 | 0.85 | 7 | 2 | 0 | Y | QGGRAYRHA | 75.1 | QGGRAYRHA | 24.48 | | | | |
| NS4A | 2133 | 0.93 | 10 | 3 | 0 | Y | GGRAYRHAM | 74.19 | GGRAYRHAM | 24.4 | GGRAYRHAL | 0.74 | | |
| NS4A | 2134 | 0.93 | 10 | 3 | 0 | Y | GRAYRHAME | 74.19 | GRAYRHAME | 24.4 | GRAYRHALE | 0.74 | | |
| NS4A | 2135 | 0.93 | 10 | 3 | 0 | Y | RAYRHAMEE | 74.19 | RAYRHAMEE | 24.4 | RAYRHALEE | 0.74 | | |
| NS4A | 2136 | 0.14 | 8 | 2 | 0 | Y | AYRHAMEEL | 98.59 | AYRHALEEL | 0.74 | | | | |
| NS4A | 2137 | 0.13 | 7 | 2 | 0 | Y | YRHAMEELP | 98.68 | YRHALEELP | 0.74 | | | | |
| NS4A | 2138 | 0.14 | 8 | 2 | 0 | Y | RHAMEELPD | 98.59 | RHALEELPD | 0.74 | | | | |
| NS4A | 2139 | 0.12 | 7 | 2 | 0 | Y | HAMEELPDT | 98.76 | HALEELPDT | 0.74 | | | | |
| NS4A | 2140 | 0.11 | 6 | 2 | 0 | Y | AMEELPDTI | 98.84 | ALEELPDTI | 0.74 | | | | |
| NS4A | 2141 | 0.11 | 6 | 2 | 0 | Y | MEELPDTIE | 98.84 | LEELPDTIE | 0.74 | | | | |
| NS4A | 2142 | 0.02 | 3 | 1 | 0 | Y | EELPDTIET | 99.83 | | | | | | |
| NS4A | 2143 | 0.13 | 5 | 2 | 0 | Y | ELPDTIETL | 98.51 | ELPDTIETI | 0.91 | | | | |
| NS4A | 2144 | 0.13 | 5 | 2 | 0 | Y | LPDTIETLM | 98.51 | LPDTIETIM | 0.91 | | | | |
| NS4A | 2145 | 0.13 | 5 | 2 | 0 | Y | PDTIETLML | 98.51 | PDTIETIML | 0.91 | | | | |
| NS4A | 2146 | 0.13 | 5 | 2 | 0 | Y | DTIETLMLL | 98.51 | DTIETIMLL | 0.91 | | | | |
| NS4A | 2147 | 0.13 | 5 | 2 | 0 | Y | TIETLMLLA | 98.51 | TIETIMLLA | 0.91 | | | | |
| NS4A | 2148 | 0.13 | 5 | 2 | 0 | Y | IETLMLLAL | 98.51 | IETIMLLAL | 0.91 | | | | |
| NS4A | 2149 | 0.14 | 6 | 2 | 0 | Y | ETLMLLALI | 98.43 | ETIMLLALI | 0.91 | | | | |
| NS4A | 2150 | 0.14 | 6 | 2 | 0 | Y | TLMLLALIA | 98.43 | TIMLLALIA | 0.91 | | | | |
| NS4A | 2151 | 0.18 | 8 | 2 | 0 | Y | LMLLALIAV | 98.1 | IMLLALIAV | 0.91 | | | | |
| NS4A | 2152 | 0.06 | 6 | 1 | 0 | Y | MLLALIAVL | 99.42 | | | | | | |
| NS4A | 2153 | 0.06 | 6 | 1 | 0 | Y | LLALIAVLT | 99.42 | | | | | | |
| NS4A | 2154 | 0.06 | 6 | 1 | 0 | Y | LALIAVLTG | 99.42 | | | | | | |
| NS4A | 2155 | 0.06 | 6 | 1 | 0 | Y | ALIAVLTGG | 99.42 | | | | | | |
| NS4A | 2156 | 0.08 | 8 | 1 | 0 | Y | LIAVLTGGV | 99.26 | | | | | | |
| NS4A | 2157 | 0.16 | 10 | 2 | 0 | Y | IAVLTGGVT | 98.43 | IAVLTGGVM | 0.74 | | | | |

FIG. 3-78

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS4A | 2158 | 0.15 | 9 | 2 | 0 | Y | AVLTGGVTL | 98.51 | AVLTGGVML | 0.74 | | | | | | |
| NS4A | 2159 | 0.15 | 9 | 2 | 0 | Y | VLTGGVTLF | 98.51 | VLTGGVMLF | 0.74 | | | | | | |
| NS4A | 2160 | 0.13 | 9 | 2 | 0 | Y | LTGGVTLFF | 98.68 | LTGGVMLFF | 0.74 | | | | | | |
| NS4A | 2161 | 0.13 | 9 | 2 | 0 | Y | TGGVTLFFL | 98.68 | TGGVMLFFL | 0.74 | | | | | | |
| NS4A | 2162 | 0.13 | 9 | 2 | 0 | Y | GGVTLFFLS | 98.68 | GGVMLFFLS | 0.74 | | | | | | |
| NS4A | 2163 | 0.13 | 9 | 2 | 0 | Y | GVTLFFLSG | 98.68 | GVMLFFLSG | 0.74 | | | | | | |
| NS4A | 2164 | 0.98 | 11 | 3 | 0 | Y | VTLFFLSGR | 71.38 | VTLFFLSGK | 27.3 | VMLFFLSGK | 0.58 | | | | |
| NS4A | 2165 | 0.95 | 8 | 3 | 0 | Y | TLFFLSGRG | 71.55 | TLFFLSGKG | 27.38 | MLFFLSGKG | 0.58 | | | | |
| NS4A | 2166 | 0.88 | 5 | 2 | 0 | Y | LFFLSGRGL | 71.79 | LFFLSGKGL | 27.96 | | | | | | |
| NS4A | 2167 | 0.88 | 5 | 2 | 0 | Y | FFLSGRGLG | 71.79 | FFLSGKGLG | 27.96 | | | | | | |
| NS4A | 2168 | 0.87 | 4 | 2 | 0 | Y | FLSGRGLGK | 71.88 | FLSGKGLGK | 27.96 | | | | | | |
| NS4A | 2169 | 0.86 | 3 | 2 | 0 | Y | LSGRGLGKT | 71.96 | LSGKGLGKT | 27.96 | | | | | | |
| NS4A | 2170 | 0.87 | 4 | 2 | 0 | Y | SGRGLGKTS | 71.88 | SGKGLGKTS | 27.96 | | | | | | |
| NS4A | 2171 | 0.87 | 4 | 2 | 0 | Y | GRGLGKTSI | 71.88 | GKGLGKTSI | 27.96 | | | | | | |
| NS4A | 2172 | 0.87 | 4 | 2 | 0 | Y | RGLGKTSIG | 71.88 | KGLGKTSIG | 27.96 | | | | | | |
| NS4A | 2173 | 0.04 | 4 | 1 | 0 | Y | GLGKTSIGL | 99.67 | | | | | | | | |
| NS4A | 2174 | 0.04 | 4 | 1 | 0 | Y | LGKTSIGLL | 99.67 | | | | | | | | |
| NS4A | 2175 | 0.04 | 4 | 1 | 0 | Y | GKTSIGLLC | 99.67 | | | | | | | | |
| NS4A | 2176 | 0.04 | 7 | 1 | 0 | Y | KTSIGLLCV | 99.67 | | | | | | | | |
| NS4A | 2177 | 0.76 | 10 | 3 | 0 | Y | TSIGLLCVM | 82.55 | TSIGLLCVT | 16.05 | TSIGLLCVI | 0.74 | | | | |
| NS4A | 2178 | 0.89 | 9 | 5 | 0 | Y | SIGLLCVMA | 81.64 | SIGLLCVTA | 15.22 | SIGLLCVTS | 0.83 | SIGLLCVIA | 0.74 | SIGLLCVMS | 0.74 |
| NS4A | 2179 | 0.88 | 9 | 5 | 0 | Y | IGLLCVMAS | 81.72 | IGLLCVTAS | 15.22 | IGLLCVTSS | 0.83 | IGLLCVIAS | 0.74 | IGLLCVMSS | 0.74 |
| NS4A | 2180 | 0.88 | 15 | 5 | 0 | Y | GLLCVMASS | 81.72 | GLLCVTASS | 15.22 | GLLCVTSSS | 0.83 | GLLCVIASS | 0.74 | GLLCVMSSS | 0.74 |
| NS4A | 2186 | 1.06 | 13 | 5 | 0 | Y | ASSVLLWMA | 71.55 | ASSLLWMA | 25.72 | SSSALLWMA | 1.49 | TSSVLLWMA | 0.17 | ASSALLWIA | 0.17 |
| NS4A | 2187 | 1.06 | 13 | 3 | 0 | Y | SSVLLWMAS | 71.79 | SSALLWMAS | 24.98 | SSALLWMAN | 2.23 | SALLWIASV | 0.17 | |
| NS4A | 2188 | 1.07 | 14 | 4 | 0 | Y | SVLLWMASV | 71.79 | SALLWMASV | 24.9 | SALLWMANV | 2.23 | | | | |

FIG. 3-79

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS4A | 2189 | 1.07 | 14 | 4 | 0 | Y | VLLWMASVE | 71.79 | ALLWMASVE | 24.9 | ALLWMANVE | 2.23 | ALLWIASVE | 0.17 |
| NS4A | 2190 | 0.24 | 9 | 2 | 0 | Y | LLWMASVEP | 96.94 | LLWMANVEP | 2.23 | | | | |
| NS4A | 2191 | 0.24 | 9 | 2 | 0 | Y | LWMASVEPH | 96.94 | LWMANVEPH | 2.23 | | | | |
| NS4A | 2192 | 0.25 | 10 | 2 | 0 | Y | WMASVEPHW | 96.86 | WMANVEPHW | 2.23 | | | | |
| NS4A | 2193 | 0.25 | 10 | 2 | 0 | Y | MASVEPHWI | 96.86 | MANVEPHWI | 2.23 | | | | |
| NS4A | 2194 | 0.2 | 7 | 2 | 0 | Y | ASVEPHWIA | 97.35 | ANVEPHWIA | 2.23 | | | | |
| NS4A | 2195 | 0.18 | 5 | 2 | 0 | Y | SVEPHWIAA | 97.52 | NVEPHWIAA | 2.23 | | | | |
| NS4A | 2196 | 0.03 | 4 | 1 | 0 | Y | VEPHWIAAS | 99.75 | | | | | | |
| NS4A | 2197 | 0.02 | 3 | 1 | 0 | Y | EPHWIAASI | 99.83 | | | | | | |
| NS4A | 2198 | 0.03 | 4 | 1 | 0 | Y | PHWIAASII | 99.75 | | | | | | |
| NS4A | 2199 | 0.03 | 4 | 1 | 0 | Y | HWIAASIIL | 99.75 | | | | | | |
| NS4A | 2200 | 0.04 | 5 | 1 | 0 | Y | WIAASIILE | 99.67 | | | | | | |
| NS4A | 2201 | 0.04 | 5 | 1 | 0 | Y | IAASIILEF | 99.67 | | | | | | |
| NS4A | 2202 | 0.04 | 5 | 1 | 0 | Y | AASIILEFF | 99.67 | | | | | | |
| NS4A | 2203 | 0.04 | 5 | 1 | 0 | Y | ASIILEFFL | 99.67 | | | | | | |
| NS4A | 2204 | 0.05 | 6 | 1 | 0 | Y | SIILEFFLM | 99.59 | | | | | | |
| NS4A | 2205 | 0.05 | 6 | 1 | 0 | Y | IILEFFLMV | 99.59 | | | | | | |
| NS4A | 2206 | 0.05 | 6 | 1 | 0 | Y | ILEFFLMVL | 99.59 | | | | | | |
| NS4A | 2207 | 0.02 | 3 | 1 | 0 | Y | LEFFLMVLL | 99.83 | | | | | | |
| NS4A | 2208 | 0.03 | 4 | 1 | 0 | Y | EFFLMVLLI | 99.75 | | | | | | |
| NS4A | 2209 | 0.02 | 3 | 1 | 0 | Y | FFLMVLLIP | 99.83 | | | | | | |
| NS4A | 2210 | 0.02 | 3 | 1 | 0 | Y | FLMVLLIPE | 99.83 | | | | | | |
| NS4A | 2211 | 0.02 | 3 | 1 | 0 | Y | LMVLLIPEP | 99.83 | | | | | | |
| NS4A | 2212 | 0.02 | 3 | 1 | 0 | Y | MVLLIPEPD | 99.83 | | | | | | |
| NS4A | 2213 | 0.08 | 4 | 1 | 0 | Y | VLLIPEPDR | 99.17 | | | | | | |
| NS4A | 2214 | 0.09 | 5 | 1 | 0 | Y | LLIPEPDRQ | 99.09 | | | | | | |

FIG. 3-80

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | fr

FIG. 3-81

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| 2K | 2241 | 0.05 | 5 | 1 | 0 | Y | ILTVAANEM | 99.59 | | | | | | |
| 2K | 2242 | 0.05 | 5 | 1 | 0 | Y | LTVAANEMG | 99.59 | | | | | | |
| 2K | 2243 | 0.05 | 5 | 1 | 0 | Y | TVAANEMGL | 99.59 | | | | | | |
| 2K | 2244 | 0.03 | 4 | 1 | 0 | Y | VAANEMGLL | 99.75 | | | | | | |
| 2K | 2245 | 0.02 | 3 | 1 | 0 | Y | AANEMGLLE | 99.83 | | | | | | |
| 2K | 2246 | 0.02 | 3 | 1 | 0 | Y | ANEMGLLET | 99.83 | | | | | | |
| NS4B | 2247 | 0.02 | 3 | 1 | 0 | Y | NEMGLLETT | 99.83 | | | | | | |
| NS4B | 2248 | 0.01 | 2 | 1 | 0 | Y | EMGLLETTK | 99.92 | | | | | | |
| NS4B | 2249 | 0.03 | 3 | 1 | 0 | Y | MGLLETTKK | 99.67 | | | | | | |
| NS4B | 2250 | 0.03 | 3 | 1 | 0 | Y | GLLETTKKD | 99.67 | | | | | | |
| NS4B | 2251 | 0.03 | 3 | 1 | 0 | Y | LLETTKKDL | 99.67 | | | | | | |
| NS4B | 2252 | 0.03 | 3 | 1 | 0 | Y | LETTKKDLG | 99.67 | | | | | | |
| NS4B | 2253 | 0.03 | 3 | 1 | 0 | Y | ETTKKDLGI | 99.67 | | | | | | |
| NS4B | 2254 | 0.03 | 3 | 1 | 0 | Y | TTKKDLGIG | 99.67 | | | | | | |
| NS4B | 2255 | 0.34 | 5 | 2 | 0 | Y | TKKDLGIGH | 94.29 | TKKDLGIGY | 5.29 | | | | |
| NS4B | 2256 | 0.64 | 8 | 3 | 0 | Y | KKDLGIGHV | 89.66 | KKDLGIGYV | 4.88 | KKDLGIGHA | 4.55 | | |
| NS4B | 2257 | 0.72 | 10 | 5 | 0 | Y | KDLGIGHVA | 89.08 | KDLGIGYVA | 4.88 | KDLGIGHAA | 3.72 | KDLGIGHAV | 0.83 |
| NS4B | 2271 | 1.14 | 7 | 4 | 0 | Y | HAAMLDVDL | 62.28 | HATMLDVDL | 35.07 | HVTMLDVDL | 0.99 | HATMLDIDL | 0.74 |
| NS4B | 2273 | 1.45 | 8 | 4 | 0 | Y | AMLDVDLHP | 62.2 | TMLDVDLHP | 18.69 | TMLDVDLRP | 17.37 | TMLDIDLHP | 0.74 |
| NS4B | 2274 | 0.75 | 5 | 2 | 0 | Y | MLDVDLHPA | 81.64 | MLDVDLRPA | 17.45 | | | | |
| NS4B | 2275 | 0.74 | 4 | 2 | 0 | Y | LDVDLHPAS | 81.72 | LDVDLRPAS | 17.45 | | | | |
| NS4B | 2276 | 0.74 | 4 | 2 | 0 | Y | DVDLHPASA | 81.72 | DVDLRPASA | 17.45 | | | | |
| NS4B | 2277 | 0.74 | 4 | 2 | 0 | Y | VDLHPASAW | 81.72 | VDLRPASAW | 17.45 | | | | |
| NS4B | 2278 | 0.67 | 2 | 2 | 0 | Y | DLHPASAWT | 82.46 | DLRPASAWT | 17.54 | | | | |
| NS4B | 2279 | 0.67 | 2 | 2 | 0 | Y | LHPASAWTL | 82.46 | LRPASAWTL | 17.54 | | | | |
| NS4B | 2280 | 0.67 | 2 | 2 | 0 | Y | HPASAWTLY | 82.46 | RPASAWTLY | 17.54 | | | | |

Note: Row 2257 additionally lists block KDLGIGHVW with frequency 0.58 as the 5th peptide required to cover 99% of block.

FIG. 3-82

Species: DENV1 (9-MERS)

| protein | block starting position | block entropy | total peptides in block | peptides required to cover 99% of block | g

FIG. 3-84

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2333 | 0.09 | 4 | 1 | 0 | Y | KMDIGVPLL | 99.01 | | | | | | |
| NS4B | 2334 | 0.08 | 3 | 1 | 0 | Y | MDIGVPLLA | 99.09 | | | | | | |
| NS4B | 2335 | 0.09 | 4 | 1 | 0 | Y | DIGVPLLAL | 99.01 | | | | | | |
| NS4B | 2336 | 0.09 | 4 | 1 | 0 | Y | IGVPLLALG | 99.01 | | | | | | |
| NS4B | 2337 | 0.01 | 2 | 1 | 0 | Y | GVPLLALGC | 99.92 | | | | | | |
| NS4B | 2338 | 0.01 | 2 | 1 | 0 | Y | VPLLALGCY | 99.92 | | | | | | |
| NS4B | 2339 | 0.01 | 2 | 1 | 0 | Y | PLLALGCYS | 99.92 | | | | | | |
| NS4B | 2340 | 0.01 | 2 | 1 | 0 | Y | LLALGCYSQ | 99.92 | | | | | | |
| NS4B | 2341 | 0.01 | 2 | 1 | 0 | Y | LALGCYSQV | 99.92 | | | | | | |
| NS4B | 2342 | 0.01 | 2 | 1 | 0 | Y | ALGCYSQVN | 99.92 | | | | | | |
| NS4B | 2343 | 0.01 | 2 | 1 | 0 | Y | LGCYSQVNP | 99.92 | | | | | | |
| NS4B | 2344 | 0.01 | 2 | 1 | 0 | Y | GCYSQVNPL | 99.92 | | | | | | |
| NS4B | 2345 | 0.01 | 2 | 1 | 0 | Y | CYSQVNPLT | 99.92 | | | | | | |
| NS4B | 2346 | 0.02 | 3 | 1 | 0 | Y | YSQVNPLTI | 99.83 | | | | | | |
| NS4B | 2347 | 0.11 | 4 | 2 | 0 | Y | SQVNPLTLT | 98.68 | SQVNPLTLI | 1.16 | PLTLTATVL | 0.33 | | |
| NS4B | 2348 | 0.12 | 5 | 2 | 0 | Y | QVNPLTLTA | 98.59 | QVNPLTLIA | 1.16 | LTLTATVLM | 0.33 | | |
| NS4B | 2349 | 0.16 | 7 | 2 | 0 | Y | VNPLTLTAA | 98.18 | VNPLTLIAA | 1.16 | TLTATVLML | 0.33 | | |
| NS4B | 2350 | 0.18 | 9 | 2 | 0 | Y | NPLTLTAAV | 98.01 | NPLTLIAAV | 1.16 | LTATVLMLV | 0.74 | LTATVLMLV | 0.33 |
| NS4B | 2351 | 0.23 | 12 | 3 | 0 | Y | PLTLTAAVL | 97.6 | PLTLIAAVL | 1.16 | TATVLMLLA | 0.74 | TATVLMLVA | 0.33 |
| NS4B | 2352 | 0.23 | 12 | 3 | 0 | Y | LTLTAAVLM | 97.6 | LTLIAAVLM | 1.16 | LTLTATVLM | 0.33 | | |
| NS4B | 2353 | 0.23 | 12 | 3 | 0 | Y | TLTAAVLML | 97.6 | TLIAAVLML | 1.16 | TLTATVLML | 0.33 | | |
| NS4B | 2354 | 0.3 | 14 | 4 | 0 | Y | LTAAVLMLV | 96.77 | LIAAVLMLV | 1.16 | LTAAVLMLV | 0.74 | | |
| NS4B | 2355 | 0.29 | 13 | 4 | 0 | Y | TAAVLMLVA | 96.86 | IAAVLMLVA | 1.16 | TAAVLMLVA | 0.74 | | |
| NS4B | 2356 | 0.2 | 12 | 3 | 0 | Y | AAVLMLVAH | 98.01 | AAVLMLLAH | 0.74 | ATVLMLVAH | 0.33 | | |
| NS4B | 2357 | 0.19 | 11 | 3 | 0 | Y | AVLMLVAHY | 98.1 | AVLMLLAHY | 0.74 | TVLMLVAHY | 0.33 | | |
| NS4B | 2358 | 0.15 | 9 | 2 | 0 | Y | VLMLVAHYA | 98.51 | VLMLLAHYA | 0.74 | | | | |

FIG. 3-85

Species: DENV1 (9-MERS)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS4B | 2359 | 0.13 | 7 | 2 | 0 | Y | LMLVAHYAI | 98.68 | LMLL

FIG. 3-86

Species: DENV1 (9-MERS)

| protein | block starting position | block entropy | total peptides in block | peptides required to cover 99% of block | gap/X fraction | 99% of block covered w/ <= 5 peptides? | block to cover 99% of (peptides required) | frequency | block to cover 99% of (pe

FIG. 3-87

Species: DENV1 (9-MERS)

| protein | block starting position | block entropy | total peptides in block | peptides required to cover 99% of block | gap/X fraction | 99% of block covered w/ <= 5 peptides? | block | frequency | peptides required to cover 99% of block | block | frequency |
|---|---|---|---|---|---|---|---|---|---|---|---|
| NS4B | 2411 | 0.07 | 2 | 1 | 0 | Y | FEKQLGQIM | 99.17 | | |
| NS4B | 2412 | 0.07 | 2 | 1 | 0 | Y | EKQLGQIML | 99.17 | | |
| NS4B | 2413 | 0.07 | 2 | 1 | 0 | Y | KQLGQIMLL | 99.17 | | |
| NS4B | 2414 | 0.12 | 5 | 2 | 0 | Y | QLGQIMLLI | 98.68 | QLGQVMLLI | 0.74 |
| NS4B | 2415 | 0.12 | 5 | 2 | 0 | Y | LGQIMLLIL | 98.68 | LGQVMLLIL | 0.74 |
| NS4B | 2416 | 0.13 | 6 | 2 | 0 | Y | GQIMLLILC | 98.59 | GQVMLLILC | 0.74 |
| NS4B | 2417 | 0.13 | 6 | 2 | 0 | Y | QIMLLILCT | 98.59 | QVMLLILCT | 0.74 |
| NS4B | 2418 | 0.14 | 7 | 1 | 0 | Y | IMLLILCTS | 98.51 | VMLLILCTS | 0.74 |
| NS4B | 2419 | 0.08 | 6 | 1 | 0 | Y | MLLILCTSQ | 99.26 | | |
| NS4B | 2420 | 0.08 | 6 | 1 | 0 | Y | LLILCTSQI | 99.26 | | |
| NS4B | 2421 | 0.08 | 6 | 1 | 0 | Y | LILCTSQIL | 99.26 | | |
| NS4B | 2422 | 0.08 | 6 | 1 | 0 | Y | ILCTSQILL | 99.26 | | |
| NS4B | 2423 | 0.03 | 4 | 1 | 0 | Y | LCTSQILLM | 99.75 | | |
| NS4B | 2424 | 0.03 | 4 | 1 | 0 | Y | CTSQILLMR | 99.75 | | |
| NS4B | 2425 | 0.02 | 3 | 1 | 0 | Y | TSQILLMRT | 99.83 | | |
| NS4B | 2426 | 0.02 | 3 | 1 | 0 | Y | SQILLMRTT | 99.83 | | |
| NS4B | 2427 | 0.01 | 2 | 1 | 0 | Y | QILLMRTTW | 99.92 | | |
| NS4B | 2428 | 0.01 | 2 | 1 | 0 | Y | ILLMRTTWA | 99.92 | | |
| NS4B | 2429 | 0.01 | 2 | 1 | 0 | Y | LLMRTTWAL | 99.92 | | |
| NS4B | 2430 | 0.01 | 3 | 1 | 0 | Y | LMRTTWALC | 99.83 | | |
| NS4B | 2431 | 0.01 | 2 | 1 | 0 | Y | MRTTWALCE | 99.92 | | |
| NS4B | 2432 | 0.02 | 3 | 1 | 0 | Y | RTTWALCES | 99.83 | | |
| NS4B | 2433 | 0.02 | 3 | 1 | 0 | Y | TTWALCESI | 99.83 | | |
| NS4B | 2434 | 0.02 | 3 | 1 | 0 | Y | TWALCESIT | 99.83 | | |
| NS4B | 2435 | 0.02 | 3 | 1 | 0 | Y | WALCESITL | 99.83 | | |
| NS4B | 2436 | 0.02 | 3 | 1 | 0 | Y | ALCESITLA | 99.83 | | |

FIG. 3-88

Species: DENV1 (9-MERS)

| prot

FIG. 3-89

Species: DENV1 (9-MERS)

| prot

FIG. 3-91

Species: DENV1 (9-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99%

FIG. 3-92

Species: DENV1 (9-MERS)

| protein | block starting position | block

FIG. 3-93

Species: DENV1 (9-MERS)

| protein | block starting position | block entropy | total peptides in block | peptides required to cover 99% of block | gap/X fraction | 99% of block covered w/ <= 5 peptides? | block | frequency | pe

FIG. 3-94

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|

FIG. 3-95

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---

FIG. 3-97

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99

FIG. 3-98

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2707 | 0.04 | 3 | — | 0 | Y | RNSTHEMYW | 99.59 | | | | | | |
| NS5 | 2708 | 0.04 | 3 | — | 0 | Y | NSTHEMYWV | 99.59 | | | | | | |
| NS5 | 2709 | 0.04 | 3 | — | 0 | Y | STHEMYWVS | 99.59 | | | | | | |
| NS5 | 2710 | 0.05 | 4 | — | 0 | Y | THEMYWVSC | 99.5 | | | | | | |
| NS5 | 2711 | 0.02 | 3 | — | 0 | Y | HEMYWVSCG | 99.83 | | | | | | |
| NS5 | 2712 | 0.02 | 3 | — | 0 | Y | EMYWVSCGT | 99.83 | | | | | | |
| NS5 | 2713 | 0.02 | 3 | — | 0 | Y | MYWVSCGTG | 99.83 | | | | | | |
| NS5 | 2714 | 0.02 | 2 | — | 0 | Y | YWVSCGTGN | 99.83 | | | | | | |
| NS5 | 2715 | 0.01 | 2 | — | 0 | Y | WVSCGTGNI | 99.92 | | | | | | |
| NS5 | 2716 | 0.01 | 2 | — | 0 | Y | VSCGTGNIV | 99.92 | | | | | | |
| NS5 | 2717 | 0.01 | 2 | — | 0 | Y | SCGTGNIVS | 99.92 | | | | | | |
| NS5 | 2718 | 0.01 | 2 | — | 0 | Y | CGTGNIVSA | 99.92 | | | | | | |
| NS5 | 2719 | 0.03 | 3 | — | 0 | Y | GTGNIVSAV | 99.67 | | | | | | |
| NS5 | 2720 | 0.03 | 3 | — | 0 | Y | TGNIVSAVN | 99.67 | | | | | | |
| NS5 | 2721 | 0.03 | 3 | — | 0 | Y | GNIVSAVNM | 99.67 | | | | | | |
| NS5 | 2722 | 0.03 | 3 | — | 0 | Y | NIVSAVNMT | 99.67 | | | | | | |
| NS5 | 2723 | 0.03 | 3 | — | 0 | Y | IVSAVNMTS | 99.67 | | | | | | |
| NS5 | 2724 | 0.03 | 3 | — | 0 | Y | VSAVNMTSR | 99.67 | | | | | | |
| NS5 | 2725 | 0.03 | 3 | — | 0 | Y | SAVNMTSRM | 99.67 | | | | | | |
| NS5 | 2726 | 0.03 | 3 | — | 0 | Y | AVNMTSRML | 99.67 | | | | | | |
| NS5 | 2727 | 0.03 | 3 | — | 0 | Y | VNMTSRMLL | 99.67 | | | | | | |
| NS5 | 2728 | 0.01 | 2 | — | 0 | Y | NMTSRMLLN | 99.92 | | | | | | |
| NS5 | 2729 | 0.01 | 2 | — | 0 | Y | MTSRMLLNR | 99.92 | | | | | | |
| NS5 | 2730 | 0.02 | 3 | — | 0 | Y | TSRMLLNRF | 99.83 | | | | | | |
| NS5 | 2731 | 0.02 | 3 | — | 0 | Y | SRMLLNRFT | 99.83 | | | | | | |
| NS5 | 2732 | 0.02 | 3 | — | 0 | Y | RMLLNRFTM | 99.83 | | | | | | |

FIG. 3-99

Species: DENV1 (9-MERS)

| protein | block starting position | block entropy | total peptides in block | peptides required to cover 99% of block | gap/X fraction | 99% of block covered w/ <=5 peptides? | block | frequency | block | frequency | block | frequency | block | frequency |
|---|---|---|---|---|---|---|---|---|---|---|---|---|---|---|
| NS5 | 2733 | 0.19 | 5 | 2 | 0 | Y | MLL

FIG. 3-100

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 2759 | 0.28 | 12 | 5 | 0 | Y | HVAVEPEVA | 97.02 | HVAVEPEIA | 0.74 | HVAVEPEEA | 0.58 | HVTVEPEVA | 0.5 | HVAVEPEVP

FIG. 3-101

| Species: DENV1 (9-MERS) protein | block starting position | block entropy | total peptides in block | peptides required to cover 99% of block | gap/X fraction | 99% of block covered w/ <= 5 peptides? | peptides required to cover 99

FIG. 3-102

Species: DENV1 (9-MERS)

| protein | block starting position | block entropy | total peptides in block | peptides required to cover 99% of block | gap/X fraction | 99% of block covered w/ >= 5 peptides? | peptides required to cover 99% of block | frequency | peptides required to cover 99% of block | frequency |
|---|---|---|---|---|---|---|---|---|---|---|
| NS5 | 2812 | 0.01 | 2 | 1 | 0 | Y |

FIG. 3-103

Species: DENV1 (9-MERS)

| protein | block starting position | block entropy | total peptides in block | peptides required to cover 99% of block | gap/X fraction | 99% of block covered w/ =< 5 peptides? | block | frequency | block | frequency | block | frequency | block | frequency |
|---|---|---|---|---|

FIG. 3-104

Species: DENV1 (9-MERS)

| protein | block starting position | block ent

FIG. 3-105

Species: DENV1 (9-MERS)

| protein | block starting position | block entropy | total peptides in block | peptides required to cover 99% of

FIG. 3-106

Species: DENV1 (9-MERS)

| protein | block starting position | block entropy | total peptides in block | peptides required to cover 99% of block | gap/X fraction | 99% of block covered w/ <= 5 peptides? | block (peptides required to cover 99% of block) | frequency | block | frequency | block | frequency | block | frequency |
|---|---|---|---|---|---|---|---|---|---|---|---|---|---|---|
| NS5 | 2917 | 0.26 | 9 | 2 | 0 | Y | AKEAVEDER | 96.61 | AKEAVEDDR | 2.56 | AVEDERFWE | 0.91 | AVEDERFWN | 0.33 |
| NS5 | 2918 | 0.26 | 9 | 2 | 0 | Y | KEAVEDERF | 96.61 | KEAVEDDRF | 2.56 | VEDERFWEL | 0.91 | VEDERFWNL | 0.33 |
| NS5 | 2919 | 0.26 | 9 | 2 | 0 | Y | EAVEDERFW | 96.61 | EAVEDDRFW | 2.56 | EDERFWELV | 0.91 | EDERFWNLV | 0.33 |
| NS5 | 2920 | 0.37 | 11 | 4 | 0 | Y | AVEDERFWD | 95.37 | AVEDDRFWD | 2.56 | | | | |
| NS5 | 2921 | 0.36 | 10 | 4 | 0 | Y | VEDERFWDL | 95.45 | VEDDRFWDL | 2.56 | | | | |
| NS5 | 2922 | 0.38 | 11 | 4 | 0 | Y | EDERFWDLV | 95.29 | EDDRFWDLV | 2.56 | | | | |
| NS5 | 2929 | 0.76 | 11 | 5 | 0 | Y | LVHRERELH | 86.35 | LVQKERELH | 10.34 | LVRRERELH | 1.32 | LVKKERELH | 0.83 | LVHKERELH | 0.66 |
| NS5 | 2930 | 0.76 | 11 | 5 | 0 | Y | VHRERELHK | 86.35 | VQKERELHK | 10.34 | VRRERELHK | 1.32 | VKKERELHK | 0.83 | VHKERELHK | 0.66 |
| NS5 | 2931 | 0.74 | 11 | 4 | 0 | Y | HRERELHKQ | 86.44 | QKERELHKQ | 10.42 | RRERELHKQ | 1.32 | KKERELHKQ | 0.83 |
| NS5 | 2932 | 0.54 | 8 | 2 | 0 | Y | RERELHKQG | 88.01 | KERELHKQG | 11.91 | | | | |
| NS5 | 2933 | 0.01 | 3 | 1 | 0 | Y | ERELHKQGK | 99.92 | | | | | | |
| NS5 | 2934 | 0.02 | 2 | 1 | 0 | Y | RELHKQGKC | 99.83 | | | | | | |
| NS5 | 2935 | 0.03 | 3 | 1 | 0 | Y | ELHKQGKCA | 99.75 | | | | | | |
| NS5 | 2936 | 0.04 | 4 | 1 | 0 | Y | LHKQGKCAT | 99.67 | | | | | | |
| NS5 | 2937 | 0.04 | 5 | 1 | 0 | Y | HKQGKCATC | 99.67 | | | | | | |
| NS5 | 2938 | 0.05 | 5 | 1 | 0 | Y | KQGKCATCV | 99.59 | | | | | | |
| NS5 | 2939 | 0.06 | 6 | 1 | 0 | Y | QGKCATCVY | 99.5 | | | | | | |
| NS5 | 2940 | 0.06 | 7 | 1 | 0 | Y | GKCATCVYN | 99.5 | | | | | | |
| NS5 | 2941 | 0.07 | 7 | 1 | 0 | Y | KCATCVYNM | 99.42 | | | | | | |
| NS5 | 2942 | 0.07 | 8 | 1 | 0 | Y | CATCVYNMM | 99.42 | | | | | | |
| NS5 | 2943 | 0.07 | 8 | 1 | 0 | Y | ATCVYNMMG | 99.42 | | | | | | |
| NS5 | 2944 | 0.05 | 8 | 1 | 0 | Y | TCVYNMMGK | 99.59 | | | | | | |
| NS5 | 2945 | 0.04 | 6 | 1 | 0 | Y | CVYNMMGKR | 99.67 | | | | | | |
| NS5 | 2946 | 0.04 | 5 | 1 | 0 | Y | VYNMMGKRE | 99.67 | | | | | | |
| NS5 | 2947 | 0.02 | 4 | 1 | 0 | Y | YNMMGKREK | 99.83 | | | | | | |
| NS5 | 2948 | 0.02 | 3 | 1 | 0 | Y | NMMGKREKK | 99.83 | | | | | | |

FIG. 3-107

Species: DENV1 (9-MERS)

| protein | block starting position | block entropy | total peptides in block | peptides required to cover 99% of block | gap/X fraction | 99% of block covered w/ <= 5 peptides? | block | frequency |
|---|---|---|

FIG. 3-109

Species: DENV1 (9-MERS)

| protein | block starting position | block entropy | total peptides in block | peptides required to cover 99% of block | gap/X fraction | 99% of block covered w/ <= 5 peptides? | block (99%) | frequency | block (99%) | frequency | block (99%) | frequency | block (99%) | frequency |
|---|---|---|---|---|---|---|---|---|---|---|---|---|---|---|
| NS5 | 3001 | 0.09 | 4 | 2 | 0 | Y | GVEGEGLHK | 98.92 | G

FIG. 3-110

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block

FIG. 3-111

Species: DENV1 (9-MERS)

| protein | block starting position | block entropy | total peptides in block | peptides required to cover 99% of block | gap/X fraction | 99% of block covered w/ <= 5 peptides? | block (peptides required to cover 99% of block) | frequency | block (to cover 99% of block) | frequency | block (to cover 99% of block) | frequency | block (to cover 99% of block) | frequency |
|---|---|---|---|---|---|---|---|---|---|---|---|---|---|---|
| NS5 | 3053 | 1.18 | 11 | 3 | 0 | Y | EPEHALLAK | 58.06 | EPEHALLAT | 39.21 | EPEHALLAR | 1.82 | | |
| NS5 | 3054 | 1.57 | 12 | 4 | 0 | Y | PEHALLAKS | 47.23 | PEHALLATS | 39.29 | PEHALLANA | 10.84 | PEHALLARS | 1.82 |
| NS5 | 3055 | 1.55 | 11 | 4 | 0 | Y | EHALLAKSI | 47.39 | EHALLATSI | 39.37 | EHALLANAI | 10.84 | EHALLARSI | 1.82 |
| NS5 | 3056 | 1.54 | 10 | 4 | 0 | Y | HALLAKSIF | 47.39 | HALLATSIF | 39.45 | HALLANAIF | 10.84 | HALLARSIF | 1.82 |
| NS5 | 3057 | 1.54 | 10 | 4 | 0 | Y | ALLAKSIFK | 47.39 | ALLATSIFK | 39.45 | ALLANAIFK | 10.84 | ALLARSIFK | 1.82 |
| NS5 | 3058 | 1.54 | 10 | 4 | 0 | Y | LLAKSIFKL | 47.39 | LLATSIFKL | 39.45 | LLANAIFKL | 10.84 | LLARSIFKL | 1.82 |
| NS5 | 3059 | 1.53 | 9 | 4 | 0 | Y | LAKSIFKLT | 47.48 | LATSIFKLT | 39.45 | LANAIFKL | 10.84 | LARSIFKLT | 1.82 |
| NS5 | 3060 | 1.53 | 9 | 4 | 0 | Y | AKSIFKLTY | 47.48 | ATSIFKLTY | 39.45 | AKAIFKLTY | 10.84 | ARSIFKLTY | 1.82 |
| NS5 | 3061 | 1.53 | 9 | 4 | 0 | Y | KSIFKLTYQ | 47.48 | TSIFKLTYQ | 39.45 | KAIFKLTYQ | 10.84 | RSIFKLTYQ | 1.82 |
| NS5 | 3062 | 0.52 | 4 | 2 | 0 | Y | SIFKLTYQN | 88.83 | AIFKLTYQN | 11 | | | | |
| NS5 | 3063 | 0.02 | 3 | 1 | 0 | Y | IFKLTYQNK | 99.83 | | | | | | |
| NS5 | 3064 | 0.01 | 2 | 1 | 0 | Y | FKLTYQNKV | 99.92 | | | | | | |
| NS5 | 3065 | 0.01 | 2 | 1 | 0 | Y | KLTYQNKVV | 99.92 | | | | | | |
| NS5 | 3066 | 0.01 | 2 | 1 | 0 | Y | LTYQNKVVR | 99.92 | | | | | | |
| NS5 | 3067 | 0.01 | 2 | 1 | 0 | Y | TYQNKVVRV | 99.92 | | | | | | |
| NS5 | 3068 | 0.01 | 2 | 1 | 0 | Y | YQNKVVRVQ | 99.92 | | | | | | |
| NS5 | 3069 | 0.03 | 3 | 1 | 0 | Y | QNKVVRVQR | 99.75 | | | | | | |
| NS5 | 3070 | 0.03 | 3 | 1 | 0 | Y | NKVVRVQRP | 99.75 | | | | | | |
| NS5 | 3071 | 0.13 | 5 | 2 | 0 | Y | KVVRVQRPA | 98.59 | KVRVQRPT | 0.99 | VRVQRPTK | 0.91 | VRVQRPTKN | 0.91 |
| NS5 | 3072 | 0.25 | 7 | 3 | 0 | Y | VVRVQRPAK | 97.02 | VVRVQRPAR | 1.57 | VRVQRPARN | 1.57 | RVQRPTKNG | 0.91 |
| NS5 | 3073 | 0.38 | 8 | 4 | 0 | Y | VRVQRPAKN | 95.2 | VRVQRPAKS | 1.82 | RVQRPARNG | 1.57 | VQRPTKNGT | 0.91 |
| NS5 | 3074 | 0.38 | 8 | 4 | 0 | Y | RVQRPAKNG | 95.2 | RVQRPAKSG | 1.82 | VQRPARNGT | 1.57 | QRPTKNGTV | 0.91 |
| NS5 | 3075 | 0.38 | 8 | 4 | 0 | Y | VQRPAKNGT | 95.2 | VQRPAKSGT | 1.82 | QRPARNGTV | 1.57 | RPTKNGTVM | 0.91 |
| NS5 | 3076 | 0.38 | 8 | 4 | 0 | Y | QRPAKNGTV | 95.2 | QRPAKSGTV | 1.82 | RPARNGTVM | 1.57 | PTKNGTVMD | 0.91 |
| NS5 | 3077 | 0.38 | 8 | 4 | 0 | Y | RPAKNGTVM | 95.2 | RPAKSGTVM | 1.82 | PARNGTVM | 1.57 | | |
| NS5 | 3078 | 0.36 | 7 | 4 | 0 | Y | PAKNGTVMD | 95.37 | PAKSGTVMD | 1.82 | PARNGTVMD | 1.57 | | |

FIG. 3-112

Species: DENV1 (9-MERS)

| protein | block starting position | block entropy | total peptides in block | peptides required to cover 99% of block | gap/X fraction | 99% of block covered w/ <= 5 peptides? | block (to cover 99% of block) | frequency | block | frequency | block | frequency | block | frequency |
|---|---|---|---|---|---|---|---|---|---|---|---|---|---|---|
| NS5 | 3079 | 0.36 | 8 | 4 | 0 | Y | AKNGTVMDV | 95.37 | AKSGTVMDV | 1.74 | ARNGTVMDV | 1.57 | TKNGTVMDV | 0.91 |
| NS5 | 3080 | 0.26 | 5 | 3 | 0 | Y | KNGTVMDVI | 96.53 | KSGTVMDVI | 1.74 | RNGTVMDVI | 1.57 | | |
| NS5 | 3081 | 0.15 | 4 | 2 | 0 | Y | NGTVMDVIS | 98.1 | SGTVMDVIS | 1.74 | | | | |
| NS5 | 3082 | 0.03 | 3 | 1 | 0 | Y | GTVMDVISR | 99.75 | | | | | | |
| NS5 | 3083 | 0.03 | 3 | 1 | 0 | Y | TVMDVISRR | 99.75 | | | | | | |
| NS5 | 3084 | 0.04 | 4 | 1 | 0 | Y | VMDVISRRD | 99.59 | | | | | | |
| NS5 | 3085 | 0.04 | 4 | 1 | 0 | Y | MDVISRRDQ | 99.59 | | | | | | |
| NS5 | 3086 | 0.04 | 4 | 1 | 0 | Y | DVISRRDQR | 99.59 | | | | | | |
| NS5 | 3087 | 0.04 | 4 | 1 | 0 | Y | VISRRDQRG | 99.59 | | | | | | |
| NS5 | 3088 | 0.03 | 3 | 1 | 0 | Y | ISRRDQRGS | 99.75 | | | | | | |
| NS5 | 3089 | 0.03 | 3 | 1 | 0 | Y | SRRDQRGSG | 99.75 | | | | | | |
| NS5 | 3090 | 0.03 | 3 | 1 | 0 | Y | RRDQRGSGQ | 99.75 | | | | | | |
| NS5 | 3091 | 0.02 | 2 | 1 | 0 | Y | RDQRGSGQV | 99.83 | | | | | | |
| NS5 | 3092 | 0.02 | 2 | 1 | 0 | Y | DQRGSGQVG | 99.83 | | | | | | |
| NS5 | 3093 | 0 | 1 | 1 | 0 | Y | QRGSGQVGT | 100 | | | | | | |
| NS5 | 3094 | 0 | 1 | 1 | 0 | Y | RGSGQVGTY | 100 | | | | | | |
| NS5 | 3095 | 0 | 1 | 1 | 0 | Y | GSGQVGTYG | 100 | | | | | | |
| NS5 | 3096 | 0 | 1 | 1 | 0 | Y | SGQVGTYGL | 100 | | | | | | |
| NS5 | 3097 | 0 | 1 | 1 | 0 | Y | GQVGTYGLN | 100 | | | | | | |
| NS5 | 3098 | 0 | 1 | 1 | 0 | Y | QVGTYGLNT | 100 | | | | | | |
| NS5 | 3099 | 0 | 1 | 1 | 0 | Y | VGTYGLNTF | 100 | | | | | | |
| NS5 | 3100 | 0 | 1 | 1 | 0 | Y | GTYGLNTFT | 100 | | | | | | |
| NS5 | 3101 | 0.03 | 2 | 1 | 0 | Y | TYGLNTFTN | 100 | | | | | | |
| NS5 | 3102 | 0.03 | 2 | 1 | 0 | Y | YGLNTFTNM | 99.75 | | | | | | |
| NS5 | 3103 | 0.11 | 3 | 2 | 0 | Y | GLNTFTNME | 98.76 | GLNTFTNMG | 0.99 | | | | |
| NS5 | 3104 | 0.84 | 6 | 3 | 0 | Y | LNTFTNMEA | 78.74 | LNTFTNMEV | 20.02 | LNTFTNMGA | 0.58 | | |

FIG. 3-113

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 3105 | 0.84 | 6 | 3 | 0 | Y | NTFTNMEAQ | 78.74 | NTFTNMEVQ | 20.02 | NTFTNMGAQ | 0.58 | | |
| NS5 | 3106 | 0.84 | 6 | 3 | 0 | Y | TFTNMEAQL | 78.74 | TFTNMEVQL | 20.02 | TFTNMGAQL | 0.58 | | |
| NS5 | 3107 | 0.84 | 7 | 3 | 0 | Y | FTNMEAQLI | 78.66 | FTNMEVQLI | 20.02 | FTNMGAQLI | 0.58 | | |
| NS5 | 3108 | 0.84 | 7 | 3 | 0 | Y | TNMEAQLIR | 78.66 | TNMEVQLIR | 20.02 | TNMGAQLIR | 0.58 | | |
| NS5 | 3109 | 0.85 | 8 | 3 | 0 | Y | NMEAQLIRQ | 78.66 | NMEVQLIRQ | 19.93 | NMGAQLIRQ | 0.58 | | |
| NS5 | 3110 | 0.85 | 8 | 3 | 0 | Y | MEAQLIRQM | 78.66 | MEVQLIRQM | 19.93 | MGAQLIRQM | 0.58 | | |
| NS5 | 3111 | 0.84 | 7 | 3 | 0 | Y | EAQLIRQME | 78.74 | EVQLIRQME | 20.02 | GAQLIRQME | 0.58 | | |
| NS5 | 3112 | 0.77 | 6 | 2 | 0 | Y | AQLIRQMES | 79.24 | VQLIRQMES | 20.43 | | | | |
| NS5 | 3113 | 0.04 | 5 | 1 | 0 | Y | QLIRQMESE | 99.67 | | | | | | |
| NS5 | 3114 | 0.11 | 7 | 2 | 0 | Y | LIRQMESEG | 98.84 | LIRQMESEE | 0.74 | | | | |
| NS5 | 3115 | 0.11 | 7 | 2 | 0 | Y | IRQMESEGI | 98.84 | IRQMESEEI | 0.74 | | | | |
| NS5 | 3116 | 0.14 | 8 | 2 | 0 | Y | RQMESEGIF | 98.51 | RQMESEEIF | 0.74 | | | | |
| NS5 | 3117 | 1.09 | 11 | 4 | 0 | Y | QMESEGIFS | 66.75 | QMESEGIFL | 31.02 | QMESEGIFF | 0.74 | QMESEEIFS | 0.66 |
| NS5 | 3118 | 1.1 | 12 | 4 | 0 | Y | MESEGIFSP | 66.75 | MESEGIFLP | 31.02 | MESEGIFFP | 0.66 | MESEEIFSP | 0.66 |
| NS5 | 3148 | 0.18 | 5 | 2 | 0 | Y | ERLKRMAIS | 97.68 | ERLRRMAIS | 1.9 | | | | |
| NS5 | 3149 | 0.16 | 4 | 2 | 0 | Y | RLKRMAISG | 97.93 | RLRRMAISG | 1.9 | | | | |
| NS5 | 3150 | 0.16 | 4 | 2 | 0 | Y | LKRMAISGD | 97.93 | LRRMAISGD | 1.9 | | | | |
| NS5 | 3151 | 0.16 | 4 | 2 | 0 | Y | KRMAISGDD | 97.93 | RRMAISGDD | 1.9 | | | | |
| NS5 | 3152 | 0.01 | 2 | 1 | 0 | Y | RMAISGDDC | 99.92 | | | | | | |
| NS5 | 3153 | 0.01 | 2 | 1 | 0 | Y | MAISGDDCV | 99.92 | | | | | | |
| NS5 | 3154 | 0.01 | 2 | 1 | 0 | Y | AISGDDCVW | 99.92 | | | | | | |
| NS5 | 3155 | 0 | 1 | 1 | 0 | Y | ISGDDCVWK | 100 | | | | | | |
| NS5 | 3156 | 0 | 1 | 1 | 0 | Y | SGDDCVWKP | 100 | | | | | | |
| NS5 | 3157 | 0.48 | 4 | 3 | 0 | Y | GDDCVWKPI | 92.22 | GDDCVWKPT | 4.3 | GDDCVWKPV | 3.31 | | |
| NS5 | 3158 | 0.48 | 4 | 3 | 0 | Y | DDCVWKPID | 92.22 | DDCVWKPTD | 4.3 | DDCVWKPVD | 3.31 | | |
| NS5 | 3159 | 0.49 | 5 | 3 | 0 | Y | DCVWKPIDD | 92.22 | DCVWKPTDD | 4.3 | DCVWKPVDD | 3.23 | | |

FIG. 3-114

Species: DENV1 (9-MERS)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency | block to cover 99% of | frequency |
|---|---|---|---|---|---|---|---|---|---|---|---|---|---|---|---|---|
| NS5 | 3160 | 0.49 | 5 | 3 | 0 | Y | CVVKPIDDR | 92.22 | CVVKPTDDR | 4.3 | CVVKPTDDR | 3.23 | | | | |
| NS5 | 3161 | 0.49 | 5 | 3 | 0 | Y | VVKPIDDRF | 92.22 | VVKPTDDRF | 4.3 | VVKPTDDRF | 3.23 | | | | |
| NS5 | 3162 | 0.49 | 5 | 3 | 0 | Y | VKPIDDRFA | 92.22 | VKPTDDRFA | 4.3 | VKPTDDRFA | 3.23 | | | | |
| NS5 | 3163 | 0.57 | 10 | 4 | 0 | Y | KPIDDRFAT | 91.4 | KPTDDRFAT | 4.22 | KPVDDRFAT | 3.23 | KPIDDRFAA | 0.66 | | |
| NS5 | 3164 | 0.58 | 11 | 4 | 0 | Y | PIDDRFATA | 91.32 | PTDDRFATA | 4.22 | PVDDRFATA | 3.23 | PIDDRFAAA | 0.66 | | |
| NS5 | 3165 | 0.58 | 11 | 4 | 0 | Y | IDDRFATAL | 91.32 | TDDRFATAL | 4.22 | VDDRFATAL | 3.23 | IDDRFAAAL | 0.66 | | |
| NS5 | 3166 | 0.47 | 10 | 4 | 0 | Y | DDRFATALT | 93.22 | DDRFATALI | 4.14 | DDRFATALS | 3.23 | DDRFAAALT | 0.74 | | |
| NS5 | 3167 | 0.47 | 10 | 4 | 0 | Y | DRFATALTA | 93.22 | DRFATALIA | 4.14 | DRFATALSA | 3.23 | DRFAAALTA | 0.74 | | |
| NS5 | 3168 | 0.47 | 9 | 4 | 0 | Y | RFATALTAL | 93.22 | RFATALIAL | 4.22 | RFATALSAL | 1.41 | RFAAALTAL | 0.74 | | |
| NS5 | 3169 | 0.47 | 9 | 4 | 0 | Y | FATALTALN | 93.05 | FATALIALN | 4.22 | FATALSALN | 1.41 | FAAALTALN | 0.74 | | |
| NS5 | 3170 | 0.49 | 11 | 4 | 0 | Y | ATALTALND | 93.05 | ATALIALND | 4.22 | ATALSALND | 1.41 | AAALTALND | 0.74 | | |
| NS5 | 3171 | 0.49 | 11 | 3 | 0 | Y | TALTALNDM | 94.04 | TALIALNDM | 4.22 | TALSALNDM | 1.41 | AALTALNDM | 0.74 | | |
| NS5 | 3172 | 0.4 | 7 | 3 | 0 | Y | ALTALNDMG | 94.13 | ALIALNDMG | 4.22 | ALSALNDMG | 1.41 | | | | |
| NS5 | 3173 | 0.39 | 6 | 3 | 0 | Y | LTALNDMGK | 93.96 | LIALNDMGK | 4.22 | LSALNDMGK | 1.41 | | | | |
| NS5 | 3174 | 0.4 | 7 | 1 | 0 | Y | TALNDMGKV | 99.67 | IALNDMGKV | 4.22 | SALNDMGKV | 1.41 | | | | |
| NS5 | 3175 | 0.04 | 4 | 1 | 0 | Y | ALNDMGKVR | 99.67 | | | | | | | | |
| NS5 | 3176 | 0.04 | 4 | 1 | 0 | Y | LNDMGKVRK | 99.67 | | | | | | | | |
| NS5 | 3177 | 0.04 | 4 | 1 | 0 | Y | NDMGKVRKD | 99.67 | | | | | | | | |
| NS5 | 3178 | 0.16 | 6 | 2 | 0 | Y | DMGKVRKDI | 98.01 | DMGKVRKDV | 1.57 | | | | | | |
| NS5 | 3179 | 0.15 | 5 | 2 | 0 | Y | MGKVRKDIP | 98.1 | MGKVRKDVP | 1.57 | | | | | | |
| NS5 | 3180 | 0.15 | 5 | 2 | 0 | Y | GKVRKDIPQ | 98.1 | GKVRKDVPQ | 1.57 | | | | | | |
| NS5 | 3181 | 0.15 | 5 | 2 | 0 | Y | KVRKDIPQW | 98.1 | KVRKDVPQW | 1.57 | | | | | | |
| NS5 | 3182 | 0.15 | 5 | 2 | 0 | Y | VRKDIPQWE | 98.1 | VRKDVPQWE | 1.57 | | | | | | |
| NS5 | 3183 | 0.14 | 4 | 2 | 0 | Y | RKDIPQWEP | 98.26 | RKDVPQWEP | 1.57 | | | | | | |
| NS5 | 3184 | 0.14 | 4 | 2 | 0 | Y | KDIPQWEPS | 98.26 | KDVPQWEPS | 1.57 | | | | | | |
| NS5 | 3185 | 0.15 | 5 | 2 | 0 | Y | DIPQWEPSK | 98.18 | DVPQWEPSK | 1.57 | | | | | | |

FIG. 3-116

Species: DENV1 (9-MERS)

| protein | block starting position | block entropy | total pe

FIG. 3-117

Species: DENV1 (9-MERS)

| protein | block starting position | block entropy | total

FIG. 3-118

Species: DENV1 (9-MERS)

| protein | block starting position | block entropy | total

FIG. 3-119

Species: DENV1 (9-MERS)

| protein | block starting position | block entropy | total peptides in block | peptides required to cover 99% of block | gap/X fraction | 99% of block covered w/ <= 5 peptides? | block | frequency | peptides required to cover 99% of block | block | frequency | peptides required to cover 99% of block | block | frequency | peptides required to cover 99% of block | block | frequency |
|---|---|---|---|---|---|---|---|---|---|---|---|---|---|---|---|---|---|
| NS5 | 3296 | 0.08 | 3 | 1 | 0 | Y | HQWMTEDM | 99.09 | | | | | | | | | |
| NS5 | 3297 | 0.08 | 3 | 1 | 0 | Y | QWMTEDML | 99.09 | | | | | | |

FIG. 3-120

Species: DENV1 (9-MERS)

| protein | block starting position | block entropy | total peptides in block | peptides required to cover 99% of block | gap/X fraction | 99% of block covered w/ <= 5 peptides? | block | frequency | block | frequency | block | frequency | block | frequency

FIG. 3-121

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | pept

FIG. 3-122

Species: DENV1 (9-MERS)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3377 | 0.18 | 8 | 3 | 0 | Y | YM

FIG. 4-1

Species: DENV1 (10-MERS)

| protein | block starting position | block entropy | total peptides in block | # peptides required to cover 99% of block | gap/X fraction | 99% of block covered w/ <= 5 peptides? | peptides required

FIG. 4-2

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 25 | 0.81 | 9 | 2 | 0 | Y | TVSQLAKRFS | 78.91 | TGSQLAKRFS | 20.35 | | | | |
| anC | 26 | 0.82 | 10 | 2 | 0 | Y | VSQLAKRFSK | 78.91 | GSQLAKRFSK | 20.26 | | | | |
| anC | 27 | 0.08 | 8 | 1 | 0 | Y | SQLAKRFSKG | 99.34 | | | | | | |
| anC | 28 | 0.07 | 8 | 1 | 0 | Y | QLAKRFSKGL | 99.42 | | | | | | |
| anC | 29 | 0.07 | 8 | 1 | 0 | Y | LAKRFSKGLL | 99.42 | | | | | | |
| anC | 30 | 0.08 | 9 | 1 | 0 | Y | AKRFSKGLLS | 99.34 | | | | | | |
| anC | 31 | 0.07 | 8 | 1 | 0 | Y | KRFSKGLLSG | 99.42 | | | | | | |
| anC | 32 | 0.06 | 7 | 1 | 0 | Y | RFSKGLLSGQ | 99.5 | | | | | | |
| anC | 33 | 0.05 | 6 | 1 | 0 | Y | FSKGLLSGQG | 99.59 | | | | | | |
| anC | 34 | 0.05 | 6 | 1 | 0 | Y | SKGLLSGQGP | 99.59 | | | | | | |
| anC | 35 | 0.09 | 8 | 1 | 0 | Y | KGLLSGQGPM | 99.17 | | | | | | |
| anC | 36 | 0.09 | 8 | 1 | 0 | Y | GLLSGQGPMK | 99.17 | | | | | | |
| anC | 37 | 0.27 | 9 | 3 | 0 | Y | LLSGQGPMKL | 96.77 | LLSGQGPMKM | 1.82 | LLSGQGPMKF | 0.66 | | |
| anC | 38 | 0.26 | 8 | 3 | 0 | Y | LSGQGPMKLV | 96.86 | LSGQGPMKMV | 1.82 | LSGQGPMKFV | 0.66 | | |
| anC | 39 | 0.26 | 8 | 3 | 0 | Y | SGQGPMKLVM | 96.86 | SGQGPMKMVM | 1.82 | SGQGPMKFVM | 0.66 | | |
| anC | 40 | 0.25 | 7 | 3 | 0 | Y | GQGPMKLVMA | 96.94 | GQGPMKMVMA | 1.82 | GQGPMKFVMA | 0.66 | | |
| anC | 41 | 0.25 | 7 | 3 | 0 | Y | QGPMKLVMAF | 96.94 | QGPMKMVMAF | 1.82 | QGPMKFVMAF | 0.66 | | |
| anC | 42 | 0.28 | 9 | 3 | 0 | Y | GPMKLVMAFI | 96.69 | GPMKMVMAFI | 1.82 | GPMKFVMAFI | 0.66 | | |
| anC | 43 | 0.28 | 9 | 3 | 0 | Y | PMKLVMAFIA | 96.69 | PMKMVMAFIA | 1.82 | PMKFVMAFIA | 0.66 | | |
| anC | 44 | 0.29 | 10 | 3 | 0 | Y | MKLVMAFIAF | 96.53 | MKMVMAFIAF | 1.82 | MKFVMAFIAF | 0.66 | | |
| anC | 45 | 0.25 | 8 | 3 | 0 | Y | KLVMAFIAFL | 96.94 | KMVMAFIAFL | 1.82 | KFVMAFIAFL | 0.66 | | |
| anC | 46 | 0.26 | 8 | 3 | 0 | Y | LVMAFIAFLR | 96.86 | MVMAFIAFLR | 1.9 | FVMAFIAFLR | 0.66 | | |
| anC | 47 | 0.06 | 6 | 1 | 0 | Y | VMAFIAFLRF | 99.42 | | | | | | |
| anC | 48 | 0.06 | 6 | 1 | 0 | Y | MAFIAFLRFL | 99.42 | | | | | | |

FIG. 4-3

Species: DENV1 (10-MERS)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 49 | 0.06 | 6 | 1 | 0 | Y | AFIAFLRFLA | 99.42 | | | | | | |
| anC | 50 | 0.06 | 6 | 1 | 0 | Y | FIAFLRFLAI | 99.42 | | | | | | |
| anC | 51 | 0.06 | 6 | 1 | 0 | Y | IAFLRFLAIP | 99.42 | | | | | | |
| anC | 52 | 0.04 | 4 | 1 | 0 | Y | AFLRFLAIPP | 99.67 | | | | | | |
| anC | 53 | 0.04 | 4 | 1 | 0 | Y | FLRFLAIPPT | 99.67 | | | | | | |
| anC | 54 | 0.02 | 3 | 1 | 0 | Y | LRFLAIPPTA | 99.83 | | | | | | |
| anC | 55 | 0.02 | 3 | 1 | 0 | Y | RFLAIPPTAG | 99.83 | | | | | | |
| anC | 56 | 0.02 | 3 | 1 | 0 | Y | FLAIPPTAGI | 99.83 | | | | | | |
| anC | 57 | 0.06 | 4 | 1 | 0 | Y | LAIPPTAGIL | 99.42 | | | | | | |
| anC | 58 | 0.07 | 5 | 1 | 0 | Y | AIPPTAGILA | 99.34 | | | | | | |
| anC | 59 | 0.07 | 5 | 1 | 0 | Y | IPPTAGILAR | 99.34 | | | | | | |
| anC | 60 | 0.07 | 6 | 1 | 0 | Y | PPTAGILARW | 99.34 | | | | | | |
| anC | 61 | 0.8 | 6 | 2 | 0 | Y | PTAGILARWG | 78.66 | PTAGILARWS | 20.68 | | | | |
| anC | 62 | 0.8 | 7 | 2 | 0 | Y | TAGILARWGS | 78.66 | TAGILARWSS | 20.68 | | | | |
| anC | 63 | 0.81 | 7 | 2 | 0 | Y | AGILARWGSF | 78.58 | AGILARWSSF | 20.68 | | | | |
| anC | 64 | 0.81 | 7 | 2 | 0 | Y | GILARWGSFK | 78.58 | GILARWSSFK | 20.68 | | | | |
| anC | 65 | 0.81 | 7 | 2 | 0 | Y | ILARWGSFKK | 78.58 | ILARWSSFKK | 20.68 | | | | |
| anC | 66 | 1.53 | 7 | 3 | 0 | Y | LARWGSFKKN | 51.61 | LARWGSFKKS | 27.05 | LARWSSFKKN | 20.68 | | |
| anC | 67 | 1.51 | 7 | 3 | 0 | Y | ARWGSFKKNG | 51.53 | ARWGSFKKSG | 27.46 | ARWSSFKKNG | 20.68 | | |
| anC | 68 | 1.5 | 6 | 3 | 0 | Y | RWGSFKKNGA | 51.53 | RWGSFKKSGA | 27.46 | RWSSFKKNGA | 20.76 | | |
| anC | 69 | 1.51 | 7 | 3 | 0 | Y | WGSFKKNGAI | 51.45 | WGSFKKSGAI | 27.46 | WSSFKKNGAI | 20.76 | | |
| anC | 70 | 1.57 | 10 | 3 | 0 | Y | GSFKKNGAIK | 51.03 | GSFKKSGAIK | 27.38 | SSFKKNGAIK | 20.6 | | |
| anC | 71 | 0.94 | 8 | 2 | 0 | Y | SFKKNGAIKV | 71.63 | SFKKSGAIKV | 27.38 | | | | |
| anC | 72 | 0.94 | 8 | 2 | 0 | Y | FKKNGAIKVL | 71.63 | FKKSGAIKVL | 27.38 | | | | |

FIG. 4-4

Species: DENV1 (10-MERS)

| protein | block starting position | block entropy | total peptides in block |

FIG. 4-5

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 120 | 0.72 | 8 | 4 | 0 | Y | RGGEPHMIVS | 85.77 | RGGEPHMIVT | 12.16 | RGGEPHMIVS | 0.99 | RGGEPHMIVG | 0.58 |
| prM | 121 | 0.72 | 8 | 4 | 0 | Y | GGEPHMIVSK | 85.77 | GGEPHMIVTK | 12.16 | GGEPHMIVSK | 0.99 | GGEPHMIVGK | 0.58 |
| prM | 122 | 0.73 | 9 | 4 | 0 | Y | GEPHMIVSKQ | 85.69 | GEPHMIVTKQ | 12.16 | GEPHMIVSKQ | 0.99 | GEPHMIVGKQ | 0.58 |
| prM | 123 | 0.73 | 9 | 4 | 0 | Y | EPHMIVSKQE | 85.69 | EPHMIVTKQE | 12.16 | EPHMIVSKQE | 0.99 | EPHMIVGKQE | 0.58 |
| prM | 124 | 0.73 | 9 | 4 | 0 | Y | PHMIVSKQER | 85.69 | PHMIVTKQER | 12.16 | PHMIVSKQER | 0.99 | PHMIVGKQER | 0.58 |
| prM | 125 | 0.74 | 10 | 4 | 0 | Y | HMIVSKQERG | 85.53 | HMIVTKQERG | 12.16 | HMIVSKQERG | 0.99 | HMIVGKQERG | 0.58 |
| prM | 126 | 0.74 | 10 | 4 | 0 | Y | MIVSKQERGK | 85.53 | MIVTKQERGK | 12.16 | MVVSKQERGK | 0.99 | MIVGKQERGK | 0.58 |
| prM | 127 | 0.76 | 11 | 3 | 0 | Y | IVSKQERGKS | 85.36 | IVTKQERGKS | 12.16 | VSKQERGKS | 0.99 | IVGKQERGKS | 0.58 |
| prM | 128 | 0.67 | 10 | 3 | 0 | Y | VSKQERGKSL | 86.52 | VTKQERGKSL | 12.16 | VGKQERGKSL | 0.5 | | |
| prM | 129 | 0.66 | 9 | 1 | 0 | Y | SKQERGKSLL | 86.6 | TKQERGKSLL | 12.16 | GKQERGKSLL | 0.5 | | |
| prM | 130 | 0.06 | 6 | 1 | 0 | Y | KQERGKSLLF | 99.42 | | | | | | |
| prM | 131 | 0.06 | 6 | 1 | 0 | Y | QERGKSLLFK | 99.42 | | | | | | |
| prM | 132 | 0.05 | 5 | 1 | 0 | Y | ERGKSLLFKT | 99.5 | | | | | | |
| prM | 133 | 0.09 | 7 | 3 | 0 | Y | RGKSLLFKTS | 99.17 | | | | | | |
| prM | 134 | 0.32 | 10 | 3 | 0 | Y | GKSLLFKTSA | 95.95 | GKSLLFKTSV | 2.56 | GKSLLFKTST | 0.58 | | |
| prM | 135 | 0.31 | 9 | 3 | 0 | Y | KSLLFKTSAG | 95.95 | KSLLFKTSVG | 2.73 | KSLLFKTSTG | 0.58 | | |
| prM | 136 | 0.47 | 11 | 4 | 0 | Y | SLLFKTSAGI | 93.88 | SLLFKTSVGI | 2.48 | SLLFKTSAGI | 2.07 | SLLFKTSTGV | 0.58 |
| prM | 137 | 0.45 | 9 | 4 | 0 | Y | LLFKTSAGVN | 94.04 | LLFKTSVGVN | 2.48 | LLFKTSAGIN | 2.07 | LLFKTSTGVN | 0.58 |
| prM | 138 | 0.44 | 9 | 4 | 0 | Y | LFKTSAGVNM | 94.13 | LFKTSVGVNM | 2.48 | LFKTSAGINM | 2.07 | LFKTSTGVNM | 0.58 |
| prM | 139 | 0.44 | 9 | 4 | 0 | Y | FKTSAGVNMC | 94.13 | FKTSVGVNMC | 2.48 | FKTSAGINMC | 2.07 | FKTSTGVNMC | 0.58 |
| prM | 140 | 0.45 | 10 | 4 | 0 | Y | KTSAGVNMCT | 94.04 | KTSVGVNMCT | 2.48 | KTSAGINMCT | 2.07 | KTSTGVNMCT | 0.58 |
| prM | 141 | 0.46 | 11 | 4 | 0 | Y | TSAGVNMCTL | 93.96 | TSVGVNMCTL | 2.48 | TSAGINMCTL | 2.07 | TSTGVNMCTL | 0.58 |
| prM | 142 | 0.49 | 12 | 5 | 0 | Y | SAGVNMCTLI | 93.63 | SVGVNMCTLI | 2.48 | SAGINMCTLI | 2.07 | STGVNMCTLI | 0.58 | SAGVNMCTLV | 0.33 |
| prM | 143 | 0.46 | 10 | 4 | 0 | Y | AGVNMCTLIA | 93.96 | VGVNMCTLIA | 2.48 | AGINMCTLIA | 2.07 | TGVNMCTLIA | 0.58 |

FIG. 4-6

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 144 | 0.22 | 6 | 2 | 0 | Y | GVNMCTLIAM | 97.11 | GINMCTLIAM | 2.32 | | | | |
| prM | 145 | 0.22 | 6 | 2 | 0 | Y | VNMCTLIAMD | 97.11 | INMCTLIAMD | 2.32 | | | | |
| prM | 146 | 0.06 | 5 | 1 | 0 | Y | NMCTLIAMDL | 99.42 | | | | | | |
| prM | 147 | 0.06 | 5 | 1 | 0 | Y | MCTLIAMDLG | 99.42 | | | | | | |
| prM | 148 | 0.06 | 5 | 1 | 0 | Y | CTLIAMDLGE | 99.42 | | | | | | |
| prM | 149 | 0.72 | 7 | 2 | 0 | Y | TLIAMDLGEL | 82.3 | TLIAMDLGEF | 17.12 | | | | |
| prM | 150 | 0.71 | 6 | 2 | 0 | Y | LIAMDLGELC | 82.38 | LIAMDLGEFC | 17.12 | | | | |
| prM | 151 | 0.8 | 6 | 3 | 0 | Y | IAMDLGELCE | 81.14 | IAMDLGEFCE | 17.12 | IAMDLGELCD | 1.32 | | |
| prM | 152 | 0.76 | 3 | 3 | 0 | Y | AMDLGELCED | 81.31 | AMDLGEFCED | 17.37 | AMDLGELCDD | 1.32 | | |
| prM | 153 | 0.77 | 4 | 3 | 0 | Y | MDLGELCEDT | 81.22 | MDLGEFCEDT | 17.37 | MDLGELCDDT | 1.32 | | |
| prM | 154 | 0.86 | 7 | 4 | 0 | Y | DLGELCEDTM | 80.23 | DLGEFCEDTM | 17.37 | DLGELCDDTM | 1.32 | DLGELCEDTI | 0.58 |
| prM | 155 | 0.86 | 7 | 4 | 0 | Y | LGELCEDTMT | 80.23 | LGEFCEDTMT | 17.37 | LGELCDDTMT | 1.32 | LGELCEDTIT | 0.58 |
| prM | 156 | 0.86 | 7 | 4 | 0 | Y | GELCEDTMTY | 80.23 | GEFCEDTMTY | 17.37 | GELCDDTMTY | 1.32 | GELCEDTITY | 0.58 |
| prM | 157 | 0.86 | 7 | 4 | 0 | Y | ELCEDTMTYK | 80.23 | EFCEDTMTYK | 17.37 | ELCDDTMTYK | 1.32 | ELCEDTITYK | 0.58 |
| prM | 158 | 0.86 | 7 | 4 | 0 | Y | LCEDTMTYKC | 80.23 | FCEDTMTYKC | 17.37 | LCDDTMTYKC | 1.32 | LCEDTITYKC | 0.58 |
| prM | 159 | 0.2 | 6 | 3 | 0 | Y | CEDTMTYKCP | 97.6 | CDDTMTYKCP | 1.32 | CEDTITYKCP | 0.58 | | |
| prM | 160 | 0.63 | 8 | 4 | 0 | Y | EDTMTYKCPR | 89 | EDTMTYKCPQ | 8.6 | DDTMTYKCPR | 1.32 | EDTITYKCPR | 0.5 |
| prM | 161 | 0.54 | 8 | 3 | 0 | Y | DTMTYKCPRI | 90.24 | DTMTYKCPQI | 8.6 | DTITYKCPRI | 0.5 | | |
| prM | 162 | 0.61 | 9 | 4 | 0 | Y | TMTYKCPRIT | 89.41 | TMTYKCPQIT | 8.6 | TMTYKCPRIS | 0.83 | TITYKCPRIT | 0.83 |
| prM | 163 | 0.61 | 9 | 4 | 0 | Y | MTYKCPRITE | 89.41 | MTYKCPQITE | 8.6 | MTYKCPRISE | 0.83 | ITYKCPRITE | 0.83 |
| prM | 164 | 1.5 | 10 | 5 | 0 | Y | TYKCPRITEA | 59.97 | TYKCPRITET | 27.38 | TYKCPQITEA | 8.6 | TYKCPRITEV | 2.89 | TYKCPRISEA | 0.74 |
| prM | 165 | 1.5 | 10 | 5 | 0 | Y | YKCPRITEAE | 59.97 | YKCPRITETE | 27.38 | YKCPQITEAE | 8.6 | YKCPRITEVE | 2.89 | YKCPRISEAE | 0.74 |
| prM | 166 | 1.5 | 10 | 5 | 0 | Y | KCPRITEAEP | 59.97 | KCPRITETEP | 27.38 | KCPQITEAEP | 8.6 | KCPRITEVEP | 2.89 | KCPRISEAEP | 0.74 |
| prM | 167 | 1.51 | 11 | 5 | 0 | Y | CPRITEAEPD | 59.88 | CPRITETEPD | 27.38 | CPQITEAEPD | 8.6 | CPRITEVEPD | 2.89 | CPRISEAEPD | 0.74 |

FIG. 4-7

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 168 | 1.51 | 11 | 5 | 0 | Y | PRITEAEPDD | 59.88 | PRITETEPDD | 27.38 | PQITEAEPDD | 8.6 | PRITEVEPDD | 2.89 | PRISEAEPDD | 0.74 |
| prM | 169 | 1.51 | 11 | 5 | 0 | Y | RITEAEPDDV | 59.88 | RITETEPDDV | 27.38 | QITEAEPDDV | 8.6 | RITEVEPDDV | 2.89 | RISEAEPDDV | 0.74 |
| prM | 170 | 1.14 | 10 | 4 | 0 | Y | ITEAEPDDVD | 68.49 | ITETEPDDVD | 27.38 | ITEVEPDDVD | 2.89 | ISEAEPDDVD | 0.74 | | |
| prM | 171 | 1.13 | 9 | 4 | 0 | Y | TEAEPDDVDC | 68.57 | TETEPDDVDC | 27.38 | TEVEPDDVDC | 2.89 | SEAEPDDVDC | 0.74 | | |
| prM | 172 | 1.06 | 7 | 3 | 0 | Y | AEPDDVDCW | 69.31 | ETEPDDVDCW | 27.46 | EVEPDDVDCW | 2.89 | | | | |
| prM | 173 | 1.05 | 6 | 3 | 0 | Y | AEPDDVDCWC | 69.4 | TEPDDVDCWC | 27.46 | VEPDDVDCWC | 2.89 | | | | |
| prM | 174 | 0.02 | 3 | 1 | 0 | Y | EPDDVDCWCN | 99.83 | | | | | | | | |
| prM | 175 | 0.2 | 5 | 2 | 0 | Y | PDDVDCWCNA | 97.19 | PDDVDCWCNT | 2.56 | | | | | | |
| prM | 176 | 0.2 | 5 | 2 | 0 | Y | DDVDCWCNAT | 97.19 | DDVDCWCNTT | 2.56 | | | | | | |
| prM | 177 | 0.39 | 7 | 3 | 0 | Y | DVDCWCNATD | 94.13 | DVDCWCNATE | 3.14 | DVDCWCNTTD | 2.56 | | | | |
| prM | 178 | 0.43 | 7 | 3 | 0 | Y | VDCWCNATDT | 93.8 | VDCWCNATET | 3.14 | VDCWCNTTDT | 2.56 | | | | |
| prM | 179 | 0.43 | 7 | 3 | 0 | Y | DCWCNATDTW | 93.8 | DCWCNATETW | 3.14 | DCWCNTTDTW | 2.56 | | | | |
| prM | 180 | 0.43 | 7 | 3 | 0 | Y | CWCNATDTWW | 93.8 | CWCNATETWV | 3.14 | CWCNTTDTWV | 2.56 | | | | |
| prM | 181 | 0.43 | 7 | 3 | 0 | Y | WCNATDTWVT | 93.8 | WCNATETWVT | 3.14 | WCNTTDTWVT | 2.56 | | | | |
| prM | 182 | 0.43 | 7 | 3 | 0 | Y | CNATDTWVTY | 93.8 | CNATETWVTY | 3.14 | CNTTDTWVTY | 2.56 | | | | |
| prM | 183 | 0.43 | 7 | 3 | 0 | Y | NATDTWVTYG | 93.8 | NATETWVTYG | 3.14 | NTTDTWVTYG | 2.56 | | | | |
| prM | 184 | 0.43 | 7 | 3 | 0 | Y | ATDTWVTYGT | 93.8 | ATETWVTYGT | 3.14 | TTDTWVTYGT | 2.56 | | | | |
| prM | 185 | 0.25 | 5 | 2 | 0 | Y | TDTWVTYGTC | 96.44 | TETWVTYGTC | 3.14 | | | | | | |
| prM | 186 | 0.29 | 5 | 2 | 0 | Y | DTWVTYGTCS | 96.03 | ETWVTYGTCS | 3.14 | | | | | | |
| prM | 187 | 0.11 | 7 | 2 | 0 | Y | TWVTYGTCSQ | 98.92 | TWVTYGTCTQ | 0.33 | | | | | | |
| prM | 188 | 0.09 | 6 | 1 | 0 | Y | WVTYGTCSQT | 99.09 | | | | | | | | |
| prM | 189 | 0.09 | 6 | 1 | 0 | Y | VTYGTCSQTG | 99.09 | | | | | | | | |
| prM | 190 | 0.14 | 8 | 2 | 0 | Y | TYGTCSQTGE | 98.68 | TYGTCSQTGG | 0.33 | YGTCTQIGEH | 0.33 | | | | |
| prM | 191 | 0.15 | 9 | 3 | 0 | Y | YGTCSQTGEH | 98.59 | YGTCSQTGGH | 0.33 | | | | | | |

FIG. 4-8

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 192 | 0.15 | 9 | 3 | 0 | Y | GT

FIG. 4-9

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 216 | 0.28 | 3 | 2 | 0 | Y | GLETRTETWM | 95.37 | GLETRAETWM | 4.55 | | | | | | |
| prM | 217 | 0.28 | 3 | 2 | 0 | Y | LETRTETWMS | 95.37 | LETRAETWMS | 4.55 | | | | | | |
| prM | 218 | 0.28 | 3 | 2 | 0 | Y | ETRTETWMSS | 95.37 | ETRAETWMSS | 4.55 | | | | | | |
| prM | 219 | 0.28 | 3 | 2 | 0 | Y | TRTETWMSSE | 95.37 | TRAETWMS

FIG. 4-10

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 240 | 0.14 | 7 | 2 | 0 | Y | WALRHPGFTV | 98.51 | WVLRHPGFTV | 0.74 | | | | |
| prM | 241 | 0.4 | 9 | 4 | 0 | Y | ALRHPGFTVI | 94.87 | ALRHPGFTV

FIG. 4-11

Species: DENV1 (10-MERS)

| protein |

FIG. 4-12

Species: DENV1 (10-MERS)

| protein | block starting position | block entropy | total peptides in block | # peptides required to cover 99% of block | gap/x fraction | 99% of block covered w/ => 5 peptides? | peptides required to cover 99% of block | frequency | peptides required to cover 99% of block | frequency |
|---|---|---|---|---|---|---|---|---|---|---|
| E | 292 | 0.04 | 4 | 1 | 0 | Y | VEGLSGATWV | 99.67 | | |
| E | 293 | 0.04 | 4 | 1 | 0 | Y | EGLSGATWVD | 99.67 | | |
| E | 294 | 0.04 | 4 | 1 | 0 | Y | GLSGATWVDV | 99.67 | | |
| E | 295 | 0.04 | 4 | 1 | 0 | Y | LSGATWVDVW | 99.67 | | |
| E | 296 | 0.03 | 3 | 1 | 0 | Y | SGATWVDVWL | 99.75 | | |
| E | 297 | 0.03 | 3 | 1 | 0 | Y | GATWVDVWLE | 99.75 | | |
| E | 298 | 0.03 | 3 | 1 | 0 | Y | ATWVDVWLEH | 99.75 | | |
| E | 299 | 0.03 | 3 | 1 | 0 | Y | TWVDVWLEHG | 99.75 | | |
| E | 300 | 0.03 | 3 | 1 | 0 | Y | WVDVWLEHGS | 99.75 | | |
| E | 301 | 0.03 | 3 | 1 | 0 | Y | VDVWLEHGSC | 99.59 | | |
| E | 302 | 0.03 | 3 | 1 | 0 | Y | DVWLEHGSCV | 99.59 | | |
| E | 303 | 0.04 | 3 | 1 | 0 | Y | VWLEHGSCVT | 99.5 | | |
| E | 304 | 0.05 | 4 | 1 | 0 | Y | VLEHGSCVTT | 99.34 | | |
| E | 305 | 0.07 | 5 | 1 | 0 | Y | LEHGSCVTTM | 99.34 | | |
| E | 306 | 0.07 | 5 | 1 | 0 | Y | EHGSCVTTMA | 99.26 | | |
| E | 307 | 0.08 | 6 | 1 | 0 | Y | HGSCVTTMAK | 99.26 | | |
| E | 308 | 0.79 | 8 | 2 | 0 | Y | GSCVTTMAKD | 79.9 | GSCVTTMAKN | 19.27 |
| E | 309 | 0.79 | 8 | 2 | 0 | Y | SCVTTMAKDK | 79.9 | SCVTTMAKNK | 19.27 |
| E | 310 | 0.79 | 8 | 2 | 0 | Y | CVTTMAKDKP | 79.9 | CVTTMAKNKP | 19.27 |
| E | 311 | 0.79 | 8 | 2 | 0 | Y | VTTMAKDKPT | 79.9 | VTTMAKNKPT | 19.27 |
| E | 312 | 0.76 | 7 | 2 | 0 | Y | TTMAKDKPTL | 80.23 | TTMAKNKPTL | 19.27 |
| E | 313 | 0.76 | 7 | 2 | 0 | Y | TMAKDKPTLD | 80.23 | TMAKNKPTLD | 19.27 |
| E | 314 | 0.76 | 6 | 2 | 0 | Y | MAKDKPTLDI | 80.31 | MAKNKPTLDI | 19.19 |
| E | 315 | 0.76 | 7 | 2 | 0 | Y | AKDKPTLDIE | 80.31 | AKNKPTLDIE | 19.19 |

FIG. 4-13

Species: DENV1 (10-MERS)

| protein | block starting position | block entropy | total peptides in block | # peptides required to cover 99% of block | g

FIG. 4-14

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block

FIG. 4-15

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 364 | 0.38 | 6 | 3 | 0 | Y | EEQ

FIG. 4-16

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 388 | 0.88 | 7 | 3 | 0 | Y | FGKGSLLTCA | 75.93 | FGKGSLLTCA | 22.99 | FGKGSLMTCA | 0.74 | | | | |
| E | 389 | 0.88 | 7 | 3 | 0 | Y | GKG

FIG. 4-17

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 412 | 0.13 | 7 | 2 | 0 | Y | YENLKYSVIV | 98.59 | HENLKYSVIV | 0.83 | | | | | | |
| E | 413 | 0.06 | 6 | 1 | 0 | Y | ENLKYSVIVT | 99.42 | | | | | | | | |
| E | 414 | 0.07 | 7 | 1 | 0 | Y | NLKYSVIVTV | 99.34 | | | | | | | | |
| E | 415 | 0.07 | 7 | 1 | 0 | Y | LKYSVIVTVH | 99.34 | |

FIG. 4-18

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 436 | 0.94 | 9 | 3 | 0 | Y | TEHGTTATIT | 75.1 | TEHGTTATIT | 23.24 | TDHGTTATIT | 0.74 | | |
| E | 437 | 0.92 | 9 | 3 | 0 | Y | EHGTTATITP | 75.27 | EHGTTATITP | 23.24 | DHGTTATITP | 0.74 | | |
| E | 438 | 0.85 | 7 | 2 | 0 | Y | HGTTATITPQ | 76.1 | HGTTATITPQ | 23.24 | | | | |
| E | 439 | 0.84 | 6 | 2 | 0 | Y | GTTATITPQA | 76.18 | GTTATITPQA | 23.24 | | | | |
| E | 440 | 0.84 | 6 | 2 | 0 | Y | TTATITPQAP | 76.18 | TTATITPQAP | 23.24 | | | | |
| E | 441 | 1.48 | 9 | 4 | 0 | Y | TATITPQAPT | 57.98 | IATITPQAPT | 22.83 | TATITPQAPS | 18.11 | IATITPQAPS | 0.41 |
| E | 442 | 1.58 | 9 | 3 | 0 | Y | ATITPQAPTS | 41.6 | ATITPQAPTS | 39.12 | ATITPQAPST | 18.44 | | |
| E | 443 | 1.58 | 9 | 3 | 0 | Y | TITPQAPTE | 41.6 | TITPQAPTSE | 39.12 | TITPQAPSTE | 18.44 | | |
| E | 444 | 1.55 | 8 | 3 | 0 | Y | ITPQAPTEI | 41.6 | ITPQAPTSEI | 39.54 | ITPQAPSTEI | 18.44 | | |
| E | 445 | 1.55 | 8 | 3 | 0 | Y | TPQAPTEIQ | 41.6 | TPQAPTSEIQ | 39.54 | TPQAPSTEIQ | 18.44 | | |
| E | 446 | 1.55 | 8 | 3 | 0 | Y | PQAPTEIQL | 41.6 | PQAPTSEIQL | 39.54 | PQAPSTEIQL | 18.44 | | |
| E | 447 | 1.57 | 8 | 3 | 0 | Y | QAPTEIQLT | 41.6 | QAPTSEIQLT | 39.29 | QAPSTEIQLT | 18.44 | | |
| E | 448 | 1.58 | 11 | 3 | 0 | Y | APTEIQLTD | 41.52 | APTSEIQLTD | 39.29 | APSTEIQLTD | 18.44 | | |
| E | 449 | 1.58 | 12 | 3 | 0 | Y | PTEIQLTDY | 41.52 | PTSEIQLTDY | 39.29 | PSTEIQLTDY | 18.44 | | |
| E | 450 | 1.58 | 12 | 3 | 0 | Y | TEIQLTDYG | 41.52 | TSEIQLTDYG | 39.29 | STEIQLTDYG | 18.44 | | |
| E | 451 | 1.17 | 12 | 4 | 0 | Y | TEIQLTDYGA | 59.47 | SEIQLTDYGA | 37.88 | SEIQLTDYGT | 1.41 | TEIQLTDYGV | 0.58 |
| E | 452 | 0.22 | 9 | 3 | 0 | Y | EIQLTDYGAL | 97.44 | EIQLTDYGTL | 1.41 | EIQLTDYGVL | 0.58 | | |
| E | 453 | 0.24 | 11 | 3 | 0 | Y | IQLTDYGALT | 97.27 | IQLTDYGTLT | 1.41 | IQLTDYGVLT | 0.58 | | |
| E | 454 | 0.24 | 11 | 3 | 0 | Y | QLTDYGALTL | 97.27 | QLTDYGTLTL | 1.41 | QLTDYGVLTL | 0.58 | | |
| E | 455 | 0.24 | 11 | 3 | 0 | Y | LTDYGALTLD | 97.27 | LTDYGTLTLD | 1.41 | LTDYGVLTLD | 0.58 | | |
| E | 456 | 0.24 | 11 | 3 | 0 | Y | TDYGALTLDC | 97.27 | TDYGTLTLDC | 1.41 | TDYGVLTLDC | 0.58 | | |
| E | 457 | 0.2 | 7 | 2 | 0 | Y | DYGALTLDCS | 97.68 | DYGTLTLDCS | 1.41 | | | | |
| E | 458 | 0.19 | 6 | 2 | 0 | Y | YGALTLDCSP | 97.77 | YGTLTLDCSP | 1.41 | | | | |
| E | 459 | 0.19 | 6 | 2 | 0 | Y | GALTLDCSPR | 97.77 | GTLTLDCSPR | 1.41 | | | | |

FIG. 4-19

Species: DENV1 (10-MERS)

| protein | block starting position | block entropy | total peptides in

FIG. 4-20

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 484 | 0.1 | 5 | 2 | 0 | Y | KSWLVHKQWF | 98.92 | KAWLVHKQWF | 0.66 | | | | |
| E | 485 | 0.08 | 4 | 1 | 0 | Y | SWLVHKQWFL | 99.09 | | | | | | |
| E | 486 | 0.03 | 3 | 1 | 0 | Y | WLVHKQWFLD | 99.75 | | | | | | |
| E | 487 | 0.03 | 3 | 1 | 0 | Y | LVHKQWFLDL | 99.75 | | | | | | |
| E | 488 | 0.03 | 3 | 1 | 0 | Y | VHKQWFLDLP | 99.75 | | | | | | |
| E | 489 | 0.01 | 2 | 1 | 0 | Y | HKQWFLDLPL | 99.92 | | | | | | |
| E | 490 | 0.02 | 3 | 1 | 0 | Y | KQWFLDLPLP | 99.83 | | | | | | |
| E | 491 | 0.01 | 2 | 1 | 0 | Y | QWFLDLPLPW | 99.92 | | | | | | |
| E | 492 | 0.02 | 3 | 1 | 0 | Y | WFLDLPLPWT | 99.83 | | | | | | |
| E | 493 | 0.02 | 3 | 1 | 0 | Y | FLDLPLPWTS | 99.83 | | | | | | |
| E | 494 | 0.02 | 3 | 1 | 0 | Y | LDLPLPWTSG | 99.83 | | | | | | |
| E | 495 | 0.06 | 6 | 1 | 0 | Y | DLPLPWTSGA | 99.5 | | | | | | |
| E | 496 | 0.26 | 8 | 3 | 0 | Y | LPLPWTSGAS | 96.86 | LPLPWTSGAT | 1.65 | LPLPWTSGAL | 0.99 | | |
| E | 497 | 0.28 | 11 | 3 | 0 | Y | PLPWTSGAST | 96.69 | PLPWTSGATT | 1.65 | PLPWTSGALT | 0.83 | | |
| E | 506 | 0.68 | 16 | 5 | 0 | Y | TSQETWNRQD | 87.26 | TSQETWNRKD | 11.17 | TLQETWNRQD | 0.25 | TTQETWNRQD | 0.25 |
| E | 507 | 0.64 | 13 | 3 | 0 | Y | SQETWNRQDL | 87.43 | SQETWNRKDL | 11.33 | LQETWNRQDL | 0.25 | | |
| E | 508 | 0.6 | 12 | 2 | 0 | Y | QETWNRQDLL | 87.84 | QETWNRKDLL | 11.33 | | | | |
| E | 509 | 0.59 | 11 | 2 | 0 | Y | ETWNRQDLLV | 88.01 | ETWNRKDLLV | 11.25 | | | ASQETWNRKD | 0.17 |
| E | 510 | 0.58 | 10 | 2 | 0 | Y | TWNRQDLLVT | 88.09 | TWNRKDLLVT | 11.25 | | | | |
| E | 511 | 0.56 | 8 | 2 | 0 | Y | WNRQDLLVTF | 88.25 | WNRKDLLVTF | 11.25 | | | | |
| E | 512 | 0.57 | 9 | 2 | 0 | Y | NRQDLLVTFK | 88.17 | NRKDLLVTFK | 11.25 | | | | |
| E | 513 | 0.57 | 9 | 2 | 0 | Y | RQDLLVTFKT | 88.17 | RKDLLVTFKT | 11.25 | | | | |
| E | 514 | 0.56 | 8 | 2 | 0 | Y | QDLLVTFKTA | 88.25 | KDLLVTFKTA | 11.25 | | | | |
| E | 515 | 0.05 | 6 | 1 | 0 | Y | DLLVTFKTAH | 99.59 | | | | | | |

FIG. 4-21

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| E | 516 | 0.05 | 6 | 1 | 0 | Y | LLVTFKTAHA | 99.59 |
| E | 517 | 0.05 | 6 | 1 | 0 | Y | LVTFKTAHAK | 99.59 |
| E | 518 | 0.04 | 5 | 1 | 0 | Y | VTFKTAHAKK | 99.67 |
| E | 519 | 0.04 | 5 | 1 | 0 | Y | TFKTAHAKKQ | 99.67 |
| E | 520 | 0.04 | 5 | 1 | 0 | Y | FKTAHAKKQE | 99.67 |

FIG. 4-22

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency

FIG. 4-23

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block

FIG. 4-24

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 590 | 0.38 | 4 | 2 | 0 | Y | KEVAETQHGT | 92

FIG. 4-25

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 620 | 0.44 | 9 | 5 | 0.17 | Y | QDEKGVTQNG | 94.29 | QDEKGVIQNG | 1.9 | QDEKGATQ

FIG. 4-26

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency

FIG. 4-27

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block

FIG. 4-28

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 701 | 0.39 | 8 | 3 | 0 | Y | DFGSIGGVFT | 94.46 | DFGSVGGVFT | 3.89 | DFGSIGGLFT | 0.99 | | | | |
| E | 702 | 0.39 | 8 | 3 | 0 | Y | FGSIGGVFTS | 94.46 | FGSVGGVFTS | 3.89 | FGSIGGLFTS | 0.99 | | | | |
| E | 706 | 0.41 | 11 | 5 | 0 | Y | GGVFTSVGKL | 95.12 | GGVFTSIGKL | 1.16 | GGLFTSVGKL | 0.99 | GGVFTSAGKL | 0.99 | GGVFTSMGKL | 0.99 |
| E | 709 | 0.52 | 11 | 5 | 0 | Y | FTSVGKLVHQ | 92.89 | FTSIGKLVHQ | 3.47 | FTSIGKLIHQ | 1.16 | FTSAGKLVHQ | 0.99 | FTSMGKLVHQ | 0.99 |
| E | 713 | 1.16 | 12 | 5 | 0 | Y | GKLVHQVFGT | 75.35 | GKLVHQIFGT | 17.95 | GKLIHQVFGT | 2.56 | GKLVHQVFGA | 2.48 | GKLIHQVFGT | 0.83 |
| E | 714 | 1.16 | 12 | 5 | 0 | Y | KLVHQVFGTA | 75.35 | KLVHQIFGTA | 17.95 | KLIHQVFGTA | 2.56 | KLVHQVFGAA | 2.48 | KLIHQVFGTA | 0.83 |
| E | 715 | 1.16 | 12 | 5 | 0 | Y | LVHQVFGTAY | 75.35 | LVHQIFGTAY | 17.95 | LIHQVFGTAY | 2.56 | LVHQVFGAAY | 2.48 | LIHQVFGTAY | 0.83 |
| E | 716 | 1.15 | 11 | 3 | 0 | Y | VHQVFGTAYG | 75.43 | VHQIFGTAYG | 17.95 | IHQVFGTAYG | 2.56 | VHQVFGAAYG | 2.48 | IHQVFGTAYG | 0.83 |
| E | 717 | 0.93 | 8 | 3 | 0 | Y | HQVFGTAYGV | 77.92 | HQIFGTAYGV | 18.86 | HQVFGAAYGV | 2.56 | | | | |
| E | 718 | 0.93 | 8 | 3 | 0 | Y | QIFGTAYGVL | 77.92 | QVFGTAYGVL | 18.86 | QVFGAAYGVL | 2.56 | | | | |
| E | 719 | 0.93 | 8 | 3 | 0 | Y | IFGTAYGVLF | 77.92 | VFGTAYGVLF | 18.86 | VFGAAYGVLF | 2.56 | | | | |
| E | 720 | 0.23 | 6 | 2 | 0 | Y | FGTAYGVLFS | 96.77 | FGAAYGVLFS | 2.89 | | | | | | |
| E | 721 | 0.23 | 6 | 2 | 0 | Y | GTAYGVLFSG | 96.77 | GAAYGVLFSG | 2.89 | | | | | | |
| E | 722 | 0.23 | 6 | 2 | 0 | Y | TAYGVLFSGV | 96.77 | AAYGVLFSGV | 2.89 | | | | | | |
| E | 723 | 0.03 | 4 | 1 | 0 | Y | AYGVLFSGVS | 99.75 | | | | | | | | |
| E | 724 | 0.03 | 6 | 1 | 0 | Y | YGVLFSGVSW | 99.75 | | | | | | | | |
| E | 725 | 0.05 | 5 | 1 | 0 | Y | GVLFSGVSWT | 99.59 | | | | | | | | |
| E | 726 | 0.04 | 4 | 1 | 0 | Y | VLFSGVSWTM | 99.67 | | | | | | | | |
| E | 727 | 0.03 | 5 | 1 | 0 | Y | LFSGVSWTMK | 99.75 | | | | | | | | |
| E | 728 | 0.04 | 5 | 1 | 0 | Y | FSGVSWTMKI | 99.67 | | | | | | | | |
| E | 729 | 0.05 | 6 | 1 | 0 | Y | SGVSWTMKIG | 99.59 | | | | | | | | |
| E | 730 | 0.12 | 7 | 2 | 0 | Y | GVSWTMKIGI | 98.68 | GYSWTMKIGL | 0.91 | | | | | | |
| E | 731 | 0.12 | 7 | 2 | 0 | Y | VSWTMKIGIG | 98.68 | VSWTMKIGLG | 0.91 | | | | | | |
| E | 732 | 0.94 | 9 | 3 | 0 | Y | SWTMKIGIGV | 73.78 | SWTMKIGIGI | 24.73 | SWTMKIGLGV | 0.91 | | | | |

FIG. 4-29

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 733 | 0.94 | 9 | 3 | 0 | Y | WTMKIGIGVL | 73.78 | WTMKIGIGIL | 24.73 | WTMKIGLGVL | 0.91 | | |
| E | 734 | 0.97 | 9 | 3 | 0 | Y | TMKIGIGVLL | 73.45 | TMKIGIGILL | 24.73 | TMKIGLGVLL | 0.91 | | |
| E | 735 | 0.95 | 10 | 3 | 0 | Y | MKIGIGVLLT | 73.53 | MKIGIGILLT | 24.81 | MKIGLGVLLT | 0.91 | | |
| E | 736 | 0.95 | 8 | 3 | 0 | Y | KIGIGVLLTW | 73.53 | KIGIGILLTW | 24.81 | KIGLGVLLTW | 0.91 | | |
| E | 737 | 0.95 | 8 | 3 | 0 | Y | IGIGVLLTWL | 73.53 | IGIGILLTWL | 24.81 | IGLGVLLTWL | 0.91 | | |
| E | 738 | 0.94 | 6 | 3 | 0 | Y | GIGVLLTWLG | 73.61 | GIGILLTWLG | 24.9 | GLGVLLTWLG | 0.91 | | |
| E | 739 | 0.96 | 8 | 3 | 0 | Y | IGVLLTWLGL | 73.53 | IGILLTWLGL | 24.73 | LGVLLTWLGL | 0.91 | | |
| E | 740 | 0.89 | 7 | 2 | 0 | Y | GVLLTWLGLN | 74.44 | GILLTWLGLN | 24.73 | | | | |
| E | 741 | 0.89 | 7 | 2 | 0 | Y | VLLTWLGLNS | 74.44 | ILLTWLGLNS | 24.73 | | | | |
| E | 742 | 0.07 | 5 | 1 | 0 | Y | LLTWLGLNSR | 99.34 | | | | | | |
| E | 743 | 0.15 | 6 | 2 | 0 | Y | LTWLGLNSRS | 98.35 | LTWLGLNSRN | 0.99 | TWLGLNSRNT | 0.99 | | |
| E | 744 | 0.21 | 7 | 3 | 0 | Y | TWLGLNSRST | 97.52 | TWLGLNSRSA | 0.99 | WLGLNSRNTS | 0.99 | | |
| E | 745 | 0.21 | 7 | 3 | 0 | Y | WLGLNSRSTS | 97.52 | WLGLNSRSAS | 0.99 | | | | |
| E | 746 | 0.32 | 8 | 4 | 0 | Y | LGLNSRSTSL | 96.11 | LGLNSRSTSF | 1.41 | LGLNSRSASL | 0.99 | LGLNSRNTSL | 0.99 |
| E | 747 | 0.32 | 8 | 4 | 0 | Y | GLNSRSTSLS | 96.11 | GLNSRSTSFS | 1.41 | GLNSRNTSLS | 0.99 | GLNSRSASLS | 0.99 |
| E | 748 | 0.33 | 9 | 4 | 0 | Y | LNSRSTSLSM | 96.11 | LNSRSTSFSM | 1.41 | LNSRSASLSM | 0.99 | LNSRNTSLSV | 0.74 |
| E | 749 | 0.3 | 8 | 4 | 0 | Y | NSRSTSLSMT | 96.36 | NSRSTSFSMT | 1.41 | NSRSASLSMT | 0.99 | NSRNTSLSVM | 0.74 |
| E | 750 | 0.3 | 8 | 4 | 0 | Y | SRSTSLSMTC | 96.36 | SRSTSFSMTC | 1.41 | SRSASLSMTC | 0.99 | SRNTSLSVMC | 0.74 |
| E | 751 | 0.31 | 9 | 4 | 0 | Y | RSTSLSMTCI | 96.28 | RSTSFSMTCI | 1.41 | RSASLSMTCI | 0.99 | RNTSLSVMCI | 0.74 |
| E | 752 | 0.38 | 11 | 5 | 0 | Y | STSLSMTCIA | 95.53 | STSFSMTCIA | 1.32 | SASLSMTCIA | 0.99 | NTSLSVMCIA | 0.74 | STSLSMTCIV | 0.74 |
| E | 753 | 0.37 | 10 | 5 | 0 | Y | TSLSMTCIAV | 95.62 | TSFSMTCIAV | 1.32 | ASLSMTCIAV | 0.99 | TSLSMTCIW | 0.74 | TSLSVMCIAV | 0.74 |
| E | 754 | 0.27 | 8 | 4 | 0 | Y | SLSMTCIAVG | 96.77 | SFSMTCIAVG | 1.32 | SLSVMCIAVG | 0.74 | SLSMTCIWG | 0.74 | | |
| E | 755 | 1.05 | 11 | 5 | 0 | Y | LSMTCIAVGL | 73.95 | LSMTCIAVGM | 22.83 | FSMTCIAVGL | 1.16 | LSVMCIAVGM | 0.74 | LSMTCIWGM | 0.5 |
| E | 756 | 1.04 | 11 | 5 | 0 | Y | SMTCIAVGLV | 73.95 | SMTCIAVGMV | 22.91 | SMTCIAVGLI | 1.16 | SVMCIAVGMV | 0.74 | SMTCIWGMV | 0.5 |

FIG. 4-30

Species: DENV1 (10-MERS)

|

FIG. 4-31

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency |
|---

FIG. 4-32

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 805 | 0.03 | 4 | 1 | 0 | Y | EQYKFQADSP | 99.75 | | | | | | |
| NS1 | 806 | 0.03 | 4 | 1 | 0 | Y | QYKFQADSPK | 99.75 | | | | | | |
| NS1 | 807 | 0.05 | 6 | 1 | 0 | Y | YKFQADSPKR | 99.59 | | | | | | |
| NS1 | 808 | 0.05 | 6 | 1 | 0 | Y | KFQADSPKRL | 99.59 | | | | | | |
| NS1 | 809 | 0.04 | 5 | 1 | 0 | Y | FQADSPKRLS | 99.67 | | | | | | |
| NS1 | 810 | 0.06 | 6 | 1 | 0 | Y | QADSPKRLSA | 99.5 | | | | | | |
| NS1 | 811 | 0.06 | 7 | 1 | 0 | Y | ADSPKRLSAA | 99.5 | | | | | | |
| NS1 | 812 | 0.08 | 8 | 1 | 0 | Y | DSPKRLSAAI | 99.34 | | | | | | |
| NS1 | 813 | 0.08 | 8 | 1 | 0 | Y | SPKRLSAAIG | 99.34 | | | | | | |
| NS1 | 814 | 0.17 | 9 | 2 | 0 | Y | PKRLSAAIGK | 98.1 | PKRLSAAIGR | 1.24 | | | | |
| NS1 | 815 | 0.18 | 10 | 2 | 0 | Y | KRLSAAIGKA | 98.01 | KRLSAAIGRA | 1.24 | | | | |
| NS1 | 816 | 0.17 | 9 | 2 | 0 | Y | RLSAAIGKAW | 98.1 | RLSAAIGRAW | 1.24 | | | | |
| NS1 | 817 | 0.18 | 9 | 2 | 0 | Y | LSAAIGKAWE | 98.01 | LSAAIGRAWE | 1.24 | | | | |
| NS1 | 818 | 0.18 | 9 | 2 | 0 | Y | SAAIGKAWEE | 98.01 | SAAIGRAWEE | 1.24 | | | | |
| NS1 | 819 | 0.18 | 9 | 2 | 0 | Y | AAIGKAWEEG | 98.01 | AAIGRAWEEG | 1.24 | | | | |
| NS1 | 820 | 0.17 | 8 | 2 | 0 | Y | AIGKAWEEGV | 98.1 | AIGRAWEEGV | 1.24 | | | | |
| NS1 | 821 | 0.16 | 7 | 2 | 0 | Y | IGKAWEEGVC | 98.18 | IGRAWEEGVC | 1.24 | | | | |
|

FIG. 4-33

Species: DENV1 (10-MERS)

| protein | block starting position | block entropy | total

FIG. 4-34

Species: DENV1 (10-MERS)

| protein | block starting position | block entropy | total peptides in block | # peptides required to cover 99% of block | gap/X fraction | 99% of block covered w/ <= 5 peptides?

FIG. 4-35

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 891 | 0.24 | 11 | 4 | 0 | Y | KSWGKAKIIG | 97.44 | KIWGKAKIIG | 0.74 | RSWGKAKIIG | 0.74 | KSWGKAKVIG | 0.25 | | |
| NS1 | 892 | 0.18 | 10 | 3 | 0 | Y | SWGKAKIIGA | 98.18 | IWGKAKIIGA | 0.74 | SWGKAKVIGA | 0.25 | | | | |
| NS1 | 893 | 0.09 | 8 | 1 | 0 | Y | WGKAKIIGAD | 99.17 | | | | | | | | |
| NS1 | 894 | 1.17 | 12 | 4 | 0 | Y | GKAKIIGADV | 72.87 | GKAKIIGADI | 19.69 | GKAKIIGADA | 5.79 | GKAKIIGADT | 0.83 | | |
| NS1 | 895 | 1.18 | 13 | 4 | 0 | Y | KAKIIGADVQ | 72.87 | KAKIIGADIQ | 19.6 | KAKIIGADAQ | 5.79 | KAKIIGADTQ | 0.83 | | |
| NS1 | 896 | 1.17 | 12 | 4 | 0 | Y | AKIIGADVQN | 72.95 | AKIIGADIQN | 19.6 | AKIIGADAQN | 5.79 | AKIIGADTQN | 0.83 | | |
| NS1 | 904 | 0.47 | 7 | 3 | 0 | Y | QNTTFIIDGP | 92.8 | QNSTFIIDGP | 4.71 | QNATFIIDGP | 1.99 | | | | |
| NS1 | 907 | 0.81 | 8 | 2 | 0 | Y | TFIIDGPNTP | 78.66 | TFIIDGPDTP | 20.6 | | | | | | |
| NS1 | 908 | 0.81 | 8 | 2 | 0 | Y | FIIDGPNTPE | 78.66 | FIIDGPDTPE | 20.6 | | | | | | |
| NS1 | 909 | 0.81 | 8 | 2 | 0 | Y | IIDGPNTPEC | 78.66 | IIDGPDTPEC | 20.6 | | | | | | |
| NS1 | 910 | 0.86 | 10 | 3 | 0 | Y | IDGPNTPECP | 78.33 | IDGPDTPECP | 20.43 | IDGPNTPECS | 0.33 | | | | |
| NS1 | 911 | 0.89 | 12 | 5 | 0 | Y | DGPNTPECPD | 78.16 | DGPDTPECPD | 20.18 | DGPNTPECSD | 0.33 | DGPDTPECPN | 0.25 | DGPNTSECPD | 0.17 |
| NS1 | 917 | 0.94 | 11 | 5 | 0 | Y | ECPDDQRAWN | 82.96 | ECPDNQRAWN | 9.93 | ECPDGQRAWN | 5.05 | ECPDEQRAWN | 0.83 | ECSDDQRAWN | 0.5 |
| NS1 | 918 | 0.95 | 12 | 5 | 0 | Y | CPDDQRAWNI | 82.88 | CPDNQRAWNI | 9.93 | CPDGQRAWNI | 5.05 | CPDEQRAWNI | 0.83 | CSDDQRAWNI | 0.5 |
| NS1 | 919 | 0.95 | 12 | 5 | 0 | Y | PDDQRAWNIW | 82.88 | PDNQRAWNIW | 9.93 | PDGQRAWNIW | 5.05 | PDEQRAWNIW | 0.83 | SDDQRAWNIW | 0.5 |
| NS1 | 920 | 0.91 | 12 | 4 | 0 | Y | DDQRAWNIWE | 83.29 | DNQRAWNIWE | 9.93 | DGQRAWNIWE | 5.05 | DEQRAWNIWE | 0.83 | | |
| NS1 | 921 | 0.89 | 10 | 4 | 0 | Y | DQRAWNIWEV | 83.46 | NQRAWNIWEV | 9.93 | GQRAWNIWEV | 5.05 | EQRAWNIWEV | 1.08 | | |
| NS1 | 922 | 0.04 | 5 | 1 | 0 | Y | QRAWNIWEVE | 99.67 | | | | | | | | |
| NS1 | 923 | 0.03 | 4 | 1 | 0 | Y | RAWNIWEVED | 99.75 | | | | | | | | |
| NS1 | 924 | 0.03 | 4 | 1 | 0 | Y | AWNIWEVEDY | 99.75 | | | | | | | | |
| NS1 | 925 | 0.03 | 4 | 1 | 0 | Y | WNIWEVEDYG | 99.75 | | | | | | | | |
| NS1 | 926 | 0.03 | 4 | 1 | 0 | Y | NIWEVEDYGF | 99.75 | | | | | | | | |
| NS1 | 927 | 0.03 | 4 | 1 | 0 | Y | IWEVEDYGFG | 99.75 | | | | | | | | |
| NS1 | 928 | 0.15 | 6 | 2 | 0 | Y | WEVEDYGFGI | 98.26 | WEVEDYGFGV | 1.41 | | | | | | |

FIG. 4-36

Species: DENV1 (10-MERS)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of

FIG. 4-37

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 956 | 0.07 | 8 | 1 | 0 | Y | HRLMSAAIKD | 99.42 | | | | | | |
| NS1 | 957 | 0.06 | 7 | 1 | 0 | Y | RLMSAAIKDS | 99.5 | | | | | | |
| NS1 | 958 | 0.09 | 8 | 1 | 0 | Y | LMSAAIKDSK | 99.17 | | | | | | |
| NS1 | 959 | 0.08 | 7 | 1 | 0 | Y | MSAAIKDSKA | 99.26 | | | | | | |
| NS1 | 960 | 0.08 | 7 | 1 | 0 | Y | SAAIKDSKAV | 99.26 | | | | | | |
| NS1 | 961 | 0.08 | 7 | 1 | 0 | Y | AAIKDSKAVH | 99.26 | | | | | | |
| NS1 | 962 | 0.08 | 7 | 1 | 0 | Y | AIKDSKAVHA | 99.26 | | | | | | |
| NS1 | 963 | 0.08 | 7 | 1 | 0 | Y | IKDSKAVHAD | 99.26 | | | | | | |
| NS1 | 964 | 0.08 | 7 | 1 | 0 | Y | KDSKAVHADM | 99.26 | | | | | | |
| NS1 | 965 | 0.07 | 6 | 1 | 0 | Y | DSKAVHADMG | 99.34 | | | | | | |
| NS1 | 966 | 0.06 | 5 | 1 | 0 | Y | SKAVHADMGY | 99.42 | | | | | | |
| NS1 | 967 | 0.04 | 2 | 1 | 0 | Y | KAVHADMGYW | 99.59 | | | | | | |
| NS1 | 968 | 0.01 | 2 | 1 | 0 | Y | AVHADMGYWI | 99.92 | | | | | | |
| NS1 | 969 | 0.01 | 2 | 1 | 0 | Y | VHADMGYWIE | 99.92 | | | | | | |
| NS1 | 970 | 0.01 | 2 | 1 | 0 | Y | HADMGYWIES | 99.92 | | | | | | |
| NS1 | 971 | 0.03 | 3 | 1 | 0 | Y | ADMGYWIESE | 99.75 | | | | | | |
| NS1 | 972 | 0.11 | 6 | 2 | 0 | Y | DMGYWIESEK | 98.84 | DMGYWIESER | 0.83 | | | | |
| NS1 | 973 | 0.11 | 6 | 2 | 0 | Y | MGYWIESEKN | 98.84 | MGYWIESERN | 0.83 | | | | |
| NS1 | 974 | 0.13 | 7 | 2 | 0 | Y | GYWIESEKNE | 98.68 | GYWIESERNE | 0.83 | | | | |
| NS1 | 975 | 0.14 | 8 | 2 | 0 | Y | YWIESEKNET | 98.51 | YWIESERNET | 0.83 | | | | |
| NS1 | 976 | 0.14 | 8 | 2 | 0 | Y | WIESEKNETW | 98.51 | WIESERNETW | 0.83 | | | | |
| NS1 | 977 | 0.15 | 9 | 2 | 0 | Y | IESEKNETWK | 98.43 | IESERNETWK | 0.83 | | | | |
| NS1 | 978 | 0.14 | 8 | 2 | 0 | Y | ESEKNETWKL | 98.51 | ESERNETWKL | 0.83 | | | | |
| NS1 | 979 | 0.2 | 12 | 3 | 0 | Y | SEKNETWKLA | 98.01 | SERNETWKLA | 0.83 | SEKNEPWKLA | 0.17 | | |

FIG. 4-38

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 982 | 0.23 | 12 | 4 | 0 | Y | NETWKLARAS | 97.68 | NETWKLARAS | 0.91 | NETWKLAGAS | 0.33 | NEPWKLARAS | 0.17 |
| NS1 | 983 | 0.24 | 13 | 4 | 0 | Y | ETWKLARASF | 97.6 | ETWKLARASF | 0.91 | ETWKLAGASF | 0.33 | EPWKLARASF | 0.17 |
| NS1 | 984 | 0.22 | 12 | 3 | 0 | Y | TWKLARASFI | 97.77 | TWKLARASFI | 0.91 | TWKLAGASFI | 0.33 | | |
| NS1 | 985 | 0.2 | 11 | 3 | 0 | Y | WKLARASFIE | 97.93 | WKLARASFIE | 0.91 | WKLAGASFIE | 0.33 | | |
| NS1 | 986 | 0.2 | 11 | 3 | 0 | Y | KLARASFIEV | 97.93 | KLARASFIEV | 0.91 | KLAGASFIEV | 0.33 | | |
| NS1 | 987 | 0.19 | 10 | 3 | 0 | Y | LARASFIEVK | 98.01 | LARASFIEVK | 0.91 | LAGASFIEVK | 0.33 | | |
| NS1 | 988 | 0.19 | 10 | 3 | 0 | Y | ARASFIEVKT | 98.01 | AKASFIEVKT | 0.91 | AGASFIEVKT | 0.33 | | |
| NS1 | 989 | 0.14 | 6 | 2 | 0 | Y | RASFIEVKTC | 98.51 | KASFIEVKTC | 0.91 | | | | |
| NS1 | 990 | 0.81 | 7 | 3 | 0 | Y | ASFIEVKTCI | 82.8 | ASFIEVKTCT | 13.73 | ASFIEVKTCV | 3.14 | | |
| NS1 | 991 | 0.81 | 7 | 3 | 0 | Y | SFIEVKTCIW | 82.8 | SFIEVKTCTW | 13.73 | SFIEVKTCVW | 3.14 | | |
| NS1 | 992 | 0.8 | 6 | 3 | 0 | Y | FIEVKTCIWP | 82.88 | FIEVKTCTWP | 13.73 | FIEVKTCVWP | 3.14 | | |
| NS1 | 993 | 0.84 | 6 | 3 | 0 | Y | IEVKTCIWPK | 82.38 | IEVKTCTWPK | 13.73 | IEVKTCVWPK | 3.14 | | |
| NS1 | 994 | 0.84 | 6 | 3 | 0 | Y | EVKTCIWPKS | 82.38 | EVKTCTWPKS | 13.73 | EVKTCVWPKS | 3.14 | | |
| NS1 | 995 | 0.84 | 6 | 3 | 0 | Y | VKTCIWPKSH | 82.38 | VKTCTWPKSH | 13.73 | VKTCVWPKSH | 3.14 | | |
| NS1 | 996 | 0.84 | 6 | 3 | 0 | Y | KTCIWPKSHT | 82.38 | KTCTWPKSHT | 13.73 | KTCVWPKSHT | 3.14 | | |
| NS1 | 997 | 0.84 | 6 | 3 | 0 | Y | TCIWPKSHTL | 82.38 | TCTWPKSHTL | 13.73 | TCVWPKSHTL | 3.14 | | |
| NS1 | 998 | 0.84 | 6 | 3 | 0 | Y | CIWPKSHTLW | 82.38 | CTWPKSHTLW | 13.73 | CVWPKSHTLW | 3.14 | | |
| NS1 | 999 | 0.84 | 6 | 3 | 0 | Y | IWPKSHTLWS | 82.38 | TWPKSHTLWS | 13.73 | VWPKSHTLWS | 3.14 | | |
| NS1 | 1000 | 0.06 | 3 | 1 | 0 | Y | WPKSHTLWSN | 99.34 | | | | | | |
| NS1 | 1001 | 0.06 | 3 | 1 | 0 | Y | PKSHTLWSNG | 99.34 | | | | | | |
| NS1 | 1002 | 0.06 | 3 | 1 | 0 | Y | KSHTLWSNGV | 99.34 | | | | | | |
| NS1 | 1003 | 0.03 | 4 | 1 | 0 | Y | SHTLWSNGVL | 99.75 | | | | | | |
| NS1 | 1004 | 0.03 | 4 | 1 | 0 | Y | HTLWSNGVLE | 99.75 | | | | | | |
| NS1 | 1005 | 0.03 | 4 | 1 | 0 | Y | TLWSNGVLES | 99.75 | | | | | | |

FIG. 4-39

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1006 | 0.03 | 4 | 1 | 0 | Y | LWSNGVLESE | 99.75 | | | | | | |
| NS1 | 1007 | 0.03 | 4 | 1 | 0 | Y | WSNGVLESEM | 99.75 | | | | | | |
| NS1 | 1008 | 0.14 | 5 | 2 | 0 | Y | SNGVLESEMI | 98.26 | SNGVLESEMV | 1.49 | | | | |
| NS1 | 1009 | 0.17 | 6 | 2 | 0 | Y | NGVLESEMII | 98.01 | NGVLESEMVI | 1.49 | | | | |
| NS1 | 1010 | 0.16 | 5 | 2 | 0 | Y | GVLESEMIIP | 98.1 | GVLESEMVIP | 1.49 | | | | |
| NS1 | 1011 | 0.16 | 5 | 2 | 0 | Y | VLESEMIIPK | 98.1 | VLESEMVIPK | 1.49 | | | | |
| NS1 | 1012 | 0.29 | 8 | 3 | 0 | Y | LESEMIIPKI | 96.53 | LESEMIIPKM | 1.49 | LESEMIIPKM | 0.99 | | |
| NS1 | 1013 | 0.4 | 8 | 4 | 0 | Y | ESEMIIPKIY | 95.04 | ESEMIIPKIH | 1.65 | ESEMVIPKIY | 1.49 | ESEMIIPKMY | 0.99 |
| NS1 | 1014 | 0.4 | 8 | 4 | 0 | Y | SEMIIPKIYG | 95.04 | SEMIIPKIHG | 1.65 | SEMVIPKIYG | 1.49 | SEMIIPKMYG | 0.99 |
| NS1 | 1015 | 0.4 | 8 | 4 | 0 | Y | EMIIPKIYGG | 95.04 | EMIIPKIHGG | 1.65 | EMVIPKIYGG | 1.49 | EMIIPKMYGG | 0.99 |
| NS1 | 1016 | 0.4 | 8 | 4 | 0 | Y | MIIPKIYGGP | 95.04 | MIIPKIHGGP | 1.65 | MVIPKIYGGP | 1.49 | MIIPKMYGGP | 0.99 |
| NS1 | 1019 | 0.41 | 12 | 5 | 0 | Y | PKIYGGPISQ | 95.12 | PKIHGGPISQ | 1.65 | PKIYGGPTSQ | 0.99 | PKMYGGPISQ | 0.83 |
| NS1 | 1020 | 0.41 | 12 | 5 | 0 | Y | KIYGGPISQH | 95.12 | KIHGGPISQH | 1.65 | KIYGGPTSQH | 0.99 | KMYGGPISQH | 0.83 |
| NS1 | 1021 | 0.41 | 12 | 5 | 0 | Y | IYGGPISQHN | 95.12 | IHGGPISQHN | 1.65 | IYGGPTSQHN | 0.99 | MYGGPISQHN | 0.83 |
| NS1 | 1022 | 0.37 | 7 | 4 | 0 | Y | YGGPISQHNY | 95.45 | HGGPISQHNY | 1.65 | YGGPTSQHNY | 1.08 | YGGPISQHNH | 0.91 |
| NS1 | 1023 | 0.25 | 6 | 3 | 0 | Y | GGPISQHNYR | 97.11 | GGPTSQHNYR | 1.08 | GGPISQHNHR | 0.91 | | |
| NS1 | 1024 | 0.25 | 6 | 3 | 0 | Y | GPISQHNYRP | 97.02 | GPTSQHNYRP | 1.08 | GPISQHNHRP | 0.91 | | |
| NS1 | 1025 | 0.25 | 6 | 3 | 0 | Y | PISQHNYRPG | 97.02 | PTSQHNYRPG | 1.08 | PISQHNHRPG | 0.91 | | |
| NS1 | 1026 | 0.25 | 6 | 3 | 0 | Y | ISQHNYRPGY | 97.02 | TSQHNYRPGY | 1.08 | ISQHNHRPGY | 0.91 | | |
| NS1 | 1027 | 0.15 | 7 | 2 | 0 | Y | SQHNYRPGYF | 98.35 | SQHNYRPGYF | 0.91 | | | | |
| NS1 | 1028 | 0.15 | 7 | 2 | 0 | Y | QHNYRPGYFT | 98.35 | QHNYRPGYFT | 0.91 | | | | |
| NS1 | 1029 | 0.15 | 7 | 2 | 0 | Y | HNYRPGYFTQ | 98.35 | HNHRPGYFTQ | 0.91 | | | | |
| NS1 | 1030 | 0.46 | 9 | 3 | 0 | Y | NYRPGYFTQT | 93.13 | NYRPGYFTQA | 4.96 | NHRPGYFTQT | 0.91 | | |
| NS1 | 1031 | 0.46 | 9 | 3 | 0 | Y | YRPGYFTQTA | 93.13 | YRPGYFTQAA | 4.96 | HRPGYFTQTA | 0.91 | | |

FIG. 4-40

Species: DENV1 (10-MERS)

| protein | block starting position | block entropy

FIG. 4-41

Species: DENV1 (10-MERS)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1056 | 0.1 | 7 | 1 | 0 | Y | EGTTVVDEH | 99.09 | | | | | | |
| NS1 | 1057 | 0.1 | 7 | 1 | 0 | Y | GTTVVDEHC | 99.09 | | | | | | |
| NS1 | 1058 | 0.1 | 7 | 1 | 0 | Y | TTVVDEHCG | 99.09 | | | | | | |
| NS1 | 1059 | 0.23 | 9 | 3 | 0 | Y | TVVDEHCGN | 97.44 | TVVDEHCGS | 0.83 | TVVDEHCGS | 0.83 | | |
| NS1 | 1060 | 0.23 | 9 | 3 | 0 | Y | VVDEHCGNR | 97.44 | VVDEHCGYR | 0.83 | VVDEHCGSR | 0.83 | | |
| NS1 | 1061 | 0.23 | 9 | 3 | 0 | Y | VDEHCGNRG | 97.44 | VDEHCGYRG | 0.83 | VDEHCGYRG | 0.83 | | |
| NS1 | 1062 | 0.22 | 9 | 3 | 0 | Y | DEHCGNRGP | 97.6 | DEHCGSRGP | 0.83 | VDEHCGYRGP | 0.83 | | |
| NS1 | 1063 | 0.23 | 9 | 3 | 0 | Y | EHCGNRGPS | 97.52 | EHCGYRGPS | 0.83 | DEHCGSRGPS | 0.83 | | |
| NS1 | 1064 | 0.21 | 10 | 3 | 0 | Y | HCGNRGPSLR | 97.68 | HCGYRGPSLR | 0.83 | EHCGSRGPSL | 0.83 | | |
| NS1 | 1065 | 0.18 | 9 | 3 | 0 | Y | CGNRGPSLRT | 98.01 | CGYRGPSLRT | 0.83 | HCGSRGPSLR | 0.83 | | |
| NS1 | 1066 | 0.18 | 6 | 3 | 0 | Y | GNRGPSLRTT | 98.01 | GSRGPSLRTT | 0.83 | CGSRGPSLRT | 0.83 | | |
| NS1 | 1067 | 0.18 | 6 | 3 | 0 | Y | NRGPSLRTTT | 98.01 | YRGPSLRTTT | 0.83 | GYRGPSLRTT | 0.83 | | |
| NS1 | 1068 | 0.05 | 6 | 1 | 0 | Y | RGPSLRTTTV | 99.5 | | | SRGPSLRTTT | 0.83 | | |
| NS1 | 1069 | 0.07 | 5 | 1 | 0 | Y | GPSLRTTTVT | 99.42 | | | | | | |
| NS1 | 1070 | 0.07 | 7 | 1 | 0 | Y | PSLRTTTVTG | 99.42 | | | | | | |
| NS1 | 1071 | 0.05 | 7 | 1 | 0 | Y | SLRTTTVTGK | 99.59 | | | | | | |
| NS1 | 1072 | 0.14 | 6 | 2 | 0 | Y | LRTTTVTGKI | 98.43 | LRTTVTGKT | 1.08 | | | | |
| NS1 | 1073 | 0.14 | 8 | 2 | 0 | Y | RTTTVTGKII | 98.35 | RTTVTGKTI | 1.08 | | | | |
| NS1 | 1074 | 0.15 | 9 | 2 | 0 | Y | TTTVTGKIIH | 98.35 | TTVTGKTIH | 1.08 | | | | |
| NS1 | 1075 | 0.15 | 9 | 2 | 0 | Y | TTVTGKIIHE | 98.35 | TTVTGKTIHE | 1.08 | | | | |
| NS1 | 1076 | 0.15 | 9 | 2 | 0 | Y | TVTGKIIHEW | 98.43 | TVTGKTIHEW | 1.08 | | | | |
| NS1 | 1077 | 0.14 | 8 | 2 | 0 | Y | VTGKIIHEWC | 98.43 | VTGKTIHEWC | 1.08 | | | | |
| NS1 | 1078 | 0.14 | 8 | 2 | 0 | Y | TGKIIHEWCC | 98.43 | TGKTIHEWCC | 1.08 | | | | |
| NS1 | 1079 | 0.13 | 7 | 2 | 0 | Y | | 98.51 | | | | | | |

FIG. 4-42

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 1080 | 0.12 | 6 | 2 | 0 | Y | GKIIHEWCCR | 98.59 | GKIIHEWCCR | 1.08 |
| NS1 | 1081 | 0.14 | 7 | 2 | 0 | Y | KIIHEWCCRS | 98.43 | KIIHEWCCRS | 1.08 |
| NS1 | 1082 | 0.14 | 7 | 2 | 0 | Y | IIHEWCCRSC | 98.43 | IIHEWCCRSC | 1.08 |
| NS1 | 1083 | 0.05 | 5 | 1 | 0 | Y | IHEWCCRSCT | 99.59 | | |
| NS1 | 1084 | 0.04 | 4 | 1 | 0 | Y | HEWCCRSCTL | 99.67 | | |
| NS1 | 1085 | 0.02 | 2 | 1 | 0 | Y | EWCCRSCTLP | 99.83 | | |
| NS1 | 1086 | 0.02 | 2 | 1 | 0 | Y | WCCRSCTLPP | 99.83 | | |
| NS1 | 1087 | 0.02 | 2 | 1 | 0 | Y | CCRSCTLPPL | 99.83 | | |
| NS1 | 1088 | 0.02 | 2 | 1 | 0 | Y | CRSCTLPPLR | 99.83 | | |
| NS1 | 1089 | 0.03 | 3 | 1 | 0 | Y | RSCTLPPLRF | 99.75 | | |
| NS1 | 1090 | 0.99 | 4 | 2 | 0 | Y | SCTLPPLRFR | 60.63 | SCTLPPLRFK | 39.12 |
| NS1 | 1091 | 0.98 | 4 | 2 | 0 | Y | CTLPLRFRG | 60.71 | CTLPPLRFKG | 39.12 |
| NS1 | 1092 | 0.98 | 4 | 2 | 0 | Y | TLPPLRFRGE | 60.71 | TLPPLRFKGE | 39.12 |
| NS1 | 1093 | 0.99 | 5 | 2 | 0 | Y | LPPLRFRGED | 60.63 | LPPLRFKGED | 39.12 |
| NS1 | 1094 | 0.99 | 5 | 2 | 0 | Y | PPLRFRGEDG | 60.63 | PPLRFKGEDG | 39.12 |
| NS1 | 1095 | 0.99 | 5 | 2 | 0 | Y | PLRFRGEDGC | 60.63 | PLRFKGEDGC | 39.12 |
| NS1 | 1096 | 0.99 | 5 | 2 | 0 | Y | LRFRGEDGCW | 60.63 | LRFKGEDGCW | 39.12 |
| NS1 | 1097 | 0.99 | 5 | 2 | 0 | Y | RFRGEDGCWY | 60.63 | RFKGEDGCWY | 39.12 |
| NS1 | 1098 | 0.99 | 5 | 2 | 0 | Y | FRGEDGCWYG | 60.63 | FKGEDGCWYG | 39.12 |
| NS1 | 1099 | 0.98 | 4 | 2 | 0 | Y | RGEDGCWYGM | 60.71 | KGEDGCWYGM | 39.12 |
| NS1 | 1100 | 0.02 | 3 | 1 | 0 | Y | GEDGCWYGME | 99.83 | | |
| NS1 | 1101 | 0.01 | 2 | 1 | 0 | Y | EDGCWYGMEI | 99.92 | | |
| NS1 | 1102 | 0.02 | 3 | 1 | 0 | Y | DGCWYGMEIR | 99.83 | | |
| NS1 | 1103 | 0.01 | 2 | 1 | 0 | Y | GCWYGMEIRP | 99.92 | | |

FIG. 4-43

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 4-44

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1128 | 0.18 | 11 | 3 | 0 | Y | GSGEVDSFSL | 98.18 | GLGEVDSFSL | 0.66 | GSGEVDNFSL | 0.33 | | |
| NS2A | 1129 | 0.18 | 11 | 3 | 0 | Y | SGEVDSFSLG | 98.18 | LGEVDSFSLG | 0.66 | SGEVDNFSLG | 0.33 | | |
| NS2A | 1130 | 0.82 | 11 | 3 | 0 | Y | GEVDSFSLGI | 79.9 | GEVDSFSLGI | 19.02 | GEVDNFSLGI | 0.33 | | |
| NS2A | 1131 | 0.79 | 11 | 2 | 0 | Y | EVDSFSLGLL | 80.07 | EVDSFSLGIL | 19.11 | | | | |
| NS2A | 1132 | 0.81 | 8 | 3 | 0 | Y | VDSFSLGLLC | 79.82 | VDSFSLGILC | 19.11 | VDNFSLGILC | 0.33 | | |
| NS2A | 1135 | 1.16 | 9 | 5 | 0 | Y | FSLGLLCISI | 77.34 | FSLGILCVSI | 12.66 | FSLGILCASI | 6.62 | FSLGLLCTSI | 1.65 | FSLGLLCVSI | 0.83 |
| NS2A | 1143 | 0.26 | 12 | 4 | 0 | Y | SIMIEEVMRS | 97.02 | SIIIEEVMRS | 0.99 | SIIIEEVMRS | 0.83 | SIMTEEVMRS | 0.74 | |
| NS2A | 1144 | 0.27 | 7 | 4 | 0 | Y | IMIEEVMRSR | 96.94 | ILIEEVMRSR | 0.91 | IIIEEVMRSR | 0.83 | IMTEEVMRSR | 0.74 | |
| NS2A | 1145 | 0.26 | 9 | 4 | 0 | Y | MIEEVMRSRW | 97.02 | LIEEVMRSRW | 0.91 | IIEEVMRSRW | 0.83 | MTEEVMRSRW | 0.74 | |
| NS2A | 1146 | 0.12 | 8 | 2 | 0 | Y | IEEVMRSRWS | 98.76 | TEEVMRSRWS | 0.74 | | | | |
| NS2A | 1147 | 0.14 | 5 | 2 | 0 | Y | EEVMRSRWSR | 98.35 | EEVMRSRWSK | 1.32 | | | | |
| NS2A | 1148 | 0.43 | 5 | 3 | 0 | Y | EVMRSRWSRK | 93.3 | EVMRSRWSRR | 5.05 | EVMRSRWSKK | 1.32 | | |
| NS2A | 1149 | 0.44 | 6 | 3 | 0 | Y | VMRSRWSRKM | 93.22 | VMRSRWSRRM | 5.05 | VMRSRWSKKM | 1.32 | | |
| NS2A | 1150 | 0.44 | 7 | 3 | 0 | Y | MRSRWSRKML | 93.22 | MRSRWSRRML | 5.05 | MRSRWSKKML | 1.32 | | |
| NS2A | 1151 | 0.45 | 7 | 3 | 0 | Y | RSRWSRKMLM | 93.05 | RSRWSRRMLM | 5.05 | RSRWSKKMLM | 1.32 | | |
| NS2A | 1152 | 0.51 | 9 | 4 | 0 | Y | SRWSRKMLMT | 92.47 | SRWSRRMLMT | 5.05 | SRWSKKMLMT | 1.32 | SRWSRKMLMA | 0.33 | |
| NS2A | 1153 | 0.51 | 11 | 4 | 0 | Y | RWSRKMLMTG | 92.47 | RWSRRMLMTG | 5.05 | RWSKKMLMTG | 1.32 | RWSRKMLMAG | 0.33 | |
| NS2A | 1154 | 0.55 | 12 | 4 | 0 | Y | WSRKMLMTGT | 92.06 | WSRRMLMTGT | 5.05 | WSKKMLMTGT | 1.32 | WSRKMLMTGI | 0.5 | WSRKMLMAGT | 0.33 |
| NS2A | 1155 | 0.55 | 12 | 4 | 0 | Y | SRKMLMTGTL | 92.06 | SRRMLMTGTL | 5.05 | SKKMLMTGTL | 1.32 | SRKMLMTGIL | 0.5 | SRKMLMAGTL | 0.33 |
| NS2A | 1157 | 0.55 | 12 | 4 | 0 | Y | KMLMTGTLAV | 91.98 | RMLMTGTLAV | 5.05 | KMLMTGTLAV | 1.41 | KMLMTGILAV | 0.5 | KMLMAGTLAV | 0.33 |
| NS2A | 1158 | 0.31 | 13 | 5 | 0 | Y | MLMTGTLAVF | 96.53 | MLMTGTLAVF | 1.41 | MLMTGILAVF | 0.5 | MLMTGTLAVL | 0.41 | MLMAGTLAVF | 0.33 |
| NS2A | 1173 | 0.26 | 7 | 3 | 0 | Y | GQLTWNDLIR | 97.02 | GQLTWSDLIR | 1.08 | GQLTWNDLTR | 0.99 | | |
| NS2A | 1174 | 0.42 | 9 | 5 | 0 | Y | QLTWNDLIRL | 94.79 | QLTWSDLIRS | 2.07 | QLTWSDLIRL | 1.08 | QLTWNDLTRL | 0.99 | QLTWKDLIRL | 0.5 |
| NS2A | 1175 | 0.42 | 9 | 5 | 0 | Y | LTWNDLIRLC | 94.79 | LTWNDLIRSC | 2.07 | LTWSDLIRLC | 1.08 | LTWNDLTRLC | 0.99 | LTWKDLIRLC | 0.5 |

FIG. 4-45

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1176 | 0.39 | 8 | 4 | 0 | Y | TWNDLIRLCI | 95.04 | TWNDLIRSCI | 2.07 | TWSDLIRLCI | 1.08 | TWNDLTRLCI | 0.99 | | |
| NS2A | 1177 | 0.38 | 7 | 4 | 0 | Y | WNDLIRLCIM | 95.12 | WNDLIRSCIM | 2.07 | WSDLIRLCIM | 1.08 | WNDLTRLCIM | 0.99 | | |
| NS2A | 1178 | 0.39 | 8 | 4 | 0 | Y | NDLIRLCIMV | 95.04 | NDLIRSCIMV | 2.07 | SDLIRLCIMV | 1.08 | NDLTRLCIMV | 0.99 | | |
| NS2A | 1179 | 0.26 | 6 | 3 | 0 | Y | DLIRLCIMVG | 96.61 | DLIRSCIMVG | 2.07 | DLTRLCIMVG | 0.99 | | | | |
| NS2A | 1180 | 0.26 | 6 | 3 | 0 | Y | LIRLCIMVGA | 96.61 | LIRSCIMVGA | 2.07 | LTRLCIMVGA | 0.99 | | | | |
| NS2A | 1181 | 0.27 | 7 | 3 | 0 | Y | IRLCIMVGAN | 96.53 | IRSCIMVGAN | 2.07 | TRLCIMVGAN | 0.99 | | | | |
| NS2A | 1182 | 0.26 | 9 | 3 | 0 | Y | RLCIMVGANV | 96.77 | RSCIMVGANA | 2.07 | RLCIMVGANV | 0.58 | | | | |
| NS2A | 1183 | 0.4 | 12 | 4 | 0 | Y | LCIMVGANAS | 94.95 | SCIMVGANAS | 2.07 | LCIMVGANAF | 1.65 | LCIMVGANVS | 0.58 | | |
| NS2A | 1184 | 0.24 | 9 | 3 | 0 | Y | CIMVGANASD | 97.11 | CIMVGANAFD | 1.65 | CIMVGANVSD | 0.66 | | | | |
| NS2A | 1185 | 0.61 | 13 | 5 | 0 | Y | IMVGANASDR | 91.81 | IMVGANASDK | 3.56 | IMVGANAFDR | 1.65 | IMVGANASDN | 1.32 | IMVGANVSDR | 0.66 |
| NS2A | 1186 | 0.61 | 13 | 5 | 0 | Y | MVGANASDRM | 91.81 | MVGANASDKM | 3.56 | MVGANAFDRM | 1.65 | MVGANASDNM | 1.32 | MVGANVSDRM | 0.66 |
| NS2A | 1187 | 0.61 | 13 | 5 | 0 | Y | VGANASDRMG | 91.81 | VGANASDKMG | 3.56 | VGANAFDRMG | 1.65 | VGANASDNMG | 1.32 | VGANVSDRMG | 0.66 |
| NS2A | 1188 | 0.61 | 13 | 5 | 0 | Y | GANASDRMGM | 91.81 | GANASDKMGM | 3.56 | GANAFDRMGM | 1.65 | GANASDNMGM | 1.32 | GANVSDRMGM | 0.66 |
| NS2A | 1189 | 0.61 | 13 | 5 | 0 | Y | ANASDRMGMG | 91.81 | ANASDKMGMG | 3.56 | ANAFDRMGMG | 1.65 | ANASDNMGMG | 1.32 | ANVSDRMGMG | 0.66 |
| NS2A | 1193 | 0.53 | 11 | 5 | 0 | Y | DRMGMGTTYL | 92.89 | DKMGMGTTYL | 3.56 | DNMGMGTTYL | 1.32 | DRMGMGTTYL | 1.08 | DRMGMGTTHL | 0.33 |
| NS2A | 1194 | 0.54 | 12 | 5 | 0 | Y | RMGMGTTYLA | 92.8 | KMGMGTTYLA | 3.56 | NMGMGTTYLA | 1.32 | RMGMGTTYLA | 1.08 | RMGMGTTHLA | 0.33 |
| NS2A | 1195 | 0.17 | 8 | 2 | 0 | Y | MGMGTTYLAL | 98.1 | MGMGTTYLAL | 1.08 | | | | | | |
| NS2A | 1196 | 0.2 | 9 | 3 | 0 | Y | GMGTTYLALM | 97.85 | GMGTTYLALM | 1.08 | GMGTTHLALM | 0.33 | | | | |
| NS2A | 1197 | 0.21 | 10 | 3 | 0 | Y | MGTTYLALMA | 97.77 | MGTTYLALMA | 1.08 | MGTTHLALMA | 0.33 | | | | |
| NS2A | 1198 | 0.2 | 9 | 3 | 0 | Y | GTTYLALMAT | 97.85 | GMTYLALMAT | 1.08 | GTTHLALMAT | 0.33 | | | | |
| NS2A | 1199 | 0.21 | 10 | 3 | 0 | Y | TTYLALMATF | 97.77 | MTYLALMATF | 1.08 | TTHLALMATF | 0.33 | | | | |
| NS2A | 1200 | 0.31 | 9 | 2 | 0 | Y | TYLALMATFK | 95.86 | TYLALMATFR | 3.14 | | | | | | |
| NS2A | 1201 | 0.35 | 9 | 3 | 0 | Y | YLALMATFKM | 95.29 | YLALMATFRM | 3.14 | YLALMATFKI | 0.66 | | | | |
| NS2A | 1202 | 0.32 | 8 | 3 | 0 | Y | LALMATFKMR | 95.62 | LALMATFRMR | 3.14 | LALMATFKIR | 0.66 | | | | |

FIG. 4-46

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to

FIG. 4-47

Species: DENV1 (10-MERS)

| protein | block starting position | block entropy | total peptides in block | # peptides required to cover 99% of block | gap/X fraction | 99% of block covered w/ <= 5 peptides? | peptides required

FIG. 4-48

Species: DENV1 (10-MERS)

| protein | block starting position | block entropy | total

FIG. 4-49

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1315 | 0.03 | 3 | 1 | 0 | Y | KTTWLPV

FIG. 4-50

Species: DENV1 (10-MERS)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1347 | 0.79 | 6 | 3 | 0 | Y | WPLNEGIMAV | 80.56 | WPLNEGIMAI | 18.28 | WPINEGIMAV | 0.91 | | |
| NS2B | 1348 | 0.79 | 6 | 3 | 0 | Y | PLNEGIMAVG | 80.56 | PLNEGIMAIG | 18.28 | PINEGIMAVG | 0.91 | | |
| NS2B | 1349 | 1.26 | 7 | 4 | 0 | Y | LNEGIMAVGI | 69.31 | LNEGIMAIGI | 18.28 | LNEGIMAVGV | 11.25 | INEGIMAVGI | 0.91 |
| NS2B | 1350 | 1.18 | 5 | 3 | 0 | Y | NEGIMAVGIV | 70.22 | NEGIMAIGIV | 18.36 | NEGIMAVGIW | 11.25 | | |
| NS2B | 1351 | 1.18 | 5 | 3 | 0 | Y | EGIMAVGIVS | 70.22 | EGIMAIGIVS | 18.36 | EGIMAVGVVS | 11.25 | | |
| NS2B | 1352 | 1.19 | 6 | 3 | 0 | Y | GIMAVGIVSI | 70.14 | GIMAIGIVSI | 18.36 | GIMAVGVVSI | 11.25 | | |
| NS2B | 1353 | 1.19 | 6 | 3 | 0 | Y | IMAVGIVSIL | 70.14 | IMAIGIVSIL | 18.36 | IMAVGVVSIL | 11.25 | | |
| NS2B | 1354 | 1.18 | 5 | 3 | 0 | Y | MAVGIVSILL | 70.22 | MAIGIVSILL | 18.36 | MAVGVVSILL | 11.25 | | |
| NS2B | 1355 | 1.18 | 6 | 3 | 0 | Y | AVGIVSILLS | 70.22 | AIGIVSILLS | 18.36 | AVGVVSILLS | 11.25 | | |
| NS2B | 1356 | 1.28 | 6 | 4 | 0 | Y | VGIVSILLSS | 68.73 | IGIVSILLSS | 18.36 | VGVVSILLSS | 11.25 | VGIVSILLSA | 1.49 |
| NS2B | 1357 | 0.64 | 6 | 3 | 0 | Y | GIVSILLSSL | 87.01 | GVVSILLSSL | 11.25 | IVSILLSSAL | 1.49 | | |
| NS2B | 1358 | 0.64 | 6 | 3 | 0 | Y | IVSILLSSLL | 87.01 | VVSILLSSLL | 11.25 | VSILLSALLK | 1.49 | | |
| NS2B | 1359 | 0.14 | 6 | 2 | 0 | Y | VSILLSSLLK | 98.26 | VSILLSALLK | 1.49 | | | | |
| NS2B | 1360 | 0.16 | 6 | 2 | 0 | Y | SILLSSLLKN | 98.1 | SILLSALLKN | 1.49 | | | | |
| NS2B | 1361 | 0.16 | 6 | 2 | 0 | Y | ILLSSLLKND | 98.1 | ILLSALLKND | 1.49 | | | | |
| NS2B | 1362 | 0.16 | 6 | 2 | 0 | Y | LLSSLLKNDV | 98.1 | LLSALLKNDV | 1.49 | | | | |
| NS2B | 1363 | 0.16 | 6 | 2 | 0 | Y | LSSLLKNDVP | 98.1 | LSALLKNDVP | 1.49 | | | | |
| NS2B | 1364 | 0.16 | 6 | 2 | 0 | Y | SSLLKNDVPL | 98.1 | SALLKNDVPL | 1.49 | | | | |
| NS2B | 1365 | 0.16 | 6 | 2 | 0 | Y | SLLKNDVPLA | 98.1 | ALLKNDVPLA | 1.49 | | | | |
| NS2B | 1366 | 0.05 | 5 | 1 | 0 | Y | LLKNDVPLAG | 99.59 | | | | | | |
| NS2B | 1367 | 0.04 | 4 | 1 | 0 | Y | LKNDVPLAGP | 99.67 | | | | | | |
| NS2B | 1368 | 0.04 | 4 | 1 | 0 | Y | KNDVPLAGPL | 99.67 | | | | | | |
| NS2B | 1369 | 0.06 | 5 | 1 | 0 | Y | NDVPLAGPLI | 99.42 | | | | | | |
| NS2B | 1370 | 0.05 | 5 | 1 | 0 | Y | DVPLAGPLIA | 99.5 | | | | | | |

FIG. 4-51

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1371 | 0.05 | 5 | 1 | 0 | Y | VPLAGPLIAG | 99.5 | | | | | | | | |
| NS2B | 1372 | 0.05 | 5 | 1 | 0 | Y | PLAGPLIAGG | 99.5 | | | | | | | | |
| NS2B | 1373 | 0.05 | 5 | 1 | 0 | Y | LAGPLIAGGM | 99.5 | | | | | | | | |
| NS2B | 1374 | 0.05 | 5 | 1 | 0 | Y | AGPLIAGGML | 99.5 | | | | | | | | |
| NS2B | 1375 | 0.05 | 5 | 1 | 0 | Y | GPLIAGGMLI | 99.5 | | | | | | | | |
| NS2B | 1376 | 0.06 | 6 | 1 | 0 | Y | PLIAGGMLIA | 99.42 | | | | | | | | |
| NS2B | 1377 | 0.06 | 6 | 1 | 0 | Y | LIAGGMLIAC | 99.42 | | | | | | | | |
| NS2B | 1378 | 0.06 | 6 | 1 | 0 | Y | IAGGMLIACY | 99.42 | | | | | | | | |
| NS2B | 1379 | 0.04 | 5 | 1 | 0 | Y | AGGMLIACYV | 99.67 | | | | | | | | |
| NS2B | 1380 | 0.04 | 5 | 1 | 0 | Y | GGMLIACYVI | 99.67 | | | | | | | | |
| NS2B | 1381 | 0.03 | 4 | 1 | 0 | Y | GMLIACYVIS | 99.75 | | | | | | | | |
| NS2B | 1382 | 0.04 | 5 | 1 | 0 | Y | MLIACYVISG | 99.67 | | | | | | | | |
| NS2B | 1383 | 0.04 | 5 | 1 | 0 | Y | LIACYVISGS | 99.67 | | | | | | | | |
| NS2B | 1384 | 0.04 | 6 | 1 | 0 | Y | IACYVISGSS | 99.59 | | | | | | | | |
| NS2B | 1385 | 0.05 | 6 | 1 | 0 | Y | ACYVISGSSA | 99.59 | | | | | | | | |
| NS2B | 1386 | 0.05 | 6 | 1 | 0 | Y | CYVISGSSAD | 99.59 | | | | | | | | |
| NS2B | 1387 | 0.05 | 7 | 1 | 0 | Y | YVISGSSADL | 99.26 | | | | | | | | |
| NS2B | 1388 | 0.08 | 8 | 1 | 0 | Y | VISGSSADLS | 99.17 | | | | | | | | |
| NS2B | 1389 | 0.09 | 8 | 1 | 0 | Y | ISGSSADLSL | 99.01 | | | | | | | | |
| NS2B | 1390 | 0.11 | 9 | 2 | 0 | Y | SGSSADLSLE | 98.84 | GSSADLLLEK | 0.33 | GSSADLLLEK | 0.25 | | | | |
| NS2B | 1391 | 0.12 | 11 | 3 | 0 | Y | GSSADLSLEK | 98.51 | SSADLLLEKA | 0.33 | SSADLSLDKA | 0.25 | | | | |
| NS2B | 1392 | 0.16 | 10 | 3 | 0 | Y | SSADLSLEKA | 98.59 | SADLLLEKAA | 0.33 | SADLSLDKAA | 0.25 | ADLLLEKAAE | 0.33 | | |
| NS2B | 1393 | 0.15 | 10 | 3 | 0 | Y | SADLSLEKAA | 98.59 | SADLLLEKAA | 0.33 | SADLSLDKAA | 0.25 | ADLLLEKAAE | 0.33 | | |
| NS2B | 1394 | 0.32 | 12 | 5 | 0 | Y | ADLSLEKAAE | 96.36 | ADLSLEKAAV | 1.32 | ADLSLEKAAK | 0.91 | ADLLLEKAAE | 0.33 | ADLSLEKTAE | 0.25 |

FIG. 4-52

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1395 | 0.33 | 12 | 5 | 0 | Y | DLSLEKAAEV | 96.28 | DLSLEKAAKV | 1.32 | | | DLSLEKTAEV | 0.25 |
| NS2B | 1396 | 0.32 | 11 | 5 | 0 | Y | LSLEKAAEVS | 96.36 | LSLEKAAKVS | 1.32 | | | LSLDKAAEVS | 0.25 |
| NS2B | 1397 | 0.32 | 11 | 5 | 0 | Y | SLEKAAEVSW | 96.36 | SLEKAA

FIG. 4-53

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1422 | 0.25 | 7 | 3 | 0 | Y | EVQDDGTMKI | 96.94 | EIQDDGTMKI | 1.24 | VVQDDGTMKI | 1.16 | | |
| NS2B | 1423 | 0.17 | 7 | 2 | 0 | Y | VQDDGTMKIK | 98.01 | IQDDGTMKIK | 1.24 | | | | |
| NS2B | 1424 | 0.09 | 7 | 1 | 0 | Y | QDDGTMKIKD | 99.17 | | | | | | |
| NS2B | 1425 | 0.09 | 7 | 1 | 0 | Y | DDGTMKIKDE | 99.17 | | | | | | |
| NS2B | 1426 | 0.09 | 7 | 1 | 0 | Y | DGTMKIKDEE | 99.17 | | | | | | |
| NS2B | 1427 | 0.14 | 8 | 2 | 0 | Y | GTMKIKDEER | 98.51 | GTMKIKDEEK | 0.66 | | | | |
| NS2B | 1428 | 0.14 | 8 | 2 | 0 | Y | TMKIKDEERD | 98.51 | TMKIKDEEKD | 0.66 | | | | |
| NS2B | 1429 | 0.11 | 7 | 2 | 0 | Y | MKIKDEERDD | 98.92 | MKIKDEEKDD | 0.66 | | | | |
| NS2B | 1430 | 0.15 | 8 | 2 | 0 | Y | KIKDEERDDT | 98.43 | KIKDEEKDDT | 0.66 | | | | |
| NS2B | 1431 | 0.27 | 9 | 3 | 0 | Y | IKDEERDDTL | 96.86 | IKDEERDDTI | 1.49 | IKDEEKDDTL | 0.74 | | |
| NS2B | 1432 | 0.27 | 9 | 3 | 0 | Y | KDEERDDTLT | 96.86 | KDEERDDTIT | 1.49 | KDEEKDDTLT | 0.74 | | |
| NS2B | 1433 | 0.28 | 10 | 3 | 0 | Y | DEERDDTLTI | 96.77 | DEERDDTITI | 1.49 | DEEKDDTLTI | 0.74 | | |
| NS2B | 1434 | 0.27 | 9 | 3 | 0 | Y | EERDDTLTIL | 96.86 | EERDDTITIL | 1.49 | EEKDDTLTIL | 0.74 | | |
| NS2B | 1435 | 0.27 | 9 | 3 | 0 | Y | ERDDTLTILL | 96.86 | ERDDTITILL | 1.49 | EKDDTLTILL | 0.74 | | |
| NS2B | 1436 | 0.27 | 9 | 3 | 0 | Y | RDDTLTILLK | 96.86 | RDDTITILLK | 1.49 | KDDTLTILLK | 0.74 | | |
| NS2B | 1437 | 0.2 | 8 | 2 | 0 | Y | DDTLTILLKA | 97.6 | DDTITILLKA | 1.49 | | | | |
| NS2B | 1438 | 0.21 | 9 | 2 | 0 | Y | DTLTILLKAT | 97.52 | DTITILLKAT | 1.49 | | | | |
| NS2B | 1439 | 0.2 | 8 | 2 | 0 | Y | TLTILLKATL | 97.6 | TITILLKATL | 1.49 | | | | |
| NS2B | 1440 | 0.16 | 7 | 2 | 0 | Y | LTILLKATLL | 98.1 | ITILLKATLL | 1.49 | | | | |
| NS2B | 1441 | 0.08 | 7 | 1 | 0 | Y | TILLKATLLA | 99.26 | | | | | | |
| NS2B | 1442 | 0.33 | 9 | 2 | 0 | Y | ILLKATLLAV | 95.37 | ILLKATLLAI | 3.64 | | | | |
| NS2B | 1443 | 0.31 | 7 | 2 | 0 | Y | LLKATLLAVS | 95.53 | LLKATLLAIS | 3.64 | | | | |
| NS2B | 1444 | 0.31 | 7 | 2 | 0 | Y | LKATLLAVSG | 95.53 | LKATLLAISG | 3.64 | | | | |
| NS2B | 1445 | 0.35 | 8 | 3 | 0 | Y | KATLLAVSGV | 95.12 | KATLLAISGV | 3.64 | KATLLAVSGM | 0.41 | | |

FIG. 4-54

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to

FIG. 4-55

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1480 | 0.14 | 6 | 2 | 0 | Y | LWDTPSPPEV | 98.51 | LWDTPSPPKV | 0.66 | | | | |
| NS3 | 1481 | 0.35 | 8 | 3 | 0 | Y | WDTPSPPEVE | 95.29 | WDTPSPPEVG | 3.06 | WDTPSPPK

FIG. 4-56

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1506 | 0.06 | 4 | 1 | 0 | Y | LLGRSQVGVG | 99.34 | | | | | | |
| NS3 | 1507 | 0.06 | 4 | 1 | 0 | Y | LGRSQVGVGV | 99.34 | | | | | | |
| NS3 | 1508 | 0.07 | 5 | 1 | 0 | Y | GRSQVGVGVF | 99.26 | | | | | | |
| NS3 | 1509 | 0.06 | 4 | 1 | 0 | Y | RSQVGVGVFQ | 99.34 | | | | | | |
| NS3 | 1510 | 0.76 | 6 | 2 | 0 | Y | SQVGVGVFQE | 79.4 | SQVGVGVFQD | 20.26 | | | | |
| NS3 | 1511 | 1.01 | 7 | 3 | 0 | Y | QVGVGVFQEN | 75.1 | QVGVGVFQDG | 20.26 | QVGVGVFQEG | 4.3 | | |
| NS3 | 1512 | 1.01 | 7 | 3 | 0 | Y | VGVGVFQENV | 75.1 | VGVGVFQDGV | 20.26 | VGVGVFQEGV | 4.3 | | |
| NS3 | 1513 | 1.01 | 7 | 3 | 0 | Y | GVGVFQENVF | 75.1 | GVGVFQDGVF | 20.26 | GVGVFQEGVF | 4.3 | | |
| NS3 | 1514 | 1.01 | 7 | 3 | 0 | Y | VGVFQENVFH | 75.1 | VGVFQDGVFH | 20.26 | VGVFQEGVFH | 4.3 | | |
| NS3 | 1515 | 1.01 | 7 | 3 | 0 | Y | GVFQENVFHT | 75.1 | GVFQDGVFHT | 20.26 | GVFQEGVFHT | 4.3 | | |
| NS3 | 1516 | 1.01 | 7 | 3 | 0 | Y | VFQENVFHTM | 75.1 | VFQDGVFHTM | 20.26 | VFQEGVFHTM | 4.3 | | |
| NS3 | 1517 | 1.01 | 7 | 3 | 0 | Y | FQENVFHTMW | 75.1 | FQDGVFHTMW | 20.26 | FQEGVFHTMW | 4.3 | | |
| NS3 | 1518 | 1.01 | 7 | 3 | 0 | Y | QENVFHTMWH | 75.1 | QDGVFHTMWH | 20.35 | QEGVFHTMWH | 4.3 | | |
| NS3 | 1519 | — | 6 | 2 | 0 | Y | ENVFHTMWHV | 75.1 | DGVFHTMWHV | 20.35 | EGVFHTMWHV | 4.3 | | |
| NS3 | 1520 | 0.82 | 6 | 2 | 0 | Y | NVFHTMWHVT | 75.1 | GVFHTMWHVT | 24.81 | | | | |
| NS3 | 1521 | 0.01 | 3 | 1 | 0 | Y | VFHTMWHVTR | 99.92 | | | | | | |
| NS3 | 1522 | 0 | 2 | 1 | 0 | Y | FHTMWHVTRG | 100 | | | | | | |
| NS3 | 1523 | 0 | 1 | 1 | 0 | Y | HTMWHVTRGA | 100 | | | | | | |
| NS3 | 1524 | 0 | 1 | 1 | 0 | Y | TMWHVTRGAV | 100 | | | | | | |
| NS3 | 1525 | 0 | 1 | 1 | 0 | Y | MWHVTRGAVL | 100 | | | | | | |
| NS3 | 1526 | 0 | 1 | 1 | 0 | Y | WHVTRGAVLM | 100 | | | | | | |
| NS3 | 1527 | 0.02 | 2 | 1 | 0 | Y | HVTRGAVLMY | 99.83 | | | | | | |
| NS3 | 1528 | 0.02 | 3 | 1 | 0 | Y | VTRGAVLMYQ | 99.83 | | | | | | |
| NS3 | 1529 | 0.02 | 3 | 1 | 0 | Y | TRGAVLMYQG | 99.83 | | | | | | |

FIG. 4-57

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 4-58

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1554 | 1.11 | 6 | 3 | 0 | Y | SYGGGWRLQG | 68.82 | SYGGGWRFQG | 26.22 | SYGGGWRLRG | 4.71 | | |
| NS3 | 1555 | 1.16 | 8 | 3 | 0 | Y | YGGGWRLQGS | 68.82 | YGGGWRFQGS | 25.56 | YGGGWRLRGS | 4.71 | | |
| NS3 | 1556 | 1.16 | 8 | 3 | 0 | Y | GGGWRLQGSW | 68.82 | GGGWRFQGSW | 25.56 | GGGWRLRGSW | 4.71 | | |
| NS3 | 1557 | 1.17 | 9 | 3 | 0 | Y | GGWRLQGSWN | 68.82 | GGWRFQGSWN | 25.48 | GGWRLRGSWN | 4.71 | | |
| NS3 | 1562 | 0.49 | 12 | 4 | 0 | Y | QGSWNTGEEV | 92.97 | RGSWNTGEEV | 4.71 | QGSWNAGEEV | 0.83 | QGLWNTGEEV | 0.5 |
| NS3 | 1563 | 0.21 | 9 | 3 | 0 | Y | GSWNTGEEVQ | 97.77 | GSWNAGEEVQ | 0.83 | GLWNTGEEVQ | 0.5 | | |
| NS3 | 1564 | 0.21 | 9 | 3 | 0 | Y | SWNTGEEVQV | 97.77 | SWNAGEEVQV | 0.83 | LWNTGEEVQV | 0.5 | | |
| NS3 | 1565 | 0.16 | 7 | 2 | 0 | Y | WNTGEEVQVI | 98.26 | WNAGEEVQVI | 0.83 | | | | |
| NS3 | 1566 | 0.16 | 7 | 2 | 0 | Y | NTGEEVQVIA | 98.26 | NAGEEVQVIA | 0.83 | | | | |
| NS3 | 1567 | 0.15 | 6 | 2 | 0 | Y | TGEEVQVIAV | 98.35 | AGEEVQVIAV | 0.83 | | | | |
| NS3 | 1568 | 0.02 | 3 | 1 | 0 | Y | GEEVQVIAVE | 99.83 | | | | | | |
| NS3 | 1569 | 0.02 | 3 | 1 | 0 | Y | EEVQVIAVEP | 99.83 | | | | | | |
| NS3 | 1570 | 0.04 | 4 | 1 | 0 | Y | EVQVIAVEPG | 99.59 | | | | | | |
| NS3 | 1571 | 0.04 | 4 | 1 | 0 | Y | VQVIAVEPGK | 99.59 | | | | | | |
| NS3 | 1572 | 0.04 | 4 | 1 | 0 | Y | QVIAVEPGKN | 99.59 | | | | | | |
| NS3 | 1573 | 0.04 | 4 | 1 | 0 | Y | VIAVEPGKNP | 99.59 | | | | | | |
| NS3 | 1574 | 0.05 | 5 | 1 | 0 | Y | IAVEPGKNPK | 99.5 | | | | | | |
| NS3 | 1575 | 0.04 | 4 | 1 | 0 | Y | AVEPGKNPKN | 99.59 | | | | | | |
| NS3 | 1576 | 0.04 | 4 | 1 | 0 | Y | VEPGKNPKNV | 99.59 | | | | | | |
| NS3 | 1577 | 0.04 | 4 | 1 | 0 | Y | EPGKNPKNVQ | 99.59 | | | | | | |
| NS3 | 1578 | 0.04 | 4 | 1 | 0 | Y | PGKNPKNVQT | 99.59 | | | | | | |
| NS3 | 1579 | 0.88 | 7 | 3 | 0 | Y | GKNPKNVQTA | 77.09 | GKNPKNVQTT | 21.26 | GKNPKNVQTM | 1.24 | | |
| NS3 | 1580 | 0.86 | 5 | 3 | 0 | Y | KNPKNVQTAP | 77.25 | KNPKNVQTTP | 21.26 | KNPKNVQTMP | 1.32 | | |
| NS3 | 1581 | 0.86 | 5 | 3 | 0 | Y | NPKNVQTAPG | 77.25 | NPKNVQTTPG | 21.26 | NPKNVQTMPG | 1.32 | | |

FIG. 4-59

Species: DEN1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1582 | 0.88 | 6 | 3 | 0 | Y | PKNVQTAPGT | 77.25 | PKNVQTTPGT | 21.09 | PKNVQTMPGT | 1.32 | | |
| NS3 | 1583 | 0.88 | 6 | 3 | 0 | Y | KNVQTAPGTF | 77.25 | KNVQTTPGTF | 21.09 | KNVQTMPGTF | 1.32 | | |
| NS3 | 1584 | 0.87 | 5 | 3 | 0 | Y | NVQTAPGTFK | 77.25 | NVQTTPGTFK | 21.17 | NVQTMPGTFK | 1.32 | | |
| NS3 | 1585 | 0.87 | 5 | 3 | 0 | Y | VQTAPGTFKT | 77.25 | VQTTPGTFKT | 21.17 | VQTMPGTFKT | 1.32 | | |
| NS3 | 1586 | 1.55 | 8 | 4 | 0 | Y | QTAPGTFKTP | 57.24 | QTTPGTFKTP | 20.6 | QTAPGTFKTS | 20.02 | QTMPGTFKTP | 1.32 |
| NS3 | 1587 | 1.55 | 8 | 4 | 0 | Y | TAPGTFKTPE | 57.24 | TPGTFKTPE | 20.6 | TAPGTFKTSE | 20.02 | TMPGTFKTPE | 1.32 |
| NS3 | 1588 | 1.55 | 8 | 4 | 0 | Y | APGTFKTPEG | 57.24 | TPGTFKTPEG | 20.6 | APGTFKTSEG | 20.02 | MPGTFKTPEG | 1.32 |
| NS3 | 1589 | 0.79 | 5 | 2 | 0 | Y | PGTFKTPEGE | 79.16 | PGTFKTSEGE | 20.18 | | | | |
| NS3 | 1590 | 0.79 | 5 | 2 | 0 | Y | GTFKTPEGEV | 79.16 | GTFKTSEGEV | 20.18 | | | | |
| NS3 | 1591 | 0.79 | 5 | 2 | 0 | Y | TFKTPEGEVG | 79.16 | TFKTSEGEVG | 20.18 | | | | |
| NS3 | 1592 | 0.77 | 4 | 2 | 0 | Y | FKTPEGEVGA | 79.32 | FKTSEGEVGA | 20.18 | | | | |
| NS3 | 1593 | 0.79 | 5 | 2 | 0 | Y | KTPEGEVGAI | 79.16 | KTSEGEVGAI | 20.18 | | | | |
| NS3 | 1594 | 0.79 | 5 | 2 | 0 | Y | TPEGEVGAIA | 79.16 | TSEGEVGAIA | 20.18 | | | | |
| NS3 | 1595 | 0.79 | 5 | 2 | 0 | Y | PEGEVGAIAL | 79.16 | SEGEVGAIAL | 20.18 | | | | |
| NS3 | 1596 | 0.03 | 3 | 1 | 0 | Y | EGEVGAIALD | 99.75 | | | | | | |
| NS3 | 1597 | 0.03 | 3 | 1 | 0 | Y | GEVGAIALDF | 99.75 | | | | | | |
| NS3 | 1598 | 0.03 | 3 | 1 | 0 | Y | EVGAIALDFK | 99.75 | | | | | | |
| NS3 | 1599 | 0.03 | 3 | 1 | 0 | Y | VGAIALDFKP | 99.75 | | | | | | |
| NS3 | 1600 | 0.03 | 3 | 1 | 0 | Y | GAIALDFKPG | 99.75 | | | | | | |
| NS3 | 1601 | 0.03 | 3 | 1 | 0 | Y | AIALDFKPGT | 99.75 | | | | | | |
| NS3 | 1602 | 0.03 | 3 | 1 | 0 | Y | IALDFKPGTS | 99.75 | | | | | | |
| NS3 | 1603 | 0.01 | 2 | 1 | 0 | Y | ALDFKPGTSG | 99.92 | | | | | | |
| NS3 | 1604 | 0.01 | 2 | 1 | 0 | Y | LDFKPGTSGS | 99.92 | | | | | | |
| NS3 | 1605 | 0.01 | 2 | 1 | 0 | Y | DFKPGTSGSP | 99.92 | | | | | | |

FIG. 4-61

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | pept

FIG. 4-62

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1654 | 0.96 | 7 | 4 | 0 | Y | EIEDEVFRKR | 78.25 | EIEDEVFKKR | 18.11 | EIEEEVFKKR | 1.74 | EIENEVFRKR | 0.99 |
| NS3 | 1655 | 0.97 | 8 | 4 | 0 | Y | IEDEVFRKRN | 78.16 | IEDEVFKKRN | 18.11 | IEEEVFKKRN | 1.74 | IENEVFRKKRN | 0.99 |
| NS3 | 1656 | 0.97 | 8 | 4 | 0 | Y | EDEVFRKRNL | 78.16 | EDEVFKKRNL | 18.11 | EEEVFKKRNL | 1.74 | ENEVFRKKRNL | 0.99 |
| NS3 | 1657 | 0.97 | 8 | 4 | 0 | Y | DEVFRKRNLT | 78.16 | DEVFKKRNLT | 18.11 | EEVFKKRNLT | 1.74 | NEVFRKKRNLT | 0.99 |
| NS3 | 1658 | 0.82 | 7 | 3 | 0 | Y | EVFRKRNLTI | 79.07 | EVFKKRNLTI | 19.85 | KVFRKRNLTI | 0.74 | | |
| NS3 | 1659 | 0.76 | 6 | 2 | 0 | Y | VFKRNLTIM | 79.82 | VFKKRNLTIM | 19.85 | | | | |
| NS3 | 1660 | 0.76 | 6 | 2 | 0 | Y | FKRNLTIMD | 79.82 | FKKRNLTIMD | 19.85 | | | | |
| NS3 | 1661 | 0.76 | 6 | 2 | 0 | Y | KRNLTIMDL | 79.82 | KKRNLTIMDL | 19.85 | | | | |
| NS3 | 1662 | 0.04 | 5 | 1 | 0 | Y | RNLTIMDLH | 99.67 | | | | | | |
| NS3 | 1663 | 0.04 | 5 | 1 | 0 | Y | NLTIMDLHP | 99.67 | | | | | | |
| NS3 | 1664 | 0.03 | 4 | 1 | 0 | Y | LTIMDLHPG | 99.75 | | | | | | |
| NS3 | 1665 | 0.02 | 3 | 1 | 0 | Y | TIMDLHPGS | 99.83 | | | | | | |
| NS3 | 1666 | 0.02 | 3 | 1 | 0 | Y | IMDLHPGSG | 99.83 | | | | | | |
|

FIG. 4-63

Species: DENV1 (10-MERS)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---

FIG. 4-64

Species: DENV1 (10-MERS)

| protein | block starting position | block entropy | total peptides in block | # peptides required to cover 99% of block | gap/X fraction | 99% of block covered w/ <= 5 peptides? | peptides required to cover

FIG. 4-65

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | fr

FIG. 4-67

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1776 | 0.02 | 3 | 1 | 0 | Y | YISTRVGMGE | 99.83 | | | | | | |
| NS3 | 1777 | 0.02 | 3 | 1 | 0 | Y | ISTRVGMGEA | 99.83 | | | | | | |
| NS3 | 1778 | 0.03 | 4 | 1 | 0 | Y | STRVGMGEAA | 99.75 | | | | | | |
| NS3 | 1779 | 0.03 | 4 | 1 | 0 | Y | TRVGMGEAAA | 99.75 | | | | | | |
| NS3 | 1780 | 0.03 | 4 | 1 | 0 | Y | RVGMGEAAAI | 99.75 | | | | | | |
| NS3 | 1781 | 0.02 | 3 | 1 | 0 | Y | VGMGEAAAIF | 99.83 | | | | | | |
| NS3 | 1782 | 0.02 | 3 | 1 | 0 | Y | GMGEAAAIFM | 99.83 | | | | | | |
| NS3 | 1783 | 0.02 | 3 | 1 | 0 | Y | MGEAAAIFMT | 99.83 | | | | | | |
| NS3 | 1784 | 0.02 | 3 | 1 | 0 | Y | GEAAAIFMTA | 99.83 | | | | | | |
| NS3 | 1785 | 0.03 | 4 | 1 | 0 | Y | EAAAIFMTAT | 99.75 | | | | | | |
| NS3 | 1786 | 0.03 | 4 | 1 | 0 | Y | AAAIFMTATP | 99.75 | | | | | | |
| NS3 | 1787 | 0.03 | 4 | 1 | 0 | Y | AAIFMTATPP | 99.75 | | | | | | |
| NS3 | 1788 | 0.02 | 3 | 1 | 0 | Y | AIFMTATPPG | 99.83 | | | | | | |
| NS3 | 1789 | 0.01 | 2 | 1 | 0 | Y | IFMTATPPGS | 99.92 | | | | | | |
| NS3 | 1790 | 0.24 | 5 | 2 | 0 | Y | FMTATPPGSV | 96.86 | FMTATPPGSM | 2.32 | | | | |
| NS3 | 1791 | 0.24 | 5 | 2 | 0 | Y | MTATPPGSVE | 96.86 | MTATPPGSME | 2.32 | | | | |
| NS3 | 1792 | 0.24 | 5 | 2 | 0 | Y | TATPPGSVEA | 96.86 | TATPPGSMEA | 2.32 | | | | |
| NS3 | 1793 | 0.24 | 5 | 2 | 0 | Y | ATPPGSVEAF | 96.86 | ATPPGSMEAF | 2.32 | | | | |
| NS3 | 1794 | 0.24 | 4 | 2 | 0 | Y | TPPGSVEAFP | 96.86 | TPPGSMEAFP | 2.32 | | | | |
| NS3 | 1795 | 0.23 | 4 | 2 | 0 | Y | PPGSVEAFPQ | 96.94 | PPGSMEAFPQ | 2.32 | | | | |
| NS3 | 1796 | 0.23 | 4 | 2 | 0 | Y | PGSVEAFPQS | 96.94 | PGSMEAFPQS | 2.32 | | | | |
| NS3 | 1797 | 0.23 | 4 | 2 | 0 | Y | GSVEAFPQSN | 96.94 | GSMEAFPQSN | 2.32 | | | | |
| NS3 | 1798 | 0.23 | 4 | 2 | 0 | Y | SVEAFPQSNA | 96.94 | SMEAFPQSNA | 2.32 | | | | |
| NS3 | 1799 | 0.36 | 8 | 4 | 0 | Y | VEAFPQSNAV | 95.45 | MEAFPQSNAV | 2.15 | VEAFPQSNAI | 1.24 | AEAFPQSNAV | 0.66 |

FIG. 4-68

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 4-69

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1824 | 1    | 8 | 3 | 0 | Y | GYEWITDFPG | 72.29 | GYDWITDFPG | 25.31 | GHEWITDFPG | 1.82 | | |
| NS3 | 1825 | 1.01 | 9 | 3 | 0 | Y | YEWITDFPGK | 72.29 | YDWITDFPGK | 25.23 | HEWITDFPGK | 1.82 | | |
| NS3 | 1826 | 0.89 | 9 | 2 | 0 | Y | EWITDFPGKT | 74.11 | DWITDFPGKT | 25.14 | | | | |
| NS3 | 1827 | 0.08 | 8 | 1 | 0 | Y | WITDFPGKTV | 99.26 | | | | | | |
| NS3 | 1828 | 0.08 | 8 | 1 | 0 | Y | ITDFPGKTVW | 99.26 | | | | | | |
| NS3 | 1829 | 0.08 | 8 | 1 | 0 | Y | TDFPGKTVWF | 99.26 | | | | | | |
| NS3 | 1830 | 0.09 | 9 | 1 | 0 | Y | DFPGKTVWFV | 99.17 | | | | | | |
| NS3 | 1831 | 0.07 | 7 | 1 | 0 | Y | FPGKTVWFVP | 99.42 | | | | | | |
| NS3 | 1832 | 0.07 | 7 | 1 | 0 | Y | PGKTVWFVPS | 99.42 | | | | | | |
| NS3 | 1833 | 0.03 | 4 | 1 | 0 | Y | GKTVWFVPSI | 99.75 | | | | | | |
| NS3 | 1834 | 0.03 | 4 | 1 | 0 | Y | KTVWFVPSIK | 99.75 | | | | | | |
| NS3 | 1835 | 0.2  | 4 | 2 | 0 | Y | TVWFVPSIKS | 97.11 | TVWFVPSIKA | 2.73 | | | | |
| NS3 | 1836 | 0.19 | 3 | 2 | 0 | Y | VWFVPSIKSG | 97.19 | VWFVPSIKAG | 2.73 | | | | |
| NS3 | 1837 | 0.19 | 3 | 2 | 0 | Y | WFVPSIKSGN | 97.19 | WFVPSIKAGN | 2.73 | | | | |
| NS3 | 1838 | 0.19 | 3 | 2 | 0 | Y | FVPSIKSGND | 97.19 | FVPSIKAGND | 2.73 | | | | |
| NS3 | 1839 | 0.2  | 4 | 2 | 0 | Y | VPSIKSGNDI | 97.11 | VPSIKAGNDI | 2.73 | | | | |
| NS3 | 1840 | 0.21 | 5 | 2 | 0 | Y | PSIKSGNDIA | 97.11 | PSIKAGNDIA | 2.65 | | | | |
| NS3 | 1841 | 0.21 | 5 | 2 | 0 | Y | SIKSGNDIAN | 97.11 | SIKAGNDIAN | 2.56 | | | | |
| NS3 | 1842 | 0.2  | 5 | 2 | 0 | Y | IKSGNDIANC | 97.19 | IKAGNDIANC | 2.56 | | | | |
| NS3 | 1843 | 0.2  | 5 | 2 | 0 | Y | KSGNDIANCL | 97.19 | KAGNDIANCL | 2.56 | | | | |
| NS3 | 1844 | 0.2  | 5 | 2 | 0 | Y | SGNDIANCLR | 97.19 | AGNDIANCLR | 2.56 | | | | |
| NS3 | 1845 | 0.03 | 4 | 1 | 0 | Y | GNDIANCLRK | 99.75 | | | | | | |
| NS3 | 1846 | 0.03 | 4 | 1 | 0 | Y | NDIANCLRKN | 99.75 | | | | | | |
| NS3 | 1847 | 0.03 | 4 | 1 | 0 | Y | DIANCLRKNG | 99.75 | | | | | | |

FIG. 4-70

Species: DENV1 (10-MERS)

| protein | block starting position | block entropy | total peptides in block | # peptides required to cover 99% of block | gap/X fraction | 99% of block covered w/ <= 5 peptides?

FIG. 4-72

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency |
|---|---|---|---|---|---|---|---|---|
| NS3 | 1896 | 0.04 | 4 | 1 | 0 | Y | ADRVIDPRRC | 99.59 |
| NS3 | 1897 | 0.04 | 4 | 1 | 0 | Y | DRVIDPRRCL | 99.59 |
| NS3 | 1898 | 0.02 | 3 | 1 | 0 | Y | RVIDPRRCLK | 99.83 |
| NS3 | 1899 | 0.02 | 3 | 1 | 0 | Y | VIDPRRCLKP | 99.83 |
| NS3 | 1900 | 0.03 | 4 | 1 | 0 | Y | IDPRRCLKPV | 99.75 |
| NS3 | 1901 | 0.02 | 3 | 1 | 0 | Y | DPRRCLKPVI | 99.83 |
| NS3 | 1902 | 0.04 | 4 | 1 | 0 | Y | PRRCLKPVIL | 99.67 |
| NS3 | 1903 | 0.04 | 4 | 1 | 0 | Y | RRCLKPVILK | 99.67 |
| NS3 | 1904 | 0.05 | 5 | 1 | 0 | Y | RCLKPVILKD | 99.5 |
| NS3 | 1905 | 0.05 | 5 | 1 | 0 | Y | CLKPVILKDG | 99.5 |
| NS3 | 1906 | 0.08 | 7 | 1 | 0 | Y | LKPVILKDGP | 99.26 |
| NS3 | 1907 | 0.08 | 7 | 1 | 0 | Y | KPVILKDGPE | 99.26 |
| NS3 | 1908 | 0.08 | 7 | 1 | 0 | Y | PVILKDGPER | 99.26 |
| NS3 | 1909 | 0.08 | 6 | 1 | 0 | Y | VILKDGPERV | 99.26 |
| NS3 | 1910 | 0.07 | 6 | 1 | 0 | Y | ILKDGPERVI | 99.34 |
| NS3 | 1911 | 0.07 | 5 | 1 | 0 | Y | LKDGPERVIL | 99.34 |
| NS3 | 1912 | 0.05 | 5 | 1 | 0 | Y | KDGPERVILA | 99.5 |
| NS3 | 1913 | 0.05 | 4 | 1 | 0 | Y | DGPERVILAG | 99.5 |
| NS3 | 1914 | 0.04 | 4 | 1 | 0 | Y | GPERVILAGP | 99.67 |
| NS3 | 1915 | 0.04 | 4 | 1 | 0 | Y | PERVILAGPM | 99.67 |
| NS3 | 1916 | 0 | 1 | 1 | 0 | Y | ERVILAGPMP | 100 |
| NS3 | 1917 | 0 | 1 | 1 | 0 | Y | RVILAGPMPV | 100 |
| NS3 | 1918 | 0 | 1 | 1 | 0 | Y | VILAGPMPVT | 100 |
| NS3 | 1919 | 0.02 | 3 | 1 | 0 | Y | ILAGPMPVTV | 99.83 |

FIG. 4-73

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1920 | 0.02 | 3 | 1 | 0 | Y | LAGPMPVTVA | 99.83 | | | | | | | | |
| NS3 | 1921 | 0.02 | 3 | 1 | 0 | Y | AGPMPVTVAS | 99.83 | | | | | | | | |
| NS3 | 1922 | 0.02 | 3 | 1 | 0 | Y | GPMPVTVASA | 99.83 | | | | | | | | |
| NS3 | 1923 | 0.02 | 3 | 1 | 0 | Y | PMPVTVASAA | 99.83 | | | | | | | | |
| NS3 | 1924 | 0.02 | 3 | 1 | 0 | Y | MPVTVASAAQ | 99.83 | | | | | | | | |
| NS3 | 1925 | 0.02 | 3 | 1 | 0 | Y | PVTVASAAQR | 99.83 | | | | | | | | |
| NS3 | 1926 | 0.02 | 3 | 1 | 0 | Y | VTVASAAQRR | 99.83 | | | | | | | | |
| NS3 | 1927 | 0.02 | 3 | 1 | 0 | Y | TVASAAQRRG | 99.83 | | | | | | | | |
| NS3 | 1928 | 0.02 | 3 | 1 | 0 | Y | VASAAQRRGR | 99.83 | | | | | | | | |
| NS3 | 1929 | 0.02 | 2 | 1 | 0 | Y | ASAAQRRGRI | 99.83 | | | | | | | | |
| NS3 | 1930 | 0.01 | 2 | 1 | 0 | Y | SAAQRRGRIG | 99.92 | | | | | | | | |
| NS3 | 1931 | 0.01 | 4 | 1 | 0 | Y | AAQRRGRIGR | 99.92 | | | | | | | | |
| NS3 | 1932 | 0.05 | 9 | 1 | 0 | Y | AQRRGRIGRN | 99.5 | | | | | | | | |
| NS3 | 1933 | 0.93 | 10 | 3 | 0 | Y | QRRGRIGRNH | 73.45 | QRRGRIGRNQ | 25.48 | QRRGRIGRNP | 0.33 | | | | |
| NS3 | 1934 | 0.93 | 10 | 3 | 0 | Y | RRGRIGRNHN | 73.45 | RRGRIGRNQN | 25.48 | RRGRIGRNPN | 0.25 | | | | |
| NS3 | 1935 | 0.93 | 11 | 3 | 0 | Y | RGRIGRNHNK | 73.45 | RGRIGRNQNK | 25.48 | RGRIGRNYNK | 0.25 | | | | |
| NS3 | 1936 | 0.94 | 11 | 3 | 0 | Y | GRIGRNHNKE | 73.45 | GRIGRNQNKE | 25.39 | GRIGRNPNKE | 0.25 | | | | |
| NS3 | 1937 | 0.94 | 11 | 3 | 0 | Y | RIGRNHNKEG | 73.45 | RIGRNQNKEG | 25.39 | RIGRNYNKEG | 0.25 | | | | |
| NS3 | 1938 | 0.94 | 11 | 3 | 0 | Y | IGRNHNKEGD | 73.45 | IGRNQNKEGD | 25.39 | IGRNPNKEGD | 0.25 | | | | |
| NS3 | 1939 | 0.93 | 10 | 3 | 0 | Y | GRNHNKEGDQ | 73.53 | GRNQNKEGDQ | 25.39 | GRNPNKEGDQ | 0.25 | | | | |
| NS3 | 1940 | 0.93 | 10 | 3 | 0 | Y | RNHNKEGDQY | 73.53 | RNQNKEGDQY | 25.39 | RNVNKEGDQY | 0.25 | | | | |
| NS3 | 1941 | 1.19 | 13 | 5 | 0 | Y | NHNKEGDQYI | 72.79 | NQNKEGDQYI | 19.27 | NQNKEGDQYI | 6.12 | NHNKEGDQYI | 0.74 | NYNKEGDQYI | 0.25 |
| NS3 | 1942 | 1.17 | 11 | 4 | 0 | Y | HNKEGDQYIY | 72.95 | QNKEGDQYIY | 19.35 | QNKEGDQYIY | 6.12 | HNKEGDQYVV | 0.74 | | |
| NS3 | 1943 | 0.76 | 6 | 2 | 0 | Y | NKEGDQYIYM | 79.49 | NKEGDQYYYM | 20.18 | | | | | | |

FIG. 4-74

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1944 | 0.76 | 5 | 2 | 0 | Y | KEGDQYIYMG | 79.49 | KEGDQYIYMG | 20.26 | | | | |
| NS3 | 1945 | 0.76 | 5 | 2 | 0 | Y | EGDQYIYMGQ | 79.49 | EGDQYIYMGQ | 20.26 | | | | |
| NS3 | 1946 | 0.75 | 4 | 2 | 0 | Y | GDQYIYMGQP | 79.49 | GDQYIYMGQP | 20.35 | | | | |
| NS3 | 1947 | 0.77 | 7 | 3 | 0 | Y | DQYIYMGQPL | 79.32 | DQYIYMGQPL | 20.26 | | | | |
| NS3 | 1948 | 0.84 | 9 | 3 | 0 | Y | QYIYMGQPLN | 78.58 | QYIYMGQPLN | 20.26 | QYIYMGQPLK | 0.66 | | |
| NS3 | 1949 | 0.84 | 9 | 3 | 0 | Y | YIYMGQPLNN | 78.58 | YIYMGQPLNN | 20.26 | YIYMGQPLKN | 0.66 | | |
| NS3 | 1950 | 0.84 | 9 | 3 | 0 | Y | IYMGQPLNND | 78.58 | IYMGQPLNND | 20.26 | IYMGQPLKND | 0.66 | | |
| NS3 | 1951 | 0.11 | 7 | 2 | 0 | Y | YMGQPLNNDE | 98.84 | YMGQPLNNDE | 0.66 | | | | |
| NS3 | 1952 | 0.11 | 7 | 2 | 0 | Y | MGQPLNNDED | 98.84 | MGQPLNNDED | 0.66 | | | | |
| NS3 | 1953 | 0.11 | 7 | 2 | 0 | Y | GQPLNNDEDH | 98.84 | GQPLNNDEDH | 0.66 | | | | |
| NS3 | 1954 | 0.11 | 7 | 2 | 0 | Y | QPLNNDEDHA | 98.84 | QPLNNDEDHA | 0.66 | | | | |
| NS3 | 1955 | 0.12 | 8 | 2 | 0 | Y | PLNNDEDHAH | 98.76 | PLNNDEDHAH | 0.66 | | | | |
| NS3 | 1956 | 0.12 | 8 | 2 | 0 | Y | LNNDEDHAHW | 98.76 | LNNDEDHAHW | 0.66 | | | | |
| NS3 | 1957 | 0.1 | 6 | 1 | 0 | Y | NNDEDHAHWT | 99.01 | | | | | | |
| NS3 | 1958 | 0.03 | 4 | 1 | 0 | Y | NDEDHAHWTE | 99.75 | | | | | | |
| NS3 | 1959 | 0.03 | 4 | 1 | 0 | Y | DEDHAHWTEA | 99.75 | | | | | | |
| NS3 | 1960 | 0.03 | 3 | 1 | 0 | Y | EDHAHWTEAK | 99.75 | | | | | | |
| NS3 | 1961 | 0.03 | 3 | 1 | 0 | Y | DHAHWTEAKM | 99.75 | | | | | | |
| NS3 | 1962 | 0.03 | 3 | 1 | 0 | Y | HAHWTEAKML | 99.75 | | | | | | |
| NS3 | 1963 | 0.03 | 3 | 1 | 0 | Y | AHWTEAKMLL | 99.75 | | | | | | |
| NS3 | 1964 | 0.04 | 4 | 1 | 0 | Y | HWTEAKMLLD | 99.67 | | | | | | |
| NS3 | 1965 | 0.02 | 3 | 1 | 0 | Y | WTEAKMLLDN | 99.83 | | | | | | |
| NS3 | 1966 | 0.04 | 5 | 1 | 0 | Y | TEAKMLLDNI | 99.67 | | | | | | |
| NS3 | 1967 | 0.04 | 5 | 1 | 0 | Y | EAKMLLDNIN | 99.67 | | | | | | |

FIG. 4-76

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---

FIG. 4-77

Species: DENV1 (10-MERS)

| protein | block starting position | block entropy | total peptides in block | #

FIG. 4-78

Species: DENV1 (10-MERS)

| protein | block starting position | block entropy | total peptides in block | # peptides required to cover 99% of block | gap/X fraction | 99% of block covered w/ <= 5 peptides?

FIG. 4-79

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2074 | 0.06 | 6 | 1 | 0 | Y | LDARTYSDPL | 99.42 | | | | | | |
| NS3 | 2075 | 0.06 | 6 | 1 | 0 | Y | DARTYSDPLA | 99.42 | | | | | | |
| NS3 | 2076 | 0.06 | 6 | 1 | 0 | Y | ARTYSDPLAL | 99.42 | | | | | | |
| NS3 | 2077 | 0.08 | 7 | 1 | 0 | Y | RTYSDPLALR | 99.26 | | | | | | |
| NS3 | 2078 | 0.07 | 6 | 1 | 0 | Y | TYSDPLALRE | 99.34 | | | | | | |
| NS3 | 2079 | 0.07 | 7 | 1 | 0 | Y | YSDPLALREF | 99.42 | | | | | | |
| NS3 | 2080 | 0.07 | 7 | 1 | 0 | Y | SDPLALREFK | 99.42 | | | | | | |
| NS3 | 2081 | 0.07 | 7 | 1 | 0 | Y | DPLALREFKE | 99.42 | | | | | | |
| NS3 | 2082 | 0.07 | 7 | 1 | 0 | Y | PLALREFKEF | 99.42 | | | | | | |
| NS3 | 2083 | 0.07 | 7 | 1 | 0 | Y | LALREFKEFA | 99.42 | | | | | | |
| NS3 | 2084 | 0.07 | 7 | 1 | 0 | Y | ALREFKEFAA | 99.42 | | | | | | |
| NS3 | 2085 | 0.06 | 6 | 1 | 0 | Y | LREFKEFAAG | 99.5 | | | | | | |
| NS3 | 2086 | 0.06 | 6 | 1 | 0 | Y | REFKEFAAGR | 99.5 | | | | | | |

FIG. 4-80

Species: DENV1 (10-MERS)

| protein | block starting position | block entropy | total peptides in block | # peptides required to cover 99% of block | gap/X fraction | 99% of block covered w/ <= 5 pept

FIG. 4-81

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2122 | 0.06 | 5 | 1 | 0 | Y | DNLVMLHNSE | 99.42 | | | | | | |
| NS4A | 2123 | 0.06 | 5 | 1 | 0 | Y | NLVMLHNSEQ | 99.42 | | | | | | |
| NS4A | 2124 | 0.06 | 5 | 1 | 0 | Y | LVMLHNSEQG | 99.42 | | | | | | |
| NS4A | 2125 | 0.06 | 5 | 1 | 0 | Y | VMLHNSEQGG | 99.42 | | | | | | |
| NS4A | 2126 | 0.85 | 5 | 2 | 0 | Y | MLHNSEQGGR | 75.19 | MLHNSEQGGK | 24.32 | | | | |
| NS4A | 2127 | 0.84 | 5 | 2 | 0 | Y | LHNSEQGGRA | 75.27 | LHNSEQGGKA | 24.32 | | | | |
| NS4A | 2128 | 0.82 | 4 | 2 | 0 | Y | HNSEQGGRAY | 75.27 | HNSEQGGKAY | 24.57 | | | | |
| NS4A | 2129 | 0.84 | 6 | 2 | 0 | Y | NSEQGGRAYR | 75.19 | NSEQGGKAYR | 24.48 | | | | |
| NS4A | 2130 | 0.85 | 7 | 2 | 0 | Y | SEQGGRAYRH | 75.1 | SEQGGKAYRH | 24.48 | | | | |
| NS4A | 2131 | 0.85 | 7 | 2 | 0 | Y | EQGGRAYRHA | 75.1 | EQGGKAYRHA | 24.48 | | | | |
| NS4A | 2132 | 0.93 | 10 | 3 | 0 | Y | QGGRAYRHAM | 74.19 | QGGKAYRHAM | 24.4 | QGGRAYRHAL | 0.74 | | |
| NS4A | 2133 | 0.93 | 10 | 3 | 0 | Y | GGRAYRHAME | 74.19 | GGKAYRHAME | 24.4 | GGRAYRHALE | 0.74 | | |
| NS4A | 2134 | 0.93 | 10 | 3 | 0 | Y | GRAYRHAMEE | 74.19 | GKAYRHAMEE | 24.4 | GRAYRHALEE | 0.74 | | |
| NS4A | 2135 | 0.93 | 10 | 3 | 0 | Y | RAYRHAMEEL | 74.19 | KAYRHAMEEL | 24.4 | RAYRHALEEL | 0.74 | | |
| NS4A | 2136 | 0.14 | 8 | 2 | 0 | Y | AYRHAMEELP | 98.59 | AYRHALEELP | 0.74 | | | | |
| NS4A | 2137 | 0.14 | 8 | 2 | 0 | Y | YRHAMEELPD | 98.59 | YRHALEELPD | 0.74 | | | | |
| NS4A | 2138 | 0.14 | 8 | 2 | 0 | Y | RHAMEELPDT | 98.59 | RHALEELPDT | 0.74 | | | | |
| NS4A | 2139 | 0.12 | 7 | 2 | 0 | Y | HAMEELPDTI | 98.76 | HALEELPDTI | 0.74 | | | | |
| NS4A | 2140 | 0.11 | 6 | 2 | 0 | Y | AMEELPDTIE | 98.84 | ALEELPDTIE | 0.74 | | | | |
| NS4A | 2141 | 0.11 | 6 | 2 | 0 | Y | MEELPDTIET | 98.84 | LEELPDTIET | 0.74 | | | | |
| NS4A | 2142 | 0.13 | 5 | 2 | 0 | Y | EELPDTIETL | 98.51 | EELPDTIETM | 0.91 | | | | |
| NS4A | 2143 | 0.13 | 5 | 2 | 0 | Y | ELPDTIETLM | 98.51 | ELPDTIETIM | 0.91 | | | | |
| NS4A | 2144 | 0.13 | 5 | 2 | 0 | Y | LPDTIETLML | 98.51 | LPDTIETIML | 0.91 | | | | |
| NS4A | 2145 | 0.13 | 5 | 2 | 0 | Y | PDTIETLMLL | 98.51 | PDTIETIMLL | 0.91 | | | | |

FIG. 4-82

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2146 | 0.14 | 6 | 2 | 0 | Y | DTIETLMLLA | 98.43 | DTIETLMLLA | 0.91 | | | | |
| NS4A | 2147 | 0.13 | 5 | 2 | 0 | Y | TIETLMLLAL | 98.51 | TIETLMLLAL | 0.91 | | | | |
| NS4A | 2148 | 0.14 | 6 | 2 | 0 | Y | IETLMLLALI | 98.43 | IETLMLLALI | 0.91 | | | | |
| NS4A | 2149 | 0.14 | 6 | 2 | 0 | Y | ETLMLLALIA | 98.43 | ETLMLLALIA | 0.91 | | | | |
| NS4A | 2150 | 0.18 | 8 | 2 | 0 | Y | TLMLLALIAV | 98.1 | TIMLLALIAV | 0.91 | | | | |
| NS4A | 2151 | 0.18 | 8 | 2 | 0 | Y | LMLLALIAVL | 98.1 | IMLLALIAVL | 0.91 | | | | |
| NS4A | 2152 | 0.06 | 6 | 1 | 0 | Y | MLLALIAVLT | 99.42 | | | | | | |
| NS4A | 2153 | 0.06 | 6 | 1 | 0 | Y | LLALIAVLTG | 99.42 | | | | | | |
| NS4A | 2154 | 0.06 | 6 | 1 | 0 | Y | LALIAVLTGG | 99.42 | | | | | | |
| NS4A | 2155 | 0.09 | 9 | 1 | 0 | Y | ALIAVLTGGV | 99.17 | | | | | | |
| NS4A | 2156 | 0.16 | 10 | 2 | 0 | Y | LIAVLTGGVT | 98.43 | LIAVLTGGVM | 0.74 | | | | |
| NS4A | 2157 | 0.16 | 10 | 2 | 0 | Y | IAVLTGGVTL | 98.43 | IAVLTGGVML | 0.74 | | | | |
| NS4A | 2158 | 0.15 | 9 | 2 | 0 | Y | AVLTGGVTLF | 98.51 | AVLTGGVMLF | 0.74 | | | | |
| NS4A | 2159 | 0.16 | 10 | 2 | 0 | Y | VLTGGVTLFF | 98.43 | VLTGGVMLFF | 0.74 | | | | |
| NS4A | 2160 | 0.13 | 9 | 2 | 0 | Y | LTGGVTLFFL | 98.68 | LTGGVMLFFL | 0.74 | | | | |
| NS4A | 2161 | 0.13 | 9 | 2 | 0 | Y | TGGVTLFFLS | 98.68 | TGGVMLFFLS | 0.74 | | | | |
| NS4A | 2162 | 0.13 | 9 | 2 | 0 | Y | GGVTLFFLSG | 98.68 | GGVMLFFLSG | 0.74 | | | | |
| NS4A | 2163 | 0.98 | 11 | 3 | 0 | Y | GVTLFFLSGR | 71.38 | GVTLFFLSGK | 27.3 | GVMLFFLSGK | 0.58 | | |
| NS4A | 2164 | 0.98 | 11 | 3 | 0 | Y | VTLFFLSGRG | 71.38 | VTLFFLSGKG | 27.3 | VMLFFLSGKG | 0.58 | | |
| NS4A | 2165 | 0.95 | 8 | 3 | 0 | Y | TLFFLSGRGL | 71.55 | TLFFLSGKGL | 27.38 | MLFFLSGKGL | 0.58 | | |
| NS4A | 2166 | 0.88 | 5 | 2 | 0 | Y | LFFLSGRGLG | 71.79 | LFFLSGKGLG | 27.96 | | | | |
| NS4A | 2167 | 0.88 | 5 | 2 | 0 | Y | FFLSGRGLGK | 71.79 | FFLSGKGLGK | 27.96 | | | | |
| NS4A | 2168 | 0.87 | 4 | 2 | 0 | Y | FLSGRGLGKT | 71.88 | FLSGKGLGKT | 27.96 | | | | |
| NS4A | 2169 | 0.87 | 4 | 2 | 0 | Y | LSGRGLGKTS | 71.88 | LSGKGLGKTS | 27.96 | | | | |

FIG. 4-83

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2170 | 0.87 | 4 | 2 | 0 | Y | SGRGLGKTSI | 71.88 | SGKGLGKTSI | 27.96 | | | | |
| NS4A | 2171 | 0.87 | 4 | 2 | 0 | Y | GRGLGKTSIG | 71.88 | GKGLGKTSIG | 27.96 | | | | |
| NS4A | 2172 | 0.89 | 5 | 2 | 0 | Y | RGLGKTSIGL | 71.71 | KGLGKTSIGL | 27.96 | | | | |
| NS4A | 2173 | 0.04 | 4 | 1 | 0 | Y | GLGKTSIGLL | 99.67 | | | | | | |
| NS4A | 2174 | 0.04 | 4 | 1 | 0 | Y | LGKTSIGLLC | 99.67 | | | | | | |
| NS4A | 2175 | 0.04 | 4 | 1 | 0 | Y | GKTSIGLLCV | 99.67 | | | | | | |
| NS4A | 2176 | 0.76 | 7 | 3 | 0 | Y | KTSIGLLCVM | 82.55 | KTSIGLLCVT | 16.05 | KTSIGLLCVI | 0.74 | | |
| NS4A | 2177 | 0.89 | 10 | 5 | 0 | Y | TSIGLLCVMA | 81.64 | TSIGLLCVTA | 15.22 | TSIGLLCVMS | 0.74 | TSIGLLCVIA | 0.74 |
| NS4A | 2178 | 0.89 | 10 | 5 | 0 | Y | SIGLLCVMAS | 81.64 | SIGLLCVTAS | 15.22 | SIGLLCVIAS | 0.83 | SIGLLCVMSS | 0.74 |
| NS4A | 2179 | 0.88 | 9 | 5 | 0 | Y | IGLLCVMASS | 81.72 | IGLLCVTASS | 15.22 | IGLLCVIASS | 0.83 | IGLLCVMSSS | 0.74 |
| NS4A | 2187 | 1.07 | 14 | 4 | 0 | Y | SSVLLWMASV | 71.79 | SSALLWMANV | 24.9 | SSVLLWIASV | 0.17 | | |
| NS4A | 2188 | 1.07 | 14 | 4 | 0 | Y | SVLLWMASVE | 71.79 | SALLWMANVE | 24.9 | SALLWIASVE | 0.17 | | |
| NS4A | 2189 | 1.07 | 14 | 4 | 0 | Y | VLLWMASVEP | 71.79 | ALLWMANVEP | 24.9 | VLLWIASVEP | 0.17 | | |
| NS4A | 2190 | 0.24 | 9 | 2 | 0 | Y | LLWMASVEPH | 96.94 | LLWMANVEPH | 2.23 | | | | |
| NS4A | 2191 | 0.25 | 10 | 2 | 0 | Y | LWMASVEPHW | 96.86 | LWMANVEPHW | 2.23 | | | | |
| NS4A | 2192 | 0.25 | 10 | 2 | 0 | Y | WMASVEPHWI | 96.86 | WMANVEPHWI | 2.23 | | | | |
| NS4A | 2193 | 0.25 | 10 | 2 | 0 | Y | MASVEPHWIA | 96.86 | MANVEPHWIA | 2.23 | | | | |
| NS4A | 2194 | 0.2 | 7 | 2 | 0 | Y | ASVEPHWIAA | 97.35 | ANVEPHWIAA | 2.23 | | | | |
| NS4A | 2195 | 0.18 | 5 | 2 | 0 | Y | SVEPHWIAAS | 97.52 | NVEPHWIAAS | 2.23 | | | | |
| NS4A | 2196 | 0.03 | 4 | 1 | 0 | Y | VEPHWIAASI | 99.75 | | | | | | |
| NS4A | 2197 | 0.04 | 5 | 1 | 0 | Y | EPHWIAASII | 99.67 | | | | | | |
| NS4A | 2198 | 0.03 | 4 | 1 | 0 | Y | PHWIAASIIL | 99.75 | | | | | | |
| NS4A | 2199 | 0.04 | 5 | 1 | 0 | Y | HWIAASIILE | 99.67 | | | | | | |
| NS4A | 2200 | 0.04 | 5 | 1 | 0 | Y | WIAASIILEF | 99.67 | | | | | | |

FIG. 4-84

Species: DENV1 (10-MERS)

| protein | block starting position | block entropy | total

FIG. 4-85

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2225 | 0.02 | 3 | 1 | 0 | Y | PQDNQLAYVW | 99.83 | | | | | | |
| 2K | 2226 | 0.03 | 4 | 1 | 0 | Y | QDNQLAYVWI | 99.75 | | | | | | |
| 2K | 2227 | 0.04 | 5 | 1 | 0 | Y | DNQLAYVWIG | 99.67 | | | | | | |
| 2K | 2228 | 0.04 | 5 | 1 | 0 | Y | NQLAYVWIGL | 99.67 | | | | | | |
| 2K | 2229 | 0.04 | 5 | 1 | 0 | Y | QLAYVWIGLL | 99.67 | | | | | | |
| 2K | 2230 | 0.04 | 5 | 1 | 0 | Y | LAYVWIGLLF | 99.67 | | | | | | |
| 2K | 2231 | 0.2 | 8 | 3 | 0 | Y | AYVWIGLLFM | 97.77 | AYVWIGLLFV | 0.91 | AYVWIGLLFI | 0.91 | | |
| 2K | 2232 | 0.2 | 8 | 3 | 0 | Y | YVWIGLLFMI | 97.77 | YVWIGLLFII | 0.91 | YVWIGLLFVI | 0.91 | | |
| 2K | 2233 | 0.2 | 8 | 3 | 0 | Y | VWIGLLFMIL | 97.77 | VWIGLLFIIL | 0.91 | VWIGLLFVIL | 0.91 | | |
| 2K | 2234 | 0.22 | 9 | 3 | 0 | Y | VIGLLFMILT | 97.6 | VIGLLFIILT | 0.91 | VIGLLFVILT | 0.91 | | |
| 2K | 2235 | 0.22 | 9 | 3 | 0 | Y | IGLLFMILTV | 97.52 | IGLLFIILTV | 0.99 | IGLLFVILTV | 0.99 | | |
| 2K | 2236 | 0.21 | 8 | 3 | 0 | Y | GLLFMILTVA | 97.6 | GLLFIILTVA | 0.99 | GLLFVILTVA | 0.99 | | |
| 2K | 2237 | 0.2 | 7 | 3 | 0 | Y | LLFMILTVAA | 97.68 | LLFIILTVAA | 0.99 | LLFVILTVAA | 0.99 | | |
| 2K | 2238 | 0.21 | 8 | 3 | 0 | Y | LFMILTVAAN | 97.6 | LFIILTVAAN | 0.99 | LFVILTVAAN | 0.99 | | |
| 2K | 2239 | 0.21 | 8 | 3 | 0 | Y | FMILTVAANE | 97.6 | FIILTVAANE | 0.99 | FVILTVAANE | 0.99 | | |
| 2K | 2240 | 0.21 | 8 | 3 | 0 | Y | MILTVAANEM | 97.6 | IILTVAANEM | 0.99 | VILTVAANEM | 0.99 | | |
| 2K | 2241 | 0.05 | 5 | 1 | 0 | Y | ILTVAANEMG | 99.59 | | | | | | |
| 2K | 2242 | 0.05 | 5 | 1 | 0 | Y | LTVAANEMGL | 99.59 | | | | | | |
| 2K | 2243 | 0.05 | 5 | 1 | 0 | Y | TVAANEMGLL | 99.59 | | | | | | |
| 2K | 2244 | 0.03 | 4 | 1 | 0 | Y | VAANEMGLLE | 99.75 | | | | | | |
| 2K | 2245 | 0.02 | 3 | 1 | 0 | Y | AANEMGLLET | 99.83 | | | | | | |
| 2K | 2246 | 0.02 | 3 | 1 | 0 | Y | ANEMGLLETT | 99.83 | | | | | | |
| NS4B | 2247 | 0.02 | 3 | 1 | 0 | Y | NEMGLLETTK | 99.83 | | | | | | |
| NS4B | 2248 | 0.03 | 3 | 1 | 0 | Y | EMGLLETTKK | 99.67 | | | | | | |

FIG. 4-86

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2249 | 0.03 | 3 | 1 | 0 | Y | MGLLETTKKD | 99.67 | | | | | | |
| NS4B | 2250 | 0.03 | 3 | 1 | 0 | Y | GLLETTKKDL | 99.67 | | | | | | |
| NS4B | 2251 | 0.03 | 3 | 1 | 0 | Y | LLETTKKDLG | 99.67 | | | | | | |
| NS4B | 2252 | 0.03 | 3 | 1 | 0 | Y | LETTKKDLGI | 99.67 | | | | | | |
| NS4B | 2253 | 0.03 | 3 | 1 | 0 | Y | ETTKKDLGIG | 99.67 | | | | | | |
| NS4B | 2254 | 0.34 | 5 | 2 | 0 | Y | TKKDLGIGH | 94.29 | TKKDLGIGHA | 5.29 | | | | |
| NS4B | 2255 | 0.64 | 8 | 3 | 0 | Y | TKKDLGIGHV | 89.66 | TKKDLGIGY | 4.88 | | | | |
| NS4B | 2256 | 0.72 | 10 | 5 | 0 | Y | KKDLGIGHVA | 89.08 | TKKDLGIGYV | 4.88 | KKDLGIGHAV | 3.72 | KKDLGIGHVV | 0.58 |
| NS4B | 2273 | 1.45 | 8 | 4 | 0 | Y | AMLDVDLHPA | 62.2 | KKDLGIGYVA | 18.69 | KKDLGIGHAA | 4.55 | | |
| NS4B | 2274 | 0.75 | 5 | 2 | 0 | Y | MLDVDLHPAS | 81.64 | TMLDVDLHPA | 17.45 | TMLDIDLHPA | 0.83 | | |
| NS4B | 2275 | 0.74 | 4 | 2 | 0 | Y | LDVDLHPASA | 81.72 | MLDVDLRPAS | 17.45 | | 0.74 | | |
| NS4B | 2276 | 0.74 | 4 | 2 | 0 | Y | DVDLHPASAW | 81.72 | LDVDLRPASA | 17.45 | | | | |
| NS4B | 2277 | 0.74 | 4 | 2 | 0 | Y | VDLHPASAWT | 81.72 | DVDLRPASAW | 17.45 | | | | |
| NS4B | 2278 | 0.67 | 4 | 2 | 0 | Y | DLHPASAWTL | 82.46 | VDLRPASAWT | 17.54 | | | | |
| NS4B | 2279 | 0.67 | 4 | 2 | 0 | Y | LHPASAWTLY | 82.46 | DLRPASAWTL | 17.54 | | | | |
| NS4B | 2280 | 0.67 | 4 | 2 | 0 | Y | HPASAWTLYA | 82.46 | LRPASAWTLY | 17.54 | | | | |
| NS4B | 2281 | 0 | 2 | 1 | 0 | Y | PASAWTLYAV | 100 | RPASAWTLYA | 17.54 | | | | |
| NS4B | 2282 | 0 | 2 | 1 | 0 | Y | ASAWTLYAVA | 100 | | | | | | |
| NS4B | 2283 | 0 | 2 | 1 | 0 | Y | SAWTLYAVAI | 100 | | | | | | |
| NS4B | 2284 | 0 | 1 | 1 | 0 | Y | AWTLYAVATT | 100 | | | | | | |
| NS4B | 2285 | 0.73 | 3 | 2 | 0 | Y | WTLYAVATTI | 80.15 | WTLYAVATTV | 19.77 | | | | |
| NS4B | 2286 | 0.74 | 4 | 2 | 0 | Y | TLYAVATTII | 80.07 | TLYAVATTVI | 19.77 | | | | |
| NS4B | 2287 | 0.74 | 4 | 2 | 0 | Y | LYAVATTIIT | 80.07 | LYAVATTVIT | 19.77 | | | | |
| NS4B | 2288 | 0.74 | 4 | 2 | 0 | Y | YAVATTIITP | 80.07 | YAVATTVITP | 19.77 | | | | |

FIG. 4-87

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|

FIG. 4-89

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2337 | 0.01 | 2 | 1 | 0 | Y | GVPLLALGCY | 99.92 | | | | | | |
| NS4B | 2338 | 0.01 | 2 | 1 | 0 | Y | VPLLALGCYS | 99.92 | | | | | | |
| NS4B | 2339 | 0.01 | 2 | 1 | 0 | Y | PLLALGCYSQ | 99.92 | | | | | | |
| NS4B | 2340 | 0.01 | 2 | 1 | 0 | Y | LLALGCYSQV | 99.92 | | | | | | |
| NS4B | 2341 | 0.01 | 2 | 1 | 0 | Y | LALGCYSQVN | 99.92 | | | | | | |
| NS4B | 2342 | 0.01 | 2 | 1 | 0 | Y | ALGCYSQVNP | 99.92 | | | | | | |
| NS4B | 2343 | 0.01 | 2 | 1 | 0 | Y | LGCYSQVNPL | 99.92 | | | | | | |
| NS4B | 2344 | 0.01 | 3 | 1 | 0 | Y | GCYSQVNPLT | 99.92 | | | | | | |
| NS4B | 2345 | 0.02 | 4 | 1 | 0 | Y | CYSQVNPLTI | 99.83 | | | | | | |
| NS4B | 2346 | 0.11 | 5 | 2 | 0 | Y | YSQVNPLTLT | 98.68 | YSQVNPLTLI | 1.16 | | | | |
| NS4B | 2347 | 0.12 | 7 | 2 | 0 | Y | SQVNPLTLTA | 98.59 | SQVNPLTLIA | 1.16 | | | | |
| NS4B | 2348 | 0.16 | 9 | 2 | 0 | Y | QVNPLTLTAA | 98.18 | QVNPLTLIAA | 1.16 | | | | |
| NS4B | 2349 | 0.18 | 12 | 2 | 0 | Y | VNPLTLTAAV | 98.01 | VNPLTLIAAV | 1.16 | | | | |
| NS4B | 2350 | 0.23 | 12 | 3 | 0 | Y | NPLTLTAAVL | 97.6 | NPLTLIAAVL | 1.16 | NPLTLTATVL | 0.33 | | |
| NS4B | 2351 | 0.23 | 12 | 3 | 0 | Y | PLTLTAAVLM | 97.6 | PLTLIAAVLM | 1.16 | PLTLTATVLM | 0.33 | | |
| NS4B | 2352 | 0.23 | 14 | 3 | 0 | Y | LTLTAAVLML | 97.6 | LTLIAAVLML | 1.16 | LTLTATVLML | 0.33 | | |
| NS4B | 2353 | 0.3 | 14 | 3 | 0 | Y | TLTAAVLMLV | 96.77 | TLIAAVLMLV | 1.16 | TLTAAVLMLL | 0.74 | TLTATVLMLV | 0.33 |
| NS4B | 2354 | 0.3 | 13 | 3 | 0 | Y | LTAAVLMLVA | 96.77 | LTIAAVLMLA | 1.16 | LTAAVLMLLA | 0.74 | LTATVLMLVA | 0.33 |
| NS4B | 2355 | 0.29 | 12 | 4 | 0 | Y | TAAVLMLVAH | 96.86 | TAAVLMLVAH | 1.16 | TAAVLMLLAH | 0.74 | TATVLMLVAH | 0.33 |
| NS4B | 2356 | 0.2 | 11 | 4 | 0 | Y | AAVLMLVAHY | 98.01 | AAVLMLLAHY | 0.74 | | | | |
| NS4B | 2357 | 0.19 | 9 | 4 | 0 | Y | AVLMLVAHYA | 98.1 | AVLMLLAHYA | 0.74 | | | | |
| NS4B | 2358 | 0.15 | 7 | 3 | 0 | Y | VLMLVAHYAI | 98.51 | VLMLLAHYAI | 0.74 | | | | |
| NS4B | 2359 | 0.13 | 5 | 2 | 0 | Y | LMLVAHYAII | 98.68 | LMLLAHYAII | 0.74 | | | | |
| NS4B | 2360 | 0.08 | 4 | 1 | 0 | Y | MLVAHYAIIG | 99.09 | | | | | | |

FIG. 4-90

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency |

FIG. 4-91

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2385 | 0.18 | 3 | 2 | 0 | Y | AAGIMKNPTV | 97.35 | AAGIMKNPTI | 2.56 | | | | |
| NS4B | 2386 | 0.18 | 3 | 2 | 0 | Y | AGIMKNPTVD | 97.35 | AGIMKNPTID | 2.56 | | | | |
| NS4B | 2387 | 0.18 | 3 | 2 | 0 | Y | GIMKNPTVDG | 97.35 | GIMKNPTIDG | 2.56 | | | | |
| NS4B | 2388 | 0.18 | 3 | 2 | 0 | Y | IMKNPTVDGI | 97.35 | IMKNPTIDGI | 2.56 | | | | |
| NS4B | 2389 | 0.25 | 5 | 3 | 0 | Y | MKNPTVDGIV | 96.61 | MKNPTIDGIV | 2.56 | | | | |
| NS4B | 2390 | 0.34 | 6 | 3 | 0 | Y | KNPTVDGIVA | 95.45 | KNPTIDGIVA | 2.56 | KNPTVDGIVT | 1.16 | | |
| NS4B | 2391 | 0.34 | 6 | 3 | 0 | Y | NPTVDGIVAI | 95.45 | NPTIDGIVAI | 2.56 | NPTVDGIVTI | 1.16 | | |
| NS4B | 2392 | 0.35 | 7 | 3 | 0 | Y | PTVDGIVAID | 95.37 | PTIDGIVAID | 2.56 | PTVDGIVTID | 1.16 | | |
| NS4B | 2393 | 0.35 | 7 | 3 | 0 | Y | TVDGIVAIDL | 95.37 | TIDGIVAIDL | 2.56 | TVDGIVTIDL | 1.16 | | |
| NS4B | 2394 | 0.35 | 7 | 3 | 0 | Y | VDGIVAIDLD | 95.37 | IDGIVAIDLD | 2.56 | VDGIVTIDLD | 1.16 | | |
| NS4B | 2395 | 0.18 | 6 | 2 | 0 | Y | DGIVAIDLDP | 97.93 | DGIVTIDLDP | 1.16 | | | | |
| NS4B | 2396 | 0.18 | 6 | 2 | 0 | Y | GIVAIDLDPV | 97.93 | GIVTIDLDPV | 1.16 | | | | |
| NS4B | 2397 | 0.18 | 6 | 2 | 0 | Y | IVAIDLDPVV | 97.93 | IVTIDLDPVV | 1.16 | | | | |
| NS4B | 2398 | 0.18 | 6 | 2 | 0 | Y | VAIDLDPVVY | 97.93 | VTIDLDPVVY | 1.16 | | | | |
| NS4B | 2399 | 0.11 | 4 | 2 | 0 | Y | AIDLDPVVYD | 98.68 | TIDLDPVVYD | 1.41 | | | | |
| NS4B | 2400 | 0.16 | 5 | 2 | 0 | Y | IDLDPVVYDT | 98.01 | IDLDPVVYDT | 1.41 | | | | |
| NS4B | 2401 | 0.16 | 5 | 2 | 0 | Y | DLDPVVYDTK | 98.01 | DLDPVVYDTK | 1.49 | | | | |
| NS4B | 2402 | 0.16 | 4 | 2 | 0 | Y | LDPVVYDAKF | 98.01 | LDPVVYDTKF | 1.49 | | | | |
| NS4B | 2403 | 0.16 | 4 | 2 | 0 | Y | DPVVYDAKFE | 98.01 | DPVVYDTKFE | 1.49 | | | | |
| NS4B | 2404 | 0.16 | 4 | 2 | 0 | Y | PVVYDAKFEK | 98.01 | PVVYDTKFEK | 1.49 | | | | |
| NS4B | 2405 | 0.16 | 4 | 2 | 0 | Y | VVYDAKFEKQ | 98.01 | VVYDTKFEKQ | 1.49 | | | | |
| NS4B | 2406 | 0.16 | 4 | 2 | 0 | Y | VYDAKFEKQL | 98.01 | VYDTKFEKQL | 1.49 | | | | |
| NS4B | 2407 | 0.16 | 4 | 2 | 0 | Y | YDAKFEKQLG | 98.01 | YDTKFEKQLG | 1.49 | | | | |
| NS4B | 2408 | 0.16 | 4 | 2 | 0 | Y | DAKFEKQLGQ | 98.01 | DTKFEKQLGQ | 1.49 | | | | |

FIG. 4-92

Species: DENV1 (10-MERS)

| prot

FIG. 4-93

Species: D

FIG. 4-94

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS4B | 2457 | 0.01 | 2 | —

FIG. 4-95

Species: DENV1 (10-MERS)

| protein | block starting position | block entropy | total peptides in block | # peptides required to cover

FIG. 4-96

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2505 | 0.03 | 3 | 1 | 0 | Y | GEKWKRQLNQ | 99.75 | | | | | | | | |
| NS5 | 2506 | 0.03 | 3 | 1 | 0 | Y | EKWKRQLNQL | 99.75 | | | | | | | | |
| NS5 | 2507 | 0.05 | 5 | 1 | 0 | Y | KWKRQLNQLS | 99.5 | | | | | | | | |
| NS5 | 2508 | 0.05 | 5 | 1 | 0 | Y | WKRQLNQLSK | 99.5 | | | | | | | | |
| NS5 | 2509 | 0.09 | 5 | 1 | 0 | Y | KRQLNQLSKS | 99.17 | | | | | | | | |
| NS5 | 2510 | 0.09 | 7 | 1 | 0 | Y | RQLNQLSKSE | 99.17 | | | | | | | | |
| NS5 | 2511 | 0.09 | 7 | 1 | 0 | Y | QLNQLSKSEF | 99.17 | | | | | | | | |
| NS5 | 2512 | 0.09 | 8 | 1 | 0 | Y | LNQLSKSEFN | 99.17 | | | | | | | | |
| NS5 | 2513 | 0.63 | 10 | 2 | 0 | Y | NQLSKSEFNT | 87.18 | NQLSKSEFNI | 11.91 | | | | | | |
| NS5 | 2514 | 0.63 | 10 | 2 | 0 | Y | QLSKSEFNTY | 87.18 | QLSKSEFNIY | 11.91 | | | | | | |
| NS5 | 2515 | 0.64 | 11 | 3 | 0 | Y | LSKSEFNTYK | 87.01 | LSKSEFNIYK | 11.91 | LSKPEFNTYK | 0.25 | | | | |
| NS5 | 2516 | 0.71 | 12 | 4 | 0 | Y | SKSEFNTYKR | 86.19 | SKSEFNIYKR | 11.91 | SKSEFNTYKK | 0.83 | SKPEFNTYKR | 0.25 | | |
| NS5 | 2517 | 0.68 | 10 | 3 | 0 | Y | KSEFNTYKRS | 86.44 | KSEFNIYKRS | 11.91 | KSEFNTYKKS | 0.83 | | | | |
| NS5 | 2518 | 0.68 | 10 | 3 | 0 | Y | SEFNTYKRSG | 86.44 | SEFNIYKRSG | 11.91 | SEFNTYKKSG | 0.83 | | | | |
| NS5 | 2519 | 0.65 | 8 | 3 | 0 | Y | EFNTYKRSGI | 86.77 | EFNIYKRSGI | 11.91 | EFNTYKKSGI | 0.83 | | | | |
| NS5 | 2520 | 0.88 | 14 | 5 | 0 | Y | FNTYKRSGIM | 83.95 | FNIYKRSGIM | 11.41 | FNTYKKSGIM | 2.48 | FNTYKRSGII | 0.83 | FNIYKRSGIV | 0.33 |
| NS5 | 2521 | 0.88 | 14 | 5 | 0 | Y | NTYKRSGIME | 83.95 | NIYKRSGIME | 11.41 | NTYKKSGIME | 2.48 | NTYKRSGIIE | 0.83 | NIYKRSGIVE | 0.33 |
| NS5 | 2522 | 0.87 | 12 | 5 | 0 | Y | TYKRSGIMEV | 84.04 | IYKRSGIMEV | 11.41 | TYKKSGIMEV | 2.56 | TYKRSGIIEV | 0.83 | IYKRSGIVEV | 0.33 |
| NS5 | 2523 | 0.34 | 8 | 3 | 0 | Y | YKRSGIMEVD | 95.53 | YKRSGIIEVD | 2.73 | YKKSGIMEVD | 0.83 | | | | |
| NS5 | 2524 | 0.34 | 8 | 3 | 0 | Y | KRSGIMEVDR | 95.53 | KRSGIIEVDR | 2.73 | KKSGIMEVDR | 0.83 | | | | |
| NS5 | 2525 | 0.35 | 9 | 4 | 0 | Y | RSGIMEVDRS | 95.62 | RSGIIEVDRS | 2.48 | KSGIMEVDRS | 0.83 | RSGIVEVDRS | 0.41 | | |
| NS5 | 2526 | 0.3 | 10 | 3 | 0 | Y | SGIMEVDRSE | 96.28 | SGIIEVDRSE | 2.48 | SGIVEVDRSE | 0.41 | | | | |
| NS5 | 2527 | 0.3 | 10 | 3 | 0 | Y | GIMEVDRSEA | 96.28 | GIIEVDRSEA | 2.48 | GIVEVDRSEA | 0.41 | | | | |
| NS5 | 2528 | 0.31 | 11 | 3 | 0 | Y | IMEVDRSEAK | 96.2 | IIEVDRSEAK | 2.48 | IVEVDRSEAK | 0.41 | | | | |

FIG. 4-97

Species: DENV1 (10-MERS)

| protein | block starting position | block entropy | total peptides in block | # peptides required to cover 99% of block | gap/X fraction | 99% of block covered w

FIG. 4-98

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|

FIG. 4-99

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 4-100

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 4-101

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2627 | 1.47 | 11 | 5 | 0.08 | Y | VFFIPPE

FIG. 4-102

Species: DENV1 (10-MERS)

| protein | block starting position | block entropy | total peptides in block | # peptides required to cover 99% of block | gap/X fraction | 99% of block covered w/ => 5 peptides? | peptides required to c

FIG. 4-103

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2685 | 0.24 | 7 | 3 | 0 | Y | WETLEQMQR | 97.02 | WEALEQMQR | 1.9 | WETLERMQR | 0.41 | | |
| NS5 | 2686 | 0.29 | 8 | 4 | 0 | Y | VETLEQMQRK | 96.53 | VEALEQMQRK | 1.9 | VETLEQMQRR | 0.5 | VETLEHMQRK | 0.41 |
| NS5 | 2687 | 0.35 | 9 | 5 | 0 | Y | ETLEQMQRKH | 95.78 | EALEQMQRKH | 1.9 | ETLEQMQRKY | 0.74 | ETLEQMQRRH | 0.5 | ETLERMQRKH | 0.41 |
| NS5 | 2688 | 0.35 | 9 | 5 | 0 | Y | TLEQMQRKHG | 95.78 | ALEQMQRKHG | 1.9 | TLEQMQRKYG | 0.74 | TLEQMQRRHG | 0.5 | TLEHMQRKHG | 0.41 |
| NS5 | 2689 | 0.2 | 7 | 3 | 0 | Y | LEQMQRKHGG | 97.77 | LEQMQRKYGG | 0.74 | LEQMQRRHGG | 0.5 | | |
| NS5 | 2690 | 0.2 | 7 | 3 | 0 | Y | EQMQRKHGGM | 97.77 | EQMQRKYGGM | 0.74 | EQMQRRHGGM | 0.5 | | |
| NS5 | 2691 | 0.21 | 8 | 4 | 0 | Y | QMQRKHGGML | 97.68 | QMQRKYGGML | 0.74 | QMQRRHGGML | 0.5 | HMQRKHGGML | 0.41 |
| NS5 | 2692 | 0.13 | 5 | 2 | 0 | Y | MQRKHGGMLV | 98.59 | MQRKYGGMLV | 0.74 | | | | |
| NS5 | 2693 | 0.13 | 5 | 2 | 0 | Y | QRKHGGMLVR | 98.59 | QRKYGGMLVR | 0.74 | | | | |
| NS5 | 2694 | 0.13 | 5 | 2 | 0 | Y | RKHGGMLVRN | 98.59 | RKYGGMLVRN | 0.74 | | | | |
| NS5 | 2695 | 0.13 | 5 | 2 | 0 | Y | KHGGMLVRNP | 98.59 | KYGGMLVRNP | 0.74 | | | | |
| NS5 | 2696 | 0.08 | 4 | 1 | 0 | Y | HGGMLVRNPL | 99.09 | | | | | | |
| NS5 | 2697 | 0.03 | 4 | 1 | 0 | Y | GGMLVRNPLS | 99.75 | | | | | | |
| NS5 | 2698 | 0.03 | 4 | 1 | 0 | Y | GMLVRNPLSR | 99.75 | | | | | | |
| NS5 | 2699 | 0.03 | 4 | 1 | 0 | Y | MLVRNPLSRN | 99.75 | | | | | | |
| NS5 | 2700 | 0.02 | 3 | 1 | 0 | Y | LVRNPLSRNS | 99.83 | | | | | | |
| NS5 | 2701 | 0.04 | 3 | 1 | 0 | Y | VRNPLSRNST | 99.59 | | | | | | |
| NS5 | 2702 | 0.04 | 3 | 1 | 0 | Y | RNPLSRNSTH | 99.59 | | | | | | |
| NS5 | 2703 | 0.04 | 3 | 1 | 0 | Y | NPLSRNSTHE | 99.59 | | | | | | |
| NS5 | 2704 | 0.04 | 3 | 1 | 0 | Y | PLSRNSTHEM | 99.59 | | | | | | |
| NS5 | 2705 | 0.05 | 4 | 1 | 0 | Y | LSRNSTHEMY | 99.5 | | | | | | |
| NS5 | 2706 | 0.05 | 4 | 1 | 0 | Y | SRNSTHEMYW | 99.5 | | | | | | |
| NS5 | 2707 | 0.04 | 3 | 1 | 0 | Y | RNSTHEMYWV | 99.59 | | | | | | |
| NS5 | 2708 | 0.04 | 3 | 1 | 0 | Y | NSTHEMYWVS | 99.59 | | | | | | |

FIG. 4-105

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2733 | 0.19 | 5 | 2 | 0 | Y | MLNRFTMAH | 97.6 | MLNRFTMTH | 1.9 | | | | |
| NS5 | 2734 | 0.19 | 5 | 2 | 0 | Y | LNRFTMAHR | 97.6 | LNRFTMTHR | 1.9 | | | | |
| NS5 | 2735 | 0.2 | 6 | 2 | 0 | Y | LNRFTMAHRK | 97.52 | LNRFTMTHRK | 1.9 | | | | |
| NS5 | 2736 | 0.2 | 6 | 2 | 0 | Y | NRFTMAHRKP | 97.52 | NRFTMTHRKP | 1.9 | | | | |
| NS5 | 2737 | 0.2 | 6 | 3 | 0 | Y | RFTMAHRKPT | 97.52 | RFTMTHRKPT | 1.9 | | | | |
| NS5 | 2738 | 0.31 | 7 | 3 | 0 | Y | FTMAHRKPTY | 96.03 | FTMTHRKPTY | 1.9 | FTMAHRKPTF | 1.49 | | |
| NS5 | 2739 | 0.3 | 6 | 3 | 0 | Y | TMAHRKPTYE | 96.11 | TMTHRKPTYE | 1.9 | TMAHRKPTFE | 1.49 | | |
| NS5 | 2740 | 0.44 | 8 | 4 | 0 | Y | MAHRKPTYER | 94.13 | MTHRKPTYER | 1.9 | MAHRKPTYEK | 1.9 | MAHRKPTFER | 1.49 |
| NS5 | 2741 | 0.44 | 8 | 4 | 0 | Y | AHRKPTYERD | 94.13 | THRKPTYERD | 1.9 | AHRKPTYEKD | 1.9 | AHRKPTFERD | 1.49 |
| NS5 | 2742 | 0.28 | 6 | 3 | 0 | Y | HRKPTYERDV | 96.36 | HRKPTYEKDV | 1.9 | HRKPTFERDV | 1.49 | | |
| NS5 | 2743 | 0.28 | 6 | 3 | 0 | Y | RKPTYERDVD | 96.36 | RKPTYEKDVD | 1.9 | RKPTFERDVD | 1.49 | | |
| NS5 | 2744 | 0.28 | 6 | 3 | 0 | Y | KPTYERDVDL | 96.36 | KPTYEKDVDL | 1.9 | KPTFERDVDL | 1.49 | | |
| NS5 | 2745 | 0.27 | 5 | 3 | 0 | Y | PTYERDVDLG | 96.44 | PTYEKDVDLG | 1.9 | PTFERDVDLG | 1.49 | | |
| NS5 | 2746 | 0.57 | 6 | 4 | 0 | Y | TYERDVDLGA | 90.9 | TYEKDVDLGA | 5.54 | TYEKDVDLGA | 1.49 | | |
| NS5 | 2747 | 0.57 | 6 | 4 | 0 | Y | YERDVDLGAG | 90.9 | YEKDVDLGTG | 5.54 | YEKDVDLGAG | 1.49 | | |
| NS5 | 2748 | 0.47 | 6 | 3 | 0 | Y | ERDVDLGAGT | 92.31 | ERDVDLGTGT | 5.54 | EKDVDLGAGT | 1.9 | | |
| NS5 | 2749 | 0.47 | 6 | 3 | 0 | Y | RDVDLGAGTR | 92.31 | RDVDLGTGTR | 5.54 | KDVDLGAGTR | 1.9 | | |
| NS5 | 2750 | 0.35 | 6 | 3 | 0 | Y | DVDLGAGTRH | 94.13 | DVDLGTGTRH | 5.54 | | | | |
| NS5 | 2751 | 0.34 | 5 | 2 | 0 | Y | VDLGAGTRHV | 94.21 | VDLGTGTRHV | 5.54 | | | | |
| NS5 | 2752 | 0.42 | 5 | 2 | 0 | Y | DLGAGTRHVA | 93.3 | DLGTGTRHVA | 5.54 | DLGAGTRHVT | 0.58 | TFERDVDLGA | 1.49 |
| NS5 | 2753 | 0.43 | 8 | 3 | 0 | Y | LGAGTRHVAV | 93.3 | LGTGTRHVAV | 5.54 | LGAGTRHVTV | 0.5 | FERDVDLGAG | 1.49 |
| NS5 | 2754 | 0.44 | 9 | 3 | 0 | Y | GAGTRHVAVE | 93.22 | GTGTRHVAVE | 5.54 | GAGTRHVTVE | 0.5 | | |
| NS5 | 2755 | 0.44 | 10 | 3 | 0 | Y | AGTRHVAVEP | 93.22 | TGTRHVAVEP | 5.54 | AGTRHVTVEP | 0.5 | | |
| NS5 | 2756 | 0.13 | 9 | 2 | 0 | Y | GTRHVAVEPE | 98.76 | GTRHVEPE | 0.5 | | | | |

FIG. 4-106

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2757 | 0.24 | 11 | 4 | 0 | Y | TRHVAVEPEV | 97.44 | TRHVAVEPEI | 0.74 | TRHVAVEPEE | 0.58 | TRHVTVEPEV | 0.5 | |
| NS5 | 2758 | 0.28 | 12 | 5 | 0 | Y | RHVAVEPEVA | 97.02 | RHVAVEPEIA | 0.74 | RHVAVEPEEA | 0.58 | RHVTVEPEVA | 0.5 | RHVAVEPEVP | 0.33 |
| NS5 | 2759 | 0.28 | 12 | 5 | 0 | Y | HVAVEPEVAN | 97.02 | HVAVEPEIAN | 0.74 | HVAVEPEEAN | 0.58 | HVTVEPEVAN | 0.5 | HVAVEPEVPN | 0.33 |
| NS5 | 2762 | 0.26 | 11 | 5 | 0 | Y | VEPEVANLDI | 97.27 | VEPEIANLDI | 0.74 | VEPEEANLDI | 0.58 | VEPEVANIDI | 0.33 | VEPEVPNLDI | 0.33 |
| NS5 | 2763 | 0.25 | 10 | 4 | 0 | Y | EPEVANLDII | 97.35 | EPEIANLDII | 0.74 | EPEEANLDII | 0.58 | EPEVANIDII | 0.33 | |
| NS5 | 2764 | 0.24 | 9 | 4 | 0 | Y | PEVANLDIIG | 97.44 | PEIANLDIIG | 0.74 | PEEANLDIIG | 0.58 | PEVANIDIIG | 0.33 | |
| NS5 | 2765 | 0.24 | 9 | 4 | 0 | Y | EVANLDIIGQ | 97.44 | EIANLDIIGQ | 0.74 | EEANLDIIGQ | 0.58 | EV

FIG. 4-107

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS5 | 2783 | 0.06 | 7 | — | 0 | Y | HKSTWHYDED | 99.5 |
| NS5 | 2784 | 0.06 | 7 | — | 0 | Y | KSTWHYDEDN | 99.5 |
| NS5 | 2785 | 0.05 | 6 | — | 0 | Y | STWHYDEDNP | 99.59 |
| NS5 | 2786 | 0.04 | 5 | — | 0 | Y | TWHYDEDNPY | 99.67 |
| NS5 | 2787 | 0.04 | 5 | — | 0 | Y | WHYDEDNPYK | 99.67 |
| NS5 | 2788 | 0.04 | 5 | — | 0 | Y | HYDEDNPYKT | 99.67 |
| NS5 | 2789 | 0.04 | 4 | — | 0 | Y | YDEDNPYKTW | 99.75 |
| NS5 | 2790 | 0.03 | 3 | — | 0 | Y | DEDNPYKTWA | 99.83 |
| NS5 | 2791 | 0.02 | 2 | — | 0 | Y | EDNPYKTWAY | 99.92 |
| NS5 | 2792 | 0.01 | 2 | — | 0 | Y | DNPYKTWAYH | 99.92 |
| NS5 | 2793 | 0.01 | 2 | — | 0 | Y | NPYKTWAYHG | 99.92 |
| NS5 | 2794 | 0 | 1 | — | 0 | Y | PYKTWAYHGS | 100 |
| NS5 | 2795 | 0 | 1 | — | 0 | Y | YKTWAYHGSY | 100 |
| NS5 | 2796 | 0.01 | 2 | — | 0 | Y | KTWAYHGSYE | 99.92 |
| NS5 | 2797 | 0.04 | 5 | — | 0 | Y | TWAYHGSYEV | 99.67 |
| NS5 | 2798 | 0.06 | 6 | — | 0 | Y | WAYHGSYEVK | 99.42 |
| NS5 | 2799 | 0.08 | 7 | — | 0 | Y | AYHGSYEVKP | 99.26 |
| NS5 | 2800 | 0.09 | 8 | — | 0 | Y | YHGSYEVKPS | 99.17 |
| NS5 | 2801 | 0.09 | 8 | — | 0 | Y | HGSYEVKPSG | 99.17 |
| NS5 | 2802 | 0.09 | 8 | — | 0 | Y | GSYEVKPSGA | 99.17 |
| NS5 | 2803 | 0.09 | 8 | — | 0 | Y | SYEVKPSGAS | 99.17 |
| NS5 | 2804 | 0.09 | 8 | — | 0 | Y | YEVKPSGASS | 99.17 |
| NS5 | 2805 | 0.09 | 8 | — | 0 | Y | EVKPSGASSM | 99.17 |
| NS5 | 2806 | 0.08 | 7 | — | 0 | Y | VKPSGASSM | 99.26 |

FIG. 4-108

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2807 | 0.07 | 6 | 1 | 0 | Y | KPSGASSMV | 99.34 | | |
| NS5 | 2808 | 0.05 | 5 | 1 | 0 | Y | PSGASSMVN | 99.59 | | |
| NS5 | 2809 | 0.03 | 3 | 1 | 0 | Y | SGSASSMVNG | 99.75 | | |
| NS5 | 2810 | 0.01 | 2 | 1 | 0 | Y | GSASSMVNGV | 99.92 | | |
| NS5 | 2811 | 0.01 | 2 | 1 | 0 | Y | SASSMVNGVV | 99.92 | | |
| NS5 | 2812 | 0.82 | 3 | 2 | 0 | Y | ASSMVNGVVK

FIG. 4-110

Species: DENV1 (10-MERS)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2855 | 0.86 | 8 | 3 | 0 | Y | DTRTPRAKRG | 78.33 | DTRTPRAKRG | 20.1 | DTRTPKAKQG | 0.91 | | |
| NS5 | 2856 | 0.86 | 8 | 3 | 0 | Y | TRTPKAKRGT | 78.33 | TRTPKAKRGT | 20.1 | TRTPKAKQGT | 0.91 | | |
| NS5 | 2857 | 1.12 | 10 | 5 | 0 | Y | RTPKAKRGTA | 77.25 | RTPKAKRGTT | 14.31 | RTPKAKRGTA | 5.79 | RTPKAKRGTV | 1.08 | RTPKAKQGTA | 0.91 |
| NS5 | 2858 | 1.12 | 10 | 5 | 0 | Y | TPKAKRGTAQ | 77.25 | TPKAKRGTT | 14.31 | TPKAKRGTAQ | 5.79 | TPKAKRGTVQ | 1.08 | TPKAKQGTAQ | 0.91 |
| NS5 | 2859 | 1.14 | 13 | 5 | 0 | Y | PKAKRGTAQI | 77.17 | PKAKRGTQI | 14.31 | PRAKRGTAQI | 5.62 | PKAKRGTVQI | 1.08 | PKAKQGTAQI | 0.83 |
| NS5 | 2860 | 1.14 | 13 | 5 | 0 | Y | KAKRGTAQIM | 77.17 | RAKRGTTQIM | 14.31 | RAKRGTAQIM | 5.62 | KAKRGTVQIM | 1.08 | KAKQGTAQIM | 0.83 |
| NS5 | 2861 | 0.85 | 11 | 5 | 0 | Y | AKRGTAQIME | 82.71 | AKRGTTQIME | 14.31 | AKRGTAQIME | 1.08 | AKQGTAQIME | 1.08 | PKRGTAQIME | 0.33 |
| NS5 | 2862 | 0.86 | 10 | 5 | 0 | Y | KRGTAQIMEV | 82.63 | KRGTTQIMEV | 14.31 | KRGTAQIMEV | 1.08 | KQGTAQIMEV | 1.08 | KRGTAQIMEM | 0.5 |
| NS5 | 2863 | 0.85 | 9 | 5 | 0 | Y | RGTAQIMEVT | 82.71 | RGTTQIMEVT | 14.31 | RGTAQIMEVT | 1.08 | QGTAQIMEVT | 1.08 | RGTAQIMEMT | 0.5 |
| NS5 | 2864 | 0.79 | 8 | 4 | 0 | Y | GTAQIMEVTA | 83.46 | GTTQIMEVTA | 14.31 | GTVQIMEVTA | 1.08 | GTAQIMEMTA | 0.5 | | |
| NS5 | 2867 | 1.02 | 10 | 3 | 0 | Y | QIMEVTAKWL | 67.66 | QIMEVTARWL | 31.1 | QIMEMTAKWL | 0.41 | | | | |
| NS5 | 2868 | 1.02 | 10 | 3 | 0 | Y | IMEVTAKWLW | 67.66 | IMEVTARWLW | 31.1 | IMEMTAKWLW | 0.41 | | | | |
| NS5 | 2869 | 1.03 | 11 | 3 | 0 | Y | MEVTAKWLWG | 67.49 | MEMTARWLWG | 31.1 | MEMTAKWLWG | 0.41 | | | | |
| NS5 | 2870 | 1.05 | 12 | 4 | 0 | Y | EVTAKWLWGF | 67.49 | EVTARWLWGF | 30.93 | EMTAKWLWGF | 0.41 | EVTARWLWSF | 0.25 | | |
| NS5 | 2871 | 1.05 | 11 | 4 | 0 | Y | VTAKWLWGFL | 67.49 | VTARWLWGFL | 30.93 | MTAKWLWGFL | 0.41 | VTARWLWSFL | 0.33 | | |
| NS5 | 2872 | 1.01 | 10 | 3 | 0 | Y | TAKWLWGFLS | 67.82 | TARWLWGFLS | 31.02 | TARWLWSFLS | 0.33 | | | | |
| NS5 | 2873 | 1.05 | 10 | 3 | 0 | Y | AKWLWGFLSR | 67.82 | ARWLWGFLSR | 31.02 | ARWLWSFLSR | 0.33 | | | | |
| NS5 | 2874 | 1.03 | 12 | 3 | 0 | Y | KWLWGFLSRN | 67.66 | RWLWGFLSRN | 31.02 | RWLWSFLSRN | 0.33 | | | | |
| NS5 | 2875 | 0.13 | 10 | 2 | 0 | Y | WLWGFLSRNK | 98.76 | WLWSFLSRNK | 0.33 | | | | | | |
| NS5 | 2876 | 0.14 | 11 | 2 | 0 | Y | LWGFLSRNKK | 98.68 | LWSFLSRNKK | 0.33 | | | | | | |
| NS5 | 2877 | 0.14 | 11 | 2 | 0 | Y | WGFLSRNKKP | 98.68 | WSFLSRNKKP | 0.33 | | | | | | |
| NS5 | 2878 | 0.14 | 11 | 2 | 0 | Y | GFLSRNKKPR | 98.68 | SFLSRNKKPR | 0.33 | | | | | | |
| NS5 | 2879 | 0.08 | 8 | 1 | 0 | Y | FLSRNKKPRI | 99.34 | | | | | | | | |
| NS5 | 2880 | 0.07 | 8 | 1 | 0 | Y | LSRNKKPRIC | 99.42 | | | | | | | | |

FIG. 4-111

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency |
|---|---|---|---|---|---|---|---|---|---|---|
| NS5 | 2881 | 0.07 | 8 | 1 | 0 | Y | SRNKKPRICT | 99.42 | | |
| NS

FIG. 4-112

Species: DENV1 (10-MERS)

| protein | block starting position | block entropy | total peptides in block | # peptides required to cover 99% of block | gap/X fraction | 99% of

FIG. 4-113

Species: DENV1 (10-MERS)

| protein | block starting position | block entropy | total peptides in block | # peptides required to cover 99% of block | gap/X f

FIG. 4-114

Species: DENV1 (10-MERS)

| protein | block starting position | block entropy | total peptides in block | # peptides required to cover 99% of block | gap/X

FIG. 4-115

Species: DENV1 (10-MERS

FIG. 4-116

Species: DENV1 (10-MERS)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3008 | 0.1 | 5 | 2 | 0 | Y | HKLGYILRDI | 98.92 | HRLGYILRDI | 0.83 | | | | |
| NS5 | 3009 | 0.1 | 5 | 2 | 0 | Y | KLGYILRDIS | 98.92 | RLGYILRDIS | 0.83 | | | | |
| NS5 | 3010 | 0.3 | 5 | 3 | 0 | Y | LGYILRDISK | 95.78 | LGYILRDISN | 2.89 | LGYILRDISR | 1.08 | | |

FIG. 4-117

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 4-118

Species: DENV1 (10

FIG. 4-119

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3080 | 0.26 | 5 | 3 | 0 | Y | KNGTVMDVIS | 96.53 | KSGTVMDVIS | 1.74 | RNGTVMDVIS | 1.57 | | |
| NS5 | 3081 | 0.16 | 5 | 2 | 0 | Y | NGTVMDVISR | 98.01 | SGTVMDVISR | 1.74 | | | | |
| NS5 | 3082 | 0.03 | 3 | 1 | 0 | Y | GTVMDVISRR | 99.75 | | | | | | |
| NS5 | 3083 | 0.04 | 4 | 1 | 0 | Y | TVMDVISRRD | 99.59 | | | | | | |
| NS5 | 3084 | 0.04 | 4 | 1 | 0 | Y | VMDVISRRDQ | 99.59 | | | | | | |
| NS5 | 3085 | 0.04 | 4 | 1 | 0 | Y | MDVISRRDQR | 99.59 | | | | | | |
| NS5 | 3086 | 0.04 | 4 | 1 | 0 | Y | DVISRRDQRG | 99.59 | | | | | | |
| NS5 | 3087 | 0.04 | 4 | 1 | 0 | Y | VISRRDQRGS | 99.75 | | | | | | |
| NS5 | 3088 | 0.03 | 3 | 1 | 0 | Y | ISRRDQRGSG | 99.75 | | | | | | |
| NS5 | 3089 | 0.03 | 3 | 1 | 0 | Y | SRRDQRGSGQ | 99.75 | | | | | | |
| NS5 | 3090 | 0.03 | 3 | 1 | 0 | Y | RRDQRGSGQV | 99.75 | | | | | | |
| NS5 | 3091 | 0.02 | 2 | 1 | 0 | Y | RDQRGSGQVG | 99.83 | | | | | | |
| NS5 | 3092 | 0.02 | 2 | 1 | 0 | Y | DQRGSGQVGT | 99.83 | | | | | | |
| NS5 | 3093 | 0 | 1 | 1 | 0 | Y | QRGSGQVGTY | 100 | | | | | | |
| NS5 | 3094 | 0 | 1 | 1 | 0 | Y | RGSGQVGTYG | 100 | | | | | | |
| NS5 | 3095 | 0 | 1 | 1 | 0 | Y | GSGQVGTYGL | 100 | | | | | | |
| NS5 | 3096 | 0 | 1 | 1 | 0 | Y | SGQVGTYGLN | 100 | | | | | | |
| NS5 | 3097 | 0 | 1 | 1 | 0 | Y | GQVGTYGLNT | 100 | | | | | | |
| NS5 | 3098 | 0 | 1 | 1 | 0 | Y | QVGTYGLNTF | 100 | | | | | | |
| NS5 | 3099 | 0 | 1 | 1 | 0 | Y | VGTYGLNTFT | 100 | | | | | | |
| NS5 | 3100 | 0 | 1 | 1 | 0 | Y | GTYGLNTFTN | 99.75 | | | | | | |
| NS5 | 3101 | 0.03 | 2 | 1 | 0 | Y | TYGLNTFTNM | 99.75 | | | | | | |
| NS5 | 3102 | 0.11 | 3 | 2 | 0 | Y | YGLNTFTNME | 98.76 | YGLNTFTNMG | 0.99 | | | | |
| NS5 | 3103 | 0.84 | 6 | 3 | 0 | Y | GLNTFTNMEA | 78.74 | GLNTFTNMEV | 20.02 | GLNTFTNMGA | 0.58 | | |

FIG. 4-120

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to

FIG. 4-121

Species: DENV1 (10-MERS)

| protein | block starting position | entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3158 | 0.49 | 5 | 3 | 0 | Y | DDCVVKPIDD | 92.22 | DDCVVKPTDD | 4.3 | DDCVVKPVDD | 3.23 | | |
| NS5 | 3159 | 0.49 | 5 | 3 | 0 | Y | DCVVKPIDDR | 92.22 | DCVVKPTDDR | 4.3 | DCVVKPVDDR | 3.23 | | |
| NS5 | 3160 | 0.49 | 5 | 3 | 0 | Y | CVVKPIDDRF | 92.22 | CVVKPTDDRF | 4.3 | CVVKPVDDRF | 3.23 | | |
| NS5 | 3161 | 0.49 | 5 | 3 | 0 | Y | VVKPIDDRFA | 92.22 | VVKPTDDRFA | 4.3 | VVKPVDDRFA | 3.23 | | |
| NS5 | 3162 | 0.57 | 10 | 4 | 0 | Y | VKPIDDRFAT | 91.4 | VKPTDDRFAT | 4.22 | VKPVDDRFAT | 3.23 | VKPIDDRFAA | 0.66 |
| NS5 | 3163 | 0.58 | 11 | 4 | 0 | Y | KPIDDRFATA | 91.32 | KPTDDRFATA | 4.22 | KPVDDRFATA | 3.23 | KPIDDRFAAA | 0.66 |
| NS5 | 3164 | 0.58 | 11 | 4 | 0 | Y | PIDDRFATAL | 91.32 | PTDDRFATAL | 4.22 | PVDDRFATAL | 3.23 | PIDDRFAAAL | 0.66 |
| NS5 | 3166 | 0.47 | 10 | 4 | 0 | Y | DDRFATALIA | 93.22 | DDRFATALIA | 4.14 | DDRFATALSA | 3.23 | DDRFAAALTA | 0.74 |
| NS5 | 3167 | 0.47 | 10 | 4 | 0 | Y | DRFATALTAL | 93.22 | DRFATALIAL | 4.14 | DRFATALSAL | 3.23 | DRFAAALTAL | 0.74 |
| NS5 | 3168 | 0.47 | 9 | 4 | 0 | Y | RFATALTALN | 93.05 | RFATALIALN | 4.22 | RFATALSALN | 1.41 | RFAAALTALN | 0.74 |
| NS5 | 3169 | 0.49 | 11 | 4 | 0 | Y | FATALTALND | 93.05 | FATALIALND | 4.22 | FATALSALND | 1.41 | FAAALTALND | 0.74 |
| NS5 | 3170 | 0.49 | 11 | 4 | 0 | Y | ATALTALNDM | 93.05 | ATALIALNDM | 4.22 | ATALSALNDM | 1.41 | AAALTALNDM | 0.74 |
| NS5 | 3171 | 0.49 | 11 | 3 | 0 | Y | TALTALNDMG | 94.04 | TALIALNDMG | 4.22 | TALSALNDMG | 1.41 | AALTALNDMG | 0.74 |
| NS5 | 3172 | 0.4 | 7 | 3 | 0 | Y | ALTALNDMGK | 93.96 | ALIALNDMGK | 4.22 | ALSALNDMGK | 1.41 | | |
| NS5 | 3173 | 0.4 | 7 | 3 | 0 | Y | LTALNDMGKV | 93.96 | LIALNDMGKV | 4.22 | LSALNDMGKV | 1.41 | | |
| NS5 | 3174 | 0.4 | 7 | 3 | 0 | Y | TALNDMGKVR | 93.96 | IALNDMGKVR | 4.22 | SALNDMGKVR | 1.41 | | |
| NS5 | 3175 | 0.04 | 4 | 1 | 0 | Y | ALNDMGKVRK | 99.67 | | | | | | |
| NS5 | 3176 | 0.04 | 4 | 1 | 0 | Y | LNDMGKVRKD | 99.67 | | | | | | |
| NS5 | 3177 | 0.16 | 6 | 2 | 0 | Y | NDMGKVRKDI | 98.01 | NDMGKVRKDV | 1.57 | | | | |
| NS5 | 3178 | 0.17 | 7 | 2 | 0 | Y | DMGKVRKDIP | 97.93 | DMGKVRKDVP | 1.57 | | | | |
| NS5 | 3179 | 0.15 | 5 | 2 | 0 | Y | MGKVRKDIPQ | 98.1 | MGKVRKDVPQ | 1.57 | | | | |
| NS5 | 3180 | 0.15 | 5 | 2 | 0 | Y | GKVRKDIPQW | 98.1 | GKVRKDVPQW | 1.57 | | | | |
| NS5 | 3181 | 0.15 | 5 | 2 | 0 | Y | KVRKDIPQWE | 98.1 | KVRKDVPQWE | 1.57 | | | | |
| NS5 | 3182 | 0.15 | 5 | 2 | 0 | Y | VRKDIPQWEP | 98.1 | VRKDVPQWEP | 1.57 | | | | |

FIG. 4-122

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3183 | 0.14 | 4 | 2 | 0 | Y | RKDIPQWE

FIG. 4-123

Species: DENV1 (10-MERS)

| protein | block starting position | block entropy | total peptides in block | # peptides required to cover 99% of block | gap/X fraction | 99% of block covered w/ <= 5 peptides? | peptides required

FIG. 4-124

Species: DENV1 (10-MERS)

| protein | block starting position | block entropy | total pe

FIG. 4-125

Species: DENV1 (10-MERS)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3255 | 0.04 | 5 | 1 | 0 | Y | QMWQLMYFHR | 99.67 | | | | | | |
| NS5 | 3256 | 0.04 | 5 | 1 | 0 | Y | MWQLMYFHRR | 99.67 | | | | | | |
| NS5 | 3257 | 0.04 | 5 | 1 | 0 | Y | WQLMYFHRRD | 99.67 | | | | | | |
| NS5 | 3258 | 0.03 | 4 | 1 | 0 | Y | QLMYFHRRDL | 99.75 | | | | | | |
| NS5 | 3259 | 0.02 | 3 | 1 | 0 | Y | LMYFHRRDLR | 99.83 | | | | | | |
| NS5 | 3260 | 0.02 | 3 | 1 | 0 | Y | MYFHRRDLRL | 99.83 | | | | | | |
| NS5 | 3261 | 0.02 | 3 | 1 | 0 | Y | YFHRRDLRLA | 99.83 | | | | | | |
| NS5 | 3262 | 0.04 | 5 | 1 | 0 | Y | FHRRDLRLAA | 99.67 | | | | | | |
| NS5 | 3263 | 0.04 | 5 | 1 | 0 | Y | HRRDLRLAAN | 99.67 | | | | | | |
| NS5 | 3264 | 0.04 | 5 | 1 | 0 | Y | RRDLRLAANA | 99.67 | | | | | | |
| NS5 | 3265 | 0.05 | 5 | 1 | 0 | Y | RDLRLAANAI | 99.59 | | | | | | |
| NS5 | 3266 | 0.07 | 7 | 1 | 0 | Y | DLRLAANAIC | 99.34 | | | | | | |
| NS5 | 3267 | 0.06 | 6 | 1 | 0 | Y | LRLAANAICS | 99.42 | | | | | | |
| NS5 | 3268 | 0.06 | 6 | 1 | 0 | Y | RLAANAICSA | 99.42 | | | | | | |
| NS5 | 3269 | 0.12 | 10 | 2 | 0 | Y | LAANAICSAV | 98.84 | LAANAICSAD | 0.41 | | | | |
| NS5 | 3270 | 0.12 | 10 | 2 | 0 | Y | AANAICSAVP | 98.84 | AANAICSADP | 0.41 | | | | |
| NS5 | 3271 | 0.18 | 15 | 4 | 0 | Y | ANAICSAVPV | 98.35 | ANAICSAVPI | 0.33 | ANAICSADPV | 0.25 | ANAICSADPV | 0.17 |
| NS5 | 3279 | 1.07 | 13 | 5 | 0 | Y | PVDWIPTSRT | 70.31 | PVDWIPTSRT | 27.3 | PVEWVPTSRT | 0.74 | PVNWVPTSRT | 0.33 |
| NS5 | 3280 | 1.07 | 13 | 5 | 0 | Y | VDWIPTSRTT | 70.31 | VDWIPTSRTT | 27.3 | VEWVPTSRTT | 0.74 | VNWVPTSRTT | 0.33 |
| NS5 | 3281 | 1.01 | 10 | 3 | 0 | Y | DWIPTSRTTW | 70.97 | DWIPTSRTTW | 27.3 | EWVPTSRTTW | 0.74 | | |
| NS5 | 3282 | 0.89 | 6 | 2 | 0 | Y | WIPTSRTTWS | 72.13 | WIPTSRTTWS | 27.46 | | | | |
| NS5 | 3283 | 0.89 | 6 | 2 | 0 | Y | VPTSRTTWSI | 72.13 | IPTSRTTWSI | 27.46 | | | | |
| NS5 | 3284 | 0.04 | 4 | 1 | 0 | Y | PTSRTTWSIH | 99.67 | | | | | | |
| NS5 | 3285 | 0.04 | 4 | 1 | 0 | Y | TSRTTWSIHA | 99.67 | | | | | | |

FIG. 4-126

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS5 | 3286 | 0.03 | 4 | 1 | 0 | Y | SRTTWSIHAH | 99.75 |
| NS5 | 3287 | 0.02 | 3 | 1 | 0 | Y | RTTWSIHAHH | 99.83 |
| NS5 | 3288 | 0.02 | 3 | 1 | 0 | Y | TTWSIHAHHQ | 99.83 |
| NS5 | 3289 | 0.02 | 3 | 1 | 0 | Y | TWSIHAHHQW | 99.83 |
| NS5 | 3290 | 0.01 | 2 | 1 | 0 | Y | WSIHAHHQWM | 99.92 |
| NS5 | 3291 | 0.01 | 2 | 1 | 0 | Y | SIHAHHQWMT | 99.92 |
| NS5 | 3292 | 0.01 | 2 | 1 | 0 | Y | IHAHHQWMTT | 99.92 |
| NS5 | 3293 | 0.01 | 2 | 1 | 0 | Y | HAHHQWMTTE | 99.92 |
| NS5 | 3294 | 0.08 | 3 | 1 | 0 | Y | AHHQWMTTED | 99.09 |
| NS5 | 3295 | 0.08 | 3 | 1 | 0 | Y | HHQWMTTEDM | 99.09 |
| NS5 | 3296 | 0.08 | 3 | 1 | 0 | Y | HQWMTTEDML | 99.09 |
| NS5 | 3297 | 0.08 | 3 | 1 | 0 | Y | QWMTTEDMLS | 99.09 |
| NS5 | 3298 | 0.08 | 3 | 1 | 0 | Y | WMTTEDMLSV | 99.09 |
| NS5 | 3299 | 0.08 | 3 | 1 | 0 | Y | MTTEDMLSVW | 99.09 |
| NS5 | 3300 | 0.08 | 3 | 1 | 0 | Y | TTEDMLSVWN | 99.09 |
| NS5 | 3301 | 0.09 | 4 | 1 | 0 | Y | TEDMLSVWNR | 99.01 |
| NS5 | 3302 | 0.09 | 4 | 1 | 0 | Y | EDMLSVWNRV | 99.01 |
| NS5 | 3303 | 0.09 | 4 | 1 | 0 | Y | DMLSVWNRVW | 99.01 |
| NS5 | 3304 | 0.02 | 3 | 1 | 0 | Y | MLSVWNRVWI | 99.83 |
| NS5 | 3305 | 0.03 | 4 | 1 | 0 | Y | LSVWNRVWIE | 99.75 |
| NS5 | 3306 | 0.03 | 4 | 1 | 0 | Y | SVWNRVWIEE | 99.75 |
| NS5 | 3307 | 0.03 | 4 | 1 | 0 | Y | VWNRVWIEEN | 99.75 |
| NS5 | 3308 | 0.03 | 4 | 1 | 0 | Y | WNRVWIEENP | 99.75 |
| NS5 | 3309 | 0.03 | 4 | 1 | 0 | Y | NRVWIEENPW | 99.75 |

FIG. 4-127

Species: DENV1 (10-MERS)

| protein | block starting position | block

FIG. 4-128

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3338 | 0.01 | 2 | 1 | 0 | Y | EDQWCGSLIG | 99.92 | | | | | | |
| NS5 | 3339 | 0.01 | 2 | 1 | 0 | Y | DQWCGSLIGL | 99.92 | | | | | | |
| NS5 | 3340 | 0.01 | 2 | 1 | 0 | Y | QWCGSLIGLT | 99.92 | | | | | | |
| NS5 | 3341 | 0.03 | 4 | 1 | 0 | Y | WCGSLIGLTA | 99.75 | | | | | | |
| NS5 | 3342 | 0.03 | 4 | 1 | 0 | Y | CGSLIGLTAR | 99.75 | | | | | | |
| NS5 | 3343 | 0.03 | 4 | 1 | 0 | Y | GSLIGLTARA | 99.75 | | | | | | |
| NS5 | 3344 | 0.03 | 4 | 1 | 0 | Y | SLIGLTARAT | 99.75 | | | | | | |
| NS5 | 3345 | 0.03 | 4 | 1 | 0 | Y | LIGLTARATW | 99.75 | | | | | | |
| NS5 | 3346 | 0.03 | 4 | 1 | 0 | Y | IGLTARATWA | 99.75 | | | | | | |
| NS5 | 3347 | 0.54 | 5 | 2 | 0 | Y | GLTARATWAT | 88.5 | GLTARATWAS | 11.25 | | | | |
| NS5 | 3348 | 0.55 | 6 | 2 | 0 | Y | LTARATWATN | 88.42 | LTARATWASN | 11.25 | | | | |
| NS5 | 3349 | 0.58 | 7 | 2 | 0 | Y | TARATWATNI | 88.09 | TARATWASNI | 11.25 | | | | |
| NS5 | 3350 | 0.59 | 8 | 2 | 0 | Y | ARATWATNIQ | 88.01 | ARATWASNIQ | 11.25 | | | | |
| NS5 | 3351 | 0.58 | 7 | 2 | 0 | Y | RATWATNIQV | 88.09 | RATWASNIQV | 11.25 | | | | |
| NS5 | 3352 | 0.58 | 7 | 2 | 0 | Y | ATWATNIQVA | 88.09 | ATWASNIQVA | 11.25 | | | | |
| NS5 | 3353 | 0.58 | 7 | 2 | 0 | Y | TWATNIQVAI | 88.09 | TWASNIQVAI | 11.25 | | | | |
| NS5 | 3354 | 0.62 | 10 | 3 | 0 | Y | WATNIQVAIN | 87.68 | WASNIQVAIN | 11.25 | WATNVQVAIN | 0.33 | | |
| NS5 | 3355 | 0.62 | 10 | 3 | 0 | Y | ATNIQVAINQ | 87.68 | ASNIQVAINQ | 11.25 | ATNVQVAINQ | 0.33 | | |
| NS5 | 3356 | 0.61 | 9 | 2 | 0 | Y | TNIQVAINQV | 87.76 | SNIQVAINQV | 11.25 | | | | |
| NS5 | 3357 | 0.11 | 8 | 1 | 0 | Y | NIQVAINQVR | 99.01 | | | | | | |
| NS5 | 3358 | 0.1 | 7 | 1 | 0 | Y | IQVAINQVRR | 99.09 | | | | | | |
| NS5 | 3359 | 0.06 | 6 | 1 | 0 | Y | QVAINQVRRL | 99.42 | | | | | | |
| NS5 | 3360 | 0.28 | 6 | 2 | 0 | Y | VAINQVRRLL | 95.86 | VAINQVRRLL | 3.64 | | | | |
| NS5 | 3361 | 0.28 | 6 | 2 | 0 | Y | AINQVRRLLG | 95.86 | AINQVRRLLG | 3.64 | | | | |

FIG. 4-129

Species: DENV1 (10-MERS)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3362 | 0.28 | 6 | 2 | 0 | Y | INQVRRLIGN | 95.86 | INQVRRLIGN | 3.64 | | | | |
| NS5 | 3363 | 0.29 | 7 | 2 | 0 | Y | NQVRRLIGNE | 95.78 | NQVRRLIGNE | 3.64 | | | | |
| NS5 | 3364 | 0.24 | 4 | 2 | 0 | Y | QVRRLIGNEN | 96.2 | QVRRLIGNEN | 3.64 | | | | |
| NS5 | 3365 | 0.24 | 4 | 2 | 0 | Y | VRRLIGNENY | 96.2 | VRRLIGNENY | 3.64 | | | | |
| NS5 | 3366 | 0.43 | 6 | 3 | 0 | Y | RRLIGNENYL | 93.47 | RRLIGNENYL | 3.64 | RRLIGNENYS | 2.65 | | |
| NS5 | 3367 | 0.44 | 7 | 3 | 0 | Y | RLIGNENYLD | 93.38 | RLIGNENYLD | 3.64 | RLIGNENYSD | 2.65 | | |
| NS5 | 3368 | 0.51 | 10 | 4 | 0 | Y | LIGNENYLDY | 92.56 | LIGNENYLDY | 3.64 | LIGNENYSDY | 2.65 | LIGNENYLDF | 0.66 |
| NS5 | 3369 | 0.51 | 10 | 4 | 0 | Y | IGNENYLDYM | 92.56 | IGNENYLDYM | 3.64 | IGNENYSDYM | 2.65 | IGNENYLDFM | 0.66 |
| NS5 | 3370 | 0.38 | 12 | 4 | 0 | Y | GNENYLDYMT | 95.37 | GNENYSDYMT | 2.48 | GNENYLDFMT | 0.66 | GNENYLDYMI | 0.58 |
| NS5 | 3371 | 0.38 | 12 | 4 | 0 | Y | NENYLDYMTS | 95.37 | NENYSDYMTS | 2.48 | NENYLDFMTS | 0.66 | NENYLDYMIS | 0.58 |
| NS5 | 3372 | 0.38 | 12 | 4 | 0 | Y | ENYLDYMTSM | 95.37 | ENYSDYMTSM | 2.48 | ENYLDFMTSM | 0.66 | ENYLDYMISM | 0.58 |
| NS5 | 3373 | 0.38 | 12 | 4 | 0 | Y | NYLDYMTSMK | 95.37 | NYSDYMTSMK | 2.48 | NYLDFMTSMK | 0.66 | NYLDYMISMK | 0.58 |
| NS5 | 3374 | 0.38 | 12 | 4 | 0 | Y | YLDYMTSMKR | 95.37 | YSDYMTSMKR | 2.48 | YLDFMTSMKR | 0.66 | YLDYMISMKR | 0.58 |
| NS5 | 3375 | 0.38 | 12 | 4 | 0 | Y | LDYMTSMKRF | 95.37 | SDYMTSMKRF | 2.48 | LDFMTSMKRF | 0.66 | LDYMISMKRF | 0.58 |
| NS5 | 3376 | 0.19 | 9 | 3 | 0 | Y | DYMTSMKRFK | 97.93 | DYMISMKRF | 0.74 | DFMTSMKRFK | 0.66 | | |
| NS5 | 3377 | 0.21 | 9 | 3 | 0 | Y | YMTSMKRFKN | 97.77 | YMISMKRFKN | 0.74 | FMTSMKRFKN | 0.66 | | |
| NS5 | 3378 | 0.2 | 8 | 3 | 0 | Y | MTSMKRFKNE | 97.85 | MISMKRFKNE | 0.74 | MTSMKRFKND | 0.66 | | |

FIG. 5-1

Species: DENV1 (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99

FIG. 5-2

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 24 | 0.82 | 10 | 2 | 0 | Y | STVSQLAKRFS | 78.91 | STGSQLAKRFS | 20.26 | | | | |
| anC | 25 | 0.82 | 10 | 2 | 0 | Y | TVSQLAKRFSK | 78.91 | TGSQLAKRFSK | 20.26 | | | | |
| anC | 26 | 0.83 | 11 | 2 | 0 | Y | VSQLAKRFSKG | 78.83 | GSQLAKRFSKG | 20.26 | | | | |
| anC | 27 | 0.09 | 9 | 1 | 0 | Y | SQLAKRFSKGL | 99.26 | | | | | | |
| anC | 28 | 0.07 | 8 | 1 | 0 | Y | QLAKRFSKGLL | 99.42 | | | | | | |
| anC | 29 | 0.08 | 9 | 1 | 0 | Y | LAKRFSKGLLS | 99.34 | | | | | | |
| anC | 30 | 0.08 | 9 | 1 | 0 | Y | AKRFSKGLLSG | 99.34 | | | | | | |
| anC | 31 | 0.07 | 8 | 1 | 0 | Y | KRFSKGLLSGQ | 99.42 | | | | | | |
| anC | 32 | 0.06 | 7 | 1 | 0 | Y | RFSKGLLSGQG | 99.5 | | | | | | |
| anC | 33 | 0.05 | 6 | 1 | 0 | Y | FSKGLLSGQGP | 99.59 | | | | | | |
| anC | 34 | 0.09 | 8 | 1 | 0 | Y | SKGLLSGQGPM | 99.17 | | | | | | |
| anC | 35 | 0.1 | 9 | 1 | 0 | Y | KGLLSGQGPMK | 99.09 | | | | | | |
| anC | 36 | 0.28 | 10 | 3 | 0 | Y | GLLSGQGPMKL | 96.69 | GLLSGQGPMKM | 1.82 | GLLSGQGPMKF | 0.66 | | |
| anC | 37 | 0.27 | 9 | 3 | 0 | Y | LLSGQGPMKLV | 96.77 | LLSGQGPMKMV | 1.82 | LLSGQGPMKFV | 0.66 | | |
| anC | 38 | 0.26 | 8 | 3 | 0 | Y | LSGQGPMKLVM | 96.86 | LSGQGPMKMVM | 1.82 | LSGQGPMKFVM | 0.66 | | |
| anC | 39 | 0.26 | 8 | 3 | 0 | Y | SGQGPMKLVMA | 96.86 | SGQGPMKMVMA | 1.82 | SGQGPMKFVMA | 0.66 | | |
| anC | 40 | 0.25 | 7 | 3 | 0 | Y | GQGPMKLVMAF | 96.94 | GQGPMKMVMAF | 1.82 | GQGPMKFVMAF | 0.66 | | |
| anC | 41 | 0.28 | 9 | 3 | 0 | Y | QGPMKLVMAFI | 96.69 | QGPMKMVMAFI | 1.82 | QGPMKFVMAFI | 0.66 | | |
| anC | 42 | 0.28 | 9 | 3 | 0 | Y | GPMKLVMAFIA | 96.69 | GPMKMVMAFIA | 1.82 | GPMKFVMAFIA | 0.66 | | |
| anC | 43 | 0.29 | 10 | 3 | 0 | Y | PMKLVMAFIAF | 96.53 | PMKNVMAFIAF | 1.82 | PMKFVMAFIAF | 0.66 | | |
| anC | 44 | 0.29 | 10 | 3 | 0 | Y | MKLVMAFIAFL | 96.53 | MKNVMAFIAFL | 1.82 | MKFVMAFIAFL | 0.66 | | |
| anC | 45 | 0.26 | 9 | 3 | 0 | Y | KLVMAFIAFLR | 96.86 | KMVMAFIAFLR | 1.82 | KFVMAFIAFLR | 0.66 | | |
| anC | 46 | 0.26 | 8 | 3 | 0 | Y | LVMAFIAFLRF | 96.86 | MVMAFIAFLRF | 1.9 | FVMAFIAFLRF | 0.66 | | |

FIG. 5-4

Species: DENV1 (11-mers)

| prot

FIG. 5-6

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 142 | 0.49 | 12 | 5 | 0 | Y | SAGVNMCTLIA | 93.63 | SVGVNMCTLIA | 2.48 | SAGINMCTLIA | 2.07 | STGVNMCTLIA | 0.58 | SAGVNMCTLVA | 0.33 |
| prM | 143 | 0.46 | 10 | 4 | 0 | Y | AGVNMCTLIAM | 93.96 | VGVNMCTLIAM | 2.48 | AGINMCTLIAM | 2.07 | TGVNMCTLIAM | 0.58 | | |
| prM | 144 | 0.22 | 6 | 2 | 0 | Y | GVNMCTLIAMD | 97.11 | GINMCTLIAMD | 2.32 | | | | | | |
| prM | 145 | 0.22 | 6 | 2 | 0 | Y | VNMCTLIAMDL | 97.11 | INMCTLIAMDL | 2.32 | | | | | | |
| prM | 146 | 0.06 | 5 | 1 | 0 | Y | NMCTLIAMDLG | 99.42 | | | | | | | | |
| prM | 147 | 0.06 | 5 | 1 | 0 | Y | MCTLIAMDLGE | 99.42 | | | | | | | | |
| prM | 148 | 0.72 | 7 | 2 | 0 | Y | CTLIAMDLGEL | 82.3 | CTLIAMDLGEF | 17.12 | | | | | | |
| prM | 149 | 0.72 | 7 | 2 | 0 | Y | TLIAMDLGELC | 82.3 | TLIAMDLGEFC | 17.12 | | | | | | |
| prM | 150 | 0.81 | 7 | 3 | 0 | Y | LIAMDLGELCE | 81.06 | LIAMDLGEFCE | 17.12 | LIAMDLGELCD | 1.32 | | | | |
| prM | 151 | 0.8 | 7 | 3 | 0 | Y | IAMDLGELCED | 81.14 | IAMDLGEFCED | 17.12 | IAMDLGELCDD | 1.32 | | | | |
| prM | 152 | 0.77 | 6 | 3 | 0 | Y | AMDLGELCEDT | 81.22 | AMDLGEFCEDT | 17.37 | AMDLGELCDDT | 1.32 | | | | |
| prM | 153 | 0.86 | 4 | 3 | 0 | Y | MDLGELCEDTM | 80.23 | MDLGEFCEDTM | 17.37 | MDLGELCDDTM | 1.32 | MDLGELCEDTI | 0.58 | | |
| prM | 154 | 0.86 | 7 | 4 | 0 | Y | DLGELCEDTMT | 80.23 | DLGEFCEDTMT | 17.37 | DLGELCDDTMT | 1.32 | DLGELCEDTIT | 0.58 | | |
| prM | 155 | 0.86 | 7 | 4 | 0 | Y | LGELCEDTMTY | 80.23 | LGEFCEDTMTY | 17.37 | LGELCDDTMTY | 1.32 | LGELCEDTITY | 0.58 | | |
| prM | 156 | 0.86 | 7 | 4 | 0 | Y | GELCEDTMTYK | 80.23 | GEFCEDTMTYK | 17.37 | GELCDDTMTYK | 1.32 | GELCEDTITYK | 0.58 | | |
| prM | 157 | 0.86 | 7 | 4 | 0 | Y | ELCEDTMTYKC | 80.23 | EFCEDTMTYKC | 17.37 | ELCDDTMTYKC | 1.32 | ELCEDTITYKC | 0.58 | | |
| prM | 158 | 0.86 | 7 | 4 | 0 | Y | LCEDTMTYKCP | 80.23 | FCEDTMTYKCP | 17.37 | LCDDTMTYKCP | 1.32 | LCEDTITYKCP | 0.58 | | |
| prM | 159 | 0.63 | 8 | 4 | 0 | Y | CEDTMTYKCPR | 89 | CEDTMTYKCPQ | 8.92 | CDDTMTYKCPR | 1.32 | CEDTITYKCPR | 0.5 | | |
| prM | 160 | 0.64 | 9 | 4 | 0 | Y | EDTMTYKCPRI | 88.92 | EDTMTYKCPQI | 8.92 | DDTMTYKCPRI | 1.32 | EDTITYKCPRI | 0.5 | | |
| prM | 161 | 0.61 | 9 | 4 | 0 | Y | DTMTYKCPRIT | 89.41 | DTMTYKCPQIT | 8.6 | DTMTYKCPRIS | 0.83 | DTITYKCPRIT | 0.5 | | |
| prM | 162 | 0.61 | 10 | 4 | 0 | Y | TMTYKCPRITE | 89.33 | TMTYKCPQITE | 8.6 | TMTYKCPRISE | 0.83 | TITYKCPRITE | 0.5 | | |
| prM | 164 | 1.5 | 10 | 5 | 0 | Y | TYKCPRITEAE | 59.97 | TYKCPRITETE | 27.38 | TYKCPQITEAE | 8.6 | TYKCPRITEVE | 2.89 | TYKCPRISEAE | 0.74 |
| prM | 165 | 1.5 | 10 | 5 | 0 | Y | YKCPRITEAEP | 59.97 | YKCPRITETEP | 27.38 | YKCPQITEAEP | 8.6 | YKCPRITEVEP | 2.89 | YKCPRISEAEP | 0.74 |

FIG. 5-7

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 166 | 1.51 | 11 | 5 | 0 | Y | KCPRITEAEPD | 59.88 | KCPRITETEPD | 27.38 | KCPQITEAEPD | 8.6 | KCPRITEVEPD | 2.89 | KCPRISEAEPD | 0.74 |
| prM | 167 | 1.51 | 11 | 5 | 0 | Y | CPRITEAEPDD | 59.88 | CPRITETEPDD | 27.38 | CPQITEAEPDD | 8.6 | CPRITEVEPDD | 2.89 | CPRISEAEPDD | 0.74 |
| prM | 168 | 1.51 | 11 | 5 | 0 | Y | PRITEAEPDDV | 59.88 | PRITETEPDDV | 27.38 | PQITEAEPDDV | 8.6 | PRITEVEPDDV | 2.89 | PRISEAEPDDV | 0.74 |
| prM | 169 | 1.51 | 11 | 5 | 0 | Y | RITEAEPDDVD | 59.88 | RITETEPDDVD | 27.38 | QITEAEPDDVD | 8.6 | RITEVEPDDVD | 2.89 | RISEAEPDDVD | 0.74 |
| prM | 170 | 1.14 | 10 | 4 | 0 | Y | ITEAEPDDVDC | 68.49 | ITETEPDDVDC | 27.38 | ITEVEPDDVDC | 2.89 | ISEAEPDDVDC | 0.74 | | |
| prM | 171 | 1.13 | 9 | 4 | 0 | Y | TEAEPDDVDCW | 68.57 | TETEPDDVDCW | 27.38 | TEVEPDDVDCW | 2.89 | SEAEPDDVDCW | 0.74 | | |
| prM | 172 | 1.06 | 7 | 3 | 0 | Y | EAEPDDVDCWC | 69.31 | ETEPDDVDCWC | 27.38 | EVEPDDVDCWC | 2.89 | | | | |
| prM | 173 | 1.05 | 6 | 3 | 0 | Y | AEPDDVDCWCN | 69.4 | TEPDDVDCWCN | 27.38 | VEPDDVDCWCN | 2.89 | | | | |
| prM | 174 | 0.2 | 5 | 2 | 0 | Y | EPDDVDCWCNA | 97.19 | EPDDVDCWCNT | 2.56 | | | | | | |
| prM | 175 | 0.2 | 5 | 2 | 0 | Y | PDDVDCWCNAT | 97.19 | PDDVDCWCNTT | 2.56 | | | | | | |
| prM | 176 | 0.4 | 6 | 3 | 0 | Y | DDVDCWCNATD | 94.04 | DDVDCWCNATE | 3.14 | DDVDCWCNTTD | 2.56 | | | | |
| prM | 177 | 0.43 | 7 | 3 | 0 | Y | DVDCWCNATDT | 93.8 | DVDCWCNATET | 3.14 | DVDCWCNTTDT | 2.56 | | | | |
| prM | 178 | 0.43 | 7 | 3 | 0 | Y | VDCWCNATDTW | 93.8 | VDCWCNATETW | 3.14 | VDCWCNTTDTW | 2.56 | | | | |
| prM | 179 | 0.43 | 7 | 3 | 0 | Y | DCWCNATDTWW | 93.8 | DCWCNATETWW | 3.14 | DCWCNTTDTWW | 2.56 | | | | |
| prM | 180 | 0.43 | 7 | 3 | 0 | Y | CWCNATDTWWT | 93.8 | CWCNATETWWT | 3.14 | CWCNTTDTWWT | 2.56 | | | | |
| prM | 181 | 0.43 | 7 | 3 | 0 | Y | WCNATDTWWTY | 93.8 | WCNATETWWTY | 3.14 | WCNTTDTWWTY | 2.56 | | | | |
| prM | 182 | 0.43 | 7 | 3 | 0 | Y | CNATDTWWTYG | 93.8 | CNATETWWTYG | 3.14 | CNTTDTWWTYG | 2.56 | | | | |
| prM | 183 | 0.43 | 7 | 3 | 0 | Y | NATDTWWTYGT | 93.8 | NATETWWTYGT | 3.14 | NTTDTWWTYGT | 2.56 | | | | |
| prM | 184 | 0.43 | 7 | 3 | 0 | Y | ATDTWWTYGTC | 93.8 | ATETWWTYGTC | 3.14 | TTDTWWTYGTC | 2.56 | | | | |
| prM | 185 | 0.29 | 7 | 2 | 0 | Y | TDTWWTYGTCS | 96.03 | TETWWTYGTCS | 3.14 | | | | | | |
| prM | 186 | 0.31 | 8 | 3 | 0 | Y | DTWWTYGTCSQ | 95.78 | ETWWTYGTCSQ | 3.14 | DTWWTYGTCTQ | 0.33 | | | | |
| prM | 187 | 0.13 | 8 | 2 | 0 | Y | TWWTYGTCSQT | 98.76 | TWWTYGTCTQI | 0.33 | | | | | | |
| prM | 188 | 0.09 | 6 | 1 | 0 | Y | WWTYGTCSQTG | 99.09 | | | | | | | | |

FIG. 5-8

Species: DENV1 (11-mers)

| protein | block starting position | block entropy | total peptides in block | # peptides required to cover 99% of block | gap/X fra

FIG. 5-9

Species: DENV1 (

FIG. 5-10

Species: DENV1 (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---

FIG. 5-11

Species: DENV1 (11-mers)

|

FIG. 5-12

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 286 | 0.89 | 8 | 2 | 0 | Y | IGSRDFVEGLS | 73.53 | IGNRDFVEGLS | 25.81 |
| E | 287 | 0.86 | 6 | 2 | 0 | Y | GSRDFVEGLSG | 73.7 | GNRDFVEGLSG | 25.97 |
| E | 288 | 0.85 | 5 | 2 | 0 | Y | SRDFVEGLSGA | 73.78 | NRDFVEGLSGA | 25.97 |
| E | 289 | 0.03 | 4 | 1 | 0 | Y | RDFVEGLSGAT | 99.75 | | |
| E | 290 | 0.03 | 4 | 1 | 0 | Y | DFVEGLSGATW | 99.75 | | |
| E | 291 | 0.04 | 4 | 1 | 0 | Y | FVEGLSGATWV | 99.67 | | |
| E | 292 | 0.04 | 4 | 1 | 0 | Y | VEGLSGATWVD | 99.67 | | |
| E | 293 | 0.04 | 4 | 1 | 0 | Y | EGLSGATWVDV | 99.67 | | |
| E | 294 | 0.04 | 4 | 1 | 0 | Y | GLSGATWVDVV | 99.67 | | |
| E | 295 | 0.04 | 3 | 1 | 0 | Y | LSGATWVDVVL | 99.75 | | |
| E | 296 | 0.03 | 3 | 1 | 0 | Y | SGATWVDVVLE | 99.75 | | |
| E | 297 | 0.03 | 3 | 1 | 0 | Y | GATWVDVVLEH | 99.75 | | |
| E | 298 | 0.03 | 3 | 1 | 0 | Y | ATWVDVVLEHG | 99.75 | | |
| E | 299 | 0.03 | 3 | 1 | 0 | Y | TWVDVVLEHGS | 99.75 | | |
| E | 300 | 0.03 | 4 | 1 | 0 | Y | WVDVVLEHGSC | 99.75 | | |
| E | 301 | 0.04 | 3 | 1 | 0 | Y | VDVVLEHGSCV | 99.59 | | |
| E | 302 | 0.04 | 5 | 1 | 0 | Y | DVVLEHGSCVT | 99.59 | | |
| E | 303 | 0.06 | 5 | 1 | 0 | Y | VVLEHGSCVTT | 99.42 | | |
| E | 304 | 0.07 | 5 | 1 | 0 | Y | VLEHGSCVTTM | 99.34 | | |
| E | 305 | 0.07 | 5 | 1 | 0 | Y | LEHGSCVTTMA | 99.34 | | |
| E | 306 | 0.08 | 6 | 1 | 0 | Y | EHGSCVTTMAK | 99.26 | | |
| E | 307 | 0.79 | 8 | 2 | 0 | Y | HGSCVTTMAKD | 79.9 | HGSCVTTMAKN | 19.27 |
| E | 308 | 0.79 | 8 | 2 | 0 | Y | GSCVTTMAKDK | 79.9 | GSCVTTMAKNK | 19.27 |

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | fr

FIG. 5-15

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 355 | 0.54 | 5 | 2 | 0 | Y | PTQGEATLV

FIG. 5-16

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 378 | 0 | 1 | 1 | 0 | Y | DRGWGNGCGLF | 100 | | |

FIG. 5-17

Species: DENV1 (11-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 401 | 0.54 | 10 | 4 | 0 | Y | CVTKLEGKIVQ | 91.15 | CVTKLEGKTVQ | 7.03 | CVTKLEGKIAQ | 0.74 | CVTKLEGKVVQ | 0.25 | | |
| E | 403 | 0.59 | 11 | 5 | 0 | Y | TKLEGKIVQYE | 90.9 | TKLEGKTVQYE | 6.62 | TKLEGKIAQYE | 0.74 | TKLEGKTVQHE | 0.41 | TKLEGKIVQHE | 0.41 |
| E | 404 | 0.59 | 11 | 5 | 0 | Y | KLEGKIVQYEN | 90.9 | KLEGKTVQYEN | 6.62 | KLEGKIAQYEN | 0.74 | KLEGKTVQHEN | 0.41 | KLEGKIVQHEN | 0.41 |
| E | 405 | 0.56 | 11 | 5 | 0 | Y | LEGKIVQYENL | 91.15 | LEGKTVQYENL | 6.62 | LEGKIAQYENL | 0.74 | LEGKTVQHENL | 0.41 | LEGKIVQHENL | 0.41 |
| E | 406 | 0.55 | 10 | 4 | 0 | Y | EGKIVQYENLK | 91.23 | EGKTVQYENLK | 6.62 | EGKIAQYENLK | 0.74 | EGKTVQHENLK | 0.41 | | |
| E | 407 | 0.54 | 9 | 4 | 0 | Y | GKIVQYENLKY | 91.32 | GKTVQYENLKY | 6.62 | GKIAQYENLKY | 0.74 | GKTVQHENLKY | 0.41 | | |
| E | 408 | 0.56 | 10 | 5 | 0 | Y | KIVQYENLKYS | 91.15 | KTVQYENLKYS | 6.62 | KIAQYENLKYS | 0.74 | KTVQHENLKYS | 0.41 | KIVQHENLKYS | 0.41 |
| E | 409 | 0.56 | 10 | 5 | 0 | Y | IVQYENLKYSV | 91.15 | TVQYENLKYSV | 6.62 | IAQYENLKYSV | 0.74 | TVQHENLKYSV | 0.41 | IVQHENLKYSV | 0.41 |
| E | 410 | 0.21 | 9 | 3 | 0 | Y | VQYENLKYSVI | 97.77 | VQHENLKYSVI | 0.83 | AQYENLKYSVI | 0.74 | | | | |
| E | 411 | 0.13 | 7 | 2 | 0 | Y | QYENLKYSVIW | 98.59 | QHENLKYSVIW | 0.83 | | | | | | |
| E | 412 | 0.13 | 7 | 2 | 0 | Y | YENLKYSVIVT | 98.59 | HENLKYSVIVT | 0.83 | | | | | | |
| E | 413 | 0.07 | 7 | 1 | 0 | Y | ENLKYSVIVTV | 99.34 | | | | | | | | |
| E | 414 | 0.07 | 7 | 1 | 0 | Y | NLKYSVIVTVH | 99.34 | | | | | | | | |
| E | 415 | 0.09 | 9 | 1 | 0 | Y | LKYSVIVTVHT | 99.17 | | | | | | | | |
| E | 416 | 0.08 | 8 | 1 | 0 | Y | KYSVIVTVHTG | 99.26 | | | | | | | | |
| E | 417 | 0.08 | 8 | 1 | 0 | Y | YSVIVTVHTGD | 99.26 | | | | | | | | |
| E | 418 | 0.08 | 8 | 1 | 0 | Y | SVIVTVHTGDQ | 99.26 | | | | | | | | |
| E | 419 | 0.08 | 8 | 1 | 0 | Y | VIVTVHTGDQH | 99.26 | | | | | | | | |
| E | 420 | 0.08 | 8 | 1 | 0 | Y | IVTVHTGDQHQ | 99.26 | | | | | | | | |
| E | 421 | 0.06 | 6 | 1 | 0 | Y | VTVHTGDQHQV | 99.5 | | | | | | | | |
| E | 422 | 0.06 | 6 | 1 | 0 | Y | TVHTGDQHQVG | 99.5 | | | | | | | | |
| E | 423 | 0.06 | 6 | 1 | 0 | Y | VHTGDQHQVGN | 99.5 | | | | | | | | |
| E | 424 | 0.05 | 5 | 1 | 0 | Y | HTGDQHQVGNE | 99.59 | | | | | | | | |

FIG. 5-18

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 425 | 0.85 | 7 | 2 | 0 | Y | TGDQHQVGNES | 74.94 | TGDQHQVGNET

FIG. 5-19

Species: DENV1 (11-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 448 | 1.58 | 12 | 3 | 0 | Y | APTIEIQLTDY | 41.52 | APTSEIQLTDY | 39.29 | APTSTEIQLTDY | 18.44 | TSEIQLTDYGT | 1.41 | TTEIQLTDYGV | 0.58 |
| E | 449 | 1.58 | 12 | 3 | 0 | Y | PTIEIQLTDYG | 41.52 | PTSEIQLTDYG | 39.29 | PSTEIQLTDYG | 18.44 | TEIQLTDYGVL | 0.58 | | |
| E | 450 | 1.71 | 14 | 5 | 0 | Y | TIEIQLTDYGA | 40.94 | TSEIQLTDYGA | 37.88 | STEIQLTDYGA | 18.44 | | | | |
| E | 451 | 1.17 | 12 | 4 | 0 | Y | TEIQLTDYGAL | 59.47 | SEIQLTDYGAL | 37.88 | SEIQLTDYGTL | 1.41 | | | | |
| E | 452 | 0.24 | 11 | 3 | 0 | Y | EIQLTDYGALT | 97.27 | EIQLTDYGALT | 1.41 | EIQLTDYGVL

FIG. 5-20

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 471 | 0.09 | 9 | 1 | 0 | Y | LDFNEMVLLTM | 99.26 | | | | | | |
| E | 472 | 0.13 | 11 | 2 | 0 | Y | DFNEMVLLTMK | 98.84 | DFNEMVLLTME | 0.33 | | | | |
| E | 473 | 0.23 | 12 | 4 | 0 | Y | FNEMVLLTMKE | 97.6 | FNEMVLLTMKK | 0.99 | FNEMVLLTMEK | 0.33 | FNEMVLLTMKG | 0.33 | |
| E | 474 | 0.25 | 13 | 4 | 0 | Y | NEMVLLTMKEK | 97.44 | NEMVLLTMKKK | 0.99 | NEMVLLTMKGK | 0.33 | NEMVLLTMEKK | 0.33 | |
| E | 475 | 0.29 | 13 | 5 | 0 | Y | EMVLLTMKEKS | 96.86 | EMVLLTMKKKS | 0.99 | EMVLLTMKEKA | 0.99 | EMVLLTMKGKS | 0.33 | EMVLLTMEKKS |
| E | 476 | 0.28 | 12 | 5 | 0 | Y | MVLLTMKEKSW | 96.94 | MVLLTMKKKSW | 0.99 | MVLLTMKEKAW | 0.66 | MVLLTMKGKSW | 0.33 | MVLLTMEKKSW |
| E | 477 | 0.27 | 11 | 4 | 0 | Y | VLLTMKEKSWL | 97.11 | VLLTMKKKSWL | 0.99 | VLLTMKEKAWL | 0.66 | VLLTMKEKKSW | 0.33 | |
| E | 478 | 0.27 | 12 | 4 | 0 | Y | LLTMKEKSWLV | 97.11 | LLTMKKKSWLV | 0.99 | LLTMKEKAWLV | 0.66 | LLTMEKKSWLV | 0.33 | |
| E | 479 | 0.27 | 12 | 4 | 0 | Y | LTMKEKSWLVH | 97.11 | LTMKKKSWLVH | 0.99 | LTMKEKAWLVH | 0.66 | LTMEKKSWLVH | 0.33 | |
| E | 480 | 0.26 | 11 | 4 | 0 | Y | TMKEKSWLVHK | 97.19 | TMKKKSWLVHK | 0.99 | TMKEKAWLVHK | 0.66 | TMEKKSWLVHK | 0.33 | |
| E | 481 | 0.25 | 10 | 4 | 0 | Y | MKEKSWLVHKQ | 97.27 | MKKKSWLVHKQ | 0.99 | MKEKAWLVHKQ | 0.66 | MEKKSWLVHKQ | 0.33 | |
| E | 482 | 0.25 | 10 | 4 | 0 | Y | KEKSWLVHKQW | 97.27 | KKKSWLVHKQW | 0.99 | KEKAWLVHKQW | 0.66 | EKKSWLVHKQW | 0.33 | |
| E | 483 | 0.23 | 8 | 3 | 0 | Y | EKSWLVHKQWF | 97.35 | KKSWLVHKQWF | 1.32 | EKAWLVHKQWF | 0.66 | | | |
| E | 484 | 0.1 | 5 | 2 | 0 | Y | KSWLVHKQWFL | 98.92 | KAWLVHKQWFL | 0.66 | | | | | |
| E | 485 | 0.08 | 4 | 1 | 0 | Y | SWLVHKQWFLD | 99.09 | | | | | | | |
| E | 486 | 0.03 | 3 | 1 | 0 | Y | WLVHKQWFLDL | 99.75 | | | | | | | |
| E | 487 | 0.03 | 3 | 1 | 0 | Y | LVHKQWFLDLP | 99.75 | | | | | | | |
| E | 488 | 0.03 | 3 | 1 | 0 | Y | VHKQWFLDLPL | 99.75 | | | | | | | |
| E | 489 | 0.02 | 3 | 1 | 0 | Y | HKQWFLDLPLP | 99.83 | | | | | | | |
| E | 490 | 0.02 | 3 | 1 | 0 | Y | KQWFLDLPLPW | 99.83 | | | | | | | |
| E | 491 | 0.02 | 3 | 1 | 0 | Y | QWFLDLPLPWT | 99.83 | | | | | | | |
| E | 492 | 0.02 | 3 | 1 | 0 | Y | WFLDLPLPWTS | 99.83 | | | | | | | |
| E | 493 | 0.02 | 3 | 1 | 0 | Y | FLDLPLPWTSG | 99.83 | | | | | | | |

FIG. 5-21

Species: DENV1 (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 494 | 0.06 | 6 | 1 | 0 | Y | LDLPLPWTSGA | 99.5 | | | | | | |
| E | 495 | 0.26 | 8 | 3 | 0 | Y | DLPLPWTSGAS | 96.86 | DLPLPWTSGAT | 1.65 | DLPLPWTSGAL | 0.99 | | |
| E | 496 | 0.28 | 11 | 3 | 0 | Y | LPLPWTSGAST | 96.69 | LPLPWTSGATT | 1.65 | LPLPWTSGALT | 0.83 | | |
| E | 506 | 0.68 | 16 | 5 | 0 | Y | TSQETWNRQDL | 87.26 | TSQETWNRKDL | 11.17 | TLQETWNRQDL | 0.25 | TTQETWNRQDL | 0.25 |
| E | 507 | 0.66 | 15 | 4 | 0 | Y | SQETWNRQDLL | 87.26 | SQETWNRKDLL | 11.33 | LQETWNRQDLL | 0.25 | TQETWNRQDLL | 0.25 |
| E | 508 | 0.61 | 13 | 2 | 0 | Y | QETWNRQDLLV | 87.84 | QETWNRKDLLV | 11.25 | | | | |
| E | 509 | 0.59 | 11 | 2 | 0 | Y | ETWNRQDLLVT | 88.01 | ETWNRKDLLVT | 11.25 | | | | |
| E | 510 | 0.58 | 10 | 2 | 0 | Y | TWNRQDLLVTF | 88.09 | TWNRKDLLVTF | 11.25 | | | | |
| E | 511 | 0.57 | 9 | 2 | 0 | Y | WNRQDLLVTFK | 88.17 | WNRKDLLVTFK | 11.25 | | | | |
| E | 512 | 0.57 | 9 | 2 | 0 | Y | NRQDLLVTFKT | 88.17 | NRKDLLVTFKT | 11.25 | | | | |
| E | 513 | 0.57 | 9 | 2 | 0 | Y | RQDLLVTFKTA | 88.17 | RKDLLVTFKTA | 11.25 | | | | |
| E | 514 | 0.56 | 8 | 2 | 0 | Y | QDLLVTFKTAH | 88.25 | KDLLVTFKTAH | 11.25 | | | | |
| E | 515 | 0.05 | 6 | 1 | 0 | Y | DLLVTFKTAHA | 99.59 | | | | | | |
| E | 516 | 0.05 | 6 | 1 | 0 | Y | LLVTFKTAHAK | 99.59 | | | | | | |
| E | 517 | 0.05 | 5 | 1 | 0 | Y | LVTFKTAHAKK | 99.59 | | | | | | |
| E | 518 | 0.04 | 5 | 1 | 0 | Y | VTFKTAHAKKQ | 99.67 | | | | | | |
| E | 519 | 0.04 | 6 | 1 | 0 | Y | TFKTAHAKKQE | 99.67 | | | | | | |
| E | 520 | 0.06 | 8 | 1 | 0 | Y | FKTAHAKKQEV | 99.42 | | | | | | |
| E | 521 | 0.08 | 7 | 1 | 0 | Y | KTAHAKKQEVV | 99.26 | | | | | | |
| E | 522 | 0.07 | 7 | 1 | 0 | Y | TAHAKKQEVV | 99.34 | | | | | | |
| E | 523 | 0.07 | 7 | 1 | 0 | Y | AHAKKQEVVVL | 99.34 | | | | | | |
| E | 524 | 0.07 | 7 | 1 | 0 | Y | HAKKQEVVVLG | 99.34 | | | | | | |
| E | 525 | 0.08 | 8 | 1 | 0 | Y | AKKQEVVVLGS | 99.26 | | | | | | |

FIG. 5-22

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 526 | 0.07 | 7 | 1 | 0 | Y | KKQEVVWLGSQ | 99.34 | | |
| E | 527 | 0.07 | 7 | 1 | 0 | Y | KQEVVWLGSQE | 99.34 | | |
| E | 528 | 0.06 | 6 | 1 | 0 | Y | QEVVWLGSQEG | 99.42 | | |
| E | 529 | 0.06 | 6 | 1 | 0 | Y | EVVWLGSQEGA | 99.42 | | |
| E | 530 | 0.05 | 5 | 1 | 0 | Y | VVWLGSQEGAM | 99.5 | | |
| E | 531 | 0.04 | 5 | 1 | 0 | Y | VWLGSQEGAMH | 99.67 | | |
| E | 532 | 0.03 | 4 | 1 | 0 | Y | WLGSQEGAMHT | 99.75 | | |
| E | 533 | 0.04 | 5 | 1 | 0 | Y | LGSQEGAMHTA | 99.67 | | |
| E | 534 | 0.05 | 6 | 1 | 0 | Y | GSQEGAMHTAL | 99.59 | | |
| E | 535 | 0.06 | 7 | 1 | 0 | Y | SQEGAMHTALT | 99.5 | | |
| E | 536 | 0.05 | 6 | 1 | 0 | Y | QEGAMHTALTG | 99.59 | | |
| E | 537 | 0.05 | 6 | 1 | 0 | Y | EGAMHTALTGA | 99.59 | | |
| E | 538 | 0.05 | 6 | 1 | 0 | Y | GAMHTALTGAT | 99.59 | | |
| E | 539 | 0.05 | 6 | 1 | 0 | Y | AMHTALTGATE | 99.59 | | |
| E | 540 | 0.05 | 6 | 1 | 0 | Y | MHTALTGATEI | 99.59 | | |
| E | 541 | 0.05 | 6 | 1 | 0 | Y | HTALTGATEIQ | 99.59 | | |
| E | 542 | 0.09 | 7 | 1 | 0 | Y | TALTGATEIQT | 99.17 | | |
| E | 543 | 0.12 | 7 | 2 | 0 | Y | ALTGATEIQTS | 98.84 | ALTGATEIQTT | 0.41 |
| E | 544 | 0.11 | 7 | 2 | 0 | Y | LTGATEIQTSG | 98.92 | LTGATEIQTTG | 0.41 |
| E | 545 | 0.12 | 7 | 2 | 0 | Y | TGATEIQTSGT | 98.84 | TGATEIQTTGT | 0.41 |
| E | 546 | 0.12 | 7 | 2 | 0 | Y | GATEIQTSGTT | 98.84 | GATEIQTTGTT | 0.41 |
| E | 547 | 0.14 | 8 | 2 | 0 | Y | ATEIQTSGTTT | 98.59 | ATEIQTTGTTT | 0.41 |
| E | 548 | 0.14 | 8 | 2 | 0 | Y | TEIQTSGTTTI | 98.59 | TEIQTTGTTTI | 0.41 |

FIG. 5-23

Species: DENV1 (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 549 | 0.14 | 8 | 2 | 0 | Y | EIQTSGTTTIF | 98.59 | EIQTGTGTTTIF | 0.41 | | | | |
| E | 550 | 0.17 | 9 | 3 | 0 | Y | IQTSGTTTIFA | 98.35 | IQTGTTTIFA | 0.41 | IQMSGTTTIFA | 0.33 | | |
| E | 551 | 0.17 | 9 | 3 | 0 | Y | QTSGTTTIFAG | 98.35 | QTTGTTTIFAG | 0.41 | QMSGTTTIFAG | 0.33 | | |
| E | 552 | 0.17 | 9 | 3 | 0 | Y | TSGTTTIFAGH | 98.35 | TGTTTIFAGH | 0.41 | MSGTTTIFAGH | 0.33 | | |
| E | 553 | 0.13 | 7 | 2 | 0 | Y | SGTTTIFAGHL | 98.76 | TGTTTIFAGHL | 0.41 | | | | |
| E | 554 | 0.1 | 7 | 1 | 0 | Y | GTTTIFAGHLK | 99.09 | | | | | | |
| E | 555 | 0.1 | 7 | 1 | 0 | Y | TTTIFAGHLKC | 99.09 | | | | | | |
| E | 556 | 0.08 | 6 | 1 | 0 | Y | TTIFAGHLKCR | 99.26 | | | | | | |
| E | 557 | 0.07 | 5 | 1 | 0 | Y | TIFAGHLKCRL | 99.34 | | | | | | |
| E | 558 | 0.04 | 4 | 1 | 0 | Y | IFAGHLKCRLK | 99.59 | | | | | | |
| E | 559 | 0.04 | 4 | 1 | 0 | Y | FAGHLKCRLKM | 99.59 | | | | | | |
| E | 560 | 0.08 | 6 | 1 | 0 | Y | AGHLKCRLKMD | 99.26 | | | | | | |
| E | 561 | 0.05 | 5 | 1 | 0 | Y | GHLKCRLKMDK | 99.5 | | | | | | |
| E | 562 | 0.05 | 5 | 1 | 0 | Y | HLKCRLKMDKL | 99.5 | | | | | | |
| E | 563 | 0.1 | 7 | 1 | 0 | Y | LKCRLKMDKLT | 99.09 | | | | | | |
| E | 564 | 0.1 | 7 | 1 | 0 | Y | KCRLKMDKLTL | 99.09 | | | | | | |
| E | 565 | 0.1 | 7 | 2 | 0 | Y | CRLKMDKLTLK | 97.6 | CRLKMDKLTLR | 1.57 | | | | |
| E | 566 | 0.2 | 7 | 2 | 0 | Y | RLKMDKLTLKG | 97.6 | RLKMDKLTLRG | 1.57 | | | | |
| E | 567 | 0.85 | 10 | 5 | 0 | Y | LKMDKLTLKGM | 84.78 | LKMDKLTLKGT | 10.75 | LKMDKLTLRGM | 1.57 | LKMDKLTLKGI | 1.41 | LKMDKLTLKGV | 0.66 |
| E | 568 | 0.85 | 10 | 5 | 0 | Y | KMDKLTLKGMS | 84.78 | KMDKLTLKGTS | 10.75 | KMDKLTLRGMS | 1.57 | KMDKLTLKGIS | 1.41 | KMDKLTLKGVS | 0.66 |
| E | 569 | 0.85 | 10 | 5 | 0 | Y | MDKLTLKGMSY | 84.78 | MDKLTLKGTSY | 10.75 | MDKLTLRGMSY | 1.57 | MDKLTLKGISY | 1.41 | MDKLTLKGVSY | 0.66 |
| E | 570 | 0.85 | 10 | 5 | 0 | Y | DKLTLKGMSYV | 84.78 | DKLTLKGTSYV | 10.75 | DKLTLRGMSYV | 1.57 | DKLTLKGISYV | 1.41 | DKLTLKGVSYV | 0.66 |
| E | 571 | 0.83 | 9 | 5 | 0 | Y | KLTLKGMSYVM | 85.03 | KLTLKGTSYVM | 10.75 | KLTLRGMSYVM | 1.57 | KLTLKGISYVM | 1.41 | KLTLKGVSYVM | 0.66 |

FIG. 5-24

Species: DENV1 (11-mers)

| protein | block starting position | block entropy | total peptides in block | # peptides required to cover 99% of block | gap/X fraction | 99% of block covered w/ <= 5 peptides? | peptides required

FIG. 5-25

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequ

FIG. 5-26

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 631 | 0.3 | 12 | 4 | 0 | Y | LITAN

FIG. 5-27

Species: DENV1 (11-mers)

| protein

FIG. 5-28

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 686 | 0.03 | 4 | 1 | 0 | Y | ARGARRMAIL

FIG. 5-29

Species: DENV1 (11-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 720 | 0.23 | 6 | 2 | 0 | Y | FGTAY

FIG. 5-30

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 743 | 0.25 | 8 | 3 | 0 | Y | LTWLGLNSRST | 97.19 | LTWLGLNSRNT | 0.99 | LTWLGLNSRSA | 0.99 | | | | |
| E | 744 | 0.21 | 7 | 3 | 0 | Y | TWLGLNSRSTS | 97.52 | TWLGLNSRNTS | 0.99 | TWLGLNSRSAS | 0.99 | | | | |
| E | 745 | 0.32 | 8 | 4 | 0 | Y | WLGLNSRSTSL | 96.11 | WLGLNSRSTSF | 1.41 | WLGLNSRNTSL | 0.99 | WLGLNSRSASL | 0.99 | | |
| E | 746 | 0.32 | 8 | 4 | 0 | Y | LGLNSRSTSLS | 96.11 | LGLNSRSTSFS | 1.41 | LGLNSRSASLS | 0.99 | LGLNSRNTSLS | 0.99 | | |
| E | 747 | 0.33 | 9 | 4 | 0 | Y | GLNSRSTSLSM | 96.11 | GLNSRSTSFSM | 1.41 | GLNSRSASLSM | 0.99 | GLNSRNTSLSV | 0.99 | | |
| E | 748 | 0.33 | 10 | 4 | 0 | Y | LNSRSTSLSMT | 96.11 | LNSRSTSFSMT | 1.41 | LNSRSASLSMT | 0.99 | LNSRNTSLSVM | 0.99 |

FIG. 5-31

Species: DENV1 (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---

FIG. 5-32

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS1 | 790 | 0.04 | 4 | 1 | 0 | Y | CGSGIFVTNEV | 99.67 |
| NS

FIG. 5-33

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 813 | 0.17 | 9 | 2 | 0 | Y | SPKRLSAAIGK | 98.1 | SPKRLSAAIGR | 1.24 | | | | |
| NS1 | 814 | 0.18 | 10 | 2 | 0 | Y | PKRLSAAIGKA | 98.01 | PKRLSAAIGRA | 1.24 | | | | |
| NS1 | 815 | 0.18 | 10 | 2 | 0 | Y | KRLSAAIGKAW | 98.01 | KRLSAAIGRAW | 1.24 | | | | |
| NS1 | 816 | 0.2 | 11 | 2 | 0 | Y | RLSAAIGKAWE | 97.85 | RLSAAIGRAWE | 1.24 | | | | |
| NS1 | 817 | 0.18 | 9 | 2 | 0 | Y | LSAAIGKAWEE | 98.01 | LSAAIGRAWEE | 1.24 | | | | |
| NS1 | 818 | 0.18 | 9 | 2 | 0 | Y | SAAIGKAWEEG | 98.01 | SAAIGRAWEEG | 1.24 | | | | |
| NS1 | 819 | 0.18 | 9 | 2 | 0 | Y | AAIGKAWEEGV | 98.01 | AAIGRAWEEGV | 1.24 | | | | |
| NS1 | 820 | 0.17 | 8 | 2 | 0 | Y | AIGKAWEEGVC | 98.1 | AIGRAWEEGVC | 1.24 | | | | |
| NS1 | 821 | 0.16 | 7 | 2 | 0 | Y | IGKAWEEGVCG | 98.18 | IGRAWEEGVCG | 1.24 | | | | |
| NS1 | 822 | 0.16 | 7 | 2 | 0 | Y | GKAWEEGVCGI | 98.18 | GRAWEEGVCGI | 1.24 | | | | |
| NS1 | 823 | 0.16 | 7 | 2 | 0 | Y | KAWEEGVCGIR | 98.18 | RAWEEGVCGIR | 1.24 | | | | |
| NS1 | 824 | 0.06 | 6 | 1 | 0 | Y | AWEEGVCGIRS | 99.42 | | | | | | |
| NS1 | 825 | 0.26 | 8 | 3 | 0 | Y | WEEGVCGIRSA | 96.86 | WEEGVCGIRST | 1.74 | WEEGVCGIRSV | 0.83 | | |
| NS1 | 826 | 0.26 | 8 | 3 | 0 | Y | EEGVCGIRSAT | 96.86 | EEGVCGIRSTT | 1.74 | EEGVCGIRSVT | 0.83 | | |
| NS1 | 827 | 0.23 | 6 | 3 | 0 | Y | EGVCGIRSATR | 97.11 | EGVCGIRSTTR | 1.74 | EGVCGIRSTR | 0.83 | | |
| NS1 | 828 | 0.24 | 7 | 3 | 0 | Y | GVCGIRSATRL | 97.02 | GVCGIRSTTRL | 1.74 | GVCGIRSVTR | 0.83 | | |
| NS1 | 829 | 0.24 | 7 | 3 | 0 | Y | VCGIRSATRLE | 97.02 | VCGIRSTTRLE | 1.74 | VCGIRSVTRLE | 0.83 | | |
| NS1 | 830 | 0.24 | 6 | 3 | 0 | Y | CGIRSATRLEN | 97.02 | CGIRSTTRLEN | 1.74 | CGIRSVTRLEN | 0.91 | | |
| NS1 | 831 | 0.3 | 8 | 4 | 0 | Y | GIRSATRLENI | 96.28 | GIRSTTRLENI | 1.74 | GIRSVTRLENI | 0.83 | | |
| NS1 | 832 | 0.3 | 8 | 4 | 0 | Y | IRSATRLENIM | 96.28 | IRSTTRLENIM | 1.74 | IRSVTRLENIM | 0.83 | GIRSATRLENV | 0.74 |
| NS1 | 833 | 0.29 | 7 | 3 | 0 | Y | RSATRLENIMW | 96.44 | RSTTRLENIMW | 1.74 | RSVTRLENIMW | 0.83 | IRSATRLENVM | 0.74 |
| NS1 | 834 | 0.45 | 9 | 4 | 0 | Y | SATRLENIMWK | 94.13 | SATRLENIMWR | 2.32 | STTRLENIMWK | 1.74 | SVTRLENIMWK | 0.83 |
| NS1 | 835 | 0.45 | 9 | 4 | 0 | Y | ATRLENIMWKQ | 94.13 | ATRLENIMWRQ | 2.32 | TTRLENIMWKQ | 1.74 | VTRLENIMWKQ | 0.83 |

FIG. 5-34

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required

FIG. 5-35

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 875 | 0.25 | 10 | 4 | 0 | Y | GKKMIRPQPME | 97.19 | GKTIRPQPME | 1.08 | GKKMWRPQPME | 0.41 | GRKMIRPQPME | 0.41 | | |
| NS1 | 876 | 1.22 | 12

FIG. 5-36

Species: DENV1 (11-mers)

| protein | block starting position | entropy | block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS1 | 909 | 0.86 | 10 | 3 | 0 | Y | IIDGPNTPECP | 78.33 | IIDGPNTPECP | 20.43 | IIDGPNTPECS | 0.33 | | |
| NS1 | 910 | 0.89 | 12 | 5 | 0 | Y | IDGPNTPECPD | 78.16 | IDGPDTPECPD | 20.18 | IDGPNTPECSD | 0.33 | IDGPDTPECPN | 0.25 | IDGPNTSECPD | 0.17 |
| NS1 | 917 | 0.95 | 12 | 5 | 0 | Y | ECPDDQRAWNI | 82.88 | ECPDNQRAWNI | 9.93 | ECPDGQRAWNI | 5.05 | ECPDEQRAWNI | 0.83 | ECSDDQRAWNI | 0.5 |
| NS1 | 918 | 0.95 | 12 | 5 | 0 | Y | CPDDQRAWNIW | 82.88 | CPDNQRAWNIW | 9.93 | CPDGQRAWNIW | 5.05 | CPDEQRAWNIW | 0.83 | CSDDQRAWNIW | 0.5 |
| NS1 | 919 | 0.96 | 13 | 5 | 0 | Y | PDDQRAWNIWE | 82.8 | PDNQRAWNIWE | 9.93 | PDGQRAWNIWE | 5.05 | PDEQRAWNIWE | 0.83 | SDDQRAWNIWE | 0.5 |
| NS1 | 920 | 0.91 | 12 | 4 | 0 | Y | DDQRAWNIWEV | 83.29 | DNQRAWNIWEV | 9.93 | DGQRAWNIWEV | 5.05 | DEQRAWNIWEV | 0.83 | | |
| NS1 | 921 | 0.89 | 10 | 4 | 0 | Y | DQRAWNIWEVE | 83.46 | NQRAWNIWEVE | 9.93 | GQRAWNIWEVE | 5.05 | EQRAWNIWEVE | 1.08 | | |
| NS1 | 922 | 0.04 | 5 | 1 | 0 | Y | QRAWNIWEVED | 99.67 | | | | | | | | |
| NS1 | 923 | 0.03 | 4 | 1 | 0 | Y | RAWNIWEVEDY | 99.75 | | | | | | | | |
| NS1 | 924 | 0.03 | 4 | 1 | 0 | Y | AWNIWEVEDYG | 99.75 | | | | | | | | |
| NS1 | 925 | 0.03 | 4 | 1 | 0 | Y | WNIWEVEDYGF | 99.75 | | | | | | | | |
| NS1 | 926 | 0.03 | 4 | 1 | 0 | Y | NIWEVEDYGFG | 99.75 | | | | | | | | |
| NS1 | 927 | 0.15 | 7 | 2 | 0 | Y | IWEVEDYGFGI | 98.18 | IWEVEDYGFGV | 1.41 | | | | | | |
| NS1 | 928 | 0.15 | 6 | 2 | 0 | Y | WEVEDYGFGIF | 98.26 | WEVEDYGFGVF | 1.41 | | | | | | |
| NS1 | 929 | 0.16 | 6 | 2 | 0 | Y | EVEDYGFGIFT | 98.1 | EVEDYGFGVFT | 1.49 | | | | | | |
| NS1 | 930 | 0.16 | 6 | 2 | 0 | Y | VEDYGFGIFTT | 98.1 | VEDYGFGVFTT | 1.49 | | | | | | |
| NS1 | 931 | 0.16 | 6 | 2 | 0 | Y | EDYGFGIFTTN | 98.1 | EDYGFGVFTTN | 1.49 | | | | | | |
| NS1 | 932 | 0.16 | 6 | 2 | 0 | Y | DYGFGIFTTNI | 98.1 | DYGFGVFTTNI | 1.49 | | | | | | |
| NS1 | 933 | 0.16 | 6 | 2 | 0 | Y | YGFGIFTTNIW | 98.1 | YGFGVFTTNIW | 1.49 | | | | | | |
| NS1 | 934 | 0.18 | 7 | 2 | 0 | Y | GFGIFTTNIWL | 97.85 | GFGVFTTNIWL | 1.49 | | | | | | |
| NS1 | 935 | 0.22 | 9 | 3 | 0 | Y | FGIFTTNIWLK | 97.44 | FGVFTTNIWLK | 1.49 | FGIFTNIWLR | 0.33 | GIFTNIWLRL | 0.33 | | |
| NS1 | 936 | 0.3 | 10 | 4 | 0 | Y | GIFTTNIWLKL | 96.44 | GVFTTNIWLKL | 1.49 | GIFTNIWLKM | 0.99 | GIFTNIWLRL | 0.33 | | |
| NS1 | 937 | 0.3 | 10 | 4 | 0 | Y | IFTTNIWLKLR | 96.44 | VFTTNIWLKLR | 1.49 | IFTTNIWLKMR | 0.99 | IFTTNIWLRLR | 0.33 | | |

FIG. 5-37

Species: DENV1 (11-mers)

| protein | block

FIG. 5-38

Species: DENV1 (11-mers)

| protein | block starting position | block entropy | total peptides in block | # peptides required to cover 99% of block | gap/X fraction | 99% of block covered w/ <= 5 peptides? | peptides required

FIG. 5-39

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 991 | 0.81 | 7 | 3 | 0 | Y | SFIEVKTCVWP | 82.8 | SFIEVKTCVWP | 13.73 | SFIEVKTCVWP | 3.14 | | |
| NS1 | 992 | 0.85 | 7 | 3 | 0 | Y | FIEVKTCVWPK | 82.3 | FIEVKTCVWPK | 13.73 | FIEVKTCVWPK | 3.14 | | |
| NS1 | 993 | 0.84 | 6 | 3 | 0 | Y | IEVKTCVWPKS | 82.38 | IEVKTCVWPKS | 13.73 | IEVKTCVWPKS | 3.14 | | |
| NS1 | 994 | 0.84 | 6 | 3 | 0 | Y | EVKTCVWPKSH | 82.38 | EVKTCVWPKSH | 13.73 | EVKTCVWPKSH | 3.14 | | |
| NS1 | 995 | 0.84 | 6 | 3 | 0 | Y | VKTCVWPKSHT | 82.38 | VKTCVWPKSHT | 13.73 | VKTCVWPKSHT | 3.14 | | |
| NS1 | 996 | 0.84 | 6 | 3 | 0 | Y | KTCVWPKSHTL | 82.38 | KTCVWPKSHTL | 13.73 | KTCVWPKSHT | 3.14 | | |
| NS1 | 997 | 0.84 | 6 | 3 | 0 | Y | TCVWPKSHTLW | 82.38 | TCVWPKSHTLW | 13.73 | TCVWPKSHTLW | 3.14 | | |
| NS1 | 998 | 0.84 | 7 | 3 | 0 | Y | CVWPKSHTLWS | 82.38 | CVWPKSHTLWS | 13.73 | CVWPKSHTLWS | 3.14 | | |
| NS1 | 999 | 0.85 | 3 | 1 | 0 | Y | VWPKSHTLWSN | 82.38 | TWPKSHTLWSN | 13.73 | VWPKSHTLWSN | 3.06 | | |
| NS1 | 1000 | 0.06 | 3 | 1 | 0 | Y | WPKSHTLWSNG | 99.34 | | | | | | |
| NS1 | 1001 | 0.06 | 5 | 1 | 0 | Y | PKSHTLWSNGV | 99.34 | | | | | | |
| NS1 | 1002 | 0.08 | 4 | 1 | 0 | Y | KSHTLWSNGVL | 99.17 | | | | | | |
| NS1 | 1003 | 0.03 | 4 | 1 | 0 | Y | SHTLWSNGVLE | 99.75 | | | | | | |
| NS1 | 1004 | 0.03 | 4 | 1 | 0 | Y | HTLWSNGVLES | 99.75 | | | | | | |
| NS1 | 1005 | 0.03 | 4 | 1 | 0 | Y | TLWSNGVLESE | 99.75 | | | | | | |
| NS1 | 1006 | 0.03 | 5 | 1 | 0 | Y | LWSNGVLESEM | 99.75 | | | | | | |
| NS1 | 1007 | 0.14 | 6 | 2 | 0 | Y | WSNGVLESEMI | 98.26 | WSNGVLESEMV | 1.49 | | | | |
| NS1 | 1008 | 0.17 | 6 | 2 | 0 | Y | SNGVLESEMII | 98.01 | SNGVLESEMVI | 1.49 | | | | |
| NS1 | 1009 | 0.17 | 5 | 2 | 0 | Y | NGVLESEMIIP | 98.01 | NGVLESEMVIP | 1.49 | | | | |
| NS1 | 1010 | 0.16 | 8 | 2 | 0 | Y | GVLESEMIIPK | 98.1 | GVLESEMVIPK | 1.49 | | | | |
| NS1 | 1011 | 0.29 | 10 | 3 | 0 | Y | VLESEMIIPKI | 96.53 | VLESEMIIPKI | 1.49 | VLESEMIIPKM | 0.99 | | |
| NS1 | 1012 | 0.42 | 8 | 4 | 0 | Y | LESEMIIPKIY | 94.87 | LESEMIIPKIH | 1.65 | LESEMIIPKIY | 1.49 | LESEMIIPKMY | 0.99 |
| NS1 | 1013 | 0.4 | 8 | 4 | 0 | Y | ESEMIIPKIYG | 95.04 | ESEMIIPKIHG | 1.65 | ESEMVIPKIYG | 1.49 | ESEMIIPKMYG | 0.99 |

FIG. 5-40

Species: DENV1 (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1014 | 0.4 | 8 | 4 | 0 | Y | SEMIIPKIYGG | 95.04 | SEMIIPKIHGG | 1.65 | SEMIIPKIYGG | 1.49 | SEMIIPKMYGG | 0.99 | | |
| NS1 | 1015 | 0.4 | 8 | 4 | 0 | Y | EMIIPKIYGGP | 95.04 | EMIIPKIHGGP | 1.65 | EMIIPKIYGGP | 1.49 | EMIIPKMYGGP | 0.99 | | |
| NS1 | 1019 | 0.41 | 12 | 5 | 0 | Y | PKIYGGPISQH | 95.12 | PKIHGGPISQH | 1.65 | PKIYGGPTSQH | 0.99 | PKMYGGPISQH | 0.83 | PKIYGGPMSQH | 0.58 |
| NS1 | 1020 | 0.41 | 12 | 5 | 0 | Y | KIYGGPISQHN | 95.12 | KIHGGPISQHN | 1.65 | KIYGGPTSQHN | 0.99 | KMYGGPISQHN | 0.83 | KIYGGPMSQHN | 0.58 |
| NS1 | 1022 | 0.37 | 7 | 4 | 0 | Y | YGGPISQHNYR | 95.45 | HGGPISQHNYR | 1.65 | YGGPTSQHNYR | 1.08 | YGGPISQHNHR | 0.91 | | |
| NS1 | 1023 | 0.26 | 7 | 3 | 0 | Y | GGPISQHNYRP | 97.02 | GGPTSQHNYRP | 1.08 | GGPISQHNHRP | 0.91 | | | | |
| NS1 | 1024 | 0.25 | 6 | 3 | 0 | Y | GPISQHNYRPG | 97.02 | GPTSQHNYRPG | 1.08 | GPISQHNHRPG | 0.91 | | | | |
| NS1 | 1025 | 0.25 | 6 | 3 | 0 | Y | PISQHNYRPGY | 97.02 | PTSQHNYRPGY | 1.08 | PISQHNHRPGY | 0.91 | | | | |
| NS1 | 1026 | 0.31 | 10 | 4 | 0 | Y | ISQHNYRPGYF | 96.44 | TSQHNYRPGYF | 1.08 | ISQHNHRPGYF | 0.91 | MSQHNYRPGYF | 0.58 | | |
| NS1 | 1027 | 0.15 | 7 | 2 | 0 | Y | SQHNYRPGYFT | 98.35 | SQHNHRPGYFT | 0.91 | | | | | | |
| NS1 | 1028 | 0.15 | 7 | 2 | 0 | Y | QHNYRPGYFTQ | 98.35 | QHNHRPGYFTQ | 0.91 | | | | | | |
| NS1 | 1029 | 0.46 | 9 | 3 | 0 | Y | HNYRPGYFTQT | 93.13 | HNHRPGYFTQT | 4.96 | HNYRPGYFTQA

FIG. 5-41

Species: DENV1 (11-mers)

| protein | block starting position | block entropy | total peptides in block | # peptides required to cover 99% of block | gap/X fraction | 99% of block covered w/ <= 5

FIG. 5-42

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides

FIG. 5-43

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block

FIG. 5-44

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1110 | 0.17 | 8 | 2 | 0 | Y | IRPVKEKEENL | 98.1 | IRPVKDKEENL | 1.08 | | | | |
| NS1 | 1111 | 0.17 | 8 | 2 | 0 | Y | RPVKEKEENLV | 98.1 | RPVKDKEENLV | 1.08 | | | | |
| NS1 | 1112 | 0.89 | 9 | 3 | 0 | Y | PVKEKEENLVK | 77.92 | PVKEENLVRS | 20.26 | P

FIG. 5-45

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1144 | 0.27 | 9 | 4 | 0 | Y | IMIEE

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block

FIG. 5-48

Species: DENV1 (11-mers)

| protein | block starting position | block

FIG. 5-49

Species: DENV1 (11-mers)

| protein | block starting position | block entropy | # peptides required to cover 99% of block | gap/X fraction | 99% of block covered w/ => 5 peptides? | total peptides in block | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1303 | 0.45 | 4 | 0 | Y | 7 | SLFPLCLSTTS | 93.38 | SLFPLCLSTTS | 4.47 | SLIPLCLSTTS | 1.08 | SLFPLCMSTTS | 0.

FIG. 5-50

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1326 | 0.95 | 13 | 5 | 0 | Y | LGCKPLTMFLI | 77.42 | FGCKPLTMFLI | 20.18 | LGCKPLMFLI | 0.91 | LGCKPLAMFLI | 0.41 | LGCKPLTMFLI | 0.25 |
| NS2A |

Species: DENV1 (11-mers)

| protein | block starting position | block entropy | total

FIG. 5-53

Species: DENV1 (11-mers)

| prot

FIG. 5-54

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1431 | 0.27 | 9 | 3 | 0 | Y | IKDEERDDTLT | 96.86 | IKDEERDDTLT | 1.49 | KDEERDDMLTI | 0.5 | | |
| NS2B | 1432 | 0.29 | 11 | 4 | 0 | Y | KDEERDDTLTI | 96.69 | KDEERDDTITI | 1.49 | | | | |
| NS2B | 1433 | 0.28 | 10 | 3 | 0 | Y | DEERDDTLTIL | 96.77 | DEERDDTITIL | 1.49 | | | | |
| NS2B | 1434 | 0.27 | 9 | 3 | 0 | Y | EERDDTLTILL | 96.86 | EERDDTITILL | 1.49 | | | | |
| NS2B | 1435 | 0.27 | 9 | 3 | 0 | Y | ERDDTLTILLK | 96.86 | ERDDTITILLK | 1.49 | | | | |

FIG. 5-55

Species: DENV1 (11-mers)

| protein | block starting position | block entropy | total peptides in block | # peptides required to cover 99% of block | gap/x fraction | 99% of block covered w/ <= 5 peptides? | peptides required to cover

FIG. 5-56

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1493 | 0.88 | 6 | 2 | 0 | Y | VLDDGIYRIMQ | 75.35 | VLDDGIYRILQ | 23.66 | | | | |
| NS3 | 1494 | 0.86 | 5 | 2 | 0 | Y | LDDGIYRIMQR | 75.6 | LDDGIYRILQR | 23.66 | | | | |
| NS3 | 1495 | 0.86 | 5 | 2 | 0 | Y | DDGIYRIMQRG | 75.6 | DDGIYRILQRG | 23.66 | | | | |
| NS3 | 1496 | 0.86 | 5 | 2 | 0 | Y | DGIYRIMQRGL | 75.6 | DGIYRILQRGL | 23.66 | | | | |
| NS3 | 1497 | 0.82 | 4 | 2 | 0 | Y | GIYRIMQRGLL | 75.6 | GIYRILQRGLL | 24.15 | | | | |
| NS3 | 1498 | 0.83 | 5 | 2 | 0 | Y | IYRIMQRGLLG | 75.52 | IYRILQRGLLG | 24.15 | | | | |
| NS3 | 1499 | 0.87 | 6 | 2 | 0 | Y | YRIMQRGLLGR | 75.52 | YRILQRGLLGR | 23.66 | | | | |
| NS3 | 1500 | 0.87 | 6 | 2 | 0 | Y | RIMQRGLLGRS | 75.52 | RILQRGLLGRS | 23.66 | | | | |
| NS3 | 1501 | 0.87 | 6 | 2 | 0 | Y | IMQRGLLGRSQ | 75.52 | ILQRGLLGRSQ | 23.66 | | | | |
| NS3 | 1502 | 0.87 | 4 | 2 | 0 | Y | MQRGLLGRSQV | 75.52 | LQRGLLGRSQV | 23.66 | | | | |
| NS3 | 1503 | 0.06 | 4 | 1 | 0 | Y | QRGLLGRSQVG | 99.34 | | | | | | |
| NS3 | 1504 | 0.06 | 4 | 1 | 0 | Y | RGLLGRSQVGV | 99.34 | | | | | | |
| NS3 | 1505 | 0.06 | 4 | 1 | 0 | Y | GLLGRSQVGVG | 99.34 | | | | | | |
| NS3 | 1506 | 0.06 | 4 | 1 | 0 | Y | LLGRSQVGVGV | 99.34 | | | | | | |
| NS3 | 1507 | 0.07 | 5 | 1 | 0 | Y | LGRSQVGVGVF | 99.26 | | | | | | |
| NS3 | 1508 | 0.07 | 5 | 1 | 0 | Y | GRSQVGVGVFQ | 99.26 | | | | |

FIG. 5-57

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1516 | 1.01 | 7 | 3 | 0 | Y | VFQENVFHTMW | 75.1 | VFQDGVFHTMW | 20.26 | VFQEGVFHTMW | 4.3 | | |
| NS3 | 1517 | 1.01 | 7 | 3 | 0 | Y | FQENVFHTMWH | 75.1 | FQDGVFHTMWH | 20.26 | FQEGVFHTMWH | 4.3 | | |
| NS3 | 1518 | — | 6 | 3 | 0 | Y | QENVFHTMWHV | 75.1 | QDGVFHTMWHV | 20.35 | QEGVFHTMWHV | 4.3 | | |
| NS3 | 1519 | — | 6 | 3 | 0 | Y | ENVFHTMWHVT | 75.1 | DGVFHTMWHVT | 20.35 | EGVFHTMWHVT | 4.3 | | |
| NS3 | 1520 | 0.82 | 3 | 2 | 0 | Y | NVFHTMWHVTR | 75.1 | GVFHTMWHVTR | 24.81 | | | | |
| NS3 | 1521 | 0.01 | 2 | 1 | 0 | Y | VFHTMWHVTRG | 99.92 | | | | | | |
| NS3 | 1522 | 0 | 1 | 1 | 0 | Y | FHTMWHVTRGA | 100 | | | | | | |
| NS3 | 1523 | 0 | 1 | 1 | 0 | Y | HTMWHVTRGAV | 100 | | | | | | |
| NS3 | 1524 | 0 | 1 | 1 | 0 | Y | TMWHVTRGAVL | 100 | | | | | | |
| NS3 | 1525 | 0 | 1 | 1 | 0 | Y | MWHVTRGAVLM | 100 | | | | | | |
| NS3 | 1526 | 0.02 | 2 | 1 | 0 | Y | WHVTRGAVLMY | 99.83 | | | | | | |
| NS3 | 1527 | 0.02 | 3 | 1 | 0 | Y | HVTRGAVLMYQ | 99.83 | | | | | | |
| NS3 | 1528 | 0.02 | 3 | 1 | 0 | Y | VTRGAVLMYQG | 99.83 | | | | | | |
| NS3 | 1529 | 0.02 | 3 | 1 | 0 | Y | TRGAVLMYQGK | 99.83 | | | | | | |
| NS3 | 1530 | 0.02 | 3 | 1 | 0 | Y | RGAVLMYQGKR | 99.83 | | | | | | |
| NS3 | 1531 | 0.02 | 3 | 1 | 0 | Y | GAVLMYQGKRL | 99.83 | | | | | | |
| NS3 | 1532 | 0.02 | 3 | 1 | 0 | Y | AVLMYQGKRLE | 99.83 | | | | | | |
| NS3 | 1533 | 0.02 | 3 | 1 | 0 | Y | VLMYQGKRLEP | 99.83 | | | | | | |
| NS3 | 1534 | 0.02 | 3 | 1 | 0 | Y | LMYQGKRLEPS | 99.83 | | | | | | |
| NS3 | 1535 | 0.02 | 3 | 1 | 0 | Y | MYQGKRLEPSW | 99.83 | | | | | | |
| NS3 | 1536 | 0.02 | 3 | 1 | 0 | Y | YQGKRLEPSWA | 99.83 | | | | | | |
| NS3 | 1537 | 0.04 | 3 | 1 | 0 | Y | QGKRLEPSWAS | 99.59 | | | | | | |
| NS3 | 1538 | 0.06 | 4 | 1 | 0 | Y | GKRLEPSWASY | 99.42 | | | | | | |

FIG. 5-59

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 5-60

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 5-61

Species: DENV

FIG. 5-62

Species: DENV1 (11-mers)

| protein | block starting position | block entropy | total peptides in block | # peptides required to cover 99% of block | gap/X fraction | 99% of block covered w/ <= 5 peptides? | peptides required

FIG. 5-64

Species: DENV1 (11-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1682 | 0.47 | 15 | 5 | 0 | Y | PAIVREAIKRK | 93.88 | PAIVREAIKRR | 3.06 | PAMVREAIKRK | 1.65 | PAIVREAIRRN | 0.25 | PAIIREAIKRK | 0.17 |
| NS3 | 1685 | 0.37 | 14 | 5 | 0 | Y | VREAIKRKLRT | 95.37 | VREAIKRRLRT | 3.06 | VREAIKRKMRT | 0.25 | VREAIRRNVRT | 0.25 | VREAMKRKLRT | 0.17 |
| NS3 | 1686 | 0.35 | 13 | 4 | 0 | Y | REAIKRKLRTL | 95.53 | REAIKRRLRTL | 3.06 | REAIKRKMRTL | 0.25 | REAIRRNVRTL | 0.25 | | |
| NS3 | 1689 | 0.51 | 14 | 5 | 0 | Y | IKRKLRTLILA | 93.38 | IKRRLRTLILA | 2.32 | IKRKRKMRTLILA | 2.32 | IKRRLRTLVLA | 0.74 | IKRKMRTLILA | 0.25 |
| NS3 | 1690 | 0.48 | 10 | 4 | 0 | Y | KRKLRTLILAP | 93.63 | KRRLRTLILAP | 2.48 | KRKLRTLVLA | 2.32 | KRRLRTLVLAP | 0.74 | | |
| NS3 | 1691 | 0.47 | 9 | 4 | 0 | Y | RKLRTLILAPT | 93.71 | RRLRTLILAPT | 2.48 | RKLRTLVLAP | 2.32 | RRLRTLVLAPT | 0.74 | | |
| NS3 | 1692 | 0.45 | 8 | 4 | 0 | Y | KLRTLILAPTR | 93.88 | KLRTLVLAPTR | 2.48 | KLRTLVLAPT | 2.32 | RLRTLVLAPTR | 0.74 | | |
| NS3 | 1693 | 0.25 | 5 | 2 | 0 | Y | LRTLILAPTRV | 96.44 | LRTLVLAPTRV | 3.06 | KLRTLVLAPTR | 2.32 | | | | |
| NS3 | 1694 | 0.2 | 2 | 2 | 0 | Y | RTLILAPTRVV | 96.86 | RTLVLAPTRVV | 3.14 | | | | | | |
| NS3 | 1695 | 0.2 | 2 | 2 | 0 | Y | TLILAPTRVVA | 96.86 | TLVLAPTRVVA | 3.14 | | | | | | |
| NS3 | 1696 | 0.22 | 3 | 2 | 0 | Y | LILAPTRVVAS | 96.69 | LVLAPTRVVAS | 3.14 | | | | | | |
| NS3 | 1697 | 0.22 | 3 | 2 | 0 | Y | ILAPTRVVASE | 96.69 | VLAPTRVVASE | 3.14 | | | | | | |
| NS3 | 1698 | 0.03 | 3 | 1 | 0 | Y | LAPTRVVASEM | 99.75 | | | | | | | | |
| NS3 | 1699 | 0.03 | 3 | 1 | 0 | Y | APTRVVASEMA | 99.75 | | | | | | | | |
| NS3 | 1700 | 0.03 | 3 | 1 | 0 | Y | PTRVVASEMAE | 99.75 | | | | | | | | |
| NS3 | 1701 | 0.03 | 3 | 1 | 0 | Y | TRVVASEMAEA | 99.75 | | | | | | | | |
| NS3 | 1702 | 0.03 | 3 | 1 | 0 | Y | RVVASEMAEAL | 99.75 | | | | | | | | |
| NS3 | 1703 | 0.03 | 3 | 1 | 0 | Y | VVASEMAEALK | 99.75 | | | | | | | | |
| NS3 | 1704 | 0.03 | 3 | 1 | 0 | Y | VASEMAEALKG | 99.75 | | | | | | | | |
| NS3 | 1705 | 0.16 | 4 | 2 | 0 | Y | ASEMAEALKGM | 98.18 | ASEMAEALKGV | 0.91 | | | | | | |
| NS3 | 1706 | 0.16 | 6 | 2 | 0 | Y | SEMAEALKGMP | 98.18 | SEMAEALKGVP | 0.91 | | | | | | |
| NS3 | 1707 | 0.15 | 5 | 2 | 0 | Y | EMAEALKGMPI | 98.26 | EMAEALKGVPI | 0.91 | | | | | | |
| NS3 | 1708 | 0.15 | 5 | 2 | 0 | Y | MAEALKGMPIR | 98.26 | MAEALKGVPIR | 0.91 | | | | | | |

FIG. 5-65

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|

FIG. 5-66

Species: DENV1 (11-mers)

| protein | block starting position | block entropy | total peptides in block | # peptides required to c

FIG. 5-67

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency |

FIG. 5-68

Species: D

FIG. 5-69

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to c

FIG. 5-70

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1824 | 1.01 | 9 | 3 | 0 | Y | GYEWITDFPGK | 72.29 | GYDWITDFPGK | 25.23 | GHEWITDFPGK | 1.82 | | |
| NS3 | 1825 | 1.02 | 10 | 3 | 0 | Y | YEWITDFPGKT | 72.29 | YDWITDFPGKT | 25.14 | HEWITDFPGKT | 1.82 | | |
| NS3 | 1826 | 0.89 | 9 | 2 | 0 | Y | EWITDFPGKTV | 74.11 | DWITDFPGKTV | 25.14 | | | | |
| NS3 | 1827 | 0.08 | 8 | 1 | 0 | Y | WITDFPGKTVW | 99.26 | | | | | | |
| NS3 | 1828 | 0.08 | 9 | 1 | 0 | Y | ITDFPGKTVWF | 99.26 | | | | | | |
| NS3 | 1829 | 0.09 | 9 | 1 | 0 | Y | TDFPGKTVWFV | 99.17 | | | | | | |
| NS3 | 1830 | 0.09 | 7 | 1 | 0 | Y | DFPGKTVWFVP | 99.17 | | | | | | |
| NS3 | 1831 | 0.07 | 7 | 1 | 0 | Y | FPGKTVWFVPS | 99.42 | | | | | | |
| NS3 | 1832 | 0.07 | 4 | 1 | 0 | Y | PGKTVWFVPSI | 99.42 | | | | | | |
| NS3 | 1833 | 0.03 | 5 | 1 | 0 | Y | GKTVWFVPSIK | 99.75 | | | | | | |
| NS3 | 1834 | 0.21 | 4 | 2 | 0 | Y | KTVWFVPSIKS | 97.02 | KTVWFVPSIKA | 2.73 | | | | |
| NS3 | 1835 | 0.2 | 3 | 2 | 0 | Y | TVWFVPSIKSG | 97.11 | TVWFVPSIKAG | 2.73 | | | | |
| NS3 | 1836 | 0.19 | 3 | 2 | 0 | Y | VWFVPSIKSGN | 97.19 | VWFVPSIKAGN | 2.73 | | | | |
| NS3 | 1837 | 0.19 | 4 | 2 | 0 | Y | WFVPSIKSGND | 97.19 | WFVPSIKAGND | 2.73 | | | | |
| NS3 | 1838 | 0.2 | 5 | 2 | 0 | Y | FVPSIKSGNDI | 97.11 | FVPSIKAGNDI | 2.73 | | | | |
| NS3 | 1839 | 0.21 | 6 | 2 | 0 | Y | VPSIKSGNDIA | 97.11 | VPSIKAGNDIA | 2.65 | | | | |
| NS3 | 1840 | 0.21 | 6 | 2 | 0 | Y | PSIKSGNDIAN | 97.11 | PSIKAGNDIAN | 2.56 | | | | |
| NS3 | 1841 | 0.21 | 5 | 2 | 0 | Y | SIKSGNDIANC | 97.11 | SIKAGNDIANC | 2.56 | | | | |
| NS3 | 1842 | 0.2 | 5 | 2 | 0 | Y | IKSGNDIANCL | 97.19 | IKAGNDIANCL | 2.56 | | | | |
| NS3 | 1843 | 0.2 | 5 | 2 | 0 | Y | KSGNDIANCLR | 97.19 | KAGNDIANCLR | 2.56 | | | | |
| NS3 | 1844 | 0.2 | 5 | 2 | 0 | Y | SGNDIANCLRK | 97.19 | AGNDIANCLRK | 2.56 | | | | |
| NS3 | 1845 | 0.03 | 4 | 1 | 0 | Y | GNDIANCLRKN | 99.75 | | | | | | |
| NS3 | 1846 | 0.03 | 4 | 1 | 0 | Y | NDIANCLRKNG | 99.75 | | | | | | |

FIG. 5-71

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---

FIG. 5-72

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
|

FIG. 5-73

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS3 | 1893 | 0.04 | 4 | 1 | 0 | Y | NFRADRVIDPR | 99.59 |
| NS3 | 1894 | 0.04 | 4 | 1 | 0 | Y | FRADRVIDPRR | 99.59 |
| NS3 | 1895 | 0.04 | 4 | 1 | 0 | Y | RADRVIDPRRC | 99.59 |
| NS3 | 1896 | 0.04 | 4 | 1 | 0 | Y | ADRVIDPRRCL | 99.59 |
| NS3 | 1897 | 0.04 | 3 | 1 | 0 | Y | DRVIDPRRCLK | 99.59 |
| NS3 | 1898 | 0.02 | 4 | 1 | 0 | Y | RVIDPRRCLKP | 99.83 |
| NS3 | 1899 | 0.03 | 4 | 1 | 0 | Y | VIDPRRCLKPV | 99.75 |
| NS3 | 1900 | 0.03 | 4 | 1 | 0 | Y | IDPRRCLKPVI | 99.75 |
| NS3 | 1901 | 0.04 | 4 | 1 | 0 | Y | DPRRCLKPVIL | 99.67 |
| NS3 | 1902 | 0.04 | 4 | 1 | 0 | Y | PRRCLKPVILK | 99.67 |
| NS3 | 1903 | 0.05 | 5 | 1 | 0 | Y | RRCLKPVILKD | 99.5 |
| NS3 | 1904 | 0.05 | 5 | 1 | 0 | Y | RCLKPVILKDG | 99.5 |
| NS3 | 1905 | 0.08 | 7 | 1 | 0 | Y | CLKPVILKDGP | 99.26 |
| NS3 | 1906 | 0.08 | 7 | 1 | 0 | Y | LKPVILKDGPE | 99.26 |
| NS3 | 1907 | 0.08 | 7 | 1 | 0 | Y | KPVILKDGPER | 99.26 |
| NS3 | 1908 | 0.08 | 7 | 1 | 0 | Y | PVILKDGPERV | 99.26 |
| NS3 | 1909 | 0.08 | 6 | 1 | 0 | Y | VILKDGPERVI | 99.34 |
| NS3 | 1910 | 0.07 | 6 | 1 | 0 | Y | ILKDGPERVIL | 99.34 |
| NS3 | 1911 | 0.07 | 5 | 1 | 0 | Y | LKDGPERVILA | 99.5 |
| NS3 | 1912 | 0.05 | 5 | 1 | 0 | Y | KDGPERVILAG | 99.5 |
| NS3 | 1913 | 0.05 | 5 | 1 | 0 | Y | DGPERVILAGP | 99.67 |
| NS3 | 1914 | 0.04 | 4 | 1 | 0 | Y | GPERVILAGPM | 99.67 |
| NS3 | 1915 | 0.04 | 4 | 1 | 0 | Y | PERVILAGPMP | 99.67 |

FIG. 5-74

Species: DENV1 (11-mers)

| protein | block starting position | block entropy | total peptides in block | # peptides required to cover 99% of block | gap/X fraction | 99% of block covered w/ <= 5 peptides? | to cover 99% of block | frequency | to cover 99% of block | frequency | to cover 99% of block | frequency | to cover 99% of block | frequency | to cover 99% of block | frequency |
|---|---|---|---|---|---|---|---|---|---|---|---|---|---|---|---|---|
| NS3 | 1916 | 0 | 1 | 1 | 0 | Y | ERVILAGPMPV | 100 | | | |

FIG. 5-75

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1939 | 0.93 | 10 | 3 | 0 | Y | GRNHNKEGDQY | 73.53 | GRNQNKEGDQY | 25.39 | | | | |
| NS3 | 1940 | 1.19 | 13 | 5 | 0 | Y | RNHNKEGDQYI | 72.79 | RNQNKEGDQYI | 19.27 | RNHNKEGDQYV | 0.74 | RNYNKEGDQYI | 0.25 |
| NS3 | 1941 | 1.19 | 13 | 5 | 0 | Y | NHNKEGDQYIY | 72.79 | NQNKEGDQYIY | 19.27 | NHNK

FIG. 5-76

Species: DENV1 (11-mers)

| protein | block starting position | entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS3 | 1962 | 0.03 | 3 | 1 | 0 | Y | HAHWTEAKMLL | 99.75 |
| NS3 | 1963 | 0.04 | 4 | 1 | 0 | Y | AHWTEAKMLLD | 99.67 |
| NS3 | 1964 | 0.04 | 4 | 1 | 0 | Y | HWTEAKMLLDN | 99.67 |
| NS3 | 1965 | 0.04 | 5 | 1 | 0 | Y | WTEAKMLLDNI | 99.67 |
| NS3 | 1966 | 0.05 | 6 | 1 | 0 | Y | TEAKMLLDNIN | 99.59 |
| NS3 | 1967 | 0.04 | 5 | 1 | 0 | Y | EAKMLLDNINT | 99.67 |
| NS3 | 1968 | 0.04 | 5 | 1 | 0 | Y | AKMLLDNINTP | 99.67 |
| NS3 | 1969 | 0.04 | 5 | 1 | 0 | Y | KMLLDNINTPE | 99.67 |
| NS3 | 1970 | 0.04 | 5 | 1 | 0 | Y | MLLDNINTPEG | 99.67 |
| NS3 | 1971 | 0.04 | 5 | 1 | 0 | Y | LLDNINTPEGI | 99.67 |
| NS3 | 1972 | 0.05 | 6 | 1 | 0 | Y | LDNINTPEGII | 99.59 |
| NS3 | 1973 | 0.05 | 6 | 1 | 0 | Y | DNINTPEGIIP | 99.59 |
| NS3 | 1974 | 0.05 | 6 | 1 | 0 | Y | NINTPEGIIPA | 99.59 |
| NS3 | 1975 | 0.05 | 6 | 1 | 0 | Y | INTPEGIIPAL | 99.59 |
| NS3 | 1976 | 0.05 | 5 | 1 | 0 | Y | NTPEGIIPALF | 99.59 |
| NS3 | 1977 | 0.04 | 4 | 1 | 0 | Y | TPEGIIPALFE | 99.67 |
| NS3 | 1978 | 0.04 | 4 | 1 | 0 | Y | PEGIIPALFEP | 99.67 |
| NS3 | 1979 | 0.04 | 4 | 1 | 0 | Y | EGIIPALFEPE | 99.67 |
| NS3 | 1980 | 0.04 | 4 | 1 | 0 | Y | GIIPALFEPER | 99.67 |
| NS3 | 1981 | 0.06 | 6 | 1 | 0 | Y | IIPALFEPERE | 99.5 |
| NS3 | 1982 | 0.06 | 6 | 1 | 0 | Y | IPALFEPEREK | 99.5 |
| NS3 | 1983 | 0.06 | 6 | 1 | 0 | Y | PALFEPEREKS | 99.5 |
| NS3 | 1984 | 0.07 | 7 | 1 | 0 | Y | ALFEPEREKSA | 99.42 |

FIG. 5-77

Species: DENV1 (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency |
|---|---|---|---|

FIG. 5-78

Species: DENV1 (11-mers)

| protein | block starting position | block entropy | total peptides in block | # peptides required to cover 99% of block | gap/X

FIG. 5-79

Species: DENV1 (11-mers)

| protein | block starting position | block entropy | total peptides in block | # peptides required to cover 99% of block | gap/X fraction | 99% of block covered w/ <= 5 peptides? | peptides required to cover

FIG. 5-80

Species: DENV1 (11-mers)

| protein | block starting position | block entropy | # peptides required to cover 99% of block | total peptides in block | gap/X fraction | 99% of block covered w/ <= 5 peptides? | peptides required to cover 99% of block | frequency |
|---|---|---|---|---|---|---|---|---|
| NS3 | 2065 | 0.08 | 1 | 8 | 0 | Y | ERKKLRPRWLD | 99.34 |
| NS3 | 2066 | 0.06 | 1 | 7 | 0 | Y | RKKLRPRWLDA | 99.5 |
| NS3 | 2067 | 0.06 | 1 | 7 | 0 | Y | KKLRPRWLDAR | 99.5 |
| NS3 | 2068 | 0.08 | 1 | 8 | 0 | Y | KLRPRWLDART | 99.26 |
| NS3 | 2069 | 0.06 | 1 | 6 | 0 | Y | LRPRWLDARTY | 99.42 |
| NS3 | 2070 | 0.06 | 1 | 6 | 0 | Y | RPRWLDARTYS | 99.42 |
| NS3 | 2071 | 0.05 | 1 | 5 | 0 | Y | PRWLDARTYSD | 99.5 |
| NS3 | 2072 | 0.05 | 1 | 5 | 0 | Y | RWLDARTYSDP | 99.5 |
| NS3 | 2073 | 0.06 | 1 | 6 | 0 | Y | WLDARTYSDPL | 99.42 |
| NS3 | 2074 | 0.06 | 1 | 6 | 0 | Y | LDARTYSDPLA | 99.42 |
| NS3 | 2075 | 0.06 | 1 | 6 | 0 | Y | DARTYSDPLAL | 99.42 |
| NS3 | 2076 | 0.08 | 1 | 7 | 0 | Y | ARTYSDPLALR | 99.26 |
| NS3 | 2077 | 0.08 | 1 | 7 | 0 | Y | RTYSDPLALRE | 99.26 |
| NS3 | 2078 | 0.09 | 1 | 8 | 0 | Y | TYSDPLALREF | 99.17 |
| NS3 | 2079 | 0.07 | 1 | 7 | 0 | Y | YSDPLALREFK | 99.42 |
| NS3 | 2080 | 0.07 | 1 | 7 | 0 | Y | SDPLALREFKE | 99.42 |
| NS3 | 2081 | 0.07 | 1 | 7 | 0 | Y | DPLALREFKEF | 99.42 |
| NS3 | 2082 | 0.07 | 1 | 7 | 0 | Y | PLALREFKEFA | 99.42 |
| NS3 | 2083 | 0.08 | 1 | 8 | 0 | Y | LALREFKEFAA | 99.34 |
| NS3 | 2084 | 0.07 | 1 | 7 | 0 | Y | ALREFKEFAAG | 99.42 |
| NS3 | 2085 | 0.06 | 1 | 6 | 0 | Y | LREFKEFAAGR | 99.5 |
| NS3 | 2086 | 0.08 | 1 | 7 | 0 | Y | REFKEFAAGRR | 99.26 |
| NS3 | 2087 | 0.08 | 1 | 6 | 0 | Y | EFKEFAAGRRS | 99.26 |

FIG. 5-81

Species: DENV1 (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2088 | 0.12 | 8 | 2 | 0 | Y | FKEFAAGRR

FIG. 5-82

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2111 | 0.91 | 13 | 4 | 0 | Y | QHLTQRAQNAL | 78.58 | QHLTLRAQNAL | 19.35 | QHLTQKAQNAL | 0.66 | QHLTLKAQNAL | 0.58 |
| NS4A | 2112 | 0.91 | 13 | 4 | 0 | Y | HLTQRAQNALD | 78.58 | HLTLRAQNALD | 19.35 | HLTQKAQNALD | 0.66 | HLTLKAQNALD | 0.58 |
| NS4A | 2113 | 0.91 | 13 | 4 | 0 | Y | LTQRAQNALDN | 78.58 | LTLRAQNALDN | 19.35 | LTQKAQNALD | 0.66 | LTLKAQNALDN | 0.58 |
| NS4A | 2114 | 0.91 | 13 | 4 | 0 | Y | TQRAQNALDNL | 78.58 | TLRAQNALDNL | 19.35 | TQKAQNALDN | 0.66 | TLKAQNALDN | 0.58 |
| NS4A | 2115 | 0.89 | 11 | 4 | 0 | Y | QRAQNALDNLV | 78.58 | LRAQNALDNLV | 19.35 | QKAQNALDNL | 0.66 | LKAQNALDNLV | 0.58 |
| NS4A | 2116 | 0.17 | 8 | 2 | 0 | Y | RAQNALDNLVM | 78.66 | KAQNALDNLVM | 1.24 | | | | |
| NS4A | 2117 | 0.08 | 8 | 1 | 0 | Y | AQNALDNLVML | 98.1 | | | | | | |
| NS4A | 2118 | 0.08 | 8 | 1 | 0 | Y | QNALDNLVMLH | 99.26 | | | | | | |
| NS4A | 2119 | 0.08 | 8 | 1 | 0 | Y | NALDNLVMLHN | 99.26 | | | | | | |
| NS4A | 2120 | 0.06 | 6 | 1 | 0 | Y | ALDNLVMLHNS | 99.26 | | | | | | |
| NS4A | 2121 | 0.06 | 5 | 1 | 0 | Y | LDNLVMLHNSE | 99.42 | | | | | | |
| NS4A | 2122 | 0.06 | 5 | 1 | 0 | Y | DNLVMLHNSEQ | 99.42 | | | | | | |
| NS4A | 2123 | 0.06 | 5 | 1 | 0 | Y | NLVMLHNSEQG | 99.42 | | | | | | |
| NS4A | 2124 | 0.06 | 5 | 1 | 0 | Y | LVMLHNSEQGG | 99.42 | | | | | | |
| NS4A | 2125 | 0.86 | 6 | 2 | 0 | Y | VMLHNSEQGGR | 75.19 | VMLHNSEQGGK | 24.23 | | | | |
| NS4A | 2126 | 0.86 | 6 | 2 | 0 | Y | MLHNSEQGGRA | 75.1 | MLHNSEQGGKA | 24.32 | | | | |
| NS4A | 2127 | 0.84 | 6 | 2 | 0 | Y | LHNSEQGGRAY | 75.27 | LHNSEQGGKAY | 24.32 | | | | |
| NS4A | 2128 | 0.84 | 6 | 2 | 0 | Y | HNSEQGGRAYR | 75.19 | HNSEQGGKAYR | 24.48 | | | | |
| NS4A | 2129 | 0.85 | 7 | 2 | 0 | Y | NSEQGGRAYRH | 75.1 | NSEQGGKAYRH | 24.48 | | | | |
| NS4A | 2130 | 0.85 | 7 | 2 | 0 | Y | SEQGGRAYRHA | 75.1 | SEQGGKAYRHA | 24.48 | | | | |
| NS4A | 2131 | 0.93 | 10 | 3 | 0 | Y | EQGGRAYRHAM | 74.19 | EQGGKAYRHAM | 24.4 | EQGGRAYRHAL | 0.74 | | |
| NS4A | 2132 | 0.93 | 10 | 3 | 0 | Y | QGGRAYRHAME | 74.19 | QGGKAYRHAME | 24.4 | QGGRAYRHALE | 0.74 | | |
| NS4A | 2133 | 0.93 | 10 | 3 | 0 | Y | GGRAYRHAMEE | 74.19 | GGKAYRHAMEE | 24.4 | GGRAYRHALEE | 0.74 | | |

FIG. 5-83

Species: DENV1 (11-mers)

| protein | block starting position | entropy | total peptides in block | # peptides required to cover 99% of block | gap/K fraction | 99% of block covered w/ <= 5 peptides? | peptides required to cover 99% of block

FIG. 5-84

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2157 | 0.16 | 10 | 2 | 0 | Y | IAVLTGGVTLF | 98.43 | IAVLTGGVMLF | 0.74 | | | | |
| NS4A | 2158 | 0.16 | 10 | 2 | 0 | Y | AVLTGGVTLFF | 98.43 | AVLTGGVMLFF | 0.74 | | | | |
| NS4A | 2159 | 0.16 | 10 | 2 | 0 | Y | VLTGGVTLFFL | 98.43 | VLTGGVMLFFL | 0.74 | | | | |
| NS4A | 2160 | 0.13 | 10 | 2 | 0 | Y | LTGGVTLFFLS | 98.68 | LTGGVMLFFLS | 0.74 | | | | |
| NS4A | 2161 | 0.13 | 9 | 2 | 0 | Y | TGGVTLFFLSG | 98.68 | TGGVMLFFLSG | 0.74 | | | | |
| NS4A | 2162 | 0.98 | 11 | 3 | 0 | Y | GGVTLFFLSGR | 71.38 | GGVTLFFLSGK | 27.3 | GGVMLFFLSGK | 0.58 | | |
| NS4A | 2163 | 0.98 | 11 | 3 | 0 | Y | GVTLFFLSGRG | 71.38 | GVTLFFLSGKG | 27.3 | GVMLFFLSGKG | 0.58 | | |
| NS4A | 2164 | 0.98 | 11 | 3 | 0 | Y | VTLFFLSGRGL | 71.38 | VTLFFLSGKGL | 27.3 | VMLFFLSGKGL | 0.58 | | |
| NS4A | 2165 | 0.95 | 8 | 3 | 0 | Y | TLFFLSGRGLG | 71.55 | TLFFLSGKGLG | 27.38 | MLFFLSGKGLG | 0.58 | | |
| NS4A | 2166 | 0.88 | 5 | 2 | 0 | Y | LFFLSGRGLGK | 71.79 | LFFLSGKGLGK | 27.96 | | | | |
| NS4A | 2167 | 0.88 | 5 | 2 | 0 | Y | FFLSGRGLGKT | 71.79 | FFLSGKGLGKT | 27.96 | | | | |
| NS4A | 2168 | 0.88 | 5 | 2 | 0 | Y | FLSGRGLGKTS | 71.79 | FLSGKGLGKTS | 27.96 | | | | |
| NS4A | 2169 | 0.87 | 4 | 2 | 0 | Y | LSGRGLGKTSI | 71.88 | LSGKGLGKTSI | 27.96 | | | | |
| NS4A | 2170 | 0.87 | 4 | 2 | 0 | Y | SGRGLGKTSIG | 71.88 | SGKGLGKTSIG | 27.96 | | | | |
| NS4A | 2171 | 0.89 | 5 | 2 | 0 | Y | GRGLGKTSIGL | 71.71 | GKGLGKTSIGL | 27.96 | | | | |
| NS4A | 2172 | 0.89 | 5 | 2 | 0 | Y | RGLGKTSIGLL | 71.71 | KGLGKTSIGLL | 27.96 | | | | |
| NS4A | 2173 | 0.04 | 4 | 1 | 0 | Y | GLGKTSIGLLC | 99.67 | | | | | | |
| NS4A | 2174 | 0.04 | 4 | 1 | 0 | Y | LGKTSIGLLCV | 99.67 | | | | | | |
| NS4A | 2175 | 0.76 | 7 | 3 | 0 | Y | GKTSIGLLCVM | 82.55 | GKTSIGLLCVT | 16.05 | GKTSIGLLCVI | 0.74 | | |
| NS4A | 2176 | 0.89 | 10 | 5 | 0 | Y | KTSIGLLCVMA | 81.64 | KTSIGLLCVTA | 15.22 | KTSIGLLCVTS | 0.83 | KTSIGLLCVIA | 0.74 | KTSIGLLCVMS | 0.74 |
| NS4A | 2177 | 0.89 | 10 | 5 | 0 | Y | TSIGLLCVMAS | 81.64 | TSIGLLCVTAS | 15.22 | TSIGLLCVTSS | 0.83 | TSIGLLCVIAS | 0.74 | TSIGLLCVMSS | 0.74 |
| NS4A | 2178 | 0.89 | 10 | 5 | 0 | Y | SIGLLCVMASS | 81.64 | SIGLLCVTASS | 15.22 | SIGLLCVTSSS | 0.83 | SIGLLCVIASS | 0.74 | SIGLLCVIASS | 0.74 |
| NS4A | 2187 | 1.07 | 14 | 4 | 0 | Y | SSVLLWMASVE | 71.79 | SSVLLWMASVE | 24.9 | SSALLWMANVE | 2.23 | SSVLLWIASVE | 0.17 | |

FIG. 5-85

Species: DENW1 (11-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of

FIG. 5-86

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4A | 2211 | 0.08 | 4 | 1 | 0 | Y | LMVLLIPEPDR | 99.17 | | | | | | | | |
| NS4A | 2212 | 0.09 | 5 | 1 | 0 | Y | MVLLIPEPDRQ | 99.09 | | | | | | | | |

FIG. 5-87

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| 2K | 2234 | 0.22 | 10 | 3 | 0 | Y | VIGLLFMILTV | 97.52 | VIGLLFVILTV | 0.91 | VIGLLFIILTV | 0.91 | | | | |
| 2K | 2235 | 0.22 | 9 | 3 | 0 | Y | IGLLFMILTVA | 97.52 | IGLLFVILTVA | 0.99 | IGLLFVILTVA | 0.91 | | | | |
| 2K | 2236 | 0.21 | 8 | 3 | 0 | Y | GLLFMILTVAA | 97.6 | GLLFIILTVAA | 0.99 | GLLFVILTVAA | 0.91 | | | | |
| 2K | 2237 | 0.21 | 8 | 3 | 0 | Y | LLFMILTVAAN | 97.6 | LLFIILTVAAN | 0.99 | LLFVILTVAAN | 0.91 | | | | |
| 2K | 2238 | 0.21 | 8 | 3 | 0 | Y | LFMILTVAANE | 97.6 | LFIILTVAANE | 0.99 | LFVILTVAANE | 0.91 | | | | |
| 2K | 2239 | 0.21 | 8 | 3 | 0 | Y | FMILTVAANEM | 97.6 | FIILTVAANEM | 0.99 | FVILTVAANEM | 0.91 | | | | |
| 2K | 2240 | 0.21 | 8 | 3 | 0 | Y | MILTVAANEMG | 97.6 | IILTVAANEMG | 0.99 | VILTVAANEMG | 0.91 | | | | |
| 2K | 2241 | 0.05 | 5 | 1 | 0 | Y | ILTVAANEMGL | 99.59 | | | | | | | | |
| 2K | 2242 | 0.05 | 5 | 1 | 0 | Y | LTVAANEMGLL | 99.59 | | | | | | | | |
| 2K | 2243 | 0.05 | 5 | 1 | 0 | Y | TVAANEMGLLE | 99.59 | | | | | | | | |
| 2K | 2244 | 0.03 | 4 | 1 | 0 | Y | VAANEMGLLET | 99.75 | | | | | | | | |
| 2K | 2245 | 0.02 | 3 | 1 | 0 | Y | AANEMGLLETT | 99.83 | | | | | | | | |
| 2K | 2246 | 0.02 | 3 | 1 | 0 | Y | ANEMGLLETTK | 99.83 | | | | | | | | |
| 2K | 2247 | 0.04 | 4 | 1 | 0 | Y | NEMGLLETTKK | 99.59 | | | | | | | | |
| NS4B | 2248 | 0.03 | 3 | 1 | 0 | Y | EMGLLETTKKD | 99.67 | | | | | | | | |
| NS4B | 2249 | 0.03 | 3 | 1 | 0 | Y | M

FIG. 5-88

Species: DENV1 (11

FIG. 5-89

Species: DENV1 (11-mers)

| protein | block starting position

FIG. 5-90

Species: DENV1 (11-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2320 | 0.03 | 3 | 1 | 0 | Y | AILMGLDKGWP | 99.67 | | |
| NS4B | 2321 | 0.03 | 3 | 1 | 0 | Y | ILMGLDKGWPI | 99.67 | | |
| NS4B | 2322 | 0.03 | 3 | 1 | 0 | Y | LMGLDKGWPIS | 99.67 | | |
| NS4B | 2323 | 0.04 | 4 | 1 | 0 | Y | MGLDKGWPISK | 99.59 | | |
| NS4B | 2324 | 0.04 | 4 | 1 | 0 | Y | GLDKGWPISKM | 99.59 | | |
| NS4B | 2325 | 0.04 | 4 | 1 | 0 | Y | LDKGWPISKMD | 99.59 | | |
| NS4B | 2326 | 0.12 | 6 | 2 | 0 | Y | DKGWPISKMDI | 98.68 | DKGWPISKMDL | 0.83 |
| NS4B | 2327 | 0.1 | 5 | 2 | 0 | Y | KGWPISKMDIG | 98.92 | KGWPISKMDLG | 0.83 |
| NS4B | 2328 | 0.1 | 5 | 2 | 0 | Y | GWPISKMDIGV | 98.92 | GWPISKMDLGV | 0.83 |
| NS4B | 2329 | 0.1 | 5 | 2 | 0 | Y | WPISKMDIGVP | 98.92 | WPISKMDLGVP | 0.83 |
| NS4B | 2330 | 0.1 | 5 | 2 | 0 | Y | PISKMDIGVPL | 98.92 | PISKMDLGVPL | 0.83 |
| NS4B | 2331 | 0.1 | 5 | 2 | 0 | Y | ISKMDIGVPLL | 98.92 | ISKMDLGVPLL | 0.83 |
| NS4B | 2332 | 0.09 | 4 | 2 | 0 | Y | SKMDIGVPLLA | 99.01 | | |
| NS4B | 2333 | 0.1 | 5 | 2 | 0 | Y | KMDIGVPLLAL | 98.92 | KMDLGVPLLAL | 0.83 |
| NS4B | 2334 | 0.09 | 4 | 1 | 0 | Y | MDIGVPLLALG | 99.01 | | |
| NS4B | 2335 | 0.09 | 4 | 1 | 0 | Y | DIGVPLLALGC | 99.01 | | |
| NS4B | 2336 | 0.09 | 4 | 1 | 0 | Y | IGVPLLALGCY | 99.01 | | |
| NS4B | 2337 | 0.01 | 2 | 1 | 0 | Y | GVPLLALGCYS | 99.92 | | |
| NS4B | 2338 | 0.01 | 2 | 1 | 0 | Y | VPLLALGCYSQ | 99.92 | | |
| NS4B | 2339 | 0.01 | 2 | 1 | 0 | Y | PLLALGCYSQV | 99.92 | | |
| NS4B | 2340 | 0.01 | 2 | 1 | 0 | Y | LLALGCYSQVN | 99.92 | | |
| NS4B | 2341 | 0.01 | 2 | 1 | 0 | Y | LALGCYSQVNP | 99.92 | | |
| NS4B | 2342 | 0.01 | 2 | 1 | 0 | Y | ALGCYSQVNPL | 99.92 | | |

FIG. 5-91

Species: DENV1 (11-mers)

| protein | block starting position | block entropy | total peptides in block | # peptides required to cover 99% of block | gap/X fraction | 99% of block covered w

FIG. 5-93

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block |

FIG. 5-94

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2412 | 0.12 | 5 | 2 | 0 | Y | EKQLGQIMLLI | 98.68 | EKQLGQVMLLI | 0.74 |
| NS4B | 2413 | 0.12 | 5 | 2 | 0 | Y | KQLGQIMLLIL | 98.68 | KQLGQVMLLIL | 0.74 |
| NS4B | 2414 | 0.13 | 6 | 2 | 0 | Y | QLGQIMLLILC | 98.59 | QLGQVMLLILC | 0.74 |
| NS4B | 2415 | 0.13 | 6 | 2 | 0 | Y | LGQIMLLILCT | 98.59 | LGQVMLLILCT | 0.74 |
| NS4B | 2416 | 0.14 | 7 | 2 | 0 | Y | GQIMLLILCTS | 98.51 | GQVMLLILCTS | 0.74 |
| NS4B | 2417 | 0.14 | 7 | 2 | 0 | Y | QIMLLILCTSQ | 98.51 | QVMLLILCTSQ | 0.74 |
| NS4B | 2418 | 0.14 | 7 | 2 | 0 | Y | IMLLILCTSQI | 98.51 | VMLLILCTSQI | 0.74 |
| NS4B | 2419 | 0.08 | 6 | 1 | 0 | Y | MLLILCTSQIL | 99.26 | | |
| NS4B | 2420 | 0.08 | 6 | 1 | 0 | Y | LLILCTSQILL | 99.26 | | |
| NS4B | 2421 | 0.08 | 6 | 1 | 0 | Y | LILCTSQILLM | 99.26 | | |
| NS4B | 2422 | 0.08 | 6 | 1 | 0 | Y | ILCTSQILLMR | 99.26 | | |
| NS4B | 2423 | 0.03 | 4 | 1 | 0 | Y | LCTSQILLMRT | 99.75 | | |
| NS4B | 2424 | 0.03 | 4 | 1 | 0 | Y | CTSQILLMRTT | 99.75 | | |
| NS4B | 2425 | 0.02 | 3 | 1 | 0 | Y | TSQILLMRTTW | 99.83 | | |
| NS4B | 2426 | 0.02 | 3 | 1 | 0 | Y | SQILLMRTTWA | 99.83 | | |
| NS4B | 2427 | 0.01 | 2 | 1 | 0 | Y | QILLMRTTWAL | 99.92 | | |
| NS4B | 2428 | 0.02 | 3 | 1 | 0 | Y | ILLMRTTWALC | 99.83 | | |
| NS4B | 2429 | 0.02 | 3 | 1 | 0 | Y | LLMRTTWALCE | 99.83 | | |
| NS4B | 2430 | 0.02 | 3 | 1 | 0 | Y | LMRTTWALCES | 99.83 | | |
| NS4B | 2431 | 0.02 | 3 | 1 | 0 | Y | MRTTWALCESI | 99.83 | | |
| NS4B | 2432 | 0.02 | 3 | 1 | 0 | Y | RTTWALCESIT | 99.83 | | |
| NS4B | 2433 | 0.02 | 3 | 1 | 0 | Y | TTWALCESITL | 99.83 | | |
| NS4B | 2434 | 0.02 | 3 | 1 | 0 | Y | TWALCESITLA | 99.83 | | |

FIG. 5-95

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS4B | 2435 | 0.05 | 5 | 1 | 0 | Y | WALCESITLAT | 99.59 |
| NS4B | 2436 | 0.05 | 5 | 1 | 0 | Y | ALCESITLATG | 99.59 |
| NS4B | 2437 | 0.05 | 5 | 1 | 0 | Y | LCESITLATGP | 99.59 |
| NS4B | 2438 | 0.05 | 5 | 1 | 0 | Y | CESITLATGPL | 99.59 |
| NS4B | 2439 |

FIG. 5-96

Species: DENV1 (11-mers)

| protein | block starting position | entropy block

FIG. 5-97

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS4B | 2481 | 0.05 | 5 | 1 | 0 | Y | GLAFSLMKSLG | 99.59 |
| NS4B | 2482 | 0.03 | 4 | 1 | 0 | Y | LAFSLMKSLGG | 99.75 |
| NS4B | 2483 | 0.05 | 5 | 1 | 0 | Y | AFSLMKSLGGG | 99.5 |
| NS4B | 2484 | 0.05 | 5 | 1 | 0 | Y | FSLMKSLGGGR | 99.5 |
| NS4B | 2485 | 0.05 | 5 | 1 | 0 | Y | SLMKSLGGGRR | 99.5 |
| NS4B | 2486 | 0.06 | 6 | 1 | 0 | Y | LMKSLGGGRRG | 99.42 |
| NS4B | 2487 | 0.05 | 5 | 1 | 0 | Y | MKSLGGGRRGT | 99.5 |
| NS4B | 2488 | 0.05 | 5 | 1 | 0 | Y | KSLGGGRRGTG | 99.5 |
| NS4B | 2489 | 0.05 | 5 | 1 | 0 | Y | SLGGGRRGTGA | 99.5 |
| NS4B | 2490 | 0.09 | 8 | 1 | 0 | Y | LGGGRRGTGAQ | 99.17 |
| NS4B | 2491 | 0.09 | 8 | 1 | 0 | Y | GGGRRGTGAQG | 99.17 |
| NS4B | 2492 | 0.09 | 8 | 1 | 0 | Y | GGRRGTGAQGE | 99.17 |
| NS4B | 2493 | 0.08 | 7 | 1 | 0 | Y | GRRGTGAQGET | 99.26 |
| NS4B | 2494 | 0.06 | 6 | 1 | 0 | Y | RRGTGAQGETL | 99.5 |
| NS4B | 2495 | 0.06 | 6 | 1 | 0 | Y | RGTGAQGETLG | 99.5 |
| NS4B | 2496 | 0.06 | 6 | 1 | 0 | Y | GTGAQGETLGE | 99.5 |
| NS4B | 2497 | 0.05 | 5 | 1 | 0 | Y | TGAQGETLGEK | 99.59 |
| NS4B | 2498 | 0.05 | 5 | 1 | 0 | Y | GAQGETLGEKW | 99.59 |
| NS5 | 2499 | 0.05 | 5 | 1 | 0 | Y | AQGETLGEKWK | 99.59 |
| NS5 | 2500 | 0.05 | 5 | 1 | 0 | Y | QGETLGEKWKR | 99.59 |
| NS5 | 2501 | 0.03 | 3 | 1 | 0 | Y | GETLGEKWKRQ | 99.75 |
| NS5 | 2502 | 0.03 | 3 | 1 | 0 | Y | ETLGEKWKRQL | 99.75 |
| NS5 | 2503 | 0.03 | 3 | 1 | 0 | Y | TLGEKWKRQLN | 99.75 |

FIG. 5-98

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2504 | 0.03 | 3 | 1 | 0 | Y | LGEK

FIG. 5-99

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequ

FIG. 5-100

Species: DENV1 (11-mers)

| protein | block starting position | block entropy | total peptides in block | # peptides required to cover 99% of block | gap/X fraction | 99% of block covered w/ <= 5 peptides? | peptides required

FIG. 5-101

Species: DENV1 (11

FIG. 5-102

Species: DENV1 (11-mers)

| protein | block starting position | block entropy | total peptides in block | # peptides required to cover 99% of block | gap/X fraction | 99% of block covered w/ <= 5 peptides? | peptides required

FIG. 5-103

Species: DENV1 (11-mers)

| protein | block starting position | block entropy | total peptides in block | # peptides required to cover 99% of block | gap/X fraction | 99% of block covered w

FIG. 5-105

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | fr

FIG. 5-106

Species: DENV1 (11-mers)

| protein | block starting position | block entropy | total peptides in block | # peptides required to cover 99% of block | gap/X fraction | 99% of block covered w

FIG. 5-107

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2725 | 0.03 | 3 | 1 | 0 | Y | SAVNMTSR

FIG. 5-108

Species: DENV1 (11-mers)

| protein | block starting position | block entropy | total peptides in block | # peptides required to cover 99% of block | gap/X fraction | 99% of block covered w/ <= 5 peptides?

FIG. 5-109

Species: DENV1 (11-mers)

| protein | block starting position | block entropy | total peptides in block | # peptides required to cover 99% of block | gap/X f

FIG. 5-111

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2820 | 0.85 | 5 | 2 | 0 | Y | VKLLTKPWDVI | 74.69 | VRLLTKPWDVI | 24.98 |
| NS5 | 2821 | 0.85 | 6 | 2 | 0 | Y | KLLTKPWDVIP | 74.69 | RLLTKPWDVIP | 24.9 |
| NS5 | 2822 | 0.05 | 5 | 1 | 0 | Y | LLTKPWDVIPM | 99.59 | | |
| NS5 | 2823 | 0.05 | 5 | 1 | 0.1 | Y | LTKPWDVIPMV | 99.5 | | |
| NS5 | 2824 | 0.06 | 6 | 1 | 0.1 | Y | TKPWDVIPMVT | 99.42 | | |
| NS5 | 2825 | 0.06 | 6 | 1 | 0.1 | Y | KPWDVIPMVTQ | 99.42 | | |
| NS5 | 2826 | 0.1 | 8 | 1 | 0.1 | Y | PWDVIPMVTQI | 99.01 | | |
| NS5 | 2827 | 0.11 | 9 | 1 | 0.1 | Y | WDVIPMVTQIA | 98.92 | | |
| NS5 | 2828 | 0.11 | 9 | 1 | 0.1 | Y | DVIPMVTQIAM | 98.92 | | |
| NS5 | 2829 | 0.11 | 9 | 1 | 0.1 | Y | VIPMVTQIAMT | 98.92 | | |
| NS5 | 2830 | 0.09 | 8 | 1 | 0.2 | Y | IPMVTQIAMTD | 99.09 | | |
| NS5 | 2831 | 0.08 | 6 | 1 | 0.2 | Y | PMVTQIAMTDT | 99.09 | | |
| NS5 | 2832 | 0.07 | 5 | 1 | 0.2 | Y | MVTQIAMTDTT | 99.17 | | |
| NS5 | 2833 | 0.07 | 5 | 1 | 0.1 | Y | VTQIAMTDTTP | 99.17 | | |
| NS5 | 2834 | 0.08 | 6 | 1 | 0.2 | Y | TQIAMTDTTPF | 99.17 | | |
| NS5 | 2835 | 0.07 | 5 | 1 | 0.2 | Y | QIAMTDTTPFG | 99.26 | | |
| NS5 | 2836 | 0.06 | 4 | 1 | 0.2 | Y | IAMTDTTPFGQ | 99.26 | | |
| NS5 | 2837 | 0.01 | 2 | 1 | 0.2 | Y | AMTDTTPFGQQ | 99.75 | | |
| NS5 | 2838 | 0 | 1 | 1 | 0.2 | Y | MTDTTPFGQQR | 99.83 | | |
| NS5 | 2839 | 0 | 1 | 1 | 0.2 | Y | TDTTPFGQQRV | 99.83 | | |
| NS5 | 2840 | 0.01 | 2 | 1 | 0.2 | Y | DTTPFGQQRVF | 99.75 | | |
| NS5 | 2841 | 0.02 | 3 | 1 | 0.2 | Y | TTPFGQQRVFK | 99.67 | | |
| NS5 | 2842 | 0.03 | 4 | 1 | 0.1 | Y | TPFGQQRVFKE | 99.67 | | |

FIG. 5-112

Species: DENV1 (11-mers)

| protein | block starting position | block entropy | total

FIG. 5-113

Species: DENV1 (11-mers)

| protein | block starting position | block

FIG. 5-115

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 5-116

Species: DENV1 (

FIG. 5-117

Species: DENV1 (11-mers)

| protein | block starting position | block entropy | total pe

FIG. 5-118

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2994 | 0.21 | 5 | 2 | 0 | Y | SRENSLSGVEG | 97.11 | SRENSFSGVEG | 2.48 | | | | | | |
| NS5 | 2995 | 0.19 | 5 | 2 | 0 | Y | RENSLSGVEGE | 97.35 | RENSFSGVEGE | 2.4 | | | | | | |
| NS5 | 2996 | 0.19 | 5 | 2 | 0 | Y | ENSLSGVEGEG | 97.35 | ENSFSGVEGEG | 2.4 | | | | | | |
| NS5 | 2997 | 0.18 | 4 | 2 | 0 | Y | NSLSGVEGEGL | 97.44 | NSFSGVEGEGL | 2.4 | | | | | | |
| NS5 | 2998 | 0.18 | 4 | 2 | 0 | Y | SLSGVEGEGLH | 97.44 | SFSGVEGEGLH | 2.4 | | | | | | |
| NS5 | 2999 | 0.26 | 5 | 3 | 0 | Y | LSGVEGEGLHK | 96.53 | FSGVEGEGLHK | 2.4 | LSGVEGEGLHR | 0.91 | | | | |
| NS5 | 3000 | 0.09 | 4 | 2 | 0 | Y | SGVEGEGLHKL | 98.92 | SGVEGEGLHRL | 0.91 | | | | | | |
| NS5 | 3001 | 0.09 | 4 | 2 | 0 | Y | GVEGEGLHKLG | 98.92 | GVEGEGLHRLG | 0.91 | | | | | | |
| NS5 | 3002 | 0.09 | 4 | 2 | 0 | Y | VEGEGLHKLGY | 98.92 | VEGEGLHRLGY | 0.91 | | | | | | |
| NS5 | 3003 | 0.09 | 4 | 2 | 0 | Y | EGEGLHKLGYI | 98.92 | EGEGLHRLGYI | 0.91 | | | | | | |
| NS5 | 3004 | 0.09 | 4 | 2 | 0 | Y | GEGLHKLGYIL | 98.92 | GEGLHRLGYIL | 0.91 | | | | | | |
| NS5 | 3005 | 0.09 | 4 | 2 | 0 | Y | EGLHKLGYILR | 98.92 | EGLHRLGYILR | 0.91 | | | | | | |
| NS5 | 3006 | 0.1 | 5 | 2 | 0 | Y | GLHKLGYILRD | 98.92 | GLHRLGYILRD | 0.91 | | | | | | |
| NS5 | 3007 | 0.1 | 5 | 2 | 0 | Y | LHKLGYILRDI | 98.92 | LHRLGYILRDI | 0.91 | | | | | | |
| NS5 | 3008 | 0.1 | 5 | 2 | 0 | Y | HKLGYILRDIS | 98.92 | HRLGYILRDIS | 0.91 | | | | | | |
| NS5 | 3009 | 0.37 | 7 | 4 | 0 | Y | KLGYILRDISK | 94.95 | KLGYILRDISN | 2.89 | KLGYILRDISR | 1.08 | RLGYILRDISK | 0.83 | | |
| NS5 | 3010 | 0.3 | 5 | 3 | 0 | Y | LGYILRDISKI | 95.78 | LGYILRDISNI | 2.89 | LGYILRDISRI | 1.08 | | | | |
| NS5 | 3011 | 0.36 | 6 | 3 | 0 | Y | GYILRDISKIP | 95.04 | GYILRDISNIP | 2.89 | GYILRDISRIP | 1.08 | | | | |
| NS5 | 3012 | 0.36 | 6 | 3 | 0 | Y | YILRDISKIPG | 95.04 | YILRDISNIPG | 2.89 | YILRDISRIPG | 1.08 | | | | |
| NS5 | 3013 | 0.36 | 6 | 3 | 0 | Y | ILRDISKIPGG | 95.04 | ILRDISNIPGG | 2.89 | ILRDISRIPGG | 1.08 | | | | |
| NS5 | 3014 | 0.43 | 7 | 4 | 0 | Y | LRDISKIPGGN | 94.29 | LRDISNIPGGN | 2.89 | LRDISRIPGGN | 1.08 | LRDISKIPGGS | 0.74 | | |
| NS5 | 3015 | 0.46 | 9 | 5 | 0 | Y | RDISKIPGGNM | 93.96 | RDISNIPGGNM | 2.89 | RDISRIPGGNM | 1.08 | RDISKISGGNM | 0.74 | RDISKIPGGSM | 0.74 |
| NS5 | 3016 | 0.46 | 9 | 5 | 0 | Y | DISKIPGGNMY | 93.96 | DISNIPGGNMY | 2.89 | DISRIPGGNMY | 1.08 | DISKISGGNMY | 0.74 | DISKIPGGSMY | 0.74 |

FIG. 5-119

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block |

FIG. 5-120

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 5-121

Species: DENV1 (11-mers)

| protein | block starting position | block entropy | total peptides in block | # peptides required to cover 99% of block | gap/X fraction | 99% of block covered w/ <= 5 peptides? | peptides required

FIG. 5-122

Species: DENV1 (11-mers)

| protein | block starting position | block entropy | total peptides in block | # peptides required to cover 99% of block | gap/X fraction | 99% of block covered w/ <= 5

FIG. 5-123

Species: DENV1 (11-mers)

| protein | block starting position | block entropy | total peptides in block | # peptides required to cover 99% of block | gap/X fraction | 99% of block covered w/ <= 5 peptides? | peptides required

FIG. 5-124

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3163 | 0.58 | 11 | 4 | 0 | Y | KPIDDRFATAL | 91.32 | KPTDDRFATAL | 4.22 | KPVDDRFATAL | 3.23 | KPIDDRFAAAL | 0.66 |
| NS5 | 3164 | 0.47 | 10 | 4 | 0 | Y | DDRFATALTAL | 93.22 | DDRFATALIAL | 4.14 | DDRFATALSAL | 1.41 | DDRFAAALTAL | 0.74 |
| NS5 | 3165 | 0.47 | 10 | 4 | 0 | Y | DRFATALTALN | 93.22 | DRFATALIALN | 4.14 | DRFATALSALN | 1.41 | DRFAAALTALN | 0.74 |
| NS5 | 3166 | 0.49 | 11 | 4 | 0 | Y | RFATALTALND | 93.05 | RFATALIALND | 4.22 | RFATALSALND | 1.41 | RFAAALTALND | 0.74 |
| NS5 | 3167 | 0.49 | 11 | 4 | 0 | Y | FATALTALNDM | 93.05 | FATALIALNDM | 4.22 | FATALSALNDM | 1.41 | FAAALTALNDM | 0.74 |
| NS5 | 3168 | 0.49 | 11 | 4 | 0 | Y | ATALTALNDMG | 93.05 | ATALIALNDMG | 4.22 | ATALSALNDMG | 1.41 | AAALTALNDMG | 0.74 |
| NS5 | 3169 | 0.49 | 11 | 4 | 0 | Y | TALTALNDMGK | 93.05 | TALIALNDMGK | 4.22 | TALSALNDMGK | 1.41 | AALTALNDMGK | 0.74 |
| NS5 | 3170 | 0.41 | 8 | 3 | 0 | Y | ALTALNDMGKV | 93.88 | ALIALNDMGKV | 4.22 | ALSALNDMGKV | 1.41 | | |
| NS5 | 3171 | 0.4 | 7 | 3 | 0 | Y | LTALNDMGKVR | 93.96 | LIALNDMGKVR | 4.22 | LSALNDMGKVR | 1.41 | | |
| NS5 | 3172 | 0.4 | 7 | 3 | 0 | Y | TALNDMGKVRK | 93.96 | IALNDMGKVRK | 4.22 | SALNDMGKVRK | 1.41 | | |
| NS5 | 3173 | 0.04 | 4 | 1 | 0 | Y | ALNDMGKVRKD | 99.67 | | | | | | |
| NS5 | 3174 | 0.16 | 6 | 2 | 0 | Y | LNDMGKVRKDI | 98.01 | LNDMGKVRKDV | 1.57 | | | | |
| NS5 | 3175 | 0.17 | 7 | 2 | 0 | Y | NDMGKVRKDIP | 97.93 | NDMGKVRKDVP | 1.57 | | | | |
| NS5 | 3176 | 0.17 | 7 | 2 | 0 | Y | DMGKVRKDIPQ | 97.93 | DMGKVRKDVPQ | 1.57 | | | | |
| NS5 | 3177 | 0.15 | 5 | 2 | 0 | Y | MGKVRKDIPQW | 98.1 | MGKVRKDVPQW | 1.57 | | | | |
| NS5 | 3178 | 0.15 | 5 | 2 | 0 | Y | GKVRKDIPQWE | 98.1 | GKVRKDVPQWE | 1.57 | | | | |
| NS5 | 3179 | 0.15 | 5 | 2 | 0 | Y | KVRKDIPQWEP | 98.1 | KVRKDVPQWEP | 1.57 | | | | |
| NS5 | 3180 | 0.15 | 5 | 2 | 0 | Y | VRKDIPQWEPS | 98.1 | VRKDVPQWEPS | 1.57 | | | | |
| NS5 | 3181 | 0.15 | 5 | 2 | 0 | Y | RKDIPQWEPSK | 98.18 | RKDVPQWEPSK | 1.57 | | | | |
| NS5 | 3182 | 0.15 | 5 | 2 | 0 | Y | KDIPQWEPSKG | 98.18 | KDVPQWEPSKG | 1.57 | | | | |
| NS5 | 3183 | 0.15 | 5 | 2 | 0 | Y | DIPQWEPSKGW | 98.18 | DVPQWEPSKGW | 1.57 | | | | |
| NS5 | 3184 | 0.15 | 5 | 2 | 0 | Y | IPQWEPSKGWN | 98.18 | VPQWEPSKGWN | 1.57 | | | | |
| NS5 | 3185 | 0.04 | 4 | 1 | 0 | Y | PQWEPSKGWND | 99.67 | | | | | | |

FIG. 5-125

Species: DENV1 (11-mers)

| protein | block starting position | block entropy | total

FIG. 5-126

Species: DENV1 (11-mers)

| protein | block starting position | entropy block | total peptides in block | # peptides required to cover 99% of block | gap/X fraction | 99% of block covered w/ =< 5 peptides? | peptides required to cover 99% of block | frequency |
|---|---|---|---|---|---|---|---|---|

FIG. 5-127

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 |

FIG. 5-129

Species: DEN V1 (11-mers)

| protein | block starting position | block entropy | total peptides in block | # peptides required to cover 99% of block |

FIG. 5-130

Species: DENV1 (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3311 | 0.03 | 4 | 1 | 0 | Y | VWIEENPWMED | 99.75 | | | | | | |
| NS5 | 3312 | 0.03 | 4 | 1 | 0 | Y | WIEENPWMEDK | 99.75 | | | | | | |
| NS5 | 3313 | 0.03 | 4 | 1 | 0 | Y | IEENPWMEDKT | 99.75 | | | | | | |
| NS5 | 3314 | 0.22 | 7 | 2 | 0 | Y | EENPWMEDKTH | 97.02 | EENPWMEDKTR | 2.56 | | | | |
| NS5 | 3315 | 1.16 | 7 | 3 | 0 | Y | ENPWMEDKTHI | 57.82 | ENPWMEDKTHV | 39.29 | ENPWMEDKTRI | 2.56 | | |
| NS5 | 3316 | 1.17 | 8 | 3 | 0 | Y | NPWMEDKTHIS | 57.82 | NPWMEDKTHVS | 39.12 | NPWMEDKTRIS | 2.56 | | |
| NS5 | 3317 | 1.18 | 9 | 3 | 0 | Y | PWMEDKTHISS | 57.73 | PWMEDKTHVSS | 39.12 | PWMEDKTRISS | 2.56 |

FIG. 5-131

Species: DENV1 (11-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3339 | 0.01 | 2 | 1 | 0 | Y | DQWCGS

FIG. 5-132

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3362 | 0.29 | 7 | 2 | 0 | Y | INQVRLLIGNE | 95.78 | INQVRRLLGNE | 3.64 | | | | |
| NS5 | 3363 | 0.29 | 7 | 2 | 0 | Y | NQVRRLLGNEN | 95.78 | NQVRRLLGNEN | 3.64 | | | | |
| NS5 | 3364 | 0.24 | 4 | 2 | 0 | Y | QVRRLLGNENY | 96.2 | QVRRLLGNENY | 3.64 | | | | |
| NS5 | 3365 | 0.43 | 6 | 3 | 0 | Y | VRRLLGNENYL | 93.47 | VRRLLGNENYL | 3.64 | | | | |
| NS5 | 3366 | 0.44 | 7 | 3 | 0 | Y | RRLIGNENYLD | 93.38 | RRLLGNENYLD | 3.64 | | | | |
| NS5 | 3367 | 0.51 | 10 | 4 | 0 | Y | RLIGNENYLDY | 92.56 | RLLGNENYLDY | 3.64 | VRRLLGNENYS | 2.65 | RLIGNENYLDF | 0.66 | |
| NS5 | 3368 | 0.51 | 10 | 4 | 0 | Y | LIGNENYLDYM | 92.56 | LLGNENYLDYM | 3.64 | RRLIGNENYSD | 2.65 | LIGNENYLDFM | 0.66 | |
| NS5 | 3369 | 0.6 | 13 | 5 | 0 | Y | IGNENYLDYMT | 91.73 | LGNENYLDYMT | 3.64 | RLIGNENYSDY | 2.65 | IGNENYLDFMT | 0.66 | IGNENYLDYMI 0.58 |
| NS5 | 3370 | 0.38 | 12 | 4 | 0 | Y | GNENYLDYMTS | 95.37 | GNENYLDYMTS | 2.48 | LIGNENYSDYM | 2.65 | GNENYLDFMTS | 0.58 | |
| NS5 | 3371 | 0.38 | 13 | 4 | 0 | Y | NENYLDYMTSM | 95.37 | NENYSDYMTSM | 2.48 | IGNENYSDYMT | 2.48 | NENYLDFMTSM | 0.58 | |
| NS5 | 3372 | 0.39 | 13 | 4 | 0 | Y | ENYLDYMTSMK | 95.29 | ENYSDYMTSMK | 2.48 | GNENYSDYMTS | 0.66 | ENYLDFMTSMK | 0.58 | |
| NS5 | 3373 | 0.38 | 12 | 4 | 0 | Y | NYLDYMTSMKR | 95.37 | NYSDYMTSMKR | 2.48 | NENYLDFMTSM | 0.66 | NYLDYMISMKR | 0.58 | |
| NS5 | 3374 | 0.38 | 12 | 4 | 0 | Y | YLDYMTSMKRF | 95.37 | YSDYMTSMKRF | 2.48 | ENYLDFMTSMK | 0.66 | YLDYMISMKRF | 0.58 | |
| NS5 | 3375 | 0.38 | 12 | 4 | 0 | Y | LDYMTSMKRFK | 95.37 | SDYMTSMKRFK | 2.48 | NYLDFMTSMKR | 0.66 | LDYMISMKRFK | 0.58 | |
| NS5 | 3376 | 0.22 | 10 | 3 | 0 | Y | DYMTSMKRFKN | 97.68 | DYMTSMKRFKN | 0.74 | YLDFMTSMKRF | 0.66 | | | |
| NS5 | 3377 | 0.28 | 11 | 4 | 0 | Y | YMTSMKRFKNE | 97.02 | YMISMKRFKNE | 0.74 | LDFMTSMKRFK | 0.66 | FMTSMKRFKNE | 0.66 | |
| | | | | | | | | | | | DFMTSMKRFKN | 0.66 | | | |
| | | | | | | | | | | | YMTSMKRFKND | 0.74 | | | |

FIG. 6-1

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 1 | 0.1 | 6 | 1 | 0 | Y | MNNQR

FIG. 6-2

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | pept

FIG. 6-4

Species: DENV2 (8-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 82 | 0.09 | 3 | 1 | 0 | Y | RGFRKEIG | 99.04 | | | | | | |
| anC | 83 | 0.07 | 3 | 1 | 0 | Y | GFRKEIGR | 99.16 | | | | | | |
| anC | 84 | 0.07 | 3 | 1 | 0 | Y | FRKEIGRM | 99.16 | | | | | | |
| anC | 85 | 0.09 | 4 | 1 | 0 | Y | RKEIGRML | 99.04 | | | | | | |
| anC | 86 | 0.1 | 5 | 2 | 0 | Y | KEIGRMLN | 98.92 | | | | | | |
| anC | 87 | 0.04 | 4 | 1 | 0 | Y | EIGRMLNI | 99.64 | REIGRMLN | 0.72 | | | | |
| anC | 88 | 0.05 | 5 | 1 | 0 | Y | IGRMLNIL | 99.52 | | | | | | |
| anC | 89 | 0.07 | 6 | 1 | 0 | Y | GRMLNILN | 99.4 | | | | | | |
| anC | 90 | 0.42 | 7 | 2 | 0 | Y | RMLNILNR | 92.81 | RMLNILNK | 6.59 | | | | |
| anC | 91 | 0.4 | 6 | 2 | 0 | Y | MLNILNRR | 92.93 | MLNILNKR | 6.59 | | | | |
| anC | 92 | 0.42 | 7 | 2 | 0 | Y | LNILNRRR | 92.81 | LNILNKRR | 6.59 | | | | |
| anC | 93 | 0.4 | 6 | 3 | 0 | Y | NILNRRRR | 92.93 | NILNKRRR | 6.59 | | | | |
| anC | 94 | 1.26 | 6 | 5 | 0 | Y | ILNRRRRT | 60.36 | ILNRRRRS | 32.69 | ILNKRRRT | 6.59 | | |
| anC | 95 | 1.53 | 9 | 5 | 0 | Y | LNRRRRTA | 58.56 | LNRRRRSA | 29.82 | LNKRRRTA | 6.59 | LNRRRRSV | 2.87 | LNRRRRTV | 1.56 |
| anC | 96 | 1.54 | 10 | 4 | 0 | Y | NRRRRTAG | 58.56 | NRRRRSAG | 29.7 | NKRRRTAG | 6.59 | NRRRRSVG | 2.87 | NRRRRTVG | 1.56 |
| anC | 109 | 1.27 | 7 | 4 | 0 | Y | IPTAMAFH | 51.86 | IPTYMAFH | 43.95 | IPTYWAFH | 2.51 | IPTAIAFH | 0.84 | | |
| anC | 110 | 1.24 | 6 | 4 | 0 | Y | PTAMAFHL | 51.86 | PTYMAFHL | 44.43 | PTYWAFHL | 2.51 | PTAIAFHL | 0.84 | | |
| anC | 111 | 1.24 | 6 | 4 | 0 | Y | TAMAFHLT | 51.86 | TYMAFHLT | 44.43 | TYWAFHLT | 2.51 | TAIAFHLT | 0.84 | | |
| anC | 112 | 1.24 | 6 | 4 | 0 | Y | AMAFHLTR | 51.86 | YMAFHLTR | 44.43 | YWAFHLT | 2.51 | AIAFHLT | 0.84 | | |
| anC | 113 | 0.28 | 5 | 3 | 0 | Y | MAFHLTTR | 96.29 | VAFHLTTR | 2.51 | IAFHLTR | 0.84 | | | | |
| anC | 114 | 0.04 | 3 | 1 | 0 | Y | AFHLTTRN | 99.64 | | | | | | |
| prM | 115 | 0.02 | 2 | 1 | 0 | Y | FHLTRNG | 99.76 | | | | | | |
| prM | 116 | 0.02 | 2 | 1 | 0 | Y | HLTRNGE | 99.76 | | | | | | |
| prM | 117 | 0.02 | 2 | 1 | 0 | Y | LTRNGEP | 99.76 | | | | | | |
| prM | 118 | 0.02 | 2 | 1 | 0 | Y | TRNGEPH | 99.76 | | | | | | |

FIG. 6-5

Species: DENV2 (8-mers)

| protein | block starting position | block entropy | total peptides in block | # peptides required to cover 99% of block | gap/X fraction | 99% of block covered w/ <=5 peptides? | peptides required to cover 99% of block | frequ

FIG. 6-6

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 149 | 1.05 | 4 | 2 | 0 | Y | TLMAIDLG | 53.41 | TLMAMDLG | 45.99 | | | | |
| prM | 150 | 1.05 | 4 | 2 | 0 | Y | LMAIDLGE | 53.41 | LMAMDLGE | 45.99 | | | | |
| prM | 151 | 1.05 | 4 | 2 | 0 | Y | MAIDLGEL | 53.41 | MAMDLGEL | 45.99 | | | | |
| prM | 152 | 1.05 | 4 | 2 | 0 | Y | AIDLGELC | 53.41 | AMDLGELC | 45.99 | | | | |
| prM | 153 | 1.05 | 3 | 1 | 0 | Y | IDLGELCE | 53.41 | MDLGELCE | 45.99 | | | | |
| prM | 154 | 0.03 | 3 | 1 | 0 | Y | DLGELCED | 99.76 | | | | | | |
| prM | 155 | 0.03 | 3 | 2 | 0 | Y | LGELCEDT | 99.76 | | | | | | |
| prM | 156 | 0.12 | 3 | 2 | 0 | Y | GELCEDTI | 98.44 | GELCEDTV | 1.44 | | | | |
| prM | 157 | 0.12 | 3 | 2 | 0 | Y | ELCEDTIT | 98.44 | ELCEDTVT | 1.44 | | | | |
| prM | 158 | 0.12 | 3 | 3 | 0 | Y | LCEDTITY | 98.44 | LCEDTVTY | 1.44 | | | | |
| prM | 159 | 0.47 | 5 | 3 | 0 | Y | CEDTITYK | 92.22 | CEDTITYN | 6.11 | CEDTVTYK | 1.44 | | |
| prM | 160 | 0.47 | 5 | 3 | 0 | Y | EDTITYKC | 92.22 | EDTITYNC | 6.11 | EDTVTYKC | 1.44 | | |
| prM | 161 | 0.47 | 5 | 3 | 0 | Y | DTITYKCP | 92.22 | DTITYNCP | 6.11 | DTVTYKCP | 1.44 | | |
| prM | 162 | 0.72 | 6 | 4 | 0 | Y | TITYKCPL | 87.66 | TITYNCPL | 6.11 | TITYKCPF | 4.67 | TVTYKCPF | 1.32 |
| prM | 163 | 0.72 | 6 | 4 | 0 | Y | ITYKCPLL | 87.66 | ITYNCPLL | 6.11 | ITYKCPFL | 4.67 | VTYKCPFL | 1.32 |
| prM | 164 | 0.79 | 7 | 5 | 0 | Y | TYKCPLLR | 86.95 | TYNCPLLR | 5.51 | TYKCPFLK | 5.39 | TYKCPLLK | 0.84 |
| prM | 165 | 0.79 | 7 | 5 | 0 | Y | YKCPLLRQ | 86.95 | YNCPLLRQ | 5.51 | YKCPFLKQ | 5.39 | YKCPLLKQ | 0.84 |
| prM | 166 | 0.79 | 7 | 5 | 0 | Y | KCPLLRQN | 86.95 | NCPLLRQN | 5.51 | KCPFLKQN | 5.39 | KCPLLKQN | 0.84 |
| prM | 167 | 0.46 | 4 | 3 | 0 | Y | CPLLRQNE | 92.57 | CPLLKQNE | 5.39 | CPLLKQNE | 1.44 | | |
| prM | 168 | 0.46 | 4 | 3 | 0 | Y | PLLRQNEP | 92.57 | PFLKQNEP | 5.39 | PLLKQNEP | 1.44 | | |
| prM | 169 | 0.46 | 4 | 3 | 0 | Y | LLRQNEPE | 92.57 | FLKQNEPE | 5.39 | LLKQNEPE | 1.44 | | |
| prM | 170 | 0.36 | 3 | 2 | 0 | Y | LRQNEPED | 93.17 | LKQNEPED | 6.83 | | | | |
| prM | 171 | 0.36 | 3 | 2 | 0 | Y | RQNEPEDI | 93.17 | KQNEPEDI | 6.83 | | | | |
| prM | 172 | 0 | 1 | 1 | 0 | Y | QNEPEDID | 100 | | | | | | |
| prM | 173 | 0.01 | 2 | 1 | 0 | Y | NEPEDIDC | 99.88 | | | | | | |

Additional column entries at positions 164–166 (cover 99% of block, frequency):
- 164: TYKCPFLR 0.6
- 165: YKCPFLRQ 0.6
- 166: NCPLLKQN 0.6

FIG. 6-9

Species: DENV2 (8-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 231 | 1.13 | 4 | 3 | 0 | Y | WKHVQRIE | 50.54 | WKHAQRIE | 47.43 | WKQAQRIE | 1.92 | | |
| prM | 232 | 1.14 | 5 | 3 | 0 | Y | KHVQRIET | 50.54 | KHAQRIET | 47.31 | KQAQRIET | 1.92 | | |
| prM | 233 | 1.14 | 5 | 3 | 0 | Y | HVQRIETW | 50.54 | HAQRIETW | 47.31 | QAQRIETW | 1.92 | | |
| prM | 234 | 1.25 | 5 | 3 | 0 | Y | VQRIETWI | 50.54 | AQRIETWI | 44.31 | AQRIETWW | 4.91 | | |
| prM | 235 | 0.33 | 5 | 2 | 0 | Y | QRIETWIL | 94.61 | QRIETWVL | 4.91 | | | | |
| prM | 236 | 0.33 | 4 | 2 | 0 | Y | RIETWILR | 94.61 | RIETWVLR | 4.91 | | | | |
| prM | 237 | 0.32 | 4 | 2 | 0 | Y | IETWILRH | 94.73 | IETWVLRH | 4.91 | | | | |
| prM | 238 | 0.32 | 4 | 2 | 0 | Y | ETWILRHP | 94.73 | ETWVLRHP | 4.91 | | | | |
| prM | 239 | 0.32 | 3 | 2 | 0 | Y | TWILRHPG | 94.85 | TWVLRHPG | 4.91 | | | | |
| prM | 240 | 0.31 | 5 | 2 | 0 | Y | WILRHPGF | 94.85 | WVLRHPGF | 4.91 | | | | |
| prM | 241 | 0.43 | 8 | 3 | 0 | Y | ILRHPGFT | 93.17 | VLRHPGFT | 4.91 | ILRHPGFA | 1.56 | LRHPGFAI | 1.56 |
| prM | 242 | 0.58 | 7 | 5 | 0 | Y | LRHPGFTI | 92.1 | LRHPGFTM | 2.63 | LRHPGFTL | 2.16 | RHPGFAIM | 1.56 | LRHPGFTT | 0.72 |
| prM | 243 | 0.56 | 7 | 5 | 0 | Y | RHPGFTIM | 92.34 | RHPGFTMM | 2.63 | RHPGFTLM | 2.16 | HPGFAIMA | 1.56 | RHPGFTTM | 0.72 |
| prM | 244 | 0.56 | 8 | 5 | 0 | Y | HPGFTIMA | 92.34 | HPGFTMMA | 2.63 | HPGFTLMA | 2.16 | PGFAIMAA | 1.56 | HPGFTTMA | 0.72 |
| prM | 245 | 0.57 | 6 | 2 | 0 | Y | PGFTIMAA | 92.22 | PGFTMMAA | 2.63 | PGFTLMAA | 2.16 | | | PGFTTMAA | 0.72 |
| prM | 250 | 0.21 | 7 | 3 | 0 | Y | MAAILAYT | 97.37 | MAAVLAYT | 1.92 | | | | |
| prM | 251 | 0.45 | 7 | 3 | 0 | Y | AAILAYTI | 93.41 | AAILAYTV | 3.95 | AAVLAYTI | 1.92 | | |
| prM | 252 | 0.45 | 6 | 3 | 0 | Y | AILAYTIG | 93.41 | AILAYTVG | 3.95 | AVLAYTIG | 1.92 | | |
| prM | 253 | 0.44 | 6 | 2 | 0 | Y | ILAYTIGT | 93.53 | ILAYTVGT | 3.95 | VLAYTIGT | 1.92 | | |
| prM | 254 | 0.31 | 7 | 3 | 0 | Y | LAYTIGTT | 95.33 | LAYTVGTT | 3.95 | | | | |
| prM | 255 | 0.64 | 7 | 3 | 0 | Y | AYTIGTTH | 89.34 | AYTVGTTH | 3.95 | AYTIGTTY | 3.95 | | |
| prM | 256 | 0.64 | 5 | 3 | 0 | Y | YTIGTTHF | 89.34 | YTVGTTHF | 3.95 | YTIGTTYF | 3.95 | | |
| prM | 257 | 0.59 | 5 | 3 | 0 | Y | TIGTTHFQ | 89.82 | TVGTTHFQ | 3.95 | TIGTTYFQ | 3.95 | | |
| prM | 258 | 0.67 | 4 | 4 | 0 | Y | IGTTHFQR | 88.74 | IGTTYFQR | 5.99 | VGTTHFQR | 5.99 | IGTTHFQK | 1.2 | | |
| prM | 259 | 1.31 | 8 | 5 | 0 | Y | GTTHFQRA | 68.14 | GTTHFQRV | 22.75 | GTTYFQRV | 5.99 | GTTHFQRT | 1.8 | GTTHFQKA | 0.84 |

FIG. 6-10

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to

FIG. 6-11

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 285 | 0.21 | 4 | 2 | 0 | Y | GISNRDFV | 97.25 | GMSNRDFV | 2.04 |
| E | 286 | 0.21 | 4 | 2 | 0 | Y | ISNRDFVE | 97.25 | M

FIG. 6-12

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 310 | 0.02 | 2 | 1 | 0 | Y | CVTTMAKN | 99.76 | | | | | | |
| E | 311 | 0.02 | 2 | 1 | 0 | Y | VTTMAKNK | 99.76 | | | | | | |
| E | 312 | 0.02 | 2 | 1 | 0 | Y | TTMAKNKP | 99.76 | | | | | | |
| E | 313 | 0.02 | 2 | 1 | 0 | Y | TMAKNKPT | 99.76 | | | | | | |
| E | 314 | 0.02 | 2 | 1 | 0 | Y | MAKNKPTL | 99.76 | | | | | | |
| E | 315 | 0.02 | 3 | 1 | 0 | Y | AKNKPTLD | 99.64 | | | | | | |
| E | 316 | 0.04 | 2 | 1 | 0 | Y | KNKPTLDF | 99.88 | | | | | | |
| E | 317 | 0.01 | 2 | 1 | 0 | Y | NKPTLDFE | 99.88 | | | | | | |

FIG. 6-13

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 336 | 0.28 | 5 | 3 | 0 | Y | LRKYCIEA | 96.41 | LRI

FIG. 6-14

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 361 | 1.3 | 8 | 5 | 0 | Y | SLNEEQDK | 63.83 | SLKEEQDK | 30.06 | TLNEEQDK | 2.4 | SLSEEQDK | 1.56 | SLVEEQDK | 1.56 |
| E | 362 | 1.14 | 6 | 4 | 0 | Y | LNEEQDKR | 66.23 | LKEEQDKR | 30.18 | LSEEQDKR | 1.56 | LVEEQDKR | 1.56 | | |
| E | 363 | 1.14 | 6 | 4 | 0 | Y | NEEQDKRF | 66.23 | KEEQDKRF | 30.18 | SEEQDKRF | 1.56 | VEEQDKRF | 1.56 | | |
| E | 364 | 1.1 | 3 | 3 | 0 | Y | EEQDKRFV | 54.73 | EEQDKRFI | 43.59 | EEQDKRFL | 1.68 | | | | |
| E | 365 | 1.1 | 3 | 3 | 0 | Y | EQDKRFVC | 54.73 | EQDKRFIC | 43.59 | EQDKRFLC | 1.68 | | | | |
| E | 366 | 1.21 | 4 | 4 | 0 | Y | QDKRFVCK | 52.93 | QDKRFICK | 43.59 | QDKRFVCR | 1.8 | QDKRFLCK | 1.68 | | |
| E | 367 | 1.21 | 4 | 4 | 0 | Y | DKRFVCKH | 52.93 | DKRFICKH | 43.59 | DKRFVCRH | 1.8 | DKRFLCKH | 1.68 | | |
| E | 368 | 1.21 | 4 | 4 | 0 | Y | KRFVCKHS | 52.93 | KRFICKHS | 43.59 | KRFVCRHS | 1.8 | KRFLCKHS | 1.68 | | |
| E | 369 | 1.27 | 6 | 4 | 0 | Y | RFVCKHSM | 52.34 | RFICKHSM | 43.47 | RFVCRHSM | 1.8 | RFLCKHSM | 1.68 | | |
| E | 370 | 1.27 | 6 | 4 | 0 | Y | FVCKHSMV | 52.34 | FICKHSMV | 43.47 | FVCRHSMV | 1.8 | FLCKHSMV | 1.68 | | |
| E | 371 | 1.27 | 6 | 4 | 0 | Y | VCKHSMVD | 52.34 | ICKHSMVD | 43.47 | VCRHSMVD | 1.8 | LCKHSMVD | 1.68 | | |
| E | 372 | 0.2 | 4 | 2 | 0 | Y | CKHSMVDR | 97.49 | CRHSMVDR | 1.8 | | | | | | |
| E | 373 | 0.2 | 4 | 2 | 0 | Y | KHSMVDRG | 97.49 | RHSMVDRG | 1.8 | | | | | | |
| E | 374 | 0.07 | 3 | 1 | 0 | Y | HSMVDRGW | 99.28 | | | | | | | | |
| E | 375 | 0.07 | 3 | 1 | 0 | Y | SMVDRGWG | 99.28 | | | | | | | | |
| E | 376 | 0.07 | 3 | 1 | 0 | Y | MVDRGWGN | 99.28 | | | | | | | | |
| E | 377 | 0 | 1 | 1 | 0 | Y | VDRGWGNG | 100 | | | | | | | | |
| E | 378 | 0 | 1 | 1 | 0 | Y | DRGWGNGC | 100 | | | | | | | | |
| E | 379 | 0 | 1 | 1 | 0 | Y | RGWGNGCG | 100 | | | | | | | | |
| E | 380 | 0 | 1 | 1 | 0 | Y | GWGNGCGL | 100 | | | | | | | | |
| E | 381 | 0 | 1 | 1 | 0 | Y | WGNGCGLF | 100 | | | | | | | | |
| E | 382 | 0 | 1 | 1 | 0 | Y | GNGCGLFG | 100 | | | | | | | | |
| E | 383 | 0 | 1 | 1 | 0 | Y | NGCGLFGK | 100 | | | | | | | | |
| E | 384 | 0 | 1 | 1 | 0 | Y | GCGLFGKG | 100 | | | | | | | | |
| E | 385 | 0.02 | 2 | 1 | 0 | Y | CGLFGKGG | 99.76 | | | | | | | | |

FIG. 6-15

Species: DENV2 (8-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 386 | 0.05 | 3 | 1 | 0 | Y | GLFGKGGI | 99.52 | | | | | | | | |
| E | 387 | 0.05 | 3 | 1 | 0 | Y | LFGKGGIV | 99.52 | | | | | | | | |
| E | 388 | 0.05 | 3 | 1 | 0 | Y | FGKGGIVT | 99.52 | | | | | | | | |
| E | 389 | 0.06 | 4 | 1 | 0 | Y | GKGGIVTC | 99.4 | | | | | | | | |
| E | 390 | 0.06 | 4 | 1 | 0 | Y | KGGIVTCA | 99.4 | | | |

FIG. 6-16

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 411 | 0.66 | 3 | 2 | 0 | Y | QPENLEYT | 83.47 | LPENLEYT | 16.41 | | | | |
| E | 412 | 0.18 | 3 | 2 | 0 | Y | PENLEYTI | 97.37 | PENLEYTV | 2.51 | | | | |
| E | 413 | 0.22 | 4 | 2 | 0 | Y | ENLEYTIV | 97.01 | ENLEYTVV | 2.51 | | | | |
| E | 414 | 1.1 | 5 | 3 | 0 | Y | NLEYTIVI | 65.51 | NLEYTWI | 31.5 | | | | |
| E | 415 | 1.1 | 5 | 3 | 0 | Y | LEYTIVIT | 65.51 | LEYTWIT | 31.5 | | | | |
| E | 416 | 1.09 | 4 | 3 | 0 | Y | EYTIVITP | 65.63 | EYTWITP | 31.5 | | | | |
| E | 417 | 1.09 | 4 | 3 | 0 | Y | YTIVITPH | 65.63 | YTWITPH | 31.5 | | | | |
| E | 418 | 1.09 | 4 | 3 | 0 | Y | TIVITPHS | 65.63 | TWITPHS | 31.5 | | | | |
| E | 419 | 1.09 | 4 | 3 | 0 | Y | IVITPHSG | 65.63 | WITPHSG | 31.5 | | | | |
| E | 420 | 0.93 | 3 | 2 | 0 | Y | VITPHSGE | 68.14 | WTPHSGE | 31.5 | | | | |
| E | 421 | 0.91 | 3 | 2 | 0 | Y | ITPHSGEE | 68.38 | VTPHSGEE | 31.5 | | | | |
| E | 422 | 0.38 | 5 | 2 | 0.12 | Y | TPHSGEEH | 93.53 | TPHSGEEN | 5.99 | | | | |
| E | 423 | 0.41 | 7 | 2 | 0.24 | Y | PHSGEEHA | 93.29 | PHSGEENA | 5.87 | | | | |
| E | 424 | 0.41 | 7 | 2 | 0.24 | Y | HSGEEHAV | 93.29 | HSGEENAV | 5.87 | | | | |
| E | 425 | 0.41 | 7 | 2 | 0.24 | Y | SGEEHAVG | 93.29 | SGEENAVG | 5.87 | | | | |
| E | 426 | 0.47 | 10 | 4 | 0.24 | Y | GEEHAVGN | 92.69 | GEENAVGN | 5.87 | GEEHAVGD | 0.36 | GEEYAVGN | 0.24 |
| E | 427 | 0.47 | 10 | 4 | 0.24 | Y | EEHAVGND | 92.57 | EENAVGND | 5.87 | EEHAVGDD | 0.36 | EEHSVGND | 0.24 |
| E | 428 | 0.48 | 11 | 4 | 0.24 | Y | EHAVGNDT | 92.34 | ENAVGNDT | 5.87 | EHAVGDDT | 0.36 | EHSVGNDT | 0.24 |

FIG. 6-17

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 436 | 0.74 | 6 | 4 | 0.12 | Y | GKHGKEIK | 87.78 | GKHGQEIK | 4.55 | GKHGKEVK | 4.43 | GKHGMEIK | 2.75 |
| E | 437 | 1.55 | 7 | 5 | 0.12 | Y | KHGKEIKI | 58.44 | KHGKEIKV | 29.34 | KHGQEIKV | 4.55 | KHGKEVKI | 4.43 |
| E | 438 | 1.56 | 8 | 5 | 0 | Y | HGKEIKIT | 58.44 | HGKEIKVT | 29.34 | HGQEIKVT | 4.55 | HGKEVKIT | 4.43 |
| E | 439 | 1.55 | 7 | 5 | 0 | Y | GKEIKITP | 58.56 | GKEIKVTP | 29.34 | GQEIKVTP | 4.55 | GKEVKITP | 4.43 |
| E | 440 | 1.55 | 7 | 5 | 0 | Y | KEIKITPQ | 58.56 | KEIKVTPQ | 29.34 | QEIKVTPQ | 4.55 | KEVKITPQ | 4.43 |
| E | 441 | 1.2 | 5 | 3 | 0 | Y | EIKITPQS | 58.92 | EIKVTPQS | 36.65 | EVKITPQS | 4.19 | | |
| E | 442 | 1.4 | 6 | 4 | 0 | Y | IKITPQSS | 54.97 | IKVTPQSS | 36.65 | VKITPQSS | 4.19 | IKITPQSP | 3.95 |
| E | 451 | 0.23 | 8 | 4 | 0 | Y | TEAELTGY | 97.49 | AEAELTDY | 0.96 | SEAELTDY | 0.36 | AEAELTGY | 0.36 |
|

FIG. 6-18

Species: DENV2 (8-mers)

| protein | block starting position | block entropy | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 469 | 0.21 | 2 | 0 | Y | TGLDFNEM | 97.72 | TSLDFNEM | 1.32 | | | | | | |
| E | 470 | 0.19 | 2 | 0 | Y | GLDFNEMV | 97.84 | SLDFNEMV | 1.32 | | | | | | |
| E | 471 | 0.09 | 1 | 0 | Y | LDFNEMVL | 99.16 | | | | | | | | |
| E | 472 | 0.07 | 1 | 0 | Y | DFNEMVLL | 99.4 | | | | | | | | |
| E | 473 | 0.08 | 1 | 0 | Y | FNEMVLLQ | 99.28 | | | | | | | | |
| E | 474 | 0.07 | 1 | 0 | Y | NEMVLLQM | 99.4 | | | | | | | | |
| E | 475 | 0.14 | 2 | 0 | Y | EMVLLQME | 98.56 | EMVLLQMK | 0.72 | | | | | | |
| E | 481 | 1.27 | 5 | 0 | Y | MEDKAWLV | 57.72 | MENKAWLV | 38.2 | MEEKAWLV | 1.56 | MESKAWLV | 1.2 | MGNKAWLV | 0.36 |
| E | 482 | 1.27 | 5 | 0 | Y | EDKAWLVH | 57.72 | ENKAWLVH | 38.2 | EEKAWLVH | 1.56 | ESKAWLVH | 1.2 | GNKAWLVH | 0.36 |
| E | 483 | 1.18 | 4 | 0 | Y | DKAWLVHR | 58.08 | NKAWLVHR | 38.92 | EKAWLVHR | 1.56 | SKAWLVHR | 1.2 | | |
| E | 484 | 0.01 | 1 | 0 | Y | KAWLVHRQ | 99.88 | | | | | | | | |
| E | 485 | 0.01 | 1 | 0 | Y | AWLVHRQW | 99.88 | | | | | | | | |
| E | 486 | 0 | 1 | 0 | Y | WLVHRQWF | 100 | | | | | | | | |
| E | 487 | 0 | 1 | 0 | Y | LVHRQWFL | 100 | | | | | | | | |
| E | 488 | 0 | 1 | 0 | Y | VHRQWFLD | 100 | | | | | | | | |
| E | 489 | 0 | 1 | 0 | Y | HRQWFLDL | 100 | | | | | | | | |
| E | 490 | 0 | 1 | 0 | Y | RQWFLDLP | 100 | | | | | | | | |
| E | 491 | 0.01 | 2 | 0 | Y | QWFLDLPL | 99.88 | | | | | | | | |
| E | 492 | 0.01 | 2 | 0 | Y | WFLDLPLP | 99.88 | | | | | | | | |
| E | 493 | 0.01 | 2 | 0 | Y | FLDLPLPW | 99.88 | | | | | | | | |
| E | 494 | 0.01 | 2 | 0 | Y | LDLPLPWL | 99.88 | | | | | | | | |
| E | 495 | 0.03 | 3 | 0 | Y | DLPLPWLP | 99.76 | | | | | | | | |
| E | 496 | 0.03 | 3 | 0 | Y | LPLPWLPG | 99.76 | | | | | | | | |
| E | 497 | 0.03 | 3 | 0 | Y | PLPWLPGA | 99.76 | | | | | | | | |
| E | 498 | 0.03 | 3 | 0 | Y | LPWLPGAD | 99.76 | | | | | | | | |

FIG. 6-19

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 499 | 0.89 | 5 | 3 | 0 | Y | PWLPGADT | 75.09 | PWLPGADK | 23.71 | | | | |
| E | 500 | 0.89 | 5 | 3 | 0 | Y | WLPGADTQ | 75.09 | WLPGADKQ | 23.71 | | | | |
| E | 501 | 1.07 | 7 | 5 | 0 | Y | LPGADTQG | 74.01 | LPGADKQE | 21.68 | | | LPGADTQE | 1.08 | LPGADIQG | 0.96 |
| E | 502 | 1.12 | 9 | 5 | 0 | Y | PGADTQGS | 73.53 | PGADKQES | 21.68 | | | PGADTQES | 1.08 | PGADIQGS | 0.96 |
| E | 503 | 1.12 | 9 | 5 | 0 | Y | GADTQGSN | 73.41 | GADKQESN | 21.68 | | | GADTQESN | 1.2 | GADIQGSN | 0.96 |
| E | 504 | 1.12 | 9 | 5 | 0 | Y | ADTQGSNW | 73.41 | ADKQESNW | 21.68 | | | ADTQESNW | 1.2 | ADIQGSNW | 0.96 |
| E | 505 | 1.12 | 9 | 5 | 0 | Y | DTQGSNWI | 73.41 | DKQESNWI | 21.68 | | | DTQESNWI | 1.2 | DIQGSNWI | 0.96 |
| E | 506 | 1.12 | 9 | 5 | 0 | Y | TQGSNWIQ | 73.41 | KQGSNWIQ | 21.68 | | | TQESNWIQ | 1.2 | IQGSNWIQ | 0.96 |
| E | 507 | 0.84 | 5 | 2 | 0.12 | Y | QGSNWIQK | 76.41 | QESNWIQK | 22.87 | | | | | | |
| E | 508 | 0.85 | 6 | 2 | 0.12 | Y | GSNWIQKE | 76.29 | ESNWIQKE | 22.87 | | | | | | |
| E | 509 | 0.21 | 7 | 2 | 0.12 | Y | SNWIQKET | 97.37 | SNWIQKEM | 1.8 | | | | | | |
| E | 510 | 0.17 | 5 | 2 | 0.12 | Y | NWIQKETL | 97.72 | NWIQKEML | 1.92 | | | | | | |
| E | 511 | 0.16 | 4 | 2 | 0.12 | Y | WIQKETLV | 97.72 | WIQKEMLV | 1.92 | | | | | | |
| E | 512 | 0.16 | 4 | 2 | 0.12 | Y | IQKETLVT | 97.72 | IQKEMLVT | 1.92 | | | | | | |
| E | 513 | 0.16 | 4 | 2 | 0.12 | Y | QKETLVTF | 97.72 | QKEMLVTF | 1.92 | | | | | | |
| E | 514 | 0.16 | 4 | 2 | 0.12 | Y | KETLVTFK | 97.72 | KEMLVTFK | 1.92 | | | | | | |
| E | 515 | 0.16 | 4 | 2 | 0.12 | Y | ETLVTFKN | 97.84 | EMLVTFKN | 1.92 | | | | | | |
| E | 516 | 0.15 | 3 | 2 | 0.12 | Y | TLVTFKNP | 97.96 | MLVTFKNP | 1.92 | | | | | | |
| E | 517 | 0 | 1 | 1 | 0 | Y | LVTFKNPH | 100 | | | | | | | | |
| E | 518 | 0 | 1 | 1 | 0 | Y | VTFKNPHA | 100 | | | | | | | | |
| E | 519 | 0 | 1 | 1 | 0 | Y | TFKNPHAK | 100 | | | | | | | | |
| E | 520 | 0.12 | 2 | 2 | 0 | Y | FKNPHAKK | 98.32 | FKNPHAKR | 1.68 | | | | | | |
| E | 521 | 0.12 | 2 | 2 | 0 | Y | KNPHAKKQ | 98.32 | KNPHAKRQ | 1.68 | | | | | | |
| E | 522 | 0.12 | 2 | 2 | 0 | Y | NPHAKKQD | 98.32 | NPHAKRQD | 1.68 | | | | | | |
| E | 523 | 0.12 | 2 | 2 | 0 | Y | PHAKKQDV | 98.32 | PHAKRQDV | 1.68 | | | | | | |

FIG. 6-20

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover

FIG. 6-21

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 549 | 0.11 | 5 | 2 | 0 | Y | EIQMS

FIG. 6-22

Species: DENV2 (8-mers)

| protein | block starting position | block

FIG. 6-23

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 599 | 0.24 | 8 | 3 | 0 | Y | TIWRVQY | 97.25 | TIWIRIQY | 1.08 | TIWRVQY | 0.84 | | | | |
| E | 600 | 0.24 | 8 | 3 | 0 | Y | IWRVQYE | 97.25 | IWIRIQYE | 1.08 | IWRVQYE | 0.84 | | | | |
| E | 601 | 0.21 | 6 | 3 | 0 | Y | WRVQYEG | 97.6 | VIRIQYEG | 1.08 | WRVQYEG | 0.84 | | | | |
| E | 602 | 0.26 | 8 | 4 | 0 | Y | RVQYEGD | 97.01 | IRIQYEGD | 1.08 | VRVQYEGD | 0.84 | | | | |
| E | 603 | 0.33 | 8 | 4 | 0 | Y | VQYEGDG | 96.05 | RVQYEGDD | 1.8 | RIQYEGDG | 1.08 | IRVQYEGE | 0.48 | | |
| E | 604 | 0.33 | 9 | 4 | 0 | Y | QYEGDGS | 96.05 | VQYEGDDS | 1.8 | IQYEGDGS | 1.08 | RVQYEGEG | 0.24 | | |
| E | 605 | 0.22 | 7 | 2 | 0 | Y | YEGDGSP | 97.37 | QYEGDDSP | 1.8 | | | VQYEGEGA | 0.24 | | |
| E | 606 | 0.2 | 6 | 2 | 0 | Y | EGDGSPC | 97.49 | YEGDDSP | 1.8 | | | | | | |
| E | 607 | 0.33 | 8 | 3 | 0 | Y | GDGSPCK | 95.93 | EGDDSPCK | 1.8 | EGDGPCR | 1.44 | | | | |
| E | 608 | 0.44 | 10 | 5 | 0 | Y | DGSPCKI | 94.49 | GDDSPCKI | 1.8 | GDGSPCRI | 1.44 | GDGSPCKV | 1.2 | GEGAPCKI | 0.24 |
| E | 609 | 0.44 | 10 | 5 | 0 | Y | GSPCKIP | 94.49 | DDSPCKIP | 1.8 | DGSPCRIP | 1.44 | DGSPCKVP | 1.2 | EDSPCKIP | 0.24 |
| E | 610 | 0.42 | 7 | 4 | 0 | Y | SPCKIPF | 94.49 | DSPCKIPF | 2.16 | GSPCRIP

FIG. 6-24

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | fr

FIG. 6-25

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 657 | 0.42 | 7 | 3 | 0 | Y | YIIIGVEP | 94.25 | YIIIGVEP | 3.11 | YIIIGVEP | 1.68 |
| E | 658 | 0.42 | 7 | 3 | 0 | Y | IIIGVEPG | 94.25 | IIIGVEPG | 3.11 | IIGVEPG | 1.68 |
| E | 659 | 0.4 | 6 | 3 | 0 | Y | IIGVEPGQ | 94.37 | IIGVEPGQ | 3.11 | IIGVEPGQ | 1.68 |
| E | 660 | 0.28 | 5 | 2 | 0 | Y | IGVEPGQL | 96.05 | VGVEPGQL | 3.11 | | |
| E | 661 | 0.08 | 4 | 1 | 0 | Y | GVEPGQLK | 99.16 | | | | |
| E | 662 | 0.08 | 4 | 1 | 0 | Y | VEPGQLKL | 99.16 | | | | |
| E | 663 | 0.52 | 5 | 3 | 0 | Y | EPGQLKLS | 91.62 | EPGQLKLS | 5.51 | EPGQLKLD | 2.4 |
| E | 664 | 0.47 | 3 | 3 | 0 | Y | PGQLKLNW | 92.1 | PGQLKLSW | 5.51 | PGQLKLDW | 2.4 |
| E | 665 | 0.48 | 4 | 3 | 0 | Y | GQLKLNWF | 91.98 | GQLKLSWF | 5.51 | GQLKLDWF | 2.4 |
| E | 666 | 0.5 | 5 | 3 | 0 | Y | QLKLNWFK | 91.98 | QLKLSWFK | 5.51 | QLKLDWFK | 1.92 |
| E | 667 | 0.5 | 5 | 3 | 0 | Y | LKLNWFKK | 91.98 | LKLSWFKK | 5.51 | LKLDWFKK | 1.92 |
| E | 668 | 0.5 | 5 | 3 | 0 | Y | KLNWFKKG | 91.98 | KLSWFKKG | 5.51 | KLDWFKKG | 1.92 |
| E | 669 | 0.5 | 5 | 3 | 0 | Y | LNWFKKGS | 91.98 | LSWFKKGS | 5.51 | LDWFKKGS | 1.92 |
| E | 670 | 0.5 | 5 | 3 | 0 | Y | NWFKKGSS | 91.98 | SWFKKGSS | 5.51 | DWFKKGSS | 1.92 |
| E | 671 | 0.06 | 3 | 1 | 0 | Y | WFKKGSSI | 99.4 | | | | |
| E | 672 | 0.06 | 3 | 1 | 0 | Y | FKKGSSIG | 99.4 | | | | |
| E | 673 | 0.07 | 3 | 1 | 0 | Y | KKGSSIGQ | 99.28 | | | | |
| E | 674 | 0.02 | 2 | 1 | 0 | Y | KGSSIGQM | 99.76 | | | | |
| E | 675 | 0.11 | 3 | 2 | 0 | Y | GSSIGQMF | 98.68 | GSSIGQMI | 1.08 | | |
| E | 676 | 0.17 | 6 | 2 | 0 | Y | SSIGQMFE | 98.08 | SSIGQMIE | 1.08 | | |
| E | 677 | 0.18 | 7 | 2 | 0 | Y | SIGQMFET | 97.96 | SIGQMIET | 1.08 | | |
| E | 678 | 0.18 | 7 | 2 | 0 | Y | IGQMFETT | 97.96 | IGQMIETT | 1.08 | | |
| E | 679 | 0.2 | 8 | 3 | 0 | Y | GQMFETTM | 97.84 | GQMIETTM | 1.08 | GQMFATTM | 0.36 |
| E | 680 | 0.2 | 8 | 3 | 0 | Y | QMFETTMR | 97.84 | QMIETTMR | 1.08 | QMFATTMR | 0.36 |
| E | 681 | 0.17 | 7 | 2 | 0 | Y | MFETTMRG | 98.08 | MIETTMRG | 1.08 | | |

FIG. 6-26

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 682 | 0.17 | 7 | 2 | 0 | Y | FETTMRGA | 98.08 | IETTMRGA | 1.08 | | | | | | |
| E | 683 | 0.09 | 6 | 1 | 0 | Y | ETTMRGAK | 99.16 | | | | | | | | |
| E | 684 | 0.04 | 4 | 1 | 0 | Y | TTMRGAKR | 99.64 | | | | | | | | |
| E | 685 | 0.03 | 3 | 1 | 0 | Y | TMRGAKRM | 99.76 | | | | | | | | |
| E | 686 | 0.03 | 3 | 1 | 0 | Y | MRGAKRMA | 99.76 | | | | | | | | |
| E | 687 | 0.02 | 2 | 1 | 0 | Y | RGAKRMAI | 99.76 | | | | | | | | |
| E | 688 | 0.02 | 2 | 1 | 0 | Y | GAKRMAIL | 99.76 | | | | | | | | |
| E | 689 | 0.02 | 2 | 1 | 0 | Y | AKRMAILG | 99.76 | | | | | | | | |
| E | 690 | 0.04 | 3 | 1 | 0 | Y | KRMAILGD | 99.64 | | | | | | | | |
| E | 691 | 0.04 | 3 | 1 | 0 | Y | RMAILGDT | 99.64 | | | | | | | | |
| E | 692 | 0.05 | 4 | 1 | 0 | Y | MAILGDTA | 99.52 | | | | | | | | |
| E | 693 | 0.05 | 4 | 1 | 0 | Y | AILGDTAW | 99.52 | | | | | | | | |
| E | 694 | 0.05 | 4 | 1 | 0 | Y | ILGDTAWD | 99.52 | | | | | | | | |
| E | 695 | 0.03 | 3 | 1 | 0 | Y | LGDTAWDF | 99.76 | | | | | | | | |
| E | 696 | 0.03 | 3 | 1 | 0 | Y | GDTAWDFG | 99.76 | | | | | | | | |
| E | 697 | 0.03 | 3 | 1 | 0 | Y | DTAWDFGS | 99.76 | | | | | |

FIG. 6-27

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency

FIG. 6-28

Species: DENV2 (8-mers)

| protein

FIG. 6-29

Species: DENV2 (8-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 757 | 1.19 | 9 | 3 | 0 | Y | VSLVLVGV | 63.95 | VSLVLVGI | 31.74 | VTLVLVGI | 3.35 | TLVLVGIV | 0.24 |
| E | 758 | 1.51 | 11 | 5 | 0 | Y | SLVLVGVV | 57.37 | SLVLVGVI | 31.62 | SLVLVGVI | 6.59 | | |
| E | 759 | 1.38 | 10 | 4 | 0 | Y | LVLVGVVT | 56.89 | LVLVGVIT | 34.97 | LVLVGVIT | 6.59 | | |
| E | 760 | 1.38 | 10 | 4 | 0 | Y | VLVGVVTL | 56.89 | VLVGVITL | 34.97 | VLVGVIL | 6.59 | | |
| E | 761 | 1.35 | 8 | 4 | 0 | Y | LVGVVTLY | 56.89 | LVGVITLY | 35.33 | LVGVITLY | 6.59 | | |
| E | 762 | 1.33 | 7 | 3 | 0 | Y | VGVVTLYL | 56.89 | VGVITLYL | 35.57 | VGVITLYL | 6.59 | | |
| E | 763 | 1.33 | 7 | 3 | 0 | Y | GVVTLYLG | 56.89 | GVITLYLG | 35.57 | GVITLYLG | 6.59 | | |
| E | 764 | 1.86 | 9 | 5 | 0 | Y | VVTLYLGA | 37.84 | IVTLYLGV | 35.57 | VTLYLGV | 19.04 | VVTLYLGA | 0.6 |
| E | 765 | 1.65 | 7 | 4 | 0 | Y | VTLYLGVM | 54.73 | VTLYLGAM | 27.66 | VTLYLGAV | 10.18 | VTLYLGA | 6.47 |
| E | 766 | 1.4 | 5 | 3 | 0 | Y | TLYLGVMV | 54.85 | TLYLGAMV | 34.25 | TLYLGAVV | 10.18 | ITLYLGAM | 6.59 |
| E | 767 | 1.36 | 5 | 3 | 0 | Y | LYLGVMVQ | 54.85 | LYLGAMVQ | 34.73 | LYLGAVVQ | 10.18 | | |
| E | 768 | 1.36 | 5 | 3 | 0 | Y | YLGVMVQA | 54.85 | YLGAMVQA | 34.73 | YLGAVVQA | 10.18 | | |
| E | 769 | 1.36 | 5 | 3 | 0 | Y | LGVMVQAD | 54.85 | LGAMVQAD | 34.73 | LGAVVQAD | 10.18 | | |
| E | 770 | 1.56 | 6 | 4 | 0 | Y | GVMVQADS | 51.02 | GAMVQADS | 34.73 | GAVVQADS | 10.18 | GVMVQADT | 3.83 |
| E | 771 | 1.56 | 6 | 4 | 0 | Y | VMVQADSG | 51.02 | AMVQADSG | 34.73 | AVVQADSG | 10.18 | VMVQADTG | 3.83 |
| E | 772 | 0.72 | 4 | 3 | 0 | Y | MVQADSGC | 85.75 | MVQADSGC | 10.3 | MVQADTGC | 3.83 | | |
| E | 773 | 0.45 | 4 | 3 | 0 | Y | VQADSGCV | 92.93 | VQADTGCV | 3.83 | VQADSGCI | 3.83 | | |
| E | 774 | 0.47 | 5 | 3 | 0 | Y | QADSGCVV | 92.69 | QADTGCVV | 3.83 | QADSGCIV | 3.83 | | |
| E | 775 | 0.46 | 4 | 3 | 0 | Y | ADSGCVVS | 92.81 | ADTGCVVS | 3.83 | ADSGCIVS | 3.23 | | |
| NS1 | 776 | 0.46 | 4 | 3 | 0 | Y | DSGCVVSW | 92.81 | DTGCVVSW | 3.83 | DSGCIVSW | 3.11 | | |
|

FIG. 6-30

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 782 | 0.26 | 6 | 2 | 0 | Y | SWKNNELK | 96.29 | SWKS

FIG. 6-31

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 807 | 0.15 | 3 | 2 | 0.12 | Y | YIKFQPESP | 97.84 | YIKFQPDSP | 1.92 | | | | | | |
| NS1 | 808 | 0.16 | 4 | 2 | 0.12 | Y | KFQPESPS | 97.72 | KFQPDSPS | 1.92 | | | | | | |
| NS1 | 809 | 0.16 | 4 | 2 | 0 | Y | FQPESPSK | 97.84 | FQPDSPSK | 1.92 | | | | | | |
| NS1 | 810 | 0.16 | 4 | 2 | 0 | Y | QPESPSKL | 97.84 | QPDSPSKL | 1.92 | | | | | | |
| NS1 | 811 | 0.16 | 4 | 2 | 0 | Y | PESPSKLA | 97.84 | PDSPSKLA | 1.92 | | | | | | |
| NS1 | 812 | 0.03 | 3 | 2 | 0 | Y | ESPSKLAS | 97.84 | DSPSKLAS | 1.92 | | | | | | |
| NS1 | 813 | 0.01 | 2 | 1 | 0 | Y | SPSKLASA | 99.76 | | | | | | | | |
| NS1 | 814 | 0.03 | 3 | 1 | 0 | Y | PSKLASAI | 99.88 | | | | | | | | |
| NS1 | 815 | 0.03 | 3 | 1 | 0 | Y | SKLASAIQ | 99.76 | | | | | | | | |
| NS1 | 816 | 0.03 | 3 | 1 | 0 | Y | KLASAIQK | 99.76 | | | | | | | | |
| NS1 | 817 | 0.03 | 3 | 2 | 0 | Y | LASAIQKA | 99.76 | | | | | | | | |
| NS1 | 818 | 0.95 | 6 | 2 | 0 | Y | ASAIQKAH | 68.86 | ASAIQKAQ | 30.54 | AIQKAHED | 0.24 | | | | |
| NS1 | 819 | 0.97 | 8 | 3 | 0 | Y | SAIQKAHE | 68.62 | SAIQKAQE | 30.54 | IQKAHEED | 1.32 | | | | |
| NS1 | 820 | 1.01 | 10 | 4 | 0 | Y | AIQKAHEE | 68.26 | AIQKAQEE | 30.54 | QKAHEEDI | 1.32 | | | | |
| NS1 | 821 | 1.1 | 11 | 5 | 0 | Y | IQKAHEEG | 66.95 | IQKAQEEG | 30.42 | KAHEEDIC | 1.32 | IQKAYEEG | 0.24 | | |
| NS1 | 822 | 1.12 | 12 | 4 | 0 | Y | QKAHEEGI | 66.95 | QKAQEEGI | 30.42 | AHEEDICG | 1.32 | QKAHEDGI | 0.24 | QKAYEEGI | 0.24 |
| NS1 | 823 | 1.1 | 12 | 4 | 0 | Y | KAHEEGIC | 67.07 | KAQEEGIC | 30.42 | HEEDICGI | 1.32 | KAYEEGIC | 0.24 | | |
| NS1 | 824 | 1.09 | 11 | 4 | 0 | Y | AHEEGICG | 67.19 | AQEEGICG | 30.42 | | | AYEEGICG | 0.24 | | |
| NS1 | 825 | 1.09 | 10 | 2 | 0 | Y | HEEGICGI | 67.19 | QEEGICGI | 30.42 | | | HEDGICGI | 0.24 | | |
| NS1 | 826 | 0.18 | 7 | 2 | 0 | Y | EEGICGIR | 97.96 | EEDICGIR | 1.32 | | | | | | |
| NS1 | 827 | 0.17 | 6 | 2 | 0 | Y | EGICGIRS | 98.08 | EDICGIRS | 1.32 | | | | | | |
| NS1 | 828 | 0.14 | 5 | 2 | 0 | Y | GICGIRSV | 98.32 | DICGIRSV | 1.32 | | | | | | |
| NS1 | 829 | 0.04 | 4 | 1 | 0 | Y | ICGIRSVT | 99.64 | | | | | | | | |
| NS1 | 830 | 0.03 | 3 | 1 | 0 | Y | CGIRSVTR | 99.76 | | | | | | | | |
| NS1 | 831 | 0.03 | 3 | 1 | 0 | Y | GIRSVTRL | 99.76 | | | | | | | | |

FIG. 6-32

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover

FIG. 6-33

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 857 | 0.18 | 6 | 3 | 0 | Y | NEVKLTIM | 98.08 | NEAKLTIM | 0.72 | NEVKMTIM | 0.6 | | | | |
| NS1 | 858 | 0.18 | 6 | 3 | 0 | Y | EVKLTIMT | 98.08 | EAKLTIMT | 0.72 | EVKMTIMT | 0.6 | | | | |
| NS1 | 859 | 0.18 | 6 | 3 | 0 | Y | VKLTIMTG | 98.08 | AKLTIMTG | 0.72 | VKMTIMTG | 0.6 | | | | |
| NS1 | 860 | 0.24 | 6 | 3 | 0 | Y | KLTIMTGD | 97.01 | KLTIMTGE | 1.8 | KMTIMTGD | 0.6 | | | | |
| NS1 | 861 | 0.48 | 8 | 4 | 0 | Y | LTIMTGDI | 93.29 | LTIMTGDT | 3.59 | LTIMTGEI | 1.8 | MTIMTGDI | 0.6 | | |
| NS1 | 862 | 0.91 | 8 | 4 | 0 | Y | TIMTGDIK | 83.23 | TIMTGDIR | 10.66 | TIMTGDTK | 3.59 | TIMTGEIK | 1.8 | | |
| NS1 | 863 | 0.88 | 7 | 4 | 0 | Y | IMTGDIKG | 83.47 | IMTGDIRG | 10.66 | IMTGDTKG | 3.59 | IMTGEIKG | 1.8 | | |
| NS1 | 864 | 0.91 | 8 | 4 | 0 | Y | MTGDIKGI | 83.23 | MTGDIRGI | 10.66 | MTGDTKGI | 3.59 | MTGEIKGI | 1.68 | | |
| NS1 | 865 | 0.9 | 9 | 4 | 0 | Y | TGDIKGIM | 83.35 | TGDIRGIM | 10.66 | TGDTKGIM | 3.59 | TGEIKGIM | 1.68 | | |
| NS1 | 866 | 0.94 | 8 | 5 | 0 | Y | GDIKGIMQ | 82.87 | GDIRGIMQ | 10.66 | GDTKGIMQ | 3.59 | GEIKGIMQ | 1.68 | GDIKGIMH | 0.48 |
| NS1 | 867 | 0.99 | 10 | 5 | 0 | Y | IKGIMQAG | 82.28 | IRGIMQAG | 10.66 | TKGIMQAG | 3.35 | IKGIMQVG | 2.28 | IKGIMHAG | 0.48 |
| NS1 | 868 | 0.9 | 8 | 5 | 0 | Y | KGIMQAGK | 83.71 | RGIMQAGK | 10.66 | KGIMQVGK | 2.51 | KGIMQAGR | 2.04 | KGIMHAGK | 0.48 |
| NS1 | 869 | 0.42 | 7 | 4 | 0 | Y | GIMQAGKR | 94.37 | GIMQVGKR | 2.51 | GIMQAGRR | 2.04 | GIMHAGKR | 0.48 | | |
| NS1 | 870 | 0.5 | 10 | 5 | 0 | Y | IMQAGKRS | 93.53 | IMQVGKRS | 2.51 | IMQAGRRS | 2.04 | IMQAGKRY | 0.6 | IMHAGKRS | 0.48 |
| NS1 | 871 | 0.47 | 8 | 4 | 0 | Y | MQAGKRSL | 93.77 | MQVGKRSL | 2.51 | MQAGRRSL | 2.16 | MQAGKRYL | 0.6 | | |
| NS1 | 872 | 0.38 | 9 | 5 | 0 | Y | GKRSLRPQ | 95.33 | GRRSLRPQ | 1.68 | GKRSLQPQ | 1.32 | GKRYLRPQ | 0.6 | GRRSLRPQ | 0.48 |
| NS1 | 875 | 0.38 | 9 | 5 | 0 | Y | KRSLRPQP | 95.33 | RRSLRPQP | 1.68 | KRSLQPQP | 1.32 | KRYLRPQP | 0.6 | RRSLRPQP | 0.48 |
| NS1 | 876 | 0.37 | 11 | 4 | 0 | Y | RSLRPQPT | 95.57 | RSLRPQPT | 1.68 | RSLQPQPT | 1.32 | RYLRPQPT | 0.6 | | |
| NS1 | 877 | 0.4 | 12 | 5 | 0 | Y | SLRPQPTE | 95.21 | SLRPQPTE | 1.68 | SLQPQPTE | 1.32 | YLRPQPTE | 0.6 | SLRPQPTQ | 0.36 |
| NS1 | 878 | 0.32 | 9 | 3 | 0 | Y | LRPQPTEL | 96.05 | LKRPQPTEL | 2.63 | LQPQPTEL | 1.32 | | | | |
| NS1 | 879 | 0.5 | 10 | 4 | 0 | Y | RPQPTELK | 93.41 | RPQPTELR | 4.31 | KPQPTELR | 1.68 | QPQPTELK | 1.32 | | |
| NS1 | 880 | 0.34 | 6 | 2 | 0 | Y | PQPTELKY | 94.85 | PQPTELRY | 4.31 | | | | | | |
| NS1 | 881 | 0.34 | 6 | 2 | 0 | Y | QPTELKYS | 94.85 | QPTELRYS | 4.31 | | | | | | |
| NS1 | 882 | 0.34 | 6 | 2 | 0 | Y | PTELKYSW | 94.85 | PTELRYSW | 4.31 | | | | | | |
| NS1 | 883 | 0.34 | 6 | 2 | 0 | Y | TELKYSWK | 94.73 | TELRYSWK | 4.31 | | | | | | |
| NS1 | 884 | 0.35 | 7 | 2 | 0 | Y | | | | | | | | | | |

FIG. 6-34

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 885 | 0.6 | 8 | 3 | 0 | Y | ELKYSWKT | 90.42 | ELKYSWKA | 4.55 | ELRYSWKT | 4.19 | | | | |
| NS1 | 886 | 0.57 | 7 | 3 | 0 | Y | LKYSWKTW | 90.78 | LKYSWKAW | 4.55 | LRYSWKTW | 4.19 | | | | |
| NS1 | 887 | 0.57 | 7 | 3 | 0 | Y | KYSWKTWG | 90.78 | KYSWKAWG | 4.55 | RYSWKTWG | 4.19 | | | | |
| NS1 | 888 | 0.32 | 5 | 2 | 0 | Y | YSWKTWGK | 94.85 | YSWKAWGK | 4.67 | | | | | | |
| NS1 | 889 | 0.35 | 7 | 2 | 0 | Y | SWKTWGKA | 94.61 | SWKAWGKA | 4.67 | | | | | | |
| NS1 | 890 | 0.35 | 7 | 2 | 0 | Y | WKTWGKAK | 94.61 | WKAWGKAK | 4.67 | | | | | | |
| NS1 | 891 | 0.5 | 10 | 3 | 0 | Y | KTWGKAKM | 92.69 | KAWGKAKM | 4.67 | KTWGKAKV | 1.68 | | | | |
| NS1 | 892 | 0.51 | 11 | 4 | 0 | Y | TWGKAKML | 92.57 | AWGKAKML | 4.67 | TWGKAKVL | 1.68 | TWGKAKIL | 0.24 | | |
| NS1 | 893 | 0.32 | 10 | 4 | 0 | Y | WGKAKMLS | 96.17 | WGKAKVLS | 1.8 | WGKAKMLP | 0.96 | WGKAKILS | 0.36 | | |
| NS1 | 894 | 0.33 | 11 | 4 | 0 | Y | GKAKMLST | 96.05 | GKAKVLST | 1.8 | GKAKMLPT | 0.96 | GKAKILST | 0.36 | | |
| NS1 | 895 | 0.37 | 13 | 5 | 0 | Y | KAKMLSTE | 95.69 | KAKVLSTE | 1.8 | KAKMLPTE | 0.96 | KAKILSTE | 0.36 | KAKMLSTG | 0.24 |
| NS1 | 904 | 1.23 | 9 | 5 | 0 | Y | HNQTFLID | 72.1 | YNQTFLID | 19.64 | HNHTFLID | 0.96 | QNQTFLID | 2.04 | HNRTFLID | 0.6 |
| NS1 | 905 | 0.39 | 6 | 3 | 0 | Y | NQTFLIDG | 93.89 | NHTFLIDG | 5.03 | NRTFLIDG | 0.6 | | | | |
| NS1 | 906 | 0.4 | 7 | 3 | 0 | Y | QTFLIDGP | 93.77 | HTFLIDGP | 5.03 | RTFLIDGP | 0.6 | | | | |
| NS1 | 907 | 0.09 | 6 | 1 | 0 | Y | TFLIDGPE | 99.16 | | | | | | | | |
| NS1 | 908 | 0.08 | 5 | 1 | 0 | Y | FLIDGPET | 99.28 | | | | | | | | |
| NS1 | 909 | 0.38 | 7 | 3 | 0 | Y | LIDGPETA | 94.61 | LIDGPETT | 3.95 | LIDGPETV | 0.72 | | | | |
| NS1 | 910 | 0.36 | 6 | 3 | 0 | Y | IDGPETAE | 94.73 | IDGPETTE | 3.95 | IDGPETVE | 0.72 | | | | |
| NS1 | 911 | 0.34 | 5 | 3 | 0 | Y | DGPETAEC | 94.97 | DGPETTEC | 3.95 | DGPETVEC | 0.72 | | | | |
| NS1 | 912 | 0.34 | 6 | 3 | 0 | Y | GPETAECP | 94.97 | GPETTECP | 3.95 | GPETVECP | 0.72 | | | | |
| NS1 | 913 | 0.35 | 6 | 3 | 0 | Y | PETAECPN | 94.97 | PETTECPN | 3.71 | PETVECPN | 0.72 | | | | |
| NS1 | 914 | 0.45 | 11 | 5 | 0 | Y | ETAECPNT | 94.49 | ETTECPNT | 1.92 | ETTECPNS | 1.68 | ETVECPNT | 0.72 | KTAECPNT | 0.24 |
| NS1 | 915 | 0.43 | 11 | 5 | 0 | Y | TAECPNTN | 94.61 | TTECPNTN | 1.92 | TTECPNSN | 1.68 | TVECPNTN | 0.72 | TAECPNAN | 0.24 |
| NS1 | 916 | 0.43 | 11 | 5 | 0 | Y | AECPNTNR | 94.61 | TECPNTNR | 1.92 | TECPNSNR | 1.68 | VECPNTNR | 0.72 | TECPSSNR | 0.24 |
| NS1 | 917 | 0.23 | 7 | 2 | 0 | Y | ECPNTNRA | 97.25 | ECPNSNRA | 1.8 | | | | | | |

FIG. 6-35

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of

FIG. 6-36

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 943 | 1.5 | 7 | 5 | 0 | Y | WLKLREKQ | 57.6 | WLKLREKQ | 31.86 | WLKLKERQ | 6.11 | WLRLREKQ | 2.4 | WLRLKEKQ | 1.44 |
| NS1 | 944 | 1.51 | 8 | 5 | 0 | Y | LKLKEKQD | 57.49 | LKLKEKQD | 31.86 | LKLKERQD | 6.11 | LRLREKQD | 2.4 | LRLKEKQD | 1.44 |
| NS1 | 953 | 0.28 | 7 | 4 | 0 | Y | FCDSKLMS | 96.77 | ICDSKLMS | 1.08 | VCDSKLMS | 0.6 | SCDSKLMS | 0.6 | | |
| NS1 | 954 | 0.05 | 3 | 1 | 0 | Y | CDSKLMSA | 99.52 | | | | | | | | |
| NS1 | 955 | 0.07 | 5 | 1 | 0 | Y | DSKLMSAA | 99.28 | | | | | | | | |
| NS1 | 956 | 0.27 | 6 | 2 | 0 | Y | SKLMSAAI | 96.29 | SKLMSAAV | 2.99 | | | | | | |
| NS1 | 957 | 0.23 | 5 | 2 | 0 | Y | KLMSAAIK | 96.65 | KLMSAAVK | 2.99 | | | | | | |
| NS1 | 958 | 0.29 | 6 | 2 | 0 | Y | LMSAAIKD | 96.05 | LMSAAVKD | 2.99 | | | | | | |
| NS1 | 959 | 0.36 | 8 | 4 | 0 | Y | MSAAIKDN | 95.57 | MSAAVKDD | 1.68 | MSAAVKDN | 1.32 | MSAAIKNN | 0.6 | | |
| NS1 | 960 | 0.36 | 8 | 4 | 0 | Y | SAAIKDNR | 95.57 | SAAVKDDR | 1.68 | SAAVKDNR | 1.32 | SAAIKNNR | 0.6 | | |
| NS1 | 961 | 0.36 | 8 | 4 | 0 | Y | AAIKDNRA | 95.57 | AAVKDDRA | 1.68 | AAVKDNRA | 1.32 | AAIKNNRA | 0.6 | | |
| NS1 | 962 | 0.37 | 9 | 4 | 0 | Y | AIKDNRAV | 95.57 | AVKDDRAV | 1.68 | AVKDNRAV | 1.2 | AIKDNRAY | 0.6 | | |
| NS1 | 963 | 0.35 | 8 | 4 | 0 | Y | IKDNRAVH | 95.69 | VKDDRAVH | 1.68 | VKDNRAVH | 1.2 | IKNNRAVH | 0.6 | | |
| NS1 | 964 | 0.26 | 7 | 3 | 0 | Y | KDNRAVHA | 96.89 | KDDRAVHA | 1.68 | KNNRAVHA | 0.6 | | | | |
| NS1 | 965 | 0.26 | 7 | 3 | 0 | Y | DNRAVHAD | 96.89 | DDRAVHAD | 1.68 | NNRAVHAD | 0.6 | | | | |
| NS1 | 966 | 0.19 | 5 | 2 | 0 | Y | NRAVHADM | 97.6 | DRAVHADM | 1.68 | | | | | | |
| NS1 | 967 | 0.04 | 4 | 1 | 0 | Y | RAVHADMG | 99.64 | | | | | | | | |
| NS1 | 968 | 0.04 | 4 | 1 | 0 | Y | AVHADMGY | 99.64 | | | | | | | | |
| NS1 | 969 | 0.04 | 4 | 1 | 0 | Y | VHADMGYW | 99.64 | | | | | | | | |
| NS1 | 970 | 0.07 | 3 | 1 | 0 | Y | HADMGYWI | 99.28 | | | | | | | | |
| NS1 | 971 | 0.07 | 3 | 1 | 0 | Y | ADMGYWIE | 99.28 | | | | | | | | |
| NS1 | 972 | 0.07 | 3 | 1 | 0 | Y | DMGYWIES | 99.28 | | | | | | | | |
| NS1 | 973 | 0.24 | 6 | 3 | 0 | Y | MGYWIESA | 97.01 | MGYWIESR | 1.92 | MGYWMESA | 0.6 | | | | |
| NS1 | 974 | 0.25 | 7 | 3 | 0 | Y | GYWIESAL | 96.89 | GYWIESRL | 1.92 | GYWMESAL | 0.6 | | | | |
| NS1 | 975 | 0.24 | 6 | 3 | 0 | Y | YWIESALN | 97.01 | YWIESRLN | 1.92 | YWMESALN | 0.6 | | | | |

FIG. 6-37

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 976 | 0.25 | 7 | 3 | 0 | Y | WIESALND | 96.89 | WIESR

FIG. 6-38

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1001 | 0.19 | 5 | 2 | 0 | Y | PKSHTLWS | 97.49 | PRSHTLWS | 2.16 | | | | |
| NS1 | 1002 | 0.18 | 4 | 2 | 0 | Y | KSHTLWSN | 97.6 | RSHTLWSN | 2.16 | | | | |
| NS1 | 1003 | 0.07 | 4 | 1 | 0 | Y | SHTLWSNG | 99.28 | | | | | | |
| NS1 | 1004 | 0.07 | 4 | 1 | 0 | Y | HTLWSNGV | 99.28 | | | | | | |
| NS1 | 1005 | 0.04 | 2 | 1 | 0 | Y | TLWSNGVL | 99.52 | | | | | | |
| NS1 | 1006 | 0.04 | 2 | 1 | 0 | Y | LWSNGVLE | 99.52 | | | | | | |
| NS1 | 1007 | 0.04 | 2 | 1 | 0 | Y | WSNGVLES | 99.52 | | | | | | |
| NS1 | 1008 | 0.04 | 2 | 1 | 0 | Y | SNGVLESE | 99.52 | | | | | | |
| NS1 | 1009 | 0.04 | 2 | 1 | 0 | Y | NGVLESEM | 99.52 | | | | | | |
| NS1 | 1010 | 0.25 | 3 | 2 | 0 | Y | GVLESEMI | 96.29 | GVLESEMV | 3.23 | | | | |
| NS1 | 1011 | 0.21 | 2 | 2 | 0 | Y | VLESEMII | 96.77 | VLESEMVI | 3.23 | | | | |
| NS1 | 1012 | 0.21 | 2 | 2 | 0 | Y | LESEMIIP | 96.77 | LESEMVIP | 3.23 | | | | |
| NS1 | 1013 | 0.21 | 2 | 2 | 0 | Y | ESEMIIPK | 96.77 | ESEMVIPK | 3.23 | | | | |
| NS1 | 1014 | 0.61 | 5 | 3 | 0 | Y | SEMIIPKN | 89.46 | SEMIIPKS | 6.71 | SEMVIPKN | 3.23 | | |
| NS1 | 1018 | 1.35 | 7 | 4 | 0 | Y | IPKNFAGP | 57.6 | IPKNLAGP | 34.61 | IPKSFAGP | 6.47 | IPKGFAGP | 0.48 |
| NS1 | 1019 | 1.36 | 8 | 4 | 0 | Y | PKNFAGPV | 57.6 | PKNLAGPV | 34.49 | PKSFAGPV | 6.47 | PKGFAGPV | 0.48 |
| NS1 | 1020 | 1.36 | 8 | 4 | 0 | Y | KNFAGPVS | 57.6 | KNLAGPVS | 34.49 | KSFAGPVS | 6.47 | KGFAGPVS | 0.48 |
| NS1 | 1021 | 1.37 | 9 | 5 | 0 | Y | NFAGPVSQ | 57.6 | NLAGPVSQ | 34.37 | SFAGPVSQ | 6.47 | GFAGPVSQ | 0.48 |
| NS1 | 1022 | 1 | 3 | 2 | 0 | Y | FAGPVSQH | 64.67 | LAGPVSQH | 34.61 | | | | |
| NS1 | 1023 | 0.03 | 5 | 1 | 0 | Y | AGPVSQHN | 99.76 | | | | | | |
| NS1 | 1024 | 0.24 | 3 | 2 | 0 | Y | GPVSQHNY | 96.77 | GPYSQHNN | 2.4 | | | | |
| NS1 | 1025 | 0.24 | 5 | 2 | 0 | Y | PVSQHNYR | 96.77 | PVSQHNNR | 2.4 | | | | |
| NS1 | 1026 | 0.29 | 6 | 3 | 0 | Y | VSQHNYRP | 96.29 | VSQHNNRP | 2.4 | VSQHNHRP | 0.6 | | |
| NS1 | 1027 | 0.27 | 5 | 3 | 0 | Y | SQHNYRPG | 96.41 | SQHNNRPG | 2.4 | SQHNHRPG | 0.6 | | |
| NS1 | 1028 | 0.27 | 5 | 3 | 0 | Y | QHNYRPGY | 96.41 | QHNNRPGY | 2.4 | QHNHRPGY | 0.6 | | |

Note: row 1021 additionally lists peptide NIAGPVSQ with frequency 0.48.

FIG. 6-39

Species: DENV2 (8-mers)

| protein | block starting position | block entropy | total peptides in block | # peptides required to cover 99% of block | gap/X fraction | 99% of block covered w/ =>5 peptides? | peptides required to

FIG. 6-40

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1054 | 1.67 | 6 | 4 | 0 | Y | FCEGTTVV | 55.69 | FCDGTTVI | 22.63 | LCEGTTVV | 12.46 | FCDGTTVV | 8.86 |
|

FIG. 6-41

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---

FIG. 6-42

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1104 | 0 | 1 | 1 | 0 | Y | CWYGMEIR | 100 | | | | | | |
| NS1 | 1105 | 0 | 1 | 1 | 0 | Y | WYGMEIRP | 100 | | | | | | |
| NS1 | 1106 | 0 | 1 | 1 | 0 | Y | YGMEIRPL | 100 | | | | | | |
| NS1 | 1107 | 0.02 | 2 | 1 | 0 | Y | GMEIRPLK | 99.76 | | | | | | |
| NS1 | 1108 | 0.02 | 2 | 1 | 0 | Y | MEIRPLKE | 99.76 | | | | | | |
| NS1 | 1109 | 0.11 | 3 | 2 | 0 | Y | EIRPLKEK | 98.68 | EIRPLKER | 1.08 | | | | |
| NS1 | 1110 | 0.11 | 3 | 2 | 0 | Y | IRPLKEKE | 98.68 | IRPLKERE | 1.08 | | | | |
| NS1 | 1111 | 0.11 | 3 | 2 | 0 | Y | RPLKEKEE | 98.68 | RPLKEREE | 1.08 | | | | |
| NS1 | 1112 | 0.12 | 4 | 2 | 0 | Y | PLKEKEEN | 98.56 | PLKEREEN | 1.08 | | | | |
| NS1 | 1113 | 0.12 | 4 | 2 | 0 | Y | LKEKEENL | 98.56 | LKEREENL | 1.08 | | | | |
| NS1 | 1114 | 0.14 | 4 | 2 | 0 | Y | KEKEENLV | 98.44 | KEREENLV | 1.08 | | | | |
| NS1 | 1115 | 0.28 | 5 | 3 | 0 | Y | EKEENLVN | 96.29 | EKEENLYS | 2.4 | EREENLVN | 1.08 | | |
| NS1 | 1116 | 0.28 | 5 | 3 | 0 | Y | KEENLVNS | 96.29 | KEENLVSS | 2.4 | REENLVNS | 1.08 | | |
| NS1 | 1117 | 0.19 | 4 | 2 | 0 | Y | EENLVNSL | 97.37 | EENLVSSL | 2.4 | | | | |
| NS1 | 1118 | 0.19 | 4 | 2 | 0 | Y | ENLVNSLV | 97.37 | ENLVSSLV | 2.4 | | | | |
| NS1 | 1119 | 0.19 | 4 | 2 | 0 | Y | NLVNSLVT | 97.37 | NLVSSLVT | 2.4 | | | | |
| NS1 | 1120 | 0.19 | 4 | 2 | 0 | Y | LVNSLVTA | 97.37 | LVSSLVTA | 2.4 | | | | |
| NS1 | 1121 | 0.19 | 4 | 2 | 0 | Y | VNSLVTAG | 97.37 | VSSLVTAG | 2.4 | | | | |
| NS1 | 1122 | 0.31 | 7 | 3 | 0 | Y | NSLVTAGH | 96.05 | SSLVTAGH | 2.4 | NSLVTAGQ | 0.72 | | |
| NS1 | 1123 | 0.13 | 5 | 2 | 0 | Y | SLVTAGHG | 98.56 | SLVTAGQG | 0.72 | | | | |
| NS1 | 1124 | 0.15 | 6 | 2 | 0 | Y | LVTAGHGQ | 98.44 | LVTAGQGQ | 0.72 | | | | |
| NS1 | 1125 | 1.04 | 8 | 3 | 0 | Y | VTAGHGQV | 67.19 | VTAGHGQI | 31.26 | VTAGQGQV | 0.6 | | |
| NS1 | 1126 | 1.04 | 8 | 3 | 0 | Y | TAGHGQVD | 67.19 | TAGHGQID | 31.26 | TAGQGQVD | 0.6 | | |
| NS1 | 1127 | 1.04 | 8 | 3 | 0 | Y | AGHGQVDN | 67.19 | AGHGQIDN | 31.26 | AGQGQVDN | 0.6 | | |
| NS2A | 1128 | 1.04 | 8 | 3 | 0 | Y | GHGQVDNF | 67.19 | GHGQIDNF | 31.26 | GQGQVDNF | 0.6 | | |

FIG. 6-43

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1129 | 1.04 | 8 | 3 | 0 | Y | HGQIDNFS | 67.19 | HGQVDNFS | 31.26 | QGQVDNFS | 0.6 | | |
| NS2A | 1130 | 0.92 | 3 | 2 | 0 | Y | GQIDNFSL | 68.02 | GQVDNFSL | 31.86 | | | | |
| NS2A | 1131 | 0.92 | 3 | 2 | 0 | Y | QIDNFSLG | 68.02 | QVDNFSLG | 31.86 | | | | |
| NS2A | 1132 | 1.19 | 4 | 3 | 0 | Y | IDNFSLGV | 62.99 | VDNFSLGV | 31.62 | IDNFSLGI | 5.15 | | |
| NS2A | 1133 | 0.32 | 3 | 2 | 0 | Y | DNFSLGVL | 94.49 | DNFSLGIL | 5.39 | | | | |
| NS2A | 1134 | 0.32 | 3 | 2 | 0 | Y | NFSLGVLG | 94.49 | NFSLGILG | 5.39 | | | | |
| NS2A | 1135 | 0.37 | 6 | 2 | 0 | Y | FSLGVLGM | 94.01 | FSLGILGM | 5.39 | | | | |
| NS2A | 1136 | 0.37 | 6 | 2 | 0 | Y | SLGVLGMA | 94.01 | SLGILGMA | 5.39 | | | | |
| NS2A | 1137 | 0.37 | 6 | 2 | 0 | Y | LGVLGMAL | 94.01 | LGILGMAL | 5.39 | | | | |
| NS2A | 1138 | 0.47 | 8 | 4 | 0 | Y | GVLGMALF | 93.41 | GILGMALF | 3.71 | GILGMALL | 1.68 | GVLGMALL | 0.6 |
| NS2A | 1139 | 0.47 | 8 | 4 | 0 | Y | VLGMALFL | 93.41 | ILGMALFL | 3.71 | ILGMALLL | 1.68 | VLGMALLL | 0.6 |
| NS2A | 1140 | 0.22 | 6 | 2 | 0 | Y | LGMALFLE | 97.13 | LGMALLLE | 2.28 | | | | |
| NS2A | 1141 | 0.21 | 5 | 2 | 0 | Y | GMALFLEE | 97.25 | GMALLLEE | 2.28 | | | | |
| NS2A | 1142 | 0.21 | 5 | 2 | 0 | Y | MALFLEEM | 97.25 | MALLLEEM | 2.28 | | | | |
| NS2A | 1143 | 0.17 | 3 | 1 | 0 | Y | ALFLEEML | 97.6 | ALLLEEML | 2.28 | | | | |
| NS2A | 1144 | 0.21 | 3 | 2 | 0 | Y | LFLEEMLR | 97.13 | LLLEEMLR | 2.28 | | | | |
| NS2A | 1145 | 0.21 | 3 | 2 | 0 | Y | FLEEMLRT | 97.13 | LLEEMLRT | 2.28 | | | | |
| NS2A | 1146 | 0.05 | 2 | 1 | 0 | Y | LEEMLRTR | 99.4 | | | | | | |
| NS2A | 1147 | 0.84 | 4 | 2 | 0 | Y | EEMLRTRV | 77.01 | EEMLRTRI | 22.16 | | | | |
| NS2A | 1148 | 0.84 | 4 | 2 | 0 | Y | EMLRTRVG | 77.01 | EMLRTRIG | 22.16 | | | | |
| NS2A | 1149 | 0.87 | 6 | 3 | 0 | Y | MLRTRVGT | 76.77 | MLRTRIGT | 22.04 | MLKTRVGT | 0.6 | | |
| NS2A | 1150 | 0.87 | 6 | 3 | 0 | Y | LRTRVGTK | 76.77 | LRTRIGTK | 22.04 | LKTRVGTK | 0.6 | | |
| NS2A | 1151 | 0.89 | 8 | 3 | 0 | Y | RTRVGTKH | 76.65 | RTRIGTKH | 21.92 | KTRVGTKH | 0.6 | | |
| NS2A | 1152 | 0.88 | 9 | 3 | 0 | Y | TRVGTKHA | 77.01 | TRIGTKHA | 21.8 | TRMGTKHA | 0.24 | | |
| NS2A | 1166 | 0.31 | 7 | 3 | 0 | Y | SFVTLITG | 96.05 | SFMTLITG | 2.4 | SLVTLITG | 0.72 | | |

FIG. 6-44

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1167 | 0.3 | 6 | 3 | 0 | Y | FVTLITGN | 96.17 | FMTLITGN | 2.4 | LVTLITGN | 0.72 | | |
| NS2A | 1168 | 0.27 | 7 | 3 | 0 | Y | VTLITGNM | 96.53 | MTLITGNM | 2.4 | VTLITGNL | 0.36 | | |
| NS2A | 1169 | 0.07 | 5 | 1 | 0 | Y | TLITGNMS | 99.28 | | | | | | |
| NS2A | 1170 | 0.1 | 8 | 1 | 0 | Y | LITGNMSF | 99.04 | | | | | | |
| NS2A | 1171 | 1 | 9 | 2 | 0 | Y | ITGNMSFR | 67.31 | ITGNMSFK | 31.74 | | | | |
| NS2A | 1172 | 1 | 9 | 2 | 0 | Y | TGNMSFRD | 67.31 | TGNMSFKD | 31.74 | | | | |
| NS2A | 1173 | 0.99 | 8 | 2 | 0 | Y | GNMSFRDL | 67.43 | GNMSFKDL | 31.74 | | | | |
| NS2A | 1174 | 0.99 | 8 | 2 | 0 | Y | NMSFRDLG | 67.43 | NMSFKDLG | 31.74 | | | | |
| NS2A | 1175 | 0.99 | 8 | 2 | 0 | Y | MSFRDLGR | 67.43 | MSFKDLGR | 31.74 | | | | |
| NS2A | 1176 | 0.97 | 7 | 2 | 0 | Y | SFRDLGRV | 67.43 | SFKDLGRV | 31.98 | | | | |
| NS2A | 1177 | 1.15 | 11 | 5 | 0 | Y | FRDLGRVM | 66.71 | FKDLGRVV | 29.94 | FKDLGRVI | 1.68 | FRDLGRVV | 0.48 | FRDLGRVM | 0.36 |
| NS2A | 1178 | 1.12 | 8 | 4 | 0 | Y | RDLGRVVM | 66.95 | KDLGRVVV | 30.06 | KDLGRVII | 1.56 | RDLGRVVV | 0.48 | | |
| NS2A | 1179 | 1.07 | 7 | 3 | 0 | Y | DLGRVVMM | 67.31 | DLGRVVVM | 30.3 | DLGRVIIM | 1.8 | | | |
| NS2A | 1180 | 1.08 | 8 | 3 | 0 | Y | LGRVVMMV | 67.19 | LGRVVVMV | 30.3 | LGRVIIMV | 1.8 | | | |
| NS2A | 1181 | 1.08 | 8 | 3 | 0 | Y | GRVVMMVG | 67.19 | GRVVVMVG | 30.3 | GRVIIMVG | 1.8 | | | |
| NS2A | 1182 | 1.13 | 10 | 4 | 0 | Y | RVVMMVGA | 66.95 | RVVVMVGA | 29.94 | RVIIMVGA | 1.8 | RVVMVGT | 0.36 | | |
| NS2A | 1191 | 1 | 9 | 5 | 0 | Y | MTDDIGMG | 76.89 | MADDIGMG | 19.4 | MTDEMGMG | 2.04 | MTDDIGIG | 0.6 | MADDIGTG | 0.36 |
| NS2A | 1192 | 1.05 | 9 | 5 | 0 | Y | TDDIGMGV | 76.17 | ADDIGMGV | 19.4 | TDEMGMGV | 2.04 | TDDIGMGI | 1.08 | TDDIGIGV | 0.6 |
| NS2A | 1193 | 0.36 | 7 | 4 | 0 | Y | DDIGMGVT | 95.45 | DEMGMGVT | 2.04 | DDIGMGIT | 1.08 | DDIGIGVT | 0.72 | | |
| NS2A | 1194 | 0.36 | 7 | 4 | 0 | Y | DIGMGVTY | 95.45 | EMGMGVTY | 2.04 | DIGMGITY | 1.08 | DIGIGVTY | 0.72 | | |
| NS2A | 1195 | 0.35 | 6 | 4 | 0 | Y | IGMGVTYL | 95.57 | MGMGVTYL | 2.04 | IGMGITYL | 1.08 | IGIGVTYL | 0.72 | | |
| NS2A | 1196 | 0.2 | 5 | 3 | 0 | Y | GMGVTYLA | 97.6 | MGITYLA | 1.08 | GIGVTYLA | 0.72 | | | |
| NS2A | 1197 | 0.2 | 5 | 3 | 0 | Y | MGVTYLAL | 97.6 | MGITYLAL | 1.08 | IGVTYLAL | 0.72 | | | |
| NS2A | 1198 | 0.1 | 3 | 2 | 0 | Y | GVTYLALL | 98.8 | GITYLALL | 1.08 | | | | | |
| NS2A | 1199 | 0.1 | 3 | 2 | 0 | Y | VTYLALLA | 98.8 | ITYLALLA | 1.08 | | | | | |

FIG. 6-45

Species: DENV2 (8-mers)

| protein | block starting position | block entropy | total peptides in

FIG. 6-46

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1225 | 1.13 | 6 | 3 | 0 | Y | SKELMMAT | 55.33 | SKELMMAT | 42.63 | SKELMMAT | 1.56 | | |
| NS2A | 1226 | 1.13 | 6 | 3 | 0 | Y | KELMMATI | 55.33 | KELMMTTI | 42.63 | KELMMATI | 1.56 | | |
| NS2A | 1227 | 1.13 | 6 | 3 | 0 | Y | ELMMATIG | 55.33 | ELMMTTIG | 42.63 | ELLMATIG | 1.56 | | |
| NS2A | 1228 | 1.22 | 7 | 4 | 0 | Y | LMMATIGI | 54.49 | LMMTTIGI | 42.28 | LLMATIGV | 1.56 | LMMATIGV | 0.84 | | |
| NS2A | 1232 | 1.36 | 7 | 5 | 0 | Y | TIGIALLS | 51.86 | TIGIVLLS | 42.28 | TIGITLLS | 2.63 | TIGIVLLS | 2.04 | TIGVALLS | 0.84 |
| NS2A | 1233 | 1.35 | 6 | 5 | 0 | Y | IGIALLSQ | 51.86 | IGIVLLSQ | 42.28 | IGITLLSQ | 2.63 | IGIVLLSQ | 2.16 | IGVALLSQ | 0.84 |
| NS2A | 1234 | 1.36 | 7 | 5 | 0 | Y | GIALLSQS | 51.86 | GIVLLSQS | 42.16 | GITLLSQS | 2.63 | GVVLLSQS | 2.16 | GVALLSQS | 0.84 |
| NS2A | 1244 | 1.03 | 9 | 5 | 0 | Y | PETILELT | 75.93 | PETVLELT | 20.36 | PGTVLELT | 1.68 | PESILELT | 0.84 | PENILELT | 0.6 |
| NS2A | 1245 | 1.03 | 9 | 5 | 0 | Y | ETILELTD | 75.93 | ETVLELTD | 20.36 | GTVLELTD | 1.68 | ESILELTD | 0.84 | ENILELTD | 0.6 |
| NS2A | 1246 | 0.93 | 7 | 4 | 0 | Y | TILELTDA | 75.93 | TVLELTDA | 22.16 | SILELTDA | 0.84 | NILELTDA | 0.6 | | |
| NS2A | 1247 | 0.93 | 8 | 3 | 0 | Y | ILELTDAL | 77.13 | VLELTDAL | 20.24 | VLELTDAI | 1.92 | | | | |
| NS2A | 1248 | 0.2 | 5 | 2 | 0 | Y | LELTDALA | 97.37 | LELTDAIA | 2.04 | | | | | | |
| NS2A | 1249 | 0.17 | 4 | 2 | 0 | Y | ELTDALAL | 97.72 | ELTDAIAL | 2.04 | | | | | | |
| NS2A | 1250 | 0.18 | 4 | 2 | 0 | Y | LTDALALG | 97.6 | LTDAIALG | 2.04 | | | | | | |
| NS2A | 1251 | 0.2 | 6 | 2 | 0 | Y | TDALALGM | 97.49 | TDAIALGI | 1.92 | | | | | | |
| NS2A | 1252 | 0.2 | 6 | 2 | 0 | Y | DALALGMM | 97.49 | DAIALGIM | 1.92 | | | | | | |
| NS2A | 1253 | 0.5 | 8 | 4 | 0 | Y | ALALGMMV | 93.05 | ALALGMMA | 3.11 | A

FIG. 6-47

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1270 | 0.25 | 7 | 2 | 0 | Y | YQLAVTIM | 96.65 | YQLAVTYM | 2.63 | | | | |
| NS2A | 1271 | 0.42 | 9 | 4 | 0 | Y | QLAVTIMA | 94.49 | QLAVTYMA | 2.63 | QLAVTIMT | 1.56 | QLAVTIMV | 0.6 | |
| NS2A | 1277 | 1.33 | 11 | 5 | 0 | Y | MAISCVPN | 53.05 | MAILCVPN | 42.28 | MAMLCIPN | 1.8 | MTILCVPN | 1.44 | MVISCVPN 0.6 |
| NS2A | 1278 | 1.32 | 11 | 5 | 0 | Y | AISCVPNA | 53.05 | AILCVPNA | 42.4 | AMLCIPNV | 1.56 | TILCVPNA | 1.44 | VISCVPNA 0.6 |
| NS2A | 1279 | 1.2 | 10 | 4 | 0 | Y | ISCVPNAV | 53.53 | ILCVPNAV | 43.83 | MLCIPNVM | 1.56 | ISCVPNAM | 0.24 | |
| NS2A | 1280 | 1.24 | 9 | 4 | 0 | Y | SCVPNAVI | 53.53 | LCVPNAVI | 43.11 | LCIPNVMI | 1.08 | LCVPNAVW | 1.08 | |
| NS2A | 1281 | 0.28 | 8 | 3 | 0 | Y | CVPNAVIL | 96.65 | CIPNVMIL | 1.56 | CVPNAVWL | 1.08 | | | |
| NS2A | 1282 | 0.59 | 12 | 5 | 0 | Y | VPNAVILQ | 92.1 | VPNAVILR | 2.99 | IPNVMILQ | 1.56 | VPNAVILL | 1.44 | VPNAVWLQ 1.08 |
| NS2A | 1283 | 0.59 | 11 | 5 | 0 | Y | PNAVILQN | 92.1 | PNAVILRN | 2.99 | PNWMILQH | 1.68 | PNAVILLN | 1.44 | PNAVWLQN 1.08 |
| NS2A | 1284 | 0.59 | 11 | 5 | 0 | Y | NAVILQNA | 92.1 | NAVILRNA | 2.99 | NVMILQHA | 1.68 | NAVILLNA | 1.44 | NAVWLQNA 1.08 |
| NS2A | 1285 | 0.59 | 11 | 5 | 0 | Y | AVILQNAW | 92.1 | AVILRNAW | 2.99 | VMILQHAW | 1.68 | AVILLNAW | 1.44 | AVWLQNAW 1.08 |
| NS2A | 1287 | 0.61 | 10 | 5 | 0 | Y | ILQNAWKV | 91.74 | ILRNAWKV | 3.11 | MILQHAWK | 1.68 | ILLNAWKV | 1.56 | VLQNAWKV 1.08 |
| NS2A | 1289 | 0.56 | 10 | 5 | 0 | Y | QNAWKVSC | 92.57 | RNAWKVSC | 3.11 | LQHAWKV | 1.56 | QHAWKVGC | 1.44 | QNAWKVGC 0.36 |
| NS2A | 1290 | 0.25 | 8 | 4 | 0 | Y | NAWKVSCT | 97.13 | HAWKVGCT | 1.44 | LNAWKVSC | 1.56 | HAWKVSCA | 0.24 | |
| NS2A | 1291 | 0.46 | 8 | 4 | 0 | Y | AWKVSCTI | 93.65 | AWKVSCTT | 3.23 | NAWKVGCT | 0.36 | AWKVSCAI | 0.48 | |
| NS2A | 1292 | 0.46 | 8 | 4 | 0 | Y | WKVSCTIL | 93.65 | WKVSCTTL | 3.23 | AWKVGCTI | 1.8 | WKVSCAIL | 0.48 | |
| NS2A | 1293 | 0.46 | 8 | 4 | 0 | Y | KVSCTILA | 93.65 | KVSCTTLA | 3.23 | WKVGCTIL | 1.8 | KVSCAILA | 0.48 | |
| NS2A | 1296 | 1.33 | 9 | 5 | 0 | Y | CTILAVVS | 54.13 | CTILAVVS | 40.24 | KVGCTILA | 1.8 | CTILATYS | 1.56 | ILAAVSYF 0.24 |
| NS2A | 1297 | 1.34 | 11 | 5 | 0 | Y | TILAAVSV | 54.13 | TILAVVSV | 40.24 | CTILAVVS | 3.23 | TILATVSV | 1.56 | |
| NS2A | 1298 | 1.36 | 8 | 5 | 0 | Y | ILAAVSYS | 54.01 | ILAVVSYS | 40.24 | TILAVVSYS | 3.23 | ILATVSYS | 1.56 | |
| NS2A | 1299 | 1.17 | 9 | 3 | 0 | Y | LAAVSYSP | 54.13 | LAVVSYSP | 43.47 | TLAVVSYSP | 3.11 | LATVSYSP | 1.56 | |
| NS2A | 1300 | 1.18 | 10 | 3 | 0 | Y | AAVSYSPL | 54.01 | AVVSYSPL | 43.47 | ATVSYSPL | 1.56 | | | |
| NS2A | 1302 | 0.49 | 9 | 4 | 0 | Y | VSVSPLLL | 93.17 | VSVSPLFL | 3.35 | VSVSPLIL | 2.28 | VSVFPLLL | 0.36 | |
| NS2A | 1303 | 0.48 | 9 | 4 | 0 | Y | SVSPLLLT | 93.29 | SVSPLFLT | 3.35 | SVSPLLLT | 2.28 | SVFPLLLT | 0.36 | |
| NS2A | 1304 | 0.48 | 9 | 4 | 0 | Y | VSPLLLTS | 93.29 | VSPLFLTS | 3.35 | VSPLLLTS | 2.28 | VFPLLLTS | 0.36 | |

FIG. 6-48

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1305 | 0.45 | 8 | 3 | 0 | Y | SPLLLTSS | 93.53 | SPLELTSS | 3.35 | SPLLLTSS | 2.28 | | |
| NS2A | 1306 | 0.57 | 9 | 4 | 0 | Y | PLLLTSSQ | 91.98 | PLFLTSSQ | 3.35 | PLLLTSSQ | 2.28 | PLLLTSR | 1.68 |
| NS2A | 1307 | 0.57 | 9 | 4 | 0 | Y | LLLTSSQQ | 91.98 | LFLTSSQQ | 3.35 | LLLTSSQQ | 2.28 | LLLTSSRQ | 1.68 |
| NS2A | 1308 | 0.55 | 8 | 4 | 0 | Y | LLTSSQQK | 92.1 | FLTSSQQK | 3.35 | LLTSSQQK | 2.28 | LLTSSRQK | 1.68 |
| NS2A | 1309 | 1.11 | 8 | 4 | 0 | Y | LTSSQQKA | 64.43 | LTSSQQKT | 33.29 | LTSSRQKT | 1.08 | LTSSRQKA | 0.6 |
| NS2A | 1310 | 1.08 | 6 | 3 | 0 | Y | TSSQQKAD | 64.55 | TSSQQKTD | 33.41 | TSSRQKTD | 1.08 | | |
| NS2A | 1311 | 1.08 | 6 | 3 | 0 | Y | SSQQKADW | 64.55 | SSQQKTDW | 33.41 | SSRQKTDW | 1.08 | | |
| NS2A | 1312 | 1.08 | 6 | 3 | 0 | Y | SQQKADWI | 64.55 | SQQKTDWI | 33.41 | SRQKTDWI | 1.08 | | |
| NS2A | 1313 | 1.08 | 6 | 3 | 0 | Y | QQKADWIP | 64.55 | QQKTDWIP | 33.41 | RQKTDWIP | 1.08 | | |
| NS2A | 1314 | 0.93 | 5 | 2 | 0 | Y | QKADWIPL | 65.27 | QKTDWIPL | 34.73 | | | | |
| NS2A | 1315 | 1.03 | 6 | 3 | 0 | Y | KADWIPLA | 65.03 | KTDWIPLA | 33.65 | KTDWIPLV | 1.08 | | |
| NS2A | 1316 | 1.03 | 6 | 3 | 0 | Y | ADWIPLAL | 65.03 | TDWIPLAL | 33.65 | TDWIPLVL | 0.96 | | |
| NS2A | 1317 | 0.13 | 2 | 2 | 0 | Y | DWIPLALT | 98.56 | DWIPLVLT | 0.84 | | | | |
| NS2A | 1318 | 0.16 | 5 | 2 | 0 | Y | WIPLALTI | 98.32 | WIPLVLTI | 0.84 | | | | |
| NS2A | 1319 | 0.17 | 6 | 2 | 0 | Y | IPLALTIK | 98.2 | IPLVLTIK | 0.84 | | | | |
| NS2A | 1320 | 0.17 | 6 | 2 | 0 | Y | PLALTIKG | 98.2 | PLVLTIKG | 0.84 | | | | |
| NS2A | 1321 | 0.17 | 7 | 2 | 0 | Y | LALTIKGL | 98.2 | LVLTIKGL | 0.84 | | | | |
| NS2A | 1322 | 0.2 | 8 | 3 | 0 | Y | ALTIKGLN | 97.96 | VLTIKGLN | 0.84 | ALTWKGLN | 0.24 | | |
| NS2A | 1323 | 0.13 | 8 | 2 | 0 | Y | LTIKGLNP | 98.8 | LTWKGLNP | 0.24 | | | | |
| NS2A | 1324 | 0.11 | 7 | 2 | 0 | Y | TIKGLNPT | 98.92 | TIKGLSPT | | | | | |
| NS2A | 1325 | 0.06 | 4 | 1 | 0 | Y | IKGLNPTA | 99.4 | | | | | | |
| NS2A | 1326 | 0.04 | 3 | 1 | 0 | Y | KGLNPTAI | 99.64 | | | | | | |
| NS2A | 1327 | 0.04 | 3 | 1 | 0 | Y | GLNPTAIF | 99.64 | | | | | | |
| NS2A | 1328 | 0.04 | 3 | 1 | 0 | Y | LNPTAIFL | 99.64 | | | | | | |
| NS2A | 1329 | 0.04 | 3 | 1 | 0 | Y | NPTAIFLT | 99.64 | | | | | | |

FIG. 6-49

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99

FIG. 6-50

Species: DENV2 (8-mers)

| protein | block starting position | block entropy | total peptides

FIG. 6-51

Species: DENV2 (8-mers)

| protein | block starting position | block entropy | total peptides in block | # peptides required to cover 99% of block | gap/X fraction | 99% of block covered w/ <= 5 peptides?

FIG. 6-52

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1411 | 0.08 | 6 | 1 | 0 | Y | EISG

FIG. 6-53

Species: DENV2 (8-mers)

| protein | block starting position | block entropy | total peptides in block | # peptides required to cover 99% of block | gap/k fraction | 99% of block covered w/ <= 5 peptides? | peptides required to cover 99% of block | frequency | peptides required to cover 99% of block | frequency | peptides required to cover 99%

FIG. 6-54

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1461 | 0.08 | 4 | 1 | 0 | Y | ITAAAWYL | 99.16 | | | | | | |
| NS2B | 1462 | 0.02 | 2 | 1 | 0 | Y | TAAAWYLW | 99.76 | | | | | | |
| NS2B | 1463 | 0.02 | 2 | 1 | 0 | Y | AAAWYLWE | 99.76 | | | | | | |
| NS2B | 1464 | 0.17 | 4 | 2 | 0 | Y | AAWYLWEV | 97.72 | AAWYLWET | 1.92 | | | | |
| NS2B | 1465 | 0.19 | 5 | 2 | 0 | Y | AWYLWEVK | 97.6 | AWYLWETK | 1.92 | | | | |
| NS2B | 1466 | 0.19 | 5 | 2 | 0 | Y | WYLWEVKK | 97.6 | WYLWETKK | 1.92 | | | | |
| NS2B | 1467 | 0.19 | 5 | 2 | 0 | Y | YLWEVKKQ | 97.6 | YLWETKKQ | 1.92 | | | | |
| NS2B | 1468 | 0.16 | 4 | 2 | 0 | Y | LWEVKKQR | 97.84 | LWETKKQR | 1.92 | | | | |
| NS2B | 1469 | 0.16 | 4 | 2 | 0 | Y | WEVKKQRA | 97.84 | WETKKQRA | 1.92 | | | | |
| NS2B | 1470 | 0.16 | 4 | 2 | 0 | Y | EVKKQRAG | 97.84 | ETKKQRAG | 1.92 | | | | |
| NS2B | 1471 | 0.16 | 4 | 2 | 0 | Y | VKKQRAGV | 97.84 | TKKQRAGV | 1.92 | | | | |
| NS2B | 1472 | 0.01 | 2 | 1 | 0 | Y | KKQRAGVL | 99.88 | | | | | | |
| NS2B | 1473 | 0 | 1 | 1 | 0 | Y | KQRAGVLW | 100 | | | | | | |
| NS2B | 1474 | 0 | 1 | 1 | 0 | Y | QRAGVLWD | 100 | | | | | | |
| NS2B | 1475 | 0.04 | 2 | 1 | 0 | Y | RAGVLWDV | 99.52 | | | | | | |
| NS2B | 1476 | 0.04 | 2 | 1 | 0 | Y | AGVLWDVP | 99.52 | | | | | | |
| NS2B | 1477 | 0.04 | 2 | 1 | 0 | Y | GVLWDVPS | 99.52 | | | | | | |
| NS2B | 1478 | 0.04 | 2 | 1 | 0 | Y | VLWDVPSP | 99.52 | | | | | | |
| NS2B | 1479 | 0.07 | 3 | 1 | 0 | Y | LWDVPSPP | 99.28 | | | | | | |
| NS2B | 1480 | 0.09 | 4 | 1 | 0 | Y | WDVPSPPP | 99.04 | | | | | | |
| NS3 | 1481 | 1.08 | 6 | 3 | 0 | Y | DVPSPPPV | 65.03 | DVPSPPPM | 32.93 | DVPSPPPI | 1.08 | | |
| NS3 | 1482 | 1.75 | 8 | 5 | 0 | Y | VPSPPPVG | 42.04 | VPSPPPMG | 32.1 | VPSPPPVE | 22.99 | VPSPPPIG | 1.08 | VPSPPPME | 0.84 |
| NS3 | 1489 | 0.92 | 6 | 3 | 0 | Y | GKAELEDG | 74.85 | EKAELEDG | 23.59 | GRAELEDG | 0.96 | | |
| NS3 | 1490 | 0.15 | 5 | 2 | 0 | Y | KAELEDGA | 98.32 | RAELEDGA | 1.08 | | | | |
| NS3 | 1491 | 0.06 | 4 | 1 | 0 | Y | AELEDGAY | 99.4 | | | | | | |

FIG. 6-55

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency

FIG. 6-56

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1517 | 0.06 | 3 | 1 | 0 | Y | KEGTFHTM | 99.4 | | | | | | |
| NS3 | 1518 | 0.01 | 2 | 1 | 0 | Y | EGTFHTMW | 99.88 | | | | | | |
| NS3 | 1519 | 0.01 | 2 | 1 | 0 | Y | GTFHTMWH | 99.88 | | | | | | |
| N

FIG. 6-57

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1542 | 0.15 | 3 | 2 | 0 | Y | PSWADVKK | 98.2 | PSWADVRK | 1.2 | | |
| NS3 | 1543 | 0.15 | 3 | 2 | 0 | Y | SWADVKKD | 98.2 | SWADVRKD | 1.2 | | |
| NS3 | 1544 | 0.09 | 2 | 2 | 0 | Y | WADVKKDL | 98.8 | WADVRKDL | 1.2 | | |
| NS3 | 1545 | 0.19 | 3 | 3 | 0 | Y | ADVKKDLI | 97.6 | ADVKKDLV | 1.2 | ADVRKDLI | 1.2 |
| NS3 | 1546 | 0.19 | 3 | 3 | 0 | Y | DVKKDLIS | 97.6 | DVKKDLVS | 1.2 | DVKKDLVS | 1.2 |
| NS3 | 1547 | 0.19 | 3 | 3 | 0 | Y | VKKDLISY | 97.6 | VKKDLVSY | 1.2 | VRKDLISY | 1.2 |
| NS3 | 1548 | 0.2 | 4 | 3 | 0 | Y | KKDLISYG | 97.49 | RKDLISYG | 1.2 | KKDLVSYG | 1.2 |
| NS3 | 1549 | 0.11 | 3 | 2 | 0 | Y | KDLISYGG | 98.68 | KDLVSYGG | 1.2 | | |
| NS3 | 1550 | 0.11 | 3 | 2 | 0 | Y | DLISYGGG | 98.68 | DLVSYGGG | 1.2 | | |
| NS3 | 1551 | 0.11 | 3 | 2 | 0 | Y | LISYGGGW | 98.68 | LVSYGGGW | 1.2 | | |
| NS3 | 1552 | 0.11 | 3 | 2 | 0 | Y | ISYGGGWK | 98.68 | VSYGGGWK | 1.2 | | |
| NS3 | 1553 | 0.01 | 2 | 1 | 0 | Y | SYGGWKL | 99.88 | | | | |
| NS3 | 1554 | 0.01 | 2 | 1 | 0 | Y | YGGGWKLE | 99.88 | | | | |
| NS3 | 1555 | 0.01 | 2 | 1 | 0 | Y | GGGWKLEG | 99.88 | | | | |
| NS3 | 1556 | 0 | 1 | 1 | 0 | Y | GGWKLEGE | 100 | | | | |
| NS3 | 1557 | 0 | 1 | 1 | 0 | Y | GWKLEGEW | 100 | | | | |
| NS3 | 1558 | 0 | 1 | 1 | 0 | Y | WKLEGEWK | 100 | | | | |
| NS3 | 1559 | 0 | 1 | 1 | 0 | Y | KLEGEWKE | 100 | | | | |
| NS3 | 1560 | 0 | 1 | 1 | 0 | Y | LEGEWKEG | 100 | | | | |
| NS3 | 1561 | 0 | 1 | 1 | 0 | Y | EGEWKEGE | 100 | | | | |
| NS3 | 1562 | 0.01 | 2 | 1 | 0 | Y | GEWKEGEE | 99.88 | | | | |
| NS3 | 1563 | 0.01 | 2 | 1 | 0 | Y | EWKEGEEV | 99.88 | | | | |
| NS3 | 1564 | 0.01 | 2 | 1 | 0 | Y | WKEGEEVQ | 99.88 | | | | |
| NS3 | 1565 | 0.01 | 2 | 1 | 0 | Y | KEGEEVQV | 99.88 | | | | |
| NS3 | 1566 | 0.01 | 2 | 1 | 0 | Y | EGEEVQVL | 99.88 | | | | |

FIG. 6-58

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1567 | 0.01 | 2 | 1 | 0 | Y | GEEVQVLA | 99.88 | | | | | | |
| NS3 | 1568 | 0.01 | 2 | 1 | 0 | Y | EEVQVLAL | 99.88 | | | | | | |
| NS3 | 1569 | 0.03 | 3 | 1 | 0 | Y | EVQVLALE | 99.76 | | | | | | |
| NS3 | 1570 | 0.01 | 2 | 1 | 0 | Y | VQVLALEP | 99.88 | | | | | | |
| NS3 | 1571 | 0.01 | 2 | 1 | 0 | Y | QVLALEPG | 99.88 | | | | | | |
| NS3 | 1572 | 0.01 | 2 | 1 | 0 | Y | VLALEPGK | 99.88 | | | | | | |
| NS3 | 1573 | 0.01 | 2 | 1 | 0 | Y | LALEPGKN | 99.88 | | | | | | |
| NS3 | 1574 | 0.01 | 2 | 1 | 0 | Y | ALEPGKNP | 99.88 | | | | | | |
| NS3 | 1575 | 0.03 | 3 | 1 | 0 | Y | LEPGKNPR | 99.76 | | | | | | |
| NS3 | 1576 | 0.01 | 2 | 1 | 0 | Y | EPGKNPRA | 99.88 | | | | | | |
| NS3 | 1577 | 0.01 | 2 | 1 | 0 | Y | PGKNPRAV | 99.88 | | | | | | |
| NS3 | 1578 | 0.01 | 2 | 1 | 0 | Y | GKNPRAVQ | 99.88 | | | | | | |
| NS3 | 1579 | 0.01 | 2 | 1 | 0 | Y | KNPRAVQT | 99.76 | | | | | | |
| NS3 | 1580 | 0.03 | 3 | 1 | 0 | Y | NPRAVQTK | 99.76 | | | | | | |
| NS3 | 1581 | 0.03 | 3 | 1 | 0 | Y | PRAVQTKP | 99.76 | | | | | | |
| NS3 | 1582 | 0.03 | 3 | 1 | 0 | Y | RAVQTKPG | 99.88 | | | | | | |
| NS3 | 1583 | 0.98 | 7 | 2 | 0 | Y | AVQTKPGL | 68.26 | AVQTKPGI | 30.9 | | | | |
| NS3 | 1584 | 0.96 | 6 | 2 | 0 | Y | VQTKPGLF | 68.38 | VQTKPGIF | 30.9 | | | | |
| NS3 | 1585 | 1.16 | 8 | 4 | 0 | Y | QTKPGLFK | 65.63 | QTKPGIFK | 30.54 | QTKPGLFR | 2.75 | QTKPGIFR | 0.36 |
| NS3 | 1586 | 1.16 | 8 | 4 | 0 | Y | TKPGLFKT | 65.63 | TKPGIFKT | 30.54 | TKPGLFRT | 2.75 | TKPGFFKT | 0.36 |
| NS3 | 1587 | 1.22 | 11 | 5 | 0 | Y | KPGLFKTN | 65.03 | KPGIFKTN | 30.42 | KPGLFRTN | 2.75 | KPGLFKTS | 0.48 | KPGFFKTN | 0.36 |
| NS3 | 1591 | 0.62 | 10 | 5 | 2 | Y | FKTNTGTI | 90.78 | FKTNAGTI | 4.79 | FRTNTGTI | 2.75 | FKTSTGTI | 0.48 | FRTNAGTI | 0.36 |
| NS3 | 1592 | 0.62 | 10 | 5 | 2 | Y | KTNTGTIG | 90.78 | KTNAGTIG | 4.79 | RTNTGTIG | 2.75 | KTSTGTIG | 0.48 | RTNAGTIG | 0.36 |
| NS3 | 1593 | 0.42 | 8 | 3 | 3 | Y | TNTGTIGA | 93.53 | TNAGTIGA | 5.15 | TSTGTIGA | 0.48 | | | |
| NS3 | 1594 | 0.44 | 9 | 3 | 3 | Y | NTGTIGAV | 93.41 | NAGTIGAV | 5.15 | STGTIGAV | 0.48 | | | |

FIG. 6-59

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1595 | 0.37 | 6 | 2 | 0 | Y | TGTIGAVS | 94.13 | AGTIGAVS | 5.15 | | | | |
| NS3 | 1596 | 0.06 | 4 | 1 | 0 | Y | GTIGAVSL | 99.4 | | | | | | |
| NS3 | 1597 | 0.06 | 4 | 1 | 0 | Y | TIGAVSLD | 99.4 | | | | | | |
| NS3 | 1598 | 0.01 | 2 | 1 | 0 | Y | IGAVSLDF | 99.88 | | | | | | |
| NS3 | 1599 | 0.01 | 2 | 1 | 0 | Y | GAVSLDFS | 99.88 | | | | | | |
| NS3 | 1600 | 0.01 | 2 | 1 | 0 | Y | AVSLDFSP | 99.88 | | | | | | |
| NS3 | 1601 | 0.01 | 2 | 1 | 0 | Y | VSLDFSPG | 99.88 | | | | | | |
| NS3 | 1602 | 0 | 1 | 1 | 0 | Y | SLDFSPGT | 100 | | | | | | |
| NS3 | 1603 | 0 | 1 | 1 | 0 | Y | LDFSPGTS | 100 | | | | | | |
| NS3 | 1604 | 0 | 1 | 1 | 0 | Y | DFSPGTSG | 100 | | | | | | |
| NS3 | 1605 | 0 | 1 | 1 | 0 | Y | FSPGTSGS | 100 | | | | | | |
| NS3 | 1606 | 0.01 | 2 | 1 | 0 | Y | SPGTSGSP | 99.88 | | | | | | |
| NS3 | 1607 | 0.01 | 2 | 1 | 0 | Y | PGTSGSPI | 99.88 | | | | | | |
| NS3 | 1608 | 0.97 | 4 | 2 | 0 | Y | GTSGSPIV | 63.47 | GTSGSPII | 36.29 | | | | |
| NS3 | 1609 | 0.97 | 4 | 2 | 0 | Y | TSGSPIVD | 63.47 | TSGSPIID | 36.29 | | | | |
| NS3 | 1610 | 1.35 | 6 | 3 | 0 | Y | SGSPIVDR | 54.85 | SGSPIIDK | 36.17 | SGSPIVDK | 8.62 | | |
| NS3 | 1611 | 1.36 | 7 | 3 | 0 | Y | GSPIVDRK | 54.73 | GSPIIDKK | 36.17 | GSPIVDKK | 8.62 | | |
| NS3 | 1612 | 1.36 | 7 | 3 | 0 | Y | SPIVDRKG | 54.73 | SPIIDKKG | 36.17 | SPIVDKKG | 8.62 | | |
| NS3 | 1613 | 1.36 | 7 | 3 | 0 | Y | PIVDRKGK | 54.73 | PIIDKKGK | 36.17 | PIVDKKGK | 8.62 | | |
| NS3 | 1614 | 1.35 | 6 | 3 | 0 | Y | IVDRKGKV | 54.85 | IIDKKGKV | 36.17 | IVDKKGKV | 8.62 | | |
| NS3 | 1615 | 1.35 | 6 | 3 | 0 | Y | VDRKGKVV | 54.85 | IDKKGKVV | 36.17 | VDKKGKVV | 8.62 | | |
| NS3 | 1616 | 1 | 3 | 2 | 0 | Y | DRKGKVVG | 54.97 | DKKGKVVG | 44.91 | | | | |
| NS3 | 1617 | 1 | 3 | 2 | 0 | Y | RKGKVVGL | 54.97 | KKGKVVGL | 44.91 | | | | |
| NS3 | 1618 | 0.01 | 2 | 1 | 0 | Y | KGKVVGLY | 99.88 | | | | | | |
| NS3 | 1619 | 0 | 1 | 1 | 0 | Y | GKVVGLYG | 100 | | | | | | |

FIG. 6-60

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1620 | 0 | 1 | 1 | 0 | Y | KWGLYGN | 100 | | | | | | | | |
| NS3 | 1621 | 0 | 1 | 1 | 0 | Y | WGLYGNG | 100 | | | | | | | | |
| NS3 | 1622 | 0 | 1 | 1 | 0 | Y | VGLYGNGV | 100 | | | | | | | | |
| NS3 | 1623 | 0 | 1 | 1 | 0 | Y | GLYGNGW | 100 | | | | | | | | |
| NS3 | 1624 | 0 | 1 | 1 | 0 | Y | LYGNGWT | 100 | | | | | | | | |
| NS3 | 1625 | 0 | 1 | 1 | 0 | Y | YGNGWTR | 100 | | | | | | | | |
| NS3 | 1626 | 0.08 | 4 | 1 | 0 | Y | GNGWTRS | 99.16 | | | | | | | | |
| NS3 | 1627 | 0.08 | 4 | 1 | 0 | Y | NGWTRSG | 99.16 | | | | | | | | |
| NS3 | 1628 | 0.49 | 6 | 1 | 0 | Y | GWTRSGA | 91.26 | GWTRSGT | 7.78 | | | | | | |
| NS3 | 1629 | 0.49 | 6 | 1 | 0 | Y | WTRSGAY | 91.26 | WTRSGTY | 7.78 | | | | | | |
| NS3 | 1630 | 0.49 | 6 | 1 | 0 | Y | TRSGAYY | 91.26 | VTRSGTYV | 7.78 | | | | | | |
| NS3 | 1631 | 0.49 | 6 | 2 | 0 | Y | TRSGAYYS | 91.26 | TRSGTYVS | 7.78 | | | | | | |
| NS3 | 1632 | 0.55 | 7 | 2 | 0 | Y | RSGAYYSA | 91.26 | RSGTYVSA | 5.99 | RSGTYVSS | 1.8 | | | | |
| NS3 | 1633 | 0.55 | 7 | 2 | 0 | Y | SGAYYSAI | 91.26 | SGTYVSAI | 5.99 | SGTYVSSI | 1.8 | | | | |
| NS3 | 1634 | 0.47 | 4 | 2 | 0 | Y | GAYYSAIA | 92.1 | GTYYSAIA | 5.99 | GTYYSSIA | 1.8 | | | | |
| NS3 | 1635 | 0.47 | 4 | 2 | 0 | Y | AYYSAIAQ | 92.1 | TYYSAIAQ | 5.99 | TYYSSIAQ | 1.8 | | | | |
| NS3 | 1636 | 0.15 | 3 | 2 | 0 | Y | YYSAIAQT | 97.96 | YVSSIAQT | 1.92 | | | | | | |
| NS3 | 1637 | 0.19 | 5 | 2 | 0 | Y | YSAIAQTE | 97.6 | VSSIAQTE | 1.92 | | | | | | |
| NS3 | 1638 | 0.2 | 6 | 2 | 0 | Y | SAIAQTEK | 97.6 | SSIAQTEK | 1.56 | | | | | | |
| NS3 | 1639 | 0.31 | 8 | 4 | 0 | Y | AIAQTEKS | 96.29 | SIAQTEKS | 1.56 | AIAQTEKN | 1.56 | AIAQTEKG | 0.72 | | |
| NS3 | 1640 | 0.34 | 10 | 5 | 0 | Y | IAQTEKSI | 96.05 | IAQTEKSV | 1.44 | IAQTEKNI | 1.44 | IAQTEKGI | 0.6 | IAQTETSV | 0.36 |
| NS3 | 1641 | 0.36 | 11 | 5 | 0 | Y | AQTEKSIE | 95.93 | AQTEKSVE | 1.44 | AQTEKNIE | 1.44 | AQTEKGIE | 0.6 | AQTETSVE | 0.36 |
| NS3 | 1647 | 0.46 | 9 | 4 | 0 | Y | IEDNPEIE | 93.77 | IEDNPDIE | 3.11 | VEDNPEIE | 1.8 | IENNPEIE | 0.6 | | |
| NS3 | 1648 | 0.34 | 8 | 3 | 0 | Y | EDNPEIED | 95.45 | EDNPDIED | 3.11 | ENNPEIED | 0.6 | DNPEIEDH | 0.6 | | |
| NS3 | 1649 | 0.38 | 8 | 4 | 0 | Y | DNPEIEDD | 94.85 | DNPDIEDD | 3.23 | NNPEIEDD | 0.6 | | | | |

FIG. 6-61

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1650 | 0.35 | 8 | 3 | 0 | Y | NPEIEDDI | 95.33 | NPDIEDDI | 3.23 | NPEIEDHI | 0.6 | | |
| NS3 | 1651 | 0.33 | 7 | 3 | 0 | Y | PEIEDDIF | 95.45 | PDIEDDIF | 3.23 | PEIEDHIF | 0.6 | | |
| NS3 | 1652 | 0.33 | 7 | 3 | 0 | Y | EIEDDIFR | 95.45 | DIEDDIFR | 3.23 | EIEDHIFR | 0.6 | | |
| NS3 | 1653 | 0.13 | 6 | 2 | 0 | Y | IEDDIFRK | 98.68 | IEDHIFRK | 0.6 | | | | |
| NS3 | 1654 | 1.06 | 7 | 3 | 0 | Y | EDDIFRKK | 62.87 | EDDIFRKR | 35.81 | EDHIFRKR | 0.6 | | |
| NS3 | 1655 | 1.17 | 8 | 4 | 0 | Y | DDIFRKKR | 62.87 | DDIFRKRR | 33.89 | DDIFRKRK | 1.92 | DHIFRKRR | 0.6 |
| NS3 | 1656 | 1.13 | 7 | 3 | 0 | Y | DIFRKKRL | 63.23 | DIFRKRRL | 34.01 | DIFRKRKL | 1.8 | | |
| NS3 | 1657 | 1.07 | 5 | 3 | 0 | Y | IFRKKRLT | 63.35 | IFRKRRLT | 34.61 | IFRKRKLT | 1.8 | | |
| NS3 | 1658 | 1.06 | 4 | 3 | 0 | Y | FRKKRLTI | 63.47 | FRKRRLTI | 34.61 | FRKRKLTI | 1.8 | | |
| NS3 | 1659 | 1.06 | 4 | 3 | 0 | Y | RKKRLTIM | 63.47 | RKRRLTIM | 34.61 | RKRKLTIM | 1.8 | | |
| NS3 | 1660 | 1.06 | 4 | 3 | 0 | Y | KKRLTIMD | 63.47 | KRRLTIMD | 34.61 | KRKLTIMD | 1.8 | | |
| NS3 | 1661 | 1.06 | 4 | 3 | 0 | Y | KRLTIMDL | 63.47 | RRLTIMDL | 34.61 | RKLTIMDL | 1.8 | | |
| NS3 | 1662 | 0.14 | 3 | 2 | 0 | Y | RLTIMDLH | 98.08 | KLTIMDLH | 1.8 | | | | |
| NS3 | 1663 | 0.01 | 2 | 1 | 0 | Y | LTIMDLHP | 99.88 | | | | | | |
| NS3 | 1664 | 0 | 1 | 1 | 0 | Y | TIMDLHPG | 100 | | | | | | |
| NS3 | 1665 | 0 | 1 | 1 | 0 | Y | IMDLHPGA | 100 | | | | | | |
| NS3 | 1666 | 0 | 1 | 1 | 0 | Y | MDLHPGAG | 100 | | | | | | |
| NS3 | 1667 | 0 | 1 | 1 | 0 | Y | DLHPGAGK | 100 | | | | | | |
| NS3 | 1668 | 0.01 | 2 | 1 | 0 | Y | LHPGAGKT | 99.88 | | | | | | |
| NS3 | 1669 | 0.01 | 2 | 1 | 0 | Y | HPGAGKTK | 99.88 | | | | | | |
| NS3 | 1670 | 0.12 | 3 | 2 | 0 | Y | PGAGKTKR | 98.44 | PGAGKTKK | 1.44 | | | | |
| NS3 | 1671 | 0.12 | 3 | 2 | 0 | Y | GAGKTKRY | 98.44 | GAGKTKKY | 1.44 | | | | |
| NS3 | 1672 | 0.12 | 3 | 2 | 0 | Y | AGKTKRYL | 98.44 | AGKTKKYL | 1.44 | | | | |
| NS3 | 1673 | 0.12 | 3 | 2 | 0 | Y | GKTKRYLP | 98.44 | GKTKKYLP | 1.44 | | | | |
| NS3 | 1674 | 0.12 | 3 | 2 | 0 | Y | KTKRYLPA | 98.44 | KTKKYLPA | 1.44 | | | | |

FIG. 6-62

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|

FIG. 6-63

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1700 | 0.01 | 2 | 1 | 0 | Y | RVWAAEME | 99.88 | | | | | | |
| NS3 | 1701 | 0.01 | 2 | 1 | 0 | Y | VWAAEMEE | 99.88 | | | | | | |
| NS3 | 1702 | 0.01 | 2 | 1 | 0 | Y | WAAEMEEA | 99.88 | | | | | | |
| NS3 | 1703 | 0.01 | 2 | 1 | 0 | Y | AAEMEEAL | 99.88 | | | | | | |
| NS3 | 1704 | 0.01 | 2 | 1 | 0 | Y | AEMEEALR | 99.88 | | | | | | |
| NS3 | 1705 | 0.01 | 2 | 1 | 0 | Y | EMEEALRG | 99.88 | | | | | | |
| NS3 | 1706 | 0.01 | 2 | 1 | 0 | Y | MEEALRGL | 99.88 | | | | | | |
| NS3 | 1707 | 0.01 | 2 | 1 | 0 | Y | EEALRGLP | 99.88 | | | | | | |
| NS3 | 1708 | 0.01 | 2 | 1 | 0 | Y | EALRGLPI | 99.88 | | | | | | |
| NS3 | 1709 | 0.01 | 2 | 1 | 0 | Y | ALRGLPIR | 99.88 | | | | | | |
| NS3 | 1710 | 0 | 1 | 1 | 0 | Y | LRGLPIRY | 100 | | | | | | |
| NS3 | 1711 | 0 | 1 | 1 | 0 | Y | RGLPIRYQ | 100 | | | | | | |
| NS3 | 1712 | 0 | 1 | 1 | 0 | Y | GLPIRYQT | 100 | | | | | | |
| NS3 | 1713 | 0.35 | 2 | 2 | 0 | Y | LPIRYQTP | 93.41 | LPIRYQTT | 6.59 | | | | |
| NS3 | 1714 | 0.35 | 2 | 2 | 0 | Y | PIRYQTPA | 93.41 | PIRYQTTA | 6.59 | | | | |
| NS3 | 1715 | 0.35 | 2 | 2 | 0 | Y | IRYQTPAI | 93.41 | IRYQTTAI | 6.59 | | | | |
| NS3 | 1716 | 1.09 | 3 | 3 | 0 | Y | RYQTPAIR | 71.38 | RYQTPAIK | 22.04 | RYQTTAIK | 6.59 | | |
| NS3 | 1717 | 1.33 | 8 | 4 | 0.48 | Y | YQTPAIRA | 71.02 | YQTPAIKT | 14.85 | YQTPAIKA | 7.07 | YQTAIKT | 6.59 |
| NS3 | 1718 | 1.35 | 9 | 4 | 0.48 | Y | QTPAIRAE | 70.42 | QTPAIKTE | 14.85 | QTPAIKAE | 7.07 | QTTAIKTE | 6.59 |
| NS3 | 1719 | 1.35 | 9 | 4 | 0.48 | Y | TPAIRAEH | 70.42 | TPAIKTEH | 14.85 | TPAIKAEH | 7.07 | TTAIKTEH | 6.59 |
| NS3 | 1720 | 1.35 | 9 | 4 | 0.48 | Y | PAIRAEHT | 70.42 | PAIKTEHT | 14.85 | PAIKAEHT | 7.07 | TAIKTEHT | 6.59 |
| NS3 | 1721 | 1.16 | 8 | 3 | 0.48 | Y | AIRAEHTG | 70.42 | AIKTEHTG | 21.44 | AIKAEHTG | 7.07 | | |
| NS3 | 1722 | 1.16 | 8 | 3 | 0.48 | Y | IRAEHTGR | 70.42 | IKTEHTGR | 21.44 | IKAEHTGR | 7.07 | | |
| NS3 | 1723 | 1.16 | 8 | 3 | 0.48 | Y | RAEHTGRE | 70.42 | KTEHTGRE | 21.44 | KAEHTGRE | 7.07 | | |
| NS3 | 1724 | 0.81 | 6 | 2 | 0.48 | Y | AEHTGREI | 77.49 | TEHTGREI | 21.56 | | | | |

FIG. 6-65

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|

FIG. 6-66

Species: DENV2 (8-mers)

| protein | block starting position | block entropy | total peptides in block | # peptides required

FIG. 6-67

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block

FIG. 6-68

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1825 | 0.26 | 11 | 4 | 0 | Y | WVTDFKGK | 97.01 | WITNFEGK | 1.68 | WITDFKGK | 0.24 | WITDFKGK | 0.24 | WITNFEGK | |
| NS3 | 1826 | 0.26 | 11 | 4 | 0 | Y | VTDFKGKT | 97.01 | ITNFKGKT | 1.68 | ITNFEGKT | 0.24 | ITNFEGKT | 0.24 | ITDFKGKT | |
| NS3 | 1827 | 0.22 | 8 | 2 | 0 | Y | TDFKGKTV | 97.37 | TNFKGKTV | 1.8 | | | | | | |
| NS3 | 1828 | 0.21 | 7 | 2 | 0 | Y | DFKGKTVW | 97.49 | NFKGKTVW | 1.8 | | | | | | |
| NS3 | 1829 | 0.07 | 5 | 1 | 0 | Y | FKGKTWF | 99.28 | | | | | | | | |
| NS3 | 1830 | 0.06 | 4 | 1 | 0 | Y | KGKTWFV | 99.4 | | | | | | | | |
| NS3 | 1831 | 0 | 1 | 1 | 0 | Y | GKTVWFVP | 100 | | | | | | | | |
| NS3 | 1832 | 0 | 1 | 1 | 0 | Y | KTVWFVPS | 100 | | | | | | | | |
| NS3 | 1833 | 0.01 | 2 | 1 | 0 | Y | TVWFVPSI | 99.88 | | | | | | | | |
| NS3 | 1834 | 0.14 | 3 | 2 | 0 | Y | VWFVPSIK | 98.08 | VWFVPSIR | 1.8 | WFVPSIRA | 1.8 | | | | |
| NS3 | 1835 | 0.31 | 4 | 3 | 0 | Y | WFVPSIKA | 95.69 | WFVPSIKT | 2.4 | FVPSIRAG | 1.8 | | | | |
| NS3 | 1836 | 0.31 | 4 | 3 | 0 | Y | FVPSIKAG | 95.69 | FVPSIKTG | 2.4 | VPSIRAGN | 1.8 | | | | |
| NS3 | 1837 | 0.31 | 4 | 3 | 0 | Y | VPSIKAGN | 95.69 | VPSIKTGN | 2.4 | PSIRAGND | 1.8 | | | | |
| NS3 | 1838 | 0.31 | 4 | 3 | 0 | Y | PSIKAGND | 95.69 | PSIKTGND | 2.4 | SIRAGNDI | 1.8 | | | | |
| NS3 | 1839 | 0.31 | 4 | 3 | 0 | Y | SIKAGNDI | 95.69 | SIKTGNDI | 2.4 | IRAGNDIA | 1.8 | | | | |
| NS3 | 1840 | 0.32 | 5 | 3 | 0 | Y | IKAGNDIA | 95.57 | IKTGNDIA | 2.4 | RAGNDIAA | 1.92 | | | | |
| NS3 | 1841 | 0.31 | 4 | 3 | 0 | Y | KAGNDIAA | 95.57 | KTGNDIAA | 2.4 | | | | | | |
| NS3 | 1842 | 0.18 | 3 | 2 | 0 | Y | AGNDIAAC | 97.49 | TGNDIAAC | 2.4 | | | | | | |
| NS3 | 1843 | 0.01 | 2 | 1 | 0 | Y | GNDIAACL | 99.88 | | | | | | | | |
| NS3 | 1844 | 0.03 | 3 | 1 | 0 | Y | NDIAACLR | 99.76 | | | | | | | | |
| NS3 | 1845 | 0.03 | 3 | 1 | 0 | Y | DIAACLRK | 99.76 | | | | | | | | |
| NS3 | 1846 | 0.03 | 3 | 1 | 0 | Y | IAACLRKN | 99.76 | | | | | | | | |
| NS3 | 1847 | 0.04 | 4 | 1 | 0 | Y | AACLRKNG | 99.64 | | | | | | | | |
| NS3 | 1848 | 0.03 | 3 | 1 | 0 | Y | ACLRKNGK | 99.76 | | | | | | | | |
| NS3 | 1849 | 0.3 | 4 | 2 | 0 | Y | CLRKNGKK | 95.09 | CLRKNGKR | 4.67 | | | | | | |

FIG. 6-69

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 6-72

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1929 | 0.28 | 2 | 2 | 0 | Y | AAQR

FIG. 6-73

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|

FIG. 6-74

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1979 | 0.07 | 3 | 1 | 0 | Y | IIPSMFEP | 99.28 | | |
| NS3 | 1980 | 0.07 | 3 | 1 | 0 | Y | IPSMFEPE | 99.28 | | |
| NS3 | 1981 | 0.07 | 3 | 1 | 0 | Y | PSMFEPER | 99.28 | | |
| NS3 | 1982 | 0.07 | 3 | 1 | 0 | Y | SMFEPERE | 99.28 | | |
| NS3 | 1983 | 0.07 | 3 | 1 | 0 | Y | MFEPEREK | 99.28 | | |
| NS3 | 1984 | 0.02 | 2 | 1 | 0 | Y | FEPEREKV | 99.76 | | |
| NS3 | 1985 | 0.02 | 2 | 1 | 0 | Y | EPEREKVD | 99.76 | | |
| NS3 | 1986 | 0 | 1 | 1 | 0 | Y | PEREKVDA | 100 | | |
| NS3 | 1987 | 0.1 | 2 | 2 | 0 | Y | EREKVDAI | 98.68 | EREKVDAV | 1.32 |
| NS3 | 1988 | 0.1 | 2 | 2 | 0 | Y | REKVDAID | 98.68 | REKVDAVD | 1.32 |
| NS3 | 1989 | 0.1 | 2 | 2 | 0 | Y | EKVDAIDG | 98.68 | EKVDAVDG | 1.32 |
| NS3 | 1990 | 0.1 | 2 | 2 | 0 | Y | KVDAIDGE | 98.68 | KVDAVDGE | 1.32 |
| NS3 | 1991 | 0.1 | 2 | 2 | 0 | Y | VDAIDGEY | 98.68 | VDAVDGEY | 1.32 |
| NS3 | 1992 | 0.1 | 2 | 2 | 0 | Y | DAIDGEYR | 98.68 | DAVDGEYR | 1.32 |
| NS3 | 1993 | 0.1 | 2 | 2 | 0 | Y | AIDGEYRL | 98.68 | AVDGEYRL | 1.32 |
| NS3 | 1994 | 0.1 | 2 | 2 | 0 | Y | IDGEYRLR | 98.68 | VDGEYRLR | 1.32 |
| NS3 | 1995 | 0 | 1 | 1 | 0 | Y | DGEYRLRG | 100 | | |
| NS3 | 1996 | 0 | 1 | 1 | 0 | Y | GEYRLRGE | 100 | | |
| NS3 | 1997 | 0 | 1 | 1 | 0 | Y | EYRLRGEA | 100 | | |
| NS3 | 1998 | 0 | 1 | 1 | 0 | Y | YRLRGEAR | 100 | | |
| NS3 | 1999 | 0.04 | 3 | 1 | 0 | Y | RLRGEARK | 99.64 | | |
| NS3 | 2000 | 0.04 | 3 | 1 | 0 | Y | LRGEARKT | 99.64 | | |
| NS3 | 2001 | 0.04 | 3 | 1 | 0 | Y | RGEARKTF | 99.64 | | |
| NS3 | 2002 | 0.04 | 3 | 1 | 0 | Y | GEARKTFV | 99.64 | | |
| NS3 | 2003 | 0.07 | 4 | 1 | 0 | Y | EARKTFVD | 99.28 | | |

FIG. 6-75

Species: DENV2 (8-mers)

|

FIG. 6-76

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | fr

FIG. 6-77

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 2054 | 0.19 | 5 | 2 | 0 | Y | VEIWTKEG | 97.49 | VEIWTKEG | 2.04 | | | | | | |
| NS3 | 2055 | 0.19 | 5 | 2 | 0 | Y | EIWTKEGE | 97.49 | EIWTKEGE | 2.04 | | | | | | |
| NS3 | 2056 | 0.19 | 5 | 2 | 0 | Y | IWTKEGER | 97.49 | IWTKEGER | 2.04 | | | | | | |
| NS3 | 2057 | 0.05 | 4 | 1 | 0 | Y | WTKEGERK | 99.52 | | | | | | | | |
| NS3 | 2058 | 0.05 | 4 | 1 | 0 | Y | TKEGERKK | 99.52 | | | | | | | | |
| NS3 | 2059 | 0.03 | 3 | 1 | 0 | Y | KEGERKKL | 99.76 | | | | | | | | |
| NS3 | 2060 | 0.03 | 3 | 1 | 0 | Y | EGERKKLK | 99.76 | | | | | | | | |
| NS3 | 2061 | 0.02 | 2 | 1 | 0 | Y | GERKKLKP | 99.76 | | | | | | | | |
| NS3 | 2062 | 0.02 | 2 | 1 | 0 | Y | ERKKLKPR | 99.76 | | | | | | | | |
| NS3 | 2063 | 0.02 | 2 | 1 | 0 | Y | RKKLKPRW | 99.76 | | | | | | | | |
| NS3 | 2064 | 0 | 1 | 1 | 0 | Y | KKLKPRWL | 100 | | | | | | | | |
| NS3 | 2065 | 0 | 1 | 1 | 0 | Y | KLKPRWLD | 100 | | | | | | | | |
| NS3 | 2066 | 0.03 | 3 | 1 | 0 | Y | LKPRWLDA | 99.76 | | | | | | | | |
| NS3 | 2067 | 0.05 | 4 | 1 | 0 | Y | KPRWLDAR | 99.52 | | | | | | | | |
| NS3 | 2068 | 0.19 | 5 | 2 | 0 | Y | PRWLDARI | 97.49 | PRWLDART | 2.04 | | | | | | |
| NS3 | 2069 | 0.19 | 5 | 2 | 0 | Y | RWLDARIY | 97.49 | RWLDARTY | 2.04 | | | | | | |
| NS3 | 2070 | 0.19 | 5 | 2 | 0 | Y | WLDARIYS | 97.49 | WLDARTYS | 2.04 | | | | | | |
| NS3 | 2071 | 0.19 | 5 | 2 | 0 | Y | LDARIYSD | 97.49 | LDARTYSD | 2.04 | | | | | | |
| NS3 | 2072 | 0.19 | 5 | 2 | 0 | Y | DARIYSDP | 97.49 | DARTYSDP | 2.04 | | |

FIG. 6-78

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block

FIG. 6-79

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 6-81

Species: DENV2 (8-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2156 | 0.19 | 6 | 2 | 0 | Y | TVTGGIFL | 97.6 | | | | | | |
| NS4A | 2157 | 0.06 | 5 | 1 | 0 | Y | VTGGIFLF | 99.4 | | | | | | |
| NS4A | 2158 | 0.04 | 3 | 1 | 0 | Y | TGGIFLFL | 99.64 | | | | | | |
| NS4A | 2159 | 0.04 | 3 | 1 | 0 | Y | GGIFLFLM | 99.64 | | | | | | |
| NS4A | 2160 | 0.04 | 3 | 1 | 0 | Y | GIFLFLMS | 99.64 | | | | | | |
| NS4A | 2161 | 0.14 | 4 | 2 | 0 | Y | IFLFLMSG | 98.32 | AVTGGIFL | 1.8 | | | | |
| NS4A | 2162 | 1.06 | 4 | 3 | 0 | Y | FLFLMSGK | 61.2 | IFLFLMSA | 1.32 | | | | |
| NS4A | 2163 | 1.08 | 4 | 3 | 0 | Y | LFLMSGKG | 60.84 | FLFLMSGR | 37.37 | FLFLMSAR | 1.32 | | |
| NS4A | 2164 | 1.54 | 7 | 5 | 0 | Y | FLMSGKGI | 53.89 | LFLMSGRG | 37.49 | LFLMSARG | 1.32 | | |
| NS4A | 2165 | 1.54 | 7 | 5 | 0 | Y | LMSGKGIG | 53.89 | FLMSGRGI | 35.09 | FLMSARGI | 6.95 | FLMSGRGV | 1.92 | FLMSARGI | 1.32 |
| NS4A | 2166 | 1.54 | 7 | 5 | 0 | Y | MSGKGIGK | 53.89 | LMSGRGIG | 35.09 | LMSGRGIG | 6.95 | LMSGRGVG | 1.92 | LMSARGIG | 1.32 |
| NS4A | 2167 | 1.54 | 8 | 5 | 0 | Y | SGKGIGKM | 53.89 | MSGRGIGK | 35.09 | MSGRGIGK | 6.95 | MSGRGVG | 1.92 | MSARGIGK | 1.32 |
| NS4A | 2168 | 1.54 | 8 | 5 | 0 | Y | GKGIGKMT | 53.89 | SGRGIGKM | 35.09 | SGKGVGKM | 6.95 | SGRGVGKM | 1.8 | SARGIGKM | 1.32 |
| NS4A | 2169 | 1.46 | 7 | 4 | 0 | Y | KGIGKMTL | 53.89 | GRGIGKMT | 36.41 | GKGVGKMT | 6.95 | GRGVGKMT | 1.8 | ARGIGKMT | 1.32 |
| NS4A | 2170 | 0.52 | 5 | 2 | 0 | Y | GIGKMTLG | 90.3 | RGIGKMTL | 8.74 | KGVGKMTL | 6.95 | RGVGKMTL | 1.8 | | |
| NS4A | 2171 | 0.48 | 4 | 2 | 0 | Y | IGKMTLGM | 90.66 | GVGKMTLG | 8.74 | | | | | | |
| NS4A | 2172 | 0.03 | 3 | 1 | 0 | Y | GKMTLGMC | 99.76 | VGKMTLGM | 8.74 | | | | | | |
| NS4A | 2173 | 0.03 | 3 | 1 | 0 | Y | KMTLGMCC | 99.76 | | | | | | | | |
| NS4A | 2174 | 0.03 | 3 | 1 | 0 | Y | MTLGMCCI | 99.76 | | | | | | | | |
| NS4A | 2175 | 0.26 | 4 | 2 | 0 | Y | TLGMCCII | 96.29 | TLGMCCIV | 3.11 | | | | | | |
| NS4A | 2176 | 0.26 | 4 | 2 | 0 | Y | LGMCCIIT | 96.29 | LGMCCIVT | 3.11 | | | | | | |
| NS4A | 2177 | 0.26 | 4 | 2 | 0 | Y | GMCCIITA | 96.29 | GMCCIVTA | 3.11 | | | | | | |
| NS4A | 2178 | 0.26 | 4 | 2 | 0 | Y | MCCIITAS | 96.29 | MCCIVTAS | 3.11 | | | | | | |
| NS4A | 2183 | 0.75 | 8 | 5 | 0 | Y | TASILLWY | 88.14 | TASVLLWY | 6.59 | TASGLLWY | 1.92 | TASILLWH | 1.56 | TASSLLWY | 0.84 |
| NS4A | 2184 | 0.75 | 8 | 5 | 0 | Y | ASILLWYA | 88.14 | ASVLLWYA | 6.59 | ASGLLWYA | 1.92 | ASILLWHA | 1.56 | ASSLLWYA | 0.84 |

FIG. 6-84

Species: DENV2 (8-mers)

| protein | block starting position | block entropy | total peptides in block | # peptides required to cover 99% of block | gap/X fraction | 99% of block covered w/ <= 5 peptides?

FIG. 6-88

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2349 | 0.4 | 8 | 3 | 0 | Y | TLTA

FIG. 6-89

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2376 | 0.35 | 4 | 2 | 0 | Y | AQKRAAAG | 93.77 | AQKRTAAG | 5.99 | | | | |
| NS4B | 2377 | 0.35 | 4 | 2 | 0 | Y | QKRAAAGI | 93.77 | QKRTAAGI | 5.99 | | | | |
| NS4B | 2378 | 0.34 | 3 | 2 | 0 | Y | KRAAAGIM | 93.89 | KRTAAGIM | 5.99 | | | | |
| NS4B | 2379 | 0.34 | 3 | 2 | 0 | Y | RAAAGIMK | 93.89 | RTAAGIMK | 5.99 | | | | |
| NS4B | 2380 | 0.34 | 3 | 2 | 0 | Y | AAAGIMKN | 93.89 | TAAGIMKN | 5.99 | | | | |
| NS4B | 2381 | 0.01 | 2 | 1 | 0 | Y | AAGIMKNP | 99.88 | | | | | | |
| NS4B | 2382 | 0.03 | 3 | 1 | 0 | Y | AGIMKNPT | 99.76 | | | | | | |
| NS4B | 2383 | 0.01 | 2 | 1 | 0 | Y | GIMKNPTV | 99.88 | | | | | | |
| NS4B | 2384 | 0.01 | 2 | 1 | 0 | Y | IMKNPTVD | 99.88 | | | | | | |
| NS4B | 2385 | 0.01 | 2 | 1 | 0 | Y | MKNPTVDG | 99.88 | | | | | | |
| NS4B | 2386 | 0.17 | 4 | 2 | 0 | Y | KNPTVDGI | 97.72 | KNPTVDGV | 2.04 | | | | |
| NS4B | 2387 | 0.17 | 4 | 2 | 0 | Y | NPTVDGIT | 97.72 | NPTVDGVT | 2.04 | | | | |
| NS4B | 2388 | 0.17 | 4 | 2 | 0 | Y | PTVDGITV | 97.72 | PTVDGVTV | 2.04 | | | | |
| NS4B | 2389 | 0.17 | 4 | 2 | 0 | Y | TVDGITVI | 97.72 | TVDGVTVI | 2.04 | | | | |
| NS4B | 2390 | 0.16 | 3 | 2 | 0 | Y | VDGITVID | 97.84 | VDGVTVID | 2.04 | | | | |
| NS4B | 2391 | 0.16 | 3 | 2 | 0 | Y | DGITVIDL | 97.84 | DGVTVIDL | 2.04 | | | | |
| NS4B | 2392 | 1.15 | 5 | 3 | 0 | Y | GITVIDLE | 49.94 | GITVIDLD | 47.78 | GVTVIDLD | 2.04 | | |
| NS4B | 2393 | 1.15 | 5 | 3 | 0 | Y | ITVIDLEP | 49.94 | ITVIDLDP | 47.78 | VTVIDLDP | 2.04 | | |
| NS4B | 2394 | 1.01 | 3 | 2 | 0.12 | Y | TVIDLDPI | 49.94 | TVIDLEPI | 49.82 | | | | |
| NS4B | 2395 | 1.01 | 3 | 2 | 0.12 | Y | VIDLDPIP | 49.94 | VIDLEPIP | 49.82 | | | | |
| NS4B | 2396 | 1.02 | 4 | 2 | 0.12 | Y | IDLDPIPY | 49.82 | IDLEPIPY | 49.82 | | | | |
| NS4B | 2397 | 1.02 | 4 | 2 | 0.12 | Y | DLEPIPYD | 49.82 | DLDPIPYD | 49.82 | | | | |
| NS4B | 2398 | 1.02 | 4 | 2 | 0.12 | Y | LEPIPYDP | 49.82 | LDPIPYDP | 49.82 | | | | |
| NS4B | 2399 | 1.02 | 2 | 2 | 0.12 | Y | EPIPYDPK | 49.82 | DPIPYDPK | 49.82 | | | | |
| NS4B | 2400 | 0.01 | 2 | 1 | 0 | Y | PIPYDPKF | 99.76 | | | | | | |

FIG. 6-91

Species: DENV2 (8-mers)

| protein | block starting position | block entropy | total peptides in block | # peptides required to cover 99% of block | gap/X

FIG. 6-93

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2476 | 0.07 | 6 | 1 | 0 | Y | AGLLFSJM | 99.4 | | | | | | |
| NS4B | 2477 | 0.19 | 7 | 2 | 0 | Y | GLLFSIMK | 97.72 | GLLFSIMR | 1.68 | | | | |
| NS4B | 2478 | 0.19 | 7 | 2 | 0 | Y | LLFSIMKN | 97.72 | LLFSIMRN | 1.68 | | | | |
| NS4B | 2479 | 0.2 | 8 | 2 | 0 | Y | LFSIMKNT | 97.6 | LFSIMRNT | 1.68 | | | | |
| NS4B | 2480 | 0.52 | 10 | 3 | 0 | Y | FSIMKNTT | 92.1 | FSIMRNTT | 5.27 | FSIMRNTT | | | |
| NS4B | 2481 | 1.08 | 12 | 5 | 0 | Y | SIMKNTTN | 78.56 | SIMKNTAN | 13.53 | SIMKNTAN | | SIMKNTIN | |
| NS4B | 2490 | 1.16 | 10 | 5 | 0 | Y | RRGTGNIG | 78.68 | RRGTGNMG | 9.82 | RRGTGNTG | 5.27 | RRGTGNVG | 1.56 | RRGTGTIG | 0.24 |
| NS4B | 2491 | 1.17 | 11 | 5 | 0 | Y | RGTGNIGE | 78.56 | RGTGNMGE | 9.82 | RGTGNTGE | 6.47 | RGTGNVGE | 2.87 | RGTGTIGE | 1.44 |
| NS4B | 2492 | 1.17 | 11 | 5 | 0 | Y | GTGNIGET | 78.56 | GTGNMGET | 9.82 | GTGNTGET | 6.47 | GTGNVGET | 2.87 | GTGTIGET | 1.44 |
| NS4B | 2493 | 1.16 | 10 | 5 | 0 | Y | TGNIGETL | 78.68 | TGNMGETL | 9.82 | TGNTGETL | 6.47 | TGN

FIG. 6-94

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides

FIG. 6-95

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency |
|---------|---|---|---|---|---|---|---|---|---|---|
| NS5 | 2535 | 0.03 | 2 | 1 | 0 | Y | GIKRGETD | 99.64 | | |
| NS5 | 2536 | 0.03 | 2 | 1 | 0 | Y | IKRGETDH | 99.64 | | |
| NS5 | 2537 | 0.03 | 2 | 1 | 0 | Y | KRGETDHH | 99.64 | | |
| NS5 | 2538 | 0.01 | 2 | 1 | 0 | Y | RGETDHHA | 99.88 | | |
| NS5 | 2539 | 0.01 | 2 | 1 | 0 | Y | GETDHHAV | 99.88 | | |
| NS5 | 2540 | 0.01 | 2 | 1 | 0 | Y | ETDHHAVS | 99.88 | | |
| NS5 | 2541 | 0.01 | 2 | 1 | 0 | Y | TDHHAVSR | 99.88 | | |
| NS5 | 2542 | 0.01 | 2 | 1 | 0 | Y | DHHAVSRG | 99.88 | | |
| NS5 | 2543 | 0.01 | 2 | 1 | 0 | Y | HHAVSRGS | 99.88 | | |
| NS5 | 2544 | 0.01 | 2 | 1 | 0 | Y | HAVSRGSA | 99.88 | | |
| NS5 | 2545 | 0.01 | 2 | 1 | 0 | Y | AVSRGSAK | 99.88 | | |
| NS5 | 2546 | 0 | 1 | 1 | 0 | Y | VSRGSAKL | 100 | | |
| NS5 | 2547 | 0 | 1 | 1 | 0 | Y | SRGSAKLR | 100 | | |
| NS5 | 2548 | 0.01 | 2 | 1 | 0 | Y | RGSAKLRW | 99.88 | | |
| NS5 | 2549 | 0.01 | 2 | 1 | 0 | Y | GSAKLRWF | 99.88 | | |
| NS5 | 2550 | 0.01 | 2 | 1 | 0 | Y | SAKLRWFV | 99.88 | | |
| NS5 | 2551 | 0.01 | 2 | 1 | 0 | Y | AKLRWFVE | 99.88 | | |
| NS5 | 2552 | 0.01 | 2 | 1 | 0 | Y | KLRWFVER | 99.88 | | |
| NS5 | 2553 | 0.01 | 3 | 1 | 0 | Y | LRWFVERN | 99.88 | | |
| NS5 | 2554 | 0.43 | 4 | 2 | 0 | Y | RWFVERNM | 91.5 | RWFVERNL | 8.38 |
| NS5 | 2555 | 0.46 | 5 | 2 | 0 | Y | WFVERNMV | 91.14 | WFVERNLV | 8.38 |
| NS5 | 2556 | 0.61 | 5 | 3 | 0 | Y | FVERNMVT | 88.98 | FVERNLVT | 8.5 | FVERNMVA | 2.04 |
| NS5 | 2557 | 0.61 | 5 | 3 | 0 | Y | VERNMVTP | 88.98 | VERNLVTP | 8.5 | VERNMVAP | 2.04 |
| NS5 | 2558 | 0.61 | 5 | 3 | 0 | Y | ERNMVTPE | 88.98 | ERNLVTPE | 8.5 | ERNMVAPE | 2.04 |
| NS5 | 2559 | 0.61 | 5 | 3 | 0 | Y | RNMVTPEG | 88.98 | RNLVTPEG | 8.5 | RNMVAPEG | 2.04 |

FIG. 6-96

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |

FIG. 6-97

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2585 | 0.65 | 8 | 4 | 0 | Y | LKNYREVK | 89.46 | LKNYKEVK | 6.11 | LKDVREVK | 3.23 | | |
| NS5 | 2586 | 0.64 | 7 | 4 | 0 | Y | KNVREVKG | 89.58 | KNVKEVKG | 6.11 | KDVREVKG | 3.23 | LKSVREVK | 0.6 |
| NS5 | 2587 | 0.6 | 5 | 3 | 0 | Y | NVREVKGL | 89.94 | NVKEVKGL | 6.11 | DVREVKGL | 3.23 | KSVREVKG | 0.6 |
| NS5 | 2588 | 0.34 | 3 | 2 | 0 | Y | VREVKGLT | 93.77 | VKEVKGLT | 6.11 | | | | |
| NS5 | 2589 | 0.37 | 4 | 2 | 0 | Y | REVKGLTK | 93.53 | KEVKGLTK | 6.11 | | | | |
| NS5 | 2590 | 0.05 | 4 | 1 | 0 | Y | EVKGLTKG | 99.52 | | | | | | |
| NS5 | 2591 | 0.04 | 3 | 1 | 0 | Y | VKGLTKGG | 99.64 | | | | | | |
| NS5 | 2592 | 0.04 | 3 | 1 | 0 | Y | KGLTKGGP | 99.64 | |

FIG. 6-98

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2610 | 0 | 1 | 1 | 0 | Y | YGWNLVRL | 100 | | | | | | |
| NS5 | 2611 | 0 | 1 | 1 | 0 | Y | GWNLVRLQ | 100 | | | | | | |
| NS5 | 2612 | 0 | 1 | 1 | 0 | Y | WNLVRLQS | 100 | | | | | | |
| NS5 | 2613 | 0 | 1 | 1 | 0 | Y | NLVRLQSG | 100 | | | | | | |
| NS5 | 2614 | 0.08 | 2 | 1 | 0 | Y | LVRLQSGV | 99.04 | | | | | | |
| NS5 | 2615 | 0.09 | 3 | 2 | 0 | Y | VRLQSGVD | 98.92 | VRLQSGID | 0.96 | | | | |
| NS5 | 2616 | 0.09 | 3 | 2 | 0 | Y | RLQSGVDV | 98.92 | RLQSGIDV | 0.96 | | | | |
| NS5 | 2617 | 0.09 | 3 | 2 | 0 | Y | LQSGVDVF | 98.92 | LQSGIDVF | 0.96 | | | | |
| NS5 | 2618 | 0.1 | 4 | 2 | 0 | Y | QSGVDVFF | 98.8 | QSGIDVFF | 0.96 | | | | |
| NS5 | 2619 | 1.16 | 7 | 4 | 0 | Y | SGVDVFFT | 64.07 | SGVDVFFV | 2.28 | SGIDVFFT | 0.96 | | |
| NS5 | 2620 | 1.16 | 7 | 4 | 0 | Y | GVDVFFTP | 64.07 | GVDVFFVP | 2.28 | GIDVFFTP | 0.96 | | |
| NS5 | 2621 | 1.16 | 7 | 4 | 0 | Y | VDVFFTPP | 64.07 | VDVFFVPP | 2.28 | IDVFFTPP | 0.96 | | |
| NS5 | 2622 | 1.09 | 6 | 3 | 0 | Y | DVFFTPPE | 65.03 | DVFFVPPE | 2.28 | | | | |
| NS5 | 2623 | 1.22 | 8 | 4 | 0 | Y | VFFTPPEK | 63.59 | VFFVPPEK | 2.16 | VFFTPPER | 1.56 | | |
| NS5 | 2624 | 1.22 | 8 | 4 | 0 | Y | FFTPPEKC | 63.59 | FFVPPEKC | 2.16 | FFTPPERC | 1.56 | | |
| NS5 | 2625 | 1.24 | 9 | 4 | 0 | Y | FTPPEKCD | 63.35 | FVPPEKCD | 2.16 | FTPPERCD | 1.56 | | |
| NS5 | 2626 | 1.24 | 9 | 4 | 0 | Y | TPPEKCDT | 63.35 | VPPEKCDT | 2.16 | TPPERCDT | 1.56 | | |
| NS5 | 2627 | 0.18 | 4 | 2 | 0 | Y | PPEKCDTL | 97.6 | | | | | | |
| NS5 | 2628 | 0.18 | 4 | 2 | 0 | Y | PEKCDTLL | 97.6 | | | | | | |
| NS5 | 2629 | 0.18 | 4 | 2 | 0 | Y | EKCDTLLC | 97.6 | | | | | | |
| NS5 | 2630 | 0.18 | 4 | 2 | 0 | Y | KCDTLLCD | 97.6 | | | | | | |
| NS5 | 2631 | 0.04 | 3 | 1 | 0 | Y | CDTLLCDI | 99.64 | | | | | | |
| NS5 | 2632 | 0.04 | 3 | 1 | 0 | Y | DTLLCDIG | 99.64 | | | | | | |
| NS5 | 2633 | 0.01 | 2 | 1 | 0 | Y | TLLCDIGE | 99.88 | | | | | | |
| NS5 | 2634 | 0 | 1 | 1 | 0 | Y | LLCDIGES | 100 | | | | | | |

FIG. 6-100

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 6-102

Species: DENV2 (8-mers)

| protein | block starting position | block

FIG. 6-103

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2739 | 0.13 | 7 | 2 | 0 | Y | KKATYEPD | 98.68 | KKTTYEPD | 0.36 | | | | | | |
| NS5 | 2740 | 0.13 | 7 | 2 | 0 | Y | KATYEPDV | 98.68 | KTTYEPDV | 0.36 | | | | | | |
| NS5 | 2741 | 0.1 | 6 | 1 | 0 | Y | ATYEPDVD | 99.04 | | | | | | | | |
| NS5 | 2742 | 0.04 | 4 | 1 | 0 | Y | TYEPDVDL | 99.64 | | | | | | | | |
| NS5 | 2743 | 0.04 | 4 | 1 | 0 | Y | YEPDVDLG | 99.64 | | | | | | | | |
| NS5 | 2744 | 0.04 | 4 | 1 | 0 | Y | EPDVDLGS | 99.64 | | | | | | | | |
| NS5 | 2745 | 0.04 | 4 | 1 | 0 | Y | PDVDLGSG | 99.64 | | | | | | | | |
| NS5 | 2746 | 0 | 1 | 1 | 0 | Y | DVDLGSGT | 100 | | | | | | | | |
| NS5 | 2747 | 0 | 2 | 1 | 0 | Y | VDLGSGTR | 100 | | | | | | | | |
| NS5 | 2748 | 0 | 3 | 1 | 0 | Y | DLGSGTRN | 100 | | | | | | | | |
| NS5 | 2749 | 0.02 | 5 | 2 | 0 | Y | LGSGTRNI | 99.76 | | | | | | | | |
| NS5 | 2750 | 0.04 | 5 | 2 | 0 | Y | GSGTRNIG | 99.64 | | | | | | | | |
| NS5 | 2751 | 0.11 | 8 | 2 | 0 | Y | SGTRNIGI | 98.8 | SGTRNIGT | 0.6 | | | | | | |
| NS5 | 2752 | 0.11 | 8 | 2 | 0 | Y | GTRNIGIE | 98.8 | GTRNIGTE | 0.6 | | | | | | |
| NS5 | 2753 | 0.73 | 9 | 4 | 0 | Y | TRNIGIES | 86.59 | TRNIGIEN | 10.3 | TRNIGIEC | 1.92 | TRNIGTES | 0.6 | | |
| NS5 | 2754 | 0.73 | 9 | 4 | 0 | Y | RNIGIESE | 86.59 | RNIGIENE | 10.3 | RNIGIECE | 1.92 | RNIGTESE | 0.6 | | |
| NS5 | 2761 | 0.88 | 9 | 5 | 0 | Y | EIPNLDII | 84.55 | ETPNLDII | 8.86 | EVPNLDII | 3.83 | ETPNMDII | 1.68 | EKPNLDII | 0.6 |
| NS5 | 2762 | 0.88 | 9 | 5 | 0 | Y | IPNLDIIG | 84.55 | TPNLDIIG | 8.86 | VPNLDIIG | 3.83 | TPNMDIIG | 1.68 | KPNLDIIG | 0.6 |
| NS5 | 2763 | 0.16 | 5 | 2 | 0 | Y | PNLDIIGK | 97.96 | PNMDIIGK | 1.68 | | | | | | |
| NS5 | 2764 | 0.16 | 5 | 2 | 0 | Y | NLDIIGKR | 97.96 | NMDIIGKR | 1.68 | | | | | | |
| NS5 | 2765 | 0.15 | 4 | 2 | 0 | Y | LDIIGKRI | 98.08 | MDIIGKRI | 1.68 | | | | | | |
| NS5 | 2766 | 0.04 | 4 | 1 | 0 | Y | DIIGKRIE | 99.64 | | | | | | | | |
| NS5 | 2767 | 0.05 | 5 | 1 | 0 | Y | IIGKRIEK | 99.52 | | | | | | | | |
| NS5 | 2768 | 0.05 | 5 | 1 | 0 | Y | IGKRIEKI | 99.52 | | | | | | | | |
| NS5 | 2769 | 0.07 | 6 | 1 | 0 | Y | GKRIEKIK | 99.4 | | | | | | | | |

FIG. 6-104

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|

FIG. 6-106

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block |

FIG. 6-108

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover

FIG. 6-109

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2898 | 0.27 | 4 | 2 | 0 | Y | AALGAVFT | 95.81 | AALGAVFT | 3.95 | | | | |
| NS5 | 2899 | 0.27 | 4 | 2 | 0 | Y | ALGAIFTD | 95.81 | ALGAVFTD | 3.95 | | | | |
| NS5 | 2900 | 0.27 | 4 | 2 | 0 | Y | LGAIFTDE | 95.81 | LGAVFTDE | 3.95 | | | | |
| NS5 | 2901 | 0.27 | 4 | 2 | 0 | Y | GAIFTDEN | 95.81 | GAVFTDEN | 3.95 | | | | |
| NS5 | 2902 | 0.28 | 5 | 2 | 0 | Y | AIFTDENK | 95.69 | AVFTDENK | 3.95 | | | | |
| NS5 | 2903 | 0.3 | 7 | 2 | 0 | Y | IFTDENKW | 95.57 | VFTDENKW | 3.83 | | | | |
| NS5 | 2904 | 0.06 | 5 | 1 | 0 | Y | FTDENKWK | 99.4 | | | | | | |
| NS5 | 2905 | 0.06 | 5 | 1 | 0 | Y | TDENKWKS | 99.4 | | | | | | |
| NS5 | 2906 | 0.04 | 3 | 1 | 0 | Y | DENKWKSA | 99.64 | | | | | | |
| NS5 | 2907 | 0.04 | 3 | 1 | 0 | Y | ENKWKSAR | 99.64 | | | | | | |
| NS5 | 2908 | 0.04 | 3 | 1 | 0 | Y | NKWKSAREA | 99.64 | | | | | | |
| NS5 | 2909 | 0.04 | 3 | 1 | 0 | Y | KWKSAREAV | 99.64 | | | | | | |
| NS5 | 2910 | 0.02 | 2 | 1 | 0 | Y | WKSAREAV | 99.76 | | | | | | |
| NS5 | 2911 | 0 | 1 | 1 | 0 | Y | KSAREAVE | 100 | | | | | | |
| NS5 | 2912 | 0.01 | 2 | 1 | 0 | Y | SAREAVED | 99.88 | | | | | | |
| NS5 | 2913 | 1.16 | 6 | 4 | 0 | Y | AREAVEDS | 65.39 | AREAVEDG | 30.78 | AREAVEDE | 1.8 | AREAVEDN | 1.8 | REAVEDER | 1.8 |
| NS5 | 2914 | 1.42 | 8 | 5 | 0 | Y | REAVEDSR | 60.24 | REAVEDGR | 30.78 | REAVEDSG | 5.03 | REAVEDNR | 1.8 | EAVEDNRF | 1.8 |
| NS5 | 2915 | 1.42 | 8 | 5 | 0 | Y | EAVEDSRF | 60.24 | EAVEDGRF | 30.78 | EAVEDSGF | 5.03 | EAVEDERF | 1.8 | AVEDERFW | 1.8 |
| NS5 | 2916 | 1.42 | 8 | 5 | 0 | Y | AVEDSRFW | 60.24 | AVEDGRFW | 30.78 | AVEDSGFW | 5.03 | AVEDERFW | 1.8 | VEDERFWE | 1.8 |
| NS5 | 2917 | 1.45 | 10 | 5 | 0 | Y | VEDSRFWE | 60 | VEDGRFWE | 30.78 | VEDSGFWE | 5.03 | VEDNRFWE | 1.8 | EDNRFWEL | 1.8 |
| NS5 | 2918 | 1.45 | 10 | 5 | 0 | Y | EDSRFWEL | 60 | EDGRFWEL | 30.78 | EDSGFWEL | 5.03 | EDRFWEL | 1.8 | FWELVERE | 1.8 |
| NS5 | 2922 | 1.39 | 8 | 5 | 0 | Y | FWELVDKE | 50.78 | FWELVDRE | 42.28 | FWELVEKE | 4.67 | FWELVEKE | 1.2 | WELVERER | 0.72 |
| NS5 | 2923 | 1.39 | 8 | 5 | 0 | Y | WELVDKER | 50.78 | WELVDRER | 42.28 | WELIDRER | 4.67 | WELVEKER | 1.2 | ELVERERN | 0.72 |
| NS5 | 2924 | 1.44 | 11 | 5 | 0 | Y | ELVDKERN | 50.42 | ELVDRERN | 42.16 | ELIDRERN | 4.67 | ELVEKERN | 1.2 | LVERERNL | 0.72 |
| NS5 | 2925 | 1.42 | 10 | 5 | 0 | Y | LVDKERNL | 50.54 | LVDRERNL | 42.16 | LIDRERNL | 4.67 | LVEKERNL | 1.2 | | |

FIG. 6-110

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequ

FIG. 6-111

Species: DENV2 (8-mers)

| protein | block starting position | block entropy | total

FIG. 6-113

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3001 | 1.05 | 6 | 2 | 0 | Y | EGLHRLGY | 59.4 | | | | | | |
| NS5 | 3002 | 1.04 | 5 | 2 | 0 | Y | GLHRLGYI | 59.52 | | | | | | |
| NS5 | 3003 | 1.04 | 5 | 2 | 0 | Y | LHRLGYIL | 59.52 | | | | | | |
| NS5 | 3004 | 1.04 | 5 | 2 | 0 | Y | HRLGYILR | 59.64 | | | | | | |
| NS5 | 3005 | 1.37 | 6 | 4 | 0 | Y | KLGYILRD | 56.89 | RLGYILRE | 35.45 | RLGYILRE | 4.07 | KLGYILRE | 3.35 | | |
| NS5 | 3006 | 0.54 | 5 | 3 | 0 | Y | LGYILRDV | 90.42 | LGYILRDI | 7.43 | LGYILRDI | 1.92 | | | | |
| NS5 | 3007 | 1.39 | 8 | 5 | 0 | Y | GYILRDVG | 65.87 | GYILREVG | 24.43 | GYILREVG | 4.07 | GYILREYS | 3.35 | GYILRDIS | 1.92 |
| NS5 | 3008 | 1.41 | 9 | 5 | 0 | Y | YILRDVGK | 65.87 | YILRDVGK | 24.43 | YILREVGK | 4.07 | YILREVSK | 3.35 | YILRDISR | 1.44 |
| NS5 | 3009 | 1.41 | 9 | 5 | 0 | Y | ILRDVGKK | 65.87 | ILRDVGKK | 24.43 | ILREVGKK | 4.07 | ILREVSKK | 3.35 | ILRDISRK | 1.44 |
| NS5 | 3012 | 1.42 | 11 | 4 | 0 | Y | DVSKKEGG | 65.87 | DVGKKEGG | 24.43 | EVGKKEGG | 4.07 | EVSKKEGG | 3.35 | DISRKAGG | 1.32 |
| NS5 | 3013 | 1.09 | 11 | 5 | 0 | Y | VSKKEGGA | 68.98 | VGKKEGGA | 28.38 | ISRKAGGA | 1.32 | ISKKAGGA | 0.36 | | |
| NS5 | 3014 | 1.08 | 10 | 4 | 0 | Y | SKKEGGAM | 69.1 | GKKEGGAM | 28.38 | SRKAGGAM | 1.08 | SKKAGGAM | 0.36 | SKKEGGTM | 0.24 |
| NS5 | 3015 | 0.22 | 8 | 3 | 0 | Y | KKEGGAMY | 97.6 | RKAGGAMY | 1.08 | KKAGGAMY | 0.36 | | | | |
| NS5 | 3016 | 0.18 | 6 | 2 | 0 | Y | KEGGAMYA | 97.84 | KAGGAMYA | 1.44 | | | | | | |
| NS5 | 3017 | 0.18 | 6 | 2 | 0 | Y | EGGAMYAD | 97.84 | AGGAMYAD | 1.44 | | | | | | |
| NS5 | 3018 | 0.06 | 4 | 1 | 0 | Y | GGAMYADD | 99.4 | | | | | | | | |
| NS5 | 3019 | 0.06 | 4 | 1 | 0 | Y | GAMYADDT | 99.4 | | | | | | | | |
| NS5 | 3020 | 0.06 | 4 | 1 | 0 | Y | AMYADDTA | 99.4 | | | | | | | | |
| NS5 | 3021 | 0.02 | 2 | 1 | 0 | Y | MYADDTAG | 99.76 | | | | | | | | |
| NS5 | 3022 | 0 | 1 | 1 | 0 | Y | YADDTAGW | 100 | | | | | | | | |
| NS5 | 3023 | 0 | 1 | 1 | 0 | Y | ADDTAGWD | 100 | | | | | | | | |
| NS5 | 3024 | 0 | 1 | 1 | 0 | Y | DDTAGWDT | 100 | | | | | | | | |
| NS5 | 3025 | 0.05 | 2 | 1 | 0 | Y | DTAGWDTR | 99.4 | | | | | | | | |
| NS5 | 3026 | 0.05 | 2 | 1 | 0 | Y | TAGWDTRI | 99.4 | | | | | | | | |
| NS5 | 3027 | 0.05 | 2 | 1 | 0 | Y | AGWDTRIT | 99.4 | | | | | | | | |

FIG. 6-114

Species: DENV2 (8-mers)

| protein | block starting position | block entropy | total peptides in block | # peptides required to cover 99% of block | gap/X fraction | 99% of block covered w

FIG. 6-115

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3061 | 0.1 | 4 | 2 | 0 | Y | KLTYQNKV | 98.8 | RLTYQNKV | 0.96 |
| NS5 | 3062 | 0.03 | 3 | 1 | 0 | Y | LTYQNKVV | 99.76 | | |
| NS5 | 3063 | 0.03 | 3 | 1 | 0 | Y | TYQNKVVR | 99.76 | | |
| NS5 | 3064 | 0.03 | 3 | 1 | 0 | Y | YQNKVVRV | 99.76 | | |
| NS5 | 3065 | 0.03 | 3 | 1 | 0 | Y | QNKVVRVQ | 99.76 | | |
| NS5 | 3066 | 0.03 | 2 | 1 | 0 | Y | NKVVRVQR | 99.76 | | |
| NS5 | 3067 | 0.01 | 3 | 1 | 0 | Y | KVVRVQRP | 99.88 | | |
| NS5 | 3068 | 0.03 | 3 | 1 | 0 | Y | VVRVQRPT | 99.76 | | |
| NS5 | 3069 | 0.04 | 3 | 1 | 0 | Y | VRVQRPTP | 99.64 | | |
| NS5 | 3070 | 0.1 | 6 | 1 | 0 | Y | RVQRPTPR | 99.04 | | |
| NS5 | 3071 | 0.1 | 6 | 1 | 0 | Y | VQRPTPRG | 99.04 | | |
| NS5 | 3072 | 0.11 | 7 | 2 | 0 | Y | QRPTPRGT | 98.92 | QRPTPKGT | 0.24 |
| NS5 | 3073 | 0.11 | 7 | 2 | 0 | Y | RPTPRGTV | 98.92 | RPTSRGTV | 0.24 |
| NS5 | 3074 | 0.13 | 8 | 2 | 0 | Y | PTPRGTVM | 98.8 | PTSRGTVM | 0.24 |
| NS5 | 3075 | 0.13 | 8 | 2 | 0 | Y | TPRGTVMD | 98.8 | TPIGTVMD | 0.24 |
| NS5 | 3076 | 0.11 | 7 | 2 | 0 | Y | PRGTVMDI | 98.92 | SRGTVMDI | 0.24 |
| NS5 | 3077 | 0.09 | 6 | 1 | 0 | Y | RGTVMDII | 99.16 | | |
| NS5 | 3078 | 0.03 | 3 | 1 | 0 | Y | GTVMDIIS | 99.76 | | |
| NS5 | 3079 | 0.03 | 3 | 1 | 0 | Y | TVMDIISR | 99.76 | | |
| NS5 | 3080 | 0.59 | 3 | 2 | 0 | Y | VMDIISRR | 85.99 | VMDIISRK | 13.89 |
| NS5 | 3081 | 0.59 | 3 | 2 | 0 | Y | MDIISRRD | 85.99 | MDIISRKD | 13.89 |
| NS5 | 3082 | 0.58 | 2 | 2 | 0 | Y | DIISRRDQ | 86.11 | DIISRNDQ | 13.89 |
| NS5 | 3083 | 0.58 | 2 | 2 | 0 | Y | IISRRDQR | 86.11 | IISRKDQR | 13.89 |
| NS5 | 3084 | 0.58 | 2 | 2 | 0 | Y | ISRRDQRG | 86.11 | ISRKDQRG | 13.89 |
| NS5 | 3085 | 0.58 | 2 | 2 | 0 | Y | SRRDQRGS | 86.11 | SRKDQRGS | 13.89 |

FIG. 6-116

Species: DENV2 (8-mers)

| protein | block starting position | block entropy | total

FIG. 6-117

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3111 | 0.01 | 2 | 1 | 0 | Y | IRQMEGEG | 99.88 | | | | | | |
| NS5 | 3112 | 1.12 | 4 | 3 | 0 | Y | RQMEGEGI | 54.61 | RQMEGEGV | 43.35 | RQMEGEGL | 1.92 | | |
| NS5 | 3113 | 1.12 | 4 | 3 | 0 | Y | QMEGEGIF | 54.61 | QMEGEGVF | 43.35 | QMEGEGLF | 1.92 | |

FIG. 6-118

Species: DENV2 (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99%

FIG. 6-119

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 6-120

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3216 | 0.15 | 4 | 2 | 0 | Y | WP

FIG. 6-122

Species: DENV2 (8-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3266 | 0.03 | 3 | 1 | 0 | Y | AANAICSA | 99.76 | | | | | | |
| NS5 | 3267 | 0.01 | 2 | 1 | 0 | Y | ANAICSAV | 99.88 | | | | | | |
| NS5 | 3268 | 0.01 | 2 | 1 | 0 | Y | NAICSAVP | 99.88 | | | | | | |
| NS5 | 3269 | 0.2 | 3 | 2 | 0 | Y | AICSAVPS | 97.13 | AICSAVPP | 2.75 | | | | |
| NS5 | 3270 | 0.18 | 2 | 2 | 0 | Y | ICSAVPSH | 97.25 | ICSAVPPH | 2.75 | | | | |
| NS5 | 3271 | 0.18 | 2 | 2 | 0 | Y | CSAVPSHW | 97.25 | CSAVPPHW | 2.75 | | | | |
| NS5 | 3272 | 0.23 | 3 | 2 | 0 | Y | SAVPSHWV | 96.77 | SAVPPHWV | 2.75 | | | | |
| NS5 | 3273 | 0.23 | 2 | 2 | 0 | Y | AVPSHWVP | 96.77 | AVPPHWVP | 2.75 | | | | |
| NS5 | 3274 | 0.23 | 3 | 2 | 0 | Y | VPSHWVPT | 96.77 | VPPHWVPT | 2.75 | | | | |
| NS5 | 3275 | 0.23 | 3 | 2 | 0 | Y | PSHWVPTS | 96.77 | PPHWVPTS | 2.75 | | | | |
| NS5 | 3276 | 0.06 | 3 | 2 | 0 | Y | SHWVPTSR | 96.77 | PHWVPTSR | 2.75 | | | | |
| NS5 | 3277 | 0.06 | 3 | 1 | 0 | Y | HWVPTSRT | 99.4 | | | | | | |
| NS5 | 3278 | 0.06 | 2 | 1 | 0 | Y | WVPTSRTT | 99.4 | | | | | | |
| NS5 | 3279 | 0.01 | 3 | 1 | 0 | Y | VPTSRTTW | 99.4 | | | | | | |
| NS5 | 3280 | 0.03 | 3 | 1 | 0 | Y | PTSRTTWS | 99.88 | | | | | | |
| NS5 | 3281 | 0.03 | 3 | 1 | 0 | Y | TSRTTWSI | 99.76 | | | | | | |
| NS5 | 3282 | 0.03 | 3 | 1 | 0 | Y | SRTTWSIH | 99.76 | | | | | | |
| NS5 | 3283 | 0.03 | 3 | 1 | 0 | Y | RTTWSIHA | 99.76 | | | | | | |
| NS5 | 3284 | 0.66 | 7 | 4 | 0 | Y | TTWSIHAK | 89.22 | TTWSIHAT | 5.27 | TTWSIHAS | 4.07 | TTWSIHAR | 1.08 |
| NS5 | 3285 | 0.66 | 7 | 4 | 0 | Y | TWSIHAKH | 89.22 | TWSIHATH | 5.27 | TWSIHASH | 4.07 | TWSIHARH | 1.08 |
| NS5 | 3286 | 0.68 | 8 | 4 | 0 | Y | WSIHAKHE | 89.1 | WSIHATHE | 5.27 | WSIHASHE | 4.07 | WSIHARHE | 1.08 |
| NS5 | 3287 | 0.68 | 8 | 4 | 0 | Y | SIHAKHEW | 89.1 | SIHATHEW | 5.27 | SIHASHEW | 4.07 | SIHARHEW | 1.08 |
| NS5 | 3288 | 0.68 | 8 | 4 | 0 | Y | IHAKHEWM | 89.1 | IHATHEWM | 5.27 | IHASHEWM | 4.07 | IHARHEWM | 1.08 |
| NS5 | 3289 | 0.66 | 7 | 4 | 0 | Y | HAKHEWMT | 89.22 | HATHEWMT | 5.27 | HASHEWMT | 4.07 | HARHEWMT | 1.08 |
| NS5 | 3290 | 0.66 | 7 | 4 | 0 | Y | AKHEWMTT | 89.22 | ATHEWMTT | 5.27 | ASHEWMTT | 4.07 | ARHEWMTT | 1.08 |

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3316 | 0.15 | 7 | 2 | 0 | Y | ED

FIG. 6-125

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3341 | 0.06 | 3 | 1 | 0 | Y | LIGLTSRA | 99.4 | | | | | | |
| NS5 | 3342 | 0.01 | 2 | 1 | 0 | Y | IGLTSRAT | 99.88 | | | | | | |
| NS5 | 3343 | 0.01 | 2 | 1 | 0 | Y | GLTSRATW | 99.88 | | | | | | |
| NS5 | 3344 | 0.01 | 2 | 1 | 0 | Y | LTSRATWA | 99.88 | | | | | | |
| NS5 | 3345 | 0.07 | 3 | 1 | 0 | Y | TSRATWAK | 99.28 | | | | | | |
| NS5 | 3346 | 0.07 | 3 | 1 | 0 | Y | SRATWAKN | 99.28 | | | | | | |
| NS5 | 3347 | 0.07 | 3 | 1 | 0 | Y | RATWAKNI | 99.28 | | | | | | |
| NS5 | 3348 | 0.07 | 3 | 1 | 0 | Y | ATWAKNIQ | 99.28 | | | | | | |
| NS5 | 3349 | 1.09 | 4 | 3 | 0 | Y | TWAKNIQT | 66.47 | TWAKNIQA | 30.54 | TWAKNIQV | 2.4 | | |
| NS5 | 3350 | 1.09 | 4 | 3 | 0 | Y | WAKNIQTA | 66.47 | WAKNIQAA | 30.54 | WAKNIQVA | 2.4 | | |
| NS5 | 3351 | 1.1 | 5 | 3 | 0 | Y | AKNIQTAI | 66.35 | AKNIQAAI | 30.54 | AKNIQVAI | 2.4 | | |
| NS5 | 3352 | 1.13 | 6 | 4 | 0 | Y | KNIQTAIN | 65.99 | KNIQAAIN | 30.54 | KNIQVAIN | 2.4 | RNIQTAIN | 0.6 |
| NS5 | 3353 | 1.08 | 5 | 3 | 0 | Y | NIQTAINQ | 66.59 | NIQAAINQ | 30.54 | NIQVAINQ | 2.4 | | |
| NS5 | 3354 | 1.08 | 5 | 3 | 0 | Y | IQTAINQV | 66.59 | IQAAINQV | 30.54 | IQVAINQV | 2.4 | | |

FIG. 6-126

Species: DENV2 (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3370 | 0.13 | 4 | 2 | 0 | Y | YTDYMPSM | 98.56 | YIDYMPSM | 0.6 | | | | |
| NS5 | 3371 | 0.13 | 4 | 2 | 0 | Y | TDYMPSMK | 98.56 | IDYMPSMK | 0.6 | | | | |
| NS5 | 3372 | 0 | 1 | 1 | 0 | Y | DYMPSMKR | 100 | | | | | | |
| NS5 | 3373 | 0 | 1 | 1 | 0 | Y | YMPSMKRF | 100 | | | | | | |
| NS5 | 3374 | 0 | 1 | 1 | 0 | Y | MPSMKRFR | 100 | | | | | | |
| NS5 | 3375 | 0.63 | 3 | 3 | 0 | Y | PSMKRFRR | 87.07 | PSMKRFRK | 11.26 | PSMKRFRS | 1.68 | | |
| NS5 | 3376 | 0.63 | 3 | 3 | 0 | Y | SMKRFRRE | 87.07 | SMKRFRKE | 11.26 | SMKRFRSE | 1.68 | | |
| NS5 | 3377 | 0.63 | 3 | 3 | 0 | Y | MKRFRREE | 87.07 | MKRFRKEE | 11.26 | MKRFRSEE | 1.68 | | |
| NS5 | 3378 | 0.63 | 3 | 3 | 0 | Y | KRFRREEE | 87.07 | KRFRKEEE | 11.14 | KRFRSEEE | 1.68 | | |
| NS5 | 3379 | 0.64 | 3 | 3 | 0 | Y | RFRREEEE | 87.07 | RFRKEEEE | 11.14 | RFRSEEEE | 1.68 | | |
| NS5 | 3380 | 0.66 | 4 | 3 | 0 | Y | FRREEEEA | 86.83 | FRKEEEEA | 11.14 | FRSEEEES | 1.68 | | |
| NS5 | 3381 | 0.66 | 6 | 3 | 0 | Y | RREEEEAG | 86.83 | RKEEEEAG | 11.14 | RSEEEESG | 1.68 | | |
| NS5 | 3382 | 0.68 | 6 | 3 | 0 | Y | REEEEAGV | 86.71 | KEEEEAGV | 11.14 | SEEEESGV | 1.68 | | |
| NS5 | 3383 | 0.19 | 7 | 2 | 0 | Y | EEEEAGVL | 97.72 | EEEESGVL | 1.68 | | | | |
| NS5 | 3384 | 0.19 | 7 | 2 | 0 | Y | EEEAGVLW | 97.72 | EEESGVLW | 1.68 | | | | |

FIG. 7-1

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| anC | 1 | 1.01 | 9 | 3 | 0 | Y | MNNQRKKAR | 66.95 | MNNQRKKIAK | 31.98 | MNNQRKKVS | 0.24 | | | | |
| anC | 2 | 1.54 | 13 | 5 | 0 | Y | NNQRKKARS | 53.65 | NNQRKKAKN | 31.5 | NNQRKKARN | 13.29 | NNQRKKAKT | 0.36 | NDQRKKARN | 0.24 |
| anC | 10 | 1.11 | 9 | 3 | 0 | Y | STPFNMLKR | 53.65 | NTPFNMLKR | 45.15 | TTPFNMLKR | 0.36 | | | | |
| anC | 11 | 0.09 | 5 | 1 | 0 | Y | TPFNMLKRE | 99.16 | | | | | | | | |
| anC | 12 | 0.01 | 2 | 1 | 0 | Y | PFNMLKRER | 99.88 | | | | | | | | |
| anC | 13 | 0 | 1 | 1 | 0 | Y | FNMLKRERN | 100 | | | | | | | | |
| anC | 14 | 0 | 1 | 1 | 0 | Y | NMLKRERNR | 100 | | | | | | | | |
| anC | 15 | 0 | 1 | 1 | 0 | Y | MLKRERNRV | 100 | | | | | | | | |
| anC | 16 | 0 | 2 | 1 | 0 | Y | LKRERNRVS | 99.88 | | | | | | | | |
| anC | 17 | 0.01 | 2 | 1 | 0 | Y | KRERNRVST | 99.84 | | | | | | | | |
| anC | 18 | 0.17 | 5 | 2 | 0 | Y | RERNRVSTV | 97.72 | RERNRVSTI | 1.8 | | | | | | |
| anC | 19 | 0.18 | 6 | 2 | 0 | Y | ERNRVSTVQ | 97.72 | ERNRVSTIQ | 1.8 | | | | | | |
| anC | 20 | 0.18 | 6 | 2 | 0 | Y | RNRVSTVQQ | 97.72 | RNRVSTIQQ | 1.8 | | | | | | |
| anC | 21 | 0.18 | 6 | 2 | 0 | Y | NRVSTVQQL | 97.72 | NRVSTIQQL | 1.8 | | | | | | |
| anC | 22 | 0.18 | 6 | 2 | 0 | Y | RVSTVQQLT | 97.72 | RYSTIQQLT | 1.8 | | | | | | |
| anC | 23 | 0.18 | 6 | 2 | 0 | Y | VSTVQQLTK | 97.72 | VSTIQQLTK | 1.8 | | | | | | |
| anC | 24 | 0.18 | 6 | 2 | 0 | Y | STVQQLTKR | 97.72 | STIQQLTKR | 1.8 | | | | | | |
| anC | 25 | 0.17 | 5 | 2 | 0 | Y | TVQQLTKRF | 97.84 | TIQQLTKRF | 1.8 | | | | | | |
| anC | 26 | 0.03 | 3 | 1 | 0 | Y | VQQLTKRFS | 99.76 | IQQLTKRFS | 1.8 | | | | | | |
| anC | 27 | 0.01 | 2 | 1 | 0 | Y | QQLTKRFSL | 99.88 | | | | | | | | |
| anC | 28 | 0.03 | 3 | 1 | 0 | Y | QLTKRFSLG | 99.76 | | | | | | | | |
| anC | 29 | 0.03 | 3 | 1 | 0 | Y | LTKRFSLGM | 99.76 | | | | | | | | |
| anC | 30 | 0.03 | 3 | 1 | 0 | Y | TKRFSLGML | 99.76 | | | | | | | | |
| anC | 31 | 0.03 | 3 | 1 | 0 | Y | KRFSLGMLQ | 99.76 | | | | | | | | |
| anC | 32 | 0.03 | 3 | 1 | 0 | Y | RFSLGMLQG | 99.76 | | | | | | | | |

FIG. 7-2

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 33 | 0.08 | 5 | 1 | 0 | Y | FSLGMLQGR | 99.28 | | | | | | |
| anC | 34 | 0.08 | 5 | 1 | 0 | Y | SLGMLQGRG | 99.28 | | | | | | |
| anC | 35 | 0.08 | 5 | 1 | 0 | Y | LGMLQGRGP | 99.28 | | | | | | |
| anC | 36 | 0.06 | 4 | 1 | 0 | Y | GMLQGRGPL | 99.4 | | | | | | |
| anC | 37 | 0.11 | 5 | 2 | 0 | Y | MLQGRGPLK | 98.92 | MLQGRGPLR | 0.48 | | | | |
| anC | 38 | 0.09 | 4 | 1 | 0 | Y | LQGRGPLKL | 99.04 | | | | | | |
| anC | 39 | 0.12 | 5 | 2 | 0 | Y | QGRGPLKLF | 98.8 | QGRGPLKLF | 0.48 | | | | |
| anC | 40 | 0.13 | 6 | 2 | 0 | Y | GRGPLKLFM | 98.68 | GRGPLRLFM | 0.48 | | | | |
| anC | 41 | 0.13 | 6 | 2 | 0 | Y | RGPLKLFMA | 98.68 | RGPLRLFMA | 0.48 | | | | |
| anC | 42 | 0.16 | 5 | 2 | 0 | Y | GPLKLFMAL | 98.2 | GPLKLFMAF | 0.96 | | | | |
| anC | 43 | 0.16 | 5 | 2 | 0 | Y | PLKLFMALV | 98.2 | PLKLFMAFV | 0.96 | | | | |
| anC | 44 | 0.19 | 6 | 3 | 0 | Y | LKLFMALVA | 97.84 | LKLFMAFVA | 0.96 | LRLFMALVA | 0.48 | | |
| anC | 45 | 0.21 | 7 | 3 | 0 | Y | KLFMALVAF | 97.72 | KLFMAFVAF | 0.96 | RLFMALVAF | 0.48 | | |
| anC | 46 | 0.18 | 7 | 2 | 0 | Y | LFMALVAFL | 98.08 | LFMAFVAFL | 0.96 | | | | |
| anC | 47 | 0.18 | 7 | 2 | 0 | Y | FMALVAFLR | 98.08 | FMAFVAFLR | 0.96 | | | | |
| anC | 48 | 0.15 | 6 | 2 | 0 | Y | MALVAFLRF | 98.32 | MAFVAFLRF | 0.96 | | | | |
| anC | 49 | 0.14 | 5 | 2 | 0 | Y | ALVAFLRFL | 98.44 | AFVAFLRFL | 0.96 | | | | |
| anC | 50 | 0.14 | 5 | 2 | 0 | Y | LVAFLRFLT | 98.44 | FVAFLRFLT | 0.96 | | | | |
| anC | 51 | 0.07 | 5 | 1 | 0 | Y | VAFLRFLTI | 99.28 | | | | | | |
| anC | 52 | 0.09 | 6 | 1 | 0 | Y | AFLRFLTIP | 99.16 | | | | | | |
| anC | 53 | 0.05 | 5 | 1 | 0 | Y | FLRFLTIPP | 99.52 | | | | | | |
| anC | 54 | 0.04 | 4 | 1 | 0 | Y | LRFLTIPPT | 99.64 | | | | | | |
| anC | 55 | 0.12 | 5 | 2 | 0 | Y | RFLTIPPTA | 98.68 | RFLTIPPTV | 0.6 | | | | |
| anC | 56 | 0.12 | 5 | 2 | 0 | Y | FLTIPPTAG | 98.68 | FLTIPPTVG | 0.6 | | | | |
| anC | 57 | 0.12 | 5 | 2 | 0 | Y | LTIPPTAGI | 98.68 | LTIPPTVGI | 0.6 | | | | |

FIG. 7-3

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 58 | 0.12 | 5 | 2 | 0 | Y | TIPPTAGIL | 98.68 | TIPPTVGIL | 0.6 | | | | |
| anC | 59 | 0.14 | 6 | 2 | 0 | Y | IPPTAGILK | 98.56 | IPPTVGILK | 0.6 | | | | |
| anC | 60 | 0.12 | 5 | 2 | 0 | Y | PPTAGILKR | 98.68 | PPTVGILKR | 0.6 | | | | |
| anC | 61 | 0.11 | 4 | 2 | 0 | Y | PTAGILKRW | 98.8 | PTVGILKRW | 0.6 | | | | |
| anC | 62 | 0.11 | 6 | 2 | 0 | Y | TAGILKRWG | 98.8 | TVGILKRWG | 0.6 | | | | |
| anC | 63 | 0.16 | 5 | 3 | 0 | Y | AGILKRWGT | 98.32 | VGILKRWGT | 0.6 | TGILKRWGT | 0.48 | | |
| anC | 64 | 0.24 | 5 | 2 | 0 | Y | GILKRWGTI | 96.77 | GILKRWGTV | 2.63 | | | | |
| anC | 65 | 0.24 | 6 | 2 | 0 | Y | ILKRWGTIK | 96.77 | ILKRWGTVK | 2.63 | | | | |
| anC | 66 | 0.25 | 7 | 2 | 0 | Y | LKRWGTIKK | 96.65 | LKRWGTVKK | 2.63 | | | | |
| anC | 67 | 0.26 | 7 | 3 | 0 | Y | KRWGTIKKS | 96.53 | KRWGTVKKS | 2.63 | | | | |
| anC | 68 | 0.28 | 7 | 3 | 0 | Y | RWGTIKKSR | 96.29 | RWGTVKKSK | 2.63 | RWGAIKKSK | 0.36 | | |
| anC | 69 | 0.28 | 7 | 3 | 0 | Y | WGTIKKSRA | 96.29 | WGTVKKSKA | 2.63 | WGTIKKSRA | 0.36 | | |
| anC | 70 | 0.3 | 8 | 4 | 0 | Y | GTIKKSKAI | 96.17 | GTVKKSKAI | 2.63 | GAIKKSKAI | 0.36 | | |
| anC | 71 | 0.44 | 10 | 4 | 0 | Y | TIKKSKAIN | 94.25 | TVKKSKAIN | 2.63 | TIKKSKAIS | 1.8 | | |
| anC | 72 | 0.43 | 9 | 3 | 0 | Y | IKKSKAINV | 94.37 | VKKSKAINV | 2.63 | IKKSKAISV | 1.8 | AIKKSKAIN | 0.36 |
| anC | 73 | 0.25 | 8 | 4 | 0 | Y | KKSKAINVL | 97.01 | KKSKAINVL | 1.8 | KKSKAISVL | 0.36 | IKKSRAINV | 0.36 |
| anC | 74 | 0.28 | 9 | 3 | 0 | Y | KSKAINVLR | 96.77 | KSKAISVLR | 1.8 | KSKAINIL | 0.36 | KSKAINILR | 0.36 |
| anC | 75 | 0.26 | 9 | 4 | 0 | Y | SKAINVLRG | 96.89 | SKAISVLRG | 1.8 | KSRAINVLR | 0.36 | | |
| anC | 76 | 0.25 | 8 | 3 | 0 | Y | KAINVLRGF | 97.01 | KAISVLRGF | 1.8 | SKAINILRG | 0.36 | | |
| anC | 77 | 0.21 | 7 | 3 | 0 | Y | AINVLRGFR | 97.37 | AISVLRGFR | 1.8 | KAINILRGF | 0.36 | | |
| anC | 78 | 0.28 | 6 | 2 | 0 | Y | INVLRGFRK | 96.65 | ISVLRGFRK | 1.92 | INVLRGFRR | 0.72 | | |
| anC | 79 | 0.27 | 7 | 3 | 0 | Y | NVLRGFRKE | 96.65 | SVLRGFRKE | 0.72 | NVLRGFRRE | 0.72 | | |
| anC | 80 | 0.12 | 6 | 3 | 0 | Y | VLRGFRKEI | 98.68 | VLRGFRREI | | | | | |
| anC | 81 | 0.09 | 3 | 1 | 0 | Y | LRGFRKEIG | 99.04 | | | | | | |
| anC | 82 | 0.1 | 4 | 2 | 0 | Y | RGFRKEIGR | 98.92 | RGFRREIGR | 0.72 | | | | |

FIG. 7-4

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 83 | 0.07 | 3 | 1 | 0 | Y | GFR

FIG. 7-5

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 121 | 0.8 | 4 | 2 | 0 | Y | NGEPHMIVG | 77.6 | NGEPHMIVS | 22.04 | | | | | | |
| prM | 122 | 1.76 | 8 | 5 | 0 | Y | GEPHMIVGR | 54.37 | GEPHMIVGI | 23.35 | GEPHMIVSR | 13.89 | GEPHMIVSI | 5.87 | GEPHMIVSK | 2.16 |
| prM | 123 | 1.78 | 10 | 5 | 0 | Y | EPHMIVGRQ | 54.37 | EPHMIVGIQ | 23.35 | EPHMIVSRQ | 13.89 | EPHMIVSIQ | 5.87 | EPHMIVSKN | 1.68 |
| prM | 124 | 1.78 | 10 | 5 | 0 | Y | PHMIVGRQE | 54.37 | PHMIVGIQE | 23.35 | PHMIVSRQE | 13.89 | PHMIVSIQE | 5.87 | PHMIVSKNE | 1.68 |
| prM | 125 | 1.78 | 10 | 5 | 0 | Y | HMIVGRQEK | 54.37 | HMIVGIQEK | 23.35 | HMIVSRQEK | 13.89 | HMIVSIQEK | 5.87 | HMIVSKNEK | 1.68 |
| prM | 126 | 1.78 | 10 | 5 | 0 | Y | MIVGRQEKG | 54.37 | MIVGIQEKG | 23.35 | MIVSRQEKG | 13.89 | MIVSIQEKG | 5.87 | MIVSKNEKG | 1.68 |
| prM | 127 | 1.78 | 9 | 5 | 0 | Y | IVGRQEKGK | 54.37 | IVGIQEKGK | 23.35 | IVSRQEKGK | 13.89 | IVSIQEKGK | 5.87 | IVSKNEKGK | 1.68 |
| prM | 128 | 1.77 | 9 | 5 | 0 | Y | VGRQEKGKS | 54.37 | VGIQEKGKS | 23.35 | VSRQEKGKS | 13.89 | VSIQEKGKS | 5.87 | VSKNEKGKS | 1.68 |
| prM | 129 | 1.77 | 6 | 5 | 0 | Y | GRQEKGKSL | 54.37 | GIQEKGKSL | 23.47 | SRQEKGKSL | 13.89 | SIQEKGKSL | 5.87 | SKNEKGKSL | 1.68 |
| prM | 130 | 1.06 | 3 | 3 | 0 | Y | RQEKGKSLL | 68.26 | IQEKGKSLL | 23.47 | KNEKGKSLL | 1.68 | | | | |
| prM | 131 | 0.15 | 1 | 2 | 0 | Y | QEKGKSLLF | 98.08 | NEKGKSLLF | 1.68 | | | | | | |
| prM | 132 | 0 | 1 | 1 | 0 | Y | EKGKSLLFK | 100 | | | | | | | | |
| prM | 133 | 0 | 1 | 1 | 0 | Y | KGKSLLFKT | 100 | | | | | | | | |
| prM | 134 | 0.21 | 3 | 2 | 0 | Y | GKSLLFKTE | 97.13 | GKSLLFKTK | 2.4 | | | | | | |
| prM | 135 | 0.69 | 6 | 4 | 0 | Y | KSLLFKTED | 88.62 | KSLLFKTEN | 6.95 | KSLLFKTKD | 2.4 | KSLLFKTEV | 1.32 | | |
| prM | 136 | 0.69 | 6 | 4 | 0 | Y | SLLFKTEDG | 88.62 | SLLFKTENG | 6.95 | SLLFKTKDG | 2.4 | SLLFKTEVG | 1.32 | | |
| prM | 143 | 0.77 | 8 | 5 | 0 | Y | DGVNMCTLM | 88.38 | NGVNMCTLM | 5.27 | DGTNMCTLM | 2.16 | NGINMCTLM | 1.68 | VGVNMCTLM | 1.32 |
| prM | 144 | 0.34 | 4 | 3 | 0 | Y | GVNMCTLMA | 95.21 | GTNMCTLMA | 2.4 | GINMCTLMA | 1.92 | | | | |
| prM | 145 | 1.31 | 7 | 5 | 0 | Y | VNMCTLMAI | 52.93 | VNMCTLMAM | 42.28 | TNMCTLMAM | 1.92 | INMCTLMAM | 1.68 | TNMCTLMAL | 0.48 |
| prM | 146 | 1.04 | 3 | 2 | 0 | Y | NMCTLMAID | 53.41 | NMCTLMAMD | 46.11 | | | | | | |
| prM | 147 | 1.05 | 4 | 2 | 0 | Y | MCTLMAIDL | 53.41 | MCTLMAMDL | 45.99 | | | | | | |
| prM | 148 | 1.05 | 4 | 2 | 0 | Y | CTLMAIDLG | 53.41 | CTLMAMDLG | 45.99 | | | | | | |
| prM | 149 | 1.05 | 4 | 2 | 0 | Y | TLMAIDLGE | 53.41 | TLMAMDLGE | 45.99 | | | | | | |
| prM | 150 | 1.05 | 4 | 2 | 0 | Y | LMAIDLGEL | 53.41 | LMAMDLGEL | 45.99 | | | | | | |
| prM | 151 | 1.05 | 4 | 2 | 0 | Y | MAIDLGELC | 53.41 | MAMDLGELC | 45.99 | | | | | | |

FIG. 7-6

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 152 | 1.05 | 4 | 2 | 0 | Y | AIDLGELCE | 53.41 | AMDLGELCE | 45.99 | | | | |
| prM | 153 | 1.06 | 5 | 2 | 0 | Y | IDLGELCED | 53.29 | MDLGELCED | 45.99 | | | | |
| prM | 154 | 0.03 | 3 | 1 | 0 | Y | DLGELCEDT | 99.76 | | | | | | |
| prM | 155 | 0.14 | 4 | 2 | 0 | Y | LGELCEDTV | 98.32 | LGELCEDTI | 1.44 | | | | |
| prM | 156 | 0.12 | 3 | 2 | 0 | Y | GELCEDTVT | 98.44 | GELCEDTIT | 1.44 | | | | |
| prM | 157 | 0.12 | 3 | 2 | 0 | Y | ELCEDTVTY | 98.44 | ELCEDTITY | 1.44 | | | | |
| prM | 158 | 0.47 | 5 | 3 | 0 | Y | LCEDTITYK | 92.22 | LCEDTITYN | 6.11 | LCEDTVTYK | 1.44 | | |
| prM | 159 | 0.47 | 5 | 3 | 0 | Y | CEDTITYKC | 92.22 | CEDTITYNC | 6.11 | CEDTVTYKC | 1.44 | | |
| prM | 160 | 0.47 | 5 | 3 | 0 | Y | EDTITYKCP | 92.22 | EDTITYNCP | 6.11 | EDTVTYKCP | 1.44 | | |
| prM | 161 | 0.74 | 6 | 4 | 0 | Y | DTITYKCPL | 87.54 | DTITYNCPL | 6.11 | DTITYKCPF | 4.67 | DTVTYKCPF | 1.32 |
| prM | 162 | 0.72 | 7 | 4 | 0 | Y | TITYKCPLL | 87.66 | TITYNCPLL | 5.51 | TITYKCPFL | 4.67 | TVTYKCPFL | 1.32 |
| prM | 163 | 0.79 | 7 | 5 | 0 | Y | TYKCPLLRQ | 86.95 | TYNCPLLRQ | 5.51 | TYKCPFLKQ | 5.39 | TYKCPFLRQ | 0.84 |
| prM | 164 | 0.79 | 7 | 5 | 0 | Y | YKCPLLRQN | 86.95 | YNCPLLRQN | 5.51 | YKCPFLKQN | 5.39 | YKCPFLRQN | 0.84 |
| prM | 165 | 0.79 | 7 | 5 | 0 | Y | KCPLLRQNE | 86.95 | NCPLLRQNE | 5.51 | KCPFLKQNE | 5.39 | NCPLLKQNE | 0.84 |
| prM | 166 | 0.46 | 4 | 3 | 0 | Y | CPLLRQNEP | 92.57 | CPFLKQNEP | 5.39 | CPLLKQNEP | 1.44 | | |
| prM | 167 | 0.46 | 4 | 3 | 0 | Y | PLLRQNEPE | 92.57 | PFLKQNEPE | 5.39 | PLLKQNEPE | 1.44 | | |
| prM | 168 | 0.46 | 4 | 3 | 0 | Y | LLRQNEPED | 92.57 | FLKQNEPED | 5.39 | LLKQNEPED | 1.44 | | |
| prM | 169 | 0.36 | 4 | 2 | 0 | Y | LRQNEPEDI | 93.17 | LKQNEPEDI | 6.83 | | | | |
| prM | 170 | 0.36 | 2 | 2 | 0 | Y | RQNEPEDID | 93.17 | KQNEPEDID | 6.83 | | | | |
| prM | 171 | 0.01 | 2 | 1 | 0 | Y | QNEPEDIDC | 99.88 | | | | | | |
| prM | 172 | 0.03 | 2 | 1 | 0 | Y | NEPEDIDCW | 99.76 | | | | | | |
| prM | 173 | 0.03 | 3 | 1 | 0 | Y | EPEDIDCWC | 99.76 | | | | | | |
| prM | 174 | 0.03 | 3 | 1 | 0 | Y | PEDIDCWCN | 99.76 | | | | | | |
| prM | 175 | 0.06 | 5 | 1 | 0 | Y | EDIDCWCNS | 99.4 | | | | | | |
| prM | 176 | 0.06 | 5 | 1 | 0 | Y | DIDCWCNST | 99.4 | | | | | | |

FIG. 7-7

Species: DENV2 (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 178 | 0.06 | 5 | 1 | 0 | y | IDCWCNSTS | 99.4 | | | | | | |
| prM | 179 | 0.08 | 6 | 1 | 0 | y | DCWCNSTST | 99.28 | | | | | | |
| prM | 180 | 0.08 | 6 | 2 | 0 | y | CWCNSTSTW | 99.28 | | | | | | |
| prM | 181 | 0.15 | 6 | 2 | 0 | y | WCNSTSTWV | 98.32 | WCNSTSTWI | 1.08 | | | | |
| prM | 182 | 0.15 | 6 | 2 | 0 | y | CNSTSTWVT | 98.32 | CNSTSTWIT | 1.08 | | | | |
| prM | 183 | 0.15 | 6 | 2 | 0 | y | NSTSTWVTY | 98.32 | NSTSTWITY | 1.08 | | | | |
| prM | 184 | 0.14 | 5 | 2 | 0 | y | STSTWVTYG | 98.44 | STSTWITYG | 1.08 | | | | |
| prM | 185 | 0.1 | 3 | 2 | 0 | y | TSTWVTYGT | 98.8 | TSTWITYGT | 1.08 | | | | |
| prM | 186 | 0.1 | 3 | 2 | 0 | y | STWVTYGTC | 98.8 | STWITYGTC | 1.08 | | | | |
| prM | 187 | 0.34 | 6 | 4 | 0 | y | TWVTYGTCT | 95.57 | TWVTYGTCS | 2.51 | TWVTYGTCA | 0.72 | TWITYGTCT | 0.6 |
| prM | 196 | 0.69 | 12 | 4 | 0 | y | TTGEHRREK | 89.46 | ATGEHRREK | 6.11 | TMGEHRREK | 1.8 | STGEHRREK | 1.68 |
| prM | 197 | 0.22 | 9 | 2 | 0 | y | TGEHRREKR | 97.37 | MGEHRREKR | 1.8 | | | | |
| prM | 198 | 0.05 | 5 | 1 | 0 | y | GEHRREKRS | 99.52 | | | | | | |
| prM | 199 | 0.05 | 5 | 1 | 0 | y | EHRREKRSV | 99.52 | | | | | | |
| prM | 200 | 0.03 | 3 | 1 | 0 | y | HRREKRSVA | 99.76 | | | | | | |
| prM | 201 | 0.01 | 2 | 1 | 0 | y | RREKRSVAL | 99.88 | | | | | | |
| prM | 202 | 0.06 | 3 | 1 | 0 | y | REKRSVALV | 99.4 | | | | | | |
| prM | 203 | 0.06 | 3 | 1 | 0 | y | EKRSVALVP | 99.4 | | | | | | |
| prM | 204 | 0.04 | 2 | 1 | 0 | y | KRSVALVPH | 99.52 | | | | | | |
| prM | 205 | 0.04 | 2 | 1 | 0 | y | RSVALVPHV | 99.52 | | | | | | |
| prM | 206 | 0.1 | 3 | 2 | 0 | y | SVALVPHVG | 98.92 | SVALVPHVR | 0.6 | | | | |
| prM | 207 | 0.1 | 3 | 2 | 0 | y | VALVPHVGM | 98.92 | VALVPHVRM | 0.6 | | | | |
| prM | 208 | 0.1 | 3 | 2 | 0 | y | ALVPHVGMG | 98.92 | ALVPHVRMG | 0.6 | | | | |
| prM | 209 | 0.1 | 3 | 2 | 0 | y | LVPHVGMGL | 98.92 | LVPHVRMGL | 0.6 | | | | |
| prM | 210 | 0.1 | 3 | 2 | 0 | y | VPHVGMGLE | 98.92 | VPHVRMGLE | 0.6 | | | | |

FIG. 7-8

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 211 | 0.05 | 2 | 1 | 0 | Y | PHVGMGLET | 99.4 | | | | | | |
| prM | 212 | 0.05 | 2 | 1 | 0 | Y | HVGMGLETR | 99.4 | | | | | | |
| prM | 213 | 0.05 | 2 | 1 | 0 | Y | VGMGLETRT | 99.4 | | | | | | |
| prM | 214 | 0.05 | 2 | 1 | 0 | Y | GMGLETRTE | 99.4 | | | | | | |
| prM | 215 | 0 | 1 | 1 | 0 | Y | MGLETRTET | 100 | | | | | | |
| prM | 216 | 0 | 1 | 1 | 0 | Y | GLETRTETW | 100 | | | | | | |
| prM | 217 | 0 | 1 | 1 | 0 | Y | LETRTETWM | 100 | | | | | | |
| prM | 218 | 0 | 1 | 1 | 0 | Y | ETRTETWMS | 100 | | | | | | |
| prM | 219 | 0 | 1 | 1 | 0 | Y | TRTETWMSS | 100 | | | | | | |
| prM | 220 | 0.02 | 2 | 1 | 0 | Y | RTETWMSSE | 99.76 | | | | | | |
| prM | 221 | 0.04 | 3 | 1 | 0 | Y | TETWMSSEG | 99.64 | | | | | | |
| prM | 222 | 0.04 | 3 | 1 | 0 | Y | ETWMSSEGA | 99.64 | | | | | | |
| prM | 223 | 0.04 | 3 | 1 | 0 | Y | TWMSSEGAW | 99.64 | | | | | | |
| prM | 224 | 0.04 | 3 | 1 | 0 | Y | WMSSEGAWK | 99.64 | | | | | | |
| prM | 225 | 0.17 | 4 | 2 | 0 | Y | MSSEGAWKH | 97.72 | MSSEGAWKQ | 1.92 | | | | |
| prM | 226 | 1.15 | 5 | 3 | 0 | Y | SSEGAWKHV | 50.54 | SSEGAWKHA | 47.19 | SSEGAWKQA | 1.92 | | |
| prM | 227 | 1.15 | 5 | 3 | 0 | Y | SEGAWKHVQ | 50.54 | SEGAWKHAQ | 47.19 | SEGAWKQAQ | 1.92 | | |
| prM | 228 | 1.16 | 6 | 3 | 0 | Y | EGAWKHVQR | 50.42 | EGAWKHAQR | 47.19 | EGAWKQAQR | 1.92 | | |
| prM | 229 | 1.14 | 5 | 3 | 0 | Y | GAWKHVQRI | 50.42 | GAWKHAQRI | 47.43 | GAWKQAQRI | 1.92 | | |
| prM | 230 | 1.13 | 4 | 3 | 0 | Y | AWKHVQRIE | 50.54 | AWKHAQRIE | 47.43 | AWKQAQRIE | 1.92 | | |
| prM | 231 | 1.14 | 5 | 3 | 0 | Y | WKHVQRIET | 50.54 | WKHAQRIET | 47.31 | WKQAQRIET | 1.92 | | |
| prM | 232 | 1.14 | 5 | 3 | 0 | Y | KHVQRIETW | 50.54 | KHAQRIETW | 47.31 | KQAQRIETW | 1.92 | | |
| prM | 233 | 1.37 | 6 | 4 | 0 | Y | HVQRIETWI | 50.54 | HAQRIETWI | 42.4 | HAQRIETWV | 4.91 | | |
| prM | 234 | 1.28 | 6 | 3 | 0 | Y | VQRIETWIL | 50.54 | AQRIETWIL | 44.07 | AQRIETWVL | 4.91 | QAQRIETWI | 1.92 |
| prM | 235 | 0.33 | 5 | 2 | 0 | Y | QRIETWILR | 94.61 | QRIETWVLR | 4.91 | | | | |

FIG. 7-9

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 236 | 0.33 | 5 | 2 | 0 | Y | RIETWILRH | 94.61 | | | | | | |
| prM | 237 | 0.32 | 4 | 2 | 0 | Y | IETWILRHP | 94.73 | | | | | | |
| prM | 238 | 0.32 | 4 | 2 | 0 | Y | ETWILRHPG | 94.73 | | | | | | |
| prM | 239 | 0.32 | 4 | 2 | 0 | Y | TWILRHPGF | 94.73 | | | | | | |
| prM | 240 | 0.43 | 5 | 3 | 0 | Y | WILRHPGFT | 94.91 | WILRHPGFA | 3.95 | | | | |
| prM | 242 | 0.58 | 8 | 5 | 0 | Y | LRHPGFTIM | 92.1 | LRHPGFTLM | 2.16 | LRHPGFAIM | 1.56 | LRHPGFTTM | 0.72 |
| prM | 243 | 0.56 | 7 | 5 | 0 | Y | RHPGFTMA | 92.34 | RHPGFTLMA | 2.16 | RHPGFAIMA | 1.56 | RHPGFTTMA | 0.72 |
| prM | 244 | 0.57 | 8 | 5 | 0 | Y | HPGFTMAA | 92.22 | HPGFTLMAA | 2.16 | HPGFAIMAA | 1.56 | HPGFTTMAA | 0.72 |
| prM | 250 | 0.45 | 7 | 3 | 0 | Y | MAAILAYTI | 93.41 | MAAVLAYTI | 3.95 | | | | |
| prM | 251 | 0.45 | 7 | 3 | 0 | Y | AAILAYTIG | 93.41 | AAVLAYTIG | 3.95 | | | | |
| prM | 252 | 0.45 | 7 | 3 | 0 | Y | AILAYTIGT | 93.41 | AVLAYTIGT | 3.95 | | | | |
| prM | 253 | 0.45 | 7 | 3 | 0 | Y | ILAYTIGTT | 93.41 | VLAYTIGTT | 3.95 | | | | |
| prM | 254 | 0.64 | 7 | 3 | 0 | Y | LAYTIGTTH | 89.34 | LAYTVGTTH | 5.99 | | | | |
| prM | 255 | 0.64 | 7 | 3 | 0 | Y | AYTIGTTHF | 89.34 | AYTVGTTHF | 5.99 | | | | |
| prM | 256 | 0.64 | 7 | 3 | 0 | Y | YTIGTTHFQ | 89.34 | YTVGTTHFQ | 5.99 | | | | |
| prM | 257 | 0.68 | 6 | 4 | 0 | Y | TIGTTHFQR | 88.62 | TVGTTHFQR | 5.99 | TIGTTHFQK | 1.2 | | |
| prM | 259 | 1.31 | 8 | 5 | 0 | Y | GTTHFQRAL | 68.14 | GTTHFQRVL | 22.75 | GTTHFQRTL | 1.8 | GTTHFQKAL | 0.84 |
| prM | 260 | 1.33 | 9 | 5 | 0 | Y | TTHFQRALI | 68.02 | TTHFQRVLI | 22.75 | TTHFQRTLI | 1.8 | TTHFQKALI | 0.84 |
| prM | 261 | 1.34 | 10 | 5 | 0 | Y | THFQRALIF | 67.9 | THFQRVLIF | 22.75 | THFQRTLIF | 1.8 | THFQKALIF | 0.84 |
| prM | 262 | 1.35 | 12 | 5 | 0 | Y | HFQRALIFI | 67.9 | HFQRVLIFI | 22.75 | HFQRTLIFI | 1.8 | HFQKALIFI | 0.84 |
| prM | 263 | 1.14 | 11 | 4 | 0 | Y | FQRALIFIL | 67.9 | FQRVLIFIL | 28.62 | FQKALIFIL | 0.84 | | |
| prM | 264 | 1.14 | 11 | 4 | 0 | Y | QRALIFILL | 67.9 | QRVLIFILL | 28.62 | QKALIFILL | 0.84 | | |
| prM | 265 | 1.36 | 12 | 5 | 0 | Y | RALIFILLT | 63.95 | RVLIFILLT | 28.62 | RTLIFILLT | 1.8 | KALIFILLT | 0.84 |
| prM | 266 | 1.32 | 12 | 5 | 0 | Y | ALIFILLTA | 64.67 | VLIFILLTA | 28.38 | TLIFILLTA | 1.8 | VLIFILLIT | 0.36 |
| prM | 267 | 0.52 | 8 | 4 | 0 | Y | LIFILLTAV | 92.34 | LIFILLTAI | 2.63 | LIFILLITV | 0.48 | | |

FIG. 7-10

Species: DENV2 (9

FIG. 7-11

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| E | 293 | 0 | 1 | 1 | 0 | Y | EGVSGGSWV | 100 |
| E | 294 | 0 | 1 | 1 | 0 | Y | GVSGGSWVD | 100 |
| E | 295 | 0 | 1 | 1 | 0 | Y | VSGGSWVDI | 100 |
| E | 296 | 0 | 1 | 1 | 0 | Y | SGGSWVDIV | 100 |
| E | 297 | 0 | 1 | 1 | 0 | Y | GGSWVDIVL | 100 |
| E | 298 | 0 | 1 | 1 | 0 | Y | GSWVDIVLE | 100 |
| E | 299 | 0 | 1 | 1 | 0 | Y | SWVDIVLEH | 100 |
| E | 300 | 0 | 1 | 1 | 0 | Y | WVDIVLEHG | 100 |
| E | 301 | 0 | 1 | 1 | 0 | Y | VDIVLEHGS | 100 |
| E | 302 | 0 | 1 | 1 | 0 | Y | DIVLEHGSC | 100 |
| E | 303 | 0 | 1 | 1 | 0 | Y | IVLEHGSCV | 100 |
| E | 304 | 0 | 1 | 1 | 0 | Y | VLEHGSCVT | 100 |
| E | 305 | 0 | 1 | 1 | 0 | Y | LEHGSCVTT | 100 |
| E | 306 | 0 | 1 | 1 | 0 | Y | EHGSCVTTM | 100 |
| E | 307 | 0 | 1 | 1 | 0 | Y | HGSCVTTMA | 100 |
| E | 308 | 0.02 | 2 | 1 | 0 | Y | GSCVTTMAK | 99.76 |
| E | 309 | 0.02 | 2 | 1 | 0 | Y | SCVTTMAKN | 99.76 |
| E | 310 | 0.02 | 2 | 1 | 0 | Y | CVTTMAKNK | 99.76 |
| E | 311 | 0.02 | 2 | 1 | 0 | Y | VTTMAKNKP | 99.76 |
| E | 312 | 0.02 | 2 | 1 | 0 | Y | TTMAKNKPT | 99.76 |
| E | 313 | 0.02 | 2 | 1 | 0 | Y | TMAKNKPTL | 99.76 |
| E | 314 | 0.02 | 2 | 1 | 0 | Y | MAKNKPTLD | 99.76 |
| E | 315 | 0.04 | 3 | 1 | 0 | Y | AKNKPTLDF | 99.64 |
| E | 316 | 0.04 | 3 | 1 | 0 | Y | KNKPTLDFE | 99.64 |
| E | 317 | 0.01 | 2 | 1 | 0 | Y | NKPTLDFEL | 99.88 |

FIG. 7-12

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 318 | 0.12 | 4 | 2 | 0 | Y | KPTLDFELI | 98.68 | KPTLDFELT | 0.96 | | | | |
| E | 319 | 0.13 | 5 | 2 | 0 | Y | PTLDFELIK | 98.56 | PTLDFELIK | 0.96 | | | | |
| E | 320 | 0.13 | 5 | 2 | 0 | Y | TLDFELIKT | 98.56 | TLDFELIKT | 0.96 | | | | |
| E | 321 | 0.13 | 5 | 2 | 0 | Y | LDFELIKTE | 98.56 | LDFELIKTE | 0.96 | | | | |
| E | 322 | 0.13 | 5 | 2 | 0 | Y | DFELIKTEA | 98.56 | DFELIKTEA | 0.96 | | | | |
| E | 323 | 0.15 | 6 | 2 | 0 | Y | FELIKTEAK | 98.32 | FELIKTEAK | 0.96 | | | | |
| E | 324 | 0.47 | 9 | 4 | 0 | Y | ELIKTEAKQ | 93.29 | ELIKTEAKH | 4.31 | ELIKTEAKE | 0.84 | ELTKTEAKH | 0.84 | |
| E | 327 | 0.5 | 9 | 4 | 0 | Y | KTEAKQPAT | 92.57 | KTEAKHPAT | 5.27 | KTEAKEPAT | 0.84 | KTEAKQSAT | 0.36 | |
| E | 328 | 0.49 | 8 | 4 | 0 | Y | TEAKQPATL | 92.69 | TEAKHPATL | 5.27 | TEAKEPATL | 0.84 | TEAKQLATL | 0.36 | |
| E | 329 | 0.49 | 8 | 4 | 0 | Y | EAKQPATLR | 92.69 | EAKHPATLR | 5.27 | EAKEPATLR | 0.84 | EAKQSATLR | 0.36 | |
| E | 330 | 0.49 | 8 | 4 | 0 | Y | AKQPATLRK | 92.69 | AKHPATLRK | 5.27 | AKEPATLRK | 0.84 | AKQSATLRK | 0.36 | |
| E | 331 | 0.61 | 10 | 5 | 0 | Y | KQPATLRKY | 91.02 | KHPATLRKF | 5.27 | KQPATLRKF | 1.68 | KEPATLRKY | 0.84 | KQSATLRKY | 0.36 |
| E | 332 | 0.59 | 9 | 4 | 0 | Y | QPATLRKYC | 91.26 | HPATLRKFC | 5.27 | QPATLRKF | 1.68 | EPATLRKY | 0.84 | |
| E | 333 | 0.33 | 9 | 4 | 0 | Y | PATLRKYCI | 96.05 | PATLRKFCI | 1.68 | PATLRKYCV | 1.2 | SATLRKYCI | 0.36 | |
| E | 334 | 0.29 | 7 | 3 | 0 | Y | ATLRKYCIE | 96.29 | ATLRKFCIE | 1.92 | ATLRKYCVE | 1.2 | | | |
| E | 335 | 0.29 | 6 | 3 | 0 | Y | TLRKYCIEA | 96.29 | TLRKFCIEA | 1.92 | TLRKYCVEA | 1.2 | | | |
| E | 336 | 0.32 | 6 | 3 | 0 | Y | LRKYCIEAK | 95.93 | LRKFCIEAK | 1.92 | LRKYCVEAK | 1.2 | | | |
| E | 337 | 0.32 | 6 | 3 | 0 | Y | RKYCIEAKL | 95.93 | RKFCIEAKL | 1.92 | RKYCVEAKL | 1.2 | | | |
| E | 338 | 0.32 | 6 | 3 | 0 | Y | KYCIEAKLT | 95.93 | KFCIEAKLT | 1.92 | KYCVEAKLT | 1.2 | | | |
| E | 339 | 0.32 | 6 | 3 | 0 | Y | YCIEAKLTN | 95.93 | FCIEAKLTN | 1.92 | YCVEAKLTN | 1.2 | | | |
| E | 340 | 0.18 | 5 | 2 | 0 | Y | CIEAKLTNT | 97.84 | CVEAKLTNT | 1.2 | | | | | |
| E | 341 | 0.2 | 6 | 3 | 0 | Y | IEARLTNTT | 97.72 | VEAKLTNTT | 1.2 | IEARLTNTT | 0.48 | | | |
| E | 342 | 0.09 | 4 | 1 | 0 | Y | EAKLTNTTT | 99.04 | | | | | | | |
| E | 343 | 0.62 | 6 | 3 | 0 | Y | AKLTNTTTE | 89.58 | AKLTNTTTA | 5.99 | AKLTNTTTD | 3.83 | | | |
| E | 344 | 0.62 | 6 | 3 | 0 | Y | KLTNTTTES | 89.58 | KLTNTTTAS | 5.99 | KLTNTTTDS | 3.83 | | | |

FIG. 7-13

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 345 | 0.58 | 4 | 3 | 0 | Y | LINTTTESR | 89.94 | LINTTTASR | 6.11 | LINTTTDSR | 3.83 | | |
| E | 346 | 0.58 | 4 | 3 | 0 | Y | TNTTTESRC | 89.94 | TNTTTASRC | 6.11 | TNTTTDSRC | 3.83 | | |
| E | 347 | 0.58 | 4 | 3 | 0 | Y | NTTTESRCP | 89.94 | NTTTASRCP | 6.11 | NTTTDSRCP | 3.83 | | |
| E | 348 | 0.58 | 4 | 3 | 0 | Y | TTTESRCPT | 89.94 | TTTASRCPT | 6.11 | TTTDSRCPT | 3.83 | | |
| E | 349 | 0.58 | 4 | 3 | 0 | Y | TTESRCPTQ | 89.94 | TTASRCPTQ | 6.11 | TTDSRCPTQ | 3.83 | | |
| E | 350 | 0.56 | 3 | 3 | 0 | Y | TESRCPTQG | 90.06 | TASRCPTQG | 6.11 | TDSRCPTQG | 3.83 | | |
| E | 351 | 0.56 | 3 | 3 | 0 | Y | ESRCPTQGE | 90.06 | ASRCPTQGE | 6.11 | DSRCPTQGE | 3.83 | | |
| E | 352 | 0 | 1 | 1 | 0 | Y | SRCPTQGEP | 100 | | | | | | |
| E | 353 | 0.18 | 3 | 2 | 0 | Y | RCPTQGEPS | 97.49 | RCPTQGEPT | 2.4 | | | | |
| E | 354 | 0.18 | 3 | 2 | 0 | Y | CPTQGEPSL | 97.49 | CPTQGEPTL | 2.4 | | | | |
| E | 355 | 1.3 | 8 | 5 | 0 | Y | PTQGEPSLN | 63.83 | PTQGEPSLK | 30.06 | PTQGEPTLN | 2.4 | PTQGEPSLV | 1.56 | PTQGEPSLS | 1.56 |
| E | 356 | 1.3 | 8 | 5 | 0 | Y | TQGEPSLNE | 63.83 | TQGEPSLKE | 30.06 | TQGEPTLNE | 2.4 | TQGEPSLSE | 1.56 | TQGEPSLVE | 1.56 |
| E | 357 | 1.3 | 8 | 5 | 0 | Y | QGEPSLNEE | 63.83 | QGEPSLKEE | 30.06 | QGEPTLNEE | 2.4 | QGEPSLSEE | 1.56 | QGEPSLVEE | 1.56 |
| E | 358 | 1.3 | 8 | 5 | 0 | Y | GEPSLNEEQ | 63.83 | GEPSLKEEQ | 30.06 | GEPTLNEEQ | 2.4 | GEPSLVEEQ | 1.56 | GEPSLSEEQ | 1.56 |
| E | 359 | 1.3 | 8 | 5 | 0 | Y | EPSLNEEQD | 63.83 | EPSLKEEQD | 30.06 | EPTLNEEQD | 2.4 | EPSLSEEQD | 1.56 | EPSLVEEQD | 1.56 |
| E | 360 | 1.3 | 8 | 5 | 0 | Y | PSLNEEQDK | 63.83 | PSLKEEQDK | 30.06 | PTLNEEQDK | 2.4 | PSLVEEQDK | 1.56 | PSLSEEQDK | 1.56 |
| E | 361 | 1.3 | 8 | 5 | 0 | Y | SLNEEQDKR | 63.83 | SLKEEQDKR | 30.06 | TLNEEQDKR | 2.4 | SLVEEQDKR | 1.56 | SLS

FIG. 7-14

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 371 | 1.27 | 6 | 4 | 0 | Y | VCKHSMVDR | 52.34 | VCKHSMVDR | 43.47 | VCRHSMVDR | 1.8 | LCKHSMVDR | 1.68 |

FIG. 7-15

Species: DENV2 (9-mers)

| protein

FIG. 7-16

Species: DENV2 (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 421 | 1.26 | 7 | 4 | 0 | Y | ITPHSGEEH | 62.75 | VTPHSGEEH | 30.78 | ITPHSGEEN | 5.27 | VTPHSGEEN | 0.72 |
| E | 422 | 0.41 | 7 | 2 | 0 | Y | TPHSGEEHA | 93.29 | TPHSGEENA | 5.87 | | | | |
| E | 423 | 0.41 | 7 | 2 | 0 | Y | PHSGEEHAV | 93.29 | PHSGEENAV | 5.87 | | | | |
| E | 424 | 0.41 | 7 | 2 | 0 | Y | HSGEEHAVG | 93.29 | HSGEENAVG | 5.87 | | | | |
| E | 425 | 0.47 | 10 | 4 | 0 | Y | SGEEHAVGN | 92.69 | SGEENAVGN | 5.87 | SGEEHAVGD | 0.36 | SGEETAVGN | 0.24 |
| E | 426 | 0.47 | 10 | 4 | 0.12 | Y | GEEHAVGND | 92.57 | GEENAVGND | 5.87 | GEEHAVGDD | 0.36 | GEEHSVGND | 0.24 |
| E | 427 | 0.48 | 11 | 4 | 0.24 | Y | EEHAVGNDT | 92.34 | EENAVGNDT | 5.87 | EEHAVGDDT | 0.36 | EEHSVGNDT | 0.24 |
| E | 428 | 0.48 | 11 | 4 | 0.24 | Y | EHAVGNDTG | 92.34 | ENAVGNDTG | 5.87 | EHAVGDDTG | 0.36 | EYAVGNDTG | 0.24 |
| E | 429 | 0.48 | 10 | 4 | 0.24 | Y | HAVGNDTGK | 92.34 | NAVGNDTGK | 5.99 | HAVGDDTGK | 0.36 | HSVGNDTGK | 0.24 |
| E | 430 | 0.11 | 7 | 2 | 0.24 | Y | AVGNDTGKH | 98.68 | AVGDDTGKH | 0.36 | | | | |
| E | 431 | 0.07 | 5 | 1 | 0.24 | Y | VGNDTGKHG | 99.04 | | | | | | |
| E | 432 | 0.56 | 9 | 4 | 0.24 | Y | GNDTGKHGK | 91.38 | GNDTGKHGQ | 4.55 | GNDTGKHGM | 2.75 | GDDTGKHGK | 0.36 |
| E | 433 | 0.56 | 9 | 4 | 0.24 | Y | NDTGKHGKE | 91.38 | NDTGKHGQE | 4.55 | NDTGKHGME | 2.75 | DDTGKHGKE | 0.36 |
| E | 434 | 0.75 | 7 | 4 | 0.24 | Y | DTGKHGKEI | 87.66 | DTGKHGQEI | 4.55 | DTGKHGMEI | 4.31 | DTGKHGMEI | 2.75 |
| E | 435 | 0.75 | 7 | 4 | 0.24 | Y | TGKHGKEIK | 87.66 | TGKHGQEIK | 4.55 | TGKHGMEIK | 4.31 | TGKHGMEIK | 2.75 |
| E | 436 | 1.55 | 8 | 5 | 0.12 | Y | GKHGKEIKV | 58.44 | GKHGKEIKV | 29.34 | GKHGQEIKV | 4.55 | GKHGKEVKI | 4.43 | GKHGMEIKV | 2.75 |
| E | 437 | 1.55 | 7 | 5 | 0.12 | Y | KHGKEIKVT | 58.44 | KHGKEIKVT | 29.34 | KHGQEIKVT | 4.55 | KHGKEVKIT | 4.43 | KHGMEIKVT | 2.75 |
| E | 438 | 1.56 | 9 | 5 | 0 | Y | HGKEIKVTP | 58.44 | HGKEIKVTP | 29.34 | HGQEIKVTP | 4.55 | HGKEVKITP | 4.43 | HGMEIKVTP | 2.75 |
| E | 439 | 1.55 | 6 | 5 | 0 | Y | GKEIKVTPQ | 58.56 | GKEIKVTPQ | 29.34 | GQEIKVTPQ | 4.55 | GKEVKITPQ | 4.43 | GMEIKVTPQ | 2.75 |
| E | 440 | 1.56 | 8 | 5 | 0 | Y | KEIKVTPQS | 58.56 | KEIKVTPQS | 29.34 | QEIKVTPQS | 4.55 | KEVKITPQS | 4.19 | MEIKVTPQS | 2.75 |
| E | 441 | 1.4 | 7 | 4 | 0 | Y | EIKVTPQSS | 54.97 | EIKVTPQSS | 36.65 | EVKITPQSS | 4.19 | EIKITPQSP | 3.95 | | |
| E | 451 | 0.23 | 8 | 2 | 0 | Y | TEAELTGYG | 97.84 | AEAELTGYG | 0.96 | AEAELTGYG | 0.36 | SEAELTDYG | 0.36 | | |
| E | 452 | 0.19 | 7 | 3 | 0 | Y | EAELTGYGT | 97.49 | EAELTDYGT | 1.32 | AELTDYGT | 0.72 | | | | |
| E | 453 | 0.21 | 6 | 3 | 0 | Y | AELTGYGTV | 97.49 | AELTDYGTI | 1.32 | AELTGYGTI | | | | | |
| E | 454 | 0.19 | 5 | 2 | 0 | Y | ELTGYGTVT | 97.72 | ELTDYGTIT | 1.32 | | | | | | |

FIG. 7-17

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 455 | 0.19 | 5 | 2 | 0 | Y | LTGYGTVTM | 97.72 | LTDYGTITM | 1.32 | | | | |
| E | 456 | 0.2 | 6 | 3 | 0 | Y | TGYGTVTME | 97.6 | TDYGTITME | 1.32 | TGYGTITME | 0.72 | | |
| E | 457 | 0.2 | 6 | 3 | 0 | Y | GYGTVTMEC | 97.6 | DYGTITMEC | 1.32 | GYGTITMEC | 0.72 | | |
| E | 458 | 0.18 | 5 | 2 | 0 | Y | YGTVTMECS | 97.6 | YGTITMECS | 2.04 | | | | |
| E | 459 | 0.2 | 6 | 2 | 0 | Y | GTVTMECSP | 97.49 | GTITMECSP | 2.04 | | | | |
| E | 460 | 0.2 | 6 | 2 | 0 | Y | TVTMECSPR | 97.49 | TITMECSPR | 2.04 | | | | |
| E | 461 | 0.18 | 5 | 2 | 0 | Y | VTMECSPRT | 97.6 | ITMECSPRT | 1.32 | | | | |
| E | 462 | 0.14 | 5 | 2 | 0 | Y | TMECSPRTG | 98.32 | TMECSPRTS | 1.32 | | | | |
| E | 463 | 0.17 | 6 | 2 | 0 | Y | MECSPRTGL | 98.08 | MECSPRTSL | 1.32 | | | | |
| E | 464 | 0.19 | 6 | 2 | 0 | Y | ECSPRTGLD | 97.84 | ECSPRTSLD | 1.32 | | | | |
| E | 465 | 0.19 | 8 | 2 | 0 | Y | CSPRTGLDF | 97.84 | CSPRTSLDF | 1.32 | | | | |
| E | 466 | 0.21 | 8 | 2 | 0 | Y | SPRTGLDFN | 97.72 | SPRTSLDFN | 1.32 | | | | |
| E | 467 | 0.21 | 9 | 2 | 0 | Y | PRTGLDFNE | 97.72 | PRTSLDFNE | 1.32 | | | | |
| E | 468 | 0.21 | 9 | 2 | 0 | Y | RTGLDFNEM | 97.72 | RTSLDFNEM | 1.32 | | | | |
| E | 469 | 0.21 | 9 | 2 | 0 | Y | TGLDFNEMV | 97.72 | TSLDFNEMV | 1.32 | | | | |
| E | 470 | 0.19 | 8 | 2 | 0 | Y | GLDFNEMVL | 97.84 | SLDFNEMVL | 1.32 | | | | |
| E | 471 | 0.09 | 7 | 1 | 0 | Y | LDFNEMVLL | 99.16 | | | | | | |
| E | 472 | 0.09 | 8 | 1 | 0 | Y | DFNEMVLLQ | 99.16 | | | | | | |
| E | 473 | 0.08 | 7 | 1 | 0 | Y | FNEMVLLQM | 99.28 | | | | | | |
| E | 474 | 0.16 | 8 | 2 | 0 | Y | NEMVLLQME | 98.32 | NEMVLLQMK | 0.72 | | | | |
| E | 481 | 1.27 | 9 | 5 | 0 | Y | MEDKAWLVH | 57.72 | MENKAWLVH | 38.2 | MEEKAWLVH | 1.56 | MESKAWLVH | 1.2 | MGNKAWLVH | 0.36 |
| E | 482 | 1.27 | 9 | 5 | 0 | Y | EDKAWLVHR | 57.72 | ENKAWLVHR | 38.2 | EKAWLVHR | 1.56 | ESKAWLVHR | 1.2 | GNKAWLVHR | 0.36 |
| E | 483 | 1.18 | 6 | 4 | 0 | Y | DKAWLVHRQ | 58.08 | NKAWLVHRQ | 38.92 | EKAWLVHRQ | 1.56 | SKAWLVHRQ | 1.2 | | |
| E | 484 | 0.01 | 2 | 1 | 0 | Y | KAWLVHRQW | 99.88 | | | | | | |
| E | 485 | 0.01 | 2 | 1 | 0 | Y | AWLVHRQWF | 99.88 | | | | | | |

FIG. 7-18

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 486 | 0 | 1 | 1 | 0 | Y | WLVHRQWFL | 100 | | | | | | |
|

FIG. 7-19

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 511 | 0.16 | 4 | 2 | 0.12 | Y | WIQKETLVT | 97.72 | WIQKEMLVT | 1.92 |
| E | 512 | 0.16 | 4 | 2 | 0.12 | Y | IQKETLVTF | 97.72 | IQKEMLVTF | 1.92 |
| E | 513 | 0.16 | 4 | 2 | 0.12 | Y | QKETLVTFK | 97.72 | QKEMLVTFK | 1.92 |

FIG. 7-20

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block |

FIG. 7-21

Species: DENV2 (9-mers)

| protein | block starting position | block entropy | total peptides in block | # peptides required to cover 99% of block | gap/X fraction | 99% of block covered w/ <= 5 peptides? | peptides required to cover

FIG. 7-22

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 586 | 1.01 | 4 | 2 | 0 | Y | FKVVKEIAE | 57.25 | FKVVKEIAE | 42.51 | | | | |
| E | 587 | 1.01 | 4 | 2 | 0 | Y | KVVKEIAET | 57.25 | KVVKEIAET | 42.51 | | | | |
| E | 588 | 1.01 | 4 | 2 | 0 | Y | VVKEIAETQ | 57.25 | VVKEIAETQ | 42.51 | | | | |
| E | 589 | 0.03 | 3 | 1 | 0 | Y | VKEIAETQH | 99.76 | | | | | | |
| E | 590 | 0.01 | 2 | 1 | 0 | Y | KEIAETQHG | 99.88 | | | | | | |
| E | 591 | 0 | 1 | 1 | 0 | Y | EIAETQHGT | 100 | | | | | | |
| E | 592 | 0.04 | 3 | 1 | 0 | Y | IAETQHGTI | 99.64 | | | | | | |
| E | 593 | 0.04 | 3 | 1 | 0 | Y | AETQHGTIV | 99.64 | | | | | | |
| E | 594 | 0.11 | 4 | 2 | 0 | Y | ETQHGTIVW | 98.8 | ETQHGTIW | 0.84 | ETQHGTIW | 0.84 | | |
| E | 595 | 0.12 | 5 | 2 | 0 | Y | TQHGTIVWR | 98.68 | TQHGTIVR | 0.84 | HGTIVWRV | 0.84 | | |
| E | 596 | 0.23 | 7 | 3 | 0 | Y | QHGTIVWRV | 97.37 | QHGTIVIRI | 1.08 | QHGTIVWRV | 1.08 | | |
| E | 597 | 0.24 | 8 | 3 | 0 | Y | HGTIVWRVQ | 97.25 | HGTIVIRIQ | 1.08 | HGTIVWRVQ | 1.08 | | |
| E | 598 | 0.24 | 8 | 3 | 0 | Y | GTIVWRVQY | 97.25 | GTIVIRIQY | 1.08 | GTIWRVQY | 1.08 | | |
| E | 599 | 0.24 | 8 | 3 | 0 | Y | TIVWRVQYE | 97.25 | TIVIRIQYE | 1.08 | TIWRVQYE | 0.84 | | |
| E | 600 | 0.24 | 8 | 3 | 0 | Y | IVWRVQYEG | 97.01 | IVIRIQYEG | 1.08 | IWRVQYEG | 0.84 | | |
| E | 601 | 0.26 | 8 | 4 | 0 | Y | VWRVQYEGD | 95.21 | VIRIQYEGD | 1.08 | VWRVQYEGD | 0.84 | VIRVQYEGE | 0.48 | |
| E | 602 | 0.4 | 10 | 5 | 0 | Y | WRVQYEGDG | 95.93 | IRVQYEGDD | 1.8 | WRVQYEGDG | 1.08 | VRVQYEGDG | 0.84 | IRLQYEGDG |
| E | 603 | 0.34 | 10 | 4 | 0 | Y | RVQYEGDGS | 95.93 | RVQYEGDDS | 1.8 | RVQYEGDGS | 1.08 | RLQYEGDGS | 0.24 | |
| E | 604 | 0.33 | 9 | 4 | 0 | Y | VQYEGDGSP | 96.05 | VQYEGDDSP | 1.8 | VQYEGDDSP | 1.08 | LQYEGDGSP | 0.24 | |
| E | 605 | 0.22 | 7 | 2 | 0 | Y | QYEGDGSPC | 97.37 | QYEGDDSPC | 1.8 | | | | |
| E | 606 | 0.33 | 8 | 3 | 0 | Y | YEGDGSPCK | 95.93 | YEGDDSPCK | 1.8 | YEGDGSPCR | 1.44 | EGDGSPCKV | 1.2 | EGDGSPCKT | 0.24 |
| E | 607 | 0.44 | 10 | 5 | 0 | Y | EGDGSPCKI | 94.49 | EGDDSPCKI | 1.8 | EGDGSPCRI | 1.44 | GDGSPCKVP | 1.2 | EGAPCKIP | 0.24 |
| E | 608 | 0.44 | 10 | 5 | 0 | Y | GDGSPCKIP | 94.49 | GDDSPCKIP | 1.8 | GDGSPCRIP | 1.44 | DGSPCKVPF | 1.2 | DGSPCKTPF | 0.24 |
| E | 609 | 0.44 | 10 | 5 | 0 | Y | DGSPCKIPF | 94.49 | DDSPCKIPF | 1.8 | DGSPCRIPF | 1.44 | GSPCKVPFE | 1.2 | |
| E | 610 | 0.42 | 7 | 4 | 0 | Y | GSPCKIPFE | 94.49 | DSPCKIPFE | 2.16 | GSPCRIPFE | 1.44 | | |

FIG. 7-23

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 611 | 0.29 | 7 | 3 | 0 | Y | SPCKIPFEI | 96.53 | SPCRIPFEI | 1.44 | SPCK

FIG. 7-24

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 646 | 0.04 | 3 | 1 | 0 | Y | NIEAEPPF

FIG. 7-25

Species: DENV2 (9-mers)

| protein | block starting position | entropy block | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 671 | 0.06 | 3 | 1 | 0 | Y | WFKKG

FIG. 7-26

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 696 | 0.03 | 3 | 1 | 0 | Y | GDTAWDFGS | 99.76 | DTAWDFGSI | 1.68 | | | | |
| E | 697 | 0.16 | 5 | 2 | 0 | Y | DTAWDFGSL | 97.96 | TAWDFGSIG | 1.68 | | | | |
| E | 698 | 0.15 | 4 | 2 | 0 | Y | TAWDFGSLG | 98.08 | AWDFGSIGG | 1.68 | | | | |
| E | 699 | 0.15 | 4 | 2 | 0 | Y | AWDFGSLGG | 98.08 | WDFGSIGGV | 1.68 | WDFGSLGGA | 0.6 | | |
| E | 700 | 0.22 | 5 | 3 | 0 | Y | WDFGSLGGV | 97.25 | DFGSIGGVF | 1.68 | DFGSLGGAF | 0.6 | |

FIG. 7-27

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 721 | 0.12 | 5 | 2 | 0 | Y | GAIYGAAFS | 98.68 | GAIYGAAFS | 0.6 | | | | |
| E | 722 | 0.12 | 5 | 2 | 0 | Y | AIYGAAFSG | 98.68 | AIYGAAFSG | 0.6 | | | | |
| E | 723 | 0.12 | 5 | 2 | 0 | Y | IYGAAFSGV | 98.68 | IYGVAFSGV | 0.6 | | | | |
| E | 724 | 0.12 | 5 | 2 | 0 | Y | YGAAFSGVS | 98.68 | YGVAFSGVS | 0.6 | | | | |
| E | 725 | 0.12 | 5 | 2 | 0 | Y | GAAFSGVSW | 98.68 | GVAFSGVSW | 0.6 | | | | |
| E | 726 | 0.23 | 7 | 3 | 0 | Y | AAFSGVSWT | 97.37 | AAFSGVSWI | 1.2 | | | | |
| E | 727 | 0.2 | 7 | 3 | 0 | Y | AFSGVSWTM | 97.72 | AFSGVSWIM | 1.2 | VAFSGVSWT | | | |
| E | 728 | 0.18 | 6 | 2 | 0 | Y | FSGVSWTMK | 97.96 | FSGVSWIMK | 1.2 | AFNGVSWTM | | | |
| E | 729 | 0.17 | 5 | 2 | 0 | Y | SGVSWTMKI | 98.08 | SGVSWIMKI | 1.2 | | | | |
| E | 730 | 0.17 | 5 | 2 | 0 | Y | GVSWTMKIL | 97.96 | GVSWIMKIL | 1.2 | | | | |
| E | 731 | 0.2 | 7 | 3 | 0 | Y | VSWTMKILI | 97.72 | VSWIMKILI | 1.2 | VSWTMKIFI | 0.48 | | |
| E | 732 | 0.2 | 7 | 3 | 0 | Y | SWTMKILIG | 97.72 | SWIMKILIG | 1.2 | SWTMKIFIG | 0.48 | | |
| E | 733 | 0.34 | 8 | 4 | 0 | Y | WTMKILIGV | 95.81 | WTMKILIGA | 1.92 | WIMKILIGV | 1.2 | | |
| E | 734 | 0.84 | 11 | 5 | 0 | Y | TMKILIGVI | 85.03 | TMKILIGVV | 10.66 | TMKILIGAI | 1.92 | | |
| E | 735 | 0.75 | 9 | 4 | 0 | Y | MKILIGVII | 86.11 | MKILIGVI | 10.78 | MKILIGAII | 1.92 | WTMKIFIGVI | 0.48 | |
| E | 736 | 0.72 | 8 | 3 | 0 | Y | KILIGVIIT | 86.35 | KILIGVIT | 10.78 | KILIGAIIT | 1.92 | IMKILIGVI | 1.08 | |
| E | 737 | 0.72 | 8 | 3 | 0 | Y | ILIGVIITW | 86.35 | ILIGVIITW | 10.78 | ILIGAIITW | 1.92 | MKIFIGVII | 0.48 | |
| E | 738 | 0.72 | 8 | 3 | 0 | Y | LIGVIITWI | 86.35 | LIGVIITWI | 10.78 | LIGAIITWI | 1.92 | | |
| E | 739 | 0.68 | 8 | 3 | 0 | Y | IGVIITWIG | 86.83 | IGVIITWIG | 10.78 | IGAIITWIG | 1.92 | | |
| E | 740 | 0.67 | 7 | 3 | 0 | Y | GVIITWIGM | 86.83 | GVIITWIG | 10.9 | GAIITWIGM | 1.92 | | TMKIFIGVI | 0.48 |
| E | 741 | 0.67 | 6 | 3 | 0 | Y | VIITWIGMN | 86.83 | VIITWIGMN | 10.9 | AIITWIGMN | 1.92 | | |
| E | 742 | 0.55 | 6 | 2 | 0 | Y | IITWIGMNS | 88.62 | IITWIGMNS | 10.9 | | | | |
| E | 743 | 0.04 | 4 | 1 | 0 | Y | ITWIGMNSR | 99.64 | ITWIGMNS | | | | | |
| E | 744 | 0.04 | 4 | 1 | 0 | Y | TWIGMNSRS | 99.64 | TWIGMNSR | | | | | |
| E | 745 | 0.05 | 5 | 1 | 0 | Y | WIGMNSRST | 99.52 | WIGMNSRS | | | | | |

FIG. 7-28

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 746 | 0.04 | 4 | 1 | 0 | Y | IGMNSRSTS | 99.64 | | | | | | |
| E | 747 | 0.05 | 5 | 1 | 0 | Y | GMNSRSTSL | 99.52 | | | | | | |
| E | 748 | 0.05 | 5 | 1 | 0 | Y | MNSRSTSLS | 99.52 | | | | | | |
| E | 749 | 0.05 | 5 | 1 | 0 | Y | NSRSTSLSV | 99.52 | | | | | | |
| E | 750 | 0.3 | 7 | 2 | 0 | Y | SRSTSLSVS | 95.57 | SRSTSLSVT | 3.83 | | | | |
| E | 751 | 0.29 | 6 | 2 | 0 | Y | RSTSLSVSL | 95.69 | RSTSLSVTL | 3.83 | | | | |
| E | 752 | 0.32 | 8 | 2 | 0 | Y | STSLSVSLV | 95.45 | STSLSVTLV | 3.71 | | | | |
| E | 753 | 0.32 | 8 | 2 | 0 | Y | TSLSVSLVL | 95.57 | TSLSVTLVL | 3.47 | | | | |
| E | 754 | 0.31 | 7 | 2 | 0 | Y | SLSVSLVLV | 95.69 | SLSVTLVLV | 3.47 | | | | |
| E | 755 | 0.31 | 7 | 2 | 0 | Y | LSVSLVLVG | 95.69 | LSVTLVLVG | 3.47 | | | | |
| E | 756 | 1.19 | 9 | 3 | 0 | Y | SVSLVLVGV | 63.95 | SVSLVLVGI | 31.74 | SVTLVLVGI | 3.35 | | |
| E | 757 | 1.51 | 11 | 5 | 0 | Y | VSLVLVGVV | 57.37 | VSLVLVGVI | 31.62 | VSLVLVGVI | 6.59 | VSLILVGIV | 0.24 |
| E | 758 | 1.38 | 10 | 4 | 0 | Y | LVLVGVTL | 56.89 | LVLVGWTL | 34.97 | LVLVGWIL | 6.59 | | |
| E | 759 | 1.38 | 10 | 4 | 0 | Y | VLVGVTLY | 56.89 | VLVGWTLY | 34.97 | VLVGWILY | 6.59 | GWILYLGA | 0.6 |
| E | 760 | 1.35 | 8 | 4 | 0 | Y | LVGWTLYL | 56.89 | LVGWTLYL | 35.33 | LVGWILYL | 6.59 | | |
| E | 761 | 1.33 | 7 | 3 | 0 | Y | VGWTLYLG | 56.89 | VGWTLYLG | 35.57 | | | | |
| E | 762 | 1.86 | 9 | 5 | 0 | Y | GWTLYLGA | 37.84 | GWTLYLGV | 35.57 | GWTLYLGA | 19.04 | | |
| E | 763 | 1.65 | 7 | 4 | 0 | Y | VTLYLGVMV | 54.73 | VTLYLGAMV | 27.66 | ITLYLGAMV | 10.18 | | |
| E | 764 | 1.41 | 6 | 3 | 0 | Y | TLYLGVMVQ | 54.85 | TLYLGAMVQ | 34.13 | | | | |
| E | 765 | 1.36 | 5 | 3 | 0 | Y | LYLGVMVQA | 54.85 | LYLGAMVQA | 34.73 | | | | |
| E | 766 | 1.36 | 5 | 3 | 0 | Y | YLGVMVQAD | 54.85 | YLGAMVQAD | 34.73 | | | | |
| E | 767 | 1.56 | 6 | 4 | 0 | Y | LGVMVQADS | 51.02 | LGAMVQADS | 34.73 | LGVMVQADT | 10.18 | | |
| E | 768 | 1.56 | 6 | 4 | 0 | Y | GVMVQADSG | 51.02 | GAMVQADSG | 34.73 | GVMVQADTG | 10.18 | | |
| E | 769 | 1.56 | 6 | 4 | 0 | Y | VMVQADSGC | 51.02 | AMVQADSGC | 34.73 | VMVQADTGC | 10.18 | | |
| E | 770 | 0.91 | 5 | 4 | 0 | Y | MVQADSGCV | 82.63 | MVQADSGCV | 10.3 | MVQADTGCV | 3.83 | MVQADSGCI | 3.11 |

FIG. 7-29

Species: DENV2 (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---

FIG. 7-30

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 798 | 0.04 | 4 | 1 | 0 | Y | DNWHTWTEQ | 99.64 | | | | | | |
| NS1 | 799 | 0.04 | 4 | 1 | 0 | Y | NVHTWTEQY | 99.64 | | | | | | |
| NS1 | 800 | 0.01 | 2 | 1 | 0.12 | Y | VHTWTEQYK | 99.76 | | | | | | |
| NS1 | 801 | 0 | 1 | 1 | 0.12 | Y | HTWTEQYKF | 99.88 | | | | | | |
| NS1 | 802 | 0 | 1 | 1 | 0.12 | Y | TWTEQYKFQ | 99.88 | | | | | | |
| NS1 | 803 | 0 | 1 | 1 | 0.12 | Y | WTEQYKFQP | 99.88 | | | | | | |
| NS1 | 804 | 0.14 | 2 | 2 | 0.12 | Y | TEQYKFQPE | 97.96 | TEQYKFQPD | 1.92 | | | | |
| NS1 | 805 | 0.15 | 3 | 2 | 0.12 | Y | EQYKFQPES | 97.84 | EQYKFQPDS | 1.92 | | | | |
| NS1 | 806 | 0.15 | 3 | 2 | 0.12 | Y | QYKFQPESP | 97.84 | QYKFQPDSP | 1.92 | | | | |
| NS1 | 807 | 0.16 | 4 | 2 | 0.12 | Y | YKFQPESPS | 97.72 | YKFQPDSPS | 1.92 | | | | |
| NS1 | 808 | 0.16 | 4 | 2 | 0.12 | Y | KFQPESPSK | 97.72 | KFQPDSPSK | 1.92 | | | | |
| NS1 | 809 | 0.16 | 4 | 2 | 0 | Y | FQPESPSKL | 97.84 | FQPDSPSKL | 1.92 | | | | |
| NS1 | 810 | 0.16 | 4 | 2 | 0 | Y | QPESPSKLA | 97.84 | QPDSPSKLA | 1.92 | | | | |
| NS1 | 811 | 0.16 | 4 | 2 | 0 | Y | PESPSKLAS | 97.84 | PDSPSKLAS | 1.92 | | | | |
| NS1 | 812 | 0.16 | 4 | 2 | 0 | Y | ESPSKLASA | 97.84 | DSPSKLASA | 1.92 | | | | |
| NS1 | 813 | 0.03 | 3 | 1 | 0 | Y | SPSKLASAI | 99.76 | | | | | | |
| NS1 | 814 | 0.03 | 3 | 1 | 0 | Y | PSKLASAIQ | 99.76 | | | | | | |
| NS1 | 815 | 0.04 | 4 | 1 | 0 | Y | SKLASAIQK | 99.64 | | | | | | |
| NS1 | 816 | 0.03 | 3 | 1 | 0 | Y | KLASAIQKA | 99.76 | | | | | | |
| NS1 | 817 | 0.95 | 6 | 2 | 0 | Y | LASAIQKAH | 68.86 | LASAIQKAQ | 30.54 | | | | |
| NS1 | 818 | 0.97 | 8 | 2 | 0 | Y | ASAIQKA

FIG. 7-31

Species: DENV2 (9-mers)

| protein | block

FIG. 7-32

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block |

FIG. 7-33

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 879 | 0.5 | 10 | 4 | 0 | Y | LRPQPTELK | 93.41 | LRPQPTELR | 2.63 | LRPQPTELR | 1.68 | LQPQPTELK | 1.32 | | |
| NS1 | 880 | 0.5 | 10 | 4 | 0 | Y | RPQPTELKY | 93.41 | RPQPTELRY | 2.63 | RPQPTELRY | 1.68 | QPQPTELKY | 1.32 | | |
| NS1 | 881 | 0.34 | 6 | 2 | 0 | Y | PQPTELRYS | 94.85 | PQPTELRYS | 4.31 | | | | | | |
| NS1 | 882 | 0.34 | 6 | 2 | 0 | Y | QPTELKYSW | 94.85 | QPTELRYSW | 4.31 | | | | | | |
| NS1 | 883 | 0.35 | 7 | 2 | 0 | Y | PTELKYSWK | 94.73 | PTELRYSWK | 4.31 | | | | | | |
| NS1 | 884 | 0.63 | 10 | 4 | 0 | Y | TELKYSWKT | 90.18 | TELKYSWKA | 4.55 | TELRYSWKT | 4.19 | TQLKYSWKT | 0.36 | | |
| NS1 | 885 | 0.6 | 8 | 3 | 0 | Y | ELKYSWKTW | 90.42 | ELKYSWKAW | 4.55 | ELRYSWKTW | 4.19 | | | | |
| NS1 | 886 | 0.57 | 7 | 3 | 0 | Y | LKYSWKTWG | 90.78 | LKYSWKAWG | 4.55 | LRYSWKTWG | 4.19 | | | | |
| NS1 | 887 | 0.58 | 8 | 3 | 0 | Y | KYSWKTWGK | 90.66 | KYSWKAWGK | 4.55 | RYSWKTWGK | 4.19 | | | | |
| NS1 | 888 | 0.35 | 7 | 2 | 0 | Y | YSWKTWGKA | 94.61 | YSWKAWGKA | 4.67 | | | | | | |
| NS1 | 889 | 0.35 | 7 | 2 | 0 | Y | SWKTWGKAK | 94.61 | SWKAWGKAK | 4.67 | | | | | | |
| NS1 | 890 | 0.5 | 10 | 3 | 0 | Y | WKTWGKAKM | 92.69 | WKAWGKAKM | 4.67 | WKTWGKAKV | 1.68 | | | | |
| NS1 | 891 | 0.52 | 12 | 4 | 0 | Y | KTWGKAKML | 92.46 | KAWGKAKML | 4.67 | KTWGKAKVL | 1.68 | KTWGKAKIL | 0.24 | | |
| NS1 | 893 | 0.33 | 11 | 4 | 0 | Y | WGKAKMLST | 96.05 | WGKAKMLPT | 1.8 | WGKAKMLPT | 0.96 | WGKAKILST | 0.36 | | |
| NS1 | 894 | 0.37 | 13 | 5 | 0 | Y | GKAKMLSTE | 95.69 | GKAKMLPTE | 1.8 | GKAKMLPTE | 0.96 | GKAKILSTE | 0.36 | | |
| NS1 | 904 | 1.23 | 9 | 5 | 0 | Y | HNQTFLIDG | 72.1 | YNQTFLIDG | 19.64 | HNHTFLIDG | 5.03 | QNQTFLIDG | 2.04 | HNRTFLIDG | 0.6 |
| NS1 | 905 | 0.4 | 7 | 3 | 0 | Y | NQTFLIDGP | 93.77 | NHTFLIDGP | 5.03 | NRTFLIDGP | 0.6 | | | | |
| NS1 | 906 | 0.43 | 8 | 3 | 0 | Y | QTFLIDGPE | 93.53 | HTFLIDGPE | 5.03 | RTFLIDGPE | 0.6 | | | | |
| NS1 | 907 | 0.09 | 6 | 1 | 0 | Y | TFLIDGPET | 99.16 | | | | | | | | |
| NS1 | 908 | 0.38 | 7 | 3 | 0 | Y | FLIDGPETA | 94.61 | FLIDGPETT | 3.95 | FLIDGPETV | 0.72 | | | | |
| NS1 | 909 | 0.38 | 7 | 3 | 0 | Y | LIDGPETAE | 94.61 | LIDGPETTE | 3.95 | LIDGPETVE | 0.72 | | | | |
| NS1 | 910 | 0.36 | 6 | 3 | 0 | Y | IDGPETAEC | 94.73 | IDGPETTEC | 3.95 | IDGPETVEC | 0.72 | | | | |
| NS1 | 911 | 0.34 | 5 | 3 | 0 | Y | DGPETAECP | 94.97 | DGPETTECP | 3.95 | DGPETVECP | 0.72 | | | | |
| NS1 | 912 | 0.35 | 6 | 3 | 0 | Y | GPETAECPN | 94.97 | GPETTECPN | 3.71 | GPETVECPN | 0.72 | | | | |
| NS1 | 915 | 0.43 | 11 | 5 | 0 | Y | TAECPNTNR | 94.61 | TTECPNTNR | 1.92 | TTECPNSNR | 1.68 | TVECPNTNR | 0.72 | TAECPNANR | 0.24 |

FIG. 7-34

Species: DENV2 (9-mers)

| protein | block starting position | block entropy | total peptides in block | # peptides required to cover 99% of block | gap/X fraction | 99% of block cov

FIG. 7-35

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 941 | 1.51 | 8 | 5 | 0 | Y | NIWLKLLREK | 57.6 | NIWLKLLREK | 31.74 | NIWLKLLREK | 6.11 | NIWLRLREK | 2.4 | NIWLRLLEEK | 1.44 |
| NS1 | 942 | 1.51 | 8 | 5 | 0 | Y | IWLKLREKQ | 57.6 | IWLKLKEKQ | 31.74 | IWLKLKERQ | 6.11 | IWLRLREKQ | 2.4 | IWLRLKEKQ | 1.44 |
| NS1 | 943 | 1.51 | 8 | 5 | 0 | Y | WLKLREKQD | 57.49 | WLKLKEKQD | 31.86 | WLKLKERQD | 6.11 | WLRLREKQD | 2.4 | WLRLKEKQD | 1.44 |
| NS1 | 953 | 0.28 | 7 | 4 | 0 | Y | FCDSKLMSA | 96.77 | ICDSKLMSA | 1.08 | SCDSKLMSA | 0.6 | VCDSKLMSA | 0.6 | | |
| NS1 | 954 | 0.07 | 5 | 1 | 0 | Y | CDSKLMSAA | 99.28 | | | | | | | | |
| NS1 | 955 | 0.27 | 6 | 2 | 0 | Y | DSKLMSAAI | 96.29 | DSKLMSAAV | 2.99 | | | | | | |
| NS1 | 956 | 0.27 | 6 | 2 | 0 | Y | SKLMSAAIK | 96.29 | SKLMSAAVK | 2.99 | | | | | | |
| NS1 | 957 | 0.3 | 7 | 3 | 0 | Y | KLMSAAIKD | 95.93 | KLMSAAVKD | 2.99 | KLMSAAIKN | 0.6 | | | | |
| NS1 | 958 | 0.36 | 8 | 4 | 0 | Y | LMSAAIKDN | 95.57 | LMSAAVKDD | 1.68 | LMSAAVKDN | 1.32 | LMSAAIKNN | 0.6 | | |
| NS1 | 959 | 0.36 | 8 | 4 | 0 | Y | MSAAIKDNR | 95.57 | MSAAVKDDR | 1.68 | MSAAVKDNR | 1.32 | MSAAIKNNR | 0.6 | | |
| NS1 | 960 | 0.36 | 8 | 4 | 0 | Y | SAAIKDNRA | 95.57 | SAAVKDDRA | 1.68 | SAAVKDNRA | 1.32 | SAAIKNNRA | 0.6 | | |
| NS1 | 961 | 0.37 | 9 | 4 | 0 | Y | AAIKDNRAV | 95.57 | AAVKDDRAV | 1.68 | AAVKDNRAV | 1.2 | AAIKNNRAV | 0.6 | | |
| NS1 | 962 | 0.37 | 9 | 4 | 0 | Y | AIKDNRAVH | 95.69 | AVKDDRAVH | 1.68 | AVKDNRAVH | 1.2 | AIKNNRAVH | 0.6 | | |
| NS1 | 963 | 0.35 | 8 | 4 | 0 | Y | IKDNRAVHA | 95.69 | VKDDRAVHA | 1.68 | VKDNRAVHA | 1.2 | IKNNRAVHA | 0.6 | | |
| NS1 | 964 | 0.26 | 7 | 3 | 0 | Y | KDNRAVHAD | 96.89 | KDDRAVHAD | 1.68 | KNNRAVHAD | 0.6 | | | | |
| NS1 | 965 | 0.26 | 7 | 3 | 0 | Y | DNRAVHADM | 96.89 | DDRAVHADM | 1.68 | NNRAVHADM | 0.6 | | | | |
| NS1 | 966 | 0.21 | 6 | 2 | 0 | Y | NRAVHADMG | 97.49 | DRAVHADMG | 1.68 | | | | | | |
| NS1 | 967 | 0.04 | 4 | 1 | 0 | Y | RAVHADMGY | 99.64 | | | | | | | | |
| NS1 | 968 | 0.04 | 4 | 1 | 0 | Y | AVHADMGYW | 99.64 | | | | | | | | |
| NS1 | 969 | 0.09 | 5 | 1 | 0 | Y | VHADMGYWI | 99.04 | | | | | | | | |
| NS1 | 970 | 0.07 | 3 | 1 | 0 | Y | HADMGYWIE | 99.28 | | | | | | | | |
| NS1 | 971 | 0.07 | 3 | 1 | 0 | Y | ADMGYWIES | 99.28 | | | | | | | | |
| NS1 | 972 | 0.24 | 6 | 3 | 0 | Y | DMGYWIESA | 97.01 | DMGYWIESR | 1.92 | DMGYWMESA | 0.6 | | | | |
| NS1 | 973 | 0.25 | 7 | 3 | 0 | Y | MGYWIESAL | 96.89 | MGYWIESRL | 1.92 | MGYWMESAL | 0.6 | | | | |
| NS1 | 974 | 0.25 | 7 | 3 | 0 | Y | GYWIESALN | 96.89 | GYWIESRLN | 1.92 | GYWMESALN | 0.6 | | | | |

FIG. 7-36

Species: DENV2 (9-mers)

| protein | block starting position | entropy | total

FIG. 7-37

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1000 | 0.19 | 5 | 2 | 0 | Y | WPKSHTLWS | 97.49 | WPRSHTLWS | 2.16 | | | | |
| NS1 | 1001 | 0.19 | 5 | 2 | 0 | Y | PKSHTLWSN | 97.49 | PRSHTLWSN | 2.16 | | | | |
| NS1 | 1002 | 0.22 | 5 | 2 | 0 | Y | KSHTLWSNG | 97.13 | RSHTLWSNG | 2.16 | | | | |
| NS1 | 1003 | 0.07 | 4 | 1 | 0 | Y | SHTLWSNGV | 99.28 | | | | | | |
| NS1 | 1004 | 0.07 | 4 | 1 | 0 | Y | HTLWSNGVL | 99.28 | | | | | | |
| NS1 | 1005 | 0.04 | 2 | 1 | 0 | Y | TLWSNGVLE | 99.52 | | | | | | |
| NS1 | 1006 | 0.04 | 2 | 1 | 0 | Y | LWSNGVLES | 99.52 | | | | | | |
| NS1 | 1007 | 0.04 | 2 | 1 | 0 | Y | WSNGVLESE | 99.52 | | | | | | |
| NS1 | 1008 | 0.04 | 2 | 1 | 0 | Y | SNGVLESEM | 99.52 | | | | | | |
| NS1 | 1009 | 0.25 | 3 | 2 | 0 | Y | NGVLESEMI | 96.29 | NGVLESEMV | 3.23 | | | | |
| NS1 | 1010 | 0.25 | 3 | 2 | 0 | Y | GVLESEMII | 96.29 | GVLESEMVI | 3.23 | | | | |
| NS1 | 1011 | 0.21 | 2 | 2 | 0 | Y | VLESEMIIP | 96.77 | VLESEMVIP | 3.23 | | | | |
| NS1 | 1012 | 0.21 | 2 | 2 | 0 | Y | LESEMIIPK | 96.77 | LESEMVIPK | 3.23 | | | | |
| NS1 | 1013 | 0.61 | 5 | 3 | 0 | Y | ESEMIIPKN | 89.46 | ESEMVIPKN | 6.71 | ESEMVIPKN | 3.23 | | |
| NS1 | 1018 | 1.36 | 8 | 4 | 0 | Y | IPKNFAGPV | 57.6 | IPKNLAGPV | 34.49 | IPKSFAGPV | 6.47 | IPKNIAGPV | 0.48 |
| NS1 | 1019 | 1.36 | 8 | 4 | 0 | Y | PKNFAGPVS | 57.6 | PKNLAGPVS | 34.49 | PKGFAGPVS | 6.47 | PKGFAGPYS | 0.48 |
| NS1 | 1020 | 1.37 | 9 | 5 | 0 | Y | KNFAGPVSQ | 57.6 | KNLAGPVSQ | 34.37 | KSFAGPVSQ | 6.47 | KGFAGPVSQ | 0.48 |
| NS1 | 1021 | 1.37 | 9 | 5 | 0 | Y | NFAGPVSQH | 57.6 | NLAGPVSQH | 34.37 | SFAGPVSQH | 6.47 | GFAGPVSQH | 0.48 |
| NS1 | 1022 | 1 | 5 | 2 | 0 | Y | FAGPVSQHN | 64.67 | LAGPVSQHN | 34.61 | | | | |
| NS1 | 1023 | 0.24 | 5 | 2 | 0 | Y | AGPVSQHNY | 96.77 | AGPVSQHNN | 2.4 | | | | |
| NS1 | 1024 | 0.24 | 5 | 2 | 0 | Y | GPVSQHNYR | 96.77 | GPVSQHNNR | 2.4 | | | | |
| NS1 | 1025 | 0.29 | 6 | 3 | 0 | Y | PVSQHNYRP | 96.29 | PVSQHNNRP | 2.4 | PYSQHNHRP | 0.6 | | |
| NS1 | 1026 | 0.29 | 6 | 3 | 0 | Y | VSQHNYRPG | 96.29 | VSQHNNRPG | 2.4 | VSQHNHRPG | 0.6 | | |
| NS1 | 1027 | 0.27 | 5 | 3 | 0 | Y | SQHNYRPGY | 96.41 | SQHNNRPGY | 2.4 | SQHNHRPGY | 0.6 | | |
| NS1 | 1028 | 0.69 | 8 | 5 | 0 | Y | QHNYRPGYH | 88.62 | QHNYRPGYH | 7.78 | QHNNRPGYH | 1.92 | QHNNRPGYY | 0.48 | QHNYRLGYH | 0.48 |

FIG. 7-38

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1029 | 0.67 | 7 | 5 | 0 | Y | HNYRPGYHT | 88.74 | HNYRPGYHT | 7.78 | HNNRPGYHT | 1.92 | HNNRPGYT | 0.48 |
| NS1 | 1030 | 0.67 | 7 | 5 | 0 | Y | NYRPGYHTQ | 88.74 | NYRPGYTQ | 7.78 | NYRLGYHTQ | 1.92 | NNRPGYYTQ | 0.48 |
| NS1 | 1032 | 1.45 | 8 | 4 | 0 | Y | RPGYHTQIA | 59.16 | RPGYHTQIA | 29.58 | RPGYHTQIT | 8.5 | | |
| NS1 | 1033 | 1.45 | 8 | 4 | 0 | Y | PGYHTQIAG | 59.16 | PGYHTQIAG | 29.58 | PGYHTQITG | 8.5 | | |
| NS1 | 1034 | 1.41 | 6 | 4 | 0 | Y | GYHTQIAGP | 59.28 | GYHTQIAGP | 29.94 | GYHTQITGP | 8.5 | | |
| NS1 | 1035 | 1.41 | 6 | 4 | 0 | Y | YHTQIAGPW | 59.28 | YHTQIAGPW | 29.94 | YHTQITGPW | 8.5 | | |
| NS1 | 1036 | 1.41 | 6 | 4 | 0 | Y | HTQIAGPWH | 59.28 | HTQIAGPWH | 29.94 | HTQITGPWH | 8.5 | | |
| NS1 | 1037 | 1.04 | 5 | 3 | 0 | Y | TQIAGPWHL | 67.78 | TQIAGPWHL | 29.94 | TQITGPWHL | 2.04 | | |
| NS1 | 1038 | 1.04 | 5 | 3 | 0 | Y | QIAGPWHLG | 67.78 | QIAGPWHLG | 29.94 | QITGPWHLG | 2.04 | | |
| NS1 | 1039 | 1.19 | 6 | 4 | 0 | Y | IAGPWHLGK | 65.27 | IAGPWHLGR | 29.94 | TAGPWHLGR | 2.51 | ITGPWHLGK | 2.04 |
| NS1 | 1040 | 0.33 | 4 | 3 | 0 | Y | AGPWHLGKL | 95.33 | AGPWHLGRL | 2.51 | TGPWHLGKL | 2.04 | | |
| NS1 | 1041 | 0.17 | 2 | 2 | 0 | Y | GPWHLGKLE | 97.49 | GPWHLGRLE | 2.4 | | | | |
| NS1 | 1042 | 0.21 | 5 | 2 | 0 | Y | PWHLGKLEM | 97.13 | PWHLGRLEM | 2.4 | | | | |
| NS1 | 1043 | 0.21 | 5 | 2 | 0 | Y | WHLGKLEMD | 97.13 | WHLGRLEMD | 2.4 | | | | |
| NS1 | 1044 | 0.21 | 5 | 2 | 0 | Y | HLGKLEMDF | 97.13 | HLGRLEMDF | 2.4 | | | | |
| NS1 | 1045 | 0.42 | 8 | 4 | 0 | Y | LGKLEMDFD | 94.49 | LGRLEMDFD | 2.4 | LGKLEMDFE | 1.68 | LGKLEMDFN | 0.84 |
| NS1 | 1046 | 0.94 | 9 | 5 | 0 | Y | GKLEMDFDF | 82.28 | GKLEMDFDL | 12.22 | GKLEMDFEF | 2.4 | GKLEMDFNF | 0.84 |
| NS1 | 1047 | 0.94 | 9 | 5 | 0 | Y | KLEMDFDFC | 82.28 | KLEMDFDLC | 12.22 | KLEMDFEFC | 2.4 | KLEMDFNFC | 0.84 |
| NS1 | 1048 | 1.6 | 9 | 5 | 0 | Y | LEMDFDFCE | 53.41 | LEMDFDLCE | 31.26 | LEMDFEFCE | 12.22 | LEMDFNFCD | 0.48 |
| NS1 | 1049 | 1.6 | 9 | 5 | 0 | Y | EMDFDFCEG | 53.41 | EMDFDLCEG | 31.26 | EMDFEFCEG | 12.22 | EMDFNFCDG | 0.48 |
| NS1 | 1050 | 1.6 | 9 | 5 | 0 | Y | MDFDFCEGT | 53.41 | MDFDLCEGT | 31.26 | MDFEFCEGT | 12.22 | MDFNFCDGT | 0.48 |
| NS1 | 1051 | 1.59 | 8 | 5 | 0 | Y | DFDFCEGTT | 53.41 | DFDLCEGTT | 31.26 | DFEFCEGTT | 12.22 | DFNFCEGTT | 0.6 |
| NS1 | 1052 | 1.59 | 8 | 5 | 0 | Y | FDFCEGTTV | 53.41 | FDLCEGTTV | 31.26 | FEFCEGTTV | 12.22 | FNFCEGTTV | 0.6 |
| NS1 | 1054 | 1.67 | 6 | 4 | 0 | Y | FCEGTTVVV | 55.69 | FCEGTTVIV | 22.63 | FCDGTTVVV | 12.46 | | |
| NS1 | 1055 | 1.2 | 5 | 3 | 0 | Y | CEGTTVVVT | 68.14 | CDGTTVVVT | 22.63 | | 8.86 | | 8.86 |

FIG. 7-39

Species: DENV2 (9-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1056 | 1.23 | 6 | 3 | 0 | Y | EGTTVWTE | 67.9 | DGTTVWTE | 22.63 | DGTTVWTE | 8.86 | | |

FIG. 7-40

Species: DENV2 (9-mers)

| protein | block starting position | block entropy | total peptides in block | #

FIG. 7-41

Species: DENV2 (9-mers)

| protein | block starting position | block entropy | total peptides in block | # peptides required to cover 99% of block | gap/X fraction | 99% of block covered w/ =>

FIG. 7-42

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 7-43

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1170 | — | 9 | 2 | 0 | Y | LITGNMSFR | 67.31 | LITGNMSFK | 31.74 | | | | |
| NS2A | 1171 | — | 9 | 2 | 0 | Y | ITGNMSFRD | 67.31 | ITGNMSFKD | 31.74 | | | | |
| NS2A | 1172 | — | 9 | 2 | 0 | Y | TGNMSFRDL | 67.31 | TGNMSFKDL | 31.74 | | | | |
| NS2A | 1173 | 0.99 | 8 | 2 | 0 | Y | GNMSFRDLG | 67.43 | GNMSFKDLG | 31.74 | | | | |
| NS2A | 1174 | 0.99 | 8 | 2 | 0 | Y | NMSFRDLGR | 67.43 | NMSFKDLGR | 31.74 | | | | |
| NS2A | 1175 | — | 9 | 2 | 0 | Y | MSFRDLGRV | 67.31 | MSFKDLGRV | 31.74 | | | | |
| NS2A | 1176 | 1.15 | 11 | 5 | 0 | Y | SFRDLGRVM | 66.71 | SFKDLGRVM | 29.94 | SFKDLGRVI | 1.68 | SFRDLGRVV | 0.48 | SFKDLGRVM | 0.36 |
| NS2A | 1178 | 1.14 | 10 | 5 | 0 | Y | RDLGRVVYM | 66.95 | KDLGRVIIM | 29.82 | KDLGRVIIM | 1.56 | RDLGRVVYM | 0.48 | KDLGRVVYM | 0.36 |
| NS2A | 1179 | 1.08 | 8 | 3 | 0 | Y | DLGRVVYMV | 67.19 | DLGRVIIMV | 30.3 | DLGRVVYMV | 1.8 | | | |
| NS2A | 1180 | 1.08 | 8 | 3 | 0 | Y | LGRVVYMVG | 67.19 | LGRVIIMVG | 30.3 | LGRVVYMVG | 1.8 | | | |
| NS2A | 1181 | 1.13 | 10 | 4 | 0 | Y | GRVVYMVGA | 66.95 | GRVIIMVGA | 29.94 | GRVVYMVGA | 1.8 | GRVVYMVGT | 0.36 | |
| NS2A | 1192 | 1.06 | 10 | 5 | 0 | Y | TDDIGMGVT | 76.17 | TDEMGMGVT | 19.28 | TDEMGMGVT | 2.04 | TDDIGMGIT | 1.08 | TDDIGIGVT | 0.6 |
| NS2A | 1193 | 0.36 | 7 | 4 | 0 | Y | DDIGMGVTY | 95.45 | DDEMGMGVTY | 2.04 | DDIGMGVTY | 1.08 | DDIGIGVTY | 0.72 | |
| NS2A | 1194 | 0.36 | 7 | 4 | 0 | Y | DIGMGVTYL | 95.45 | DIGMGITYL | 2.04 | DIGMGITYL | 1.08 | DIGVTYL | 0.72 | |
| NS2A | 1195 | 0.35 | 6 | 3 | 0 | Y | IGMGVTYLA | 95.57 | IGMGITYLA | 2.04 | IGMGITYLA | 1.08 | IGIGVTYLA | 0.72 | |
| NS2A | 1196 | 0.2 | 5 | 3 | 0 | Y | GMGVTYLAL | 97.6 | GMGITYLAL | 1.08 | GIGVTYLAL | 0.72 | | | |
| NS2A | 1197 | 0.2 | 5 | 3 | 0 | Y | MGVTYLALL | 97.6 | MGITYLALL | 1.08 | IGVTYLALL | 0.72 | | | |
| NS2A | 1198 | 0.1 | 3 | 2 | 0 | Y | GVTYLALLA | 98.8 | GITYLALLA | 1.08 | | | | |
| NS2A | 1199 | 0.11 | 4 | 2 | 0 | Y | VTYLALLAA | 98.68 | ITYLALLAA | 1.08 | | | | |
| NS2A | 1200 | 0.06 | 4 | 1 | 0 | Y | TYLALLAAF | 99.4 | | | | | | |
| NS2A | 1201 | 0.2 | 4 | 2 | 0 | Y | YLALLAAFK | 97.37 | YLALLAAFR | 2.16 | | | | |
| NS2A | 1202 | 0.22 | 5 | 2 | 0 | Y | LALLAAFKV | 97.13 | LALLAAFRV | 2.16 | | | | |
| NS2A | 1203 | 0.23 | 6 | 2 | 0 | Y | ALLAAFKVR | 97.13 | ALLAAFRVR | 2.04 | | | | |
| NS2A | 1204 | 0.23 | 6 | 2 | 0 | Y | LLAAFKVRP | 97.13 | LLAAFRVRP | 2.04 | | | | |
| NS2A | 1205 | 0.23 | 6 | 2 | 0 | Y | LAAFKVRPT | 97.13 | LAAFRVRPT | 2.04 | | | | |

FIG. 7-44

Species: DENV2 (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1206 | 0.24 | 7 | 2 | 0 | Y | AAFKVRPTF | 97.01 | AAFKVRPTF | 2.04 | | | | |
| NS2A | 1207 | 0.29 | 7 | 4 | 0 | Y | AFKVRPTFA | 96.53 | AFKVRPTFA | 2.04 | AYK

FIG. 7-45

Species: DENV2 (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides

FIG. 7-46

Species: DENV2 (9-mers)

| protein | block starting position | block entropy | total peptides in block | #

FIG. 7-47

Species: DENV2 (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 7-49

Species: DENV2 (9-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1376 | 0.03 | 3 | 1 | 0 | Y | PLVAGGLLT | 99.76 | | | | | | |
| NS2B | 1377 | 0.03 | 3 | 1 | 0 | Y | LVAGGLLTV | 99.76 | | | | | | |
| NS2B | 1378 | 0.03 | 3 | 1 | 0 | Y | VAGGLLTVC | 99.76 | | | | | | |
| NS2B | 1379 | 0.01 | 2 | 1 | 0 | Y | AGGLLTVCY | 99.88 | | | | | | |
| NS2B | 1380 | 0.01 | 2 | 1 | 0 | Y | GGLLTVCYV | 99.88 | | | | | | |
| NS2B | 1381 | 0.01 | 2 | 1 | 0 | Y | GLLTVCYVL | 99.88 | | | | | | |
| NS2B | 1382 | 0.01 | 2 | 1 | 0 | Y | LLTVCYVLT | 99.88 | | | | | | |
| NS2B | 1383 | 0 | 1 | 1 | 0 | Y | LTVCYVLTG | 100 | | | | | | |
| NS2B | 1384 | 0 | 1 | 1 | 0 | Y | TVCYVLTGR | 100 | | | | | | |
| NS2B | 1385 | 0.01 | 2 | 1 | 0 | Y | VCYVLTGRS | 99.88 | | | | | | |
| NS2B | 1386 | 0.01 | 2 | 1 | 0 | Y | CYVLTGRSA | 99.88 | | | | | | |
| NS2B | 1387 | 0.01 | 2 | 1 | 0 | Y | YVLTGRSAD | 99.88 | | | | | | |
| NS2B | 1388 | 0.01 | 2 | 1 | 0 | Y | VLTGRSADL | 99.88 | | | | | | |
| NS2B | 1389 | 0.01 | 2 | 1 | 0 | Y | LTGRSADLE | 99.88 | | | | | | |
| NS2B | 1390 | 0.01 | 2 | 1 | 0 | Y | TGRSADLEL | 99.88 | | | | | | |
| NS2B | 1391 | 0.01 | 3 | 1 | 0 | Y | GRSADLELE | 99.88 | | | | | | |
| NS2B | 1392 | 0.21 | 4 | 2 | 0 | Y | RSADLELER | 96.89 | RSADLELEK | 2.99 | | | | | |
| NS2B | 1393 | 0.23 | 4 | 2 | 0 | Y | SADLELERA | 96.65 | SADLELEKA | 2.99 | | | | | |
| NS2B | 1394 | 1.18 | 6 | 3 | 0 | Y | ADLELERAA | 58.08 | ADLELERAT | 38.68 | ADLELEKAA | 2.63 | | | |
| NS2B | 1395 | 1.27 | 9 | 5 | 0 | Y | DLELERAAD | 57.49 | DLELERATD | 38.44 | DLELEKAAE | 1.92 | DLELEKAAD | 0.72 | DLELERAAE | 0.6 |
| NS2B | 1396 | 1.27 | 9 | 5 | 0 | Y | LELERAADV | 57.49 | LELERATDV | 38.44 | LELEKAAEV | 1.92 | LELEKAADV | 0.72 | LELERAAEV | 0.6 |
| NS2B | 1404 | 0.68 | 9 | 5 | 0 | Y | VKWEDQAEI | 89.82 | VRWEEQAEI | 5.03 | VKWDDQAEI | 2.4 | VRWEEQAEI | 1.32 | VKWEEQAEI | 0.6 |
| NS2B | 1405 | 0.68 | 9 | 5 | 0 | Y | KWEDQAEIS | 89.82 | RWEEQAEIS | 5.03 | KWDDQAEIS | 2.4 | RWEDQAEIS | 1.32 | KWEEQAEIS | 0.6 |
| NS2B | 1406 | 0.57 | 8 | 3 | 0 | Y | WEDQAEISG | 91.02 | WEEQAEISG | 5.63 | WDDQAEISG | 2.4 | | | |
| NS2B | 1407 | 0.57 | 8 | 3 | 0 | Y | EDQAEISGS | 91.02 | EEQAEISGS | 5.63 | DDQAEISGS | 2.4 | | | |

FIG. 7-50

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1408 | 0.41 | 7 | 2 | 0 | Y | DQAEISGSS | 93.41 | EQAEISGSS | 5.63 | | | | |
| NS2B | 1409 | 0.08 | 5 | 1 | 0 | Y | QAEISGSSP | 99.16 | | | | | | |
| NS2B | 1410 | 0.08 | 6 | 1 | 0 | Y | AEISGSSPI | 99.28 | | | | | | |
| NS2B | 1411 | 0.08 | 6 | 1 | 0 | Y | EISGSSPIL | 99.28 | | | | | | |
| NS2B | 1412 | 0.08 | 6 | 1 | 0 | Y | ISGSSPILS | 99.28 | | | | | | |
| NS2B | 1413 | 0.22 | 7 | 2 | 0 | Y | SGSSPILSI | 97.25 | SGSSPILSV | 2.04 | | | | |
| NS2B | 1414 | 0.26 | 8 | 3 | 0 | Y | GSSPILSIT | 96.89 | GSSPILSYT | 2.04 | GSSPILSII | 0.36 | | |
| NS2B | 1415 | 0.24 | 7 | 2 | 0 | Y | SSPILSITI | 97.01 | SSPILSYTI | 2.04 | | | | |
| NS2B | 1416 | 0.46 | 7 | 3 | 0 | Y | SPILSITIS | 93.29 | SPILSITIA | 3.83 | SPILSYTIS | 2.04 | | |
| NS2B | 1417 | 0.46 | 6 | 3 | 0 | Y | PILSITISE | 93.29 | PILSITIAE | 3.83 | PILSYTISE | 2.04 | | |
| NS2B | 1418 | 0.45 | 4 | 3 | 0 | Y | ILSITISED | 93.41 | ILSITIAED | 3.83 | ILSYTISED | 2.04 | | |
| NS2B | 1419 | 0.41 | 4 | 3 | 0 | Y | LSITISEDG | 93.77 | LSITIAEDG | 3.83 | LSYTISEDG | 2.04 | | |
| NS2B | 1420 | 0.41 | 4 | 3 | 0 | Y | SITISEDGS | 93.77 | SITIAEDGS | 3.83 | SYTISEDGS | 2.04 | | |
| NS2B | 1421 | 0.41 | 4 | 3 | 0 | Y | ITISEDGSM | 93.77 | ITIAEDGSM | 3.83 | VTISEDGSM | 2.04 | | |
| NS2B | 1422 | 0.27 | 3 | 2 | 0 | Y | TISEDGSMS | 95.81 | TIAEDGSMS | 3.83 | | | | |
| NS2B | 1423 | 0.25 | 3 | 2 | 0 | Y | ISEDGSMSI | 96.05 | IAEDGSMSI | 3.83 | | | | |
| NS2B | 1424 | 0.28 | 4 | 2 | 0 | Y | SEDGSMSIK | 95.69 | AEDGSMSIK | 3.83 | | | | |
| NS2B | 1425 | 0.05 | 3 | 1 | 0 | Y | EDGSMSIKN | 99.52 | | | | | | |
| NS2B | 1426 | 0.05 | 3 | 1 | 0 | Y | DGSMSIKNE | 99.52 | | | | | | |
| NS2B | 1427 | 0.05 | 3 | 1 | 0 | Y | GSMSIKNEE | 99.52 | | | | | | |
| NS2B | 1428 | 0.05 | 3 | 1 | 0 | Y | SMSIKNEEE | 99.52 | | | | | | |
| NS2B | 1429 | 0.05 | 3 | 1 | 0 | Y | MSIKNEEEE | 99.52 | | | | | | |
| NS2B | 1430 | 0.45 | 5 | 2 | 0 | Y | SIKNEEEEQ | 91.86 | SIKNEEEEH | 7.43 | | | | |
| NS2B | 1431 | 0.58 | 6 | 3 | 0 | Y | IKNEEEEQT | 90.06 | IKNEEEEHT | 7.43 | IKNEEEEQI | 1.8 | | |
| NS2B | 1432 | 0.57 | 5 | 3 | 0 | Y | KNEEEEQTL | 90.18 | KNEEEEHTL | 7.43 | KNEEEEQIL | 1.8 | | |

FIG. 7-51

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1433 | 0.53 | 4 | 3 | 0 | Y | NEEEEQTLT | 90.54 | NEEEEHTLT | 7.43 | NEEEEQTLT | 1.8 | | |
| NS2B | 1434 | 0.53 | 4 | 3 | 0 | Y | EEEEQTLTI | 90.54 | EEEEHTLT

FIG. 7-52

Species: DENV2 (9-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1458 | 0.12 | 5 | 2 | 0.12 | Y | SIPITAAAW | 98.56 | SMPITAAAW | 0.6 | | | | | | |
| NS2B | 1459 | 0.15 | 6 | 2 | 0.12 | Y | IPITAAAWY | 98.32 | MPITAAAWY | 0.6 | | | | | | |
| NS2B | 1460 | 0.08 | 4 | 1 | 0 | Y | PITAAAWYL | 99.16 | | | | | | | | |
| NS2B | 1461 | 0.08 | 4 | 1 | 0 | Y | ITAAAW

FIG. 7-53

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1490 | 0.15 | 5 | 2 | 0 | Y | KAELEDGAY | 98.32 | RAELEDGAY | 1.08 | | | | |
| NS3 | 1491 | 0.06 | 4 | 1 | 0 | Y | AELEDGAYR | 99.4 | | | | | | |
| NS3 | 1492 | 0.06 | 4 | 1 | 0 | Y | ELEDGAYRI | 99.4 | | | | | | |
| NS3 | 1493 | 0.05 | 3 | 1 | 0 | Y | LEDGAYRIK | 99.52 | | | | | | |

FIG. 7-54

Species: DENV2 (9-mers)

| protein | block starting position | block entropy | total peptides in block | # peptides required to cover 99% of block | gap/X fraction | 99% of block covered w

FIG. 7-55

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1540 | 0.17 | 5 | 2 | 0 | Y | IEPSWADVK | 97.96 | IEPSWADVR | 1.2 | | |
| NS3 | 1541 | 0.15 | 3 | 2 | 0 | Y | EPSWADVKK | 98.2 | EPSWADVRK | 1.2 | | |
| NS3 | 1542 | 0.15 | 3 | 2 | 0 | Y | PSWADVKKD | 98.2 | PSWADVRKD | 1.2 | | |
| NS3 | 1543 | 0.15 | 3 | 2 | 0 | Y | SWADVKKDL | 98.2 | SWADVRKDL | 1.2 | | |
| NS3 | 1544 | 0.19 | 3 | 3 | 0 | Y | WADVKKDLI | 97.6 | WADVRKDLI | 1.2 | WADVKKDLV | 1.2 |
| NS3 | 1545 | 0.19 | 3 | 3 | 0 | Y | ADVKKDLIS | 97.6 | ADVRKDLIS | 1.2 | ADVKKDLVS | 1.2 |
| NS3 | 1546 | 0.19 | 3 | 3 | 0 | Y | DVKKDLISY | 97.6 | DVRKDLISY | 1.2 | DVRKDLISY | 1.2 |
| NS3 | 1547 | 0.2 | 4 | 3 | 0 | Y | VKKDLISYG | 97.49 | VRKDLISYG | 1.2 | VKKDLVSYG | 1.2 |
| NS3 | 1548 | 0.2 | 4 | 3 | 0 | Y | KKDLISYGG | 97.49 | RKDLISYGG | 1.2 | KKDLVSYGG | 1.2 |
| NS3 | 1549 | 0.11 | 3 | 2 | 0 | Y | KDLISYGGG | 98.68 | KDLVSYGGG | 1.2 | | |
| NS3 | 1550 | 0.11 | 3 | 2 | 0 | Y | DLISYGGGW | 98.68 | DLVSYGGGW | 1.2 | | |
| NS3 | 1551 | 0.11 | 3 | 2 | 0 | Y | LISYGGGWK | 98.68 | LVSYGGGWK | 1.2 | | |
| NS3 | 1552 | 0.11 | 3 | 2 | 0 | Y | ISYGGGWKL | 98.68 | VSYGGGWKL | 1.2 | | |
| NS3 | 1553 | 0.01 | 2 | 1 | 0 | Y | SYGGGWKLE | 99.88 | | | | |
| NS3 | 1554 | 0.01 | 2 | 1 | 0 | Y | YGGGWKLEG | 99.88 | | | | |
| NS3 | 1555 | 0.01 | 2 | 1 | 0 | Y | GGGWKLEGE | 99.88 | | | | |
| NS3 | 1556 | 0 | 1 | 1 | 0 | Y | GGWKLEGEW | 100 | | | | |
| NS3 | 1557 | 0 | 1 | 1 | 0 | Y | GWKLEGEWK | 100 | | | | |
| NS3 | 1558 | 0 | 1 | 1 | 0 | Y | WKLEGEWKE | 100 | | | | |
| NS3 | 1559 | 0 | 1 | 1 | 0 | Y | KLEGEWKEG | 100 | | | | |
| NS3 | 1560 | 0 | 1 | 1 | 0 | Y | LEGEWKEGE | 100 | | | | |
| NS3 | 1561 | 0.01 | 2 | 1 | 0 | Y | EGEWKEGEE | 99.88 | | | | |
| NS3 | 1562 | 0.01 | 2 | 1 | 0 | Y | GEWKEGEEV | 99.88 | | | | |
| NS3 | 1563 | 0.01 | 2 | 1 | 0 | Y | EWKEGEEVQ | 99.88 | | | | |
| NS3 | 1564 | 0.01 | 2 | 1 | 0 | Y | WKEGEEVQV | 99.88 | | | | |

FIG. 7-56

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 7-57

Species: DENV2 (9-mers)

| protein | block starting position | block entropy | total peptides in block | # peptides required to cover 99% of block | gap/X fraction | 99% of block covered w/ <= 5 peptides? | peptides required to cover

FIG. 7-58

Species: D

FIG. 7-59

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1650 | 0.35 | 8 | 3 | 0 | Y | NPEIEDDIF | 95.33 | NPDIEDDIF | 3.23 | NPEIEDHIF | 0.6 | | |
| NS3 | 1651 | 0.33 | 7 | 3 | 0 | Y | PEIEDDIFR | 95.45 | PDIEDDIFR | 3.23 | PEIEDHIFR | 0.6 | | |
| NS3 | 1652 | 0.33 | 7 | 3 | 0 | Y | EIEDDIFRK | 95.45 | DIEDDIFRK | 3.23 | EIEDHIFRK | 0.6 | | |
| NS3 | 1653 | 1.06 | 7 | 3 | 0 | Y | IEDDIFRKK | 62.87 | IEDDIFRKR | 35.81 | IEDHIFRKR | 0.6 | | |
| NS3 | 1654 | 1.17 | 8 | 4 | 0 | Y | EDDIFRKKR | 62.87 | EDDIFRKRR | 33.89 | EDDIFRKKK | 1.92 | EDHIFRKKR | 0.6 |
| NS3 | 1655 | 1.17 | 9 | 4 | 0 | Y | DDIFRKKRL | 62.87 | DDIFRKRRL | 33.89 | DDIFRKKRL | 1.8 | DHIFRKRRL | 0.6 |
| NS3 | 1656 | 1.13 | 7 | 3 | 0 | Y | DIFRKKRLT | 63.23 | DIFRKRRLT | 34.01 | DIFRKKRLT | 1.8 | | |
| NS3 | 1657 | 1.07 | 5 | 3 | 0 | Y | IFRKKRLTI | 63.35 | IFRKRRLTI | 34.61 | IFRKRRLTI | 1.8 | | |
| NS3 | 1658 | 1.06 | 4 | 3 | 0 | Y | FRKKRLTIM | 63.47 | FRKRRLTIM | 34.61 | FRKRKLTIM | 1.8 | | |
| NS3 | 1659 | 1.06 | 4 | 3 | 0 | Y | RKKRLTIMD | 63.47 | RKRRLTIMD | 34.61 | RKRKLTIMD | 1.8 | | |
| NS3 | 1660 | 1.06 | 4 | 3 | 0 | Y | KKRLTIMDL | 63.47 | KRRLTIMDL | 34.61 | KRKLTIMDL | 1.8 | | |
| NS3 | 1661 | 1.06 | 4 | 3 | 0 | Y | KRLTIMDLH | 63.47 | RRLTIMDLH | 34.61 | RKLTIMDLH | 1.8 | | |
| NS3 | 1662 | 0.14 | 3 | 2 | 0 | Y | RLTIMDLHP | 98.08 | KLTIMDLHP | 1.8 | | | | |
| NS3 | 1663 | 0.01 | 2 | 1 | 0 | Y | LTIMDLHPG | 99.88 | | | | | | |
| NS3 | 1664 | 0 | 1 | 1 | 0 | Y | TIMDLHPGA | 100 | | | | | | |
| NS3 | 1665 | 0 | 1 | 1 | 0 | Y | IMDLHPGAG | 100 | | | | | | |
| NS3 | 1666 | 0 | 1 | 1 | 0 | Y | MDLHPGAGK | 100 | | | | | | |
| NS3 | 1667 | 0.01 | 2 | 1 | 0 | Y | DLHPGAGKT | 99.88 | | | | | | |
| NS3 | 1668 | 0.01 | 2 | 1 | 0 | Y | LHPGAGKTK | 99.88 | | | | | | |
| NS3 | 1669 | 0.12 | 3 | 2 | 0 | Y | HPGAGKTKR | 98.44 | HPGAGKTKK | 1.44 | | | | |
| NS3 | 1670 | 0.12 | 3 | 2 | 0 | Y | PGAGKTKRY | 98.44 | PGAGKTKKY | 1.44 | | | | |
| NS3 | 1671 | 0.12 | 3 | 2 | 0 | Y | GAGKTKRYL | 98.44 | GAGKTKKYL | 1.44 | | | | |
| NS3 | 1672 | 0.12 | 3 | 2 | 0 | Y | AGKTKRYLP | 98.44 | AGKTKKYLP | 1.44 | | | | |
| NS3 | 1673 | 0.12 | 3 | 2 | 0 | Y | GKTKRYLPA | 98.44 | GKTKKYLPA | 1.44 | | | | |
| NS3 | 1674 | 0.12 | 3 | 2 | 0 | Y | KTKRYLPAI | 98.44 | KTKKYLPAI | 1.44 | | | | |

FIG. 7-60

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | fr

FIG. 7-61

Species: DENV2 (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1700 | 0.01 | 2 | 1 | 0 | Y | RVVAA

FIG. 7-62

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block |

FIG. 7-63

Species: DENV2 (9-mers)

| protein | block starting position | block entropy | total peptides in block | # peptides required to cover 99% of block | gap/X f

FIG. 7-64

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS3 | 1775 | 0 | 1 | 1 | 0 | Y | ISTRVEMGE | 100 |
| NS3 | 1776 | 0 | 1 | 1 | 0 | Y | STRVEMGEA | 100 |
| NS3 | 1777 | 0 | 1 | 1 | 0 | Y | TRVEMGEAA | 100 |
| NS3 | 1778 | 0 | 1 | 1 | 0 | Y | RVEMGEAAG | 100 |
| NS3 | 1779 | 0 | 1 | 1 | 0 | Y | VEMGEAAGI | 100 |
| NS3 | 1780 | 0 | 1 | 1 | 0 | Y | EMGEAAGIF | 100 |
| NS3 | 1781 | 0 | 1 | 1 | 0 | Y | MGEAAGIFM | 100 |
| NS3 | 1782 | 0 | 1 | 1 | 0 | Y | GEAAGIFMT | 100 |
| NS3 | 1783 | 0 | 1 | 1 | 0 | Y | EAAGIFMTA | 100 |
| NS3 | 1784 | 0 | 1 | 1 | 0 | Y | AAGIFMTAT | 100 |
| NS3 | 1785 | 0 | 1 | 1 | 0 | Y | AGIFMTATP | 100 |
| NS3 | 1786 | 0 | 1 | 1 | 0 | Y | GIFMTATPP | 100 |
| NS3 | 1787 | 0 | 1 | 1 | 0 | Y | IFMTATPPG | 100 |
| NS3 | 1788 | 0.02 | 2 | 1 | 0 | Y | FMTATPPGS | 99.76 |
| NS3 | 1789 | 0.07 | 3 | 1 | 0 | Y | MTATPPGSR | 99.28 |
| NS3 | 1790 | 0.07 | 3 | 1 | 0 | Y | TATPPGSRD | 99.28 |
| NS3 | 1791 | 0.09 | 4 | 1 | 0 | Y | ATPPGSRDP | 99.04 |
| NS3 | 1792 | 0.09 | 4 | 1 | 0 | Y | TPPGSRDPF | 99.04 |
| NS3 | 1793 | 0.09 | 4 | 1 | 0 | Y | PPGSRDPFP | 99.04 |
| NS3 | 1794 | 0.09 | 4 | 1 | 0 | Y | PGSRDPFPQ | 99.04 |
| NS3 | 1795 | 0.09 | 4 | 1 | 0 | Y | GSRDPFPQS | 99.04 |
| NS3 | 1796 | 0.09 | 4 | 1 | 0 | Y | SRDPFPQSN | 99.28 |
| NS3 | 1797 | 0.07 | 3 | 1 | 0 | Y | RDPFPQSNA | 99.76 |
| NS3 | 1798 | 0.02 | 2 | 1 | 0 | Y | DPFPQSNAP | 99.76 |
| NS3 | 1799 | 0.02 | 2 | 1 | 0 | Y | PFPQSNAPI | 99.76 |

FIG. 7-65

Species: DENV2 (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block |

FIG. 7-66

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1825 | 0.26 | 11 | 4 | 0 | Y | WTDFKGKT | 97.01 | WITNFKGKT | 1.68 | WITDFKGKT | 0.24 | WITNFEGKT | 0.24 |
| NS3 | 1826 | 0.26 | 11 | 4 | 0 | Y | VTDFKGKTV | 97.01 | ITNFKGKTV | 1.68 | ITNFEGKTV | 0.24 | ITDFKGKTV | 0.24 |
| NS3 | 1827 | 0.22 | 8 | 2 | 0 | Y | TDFKGKTVW | 97.37 | TNFKGKTVW | 1.8 | | | | |
| NS3 | 1828 | 0.21 | 7 | 2 | 0 | Y | DFKGKTVWF | 97.49 | NFKGKTVWF | 1.8 | | | | |
| NS3 | 1829 | 0.07 | 5 | 1 | 0 | Y | FKGKTVWFV | 99.28 | | | | | | |
| NS3 | 1830 | 0.06 | 4 | 1 | 0 | Y | KGKTVWFVP | 99.4 | | | | | | |
| NS3 | 1831 | 0 | 1 | 1 | 0 | Y | GKTVWFVPS | 100 | | | |

FIG. 7-67

Species: DENV2 (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99%

FIG. 7-68

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1880 | 0.01 | 2 | 1 | 0 | Y | VTT

FIG. 7-69

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1905 | 0.12 | 6 | 2 | 0 | Y | KPVILTDGE | 98.8 | KPVILTEGE | 0.36 | | | | |
| NS3 | 1906 | 0.12 | 6 | 2 | 0 | Y | PVILTDGEE | 98.8 | PVILTEGEE | 0.36 | | | | |
| NS3 | 1907 | 0.12 | 6 | 2 | 0 | Y | VILTDGEER | 98.8 | VILTEGEER | 0.36 | | | | |
| NS3 | 1908 | 0.12 | 6 | 2 | 0 | Y | ILTDGEERV | 98.8 | ILTEGEERV | 0.36 | | | | |
| NS3 | 1909 | 0.24 | 8 | 3 | 0 | Y | LTDGEERVI | 97.25 | LTDGEERVV | 1.56 | LTHGEERVI | 0.24 | | |

FIG. 7-70

Species: DENV2 (9-mers)

| protein | block starting position | block entropy | total pe

FIG. 7-71

Species: DENV2 (9-mers)

| protein | block starting position | block entropy | total peptides in block | # peptides required to cover 99

FIG. 7-72

Species: DENV2 (9-mers)

| protein | block starting position | block entropy | total

FIG. 7-73

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2005 | 0.19 | 5 | 2 | 0 | Y | RKTFVDLMR | 97.6 | RKTFVDLMK | 1

FIG. 7-74

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2030 | 1.08 | 9 | 4 | 0.12 | Y | INYADRRWC | 67.9 | INYADRKWC | 29.58 | INYTDRKWC | 1.08 | ISYADRKWC | 0.72 |
| NS3 | 2031 | 1.07 | 8 | 4 | 0.12 | Y | NYADRRWCF | 68.02 | NYADRKWCF | 29.58 | NYTDRKWCF | 1.08 | SYADRKWCF | 0.72 |
| NS3 | 2032 | — | 6 | 3 | 0.12 | Y | YADRRWCFD | 68.14 | YADRKWCFD | 30.3 | YTDRKWCFD | 1.08 | | |
| NS3 | 2033 | — | 6 | 3 | 0.12 | Y | ADRRWCFDG | 68.14 | ADRKWCFDG | 30.3 | TDRKWCFDG | 1.08 | | |
| NS3 | 2034 | 1.54 | 5 | 4 | 0 | Y | DRRWCFDGI | 52.46 | DRKWCFDGI | 31.5 | DRRWCFDGV | 13.53 | DRRWCFDGT | 2.4 |
| NS3 | 2035 | 1.71 | 8 | 5 | 0 | Y | RRWCFDGIK | 51.74 | RKWCFDGIK | 29.58 | RRWCFDGVK | 13.53 | RRWCFDGTR | 2.4 |
| NS3 | 2036 | 1.71 | 8 | 5 | 0 | Y | RWCFDGIKN | 51.74 | KWCFDGIKN | 29.58 | RWCFDGVKN | 13.53 | RWCFDGTRN | 2.4 |
| NS3 | 2037 | 0.93 | 7 | 4 | 0 | Y | WCFDGIKNN | 81.32 | WCFDGIKNN | 13.41 | WCFDGVKNN | 2.51 | WCFDGTRNN | 2.4 |
| NS3 | 2038 | 0.93 | 7 | 4 | 0 | Y | CFDGIKNNQ | 81.32 | CFDGVKNNQ | 13.41 | CFDGIRNNQ | 2.51 | CFDGTRNNQ | 2.4 |
| NS3 | 2039 | 0.93 | 7 | 4 | 0 | Y | FDGIKNNQI | 81.32 | FDGVKNNQI | 13.41 | FDGIRNNQI | 2.51 | FDGTRNNQI | 2.4 |
| NS3 | 2040 | 0.93 | 7 | 4 | 0 | Y | DGIKNNQIL | 81.32 | DGVKNNQIL | 13.41 | DGIRNNQIL | 2.51 | DGTRNNQIL | 2.4 |
| NS3 | 2041 | 0.93 | 7 | 4 | 0 | Y | GIKNNQILE | 81.32 | GVKNNQILE | 13.41 | GIRNNQILE | 2.51 | GTRNNQILE | 2.4 |
| NS3 | 2042 | 0.93 | 7 | 4 | 0 | Y | IKNNQILEE | 81.32 | VKNNQILEE | 13.41 | IRNNQILEE | 2.51 | TRNNQILEE | 2.4 |
| NS3 | 2043 | 0.31 | 4 | 2 | 0 | Y | KNNQILEEN | 94.85 | RNNQILEEN | 4.91 | | | | |
| NS3 | 2044 | 0.85 | 4 | 2 | 0 | Y | NNQILEENV | 75.57 | NNQILEENM | 23.71 | | | | |
| NS3 | 2045 | 0.86 | 5 | 2 | 0 | Y | NQILEENVE | 75.57 | NQILEENME | 23.59 | | | | |
| NS3 | 2046 | 0.85 | 4 | 2 | 0 | Y | QILEENVEV | 75.69 | QILEENMEV | 23.59 | | | | |
| NS3 | 2047 | 0.85 | 4 | 2 | 0 | Y | ILEENVEVE | 75.69 | ILEENMEVE | 23.59 | | | | |
| NS3 | 2048 | 0.96 | 7 | 3 | 0 | Y | LEENVEVEI | 75.57 | LEENMEVEI | 21.92 | LEENMEVEV | 1.68 | | |
| NS3 | 2049 | 0.96 | 7 | 3 | 0 | Y | EENVEVEIW | 75.57 | EENMEVEIW | 21.92 | EENMEVEVW | 1.68 | | |
| NS3 | 2050 | 0.98 | 8 | 4 | 0 | Y | ENVEVEIWT | 75.33 | ENMEVEIWT | 21.92 | ENMEVEVWT | 1.68 | ENIEVEIWT | 0.36 |
| NS3 | 2051 | 0.98 | 8 | 4 | 0 | Y | NVEVEIWTK | 75.33 | NMEVEIWTK | 21.92 | NMEVEVWTK | 1.68 | NIEVEIWTK | 0.36 |
| NS3 | 2052 | 0.99 | 9 | 4 | 0 | Y | VEVEIWTKE | 75.21 | MEVEIWTKE | 21.92 | MEVEVWTKE | 1.68 | IEVEIWTKE | 0.36 |
| NS3 | 2053 | 0.19 | 5 | 2 | 0 | Y | EVEIWTKEG | 97.49 | EVEVWTKEG | 2.04 | | | | |
| NS3 | 2054 | 0.19 | 5 | 2 | 0 | Y | VEIWTKEGE | 97.49 | VEVWTKEGE | 2.04 | | | | |

FIG. 7-75

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 7-76

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2080 | 0.04 | 3 | 1 | 0.24 | Y | LALKEFKEF | 99.4 | | | | | | |
| NS3 | 2081 | 0.04 | 3 | 1 | 0.24 | Y | ALKEFKEFA | 99.4 | | | | | | |
| NS3 | 2082 | 0.01 | 2 | 1 | 0.24 | Y | LKEFKEFAA | 99.64 | | | | | | |
| NS3 | 2083 | 0.01 | 2 | 1 | 0.24 | Y | KEFKEFAAG | 99.64 | | | | | | |
| NS3 | 2084 | 0.01 | 2 | 1 | 0.24 | Y | EFKEFAAGR | 99.64 | | | | | | |
| NS3 | 2085 | 0.01 | 3 | 1 | 0.24 | Y | FKEFAAGRK | 99.64 | | | | | | |
| NS3 | 2086 | 0.03 | 3 | 1 | 0 | Y | KEFAAGRKS | 99.76 | | | | | | |
| NS3 | 2087 | 0.03 | 3 | 1 | 0 | Y | EFAAGRKSL | 99.76 | | | | | | |
| NS3 | 2088 | 0.16 | 4 | 2 | 0 | Y | FAAGRKSLT | 97.96 | FAAGRKSLA | 1.8 | | | | |
| NS3 | 2089 | 0.16 | 4 | 2 | 0 | Y | AAGRKSLTL | 97.96 | AAGRKSLAL | 1.8 | | | | |
| NS3 | 2090 | 0.27 | 5 | 3 | 0 | Y | AGRKSLTLN | 96.41 | AGRKSLALN | 1.8 | AGRKSLTLS | 1.56 | | |
| NS3 | 2091 | 0.27 | 5 | 3 | 0 | Y | GRKSLTLNL | 96.41 | GRKSLALNL | 1.8 | GRKSLTLSL | 1.56 | | |
| NS3 | 2092 | 0.27 | 5 | 3 | 0 | Y | RKSLTLNLI | 96.41 | RKSLALNLI | 1.8 | RKSLTLSLI | 1.56 | | |
| NS3 | 2093 | 0.27 | 5 | 3 | 0 | Y | KSLTLNLIT | 96.41 | KSLALNLIT | 1.8 | KSLTLSLIT | 1.56 | | |
| NS3 | 2094 | 0.27 | 5 | 3 | 0 | Y | SLTLNLITE | 96.41 | SLALNLITE | 1.8 | SLTLSLITE | 1.56 | | |
| NS3 | 2095 | 0.27 | 5 | 3 | 0 | Y | LTLNLITEM | 96.53 | LALNLITEM | 1.8 | LTLSLITEM | 1.56 | | |
| NS3 | 2096 | 0.27 | 5 | 3 | 0 | Y | TLNLITEMG | 96.53 | ALNLITEMG | 1.8 | TLSLITEMG | 1.32 | | |
| NS3 | 2097 | 0.18 | 5 | 2 | 0 | Y | LNLITEMGR | 97.84 | LSLITEMGR | 1.32 | | | | |
| NS3 | 2098 | 0.18 | 5 | 2 | 0 | Y | NLITEMGRL | 97.84 | SLITEMGRL | 1.32 | | | | |
| NS4A | 2099 | 0.08 | 4 | 1 | 0 | Y | LITEMGRLP | 99.16 | | | | | | |
| NS4A | 2100 | 0.07 | 3 | 1 | 0 | Y | ITEMGRLPT | 99.28 | | | | | | |
| NS4A | 2101 | 0.08 | 4 | 1 | 0 | Y | TEMGRLPTF | 99.16 | | | | | | |
| NS4A | 2102 | 0.08 | 4 | 1 | 0 | Y | EMGRLPTFM | 99.16 | | | | | | |
| NS4A | 2103 | 0.08 | 4 | 1 | 0 | Y | MGRLPTFMT | 99.16 | | | | | | |
| NS4A | 2104 | 0.07 | 4 | 1 | 0 | Y | GRLPTFMTQ | 99.28 | | | | | | |

FIG. 7-77

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2105 | 0.07 | 4 | 1 | 0 | Y | RLPTFMTQK | 99.28 | | | | | | |
| NS4A | 2106 | 0.93 | 4 | 2 | 0 | Y | LPTFMTQKA | 68.02 | LPTFMTQKT | 31.74 | | | | |
| NS4A | 2107 | 0.96 | 5 | 2 | 0 | Y | PTFMTQKAR | 67.66 | PTFMTQKTR | 31.74 | | | | |
| NS4A | 2108 | 1.63 | 6 | 3 | 0 | Y | TFMTQKARN | 37.25 | TFMTQKTRD | 31.74 | TFMTQKARD | 30.42 | | |
| NS4A | 2109 | 1.63 | 6 | 3 | 0 | Y | FMTQKARNA | 37.25 | FMTQKTRDA | 31.74 | FMTQKARDA | 30.42 | | |
| NS4A | 2110 | 1.62 | 5 | 3 | 0 | Y | MTQKARNAL | 37.25 | MTQKTRDAL | 31.74 | MTQKARDAL | 30.54 | | |
| NS4A | 2111 | 1.62 | 5 | 3 | 0 | Y | TQKARNALD | 37.25 | TQKTRDALD | 31.74 | TQKARDALD | 30.54 | | |
| NS4A | 2112 | 1.62 | 5 | 3 | 0 | Y | QKARNALDN | 37.25 | QKTRDALDN | 31.74 | QKARDALDN | 30.54 | | |
| NS4A | 2113 | 1.62 | 5 | 3 | 0 | Y | KARNALDNL | 37.25 | KTRDALDNL | 31.74 | KARDALDNL | 30.54 | | |
| NS4A | 2114 | 1.63 | 6 | 3 | 0 | Y | ARNALDNLA | 37.25 | TRDALDNLA | 31.74 | ARDALDNLA | 30.42 | | |
| NS4A | 2115 | 1.02 | 6 | 2 | 0 | Y | RDALDNLAV | 62.04 | RNALDNLAV | 37.25 | | | | |
| NS4A | 2116 | 0.98 | 4 | 2 | 0 | Y | DALDNLAVL | 62.04 | NALDNLAVL | 37.72 | | | | |
| NS4A | 2117 | 0.04 | 4 | 1 | 0 | Y | ALDNLAVLH | 99.64 | | | | | | |
| NS4A | 2118 | 0.16 | 5 | 2 | 0 | Y | LDNLAVLHT | 97.96 | LDNLAVLHS | 1.68 | | | | |
| NS4A | 2119 | 0.16 | 5 | 2 | 0 | Y | DNLAVLHTA | 97.96 | DNLAVLHSA | 1.68 | | | | |
| NS4A | 2120 | 0.16 | 5 | 2 | 0 | Y | NLAVLHTAE | 97.96 | NLAVLHSAE | 1.68 | | | | |
| NS4A | 2121 | 0.77 | 8 | 3 | 0 | Y | LAVLHTAEA | 84.07 | LAVLHTAEV | 13.53 | LAVLHSAEM | 1.56 | | |
| NS4A | 2122 | 0.77 | 8 | 3 | 0 | Y | AVLHTAEAG | 84.07 | AVLHTAEVG | 13.53 | AVLHSAEMG | 1.56 | | |
| NS4A | 2123 | 0.76 | 7 | 3 | 0 | Y | VLHTAEAGG | 84.19 | VLHTAEVGG | 13.53 | VLHSAEMGG | 1.56 | | |
| NS4A | 2124 | 1.07 | 9 | 5 | 0 | Y | LHTAEAGGR | 80 | LHTAEVGGR | 11.74 | LHTAEAGGK | 4.31 | LHTAEVGGK | 1.8 | LHSAEMGGR | 1.56 |
| NS4A | 2125 | 1.07 | 9 | 5 | 0 | Y | HTAEAGGRA | 80 | HTAEVGGRA | 11.74 | HTAEAGGKA | 4.31 | HTAEVGGKA | 1.8 | HSAEMGGRA | 1.56 |
| NS4A | 2126 | 1.09 | 10 | 5 | 0 | Y | TAEAGGRAY | 80 | TAEVGGRAY | 11.38 | TAEAGGRAY | 4.31 | TAEVGGKAY | 1.8 | SAEMGGRAY | 1.56 |
| NS4A | 2130 | 0.45 | 6 | 3 | 0 | Y | GGRAYNHAL | 93.17 | GGKAYNHAL | 4.67 | GGKAYTHAL | 1.56 | | |
| NS4A | 2131 | 0.49 | 8 | 4 | 0 | Y | GRAYNHALS | 92.69 | GRAYNHALS | 4.67 | GKAYTHALS | 1.56 | GRAHNHALS | 0.36 | | |
| NS4A | 2132 | 0.49 | 8 | 4 | 0 | Y | RAYNHALSE | 92.69 | KAYNHALSE | 4.67 | KAYTHALSE | 1.56 | RAHNHALSE | 0.36 | | |

FIG. 7-78

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2133 | 0.22 | 6 | 2 | 0 | Y | AYNHALSEL | 97.37 | AYTHALSEL | 1.68 | | | | |
| NS4A | 2134 | 0.22 | 6 | 2 | 0 | Y | YNHALSELP | 97.37 | YTHALSELP | 1.68 | | | | |
| NS

FIG. 7-79

Species: DENV2 (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | pept

FIG. 7-80

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4A | 2191 | 0.01 | 2 | 1 | 0 | Y | AQIQPHWIA | 99.88 | | |
| NS4A | 2192 | 0.01 | 2 | 1 | 0 | Y | QIQPHWIAA | 99.88 | | |
| NS4A | 2193 | 0 | 1 | 1 | 0 | Y | IQPHWIAAS | 100 | | |
| NS4A | 2194 | 0 | 1 | 1 | 0 | Y | QPHWIAASI | 100 | | |
| NS4A | 2195 | 0 | 1 | 1 | 0 | Y | PHWIAASII | 100 | | |
| NS4A | 2196 | 0 | 1 | 1 | 0 | Y | HWIAASIIL | 100 | | |
| NS4A | 2197 | 0.07 | 2 | 1 | 0 | Y | WIAASIILE | 99.16 | | |
| NS4A | 2198 | 0.07 | 2 | 1 | 0 | Y | IAASIILEF | 99.16 | | |
| NS4A | 2199 | 0.07 | 2 | 1 | 0 | Y | AASIILEFF | 99.16 | | |
| NS4A | 2200 | 0.07 | 2 | 1 | 0 | Y | ASIILEFFL | 99.16 | | |
| NS4A | 2201 | 0.1 | 4 | 2 | 0 | Y | SIILEFFLI | 98.92 | SIILVFFLI | 0.84 |
| NS4A | 2202 | 0.11 | 5 | 2 | 0 | Y | IILEFFLIV | 98.8 | IILVFFLIV | 0.84 |
| NS4A | 2203 | 0.11 | 5 | 2 | 0 | Y | ILEFFLIVL | 98.8 | ILVFFLIVL | 0.84 |
| NS4A | 2204 | 0.11 | 5 | 2 | 0 | Y | LEFFLIVLL | 98.8 | LVFFLIVLL | 0.84 |
| NS4A | 2205 | 0.11 | 5 | 2 | 0 | Y | EFFLIVLLI | 98.8 | VFFLIVLLI | 0.84 |
| NS4A | 2206 | 0.04 | 4 | 1 | 0 | Y | FFLIVLLIP | 99.64 | | |
| NS4A | 2207 | 0.04 | 4 | 1 | 0 | Y | FLIVLLIPE | 99.64 | | |
| NS4A | 2208 | 0.04 | 4 | 1 | 0 | Y | LIVLLIPEP | 99.64 | | |
| NS4A | 2209 | 0.04 | 4 | 1 | 0 | Y | IVLLIPEPE | 99.64 | | |
| NS4A | 2210 | 0.01 | 2 | 1 | 0 | Y | VLLIPEPEK | 99.88 | | |
| NS4A | 2211 | 0 | 1 | 1 | 0 | Y | LLIPEPEKQ | 100 | | |
| NS4A | 2212 | 0 | 1 | 1 | 0 | Y | LIPEPEKQR | 100 | | |
| NS4A | 2213 | 0 | 1 | 1 | 0 | Y | IPEPEKQRT | 100 | | |
| NS4A | 2214 | 0 | 1 | 1 | 0 | Y | PEPEKQRTP | 100 | | |
| NS4A | 2215 | 0 | 1 | 1 | 0 | Y | EPEKQRTPQ | 100 | | |

FIG. 7-81

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | fr

FIG. 7-82

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2241 | 0.01 | 2 | 1 | 0 | Y | TMANEMGFL | 99.88 | | | | | | |
| 2K | 2242 | 0.01 | 2 | 1 | 0 | Y | MANEMGFLE | 99.88 | | | | | | |
| 2K | 2243 | 0.01 | 2 | 1 | 0 | Y | ANEMGFLEK | 99.88 | | | | | | |
| 2K | 2244 | 0 | 1 | 1 | 0 | Y | NEMGFLEKT | 100 | | | | | | |
| 2K | 2245 | 0 | 1 | 1 | 0 | Y | EMGFLEKTK | 100 | | | | | | |
| NS4B | 2246 | 0.04 | 2 | 1 | 0 | Y | MGFLEKTKK | 99.52 | | | | | | |
| NS4B | 2247 | 0.04 | 2 | 1 | 0 | Y | GFLEKTKKD | 99.52 | | | | | | |
| NS4B | 2248 | 0.42 | 4 | 2 | 0 | Y | FLEKTKKDL | 92.22 | FLEKTKKDF | 7.31 | | | | |
| NS4B | 2249 | 0.42 | 4 | 2 | 0 | Y | LEKTKKDLG | 92.22 | LEKTKKDFG | 7.31 | | | | |
| NS4B | 2250 | 0.7 | 6 | 3 | 0 | Y | EKTKKDLGL | 87.43 | EKTKKDFGL | 7.19 | EKTKKDLGF | 4.79 | | |
| NS4B | 2251 | 0.7 | 6 | 3 | 0 | Y | KTKKDLGLG | 87.43 | KTKKDFGLG | 7.19 | KTKKDLGFG | 4.79 | | |
| NS4B | 2265 | 1.49 | 9 | 5 | 0.12 | Y | ESESNILDI | 47.78 | QPESNILDI | 42.4 | EPESNILDI | 7.31 | QPEINILDI | 1.08 |
| NS4B | 2266 | 1.19 | 8 | 4 | 0.12 | Y | PESNILDID | 49.7 | SESNILDID | 47.78 | PEINILDID | 1.08 | HESNILDID | 0.48 |
| NS4B | 2267 | 0.15 | 4 | 2 | 0.12 | Y | ESNILDIDL | 98.08 | EINILDIDL | 1.32 | | | QHESNILDI | 0.48 |
| NS4B | 2268 | 0.16 | 4 | 2 | 0 | Y | SNILDIDLR | 98.08 | INILDIDLR | 1.44 | | | | |
| NS4B | 2269 | 0 | 1 | 1 | 0 | Y | NILDIDLRP | 100 | | | | | | |
| NS4B | 2270 | 0 | 1 | 1 | 0 | Y | ILDIDLRPA | 100 | | | | | | |
| NS4B | 2271 | 0 | 1 | 1 | 0 | Y | LDIDLRPAS | 100 | | | | | | |
| NS4B | 2272 | 0 | 1 | 1 | 0 | Y | DIDLRPASA | 100 | | | | | | |
| NS4B | 2273 | 0 | 1 | 1 | 0 | Y | IDLRPASAW | 100 | | | | | | |
| NS4B | 2274 | 0 | 1 | 1 | 0 | Y | DLRPASAWT | 100 | | | | | | |
| NS4B | 2275 | 0 | 1 | 1 | 0 | Y | LRPASAWTL | 100 | | | | | | |
| NS4B | 2276 | 0 | 1 | 1 | 0 | Y | RPASAWTLY | 100 | | | | | | |
| NS4B | 2277 | 0 | 1 | 1 | 0 | Y | PASAWTLYA | 100 | | | | | | |
| NS4B | 2278 | 0 | 1 | 1 | 0 | Y | ASAWTLYAV | 100 | | | | | | |

FIG. 7-83

Species: DENV2 (9-mers)

| protein | block starting position | block entropy | total peptides in block | # peptides required to cover 99% of block | g

FIG. 7-84

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2304 | 0.09 | 4 | 1 | 0 | Y | VNVSLTAIA | 99.04 | | |
| NS4B | 2305 | 0.09 | 4 | 1 | 0 | Y | NVSLTAIAN | 99.04 | | |
| NS4B | 2306 | 0.09 | 4 | 1 | 0 | Y | VSLTAIANQ | 99.04 | | |
| NS4B | 2307 | 0.02 | 2 | 1 | 0 | Y | SLTAIANQA | 99.76 | | |
| NS4B | 2308 | 0.02 | 2 | 1 | 0 | Y | LTAIANQAT | 99.76 | | |
| NS4B | 2309 | 0.02 | 2 | 1 | 0 | Y | TAIANQATV | 99.76 | | |
| NS4B | 2310 | 0.02 | 2 | 1 | 0 | Y | AIANQATVL | 99.64 | | |
| NS4B | 2311 | 0.04 | 3 | 1 | 0 | Y | IANQATVLM | 99.88 | | |
| NS4B | 2312 | 0.01 | 2 | 1 | 0 | Y | ANQATVLMG | 99.88 | | |
| NS4B | 2313 | 0.01 | 2 | 1 | 0 | Y | NQATVLMGL | 99.88 | | |
| NS4B | 2314 | 0.01 | 2 | 1 | 0 | Y | QATVLMGLG | 99.82 | | |
| NS4B | 2315 | 0.48 | 3 | 2 | 0 | Y | ATVLMGLGK | 89.82 | ATVLMGLGR | 10.06 |
| NS4B | 2316 | 0.48 | 3 | 2 | 0 | Y | TVLMGLGKG | 89.82 | TVLMGLGRG | 10.06 |
| NS4B | 2317 | 0.48 | 3 | 2 | 0 | Y | VLMGLGKGW | 89.82 | VLMGLGRGW | 10.06 |
| NS4B | 2318 | 0.5 | 4 | 2 | 0 | Y | LMGLGKGWP | 89.7 | LMGLGRGWP | 10.06 |
| NS4B | 2319 | 0.5 | 4 | 2 | 0 | Y | MGLGKGWPL | 89.7 | MGLGRGWPL | 10.06 |
| NS4B | 2320 | 0.48 | 3 | 2 | 0 | Y | GLGKGWPLS | 89.82 | GLGRGWPLS | 10.06 |
| NS4B | 2321 | 0.48 | 3 | 2 | 0 | Y | LGKGWPLSK | 89.82 | LGRGWPLSK | 10.06 |
| NS4B | 2322 | 0.5 | 4 | 2 | 0 | Y | GKGWPLSKM | 89.7 | GRGWPLSKM | 10.06 |
| NS4B | 2323 | 0.5 | 4 | 2 | 0 | Y | KGWPLSKMD | 89.7 | RGWPLSKMD | 10.06 |
| NS4B | 2324 | 0.05 | 5 | 1 | 0 | Y | GWPLSKMDI | 99.52 | | |
| NS4B | 2325 | 0.05 | 5 | 1 | 0 | Y | WPLSKMDIG | 99.52 | | |
| NS4B | 2326 | 0.18 | 6 | 2 | 0 | Y | PLSKMDIGV | 97.72 | PLSKMDIGA | 1.8 |
| NS4B | 2327 | 0.18 | 6 | 2 | 0 | Y | LSKMDIGVP | 97.72 | LSKMDIGAP | 1.8 |
| NS4B | 2328 | 0.18 | 6 | 2 | 0 | Y | SKMDIGVPL | 97.72 | SKMDIGAPL | 1.8 |

FIG. 7-85

Species: DENV2 (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2329 | 0.18 | 6 | 2 | 0 | Y | KMDIGVPLL | 97.72 | KMDIGA

FIG. 7-86

Species: DENV2 (9-mers)

| protein | block starting position | block entropy | total pe

FIG. 7-87

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 7-88

Species: DENV2 (9

FIG. 7-89

Species: DENV2 (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2433 | 0.05 | 5 | 1 | 0 | Y | LCEALTLAT | 99.52 | | |
| NS4B | 2434 | 0.04 | 4 | 1 | 0 | Y | CEALTLATG | 99.64 | | |
| NS4B | 2435 | 0.04 | 4 | 1 | 0 | Y | EALTLATGP | 99.64 | | |
| NS4B | 2436 | 0.2 | 5 | 2 | 0 | Y | ALTLATGPI | 97.25 | ALTLATGPV | 2.4 |
| NS4B | 2437 | 0.19 | 4 | 2 | 0 | Y | LTLATGPIS | 97.37 | LTLATGPVS | 2.4 |
| NS4B | 2438 | 0.19 | 4 | 2 | 0 | Y | TLATGPIST | 97.37 | TLATGPVST | 2.4 |
| NS4B | 2439 | 0.19 | 4 | 2 | 0 | Y | LATGPISTL | 97.37 | LATGPVSTL | 2.4 |
| NS4B | 2440 | 0.19 | 4 | 2 | 0 | Y | ATGPISTLW | 97.37 | ATGPVSTLW | 2.4 |
| NS4B | 2441 | 0.18 | 3 | 2 | 0 | Y | TGPISTLWE | 97.49 | TGPVSTLWE | 2.4 |
| NS4B | 2442 | 0.18 | 3 | 2 | 0 | Y | GPISTLWEG | 97.49 | GPVSTLWEG | 2.4 |
| NS4B | 2443 | 0.22 | 4 | 2 | 0 | Y | PISTLWEGN | 97.01 | PVSTLWEGN | 2.4 |
| NS4B | 2444 | 0.22 | 4 | 2 | 0 | Y | ISTLWEGNP | 97.01 | VSTLWEGNP | 2.4 |
| NS4B | 2445 | 0.06 | 3 | 1 | 0 | Y | STLWEGNPG | 99.4 | | |
| NS4B | 2446 | 0.2 | 4 | 2 | 0 | Y | TLWEGNPGR | 97.37 | TLWEGNPGK | 2.04 |
| NS4B | 2447 | 0.21 | 5 | 2 | 0 | Y | LWEGNPGRF | 97.25 | LWEGNPGKF | 2.04 |
| NS4B | 2448 | 0.21 | 5 | 2 | 0 | Y | WEGNPGRFW | 97.25 | WEGNPGKFW | 2.04 |
| NS4B | 2449 | 0.2 | 4 | 2 | 0 | Y | EGNPGRFWN | 97.37 | EGNPGKFWN | 2.04 |
| NS4B | 2450 | 0.2 | 4 | 2 | 0 | Y | GNPGRFWNT | 97.37 | GNPGKFWNT | 2.04 |
| NS4B | 2451 | 0.2 | 4 | 2 | 0 | Y | NPGRFWNTT | 97.37 | NPGKFWNTT | 2.04 |
| NS4B | 2452 | 0.16 | 3 | 2 | 0 | Y | PGRFWNTTI | 97.84 | PGKFWNTTI | 2.04 |
| NS4B | 2453 | 0.16 | 3 | 2 | 0 | Y | GRFWNTTIA | 97.84 | GKFWNTTIA | 2.04 |
| NS4B | 2454 | 0.16 | 3 | 2 | 0 | Y | RFWNTTIAV | 97.84 | KFWNTTIAV | 2.04 |
| NS4B | 2455 | 0.01 | 2 | 1 | 0 | Y | FWNTTIAVS | 99.88 | | |
| NS4B | 2456 | 0 | 1 | 1 | 0 | Y | WNTTIAVSM | 100 | | |
| NS4B | 2457 | 0.01 | 2 | 1 | 0 | Y | NTTIAVSMA | 99.88 | | |

FIG. 7-90

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 7-91

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2492 | 1.17 | 11 | 5 | 0 | Y | GTGNIGETL | 78.56 | GTGN

FIG. 7-92

Species: DENV2 (9-mers)

| protein | block starting position | entropy block | total peptides in block | # peptides required to cover 99% of block | gap/X fraction | 99% of block covered w/ => 5 peptides? | peptides required to cover 99% of block | frequency | peptides required to cover 99% of block | frequency |
|---|---|---|---|---|---|---|---|---|---|---|
| NS5 | 2520 | 0.14 | 2 | 2 | 0 | Y | KKSGIQEVD | 97.96 | KRSGIQEVD | 2.04 |
| NS5 | 2521 | 0.14 | 2 | 2 | 0 | Y | KSGIQEVDR | 97.96 | RSGIQEVDR | 2.04 |
| NS5 | 2522 | 0 | 1 | 1 | 0 | Y | SGIQEVDRT | 100 | | |
| NS5 | 2523 | 0 | 1 | 1 | 0 | Y | GIQEVDRTL | 100 | | |
| NS5 | 2524 | 0 | 1 | 1 | 0 | Y | IQEVDRTLA | 100 | | |
| NS5 | 2525 | 0 | 1 | 1 | 0 | Y | QEVDRTLAK | 100 | | |
| NS5 | 2526 | 0 | 1 | 1 | 0 | Y | EVDRTLAKE | 100 | | |
| NS5 | 2527 | 0 | 1 | 1 | 0 | Y | VDRTLAKEG | 100 | | |
| NS5 | 2528 | 0 | 1 | 1 | 0 | Y | DRTLAKEGI | 100 | | |
| NS5 | 2529 | 0.03 | 2 | 1 | 0 | Y | RTLAKEGIK | 99.64 | | |
| NS5 | 2530 | 0.03 | 2 | 1 | 0 | Y | TLAKEGIKR | 99.64 | | |
| NS5 | 2531 | 0.03 | 2 | 1 | 0 | Y | LAKEGIKRG | 99.64 | | |
| NS5 | 2532 | 0.03 | 2 | 1 | 0 | Y | AKEGIKRGE | 99.64 | | |
| NS5 | 2533 | 0.03 | 2 | 1 | 0 | Y | KEGIKRGET | 99.64 | | |
| NS5 | 2534 | 0.03 | 2 | 1 | 0 | Y | EGIKRGETD | 99.64 | | |
| NS5 | 2535 | 0.03 | 3 | 1 | 0 | Y | GIKRGETDH | 99.64 | | |
| NS5 | 2536 | 0.03 | 2 | 1 | 0 | Y | IKRGETDHH | 99.64 | | |
| NS5 | 2537 | 0.05 | 2 | 1 | 0 | Y | KRGETDHHA | 99.52 | | |
| NS5 | 2538 | 0.01 | 2 | 1 | 0 | Y | RGETDHHAV | 99.88 | | |
| NS5 | 2539 | 0.01 | 2 | 1 | 0 | Y | GETDHHAVS | 99.88 | | |
| NS5 | 2540 | 0.01 | 2 | 1 | 0 | Y | ETDHHAVSR | 99.88 | | |
| NS5 | 2541 | 0.01 | 2 | 1 | 0 | Y | TDHHAVSRG | 99.88 | | |
| NS5 | 2542 | 0.01 | 2 | 1 | 0 | Y | DHHAVSRGS | 99.88 | | |
| NS5 | 2543 | 0.01 | 2 | 1 | 0 | Y | HHAVSRGSA | 99.88 | | |
| NS5 | 2544 | 0.01 | 2 | 1 | 0 | Y | HAVSRGSAK | 99.88 | | |

FIG. 7-93

Species

FIG. 7-94

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

FIG. 7-95

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | fr

FIG. 7-96

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2620 | 1.16 | 7 | 4 | 0 | Y | GVDV

FIG. 7-97

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2645 | 1.02 | 4 | 2 | 0 | Y | PTIEAGRTL | 55.21 | PTVEAGRTL | 44.55 | | | | |
| NS5 | 2646 | 1.02 | 4 | 2 | 0 | Y | TIEAGRTLR | 55.21 | TVEAGRTLR | 44.55 | | | | |
| NS5 | 2647 | 1.04 | 6 | 2 | 0 | Y | IEAGRTLRV | 55.09 | VEAGRTLRV | 44.43 | | | | |
| NS5 | 2648 | 0.05 | 4 | 1 | 0 | Y | EAGRTLRVL | 99.52 | | | | | | |
| NS5 | 2649 | 0.39 | 5 | 2 | 0 | Y | AGRTLRVLN | 92.93 | AGRTLRVLS | 6.71 | | | | |
| NS5 | 2650 | 0.39 | 5 | 2 | 0 | Y | GRTLRVLNL | 92.93 | GRTLRVLSL | 6.71 | | | | |
| NS5 | 2651 | 0.41 | 6 | 2 | 0 | Y | RTLRVLNLV | 92.81 | RTLRVLSLV | 6.71 | | | | |
| NS5 | 2652 | 0.41 | 6 | 2 | 0 | Y | TLRVLNLVE | 92.81 | TLRVLSLVE | 6.71 | | | | |
| NS5 | 2653 | 0.43 | 7 | 2 | 0 | Y | LRVLNLVEN | 92.57 | LRVLSLVEN | 6.71 | | | | |
| NS5 | 2654 | 0.43 | 7 | 2 | 0 | Y | RVLNLVENW | 92.57 | RVLSLVENW | 6.71 | | | | |
| NS5 | 2655 | 0.43 | 7 | 2 | 0 | Y | VLNLVENWL | 92.57 | VLSLVENWL | 6.71 | | | | |
| NS5 | 2656 | 0.57 | 9 | 3 | 0 | Y | LNLVENWLN | 90.54 | LSLVENWLN | 6.71 | LNLVENWLG | 1.92 | | |
| NS5 | 2657 | 0.59 | 10 | 3 | 0 | Y | NLVENWLNN | 90.3 | SLVENWLNN | 6.71 | NLVENWLGS | 1.92 | | |
| NS5 | 2658 | 0.61 | 11 | 4 | 0 | Y | LVENWLNND | 90.18 | LVENWLNNN | 6.83 | LVENWLGSN | 1.92 | | |
| NS5 | 2659 | 0.63 | 11 | 5 | 0 | Y | VENWLNNDT | 89.94 | VENWLNNNT | 6.83 | VENWLGSNT | 1.92 | LVESWLNNN | 0.24 | |
| NS5 | 2660 | 0.64 | 10 | 5 | 0 | Y | ENWLNNDTQ | 89.82 | ENWLNNNTQ | 6.83 | ENWLGSNTQ | 1.92 | VESWLNNNT | 0.24 | VENWLNNNI | 0.24 |
| NS5 | 2661 | 0.63 | 10 | 5 | 0 | Y | NWLNNDTQF | 89.94 | NWLNNNTQF | 6.83 | NWLGSNTQF | 1.92 | ENWLNNNTQ | 0.24 | ENWLNNNIQ | 0.24 |
| NS5 | 2662 | 0.61 | 9 | 4 | 0 | Y | WLNNDTQFC | 90.18 | WLNNNTQFC | 6.83 | WLGSNTQFC | 1.92 | NWLNNNTKF | 0.24 | NWLNNNIQF | 0.24 |
| NS5 | 2663 | 0.94 | 10 | 5 | 0 | Y | LNNDTQFCI | 83.71 | LNNNTQFCI | 6.83 | LGSNTQFCV | 6.47 | WLKNNTQFC | 0.24 | |
| NS5 | 2664 | 0.94 | 10 | 5 | 0 | Y | NNDTQFCIK | 83.71 | NNNTQFCIK | 6.83 | GSNTQFCVK | 6.47 | LGSNTQFCV | 1.92 | LNNNTKFCI | 0.24 |
| NS5 | 2665 | 0.92 | 9 | 4 | 0 | Y | NDTQFCIKV | 83.95 | NTQFCIKV | 6.83 | SNTQFCVKV | 6.47 | GSNTQFCVK | 1.92 | NNNTKFCIK

FIG. 7-98

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2670 | 0.43 | 3 | 2 | 0 | Y | CI

FIG. 7-99

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2700 | 0.04 | 4 | 1 | 0 | Y | PLSRNSTHE | 99.64 | | |
| NS5 | 2701 | 0.04 | 4 | 1 | 0 | Y | LSRNSTHEM | 99.64 | | |
| NS5 | 2702 | 0.04 | 4 | 1 | 0 | Y | SRNSTHEMY | 99.64 | | |
| NS5 | 2703 | 0.04 | 4 | 1 | 0 | Y | RNSTHEMYW | 99.64 | | |
| NS5 | 2704 | 0.05 | 5 | 1 | 0 | Y | NSTHEMYWV | 99.52 | | |
| NS5 | 2705 | 0.05 | 5 | 1 | 0 | Y | STHEMYWVS | 99.52 | | |
| NS5 | 2706 | 0.05 | 5 | 1 | 0 | Y | THEMYWVSN | 99.52 | | |
| NS5 | 2707 | 0.04 | 4 | 1 | 0 | Y | HEMYWVSNA | 99.64 | | |
| NS5 | 2708 | 1.02 | 4 | 2 | 0 | Y | EMYWVSNAT | 54.73 | EMYWVSNAS | 45.03 |
| NS5 | 2709 | 1.01 | 3 | 2 | 0 | Y | MYWVSNATG | 54.73 | MYWVSNASG | 45.15 |
| NS5 | 2710 | 1.01 | 3 | 2 | 0 | Y | YWVSNATGN | 54.73 | YWVSNASGN | 45.15 |
| NS5 | 2711 | 1.03 | 4 | 2 | 0 | Y | WVSNATGNI | 54.73 | WVSNASGNI | 44.91 |
| NS5 | 2712 | 1.03 | 4 | 2 | 0 | Y | VSNATGNIV | 54.73 | VSNASGNIV | 44.91 |
| NS5 | 2713 | 1.02 | 3 | 2 | 0 | Y | SNATGNIVS | 54.73 | SNASGNIVS | 45.03 |
| NS5 | 2714 | 1.03 | 4 | 2 | 0 | Y | NATGNIVSS | 54.61 | NASGNIVSS | 45.03 |
| NS5 | 2715 | 1.03 | 4 | 2 | 0 | Y | ATGNIVSSV | 54.61 | ASGNIVSSV | 45.03 |
| NS5 | 2716 | 1.03 | 4 | 2 | 0 | Y | TGNIVSSVN | 54.61 | SGNIVSSVN | 45.03 |
| NS5 | 2717 | 0.06 | 4 | 1 | 0 | Y | GNIVSSVNM | 99.4 | | |
| NS5 | 2718 | 0.06 | 3 | 1 | 0 | Y | NIVSSVNMI | 99.4 | | |
| NS5 | 2719 | 0.06 | 3 | 1 | 0 | Y | IVSSVNMIS | 99.4 | | |
| NS5 | 2720 | 0.04 | 4 | 1 | 0 | Y | VSSVNMISR | 99.64 | | |
| NS5 | 2721 | 0.04 | 3 | 1 | 0 | Y | SSVNMISRM | 99.64 | | |
| NS5 | 2722 | 0.04 | 3 | 1 | 0 | Y | SVNMISRML | 99.64 | | |
| NS5 | 2723 | 0.04 | 3 | 1 | 0 | Y | VNMISRMLI | 99.64 | | |
| NS5 | 2724 | 0.04 | 3 | 1 | 0 | Y | NMISRMLIN | 99.64 | | |

FIG. 7-100

Species: DENV2 (9-mers)

| protein | block starting position | block entropy | total

FIG. 7-101

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2750 | 0.11 | 5 | 2 | 0 | Y | GSGTRNIGI | 98.8 | GSGTRNIGT | 0.6 | | | | |
| NS5 | 2751 | 0.11 | 5 | 2 | 0 | Y | SGTRNIGIE | 98.8 | SGTRNIGTE | 0.6 | | | | |
| NS5 | 2752 | 0.73 | 8 | 4 | 0 | Y | GTRNIGIES | 86.59 | GTRNIGIEN | 10.3 | GTRNIGIEC | | GTRNIGTES | 1.92 |
| NS5 | 2753 | 0.73 | 8 | 4 | 0 | Y | TRNIGIESE | 86.59 | TRNIGIENE | 10.3 | TRNIGIECE | | TRNIGTESE | 1.92 |
| NS5 | 2761 | 0.88 | 9 | 5 | 0 | Y | EIPNLDIIG | 84.55 | ETPNLDIIG | 8.86 | EVPNLDIIG | 3.83 | ETPNMDIIG | 1.68 |
| NS5 | 2762 | 0.88 | 9 | 5 | 0 | Y | IPNLDIIGK | 84.55 | TPNLDIIGK | 8.86 | VPNLDIIGK | 3.83 | TPNMDIIGK | 1.68 |
| NS5 | 2763 | 0.16 | 5 | 2 | 0 | Y | PNLDIIGKR | 97.96 | PNMDIIGKR | 1.68 | | | | |
| NS5 | 2764 | 0.16 | 5 | 2 | 0 | Y | NLDIIGKRI | 97.96 | NMDIIGKRI | 1.68 | | | | |
| NS5 | 2765 | 0.16 | 5 | 2 | 0 | Y | LDIIGKRIE | 97.96 | MDIIGKRIE | 1.68 | | | | |
| NS5 | 2766 | 0.07 | 6 | 1 | 0 | Y | DIIGKRIEK | 99.4 | | | | | | |
| NS5 | 2767 | 0.07 | 6 | 1 | 0 | Y | IIGKRIEKI | 99.4 | | | | | | |
| NS5 | 2768 | 0.07 | 6 | 1 | 0 | Y | IGKRIEKIK | 99.4 | | | | | | |
| NS5 | 2769 | 0.2 | 8 | 2 | 0 | Y | GKRIEKIKQ | 97.6 | GKRIEKIKE | 1.68 | | | | |
| NS5 | 2770 | 0.2 | 8 | 2 | 0 | Y | KRIEKIKQE | 97.6 | KRIEKIKEE | 1.68 | | | | |
| NS5 | 2771 | 0.2 | 8 | 2 | 0 | Y | RIEKIKQEH | 97.6 | RIEKIKEEH | 1.68 | | | | |
| NS5 | 2772 | 0.22 | 9 | 2 | 0 | Y | IEKIKQEHE | 97.49 | IEKIKEEHE | 1.68 | | | | |
| NS5 | 2773 | 0.77 | 11 | 4 | 0 | Y | EKIKQEHET | 86.47 | EKIKQEHEI | 9.82 | EKIKEEHET | 1.68 | EKIKQEHEA | 1.2 |
| NS5 | 2774 | 0.77 | 11 | 4 | 0 | Y | KIKQEHETS | 86.47 | KIKQEHEIS | 9.82 | KIKEEHETS | 1.68 | KIKQEHEAS | 1.2 |
| NS5 | 2775 | 0.74 | 9 | 4 | 0 | Y | IKQEHETSW | 86.71 | IKQEHEISW | 9.82 | IKEEHETSW | 1.68 | IKQEHEASW | 1.2 |
| NS5 | 2776 | 0.76 | 10 | 4 | 0 | Y | KQEHETSWH | 86.47 | KQEHEISWH | 9.94 | KEEHETSWH | 1.68 | KQEHEASWH | 1.2 |
| NS5 | 2777 | 0.77 | 10 | 4 | 0 | Y | QEHETSWHY | 86.35 | QEHEISWHY | 9.94 | EEHETSWHY | 1.68 | QEHEASWHY | 1.2 |
| NS5 | 2778 | 0.64 | 8 | 3 | 0 | Y | EHETSWHYD | 88.14 | EHEISWHYD | 9.94 | EHEASWHYD | 1.2 | | |
| NS5 | 2779 | 0.64 | 8 | 3 | 0 | Y | HETSWHYDQ | 88.14 | HEISWHYDQ | 9.94 | HEASWHYDQ | 1.2 | | |
| NS5 | 2780 | 0.64 | 8 | 3 | 0 | Y | ETSWHYDQD | 88.14 | EISWHYDQD | 9.94 | EASWHYDQD | 1.2 | | |
| NS5 | 2781 | 0.64 | 8 | 3 | 0 | Y | TSWHYDQDH | 88.14 | ISWHYDQDH | 9.94 | ASWHYDQDH | 1.2 | | |

FIG. 7-102

Species: DENV2 (9-mers)

| protein | block starting position | entropy | total peptides in block | # peptides required to cover 99% of block | gap/X f

FIG. 7-103

Species: DENV2 (9-mers)

| protein | block starting position | entropy block | total

FIG. 7-104

Species: DENV2 (9-mers)

| protein | block starting position | entropy | total peptides in block | # peptides required to cover 99% of block

FIG. 7-105

Species: DENV2 (9-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of

FIG. 7-106

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 7-107

Species: DENV2 (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 7-108

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|

FIG. 7-109

Species: DENV2 (9-mers)

| protein | block starting position | block

FIG. 7-110

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 7-111

Species: DENV2 (9-mers)

| protein | block starting position

FIG. 7-112

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3054 | 0.24 | 4 | 3 | 0 | Y | KLAEAIFKL | 96.77 | RLAEAIFKL | 2.16 | KLAEAIFRL | 0.96 | | |
| NS5 | 3055 | 0.09 | 3 | 2 | 0 | Y | LAEAIFKLT | 98.92 | LAEAIFRLT | 0.96 | | | | |
| NS5 | 3056 | 0.09 | 3 | 2 | 0 | Y | AEAIFKLTY | 98.92 | AEAIFRLTY | 0.96 | | | | |
| NS5 | 3057 | 0.09 | 3 | 2 | 0 | Y | EAIFKLTYQ | 98.92 | EAIFRLTYQ | 0.96 | | | | |
| NS5 | 3058 | 0.1 | 4 | 2 | 0 | Y | AIFKLTYQN | 98.8 | AIFRLTYQN | 0.96 | | | | |
| NS5 | 3059 | 0.1 | 4 | 2 | 0 | Y | IFKLTYQNK | 98.8 | IFRLTYQNK | 0.96 | | | | |
| NS5 | 3060 | 0.1 | 4 | 2 | 0 | Y | FKLTYQNKV | 98.8 | FRLTYQNKV | 0.96 | | | | |
| NS5 | 3061 | 0.1 | 4 | 2 | 0 | Y | KLTYQNKVW | 98.8 | RLTYQNKVW | 0.96 | | | | |
| NS5 | 3062 | 0.03 | 3 | 1 | 0 | Y | LTYQNKVWR | 99.76 | | | | | | |
| NS5 | 3063 | 0.03 | 3 | 1 | 0 | Y | TYQNKVWRV | 99.76 | | | | | | |
| NS5 | 3064 | 0.03 | 3 | 1 | 0 | Y | YQNKVWRVQ | 99.76 | | | | | | |
| NS5 | 3065 | 0.03 | 3 | 1 | 0 | Y | QNKVWRVQR | 99.76 | | | | | | |
| NS5 | 3066 | 0.03 | 3 | 1 | 0 | Y | NKVWRVQRP | 99.76 | | | | | | |
| NS5 | 3067 | 0.03 | 3 | 1 | 0 | Y | KVWRVQRPT | 99.76 | | | | | | |
| NS5 | 3068 | 0.05 | 4 | 1 | 0 | Y | VWRVQRPTP | 99.52 | | | | | | |
| NS5 | 3069 | 0.1 | 6 | 1 | 0 | Y | WRVQRPTPR | 99.04 | | | | | | |
| NS5 | 3070 | 0.1 | 6 | 1 | 0 | Y | RVQRPTPRG | 99.04 | | | | | | |
| NS5 | 3071 | 0.11 | 7 | 2 | 0 | Y | VQRPTPRGT | 98.92 | VQRPTPKGT | 0.24 | | | | |
| NS5 | 3072 | 0.11 | 7 | 2 | 0 | Y | QRPTPRGTV | 98.92 | QRPTPIGTV | 0.24 | | | | |
| NS5 | 3073 | 0.13 | 8 | 2 | 0 | Y | RPTPRGTVM | 98.8 | RPTSRGTVM | 0.24 | | | | |
| NS5 | 3074 | 0.13 | 8 | 2 | 0 | Y | PTPRGTVMD | 98.8 | PTPKGTVMD | 0.24 | | | | |
| NS5 | 3075 | 0.13 | 8 | 2 | 0 | Y | TPRGTVMDI | 98.8 | TPKGTVMDI | 0.24 | | | | |
| NS5 | 3076 | 0.11 | 7 | 2 | 0 | Y | PRGTVMDII | 98.92 | PKGTVMDII | 0.24 | | | | |
| NS5 | 3077 | 0.09 | 6 | 1 | 0 | Y | RGTVMDIIS | 99.16 | | | | | | |
| NS5 | 3078 | 0.03 | 3 | 1 | 0 | Y | GTVMDIISR | 99.76 | | | | | | |

FIG. 7-113

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3079 | 0.61 | 4 | 2 | 0 | Y | TVMDIISRR | 85.87 | TVMDIIS

FIG. 7-114

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3104 | 0.12 | 5 | 2 | 0 | Y | TNMEAQLIR | 98.68 | TNMGAQLIR | 0.84 | | | | |
| NS5 | 3105 | 0.12 | 5 | 2 | 0 | Y | NMEAQLIRQ | 98.68 | NMGAQLIRQ | 0.84 | | | | |
| NS5 | 3106 | 0.11 | 4 | 2 | 0 | Y | MEAQLIRQM | 98.8 | MGAQLIRQM | 0.84 | | | | |
| NS5 | 3107 | 0.08 | 3 | 1 | 0 | Y | EAQLIRQME | 99.04 | | | | | | |
| NS5 | 3108 | 0.01 | 2 | 1 | 0 | Y | AQLIRQMEG | 99.88 | | | | | | |
| NS5 | 3109 | 0.01 | 2 | 1 | 0 | Y | QLIRQMEGE | 99.88 | | | | | | |
| NS5 | 3110 | 0.03 | 3 | 1 | 0 | Y | LIRQMEGEG | 99.76 | | | | | | |
| NS5 | 3111 | 1.12 | 4 | 3 | 0 | Y | IRQMEGEGI | 54.61 | IRQMEGEGV | 43.35 | IRQMEGEGL | 1.92 | | |
| NS5 | 3112 | 1.12 | 4 | 3 | 0 | Y | RQMEGEGIF | 54.61 | RQMEGEGVF | 43.35 | RQMEGEGLF | 1.92 | | |
| NS5 | 3113 | 1.17 | 7 | 3 | 0 | Y | QMEGEGIFK | 54.49 | QMEGEGVFK | 42.99 | QMEGEGLFK | 1.92 | | |
| NS5 | 3140 | 0.31 | 10 | 4 | 0 | Y | RVGRERLSR | 96.53 | REGRERLAR | 1.32 | RVGRERLTR | 0.84 | REGRERLSR | 0.36 |
| NS5 | 3141 | 0.29 | 9 | 4 | 0 | Y | VGRERLSRM | 96.65 | EGRERLARM | 1.32 | VGRERLTRM | 0.84 | EGRERLSRM | 0.36 |
| NS5 | 3142 | 0.26 | 8 | 3 | 0 | Y | GRERLSRMA | 96.89 | GRERLARMA | 1.32 | GRERLTRMA | 1.08 | | |
| NS5 | 3143 | 0.26 | 8 | 3 | 0 | Y | RERLSRMAI | 96.89 | RERLARMAI | 1.32 | RERLTRMAI | 1.08 | | |
| NS5 | 3144 | 0.25 | 7 | 3 | 0 | Y | ERLSRMAIS | 97.01 | ERLARMAIS | 1.32 | ERLTRMAIS | 1.08 | | |
| NS5 | 3145 | 0.25 | 7 | 3 | 0 | Y | RLSRMAISG | 97.01 | RLARMAISG | 1.32 | RLTRMAISG | 1.08 | | |
| NS5 | 3146 | 0.25 | 7 | 3 | 0 | Y | LSRMAISGD | 97.01 | LARMAISGD | 1.32 | LTRMAISGD | 1.08 | | |
| NS5 | 3147 | 0.25 | 7 | 3 | 0 | Y | SRMAISGDD | 97.01 | ARMAISGDD | 1.32 | TRMAISGDD | 1.08 | | |
| NS5 | 3148 | 0.05 | 4 | 1 | 0 | Y | RMAISGDDC | 99.52 | | | | | | |
| NS5 | 3149 | 0.05 | 4 | 1 | 0 | Y | MAISGDDCV | 99.52 | | | | | | |
| NS5 | 3150 | 0.08 | 5 | 1 | 0 | Y | AISGDDCVV | 99.28 | | | | | | |
| NS5 | 3151 | 0.04 | 3 | 1 | 0 | Y | ISGDDCVVK | 99.64 | | | | | | |
| NS5 | 3152 | 0.02 | 2 | 1 | 0 | Y | SGDDCVVKP | 99.76 | | | | | | |
| NS5 | 3153 | 0.92 | 3 | 2 | 0 | Y | GDDCVVKPL | 68.86 | GDDCVVKPI | 30.9 | | | | |
| NS5 | 3154 | 0.92 | 3 | 2 | 0 | Y | DDCVVKPLD | 68.86 | DDCVVKPID | 30.9 | | | | |

FIG. 7-115

Species: DENV2 (9-mers)

| protein | block starting position | block entropy | total peptides in block | # peptides required to cover 99% of block | gap/X fraction | 99% of block covered w/ <= 5 peptides?

FIG. 7-116

Species: DENV2 (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3183 | 0.86 | 3 | 2 | 0 | Y | QQWEPSRGW | 72.46 | QQWEPSKGW | 27.43 | | | | | | |
| NS5 | 3184 | 0.99 | 7 | 3 | 0 | Y | QWEPSRGWN | 72.22 | QWEPSKGWN | 25.51 | QWEPSKGWS | 1.8 | | | | |
| NS5 | 3185 | 0.99 | 7 | 3 | 0 | Y | WEPSRGWND | 72.22 | WEPSKGWND | 25.51 | W

FIG. 7-117

Species: DENV2 (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required

FIG. 7-118

Species: DENV2 (9-mers)

| protein | block starting position | block entropy | total pe

FIG. 7-119

Species: DENV2 (9-mers)

|

FIG. 7-120

Species: DENV2 (9-mers)

| protein

FIG. 7-121

Species: DENV2 (9-mers)

| protein | block starting position | entropy block | total

Species: DENV2 (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 59 | 0.14 | 6 | 2 | 0 | yes | IPPTAGILKR | 98.56 | IPPTV

FIG. 8-4

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 84 | 0.1 | 5 | 2 | 0 | yes | FRKEIGRMLN | 98.92 | FRREIGRMLN | 0.72 | | | | |
| anC | 85 | 0.1 | 5 | 2 | 0 | yes | RREIGRMLNI | 98.92 | RREIGRMLNI | 0.72 | | | | |
| anC | 86 | 0.11 | 6 | 2 | 0 | yes | KEIGRMLNIL | 98.8 | REIGRMLNIL | 0.72 | | | | |
| anC | 87 | 0.07 | 6 | 1 | 0 | yes | EIGRMLNILN | 99.4 | | | | | | |
| anC | 88 | 0.42 | 7 | 2 | 0 | yes | IGRMLNILNR | 92.81 | IGRMLNILNK | 6.59 | | | | |
| anC | 89 | 0.42 | 7 | 2 | 0 | yes | GRMLNILNRR | 92.81 | GRMLNILNKR | 6.59 | | | | |
| anC | 90 | 0.43 | 8 | 2 | 0 | yes | RMLNILNRRR | 92.69 | RMLNILNKRR | 6.59 | | | | |
| anC | 91 | 0.42 | 7 | 3 | 0 | yes | MLNILNRRRR | 92.81 | MLNILNKRRR | 6.59 | | | | |
| anC | 92 | 1.28 | 8 | 5 | 0 | yes | LNILNRRRRT | 60.24 | LNILNRRRRS | 32.57 | LNILNKRRRT | 6.59 | | |
| anC | 93 | 1.54 | 10 | 5 | 0 | yes | NILNRRRRTA | 58.56 | NILNRRRRSA | 29.7 | NILNKRRRTA | 6.59 | NILNRRRRSV | 2.87 | NILNRRRRTV | 1.56 |
| anC | 94 | 1.55 | 11 | 4 | 0 | yes | ILNRRRRTAG | 58.44 | ILNRRRRSAG | 29.7 | ILNKRRRTAG | 6.59 | ILNRRRRSVG | 2.87 | ILNRRRRTVG | 1.56 |
| anC | 109 | 1.27 | 7 | 4 | 0 | yes | IPTAMAFHLT | 51.86 | IPTVMAFHLT | 43.95 | IPTVWAFHLT | 2.51 | IPTAIAFHLT | 0.84 | |
| anC | 110 | 1.24 | 6 | 4 | 0 | yes | PTAMAFHLTT | 51.86 | PTVMAFHLT | 44.43 | PTVWAFHLT | 2.51 | PTAIAFHLT | 0.84 | |
| anC | 111 | 1.24 | 6 | 4 | 0 | yes | TAMAFHLTTR | 51.86 | TYMAFHLTR | 44.43 | TVWAFHLTR | 2.51 | TAIAFHLTR | 0.84 | |
| anC | 112 | 1.26 | 8 | 4 | 0 | yes | AMAFHLTTRN | 51.74 | VMAFHLTTRN | 44.31 | VWAFHLTRN | 2.51 | AIAFHLTRN | 0.84 | |
| anC | 113 | 0.3 | 6 | 3 | 0 | yes | MAFHLTTRNG | 96.05 | VAFHLTTRNG | 2.51 | IAFHLTTRNG | 0.84 | | |
| anC | 114 | 0.04 | 3 | 1 | 0 | yes | AFHLTTRNGE | 99.64 | | | | | | |
| anC | 115 | 0.02 | 2 | 1 | 0 | yes | FHLTTRNGEP | 99.76 | | | | | | |
| anC | 116 | 0.02 | 2 | 1 | 0 | yes | HLTTRNGEPH | 99.76 | | | | | | |
| anC | 117 | 0.02 | 2 | 1 | 0 | yes | LTTRNGEPHM | 99.76 | | | | | | |
| pfM | 118 | 0.04 | 3 | 1 | 0 | yes | TTRNGEPHMI | 99.64 | | | | | | |
| pfM | 119 | 0.04 | 3 | 1 | 0 | yes | TRNGEPHMIV | 99.64 | | | | | | |
| pfM | 120 | 0.8 | 4 | 2 | 0 | yes | RNGEPHMIVG | 77.6 | RNGEPHMIVS | 22.04 | | | | |
| pfM | 121 | 1.78 | 10 | 5 | 0 | yes | NGEPHMIVGR | 54.25 | NGEPHMIVGI | 23.23 | NGEPHMIVSR | 13.89 | NGEPHMIVSI | 5.87 | NGEPHMIVSK | 2.16 |
| pfM | 122 | 1.78 | 10 | 5 | 0 | yes | GEPHMIVGRQ | 54.37 | GEPHMIVGIQ | 23.35 | GEPHMIVSRQ | 13.89 | GEPHMIVSIQ | 5.87 | GEPHMIVSKN | 1.68 |

FIG. 8-5

Species: DENV2 (10-mers)

| protein | block starting position | block entropy | total peptides in block | # peptides required to cover 99% of block | gap/K fraction | 99% of block covered w/ <= 5 peptides? | peptides required to cover 99% of block | frequency | peptides

FIG. 8-6

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to

FIG. 8-7

Species: DENV2 (10-mers)

| protein | block starting position | block entropy | total peptides in block | # peptides required to cover 99% of block | gap/X fraction | 99% of block covered w

FIG. 8-8

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 216 | 0 | 1 | 1 | 0 | yes | GLETRTETWM | 100 | | | | | | | | |
| prM | 217 | 0 | 1 | 1 | 0 | yes | LETRTETWMS | 100 | | | | | | | | |
| prM | 218 | 0 | 1 | 1 | 0 | yes | ETRTETWMSS | 100 | | | | | | | | |
| prM | 219 | 0.02 | 2 | 1 | 0 | yes | TRTETWMSSE | 99.76 | | | | | | | | |
| prM | 220 | 0.04 | 3 | 1 | 0 | yes | RTETWMSSEG | 99.64 | | | | | | | | |
| prM | 221 | 0.04 | 3 | 1 | 0 | yes | TETWMSSEGA | 99.64 | | | | | | | | |
| prM | 222 | 0.04 | 3 | 1 | 0 | yes | ETWMSSEGAW | 99.64 | | | | | | | | |
| prM | 223 | 0.04 | 3 | 1 | 0 | yes | TWMSSEGAWK | 99.64 | | | | | | | | |
| prM | 224 | 0.17 | 4 | 2 | 0 | yes | WMSSEGAWKH | 97.72 | WMSSEGAWKQ | 1.92 | | | | | | |
| prM | 225 | 1.15 | 5 | 3 | 0 | yes | MSSEGAWKHV | 50.54 | MSSEGAWKHA | 47.19 | MSSEGAWKQA | 1.92 | | | | |
| prM | 226 | 1.15 | 5 | 3 | 0 | yes | SSEGAWKHVQ | 50.54 | SSEGAWKHAQ | 47.19 | SSEGAWKQAQ | 1.92 | | | | |
| prM | 227 | 1.16 | 6 | 3 | 0 | yes | SEGAWKHVQR | 50.42 | SEGAWKHAQR | 47.19 | SEGAWKQAQR | 1.92 | | | | |
| prM | 228 | 1.16 | 6 | 3 | 0 | yes | EGAWKHVQRI | 50.42 | EGAWKHAQRI | 47.19 | EGAWKQAQRI | 1.92 | | | | |
| prM | 229 | 1.14 | 5 | 3 | 0 | yes | GAWKHVQRIE | 50.42 | GAWKHAQRIE | 47.43 | GAWKQAQRIE | 1.92 | | | | |
| prM | 230 | 1.14 | 5 | 3 | 0 | yes | AWKHVQRIET | 50.54 | AWKHAQRIET | 47.31 | AWKQAQRIET | 1.92 | | | | |
| prM | 231 | 1.14 | 5 | 3 | 0 | yes | WKHVQRIETW | 50.54 | WKHAQRIETW | 47.31 | WKQAQRIETW | 1.92 | | | | |
| prM | 232 | 1.37 | 6 | 4 | 0 | yes | KHVQRIETWI | 50.54 | KHAQRIETWI | 42.4 | KHAQRIETWV | 4.91 | KQAQRIETWI | 1.92 | | |
| prM | 233 | 1.39 | 7 | 4 | 0 | yes | HVQRIETWIL | 50.54 | HAQRIETWIL | 42.16 | HAQRIETWVL | 4.91 | QAQRIETWIL | 1.92 | | |
| prM | 234 | 1.28 | 6 | 3 | 0 | yes | VQRIETWILR | 50.54 | AQRIETWILR | 44.07 | AQRIETWVLR | 4.91 | | | | |
| prM | 235 | 0.33 | 5 | 2 | 0 | yes | QRIETWILRH | 94.61 | QRIETWVLRH | 4.91 | | | | | | |
| prM | 236 | 0.33 | 6 | 2 | 0 | yes | RIETWILRHP | 94.61 | RIETWVLRHP | 4.91 | | | | | | |
| prM | 237 | 0.32 | 5 | 2 | 0 | yes | IETWILRHPG | 94.73 | IETWVLRHPG | 4.91 | | | | | | |
| prM | 238 | 0.32 | 4 | 2 | 0 | yes | ETWILRHPGF | 94.73 | ETWVLRHPGF | 4.91 | | | | | | |
| prM | 239 | 0.45 | 4 | 3 | 0 | yes | TWILRHPGFT | 93.05 | TWILRHPGFA | 1.56 | | | | | | |
| prM | 242 | 0.58 | 8 | 5 | 0 | yes | LRHPGFTMMA | 92.1 | LRHPGFTLMA | 2.63 | LRHPGFTLMA | 2.16 | LRHPGFAIMA | 1.56 | LRHPGFTTMA | 0.72 |

FIG. 8-9

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |

FIG. 8-10

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to

FIG. 8-11

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 8-12

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 331 | 0.61 | 10 | 5 | 0 | yes | KQPATLRKYC | 91.02 | KHPATLRKYC | 5.27 | KQPATLRKFC | 1.68 | KEPATLRKYC | 0.84 | KQSATLRKYC | 0.36 |
| E | 333 | 0.35 | 10 | 4 | 0 | yes | PATLRKYCIE | 95.81 | PATLRKFCIE | 1.68 | PATLRKYCIE | 1.2 | SATLRKYCIE | 0.36 | | |
| E | 334 | 0.29 | 7 | 3 | 0 | yes | ATLRKYCIEA | 96.29 | ATLRKFCIEA | 1.92 | ATLRKYCIEA | 1.2 | | | | |
| E | 335 | 0.33 | 7 | 4 | 0 | yes | TLRKYCIEAK | 95.81 | TLRKFCIEAK | 1.92 | TLRKYCIEAK | 1.2 | TLRKYCIEAR | 0.48 | | |
| E | 336 | 0.32 | 6 | 3 | 0 | yes | LRKYCIEAKL | 95.93 | LRKFCIEAKL | 1.92 | LRKYCVEAKL | 1.2 | | | | |
| E | 337 | 0.32 | 6 | 3 | 0 | yes | RKYCIEAKLT | 95.93 | RKFCIEAKLT | 1.92 | RKYCVEAKLT | 1.2 | | | | |
| E | 338 | 0.32 | 6 | 3 | 0 | yes | KYCIEAKLTN | 95.93 | KFCIEAKLTN | 1.92 | KYCVEAKLTN | 1.2 | | | | |
| E | 339 | 0.32 | 6 | 3 | 0 | yes | YCIEAKLTNT | 95.93 | FCIEAKLTNT | 1.92 | YCVEAKLTNT | 1.2 | | | | |
| E | 340 | 0.2 | 6 | 3 | 0 | yes | CIEAKLTNTT | 97.72 | CVEAKLTNTT | 1.2 | CIEARLTNTT | 0.48 | | | | |
| E | 341 | 0.2 | 7 | 3 | 0 | yes | IEAKLTNTTT | 97.72 | VEAKLTNTTT | 1.2 | IEARLTNTTT | 0.48 | | | | |
| E | 342 | 0.65 | 6 | 3 | 0 | yes | EAKLTNTTTE | 89.22 | EAKLTNTTTA | 5.99 | EAKLTNTTTD | 3.83 | | | | |
| E | 343 | 0.62 | 6 | 3 | 0 | yes | AKLTNTTTES | 89.58 | AKLTNTTTAS | 5.99 | AKLTNTTTDS | 3.83 | | | | |
| E | 344 | 0.62 | 6 | 3 | 0 | yes | KLTNTTTESR | 89.58 | KLTNTTTASR | 5.99 | KLTNTTTDSR | 3.83 | | | | |
| E | 345 | 0.58 | 4 | 3 | 0 | yes | LTNTTTESRC | 89.94 | LTNTTTASRC | 6.11 | LTNTTTDSRC | 3.83 | | | | |
| E | 346 | 0.58 | 4 | 3 | 0 | yes | TNTTTESRCP | 89.94 | TNTTTASRCP | 6.11 | TNTTTDSRCP | 3.83 | | | | |
| E | 347 | 0.58 | 4 | 3 | 0 | yes | NTTTESRCPT | 89.94 | NTTTASRCPT | 6.11 | NTTTDSRCPT | 3.83 | | | | |
| E | 348 | 0.58 | 4 | 3 | 0 | yes | TTTESRCPTQ | 89.94 | TTTASRCPTQ | 6.11 | TTTDSRCPTQ | 3.83 | | | | |
| E | 349 | 0.58 | 4 | 3 | 0 | yes | TTESRCPTQG | 89.94 | TTASRCPTQG | 6.11 | TTDSRCPTQG | 3.83 | | | | |
| E | 350 | 0.56 | 3 | 3 | 0 | yes | TESRCPTQGE | 90.06 | TASRCPTQGE | 6.11 | TDSRCPTQGE | 3.83 | | | | |
| E | 351 | 0.56 | 3 | 3 | 0 | yes | ESRCPTQGEP | 90.06 | ASRCPTQGEP | 6.11 | DSRCPTQGEP | 3.83 | | | | |
| E | 352 | 0.18 | 3 | 2 | 0 | yes | SRCPTQGEPS | 97.49 | SRCPTQGEPT | 2.4 | | | | | | |
| E | 353 | 0.18 | 3 | 2 | 0 | yes | RCPTQGEPSL | 97.49 | RCPTQGEPTL | 2.4 | | | | | | |
| E | 354 | 1.3 | 8 | 5 | 0 | yes | CPTQGEPSLK | 63.83 | CPTQGEPSLN | 30.06 | CPTQGEPTLN | 2.4 | CPTQGEPSLV | 1.56 | CPTQGEPSLS | 1.56 |
| E | 355 | 1.3 | 8 | 5 | 0 | yes | PTQGEPSLKE | 63.83 | PTQGEPSLNE | 30.06 | PTQGEPTLNE | 2.4 | PTQGEPSLSE | 1.56 | PTQGEPSLVE | 1.56 |
| E | 356 | 1.3 | 8 | 5 | 0 | yes | TQGEPSLKEE | 63.83 | TQGEPSLNEE | 30.06 | TQGEPTLNEE | 2.4 | TQGEPSLSEE | 1.56 | TQGEPSLVEE | 1.56 |

FIG. 8-13

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 357 | 1.3 | 8 | 5 | 0 | yes | QGEPSLNEEQ | 63.83 | QGEPSLKEEQ | 30.06 | QGEPTLNEEQ | 2.4 | QGEPSLVEEQ | 1.56 | QGEPSLSEEQ | 1.56 |
| E | 358 | 1.3 | 8 | 5 | 0 | yes | GEPSLNEEQD | 63.83 | GEPSLKEEQD | 30.06 | GEPTLNEEQD | 2.4 | GEPSLVEEQD | 1.56 | GEPSLSEEQD | 1.56 |
| E | 359 | 1.3 | 8 | 5 | 0 | yes | EPSLNEEQDK | 63.83 | EPSLKEEQDK | 30.06 | EPTLNEEQDK | 2.4 | EPSLVEEQDK | 1.56 | EPSLSEEQDK | 1.56 |
| E | 360 | 1.3 | 8 | 5 | 0 | yes | PSLNEEQDKR | 63.83 | PSLKEEQDKR | 30.06 | PTLNEEQDKR | 2.4 | PSLVEEQDKR | 1.56 | PSLSEEQDKR | 1.56 |
| E | 361 | 1.3 | 8 | 5 | 0 | yes | SLNEEQDKRF | 63.83 | SLKEEQDKRF | 30.06 | TLNEEQDKRF | 2.4 | SLVEEQDKRF | 1.56 | SLSEEQDKRF | 1.56 |
| E | 364 | 1.21 | 4 | 4 | 0 | yes | EEQDKRFVCK | 52.93 | EEQDKRFICK | 43.59 | EEQDKRFVCR | 1.8 | EEQDKRFLCK | 1.68 | | |
| E | 365 | 1.21 | 4 | 4 | 0 | yes | EQDKRFVCKH | 52.93 | EQDKRFICKH | 43.59 | EQDKRFVCRH | 1.8 | EQDKRFLCKH | 1.68 | | |
| E | 366 | 1.21 | 4 | 4 | 0 | yes | QDKRFVCKHS | 52.93 | QDKRFICKHS | 43.59 | QDKRFVCRHS | 1.8 | QDKRFLCKHS | 1.68 | | |
| E | 367 | 1.27 | 6 | 4 | 0 | yes | DKRFVCKHSM | 52.34 | DKRFICKHSM | 43.47 | DKRFVCRHSM | 1.8 | DKRFLCKHSM | 1.68 | | |
| E | 368 | 1.27 | 6 | 4 | 0 | yes | KRFVCKHSMV | 52.34 | KRFICKHSMV | 43.47 | KRFVCRHSMV | 1.8 | KRFLCKHSMV | 1.68 | | |
| E | 369 | 1.27 | 6 | 4 | 0 | yes | RFVCKHSMVD | 52.34 | RFICKHSMVD | 43.47 | RFVCRHSMVD | 1.8 | RFLCKHSMVD | 1.68 | | |
| E | 370 | 1.27 | 6 | 4 | 0 | yes | FVCKHSMVDR | 52.34 | FICKHSMVDR | 43.47 | FVCRHSMVDR | 1.8 | FLCKHSMVDR | 1.68 | | |
| E | 371 | 1.27 | 6 | 4 | 0 | yes | VCKHSMVDRG | 52.34 | ICKHSMVDRG | 43.47 | VCRHSMVDRG | 1.8 | LCKHSMVDRG | 1.68 | | |
| E | 372 | 0.2 | 4 | 2 | 0 | yes | CKHSMVDRGW | 97.49 | CRHSMVDRGW | 1.8 | | | | | | |
| E | 373 | 0.2 | 4 | 2 | 0 | yes | KHSMVDRGWG | 97.49 | RHSMVDRGWG | 1.8 | | | | | | |
| E | 374 | 0.07 | 3 | 1 | 0 | yes | HSMVDRGWGN | 99.28 | | | | | | | | |
| E | 375 | 0.07 | 3 | 1 | 0 | yes | SMVDRGWGNG | 99.28 | | | | | | | | |
| E | 376 | 0.07 | 3 | 1 | 0 | yes | MVDRGWGNGC | 99.28 | | | | | | | | |
| E | 377 | 0 | 1 | 1 | 0 | yes | VDRGWGNGCG | 100 | | | | | | | | |
| E | 378 | 0 | 1 | 1 | 0 | yes | DRGWGNGCGL | 100 | | | | | | | | |
| E | 379 | 0 | 1 | 1 | 0 | yes | RGWGNGCGLF | 100 | | | | | | | | |
| E | 380 | 0 | 1 | 1 | 0 | yes | GWGNGCGLFG | 100 | | | | | | | | |
| E | 381 | 0 | 1 | 1 | 0 | yes | WGNGCGLFGK | 100 | | | | | | | | |
| E | 382 | 0 | 1 | 1 | 0 | yes | GNGCGLFGKG | 100 | | | | | | | | |
| E | 383 | 0.02 | 2 | 1 | 0 | yes | NGCGLFGKGG | 99.76 | | | | | | | | |

FIG. 8-14

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 384 | 0.05 | 3 | 1 | 0 | yes | GCGLFGKGGI | 99.52 | | | | | | |
| E | 385 | 0.05 | 3 | 1 | 0 | yes | CGLFGKGGIV | 99.52 | | | | | | |
| E | 386 | 0.05 | 3 | 1 | 0 | yes | GLFGKGGIVT | 99.52 | | | | | | |
| E | 387 | 0.06 | 4 | 1 | 0 | yes | LFGKGGIVTC | 99.4 | | | | | | |
| E | 388 | 0.06 | 4 | 1 | 0 | yes | FGKGGIVTCA | 99.4 | | | | | | |
| E | 389 | 0.12 | 6 | 2 | 0 | yes | GKGGIVTCAM | 98.8 | | | | | | |
| E | 390 | 0.12 | 6 | 2 | 0 | yes | KGGIVTCAMF | 98.8 | | | | | | |
| E | 391 | 0.31 | 9 | 4 | 0 | yes | GGIVTCAMFT | 96.29 | GGIVTCAK | 0.48 | GGIVTCAMFS | 0.48 | GGIVTCAKFT | 0.48 | |
| E | 392 | 0.31 | 9 | 4 | 0 | yes | GIVTCAMFTC | 96.29 | GIVTCAKF | 0.48 | GIVTCAMFSC | 0.48 | GIVTCAKFTC | 0.48 | |
| E | 393 | 0.41 | 9 | 4 | 0 | yes | IVTCAMFTCK | 94.85 | GGIVTCAMFR | | IVTCAMFTCL | 1.68 | IVTCAMFSCK | 0.48 | IVTCAKFTCK | 0.48 |
| E | 394 | 0.4 | 8 | 4 | 0 | yes | VTCAMFTCKK | 94.85 | GIVTCAMFR | | VTCAMFTCL | 1.92 | VTCAMFSCKK | 0.48 | VTCAKFTCKK | 0.48 |
| E | 395 | 0.4 | 9 | 5 | 0.12 | yes | TCAMFTCKKN | 94.85 | IVTCAMFRCK | | TCAMFTCLKK | 1.56 | TCAMFSCKKN | 0.48 | TCAKFTCKKN | 0.48 |
| E | 396 | 0.4 | 9 | 5 | 0.12 | yes | CAMFTCKKNM | 94.85 | VTCAMFRCK | | CAMFTCLKK | 1.56 | CAMFSCKKNM | 0.48 | CAKFTCKKNM | 0.48 |
| E | 397 | 0.5 | 9 | 5 | 0.12 | yes | AMFTCKKNME | 93.41 | TCAMFRCKKN | | AMFTCLKKM | 1.56 | AMFTCKKNMK | 1.56 | AKFTCKKNME | 0.48 |
| E | 398 | 0.5 | 9 | 5 | 0.12 | yes | MFTCKKNMEG | 93.41 | CAMFRCKKNM | | MFTCLKKME | 1.56 | MFTCLKKMEG | 1.56 | MFSCKKNMEG | 0.48 |
| E | 399 | 0.47 | 8 | 4 | 0.12 | yes | FTCKKNMEGK | 93.77 | AMFRCKKNME | | FTCKKNMEGK | 1.56 | FTCLKKMEGK | 1.56 | FSCKKNMEGK | 0.48 |
| E | 401 | 1.26 | 9 | 5 | 0 | yes | CKKNMEGKVV | 50.66 | MFRCKKNMEG | | CKKNMIGKVV | 1.56 | CLKKMEGKVV | 1.56 | | |
| E | 402 | 1.72 | 9 | 5 | 0 | yes | KKNMEGKVVQ | 45.51 | FRCKKN

FIG. 8-15

Species: DENV2 (10-mers)

| protein | block starting position | block entropy | total peptides in block | # peptides required to cover 99% of block | gap/X fraction | 99% of block covered w/ <= 5 peptides?

FIG. 8-16

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |

FIG. 8-17

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 471 | 0.12 | 9 | 2 | 0 | yes | LDFNEMYLLQ | 98.92 | FDFNEMYLLQ | 0.24 | |

FIG. 8-18

Species: DENV2 (10-mers)

| protein | block starting position | block entropy | total peptides in block | # peptides required to cover 99% of block | gap/K fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 503 | 1.12 | 9 | 5 | 0 | yes | GADTQGSNWI | 73.41 | GADIKQGSNWI | 21.68 | GADTQESNWI | 2.04 | GADIQGSNWI | 0.96 |
| E | 504 | 1.12 | 9 | 5 | 0 | yes | ADTQGSNWIQ | 73.41 | ADIKQGSNWIQ | 21.68 | ADTQESNWIQ | 2.04 | ADIQGSNWIQ | 0.96 |
| E | 505 | 1.12 | 9 | 5 | 0.12 | yes | DTQGSNWIQK | 73.41 | DIKQGSNWIQK | 21.68 | DTQESNWIQK | 2.04 | DIQGSNWIQK | 0.96 |
| E | 506 | 1.13 | 10 | 5 | 0.12 | yes | TQGSNWIQKE | 73.29 | KQGSNWIQKE | 21.68 | TQESNWIQKE | 2.04 | IQGSNWIQKE | 0.96 |
| E | 507 | 0.98 | 9 | 4 | 0.12 | yes | QGSNWIQKET | 74.97 | QGSNWIQKEM | 22.4 | QGLNWIQKET | 1.32 | | |
| E | 508 | 0.98 | 9 | 4 | 0.12 | yes | GSNWIQKETL | 74.97 | GSNWIQKEML | 22.4 | ESNWIQKEML | 1.32 | | |
| E | 509 | 0.21 | 7 | 2 | 0.12 | yes | SNWIQKETLV | 97.37 | SNWIQKEMLV | 1.68 | | | | |
| E | 510 | 0.17 | 5 | 2 | 0.12 | yes | NWIQKETLVT | 97.72 | NWIQKEMLVT | 1.8 | | | | |
| E | 511 | 0.16 | 4 | 2 | 0.12 | yes | WIQKETLVTF | 97.72 | WIQKEMLVTF | 1.92 | | | | |
| E | 512 | 0.16 | 4 | 2 | 0.12 | yes | IQKETLVTFK | 97.72 | IQKEMLVTFK | 1.92 | | | | |
| E | 513 | 0.16 | 4 | 2 | 0.12 | yes | QKETLVTFKN | 97.72 | QKEMLVTFKN | 1.92 | | | | |
| E | 514 | 0.16 | 4 | 2 | 0.12 | yes | KETLVTFKNP | 97.72 | KEMLVTFKNP | 1.92 | | | | |
| E | 515 | 0.16 | 4 | 2 | 0 | yes | ETLVTFKNPH | 97.84 | EMLVTFKNPH | 1.68 | | | | |
| E | 516 | 0.15 | 3 | 2 | 0 | yes | TLVTFKNPHA | 97.96 | MLVTFKNPHA | 1.68 | | | | |
| E | 517 | 0 | 1 | 1 | 0 | yes | LVTFKNPHAK | 100 | | | | | | |
| E | 518 | 0.12 | 2 | 2 | 0 | yes | VTFKNPHAKK | 98.32 | VTFKNPHAKR | 1.68 | | | | |
| E | 519 | 0.12 | 2 | 2 | 0 | yes | TFKNPHAKKQ | 98.32 | TFKNPHAKRQ | 1.68 | | | | |
| E | 520 | 0.12 | 2 | 2 | 0 | yes | FKNPHAKKQD | 98.32 | FKNPHAKRQD | 1.68 | | | | |
| E | 521 | 0.12 | 2 | 2 | 0 | yes | KNPHAKKQDV | 98.32 | KNPHAKRQDV | 1.68 | | | | |
| E | 522 | 0.14 | 3 | 2 | 0 | yes | NPHAKKQDVV | 98.2 | NPHAKRQDVV | 1.68 | | | | |
| E | 523 | 0.16 | 4 | 2 | 0 | yes | PHAKKQDVVV | 97.96 | PHAKRQDVVV | 1.68 | | | | |

FIG. 8-19

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 528 | 0.05 | 4 | 1 | 0 | yes | QDVVVLGSQE | 99.52 | | | | | | | | |
| E | 529 | 0.05 | 4 | 1 | 0 | yes | DVVVLGSQEG | 99.52 | | | | | | | | |
| E | 530 | 0.05 | 4 | 1 | 0 | yes | VVVLGSQEGA | 99.52 | | | | | | | | |
| E | 531 | 0.05 | 4 | 1 | 0 | yes | VVLGSQEGAM | 99.52 | | | | | | | | |
| E | 532 | 0.04 | 3 | 1 | 0 | yes | VLGSQEGAMH | 99.64 | | | | | | | | |
| E | 533 | 0.04 | 4 | 1 | 0 | yes | LGSQEGAMHT | 99.64 | | | | | | | | |
| E | 534 | 0.03 | 3 | 1 | 0 | yes | GSQEGAMHTA | 99.76 | | | | | | | | |
| E | 535 | 0.03 | 3 | 1 | 0 | yes | SQEGAMHTAL | 99.76 | | | | | | | | |
| E | 536 | 0.03 | 3 | 1 | 0 | yes | QEGAMHTALT | 99.76 | | | | | | | | |
| E | 537 | 0.03 | 3 | 1 | 0 | yes | EGAMHTALTG | 99.76 | | | | | | | | |
| E | 538 | 0.04 | 4 | 1 | 0 | yes | GAMHTALTGA | 99.64 | | | | | | | | |
| E | 539 | 0.07 | 6 | 1 | 0 | yes | AMHTALTGAT | 99.4 | | | | | | | | |
| E | 540 | 0.07 | 6 | 1 | 0 | yes | MHTALTGATE | 99.4 | | | | | | | | |
| E | 541 | 0.07 | 6 | 1 | 0 | yes | HTALTGATEI | 99.4 | | | | | | | | |
| E | 542 | 0.08 | 7 | 1 | 0 | yes | TALTGATEIQ | 99.28 | | | | | | | | |
| E | 543 | 0.08 | 6 | 1 | 0 | yes | ALTGATEIQM | 99.28 | | | | | | | | |
| E | 544 | 0.08 | 6 | 1 | 0 | yes | LTGATEIQMS | 99.28 | | | | | | | | |
| E | 545 | 0.15 | 8 | 2 | 0 | yes | TGATEIQMSS | 98.44 | TGATEIQMSL | 0.84 | | | | | | |
| E | 546 | 0.15 | 8 | 2 | 0 | yes | GATEIQMSSG | 98.44 | GATEIQMSLG | 0.84 | | | | | | |
| E | 547 | 0.15 | 8 | 2 | 0 | yes | ATEIQMSSGN | 98.44 | ATEIQMSLGN | 0.84 | | | | | | |
| E | 548 | 0.2 | 7 | 3 | 0 | yes | TEIQMSSGNL | 97.84 | TEIQMSLGNI | 0.84 | TEIQMSSGNI | 0.6 | | | | |
| E | 549 | 0.18 | 8 | 3 | 0 | yes | EIQMSSGNLL | 98.08 | EIQMSLGNIL | 0.84 | EIQMSSGNIL | 0.6 | | | | |
| E | 550 | 0.19 | 9 | 3 | 0 | yes | IQMSSGNLLF | 97.96 | IQMSLGNILF | 0.84 | IQMSSGNILF | 0.6 | | | | |
| E | 551 | 0.19 | 8 | 3 | 0 | yes | QMSSGNLLFT | 97.96 | QMSLGNILFM | 0.84 | QMSSGNILFM | 0.48 | | | | |
| E | 552 | 0.18 | 8 | 3 | 0 | yes | MSSGNLLFTG | 98.08 | MSLGNILFMG | 0.84 | MSSGNILFMG | 0.48 | | | | |

FIG. 8-20

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---------|------------------------|---------------|------------------------|------------------------------------------|----------------|--------------------------------------|----------------------------------------|-----------|----------------------------------------|-----------|
| E | 553 | 0.16 | 6 | 2 | 0 | yes | SSGNLLFTGH | 98.2 | SLGNILFMGH | 0.96 |
| E | 554 | 0.16 | 6 | 2 | 0 | yes | SGNLLFTGHL | 98.2 | LGNILFMGHL | 0.96 |
| E | 555 | 0.15 | 5 | 2 | 0 | yes | GNLLFTGHLK | 98.2 | GNILFMGHLK | 1.44 |
| E | 556 | 0.15 | 5 | 2 | 0 | yes | NLLFTGHLKC | 98.2 | NILFMGHLKC | 1.44 |
| E | 557 | 0.15 | 5 | 2 | 0 | yes | LLFTGHLKCR | 98.2 | ILFMGHLKCR | 1.44 |
| E | 558 | 0.14 | 4 | 2 | 0 | yes | LFTGHLKCRL | 98.2 | LFMGHLKCRL | 1.56 |
| E | 559 | 0.17 | 5 | 2 | 0 | yes | FTGHLKCRLR | 97.96 | FMGHLKCRLR | 1.56 |
| E | 560 | 0.17 | 5 | 2 | 0 | yes | TGHLKCRLRM | 97.96 | MGHLKCRLRM | 1.56 |
| E | 561 | 0.05 | 4 | 1 | 0 | yes | GHLKCRLRMD | 99.52 | | |
| E | 562 | 0.05 | 4 | 1 | 0 | yes | HLKCRLRMDK | 99.52 | | |
| E | 563 | 0.05 | 4 | 1 | 0 | yes | LKCRLRMDKL | 99.52 | | |
| E | 564 | 0.05 | 4 | 1 | 0 | yes | KCRLRMDKLQ | 99.52 | | |
| E | 565 | 0.05 | 4 | 1 | 0 | yes | CRLRMDKLQL | 99.52 | | |
| E | 566 | 0.05 | 4 | 1 | 0 | yes | RLRMDKLQLK | 99.52 | | |
| E | 567 | 0.05 | 4 | 1 | 0 | yes | LRMDKLQLKG | 99.52 | | |
| E | 568 | 0.05 | 3 | 1 | 0 | yes | RMDKLQLKGM | 99.52 | | |
| E | 569 | 0.03 | 2 | 1 | 0 | yes | MDKLQLKGMS | 99.88 | | |
| E | 570 | 0.01 | 1 | 1 | 0 | yes | DKLQLKGMSY | 99.88 | | |
| E | 571 | 0 | 1 | 1 | 0 | yes | KLQLKGMSYS | 100 | | |
| E | 572 | 0.01 | 2 | 1 | 0 | yes | LQLKGMSYSM | 99.88 | | |
| E | 573 | 0.01 | 2 | 1 | 0 | yes | QLKGMSYSMC | 99.88 | | |
| E | 574 | 0.03 | 3 | 1 | 0 | yes | LKGMSYSMCT | 99.76 | | |
| E | 575 | 0.03 | 3 | 1 | 0 | yes | KGMSYSMCTG | 99.76 | | |
| E | 576 | 0.03 | 3 | 1 | 0 | yes | GMSYSMCTGK | 99.76 | | |
| E | 577 | 0.03 | 3 | 1 | 0 | yes | MSYSMCTGKF | 99.76 | | |

FIG. 8-21

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 578 | 0.03 | 3 | 1 | 0 | yes | SYSMCTGKFK | 99.76 | | | | | | | | |
| E | 579 | 1.01 | 4 | 2 | 0 | yes | YSMCTGKFKI | 57.13 | YSMCTGKFKV | 42.63 | | | | | | |
| E | 580 | 1.02 | 5 | 2 | 0 | yes | SMCTGKFKIV | 57.13 | SMCTGKFKVV | 42.51 | | | | | | |
| E | 581 | 1.03 | 6 | 2 | 0 | yes | MCTGKFKIVK | 57.13 | MCTGKFKVVK | 42.4 | | | | | | |
| E | 582 | 1.02 | 5 | 2 | 0 | yes | CTGKFKIVKE | 57.13 | CTGKFKVVKE | 42.51 | | | | | | |
| E | 583 | 1.02 | 5 | 2 | 0 | yes | TGKFKIVKEI | 57.13 | TGKFKVVKEI | 42.51 | | | | | | |
| E | 584 | 1.01 | 4 | 2 | 0 | yes | GKFKIVKEIA | 57.25 | GKFKVVKEIA | 42.51 | | | | | | |
| E | 585 | 1.01 | 4 | 2 | 0 | yes | KFKIVKEIAE | 57.25 | KFKVVKEIAE | 42.51 | | | | | | |
| E | 586 | 1.01 | 4 | 2 | 0 | yes | FKIVKEIAET | 57.25 | FKVVKEIAET | 42.51 | | | | | | |
| E | 587 | 1.01 | 4 | 2 | 0 | yes | KIVKEIAETQ | 57.25 | KVVKEIAETQ | 42.51 | | | | | | |
| E | 588 | 1.01 | 4 | 2 | 0 | yes | IVKEIAETQH | 57.25 | VVKEIAETQH | 42.51 | | | | | | |
| E | 589 | 0.03 | 3 | 1 | 0 | yes | VKEIAETQHG | 99.76 | | | | | | | | |
| E | 590 | 0.01 | 2 | 1 | 0 | yes | KEIAETQHGT | 99.88 | | | | | | | | |
| E | 591 | 0.04 | 3 | 1 | 0 | yes | EIAETQHGTI | 99.64 | | | | | | | | |
| E | 592 | 0.04 | 3 | 1 | 0 | yes | IAETQHGTIV | 99.64 | | | | | | | | |
| E | 593 | 0.11 | 4 | 2 | 0 | yes | AETQHGTIVI | 98.3 | AETQHGTIVV | 0.84 | TQHGTIWRV | 0.84 | | | | |
| E | 594 | 0.12 | 5 | 2 | 0 | yes | ETQHGTIVIR | 98.68 | ETQHGTIVVR | 0.84 | QHGTIVVRVQ | 0.84 | | | | |
| E | 595 | 0.23 | 7 | 3 | 0 | yes | TQHGTIVIRI | 97.37 | TQHGTIVIRI | 1.08 | HGTIWRVQY | 1.08 | | | | |
| E | 596 | 0.24 | 8 | 3 | 0 | yes | QHGTIVIRIQ | 97.25 | QHGTIVIRIQ | 1.08 | GTIVIRVQYE | 1.08 | | | | |
| E | 597 | 0.24 | 8 | 3 | 0 | yes | HGTIVIRIQY | 97.25 | HGTIVIRIQY | 1.08 | TIVVRVQYEG | 1.08 | | | | |
| E | 598 | 0.24 | 8 | 3 | 0 | yes | GTIVIRIQYE | 97.25 | GTIVIRIQYE | 1.08 | IVVRVQYEGD | 1.08 | | | | |
| E | 599 | 0.24 | 8 | 3 | 0 | yes | TIVIRIQYEG | 97.25 | TIVIRIQYEG | 1.08 | VVRVQYEGDG | 1.8 | IVIRVQYEGE | 0.48 | | |
| E | 600 | 0.3 | 10 | 4 | 0 | yes | IVIRIQYEGD | 96.65 | IVIRIQYEGD | 1.08 | VRVQYEGDGS | 1.8 | VRVQYEGDG | 0.84 | VIRVQYEGED | 0.24 |
| E | 601 | 0.4 | 10 | 5 | 0 | yes | VIRIQYEGDG | 95.21 | VIRIQYEGDD | 1.8 | IRIQYEGDGS | | VRVQYEGDGS | 0.84 | IRVQYEGEGA | 0.24 |
| E | 602 | 0.41 | 11 | 5 | 0 | yes | IRIQYEGDGS | 95.09 | IRIQYEGDGS | 1.8 | | | | | | |

FIG. 8-22

Species: DENV2 (10-

FIG. 8-23

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 640 | 0.39 | 7 | 4 | 0 | yes | EKDSPINIEA | 95.09 | EKDSPINIEA | 1.8 | GKDSPINIEA | 1.56 | EKDNPINIEA | 0.6 | | |
| E | 641 | 0.26 | 5 | 3 | 0 | yes | KDSPINIEAE | 96.65 | KDSPINIEAE | 2.04 | KDNPINIEAE | 0.6 | | | | |
| E | 642 | 0.26 | 5 | 3 | 0 | yes | DSPINIEAEP | 96.65 | DSPINIEAEP | 2.04 | DNPINIEAEP | 0.6 | | | | |
| E | 643 | 0.26 | 5 | 3 | 0 | yes | SPINIEAEPP | 96.65 | SPINIEAEPP | 2.04 | NPINIEAEPP | 0.6 | | | | |
| E | 644 | 0.21 | 4 | 2 | 0 | yes | PINIEAEPPF | 97.01 | PINIEAEPPF | 2.63 | | | | | | |
| E | 645 | 0.21 | 4 | 2 | 0 | yes | INIEAEPPFG | 97.01 | INIEAEPPFG | 2.63 | | | | | | |
| E | 646 | 0.04 | 3 | 1 | 0 | yes | NIEAEPPFGD | 99.64 | | | | | | | | |
| E | 647 | 0.04 | 3 | 1 | 0 | yes | IEAEPPFGDS | 99.64 | | | | | | | | |
| E | 648 | 0.01 | 2 | 1 | 0 | yes | EAEPPFGDSY | 99.88 | | | | | | | | |
| E | 649 | 0.03 | 3 | 1 | 0 | yes | AEPPFGDSYI | 99.76 | | | | | | | | |
| E | 650 | 0.15 | 4 | 2 | 0 | yes | EPPFGDSYIV | 98.08 | EPPFGDSYIV | 1.68 | PPFGDSYIVI | 1.68 | | | | |
| E | 651 | 0.35 | 5 | 3 | 0 | yes | PPFGDSYIII | 94.97 | PPFGDSYIIV | 3.11 | PFGDSYIVIG | 1.68 | | | | |
| E | 652 | 0.35 | 5 | 3 | 0 | yes | PFGDSYIIIG | 94.97 | PFGDSYIIVG | 3.11 | FGDSYIVIGV | 1.68 | | | | |
| E | 653 | 0.38 | 6 | 3 | 0 | yes | FGDSYIIIGV | 94.61 | FGDSYIIVGV | 3.11 | GDSYIVIGVE | 1.68 | | | | |
| E | 654 | 0.42 | 7 | 3 | 0 | yes | GDSYIIIGVE | 94.25 | GDSYIIVGVE | 3.11 | DSYIVIGVEP | 1.68 | | | | |
| E | 655 | 0.42 | 7 | 3 | 0 | yes | DSYIIIGVEP | 94.25 | DSYIIVGVEP | 3.11 | SYIVIGVEPG | 1.68 | | | | |
| E | 656 | 0.42 | 7 | 3 | 0 | yes | SYIIIGVEPG | 94.25 | SYIIVGVEPG | 3.11 | YIVIGVEPGQ | 1.68 | | | | |
| E | 657 | 0.42 | 7 | 3 | 0 | yes | YIIIGVEPGQ | 94.25 | YIIVGVEPGQ | 3.11 | IVIGVEPGQL | 1.68 | | | | |
| E | 658 | 0.42 | 7 | 3 | 0 | yes | IIIGVEPGQL | 94.25 | IIVGVEPGQL | 3.11 | VIGVEPGQLK | 1.68 | | | | |
| E | 659 | 0.4 | 6 | 2 | 0 | yes | IIGVEPGQLK | 94.37 | IVGVEPGQLK | 3.11 | | | | | | |
| E | 660 | 0.28 | 5 | 2 | 0 | yes | IGVEPGQLKL | 96.05 | VGVEPGQLKL | 3.11 | | | | | | |
| E | 661 | 0.55 | 7 | 3 | 0 | yes | GVEPGQLKLN | 91.38 | GVEPGQLKLS | 5.51 | GVEPGQLKLD | 2.28 | | | | |
| E | 662 | 0.55 | 7 | 3 | 0 | yes | VEPGQLKLNW | 91.38 | VEPGQLKLSW | 5.51 | VEPGQLKLDW | 2.28 | | | | |
| E | 663 | 0.53 | 6 | 3 | 0 | yes | EPGQLKLNWF | 91.5 | EPGQLKLSWF | 5.51 | EPGQLKLDWF | 2.4 | | | | |
| E | 664 | 0.5 | 5 | 3 | 0 | yes | PGQLKLNWFK | 91.98 | PGQLKLSWFK | 5.51 | PGQLKLDWFK | 1.92 | | | | |

FIG. 8-24

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 665 | 0.5 | 5 | 3 | 0 | yes | GQLKLNWFKK | 91.98 | GQLKLSWFKK | 5.51 | GQLKLDWFKK | 1.92 |
| E | 666 | 0.5 | 5 | 3 | 0 | yes | QLKLNWFKKG | 91.98 | QLKLSWFKKG | 5.51 | QLKLDWFKKG | 1.92 |
| E | 667 | 0.5 | 5 | 3 | 0 | yes | LKLNWFKKGS | 91.98 | LKLSWFKKGS | 5.51 | LKLDWFKKGS | 1.92 |
| E | 668 | 0.5 | 5 | 3 | 0 | yes | KLNWFKKGSS | 91.98 | KLSWFKKGSS | 5.51 | KLDWFKKGSS | 1.92 |
| E | 669 | 0.5 | 5 | 3 | 0 | yes | LNWFKKGSSI | 91.98 | LSWFKKGSSI | 5.51 | LDWFKKGSSI | 1.92 |
| E | 670 | 0.5 | 5 | 3 | 0 | yes | NWFKKGSSIG | 91.98 | SWFKKGSSIG | 5.51 | DWFKKGSSIG | 1.92 |
| E | 671 | 0.08 | 4 | 1 | 0 | yes | WFKKGSSIGQ | 99.16 | | | | |
| E | 672 | 0.08 | 4 | 1 | 0 | yes | FKKGSSIGQM | 99.16 | | | | |
| E | 673 | 0.15 | 4 | 2 | 0 | yes | KKGSSIGQMF | 98.2 | KKGSSIGQMI | 1.08 | | |
| E | 674 | 0.17 | 6 | 2 | 0 | yes | KGSSIGQMFE | 98.08 | KGSSIGQMIE | 1.08 | | |
| E | 675 | 0.18 | 7 | 2 | 0 | yes | GSSIGQMFET | 97.96 | GSSIGQMIET | 1.08 | | |
| E | 676 | 0.18 | 7 | 2 | 0 | yes | SSIGQMFETT | 97.96 | SSIGQMIETT | 1.08 | | |
| E | 677 | 0.2 | 8 | 3 | 0 | yes | SIGQMFETTM | 97.84 | SIGQMIETTM | 1.08 | SIGQMFATTM | 0.36 |
| E | 678 | 0.2 | 8 | 3 | 0 | yes | IGQMFETTMR | 97.84 | IGQMIETTMR | 1.08 | IGQMFATTMR | 0.36 |
| E | 679 | 0.2 | 8 | 3 | 0 | yes | GQMFETTMRG | 97.84 | GQMIETTMRG | 1.08 | GQMFATTMRG | 0.36 |
| E | 680 | 0.2 | 8 | 3 | 0 | yes | QMFETTMRGA | 97.84 | QMIETTMRGA | 1.08 | QMFATTMRGA | 0.36 |
| E | 681 | 0.17 | 7 | 2 | 0 | yes | MFETTMRGAK | 98.08 | MIETTMRGAK | 1.08 | | |
| E | 682 | 0.17 | 7 | 2 | 0 | yes | FETTMRGAKR | 98.08 | IETTMRGAKR | 1.08 | | |
| E | 683 | 0.09 | 6 | 1 | 0 | yes | ETTMRGAKRM | 99.16 | | | | |
| E | 684 | 0.04 | 4 | 1 | 0 | yes | TTMRGAKRMA | 99.64 | | | | |
| E | 685 | 0.05 | 4 | 1 | 0 | yes | TMRGAKRMAI | 99.52 | | | | |
| E | 686 | 0.05 | 4 | 1 | 0 | yes | MRGAKRMAIL | 99.52 | | | | |
| E | 687 | 0.02 | 2 | 1 | 0 | yes | RGAKRMAILG | 99.76 | | | | |
| E | 688 | 0.04 | 3 | 1 | 0 | yes | GAKRMAILGD | 99.64 | | | | |
| E | 689 | 0.04 | 3 | 1 | 0 | yes | AKRMAILGDT | 99.64 | | | | |

FIG. 8-25

Species: DENV2 (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 690 | 0.05 | 4 | 1 | 0 | yes | KRMAILGDTA | 99.52 | | | | | | |
| E | 691 | 0.05 | 4 | 1 | 0 | yes | RMAILGDTAW | 99.52 | | | | | | |
| E | 692 | 0.05 | 4 | 1 | 0 | yes | MAILGDTAWD | 99.52 | | | | | | |
| E | 693 | 0.05 | 4 | 1 | 0 | yes | AILGDTAWDF | 99.52 | | | | | | |
| E | 694 | 0.05 | 4 | 1 | 0 | yes | ILGDTAWDFG | 99.52 | | | | | | |
| E | 695 | 0.03 | 3 | 1 | 0 | yes | LGDTAWDFGS | 99.76 | | | | | | |
| E | 696 | 0.16 | 5 | 2 | 0 | yes | GDTAWDFGSL | 97.96 | GDTAWDFGSI | 1.68 | | | | | |
| E | 697 | 0.16 | 5 | 2 | 0 | yes | DTAWDFGSLG | 97.96 | DTAWDFGSIG | 1.68 | | | | | |
| E | 698 | 0.15 | 4 | 2 | 0 | yes | TAWDFGSLGG | 98.08 | TAWDFGSIGG | 1.68 | | | | | |
| E | 699 | 0.24 | 6 | 3 | 0 | yes | AWDFGSLGGV | 97.13 | AWDFGSIGGV | 1.68 | AWDFGSLGGA | 0.6 | | | |
| E | 700 | 0.24 | 6 | 3 | 0 | yes | WDFGSLGGVF | 97.13 | WDFGSIGGVF | 1.68 | WDFGSLGGAF | 0.6 | | | |
| E | 701 | 0.24 | 6 | 3 | 0 | yes | DFGSLGGVFT | 97.13 | DFGSIGGVFT | 1.68 | DFGSLGGAFT | 0.6 | | | |
| E | 702 | 0.38 | 9 | 5 | 0 | yes | FGSLGGVFTS | 95.45 | FGSIGGVFTS | 1.68 | FGSLGGAFTS | 0.6 | | | |
| E | 703 | 0.38 | 9 | 5 | 0 | yes | GSLGGVFTSI | 95.45 | GSIGGVFTSV | 1.68 | GSLGGVFTSV | 1.2 | GSLGGAFTSI | 0.6 | GSLGGVFTSM | 0.36 |
| E | 704 | 0.38 | 9 | 5 | 0 | yes | SLGGVFTSIG | 95.45 | SIGGVFTSVG | 1.68 | SLGGVFTSVG | 1.2 | SLGGAFTSIG | 0.6 | SLGGMFTSIG | 0.36 |
| E | 705 | 0.38 | 9 | 5 | 0 | yes | LGGVFTSIGK | 95.57 | IGGVFTSVGK | 1.68 | LGGVFTSVGK | 1.2 | LGGAFTSIGK | 0.6 | LGGVFTSMGK | 0.36 |
| E | 706 | 0.34 | 7 | 3 | 0 | yes | GGVFTSIGKA | 95.57 | GGVFTSVGKA | 2.87 | GGAFTSIGKA | 0.6 | | | |
| E | 707 | 0.34 | 7 | 3 | 0 | yes | GVFTSIGKAL | 95.57 | GVFTSVGKAL | 2.87 | GAFTSIGKAL | 0.6 | | | |
| E | 708 | 0.34 | 7 | 3 | 0 | yes | VFTSIGKALH | 95.57 | VFTSVGKALH | 2.87 | AFTSIGKALH | 0.6 | | | |
| E | 709 | 0.25 | 5 | 2 | 0 | yes | FTSIGKALHQ | 96.53 | FTSVGKALHQ | 2.63 | | | | | |
| E | 710 | 0.26 | 6 | 2 | 0 | yes | TSIGKALHQV | 96.53 | TSVGKALHQV | 2.63 | | | | | |
| E | 711 | 0.26 | 6 | 2 | 0 | yes | SIGKALHQVF | 96.53 | SVGKALHQVF | 2.63 | | | | | |
| E | 712 | 0.26 | 6 | 2 | 0 | yes | IGKALHQVFG | 96.53 | VGKALHQVFG | 2.63 | | | | | |
| E | 713 | 0.03 | 2 | 1 | 0 | yes | GKALHQVFGA | 99.64 | | | | | | | |
| E | 714 | 0.03 | 2 | 1 | 0 | yes | KALHQVFGAI | 99.64 | | | | | | | |

FIG. 8-26

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 715 | 0.03 | 2 | 1 | 0 | yes | ALHQVFGAIY | 99.64 | | | | | | | | |
| E | 716 | 0.03 | 2 | 1 | 0 | yes | LHQVFGAIYG | 99.64 | | | | | | | | |
| E | 717 | 0.09 | 3 | 1 | 0 | yes | HQVFGAIYGA | 99.04 | | | | | | | | |
| E | 718 | 0.11 | 4 | 2 | 0 | yes | QVFGAIYGAA | 98.8 | QVFGAIYGVA | 0.6 | | | | | | |
| E | 719 | 0.12 | 5 | 2 | 0 | yes | VFGAIYGAAF | 98.68 | VFGAIYGVAF | 0.6 | | | | | | |
| E | 720 | 0.12 | 5 | 2 | 0 | yes | FGAIYGAAFS | 98.68 | FGAIYGVAFS | 0.6 | | | | | | |
| E | 721 | 0.12 | 5 | 2 | 0 | yes | GAIYGAAFSG | 98.68 | GAIYGVAFSG | 0.6 | | | | | | |
| E | 722 | 0.12 | 5 | 2 | 0 | yes | AIYGAAFSGV | 98.68 | AIYGVAFSGV | 0.6 | | | | | | |
| E | 723 | 0.12 | 5 | 2 | 0 | yes | IYGAAFSGVS | 98.68 | IYGVAFSGVS | 0.6 | | | | | | |
| E | 724 | 0.12 | 5 | 2 | 0 | yes | YGAAFSGVSW | 98.68 | YGVAFSGVSW | 0.6 | | | | | | |
| E | 725 | 0.23 | 7 | 3 | 0 | yes | GAAFSGVSWT | 97.37 | GAAFSGVSWI | 1.2 | GVAFSGVSWT | 0.48 | | | | |
| E | 726 | 0.26 | 8 | 4 | 0 | yes | AAFSGVSWTM | 97.13 | AAFSGVSWIM | 1.2 | VAFSGVSWTM | 0.48 | | | | |
| E | 727 | 0.2 | 7 | 3 | 0 | yes | AFSGVSWTMK | 97.72 | AFSGVSWIMK | 1.2 | AFNGVSWTMK | 0.48 | AAFNGVSWTM | 0.36 | | |
| E | 728 | 0.18 | 6 | 2 | 0 | yes | FSGVSWTMKI | 97.96 | FSGVSWIMKI | 1.2 | | | | | | |
| E | 729 | 0.21 | 6 | 3 | 0 | yes | SGVSWTMKIL | 97.6 | SGVSWIMKIL | 1.2 | SGVSWTMKIF | 0.48 | | | | |
| E | 730 | 0.2 | 7 | 3 | 0 | yes | GVSWTMKILI | 97.72 | GVSWIMKILI | 1.2 | GVSWTMKIFI | 0.48 | | | | |
| E | 731 | 0.2 | 7 | 3 | 0 | yes | VSWTMKILIG | 97.72 | VSWIMKILIG | 1.2 | VSWTMKIFIG | 0.48 | | | | |
| E | 732 | 0.34 | 8 | 4 | 0 | yes | SWTMKILIGV | 95.81 | SWTMKILIGA | 1.92 | SWIMKILIGV | 1.2 | SWTMKIFIGV | 0.48 | | |
| E | 733 | 0.84 | 11 | 5 | 0 | yes | WTMKILIGVI | 85.03 | WTMKILIGAI | 10.66 | WTMKILIGAI | 1.92 | WIMKILIGVI | 1.08 | WTMKIFIGVI | 0.48 |
| E | 734 | 0.85 | 12 | 5 | 0 | yes | TMKILIGVII | 85.03 | TMKILIGVI | 10.54 | TMKILIGAII | 1.92 | IMKILIGVII | 1.08 | TMKIFIGVII | 0.48 |
| E | 735 | 0.75 | 9 | 4 | 0 | yes | MKILIGVIIT | 86.11 | MKILIGVIT | 10.78 | MKILIGAIIT | 1.92 | MKIFIGVIIT | 0.48 | | |
| E | 736 | 0.72 | 8 | 3 | 0 | yes | KILIGVIITW | 86.35 | KILIGVITW | 10.78 | KILIGAIITW | 1.92 | | | | |
| E | 737 | 0.72 | 8 | 3 | 0 | yes | ILIGVIITWI | 86.35 | ILIGVITWI | 10.78 | ILIGAIITWI | 1.92 | | | | |
| E | 738 | 0.72 | 8 | 3 | 0 | yes | LIGVIITWIG | 86.35 | LIGVITWIG | 10.78 | LIGAIITWIG | 1.92 | | | | |
| E | 739 | 0.68 | 7 | 3 | 0 | yes | IGVIITWIGM | 86.83 | IGVITWIGM | 10.78 | IGAIITWIGM | 1.92 | | | | |

FIG. 8-27

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 8-28

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 769 | 1.56 | 6 | 4 | 0 | yes | LGVMVQADSG | 51.02 | LGAMVQADSG | 34.73 | LGAVVQADSG | 10.18 | LGVMVQADTG | 3.83 | | |
| E | 770 | 1.56 | 6 | 4 | 0 | yes | GVMVQADSGC | 51.02 | GAMVQADSGC | 34.73 | GAVVQADSGC | 10.18 | GVMVQADTGC | 3.83 | | |
| E | 771 | 1.73 | 8 | 5 | 0 | yes | VMVQADSGCV | 50.66 | AMVQADSGCV | 31.98 | AMVQADSGCV | 10.18 | VMVQADTGCV | 3.83 | AMVQADSGCI | 2.75 |
| E | 772 | 0.94 | 6 | 4 | 0 | yes | MVQADSGCVW | 82.4 | VV

FIG. 8-29

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 794 | 0.35 | 5 | 2 | 0 | yes | IFITDNVHTW | 94.01 | IFVTDNVHTW | 5.63 | | | | |
| NS1 | 795 | 0.35 | 5 | 2 | 0 | yes | FITDNVHTWT | 94.01 | FVTDNVHTWT | 5.63 | | | | |
| NS1 | 796 | 0.35 | 5 | 2 | 0 | yes | ITDNVHTWTE | 94.01 | VTDNVHTWTE | 5.63 | | | | |
| NS1 | 797 | 0.04 | 4 | 1 | 0 | yes | TDNVHTWTEQ | 99.64 | | | | | | |
| NS1 | 798 | 0.04 | 4 | 1 | 0 | yes | DNVHTWTEQY | 99.64 | | | | | | |
| NS1 | 799 | 0.04 | 2 | 1 | 0 | yes | NVHTWTEQYK | 99.52 | | | | | | |
| NS1 | 800 | 0.01 | 1 | 1 | 0 | yes | VHTWTEQYKF | 99.76 | | | | | | |
| NS1 | 801 | 0 | 1 | 1 | 0 | yes | HTWTEQYKFQ | 99.88 | | | | | | |
| NS1 | 802 | 0 | 2 | 1 | 0 | yes | TWTEQYKFQP | 99.88 | | | | | | |
| NS1 | 803 | 0.14 | 3 | 2 | 0.12 | yes | WTEQYKFQPE | 97.96 | WTEQYKFQPD | 1.92 | | | | |
| NS1 | 804 | 0.15 | 3 | 2 | 0.12 | yes | TEQYKFQPES | 97.84 | TEQYKFQPDS | 1.92 | | | | |
| NS1 | 805 | 0.15 | 3 | 2 | 0.12 | yes | EQYKFQPESP | 97.84 | EQYKFQPDSP | 1.92 | | | | |
| NS1 | 806 | 0.16 | 4 | 2 | 0.12 | yes | QYKFQPESPS | 97.72 | QYKFQPDSPS | 1.92 | | | | |
| NS1 | 807 | 0.16 | 4 | 2 | 0.12 | yes | YKFQPESPSK | 97.72 | YKFQPDSPSK | 1.92 | | | | |
| NS1 | 808 | 0.16 | 4 | 2 | 0.12 | yes | KFQPESPSKL | 97.72 | KFQPDSPSKL | 1.92 | | | | |
| NS1 | 809 | 0.16 | 4 | 2 | 0.12 | yes | FQPESPSKLA | 97.84 | FQPDSPSKLA | 1.92 | | | | |
| NS1 | 810 | 0.16 | 4 | 2 | 0 | yes | QPESPSKLAS | 97.84 | QPDSPSKLAS | 1.92 | | | | |
| NS1 | 811 | 0.16 | 4 | 2 | 0 | yes | PESPSKLASA | 97.84 | PDSPSKLASA | 1.92 | | | | |
| NS1 | 812 | 0.16 | 3 | 2 | 0 | yes | ESPSKLASAI | 97.84 | DSPSKLASAI | 1.92 | | | | |
| NS1 | 813 | 0.03 | 4 | 1 | 0 | yes | SPSKLASAIQ | 99.76 | | | | | | |
| NS1 | 814 | 0.04 | 4 | 1 | 0 | yes | PSKLASAIQK | 99.64 | | | | | | |
| NS1 | 815 | 0.04 | 4 | 1 | 0 | yes | SKLASAIQKA | 99.64 | | | | | | |
| NS1 | 816 | 0.95 | 6 | 2 | 0 | yes | KLASAIQKAH | 68.86 | KLASAIQKAQ | 30.54 | | | | |
| NS1 | 817 | 0.97 | 8 | 2 | 0 | yes | LASAIQKAHE | 68.62 | LASAIQKAQE | 30.54 | | | | |
| NS1 | 818 | 1.01 | 10 | 3 | 0 | yes | ASAIQKAHEE | 68.26 | ASAIQKAQEE | 30.54 | ASAIQKAHED | 0.24 | | |

FIG. 8-30

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 819 | 1.1 | 11 | 4 | 0 | yes | SAIQKAHEEG | 66.95 | SAIQKAQEEG | 30.54 | SAIQKAHEED | 1.32 | SAIQKAHEDG | 0.24 | | |
| NS1 | 820 | 1.12 | 12 | 5 | 0 | yes | AIQKAHEEGI | 66.95 | AIQKAQEEGI | 30.42 | AIQKAHEEDI | 1.32 | AIQKAHEDGI | 0.24 | AIQKAYEEGI | 0.24 |
| NS1 | 821 | 1.12 | 12 | 5 | 0 | yes | IQKAHEEGIC | 66.95 | IQKAQEEGIC | 30.42 | IQKAHEEDIC | 1.32 | IQKAHEDGIC | 0.24 | IQKAYEEGIC | 0.24 |
| NS1 | 822 | 1.12 | 12 | 5 | 0 | yes | QKAHEEGICG | 66.95 | QKAQEEGICG | 30.42 | QKAHEEDICG | 1.32 | QKAHEDGICG | 0.24 | QKAHEDGICG | 0.24 |
| NS1 | 823 | 1.1 | 11 | 4 | 0 | yes | KAHEEGICGI | 67.07 | KAQEEGICGI | 30.42 | KAHEEDICGI | 1.32 | KAYEEGICGI | 0.24 | | |
| NS1 | 824 | 1.09 | 10 | 4 | 0 | yes | AHEEGICGIR | 67.19 | AQEEGICGIR | 30.42 | AHEEDICGIR | 1.32 | AHEDGICGIR | 0.24 | | |
| NS1 | 825 | 1.1 | 11 | 4 | 0 | yes | HEEGICGIRS | 67.07 | QEEGICGIRS | 30.42 | HEEDICGIRS | 1.32 | HEDGICGIRS | 0.24 | | |
| NS1 | 826 | 0.21 | 9 | 2 | 0 | yes | EEGICGIRSV | 97.72 | EEDICGIRSV | 1.32 | | | | | | |
| NS1 | 827 | 0.18 | 7 | 2 | 0 | yes | EGICGIRSVT | 97.96 | EDICGIRSVT | 1.32 | | | | | | |
| NS1 | 828 | 0.14 | 5 | 2 | 0 | yes | GICGIRSVTR | 98.32 | DICGIRSVTR | 1.32 | | | | | | |
| NS1 | 829 | 0.04 | 4 | 1 | 0 | yes | ICGIRSVTRL | 99.64 | | | | | | | | |
| NS1 | 830 | 0.03 | 3 | 1 | 0 | yes | CGIRSVTRLE | 99.76 | | | | | | | | |
| NS1 | 831 | 0.03 | 3 | 1 | 0 | yes | GIRSVTRLEN | 99.76 | | | | | | | | |
| NS1 | 832 | 0.04 | 4 | 1 | 0 | yes | IRSVTRLENL | 99.64 | | | | | | | | |
| NS1 | 833 | 0.04 | 4 | 1 | 0 | yes | RSVTRLENLM | 99.64 | | | | | | | | |
| NS1 | 834 | 0.04 | 4 | 1 | 0 | yes | SVTRLENLMW | 99.64 | | | | | | | | |
| NS1 | 835 | 0.09 | 3 | 1 | 0 | yes | VTRLENLMWK | 99.04 | | | | | | | | |
| NS1 | 836 | 0.07 | 3 | 1 | 0 | yes | TRLENLMWKQ | 99.16 | | | | | | | | |
| NS1 | 837 | 0.11 | 4 | 2 | 0 | yes | RLENLMWKQI | 98.8 | RLENLMWRQI | 0.72 | ENLMWRQITP | 0.6 | | | | |
| NS1 | 838 | 0.11 | 5 | 2 | 0 | yes | LENLMWKQIT | 98.8 | LENLMWRQIT | 0.6 | NLMWRQITPE | 0.6 | | | | |
| NS1 | 839 | 0.26 | 6 | 3 | 0 | yes | ENLMWKQITP | 96.65 | ENLMWKQITS | 2.16 | LMWRQITPEL | 0.6 | | | | |
| NS1 | 840 | 0.26 | 6 | 3 | 0 | yes | NLMWKQITPE | 96.65 | NLMWKQITSE | 2.16 | MWRQITPELN | 0.6 | | | | |
| NS1 | 841 | 0.26 | 6 | 3 | 0 | yes | LMWKQITPEL | 96.65 | LMWKQITSEL | 2.16 | WRQITPELNH | 0.6 | | | | |
| NS1 | 842 | 0.25 | 5 | 3 | 0 | yes | MWKQITPELN | 96.77 | MWKQITSELN | 2.16 | | | | | | |
| NS1 | 843 | 0.25 | 5 | 3 | 0 | yes | WKQITPELNH | 96.77 | WKQITSELNH | 2.16 | | | | | | |

FIG. 8-31

Species: DENV2 (10-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 844 | 0.25 | 5 | 3 | 0 | yes | KQITPELNH | 96.77 | KQITSELNH | 2.16 | | | | |
| NS1 | 845 | 0.21 | 5 | 2 | 0 | yes | QITPELNHIL | 97.25 | QITSELNHIL | 2.16 | | | | |
| NS1 | 846 | 1.13 | 8 | 4 | 0 | yes | ITPELNHILS | 65.99 | ITPELNHILA | 30.78 | ITSELNHILS | 2.16 | | |
| NS1 | 847 | 1.1 | 7 | 3 | 0 | yes | TPELNHILSE | 66.35 | TPELNHILAE | 30.78 | TSELNHILSE | 2.16 | | |
| NS1 | 848 | 1.1 | 6 | 3 | 0 | yes | PELNHILSEN | 66.35 | PELNHILAEN | 30.78 | SELNHILSEN | 2.16 | | |
| NS1 | 849 | 0.96 | 5 | 2 | 0 | yes | ELNHILSENE | 68.5 | ELNHILAENE | 30.78 | | | |

FIG. 8-32

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 880 | 0.5 | 10 | 4 | 0 | yes | RPQPTELKYS | 93.41 | RPQPTELRYS | 2.63 | KPQPTELRYS | 1.68 | QPQPTELKYS | 1.32 | | |
| NS1 | 881 | 0.34 | 6 | 2 | 0 | yes | PQPTELKYSW | 94.85 | PQPTELRYSW | 4.31 | | | | | | |
| NS1 | 882 | 0.35 | 7 | 2 | 0 | yes | QPTELKYSWK | 94.73 | QPTELRYSWK | 4.31 | | | | | | |
| NS1 | 883 | 0.63 | 10 | 4 | 0 | yes | PTELKYSWKT | 90.18 | PTELRYSWKT | 4.55 | PTELRYSWKT | 4.19 | | | | |
| NS1 | 884 | 0.63 | 10 | 4 | 0 | yes | TELKYSWKTW | 90.18 | TELRYSWKTW | 4.55 | TELRYSWKT | 4.19 | PTQLKYSWKT | 0.36 | | |
| NS1 | 885 | 0.6 | 8 | 3 | 0 | yes | ELKYSWKTWG | 90.42 | ELKYSWKAWG | 4.55 | ELRYSWKTWG | 4.19 | TQLKYSWKTW | 0.36 | | |
| NS1 | 886 | 0.58 | 8 | 3 | 0 | yes | LKYSWKTWGK | 90.66 | LKYSWKAWGK | 4.55 | LRYSWKTWGK | 4.19 | | | | |
| NS1 | 887 | 0.61 | 10 | 3 | 0 | yes | KYSWKTWGKA | 90.42 | KYSWKAWGKA | 4.55 | RYSWKTWGKA | 4.19 | | | | |
| NS1 | 888 | 0.35 | 7 | 2 | 0 | yes | YSWKTWGKAK | 94.61 | YSWKAWGKAK | 4.67 | | | | | | |
| NS1 | 889 | 0.5 | 10 | 3 | 0 | yes | SWKTWGKAKM | 92.69 | SWKAWGKAKM | 4.67 | SWKTWGKAKV | 1.68 | | | | |
| NS1 | 890 | 0.52 | 12 | 4 | 0 | yes | WKTWGKAKML | 92.46 | WKAWGKAKML | 4.67 | WKTWG

FIG. 8-33

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 920 | 0.23 | 7 | 2 | 0 | yes | NTNRAWNSLE | 97.25 | NSNRAWNSLE | 1.8 | | | | |
| NS1 | 921 | 0.22 | 6 | 2 | 0 | yes | TNRAWNSLEV | 97.25 | SNRAWNSLEV | 2.04 | | | | |
| NS1 | 922 | 0.01 | 2 | 1 | 0 | yes | NRAWNSLEVE | 99.88 | | | | | | |
| NS1 | 923 | 0 | 1 | 1 | 0 | yes | RAWNSLEVED | 100 | | | | | | |
| NS1 | 924 | 0 | 1 | 1 | 0 | yes | AWNSLEVEDY | 100 | | | | | | |
| NS1 | 925 | 0 | 1 | 1 | 0 | yes | WNSLEVEDYG | 100 | | | | | | |
| NS1 | 926 | 0 | 1 | 1 | 0 | yes | NSLEVEDYGF | 100 | | | | | | |
| NS1 | 927 | 0 | 1 | 1 | 0 | yes | SLEVEDYGFG | 100 | | | | | | |
| NS1 | 928 | 0.14 | 3 | 2 | 0 | yes | LEVEDYGFGV | 98.08 | LEVEDYGFGI | 1.8 | | | | |
| NS1 | 929 | 0.14 | 3 | 2 | 0 | yes | EVEDYGFGVF | 98.08 | EVEDYGFGIF | 1.8 | | | | |
| NS1 | 930 | 0.65 | 4 | 3 | 0 | yes | VEDYGFGVFT | 86.71 | VEDYGFGVFS | 11.38 | VEDYGFGIFT | 1.8 | | |
| NS1 | 931 | 0.65 | 4 | 3 | 0 | yes | EDYGFGVFTT | 86.71 | EDYGFGVFST | 11.38 | EDYGFGIFTT | 1.8 | | |
| NS1 | 932 | 0.66 | 4 | 3 | 0 | yes | DYGFGVFTTN | 86.71 | DYGFGVFSTN | 11.38 | DYGFGIFTTN | 1.8 | | |
| NS1 | 933 | 0.66 | 4 | 3 | 0 | yes | YGFGVFTTNI | 86.59 | YGFGVFSTNI | 11.38 | YGFGIFTTNI | 1.8 | | |
| NS1 | 934 | 0.66 | 5 | 3 | 0 | yes | GFGVFTTNIW | 86.59 | GFGVFSTNIW | 11.38 | GFGIFTTNIW | 1.8 | | |
| NS1 | 935 | 0.89 | 5 | 3 | 0 | yes | FGVFTTNIWL | 86.59 | FGVFSTNIWL | 11.38 | FGIFTTNIWL | 1.8 | | |
| NS1 | 936 | 0.89 | 6 | 4 | 0 | yes | GVFTTNIWLK | 82.75 | GVFSTNIWLK | 11.38 | GVFTTNIWLR | 3.83 | GIFTTNIWLK | 1.8 |
| NS1 | 937 | 1.63 | 6 | 4 | 0 | yes | VFTTNIWLKL | 82.75 | VFSTNIWLKL | 11.38 | VFTTNIWLRL | 3.83 | IFTTNIWLKL | 1.8 |
| NS1 | 938 | 1.67 | 7 | 5 | 0 | yes | FTTNIWLKLR | 46.83 | FSTNIWLKLR | 37.84 | FTTNIWLKLR | 11.38 | FTTNIWLRLK | 2.4 |
| NS1 | 939 | 1.51 | 6 | 5 | 0 | yes | TTNIWLKLRE | 46.35 | STNIWLKLRE | 37.84 | TTNIWLKLRE | 11.38 | TTNIWLRLKE | 2.4 |
| NS1 | 940 | 1.51 | 8 | 5 | 0 | yes | TNIWLKLREK | 57.6 | TNIWLKLKER | 31.74 | TNIWLKLKER | 6.11 | TNIWLRLKEK | 2.4 |
| NS1 | 941 | 1.52 | 9 | 5 | 0 | yes | NIWLKLREKQ | 57.49 | NIWLKLKERQ | 31.74 | NIWLKLKERQ | 6.11 | NIWLRLKEKQ | 2.4 |
| NS1 | 942 | 1.52 | 9 | 5 | 0 | yes | IWLKLREKQD | 57.49 | IWLKLKERQD | 31.74 | IWLKLKERQD | 6.11 | IWLRLKEKQD | 2.4 |
| NS1 | 953 | 0.31 | 6 | 2 | 0 | yes | FCDSKLMSAA | 96.53 | ICDSKLMSAA | 1.08 | VCDSKLMSAA | 0.6 | SCDSKLMSAA | 0.6 |
| NS1 | 954 | 0.27 | 6 | 2 | 0 | yes | CDSKLMSAAI | 96.29 | CDSKLMSAAV | 2.99 | | | LCDSKLMSAA | 0.48 |

FIG. 8-34

Species: DENV2 (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 955 | 0.27 | 6 | 2 | 0 | yes | DSKLMSAAIK | 96.29 | DSKLMSAAVK | 2.99 | | | | |
| NS1 | 956 | 0.33 | 8 | 3 | 0 | yes | SKLMSAAIKD | 95.57 | SKLMSAAVKD | 2.99 | SKLMSAAIKN | 0.6 | | |
| NS1 | 957 | 0.37 | 9 | 4 | 0 | yes | KLMSAAIKDN | 95.45 | KLMSAAVKDD | 1.68 | KLMSAAVKDN | 1.32 | KLMSAAIKNN | 0.6 |
| NS1 | 958 | 0.36 | 8 | 4 | 0 | yes | LMSAAIKDNR | 95.57 | LMSAAVKDDR | 1.68 | LMSAAVKDNR | 1.32 | LMSAAIKNNR | 0.6 |
| NS1 | 959 | 0.36 | 8 | 4 | 0 | yes | MSAAIKDNRA | 95.57 | MSAAVKDDRA | 1.68 | MSAAVKDNRA | 1.32 | MSAAIKNNRA | 0.6 |
| NS1 | 960 | 0.37 | 9 | 4 | 0 | yes | SAAIKDNRAV | 95.57 | SAAVKDDRAV | 1.68 | SAAVKDNRAV | 1.2 | SAAIKNNRAV | 0.6 |
| NS1 | 961 | 0.37 | 9 | 4 | 0 | yes | AAIKDNRAVH | 95.57 | AAVKDDRAVH | 1.68 | AAVKDNRAVH | 1.2 | AAIKNNRAVH | 0.6 |
| NS1 | 962 | 0.37 | 9 | 4 | 0 | yes | AIKDNRAVHA | 95.57 | AVKDDRAVHA | 1.68 | AVKDNRAVHA | 1.2 | AIKNNRAVHA | 0.6 |
| NS1 | 963 | 0.35 | 8 | 4 | 0 | yes | IKDNRAVHAD | 95.69 | VKDDRAVHAD | 1.68 | VKDNRAVHAD | 1.2 | IKNNRAVHAD | 0.6 |
| NS1 | 964 | 0.26 | 7 | 3 | 0 | yes | KDNRAVHADM | 96.89 | KDDRAVHADM | 1.68 | KNNRAVHADM | 0.6 | | |
| NS1 | 965 | 0.27 | 8 | 3 | 0 | yes | DNRAVHADMG | 96.77 | DDRAVHADMG | 1.68 | NNRAVHADMG | 0.6 | | |
| NS1 | 966 | 0.21 | 6 | 2 | 0 | yes | NRAVHADMGY | 97.49 | DRAVHADMGY | 1.68 | | | | |
| NS1 | 967 | 0.04 | 4 | 1 | 0 | yes | RAVHADMGYW | 99.64 | | | | | | |
| NS1 | 968 | 0.09 | 5 | 1 | 0 | yes | AVHADMGYWI | 99.04 | | | | | | |
| NS1 | 969 | 0.09 | 5 | 1 | 0 | yes | VHADMGYWIE | 99.04 | | | | | | |
| NS1 | 970 | 0.07 | 3 | 1 | 0 | yes | HADMGYWIES | 99.28 | | | | | | |
| NS1 | 971 | 0.24 | 6 | 3 | 0 | yes | ADMGYWIESA | 97.01 | ADMGYWIESR | 1.92 | ADMGYWMESA | 0.6 | | |
| NS1 | 972 | 0.25 | 7 | 3 | 0 | yes | DMGYWIESAL | 96.89 | DMGYWIESRL | 1.92 | DMGYWMESAL | 0.6 | | |
| NS1 | 973 | 0.25 | 7 | 3 | 0 | yes | MGYWIESALN | 96.89 | MGYWIESRLN | 1.92 | MGYWMESALN | 0.6 | | |
| NS1 | 974 | 0.27 | 8 | 3 | 0 | yes | GYWIESALND | 96.77 | GYWIESRLND | 1.92 | GYWMESALND | 0.6 | | |
| NS1 | 975 | 0.25 | 7 | 3 | 0 | yes | YWIESALNDT | 96.89 | YWIESRLNDT | 1.92 | YWMESALNDT | 0.6 | | |
| NS1 | 976 | 0.25 | 7 | 3 | 0 | yes | WIESALNDTW | 96.89 | WIESRLNDTW | 1.92 | WMESALNDTW | 0.6 | | |
| NS1 | 977 | 0.25 | 7 | 3 | 0 | yes | IESALNDTWK | 96.89 | IESRLNDTWK | 1.92 | MESALNDTWK | 0.6 | | |
| NS1 | 978 | 1.17 | 8 | 3 | 0 | yes | ESALNDTWKM | 54.49 | ESALNDTWKI | 42.99 | ESRLNDTWKM | 1.92 | | |
| NS1 | 979 | 1.17 | 8 | 3 | 0 | yes | SALNDTWKME | 54.49 | SALNDTWKIE | 42.99 | SRLNDTWKME | 1.92 | | |

FIG. 8-35

Species: DENV2 (10-mers)

| protein | block starting position | block entropy | total peptides in block | # peptides required to cover 99% of block | gap/λ fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 980 | 1.21 | 10 | 4 | 0 | yes | ALNDTWKMEK | 54.25 | ALNDTWKIEK | 42.75 | RLNDTWKMEK | 1.92 | ALNDTWKMER | 0.24 | | |
| NS1 | 981 | 1.05 | 6 | 2 | 0 | yes | LNDTWKMEKA | 56.41 | LNDTWKIEKA | 42.87 | | | | | | |
| NS1 | 982 | 1.05 | 6 | 2 | 0 | yes | NDTWKMEKAS | 56.41 | NDTWKIEKAS | 42.87 | | | | | | |
| NS1 | 983 | 1.05 | 6 | 2 | 0 | yes | DTWKMEKASF | 56.41 | DTWKIEKASF | 42.87 | | | | | | |
| NS1 | 984 | 1.04 | 5 | 2 | 0 | yes | TWKMEKASFI | 56.53 | TWKIEKASFI | 42.87 | | | | | | |
| NS1 | 985 | 1.04 | 5 | 2 | 0 | yes | WKMEKASFIE | 56.53 | WKIEKASFIE | 42.87 | | | | | | |
| NS1 | 986 | 1.32 | 7 | 3 | 0 | yes | KMEKASFIEV | 50.78 | KIEKASFIEV | 42.75 | KMEKASFIEI | 5.75 | | | | |
| NS1 | 987 | 1.32 | 7 | 3 | 0 | yes | MEKASFIEVK | 50.78 | IEKASFIEVK | 42.75 | MEKASFIEIK | 5.75 | | | | |
| NS1 | 988 | 1.25 | 6 | 3 | 0 | yes | EKASFIEVKS | 61.08 | EKASFIEVKN | 32.46 | EKASFIEIKS | 5.87 | | | | |
| NS1 | 989 | 1.25 | 6 | 3 | 0 | yes | KASFIEVKSC | 61.08 | KASFIEVKNC | 32.46 | KASFIEIKSC | 5.87 | | | | |
| NS1 | 990 | 1.34 | 6 | 4 | 0 | yes | ASFIEVKSCH | 59.64 | ASFIEVKNCH | 32.57 | ASFIEIKSCH | 5.75 | ASFIEVKSCY | 1.8 | | |
| NS1 | 991 | 1.34 | 6 | 4 | 0 | yes | SFIEVKSCHW | 59.64 | SFIEVKNCHW | 32.57 | SFIEIKSCHW | 5.75 | SFIEVKSCYW | 1.8 | | |
| NS1 | 992 | 1.35 | 7 | 4 | 0 | yes | FIEVKSCHWP | 59.64 | FIEVKNCHWP | 32.46 | FIEIKSCHWP | 5.75 | FIEVKSCYWP | 1.8 | | |
| NS1 | 993 | 1.41 | 10 | 5 | 0 | yes | IEVKSCHWPK | 59.16 | IEVKNCHWPK | 32.34 | IEIKSCHWPK | 5.75 | IEVKSCYWPR | 1.56 | IEVKSCHWPR | 0.48 |
| NS1 | 994 | 1.41 | 10 | 5 | 0 | yes | EVKSCHWPKS | 59.16 | EVKNCHWPKS | 32.34 | EIKSCHWPKS | 5.75 | EVKSCYWPRS | 1.56 | EVKSCHWPRS | 0.48 |
| NS1 | 995 | 1.42 | 11 | 5 | 0 | yes | VKSCHWPKSH | 59.04 | VKNCHWPKSH | 32.34 | IKSCHWPKSH | 5.75 | VKSCYWPRSH | 1.56 | VKSCHWPRSH | 0.48 |
| NS1 | 996 | 1.14 | 9 | 4 | 0 | yes | KSCHWPKSHT | 64.79 | KNCHWPKSHT | 32.34 | KSCYWPRSHT | 1.56 | KSCHWPRSHT | 0.48 | | |
| NS1 | 997 | 1.14 | 9 | 4 | 0 | yes | SCHWPKSHTL | 64.79 | NCHWPKSHTL | 32.34 | SCYWPRSHTL | 1.56 | SCHWPRSHTL | 0.48 | | |
| NS1 | 998 | 0.24 | 7 | 3 | 0 | yes | CHWPKSHTLW | 97.13 | CYWPRSHTLW | 1.56 | CHWPRSHTLW | 0.6 | | | | |
| NS1 | 999 | 0.24 | 7 | 3 | 0 | yes | HWPKSHTLWS | 97.13 | YWPRSHTLWS | 1.56 | HWPRSHTLWS | 0.6 | | | | |
| NS1 | 1000 | 0.19 | 5 | 2 | 0 | yes | WPKSHTLWSN | 97.49 | WPRSHTLWSN | 2.16 | | | | | | |
| NS1 | 1001 | 0.23 | 6 | 2 | 0 | yes | PKSHTLWSNG | 97.01 | PRSHTLWSNG | 2.16 | | | | | | |
| NS1 | 1002 | 0.22 | 5 | 2 | 0 | yes | KSHTLWSNGV | 97.13 | RSHTLWSNGV | 2.16 | | | | | |

FIG. 8-36

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1005 | 0.04 | 2 | 1 | 0 | yes | TLWSNGVLES | 99.52 | | | | | | |
| NS1 | 1006 | 0.04 | 2 | 1 | 0 | yes | LWSNGVLESE | 99.52 | | | | | | |
| NS1 | 1007 | 0.04 | 2 | 1 | 0 | yes | WSNGVLESEM | 99.52 | | | | | | |
| NS1 | 1008 | 0.25 | 3 | 2 | 0 | yes | SNGVLESEMI | 96.29 | SNGVLESEMV | 3.23 | | | | |
| NS1 | 1009 | 0.25 | 3 | 2 | 0 | yes | NGVLESEMII | 96.29 | NGVLESEMVI | 3.23 | | | | |
| NS1 | 1010 | 0.25 | 3 | 2 | 0 | yes | GVLESEMIIP | 96.29 | GVLESEMVIP | 3.23 | | | | |
| NS1 | 1011 | 0.21 | 2 | 2 | 0 | yes | VLESEMIIPK | 96.77 | VLESEMVIPK | 3.23 | | | | |
| NS1 | 1012 | 0.61 | 5 | 3 | 0 | yes | LESEMIIPKS | 89.46 | LESEMVIPKN | 6.71 | | | | |
| NS1 | 1018 | 1.36 | 8 | 4 | 0 | yes | IPKNFAGPVS | 57.6 | IPKNLAGPVS | 34.49 | IPKSF

FIG. 8-37

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1037 | 1.04 | 5 | 3 | 0 | yes | TQTAGPWHLG | 67.78 | TQJAGPWHLG | 29.94 | TQJTGPWHLG | 2.04 | | | | |
| NS1 | 1038 | 1.19 | 6 | 4 | 0 | yes | QTAGPWHLGK | 65.27 | QIAGPWHLGK | 29.94 | QTAGPWHLGR | 2.51 | QITGPWHLGK | 2.04 | | |
| NS1 | 1039 | 1.19 | 6 | 4 | 0 | yes | TAGPWHLGKL | 65.27 | IAGPWHLGKL | 29.94 | TAGPWHLGRL | 2.51 | ITGPWHLGKL | 2.04 | | |
| NS1 | 1040 | 0.33 | 4 | 3 | 0 | yes | AGPWHLGKLE | 95.33 | AGPWHLGRLE | 2.51 | TGPWHLGKLE | 2.04 | | | | |
| NS1 | 1041 | 0.21 | 5 | 2 | 0 | yes | GPWHLGKLEM | 97.13 | GPWHLGRLEM | 2.4 | | | | | | |
| NS1 | 1042 | 0.21 | 5 | 2 | 0 | yes | PWHLGKLEMD | 97.13 | PWHLGRLEMD | 2.4 | | | | | | |
| NS1 | 1043 | 0.21 | 5 | 2 | 0 | yes | WHLGKLEMDF | 97.13 | WHLGRLEMDF | 2.4 | | | | | | |
| NS1 | 1044 | 0.42 | 8 | 4 | 0 | yes | HLGKLEMDFD | 94.49 | HLGRLEMDFE | 2.4 | HLGKLEMDFE | 1.68 | HLGKLEMDFN | 0.84 | | |
| NS1 | 1045 | 0.94 | 9 | 5 | 0 | yes | LGKLEMDFDF | 82.28 | LGRLEMDFDL | 12.22 | LGKLEMDFDL | 2.4 | LGKLEMDFEF | 1.68 | LGKLEMDFNF | 0.84 |
| NS1 | 1046 | 0.94 | 9 | 5 | 0 | yes | GKLEMDFDFC | 82.28 | GRLEMDFDLC | 12.22 | GKLEMDFDLC | 2.4 | GKLEMDFEFC | 1.68 | GKLEMDFNFC | 0.84 |
| NS1 | 1047 | 1.6 | 9 | 5 | 0 | yes | LEMDFDFCEG | 53.41 | LEMDFDCEG | 31.26 | LEMDFDLCEG | 12.22 | LEMDFEFCEG | 1.68 | LEMDFNFCDG | 0.48 |
| NS1 | 1048 | 1.6 | 9 | 5 | 0 | yes | EMDFDFCDGT | 53.41 | EMDFDCDGT | 31.26 | EMDFDLCEGT | 12.22 | EMDFEFCEGT | 1.68 | EMDFNFCDGT | 0.48 |
| NS1 | 1049 | 1.6 | 9 | 5 | 0 | yes | MDFDFCEGTT | 53.41 | MDFDFCDGTT | 31.26 | MDFDLCEGTT | 12.22 | MDFEFCEGTT | 1.68 | MDFNFCDGTT | 0.48 |
| NS1 | 1050 | 1.59 | 8 | 5 | 0 | yes | DFDFCEGTTV | 55.69 | DFDFCDGTTV | 31.26 | DFDLCEGTTV | 12.22 | DFEFCEGTTV | 1.68 | DFNFCEGTTV | 0.6 |
| NS1 | 1051 | 1.67 | 6 | 4 | 0 | yes | FCEGTTVVVT | 67.9 | FCDGTTVVVT | 22.63 | LCEGTTVVVT | 12.46 | FCDGTTVVVT | 8.86 | | |
| NS1 | 1054 | 1.23 | 6 | 3 | 0 | yes | CEGTTVVVTE | 65.87 | CDGTTVVVTE | 22.63 | CDGTTVVVTE | 8.86 | | | | |
| NS1 | 1055 | 1.38 | 9 | 5 | 0 | yes | EGTTVVVTED | 74.73 | EGTTVVVTED | 22.63 | DGTTVVVTED | 8.86 | EGTTVVVTEE | 1.44 | EGTTVVVTEN | 0.48 |
| NS1 | 1056 | 0.99 | 8 | 4 | 0 | yes | GTTVVVTEDC | 74.73 | GTTVVVTEDC | 22.63 | GTTVVVTEEC | 1.44 | GTTVVVTENC | 0.48 | | |
| NS1 | 1057 | 0.99 | 8 | 4 | 0 | yes | TTVVVTEDCG | 74.73 | TTVVVTEDCG | 22.63 | TTVVVTEEGG | 1.44 | TTVVVTENCG | 0.48 | | |
| NS1 | 1058 | 0.99 | 8 | 4 | 0 | yes | TVVVTEDCGN | 74.73 | TVVVTEDCGN | 22.63 | TVVVTEEGN | 1.44 | TVVVTENCGN | 0.48 | | |
| NS1 | 1059 | 0.99 | 8 | 4 | 0 | yes | VVVTEDCGNR | 74.73 | VVVTEEDCGNR | 22.63 | VVVTEEGNR | 1.44 | VVVTENCGNR | 0.48 | | |
| NS1 | 1060 | 0.99 | 8 | 4 | 0 | yes | VVTEDCGNRG | 74.73 | VVTEEDCGNRG | 22.63 | VVTEECGNRG | 1.44 | VVTENCGNRG | 0.48 | | |
| NS1 | 1061 | 0.99 | 8 | 4 | 0 | yes | VTEDCGNRGP | 97.49 | VTEDCGNRGP | 1.44 | VTEECGNRGP | 1.44 | | | | |
| NS1 | 1062 | 0.21 | 6 | 3 | 0 | yes | TEDCGNRGPS | 97.49 | TEECGNRGPS | 1.44 | TENCGNRGPS | 0.48 | | | | |
| NS1 | 1063 | 0.21 | 6 | 3 | 0 | yes | EDCGNRGPSL | 97.49 | EECGNRGPSL | 1.44 | ENCGNRGPSL | 0.48 | | | | |
| NS1 | 1064 | 0.21 | 6 | 3 | 0 | yes | | | | | | | | | | |

FIG. 8-39

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 1090 | 0 | 1 | 1 | 0 | yes | SCTLPPLRYR | 100 | | |
| NS1 | 1091 | 0 | 1 | 1 | 0 | yes | CTLPPLRYRG | 100 | | |
| NS1 | 1092 | 0.03 | 2 | 1 | 0 | yes | TLPPLRYRGE | 99.64 | | |
| NS1 | 1093 | 0.05 | 3 | 1 | 0 | yes | LPPLRYRGED | 99.52 | | |
| NS1 | 1094 | 0.05 | 3 | 1 | 0 | yes | PPLRYRGEDG | 99.52 | | |
| NS1 | 1095 | 0.05 | 3 | 1 | 0 | yes | PLRYRGEDGC | 99.52 | | |
| NS1 | 1096 | 0.05 | 3 | 1 | 0 | yes | LRYRGEDGCW | 99.52 | | |
| NS1 | 1097 | 0.05 | 3 | 1 | 0 | yes | RYRGEDGCWY | 99.52 | | |
| NS1 | 1098 | 0.05 | 3 | 1 | 0 | yes | YRGEDGCWYG | 99.52 | | |
| NS1 | 1099 | 0.05 | 3 | 1 | 0 | yes | RGEDGCWYGM | 99.52 | | |
| NS1 | 1100 | 0.05 | 3 | 1 | 0 | yes | GEDGCWYGME | 99.52 | | |
| NS1 | 1101 | 0.05 | 3 | 1 | 0 | yes | EDGCWYGMEI | 99.52 | | |
| NS1 | 1102 | 0.01 | 2 | 1 | 0 | yes | DGCWYGMEIR | 99.88 | | |
| NS1 | 1103 | 0 | 1 | 1 | 0 | yes | GCWYGMEIRP | 100 | | |
| NS1 | 1104 | 0 | 1 | 1 | 0 | yes | CWYGMEIRPL | 100 | | |
| NS1 | 1105 | 0.02 | 2 | 2 | 0 | yes | WYGMEIRPLK | 99.76 | | |
| NS1 | 1106 | 0.02 | 2 | 2 | 0 | yes | YGMEIRPLKE | 99.76 | | |
| NS1 | 1107 | 0.11 | 3 | 2 | 0 | yes | GMEIRPLKEK | 98.68 | GMEIRPLKER | 1.08 |
| NS1 | 1108 | 0.11 | 3 | 2 | 0 | yes | MEIRPLKEKE | 98.68 | MEIRPLKERE | 1.08 |
| NS1 | 1109 | 0.11 | 3 | 2 | 0 | yes | EIRPLKEKEE | 98.68 | EIRPLKEREE | 1.08 |
| NS1 | 1110 | 0.12 | 4 | 2 | 0 | yes | IRPLKEKEEN | 98.56 | IRPLKEREEN | 1.08 |
| NS1 | 1111 | 0.12 | 4 | 2 | 0 | yes | RPLKEKEENL | 98.56 | RPLKEREENL | 1.08 |
| NS1 | 1112 | 0.14 | 5 | 2 | 0 | yes | PLKEKEENLV | 98.44 | PLKEREENLV | 1.08 |
| NS1 | 1113 | 0.3 | 6 | 3 | 0 | yes | LKEKEENLVN | 96.05 | LKEREENLVN | 2.4 |
| NS1 | 1114 | 0.3 | 6 | 3 | 0 | yes | KEKEENLVNS | 96.05 | KEREENLVNS | 2.4 |

| peptides required to cover 99% of block | frequency |
|---|---|
| | |
| | |
| | |
| | |
| | |
| | |
| | |
| | |
| | |
| | |
| | |
| | |
| | |
| | |
| | |
| | |
| | |
| | |
| | |
| | |
| | |
| | |
| | |
| LKEREENLVN | 1.08 |
| KEREENLVNS | 1.08 |

FIG. 8-40

Species: DENV2 (10-mers)

| protein | block starting position | block entropy | total peptides in block | # peptides required to cover 99% of block | gap/X fraction | 66% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1115 | 0.28 | 5 | 3 | 0 | yes | EKEENLVNSL | 96.29 | EKEENLVSSL | 2.4 | EREENLVNSL | 1.08 | | |
| NS1 | 1116 | 0.28 | 5 | 3 | 0 | yes | KEENLVNSLV | 96.29 | KEENLVSSLV | 2.4 | REENLVNSLV | 1.08 | | |
| NS1 | 1117 | 0.19 | 4 | 2 | 0 | yes | EENLVNSLVT | 97.37 | EENLVSSLVT | 2.4 | | | | |
| NS1 | 1118 | 0.19 | 4 | 2 | 0 | yes | ENLVNSLVTA | 97.37 | ENLVSSLVTA | 2.4 | | | | |
| NS1 | 1119 | 0.19 | 4 | 3 | 0 | yes | NLVNSLVTAG | 97.37 | NLVSSLVTAG | 2.4 | | | | |
| NS1 | 1120 | 0.32 | 8 | 3 | 0 | yes | LVNSLVTAGH | 95.93 | LVSSLVTAGH | 2.4 | LVNSLVTAGQ | 0.72 | | |
| NS1 | 1121 | 0.32 | 8 | 3 | 0 | yes | VNSLVTAGHG | 95.93 | VSSLVTAGHG | 2.4 | VNSLVTAGQG | 0.72 | | |
| NS1 | 1122 | 0.32 | 8 | 3 | 0 | yes | NSLVTAGHGQ | 95.93 | SSLVTAGHGQ | 2.4 | NSLVTAGQGQ | 0.72 | | |
| NS1 | 1123 | 1.04 | 8 | 3 | 0 | yes | SLVTAGHGQI | 67.19 | SLVTAGHGQV | 31.26 | SLVTAGQGQV | 0.6 | | |
| NS1 | 1124 | 1.04 | 8 | 3 | 0 | yes | LVTAGHGQID | 67.19 | LVTAGHGQVD | 31.26 | LVTAGQGQVD | 0.6 | | |
| NS1 | 1125 | 1.04 | 8 | 3 | 0 | yes | VTAGHGQIDN | 67.19 | VTAGHGQVDN | 31.26 | VTAGQGQVDN | 0.6 | | |
| NS1 | 1126 | 1.04 | 8 | 3 | 0 | yes | TAGHGQIDNF | 67.19 | TAGHGQVDNF | 31.26 | TAGQGQVDNF | 0.6 | | |
| NS1 | 1127 | 1.04 | 8 | 3 | 0 | yes | AGHGQIDNFS | 67.19 | AGHGQVDNFS | 31.26 | AGQGQVDNFS | 0.6 | | |
| NS1 | 1128 | 1.04 | 8 | 3 | 0 | yes | GHGQIDNFSL | 67.19 | GHGQVDNFSL | 31.26 | GQGQVDNFSL | 0.6 | | |
| NS1 | 1129 | 1.04 | 8 | 3 | 0 | yes | HGQIDNFSLG | 67.19 | HGQVDNFSLG | 31.26 | QGQVDNFSLG | 0.6 | | |
| NS1 | 1130 | 1.19 | 5 | 2 | 0 | yes | GQIDNFSLGV | 62.99 | GQVDNFSLGV | 31.62 | GQIDNFSLGI | 5.03 | | |
| NS2A | 1131 | 1.21 | 6 | 2 | 0 | yes | QIDNFSLGVL | 62.87 | QVDNFSLGVL | 31.62 | QIDNFSLGIL | 5.03 | | |
| NS2A | 1132 | 1.2 | 5 | 2 | 0 | yes | IDNFSLGVLG | 62.87 | VDNFSLGVLG | 31.62 | IDNFSLGILG | 5.15 | | |
| NS2A | 1133 | 0.37 | 6 | 3 | 0 | yes | DNFSLGVLGM | 94.01 | DNFSLGILGM | 5.39 | | | | |
| NS2A | 1134 | 0.37 | 6 | 2 | 0 | yes | NFSLGVLGMA | 94.01 | NFSLGILGMA | 5.39 | | | | |
| NS2A | 1135 | 0.37 | 6 | 2 | 0 | yes | FSLGVLGMAL | 94.01 | FSLGILGMAL | 5.39 | | | | |
| NS2A | 1136 | 0.47 | 8 | 4 | 0 | yes | SLGVLGMALF | 93.41 | SLGILGMALF | 3.71 | SLGILGMALL | 1.68 | SLGVLGMALL | 0.6 |
| NS2A | 1137 | 0.47 | 8 | 4 | 0 | yes | LGVLGMALFL | 93.41 | LGILGMALFL | 3.71 | LGILGMALLL | 1.68 | LGVLGMALLL | 0.6 |
| NS2A | 1138 | 0.47 | 8 | 4 | 0 | yes | GVLGMALFLE | 93.41 | GILGMALFLE | 3.71 | GILGMALLLE | 1.68 | GVLGMALLLE | 0.6 |
| NS2A | 1139 | 0.47 | 8 | 4 | 0 | yes | VLGMALFLEE | 93.41 | ILGMALFLEE | 3.71 | ILGMALLLEE | 1.68 | VLGMALLLEE | 0.6 |

FIG. 8-41

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1140 | 0.22 | 6 | 2 | 0 | yes | LGMAFLEEM | 97.13 | LGMALLLEEM | 2.28 | | | | |
| NS2A | 1141 | 0.21 | 5 | 2 | 0 | yes | GMALFLEEML | 97.25 | GMALLLEEML | 2.28 | | | | |
| NS2A | 1142 | 0.26 | 6 | 3 | 0 | yes | MALFLEEMLR | 96.65 | MALLLEEMLR | 2.28 | MALFLEEMLK | 0.6 | | |
| NS2A | 1143 | 0.22 | 4 | 2 | 0 | yes | ALFLEEMLRT | 97.01 | ALLLEEMLRT | 2.28 | | | | |
| NS2A | 1144 | 0.21 | 3 | 2 | 0 | yes | LFLEEMLRTR | 97.13 | LLLEEMLRTR | 2.28 | | | | |
| NS2A | 1145 | 0.99 | 6 | 4 | 0 | yes | FLEEMLRTRV | 75.33 | FLEEMLRTRI | 21.56 | LLEEMLRTRV | 1.68 | FLEEMLKTRV | 0.6 |
| NS2A | 1146 | 0.84 | 4 | 3 | 0 | yes | LEEMLRTRVG | 77.01 | LEEMLRTRIG | 22.16 | | | | |
| NS2A | 1147 | 0.87 | 6 | 3 | 0 | yes | EEMLRTRVGT | 76.77 | EEMLRTRIGT | 22.04 | | | | |
| NS2A | 1148 | 0.87 | 6 | 3 | 0 | yes | EMLRTRVGTK | 76.77 | EMLRTRIGTK | 22.04 | | | | |
| NS2A | 1149 | 0.89 | 6 | 3 | 0 | yes | MLRTRVGTKH | 76.65 | MLRTRIGTKH | 21.92 | | | | |
| NS2A | 1150 | 0.93 | 8 | 4 | 0 | yes | LRTRVGTKHA | 76.41 | LRTRIGTKHA | 21.8 | LKTRVGTKHV | 0.6 | LRTRVGTKHV | 0.24 |
| NS2A | 1166 | 0.34 | 10 | 4 | 0 | yes | SFVTLITGNM | 95.81 | SFMTLITGNM | 2.4 | SLVTLITGNM | 0.72 | SFTLITGNM | 0.36 |
| NS2A | 1167 | 0.33 | 9 | 4 | 0 | yes | FVTLITGNMS | 95.81 | FMTLITGNMS | 2.4 | LVTLITGNMS | 0.72 | FLTLITGNMS | 0.36 |
| NS2A | 1168 | 0.31 | 8 | 4 | 0 | yes | VTLITGNMSF | 96.17 | MTLITGNMSF | 2.4 | LTLITGNMSF | 0.36 | VTLITGNLSF | 0.24 |
| NS2A | 1169 | 1.01 | 11 | 4 | 0 | yes | TLITGNMSFR | 67.31 | TLITGNMSFK | 31.62 | TLITGNLSFK | 0.24 | | |
| NS2A | 1170 | 1 | 10 | 3 | 0 | yes | LITGNMSFRD | 67.31 | LITGNMSFKD | 31.74 | | | | |
| NS2A | 1171 | 1 | 10 | 2 | 0 | yes | ITGNMSFRDL | 67.31 | ITGNMSFKDL | 31.74 | | | | |
| NS2A | 1172 | 1 | 9 | 2 | 0 | yes | TGNMSFRDLG | 67.31 | TGNMSFKDLG | 31.74 | | | | |
| NS2A | 1173 | 0.99 | 9 | 2 | 0 | yes | GNMSFRDLGR | 67.43 | GNMSFKDLGR | 31.74 | | | | |
| NS2A | 1174 | 1 | 9 | 2 | 0 | yes | NMSFRDLGRV | 67.31 | NMSFKDLGRV | 31.74 | | | | |
| NS2A | 1178 | 1.15 | 11 | 5 | 0 | yes | RDLGRVVMV | 66.95 | KDLGRVVMV | 29.82 | RDLGRVIIMV | 1.56 | RDLGRVVMV | 0.48 |
| NS2A | 1179 | 1.08 | 8 | 3 | 0 | yes | DLGRVVMVG | 67.19 | DLGRVVMVG | 30.3 | DLGRVIIMVG | 1.8 | LGRVWMVGT | 0.36 |
| NS2A | 1180 | 1.13 | 10 | 4 | 0 | yes | LGRVVMVGA | 66.95 | LGRVIIMVGA | 1.8 | LGRVWMVGA | 1.08 | | |
| NS2A | 1192 | 1.06 | 10 | 5 | 0 | yes | TDDIGMGVTY | 76.17 | TDEMGMGVTY | 19.28 | TDDIGMGITY | 2.04 | TDDIGMGITY | 1.08 |
| NS2A | 1193 | 0.36 | 7 | 4 | 0 | yes | DDIGMGVTYL | 95.45 | DEMGMGVTYL | 2.04 | DDIGIGVTYL | 0.72 | | |

FIG. 8-42

Species: DENV2 (10-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | pe

FIG. 8-43

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1219 | 0.21 | 6 | 3 | 0 | yes | LLRKLTSKEL | 97.49 | FLRKLTSKEL | 1.44 | LLRKLTSKEL | 0.48 | | | | |
| NS2A | 1220 | 0.21 | 5 | 2 | 0 | yes | LRKLTSKELM | 97.37 | LRKLTSKELL | 1.68 | | | | | | |
| NS2A | 1221 | 0.21 | 5 | 2 | 0 | yes | RKLTSKELMM | 97.37 | RKLTSKELLM | 1.68 | | | | | | |
| NS2A | 1222 | 1.16 | 7 | 3 | 0 | yes | KLTSKELMMA | 55.21 | KLTSKELMMT | 42.4 | KLTSKELLMA | 1.68 | | | | |
| NS2A | 1223 | 1.13 | 6 | 3 | 0 | yes | LTSKELMMAT | 55.33 | LTSKELMMTT | 42.63 | LTSKELLMAT | 1.56 | | | | |
| NS2A | 1224 | 1.13 | 6 | 3 | 0 | yes | TSKELMMATI | 55.33 | TSKELMMTTI | 42.63 | TSKELLMATI | 1.56 | | | | |
| NS2A | 1225 | 1.13 | 6 | 3 | 0 | yes | SKELMMATIG | 55.33 | SKELMMTTIG | 42.63 | SKELLMATIG | 1.56 | | | | |
| NS2A | 1226 | 1.23 | 8 | 4 | 0 | yes | KELMMATIGI | 54.49 | KELMMTTIGI | 42.16 | KELMMATIGV | 1.56 | KELMMATIGV | 1.56 | | |
| NS2A | 1232 | 1.37 | 8 | 5 | 0 | yes | TIGIALLSQS | 51.86 | TIGIVLLSQS | 42.16 | TIGTLLSQS | 2.63 | TIGWLLSQS | 2.04 | TIGVALLSQS | 0.84 |
| NS2A | 1244 | 1.03 | 9 | 5 | 0 | yes | PETILELTDA | 75.93 | PETVLELTDA | 20.36 | PGTVLELTDA | 1.68 | PESILELTDA | 1.32 | PENILELTDA | 0.6 |
| NS

FIG. 8-44

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1283 | 0.59 | 11 | 5 | 0 | yes | PNAVILQNAW | 92.1 | PNAVILRNAW | 2.99 | PNVMILQHAW | 1.68 | PNAVILLNAW | 1.44 | PNAVILQHAW | 1.08

FIG. 8-45

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---

FIG. 8-46

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS2B | 1351 | 0.56 | 2 | 2 | 0 | yes | EAIMAVGMVS | 86.95 | EAVMAVGMVS | 13.05 |
| NS2B | 1352 | 0.56 | 2 | 2 | 0 | yes | AIMAVGMVSI | 86.95 | AVMAVGMVSI | 13.05 |
| NS2B | 1353 | 0.56 | 2 | 2 | 0 | yes | IMAVGMVSIL | 86.95 | VMAVGMVSIL | 13.05 |
| NS2B | 1354 | 0 | 1 | 1 | 0 | yes | MAVGMVSILA | 100 | | |
| NS2B | 1355 | 0 | 1 | 1 | 0 | yes | AVGMVSILAS | 100 | | |
| NS2B | 1356 | 0 | 1 | 1 | 0 | yes | VGMVSILASS | 100 | | |
| NS2B | 1357 | 0 | 1 | 1 | 0 | yes | GMVSILASSL | 100 | | |
| NS2B | 1358 | 0 | 1 | 1 | 0 | yes | MVSILASSLL | 100 | | |
| NS2B | 1359 | 0 | 1 | 1 | 0 | yes | VSILASSLLK | 100 | | |
| NS2B | 1360 | 0.01 | 2 | 1 | 0 | yes | SILASSLLKN | 99.88 | | |
| NS2B | 1361 | 0.01 | 2 | 1 | 0 | yes | ILASSLLKND | 99.88 | | |
| NS2B | 1362 | 0.06 | 4 | 1 | 0 | yes | LASSLLKNDI | 99.4 | | |
| NS2B | 1363 | 0.06 | 4 | 1 | 0 | yes | ASSLLKNDIP | 99.4 | | |
| NS2B | 1364 | 0.06 | 4 | 1 | 0 | yes | SSLLKNDIPM | 99.4 | | |
| NS2B | 1365 | 0.06 | 4 | 1 | 0 | yes | SLLKNDIPMT | 99.4 | | |
| NS2B | 1366 | 0.06 | 4 | 1 | 0 | yes | LLKNDIPMTG | 99.4 | | |
| NS2B | 1367 | 0.06 | 4 | 1 | 0 | yes | LKNDIPMTGP | 99.4 | | |
| NS2B | 1368 | 0.08 | 5 | 1 | 0 | yes | KNDIPMTGPL | 99.28 | | |
| NS2B | 1369 | 0.06 | 4 | 1 | 0 | yes | NDIPMTGPLV | 99.4 | | |
| NS2B | 1370 | 0.06 | 4 | 1 | 0 | yes | DIPMTGPLVA | 99.4 | | |
| NS2B | 1371 | 0.01 | 2 | 1 | 0 | yes | IPMTGPLVAG | 99.4 | | |
| NS2B | 1372 | 0.01 | 2 | 1 | 0 | yes | PMTGPLVAGG | 99.88 | | |
| NS2B | 1373 | 0.03 | 3 | 1 | 0 | yes | MTGPLVAGGL | 99.76 | | |
| NS2B | 1374 | 0.03 | 3 | 1 | 0 | yes | TGPLVAGGLL | 99.76 | | |
| NS2B | 1375 | 0.03 | 3 | 1 | 0 | yes | GPLVAGGLLT | 99.76 | | |

FIG. 8-47

Species: DENV2 (10-mers)

| protein | block starting position | block entropy | total

FIG. 8-48

Species: DENV2 (10-mers)

| protein | block starting position | block entropy | total peptides in block | # peptides required to cover 99% of block | gap/X fraction | 99% of block covered w/ <= 5 peptides?

FIG. 8-49

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1434 | 0.53 | 4 | 3 | 0 | yes | EEEEQ

FIG. 8-50

Species: DENV2 (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1459 | 0.15 | 6 | 2 | 0.12 | yes | IPITAAAWYL | 98.32 | MPITAAAWYL | 0.6 | | | | |
| NS2B | 1460 | 0.08 | 4 | 1 | 0 | yes | PITAAAWYLW | 99.16 | | | | | | |
| NS2B | 1461 | 0.08 | 4 | 1 | 0 | yes | IT

FIG. 8-51

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1492 | 0.06 | 4 | 1 | 0 | yes | ELEDGAYRIK | 99.4 | | | | | | |
| NS3 | 1493 | 0.05 | 3 | 1 | 0 | yes | LEDGAYRIKQ | 99.52 | | | | | | |
| NS3 | 1494 | 1.04 | 4 | 2 | 0 | yes | EDGAYRIKQR | 51.38 | EDGAYRIKQK | 48.14 | | | | |
| NS3 | 1495 | 1.07 | 5 | 2 | 0 | yes | DGAYRIKQRG | 51.38 | DGAYRIKQKG | 47.78 | | | | |
| NS3 | 1496 | 1.08 | 6 | 2 | 0 | yes | GAYRIKQRGI | 51.38 | GAYRIKQKGI | 47.66 | | | | |
| NS3 | 1497 | 1.52 | 8 | 4 | 0 | yes | AYRIKQRGIL | 47.19 | AYRIKQKGIL | 40 | AYRIKQRGIF | 11.38 | AYRIKQKGIF | 0.48 |
| NS3 | 1498 | 1.5 | 7 | 4 | 0 | yes | YRIKQRGILG | 47.19 | YRIKQKGILG | 40.12 | YRIKQRGIFG | 11.38 | YRIKQKGIFG | 0.48 |
| NS3 | 1499 | 1.53 | 9 | 5 | 0 | yes | RIKQRGILGY | 47.07 | RIKQKGILGY | 40.12 | RIKQRGIFGY | 11.26 | RIKQKGIFGY | 0.48 |
| NS3 | 1500 | 1.53 | 9 | 5 | 0 | yes | IKQRGILGYS | 47.07 | IKQKGILGYS | 40.12 | IKQRGIFGYS | 11.26 | IKQKGIFGYS | 0.48 |
| NS3 | 1501 | 1.53 | 9 | 5 | 0 | yes | KQRGILGYSQ | 47.07 | KQKGILGYSQ | 40.12 | KQRGIFGYSQ | 11.26 | KQKGIFGYSQ | 0.48 |
| NS3 | 1502 | 1.53 | 9 | 5 | 0 | yes | QRGILGYSQI | 47.07 | QKGILGYSQI | 40.12 | QRGIFGYSQI | 11.26 | QKGIFGYSQI | 0.48 |
| NS3 | 1503 | 1.53 | 9 | 5 | 0 | yes | RGILGYSQIG | 47.07 | KGILGYSQIG | 40.12 | RGIFGYSQIG | 11.26 | KGIFGYSQIG | 0.48 |
| NS3 | 1504 | 0.65 | 9 | 3 | 0 | yes | GILGYSQIGA | 86.95 | GIFGYSQIGA | 11.74 | RILGYSQIGA | 0.36 | | |
| NS3 | 1505 | 0.62 | 8 | 2 | 0 | yes | ILGYSQIGAG | 87.31 | IFGYSQIGAG | 11.74 | | | | |
| NS3 | 1506 | 0.57 | 6 | 2 | 0 | yes | LGYSQIGAGV | 87.78 | FGYSQIGAGV | 11.74 | | | | |
| NS3 | 1507 | 0.05 | 4 | 1 | 0 | yes | GYSQIGAGVY | 99.52 | | | | | | |
| NS3 | 1508 | 0.09 | 5 | 1 | 0 | yes | YSQIGAGVYK | 99.04 | | | | | | |
| NS3 | 1509 | 0.07 | 4 | 1 | 0 | yes | SQIGAGVYKE | 99.28 | | | | | | |
| NS3 | 1510 | 0.07 | 4 | 1 | 0 | yes | QIGAGVYKEG | 99.28 | | | | | | |
| NS3 | 1511 | 0.07 | 4 | 1 | 0 | yes | IGAGVYKEGT | 99.28 | | | | | | |
| NS3 | 1512 | 0.07 | 4 | 1 | 0 | yes | GAGVYKEGTF | 99.28 | | | | | | |
| NS3 | 1513 | 0.07 | 4 | 1 | 0 | yes | AGVYKEGTFH | 99.28 | | | | | | |
| NS3 | 1514 | 0.04 | 2 | 1 | 0 | yes | GVYKEGTFHT | 99.52 | | | | | | |
| NS3 | 1515 | 0.06 | 3 | 1 | 0 | yes | VYKEGTFHTM | 99.4 | | | | | | |
| NS3 | 1516 | 0.06 | 3 | 1 | 0 | yes | YKEGTFHTMW | 99.4 | | | | | | |

FIG. 8-52

Species: DENV2 (10-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1517 | 0.06 | 3 | 1 | 0 | yes | KEGTFHTMWH | 99.4 | | | | | | |
| NS3 | 1518 | 0.01 | 2 | 1 | 0 | yes | EGTFHTMWHV | 99.88 | | | | | | |
| NS3 | 1519 | 0.01 | 2 | 1 | 0 | yes | GTFHTMWHVT | 99.88 | | | | | | |
| NS3 | 1520 | 0.01 | 2 | 1 | 0 | yes | TFHTMWHVTR | 99.88 | | | | | | |
| NS3 | 1521 | 0.01 | 2 | 1 | 0 | yes | FHTMWHVTRG | 99.88 | | | | | | |
| NS3 | 1522 | 0.01 | 2 | 1 | 0 | yes | HTMWHVTRGA | 99.88 | | | | | | |
| NS3 | 1523 | 0.01 | 2 | 1 | 0 | yes | TMWHVTRGAV | 99.88 | | | | | | |
| NS3 | 1524 | 0.01 | 3 | 1 | 0 | yes | MWHVTRGAVL | 99.88 | | | | | | |
| NS3 | 1525 | 0.23 | 3 | 3 | 0 | yes | WHVTRGAVLM | 96.89 | WHVTRGAVLV | 1.68 | WHVTRGAVLT | 1.68 | | |
| NS3 | 1526 | 0.23 | 3 | 3 | 0 | yes | HVTRGAVLMH | 96.89 | HVTRGAVLVH | 1.68 | HVTRGAVLTH | 1.68 | | |
| NS3 | 1527 | 1.19 | 4 | 4 | 0 | yes | VTRGAVLMHK | 54.97 | VTRGAVLVHK | 41.92 | VTRGAVLVHK | 1.68 | VTRGAVLTHK | 1.44 |
| NS3 | 1528 | 1.19 | 4 | 4 | 0 | yes | TRGAVLMHKG | 54.97 | TRGAVLVHKG | 41.92 | TRGAVLVHKG | 1.68 | TRGAVLTHKG | 1.44 |
| NS3 | 1529 | 1.19 | 4 | 4 | 0 | yes | RGAVLMHKGK | 54.97 | RGAVLVHKGK | 41.92 | RGAVLVHKGK | 1.68 | RGAVLTHKGK | 1.44 |
| NS3 | 1530 | 1.19 | 6 | 4 | 0 | yes | GAVLMHKGKR | 54.97 | GAVLVHKGKR | 41.92 | GAVLVHKGKR | 1.68 | GAVLTHKGKR | 1.44 |
| NS3 | 1531 | 1.21 | 6 | 4 | 0 | yes | AVLMHKGKRI | 54.85 | AVLVHKGKRI | 41.8 | AVLYHKGKRI | 1.68 | AVLTHKGKRI | 1.44 |
| NS3 | 1532 | 1.21 | 6 | 4 | 0 | yes | VLMHKGKRIE | 54.85 | VLVHKGKRIE | 41.8 | VLYHKGKRIE | 1.68 | VLTHKGKRIE | 1.44 |
| NS3 | 1533 | 1.21 | 7 | 4 | 0 | yes | LMHKGKRIEP | 54.85 | LVHKGKRIEP | 41.8 | LVHKGKRIEP | 1.68 | LTHKGKRIEP | 1.44 |
| NS3 | 1534 | 1.26 | 5 | 4 | 0 | yes | MHKGKRIEPS | 54.85 | VHKGKRIEPS | 41.2 | VHKGKRIEPS | 1.68 | THKGKRIEPS | 1.44 |
| NS3 | 1535 | 1.06 | 5 | 2 | 0 | yes | HKGKRIEPSW | 54.85 | HKGKRIEPSW | 44.31 | | | | |
| NS3 | 1536 | 1.06 | 4 | 2 | 0 | yes | KGKRIEPSWA | 54.85 | KGKRIEPSWA | 44.31 | | | | |
| NS3 | 1537 | 0.08 | 4 | 1 | 0 | yes | GKRIEPSWAD | 99.16 | | | | | | |
| NS3 | 1538 | 0.08 | 5 | 1 | 0 | yes | KRIEPSWADV | 99.16 | | | | | | |
| NS3 | 1539 | 0.17 | 5 | 2 | 0 | yes | RIEPSWADVK | 97.96 | RIEPSWADVR | 1.2 | | | | |
| NS3 | 1540 | 0.17 | 5 | 2 | 0 | yes | IEPSWADVKK | 97.96 | IEPSWADVRK | 1.2 | | | | |
| NS3 | 1541 | 0.15 | 3 | 2 | 0 | yes | EPSWADVKKD | 98.2 | EPSWADVRKD | 1.2 | | | | |

FIG. 8-53

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1542 | 0.15 | 3 | 2 | 0 | yes | PSWADVKKDL | 98.2 | PSWADVRKDL | 1.2 | | | | |
| NS3 | 1543 | 0.24 | 4 | 3 | 0 | yes | SWADVKKDLI | 97.01 | SWADVRKDLI | 1.2 | SWADVKKDLV | 1.2 | | |
| NS3 | 1544 | 0.19 | 3 | 3 | 0 | yes | WADVKKDLIS | 97.6 | WADVRKDLI | 1.2 | WADVRKDLIS | 1.2 | | |
| NS3 | 1545 | 0.19 | 3 | 3 | 0 | yes | ADVKKDLISY | 97.6 | ADVKKDLVSY | 1.2 | ADVRKDLISY | 1.2 | | |
| NS3 | 1546 | 0.2 | 4 | 3 | 0 | yes | DVKKDLISYG | 97.49 | DVKKDLISYG | 1.2 | DVKKDLVSYG | 1.2 | | |
| NS3 | 1547 | 0.2 | 4 | 3 | 0 | yes | VKKDLISYGG | 97.49 | VKKDLVSYGG | 1.2 | VRKDLISYGG | 1.2 | | |
| NS3 | 1548 | 0.2 | 4 | 3 | 0 | yes | KKDLISYGGG | 97.49 | RKDLISYGGG | 1.2 | KKDLVSYGGG | 1.2 | | |
| NS3 | 1549 | 0.11 | 3 | 2 | 0 | yes | KDLISYGGGW | 98.68 | KDLVSYGGGW | 1.2 | | | | |
| NS3 | 1550 | 0.11 | 3 | 2 | 0 | yes | DLISYGGGWK | 98.68 | DLVSYGGGWK | 1.2 | | | | |
| NS3 | 1551 | 0.11 | 3 | 2 | 0 | yes | LISYGGGWKL | 98.68 | LVSYGGGWKL | 1.2 | | | | |
| NS3 | 1552 | 0.11 | 3 | 2 | 0 | yes | ISYGGGWKLE | 98.68 | VSYGGGWKLE | 1.2 | | | | |
| NS3 | 1553 | 0.01 | 2 | 1 | 0 | yes | SYGGGWKLEG | 99.88 | | | | | | |
| NS3 | 1554 | 0.01 | 2 | 1 | 0 | yes | YGGGWKLEGE | 99.88 | | | | | | |
| NS3 | 1555 | 0.01 | 2 | 1 | 0 | yes | GGGWKLEGEW | 99.88 | | | | | | |
| NS3 | 1556 | 0 | 1 | 1 | 0 | yes | GGWKLEGEWK | 100 | | | | | | |
| NS3 | 1557 | 0 | 1 | 1 | 0 | yes | GWKLEGEWKE | 100 | | | | | | |
| NS3 | 1558 | 0 | 1 | 1 | 0 | yes | WKLEGEWKEG | 100 | | | | | | |
| NS3 | 1559 | 0 | 1 | 1 | 0 | yes | KLEGEWKEGE | 100 | | | | | | |
| NS3 | 1560 | 0.01 | 2 | 1 | 0 | yes | LEGEWKEGEE | 99.88 | | | | | | |
| NS3 | 1561 | 0.01 | 2 | 1 | 0 | yes | EGEWKEGEEV | 99.88 | | | | | | |
| NS3 | 1562 | 0.01 | 2 | 1 | 0 | yes | GEWKEGEEVQ | 99.88 | | | | | | |
| NS3 | 1563 | 0.01 | 2 | 1 | 0 | yes | EWKEGEEVQV | 99.88 | | | | | | |
| NS3 | 1564 | 0.01 | 2 | 1 | 0 | yes | WKEGEEVQVL | 99.88 | | | | | | |
| NS3 | 1565 | 0.01 | 2 | 1 | 0 | yes | KEGEEVQVLA | 99.88 | | | | | | |
| NS3 | 1566 | 0.01 | 2 | 1 | 0 | yes | EGEEVQVLAL | 99.88 | | | | | | |

FIG. 8-54

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1567 | 0.03 | 3 | 1 | 0 | yes | GEEVQVLALE | 99.76 | | | | | | |
| NS3 | 1568 | 0.03 | 3 | 1 | 0 | yes | EEVQVLALEP | 99.76 | | | | | | |
| NS3 | 1569 | 0.03 | 3 | 1 | 0 | yes | EVQVLALEPG | 99.76 | | | | | | |
| NS3 | 1570 | 0.01 | 2 | 1 | 0 | yes | VQVLALEPGK | 99.88 | | | | | | |
| NS3 | 1571 | 0.01 | 2 | 1 | 0 | yes | QVLALEPGKN | 99.88 | | | | | | |
| NS3 | 1572 | 0.01 | 2 | 1 | 0 | yes | VLALEPGKNP | 99.88 | | | | | | |
| NS3 | 1573 | 0.01 | 2 | 1 | 0 | yes | LALEPGKNPR | 99.88 | | | | | | |
| NS3 | 1574 | 0.03 | 3 | 1 | 0 | yes | ALEPGKNPRA | 99.76 | | | | | | |
| NS3 | 1575 | 0.03 | 3 | 1 | 0 | yes | LEPGKNPRAV | 99.76 | | | | | | |
| NS3 | 1576 | 0.03 | 3 | 1 | 0 | yes | EPGKNPRAVQ | 99.76 | | | | | | |
| NS3 | 1577 | 0.01 | 2 | 1 | 0 | yes | PGKNPRAVQT | 99.88 | | | | | | |
| NS3 | 1578 | 0.03 | 3 | 1 | 0 | yes | GKNPRAVQTK | 99.76 | | | | | | |
| NS3 | 1579 | 0.03 | 3 | 1 | 0 | yes | KNPRAVQTKP | 99.76 | | | | | | |
| NS3 | 1580 | 0.03 | 3 | 1 | 0 | yes | NPRAVQTKPG | 99.76 | | | | | | |
| NS3 | 1581 | 0.98 | 7 | 2 | 0 | yes | PRAVQTKPGL | 68.26 | PRAVQTKPGI | 30.9 | | | | | |
| NS3 | 1582 | 0.98 | 7 | 2 | 0 | yes | RAVQTKPGLF | 68.26 | RAVQTKPGIF | 30.9 | | | | | |
| NS3 | 1583 | 1.17 | 9 | 4 | 0 | yes | AVQTKPGLFK | 65.51 | AVQTKPGIFK | 30.54 | AVQTKPGIFR | 2.75 | AVQTKPGIFR | 0.36 | |
| NS3 | 1584 | 1.16 | 8 | 4 | 0 | yes | VQTKPGLFKT | 65.63 | VQTKPGIFKT | 30.54 | VQTKPGIFRT | 2.75 | VQTKPGIFRT | 0.36 | |
| NS3 | 1585 | 1.22 | 11 | 5 | 0 | yes | QTKPGLFKTN | 65.03 | QTKPGIFKTN | 30.42 | QTKPGLFRTN | 2.75 | QTKPGLFKTS | 0.48 | QTKPGFFKTN | 0.36 |
| NS3 | 1591 | 0.62 | 10 | 5 | 0 | yes | FKTNTGTIGA | 90.78 | FKTNAGTIGA | 4.79 | FRTNTGTIGA | 2.75 | FKTSTGTIGA | 0.48 | FRTNAGTIGA | 0.36 |
| NS3 | 1592 | 0.63 | 11 | 5 | 0 | yes | KTNTGTIGAV | 90.78 | KTNAGTIGAV | 4.79 | RTNTGTIGAV | 2.63 | KTSTGTIGAV | 0.48 | RTNAGTIGAV | 0.36 |
| NS3 | 1593 | 0.44 | 9 | 3 | 0 | yes | TNTGTIGAVS | 93.41 | TNAGTIGAVS | 5.15 | TSTGTIGAVS | 0.48 | | | |
| NS3 | 1594 | 0.44 | 9 | 3 | 0 | yes | NTGTIGAVSL | 93.41 | N

FIG. 8-55

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1597 | 0.06 | 4 | 1 | 0 | yes | TIGAVSLD

FIG. 8-56

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block

FIG. 8-57

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1655 | 1.17 | 9 | 4 | 0 | yes | DDIFRKRRLT | 62.87 | DDIFRKRRLT | 33.89 | DDIFRKRRLT | 1.8 | DHIFRKRRLT | 0.6 |
| NS3 | 1656 | 1.13 | 7 | 3 | 0 | yes | DIFRKKRLTI | 63.23 | DIFRKRRLTI | 34.01 | DIFRKRRLTI | 1.8 | | |
| NS3 | 1657 | 1.07 | 5 | 3 | 0 | yes | IFRKKRLTIM | 63.35 | IFRKRRLTIM | 34.61 | IFRKRRLTIM | 1.8 | | |
| NS3 | 1658 | 1.06 | 4 | 3 | 0 | yes | FRKKRLTIMD | 63.47 | FRKRRLTIMD | 34.61 | FRKRRLTIMD | 1.8 | | |
| NS3 | 1659 | 1.06 | 4 | 3 | 0 | yes | RKKRLTIMDL | 63.47 | RKRRLTIMDL | 34.61 | RKRRLTIMDL | 1.8 | | |
| NS3 | 1660 | 1.06 | 4 | 3 | 0 | yes | KKRLTIMDLH | 63.47 | KRRLTIMDLH | 34.61 | KRRLTIMDLH | 1.8 | | |
| NS3 | 1661 | 1.06 | 4 | 3 | 0 | yes | KRLTIMDLHP | 63.47 | RRLTIMDLHP | 34.61 | RKLTIMDLHP | 1.8 | | |
| NS3 | 1662 | 0.14 | 3 | 2 | 0 | yes | RLTIMDLHPG | 98.08 | KLTIMDLHPG | 1.8 | | | | |
| NS3 | 1663 | 0.01 | 2 | 1 | 0 | yes | LTIMDLHPGA | 99.88 | | | | | | |
| NS3 | 1664 | 0 | 1 | 1 | 0 | yes | TIMDLHPGAG | 100 | | | | | | |
| NS3 | 1665 | 0 | 1 | 1 | 0 | yes | IMDLHPGAGK | 100 | | | | | | |
| NS3 | 1666 | 0.01 | 2 | 1 | 0 | yes | MDLHPGAGKT | 99.88 | | | | | | |
| NS3 | 1667 | 0.01 | 2 | 1 | 0 | yes | DLHPGAGKTK | 99.88 | | | | | | |
| NS3 | 1668 | 0.12 | 3 | 2 | 0 | yes | LHPGAGKTKR | 98.44 | LHPGAGKTKK | 1.44 | | | | |
| NS3 | 1669 | 0.12 | 3 | 2 | 0 | yes | HPGAGKTKRY | 98.44 | HPGAGKTKKY | 1.44 | | | | |
| NS3 | 1670 | 0.12 | 3 | 2 | 0 | yes | PGAGKTKRYL | 98.44 | PGAGKTKKYL | 1.44 | | | | |
| NS3 | 1671 | 0.12 | 3 | 2 | 0 | yes | GAGKTKRYLP | 98.44 | GAGKTKKYLP | 1.44 | | | | |
| NS3 | 1672 | 0.12 | 3 | 2 | 0 | yes | AGKTKRYLPA | 98.44 | AGKTKKYLPA | 1.44 | | | | |
| NS3 | 1673 | 0.12 | 3 | 2 | 0 | yes | GKTKRYLPAI | 98.44 | GKTKKYLPAI | 1.44 | | | | |
| NS3 | 1674 | 0.12 | 3 | 2 | 0 | yes | KTKRYLPAIV | 98.44 | KTKKYLPAIV | 1.44 | | | | |
| NS3 | 1675 | 0.12 | 3 | 2 | 0 | yes | TKRYLPAIVR | 98.44 | TKKYLPAIVR | 1.44 | | | | |
| NS3 | 1676 | 0.14 | 4 | 2 | 0 | yes | KRYLPAIVRE | 98.32 | KKYLPAIVRE | 1.44 | | | | |
| NS3 | 1677 | 0.14 | 4 | 2 | 0 | yes | RYLPAIVREA | 98.32 | KYLPAIVREA | 1.44 | | | | |
| NS3 | 1678 | 0.03 | 3 | 1 | 0 | yes | YLPAIVREAI | 99.76 | | | | | | |
| NS3 | 1679 | 0.21 | 4 | 2 | 0 | yes | LPAIVREAIK | 97.25 | LPAIVREAIR | 1.92 | | | | |

FIG. 8-58

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1680 | 0.21 | 4 | 2 | 0 | yes | PAIVREAIKR | 97.25 | PAIVREAIRR | 1.92 |
| NS3 | 1681 | 0.21 | 4 | 2 | 0 | yes | AIVREAIKRG | 97.25 | AIVREAIRRG | 1.92 |
| NS3 | 1682 | 0.21 | 4 | 2 | 0 | yes | IVREAIKRGL | 97.25 | IVREAIR

FIG. 8-59

Species: DENV2 (10-mers)

| protein

FIG. 8-61

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS3 | 1755 | 0.01 | 2 | 1 | 0 | yes | LIIMDEAHFT | 99.88 |
| NS3 | 1756 | 0.01 | 2 | 1 | 0 | yes | IIMDEAHFTD | 99.88 |
| NS3 | 1757 | 0.01 | 2 | 1 | 0 | yes | IMDEAHFTDP | 99.88 |
| NS3 | 1758 | 0 | 1 | 1 | 0 | yes | MDEAHFTDPA | 100 |
| NS3 | 1759 | 0.01 | 2 | 1 | 0 | yes | DEAHFTDPAS | 99.88 |
| NS3 | 1760 | 0.01 | 2 | 1 | 0 | yes | EAHFTDPASI | 99.88 |
| NS3 | 1761 | 0.01 | 2 | 1 | 0 | yes | AHFTDPASIA | 99.88 |
| NS3 | 1762 | 0.01 | 2 | 1 | 0 | yes | HFTDPASIAA | 99.88 |
| NS3 | 1763 | 0.01 | 2 | 1 | 0 | yes | FTDPASIAAR | 99.88 |
| NS3 | 1764 | 0.01 | 2 | 1 | 0 | yes | TDPASIAARG | 99.88 |
| NS3 | 1765 | 0.01 | 2 | 1 | 0 | yes | DPASIAARGY | 99.88 |
| NS3 | 1766 | 0.01 | 2 | 1 | 0 | yes | PASIAARGYI | 99.88 |
| NS3 | 1767 | 0.01 | 2 | 1 | 0 | yes | ASIAARGYIS | 99.88 |
| NS3 | 1768 | 0.01 | 2 | 1 | 0 | yes | SIAARGYIST | 99.88 |
| NS3 | 1769 | 0 | 1 | 1 | 0 | yes | IAARGYISTR | 100 |
| NS3 | 1770 | 0 | 1 | 1 | 0 | yes | AARGYISTRV | 100 |
| NS3 | 1771 | 0 | 1 | 1 | 0 | yes | ARGYISTRVE | 100 |
| NS3 | 1772 | 0 | 1 | 1 | 0 | yes | RGYISTRVEM | 100 |
| NS3 | 1773 | 0 | 1 | 1 | 0 | yes | GYISTRVEMG | 100 |
| NS3 | 1774 | 0 | 1 | 1 | 0 | yes | YISTRVEMGE | 100 |
| NS3 | 1775 | 0 | 1 | 1 | 0 | yes | ISTRVEMGEA | 100 |
| NS3 | 1776 | 0 | 1 | 1 | 0 | yes | STRVEMGEAA | 100 |
| NS3 | 1777 | 0 | 1 | 1 | 0 | yes | TRVEMGEAAG | 100 |
| NS3 | 1778 | 0 | 1 | 1 | 0 | yes | RVEMGEAAGI | 100 |
| NS3 | 1779 | 0 | 1 | 1 | 0 | yes | VEMGEAAGIF | 100 |

FIG. 8-62

Species: DENV2 (10-mers)

| protein | block starting position | block entropy | total peptides in block | # peptides required to cover

FIG. 8-63

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1805 | 1.06 | 5 | 3 | 0 | yes | APIMDEEREI | 64.07 | APIDEEREI | 34.25 | APIVDEEREI | 1.32 | | |
| NS3 | 1806 | 1.06 | 5 | 3 | 0 | yes | PIMDEEREIP | 64.07 | PIDEEREIP | 34.25 | PIWDEEREIP | 1.32 | | |
| NS3 | 1807 | 1.06 | 5 | 3 | 0 | yes | IMDEEREIPE | 64.07 | IDEEREIPE | 34.25 | IVDEEREIPE | 1.32 | | |
| NS3 | 1808 | 1.06 | 5 | 3 | 0 | yes | MDEEREIPER | 64.07 | IDEEREIPER | 34.25 | VDEEREIPER | 1.32 | | |
| NS3 | 1809 | 0.01 | 2 | 1 | 0 | yes | DEEREIPERS | 99.88 | | | | | | |
| NS3 | 1810 | 0.01 | 2 | 1 | 0 | yes | EEREIPERSW | 99.88 | | | | | | |
| NS3 | 1811 | 0.14 | 4 | 2 | 0 | yes | EREIPERSWN | 98.08 | EREIPERSWS | 1.92 | | | | |
| NS3 | 1812 | 0.24 | 4 | 3 | 0 | yes | REIPERSWNS | 96.89 | REIPERSWSS | 1.92 | REIPERSWNT | 1.08 | | |
| NS3 | 1813 | 0.24 | 5 | 3 | 0 | yes | EIPERSWNSG | 96.89 | EIPERSWSSG | 1.92 | EIPERSWNTG | 1.08 | | |
| NS3 | 1814 | 0.26 | 5 | 3 | 0 | yes | IPERSWNSGH | 96.65 | IPERSWSSGH | 1.92 | IPERSWNTGH | 1.08 | | |
| NS3 | 1815 | 0.26 | 5 | 3 | 0 | yes | PERSWNSGHE | 96.65 | PERSWSSGHE | 1.92 | PERSWNTGHE | 1.08 | | |
| NS3 | 1816 | 0.26 | 5 | 3 | 0 | yes | ERSWNSGHEW | 96.65 | ERSWSSGHEW | 2.16 | ERSWNTGHEW | 1.08 | | |
| NS3 | 1817 | 0.42 | 7 | 4 | 0 | yes | RSWNSGHEWV | 94.37 | RSWNSGHEWI | 2.16 | RSWSSGHEWV | 1.92 | RSWNTGHEWV | 1.08 | |
| NS3 | 1818 | 0.44 | 8 | 4 | 0 | yes | SWNSGHEWVT | 94.25 | SWNSGHEWIT | 1.92 | SWSSGHEWVT | 1.92 | SWNTGHEWVT | 1.08 | |
| NS3 | 1819 | 0.46 | 10 | 4 | 0 | yes | WNSGHEWVTD | 94.13 | WNSGHEWITN | 1.92 | WSSGHEWVTD | 1.92 | WNTGHEWVTD | 1.08 | |
| NS3 | 1820 | 0.47 | 11 | 5 | 0 | yes | NSGHEWVTDF | 94.01 | SSGHEWVTDF | 1.92 | NSGHEWITNF | 1.92 | NTGHEWVTDF | 1.08 | NSGHEWVTDF | 0.24 |
| NS3 | 1822 | 0.29 | 12 | 5 | 0 | yes | GHEWVTDFKG | 96.77 | GHEWITNFKG | 1.68 | GHEWITDFKG | 1.92 | GHEWVTNFEG | 0.24 | GYEWVTDFKG | 0.24 |
| NS3 | 1823 | 0.29 | 12 | 5 | 0 | yes | HEWVTDFKGK | 96.77 | HEWITNFKGK | 1.68 | YEWVTDFKGK | 1.92 | HEWITNFEGK | 0.24 | HEWITDFKGK | 0.24 |
| NS3 | 1824 | 0.26 | 11 | 4 | 0 | yes | EWVTDFKGKT | 97.01 | EWITNFKGKT | 1.68 | EWITDFKGKT | 1.68 | EWITNFEGKT | 0.24 | |
| NS3 | 1825 | 0.26 | 11 | 4 | 0 | yes | WVTDFKGKTV | 97.01 | WITNFKGKTV | 1.68 | WITDFKGKTV | 1.68 | WITN

FIG. 8-64

Species: DENV2 (10

FIG. 8-65

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1856 | 0.27 | 2 | 2 | 0 | yes | KVIQLSRKTF | 95.33 | RVIQLSRKTF | 4.67 | | | | | | |
| NS3 | 1857 | 0 | 1 | 1 | 0 | yes | VIQLSRKTFD | 100 | | | | | | | | |
| NS3 | 1858 | 0.17 | 4 | 2 | 0 | yes | IQLSRKTFDS | 97.84 | IQLSRKTFDT | 1.8 | | | | | | |
| NS3 | 1859 | 0.17 | 4 | 2 | 0 | yes | QLSRKTFDSE | 97.84 | QLSRKTFDTE | 1.8 | | | | | | |
| NS3 | 1860 | 0.17 | 4 | 2 | 0 | yes | LSRKTFDSEY | 97.84 | LSRKTFDTEY | 1.8 | | | | | | |
| NS3 | 1861 | 0.5 | 7 | 5 | 0 | yes | SRKTFDSEYV | 93.05 | SRKTFDSEYI | 3.83 | SRKTFDTEYT | 0.96 | SRKTFDSEYA | 0.96 | SRKTFDTEYI | 0.84 |
| NS3 | 1862 | 0.5 | 7 | 5 | 0 | yes | RKTFDSEYIK | 93.05 | RKTFDSEYIK | 3.83 | RKTFDTEYIK | 0.96 | RKTFDSEYAK | 0.96 | RKTFDTEYIK | 0.84 |
| NS3 | 1863 | 0.5 | 7 | 5 | 0 | yes | KTFDSEYIKT | 93.05 | KTFDSEYIKT | 3.83 | KTFDSEYIKT | 0.96 | KTFDSEYAKT | 0.96 | KTFDTEYIKT | 0.84 |
| NS3 | 1864 | 0.52 | 8 | 5 | 0 | yes | TFDSEYIKTR | 92.81 | TFDSEYIKTR | 3.83 | TFDSEYAKTR | 0.96 | TFDTEYIKTR | 0.84 | | |
| NS3 | 1871 | 1.11 | 6 | 3 | 0 | yes | KTRTNDWDFV | 51.26 | KTRANDWDFV | 47.43 | KTRSNDWDFV | 0.6 | | | | |
| NS3 | 1872 | 1.12 | 7 | 3 | 0 | yes | TRTNDWDFVV | 51.14 | TRANDWDFVV | 47.43 | TRSNDWDFVV | 0.6 | | | | |
| NS3 | 1873 | 1.12 | 7 | 3 | 0 | yes | RTNDWDFVVT | 51.14 | RANDWDFVVT | 47.43 | RSNDWDFVVT | 0.6 | | | | |
| NS3 | 1874 | 1.1 | 6 | 3 | 0 | yes | TNDWDFVVTT | 51.38 | ANDWDFVVTT | 47.43 | SNDWDFVVTT | 0.6 | | | | |
| NS3 | 1875 | 0.03 | 3 | 1 | 0 | yes | NDWDFVVTTD | 99.76 | | | | | | | | |
| NS3 | 1876 | 0.01 | 2 | 1 | 0 | yes | DWDFVVTTDI | 99.88 | | | | | | | | |
| NS3 | 1877 | 0.01 | 2 | 1 | 0 | yes | WDFVVTTDIS | 99.88 | | | | | | | | |
| NS3 | 1878 | 0.01 | 2 | 1 | 0 | yes | DFVVTTDISE | 99.88 | | | | | | | | |
| NS3 | 1879 | 0.01 | 2 | 1 | 0 | yes | FVVTTDISEM | 99.88 | | | | | | | | |
| NS3 | 1880 | 0.01 | 2 | 1 | 0 | yes | VVTTDISEMG | 99.88 | | | | | | | | |
| NS3 | 1881 | 0.01 | 2 | 1 | 0 | yes | VTTDISEMGA | 99.88 | | | | | | | | |
| NS3 | 1882 | 0 | 1 | 1 | 0 | yes | TTDISEMGAN | 100 | | | | | | | | |
| NS3 | 1883 | 0 | 1 | 1 | 0 | yes | TDISEMGANF | 100 | | | | | | | | |
| NS3 | 1884 | 0.53 | 2 | 2 | 0 | yes | DISEMGANFK | 88.02 | DISEMGANFR | 11.98 | | | | | | |
| NS3 | 1885 | 0.53 | 2 | 2 | 0 | yes | ISEMGANFKA | 88.02 | ISEMGANFRA | 11.98 | | | | | | |
| NS3 | 1886 | 0.55 | 3 | 2 | 0 | yes | SEMGANFKAE | 87.78 | SEMGANFRAE | 11.98 | | | | | | |

FIG. 8-66

Species: DENV2 (10-mers)

| protein | block starting position | block entropy | total pe

FIG. 8-67

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1912 | 0.15 | 3 | 2 | 0 | yes | GEER

FIG. 8-68

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1937 | 0.23 | 4 | 2 | 0 | yes | GRNPKNENDQ | 96.77 | GRNPRNENDQ | 2.63 |
| NS3 | 1938 | 0.23 | 4 | 2 | 0 | yes | RNPKNENDQY | 96.77 | RNPRNENDQY | 2.63 |
| NS3 | 1939 | 0.23 | 4 | 2 | 0 | yes | NPKNENDQYI | 96.77 | NPRNENDQYI | 2.63 |
| NS3 | 1940 | 0.23 | 4 | 2 | 0 | yes | PKNENDQYIY | 96.77 | PRNENDQYIY | 2.63 |
| NS3 | 1941 | 0.23 | 4 | 2 | 0 | yes | KNENDQYIYM | 96.77 | RNENDQYIYM | 2.63 |
| NS3 | 1942 | 0.06 | 3 | 1 | 0 | yes | NENDQYIYMG | 99.4 | | |
| NS3 | 1943 | 0.06 | 3 | 1 | 0 | yes | ENDQYIYMGE | 99.4 | | |
| NS3 | 1944 | 0.04 | 2 | 1 | 0 | yes | NDQYIYMGEP | 99.52 | | |
| NS3 | 1945 | 0 | 1 | 1 | 0 | yes | DQYIYMGEPL | 100 | | |
| NS3 | 1946 | 0 | 1 | 1 | 0 | yes | QYIYMGEPLE | 100 | | |
| NS3 | 1947 | 0.01 | 2 | 1 | 0 | yes | YIYMGEPLEN | 99.88 | | |
| NS3 | 1948 | 0.01 | 2 | 1 | 0 | yes | IYMGEPLEND | 99.88 | | |
| NS3 | 1949 | 0.03 | 3 | 1 | 0 | yes | YMGEPLENDE | 99.76 | | |
| NS3 | 1950 | 0.04 | 4 | 1 | 0 | yes | MGEPLENDED | 99.64 | | |
| NS3 | 1951 | 0.04 | 4 | 1 | 0 | yes | GEPLENDEDC | 99.64 | | |
| NS3 | 1952 | 0.04 | 4 | 1 | 0 | yes | EPLENDEDCA | 99.64 | | |
| NS3 | 1953 | 0.07 | 5 | 1 | 0 | yes | PLENDEDCAH | 99.28 | | |
| NS3 | 1954 | 0.07 | 5 | 1 | 0 | yes | LENDEDCAHW | 99.28 | | |
| NS3 | 1955 | 0.07 | 5 | 1 | 0 | yes | ENDEDCAHWK | 99.28 | | |
| NS3 | 1956 | 0.06 | 4 | 1 | 0 | yes | NDEDCAHWKE | 99.4 | | |
| NS3 | 1957 | 0.06 | 4 | 1 | 0 | yes | DEDCAHWKEA | 99.4 | | |
| NS3 | 1958 | 0.05 | 3 | 1 | 0 | yes | EDCAHWKEAK | 99.52 | | |
| NS3 | 1959 | 0.03 | 2 | 1 | 0 | yes | DCAHWKEAKM | 99.64 | | |
| NS3 | 1960 | 0.03 | 2 | 1 | 0 | yes | CAHWKEAKML | 99.64 | | |
| NS3 | 1961 | 0.03 | 2 | 1 | 0 | yes | AHWKEAKMLL | 99.64 | | |

FIG. 8-70

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1987 | 0.1 | 2 | 2 | 0 | yes | EREKVDAIDG | 98.68 | EREKVDAVDG | 1.32 |
| NS3 | 1988 | 0.1 | 2 | 2 | 0 | yes | REKVDAIDGE | 98.68 | REKVDAVDGE | 1.32 |
| NS3 | 1989 | 0.1 | 2 | 2 | 0 | yes | EKVDAIDGEY | 98.68 | EKVDAVDGEY | 1.32 |
|

FIG. 8-71

Species: DENV2 (10-mers)

| protein | block starting position | block entropy | total peptides in block | # peptides required to 99% cover of block | gap/X fraction | 99% of block covered w/ <= 5 peptides? | peptides required to cover 99% of block | frequency | peptides required to cover 99% of block |

FIG. 8-72

Species: DENV2 (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 2038 | 0.93 | 7 | 4 | 0 | yes | CFDGIKNNQI | 81.32 | CFDGVKNNQI | 13.41 | CFDGIRNNQI | 2.51 | CFDGTRNNQI | 2.4 | | |
| NS3 | 2039 | 0.93 | 7 | 4 | 0 | yes | FDGIKNNQIL | 81.32 | FDGVKNNQIL | 13.41 | FDGIRNNQIL | 2.51 | FDGTRNNQIL | 2.4 | | |
| NS3 | 2040 | 0.93 | 7 | 4 | 0 | yes | DGIKNNQILE | 81.32 | DGVKNNQILE | 13.41 | DGIRNNQILE | 2.51 | DGTRNNQILE | 2.4 | | |
| NS3 | 2041 | 0.93 | 7 | 4 | 0 | yes | GIKNNQILEE | 81.32 | GVKNNQILEE | 13.41 | GIRNNQILEE | 2.51 | GTRNNQILEE | 2.4 | | |
| NS3 | 2042 | 0.93 | 7 | 4 | 0 | yes | IKNNQILEEN | 81.32 | VKNNQILEEN | 13.41 | IRNNQILEEN | 2.51 | TRNNQILEEN | 2.4 | | |
| NS3 | 2043 | 1.14 | 8 | 4 | 0 | yes | KNNQILEENV | 72.69 | KNNQILEENM | 21.8 | RNNQILEENV | 2.75 | RNNQILEENM | 1.92 | | |
| NS3 | 2044 | 0.86 | 5 | 2 | 0 | yes | NNQILEENME | 75.57 | NNQILEENME | 23.59 | | | | | | |
| NS3 | 2045 | 0.86 | 5 | 2 | 0 | yes | NQILEENMEV | 75.57 | NQILEENMEV | 23.59 | | | | | | |
| NS3 | 2046 | 0.85 | 4 | 2 | 0 | yes | QILEENMEVE | 75.69 | QILEENMEVE | 23.59 | | | | | | |
| NS3 | 2047 | 0.96 | 7 | 3 | 0 | yes | ILEENMEVEI | 75.57 | ILEENMEVEV | 21.92 | ILEENMEVEV | 1.68 | | | | |
| NS3 | 2048 | 0.96 | 7 | 3 | 0 | yes | LEENMEVEIW | 75.57 | LEENMEVEIW | 21.92 | LEENMEVEVW | 1.68 | EENIEVEIWT | 0.36 | | |
| NS3 | 2049 | 0.98 | 8 | 4 | 0 | yes | EENMEVEIWT | 75.33 | EENMEVEIWT | 21.92 | EENMEVEVWT | 1.68 | ENIEVEIWTK | 0.36 | | |
| NS3 | 2050 | 0.98 | 8 | 4 | 0 | yes | ENMEVEIWTK | 75.33 | ENMEVEIWTK | 21.92 | ENMEVEVWTK | 1.68 | NIEVEIWTKE | 0.36 | | |
| NS3 | 2051 | 0.99 | 9 | 4 | 0 | yes | NVEVEIWTKE | 75.21 | NMEVEIWTKE | 21.92 | NMEVEVWTKE | 1.68 | IEVEIWTKEG | 0.36 | | |
| NS3 | 2052 | 0.99 | 9 | 4 | 0 | yes | VEVEIWTKEG | 75.21 | MEVEIWTKEG | 21.92 | MEVEVWTKEG | 1.68 | | | | |
| NS3 | 2053 | 0.19 | 5 | 2 | 0 | yes | EVEIWTKEGE | 97.49 | EVEVWTKEGE | 2.04 | | | | | | |
| NS3 | 2054 | 0.21 | 6 | 2 | 0 | yes | VEIWTKEGER | 97.37 | VEVWTKEGER | 2.04 | | | | | | |
| NS3 | 2055 | 0.21 | 6 | 2 | 0 | yes | EIWTKEGERK | 97.37 | EVWTKEGERK | 2.04 | | | | | | |
| NS3 | 2056 | 0.19 | 5 | 2 | 0 | yes | IWTKEGERKK | 97.49 | VWTKEGERKK | 2.04 | | | | | | |
| NS3 | 2057 | 0.05 | 4 | 1 | 0 | yes | WTKEGERKKL | 99.52 | | | | | | | | |
| NS3 | 2058 | 0.05 | 4 | 1 | 0 | yes | TKEGERKKLK | 99.52 | | | | | | | | |
| NS3 | 2059 | 0.03 | 3 | 1 | 0 | yes | KEGERKKLKP | 99.76 | | | | | | | | |
| NS3 | 2060 | 0.03 | 3 | 1 | 0 | yes | EGERKKLKPR | 99.76 | | | | | | | | |
| NS3 | 2061 | 0.02 | 2 | 1 | 0 | yes | GERKKLKPRW | 99.76 | | | | | | | | |
| NS3 | 2062 | 0.02 | 2 | 1 | 0 | yes | ERKKLKPRWL | 99.76 | | | | | | | | |

FIG. 8-73

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2063 | 0.02 | 2 | 1 | 0 | yes | RKKLKPRWLD | 99.76 | | | | | | |
| NS3 | 2064 | 0.03 | 3 | 1 | 0 | yes | KKLKPRWLDA | 99.76 | | | | | | |
| NS3 | 2065 | 0.05 | 4 | 2 | 0 | yes | KLKPRWLDAR | 99.52 | | | | | | |
| NS3 | 2066 | 0.19 | 5 | 2 | 0 | yes | LKPRWLDARI | 97.49 | LKPRWLDART | 2.04 | | | | |
| NS3 | 2067 | 0.19 | 5 | 2 | 0 | yes | KPRWLDARIY | 97.49 | KPRWLDARTY | 2.04 | | | | |
| NS3 | 2068 | 0.19 | 5 | 2 | 0 | yes | PRWLDARIYS | 97.49 | PRWLDARTYS | 2.04 | | | | |
| NS3 | 2069 | 0.19 | 5 | 2 | 0 | yes | RWLDARIYSD | 97.49 | RWLDARTYSD | 2.04 | | | | |
| NS3 | 2070 | 0.19 | 5 | 2 | 0 | yes | WLDARIYSDP | 97.49 | WLDARTYSDP | 2.04 | | | | |
| NS3 | 2071 | 0.19 | 5 | 2 | 0 | yes | LDARIYSDPL | 97.49 | LDARTYSDPL | 2.04 | | | | |
| NS3 | 2072 | 0.22 | 6 | 2 | 0 | yes | DARIYSDPLA | 97.25 | DARTYSDPLA | 2.04 | | | | |
| NS3 | 2073 | 0.22 | 6 | 2 | 0 | yes | ARIYSDPLAL | 97.25 | ARTYSDPLAL | 2.04 | | | | |
| NS3 | 2074 | 0.21 | 5 | 2 | 0.24 | yes | RIYSDPLALK | 97.13 | RTYSDPLALK | 2.04 | | | | |
| NS3 | 2075 | 0.18 | 4 | 1 | 0.24 | yes | IYSDPLALKE | 97.37 | TYSDPLALKE | 2.04 | | | | |
| NS3 | 2076 | 0.04 | 3 | 1 | 0.24 | yes | YSDPLALKEF | 99.4 | | | | | | |
| NS3 | 2077 | 0.04 | 3 | 1 | 0.24 | yes | SDPLALKEFK | 99.4 | | | | | | |
| NS3 | 2078 | 0.04 | 3 | 1 | 0.24 | yes | DPLALKEFKE | 99.4 | | | | | | |
| NS3 | 2079 | 0.04 | 3 | 1 | 0.24 | yes | PLALKEFKEF | 99.4 | | | | | | |
| NS3 | 2080 | 0.04 | 3 | 1 | 0.24 | yes | LALKEFKEFA | 99.4 | | | | | | |
| NS3 | 2081 | 0.04 | 2 | 1 | 0.24 | yes | ALKEFKEFAA | 99.4 | | | | | | |
| NS3 | 2082 | 0.01 | 2 | 1 | 0.24 | yes | LKEFKEFAAG | 99.64 | | | | | | |
| NS3 | 2083 | 0.01 | 2 | 1 | 0.24 | yes | KEFKEFAAGR | 99.64 | | | | | | |
| NS3 | 2084 | 0.01 | 2 | 1 | 0.24 | yes | EFKEFAAGRK | 99.64 | | | | | | |
| NS3 | 2085 | 0.03 | 3 | 1 | 0 | yes | FKEFAAGRKS | 99.52 | | | | | | |
| NS3 | 2086 | 0.03 | 3 | 1 | 0 | yes | KEFAAGRKSL | 99.76 | | | | | | |
| NS3 | 2087 | 0.16 | 4 | 2 | 0 | yes | EFAAGRKSLT | 97.96 | EFAAGRKSLA | 1.8 | | | | |

FIG. 8-74

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2088 | 0.16 | 4 | 2 | 0 | yes | FAAGRKSLTL | 97.96 | FAAGRKSLAL | 1.8 | | | | |
| NS3 | 2089 | 0.27 | 5 | 3 | 0 | yes | AAGRKSLTLN | 96.41 | AAGRKSLALN | 1.8 | AAGRKSLTLS | 1.56 | | |
| NS3 | 2090 | 0.29 | 6 | 3 | 0 | yes | AGRKSLTLNL | 96.29 | AGRKSLALNL | 1.8 | AGRKSLTLSL | 1.56 | | |
| NS3 | 2091 | 0.27 | 5 | 3 | 0 | yes | GRKSLTLNLI | 96.41 | GRKSLALNLI | 1.8 | GRKSLTLSLI | 1.56 | | |
| NS3 | 2092 | 0.27 | 5 | 3 | 0 | yes | RKSLTLNLIT | 96.41 | RKSLALNLIT | 1.8 | RKSLTLSLIT | 1.56 | | |
| NS3 | 2093 | 0.27 | 5 | 3 | 0 | yes | KSLTLNLITE | 96.41 | KSLALNLITE | 1.8 | KSLTLSLITE | 1.56 | | |
| NS3 | 2094 | 0.28 | 6 | 3 | 0 | yes | SLTLNLITEM | 96.41 | SLALNLITEM | 1.8 | SLTLSLITEM | 1.32 | | |
| NS3 | 2095 | 0.27 | 5 | 3 | 0 | yes | LTLNLITEMG | 96.53 | LALNLITEMG | 1.8 | LTLSLITEMG | 1.32 | | |
| NS3 | 2096 | 0.31 | 6 | 3 | 0 | yes | TLNLITEMGR | 96.05 | ALNLITEMGR | 1.8 | TLSLITEMGR | 1.32 | | |
| NS4A | 2097 | 0.18 | 5 | 2 | 0 | yes | LNLITEMGRL | 97.84 | LSLITEMGRL | 1.32 | | | | |
| NS4A | 2098 | 0.18 | 5 | 2 | 0 | yes | NLITEMGRLP | 97.84 | SLITEMGRLP | 1.32 | | | | |
| NS4A | 2099 | 0.08 | 4 | 1 | 0 | yes | LITEMGRLPT | 99.16 | | | | | | |
| NS4A | 2100 | 0.08 | 4 | 1 | 0 | yes | ITEMGRLPTF | 99.16 | | | | | | |
| NS4A | 2101 | 0.08 | 4 | 1 | 0 | yes | TEMGRLPTFM | 99.16 | | | | | | |
| NS4A | 2102 | 0.08 | 4 | 1 | 0 | yes | EMGRLPTFMT | 99.16 | | | | | | |
| NS4A | 2103 | 0.09 | 5 | 1 | 0 | yes | MGRLPTFMTQ | 99.04 | | | | | | |
| NS4A | 2104 | 0.07 | 4 | 1 | 0 | yes | GRLPTFMTQK | 99.28 | | | | | | |
| NS4A | 2105 | 0.97 | 6 | 2 | 0 | yes | RLPTFMTQKA | 67.66 | RLPTFMTQKT | 31.62 | | | | |
| NS4A | 2106 | 0.96 | 5 | 2 | 0 | yes | LPTFMTQKAR | 67.66 | LPTFMTQKTR | 31.74 | | | | |
| NS4A | 2107 | 1.63 | 6 | 3 | 0 | yes | PTFMTQKARN | 37.25 | PTFMTQKTRD | 31.74 | PTFMTQKARD | 30.42 | | |
| NS4A | 2108 | 1.63 | 6 | 3 | 0 | yes | TFMTQKARNA | 37.25 | TFMTQKTRDA | 31.74 | TFMTQKARDA | 30.42 | | |
| NS4A | 2109 | 1.63 | 6 | 3 | 0 | yes | FMTQKARNAL | 37.25 | FMTQKTRDAL | 31.74 | FMTQKARDAL | 30.42 | | |
| NS4A | 2110 | 1.62 | 5 | 3 | 0 | yes | MTQKARNALD | 37.25 | MTQKTRDALD | 31.74 | MTQKARDALD | 30.54 | | |
| NS4A | 2111 | 1.62 | 5 | 3 | 0 | yes | TQKARNALDN | 37.25 | TQKTRDALDN | 31.74 | TQKARDALDN | 30.54 | | |
| NS4A | 2112 | 1.62 | 5 | 3 | 0 | yes | QKARNALDNL | 37.25 | QKTRDALDNL | 31.74 | QKARDALDNL | 30.54 | | |

FIG. 8-75

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2113 | 1.63 | 6 | 3 | 0 | yes | KARNALDNLA | 37.25 | KTRDAL

FIG. 8-76

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block

FIG. 8-77

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4A | 2168 | 1.54 | 8 | 5 | 0 | yes | GKGIGKMTLG | 53.89 | GRGIGKMTLG | 35.09 | GKGVGKMTLG | 6.95 | GRGVGKMTLG | 1.8 | ARGIGKMTLG | 1.32 |
| NS4A | 2169 | 1.46 | 7 | 4 | 0 | yes | KGIGKMTLGM | 53.89 | RGIGKMTLGM | 36.41 | KGVGKMTLGM | 6.95 | RGVGKMTLGM | 1.8 | | |
| NS4A | 2170 | 0.53 | 6 | 3 | 0 | yes | GIGKMTLGMC | 90.3 | GVGKMTLGMC | 8.62 | GMGKMTLGMC | 0.48 | | | | |
| NS4A | 2171 | 0.49 | 5 | 2 | 0 | yes | IGKMTLGMCC | 90.66 | VGKMTLGMCC | 8.62 | | | | | | |
| NS4A | 2172 | 0.03 | 3 | 1 | 0 | yes | GKMTLGMCCI | 99.76 | | | | | | | | |
| NS4A | 2173 | 0.27 | 5 | 2 | 0 | yes | KMTLGMCCII | 96.17 | KMTLGMCCIV | 3.11 | | | | | | |
| NS4A | 2174 | 0.27 | 5 | 2 | 0 | yes | MTLGMCCIIT | 96.17 | MTLGMCCIVT | 3.11 | | | | | | |
| NS4A | 2175 | 0.26 | 4 | 2 | 0 | yes | TLGMCCIITA | 96.29 | TLGMCCIVTA | 3.11 | | | | | | |
| NS4A | 2176 | 0.26 | 4 | 2 | 0 | yes | LGMCCIITAS | 96.29 | LGMCCIVTAS | 3.11 | | | | | | |
| NS4A | 2187 | 0.16 | 5 | 2 | 0 | yes | LLWYAQIQPH | 98.08 | LLWHAQIQPH | 1.56 | | | | | | |
| NS4A | 2188 | 0.16 | 5 | 2 | 0 | yes | LWYAQIQPHW | 98.08 | LWHAQIQPHW | 1.56 | | | | | | |
| NS4A | 2189 | 0.16 | 5 | 2 | 0 | yes | WYAQIQPHWI | 98.08 | WHAQIQPHWI | 1.56 | | | | | | |
| NS4A | 2190 | 0.16 | 5 | 2 | 0 | yes | YAQIQPHWIA | 98.08 | HAQIQPHWIA | 1.56 | | | | | | |
| NS4A | 2191 | 0.01 | 2 | 1 | 0 | yes | AQIQPHWIAA | 99.88 | | | | | | | | |
| NS4A | 2192 | 0.01 | 2 | 1 | 0 | yes | QIQPHWIAAS | 99.88 | | | | | | | | |
| NS4A | 2193 | 0 | 1 | 1 | 0 | yes | IQPHWIAASI | 100 | | | | | | | | |
| NS4A | 2194 | 0 | 1 | 1 | 0 | yes | QPHWIAASII | 100 | | | | | | | | |
| NS4A | 2195 | 0 | 1 | 1 | 0 | yes | PHWIAASIIL | 100 | | | | | | | | |
| NS4A | 2196 | 0.07 | 2 | 1 | 0 | yes | HWIAASIILE | 99.16 | | | | | | | | |
| NS4A | 2197 | 0.07 | 2 | 1 | 0 | yes | WIAASIILEF | 99.16 | | | | | | | | |
| NS4A | 2198 | 0.07 | 2 | 1 | 0 | yes | IAASIILEFF | 99.16 | | | | | | | | |
| NS4A | 2199 | 0.07 | 2 | 1 | 0 | yes | AASIILEFFL | 99.16 | | | | | | | | |
| NS4A | 2200 | 0.1 | 4 | 2 | 0 | yes | ASIILEFFLI | 98.92 | ASIILVFFLI | 0.84 | | | | | | |
| NS4A | 2201 | 0.11 | 5 | 2 | 0 | yes | SIILEFFLIV | 98.8 | SIILVFFLIV | 0.84 | | | | | | |
| NS4A | 2202 | 0.11 | 5 | 2 | 0 | yes | IILEFFLIVL | 98.8 | IILVFFLIVL | 0.84 | | | | | | |

FIG. 8-78

Species: DENV2 (10-mers)

| protein | block starting position | block entropy | total peptides in block | # peptides required to cover 99% of block | gap/X fraction | 99% of block covered w/ <= 5 peptides?

FIG. 8-79

Species: DENV2 (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| 2K | 2228 | 0.31 | 4 | 3 | 0 | yes | TYVIAILTV | 95.69 | TYVIAILTV | 2.4 | TYVIAILTL | 1.8 | | | | |
| 2K | 2229 | 0.31 | 4 | 3 | 0 | yes | YVIAILTVV | 95.69 | YVIAILTVV | 2.4 | YVIAILTLV | 1.8 | | | | |
| 2K | 2230 | 0.32 | 5 | 3 | 0 | yes | VIAILTVVA | 95.57 | VIAILTVVA | 2.4 | VIAILTLVA | 1.8 | | | | |
| 2K | 2231 | 0.32 | 5 | 3 | 0 | yes | IAILTVVAA | 95.57 | IAILTVAAT | 2.4 | IAILTLVAA | 1.8 | | | | |
| 2K | 2232 | 0.15 | 3 | 2 | 0 | yes | AILTVVAAT | 97.96 | AILTVAAT | 1.92 | | | | | | |
| 2K | 2233 | 0.15 | 3 | 2 | 0 | yes | ILTVVAATM | 97.96 | ILTVAATM | 1.92 | | | | | | |
| 2K | 2234 | 0.15 | 3 | 2 | 0 | yes | LTVVAATMA | 97.96 | LTVAATMA | 1.92 | | | | | | |
| 2K | 2235 | 0.15 | 3 | 2 | 0 | yes | TVVAATMAN | 97.96 | TVAATMAN | 1.92 | | | | | | |
| 2K | 2236 | 0.15 | 3 | 2 | 0 | yes | VVAATMANE | 97.96 | TVAATMANE | 1.92 | | | | | | |
| 2K | 2237 | 0.15 | 3 | 2 | 0 | yes | VAATMANEM | 97.96 | LVAATMANEM | 1.92 | | | | | | |
| 2K | 2238 | 0.01 | 2 | 1 | 0 | yes | AATMANEMG | 99.88 | | | | | | | | |
| 2K | 2239 | 0.01 | 2 | 1 | 0 | yes | ATMANEMGF | 99.88 | | | | | | | | |
| 2K | 2240 | 0.01 | 2 | 1 | 0 | yes | TMANEMGFL | 99.88 | | | | | | | | |
| 2K | 2241 | 0.01 | 2 | 1 | 0 | yes | MANEMGFLE | 99.88 | | | | | | | | |
| 2K | 2242 | 0.01 | 2 | 1 | 0 | yes | ANEMGFLEK | 99.88 | | | | | | | | |
| 2K | 2243 | 0.01 | 2 | 1 | 0 | yes | NEMGFLEKT | 99.88 | | | | | | | | |
| 2K | 2244 | 0 | 1 | 1 | 0 | yes | EMGFLEKTK | 100 | | | | | | | | |
| NS4B | 2245 | 0.04 | 2 | 1 | 0 | yes | MGFLEKTKK | 99.52 | | | | | | | | |
| NS4B | 2246 | 0.04 | 2 | 1 | 0 | yes | GFLEKTKKD | 99.52 | | | | | | | | |
| NS4B | 2247 | 0.42 | 4 | 2 | 0 | yes | FLEKTKKDL | 92.22 | GFLEKTKDF | 7.31 | GFLEKTKDLGF | 4.79 | | | | |
| NS4B | 2248 | 0.42 | 4 | 2 | 0 | yes | LEKTKKDLG | 92.22 | FLEKTKDFG | 7.31 | EKTKKDLGFG | 4.79 | | | | |
| NS4B | 2249 | 0.7 | 6 | 3 | 0 | yes | LEKTKKDLGL | 87.43 | LEKTKKDFGL | 7.19 | EPESNILDID | 7.31 | EPESNILDID | 7.31 | | |
| NS4B | 2250 | 0.7 | 6 | 3 | 0 | yes | EKTKKDLGLG | 87.43 | EKTKKDFGLG | 7.19 | PEINILDIDL | 1.08 | | | | |
| NS4B | 2265 | 1.49 | 9 | 5 | 0.12 | yes | ESESNILDID | 47.78 | QPESNILDID | 42.4 | QPESNILDID | 7.31 | QPEINILDID | 1.08 | | |
| NS4B | 2266 | 1.19 | 8 | 4 | 0.12 | yes | PESNILDIDL | 49.7 | SESNILDIDL | 47.78 | PEINILDIDL | 1.08 | HESNILDIDL | 0.48 | QHESNILDID | 0.48 |

FIG. 8-82

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2317 | 0.5 | 4 | 2 | 0 | yes | VLMGLGKGWP | 89.7 | VLMGLGRGWP | 10.06 |
| NS4B | 2318 | 0.5 | 4 | 2 | 0 | yes | LMGLGKGWPL | 89.7 | LMGLGRGWPL | 10.06 |
| NS4B | 2319 | 0.5 | 4 | 2 | 0 | yes | MGLGKGWPLS | 89.7 | MGLGRGWPL

FIG. 8-83

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2342 | 0.1 | 6 | 1 | 0 | yes | YSQVNPITLT | 99.04 | | | | | | |
| NS4B | 2343 | 0.11 | 7 | 2 | 0 | yes | SQVNPITLTA | 98.92 | SQVNPTLTA | 0.36 | | | | |
| NS4B | 2344 | 0.11 | 7 | 2 | 0 | yes | QVNPITLTAA | 98.92 | QVNPTLTAA | 0.36 | | | | |
| NS4B | 2345 | 0.11 | 7 | 2 | 0 | yes | VNPITLTAAL | 98.92 | VNPTLTAAL | 0.36 | | | | |
| NS4B | 2346 | 0.35 | 9 | 3 | 0 | yes | NPITLTAALF | 95.09 | NPVTLTAALF | 3.71 | NPVTLTAALL | 0.36 | | |
| NS4B | 2347 | 0.46 | 11 | 5 | 0 | yes | PITLTAALFL | 93.77 | PITLTAALLS | 3.71 | PITLTAALLL | 1.08 | PVTLTAALLL | 0.36 | PITLTAALLM | 0.24 |
| NS4B | 2348 | 0.46 | 11 | 5 | 0 | yes | ITLTAALFLL | 93.77 | ITLTAALLSL | 3.71 | ITLTAALLLL | 1.08 | VTLTAALLLL | 0.36 | TTLTAALFLL | 0.24 |
| NS4B | 2351 | 0.55 | 11 | 5 | 0 | yes | TAALFLLVAH | 92.46 | TAALLLLIAH | 3.95 | TAALLLLVAH | 1.56 | TAALLSLVAH | 0.84 | TAALLLLMAH | 0.24 |
| NS4B | 2357 | 0.25 | 10 | 3 | 0 | yes | LIAHYAIIGP | 97.13 | LMAHYAIIGP | 1.8 | | | | |
| NS4B | 2358 | 0.27 | 11 | 4 | 0 | yes | IAHYAIIGPG | 96.89 | MAHYAIIGPG | 1.8 | VAHYAIIGPA | 0.24 | | |
| NS4B | 2359 | 0.1 | 8 | 1 | 0 | yes | VAHYAIIGPGL | 99.04 | | | | | | |
| NS4B | 2360 | 0.09 | 7 | 1 | 0 | yes | AHYAIIGPGL | 99.16 | | | | | | |
| NS4B | 2361 | 0.08 | 6 | 1 | 0 | yes | HYAIIGPGLQ | 99.28 | | | | | | |
| NS4B | 2362 | 0.08 | 6 | 1 | 0 | yes | YAIIGPGLQA | 99.28 | | | | | | |
| NS4B | 2363 | 0.08 | 6 | 1 | 0 | yes | AIIGPGLQAK | 99.28 | | | | | | |
| NS4B | 2364 | 0.09 | 7 | 1 | 0 | yes | IIGPGLQAKA | 99.16 | | | | | | |
| NS4B | 2365 | 0.08 | 6 | 1 | 0 | yes | IGPGLQAKAT | 99.28 | | | | | | |
| NS4B | 2366 | 0.05 | 4 | 1 | 0 | yes | GPGLQAKATR | 99.52 | | | | | | |
| NS4B | 2367 | 0.04 | 3 | 1 | 0 | yes | PGLQAKATRE | 99.64 | | | | | | |
| NS4B | 2368 | 0.05 | 4 | 1 | 0 | yes | GLQAKATREA | 99.52 | | | | | | |
| NS4B | 2369 | 0.05 | 4 | 1 | 0 | yes | LQAKATREAQ | 99.52 | | | | | | |
| NS4B | 2370 | 0.05 | 4 | 1 | 0 | yes | QAKATREAQK | 99.52 | | | | | | |
| NS4B | 2371 | 0.38 | 5 | 2 | 0 | yes | AKATREAQKR | 99.52 | | | | | | |
| NS4B | 2371 | 0.38 | 5 | 2 | 0 | yes | KATREAQKRA | 93.53 | KATREAQKRT | 5.99 | | | | |
| NS4B | 2372 | 0.38 | 5 | 2 | 0 | yes | ATREAQKRAA | 93.53 | ATREAQKRTA | 5.99 | | | | |
| NS4B | 2373 | 0.39 | 6 | 2 | 0 | yes | TREAQKRAAA | 93.41 | TREAQKRTAA | 5.99 | | | | |

FIG. 8-84

Species: DENV2 (10-mers)

| protein | block starting position | block entropy | total peptides in block | # peptides required to cover 99% of block | gap/X fraction | 99% of

FIG. 8-85

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|

FIG. 8-86

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|

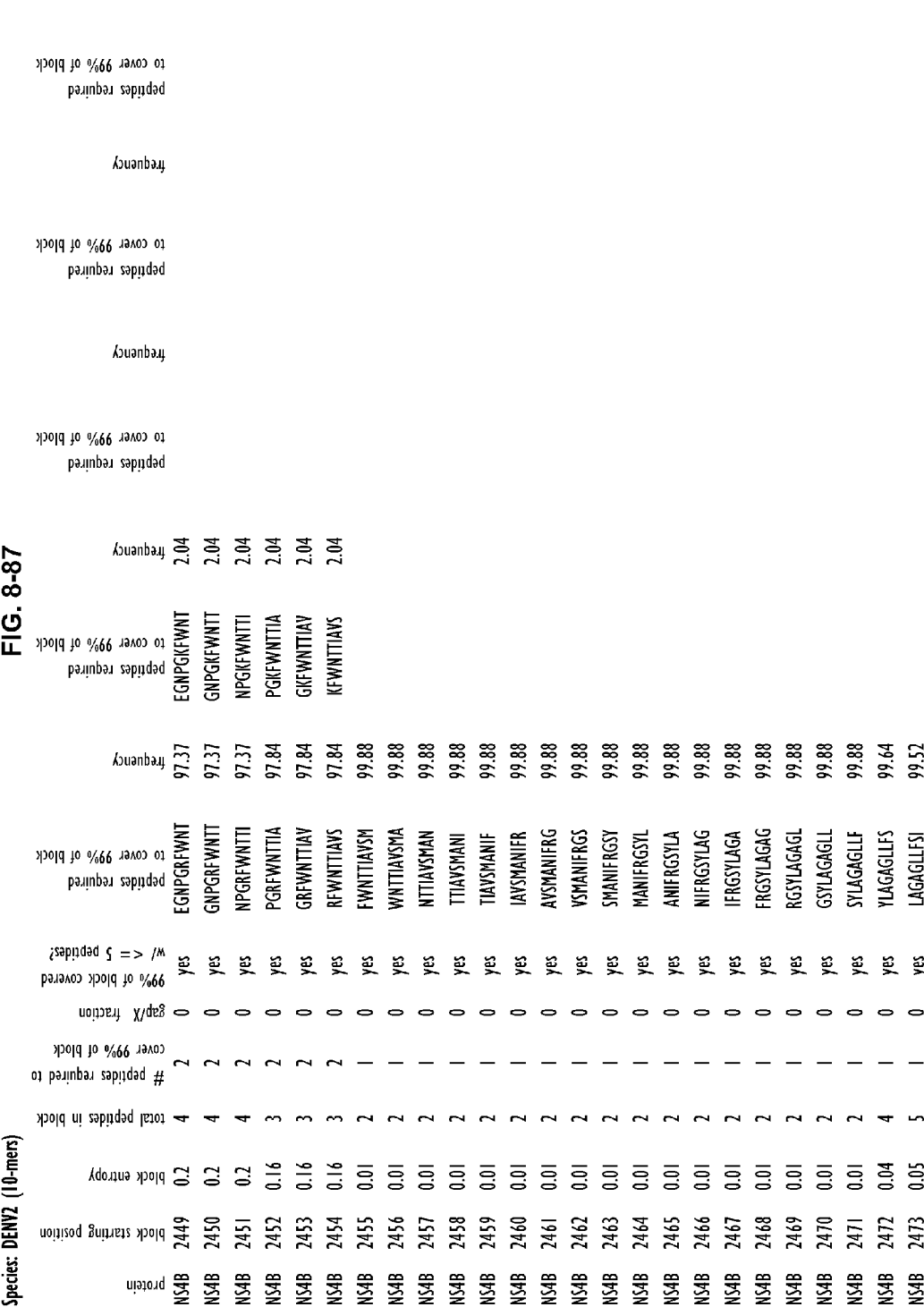

FIG. 8-88

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 8-89

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2515 | 0.35 | 5 | 3 | 0 | yes | EFQIYKKSGI | 95.33 | EFQIYKRSGI | 2.04 | EFQTYKKSGI | 1.92 |
| NS5 | 2516 | 0.35 | 5 | 3 | 0 | yes | FQIYKKSGIQ | 95.33 | FQIYKRSGIQ | 2.04 | FQTYKKSGIQ | 1.92 |
| NS5 | 2517 | 0.33 | 4 | 3 | 0 | yes | QIYKKSGIQE | 95.45 | QIYKRSGIQE | 2.04 | QTYKKSGIQE | 1.92 |
| NS5 | 2518 | 0.33 | 4 | 3 | 0 | yes | IYKKSGIQEV | 95.45 | IYKRSGIQEV | 2.04 | TYKKSGIQEV | 1.92 |
| NS5 | 2519 | 0.14 | 2 | 2 | 0 | yes | YKKSGIQEVD | 97.96 | YKRSGIQEVD | 2.04 | | |
| NS5 | 2520 | 0.14 | 2 | 2 | 0 | yes | KKSGIQEVDR | 97.96 | KRSGIQEVDR | 2.04 | | |
| NS5 | 2521 | 0.14 | 2 | 2 | 0 | yes | KSGIQEVDRT | 97.96 | RSGIQEVDRT | 2.04 | | |
| NS5 | 2522 | 0 | 1 | 1 | 0 | yes | SGIQEVDRTL | 100 | | | | |
| NS5 | 2523 | 0 | 1 | 1 | 0 | yes | GIQEVDRTLA | 100 | | | | |
| NS5 | 2524 | 0 | 1 | 1 | 0 | yes | IQEVDRTLAK | 100 | | | | |
| NS5 | 2525 | 0 | 1 | 1 | 0 | yes | QEVDRTLAKE | 100 | | | | |
| NS5 | 2526 | 0 | 1 | 1 | 0 | yes | EVDRTLAKEG | 100 | | | | |
| NS5 | 2527 | 0 | 1 | 1 | 0 | yes | VDRTLAKEGI | 100 | | | | |
| NS5 | 2528 | 0.03 | 2 | 1 | 0 | yes | DRTLAKEGIK | 99.64 | | | | |
| NS5 | 2529 | 0.03 | 2 | 1 | 0 | yes | RTLAKEGIKR | 99.64 | | | | |
| NS5 | 2530 | 0.03 | 2 | 1 | 0 | yes | TLAKEGIKRG | 99.64 | | | | |
| NS5 | 2531 | 0.03 | 2 | 1 | 0 | yes | LAKEGIKRGE | 99.64 | | | | |
| NS5 | 2532 | 0.03 | 2 | 1 | 0 | yes | AKEGIKRGET | 99.64 | | | | |
| NS5 | 2533 | 0.03 | 2 | 1 | 0 | yes | KEGIKRGETD | 99.64 | | | | |
| NS5 | 2534 | 0.03 | 2 | 1 | 0 | yes | EGIKRGETDH | 99.64 | | | | |
| NS5 | 2535 | 0.03 | 2 | 1 | 0 | yes | GIKRGETDHH | 99.64 | | | | |
| NS5 | 2536 | 0.05 | 3 | 1 | 0 | yes | IKRGETDHHA | 99.52 | | | | |
| NS5 | 2537 | 0.05 | 3 | 1 | 0 | yes | KRGETDHHAV | 99.52 | | | | |
| NS5 | 2538 | 0.01 | 2 | 1 | 0 | yes | RGETDHHAVS | 99.88 | | | | |
| NS5 | 2539 | 0.01 | 2 | 1 | 0 | yes | GETDHHAYSR | 99.88 | | | | |

FIG. 8-90

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2540 | 0.01 | 2 | 1 | 0 | yes | ETDHHAYSRG | 99.88 | | | | | | |
| NS5 | 2541 | 0.01 | 2 | 1 | 0 | yes | TDHHAYSRGS | 99.88 | | | | | | |
| NS5 | 2542 | 0.01 | 2 | 1 | 0 | yes | DHHAYSRGSA | 99.88 | | | | | | |
| NS5 | 2543 | 0.01 | 2 | 1 | 0 | yes | HHAYSRGSAK | 99.88 | | | | | | |
| NS5 | 2544 | 0.01 | 2 | 1 | 0 | yes | HAYSRGSAKL | 99.88 | | | | | | |
| NS5 | 2545 | 0.01 | 2 | 1 | 0 | yes | AYSRGSAKLR | 99.88 | | | | | | |
| NS5 | 2546 | 0.01 | 2 | 1 | 0 | yes | YSRGSAKLRW | 99.88 | | | | | | |
| NS5 | 2547 | 0.01 | 2 | 1 | 0 | yes | SRGSAKLRWF | 99.88 | | | | | | |
| NS5 | 2548 | 0.01 | 2 | 1 | 0 | yes | RGSAKLRWFV | 99.88 | | | | | | |
| NS5 | 2549 | 0.01 | 2 | 1 | 0 | yes | GSAKLRWFVE | 99.88 | | | | | | |
| NS5 | 2550 | 0.01 | 2 | 1 | 0 | yes | SAKLRWFVER | 99.88 | | | | | | |
| NS5 | 2551 | 0.01 | 2 | 1 | 0 | yes | AKLRWFVERN | 99.88 | | | | | | |
| NS5 | 2552 | 0.43 | 3 | 2 | 0 | yes | KLRWFVERNM | 91.5 | KLRWFVERNL | 8.38 | | | | |
| NS5 | 2553 | 0.46 | 4 | 2 | 0 | yes | LRWFVERNMV | 91.14 | LRWFVERNLV | 8.38 | | | | |
| NS5 | 2554 | 0.62 | 6 | 3 | 0 | yes | RWFVERNMVT | 88.98 | RWFVERNLVT | 8.38 | RWFVERNMVA | 2.04 | | |
| NS5 | 2555 | 0.62 | 6 | 3 | 0 | yes | WFVERNMVTP | 88.98 | WFVERNLVTP | 8.38 | WFVERNMVAP | 2.04 | | |
| NS5 | 2556 | 0.61 | 5 | 3 | 0 | yes | FVERNMVTPE | 88.98 | FVERNLVTPE | 8.5 | FVERNMVAPE | 2.04 | | |
| NS5 | 2557 | 0.61 | 6 | 3 | 0 | yes | VERNMVTPEG | 88.98 | VERNLVTPEG | 8.5 | VERNMVAPEG | 2.04 | | |
| NS5 | 2558 | 0.62 | 5 | 3 | 0 | yes | ERNMVTPEGK | 88.86 | ERNLVTPEGK | 8.5 | ERNMVAPEGK | 2.04 | | |
| NS5 | 2559 | 0.62 | 6 | 3 | 0 | yes | RNMVTPEGKV | 88.86 | RNLVTPEGKV | 8.5 | RNMVAPEGKV | 2.04 | | |
| NS5 | 2560 | 0.7 | 8 | 4 | 0 | yes | NMVTPEGKVW | 88.86 | NLVTPEGKVM | 6.23 | NLVTPEGKVW | 2.28 | NMVAPEGKVW | 2.04 |
| NS5 | 2561 | 0.7 | 8 | 4 | 0 | yes | MVTPEGKVWD | 88.86 | LVTPEGKVMD | 6.23 | LVTPEGKVWD | 2.28 | MVAPEGKVWD | 2.04 |
| NS5 | 2562 | 0.36 | 7 | 3 | 0 | yes | VTPEGKVWDL | 95.09 | VTPEGKVMDL | 2.28 | VAPEGKVWDL | 2.04 | | |
| NS5 | 2563 | 0.34 | 6 | 3 | 0 | yes | TPEGKVWDLG | 95.33 | TPEGKVMDLG | 2.28 | APEGKVWDLG | 2.04 | | |
| NS5 | 2564 | 0.2 | 5 | 2 | 0 | yes | PEGKVWDLGC | 97.37 | PEGKVMDLGC | 2.28 | | | | |

FIG. 8-91

Species: DENV2 (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2565 | 0.21 | 6 | 2 | 0 | yes | EGKVVDLGCG | 97.25 | EGKVMDLGCG | 2.28 | | | | |
| NS5 | 2566 | 0.21 | 6 | 2 | 0 | yes | GKVVDLGCGR | 97.25 | GKVMDLGCGR | 2.28 | | | | |
| NS5 | 2567 | 0.21 | 6 | 2 | 0 | yes | KVVDLGCGRG | 97.25 | KVMDLGCGRG | 2.28 | | | | |
| NS5 | 2568 | 0.2 | 5 | 2 | 0 | yes | VVDLGCGRGG | 97.37 | VMDLGCGRGG | 2.28 | | | | |
| NS5 | 2569 | 0.2 | 5 | 2 | 0 | yes | VDLGCGRGGW | 97.37 | MDLGCGRGGW | 2.28 | | | | |
| NS5 | 2570 | 0.03 | 3 | 1 | 0 | yes | DLGCGRGGWS | 99.76 | | | | | | |
| NS5 | 2571 | 0.03 | 3 | 1 | 0 | yes | LGCGRGGWSY | 99.76 | | | | | | |
| NS5 | 2572 | 0.04 | 4 | 1 | 0 | yes | GCGRGGWSYY | 99.64 | | | | | | |
| NS5 | 2573 | 0.04 | 4 | 1 | 0 | yes | CGRGGWSYYC | 99.64 | | | | | | |
| NS5 | 2574 | 0.03 | 3 | 1 | 0 | yes | GRGGWSYYCG | 99.76 | | | | | | |
| NS5 | 2575 | 0.01 | 2 | 1 | 0 | yes | RGGWSYYCGG | 99.88 | | | | | | |
| NS5 | 2576 | 0.03 | 3 | 1 | 0 | yes | GGWSYYCGGL | 99.76 | | | | | | |
| NS5 | 2577 | 0.06 | 5 | 1 | 0 | yes | GWSYYCGGLK | 99.4 | | | | | | |
| NS5 | 2578 | 0.32 | 7 | 3 | 0 | yes | WSYYCGGLKN | 95.57 | WSYYCGGLKD | 3.23 | WSYYCGGLKS | 0.6 | | |
| NS5 | 2579 | 0.32 | 7 | 3 | 0 | yes | SYYCGGLKNV | 95.57 | SYYCGGLKDV | 3.23 | SYYCGGLKSV | 0.6 | | |
| NS5 | 2580 | 0.65 | 8 | 4 | 0 | yes | YYCGGLKNVK | 89.58 | YYCGGLKDVR | 5.99 | YYCGGLKDVR | 3.23 | YYCGGLKSVR | 0.6 |
| NS5 | 2581 | 0.66 | 9 | 4 | 0 | yes | YCGGLKNVRE | 89.46 | YCGGLKDVRE | 5.99 | YCGGLKDVRE | 3.23 | YCGGLKSVRE | 0.6 |
| NS5 | 2582 | 0.65 | 8 | 4 | 0 | yes | CGGLKNVREV | 89.46 | CGGLKDVREV | 6.11 | CGGLKDVREV | 3.23 | CGGLKSVREV | 0.6 |
| NS5 | 2583 | 0.65 | 8 | 4 | 0 | yes | GGLKNVREVK | 89.46 | GGLKDVREVK | 6.11 | GGLKDVREVK | 3.23 | GGLKSVREVK | 0.6 |
| NS5 | 2584 | 0.65 | 8 | 4 | 0 | yes | GLKNVREVKG | 89.46 | GLKDVREVKG | 6.11 | GLKDVREVKG | 3.23 | GLKSVREVKG | 0.6 |
| NS5 | 2585 | 0.65 | 8 | 4 | 0 | yes | LKNVREVKGL | 89.46 | LKDVREVKGL | 6.11 | LKDVREVKGL | 3.23 | LKSVREVKGL | 0.6 |
| NS5 | 2586 | 0.64 | 7 | 4 | 0 | yes | KNVREVKGLT | 89.58 | KNVKEVKGLT | 6.11 | KDVREVKGLT | 3.23 | KSVREVKGLT | 0.6 |
| NS5 | 2587 | 0.62 | 6 | 3 | 0 | yes | NVREVKGLTK | 89.7 | NVKEVKGLTK | 6.11 | DVREVKGLTK | 3.23 | | |
| NS5 | 2588 | 0.38 | 5 | 2 | 0 | yes | VREVKGLTKG | 93.41 | VKEVKGLTKG | 6.11 | | | | |
| NS5 | 2589 | 0.38 | 5 | 2 | 0 | yes | REVKGLTKGG | 93.41 | KEVKGLTKGG | 6.11 | | | | |

FIG. 8-92

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2590 | 0.05 | 4 | 1 | 0 | yes | EWKGLTKGGP | 99.52 | | |
| NS5 | 2591 | 0.04 | 3 | 1 | 0 | yes | VKGLTKGGPG | 99.64 | | |
| NS5 | 2592 | 0.04 | 3 | 1 | 0 | yes | KGLTKGGPGH | 99.64 | | |
| NS5 | 2593 | 0.04 | 3 | 1 | 0 | yes | GLTKGGPGHE | 99.64 | | |
| NS5 | 2594 | 0.04 | 3 | 1 | 0 | yes | LTKGGPGHEE | 99.64 | | |
| NS5 | 2595 | 0.04 | 4 | 1 | 0 | yes | TKGGPGHEEP | 99.64 | | |
| NS5 | 2596 | 0.12 | 4 | 2 | 0 | yes | KGGPGHEEPI | 98.68 | KGGPGHEEPV | 0.96 |
| NS5 | 2597 | 0.1 | 3 | 2 | 0 | yes | GGPGHEEPIP | 98.8 | GGPGHEEPVP | 0.96 |
| NS5 | 2598 | 0.09 | 3 | 2 | 0 | yes | GPGHEEPIPM | 98.92 | GPGHEEPVPM | 0.96 |
| NS5 | 2599 | 0.09 | 3 | 2 | 0 | yes | PGHEEPIPMS | 98.92 | PGHEEPVPMS | 0.96 |
| NS5 | 2600 | 0.09 | 3 | 2 | 0 | yes | GHEEPIPMST | 98.92 | GHEEPVPMST | 0.96 |
| NS5 | 2601 | 0.09 | 3 | 2 | 0 | yes | HEEPIPMSTY | 98.92 | HEEPVPMSTY | 0.96 |
| NS5 | 2602 | 0.09 | 3 | 2 | 0 | yes | EEPIPMSTYG | 98.92 | EEPVPMSTYG | 0.96 |
| NS5 | 2603 | 0.09 | 3 | 2 | 0 | yes | EPIPMSTYGW | 98.92 | EPVPMSTYGW | 0.96 |
| NS5 | 2604 | 0.09 | 3 | 2 | 0 | yes | PIPMSTYGWN | 98.92 | PVPMSTYGWN | 0.96 |
| NS5 | 2605 | 0.09 | 3 | 2 | 0 | yes | IPMSTYGWNL | 98.92 | VPMSTYGWNL | 0.96 |
| NS5 | 2606 | 0.01 | 2 | 1 | 0 | yes | PMSTYGWNLV | 99.88 | | |
| NS5 | 2607 | 0 | 1 | 1 | 0 | yes | MSTYGWNLVR | 100 | | |
| NS5 | 2608 | 0 | 1 | 1 | 0 | yes | STYGWNLVRL | 100 | | |
| NS5 | 2609 | 0 | 1 | 1 | 0 | yes | TYGWNLVRLQ | 100 | | |
| NS5 | 2610 | 0 | 1 | 1 | 0 | yes | YGWNLVRLQS | 100 | | |
| NS5 | 2611 | 0 | 1 | 1 | 0 | yes | GWNLVRLQSG | 100 | | |
| NS5 | 2612 | 0.08 | 2 | 1 | 0 | yes | WNLVRLQSGV | 99.04 | | |
| NS5 | 2613 | 0.09 | 3 | 2 | 0 | yes | NLVRLQSGVD | 98.92 | NLVRLQSGID | 0.96 |
| NS5 | 2614 | 0.09 | 3 | 2 | 0 | yes | LVRLQSGVDV | 98.92 | LVRLQSGIDV | 0.96 |

FIG. 8-93

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2615 | 0.09 | 3 | 2 | 0 | yes | VRLQSGVDVF | 98.92 | | | | | | |

FIG. 8-94

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2640 | 1.02 | 4 | 2 | 0 | yes | ESSPN

FIG. 8-95

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 8-97

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2722 | 0.05 | 4 | 1 | 0 | yes | SVNMIS

FIG. 8-98

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2747 | 0.02 | 2 | 1 | 0 | yes | VDLGS

FIG. 8-99

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 8-100

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 8-101

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|

FIG. 8-102

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2855 | 0.05 | 4 | 1 | 0 | yes | QEPKEGTKKL | 99.52 | | | | | | |
| NS5 | 2856 | 0.05 | 4 | 1 | 0 | yes | EPKEGTKKLM | 99.52 | | | | | | |
| NS5 | 2857 | 0.67 | 4 | 2 | 0 | yes | PKEGTKKLMK | 83.83 | PKEGTKKLMR | 15.81 | | | | |
| NS5 | 2858 | 0.67 | 4 | 2 | 0 | yes | KEGTKKLMKI | 83.83 | KEGTKKLMRI | 15.81 | | | | |
| NS5 | 2859 | 0.67 | 4 | 2 | 0 | yes | EGTKKLMKIT | 83.83 | EGTKKLMRIT | 15.81 | | | | |
| NS5 | 2860 | 0.67 | 4 | 2 | 0 | yes | GTKKLMKITA | 83.83 | GTKKLMRITA | 15.81 | | | | |
| NS5 | 2861 | 0.79 | 6 | 4 | 0 | yes | TKKLMKITAE | 82.75 | TKKLMRITAE | 15.09 | TKKLMKITAK | 0.96 | TKKLMRITAK | 0.72 |
| NS5 | 2862 | 0.79 | 6 | 4 | 0 | yes | KKLMKITAEW | 82.75 | KKLMRITAEW | 15.09 | KKLMRITAKW | 0.96 | KKLMRITAKW | 0.72 |
| NS5 | 2863 | 0.79 | 6 | 4 | 0 | yes | KLMKITAEWL | 82.75 | KLMRITAEWL | 15.09 | KLMRITAKWL | 0.96 | | |
| NS5 | 2864 | 0.78 | 5 | 3 | 0 | yes | LMKITAEWLW | 82.75 | LMRITAEWLW | 15.33 | LMKITAK

FIG. 8-103

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2888 | 0.77 | 8 | 4 | 0 | yes | EEFTRKKVRSN | 85.39 | EEFTKKVRSN | 11.5 | AEFCNKVRSN | 1.92 | EEFARKVRSN | 0.36 |
| NS5 | 2889 | 0.73 | 6 | 3 | 0 | yes | EFTRKVRSNA | 85.63 | EFTKKVRSNA | 11.62 | EFCNKVRSNA | 1.92 | | |
| NS5 | 2890 | 0.73 | 6 | 3 | 0 | yes | FTRKVRSNAA | 85.63 | FTKKVRSNAA | 11.62 | FCNKVRSNAA | 1.92 | | |
| NS5 | 2891 | 0.73 | 6 | 3 | 0 | yes | TRKVRSNAAL | 85.63 | TKKVRSNAAL | 11.62 | CNKVRSNAAL | 1.92 | | |
| NS5 | 2892 | 0.68 | 4 | 3 | 0 | yes | RKVRSNAALG | 86.23 | KKVRSNAALG | 11.62 | NKVRSNAALG | 1.92 | | |
| NS5 | 2893 | 0.02 | 2 | 1 | 0 | yes | KVRSNAALGA | 99.76 | | | | | | |
| NS5 | 2894 | 0.26 | 3 | 2 | 0 | yes | VRSNAALGAI | 95.81 | VRSNAALGAV | 3.95 | | | | |
| NS5

FIG. 8-104

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

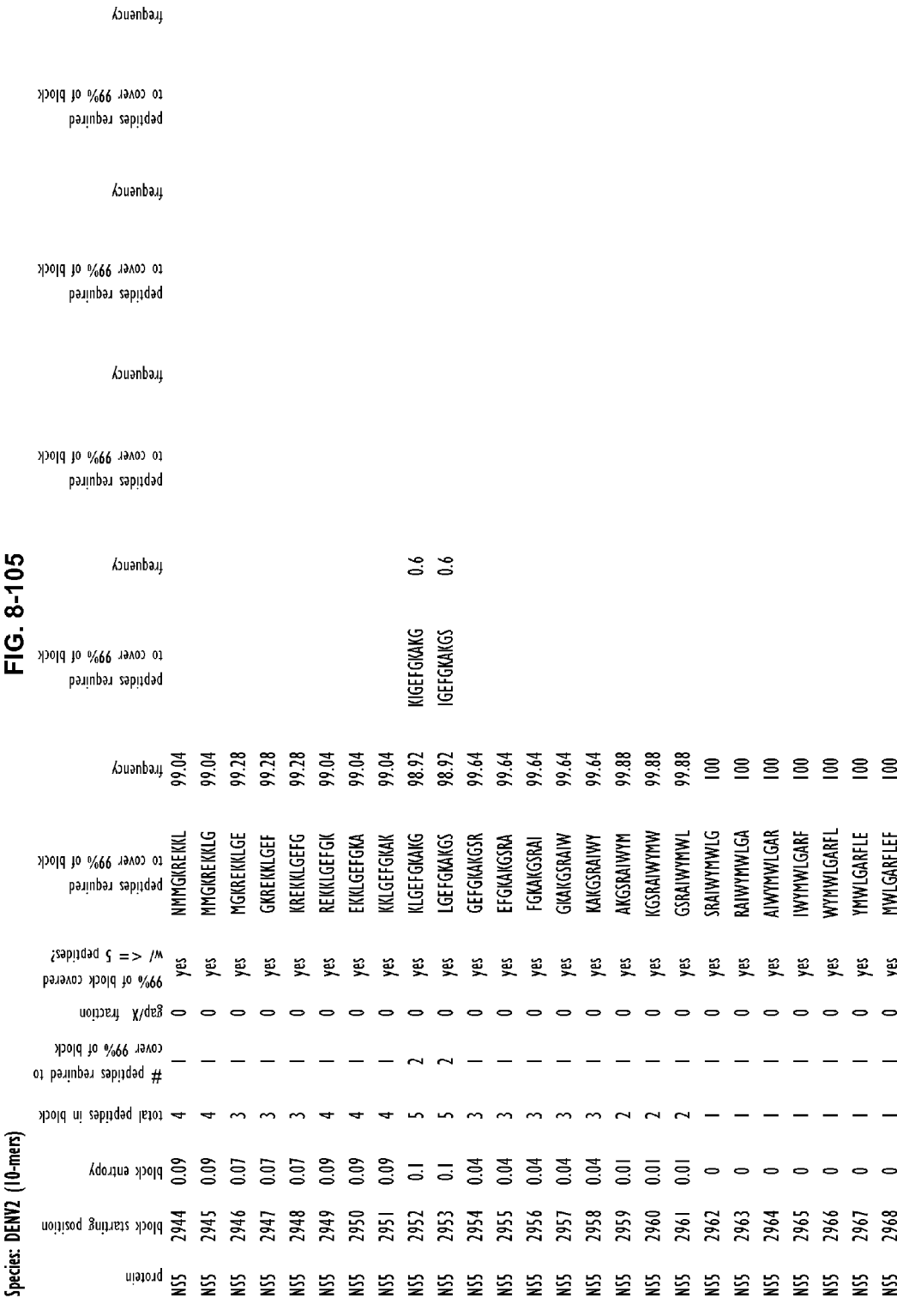

FIG. 8-107

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2994 | 0.05 | 5 | 1 | 0 | yes | SLSGVEGEGL | 99.52 | | | | | | |
| NS5 | 2995 | 0.11 | 6 | 2 | 0 | yes | LSGVEGEGLH | 98.92 | LSGVEGEGLY | 0.6 | | | | |
| NS5 | 2996 | 1.07 | 7 | 3 | 0 | yes | SGVEGEGLHK | 59.28 | SGVEGEGLHR | 39.64 | SGVEGEGLYK | 0.6 | | |
| NS5 | 2997 | 1.07 | 7 | 3 | 0 | yes | GVEGEGLHKL | 59.28 | GVEGEGLHRL | 39.64 | GVEGEGLYKL | 0.6 | | |
| NS5 | 2998 | 1.08 | 8 | 3 | 0 | yes | VEGEGLHKLG | 59.16 | VEGEGLHRLG | 39.64 | VEGEGLYKLG | 0.6 | | |
| NS5 | 2999 | 1.07 | 7 | 3 | 0 | yes | EGEGLHKLGY | 59.28 | EGEGLHRLGY | 39.64 | EGEGLYKLGY | 0.6 | | |
| NS5 | 3000 | 1.07 | 7 | 3 | 0 | yes | GEGLHKLGYI | 59.28 | GEGLHRLGYI | 39.64 | GEGLYKLGYI | 0.6 | | |
| NS5 | 3001 | 1.05 | 7 | 2 | 0 | yes | EGLHKLGYIL | 59.4 | EGLHRLGYIL | 39.64 | | | | |
| NS5 | 3002 | 1.05 | 6 | 2 | 0 | yes | GLHKLGYILR | 59.52 | GLHRLGYILR | 39.52 | | | | |
| NS5 | 3003 | 1.43 | 8 | 4 | 0 | yes | LHKLGYILRD | 56.17 | LHRLGYILRD | 35.45 | LHRLGYILRE | 4.07 | LHKLGYILRE | 3.35 |
| NS5 | 3004 | 1.54 | 8 | 5 | 0 | yes | HKLGYILRDV | 54.37 | HRLGYILRDV | 35.45 | HRLGYILREV | 4.07 | HKLGYILREV | 3.35 | HKLGYILRDI | 1.92 |
| NS5 | 3006 | 1.42 | 10 | 5 | 0 | yes | LGYILRDVSK | 65.75 | LGYILRDVGK | 24.43 | LGYILREVGK | 4.07 | LGYILREVSK | 3.35 | LGYILRDISR | 1.44 |
| NS5 | 3007 | 1.42 | 10 | 5 | 0 | yes | GYILRDVSKK | 65.75 | GYILRDVGKK | 24.43 | GYILREVGKK | 4.07 | GYILREVSKK | 3.35 | GYILRDISRK | 1.44 |
| NS5 | 3013 | 1.1 | 12 | 5 | 0 | yes | VSKKEGGAMY | 68.98 | VGKKEGGAMY | 28.38 | ISRKAGGAMY | 1.08 | ISKKAGGAMY | 0.36 | VSKKEGGTMY | 0.24 |
| NS5 | 3014 | 1.08 | 10 | 5 | 0 | yes | SKKEGGAMYA | 69.1 | GKKEGGAMYA | 28.38 | SRKAGGAMYA | 1.08 | SKKAGGAMYA | 0.36 | SKKEGGTMYA | 0.24 |
| NS5 | 3015 | 0.22 | 8 | 3 | 0 | yes | KKEGGAMYAD | 97.6 | RKAGGAMYAD | 1.08 | KKAGGAMYAD | 0.36 | | | |
| NS5 | 3016 | 0.18 | 6 | 2 | 0 | yes | KEGGAMYADD | 97.84 | KAGGAMYADD | 1.44 | | | | |
| NS5 | 3017 | 0.18 | 6 | 2 | 0 | yes | EGGAMYADDT | 97.84 | AGGAMYADDT | 1.44 | | | | |
| NS5 | 3018 | 0.06 | 4 | 1 | 0 | yes | GGAMYADDTA | 99.4 | | | | | | |
| NS5 | 3019 | 0.06 | 4 | 1 | 0 | yes | GAMYADDTAG | 99.4 | | | | | | |
| NS5 | 3020 | 0.06 | 4 | 1 | 0 | yes | AMYADDTAGW | 99.4 | | | | | | |
| NS5 | 3021 | 0.02 | 2 | 1 | 0 | yes | MYADDTAGWD | 99.76 | | | | | | |
| NS5 | 3022 | 0 | 1 | 1 | 0 | yes | YADDTAGWDT | 100 | | | | | | |
| NS5 | 3023 | 0.05 | 2 | 1 | 0 | yes | ADDTAGWDTR | 99.4 | | | | | | |
| NS5 | 3024 | 0.05 | 2 | 1 | 0 | yes | DDTAGWDTRI | 99.4 | | | | | | |

FIG. 8-108

Species: DENV2 (10-mers)

| protein | block starting position | block entropy | total

FIG. 8-109

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3060 | 0.1 | 4 | 2 | 0 | yes | FKLTYQNKVV

FIG. 8-110

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 3085 | 0.58 | 2 | 2 | 0 | yes | SRKDQRGSGQ | 86.11 | SRKDQRGSGQ | 13.89 | | |
| NS5 | 3086 | 0.58 | 2 | 2 | 0 | yes | RRDQRGSGQV | 86.11 | RKDQRGSGQV | 13.89 | | |
| NS5 | 3087 | 0.9 | 5 | 3 | 0 | yes | RDQRGSGQVG | 80.6 | KDQRGSGQVG | 13.77 | RDQRGSGQVW | 5.39 |
| NS5 | 3088 | 0.32 | 3 | 2 | 0 | yes | DQRGSGQVGT | 94.37 | DQRGSGQVWT | 5.51 | | |
| NS5 | 3089 | 0.32 | 3 | 2 | 0 | yes | QRGSGQVGTY | 94.37 | QRGSGQVWTY | 5.51 | | |
| NS5 | 3090 | 0.32 | 3 | 2 | 0 | yes | RGSGQVGTYG | 94.37 | RGSGQVWTYG | 5.51 | | |
| NS5 | 3091 | 0.32 | 3 | 2 | 0 | yes | GSGQVGTYGL | 94.37 | GSGQVWTYGL | 5.51 | | |
| NS5 | 3092 | 0.32 | 3 | 2 | 0 | yes | SGQVGTYGLN | 94.37 | SGQVWTYGLN | 5.51 | | |
| NS5 | 3093 | 0.32 | 3 | 2 | 0 | yes | GQVGTYGLNT | 94.37 | GQVWTYGLNT | 5.51 | | |
| NS5 | 3094 | 0.32 | 3 | 2 | 0 | yes | QVGTYGLNTF | 94.37 | QVWTYGLNTF | 5.51 | | |
| NS5 | 3095 | 0.32 | 3 | 2 | 0 | yes | VGTYGLNTFT | 94.37 | VWTYGLNTFT | 5.51 | | |
| NS5 | 3096 | 0.33 | 4 | 2 | 0 | yes | GTYGLNTFTN | 94.25 | VTYGLNTFTN | 5.51 | | |
| NS5 | 3097 | 0.04 | 3 | 1 | 0 | yes | TYGLNTFTNM | 99.64 | | | | |
| NS5 | 3098 | 0.11 | 4 | 2 | 0 | yes | YGLNTFTNME | 98.8 | YGLNTFTNMG | 0.84 | | |
| NS5 | 3099 | 0.11 | 4 | 2 | 0 | yes | GLNTFTNMEA | 98.8 | GLNTFTNMGA | 0.84 | | |
| NS5 | 3100 | 0.11 | 4 | 2 | 0 | yes | LNTFTNMEAQ | 98.8 | LNTFTNMGAQ | 0.84 | | |
| NS5 | 3101 | 0.12 | 5 | 2 | 0 | yes | NTFTNMEAQL | 98.68 | NTFTNMGAQL | 0.84 | | |
| NS5 | 3102 | 0.12 | 5 | 2 | 0 | yes | TFTNMEAQLI | 98.68 | TFTNMGAQLI | 0.84 | | |
| NS5 | 3103 | 0.12 | 5 | 2 | 0 | yes | FTNMEAQLIR | 98.68 | FTNMGAQLIR | 0.84 | | |
| NS5 | 3104 | 0.12 | 5 | 2 | 0 | yes | TNMEAQLIRQ | 98.68 | TNMGAQLIRQ | 0.84 | | |
| NS5 | 3105 | 0.12 | 5 | 2 | 0 | yes | NMEAQLIRQM | 98.68 | NMGAQLIRQM | 0.84 | | |
| NS5 | 3106 | 0.12 | 4 | 2 | 0 | yes | MEAQLIRQME | 98.8 | MGAQLIRQME | 0.84 | | |
| NS5 | 3107 | 0.11 | 3 | 1 | 0 | yes | EAQLIRQMEG | 99.04 | | | | |
| NS5 | 3108 | 0.08 | 2 | 1 | 0 | yes | AQLIRQMEGE | 99.88 | | | | |
| NS5 | 3109 | 0.01 | 3 | 1 | 0 | yes | QLIRQMEGEG | 99.76 | | | | |

FIG. 8-111

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3110 | 1.13 | 5 | 3 | 0 | yes | LIRQMEGEGI | 54.49 | LIRQMEGEGV | 43.35 | LIRQMEGEGL | 1.92 | | |
| NS5 | 3111 | 1.12 | 4 | 3 | 0 | yes | IRQMEGEGIF | 54.61 | IRQMEGEGVF | 43.35 | IRQMEGEGLF | 1.92 | | |
| NS5 | 3112 | 1.17 | 7 | 3 | 0 | yes | RQMEGEGIFK | 54.49 | RQMEGEGVFK | 42.99 | RQMEGEGLFK | 1.92 | | |
| NS5 | 3140 | 0.31 | 10 | 4 | 0 | yes | RVGRERLSRM | 96.53 | REGRERLARM | 1.32 | RVGRERLTRM | 0.84 | REGRERLSRM | 0.36 |
| NS5 | 3141 | 0.33 | 11 | 5 | 0 | yes | VGRERLSRMA | 96.29 | EGRERLARMA | 1.32 | VGRERLTRMA | 0.84 | EGRERLSRMA | 0.36 |
| NS5 | 3142 | 0.28 | 9 | 3 | 0 | yes | GRERLSRMAI | 96.77 | GRERLARMAI | 1.32 | GRERLTRMAI | 1.08 | | |
| NS5 | 3143 | 0.26 | 8 | 3 | 0 | yes | RERLSRMAIS | 96.89 | RERLARMAIS | 1.32 | RERLTRMAIS | 1.08 | | |
| NS5 | 3144 | 0.25 | 7 | 3 | 0 | yes | ERLSRMAISG | 97.01 | ERLARMAISG | 1.32 | ERLTRMAISG | 1.08 | | |
| NS5 | 3145 | 0.25 | 7 | 3 | 0 | yes | RLSRMAISGD | 97.01 | RLARMAISGD | 1.32 | RLTRMAISGD | 1.08 | | |
| NS5 | 3146 | 0.25 | 7 | 3 | 0 | yes | LSRMAISGDD | 97.01 | LARMAISGDD | 1.32 | LTRMAISGDD | 1.08 | | |
| NS5 | 3147 | 0.25 | 7 | 3 | 0 | yes | SRMAISGDDC | 97.01 | ARMAISGDDC | 1.32 | TRMAISGDDC | 1.08 | | |
| NS5 | 3148 | 0.05 | 4 | 1 | 0 | yes | RMAISGDDCV | 99.52 | | | | | | |
| NS5 | 3149 | 0.08 | 5 | 1 | 0 | yes | MAISGDDCVW | 99.28 | | | | | | |
| NS5 | 3150 | 0.08 | 5 | 1 | 0 | yes | AISGDDCVWK | 99.28 | | | | | | |
| NS5 | 3151 | 0.04 | 3 | 1 | 0 | yes | ISGDDCVWKP | 99.64 | | | | | | |
| NS5 | 3152 | 0.92 | 3 | 2 | 0 | yes | SGDDCVWKPL | 68.86 | SGDDCVWKPI | 30.9 | | | | |
| NS5 | 3153 | 0.92 | 3 | 2 | 0 | yes | GDDCVWKPLD | 68.86 | GDDCVWKPID | 30.9 | | | | |
| NS5 | 3154 | 0.94 | 4 | 2 | 0 | yes | DDCVWKPLDD | 68.62 | DDCVWKPIDD | 30.9 | | | | |
| NS5 | 3155 | 0.94 | 4 | 2 | 0 | yes | DCVWKPLDDR | 68.62 | DCVWKPIDDR | 30.9 | | | | |
| NS5 | 3156 | 0.96 | 5 | 2 | 0 | yes | CVWKPLDDRF | 68.38 | CVWKPIDDRF | 30.9 | | | | |
| NS5 | 3157 | 0.96 | 6 | 2 | 0 | yes | VWKPLDDRFA | 68.38 | VWKPIDDRFA | 30.9 | | | | |
| NS5 | 3162 | 1.15 | 10 | 4 | 0 | yes | DDRFASALTA | 70.66 | DDRFANALTA | 24.31 | DDRFARALTA | 3.47 | DDRFAKALTA | 0.6 |
| NS5 | 3163 | 1.15 | 10 | 4 | 0 | yes | DRFASALTAL | 70.66 | DRFANALTAL | 24.31 | DRFARALTAL | 3.47 | DRFAKALTAL | 0.6 |
| NS5 | 3164 | 1.14 | 9 | 4 | 0 | yes | RFASALTALN | 70.66 | RFANALTALN | 24.43 | RFARALTALN | 3.47 | RFAKALTALN | 0.6 |
| NS5 | 3165 | 1.15 | 10 | 4 | 0 | yes | FASALTALND | 70.66 | FANALTALND | 24.31 | FARALTALND | 3.47 | FAKALTALND | 0.6 |

FIG. 8-112

Species: DENV2 (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to c

FIG. 8-113

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3191 | 0.16 | 4 | 2 | 0 | yes | WNDW

FIG. 8-114

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|

FIG. 8-115

Species: DENV2 (10-mers)

| protein | block starting position | block entropy | total

FIG. 8-116

Species: DENV2 (10-mers)

| protein | block starting position | block entropy | total peptides in block | # peptides required to cover 99% of block | gap/X fraction | 99% of block covered w/ <= 5 peptides? | peptides required

FIG. 8-117

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3298 | 1.09 | 4 | 3 | 0 | yes | EDMLA

FIG. 8-118

Species: DENV2 (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | fr

FIG. 8-119

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3350 | 1.13 | 6 | 4 | 0 | yes | WAKNIQTAIN | 65.99 | W

FIG. 8-120

Species: DENV2 (10-mers)

| protein | block

FIG. 9-1

Species: DENV2 (11-mers)

| protein | block starting position | block entropy | total peptides in block | peptides required to cover 99% of block | gap/X fraction | 99% of block covered w/ <= 5 peptides? | block | frequency | peptides required to cover 99% of block | block | frequency | peptides required to cover 99% of block | block | frequency | peptides required to cover 99% of block | block | frequency |
|---|---|---|---|---|---|---|---|---|---|---|---|---|---|---|---|---|---|
| anC | 10 | 1.11 | 9 | 3 | 0 | yes | STPFNMLKRER | 53.65 | NTPFNMLKRER | 45.15 | TTPFNMLKRER | 0.36 | | | | | |
| anC | 11 | 0.09 | 5 | 1 | 0 | yes | TPFNMLKRERN | 99.16 | | | | | | | | | |
| anC | 12 | 0.01 | 2 | 1 | 0 | yes | PFNMLKRERNR | 99.88 | | | | | | | | | |
| anC | 13 | 0 | 1 | 1 | 0 | yes | FNMLKRERNRV | 100 | | | | | | | | | |
| anC | 14 | 0 | 1 | 1 | 0 | yes | NMLKRERNRVS | 100 | | | | | | | | | |
| anC | 15 | 0.01 | 2 | 1 | 0 | yes | MLKRERNRVST | 99.88 | | | | | | | | | |
| anC | 16 | 0.17 | 5 | 2 | 0 | yes | LKRERNRVSTV | 97.84 | LKRERNRVSTI | 1.8 | | | | | | | |
| anC | 17 | 0.18 | 6 | 2 | 0 | yes | KRERNRVSTVQ | 97.72 | KRERNRVSTIQ | 1.8 | | | | | | | |
| anC | 18 | 0.18 | 6 | 2 | 0 | yes | RERNRVSTVQQ | 97.72 | RERNRVSTIQQ | 1.8 | | | | | | | |
| anC | 19 | 0.18 | 6 | 2 | 0 | yes | ERNRVSTVQQL | 97.72 | ERNRVSTIQQL | 1.8 | | | | | | | |
| anC | 20 | 0.18 | 6 | 2 | 0 | yes | RNRVSTVQQLT | 97.72 | RNRVSTIQQLT | 1.8 | | | | | | | |
| anC | 21 | 0.18 | 6 | 2 | 0 | yes | NRVSTVQQLTK | 97.72 | NRVSTIQQLTK | 1.8 | | | | | | | |
| anC | 22 | 0.18 | 6 | 2 | 0 | yes | RVSTVQQLTKR | 97.72 | RVSTIQQLTKR | 1.8 | | | | | | | |
| anC | 23 | 0.18 | 6 | 2 | 0 | yes | VSTVQQLTKRF | 97.72 | VSTIQQLTKRF | 1.8 | | | | | | | |
| anC | 24 | 0.18 | 6 | 2 | 0 | yes | STVQQLTKRFS | 97.72 | STIQQLTKRFS | 1.8 | | | | | | | |
| anC | 25 | 0.2 | 7 | 2 | 0 | yes | TVQQLTKRFSL | 97.6 | TIQQLTKRFSL | 1.8 | | | | | | | |
| anC | 26 | 0.18 | 6 | 2 | 0 | yes | VQQLTKRFSLG | 97.72 | IQQLTKRFSLG | 1.8 | | | | | | | |
| anC | 27 | 0.04 | 4 | 1 | 0 | yes | QQLTKRFSLGM | 99.64 | | | | | | | | | |
| anC | 28 | 0.03 | 3 | 1 | 0 | yes | QLTKRFSLGML | 99.76 | | | | | | | | | |
| anC | 29 | 0.03 | 3 | 1 | 0 | yes | LTKRFSLGMLQ | 99.76 | | | | | | | | | |
| anC | 30 | 0.03 | 3 | 1 | 0 | yes | TKRFSLGMLQG | 99.76 | | | | | | | | | |
| anC | 31 | 0.08 | 5 | 1 | 0 | yes | KRFSLGMLQGR | 99.28 | | | | | | | | | |
| anC | 32 | 0.08 | 5 | 1 | 0 | yes | RFSLGMLQGRG | 99.28 | | | | | | | | | |
| anC | 33 | 0.08 | 5 | 1 | 0 | yes | FSLGMLQGRGP | 99.28 | | | | | | | | | |
| anC | 34 | 0.08 | 5 | 1 | 0 | yes | SLGMLQGRGPL | 99.28 | | | | | | | | | |
| anC | 35 | 0.12 | 6 | 2 | 0 | yes | LGMLQGRGPLK | 98.8 | LGMLQGRGPLR | 0.48 | | | | | | | |

FIG. 9-2

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency |
|---|---|---|---|---|---|---|---|---|---|---|---|---|
| anC | 36 | 0.11 | 5 | 2 | 0 | yes | GMLQGRGPLKL | 98.92 | GMLQGRGPLRL | 0.48 | | |
| anC | 37 | 0.13 | 6 | 2 | 0 | yes | MLQGRGPLKLF | 98.68 | MLQGRGPLRLF | 0.48 | | |
| anC | 38 | 0.13 | 6 | 2 | 0 | yes | LQGRGPLKLFM | 98.68 | LQGRGPLRLFM | 0.48 | | |
| anC | 39 | 0.13 | 6 | 2 | 0 | yes | QGRGPLKLFMA | 98.68 | QGRGPLRLFMA | 0.48 | | |
| anC | 40 | 0.21 | 7 | 3 | 0 | yes | GRGPLKLFMAL | 97.72 | GRGPLKLFMAF | 0.96 | GRGPLRLFMAL | 0.48 |
| anC | 41 | 0.21 | 7 | 3 | 0 | yes | RGPLKLFMALV | 97.72 | RGPLKLFMAFV | 0.96 | RGPLRLFMALV | 0.48 |
| anC | 42 | 0.19 | 6 | 3 | 0 | yes | GPLKLFMALVA | 97.84 | GPLKLFMAFVA | 0.96 | GPLRLFMALVA | 0.48 |
| anC | 43 | 0.21 | 7 | 3 | 0 | yes | PLKLFMALVAF | 97.72 | PLKLFMAFVAF | 0.96 | PLRLFMALVAF | 0.48 |
| anC | 44 | 0.22 | 8 | 3 | 0 | yes | LKLFMALVAFL | 97.6 | LKLFMAFVAFL | 0.96 | LRLFMALVAFL | 0.48 |
| anC | 45 | 0.22 | 8 | 3 | 0 | yes | KLFMALVAFLR | 97.6 | KLFMAFVAFLR | 0.96 | RLFMALVAFLR | 0.48 |
| anC | 46 | 0.18 | 7 | 2 | 0 | yes | LFMALVAFLRF | 98.08 | LFMAFVAFLRF | 0.96 | | |
| anC | 47 | 0.18 | 7 | 2 | 0 | yes | FMALVAFLRFL | 98.08 | FMAFVAFLRFL | 0.96 | | |
| anC | 48 | 0.15 | 6 | 2 | 0 | yes | MALVAFLRFLT | 98.32 | MAFVAFLRFLT | 0.96 | | |
| anC | 49 | 0.15 | 6 | 2 | 0 | yes | ALVAFLRFLTI | 98.32 | AFVAFLRFLTI | 0.96 | | |
| anC | 50 | 0.17 | 7 | 2 | 0 | yes | LVAFLRFLTIP | 98.2 | FVAFLRFLTIP | 0.96 | | |
| anC | 51 | 0.09 | 6 | 1 | 0 | yes | VAFLRFLTIPP | 99.16 | | | | |
| anC | 52 | 0.09 | 6 | 1 | 0 | yes | AFLRFLTIPPT | 99.16 | | | | |
| anC | 53 | 0.15 | 7 | 2 | 0 | yes | FLRFLTIPPTA | 98.44 | FLRFLTIPPTV | 0.6 | | |
| anC | 54 | 0.14 | 6 | 2 | 0 | yes | LRFLTIPPTAG | 98.56 | LRFLTIPPTVG | 0.6 | | |
| anC | 55 | 0.12 | 5 | 2 | 0 | yes | RFLTIPPTAGI | 98.68 | RFLTIPPTVGI | 0.6 | | |
| anC | 56 | 0.12 | 5 | 2 | 0 | yes | FLTIPPTAGIL | 98.68 | FLTIPPTVGIL | 0.6 | | |
| anC | 57 | 0.14 | 6 | 2 | 0 | yes | LTIPPTAGILK | 98.56 | LTIPPTVGILK | 0.6 | | |
| anC | 58 | 0.14 | 6 | 2 | 0 | yes | TIPPTAGILKR | 98.56 | TIPPTVGILKR | 0.6 | | |
| anC | 59 | 0.14 | 6 | 2 | 0 | yes | IPPTAGILKRW | 98.56 | IPPTVGILKRW | 0.6 | | |
| anC | 60 | 0.12 | 5 | 2 | 0 | yes | PPTAGILKRWG | 98.68 | PPTVGILKRWG | 0.6 | | |
| anC | 61 | 0.16 | 6 | 3 | 0 | yes | PTAGILKRWGT | 98.32 | PTVGILKRWGT | 0.6 | PTTGILKRWGT | 0.48 |

FIG. 9-3

Species: DENV2 (11-mers)

| protein | block starting position | block entropy | total peptides in block | peptides required to cover 99% of block | gap/X fraction | 99% of block covered w/ <= 5 peptides?

FIG. 9-4

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 9-5

Species: DENV2 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 130 | 1.06 | 6 | 3 | 0 | yes | RQEK

FIG. 9-6

Species: DENV2 (11-mers)

| protein | block starting position | block entropy | total peptides in block | peptides required to cover 99% of block | gap/X fraction | 99% of block covered w/ <= 5 peptides? | block | frequency | block (to cover 99%) | frequency | block (to cover 99%) | frequency | block (to cover 99%) | frequency |
|---|---|---|---|---|---|---|---|---|

FIG. 9-7

Species: DENV2 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 204 | 0.1 | 3 | 2 | 0 | yes | KRSVALVPHVG | 98.92 | KRSVALVPHVR | 0.6 | | | | |
| prM | 205 | 0.1 | 3 | 2 | 0 | yes | RSVALVPHVGM | 98.92 | RSVALVPHVRM | 0.6 | | | | |
| prM | 206 | 0.1 | 3 | 2 | 0 | yes | SVALVPHVGMG | 98.92 | SVALVPHVRMG | 0.6 | | | | |
| prM | 207 | 0.1 | 3 | 2 | 0 | yes | VALVPHVGMGL | 98.92 | VALVPHVRMGL | 0.6 | | | | |
| prM | 208 | 0.1 | 3 | 2 | 0 | yes | ALVPHVGMGLE | 98.92 | ALVPHVRMGLE | 0.6 | | | | |
| prM | 209 | 0.1 | 3 | 2 | 0 | yes | LVPHVGMGLET | 98.92 | LVPHVRMGLET | 0.6 | | | | |
| prM | 210 | 0.1 | 3 | 2 | 0 | yes | VPHVGMGLETR | 98.92 | VPHVRMGLETR | 0.6 | | | | |
| prM | 211 | 0.05 | 2 | 1 | 0 | yes | PHVGMGLETRT | 99.4 | | | | | | |
| prM | 212 | 0.05 | 2 | 1 | 0 | yes | HVGMGLETRTE | 99.4 | | | | | | |
| prM | 213 | 0.05 | 2 | 1 | 0 | yes | VGMGLETRTET | 99.4 | | | | | | |
| prM | 214 | 0.05 | 2 | 1 | 0 | yes | GMGLETRTETW | 99.4 | | | | | | |
| prM | 215 | 0 | 1 | 1 | 0 | yes | MGLETRTETWM | 100 | | | | | | |
| prM | 216 | 0 | 1 | 1 | 0 | yes | GLETRTETWMS | 100 | | | | | | |
| prM | 217 | 0 | 1 | 1 | 0 | yes | LETRTETWMSS | 100 | | | | | | |
| prM | 218 | 0.02 | 2 | 1 | 0 | yes | ETRTETWMSSE | 99.76 | | | | | | |
| prM | 219 | 0.04 | 3 | 2 | 0 | yes | TRTETWMSSEG | 99.64 | | | | | | |
| prM | 220 | 0.04 | 3 | 2 | 0 | yes | RTETWMSSEGA | 99.64 | | | | | | |
| prM | 221 | 0.04 | 3 | 2 | 0 | yes | TETWMSSEGA W | 99.64 | | | | | | |
| prM | 222 | 0.04 | 3 | 2 | 0 | yes | ETWMSSEGAWK | 99.64 | | | | | | |
| prM | 223 | 0.17 | 4 | 2 | 0 | yes | TWMSSEGAWKH | 97.72 | TWMSSEGAWKQ | 1.92 | | | | |
| prM | 224 | 1.15 | 5 | 3 | 0 | yes | WMSSEGAWKHA | 50.54 | WMSSEGAWKHQ | 47.19 | WMSSEGAWKQA | 1.92 | | |
| prM | 225 | 1.15 | 5 | 3 | 0 | yes | MSSEGAWKHAQ | 50.54 | MSSEGAWKHVQ | 47.19 | MSSEGAWKQAQ | 1.92 | | |
| prM | 226 | 1.16 | 6 | 3 | 0 | yes | SSEGAWKHAQR | 50.42 | SSEGAWKHVQR | 47.19 | SSEGAWKQAQR | 1.92 | | |
| prM | 227 | 1.16 | 6 | 3 | 0 | yes | SEGAWKHAQRI | 50.42 | SEGAWKHVQRI | 47.19 | SEGAWKQAQRI | 1.92 | | |
| prM | 228 | 1.16 | 6 | 3 | 0 | yes | EGAWKHAQRIE | 50.42 | EGAWKHVQRIE | 47.19 | EGAWKQAQRIE | 1.92 | | |
| prM | 229 | 1.15 | 6 | 3 | 0 | yes | GAWKHAQRIET | 50.42 | GAWKHVQRIET | 47.31 | GAWKQAQRIET | 1.92 | | |

FIG. 9-8

Species: DENV2 (11-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| prM | 230 | 1.14 | 5 | 3 | 0 | yes | AWKHVQRIETW | 50.54 | AWKHAQRIETW | 47.31 | | | AWKQAQRIETW | 1.92 |
| prM | 231 | 1.37 | 6 | 4 | 0 | yes | WKHVQRIETWI | 50.54 | WKHAQRIETWI | 42.4 | | | WKHAQRIETWV | 4.91 | WIQAQRIETWI | 1.92 |
| prM | 232 | 1.39 | 7 | 4 | 0 | yes | KHVQRIETWIL | 50.54 | KHAQRIETWIL | 42.16 | | | KHAQRIETWVL | 4.91 | KQAQRIETWIL | 1.92 |
| prM | 233 | 1.39 | 7 | 4 | 0 | yes | HVQRIETWILR | 50.54 | HAQRIETWILR | 42.16 | | | HAQRIETWVLR | 4.91 | QAQRIETWILR | 1.92 |
| prM | 234 | 1.28 | 6 | 3 | 0 | yes | VQRIETWILRH | 50.54 | AQRIETWILRH | 44.07 | | | AQRIETWVLRH | 4.91 | | |
| prM | 235 | 0.33 | 5 | 2 | 0 | yes | QRIETWILRHP | 94.61 | QRIETWVLRHP | 4.91 | | | | | | |
| prM | 236 | 0.33 | 5 | 2 | 0 | yes | RIETWILRHPG | 94.61 | RIETWVLRHPG | 4.91 | | | | | | |
| prM | 237 | 0.32 | 4 | 2 | 0 | yes | IETWILRHPGF | 94.73 | IETWILRHPGF | 4.91 | | | | | | |
| prM | 238 | 0.45 | 6 | 3 | 0 | yes | ETWILRHPGFT | 93.05 | ETWILRHPGFT | 4.91 | ETWILRHPGFA | 1.56 | | | | |
| prM | 242 | 0.59 | 5 | 5 | 0 | yes | LRHPGFTMMAA | 91.98 | LRHPGFTMMAA | 2.63 | LRHPGFTLMAA | 2.16 | LRHPGFAIMAA | 1.56 | LRHPGFTTMAA | 0.72 |
| prM | 250 | 0.45 | 7 | 3 | 0 | yes | MAAILAYTIGT | 93.41 | MAAILAYTVGT | 3.95 | MAAVLAYTIGT | 1.92 | | | | |
| prM | 251 | 0.46 | 8 | 4 | 0 | yes | AAILAYTIGTT | 93.29 | AAILAYTVGTT | 3.95 | AAVLAYTIGTT | 1.92 | AVLAYTIGTTH | 1.92 | | |
| prM | 252 | 0.78 | 9 | 4 | 0 | yes | AILAYTIGTTH | 87.31 | AILAYTVGTTH | 5.99 | ILAYTVGTTH | 3.95 | VLAYTIGTTHF | 1.92 | | |
| prM | 253 | 0.77 | 9 | 4 | 0 | yes | ILAYTIGTTHF | 87.43 | ILAYTVGTTHF | 5.99 | ILAYTIGTTHF | 3.95 | AYTIGTTHFQ | 1.2 | | |
| prM | 254 | 0.64 | 7 | 3 | 0 | yes | LAYTIGTTHFQ | 89.34 | LAYTVGTTHFQ | 5.99 | LAYTVGTTHFQ | 3.95 | | | | |
| prM | 255 | 0.73 | 8 | 4 | 0 | yes | AYTIGTTHFQR | 88.14 | AYTIGTTHFQR | 5.99 | AYTVGTTHFQR | 3.95 | GTTHFQRALIF | 1.8 | GTTHFQKALIF | 0.84 |
| prM | 259 | 1.34 | 10 | 5 | 0 | yes | GTTHFQRALIF | 67.9 | GTTHFQRVLIF | 22.75 | GTTYFQRVLIF | 5.99 | GTTHFQRTLIF | 1.8 | TTHFQKALIFI | 0.84 |
| prM | 260 | 1.36 | 13 | 5 | 0 | yes | TTHFQRALIFI | 67.78 | TTHFQRVLIFI | 22.75 | TTYFQRVLIFI | 5.87 | TTHFQRTLIFI | 1.8 | THFQKALIFIL | 0.84 |
| prM | 261 | 1.36 | 13 | 5 | 0 | yes | THFQRALIFIL | 67.78 | THFQRVLIFIL | 22.75 | TYFQRVLIFIL | 5.87 | THFQRTLIFIL | 1.8 | HFQKALIFILL | 0.84 |
| prM | 262 | 1.35 | 12 | 5 | 0 | yes | HFQRALIFILL | 67.9 | HFQRVLIFILL | 22.75 | YFQRVLIFILL | 5.87 | HFQRTLIFILL | 1.8 | FQKALIFILLT | 0.84 |
| prM | 263 | 1.36 | 12 | 5 | 0 | yes | FQRALIFILLT | 63.95 | FQRVLIFILLT | 28.62 | FQRALIFILLA | 3.95 | FQRTLIFILLT | 1.8 | LIFILLTVAP | 0.48 |
| prM | 267 | 0.68 | 9 | 4 | 0 | yes | LIFILLTAVAP | 90.06 | LIFILLAAVAP | 3.95 | LIFILLTAIAP | 2.63 | LIFILLTAVTP | 2.28 | IFILLTTVAPS | 0.48 |
| prM | 268 | 0.68 | 8 | 4 | 0 | yes | IFILLTAVAPS | 90.06 | IFILLAAVAPS | 3.95 | IFILLTAIAPS | 2.63 | IFILLTAVTPS | 2.28 | | |
| prM | 269 | 0.66 | 8 | 4 | 0 | yes | FILLTAVAPSM | 90.18 | FILLAAVAPSM | 3.95 | FILLTAIAPSM | 2.63 | FILLTAVTPSM | 2.28 | | |
| prM | 271 | 0.66 | 8 | 5 | 0 | yes | LLTAVAPSMTM | 90.42 | LLAAVAPSMTM | 3.95 | LLTAIAPSMTM | 2.16 | LLTAVTPSMTM | 2.16 | LLTAIAPSMAM | 0.48 |
| prM | 272 | 0.66 | 8 | 5 | 0 | yes | LTAVAPSMTMR | 90.42 | LAAVAPSMTMR | 3.95 | LTAIAPSMTMR | 2.16 | LTAVTPSMTMR | 2.16 | LTTVAPSMTMR | 0.48 |

FIG. 9-9

Species: DENV2 (11-mers)

| protein | block starting position | block entropy | total peptides in block | peptides required to cover 99% of block | gap/X fraction | 99% of block covered w/

FIG. 9-10

Species: DENV2 (11-mers)

| protein | block starting position | block entropy | total peptides in block | peptides required to cover 99% of block | gap/X fraction | covered w/ <=5 99% of block peptides? | block | frequency | block | frequency | block | frequency | block | frequency |
|---|---|---|---|---|---|---|---|---|---|---|---|---|---|---|
| E | 299 | 0 | 1 | 1 | 0 | yes | SWDIWLEHGS | 100 | | | | | | |
| E | 300 | 0 | 1 | 1 | 0 | yes | WDIWLEHGSC | 100 | | | | | | |
| E | 301 | 0 | 1 | 1 | 0 | yes | VDIWLEHGSCV | 100 | | | | | | |
| E | 302 | 0 | 1 | 1 | 0 | yes | DIWLEHGSCVT | 100 | | | | | | |
| E | 303 | 0 | 1 | 1 | 0 | yes | IWLEHGSCVTT | 100 | | | | | | |
| E | 304 | 0 | 1 | 1 | 0 | yes | WLEHGSCVTTM | 100 | | | | | | |
| E | 305 | 0 | 1 | 1 | 0 | yes | LEHGSCVTTMA | 100 | | | | | | |
| E | 306 | 0.02 | 2 | 1 | 0 | yes | EHGSCVTTMAK | 99.76 | | | | | | |
| E | 307 | 0.02 | 2 | 1 | 0 | yes | HGSCVTTMAKN | 99.76 | | | | | | |
| E | 308 | 0.02 | 2 | 1 | 0 | yes | GSCVTTMAKNK | 99.76 | | | | | | |
| E | 309 | 0.02 | 2 | 1 | 0 | yes | SCVTTMAKNKP | 99.76 | | | | | | |
| E | 310 | 0.02 | 2 | 1 | 0 | yes | CVTTMAKNKPT | 99.76 | | | | | | |
| E | 311 | 0.02 | 2 | 1 | 0 | yes | VTTMAKNKPTL | 99.76 | | | | | | |
| E | 312 | 0.02 | 2 | 1 | 0 | yes | TTMAKNKPTLD | 99.76 | | | | | | |
| E | 313 | 0.04 | 3 | 1 | 0 | yes | TMAKNKPTLDF | 99.64 | | | | | | |
| E | 314 | 0.04 | 3 | 1 | 0 | yes | MAKNKPTLDFE | 99.64 | | | | | | |
| E | 315 | 0.04 | 3 | 1 | 0 | yes | AKNKPTLDFEL | 99.64 | | | | | | |
| E | 316 | 0.14 | 5 | 2 | 0 | yes | KNKPTLDFELI | 98.44 | KNKPTLDFELT | 0.96 | | | | |
| E | 317 | 0.13 | 5 | 2 | 0 | yes | NKPTLDFELIK | 98.56 | NKPTLDFELTK | 0.96 | | | | |
| E | 318 | 0.13 | 5 | 2 | 0 | yes | KPTLDFELIKT | 98.56 | KPTLDFELTKT | 0.96 | | | | |
| E | 319 | 0.13 | 5 | 2 | 0 | yes | PTLDFELIKTE | 98.56 | PTLDFELIKTE | 0.96 | | | | |
| E | 320 | 0.13 | 5 | 2 | 0 | yes | TLDFELIKTEA | 98.56 | TLDFELIKTEA | 0.96 | | | | |
| E | 321 | 0.15 | 6 | 2 | 0 | yes | LDFELIKTEAK | 98.32 | LDFELIKTEAK | 0.96 | | | | |
| E | 322 | 0.49 | 10 | 4 | 0 | yes | DFELIKTEAKQ | 93.17 | DFELIKTEAKH | 4.31 | DFELIKTEAKE | 0.84 | DFELIKTEAKH | 0.84 |
| E | 327 | 0.5 | 9 | 4 | 0 | yes | KTEAKQPATLR | 92.57 | KTEAKHPATLR | 5.27 | KTEAKEPATLR | 0.84 | KTEAKQLATLR | 0.36 |
| E | 328 | 0.49 | 8 | 4 | 0 | yes | TEAKQPATLRK | 92.69 | TEAKHPATLRK | 5.27 | TEAKEPATLRK | 0.84 | TEAKQSATLRK | 0.36 |

FIG. 9-11

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| E | 329 | 0.61 | 10 | 5 | 0 | yes | EAKQPATLRKY | 91.02 | EAKHPATLRKY | 5.27 | EAKQPATLRKF | 1.68 | EAKEPATLRKY | 0.84 | EAKQSATLRKY | 0.36 |
| E | 330 | 0.61 | 10 | 5 | 0 | yes | AKQPATLRKYC | 91.02 | AKHPATLRKYC | 5.27 | AKQPATLRKFC | 1.68 | AKEPATLRKYC | 0.84 | AKQSATLRKYC | 0.36 |
| E | 333 | 0.35 | 10 | 4 | 0 | yes | PATLRKYCIEA | 95.81 | PATLRKFCIEA | 1.68 | PATLRKYCVEA | 1.2 | SATLRKYCIEA | 0.36 | | |
| E | 334 | 0.34 | 8 | 4 | 0 | yes | ATLRKYCIEAK | 95.81 | ATLRKFCIEAK | 1.92 | ATLRKYCVEAK | 1.2 | ATLRKYCIEAR | 0.48 | | |
| E | 335 | 0.33 | 7 | 4 | 0 | yes | TLRKYCIEAKL | 95.93 | TLRKFCIEAKL | 1.92 | TLRKYCVEAKL | 1.2 | TLRKYCIEARL | 0.48 | | |
| E | 336 | 0.32 | 6 | 3 | 0 | yes | LRKYCIEAKLT | 95.93 | LRKFCIEAKLT | 1.92 | LRKYCVEAKLT | 1.2 | | | | |
| E | 337 | 0.32 | 6 | 3 | 0 | yes | RKYCIEAKLTN | 95.93 | RKFCIEAKLTN | 1.92 | RKYCVEAKLTN | 1.2 | | | | |
| E | 338 | 0.32 | 6 | 3 | 0 | yes | KYCIEAKLTNT | 95.81 | KFCIEAKLTNT | 1.92 | KYCVEAKLTNT | 1.2 | | | | |
| E | 339 | 0.33 | 7 | 4 | 0 | yes | YCIEAKLTNTT | 95.81 | FCIEAKLTNTT | 1.92 | YCVEAKLTNTT | 1.2 | YCIEARLTNTT | 0.48 | | |
| E | 340 | 0.2 | 6 | 3 | 0 | yes | CIEAKLTNTTT | 97.72 | CVEAKLTNTTT | 1.2 | CIEARLTNTTT | 0.48 | | | | |
| E | 341 | 0.76 | 10 | 5 | 0 | yes | IEAKLTNTTTE | 88.14 | IEAKLTNTTTA | 5.75 | IEAKLTNTTTD | 3.83 | | | IEARLTNTTTE | 0.36 |
| E | 342 | 0.65 | 7 | 3 | 0 | yes | EAKLTNTTTES | 89.22 | EAKLTNTTTAS | 5.99 | EAKLTNTTTDS | 3.83 | VEAKLTNTTTE | 0.96 | | |
| E | 343 | 0.62 | 6 | 3 | 0 | yes | AKLTNTTTESR | 89.58 | AKLTNTTTASR | 5.99 | AKLTNTTTDSR | 3.83 | | | | |
| E | 344 | 0.62 | 6 | 3 | 0 | yes | KLTNTTTESRC | 89.58 | KLTNTTTASRC | 5.99 | KLTNTTTDSRC | 3.83 | | | | |
| E | 345 | 0.58 | 4 | 3 | 0 | yes | LTNTTTESRCP | 89.94 | LTNTTTASRCP | 6.11 | LTNTTTDSRCP | 3.83 | | | | |
| E | 346 | 0.58 | 4 | 3 | 0 | yes | TNTTTESRCPT | 89.94 | TNTTTASRCPT | 6.11 | TNTTTDSRCPT | 3.83 | | | | |
| E | 347 | 0.58 | 4 | 3 | 0 | yes | NTTTESRCPTQ | 89.94 | NTTTASRCPTQ | 6.11 | NTTTDSRCPTQ | 3.83 | | | | |
| E | 348 | 0.58 | 4 | 3 | 0 | yes | TTTESRCPTQG | 89.94 | TTTASRCPTQG | 6.11 | TTTDSRCPTQG | 3.83 | | | | |
| E | 349 | 0.58 | 4 | 3 | 0 | yes | TTESRCPTQGE | 89.94 | TTASRCPTQGE | 6.11 | TTDSRCPTQGE | 3.83 | | | | |
| E | 350 | 0.56 | 3 | 3 | 0 | yes | TESRCPTQGEP | 90.06 | TASRCPTQGEP | 6.11 | TDSRCPTQGEP | 3.83 | | | | |
| E | 351 | 0.61 | 5 | 4 | 0 | yes | ESRCPTQGEPS | 89.94 | ASRCPTQGEPS | 2.4 | DSRCPTQGEPT | 2.4 | DSRCPTQGEPS | 1.44 | | |
| E | 352 | 0.18 | 3 | 2 | 0 | yes | SRCPTQGEPSL | 97.49 | SRCPTQGEPTL | 2.4 | | | | | | |
| E | 353 | 1.3 | 8 | 5 | 0 | yes | RCPTQGEPSLN | 63.83 | RCPTQGEPSLK | 30.06 | RCPTQGEPTLN | 2.4 | RCPTQGEPSLS | 1.56 | RCPTQGEPSLV | 1.56 |
| E | 354 | 1.3 | 8 | 5 | 0 | yes | CPTQGEPSLNE | 63.83 | CPTQGEPSLKE | 30.06 | CPTQGEPTLNE | 2.4 | CPTQGEPSLVE | 1.56 | CPTQGEPSLSE | 1.56 |
| E | 355 | 1.3 | 8 | 5 | 0 | yes | PTQGEPSLNEE | 63.83 | PTQGEPSLKEE | 30.06 | PTQGEPTLNEE | 2.4 | PTQGEPSLVEE | 1.56 | PTQGEPSLSEE | 1.56 |
| E | 356 | 1.3 | 8 | 5 | 0 | yes | TQGEPSLNEEQ | 63.83 | TQGEPSLKEEQ | 30.06 | TQGEPTLNEEQ | 2.4 | TQGEPSLVEEQ | 1.56 | TQGEPSLSEEQ | 1.56 |

FIG. 9-12

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 357 | 1.3 | 8 | 5 | 0 | yes | QGEPSLNEEQD | 63.83 | QGEPSLKEEQD | 30.06 | QGEPTLNEEQD | 2.4 | QGEPSLVEEQD | 1.56 | QGEPSLSEEQD | 1.56 |
| E | 358 | 1.3 | 8 | 5 | 0 | yes | GEPSLNEE

FIG. 9-13

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block

FIG. 9-14

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| E | 416 | 1.09 | 4 | 3 | 0 | yes | EYTIWTPHSG | 65.63 | EYTIWTPHSG | 31.5 | EYTWTPHSG | 2.51 | | | | |
| E | 417 | 1.09 | 4 | 3 | 0 | yes | YTIWTPHSGE | 65.63 | YTIWTPHSGE | 31.5 | YTIWTPHSGE | 2.51 | | | | |
| E | 418 | 1.1 | 5 | 3 | 0 | yes | TIWTPHSGEE | 65.51 | TIWTPHSGEE | 31.5 | TWTPHSGEE | 2.51 | | | | |
| E | 419 | 1.45 | 9 | 5 | 0 | yes | IWTPHSGEEH | 59.88 | IWTPHSGEEH | 30.78 | IWTPHSGEEN | 5.27 | WITPHSGEEH | 2.51 | IWTPHSGEEN | 0.72 |
| E | 420 | 1.32 | 10 | 5 | 0 | yes | VTPHSGEEHA | 62.4 | WTPHSGEEHA | 30.54 | VTPHSGEENA | 5.27 | WTPHSGEENA | 0.6 | MTPHSGEEHA | 0.36 |
| E | 421 | 1.29 | 9 | 4 | 0 | yes | ITPHSGEEHAV | 62.75 | VTPHSGEEHAV | 30.54 | ITPHSGEENAV | 5.27 | VTPHSGEENAV | 0.6 | | |
| E | 422 | 0.41 | 7 | 2 | 0 | yes | TPHSGEEHAVG | 93.29 | TPHSGEENAVG | 5.87 | | | | | | |
| E | 423 | 0.47 | 10 | 4 | 0.12 | yes | PHSGEEHAVGN | 92.69 | PHSGEENAVGN | 5.87 | PHSGEEYAVGD | 0.36 | PHSGEEYAVGN | 0.24 | | |
| E | 424 | 0.47 | 10 | 4 | 0.24 | yes | HSGEEHAVGND | 92.57 | HSGEENAVGND | 5.87 | HSGEEHAVGDD | 0.36 | HSGEEYAVGND | 0.24 | | |
| E | 425 | 0.48 | 11 | 4 | 0.24 | yes | SGEEHAVGNDT | 92.34 | SGEENAVGNDT | 5.87 | SGEEHAVGDDT | 0.36 | SGEEHSVGNDT | 0.24 | | |
| E | 426 | 0.48 | 11 | 4 | 0.24 | yes | GEEHAVGNDTG | 92.34 | GEENAVGNDTG | 5.87 | GEEHAVGDDTG | 0.36 | GEEYAVGNDTG | 0.24 | | |
| E | 427 | 0.48 | 11 | 4 | 0.24 | yes | EEHAVGNDTGK | 92.34 | EENAVGNDTGK | 5.87 | EEHAVGDDTGK | 0.36 | EEHSVGNDTGK | 0.24 | | |
| E | 428 | 0.48 | 11 | 4 | 0.24 | yes | EHAVGNDTGKH | 92.34 | ENAVGNDTGKH | 5.87 | EHAVGDDTGKH | 0.36 | EYAVGNDTGKH | 0.24 | | |
| E | 429 | 0.48 | 10 | 4 | 0.24 | yes | HAVGNDTGKHG | 92.34 | NAVGNDTGKHG | 5.99 | HAVGDDTGKHG | 0.36 | YAVGNDTGKHG | 0.24 | | |
| E | 430 | 0.58 | 11 | 5 | 0.24 | yes | AVGNDTGKHGK | 91.26 | AVGNDTGKHGQ | 4.55 | AVGNDTGKHGM | 2.51 | AVGDDTGKHGK | 0.36 | AVGNDTGKHGE | 0.24 |
| E | 431 | 0.56 | 9 | 4 | 0.24 | yes | VGNDTGKHGKE | 91.38 | VGNDTGKHGQE | 4.55 | VGNDTGKHGME | 2.75 | VGDDTGKHGKE | 0.36 | | |
| E | 432 | 0.8 | 11 | 5 | 0.24 | yes | GNDTGKHGKEI | 87.31 | GNDTGKHGQEI | 4.55 | GNDTGKHGMEI | 4.07 | GNDTGKHGKEV | 2.75 | GDDTGKHGKEI | 0.24 |
| E | 433 | 0.8 | 11 | 5 | 0.24 | yes | NDTGKHGKEIK | 87.31 | NDTGKHGQEIK | 4.55 | NDTGKHGMEIK | 4.07 | NDTGKHGKEVK | 2.75 | NDTGKHGEEIK | 0.24 |
| E | 434 | 1.56 | 8 | 5 | 0.24 | yes | DTGKHGKEIKI | 58.32 | DTGKHGKEIKV | 29.34 | DTGKHGQEIKV | 4.55 | DTGKHGKEVKI | 4.31 | DTGKHGMEIKV | 2.75 |
| E | 435 | 1.56 | 8 | 5 | 0.24 | yes | TGKHGKEIKIT | 58.32 | TGKHGKEIKVT | 29.34 | TGKHGQEIKVT | 4.55 | TGKHGKEVKIT | 4.55 | TGKHGMEIKVT | 2.75 |
| E | 436 | 1.55 | 7 | 5 | 0.12 | yes | GKHGKEIKITP | 58.44 | GKHGKEIKVTP | 29.34 | GKHGQEIKVTP | 4.55 | GKHGKEVKITP | 4.43 | GKHGMEIKVTP | 2.75 |
| E | 437 | 1.55 | 7 | 5 | 0.12 | yes | KHGKEIKITPQ | 58.44 | KHGKEIKVTPQ | 29.34 | KHGQEIKVTPQ | 4.55 | KHGKEVKITPQ | 4.43 | KHGMEIKVTPQ | 2.75 |
| E | 438 | 1.58 | 10 | 5 | 0 | yes | HGKEIKITPQS | 58.44 | HGKEIKVTPQS | 29.34 | HGQEIKVTPQS | 4.55 | HGKEVKITPQS | 4.19 | HGMEIKVTPQS | 2.75 |
| E | 452 | 0.25 | 8 | 3 | 0 | yes | EAELTGYGTVT | 97.13 | EAELTDYGTIT | 1.32 | EAELTGYGTIT | 0.72 | | | | |
| E | 453 | 0.21 | 6 | 3 | 0 | yes | AELTGYGTVTM | 97.49 | AELTDYGTITM | 1.32 | AELTGYGTITM | 0.72 | | | | |
| E | 454 | 0.2 | 6 | 3 | 0 | yes | ELTGYGTVTME | 97.6 | ELTDYGTITME | 1.32 | ELTGYGTITME | 0.72 | | | | |

FIG. 9-15

Species: DENV2 (11-mers)

| protein | block starting position | block entropy | total peptides in block | peptides required to cover 99% of block | gap/X fraction | 99% of block covered w/ <= 5 peptides? | block (to cover 99%) | frequency | block (peptides required to cover 99% of) | frequency | block (peptides required to cover 99% of) | frequency | block (peptides required to cover 99% of) | frequency |
|---|---|---|---|---|---|---|---|---|---|---|---|---|---|---|
| E | 455 | 0.2 | 6 | 3 | 0 | yes | LTGYGTVTMEC | 97.6 | LTGYGTITMEC | 1.32 | | | | |
| E | 456 | 0.2 | 6 | 3 | 0 | yes | TGYGTVTMECS | 97.6 | TGYGTITMECS | 1.32 | | | | |
| E | 457 | 0.22 | 7 | 3 | 0 | yes | GYGTVTMECSP | 97.49 | DYGTITMECSP | 1.32 | | | | |
| E | 458 | 0.2 | 6 | 2 | 0 | yes | YGTVTMECSPR | 97.49 | YGTITMECSP | 2.04 | | | | |
| E | 459 | 0.21 | 7 | 2 | 0 | yes | GTVTMECSPRT | 97.37 | GTITMECSPRT | 2.04 | | | | |
| E | 460 | 0.31 | 8 | 3 | 0 | yes | TVTMECSPRTG | 96.05 | TITMECSPRTG | 2.04 | TVTMECSPRTS | 1.32 | | |
| E | 461 | 0.31 | 7 | 3 | 0 | yes | VTMECSPRTGL | 96.05 | ITMECSPRTGL | 2.04 | VTMECSPRTSL | 1.32 | | |
| E | 462 | 0.19 | 8 | 2 | 0 | yes | TMECSPRTGLD | 97.84 | TMECSPRTSLD | 1.32 | | | | |
| E | 463 | 0.21 | 9 | 3 | 0 | yes | MECSPRTGLDF | 97.72 | MECSPRTSLDF | 1.32 | | | | |
| E | 464 | 0.22 | 10 | 3 | 0 | yes | ECSPRTGLDFN | 97.6 | ECSPRTSLDFN | 1.32 | ECSPRTGFDFN | 0.24 | | |
| E | 465 | 0.22 | 9 | 2 | 0 | yes | CSPRTGLDFNE | 97.72 | CSPRTSLDFNE | 1.32 | | | | |
| E | 466 | 0.22 | 10 | 3 | 0 | yes | SPRTGLDFNEM | 97.6 | SPRTSLDFNEM | 1.32 | SPRTGFDFNEM | 0.24 | | |
| E | 467 | 0.22 | 10 | 3 | 0 | yes | PRTGLDFNEMV | 97.6 | PRTSLDFNEMV | 1.32 | PRTGFDFNEMV | 0.24 | | |
| E | 468 | 0.21 | 9 | 2 | 0 | yes | RTGLDFNEMVL | 97.72 | RTSLDFNEMVL | 1.32 | | | | |
| E | 469 | 0.21 | 10 | 3 | 0 | yes | TGLDFNEMVLL | 97.72 | TSLDFNEMVLL | 1.32 | | | | |
| E | 470 | 0.22 | 9 | 2 | 0 | yes | GLDFNEMVLLQ | 97.6 | SLDFNEMVLLQ | 1.32 | GFDFNEMVLLQ | 0.24 | | |
| E | 471 | 0.12 | 9 | 2 | 0 | yes | LDFNEMVLLQM | 98.92 | FDFNEMVLLQM | 0.24 | | | | |
| E | 472 | 0.19 | 10 | 3 | 0 | yes | DFNEMVLLQME | 98.08 | DFNEMVLLQMK | 0.72 | DFNEMVLLQMG | 0.36 | | |
| E | 481 | 1.27 | 9 | 5 | 0 | yes | MEDKAWLVHRQ | 57.72 | MENKAWLVHRQ | 38.2 | MEEKAWLVHRQ | 1.56 | MESKAWLVHRQ | 1.2 | MGNKAWLVHRQ | 0.36 |
| E | 482 | 1.27 | 9 | 5 | 0 | yes | EDKAWLVHRQW | 57.72 | ENKAWLVHRQW | 38.2 | EEKAWLVHRQW | 1.56 | ESKAWLVHRQW | 1.2 | GNKAWLVHRQW | 0.36 |
| E | 483 | 1.18 | 6 | 4 | 0 | yes | DKAWLVHRQWF | 58.08 | NKAWLVHRQWF | 38.92 | EKAWLVHRQWF | 1.56 | SKAWLVHRQWF | 1.2 | | |
| E | 484 | 0.01 | 2 | 1 | 0 | yes | KAWLVHRQWFL | 99.88 | | | | | | |
| E | 485 | 0.01 | 2 | 1 | 0 | yes | AWLVHRQWFLD | 99.88 | | | | | | |
| E | 486 | 0 | 1 | 1 | 0 | yes | WLVHRQWFLDL | 100 | | | | | | |
| E | 487 | 0 | 1 | 1 | 0 | yes | LVHRQWFLDLP | 100 | | | | | | |
| E | 488 | 0.01 | 2 | 1 | 0 | yes | VHRQWFLDLPL | 99.88 | | | | | | |

FIG. 9-16

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 489 | 0.01 | 2 | 1 | 0 | yes | HRQWFLDLPLP | 99.88 | | | | | | |
| E | 490 | 0.01 | 2 | 1 | 0 | yes | RQWFLDLPLPW | 99.88 | | | | | | |
| E | 491 | 0.01 | 2 | 1 | 0 | yes | QWFLDLPLPWL | 99.88 | | | | | | |
| E | 492 | 0.03 | 2 | 1 | 0 | yes | WFLDLPLPWLP | 99.76 | | | | | | |
| E | 493 | 0.03 | 3 | 1 | 0 | yes | FLDLPLPWLPG | 99.76 | | | | | | |
| E | 494 | 0.03 | 3 | 1 | 0 | yes | LDLPLPWLPGA | 99.76 | | | | | | |
| E | 495 | 0.03 | 3 | 1 | 0 | yes | DLPLPWLPGAD | 99.76 | | | | | | |
| E | 496 | 0.9 | 6 | 3 | 0 | yes | LPLPWLPGADT | 74.97 | LPLPWLPGADK | 23.71 | | | | |
| E | 497 | 0.9 | 6 | 3 | 0 | yes | PLPWLPGADTQ | 74.97 | PLPWLPGADIQ | 23.71 | | | | |
| E | 498 | 1.08 | 8 | 5 | 0 | yes | LPWLPGADTQG | 73.89 | LPWLPGADKQG | 21.68 | LPWLPGADTQE | 1.08 | LPWLPGADIQG | 0.96 |
| E | 499 | 1.12 | 9 | 5 | 0 | yes | PWLPGADTQGS | 73.53 | PWLPGADKQGS | 21.68 | PWLPGADTQES | 1.08 | PWLPGADIQGS | 0.96 |
| E | 500 | 1.13 | 10 | 5 | 0 | yes | WLPGADTQGSN | 73.41 | WLPGADKQGSN | 21.68 | WLPGADTQESN | 1.08 | WLPGADIQGSN | 0.96 |
| E | 501 | 1.13 | 10 | 5 | 0 | yes | LPGADTQGSNW | 73.41 | LPGADKQGSNW | 21.68 | LPGADTQESNW | 1.08 | LPGADIQGSNW | 0.96 |
| E | 502 | 1.13 | 10 | 5 | 0 | yes | PGADTQGSNWI | 73.41 | PGADKQGSNWI | 21.68 | PGADTQESNWI | 1.08 | PGADIQGSNWI | 0.96 |
| E | 503 | 1.12 | 9 | 5 | 0 | yes | GADTQGSNWIQ | 73.41 | GADKQGSNWIQ | 21.68 | GADTQESNWIQ | 1.2 | GADIQGSNWIQ | 0.96 |
| E | 504 | 1.12 | 9 | 5 | 0 | yes | ADTQGSNWIQK | 73.41 | ADKQGSNWIQK | 21.68 | ADTQESNWIQK | 1.08 | ADIQGSNWIQK | 0.96 |
| E | 505 | 1.13 | 10 | 5 | 0.12 | yes | DTQGSNWIQKE | 73.29 | DKQGSNWIQKE | 21.68 | DTQESNWIQKE | 1.08 | DIQGSNWIQKE | 0.96 |
| E | 507 | 0.98 | 9 | 4 | 0.12 | yes | QGSNWIQKETL | 74.97 | QGSNWIQKEML | 22.4 | QG

FIG. 9-17

Species: DENV2 (11-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| E | 516 | 0.15 | 3 | 2 | 0 | yes | TLVTFKNPHAK | 97.96 | MLVTFKNPHAK | 1.92 |
| E | 517 | 0.12 | 2 | 2 | 0 | yes | LVTFKNPHAKK | 98.32 | LVTFKNPHAKR | 1.68 |
| E | 518 | 0.12 | 2 | 2 | 0 | yes | VTFKNPHAKKQ | 98.32 | VTFKNPHAKRQ | 1.68 |
| E | 519 | 0.12 | 2 | 2 | 0 | yes | TFKNPHAKKQD | 98.32 | TFKNPHAKRQD | 1.68 |
| E | 520 | 0.12 | 2 | 2 | 0 | yes | FKNPHAKKQDV | 98.32 | FKNPHAKRQDV | 1.68 |
| E | 521 | 0.14 | 3 | 2 | 0 | yes | KNPHAKKQDVV | 98.2 | KNPHAKRQDVV | 1.68 |
| E | 522 | 0.16 | 4 | 2 | 0 | yes | NPHAKKQDVVV | 97.96 | NPHAKRQDVVV | 1.68 |
| E | 523 | 0.17 | 5 | 2 | 0 | yes | PHAKKQDVVVL | 97.84 | PHAKRQDVVVL | 1.68 |
| E | 524 | 0.17 | 5 | 2 | 0 | yes | HAKKQDVVVLG | 97.84 | HAKRQDVVVLG | 1.68 |
| E | 525 | 0.17 | 5 | 2 | 0 | yes | AKKQDVVVLGS | 97.84 | AKRQDVVVLGS | 1.68 |
| E | 526 | 0.17 | 5 | 2 | 0 | yes | KKQDVVVLGSQ | 97.84 | KRQDVVVLGSQ | 1.68 |
| E | 527 | 0.17 | 5 | 2 | 0 | yes | KQDVVVLGSQE | 97.84 | RQDVVVLGSQE | 1.68 |
| E | 528 | 0.05 | 4 | 1 | 0 | yes | QDVVVLGSQEG | 99.52 | | |
| E | 529 | 0.05 | 4 | 1 | 0 | yes | DVVVLGSQEGA | 99.52 | | |
| E | 530 | 0.05 | 4 | 1 | 0 | yes | VVVLGSQEGAM | 99.52 | | |
| E | 531 | 0.05 | 4 | 1 | 0 | yes | VVLGSQEGAMH | 99.52 | | |
| E | 532 | 0.06 | 5 | 1 | 0 | yes | VLGSQEGAMHT | 99.4 | | |
| E | 533 | 0.04 | 4 | 1 | 0 | yes | LGSQEGAMHTA | 99.64 | | |
| E | 534 | 0.03 | 3 | 1 | 0 | yes | GSQEGAMHTAL | 99.76 | | |
| E | 535 | 0.03 | 3 | 1 | 0 | yes | SQEGAMHTALT | 99.76 | | |
| E | 536 | 0.03 | 3 | 1 | 0 | yes | QEGAMHTALTG | 99.76 | | |
| E | 537 | 0.04 | 4 | 1 | 0 | yes | EGAMHTALTGA | 99.64 | | |
| E | 538 | 0.07 | 6 | 1 | 0 | yes | GAMHTALTGAT | 99.4 | | |
| E | 539 | 0.07 | 6 | 1 | 0 | yes | AMHTALTGATE | 99.4 | | |
| E | 540 | 0.07 | 6 | 1 | 0 | yes | MHTALTGATEI | 99.4 | | |
| E | 541 | 0.08 | 7 | 1 | 0 | yes | HTALTGATEIQ | 99.28 | | |

FIG. 9-18

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency |
|---|---|---|---|---|---|---|---|---|---|---|---|---|
| E | 542 | 0.1  | 8  | 1 | 0 | yes | TALTGATEIQM | 99.04 |             |      |             |      |
| E | 543 | 0.08 | 6  | 1 | 0 | yes | ALTGATEIQMS | 99.28 |             |      |             |      |
| E | 544 | 0.15 | 8  | 2 | 0 | yes | LTGATEIQMSS | 98.44 | LTGATEIQMSL | 0.84 |             |      |
| E | 545 | 0.15 | 8  | 2 | 0 | yes | TGATEIQMSSG | 98.44 | TGATEIQMSLG | 0.84 |             |      |
| E | 546 | 0.15 | 8  | 2 | 0 | yes | GATEIQMSSGN | 98.44 | GATEIQMSLGN | 0.84 |             |      |
| E | 547 | 0.22 | 10 | 3 | 0 | yes | ATEIQMSSGNL | 97.72 | ATEIQMSLGNI | 0.84 | ATEIQMSSGNI | 0.6  |
| E | 548 | 0.2  | 9  | 3 | 0 | yes | TEIQMSSGNLL | 97.84 | TEIQMSLGNIL | 0.84 | TEIQMSSGNIL | 0.6  |
| E | 549 | 0.19 | 8  | 3 | 0 | yes | EIQMSSGNLLF | 97.96 | EIQMSLGNILF | 0.84 | EIQMSSGNILF | 0.6  |
| E | 550 | 0.19 | 9  | 3 | 0 | yes | IQMSSGNLLFT | 97.96 | IQMSLGNILFM | 0.84 | IQMSSGNILFM | 0.48 |
| E | 551 | 0.19 | 9  | 3 | 0 | yes | QMSSGNLLFTG | 97.96 | QMSLGNILFMG | 0.84 | QMSSGNILFMG | 0.48 |
| E | 552 | 0.18 | 8  | 3 | 0 | yes | MSSGNLLFTGH | 98.08 | MSLGNILFMGH | 0.84 | MSSGNILFMGH | 0.48 |
| E | 553 | 0.16 | 6  | 2 | 0 | yes | SSGNLLFTGHL | 98.2  | SLGNILFMGHL | 0.96 |             |      |
| E | 554 | 0.16 | 6  | 2 | 0 | yes | SGNLLFTGHLK | 98.2  | LGNILFMGHLK | 0.96 |             |      |
| E | 555 | 0.15 | 5  | 2 | 0 | yes | GNLLFTGHLKC | 98.2  | GNILFMGHLKC | 1.44 |             |      |
| E | 556 | 0.15 | 5  | 2 | 0 | yes | NLLFTGHLKCR | 98.2  | NILFMGHLKCR | 1.44 |             |      |
| E | 557 | 0.15 | 5  | 2 | 0 | yes | LLFTGHLKCRL | 98.2  | ILFMGHLKCRL | 1.44 |             |      |
| E | 558 | 0.17 | 5  | 2 | 0 | yes | LFTGHLKCRLR | 97.96 | LFMGHLKCRLR | 1.56 |             |      |
| E | 559 | 0.18 | 6  | 2 | 0 | yes | FTGHLKCRLRM | 97.84 | FMGHLKCRLRM | 1.56 |             |      |
| E | 560 | 0.18 | 6  | 2 | 0 | yes | TGHLKCRLRMD | 97.84 | MGHLKCRLRMD | 1.56 |             |      |
| E | 561 | 0.05 | 4  | 1 | 0 | yes | GHLKCRLRMDK | 99.52 |             |      |             |      |
| E | 562 | 0.05 | 4  | 1 | 0 | yes | HLKCRLRMDKL | 99.52 |             |      |             |      |
| E | 563 | 0.05 | 4  | 1 | 0 | yes | LKCRLRMDKLQ | 99.52 |             |      |             |      |
| E | 564 | 0.05 | 4  | 1 | 0 | yes | KCRLRMDKLQL | 99.52 |             |      |             |      |
| E | 565 | 0.05 | 4  | 1 | 0 | yes | CRLRMDKLQLK | 99.52 |             |      |             |      |
| E | 566 | 0.05 | 4  | 1 | 0 | yes | RLRMDKLQLKG | 99.52 |             |      |             |      |
| E | 567 | 0.05 | 4  | 1 | 0 | yes | LRMDKLQLKGM | 99.52 |             |      |             |      |

FIG. 9-19

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 9-20

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | pe

FIG. 9-21

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 626 | 1.01 | 7 | 3 | 0 | yes | HVLGRLITVNP | 67.9 | YVLGRLITVNP | 30.78 | YILGRLITVNP | 0.48 | | |
| E | 627 | 0.16 | 6 | 2 | 0 | yes | VLGRLITVNPI | 98.32 | ILGRLITVNPI | 0.72 | | | | |
| E | 628 | 0.19 | 6 | 3 | 0 | yes | LGRLITVNPIV | 97.96 | LGRLITVNPII | 0.72 | LGRLITVNPIA | 0.6 | | |
| E | 629 | 0.5 | 8 | 5 | 0 | yes | GRLITVNPIVT | 93.29 | GRLITVNPIVI | 3.35 | GRLITVNPIVA | 1.32 | GRLITVNPIIT | 0.72 | GRLITVNPIAT | 0.6 |
| E | 640 | 0.39 | 7 | 4 | 0 | yes | EKDSPVNIEAE | 95.09 | EKDSPINIEAE | 1.8 | GKDSPVNIEAE | 1.56 | EKDNPINIEAE | 0.6 | |
| E | 641 | 0.26 | 5 | 3 | 0 | yes | KDSPVNIEAEP | 96.65 | KDSPINIEAEP | 2.04 | KDNPINIEAEP | 0.6 | | |
| E | 642 | 0.26 | 5 | 3 | 0 | yes | DSPVNIEAEPP | 96.65 | DSPINIEAEPP | 2.04 | DNPINIEAEPP | 0.6 | | |
| E | 643 | 0.28 | 6 | 3 | 0 | yes | SPVNIEAEPPF | 96.53 | SPINIEAEPPF | 2.04 | NPINIEAEPPF | 0.6 | | |
| E | 644 | 0.21 | 4 | 2 | 0 | yes | PVNIEAEPPFG | 97.01 | PINIEAEPPFG | 2.63 | | | | |
| E | 645 | 0.21 | 4 | 2 | 0 | yes | VNIEAEPPFGD | 97.01 | INIEAEPPFGD | 2.63 | | | | |
| E | 646 | 0.04 | 3 | 1 | 0 | yes | NIEAEPPFGDS | 99.64 | | | | | | |
| E | 647 | 0.04 | 3 | 1 | 0 | yes | IEAEPPFGDSY | 99.64 | | | | | | |
| E | 648 | 0.03 | 3 | 1 | 0 | yes | EAEPPFGDSYI | 99.76 | | | | | | |
| E | 649 | 0.15 | 4 | 2 | 0 | yes | AEPPFGDSYII | 98.08 | AEPPFGDSYIV | 1.68 | | | | |
| E | 650 | 0.35 | 5 | 3 | 0 | yes | EPPFGDSYIII | 94.97 | EPPFGDSYIIV | 3.11 | EPPFGDSYIVI | 1.68 | | |
| E | 651 | 0.35 | 5 | 3 | 0 | yes | PPFGDSYIIIG | 94.97 | PPFGDSYIIVG | 3.11 | PPFGDSYIVIG | 1.68 | | |
| E | 652 | 0.38 | 6 | 3 | 0 | yes | PFGDSYIIIGV | 94.61 | PFGDSYIIVGV | 3.11 | PFGDSYIVIGV | 1.68 | | |
| E | 653 | 0.43 | 8 | 4 | 0 | yes | FGDSYIIIGVE | 94.13 | FGDSYIIVGVE | 3.11 | FGDSYIVIGVE | 1.68 | FGDSYIIIGAE | 0.36 |
| E | 654 | 0.42 | 7 | 3 | 0 | yes | GDSYIIIGVEP | 94.25 | GDSYIIVGVEP | 3.11 | GDSYIVIGVEP | 1.68 | | |
| E | 655 | 0.42 | 7 | 3 | 0 | yes | DSYIIIGVEPG | 94.25 | DSYIIVGVEPG | 3.11 | DSYIVIGVEPG | 1.68 | | |
| E | 656 | 0.42 | 7 | 3 | 0 | yes | SYIIIGVEPGQ | 94.25 | SYIIVGVEPGQ | 3.11 | SYIVIGVEPGQ | 1.68 | | |
| E | 657 | 0.42 | 7 | 3 | 0 | yes | YIIIGVEPGQL | 94.25 | YIIVGVEPGQL | 3.11 | YIVIGVEPGQL | 1.68 | | |
| E | 658 | 0.42 | 7 | 3 | 0 | yes | IIIGVEPGQLK | 94.25 | IIVGVEPGQLK | 3.11 | IVIGVEPGQLK | 1.68 | | |
| E | 659 | 0.4 | 6 | 3 | 0 | yes | IIGVEPGQLKL | 94.37 | IVGVEPGQLKL | 3.11 | VIGVEPGQLKL | 1.68 | | |
| E | 660 | 0.74 | 8 | 4 | 0 | yes | IGVEPGQLKLN | 88.26 | IGVEPGQLKLS | 5.51 | VGVEPGQLKLN | 3.11 | IGVEPGQLKLD | 2.28 |
| E | 661 | 0.55 | 7 | 3 | 0 | yes | GVEPGQLKLNW | 91.38 | GVEPGQLKLSW | 5.51 | GVEPGQLKLDW | 2.28 | | |

FIG. 9-22

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 662 | 0.56 | 8 | 3 | 0 | yes | VEPGQLKLNWF | 91.26 | VEPGQLKLSWF | 5.51 | VEPGQLKLDWF | 2.28 | | |
| E | 663 | 0.55 | 7 | 4 | 0 | yes | EPGQLKLNWFK | 91.5 | EPGQLKLSWFK | 5.51 | EPGQLKLDWFK | 1.92 | EPGQLKLDWFR | 0.48 |
| E | 664 | 0.5 | 5 | 3 | 0 | yes | PGQLKLNWFKK | 91.98 | PGQLKLSWFKK | 5.51 | PGQLKLDWFKK | 1.92 | |

FIG. 9-23

Species: DENV2 (11-mers)

| protein | block starting position | block entropy | total peptides in block | peptides required to cover 99% of block | gap/X fraction | 99%

FIG. 9-24

Species: DENV2 (11-mers)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | fr

FIG. 9-25

Species: DENV2 (11-mers)

| protein | block starting position | block entropy | total peptides in block | peptides required to cover 99% of block | gap/X fraction | 99% of block covered w/ <= 5 peptides? | block (peptides required to cover 99%) | frequency | block | frequency | block | frequency | block | frequency | block | frequency |
|---|---|---|---|---|---|---|---|---|---|---|---|---|---|---|---|
| E | 740 | 0.68 |

FIG. 9-26

Species: DENV2 (11-mers)

| protein | block starting position | block entropy | total peptides in block | peptides required to cover 99% of block | gap/X fraction | 99% of block covered w/ <=5 peptides? | block | frequency | block | frequency | block | frequency | block | frequency | block | frequency |
|---|---|---|---|---|---|---|---|---|---|---|---|---|---|---|---|---|
| E | 772 | 0.94 | 6 | 4 | 0 | yes | MVQADSGCVVS | 82.4 | MVQADSGCVVS | 10.3 | MVQADTGCVVS | 3.83 | MVQADSGCVVS | 3.11 | | |
| E | 773 | 0.47 | 5 | 3 | 0 | yes | VQADSGCVVSW | 92.69 | VQADTGCVVSW | 3.83 | VQADSGCVVSW | 3.11 | | | | |
| E | 774 | 0.47 | 5 | 3 | 0 | yes | QADSGCVVSWK | 92.69 | QADTGCVVSWK | 3.83 | QADSGCVVSWK | 3.11 | | | | |
| E | 775 | 0.67 | 6 | 4 | 0 | yes | ADSGCVVSWKN | 89.46 | ADTGCVVSWKN | 3.83 | ADSGCVVSWKS | 3.23 | ADSGCVVSWKN | 3.11 | | |
| NS1 | 776 | 0.68 | 7 | 4 | 0 | yes | DSGCVVSWKNK | 89.46 | DTGCVVSWKNK | 3.83 | DSGCVVSWKNE | 3.11 | DSGCVVSWKNK | 3.11 | | |
| NS1 | 777 | 0.68 | 7 | 4 | 0 | yes | SGCVVSWKNKE | 89.46 | TGCVVSWKNKE | 3.83 | SGCVVSWKSKE | 3.11 | SGCVVSWKNKE | 3.11 | | |
| NS1 | 778 | 0.47 | 7 | 3 | 0 | yes | GCVVSWKNKEL | 93.05 | GCVVSWKNKEL | 3.11 | GCVVSWKSKEL | 3.11 | | | | |
| NS1 | 779 | 0.49 | 8 | 3 | 0 | yes | CVVSWKNKELK | 92.93 | CIVSWKNKELK | 3.11 | CVVSWKSKELK | 3.11 | | | | |
| NS1 | 780 | 0.49 | 8 | 3 | 0 | yes | VVSWKNKELKC | 92.93 | VSWKSKELKC | 3.11 | IVSWKNKELKC | 3.11 | | | | |
| NS1 | 781 | 0.29 | 7 | 2 | 0 | yes | VSWKNKELKCG | 96.05 | VSWKSKELKCG | 3.11 | | | | | | |
| NS1 | 782 | 0.28 | 7 | 2 | 0 | yes | SWKNKELKCGS | 96.17 | SWKSKELKCGS | 3.11 | | | | | | |
| NS1 | 783 | 0.28 | 7 | 2 | 0 | yes | WKNKELKCGSG | 96.17 | WKSKELKCGSG | 3.11 | | | | | | |
| NS1 | 784 | 0.28 | 7 | 2 | 0 | yes | KNKELKCGSGI | 96.17 | KSKELKCGSGI | 3.11 | | | | | | |
| NS1 | 785 | 0.28 | 7 | 2 | 0 | yes | NKELKCGSGIF | 96.17 | SKELKCGSGIF | 3.11 | | | | | | |
| NS1 | 786 | 0.37 | 6 | 2 | 0 | yes | KELKCGSGIFV | 93.89 | KELKCGSGIFY | 5.51 | | | | | | |
| NS1 | 787 | 0.36 | 5 | 2 | 0 | yes | ELKCGSGIFIT | 94.01 | ELKCGSGIFVT | 5.51 | | | | | | |
| NS1 | 788 | 0.36 | 5 | 2 | 0 | yes | LKCGSGIFITD | 94.01 | LKCGSGIFVTD | 5.51 | | | | | | |
| NS1 | 789 | 0.37 | 6 | 2 | 0 | yes | KCGSGIFITDN | 93.89 | KCGSGIFVTDN | 5.63 | | | | | | |
| NS1 | 790 | 0.37 | 6 | 2 | 0 | yes | CGSGIFITDNV | 93.89 | CGSGIFVTDNV | 5.63 | | | | | | |
| NS1 | 791 | 0.37 | 6 | 2 | 0 | yes | GSGIFITDNVH | 93.89 | GSGIFVTDNVH | 5.63 | | | | | | |
| NS1 | 792 | 0.37 | 6 | 2 | 0 | yes | SGIFITDNVHT | 93.89 | SGIFVTDNVHT | 5.63 | | | | | | |
| NS1 | 793 | 0.35 | 5 | 2 | 0 | yes | GIFITDNVHTW | 94.01 | GIFVTDNVHTW | 5.63 | | | | | | |
| NS1 | 794 | 0.35 | 5 | 2 | 0 | yes | IFITDNVHTWT | 94.01 | IFVTDNVHTWT | 5.63 | | | | | | |
| NS1 | 795 | 0.35 | 5 | 2 | 0 | yes | FITDNVHTWTE | 94.01 | FVTDNVHTWTE | 5.63 | | | | | | |
| NS1 | 796 | 0.35 | 5 | 2 | 0 | yes | ITDNVHTWTEQ | 94.01 | VTDNVHTWTEQ | 5.63 | | | | | | |
| NS1 | 797 | 0.04 | 4 | 1 | 0 | yes | TDNVHTWTEQY | 99.64 | | | | | | | | |

FIG. 9-27

Species: DENV2 (11-mers)

| protein | block starting position | block entropy | total peptides in block | peptides required to cover 99% of block | gap/X

FIG. 9-28

Species: DENV2 (11-mers)

|

FIG. 9-29

Species: DENV2 (11-mers)

| protein | block starting position | block entropy | total peptides in block | peptides required to cover 99% of block | gap/X fraction | 99% of block covered w/ <= 5 peptides? | block (99%) | fr

FIG. 9-30

Species: DENV2 (11-mers)

| protein | block starting position | block entropy | total peptides in block | peptides required to cover 99% of block | gap/X fraction | 99% of block covered w/ <= 5 peptides? | block (peptides required to cover 99% of block) | frequency | block (peptides required to c

FIG. 9-31

Species: DENV2 (11-mers)

| protein | block starting position | block entropy | total peptides in block (11-mers) | peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS1 | 940 | 1.51 | 8 | 5 | 0 | yes | TNIWLKLREKQ | 57.6 | TNIWLKLREKQ | 31.74 | TNIWLKLLKERQ | 6.11 | TNIWLRLREKQ | 2.4 | TNIWLRLLKEKQ | 1.44 |
| NS1 | 941 | 1.52 | 9 | 5 | 0 | yes | NIWLKLREKQD | 57.49 | NIWLKLREKQD | 31.74 | NIWLKLLKERQD | 6.11 | NIWLRLREKQD | 2.4 | NIWLRLLKEKQD | 1.44 |
| NS1 | 954 | 0.27 | 6 | 2 | 0 | yes | CDSKLMSAAIK | 96.29 | CDSKLMSAAVK | 2.99 | | | | | | |
| NS1 | 955 | 0.33 | 8 | 3 | 0 | yes | DSKLMSAAIKD | 95.57 | DSKLMSAAVKD | 2.99 | DSKLMSAAIKN | 0.6 | | | | |
| NS1 | 956 | 0.41 | 10 | 5 | 0 | yes | SKLMSAAIKDN | 95.09 | SKLMSAAVKDD | 1.68 | SKLMSAAIKDD | 1.32 | SKLMSAAIKNN | 0.6 | SKLMSAAIKDS | 0.48 |
| NS1 | 957 | 0.37 | 9 | 4 | 0 | yes | KLMSAAIKDNR | 95.45 | KLMSAAVKDDR | 1.68 | KLMSAAVKDNR | 1.32 | KLMSAAIKNNR | 0.6 | | |
| NS1 | 958 | 0.36 | 8 | 4 | 0 | yes | LMSAAIKDNRA | 95.57 | LMSAAVKDDRA | 1.68 | LMSAAVKDNRA | 1.32 | LMSAAIKNNRA | 0.6 | | |
| NS1 | 959 | 0.37 | 9 | 4 | 0 | yes | MSAAIKDNRAV | 95.57 | MSAAVKDDRAV | 1.68 | MSAAVKDNRAV | 1.2 | MSAAIKNNRAV | 0.6 | | |
| NS1 | 960 | 0.37 | 9 | 4 | 0 | yes | SAAIKDNRAVH | 95.57 | SAAVKDDRAVH | 1.68 | SAAVKDNRAVH | 1.2 | SAAIKNNRAVH | 0.6 | | |
| NS1 | 961 | 0.37 | 9 | 4 | 0 | yes | AAIKDNRAVHA | 95.57 | AAVKDDRAVHA | 1.68 | AAVKDNRAVHA | 1.2 | AAIKNNRAVHA | 0.6 | | |
| NS1 | 962 | 0.37 | 9 | 4 | 0 | yes | AIKDNRAVHAD | 95.57 | AVKDDRAVHAD | 1.68 | AVKDNRAVHAD | 1.2 | AIKNNRAVHAD | 0.6 | | |
| NS1 | 963 | 0.35 | 8 | 4 | 0 | yes | IKDNRAVHADM | 95.69 | VKDDRAVHADM | 1.68 | VKDNRAVHADM | 1.2 | IKNNRAVHADM | 0.6 | | |
| NS1 | 964 | 0.27 | 8 | 3 | 0 | yes | KDNRAVHADMG | 96.77 | KDDRAVHADMG | 1.68 | KNNRAVHADMG | 0.6 | | | | |
| NS1 | 965 | 0.27 | 8 | 3 | 0 | yes | DNRAVHADMGY | 96.77 | DDRAVHADMGY | 1.68 | NNRAVHADMGY | 0.6 | | | | |
| NS1 | 966 | 0.21 | 6 | 2 | 0 | yes | NRAVHADMGYW | 97.49 | DRAVHADMGYW | 1.68 | | | | | | |
| NS1 | 967 | 0.09 | 5 | 1 | 0 | yes | RAVHADMGYWI | 99.04 | | | | | | | | |
| NS1 | 968 | 0.09 | 5 | 1 | 0 | yes | AVHADMGYWIE | 99.04 | | | | | | | | |
| NS1 | 969 | 0.09 | 5 | 1 | 0 | yes | VHADMGYWIES | 99.04 | | | | | | | | |
| NS1 | 970 | 0.24 | 6 | 3 | 0 | yes | HADMGYWIESA | 97.01 | HADMGYWIESR | 1.92 | HADMGYWMESA | 0.6 | | | | |
| NS1 | 971 | 0.25 | 7 | 3 | 0 | yes | ADMGYWIESAL | 96.89 | ADMGYWIESRL | 1.92 | ADMGYWMESAL | 0.6 | | | | |
| NS1 | 972 | 0.25 | 7 | 3 | 0 | yes | DMGYWIESALN | 96.89 | DMGYWIESRLN | 1.92 | DMGYWMESALN | 0.6 | | | | |
| NS1 | 973 | 0.27 | 8 | 3 | 0 | yes | MGYWIESALND | 96.77 | MGYWIESRLND | 1.92 | MGYWMESALND | 0.6 | | | | |
| NS1 | 974 | 0.27 | 8 | 3 | 0 | yes | GYWIESALNDT | 96.77 | GYWIESRLNDT | 1.92 | GYWMESALNDT | 0.6 | | | | |
| NS1 | 975 | 0.25 | 7 | 3 | 0 | yes | YWIESALNDTW | 96.89 | YWIESRLNDTW | 1.92 | YWMESALNDTW | 0.6 | | | | |
| NS1 | 976 | 0.25 | 7 | 3 | 0 | yes | WIESALNDTWK | 96.89 | WIESRLNDTWK | 1.92 | WMESALNDTWK | 0.6 | | | | |
| NS1 | 977 | 1.22 | 10 | 4 | 0 | yes | IESALNDTWKM | 54.37 | IESRLNDTWKI | 42.51 | IESRLNDTWKM | 1.92 | MESALNDTWKI | 0.48 | | |

FIG. 9-32

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 9-33

Species: DENV2 (11-mers)

| protein | block starting position | block entropy | total peptides in block | peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS1 | 1004 | 0.07 | 4 | 1 | 0 | yes | HTLWSNGVLES | 99.28 | | | | | | |
| NS1 | 1005 | 0.04 | 2 | 1 | 0 | yes | TLWSNGVLESE | 99.52 | | | | | | |
| NS1 | 1006 | 0.04 | 2 | 1 | 0 | yes | LWSNGVLESEM | 99.52 | | | | | | |
| NS1 | 1007 | 0.25 | 3 | 2 | 0 | yes | WSNGVLESEMI | 96.29 | WSNGVLESEMV | 3.23 | | | | |
| NS1 | 1008 | 0.25 | 3 | 2 | 0 | yes | SNGVLESEMII | 96.29 | SNGVLESEMVI | 3.23 | | | | |
| NS1 | 1009 | 0.25 | 3 | 2 | 0 | yes | NGVLESEMIIP | 96.29 | NGVLESEMVIP | 3.23 | | | | |
| NS1 | 1010 | 0.25 | 3 | 2 | 0 | yes | GVLESEMIIPK | 96.29 | GVLESEMVIPK | 3.23 | | | | |
| NS1 | 1011 | 0.61 | 5 | 3 | 0 | yes | VLESEMIIPKN | 89.46 | VLESEMIIPKS | 6.71 | VLESEMVIPKN | 3.23 | | | |
| NS1 | 1018 | 1.37 | 9 | 5 | 0 | yes | IPKNFAGPVSQ | 57.6 | IPKNLAGPVSQ | 34.37 | IPKSFAGPVSQ | 6.47 | IPKGFAGPVSQ | 0.48 |
| NS1 | 1019 | 1.37 | 9 | 5 | 0 | yes | PKNFAGPVSQH | 57.6 | PKNLAGPVSQH | 34.37 | PKISFAGPVSQH | 6.47 | PKNIAGPVSQH | 0.48 |
| NS1 | 1020 | 1.37 | 9 | 5 | 0 | yes | KNFAGPVSQHN | 57.6 | KNLAGPVSQHN | 34.37 | KSFAGPVSQHN | 6.47 | KGFAGPVSQHN | 0.48 |
| NS1 | 1022 | 1.19 | 10 | 5 | 0 | yes | FAGPVSQHNYR | 62.51 | LAGPVSQHNYR | 34.13 | FAGPVSQHNN

FIG. 9-34

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1040 | 0.37 | 7 | 3 | 0 | yes | AGPWHLGKLEM | 94.97 | AGPWHL

FIG. 9-35

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|

FIG. 9-36

Species: DENV2 (11-mers)

| protein | block starting position | block entropy | total peptides in block | peptides required to cover 99% of block | gap/X fraction | 99% of block covered w/ <= 5 peptides? | block | frequency | block (peptides required to cover 99%) | frequency | block | frequency | block | frequency | block | frequency |
|---|---|---|---|---|---|---|---|---|---|---|---|---|---|---|---|---|
| NS1 | 1097 | 0.05 | 3 | 1 | 0 | yes | RYRGEDGCWYG | 99.52 | | | | | | | | |
| NS1 | 1098 | 0.05 | 3 | 1 | 0 | yes | YRGEDGCWYGM | 99.52 | | | | | | | | |
| NS1 | 1099 | 0.05 | 3 | 1 | 0 | yes | RGEDGCWYGME | 99.52 | | | | | | | | |
| NS1 | 1100 | 0.05 | 3 | 1 | 0 | yes | GEDGCWYGMEI | 99.52 | | | | | | | | |
| NS1 | 1101 | 0.05 | 3 | 1 | 0 | yes | EDGCWYGMEIR | 99.52 | | | | | | | | |
| NS1 | 1102 | 0.01 | 2 | 1 | 0 | yes | DGCWYGMEIRP | 99.88 | | | | | | | | |
| NS1 | 1103 | 0 | 1 | 1 | 0 | yes | GCWYGMEIRPL | 100 | | | | | | | | |
| NS1 | 1104 | 0.02 | 2 | 1 | 0 | yes | CWYGMEIRPLK | 99.76 | | | | | | | | |
| NS1 | 1105 | 0.02 | 2 | 1 | 0 | yes | WYGMEIRPLKE | 99.76 | | | | | | | | |
| NS1 | 1106 | 0.11 | 3 | 2 | 0 | yes | YGMEIRPLKEK | 98.68 | YGMEIRPLKER | 1.08 | | | | | | |
| NS1 | 1107 | 0.11 | 3 | 2 | 0 | yes | GMEIRPLKEKE | 98.68 | GMEIRPLKERE | 1.08 | | | | | | |
| NS1 | 1108 | 0.11 | 3 | 2 | 0 | yes | MEIRPLKEKEE | 98.68 | MEIRPLKEREE | 1.08 | | | | | | |
| NS1 | 1109 | 0.12 | 4 | 2 | 0 | yes | EIRPLKEKEEN | 98.56 | EIRPLKEREEN | 1.08 | | | | | | |
| NS1 | 1110 | 0.12 | 4 | 2 | 0 | yes | IRPLKEKEENL | 98.56 | IRPLKEREENL | 1.08 | | | | | | |
| NS1 | 1111 | 0.14 | 5 | 2 | 0 | yes | RPLKEKEENLV | 98.44 | RPLKEREENLV | 1.08 | | | | | | |
| NS1 | 1112 | 0.3 | 6 | 3 | 0 | yes | PLKEKEENLVN | 96.05 | PLKEREENLVN | 2.4 | | | | | | |
| NS1 | 1113 | 0.3 | 6 | 3 | 0 | yes | LKEKEENLVNS | 96.05 | LKEREENLVNS | 2.4 | | | | | | |
| NS1 | 1114 | 0.3 | 6 | 3 | 0 | yes | KEKEENLVNSL | 96.05 | KEREENLVNSL | 2.4 | | | | | | |
| NS1 | 1115 | 0.28 | 5 | 3 | 0 | yes | EKEENLVNSLV | 96.29 | EREENLVNSLV | 2.4 | | | | | | |
| NS1 | 1116 | 0.28 | 5 | 3 | 0 | yes | KEENLVNSLVT | 96.29 | REENLVNSLVT | 2.4 | | | | | | |
| NS1 | 1117 | 0.19 | 4 | 2 | 0 | yes | EENLVNSLVTA | 97.37 | EENLVSSLVTA | 2.4 | | | | | | |
| NS1 | 1118 | 0.19 | 4 | 2 | 0 | yes | ENLVNSLVTAG | 97.37 | ENLVSSLVTAG | 2.4 | | | | | | |
| NS1 | 1119 | 0.32 | 8 | 3 | 0 | yes | NLVNSLVTAGH | 95.93 | NLVSSLVTAGH | 2.4 | NLVNSLVTAGQ | 0.72 | | | | |
| NS1 | 1120 | 0.32 | 8 | 3 | 0 | yes | LVNSLVTAGHG | 95.93 | LVSSLVTAGHG | 2.4 | LVNSLVTAGQG | 0.72 | | | | |
| NS1 | 1121 | 0.33 | 9 | 4 | 0 | yes | VNSLVTAGHGQ | 95.81 | VSSLVTAGHGQ | 2.4 | VNSLVTAGQGQ | 0.72 | VNSLVTAGYGQ | 0.48 | | |
| NS1 | 1122 | 1.2 | 10 | 5 | 0 | yes | NSLVTAGHGQI | 64.67 | NSLVTAGHGQI | 31.26 | SSLVTAGHGQI | 2.4 | NSLVTAGGQV | 0.6 | NSLVTAGYGQI | 0.48 |

FIG. 9-37

Species: DENV2 (11-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency

FIG. 9-38

Species: DENV2 (11-mers)

| protein | block starting position | block entropy | total peptides in block | peptides required to cover 99% of block | gap/X fraction | 99% of block covered w/ <= 5 peptides? | block to cover 99% of | frequency | block to

FIG. 9-39

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover

FIG. 9-40

Species: DENV2 (11-mers)

| protein | block starting position | block entropy | total peptides in block | peptides required to cover 99% of block | gap/X fraction | covered w/ <= 5 99% of block peptides? | block to cover 99% of | fr

FIG. 9-41

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 9-42

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS2B | 1356 | 0 | 1 | — | 0 | yes | VGMVSILASSL | 100 |
| NS2B | 1357 | 0 | 1 | — | 0 | yes | GMVSILASSLL | 100 |
| NS2B | 1358 | 0 | 1 | — | 0 | yes | M

FIG. 9-43

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1382 | 0.01 | 2 | 1 | 0 | yes | LLTVCYVLTGR | 99.88 | | | | | | |
| NS2B | 1383 | 0.01 | 2 | 1 | 0 | yes | LTVCYVLTGRS | 99.88 | | | | | | |
| NS2B | 1384 | 0.01 | 2 | 1 | 0 | yes | TVCYVLTGRSA | 99.88 | | | | | | |

FIG. 9-44

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1417 | 0.46 | 7 | 3 | 0 | yes | PILSITISEDG | 93.29 | PILSITIAEDG | 3.83 | PILSVTISEDG | 2.04 | | |
| NS2B | 1418 | 0.45 | 6 | 3 | 0 | yes | ILSITISEDGS | 93.41 | ILSITIAEDGS | 3.83 | ILSVTISEDGS | 2.04 | | |
| NS2B | 1419 | 0.41 | 4 | 3 | 0 | yes | LSITISEDGSM | 93.77 | LSITIAEDGSM | 3.83 | LSVTISEDGSM | 2.04 | | |
| NS2B | 1420 | 0.41 | 4 | 3 | 0 | yes | SITISEDGSMS | 93.77 | SITIAEDGSMS | 3.83 | SVTISEDGSMS | 2.04 | | |
| NS2B | 1421 | 0.42 | 5 | 3 | 0 | yes | ITISEDGSMSI | 93.65 | ITIAEDGSMSI | 3.83 | VTISEDGSMSI | 2.04 | | |
| NS2B | 1422 | 0.32 | 5 | 2 | 0 | yes | TISEDGSMSIK | 95.33 | TIAEDGSMSIK | 3.83 | | | | |
| NS2B | 1423 | 0.28 | 4 | 2 | 0 | yes | ISEDGSMSIKN | 95.69 | IAEDGSMSIKN | 3.83 | | | | |
| NS2B | 1424 | 0.28 | 4 | 2 | 0 | yes | SEDGSMSIKNE | 95.69 | AEDGSMSIKNE | 3.83 | | | | |
| NS2B | 1425 | 0.05 | 3 | 1 | 0 | yes | EDGSMSIKNEE | 99.52 | | | | | | |
| NS2B | 1426 | 0.05 | 3 | 1 | 0 | yes | DGSMSIKNEEE | 99.52 | | | | | | |
| NS2B | 1427 | 0.05 | 3 | 1 | 0 | yes | GSMSIKNEEEE | 99.52 | | | | | | |
| NS2B | 1428 | 0.45 | 5 | 2 | 0 | yes | SMSIKNEEEEQ | 91.86 | SMSIKNEEEEH | 7.43 | | | | |
| NS2B | 1429 | 0.58 | 6 | 3 | 0 | yes | MSIKNEEEEQT | 90.06 | MSIKNEEEEHT | 7.43 | MSIKNEEEEQI | 1.8 | | |
| NS2B | 1430 | 0.58 | 6 | 3 | 0 | yes | SIKNEEEEQTL | 90.06 | SIKNEEEEHTL | 7.43 | SIKNEEEEQIL | 1.8 | | |
| NS2B | 1431 | 0.58 | 6 | 3 | 0 | yes | IKNEEEEQTLI | 90.06 | IKNEEEEHTLI | 7.43 | IKNEEEEQILT | 1.8 | | |
| NS2B | 1432 | 0.57 | 5 | 3 | 0 | yes | KNEEEEQTLTI | 90.18 | KNEEEEHTLTI | 7.43 | KNEEEEQILTI | 1.8 | | |
| NS2B | 1433 | 0.53 | 4 | 3 | 0 | yes | NEEEEQTLTIL | 90.54 | NEEEEHTLTIL | 7.43 | NEEEEQILTIL | 1.8 | | |
| NS2B | 1434 | 0.53 | 4 | 3 | 0 | yes | EEEEQTLTILI | 90.54 | EEEEHTLTILI | 7.43 | EEEEQILTILI | 1.8 | | |
| NS2B | 1435 | 0.53 | 4 | 3 | 0 | yes | EEEQTLTILIR | 90.54 | EEEHTLTILIR | 7.43 | EEEQILTILIR | 1.8 | | |
| NS2B | 1436 | 0.55 | 5 | 3 | 0 | yes | EEQTLTILIRT | 90.42 | EEHTLTILIRT | 7.43 | EEQILTILIRT | 1.8 | | |
| NS2B | 1437 | 0.55 | 5 | 3 | 0 | yes | EQTLTILIRTG | 90.42 | EHTLTILIRTG | 7.43 | EQILTILIRTG | 1.8 | | |
| NS2B | 1438 | 0.55 | 5 | 3 | 0 | yes | QTLTILIRTGL | 90.42 | HTLTILIRTGL | 7.43 | QILTILIRTGL | 1.8 | | |
| NS2B | 1439 | 0.14 | 3 | 2 | 0 | yes | TLTILIRTGLL | 98.08 | ILTILIRTGLL | 1.8 | | | | |
| NS2B | 1440 | 0.01 | 2 | 1 | 0 | yes | LTILIRTGLLV | 99.88 | | | | | | |
| NS2B | 1441 | 0.04 | 3 | 1 | 0 | yes | TILIRTGLLVI | 99.64 | | | | | | |
| NS2B | 1442 | 0.04 | 3 | 1 | 0 | yes | ILIRTGLLVIS | 99.64 | | | | | | |

FIG. 9-45

| Species: DENV2 (11-mers) protein | block starting position | block entropy | total peptides in block | peptides required to cover 99% of block | gap/X fraction | 99% of block covered w/ <= 5 peptides? | block to

FIG. 9-46

Species: DENV2 (11-mers)

| protein | block starting position | block entropy | total peptides in block | peptides required to cover 99% of block | gap/X fraction | 99% of block covered w/ <= 5 peptides? | block | frequency | block to cover 99% | frequency | block to cover 99% | frequency | block to cover 99% | frequency |
|---|---|---|---|---|---|---|---|---|---|---|---|---|---|---|
| NS2B | 1470 | 0.16 | 4 | 2 | 0 | yes | EVKKQRA

FIG. 9-47

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1505 | 0.62 | 8 | 2 | 0 | yes | ILGYSQIGAGVY | 87.31 | IFGYSQIGAGVY | 11.74 | | | | |
| NS3 | 1506 | 0.57 | 6 | 2 | 0 | yes | LGYSQIGAGVY | 87.78 | FGYSQIGAGVY | 11.74 | | | | |
| NS3 | 1507 | 0.09 | 5 | 1 | 0 | yes | GYSQIGAGVYK | 99.04 | | | | | | |
| NS3 | 1508 | 0.09 | 5 | 1 | 0 | yes | YSQIGAGVYKE | 99.04 | | | | | | |
| NS3 | 1509 | 0.07 | 4 | 1 | 0 | yes | SQIGAGVYKEG | 99.28 | | | | | | |
| NS3 | 1510 | 0.07 | 4 | 1 | 0 | yes | QIGAGVYKEGT | 99.28 | | | | | | |
| NS3 | 1511 | 0.07 | 4 | 1 | 0 | yes | IGAGVYKEGTF | 99.28 | | | | | | |
| NS3 | 1512 | 0.07 | 4 | 1 | 0 | yes | GAGVYKEGTFH | 99.28 | | | | | | |
| NS3 | 1513 | 0.07 | 4 | 1 | 0 | yes | AGVYKEGTFHT | 99.28 | | | | | | |
| NS3 | 1514 | 0.06 | 3 | 1 | 0 | yes | GVYKEGTFHTM | 99.4 | | | | | | |
| NS3 | 1515 | 0.06 | 3 | 1 | 0 | yes | VYKEGTFHTMW | 99.4 | | | | | | |
| NS3 | 1516 | 0.06 | 3 | 1 | 0 | yes | YKEGTFHTMWH | 99.4 | | | | | | |
| NS3 | 1517 | 0.06 | 3 | 1 | 0 | yes | KEGTFHTMWHV | 99.4 | | | | | | |
| NS3 | 1518 | 0.01 | 2 | 1 | 0 | yes | EGTFHTMWHVT | 99.88 | | | | | | |
| NS3 | 1519 | 0.01 | 2 | 1 | 0 | yes | GTFHTMWHVTR | 99.88 | | | | | | |
| NS3 | 1520 | 0.01 | 2 | 1 | 0 | yes | TFHTMWHVTRG | 99.88 | | | | | | |
| NS3 | 1521 | 0.01 | 2 | 1 | 0 | yes | FHTMWHVTRGA | 99.88 | | | | | | |
| NS3 | 1522 | 0.01 | 2 | 1 | 0 | yes | HTMWHVTRGAV | 99.88 | | | | | | |
| NS3 | 1523 | 0.01 | 2 | 1 | 0 | yes | TMWHVTRGAVL | 99.88 | | | | | | |
| NS3 | 1524 | 0.24 | 4 | 3 | 0 | yes | MWHVTRGAVLM | 96.77 | MWHVTRGAVLV | 1.68 | MWHVTRGAVLT | 1.44 | | |
| NS3 | 1525 | 0.23 | 3 | 3 | 0 | yes | WHVTRGAVLMH | 96.89 | WHVTRGAVLVH | 1.68 | WHVTRGAVLTH | 1.44 | | |
| NS3 | 1526 | 1.19 | 4 | 4 | 0 | yes | HVTRGAVLMHR | 54.97 | HVTRGAVLMHK | 41.92 | HVTRGAVLVHK | 1.68 | HVTRGAVLTHK | 1.44 |
| NS3 | 1527 | 1.19 | 4 | 4 | 0 | yes | VTRGAVLMHRG | 54.97 | VTRGAVLMHKG | 41.92 | VTRGAVLVHKG | 1.68 | VTRGAVLTHKG | 1.44 |
| NS3 | 1528 | 1.19 | 4 | 4 | 0 | yes | TRGAVLMHRGK | 54.97 | TRGAVLMHKGK | 41.92 | TRGAVLVHKGK | 1.68 | TRGAVLTHKGK | 1.44 |
| NS3 | 1529 | 1.19 | 4 | 4 | 0 | yes | RGAVLMHRGKR | 54.97 | RGAVLMHKGKR | 41.92 | RGAVLVHKGKR | 1.68 | RGAVLTHKGKR | 1.44 |
| NS3 | 1530 | 1.21 | 6 | 4 | 0 | yes | GAVLMHRGKRI | 54.85 | GAVLMHKGKRI | 41.8 | GAVLVHKGKRI | 1.68 | GAVLTHKGKRI | 1.44 |

FIG. 9-48

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency

FIG. 9-49

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1557 | 0 | 1 | — | 0 | yes | GWKLEGEWKEG | 100 | | | | | | |
| NS3 | 1558 | 0 | 1 | — | 0 | yes | WKLEGEWKEGE | 100 | | | | | | |
| NS3 | 1559 | 0.01 | 2 | — | 0 | yes | KLEGEWKEGEE | 99.88 | | | | | | |
| NS3 | 1560 | 0.01 | 2 | — | 0 | yes | LEGEWKEGEEV | 99.88 | | | | | | |
| NS3 | 1561 | 0.01 | 2 | — | 0 | yes | EGEWKEGEEVQ | 99.88 | | | | | | |
| NS3 | 1562 | 0.01 | 2 | — | 0 | yes | GEWKEGEEVQV | 99.88 | | | | | | |
| NS3 | 1563 | 0.01 | 2 | — | 0 | yes | EWKEGEEVQVL | 99.88 | | | | | | |
| NS3 | 1564 | 0.01 | 2 | — | 0 | yes | WKEGEEVQVLA | 99.88 | | | | | | |
| NS3 | 1565 | 0.01 | 2 | — | 0 | yes | KEGEEVQVLAL | 99.88 | | | | | | |
| NS3 | 1566 | 0.03 | 3 | — | 0 | yes | EGEEVQVLALE | 99.76 | | | | | | |
| NS3 | 1567 | 0.03 | 3 | — | 0 | yes | GEEVQVLALEP | 99.76 | | | | | | |
| NS3 | 1568 | 0.03 | 3 | — | 0 | yes | EEVQVLALEPG | 99.76 | | | | | | |
| NS3 | 1569 | 0.03 | 3 | — | 0 | yes | EVQVLALEPGK | 99.76 | | | | | | |
| NS3 | 1570 | 0.01 | 2 | — | 0 | yes | VQVLALEPGKN | 99.88 | | | | | | |
| NS3 | 1571 | 0.01 | 2 | — | 0 | yes | QVLALEPGKNP | 99.88 | | | | | | |
| NS3 | 1572 | 0.03 | 3 | — | 0 | yes | VLALEPGKNPR | 99.76 | | | | | | |
| NS3 | 1573 | 0.03 | 3 | — | 0 | yes | LALEPGKNPRA | 99.76 | | | | | | |
| NS3 | 1574 | 0.03 | 3 | — | 0 | yes | ALEPGKNPRAV | 99.76 | | | | | | |
| NS3 | 1575 | 0.03 | 3 | — | 0 | yes | LEPGKNPRAVQ | 99.76 | | | | | | |
| NS3 | 1576 | 0.03 | 3 | — | 0 | yes | EPGKNPRAVQT | 99.76 | | | | | | |
| NS3 | 1577 | 0.03 | 3 | — | 0 | yes | PGKNPRAVQTK | 99.76 | | | | | | |
| NS3 | 1578 | 0.03 | 3 | — | 0 | yes | GKNPRAVQTKP | 99.76 | | | | | | |
| NS3 | 1579 | 0.03 | 3 | — | 0 | yes | KNPRAVQTKPG | 99.76 | | | | | | |
| NS3 | 1580 | 0.98 | 7 | 2 | 0 | yes | NPRAVQTKPGL | 68.26 | NPRAVQTKPGI | 30.9 | | | | |
| NS3 | 1581 | 0.98 | 7 | 2 | 0 | yes | PRAVQTKPGLF | 68.26 | PRAVQTKPGIF | 30.9 | | | | |
| NS3 | 1582 | 1.17 | 9 | 4 | 0 | yes | RAVQTKPGLFK | 65.51 | RAVQTKPGIFK | 30.54 | RAVQTKPGLFR | 2.75 | RAVQTKPGFFK | 0.36 |

FIG. 9-50

Species: DENV2 (11-mers)

| protein | block starting position | block entropy | total peptides in block | block peptides required to cover 99% of block | gap/X fraction | 99% of block covered w/ <= 5 peptides? | block | frequency | block peptides required to cover

FIG. 9-51

Species: DENV2 (11-mers)

| protein | block starting position | block entropy | total peptides in block | peptides required to cover 99% of block | gap/X fraction | yes / <= 5 covered w/ peptides? | block to cover 99% of | frequency | block

FIG. 9-52

Species: DENV2 (11-mers)

| protein | block starting position | block entropy | total peptides in block | peptides required to cover 99% of block | g

FIG. 9-53

Species: DENV2 (11-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 1676 | 0.14 | 4 | 2 | 0 | yes | KRYLPAIVREA | 98.32 | KKYLPAIVREA | 1.44 |
| NS3 | 1677 | 0.14 | 4 | 2 | 0 | yes | RYLPAIVREAI | 98.32 | KYLPAIVREAI | 1.44 |
| NS3 | 1678 | 0.22 | 5 | 2 | 0 | yes | YLPAIVREAIK | 97.13 | YLPAIVREAIR | 1.92 |
| NS3 | 1679 | 0.21 | 4 | 2 | 0 | yes | LPAIVREAIKR | 97.25 | LPAIVREAIRR | 1.92 |
| NS3 | 1680 | 0.21 | 4 | 2 | 0 | yes | PAIVREAIKRG | 97.25 | PAIVREAIRRG | 1.92 |
| NS3 | 1681 | 0.21 | 4 | 2 | 0 | yes | AIVREAIKRGL | 97.25 | AIVREAIRRGL | 1.92 |
| NS3 | 1682 | 0.21 | 4 | 2 | 0 | yes | IVREAIKRGLR | 97.25 | IVREAIRRGLR | 1.92 |
| NS3 | 1683 | 0.22 | 5 | 2 | 0 | yes | VREAIKRGLRT | 97.13 | VREAIRRGLRT | 1.92 |
| NS3 | 1684 | 0.22 | 5 | 2 | 0 | yes | REAIKRGLRTL | 97.13 | REAIRRGLRTL | 1.92 |
| NS3 | 1685 | 0.22 | 5 | 2 | 0 | yes | EAIKRGLRTLI | 97.13 | EAIRRGLRTLI | 1.92 |
| NS3 | 1686 | 0.21 | 4 | 2 | 0 | yes | AIKRGLRTLIL | 97.25 | AIRRGLRTLIL | 1.92 |
| NS3 | 1687 | 0.21 | 4 | 2 | 0 | yes | IKRGLRTLILA | 97.25 | IRRGLRTLILA | 1.92 |
| NS3 | 1688 | 0.21 | 4 | 2 | 0 | yes | KRGLRTLILAP | 97.25 | RRGLRTLILAP | 1.92 |
| NS3 | 1689 | 0.01 | 2 | 1 | 0 | yes | RGLRTLILAPT | 99.88 | | |
| NS3 | 1690 | 0.01 | 2 | 1 | 0 | yes | GLRTLILAPTR | 99.88 | | |
| NS3 | 1691 | 0.01 | 2 | 1 | 0 | yes | LRTLILAPTRV | 99.88 | | |
| NS3 | 1692 | 0.01 | 2 | 1 | 0 | yes | RTLILAPTRVV | 99.88 | | |
| NS3 | 1693 | 0.01 | 2 | 1 | 0 | yes | TLILAPTRVVA | 99.88 | | |
| NS3 | 1694 | 0.01 | 2 | 1 | 0 | yes | LILAPTRVVAA | 99.88 | | |
| NS3 | 1695 | 0.01 | 2 | 1 | 0 | yes | ILAPTRVVAAE | 99.88 | | |
| NS3 | 1696 | 0.01 | 2 | 1 | 0 | yes | LAPTRVVAAEM | 99.88 | | |
| NS3 | 1697 | 0.01 | 2 | 1 | 0 | yes | APTRVVAAEME | 99.88 | | |
| NS3 | 1698 | 0.01 | 2 | 1 | 0 | yes | PTRVVAAEMEE | 99.88 | | |
| NS3 | 1699 | 0.01 | 2 | 1 | 0 | yes | TRVVAAEMEEA | 99.88 | | |
| NS3 | 1700 | 0.01 | 2 | 1 | 0 | yes | RVVAAEMEEAL | 99.88 | | |
| NS3 | 1701 | 0.01 | 2 | 1 | 0 | yes | VVAAEMEEALR | 99.88 | | |

FIG. 9-54

Species: DENV2 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|

FIG. 9-55

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|

FIG. 9-56

Species: DENV2 (11-mers)

| protein | block starting position | block entropy | total peptides in block required to cover 99% of block | gap/X fraction | 99% of block covered w/ <= 5 peptides? | peptides required to cover 99% of block | frequency |
|---|---|---|---|---|

FIG. 9-57

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1780 | 0 | 1 | 1 | 0 | yes | EMGEAAGIFMT | 100 | | | | | | |
| NS3 | 1781 | 0 | 1 | 1 | 0 | yes | MGEAAGIFMTA | 100 | | | | | | |
| NS3 | 1782 | 0 | 1 | 1 | 0 | yes | GEAAGIFMTAT | 100 | | | | | | |
| NS3 | 1783 | 0 | 1 | 1 | 0 | yes | EAAGIFMTATP | 100 | | | | | | |
| NS3 | 1784 | 0 | 1 | 1 | 0 | yes | AAGIFMTATPP | 100 | | | | | | |
| NS3 | 1785 | 0 | 1 | 1 | 0 | yes | AGIFMTATPPG | 100 | | | | | | |
| NS3 | 1786 | 0.02 | 2 | 1 | 0 | yes | GIFMTATPPGS | 99.76 | | | | | | |
| NS3 | 1787 | 0.07 | 3 | 1 | 0 | yes | IFMTATPPGSR | 99.28 | | | | | | |
| NS3 | 1788 | 0.07 | 3 | 1 | 0 | yes | FMTATPPGSRD | 99.28 | | | | | | |
| NS3 | 1789 | 0.09 | 4 | 1 | 0 | yes | MTATPPGSRDP | 99.04 | | | | | | |
| NS3 | 1790 | 0.09 | 4 | 1 | 0 | yes | TATPPGSRDPF | 99.04 | | | | | | |
| NS3 | 1791 | 0.09 | 4 | 1 | 0 | yes | ATPPGSRDPFP | 99.04 | | | | | | |
| NS3 | 1792 | 0.09 | 4 | 1 | 0 | yes | TPPGSRDPFPQ | 99.04 | | | | | | |
| NS3 | 1793 | 0.09 | 4 | 1 | 0 | yes | PPGSRDPFPQS | 99.04 | | | | | | |
| NS3 | 1794 | 0.09 | 4 | 1 | 0 | yes | PGSRDPFPQSN | 99.04 | | | | | | |
| NS3 | 1795 | 0.09 | 4 | 1 | 0 | yes | GSRDPFPQSNA | 99.04 | | | | | | |
| NS3 | 1796 | 0.09 | 4 | 1 | 0 | yes | SRDPFPQSNAP | 99.04 | | | | | | |
| NS3 | 1797 | 0.07 | 3 | 1 | 0 | yes | RDPFPQSNAPI | 99.28 | | | | | | |
| NS3 | 1798 | 1.07 | 5 | 3 | 0 | yes | DPFPQSNAPIM | 63.95 | DPFPQSNAPII | 34.25 | DPFPQSNAPIV | 1.32 | | |
| NS3 | 1799 | 1.07 | 5 | 3 | 0 | yes | PFPQSNAPIMD | 63.95 | PFPQSNAPIID | 34.25 | PFPQSNAPIVD | 1.32 | | |
| NS3 | 1800 | 1.06 | 5 | 3 | 0 | yes | FPQSNAPIMDE | 64.07 | FPQSNAPIIDE | 34.25 | FPQSNAPIVDE | 1.32 | | |
| NS3 | 1801 | 1.06 | 5 | 3 | 0 | yes | PQSNAPIMDEE | 64.07 | PQSNAPIIDEE | 34.25 | PQSNAPIVDEE | 1.32 | | |
| NS3 | 1802 | 1.06 | 5 | 3 | 0 | yes | QSNAPIMDEER | 64.07 | QSNAPIIDEER | 34.25 | QSNAPIVDEER | 1.32 | | |
| NS3 | 1803 | 1.06 | 5 | 3 | 0 | yes | SNAPIMDEERE | 64.07 | SNAPIIDEERE | 34.25 | SNAPIVDEERE | 1.32 | | |
| NS3 | 1804 | 1.06 | 5 | 3 | 0 | yes | NAPIMDEEREI | 64.07 | NAPIIDEEREI | 34.25 | NAPIVDEEREI | 1.32 | | |
| NS3 | 1805 | 1.06 | 5 | 3 | 0 | yes | APIMDEEREIP | 64.07 | APIIDEEREIP | 34.25 | APIVDEEREIP | 1.32 | | |

FIG. 9-58

Species: DENV2 (11-mers)

| protein | block starting position | block entropy | total peptides in block | peptides required to cover 99% of block | gap/X fraction | 99% of block covered w/ <= 5 peptides? | block (to cover 99% of block) | frequency | block (to cover 99% of block) | frequency | block (to cover 99% of block) | frequency | block (to cover 99% of block) | frequency |
|---|---|---|---|---|---|---|---|---|---|---|---|---|---|---|
| NS3 | 1806 | 1.06 | 5 | 3 | 0 | yes | PIMDEEREIPE | 64.07 | PIIDEEREIPE | 34.25 | PIVDEEREIPE | 1.32 | | |
| NS3 | 1807 | 1.06 | 5 | 3 | 0 | yes | IMDEEREIPER | 64.07 | IIDEEREIPER | 34.25 | IVDEEREIPER | 1.32 | | |
| NS3 | 1808 | 1.06 | 5 | 3 | 0 | yes | MDEEREIPERS | 64.07 | IDEEREIPERS | 34.25 | VDEEREIPERS | 1.32 | | |
| NS3 | 1809 | 0.01 | 2 | 1 | 0 | yes | DEEREIPERSW | 99.88 | | | | | | |
| NS3 | 1810 | 0.15 | 3 | 2 | 0 | yes | EEREIPERSWN | 97.96 | EEREIPERSWS | 1.92 | | | | |
| NS3 | 1811 | 0.24 | 4 | 3 | 0 | yes | EREIPERSWNS | 96.89 | EREIPERSWSS | 1.92 | EREIPERSWNT | 1.08 | | |
| NS3 | 1812 | 0.24 | 4 | 3 | 0 | yes | REIPERSWNSG | 96.89 | REIPERSWSSG | 1.92 | REIPERSWNTG | 1.08 | | |
| NS3 | 1813 | 0.26 | 5 | 3 | 0 | yes | EIPERSWNSGH | 96.65 | EIPERSWSSGH | 1.92 | EIPERSWNTGH | 1.08 | | |
| NS3 | 1814 | 0.26 | 5 | 3 | 0 | yes | IPERSWNSGHE | 96.65 | IPERSWSSGHE | 1.92 | IPERSWNTGHE | 1.08 | | |
| NS3 | 1815 | 0.26 | 5 | 3 | 0 | yes | PERSWNSGHEW | 96.65 | PERSWSSGHEW | 1.92 | PERSWNTGHEW | 1.08 | | |
| NS3 | 1816 | 0.42 | 7 | 3 | 0 | yes | ERSWNSGHEWI | 94.37 | ERSWSSGHEWV | 2.16 | ERSWNTGHEWV | 1.08 | | |
| NS3 | 1817 | 0.44 | 8 | 4 | 0 | yes | RSWNSGHEWIT | 94.25 | RSWSSGHEWVT | 2.16 | RSWNTGHEWVT | 1.08 | | |
| NS3 | 1818 | 0.46 | 10 | 4 | 0 | yes | SWNSGHEWITN | 94.13 | SWSSGHEWVTD | 1.92 | SWNTGHEWVTD | 1.08 | | |
| NS3 | 1819 | 0.47 | 11 | 4 | 0 | yes | WNSGHEWITNF | 94.01 | WNSGHEWVTDF | 1.92 | WNTGHEWVTDF | 1.08 | WNSGHEWITDF | 0.24 |
| NS3 | 1822 | 0.29 | 12 | 5 | 0 | yes | GHEWTDFKGKT | 96.77 | GYEWTDFKGKT | 1.68 | GHEWITDFKGK | 0.24 | GHEWITNFEGK | 0.24 |
| NS3 | 1823 | 0.29 | 12 | 5 | 0 | yes | HEWTDFKGKTV | 96.77 | YEWTDFKGKTV | 1.68 | HEWITDFKGKT | 0.24 | HEWITNFEGKT | 0.24 |
| NS3 | 1824 | 0.26 | 11 | 4 | 0 | yes | EWTDFKGKTVW | 97.01 | EWITNFEGKTV | 1.68 | EWITDFKGKTV | 0.24 | | |
| NS3 | 1825 | 0.26 | 11 | 4 | 0 | yes | WTDFKGKTVWF | 97.01 | WITNFEGKTVW | 1.68 | WITDFKGKTVW | 0.24 | | |
| NS3 | 1826 | 0.26 | 11 | 4 | 0 | yes | TDFKGKTVWFV | 97.01 | ITNFEGKTVWF | 1.68 | ITDFKGKTVWF | 0.24 | | |
| NS3 | 1827 | 0.22 | 8 | 2 | 0 | yes | DFKGKTVWFVP | 97.37 | TNFKGKTVWFV | 1.8 | | | | |
| NS3 | 1828 | 0.21 | 7 | 2 | 0 | yes | FKGKTVWFVPS | 97.49 | NFKGKTVWFVP | 1.8 | | | | |
| NS3 | 1829 | 0.07 | 5 | 1 | 0 | yes | KGKTVWFVPSI | 99.28 | | | | | | |
| NS3 | 1830 | 0.07 | 5 | 1 | 0 | yes | GKTVWFVPSIK | 99.28 | | | | | | |
| NS3 | 1831 | 0.14 | 3 | 2 | 0 | yes | KTVWFVPSIKA | 98.08 | GKTVWFVPSIR | 1.8 | | | | |
| NS3 | 1832 | 0.31 | 4 | 3 | 0 | yes | TVWFVPSIKAG | 95.69 | KTVWFVPSIKT | 2.4 | KTVWFVPSIRA | 1.8 | | |
| NS3 | 1833 | 0.31 | 4 | 3 | 0 | yes | VWFVPSIKAGN (TWFVPSIKTG) | 95.69 | TWFVPSIKTG | 2.4 | TWFVPSIRAG | 1.8 | | |

FIG. 9-59

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency |
|---|---|---|---|---|---

FIG. 9-60

Species: DENV2 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | pept

FIG. 9-61

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1893 | 0.55 | 3 | 2 | 0 | yes | KAERVIDPRRC | 87.78 | RAERVIDPRRC | 11.98 | | | | |
| NS3 | 1894 | 0.02 | 2 | 1 | 0 | yes | AERVIDPRRCM | 99.76 | | | | | | |
| NS3 | 1895 | 0.02 | 2 | 1 | 0 | yes | ERVIDPRRCMK | 99.76 | | | | | | |
| NS3 | 1896 | 0 | 1 | 1 | 0 | yes | RVIDPRRCMKP | 100 | | | | | | |
| NS3 | 1897 | 0 | 1 | 1 | 0 | yes | VIDPRRCMKPV | 100 | | | | | | |
| NS3 | 1898 | 0 | 1 | 1 | 0 | yes | IDPRRCMKPVI | 100 | | | | | | |
| NS3 | 1899 | 0.02 | 2 | 1 | 0 | yes | DPRRCMKPVIL | 99.76 | | | | | | |
| NS3 | 1900 | 0.1 | 5 | 2 | 0 | yes | PRRCMKPVILT | 99.04 | | | | | | |
| NS3 | 1901 | 0.12 | 6 | 2 | 0 | yes | RRCMKPVILTD | 98.8 | RCMKPVILTEG | 0.36 | | | | |
| NS3 | 1902 | 0.12 | 6 | 3 | 0 | yes | RCMKPVILTDG | 98.8 | CMKPVILTEGE | 0.36 | | | | |
| NS3 | 1903 | 0.12 | 6 | 3 | 0 | yes | CMKPVILTDGE | 98.8 | MKPVILTEGEE | 0.36 | | | | |
| NS3 | 1904 | 0.12 | 6 | 3 | 0 | yes | MKPVILTDGEE | 98.8 | KPVILTEGEER | 0.36 | | | | |
| NS3 | 1905 | 0.12 | 6 | 2 | 0 | yes | KPVILTDGEER | 98.8 | PVILTEGEERV | 0.36 | | | | |
| NS3 | 1906 | 0.24 | 8 | 3 | 0 | yes | PVILTDGEERV | 97.25 | VILTDGEERVV | 1.56 | VILTEGEERVI | 0.24 | | |
| NS3 | 1907 | 0.24 | 8 | 3 | 0 | yes | VILTDGEERVI | 97.25 | ILTDGEERVIL | 1.56 | ILTEGEERVIL | 0.24 | | |
| NS3 | 1908 | 0.24 | 8 | 3 | 0 | yes | ILTDGEERVIL | 97.25 | LTDGEERVILA | 1.56 | LADGEERVILA | 0.24 | | |
| NS3 | 1909 | 0.24 | 8 | 3 | 0 | yes | LTDGEERVILA | 97.25 | TDGEERVILAG | 1.56 | TEGEERVILAG | 0.24 | | |
| NS3 | 1910 | 0.22 | 7 | 2 | 0 | yes | TDGEERVILAG | 97.49 | DGEERVILAGP | 1.56 | | | | |
| NS3 | 1911 | 0.15 | 3 | 2 | 0 | yes | DGEERVILAGP | 98.08 | GEERVILAGPM | 1.68 | | | | |
| NS3 | 1912 | 0.13 | 3 | 2 | 0 | yes | GEERVILAGPM | 98.32 | EERVILAGPMP | 1.56 | | | | |
| NS3 | 1913 | 0.13 | 3 | 2 | 0 | yes | EERVILAGPMP | 98.2 | ERVILAGPMPV | 1.56 | | | | |
| NS3 | 1914 | 0.14 | 4 | 2 | 0 | yes | ERVILAGPMPV | 98.2 | RVILAGPMPYT | 1.56 | | | | |
| NS3 | 1915 | 0.14 | 4 | 2 | 0 | yes | RVILAGPMPYT | 98.2 | VILAGPMPVTH | 1.56 | | | | |
| NS3 | 1916 | 0.14 | 4 | 2 | 0 | yes | VILAGPMPVTH | 98.2 | ILAGPMPVTHS | 1.56 | | | | |
| NS3 | 1917 | 0.2 | 5 | 2 | 0 | yes | ILAGPMPVTHS | 97.49 | LAGPMPVTHSS | 1.56 | | | | |
| NS3 | 1918 | 0.1 | 5 | 2 | 0 | yes | LAGPMPVTHSS | 98.92 | LAGPMPVTHFS | 0.72 | | | | |

FIG. 9-62

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1919 | 0.1 | 5 | 2 | 0 | yes | AGPMPVTHSSA | 98.92 | AGPMPVTHFSA | 0.72 | | |
| NS3 | 1920 | 0.1 | 5 | 2 | 0 | yes | GPMPVTHSSAA | 98.92 | GPMPVTHFSAA | 0.72 | | |
| NS3 | 1921 | 0.1 | 5 | 2 | 0 | yes | PMPVTHSSAAQ | 98.92 | PMPVTHFSAAQ | 0.72 | | |
| NS3 | 1922 | 0.1 | 5 | 2 | 0 | yes | MPVTHSSAAQR | 98.92 | MPVTHFSAAQR | 0.72 | | |
| NS3 | 1923 | 0.1 | 5 | 2 | 0 | yes | PVTHSSAAQRR | 98.92 | PVTHFSAAQRR | 0.72 | | |
| NS3 | 1924 | 0.09 | 4 | 1 | 0 | yes | VTHSSAAQRRG | 99.04 | | | | |
| NS3 | 1925 | 0.07 | 3 | 1 | 0 | yes | THSSAAQRRGR | 99.16 | | | | |
| NS3 | 1926 | 0.35 | 4 | 2 | 0 | yes | HSSAAQRRGRI | 94.37 | HSSAAQRRGRV | 4.79 | | |
| NS3 | 1927 | 0.35 | 4 | 2 | 0 | yes | SSAAQRRGRIG | 94.37 | SSAAQRRGRVG | 4.79 | | |
| NS3 | 1928 | 0.29 | 3 | 2 | 0 | yes | SAAQRRGRIGR | 95.09 | SAAQRRGRVGR | 4.79 | | |
| NS3 | 1929 | 0.28 | 2 | 2 | 0 | yes | AAQRRGRIGRN | 95.09 | AAQRRGRVGRN | 4.91 | | |
| NS3 | 1930 | 0.28 | 2 | 2 | 0 | yes | AQRRGRIGRNP | 95.09 | AQRRGRVGRNP | 4.91 | | |
| NS3 | 1931 | 0.46 | 3 | 3 | 0 | yes | QRRGRIGRNPK | 92.46 | QRRGRVGRNPK | 4.91 | QRRGRIGRNPR | 2.63 |
| NS3 | 1932 | 0.46 | 3 | 3 | 0 | yes | RRGRIGRNPKN | 92.46 | RRGRVGRNPKN | 4.91 | RRGRIGRNPRN | 2.63 |
| NS3 | 1933 | 0.46 | 3 | 3 | 0 | yes | RGRIGRNPKNE | 92.46 | RGRVGRNPKNE | 4.79 | RGRIGRNPRNE | 2.63 |
| NS

FIG. 9-63

Species: DENV2 (11-mers)

| protein | block starting position | block

FIG. 9-64

Species: DENV2 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|

FIG. 9-65

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1997 | 0.04 | 3 | 1 | 0 | yes | EYRLRGEARKT | 99.64 | | | | | | |
| NS3 | 1998 | 0.04 | 3 | 1 | 0 | yes | YRLRGEARKTF | 99.64 | | | | | | |
| NS3 | 1999 | 0.04 | 3 | 1 | 0 | yes | RLRGEARKTFV | 99.64 | | | | | | |
| NS3 | 2000 | 0.07 | 4 | 1 | 0 | yes | LRGEARKTFVD | 99.28 | | | | | | |
| NS3 | 2001 | 0.07 | 4 | 1 | 0 | yes | RGEARKTFVDL | 99.28 | | | | | | |
| NS3 | 2002 | 0.07 | 4 | 1 | 0 | yes | GEARKTFVDLM | 99.28 | | | | | | |
| NS3 | 2003 | 0.19 | 5 | 2 | 0 | yes | EARKTFVDLMK | 97.6 | EARKTFVDLMK | 1.68 | | | | |
| NS3 | 2004 | 0.19 | 5 | 2 | 0 | yes | ARKTFVDLMRR | 97.6 | ARKTFVDLMKR | 1.68 | | | | |
| NS3 | 2005 | 0.19 | 5 | 2 | 0 | yes | RKTFVDLMRRG | 97.6 | RKTFVDLMKRG | 1.68 | | | | |
| NS3 | 2006 | 0.19 | 5 | 2 | 0 | yes | KTFVDLMRRGD | 97.6 | KTFVDLMKRGD | 1.68 | | | | |
| NS3 | 2007 | 0.16 | 3 | 2 | 0 | yes | TFVDLMRRGDL | 97.96 | TFVDLMKRGDL | 1.68 | | | | |
| NS3 | 2008 | 0.16 | 3 | 2 | 0 | yes | FVDLMRRGDLP | 97.96 | FVDLMKRGDLP | 1.68 | | | | |
| NS3 | 2009 | 0.16 | 3 | 2 | 0 | yes | VDLMRRGDLPV | 97.96 | VDLMKRGDLPV | 1.68 | | | | |
| NS3 | 2010 | 0.16 | 3 | 2 | 0 | yes | DLMRRGDLPVW | 97.96 | DLMKRGDLPVW | 1.68 | | | | |
| NS3 | 2011 | 0.12 | 2 | 2 | 0 | yes | LMRRGDLPVWL | 97.96 | LMKRGDLPVWL | 1.68 | | | | |
| NS3 | 2012 | 0.12 | 2 | 2 | 0 | yes | MRRGDLPVWLA | 98.32 | MKRGDLPVWLA | 1.68 | | | | |
| NS3 | 2013 | 0.2 | 3 | 2 | 0 | yes | RRGDLPVWLAY | 98.32 | KRGDLPVWLAY | 1.68 | | | | |
| NS3 | 2014 | 1.01 | 4 | 3 | 0 | yes | RGDLPVWLAYK | 97.37 | RGDLPVWLAYR | 33.89 | RGDLPVWLAFK | 0.96 | | |
| NS3 | 2015 | 1.01 | 5 | 3 | 0 | yes | GDLPVWLAYKV | 65.03 | GDLPVWLAYRV | 33.89 | GDLPVWLAFKV | 0.96 | | |
| NS3 | 2016 | 1.01 | 6 | 3 | 0 | yes | DLPVWLAYKVA | 65.03 | DLPVWLAYRVA | 33.89 | DLPVWLAFKVA | 0.96 | | |
| NS3 | 2017 | 1.18 | 5 | 4 | 0 | yes | LPVWLAYKVAA | 62.16 | LPVWLAYRVAA | 33.89 | LPVWLAYKVAS | 2.87 | LPVWLAFKVAA | 0.96 |
| NS3 | 2018 | 1.19 | 6 | 4 | 0 | yes | PVWLAYKVAAE | 62.04 | PVWLAYRVAAE | 33.89 | PVWLAYKVASE | 2.87 | PVWLAFKVAAE | 0.96 |
| NS3 | 2019 | 1.19 | 6 | 4 | 0 | yes | VWLAYKVAAEG | 62.04 | VWLAYRVAAEG | 33.89 | VWLAYKVASEG | 2.87 | VWLAFKVAAEG | 0.96 |
| NS3 | 2020 | 1.2 | 7 | 4 | 0 | yes | WLAYKVAAEGI | 61.92 | WLAYRVAAEGI | 33.89 | WLAYKVASEGI | 2.87 | WLAFKVAAEGI | 0.96 |
| NS3 | 2021 | 1.24 | 9 | 5 | 0 | yes | LAYKVAAEGIN | 61.92 | LAYRVAAEGIN | 33.77 | LAYKVASEGIN | 2.16 | LAFKVAAEGIN | 0.96 | LAYKVASEGIS | 0.72 |
| NS3 | 2022 | 1.24 | 9 | 5 | 0 | yes | AYKVAAEGINY | 61.92 | AYRVAAEGINY | 33.77 | AYKVASEGINY | 2.16 | AFKVAAEGINY | 0.96 | AYKVASEGISY | 0.72 |

FIG. 9-66

Species: DENV2 (11-mers)

| protein | block starting position | block entropy | total peptides in block (11-mers) | peptides required to cover 99% of block | gap/X fraction | 99% of block covered w/ <= 5 peptides? | block to cover 99% of peptides required | frequency | block to cover 99% of peptides required | frequency

FIG. 9-67

Species: DENV2 (11-mers)

| protein | block starting position | block entropy | total

FIG. 9-68

Species: DENV2 (11-mers)

| protein | block starting position | block entropy | total peptides in block | peptides required to cover 99% of block | gap/X fraction | 99% of block covered w/ <= 5 peptides?

FIG. 9-69

Species: DENV2 (11-mers)

| protein | block starting position | block entropy | total peptides in block | peptides required to cover 99% of block | gap/X fraction | 99% of block covered w/

FIG. 9-70

Species: DENV2 (11-mers)

| protein | block starting position | block entropy | total peptides in block | peptides required to cover 99% of block | gap/X fraction | 99% of block covered w/ <= 5 peptides? | block to cover 99% of | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS4A | 2138 | 0.06 | 4 | 1 | 0 | yes | LSELPETLETL | 99.4 | | | | | | |
| NS4A | 2139 | 0.06 | 4 | 1 | 0 | yes | SELPETLETLL | 99.4 | | | | | | |

FIG. 9-71

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2165 | 1.54 | 8 | 5 | 0 | yes | LMSGKGIGKMT | 53.89 | LMSGKGVGKMT | 35.09 | LMSGKGVGKMT | 6.95 | LMSGRGVGKMT | 1.8 | LMSAR

FIG. 9-72

Species: DENV2 (11-mers)

| protein | block starting position | block entropy | total peptides in block | peptides required to cover 99% of block | gap/X fraction | 99% of block covered w/ <= 5 peptides? | block | frequency | peptides required to

FIG. 9-73

Species: DENV2 (11-mers)

| protein | block starting position | block entropy | total

FIG. 9-74

Species: DENV2 (11-mers)

| protein | block starting position | block entropy | total peptides in block | peptides required to cover 99% of block | gap/X fraction | 99% of block covered w/ <= 5 peptides? | block peptides required to cover 99% of block | frequency | peptides required to cover 99% of block | frequency | peptides required to cover

FIG. 9-75

Species: DENV2 (11-mers)

| protein | block starting position | block entropy | total peptides in block | pe

FIG. 9-76

Species: DENV2 (11-mers)

| protein | block starting position | block entropy | total peptides in block | peptides required to cover 99% of block | gap/X fraction | 99% of block covered w/ <= 5 pe

FIG. 9-77

Species: DENV2 (11-mers)

| protein | block starting position | block entropy | total peptides in block | peptides required to cover 99% of block | gap/X fraction | 99% of block covered w/ M

FIG. 9-78

Species: DENV2 (11-mers)

| protein | block starting position | block entropy | total peptides in block | peptides required to cover 99% of block | gap/X fraction | 99% of block covered w/ M <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2382 | 0.03 | 3 | 1 | 0 | yes | AGIMKNPTVDG | 99.76 | | | | | | |
| NS4B | 2383 | 0.17 | 4 | 2 | 0 | yes | GIMKNPTVDGI | 97.72 | GIMKNPTVDGV | 2.04 | | | | |
| NS4B | 2384 | 0.17 | 4 | 2 | 0 | yes | IMKNPTVDGIT | 97.72 | IMKNPTVDGVT | 2.04 | | | | |
| NS4B | 2385 | 0.17 | 4 | 2 | 0 | yes | MKNPTVDGITV | 97.72 | MKNPTVDGVTV | 2.04 | | | | |
| NS4B | 2386 | 0.17 | 4 | 2 | 0 | yes | KNPTVDGITVI | 97.72 | KNPTVDGVTVI | 2.04 | | | | |
| NS4B | 2387 | 0.17 | 4 | 2 | 0 | yes | NPTVDGITVID | 97.72 | NPTVDGVTVID | 2.04 | | | | |
| NS4B | 2388 | 0.17 | 4 | 2 | 0 | yes | PTVDGITVIDL | 97.72 | PTVDGVTVIDL | 2.04 | | | | |
| NS4B | 2389 | 1.16 | 6 | 3 | 0 | yes | TVDGITVIDLD | 49.94 | TVDGVTVIDLD | 47.66 | TVDGVTVIDLD | 2.04 | | |
| NS4B | 2390 | 1.15 | 5 | 3 | 0.12 | yes | VDGITVIDLDP | 49.94 | VDGVTVIDLDP | 47.78 | VDGVTVIDLDP | 2.04 | | |
| NS4B | 2391 | 1.15 | 5 | 3 | 0.12 | yes | DGITVIDLDPI | 49.82 | DGVTVIDLDPI | 47.78 | DGVTVIDLDPI | 2.04 | | |
| NS4B | 2392 | 1.15 | 5 | 3 | 0.12 | yes | GITVIDLDPIP | 49.82 | GVTVIDLDPIP | 47.78 | GVTVIDLDPIP | 2.04 | | |
| NS4B | 2393 | 1.16 | 6 | 3 | 0.12 | yes | ITVIDLDPIPY | 49.82 | TVIDLDPIPY | 47.66 | VTVIDLDPIPY | 2.04 | | |
| NS4B | 2394 | 1.02 | 4 | 2 | 0.12 | yes | TVIDLDPIPYD | 49.82 | TVIDLEPIPYD | 49.82 | | | | |
| NS4B | 2395 | 1.02 | 4 | 2 | 0.12 | yes | VIDLDPIPYDP | 49.82 | VIDLEPIPYDP | 49.82 | | | | |
| NS4B | 2396 | 1.02 | 4 | 2 | 0.12 | yes | IDLDPIPYDPK | 49.82 | IDLEPIPYDPK | 49.82 | | | | |
| NS4B | 2397 | 1.02 | 4 | 2 | 0.12 | yes | DLDPIPYDPKF | 49.82 | DLEPIPYDPKF | 49.82 | | | | |
| NS4B | 2398 | 1.02 | 4 | 2 | 0.12 | yes | LDPIPYDPKFE | 49.82 | LEPIPYDPKFE | 49.82 | | | | |
| NS4B | 2399 | 1.02 | 4 | 2 | 0.12 | yes | DPIPYDPKFEK | 49.82 | EPIPYDPKFEK | 49.82 | | | | |
| NS4B | 2400 | 0.01 | 2 | 1 | 0 | yes | PIPYDPKFEKQ | 99.76 | | | | | | |
| NS4B | 2401 | 0.01 | 2 | 1 | 0 | yes | IPYDPKFEKQL | 99.76 | | | | | | |
| NS4B | 2402 | 0.01 | 2 | 1 | 0 | yes | PYDPKFEKQLG | 99.88 | | | | | | |
| NS4B | 2403 | 0.01 | 2 | 1 | 0 | yes | YDPKFEKQLGQ | 99.88 | |

FIG. 9-79

Species: DENV2 (11-mers)

| protein | block starting position | block entropy | total peptides in block | peptides required to cover 99% of block | gap/X fraction | 99% of block covered w/ <= 5 peptides? | block |

FIG. 9-80

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2434 | 0.2 | 5 | 2 | 0 | yes | CEALTLATGPI | 97.25 | CEALTLATGPV | 2.4 | | | | |
| NS4B | 2435 | 0.2 | 5 | 2 | 0 | yes | EALTLATGP

FIG. 9-81

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2460 | 0.01 | 2 | 1 | 0 | yes | IAVSM

FIG. 9-82

Species: DENV2

FIG. 9-83

Species: DENV2 (11-mers)

| protein | block starting position | block entropy | total peptides in block | peptides required to cover 99% of block | gap/X fraction | 99% of block covered w/ <= 5 peptides? | block | frequency | peptides required to cover 99% of block | block | frequency | peptides

FIG. 9-84

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2558 | 0.62 | 6 | 3 | 0 | yes | ERNMVTPEGKV | 88.86 | ERNLVTPEGKV | 8.5 | ERNMVAPEGKV | 2.04 | | |
| NS5 | 2559 | 0.7 | 8 | 4 | 0 | yes | RNMVTPEGKVV | 88.86 | RNLVTPEGKVM | 6.23 | RNMVAPEGKVV | 2.04 | | |
| NS5 | 2560 | 0.7 | 8 | 4 | 0 | yes | NMVTPEGKVWD | 88.86 | NLVTPEGKVWD | 6.23 | NMVAPEGKVWD | 2.04 | | |
| NS5 | 2561 | 0.7 | 8 | 4 | 0 | yes | MVTPEGKVWDL | 88.86 | LVTPEGKVMDL | 6.23 | MVAPEGK

FIG. 9-85

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of

FIG. 9-86

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | fr

FIG. 9-87

Species: DENV2 (11-mers)

| protein | block starting position | block entropy | total peptides in block | peptides required to cover 99% of block | gap/X fraction | covered w/ <= 5 peptides? 99% of block | peptides required to cover 99% of block | frequency | peptides required

FIG. 9-89

Species: DENV2 (11-mers)

| protein | block starting position | block entropy | total peptides in block | peptides required to cover 99% of block | gap/X fraction | 99% of block covered w/

FIG. 9-90

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2725 | 0.04 | 3 | 1 | 0 | yes | MISRMLINRFT | 99.64 | | | | | | |
| NS5 | 2726 | 0.04 | 3 | 1 | 0 | yes | ISRMLINRFTM | 99.64 | | | | | | |
| NS5 | 2727 | 1.02 | 4 | 2 | 0 | yes | SRMLINRFTMR | 55.81 | SRMLINRFTMR | 43.83 | | | | |
| NS5 | 2728 | 1.14 | 5 | 3 | 0 | yes | RMLINRFTMRH | 55.81 | RMLINRFTMRH | 41.92 | RMLINRFTMRY | 1.92 | | |
| NS5 | 2729 | 1.14 | 5 | 3 | 0 | yes | MLINRFTMRHK | 55.81 | MLINRFTMKHK | 41.92 | MLINRFTMRYK | 1.92 | | |
| NS5 | 2730 | 1.17 | 6 | 3 | 0 | yes | LINRFTMKHKK | 55.81 | LINRFTMRHKK | 41.56 | LINRFTMRYKK | 1.92 | | |
| NS5 | 2731 | 1.22 | 9 | 4 | 0 | yes | INRFTMKHKKA | 55.57 | INRFTMRHKKA | 41.2 | INRFTMRYKKA | 1.92 | INRFTMRHKRA | 0.36 |
| NS5 | 2732 | 1.19 | 7 | 3 | 0 | yes | NRFTMKHKKAT | 55.69 | NRFTMRHKKAT | 41.44 | NRFTMRYKKAT | 1.92 | | |
| NS5 | 2733 | 1.19 | 7 | 3 | 0 | yes | RFTMKHKKATY | 55.69 | RFTMRHKKATY | 41.44 | RFTMRYKKATY | 1.92 | | |
| NS5 | 2734 | 1.19 | 7 | 3 | 0 | yes | FTMKHKKATYE | 55.69 | FTMRHKKATYE | 41.44 | FTMRYKKATYE | 1.92 | | |
| NS5 | 2735 | 1.23 | 10 | 4 | 0 | yes | TMKHKKATYEP | 55.33 | TMRHKKATYEP | 41.44 | TMRYKKATYEP | 1.92 | TMRHKKRATYEP | 0.36 |
| NS5 | 2736 | 1.23 | 10 | 4 | 0 | yes | MKHKKATYEPD | 55.33 | MRHKKATYEPD | 41.44 | MRYKKATYEPD | 1.92 | MRHKKRATYEPD | 0.36 |
| NS5 | 2737 | 1.23 | 10 | 4 | 0 | yes | KHKKATYEPDV | 55.33 | RHKKATYEPDV | 41.44 | RYKKATYEPDV | 1.92 | RHKKRATYEPDV | 0.36 |
| NS5 | 2738 | 0.27 | 8 | 3 | 0 | yes | HKKATYEPDVD | 96.77 | YKKATYEPDVD | 1.92 | HKKTTYEPDVD | 0.36 | | |
| NS5 | 2739 | 0.13 | 7 | 2 | 0 | yes | KKATYEPDVDL | 98.68 | KRATYEPDVDL | 0.36 | | | | |
| NS5 | 2740 | 0.13 | 7 | 2 | 0 | yes | KATYEPDVDLG | 98.68 | KTTYEPDVDLG | 0.36 | | | | |
| NS5 | 2741 | 0.1 | 6 | 1 | 0 | yes | ATYEPDVDLGS | 99.04 | | | | | | |
| NS5 | 2742 | 0.04 | 4 | 1 | 0 | yes | TYEPDVDLGSG | 99.64 | | | | | | |
| NS5 | 2743 | 0.04 | 4 | 1 | 0 | yes | YEPDVDLGSGT | 99.64 | | | | | | |
| NS5 | 2744 | 0.04 | 4 | 1 | 0 | yes | EPDVDLGSGTR | 99.64 | | | | | | |
| NS5 | 2745 | 0.02 | 2 | 1 | 0 | yes | PDVDLGSGTRN | 99.76 | | | | | | |
| NS5 | 2746 | 0.04 | 3 | 1 | 0 | yes | DVDLGSGTRNI | 99.64 | | | | | | |
| NS5 | 2747 | 0.04 | 3 | 1 | 0 | yes | VDLGSGTRNIG | 99.64 | | | | | | |
| NS5 | 2748 | 0.11 | 5 | 2 | 0 | yes | DLGSGTRNIGI | 98.8 | DLGSGTRNIGT | 0.6 | | | | |
| NS5 | 2749 | 0.11 | 5 | 2 | 0 | yes | LGSGTRNIGIE | 98.8 | LGSGTRNIGTE | 0.6 | GSGTRNIGTES | 0.6 | | |
| NS5 | 2750 | 0.73 | 8 | 4 | 0 | yes | GSGTRNIGIES | 86.59 | GSGTRNIGIEN | 10.3 | GSGTRNIGIEC | 1.92 | | |

FIG. 9-91

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 9-92

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2786 | 0.06 | 3 | 1 | 0 | yes | DQDHPYKTWAY | 99.4 | | |
| NS5 | 2787 | 0.06 | 3 | 1 | 0 | yes | QDHPYKTWAYH | 99.4 | | |
| NS5 | 2788 | 0.06 | 3 | 1 | 0 | yes | DHPYKTWAYHG | 99.4 | | |
| NS5 | 2789 | 0.06 | 3 | 1 | 0 | yes | HPYKTWAYHGS | 99.4 | | |
| NS5 | 2790 | 0.04 | 2 | 1 | 0 | yes | PYKTWAYHGSY | 99.52 | | |
| NS5 | 2791 | 0.04 | 2 | 1 | 0 | yes | YKTWAYHGSYE | 99.52 | | |
| NS5 | 2792 | 0.06 | 3 | 1 | 0 | yes | KTWAYHGSYET | 99.4 | | |
| NS5 | 2793 | 0.03 | 3 | 1 | 0 | yes | TWAYHGSYETK | 99.76 | | |
| NS5 | 2794 | 0.03 | 3 | 1 | 0 | yes | WAYHGSYETKQ | 99.76 | | |
| NS5 | 2795 | 0.03 | 3 | 1 | 0 | yes | AYHGSYETKQT | 99.76 | | |
| NS5 | 2796 | 0.03 | 3 | 1 | 0 | yes | YHGSYETKQTG | 99.76 | | |
| NS5 | 2797 | 0.03 | 3 | 1 | 0 | yes | HGSYETKQTGS | 99.76 | | |
| NS5 | 2798 | 0.03 | 3 | 1 | 0 | yes | GSYETKQTGSA | 99.76 | | |
| NS5 | 2799 | 0.03 | 3 | 1 | 0 | yes | SYETKQTGSAS | 99.76 | | |
| NS5 | 2800 | 0.04 | 4 | 1 | 0 | yes | YETKQTGSASS | 99.64 | | |
| NS5 | 2801 | 0.04 | 4 | 1 | 0 | yes | ETKQTGSASSM | 99.64 | | |
| NS5 | 2802 | 0.05 | 5 | 1 | 0 | yes | TKQTGSASSMV | 99.52 | | |
| NS5 | 2803 | 0.05 | 5 | 1 | 0 | yes | KQTGSASSMVN | 99.52 | | |
| NS5 | 2804 | 0.04 | 4 | 1 | 0 | yes | QTGSASSMVNG | 99.64 | | |
| NS5 | 2805 | 0.04 | 4 | 1 | 0 | yes | TGSASSMVNGV | 99.64 | | |
| NS5 | 2806 | 0.06 | 5 | 1 | 0 | yes | GSASSMVNGVV | 99.4 | | |
| NS5 | 2807 | 0.42 | 6 | 2 | 0 | yes | SASSMVNGVVR | 92.69 | SASSMVNGVVK | 6.71 |
| NS5 | 2808 | 0.42 | 6 | 2 | 0 | yes | ASSMVNGVVRL | 92.69 | ASSMVNGVVKL | 6.71 |
| NS5 | 2809 | 0.42 | 6 | 2 | 0 | yes | SSMVNGVVRLL | 92.69 | SSMVNGVVKLL | 6.71 |
| NS5 | 2810 | 0.42 | 6 | 2 | 0 | yes | SMVNGVVRLLT | 92.69 | SMVNGVVKLLT | 6.71 |
| NS5 | 2811 | 0.41 | 5 | 2 | 0 | yes | MVNGVVRLLTK | 92.81 | MVNGVVKLLTK | 6.71 |

FIG. 9-93

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | fr

FIG. 9-94

Species: DENV2 (11-mers)

| protein | block starting position | block entropy | total peptides in block | peptides required to cover 99% of block | 99% of block covered w/ <= 5 peptides? | gap/X fraction | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2838 | 0.05 | 2 | 1 | yes | 0 | TPFGQQRVFKE | 99.4 | | | | | | |
| NS5 | 2839 | 0.05 | 2 | 1 | yes | 0 | PFGQQRVFKEK | 99.4 | | | | | | |
| NS5 | 2840 | 0.05 | 2 | 1 | yes | 0 | FGQQRVFKEKV | 99.4 | | | | | | |
| NS5 | 2841 | 0.05 | 2 | 1 | yes | 0 | GQQRVFKEKVD | 99.4 | | | | | | |
| NS5 | 2842 | 0.05 | 2 | 1 | yes | 0 | QQRVFKEKVDT | 99.4 | | | | | | |
| NS5 | 2843 | 0.05 | 2 | 1 | yes | 0 | QRVFKEKVDTR | 99.4 | | | | | | |
| NS5 | 2844 | 0.07 | 3 | 1 | yes | 0 | RVFKEKVDTRT | 99.28 | | | | | | |
| NS5 | 2845 | 0.07 | 3 | 1 | yes | 0 | VFKEKVDTRTQ | 99.28 | | | | | | |
| NS5 | 2846 | 0.09 | 4 | 1 | yes | 0 | FKEKVDTRTQE | 99.04 | | | | | | |
| NS5 | 2847 | 0.09 | 4 | 1 | yes | 0 | KEKVDTRTQEP | 99.04 | | | | | | |
| NS5 | 2848 | 0.09 | 4 | 1 | yes | 0 | EKVDTRTQEPK | 99.04 | | | | | | |
| NS5 | 2849 | 0.04 | 3 | 1 | yes | 0 | KVDTRTQEPKE | 99.64 | | | | | | |
| NS5 | 2850 | 0.04 | 4 | 1 | yes | 0 | VDTRTQEPKEG | 99.64 | | | | | | |
| NS5 | 2851 | 0.04 | 4 | 1 | yes | 0 | DTRTQEPKEGT | 99.64 | | | | | | |
| NS5 | 2852 | 0.04 | 4 | 1 | yes | 0 | TRTQEPKEGTK | 99.64 | | | | | | |
| NS5 | 2853 | 0.06 | 5 | 1 | yes | 0 | RTQEPKEGTKK | 99.4 | | | | | | |
| NS5 | 2854 | 0.05 | 4 | 1 | yes | 0 | TQEPKEGTKKL | 99.4 | | | | | | |
| NS5 | 2855 | 0.05 | 5 | 2 | yes | 0 | QEPKEGTKKLM | 99.52 | | | | | | |
| NS5 | 2856 | 0.68 | 5 | 2 | yes | 0 | EPKEGTKKLMR | 83.71 | EPKEGTKKLMR | 15.81 | | | | | |
| NS5 | 2857 | 0.67 | 4 | 2 | yes | 0 | PKEGTKKLMKI | 83.83 | PKEGTKKLMRI | 15.81 | | | | | |
| NS5 | 2858 | 0.67 | 4 | 2 | yes | 0 | KEGTKKLMKIT | 83.83 | KEGTKKLMRIT | 15.81 | | | | | |
| NS5 | 2859 | 0.67 | 4 | 2 | yes | 0 | EGTKKLMKITA | 83.83 | EGTKKLMRITA | 15.81 | | | | | |
| NS5 | 2860 | 0.81 | 7 | 4 | yes | 0 | GTKKLMKITAE | 82.63 | GTKKLMRITAE | 15.09 | GTKKLMKITAK | 0.96 | GTKKLMRITAK | 0.72 |
| NS5 | 2861 | 0.79 | 6 | 4 | yes | 0 | TKKLMKITAEW | 82.75 | TKKLMRITAEW | 15.09 | TKKLMKITAKW | 0.96 | TKKLMRITAKW | 0.72 |
| NS5 | 2862 | 0.79 | 6 | 4 | yes | 0 | KKLMKITAEWL | 82.75 | KKLMRITAEWL | 15.09 | KKLMKITAKWL | 0.96 | KKLMRITAKWL | 0.72 |
| NS5 | 2863 | 0.79 | 6 | 4 | yes | 0 | KLMKITAEWLW | 82.75 | KLMRITAEWLW | 15.09 | KLMKITAKWLW | 0.96 | KLMRITAKWLW | 0.72 |

FIG. 9-95

Species: DENV2 (11-mers)

| protein | block starting position | block entropy | total

FIG. 9-96

Species: DENV2 (11-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover

FIG. 9-97

Species: DENV2 (11-mers)

| protein | block star

FIG. 9-99

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency

FIG. 9-100

Species: DENV2 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of

FIG. 9-101

Species: DENV2 (11-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency |
|---|---|---|---|---|---|---|---|---|---|---|
| NS5 | 3059 | 0.12 | 5 | 2 | 0 | yes | IFKLTYQNKV | 98.68 | IFR

FIG. 9-102

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS5 | 3085 | 0.58 | 2 | 2 | 0 | yes | SRRDQRGSGQV | 86.11 | SRKDQRGSGQV | 13.89 | | | | | | |
| NS5 | 3086 | 0.9 | 5 | 3 | 0 | yes | RRDQRGSGQVG | 80.6 | RKDQRGSGQVG | 13.77 | RRDQRGSGQW | 5.39 | | | | |
| NS5 | 3087 | 0.9 | 5 | 3 | 0 | yes | RDQRGSGQVGT | 80.6 | KDQRGSGQVGT | 13.77 | RDQRGSGQWT | 5.39 | | | | |
| NS5 | 3088 | 0.32 | 3 | 2 | 0 | yes | DQRGSGQVGTY | 94.37 | DQRGSGQWTY | 5.51 | | | | | | |
| NS5 | 3089 | 0.32 | 3 | 2 | 0 | yes | QRGSGQVGTYG | 94.37 | QRGSGQWTYG | 5.51 | | | | | | |
| NS5 | 3090 | 0.32 | 3 | 2 | 0 | yes | RGSGQVGTYGL | 94.37 | RGSGQWTYGL | 5.51 | | | | | | |
| NS5 | 3091 | 0.32 | 3 | 2 | 0 | yes | GSGQVGTYGLN | 94.37 | GSGQWTYGLN | 5.51 | | | | | | |
| NS5 | 3092 | 0.32 | 3 | 2 | 0 | yes | SGQVGTYGLNT | 94.37 | SGQWTYGLNT | 5.51 | | | | | | |
| NS5 | 3093 | 0.32 | 3 | 2 | 0 | yes | GQVGTYGLNTF | 94.37 | GQWTYGLNTF | 5.51 | | | | | | |
| NS5 | 3094 | 0.32 | 3 | 2 | 0 | yes | QVGTYGLNTFT | 94.37 | QWTYGLNTFT | 5.51 | | | | | | |
| NS5 | 3095 | 0.33 | 4 | 2 | 0 | yes | VGTYGLNTFTN | 94.25 | WTYGLNTFTN | 5.51 | | | | | | |
| NS5 | 3096 | 0.36 | 5 | 2 | 0 | yes | GTYGLNTFTNM | 94.01 | VTYGLNTFTNM | 5.51 | | | | | | |
| NS5 | 3097 | 0.11 | 4 | 2 | 0 | yes | TYGLNTFTNME | 98.8 | TYGLNTFTNMG | 0.84 | | | | | | |
| NS5 | 3098 | 0.11 | 4 | 2 | 0 | yes | YGLNTFTNMEA | 98.8 | YGLNTFTNMGA | 0.84 | | | | | | |
| NS5 | 3099 | 0.11 | 4 | 2 | 0 | yes | GLNTFTNMEAQ | 98.8 | GLNTFTNMGAQ | 0.84 | | | | | | |
| NS5 | 3100 | 0.12 | 5 | 2 | 0 | yes | LNTFTNMEAQL | 98.68 | LNTFTNMGAQL | 0.84 | | | | | | |
| NS5 | 3101 | 0.12 | 5 | 2 | 0 | yes | NTFTNMEAQLI | 98.68 | NTFTNMGAQLI | 0.84 | | | | | | |
| NS5 | 3102 | 0.12 | 5 | 2 | 0 | yes | TFTNMEAQLIR | 98.68 | TFTNMGAQLIR | 0.84 | | | | | | |
| NS5 | 3103 | 0.12 | 5 | 2 | 0 | yes | FTNMEAQLIRQ | 98.68 | FTNMGAQLIRQ | 0.84 | | | | | | |
| NS5 | 3104 | 0.12 | 5 | 2 | 0 | yes | TNMEAQLIRQM | 98.68 | TNMGAQLIRQM | 0.84 | | | | | | |
| NS5 | 3105 | 0.12 | 5 | 2 | 0 | yes | NMEAQLIRQME | 98.68 | NMGAQLIRQME | 0.84 | | | | | | |
| NS5 | 3106 | 0.11 | 4 | 2 | 0 | yes | MEAQLIRQMEG | 98.8 | MGAQLIRQMEG | 0.84 | | | | | | |
| NS5 | 3107 | 0.08 | 3 | 1 | 0 | yes | EAQLIRQMEGE | 99.04 | | | | | | | | |
| NS5 | 3108 | 0.03 | 3 | 1 | 0 | yes | AQLIRQMEGEG | 99.76 | | | | | | | | |
| NS5 | 3109 | 1.13 | 5 | 3 | 0 | yes | QLIRQMEGEGI | 54.49 | QLIRQMEGEGV | 43.35 | QLIRQMEGEGL | 1.92 | | | | |
| NS5 | 3110 | 1.13 | 5 | 3 | 0 | yes | LIRQMEGEGIF | 54.49 | LIRQMEGEGVF | 43.35 | LIRQMEGEGLF | 1.92 | | | | |

FIG. 9-103

Species: DENV2 (11-mers)

| protein | block starting position | block entropy | total peptides in block | peptides required to cover 99% of block | gap/X fraction | 99% of block covered w/ <= 5 peptides? | peptides required to cover 99

FIG. 9-104

Species: DENV2 (11-mers)

| protein | block starting position | block entropy | total peptides in block | peptides required to cover 99

FIG. 9-105

Species: DENV2 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS5 | 3198 | 1.05 | 5 | 2 | 0 | yes | PFCSHHFHELI | 51.26 | PFCSHHFHELV | 48.26 | | | | | | |
| NS5 | 3199 | 1.05 | 5 | 2 | 0 | yes | FCSHHFHELIM | 51.26 | FCSHHFHELVM | 48.26 | | | | | | |
| NS5 | 3200 | 1.05 | 5 | 2 | 0 | yes | CSHHFHELIMK | 51.26 | CSHHFHELVMK | 48.26 | | | | | | |
| NS5 | 3201 | 1.05 | 5 | 2 | 0 | yes | SHHFHELIMKD | 51.26 | SHHFHELVMKD | 48.26 | | | | | | |
| NS5 | 3202 | 1.05 | 5 | 2 | 0 | yes | HHFHELIMKDG | 51.26 | HHFHELVMKDG | 48.26 | | | | | | |
| NS5 | 3203 | 1.05 | 8 | 5 | 0 | yes | HFHELIMKDGR | 51.26 | HFHELVMKDGR | 48.26 | | | | | | |
| NS5 | 3209 | 0.53 | 8 | 5 | 0 | yes | MKDGRVLVPC | 92.93 | MKDGRTLVPC | 2.16 | MKDGRILVPC | 1.8 | MKDGRKLVPC | 1.68 | MKDGRMLVPC | 0.96 |
| NS5 | 3210 | 0.53 | 8 | 5 | 0 | yes | KDGRVLVPCR | 92.93 | KDGRTLVPCR | 2.16 | KDGRILVPCR | 1.8 | KDGRKLVPCR | 1.68 | KDGRMLVPCR | 0.96 |
| NS5 | 3215 | 0.17 | 5 | 2 | 0 | yes | LVVPCRNQDEL | 97.96 | LVVPCRSQDEL | 1.56 | | | | | | |
| NS5 | 3216 | 0.18 | 6 | 2 | 0 | yes | VVPCRNQDELI | 97.84 | VVPCRSQDELI | 1.56 | | | | | | |
| NS5 | 3217 | 0.19 | 7 | 2 | 0 | yes | VPCRNQDELIG | 97.72 | VPCRSQDELIG | 1.56 | | | | | | |
| NS5 | 3218 | 0.17 | 6 | 2 | 0 | yes | PCRNQDELIGR | 97.96 | PCRSQDELIGR | 1.56 | | | | | | |
| NS5 | 3219 | 0.17 | 6 | 2 | 0 | yes | CRNQDELIGRA | 97.96 | CRSQDELIGRA | 1.56 | | | | | | |
| NS5 | 3220 | 0.17 | 6 | 2 | 0 | yes | RNQDELIGRAR | 97.96 | RSQDELIGRAR | 1.56 | | | | | | |
| NS5 | 3221 | 0.18 | 7 | 2 | 0 | yes | NQDELIGRARI | 97.84 | SQDELIGRARI | 1.56 | | | | | | |
| NS5 | 3222 | 0.07 | 6 | 1 | 0 | yes | QDELIGRARIS | 99.4 | | | | | | | | |
| NS5 | 3223 | 0.07 | 6 | 1 | 0 | yes | DELIGRARISQ | 99.4 | | | | | | | | |
| NS5 | 3224 | 0.05 | 5 | 1 | 0 | yes | ELIGRARISQG | 99.52 | | | | | | | | |
| NS5 | 3225 | 0.05 | 5 | 1 | 0 | yes | LIGRARISQGA | 99.52 | | | | | | | | |
| NS5 | 3226 | 0.05 | 5 | 1 | 0 | yes | IGRARISQGAG | 99.52 | | | | | | | | |
| NS5 | 3227 | 0.04 | 4 | 1 | 0 | yes | GRARISQGAGW | 99.64 | | | | | | | | |
| NS5 | 3228 | 0.03 | 3 | 1 | 0 | yes | RARISQGAGWS | 99.76 | | | | | | | | |
| NS5 | 3229 | 0.06 | 4 | 1 | 0 | yes | ARISQGAGWSL | 99.4 | | | | | | | | |
| NS5 | 3230 | 1.05 | 5 | 2 | 0 | yes | RISQGAGWSLK | 54.97 | RISQGAGWSLR | 44.43 | | | | | | |
| NS5 | 3231 | 1.05 | 5 | 2 | 0 | yes | ISQGAGWSLKE | 54.97 | ISQGAGWSLRE | 44.43 | | | | | | |
| NS5 | 3232 | 1.03 | 4 | 2 | 0 | yes | SQGAGWSLKET | 55.09 | SQGAGWSLRET | 44.43 | | | | | | |

FIG. 9-106

Species: DENY2 (11-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS5 | 3233 | 1.03 | 4 | 2 | 0 | yes | QGAGWSL

FIG. 9-107

Species: DENV2 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3259 | 0.04 | 4 | 1 | 0 | yes | HRR

FIG. 9-108

| protein | block starting position | block entropy | total peptides in block (11-mers) | peptides required to cover 99% of block | 99% of block covered w/ <= 5 peptides? | gap/X fraction | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3285 | 0.68 | 8 | 4 | yes |

FIG. 9-109

Species: DENV2 (11-mers)

| protein | block starting position | block entropy | total peptides in block | peptides required to cover 99% of block | gap/X fraction | 99%

FIG. 9-110

Species: DENV2 (11-mers)

| protein | block starting position | block entropy | total peptides in block | peptides required to cover 99% of block | gap/X fraction | 99% of block covered w/ <= 5 peptides? | block to cover 99% of block | frequency | block to cover 99% of block

FIG. 9-111

Species: DENV2 (11-mers)

| prot

Figure 10-2

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block |

Figure 10-4

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 73 | 0.11 | 6 | 2 | 0 | Y | KKSG

Figure 10-5

Species: DENV3 (8-mer)

| protein | block

Figure 10-6

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| prM | 126 | 0.25 | 3 | 2 | 0 | Y | MIVGKNER | 96.11 | MIVAKNER | 3.72 |
| prM | 127 | 0.25 | 3 | 2 | 0 | Y | IVGKNERG | 96.11 | IVAKNERG | 3.72 |
| prM | 128 | 0.27 | 4 | 2 | 0 | Y | VGKNERGK | 95.93 | VAKNERGK | 3.72 |
| prM | 129 | 0.29 | 5 | 1 | 0 | Y | GKNERGKS | 95.75 | AKNERGKS | 3.72 |
| prM | 130 | 0.09 | 5 | 1 | 0 | Y | KNERGKSL | 99.12 | | |
| prM | 131 | 0.09 | 5 | 1 | 0 | Y | NERGKSLL | 99.12 | | |
| prM | 132 | 0.07 | 4 | 1 | 0 | Y | ERGKSLLF | 99.29 | | |
| prM | 133 | 0.07 | 4 | 1 | 0 | Y | RGKSLLFK | 99.29 | | |
| prM | 134 | 0.07 | 4 | 1 | 0 | Y | GKSLLFKT | 99.29 | | |
| prM | 135 | 0.09 | 5 | 1 | 0 | Y | KSLLFKTA | 99.12 | | |
| prM | 136 | 0.17 | 5 | 2 | 0 | Y | SLLFKTAS | 98.05 | SLLFKTAT | 1.24 |
| prM | 137 | 0.15 | 4 | 2 | 0 | Y | LLFKTASG | 98.23 | LLFKTATG | 1.24 |
| prM | 138 | 0.17 | 5 | 2 | 0 | Y | LFKTASGI | 98.05 | LFKTATGI | 1.24 |
| prM | 139 | 0.13 | 4 | 2 | 0 | Y | FKTASGIN | 98.41 | FKTATGIN | 1.24 |
| prM | 140 | 0.13 | 4 | 2 | 0 | Y | KTASGINM | 98.41 | K

Figure 10-7

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequ

Figure 10-11

Species: DENV3 (8-mer)

| protein | block starting position | block entropy | total peptides in block | peptides required to cover 99% of block | gap/X fraction | 99% of block covered w/ <= 5 peptides? | peptides required to cover

Figure 10-12

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| prM | 274 | 0.17 | 2 | 2 | 0 | Y | LVTPSMTM | 97.52 | LVTPSMAM | 2.48 |
| prM | 275 | 0.17 | 2 | 2 | 0 | Y | VTPSMTMR | 97.52 | VTPSMAMR | 2.48 |
| prM | 276 | 0.17 | 2 | 2 | 0 | Y | TPSMTMRC | 97.52 | TPSMAMRC | 2.48 |
| prM | 277 | 0.17 | 2 | 2 | 0 | Y | PSMTMRCV | 97.52 | PSMAMRCV | 2.48 |
| prM | 278 | 0.17 | 2 | 2 | 0 | Y | SMTMRCVG | 97.52 | SMAMRCVG | 2.48 |
| prM | 279 | 0.22 | 3 | 2 | 0 | Y | MTMRCVGV | 96.99 | MAMRCVGV | 2.48 |
| prM | 280 | 0.22 | 3 | 2 | 0 | Y | TMRCVGVG | 96.99 | AMRCVGVG | 2.48 |
| E | 281 | 0.05 | 2 | 1 | 0 | Y | MRCVGVGN | 99.47 | | |
| E | 282 | 0.05 | 2 | 1 | 0 | Y | RCVGVGNR | 99.47 | | |
| E | 283 | 0.05 | 2 | 1 | 0 | Y | CVGVGNRD | 99.47 | | |
| E | 284 | 0.05 | 2 | 1 | 0 | Y | VGVGNRDF | 99.47 | | |
| E | 285 | 0.05 | 2 | 1 | 0 | Y | GVGNRDFV | 99.47 | | |
| E | 286 | 0.05 | 2 | 1 | 0 | Y | VGNRDFVE | 99.47 | | |
| E | 287 | 0 | 1 | 1 | 0 | Y | GNRDFVEG | 100 | | |
| E | 288 | 0 | 1 | 1 | 0 | Y | NRDFVEGL | 100 | | |
| E | 289 | 0 | 1 | 1 | 0 | Y | RDFVEGLS | 100 | | |
| E | 290 | 0 | 1 | 1 | 0 | Y | DFVEGLSG | 100 | | |
| E | 291 | 0 | 1 | 1 | 0 | Y | FVEGLSGA | 100 | | |
| E | 292 | 0 | 1 | 1 | 0 | Y | VEGLSGAT | 100 | | |
| E | 293 | 0 | 1 | 1 | 0 | Y | EGLSGATW | 100 | | |
| E | 294 | 0.03 | 2 | 1 | 0 | Y | GLSGATWV | 99.65 | | |
| E | 295 | 0.03 | 2 | 1 | 0 | Y | LSGATWVD | 99.65 | | |
| E | 296 | 0.03 | 2 | 1 | 0 | Y | SGATWVDV | 99.65 | | |
| E | 297 | 0.03 | 2 | 1 | 0 | Y | GATWVDVV | 99.65 | | |

Figure 10-15

Species: DENV3 (8-mer)

| protein | block starting position | block entropy | total

Figure 10-16

Species: DENV3 (8-mer)

| protein | block starting position | block entropy | total pe

Figure 10-17

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 394 | 0 | 1 | 1 | 0 | Y | VTCAKFQC | 100 | | | | | | |
| E | 395 | 0 | 1 | 1 | 0 | Y | TCAKFQC

Figure 10-18

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 420 | 0.17 | 4 | 2 | 0 | Y | IITVHTGD | 97.88 | | | | |
| E | 421 | 0.04 | 3 | 1 | 0 | Y | ITVHTGDQ | 99.65 | | | | |
| E | 422 | 0.06 | 4 | 1 | 0 | Y | TVHTGDQH | 99.47 | | | | |
| E | 423 | 0.06 | 4 | 1 | 0 | Y | VHTGDQHQ | 99.47 | | | | |
| E | 424 | 0.06 | 4 | 1 | 0 | Y | HTGDQHQV | 99.47 | | | | |
| E | 425 | 0.06 | 5 | 1 | 0 | Y | TGDQHQVG | 99.47 | | | | |
| E | 426 | 0.07 | 6 | 1 | 0 | Y | GDQHQVGN | 99.29 | TITVHTGD | 1.77 | | | |
| E | 427 | 0.89 | 6 | 2 | 0 | Y | DQHQVGNE | 73.98 | DQHQVGND | 25.31 | | | |
| E | 428 | 0.89 | 5 | 2 | 0 | Y | QHQVGNET | 73.81 | QHQVGNDT | 25.49 | | | |
| E | 429 | 0.88 | 4 | 2 | 0 | Y | HQVGNETQ | 73.81 | HQVGNDTQ | 25.66 | | | |
| E | 430 | 0.86 | 6 | 2 | 0 | Y | QVGNETQG | 73.81 | QVGNDTQG | 25.84 | | | |
| E | 431 | 0.89 | 7 | 3 | 0 | Y | VGNETQGV | 73.63 | VGNDTQGV | 25.66 | | | |
| E | 432 | 0.91 | 8 | 3 | 0 | Y | GNETQGVT | 73.45 | GNDTQGVT | 25.66 | | | |
| E | 433 | 0.94 | 7 | 3 | 0 | Y | NETQGVTA | 73.45 | NDTQGVTV | 25.31 | NDTQGVTA | 0.35 | | |
| E | 434 | 0.92 | 6 | 2 | 0 | Y | ETQGVTAE | 73.63 | DTQGVTVE | 25.31 | DTQGVTAE | 0.35 | | |
| E | 435 | 0.89 | 5 | 3 | 0 | Y | TQGVTAEI | 73.98 | TQGVTVEI | 25.31 | | | |
| E | 436 | 0.87 | 6 | 3 | 0 | Y | QGVTAEIT | 74.16 | QGVTVEIT | 25.31 | | | |
| E | 437 | 0.92 | 6 | 3 | 0 | Y | GVTAEITP | 73.63 | GVTVEITP | 25.31 | GVTAEITS | 0.53 | | |
| E | 438 | 0.92 | 6 | 3 | 0 | Y | VTAEITPQ | 73.63 | VTVEITPQ | 25.31 | VTAEITSQ | 0.53 | | |
| E | 439 | 0.88 | 4 | 2 | 0 | Y | TAEITPQA | 73.81 | TVEITPQA | 25.49 | | | |
| E | 440 | 0.86 | 3 | 2 | 0 | Y | AEITPQAS | 73.98 | VEITPQAS | 25.49 | | | |
| E | 441 | 0.1 | 3 | 2 | 0 | Y | EITPQASI | 98.94 | EITPQASI | 0.53 | | | |
| E | 442 | 1.13 | 7 | 4 | 0 | Y | ITPQASTT | 61.77 | ITPQASTV | 35.93 | ITPQASTA | 0.88 | ITSQASTA | 0.53 |
| E | 443 | 1.13 | 7 | 4 | 0 | Y | TPQASTTE | 61.77 | TPQASTVE | 35.93 | TPQASTAE | 0.88 | TPQASITE | 0.53 |

Figure 10-19

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 444 | 1.18 | 8 | 5 | 0 | Y | PQASTVEA | 61.24 | PQASTVEA | 35.93 | PQASTAEA | 0.88 | SQASTAEA | 0.53 | PQASTTEV | 0.53 |
| E | 445 | 1.51 | 8 | 5 | 0 | Y | QASTTEAI | 61.24 | QASTVEAV | 21.24 | QASTVEAI | 14.69 | QASTAEAI | 1.42 | QASTTEVI | 0.53 |
| E | 446 | 1.51 | 8 | 5 | 0 | Y | ASTTEAIL | 61.24 | ASTVEAVL | 21.24 | ASTVEAIL | 14.69 | ASTAEAIL | 1.42 | ASITEAIL | 0.53 |
| E | 449 | 1.48 | 8 | 5 | 0 | Y | TEAILPEY | 61.77 | VEAVLPEY | 21.06 | VEAILPEY | 14.69 | AEAILPEY | 1.42 | TEVILPEY | 0.53 |
| E | 450 | 0.82 | 5 | 2 | 0 | Y | EAILPEYG | 78.05 | EAVLPEYG | 21.06 | VILPEYGT | 0.53 | | | | |
| E | 451 | 0.86 | 7 | 3 | 0 | Y | AILPEYGT | 77.88 | AVLPEYGT | 20.88 | | | | | | |
| E | 452 | 0.81 | 6 | 2 | 0 | Y | ILPEYGTL | 78.41 | VLPEYGTL | 20.88 | | | | | | |
| E | 453 | 0.07 | 5 | 1 | 0 | Y | LPEYGTLG | 99.29 | | | | | | | | |
| E | 454 | 0.07 | 5 | 1 | 0 | Y | PEYGTLGL | 99.29 | | | | | | | | |
| E | 455 | 0.07 | 5 | 1 | 0 | Y | EYGTLGLE | 99.29 | | | | | | | | |
| E | 456 | 0.07 | 5 | 1 | 0 | Y | YGTLGLEC | 99.29 | | | | | | | | |
| E | 457 | 0.07 | 5 | 1 | 0 | Y | GTLGLECS | 99.29 | | | | | | | | |
| E | 458 | 0.07 | 5 | 1 | 0 | Y | TLGLECSP | 99.65 | | | | | | | | |
| E | 459 | 0.04 | 3 | 1 | 0 | Y | LGLECSPR | 99.47 | | | | | | | | |
| E | 460 | 0.06 | 4 | 1 | 0 | Y | GLECSPRT | 99.65 | | | | | | | | |
| E | 461 | 0.04 | 3 | 1 | 0 | Y | LECSPRTG | 99.65 | | | | | | | | |
| E | 462 | 0.04 | 3 | 1 | 0 | Y | ECSPRTGL | 99.82 | | | | | | | | |
| E | 463 | 0.02 | 2 | 1 | 0 | Y | CSPRTGLD | 99.82 | | | | | | | | |
| E | 464 | 0.02 | 2 | 1 | 0 | Y | SPRTGLDF | 99.65 | | | | | | | | |
| E | 465 | 0.04 | 3 | 1 | 0 | Y | PRTGLDFN | 99.65 | | | | | | | | |
| E | 466 | 0.04 | 3 | 1 | 0 | Y | RTGLDFNE | 99.65 | | | | | | | | |
| E | 467 | 0.04 | 3 | 1 | 0 | Y | TGLDFNEM | 99.65 | | | | | | | | |
| E | 468 | 0.04 | 3 | 1 | 0 | Y | GLDFNEMI | 99.65 | | | | | | | | |
| E | 469 | 0.04 | 3 | 1 | 0.71 | Y | LDFNEMIL | 98.94 | | | | | | | | |

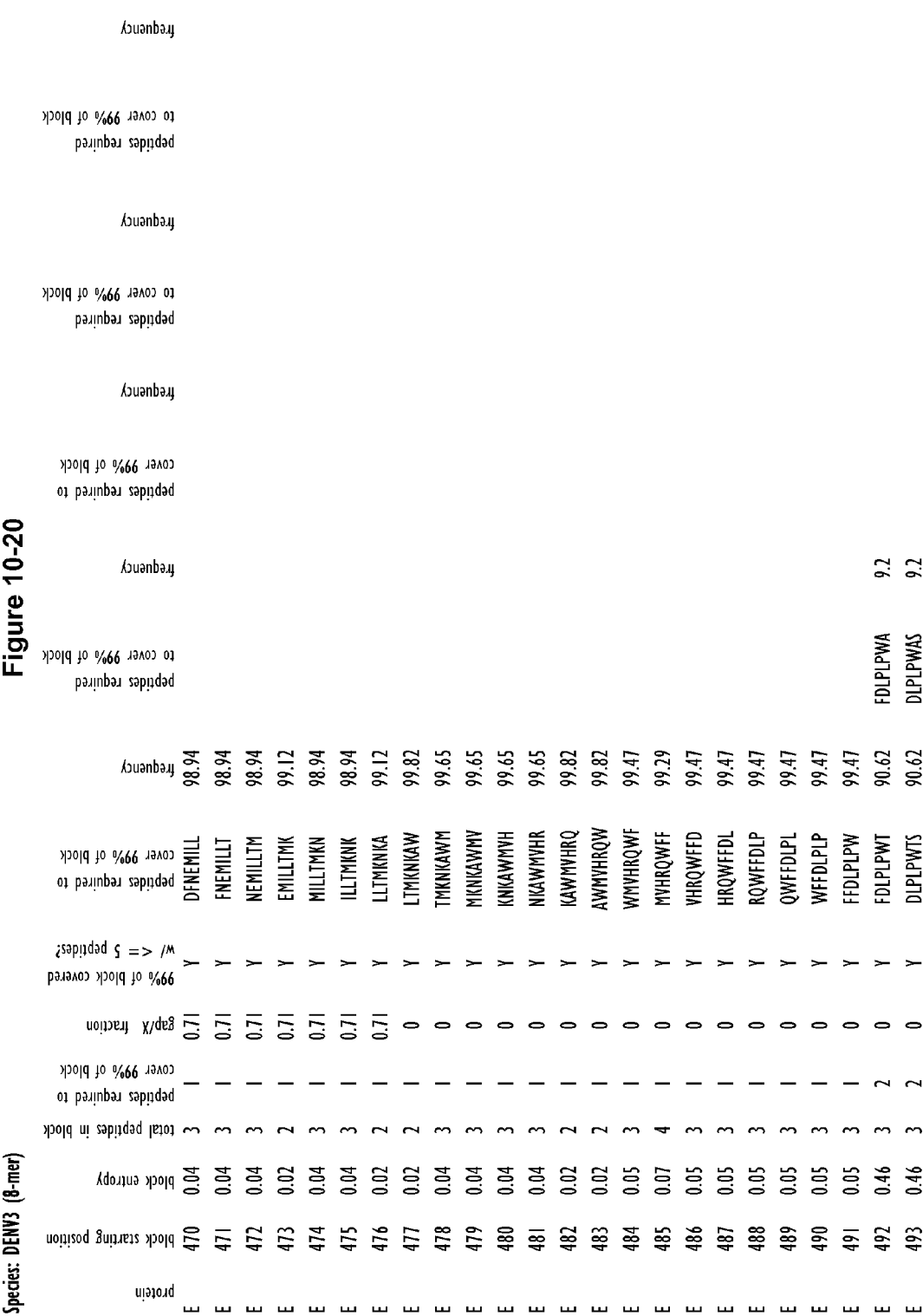

Figure 10-21

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 494 | 0.46 | 3 | 2 | 0 | Y | LPLPWTSG | 90.62 | LPLPWASG | 9.2 | | | | |
| E | 495 | 0.56 | 5 | 3 | 0 | Y | PLPWTSGA | 89.56 | PLPWASGA | 9.2 | | | | |
| E | 496 | 0.59 | 6 | 4 | 0 | Y | LPWTSGAT | 89.2 | LPWASGAT | 9.2 | | | | |
| E | 497 | 0.67 | 8 | 5 | 0 | Y | PWTSGATT | 88.32 | PWASGATA | 9.2 | PLPWTSGV | 0.53 | | | |
| E | 503 | 0.25 | 9 | 5 | 0 | Y | TTETPTWN | 97.35 | TAETPTWN | 0.71 | LPWTSGVT | 0.53 | LPWTSGTT | 0.53 | |
| E | 504 | 0.69 | 9 | 5 | 0 | Y | TETPTWNR | 87.43 | TETPTWNK | 10.27 | PWTSGATA | 0.71 | PWTSGTTT | 0.53 | PWTSGVTT | 0.53 |
| E | 505 | 0.61 | 7 | 3 | 0 | Y | ETPTWNRK | 88.32 | ETPTWNKK | 10.27 | TTETPTWN | 0.53 | TTKTPTWN | 0.35 | ITETPTWN | 0.35 |
| E | 506 | 0.56 | 5 | 2 | 0 | Y | TPTWNRKE | 88.85 | TPTWNKKE | 10.27 | AETPTWNR | 0.71 | TETPTWNR | 0.53 | TKTPTWNR | 0.35 |
| E | 507 | 0.54 | 4 | 2 | 0 | Y | PTWNRKEL | 89.03 | PTWNKKEL | 10.27 | ETPTWNRK | 0.53 | TETPIWNR | 0.53 | |
| E | 508 | 0.54 | 4 | 2 | 0 | Y | TWNRKELL | 89.03 | TWNKKELL | 10.27 | | | | | |
| E | 509 | 0.51 | 4 | 2 | 0 | Y | WNRKELLV | 89.38 | WNKKELLV | 10.27 | | | | | |
| E | 510 | 0.51 | 3 | 2 | 0 | Y | NRKELLVT | 89.38 | NKKELLVT | 10.27 | | | | | |
| E | 511 | 0.5 | 3 | 2 | 0 | Y | RKELLVTF | 89.56 | KKELLVTF | 10.27 | | | | | |
| E | 512 | 0.04 | 3 | 1 | 0 | Y | KELLVTFK | 99.65 | | | | | | | |
| E | 513 | 0.04 | 3 | 1 | 0 | Y | ELLVTFKN | 99.65 | | | | | | | |
| E | 514 | 0.04 | 3 | 1 | 0 | Y | LLVTFKNA | 99.65 | | | | | | | |
| E | 515 | 0.04 | 3 | 1 | 0 | Y | LVTFKNAH | 99.65 | | | | | | | |
| E | 516 | 0.04 | 3 | 1 | 0 | Y | VTFKNAHA | 99.65 | | | | | | | |
| E | 517 | 0.02 | 2 | 1 | 0 | Y | TFKNAHAK | 99.82 | | | | | | | |
| E | 518 | 0.02 | 2 | 1 | 0 | Y | FKNAHAKK | 99.82 | | | | | | | |
| E | 519 | 0.02 | 2 | 1 | 0 | Y | KNAHAKKQ | 99.82 | | | | | | | |
| E | 520 | 0 | 1 | 1 | 0 | Y | NAHAKKQE | 100 | | | | | | | |
| E | 521 | 0 | 1 | 1 | 0 | Y | AHAKKQEV | 100 | | | | | | | |
| E | 522 | 0 | 1 | 1 | 0 | Y | HAKKQEVV | 100 | | | | | | | |

Figure 10-22

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 523 | 0 | 1 | 1 | 0 | Y | AKK

Figure 10-23

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 547 | 0.55 | 5 | 2 | 0 | Y | EIQNSGGT | 88.5 | EIQTSGGT | 10.97 | | | | |
| E | 548 | 0.63 | 7 | 3 | 0 | Y | IQNSGGTS | 87.61 | IQTSGGTS | 10.97 | IQNSGGTN | 0.53 | | |
| E | 549 | 0.63 | 7 | 3 | 0 | Y | QNSGGTSI | 87.79 | QTSGGTSI | 10.8 | QNSGGTNI | 0.53 | | |
| E | 550 | 0.63 | 7 | 3 | 0 | Y | NSGGTSIF | 87.79 | TSGGTSIF | 10.8 | NSGGTNIF | 0.53 | | |
| E | 551 | 0.17 | 6 | 3 | 0 | Y | SGGTSIFA | 98.23 | SGGTNIFA | 0.53 | SGGTTIFA | 0.35 | | |
| E | 552 | 0.13 | 5 | 2 | 0 | Y | GGTSIFAG | 98.58 | GGTNIFAG | 0.53 | | | | |
| E | 553 | 0.13 | 5 | 2 | 0 | Y | GTSIFAGH | 98.58 | GTNIFAGH | 0.53 | | | | |
| E | 554 | 0.13 | 5 | 2 | 0 | Y | TSIFAGHL | 98.58 | TNIFAGHL | 0.53 | | | | |
| E | 555 | 0.13 | 5 | 2 | 0 | Y | SIFAGHLK | 98.58 | NIFAGHLK | 0.53 | | | | |
| E | 556 | 0.05 | 3 | 1 | 0 | Y | IFAGHLKC | 99.47 | | | | | | |
| E | 557 | 0.03 | 2 | 1 | 0 | Y | FAGHLKCR | 99.65 | | | | | | |
| E | 558 | 0.03 | 2 | 1 | 0 | Y | AGHLKCRL | 99.65 | | | | | | |
| E | 559 | 0 | 1 | 1 | 0 | Y | GHLKCRLK | 100 | | | | | | |
| E | 560 | 0 | 1 | 1 | 0 | Y | HLKCRLKM | 100 | | | | | | |
| E | 561 | 0 | 1 | 1 | 0 | Y | LKCRLKMD | 100 | | | | | | |
| E | 562 | 0.02 | 2 | 1 | 0 | Y | KCRLKMDK | 99.82 | | | | | | |
| E | 563 | 0.02 | 2 | 1 | 0 | Y | CRLKMDKL | 99.82 | | | | | | |
| E | 564 | 0.07 | 4 | 1 | 0 | Y | RLKMDKLE | 99.29 | | | | | | |
| E | 565 | 0.07 | 4 | 1 | 0 | Y | LKMDKLEL | 99.29 | | | | | | |
| E | 566 | 0.07 | 4 | 1 | 0 | Y | KMDKLELK | 99.29 | | | | | | |
| E | 567 | 0.07 | 4 | 1 | 0 | Y | MDKLELKG | 99.29 | | | | | | |
| E | 568 | 0.07 | 4 | 1 | 0 | Y | DKLELKGM | 99.29 | | | | | | |
| E | 569 | 0.07 | 4 | 1 | 0 | Y | KLELKGMS | 99.29 | | | | | | |
| E | 570 | 0.05 | 3 | 1 | 0 | Y | LELKGMSY | 99.47 | | | | | | |

Figure 10-24

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 571 | 0.05 | 3 | 1 | 0 | Y | ELKGMSY

Figure 10-25

Species: DENV3 (8-mer)

| protein | block starting position | block entropy | total peptides in block | peptides required to cover 99% of block | gap/X fraction | 99% of block covered w/ <= 5 peptides?

Figure 10-26

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides

Figure 10-27

Species: DENV3 (8-mer)

| protein | block starting position | block entropy | total peptides in block | peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---

Figure 10-28

Species: DENV3 (8-mer)

| protein | block starting position | block entropy | total

Figure 10-29

Species: DENV3 (8-mer)

| protein | block starting position | block entropy | total peptides in block | peptides required to cover 99% of block | gap/X

Figure 10-30

Species: DENV3 (8-mer)

| protein | block starting position | block entropy | total peptides in block | peptides required to cover 99% of block | gap/X fraction | 99% of block covered w/ <= 5 peptides? | peptides required to cover

Figure 10-31

Species: DENV3 (

Figure 10-32

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 770 | 0.47 | 3 | 2 | 0 | Y | VQADMGC | 91.15 | VQADTGC | 8.14 | | | | |
| E | 771 | 0.8 | 4 | 3 | 0 | Y | VQADMGCV | 84.78 | VQADTGCV | 8.14 | VQADMGCA | 6.37 | | |
| E | 772 | 0.88 | 6 | 4 | 0 | Y | QADMGCVI | 83.89 | QADTGCVI | 7.96 | QADMGCAI | 6.37 | Q

Figure 10-33

Species: DENV3 (8-mer)

| protein | block starting position | block entropy | total

Figure 10-35

Species: DENV3 (8

Figure 10-36

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 871 | 0.15 | 6 | 2 | 0 | Y | EQGKRTLT | 98.41 | EQGKRALT | 0.71 | QGKRTLTL | 0.35 | | |
| NS1 | 872 | 0.18 | 7 | 3 | 0 | Y | QGKRTLTP | 98.05 | QGKRALTP | 0.71 | GKRTLTLQ | 0.35 | | |
| NS1 | 873 | 0.18 | 7 | 3 | 0 | Y | GKRTLTPQ | 98.05 | GKRALTPQ | 0.71 | KRTLTLQP | 0.35 | | |
| NS1 | 874 | 0.18 | 7 | 3 | 0 | Y | KRTLTPQP | 98.05 | KRALTPQP | 0.71 | RTLTLQPM | 0.35 | RTLTLQPM | 0.35 |
| NS1 | 875 | 0.2 | 8 | 4 | 0 | Y | RTLTPQPM | 97.88 | RALTPQPM | 0.71 | RILTLQPM | 0.35 | RILTLQPM | 0.35 |
| NS1 | 876 | 0.22 | 9 | 4 | 0 | Y | TLTPQPME | 97.7 | ALTPQPME | 0.71 | TLTLQPME | 0.35 | ILTPQPME | 0.35 |
| NS1 | 877 | 0.13 | 7 | 2 | 0 | Y | LTPQPMEL | 98.76 | LTLQPMEL | 0.71 | | | | |
| NS1 | 878 | 0.15 | 8 | 3 | 0 | Y | TPQPMELK | 98.58 | TLQPMELK | 0.35 | IPQPMELK | 0.18 | | |
| NS1 | 879 | 0.09 | 5 | 1 | 0 | Y | PQPMELKY | 99.12 | | | | | | |
| NS1 | 880 | 0.06 | 4 | 1 | 0 | Y | QPMELKYS | 99.47 | | | | | | |
| NS1 | 881 | 0.06 | 4 | 1 | 0 | Y | PMELKYSW | 99.47 | | | | | | |
| NS1 | 882 | 0.06 | 4 | 1 | 0 | Y | MELKYSWK | 99.47 | | | | | | |
| NS1 | 883 | 0.12 | 5 | 2 | 0 | Y | ELKYSWKT | 98.76 | ELKYSWKA | 0.71 | | | | |
| NS1 | 884 | 0.1 | 4 | 2 | 0 | Y | LKYSWKTW | 98.94 | LKYSWKAW | 0.71 | | | | |
| NS1 | 885 | 0.1 | 4 | 2 | 0 | Y | KYSWKTWG | 98.94 | KYSWKAWG | 0.71 | | | | |
| NS1 | 886 | 0.1 | 4 | 2 | 0 | Y | YSWKTWGK | 98.94 | YSWKAWGK | 0.71 | | | | |
| NS1 | 887 | 0.12 | 5 | 3 | 0 | Y | SWKTWGKA | 98.76 | SWKAWGKA | 0.71 | WKAWGKAK | 0.71 | | |
| NS1 | 888 | 0.27 | 6 | 5 | 0 | Y | WKTWGKAK | 96.46 | WKTWGKAR | 2.3 | KAWGKAKI | 0.71 | | |
| NS1 | 889 | 0.38 | 8 | 5 | 0 | Y | KTWGKAKI | 95.22 | KTWGKARI | 2.3 | TWGKAKIV | 1.59 | KTWGKAKV | 0.71 | KTWGKAKM | 0.53 |
| NS1 | 890 | 0.4 | 9 | 5 | 0 | Y | TWGKAKIV | 95.04 | TWGKARIV | 2.3 | WGKAKIVT | 1.59 | AWGKAKIV | 0.71 | TWGKAKMV | 0.53 |
| NS1 | 891 | 0.46 | 9 | 5 | 0 | Y | WGKAKIVT | 94.16 | WGKARIVT | 2.3 | GKAKIVTA | 1.59 | WGKAKIVT | 0.71 | WGKAKMVT | 0.53 |
| NS1 | 892 | 0.46 | 10 | 5 | 0 | Y | GKAKIVTA | 94.16 | GKARIVTA | 2.3 | KAKIVTAE | 1.59 | GKAKIVTA | 0.71 | GKAKMVTA | 0.53 |
| NS1 | 893 | 0.48 | 9 | 5 | 0 | Y | KAKIVTAE | 93.98 | KARIVTAE | 2.3 | AETQNSSF | 0.53 | KAKIVTAE | 0.71 | KAKMVTAE | 0.53 |
| NS1 | 894 | 0.57 | 9 | 4 | 0 | Y | AETQNSSF | 90.09 | AETQNSSF | 8.32 | | | AEIQNSSF | 0.18 | | |

Figure 10-37

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to c

Figure 10-38

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to

Figure 10-39

Species: DENV3 (8-mer)

| protein | block starting position | block entropy | total peptides in block | peptides required to cover 99% of block | gap/X fraction | 99% of block

Figure 10-40

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|

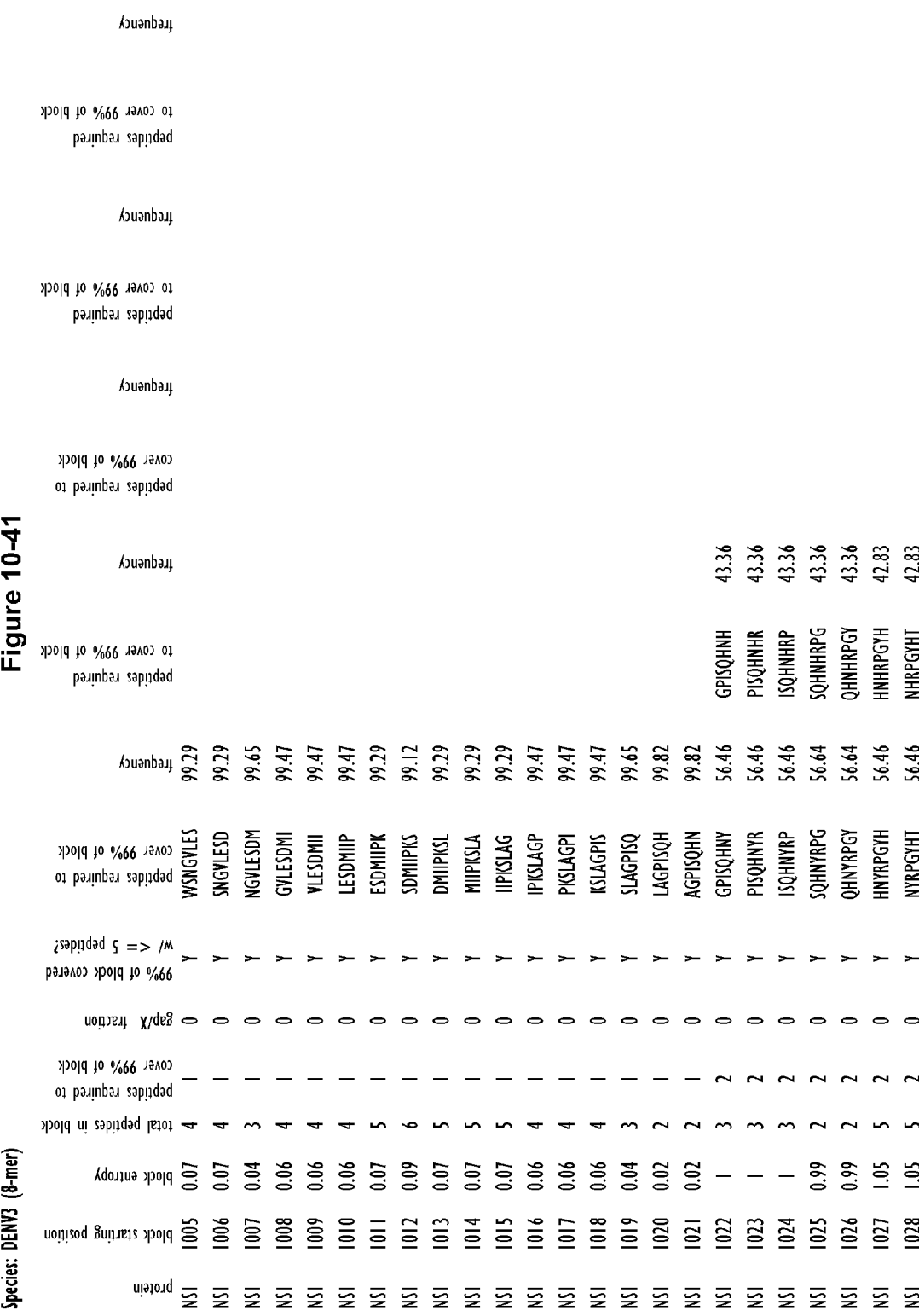

Figure 10-42

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 1029 | 1.05 | 5 | 2 | 0 | Y | YRPGYHTQ | 56.46 | HRPGYHTQ | 42.83 |
| NS1 | 1030 | 0.07 | 3 | 1 | 0 | Y | RPGYHTQT | 99.29 | | |
| NS1 | 1031 | 0.09 | 4 | 1 | 0 | Y | PGYHTQTA | 99.12 | | |
| NS1 | 1032 | 0.09 | 4 | 1 | 0 | Y | GYHTQTAG | 99.12 | | |
| NS1 | 1033 | 0.1 | 5 | 2 | 0 | Y | YHTQTAGP | 98.94 | YYTQTAGP | 0.53 |
| NS1 | 1034 | 0.1 | 5 | 2 | 0 | Y | HTQTAGPW | 98.94 | YTQTAGPW | 0.53 |
| NS1 | 1035 | 0.04 | 3 | 1 | 0 | Y | TQTAGPWH | 99.65 | | |
| NS1 | 1036 | 0.04 | 3 | 1 | 0 | Y | QTAGPWHL | 99.65 | | |
| NS1 | 1037 | 0.04 | 3 | 1 | 0 | Y | TAGPWHLG | 99.65 | | |
| NS1 | 1038 | 0.04 | 3 | 1 | 0 | Y | AGPWHLGK | 99.82 | | |
| NS1 | 1039 | 0.02 | 2 | 1 | 0 | Y | GPWHLGKL | 99.12 | | |
| NS1 | 1040 | 0.08 | 3 | 1 | 0 | Y | PWHLGKLE | 99.29 | | |
| NS1 | 1041 | 0.06 | 2 | 1 | 0 | Y | WHLGKLEL | 99.29 | | |
| NS1 | 1042 | 0.06 | 2 | 1 | 0 | Y | HLGKLELD | 99.29 | | |
| NS1 | 1043 | 0.06 | 2 | 1 | 0 | Y | LGKLELDF | 99.12 | | |
| NS1 | 1044 | 0.08 | 3 | 1 | 0 | Y | GKLELDFN | 99.12 | | |
| NS1 | 1045 | 0.08 | 3 | 1 | 0 | Y | KLELDFNY | 99.12 | | |
| NS1 | 1046 | 0.08 | 3 | 1 | 0 | Y | LELDFNYC | 99.12 | | |
| NS1 | 1047 | 0.08 | 3 | 1 | 0 | Y | ELDFNYCE | 99.12 | | |
| NS1 | 1048 | 0.02 | 2 | 1 | 0 | Y | LDFNYCEG | 99.82 | | |
| NS1 | 1049 | 0.02 | 2 | 1 | 0 | Y | DFNYCEGT | 99.82 | | |
| NS1 | 1050 | 0.02 | 2 | 1 | 0 | Y | FNYCEGTT | 99.82 | | |
| NS1 | 1051 | 0.02 | 2 | 1 | 0 | Y | NYCEGTTV | 99.82 | | |
| NS1 | 1052 | 0 | 1 | 1 | 0 | Y | YCEGTTVV | 100 | | |

Figure 10-43

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1053 | 0 | 1 | — | 0 | Y | CEGTTWI | 100 | | | | | | |
| NS1 | 1054 | 0.29 | 3 | 3 | 0 | Y | EGTTWIT | 95.75 | EGTTWIA | 3.01 | EGTTWIS | 1.24 | | |
| NS1 | 1055 | 0.32 | 4 | 3 | 0 | Y | GTTWITE | 95.4 | GTTWIAE | 3.01 | GTTWISE | 1.24 | | |
| NS1 | 1056 | 0.92 | 6 | 5 | 0 | Y | TTWITEN | 83.89 | TTWITES | 8.67 | TTWIAEN | 3.01 | TTWITED | 2.83 | TTWISEN | 1.24 |
| NS1 | 1057 | 0.92 | 6 | 5 | 0 | Y | TWITENC | 83.89 | TWITESC | 8.67 | TWIAENC | 3.01 | TWITEDC | 2.83 | TWISENC | 1.24 |
| NS1 | 1058 | 0.92 | 6 | 5 | 0 | Y | WITENCG | 83.89 | WITESCG | 8.67 | WIAENCG | 3.01 | WITEDCG | 2.83 | WISENCG | 1.24 |
| NS1 | 1059 | 0.96 | 8 | 5 | 0 | Y | VITENCGT | 83.54 | VITESCGT | 8.67 | VIAENCGT | 3.01 | VITEDCGT | 2.83 | VISENCGT | 1.24 |
| NS1 | 1064 | 0.15 | 9 | 4 | 0 | Y | CGTRGPSL | 98.58 | CGTKGPSL | 0.18 | CGTRGPAL | 0.18 | CGTGGPSL | 0.18 | |
| NS1 | 1065 | 0.15 | 9 | 4 | 0 | Y | GTRGPSLR | 98.58 | GTSGPSLI | 0.18 | GMRGPSLR | 0.18 | GTGGPSLR | 0.18 | |
| NS1 | 1066 | 0.17 | 10 | 5 | 0 | Y | TRGPSLRT | 98.41 | TRGSSLRT | 0.18 | TRRPSLRT | 0.18 | TRGPALRT | 0.18 | |
| NS1 | 1067 | 0.13 | 8 | 3 | 0 | Y | RGPSLRTT | 98.76 | SGPSLRTT | 0.18 | RGPSLRAT | 0.18 | | | IRGPSLRT | 0.18 |
| NS1 | 1068 | 0.09 | 6 | 1 | 0 | Y | GPSLRTTT | 99.12 | | | | | | |
| NS1 | 1069 | 0.07 | 5 | 1 | 0 | Y | PSLRTTTV | 99.29 | | | | | | |
| NS1 | 1070 | 0.06 | 4 | 1 | 0 | Y | SLRTTTVS | 99.47 | | | | | | |
| NS1 | 1071 | 0.04 | 3 | 1 | 0 | Y | LRTTTVSG | 99.65 | | | | | | |
| NS1 | 1072 | 0.04 | 3 | 1 | 0 | Y | RTTTVSGK | 99.65 | | | | | | |
| NS1 | 1073 | 0.02 | 2 | 1 | 0 | Y | TTTVSGKL | 99.82 | | | | | | |
| NS1 | 1074 | 0 | 1 | — | 0 | Y | TTVSGKLI | 100 | | | | | | |
| NS1 | 1075 | 0 | 1 | — | 0 | Y | TVSGKLIH | 100 | | | | | | |
| NS1 | 1076 | 0 | 1 | — | 0 | Y | VSGKLIHE | 100 | | | | | | |
| NS1 | 1077 | 0 | 1 | — | 0 | Y | SGKLIHEW | 100 | | | | | | |
| NS1 | 1078 | 0 | 1 | — | 0 | Y | GKLIHEWC | 100 | | | | | | |
| NS1 | 1079 | 0 | 1 | — | 0 | Y | KLIHEWCC | 100 | | | | | | |
| NS1 | 1080 | 0 | 1 | — | 0 | Y | LIHEWCCR | 100 | | | | | | |

Figure 10-45

Species: DENV3 (8

Figure 10-46

Species: DENV3 (8-mer)

| protein | block starting position | block entropy | total

Figure 10-47

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1153 | 0.2 | 4 | 2 | 0 | Y | GKKHMIAG | 97.17 | GKKHMIVG | 2.48 | | | | |
| NS2A | 1154 | 0.4 | 6 | 4 | 0 | Y | KKHMIAGV | 94.51 | KKHMIVGV | 2.48 | KKHMIAGA | 1.95 | KKHMIAGI | 0.71 | |
| NS2A | 1163 | 0.33 | 8 | 4 | 0 | Y | FTFVLLLS | 95.93 | FMFVLLLS | 1.77 | LTFVLLLS | 1.24 | FIFVLLLS | 0.35 | |
| NS2A | 1164 | 0.24 | 7 | 3 | 0 | Y | TFVLLLSG | 97.17 | MFVLLLSG | 1.77 | IFVLLLSG | 0.35 | | |
| NS2A | 1165 | 0.07 | 5 | 1 | 0 | Y | FVLLLSGQ | 99.29 | | | | | | |
| NS2A | 1166 | 0.07 | 5 | 1 | 0 | Y | VLLLSGQI | 99.29 | | | | | | |
| NS2A | 1167 | 0.06 | 5 | 1 | 0 | Y | LLLSGQIT | 99.47 | | | | | | |
| NS2A | 1168 | 0.06 | 4 | 1 | 0 | Y | LLSGQITW | 99.47 | | | | | | |
| NS2A | 1169 | 0.07 | 5 | 1 | 0 | Y | LSGQITWR | 99.29 | | | | | | |
| NS2A | 1170 | 0.09 | 6 | 1 | 0 | Y | SGQITWRD | 99.12 | | | | | | |
| NS2A | 1171 | 0.13 | 7 | 2 | 0 | Y | GQITWRDM | 98.76 | GQITWRDL | 0.35 | QITWRDLA | 0.35 | | |
| NS2A | 1172 | 0.42 | 8 | 3 | 0 | Y | QITWRDMA | 93.63 | QITWRDMT | 5.13 | DMTHTLIM | 5.13 | DMAHTFIM | 2.12 | |
| NS2A | 1177 | 0.91 | 9 | 5 | 0 | Y | DMAHTLIM | 84.78 | DMARTLIM | 6.73 | THTLIMIG | 6.73 | AHTFIMIG | 2.12 | DLAHTLIM | 0.35 |
| NS2A | 1179 | 0.87 | 7 | 4 | 0 | Y | AHTLIMIG | 85.13 | ARTLIMIG | 6.73 | HTFIMIGS | 2.12 | | |
| NS2A | 1180 | 0.59 | 6 | 3 | 0 | Y | HTLIMIGS | 90.27 | RTLIMIGS | 6.73 | | | | |
| NS2A | 1181 | 0.22 | 4 | 2 | 0 | Y | TLIMIGSN | 96.99 | TFIMIGSN | 2.48 | | | | |
| NS2A | 1182 | 0.27 | 5 | 3 | 0 | Y | LIMIGSNA | 96.46 | FIMIGSNA | 2.48 | LIMIGSNT | 0.53 | | |
| NS2A | 1183 | 0.23 | 5 | 3 | 0 | Y | IMIGSNAS | 97.17 | IMIGSNAT | 1.77 | IMIGSNTS | 0.53 | | |
| NS2A | 1184 | 0.23 | 5 | 3 | 0 | Y | MIGSNASD | 97.17 | MIGSNATD | 1.77 | MIGNTSD | 0.53 | | |
| NS2A | 1185 | 0.36 | 6 | 4 | 0 | Y | IGSNASDR | 95.4 | IGSNATDR | 1.77 | IGSNASDK | 1.77 | IGSNTSDR | 0.53 | |
| NS2A | 1186 | 0.34 | 6 | 3 | 0 | Y | GSNASDRM | 95.58 | GSNATDRM | 1.77 | GSNASDKM | 1.77 | | |
| NS2A | 1187 | 0.34 | 6 | 3 | 0 | Y | SNASDRMG | 95.58 | SNASDKMG | 1.77 | SNATDRMG | 1.77 | | |
| NS2A | 1188 | 0.34 | 6 | 3 | 0 | Y | NASDRMGM | 95.58 | NASDKMGM | 1.77 | NATDRMGM | 1.77 | | |
| NS2A | 1189 | 0.32 | 5 | 3 | 0 | Y | ASDRMGMG | 95.75 | ATDRMGMG | 1.77 | ASDKMGMG | 1.77 | | |

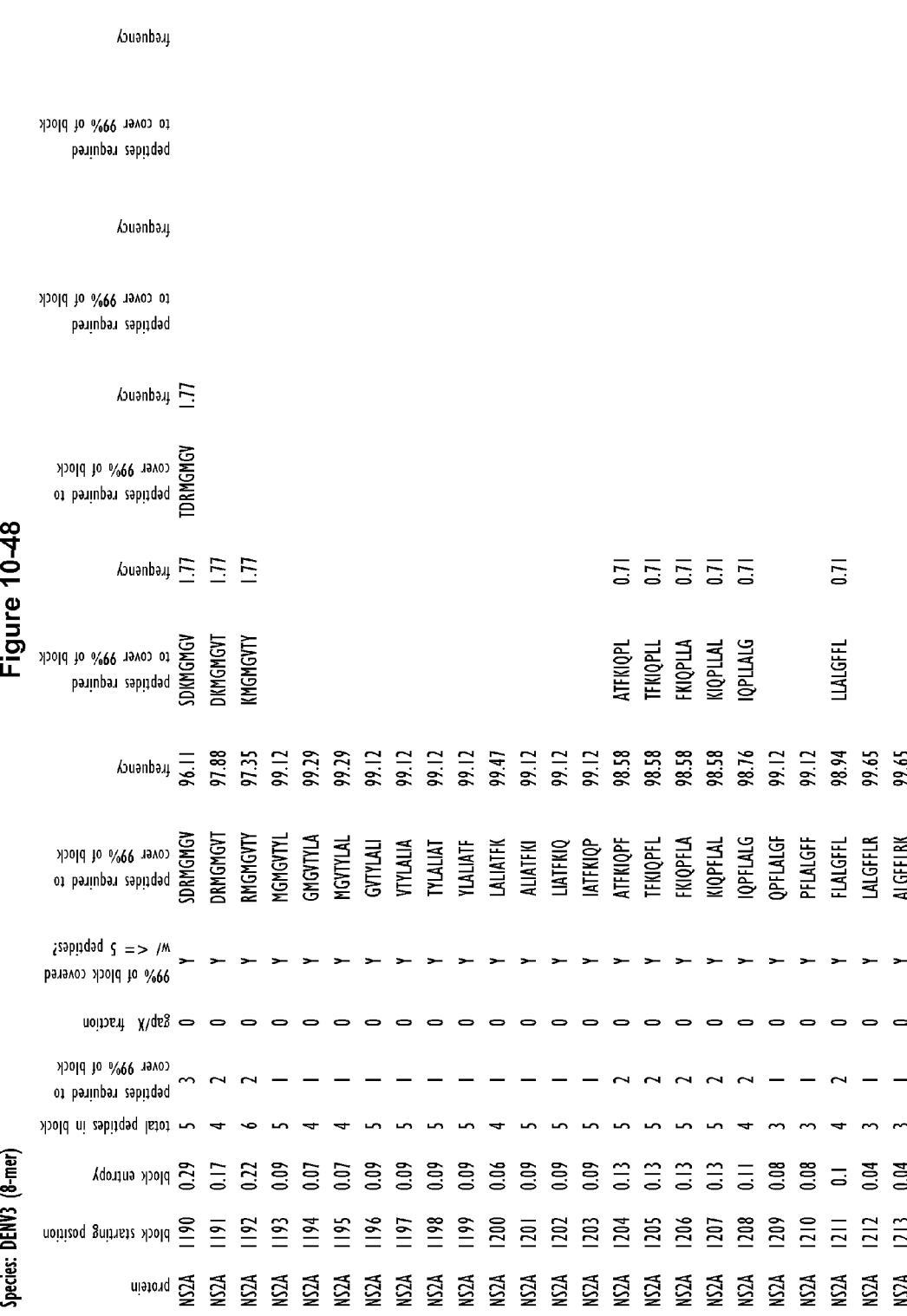

Figure 10-49

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1214 | 0.02 | 2 | 1 | 0 | Y | LGFFLRKL | 99.82 | | | | | | |
| NS2A | 1215 | 0.02 | 2 | 1 | 0 | Y | GFFLRKLT | 99.82 | | | | | | |
| NS2A | 1216 | 0.02 | 2 | 1 | 0 | Y | FFLRKLTS | 99.82 | | | | | | |
| NS2A | 1217 | 0.02 | 2 | 1 | 0 | Y | FLRKLTSR | 99.82 | | | | | | |
| NS2A | 1218 | 0.02 | 2 | 1 | 0 | Y | LRKLTSRE | 99.82 | | | | | | |
| NS2A | 1219 | 0 | 1 | 1 | 0 | Y | RKLTSREN | 100 | | | | | | |
| NS2A | 1220 | 0.02 | 2 | 1 | 0 | Y | KLTSRENL | 99.82 | | | | | | |
| NS2A | 1221 | 0.02 | 2 | 1 | 0 | Y | LTSRENLL | 99.82 | | | | | | |
| NS2A | 1222 | 0.02 | 2 | 1 | 0 | Y | TSRENLLL | 99.82 | | | | | | |
| NS2A | 1223 | 0.02 | 2 | 1 | 0 | Y | SRENLLLG | 99.82 | | | | | | |
| NS2A | 1224 | 0.02 | 2 | 1 | 0 | Y | RENLLLGV | 99.82 | | | | | | |
| NS2A | 1225 | 0.02 | 2 | 1 | 0 | Y | ENLLLGVG | 99.82 | | | | | | |
| NS2A | 1226 | 0.02 | 2 | 1 | 0 | Y | NLLLGVGL | 99.82 | | | | | | |
| NS2A | 1227 | 0.02 | 2 | 1 | 0 | Y | LLLGVGLA | 99.82 | | | | | | |
| NS2A | 1228 | 0 | 1 | 1 | 0 | Y | LLGVGLAM | 100 | | | | | | |
| NS2A | 1229 | 0.03 | 2 | 1 | 0 | Y | LGVGLAMA | 99.65 | | | | | | |
| NS2A | 1230 | 0.14 | 3 | 2 | 0 | Y | GVGLAMAT | 98.23 | GVGLAMAA | 1.42 | | | | |
| NS2A | 1231 | 0.16 | 4 | 2 | 0 | Y | VGLAMATT | 98.05 | VGLAMAAT | 1.42 | | | | |
| NS2A | 1232 | 0.18 | 5 | 2 | 0 | Y | GLAMATTL | 97.88 | GLAMAATL | 1.42 | | | | |
| NS2A | 1233 | 0.19 | 6 | 2 | 0 | Y | LAMATTLQ | 97.88 | LAMAATLR | 1.24 | | | | |
| NS2A | 1234 | 0.19 | 6 | 2 | 0 | Y | AMATTLQL | 97.88 | AMAATLRL | 1.24 | | | | |
| NS2A | 1235 | 0.19 | 6 | 2 | 0 | Y | MATTLQLP | 97.88 | MAATLRLP | 1.24 | | | | |
| NS2A | 1236 | 0.22 | 7 | 3 | 0 | Y | ATTLQLPE | 97.52 | AATLRLPE | 1.24 | TTTLQLPE | 0.35 | | |
| NS2A | 1237 | 0.19 | 6 | 2 | 0 | Y | TTLQLPED | 97.88 | ATLRLPED | 1.24 | | | | |

Figure 10-50

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS2A | 1238 | 0.2 | 7 | 3 | 0 | Y | TLQLPEDI | 97.7 | TLRLPEDI | 1.24 | TLQLPADI | 0.35 |
| NS2A | 1239 | 0.19 | 6 | 2 | 0 | Y | LQLPEDIE | 97.88 | LRLPEDIE | 1.24 | | |
| NS2A | 1240 | 0.17 | 5 | 2 | 0 | Y | QLPEDIEQ | 98.05 | RLPEDIEQ | 1.24 | | |
| NS2A | 1241 | 0.07 | 4 | 1 | 0 | Y | LPEDIEQM | 99.29 | | | | |
| NS2A | 1242 | 0.07 | 4 | 1 | 0 | Y | PEDIEQMA | 99.29 | | | | |
| NS2A | 1243 | 0.07 | 4 | 1 | 0 | Y | EDIEQMAN | 99.29 | | | | |
| NS2A | 1244 | 0.04 | 3 | 1 | 0 | Y | DIEQMANG | 99.65 | | | | |
| NS2A | 1245 | 0.09 | 4 | 1 | 0 | Y | IEQMANGI | 99.12 | | | | |
| NS2A | 1246 | 0.05 | 2 | 1 | 0 | Y | EQMANGIA | 99.47 | | | | |
| NS2A | 1247 | 0.05 | 2 | 1 | 0 | Y | QMANGIAL | 99.47 | | | | |
| NS2A | 1248 | 0.05 | 2 | 1 | 0 | Y | MANGIALG | 99.47 | | | | |
| NS2A | 1249 | 0.05 | 2 | 1 | 0 | Y | ANGIALGL | 99.47 | | | | |
| NS2A | 1250 | 0.05 | 2 | 1 | 0 | Y | NGIALGLM | 99.47 | | | | |
| NS2A | 1251 | 0.87 | 4 | 2 | 0 | Y | GIALGLMA | 74.87 | GIALGLMT | 24.42 | | |
| NS2A | 1252 | 0.87 | 4 | 2 | 0 | Y | IALGLMAL | 74.87 | IALGLMTL | 24.42 | | |
| NS2A | 1253 | 0.82 | 3 | 2 | 0 | Y | ALGLMALK | 75.4 | ALGLMTLK | 24.42 | | |
| NS2A | 1254 | 0.82 | 3 | 2 | 0 | Y | LGLMALKL | 75.4 | LGLMTLKL | 24.42 | | |
| NS2A | 1255 | 0.96 | 5 | 3 | 0 | Y | GLMALKLI | 73.45 | GLMTLKLI | 24.42 | GLMALKLT | 1.77 |
| NS2A | 1256 | 0.96 | 5 | 3 | 0 | Y | LMALKLIT | 73.45 | LMTLKLIT | 24.42 | LMALKLIT | 1.77 |
| NS2A | 1257 | 0.96 | 5 | 3 | 0 | Y | MALKLITQ | 73.45 | MTLKLITQ | 24.42 | MALKLITQ | 1.77 |
| NS2A | 1258 | 0.96 | 5 | 3 | 0 | Y | ALKLITQF | 73.45 | TLKLITQF | 24.42 | ALKLITQF | 1.77 |
| NS2A | 1259 | 0.15 | 5 | 2 | 0 | Y | LKLITQFE | 98.05 | LKLITQFF | 1.77 | | |
| NS2A | 1260 | 0.18 | 3 | 2 | 0 | Y | KLITQFET | 97.7 | KLITQFET | 1.77 | | |
| NS2A | 1261 | 0.18 | 4 | 2 | 0 | Y | LITQFETY | 97.7 | LTQFETY | 1.77 | | |

Figure 10-51

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required

Figure 10-52

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1286 | 0 | 1 | 1 | 0 | Y | LTVAWRTA | 100 | | | | | | |
| NS2A | 1287 | 0 | 1 | 1 | 0 | Y | TVAWRTAT | 100 | | | | | | |
| NS2A | 1288 | 0 | 1 | 1 | 0 | Y | VAWRTATL | 100 | | | | | | |
| NS2A | 1289 | 0.03 | 2 | 1 | 0 | Y | AWRTATLI | 99.65 | | | | | | |
| NS2A | 1290 | 0.03 | 2 | 1 | 0 | Y | WRTATLIL | 99.65 | | | | | | |
| NS2A | 1291 | 0.03 | 2 | 1 | 0 | Y | RTATLILA | 99.65 | | | | | | |
| NS2A | 1292 | 0.17 | 3 | 2 | 0 | Y | TATLILAG | 97.7 | TATLILAV | 1.95 | | | | |
| NS2A | 1293 | 0.59 | 4 | 3 | 0 | Y | ATLILAGV | 89.2 | ATLILAGI | 8.5 | | | | |
| NS2A | 1294 | 0.59 | 4 | 3 | 0 | Y | TLILAGVS | 89.2 | TLILAGIS | 8.5 | | | | |
| NS2A | 1295 | 0.62 | 5 | 3 | 0 | Y | LILAGVSL | 88.85 | LILAGISL | 8.5 | | | | |
| NS2A | 1296 | 0.65 | 7 | 4 | 0 | Y | ILAGVSLL | 88.85 | ILAGISLL | 8.14 | | | | |
| NS2A | 1297 | 0.61 | 6 | 3 | 0 | Y | LAGVSLLP | 89.2 | LAGISLLP | 8.14 | | | | |
| NS2A | 1300 | 1.36 | 8 | 5 | 0 | Y | VSLLPVCQ | 65.31 | VSLLPLCQ | 23.36 | VLAGVSLL | 0.35 | | |
| NS2A | 1301 | 0.91 | 6 | 3 | 0 | Y | SLLPVCQS | 74.87 | SLLPLCQS | 23.89 | VSLLPMCQ | 0.53 | ISLLPLCQ | 0.53 |
| NS2A | 1302 | 0.91 | 6 | 3 | 0 | Y | LLPVCQSS | 74.87 | LLPLCQSS | 23.89 | | | | |
| NS2A | 1303 | 0.87 | 5 | 2 | 0 | Y | LPVCQSSS | 75.22 | LPLCQSSS | 23.89 | | | | |
| NS2A | 1304 | 0.84 | 3 | 2 | 0 | Y | PVCQSSSM | 75.58 | PLCQSSSM | 23.89 | | | | |
| NS2A | 1305 | 0.84 | 3 | 2 | 0 | Y | VCQSSSMR | 75.58 | LCQSSSMR | 23.89 | | | | |
| NS2A | 1306 | 0 | 1 | 1 | 0 | Y | CQSSSMRK | 100 | | | | | | |
| NS2A | 1307 | 0.28 | 2 | 2 | 0 | Y | QSSSMRKT | 95.22 | QSSSMRKS | 4.78 | | | | |
| NS2A | 1308 | 0.28 | 2 | 2 | 0 | Y | SSSMRKTD | 95.22 | SSSMRKSD | 4.78 | | | | |
| NS2A | 1309 | 0.28 | 2 | 2 | 0 | Y | SSMRKTDW | 95.22 | SSMRKSDW | 4.78 | | | | |
| NS2A | 1310 | 0.31 | 3 | 2 | 0 | Y | SMRKTDWL | 94.87 | SMRKSDWL | 4.78 | | | | |
| NS2A | 1311 | 0.31 | 3 | 2 | 0 | Y | MRKTDWLP | 94.87 | MRKSDWLP | 4.78 | | | | |

Figure 10-53

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of

Figure 10-56

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1387 | 0.02 | 2 | 1 | 0 | Y | ITGTSADL | 99.82 | TGTSADLI | 0.88 | | | | | | |
| NS2B | 1388 | 0.11 | 4 | 2 | 0 | Y | TGTSADLI | 98.76 | GTSADLIV | 0.88 | | | | | | |
| NS2B | 1389 | 0.09 | 3 | 2 | 0 | Y | GTSADLIV | 98.94 | TSADLIVE | 0.88 | | | | | | |
| NS2B | 1390 | 0.09 | 3 | 2 | 0 | Y | TSADLIVE | 98.94 | SADLIVEK | 0.88 | | | | | | |
| NS2B | 1391 | 0.11 | 4 | 3 | 0 | Y | SADLIVEK | 98.76 | ADLIVEKA | 0.88 | | | | | | |
| NS2B | 1392 | 0.19 | 6 | 3 | 0 | Y | ADLIVEKA | 97.88 | DLIVEKAA | 0.88 | | | | | | |
| NS2B | 1393 | 0.22 | 7 | 5 | 0 | Y | DLIVEKAA | 97.52 | LIVEKAAD | 0.88 | ADLTVEKV | 0.71 | | | | |
| NS2B | 1394 | 0.32 | 9 | 5 | 0 | Y | LIVEKAAD | 96.46 | ADITWEEE | 16.28 | DLTVEKVA | 0.71 | | | | |
| NS2B | 1400 | 0.84 | 10 | 4 | 0 | Y | ADVTWEEE | 81.59 | DITWEEEA | 16.28 | LTVEKVAD | 0.71 | LTVEKAAN | 0.53 | LTVEKAAE | 0.53 |
| NS2B | 1401 | 0.81 | 9 | 2 | 0 | Y | DVTWEEEA | 81.95 | ITWEEEAE | 16.46 | AEVTWEEE | 0.53 | PDVTWEEE | 0.35 | ANVTWEEE | 0.35 |
| NS2B | 1402 | 0.72 | 6 | 1 | 0 | Y | VTWEEEAE | 82.83 | | | EVTWEEEA | 0.53 | NVTWEEEA | 0.35 | | |
| NS2B | 1403 | 0.07 | 5 | 1 | 0 | Y | TWEEEAEQ | 99.29 | | | | | | | | |
| NS2B | 1404 | 0.06 | 4 | 1 | 0 | Y | WEEEAEQT | 99.47 | | | | | | | | |
| NS2B | 1405 | 0.04 | 3 | 1 | 0 | Y | EEEAEQTG | 99.65 | | | | | | | | |
| NS2B | 1406 | 0 | 1 | 1 | 0 | Y | EEAEQTGV | 100 | | | | | | | | |
| NS2B | 1407 | 0 | 1 | 1 | 0 | Y | EAEQTGVS | 100 | | | | | | | | |
| NS2B | 1408 | 0 | 1 | 1 | 0 | Y | AEQTGVSH | 100 | | | | | | | | |
| NS2B | 1409 | 0.02 | 2 | 1 | 0 | Y | EQTGVSHN | 99.82 | | | | | | | | |
| NS2B | 1410 | 0.02 | 2 | 1 | 0 | Y | QTGVSHNL | 99.82 | | | | | | | | |
| NS2B | 1411 | 0.02 | 2 | 2 | 0 | Y | TGVSHNLM | 99.82 | GVSHNLMV | 0.88 | | | | | | |
| NS2B | 1412 | 0.11 | 4 | 2 | 0 | Y | GVSHNLMI | 98.76 | VSHNLMVT | 0.88 | | | | | | |
| NS2B | 1413 | 0.11 | 4 | 2 | 0 | Y | VSHNLMIT | 98.76 | SHNLMVTV | 0.88 | | | | | | |
| NS2B | 1414 | 0.11 | 4 | 2 | 0 | Y | SHNLMITV | 98.76 | HNLMVTVD | 0.88 | | | | | | |
| NS2B | 1415 | 0.11 | 4 | 2 | 0 | Y | HNLMITVD | 98.76 | | | | | | | | |

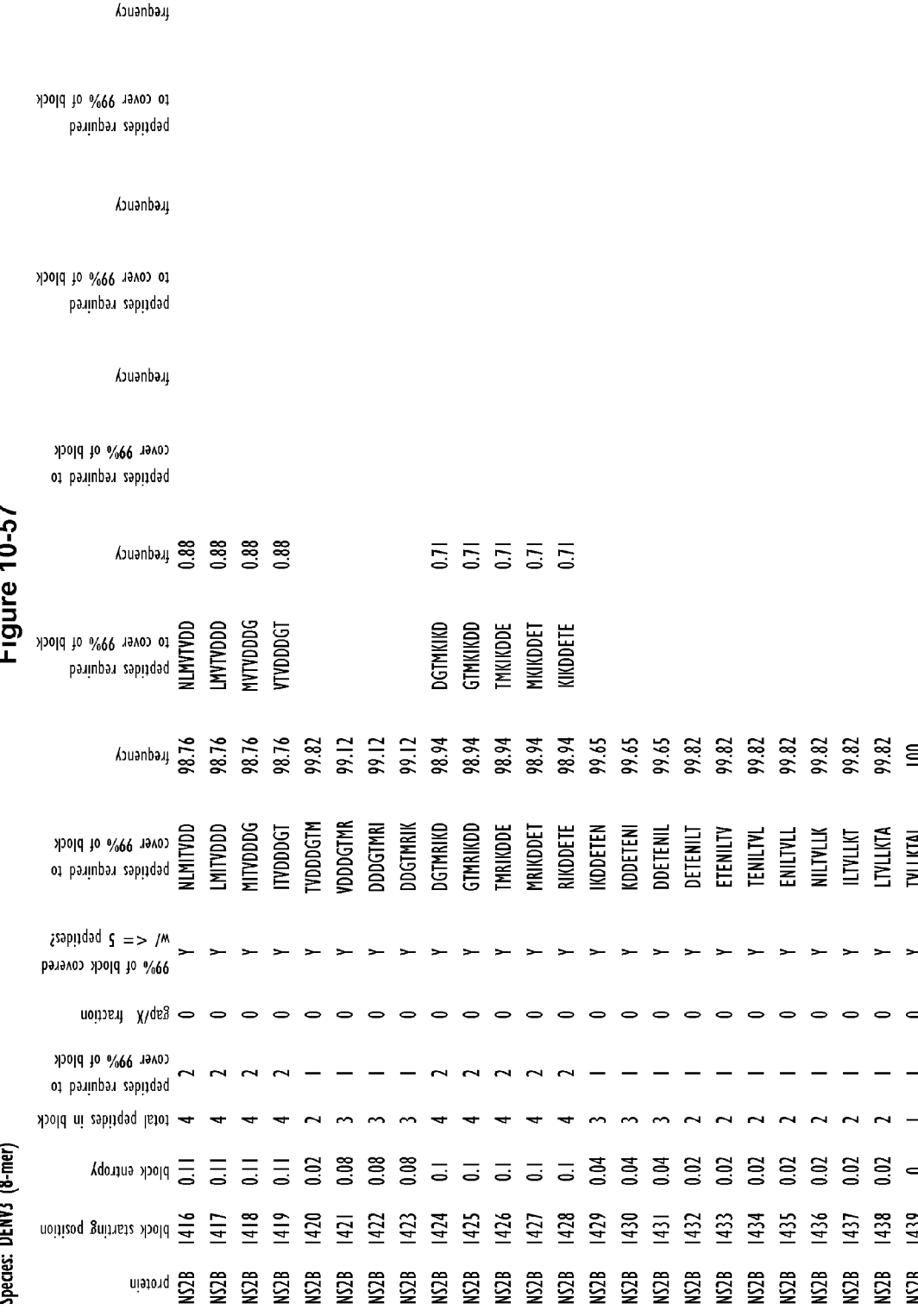

Figure 10-58

Species: DENV3 (8-mer)

| protein | block starting position | block entropy | total

Figure 10-59

Species: DENV3 (8-mer)

|

Figure 10-60

Species: DENV3 (8-mer)

| protein | block starting position | block entropy | total peptides in block | peptides required to cover 99% of block | gap/X fraction | 99% of block covered w/

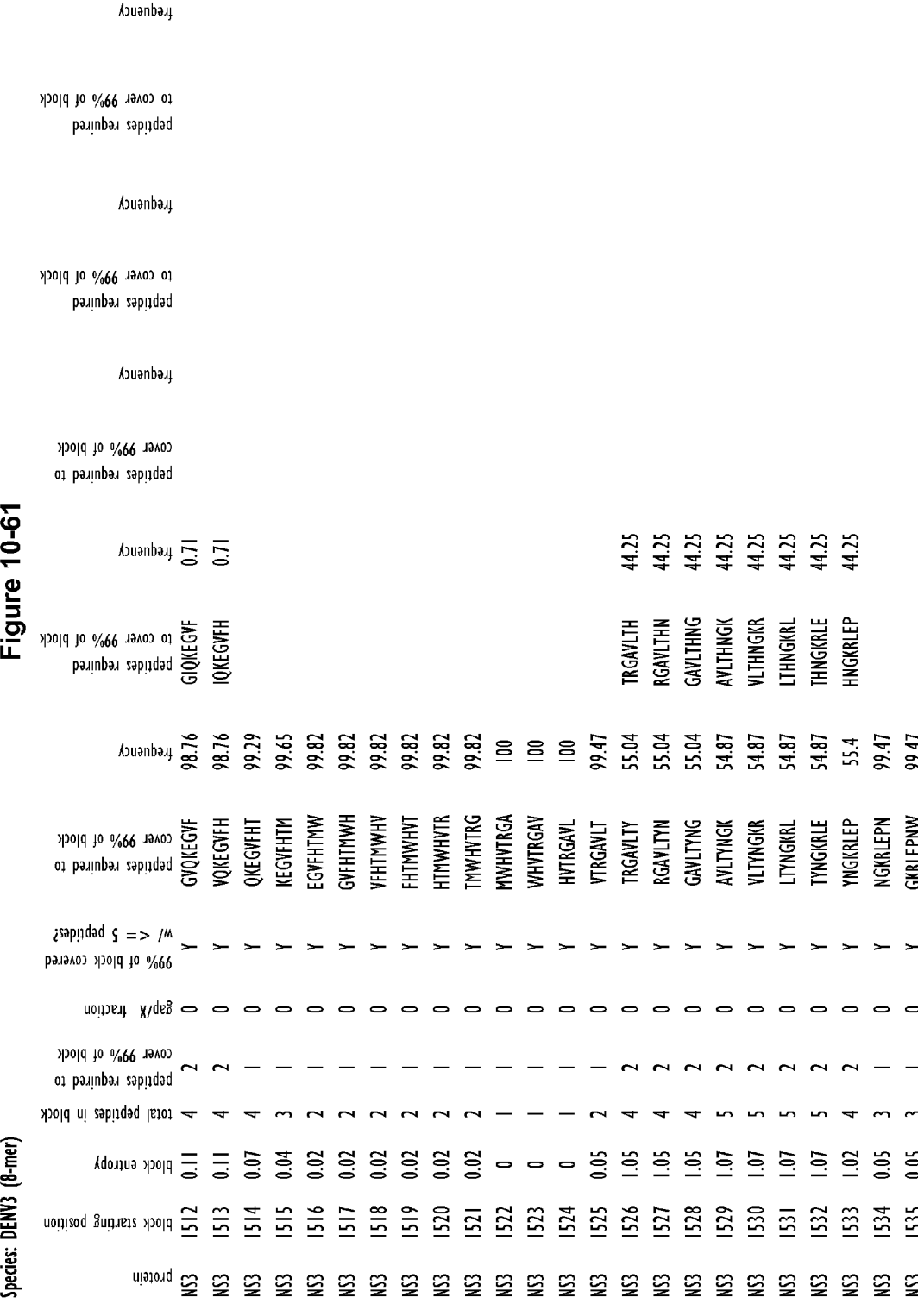

Figure 10-62

Species: DENV3 (8-mer)

| protein | block starting position | block entropy | total peptides in block | peptides required to cover 99% of block | gap/X fraction | 99% of block covered w/ =>5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1536 | 0.05 | 3 | 1 | 0 | Y | KRLEPNWA | 99.47 | | | | | | |
| NS3 | 1537 | 0.18 | 3 | 2 | 0 | Y | RLEPNWAS | 97.52 | RLEPNWAN | 2.12 | | | | |
| NS3 | 1538 | 0.18 | 3 | 2 | 0 | Y | LEPNWASV | 97.52 | LEPNWANV | 2.12 | | | | |
| NS3 | 1539 | 0.2 | 4 | 2 | 0 | Y | EPNWASVK | 97.35 | E

Figure 10-63

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to

Figure 10-64

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99%

Figure 10-65

Species: DENV3 (8-mer)

| protein | block starting position | block entropy | total peptides in block | peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1608 | 0.03 | 2 | 1 | 0 | Y | SGSPIINR | 99.65 | | | | | | |
| NS3 | 1609 | 0.03 | 2 | 1 | 0 | Y | GSPIINRE | 99.65 | | | | | | |
| NS3 | 1610 | 0.03 | 2 | 1 | 0 | Y | SPIINREG | 99.65 | | | | | | |
| NS3 | 1611 | 0.03 | 2 | 1 | 0 | Y | PIINREGK | 99.65 | | | | | | |
| NS3 | 1612 | 0.21 | 3 | 2 | 0 | Y | IINREGKV | 96.99 | IINREGKI | 2.65 | | | | |
| NS3 | 1613 | 0.24 | 4 | 2 | 0 | Y | INREGKVV | 96.64 | INREGKIV | 2.65 | | | | |
| NS3 | 1614 | 0.24 | 4 | 2 | 0 | Y | NREGKVVG | 96.64 | NREGKIVG | 2.65 | | | | |
| NS3 | 1615 | 0.24 | 4 | 2 | 0 | Y | REGKVVGL | 96.64 | REGKIVGL | 2.65 | | | | |
| NS3 | 1616 | 0.21 | 3 | 2 | 0 | Y | EGKVVGLY | 96.99 | EGKIVGLY | 2.65 | | | | |
| NS3 | 1617 | 0.21 | 3 | 2 | 0 | Y | GKVVGLYG | 96.99 | GKIVGLYG | 2.65 | | | | |
| NS3 | 1618 | 0.21 | 3 | 2 | 0 | Y | KVVGLYGN | 96.99 | KIVGLYGN | 2.65 | | | | |
| NS3 | 1619 | 0.21 | 3 | 2 | 0 | Y | VVGLYGNG | 96.99 | IVGLYGNG | 2.65 | | | | |
| NS3 | 1620 | 0.03 | 2 | 1 | 0 | Y | VGLYGNGV | 99.65 | | | | | | |
| NS3 | 1621 | 0.05 | 2 | 1 | 0 | Y | GLYGNGVV | 99.47 | | | | | | |
| NS3 | 1622 | 0.05 | 2 | 1 | 0 | Y | LYGNGVVT | 99.47 | | | | | | |
| NS3 | 1623 | 0.05 | 2 | 1 | 0 | Y | YGNGVVTK | 99.47 | | | | | | |
| NS3 | 1624 | 0.11 | 3 | 2 | 0 | Y | GNGVVTKN | 98.76 | GNGVVTKS | 0.71 | | | | |
| NS3 | 1625 | 0.11 | 3 | 2 | 0 | Y | NGVVTKNG | 98.76 | NGVVTKSG | 0.71 | | | | |
| NS3 | 1626 | 0.11 | 3 | 2 | 0 | Y | GVVTKNGG | 98.76 | GVVTKSGG | 0.71 | | | | |
| NS3 | 1627 | 0.11 | 3 | 2 | 0 | Y | VVTKNGGY | 98.76 | VVTKSGGY | 0.71 | | | | |
| NS3 | 1628 | 0.11 | 3 | 2 | 0 | Y | VTKNGGYV | 98.76 | VTKSGGYV | 0.71 | | | | |
| NS3 | 1629 | 0.06 | 2 | 1 | 0 | Y | TKNGGYVS | 99.29 | | | | | | |
| NS3 | 1630 | 0.06 | 2 | 1 | 0 | Y | KNGGYVSG | 99.29 | | | | | | |
| NS3 | 1631 | 0.06 | 2 | 1 | 0 | Y | NGGYVSGI | 99.29 | | | | | | |

Figure 10-66

Species: DENV3 (8-mer)

| protein | block starting position | block entropy | total peptides in block | peptides required to cover 99% of block | gap/X fraction | 99% of block covered w/ <= 5 peptides? | peptides required

Figure 10-67

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1656 | 0.11 | 4 | 2 | 0 | Y | MFKKRNLT | 98.76 | MFKKRNLT | 0

Figure 10-68

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1680 | 0.4 | 4 | 2 | 0 | Y | AIVREAIK | 93.27 | AIIREAIK | 5.84 |
| NS3 | 1681 | 0.37 | 3 | 2 | 0 | Y | IVREAIKR | 93.63 | IIREAIKR | 5.84 |
| NS3 | 1682 | 0.32 | 2 | 2 | 0 | Y | VREAIKRR | 94.16 | IREAIKRR | 5.84 |
| NS3 | 1683 | 0 | 1 | 1 | 0 | Y | REAIKRRL | 100 | | |
| NS3 | 1684 | 0 | 1 | 1 | 0 | Y | EAIKRRLR | 100 | | |
| NS3 | 1685 | 0 | 1 | 1 | 0 | Y | AIKRRLRT | 100 | | |
| NS3 | 1686 | 0 | 1 | 1 | 0 | Y | IKRRLRTL | 100 | | |
| NS3 | 1687 | 0 | 1 | 1 | 0 | Y | KRRLRTLI | 100 | | |
| NS3 | 1688 | 0 | 1 | 1 | 0 | Y | RRLRTLIL | 100 | | |
| NS3 | 1689 | 0 | 1 | 1 | 0 | Y | RLRTLILA | 100 | | |
| NS3 | 1690 | 0 | 1 | 1 | 0 | Y | LRTLILAP | 100 | | |
| NS3 | 1691 | 0 | 1 | 1 | 0 | Y | RTLILAPT | 100 | | |
| NS3 | 1692 | 0 | 1 | 1 | 0 | Y | TLILAPTR | 100 | | |
| NS3 | 1693 | 0 | 1 | 1 | 0 | Y | LILAPTRV | 100 | | |
| NS3 | 1694 | 0 | 1 | 1 | 0 | Y | ILAPTRVV | 100 | | |
| NS3 | 1695 | 0 | 1 | 1 | 0 | Y | LAPTRVVA | 100 | | |
| NS3 | 1696 | 0 | 1 | 1 | 0 | Y | APTRVVAA | 100 | | |
| NS3 | 1697 | 0 | 1 | 1 | 0 | Y | PTRVVAAE | 100 | | |
| NS3 | 1698 | 0 | 1 | 1 | 0 | Y | TRVVAAEM | 100 | | |
| NS3 | 1699 | 0 | 1 | 1 | 0 | Y | RVVAAEME | 100 | | |
| NS3 | 1700 | 0 | 1 | 1 | 0 | Y | VVAAEMEE | 100 | | |
| NS3 | 1701 | 0 | 1 | 1 | 0 | Y | VAAEMEEA | 100 | | |
| NS3 | 1702 | 0.02 | 2 | 1 | 0 | Y | AAEMEEAL | 99.82 | | |
| NS3 | 1703 | 0.06 | 4 | 1 | 0 | Y | AEMEEALK | 99.47 | | |

Figure 10-69

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1704 | 0.06 | 4 | 1 | 0 | Y | EMEEALKG | 99.47 | | | | | | |
| NS3 | 1705 | 0.06 | 4 | 1 | 0 | Y | MEEALKGL | 99.47 | | | | | | |
| NS3 | 1706 | 0.06 | 4 | 1 | 0 | Y | EEALKGLP | 99.47 | | | | | | |
| NS3 | 1707 | 0.07 | 5 | 1 | 0 | Y | EALKGLPI | 99.29 | | | | | | |
| NS3 | 1708 | 0.07 | 5 | 1 | 0 | Y | ALKGLPIR | 99.29 | | | | | | |
| NS3 | 1709 | 0.07 | 5 | 1 | 0 | Y | LKGLPIRY | 99.29 | | | | | | |
| NS3 | 1710 | 0.06 | 4 | 1 | 0 | Y | KGLPIRYQ | 99.47 | | | | | | |
| NS3 | 1711 | 0.02 | 2 | 1 | 0 | Y | GLPIRYQT | 99.82 | | | | | | |
| NS3 | 1712 | 0.05 | 3 | 1 | 0 | Y | LPIRYQTT | 99.47 | | | | | | |
| NS3 | 1713 | 0.09 | 4 | 1 | 0 | Y | PIRYQTTA | 99.12 | | | | | | |
| NS3 | 1714 | 0.32 | 6 | 3 | 0 | Y | IRYQTTAT | 95.58 | IRYQTTAI | 3.36 | IRYQTTVT | 3.36 | | |
| NS3 | 1715 | 0.33 | 6 | 3 | 0 | Y | RYQTTATK | 95.4 | RYQTTAIK | 3.36 | RYQTSATK | 3.36 | | |
| NS3 | 1716 | 0.33 | 6 | 3 | 0 | Y | YQTTATKS | 95.4 | YQTTAIKS | 3.36 | YQTTVTKS | 3.36 | | |
| NS3 | 1717 | 0.35 | 7 | 4 | 0 | Y | QTTATKSE | 95.22 | QTTAIKSE | 3.36 | QTTATRSE | 3.36 | QTTVTKSE | 0.35 |
| NS3 | 1718 | 0.35 | 7 | 4 | 0 | Y | TTATKSEH | 95.22 | TTAIKSEH | 3.36 | TTVTKSEH | 3.36 | TTATRSEH | 0.35 |
| NS3 | 1719 | 0.35 | 7 | 4 | 0 | Y | TATKSEHT | 95.22 | TAIKSEHT | 3.36 | TATRSEHT | 3.36 | TVTKSEHT | 0.35 |
| NS3 | 1720 | 0.32 | 6 | 3 | 0 | Y | ATKSEHTG | 95.58 | AIKSEHTG | 3.36 | VTKSEHTG | 3.36 | | |
| NS3 | 1721 | 0.63 | 6 | 4 | 0 | Y | TKSEHTGR | 89.2 | KSEHTGK | 6.73 | IKSEHTGR | 3.36 | | |
| NS3 | 1722 | 0.41 | 4 | 3 | 0 | Y | KSEHTGRE | 92.74 | KSEHTGKE | 6.73 | | | | |
| NS3 | 1723 | 0.37 | 3 | 2 | 0 | Y | SEHTGREI | 93.1 | SEHTGKEI | 6.73 | | | | |
| NS3 | 1724 | 0.37 | 3 | 2 | 0 | Y | EHTGREIV | 93.1 | EHTGKEIV | 6.73 | | | | |
| NS3 | 1725 | 0.36 | 2 | 2 | 0 | Y | HTGREIVD | 93.1 | HTGKEIVD | 6.9 | | | | |
| NS3 | 1726 | 0.36 | 2 | 2 | 0 | Y | TGREIVDL | 93.1 | TGKEIVDL | 6.9 | | | | |
| NS3 | 1727 | 0.36 | 2 | 2 | 0 | Y | GREIVDLM | 93.1 | GKEIVDLM | 6.9 | | | | |

Figure 10-70

Species: DENV3 (8

Figure 10-71

Species: DENV3 (8-mer)

| protein | block starting position | block entropy | total

Figure 10-72

Species: DENV3 (8-mer)

| protein | block star

Figure 10-73

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1800 | 0.02 | 2 | 1 | 0 | Y | PQSNAPIQ | 99.82 | | | | | | |
| NS3 | 1801 | 0.02 | 2 | 1 | 0 | Y | QSNAPIQD | 99.82 | | | | | | |
| NS3 | 1802 | 0.05 | 3 | 1 | 0 | Y | SNAPIQDE | 99.47 | | | | | | |
| NS3 | 1803 | 0.05 | 3 | 1 | 0 | Y | NAPIQDEE | 99.47 | | | | | | |
| NS3 | 1804 | 0.18 | 4 | 2 | 0 | Y | APIQDEER | 97.7 | APIQDEEK | 1.77 | | | | |
| NS3 | 1805 | 0.16 | 3 | 2 | 0 | Y | PIQDEERD | 97.88 | PIQDEEKD | 1.77 | | | | |
| NS3 | 1806 | 0.16 | 3 | 2 | 0 | Y | IQDEERDI | 97.88 | IQDEEKDI | 1.77 | | | | |
| NS3 | 1807 | 0.16 | 3 | 2 | 0 | Y | QDEERDIP | 97.88 | QDEEKDIP | 1.77 | | | | |
| NS3 | 1808 | 0.16 | 3 | 2 | 0 | Y | DEERDIPE | 97.88 | DEEKDIPE | 1.77 | | | | |
| NS3 | 1809 | 0.16 | 3 | 2 | 0 | Y | EERDIPER | 97.88 | EEKDIPER | 1.77 | | | | |
| NS3 | 1810 | 0.13 | 2 | 2 | 0 | Y | ERDIPERS | 98.23 | EKDIPERS | 1.77 | | | | |
| NS3 | 1811 | 0.13 | 2 | 2 | 0 | Y | RDIPERSW | 98.23 | KDIPERSW | 1.77 | | | | |
| NS3 | 1812 | 0 | 1 | 1 | 0 | Y | DIPERSWN | 100 | | | | | | |
| NS3 | 1813 | 0 | 1 | 1 | 0 | Y | IPERSWNS | 100 | | | | | | |
| NS3 | 1814 | 0 | 1 | 1 | 0 | Y | PERSWNSG | 100 | | | | | | |
| NS3 | 1815 | 0 | 1 | 1 | 0 | Y | ERSWNSGN | 100 | | | | | | |
| NS3 | 1816 | 0.34 | 2 | 2 | 0 | Y | RSWNSGNE | 93.81 | RSWNSGND | 6.19 | | | | |
| NS3 | 1817 | 0.34 | 2 | 2 | 0 | Y | SWNSGNEW | 93.81 | SWNSGNDW | 6.19 | | | | |
| NS3 | 1818 | 0.34 | 2 | 2 | 0 | Y | WNSGNEWI | 93.81 | WNSGNDWI | 6.19 | | | | |
| NS3 | 1819 | 0.34 | 2 | 2 | 0 | Y | NSGNEWIT | 93.81 | NSGNDWIT | 6.19 | | | | |
| NS3 | 1820 | 0.34 | 2 | 2 | 0 | Y | SGNEWITD | 93.81 | SGNDWITD | 6.19 | | | | |
| NS3 | 1821 | 0.34 | 2 | 2 | 0 | Y | GNEWITDF | 93.81 | GNDWITDF | 6.19 | | | | |
| NS3 | 1822 | 1.26 | 6 | 4 | 0 | Y | NEWITDFV | 63.89 | NEWITDFA | 29.2 | NDWITDFA | 5.84 | NEWITDFT | 0.53 |
| NS3 | 1823 | 1.26 | 6 | 4 | 0 | Y | EWITDFAG | 63.89 | EWITDFVG | 29.2 | DWITDFAG | 5.84 | EWITDFTG | 0.53 |

Figure 10-74

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1824 | — | 7 | 3 | 0 | Y | WITDFAGK | 69.56 | WITDFVGK | 29.03 | WITDFTGK | 0.53 |
| NS3 | 1825 | — | 7 | 3 | 0 | Y | ITDFAGKT | 69.56 | ITDFVGKT | 29.03 | ITDFTGKT | 0.53 |
| NS3 | 1826 | — | 7 | 3 | 0 | Y | TDFAGKTV | 69.56 | TDFVGKTV | 29.03 | TDFTGKTV | 0.53 |
| NS3 | 1827 | — | 7 | 3 | 0 | Y | DFAGKTVW | 69.56 | DFVGKTVW | 29.03 | DFTGKTVW | 0.53 |
| NS3 | 1828 | — | 7 | 3 | 0 | Y | FAGKTVWF | 69.56 | FVGKTVWF | 29.03 | FTGKTVWF | 0.53 |
| NS3 | 1829 | — | 7 | 3 | 0 | Y | AGKTVWFV | 69.56 | VGKTVWFV | 29.03 | TGKTVWFV | 0.53 |
| NS3 | 1830 | 0.03 | 2 | 1 | 0 | Y | GKTVWFVP | 99.65 | | | | |
| NS3 | 1831 | 0.03 | 2 | 1 | 0 | Y | KTVWFVPS | 99.65 | | | | |
| NS3 | 1832 | 0 | 1 | 1 | 0 | Y | TVWFVPSI | 100 | | | | |
| NS3 | 1833 | 0 | 1 | 1 | 0 | Y | VWFVPSIK | 100 | | | | |
| NS3 | 1834 | 0 | 1 | 1 | 0 | Y | WFVPSIKA | 100 | | | | |
| NS3 | 1835 | 0 | 1 | 1 | 0 | Y | FVPSIKAG | 100 | | | | |
| NS3 | 1836 | 0 | 1 | 1 | 0 | Y | VPSIKAGN | 100 | | | | |
| NS3 | 1837 | 0.04 | 3 | 1 | 0 | Y | PSIKAGND | 99.65 | | | | |
| NS3 | 1838 | 0.04 | 3 | 1 | 0 | Y | SIKAGNDI | 99.65 | | | | |
| NS3 | 1839 | 0.04 | 3 | 1 | 0 | Y | IKAGNDIA | 99.65 | | | | |
| NS3 | 1840 | 0.04 | 3 | 1 | 0 | Y | KAGNDIAN | 99.65 | | | | |
| NS3 | 1841 | 0.04 | 3 | 1 | 0 | Y | AGNDIANC | 99.65 | | | | |
| NS3 | 1842 | 0.04 | 3 | 1 | 0 | Y | GNDIANCL | 99.65 | | | | |
| NS3 | 1843 | 0.04 | 3 | 1 | 0 | Y | NDIANCLR | 99.65 | | | | |
| NS3 | 1844 | 0.04 | 3 | 1 | 0 | Y | DIANCLRK | 99.65 | | | | |
| NS3 | 1845 | 0 | 1 | 1 | 0 | Y | IANCLRKN | 100 | | | | |
| NS3 | 1846 | 0 | 1 | 1 | 0 | Y | ANCLRKNG | 100 | | | | |
| NS3 | 1847 | 0 | 1 | 1 | 0 | Y | NCLRKNGK | 100 | | | | |

Figure 10-76

Species: DENV3 (8-mer)

| protein | block star

Figure 10-78

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1920 | 0.55 | 3 | 2 | 0 | Y | PMPYTAAS | 88.32 | PMPYTVAS | 11.15 |
| NS3 | 1921 | 0.55 | 3 | 2 | 0 | Y | MPYTAASA | 88.32 | MPYTVASA | 11.15 |
| NS3 | 1922 | 0.5 | 2 | 2 | 0 | Y | PYTAASAA | 88.85 | PYTVASAA | 11.15 |
| NS3 | 1923 | 0.5 | 2 | 2 | 0 | Y | YTAASAAQ | 88.85 | YTVASAAQ | 11.15 |
| NS3 | 1924 | 0.5 | 2 | 2 | 0 | Y | TAASAAQR | 88.85 | TVASAAQR | 11.15 |
| NS3 | 1925 | 0.5 | 2 | 2 | 0 | Y | AASAAQRR | 88.85 | VASAAQRR | 11.15 |
| NS3 | 1926 | 0 | 1 | 1 | 0 | Y | ASAAQRRG | 100 | | |
| NS3 | 1927 | 0 | 1 | 1 | 0 | Y | SAAQRRGR | 100 | | |
| NS3 | 1928 | 0 | 1 | 1 | 0 | Y | AAQRRGRV | 100 | | |
| NS3 | 1929 | 0 | 1 | 1 | 0 | Y | AQRRGRVG | 100 | | |
| NS3 | 1930 | 0 | 1 | 1 | 0 | Y | QRRGRVGR | 100 | | |
| NS3 | 1931 | 0 | 1 | 1 | 0 | Y | RRGRVGRN | 100 | | |
| NS3 | 1932 | 0.05 | 2 | 2 | 0 | Y | RGRVGRNP | 99.47 | | |
| NS3 | 1933 | 0.15 | 5 | 2 | 0 | Y | GRVGRNPQ | 98.41 | GRVGRNPP | 0.71 |
| NS3 | 1934 | 0.15 | 5 | 2 | 0 | Y | RVGRNPQK | 98.41 | RVGRNPPK | 0.71 |
| NS3 | 1935 | 0.15 | 5 | 2 | 0 | Y | VGRNPQKE | 98.41 | VGRNPPKE | 0.71 |
| NS3 | 1936 | 0.15 | 5 | 2 | 0 | Y | GRNPQKEN | 98.41 | GRNPPKEN | 0.71 |
| NS3 | 1937 | 0.16 | 6 | 3 | 0 | Y | RNPQKEND | 98.23 | RNPPKEND | 0.71 |
| NS3 | 1938 | 0.16 | 6 | 3 | 0 | Y | NPQKENDQ | 98.23 | NPPKENDQ | 0.71 |
| NS3 | 1939 | 0.16 | 6 | 3 | 0 | Y | PQKENDQY | 98.23 | PPKENDQY | 0.71 |
| NS3 | 1940 | 0.16 | 5 | 2 | 0 | Y | QKENDQYI | 98.76 | PKENDQYI | 0.71 |
| NS3 | 1941 | 0.12 | 2 | 2 | 0 | Y | KENDQYIF | 99.82 | | |
| NS3 | 1942 | 0.02 | 4 | 2 | 0 | Y | ENDQYIFT | 97.35 | ENDQYIFM | 2.3 |
| NS3 | 1943 | 0.2 | 4 | 2 | 0 | Y | NDQYIFTG | 97.35 | NDQYIFMG | 2.3 |

Additional peptides (third variant) for rows 1937–1939:

| block starting position | peptides required to cover 99% of block | frequency |
|---|---|---|
| 1937 | RNSQKEND | 0.53 |
| 1938 | NSQKENDQ | 0.53 |
| 1939 | SQKENDQY | 0.53 |

Figure 10-79

Species: DENW3 (8-mer)

| protein | block starting position | block entropy | total peptides in block | peptides required to cover 99% of block | gap/X fraction | 99% of block covered w/ => 5 peptides? | peptides required to cover 99% of block | frequency | peptides required to cover 99% of block | frequency |
|---|---|---|---|---|---|---|---|---|---|---|
| NS3 | 1944 | 0.2 | 4 | 2 | 0 | Y | DQYIFTGQ | 97.35 | DQYI

Figure 10-80

Species: DENV3 (8-mer)

| protein | block starting position | block entropy | total peptides in block | peptides required to cover 99% of block | g

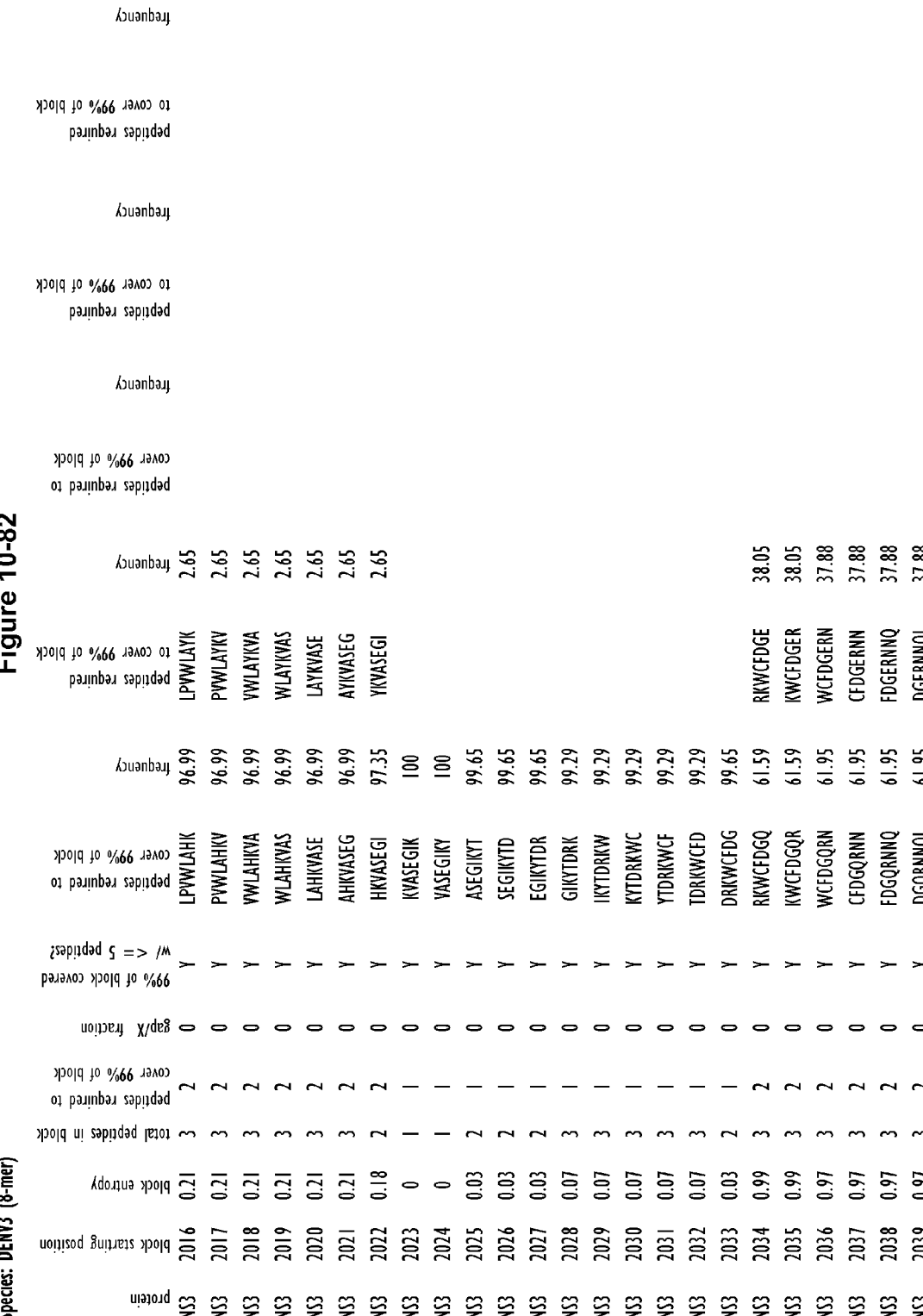

Figure 10-83

Species: DENV3 (8-mer)

| protein | block starting position | block

Figure 10-85

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of

Figure 10-86

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---

Figure 10-87

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to

Figure 10-88

Species: DENV3 (8-mer)

| protein | block starting position | block entropy |

Figure 10-89

Species: DENV3 (8-mer)

| protein | block

Figure 10-90

Species: DENV3 (8-mer)

| protein | block starting position | block entropy | total pe

Figure 10-91

Species: DENV3 (8-mer)

| protein | block starting position | block entropy | total peptides in block | peptides required to cover 99% of block | gap/X fraction | 99% of block covered w/ => 5 peptides? | peptides required to cover 99% of block | frequency | peptides required to c

Figure 10-92

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2256 | 0.11 | 4 | 2 | 0 | Y | GMSKEPGV | 98.76 | GMSREPGV | 0.88 | | | | |
| NS4B | 2257 | 0.3 | 5 | 3 | 0 | Y | MSKEPGVV | 95.75 | MSKEPGVA | 3.01 | | | | |
| NS4B | 2258 | 0.34 | 6 | 3 | 0 | Y | SKEPGVVS | 95.4 | SKEPGVAS | 3.01 | | | | |
| NS4B | 2259 | 0.44 | 8 | 4 | 0 | Y | KEPGVVSP | 94.16 | KEPGVASP | 3.01 | MSREPGVW | 0.88 | | |
| NS4B | 2260 | 0.46 | 9 | 5 | 0 | Y | EPGVVSPT | 93.98 | EPGVASPT | 3.01 | SREPGVWS | 0.88 | | |
| NS4B | 2261 | 0.46 | 9 | 5 | 0 | Y | PGVVSPTS | 93.98 | PGVASPTS | 3.01 | KEPGVWSS | 1.06 | REPGVWSP | 0.88 |
| NS4B | 2262 | 0.46 | 9 | 5 | 0 | Y | GVVSPTSY | 93.98 | GVASPTSY | 3.01 | EPGVWSST | 1.06 | EPGVWSPN | 0.71 | EPGVWPPT | 0.35 |
| NS4B | 2263 | 0.44 | 8 | 4 | 0 | Y | VVSPTSYL | 94.16 | VASPTSYL | 3.01 | PGVWSSTS | 1.06 | PGVWSPNS | 0.71 | PGVWSPIS | 0.35 |
| NS4B | 2264 | 0.43 | 7 | 3 | 0 | Y | VSPTSYLD | 94.34 | ASPTSYLD | 3.01 | GVWSSTSY | 1.06 | GVWSPNSY | 0.71 | GVWPPTSY | 0.35 |
| NS4B | 2265 | 0.23 | 6 | 3 | 0 | Y | SPTSYLDV | 97.35 | SSTSYLDV | 1.06 | VWSSTSYL | 1.06 | VWSPNSYL | 0.71 | VWSPISYL | 0.35 |
| NS4B | 2266 | 0.2 | 5 | 3 | 0 | Y | PTSYLDVD | 97.7 | STSYLDVD | 1.06 | VSSTSYLD | 1.06 | VSPNSYLD | 0.71 | | |
| NS4B | 2267 | 0.09 | 3 | 2 | 0 | Y | TSYLDVDL | 98.94 | NSYLDVDL | 0.71 | SPNSYLDV | 1.06 | | | | |
| NS4B | 2268 | 0 | 1 | 1 | 0 | Y | SYLDVDLH | 100 | | | PNSYLDVD | 0.71 | | | | |
| NS4B | 2269 | 0 | 1 | 1 | 0 | Y | YLDVDLHP | 100 | | | | | | | | |
| NS4B | 2270 | 0 | 1 | 1 | 0 | Y | LDVDLHPA | 100 | | | | | | | | |
| NS4B | 2271 | 0 | 1 | 1 | 0 | Y | DVDLHPAS | 100 | | | | | | | | |
| NS4B | 2272 | 0 | 1 | 1 | 0 | Y | VDLHPASA | 100 | | | | | | | | |
| NS4B | 2273 | 0 | 1 | 1 | 0 | Y | DLHPASAW | 100 | | | | | | | | |
| NS4B | 2274 | 0.02 | 2 | 1 | 0 | Y | LHPASAWT | 99.82 | | | | | | | | |
| NS4B | 2275 | 0.02 | 2 | 1 | 0 | Y | HPASAWTL | 99.82 | | | | | | | | |
| NS4B | 2276 | 0.02 | 2 | 1 | 0 | Y | PASAWTLY | 99.82 | | | | | | | | |
| NS4B | 2277 | 0.02 | 2 | 1 | 0 | Y | ASAWTLYA | 99.82 | | | | | | | | |
| NS4B | 2278 | 0.02 | 2 | 1 | 0 | Y | SAWTLYAV | 99.82 | | | | | | | | |
| NS4B | 2279 | 0.02 | 2 | 1 | 0 | Y | AWTLYAVA | 99.82 | | | | | | | | |

Figure 10-93

Species: DENV3 (8-mer)

| protein | block starting position | block entropy | total peptides in block | peptides required to cover 99% of block | gap/X fraction | 99% of block covered w/ <= 5 peptides? | peptides required to c

Figure 10-94

Species: DENV3 (8-mer)

| protein | block starting position | block entropy | total peptides in block | peptides required to cover 99% of block | gap/X

Figure 10-95

Species: DENV3 (8-mer)

| protein | block starting position | block entropy | total peptides in block | peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2328 | 0.02 | 2 | 1 | 0 | Y | KMDLGVPL | 99.82 | | | | | | |
| NS4B | 2329 | 0.02 | 2 | 1 | 0 | Y | MDLGVPLL | 99.82 | | | | | | |
| NS4B | 2330 | 0.02 | 2 | 1 | 0 | Y | DLGVPLLA | 99.82 | | | | | | |
| NS4B | 2331 | 0.02 | 2 | 1 | 0 | Y | LGVPLLAL | 99.82 | | | | | | |
| NS4B | 2332 | 0.02 | 2 | 1 | 0 | Y | GVPLLALG | 99.82 | | | | | | |
| NS4B | 2333 | 0.02 | 2 | 1 | 0 | Y | VPLLALGC | 99.82 | | | | | | |
| NS4B | 2334 | 0 | 1 | 1 | 0 | Y | PLLALGCY | 100 | | | | | | |
| NS4B | 2335 | 0 | 1 | 1 | 0 | Y | LLALGCYS | 100 | | | | | | |
| NS4B | 2336 | 0 | 1 | 1 | 0 | Y | LALGCYSQ | 100 | | | | | | |
| NS4B | 2337 | 0 | 1 | 1 | 0 | Y | ALGCYSQV | 100 | | | | | | |
| NS4B | 2338 | 0 | 1 | 1 | 0 | Y | LGCYSQVN | 100 | | | | | | |
| NS4B | 2339 | 0 | 1 | 1 | 0 | Y | GCYSQVNP | 100 | | | | | | |
| NS4B | 2340 | 0 | 1 | 1 | 0 | Y | CYSQVNPL | 100 | | | | | | |
| NS4B | 2341 | 0 | 1 | 1 | 0 | Y | YSQVNPLT | 100 | | | | | | |
| NS4B | 2342 | 0 | 1 | 1 | 0 | Y | SQVNPLTI | 100 | | | | | | |
| NS4B | 2343 | 0.13 | 3 | 2 | 0 | Y | QVNPLTIT | 98.41 | QVNPLTII | 0.88 | | | | |
| NS4B | 2344 | 0.13 | 3 | 2 | 0 | Y | VNPLTITA | 98.41 | VNPLTIIA | 0.88 | | | | |
| NS4B | 2345 | 0.22 | 4 | 3 | 0 | Y | NPLTITAA | 97.35 | NPLTITAV | 1.06 | NPLTIIAA | 0.88 | | |
| NS4B | 2346 | 0.22 | 4 | 3 | 0 | Y | PLTITAAV | 97.35 | PLTITAVL | 1.06 | PLTIIAAV | 0.88 | | |
| NS4B | 2347 | 0.24 | 5 | 3 | 0 | Y | LTITAAVL | 97.17 | LTITAVLL | 1.06 | LTIIAAVL | 1.06 | | |
| NS4B | 2348 | 0.24 | 5 | 3 | 0 | Y | TITAAVLL | 97.17 | TITAVLLL | 1.06 | TIIAAVLL | 1.06 | | |
| NS4B | 2349 | 0.24 | 5 | 3 | 0 | Y | ITAAVLLL | 97.17 | ITAVLLLI | 1.06 | IIAAVLLL | 1.06 | | |
| NS4B | 2350 | 1.18 | 7 | 5 | 0 | Y | TAAVLLLI | 62.3 | TAAVLLLV | 34.51 | TAAVLLLV | 1.06 | IAAVLLLV | 0.88 |
| NS4B | 2351 | 1.07 | 5 | 3 | 0 | Y | AAVLLLIT | 62.3 | AAVLLLVT | 36.11 | AAVLLLV | 1.06 | AAVLLLV | 0.71 |

Figure 10-97

Species: DENV3 (8-mer)

| protein | block starting position | block entropy | total peptides in block | peptides required to cover 99% of block | gap/X fraction | 99% of block covered w/ =< 5 peptides? | peptides required to cover 99% of block | frequency |
|---|---|---|---|---|---|---|---|---|
| NS4B | 2376 | 0 |

Figure 10-98

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2400 | 0.05 | 3 | 1 | 0 | Y | VIYDSKFE | 99.47 | | | | | | |
| NS4B | 2401 | 0.05 | 3 | 1 | 0 | Y | IYDSKFEK | 99.47 | | | | | | |
| NS4B | 2402 | 0.05 | 3 | 1 | 0 | Y | YDSKFEKQ | 99.47 | | | | | | |
| NS4B | 2403 | 0.02 | 2 | 1 | 0 | Y | DSKFEKQL | 99.82 | | | | | | |
| NS4B | 2404 | 0.02 | 2 | 1 | 0 | Y | SKFEKQLG | 99.82 | | | | | | |
| NS4B | 2405 | 0 | 1 | 1 | 0 | Y | KFEKQLGQ | 100 | | | | | | |
| NS4B | 2406 | 0.02 | 2 | 1 | 0 | Y | FEKQLGQV | 99.82 | | | | | | |
| NS4B | 2407 | 0.02 | 2 | 1 | 0 | Y | EKQLGQVM | 99.82 | | | | | | |
| NS4B | 2408 | 0.02 | 2 | 1 | 0 | Y | KQLGQVML | 99.82 | | | | | | |
| NS4B | 2409 | 0.02 | 2 | 1 | 0 | Y | QLGQVMLL | 99.82 | | | | | | |
| NS4B | 2410 | 0.05 | 3 | 1 | 0 | Y | LGQVMLLV | 99.47 | | | | | | |
| NS4B | 2411 | 0.05 | 3 | 1 | 0 | Y | GQVMLLVL | 99.47 | | | | | | |
| NS4B | 2412 | 0.05 | 3 | 1 | 0 | Y | QVMLLVLC | 99.47 | | | | | | |
| NS4B | 2413 | 0.11 | 5 | 2 | 0 | Y | VMLLVLCA | 98.94 | VMLLVLCV | 0.35 | | | | |
| NS4B | 2414 | 0.15 | 6 | 3 | 0 | Y | MLLVLCAV | 98.41 | MLLVLCAA | 0.53 | MLLVLCVW | 0.35 | | |
| NS4B | 2415 | 0.15 | 6 | 3 | 0 | Y | LLVLCAVQ | 98.41 | LLVLCAAQ | 0.53 | LLVLCVWQ | 0.35 | | |
| NS4B | 2416 | 0.15 | 6 | 3 | 0 | Y | LVLCAVQL | 98.41 | LVLCAAQL | 0.53 | LILCAVQL | 0.35 | | |
| NS4B | 2417 | 0.15 | 6 | 3 | 0 | Y | VLCAVQLL | 98.41 | VLCAAQLL | 0.53 | ILCAVQLL | 0.35 | | |
| NS4B | 2418 | 0.12 | 5 | 2 | 0 | Y | LCAVQLLL | 98.76 | LCAAQLLL | 0.53 | | | | |
| NS4B | 2419 | 0.12 | 5 | 2 | 0 | Y | CAVQLLLM | 98.76 | CAAQLLLM | 0.53 | | | | |
| NS4B | 2420 | 0.14 | 6 | 2 | 0 | Y | AVQLLLMR | 98.58 | AAQLLLMR | 0.53 | | | | |
| NS4B | 2421 | 0.09 | 4 | 1 | 0 | Y | VQLLLMRT | 99.12 | | | | | | |
| NS4B | 2422 | 0.02 | 2 | 1 | 0 | Y | QLLLMRTS | 99.82 | | | | | | |
| NS4B | 2423 | 0.02 | 2 | 1 | 0 | Y | LLLMRTSW | 99.82 | | | | | | |

Figure 10-99

Species: DENV3 (8-mer)

| protein | block starting position | block entropy | total peptides in block | peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2424 | 0.02 | 2 | 1 | 0 | Y | LLMRTSWA | 99.82 | | | | | | |
| NS4B | 2425 | 0.46 | 3 | 2 | 0 | Y | LMRTSWAL | 90.62 | LMRTSWAF | 9.2 | | | | |
| NS4B | 2426 | 0.46 | 3 | 2 | 0 | Y | MRTSWALC | 90.62 | MRTSWAFC | 9.2 | | | | |
| NS4B | 2427 | 0.46 | 3 | 2 | 0 | Y | RTSWALCE | 90.62 | RTSWAFCE | 9.2 | | | | |
| NS4B | 2428 | 0.54 | 3 | 3 | 0 | Y | TSWALCEA | 89.56 | TSWAFCEA | 9.2 | TSWALCEV | 1.24 | | |
| NS4B | 2429 | 0.54 | 3 | 3 | 0 | Y | SWALCEAL | 89.56 | SWAFCEAL | 9.2 | SWALCEVL | 1.24 | | |
| NS4B | 2430 | 0.54 | 3 | 3 | 0 | Y | WALCEALT | 89.56 | WAFCEALT | 9.2 | WALCEVLT | 1.24 | | |
| NS4B | 2431 | 0.54 | 3 | 3 | 0 | Y | ALCEALTL | 89.56 | AFCEALTL | 9.2 | ALCEVLTL | 1.24 | | |
| NS4B | 2432 | 0.54 | 3 | 3 | 0 | Y | LCEALTLA | 89.56 | FCEALTLA | 9.2 | LCEVLTLA | 1.24 | | |
| NS4B | 2433 | 0.1 | 2 | 2 | 0 | Y | CEALTLAT | 98.76 | CEVLTLAT | 1.24 | | | | |
| NS4B | 2434 | 0.1 | 2 | 2 | 0 | Y | EALTLATG | 98.76 | EVLTLATG | 1.24 | | | | |
| NS4B | 2435 | 0.1 | 2 | 2 | 0 | Y | ALTLATGP | 98.76 | VLTLATGP | 1.24 | | | | |
| NS4B | 2436 | 0.02 | 2 | 1 | 0 | Y | LTLATGPI | 99.82 | | | | | | |
| NS4B | 2437 | 0.02 | 2 | 1 | 0 | Y | TLATGPIT | 99.82 | | | | | | |
| NS4B | 2438 | 0.02 | 2 | 1 | 0 | Y | LATGPITT | 99.82 | | | | | | |
| NS4B | 2439 | 0.02 | 2 | 1 | 0 | Y | ATGPITTL | 99.82 | | | | | | |
| NS4B | 2440 | 0.02 | 2 | 1 | 0 | Y | TGPITTLW | 99.82 | | | | | | |
| NS4B | 2441 | 0.02 | 2 | 1 | 0 | Y | GPITTLWE | 99.82 | | | | | | |
| NS4B | 2442 | 0.02 | 2 | 1 | 0 | Y | PITTLWEG | 99.82 | | | | | | |
| NS4B | 2443 | 0.02 | 2 | 1 | 0 | Y | ITTLWEGS | 99.82 | | | | | | |
| NS4B | 2444 | 0 | 1 | 1 | 0 | Y | TTLWEGSP | 100 | | | | | | |
| NS4B | 2445 | 0 | 1 | 1 | 0 | Y | TLWEGSPG | 100 | | | | | | |
| NS4B | 2446 | 0 | 1 | 1 | 0 | Y | LWEGSPGK | 100 | | | | | | |
| NS4B | 2447 | 0 | 1 | 1 | 0 | Y | WEGSPGKF | 100 | | | | | | |

Figure 10-100

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of

Figure 10-101

Species: DENV3 (8-mer)

| protein | block starting position | block entropy | total

Figure 10-102

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2496 | 0 | 1 | 1 | 0 | Y | GETLGEKW | 100 | | | | | | |
| NS5 | 2497 | 0 | 1 | 1 | 0 | Y | ETLGEKWK | 100 | | | | | | |
| NS5 | 2498 | 0.09 | 3 | 2 | 0 | Y | TLGEKWKK | 98.94 | TLGEKWKR | 0.71 | | | | |
| NS5 | 2499 | 0.2 | 5 | 3 | 0 | Y | LGEKWKKK | 97.7 | LGEKWKKR | 0.88 | LGEKWKRK | 0.71 | | |
| NS5 | 2500 | 0.2 | 5 | 3 | 0 | Y | GEKWKKKL | 97.7 | GEKWKKRL | 0.88 | GEKWKRKL | 0.71 | | |
| NS5 | 2501 | 0.2 | 5 | 3 | 0 | Y | EKWKKKLN | 97.7 | EKWKKRLN | 0.88 | EKWKRKLN | 0.71 | | |
| NS5 | 2502 | 0.2 | 5 | 3 | 0 | Y | KWKKKLNQ | 97.7 | KWKKRLNQ | 0.88 | KWKRKLNQ | 0.71 | | |
| NS5 | 2503 | 0.2 | 5 | 3 | 0 | Y | WKKKLNQL | 97.7 | WKKRLNQL | 0.88 | WKRKLNQL | 0.71 | | |
| NS5 | 2504 | 0.22 | 6 | 3 | 0 | Y | KKKLNQLS | 97.52 | KKRLNQLS | 0.88 | KRKLNQLS | 0.71 | | |
| NS5 | 2505 | 0.27 | 7 | 4 | 0 | Y | KKLNQLSR | 96.99 | KRLNQLSR | 0.88 | RKLNQLSR | 0.71 | KKLNQLSW | 0.53 |
| NS5 | 2506 | 0.22 | 6 | 4 | 0 | Y | KLNQLSRK | 97.52 | RLNQLSRK | 0.88 | KLNQLSRR | 0.53 | KLNQLSWK | 0.53 |
| NS5 | 2507 | 0.29 | 5 | 3 | 0 | Y | LNQLSRKE | 96.11 | LNQLSRKD | 2.65 | LNQLSWKE | 0.53 | | |
| NS5 | 2508 | 0.29 | 5 | 3 | 0 | Y | NQLSRKEF | 96.11 | NQLSRKDF | 2.65 | NQLSRREF | 0.53 | | |
| NS5 | 2509 | 0.31 | 6 | 3 | 0 | Y | QLSRKEFD | 95.93 | QLSRKDFD | 2.65 | QLSWKEFD | 0.53 | | |
| NS5 | 2510 | 0.31 | 6 | 3 | 0 | Y | LSRKEFDL | 95.93 | LSRKDFDL | 2.65 | LSRREFDL | 0.53 | | |
| NS5 | 2511 | 0.33 | 7 | 4 | 0 | Y | SRKEFDLY | 95.75 | SRKDFDLY | 2.65 | SWKEFDLY | 0.53 | SRREFDLY | 0.53 |
| NS5 | 2512 | 0.31 | 6 | 3 | 0 | Y | RKEFDLYK | 95.93 | RKDFDLYK | 2.65 | RREFDLYK | 0.53 | | |
| NS5 | 2513 | 0.26 | 5 | 2 | 0 | Y | KEFDLYKK | 96.46 | KDFDLYKK | 2.65 | | | | |
| NS5 | 2514 | 0.21 | 4 | 2 | 0 | Y | EFDLYKKS | 96.99 | DFDLYKKS | 2.65 | | | | |
| NS5 | 2515 | 0.04 | 3 | 1 | 0 | Y | FDLYKKSG | 99.65 | | | | | | |
| NS5 | 2516 | 0.04 | 3 | 1 | 0 | Y | DLYKKSGI | 99.65 | | | | | | |
| NS5 | 2517 | 0.02 | 2 | 1 | 0 | Y | LYKKSGIT | 99.82 | | | | | | |
| NS5 | 2518 | 0.02 | 2 | 1 | 0 | Y | YKKSGITE | 99.82 | | | | | | |
| NS5 | 2519 | 0 | 1 | 1 | 0 | Y | KKSGITEV | 100 | | | | | | |

Figure 10-103

Species: DENV3 (8-mer)

| protein | block starting position | block entropy | total peptides in block | peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2520 | 0.02 | 2 | 1 | 0 | Y | KSGITEVD | 99.82 | | | | | | |
| NS5 | 2521 | 0.02 | 2 | 1 | 0 | Y | SGITEVDR | 99.82 | | | | | | |
| NS5 | 2522 | 0.21 | 4 | 3 | 0 | Y | GITEVDRT | 97.35 | GITEVDRI | 1.59 | GITEVDRS | 0.88 | | |
| NS5 | 2523 | 0.23 | 5 | 3 | 0 | Y | ITEVDRTE | 97.17 | ITEVDRIE | 1.59 | ITEVDRSE | 0.88 | | |
| NS5 | 2524 | 0.23 | 5 | 3 | 0 | Y | TEVDRTEA | 97.17 | TEVDRIEA | 1.59 | TEVDRSEA | 0.88 | | |
| NS5 | 2525 | 0.23 | 5 | 3 | 0 | Y | EVDRTEAK | 97.17 | EVDRIEAK | 1.59 | EVDRSEAK | 0.88 | | |
| NS5 | 2526 | 0.23 | 5 | 3 | 0 | Y | VDRTEAKE | 97.17 | VDRIEAKE | 1.59 | VDRSEAKE | 0.88 | | |
| NS5 | 2527 | 0.23 | 5 | 3 | 0 | Y | DRTEAKEG | 97.17 | DRIEAKEG | 1.59 | DRSEAKEG | 0.88 | | |
| NS5 | 2528 | 0.21 | 4 | 3 | 0 | Y | RTEAKEGL | 97.35 | RIEAKEGL | 1.59 | RSEAKEGL | 0.88 | | |
| NS5 | 2529 | 0.26 | 5 | 3 | 0 | Y | TEAKEGLK | 96.81 | IEAKEGLK | 1.59 | SEAKEGLK | 0.88 | | |
| NS5 | 2530 | 0.11 | 4 | 2 | 0 | Y | EAKEGLKR | 98.76 | EAKEGLRR | 0.53 | | | | |
| NS5 | 2531 | 0.13 | 4 | 2 | 0 | Y | AKEGLKRG | 98.58 | AKEGLRRG | 0.53 | | | | |
| NS5 | 2532 | 0.13 | 4 | 2 | 0 | Y | KEGLKRGE | 98.58 | KEGLRRGE | 0.53 | | | | |
| NS5 | 2533 | 1.13 | 7 | 4 | 0 | Y | EGLKRGEI | 58.05 | EGLKRGET | 40.18 | EGLKKGEI | 0.53 | EGLKRRET | 0.35 |
| NS5 | 2534 | 1.13 | 7 | 4 | 0 | Y | GLKRGEIT | 58.05 | GLKRGETT | 40.18 | GLKKGEIT | 0.53 | GLRRGEIT | 0.35 |
| NS5 | 2537 | 1.16 | 9 | 5 | 0 | Y | RGEITHHA | 57.88 | RGETTHHA | 40 | KGEITHHA | 0.53 | RGEVTHHA | 0.35 |
| NS5 | 2538 | 1.12 | 8 | 4 | 0 | Y | GEITHHAV | 58.41 | GETTHHAV | 40 | RETTHHA | 0.35 | GEITRHAV | 0.35 |
| NS5 | 2539 | 1.09 | 7 | 3 | 0 | Y | EITHHAVS | 58.41 | ETTHHAVS | 40.35 | EVTHHAVS | 0.35 | | |
| NS5 | 2540 | 1.09 | 7 | 3 | 0 | Y | ITHHAVSR | 58.41 | TTHHAVSR | 40.35 | VTHHAVSR | 0.35 | | |
| NS5 | 2541 | 0.08 | 3 | 1 | 0 | Y | THHAVSRG | 99.12 | | | | | | |
| NS5 | 2542 | 0.23 | 4 | 2 | 0 | Y | HHAVSRGS | 96.99 | HHAVSRGT | 2.12 | | | | |
| NS5 | 2543 | 0.18 | 3 | 2 | 0 | Y | HAVSRGSA | 97.52 | HAVSRGTA | 2.12 | | | | |
| NS5 | 2544 | 0.15 | 2 | 2 | 0 | Y | AVSRGSAK | 97.88 | AVSRGTAK | 2.12 | | | | |
| NS5 | 2545 | 0.15 | 2 | 2 | 0 | Y | VSRGSAKL | 97.88 | VSRGTAKL | 2.12 | | | | |

Figure 10-104

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | fr

Figure 10-105

Species: DENV3 (8-mer)

| protein

Figure 10-106

Species: DENV3 (8-mer)

| protein | block starting position | block entropy | total peptides in block | peptides required to cover 99% of block | g

Figure 10-107

Species: DENV3 (8-mer)

| protein | block starting position | block entropy | total pe

Figure 10-108

Species: DENV3 (8-mer)

| protein | block starting position | block entropy | total peptides in block | peptides required to cover 99

Figure 10-109

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | fr

Figure 10-111

Species: DENV3 (8-mer)

| protein | block starting position | block entropy | total

Figure 10-112

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2738 | 0.23 | 3 | 3 | 0 | Y | RPTIEKDV | 96.81 | RPTIEKDV | 1.95 | RPTIERDV | 1.24 | | |
| NS5 | 2739 | 0.11 | 3 | 2 | 0 | Y | PTIEKDVD | 98.58 | PTIERDVD | 1.24 | | | | |
| NS5 | 2740 | 0.11 | 3 | 2 | 0 | Y | TIEKDVDL | 98.58 | TIERDVDL | 1.24 | | | | |
| NS5 | 2741 | 0.11 | 3 | 2 | 0 | Y | IEKDVDLG | 98.58 | IERDVDLG | 1.24 | | | | |
| NS5 | 2742 | 0.11 | 3 | 2 | 0 | Y | EKDVDLGA | 98.58 | ERDVDLGA | 1.24 | | | | |
| NS5 | 2743 | 0.11 | 3 | 2 | 0 | Y | KDVDLGAG | 98.58 | RDVDLGAG | 1.24 | | | | |
| NS5 | 2744 | 0.04 | 3 | 1 | 0 | Y | DVDLGAGT | 99.65 | | | | | | |
| NS5 | 2745 | 0.04 | 3 | 1 | 0 | Y | VDLGAGTR | 99.65 | | | | | | |
| NS5 | 2746 | 0.04 | 3 | 1 | 0 | Y | DLGAGTRH | 99.65 | | | | | | |
| NS5 | 2747 | 0.04 | 3 | 1 | 0 | Y | LGAGTRHV | 99.65 | | | | | | |
| NS5 | 2748 | 0.06 | 4 | 1 | 0 | Y | GAGTRHVN | 99.47 | | | | | | |
| NS5 | 2749 | 0.06 | 4 | 1 | 0 | Y | AGTRHVNA | 99.47 | | | | | | |
| NS5 | 2750 | 0.06 | 4 | 1 | 0 | Y | GTRHVNAE | 99.47 | | | | | | |
| NS5 | 2751 | 0.06 | 4 | 1 | 0 | Y | TRHVNAEP | 99.47 | | | | | | |
| NS5 | 2752 | 0.06 | 4 | 1 | 0 | Y | RHVNAEPE | 99.47 | | | | | | |
| NS5 | 2753 | 0.14 | 5 | 2 | 0 | Y | HVNAEPET | 98.41 | HVNAEPEI | 1.06 | | | | |
| NS5 | 2754 | 0.14 | 5 | 2 | 0 | Y | VNAEPETP | 98.41 | VNAEPEIP | 1.06 | | | | |
| NS5 | 2755 | 0.12 | 4 | 2 | 0 | Y | NAEPETPN | 98.58 | NAEPEIPN | 1.06 | | | | |
| NS5 | 2756 | 0.1 | 3 | 2 | 0 | Y | AEPETPNM | 98.76 | AEPEIPNM | 1.06 | | | | |
| NS5 | 2757 | 0.12 | 4 | 2 | 0 | Y | EPETPNMD | 98.58 | EPEIPNMD | 1.06 | | | | |
| NS5 | 2758 | 0.14 | 5 | 2 | 0 | Y | PETPNMDV | 98.41 | PEIPNMDV | 1.06 | | | | |
| NS5 | 2759 | 0.14 | 5 | 2 | 0 | Y | ETPNMDVI | 98.41 | EIPNMDVI | 1.06 | | | | |
| NS5 | 2760 | 0.14 | 5 | 2 | 0 | Y | TPNMDVIG | 98.41 | IPNMDVIG | 1.06 | | | | |
| NS5 | 2761 | 0.04 | 3 | 1 | 0 | Y | PNMDVIGE | 99.65 | | | | | | |

Figure 10-113

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to c

Figure 10-114

Species: DENV3 (8-mer)

| protein | block starting position | block entropy | total peptides in block | pe

Figure 10-115

| Species: DENV3 (8-mer) | | | | | | | | | | | | | | | |
|---|---|---|---|---|---|---|---|---|---|---|---|---|---|---|---|
| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | frequency |
| NS5 | 2811 | 0 | 1 | 1 | 0 | Y | NGVVKLLT | 100 | | | | | | | |
| NS5 | 2812 | 0 | 1 | 1 | 0 | Y | GVVKLLTK | 100 | | | | | | | |
| NS5 | 2813 | 0 | 1 | 1 | 0 | Y | VKLLTKP | 100 | | | | | | | |
| NS5 | 2814 | 0 | 1 | 1 | 0 | Y | VKLLTKPW | 100 | | | | | | | |
| NS5 | 2815 | 0 | 1 | 1 | 0 | Y | KLLTKPWD | 100 | | | | | | | |
| NS5 | 2816 | 0 | 1 | 1 | 0 | Y | LLTKPWDV | 100 | | | | | | | |
| NS5 | 2817 | 0 | 1 | 1 | 0 | Y | LTKPWDVV | 100 | | | | | | | |
| NS5 | 2818 | 0 | 1 | 1 | 0 | Y | TKPWDVVP | 100 | | | | | | | |
| NS5 | 2819 | 0.37 | 2 | 2 | 0 | Y | KPWDVVPM | 92.92 | KPWDVVPT | 7.08 | | | | | |
| NS5 | 2820 | 0.37 | 2 | 2 | 0 | Y | PWDVVPMV | 92.92 | PWDVVPTV | 7.08 | | | | | |
| NS5 | 2821 | 0.51 | 4 | 3 | 0 | Y | WDVVPMVT | 90.97 | WDVVPTVT | 7.08 | WDVVPMVI | 1.77 | | | |
| NS5 | 2822 | 0.51 | 4 | 3 | 0 | Y | DVVPMVTQ | 90.97 | DVVPTVTQ | 7.08 | DVVPMVIQ | 1.77 | | | |
| NS5 | 2823 | 0.51 | 4 | 3 | 0 | Y | VVPMVTQM | 90.97 | VVPTVTQM | 7.08 | VPMVIQM | 1.77 | | | |
| NS5 | 2824 | 0.51 | 4 | 3 | 0 | Y | VPMVTQMA | 90.97 | VPTVTQMA | 7.08 | VPMVIQMA | 1.77 | | | |
| NS5 | 2825 | 0.51 | 4 | 3 | 0 | Y | PMVTQMAM | 90.97 | PTVTQMAM | 7.08 | PMVIQMAM | 1.77 | | | |
| NS5 | 2826 | 0.15 | 3 | 2 | 0 | Y | MVTQMAMT | 98.05 | TVTQMAMT | 7.08 | MVIQMAMT | 1.77 | | | |
| NS5 | 2827 | 0.15 | 3 | 2 | 0 | Y | VTQMAMTD | 98.05 | VIQMAMTD | 1.77 | | | | | |
| NS5 | 2828 | 0 | 1 | 1 | 0 | Y | TQMAMTDT | 100 | IQMAMTDT | 1.77 | | | | | |
| NS5 | 2829 | 0 | 1 | 1 | 0 | Y | QMAMTDTT | 100 | | | | | | | |
| NS5 | 2830 | 0 | 1 | 1 | 0 | Y | MAMTDTTP | 100 | | | | | | | |
| NS5 | 2831 | 0 | 1 | 1 | 0 | Y | AMTDTTPF | 100 | | | | | | | |
| NS5 | 2832 | 0 | 1 | 1 | 0 | Y | MTDTTPFG | 100 | | | | | | | |
| NS5 | 2833 | 0.02 | 2 | 1 | 0 | Y | TDTTPFGQ | 99.82 | | | | | | | |
| NS5 | 2834 | 0.02 | 2 | 1 | 0 | Y | DTTPFGQQ | 99.82 | | | | | | | |

Figure 10-116

Species: DENV3 (8-mer)

| protein | block starting position | block entropy | total

Figure 10-117

Species: DENV3 (8-mer)

| protein | block starting position | block entropy | total peptides in block | peptides required to cover 99% of block | gap/X fraction | 99% of block covered w/ =< 5 peptides? | peptides required to cover 99% of block | frequency | peptides required to cover 99% of block | frequency |
|---|---|---|---|---|---|---|---|---|---|---|
| NS5 | 2864 | 1.06 | 4 | 2 | 0 | Y | EITAEWLW | 52.57 | GITAEWLW | 46.73 |
| NS5 | 2865 | 0.12 | 5 | 2 | 0 | Y | ITAEWLWR | 98.76 | ITAGWLWR | 0.53 |
| NS5 | 2866 | 0.12 | 5 | 2 | 0 | Y | TAEWLWRT | 98.76 | TAGWLWRT | 0.53 |
| NS5 | 2867 | 0.12 | 5 | 2 | 0 | Y | AEWLWRTL | 98.76 | AGWLWRTL | 0.53 |
| NS5 | 2868 | 0.12 | 5 | 2 | 0 | Y | EWLWRTLG | 98.76 | GWLWRTLG | 0.53 |
| NS5 | 2869 | 0.07 | 4 | 1 | 0 | Y | WLWRTLGR | 99.29 | | |
| NS5 | 2870 | 0.07 | 4 | 1 | 0 | Y | LWRTLGRN | 99.29 | | |
| NS5 | 2871 | 0.07 | 4 | 1 | 0 | Y | WRTLGRNK | 99.29 | | |
| NS5 | 2872 | 0.94 | 5 | 2 | 0 | Y | RTLGRNKR | 70.27 | RTLGRNKR | 29.03 |
| NS5 | 2873 | 0.89 | 3 | 2 | 0 | Y | TLGRNKKP | 70.8 | TLGRNKRP | 29.03 |
| NS5 | 2874 | 0.87 | 2 | 2 | 0 | Y | LGRNKKPR | 70.97 | LGRNKRPR | 29.03 |
| NS5 | 2875 | 0.87 | 2 | 2 | 0 | Y | GRNKKPRL | 70.97 | GRNKRPRL | 29.03 |
| NS5 | 2876 | 0.87 | 2 | 2 | 0 | Y | RNKKPRLC | 70.97 | RNKRPRLC | 29.03 |
| NS5 | 2877 | 0.89 | 3 | 2 | 0 | Y | NKKPRLCT | 70.8 | NKRPRLCT | 29.03 |
| NS5 | 2878 | 0.89 | 3 | 2 | 0 | Y | KKPRLCTR | 70.8 | KRPRLCTR | 29.03 |
| NS5 | 2879 | 0.89 | 3 | 2 | 0 | Y | KPRLCTRE | 70.8 | RPRLCTRE | 29.03 |
| NS5 | 2880 | 0.02 | 2 | 1 | 0 | Y | PRLCTREE | 99.82 | | |
| NS5 | 2881 | 0.02 | 2 | 1 | 0 | Y | RLCTREEF | 99.82 | | |
| NS5 | 2882 | 0.17 | 4 | 2 | 0 | Y | LCTREEFI | 97.88 | LCTREEFI | 1.77 |
| NS5 | 2883 | 0.2 | 5 | 2 | 0 | Y | CTREEFTK | 97.52 | CTREEFIK | 1.77 |
| NS5 | 2884 | 0.2 | 5 | 2 | 0 | Y | TREEFTKK | 97.52 | TREEFIKK | 1.77 |
| NS5 | 2885 | 0.2 | 5 | 2 | 0 | Y | REEFTKKV | 97.52 | REEFIKKV | 1.77 |
| NS5 | 2886 | 0.2 | 5 | 2 | 0 | Y | EEFTKKVR | 97.52 | EEFIKKVR | 1.77 |
| NS5 | 2887 | 0.2 | 5 | 2 | 0 | Y | EFTKKVRT | 97.52 | EFIKKVRT | 1.77 |

Figure 10-118

Species: DENV3 (8-mer)

| protein

Figure 10-119

Species: DENV3 (8-mer)

| protein | block starting position | block entropy | total peptides in block | peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2912 | 1.44 | 6 | 3 | 0 | Y | KAAVEDED

Figure 10-120

Species: DENV3 (8-mer)

| protein | block starting position | block

Figure 10-121

Species: DENV3 (8-mer)

| protein | block starting position | block entropy | total peptides in block | peptides required to cover 99

Figure 10-122

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|

Figure 10-123

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequ

Figure 10-124

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99

Figure 10-125

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | fr

Figure 10-126

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3080 | 0 | 1 | 1 | 0 | Y | DIISRKDQ | 100 | | | | | | |
| NS5 | 3081 | 0 | 1 | 1 | 0 | Y | IISRKDQR | 100 | | | | | | |
| NS5 | 3082 | 0 | 1 | 1 | 0 | Y | ISRKDQRG | 100 | | | | | | |
| NS5 | 3083 | 0 | 1 | 1 | 0 | Y | SRKDQRGS | 100 | | | | | | |
| NS5 | 3084 | 0 | 1 | 1 | 0 | Y | RKDQRGSG | 100 | | | |

Figure 10-127

Species: DENV3 (8-mer)

|

Figure 10-129

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3176 | 0.04 | 3 | 1 | 0 | Y | GKVRKDIP | 99.65 | | |
| NS5 | 3177 | 0.04 | 3 | 1 | 0 | Y | KVRKDIPQ | 99.65 | | |
| NS5 | 3178 | 0.04 | 3 | 1 | 0 | Y | VRKDIPQW | 99.65 | | |
| NS5 | 3179 | 0.02 | 2 | 1 | 0 | Y | RKDIPQWQ | 99.82 | | |
| NS5 | 3180 | 0.02 | 2 | 1 | 0 | Y | KDIPQWQP | 99.82 | | |
| NS5 | 3181 | 0.02 | 2 | 1 | 0 | Y | DIPQWQPS | 99.82 | | |
| NS5 | 3182 | 0.05 | 3 | 1 | 0 | Y | IPQWQPSK | 99.47 | | |
| NS5 | 3183 | 0.03 | 2 | 1 | 0 | Y | PQWQPSKG | 99.65 | | |
| NS5 | 3184 | 0.05 | 3 | 1 | 0 | Y | QWQPSKGW | 99.47 | | |
| NS5 | 3185 | 0.16 | 4 | 2 | 0 | Y | WQPSKGWH | 98.05 | WQPSKGWQ | 1.42 |
| NS5 | 3186 | 0.16 | 4 | 2 | 0 | Y | QPSKGWHD | 98.05 | QPSKGWQD | 1.42 |
| NS5 | 3187 | 0.16 | 4 | 2 | 0 | Y | PSKGWHDW | 98.05 | PSKGWQDW | 1.42 |
| NS5 | 3188 | 0.16 | 4 | 2 | 0 | Y | SKGWHDWQ | 98.05 | SKGWQDWQ | 1.42 |
| NS5 | 3189 | 0.16 | 4 | 2 | 0 | Y | KGWHDWQQ | 98.05 | KGWQDWQQ | 1.42 |
| NS5 | 3190 | 0.13 | 3 | 2 | 0 | Y | GWHDWQQV | 98.41 | GWQDWQQV | 1.42 |
| NS5 | 3191 | 0.13 | 3 | 2 | 0 | Y | WHDWQQVP | 98.41 | WQDWQQVP | 1.42 |
| NS5 | 3192 | 0.11 | 2 | 2 | 0 | Y | HDWQQVPF | 98.58 | QDWQQVPF | 1.42 |
| NS5 | 3193 | 0 | 1 | 1 | 0 | Y | DWQQVPFC | 100 | | |
| NS5 | 3194 | 0 | 1 | 1 | 0 | Y | WQQVPFCS | 100 | | |
| NS5 | 3195 | 0 | 1 | 1 | 0 | Y | QQVPFCSH | 100 | | |
| NS5 | 3196 | 0 | 1 | 1 | 0 | Y | QVPFCSHH | 100 | | |
| NS5 | 3197 | 0 | 1 | 1 | 0 | Y | VPFCSHHF | 100 | | |
| NS5 | 3198 | 0 | 1 | 1 | 0 | Y | PFCSHHFH | 100 | | |
| NS5 | 3199 | 0 | 1 | 1 | 0 | Y | FCSHHFHE | 100 | | |

Figure 10-130

Species: DENV3 (8-mer)

| protein | block starting position | block

Figure 10-131

Species: DENV3 (8-mer)

| protein | block starting position | block entropy | total peptides in block | peptides required to cover 99% of block | g

Figure 10-132

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3248 | 0.55 | 4 | 3 | 0 | Y | AYAQMWSL | 89.38 | AYAQMWAL | 9.38 | AYAQMWTL | 0.88 | | |
| NS5 | 3249 | 0.55 | 4 | 3 | 0 | Y | YAQMWSLM | 89.38 | YAQMWALM | 9.38 | YAQMWTLM | 0.88 | | |
| NS5 | 3250 | 0.55 | 4 | 3 | 0 | Y | AQMWSLMY | 89.38 | AQMWALMY | 9.38 | AQMWTLMY | 0.88 | | |
| NS5 | 3251 | 0.55 | 4 | 3 | 0 | Y | QMWSLMYF | 89.38 | QMWALMYF | 9.38 | QMWTLMYF | 0.88 | | |
| NS5 | 3252 | 0.55 | 4 | 3 | 0 | Y | MWSLMYFH | 89.38 | MWALMYFH | 9.38 | MWTLMYFH | 0.88 | | |
| NS5 | 3253 | 0.55 | 4 | 3 | 0 | Y | WSLMYFHR | 89.38 | WALMYFHR | 9.38 | WTLMYFHR | 0.88 | | |
| NS5 | 3254 | 0.55 | 4 | 3 | 0 | Y | SLMYFHRR | 89.38 | ALMYFHRR | 9.38 | TLMYFHRR | 0.88 | | |
| NS5 | 3255 | 0 | 1 | 1 | 0 | Y | LMYFHRRD | 100 | | | | | | |
| NS5 | 3256 | 0 | 1 | 1 | 0 | Y | MYFHRRDL | 100 | | | | | | |
| NS5 | 3257 | 0 | 1 | 1 | 0 | Y | YFHRRDLR | 100 | | | | | | |
| NS5 | 3258 | 0 | 1 | 1 | 0 | Y | FHRRDLRL | 100 | | | | | | |
| NS5 | 3259 | 0 | 1 | 1 | 0 | Y | HRRDLRLA | 100 | | | | | | |
| NS5 | 3260 | 0 | 1 | 1 | 0 | Y | RRDLRLAS | 100 | | | | | | |
| NS5 | 3261 | 0 | 1 | 1 | 0 | Y | RDLRLASN | 100 | | | | | | |
| NS5 | 3262 | 0 | 1 | 1 | 0 | Y | DLRLASNA | 100 | | | | | | |
| NS5 | 3263 | 0 | 1 | 1 | 0 | Y | LRLASNAI | 100 | | | | | | |
| NS5 | 3264 | 0 | 1 | 1 | 0 | Y | RLASNAIC | 100 | | | | | | |
| NS5 | 3265 | 0 | 1 | 1 | 0 | Y | LASNAICS | 100 | | | | | | |
| NS5 | 3266 | 0 | 1 | 1 | 0 | Y | ASNAICSA | 100 | | | | | | |
| NS5 | 3267 | 0 | 1 | 1 | 0 | Y | SNAICSAV | 100 | | | | | | |
| NS5 | 3268 | 0 | 1 | 1 | 0 | Y | NAICSAVP | 100 | | | | | | |
| NS5 | 3269 | 0.17 | 2 | 2 | 0 | Y | AICSAVPV | 97.52 | AICSAVPA | 2.48 | | | | |
| NS5 | 3270 | 0.17 | 2 | 2 | 0 | Y | ICSAVPVH | 97.52 | ICSAVPAH | 2.48 | | | | |
| NS5 | 3271 | 0.17 | 2 | 2 | 0 | Y | CSAVPVHW | 97.52 | CSAVPAHW | 2.48 | | | | |

Figure 10-133

Species: DENV3 (8-mer)

|

Figure 10-134

Species: DENV3 (8

Figure 10-135

Species: DENV3 (8-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3320 | 1.14 | 8 | 4 | 0 | Y | PVTTWENV | 60.53 | PVTTWEDV | 37.35 | PITTWENV | 0.71 | PITTWEDV | 0.53 |
| NS5 | 3321 | 1.14 | 8 | 4 | 0 | Y | VTTWENVP | 60.53 | VTTWEDVP | 37.35 | ITTWENVP | 0.71 | ITTWEDVP | 0.53 |
| NS5 | 3322 | 1.04 | 6 | 2 | 0 | Y | TTWENVPY | 61.24 | TTWEDVPY | 37.88 | | | | |
| NS5 | 3323 | 0.99 | 3 | 2 | 0 | Y | TWENVPYL | 61.24 | TWEDVPYL | 38.41 | | | | |
| NS5 | 3324 | 0.99 | 3 | 2 | 0 | Y | WENVPYLG | 61.24 | WEDVPYLG | 38.41 | | | | |
| NS5 | 3325 | 0.99 | 3 | 2 | 0 | Y | ENVPYLGK | 61.24 | EDVPYLGK | 38.41 | | | | |
| NS5 | 3326 | 0.99 | 3 | 2 | 0 | Y | NVPYLGKR | 61.24 | DVPYLGKR | 38.41 | | | | |
| NS5 | 3327 | 0.03 | 2 | 1 | 0 | Y | VPYLGKRE | 99.65 | | | | | | |
| NS5 | 3328 | 0 | 1 | 1 | 0 | Y | PYLGKRED | 100 | | | | | | |
| NS5 | 3329 | 0 | 1 | 1 | 0 | Y | YLGKREDQ | 100 | | | | | | |
| NS5 | 3330 | 0 | 1 | 1 | 0 | Y | LGKREDQW | 100 | | | | | | |
| NS5 | 3331 | 0 | 1 | 1 | 0 | Y | GKREDQWC | 100 | | | | | | |
| NS5 | 3332 | 0 | 1 | 1 | 0 | Y | KREDQWCG | 100 | | | | | | |
| NS5 | 3333 | 0 | 1 | 1 | 0 | Y | REDQWCGS | 100 | | | | | | |
| NS5 | 3334 | 0.02 | 2 | 1 | 0 | Y | EDQWCGSL | 99.82 | | | | | | |
| NS5 | 3335 | 0.02 | 2 | 1 | 0 | Y | DQWCGSLI | 99.82 | | | | | | |
| NS5 | 3336 | 0.02 | 2 | 1 | 0 | Y | QWCGSLIG | 99.82 | | | | | | |
| NS5 | 3337 | 0.04 | 3 | 1 | 0 | Y | WCGSLIGL | 99.65 | | | | | | |
| NS5 | 3338 | 0.06 | 4 | 1 | 0 | Y | CGSLIGLT | 99.47 | | | | | | |
| NS5 | 3339 | 0.06 | 4 | 1 | 0 | Y | GSLIGLTS | 99.47 | | | | | | |
| NS5 | 3340 | 0.06 | 4 | 1 | 0 | Y | SLIGLTSR | 99.47 | | | | | | |
| NS5 | 3341 | 0.07 | 5 | 1 | 0 | Y | LIGLTSRA | 99.29 | | | | | | |
| NS5 | 3342 | 0.06 | 4 | 1 | 0 | Y | IGLTSRAT | 99.47 | | | | | | |
| NS5 | 3343 | 0.06 | 4 | 1 | 0 | Y | GLTSRATW | 99.47 | | | | | | |

Figure 10-136

Species: DENV3 (8-mer)

| protein | block starting position | block entropy | total

Figure 10-137

Species: DENV3 (8-mer)

| protein | block starting position | block entropy | total pe

FIG. 11-1

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| anC | 1 | 0.15 | 3 | 2 | 0 | Y | MNNQRKKTG | 98.05 | MNN

FIG. 11-2

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency |
|---|---|---|---|---|---|---|---|---|---|---|---|---|
| anC | 27 | 1 | 4 | 2 | 0 | Y | SQLAKRFSK | 64.07 | SQLAKRFSR | 35.22 | | |
| anC | 28 | 1.03 | 3 | 3 | 0 | Y | QLAKRFSKG | 63.01 | QLAKRFSRG | 35.75 | QLAKRFSKE | 1.24 |
| anC | 29 | 1.03 | 3 | 3 | 0 | Y | LAKRFSKGL | 63.01 | LAKRFSRGL | 35.75 | LAKRFSKEL | 1.24 |
| anC | 30 | 1.03 | 3 | 3 | 0 | Y | AKRFSKGLL | 63.01 | AKRFSRGLL | 35.75 | AKRFSKELL | 1.24 |
| anC | 31 | 1.05 | 4 | 3 | 0 | Y | KRFSKGLLN | 62.83 | KRFSRGLLN | 35.75 | KRFSKELLN | 1.24 |
| anC | 32 | 1.05 | 4 | 3 | 0 | Y | RFSKGLLNG | 62.83 | RFSRGLLNG | 35.75 | RFSKELLNG | 1.24 |
| anC | 33 | 1.05 | 4 | 3 | 0 | Y | FSKGLLNGQ | 62.83 | FSRGLLNGQ | 35.75 | FSKELLNGQ | 1.24 |
| anC | 34 | 1.05 | 4 | 3 | 0 | Y | SKGLLNGQG | 62.83 | SRGLLNGQG | 35.75 | SKELLNGQG | 1.24 |
| anC | 35 | 1.05 | 3 | 2 | 0 | Y | KGLLNGQGP | 62.83 | RGLLNGQGP | 35.75 | KELLNGQGP | 1.24 |
| anC | 36 | 0.11 | 3 | 1 | 0 | Y | GLLNGQGPM | 98.58 | ELLNGQGPM | 1.24 | | |
| anC | 37 | 0.07 | 3 | 1 | 0 | Y | LLNGQGPMK | 99.29 | | | | |
| anC | 38 | 0.07 | 2 | 1 | 0 | Y | LNGQGPMKL | 99.29 | | | | |
| anC | 39 | 0.07 | 2 | 1 | 0 | Y | NGQGPMKLV | 99.29 | | | | |
| anC | 40 | 0.05 | 3 | 1 | 0 | Y | GQGPMKLVM | 99.47 | | | | |
| anC | 41 | 0.05 | 3 | 1 | 0 | Y | QGPMKLVMA | 99.47 | | | | |
| anC | 42 | 0.07 | 3 | 1 | 0 | Y | GPMKLVMAF | 99.29 | | | | |
| anC | 43 | 0.07 | 3 | 1 | 0 | Y | PMKLVMAFI | 99.29 | | | | |
| anC | 44 | 0.07 | 3 | 1 | 0 | Y | MKLVMAFIA | 99.29 | | | | |
| anC | 45 | 0.07 | 3 | 1 | 0 | Y | KLVMAFIAF | 99.29 | | | | |
| anC | 46 | 0.02 | 2 | 1 | 0 | Y | LVMAFIAFL | 99.82 | | | | |
| anC | 47 | 0.02 | 2 | 1 | 0 | Y | VMAFIAFLR | 99.82 | | | | |
| anC | 48 | 0.02 | 2 | 1 | 0 | Y | MAFIAFLRF | 99.82 | | | | |
| anC | 49 | 0.02 | 2 | 1 | 0 | Y | AFIAFLRFL | 99.82 | | | | |
| anC | 50 | 0.02 | 2 | 1 | 0 | Y | FIAFLRFLA | 99.82 | | | | |
| anC | 51 | 0 | 1 | 1 | 0 | Y | IAFLRFLAI | 100 | | | | |
| anC | 52 | 0 | 1 | 1 | 0 | Y | AFLRFLAIP | 100 | | | | |

FIG. 11-4

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---

FIG. 11-5

Species: DENV3 (9-mer)

| protein | block starting position | block entropy | total peptides in block | peptides required to cover 99% of block | gap

FIG. 11-6

Species: DENV3 (9-mer)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 140 | 0.13 | 4 | 2 | 0 | Y | KTASGINMC | 98.41 | KTASGINMC | 1.24 | | | | | | |
| prM | 141 | 0.13 | 4 | 2 | 0 | Y | TASGINMCT | 98.41 | TASGINMCT | 1.24 | | | | | | |
| prM | 142 | 0.13 | 4 | 2 | 0 | Y | ASGINMCTL | 98.41 | ATGINMCTL | 1.24 | | | | | | |
| prM | 143 | 0.11 | 3 | 2 | 0 | Y | SGINMCTLI | 98.58 | TGINMCTLI | 1.24 | | | | | | |
| prM | 144 | 0.02 | 2 | 1 | 0 | Y | GINMCTLIA | 99.82 | | | | | | | | |
| prM | 145 | 0.02 | 2 | 1 | 0 | Y | INMCTLIAM | 99.82 | | | | | | | | |
| prM | 146 | 0 | 1 | 1 | 0 | Y | NMCTLIAMD | 100 | | | | | | | | |
| prM | 147 | 0 | 1 | 1 | 0 | Y | MCTLIAMDL | 100 | | | | | | | | |
| prM | 148 | 0 | 1 | 1 | 0 | Y | CTLIAMDLG | 100 | | | | | | | | |
| prM | 149 | 0 | 1 | 1 | 0 | Y | TLIAMDLGE | 100 | | | | | | | | |
| prM | 150 | 0 | 1 | 1 | 0 | Y | LIAMDLGEM | 100 | | | | | | | | |
| prM | 151 | 0 | 1 | 1 | 0 | Y | IAMDLGEMC | 100 | | | | | | | | |
| prM | 152 | 0 | 1 | 1 | 0 | Y | AMDLGEMCD | 100 | | | | | | | | |
| prM | 153 | 0 | 1 | 1 | 0 | Y | MDLGEMCDD | 100 | | | | | | | | |
| prM | 154 | 0 | 1 | 1 | 0 | Y | DLGEMCDDT | 100 | | | | | | | | |
| prM | 155 | 0.1 | 2 | 2 | 0 | Y | LGEMCDDTV | 98.76 | LGEMCDDTI | 1.24 | | | | | | |
| prM | 156 | 0.1 | 2 | 2 | 0 | Y | GEMCDDTVT | 98.76 | GEMCDDTIT | 1.24 | | | | | | |
| prM | 157 | 0.1 | 2 | 2 | 0 | Y | EMCDDTVTY | 98.76 | EMCDDTITY | 1.24 | | | | | | |
| prM | 158 | 0.11 | 3 | 2 | 0 | Y | MCDDTVTYK | 98.58 | MCDDTITYK | 1.24 | | | | | | |
| prM | 159 | 0.11 | 3 | 2 | 0 | Y | CDDTVTYKC | 98.58 | CDDTITYK | 1.24 | | | | | | |
| prM | 160 | 0.11 | 3 | 2 | 0 | Y | DDTVTYKCP | 98.58 | DDTITYKCP | 1.24 | | | | | | |
| prM | 161 | 1.14 | 6 | 4 | 0 | Y | DTVTYKCPH | 64.07 | DTVTYKCPL | 32.92 | DTVTYKCPF | 1.59 | DTITYKCPL | 1.06 | | |
| prM | 162 | 1.16 | 7 | 4 | 0 | Y | TVTYKCPHI | 64.07 | TVTYKCPLI | 32.57 | TVTYKCPFI | 1.59 | TITYKCPLI | 1.06 | | |
| prM | 164 | 1.65 | 8 | 5 | 0 | Y | TYKCPHITE | 59.12 | TYKCPLIAE | 23.54 | TYKCPLITE | 9.91 | TYKCPHIAE | 5.13 | TYKCPFIAE | 1.59 |
| prM | 170 | 0.99 | 7 | 3 | 0 | Y | ITEVEPEDI | 68.85 | IAEVEPEDI | 30.09 | VAEVEPEDI | 0.35 | | | | |
| prM | 171 | 0.96 | 6 | 2 | 0 | Y | TEVEPEDID | 68.85 | AEVEPEDID | 30.44 | | | | | | |

FIG. 11-8

Species: DENV3 (9-mer)

| protein | block starting position | block entropy | total peptides in block | peptides required to cover 99% of block | gap/X fraction | 99% of block covered w/ <= 5 peptides? | block | frequency | block

FIG. 11-10

Species: DENV3 (9-mer)

| protein | block starting position | block entropy | total peptides in block | peptides required to cover 99% of block | gap/X fraction | covered w/ <= 5 peptides? | block | frequency | block | frequency | block | frequency | block | frequency |
|---|---|---|---|---|---|---|---|---|---|---|---|---|---|---|
| pM | 250 | 0.12 | 5 | 2 | 0 | Y | LALFLAHYI | 98.76 | LALFLAHYW | 0

FIG. 11-11

Species: DENV3 (9-mer)

| protein | block starting position | block entropy | total peptides in block | peptides required to cover 99% of block | gap/X fraction | 99% of block covered w/ <= 5 peptides? | block | frequency | block | frequency |
|---|---|---|

FIG. 11-12

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block |

FIG. 11-14

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | fr

FIG. 11-16

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | peptides required to cover 99% of block | block | frequency |
|---|---|---|---|---|---|---|

FIG. 11-17

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 436 | 0.92 | 6 | 3 | 0 | Y | QGVTAEITP | 73.63 | QGVTAEITP | 25.31 | | | QGVTAEITS | 0.53 |
| E | 437 | 0.92 | 6 | 3 | 0 | Y | GVTAEITPQ | 73.63 | GVTAEITPQ | 25.31 | | | GVTAEITSQ | 0.53 |
| E | 438 | 0.92 | 6 | 3 | 0 | Y | VTAEITPQA | 73.63 | VTAEITPQA | 25.31 | | | VTAEITSQA | 0.53 |
| E | 439 | 0.88 | 4 | 2 | 0 | Y | TAEITPQAS | 73.81 | TVEITPQAS | 25.49 | | | | |
| E | 440 | 0.91 | 4 | 3 | 0 | Y | AEITPQAST | 73.45 | VEITPQAST | 25.49 | | | AEITSQAST | 0.53 |
| E | 441 | 1.13 | 7 | 4 | 0 | Y | EITPQASTT | 61.77 | EITPQASTV | 35.93 | EITPQASTA | 0.88 | EITPQASIT | 0.53 |
| E | 442 | 1.13 | 7 | 4 | 0 | Y | ITPQASTTE | 61.77 | ITPQASTVE | 35.93 | ITPQASTAE | 0.88 | ITSQASTAE | 0.53 |
| E | 443 | 1.18 | 8 | 5 | 0 | Y | TPQASTTEA | 61.24 | TPQASTVEA | 35.93 | TPQASTAEA | 0.88 | TPQASITEA | 0.53 |
| E | 445 | 1.51 | 8 | 5 | 0 | Y | QASTTEAIL | 61.24 | QASTVEAIL | 21.24 | QASTAEAIL | 14.69 | QASITEAIL | 1.42 |
| E | 449 | 1.48 | 8 | 5 | 0 | Y | TEAILPEYG | 61.77 | VEAVLPEYG | 21.06 | AEAILPEYG | 14.69 | AEAILPEYG | 1.42 |
| E | 450 | 0.86 | 7 | 3 | 0 | Y | EAILPEYGT | 77.88 | EAVLPEYGT | 20.88 | EVILPEYGT | 0.53 | | |
| E | 451 | 0.86 | 7 | 3 | 0 | Y | AILPEYGTL | 77.88 | AVLPEYGTL | 20.88 | VILPEYGTL | 0.53 | | |
| E | 452 | 0.83 | 7 | 2 | 0 | Y | ILPEYGTLG | 78.23 | VLPEYGTLG | 20.88 | | | | |
| E | 453 | 0.07 | 5 | 1 | 0 | Y | LPEYGTLGL | 99.29 | | | | | | |
| E | 454 | 0.07 | 5 | 1 | 0 | Y | PEYGTLGLE | 99.29 | | | | | | |
| E | 455 | 0.07 | 5 | 1 | 0 | Y | EYGTLGLEC | 99.29 | | | | | | |
| E | 456 | 0.07 | 5 | 1 | 0 | Y | YGTLGLECS | 99.29 | | | | | | |
| E | 457 | 0.07 | 5 | 1 | 0 | Y | GTLGLECSP | 99.29 | | | | | | |
| E | 458 | 0.07 | 5 | 1 | 0 | Y | TLGLECSPR | 99.29 | | | | | | |
| E | 459 | 0.06 | 4 | 1 | 0 | Y | LGLECSPRT | 99.47 | | | | | | |
| E | 460 | 0.06 | 4 | 1 | 0 | Y | GLECSPRTG | 99.47 | | | | | | |
| E | 461 | 0.04 | 3 | 1 | 0 | Y | LECSPRTGL | 99.65 | | | | | | |
| E | 462 | 0.04 | 3 | 1 | 0 | Y | ECSPRTGLD | 99.65 | | | | | | |
| E | 463 | 0.02 | 2 | 1 | 0 | Y | CSPRTGLDF | 99.82 | | | | | | |
| E | 464 | 0.04 | 3 | 1 | 0 | Y | SPRTGLDFN | 99.65 | | | | | | |
| E | 465 | 0.04 | 3 | 1 | 0 | Y | PRTGLDFNE | 99.65 | | | | | | |

Additional entries (rightmost column, frequency 0.53): TSQASTAEA (pos 443), QASITEAIL (pos 445), TEVILPEYG (pos 449).

FIG. 11-19

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 492 | 0.48 | 4 | 2 | 0 | Y | FDLPLPWTS | 90.44 | FDLPLPWAS | 9.2 | | | | |
| E | 493 | 0.46 | 3 | 2 | 0 | Y | DLPLPWTSG | 90.62 | DLPLPW

FIG. 11-20

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 525 | 0 | 1 | 1 | 0 | Y | KQEVWLGS | 100 | | | | | | |
| E | 526 | 0 | 1 | 1 | 0 | Y | QEVWLGSQ | 100 | | | | | | |
| E | 527 | 0 | 1 | 1 | 0 | Y | EVWLGSQE | 100 | | | | | | |
| E | 528 | 0 | 1 | 1 | 0 | Y | VWLGSQEG | 100 | | | | | | |
| E | 529 | 0 | 1 | 1 | 0 | Y | WLGSQEGA | 100 | | | | | | |
| E | 530 | 0 | 1 | 1 | 0 | Y | LGSQEGAM | 100 | | | | | | |
| E | 531 | 0 | 1 | 1 | 0 | Y | GSQEGAMH | 100 | | | | | | |
| E | 532 | 0 | 2 | 1 | 0 | Y | SQEGAMHT | 100 | | | | | | |
| E | 533 | 0.02 | 2 | 1 | 0 | Y | SQEGAMHTA | 99.82 | | | | | | |
| E | 534 | 0.02 | 2 | 1 | 0 | Y | QEGAMHTAL | 99.82 | | | | | | |
| E | 535 | 0.02 | 2 | 1 | 0 | Y | EGAMHTALT | 99.82 | | | | | | |
| E | 536 | 0.02 | 3 | 1 | 0 | Y | GAMHTALTG | 99.82 | | | | | | |
| E | 537 | 0.04 | 3 | 1 | 0 | Y | AMHTALTGA | 99.65 | | | | | | |
| E | 538 | 0.04 | 3 | 1 | 0 | Y | MHTALTGAT | 99.65 | | | | | | |
| E | 539 | 0.04 | 4 | 1 | 0 | Y | HTALTGATE | 99.65 | | | | | | |
| E | 540 | 0.06 | 4 | 1 | 0 | Y | TALTGATEI | 99.47 | | | | | | |
| E | 541 | 0.06 | 4 | 1 | 0 | Y | ALTGATEIQ | 99.47 | | | | | | |
| E | 542 | 0.54 | 6 | 2 | 0 | Y | LTGATEIQN | 88.5 | LTGATEIQT | 11.15 | | | | |
| E | 543 | 0.57 | 6 | 2 | 0 | Y | TGATEIQNS | 88.32 | TGATEIQTS | 10.97 | | | | |
| E | 544 | 0.57 | 6 | 2 | 0 | Y | GATEIQNSG | 88.32 | GATEIQTSG | 10.97 | | | | |
| E | 545 | 0.57 | 5 | 2 | 0 | Y | ATEIQNSGG | 88.32 | ATEIQTSGG | 10.97 | | | | |
| E | 546 | 0.55 | 7 | 2 | 0 | Y | TEIQNSGGT | 88.5 | TEIQTSGGT | 10.97 | | | | |
| E | 547 | 0.63 | 8 | 3 | 0 | Y | EIQNSGGTS | 87.61 | EIQTSGGTS | 10.8 | EIQNSGGTN | 0.53 | | |
| E | 548 | 0.65 | 7 | 4 | 0 | Y | IQNSGGTSI | 87.61 | IQTSGGTSI | 10.8 | IQNSGGTNI | 0.53 | IQNSGGTTI | 0.35 |
| E | 549 | 0.63 | 8 | 3 | 0 | Y | QNSGGTSIF | 87.79 | QTSGGTSIF | 10.8 | QNSGGTNIF | 0.53 | | |
| E | 550 | 0.66 | 8 | 4 | 0 | Y | NSGGTSIFA | 87.43 | TSGGTSIFA | 10.8 | NSGGTNIFA | 0.53 | NSGGTTIFA | 0.35 |

FIG. 11-21

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 551 | 0.17 | 6 | 3 | 0 | Y | SGGTSIFAG | 98.23 | SGGTNIFAG | 0.53 | LGGTSIFAG | 0.35 | | | | |
| E | 552 | 0.13 | 5 | 2 | 0 | Y | GGTSIFAGH | 98.58 | GGTNIFAGH | 0.53 | | | | | |
| E | 553 | 0.13 | 5 | 2 | 0 | Y | GTSIFAGHL | 98.58 | GTNIFAGHL | 0.53 | | | | | |
| E | 554 | 0.13 | 5 | 2 | 0 | Y | TSIFAGHLK | 98.58 | TNIFAGHLK | 0.53 | | | | | |
| E | 555 | 0.13 | 5 | 2 | 0 | Y | SIFAGHLKC | 98.58 | NIFAGHLKC | 0.53 | | | | | |
| E | 556 | 0.05 | 3 | 1 | 0 | Y | IFAGHLKCR | 99.47 | | | | | | | |
| E | 557 | 0.03 | 2 | 1 | 0 | Y | FAGHLKCRL | 99.65 | | | | | | | |
| E | 558 | 0.03 | 2 | 1 | 0 | Y | AGHLKCRLK | 99.65 | | | | | | | |
| E | 559 | 0 | 1 | 1 | 0 | Y | GHLKCRLKM | 100 | | | | | | | |
| E | 560 | 0 | 1 | 1 | 0 | Y | HLKCRLKMD | 100 | | | | | | | |
| E | 561 | 0.02 | 2 | 1 | 0 | Y | LKCRLKMDK | 99.82 | | | | | | | |
| E | 562 | 0.02 | 2 | 1 | 0 | Y | KCRLKMDKL | 99.82 | | | | | | | |
| E | 563 | 0.07 | 4 | 1 | 0 | Y | CRLKMDKLE | 99.29 | | | | | | | |
| E | 564 | 0.07 | 4 | 1 | 0 | Y | RLKMDKLEL | 99.29 | | | | | | | |
| E | 565 | 0.07 | 4 | 1 | 0 | Y | LKMDKLELI | 99.29 | | | | | | | |
| E | 566 | 0.07 | 4 | 1 | 0 | Y | KMDKLELIKG | 99.29 | | | | | | | |
| E | 567 | 0.07 | 4 | 1 | 0 | Y | MDKLELIKGM | 99.29 | | | | | | | |
| E | 568 | 0.07 | 4 | 1 | 0 | Y | DKLELKGMS | 99.29 | | | | | | | |
| E | 569 | 0.05 | 3 | 1 | 0 | Y | KLELKGMSY | 99.47 | | | | | | | |
| E | 570 | 0.05 | 3 | 1 | 0 | Y | LELKGMSYA | 99.47 | | | | | | | |
| E | 571 | 0 | 1 | 1 | 0 | Y | ELKGMSYAM | 100 | | | | | | | |
| E | 572 | 0 | 3 | 1 | 0 | Y | LKGMSYAMC | 100 | | | | | | | |
| E | 573 | 1.19 | 5 | 3 | 0 | Y | KGMSYAMCT | 62.65 | KGMSYAMCL | 31.33 | KGMSYAMCS | 6.02 | | | | |
| E | 574 | 1.26 | 7 | 3 | 0 | Y | GMSYAMCTN | 62.65 | GMSYAMCLN | 30.44 | GMSYAMCSN | 6.02 | | | | |
| E | 575 | 1.43 | 7 | 5 | 0 | Y | MSYAMCTNT | 62.48 | MSYAMCLNT | 27.08 | MSYAMCSNA | 6.02 | MSYAMCLNA | 3.36 | MSYAMCLGS | 0.71 |
| E | 576 | 1.43 | 7 | 5 | 0 | Y | SYAMCTNTF | 62.48 | SYAMCLNTF | 27.08 | SYAMCSNAF | 6.02 | SYAMCLNAF | 3.36 | SYAMCLGSF | 0.71 |

FIG. 11-22

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block |

FIG. 11-23

Species: DENV3 (9-mer)

| protein | block starting position | block entropy | total peptides in block | peptides required to cover 99% of block | gap/X fraction | 99% of block covered w/ <= 5 peptides? | block | frequency | block required to cover 99% of block | frequency | block required to cover 99% of block | frequency | block required to cover 99% of block | frequency |
|---|---|---|---|---|---|---|---|---|---|---|---|---|---|---|
| E | 606 | 1.09 | 6 | 4 | 0 | Y | GEDAPCKIP | 64.6 | GEDVPCKIP | 33.27 | GEDVPCKVP | 1.06 | GKDAPCKIP | 0.71 |
| E | 607 | 1.09 | 6 | 4 | 0 | Y | EDAPCKIPF | 64.6 | EDVPCKIPF | 33.27 | EDVPCKVPF | 1.06 | KDAPCKIPF | 0.71 |
| E | 608 | 1.03 | 5 | 3 | 0 | Y | DAPCKIPFS | 65.31 | DVPCKIPFS | 33.27 | DVPCKVPFS | 1.06 | | |
| E | 609 | 1.01 | 4 | 3 | 0 | Y | APCKIPFST | 65.49 | VPCKIPFST | 33.27 | VPCKVPFST | 1.06 | | |
| E | 610 | 0.1 | 3 | 2 | 0 | Y | PCKIPFSTE | 98.76 | PCKVPFSTE | 1.06 | | | | |
| E | 611 | 0.1 | 3 | 2 | 0 | Y | CKIPFSTED | 98.76 | CKVPFSTED | 1.06 | | | | |
| E | 612 | 0.18 | 4 | 3 | 0 | Y | KIPFSTEDG | 97.88 | KVPFSTEDG | 1.06 | KIPFSTEDE | 0.88 | | |
| E | 613 | 0.2 | 5 | 3 | 0 | Y | IPFSTEDGQ | 97.7 | VPFSTEDGQ | 1.06 | IPFSTEDEQ | 0.88 | | |
| E | 614 | 0.13 | 5 | 2 | 0 | Y | PFSTEDGQG | 98.58 | PFSTEDEQG | 0.88 | | | | |
| E | 615 | 0.15 | 6 | 3 | 0 | Y | FSTEDGQGK | 98.41 | FSTEDEQGK | 0.88 | | | | |
| E | 616 | 0.2 | 8 | 3 | 0 | Y | STEDGQGKA | 97.88 | STEDEQGKA | 0.88 | STEDGQGKV | 0.35 | | |
| E | 617 | 0.2 | 8 | 3 | 0 | Y | TEDGQGKAH | 97.88 | TEDEQGKAH | 0.88 | TEDGQGKVH | 0.35 | | |
| E | 618 | 0.31 | 9 | 4 | 0 | Y | EDGQGKAHN | 96.46 | EDEQGKAHN | 1.42 | EDEQGKAHS | 0.88 | EDGQGKVHN | 0.35 |
| E | 619 | 0.31 | 9 | 4 | 0 | Y | DGQGKAHNG | 96.46 | DGQGKAHSG | 1.42 | DEQGKAHNG | 0.88 | DGQGKVHNG | 0.35 |
| E | 620 | 0.31 | 9 | 4 | 0 | Y | GQGKAHNGR | 96.46 | GQGKAHSGR | 1.42 | EQGKAHNGR | 0.88 | GQGKVHNGR | 0.35 |
| E | 621 | 0.23 | 8 | 3 | 0 | Y | QGKAHNGRL | 97.35 | QGKAHSGRL | 1.42 | QGKVHNGRL | 0.35 | | |
| E | 622 | 0.2 | 6 | 2 | 0 | Y | GKAHNGRLI | 97.7 | GKAHSGRLI | 1.42 | | | | |
| E | 623 | 0.18 | 5 | 2 | 0 | Y | KAHNGRLIT | 97.88 | KAHSGRLIT | 1.42 | | | | |
| E | 624 | 0.16 | 4 | 2 | 0 | Y | AHNGRLITA | 98.05 | AHSGRLITA | 1.42 | | | | |
| E | 625 | 0.11 | 2 | 2 | 0 | Y | HNGRLITAN | 98.58 | HSGRLITAN | 1.42 | | | | |
| E | 626 | 0.11 | 2 | 2 | 0 | Y | NGRLITANP | 98.58 | SGRLITANP | 1.42 | | | | |
| E | 627 | 0.14 | 2 | 2 | 0 | Y | GRLITANPV | 98.05 | GRLITANPI | 1.95 | | | | |
| E | 628 | 0.14 | 2 | 2 | 0 | Y | RLITANPVV | 98.05 | RLITANPIV | 1.95 | | | | |
| E | 629 | 0.22 | 4 | 2 | 0 | Y | LITANPVVT | 97.17 | LITANPIVT | 1.95 | | | | |
| E | 630 | 0.22 | 4 | 2 | 0 | Y | ITANPVVTK | 97.17 | ITANPIVTK | 1.95 | | | | |
| E | 631 | 0.24 | 5 | 3 | 0 | Y | TANPVVTKK | 96.99 | TANPIVTKK | 1.95 | TANPVVKK | 0.71 | | |

FIG. 11-24

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 632 | 0.33 | 6 | 4 | 0 | Y | ANPWTKKE | 95.75 | ANPWTKKD

FIG. 11-25

Species: DENV3 (9-mer)

| protein | block starting position | block entropy | total peptides in block | peptides required to cover 99% of block | gap/X fraction | covered w/ <= 5 peptides? | block | frequency | block | frequency | block | frequency |
|---|---|---|---|---|---|---|---|---|---|---|---|---|
| E | 664 | 0.19 | 5 | 3 | 0 | Y | ALKINWYKK | 97.88 | SLKINWYKK | 0.88 | ALKINWYRK | 0.71 |
| E | 665 | 0.11 | 4 | 2 | 0 | Y | LKINWYKKG | 98.76 | LKINWYRKG | 0.71 | | |
| E | 666 | 0.11 | 4 | 2 | 0 | Y | KINWYKKGS | 98.76 | KINWYRKGS | 0.71 | | |
| E | 667 | 0.08 | 3 | 1 | 0 | Y | INWYKKGSS | 99.12 | | | | |
| E | 668 | 0.08 | 3 | 1 | 0 | Y | NWYKKGSSI | 99.12 | | | | |
| E | 669 | 0.08 | 3 | 1 | 0 | Y | WYKKGSSIG | 99.12 | | | | |
| E | 670 | 0.08 | 3 | 1 | 0 | Y | YKKGSSIGK | 99.12 | | | | |
| E | 671 | 0.08 | 3 | 1 | 0 | Y | KKGSSIGKM | 99.12 | | | | |
| E | 672 | 0.02 | 2 | 1 | 0 | Y | KGSSIGKMF | 99.82 | | | | |
| E | 673 | 0 | 1 | 1 | 0 | Y | GSSIGKMFE | 100 | | | | |
| E | 674 | 0.02 | 2 | 1 | 0 | Y | SSIGKMFEA | 99.82 | | | | |
| E | 675 | 0.02 | 2 | 1 | 0 | Y | SIGKMFEAT | 99.82 | | | | |
| E | 676 | 0.05 | 3 | 1 | 0 | Y | IGKMFEATA | 99.47 | | | | |
| E | 677 | 0.07 | 4 | 1 | 0 | Y | GKMFEATAR | 99.29 | | | | |
| E | 678 | 0.07 | 4 | 1 | 0 | Y | KMFEATARG | 99.29 | | | | |
| E | 679 | 0.07 | 4 | 1 | 0 | Y | MFEATARGA | 99.29 | | | | |
| E | 680 | 0.07 | 4 | 1 | 0 | Y | FEATARGAR | 99.29 | | | | |
| E | 681 | 0.07 | 4 | 1 | 0 | Y | EATARGARR | 99.29 | | | | |
| E | 682 | 0.07 | 4 | 1 | 0 | Y | ATARGARRM | 99.29 | | | | |
| E | 683 | 0.05 | 3 | 1 | 0 | Y | TARGARRMA | 99.47 | | | | |
| E | 684 | 0.05 | 3 | 1 | 0 | Y | ARGARRMAI | 99.47 | | | | |
| E | 685 | 0.02 | 2 | 1 | 0 | Y | RGARRMAIL | 99.82 | | | | |
| E | 686 | 0 | 1 | 1 | 0 | Y | GARRMAILG | 100 | | | | |
| E | 687 | 0 | 1 | 1 | 0 | Y | ARRMAILGD | 100 | | | | |
| E | 688 | 0.02 | 2 | 1 | 0 | Y | RRMAILGDT | 99.82 | | | | |
| E | 689 | 0.02 | 2 | 1 | 0 | Y | RMAILGDTA | 99.82 | | | | |

FIG. 11-27

Species: DENV3 (9-mer)

| protein | block starting position | block entropy | total peptides in block | peptides required to cover 99% of block | gap/X fraction | 99% of block covered w/ <= 5 peptides? | peptides

FIG. 11-28

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 742 | 0.04 | 3 | 1 | 0 | Y | TWIGLNSKN | 99.65 | | | | | | |
| E | 743 | 0.07 | 5 | 1 | 0 | Y | WIGLNSKNT | 99.29 | | | | | | |
| E | 744 | 0.09 | 6 | 1 | 0 | Y | IGLNSKNTS | 99.12 | | | | | | |
| E | 745 | 0.07 | 5 | 1 | 0 | Y | GLNSKNTSM | 99.29 | | | | | | |
| E | 746 | 0.07 | 5 | 1 | 0 | Y | LNSKNTSMS | 99.29 | | | | | | |
| E | 747 | 0.07 | 5 | 1 | 0 | Y | NSKNTSMSF | 99.29 | | | | | | |
| E | 748 | 0.07 | 5 | 1 | 0 | Y | SKNTSMSFS | 99.29 | | | | | | |
| E | 749 | 0.07 | 5 | 1 | 0 | Y | KNTSMSFSC | 99.29 | | | | | | |
| E | 750 | 0.06 | 4 | 1 | 0 | Y | NTSMSFSCI | 99.47 | | | | | | |
| E | 751 | 1.03 | 6 | 2 | 0 | Y | TSMSFSCIA | 62.48 | TSMSFSCIV | 36.64 | | | | |
| E | 752 | 1.02 | 5 | 2 | 0 | Y | SMSFSCIAI | 62.48 | SMSFSCIVI | 36.81 | | | | |
| E | 753 | 1 | 4 | 2 | 0 | Y | MSFSCIAIG | 62.65 | MSFSCIVIG | 36.81 | | | | |
| E | 754 | 1.16 | 7 | 3 | 0 | Y | SFSCIAIGI | 60.53 | SFSCIVIGI | 36.64 | SFSCIAIGV | 1.95 | | |
| E | 755 | 1.17 | 8 | 4 | 0 | Y | FSCIAIGII | 60.53 | FSCIVIGII | 36.46 | FSCIAIGVI | 1.95 | FSCITIGII | 0.35 |
| E | 756 | 1.17 | 8 | 4 | 0 | Y | SCIAIGIIT | 60.53 | SCIVIGIIT | 36.46 | SCIAIGVIT | 1.95 | SCITIGIIT | 0.35 |
| E | 757 | 1.17 | 8 | 4 | 0 | Y | CIAIGIITL | 60.53 | CIVIGIITL | 36.46 | CIAIGVITL | 1.95 | CITIGIITL | 0.35 |
| E | 758 | 1.17 | 8 | 4 | 0 | Y | IAIGIITLY | 60.53 | IVIGIITLY | 36.46 | IAIGVITLY | 1.95 | ITIGIITLY | 0.35 |
| E | 759 | 1.17 | 8 | 4 | 0 | Y | AIGIITLYL | 60.53 | VIGIITLYL | 36.46 | AIGVITLYL | 1.95 | TIGIITLYL | 0.35 |
| E | 760 | 0.2 | 5 | 2 | 0 | Y | IGIITLYLG | 97.35 | IGWITLYLG | 2.12 | | | | |
| E | 761 | 0.41 | 6 | 4 | 0 | Y | GIITLYLGA | 94.51 | GWITLYLGA | 2.12 | GIITLYLGT | 1.95 | GIITLYLGV | 1.06 |
| E | 762 | 0.41 | 6 | 4 | 0 | Y | IITLYLGAV | 94.51 | VITLYLGAV | 2.12 | IITLYLGTV | 1.95 | IITLYLGVV | 1.06 |
| E | 763 | 0.24 | 4 | 3 | 0 | Y | ITLYLGAVV | 96.81 | ITLYLGTVV | 1.95 | ITLYLGVVQ | 1.06 | | |
| E | 764 | 0.22 | 3 | 3 | 0 | Y | TLYLGAVVQ | 96.99 | TLYLGTVVQ | 1.95 | TLYLGVVQA | 1.06 | | |
| E | 765 | 0.22 | 3 | 3 | 0 | Y | LYLGAVVQA | 96.99 | LYLGTVVQA | 1.95 | LYLGVVQAD | 1.06 | | |
| E | 766 | 0.22 | 3 | 3 | 0 | Y | YLGAVVQAD | 96.99 | YLGTVVQAD | 1.95 | YLGVVQADM | 1.06 | | |
| E | 767 | 0.69 | 5 | 4 | 0 | Y | LGAVVQADM | 88.14 | LGAVVQADT | 8.14 | LGTVVQADM | 1.95 | LGVVQADM | 1.06 |

FIG. 11-29

Species: DENV3 (9-mer)

| protein | block starting position | block ent

FIG. 11-30

Species: DENV3 (9-mer)

| protein | block starting position | block entropy | total peptides in block | peptides

FIG. 11-32

Species: DENV3 (9-mer)

FIG. 11-33

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 878 | 0.15 | 8 | 3 | 0 | Y | TPQPMELKY | 98.58 | TLQPMELKY | 0.35 | PPQPMELKY | 0.18 | | | | |
| NS1 | 879 | 0.09 | 5 | 1 | 0 | Y | PQPMELKYS | 99.12 | | | | | | | | |
| NS1 | 880 | 0.06 | 4 | 1 | 0 | Y | QPMELKYSW | 99.47 | | | | | | | | |
| NS1 | 881 | 0.06 | 4 | 1 | 0 | Y | PMELKYSWK | 99.47 | | | | | | | | |
| NS1 | 882 | 0.14 | 6 | 2 | 0 | Y | MELKYSWKT | 98.58 | MELKYSWKA | 0.71 | | | | | | |
| NS1 | 883 | 0.12 | 5 | 2 | 0 | Y | ELKYSWKTW | 98.76 | ELKYSWKAW | 0.71 | | | | | | |
| NS1 | 884 | 0.1 | 4 | 2 | 0 | Y | LKYSWKTWG | 98.94 | LKYSWKAWG | 0.71 | | | | | | |
| NS1 | 885 | 0.12 | 5 | 2 | 0 | Y | KYSWKTWGK | 98.76 | KYSWKAWGK | 0.71 | | | | | | |
| NS1 | 886 | 0.12 | 5 | 2 | 0 | Y | YSWKTWGKA | 98.76 | YSWKAWGKA | 0.71 | | | | | | |
| NS1 | 887 | 0.27 | 6 | 3 | 0 | Y | SWKTWGKAK | 96.46 | SWKTWGKAR | 2.3 | SWKAWGKAK | 0.71 | | | | |
| NS1 | 888 | 0.38 | 8 | 5 | 0 | Y | WKTWGKAKI | 95.22 | WKTWGKARI | 2.3 | WKTWGKAKV | 2.3 | WKAWGKAKI | 0.71 | WKTWGKAKM | 0.53 |
| NS1 | 889 | 0.4 | 9 | 5 | 0 | Y | KTWGKAKIV | 95.04 | KTWGKARIV | 2.3 | KAWGKAKIV | 2.3 | KTWGKAKIV | 0.71 | KTWGKAKMV | 0.53 |
| NS1 | 890 | 0.46 | 10 | 5 | 0 | Y | WGKAKIVTA | 94.16 | WGKARIVTA | 2.3 | WGKAKIVIA | 1.59 | WGKAKVVTA | 0.71 | WGKAKMVTA | 0.53 |
| NS1 | 891 | 0.48 | 9 | 5 | 0 | Y | GKAKIVTAE | 93.98 | GKARIVTAE | 2.3 | GKAKIVIAE | 1.59 | GKAKVVTAE | 0.71 | GKAKMVTAE | 0.53 |
| NS1 | 892 | 0.57 | 9 | 4 | 0 | Y | AETQNSSFH | 90.09 | AEIQNSSFH | 8.32 | AETQNSSFH | 0.53 | AENQNSSFH | 0.18 | | |
| NS1 | 899 | 0.57 | 9 | 4 | 0 | Y | ETQNSSFII | 90.09 | EIQNSSFII | 8.32 | ETQNFSFII | 0.53 | EIQNFSFII | 0.18 | | |
| NS1 | 900 | 0.55 | 8 | 3 | 0 | Y | TQNSSFIID | 90.27 | IQNSSFIID | 8.32 | TQNFSFIID | 0.53 | | | | |
| NS1 | 901 | 0.08 | 3 | 1 | 0 | Y | QNSSFIIDG | 99.12 | | | | | | | | |
| NS1 | 902 | 0.08 | 3 | 1 | 0 | Y | NSSFIIDGP | 99.12 | | | | | | | | |
| NS1 | 903 | 0.22 | 5 | 3 | 0 | Y | SSFIIDGPN | 97.35 | SSFIIDGPS | 1.59 | FSFIIDGPN | 0.71 | | | | |
| NS1 | 904 | 0.16 | 4 | 2 | 0 | Y | SFIIDGPNT | 98.05 | SFIIDGPST | 1.59 | | | | | | |
| NS1 | 905 | 0.16 | 4 | 2 | 0 | Y | FIIDGPNTP | 98.05 | FIIDGPSTP | 1.59 | | | | | | |
| NS1 | 906 | 0.16 | 5 | 2 | 0 | Y | IIDGPNTPE | 98.05 | IIDGPSTPE | 1.59 | | | | | | |
| NS1 | 907 | 0.17 | 5 | 2 | 0 | Y | IDGPNTPEC | 97.88 | IDGPSTPEC | 1.59 | | | | | | |
| NS1 | 908 | 0.17 | 5 | 2 | 0 | Y | DGPNTPECP | 97.88 | DGPSTPECP | 1.59 | | | | | | |
| NS1 | 909 | 0.58 | 6 | 3 | 0 | Y | GPNTPECPS | 89.73 | GPNTPECPN | 8.14 | GPSTPECPS | 1.59 | | | | |

FIG. 11-35

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 942 | 0.73 | 9 | 5 | 0 | Y | LKLREVYTQ | 86.55 | LKLREVYTQ | 10.8 | LKLREVHTQ | 0.88 | LKLREMYSQ | 0.53 | LKLREAYTQ | 0.35 |
| NS1 | 949 | 1.03 | 6 | 4 | 0 | Y | TQLCDHRLM | 72.74 | TQSCDHRLM | 24.25 | TQTCDHRLM | 1.77 | SQLCDHRLM | 0.53 | | |
| NS1 | 950 | 0.99 | 5 | 3 | 0 | Y | QLCDHRLMS | 73.27 | QSCDHRLMS | 24.25 | QTCDHRLMS | 1.77 | | | | |
| NS1 | 951 | 0.99 | 5 | 3 | 0 | Y | LCDHRLMSA | 73.27 | SCDHRLMSA | 24.25 | TCDHRLMSA | 1.77 | | | | |
| NS1 | 952 | 0 | 1 | 1 | 0 | Y | CDHRLMSAA | 100 | | | | | | | | |
| NS1 | 953 | 0.83 | 2 | 2 | 0 | Y | DHRLMSAAV | 73.45 | DHRLMSAAI | 26.55 | | | | | | |
| NS1 | 954 | 0.83 | 2 | 2 | 0 | Y | HRLMSAAVK | 73.45 | HRLMSAAIK | 26.55 | | | | | | |
| NS1 | 955 | 0.83 | 2 | 2 | 0 | Y | RLMSAAVKD | 73.45 | RLMSAAIKD | 26.55 | | | | | | |
| NS1 | 956 | 0.83 | 2 | 2 | 0 | Y | LMSAAVKDE | 73.45 | LMSAAIKDE | 26.55 | | | | | | |
| NS1 | 957 | 0.85 | 3 | 2 | 0 | Y | MSAAVKDER | 73.45 | MSAAIKDER | 26.37 | | | | | | |
| NS1 | 958 | 0.85 | 3 | 2 | 0 | Y | SAAVKDERA | 73.45 | SAAIKDERA | 26.37 | | | | | | |
| NS1 | 959 | 0.87 | 4 | 2 | 0 | Y | AAVKDERAV | 73.27 | AAIKDERAV | 26.37 | | | | | | |
| NS1 | 960 | 0.87 | 4 | 2 | 0 | Y | AVKDERAVH | 73.27 | AIKDERAVH | 26.37 | | | | | | |
| NS1 | 961 | 0.87 | 4 | 2 | 0 | Y | VKDERAVHA | 73.27 | IKDERAVHA | 26.37 | | | | | | |
| NS1 | 962 | 0.04 | 3 | 1 | 0 | Y | KDERAVHAD | 99.65 | | | | | | | | |
| NS1 | 963 | 0.04 | 3 | 1 | 0 | Y | DERAVHADM | 99.65 | | | | | | | | |
| NS1 | 964 | 0.04 | 3 | 1 | 0 | Y | ERAVHADMG | 99.65 | | | | | | | | |
| NS1 | 965 | 0.04 | 3 | 1 | 0 | Y | RAVHADMGY | 99.65 | | | | | | | | |
| NS1 | 966 | 0.02 | 2 | 1 | 0 | Y | AVHADMGYW | 99.82 | | | | | | | | |
| NS1 | 967 | 0.04 | 3 | 1 | 0 | Y | VHADMGYWI | 99.65 | | | | | | | | |
| NS1 | 968 | 0.02 | 2 | 1 | 0 | Y | HADMGYWIE | 99.82 | | | | | | | | |
| NS1 | 969 | 0.02 | 2 | 1 | 0 | Y | ADMGYWIES | 99.82 | | | | | | | | |
| NS1 | 970 | 0.02 | 2 | 1 | 0 | Y | DMGYWIESQ | 99.82 | | | | | | | | |
| NS1 | 971 | 0.02 | 2 | 1 | 0 | Y | MGYWIESQK | 99.82 | | | | | | | | |
| NS1 | 972 | 0.04 | 3 | 1 | 0 | Y | GYWIESQKN | 99.65 | | | | | | | | |
| NS1 | 973 | 0.04 | 3 | 1 | 0 | Y | YWIESQKNG | 99.65 | | | | | | | | |

FIG. 11-38

Species: DENV3 (9-mer)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS1 | 1026 | 1.05 | 5 | 2 | 0 | Y | QHNYRPGYH | 56.46 | QHNHRPGYH | 42.83 |
| NS1 | 1027 | 1.05 | 5 | 2 | 0 | Y | HNYRPGYHT | 56.46 | HNHRPGYHT | 42.83 |
| NS1 | 1028 | 1.05 | 5 | 2 | 0 | Y | NYRPGYHTQ | 56.46 | NHRPGYHTQ | 42.83 |
| NS1 | 1029 | 1.05 | 5 | 2 | 0 | Y | YRPGYHTQT | 56.46 | HRPGYHTQT | 42.83 |
| NS1 | 1030 | 0.09 | 4 | 1 | 0 | Y | RPGYHTQTA | 99.12 | | |
| NS1 | 1031 | 0.09 | 4 | 1 | 0 | Y | PGYHTQTAG | 99.12 | | |
| NS1 | 1032 | 0.1 | 5 | 2 | 0 | Y | GYHTQTAGP | 98.94 | GYTQTAGP | 0.53 |
| NS1 | 1033 | 0.1 | 5 | 2 | 0 | Y | YHTQTAGPW | 98.94 | YTQTAGPW | 0.53 |
| NS1 | 1034 | 0.1 | 5 | 2 | 0 | Y | HTQTAGPWH | 98.94 | YTQTAGPWH | 0.53 |
| NS1 | 1035 | 0.04 | 3 | 1 | 0 | Y | TQTAGPWHL | 99.65 | | |
| NS1 | 1036 | 0.04 | 3 | 1 | 0 | Y | QTAGPWHLG | 99.65 | | |
| NS1 | 1037 | 0.04 | 3 | 1 | 0 | Y | TAGPWHLGK | 99.65 | | |
| NS1 | 1038 | 0.04 | 3 | 1 | 0 | Y | AGPWHLGKL | 99.65 | | |
| NS1 | 1039 | 0.08 | 2 | 1 | 0 | Y | GPWHLGKLE | 99.12 | | |
| NS1 | 1040 | 0.08 | 3 | 1 | 0 | Y | PWHLGKLEL | 99.12 | | |
| NS1 | 1041 | 0.06 | 2 | 1 | 0 | Y | WHLGKLELD | 99.29 | | |
| NS1 | 1042 | 0.06 | 3 | 1 | 0 | Y | HLGKLELDF | 99.29 | | |
| NS1 | 1043 | 0.08 | 3 | 1 | 0 | Y | LGKLELDFN | 99.12 | | |
| NS1 | 1044 | 0.08 | 3 | 1 | 0 | Y | GKLELDFNY | 99.12 | | |
| NS1 | 1045 | 0.08 | 3 | 1 | 0 | Y | KLELDFNYC | 99.12 | | |
| NS1 | 1046 | 0.08 | 3 | 1 | 0 | Y | LELDFNYCE | 99.12 | | |
| NS1 | 1047 | 0.08 | 3 | 1 | 0 | Y | ELDFNYCEG | 99.12 | | |
| NS1 | 1048 | 0.02 | 2 | 1 | 0 | Y | LDFNYCEGT | 99.82 | | |
| NS1 | 1049 | 0.02 | 2 | 1 | 0 | Y | DFNYCEGTT | 99.82 | | |
| NS1 | 1050 | 0.02 | 2 | 1 | 0 | Y | FNYCEGTTV | 99.82 | | |
| NS1 | 1051 | 0.02 | 2 | 1 | 0 | Y | NYCEGTTVW | 99.82 | | |

FIG. 11-39

Species: DENV3 (9-mer)

| protein | block starting position | block entropy | total

FIG. 11-41

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block to cover 99% | frequency | block to cover 99% | frequency | block to cover 99% | frequency |
|---|---|---|---|---|---|---|---|---|---|---|---|---|---|---|---|---|
| NS1 | 1109 | 1.17 | 7 | 4 | 0 | Y | RPISEKEEN | 61.24 | RPINEKEEN | 35.93 | RPVNEKEEN | 1.24 | RPYSEKEEN | 0.71 | | |
| NS1 | 1110 | 1.17 | 7 | 4 | 0 | Y | PISEKEENM | 61.24 | PINEKEENM | 35.93 | PVNEKEENM | 1.24 | PYSEKEENM | 0.71 | | |
| NS1 | 1111 | 1.18 | 8 | 5 | 0 | Y | ISEKEENMV | 61.24 | INEKEENMV | 35.75 | VNEKEENMV | 1.24 | VSEKEENMV | 0.71 | TSEKEENMV | 0.35 |
| NS1 | 1112 | 0.99 | 4 | 2 | 0 | Y | SEKEENMVK | 62.3 | NEKEENMVK | 37.35 | | | | | | |
| NS1 | 1113 | 0.04 | 3 | 1 | 0 | Y | EKEENMVKS | 99.65 | | | | | | | | |
| NS1 | 1114 | 0.04 | 3 | 1 | 0 | Y | KEENMVKSL | 99.65 | | | | | | | | |
| NS1 | 1115 | 0.19 | 3 | 2 | 0 | Y | EENMVKSLV | 97.35 | EENMVKSLA | 2.48 | | | | | | |
| NS1 | 1116 | 0.19 | 3 | 2 | 0 | Y | ENMVKSLVS | 97.35 | ENMVKSLAS | 2.48 | | | | | | |
| NS1 | 1117 | 0.19 | 3 | 2 | 0 | Y | NMVKSLVSA | 97.35 | NMVKSLASA | 2.48 | | | | | | |
| NS1 | 1118 | 0.19 | 3 | 2 | 0 | Y | MVKSLVSAG | 97.35 | MVKSLASAG | 2.48 | | | | | | |
| NS1 | 1119 | 0.2 | 4 | 2 | 0 | Y | VKSLVSAGS | 97.17 | VKSLASAGS | 2.48 | | | | | | |
| NS1 | 1120 | 0.19 | 3 | 2 | 0 | Y | KSLVSAGSG | 97.35 | KSLASAGSG | 2.48 | | | | | | |
| NS1 | 1121 | 0.91 | 4 | 3 | 0 | Y | SLVSAGSGK | 76.81 | SLYSAGSGE | 20.53 | SLASAGSGK | 2.48 | | | | |
| NS1 | 1122 | 1.25 | 7 | 5 | 0 | Y | LVSAGSGKV | 71.33 | LVSAGSGEV | 20.53 | LVSAGSGKM | 3.54 | LASAGGGKV | 2.48 | LVSAGSGKA | 1.77 |
| NS1 | 1123 | 1.25 | 7 | 5 | 0 | Y | VSAGSGKVD | 71.33 | VSAGSGEVD | 20.53 | VSAGSGKMD | 3.54 | ASAGSGKVD | 2.48 | VSAGSGKAD | 1.77 |
| NS1 | 1124 | 1.1 | 6 | 4 | 0 | Y | SAGSGKVDN | 73.81 | SAGSGEVDN | 20.53 | SAGGGKMDN | 3.54 | SAGGGKADN | 1.77 | | |
| NS1 | 1125 | 1.1 | 6 | 4 | 0 | Y | AGSGKVDNF | 73.81 | AGSGEVDNF | 20.53 | AGSGKMDNF | 3.54 | AGSGKADNF | 1.77 | | |
| NS1 | 1126 | 1.12 | 7 | 4 | 0 | Y | GSGKVDNFT | 73.63 | GSGEVDNFT | 20.53 | GSGKMDNFT | 3.54 | GSGKADNFT | 1.77 | | |
| NS1 | 1127 | 1.1 | 6 | 4 | 0 | Y | SGKVDNFTM | 73.81 | SGEVDNFTM | 20.53 | SGKMDNFTM | 3.54 | SGKADNFTM | 1.77 | | |
| NS1 | 1128 | 1.1 | 6 | 4 | 0 | Y | GKVDNFTMG | 73.63 | GEVDNFTMG | 20.53 | GKMDNFTMG | 3.54 | GKADNFTMG | 1.77 | | |
| NS1 | 1130 | 0.48 | 9 | 5 | 0 | Y | VDNFTMGVL | 93.63 | MDNFTMGIL | 3.01 | ADNFTMGVL | 1.77 | MDNFTMGVL | 0.53 | VDNFTMGAL | 0.35 |
| NS2A | 1131 | 0.27 | 5 | 2 | 0 | Y | DNFTMGVLC | 96.11 | DNFTMGILC | 3.19 | | | | | | |
| NS2A | 1132 | 0.27 | 5 | 2 | 0 | Y | NFTMGVLCL | 96.11 | NFTMGILCL | 3.19 | | | | | | |
| NS2A | 1133 | 0.29 | 6 | 2 | 0 | Y | FTMGVLCLA | 95.93 | FTMGILCLA | 3.19 | | | | | | |
| NS2A | 1134 | 0.29 | 6 | 2 | 0 | Y | TMGVLCLAI | 95.93 | TMGILCLAI | 3.19 | | | | | | |
| NS2A | 1135 | 0.31 | 7 | 3 | 0 | Y | MGVLCLAIL | 95.75 | MGILCLAIL | 3.19 | MGALCLAIL | 0.35 | | | | |

FIG. 11-43

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS2A | 1171 | 0.42 | 8 | 3 | 0 | Y | GQITWRDMA | 93.63 | GQITWRDMT | 5.13 | GQITWRDLA | 0.35 | | |
| NS2A | 1179 | 0.87 | 7 | 4 | 0 | Y | AHTLIMIGS | 85.13 | ARTLIMIGS | 6.73 | THTLIMIGS | 5.13 | AHTFIMIGS | 2.12 |
| NS2A | 1180 | 0.61 | 7 | 4 | 0 | Y | HTLIMIGSN | 90.09 | RTLIMIGSN | 6.73 | HTFIMIGSN | 2.12 | HTLIMYGSN | 0.35 |
| NS2A | 1181 | 0.27 | 5 | 3 | 0 | Y | TLIMIGSNA | 96.46 | TFIMIGSNA | 2.48 | TLIMIGSNT | 0.53 | | |
| NS2A | 1182 | 0.39 | 6 | 4 | 0 | Y | LIMIGSNAS | 94.69 | FIMIGSNAS | 2.48 | LIMIGSNAT | 1.77 | LIMIGSNTS | 0.53 |
| NS2A | 1183 | 0.23 | 5 | 3 | 0 | Y | IMIGSNASD | 97.17 | IMIGSNATD | 1.77 | IMIGSNTSD | 0.53 | | |
| NS2A | 1184 | 0.36 | 6 | 4 | 0 | Y | MIGSNASDR | 95.4 | MIGSNATDR | 1.77 | MIGSNASDK | 1.77 | MIGSNTSDR | 0.53 |
| NS2A | 1185 | 0.37 | 7 | 4 | 0 | Y | IGSNASDRM | 95.22 | IGSNASDKM | 1.77 | IGSNATDRM | 1.77 | IGNTSDRM | 0.53 |
| NS2A | 1186 | 0.34 | 6 | 3 | 0 | Y | GSNASDRMG | 95.58 | GSNASDKMG | 1.77 | GSNATDRMG | 1.77 | | |
| NS2A | 1187 | 0.34 | 6 | 3 | 0 | Y | SNASDRMGM | 95.58 | SNASDKMGM | 1.77 | SNATDRMGM | 1.77 | | |
| NS2A | 1188 | 0.34 | 6 | 3 | 0 | Y | NASDRMGMG | 95.58 | NASDKMGMG | 1.77 | NATDRMGMG | 1.77 | | |
| NS2A | 1189 | 0.34 | 6 | 3 | 0 | Y | ASDRMGMGV | 95.58 | ATDRMGMGV | 1.77 | ASDKMGMGV | 1.77 | | |
| NS2A | 1190 | 0.29 | 6 | 3 | 0 | Y | SDRMGMGVT | 96.11 | SDKMGMGVT | 1.77 | TDRMGMGVT | 1.77 | | |
| NS2A | 1191 | 0.22 | 5 | 3 | 0 | Y | DRMGMGVTY | 97.35 | DKMGMGVTY | 1.77 | | | | |
| NS2A | 1192 | 0.22 | 5 | 2 | 0 | Y | RMGMGVTYL | 97.35 | KMGMGVTYL | 1.77 | | | | |
| NS2A | 1193 | 0.09 | 5 | 2 | 0 | Y | MGMGVTYLA | 99.12 | | | | | | |
| NS2A | 1194 | 0.07 | 4 | 1 | 0 | Y | GMGVTYLAL | 99.29 | | | | | | |
| NS2A | 1195 | 0.09 | 5 | 1 | 0 | Y | MGVTYLALI | 99.12 | | | | | | |
| NS2A | 1196 | 0.09 | 5 | 1 | 0 | Y | GVTYLALIA | 99.12 | | | | | | |
| NS2A | 1197 | 0.11 | 6 | 2 | 0 | Y | VTYLALIAT | 98.94 | VTHLALIAT | 0.35 | | | | |
| NS2A | 1198 | 0.09 | 5 | 1 | 0 | Y | TYLALIATF | 99.12 | | | | | | |
| NS2A | 1199 | 0.11 | 6 | 2 | 0 | Y | YLALIATFK | 98.94 | HLALIATFK | 0.35 | | | | |
| NS2A | 1200 | 0.09 | 5 | 1 | 0 | Y | LALIATFKI | 99.12 | | | | | | |
| NS2A | 1201 | 0.09 | 5 | 1 | 0 | Y | ALIATFKIQ | 99.12 | | | | | | |
| NS2A | 1202 | 0.09 | 5 | 1 | 0 | Y | LIATFKIQP | 99.12 | | | | | | |
| NS2A | 1203 | 0.15 | 6 | 2 | 0 | Y | IATFKIQPF | 98.41 | IATFKIQPL | 0.71 | | | | |

FIG. 11-45

Species: D

FIG. 11-46

Species: DENV3 (9-mer)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS2A | 1256 | 0.96 | 5 | 3 | 0 | Y | LMALKLITQ | 73.45 | LMTLKLITQ | 24.42 | LMALKLITQ | 1.77 | | |
| NS2A | 1257 | 0.96 | 5 | 3 | 0 | Y | MALKLITQF | 73.45 | MTLKLITQF | 24.42 | MALKLITQF | 1.77 | | |
| NS2A | 1258 | 0.96 | 4 | 3 | 0 | Y | ALKLITQFE | 73.45 | TLKLITQFE | 24.42 | ALKLITQFE | 1.77 | | |
| NS2A | 1259 | 0.18 | 4 | 2 | 0 | Y | LKLITQFET | 97.7 | LKLITQFET | 1.77 | | | | |
| NS2A | 1260 | 0.18 | 4 | 2 | 0 | Y | KLITQFETY | 97.7 | KLITQFETY | 1.77 | | | | |
| NS2A | 1261 | 0.18 | 4 | 2 | 0 | Y | LITQFETYQ | 97.7 | LITQFETYQ | 1.77 | | | | |
| NS2A | 1262 | 0.03 | 2 | 1 | 0 | Y | ITQFETYQL | 97.7 | ITQFETYQL | 1.77 | | | | |
| NS2A | 1263 | 0.09 | 3 | 2 | 0 | Y | TQFETYQLW | 99.65 | | | | | | |
| NS2A | 1264 | 0.09 | 3 | 2 | 0 | Y | QFETYQLWT | 98.94 | QFETYQLWA | 0.71 | | | | |
| NS2A | 1265 | 0.09 | 3 | 2 | 0 | Y | FETYQLWTA | 98.94 | FETYQLWAA | 0.71 | | | | |
| NS2A | 1266 | 0.09 | 3 | 2 | 0 | Y | ETYQLWTAL | 98.94 | ETYQLWAAL | 0.71 | | | | |
| NS2A | 1267 | 1.13 | 6 | 4 | 0 | Y | TYQLWTALI | 54.51 | TYQLWTALV | 43.72 | TYQLWAALV | 0.71 | TYQLWTALA | 0.53 |
| NS2A | 1268 | 1.1 | 5 | 3 | 0 | Y | YQLWTALIS | 54.87 | YQLWTALVS | 43.72 | YQLWAALVS | 0.71 | | |
| NS2A | 1269 | 1.1 | 5 | 3 | 0 | Y | QLWTALISL | 54.87 | QLWTALVSL | 43.72 | QLWAALVSL | 0.71 | | |
| NS2A | 1270 | 1.4 | 8 | 5 | 0 | Y | LWTALISLT | 54.69 | LWTALVSLT | 36.99 | LWTALVSLM | 6.73 | LWTALASLM | 0.53 |
| NS2A | 1271 | 1.4 | 8 | 5 | 0 | Y | WTALISLTC | 54.69 | WTALVSLTC | 36.99 | WTALVSLMC | 6.73 | WTALASLMC | 0.53 |
| NS2A | 1273 | 1.37 | 7 | 4 | 0 | Y | ALISLTCSN | 54.69 | ALVSLTCSN | 37.35 | ALVSLMCSN | 6.73 | ALASLMCSN | 0.53 |
| NS2A | 1274 | 1.37 | 7 | 4 | 0 | Y | LISLTCSNT | 54.69 | LVSLTCSNT | 37.35 | LVSLMCSNT | 6.73 | LASLMCSNT | 0.53 |
| NS2A | 1276 | 1.04 | 7 | 4 | 0 | Y | SLTCSNTIF | 78.05 | SLTCSNTMF | 13.45 | SLMCSNTIF | 7.43 | SLMCANTIF | 0.35 |
| NS2A | 1277 | 1.04 | 7 | 4 | 0 | Y | LTCSNTIFT | 78.05 | LTCSNTMFT | 13.45 | LMCSNTIFT | 7.43 | LMCANTIFT | 0.35 |
| NS2A | 1278 | 1.04 | 7 | 4 | 0 | Y | TCSNTIFTL | 78.05 | TCSNTMFTL | 13.45 | MCSNTIFTL | 7.43 | | |
| NS2A | 1279 | 0.67 | 6 | 3 | 0 | Y | CSNTIFTLT | 85.49 | CSNTMFTLT | 13.45 | CSNTILTLT | 0.35 | TCSNTILTL | |
| NS2A | 1280 | 0.67 | 6 | 3 | 0 | Y | SNTIFTLTV | 85.49 | SNTMFTLTV | 13.45 | ANTIFLTV | 0.35 | | |
| NS2A | 1281 | 0.64 | 5 | 2 | 0 | Y | NTIFTLTVA | 85.84 | NTMFTLTVA | 13.45 | | | | |
| NS2A | 1282 | 0.64 | 5 | 2 | 0 | Y | TIFTLTVAW | 85.84 | TMFTLTVAW | 13.45 | | | | |
| NS2A | 1283 | 0.64 | 5 | 2 | 0 | Y | IFTLTVAWR | 85.84 | MFTLTVAWR | 13.45 | | | | |

FIG. 11-47

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of

FIG. 11-48

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---

FIG. 11-50

| protein | block starting position | block entropy | total peptides in block | peptides required to cover 99% of block | gap/X fraction | covered w/ <= 5 peptides? | block | frequency | block | frequency | block | frequency | block | frequency |
|---|---|---|---|---|---|---|---|---|---|---|---|---|---|---|
| NS2B | 1372 | 0.05 | 3 | 1 | 0 | Y | AGPLVAGGL | 99.47 | | | | | | |
| NS2B | 1373 | 0.05 | 3 | 1 | 0 | Y | GPLVAGGLL | 99.47 | | | | | | |
| NS2B | 1374 | 0.05 | 3 | 1 | 0 | Y | PLVAGGLLI | 99.47 | | | | | | |
| NS2B | 1375 | 0.05 | 3 | 1 | 0 | Y | LVAGGLLIA | 99.47 | | | | | | |
| NS2B | 1376 | 0.05 | 3 | 1 |

FIG. 11-54

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency

FIG. 11-55

Species: DENV3 (9-mer)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS3 | 1508 | 0.11 | 4 | 2 | 0 | Y | QVGVGVQKE | 98.76 | QVGVGIQKE | 0.71 |
| NS3 | 1509 | 0.11 | 4 | 2 | 0 | Y | VGVGVQKEG | 98.76 | VGVGIQKEG | 0.71 |
| NS3 | 1510 | 0.11 | 4 | 2 | 0 | Y | GVGVQKEGV | 98.76 | GVGIQKEGV | 0.71 |
| NS3 | 1511 | 0.11 | 4 | 2 | 0 | Y | VGVQKEGVF | 98.76 | VGIQKEGVF | 0.71 |
| NS3 | 1512 | 0.11 | 4 | 2 | 0 | Y | GVQKEGVFH | 98.76 | GIQKEGVFH | 0.71 |
| NS3 | 1513 | 0.13 | 5 | 2 | 0 | Y | VQKEGVFHT | 98.58 | IQKEGVFHT | 0.71 |
| NS3 | 1514 | 0.07 | 4 | 1 | 0 | Y | QKEGVFHTM | 99.29 | | |
| NS3 | 1515 | 0.04 | 3 | 1 | 0 | Y | KEGVFHTMW | 99.65 | | |
| NS3 | 1516 | 0.02 | 2 | 1 | 0 | Y | EGVFHTMWH | 99.82 | | |
| NS3 | 1517 | 0.02 | 2 | 1 | 0 | Y | GVFHTMWHV | 99.82 | | |
| NS3 | 1518 | 0.02 | 2 | 1 | 0 | Y | VFHTMWHVT | 99.82 | | |
| NS3 | 1519 | 0.02 | 2 | 1 | 0 | Y | FHTMWHVTR | 99.82 | | |
| NS3 | 1520 | 0.02 | 2 | 1 | 0 | Y | HTMWHVTRG | 99.82 | | |
| NS3 | 1521 | 0.02 | 2 | 1 | 0 | Y | TMWHVTRGA | 99.82 | | |
| NS3 | 1522 | 0 | 1 | 1 | 0 | Y | MWHVTRGAV | 100 | | |
| NS3 | 1523 | 0 | 1 | 1 | 0 | Y | WHVTRGAVL | 100 | | |
| NS3 | 1524 | 0.05 | 2 | 1 | 0 | Y | HVTRGAVLT | 99.47 | | |
| NS3 | 1525 | 1.05 | 4 | 2 | 0 | Y | VTRGAVLTY | 55.04 | VTRGAVLTH | 44.25 |
| NS3 | 1526 | 1.05 | 4 | 2 | 0 | Y | TRGAVLTYN | 55.04 | TRGAVLTHN | 44.25 |
| NS3 | 1527 | 1.05 | 4 | 2 | 0 | Y | RGAVLTYNG | 55.04 | RGAVLTHNG | 44.25 |
| NS3 | 1528 | 1.07 | 5 | 2 | 0 | Y | GAVLTYNGK | 54.87 | GAVLTHNGK | 44.25 |
| NS3 | 1529 | 1.07 | 5 | 2 | 0 | Y | AVLTYNGKR | 54.87 | AVLTHNGKR | 44.25 |
| NS3 | 1530 | 1.07 | 5 | 2 | 0 | Y | VLTYNGKRL | 54.87 | VLTHNGKRL | 44.25 |
| NS3 | 1531 | 1.07 | 5 | 2 | 0 | Y | LTYNGKRLE | 54.87 | LTHNGKRLE | 44.25 |
| NS3 | 1532 | 1.07 | 5 | 2 | 0 | Y | TYNGKRLEP | 54.87 | THNGKRLEP | 44.25 |
| NS3 | 1533 | 1.06 | 5 | 2 | 0 | Y | YNGKRLEPN | 55.04 | HNGKRLEPN | 44.25 |

FIG. 11-56

Species: DENV3 (9-mer)

| protein | block starting position | block entropy | total peptides in block | peptides required to cover 99% of block | gap/X fraction | covered w/ <= 5 peptides? | block to cover 99% of block | frequency | block to cover 99% of block | frequency | block to cover 99% of block | frequency | block to cover 99% of block | frequency | block to cover 99% of block | frequency |
|---|---|---|---|---|---|---|---|---|---|---|---|---|---|---|---|---|
| NS3 | 1534 | 0.05 | 3 | 1 | 0 | Y | NGKRLEPNW | 99.47 | | | | | | | | |
| NS3 | 1535 | 0.05 | 3 | 1 | 0 | Y | GKRLEPNWA | 99.47 | | | | | | | | |
| NS3 | 1536 | 0.2 | 4 | 2 | 0 | Y | KRLEPNWAS | 97.35 | KRLEPNWAN | 2.12 | | | | | | |
| NS3 | 1537 | 0.18 | 3 | 2 | 0 | Y | RLEPNWASY | 97.52 | RLEPNWANV | 2.12 | | | | | | |
| NS3 | 1538 | 0.2 | 4 | 2 | 0 | Y | LEPNWASYK | 97.35 | LEPNWANVK | 2.12 | | | | | | |
| NS3 | 1539 | 0.22 | 5 | 2 | 0 | Y | EPNWASYKK | 97.17 | EPNWANVKK | 2.12 | | | | | | |
| NS3 | 1540 | 0.22 | 5 | 2 | 0 | Y | PNWASVKKD | 97.17 | PNWANVKKD | 2.12 | | | | | | |
| NS3 | 1541 | 0.22 | 5 | 2 | 0 | Y | NWASVKKDL | 97.17 | NWANVKKDL | 2.12 | | | | | | |
| NS3 | 1542 | 0.2 | 5 | 2 | 0 | Y | WASVKKDLI | 97.35 | WANVKKDLI | 2.12 | | | | | | |
| NS3 | 1543 | 0.2 | 5 | 2 | 0 | Y | ASVKKDLIS | 97.35 | ANVKKDLIS | 2.12 | | | | | | |
| NS3 | 1544 | 0.2 | 4 | 2 | 0 | Y | SVKKDLISY | 97.35 | NVKKDLISY | 2.12 | | | | | | |
| NS3 | 1545 | 0.06 | 3 | 1 | 0 | Y | VKKDLISYG | 99.47 | | | | | | | | |
| NS3 | 1546 | 0.06 | 2 | 1 | 0 | Y | KKDLISYGG | 99.47 | | | | | | | | |
| NS3 | 1547 | 0.04 | 2 | 1 | 0 | Y | KDLISYGGG | 99.65 | | | | | | | | |
| NS3 | 1548 | 0.02 | 3 | 1 | 0 | Y | DLISYGGGW | 99.82 | | | | | | | | |
| NS3 | 1549 | 0.17 | 3 | 2 | 0 | Y | LISYGGGWR | 97.7 | LISYGGGWK | 2.12 | | | | | | |
| NS3 | 1550 | 0.17 | 3 | 2 | 0 | Y | ISYGGGWRL | 97.7 | ISYGGGWKL | 2.12 | | | | | | |
| NS3 | 1551 | 0.35 | 4 | 3 | 0 | Y | SYGGGWRLS | 94.69 | SYGGGWRLN | 2.12 | SYGGGWKLS | 2.12 | | | | |
| NS3 | 1552 | 0.46 | 6 | 4 | 0 | Y | YGGGWRLSA | 93.27 | YGGGWRLNA | 3.19 | YGGGWKLSA | 2.12 | YGGGWRLST | 1.42 | | |
| NS3 | 1553 | 0.49 | 6 | 4 | 0 | Y | GGGWRLSAQ | 92.92 | GGGWRLNAQ | 3.19 | GGGWKLSAQ | 2.12 | GGGWRLSTQ | 1.42 | | |
| NS3 | 1554 | 0.49 | 8 | 4 | 0 | Y | GGWRLSAQW | 92.92 | GGWRLNAQW | 3.19 | GGWKLSAQW | 2.12 | GGWRLSTQW | 1.42 | | |
| NS3 | 1555 | 0.6 | 9 | 5 | 0 | Y | GWRLSAQWQ | 91.68 | GWRLNAQWQ | 3.19 | GWKLSAQWQ | 2.12 | GWRLSTQWQ | 1.42 | GWRLSAQWK | 1.06 |
| NS3 | 1556 | 0.63 | 9 | 5 | 0 | Y | WRLSAQWQK | 91.33 | WRLNAQWQK | 3.19 | WKLSAQWQK | 2.12 | WRLSTQWQK | 1.42 | WRLSAQWKK | 1.06 |
| NS3 | 1557 | 0.63 | 9 | 5 | 0 | Y | RLSAQWQKG | 91.33 | RLNAQWQKG | 3.19 | KLSAQWQKG | 2.12 | RLSTQWQKG | 1.42 | RLSAQWKKG | 1.06 |
| NS3 | 1558 | 0.48 | 8 | 4 | 0 | Y | LSAQWQKGE | 93.45 | LNAQWQKGE | 3.19 | LSTQWQKGE | 1.42 | LSAQWKKGE | 1.06 | | |
| NS3 | 1559 | 0.48 | 8 | 4 | 0 | Y | SAQWQKGEE | 93.45 | NAQWQKGEE | 3.19 | STQWQKGEE | 1.42 | SAQWKKGEE | 1.06 | | |

FIG. 11-58

Species: DENV3 (

FIG. 11-59

Species: DENV3 (9-mer)

| protein | block starting position | block entropy | total

FIG. 11-63

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1717 | 0.35 | 7 | 4 | 0 | Y | QTTATKSEH | 95.22 | QTTAIKSEH | 3.36 | QTTVTIKSEH | 0.35 | | |
| NS3 | 1718 | 0.35 | 7 | 4 | 0 | Y | TTATKSEHT | 95.22 | TTAIKSEHT | 3.36 | TTVTIKSEHT | 0.35 | TSATKSEHT | 0.35 |
| NS3 | 1719 | 0.35 | 7 | 4 | 0 | Y | TATKSEHTG | 95.22 | TAIKSEHTG | 3.36 | SATIKSEHTG | 0.35 | TVTIKSEHTG | 0.35 |
| NS3 | 1720 | 0.67 | 7 | 4 | 0 | Y | ATKSEHTGR | 88.85 | ATIKSEHTGK | 6.73 | AIIKSEHTGR | 3.36 | VTIKSEHTGR | 0.35 |
| NS3 | 1721 | 0.63 | 6 | 3 | 0 | Y | TKSEHTGRE | 89.2 | TIKSEHTGKE | 6.73 | IKSEHTGRE | 3.36 | | |
| NS3 | 1722 | 0.41 | 4 | 2 | 0 | Y | KSEHTGREI | 92.74 | KSEHTGKEI | 6.73 | | | | |
| NS3 | 1723 | 0.37 | 3 | 2 | 0 | Y | SEHTGREIV | 93.1 | SEHTGKEIV | 6.73 | | | | |
| NS3 | 1724 | 0.37 | 3 | 2 | 0 | Y | EHTGREIVD | 93.1 | EHTGKEIVD | 6.73 | | | | |
| NS3 | 1725 | 0.36 | 2 | 2 | 0 | Y | HTGREIVDL | 93.1 | HTGKEIVDL | 6.73 | | | | |
| NS3 | 1726 | 0.36 | 2 | 2 | 0 | Y | TGREIVDLM | 93.1 | TGKEIVDLM | 6.9 | | | | |
| NS3 | 1727 | 0.38 | 3 | 2 | 0 | Y | GREIVDLMC | 92.92 | GKEIVDLMC | 6.9 | | | | |
| NS3 | 1728 | 0.38 | 3 | 2 | 0 | Y | REIVDLMCH | 92.92 | KEIVDLMCH | 6.9 | | | | |
| NS3 | 1729 | 0.02 | 2 | 1 | 0 | Y | EIVDLMCHA | 99.82 | | | | | | |
| NS3 | 1730 | 0.04 | 3 | 1 | 0 | Y | IVDLMCHAT | 99.65 | | | | | | |
| NS3 | 1731 | 0.04 | 3 | 1 | 0 | Y | VDLMCHATF | 99.65 | | | | | | |
| NS3 | 1732 | 0.04 | 3 | 1 | 0 | Y | DLMCHATFT | 99.65 | | | | | | |
| NS3 | 1733 | 0.04 | 3 | 1 | 0 | Y | LMCHATFTM | 99.65 | | | | | | |
| NS3 | 1734 | 0.04 | 3 | 1 | 0 | Y | MCHATFTMR | 99.65 | | | | | | |
| NS3 | 1735 | 0.04 | 3 | 1 | 0 | Y | CHATFTMRL | 99.65 | | | | | | |
| NS3 | 1736 | 0.02 | 2 | 1 | 0 | Y | HATFTMRLL | 99.82 | | | | | | |
| NS3 | 1737 | 0.02 | 2 | 1 | 0 | Y | ATFTMRLLS | 99.82 | | | | | | |
| NS3 | 1738 | 0.02 | 2 | 1 | 0 | Y | TFTMRLLSP | 99.82 | | | | | | |
| NS3 | 1739 | 0 | 1 | 1 | 0 | Y | FTMRLLSPV | 100 | | | | | | |
| NS3 | 1740 | 0 | 1 | 1 | 0 | Y | TMRLLSPVR | 100 | | | | | | |
| NS3 | 1741 | 0 | 1 | 1 | 0 | Y | MRLLSPVRV | 100 | | | | | | |
| NS3 | 1742 | 0.02 | 2 | 1 | 0 | Y | RLLSPVRVP | 99.82 | | | | | | |

FIG. 11-64

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1743 | 0.02 | 2 | 1 | 0 | Y | LLSPVRVPN | 99.82 | | | | |
| NS3 | 1744 | 0.02 | 2 | 1 | 0 | Y | LSPVRVPNY | 99.82 | | | | |
| NS3 | 1745 | 0.02 | 2 | 1 | 0 | Y | SPVRVPNYN | 99.82 | | | | |
| NS3 | 1746 | 0.02 | 2 | 1 | 0 | Y | PVRVPNYNL | 99.82 | | | | |
| NS3 | 1747 | 0.42 | 3 | 2 | 0 | Y | VRVPNYNLI | 91.86 | VRVPNYNLV | 7.96 | | |
| NS3 | 1748 | 0.58 | 5 | 3 | 0 | Y | RVPNYNLII | 89.73 | RVPNYNLVI | 7.79 | RVPNYNLIV | 2.12 |
| NS3 | 1749 | 0.58 | 5 | 3 | 0 | Y | VPNYNLIIM | 89.73 | VPNYNLVIM | 7.79 | VPNYNLIVM | 2.12 |
| NS3 | 1750 | 0.58 | 5 | 3 | 0 | Y | PNYNLIIMD | 89.73 | PNYNLVIMD | 7.79 | PNYNLIVMD | 2.12 |
| NS3 | 1751 | 0.56 | 4 | 3 | 0 | Y | NYNLIIMDE | 89.91 | NYNLVIMDE | 7.79 | NYNLIVMDE | 2.12 |
| NS3 | 1752 | 0.56 | 4 | 3 | 0 | Y | YNLIIMDEA | 89.91 | YNLVIMDEA | 7.79 | YNLIVMDEA | 2.12 |
| NS3 | 1753 | 0.56 | 4 | 3 | 0 | Y | NLIIMDEAH | 89.91 | NLVIMDEAH | 7.79 | NLIVMDEAH | 2.12 |
| NS3 | 1754 | 0.56 | 4 | 3 | 0 | Y | LIIMDEAHF | 89.91 | LVIMDEAHF | 7.79 | LIVMDEAHF | 2.12 |
| NS3 | 1755 | 0.56 | 4 | 3 | 0 | Y | IIMDEAHFT | 89.91 | VIMDEAHFT | 7.79 | IVMDEAHFT | 2.12 |
| NS3 | 1756 | 0.16 | 2 | 2 | 0 | Y | IMDEAHFTD | 97.7 | VMDEAHFTD | 2.3 | | |
| NS3 | 1757 | 0 | 1 | 1 | 0 | Y | MDEAHFTDP | 100 | | | | |
| NS3 | 1758 | 0 | 1 | 1 | 0 | Y | DEAHFTDPA | 100 | | | | |
| NS3 | 1759 | 0 | 1 | 1 | 0 | Y | EAHFTDPAS | 100 | | | | |
| NS3 | 1760 | 0 | 1 | 1 | 0 | Y | AHFTDPASI | 100 | | | | |
| NS3 | 1761 | 0.02 | 2 | 1 | 0 | Y | HFTDPASIA | 99.82 | | | | |
| NS3 | 1762 | 0.02 | 2 | 1 | 0 | Y | FTDPASIAA | 99.82 | | | | |
| NS3 | 1763 | 0.02 | 2 | 1 | 0 | Y | TDPASIAAR | 99.82 | | | | |
| NS3 | 1764 | 0.02 | 2 | 1 | 0 | Y | DPASIAARG | 99.82 | | | | |
| NS3 | 1765 | 0.02 | 2 | 1 | 0 | Y | PASIAARGY | 99.82 | | | | |
| NS3 | 1766 | 0.02 | 2 | 1 | 0 | Y | ASIAARGYI | 99.82 | | | | |
| NS3 | 1767 | 0.02 | 2 | 1 | 0 | Y | SIAARGYIS | 99.82 | | | | |
| NS3 | 1768 | 0.02 | 2 | 1 | 0 | Y | IAARGYIST | 99.82 | | | | |

FIG. 11-65

Species: DENV3 (9-mer)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1769 | 0.02 | 2 | 1 | 0 | Y | AARGYISTR | 99.82 | | | | | | |
| NS3 | 1770 | 0 | 1 | 1 | 0 | Y | ARGYISTRV | 100 | | | | | | |
| NS3 | 1771 | 0 | 1 | 1 | 0 | Y | RGYISTRVG | 100 | | | | | | |
| NS3 | 1772 | 0 | 1 | 1 | 0 | Y | GYISTRVGM | 100 | | | | | | |
| NS3 | 1773 | 0 | 1 | 1 | 0 | Y | YISTRVGMG | 100 | | | | | | |
| NS3 | 1774 | 0 | 1 | 1 | 0 | Y | ISTRVGMGE | 100 | | | | | | |
| NS3 | 1775 | 0.12 | 2 | 2 | 0 | Y | STRVGMGEA | 98.41 | STRVGMGET | 1.59 | | | | |
| NS3 | 1776 | 0.14 | 3 | 2 | 0 | Y | TRVGMGEAA | 98.23 | TRVGMGETA | 1.59 | | | | |
| NS3 | 1777 | 0.14 | 3 | 2 | 0 | Y | RVGMGEAAA | 98.23 | RVGMGETAA | 1.59 | | | | |
| NS3 | 1778 | 0.14 | 3 | 2 | 0 | Y | VGMGEAAAI | 98.23 | VGMGETAAI | 1.59 | | | | |
| NS3 | 1779 | 0.14 | 3 | 2 | 0 | Y | GMGEAAAIF | 98.23 | GMGETAAIF | 1.59 | | | | |
| NS3 | 1780 | 0.14 | 3 | 2 | 0 | Y | MGEAAAIFM | 98.23 | MGETAAIFM | 1.59 | | | | |
| NS3 | 1781 | 0.14 | 3 | 2 | 0 | Y | GEAAAIFMT | 98.23 | GETAAIFMT | 1.59 | | | | |
| NS3 | 1782 | 0.14 | 3 | 2 | 0 | Y | EAAAIFMTA | 98.23 | ETAAIFMTA | 1.59 | | | | |
| NS3 | 1783 | 0.14 | 3 | 2 | 0 | Y | AAAIFMTAT | 98.23 | TAAIFMTAT | 1.59 | | | | |
| NS3 | 1784 | 0.02 | 2 | 1 | 0 | Y | AAIFMTATP | 99.82 | | | | | | |
| NS3 | 1785 | 0 | 1 | 1 | 0 | Y | AIFMTATPP | 100 | | | | | | |
| NS3 | 1786 | 0 | 1 | 1 | 0 | Y | IFMTATPPG | 100 | | | | | | |
| NS3 | 1787 | 0 | 1 | 1 | 0 | Y | FMTATPPGT | 100 | | | | | | |
| NS3 | 1788 | 0.02 | 2 | 1 | 0 | Y | MTATPPGTA | 99.82 | | | | | | |
| NS3 | 1789 | 0.84 | 3 | 2 | 0 | Y | TATPPGTAD | 73.98 | TATPPGTAE | 25.84 | | | | |
| NS3 | 1790 | 0.86 | 4 | 2 | 0 | Y | ATPPGTADA | 73.81 | ATPPGTAEA | 25.84 | | | | |
| NS3 | 1791 | 0.86 | 4 | 2 | 0 | Y | TPPGTADAF | 73.81 | TPPGTAEAF | 25.84 | | | | |
| NS3 | 1792 | 0.86 | 4 | 2 | 0 | Y | PPGTADAFP | 73.81 | PPGTAEAFP | 25.84 | | | | |
| NS3 | 1793 | 0.86 | 4 | 2 | 0 | Y | PGTADAFPQ | 73.81 | PGTAEAFPQ | 25.84 | | | | |
| NS3 | 1794 | 0.86 | 4 | 2 | 0 | Y | GTADAFPQS | 73.81 | GTAEAFPQS | 25.84 | | | | |

FIG. 11-66

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|

FIG. 11-67

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---

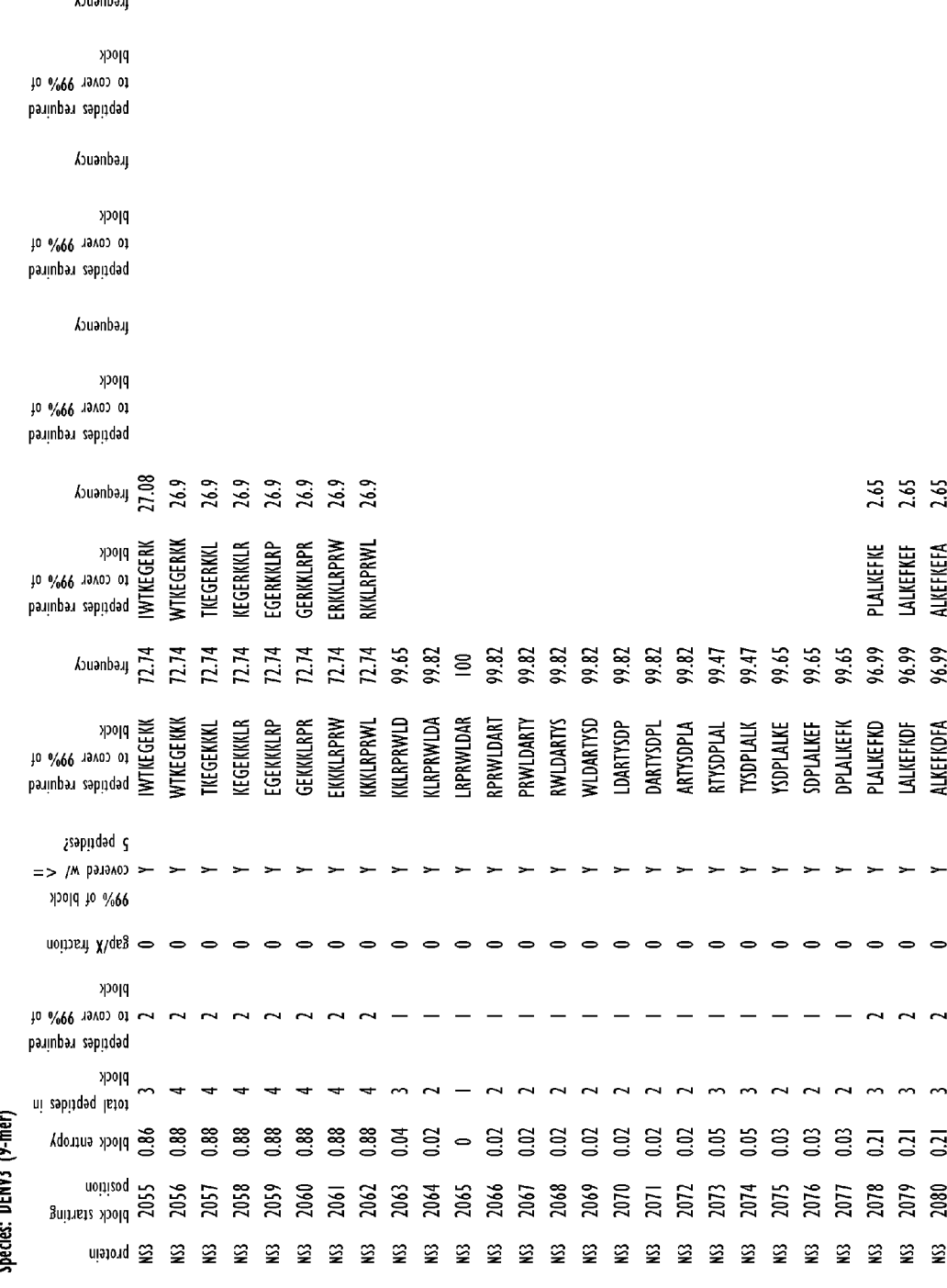

FIG. 11-77

Species: DENV3 (9-mer)

| protein | block starting position | block entropy | total peptides in block | peptides required to cover 99% of block | gap/X fraction | covered w/ <= 5 peptides? | block | frequency | block | frequency | block | frequency | block | frequency | block | frequency |
|---|---|---|---|---|---|---|---|---|---|---|---|---|---|---|---|---|
| NS3 | 2081 | 0.21 | 3 | 2 | 0 | Y | LKEFKDFAA | 96.99

FIG. 11-78

Species: DENV3 (9-mer)

| protein

FIG. 11-80

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2159 | 0.25 | 4 | 2 | 0 | Y | GAMLFLISG | 96.64 | GVMLFLISG | 2.48 | | | | |
| NS4A | 2160 | 0.33 | 5 | 3 | 0 | Y | AMLFLISGK | 95.58 | VMLFLISGK | 2.48 | AMLFLISGR | 1.06 | | |
| NS4A | 2161 | 0.16 | 4 | 2 | 0 | Y | MLFLISGKG | 98.05 | MLFLISGRG | 1.06 | | | | |
| NS4A | 2162 | 0.48 | 6 | 4 | 0 | Y | LFLISGKGI

FIG. 11-81

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4A | 2185 | 1.72 | 9 | 5 | 0 | Y | GMLWMAEIP | 52.04 | GMLWMADVP

FIG. 11-83

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|

FIG. 11-85

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS4B | 2290 | 0 | 1 | — | 0 | Y | ITPMLRHTI | 100 |
| NS4B | 2291 | 0 | 1 | — | 0 | Y | TPMLRHTIE | 100 |
| NS4B | 2292 | 0 | 1 | — | 0 | Y | PMLRHTIEN | 100 |
| NS4B | 2293 | 0 | 1 | — | 0 | Y | MLRHTIENS | 100 |
| NS4B | 2294 | 0 | 1 | — | 0 | Y | LRHTIENST | 100 |
| NS4B | 2295 | 0 | 1 | — | 0 | Y | RHTIENSTA | 100 |
| NS4B | 2296 | 0 | 1 | — | 0 | Y | HTIENSTAN | 100 |
| NS4B | 2297 | 0 | 1 | — | 0 | Y | TIENSTANV | 100 |
| NS4B | 2298 | 0 | 1 | — | 0 | Y | IENSTANVS | 100 |
| NS4B | 2299 | 0 | 1 | — | 0 | Y | ENSTANVSL | 100 |
| NS4B | 2300 | 0 | 1 | — | 0 | Y | NSTANVSLA | 100 |
| NS4B | 2301 | 0 | 1 | — | 0 | Y | STANVSLAA | 100 |
| NS4B | 2302 | 0 | 1 | — | 0 | Y | TANVSLAAI | 100 |
| NS4B | 2303 | 0 | 1 | — | 0 | Y | ANVSLAAIA | 100 |
| NS4B | 2304 | 0 | 1 | — | 0 | Y | NVSLAAIAN | 100 |
| NS4B | 2305 | 0 | 1 | — | 0 | Y | VSLAAIANQ | 100 |
| NS4B | 2306 | 0 | 1 | — | 0 | Y | SLAAIANQA | 100 |
| NS4B | 2307 | 0 | 1 | — | 0 | Y | LAAIANQAV | 100 |
| NS4B | 2308 | 0 | 1 | — | 0 | Y | AAIANQAVV | 100 |
| NS4B | 2309 | 0 | 1 | — | 0 | Y | AIANQAVVL | 100 |
| NS4B | 2310 | 0 | 1 | — | 0 | Y | IANQAVVLM | 100 |
| NS4B | 2311 | 0 | 1 | — | 0 | Y | ANQAVVLMG | 100 |
| NS4B | 2312 | 0 | 1 | — | 0 | Y | NQAVVLMGL | 100 |
| NS4B | 2313 | 0.03 | 2 | — | 0 | Y | QAVVLMGLD | 99.65 |
| NS4B | 2314 | 0.03 | 2 | — | 0 | Y | AVVLMGLDK | 99.65 |
| NS4B | 2315 | 0.03 | 2 | — | 0 | Y | VVLMGLDKG | 99.65 |

FIG. 11-86

Species: DENV3 (9-mer)

| protein | block starting position | block entropy | total

FIG. 11-87

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2342 | 0.13 | 3 | 2 | 0 | Y | SQVNPLTLT | 98.41 | SQVNPLTLT | 0.88 | | | | |
| NS4B | 2343 | 0.13 | 3 | 2 | 0 | Y | QVNPLTLTA | 98.41 | QVNPLTLTA | 0.88 | | | | |
| NS4B | 2344 | 0.22 | 4 | 3 | 0 | Y | VNPLTLTAA | 97.35 | VNPLTLTAV | 1.06 | VNPLTLTAA | 0.88 | | |
| NS4B | 2345 | 0.22 | 4 | 3 | 0 | Y | NPLTLTAAV | 97.35 | NPLTLTAVV | 1.06 | NPLTLTAAV | 0.88 | | |
| NS4B | 2346 | 0.24 | 5 | 3 | 0 | Y | PLTLTAAVL | 97.17 | P

FIG. 11-88

Species: DENV3 (9-mer)

| protein | block starting position | block entropy | total peptides in block | peptides required to cover 99% of block | gap/X fraction | 99% of block covered w/ <= 5 peptides? | block | frequency | peptides required to cover 99% of block |

FIG. 11-92

Species: DENV3 (9-mer)

| protein | block starting position | block entropy | total peptides in block | peptides required to cover 99% of block | gap/X fraction | 99% of block covered w/ <= 5 peptides? | peptides required to cover 99

FIG. 11-93

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|

FIG. 11-94

Species: DENV3 (9-mer)

| protein | block starting position | block entropy | total peptides in block | peptides required to cover 99% of block | gap/X fraction | 99% of block covered w/ <= 5 peptides? | block (to cover 99%) | fr

FIG. 11-95

Species: DENV3 (9-mer)

| protein | block starting position | block entropy | total pe

FIG. 11-96

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS5 | 2579 | 0.06 | 4 | 1 | 0 | Y | YYCAGLKKV | 99.47 |
| NS5 | 2580 | 0.07 | 5 | 1 | 0 | Y | YCAGLKKVT | 99.29 |
| NS5 | 2581 | 0.07 | 5 | 1 | 0 | Y | CAGLKKVTE | 99.29 |
| NS5 | 2582 | 0.07 | 5 | 1 | 0 | Y | AGLKKVTEV | 99.29 |
| NS5 | 2583 | 0.06 | 4 | 1 | 0.18 | Y | GLKKVTEVR | 99.29 |
| NS5 | 2584 | 0.06 | 4 | 1 | 0.18 | Y | LKKVTEVRG | 99.29 |
| NS5 | 2585 | 0.06 | 4 | 1 | 0.18 | Y | KKVTEVRGY | 99.29 |
| NS5 | 2586 | 0.04 | 3 | 1 | 0.18 | Y | KVTEVRGYT | 99.47 |
| NS5 | 2587 | 0.02 | 2 | 1 | 0.18 | Y | VTEVRGYTK | 99.65 |
| NS5 | 2588 | 0.04 | 3 | 1 | 0.18 | Y | TEVRGYTKG | 99.47 |
| NS5 | 2589 | 0.02 | 2 | 1 | 0.18 | Y | EVRGYTKGG | 99.65 |
| NS5 | 2590 | 0.02 | 2 | 1 | 0.18 | Y | VRGYTKGGP | 99.65 |
| NS5 | 2591 | 0.02 | 2 | 1 | 0.18 | Y | RGYTKGGPG | 99.65 |
| NS5 | 2592 | 0.04 | 3 | 1 | 0 | Y | GYTKGGPGH | 99.65 |
| NS5 | 2593 | 0.02 | 2 | 1 | 0 | Y | YTKGGPGHE | 99.65 |
| NS5 | 2594 | 0.04 | 3 | 1 | 0 | Y | TKGGPGHEE | 99.65 |
| NS5 | 2595 | 0.04 | 3 | 1 | 0 | Y | KGGPGHEEP | 99.65 |
| NS5 | 2596 | 0.04 | 3 | 1 | 0 | Y | GGPGHEEPV | 99.65 |
| NS5 | 2597 | 0.02 | 2 | 1 | 0 | Y | GPGHEEPVP | 99.82 |
| NS5 | 2598 | 0.02 | 2 | 1 | 0 | Y | PGHEEPVPM | 99.82 |
| NS5 | 2599 | 0.02 | 2 | 1 | 0 | Y | GHEEPVPMS | 99.82 |
| NS5 | 2600 | 0.02 | 2 | 1 | 0 | Y | HEEPVPMST | 99.82 |
| NS5 | 2601 | 0.04 | 3 | 1 | 0 | Y | EEPVPMSTY | 99.65 |
| NS5 | 2602 | 0.04 | 3 | 1 | 0 | Y | EPVPMSTYG | 99.65 |
| NS5 | 2603 | 0.04 | 3 | 1 | 0 | Y | PVPMSTYGW | 99.65 |
| NS5 | 2604 | 0.04 | 3 | 1 | 0 | Y | VPMSTYGWN | 99.65 |

FIG. 11-97

Species: DENV3 (9-mer)

| prot

FIG. 11-99

Species: DENV3 (9-mer)

| protein | block starting position | block entropy | total pe

FIG. 11-100

Species: DENV3 (9-mer)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS5 | 2683 | 0.8 | 4 | 2 | 0 | Y | LERLQRKHG | 77.7 | LERLQRKYG | 21.95 |
| NS5 | 2684 | 0.8 | 4 | 2 | 0 | Y | ERLQRKHGG | 77.7 | ERLQRKYGG | 21.95 |
| NS5 | 2685 | 0.8 | 4 | 2 | 0 | Y | RLQRKHGGM | 77.7 | RLQRKYGGM | 21.95 |
| NS5 | 2686 | 0.78 | 3 | 2 | 0 | Y | LQRKHGGML | 77.7 | LQRKYGGML | 22.12 |
| NS5 | 2687 | 0.78 | 3 | 2 | 0 | Y | QRKHGGMLV | 77.7 | QRKYGGMLV | 22.12 |
| NS5 | 2688 | 0.78 | 3 | 2 | 0 | Y | RKHGGMLVR | 77.7 | RKYGGMLVR | 22.12 |
| NS5 | 2689 | 0.82 | 5 | 2 | 0 | Y | KHGGMLVRN | 77.35 | KYGGMLVRN | 22.12 |
| NS5 | 2690 | 0.8 | 4 | 2 | 0 | Y | HGGMLVRNP | 77.35 | YGGMLVRNP | 22.3 |
| NS5 | 2691 | 0.04 | 3 | 1 | 0 | Y | GGMLVRNPL | 99.65 | | |
| NS5 | 2692 | 0.04 | 3 | 1 | 0 | Y | GMLVRNPLS | 99.65 | | |
| NS5 | 2693 | 0.04 | 3 | 1 | 0 | Y | MLVRNPLSR | 99.65 | | |
| NS5 | 2694 | 0.04 | 3 | 1 | 0 | Y | LVRNPLSRN | 99.65 | | |
| NS5 | 2695 | 0.04 | 3 | 1 | 0 | Y | VRNPLSRNS | 99.65 | | |
| NS5 | 2696 | 0.04 | 3 | 1 | 0 | Y | RNPLSRNST | 99.65 | | |
| NS5 | 2697 | 0.04 | 3 | 1 | 0 | Y | NPLSRNSTH | 99.65 | | |
| NS5 | 2698 | 0 | 1 | 1 | 0 | Y | PLSRNSTHE | 100 | | |
| NS5 | 2699 | 0 | 1 | 1 | 0 | Y | LSRNSTHEM | 100 | | |
| NS5 | 2700 | 0.04 | 3 | 1 | 0 | Y | SRNSTHEMY | 99.65 | | |
| NS5 | 2701 | 0.04 | 3 | 1 | 0 | Y | RNSTHEMYW | 99.65 | | |
| NS5 | 2702 | 0.04 | 3 | 1 | 0 | Y | NSTHEMYWI | 99.65 | | |
| NS5 | 2703 | 0.04 | 3 | 1 | 0 | Y | STHEMYWIS | 99.65 | | |
| NS5 | 2704 | 0.04 | 3 | 1 | 0 | Y | THEMYWISN | 99.65 | | |
| NS5 | 2705 | 0.04 | 3 | 1 | 0 | Y | HEMYWISNG | 99.65 | | |
| NS5 | 2706 | 0.09 | 4 | 1 | 0 | Y | EMYWISNGT | 99.12 | | |
| NS5 | 2707 | 0.09 | 4 | 1 | 0 | Y | MYWISNGTG | 99.12 | | |
| NS5 | 2708 | 0.09 | 4 | 1 | 0 | Y | YWISNGTGN | 99.12 | | |

FIG. 11-102

Species: DENV3 (9-mer)

| protein | block starting position | block entropy | total peptides in block | pe

FIG. 11-103

Species: DENV3 (9-mer)

| protein | block starting position | block entropy | total peptides in block | peptides required to cover 99% of block | gap/X fraction | 99% of block covered w/ <=

FIG. 11-105

Species: DENV3 (9-mer)

| protein | block starting position | block entropy | total pe

FIG. 11-106

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | peptides required to cover 99

FIG. 11-108

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 11-109

Species: DENV3 (9-mer)

| protein | block starting position

FIG. 11-113

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 3031 | 0.06 | 4 | 1 | 0 | Y | ITEDDLHNE | 99.47 | | | | | | |
| NS5 | 3032 | 0.06 | 4 | 1 | 0 | Y | TEDDLHNEE | 99.47 | | | | | | |
| NS5 | 3033 | 0.04 | 3 | 1 | 0 | Y | EDDLHNEEK | 99.65 | | | | | | |
| NS5 | 3034 | 0.04 | 3 | 1 | 0 | Y | DDLHNEEKI | 99.65 | | | | | | |
| NS5 | 3035 | 0.5 | 5 | 3 | 0 | Y | DLHNEEKIT | 90.8 | DLHNEEKIM | 8.14 | | | | |
| NS5 | 3036 | 0.54 | 6 | 3 | 0 | Y | LHNEEKITQ | 90.44 | LHNEEKIMQ | 8.14 | | | | |
| NS5 | 3037 | 0.54 | 6 | 3 | 0 | Y | HNEEKITQQ | 90.44 | HNEEKIMQQ | 8.14 | | | | |
| NS5 | 3038 | 0.52 | 5 | 3 | 0 | Y | NEEKITQQM | 90.62 | NEEKIMQQM | 8.14 | | | | |
| NS5 | 3039 | 0.55 | 6 | 3 | 0 | Y | EEKITQQMD | 90.27 | EEKIMQQMD | 8.14 | | | | |
| NS5 | 3040 | 0.55 | 6 | 3 | 0 | Y | EKITQQMDP | 90.27 | EKIMQQMDP | 8.14 | | | | |
| NS5 | 3041 | 0.59 | 8 | 4 | 0 | Y | KITQQMDPE | 89.91 | KIMQQMDPE | 8.14 | KITQQMNPE | 0.35 | | |
| NS5 | 3042 | 0.59 | 8 | 4 | 0 | Y | ITQQMDPEH | 89.91 | IMQQMDPEH | 8.14 | ITQQMNPEH | 0.35 | | |
| NS5 | 3043 | 0.62 | 9 | 5 | 0 | Y | TQQMDPEHR | 89.56 | MQQMDPEHR | 8.14 | TQQMDPEHK | 0.35 | THQMDPEHR | 0.35 |
| NS5 | 3045 | 0.23 | 10 | 5 | 0 | Y | QMDPEHRQL | 97.7 | QMDPEHRRL | 0.35 | QMDPEHRLL | 0.35 | QMDPEHRKL | 0.35 |
| NS5 | 3046 | 0.23 | 10 | 5 | 0 | Y | MDPEHRQLA | 97.7 | MDPEHRRLA | 0.35 | MDPEHRLLA | 0.35 | MDPEHRRLA | 0.35 |
| NS5 | 3048 | 0.38 | 9 | 5 | 0 | Y | PEHRQLANA | 95.22 | PEHRLLANA | 2.65 | PEHRLLANA | 0.35 | PEHRKLANA | 0.35 |
| NS5 | 3049 | 0.38 | 9 | 5 | 0 | Y | EHRQLANAI | 95.22 | EHRLLANAI | 2.65 | EHRKLANAI | 0.35 | EHRRLANAI | 0.35 |
| NS5 | 3050 | 0.36 | 8 | 5 | 0 | Y | HRQLANAIF | 95.4 | HRLLANAIF | 2.65 | HKQLANAIF | 0.35 | HRKLANAIF | 0.35 |
| NS5 | 3051 | 0.36 | 8 | 5 | 0 | Y | RQLANAIFK | 95.4 | RLLANAIFK | 2.65 | KQLANAIFK | 0.35 | RRLANAIFK | 0.35 |
| NS5 | 3052 | 0.33 | 7 | 4 | 0 | Y | QLANAIFKL | 95.75 | LLANAIFKL | 2.65 | RLANAIFKL | 0.35 | | |
| NS5 | 3053 | 0.21 | 4 | 2 | 0 | Y | LANAIFKLT | 96.99 | | | | | | |
| NS5 | 3054 | 0.21 | 4 | 2 | 0 | Y | ANAIFKLTY | 96.99 | | | | | | |
| NS5 | 3055 | 0.21 | 4 | 2 | 0 | Y | NAIFKLTYQ | 96.99 | | | | | | |
| NS5 | 3056 | 0 | 1 | 1 | 0 | Y | AIFKLTYQN | 100 | | | | | | |
| NS5 | 3057 | 0 | 1 | 1 | 0 | Y | IFKLTYQNK | 100 | | | | | | |
| NS5 | 3058 | 0.02 | 2 | 1 | 0 | Y | FKLTYQNKV | 99.82 | | | | | | |

FIG. 11-115

Species: DENV3 (9-mer)

| protein | block starting position | block entropy | total peptides in block | peptides required to cover 99% of block | gap/X fraction | covered w/ <= 5 peptides? | block | frequency | peptides required to cover 99% of block | block | frequency | peptides required to cover 99% of block | block | frequency | peptides required to cover 99% of block | block | frequency |
|---|---|---|---|---|---|---|---|---|---|---|---|---|---|---|---|---|---|
| NS5 | 3085 | 0.03 | 2 | 1 | 0 | Y | KDQRGSGQV | 99.65 | | | | | | | | | |
| NS5 | 3086 | 0.03 | 2 | 1 | 0 | Y | DQRGSGQVG | 99.65 | | | | | | | | | |
| NS5 | 3087 | 0.03 | 2 | 1 | 0 | Y | QRGSGQVGT | 99.65 | | | | | | | | | |
| NS5 | 3088 | 0.03 | 2 | 1 | 0 | Y | RGSGQVGTY | 99.65 | | | | | | | | | |
| NS5 | 3089 | 0.05 | 3 | 1 | 0 | Y | GSGQVGTYG | 99.47 | | | | | | | | | |
| NS5 | 3090 | 0.05 | 3 | 1 | 0 | Y | SGQVGTYGL | 99.47 | | | | | | | | | |
| NS5 | 3091 | 0.05 | 3 | 1 | 0 | Y | GQVGTYGLN | 99.47 | | | | | | | | | |
| NS5 | 3092 | 0.05 | 3 | 1 | 0 | Y | QVGTYGLNT | 99.47 | | | |

FIG. 11-116

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3139 | 0.61 | 9 | 4 | 0 | Y | ETKGVERLR | 90.8 | ETKGVERLK | 5.31 | ETEGVERLIK | 1.77 | | |
| NS5 | 3140 | 0.61 | 9 | 4 | 0 | Y | TKGVERLKR | 90.8 | TKGVERLRR | 5.31 | TEGVERLKR | 1.77 | ENKGVERLIK | 1.24 |
| NS5 | 3141 | 0.47 | 5 | 3 | 0 | Y | KGVERLKRM | 92.39 | KGVERLRRM | 5.31 | EGVERLKRM | 1.95 | NKGVERLKR | 1.24 |
| NS5 | 3142 | 0.32 | 3 | 2 | 0 | Y | GVERLKRMA | 94.51 | GVERLRRMA | 5.31 | | | | |
| NS5 | 3143 | 0.32 | 3 | 2 | 0 | Y | VERLKRMAI | 94.51 | VERLRRMAI | 5.31 | | | | |
| NS5 | 3144 | 0.32 | 3 | 2 | 0 | Y | ERLKRMAIS | 94.51 | ERLRRMAIS | 5.31 | | | | |
| NS5 | 3145 | 0.3 | 2 | 2 | 0 | Y | RLKRMAISG | 94.69 | RLRRMAISG | 5.31 | | | | |
| NS5 | 3146 | 0.3 | 2 | 2 | 0 | Y | LKRMAISGD | 94.69 | LRRMAISGD | 5.31 | | | | |
| NS5 | 3147 | 0.3 | 2 | 2 | 0 | Y | KRMAISGDD | 94.69 | RRMAISGDD | 5.31 | | | | |
| NS5 | 3148 | 0 | 1 | 1 | 0 | Y | RMAISGDDC | 100 | | | | | | |
| NS5 | 3149 | 0 | 1 | 1 | 0 | Y | MAISGDDCV | 100 | | | | | | |
| NS5 | 3150 | 0 | 1 | 1 | 0 | Y | AISGDDCVW | 100 | | | | | | |
| NS5 | 3151 | 0 | 1 | 1 | 0 | Y | ISGDDCVWK | 100 | | | | | | |
| NS5 | 3152 | 0 | 1 | 1 | 0 | Y | SGDDCVWKP | 100 | | | | | | |
| NS5 | 3153 | 0 | 1 | 1 | 0 | Y | GDDCVWKPI | 100 | | | | | | |
| NS5 | 3154 | 0 | 1 | 1 | 0 | Y | DDCVWKPID | 100 | | | | | | |
| NS5 | 3155 | 0 | 1 | 1 | 0 | Y | DCVWKPIDD | 100 | | | | | | |
| NS5 | 3156 | 0 | 1 | 1 | 0 | Y | CVWKPIDDR | 100 | | | | | | |
| NS5 | 3157 | 0 | 1 | 1 | 0 | Y | VWKPIDDRF | 100 | | | | | | |
| NS5 | 3158 | 0 | 1 | 1 | 0 | Y | VKPIDDRFA | 100 | | | | | | |
| NS5 | 3159 | 0.04 | 3 | 1 | 0 | Y | KPIDDRFAN | 99.65 | | | | | | |
| NS5 | 3160 | 0.04 | 3 | 1 | 0 | Y | PIDDRFANA | 99.65 | | | | | | |
| NS5 | 3161 | 0.04 | 3 | 1 | 0 | Y | IDDRFANAL | 99.65 | | | | | | |
| NS5 | 3162 | 0.2 | 5 | 2 | 0 | Y | DDRFANALL | 97.35 | DDRFANALF | 2.12 | | | | |
| NS5 | 3163 | 0.2 | 5 | 2 | 0 | Y | DRFANALLA | 97.35 | DRFANALFA | 2.12 | | | | |
| NS5 | 3164 | 0.2 | 5 | 2 | 0 | Y | RFANALLAL | 97.35 | RFANALFAL | 2.12 | | | | |

FIG. 11-117

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|

FIG. 11-118

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3191 | 0.13 | 3 | 2 | 0 | Y | WHDWQQVPF | 98.41 | WQDWQQVPF | 1.42 | | | | | | |
| NS5 | 3192 | 0.11 | 3 | 2 | 0 | Y | HDWQQVPFC | 98.58 | QDWQQVPFC | 1.42 | | | | | | |
| NS5 | 3193 | 0 | 2 | 2 | 0 | Y | DWQQVPFCS | 100 | | | | | | | | |
| NS5 | 3194 | 0 | 1 | 1 | 0 | Y | WQQVPFCSH | 100 | | | | | | | | |
| NS5 | 3195 | 0 | 1 | 1 | 0 | Y | QQVPFCSHH | 100 | | | | | | | | |
| NS5 | 3196 | 0 | 1 | 1 | 0 | Y | QVPFCSHHF | 100 | | | | | | | | |
| NS5 | 3197 | 0 | 1 | 1 | 0 | Y | VPFCSHHFH | 100 | | | | | | | | |
| NS5 | 3198 | 0 | 1 | 1 | 0 | Y | PFCSHHFHE | 100 | | | | | | | | |
| NS5 | 3199 | 0 | 1 | 1 | 0 | Y | FCSHHFHEL | 100 | | | | | | | | |
| NS5 | 3200 | 0.02 | 2 | 1 | 0 | Y | CSHHFHELI | 99.82 | | | | | | | | |
| NS5 | 3201 | 0.02 | 2 | 1 | 0 | Y | SHHFHELIM | 99.82 | | | | | | | | |
| NS5 | 3202 | 0.02 | 2 | 1 | 0 | Y | HHFHELIMK | 99.82 | | | | | | | | |
| NS5 | 3203 | 0.02 | 2 | 1 | 0 | Y | HFHELIMKD | 99.82 | | | | | | | | |
| NS5 | 3204 | 0.02 | 2 | 1 | 0 | Y | FHELIMKDG | 99.82 | | | | | | | | |
| NS5 | 3205 | 0.02 | 2 | 1 | 0 | Y | HELIMKDGR | 99.82 | | | | | | | | |
| NS5 | 3206 | 0.04 | 3 | 1 | 0 | Y | ELIMKDGRK | 99.65 | | | | | | | | |
| NS5 | 3207 | 0.04 | 3 | 1 | 0 | Y | LIMKDGRKL | 99.65 | | | | | | | | |
| NS5 | 3208 | 0.02 | 2 | 1 | 0 | Y | IMKDGRKLV | 99.82 | | | | | | | | |
| NS5 | 3209 | 0.02 | 2 | 1 | 0 | Y | MKDGRKLVW | 99.82 | | | | | | | | |
| NS5 | 3210 | 0.02 | 2 | 1 | 0 | Y | KDGRKLVWP | 99.82 | | | | | | | | |
| NS5 | 3211 | 0.02 | 2 | 1 | 0 | Y | DGRKLVWPC | 99.82 | | | | | | | | |
| NS5 | 3212 | 0.04 | 3 | 1 | 0 | Y | GRKLVWPCR | 99.65 | | | | | | | | |
| NS5 | 3213 | 0.04 | 3 | 1 | 0 | Y | RKLVWPCRP | 99.47 | | | | | | | | |
| NS5 | 3214 | 0.06 | 4 | 1 | 0 | Y | KLVWPCRPQ | 99.65 | | | | | | | | |
| NS5 | 3215 | 0.04 | 3 | 1 | 0 | Y | LVWPCRPQD | 99.65 | | | | | | | | |
| NS5 | 3216 | 0.04 | 3 | 1 | 0 | Y | VWPCRPQDE | 99.65 | | | | | | | | |

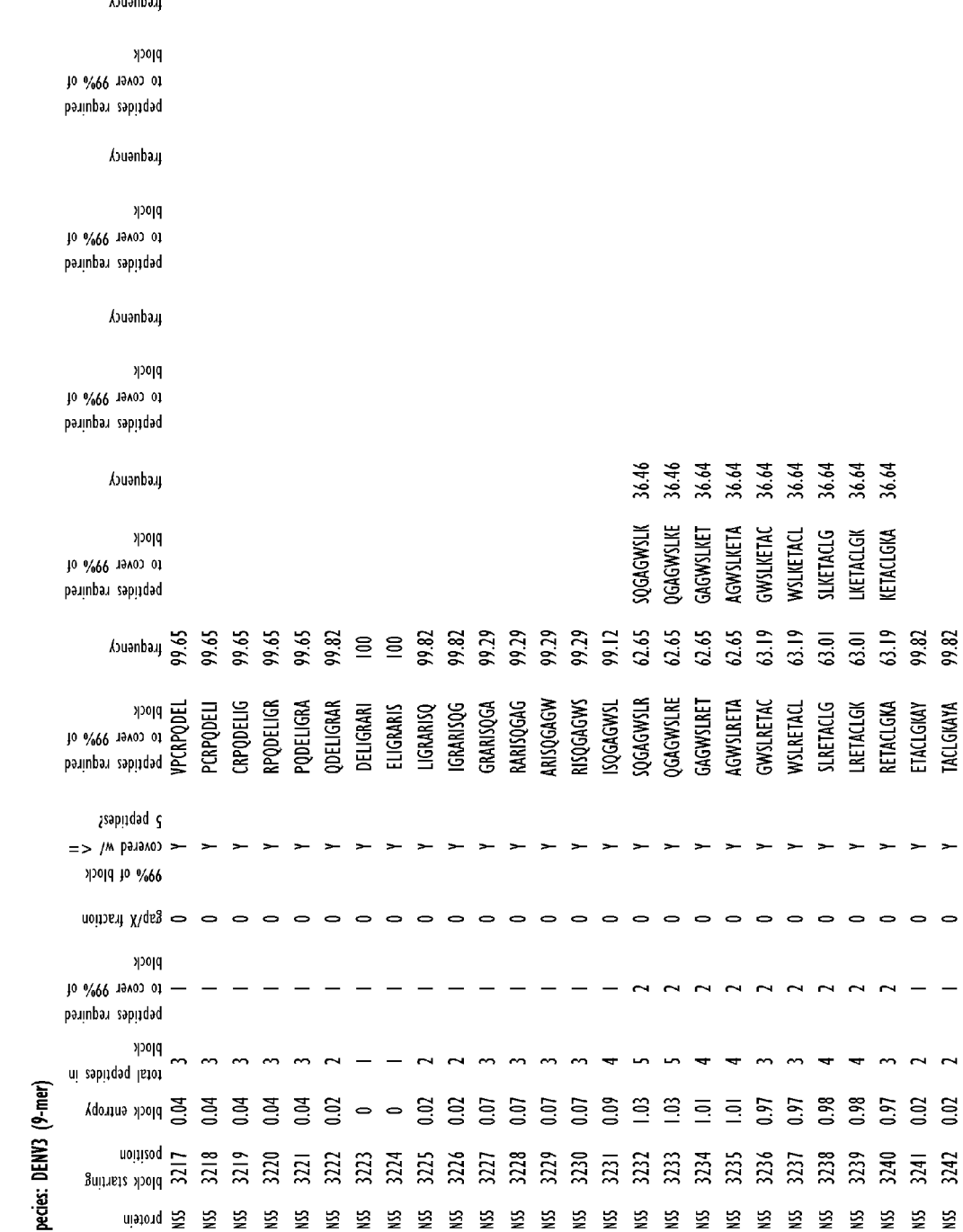

FIG. 11-122

Species: DENV3 (9-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 3295 | 0.23 | 5 | 3 | 0 | Y | MTTEDMLTV | 97.17 | MTTEDMLAV | 1.24 | MTTEDMLSV | 1.06 | | |
| NS5 | 3296 | 0.23 | 5 | 3 | 0 | Y | TTEDMLTVW | 97.17 | TTEDMLAVW | 1.24 | TEDMLSVW | 1.06 | | |
| NS5 | 3297 | 0.23 | 5 | 3 | 0 | Y | TEDMLTVWN | 97.17 | TEDMLAVWN | 1.24 | TEDMLSVWN | 1.06 | | |
| NS5 | 3298 | 0.23 | 5 | 3 | 0 | Y | EDMLTVWNR | 97.17 | EDMLAVWNR | 1.24 | EDMLSVWNR | 1.06 | | |
| NS5 | 3299 | 0.23 | 5 | 3 | 0 | Y | DMLTVWNRV | 97.17 | DMLAVWNRV | 1.24 | DMLSVWNRV | 1.06 | | |
| NS5 | 3300 | 0.21 | 4 | 3 | 0 | Y | MLTVWNRVW | 97.35 | MLAVWNRVW | 1.24 | MLSVWNRVW | 1.06 | | |
| NS5 | 3301 | 0.21 | 4 | 3 | 0 | Y | LTVWNRVWI | 97.35 | LAVWNRVWI | 1.24 | LSVWNRVWI | 1.06 | | |
| NS5 | 3302 | 0.21 | 4 | 3 | 0 | Y | TVWNRVWIE | 97.35 | AVWNRVWIE | 1.24 | SVWNRVWIE | 1.06 | | |
| NS5 | 3303 | 0.43 | 2 | 2 | 0 | Y | VWNRVWIED | 91.15 | VWNRVWIEE | 8.85 | | | | |
| NS5 | 3304 | 0.43 | 2 | 2 | 0 | Y | WNRVWIEDN | 91.15 | WNRVWIEEN | 8.85 | | | | |
| NS5 | 3305 | 0.43 | 2 | 2 | 0 | Y | NRVWIEDNP | 91.15 | NRVWIEENP | 8.85 | | | | |
| NS5 | 3306 | 0.43 | 2 | 2 | 0 | Y | RVWIEDNPW | 91.15 | RVWIEENPW | 8.85 | | | | |
| NS5 | 3307 | 0.43 | 2 | 2 | 0 | Y | VWIEDNPWM | 91.15 | VWIEENPWM | 8.85 | | | | |
| NS5 | 3308 | 0.46 | 3 | 2 | 0 | Y | WIEDNPWME | 90.8 | WIEENPWME | 8.85 | | | | |
| NS5 | 3309 | 0.5 | 4 | 2 | 0 | Y | IEDNPWMED | 90.44 | IEENPWMED | 8.85 | | | | |
| NS5 | 3310 | 0.5 | 4 | 2 | 0 | Y | EDNPWMEDK | 90.44 | EENPWMEDK | 8.85 | | | | |
| NS5 | 3311 | 0.5 | 4 | 2 | 0 | Y | DNPWMEDKT | 90.44 | ENPWMEDKT | 8.85 | | | | |
| NS5 | 3312 | 0.07 | 3 | 1 | 0 | Y | NPWMEDKTP | 99.29 | | | | | | |
| NS5 | 3313 | 0.16 | 4 | 2 | 0 | Y | PWMEDKTPV | 98.05 | PWMEDKTPI | 1.24 | | | | |
| NS5 | 3314 | 0.22 | 7 | 3 | 0 | Y | WMEDKTPVT | 97.52 | WMEDKTPIT | 1.24 | WMENKTPVT | 0.35 | | |
| NS5 | 3315 | 0.22 | 7 | 3 | 0 | Y | MEDKTPVTT | 97.52 | MEDKTPITT | 1.24 | MGDKTPVTT | 0.35 | | |
| NS5 | 3316 | 0.22 | 7 | 3 | 0 | Y | EDKTPVTTW | 97.52 | EDKTPITTW | 1.24 | ENKTPVTTW | 0.35 | | |
| NS5 | 3317 | 0.19 | 6 | 2 | 0 | Y | DKTPVTTWE | 97.88 | DKTPITTWE | 1.24 | | | | |
| NS5 | 3318 | 1.11 | 7 | 4 | 0 | Y | KTPVTTWEN | 60.53 | KTPVTTWED | 37.7 | KTPITTWEN | 0.71 | KTPITTWED | 0.53 |
| NS5 | 3319 | 1.14 | 8 | 4 | 0 | Y | TPVTTWENV | 60.53 | TPVTTWEDV | 37.35 | TPITTWENV | 0.71 | TPITTWEDV | 0.53 |
| NS5 | 3320 | 1.14 | 8 | 4 | 0 | Y | PVTTWENVP | 60.53 | PVTTWEDVP | 37.35 | PITTWENVP | 0.71 | PITTWEDVP | 0.53 |

FIG. 11-123

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3321 | 1.14 | 8 | 4 | 0 | Y | VTTWENWPY | 60.53 | VTTWEDVPY | 37.35 | ITTWENPY | 0.71 | ITTWEDVPY | 0.53 |
| NS5 | 3322 | 1.04 | 6 | 2 | 0 | Y | TTWENPYL | 61.24 | TTWEDVPYL | 37.88 | | | | |
| NS5 | 3323 | 0.99 | 3 | 2 | 0 | Y | TWENPYLG | 61.24 | TWEDVPYLG | 38.41 | | | | |
| NS5 | 3324 | 0.99 | 3 | 2 | 0 | Y | WENVPYLGK | 61.24 | WEDVPYLGK | 38.41 | | | | |
| NS5 | 3325 | 0.99 | 3 | 2 | 0 | Y | ENVPYLGKR | 61.24 | EDVPYLGKR | 38.41 | | | | |
| NS5 | 3326 | 0.99 | 3 | 2 | 0 | Y | NVPYLGKRE | 61.24 | DVPYLGKRE | 38.41 | | | | |
| NS5 | 3327 | 0.03 | 2 | 1 | 0 | Y | VPYLGKRED | 99.65 | | | | | | |
| NS5 | 3328 | 0 | 1 | 1 | 0 | Y | PYLGKREDQ | 100 | | | | | | |
| NS5 | 3329 | 0 | 1 | 1 | 0 | Y | YLGKREDQW | 100 | | | | | | |
| NS5 | 3330 | 0 | 1 | 1 | 0 | Y | LGKREDQWC | 100 | | | | | | |
| NS5 | 3331 | 0 | 1 | 1 | 0 | Y | GKREDQWCG | 100 | | | | | | |
| NS5 | 3332 | 0 | 1 | 1 | 0 | Y | KREDQWCGS | 100 | | | | | | |
| NS5 | 3333 | 0.02 | 2 | 1 | 0 | Y | REDQWCGSL | 99.82 | | | | | | |
| NS5 | 3334 | 0.02 | 2 | 1 | 0 | Y | EDQWCGSLI | 99.82 | | | | | | |
| NS5 | 3335 | 0.02 | 2 | 1 | 0 | Y | DQWCGSLIG | 99.82 | | | | | | |
| NS5 | 3336 | 0.04 | 3 | 1 | 0 | Y | QWCGSLIGL | 99.65 | | | | | | |
| NS5 | 3337 | 0.06 | 4 | 1 | 0 | Y | WCGSLIGLT | 99.47 | | | | | | |
| NS5 | 3338 | 0.06 | 4 | 1 | 0 | Y | CGSLIGLTS | 99.47 | | | | | | |
| NS5 | 3339 | 0.06 | 4 | 1 | 0 | Y | GSLIGLTSR | 99.47 | | | | | | |
| NS5 | 3340 | 0.07 | 5 | 1 | 0 | Y | SLIGLTSRA | 99.29 | | | | | | |
| NS5 | 3341 | 0.07 | 5 | 1 | 0 | Y | LIGLTSRAT | 99.29 | | | | | | |
| NS5 | 3342 | 0.06 | 4 | 1 | 0 | Y | IGLTSRATW | 99.47 | | | | | | |
| NS5 | 3343 | 0.06 | 4 | 1 | 0 | Y | GLTSRATWA | 99.47 | | | | | | |
| NS5 | 3344 | 0.06 | 4 | 1 | 0 | Y | LTSRATWAQ | 99.47 | | | | | | |
| NS5 | 3345 | 0.04 | 3 | 1 | 0 | Y | TSRATWAQN | 99.65 | | | | | | |
| NS5 | 3346 | 0.02 | 2 | 1 | 0 | Y | SRATWAQNI | 99.82 | | | | | | |

FIG. 11-124

Species: DENV3 (9-mer)

| protein | block starting position | block entropy | total peptides in block | peptides required to cover 99% of block | gap/X fraction | covered w/ <= 5 peptides? | peptides required to cover 99% of block | fr

FIG. 11-125

Species: DENV3 (9-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3373 | 0.05 | 3 | 1 | 0 | Y | YMPSMKRFR | 99.47 | | | | | | |
| NS5 | 3374 | 0.05 | 3 | 1 | 0 | Y | MPSMKRFRK | 99.47 | | | | | | |
| NS5 | 3375 | 0.05 | 3 | 1 | 0 | Y | PSMKRFRKE | 99.47 | | | | | | |
| NS5 | 3376 | 0.05 | 3 | 1 | 0 | Y | SMKRFRKEE | 99.47 | | | | | | |
| NS5 | 3377 | 0.03 | 2 | 1 | 0 | Y | MKRFRKEEE | 99.65 | | | | | | |
| NS5 | 3378 | 0.58 | 4 | 3 | 0 | Y | KRFRKEEES | 89.2 | KRFRKEEEL | 9.03 | KRFRKEEET | 1.42 | | |
| NS5 | 3379 | 0.58 | 4 | 3 | 0 | Y | RFRKEEESE | 89.2 | RFRKEEELE | 9.03 | RFRKEEETE | 1.42 | | |
| NS5 | 3380 | 0.58 | 4 | 3 | 0 | Y | FRKEEESEG | 89.2 | FRKEEELEG | 9.03 | FRKEEETEG | 1.42 | | |
| NS5 | 3381 | 0.62 | 5 | 3 | 0 | Y | RKEEESEGA | 88.67 | RKEEELEGA | 9.03 | RKEEETEGA | 1.42 | | |
| NS5 | 3382 | 0.59 | 4 | 3 | 0 | Y | KEEESEGAI | 89.03 | KEEELEGAI | 9.03 | KEEETEGAI | 1.42 | | |
| NS5 | 3383 | 0.59 | 4 | 3 | 0 | Y | EEESEGAIW | 89.03 | EEELEGAIW | 9.03 | EEETEGAIW | 1.42 | | |

FIG. 12-1

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | pe

FIG. 12-2

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | fr

FIG. 12-3

Species: DENV3 (10-mer)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|

FIG. 12-4

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required

FIG. 12-5

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 117 | 0.05 | 3 | 1 | 0 | Y | LTSRDGEPRM | 99.47 | | | | | | |
| prM | 118 | 0.05 | 3 | 1 | 0 | Y | TSRDGEPRMI | 99.47 | | | | | | |
| prM | 119 | 0.05 | 3 | 1 | 0 | Y | SRDGEPRMIV | 99.47 | | | | | | |
| prM | 120 | 0.28 | 4 | 2 | 0 | Y | RDGEPRM

FIG. 12-6

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 143 | 0.11 | 3

FIG. 12-8

Species: DENV3 (10-mer)

| protein | block starting position | block entropy | total

FIG. 12-9

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 229 | 0.09 | 4 | 1 | 0 | Y | GAWRQVEKVE | 99.12 | AWRQVERVET | 0.53 | | | | |
| prM | 230 | 0.1 | 5 | 2 | 0 | Y | AWRQVEKVET | 98.94 | WRQVERVETW | 0.53 | | | | |
| prM | 231 | 0.1 | 5 | 2 | 0 | Y | WRQVEKVETW | 98.94 | RQVERVETWA | 0.53 | | | | |
| prM | 232 | 0.1 | 5 | 2 | 0 | Y | RQVEKVETWA | 98.94 | QVEKVETWAF | 9.56 | QVERVETWAL | 0.35 | | |
| prM | 233 | 0.56 | 7 | 3 | 0 | Y | QVEKVETWAL | 89.38 | VEKVETWAFR | 9.56 | | | | |
| prM | 234 | 0.54 | 6 | 2 | 0 | Y | VEKVETWALR | 89.56 | EKVETWAFRH | 9.73 | | | | |
| prM | 235 | 0.53 | 5 | 2 | 0 | Y | EKVETWALRH | 89.73 | KVETWAFRHP | 9.73 | | | | |
| prM | 236 | 0.53 | 5 | 2 | 0 | Y | KVETWALRHP | 89.73 | VETWAFRHPG | 9.56 | | | | |
| prM | 237 | 0.48 | 3 | 2 | 0 | Y | VETWALRHPG | 90.09 | ETWAFRHPGF | 9.73 | | | | |
| prM | 238 | 0.48 | 3 | 2 | 0 | Y | ETWALRHPGF | 90.09 | TWAFRHPGFT | 9.56 | | | | |
| prM | 239 | 0.5 | 4 | 2 | 0 | Y | TWALRHPGFT | 89.91 | WAFRHPGFTI | 9.56 | | | | |
| prM | 240 | 0.51 | 4 | 2 | 0 | Y | WALRHPGFTI | 89.91 | AFRHPGFTIL | 9.56 | | | | |
| prM | 241 | 0.51 | 4 | 2 | 0 | Y | ALRHPGFTIL | 89.91 | FRHPGFTILA | 9.56 | | | | |
| prM | 242 | 0.51 | 4 | 2 | 0 | Y | LRHPGFTILA | 89.91 | | | | | | |
| prM | 243 | 0.05 | 3 | 1 | 0 | Y | RHPGFTILAL | 99.47 | | | | | | |
| prM | 244 | 0.05 | 3 | 1 | 0 | Y | HPGFTILALF | 99.47 | | | | | | |
| prM | 245 | 0.05 | 3 | 1 | 0 | Y | PGFTILALFL | 99.47 | | | | | | |
| prM | 246 | 0.05 | 3 | 1 | 0 | Y | GFTILALFLA | 99.47 | | | | | | |
| prM | 247 | 0.07 | 4 | 1 | 0 | Y | FTILALFLAH | 99.29 | | | | | | |
| prM | 248 | 0.07 | 5 | 1 | 0 | Y | TILALFLAHY | 99.29 | | | | | | |
| prM | 249 | 0.14 | 6 | 2 | 0 | Y | IIALFLAHYI | 98.58 | IIALFLAHYV | 0.71 | | | | |
| prM | 250 | 0.15 | 6 | 2 | 0 | Y | LALFLAHYIG | 98.41 | LALFLAHYVG | 0.71 | | | | |
| prM | 251 | 0.15 | 6 | 2 | 0 | Y | ALFLAHYIGT | 98.41 | ALFLAHYVGT | 0.71 | | | | |
| prM | 252 | 0.15 | 6 | 2 | 0 | Y | LFLAHYIGTS | 98.41 | LFLAHYVGTS | 0.71 | | | | |
| prM | 253 | 0.17 | 7 | 3 | 0 | Y | FLAHYIGTSL | 98.23 | FLAHYIGTSL | 1.59 | FLAHYISTSL | 0.35 | | |
| prM | 254 | 0.29 | 8 | 4 | 0 | Y | LAHYIGTSLI | 96.64 | LAHYIGTSLI | 0.71 | LAHYVGTSLT | 0.35 | LAHYISTSLT | 0.35 |

FIG. 12-10

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block (to cover 99%) | frequency |
|---|---|---|---|---|---|---|---|---|---|---|---|---|---|---|
| prM | 255 | 0.29 | 8 | 4 | 0 | Y | AHYIGTSLIQ | 96.64 | AHYIGTSLIQ | 1.59 | AHYIGTSLIQ | 0.71 | AHYISTSLIQ | 0.35 |
| prM | 256 | 0.29 | 8 | 4 | 0 | Y | HYIGTSLIQK | 96.64 | HYIGTSLIQK | 1.59 | HYIGTSLIQK | 0.71 | HYISTSLTQK | 0.35 |
| prM | 257 | 0.42 | 8 | 4 | 0 | Y | YIGTSLTQKV | 94.69 | YIGTSLTQKA | 2.12 | YIGTSLTQKV | 1.59 | YYGTSLTQKV | 0.71 |
| prM | 258 | 0.4 | 7 | 4 | 0 | Y | IGTSLTQKVV | 94.87 | IGTSLTQKAV | 2.12 | IGTSLIQKVI | 1.59 | VGTSLTQKVV | 0.71 |
| prM | 259 | 0.32 | 5 | 3 | 0 | Y | GTSLTQKVVI | 95.75 | GTSLTQKAVI | 2.12 | GTSLIQKVVI | 1.59 | | |
| prM | 260 | 0.28 | 4 | 3 | 0 | Y | TSLTQKVVIF | 96.11 | TSLTQKAVIF | 2.12 | TSLIQKVVIF | 1.59 | | |
| prM | 261 | 0.62 | 8 | 5 | 0 | Y | SLTQKVVIFI | 91.33 | SLTQKVVIFV | 3.36 | SLTQKAVIFI | 1.95 | SLTQKVVIFT | 1.42 | SLIQKVVIFH | 1.42 |
| prM | 262 | 0.62 | 8 | 5 | 0 | Y | LTQKVVIFIL | 91.33 | LTQKVVIFVL | 3.36 | LTQKAVIFIL | 1.95 | LIQKVVIFIL | 1.42 | LTQKVVIFTL | 1.42 |
| prM | 263 | 0.6 | 7 | 5 | 0 | Y | TQKVVIFILL | 91.5 | TQKVVIFVLL | 3.36 | TQKAVIFILL | 1.95 | IQKVVIFILL | 1.42 | TQKVVIFTLL | 1.42 |
| prM | 264 | 0.53 | 6 | 4 | 0 | Y | QKVVIFILLM | 92.39 | QKVVIFVLLM | 3.54 | QKAVIFILLM | 1.95 | QKVVIFTLLM | 1.42 | | |
| prM | 265 | 0.53 | 6 | 4 | 0 | Y | KVVIFILLML | 92.39 | KVVIFVLLML | 3.54 | KAVIFILLML | 1.95 | KVVIFTLLML | 1.42 | | |
| prM | 266 | 0.53 | 6 | 4 | 0 | Y | VVIFILLMLV | 92.39 | VVIFVLLMLV | 3.54 | AVIFILLMLV | 1.95 | VVIFTLLMLV | 1.42 | | |
| prM | 267 | 0.39 | 4 | 3 | 0 | Y | VIFILLMLVT | 94.34 | VIFVLLMLVT | 3.54 | VIFTLLMLVT | 1.59 | | | | |
| prM | 268 | 0.39 | 4 | 3 | 0 | Y | IFILLMLVTP | 94.34 | IFVLLMLVTP | 3.54 | IFTLLMLVTP | 1.59 | | | | |
| prM | 269 | 0.39 | 4 | 3 | 0 | Y | FILLMLVTPS | 94.34 | FVLLMLVTPS | 3.54 | FTLLMLVTPS | 1.59 | | | | |
| prM | 270 | 0.39 | 4 | 3 | 0 | Y | ILLMLVTPSM | 94.34 | VLLMLVTPSM | 3.54 | TLLMLVTPSM | 1.59 | | | | |
| prM | 271 | 0.19 | 3 | 2 | 0 | Y | LLMLVTPSMT | 97.52 | LLMLVTPSMA | 1.95 | | | | | | |
| prM | 272 | 0.19 | 3 | 2 | 0 | Y | LMLVTPSMTM | 97.52 | LMLVTPSMAM | 1.95 | | | | | | |
| prM | 273 | 0.19 | 3 | 2 | 0 | Y | MLVTPSMTMR | 97.52 | MLVTPSMAMR | 1.95 | | | | | | |
| prM | 274 | 0.17 | 2 | 2 | 0 | Y | LVTPSMTMRC | 97.52 | LVTPSMAMRC | 2.48 | | | | | | |
| prM | 275 | 0.17 | 2 | 2 | 0 | Y | VTPSMTMRCV | 97.52 | VTPSMAMRCV | 2.48 | | | | | | |
| prM | 276 | 0.17 | 2 | 2 | 0 | Y | TPSMTMRCVG | 97.52 | TPSMAMRCVG | 2.48 | | | | | | |
| prM | 277 | 0.22 | 3 | 2 | 0 | Y | PSMTMRCVGV | 96.99 | PSMAMRCVGV | 2.48 | | | | | | |
| prM | 278 | 0.22 | 3 | 2 | 0 | Y | SMTMRCVGVG | 96.99 | SMAMRCVGVG | 2.48 | | | | | | |
| prM | 279 | 0.22 | 3 | 2 | 0 | Y | MTMRCVGVGN | 96.99 | MAMRCVGVGN | 2.48 | | | | | | |
| prM | 280 | 0.22 | 3 | 2 | 0 | Y | TMRCVGVGNR | 96.99 | AMRCVGVGNR | 2.48 | | | | | | |

FIG. 12-11

Species: DENV3 (10-mer)

| protein | block starting position | block entropy | total peptides in block | peptides required to cover 99% of block | gap/X fraction | 99% of block covered w/ <= 5 peptides?

FIG. 12-12

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 307 | 0.09 | 4 | 1 | 0 | Y | HGGCVTTMAK | 99.12 | | | | | | |
| E | 308 | 0.5 | 5 | 2 | 0 | Y | GGCVTTMAKN | 90.62 | GGCVTTMAKS | 8.5 | | | | |
| E | 309 | 0.5 | 5 | 2 | 0 | Y | GCVTTMAKNK | 90.62 | GCVTTMAKSK | 8.5 | | | | |
| E | 310 | 0.5 | 5 | 2 | 0 | Y | CVTTMAKNKP | 90.62 | CVTTMAKSKP | 8.5 | | | | |
| E | 311 | 0.5 | 5 | 2 | 0 | Y | VTTMAKNKPT | 90.62 | VTTMAKSKPT | 8.5 | | | | |
| E | 312 | 0.5 | 5 | 2 | 0 | Y | TTMAKNKPTL | 90.62 | TTMAKSKPTL | 8.5 | | | | |
| E | 313 | 0.5 | 5 | 2 | 0 | Y | TMAKNKPTLD | 90.62 | TMAKSKPTLD | 8.5 | | | | |
| E | 314 | 0.5 | 5 | 2 | 0 | Y | MAKNKPTLDI | 90.62 | MAKSKPTLDI | 8.5 | | | | |
| E | 315 | 0.48 | 4 | 2 | 0 | Y | AKNKPTLDIE | 90.8 | AKSKPTLDIE | 8.5 | | | | |
| E | 316 | 0.47 | 3 | 2 | 0 | Y | KNKPTLDIEL | 90.97 | KSKPTLDIEL | 8.5 | | | | |
| E | 317 | 0.42 | 2 | 2 | 0 | Y | NKPTLDIELQ | 91.5 | SKPTLDIELQ | 8.5 | | | | |
| E | 318 | 0 | 1 | 1 | 0 | Y | KPTLDIELQK | 100 | | | | | | |
| E | 319 | 0 | 1 | 1 | 0 | Y | PTLDIELQKT | 100 | | | | | | |
| E | 320 | 0 | 1 | 1 | 0 | Y | TLDIELQKTE | 100 | | | | | | |
| E | 321 | 0 | 1 | 1 | 0 | Y | LDIELQKTEA | 100 | | | | | | |
| E | 322 | 0.02 | 2 | 1 | 0 | Y | DIELQKTEAT | 99.82 | | | | | | |
| E | 323 | 0.02 | 2 | 1 | 0 | Y | IELQKTEATQ | 99.82 | | | | | | |
| E | 324 | 0.02 | 2 | 1 | 0 | Y | ELQKTEATQL | 99.82 | | | | | | |
| E | 325 | 0.02 | 2 | 1 | 0 | Y | LQKTEATQLA | 99.82 | | | | | | |
| E | 326 | 0.02 | 2 | 1 | 0 | Y | QKTEATQLAT | 99.82 | | | | | | |
| E | 327 | 0.02 | 2 | 1 | 0 | Y | KTEATQLATL | 99.82 | | | | | | |
| E | 328 | 0.02 | 2 | 1 | 0 | Y | TEATQLATLR | 99.82 | | | | | | |
| E | 329 | 0.02 | 2 | 1 | 0 | Y | EATQLATLRK | 99.82 | | | | | | |
| E | 330 | 0.02 | 2 | 1 | 0 | Y | ATQLATLRKL | 99.82 | | | | | | |
| E | 331 | 0.02 | 2 | 1 | 0 | Y | TQLATLRKLC | 99.82 | | | | | | |
| E | 332 | 0.02 | 2 | 1 | 0 | Y | QLATLRKLCI | 99.82 | | | | | | |

FIG. 12-13

Species: DENV3 (10-mer)

| protein | block starting position | block entropy | total peptides in block | peptides required to cover 99% of block | gap/X fraction | 99% of block covered w/ <=

FIG. 12-14

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| E | 359 | 1.48 | 6 | 4 | 0 | Y | EAVLPEEQDQ | 58.05 | EAILPEEQDQ | 26.55 | EATLPEEQDQ | 13.45 | EAALPEEQDQ | 1.59 | | |
| E | 360 | 1.5 | 7 | 4 | 0 | Y | AVLPEEQDQN | 57.88 | AILPEEQDQN | 26.55 | ATLPEEQDQN | 13.45 | AALPEEQDQN | 1.59 | | |
| E | 361 | 1.51 | 8 | 4 | 0 | Y | VLPEEQDQNY | 57.88 | ILPEEQDQNY | 26.37 | TLPEEQDQNY | 13.45 | ALPEEQDQNY | 1.59 | | |
| E | 362 | 0.07 | 5 | 1 | 0 | Y | LPEEQDQNYV | 99.29 | | | | | | | | |
| E | 363 | 0.07 | 5 | 1 | 0 | Y | PEEQDQNYVC | 99.29 | | | | | | | | |
| E | 364 | 0.07 | 5 | 1 | 0 | Y | EEQDQNYVCK | 99.29 | | | | | | | | |
| E | 365 | 0.07 | 5 | 1 | 0 | Y | EQDQNYVCKH | 99.29 | | | | | | | | |
| E | 366 | 0.07 | 5 | 1 | 0 | Y | QDQNYVCKHT | 99.29 | | | | | | | | |
| E | 367 | 0.06 | 4 | 1 | 0 | Y | DQNYVCKHTY | 99.47 | | | | | | | | |
| E | 368 | 0.06 | 4 | 1 | 0 | Y | QNYVCKHTYV | 99.47 | | | | | | | | |
| E | 369 | 0.06 | 4 | 1 | 0 | Y | NYVCKHTYVD | 99.47 | | | | | | | | |
| E | 370 | 0.04 | 3 | 1 | 0 | Y | YVCKHTYVDR | 99.65 | | | | | | | | |
| E | 371 | 0.02 | 2 | 1 | 0 | Y | VCKHTYVDRG | 99.82 | | | | | | | | |
| E | 372 | 0.02 | 2 | 1 | 0 | Y | CKHTYVDRGW | 99.82 | | | | | | | | |
| E | 373 | 0.02 | 2 | 1 | 0 | Y | KHTYVDRGWG | 99.82 | | | | | | | | |
| E | 374 | 0 | 1 | 1 | 0 | Y | HTYVDRGWGN | 100 | | | | | | | | |
| E | 375 | 0 | 1 | 1 | 0 | Y | TYVDRGWGNG | 100 | | | | | | | | |
| E | 376 | 0 | 1 | 1 | 0 | Y | YVDRGWGNGC | 100 | | | | | | | | |
| E | 377 | 0 | 1 | 1 | 0 | Y | VDRGWGNGCG | 100 | | | | | | | | |
| E | 378 | 0 | 1 | 1 | 0 | Y | DRGWGNGCGL | 100 | | | | | | | | |
| E | 379 | 0 | 1 | 1 | 0 | Y | RGWGNGCGLF | 100 | | | | | | | | |
| E | 380 | 0 | 1 | 1 | 0 | Y | GWGNGCGLFG | 100 | | | | | | | | |
| E | 381 | 0 | 1 | 1 | 0 | Y | WGNGCGLFGK | 100 | | | | | | | | |
| E | 382 | 0 | 1 | 1 | 0 | Y | GNGCGLFGKG | 100 | | | | | | | | |
| E | 383 | 0 | 1 | 1 | 0 | Y | NGCGLFGKGS | 100 | | | | | | | | |
| E | 384 | 0 | 1 | 1 | 0 | Y | GCGLFGKGSL | 100 | | | | | | | | |

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 416 | 0.16 | 3 | 2 | 0 | Y | KYTVIITVHT | 97.88 | KYTVIITVHT | 1.95 | | | | |
| E | 417 | 0.16 | 3 | 2 | 0 | Y | YTVIITVHTG | 97.88 | YTVIITVHTG | 1.95 | | | | |
| E | 418 | 0.17 | 4 | 2 | 0 | Y | TVIITVHTGD | 97.88 | TVIITVHTGD | 1.77 | | | | |
| E | 419 | 0.17 | 5 | 2 | 0 | Y | VIITVHTGDQ | 97.88 | VIITVHTGDQ | 1.59 | | | | |
| E | 420 | 0.19 | 6 | 2 | 0 | Y | IITVHTGDQH | 97.7 | IITVHTGDQH | 1.59 | | | | |
| E | 421 | 0.06 | 4 | 1 | 0 | Y | ITVHTGDQHQ | 99.47 | | | | | | |
| E | 422 | 0.06 | 4 | 1 | 0 | Y | TVHTGDQHQV | 99.47 | | | | | | |
| E | 423 | 0.06 | 4 | 1 | 0 | Y | VHTGDQHQVG | 99.47 | | | | | | |
| E | 424 | 0.07 | 5 | 1 | 0 | Y | HTGDQHQVGN | 99.29 | | | | | | |
| E | 425 | 0.89 | 6 | 2 | 0 | Y | TGDQHQVGNE | 73.98 | TGDQHQVGND | 25.31 | | | | |
| E | 426 | 0.91 | 7 | 2 | 0 | Y | GDQHQVGNET | 73.81 | GDQHQVGNDT | 25.31 | | | | |
| E | 427 | 0.91 | 7 | 2 | 0 | Y | DQHQVGNETQ | 73.81 | DQHQVGNDTQ | 25.31 | | | | |
| E | 428 | 0.89 | 6 | 2 | 0 | Y | QHQVGNETQG | 73.81 | QHQVGNDTQG | 25.49 | | | | |
| E | 429 | 0.91 | 7 | 2 | 0 | Y | HQVGNETQGV | 73.63 | HQVGNDTQGV | 25.49 | | | | |
| E | 430 | 0.91 | 7 | 2 | 0 | Y | QVGNETQGVT | 73.45 | QVGNDTQGVT | 25.66 | | | | |
| E | 431 | 0.94 | 8 | 3 | 0 | Y | VGNETQGVTA | 73.45 | VGNDTQGVTV | 25.31 | VGNDTQGVTA | 0.35 | | |
| E | 432 | 0.94 | 8 | 3 | 0 | Y | GNETQGVTAE | 73.45 | GNDTQGVTVE | 25.31 | GNDTQGVTAE | 0.35 | | |
| E | 433 | 0.94 | 8 | 3 | 0 | Y | NETQGVTAEI | 73.45 | NDTQGVTVEI | 25.31 | NDTQGVTAEI | 0.35 | | |
| E | 434 | 0.92 | 7 | 3 | 0 | Y | ETQGVTAEIT | 73.63 | DTQGVTVEIT | 25.31 | DTQGVTAEIT | 0.35 | | |
| E | 435 | 0.93 | 7 | 3 | 0 | Y | TQGVTAEITP | 73.45 | TQGVTVEITP | 25.31 | TQGVTAEITS | 0.53 | | |
| E | 436 | 0.92 | 6 | 3 | 0 | Y | QGVTAEITPQ | 73.63 | QGVTVEITPQ | 25.31 | QGVTAEITSQ | 0.53 | | |
| E | 437 | 0.92 | 6 | 3 | 0 | Y | GVTAEITPQA | 73.63 | GVTVEITPQA | 25.31 | GVTAEITSQA | 0.53 | | |
| E | 438 | 0.92 | 6 | 3 | 0 | Y | VTAEITPQAS | 73.63 | VTVEITPQAS | 25.31 | VTAEITSQAS | 0.53 | | |
| E | 439 | 0.93 | 5 | 3 | 0 | Y | TAEITPQAST | 73.27 | TVEITPQAST | 25.49 | TAEITSQAST | 0.53 | | |
| E | 441 | 1.13 | 7 | 4 | 0 | Y | EITPQASTTE | 61.77 | EITPQASTVE | 35.93 | EITPQASTEE | 0.88 | EITPQASITE | 0.53 |
| E | 442 | 1.18 | 8 | 5 | 0 | Y | ITPQASTTEA | 61.24 | ITPQASTVEA | 35.93 | ITPQASTAEA | 0.88 | ITPQASITEA | 0.53 |

Additional alternative for row 442: ITSQASTAEA, frequency 0.53

FIG. 12-17

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| E | 449 | 1.51 | 10 | 5 | 0 | Y | TEAILPEYGT | 61.77 | VEAVLPEYGT | 20.88 | VEAILPEYGT | 14.51 | AEAILPEYGT | 1.42 | TEVILPEYGT | 0.53 |
| E | 450 | 0.86 | 7 | 3 | 0 | Y | EAILPEYGTL | 77.88 | EAVLPEYGTL | 20.88 | EVILPEYGTL | 0.53 | | | | |
| E | 451 | 0.88 | 8 | 3 | 0 | Y | AILPEYGTLG | 77.7 | AVLPEYGTLG | 20.88 | VILPEYGTLG | 0.53 | | | | |
| E | 452 | 0.83 | 7 | 2 | 0 | Y | ILPEYGTLGL | 78.23 | VLPEYGTLGL | 20.88 | | | | | | |
| E | 453 | 0.07 | 5 | 1 | 0 | Y | LPEYGTLGLE | 99.29 | | | | | | | | |
| E | 454 | 0.07 | 5 | 1 | 0 | Y | PEYGTLGLEC | 99.29 | | | | | | | | |
| E | 455 | 0.07 | 5 | 1 | 0 | Y | EYGTLGLECS | 99.29 | | | | | | | | |
| E | 456 | 0.07 | 5 | 1 | 0 | Y | YGTLGLECSP | 99.29 | | | | | | | | |
| E | 457 | 0.07 | 5 | 1 | 0 | Y | GTLGLECSPR | 99.12 | | | | | | | | |
| E | 458 | 0.09 | 6 | 1 | 0 | Y | TLGLECSPRT | 99.47 | | | | | | | | |
| E | 459 | 0.06 | 4 | 1 | 0 | Y | LGLECSPRTG | 99.47 | | | | | | | | |
| E | 460 | 0.06 | 4 | 1 | 0 | Y | GLECSPRTGL | 99.65 | | | | | | | | |
| E | 461 | 0.04 | 3 | 1 | 0 | Y | LECSPRTGLD | 99.65 | | | | | | | | |
| E | 462 | 0.04 | 3 | 1 | 0 | Y | ECSPRTGLDF | 99.65 | | | | | | | | |
| E | 463 | 0.04 | 3 | 1 | 0 | Y | CSPRTGLDFN | 99.65 | | | | | | | | |
| E | 464 | 0.04 | 3 | 1 | 0 | Y | SPRTGLDFNE | 99.65 | | | | | | | | |
| E | 465 | 0.04 | 3 | 1 | 0 | Y | PRTGLDFNEM | 99.47 | | | | | | | | |
| E | 466 | 0.06 | 4 | 1 | 0 | Y | RTGLDFNEMI | 99.47 | | | | | | | | |
| E | 467 | 0.06 | 4 | 1 | 0.71 | Y | TGLDFNEMIL | 98.76 | | | | | | | | |
| E | 468 | 0.04 | 3 | 1 | 0.71 | Y | GLDFNEMILL | 98.94 | | | | | | | | |
| E | 469 | 0.04 | 3 | 1 | 0.71 | Y | LDFNEMILLT | 98.94 | | | | | | | | |
| E | 470 | 0.04 | 3 | 1 | 0.71 | Y | DFNEMILLTM | 98.94 | | | | | | | | |
| E | 471 | 0.04 | 3 | 1 | 0.71 | Y | FNEMILLTMK | 98.94 | | | | | | | | |
| E | 472 | 0.06 | 4 | 1 | 0.71 | Y | NEMILLTMKN | 98.76 | | | | | | | | |
| E | 473 | 0.04 | 3 | 1 | 0.71 | Y | EMILLTMKNK | 98.94 | | | | | | | | |
| E | 474 | 0.04 | 3 | 1 | 0.71 | Y | MILLTMKNKA | 98.94 | | | | | | | | |

FIG. 12-18

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 475 | 0.04 | 3 | 1 | 0.71 | Y | ILLTMKN

FIG. 12-19

Species: DENV3 (10-mer)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| E | 509 | 0.51 | 4 | 2 | 0 | Y | WNRKELLVTF | 89.38 | WNKKELLVTF | 10.27 |
| E | 510 | 0.53 | 5 | 2 | 0 | Y | NRKELLVTFK | 89.2 | NKKELLVTFK | 10.27 |
| E | 511 | 0.51 | 4 | 2 | 0 | Y | RKELLVTFKN | 89.38 | KKELLVTFKN | 10.27 |
| E | 512 | 0.04 | 3 | 1 | 0 | Y | KELLVTFKNA | 99.65 | | |
| E | 513 | 0.04 | 3 | 1 | 0 | Y | ELLVTFKNAH | 99.65 | | |
| E | 514 | 0.04 | 3 | 1 | 0 | Y | LLVTFKNAHA | 99.65 | | |
| E | 515 | 0.04 | 3 | 1 | 0 | Y | LVTFKNAHAK | 99.65 | | |
| E | 516 | 0.04 | 3 | 1 | 0 | Y | VTFKNAHAKK | 99.65 | | |
| E | 517 | 0.02 | 2 | 1 | 0 | Y | TFKNAHAKKQ | 99.82 | | |
| E | 518 | 0.02 | 2 | 1 | 0 | Y | FKNAHAKKQE | 99.82 | | |
| E | 519 | 0.02 | 2 | 1 | 0 | Y | KNAHAKKQEV | 99.82 | | |
| E | 520 | 0 | 1 | 1 | 0 | Y | NAHAKKQEVV | 100 | | |
| E | 521 | 0 | 1 | 1 | 0 | Y | AHAKKQEVVV | 100 | | |
| E | 522 | 0 | 1 | 1 | 0 | Y | HAKKQEVVVL | 100 | | |
| E | 523 | 0 | 1 | 1 | 0 | Y | AKKQEVVVLG | 100 | | |
| E | 524 | 0 | 1 | 1 | 0 | Y | KKQEVVVLGS | 100 | | |
| E | 525 | 0 | 1 | 1 | 0 | Y | KQEVVVLGSQ | 100 | | |
| E | 526 | 0 | 1 | 1 | 0 | Y | QEVVVLGSQE | 100 | | |
| E | 527 | 0 | 1 | 1 | 0 | Y | EVVVLGSQEG | 100 | | |
| E | 528 | 0 | 1 | 1 | 0 | Y | VVVLGSQEGA | 100 | | |
| E | 529 | 0 | 1 | 1 | 0 | Y | VVLGSQEGAM | 100 | | |
| E | 530 | 0 | 1 | 1 | 0 | Y | VLGSQEGAMH | 100 | | |
| E | 531 | 0 | 1 | 1 | 0 | Y | LGSQEGAMHT | 100 | | |
| E | 532 | 0.02 | 2 | 1 | 0 | Y | GSQEGAMHTA | 99.82 | | |
| E | 533 | 0.02 | 2 | 1 | 0 | Y | SQEGAMHTAL | 99.82 | | |
| E | 534 | 0.02 | 2 | 1 | 0 | Y | QEGAMHTALT | 99.82 | | |

FIG. 12-20

Species: DENV3 (10-mer)

| protein | block starting position | block entropy | total peptides in block | peptides required to cover 99% of block | gap/X fraction | 99% of block covered w/ <= 5 peptides? | block | frequency | peptides required to cover 99% of block | block | frequency | peptides required to cover 99% of block | block | frequency | peptides required to cover 99% of block | block | frequency |
|---|---|---|---|---|---|---|---|---|---|---|---|---|---|---|---|---|---|
| E | 535 | 0.02 | 2 | 1 | 0 | Y | EGAMHTALTG | 99.82 | | | | | | | | | |
| E | 536 | 0.04 | 3 | 1 | 0 | Y | GAMHTALTGA | 99.65 | | | | | | | | | |
| E | 537 | 0.04 | 3 | 1 | 0 | Y | AMHTALTGAT | 99.65 | | | | | | | | | |
| E | 538 | 0.04 | 3 | 1 | 0 | Y | MHTALTGATE | 99.65 | | | | | | | | | |
| E | 539 | 0.06 | 4 | 1 | 0 | Y | HTALTGATEI | 99.47 | | | | | | | | | |
| E | 540 | 0.06 | 4 | 1 | 0 | Y | TALTGATEIQ | 99.47 | | | | | | | | | |
| E | 541 | 0.56 | 5 | 2 | 0 | Y | ALTGATEIQN | 88.32 | ALTGATEIQT | 11.15 | | | | | | | |
| E | 542 | 0.57 | 6 | 2 | 0 | Y | LTGATEIQNS | 88.32 | LTGATEIQTS | 10.97 | | | | | | | |
| E | 543 | 0.57 | 6 | 2 | 0 | Y | TGATEIQNSG | 88.32 | TGATEIQTSG | 10.97 | | | | | | | |
| E | 544 | 0.57 | 6 | 2 | 0 | Y | GATEIQNSGG | 88.32 | GATEIQTSGG | 10.97 | | | | | | | |
|

FIG. 12-21

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover

FIG. 12-22

Species: DENV3 (10-mer)

| protein | block starting position | block entropy | total peptides in block | peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| E | 591 | 0.07 | 3 | 1 | 0 | Y | S

FIG. 12-23

Species: DENV3 (10-mer)

| protein | block starting position | block entropy | total peptides in block | peptides required to cover 99% of block | gap/X fraction | 99% of block covered w/ <= 5 peptides? | block

FIG. 12-24

Species: DENV3 (10-mer)

| protein | block starting position | block entropy | total peptides in block | peptides required to cover 99% of block | gap/X fraction | covered w/ <= 5 peptides? | block | frequency | peptides required to cover 99% of block | block | frequency | peptides required to cover 99% of block | block | frequency | peptides required to cover 99% of block | block | frequency |
|---|---|---|---|---|---|---|---|---|---|---|---|---|---|---|---|---|
| E | 643 | 0.12 | 4 | 2 | 0 | Y | VNIEAEPPFG | 98.58 | INIEAEPPFG | 1.06 | | | | | | |
| E | 644 | 0.04 | 3 | 1 | 0 | Y | NIEAEPPFGE | 99.65 | | | | | | |

FIG. 12-25

Species: DENV3 (10-mer)

| protein | block starting position | block entropy | total peptides in block | peptides required to c

FIG. 12-26

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | fr

FIG. 12-27

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | pept

FIG. 12-28

Species: DENV3 (10-mer)

| protein | block starting position | block entropy | total peptides in block | peptides required to cover 99% of block | gap/X fraction | 99% of block covered w/ <= 5 peptides? | block (to cover 99%) | frequency | block | frequency | block | frequency | block (to cover 99% of peptides required) | frequency |
|---|---|---|---|---|---|---|---|---|---|---|---|---|---|---|
| E | 754 | 1.17 | 8 | 4 | 0 | Y | SFSC

FIG. 12-29

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to c

FIG. 12-30

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS1 | 806 | 0.07 | 4 | — | 0 | Y | KFQADSPKRL | 99.29 |
| NS1 | 807 | 0.04 | 3 | — | 0 | Y | FQADSPKRLA | 99.65 |
| NS1 | 808 | 0.04 | 3 | — | 0 | Y | QADSPKRLAT | 99.65 |
| NS1 | 809 | 0.04 | 3 | — | 0 | Y | ADSPKRLATA | 99.65 |
| NS1 | 810 | 0.04 | 3 | — | 0 | Y | DSPKRLATAI | 99.65 |
| NS1 | 811 | 0.04 | 3 | — | 0 | Y | SPKRLATAIA | 99.65 |
| NS1 | 812 | 0.04 | 3 | — | 0 | Y | PKRLATAIAG | 99.65 |
| NS1 | 813 | 0.06 | 4 | — | 0 | Y | KRLATAIAGA | 99.47 |
| NS1 | 814 | 0.06 | 4 | — | 0 | Y | RLATAIAGAW | 99.47 |
| NS1 | 815 | 0.06 | 4 | — | 0 | Y | LATAIAGAWE | 99.47 |
| NS1 | 816 | 0.06 | 4 | — | 0 | Y | ATAIAGAWEN | 99.47 |
| NS1 | 817 | 0.06 | 4 | — | 0 | Y | TAIAGAWENG | 99.47 |
| NS1 | 818 | 0.06 | 4 | — | 0 | Y | AIAGAWENGV | 99.47 |
| NS1 | 819 | 0.06 | 4 | — | 0 | Y | IAGAWENGVC | 99.47 |
| NS1 | 820 | 0.06 | 4 | — | 0 | Y | AGAWENGVCG | 99.47 |
| NS1 | 821 | 0.06 | 4 | — | 0 | Y | GAWENGVCGI | 99.47 |
| NS1 | 822 | 0.06 | 4 | — | 0 | Y | AWENGVCGIR | 99.47 |
| NS1 | 823 | 0.04 | 3 | — | 0 | Y | WENGVCGIRS | 99.65 |
| NS1 | 824 | 0.04 | 3 | — | 0 | Y | ENGVCGIRST | 99.65 |
| NS1 | 825 | 0.02 | 2 | — | 0 | Y | NGVCGIRSTT | 99.82 |
| NS1 | 826 | 0 | 1 | — | 0 | Y | GVCGIRSTTR | 100 |
| NS1 | 827 | 0 | 1 | — | 0 | Y | VCGIRSTTRM | 100 |
| NS1 | 828 | 0 | 1 | — | 0 | Y | CGIRSTTRME | 100 |
| NS1 | 829 | 0 | 1 | — | 0 | Y | GIRSTTRMEN | 100 |
| NS1 | 830 | 0 | 1 | — | 0 | Y | IRSTTRMENL | 100 |
| NS1 | 831 | 0 | 1 | — | 0 | Y | RSTTRMENLL | 100 |

Species: DENV3 (10-mer)

FIG. 12-31

Species: DENV3 (

FIG. 12-32

Species: DENV3 (10-mer)

| protein | block starting position | block entropy | total peptides in block | peptides required to cover 99% of block | gap/X fraction | 99% of block covered w/ <= 5 peptides?

FIG. 12-33

Species: DENV3 (10-mer)

| protein | block starting position | block entropy | total peptides in block | peptides required to cover 99% of block | gap/x fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 901 | 0.55 | 8 | 3 | 0 | Y | TQNSSFIIDG | 90.27 | IQNSSFIIDG | 8.32 | | | | |
| NS1 | 902 | 0.1 | 4 | 2 | 0 | Y | QNSSFIIDGP | 98.94 | QNFSFIIDGP | 0.71 | TQNFSFIIDG | 0.53 | | |
| NS1 | 903 | 0.22 | 5 | 3 | 0 | Y | NSSFIIDGPN | 97.35 | NSSFIIDGPS | 1.59 | NFSFIIDGPN | 0.71 | | |
| NS1 | 904 | 0.22 | 5 | 3 | 0 | Y | SSFIIDGPNT | 97.35 | SSFIIDGPST | 1.59 | FSFIIDGPNT | 0.71 | | |
| NS1 | 905 | 0.16 | 4 | 2 | 0 | Y | SFIIDGPNTP | 98.05 | SFIIDGPSTP | 1.59 | | | | |
| NS1 | 906 | 0.16 | 4 | 2 | 0 | Y | FIIDGPNTPE | 98.05 | FIIDGPSTPE | 1.59 | | | | |
| NS1 | 907 | 0.17 | 5 | 2 | 0 | Y | IIDGPNTPEC | 97.88 | IIDGPSTPEC | 1.59 | | | | |
| NS1 | 908 | 0.17 | 5 | 2 | 0 | Y | IDGPNTPECP | 97.88 | IDGPSTPECP | 1.59 | | | | |
| NS1 | 909 | 0.58 | 6 | 3 | 0 | Y | DGPNTPECPS | 89.73 | DGPNTPECPN | 8.14 | DGPSTPECPS | 1.59 | | |
| NS1 | 910 | 0.86 | 9 | 5 | 0 | Y | GPNTPECPSA | 86.55 | GPNTPECPNA | 6.19 | GPNTPECPSV | 2.83 | GPNTPECPNT | 1.95 | GPSTPECPSA | 1.59 |
| NS1 | 917 | 0.78 | 9 | 5 | 0 | Y | PSASRAWNVW | 87.79 | PNASRAWNVW | 6.19 | PSYSRAWNVW | 2.83 | PNTSRAWNVW | 1.95 | PSAARAWNVW | 0.35 |
| NS1 | 918 | 0.78 | 9 | 5 | 0 | Y | SASRAWNVWE | 87.79 | NASRAWNVWE | 6.19 | SVSRAWNVWE | 2.83 | NTSRAWNVWE | 1.95 | SALRAWNVWE | 0.35 |
| NS1 | 919 | 0.42 | 6 | 3 | 0 | Y | ASRAWNVWEV | 94.16 | VSRAWNVWEV | 2.83 | TSRAWNVWEV | 2.12 | | | |
| NS1 | 920 | 0.08 | 3 | 1 | 0 | Y | SRAWNVWEVE | 99.12 | | | | | | |
| NS1 | 921 | 0.02 | 2 | 1 | 0 | Y | RAWNVWEVED | 99.82 | | | | | | |
| NS1 | 922 | 0.02 | 2 | 1 | 0 | Y | AWNVWEVEDY | 99.82 | | | | | | |
| NS1 | 923 | 0.02 | 2 | 1 | 0 | Y | WNVWEVEDYG | 99.82 | | | | | | |
| NS1 | 924 | 0.02 | 2 | 1 | 0 | Y | NVWEVEDYGF | 99.82 | | | | | | |
| NS1 | 925 | 0.02 | 2 | 1 | 0 | Y | VWEVEDYGFG | 99.82 | | | | | | |
| NS1 | 926 | 0.02 | 2 | 1 | 0 | Y | WEVEDYGFGV | 99.82 | | | | | | |
| NS1 | 927 | 0.02 | 2 | 1 | 0 | Y | EVEDYGFGVF | 99.82 | | | | | | |
| NS1 | 928 | 0.02 | 2 | 1 | 0 | Y | VEDYGFGVFT | 99.29 | | | | | | |
| NS1 | 929 | 0.07 | 3 | 1 | 0 | Y | EDYGFGVFTT | 99.29 | | | | | | |
| NS1 | 930 | 0.07 | 3 | 1 | 0 | Y | DYGFGVFTTN | 99.29 | | | | | | |
| NS1 | 931 | 0.05 | 2 | 1 | 0 | Y | YGFGVFTTNI | 99.47 | | | | | | |
| NS1 | 932 | 0.05 | 2 | 1 | 0 | Y | GFGVFTTNIW | 99.47 | | | | | | |

FIG. 12-34

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to c

FIG. 12-35

Species: DENV3 (10-mer)

| protein | block starting position | block entropy | total peptides in block | peptides required to cover 99% of block | gap/X fraction | 99% of block covered w/ <= 5 peptides? | block | frequency | block | frequency |

FIG. 12-36

Species: DENV3 (10-mer)

| protein | block starting position | block entropy | total peptides in block | peptides required to cover 99% of block | gap/X fraction | covered w/ <= 5 peptides? 99% of block | peptides required to c

FIG. 12-37

Species: DENV3 (10-mer)

| protein | block starting position | block entropy | total peptides in block | peptides required to cover 99% of block | gap/X fraction | 99% of block covered w/

FIG. 12-38

Species: DENY3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 1044 | 0.08 | 3 | 1 | 0 | Y | GKLELDFNYC | 99.12 | | | | | | |
| NS1 | 1045 | 0.08 | 3 | 1 | 0 | Y | KLELDFNYCE | 99.12 | | | | | | |
| NS1 | 1046 | 0.08 | 3 | 1 | 0 | Y | LELDFNYCEG | 99.12 | | | | | | |
| NS1 | 1047 | 0.08 | 3 | 1 | 0 | Y | ELDFNYCEGT | 99.12 | | | | | | |
| NS1 | 1048 | 0.02 | 2 | 1 | 0 | Y | LDFNYCEGTT | 99.82 | | | | | | |
| NS1 | 1049 | 0.02 | 2 | 1 | 0 | Y | DFNYCEGTTV | 99.82 | | | | | | |
| NS1 | 1050 | 0.02 | 2 | 1 | 0 | Y | FNYCEGTTVW | 99.82 | | | | | | |
| NS1 | 1051 | 0.02 | 2 | 1 | 0 | Y | NYCEGTTVWI | 99.82 | | | | | | |
| NS1 | 1052 | 0.29 | 3 | 3 | 0 | Y | YCEGTTVWIT | 95.75 | YCEGTTVWIA | 3.01 | YCEGTTVWIS | 1.24 | | | |
| NS1 | 1053 | 0.32 | 4 | 3 | 0 | Y | CEGTTVWITE | 95.4 | CEGTTVWIAE | 3.01 | CEGTTVWISE | 1.24 | | | |
| NS1 | 1054 | 0.92 | 6 | 5 | 0 | Y | EGTTVWITEN | 83.89 | EGTTVWIAEN | 8.67 | EGTTVWITED | 2.83 | EGTTVWISEN | 1.24 |
| NS1 | 1055 | 0.92 | 6 | 5 | 0 | Y | GTTVWITENC | 83.89 | GTTVWIAENC | 8.67 | GTTVWITEDC | 2.83 | GTTVWISENC | 1.24 |
| NS1 | 1056 | 0.92 | 6 | 5 | 0 | Y | TTVWITENCG | 83.89 | TTVWIAENCG | 8.67 | TTVWITEDCG | 2.83 | TTVWISENCG | 1.24 |
| NS1 | 1057 | 0.96 | 8 | 5 | 0 | Y | TWVITENCGT | 83.54 | TWVIAENCGT | 8.67 | TWVITEDCGT | 2.83 | TWVISENCGT | 1.24 |
| NS1 | 1064 | 0.17 | 10 | 5 | 0 | Y | CGTRGPSLRT | 98.41 | CGMRGPSLRT | 0.18 | CGTRGPALRT | 0.18 | CGTRRPSLRT | 0.18 |
| NS1 | 1065 | 0.17 | 10 | 5 | 0 | Y | GTRGPSLRTT | 98.41 | GTRGPSLRAT | 0.18 | GIRGPSLRTT | 0.18 | GTRRPSLRTT | 0.18 |
| NS1 | 1066 | 0.17 | 10 | 5 | 0 | Y | TRGPSLRTTT | 98.41 | IRGPSLRTTT | 0.18 | TRGPSLRATT | 0.18 | TSGPSLRTTT | 0.18 |
| NS1 | 1067 | 0.13 | 8 | 3 | 0 | Y | RGPSLRTTTV | 98.76 | KGPSLRTTTV | 0.18 | GGPSLRTTTV | 0.18 | TRGSSLRTTT | 0.18 |
| NS1 | 1068 | 0.09 | 6 | 1 | 0 | Y | GPSLRTTTVS | 99.12 | | | | | | |
| NS1 | 1069 | 0.07 | 5 | 1 | 0 | Y | PSLRTTTVSG | 99.29 | | | | | | |
| NS1 | 1070 | 0.06 | 4 | 1 | 0 | Y | SLRTTTVSGK | 99.47 | | | | | | |
| NS1 | 1071 | 0.04 | 3 | 1 | 0 | Y | LRTTTVSGKL | 99.65 | | | | | | |
| NS1 | 1072 | 0.04 | 3 | 1 | 0 | Y | RTTTVSGKLI | 99.65 | | | | | | |
| NS1 | 1073 | 0.02 | 2 | 1 | 0 | Y | TTTVSGKLIH | 99.82 | | | | | | |
| NS1 | 1074 | 0 | 1 | 1 | 0 | Y | TTVSGKLIHE | 100 | | | | | | |
| NS1 | 1075 | 0 | 1 | 1 | 0 | Y | TVSGKLIHEW | 100 | | | | | | |

FIG. 12-39

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS1 | 1076 | 0 | 1 | — | 0 | Y | VSGKLIHEWC | 100 |
| NS1 | 1077 | 0 | 1 | — | 0 | Y | SGKLIHEWCC | 100 |
| NS1 | 1078 | 0 | 1 | — | 0 | Y | GKLIHEWCCR | 100 |
| NS1 | 1079 | 0 | 1 | — | 0 | Y | KLIHEWCCRS | 100 |
| NS1 | 1080 | 0 | 1 | — | 0 | Y | LIHEWCCRSC | 100 |
| NS1 | 1081 | 0 | 1 | — | 0 | Y | IHEWCCRSCT | 100 |
| NS1 | 1082 | 0 | 1 | — | 0 | Y | HEWCCRSCTL | 100 |
| NS1 | 1083 | 0 | 1 | — | 0 | Y | EWCCRSCTLP | 100 |
| NS1 | 1084 | 0 | 1 | — | 0 | Y | WCCRSCTLPP | 100 |
| NS1 | 1085 | 0 | 1 | — | 0 | Y | CCRSCTLPPL | 100 |
| NS1 | 1086 | 0 | 1 | — | 0 | Y | CRSCTLPPLR | 100 |
| NS1 | 1087 | 0 | 1 | — | 0 | Y | RSCTLPPLRY | 100 |
| NS1 | 1088 | 0.03 | 2 | — | 0 | Y | SCTLPPLRYM | 99.65 |
| NS1 | 1089 | 0.03 | 2 | — | 0 | Y | CTLPPLRYMG | 99.65 |
| NS1 | 1090 | 0.05 | 3 | — | 0 | Y | TLPPLRYMGE | 99.47 |
| NS1 | 1091 | 0.05 | 3 | — | 0 | Y | LPPLRYMGED | 99.47 |
| NS1 | 1092 | 0.05 | 3 | — | 0 | Y | PPLRYMGEDG | 99.47 |
| NS1 | 1093 | 0.05 | 3 | — | 0 | Y | PLRYMGEDGC | 99.47 |
| NS1 | 1094 | 0.05 | 3 | — | 0 | Y | LRYMGEDGCW | 99.47 |
| NS1 | 1095 | 0.05 | 3 | — | 0 | Y | RYMGEDGCWY | 99.47 |
| NS1 | 1096 | 0.05 | 3 | — | 0 | Y | YM

FIG. 12-40

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 12-41

Species: DENV3 (10-mer)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| NS2A | 1130 | 0.48 | 9 | 5 | 0 | Y | VDNFTMGVLC | 93.63 | MDNFTMGILC | 3.01 | ADNFTMGVLC | 1.77 | MDNFTMGVLC | 0.53 | VDNFTMGALC | 0.35 |
| NS2A | 1131 | 0.27 | 5 | 2 | 0 | Y | DNFTMGVLCL | 96.11 | DNFTMGILCL | 3.19 | | | | | | |
| NS2A | 1132 | 0.29 | 6 | 2 | 0 | Y | NFTMGVLCLA | 95.93 | NFTMGILCLA | 3.19 | | | | | | |
| NS2A | 1133 | 0.29 | 6 | 2 | 0 | Y | FTMGVLCLAI | 95.93 | FTMGILCLAI | 3.19 | | | | | | |
| NS2A | 1134 | 0.31 | 7 | 3 | 0 | Y | TMGVLCLAIL | 95.75 | TMGILCLAIL | 3.19 | TMGALCLAIL | 0.35 | | | | |
| NS2A | 1135 | 0.33 | 8 | 3 | 0 | Y | MGVLCLAILF | 95.58 | MGILCLAILF | 3.19 | MGALCLAILF | 0.35 | | | | |
| NS2A | 1136 | 0.31 | 7 | 3 | 0 | Y | GVLCLAILFE | 95.75 | GILCLAILFE | 3.19 | GALCLAILFE | 0.35 | | | | |
| NS2A | 1137 | 0.31 | 7 | 3 | 0 | Y | VLCLAILFEE | 95.75 | ILCLAILFEE | 3.19 | ALCLAILFEE | 0.35 | | | | |
| NS2A | 1138 | 0.09 | 3 | 1 | 0 | Y | LCLAILFEEV | 99.12 | | | | | | | | |
| NS2A | 1139 | 0.14 | 6 | 2 | 0 | Y | CLAILFEEVM | 98.58 | CLAILFEEVL | 0.53 | | | | | | |
| NS2A | 1140 | 0.14 | 7 | 2 | 0 | Y | LAILFEEVMR | 98.58 | LAILFEEVLR | 0.53 | | | | | | |
| NS2A | 1141 | 0.14 | 7 | 2 | 0 | Y | AILFEEVMRG | 98.58 | AILFEEVLRG | 0.53 | | | | | |

FIG. 12-42

Species: DENV3 (10-mer)

| protein | block starting position | block entropy | total peptides in block | peptides required to cover 99% of block | gap/X fraction | 99% of block covered w/ <= 5 peptides?

FIG. 12-43

Species: DENV3 (10-mer)

| protein | block starting position | block entropy | total peptides in block | peptides required to cover 99% of block | gap/X fraction | 99% of block covered w/ <= 5 peptides? | block to cover 99% of | frequency | block to cover 99% of | frequency |
|---|---|---|---|---|---|---|---|---|---|---|
| NS2A | 1200 | 0.09 | 5 | 1 | 0 | Y | LALIATFKIQ | 99.12 | | |
| NS2A | 1201 | 0.09 | 5 | 1 | 0 | Y | ALIATFKIQP | 99.12 | | |
| NS2A | 1202 | 0.15 | 6 | 2 | 0 | Y | LIATFKIQPF | 98.41 | LIATFKIQPL | 0.71 |
| NS2A | 1203 | 0.15 | 6 | 2 | 0 | Y | IATFKIQPFL | 98.41 | IATFKIQPLL | 0.71 |
| NS2A | 1204 | 0.15 | 6 | 2 | 0 | Y | ATFKIQPFLA | 98.41 | ATFKIQPLLA | 0.71 |
| NS2A | 1205 | 0.15 | 6 | 2 | 0 | Y | TFKIQPFLAL | 98.41 | TFKIQPLLAL | 0.71 |
| NS2A | 1206 | 0.13 | 5 | 2 | 0 | Y | FKIQPFLALG | 98.58 | FKIQPLLALG | 0.71 |
| NS2A | 1207 | 0.13 | 5 | 2 | 0 | Y | KIQPFLALGF | 98.58 | KIQPLLALGF | 0.71 |
| NS2A | 1208 | 0.11 | 4 | 2 | 0 | Y | IQPFLALGFF | 98.76 | IQPLLALGFF | 0.71 |
| NS2A | 1209 | 0.1 | 4 | 2 | 0 | Y | QPFLALGFFL | 98.94 | QPLLALGFFL | 0.71 |
| NS2A | 1210 | 0.1 | 4 | 2 | 0 | Y | PFLALGFFLR | 98.94 | PLLALGFFLR | 0.71 |
| NS2A | 1211 | 0.1 | 4 | 2 | 0 | Y | FLALGFFLRK | 98.94 | LLALGFFLRK | 0.71 |
| NS2A | 1212 | 0.04 | 3 | 1 | 0 | Y | LALGFFLRKL | 99.65 | | |
| NS2A | 1213 | 0.04 | 3 | 1 | 0 | Y | ALGFFLRKLT | 99.65 | | |
| NS2A | 1214 | 0.02 | 2 | 1 | 0 | Y | LGFFLRKLTS | 99.82 | | |
| NS2A | 1215 | 0.02 | 2 | 1 | 0 | Y | GFFLRKLTSR | 99.82 | | |
| NS2A | 1216 | 0.02 | 2 | 1 | 0 | Y | FFLRKLTSRE | 99.82 | | |
| NS2A | 1217 | 0.02 | 2 | 1 | 0 | Y | FLRKLTSREN | 99.82 | | |
| NS2A | 1218 | 0.04 | 3 | 1 | 0 | Y | LRKLTSRENL | 99.65 | | |
| NS2A | 1219 | 0.02 | 2 | 1 | 0 | Y | RKLTSRENLL | 99.82 | | |
| NS2A | 1220 | 0.02 | 2 | 1 | 0 | Y | KLTSRENLLL | 99.82 | | |
| NS2A | 1221 | 0.02 | 2 | 1 | 0 | Y | LTSRENLLLG | 99.82 | | |
| NS2A | 1222 | 0.02 | 2 | 1 | 0 | Y | TSRENLLLGV | 99.82 | | |
| NS2A | 1223 | 0.02 | 2 | 1 | 0 | Y | SRENLLLGVG | 99.82 | | |
| NS2A | 1224 | 0.02 | 2 | 1 | 0 | Y | RENLLLGVGL | 99.82 | | |
| NS2A | 1225 | 0.02 | 2 | 1 | 0 | Y | ENLLLGVGLA | 99.82 | | |

FIG. 12-44

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of

FIG. 12-45

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS2A | 1252 | 0.87 | 4 | 2 | 0 | Y | IALGLMALKLI | 74.87 | IALGLMTLKLI | 24.42 | ALGLMALKLI | 1.77 | | |
| NS2A | 1253 | 0.96 | 5 | 3 | 0 | Y | ALGLMALKLI | 73.45 | ALGLMTLKLI | 24.42 | ALGLMALKLIT | 1.77 |

FIG. 12-46

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | pe

FIG. 12-47

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1312 | 1.11 | 5 | 4 | 0 | Y | RKTDWLPMTV | 74.51 | RKTDWLPMAV | 18.41 | RKSDWLPMTY | 4.78 | RKTDWLPVAV | 1.95 | | |
| NS2A | 1313 | 1.13 | 6 | 4 | 0 | Y | KTDWLPMTVA | 74.34 | KTDWLPMAVA | 18.41 | KSDWLPMTVA | 4.78 | KTDWLPVAVA | 1.95 | | |
| NS2A | 1314 | 1.13 | 6 | 4 | 0 | Y | TDWLPMTVAA | 74.34 | TDWLPMAVAA | 18.41 | SDWLPMTVAA | 4.78 | TDWLPVAVAA | 1.95 | | |
| NS2A | 1315 | 0.87 | 5 | 3 | 0 | Y | DWLPMTVAAM | 79.12 | DWLPMAVAAM | 18.41 | DWLPVAVAAM | 1.95 | | | | |
| NS2A | 1316 | 0.87 | 5 | 3 | 0 | Y | WLPMTVAAMG | 79.12 | WLPMAVAAMG | 18.41 | WLPVAVAAMG | 1.95 | | | | |
| NS2A | 1317 | 0.97 | 8 | 4 | 0 | Y | LPMTVAAMGV | 78.05 | LPMAVAAMGV | 18.41 | LPVAVAAMGV | 1.95 | LPMTVAAMGA | 0.71 | | |
| NS2A | 1321 | 0.38 | 9 | 5 | 0 | Y | VAAMGVPPLP | 95.4 | VAAMGVPSLP | 2.12 | VAAMGAQPLP | 0.71 | VAAMGVSPLP | 0.53 | VAAMGVQPLP | 0.53 |
| NS2A | 1322 | 0.38 | 9 | 5 | 0 | Y | AAMGVPPLPL | 95.4 | AAMGVPSLPL | 2.12 | AAMGAQPLPL | 0.71 | AAMGVSPLPL | 0.53 | AAMGVQPLPL | 0.53 |
| NS2A | 1323 | 0.38 | 9 | 5 | 0 | Y | AMGVPPLPLF | 95.4 | AMGVPSLPLF | 2.12 | AMGAQPLPLF | 0.71 | AMGVSPLPLF | 0.53 | AMGVQPLPLF | 0.53 |
| NS2A | 1324 | 0.38 | 9 | 5 | 0 | Y | MGVPPLPLFI | 95.4 | MGVPSLPLFI | 2.12 | MGAQPLPLFI | 0.71 | MGVSPLPLFI | 0.53 | MGVQPLPLFI | 0.53 |
| NS2A | 1325 | 0.38 | 9 | 4 | 0 | Y | GVPPLPLFIF | 95.4 | GVPSLPLFIF | 2.12 | GAQPLPLFIF | 0.71 | GVSPLPLFIF | 0.53 | GVQPLPLFIF | 0.53 |
| NS2A | 1328 | 0.43 | 8 | 4 | 0 | Y | PLPLFIFSLK | 94.51 | SLPLFIFSLK | 2.12 | PLPLFIFNLK | 1.59 | PLPLFIFGLK | 0.88 | | |
| NS2A | 1329 | 0.28 | 7 | 3 | 0 | Y | LPLFIFSLKD | 96.64 | LPLFIFNLKD | 1.59 | PLPLFIFGLKD | 0.88 | | | | |
| NS2A | 1330 | 0.35 | 7 | 4 | 0 | Y | PLFIFSLKDT | 95.75 | PLFIFNLKDT | 1.59 | PLFIFSLKDA | 1.06 | PLFIFGLKDT | 0.88 | | |
| NS2A | 1336 | 0.99 | 9 | 5 | 0 | Y | LKDTLKRRSW | 75.93 | LKDTPKRRSW | 21.24 | LKDTPKRKSW | 1.06 | LKDALKRRSW | 0.71 | LKDAPKRRSW | 0.35 |
| NS2A | 1337 | 0.99 | 9 | 5 | 0 | Y | KDTLKRRSWP | 75.93 | KDTPKRRSWP | 21.24 | KDTPKRKSWP | 1.06 | KDALKRRSWP | 0.71 | KDAPKRRSWP | 0.35 |
| NS2A | 1338 | 0.99 | 9 | 5 | 0 | Y | DTLKRRSWPL | 75.93 | DTPKRRSWPL | 21.24 | DTPKRKSWPL | 1.06 | DALKRRSWPL | 0.71 | DAPKRRSWPL | 0.35 |
| NS2A | 1339 | 0.99 | 9 | 5 | 0 | Y | TLKRRSWPLN | 75.93 | TPKRRSWPLN | 21.24 | TPKRKSWPLN | 1.06 | ALKRRSWPLN | 0.71 | APKRRSWPLN | 0.35 |
| NS2A | 1340 | 0.91 | 7 | 3 | 0 | Y | LKRRSWPLNE | 76.64 | PKRRSWPLNE | 21.59 | PKRKSWPLNE | 1.06 | | | | |
| NS2A | 1341 | 0.14 | 4 | 2 | 0 | Y | KRRSWPLNEG | 98.41 | KRKSWPLNEG | 1.06 | | | | | | |
| NS2A | 1342 | 0.1 | 3 | 2 | 0 | Y | RRSWPLNEGV | 98.76 | RKSWPLNEGV | 1.06 | | | | | | |
| NS2A | 1343 | 0.08 | 2 | 2 | 0 | Y | RSWPLNEGVM | 98.94 | KSWPLNEGVM | 1.06 | | | | | | |
| NS2A | 1344 | 0 | 1 | 1 | 0 | Y | SWPLNEGVMA | 100 | | | | | | | | |
| NS2B | 1345 | 0.06 | 2 | 2 | 0 | Y | WPLNEGVMAV | 99.29 | WPLNEGVMAY | 0.71 | | | | | | |
| NS2B | 1346 | 0.06 | 2 | 2 | 0 | Y | PLNEGVMAVG | 99.29 | PLNEGVMAYG | 0.71 | | | | | | |
| NS2B | 1347 | 0.06 | 2 | 2 | 0 | Y | LNEGVMAVGL | 99.29 | LNEGVMAYGL | 0.71 | | | | | | |

FIG. 12-48

Species: DENV3 (10-mer)

| protein | block starting position | block entropy | total

FIG. 12-49

Species: DENV3 (10-mer)

| prot

FIG. 12-50

Species: DENV3 (10-mer)

| protein | block starting position | block entropy | total peptides in block | peptides required to cover 99% of block | gap/X fraction | 99% of block covered w/ <= 5 peptides? | block | frequency | block | peptides required to cover 99% of block | frequency | block | peptides required to cover 99% of block | frequency | block | peptides required to cover 99% of block | frequency |
|---|---|---|---|---|---|---|---|---|---|---|---|---|---|---|---|

FIG. 12-51

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS2B | 1433 | 0.02 | 2 | 1 | 0 | Y | ETENILTVLL | 99.82 | | |
| NS2B | 1434 | 0.02 | 2 | 1 | 0 | Y | TENILTVLLK | 99.82 | | |
| NS2B | 1435 | 0.02 | 2 | 1 | 0 | Y | ENILTVLLKT | 99.82 | | |
| NS2B | 1436 | 0.02 | 2 | 1 | 0 | Y | NILT

FIG. 12-52

Species: DENV3 (10-mer)

| protein | block starting position | block entropy | total peptides in block | peptides required to cover 99% of block | gap/X fraction | 99% of block covered w/ <= 5 peptides? | block | frequency | peptides required to cover

FIG. 12-53

Species: DENV3 (10-mer)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99

FIG. 12-54

Species: DENV3 (10-mer)

| protein | block starting position | block entropy | total peptides in block | peptides required to cover 99% of block | gap/X fraction | 99% of block covered w/

FIG. 12-55

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1537 | 0.2 | 4 | 2 | 0 | Y | RLEPNWASVK | 97.35 | RLEPNWANVK | 2.12 | | | | |
| NS3 | 1538 | 0.22 | 5 | 2 | 0 | Y | LEPNWASVKK | 97.17 | LEPNWANVKK | 2.12 | | | | |
| NS3 | 1539 | 0.22 | 5 | 2 | 0 | Y | EPNWASVKKD | 97.17 | EPNWANVKKD | 2.12 | | | | |
| NS3 | 1540 | 0.22 | 5 | 2 | 0 | Y | PNWASVKKDL | 97.17 | PNWANVKKDL | 2.12 | | | | |
| NS3 | 1541 | 0.24 | 6 | 2 | 0 | Y | NWASVKKDLI | 96.99 | NWANVKKDLI | 2.12 | | | | |
| NS3 | 1542 | 0.2 | 5 | 2 | 0 | Y | WASVKKDLIS | 97.35 | WANVKKDLIS | 2.12 | | | | |
| NS3 | 1543 | 0.2 | 5 | 2 | 0 | Y | ASVKKDLISY | 97.35 | ANVKKDLISY | 2.12 | | | | |
| NS3 | 1544 | 0.2 | 5 | 2 | 0 | Y | SVKKDLISYG | 97.35 | NVKKDLISYG | 2.12 | | | | |
| NS3 | 1545 | 0.06 | 4 | 1 | 0 | Y | VKKDLISYGG | 99.47 | | | | | | |
| NS3 | 1546 | 0.06 | 3 | 1 | 0 | Y | KKDLISYGGG | 99.47 | | | | | | |
| NS3 | 1547 | 0.04 | 3 | 1 | 0 | Y | KDLISYGGGW | 99.65 | | | | | | |
| NS3 | 1548 | 0.17 | 3 | 2 | 0 | Y | DLISYGGGWR | 97.7 | DLISYGGGWK | 2.12 | | | | |
| NS3 | 1549 | 0.17 | 3 | 2 | 0 | Y | LISYGGGWRL | 97.7 | LISYGGGWKL | 2.12 | | | | |
| NS3 | 1550 | 0.37 | 4 | 3 | 0 | Y | ISYGGGWRLS | 94.51 | ISYGGGWRLN | 3.19 | ISYGGGWKLS | 2.12 | | |
| NS3 | 1551 | 0.46 | 4 | 4 | 0 | Y | SYGGGWRLSA | 93.27 | SYGGGWRLNA | 3.19 | SYGGGWKLSA | 2.12 | | |
| NS3 | 1552 | 0.49 | 6 | 4 | 0 | Y | YGGGWRLSAQ | 92.92 | YGGGWRLNAQ | 3.19 | YGGGWKLSAQ | 2.12 | | |
| NS3 | 1553 | 0.49 | 6 | 4 | 0 | Y | GGGWRLSAQW | 92.92 | GGGWRLNAQW | 3.19 | GGGWKLSAQW | 2.12 | | |
| NS3 | 1554 | 0.6 | 8 | 5 | 0 | Y | GGWRLSAQWQ | 91.68 | GGWRLNAQWQ | 3.19 | GGWKLSAQWQ | 2.12 | | |
| NS3 | 1555 | 0.63 | 9 | 5 | 0 | Y | GWRLSAQWQK | 91.33 | GWRLNAQWQK | 3.19 | GWKLSAQWQK | 2.12 | SYGGGWRLST | 1.42 | GGWRLSAQWK | 1.06 |
| NS3 | 1556 | 0.63 | 9 | 5 | 0 | Y | WRLSAQWQKG | 91.33 | WRLNAQWQKG | 3.19 | WKLSAQWQKG | 2.12 | YGGGWRLSTQ | 1.42 | GWRLSAQWKK | 1.06 |
| NS3 | 1557 | 0.63 | 9 | 5 | 0 | Y | RLSAQWQKGE | 91.33 | RLNAQWQKGE | 3.19 | KLSAQWQKGE | 2.12 | GGGWRLSTQW | 1.42 | WRLSAQWKKG | 1.06 |
| NS3 | 1558 | 0.48 | 8 | 4 | 0 | Y | LSAQWQKGEE | 93.45 | LNAQWQKGEE | 3.19 | LSTQWQKGEE | 1.42 | GGWRLSTQWQ | 1.42 | RLSAQWKKGE | 1.06 |
| NS3 | 1559 | 0.48 | 8 | 4 | 0 | Y | SAQWQKGEEV | 93.45 | NAQWQKGEEV | 3.19 | STQWQKGEEV | 1.42 | GWRLSTQWQK | 1.42 | | |
| NS3 | 1560 | 0.28 | 7 | 3 | 0 | Y | AQWQKGEEVQ | 96.64 | TQWQKGEEVQ | 1.42 | AQWKKGEEVQ | 1.06 | WRLSTQWQKG | 1.42 | | |
| NS3 | 1561 | 0.19 | 7 | 3 | 0 | Y | QWQKGEEVQV | 97.88 | QWKKGEEVQV | 1.06 | QWQRGEEVQV | 0.35 | RLSTQWQKGE | 1.42 | | |
| NS3 | 1562 | 0.17 | 6 | 2 | 0 | Y | WQKGEEVQVI | 98.05 | WKKGEEVQVI | 1.06 | | | LSAQWKKGEE | 1.06 | | |

FIG. 12-56

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1563 | 0.16 | 5 | 2 | 0 | Y | QKGEEVQVIA | 98.23 | KKGEEVQVIA | 1.06 | | | | |
| NS3 | 1564 | 0.05 | 3 | 1 | 0 | Y | KGEEVQVIAV | 99.47 | | | | | | |
| NS3 | 1565 | 0.02 | 2 | 1 | 0 | Y | GEEVQVIAVE | 99.82 | | | | | | |
| NS3 | 1566 | 0.02 | 2 | 1 | 0 | Y | EEVQVIAVEP | 99.82 | | | | | | |
| NS3 | 1567 | 0.02 | 2 | 1 | 0 | Y | EVQVIAVEPG | 99.82 | | | | | | |
| NS3 | 1568 | 0.02 | 2 | 1 | 0 | Y | VQVIAVEPGK | 99.82 | | | | | | |
| NS3 | 1569 | 0.02 | 2 | 1 | 0 | Y | QVIAVEPGKN | 99.82 | | | | | | |
| NS3 | 1570 | 0.02 | 2 | 1 | 0 | Y | VIAVEPGKNP | 99.82 | | | | | | |
| NS3 | 1571 | 0 | 1 | 1 | 0 | Y | IAVEPGKNPK | 100 | | | | | | |
| NS3 | 1572 | 0.02 | 2 | 1 | 0 | Y | AVEPGKNPKN | 99.82 | | | | | | |
| NS3 | 1573 | 0.02 | 2 | 1 | 0 | Y | VEPGKNPKNF | 99.82 | | | | | | |
| NS3 | 1574 | 0.02 | 2 | 1 | 0 | Y | EPGKNPKNFQ | 99.82 | | | | | | |
| NS3 | 1575 | 0.02 | 2 | 1 | 0 | Y | PGKNPKNFQT | 99.82 | | | | | | |
| NS3 | 1576 | 0.35 | 5 | 2 | 0 | Y | GKNPKNFQTM | 94.51 | GKNPKNFQTT | 4.78 | | | | |
| NS3 | 1577 | 0.35 | 5 | 2 | 0 | Y | KNPKNFQTMP | 94.51 | KNPKNFQTTP | 4.78 | | | | |
| NS3 | 1578 | 0.35 | 5 | 2 | 0 | Y | NPKNFQTMPG | 94.51 | NPKNFQTTPG | 4.78 | | | | |
| NS3 | 1579 | 1.28 | 8 | 4 | 0 | Y | PKNFQTMPGI | 58.23 | PKNFQTMPGT | 36.28 | PKNFQTTPGI | 4.25 | PKNFQTTPGI | 0.53 |
| NS3 | 1580 | 1.28 | 8 | 4 | 0 | Y | KNFQTMPGIF | 58.23 | KNFQTMPGTF | 36.28 | KNFQTTPGTF | 4.25 | KNFQTTPGIF | 0.53 |
| NS3 | 1581 | 1.28 | 8 | 4 | 0 | Y | NFQTMPGIFQ | 58.23 | NFQTMPGTFQ | 36.28 | NFQTTPGTFQ | 4.25 | NFQTTPGIFQ | 0.53 |
| NS3 | 1582 | 1.27 | 7 | 4 | 0 | Y | FQTMPGIFQT | 58.05 | FQTMPG

FIG. 12-57

Species: DENV3 (10-mer)

| protein | block starting position | block entropy | total peptides in block (10-mer) | peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1591 | 0.17 | 6 | 3 | 0 | Y | TTTGEIGAIA | 98.23 | TTTGEIGAIA | 0.53 | TTTGEIGAIA | 0.35 | | |
| NS3 | 1592 | 0.17 | 6 | 3 | 0 | Y | TTGEIGAIAL | 98.23 | TTGEIGAIAL | 0.53 | TTGEIGAYAL | 0.35 | | |
| NS3 | 1593 | 0.13 | 5 | 2 | 0 | Y | TGEIGAIALD | 98.58 | TGEIGAIALD | 0.53 | | | | |
| NS3 | 1594 | 0.05 | 3 | 1 | 0 | Y | GEIGAIALDF | 99.47 | | | | | | |
| NS3 | 1595 | 0.05 | 3 | 1 | 0 | Y | EIGAIALDFK | 99.47 | | | | | | |
| NS3 | 1596 | 0.05 | 3 | 1 | 0 | Y | IGAIALDFKP | 99.47 | | | | | | |
| NS3 | 1597 | 0.05 | 3 | 1 | 0 | Y | GAIALDFKPG | 99.47 | | | | | | |
| NS3 | 1598 | 0.05 | 3 | 1 | 0 | Y | AIALDFKPGT | 99.47 | | | | | | |
| NS3 | 1599 | 0.05 | 3 | 1 | 0 | Y | IALDFKPGTS | 99.47 | | | | | | |
| NS3 | 1600 | 0 | 1 | 1 | 0 | Y | ALDFKPGTSG | 100 | | | | | | |
| NS3 | 1601 | 0 | 1 | 1 | 0 | Y | LDFKPGTSGS | 100 | | | | | | |
| NS3 | 1602 | 0 | 1 | 1 | 0 | Y | DFKPGTSGSP | 100 | | | | | | |
| NS3 | 1603 | 0 | 1 | 1 | 0 | Y | FKPGTSGSPI | 100 | | | | | | |
| NS3 | 1604 | 0 | 1 | 1 | 0 | Y | KPGTSGSPII | 100 | | | | | | |
| NS3 | 1605 | 0 | 1 | 1 | 0 | Y | PGTSGSPIIN | 100 | | | | | | |
| NS3 | 1606 | 0.03 | 2 | 2 | 0 | Y | GTSGSPIINR | 99.65 | | | | | | |
| NS3 | 1607 | 0.03 | 2 | 2 | 0 | Y | TSGSPIINRE | 99.65 | | | | | | |
| NS3 | 1608 | 0.03 | 2 | 2 | 0 | Y | SGSPIINREG | 99.65 | | | | | | |
| NS3 | 1609 | 0.03 | 2 | 2 | 0 | Y | GSPIINREGK | 99.65 | | | | | | |
| NS3 | 1610 | 0.21 | 3 | 2 | 0 | Y | SPIINREGKV | 96.99 | SPIINREGKI | 2.65 | | | | |
| NS3 | 1611 | 0.24 | 4 | 2 | 0 | Y | PIINREGKVV | 96.64 | PIINREGKIV | 2.65 | | | | |
| NS3 | 1612 | 0.24 | 4 | 2 | 0 | Y | IINREGKVVG | 96.64 | IINREGKIVG | 2.65 | | | | |
| NS3 | 1613 | 0.24 | 4 | 2 | 0 | Y | INREGKVVGL | 96.64 | INREGKIVGL | 2.65 | | | | |
| NS3 | 1614 | 0.24 | 4 | 2 | 0 | Y | NREGKVVGLY | 96.64 | NREGKIVGLY | 2.65 | | | | |
| NS3 | 1615 | 0.24 | 4 | 2 | 0 | Y | REGKVVGLYG | 96.64 | REGKIVGLYG | 2.65 | | | | |
| NS3 | 1616 | 0.21 | 3 | 2 | 0 | Y | EGKVVGLYGN | 96.99 | EGKIVGLYGN | 2.65 | | | | |

FIG. 12-58

Species: DENV3 (10-mer)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS3 | 1617 | 0.21 | 3 | 2 | 0 | Y | GKIVGLYGNG | 96.99 | GKIVGLYGNG | 2.65 |
| NS3 | 1618 | 0.21 | 3 | 2 | 0 | Y | KIVGLYGNGV | 96.99 | KIVGLYGNGV | 2.65 |
| NS3 | 1619 | 0.26 | 4 | 2 | 0 | Y | IVGLYGNGVV | 96.46 | IVGLYGNGVV | 2.65 |
| NS3 | 1620 | 0.08 | 3 | 1 | 0 | Y | VGLYGNGVVT | 99.12 | | |
| NS3 | 1621 | 0.05 | 2 | 1 | 0 | Y | GLYGNGVVTK | 99.47 | | |
| NS3 | 1622 | 0.11 | 3 | 2 | 0 | Y | LYGNGVVTKN | 98.76 | LYGNGVVTKS | 0.71 |
| NS3 | 1623 | 0.11 | 3 | 2 | 0 | Y | YGNGVVTKNG | 98.76 | YGNGVVTKSG | 0.71 |
| NS3 | 1624 | 0.11 | 3 | 2 | 0 | Y | GNGVVTKNGG | 98.76 | GNGVVTKSGG | 0.71 |
| NS3 | 1625 | 0.11 | 3 | 2 | 0 | Y | NGVVTKNGGY | 98.76 | NGVVTKSGGY | 0.71 |
| NS3 | 1626 | 0.11 | 3 | 2 | 0 | Y | GVVTKNGGYV | 98.76 | GVVTKSGGYV | 0.71 |
| NS3 | 1627 | 0.11 | 3 | 2 | 0 | Y | VVTKNGGYVS | 98.76 | VVTKSGGYVS | 0.71 |
| NS3 | 1628 | 0.11 | 3 | 2 | 0 | Y | VTKNGGYVSG | 98.76 | VTKSGGYVSG | 0.71 |
| NS3 | 1629 | 0.06 | 2 | 1 | 0 | Y | TKNGGYVSGI | 99.29 | | |
| NS3 | 1630 | 0.06 | 2 | 1 | 0 | Y | KNGGYVSGIA | 99.29 | | |
| NS3 | 1631 | 0.06 | 2 | 1 | 0 | Y | NGGYVSGIAQ | 99.29 | | |
| NS3 | 1632 | 0 | 1 | 1 | 0 | Y | GGYVSGIAQT | 100 | | |
| NS3 | 1633 | 0.05 | 3 | 1 | 0 | Y | GYVSGIAQTN | 99.47 | | |
| NS3 | 1634 | 0.05 | 3 | 1 | 0 | Y | YVSGIAQTNA | 99.47 | | |
| NS3 | 1635 | 0.05 | 3 | 1 | 0 | Y | VSGIAQTNAE | 99.47 | | |
| NS3 | 1636 | 0.07 | 4 | 1 | 0 | Y | SGIAQTNAEP | 99.29 | | |
| NS3 | 1637 | 0.07 | 4 | 1 | 0 | Y | GIAQTNAEPD | 99.29 | | |
| NS3 | 1638 | 0.07 | 4 | 1 | 0 | Y | IAQTNAEPDG | 99.29 | | |
| NS3 | 1639 | 0.07 | 4 | 1 | 0 | Y | AQTNAEPDGP | 99.29 | | |
| NS3 | 1640 | 0.12 | 5 | 2 | 0 | Y | QTNAEPDGPT | 98.76 | QTNAEPDGPA | 0.53 |
| NS3 | 1641 | 0.12 | 5 | 2 | 0 | Y | TNAEPDGPTP | 98.76 | TNAEPDGPAP | 0.53 |
| NS3 | 1642 | 0.12 | 5 | 2 | 0 | Y | NAEPDGPTPE | 98.76 | NAEPDGPAPE | 0.53 |

FIG. 12-59

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 12-60

Species: DENV3 (10-mer)

| protein | block starting position | block entropy | total peptides in block | peptides required to cover 99% of block | gap/X fraction | 99% of block covered w/ <= 5 peptides? | block | frequency | peptides required to cover 99% of block | frequency |

FIG. 12-61

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS3 | 1695 | 0 | 1 | 1 | 0 | Y | LAPTRVVAAE | 100 | | | | | | | | |
| NS3 | 1696 | 0 | 1 | 1 | 0 | Y | APTRVVAAEM | 100 | | | | | | | | |
| NS3 | 1697 | 0 | 1 | 1 | 0 | Y | PTRVVAAEME | 100 | | | | | | | | |
| NS3 | 1698 | 0 | 1 | 1 | 0 | Y | TRVVAAEMEE | 100 | | | | | | | | |
| NS3 | 1699 | 0 | 1 | 1 | 0 | Y | RVVAAEMEEA | 100 | | | | | | | | |
| NS3 | 1700 | 0.02 | 2 | 1 | 0 | Y | VVAAEMEEAL | 99.82 | | | | | | | | |
| NS3 | 1701 | 0.06 | 4 | 1 | 0 | Y | VAAEMEEALK | 99.47 | | | | | | | | |
| NS3 | 1702 | 0.06 | 4 | 1 | 0 | Y | AAEMEEALKG | 99.47 | | | | | | | | |
| NS3 | 1703 | 0.06 | 4 | 1 | 0 | Y | AEMEEALKGL | 99.47 | | | | | | | | |
| NS3 | 1704 | 0.07 | 5 | 1 | 0 | Y | EMEEALKGLP | 99.29 | | | | | | | | |
| NS3 | 1705 | 0.07 | 5 | 1 | 0 | Y | MEEALKGLPI | 99.29 | | | | | | | | |
| NS3 | 1706 | 0.07 | 5 | 1 | 0 | Y | EEALKGLPIR | 99.29 | | | | | | | | |
| NS3 | 1707 | 0.07 | 5 | 1 | 0 | Y | EALKGLPIRY | 99.29 | | | | | | | | |
| NS3 | 1708 | 0.07 | 5 | 1 | 0 | Y | ALKGLPIRYQ | 99.29 | | | | | | | | |
| NS3 | 1709 | 0.07 | 5 | 1 | 0 | Y | LKGLPIRYQT | 99.29 | | | | | | | | |
| NS3 | 1710 | 0.09 | 4 | 1 | 0 | Y | KGLPIRYQTT | 99.12 | | | | | | | | |
| NS3 | 1711 | 0.09 | 6 | 1 | 0 | Y | GLPIRYQTTA | 99.12 | | | | | | | | |
| NS3 | 1712 | 0.32 | 7 | 3 | 0 | Y | LPIRYQTTAT | 95.58 | LPIRYQTTAI | 3.36 | LPIRYQTVT | 0.35 | | | | |
| NS3 | 1713 | 0.35 | 7 | 4 | 0 | Y | PIRYQTTATK | 95.22 | PIRYQTTAIK | 3.36 | PIRYQTSATK | 0.35 | PIRYQTTATR | 0.35 | | |
| NS3 | 1714 | 0.35 | 7 | 4 | 0 | Y | IRYQTTATKS | 95.22 | IRYQTTAIKS | 3.36 | IRYQTTVTKS | 0.35 | IRYQTATRS | 0.35 | | |
| NS3 | 1715 | 0.35 | 7 | 4 | 0 | Y | RYQTTATKSE | 95.22 | RYQTTAIKSE | 3.36 | RYQTTATRSE | 0.35 | RYQTSATKSE | 0.35 | | |
| NS3 | 1716 | 0.35 | 7 | 4 | 0 | Y | YQTTATKSEH | 95.22 | YQTTAIKSEH | 3.36 | YQTSATRSEH | 0.35 | YQTSATKSEH | 0.35 | | |
| NS3 | 1717 | 0.35 | 7 | 4 | 0 | Y | QTTATKSEHT | 95.22 | QTTAIKSEHT | 3.36 | QTTVTKSEHT | 0.35 | QTSATKSEHT | 0.35 | | |
| NS3 | 1718 | 0.35 | 7 | 4 | 0 | Y | TTATKSEHTG | 95.22 | TTAIKSEHTG | 3.36 | TTATRSEHTG | 0.35 | TTVTKSEHTG | 0.35 | | |
| NS3 | 1719 | 0.7 | 8 | 5 | 0 | Y | TATKSEHTGR | 88.5 | TATKSEHTGK | 6.73 | TAIKSEHTGR | 3.36 | TATRSEHTGR | 0.35 | TVTKSEHTGR | 0.35 |
| NS3 | 1720 | 0.67 | 7 | 4 | 0 | Y | ATKSEHTGRE | 88.85 | ATKSEHTGKE | 6.73 | AIKSEHTGRE | 3.36 | VTKSEHTGRE | 0.35 | | |

FIG. 12-62

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1721 | 0.63 | 6 | 3 | 0 | Y | TKSEHTGREI | 89.2 | TKSEHTGKEI | 6.73 | IKSEHTGREI | 3.36 | | |
| NS3 | 1722 | 0.41 | 4 | 2 | 0 | Y | KSEHTGREIV | 92.74 | KSEHTGKEIV | 6.73 | | | | |
| NS3 | 1723 | 0.37 | 3 | 2 | 0 | Y | SEHTGREIVD | 93.1 | SEHTGKEIVD | 6.73 | | | | |
| NS3 | 1724 | 0.37 | 3 | 2 | 0 | Y | EHTGREIVDL | 93.1 | EHTGKEIVDL | 6.73 | | | | |
| NS3 | 1725 | 0.36 | 3 | 2 | 0 | Y | HTGREIVDLM | 93.1 | HTGKEIVDLM | 6.9 | | | | |
| NS3 | 1726 | 0.38 | 3 | 2 | 0 | Y | TGREIVDLMC | 92.92 | TGKEIVDLMC | 6.9 | | | | |
| NS3 | 1727 | 0.38 | 3 | 2 | 0 | Y | GREIVDLMCH | 92.92 | GKEIVDLMCH | 6.9 | | | | |
| NS3 | 1728 | 0.38 | 3 | 2 | 0 | Y | REIVDLMCHA | 92.92 | KEIVDLMCHA | 6.9 | | | | |
| NS3 | 1729 | 0.04 | 3 | 1 | 0 | Y | EIVDLMCHAT | 99.65 | | | | | | |
| NS3 | 1730 | 0.04 | 3 | 1 | 0 | Y | IVDLMCHATF | 99.65 | | | | | | |
| NS3 | 1731 | 0.04 | 3 | 1 | 0 | Y | VDLMCHATFT | 99.65 | | | | | | |
| NS3 | 1732 | 0.04 | 3 | 1 | 0 | Y | DLMCHATFTM | 99.65 | | | | | | |
| NS3 | 1733 | 0.04 | 3 | 1 | 0 | Y | LMCHATFTMR | 99.65 | | | | | | |
| NS3 | 1734 | 0.04 | 3 | 1 | 0 | Y | MCHATFTMRL | 99.65 | | | | | | |
| NS3 | 1735 | 0.04 | 3 | 1 | 0 | Y | CHATFTMRLL | 99.65 | | | | | | |
| NS3 | 1736 | 0.04 | 2 | 1 | 0 | Y | HATFTMRLLS | 99.82 | | | | | | |
| NS3 | 1737 | 0.02 | 2 | 1 | 0 | Y | ATFTMRLLSP | 99.82 | | | | | | |
| NS3 | 1738 | 0.02 | 2 | 1 | 0 | Y | TFTMRLLSPV | 99.82 | | | | | | |
| NS3 | 1739 | 0 | 1 | 1 | 0 | Y | FTMRLLSPVR | 100 | | | | | | |
| NS3 | 1740 | 0 | 1 | 1 | 0 | Y | TMRLLSPVRV | 100 | | | | | | |
| NS3 | 1741 | 0.02 | 2 | 1 | 0 | Y | MRLLSPVRVP | 99.82 | | | | | | |
| NS3 | 1742 | 0.02 | 2 | 1 | 0 | Y | RLLSPVRVPN | 99.82 | | | | | | |
| NS3 | 1743 | 0.02 | 2 | 1 | 0 | Y | LLSPVRVPNY | 99.82 | | | | | | |
| NS3 | 1744 | 0.02 | 2 | 1 | 0 | Y | LSPVRVPNYN | 99.82 | | | | | | |
| NS3 | 1745 | 0.02 | 2 | 1 | 0 | Y | SPVRVPNYNL | 99.82 | | | | | | |
| NS3 | 1746 | 0.42 | 3 | 2 | 0 | Y | PVRVPNYNLI | 91.86 | PVRVPNYNLV | 7.96 | | | | |

FIG. 12-63

Species: DENV3 (10-mer)

| protein | block starting position | block entropy | total peptides in block | peptides required to cover 99% of block | gap/X fraction | 99% of block covered w/ <= 5 peptides? | block | frequency | block

FIG. 12-64

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block

FIG. 12-65

Species: DENV3 (10-mer)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1799 | 0.02 | 2 | 1 | 0 | Y | FPQSNAPIQD | 99.82 | | | | | | |
| NS3 | 1800 | 0.05 | 3 | 1 | 0 | Y | PQSNAPIQDE | 99.47 | | | | | | |
| NS3 | 1801 | 0.05 | 3 | 1 | 0 | Y | QSNAPIQDEE | 99.47 | | | | | | |
| NS3 | 1802 | 0.18 | 4 | 2 | 0 | Y | SNAPIQDEER | 97.7 | SNAPIQDEEK | 1.77 | | | | |
| NS3 | 1803 | 0.18 | 4 | 2 | 0 | Y | NAPIQDEERD | 97.7 | NAPIQDEEKD | 1.77 | | | | |
| NS3 | 1804 | 0.18 | 4 | 2 | 0 | Y | APIQDEERDI | 97.7 | APIQDEEKDI | 1.77 | | | | |
| NS3 | 1805 | 0.16 | 3 | 2 | 0 | Y | PIQDEERDIP | 97.88 | PIQDEEKDIP | 1.77 | | | | |
| NS3 | 1806 | 0.16 | 3 | 2 | 0 | Y | IQDEERDIPE | 97.88 | IQDEEKDIPE | 1.77 | | | | |
| NS3 | 1807 | 0.16 | 3 | 2 | 0 | Y | QDEERDIPER | 97.88 | QDEEKDIPER | 1.77 | | | | |
| NS3 | 1808 | 0.16 | 3 | 2 | 0 | Y | DEERDIPERS | 97.88 | DEEKDIPERS | 1.77 | | | | |
| NS3 | 1809 | 0.16 | 3 | 2 | 0 | Y | EERDIPERSW | 97.88 | EEKDIPERSW | 1.77 | | | | |
| NS3 | 1810 | 0.13 | 2 | 2 | 0 | Y | ERDIPERSWN | 98.23 | EKDIPERSWN | 1.77 | | | | |
| NS3 | 1811 | 0.13 | 2 | 2 | 0 | Y | RDIPERSWNS | 98.23 | KDIPERSWNS | 1.77 | | | | |
| NS3 | 1812 | 0 | 2 | 1 | 0 | Y | DIPERSWNSG | 100 | | | | | | |
| NS3 | 1813 | 0 | 2 | 1 | 0 | Y | IPERSWNSGN | 100 | | | | | | |
| NS3 | 1814 | 0.34 | 3 | 2 | 0 | Y | PERSWNSGNE | 93.81 | PERSWNSGND | 6.19 | | | | |
| NS3 | 1815 | 0.34 | 3 | 2 | 0 | Y | ERSWNSGNEW | 93.81 | ERSWNSGNDW | 6.19 | | | | |
| NS3 | 1816 | 0.34 | 3 | 2 | 0 | Y | RSWNSGNEWI | 93.81 | RSWNSGNDWI | 6.19 | | | | |
| NS3 | 1817 | 0.34 | 3 | 2 | 0 | Y | SWNSGNEWIT | 93.81 | SWNSGNDWIT | 6.19 | | | | |
| NS3 | 1818 | 0.34 | 3 | 2 | 0 | Y | WNSGNEWITD | 93.81 | WNSGNDWITD | 6.19 | | | | |
| NS3 | 1819 | 0.34 | 3 | 2 | 0 | Y | NSGNEWITDF | 93.81 | NSGNDWITDF | 6.19 | | | | |
| NS3 | 1820 | 1.26 | 6 | 4 | 0 | Y | SGNEWITDFV | 63.89 | SGNDWITDFA | 29.2 | SGNEWITDFT | 0.53 | | |
| NS3 | 1821 | 1.26 | 6 | 4 | 0 | Y | GNEWITDFVG | 63.89 | GNDWITDFAG | 29.2 | GNEWITDFTG | 0.53 | | |
| NS3 | 1822 | 1.29 | 8 | 4 | 0 | Y | NEWITDFAGK | 63.72 | NDWITDFAGK | 29.03 | NEWITDFTGK | 0.53 | | |
| NS3 | 1823 | 1.29 | 8 | 4 | 0 | Y | EWITDFAGKT | 63.72 | DWITDFAGKT | 29.03 | EWITDFTGKT | 0.53 | | |
| NS3 | 1824 | 1 | 7 | 3 | 0 | Y | WITDFAGKTV | 69.56 | WITDFTGKTV | 0.53 | | | | |

FIG. 12-66

Species: DENV3 (10-mer)

| protein | block starting position | block entropy | total peptides in block | peptides required to cover 99% of block | gap/X fraction | 99% of block covered w/ <= 5 peptides? | block | fr

FIG. 12-67

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1851 | 0.02 | 2 | 1 | 0 | Y | KNGKKVIQLS | 99.82 | | |
| NS3 | 1852 | 0.02 | 2 | 1 | 0 | Y | NGKKVIQLSR | 99.82 | | |
| NS3 | 1853 | 0.02 | 2 | 1 | 0 | Y | GKKVIQLSRK | 99.82 | | |
| NS3 | 1854 | 0.02 | 2 | 1 | 0 | Y | KKVIQLSRKT | 99.82 | | |
| NS3 | 1855 | 0.02 | 2 | 1 | 0 | Y | KVIQLSRKTF | 99.82 | | |
| NS3 | 1856 | 0.05 | 3 | 1 | 0 | Y | VIQLSRKTFD | 99.47 | | |
| NS3 | 1857 | 0.05 | 3 | 1 | 0 | Y | IQLSRKTFDT | 99.47 | | |
| NS3 | 1858 | 0.05 | 3 | 1 | 0 | Y | QLSRKTFDTE | 99.47 | | |
| NS3 | 1859 | 0.05 | 3 | 1 | 0 | Y | LSRKTFDTEY | 99.47 | | |
| NS3 | 1860 | 0.05 | 3 | 1 | 0 | Y | SRKTFDTEYQ | 99.47 | | |
| NS3 | 1861 | 0.07 | 4 | 1 | 0 | Y | RKTFDTEYQK | 99.29 | | |
| NS3 | 1862 | 0.09 | 5 | 1 | 0 | Y | KTFDTEYQKT | 99.12 | | |
| NS3 | 1863 | 0.85 | 6 | 2 | 0 | Y | TFDTEYQKTR | 76.81 | TFDTEYQKTR | 22.3 |
| NS3 | 1864 | 0.85 | 6 | 2 | 0 | Y | FDTEYQKTRL | 76.81 | FDTEYQKTRL | 22.3 |
| NS3 | 1865 | 0.85 | 6 | 2 | 0 | Y | DTEYQKTRLN | 76.81 | DTEYQKTRLN | 22.3 |
| NS3 | 1866 | 0.82 | 5 | 2 | 0 | Y | TEYQKTRLND | 77.35 | TEYQKTRLND | 22.12 |
| NS3 | 1867 | 0.82 | 5 | 2 | 0 | Y | EYQKTRLNDW | 77.35 | EYQKTRLNDW | 22.12 |
| NS3 | 1868 | 0.82 | 5 | 2 | 0 | Y | YQKTRLNDWD | 77.35 | YQKTRLNDWD | 22.12 |
| NS3 | 1869 | 0.82 | 5 | 2 | 0 | Y | QKTRLNDWDF | 77.35 | QKTRLNDWDF | 22.12 |
| NS3 | 1870 | 0.83 | 6 | 2 | 0 | Y | KTRLNDWDFV | 77.35 | KTRLNDWDFV | 21.95 |
| NS3 | 1871 | 0.81 | 5 | 2 | 0 | Y | TRLNDWDFVT | 77.52 | TRLNDWDFVT | 21.95 |
| NS3 | 1872 | 0.8 | 4 | 1 | 0 | Y | RLNDWDFVVT | 77.7 | RLNDWDFVVT | 21.95 |
| NS3 | 1873 | 0.04 | 3 | 1 | 0 | Y | LNDWDFVVTT | 99.65 | | |
| NS3 | 1874 | 0.04 | 3 | 1 | 0 | Y | NDWDFVVTTD | 99.65 | | |
| NS3 | 1875 | 0.04 | 3 | 1 | 0 | Y | DWDFVVTTDI | 99.65 | | |
| NS3 | 1876 | 0.02 | 2 | 1 | 0 | Y | WDFVVTTDIS | 99.82 | | |

FIG. 12-68

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 12-69

Species: DENV3 (10-mer)

|

FIG. 12-70

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1929 | 0 | 1 | 1 | 0 | Y | AQRRGVGRN | 100 | | | | | | |
| NS3 | 1930 | 0.05 | 2 | 1 | 0 | Y | QRRGVGRNP | 99.47 | RRGRVGRNPP | 0.71 | | | | |
| NS3 | 1931 | 0.15 | 5 | 2 | 0 | Y | RRGRVGRNPQ | 98.41 | RGRVGRNPPK | 0.71 | | | | |
| NS3 | 1932 | 0.15 | 5 | 2 | 0 | Y | RGRVGRNPQK | 98.41 | GRVGRNPPKE | 0.71 | | | | |
| NS3 | 1933 | 0.15 | 5 | 2 | 0 | Y | GRVGRNPQKE | 98.41 | RVGRNPPKEN | 0.71 | | | | |
| NS3 | 1934 | 0.15 | 5 | 2 | 0 | Y | RVGRNPQKEN | 98.41 | VGRNPPKEND | 0.71 | | | | |
| NS3 | 1935 | 0.16 | 6 | 3 | 0 | Y | VGRNPQKEND | 98.23 | GRNPPKENDQ | 0.71 | VGRNSQKEND | 0.53 | | |
| NS3 | 1936 | 0.16 | 6 | 3 | 0 | Y | GRNPQKENDQ | 98.23 | RNPPKENDQY | 0.71 | GRNSQKENDQ | 0.53 | | |
| NS3 | 1937 | 0.16 | 6 | 3 | 0 | Y | RNPQKENDQY | 98.23 | NPPKENDQYI | 0.71 | RNSQKENDQY | 0.53 | | |
| NS3 | 1938 | 0.16 | 6 | 3 | 0 | Y | NPQKENDQYI | 98.23 | PPKENDQYIF | 0.71 | NSQKENDQYI | 0.53 | | |
| NS3 | 1939 | 0.16 | 6 | 3 | 0 | Y | PQKENDQYIF | 98.23 | PKENDQYIFM | 0.71 | SQKENDQYIF | 0.53 | | |
| NS3 | 1940 | 0.29 | 7 | 3 | 0 | Y | QKENDQYIFT | 96.28 | KENDQYIFMG | 2.3 | PKENDQYIFT | 0.71 | | |
| NS3 | 1941 | 0.2 | 4 | 2 | 0 | Y | KENDQYIFTG | 97.35 | ENDQYIFMGQ | 2.3 | | | | |
| NS3 | 1942 | 0.2 | 4 | 2 | 0 | Y | ENDQYIFTGQ | 97.35 | NDQYIFMGQP | 2.3 | | | | |
| NS3 | 1943 | 0.2 | 4 | 2 | 0 | Y | NDQYIFTGQP | 97.35 | DQYIFMGQPL | 2.3 | | | | |
| NS3 | 1944 | 0.2 | 4 | 2 | 0 | Y | DQYIFTGQPL | 97.35 | QYIFMGQPLN | 2.3 | | | | |
| NS3 | 1945 | 0.18 | 3 | 2 | 0 | Y | QYIFTGQPLN | 97.52 | YIFMGQPLNN | 1.77 | | | | |
| NS3 | 1946 | 0.19 | 4 | 2 | 0 | Y | YIFTGQPLNN | 97.52 | IFMGQPLNND | 1.77 | | | | |
| NS3 | 1947 | 0.19 | 4 | 2 | 0 | Y | IFTGQPLNND | 97.52 | FMGQPLNNDE | 1.77 | | | | |
| NS3 | 1948 | 0.19 | 4 | 2 | 0 | Y | FTGQPLNNDE | 97.52 | MGQPLNNDED | 1.77 | | | | |
| NS3 | 1949 | 0.19 | 4 | 2 | 0 | Y | TGQPLNNDED | 97.52 | | | | | | |
| NS3 | 1950 | 0.05 | 2 | 1 | 0 | Y | GQPLNNDEDH | 99.47 | | | | | | |
| NS3 | 1951 | 0.05 | 2 | 1 | 0 | Y | QPLNNDEDHA | 99.47 | | | | | | |
| NS3 | 1952 | 0.05 | 2 | 1 | 0 | Y | PLNNDEDHAH | 99.47 | | | | | | |
| NS3 | 1953 | 0.05 | 2 | 1 | 0 | Y | LNNDEDHAHW | 99.47 | | | | | | |
| NS3 | 1954 | 0.05 | 2 | 1 | 0 | Y | NNDEDHAHWT | 99.47 | | | | | | |

FIG. 12-71

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency |

FIG. 12-72

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| N

FIG. 12-73

Species: DENV3 (10-mer)

| protein | block starting position | block entropy | total peptides in block | peptides required to cover 99% of block | gap/X fraction | 99% of block covered w/ <= 5 peptides? | block | frequency | pe

FIG. 12-74

Species: DENV3 (10-mer)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 2033 | 0.99 | 3 | 2 | 0 | Y | DRKWCFDGQR | 61.59 | DRKWCFDGER | 38.05 |
| NS3 | 2034 | 1.01 | 4 | 2 | 0 | Y | RKWCFDGQRN | 61.59 | RKWCFDGERN | 37.88 |
| NS3 | 2035 | 1.01 | 4 | 2 | 0 | Y | KWCFDGQRNN | 61.59 | KWCFDGERNN | 37.88 |
| NS3 | 2036 | 0.97 | 3 | 2 | 0 | Y | WCFDGQRNNQ | 61.95 | WCFDGERNNQ | 37.88 |
| NS3 | 2037 | 0.97 | 3 | 2 | 0 | Y | CFDGQRNNQI | 61.95 | CFDGERNNQI | 37.88 |
| NS3 | 2038 | 0.97 | 3 | 2 | 0 | Y | FDGQRNNQIL | 61.95 | FDGERNNQIL | 37.88 |
| NS3 | 2039 | 0.97 | 3 | 2 | 0 | Y | DGQRNNQILE | 61.95 | DGERNNQILE | 37.88 |
| NS3 | 2040 | 0.97 | 3 | 2 | 0 | Y | GQRNNQILEE | 61.95 | GERNNQILEE | 37.88 |
| NS3 | 2041 | 0.97 | 3 | 2 | 0 | Y | QRNNQILEEN | 61.95 | ERNNQILEEN | 37.88 |
| NS3 | 2042 | 0.04 | 2 | 1 | 0 | Y | RNNQILEENM | 99.65 | | |
| NS3 | 2043 | 0.04 | 2 | 1 | 0 | Y | NNQILEENMD | 99.65 | | |
| NS3 | 2044 | 0.02 | 2 | 1 | 0 | Y | NQILEENMDV | 99.82 | | |
| NS3 | 2045 | 0.02 | 2 | 1 | 0 | Y | QILEENMDVE | 99.82 | | |
| NS3 | 2046 | 0.02 | 2 | 1 | 0 | Y | ILEENMDVEI | 99.82 | | |
| NS3 | 2047 | 0.02 | 2 | 1 | 0 | Y | LEENMDVEIW | 99.82 | | |
| NS3 | 2048 | 0.02 | 2 | 1 | 0 | Y | EENMDVEIWT | 99.82 | | |
| NS3 | 2049 | 0.02 | 2 | 1 | 0 | Y | ENMDVEIWTK | 99.82 | | |
| NS3 | 2050 | 0.02 | 2 | 1 | 0 | Y | NMDVEIWTKE | 99.82 | | |
| NS3 | 2051 | 0.02 | 2 | 1 | 0 | Y | MDVEIWTKEG | 99.82 | | |
| NS3 | 2052 | 0 | 1 | 1 | 0 | Y | DVEIWTKEGE | 100 | | |
| NS3 | 2053 | 0.84 | 2 | 2 | 0 | Y | VEIWTKEGEK | 72.92 | VEIWTKEGER | 27.08 |
| NS3 | 2054 | 0.86 | 3 | 2 | 0 | Y | EIWTKEGEKK | 72.74 | EIWTKEGERK | 27.08 |
| NS3 | 2055 | 0.88 | 4 | 2 | 0 | Y | IWTKEGEKKK | 72.74 | IWTKEGERKK | 26.9 |
| NS3 | 2056 | 0.88 | 4 | 2 | 0 | Y | WTKEGEKKKL | 72.74 | WTKEGERKKL | 26.9 |
| NS3 | 2057 | 0.88 | 4 | 2 | 0 | Y | TKEGEKKKLR | 72.74 | TKEGERKKLR | 26.9 |
| NS3 | 2058 | 0.88 | 4 | 2 | 0 | Y | KEGEKKKLRP | 72.74 | KEGERKKLRP | 26.9 |

FIG. 12-75

Species: DENV3 (10-mer)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 2059 | 0.88 | 4 | 2 | 0 | Y | EGEKKKLRPR | 72.74 | EGERKKLRPR | 26.9 |
| NS3 | 2060 | 0.88 | 4 | 2 | 0 | Y | GEKKKLRPRW | 72.74 | GERKKLRPRW | 26.9 |
| NS3 | 2061 | 0.88 | 4 | 2 | 0 | Y | EKKKLRPRWL | 72.74 | ERKKLRPRWL | 26.9 |
| NS3 | 2062 | 0.88 | 4 | 2 | 0 | Y | KKKLRPRWLD | 72.74 | RKKLRPRWLD | 26.9 |
| NS3 | 2063 | 0.04 | 3 | 1 | 0 | Y | KLRPRWLDA | 99.65 | | |
| NS3 | 2064 | 0.02 | 2 | 1 | 0 | Y | KLRPRWLDAR | 99.82 | | |
| NS3 | 2065 | 0.02 | 2 | 1 | 0 | Y | LRPRWLDART | 99.82 | | |
| NS3 | 2066 | 0.02 | 2 | 1 | 0 | Y | RPRWLDARTY | 99.82 | | |
| NS3 | 2067 | 0.02 | 2 | 1 | 0 | Y | PRWLDARTYS | 99.82 | | |
| NS3 | 2068 | 0.02 | 2 | 1 | 0 | Y | RWLDARTYSD | 99.82 | | |
| NS3 | 2069 | 0.02 | 2 | 1 | 0 | Y | WLDARTYSDP | 99.82 | | |
| NS3 | 2070 | 0.02 | 2 | 1 | 0 | Y | LDARTYSDPL | 99.82 | | |
| NS3 | 2071 | 0.02 | 2 | 1 | 0 | Y | DARTYSDPLA | 99.82 | | |
| NS3 | 2072 | 0.05 | 3 | 1 | 0 | Y | ARTYSDPLAL | 99.47 | | |
| NS3 | 2073 | 0.05 | 3 | 1 | 0 | Y | RTYSDPLALK | 99.47 | | |
| NS3 | 2074 | 0.05 | 3 | 1 | 0 | Y | TYSDPLALKE | 99.47 | | |
| NS3 | 2075 | 0.03 | 2 | 1 | 0 | Y | YSDPLALKEF | 99.65 | | |
| NS3 | 2076 | 0.03 | 2 | 1 | 0 | Y | SDPLALKEFK | 99.65 | | |
| NS3 | 2077 | 0.21 | 3 | 2 | 0 | Y | DPLALKEFKD | 96.99 | DPLALKEFKE | 2.65 |
| NS3 | 2078 | 0.21 | 3 | 2 | 0 | Y | PLALKEFKDF | 96.99 | PLALKEFKEF | 2.65 |
| NS3 | 2079 | 0.21 | 3 | 2 | 0 | Y | LALKEFKDFA | 96.99 | LALKEFKEFA | 2.65 |
| NS3 | 2080 | 0.21 | 3 | 2 | 0 | Y | ALKEFKDFAA | 96.99 | ALKEFKEFAA | 2.65 |
| NS3 | 2081 | 0.21 | 3 | 2 | 0 | Y | LKEFKDFAAG | 96.99 | LKEFKEFAAG | 2.65 |
| NS3 | 2082 | 0.18 | 2 | 2 | 0 | Y | KEFKDFAAGR | 97.35 | KEFKEFAAGR | 2.65 |
| NS3 | 2083 | 0.18 | 2 | 2 | 0 | Y | EFKDFAAGRK | 97.35 | EFKEFAAGRK | 2.65 |
| NS3 | 2084 | 0.18 | 2 | 2 | 0 | Y | FKDFAAGRKS | 97.35 | FKEFAAGRKS | 2.65 |

FIG. 12-76

Species: DENV3 (10-mer)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2085 | 0.18 | 2 | 2 | 0 | Y | KDFAAGRKSI | 97.35 | KEFAAGRKSI | 2.65 | | | | |
| NS3 | 2086 | 0.21 | 3 | 2 | 0 | Y | DFAAGRKSIA | 96.99 | EFAAGRKSIA | 2.65 | | | | |
| NS3 | 2087 | 0.14 | 4 | 2 | 0 | Y | FAAGRKSIAL | 98.41 | FAAGRKSIAF | 1.06 | | | | |
| NS3 | 2088 | 0.14 | 4 | 2 | 0 | Y | AAGRKSIALD | 98.41 | AAGRKSIAFD | 1.06 | | | | |
| NS3 | 2089 | 0.14 | 4 | 2 | 0 | Y | AGRKSIALDL | 98.41 | AGRKSIAFDL | 1.06 | | | | |
| NS3 | 2090 | 0.16 | 5 | 2 | 0 | Y | GRKSIALDLV | 98.23 | GRKSIAFDLV | 1.06 | | | | |
| NS3 | 2091 | 0.16 | 5 | 2 | 0 | Y | RKSIALDLVT | 98.23 | RKSIAFDLVT | 1.06 | | | | |
| NS3 | 2092 | 0.16 | 5 | 2 | 0 | Y | KSIALDLVTE | 98.23 | KSIAFDLVTE | 1.06 | | | | |
| NS3 | 2093 | 0.16 | 5 | 2 | 0 | Y | SIALDLVTEI | 98.23 | SIAFDLVTEI | 1.06 | | | | |
| NS3 | 2094 | 0.16 | 5 | 2 | 0 | Y | IALDLVTEIG | 98.23 | IAFDLVTEIG | 1.06 | | | | |
| NS3 | 2095 | 0.16 | 5 | 2 | 0 | Y | ALDLVTEIGR | 98.23 | AFDLVTEIGR | 1.06 | | | | |
| NS3 | 2096 | 0.12 | 4 | 2 | 0 | Y | LDLVTEIGRV | 98.58 | FDLVTEIGRV | 1.06 | | | | |
| NS4A | 2097 | 0.02 | 2 | 1 | 0 | Y | DLVTEIGRVP | 99.82 | | | | | | |
| NS4A | 2098 | 0.64 | 4 | 2 | 0 | Y | LVTEIGRVPS | 84.96 | LVTEIGRVPT | 14.69 | | | | |
| NS4A | 2099 | 0.64 | 4 | 2 | 0 | Y | VTEIGRVPSH | 84.96 | VTEIGRVPTH | 14.69 | | | | |
| NS4A | 2100 | 0.62 | 3 | 2 | 0 | Y | TEIGRVPSHL | 85.13 | TEIGRVPTHL | 14.69 | | | | |
| NS4A | 2101 | 0.64 | 4 | 2 | 0 | Y | EIGRVPSHLA | 84.96 | EIGRVPTHLA | 14.69 | | | | |
| NS4A | 2102 | 0.96 | 5 | 3 | 0 | Y | IGRVPSHLAH | 78.76 | IGRVPTHLAH | 14.69 | IGRVPSHLAY | 6.19 | | |
| NS4A | 2103 | 0.98 | 6 | 3 | 0 | Y | GRVPSHLAHR | 78.58 | GRVPTHLAHR | 14.69 | GRVPSHLAYR | 6.19 | | |
| NS4A | 2104 | 0.98 | 6 | 3 | 0 | Y | RVPSHLAHRT | 78.58 | RVPTHLAHRT | 14.69 | RVPSHLAYRT | 6.19 | | |
| NS4A | 2105 | 0.99 | 7 | 3 | 0 | Y | VPSHLAHRTR | 78.41 | VPTHLAHRTR | 14.69 | VPSHLAYRTR | 6.19 | | |
| NS4A | 2106 | 1.04 | 10 | 5 | 0 | Y | PSHLAHRTRN | 78.23 | PTHLAHRTRN | 14.51 | PSHLAYRTRN | 6.02 | PSHLAHKTRN | 0.18 | PSHLAYRTRS | 0.18 |
| NS4A | 2107 | 1.04 | 10 | 5 | 0 | Y | SHLAHRTRNA | 78.23 | THLAHRTRNA | 14.51 | SHLAYRTRNA | 6.02 | SHLAYRTRSA | 0.18 | SHLAHRTKNA | 0.18 |
| NS4A | 2108 | 0.44 | 8 | 3 | 0 | Y | HLAHRTRNAL | 92.92 | HLAYRTRNAL | 6.02 | HLAHRTKNAL | 0.18 | | |
| NS4A | 2109 | 0.44 | 8 | 3 | 0 | Y | LAHRTRNALD | 92.92 | LAYRTRNALD | 6.02 | LAHKTRNALD | 0.18 | | |
| NS4A | 2110 | 0.44 | 8 | 3 | 0 | Y | AHRTRNALDN | 92.92 | AYRTRNALDN | 6.02 | AYRTRSALDN | 0.18 | | |

FIG. 12-77

Species: DENV3 (10-mer)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency |
|---|---|---|---|---|---|---|---|---|

FIG. 12-78

Species: DENV3

FIG. 12-79

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block

FIG. 12-80

Species: DENV3 (10-mer)

| protein | block starting position | block entropy | total peptides in block | peptides required to cover 99% of block | gap/X fraction | 99% of block covered w/ <= 5 peptides? | block to cover 99% of block | fr

FIG. 12-81

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2215 | 0 | 1 | 1 | 0 | Y | PEKQRTPQDN | 100 | | | | | | |
| NS4A | 2216 | 0 | 1 | 1 | 0 | Y | EKQRTPQDNQ | 100 | | | | | | |
| NS4A | 2217 | 0 | 1 | 1 | 0 | Y | KQRTPQDNQL | 100 | | | | | | |
| NS4A | 2218 | 0 | 1 | 1 | 0 | Y | QRTPQDNQLA | 100 | | | | | | |
| NS4A | 2219 | 0 | 1 | 1 | 0 | Y | RTPQDNQLAY | 100 | | | | | | |
| 2K | 2220 | 0 | 1 | 1 | 0 | Y | TPQDNQLAYY | 100 | | | | | | |
| 2K | 2221 | 0 | 1 | 1 | 0 | Y | PQDNQLAYYW | 100 | | | | | | |
| 2K | 2222 | 0 | 1 | 1 | 0 | Y | QDNQLAYYWI | 100 | | | | | | |
| 2K | 2223 | 0 | 1 | 1 | 0 | Y | DNQLAYYWIG | 100 | | | | | | |
| 2K | 2224 | 0 | 1 | 1 | 0 | Y | NQLAYYWIGI | 100 | | | | | | |
| 2K | 2225 | 0 | 1 | 1 | 0 | Y | QLAYYWIGIL | 100 | | | | | | |
| 2K | 2226 | 0 | 1 | 1 | 0 | Y | LAYYWIGILT | 100 | | | | | | |
| 2K | 2227 | 0 | 1 | 1 | 0 | Y | AYYWIGILTL | 100 | | | | | | |
| 2K | 2228 | 0 | 1 | 1 | 0 | Y | YYWIGILTLA | 100 | | | | | | |
| 2K | 2229 | 0 | 1 | 1 | 0 | Y | YWIGILTLAA | 100 | | | | | | |
| 2K | 2230 | 0.22 | 3 | 2 | 0 | Y | VIGILTLAAI | 96.64 | VIGILTLAAT | 3.19 | | | | |
| 2K | 2231 | 1.16 | 5 | 3 | 0 | Y | IGILTLAAII | 59.47 | IGILTLAAIV | 37.17 | IGILTLAATI | 3.01 | | |
| 2K | 2232 | 1.32 | 6 | 4 | 0 | Y | GILTLAAIIA | 59.47 | GILTLAAIVA | 33.98 | GILTLAAIVT | 3.19 | GILTLAATIA | 3.01 | |
| 2K | 2233 | 1.32 | 6 | 4 | 0 | Y | ILTLAAIIAA | 59.47 | ILTLAAIVAA | 33.98 | ILTLAAIVTA | 3.19 | ILTLAATIAA | 3.01 | |
| 2K | 2234 | 1.32 | 6 | 4 | 0 | Y | LTLAAIIAAN | 59.47 | LTLAAIVAAN | 33.98 | LTLAAIVTAN | 3.19 | LTLAATIAAN | 3.01 | |
| 2K | 2235 | 1.32 | 6 | 4 | 0 | Y | TLAAIIAANE | 59.47 | TLAAIVAANE | 33.98 | TLAAIVTANE | 3.19 | TLAATIAANE | 3.01 | |
| 2K | 2236 | 1.32 | 6 | 4 | 0 | Y | LAAIIAANEM | 59.47 | LAAIVAANEM | 33.98 | LAAIVTANEM | 3.19 | LAATIAANEM | 3.01 | |
| 2K | 2237 | 1.32 | 6 | 4 | 0 | Y | AAIIAANEMG | 59.47 | AAIVAANEMG | 33.98 | AAIVTANEMG | 3.19 | AATIAANEMG | 3.01 | |
| 2K | 2238 | 1.38 | 8 | 5 | 0 | Y | AIIAANEMGL | 58.94 | AIVAANEMGL | 33.81 | AIVTANEMGL | 3.19 | ATIAANEMGL | 3.01 | AIIAANEMGM | 0.53 |
| 2K | 2239 | 1.38 | 8 | 5 | 0 | Y | IIAANEMGLL | 58.94 | IVAANEMGLL | 33.81 | IVTANEMGLL | 3.19 | TIAANEMGLL | 3.01 | IIAANEMGML | 0.53 |
| 2K | 2240 | 1.17 | 5 | 3 | 0 | Y | IAANEMGLLE | 62.12 | VAANEMGLLE | 33.98 | VTANEMGLLE | 3.19 | | | |

FIG. 12-82

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequ

FIG. 12-83

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | fr

FIG. 12-84

Species: DENV3 (10-mer)

| protein | block starting position | block entropy | total peptides in block | peptides required to cover 99% of block | g

FIG. 12-85

Species: DENV3 (10-mer)

| protein | block starting position | block entropy | total peptides in block | peptides required to cover 99% of block | gap/X fraction | 99% of block covered w/ <= 5 peptides? | block (peptides required to cover 99% of) | frequency | block

FIG. 12-86

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2347 | 0.24 | 5 | 3 | 0 | Y | LTLTAAVLLL | 97.17 | | | | | | |
| NS4B | 2348 | 1.18 | 7 | 5 | 0 | Y | TLTAAVLLLV | 62.3 | LTLTAAVLLL | 1.06 | | | | |
| NS4B | 2349 | 1.18 | 7 | 5 | 0 | Y | LTAAVLLLVT | 62.3 | TLTAAVLLLV | 34.51 | TLIAAVLLLV | 0.88 | TLIAAVLLLV | 0.71 |
| NS4B | 2350 | 1.18 | 7 | 5 | 0 | Y | TAAVLLLVTH | 62.3 | LTAAVLLLVT | 34.51 | LIAAVLLLVT | 0.88 | LAAAVLLLVT | 0.71 |
| NS4B | 2351 | 1.07 | 5 | 3 | 0 | Y | AAVLLLVTHY | 62.3 | TAAVLLLVTH | 34.51 | IAAVLLLVTH | 0.88 | AAAVLLLVTH | 0.71 |
| NS4B | 2352 | 1.07 | 5 | 3 | 0 | Y | AVLLLVTHYA | 62.3 | AAVLLLVTHY | 36.11 | | | | |
| NS4B | 2353 | 1 | 4 | 2 | 0 | Y | VLLLVTHYAI | 62.3 | AVLLLVTHYA | 36.11 | | | | |
| NS4B | 2354 | 1 | 4 | 2 | 0 | Y | LLLVTHYAII | 62.3 | VLLLVTHYAI | 37.17 | | | | |
| NS4B | 2355 | 0.98 | 3 | 2 | 0 | Y | LLVTHYAIIG | 62.48 | LLLVTHYAII | 37.17 | | | | |
| NS4B | 2356 | 0.98 | 3 | 2 | 0 | Y | LVTHYAIIGP | 62.48 | LLVTHYAIIG | 37.17 | | | | |
| NS4B | 2357 | 0.98 | 3 | 2 | 0 | Y | VTHYAIIGPG | 62.48 | LVTHYAIIGP | 37.17 | | | | |
| NS4B | 2358 | 0 | 1 | 1 | 0 | Y | THYAIIGPGL | 100 | VTHYAIIGPG | 37.17 | | | | |
| NS4B | 2359 | 0 | 1 | 1 | 0 | Y | HYAIIGPGLQ | 100 | | | | | | |
| NS4B | 2360 | 0 | 1 | 1 | 0 | Y | YAIIGPGLQA | 100 | | | | | | |
| NS4B | 2361 | 0 | 1 | 1 | 0 | Y | AIIGPGLQAK | 100 | | | | | | |
| NS4B | 2362 | 0 | 1 | 1 | 0 | Y | IIGPGLQAKA | 100 | | | | | | |
| NS4B | 2363 | 0 | 1 | 1 | 0 | Y | IGPGLQAKAT | 100 | | | | | | |
| NS4B | 2364 | 0 | 1 | 1 | 0 | Y | GPGLQAKATR | 100 | | | | | | |
| NS4B | 2365 | 0 | 1 | 1 | 0 | Y | PGLQAKATRE | 100 | | | | | | |
| NS4B | 2366 | 0 | 1 | 1 | 0 | Y | GLQAKATREA | 100 | | | | | | |
| NS4B | 2367 | 0 | 1 | 1 | 0 | Y | LQAKATREAQ | 100 | | | | | | |
| NS4B | 2368 | 0 | 1 | 1 | 0 | Y | QAKATREAQK | 100 | | | | | | |
| NS4B | 2369 | 0 | 1 | 1 | 0 | Y | AKATREAQKR | 100 | | | | | | |
| NS4B | 2370 | 0 | 1 | 1 | 0 | Y | KATREAQKRT | 100 | | | | | | |
| NS4B | 2371 | 0 | 1 | 1 | 0 | Y | ATREAQKRTA | 100 | | | | | | |
| NS4B | 2372 | 0 | 1 | 1 | 0 | Y | TREAQKRTAA | 100 | | | | | | |

FIG. 12-87

Species: DENV3 (10-mer)

| protein

FIG. 12-88

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to c

FIG. 12-89

Species: DENV3 (10-mer)

| protein | block starting position | block entropy | total peptides in block | peptides required to cover 99% of block | gap/

FIG. 12-90

Species: DENV3 (10-mer)

| protein | block starting position | block entropy | total peptides in block | peptides required to cover 99% of block | gap/X fraction | 99% of block covered w/ <= 5 peptides? | block | fr

FIG. 12-91

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS4B | 2477 | 0.1 | 5 | 2 | 0 | Y | LAFSIMKSVG | 98.94 | LAFSIMKSVG | 0.53 | | | | | | |
| NS4B | 2478 | 0.14 | 7 | 2 | 0 | Y | AFSIMKSVGT | 98.58 | AFSYMKSVGT | 0.53 | | | | | | |
| NS4B | 2479 | 0.14 | 7 | 2 | 0 | Y | FSIMKSVGTG | 98.58 | FSYMKSVGTG | 0.53 | | | | | | |
| NS4B | 2480 | 0.81 | 7 | 3 | 0 | Y | SIMKSVGTGK | 80.18 | SIMKSVGTGR | 18.58 | SYMKSVGTGK | 0.53 | | | | |
| NS4B | 2481 | 0.81 | 7 | 3 | 0 | Y | IMKSVGTGKR | 80.18 | IMKSVGTGRR | 18.58 | VMKSVGTGKR | 0.53 | | | | |
| NS4B | 2482 | 0.77 | 6 | 2 | 0 | Y | MKSVGTGKRG | 80.71 | MKSVGTGRRG | 18.58 | | | | | | |
| NS4B | 2483 | 0.77 | 6 | 2 | 0 | Y | KSVGTGKRGT | 80.71 | KSVGTGRRGT | 18.58 | | | | | | |
| NS4B | 2484 | 0.75 | 5 | 2 | 0 | Y | SVGTGKRGTG | 80.88 | SVGTGRRGTG | 18.58 | | | | | | |
| NS4B | 2485 | 0.79 | 6 | 3 | 0 | Y | VGTGKRGTGS | 80.35 | VGTGRRGTGS | 18.58 | VGTGKRGTGL | 0.35 | | | | |
| NS4B | 2486 | 0.81 | 7 | 3 | 0 | Y | GTGKRGTGSQ | 80.18 | GTGRRGTGSQ | 18.58 | GTGKRGTGLQ | 0.35 | | | | |
| NS4B | 2487 | 0.81 | 7 | 3 | 0 | Y | TGKRGTGSQG | 80.18 | TGRRGTGSQG | 18.58 | TGKRGTGTQG | 0.35 | | | | |
| NS4B | 2488 | 0.78 | 5 | 2 | 0 | Y | GKRGTGSQGE | 80.18 | GRRGTGSQGE | 18.94 | | | | | | |
| NS4B | 2489 | 0.78 | 5 | 2 | 0 | Y | KRGTGSQGET | 80.18 | RRGTGSQGET | 18.94 | | | | | | |
| NS4B | 2490 | 0.09 | 4 | 1 | 0 | Y | RGTGSQGETL | 99.12 | | | | | | | | |
| NS4B | 2491 | 0.09 | 4 | 1 | 0 | Y | GTGSQGETLG | 99.12 | | | | | | | | |
| NS4B | 2492 | 0.09 | 4 | 1 | 0 | Y | TGSQGETLGE | 99.12 | | | | | | | | |
| NS4B | 2493 | 0.09 | 4 | 1 | 0 | Y | GSQGETLGEK | 99.12 | | | | | | | | |
| NS4B | 2494 | 0.02 | 2 | 1 | 0 | Y | SQGETLGEKW | 99.82 | | | | | | | | |
| NS4B | 2495 | 0.09 | 3 | 1 | 0 | Y | QGETLGEKWK | 98.94 | | | | | | | | |
| NS4B | 2496 | 0.09 | 5 | 2 | 0 | Y | GETLGEKWKK | 98.94 | GETLGEKWKR | 0.71 | | | | | | |
| NS5 | 2497 | 0.2 | 5 | 3 | 0 | Y | ETLGEKWKKK | 97.7 | ETLGEKWKKR | 0.88 | ETLGEKWKRK | 0.71 | | | | |
| NS5 | 2498 | 0.2 | 5 | 3 | 0 | Y | TLGEKWKKKL | 97.7 | TLGEKWKKRL | 0.88 | TLGEKWKRKL | 0.71 | | | | |
| NS5 | 2499 | 0.2 | 5 | 3 | 0 | Y | LGEKWKKKLN | 97.7 | LGEKWKKRLN | 0.88 | LGEKWKRKLN | 0.71 | | | | |
| NS5 | 2500 | 0.2 | 5 | 3 | 0 | Y | GEKWKKKLNQ | 97.7 | GEKWKKRLNQ | 0.88 | GEKWKRKLNQ | 0.71 | | | | |
| NS5 | 2501 | 0.2 | 5 | 3 | 0 | Y | EKWKKKLNQL | 97.7 | EKWKKRLNQL | 0.88 | EKWKRKLNQL | 0.71 | | | | |
| NS5 | 2502 | 0.22 | 6 | 3 | 0 | Y | KWKKKLNQLS | 97.52 | KWKKRLNQLS | 0.88 | KWKRKLNQLS | 0.71 | | | | |

FIG. 12-92

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2503 | 0.27 | 7 | 4 | 0 | Y | WKKKLNQLSR | 96.99 | WKKRLNQLSR | 0.88 | WKKRLNQLSR | 0.71 | WKKKLNQLSW | 0.53 |

FIG. 12-93

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to c

FIG. 12-94

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2560 | 0.13 | 3 | 2 | 0 | Y | MVIPEGRVID | 98.41 | MVVPEGRVID | 1.24 | | | | |
| NS5 | 2561 | 0.13 | 3 | 2 | 0 | Y | VIPEGRVIDL | 98.41 | VPEGRVIDL | 1.24 | | | | |
| NS5 | 2562 | 0.13 | 3 | 2 | 0 | Y | IPEGRVIDLG | 98.41 | VPEGRVIDLG | 1.24 | | | | |
| NS5 | 2563 | 0 | 1 | 1 | 0 | Y | PEGRVIDLGC | 100 | | | | | | |
| NS5 | 2564 | 0 | 1 | 1 | 0 | Y | EGRVIDLGCG | 100 | | | | | | |
| NS5 | 2565 | 0 | 1 | 1 | 0 | Y | GRVIDLGCGR | 100 | | | | | | |
| NS5 | 2566 | 0 | 1 | 1 | 0 | Y | RVIDLGCGRG | 100 | | | | | | |
| NS5 | 2567 | 0 | 1 | 1 | 0 | Y | VIDLGCGRGG | 100 | | | | | | |
| NS5 | 2568 | 0 | 1 | 1 | 0 | Y | IDLGCGRGGW | 100 | | | | | | |
| NS5 | 2569 | 0 | 1 | 1 | 0 | Y | DLGCGRGGWS | 100 | | | | | | |
| NS5 | 2570 | 0 | 1 | 1 | 0 | Y | LGCGRGGWSY | 100 | | | | | | |
| NS5 | 2571 | 0 | 1 | 1 | 0 | Y | GCGRGGWSYY | 100 | | | | | | |
| NS5 | 2572 | 0 | 1 | 1 | 0 | Y | CGRGGWSYYC | 100 | | | | | | |
| NS5 | 2573 | 0 | 1 | 1 | 0 | Y | GRGGWSYYCA | 100 | | | | | | |
| NS5 | 2574 | 0 | 1 | 1 | 0 | Y | RGGWSYYCAG | 100 | | | | | | |
| NS5 | 2575 | 0 | 1 | 1 | 0 | Y | GGWSYYCAGL | 100 | | | | | | |
| NS5 | 2576 | 0.02 | 2 | 1 | 0 | Y | GWSYYCAGLK | 99.82 | | | | | | |
| NS5 | 2577 | 0.04 | 3 | 1 | 0 | Y | WSYYCAGLKK | 99.65 | | | | | | |
| NS5 | 2578 | 0.06 | 4 | 1 | 0 | Y | SYYCAGLKKV | 99.47 | | | | | | |
| NS5 | 2579 | 0.07 | 5 | 1 | 0 | Y | YYCAGLKKVT | 99.29 | | | | | | |
| NS5 | 2580 | 0.07 | 5 | 1 | 0 | Y | YCAGLKKVTE | 99.29 | | | | | | |
| NS5 | 2581 | 0.07 | 5 | 1 | 0.18 | Y | CAGLKKVTEV | 99.29 | | | | | | |
| NS5 | 2582 | 0.06 | 4 | 1 | 0.18 | Y | AGLKKVTEVR | 99.29 | | | | | | |
| NS5 | 2583 | 0.06 | 4 | 1 | 0.18 | Y | GLKKVTEVRG | 99.29 | | | | | | |
| NS5 | 2584 | 0.06 | 4 | 1 | 0.

FIG. 12-95

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block |

FIG. 12-96

Species: DENV3 (10-mer)

| protein | block starting position | block entropy | total peptides in block | peptides required to cover 99% of block | gap/X fraction | covered w/ <=5 peptides? | peptides required to cover 99% of block | frequency | peptides required to cover 99% of block | fr

FIG. 12-97

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2638 | 0.05 | 3 | 1 | 0 | Y | GESSPSPTVE | 99.47 | | | | | | |
| NS5 | 2639 | 0.05 | 3 | 1 | 0 | Y | ESSPSPTVE

FIG. 12-98

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|

FIG. 12-99

Species: DENV3 (10-mer)

| protein | block starting position | block entropy | total

FIG. 12-100

Species: DENV3 (10-mer)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2716 | 1.06 | 5 | 2 | 0 | Y | NIVASVNMYS | 51.68 | NIVSSVNMYS | 47.61 | | | | |
| NS5 | 2717 | 1.06 | 5 | 2 | 0 | Y | IVASVNMYSR | 51.68 | IVSSVNMVSR | 47.61 | | | | |
| NS5 | 2718 | 1.06 | 5 | 2 | 0 | Y | VASVNMYSRL | 51.68 | VSSVNMVSRL | 47.61 | | | | |
| NS5 | 2719 | 1.06 | 5 | 2 | 0 | Y | ASVNMYSRLL | 51.68 | SSVNMVSRLL | 47.61 | | | | |
| NS5 | 2720 | 0.07 | 4 | 1 | 0 | Y | SVNMYSRLLL | 99.29 | | | | | | |
| NS5 | 2721 | 0.07 | 4 | 1 | 0 | Y | VNMYSRLLLN | 99.29 | | | | | | |
| NS5 | 2722 | 0.05 | 3 | 1 | 0 | Y | NMYSRLLLNR | 99.47 | | | | | | |
| NS5 | 2723 | 0.07 | 4 | 1 | 0 | Y | MYSRLLLNRF | 99.29 | | | | | | |
| NS5 | 2724 | 0.05 | 3 | 1 | 0 | Y | YSRLLLNRFT | 99.47 | | | | | | |
| NS5 | 2725 | 0.02 | 2 | 1 | 0 | Y | SRLLLNRFTM | 99.82 | | | | | | |
| NS5 | 2726 | 0.02 | 2 | 1 | 0 | Y | RLLLNRFTMT | 99.82 | | | | | | |
| NS5 | 2727 | 0.37 | 3 | 2 | 0 | Y | LLLNRFTMTH | 93.27 | LLLNRFTMTY | 6.55 | | | | |
| NS5 | 2728 | 0.37 | 3 | 2 | 0 | Y | LLNRFTMTHR | 93.27 | LLNRFTMTYR | 6.55 | | | | |
| NS5 | 2729 | 0.46 | 5 | 3 | 0 | Y | LNRFTMTHRR | 92.74 | LNRFTMTYRR | 5.13 | LNRFTMTYRK | 1.42 | | |
| NS5 | 2730 | 0.46 | 5 | 3 | 0 | Y | NRFTMTHRRP | 92.74 | NRFTMTYRRP | 5.13 | NRFTMTYRKP | 1.42 | | |
| NS5 | 2731 | 0.46 | 5 | 3 | 0 | Y | RFTMTHRRPT | 92.74 | RFTMTYRRPT | 5.13 | RFTMTYRKPT | 1.42 | | |
| NS5 | 2732 | 0.46 | 5 | 3 | 0 | Y | FTMTHRRPTI | 92.92 | FTMTYRRPTI | 5.13 | FTMTYRKPTI | 1.42 | | |
| NS5 | 2733 | 0.45 | 4 | 3 | 0 | Y | TMTHRRPTIE | 91.68 | TMTYRRPTIE | 5.13 | TMTYRKPTIE | 1.42 | | |
| NS5 | 2734 | 0.54 | 5 | 4 | 0 | Y | MTHRRPTIEK | 91.68 | MTYRRPTIEK | 5.13 | MTYRKPTIEK | 1.42 | MTHRRPTIER | 1.24 |
| NS5 | 2735 | 0.54 | 5 | 4 | 0 | Y | THRRPTIEKD | 91.68 | TYRRPTIEKD | 5.13 | TYRKPTIEKD | 1.42 | THRRPTIERD | 1.24 |
| NS5 | 2736 | 0.54 | 5 | 4 | 0 | Y | HRRPTIEKDV | 91.68 | YRRPTIEKDV | 5.13 | YRKPTIEKDV | 1.42 | HRRPTIERDV | 1.24 |
| NS5 | 2737 | 0.25 | 4 | 3 | 0 | Y | RRPTIEKDVD | 96.64 | RKPTIEKDVD | 1.95 | RRPTIERDVD | 1.42 | | |
| NS5 | 2738 | 0.25 | 4 | 3 | 0 | Y | RPTIEKDVDL | 96.64 | KPTIEKDVDL | 1.95 | RPTIERDVDL | 1.24 | | |
| NS5 | 2739 | 0.11 | 3 | 2 | 0 | Y | PTIEKDVDLG | 98.58 | PTIERDVDLG | 1.24 | | | | |
| NS5 | 2740 | 0.11 | 3 | 2 | 0 | Y | TIEKDVDLGA | 98.58 | TIERDVDLGA | 1.24 | | | | |
| NS5 | 2741 | 0.11 | 3 | 2 | 0 | Y | IEKDVDLGAG | 98.58 | IERDVDLGAG | 1.24 | | | | |

FIG. 12-101

Species: DENV3 (10-mer)

| protein | block starting position | block entropy | total peptides in block | peptides required to cover 99% of block | gap/X fraction | covered w/ <= 5 peptides? | block | frequency | peptides required to cover 99% of block | frequency | peptides required to cover 99% of block | frequency | peptides required to cover 99% of block | frequ

FIG. 12-102

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2768 | 0.61 | 10 | 5 | 0 | Y | ERIKRIKEEH | 89.03 | ERIRRIKEEH | 9.38 | ERI

FIG. 12-103

Species: DENV3 (10-mer)

| protein | block starting position | block entropy | total

FIG. 12-104

Species: DENV3 (10-mer)

| prot

FIG. 12-105

Species: DENV3 (10-mer)

| protein | block starting position | block entropy | total peptides in block | peptides required to cover 99% of block | gap/X fraction | 99% of block covered w/ <= 5 peptides? | block

FIG. 12-106

Species: DENV3 (10-mer)

| protein | block starting position | block entropy | total peptides in block | peptides required to cover 99% of block | gap/X fraction | 99% of block covered w/ <= 5 peptides? | block | frequency | peptides required to cover 99% of block | block | frequency | peptides required to cover 99% of block | block | frequency | peptides required to cover 99% of block | block | frequency |
|---|---|---|---|---|---|---|---|---|---|---|---|---|---|---|---|---

FIG. 12-107

Species: DENV3 (10-mer)

| protein | block starting position | block entropy | total peptides in block | peptides required to cover 99% of block | gap/X fraction | 99% of block covered w/ <= 5 peptides? | block (peptides required to cover 99% of block) | frequency | block | frequency | block | frequency | block | frequency |
|---|---|---|---|---|---|---|---|---|---|---|---|---|---|---|
| NS5 | 2911 | 1.44 | 6 | 3 | 0 | Y | AKAAVEDED

FIG. 12-108

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS5 | 2937 | 0.02 | 2 | 1 | 0 | Y | GSCVYNMMGK | 99.82 |
| NS5 | 2938 | 0.02 | 2 | 1 | 0 | Y | SCVYNMMGKR | 99.82 |
| NS5 | 2939 | 0.02

FIG. 12-109

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

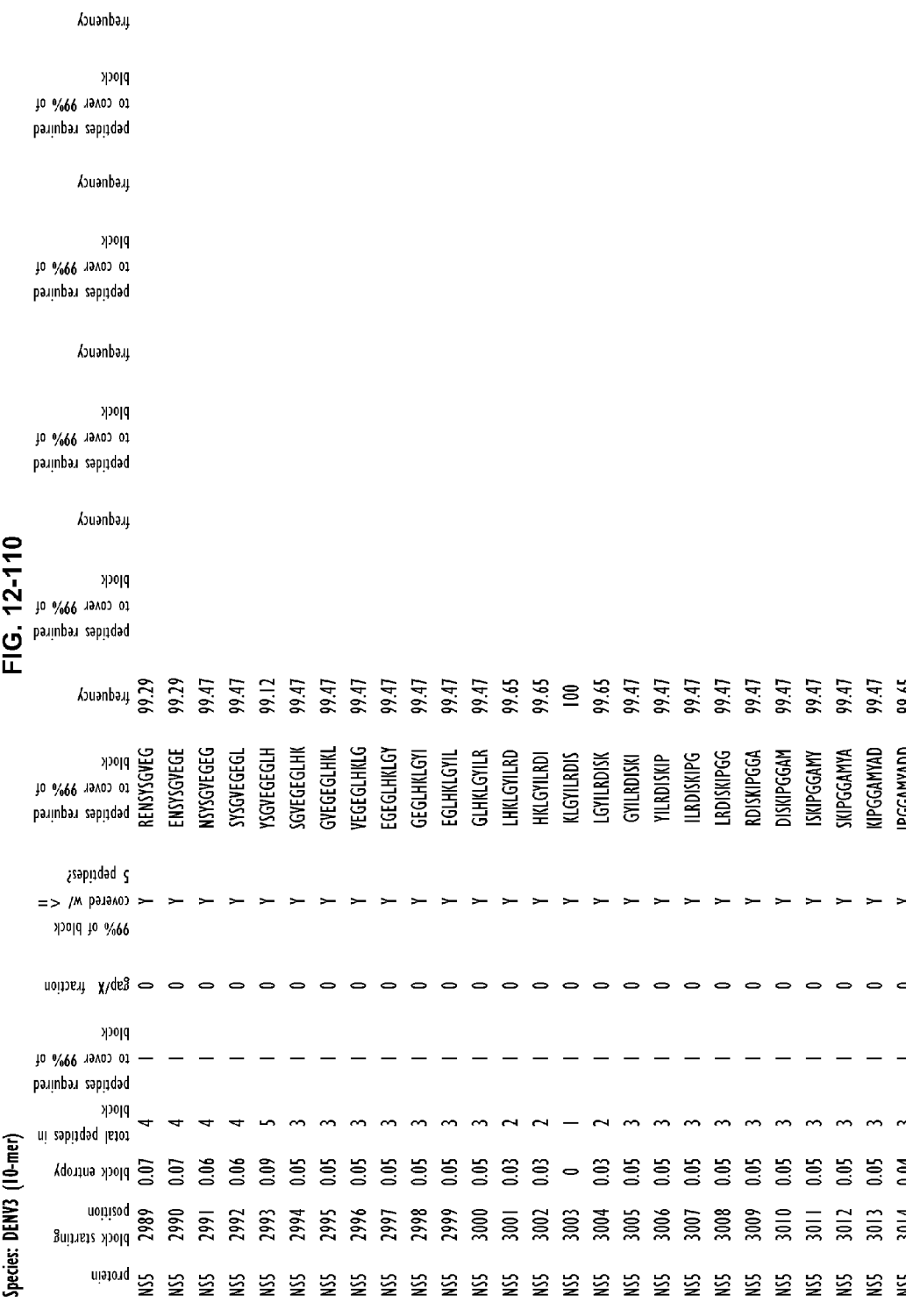

FIG. 12-111

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 3015 | 0.02 | 2 | 1 | 0 | Y | PGGAMYADDT | 99.82 | | | | | | |
| NS5 | 3016 | 0.02 | 2 | 1 | 0 | Y | GGAMYADDTA | 99.82 | | | | | | |
| NS5 | 3017 | 0.02 | 2 | 1 | 0 | Y | GAMYADDTAG | 99.82 | | | | | | |
| NS5 | 3018 | 0.02 | 2 | 1 | 0 | Y | AMYADDTAGW | 99.82 | | | | | | |
| NS5 | 3019 | 0.02 | 2 | 1 | 0 | Y | MYADDTAGWD | 99.82 | | | | | | |
| NS5 | 3020 | 0.02 | 2 | 1 | 0 | Y | YADDTAGWDT | 99.82 | | | | | | |
| NS5 | 3021 | 0.02 | 2 | 1 | 0 | Y | ADDTAGWDTR | 99.82 | | | | | | |
| NS5 | 3022 | 0.02 | 2 | 1 | 0 | Y | DDTAGWDTRI | 99.82 | | | | | | |
| NS5 | 3023 | 0.04 | 3 | 1 | 0 | Y | DTAGWDTRIT | 99.65 | | | | | | |
| NS5 | 3024 | 0.02 | 2 | 1 | 0 | Y | TAGWDTRITE | 99.82 | | | | | | |
| NS5 | 3025 | 0.02 | 2 | 1 | 0 | Y | AGWDTRITED | 99.82 | | | | | | |
| NS5 | 3026 | 0.02 | 2 | 1 | 0 | Y | GWDTRITEDD | 99.82 | | | | | | |
| NS5 | 3027 | 0.02 | 2 | 1 | 0 | Y | WDTRITEDDL | 99.82 | | | | | | |
| NS5 | 3028 | 0.04 | 3 | 1 | 0 | Y | DTRITEDDLH | 99.65 | | | | | | |
| NS5 | 3029 | 0.06 | 4 | 1 | 0 | Y | TRITEDDLHN | 99.47 | | | | | | |
| NS5 | 3030 | 0.06 | 4 | 1 | 0 | Y | RITEDDLHNE | 99.47 | | | | | | |
| NS5 | 3031 | 0.06 | 4 | 1 | 0 | Y | ITEDDLHNEE | 99.47 | | | | | | |
| NS5 | 3032 | 0.06 | 4 | 1 | 0 | Y | TEDDLHNEEK | 99.47 | | | | | | |
| NS5 | 3033 | 0.04 | 3 | 1 | 0 | Y | EDDLHNEEKI | 99.65 | | | | | | |
| NS5 | 3034 | 0.5 | 5 | 3 | 0 | Y | DDLHNEEKIT | 90.8 | DDLHNEEKII | 8.14 | DDLHNEEKIM | 0.71 | | |
| NS5 | 3035 | 0.54 | 6 | 3 | 0 | Y | DLHNEEKITQ | 90.44 | DLHNEEKIIQ | 8.14 | DLHNEEKIMQ | 0.71 | | |
| NS5 | 3036 | 0.54 | 6 | 3 | 0 | Y | LHNEEKITQQ | 90.44 | LHNEEKIIQQ | 8.14 | LHNEEKIMQQ | 0.71 | | |
| NS5 | 3037 | 0.54 | 6 | 3 | 0 | Y | HNEEKITQQM | 90.44 | HNEEKIIQQM | 8.14 | HNEEKIMQQM | 0.71 | | |
| NS5 | 3038 | 0.57 | 7 | 4 | 0 | Y | NEEKITQQMD | 90.09 | NEEKIIQQMD | 8.14 | NEEKIMQQMD | 0.71 | NEEKITQQMN | 0.35 |
| NS5 | 3039 | 0.55 | 6 | 3 | 0 | Y | EEKITQQMDP | 90.27 | EEKIIQQMDP | 8.14 | EEKIMQQMDP | 0.71 | | |
| NS5 | 3040 | 0.59 | 8 | 4 | 0 | Y | EKITQQMDPE | 89.91 | EKIIQQMDPE | 8.14 | EKIMQQMDPE | 0.71 | EKITQQMNPE | 0.35 |

FIG. 12-112

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3041 | 0.59 | 8 | 4 | 0 | Y | KITQQMDPEH | 89.91 | KIIQQMDPEH | 8.14 | KIMQQMDPEH | 0.71 | KITHQMDPEH | 0.35 | | |
| NS5 | 3042 | 0.62 | 9 | 5 | 0 | Y | ITQQMDPEHR | 89.56 | IIQQMDPEHR | 8.14 | IMQQMDPEHR | 0.71 | ITHQMDPEH | 0.35 | ITQQMNPEHR | 0.35 |
| NS5 | 3045 | 0.23 | 10 | 5 | 0 | Y | QMDPEHRQLA | 97.7 | QMDPEHRLLA | 0.35 | QMDPEHRKLA | 0.35 | QMDPEHRRLA | 0.35 | QMDPEHRQ

FIG. 12-113

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 3071 | 0.98 | 3 | 2 | 0 | Y | RPTPTGTVMD | 62.3 | RPTPKGTVMD | 37.35 | | | | |
| NS5 | 3072 | 0.98 | 3 | 2 | 0 | Y | PTPTGTVMDI | 62.3 | PTPKGTVMDI | 37.35 | | | | |
| NS5 | 3073 | 0.98 | 3 | 2 | 0 | Y | TPTGTVMDII | 62.3 | TPKGTVMDII | 37.35 | | | | |
| NS5 | 3074 | 0.98 | 3 | 2 | 0 | Y | PTGTVMDIIS | 62.3 | PKGTVMDIIS | 37.35 | | | | |
| NS5 | 3075 | 0.98 | 3 | 2 | 0 | Y | TGTVMDIISR | 62.3 | KGTVMDIISR | 37.35 | | | | |
| NS5 | 3076 | 0 | 1 | 1 | 0 | Y | GTVMDIISRK | 100 | | | | | | |
| NS5 | 3077 | 0 | 1 | 1 | 0 | Y | TVMDIISRKD | 100 | | | | | | |
| NS5 | 3078 | 0 | 1 | 1 | 0 | Y | VMDIISRKDQ | 100 | | | | | | |
| NS5 | 3079 | 0 | 1 | 1 | 0 | Y | MDIISRKDQR | 100 | | | | | | |
| NS5 | 3080 | 0 | 1 | 1 | 0 | Y | DIISRKDQRG | 100 | | | | | | |
| NS5 | 3081 | 0 | 1 | 1 | 0 | Y | IISRKDQRGS | 100 | | | | | | |
| NS5 | 3082 | 0 | 1 | 1 | 0 | Y | ISRKDQRGSG | 100 | | | | | | |
| NS5 | 3083 | 0 | 1 | 1 | 0 | Y | SRKDQRGSGQ | 100 | | | | | | |
| NS5 | 3084 | 0.03 | 2 | 1 | 0 | Y | RKDQRGSGQV | 99.65 | | | | | | |
| NS5 | 3085 | 0.03 | 2 | 1 | 0 | Y | KDQRGSGQVG | 99.65 | | | | | | |
| NS5 | 3086 | 0.03 | 2 | 1 | 0 | Y | DQRGSGQVGT | 99.65 | | | | | | |
| NS5 | 3087 | 0.03 | 2 | 1 | 0 | Y | QRGSGQVGTY | 99.65 | | | | | | |
| NS5 | 3088 | 0.05 | 3 | 1 | 0 | Y | RGSGQVGTYG | 99.47 | | | | | | |
| NS5 | 3089 | 0.05 | 3 | 1 | 0 | Y | GSGQVGTYGL | 99.47 | | | | | | |
| NS5 | 3090 | 0.05 | 3 | 1 | 0 | Y | SGQVGTYGLN | 99.47 | | | | | | |
| NS5 | 3091 | 0.05 | 3 | 1 | 0 | Y | GQVGTYGLNT | 99.47 | | | | | | |
| NS5 | 3102 | 1.07 | 5 | 3 | 0 | Y | FTNMEAQLIR | 61.95 | FTNMEAQLVR | 36.46 | FTNMEVQLIR | 1.06 | | |
| NS5 | 3103 | 1.07 | 5 | 3 | 0 | Y | TNMEAQLIRQ | 61.95 | TNMEAQLVRQ | 36.46 | TNMEVQLIRQ | 1.06 | | |
| NS5 | 3104 | 1.06 | 4 | 3 | 0 | Y | NMEAQLIRQM | 62.12 | NMEAQLVRQM | 36.46 | NMEVQLIRQM | 1.06 | | |
| NS5 | 3105 | 1.06 | 4 | 3 | 0 | Y | MEAQLIRQME | 62.12 | MEAQLVRQME | 36.46 | MEVQLIRQM | 1.06 | | |
| NS5 | 3106 | 1.06 | 4 | 3 | 0 | Y | EAQLIRQMEG | 62.12 | EAQLVRQMEG | 36.46 | EVQLIRQMEG | 1.06 | | |

FIG. 12-114

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency

FIG. 12-115

Species: DENV3 (10-mer)

| protein | block starting position | block entropy | total

FIG. 12-116

Species: DENV3 (10-mer)

| protein | block starting position | block entropy | total

FIG. 12-118

Species: DENV3 (10-mer)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS5 | 3232 | 1.03 | 5 | 2 | 0 | Y | SQGAGWSLRE | 62.65 | SQGAGWSLKE | 36.46 | | | | | | |
| NS5 | 3233 | 1.03 | 5 | 2 | 0 | Y | QGAGWSLRET | 62.65 | QGAGWSLKET | 36.46 | | | | | | |
| NS5 | 3234 | 1.01 | 4 | 2 | 0 | Y | GAGWSLRETA | 62.65 | GAGWSLKETA | 36.64 | | | | | | |
| NS5 | 3235 | 1.01 | 4 | 2 | 0 | Y | AGWSLRETAC | 62.65 | AGWSLKETAC | 36.64 | | | | | | |
| NS5 | 3236 | 0.97 | 3 | 2 | 0 | Y | GWSLRETACL | 63.19 | GWSLKETACL | 36.64 | | | | | | |
| NS5 | 3237 | 0.98 | 4 | 2 | 0 | Y | WSLRETACLG | 63.01 | WSLKETACLG | 36.64 | | | | | | |
| NS5 | 3238 | 0.98 | 4 | 2 | 0 | Y | SLRETACLGK | 63.01 | SLKETACLGK | 36.64 | | | | | | |
| NS5 | 3239 | 0.98 | 4 | 2 | 0 | Y | LRETACLGKA | 63.01 | LKETACLGKA | 36.64 | | | | | | |
| NS5 | 3240 | 0.97 | 3 | 2 | 0 | Y | RETACLGKAY | 63.19 | KETACLGKAY | 36.64 | | | | | | |
| NS5 | 3241 | 0.02 | 2 | 1 | 0 | Y | ETACLGKAYA | 99.82 | | | | | | | | |
| NS5 | 3242 | 0.02 | 2 | 1 | 0 | Y | TACLGKAYAQ | 99.82 | | | | | | | | |
| NS5 | 3243 | 0.02 | 2 | 1 | 0 | Y | ACLGKAYAQM | 99.82 | | | | | | | | |
| NS5 | 3244 | 0.02 | 2 | 1 | 0 | Y | CLGKAYAQMW | 99.82 | | | | | | | | |
| NS5 | 3245 | 0.57 | 5 | 3 | 0 | Y | LGKAYAQMWS | 89.2 | LGKAYAQMWA | 9.38 | LGKAYAQMWT | 0.88 | | | | |
| NS5 | 3246 | 0.57 | 5 | 3 | 0 | Y | GKAYAQMWSL | 89.2 | GKAYAQMWAL | 9.38 | GKAYAQMWTL | 0.88 | | | | |
| NS5 | 3247 | 0.55 | 4 | 3 | 0 | Y | KAYAQMWSLM | 89.38 | KAYAQMWALM | 9.38 | KAYAQMWTLM | 0.88 | | | | |
| NS5 | 3248 | 0.55 | 4 | 3 | 0 | Y | AYAQMWSLMY | 89.38 | AYAQMWALMY | 9.38 | AYAQMWTLMY | 0.88 | | | | |
| NS5 | 3249 | 0.55 | 4 | 3 | 0 | Y | YAQMWSLMYF | 89.38 | YAQMWALMYF | 9.38 | YAQMWTLMYF | 0.88 | | | | |
| NS5 | 3250 | 0.55 | 4 | 3 | 0 | Y | AQMWSLMYFH | 89.38 | AQMWALMYFH | 9.38 | AQMWTLMYFH | 0.88 | | | | |
| NS5 | 3251 | 0.55 | 4 | 3 | 0 | Y | QMWSLMYFHR | 89.38 | QMWALMYFHR | 9.38 | QMWTLMYFHR | 0.88 | | | | |
| NS5 | 3252 | 0.55 | 4 | 3 | 0 | Y | MWSLMYFHRR | 89.38 | MWALMYFHRR | 9.38 | MWTLMYFHRR | 0.88 | | | | |
| NS5 | 3253 | 0.55 | 4 | 3 | 0 | Y | WSLMYFHRRD | 89.38 | WALMYFHRRD | 9.38 | WTLMYFHRRD | 0.88 | | | | |
| NS5 | 3254 | 0.55 | 4 | 3 | 0 | Y | SLMYFHRRDL | 89.38 | ALMYFHRRDL | 9.38 | TLMYFHRRDL | 0.88 | | | | |
| NS5 | 3255 | 0 | 1 | 1 | 0 | Y | LMYFHRRDLR | 100 | | | | | | | | |
| NS5 | 3256 | 0 | 1 | 1 | 0 | Y | MYFHRRDLRL | 100 | | | | | | | | |
| NS5 | 3257 | 0 | 1 | 1 | 0 | Y | YFHRRDLRLA | 100 | | | | | | | | |

FIG. 12-119

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3258 | 0 | 1 | 1 | 0 | Y | FHRRDLRLAS | 100 | | | | | | |
| NS5 | 3259 | 0 | 1 | 1 | 0 | Y | HRRDLRLASN | 100 | | | | | | |
| NS5 | 3260 | 0 | 1 | 1 | 0 | Y | RRDLRLASNA | 100 | | | | | | |
| NS5 | 3261 | 0 | 1 | 1 | 0 | Y | RDLRLASNAI | 100 | | | | | | |
| NS5 | 3262 | 0 | 1 | 1 | 0 | Y | DLRLASNAIC | 100 | | | | | | |
| NS5 | 3263 | 0 | 1 | 1 | 0 | Y | LRLASNAICS | 100 | | | | | | |
| NS5 | 3264 | 0 | 1 | 1 | 0 | Y | RLASNAICSA | 100 | | | | | | |
| NS5 | 3265 | 0 | 1 | 1 | 0 | Y | LASNAICSAV | 100 | | | | | | |
| NS5 | 3266 | 0 | 1 | 1 | 0 | Y | ASNAICSAVP | 100 | | | | | | |
| NS5 | 3267 | 0.17 | 2 | 2 | 0 | Y | SNAICSAVPV | 97.52 | SNAICSAVPA | 2.48 | | | | |
| NS5 | 3268 | 0.17 | 2 | 2 | 0 | Y | NAICSAVPVH | 97.52 | NAICSAVPAH | 2.48 | | | | |
| NS5 | 3269 | 0.17 | 2 | 2 | 0 | Y | AICSAVPVHW | 97.52 | AICSAVPAHW | 2.48 | | | | |
| NS5 | 3270 | 0.77 | 4 | 3 | 0 | Y | ICSAVPVHWV | 82.83 | ICSAVPVHWI | 14.69 | ICSAVPAHWV | 2.3 | | |
| NS5 | 3271 | 0.77 | 4 | 3 | 0 | Y | CSAVPVHWVP | 82.83 | CSAVPVHWIP | 14.69 | CSAVPAHWVP | 2.3 | | |
| NS5 | 3272 | 0.8 | 5 | 3 | 0 | Y | SAVPVHWVPT | 82.83 | SAVPVHWIPT | 14.34 | SAVPAHWVPT | 2.3 | | |
| NS5 | 3273 | 0.8 | 5 | 3 | 0 | Y | AVPVHWVPTS | 82.83 | AVPVHWIPTS | 14.34 | AVPAHWVPTS | 2.3 | | |
| NS5 | 3274 | 0.8 | 5 | 3 | 0 | Y | VPVHWVPTSR | 82.83 | VPVHWIPTSR | 14.34 | VPAHWVPTSR | 2.3 | | |
| NS5 | 3275 | 0.8 | 5 | 3 | 0 | Y | PVHWVPTSRT | 82.83 | PVHWIPTSRT | 14.34 | PAHWVPTSRT | 2.3 | | |
| NS5 | 3276 | 0.8 | 5 | 3 | 0 | Y | VHWVPTSRTT | 82.83 | VHWIPTSRTT | 14.34 | AHWVPTSRTT | 2.3 | | |
| NS5 | 3277 | 0.63 | 3 | 2 | 0 | Y | HWVPTSRTTW | 85.13 | HWIPTSRTTW | 14.51 | | | | |
| NS5 | 3278 | 0.63 | 3 | 2 | 0 | Y | WVPTSRTTWS | 85.13 | WIPTSRTTWS | 14.51 | | | | |
| NS5 | 3279 | 0.63 | 3 | 2 | 0 | Y | VPTSRTTWSI | 85.13 | IPTSRTTWSI | 14.51 | | | | |
| NS5 | 3280 | 0.03 | 2 | 1 | 0 | Y | PTSRTTWSIH | 99.65 | | | | | | |
| NS5 | 3281 | 0.03 | 2 | 1 | 0 | Y | TSRTTWSIHA | 99.65 | | | | | | |
| NS5 | 3282 | 0 | 1 | 1 | 0 | Y | SRTTWSIHAH | 100 | | | | | | |
| NS5 | 3283 | 0 | 1 | 1 | 0 | Y | RTTWSIHAHH | 100 | | | | | | |

FIG. 12-120

Species: DENV3 (10-mer)

| protein | block starting position | block entropy | total

FIG. 12-121

Species: DENV3 (10-mer)

| protein | block starting position | block ent

FIG. 12-122

Species: DENV3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover

FIG. 12-123

Species: DENW3 (10-mer)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3362 | 0.86 | 5 | 2 | 0 | Y | RSLIGNEEFL | 75.58 | RSLIGDEEFL | 23.72 | | | | |
| NS5 | 3363 | 0.86 | 5 | 2 | 0 | Y | SLIGNEEFLD | 75.58 | SLIGDEEFLD | 23.72 | | | | |
| NS5 | 3364 | 0.86 | 5 | 2 | 0 | Y | LIGNEEFLDY | 75.58 | LIGDEEFLDY | 23.72 | | | | |
| NS5 | 3365 | 0.86 | 5 | 2 | 0 | Y | IGNEEFLDYM | 75.58 | IGDEEFLDYM | 23.72 | | | | |
| NS5 | 3366 | 0.84 | 4 | 2 | 0 | Y | GNEEFLDYMP | 75.75 | GDEEFLDYMP | 23.72 | | | | |
| NS5 | 3367 | 0.86 | 5 | 2 | 0 | Y | NEEFLDYMPS | 75.58 | DEEFLDYMPS | 23.72 | | | | |
| NS5 | 3368 | 0.05 | 3 | 1 | 0 | Y | EEFLDYMPSM | 99.47 | | | | | | |
| NS5 | 3369 | 0.05 | 3 | 1 | 0 | Y | EFLDYMPSMK | 99.47 | | | | | | |
| NS5 | 3370 | 0.05 | 3 | 1 | 0 | Y | FLDYMPSMKR | 99.47 | | | | | | |
| NS5 | 3371 | 0.05 | 3 | 1 | 0 | Y | LDYMPSMKRF | 99.47 | | | | | | |
| NS5 | 3372 | 0.05 | 3 | 1 | 0 | Y | DYMPSMKRFR | 99.47 | | | | | | |
| NS5 | 3373 | 0.05 | 3 | 1 | 0 | Y | YMPSMKRFRK | 99.47 | | | | | | |
| NS5 | 3374 | 0.05 | 3 | 1 | 0 | Y | MPSMKRFRKE | 99.47 | | | | | | |
| NS5 | 3375 | 0.05 | 3 | 1 | 0 | Y | PSMKRFRKEE | 99.47 | | | | | | |
| NS5 | 3376 | 0.05 | 3 | 1 | 0 | Y | SMKRFRKEEE | 99.47 | | | | | | |
| NS5 | 3377 | 0.58 | 4 | 3 | 0 | Y | MKRFRKEEES | 89.2 | MKRFRKEEEL | 9.03 | MKRFRKEEET | 1.42 | | |
| NS5 | 3378 | 0.58 | 4 | 3 | 0 | Y | KRFRKEEESE | 89.2 | KRFRKEEELE | 9.03 | KRFKEEETE | 1.42 | | |
| NS5 | 3379 | 0.58 | 4 | 3 | 0 | Y | RFRKEEESEG | 89.2 | RFRKEEELEG | 9.03 | RFRKEEETEG | 1.42 | | |
| NS5 | 3380 | 0.62 | 5 | 3 | 0 | Y | FRKEEESEGA | 88.67 | FRKEEELEGA | 9.03 | FRKEEETEGA | 1.42 | | |
| NS5 | 3381 | 0.62 | 5 | 3 | 0 | Y | RKEEESEGAI | 88.67 | RKEEELEGAI | 9.03 | RKEEETEGA | 1.42 | | |
| NS5 | 3382 | 0.59 | 4 | 3 | 0 | Y | KEEESEGAIW | 89.03 | KEEELEGAIW | 9.03

FIG. 13-1

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 1 | 0.19 | 4 | 2 | 0 | yes | MNNQRKKTGKP | 97.52 | MNNQRKKAGKP | 1.77 | | | | |
| anC | 2 | 0.19 | 4 | 2 | 0 | yes | NNQRKKTGKPS | 97.52 | NNQRKKAGKPS | 1.77 | | | | |
| anC | 3 | 0.19 | 4 | 2 | 0 | yes | NQRKKTGKPSI | 97.52 | NQRKKAGKPSI | 1.77 | | | | |
| anC | 4 | 0.18 | 3 | 2 | 0 | yes | QRKKTGKPSIN | 97.7 | QRKKAGKPSIN | 1.77 | | | | |
| anC | 5 | 0.18 | 3 | 2 | 0 | yes | RKKTGKPSINM | 97.7 | RKKAGKPSINM | 1.77 | | | | |
| anC | 6 | 0.18 | 3 | 2 | 0 | yes | KKTGKPSINML | 97.7 | KKAGKPSINML | 1.77 | | | | |
| anC | 7 | 0.18 | 3 | 2 | 0 | yes | KTGKPSINMLK | 97.7 | KAGKPSINMLK | 1.77 | | | | |
| anC | 8 | 0.18 | 3 | 2 | 0 | yes | TGKPSINMLKR | 97.7 | AGKPSINMLKR | 1.77 | | | | |
| anC | 9 | 0.08 | 2 | 1 | 0 | yes | GKPSINMLKRV | 99.12 | | | | | | |
| anC | 10 | 0.08 | 2 | 1 | 0 | yes | KPSINMLKRVR | 99.12 | | | | | | |
| anC | 11 | 0.03 | 2 | 1 | 0 | yes | PSINMLKRVRN | 99.65 | | | | | | |
| anC | 12 | 0.03 | 2 | 1 | 0 | yes | SINMLKRVRNR | 99.65 | | | | | | |
| anC | 13 | 0.03 | 2 | 1 | 0 | yes | INMLKRVRNRV | 99.65 | | | | | | |
| anC | 14 | 0.03 | 2 | 1 | 0 | yes | NMLKRVRNRVS | 99.65 | | | | | | |
| anC | 15 | 0.03 | 2 | 1 | 0 | yes | MLKRVRNRVST | 99.65 | | | | | | |
| anC | 16 | 0.03 | 2 | 1 | 0 | yes | LKRVRNRVSTG | 99.65 | | | | | | |
| anC | 17 | 0.1 | 4 | 2 | 0 | yes | KRVRNRVSTGS | 98.94 | KRVRNRVSTGT | 0.53 | | | | |
| anC | 18 | 0.1 | 4 | 2 | 0 | yes | RVRNRVSTGSQ | 98.94 | RVRNRVSTGTQ | 0.53 | | | | |
| anC | 19 | 0.1 | 4 | 2 | 0 | yes | VRNRVSTGSQL | 98.94 | VRNRVSTGTQL | 0.53 | | | | |
| anC | 20 | 0.07 | 3 | 1 | 0 | yes | RNRVSTGSQLA | 99.29 | | | | | | |
| anC | 21 | 0.07 | 3 | 1 | 0 | yes | NRVSTGSQLAK | 99.29 | | | | | | |
| anC | 22 | 0.07 | 3 | 1 | 0 | yes | RVSTGSQLAKR | 99.29 | | | | | | |
| anC | 23 | 0.07 | 3 | 1 | 0 | yes | VSTGSQLAKRF | 99.29 | | | | | | |
| anC | 24 | 0.07 | 3 | 1 | 0 | yes | STGSQLAKRFS | 99.29 | | | | | | |
| anC | 25 | 1 | 4 | 2 | 0 | yes | TGSQLAKRFSK | 64.07 | TGSQLAKRFSR | 35.22 | | | | |
| anC | 26 | 1.09 | 5 | 3 | 0 | yes | GSQLAKRFSKG | 62.83 | GSQLAKRFSRG | 35.22 | GSQLAKRFSKE | 1.24 | | |

FIG. 13-2

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| anC | 27 | 1.09 | 5 | 3 | 0 | yes | SQLAKRFSKGL | 62.83 | SQLAKRFSRGL | 35.22 | SQLA

FIG. 13-3

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 53 | 0 | 1 | 1 | 0 | yes | FLRFLA

FIG. 13-4

Species: DENV3 (11-mers)

| protein | block starting position | block entropy | total peptides in block | peptides required to cover 99% of block | gap/X fraction | covered w/ <= 5 peptides? | block | frequency | block | frequency | block | frequency | block | frequency | block | frequency |
|---|---|---|---|---|---|---|---|---|---|---|---|---|---|---|---|---|
| anC | 79 | 0.68 | 7 | 4 | 0 | yes | KVLKGFKKEIS | 87.79 | KVLRGFKKEIS | 9.38 | KVLKGFKKEIS | 1.59 | KVLKSFKKEIS | 0.53 | VLRGFKKEISS | 0.35 |
| anC | 80 | 0.71 | 8 | 5 | 0 | yes | VLKGFKKEISN | 87.61 | VLRGFKKEISN | 9.2 | VLKGFKKEISN | 1.59 | VLKSFKKEISN | 0.53 | | |
| anC | 81 | 0.69 | 7 | 4 | 0 | yes | LKGFKKEISNM | 87.79 | LRGFKKEISNM | 9.2 | LKGFKKEISNM | 1.59 | LKSFKKEISNM | 0.53 | | |
| anC | 82 | 0.69 | 7 | 4 | 0 | yes | KGFKKEISNML | 87.79 | RGFKKEISNML | 9.2 | KGFKKEISNML | 1.59 | KSFKKEISNML | 0.53 | | |
| anC | 83 | 0.23 | 4 | 3 | 0 | yes | GFKKEISNMLS | 96.99 | GFKKEISNMLS | 1.95 | SFKKEISNMLS | 0.53 | | | | |
| anC | 84 | 0.19 | 3 | 2 | 0 | yes | FKKEISNMLSI | 97.52 | FKKEISNMLSI | 1.95 | | | | | | |
| anC | 85 | 0.2 | 4 | 2 | 0 | yes | KKEISNMLSII | 97.35 | KKEISNMLSII | 1.95 | | | | | | |
| anC | 86 | 0.2 | 4 | 2 | 0 | yes | KEISNMLSIIN | 97.35 | REISNMLSIIN | 1.95 | | | | | | |
| anC | 87 | 0.55 | 6 | 3 | 0 | yes | EISNMLSIINK | 89.56 | EISNMLSIINR | 9.38 | EISNMLSIINQ | 0.35 | | | | |
| anC | 88 | 0.55 | 6 | 3 | 0 | yes | ISNMLSIINKR | 89.56 | ISNMLSIINRR | 9.38 | ISNMLSIINQR | 0.35 | | | | |
| anC | 89 | 0.59 | 7 | 4 | 0 | yes | SNMLSIINKRR | 89.2 | SNMLSIINRRK | 9.38 | SNMLSIINKRR | 0.35 | SNMLSIINQRK | 0.35 | | |
| anC | 90 | 0.62 | 8 | 5 | 0 | yes | NMLSIINKRRK | 89.2 | NMLSIINRRKK | 8.67 | NMLSIINRRKR | 0.71 | NMLSIINQRKK | 0.35 | | |
| anC | 91 | 0.58 | 6 | 3 | 0 | yes | MLSIINKRRKT | 89.38 | MLSIINRRKKT | 9.03 | MLSIINRRKRT | 0.71 | | | | |
| anC | 92 | 0.59 | 7 | 3 | 0 | yes | LSIINKRRKTS | 89.38 | LSIINRRKKTS | 9.03 | LSIINRRKRTS | 0.71 | | | | |
| anC | 107 | 1.19 | 10 | 5 | 0 | yes | MILPAALAFHL | 61.24 | MMLPATLAFHL | 35.75 | MILPATLAFHL | 1.42 | MVLPAALAFHL | 0.35 | MMFPATLAFHL | 0.35 |
| anC | 108 | 1.19 | 10 | 5 | 0 | yes | ILPAALAFHLT | 61.24 | MLPATLAFHLT | 35.75 | ILPATLAFHLT | 1.42 | MVLPAALAFHL | 0.35 | VLPAALAFHLT | 0.35 |
| anC | 109 | 1.04 | 6 | 2 | 0 | yes | LPAALAFHLTS | 61.95 | LPATLAFHLTS | 37.17 | | | | | | |
| anC | 110 | 0.99 | 4 | 2 | 0 | yes | PAALAFHLTSR | 62.12 | PATLAFHLTSR | 37.52 | | | | | | |
| anC | 111 | 0.99 | 3 | 2 | 0 | yes | AALAFHLTSRD | 62.12 | ATLAFHLTSRD | 37.52 | | | | | | |
| anC | 112 | 0.97 | 3 | 2 | 0 | yes | ALAFHLTSRDG | 62.12 | TLAFHLTSRDG | 37.7 | | | | | | |
| anC | 113 | 0.02 | 2 | 1 | 0 | yes | LAFHLTSRDGE | 99.82 | | | | | | | | |
| anC | 114 | 0 | 1 | 1 | 0 | yes | AFHLTSRDGEP | 100 | | | | | | | | |
| prM | 115 | 0.05 | 3 | 1 | 0 | yes | FHLTSRDGEPR | 99.47 | | | | | | | | |
| prM | 116 | 0.05 | 3 | 1 | 0 | yes | HLTSRDGEPRM | 99.47 | | | | | | | | |
| prM | 117 | 0.05 | 3 | 1 | 0 | yes | LTSRDGEPRMI | 99.47 | | | | | | | | |
| prM | 118 | 0.05 | 3 | 1 | 0 | yes | TSRDGEPRMIV | 99.47 | | | | | | | | |

FIG. 13-5

Species: DENV3 (11-mers)

| protein | block starting position | block entropy | total peptides in block | peptides required to cover 99% of block | gap/X fraction | covered w/ <= 5 peptides? | peptides required to cover 99% of block

FIG. 13-6

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 145 | 0.02 | 2 | 1 | 0 | yes | INMCTLIAMDL | 99.82 | | | | | | |
| prM | 146 | 0 | 1 | 1 | 0 | yes | NMCTLIAMDLG | 100 | | | | | | |
| prM | 147 | 0 | 1 | 1 | 0 | yes | MCTLIAMDLGE | 100 | | | | | | |
| prM | 148 | 0 | 1 | 1 | 0 | yes | CTLIAMDLGEM | 100 | | | | | | |
| prM | 149 | 0 | 1 | 1 | 0 | yes | TLIAMDLGEMC | 100 | | | | | | |
| prM | 150 | 0 | 1 | 1 | 0 | yes | LIAMDLGEMCD | 100 | | | | | | |
| prM | 151 | 0 | 1 | 1 | 0 | yes | IAMDLGEMCDD | 100 | | | | | | |
| prM | 152 | 0 | 1 | 1 | 0 | yes | AMDLGEMCDDT | 100 | | | | | | |
| prM | 153 | 0.1 | 2 | 2 | 0 | yes | MDLGEMCDDTV | 98.76 | MDLGEMCDDTI | 1.24 | | | | |
| prM | 154 | 0.1 | 2 | 2 | 0 | yes | DLGEMCDDTVT | 98.76 | DLGEMCDDTIT | 1.24 | | | | |
| prM | 155 | 0.1 | 2 | 2 | 0 | yes | LGEMCDDTVTY | 98.76 | LGEMCDDTITY | 1.24 | | | | |
| prM | 156 | 0.11 | 3 | 2 | 0 | yes | GEMCDDTVTYK | 98.58 | GEMCDDTITYK | 1.24 | | | | |
| prM | 157 | 0.11 | 3 | 2 | 0 | yes | EMCDDTVTYKC | 98.58 | EMCDDTITYKC | 1.24 | | | | |
| prM | 158 | 0.11 | 3 | 2 | 0 | yes | MCDDTVTYKCP | 98.58 | MCDDTITYKCP | 1.24 | | | | |
| prM | 159 | 1.14 | 6 | 4 | 0 | yes | CDDTVTYKCPH | 64.07 | CDDTVTYKCPL | 32.92 | CDDTVTYKCPF | 1.59 | CDDTITYKCPL | 1.06 |
| prM | 160 | 1.16 | 7 | 4 | 0 | yes | DDTVTYKCPHI | 64.07 | DDTVTYKCPLI | 32.57 | DDTVTYKCPFI | 1.59 | DDTITYKCPLI | 1.06 |
| prM | 170 | 0.99 | 7 | 3 | 0 | yes | ITEVEPEDIDC | 68.85 | IAEVEPEDIDC | 30.09 | VAEVEPEDIDC | 0.35 | | |
| prM | 171 | 0.96 | 6 | 2 | 0 | yes | TEVEPEDIDCW | 68.85 | AEVEPEDIDCW | 30.44 | | | | |
| prM | 172 | 0.05 | 3 | 1 | 0 | yes | EVEPEDIDCWC | 99.47 | | | | | | |
| prM | 173 | 0.05 | 2 | 1 | 0 | yes | VEPEDIDCWCN | 99.47 | | | | | | |
| prM | 174 | 0.03 | 2 | 1 | 0 | yes | EPEDIDCWCNL | 99.65 | | | | | | |
| prM | 175 | 0.03 | 2 | 1 | 0 | yes | PEDIDCWCNLT | 99.65 | | | | | | |
| prM | 176 | 0.03 | 2 | 1 | 0 | yes | EDIDCWCNLTS | 99.65 | | | | | | |
| prM | 177 | 0.07 | 3 | 1 | 0 | yes | DIDCWCNLTST | 99.29 | | | | | | |
| prM | 178 | 0.07 | 3 | 1 | 0 | yes | IDCWCNLTSTW | 99.29 | | | | | | |
| prM | 179 | 0.07 | 3 | 1 | 0 | yes | DCWCNLTSTWV | 99.29 | | | | | | |

FIG. 13-7

Species: DENV3 (11

FIG. 13-8

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover

FIG. 13-9

Species: DENV3 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 232 | 0.56 | 7 | 3 | 0 | yes | RQVEKVETWAL | 89.38 | RQVEKVETWAF | 9.56 | RQVEKVETWAL | 0.35 | | | | |
| prM | 233 | 0.56 | 7 | 3 | 0 | yes | QVEKVETWALR | 89.38 | QVEKVETWAFR | 9.56 | QVERVETWALR | 0.35 | | | | |
| prM | 234 | 0.54 | 6 | 2 | 0 | yes | VEKVETWALRH | 89.56 | VEKVETWAFRH | 9.56 | | | | | | |
| prM | 235 | 0.53 | 5 | 2 | 0 | yes | EKVETWALRHP | 89.73 | EKVETWAFRHP | 9.56 | | | | | | |
| prM | 236 | 0.53 | 5 | 2 | 0 | yes | KVETWALRHPG | 89.73 | KVETWAFRHPG | 9.56 | | | | | | |
| prM | 237 | 0.48 | 3 | 2 | 0 | yes | VETWALRHPGF | 90.09 | VETWAFRHPGF | 9.73 | | | | | | |
| prM | 238 | 0.5 | 4 | 2 | 0 | yes | ETWALRHPGFT | 89.91 | ETWAFRHPGFT | 9.73 | | | | | | |
| prM | 239 | 0.52 | 5 | 2 | 0 | yes | TWALRHPGFTI | 89.91 | TWAFRHPGFTI | 9.38 | | | | | | |
| prM | 240 | 0.51 | 4 | 2 | 0 | yes | WALRHPGFTIL | 89.91 | WAFRHPGFTIL | 9.56 | | | | | | |
| prM | 241 | 0.51 | 4 | 2 | 0 | yes | ALRHPGFTILA | 89.91 | AFRHPGFTILA | 9.56 | | | | | | |
| prM | 242 | 0.51 | 4 | 2 | 0 | yes | LRHPGFTILAL | 89.91 | FRHPGFTILAL | 9.56 | | | | | | |
| prM | 243 | 0.05 | 3 | 1 | 0 | yes | RHPGFTILALF | 99.47 | | | | | | | | |
| prM | 244 | 0.05 | 3 | 1 | 0 | yes | HPGFTILALFL | 99.47 | | | | | | | | |
| prM | 245 | 0.05 | 3 | 1 | 0 | yes | PGFTILALFLA | 99.47 | | | | | | | | |
| prM | 246 | 0.07 | 4 | 1 | 0 | yes | GFTILALFLAH | 99.29 | | | | | | | | |
| prM | 247 | 0.07 | 5 | 1 | 0 | yes | FTILALFLAHY | 99.29 | | | | | | | | |
| prM | 248 | 0.15 | 7 | 2 | 0 | yes | TILALFLAHYI | 98.41 | TILALFLAHYY | 0.71 | | | | | | |
| prM | 249 | 0.17 | 7 | 3 | 0 | yes | ILALFLAHYIG | 98.23 | ILALFLAHYVG | 0.71 | ILALFLAHYIS | 0.35 | | | | |
| prM | 250 | 0.15 | 6 | 2 | 0 | yes | LALFLAHYIGT | 98.41 | LALFLAHYVGT | 0.71 | | | | | | |
| prM | 251 | 0.15 | 6 | 2 | 0 | yes | ALFLAHYIGTS | 98.41 | ALFLAHYVGTS | 0.71 | | | | | | |
| prM | 252 | 0.17 | 7 | 3 | 0 | yes | LFLAHYIGTSL | 98.23 | LFLAHYVGTSL | 1.59 | LFLAHYIGTSL | 0.71 | FLAHYISTSLT | 0.35 | | |
| prM | 253 | 0.29 | 8 | 4 | 0 | yes | FLAHYIGTSLT | 96.64 | FLAHYIGTSLI | 1.59 | FLAHYIGTSLT | 0.71 | LAHYISTSLTQ | 0.35 | | |
| prM | 254 | 0.29 | 8 | 4 | 0 | yes | LAHYIGTSLTQ | 96.64 | LAHYIGTSLIQ | 1.59 | LAHYYGTSLTQ | 0.71 | AHYISTSLTQK | 0.35 | | |
| prM | 255 | 0.29 | 8 | 4 | 0 | yes | AHYIGTSLTQK | 96.64 | AHYIGTSLTQK | 1.59 | AHYYGTSLTQK | 0.71 | HYIGTSLTQKV | 0.71 | | |
| prM | 256 | 0.43 | 9 | 5 | 0 | yes | HYIGTSLTQKV | 94.51 | HYIGTSLTQKA | 2.12 | HYIGTSLIQKV | 1.59 | HYYGTSLTQKV | 0.71 | HYISTSLTQKV | 0.35 |
| prM | 257 | 0.42 | 8 | 4 | 0 | yes | YIGTSLTQKVV | 94.69 | YIGTSLTQKAV | 2.12 | YIGTSLIQKVV | 1.59 | YYGTSLTQKVV | 0.71 | | |

FIG. 13-10

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 258 | 0.4 | 7 | 4 | 0 | yes | IGTSLTQKVI | 94.87 | IGTSLTQKAVI | 2.12 | IGTSLIQKVVI | 1.59 | | |
| prM | 259 | 0.32 | 5 | 3 |

FIG. 13-11

Species: DENV3 (11-mers)

| protein | block starting position | block entropy | total peptides in block | peptides required to cover 99% of block | gap/X fraction | 99% of block covered w/ <= 5 peptides? | block | frequency | peptides required to cover 99% of block | block | frequency |
|---|---|---|---|---|---|---|---|---|---|---|---|
| E | 284 | 0.05 | 2 | 1 | 0 | yes | VGVGNRDF

FIG. 13-12

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 310 | 0.5  | 5 | 2 | 0 | yes | CVTTMAKNKPT | 90.62 | CVTTMAKSKPT | 8.5 |
| E | 311 | 0.5  | 5 | 2 | 0 | yes | VTTMAKNKPTL | 90.62 | VTTMAKSKPTL | 8.5 |
| E | 312 | 0.5  | 5 | 2 | 0 | yes | TTMAKNKPTLD | 90.62 | TTMAKSKPTLD | 8.5 |
| E | 313 | 0.5  | 5 | 2 | 0 | yes | TMAKNKPTLDI | 90.62 | TMAKSKPTLDI | 8.5 |
| E | 314 | 0.5  | 5 | 2 | 0 | yes | MAKNKPTLDIE | 90.62 | MAKSKPTLDIE | 8.5 |
| E | 315 | 0.48 | 4 | 2 | 0 | yes | AKNKPTLDIEL | 90.8  | AKSKPTLDIEL | 8.5 |
| E | 316 | 0.47 | 3 | 2 | 0 | yes | KNKPTLDIELQ | 90.97 | KSKPTLDIELQ | 8.5 |
| E | 317 | 0.42 | 2 | 2 | 0 | yes | NKPTLDIELQK | 91.5  | SKPTLDIELQK | 8.5 |
| E | 318 | 0    | 1 | 1 | 0 | yes | KPTLDIELQKT | 100 | | |
| E | 319 | 0    | 1 | 1 | 0 | yes | PTLDIELQKTE | 100 | | |
| E | 320 | 0    | 1 | 1 | 0 | yes | TLDIELQKTEA | 100 | | |
| E | 321 | 0    | 1 | 1 | 0 | yes | LDIELQKTEAT | 100 | | |
| E | 322 | 0.02 | 2 | 1 | 0 | yes | DIELQKTEATQ | 99.82 | | |
| E | 323 | 0.02 | 2 | 1 | 0 | yes | IELQKTEATQL | 99.82 | | |
| E | 324 | 0.02 | 2 | 1 | 0 | yes | ELQKTEATQLA | 99.82 | | |
| E | 325 | 0.02 | 2 | 1 | 0 | yes | LQKTEATQLAT | 99.82 | | |
| E | 326 | 0.02 | 2 | 1 | 0 | yes | QKTEATQLATL | 99.82 | | |
| E | 327 | 0.02 | 2 | 1 | 0 | yes | KTEATQLATLR | 99.82 | | |
| E | 328 | 0.02 | 2 | 1 | 0 | yes | TEATQLATLRK | 99.82 | | |
| E | 329 | 0.02 | 2 | 1 | 0 | yes | EATQLATLRKL | 99.82 | | |
| E | 330 | 0.02 | 2 | 1 | 0 | yes | ATQLATLRKLC | 99.82 | | |
| E | 331 | 0.02 | 2 | 1 | 0 | yes | TQLATLRKLCI | 99.82 | | |
| E | 332 | 0.04 | 3 | 1 | 0 | yes | QLATLRKLCIE | 99.65 | | |
| E | 333 | 0.02 | 2 | 1 | 0 | yes | LATLRKLCIEG | 99.82 | | |
| E | 334 | 0.05 | 3 | 1 | 0 | yes | ATLRKLCIEGK | 99.47 | | |
| E | 335 | 0.05 | 3 | 1 | 0 | yes | TLRKLCIEGKI | 99.47 | | |

FIG. 13-13

Species: DENV3 (11-mers)

| protein | block starting position | block entropy | total peptides in block (11-mers) | peptides required to cover 99% of block | gap/X fraction | 99% of block covered w/ <= 5 peptides? | block | frequency | peptides required to cover 99% of block | block | frequency | peptides required to cover 99% of block | block | frequency |
|---|---|---|---|---|---|---|---|---|---|---|---|---|---|---|
| E | 336 | 0.05 | 3 | 1 | 0 | yes | LRKLCIEGKIT | 99.47 | | | | | | |
| E | 337 | 0.05 | 3 | 1 | 0 | yes | RKLCIEGKITN | 99.47 | | | | | | |
| E | 338 | 0.53 | 5 | 2 | 0 | yes | KLCIEGKITNI | 89.2 | KLCIEGKITNV | 10.27 | | | | |
| E | 339 | 0.53 | 5 | 2 | 0 | yes | LCIEGKITNIT | 89.2 | LCIEGKITNVT | 10.27 | | | | |
| E | 340 | 0.53 | 5 | 2 | 0 | yes | CIEGKITNITT | 89.2 | CIEGKITNVTT | 10.27 | | | | |
| E | 341 | 0.55 | 6 | 2 | 0 | yes | IEGKITNITTD | 89.03 | IEGKITNVTTD | 10.27 | | | | |
| E | 342 | 0.55 | 6 | 2 | 0 | yes | EGKITNITTDS | 89.03 | EGKITNVTTDS | 10.27 | | | | |
| E | 343 | 0.53 | 5 | 2 | 0 | yes | GKITNITTDSR | 89.2 | GKITNVTTDSR | 10.27 | | | | |
| E | 344 | 0.53 | 5 | 2 | 0 | yes | KITNITTDSRC | 89.2 | KITNVTTDSRC | 10.27 | | | | |
| E | 345 | 0.5 | 3 | 2 | 0 | yes | ITNITTDSRCP | 89.38 | ITNVTTDSRCP | 10.44 | | | | |
| E | 346 | 0.5 | 3 | 2 | 0 | yes | TNITTDSRCPT | 89.38 | TNVTTDSRCPT | 10.44 | | | | |
| E | 347 | 0.5 | 3 | 2 | 0 | yes | NITTDSRCPTQ | 89.38 | NVTTDSRCPTQ | 10.44 | | | | |
| E | 348 | 0.5 | 3 | 2 | 0 | yes | ITTDSRCPTQG | 89.38 | VTTDSRCPTQG | 10.44 | | | | |
| E | 349 | 0.02 | 2 | 1 | 0 | yes | TTDSRCPTQGE | 99.82 | | | | | | |
| E | 350 | 0.02 | 2 | 1 | 0 | yes | TDSRCPTQGEA | 99.82 | | | | | | |
| E | 351 | 1.46 | 5 | 4 | 0 | yes | DSRCPTQGEAV | 58.23 | DSRCPTQGEAI | 26.55 | DSRCPTQGEAT | 13.45 | DSRCPTQGEAA | 1.59 |
| E | 352 | 1.45 | 4 | 4 | 0 | yes | SRCPTQGEAVL | 58.23 | SRCPTQGEAIL | 26.73 | SRCPTQGEATL | 13.45 | SRCPTQGEAAL | 1.59 |
| E | 353 | 1.46 | 5 | 4 | 0 | yes | RCPTQGEAVLP | 58.05 | RCPTQGEAILP | 26.73 | RCPTQGEATLP | 13.45 | RCPTQGEAALP | 1.59 |
| E | 354 | 1.46 | 5 | 4 | 0 | yes | CPTQGEAVLPE | 58.05 | CPTQGEAILPE | 26.73 | CPTQGEATLPE | 13.45 | CPTQGEAALPE | 1.59 |
| E | 355 | 1.46 | 5 | 4 | 0 | yes | PTQGEAVLPEE | 58.05 | PTQGEAILPEE | 26.73 | PTQGEATLPEE | 13.45 | PTQGEAALPEE | 1.59 |
| E | 356 | 1.48 | 6 | 4 | 0 | yes | TQGEAVLPEEQ | 58.05 | TQGEAILPEEQ | 26.55 | TQGEATLPEEQ | 13.45 | TQGEAALPEEQ | 1.59 |
| E | 357 | 1.48 | 6 | 4 | 0 | yes | QGEAVLPEEQD | 58.05 | QGEAILPEEQD | 26.55 | QGEATLPEEQD | 13.45 | QGEAALPEEQD | 1.59 |
| E | 358 | 1.48 | 6 | 4 | 0 | yes | GEAVLPEEQDQ | 58.05 | GEAILPEEQDQ | 26.55 | GEATLPEEQDQ | 13.45 | GEAALPEEQDQ | 1.59 |
| E | 359 | 1.5 | 7 | 4 | 0 | yes | EAVLPEEQDQN | 57.88 | EAILPEEQDQN | 26.55 | EATLPEEQDQN | 13.45 | EAALPEEQDQN | 1.59 |
| E | 360 | 1.51 | 8 | 4 | 0 | yes | AVLPEEQDQNY | 57.88 | AILPEEQDQNY | 26.37 | ATLPEEQDQNY | 13.45 | AALPEEQDQNY | 1.59 |
| E | 361 | 1.51 | 8 | 4 | 0 | yes | VLPEEQDQNYV | 57.88 | ILPEEQDQNYV | 26.37 | TLPEEQDQNYV | 13.45 | ALPEEQDQNYV | 1.59 |

FIG. 13-14

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| E | 362 | 0.07 | 5 | 1 | 0 | yes | LPEEQDQNYYC | 99.29 |
| E | 363 | 0.09 | 6 | 1 | 0 | yes | PEEQDQNYYCK | 99.12 |
| E | 364 | 0.07 | 5 | 1 | 0 | yes | EEQDQNYYCKH | 99.29 |
| E | 365 | 0.07 | 5 | 1 | 0 | yes | EQDQNYYCKHT | 99.29 |
| E | 366 | 0.07 | 5 | 1 | 0 | yes | QDQNYYCKHTY | 99.29 |
| E | 367 | 0.07 | 4 | 1 | 0 | yes | DQNYYCKHTYV | 99.47 |
| E | 368 | 0.06 | 4 | 1 | 0 | yes | QNYYCKHTYVD | 99.47 |
| E | 369 | 0.06 | 4 | 1 | 0 | yes | NYYCKHTYVDR | 99.47 |
| E | 370 | 0.04 | 3 | 1 | 0 | yes | YYCKHTYVDRG | 99.65 |
| E | 371 | 0.02 | 2 | 1 | 0 | yes | YCKHTYVDRGW | 99.82 |
| E | 372 | 0.02 | 2 | 1 | 0 | yes | CKHTYVDRGWG | 99.82 |
| E | 373 | 0.02 | 2 | 1 | 0 | yes | KHTYVDRGWGN | 99.82 |
| E | 374 | 0 | 1 | 1 | 0 | yes | HTYVDRGWGNG | 100 |
| E | 375 | 0 | 1 | 1 | 0 | yes | TYVDRGWGNGC | 100 |
| E | 376 | 0 | 1 | 1 | 0 | yes | YVDRGWGNGCG | 100 |
| E | 377 | 0 | 1 | 1 | 0 | yes | VDRGWGNGCGL | 100 |
| E | 378 | 0 | 1 | 1 | 0 | yes | DRGWGNGCGLF | 100 |
| E | 379 | 0 | 1 | 1 | 0 | yes | RGWGNGCGLFG | 100 |
| E | 380 | 0 | 1 | 1 | 0 | yes | GWGNGCGLFGK | 100 |
| E | 381 | 0 | 1 | 1 | 0 | yes | WGNGCGLFGKG | 100 |
| E | 382 | 0 | 1 | 1 | 0 | yes | GNGCGLFGKGS | 100 |
| E | 383 | 0 | 1 | 1 | 0 | yes | NGCGLFGKGSL | 100 |
| E | 384 | 0 | 1 | 1 | 0 | yes | GCGLFGKGSLV | 100 |
| E | 385 | 0 | 1 | 1 | 0 | yes | CGLFGKGSLVT | 100 |
| E | 386 | 0 | 1 | 1 | 0 | yes | GLFGKGSLVTC | 100 |
| E | 387 | 0 | 1 | 1 | 0 | yes | LFGKGSLVTCA | 100 |

FIG. 13-15

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 388 | 0 | 1 | 1 | 0 | yes | FGKGSLVTCAK | 100 | | | | | | |
| E | 389 | 0 | 1 | 1 | 0 | yes | GKGSLVTCAKF | 100 | | | | | | |
| E | 390 | 0 | 1 | 1 | 0 | yes | KGSLVTCAKFQ | 100 | | | | | | |
| E | 391 | 0 | 1 | 1 | 0 | yes | GSLVTCAKFQC | 100 | | | | | | |
| E | 392 | 0 | 1 | 1 | 0 | yes | SLVTCAKFQCL | 100 | | | | | | |
| E | 393 | 0.05 | 3 | 1 | 0 | yes | LVTCAKFQCLE | 99.47 | | | | | | |
| E | 394 | 0.81 | 7 | 3 | 0 | yes | VTCAKFQCLEP | 84.78 | VTCAKFQCLES | 8.14 | VTCAKFQCLEL | 6.37 | | |
| E | 395 | 0.85 | 8 | 4 | 0 | yes | TCAKFQCLEPI | 84.42 | TCAKFQCLESI | 8.14 | TCAKFQCLELI | 6.37 | TCAKFQCLEPV | 0.35 |
| E | 396 | 0.85 | 8 | 4 | 0 | yes | CAKFQCLEPIE | 84.42 | CAKFQCLESIE | 8.14 | CAKFQCLELIE | 6.37 | CAKFQCLEPVE | 0.35 |
| E | 397 | 0.85 | 8 | 4 | 0 | yes | AKFQCLEPIEG | 84.42 | AKFQCLESIEG | 8.14 | AKFQCLELIEG | 6.37 | AKFQCLEPVEG | 0.35 |
| E | 398 | 0.85 | 8 | 4 | 0 | yes | KFQCLEPIEGK | 84.42 | KFQCLESIEGK | 8.14 | KFQCLELIEGK | 6.37 | KFQCLEPVEGK | 0.35 |
| E | 405 | 0.9 | 6 | 3 | 0 | yes | IEGKVVQYENL | 78.58 | IEGKVVQHENL | 18.76 | IEGKAVQHENL | 1.77 | | |
| E | 406 | 0.87 | 5 | 3 | 0 | yes | EGKVVQYENLK | 78.94 | EGKVVQHENLK | 18.76 | EGKAVQHENLK | 1.77 | | |
| E | 407 | 0.87 | 5 | 3 | 0 | yes | GKVVQYENLKY | 78.94 | GKVVQHENLKY | 18.76 | GKAVQHENLKY | 1.77 | | |
| E | 408 | 0.87 | 5 | 3 | 0 | yes | KVVQYENLKYT | 78.94 | KVVQHENLKYT | 18.76 | KAVQHENLKYT | 1.77 | | |
| E | 409 | 0.87 | 5 | 3 | 0 | yes | VVQYENLKYTV | 78.94 | VVQHENLKYTV | 18.76 | AVQHENLKYTV | 1.77 | | |
| E | 410 | 0.86 | 5 | 3 | 0 | yes | VQYENLKYTVI | 79.12 | VQHENLKYTVI | 18.76 | VQHENLKYTV | 1.77 | | |
| E | 411 | 0.86 | 5 | 3 | 0 | yes | QYENLKYTVII | 79.12 | QHENLKYTVII | 18.76 | QHENLKYTVTI | 1.77 | | |
| E | 412 | 0.86 | 5 | 3 | 0 | yes | YENLKYTVIIT | 79.12 | HENLKYTVIIT | 18.76 | HENLKYTVTIT | 1.77 | | |
| E | 413 | 0.17 | 4 | 2 | 0 | yes | ENLKYTVIITV | 97.88 | ENLKYTVIITV | 1.77 | | | | |
| E | 414 | 0.17 | 4 | 2 | 0 | yes | NLKYTVIITVH | 97.88 | NLKYTVIITVH | 1.77 | | | | |
| E | 415 | 0.16 | 3 | 2 | 0 | yes | LKYTVIITVHT | 97.88 | LKYTVIITVHT | 1.95 | | | | |
| E | 416 | 0.16 | 3 | 2 | 0 | yes | KYTVIITVHTG | 97.88 | KYTVIITVHTG | 1.95 | | | | |
| E | 417 | 0.17 | 4 | 2 | 0 | yes | YTVIITVHTGD | 97.88 | YTVIITVHTGD | 1.77 | | | | |
| E | 418 | 0.17 | 5 | 2 | 0 | yes | TVIITVHTGDQ | 97.88 | TVIITVHTGDQ | 1.59 | | | | |
| E | 419 | 0.19 | 6 | 2 | 0 | yes | VIITVHTGDQH | 97.7 | VTITVHTGDQH | 1.59 | | | | |

FIG. 13-16

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 420 | 0.19 | 6 | 2 | 0 | yes | IITVHTGDDHQV | 97.7 | IITVHTGDDHQ | 1.59 | | | | |
| E | 421 | 0.06 | 4 | 1 | 0 | yes | ITVHTGDDHQV | 99.47 | | | | | | |
| E | 422 | 0.06 | 4 | 1 | 0 | yes | TVHTGDDHQVG | 99.47 | | | | | | |
| E | 423 | 0.07 | 5 | 1 | 0 | yes | VHTGDDHQVGN | 99.29 | | | | | | |
| E | 424 | 0.89 | 6 | 2 | 0 | yes | HTGDDHQVGNE | 73.98 | HTGDDHQVGND | 25.31 | | | | |
| E | 425 | 0.91 | 7 | 2 | 0 | yes | TGDDHQVGNET | 73.81 | TGDDHQVGNDT | 25.31 | | | | |
| E | 426 | 0.91 | 7 | 2 | 0 | yes | GDDHQVGNETQ | 73.81 | GDDHQVGNDTQ | 25.31 | | | | |
| E | 427 | 0.91 | 7 | 2 | 0 | yes | DDHQVGNETQG | 73.81 | DDHQVGNDTQG | 25.31 | | | | |
| E | 428 | 0.92 | 8 | 3 | 0 | yes | DHQVGNETQGV | 73.63 | DHQVGNDTQGV | 25.31 | QPQVGNDTQGV | 0.18 | | |
| E | 429 | 0.93 | 8 | 3 | 0 | yes | HQVGNETQGVT | 73.45 | HQVGNDTQGVT | 25.49 | PQVGNDTQGVT | 0.18 | | |
| E | 430 | 0.94 | 8 | 3 | 0 | yes | QVGNETQGVTA | 73.45 | QVGNDTQGVTA | 25.31 | QVGNDTQGVTA | 0.35 | | |
| E | 431 | 0.94 | 8 | 3 | 0 | yes | VGNETQGVTAE | 73.45 | VGNDTQGVTAE | 25.31 | VGNDTQGVTAE | 0.35 | | |
| E | 432 | 0.94 | 8 | 3 | 0 | yes | GNETQGVTAEI | 73.45 | GNDTQGVTAEI | 25.31 | GNDTQGVTAEI | 0.35 | | |
| E | 433 | 0.94 | 8 | 3 | 0 | yes | NETQGVTAEIT | 73.45 | NDTQGVTAEIT | 25.31 | NDTQGVTAEIT | 0.35 | | |
|

FIG. 13-17

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|

FIG. 13-18

Species: DENV3

| protein | block starting position | block entropy | total peptides in block (11-mers) | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 481 | 0.07 | 4 | 1 | 0 | yes | NKAWMVHRQWF | 99.29 | | | | | | |
| E | 482 | 0.07 | 4 | 1 | 0 | yes | KAWMVHRQWFF | 99.29 | | | | | | |
| E | 483 | 0.07 | 4 | 1 | 0 | yes | AWMVHRQWFFD | 99.29 | | | | | | |
| E | 484 | 0.07 | 4 | 1 | 0 | yes | WMVHRQWFFDL | 99.29 | | | | | | |
| E | 485 | 0.07 | 4 | 1 | 0 | yes | MVHRQWFFDLP | 99.29 | | | | | | |
| E | 486 | 0.05 | 3 | 1 | 0 | yes | VHRQWFFDLPL | 99.47 | | | | | | |
| E | 487 | 0.05 | 3 | 1 | 0 | yes | HRQWFFDLPLP | 99.47 | | | | | | |
| E | 488 | 0.05 | 3 | 1 | 0 | yes | RQWFFDLPLPW | 99.47 | | | | | | |
| E | 489 | 0.5 | 4 | 2 | 0 | yes | QWFDLPLPWT | 90.27 | QWFDLPLPWA | 9.2 | | | | |
| E | 490 | 0.51 | 5 | 2 | 0 | yes | WFDLPLPWTS | 90.09 | WFDLPLPWAS | 9.2 | | | | |
| E | 491 | 0.51 | 5 | 2 | 0 | yes | FDLPLPWTSG | 90.09 | FDLPLPWASG | 9.2 | | | | |
| E | 492 | 0.57 | 6 | 3 | 0 | yes | FDLPLPWTSGA | 89.38 | FDLPLPWASGA | 9.2 | FDLPLPWTSGT | 0.53 | | |
| E | 493 | 0.59 | 6 | 4 | 0 | yes | DLPLPWTSGAT | 89.2 | DLPLPWASGAT | 9.2 | DLPLPWTSGTT | 0.53 | DLPLPWTSGVT | 0.53 |
| E | 494 | 0.67 | 8 | 5 | 0 | yes | LPLPWTSGATT | 88.32 | LPLPWASGATA | 9.2 | LPLPWTSGATA | 0.71 | LPLPWTSGVTT | 0.53 |
| E | 504 | 0.69 | 9 | 5 | 0 | yes | TETPTWNRKEL | 87.43 | TETPTWNKKEL | 10.27 | AETPTWNRKEL | 0.71 | TETPTWNRKEL | 0.53 |
| E | 505 | 0.61 | 7 | 3 | 0 | yes | ETPTWNRKELL | 88.32 | ETPTWNKKELL | 10.27 | ETPTWNRKELL | 0.53 | | |
| E | 506 | 0.58 | 6 | 3 | 0 | yes | TPTWNRKELLV | 88.67 | TPTWNKKELLV | 10.27 | TPIWNRKELLV | 0.53 | | |
| E | 507 | 0.56 | 5 | 2 | 0 | yes | PTWNRKELLVT | 88.85 | PTWNKKELLVT | 10.27 | | | | |
| E | 508 | 0.56 | 5 | 2 | 0 | yes | TWNRKELLVTF | 88.85 | TWNKKELLVTF | 10.27 | | | | |
| E | 509 | 0.53 | 5 | 2 | 0 | yes | WNRKELLVTFK | 89.2 | WNKKELLVTFK | 10.27 | | | | |
| E | 510 | 0.53 | 5 | 2 | 0 | yes | NRKELLVTFKN | 89.2 | NKKELLVTFKN | 10.27 | | | | |
| E | 511 | 0.51 | 4 | 2 | 0 | yes | RKELLVTFKNA | 89.38 | KKELLVTFKNA | 10.27 | | | | |
| E | 512 | 0.04 | 3 | 1 | 0 | yes | KELLVTFKNAH | 99.65 | | | | | | |
| E | 513 | 0.04 | 3 | 1 | 0 | yes | ELLVTFKNAHA | 99.65 | | | | | | |
| E | 514 | 0.04 | 3 | 1 | 0 | yes | LLVTFKNAHAK | 99.65 | | | | | | |
| E | 515 | 0.04 | 3 | 1 | 0 | yes | LVTFKNAHAKK | 99.65 | | | | | | |

Note: Row for position 494 shows an additional fifth block "LPLPWTSGTTT" at frequency 0.53; row for position 504 shows an additional fifth block "TKTPTWNRKEL" at frequency 0.35.

FIG. 13-19

Species: DENV3 (11-mers)

| protein | block starting position | block entropy | total peptides in block | peptides required to cover 99% of block | gap/X fraction | 99% of block covered w/ <= 5 peptides? | block | frequency | peptides required to

FIG. 13-20

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 542 | 0.57 | 6 | 2 | 0 | yes | LTGATEIQN

FIG. 13-21

Species: DENV3 (11-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 568 | 0.07 | 4 | 1 | 0 | yes | DIKLELKG

FIG. 13-22

Species: DENV3 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 599 | 1.36 | 8 | 5 | 0 | yes | LIKVEYKGEDA | 58.94 | LIKVEY

FIG. 13-23

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 625 | 0.25 | 3 | 3 | 0

FIG. 13-24

Species: DENV3 (11-mers)

| protein | block starting position | block entropy | total peptides in block | peptides required to cover 99% of block | gap/X fraction | 99% of block covered w/ <= 5 peptides? | block | frequency | block | frequency | block | fr

FIG. 13-25

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| E | 686 | 0.02 | 2 | — | 0 | yes | GARRMAILGDT | 99.82 |
| E | 687 | 0.02 | 2 | — | 0 | yes | ARRMAILGDTA | 99.82 |
| E | 688 | 0.02 | 2 | — | 0 | yes | RRMAILGDTAW | 99.82 |
| E | 689 | 0.02 | 2 | — | 0 | yes | RMAILGDTAWD | 99.82 |
| E | 690 | 0.02 | 2 | — | 0 | yes | MAILGDTAWDF | 99.82 |
| E | 691 | 0.02 | 2 | — | 0 | yes | AILGDTAWDFG | 99.82 |
| E | 692 | 0.02 | 2 | — | 0 | yes | ILGDTAWDFGS | 99.82 |
| E | 693 | 0.04 | 3 | — | 0 | yes | LGDTAWDFGSV | 99.65 |
| E | 694 | 0.04 | 3 | — | 0 | yes | GDTAWDFGSVG | 99.65 |
| E | 695 | 0.04 | 3 | — | 0 | yes | DTAWDFGSVGG | 99.65 |
| E | 696 | 0.07 | 4 | — | 0 | yes | TAWDFGSVGGV | 99.29 |
| E | 697 | 0.05 | 3 | — | 0 | yes | AWDFGSVGGVL | 99.47 |
| E | 698 | 0.05 | 3 | — | 0 | yes | WDFGSVGGVLN | 99.47 |
| E | 699 | 0.05 | 3 | — | 0 | yes | DFGSVGGVLNS | 99.47 |
| E | 700 | 0.05 | 3 | — | 0 | yes | FGSVGGVLNSL | 99.47 |
| E | 701 | 0.05 | 3 | — | 0 | yes | GSVGGVLNSLG | 99.47 |
| E | 702 | 0.05 | 3 | — | 0 | yes | SVGGVLNSLGK | 99.47 |
| E | 703 | 0.09 | 5 | — | 0 | yes | VGGVLNSLGKM | 99.12 |
| E | 704 | 0.07 | 4 | — | 0 | yes | GGVLNSLGKMV | 99.29 |
| E | 705 | 0.07 | 4 | — | 0 | yes | GVLNSLGKMVH | 99.29 |
| E | 706 | 0.07 | 4 | — | 0 | yes | VLNSLGKMVHQ | 99.29 |
| E | 707 | 0.07 | 4 | — | 0 | yes | LNSLGKMVHQI | 99.29 |
| E | 708 | 0.07 | 4 | — | 0 | yes | NSLGKMVHQIF | 99.29 |
| E | 709 | 0.07 | 4 | — | 0 | yes | SLGKMVHQIFG | 99.29 |
| E | 710 | 0.07 | 4 | — | 0 | yes | LGKMVHQIFGS | 99.29 |
| E | 711 | 0.07 | 4 | — | 0 | yes | GKMVHQIFGSA | 99.29 |

FIG. 13-26

Species: DENV3 (11-mers)

| protein | block starting position | block entropy | total peptides in block (11-mers) | peptides required to cover 99% of block | gap/X fraction | 99% of block covered w/ <= 5 peptides? | block (peptides to cover 99% of block) | frequency | block | frequency | block | frequency | block | frequency |
|---|---|---|---|---|---|---|---|---|---|---|---|---|---|---|
| E | 712 | 0.07 | 4 | 1 | 0 | yes | KMYHQIFGSAY | 99.29 | | | | | | |
| E | 713 | 0.07 | 4 | 1 | 0 | yes | MYHQIFGSAYT | 99.29 | | | | | | |
| E | 714 | 0.05 | 3 | 1 | 0 | yes | VHQIFGSAYTA | 99.47 | | | | | | |
| E | 715 | 0.07 | 4 | 1 | 0 | yes | HQIFGSAYTAL | 99.29 | | | | | | |
| E | 716 | 0.07 | 4 | 1 | 0 | yes | QIFGSAYTALF | 99.29 | | | | | | |
| E | 717 | 0.23 | 5 | 2 | 0 | yes | IFGSAYTALFS | 96.99 | IFGSAYTALFG | 2.3 | | | | |
| E | 718 | 0.2 | 4 | 2 | 0 | yes | FGSAYTALFSG | 97.35 | FGSAYTALFGG | 2.3 | | | | |
| E | 719 | 0.2 | 4 | 2 | 0 | yes | GSAYTALFSGV | 97.35 | GSAYTALFGGV | 2.3 | | | | |
| E | 720 | 0.2 | 4 | 2 | 0 | yes | SAYTALFSGVS | 97.35 | SAYTALFGGVS | 2.3 | | | | |
| E | 721 | 0.2 | 4 | 2 | 0 | yes | AYTALFSGVSW | 97.35 | AYTALFGGVSW | 2.3 | | | | |
| E | 722 | 1.13 | 6 | 4 | 0 | yes | YTALFSGVSWV | 62.65 | YTALFSGVSWI | 34.69 | YTALFGGVSWI | 1.59 | YTALFGGVSWM | 0.71 |
| E | 723 | 1.13 | 6 | 4 | 0 | yes | TALFSGVSWVM | 62.65 | TALFSGVSWIM | 34.69 | TALFGGVSWIM | 1.59 | TALFGGVSWMM | 0.71 |
| E | 724 | 1.13 | 6 | 4 | 0 | yes | ALFSGVSWVMK | 62.65 | ALFSGVSWIMK | 34.69 | ALFGGVSWIMK | 1.59 | ALFGGVSWMMK | 0.71 |
| E | 725 | 1.14 | 6 | 4 | 0 | yes | LFSGVSWVMKI | 62.48 | LFSGVSWIMKI | 34.69 | LFGGVSWIMKI | 1.59 | LFGGVSWMMKI | 0.71 |
| E | 726 | 1.13 | 5 | 4 | 0 | yes | FSGVSWVMKIG | 62.48 | FSGVSWIMKIG | 34.87 | FGGVSWIMKIG | 1.59 | FGGVSWMMKIG | 0.71 |
| E | 727 | 1.13 | 5 | 3 | 0 | yes | SGVSWVMKIGI | 62.48 | SGVSWIMKIGI | 34.87 | GGVSWIMKIGIG | 1.59 | | |
| E | 728 | 1.03 | 4 | 3 | 0 | yes | GVSWVMKIGIG | 62.48 | GVSWIMKIGIG | 36.46 | GVSWMMKIGIG | 0.71 | | |
| E | 729 | 1.33 | 7 | 4 | 0 | yes | VSWVMKIGIGV | 56.81 | VSWIMKIGIGV | 36.46 | VSWMMKIGIGV | 5.31 | | |
| E | 730 | 1.33 | 7 | 4 | 0 | yes | SWVMKIGIGVL | 56.81 | SWIMKIGIGIL | 36.46 | SWMMKIGIGVL | 5.31 | | |
| E | 731 | 1.33 | 7 | 4 | 0 | yes | WVMKIGIGVLL | 56.81 | WIMKIGIGILL | 36.46 | WMMKIGIGVLL | 5.31 | | |
| E | 732 | 1.33 | 7 | 4 | 0 | yes | VMKIGIGVLLT | 56.81 | IMKIGIGILLT | 36.46 | MMKIGIGVLLT | 5.31 | | |
| E | 733 | 0.37 | 5 | 2 | 0 | yes | MKIGIGVLLTW | 93.98 | MKIGIGILLTWI | 5.31 | | | | |
| E | 734 | 0.39 | 6 | 2 | 0 | yes | KIGIGVLLTWI | 93.81 | KIGIGILLTWI | 5.31 | | | | |
| E | 735 | 0.39 | 6 | 2 | 0 | yes | IGIGVLLTWIG | 93.81 | IGIGILLTWIG | 5.31 | | | | |
| E | 736 | 0.36 | 5 | 2 | 0 | yes | GIGVLLTWIGL | 94.16 | GIGILLTWIGL | 5.31 | | | | |
| E | 737 | 0.36 | 5 | 2 | 0 | yes | IGVLLTWIGLN | 94.16 | IGILLTWIGLN | 5.31 | | | | |

FIG. 13-27

Species: DENV3 (11-mers)

| protein | block starting position | block entropy | total peptides in block | peptides required to cover 99% of block | gap/X fraction | 99% of block covered w/ <= 5 peptides? | block | frequency | peptides required to cover 99% of block

FIG. 13-28

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 765 | 0.69 | 5 | 4 | 0 | yes | LYLGAVVQADM | 88.14 | LYLGAVVQADT | 8.14 | LYLGTVVQADM | 1.95 | LYLGVVVQADM | 1.06 |
| E | 766 | 0.69 | 5 | 4 | 0 | yes | YLGAVVQADMG | 88.14 | YLGAVVQADTG | 8.14 | YLGTVVQADMG | 1.95 | YLGVVVQADMG | 1.06 |
| E | 767 | 0.69 | 5 | 4 | 0 | yes | LGAVVQADMGC | 88.14 | LGAVVQADTGC | 8.14 | LGTVVQADMGC | 1.95 | LGVVVQADMGC | 1.06 |
| E | 768 | 1.02 | 7 | 5 | 0 | yes | GAVVQADMGCV | 81.95 | GAVVQADTGCV | 8.14 | GAVVQADMGCA | 6.19 | GTVVQADMGCV | 1.77 |
| E | 769 | 0.88 | 6 | 4 | 0 | yes | VVQADMGCVIN | 83.89 | VVQADTGCVIN | 7.96 | VVQADMGCAIN | 6.37 | VVQADMGCVVN | 0.88 |
| E | 770 | 0.88 | 6 | 4 | 0 | yes | VQADMGCVINW | 83.89 | VQADTGCVINW | 7.96 | VQADMGCAINW | 6.37 | VQADMGCVVNW | 0.88 |
| E | 771 | 0.88 | 6 | 4 | 0 | yes | QADMGCVINWK | 83.89 | QADTGCVINWK | 7.96 | QADMGCAINWK | 6.37 | QADMGCVVNWK | 0.88 |
| E | 772 | 0.88 | 6 | 4 | 0 | yes | ADMGCVINWKG | 83.89 | ADTGCVINWKG | 7.96 | ADMGCAINWKG | 6.37 | ADMGCVVNWKG | 0.88 |
| NS1 | 773 | 0.9 | 7 | 5 | 0 | yes | DMGCVINWKGK | 83.72 | DTGCVINWKGK | 7.96 | DMGCAINWKGK | 6.37 | DMGCVVNWKGK | 0.88 |
| NS1 | 774 | 0.9 | 7 | 5 | 0 | yes | MGCVINWKGKE | 83.72 | TGCVINWKGKE | 7.96 | MGCAINWKGKE | 6.37 | MGCVVNWKGKE | 0.88 |
| NS1 | 775 | 0.44 | 4 | 3 | 0 | yes | GCVINWKGKEL | 92.39 | GCAINWKGKEL | 6.37 | GCVVNWKGKEL | 1.06 | | |
| NS1 | 776 | 0.44 | 4 | 3 | 0 | yes | CVINWKGKELK | 92.39 | CAINWKGKELK | 6.37 | CVINWKGKELK | 1.06 | | |
| NS1 | 777 | 0.44 | 4 | 3 | 0 | yes | VINWKGKELKC | 92.39 | AINWKGKELKC | 6.37 | VINWKGKELKC | 1.06 | | |
| NS1 | 778 | 0.1 | 3 | 2 | 0 | yes | INWKGKELKCG | 98.76 | VNWKGKELKCG | 1.06 | | | | |
| NS1 | 779 | 0.23 | 3 | 2 | 0 | yes | NWKGKELKCGS | 96.46 | NWKGKELKCGN | 3.36 | | | | |
| NS1 | 780 | 0.23 | 3 | 2 | 0 | yes | WKGKELKCGSG | 96.46 | WKGKELKCGNG | 3.36 | | | | |
| NS1 | 781 | 0.23 | 3 | 2 | 0 | yes | KGKELKCGSGI | 96.46 | KGKELKCGNGI | 3.36 | | | | |
| NS1 | 782 | 0.23 | 3 | 2 | 0 | yes | GKELKCGSGIF | 96.46 | GKELKCGNGIF | 3.36 | | | | |
| NS1 | 783 | 0.23 | 3 | 2 | 0 | yes | KELKCGSGIFV | 96.46 | KELKCGNGIFV | 3.36 | | | | |
| NS1 | 784 | 0.21 | 2 | 2 | 0 | yes | ELKCGSGIFVT | 96.64 | ELKCGNGIFVT | 3.36 | | | | |
| NS1 | 785 | 0.21 | 2 | 2 | 0 | yes | LKCGSGIFVTN | 96.64 | LKCGNGIFVTN | 3.36 | | | | |
| NS1 | 786 | 0.21 | 2 | 2 | 0 | yes | KCGSGIFVTNE | 96.64 | KCGNGIFVTNE | 3.36 | | | | |
| NS1 | 787 | 0.21 | 2 | 2 | 0 | yes | CGSGIFVTNEV | 96.64 | CGNGIFVTNEV | 3.36 | | | | |
| NS1 | 788 | 0.21 | 2 | 2 | 0 | yes | GSGIFVTNEVH | 96.64 | GNGIFVTNEVH | 3.36 | | | | |
| NS1 | 789 | 0.21 | 2 | 2 | 0 | yes | SGIFVTNEVHT | 96.46 | NGIFVTNEVHT | 3.36 | | | | |
| NS1 | 790 | 0.23 | 3 | 2 | 0 | yes | GIFVTNEVHTW | 99.82 | | | | | | |
| NS1 | 791 | 0.02 | 2 | 1 | 0 | yes | | | | | | | | |

FIG. 13-29

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 844 | 0.27 | 6 | 2 | 0 | yes | IANELNYIL

FIG. 13-32

Species: DENV3 (11-mers)

| protein | block starting position | block entropy | total peptides in block | peptides required to cover 99% of block | gap/X fraction | 99% of block covered w/ <= 5 peptides? | block to cover 99% of | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 880 | 0.14 | 6 | 2 | 0 | yes | QPMELKYSWKT | 98.58 | QPMELKYSWKA | 0.71 | | | | |
| NS1 | 881 | 0.14 | 6 | 2 | 0 | yes | PMELKYSWKTW | 98.58 | PMELKYSWKAW | 0.71 | | | | |
| NS1 | 882 | 0.14 | 6 | 2 | 0 | yes | MELKYSWKTWG | 98.58 | MELKYSWKAWG | 0.71 | | | | |
| NS1 | 883 | 0.14 | 6 | 2 | 0 | yes | ELKYSWKTWGK | 98.58 | ELKYSWKAWGK | 0.71 | | | | |
| NS1 | 884 | 0.14 | 6 | 2 | 0 | yes | LKYSWKTWGKA | 98.58 | LKYSWKAWGKA | 0.71 | | | | |
| NS1 | 885 | 0.29 | 7 | 3 | 0 | yes | KYSWKTWGKAK | 96.28 | KYSWKTWGKAR | 2.3 | KYSWKAWGKAK | 0.71 | | |
| NS1 | 886 | 0.38 | 8 | 5 | 0 | yes | YSWKTWGKAKI | 95.22 | YSWKTWGKARI | 2.3 | YSWKAWGKAKI | 0.71 | YSWKTWGKAKM | 0.53 |
| NS1 | 887 | 0.4 | 9 | 5 | 0 | yes | SWKTWGKAKIV | 95.04 | SWKTWGKARIV | 2.3 | SWKTWGKAKIV | 0.71 | SWKTWGKAKMV | 0.53 |
| NS1 | 899 | 0.57 | 9 | 4 | 0 | yes | AETQNSSFIID | 90.09 | AEIQNSSFIID | 8.32 | AETQNFSFIID | 0.53 | AETRNSSFIID | 0.71 |
| NS1 | 900 | 0.57 | 9 | 4 | 0 | yes | ETQNSSFIIDG | 90.09 | EIQNSSFIIDG | 8.32 | ETQNFSFIIDG | 0.53 | ENQNSSFIID | 0.18 |
| NS1 | 901 | 0.57 | 9 | 4 | 0 | yes | TQNSSFIIDGP | 90.09 | IQNSSFIIDGP | 8.32 | TQNFSFIIDGP | 0.53 | KQNSSFIIDGP | 0.18 |
| NS1 | 902 | 0.22 | 6 | 3 | 0 | yes | QNSSFIIDGPN | 97.35 | QNSSFIIDGPS | 1.42 | QNFSFIIDGPN | 0.71 | | |
| NS1 | 903 | 0.22 | 5 | 3 | 0 | yes | NSSFIIDGPNT | 97.35 | NSSFIIDGPST | 1.59 | NFSFIIDGPNT | 0.71 | | |
| NS1 | 904 | 0.22 | 5 | 3 | 0 | yes | SSFIIDGPNTP | 97.35 | SSFIIDGPSTP | 1.59 | FSFIIDGPNTP | 0.71 | | |
| NS1 | 905 | 0.16 | 4 | 2 | 0 | yes | SFIIDGPNTPE | 98.05 | SFIDGPSTPE | 1.59 | | | | |
| NS1 | 906 | 0.17 | 5 | 2 | 0 | yes | FIIDGPNTPEC | 97.88 | FIIDGPSTPEC | 1.59 | | | | |
| NS1 | 907 | 0.17 | 5 | 2 | 0 | yes | IIDGPNTPECP | 97.88 | IIDGPSTPECP | 1.59 | | | | |
| NS1 | 908 | 0.58 | 6 | 3 | 0 | yes | IDGPNTPECPS | 89.73 | IDGPNTPECPN | 8.14 | IDGPSTPECPS | 1.59 | | |
| NS1 | 909 | 0.86 | 9 | 5 | 0 | yes | DGPNTPECPSA | 86.55 | DGPNTPECPNA | 6.19 | DGPNTPECPSY | 2.83 | DGPNTPECPNT | 1.95 | DGPSTPECPSA | 1.59 |
| NS1 | 917 | 0.78 | 9 | 5 | 0 | yes | PSASRAWNVWE | 87.79 | PNASRAWNVWE | 6.19 | PSVSRAWNVWE | 2.83 | PNTSRAWNVWE | 1.95 | PSA

FIG. 13-33

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 924 | 0.02 | 2 | 1 | 0 | yes | NWEVEDYGFG | 99.82 | | | | | | |
| NS1 | 925 | 0.02 | 2 | 1 | 0 | yes | WEVEDYGFGV | 99.82 | | | | | | |
| NS1 | 926 | 0.02 | 2 | 1 | 0 | yes | WEVEDYGFGVF | 99.82 | | | | | | |
| NS1 | 927 | 0.07 | 3 | 1 | 0 | yes | EVEDYGFGVFT | 99.29 | | | | | | |
| NS1 | 928 | 0.07 | 3 | 1 | 0 | yes | VEDYGFGVFTT | 99.29 | | | | | | |
| NS1 | 929 | 0.07 | 3 | 1 | 0 | yes | EDYGFGVFTTN | 99.29 | | | | | | |
| NS1 | 930 | 0.07 | 3 | 1 | 0 | yes | DYGFGVFTTNI | 99.29 | | | | | | |
| NS1 | 931 | 0.05 | 2 | 1 | 0 | yes | YGFGVFTTNIW | 99.47 | | | | | | |
| NS1 | 932 | 0.05 | 2 | 1 | 0 | yes | GFGVFTTNIWL | 99.47 | | | | | | |
| NS1 | 933 | 0.05 | 2 | 1 | 0 | yes | FGVFTTNIWLK | 99.47 | | | | | | |
| NS1 | 934 | 0.05 | 2 | 1 | 0 | yes | GVFTTNIWLKL | 99.47 | | | | | | |
| NS1 | 935 | 0.05 | 2 | 1 | 0 | yes | VFTTNIWLKLK | 99.47 | | | | | | |
| NS1 | 936 | 0.08 | 3 | 1 | 0 | yes | FTTNIWLKLRE | 99.12 | | | | | | |
| NS1 | 937 | 0.68 | 8 | 4 | 0 | yes | TTNIWLKLREV | 86.9 | TTNIWLKLREM | 11.33 | STNIWLKLREV | 0.53 | | |
| NS1 | 938 | 0.7 | 8 | 4 | 0 | yes | TNIWLKLREVY | 86.55 | TNIWLKLREMY | 11.33 | TNIWLKLREVH | 0.88 | TNIWLKLRDV | 0.35 |
| NS1 | 939 | 0.73 | 9 | 5 | 0 | yes | NIWLKLREVYT | 86.55 | NIWLKLREMYT | 10.8 | NIWLKLREVHT | 0.88 | NIWLKLREMYS | 0.53 | NIWLKLREAYT | 0.35 |
| NS1 | 940 | 0.73 | 9 | 5 | 0 | yes | IWLKLREVYTQ | 86.55 | IWLKLREMYTQ | 10.8 | IWLKLREVHTQ | 0.88 | IWLKLREMYSQ | 0.53 | IWLKLREAYTQ | 0.35 |
| NS1 | 949 | 1.03 | 6 | 4 | 0 | yes | TQLCDHRLMSA | 72.74 | TQSCDHRLMSA | 24.25 | TQTCDHRLMSA | 1.77 | SQLCDHRLMSA | 0.53 | | |
| NS1 | 950 | 0.99 | 5 | 3 | 0 | yes | QLCDHRLMSAA | 73.27 | QSCDHRLMSAA | 24.25 | QTCDHRLMSAA | 1.77 | | | |
| NS1 | 951 | 1.03 | 6 | 4 | 0 | yes | LCDHRLMSAAV | 72.74 | SCDHRLMSAAI | 24.25 | TCDHRLMSAAI | 1.77 | LCDHRLMSAAI | 0.53 | | |
| NS1 | 952 | 0.83 | 2 | 2 | 0 | yes | CDHRLMSAAVK | 73.45 | CDHRLMSAAIK | 26.55 | | | | | |
| NS1 | 953 | 0.83 | 2 | 2 | 0 | yes | DHRLMSAAVKD | 73.45 | DHRLMSAAIKD | 26.55 | | | | | |
| NS1 | 954 | 0.83 | 2 | 2 | 0 | yes | HRLMSAAVKDE | 73.45 | HRLMSAAIKDE | 26.55 | | | | | |
| NS1 | 955 | 0.85 | 3 | 2 | 0 | yes | RLMSAAVKDER | 73.45 | RLMSAAIKDER | 26.37 | | | | | |
| NS1 | 956 | 0.85 | 3 | 2 | 0 | yes | LMSAAVKDERA | 73.45 | LMSAAIKDERA | 26.37 | | | | | |
| NS1 | 957 | 0.87 | 4 | 2 | 0 | yes | MSAAVKDERAV | 73.27 | MSAAIKDERAV | 26.37 | | | | | |

FIG. 13-34

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency |
|---|---|---|---|---|---|---|---|---|---|---|
| NS1 | 958 | 0.87 | 4 | 2 | 0 | yes | SAAVKDERAVH | 73.27 | SAAIKDERAVH | 26.37 |
| NS1 | 959 | 0.87 | 4 | 2 | 0 | yes | AAVKDERAVHA | 73.27 | AAIKDERAVHA | 26.37 |
| NS1 | 960 | 0.87 | 4 | 2 | 0 | yes | AVKDERAVHAD | 73.27 | AIKDERAVHAD | 26.37 |
| NS1 | 961 | 0.87 | 4 | 2 | 0 | yes | VKDERAVHADM | 73.27 | IKDERAVHADM | 26.37 |
| NS1 | 962 | 0.04 | 3 | 1 | 0 | yes | KDERAVHADMG | 99.65 | | |
| NS1 | 963 | 0.04 | 3 | 1 | 0 | yes | DERAVHADMGY | 99.65 | | |
| NS1 | 964 | 0.04 | 3 | 1 | 0 | yes | ERAVHADMGYW | 99.65 | | |
| NS1 | 965 | 0.06 | 4 | 1 | 0 | yes | RAVHADMGYWI | 99.47 | | |
| NS1 | 966 | 0.04 | 3 | 1 | 0 | yes | AVHADMGYWIE | 99.65 | | |
| NS1 | 967 | 0.04 | 3 | 1 | 0 | yes | VHADMGYWIES | 99.65 | | |
| NS1 | 968 | 0.02 | 2 | 1 | 0 | yes | HADMGYWIESQ | 99.82 | | |
| NS1 | 969 | 0.02 | 2 | 1 | 0 | yes | ADMGYWIESQK | 99.82 | | |
| NS1 | 970 | 0.04 | 3 | 1 | 0 | yes | DMGYWIESQKN | 99.65 | | |
| NS1 | 971 | 0.04 | 3 | 1 | 0 | yes | MGYWIESQKNG | 99.65 | | |
| NS1 | 972 | 0.04 | 3 | 1 | 0 | yes | GYWIESQKNGS | 99.65 | | |
| NS1 | 973 | 0.04 | 3 | 1 | 0 | yes | YWIESQKNGSW | 99.65 | | |
| NS1 | 974 | 0.04 | 3 | 1 | 0 | yes | WIESQKNGSWK | 99.65 | | |
| NS1 | 975 | 0.02 | 2 | 1 | 0 | yes | IESQKNGSWKL | 99.82 | | |
| NS1 | 976 | 0.02 | 2 | 1 | 0 | yes | ESQKNGSWKLE | 99.82 | | |
| NS1 | 977 | 0.02 | 2 | 1 | 0 | yes | SQKNGSWKLEK | 99.82 | | |
| NS1 | 978 | 0.02 | 2 | 1 | 0 | yes | QKNGSWKLEKA | 99.82 | | |
| NS1 | 979 | 0.02 | 3 | 1 | 0 | yes | KNGSWKLEKAS | 99.82 | | |
| NS1 | 980 | 0.87 | 3 | 2 | 0 | yes | NGSWKLEKASL | 72.39 | NGSWKLEKASF | 27.43 |
| NS1 | 981 | 0.85 | 2 | 2 | 0 | yes | GSWKLEKASLI | 72.57 | GSWKLEKASFI | 27.43 |
| NS1 | 982 | 0.85 | 2 | 2 | 0 | yes | SWKLEKASLIE | 72.57 | SWKLEKASFIE | 27.43 |
| NS1 | 983 | 0.85 | 2 | 2 | 0 | yes | WKLEKASLIEV | 72.57 | WKLEKASFIEV | 27.43 |

FIG. 13-35

Species: DENV3 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS1 | 984 | 0.85 | 2 | 2 | 0 | yes | KLEKASLIEVK | 72.57 | KLEKASFIEVK | 27.43

FIG. 13-36

| protein | block starting position | block entropy | total peptides in block (11-mers) | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 1010 | 0.09 | 6 | 1 | 0 | yes | LESDMII

FIG. 13-37

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1036 | 0.04 | 3 | 1 | 0 | yes | QTAGPWHLGKL | 99.65 | | | | | | |
| NS1 | 1037 | 0.1 | 4 | 2 | 0 | yes | TAGPWHLGKLE | 98.94 | TAGPWHLGKLD | 0.71 | | | | |
| NS1 | 1038 | 0.1 | 4 | 2 | 0 | yes | AGPWHLGKLEL | 98.94 | AGPWHLGKLDL | 0.71 | | | | |
| NS1 | 1039 | 0.08 | 3 | 1 | 0 | yes | GPWHLGKLELD | 99.12 | | | | | | |
| NS1 | 1040 | 0.08 | 3 | 1 | 0 | yes | PWHLGKLELDF | 99.12 | | | | | | |
| NS1 | 1041 | 0.08 | 3 | 1 | 0 | yes | WHLGKLELDFN | 99.12 | | | | | | |
| NS1 | 1042 | 0.08 | 3 | 1 | 0 | yes | HLGKLELDFNY | 99.12 | | | | | | |
| NS1 | 1043 | 0.08 | 3 | 1 | 0 | yes | LGKLELDFNYC | 99.12 | | | | | | |
| NS1 | 1044 | 0.08 | 3 | 1 | 0 | yes | GKLELDFNYCE | 99.12 | | | | | | |
| NS1 | 1045 | 0.08 | 3 | 1 | 0 | yes | KLELDFNYCEG | 99.12 | | | | | | |
| NS1 | 1046 | 0.08 | 3 | 1 | 0 | yes | LELDFNYCEGT | 99.12 | | | | | |

FIG. 13-38

Species: DENV3 (11-mers)

| protein | block starting position | block entropy | total peptides in block | peptides required to cover 99% of block | gap/X fraction | 99% of block covered w/ <= 5 peptides? | pe

FIG. 13-39

Species: DENV3 (11-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| NS1 | 1095 | 0.05 | 3 | 1 | 0 | yes | RYMGEDGCWYG | 99.47 | | | | | | |
| NS1 | 1096 | 0.05 | 3 | 1 | 0 | yes | YMGEDGCWYGM | 99.47 | | | | | | |
| NS1 | 1097 | 0.05 | 3 | 1 | 0 | yes | MGEDGCWYGME | 99.47 | | | | | | |
| NS1 | 1098 | 0.02 | 2 | 1 | 0 | yes | GEDGCWYGMEI | 99.82 | | | | | | |
| NS1 | 1099 | 0.02 | 2 | 1 | 0 | yes | EDGCWYGMEIR | 99.82 | | | | | | |
| NS1 | 1100 | 0 | 1 | 1 | 0 | yes | DGCWYGMEIRP | 100 | | | | | | |
| NS1 | 1101 | 0.2 | 3 | 2 | 0 | yes | GCWYGMEIRPI | 97.35 | GCWYGMEIRPV | 1.95 | | | | |
| NS1 | 1102 | 1.15 | 6 | 4 | 0 | yes | CWYGMEIRPIS | 61.42 | CWYGMEIRPIN | 35.93 | CWYGMEIRPVN | 1.24 | CWYGMEIRPYS | 0.71 |
| NS1 | 1103 | 1.15 | 6 | 4 | 0 | yes | WYGMEIRPISE | 61.42 | WYGMEIRPINE | 35.93 | WYGMEIRPVNE | 1.24 | WYGMEIRPVSE | 0.71 |
| NS1 | 1104 | 1.17 | 7 | 4 | 0 | yes | YGMEIRPISEK | 61.24 | YGMEIRPINEK | 35.93 | YGMEIRPVNEK | 1.24 | YGMEIRPVSEK | 0.71 |
| NS1 | 1105 | 1.17 | 7 | 4 | 0 | yes | GMEIRPISEKE | 61.24 | GMEIRPINEKE | 35.93 | GMEIRPVNEKE | 1.24 | GMEIRPVSEKE | 0.71 |
| NS1 | 1106 | 1.17 | 7 | 4 | 0 | yes | MEIRPISEKEE | 61.24 | MEIRPINEKEE | 35.93 | MEIRPVNEKEE | 1.24 | MEIRPVSEKEE | 0.71 |
| NS1 | 1107 | 1.17 | 7 | 4 | 0 | yes | EIRPISEKEEN | 61.24 | EIRPINEKEEN | 35.93 | EIRPVNEKEEN | 1.24 | EIRPVSEKEEN | 0.71 |
| NS1 | 1108 | 1.17 | 7 | 4 | 0 | yes | IRPISEKEENM | 61.24 | IRPINEKEENM | 35.93 | IRPVNEKEENM | 1.24 | IRPVSEKEENM | 0.71 |
| NS1 | 1109 | 1.18 | 8 | 5 | 0 | yes | RPISEKEENMV | 61.24 | RPINEKEENMV | 35.75 | RPVNEKEENMV | 1.24 | RPVSEKEENMV | 0.71 | RPTSEKEENMV | 0.35 |
| NS1 | 1110 | 1.18 | 8 | 5 | 0 | yes | PISEKEENMVK | 61.24 | PINEKEENMVK | 35.75 | PVNEKEENMVK | 1.24 | PVSEKEENMVK | 0.71 | PTSEKEENMVK | 0.35 |
| NS1 | 1111 | 1.18 | 8 | 5 | 0 | yes | ISEKEENMVKS | 61.24 | INEKEENMVKS | 35.75 | VNEKEENMVKS | 1.24 | VSEKEENMVKS | 0.71 | TSEKEENMVKS | 0.35 |
| NS1 | 1112 | 0.99 | 4 | 2 | 0 | yes | SEKEENMVKSL | 62.3 | NEKEENMVKSL | 37.35 | | | | |
| NS1 | 1113 | 0.2 | 4 | 2 | 0 | yes | EKEENMVKSLV | 97.17 | EKEENMVKSLA | 2.48 | | | | |
| NS1 | 1114 | 0.2 | 4 | 2 | 0 | yes | KEENMVKSLYS | 97.17 | KEENMVKSLAS | 2.48 | | | | |
| NS1 | 1115 | 0.19 | 3 | 2 | 0 | yes | EENMVKSLYSA | 97.35 | EENMVKSLASA | 2.48 | | | | |
| NS1 | 1116 | 0.19 | 3 | 2 | 0 | yes | ENMVKSLYSAG | 97.35 | ENMVKSLASAG | 2.48 | | | | |
| NS1 | 1117 | 0.2 | 4 | 2 | 0 | yes | NMVKSLYSAGS | 97.17 | NMVKSLASAGS | 2.48 | | | | |
| NS1 | 1118 | 0.2 | 4 | 2 | 0 | yes | MVKSLYSAGSG | 97.17 | MVKSLASAGSG | 2.48 | | | | |
| NS1 | 1119 | 0.93 | 5 | 3 | 0 | yes | VKSLYSAGSGK | 76.64 | VKSLYSAGSGE | 20.53 | VKSLASAGSGK | 2.48 | | |
| NS1 | 1120 | 1.25 | 7 | 5 | 0 | yes | KSLYSAGSGKV | 71.33 | KSLYSAGSGEV | 20.53 | KSLVSAGSGKM | 3.54 | KSLASAGSGKV | 2.48 | KSLVSAGSGKA | 1.77 |

FIG. 13-40

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|

FIG. 13-41

Species: DENV3 (11-mers)

| protein | block starting position | block entropy | total peptides in block | peptides required to cover 99% of block | gap/X fraction | 99% of block covered w/ <= 5 peptides? | peptides required to cover 99

FIG. 13-42

Species: DENV3 (11-mers)

| protein | block starting position | block entropy | total peptides in block (11-mers) | peptides required to cover 99% of block | gap/X fraction | 99% of block covered w/ <= 5 peptides? | peptides required to cover 99% of block | frequency | peptides required to cover 99% of block | frequency | peptides

FIG. 13-43

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1282 | 0.64 | 5 | 2 | 0 | yes | TIFTLTVAWRT | 85.84 | TMFTLTVAWRT | 13.45 | | | | |
| NS2A | 1283 | 0.64 | 5 | 2 | 0 | yes | IFTLTVAWRTA | 85.84 | MFTLTVAWRTA | 13.45 | | | | |
| NS2A | 1284 | 0.05 | 3 | 1 | 0 | yes | FLTVAWRTAT | 99.47 | | | | | | |
| NS2A | 1285 | 0 | 1 | 1 | 0 | yes

FIG. 13-46

Species: DENV3 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS2A | 1313 | 1.13 | 6 | 4 | 0 | yes | KTDWLPMTVAA | 74.34 | KTDWLPMAVAA | 18.41 | KSDWLPMTVAA | 4.78 | KTDWLPVAVAA | 1.95 | | |
| NS2A | 1314 | 1.13 | 6 | 4 | 0 | yes | TDWLPMTVAAM | 74.34 | TDWLPMAVAAM | 18.41 | SDWLPMTVAAM | 4.78 | TDWLPVAVAAM | 1.95 | | |
| NS2A | 1315 | 0.87 |

FIG. 13-47

Species: DENV3 (11-mers)

| protein | block starting position | block entropy | total peptides in block | peptides required to cover 99% of block | gap/X fraction | 99% of block covered w/ <= 5 peptides?

FIG. 13-48

Species: DENV3 (11-mers)

| protein | block starting position | block entropy | total peptides in block | peptides required to cover 99% of block | gap/X fraction | 99% of block covered w/ <= 5 peptides? | block to cover 99% of | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1378 | 0.05 | 3 | 1 | 0 | yes | GGLLIACYVIT | 99.47 | | | | | | |
| NS2B | 1379 | 0.05 | 3 | 1 | 0 | yes | GLLIACYVITG | 99.47 | | | | | | |
| NS2B | 1380 | 0.05 | 3 | 1 | 0 | yes | LLIACYVITGT | 99.47 | | | | | | |
| NS2B | 1381 | 0.02 | 2 | 1 | 0 | yes | LIACYVITGTS | 99.82 | | | | | | |
| NS2B | 1382 | 0.02 | 2 | 1 | 0 | yes | IACYVITGTSA | 99.82 | | | | | | |
| NS2B | 1383 | 0.02 | 2 | 1 | 0 | yes | ACYVITGTSAD | 99.82 | | | | | | |
| NS2B | 1384 | 0.02 | 2 | 1 | 0 | yes | CYVITGTSADL | 99.82 | | | | | | |
| NS2B | 1385 | 0.11 | 4 | 2 | 0 | yes | YVITGTSADLI | 98.76 | YVITGTSADLI | 0.88 | | | | |
| NS2B | 1386 | 0.11 | 4 | 2 | 0 | yes | VITGTSADLIV | 98.76 | VITGTSADLIV | 0.88 | | | | |
| NS2B | 1387 | 0.11 | 4 | 2 | 0 | yes | ITGTSADLIVE | 98.76 | ITGTSADLIVE | 0.88 | | | | |
| NS2B | 1388 | 0.13 | 5 | 2 | 0 | yes | TGTSADLIVEK | 98.58 | TGTSADLIVEK | 0.88 | | | | |
| NS2B | 1389 | 0.19 | 6 | 3 | 0 | yes | GTSADLIVEKA | 97.88 | GTSADLIVEKA | 0.88 | GTSADLIVEKV | 0.71 | | |
| NS2B | 1390 | 0.22 | 7 | 3 | 0 | yes | TSADLIVEKAA | 97.52 | TSADLIVEKAA | 0.88 | TSADLIVEKVA | 0.71 | | |
| NS2B | 1391 | 0.32 | 9 | 5 | 0 | yes | SADLIVEKAAD | 96.46 | SADLIVEKAAD | 0.88 | SADLIVEKVAD | 0.71 | SADLIVEKAAN | 0.53 | SADLIVEKAAE | 0.53 |
| NS2B | 1400 | 0.84 | 10 | 5 | 0 | yes | ADVTWEEEAEQ | 81.59 | ADITWEEEAEQ | 16.28 | AEVTWEEEAEQ | 0.53 | ANVTWEEEAEQ | 0.35 | PDVTWEEEAEQ | 0.35 |
| NS2B | 1401 | 0.81 | 9 | 4 | 0 | yes | DVTWEEEAEQT | 81.95 | DITWEEEAEQT | 16.28 | EVTWEEEAEQT | 0.53 | NVTWEEEAEQT | 0.35 | |
| NS2B | 1402 | 0.72 | 6 | 2 | 0 | yes | VTWEEEAEQTG | 82.83 | ITWEEEAEQTG | 16.46 | | | | |
| NS2B | 1403 | 0.07 | 5 | 1 | 0 | yes | TWEEEAEQTGV | 99.29 | | | | | | |
| NS2B | 1404 | 0.06 | 4 | 1 | 0 | yes | WEEEAEQTGVS | 99.47 | | | | | | |
| NS2B | 1405 | 0.04 | 3 | 1 | 0 | yes | EEEAEQTGVSH | 99.65 | | | | | | |
| NS2B | 1406 | 0.02 | 2 | 1 | 0 | yes | EEAEQTGVSHN | 99.82 | | | | | | |
| NS2B | 1407 | 0.02 | 2 | 1 | 0 | yes | EAEQTGVSHNL | 99.82 | | | | | | |
| NS2B | 1408 | 0.02 | 2 | 1 | 0 | yes | AEQTGVSHNLM | 99.82 | | | | | | |
| NS2B | 1409 | 0.11 | 4 | 2 | 0 | yes | EQTGVSHNLMI | 98.76 | EQTGVSHNLMV | 0.88 | | | | |
| NS2B | 1410 | 0.11 | 4 | 2 | 0 | yes | QTGVSHNLMIT | 98.76 | QTGVSHNLMVT | 0.88 | | | | |
|

FIG. 13-49

Species: DENV3 (11-mers)

| protein | block starting position | block entropy | total peptides in block | peptides required to cover 99% of block | gap/X fraction | 99% of block covered w/ => 5 peptides? | block (to cover 99% of block) | frequency | block

FIG. 13-50

Species: DENV3 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS2B | 1438 | 0.02 | 2 | 1 | 0 | yes | LTVLLKTALLI | 99.82 | | | | | | |
|

FIG. 13-51

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1464 | 0.35 | 5 | 3 | 0 | yes | WHTWQKQTQRS | 94.69 | WHTWQKQTRRS | 4.25 | WHTWQKRTQRS | 0.53 | | |
| NS2B | 1465 | 0.35 | 5 | 3 | 0 | yes | HTWQKQTQRSG | 94.69 | HTWQKQTRRSG | 4.25 | HTWQKRTQRSG | 0.53 | | |
| NS2B | 1466 | 0.35 | 5 | 3 | 0 | yes | TWQKQTQRSG

FIG. 13-52

Species: DENY3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1490 | 0.09 | 4 | 1 | 0 | yes | ELEEGYRIKQ | 99.12 | | | | | | | | |
| NS3 | 1491 | 0.1 | 5 | 2 | 0 | yes | LEEGYRIKQQ | 98.94 | LEEGYRINQQ | 0.53 | | | | | | |
| NS3 | 1492 | 0.1 | 5 | 2 | 0 | yes | EEGYRIKQQG | 98.94 | EEGYRINQQG | 0.53 | | | | | | |
| NS3 | 1493 | 0.1 | 5 | 2 | 0 | yes | EGYRIKQQGI | 98.94 | EGYRINQQGI | 0.53 | | | | | | |
| NS3 | 1494 | 0.26 | 5 | 2 | 0 | yes | GYRIKQQGIF | 96.46 | GYRIKQQGIL | 2.65 | | | | | | |
| NS3 | 1495 | 0.26 | 5 | 2 | 0 | yes | VYRIKQQGIFG | 96.46 | VYRIKQQGILG | 2.65 | | | | | | |
| NS3 | 1496 | 0.26 | 5 | 2 | 0 | yes | YRIKQQGIFGK | 96.46 | YRIKQQGILGK | 2.65 | | | | | | |
| NS3 | 1497 | 0.28 | 6 | 3 | 0 | yes | RIKQQGIFGKT | 96.28 | RIKQQGILGKT | 2.65 | RINQQGIFGKT | 0.53 | | | | |
| NS3 | 1498 | 0.26 | 5 | 2 | 0 | yes | IKQQGIFGKTQ | 96.46 | IKQQGILGKTQ | 2.65 | | | | | | |
| NS3 | 1499 | 0.26 | 5 | 2 | 0 | yes | KQQGIFGKTQV | 96.46 | KQQGILGKTQV | 2.65 | | | | | | |
| NS3 | 1500 | 0.21 | 4 | 2 | 0 | yes | QQGIFGKTQVG | 96.99 | QQGILGKTQVG | 2.65 | | | | | | |
| NS3 | 1501 | 0.21 | 4 | 2 | 0 | yes | QGIFGKTQVGV | 96.99 | QGILGKTQVGV | 2.65 | | | | | | |
| NS3 | 1502 | 0.2 | 3 | 2 | 0 | yes | GIFGKTQVGVG | 97.17 | GILGKTQVGVG | 2.65 | | | | | | |
| NS3 | 1503 | 0.26 | 4 | 2 | 0 | yes | IFGKTQVGVGV | 96.46 | ILGKTQVGVGV | 2.65 | | | | | | |
| NS3 | 1504 | 0.29 | 5 | 3 | 0 | yes | FGKTQVGVGVQ | 96.11 | LGKTQVGVGVQ | 2.65 | FGKTQVGVGIQ | 0.71 | | | | |
| NS3 | 1505 | 0.13 | 5 | 2 | 0 | yes | GKTQVGVGVQK | 98.58 | GKTQVGVGIQK | 0.71 | | | | | | |
| NS3 | 1506 | 0.13 | 5 | 2 | 0 | yes | KTQVGVGVQKE | 98.58 | KTQVGVGIQKE | 0.71 | | | | | | |
| NS3 | 1507 | 0.13 | 5 | 2 | 0 | yes | TQVGVGVQKEG | 98.58 | TQVGVGIQKEG | 0.71 | | | | | | |
| NS3 | 1508 | 0.11 | 4 | 2 | 0 | yes | QVGVGVQKEGV | 98.76 | QVGVGIQKEGV | 0.71 | | | | | | |
| NS3 | 1509 | 0.11 | 4 | 2 | 0 | yes | VGVGVQKEGVF | 98.76 | VGVGIQKEGVF | 0.71 | | | | | | |
| NS3 | 1510 | 0.11 | 4 | 2 | 0 | yes | GVGVQKEGVFH | 98.76 | GVGIQKEGVFH | 0.71 | | | | | | |
| NS3 | 1511 | 0.13 | 5 | 2 | 0 | yes | VGVQKEGVFHT | 98.58 | VGIQKEGVFHT | 0.71 | | | | | | |
| NS3 | 1512 | 0.13 | 5 | 2 | 0 | yes | GVQKEGVFHTM | 98.58 | GIQKEGVFHTM | 0.71 | | | | | | |
| NS3 | 1513 | 0.13 | 5 | 2 | 0 | yes | VQKEGVFHTMW | 98.58 | IQKEGVFHTMW | 0.71 | | | | | | |
| NS3 | 1514 | 0.07 | 4 | 1 | 0 | yes | QKEGVFHTMWH | 99.29 | | | | | | | | |
| NS3 | 1515 | 0.04 | 3 | 1 | 0 | yes | KEGVFHTMWHV | 99.65 | | | | | | | | |

FIG. 13-53

Species: DENV3 (11-mers)

| protein | block starting position | block entropy | total peptides in block | peptides required to cover 99% of block | gap/X fraction | covered w/ <= 5 peptides? | pe

FIG. 13-54

Species: DENV3 (11-mers)

| protein | block starting position | block entropy | total peptides in block | peptides required to cover 99% of block | gap/X fraction | covered w/ <= 5 peptides? | block | frequency | peptides required to cover 99% of block | block | frequency | peptides

FIG. 13-55

Species: DENV3 (11-mers)

| protein | block starting position | block entropy | total peptides in block | peptides required to cover 99% of block | gap/X fraction | 99%

FIG. 13-56

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency

FIG. 13-57

Species: DENV3 (11-mers)

| protein | block starting position | block entropy | total peptides in block | peptides required to cover 99% of block | 99% of block covered w/ <= 5 peptides? | block | frequency | peptides required to cover 99% of block | block | frequency |
|---|---|---|---|---|---|---|---|---

FIG. 13-58

Species: DENV3 (11-mers)

| protein | block starting position | block entropy | total peptides in block | peptides required to cover 99% of block | gap/X fraction | covered w/ <= 5 peptides? | block | frequency | block | frequency | block | frequency | block | frequency |
|---|---|---|---|---|---|---|---|---|---|---|---|---|---|---|
| NS3 | 1649 | 0.14 | 4 | 2 | 0 | yes | TPELEEEMFKK | 98.41 | TPELEEEMFRK | 0.88 | | | | |
| NS3 | 1650 | 0.09 | 3 | 2 | 0 | yes | PELEEEMFKKR | 98.94 | PELEEEMFRKR | 0.88 | | | | |
| NS3 | 1651 | 0.11 | 4 | 2 | 0 | yes | ELEEEMFKKRN | 98.76 | ELEEEMFRKRN | 0.88 | | | | |
| NS3 | 1652 | 0.11 | 4 | 2 | 0 | yes | LEEEMFKKRNL | 98.76 | LEEEMFRKRNL | 0.88 | | | | |
| NS3 | 1653 | 0.11 | 4 | 2 | 0 | yes | EEEMFKKRNLT | 98.76 | EEEMFRKRNLT | 0.88 | | | | |
| NS3 | 1654 | 0.11 | 4 | 2 | 0 | yes | EEMFKKRNLTI | 98.76 | EEMFRKRNLTI | 0.88 | | | | |
| NS3 | 1655 | 0.11 | 4 | 2 | 0 | yes | EMFKKRNLTIM | 98.76 | EMFRKRNLTIM | 0.88 | | | | |
| NS3 | 1656 | 0.11 | 4 | 2 | 0 | yes | MFKKRNLTIMD | 98.76 | MFRKRNLTIMD | 0.88 | | | | |
| NS3 | 1657 | 0.09 | 3 | 2 | 0 | yes | FKKRNLTIMDL | 98.94 | FRKRNLTIMDL | 0.88 | | | | |
| NS3 | 1658 | 0.09 | 3 | 2 | 0 | yes | KKRNLTIMDLH | 98.94 | RKRNLTIMDLH | 0.88 | | | | |
| NS3 | 1659 | 0.02 | 2 | 1 | 0 | yes | KRNLTIMDLHP | 99.82 | | | | | | |
| NS3 | 1660 | 0.02 | 2 | 1 | 0 | yes | RNLTIMDLHPG | 99.82 | | | | | | |
| NS3 | 1661 | 0.02 | 2 | 1 | 0 | yes | NLTIMDLHPGS | 99.82 | | | | | | |
| NS3 | 1662 | 0 | 1 | 1 | 0 | yes | LTIMDLHPGSG | 100 | | | | | | |
| NS3 | 1663 | 0 | 1 | 1 | 0 | yes | TIMDLHPGSGK | 100 | | | | | | |
| NS3 | 1664 | 0 | 1 | 1 | 0 | yes | IMDLHPGSGKT | 100 | | | | | | |
| NS3 | 1665 | 0 | 1 | 1 | 0 | yes | MDLHPGSGKTR | 100 | | | | | | |
| NS3 | 1666 | 0 | 1 | 1 | 0 | yes | DLHPGSGKTRK | 100 | | | | | | |
| NS3 | 1667 | 0 | 1 | 1 | 0 | yes | LHPGSGKTRKY | 100 | | | | | | |
| NS3 | 1668 | 0 | 1 | 1 | 0 | yes | HPGSGKTRKYL | 100 | | | | | | |
| NS3 | 1669 | 0.03 | 2 | 1 | 0 | yes | PGSGKTRKYLP | 99.65 | | | | | | |
| NS3 | 1670 | 0.08 | 3 | 1 | 0 | yes | GSGKTRKYLPA | 99.12 | | | | | | |
| NS3 | 1671 | 0.4 | 4 | 2 | 0 | yes | SGKTRKYLPAI | 93.27 | GKTRKYLPAII | 5.84 | | | | |
| NS3 | 1672 | 0.4 | 4 | 2 | 0 | yes | GKTRKYLPAIV | 93.27 | KTRKYLPAIIR | 5.84 | | | | |
| NS3 | 1673 | 0.4 | 4 | 2 | 0 | yes | KTRKYLPAIVR | 93.27 | TRKYLPAIIRE | 5.84 | | | | |
| NS3 | 1674 | 0.4 | 4 | 2 | 0 | yes | TRKYLPAIVRE | 93.27 | | | | | | |

FIG. 13-59

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1675 | 0.4 | 4 | 2 | 0 | yes | RKYLPAIVREA | 93.27 | RKYLPAIIREA | 5.84 |
| NS3 | 1676 | 0.4 | 4 | 2 | 0 | yes | KYLPAIVREAI | 93.27 | KYLPAIIREAI | 5.84 |
| NS3 | 1677 | 0.4 | 4 | 2 | 0 | yes | YLPAIVREAIK | 93.27 | YLPAIIREAIK | 5.84 |
| NS3 | 1678 | 0.4 | 4 | 2 | 0 | yes | LPAIVREAIKR | 93.27 | LPAIIREAIKR | 5.84 |
| NS3 | 1679 | 0.4 | 4 | 2 | 0 | yes | PAIVREAIKRR | 93.27 | PAIIREAIKRR | 5.84 |
| NS3 | 1680 | 0.4 | 4 | 2 | 0 | yes | AIVREAIKRRL | 93.27 | AIIREAIKRRL | 5.84 |
| NS3 | 1681 | 0.37 | 3 | 2 | 0 | yes | IVREAIKRRLR | 93.63 | IREAIKRRLRT | 5.84 |
| NS3 | 1682 | 0.32 | 2 | 2 | 0 | yes | VREAIKRRLRT | 94.16 | | |
| NS3 | 1683 | 0 | 1 | 1 | 0 | yes | REAIKRRLRTL | 100 | | |
| NS3 | 1684 | 0 | 1 | 1 | 0 | yes | EAIKRRLRTLI | 100 | | |
| NS3 | 1685 | 0 | 1 | 1 | 0 | yes | AIKRRLRTLIL | 100 | | |
| NS3 | 1686 | 0 | 1 | 1 | 0 | yes | IKRRLRTLILA | 100 | | |
| NS3 | 1687 | 0 | 1 | 1 | 0 | yes | KRRLRTLILAP | 100 | | |
| NS3 | 1688 | 0 | 1 | 1 | 0 | yes | RRLRTLILAPT | 100 | | |
| NS3 | 1689 | 0 | 1 | 1 | 0 | yes | RLRTLILAPTR | 100 | | |
| NS3 | 1690 | 0 | 1 | 1 | 0 | yes | LRTLILAPTRV | 100 | | |
| NS3 | 1691 | 0 | 1 | 1 | 0 | yes | RTLILAPTRVV | 100 | | |
| NS3 | 1692 | 0 | 1 | 1 | 0 | yes | TLILAPTRVVA | 100 | | |
| NS3 | 1693 | 0 | 1 | 1 | 0 | yes | LILAPTRVVAA | 100 | | |
| NS3 | 1694 | 0 | 1 | 1 | 0 | yes | ILAPTRVVAAE | 100 | | |
| NS3 | 1695 | 0 | 1 | 1 | 0 | yes | LAPTRVVAAEM | 100 | | |
| NS3 | 1696 | 0 | 1 | 1 | 0 | yes | APTRVVAAEME | 100 | | |
| NS3 | 1697 | 0 | 1 | 1 | 0 | yes | PTRVVAAEMEE | 100 | | |
| NS3 | 1698 | 0 | 1 | 1 | 0 | yes | TRVVAAEMEEA | 100 | | |
| NS3 | 1699 | 0.02 | 2 | 1 | 0 | yes | RVVAAEMEEAL | 99.82 | | |
| NS3 | 1700 | 0.06 | 4 | 1 | 0 | yes | VVAAEMEEALK | 99.47 | | |

FIG. 13-60

Species: DENV3 (11-mers)

| protein | block starting position | block entropy | total peptides in block (11-mers) | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1701 | 0.06 | 4 | 1 | 0 | yes | VAAEMEEALKG | 99.47 | | | | | | |
| NS3 | 1702 | 0.06 | 4 | 1 | 0 | yes | AAEMEEALKGL | 99.47 | | | | | | |
| NS3 | 1703 | 0.06 | 4 | 1 | 0 | yes | AEMEEALKGLP | 99.47 | | | | | | |
| NS3 | 1704 | 0.07 | 5 | 1 | 0 | yes | EMEEALKGLPI | 99.29 | | | | | | |
| NS3 | 1705 | 0.07 | 5 | 1 | 0 | yes | MEEALKGLPIR | 99.29 | | | | | | |
| NS3 | 1706 | 0.07 | 5 | 1 | 0 | yes | EEALKGLPIRY | 99.29 | | | | | | |
| NS3 | 1707 | 0.07 | 5 | 1 | 0 | yes | EALKGLPIRYQ | 99.29 | | | | | | |
| NS3 | 1708 | 0.07 | 5 | 1 | 0 | yes | ALKGLPIRYQT | 99.29 | | | | | | |
| NS3 | 1709 | 0.11 | 6 | 2 | 0 | yes | LKGLPIRYQTS | 98.94 | | | | | | |
| NS3 | 1710 | 0.12 | 6 | 2 | 0 | yes | KGLPIRYQTSA | 98.76 | | | | | | |
| NS3 | 1711 | 0.32 | 6 | 3 | 0 | yes | GLPIRYQTTAT | 95.58 | GLPIRYQTTAI | 3.36 | GLPIRYQTSAT | 0.35 | | |
| NS3 | 1712 | 0.35 | 7 | 4 | 0 | yes | LPIRYQTTATK | 95.22 | LPIRYQTTAIK | 3.36 | LPIRYQTTVTK | 0.35 | LPIRYQTATR | 0.35 |
| NS3 | 1713 | 0.35 | 7 | 4 | 0 | yes | PIRYQTTATKS | 95.22 | PIRYQTTAIKS | 3.36 | PIRYQTTATRS | 0.35 | PIRYQTTVTKS | 0.35 |
| NS3 | 1714 | 0.37 | 8 | 4 | 0 | yes | IRYQTTATKSE | 95.04 | IRYQTTAIKSE | 3.36 | IRYQTSATKSE | 0.35 | IRYQTTVTKSE | 0.35 |
| NS3 | 1715 | 0.35 | 7 | 4 | 0 | yes | RYQTTATKSEH | 95.22 | RYQTTAIKSEH | 3.36 | RYQTATRSEH | 0.35 | RYQTSATKSEH | 0.35 |
| NS3 | 1716 | 0.35 | 7 | 4 | 0 | yes | YQTTATKSEHT | 95.22 | YQTTAIKSEHT | 3.36 | YQTSATKSEHT | 0.35 | YQTTVTKSEHT | 0.35 |
| NS3 | 1717 | 0.35 | 7 | 4 | 0 | yes | QTTATKSEHTG | 95.22 | QTTAIKSEHTG | 3.36 | QTSATKSEHTG | 0.35 | QTTATRSEHTG | 0.35 |
| NS3 | 1718 | 0.7 | 8 | 5 | 0 | yes | TTATKSEHTGR | 88.5 | TTAIKSEHTGR | 6.73 | TSATKSEHTGR | 0.35 | TTVTKSEHTGR | 0.35 |
| NS3 | 1719 | 0.7 | 8 | 5 | 0 | yes | TATKSEHTGRE | 88.5 | TAIKSEHTGRE | 6.73 | TATRSEHTGRE | 0.35 | SATKSEHTGRE | 0.35 |
| NS3 | 1720 | 0.67 | 7 | 4 | 0 | yes | ATKSEHTGREI | 88.85 | AIKSEHTGREI | 6.73 | ATRSEHTGREI | 0.35 | | |
| NS3 | 1721 | 0.63 | 6 | 3 | 0 | yes | TKSEHTGREIV | 89.2 | IKSEHTGREIV | 6.73 | | | | |
| NS3 | 1722 | 0.41 | 4 | 2 | 0 | yes | KSEHTGREIVD | 92.74 | | | | | | |
| NS3 | 1723 | 0.37 | 3 | 2 | 0 | yes | SEHTGREIVDL | 93.1 | SEHTGKEIVDL | | | | | |
| NS3 | 1724 | 0.37 | 3 | 2 | 0 | yes | EHTGREIVDLM | 93.1 | EHTGKEIVDLM | | | | | |
| NS3 | 1725 | 0.38 | 3 | 2 | 0 | yes | HTGREIVDLMC | 92.92 | HTGKEIVDLMC | | | | | |
| NS3 | 1726 | 0.38 | 3 | 2 | 0 | yes | TGREIVDLMCH | 92.92 | TGKEIVDLMCH | | | | | |

FIG. 13-61

Species: DENV3 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1727 | 0.38 | 3 | 2 | 0 | yes | GREIVDLMCHA | 92.92 | GREIVDLMCHA | 6.9 | | | | |
| NS3 | 1728 | 0.4 | 4 | 2 | 0 | yes | REIVDLMCHAT | 92.74 | REIVDLMCHAT | 6.9 | | | | |
| NS3 | 1729 | 0.04 | 3 | 1 | 0 | yes | EIVDLMCHATF | 99.65 | | | | | | |
| NS3 | 1730 | 0.04 | 3 | 1 | 0 | yes | IVDLMCHATFT | 99.65 | | | | | | |
| NS3 | 1731 | 0.04 | 3 | 1 | 0 | yes | VDLMCHATFTM | 99.65 | | | | | | |
| NS3 | 1732 | 0.04 | 3 | 1 | 0 | yes | DLMCHATFTMR | 99.65 | | | | | | |
| NS3 | 1733 | 0.04 | 3 | 1 | 0 | yes | LMCHATFTMRL | 99

FIG. 13-62

Species: DENV3 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|

FIG. 13-63

Species: DENV3 (11-mers)

| protein | block starting position | block entropy | total peptides in block | peptides required to cover 99% of block | gap/X fraction | 99% of block covered w/ <= 5 peptides? | block |

FIG. 13-64

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1805 | 0.16 | 3 | 2 | 0 | yes | PIQDEERDIPE | 97.88 | PIQDEEKDIPE | 1.77 | | | | |
| NS3 | 1806 | 0.16 | 3 | 2 | 0 | yes | IQDEERDIPER | 97.88 | IQDEEKDIPER | 1.77 | | | | |
| NS3 | 1807 | 0.16 | 3 | 2 | 0 | yes | QDEERDIPERS | 97.88 | QDEEKDIPERS | 1.77 | | | | |
| NS3 | 1808 | 0.16 | 3 | 2 | 0 | yes | DEERDIPERSW | 97.88 | DEEKDIPERSW | 1.77 | | | | |
| NS3 | 1809 | 0.16 | 3 | 2 | 0 | yes | EERDIPERSWN | 97.88 | EEKDIPERSWN | 1.77 | | | | |
| NS3 | 1810 | 0.13 | 2 | 2 | 0 | yes | ERDIPERSWNS | 98.23 | EKDIPERSWNS | 1.77 | | | | |
| NS3 | 1811 | 0.13 | 2 | 2 | 0 | yes | RDIPERSWNSG | 98.23 | KDIPERSWNSG | 1.77 | | | | |
| NS3 | 1812 | 0 | 1 | 1 | 0 | yes | DIPERSWNSGN | 100 | | | | | | |
| NS3 | 1813 | 0.34 | 2 | 2 | 0 | yes | IPERSWNSGNE | 93.81 | IPERSWNSGND | 6.19 | | | | |
| NS3 | 1814 | 0.34 | 2 | 2 | 0 | yes | PERSWNSGNEW | 93.81 | PERSWNSGNDW | 6.19 | | | | |
| NS3 | 1815 | 0.34 | 2 | 2 | 0 | yes | ERSWNSGNEWI | 93.81 | ERSWNSGNDWI | 6.19 | | | | |
| NS3 | 1816 | 0.34 | 2 | 2 | 0 | yes | RSWNSGNEWIT | 93.81 | RSWNSGNDWIT | 6.19 | | | | |
| NS3 | 1817 | 0.34 | 2 | 2 | 0 | yes | SWNSGNEWITD | 93.81 | SWNSGNDWITD | 6.19 | | | | |
| NS3 | 1818 | 0.34 | 2 | 2 | 0 | yes | WNSGNEWITDF | 93.81 | WNSGNDWITDF | 6.19 | | | | |
| NS3 | 1819 | 1.26 | 6 | 4 | 0 | yes | NSGNEWITDFA | 63.89 | NSGNEWITDFV | 29.2 | NSGNDWITDFA | 5.84 | NSGNEWITDFT | 0.53 |
| NS3 | 1820 | 1.26 | 6 | 4 | 0 | yes | SGNEWITDFAG | 63.89 | SGNEWITDFVG | 29.2 | SGNDWITDFAG | 5.84 | SGNEWITDFTG | 0.53 |
| NS3 | 1821 | 1.29 | 8 | 4 | 0 | yes | GNEWITDFAGK | 63.72 | GNEWITDFVGK | 29.03 | GNDWITDFAGK | 5.84 | GNEWITDFTGK | 0.53 |
| NS3 | 1822 | 1.29 | 8 | 4 | 0 | yes | NEWITDFAGKT | 63.72 | NEWITDFVGKT | 29.03 | NDWITDFAGKT | 5.84 | NEWITDFTGKT | 0.53 |
| NS3 | 1823 | 1.29 | 8 | 4 | 0 | yes | EWITDFAGKTV | 63.72 | EWITDFVGKTV | 29.03 | DWITDFAGKTV | 5.84 | EWITDFTGKTV | 0.53 |
| NS3 | 1824 | 1 | 7 | 3 | 0 | yes | WITDFAGKTVW | 69.56 | WITDFVGKTVW | 29.03 | WITDFGKTVW | 0.53 | | |
| NS3 | 1825 | 1 | 7 | 3 | 0 | yes | ITDFAGKTVWF | 69.56 | ITDFVGKTVWF | 29.03 | ITDFGKTVWF | 0.53 | | |
| NS3 | 1826 | 1 | 7 | 3 | 0 | yes | TDFAGKTVWFV | 69.56 | TDFVGKTVWFV | 29.03 | TDFGKTVWFV | 0.53 | | |
| NS3 | 1827 | 1 | 7 | 3 | 0 | yes | DFAGKTVWFVP | 69.56 | DFVGKTVWFVP | 29.03 | DFGKTVWFVP | 0.53 | | |
| NS3 | 1828 | 1 | 7 | 3 | 0 | yes | FAGKTVWFVPS | 69.56 | FVGKTVWFVPS | 29.03 | FTGKTVWFVPS | 0.53 | | |
| NS3 | 1829 | 1 | 7 | 3 | 0 | yes | AGKTVWFVPSI | 69.56 | VGKTVWFVPSI | 29.03 | TGKTVWFVPSI | 0.53 | | |
| NS3 | 1830 | 0.03 | 2 | 1 | 0 | yes | GKTVWFVPSIK | 99.65 | | | | | | |

FIG. 13-65

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS3 | 1831 | 0.03 | 2 | — | 0 | yes | KTVWFVPSIKA | 99.65 |
| NS3 | 1832 | 0 | 1 | — | 0 | yes | TVWFVPSIKAG | 100 |
| NS3 | 1833 | 0 | 1 | — | 0 | yes | VWFVPSIKAGN | 100 |
| NS3 | 1834 | 0.04 | 3 | — | 0 | yes | WFVPSIKAGND | 99.65 |

FIG. 13-66

Species: DENV3 (11-mers)

| protein | block starting position | block entropy | total peptides in block | peptides required to cover 99% of block | gap/X fraction | 99% of block covered w/ <= 5 peptides? | block | frequency | peptides required to cover 99% of block | block | frequency | peptides

FIG. 13-67

Species: DENV3 (11-mers)

| protein | block starting position | block entropy | total peptides in block | peptides required to cover 99% of block | gap/X fraction | covered w/ <= 5 peptides? | block | frequency | peptides required to cover 99% of block | frequency |
|---|---|---|---|---|---|---|---|---|---|---|
| NS3 | 1883 | 0.1 | 5 | 2 | 0 | yes | DISEMGANFKA | 98.94 | DISEMGANFRA | 0.53 |
| NS3 | 1884 | 0.1 | 5 | 2 | 0 | yes | ISEMGANFKAD | 98.94 | ISEMGANFRAD | 0.53 |
| NS3 | 1885 | 0.1 | 5 | 2 | 0 | yes | SEMGANFKADR | 98.94 | SEMGANFRADR | 0.53 |
| NS3 | 1886 | 0.1 | 5 | 2 | 0 | yes | EMGANFKADRV | 98.94 | EMGANFRADRV | 0.53 |
| NS3 | 1887 | 0.1 | 5 | 2 | 0 | yes | MGANFKADRVI | 98.94 | MGANFRADRVI | 0.53 |
| NS3 | 1888 | 0.1 | 5 | 2 | 0 | yes | GANFKADRVID | 98.94 | GANFRADRVID | 0.53 |
| NS3 | 1889 | 0.1 | 5 | 2 | 0 | yes | ANFKADRVIDP | 98.94 | ANFRADRVIDP | 0.53 |
| NS3 | 1890 | 0.1 | 5 | 2 | 0 | yes | NFKADRVIDPR | 98.94 | NFRADRVIDPR | 0.53 |
| NS3 | 1891 | 0.1 | 5 | 2 | 0 | yes | FKADRVIDPRR | 98.94 | FRADRVIDPRR | 0.53 |
| NS3 | 1892 | 0.1 | 5 | 2 | 0 | yes | KADRVIDPRRC | 98.94 | RADRVIDPRRC | 0.53 |
| NS3 | 1893 | 0.04 | 3 | 2 | 0 | yes | ADRVIDPRRCL | 99.65 | | |
| NS3 | 1894 | 0 | 1 | 1 | 0 | yes | DRVIDPRRCLK | 100 | | |
| NS3 | 1895 | 0 | 1 | 1 | 0 | yes | RVIDPRRCLKP | 100 | | |
| NS3 | 1896 | 0 | 1 | 1 | 0 | yes | VIDPRRCLKPV | 100 | | |
| NS3 | 1897 | 0 | 1 | 1 | 0 | yes | IDPRRCLKPVI | 100 | | |
| NS3 | 1898 | 0 | 1 | 1 | 0 | yes | DPRRCLKPVIL | 100 | | |
| NS3 | 1899 | 0 | 1 | 1 | 0 | yes | PRRCLKPVILT | 100 | | |
| NS3 | 1900 | 0 | 1 | 1 | 0 | yes | RRCLKPVILTD | 100 | | |
| NS3 | 1901 | 0 | 1 | 1 | 0 | yes | RCLKPVILTDG | 100 | | |
| NS3 | 1902 | 0.02 | 2 | 1 | 0 | yes | CLKPVILTDGP | 99.82 | | |
| NS3 | 1903 | 0.02 | 2 | 1 | 0 | yes | LKPVILTDGPE | 99.82 | | |
| NS3 | 1904 | 0.02 | 2 | 1 | 0 | yes | KPVILTDGPER | 99.82 | | |
| NS3 | 1905 | 0.02 | 2 | 1 | 0 | yes | PVILTDGPERV | 99.82 | | |
| NS3 | 1906 | 0.02 | 2 | 1 | 0 | yes | VILTDGPERVI | 99.82 | | |
| NS3 | 1907 | 0.02 | 2 | 1 | 0 | yes | ILTDGPERVIL | 99.82 | | |
| NS3 | 1908 | 0.02 | 2 | 1 | 0 | yes | LTDGPERVILA | 99.82 | | |

FIG. 13-68

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1909 | 0.02 | 2 | 1 | 0 | yes | TDGPERVILAG | 99.82 | | | | | | |
| NS3 | 1910 | 0.02 | 2 | 1 | 0 | yes | DGPERVILAGP | 99.82 | | | | | | |
| NS3 | 1911 | 0.07 | 3 | 1 | 0 | yes | GPERVILAGPM | 99.29 | | | | | | |
| NS3 | 1912 | 0.07 | 3 | 1 | 0 | yes | PERVILAGPMP | 99.29 | | | | | | |
| NS3 | 1913 | 0.05 | 2 | 1 | 0 | yes | ERVILAGPMPV | 99.47 | | | | | | |
| NS3 | 1914 | 0.05 | 2 | 1 | 0 | yes | RVILAGPMPVT | 99.47 | | | | | | |
| NS3 | 1915 | 0.55 | 3 | 2 | 0 | yes | VILAGPMPVTA | 88.32 | VILAGPMPVTV | 11.15 | | | | |
| NS3 | 1916 | 0.55 | 3 | 2 | 0 | yes | ILAGPMPVTAA | 88.32 | ILAGPMPVTVA | 11.15 | | | | |
| NS3 | 1917 | 0.55 | 3 | 2 | 0 | yes | LAGPMPVTAAS | 88.32 | LAGPMPVTVAS | 11.15 | | | | |
| NS3 | 1918 | 0.55 | 3 | 2 | 0 | yes | AGPMPVTAASA | 88.32 | AGPMPVTVASA | 11.15 | | | | |
| NS3 | 1919 | 0.55 | 3 | 2 | 0 | yes | GPMPVTAASAA | 88.32 | GPMPVTVASAA | 11.15 | | | | |
| NS3 | 1920 | 0.55 | 3 | 2 | 0 | yes | PMPVTAASAAQ | 88.32 | PMPVTVASAAQ | 11.15 | | | | |
| NS3 | 1921 | 0.55 | 3 | 2 | 0 | yes | MPVTAASAAQR | 88.32 | MPVTVASAAQR | 11.15 | | | | |
| NS3 | 1922 | 0.5 | 2 | 2 | 0 | yes | PVTAASAAQRR | 88.85 | PVTVASAAQRR | 11.15 | | | | |
| NS3 | 1923 | 0.5 | 2 | 2 | 0 | yes | VTAASAAQRRG | 88.85 | VTVASAAQRRG | 11.15 | | | | |
| NS3 | 1924 | 0.5 | 2 | 2 | 0 | yes | TAASAAQRRGR | 88.85 | TVASAAQRRGR | 11.15 | | | | |
| NS3 | 1925 | 0.5 | 2 | 2 | 0 | yes | AASAAQRRGRV | 88.85 | VASAAQRRGRV | 11.15 | | | | |
| NS3 | 1926 | 0 | 1 | 1 | 0 | yes | ASAAQRRGRVG | 100 | | | | | |

FIG. 13-69

Species: DENV3 (11-mers)

| protein | block starting position | block entropy | total peptides in block (11-mers) | peptides required to cover 99% of block | gap/X fraction |

FIG. 13-70

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|

FIG. 13-71

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | block | frequency | peptides required to cover 99% of block | block | frequency |
|---|---|---|---|---|---|---|---|---|---|---|---|---|
| NS3 | 1987 | 0.02 | 2 | — | 0 | yes | | REKSAAIDGEY | 99.82 | | | |
| NS3 | 1988 | 0.02 | 2 | — | 0 | yes | | EKSAAIDGEYR | 99.82 | | | |
| NS3 | 1989 | 0.04 | 3 | — | 0 | yes | | KSAAIDGEYRL | 99.65 | | | |
| NS3 | 1990 | 0.06 | 4 | — | 0 | yes | | SAAIDGEYRLK | 99.47 | | | |
| NS3 | 1991 | 0.06 | 4 | — | 0 | yes | | AAIDGEYRLKG | 99.47 | | | |
| NS3 | 1992 | 0.06 | 4 | — | 0 | yes | | AIDGEYRLKGE | 99.47 | | | |
| NS3 | 1993 | 0.06 | 4 | — | 0 | yes | | IDGEYRLKGES | 99.47 | | | |
| NS3 | 1994 | 0.06 | 4 | — | 0 | yes | | DGEYRLKGESR | 99.47 | | | |
| NS3 | 1995 | 0.06 | 4 | — | 0 | yes | | GEYRLKGESRK | 99.65 | | | |
| NS3 | 1996 | 0.04 | 3 | — | 0 | yes | | EYRLKGESRKT | 99.65 | | | |
| NS3 | 1997 | 0.04 | 3 | — | 0 | yes | | YRLKGESRKTF | 99.47 | | | |
| NS3 | 1998 | 0.06 | 4 | — | 0 | yes | | RLKGESRKTFV | 99.65 | | | |
| NS3 | 1999 | 0.06 | 4 | — | 0 | yes | | LKGESRKTFVE | 99.47 | | | |
| NS3 | 2000 | 0.04 | 3 | — | 0 | yes | | KGESRKTFVEL | 99.65 | | | |
| NS3 | 2001 | 0.02 | 2 | — | 0 | yes | | GESRKTFVELM | 99.82 | | | |
| NS3 | 2002 | 0.02 | 2 | — | 0 | yes | | ESRKTFVELMR | 99.82 | | | |
| NS3 | 2003 | 0.02 | 2 | — | 0 | yes | | SRKTFVELMRR | 99.82 | | | |
| NS3 | 2004 | 0.02 | 2 | — | 0 | yes | | RKTFVELMRRG | 99.82 | | | |
| NS3 | 2005 | 0.07 | 4 | — | 0 | yes | | KTFVELMRRGD | 99.29 | | | |
| NS3 | 2006 | 0.07 | 4 | — | 0 | yes | | TFVELMRRGDL | 99.29 | | | |
| NS3 | 2007 | 0.07 | 4 | — | 0 | yes | | FVELMRRGDLP | 99.29 | | | |
| NS3 | 2008 | 0.07 | 4 | — | 0 | yes | | VELMRRGDLPV | 99.29 | | | |
| NS3 | 2009 | 0.05 | 3 | — | 0 | yes | | ELMRRGDLPVW | 99.47 | | | |
| NS3 | 2010 | 0.05 | 3 | — | 0 | yes | | LMRRGDLPVWL | 99.47 | | | |
| NS3 | 2011 | 0.09 | 4 | — | 0 | yes | | MRRGDLPVWLA | 99.12 | | | |
| NS3 | 2012 | 0.26 | 5 | 2 | 0 | yes | | MRRGDLPVWLA | 96.46 | | RRGDLPVWLAY | 2.65 |

FIG. 13-72

Species: DENV3 (11-mers)

| protein | block starting position | block entropy | total peptides in block | peptides required to cover 99% of block | gap/X fraction | 99% of block covered w/ <= 5 peptides? | block | frequency | block | frequency | peptides required to cover 99% of block | block | frequency | peptides required to cover

FIG. 13-73

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 2039 | 0.97 | 3 | 2 | 0 | yes | DGQ

FIG. 13-74

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2065 | 0.02 | 2 | 1 | 0 | yes | LRP

FIG. 13-75

Species: DENV3 (11-mers)

| protein | block starting position | block entropy | total peptides in block | peptides required to cover 99% of block | gap/X fraction | covered w/ <= 5 peptides? 99

FIG. 13-76

Species: DENV3 (11-mers)

| protein | block starting position | block entropy | total peptides in block | peptides required to cover 99% of block | 99% of block covered w/ <= 5 peptides? | gap/X fraction | block to cover 99% of | frequency | block peptides required to cover 99

FIG. 13-77

Species: DENW3 (11-mers)

| protein | block starting position | block entropy | total peptides in block | peptides required to cover 99% of block | gap/X fraction | 99% of block covered w/ <= 5 peptides? | peptide 1 | freq | peptide 2 | freq | peptide 3 | freq | peptide 4 | freq | peptide 5 | freq |
|---|---|---|---|---|---|---|---|---|---|---|---|---|---|---|---|---|
| NS4A | 2143 | 0.04 | 3 | 1 | 0 | yes | TMETLLLLGLM | 99.65 | | | | | | | | |
| NS4A | 2144 | 0.04 | 3 | 1 | 0 | yes | METLLLLGLMI | 99.65 | | | | | | | | |
| NS4A | 2145 | 0.06 | 4 | 1 | 0 | yes | ETLLLLGLMIL | 99.47 | | | | | | | | |
| NS4A | 2146 | 0.06 | 4 | 1 | 0 | yes | TLLLLGLMILL | 99.47 | | | | | | | | |
| NS4A | 2147 | 0.06 | 4 | 1 | 0 | yes | LLLLGLMILLT | 99.47 | | | | | | | | |
| NS4A | 2148 | 0.07 | 4 | 1 | 0 | yes | LLLGLMILLTG | 99.29 | | | | | | | | |
| NS4A | 2149 | 0.07 | 4 | 1 | 0 | yes | LLGLMILLTGG | 99.29 | | | | | | | | |
| NS4A | 2150 | 0.24 | 5 | 2 | 0 | yes | LGLMILLTGGA | 96.81 | LGLMILLTGGV | 2.48 | | | | | | |
| NS4A | 2151 | 0.22 | 4 | 2 | 0 | yes | GLMILLTGGAM | 96.99 | GLMILLTGGVM | 2.48 | | | | | | |
| NS4A | 2152 | 0.22 | 4 | 2 | 0 | yes | LMILLTGGAML | 96.99 | LMILLTGGVML | 2.48 | | | | | | |
| NS4A | 2153 | 0.22 | 4 | 2 | 0 | yes | MILLTGGAMLF | 96.99 | MILLTGGVMLF | 2.48 | | | | | | |
| NS4A | 2154 | 0.24 | 5 | 2 | 0 | yes | ILLTGGAMLFL | 96.81 | ILLTGGVMLFL | 2.48 | | | | | | |
| NS4A | 2155 | 0.3 | 6 | 3 | 0 | yes | LLTGGAMLFLI | 96.11 | LLTGGVMLFLI | 2.48 | LLTGGAMLFLV | 0.71 | | | | |
| NS4A | 2156 | 0.28 | 5 | 3 | 0 | yes | LTGGAMLFLIS | 96.28 | LTGGVMLFLIS | 2.48 | LTGGAMLFLVS | 0.71 | | | | |
| NS4A | 2157 | 0.28 | 5 | 3 | 0 | yes | TGGAMLFLISG | 96.28 | TGGVMLFLISG | 2.48 | TGGAMLFLVSG | 0.71 | | | | |
| NS4A | 2158 | 0.36 | 6 | 4 | 0 | yes | GGAMLFLISGK | 95.22 | GGVMLFLISGK | 2.48 | GGAMLFLISGR | 1.06 | GGAMLFLVSGK | 0.71 | | |
| NS4A | 2159 | 0.33 | 5 | 3 | 0 | yes | GAMLFLISGKG | 95.58 | GVMLFLISGKG | 2.48 | GAMLFLISGRG | 1.06 | | | | |
| NS4A | 2161 | 0.48 | 6 | 4 | 0 | yes | MLFLISGKGIG | 92.57 | MLFLISGKGVG | 5.31 | MLFLISGRGIG | 1.06 | MLFLVSGKGIG | 0.71 | | |
| NS4A | 2162 | 0.48 | 6 | 4 | 0 | yes | LFLISGKGIGK | 92.57 | LFLISGKGVGK | 5.31 | LFLISGRGIGK | 1.06 | LFLVSGKGIGK | 0.71 | | |
| NS4A | 2163 | 0.51 | 8 | 5 | 0 | yes | FLISGKGIGKT | 92.39 | FLISGKGVGKT | 5.31 | FLISGRGIGKA | 0.71 | FLVSGKGIGKT | 0.71 | | |
| NS4A | 2164 | 0.56 | 9 | 5 | 0 | yes | LISGKGIGKTS | 91.86 | LISGKGVGKTS | 5.31 | LISGRGIGKAS | 0.71 | LVSGKGIGKTT | 0.71 | LISGKGIGKTT | 0.53 |
| NS4A | 2165 | 0.56 | 9 | 5 | 0 | yes | ISGKGIGKTSI | 91.86 | ISGKGVGKTSI | 5.31 | ISGRGIGKASI | 0.71 | VSGKGIGKTTI | 0.71 | ISGKGIGKTTI | 0.53 |
| NS4A | 2166 | 0.54 | 8 | 4 | 0 | yes | SGKGIGKTSIG | 91.86 | SGKGVGKTSIG | 5.31 | SGRGIGKASIG | 1.24 | SGKGIGKTTIG | 0.71 | | |
| NS4A | 2167 | 0.54 | 8 | 4 | 0 | yes | GKGIGKTSIGL | 91.86 | GKGVGKTSIGL | 5.31 | GRGIGKASIGL | 1.24 | GKGIGKTTIGL | 0.71 | | |
| NS4A | 2168 | 0.54 | 8 | 4 | 0 | yes | KGIGKTSIGLI | 91.86 | KGVGKTSIGLI | 5.31 | RGIGKASIGLI | 1.24 | KGIGKTTIGLI | 0.71 | | |
| NS4A | 2169 | 0.5 | 6 | 4 | 0 | yes | GIGKTSIGLIC | 92.21 | GVGKTSIGLIC | 5.31 | GIGKASIGLIC | 1.24 | GIGKTTIGLIC | 0.88 | | |

FIG. 13-78

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to c

FIG. 13-79

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2198 | 0.16 | 3 | 2 | 0 | yes | ASAIVLEFFMM | 97.88 | ASAIILEFFMM | 1.77 | | | | |
| NS4A | 2199 | 0.16 | 3 | 2 | 0 | yes | SAIVLEFFMMV | 97.88 | SAIILEFFMMV | 1.77 | | | | |
| NS4A | 2200 | 0.16 | 3 | 2 | 0 | yes | AIVLEFFMMVL | 97.88 | AIILEFFMMVL | 1.77 | | | | |
| NS4A | 2201 | 0.16 | 3 | 2 | 0 | yes | IVLEFFMMVLL | 97.88 | IILEFFMMVLL | 1.77 | | | | |
| NS4A | 2202 | 0.13 | 2 | 2 | 0 | yes | VLEFFMMVLLI | 98.23 | ILEFFMMVLLI | 1.77 | | | | |
| NS4A | 2203 | 0 | 1 | 1 | 0 | yes | LEFFMMVLLIP | 100 | | | | | | |
| NS4A | 2204 | 0.02 | 2 | 1 | 0 | yes | EFFMMVLLIPE | 99.82 | | | | | | |
| NS4A | 2205 | 0.02 | 2 | 1 | 0 | yes | FFMMVLLIPEP | 99.82 | | | | | | |
| NS4A | 2206 | 0.02 | 2 | 1 | 0 | yes | FMMVLLIPEPE | 99.82 | | | | | | |
| NS4A | 2207 | 0.02 | 2 | 1 | 0 | yes | MMVLLIPEPEK | 99.82 | | | | | | |
| NS4A | 2208 | 0.02 | 2 | 1 | 0 | yes | MVLLIPEPEKQ | 99.82 | | | | | | |
| NS4A | 2209 | 0.02 | 2 | 1 | 0 | yes | VLLIPEPEKQR | 99.82 | | | | | | |
| NS4A | 2210 | 0.02 | 2 | 1 | 0 | yes | LLIPEPEKQRT | 99.82 | | | | | | |
| NS4A | 2211 | 0.02 | 2 | 1 | 0 | yes | LIPEPEKQRTP | 99.82 | | | | | | |
| NS4A | 2212 | 0.02 | 2 | 1 | 0 | yes | IPEPEKQRTPQ | 99.82 | | | | | | |
| NS4A | 2213 | 0.02 | 2 | 1 | 0 | yes | PEPEKQRTPQD | 99.82 | | | | | | |
| NS4A | 2214 | 0.02 | 2 | 1 | 0 | yes | EPEKQRTPQDN | 99.82 | | | | | | |
| NS4A | 2215 | 0 | 1 | 1 | 0 | yes | PEKQRTPQDNQ | 100 | | | | | | |
| NS4A | 2216 | 0 | 1 | 1 | 0 | yes | EKQRTPQDNQL | 100 | | | | | | |
| NS4A | 2217 | 0 | 1 | 1 | 0 | yes | KQRTPQDNQLA | 100 | | | | | | |
| NS4A | 2218 | 0 | 1 | 1 | 0 | yes | QRTPQDNQLAY | 100 | | | | | | |
| NS4A | 2219 | 0 | 1 | 1 | 0 | yes | RTPQDNQLAYV | 100 | | | | | | |
| 2K | 2220 | 0 | 1 | 1 | 0 | yes | TPQDNQLAYVV | 100 | | | | | | |
| 2K | 2221 | 0 | 1 | 1 | 0 | yes | PQDNQLAYVVI | 100 | | | | | | |
| 2K | 2222 | 0 | 1 | 1 | 0 | yes | QDNQLAYVVIG | 100 | | | | | | |
| 2K | 2223 | 0 | 1 | 1 | 0 | yes | DNQLAYVVIGI | 100 | | | | | | |

FIG. 13-80

Species: DENV3 (11-mers)

| protein | block starting position | block entropy | total peptides in block | peptides required to cover 99% of block | gap/X fraction | 99% of block covered w/ <= 5 peptides?

FIG. 13-81

Species: DENV3 (11-mers)

| protein | block starting position | block entropy | total peptides in block | peptides required to cover 99% of block | gap/X fraction | covered w/ <= 5 peptides? | block | fr

FIG. 13-82

Species: DENV3

FIG. 13-83

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS4B | 2305 | 0 | 1 | — | 0 | yes | VSLAAIANQAV | 100 |
| NS4B | 2306 | 0 | 1 | — | 0 | yes | SLAAIANQAVV | 100 |
| NS4B | 2307 | 0 | 1 | — | 0 | yes | LAAIANQAVVL | 100 |
| NS4B | 2308 | 0 | 1 | — | 0 | yes | AAIANQAVVLM | 100 |
| NS4B | 2309 | 0 | 1 | — | 0 | yes | AIANQAVVLMG | 100 |
| NS4B | 2310 | 0 | 1 | — | 0 | yes | IANQAVVLMGL | 100 |
| NS4B | 2311 | 0.03 | 2 | — | 0 | yes | ANQAVVLMGLD | 99.65 |
| NS4B | 2312 | 0.03 | 2 | — | 0 | yes | NQAVVLMGLDK | 99.65 |
| NS4B | 2313 | 0.03 | 2 | — | 0 | yes | QAVVLMGLDKG | 99.65 |
| NS4B | 2314 | 0.03 | 2 | — | 0 | yes | AVVLMGLDKGW | 99.65 |
| NS4B | 2315 | 0.03 | 2 | — | 0 | yes | VVLMGLDKGWP | 99.65 |
| NS4B | 2316 | 0.03 | 2 | — | 0 | yes | VLMGLDKGWPI | 99.65 |
| NS4B | 2317 | 0.03 | 2 | — | 0 | yes | LMGLDKGWPIS | 99.65 |
| NS4B | 2318 | 0.03 | 2 | — | 0 | yes | MGLDKGWPISK | 99.65 |
| NS4B | 2319 | 0.03 | 2 | — | 0 | yes | GLDKGWPISKM | 99.65 |
| NS4B | 2320 | 0.03 | 2 | — | 0 | yes | LDKGWPISKMD | 99.65 |
| NS4B | 2321 | 0.03 | 2 | — | 0 | yes | DKGWPISKMDL | 99.65 |
| NS4B | 2322 | 0 | 1 | — | 0 | yes | KGWPISKMDLG | 100 |
| NS4B | 2323 | 0.02 | 2 | — | 0 | yes | GWPISKMDLGV | 99.82 |
| NS4B | 2324 | 0.02 | 2 | — | 0 | yes | WPISKMDLGVP | 99.82 |
| NS4B | 2325 | 0.02 | 2 | — | 0 | yes | PISKMDLGVPL | 99.82 |
| NS4B | 2326 | 0.02 | 2 | — | 0 | yes | ISKMDLGVPLL | 99.82 |
| NS4B | 2327 | 0.02 | 2 | — | 0 | yes | SKMDLGVPLLA | 99.82 |
| NS4B | 2328 | 0.02 | 2 | — | 0 | yes | KMDLGVPLLAL | 99.82 |
| NS4B | 2329 | 0.02 | 2 | — | 0 | yes | MDLGVPLLALG | 99.82 |
| NS4B | 2330 | 0.02 | 2 | — | 0 | yes | DLGVPLLALGC | 99.82 |

FIG. 13-84

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required

FIG. 13-85

Species: DENV3 (11-mers)

FIG. 13-86

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|

FIG. 13-87

Species: DENV3 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS4B | 2409 | 0.05 | 3 | 1 | 0 | yes | QLGQVMLLVLC | 99.47 | | | | | | |
| NS4B | 2410 | 0.11 | 5 | 2 | 0 | yes | LGQVMLLVLCA | 98.94 | LGQVMLLVLCV | 0.35 | | | | |
| NS4B | 2411 | 0.17 | 7 | 3 | 0 | yes | GQVMLLVLCAV | 98.23 | GQVMLLVLCAA | 0.53 | GQVMLLILCAV | 0.35 | | |
| NS4B | 2412 | 0.17 | 7 | 3 | 0 | yes | QVMLLVLCAVQ | 98.23 | QVMLLVLCAAQ | 0.53 | QVMLLVLCWQ | 0.35 | | |
| NS4B | 2413 | 0.17 | 7 | 3 | 0 | yes | VMLLVLCAVQL | 98.23 | VMLLVLCAAQL | 0.53 | VMLLVLCVQL | 0.35 | | |
| NS4B | 2414 | 0.15 | 6 | 3 | 0 | yes | MLLVLCAVQLL | 98.41 | MLLVLCAAQLL | 0.53 | MLLILCAVQLL | 0.35 | | |
| NS4B | 2415 | 0.15 | 6 | 3 | 0 | yes | LLVLCAVQLLL | 98.41 | LLVLCAAQLLL | 0.53 | LLVLCWQLLL | 0.35 | | |
| NS4B | 2416 | 0.15 | 6 | 3 | 0 | yes | LVLCAVQLLLM | 98.41 | LVLCAAQLLLM | 0.53 | LVLCWQLLLM | 0.35 | | |
| NS4B | 2417 | 0.17 | 7 | 3 | 0 | yes | VLCAVQLLLMR | 98.23 | VLCAAQLLLMR | 0.53 | ILCAVQLLLMR | 0.35 | | |
| NS4B | 2418 | 0.14 | 6 | 2 | 0 | yes | LCAVQLLLMRT | 98.58 | LCAAQLLLMRT | 0.53 | | | | |
| NS4B | 2419 | 0.14 | 6 | 2 | 0 | yes | CAVQLLLMRTS | 98.58 | CAAQLLLMRTS | 0.53 | | | | |
| NS4B | 2420 | 0.14 | 6 | 2 | 0 | yes | AVQLLLMRTSW | 98.58 | AAQLLLMRTSW | 0.53 | | | | |
| NS4B | 2421 | 0.09 | 4 | 1 | 0 | yes | VQLLLMRTSWA | 99.12 | | | | | | |
| NS4B | 2422 | 0.46 | 3 | 2 | 0 | yes | QLLLMRTSWAL | 90.62 | QLLLMRTSWAF | 9.2 | | | | |
| NS4B | 2423 | 0.46 | 3 | 2 | 0 | yes | LLLMRTSWALC | 90.62 | LLLMRTSWAFC | 9.2 | | | | |
| NS4B | 2424 | 0.46 | 3 | 2 | 0 | yes | LLMRTSWALCE | 90.62 | LLMRTSWAFCE | 9.2 | | | | |
| NS4B | 2425 | 0.55 | 4 | 3 | 0 | yes | LMRTSWALCEA | 89.56 | LMRTSWAFCEA | 9.2 | LMRTSWALCEV | 1.06 | | |
| NS4B | 2426 | 0.55 | 4 | 3 | 0 | yes | MRTSWALCEAL | 89.56 | MRTSWAFCEAL | 9.2 | MRTSWALCEVL | 1.06 | | |
| NS4B | 2427 | 0.55 | 4 | 3 | 0 | yes | RTSWALCEALI | 89.56 | RTSWAFCEALI | 9.2 | RTSWALCEVLT | 1.06 | | |
| NS4B | 2428 | 0.54 | 3 | 3 | 0 | yes | TSWALCEALTL | 89.56 | TSWAFCEALTL | 9.2 | TSWALCEVLT | 1.24 | | |
| NS4B | 2429 | 0.54 | 3 | 3 | 0 | yes | SWALCEALTLA | 89.56 | SWAFCEALTLA | 9.2 | SWALCEVLTLA | 1.24 | | |
| NS4B | 2430 | 0.54 | 3 | 3 | 0 | yes | WALCEALTLAT | 89.56 | WAFCEALTLAT | 9.2 | WALCEVLTLAT | 1.24 | | |
| NS4B | 2431 | 0.54 | 3 | 3 | 0 | yes | ALCEALTLATG | 89.56 | AFCEALTLATG | 9.2 | ALCEVLTLATG | 1.24 | | |
| NS4B | 2432 | 0.54 | 3 | 3 | 0 | yes | LCEALTLATGP | 89.56 | FCEALTLATGP | 9.2 | LCEVLTLATGP | 1.24 | | |
| NS4B | 2433 | 0.11 | 3 | 2 | 0 | yes | CEALTLATGPI | 98.58 | CEVLTLATGPI | 1.24 | | | | |
| NS4B | 2434 | 0.11 | 3 | 2 | 0 | yes | EALTLATGPIT | 98.58 | EVLTLATGPIT | 1.24 | | | | |

FIG. 13-88

Species: DENV3 (11-mers)

| protein | block starting position | block entropy | total pe

FIG. 13-89

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of

FIG. 13-90

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99

FIG. 13-91

Species: DENV3 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 2515 | 0.04 | 3 | 1 | 0 | yes | FDLYKKSGITE | 99.65 | | | | | | |
| NS5 | 2516 | 0.04 | 3 | 1 | 0 | yes | DLYKKSGITEV | 99.65 | | | | | | |
| NS5 | 2517 | 0.04 | 3 | 1 | 0 | yes | LYKKSGITEVD | 99.65 | | | | | | |
| NS5 | 2518 | 0.04 | 3 | 1 | 0 | yes | YKKSGITEVDR | 99.65 | | | | | | |
| NS5 | 2519 | 0.21 | 4 | 3 | 0 | yes | KKSGITEVDRI | 97.35 | KKSGITEVDRS | 1.59 | | | | |
| NS5 | 2520 | 0.23 | 5 | 3 | 0 | yes | KSGITEVDRIE | 97.17 | KSGITEVDRSE | 1.59 | | | | |
| NS5 | 2521 | 0.23 | 5 | 3 | 0 | yes | SGITEVDRIEA | 97.17 | SGITEVDRSEA | 1.59 | | | | |
| NS5 | 2522 | 0.23 | 5 | 3 | 0 | yes | GITEVDRIEAK | 97.17 | GITEVDRSEAK | 1.59 | | | | |
| NS5 | 2523 | 0.23 | 5 | 3 | 0 | yes | ITEVDRIEAKE | 97.17 | ITEVDRSEAKE | 1.59 | | | | |
| NS5 | 2524 | 0.23 | 5 | 3 | 0 | yes | TEVDRIEAKEG | 97.17 | TEVDRSEAKEG | 1.59 | | | | |
| NS5 | 2525 | 0.23 | 5 | 3 | 0 | yes | EVDRIEAKEGL | 97.17 | EVDRSEAKEGL | 1.59 | | | | |
| NS5 | 2526 | 0.28 | 6 | 3 | 0 | yes | VDRIEAKEGLK | 96.64 | VDRSEAKEGLK | 1.59 | | | | |
| NS5 | 2527 | 0.32 | 7 | 4 | 0 | yes | DRIEAKEGLKR | 96.11 | DRSEAKEGLKR | 1.59 | DRTEAKEGLKK | 0.53 | | |
| NS5 | 2528 | 0.34 | 7 | 5 | 0 | yes | RIEAKEGLKRG | 95.93 | RSEAKEGLKRG | 1.59 | RTEAKEGLKKG | 0.53 | RTEAKEGLRRG | 0.53 |
| NS5 | 2529 | 0.34 | 7 | 5 | 0 | yes | IEAKEGLKRGE | 95.93 | SEAKEGLKRGE | 1.59 | TEAKEGLKRGE | 0.53 | TEAKEGLRRGE | 0.53 |
| NS5 | 2530 | 1.14 | 8 | 5 | 0 | yes | EAKEGLKRGET | 58.05 | EAKEGLKKGEI | 40 | EAKGLKRRET | 0.35 | EAKEGLKRRET | 0.35 |
| NS5 | 2531 | 1.13 | 7 | 4 | 0 | yes | AKEGLKRGETT | 58.05 | AKEGLKKGEI | 40.18 | AKEGLKRRETT | 0.53 | | |
| NS5 | 2537 | 1.16 | 9 | 5 | 0 | yes | RGETTHHAVSR | 57.88 | RGETTHHAVSR | 40 | RRETTHHAVSR | 0.53 | RGEITRHAVSR | 0.35 |
| NS5 | 2538 | 1.12 | 8 | 4 | 0 | yes | GETTHHAVSRG | 58.41 | GEITRHAVSRG | 40 | RETTHHAVSR | 0.35 | | |
| NS5 | 2539 | 1.22 | 9 | 5 | 0 | yes | ETTHHAVSRGS | 58.23 | ETTHHAVSRGT | 38.41 | EITRHAVSRGS | 1.95 | EVTHHAVSRGS | 0.35 |
| NS5 | 2540 | 1.22 | 9 | 5 | 0 | yes | TTHHAVSRGSA | 58.23 | TTHHAVSRGTA | 38.41 | VTHHAVSRGSA | 1.95 | ITRHAVSRGSA | 0.35 |
| NS5 | 2541 | 0.23 | 4 | 2 | 0 | yes | THHAVSRGSAK | 96.99 | THHAVSRGTAK | 2.12 | | | | |
| NS5 | 2542 | 0.23 | 4 | 2 | 0 | yes | HHAVSRGSAKL | 96.99 | HHAVSRGTAKL | 2.12 | | | | |
| NS5 | 2543 | 0.18 | 3 | 2 | 0 | yes | HAVSRGSAKLQ | 97.52 | HAVSRGTAKLQ | 2.12 | | | | |
| NS5 | 2544 | 0.15 | 2 | 2 | 0 | yes | AVSRGSAKLQW | 97.88 | AVSRGTAKLQW | 2.12 | | | | |
| NS5 | 2545 | 0.17 | 3 | 2 | 0 | yes | VSRGSAKLQWF | 97.7 | VSRGTAKLQWF | 2.12 | | | | |

FIG. 13-92

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2546 | 0.17 | 3 | 2 | 0 | yes | SRGSAKLQWFV | 97.7 | SRGTAKLQWFV | 2.12 | | | | |
| NS5 | 2547 | 0.17 | 3 | 2 | 0 | yes | RGSAKLQWFVE | 97.7 | RGTAKLQWFVE | 2.12 | | | | |
| NS5 | 2548 | 0.17 | 3 | 2 | 0 | yes | GSAKLQWFVER | 97.7 | GTAKLQWFVER | 2.12 | | | | |
| NS5 | 2549 | 0.17 | 3 | 2 | 0 | yes | SAKLQWFVERN | 97.7 | TAKLQWFVERN | 2.12 | | | | |
| NS5 | 2550 | 0.02 | 2 | 1 | 0 | yes | AKLQWFVERNM | 99.82 | | | | | | |
| NS5 | 2551 | 0.02 | 2 | 1 | 0 | yes | KLQWFVERNMV | 99.82 | | | | | | |
| NS5 | 2552 | 0.15 | 4 | 2 | 0 | yes | LQWFVERNMVI | 98.23 | LQWFVERNMVV | 1.24 | | | | |
| NS5 | 2553 | 0.15 | 4 | 2 | 0 | yes | QWFVERNMVIP | 98.23 | QWFVERNMVVP | 1.24 | | | | |
| NS5 | 2554 | 0.15 | 4 | 2 | 0 | yes | WFVERNMVIPE | 98.23 | WFVERNMVVPE | 1.24 | | | | |
| NS5 | 2555 | 0.15 | 3 | 2 | 0 | yes | FVERNMVIPEG | 98.23 | FVERNMVVPEG | 1.24 | | | | |
| NS5 | 2556 | 0.13 | 3 | 2 | 0 | yes | VERNMVIPEGR | 98.41 | VERNMVVPEGR | 1.24 | | | | |
| NS5 | 2557 | 0.13 | 3 | 2 | 0 | yes | ERNMVIPEGRV | 98.41 | ERNMVVPEGRV | 1.24 | | | | |
| NS5 | 2558 | 0.13 | 3 | 2 | 0 | yes | RNMVIPEGRVI | 98.41 | RNMVVPEGRVI | 1.24 | | | | |
| NS5 | 2559 | 0.13 | 3 | 2 | 0 | yes | NMVIPEGRVID | 98.41 | NMVVPEGRVID | 1.24 | | | | |
| NS5 | 2560 | 0.13 | 3 | 2 | 0 | yes | MVIPEGRVIDL | 98.41 | MVVPEGRVIDL | 1.24 | | | | |
| NS5 | 2561 | 0.13 | 3 | 2 | 0 | yes | VIPEGRVIDLG | 98.41 | VVPEGRVIDLG | 1.24 | | | | |
| NS5 | 2562 | 0.13 | 3 | 2 | 0 | yes | IPEGRVIDLGC | 98.41 | VPEGRVIDLGC | 1.24 | | | | |
| NS5 | 2563 | 0 | 1 | 1 | 0 | yes | PEGRVIDLGCG | 100 | | | | | | |
| NS5 | 2564 | 0 | 1 | 1 | 0 | yes | EGRVIDLGCGR | 100 | | | | | | |
| NS5 | 2565 | 0 | 1 | 1 | 0 | yes | GRVIDLGCGRG | 100 | | | | | | |
| NS5 | 2566 | 0 | 1 | 1 | 0 | yes | RVIDLGCGRGG | 100 | | | | | | |
| NS5 | 2567 | 0 | 1 | 1 | 0 | yes | VIDLGCGRGGW | 100 | | | | | | |
| NS5 | 2568 | 0 | 1 | 1 | 0 | yes | IDLGCGRGGWS | 100 | | | | | | |
| NS5 | 2569 | 0 | 1 | 1 | 0 | yes | DLGCGRGGWSY | 100 | | | | | | |
| NS5 | 2570 | 0 | 1 | 1 | 0 | yes | LGCGRGGWSYY | 100 | | | | | | |
| NS5 | 2571 | 0 | 1 | 1 | 0 | yes | GCGRGGWSYYC | 100 | | | | | | |

FIG. 13-93

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|

FIG. 13-94

Species: DENV3 (11-mers)

| protein | block starting position | block entropy | total peptides in block | peptides required to cover 99% of block | 99% of block covered w/ <= 5 peptides? | block 99% of block | frequency | block peptides required to cover 99% of | frequency | block peptides required to cover 99% of

FIG. 13-95

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2624 | 0.06 | 4 | 1 | 0 | yes | YLPP

FIG. 13-96

Species: DENV3 (11-mers)

| protein | block starting position | block entropy | total peptides in block | peptides required to cover 99% of block | gap/X fraction | 99% of block covered w/ <= 5 peptides? | pe

FIG. 13-97

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2676 | 0.61 | 7 | 4 | 0 | yes | MPTVIEHLERL | 90.44 | MPAVIEHLERL | 6.19 | MPTVEHLERL | 1.59 | MPNVIEHLERL | 1.06 |
| NS5 | 2677 | 0.61 | 7 | 4 | 0 | yes | PTVIEHLERLQ | 90.44 | PAVIEHLERLQ | 6.19 | PTVEHLERLQ | 1.59 | PNVIEHLERLQ | 1.06 |
| NS5 | 2678 | 0.61 | 7 | 4 | 0 | yes | TVIEHLERL

FIG. 13-98

Species: DENV3 (11-mers)

| protein | block starting position | block entropy | total peptides in block | peptides required to cover 99% of block | gap/X fraction | covered w/ <= 5 peptides? 99% of block | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2702 | 0.04 | 3

FIG. 13-99

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 13-100

Species: DENV3 (11-mers)

| protein | block starting position | block entropy | total peptides in block | peptides required to cover 99% of block | gap/X fraction | 99% of block covered w

FIG. 13-101

Species: DENV3 (11-mers)

| protein

FIG. 13-103

Species: DENV3 (11-mers)

| protein | block starting position | block entropy | total peptides in block | peptides required to cover 99% of block | gap/X fraction | 99% of block covered w/ <= 5 peptides? | block | fr

FIG. 13-104

Species: DENV3 (11-mers)

| protein | block starting position | block entropy | total peptides in block | peptides required to cover 99% of block | gap/X fraction | 99% of block covered w/

FIG. 13-105

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides required to cover

FIG. 13-106

Species: DENV3 (11-mers)

| protein | block

FIG. 13-107

Species: DENV3 (11-mers)

| protein | block starting position | block entropy | total

FIG. 13-108

Species: DENV3 (11

FIG. 13-109

Species: DENV3 (11-mers)

| prot

FIG. 13-110

Species: DENV3 (11-mers)

| protein | block starting position | block entropy | total peptides in block | peptides required to cover 99% of block | gap/X fraction | 99% of block covered w/ => 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| NS5 | 3030 | 0.06 | 4 | 1 | 0 | yes | RITEDDLHNEE | 99.47 | | | | | | |
| NS5 | 3031 | 0.06 | 4 | 1 | 0 | yes | ITEDDLHNEEK | 99.47 | | | | | | |
| NS5 | 3032 | 0.06 | 4 | 1 | 0 | yes | TEDDLHNEEKI | 99.47 | | | | | | |
| NS5 | 3033 | 0.5 | 5 | 3 | 0 | yes | EDDLHNEEKIT | 90.8 | EDDLHNEEKIM | 8.14 | | | | |
| NS5 | 3034 | 0.54 | 6 | 3 | 0 | yes | DDLHNEEKITQ | 90.44 | DDLHNEEKIMQ | 8.14 | | | | |
| NS5 | 3035 | 0.54 | 6 | 3 | 0 | yes | DLHNEEKITQQ | 90.44 | DLHNEEKIMQQ | 8.14 | | | | |
| NS5 | 3036 | 0.54 | 6 | 3 | 0 | yes | LHNEEKITQQM | 90.44 | LHNEEKIMQQM | 8.14 | | | | |
| NS5 | 3037 | 0.59 | 8 | 4 | 0 | yes | HNEEKITQQMD | 89.91 | HNEEKIIQQMD | 8.14 | HNEEKITHQMD | 0.35 | | |
| NS5 | 3038 | 0.57 | 7 | 4 | 0 | yes | NEEKITQQMDP | 90.09 | NEEKIIQQMDP | 8.14 | NEEKITHQMDP | 0.35 | | |
| NS5 | 3039 | 0.59 | 8 | 4 | 0 | yes | EEKITQQMDPE | 89.91 | EEKIIQQMDPE | 8.14 | EEKITQQMNPE | 0.35 | | |
| NS5 | 3040 | 0.59 | 8 | 4 | 0 | yes | EKITQQMDPEH | 89.91 | EKIIQQMDPEH | 8.14 | EKITQQMNPEH | 0.35 | | |
| NS5 | 3041 | 0.62 | 9 | 5 | 0 | yes | KITQQMDPEHR | 89.56 | KIIQQMDPEHR | 8.14 | KITHQMDPEHR | 0.35 | KITQQMNPEHR | 0.35 |
| NS5 | 3048 | 0.38 | 9 | 5 | 0 | yes | PEHRQLANAIF | 95.22 | PEHRLLANAIF | 2.65 | PEHKQLANAIF | 0.35 | PEHRKLANAIF | 0.35 |
| NS5 | 3049 | 0.38 | 9 | 5 | 0 | yes | EHRQLANAIFK | 95.22 | EHRLLANAIFK | 2.65 | EHKQLANAIFK | 0.35 | EHRKLANAIFK | 0.35 |
| NS5 | 3050 | 0.36 | 8 | 5 | 0 | yes | HRQLANAIFKL | 95.4 | HRLLANAIFKL | 2.65 | HRKLANAIFKL | 0.35 | HKQLANAIFKL | 0.35 |
| NS5 | 3051 | 0.36 | 8 | 5 | 0 | yes | RQLANAIFKLT | 95.4 | RLLANAIFKLT | 2.65 | RKLANAIFKLT | 0.35 | KQLANAIFKLT | 0.35 |
| NS5 | 3052 | 0.33 | 7 | 4 | 0 | yes | QLANAIFKLTY | 95.75 | QLASAIFKLTY | 2.65 | RLANAIFKLTY | 0.35 | | |
| NS5 | 3053 | 0.21 | 4 | 2 | 0 | yes | LANAIFKLTYQ | 96.99 | LASAIFKLTYQ | 2.65 | | | | |
| NS5 | 3054 | 0.21 | 4 | 2 | 0 | yes | ANAIFKLTYQN | 96.99 | ASAIFKLTYQN | 2.65 | | | | |
| NS5 | 3055 | 0.21 | 4 | 2 | 0 | yes | NAIFKLTYQNK | 96.99 | SAIFKLTYQNK | 2.65 | | | | |
| NS5 | 3056 | 0.02 | 2 | 1 | 0 | yes | AIFKLTYQNKV | 99.82 | | | | | | |
| NS5 | 3057 | 0.02 | 2 | 1 | 0 | yes | IFKLTYQNKVV | 99.82 | | | | | | |
| NS5 | 3058 | 0.02 | 2 | 1 | 0 | yes | FKLTYQNKVVK | 99.82 | | | | | | |
| NS5 | 3059 | 0.02 | 2 | 1 | 0 | yes | KLTYQNKVVKV | 99.82 | | | | | | |
| NS5 | 3060 | 0.02 | 2 | 1 | 0 | yes | LTYQNKVVKVQ | 99.82 | | | | | | |
| NS5 | 3061 | 0.02 | 2 | 1 | 0 | yes | TYQNKVVKVQR | 99.82 | | | | | | |

FIG. 13-111

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of

FIG. 13-112

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3088 | 0.05 | 3 | 1 | 0 | yes | RGSGQVGTYGL | 99.47 | | | | | | |
| NS5 | 3089 | 0.05 | 3 | 1 | 0 | yes | GSGQVGTYGLN | 99.47 | | | | | | |
| NS5 | 3090 | 0.05 | 3 | 1 | 0 | yes | SGQVGTYGLNT | 99.47 | | | | | | |
| NS5 | 3102 | 1.07 | 5 | 3 | 0 | yes | FTNMEAQLIRQ | 61.95 | FTNMEAQLVRQ | 36.46 | FTNMEVQLIRQ | 1.06 | | |
| NS5 | 3103 | 1.07 | 5 | 3 | 0 | yes | TNMEAQLIRQM | 61.95 | TNMEAQLVRQM | 36.46 | TNMEVQLIRQM | 1.06 | | |
| NS5 | 3104 | 1.06 | 4 | 3 | 0 | yes | NMEAQLIRQME | 62.12 | NMEAQLVRQME | 36.46 | NMEVQLIRQME | 1.06 | | |
| NS5 | 3105 | 1.06 | 4 | 3 | 0 | yes | MEAQLIRQMEG | 62.12 | MEAQLVRQMEG | 36.46 | MEVQLIRQMEG | 1.06 | | |
| NS5 | 3106 | 1.06 | 4 | 3 | 0 | yes | EAQLIRQMEGE | 62.12 | EAQLVRQMEGE | 36.46 | EVQLIRQMEGE | 1.06 | | |
| NS5 | 3107 | 1.11 | 6 | 4 | 0 | yes | AQLIRQMEGEG | 61.95 | AQLVRQMEGEG | 35.93 | VQLIRQMEGEG | 1.06 | AQLVRQMEGED | 0.53 | |
| NS5 | 3108 | 1.01 | 4 | 2 | 0 | yes | QLIRQMEGEGV | 63.01 | QLVRQMEGEGV | 36.28 | | | | |
| NS5 | 3109 | 1.01 | 4 | 2 | 0 | yes | LIRQMEGEGVL | 63.01 | LVRQMEGEGVL | 36.28 | | | | |
| NS5 | 3110 | 1.46 | 7 | 4 | 0 | yes | IRQMEGEGVLS | 60.53 | VRQMEGEGVLS | 27.43 | VRQMEGEGVLT | 8.85 | IRQMEGEGVLT | 2.3 | |
| NS5 | 3111 | 0.67 | 5 | 3 | 0 | yes | RQMEGEGVLSK | 86.9 | RQMEGEGVLSE | 11.15 | RQMEGEGVLSE | 1.06 | | |
| NS5 | 3112 | 1.19 | 8 | 5 | 0 | yes | QMEGEGVLSKA | 77.35 | QMEGEGVLSKT | 11.15 | QMEGEGVLSKV | 6.37 | QMEGEGVLSKV | 3.19 | QMEGEGVLSEA | 1.06 |
| NS5 | 3135 | 0.51 | 10 | 5 | 0 | yes | TQWLETKGVER | 93.63 | TQWLETEGVER | 1.77 | AQWLETKGVER | 1.24 | TQWLENKGVER | 1.24 |
| NS5 | 3136 | 0.32 | 8 | 3 | 0 | yes | QWLETKGVERL | 96.11 | QWLETEGVERL | 1.77 | IQWLETKGVER | 1.24 | | |
| NS5 | 3137 | 0.61 | 9 | 4 | 0 | yes | WLETKGVERLK | 90.8 | WLETKGVERLR | 5.31 | QWLENKGVERL | 1.24 | | |
| NS5 | 3138 | 0.61 | 9 | 4 | 0 | yes | LETKGVERLKR | 90.8 | LETKGVERLRR | 5.31 | WLENKGVERLK | 1.24 | | |
| NS5 | 3139 | 0.61 | 9 | 4 | 0 | yes | ETKGVERLKRM | 90.8 | ETKGVERLRRM | 5.31 | LENKGVERLKR | 1.24 | | |
| NS5 | 3140 | 0.61 | 9 | 4 | 0 | yes | TKGVERLKRMA | 90.8 | TKGVERLRRMA | 5.31 | ENKGVERLKRM | 1.24 | | |
| NS5 | 3141 | 0.47 | 5 | 3 | 0 | yes | KGVERLKRMAI | 92.39 | KGVERLRRMAI | 5.31 | NKGVERLKRMA | 1.24 | | |
| NS5 | 3142 | 0.32 | 3 | 2 | 0 | yes | GVERLKRMAIS | 94.51 | GVERLRRMAIS | 5.31 | | | | |
| NS5 | 3143 | 0.32 | 3 | 2 | 0 | yes | VERLKRMAISG | 94.51 | VERLRRMAISG | 5.31 | | | | |
| NS5 | 3144 | 0.32 | 3 | 2 | 0 | yes | ERLKRMAISGD | 94.51 | ERLRRMAISGD | 5.31 | | | | |
| NS5 | 3145 | 0.3 | 2 | 2 | 0 | yes | RLKRMAISGDD | 94.69 | RLRRMAISGDD | 5.31 | | | | |
| NS5 | 3146 | 0.3 | 2 | 2 | 0 | yes | LKRMAISGDDC | 94.69 | LRRMAISGDDC | 5.31 | | | | |

FIG. 13-113

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---------|------|------|---|---|---|-----|------------|-------|------------|------|
| NS5 | 3147 | 0.3 | 2 | 2 | 0 | yes | KRMAISGDDCV | 94.69 | RRMAISGDDCV | 5.31 |
| NS5 | 3148 | 0 | 1 | 1 | 0 | yes | RMAISGDDCVV | 100 | | |
| NS5 | 3149 | 0 | 1 | 1 | 0 | yes | MAISGDDCVVK | 100 | | |
| NS5 | 3150 | 0 | 1 | 1 | 0 | yes | AISGDDCVVKP | 100 | | |
| NS5 | 3151 | 0 | 1 | 1 | 0 | yes | ISGDDCVVKPI | 100 | | |
| NS5 | 3152 | 0 | 1 | 1 | 0 | yes | SGDDCVVKPID | 100 | | |
| NS5 | 3153 | 0 | 1 | 1 | 0 | yes | GDDCVVKPIDD | 100 | | |
| NS5 | 3154 | 0 | 1 | 1 | 0 | yes | DDCVVKPIDDR | 100 | | |
| NS5 | 3155 | 0 | 1 | 1 | 0 | yes | DCVVKPIDDRF | 100 | | |
| NS5 | 3156 | 0 | 1 | 1 | 0 | yes | CVVKPIDDRFA | 100 | | |
| NS5 | 3157 | 0.04 | 3 | 2 | 0 | yes | VVKPIDDRFAN | 99.65 | | |
| NS5 | 3158 | 0.04 | 3 | 2 | 0 | yes | VKPIDDRFANA | 99.65 | | |
| NS5 | 3159 | 0.04 | 3 | 2 | 0 | yes | KPIDDRFANAL | 99.65 | | |
| NS5 | 3160 | 0.2 | 5 | 2 | 0 | yes | PIDDRFANALL | 97.35 | PIDDRFANALF | 2.12 |
| NS5 | 3161 | 0.2 | 5 | 2 | 0 | yes | IDDRFANALLA | 97.35 | IDDRFANALFA | 2.12 |
| NS5 | 3162 | 0.2 | 5 | 2 | 0 | yes | DDRFANALLAL | 97.35 | DDRFANALFAL | 2.12 |
| NS5 | 3163 | 0.2 | 5 | 2 | 0 | yes | DRFANALLALN | 97.35 | DRFANALFALN | 2.12 |
| NS5 | 3164 | 0.2 | 5 | 2 | 0 | yes | RFANALLALND | 97.35 | RFANALFALND | 2.12 |
| NS5 | 3165 | 0.22 | 6 | 2 | 0 | yes | FANALLALNDM | 97.17 | FANALFALNDM | 2.12 |
| NS5 | 3166 | 0.22 | 6 | 2 | 0 | yes | ANALLALNDMG | 97.17 | ANALFALNDMG | 2.12 |
| NS5 | 3167 | 0.22 | 6 | 2 | 0 | yes | NALLALNDMGK | 97.17 | NALFALNDMGK | 2.12 |
| NS5 | 3168 | 0.2 | 5 | 2 | 0 | yes | ALLALNDMGKV | 97.35 | ALFALNDMGKV | 2.12 |
| NS5 | 3169 | 0.2 | 5 | 2 | 0 | yes | LLALNDMGKVR | 97.35 | LFALNDMGKVR | 2.12 |
| NS5 | 3170 | 0.2 | 5 | 2 | 0 | yes | LALNDMGKVRK | 97.35 | FALNDMGKVRK | 2.12 |
| NS5 | 3171 | 0.04 | 3 | 1 | 0 | yes | ALNDMGKVRKD | 99.65 | | |
| NS5 | 3172 | 0.06 | 4 | 1 | 0 | yes | LNDMGKVRKDI | 99.47 | | |

FIG. 13-114

Species: DENV3 (11-mers)

| protein | block starting position | block entropy | total peptides in block | peptides required to cover 99% of block | gap/X f

FIG. 13-115

| protein | block starting position | block entropy | total peptides in block (11-mers) | peptides required to cover 99% of block | gap/X fraction | 99% of block covered w/ <= 5 peptides? | peptides required to cover 99% of block | frequ

FIG. 13-116

Species: DENV3 (11-mers)

| protein | block starting position | block entropy | total peptides in block | peptides required to cover 99% of block | gap/X fraction | 99% of block covered w/ <= 5 peptides? | peptides required to cover 99

FIG. 13-117

Species: DENV3 (11-mers)

| protein

FIG. 13-118

Species: DENV3 (11-mers)

| protein | block starting position | block entropy | total peptides in block | peptides required to cover 99% of block | gap/X fraction | covered w/ <= 5 peptides? | peptides required to cover 99% of block | frequency | peptides

FIG. 13-119

Species: DENV3 (11-mers)

| protein | block starting position | block entropy | total peptides in block | peptides required to cover 99% of block | gap/X fraction | covered w/ <= 5 peptides? 99

FIG. 13-120

Species: DENV3 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required

FIG. 13-121

Species: DENV3 (11-mers)

| protein | block starting position | block entropy | total peptides in block | peptides required to cover 99% of block | gap/X fraction | covered w/ <= 5 peptides? 99% of block | block (to cover 99% of block) | frequency | block (to cover 99% of block) | frequency | block (to cover 99% of block) | frequency | block (to cover 99% of block) | frequency |
|---|---|---|---|---|---|---|---|---|---|---|---|---|---|---|
| NS5 | 3355 | 1.1 | 6 | 4 | 0 | yes | PTAIQQVRSLI | 60.88 | LTAIQQVRSLI | 37.35 | LTAIQQVRSLI | 0.71 | STAIQQVRSLI | 0.53 |
| NS5 | 3356 | 0.11 | 4 | 2 | 0 | yes | TAIQQVRSLIG | 98.76 | IAIQQVRSLIG | 0.71 | | | | |
| NS5 | 3357 | 0.86 | 5 | 2 | 0 | yes | AIQQVRSLIGN | 75.22 | AIQQVRSLIGD | 24.07 | | | | |
| NS5 | 3358 | 0.86 | 5 | 2 | 0 | yes | IQQVRSLIGNE | 75.22 | IQQVRSLIGDE | 24.07 | | | | |
| NS5 | 3359 | 0.86 | 5 | 2 | 0 | yes | QQVRSLIGNEE | 75.22 | QQVRSLIGDEE | 24.07 | | | | |
| NS5 | 3360 | 0.83 | 4 | 2 | 0 | yes | QVRSLIGNEEF | 75.58 | QVRSLIGDEEF | 24.07 | | | | |
| NS5 | 3361 | 0.86 | 5 | 2 | 0 | yes | VRSLIGNEEFL | 75.58 | VRSLIGDEEFL | 23.72 | | | | |
| NS5 | 3362 | 0.86 | 5 | 2 | 0 | yes | RSLIGNEEFLD | 75.58 | RSLIGDEEFLD | 23.72 | | | | |
| NS5 | 3363 | 0.86 | 5 | 2 | 0 | yes | SLIGNEEFLDY | 75.58 | SLIGDEEFLDY | 23.72 | | | | |
| NS5 | 3364 | 0.86 | 5 | 2 | 0 | yes | LIGNEEFLDYM | 75.58 | LIGDEEFLDYM | 23.72 | | | | |
| NS5 | 3365 | 0.86 | 5 | 2 | 0 | yes | IGNEEFLDYMP | 75.58 | IGDEEFLDYMP | 23.72 | | | | |
| NS5 | 3366 | 0.86 | 5 | 2 | 0 | yes | GNEEFLDYMPS | 75.58 | GDEEFLDYMPS | 23.72 | | | | |
| NS5 | 3367 | 0.86 | 5 | 2 | 0 | yes | NEEFLDYMPSM | 75.58 | DEEFLDYMPSM | 23.72 | | | | |
| NS5 | 3368 | 0.05 | 3 | 1 | 0 | yes | EEFLDYMPSMK | 99.47 | | | | | | |
| NS5 | 3369 | 0.05 | 3 | 1 | 0 | yes | EFLDYMPSMKR | 99.47 | | | | | | |
| NS5 | 3370 | 0.05 | 3 | 1 | 0 | yes | FLDYMPSMKRF | 99.47 | | | | | | |
| NS5 | 3371 | 0.09 | 4 | 1 | 0 | yes | LDYMPSMKRFR | 99.12 | | | | | | |
| NS5 | 3372 | 0.05 | 3 | 1 | 0 | yes | DYMPSMKRFRK | 99.47 | | | | | | |
| NS5 | 3373 | 0.05 | 3 | 1 | 0 | yes | YMPSMKRFRKE | 99.47 | | | | | | |
| NS5 | 3374 | 0.05 | 3 | 1 | 0 | yes | MPSMKRFRKEE | 99.47 | | | | | | |
| NS5 | 3375 | 0.05 | 3 | 1 | 0 | yes | PSMKRFRKEEE | 99.47 | | | | | | |
| NS5 | 3376 | 0.59 | 5 | 3 | 0 | yes | SMKRFRKEEES | 89.03 | SMKRFRKEEEL | 9.03 | SMKRFRKEEET | 1.42 | | |
| NS5 | 3377 | 0.58 | 4 | 3 | 0 | yes | MKRFRKEEESE | 89.2 | MKRFRKEEELE | 9.03 | MKRFRKEEETE | 1.42 | | |
| NS5 | 3378 | 0.58 | 4 | 3 | 0 | yes | KRFRKEEESEG | 89.2 | KRFRKEEELEG | 9.03 | KRFRKEEETEG | 1.42 | | |
| NS5 | 3379 | 0.62 | 5 | 3 | 0 | yes | RFRKEEESEGA | 88.67 | RFRKEEELEGA | 9.03 | RFRKEEETEGA | 1.42 | | |
| NS5 | 3380 | 0.62 | 5 | 3 | 0 | yes | FRKEEESEGAI | 88.67 | FRKEEELEGAI | 9.03 | FRKEEETEGAI | 1.42 | | |

FIG. 13-122

Species: DENV3 (11-mers)

| protein | block starting position | block entropy | total peptides in block | peptides required to cover 99% of block | gap/X fraction | 99% of block covered w/ <= 5 peptides? | |

FIG. 14-1

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required

FIG. 14-2

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 28 | 0.55 | 4 | 4 | 0 | Y | GLVKRFST | 91.26 | GLVKRFSS | 4.85 | | | | |
| anC | 29 | 0.55 | 4 | 4 | 0 | Y | LVKRFSTG | 91.26 | LVKRFSSG | 4.85 | | | | |
| anC | 30 | 0.55 | 4 | 4 | 0 | Y | VKRFSTGL | 91.26 | VKRFSSGL | 4.85 | | | | |
| anC | 31 | 0.55 | 4 | 4 | 0 | Y | KRFSTGLF | 91.26 | KRFSSGLF | 4.85 | | | | |
| anC | 32 | 0.55 | 4 | 4 | 0 | Y | RFSTGLFS | 91.26 | RFSSGLFS | 4.85 | | | | |
| anC | 33 | 0.55 | 4 | 4 | 0 | Y | FSTGLFSG | 91.26 | FSSGLFSG | 4.85 | | | | |
| anC | 34 | 0.55 | 4 | 4 | 0 | Y | STGLFSGK | 91.26 | SSGLFSGK | 4.85 | | | | |
| anC | 35 | 0.55 | 4 | 4 | 0 | Y | TGLFSGKG | 91.26 | SGLFSGKG | 4.85 | | | | |
| anC | 36 | 0.14 | 2 | 2 | 0 | Y | GLFSGKGP | 98.06 | GMLQGRGP | 1.94 | | | | |
| anC | 37 | 0.14 | 2 | 2 | 0 | Y | LFSGKGPL | 98.06 | MLQGRGPL | 1.94 | | | | |
| anC | 38 | 0.14 | 2 | 2 | 0 | Y | FSGKGPLR | 98.06 | LQGRGPLK | 1.94 | | | | |
| anC | 39 | 0.14 | 2 | 2 | 0 | Y | SGKGPLRM | 98.06 | QGRGPLKL | 1.94 | | | | |
| anC | 40 | 0.14 | 2 | 2 | 0 | Y | GKGPLRMV | 98.06 | GRGPLKLF | 1.94 | | | | |
| anC | 41 | 0.14 | 2 | 2 | 0 | Y | KGPLRMVL | 98.06 | RGPLKLFM | 1.94 | | | | |
| anC | 42 | 0.14 | 2 | 2 | 0 | Y | GPLRMVLA | 98.06 | GPLKLFMA | 1.94 | | | | |
| anC | 43 | 0.14 | 2 | 2 | 0 | Y | PLRMVLAF | 98.06 | PLKLFMAL | 1.94 | | | | |
| anC | 44 | 0.14 | 2 | 2 | 0 | Y | LRMVLAFI | 98.06 | LKLFMALV | 1.94 | | | | |
| anC | 45 | 0.14 | 2 | 2 | 0 | Y | RMVLAFIT | 98.06 | KLFMALVA | 1.94 | | | | |
| anC | 46 | 0.14 | 2 | 2 | 0 | Y | MVLAFITF | 98.06 | LFMALVAF | 1.94 | | | | |
| anC | 47 | 0.14 | 2 | 2 | 0 | Y | VLAFITFL | 98.06 | FMALVAFL | 1.94 | | | | |
| anC | 48 | 0.14 | 2 | 2 | 0 | Y | LAFITFLR | 98.06 | MALVAFLR | 1.94 | | | | |
| anC | 49 | 0.14 | 2 | 2 | 0 | Y | AFITFLRV | 98.06 | ALVAFLRF | 1.94 | | | | |
| anC | 50 | 0.14 | 2 | 2 | 0 | Y | FITFLRVL | 98.06 | LVAFLRFL | 1.94 | | | | |
| anC | 51 | 0.14 | 2 | 2 | 0 | Y | ITFLRVLS | 98.06 | VAFLRFLT | 1.94 | | | | |
| anC | 52 | 0.14 | 2 | 2 | 0 | Y | TFLRVLSI | 98.06 | AFLRFLTI | 1.94 | | | | |
| anC | 53 | 0.14 | 2 | 2 | 0 | Y | FLRVLSIP | 98.06 | FLRFLTIP | 1.94 | | | | |

FIG. 14-3

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| anC | 54 | 0.14 | 2 | 2 | 0 | Y | LRVLSIPP | 98.06 | LRF

FIG. 14-4

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 80 | 0.7 | 4 | 3 | 0 | Y | ILIGFRKE | 86.41 | ILTGFRKE | 10.68 | VLRGFRKE | 1.94 | | |
| anC | 81 | 0.63 | 3 | 3 | 0 | Y | LIGFRKEI | 87.38 | LTGFRKEI | 10.68 | LRGFRKEI | 1.94 | | |
| anC | 82 | 0.63 | 3 | 3 | 0 | Y | IGFRKEIG | 87.38 | TGFRKEIG | 10.68 | RGFRKEIG | 1.94 | | |
| anC | 83 | 0 | 1 | 1 | 0 | Y | GFRKEIGR | 100 | | | | | | |
| anC | 84 | 0 | 1 | 1 | 0 | Y | FRKEIGRM | 100 | | | | | | |
| anC | 85 | 0 | 1 | 1 | 0 | Y | RKEIGRML | 100 | | | | | | |
| anC | 86 | 0 | 1 | 1 | 0 | Y | KEIGRMLN | 100 | | | | | | |
| anC | 87 | 0 | 1 | 1 | 0 | Y | EIGRMLNI | 100 | | | | | | |
| anC | 88 | 0 | 1 | 1 | 0 | Y | IGRMLNIL | 100 | | | | | | |
| anC | 89 | 0 | 1 | 1 | 0 | Y | GRMLNILN | 100 | | | | | | |
| anC | 90 | 0.46 | 2 | 2 | 0 | Y | RMLNILNG | 90.29 | RMLNILNR | 9.71 | | | | |
| anC | 91 | 0.46 | 2 | 2 | 0 | Y | MLNILNGR | 90.29 | MLNILNRR | 9.71 | | | | |
| anC | 92 | 0.67 | 4 | 4 | 0 | Y | LNILNGRK | 88.35 | LNILNRRK | 7.77 | LNILNRRK | 1.94 | LNILNGRR | 1.94 |
| anC | 93 | 0.67 | 4 | 4 | 0 | Y | NILNGRKR | 88.35 | NILNRRKR | 7.77 | NILNRRKR | 1.94 | NILNGRRR | 1.94 |
| anC | 94 | 0.73 | 5 | 5 | 0 | Y | ILNGRKRS | 88.35 | ILNRRRS | 5.83 | ILNGRRRS | 1.94 | ILNRRKRS | 1.94 |
| anC | 95 | 0.73 | 5 | 5 | 0 | Y | LNGRKRST | 88.35 | LNRRRST | 5.83 | LNRRRTA | 1.94 | LNRRRTA | 1.94 |
| anC | 98 | 1.25 | 6 | 5 | 0 | Y | RKRSTITL | 74.76 | RKRSTMTL | 13.59 | RRSTVTLL | 6.8 | RKRSTVTL | 1.94 |
| anC | 99 | 1.25 | 6 | 5 | 0 | Y | KRSTITLL | 74.76 | KRSTMTLL | 13.59 | KRSTVTLL | 6.8 | KRSTVTLL | 1.94 |
| anC | 100 | 1.04 | 4 | 4 | 0 | Y | RSTITLLC | 74.76 | RSTMTLLC | 20.39 | RSTVTLLC | 2.91 | RTAGMIIM | 1.94 |
| anC | 101 | 1.04 | 4 | 4 | 0 | Y | STITLLCI | 74.76 | STMTLLCL | 20.39 | STVTLLCL | 2.91 | TAGMIIML | 1.94 |
| anC | 102 | 1.04 | 4 | 4 | 0 | Y | TITLLCLI | 74.76 | TMTLLCLI | 20.39 | TVTLLCLI | 2.91 | AGMIIMLI | 1.94 |
| anC | 103 | 1.04 | 4 | 4 | 0 | Y | ITLLCLIP | 74.76 | MTLLCLIP | 20.39 | VTLLCLIP | 2.91 | GMIIMLIP | 1.94 |
| anC | 104 | 0.14 | 2 | 2 | 0 | Y | TLLCLIPT | 98.06 | MIIMLIPT | 1.94 | | | | |
| anC | 105 | 0.87 | 4 | 4 | 0 | Y | LLCLIPTV | 83.5 | LLCLIPTA | 9.71 | LLCLIPTI | 4.85 | IIMLIPTV | 1.94 |
| anC | 106 | 0.87 | 4 | 4 | 0 | Y | LCLIPTVM | 83.5 | LCLIPTAM | 9.71 | LCLIPTIM | 4.85 | IMLIPTVM | 1.94 |
| anC | 107 | 0.87 | 4 | 4 | 0 | Y | CLIPTVMA | 83.5 | CLIPTAMA | 9.71 | CLIPTIMA | 4.85 | MLIPTVMA | 1.94 |

FIG. 14-5

Species: DENV4 (8-mers)

| protein | block starting position | block entropy | total peptides in block | peptides required to cover 99% of block | gap/X fraction | 99% of block covered w/ <= 5 peptides? | block | frequency | block (to cover 99%) | frequency | block (to cover 99%) | frequency | block (to cover 99%) | frequency |
|---|---|---|---|---|---|---|---|---|---|---|---|---|---|---|
| anC | 108 | 0.73 | 3 | 3 | 0 | Y | LIPTYMAF | 85.44 | LIPTAMAF | 9.71 | LIPTIMAF | 4.85 | | |
| anC | 109 | 1.14 | 4 | 4 | 0 | Y | IPTYMAFH | 76.7 | IPTAMAFH | 9.71 | IPTYMAFS | 8.74 | IPTIMAFH | 4.85 |
| anC | 110 | 1.14 | 4 | 4 | 0 | Y | PTYMAFHL | 76.7 | PTAMAFHL | 9.71 | PTYMAFSL | 8.74 | PTIMAFHL | 4.85 |
| anC | 111 | 1.27 | 5 | 5 | 0 | Y | TYMAFHLS | 74.76 | TAMAFHLS | 9.71 | TYMAFSLS | 8.74 | TIMAFHLS | 4.85 |
| anC | 112 | 1.31 | 6 | 5 | 0 | Y | YMAFHLST | 74.76 | AMAFHLST | 9.71 | YMAFSLST | 8.74 | IMAFHLST | 3.88 |
| anC | 113 | 0.64 | 4 | 3 | 0 | Y | MAFHLSTR | 88.35 | MAFSLSTR | 8.74 | MAFHLTTR | 1.94 | | |
| anC | 114 | 0.64 | 4 | 3 | 0 | Y | AFHLSTRD | 88.35 | AFSLSTRD | 8.74 | AFHLTTRN | 1.94 | | |
| anC | 115 | 0.64 | 4 | 3 | 0 | Y | FHLSTRDG | 88.35 | FSLSTRDG | 8.74 | FHLTTRNG | 1.94 | | |
| anC | 116 | 0.64 | 4 | 3 | 0 | Y | HLSTRDGE | 88.35 | SLSTRDGE | 8.74 | HLTTRNGE | 1.94 | | |
| prM | 117 | 0.22 | 3 | 2 | 0 | Y | LSTRDGEP | 97.09 | LTTRNGEP | 1.94 | | | | |
| prM | 118 | 0.22 | 3 | 2 | 0 | Y | STRDGEPL | 97.09 | TTRNGEPH | 1.94 | | | | |
| prM | 119 | 0.22 | 3 | 2 | 0 | Y | TRDGEPLM | 97.09 | TRNGEPHM | 1.94 | | | | |
| prM | 120 | 0.14 | 2 | 2 | 0 | Y | RDGEPLMI | 98.06 | RNGEPHMI | 1.94 | | | | |
| prM | 121 | 0.14 | 2 | 2 | 0 | Y | DGEPLMIV | 98.06 | NGEPHMIV | 1.94 | | | | |
| prM | 122 | 0.22 | 3 | 2 | 0 | Y | GEPLMIVA | 97.09 | GEPHMIVS | 1.94 | | | | |
| prM | 123 | 0.3 | 4 | 3 | 0 | Y | EPLMIVAK | 96.12 | EPHMIVSR | 1.94 | EPLMIVGK | 0.97 | | |
| prM | 124 | 0.3 | 4 | 3 | 0 | Y | PLMIVAKH | 96.12 | PHMIVSRQ | 1.94 | PLMIVARH | 0.97 | | |
| prM | 125 | 0.3 | 4 | 3 | 0 | Y | LMIVAKHE | 96.12 | HMIVSRQE | 1.94 | LMIVARHE | 0.97 | | |
| prM | 126 | 0.3 | 4 | 3 | 0 | Y | MIVAKHER | 96.12 | MIVSRQEK | 1.94 | MIVARHER | 0.97 | | |
| prM | 127 | 0.3 | 4 | 3 | 0 | Y | IVAKHERG | 96.12 | IVSRQEKG | 1.94 | IVGKHERG | 0.97 | | |
| prM | 128 | 0.3 | 4 | 3 | 0 | Y | VAKHERGR | 96.12 | VSRQEKGK | 1.94 | VGKHERGR | 0.97 | | |
| prM | 129 | 0.3 | 4 | 3 | 0 | Y | AKHERGRP | 96.12 | SRQEKGKS | 1.94 | GKHERGRP | 0.97 | | |
| prM | 130 | 0.22 | 3 | 2 | 0 | Y | KHERGRPL | 97.09 | RQEKGKSL | 1.94 | | | | |
| prM | 131 | 0.14 | 2 | 2 | 0 | Y | HERGRPLL | 98.06 | QEKGKSLL | 1.94 | | | | |
| prM | 132 | 0.14 | 2 | 2 | 0 | Y | ERGRPLLF | 98.06 | EKGKSLLF | 1.94 | | | | |
| prM | 133 | 0.14 | 2 | 2 | 0 | Y | RGRPLLFK | 98.06 | KGKSLLFK | 1.94 | | | | |

Additional coverage peptides (rows at positions 111 and 112):
- position 111: TVMAFHLT, frequency 1.94
- position 112: VMAFHLT, frequency 1.94

FIG. 14-6

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 134 | 0.14 | 2 | 2 | 0 | Y | GRPLLFKT | 98.06 | GKSLLFKT | 1.94 | | | | |
| prM | 135 | 0.14 | 2 | 2 | 0 | Y | RPLLFKTT | 98.06 | KSLLFKTE | 1.94 | | | | |
| prM | 136 | 0.14 | 2 | 2 | 0 | Y | PLLFKTTE | 98.06 | SLLFKTED | 1.94 | | | | |
| prM | 137 | 0.14 | 2 | 2 | 0 | Y | LLFKTTEG | 98.06 | LLFKTEDG | 1.94 | | | | |
| prM | 138 | 0.22 | 3 | 2 | 0 | Y | LFKTTEGI | 97.09 | LFKTEDGV | 1.94 | | | |

FIG. 14-7

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 160 | 0.28 | 3 | 3 | 0 | Y | EDTVTYKC | 96.12 | EDTVTYEC | 1.94 | | | | |
| prM | 161 | 0.28 | 3 | 3 | 0 | Y | DTVTYKCP | 96.12 | DTVTYECP | 1.94 | | | | |
| prM | 162 | 0.28 | 3 | 3 | 0 | Y | TVTYKCPL | 96.12 | TITYKCPL | 1.94 | | | | |
| prM | 163 | 0.28 | 3 | 3 | 0 | Y | VTYKCPLL | 96.12 | VTYECPLL | 1.94 | | | | |
| prM | 164 | 0.55 | 4 | 4 | 0 | Y | TYKCPLLI | 91.26 | TYECPLLV | 4.85 | | | | |
| prM | 165 | 0.55 | 4 | 4 | 0 | Y | YKCPLLVN | 91.26 | YECPLLVN | 4.85 | | | | |
| prM | 166 | 0.55 | 4 | 4 | 0 | Y | KCPLLVNT | 91.26 | KCPLLRQN | 4.85 | | | | |
| prM | 167 | 0.42 | 3 | 3 | 0 | Y | CPLLVNTE | 93.2 | CPLLRQNE | 4.85 | | | | |
| prM | 168 | 0.42 | 3 | 3 | 0 | Y | PLLVNTEP | 93.2 | PLLRQNEP | 4.85 | | | | |
| prM | 169 | 0.42 | 3 | 3 | 0 | Y | LLVNTEPE | 93.2 | LLRQNEPE | 4.85 | | | | |
| prM | 170 | 0.42 | 3 | 3 | 0 | Y | LVNTEPED | 93.2 | LRQNEPED | 4.85 | | | | |
| prM | 171 | 0.42 | 3 | 3 | 0 | Y | VNTEPEDI | 93.2 | RQNEPEDI | 4.85 | | | | |
| prM | 172 | 0.14 | 2 | 2 | 0 | Y | NTEPEDID | 98.06 | QNEPEDID | 1.94 | | | | |
| prM | 173 | 0.14 | 2 | 2 | 0 | Y | TEPEDIDC | 98.06 | NEPEDIDC | 1.94 | | | | |
| prM | 174 | 0 | 1 | 1 | 0 | Y | EPEDIDCW | 100 | | | | | | |
| prM | 175 | 0 | 1 | 1 | 0 | Y | PEDIDCWC | 100 | | | | | | |
| prM | 176 | 0 | 1 | 1 | 0 | Y | EDIDCWCN | 100 | | | | | | |
| prM | 177 | 0.19 | 2 | 2 | 0 | Y | DIDCWCNL | 97.09 | DIDCWCNS | 2.91 | | | | |
| prM | 178 | 0.19 | 2 | 2 | 0 | Y | IDCWCNLT | 97.09 | IDCWCNST | 2.91 | | | | |
| prM | 179 | 0.27 | 3 | 2 | 0 | Y | DCWCNLTS | 96.12 | DCWCNSTS | 2.91 | | | | |
| prM | 180 | 0.62 | 4 | 3 | 0 | Y | CWCNLTST | 89.32 | CWCNLTSA | 6.8 | CWCNSTST | 2.91 | | |
| prM | 181 | 0.62 | 4 | 3 | 0 | Y | WCNLTSTW | 89.32 | WCNLTSAW | 6.8 | WCNSTSTW | 2.91 | | |
| prM | 182 | 0.62 | 4 | 3 | 0 | Y | CNLTSTWV | 89.32 | CNLTSAWV | 6.8 | CNSTSTWV | 2.91 | | |
| prM | 183 | 0.62 | 4 | 3 | 0 | Y | NLTSTWVM | 89.32 | NLTSAWVM | 6.8 | NSTSTWVT | 2.91 | | |
| prM | 184 | 0.62 | 4 | 3 | 0 | Y | LTSTWVMY | 89.32 | LTSAWVMY | 6.8 | STSTWVTY | 2.91 | | |
| prM | 185 | 0.62 | 4 | 3 | 0 | Y | TSTWVMYG | 89.32 | TSAWVMYG | 6.8 | TSTWVTYG | 2.91 | | |

FIG. 14-8

Species: DENV4 (8-mers)

|

FIG. 14-9

Species: DENV4 (8-mers)

| protein | block starting position | block entropy | total peptides in block | peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 212 | 0.

FIG. 14-10

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 238 | 0.22 | 3 | 2 | 0 | Y | ESWILRNP | 97.09 | ETWILRHP | 1.94 | | | | |
| prM | 239 | 0.22 | 3 | 2 | 0 | Y | SWILRNPG | 97.09 | TWILRHPG | 1.94 | | | | |
| prM | 240 | 0.22 | 3 | 2 | 0 | Y | WILRNPGF | 97.09 | WILRHPGF | 1.94 | | | | |
| prM | 241 | 0.22 | 3 | 2 | 0 | Y | ILRNPGFA | 97.09 | ILRHPGFT | 1.94 | | | | |
| prM | 242 | 0.14 | 2 | 2 | 0 | Y | LRNPGFAL | 98.06 | LRHPGFTI | 1.94 | | | | |
| prM | 243 | 0.14 | 2 | 2 | 0 | Y | RNPGFALL | 98.06 | RHPGFTIM | 1.94 | | | | |
| prM | 244 | 0.14 | 2 | 2 | 0 | Y | NPGFALLA | 98.06 | HPGFTIMA | 1.94 | | | | |
| prM | 245 | 0.14 | 2 | 2 | 0 | Y | PGFALLAG | 98.06 | PGFTIMAA | 1.94 | | | | |
| prM | 246 | 0.14 | 2 | 2 | 0 | Y | GFALLAGF | 98.06 | GFTIMAAI | 1.94 | | | | |
| prM | 247 | 0.14 | 2 | 2 | 0 | Y | FALLAGFM | 98.06 | FTIMAAIL | 1.94 | | | | |
| prM | 248 | 0.14 | 2 | 2 | 0 | Y | ALLAGFMA | 98.06 | TIMAAILA | 1.94 | | | | |
| prM | 249 | 0.14 | 2 | 2 | 0 | Y | LLAGFMAY | 98.06 | IMAAILAY | 1.94 | | | | |
| prM | 250 | 0.14 | 2 | 2 | 0 | Y | LAGFMAYM | 98.06 | MAAILAYT | 1.94 | | | | |
| prM | 251 | 0.28 | 3 | 3 | 0 | Y | AGFMAYMI | 96.12 | AGFMAYMV | 1.94 | AAILAYTI | 1.94 | | |
| prM | 252 | 0.28 | 3 | 3 | 0 | Y | GFMAYMIG | 96.12 | AILAYTIG | 1.94 | GFMAYMVG | 1.94 | | |
| prM | 253 | 0.28 | 3 | 3 | 0 | Y | FMAYMIGQ | 96.12 | FMAYMVGQ | 1.94 | ILAYTIGT | 1.94 | | |
| prM | 254 | 0.28 | 3 | 3 | 0 | Y | MAYMIGQT | 96.12 | MAYMVGQT | 1.94 | LAYTIGTT | 1.94 | | |
| prM | 255 | 0.35 | 4 | 3 | 0 | Y | AYMIGQTG | 95.15 | AYMVGQTG | 1.94 | AYTIGTTH | 1.94 | | |
| prM | 256 | 0.35 | 4 | 3 | 0 | Y | YMIGQTGI | 95.15 | YMVGQTGI | 1.94 | YTIGTTHF | 1.94 | | |
| prM | 257 | 0.35 | 4 | 3 | 0 | Y | MIGQTGII | 95.15 | TIGTTHFQ | 1.94 | MVGQTGIQ | 1.94 | | |
| prM | 258 | 0.35 | 4 | 3 | 0 | Y | IGQTGIQR | 95.15 | IGTTHFQR | 1.94 | VGQTGIQR | 1.94 | | |
| prM | 259 | 0.3 | 4 | 3 | 0 | Y | GQTGIQRT | 96.12 | GTTHFQRA | 1.94 | GQTRIQRT | 0.97 | | |
| prM | 260 | 0.37 | 5 | 4 | 0 | Y | QTGIQRTV | 95.15 | TTHFQRAL | 1.94 | QTGIQRAV | 0.97 | QTRIQRTV | 0.97 |
| prM | 261 | 0.37 | 5 | 4 | 0 | Y | TGIQRTVF | 95.15 | THFQRALI | 1.94 | TGIQRAVF | 0.97 | TGIQRTIF | 0.97 |
| prM | 262 | 0.37 | 5 | 4 | 0 | Y | GIQRTVFF | 95.15 | HFQRALIF | 1.94 | RIQRTVFF | 0.97 | GIQRAVFF | 0.97 |
| prM | 263 | 0.53 | 5 | 4 | 0 | Y | IQRTVFFV | 92.23 | IQRTVFFI | 3.88 | FQRALIFI | 1.94 | IQRAVFFV | 0.97 |

FIG. 14-11

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|

FIG. 14-12

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 290 | 0 | 1 | 1 | 0 | Y | DFVEGVSG | 100 | | | | | | |
| E | 291 | 0 | 1 | 1 | 0 | Y | FVEGVSGG | 100 | | | | | | |
| E | 292 | 0.3 | 4 | 3 | 0 | Y | VEGVSGGA | 96.12 | VEGVSGGS | 1.94 | VEGVSGGV | 0.97 | | |
| E | 293 | 0.3 | 4 | 3 | 0 | Y | EGVSGGAW | 96.12 | EGVSGGSW | 1.94 | EGVSGGTW | 0.97 | | |
| E | 294 | 0.3 | 4 | 3 | 0 | Y | GVSGGAWV | 96.12 | GVSGGSWV | 1.94 | GVSGGTWV | 0.97 | | |
| E | 295 | 0.3 | 4 | 3 | 0 | Y | VSGGAWVD | 96.12 | VSGGSWVD | 1.94 | VSGGWVD | 0.97 | | |
| E | 296 | 0.3 | 4 | 3 | 0 | Y | SGGAWVDL | 96.12 | SGGSWVDI | 1.94 | SGGTWVDL | 0.97 | | |
| E | 297 | 0.3 | 4 | 3 | 0 | Y | GGAWVDLV | 96.12 | GGSWVDIV | 1.94 | GGTWVDLV | 0.97 | | |
| E | 298 | 0.3 | 4 | 3 | 0 | Y | GAWVDLVL | 96.12 | GSWVDIVL | 1.94 | GWVDLVL | 0.97 | | |
| E | 299 | 0.3 | 4 | 3 | 0 | Y | AWVDLVLE | 96.12 | SWVDIVLE | 1.94 | TWVDLVLE | 0.97 | | |
| E | 300 | 0.14 | 2 | 2 | 0 | Y | WVDLVLEH | 98.06 | WVDIVLEH | 1.94 | | | | |
| E | 301 | 0.14 | 2 | 2 | 0 | Y | VDLVLEHG | 98.06 | VDIVLEHG | 1.94 | | | | |
| E | 302 | 0.14 | 2 | 2 | 0 | Y | DLVLEHGG | 98.06 | DIVLEHGS | 1.94 | | | | |
| E | 303 | 0.14 | 2 | 2 | 0 | Y | LVLEHGCV | 98.06 | IVLEHGSC | 1.94 | | | | |
| E | 304 | 0.14 | 2 | 2 | 0 | Y | VLEHGGCV | 98.06 | VLEHGSCV | 1.94 | | | | |
| E | 305 | 0.14 | 2 | 2 | 0 | Y | LEHGGCVT | 98.06 | LEHGSCVT | 1.94 | | | | |
| E | 306 | 0.14 | 2 | 2 | 0 | Y | EHGGCVTT | 98.06 | EHGSCVTT | 1.94 | | | | |
| E | 307 | 0.14 | 2 | 2 | 0 | Y | HGGCVTTM | 98.06 | HGSCVTTM | 1.94 | | | | |
| E | 308 | 0.14 | 2 | 2 | 0 | Y | GGCVTTMA | 98.06 | GSCVTTMA | 1.94 | | | | |
| E | 309 | 0.14 | 2 | 2 | 0 | Y | GCVTTMAQ | 98.06 | SCVTTMAK | 1.94 | | | | |
| E | 310 | 0.14 | 2 | 2 | 0 | Y | CVTTMAQG | 98.06 | CVTTMAKN | 1.94 | | | | |
| E | 311 | 0.14 | 2 | 2 | 0 | Y | VTTMAQGK | 98.06 | VTTMAKNK | 1.94 | | | | |
| E | 312 | 0.14 | 2 | 2 | 0 | Y | TTMAQGKP | 98.06 | TTMAKNKP | 1.94 | | | | |
| E | 313 | 0.14 | 2 | 2 | 0 | Y | TMAQGKPT | 98.06 | TMAKNKPT | 1.94 | | | | |
| E | 314 | 0.14 | 2 | 2 | 0 | Y | MAQGKPTL | 98.06 | MAKNKPTL | 1.94 | | | | |
| E | 315 | 0.14 | 2 | 2 | 0 | Y | AQGKPTLD | 98.06 | AKNKPTLD | 1.94 | | | | |

FIG. 14-13

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency |
|---|---|---|---|---|---|---|---|---|

FIG. 14-14

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 342 | 1.15 | 4 | 3 | 0 | Y | EASISNIT | 60

FIG. 14-15

Species: DENV4 (8-mers)

| protein | block starting position | block entropy | total peptides in block | peptides required to cover 99% of block | gap/X fraction | covered w/ <= 5 peptides? | block | frequency | block | frequency | block | frequency | block | frequency | block | frequency |
|---|---|---|---|---|---|---|---|---|---|---|---|---|---|---|---|---|
| E | 368 | 0.3 | 4 | 3 | 0 | Y | QQYICRRD | 96.12 | KRFVCKHS | 1.94 | RQYICRRD | 0.97 | | | | |
| E | 369 | 0.35 | 4 | 3 | 0 | Y | QYICRRDV | 95.15 | RFVCKHSM | 1.94 | QYICRRDM | 1.94 | | | | |
| E | 370 | 0.35 | 4 | 3 | 0 | Y | YICRRDW | 95.15 | YICRRDMV | 1.94 | FVCKHSMV | 1.94 | | | | |
| E | 371 | 0.35 | 4 | 3 | 0 | Y | ICRRDVVD | 95.15 | VCKHSMVD | 1.94 | ICRRDMVD | 1.94 | | | | |
| E | 372 | 0.35 | 4 | 3 | 0 | Y | CRRDVVDR | 95.15 | CRRDMVDR | 1.94 | CKHSMVDR | 1.94 | | | | |
| E | 373 | 0.35 | 4 | 3 | 0 | Y | RRDVVDRG | 95.15 | KHSMVDRG | 1.94 | RRDMVDRG | 1.94 | | | | |
| E | 374 | 0.35 | 4 | 3 | 0 | Y | RDVVDRGW | 95.15 | RDMVDRGW | 1.94 | HSMVDRGW | 1.94 | | | | |
| E | 375 | 0.35 | 4 | 3 | 0 | Y | DVVDRGWG | 95.15 | SMVDRGWG | 1.94 | DMVDRGWG | 1.94 | | | | |
| E | 376 | 0.24 | 2 | 2 | 0 | Y | VVDRGWGN | 96.12 | MVDRGWGN | 3.88 | | | | | | |
| E | 377 | 0 | 1 | 1 | 0 | Y | VDRGWGNG | 100 | | | | | | | | |
| E | 378 | 0 | 1 | 1 | 0 | Y | DRGWGNGC | 100 | | | | | | | | |
| E | 379 | 0 | 1 | 1 | 0 | Y | RGWGNGCG | 100 | | | | | | | | |
| E | 380 | 0 | 1 | 1 | 0 | Y | GWGNGCGL | 100 | | | | | | | | |
| E | 381 | 0 | 1 | 1 | 0 | Y | WGNGCGLF | 100 | | | | | | | | |
| E | 382 | 0 | 1 | 1 | 0 | Y | GNGCGLFG | 100 | | | | | | | | |
| E | 383 | 0 | 1 | 1 | 0 | Y | NGGLFGK | 100 | | | | | | | | |
| E | 384 | 0 | 1 | 1 | 0 | Y | GCGLFGKG | 100 | | | | | | | | |
| E | 385 | 0 | 1 | 1 | 0 | Y | CGLFGKGG | 100 | | | | | | | | |
| E | 386 | 0.14 | 2 | 2 | 0 | Y | GLFGKGGV | 98.06 | GLFGKGGI | 1.94 | | | | | | |
| E | 387 | 0.14 | 2 | 2 | 0 | Y | LFGKGGW | 98.06 | LFGKGGIV | 1.94 | | | | | | |
| E | 388 | 0.14 | 2 | 2 | 0 | Y | FGKGGVT | 98.06 | FGKGGIVT | 1.94 | | | | | | |
| E | 389 | 0.14 | 2 | 2 | 0 | Y | GKGGVTC | 98.06 | GKGGIVTC | 1.94 | | | | | | |
| E | 390 | 0.14 | 2 | 2 | 0 | Y | KGGWTCA | 98.06 | KGGIVTCA | 1.94 | | | | | | |
| E | 391 | 0.14 | 2 | 2 | 0 | Y | GGWTCAK | 98.06 | GGIVTCAM | 1.94 | | | | | | |
| E | 392 | 0.14 | 2 | 2 | 0 | Y | GWTCAKF | 98.06 | GIVTCAMF | 1.94 | | | | | | |
| E | 393 | 0.56 | 3 | 3 | 0 | Y | WTCAKFS | 89.32 | WTCAKFL | 8.74 | IVTCAMFT | 1.94 | | | | |

FIG. 14-16

Species: DENV4 (8-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 394 | 0.56 | 3 | 3 | 0 | Y | VTCAKFSC | 89.32 | VTCAKFLC | 8.74 | VTCAMFTC | 1.94 | | |
| E | 395 | 0.56 | 3 | 3 | 0 | Y | TCAKFSCS | 89.32 | TCAKFLCS | 8.74 | TCAMFTCK | 1.94 | | |
| E | 396 | 0.56 | 3 | 3 | 0 | Y | CAKFSCSG | 89.32 | CAKFLCSG | 8.74 | CAMFTCKK | 1.94 | | |
| E | 397 | 0.56 | 3 | 3 | 0 | Y | AKFSCSGK | 89.32 | AKFLCSGK | 8.74 | AMFTCKKN | 1.94 | | |
| E | 398 | 0.56 | 3 | 3 | 0 | Y | KFSCSGKI | 89.32 | KFLCSGKI | 8.74 | MFTCKKNM | 1.94 | | |
| E | 399 | 0.56 | 3 | 3 | 0 | Y | FSCSGKIT | 89.32 | FLCSGKIT | 8.74 | FTCKKNME | 1.94 | | |
| E | 400 | 0.56 | 3 | 3 | 0 | Y | SCSGKITG | 89.32 | LCSGKITG | 8.74 | TCKKNMEG | 1.94 | | |
| E | 401 | 0.14 | 2 | 2 | 0 | Y | CSGKITGN | 98.06 | CKKNMEGK | 1.94 | | | | |
| E | 402 | 0.14 | 2 | 2 | 0 | Y | SGKITGNL | 98.06 | KKNMEGKV | 1.94 | | | | |
| E | 403 | 0.14 | 2 | 2 | 0 | Y | GKITGNLV | 98.06 | KNMEGKVV | 1.94 | | | | |
| E | 404 | 0.14 | 2 | 2 | 0 | Y | KITGNLVQ | 98.06 | NMEGKVVQ | 1.94 | | | | |
| E | 405 | 0.22 | 3 | 2 | 0 | Y | ITGNLVQI | 97.09 | MEGKVVQP | 1.94 | | | | |
| E | 406 | 0.22 | 3 | 2 | 0 | Y | TGNLVQIE | 97.09 | EGKVVQPE | 1.94 | | | | |
| E | 407 | 0.22 | 3 | 2 | 0 | Y | GNLVQIEN | 97.09 | GKVVQPEN | 1.94 | | | | |
| E | 408 | 0.22 | 3 | 2 | 0 | Y | NLVQIENL | 97.09 | KVVQPENL | 1.94 | | | | |
| E | 409 | 0.22 | 3 | 2 | 0 | Y | LVQIENLE | 97.09 | VVQPENLE | 1.94 | | | | |
| E | 410 | 0.22 | 3 | 2 | 0 | Y | VQIENLEY | 97.09 | VQPENLEY | 1.94 | | | | |
| E | 411 | 0.22 | 3 | 2 | 0 | Y | QIENLEYT | 97.09 | QPENLEYT | 1.94 | | | | |
| E | 412 | 0.22 | 3 | 2 | 0 | Y | IENLEYTV | 97.09 | PENLEYTI | 1.94 | | | | |
| E | 413 | 0.14 | 2 | 2 | 0 | Y | ENLEYTVV | 98.06 | ENLEYTIV | 1.94 | | | | |
| E | 414 | 0.14 | 2 | 2 | 0 | Y | NLEYTVVV | 98.06 | NLEYTIVI | 1.94 | | | | |
| E | 415 | 0.14 | 2 | 2 | 0 | Y | LEYTVVVT | 98.06 | LEYTIVIT | 1.94 | | | | |
| E | 416 | 0.14 | 2 | 2 | 0 | Y | EYTVVVTV | 98.06 | EYTIVITP | 1.94 | | | | |
| E | 417 | 0.14 | 2 | 2 | 0 | Y | YTVVVTVH | 98.06 | YTIVITPH | 1.94 | | | | |
| E | 418 | 0.14 | 2 | 2 | 0 | Y | TVVVTVHN | 98.06 | TIVITPHS | 1.94 | | | | |
| E | 419 | 0.14 | 2 | 2 | 0 | Y | VVVTVHNG | 98.06 | IVITPHSG | 1.94 | | | | |

FIG. 14-17

Species: DENV4 (8-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 420 | 0.14 | 2 | 2 | 0 | Y | WTVHNGD | 98.06 | VTP

FIG. 14-18

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 446 | 0.35 | 4 | 3 | 0 | Y | PRSPSVEV | 95.15 | PQSSITEA | 1.94 | | | | |
| E | 447 | 0.57 | 6 | 5 | 0 | Y | RSPSVEVK | 92.23 | QSSITEAE | 1.94 | RTPSVEVK | 1.94 | RSPSVEVQ | 0.97 |
| E | 448 | 0.57 | 6 | 5 | 0 | Y | SPSVEVKL | 92.23 | SSITEAEL | 1.94 | SPSVEVEL | 1.94 | SPSAEVKL | 0.97 |
| E | 449 | 0.43 | 5 | 4 | 0 | Y | PSVEVKLP | 94.17 | SITEAELT | 1.94 | PSVEVQLP | 0.97 | | |
| E | 450 | 0.43 | 5 | 4 | 0 | Y | SVEVKLPD | 94.17 | SVEVELPD | 1.94 | SVEVQLPD | 0.97 | | |
| E | 451 | 0.43 | 5 | 4 | 0 | Y | VEVKLPDY | 94.17 | TEAELTGY | 1.94 | AEVKLPDY | 0.97 | | |
| E | 452 | 0.35 | 4 | 3 | 0 | Y | EVKLPDYG | 95.15 | EAELTGYG | 1.94 | | | | |
| E | 453 | 0.35 | 4 | 3 | 0 | Y | VKLPDYGE | 95.15 | VELPDYGE | 1.94 | | | | |
| E | 454 | 0.35 | 4 | 3 | 0 | Y | KLPDYGEL | 95.15 | ELPDYGEL | 1.94 | | | | |
| E | 455 | 0.28 | 3 | 3 | 0 | Y | LPDYGELT | 96.12 | LPDYGELS | 1.94 | | | | |
| E | 456 | 0.28 | 3 | 3 | 0 | Y | PDYGELTL | 96.12 | PDYGELSL | 1.94 | | | | |
| E | 457 | 0.28 | 3 | 3 | 0 | Y | DYGELTLD | 96.12 | DYGELSLD | 1.94 | | | | |
| E | 458 | 0.28 | 3 | 3 | 0 | Y | YGELTLDC | 96.12 | YGELSLDC | 1.94 | | | | |
| E | 459 | 0.28 | 3 | 3 | 0 | Y | GELTLDCE | 96.12 | GTVTMECS | 1.94 | | | | |
| E | 460 | 0.28 | 3 | 3 | 0 | Y | ELTLDCEP | 96.12 | ELSLDCEP | 1.94 | | | | |
| E | 461 | 0.28 | 3 | 3 | 0 | Y | LTLDCEPR | 96.12 | VTMECSPR | 1.94 | | | | |
| E | 462 | 0.28 | 3 | 3 | 0 | Y | TLDCEPRS | 96.12 | SLDCEPRS | 1.94 | | | | |
| E | 463 | 0.14 | 2 | 2 | 0 | Y | LDCEPRSG | 98.06 | | | | | | |
| E | 464 | 0.14 | 2 | 2 | 0 | Y | DCEPRSGI | 98.06 | | | | | | |
| E | 465 | 0.14 | 2 | 2 | 0 | Y | CEPRSGID | 98.06 | | | | | | |
| E | 466 | 0.14 | 2 | 2 | 0 | Y | EPRSGIDF | 98.06 | | | | | | |
| E | 467 | 0.14 | 2 | 2 | 0 | Y | PRSGIDFN | 98.06 | | | | | | |
| E | 468 | 0.14 | 2 | 2 | 0 | Y | RSGIDFNE | 98.06 | | | | | | |
| E | 469 | 0.14 | 2 | 2 | 0 | Y | SGIDFNEM | 98.06 | | | | | | |
| E | 470 | 0.14 | 2 | 2 | 0 | Y | GIDFNEMI | 98.06 | | | | | | |
| E | 471 | 0.14 | 2 | 2 | 0 | Y | IDFNEMIL | 98.06 | | | | | | |

Species: DENV4 (8-mers)

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 503 | 0.28 | 3 | 3 | 0 | Y | GADTSE

FIG. 14-21

Species: D

FIG. 14-22

Species: DENV4 (8-mers)

| protein | block starting position | block entropy | total peptides in block | peptides required to cover 99% of block | gap/X fraction | 99% of block covered w/ <= 5 peptides? | block (peptides required to cover 99% of block) | frequency | block (peptides required to cover 99% of block) | frequency | block (peptides required to cover 99% of block) | frequency |
|---|---|---|---|---|---|---|---|---|---|---|---|---|
| E | 555 | 0.22 | 3 | 2 | 0 | Y | GNHMFA

FIG. 14-23

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 581 | 0.14 | 2 | 2 | 0 | Y | MCSGKFSI | 98.06 | MCTGKFKV | 1.94 | | | | |
| E | 582 | 0.14 | 2 | 2 | 0 | Y | CSGKFSID | 98.06 | CTGKFKVW | 1.94 | | | | |
| E | 583 | 0.28 | 3 | 3 | 0 | Y | SGKFSIDK | 96.12 | SGKFSIDR | 1.94 | TGKFKVWK | 1.94 | | |
| E | 584 | 0.28 | 3 | 3 | 0 | Y | GKFSIDKE | 96.12 | GKFSIDRE | 1.94 | GKFKVWKE | 1.94 | | |
| E | 585 | 0.28 | 3 | 3 | 0 | Y | KFSIDKEM | 96.12 | KFKVWKEI | 1.94 | KFSIDREM | 1.94 | | |
| E | 586 | 0.28 | 3 | 3 | 0 | Y | FSIDKEMA | 96.12 | FKVWKEIA | 1.94 | FSIDREMA | 1.94 | | |
| E | 587 | 0.28 | 3 | 3 | 0 | Y | SIDKEMAE | 96.12 | KVWKEIAE | 1.94 | SIDREMAE | 1.94 | | |
| E | 588 | 0.28 | 3 | 3 | 0 | Y | IDKEMAET | 96.12 | VWKEIAET | 1.94 | IDREMAET | 1.94 | | |
| E | 589 | 0.28 | 3 | 3 | 0 | Y | DKEMAETQ | 96.12 | WKEIAETQ | 1.94 | DREMAETQ | 1.94 | | |
| E | 590 | 0.28 | 3 | 3 | 0 | Y | KEMAETQH | 96.12 | KEIAETQH | 1.94 | REMAETQH | 1.94 | | |
| E | 591 | 0.14 | 2 | 2 | 0 | Y | EMAETQHG | 98.06 | EIAETQHG | 1.94 | | | | |
| E | 592 | 0.14 | 2 | 2 | 0 | Y | MAETQHGT | 98.06 | IAETQHGT | 1.94 | | | | |
| E | 593 | 0.22 | 3 | 3 | 0 | Y | AETQHGTT | 97.09 | AETQHGTI | 1.94 | | | | |
| E | 594 | 0.22 | 3 | 3 | 0 | Y | ETQHGTTV | 97.09 | ETQHGTIV | 1.94 | | | | |
| E | 595 | 0.3 | 4 | 3 | 0 | Y | TQHGTTVW | 96.12 | TQHGTIVI | 1.94 | TQHGTAVV | 0.97 | | |
| E | 596 | 0.3 | 4 | 3 | 0 | Y | QHGTTVWK | 96.12 | QHGTIVIR | 1.94 | QHGTAVVK | 0.97 | | |
| E | 597 | 0.3 | 4 | 3 | 0 | Y | HGTTVWKV | 96.12 | HGTIVIRV | 1.94 | HGTTVIKV | 0.97 | | |
| E | 598 | 0.3 | 4 | 3 | 0 | Y | GTTVWKVK | 96.12 | GTIVIRVQ | 1.94 | GTAVVKVK | 0.97 | | |
| E | 599 | 0.3 | 4 | 3 | 0 | Y | TTVWKVKY | 96.12 | TIVIRVQY | 1.94 | TTVIKVKY | 0.97 | | |
| E | 600 | 0.3 | 4 | 3 | 0 | Y | TVWKVKYE | 96.12 | IVIRVQYE | 1.94 | TVIKVKYE | 0.97 | | |
| E | 601 | 0.22 | 3 | 2 | 0 | Y | VWKVKYEG | 97.09 | VIRVQYEG | 1.94 | | | | |
| E | 602 | 0.49 | 4 | 3 | 0 | Y | VKVKYEGA | 92.23 | VKVKYEGT | 4.85 | IRVQYEGD | 1.94 | | |
| E | 603 | 0.42 | 3 | 3 | 0 | Y | KVKYEGAG | 93.2 | KVKYEGTG | 4.85 | RVQYEGDG | 1.94 | | |
| E | 604 | 0.42 | 3 | 3 | 0 | Y | VKYEGAGA | 93.2 | VKYEGTGA | 4.85 | VQYEGDGS | 1.94 | | |
| E | 605 | 0.42 | 3 | 3 | 0 | Y | KYEGAGAP | 93.2 | KYEGTGAP | 4.85 | QYEGDGSP | 1.94 | | |
| E | 606 | 0.42 | 3 | 3 | 0 | Y | YEGAGAPC | 93.2 | YEGTGAPC | 4.85 | YEGDGSPC | 1.94 | | |

FIG. 14-24

Species: DENV4 (8-mers)

| protein | block starting position | block entropy | total peptides in block | gap/X fraction | peptides required to cover 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 607 | 0.42 | 3 | 0 | 3 | Y | EGAGAPCK | 93.2 | EGTGAPCK | 4.85 | EGDGSPCK | 1.94 | | |
| E | 608 | 0.59 | 5 | 0 | 4 | Y | GAGAPCKV | 91.26 | GTGAPCKV | 3.88 | GDGSPCKI | 1.94 | GAGAPCKI | 1.94 |
| E | 609 | 0.59 | 5 | 0 | 4 | Y | AGAPCKVP | 91.26 | TGAPCKVP | 3.88 | AGAPCKIP | 1.94 | DGSPCKIP | 1.94 |
| E | 610 | 0.33 | 3 | 0 | 3 | Y | GAPCKVPI | 95.15 | GAPCKIPI | 2.91 | GSPCKIPF | 1.94 | | |
| E | 611 | 0.33 | 3 | 0 | 3 | Y | APCKVPIE | 95.15 | APCKIPIE | 2.91 | SPCKIPFE | 1.94 | | |
| E | 612 | 0.33 | 3 | 0 | 3 | Y | PCKVPIEI | 95.15 | PCKIPIEI | 2.91 | PCKIPFEI | 1.94 | | |
| E | 613 | 0.35 | 4 | 0 | 3 | Y | CKVPIEIR | 95.15 | CKIPIEIR | 1.94 | CKIPFEIM | 1.94 | | |
| E | 614 | 0.35 | 4 | 0 | 3 | Y | KVPIEIRD | 95.15 | KIPIEIRD | 1.94 | KIPFEIMD | 1.94 | | |
| E | 615 | 0.35 | 4 | 0 | 3 | Y | VPIEIRDV | 95.15 | IPEIRDV | 1.94 | IPFEIMDL | 1.94 | | |
| E | 616 | 0.22 | 2 | 0 | 2 | Y | PIEIRDVN | 97.09 | PEIMDLE | 1.94 | | | | |
| E | 617 | 0.22 | 2 | 0 | 2 | Y | IEIRDVNK | 97.09 | FEIMDLEK | 1.94 | | | | |
| E | 618 | 0.41 | 4 | 0 | 3 | Y | EIRDVNKE | 94.17 | EIMDLEKR | 2.91 | | | | |
| E | 619 | 0.48 | 5 | 0 | 4 | Y | IRDVNKEK | 93.2 | IMDLEKRH | 2.91 | IRDVNKKK | 1.94 | IKDMNKEK | 0.97 | DVNKERV | 0.97 |
| E | 620 | 0.48 | 5 | 0 | 4 | Y | RDVNKEKV | 93.2 | MDLEKRHV | 2.91 | RDVNKKKV | 1.94 | RDVNKERV | 0.97 | MNKEKVVG | 0.97 |
| E | 621 | 0.62 | 6 | 0 | 5 | Y | DVNKEKVV | 91.26 | DLEKRHVL | 2.91 | DVNKKKVV | 1.94 | DVNKEKVI | 1.94 | KVIGRVIS | 0.97 |
| E | 622 | 0.62 | 6 | 0 | 5 | Y | VNKEKVVG | 91.26 | LEKRHVLG | 2.91 | VNKKKVVG | 1.94 | VNKEKVIG | 1.94 | VIGRIISS | 0.97 |
| E | 623 | 0.54 | 5 | 0 | 4 | Y | NKEKVVGR | 92.23 | NKEKVIGR | 2.91 | NKKKVVGR | 1.94 | EKRHVLGR | 1.94 | GRIISSIP | 0.97 |
| E | 626 | 1.26 | 6 | 0 | 5 | Y | KVVGRIIS | 62.14 | KVVGRIIT | 33.01 | KVVGRIIS | 1.94 | RVVGRVIS | 0.97 | ISSIPLAE | 0.97 |
| E | 627 | 1.81 | 6 | 0 | 5 | Y | VVGRVISS | 36.89 | VVGRVISA | 33.01 | VVGRIISS | 1.94 | VLGRLITV | 1.94 | PIVTEKDS | 1.94 |
| E | 629 | 1.81 | 6 | 0 | 5 | Y | GRVISSTP | 35.92 | GRVISATP | 33.01 | GRIISSTP | 1.94 | GRLITVNP | 1.94 | AEYTNSVT | 1.94 |
| E | 632 | 1.68 | 6 | 0 | 5 | Y | ISSTPLAE | 51.46 | ISSTPAE | 27.18 | ISATPLAE | 1.94 | ITVNPIVT | 1.94 | TEKDSPVN | 1.94 |
| E | 636 | 1.02 | 5 | 0 | 4 | Y | PLAENTNS | 79.61 | PFAESTNS | 13.59 | PFAENTNS | 1.94 | PFAETNS | 1.94 | EKDSPVNI | 1.94 |
| E | 638 | 0.73 | 6 | 0 | 5 | Y | AENTNSVT | 89.32 | AESTNSVT | 2.91 | AENTNSAT | 2.91 | VTEKDSPV | 1.94 | | |
| E | 639 | 0.73 | 6 | 0 | 5 | Y | ENTNSVTN | 89.32 | ESTNSVTN | 2.91 | ENTNSATN | 2.91 | EYTNSVTN | 1.94 | | |
| E | 640 | 0.73 | 6 | 0 | 5 | Y | NTNSVTNI | 89.32 | NTNSATNI | 2.91 | STNSVTNI | 2.91 | YTNSVTNI | 1.94 | | |
| E | 641 | 0.41 | 4 | 0 | 3 | Y | TNSVTNIE | 94.17 | KDSPVNIE | 1.94 | TNSATNIE | 1.94 | | | | |

FIG. 14-25

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 642 | 0.41 | 4 | 3 | 0 | Y | NSVTNIEL | 94.17 | NSATNIEL | 2.91 | DSPVNIEA | 1.94 | | | | |
| E | 643 | 0.41 | 4 | 3 | 0 | Y | SVTNIELE | 94.17 | SATNIELE | 2.91 | SPVNIEAE | 1.94 | | | | |
| E | 644 | 0.41 | 4 | 3 | 0 | Y | VTNIELEP | 94.17 | ATNIELEP | 2.91 | PVNIEAEP | 1.94 | | | |

FIG. 14-26

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 668 | 0.22 | 3 | 2 | 0 | Y | TLHWFRKG | 97.09 | KLNWFKKG | 1.94 | | | | |
| E | 669 | 0.22 | 3 | 2 | 0 | Y | LHWFRKGS | 97.09 | LNWFKKGS | 1.94 | | | | |
| E | 670 | 0.22 | 3 | 2 | 0 | Y | HWFRKGSS | 97.09 | NWFKKGSS | 1.94 | | | | |
| E | 671 | 0.22 | 3 | 2 | 0 | Y | WFRKGSSI | 97.09 | WFKKGSSI | 1.94 | | | | |
| E | 672 | 0.22 | 3 | 2 | 0 | Y | FRKGSSIG | 97.09 | FKKGSSIG | 1.94 | | | | |
| E | 673 | 0.22 | 3 | 2 | 0 | Y | RKGSSIGK | 97.09 | KKGSSIGQ | 1.94 | | | | |
| E | 674 | 0.22 | 3 | 2 | 0 | Y | KGSSIGKM | 97.09 | KGSSIGQM | 1.94 | | | | |
| E | 675 | 0.28 | 3 | 3 | 0 | Y | GSSIGKMF | 96.12 | GSSIGKML | 1.94 | GSSIGQMF | 1.94 | | |
| E | 676 | 0.28 | 3 | 3 | 0 | Y | SSIGKMFE | 96.12 | SSIGKMLE | 1.94 | SSIGQMFE | 1.94 | | |
| E | 677 | 0.28 | 3 | 3 | 0 | Y | SIGKMFES | 96.12 | SIGQMFET | 1.94 | SIGKMLES | 1.94 | | |
| E | 678 | 0.28 | 3 | 3 | 0 | Y | IGKMFEST | 96.12 | IGQMFETT | 1.94 | IGKMLEST | 1.94 | | |
| E | 679 | 0.28 | 3 | 3 | 0 | Y | GKMFESTY | 96.12 | GKMLESTY | 1.94 | GQMFETTM | 1.94 | | |
| E | 680 | 0.28 | 3 | 3 | 0 | Y | KMFESTYR | 96.12 | KMLESTYR | 1.94 | QMFETTMR | 1.94 | | |
| E | 681 | 0.28 | 3 | 3 | 0 | Y | MFESTYRG | 96.12 | MFETTMRG | 1.94 | MLESTYRG | 1.94 | | |
| E | 682 | 0.28 | 3 | 2 | 0 | Y | FESTYRGA | 96.12 | FETTMRGA | 1.94 | LESTYRGA | 1.94 | | |
| E | 683 | 0.14 | 2 | 2 | 0 | Y | ESTYRGAK | 98.06 | ETTMRGAK | 1.94 | | | | |
| E | 684 | 0.14 | 2 | 2 | 0 | Y | STYRGAKR | 98.06 | TTMRGAKR | 1.94 | | | | |
| E | 685 | 0.14 | 2 | 2 | 0 | Y | TYRGAKRM | 98.06 | TMRGAKRM | 1.94 | | | | |
| E | 686 | 0.14 | 2 | 2 | 0 | Y | YRGAKRMA | 98.06 | MRGAKRMA | 1.94 | | | | |
| E | 687 | 0 | 1 | 1 | 0 | Y | RGAKRMAI | 100 | | | | | | |
| E | 688 | 0 | 1 | 1 | 0 | Y | GAKRMAIL | 100 | | | | | | |
| E | 689 | 0 | 1 | 1 | 0 | Y | AKRMAILG | 100 | | | | | | |
| E | 690 | 0.14 | 2 | 2 | 0 | Y | KRMAILGE | 98.06 | KRMAILGD | 1.94 | | | | |
| E | 691 | 0.14 | 2 | 2 | 0 | Y | RMAILGET | 98.06 | RMAILGDT | 1.94 | | | | |
| E | 692 | 0.14 | 2 | 2 | 0 | Y | MAILGETA | 98.06 | MAILGDTA | 1.94 | | | | |
| E | 693 | 0.14 | 2 | 2 | 0 | Y | AILGETAW | 98.06 | AILGDTAW | 1.94 | | | | |

FIG. 14-27

Species: DENV4 (8-mers)

FIG. 14-28

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 720 | 0.14 | 2 | 2 | 0 | Y | FGWYTTM | 98.06 | FGAIYGAA | 1.94 | | | | |
| E | 721 | 0.14 | 2 | 2 | 0 | Y | GSVYTTMF | 98.06 | GAIYGAAF | 1.94 | | | | |
| E | 722 | 0.14 | 2 | 2 | 0 | Y | SVYTTMFG | 98.06 | AIYGAAFS | 1.94 | | | | |
| E |

FIG. 14-29

Species: DENV4 (8-mers)

| protein | block starting position | block entropy | total peptides in block | peptides required to cover 99% of block | gap/X fraction | 99% of block covered w/ <= 5 peptides? | block to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 747 | 0.28 | 3 | 3 | 0 | Y | GTNSRN

FIG. 14-30

Species: DENV4 (8-mers)

| protein | block starting position | block entropy | total peptides in block | peptides required to cover 99% of block | gap/X fraction |

FIG. 14-31

Species: DENV4 (8-mers)

| protein | block starting position | block entropy | total peptides in block | peptides required to cover 99% of block | gap/X fraction | 99% of block covered w/ <= 5 peptides? | block |

FIG. 14-32

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 831 | 0.08 | 2 | 1 | 0 | Y | GIRSTTRL | 99.03 | | | | | | |
| NS1 | 832 | 0.08 | 2 | 1 | 0 | Y | IRSTRLE | 99.03 | | | | | | |
| NS1 | 833 | 0 | 1 | 1 | 0 | Y | RSTTRLEN | 100 | | |

FIG. 14-33

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS1 | 857 | 0.08 | 2 | 1 | 0 | Y | GGHDLTW | 99.03 | | | | | | |

FIG. 14-34

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 885 | 0 | 1 | 1 | 0 | Y | DLKYSWK

FIG. 14-35

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block

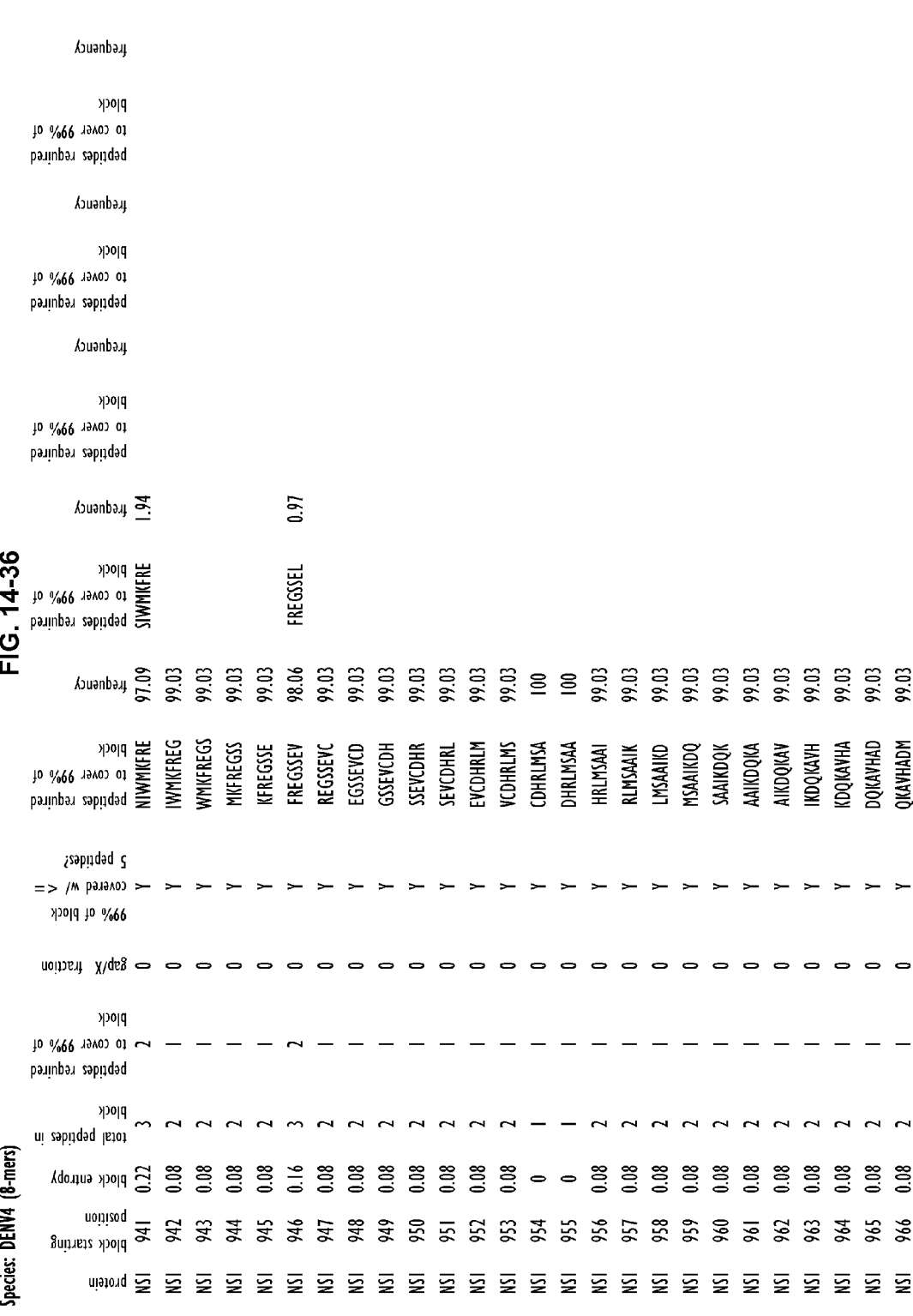

FIG. 14-37

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required

FIG. 14-38

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 993 | 0 | 1 | 1 | 0 | Y | IEVKTCLW | 100 | | | | | | |
| NS1 | 994 | 0 | 1 | 1 | 0 | Y | EVKTCLWP | 100 | | | | | | |
| NS1 | 995 | 0 | 1 | 1 | 0 | Y | VKTCLWPK | 100 | | | | | | |
| NS1 | 996 | 0 | 1 | 1 | 0 | Y | KTCLWPKT | 100 | | | | | | |
| NS1 | 997 | 0 | 1 | 1 | 0 | Y | TCLWPKTH | 100 | | | | | | |
| NS1 | 998 | 0 | 1 | 1 | 0 | Y | CLWPKTHT | 100 | | | | | | |
| NS1 | 999 | 0 | 1 | 1 | 0 | Y | LWPKTHTL | 100 | | | | | | |
| NS1 | 1000 | 0 | 1 | 1 | 0 | Y | WPKTHTLW | 100 | | | | | | |
| NS1 | 1001 | 0 | 1 | 1 | 0 | Y | PKTHTLWS | 100 | | | | | | |
| NS1 | 1002 | 0 | 1 | 1 | 0 | Y | KTHTLWSN | 100 | | | | | | |
| NS1 | 1003 | 0 | 1 | 1 | 0 | Y | THTLWSNG | 100 | | | | | | |
| NS1 | 1004 | 0 | 1 | 1 | 0 | Y | HTLWSNGV | 100 | | | | | | |
| NS1 | 1005 | 0 | 1 | 1 | 0 | Y | TLWSNGVL | 100 | | | | | | |
| NS1 | 1006 | 0 | 1 | 1 | 0 | Y | LWSNGVLE | 100 | | | | | | |
| NS1 | 1007 | 0 | 1 | 1 | 0 | Y | WSNGVLES | 100 | | | | | | |
| NS1 | 1008 | 0 | 1 | 1 | 0 | Y | SNGVLESQ | 100 | | | | | | |
| NS1 | 1009 | 0 | 1 | 1 | 0 | Y | NGVLESQM | 100 | | | | | | |
| NS1 | 1010 | 0 | 1 | 1 | 0 | Y | GVLESQML | 100 | | | | | | |
| NS1 | 1011 | 0 | 1 | 1 | 0 | Y | VLESQMLI | 100 | | | | | | |
| NS1 | 1012 | 0 | 1 | 1 | 0 | Y | LESQMLIP | 100 | | | | | | |
| NS1 | 1013 | 0.46 | 2 | 2 | 0 | Y | ESQMLIPK | 90.29 | ESQMLIPR | 9.71 | | | | |
| NS1 | 1014 | 0.92 | 4 | 3 | 0 | Y | SQMLIPKS | 81.55 | SQMLIPRS | 9.71 | SQMLIPKA | 7.77 | | |
| NS1 | 1015 | 0.92 | 4 | 3 | 0 | Y | QMLIPKSY | 81.55 | QMLIPRSY | 9.71 | QMLIPKAY | 7.77 | | |
| NS1 | 1016 | 0.92 | 4 | 3 | 0 | Y | MLIPKSYA | 81.55 | MLIPRSYA | 9.71 | MLIPKAYA | 7.77 | | |
| NS1 | 1017 | 0.92 | 4 | 3 | 0 | Y | LIPKSYAG | 81.55 | LIPRSYAG | 9.71 | LIPKAYAG | 7.77 | | |
| NS1 | 1018 | 0.92 | 4 | 3 | 0 | Y | IPKSYAGP | 81.55 | IPRSYAGP | 9.71 | IPKAYAGP | 7.77 | | |

FIG. 14-39

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 1019 | 0.98 | 5 | 4 | 0 | Y | PKSYAGPF | 81.55 | PRSYAGPF | 9.71 | PKAYAGPF | 5.83 | PKAYAGPI | 1.94 |
| NS1 | 1020 | 0.98 | 5 | 4 | 0 | Y | KSYAGPFS | 81.55 | RSYAGPFS | 9.71 | KAYAGPFS | 5.83 | KAYAGPIS | 1.94 |
| NS1 | 1021 | 0.72 | 5 | 4 | 0 | Y | SYAGPFSQ | 88.35 | AYAGPFSQ | 5.83 | SYAGPFSH | 2.91 | AYAGPISQ | 1.94 |
| NS1 | 1022 | 0.41 | 4 | 3 | 0 | Y | YAGPFSQH | 94.17 | YAGPFSHH | 2.91 | YAGPISQH | 1.94 | | |
| NS1 | 1023 | 0.41 | 4 | 3 | 0 | Y | AGPFSQHN | 94.17 | AGPFSHHN | 2.91 | AGPISQHN | 1.94 | | |
| NS1 | 1024 | 0.41 | 4 | 3 | 0 | Y | GPFSQHNY | 94.17 | GPFSHHNY | 2.91 | GPISQHNY | 1.94 | | |
| NS1 | 1025 | 0.41 | 4 | 3 | 0 | Y | PFSQHNYR | 94.17 | PFSHHNYR | 2.91 | PISQHNYR | 1.94 | | |
| NS1 | 1026 | 0.41 | 4 | 3 | 0 | Y | FSQHNYRQ | 94.17 | FSHHNYRQ | 2.91 | ISQHNYRQ | 1.94 | | |
| NS1 | 1027 | 0.19 | 2 | 2 | 0 | Y | SQHNYRQG | 97.09 | SHHNYRQG | 2.91 | | | | |
| NS1 | 1028 | 0.19 | 2 | 2 | 0 | Y | QHNYRQGY | 97.09 | HHNYRQGY | 2.91 | | | | |
| NS1 | 1029 | 0 | 1 | 1 | 0 | Y | HNYRQGYA | 100 | | | | | | |
| NS1 | 1030 | 0 | 1 | 1 | 0 | Y | NYRQGYAT | 100 | | | | | | |
| NS1 | 1031 | 0 | 1 | 1 | 0 | Y | YRQGYATQ | 100 | | | | | | |
| NS1 | 1032 | 0.14 | 2 | 2 | 0 | Y | RQGYATQT | 98.06 | RQGYATQI | 1.94 | | | | |
| NS1 | 1033 | 0.73 | 4 | 4 | 0 | Y | QGYATQTV | 87.38 | QGYATQTM | 5.83 | QGYATQTA | 4.85 | QGYATQIA | 1.94 |
| NS1 | 1034 | 0.73 | 4 | 4 | 0 | Y | GYATQTVG | 87.38 | GYATQTMG | 5.83 | GYATQTAG | 4.85 | GYATQIAG | 1.94 |
| NS1 | 1035 | 0.73 | 4 | 4 | 0 | Y | YATQTVGP | 87.38 | YATQTMGP | 5.83 | YATQTAGP | 4.85 | YATQIAGP | 1.94 |
| NS1 | 1036 | 0.73 | 4 | 4 | 0 | Y | ATQTVGPW | 87.38 | ATQTMGPW | 5.83 | ATQTAGPW | 4.85 | ATQIAGPW | 1.94 |
| NS1 | 1037 | 0.73 | 4 | 4 | 0 | Y | TQTVGPWH | 87.38 | TQTMGPWH | 5.83 | TQTAGPWH | 4.85 | TQIAGPWH | 1.94 |
| NS1 | 1038 | 0.73 | 4 | 4 | 0 | Y | QTVGPWHL | 87.38 | QTMGPWHL | 5.83 | QTAGPWHL | 4.85 | QIAGPWHL | 1.94 |
| NS1 | 1039 | 0.73 | 4 | 4 | 0 | Y | TVGPWHLG | 87.38 | TMGPWHLG | 5.83 | TAGPWHLG | 4.85 | IAGPWHLG | 1.94 |
| NS1 | 1040 | 0.67 | 3 | 3 | 0 | Y | VGPWHLGK | 87.38 | AGPWHLGK | 6.8 | MGPWHLGK | 5.83 | | |
| NS1 | 1041 | 0 | 1 | 1 | 0 | Y | GPWHLGKL | 100 | | | | | | |
| NS1 | 1042 | 0 | 1 | 1 | 0 | Y | PWHLGKLE | 100 | | | | | | |
| NS1 | 1043 | 0.08 | 2 | 1 | 0 | Y | WHLGKLEI | 99.03 | | | | | | |
| NS1 | 1044 | 0.16 | 3 | 2 | 0 | Y | HLGKLEID | 98.06 | HLGKLEMD | 0.97 | | | | |

FIG. 14-40

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 1045 | 0.16 | 3 | 2 | 0 | Y | LGKLEIDF | 98.06 | LGKLEIGF | 0.97 | | | | |
| NS1 | 1046 | 0.16 | 3 | 2 | 0 | Y | GKLEIDFG | 98.06 | GKLEIGFG | 0.97 | | | | |
| NS1 | 1047 | 0.16 | 3 | 2 | 0 | Y | KLEIDFGE | 98.06 | KLEMDFGE | 0.97 | | | | |
| NS1 | 1048 | 0.16 | 3 | 2 | 0 | Y | LEIDFGEC | 98.06 | LEMDFGEC | 0.97 | | | | |
| NS1 | 1049 | 0.16 | 3 | 2 | 0 | Y | EIDFGECP | 98.06 | EIGFGECP | 0.97 | | | | |
| NS1 | 1050 | 0.16 | 2 | 2 | 0 | Y | IDFGECPG | 98.06 | MDFGECPG | 0.97 | | | | |
| NS1 | 1051 | 0.08 | 1 | 1 | 0 | Y | DFGECPGT | 99.03 | | | | | | |
| NS1 | 1052 | 0 | 1 | 1 | 0 | Y | FGECPGTT | 100 | | | | | | |
| NS1 | 1053 | 0 | 1 | 1 | 0 | Y | GECPGTTV | 100 | | | | | | |
| NS1 | 1054 | 0.19 | 2 | 2 | 0 | Y | ECPGTTVT | 97.09 | ECPGTTVA | 2.91 | | | | |
| NS1 | 1055 | 0.33 | 3 | 3 | 0 | Y | CPGTTVTI | 95.15 | CPGTTVAI | 2.91 | CPGTTVTV | 0.97 | | |
| NS1 | 1056 | 0.35 | 3 | 3 | 0 | Y | PGTTVTIQ | 95.15 | PGTTVAIQ | 2.91 | PGTTVTVQ | 1.94 | | |
| NS1 | 1057 | 0.48 | 4 | 4 | 0 | Y | GTTVTIQE | 93.2 | GTTVAIQE | 2.91 | GTTVTIQD | 1.94 | GTTVTVQE | 0.97 |
| NS1 | 1058 | 1.25 | 6 | 5 | 0 | Y | TTVTIQED | 68.93 | TTVAIQED | 24.27 | TTVTIQED | 2.91 | TTVTIQDD | 1.94 |
| NS1 | 1059 | 1.25 | 6 | 5 | 0 | Y | TVTIQEDC | 68.93 | TVAIQEDC | 24.27 | TVTIQEDC | 2.91 | TVTIQDDC | 1.94 |
| NS1 | 1063 | 1.19 | 6 | 5 | 0 | Y | QEDCDHRG | 70.87 | QENCDHRG | 23.3 | QDDCDHRG | 1.94 | QEDCGHRG | 1.94 |
| NS1 | 1064 | 1.12 | 5 | 4 | 0 | Y | EDCDHRGP | 71.84 | ENCDHRGP | 23.3 | DDCDHRGP | 1.94 | EDCGHRGS | 1.94 |
| NS1 | 1065 | 0.99 | 4 | 3 | 0 | Y | DCDHRGPS | 73.79 | NCDHRGPS | 23.3 | DCGHRGSS | 1.94 | | |
| NS1 | 1066 | 0.22 | 3 | 2 | 0 | Y | CDHRGPSL | 97.09 | CGHRGSSL | 1.94 | | | | |
| NS1 | 1067 | 0.22 | 3 | 2 | 0 | Y | DHRGPSLR | 97.09 | GHRGSSLR | 1.94 | | | | |
| NS1 | 1068 | 0.14 | 2 | 2 | 0 | Y | HRGPSLRT | 98.06 | HRGSSLRT | 1.94 | | | | |
| NS1 | 1069 | 0.14 | 2 | 2 | 0 | Y | RGPSLRIT | 98.06 | RGSSLRIT | 1.94 | | | | |
| NS1 | 1070 | 0.14 | 2 | 2 | 0 | Y | GPSLRTTT | 98.06 | GSSLRTTT | 1.94 | | | | |
| NS1 | 1071 | 0.14 | 2 | 2 | 0 | Y | PSLRTTTA | 98.06 | SSLRTTTA | 1.94 | | | | |
| NS1 | 1072 | 0 | 1 | 1 | 0 | Y | SLRTTTAS | 100 | | | | | | |
| NS1 | 1073 | 0 | 1 | 1 | 0 | Y | LRTTTASG | 100 | | | | | | |

FIG. 14-41

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency |
|

FIG. 14-42

Species: DENV4 (8-mers)

| protein | block starting position | block entropy | total peptides in block | peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS1 | 1100 | 0 | 1 | 1 | 0 | Y | GEDGCWYG | 100 | |

FIG. 14-43

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1132 | 0.16 | 3 | 2 | 0 | Y | SETFSMGL | 98.06 | SETFFMGL | 0.97 | | | | |
| NS2A | 1133 | 0.08 | 2 | 1 | 0 | Y | ETFSMGLL | 99.03 | | | | | | |
| NS2A | 1134 | 0.08 | 2 | 1 | 0 | Y | TFSMGLLC | 99.03 | | | | | | |
| NS2A | 1135 | 0.08 | 2 | 1 | 0 | Y | FSMGLLCL | 99.03 | | | | | | |
| NS2A | 1136 | 0.08 | 2 | 1 | 0 | Y | SMGLLCLT | 99.03 | | | | | | |
| NS2A | 1137 | 0 | 1 | 1 | 0 | Y | MGLLCLTL | 100 | | | | | | |
| NS2A | 1138 | 0 | 1 | 1 | 0 | Y | GLLCLTLF | 100 | | | | | | |
| NS2A | 1139 | 0.42 | 3 | 3 | 0 | Y | LLCLTLFV | 93.2 | LLCLTLFM | 4.85 | LLCLTLFI | 1.94 | | |
| NS2A | 1140 | 0.42 | 3 | 3 | 0 | Y | LCLTLFVE | 93.2 | LCLTLFME | 4.85 | LCLTLFIE | 1.94 | | |
| NS2A | 1141 | 0.42 | 3 | 3 | 0 | Y | CLTLFVEE | 93.2 | CLTLFMEE | 4.85 | CLTLFIEE | 1.94 | | |
| NS2A | 1142 | 0.42 | 3 | 3 | 0 | Y | LTLFVEEC | 93.2 | LTLFMEEC | 4.85 | LTLFIEEC | 1.94 | | |
| NS2A | 1143 | 0.42 | 3 | 3 | 0 | Y | TLFVEECL | 93.2 | TLFMEECL | 4.85 | TLFIEECL | 1.94 | | |
| NS2A | 1144 | 0.42 | 3 | 3 | 0 | Y | LFVEECLR | 93.2 | LFMEECLR | 4.85 | LFIEECLR | 1.94 | | |
| NS2A | 1145 | 0.42 | 3 | 3 | 0 | Y | FVEECLRR | 93.2 | FMEECLRR | 4.85 | FIEECLRR | 1.94 | | |
| NS2A | 1146 | 0.42 | 3 | 3 | 0 | Y | VEECLRRR | 93.2 | MEECLRRR | 4.85 | IEECLRRK | 1.94 | | |
| NS2A | 1147 | 0.14 | 2 | 2 | 0 | Y | EECLRRRV | 98.06 | EECLRRKV | 1.94 | | | | |
| NS2A | 1148 | 0.14 | 2 | 2 | 0 | Y | ECLRRRVT | 98.06 | ECLRRKVT | 1.94 | | | | |
| NS2A | 1149 | 0.14 | 2 | 2 | 0 | Y | CLRRRVTR | 98.06 | CLRRKVTR | 1.94 | | | | |
| NS2A | 1150 | 0.14 | 2 | 2 | 0 | Y | LRRRVTRK | 98.06 | LRRKVTRK | 1.94 | | | | |
| NS2A | 1151 | 0.14 | 2 | 2 | 0 | Y | RRRVTRKH | 98.06 | RRKVTRKH | 1.94 | | | | |
| NS2A | 1152 | 0.14 | 2 | 2 | 0 | Y | RRVTRKHM | 98.06 | RKVTRKHM | 1.94 | | | | |
| NS2A | 1153 | 0.22 | 3 | 2 | 0 | Y | RVTRKHMI | 97.09 | KVTRKHMI | 1.94 | | | | |
| NS2A | 1154 | 0.08 | 2 | 1 | 0 | Y | VTRKHMIL | 99.03 | | | | | | |
| NS2A | 1155 | 1.05 | 3 | 2 | 0 | Y | TRKHMILA | 58.25 | TRKHMILV | 40.78 | | | | |
| NS2A | 1156 | 1.05 | 3 | 2 | 0 | Y | RKHMILAV | 58.25 | RKHMILVV | 40.78 | | | | |
| NS2A | 1157 | 1.16 | 4 | 3 | 0 | Y | KHMILAVW | 58.25 | KHMILVVW | 38.83 | KHMILVVA | 1.94 | | |

FIG. 14-44

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|

FIG. 14-45

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1189 | 0.57 | 5 | 4 | 0 | Y | DTMSGRIG | 91.26 | DTMSGRMG | 4.85 | DTMLSRVG | 1.94 | DTMSSRMG | 0.97 |
| NS2A | 1190 | 0.57 | 5 | 4 | 0 | Y | TMSGRIGG | 91.26 | TMSGRMGG | 4.85 | TMLSRVGG | 1.94 | TMSSRMGG | 0.97 |
| NS2A | 1191 | 0.57 | 5 | 4 | 0 | Y | MSGRIGGQ | 91.26 | MSGRMGGQ | 4.85 | MLSRVGGQ | 1.94 | MFGRMGGQ | 0.97 |
| NS2A | 1194 | 1.5 | 6 | 5 | 0 | Y | RIGGQTHL | 58.25 | RIGGQIHL | 31.07 | RMGGQIHL | 5.83 | RVGGQTHL | 1.94 |
| NS2A | 1195 | 1.5 | 6 | 5 | 0 | Y | IGGQTHLA | 58.25 | IGGQIHLA | 31.07 | MGGQIHLA | 5.83 | IGGQVHLA | 1.94 |
| NS2A | 1196 | 1.12 | 3 | 3 | 0 | Y | GGQTHLAI | 60.19 | GGQIHLAI | 36.89 | GGQVHLAI | 2.91 | | |
| NS2A | 1197 | 1.12 | 3 | 3 | 0 | Y | GQTHLAIM | 60.19 | GQIHLAIM | 36.89 | GQVHLAIM | 2.91 | | |
| NS2A | 1198 | 1.31 | 5 | 4 | 0 | Y | QTHLAIMA | 58.25 | QIHLAIMA | 35.92 | QVHLAIMA | 2.91 | QTHLAIMI | 1.94 |
| NS2A | 1199 | 1.31 | 5 | 4 | 0 | Y | THLAIMAV | 58.25 | IHLAIMAV | 35.92 | VHLAIMAV | 2.91 | THLAIMIV | 1.94 |
| NS2A | 1200 | 0.22 | 3 | 2 | 0 | Y | HLAIMAVF | 97.09 | HLAIMIVF | 1.94 | | | | |
| NS2A | 1201 | 0.22 | 3 | 2 | 0 | Y | LAIMAVFK | 97.09 | LAIMIVFK | 1.94 | | | | |
| NS2A | 1202 | 0.22 | 3 | 2 | 0 | Y | AIMAVFKM | 97.09 | AIMIVFKM | 1.94 | | | | |
| NS2A | 1203 | 0.22 | 3 | 2 | 0 | Y | IMAVFKMS | 97.09 | IMIVFKMS | 1.94 | | | | |
| NS2A | 1204 | 0.22 | 3 | 2 | 0 | Y | MAVFKMSP | 97.09 | MIVFKMSP | 1.94 | | | | |
| NS2A | 1205 | 0.22 | 3 | 2 | 0 | Y | AVFKMSPG | 97.09 | IVFKMSPG | 1.94 | | | | |
| NS2A | 1206 | 0.08 | 2 | 1 | 0 | Y | VFKMSPGY | 99.03 | | | | | | |
| NS2A | 1207 | 0 | 1 | 1 | 0 | Y | FKMSPGYV | 100 | | | | | | |
| NS2A | 1208 | 0 | 1 | 1 | 0 | Y | KMSPGYVL | 100 | | | | | | |
| NS2A | 1209 | 0 | 1 | 1 | 0 | Y | MSPGYVLG | 100 | | | | | | |
| NS2A | 1210 | 0.32 | 2 | 2 | 0 | Y | SPGYVLGV | 94.17 | SPGYVLGI | 5.83 | | | | |
| NS2A | 1211 | 0.32 | 2 | 2 | 0 | Y | PGYVLGVF | 94.17 | PGYVLGIF | 5.83 | | | | |
| NS2A | 1212 | 0.32 | 2 | 2 | 0 | Y | GYVLGVFL | 94.17 | GYVLGIFL | 5.83 | | | | |
| NS2A | 1213 | 0.32 | 2 | 2 | 0 | Y | YVLGVFLR | 94.17 | YVLGIFLR | 5.83 | | | | |
| NS2A | 1214 | 0.49 | 4 | 3 | 0 | Y | VLGVFLRK | 92.23 | VLGIFLRK | 4.85 | VLGVFLRR | 1.94 | | |
| NS2A | 1215 | 0.49 | 4 | 3 | 0 | Y | LGVFLRKL | 92.23 | LGIFLRKL | 4.85 | LGVFLRRL | 1.94 | | |
| NS2A | 1216 | 0.49 | 4 | 3 | 0 | Y | GVFLRKLT | 92.23 | GIFLRKLT | 4.85 | GVFLRRLT | 1.94 | | |

FIG. 14-46

Species: DENV4 (8-mers)

| protein | block starting position | block entropy | total peptides in block | peptides required to cover 99% of block | gap/X fraction | covered w/ <= 5 peptides? | block | frequency | peptides required to cover 99% of block | frequency | peptides required to cover 99% of block

FIG. 14-47

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1243 | 0.36 | 3 | 2 | 0 | Y | PHDLMELI | 94.17 | PHDLMEFI | 4.85 | | | | | | |
| NS2A | 1244 | 0.36 | 3 | 2 | 0 | Y | HDLMELID | 94.17 | HDLMEFID | 4.85 | | | | | | |
| NS2A | 1245 | 0.32 | 2 | 2 | 0 | Y | DLMELIDG | 94.17 | DLMEFIDG | 5.83 | | | | | | |
| NS2A | 1246 | 0.36 | 3 | 2 | 0 | Y | LMELIDGI | 94.17 | LMEFIDGI | 4.85 | | | | | | |
| NS2A | 1247 | 0.44 | 4 | 3 | 0 | Y | MELIDGIS | 93.2 | MEFIDGIS | 4.85 | MELIDGIA | 0.97 | | | | |
| NS2A | 1248 | 0.44 | 4 | 3 | 0 | Y | ELIDGISL | 93.2 | EFIDGISL | 4.85 | EFIDGISL | 0.97 | | | | |
| NS2A | 1249 | 0.44 | 4 | 3 | 0 | Y | LIDGISLG | 93.2 | FIDGISLG | 4.85 | FIDGISLG | 0.97 | | | | |
| NS2A | 1250 | 0.16 | 3 | 2 | 0 | Y | IDGISLGL | 98.06 | IDGIALGL | 0.97 | | | | | | |
| NS2A | 1251 | 0.16 | 3 | 2 | 0 | Y | DGISLGLI | 98.06 | DGIALGLI | 0.97 | | | | | | |
| NS2A | 1252 | 0.16 | 3 | 2 | 0 | Y | GISLGLII | 98.06 | GIALGLII | 0.97 | | | | | | |
| NS2A | 1253 | 0.16 | 3 | 2 | 0 | Y | ISLGLIIL | 98.06 | IALGLIIL | 0.97 | | | | | | |
| NS2A | 1254 | 0.08 | 2 | 1 | 0 | Y | SLGLIILK | 99.03 | | | | | | | | |
| NS2A | 1255 | 0.51 | 3 | 2 | 0 | Y | LGLIILKI | 90.29 | LGLIILKM | 8.74 | | | | | | |
| NS2A | 1256 | 0.51 | 3 | 2 | 0 | Y | GLIILKIV | 90.29 | GLIILKMV | 8.74 | | | | | | |
| NS2A | 1257 | 0.55 | 4 | 3 | 0 | Y | LIILKIVT | 90.29 | LIILKMVT | 7.77 | LIILKTVT | 0.97 | | | | |
| NS2A | 1258 | 1.1 | 5 | 4 | 0 | Y | IILKIVTQ | 76.7 | IILKMVTH | 13.59 | ILLKIVTH | 7.77 | ILLKMVYH | 0.97 | | |
| NS2A | 1259 | 1.1 | 5 | 4 | 0 | Y | LLKIVTQF | 76.7 | LLKIVTHF | 13.59 | LLKMVTHF | 7.77 | LLKMVWHF | 0.97 | | |
| NS2A | 1260 | 1.1 | 5 | 4 | 0 | Y | LKIVTQFD | 76.7 | LKIVTHFD | 13.59 | LKMVTHFD | 7.77 | LKMVWHFD | 0.97 | | |
| NS2A | 1263 | 1.05 | 6 | 5 | 0 | Y | VTQFDNTQ | 76.7 | VTHFDDTQ | 18.45 | VTHFDNTQ | 1.94 | VTHFDSTQ | 0.97 | VTQFDDTQ | 0.97 |
| NS2A | 1264 | 1.05 | 6 | 5 | 0 | Y | TQFDNTQV | 76.7 | THFDDTQV | 18.45 | THFDNTQV | 1.94 | THFDSTQV | 0.97 | VHFDNAQL | 0.97 |
| NS2A | 1265 | 1.05 | 6 | 5 | 0 | Y | QFDNTQVG | 76.7 | HFDDTQVG | 18.45 | HFDNTQVG | 1.94 | HFDSTQVG | 0.97 | HFDNAQLG | 0.97 |
| NS2A | 1266 | 0.35 | 4 | 3 | 0 | Y | FDNTQVGT | 95.15 | FDDTQVGT | 2.91 | FDSTQVGT | 0.97 | | | | |
| NS2A | 1267 | 0.35 | 4 | 3 | 0 | Y | DNTQVGTL | 95.15 | DDTQVGTL | 2.91 | DNAQLGTL | 0.97 | | | | |
| NS2A | 1268 | 0.35 | 4 | 3 | 0 | Y | NTQVGTLA | 95.15 | DTQVGTLA | 2.91 | NAQLGTLA | 0.97 | | | | |
| NS2A | 1269 | 0.08 | 2 | 1 | 0 | Y | TQVGTLAL | 99.03 | | | | | | | | |
| NS2A | 1270 | 0.16 | 3 | 2 | 0 | Y | QVGTLALS | 98.06 | QLGTLALS | 0.97 | | | | | | |

FIG. 14-48

Species: DENV4 (8-mers)

| protein | block starting position | block entropy | total peptides in block | peptides required to cover 99% of block | gap/X fraction | 99% of block covered w/ <= 5 peptides? | block (to cover 99% of block) | frequency | block (to cover 99% of block) | frequency | block (to cover 99% of block) | frequency | block (to cover 99% of block) | frequency |
|---|---|---|---|---|---|---|---|---|---|---|---|---|---|---|
| NS2A | 1271 | 0.16 | 3 | 2 | 0 | Y | VGTLALSL | 98.06 | LGTLALSL | 0.97 | | | | |
| NS2A | 1272 | 0.08 | 2 | 1 | 0 | Y | GTLALSLT | 99.03 | | | | | | |
| NS2A | 1273 | 0.08 | 2 | 1 | 0 | Y | TLALSLTF | 99.03 | | | | | | |
| NS2A | 1274 | 0.08 | 2 | 1 | 0 | Y | LALSLTFI | 99.03 | | | | | | |
| NS2A | 1275 | 0.35 | 4 | 3 | 0 | Y | ALSLTFIR | 95.15 | ALSLTFIK | 2.91 | ALALTFIK | 0.97 | | |
| NS2A | 1276 | 0.37 | 5 | 4 | 0 | Y | LSLTFIKS | 95.15 | LSLTFIKS | 1.94 | LALTFIKS | 0.97 | LSLTFISS | 0.97 |
| NS2A | 1277 | 0.37 | 5 | 4 | 0 | Y | SLTFIKST | 95.15 | SLTFISST | 1.94 | SLTFISST | 0.97 | SLTFIKTT | 0.97 |
| NS2A | 1278 | 0.87 | 6 | 5 | 0 | Y | LTFIRSTM | 85.44 | LTFIRSTT | 7.77 | LTFIKSTM | 2.91 | LTFIRSTI | 1.94 |
| NS2A | 1286 | 1.24 | 4 | 4 | 0 | Y | SLVMAWRT | 58.25 | PLVMAWRT | 36.89 | PLIMAWRT | 2.91 | PLTMAWRT | 1.94 |
| NS2A | 1287 | 0.33 | 3 | 3 | 0 | Y | LVMAWRTI | 95.15 | LIMAWRTI | 2.91 | LTMAWRTI | 1.94 | | |
| NS2A | 1288 | 0.33 | 3 | 3 | 0 | Y | VMAWRTIM | 95.15 | IMAWRTIM | 2.91 | TMAWRTIM | 1.94 | | |
| NS2A | 1289 | 0.08 | 2 | 1 | 0 | Y | MAWRTIMA | 99.03 | | | | | | |
| NS2A | 1290 | 0.08 | 2 | 1 | 0 | Y | AWRTIMAV | 99.03 | | | | | | |
| NS2A | 1291 | 0.47 | 3 | 2 | 0 | Y | WRTIMAVL | 91.26 | WRTIMAVF | 7.77 | | | | |
| NS2A | 1292 | 0.47 | 3 | 2 | 0 | Y | RTIMAVLF | 91.26 | RTIMAVFF | 7.77 | | | | |
| NS2A | 1293 | 0.61 | 4 | 3 | 0 | Y | TIMAVLFV | 89.32 | TIMAVFFV | 7.77 | TIMAVLFA | 1.94 | | |
| NS2A | 1294 | 0.61 | 4 | 3 | 0 | Y | IMAVLFVV | 89.32 | IMAVFFVV | 7.77 | IMAVLFAV | 1.94 | | |
| NS2A | 1295 | 0.61 | 4 | 3 | 0 | Y | MAVLFVWT | 89.32 | MAVFFVWT | 7.77 | MAVLFAVT | 1.94 | | |
| NS2A | 1296 | 0.61 | 4 | 3 | 0 | Y | AVLFVWTL | 89.32 | AVFFVWTL | 7.77 | AVLFAVTL | 1.94 | | |
| NS2A | 1297 | 0.53 | 3 | 3 | 0 | Y | VLFVWTLI | 90.29 | VFFVWTLI | 7.77 | VLFAVTLI | 1.94 | | |
| NS2A | 1298 | 0.53 | 3 | 3 | 0 | Y | LFVWTLIP | 90.29 | FFVWTLIP | 7.77 | LFAVTLIP | 1.94 | | |
| NS2A | 1299 | 0.14 | 2 | 2 | 0 | Y | FVWTLIPL | 98.06 | FAVTLIPL | 1.94 | | | | |
| NS2A | 1300 | 0.14 | 2 | 2 | 0 | Y | WTLIPLC | 98.06 | AVTLIPLC | 1.94 | | | | |
| NS2A | 1301 | 0 | 1 | 1 | 0 | Y | VTLIPLCR | 100 | | | | | | |
| NS2A | 1302 | 0 | 1 | 1 | 0 | Y | TLIPLCRT | 100 | | | | | | |
| NS2A | 1303 | 0 | 1 | 1 | 0 | Y | LIPLCRTS | 100 | | | | | | |

FIG. 14-49

Species: DENV4 (8-mers)

| protein | block starting position | block entropy | total peptides in block | peptides required to cover 99% of block | gap/X fraction | covered w/ <= 5 peptides? 99% of block | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1304 | 0 | 1 | 1 | 0 | Y | IPLCRTSC | 100 | | | | | | |
| NS2A | 1305 | 0 | 1 | 1 | 0 | Y | PLCRTSCL | 100 | | | | | | |
| NS2A | 1306 | 0 | 1 | 1 | 0 | Y | LCRTSCLQ | 100 | | | | | | |
| NS2A | 1307 | 0.08 | 2 | 1 | 0 | Y | CRTSCLQK | 99.03 | | | | | | |
| NS2A | 1308 | 0.08 | 2 | 1 | 0 | Y | RTSCLQKQ | 99.03 | | | | | | |
| NS2A | 1309 | 0.08 | 2 | 1 | 0 | Y | TSCLQKQS | 99.03 | | | | | | |
| NS2A | 1310 | 0.08 | 2 | 1 | 0 | Y | SCLQKQSH | 99.03 | | | | | | |
| NS2A | 1311 | 0.08 | 2 | 1 | 0 | Y | CLQKQSHW | 99.03 | | | | | | |
| NS2A | 1312 | 0.16 | 3 | 2 | 0 | Y | LQKQSHWV | 98.06 | LQNQSHWV | 0.97 | | | | |
| NS2A | 1313 | 0.16 | 3 | 2 | 0 | Y | QKQSHWVE | 98.06 | QKQSHWIE | 0.97 | | | | |
| NS2A | 1314 | 0.16 | 3 | 2 | 0 | Y | KQSHWVEI | 98.06 | KQSHWIEI | 0.97 | | | | |
| NS2A | 1315 | 0.08 | 2 | 1 | 0 | Y | QSHWVEIT | 99.03 | | | | | | |
| NS2A | 1316 | 0.08 | 2 | 1 | 0 | Y | SHWVEITA | 99.03 | | | | | | |
| NS2A | 1317 | 0.27 | 3 | 2 | 0 | Y | HWVEITAL | 96.12 | HWVEITAI | 2.91 | | | | |
| NS2A | 1318 | 0.41 | 4 | 3 | 0 | Y | WVEITALI | 94.17 | WVEITAII | 2.91 | WVEITALT | 1.94 | | |
| NS2A | 1319 | 0.41 | 4 | 3 | 0 | Y | VEITALIL | 94.17 | VEITAIIL | 2.91 | VEITALTL | 1.94 | | |
| NS2A | 1320 | 0.33 | 3 | 3 | 0 | Y | EITALILG | 95.15 | EITAIILG | 2.91 | EITALTLG | 1.94 | | |
| NS2A | 1321 | 0.33 | 3 | 3 | 0 | Y | ITALILGA | 95.15 | ITAIILGA | 2.91 | ITALTLGA | 1.94 | | |
| NS2A | 1322 | 0.33 | 3 | 3 | 0 | Y | TALILGAQ | 95.15 | TAIILGAQ | 2.91 | TALTLGAQ | 1.94 | | |
| NS2A | 1323 | 0.33 | 3 | 3 | 0 | Y | ALILGAQA | 95.15 | AIILGAQA | 2.91 | ALTLGAQA | 1.94 | | |
| NS2A | 1324 | 0.33 | 3 | 3 | 0 | Y | LILGAQAL | 95.15 | IILGAQAL | 2.91 | LTLGAQAL | 1.94 | | |
| NS2A | 1325 | 0.14 | 2 | 2 | 0 | Y | ILGAQALP | 98.06 | TLGAQALP | 1.94 | | | | |
| NS2A | 1326 | 0 | 1 | 1 | 0 | Y | LGAQALPV | 100 | | | | | | |
| NS2A | 1327 | 0 | 1 | 1 | 0 | Y | GAQALPVY | 100 | | | | | | |
| NS2A | 1328 | 0 | 1 | 1 | 0 | Y | AQALPVYL | 100 | | | | | | |
| NS2A | 1329 | 0 | 1 | 1 | 0 | Y | QALPVYLM | 100 | | | | | | |

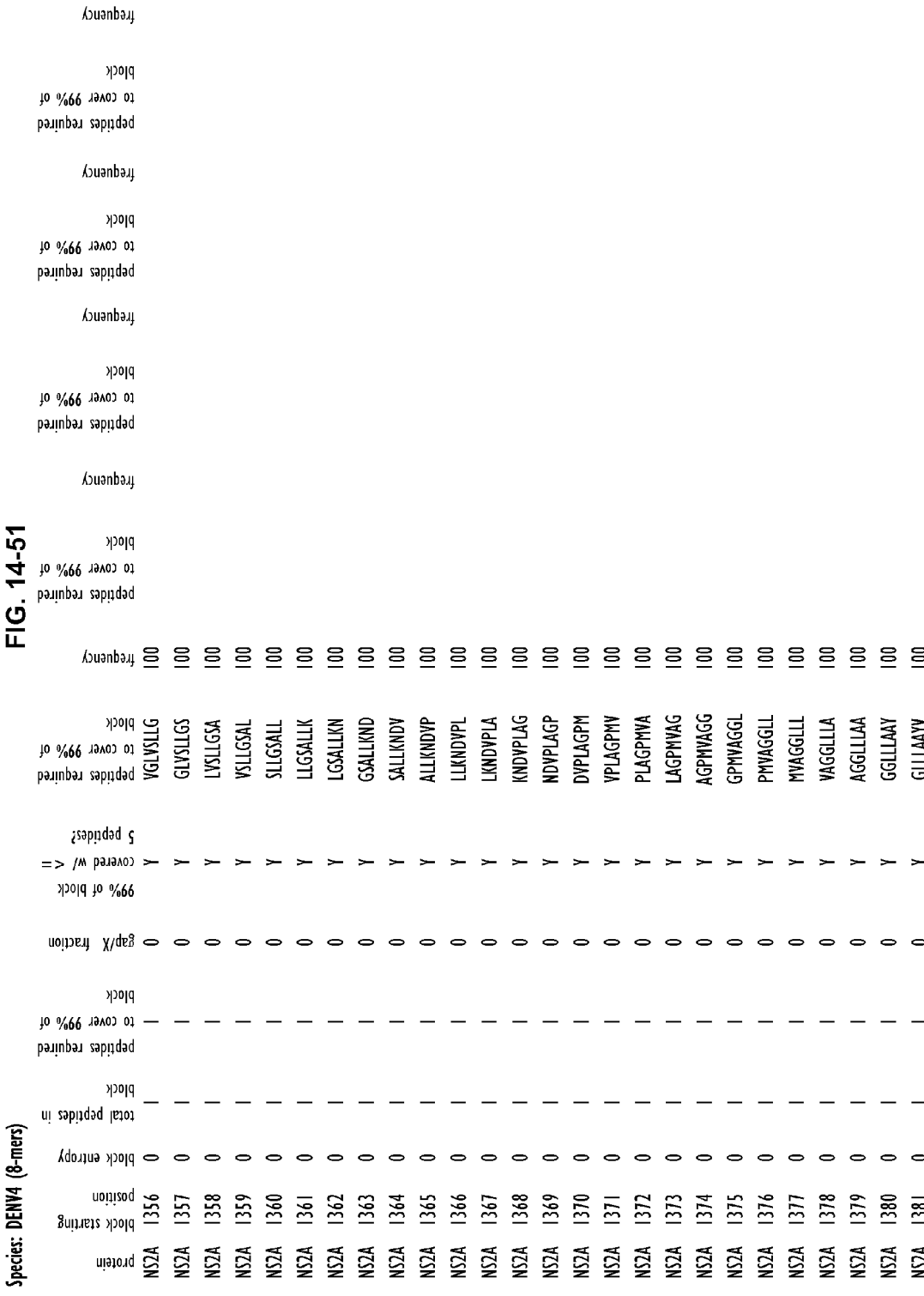

FIG. 14-52

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1382 | 0 | 1 | 1 | 0 | Y | LLLAAYVM | 100 | | | | | | |
| NS2A | 1383 | 0 | 1 | 1 | 0 | Y | LLAAYVMS | 100 | | | | | | |
| NS2A | 1384 | 0 | 1 | 1 | 0 | Y | LAAYVMSG | 100 | | | | | | |
| NS2A | 1385 | 0 | 1 | 1 | 0 | Y | AAYVMSGS | 100 | | | | | | |
| NS2A | 1386 | 0.08 | 2 | 1 | 0 | Y | AYVMSGSS | 99.03 | | | | | | |
| NS2A | 1387 | 0.08 | 2 | 1 | 0 | Y | YVMSGSSA | 99.03 | | | | | | |
| NS2A | 1388 | 0.08 | 2 | 1 | 0 | Y | VMSGSSAD | 99.03 | | | | | | |
| NS2A | 1389 | 0.08 | 2 | 1 | 0 | Y | MSGSSADL | 99.03 | | | | | | |
| NS2A | 1390 | 0.08 | 2 | 1 | 0 | Y | SGSSADLS | 99.03 | | | | | | |
| NS2A | 1391 | 0.08 | 2 | 1 | 0 | Y | GSSADLSL | 99.03 | | | | | | |
| NS2A | 1392 | 0.08 | 2 | 1 | 0 | Y | SSADLSLE | 99.03 | | | | | | |
| NS2A | 1393 | 0.22 | 3 | 2 | 0 | Y | SADLSLEK | 97.09 | SADLSLER | 1.94 | | | | |
| NS2A | 1394 | 0.14 | 2 | 2 | 0 | Y | ADLSLERA | 98.06 | ADLSLERA | 1.94 | | | | |
| NS2A | 1395 | 0.14 | 2 | 2 | 0 | Y | DLSLERAA | 98.06 | DLSLERAA | 1.94 | | | | |
| NS2A | 1396 | 0.37 | 3 | 3 | 0 | Y | LSLEKAAN | 94.17 | LSLEKAAS | 3.88 | LSLERAAN | 1.94 | | |
| NS2A | 1397 | 0.37 | 3 | 3 | 0 | Y | SLEKAANV | 94.17 | SLEKAASV | 3.88 | SLERAANV | 1.94 | | |
| NS2A | 1398 | 0.37 | 3 | 3 | 0 | Y | LEKAANVQ | 94.17 | LEKAASVQ | 3.88 | LERAANVQ | 1.94 | | |
| NS2A | 1399 | 0.37 | 3 | 3 | 0 | Y | EKAANVQW | 94.17 | EKAASVQW | 3.88 | ERAANVQW | 1.94 | | |
| NS2A | 1400 | 0.37 | 3 | 3 | 0 | Y | KAANVQWD | 94.17 | KAASVQWD | 3.88 | RAANVQWD | 1.94 | | |
| NS2A | 1401 | 0.24 | 2 | 2 | 0 | Y | AANVQWDE | 96.12 | AASVQWDE | 3.88 | | | | |
| NS2A | 1402 | 0.24 | 2 | 2 | 0 | Y | ANVQWDEM | 96.12 | ASVQWDEM | 3.88 | | | | |
| NS2A | 1403 | 0.24 | 2 | 2 | 0 | Y | NVQWDEMA | 96.12 | SVQWDEMA | 3.88 | | | | |
| NS2A | 1404 | 0.08 | 2 | 1 | 0 | Y | VQWDEMAD | 99.03 | | | | | | |
| NS2A | 1405 | 0.08 | 2 | 1 | 0 | Y | QWDEMADI | 99.03 | | | | | | |
| NS2A | 1406 | 0.08 | 2 | 1 | 0 | Y | WDEMADIT | 99.03 | | | | | | |
| NS2A | 1407 | 0.08 | 2 | 1 | 0 | Y | DEMADITG | 99.03 | | | | | | |

FIG. 14-54

Species: DENV4 (8-mers)

| protein | block starting position | block entropy | total peptides in block | peptides required to cover 99% of block | gap/x fraction | 99% of block covered w/ <= 5 peptides? | block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1434 | 0.32 | 3 | 2 | 0 | Y | VEETNMI

FIG. 14-55

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1460 | 1.28 | 3 | 3 | 0 | Y | PVTMTLWY | 63.11 | PITMTLWY | 25.24 | PVTMALWY | 11.65 | | |
| NS2A | 1461 | 1.36 | 4 | 4 | 0 | Y | VTMTLWYM | 63.11 | ITMTLWYM | 25.24 | VTMALWYI | 9.71 | V

FIG. 14-56

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1489 | 1.37 | 5 | 4 | 0 | Y | QKAALSEG | 70.87 | QKAALSEG | 10.68 | QKATLSEG | 9.71 | QKATLTEG | 7.77 |
| NS3 | 1490 | 0.92 | 4 | 3 | 0 | Y | KAALSEGV | 81.55 | KATLSEGV | 9.71 | KATLTEGV | 7.77 | | |
| NS3 | 1491 | 0.92 | 4 | 3 | 0 | Y | AALSEGVY | 81.55 | ATLSEGVY | 9.71 | ATLTEGVY | 7.77 | | |
| NS3 | 1492 | 0.92 | 4 | 3 | 0 | Y | ALSEGVYR | 81.55 | TLSEGVYR | 9.71 | TLTEGVYR | 7.77 | | |
| NS3 | 1493 | 0.43 | 2 | 2 | 0 | Y | LSEGVYRI | 91.26 | LTEGVYRI | 8.74 | | | | |
| NS3 | 1494 | 0.43 | 2 | 2 | 0 | Y | SEGVYRIM | 91.26 | TEGVYRIM | 8.74 | | | | |
| NS3 | 1495 | 0 | 1 | 1 | 0 | Y | EGVYRIMQ | 100 | | | | | | |
| NS3 | 1496 | 0 | 1 | 1 | 0 | Y | GVYRIMQR | 100 | | | | | | |
| NS3 | 1497 | 0 | 1 | 1 | 0 | Y | VYRIMQRG | 100 | | | | | | |
| NS3 | 1498 | 0 | 1 | 1 | 0 | Y | YRIMQRGL | 100 | | | | | | |
| NS3 | 1499 | 0.32 | 2 | 2 | 0 | Y | RIMQRGLF | 94.17 | RIMQRGLL | 5.83 | | | | |
| NS3 | 1500 | 0.32 | 2 | 2 | 0 | Y | IMQRGLFG | 94.17 | IMQRGLLG | 5.83 | | | | |
| NS3 | 1501 | 0.36 | 3 | 2 | 0 | Y | MQRGLFGK | 94.17 | MQRGLLGK | 4.85 | | | | |
| NS3 | 1502 | 0.36 | 3 | 2 | 0 | Y | QRGLFGKT | 94.17 | QRGLLGKT | 4.85 | | | | |
| NS3 | 1503 | 0.36 | 3 | 2 | 0 | Y | RGLFGKTQ | 94.17 | RGLLGKTQ | 4.85 | | | | |
| NS3 | 1504 | 0.36 | 3 | 2 | 0 | Y | GLFGKTQV | 94.17 | GLLGKTQV | 4.85 | | | | |
| NS3 | 1505 | 0.36 | 3 | 2 | 0 | Y | LFGKTQVG | 94.17 | LLGKTQVG | 4.85 | | | | |
| NS3 | 1506 | 0.36 | 3 | 2 | 0 | Y | FGKTQVGV | 94.17 | LGKTQVGV | 4.85 | | | | |
| NS3 | 1507 | 0.08 | 2 | 1 | 0 | Y | GKTQVGVG | 99.03 | KTQVGVGV | 0.97 | | | | |
| NS3 | 1508 | 0.16 | 2 | 2 | 0 | Y | KTQVGVGI | 98.06 | | | | | | |
| NS3 | 1509 | 0.08 | 2 | 1 | 0 | Y | TQVGVGIH | 99.03 | | | | | | |
| NS3 | 1510 | 0.39 | 4 | 3 | 0 | Y | QVGVGIHM | 94.17 | QVGVGIHI | 3.88 | QVGVGIHT | 0.97 | | |
| NS3 | 1511 | 0.39 | 4 | 3 | 0 | Y | VGVGIHME | 94.17 | VGVGIHIE | 3.88 | VGVGIHTE | 0.97 | | |
| NS3 | 1512 | 0.39 | 4 | 3 | 0 | Y | GVGIHMEG | 94.17 | GVGIHIEG | 3.88 | GVGHVEG | 0.97 | | |
| NS3 | 1513 | 0.39 | 4 | 3 | 0 | Y | VGIHMEGV | 94.17 | VGIHIEGV | 3.88 | VGVHVEGV | 0.97 | | |
| NS3 | 1514 | 0.39 | 4 | 3 | 0 | Y | GIHMEGVF | 94.17 | GIHIEGVF | 3.88 | GVHVEGVF | 0.97 | | |

FIG. 14-57

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1515 | 0.39 | 4 | 3 | 0 | Y | IHMEGVFH | 94.17 | IHEGVFH | 3.88 | IHTEGVFH | 0.97 | | |
| NS3 | 1516 | 0.39 | 4 | 3 | 0 | Y | HMEGVFHT | 94.17 | HIEGVFHT | 3.88 | HVEGVFHT | 0.97 | | |
| NS3 | 1517 | 0.39 | 4 | 3 | 0 | Y | MEGVFHTM | 94.17 | IEGVFHTM | 3.88 | VEGVFHTM | 0.97 | | |
| NS3 | 1518 | 0 | 1 | 1 | 0 | Y | EGVFHTMW | 100 | | | | | | |
| NS3 | 1519 | 0 | 1 | 1 | 0 | Y | GVFHTMWH | 100 | | | | | | |
| NS3 | 1520 | 0 | 1 | 1 | 0 | Y | VFHTMWHV | 100 | | | |

FIG. 14-58

Species: DENV4 (8-mers)

| protein | block starting position | block entropy | total peptides in block | peptides required to cover 99% of block | gap/X fraction | 99% of block covered w/

FIG. 14-59

Species: DENV4 (8-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 1567 | 0 | 1 | 1 | 0 | Y | EEDVQVLA | 100 | | |
| NS3 | 1568 | 0.19 | 2 | 2 | 0

FIG. 14-60

Species: DENV4 (8-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 1593 | 0.22 | 3 | 2 | 0 | Y | TL

FIG. 14-62

Species: DENV4 (8-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover

FIG. 14-63

Species: DENV4 (8-mers)

| protein | block starting position | block entropy | total peptides in block | peptides required to cover 99% of block | gap/x fraction | 99% of block covered w/ <= 5 peptides? | peptides required to cover 99% of block | frequency |
|---|---|---|---|---|---|---|---|---|

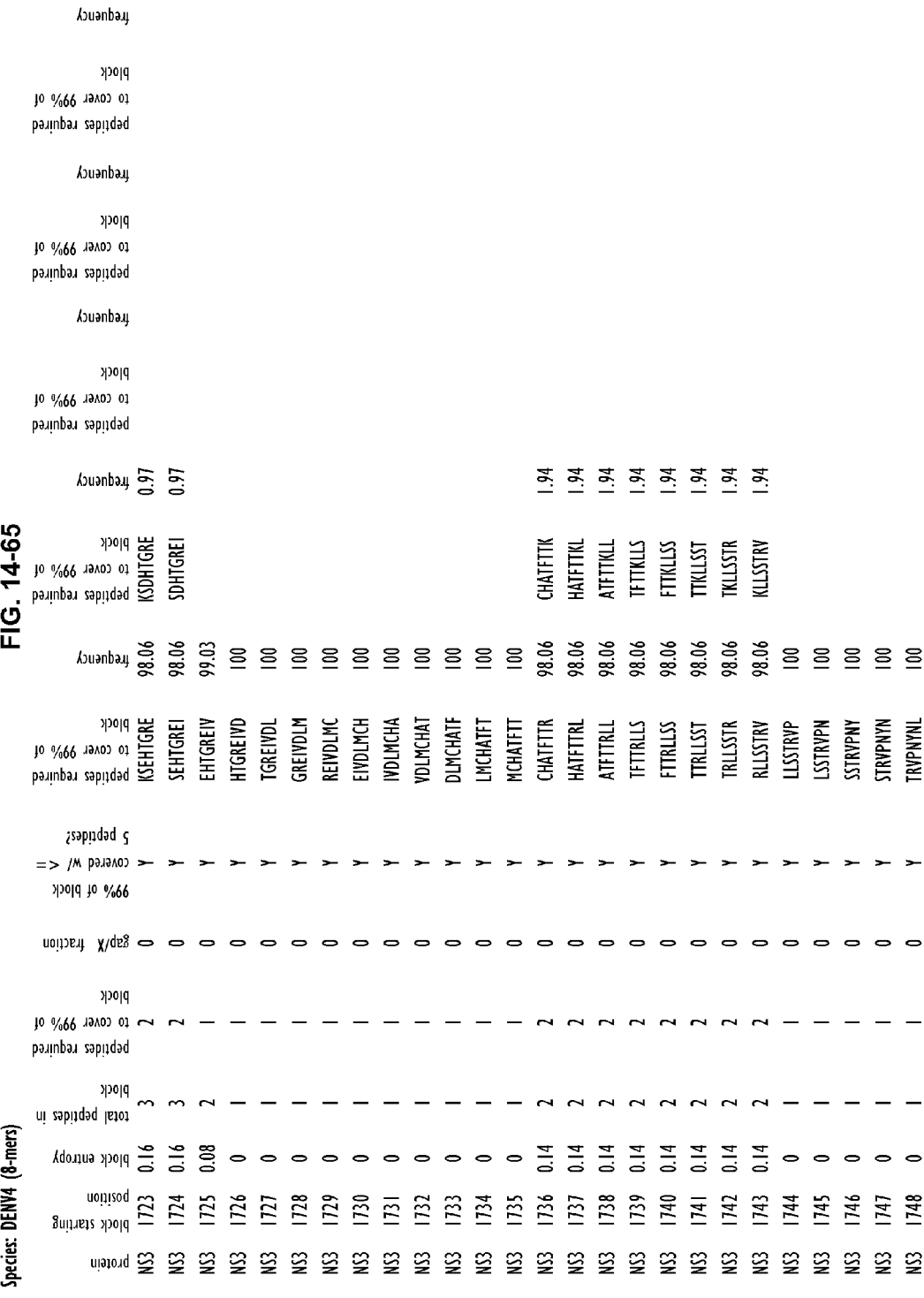

FIG. 14-67

Species: DENV4 (8-mers)

| protein | block starting position | block entropy | total peptides in block | peptides required to cover 99% of block | gap/X fraction | 99% of block covered w/ <= 5 peptides? | block to cover 99% of peptides required | frequency | block

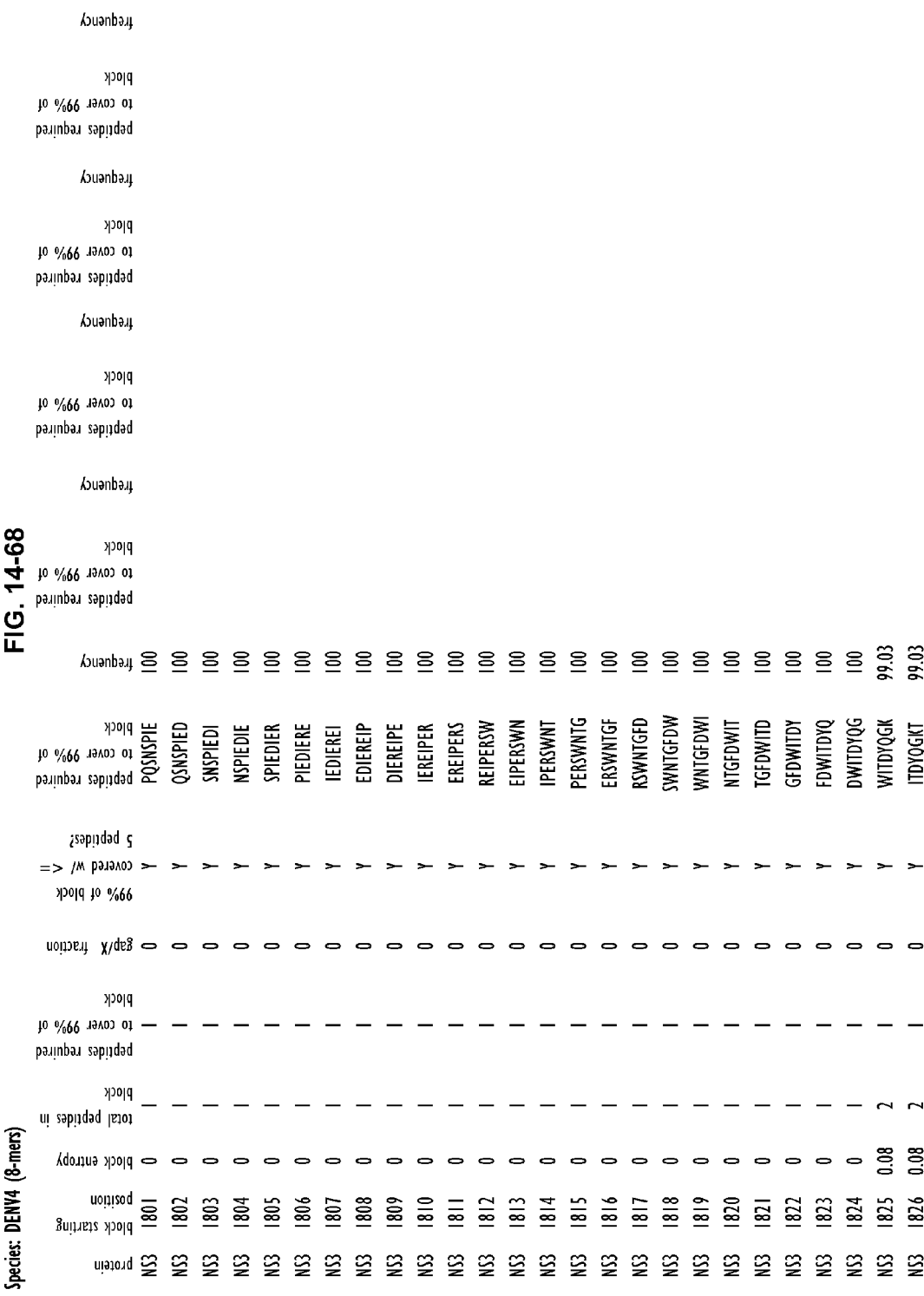

FIG. 14-69

Species: DENV4 (8-mers)

| protein | block starting position | block entropy | total peptides in block | peptides required to cover 99% of block | gap/X fraction | 99% of block covered w/ <= 5 peptides?

FIG. 14-70

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1853 | 0.54 | 3 | 2 | 0 | Y | SGKRVIQL | 89.32 | SGKRVIQL | 9.71 |
| NS3 | 1854 | 0.54 | 3 | 2 | 0 | Y | GKRVIQLS | 89.32 | GKRVIQLS | 9.71 |
| NS3 | 1855 | 0.54 | 3 | 2 | 0 | Y | KRVIQLSR | 89.32 | KRVIQLSR | 9.71 |

FIG. 14-72

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1905 | 0.63 | 3 | 3 | 0 | Y | KPVILTDG | 87.38 | KPVILPDG | 10.68 | KPVISTDG | 1.94 | | |
| NS3 | 1906 | 0.7 | 4 | 3 | 0 | Y | PVILTDGP | 86.41 | PVILPDGP | 10.68 | PVISTDGP | 1.94 | | |
| NS3 | 1907 | 0.7 | 4 | 3 | 0 | Y | VILTDGPE | 86.41 | VILPDGPE | 10.68 | VISTDGPE | 1.94 | | |
| NS3 | 1908 | 0.7 | 4 | 3 | 0 | Y | ILTDGPER | 86.41 | ILPDGPER | 10.68 | ISTDGPER | 1.94 | | |
| NS3 | 1909 | 0.7 | 4 | 3 | 0 | Y | LTDGPERV | 86.41 | LPDGPERV | 10.68 | STDGPERV | 1.94 | | |
| NS3 | 1910 | 0.57 | 3 | 2 | 0 | Y | TDGPERVI | 88.35 | PDGPERVI | 10.68 | | | | |
| NS3 | 1911 | 0.08 | 2 | 1 | 0 | Y | DGPERVIL | 99.03 | | | | | | |
| NS3 | 1912 | 0.08 | 2 | 1 | 0 | Y | GPERVILA | 99.03 | | | | | | |
| NS3 | 1913 | 0.08 | 2 | 1 | 0 | Y | PERVILAG | 99.03 | | | | | | |
| NS3 | 1914 | 0 | 1 | 1 | 0 | Y | ERVILAGP | 100 | | | | | | |
| NS3 | 1915 | 0 | 1 | 1 | 0 | Y | RVILAGPI | 100 | | | | | | |
| NS3 | 1916 | 0 | 1 | 1 | 0 | Y | VILAGPIP | 100 | | | | | | |
| NS3 | 1917 | 0 | 1 | 1 | 0 | Y | ILAGPIPV | 100 | | | | | | |
| NS3 | 1918 | 0 | 1 | 1 | 0 | Y | LAGPIPVT | 100 | | | | | | |
| NS3 | 1919 | 0 | 1 | 1 | 0 | Y | AGPIPVTP | 100 | | | | | | |
| NS3 | 1920 | 0 | 1 | 1 | 0 | Y | GPIPVTPA | 100 | | | | | | |
| NS3 | 1921 | 0 | 1 | 1 | 0 | Y | PIPVTPAS | 100 | | | | | | |
| NS3 | 1922 | 0 | 1 | 1 | 0 | Y | IPVTPASA | 100 | | | | | | |
| NS3 | 1923 | 0 | 1 | 1 | 0 | Y | PVTPASAA | 100 | | | | | | |
| NS3 | 1924 | 0 | 1 | 1 | 0 | Y | VTPASAAQ | 100 | | | | | | |
| NS3 | 1925 | 0 | 1 | 1 | 0 | Y | TPASAAQR | 100 | | | | | | |
| NS3 | 1926 | 0 | 1 | 1 | 0 | Y | PASAAQRR | 100 | | | | | | |
| NS3 | 1927 | 0 | 1 | 1 | 0 | Y | ASAAQRRG | 100 | | | | | | |
| NS3 | 1928 | 0 | 1 | 1 | 0 | Y | SAAQRRGR | 100 | | | | | | |
| NS3 | 1929 | 0 | 1 | 1 | 0 | Y | AAQRRGRI | 100 | | | | | | |
| NS3 | 1930 | 0 | 1 | 1 | 0 | Y | AQRRGRIG | 100 | | | | | | |

FIG. 14-73

Species: DENV4 (8-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of

FIG. 14-74

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|

FIG. 14-75

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequ

FIG. 14-76

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2009 | 0.14 | 2 | 2 | 0 | Y | VELMRRGD | 98.06 | VELMKRGD | 1.94 | | | | |
| NS3 | 2010 | 0.14 | 2 | 2 | 0 | Y | ELMRRGDL | 98.06 | ELMKRGDL | 1.94 | | | | |
| NS3 | 2011 | 0.14 | 2 | 2 | 0 | Y | LMRRGDLP | 98.06 | LMKRGDLP | 1.94 | | | | |
| NS3 | 2012 | 0.14 | 2 | 2 | 0 | Y | MRRGDLPV | 98.06 | MKRGDLPV | 1.94 | | | | |
| NS3 | 2013 | 0.14 | 2 | 2 | 0 | Y | RRGDLPYW | 98.06 | KRGDLPYW | 1.94 | | | | |
| NS3 | 2014 | 0 | 1 | 1 | 0 | Y | RGDLPYWL | 100 | | | | | | |
| NS3 | 2015 | 0 | 1 | 1 | 0 | Y | GDLPYWLS | 100 | | | | | | |
| NS3 | 2016 | 0 | 1 | 1 | 0 | Y | DLPYWLSY | 100 | | | | | | |
| NS3 | 2017 | 0 | 1 | 1 | 0 | Y | LPYWLSYK | 100 | | | | | | |
| NS3 | 2018 | 0 | 1 | 1 | 0 | Y | PYWLSYKV | 100 | | | | | | |
| NS3 | 2019 | 0 | 1 | 1 | 0 | Y | YWLSYKVA | 100 | | | | | | |
| NS3 | 2020 | 0 | 1 | 1 | 0 | Y | WLSYKVAS | 100 | | | | | | |
| NS3 | 2021 | 0 | 1 | 1 | 0 | Y | LSYKVASA | 100 | | | | | | |
| NS3 | 2022 | 0 | 1 | 1 | 0 | Y | SYKVASAG | 100 | | | | | | |
| NS3 | 2023 | 0 | 1 | 1 | 0 | Y | YKVASAGI | 100 | | | | | | |
| NS3 | 2024 | 0 | 1 | 1 | 0 | Y | KVASAGIS | 100 | | | | | | |
| NS3 | 2025 | 0 | 1 | 1 | 0 | Y | VASAGISY | 100 | | | | | | |
| NS3 | 2026 | 0.22 | 3 | 2 | 0 | Y | ASAGISYK | 97.09 | ASAGISYE | 1.94 | | | | |
| NS3 | 2027 | 0.22 | 3 | 2 | 0 | Y | SAGISYKD | 97.09 | SAGISYED | 1.94 | | | | |
| NS3 | 2028 | 0.22 | 3 | 2 | 0 | Y | AGISYKDR | 97.09 | AGISYEDR | 1.94 | | | | |
| NS3 | 2029 | 0.22 | 3 | 2 | 0 | Y | GISYKDRE | 97.09 | GISYEDRE | 1.94 | | | | |
| NS3 | 2030 | 0.22 | 3 | 2 | 0 | Y | ISYKDREW | 97.09 | ISYEDREW | 1.94 | | | | |
| NS3 | 2031 | 0.22 | 3 | 2 | 0 | Y | SYKDREWC | 97.09 | SYEDREWC | 1.94 | | | | |
| NS3 | 2032 | 0.22 | 3 | 2 | 0 | Y | YKDREWCF | 97.09 | YEDREWCF | 1.94 | | | | |
| NS3 | 2033 | 0.22 | 3 | 2 | 0 | Y | KDREWCFT | 97.09 | EDREWCFT | 1.94 | | | | |
| NS3 | 2034 | 0 | 1 | 1 | 0 | Y | DREWCFTG | 100 | | | | | | |

FIG. 14-77

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS

FIG. 14-78

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | block | frequency |
|---|---|---|---|---|---|---|---|---|---|---|---|
| NS3 | 2061 | 0 | 1 | 1 | 0 | Y | GEKKKLRP | 100 | | | |
| NS3 | 2062 | 0.99 | 2 | 2 | 0 | Y | EKKKLRPR | 54.37 | | EKKKLRPK | 45.63 |
| NS3 | 2063 | 0.99 | 2 | 2 | 0 | Y | KKKLRPRW | 54.37 | | KKKLRPKW | 45.63 |
| NS3 | 2064 | 0.99 | 2 | 2 | 0 | Y | KKLRPRWL | 54.37 | | KKLRPKWL | 45.63 |
| NS3 | 2065 | 0.99 | 2 | 2 | 0 | Y | KLRPRWLD | 54.37 | | KLRPKWLD | 45.63 |
| NS3 | 2066 | 0.99 | 2 | 2 | 0 | Y | LRPRWLDA | 54.37 | | LRPKWLDA | 45.63 |
| NS3 | 2067 | 0.99 | 2 | 2 | 0 | Y | RPRWLDAR | 54.37 | | RPKWLDAR | 45.63 |
| NS3 | 2068 | 0.99 | 2 | 2 | 0 | Y | PRWLDARV | 54.37 | | PKWLDARV | 45.63 |
| NS3 | 2069 | 0.99 | 2 | 2 | 0 | Y | RWLDARVY | 54.37 | | KWLDARVY | 45.63 |
| NS3 | 2070 | 0 | 1 | 1 | 0 | Y | WLDARVYA | 100 | | | |
| NS3 | 2071 | 0 | 1 | 1 | 0 | Y | LDARVYAD | 100 | | | |
| NS3 | 2072 | 0 | 1 | 1 | 0 | Y | DARVYADP | 100 | | | |
| NS3 | 2073 | 0 | 1 | 1 | 0 | Y | ARVYADPM | 100 | | | |
| NS3 | 2074 | 0 | 1 | 1 | 0 | Y | RVYADPMA | 100 | | | |
| NS3 | 2075 | 0 | 1 | 1 | 0 | Y | VYADPMAL | 100 | | | |
| NS3 | 2076 | 0.08 | 2 | 1 | 0 | Y | YADPMALK | 99.03 | | | |
| NS3 | 2077 | 0.08 | 2 | 1 | 0 | Y | ADPMALKD | 99.03 | | | |
| NS3 | 2078 | 0.08 | 2 | 1 | 0 | Y | DPMALKDF | 99.03 | | | |
| NS3 | 2079 | 0.08 | 2 | 1 | 0 | Y | PMALKDFK | 99.03 | | | |
| NS3 | 2080 | 0.08 | 2 | 1 | 0 | Y | MALKDFKE | 99.03 | | | |
| NS3 | 2081 | 0.08 | 2 | 1 | 0 | Y | ALKDFKEF | 99.03 | | | |
| NS3 | 2082 | 0.08 | 2 | 1 | 0 | Y | LKDFKEFA | 99.03 | | | |
| NS3 | 2083 | 0.08 | 2 | 1 | 0 | Y | KDFKEFAS | 99.03 | | | |
| NS3 | 2084 | 0 | 1 | 1 | 0 | Y | DFKEFASG | 100 | | | |
| NS3 | 2085 | 0 | 1 | 1 | 0 | Y | FKEFASGR | 100 | | | |
| NS3 | 2086 | 0 | 1 | 1 | 0 | Y | KEFASGRK | 100 | | | |

FIG. 14-79

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2087 | 0 | 1 | 1 | 0 | Y | EFASGRKS | 100 | | | | | | |
| NS3 | 2088 | 0.08 | 2 | 1 | 0 | Y | FASGRKSI | 99.03 | | | | | | |
| NS3 | 2089 | 0.08 | 2 | 1 | 0 | Y | ASGRKSIT | 99.03 | | | | | | |
| NS3 | 2090 | 0.08 | 2 | 1 | 0 | Y | SGRKSITL | 99.03 | | | | | | |
| NS3 | 2091 | 0.08 | 2 | 1 | 0 | Y | GRKSITLD | 99.03 | | | | | | |
| NS3 | 2092 | 0.08 | 2 | 1 | 0 | Y | RKSITLDI | 99.03 | | | | | | |
| NS3 | 2093 | 0.08 | 2 | 1 | 0 | Y | KSITLDIL | 99.03 | | | | | | |
| NS3 | 2094 | 0.08 | 2 | 1 | 0 | Y | SITLDILT | 99.03 | | | | | | |
| NS3 | 2095 | 0.08 | 2 | 1 | 0 | Y | ITLDILTE | 99.03 | | | | | | |
| NS4A | 2096 | 0 | 1 | 1 | 0 | Y | TLDILTEI | 100 | | | | | | |
| NS4A | 2097 | 0 | 1 | 1 | 0 | Y | LDILTEIA | 100 | | | | | | |
| NS4A | 2098 | 0.43 | 2 | 2 | 0 | Y | DILTEIAS | 91.26 | DILTEIAT | 8.74 | | | | |
| NS4A | 2099 | 0.43 | 2 | 2 | 0 | Y | ILTEIASL | 91.26 | ILTEIATL | 8.74 | | | | |
| NS4A | 2100 | 0.43 | 2 | 2 | 0 | Y | LTEIASLP | 91.26 | LTEIATLP | 8.74 | | | | |
| NS4A | 2101 | 0.57 | 4 | 3 | 0 | Y | TEIASLPT | 90.29 | TEIATLPT | 6.8 | TEIATLPA | 1.94 | | |
| NS4A | 2102 | 0.57 | 4 | 3 | 0 | Y | EIASLPTY | 90.29 | EIATLPTY | 6.8 | EIATLPAY | 1.94 | | |
| NS4A | 2103 | 0.57 | 4 | 3 | 0 | Y | IASLPTYL | 90.29 | IATLPTYL | 6.8 | IATLPAYL | 1.94 | | |
| NS4A | 2104 | 0.57 | 4 | 3 | 0 | Y | ASLPTYLS | 90.29 | ATLPTYLS | 6.8 | ATLPAYLS | 1.94 | | |
| NS4A | 2105 | 0.57 | 4 | 3 | 0 | Y | SLPTYLSS | 90.29 | TLPTYLSS | 6.8 | TLPAYLSS | 1.94 | | |
| NS4A | 2106 | 0.61 | 4 | 3 | 0 | Y | LPTYLSSR | 89.32 | LPTYLSSK | 7.77 | LPAYLSSK | 1.94 | | |
| NS4A | 2107 | 0.61 | 4 | 3 | 0 | Y | PTYLSSRA | 89.32 | PTYLSSKA | 7.77 | PAYLSSKA | 1.94 | | |
| NS4A | 2108 | 0.61 | 4 | 3 | 0 | Y | TYLSSRAK | 89.32 | TYLSSKAK | 7.77 | AYLSSKAK | 1.94 | | |
| NS4A | 2109 | 0.46 | 2 | 2 | 0 | Y | YLSSRAKL | 90.29 | YLSSKAKL | 9.71 | | | | |
| NS4A | 2110 | 0.46 | 2 | 2 | 0 | Y | LSSRAKLA | 90.29 | LSSKAKLA | 9.71 | | | | |
| NS4A | 2111 | 0.46 | 2 | 2 | 0 | Y | SSRAKLAL | 90.29 | SSKAKLAL | 9.71 | | | | |
| NS4A | 2112 | 0.46 | 2 | 2 | 0 | Y | SRAKLALD | 90.29 | SKAKLALD | 9.71 | | | | |

FIG. 14-80

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 14-81

Species: DENV4 (8-mers)

| protein | block starting position | block entropy | total peptides in block | peptides required to cover 99% of block | gap/X fraction | covered w/ <= 5 peptides? | block | frequency | block | frequency |
|---|---|---|---|---|---|---|---|---|---|---|
| NS4A | 2139 | 0 | 1 | 1 | 0 | Y | NELPESL

FIG. 14-82

Species: DENV4 (8-mers)

| protein | block starting position | block entropy | total peptides in block | peptides required to cover 99% of block | gap/X fraction | 99% of block covered w/ <= 5 peptides? | block | frequency | block (peptides required to cover 99% of block) | frequency | block (peptides required to cover 99% of block) | frequency | block (peptides required to cover 99% of block) | frequency |
|---|---|---|---|---|---|---|---|---|---|---|---|---|---|---|
| NS4A | 2165 | 0.22 | 3 | 2 | 0 | Y | FMQGKGIG | 97.09 | FMQGKGMG | 1.94 | | | | |
| NS4A | 2166 | 0.22 | 3 | 2 | 0 | Y | MQGKGIGK | 97.09 | MQGKGMGK | 1.94 | | | | |
| NS4A | 2167 | 0.22 | 3 | 2 | 0 | Y | QGKGIGKL | 97.09 | QGKGMGKL | 1.94 | | | | |
| NS4A | 2168 | 0.22 | 3 | 2 | 0 | Y | GKGIGKLS | 97.09 | GKGMGKLS | 1.94 | | | | |
| NS4A | 2169 | 0.35 | 4 | 3 | 0 | Y | KGIGKLSM | 95.15 | KGIGKLSV | 1.94 | KGMGKLSM | 1.94 | | |
| NS4A | 2170 | 0.28 | 3 | 3 | 0 | Y | GIGKLSMG | 96.12 | GMGKLSMG | 1.94 | GIGKLSVG | 1.94 | | |
| NS4A | 2171 | 0.28 | 3 | 2 | 0 | Y | IGKLSMGL | 96.12 | MGKLSMGL | 1.94 | IGKLSVGL | 1.94 | | |
| NS4A | 2172 | 0.14 | 2 | 2 | 0 | Y | GKLSMGLI | 98.06 | GKLSVGLI | 1.94 | | | | |
| NS4A | 2173 | 0.9 | 3 | 3 | 0 | Y | KLSMGLIT | 75.73 | KLSMGLIA | 22.33 | KLSVGLIA | 1.94 | | |
| NS4A | 2174 | 0.9 | 3 | 3 | 0 | Y | LSMGLITI | 75.73 | LSMGLIAI | 22.33 | LSVGLIAI | 1.94 | | |
| NS4A | 2175 | 0.9 | 3 | 3 | 0 | Y | SMGLITIA | 75.73 | SMGLIAIA | 22.33 | SVGLIAIA | 1.94 | | |
| NS4A | 2176 | 1.12 | 4 | 4 | 0 | Y | MGLITIAV | 71.84 | MGLIAIAV | 22.33 | MGLITIAM | 3.88 | VGLIAIAV | 1.94 |
| NS4A | 2177 | 1.02 | 3 | 3 | 0 | Y | GLITIAVA | 71.84 | GLIAIAVA | 24.27 | GLITIAMA | 3.88 | | |
| NS4A | 2178 | 1.02 | 3 | 3 | 0 | Y | LITIAVAS | 71.84 | LIAIAVAS | 24.27 | LITIAMAS | 3.88 | | |
| NS4A | 2179 | 1.08 | 4 | 3 | 0 | Y | ITIAVASG | 71.84 | IAIAVASG | 23.3 | ITIAMASG | 3.88 | | |
| NS4A | 2180 | 1.08 | 4 | 3 | 0 | Y | TIAVASGL | 71.84 | AIAVASGL | 23.3 | TIAMASGL | 3.88 | | |
| NS4A | 2181 | 0.5 | 3 | 3 | 0 | Y | IAVASGLL | 92.23 | IAMASGLL | 3.88 | IAVASGLF | 2.91 | | |
| NS4A | 2182 | 0.5 | 3 | 3 | 0 | Y | AVASGLLW | 92.23 | AMASGLLW | 3.88 | AVASGLFW | 2.91 | | |
| NS4A | 2183 | 0.58 | 4 | 3 | 0 | Y | VASGLLWV | 91.26 | MASGLLWI | 3.88 | VASGLFWV | 2.91 | VASSLLWV | 0.97 |
| NS4A | 2184 | 0.55 | 4 | 3 | 0 | Y | ASGLLWVA | 91.26 | ASGLLWIA | 4.85 | ASGLFWVA | 2.91 | | |
| NS4A | 2185 | 0.55 | 5 | 3 | 0 | Y | SGLLWVAE | 91.26 | SGLLWIAE | 4.85 | SGLFWVAE | 2.91 | | |
| NS4A | 2186 | 0.68 | 4 | 4 | 0 | Y | GLLWVAEI | 89.32 | GLLWIAEI | 4.85 | GLFWVAEI | 2.91 | GLLWVAEL | 1.94 |
| NS4A | 2187 | 0.6 | 5 | 4 | 0 | Y | LLWVAEIQ | 90.29 | LLWIAEIQ | 4.85 | LFWVAEIQ | 2.91 | LLWVAELQ | 1.94 |
| NS4A | 2188 | 0.6 | 4 | 4 | 0 | Y | LWVAEIQP | 90.29 | LWIAEIQP | 4.85 | FWVAEIQP | 2.91 | LWVAELQP | 1.94 |
| NS4A | 2189 | 0.42 | 3 | 3 | 0 | Y | WVAEIQPQ | 93.2 | WIAEIQPQ | 4.85 | WVAELQPQ | 1.94 | | |
| NS4A | 2190 | 0.42 | 3 | 3 | 0 | Y | VAEIQPQW | 93.2 | IAEIQPQW | 4.85 | VAELQPQW | 1.94 | | |

FIG. 14-83

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS4A | 2191 | 0.14 | 2 | 2 | 0 | Y | AEIQPQWI | 98.06 | AEIQPQWI | 1.94 |
| NS4A | 2192 | 0.14 | 2 | 2 | 0 | Y | EIQPQWIA | 98.06 | ELQPQWIA | 1.94 |
| NS4A | 2193 | 0.14 | 2 | 2 | 0 | Y | IQPQWIAA | 98.06 | LQPQWIAA | 1.94 |
| NS4A | 2194 | 0 | 1 | 1 | 0 | Y | QPQWIAAS | 100 | | |
| NS4A | 2195 | 0 | 1 | 1 | 0 | Y | PQWIAASI | 100 | | |
| NS4A | 2196 | 0 | 1 | 1 | 0 | Y | QWIAASII | 100 | | |
| NS4A | 2197 | 0 | 1 | 1 | 0 | Y | WIAASIIL | 100 | | |
| NS4A | 2198 | 0 | 1 | 1 | 0 | Y | IAASIILE | 100 | | |
| NS4A | 2199 | 0 | 1 | 1 | 0 | Y | AASIILEF | 100 | | |
| NS4A | 2200 | 0 | 1 | 1 | 0 | Y | ASIILEFF | 100 | | |
| NS4A | 2201 | 0 | 1 | 1 | 0 | Y | SIILEFFL | 100 | | |
| NS4A | 2202 | 0 | 1 | 1 | 0 | Y | IILEFFLM | 100 | | |
| NS4A | 2203 | 0 | 1 | 1 | 0 | Y | ILEFFLMV | 100 | | |
| NS4A | 2204 | 0 | 1 | 1 | 0 | Y | LEFFLMVL | 100 | | |
| NS4A | 2205 | 0 | 1 | 1 | 0 | Y | EFFLMVLL | 100 | | |
| NS4A | 2206 | 0.19 | 2 | 2 | 0 | Y | FFLMVLLI | 97.09 | FFLMVLLV | 2.91 |
| NS4A | 2207 | 0.19 | 2 | 2 | 0 | Y | FLMVLLIP | 97.09 | FLMVLLVP | 2.91 |
| NS4A | 2208 | 0.19 | 2 | 2 | 0 | Y | LMVLLIPE | 97.09 | LMVLLVPE | 2.91 |
| NS4A | 2209 | 0.19 | 2 | 2 | 0 | Y | MVLLIPEP | 97.09 | MVLLVPEP | 2.91 |
| NS4A | 2210 | 0.19 | 2 | 2 | 0 | Y | VLLIPEPE | 97.09 | VLLVPEPE | 2.91 |
| NS4A | 2211 | 0.19 | 2 | 2 | 0 | Y | LLIPEPEK | 97.09 | LLVPEPEK | 2.91 |
| NS4A | 2212 | 0.19 | 2 | 2 | 0 | Y | LIPEPEKQ | 97.09 | LVPEPEKQ | 2.91 |
| NS4A | 2213 | 0.19 | 2 | 2 | 0 | Y | IPEPEKQR | 97.09 | VPEPEKQR | 2.91 |
| NS4A | 2214 | 0 | 1 | 1 | 0 | Y | PEPEKQRT | 100 | | |
| NS4A | 2215 | 0 | 1 | 1 | 0 | Y | EPEKQRTP | 100 | | |
| NS4A | 2216 | 0 | 1 | 1 | 0 | Y | PEKQRTPQ | 100 | | |

FIG. 14-84

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2217 | 0 | 1 | 1 | 0 | Y | EKQRTPQD | 100 | |

FIG. 14-85

Species: DENV4 (8-mers)

| protein | block starting position | block entropy | total peptides in block | peptides required to cover 99% of block | gap/X fraction | 99% of block covered w/ <= 5 peptides? | block | frequency | block (peptides required to cover 99% of block) | frequency | block (peptides required to cover 99% of block) | frequency | block (peptides required to cover 99% of block) | frequency | block (peptides required to cover 99% of block) | frequency |
|---|---|---|---|---|---|---|---|---|---|---|---|---|---|---|---|---|
| NS4B | 2243 | 0 | 1 | 1 | 0 | Y | ANEMGLIE | 100 | | | | | | | | |
| NS4B | 2244 | 0 | 1 | 1 | 0 | Y | NEMGLIEK | 100 | | | | | | | | |
| NS4B | 2245 | 0 | 1 | 1 | 0 | Y | EMGLIEKT | 100 | | | | | | | | |
| NS4B | 2246 | 0 | 1 | 1 | 0 | Y | MGLIEKTK | 100 | | | | | | | | |
| NS4B | 2247 | 0.19 | 2 | 2 | 0 | Y | GLIEKTKT | 97.09 | GLIEKTKA | 2.91 | | | | | | |
| NS4B | 2248 | 0.19 | 2 | 2 | 0 | Y | LIEKTKTD | 97.09 | LIEKTKAD | 2.91 | | | | | | |
| NS4B | 2249 | 0.19 | 2 | 2 | 0 | Y | IEKTKTDF | 97.09 | IEKTKADF | 2.91 | | | | | | |
| NS4B | 2250 | 0.19 | 2 | 2 | 0 | Y | EKTKTDFG | 97.09 | ERTKADFG | 2.91 | | | | | | |
| NS4B | 2251 | 0.19 | 2 | 2 | 0 | Y | KTKTDFGF | 97.09 | KTKADFGF | 2.91 | | | | | | |
| NS4B | 2252 | 0.19 | 2 | 2 | 0 | Y | TKTDFGFY | 97.09 | TKADFGFY | 2.91 | | | | | | |
| NS4B | 2253 | 0.19 | 2 | 2 | 0 | Y | KTDFGFYQ | 97.09 | KADFGFYQ | 2.91 | | | | | | |
| NS4B | 2254 | 0.61 | 4 | 4 | 0 | Y | TDFGFYQV | 90.29 | TDFGFYQA | 3.88 | TDFGFYQE | 2.91 | ADFGFYQV | 2.91 | | |
| NS4B | 2255 | 0.43 | 3 | 3 | 0 | Y | DFGFYQVK | 93.2 | DFGFYQAK | 3.88 | DFGFYQEK | 2.91 | | | | |
| NS4B | 2256 | 0.53 | 5 | 4 | 0 | Y | FGFYQVKT | 92.23 | FGFYQAKT | 3.88 | FGFYQEKT | 1.94 | FGFYQVKA | 0.97 | | |
| NS4B | 2257 | 0.53 | 5 | 4 | 0 | Y | GFYQVKTE | 92.23 | GFYQAKTE | 3.88 | GFYQEKTE | 1.94 | GFYQVKAE | 0.97 | | |
| NS4B | 2258 | 0.61 | 6 | 5 | 0 | Y | FYQVKTET | 91.26 | FYQAKTET | 3.88 | FYQEKTET | 1.94 | FYQVKTEI | 0.97 | FYQEKPET | 0.97 |
| NS4B | 2259 | 0.61 | 6 | 5 | 0 | Y | YQVKTETT | 91.26 | YQAKTETT | 3.88 | YQEKTETT | 1.94 | YQVKAETT | 0.97 | YQEKPETT | 0.97 |
| NS4B | 2260 | 0.61 | 6 | 5 | 0 | Y | QVKTETTI | 91.26 | QAKTETTI | 3.88 | QEKTETTI | 1.94 | QVKTEITI | 0.97 | QWKAETTI | 0.97 |
| NS4B | 2261 | 0.61 | 6 | 5 | 0 | Y | VKTETTIL | 91.26 | AKTETTIL | 3.88 | EKTETTIL | 1.94 | VKAETTIL | 0.97 | VKTETIIL | 0.97 |
| NS4B | 2262 | 0.24 | 4 | 3 | 0 | Y | KTETTILD | 97.09 | KAETTILD | 3.88 | KPETTILD | 0.97 | | | | |
| NS4B | 2263 | 0.24 | 4 | 3 | 0 | Y | TETTILDV | 97.09 | AETTILDV | 3.88 | PETTILDV | 0.97 | | | | |
| NS4B | 2264 | 0.08 | 2 | 1 | 0 | Y | ETTILDVD | 99.03 | | | | | | | | |
| NS4B | 2265 | 0.08 | 2 | 1 | 0 | Y | TTILDVDL | 99.03 | | | | | | | | |
| NS4B | 2266 | 0 | 1 | 1 | 0 | Y | TILDVDLR | 100 | | | | | | | | |
| NS4B | 2267 | 0 | 1 | 1 | 0 | Y | ILDVDLRP | 100 | | | | | | | | |
| NS4B | 2268 | 0 | 1 | 1 | 0 | Y | LDVDLRPA | 100 | | | | | | | | |

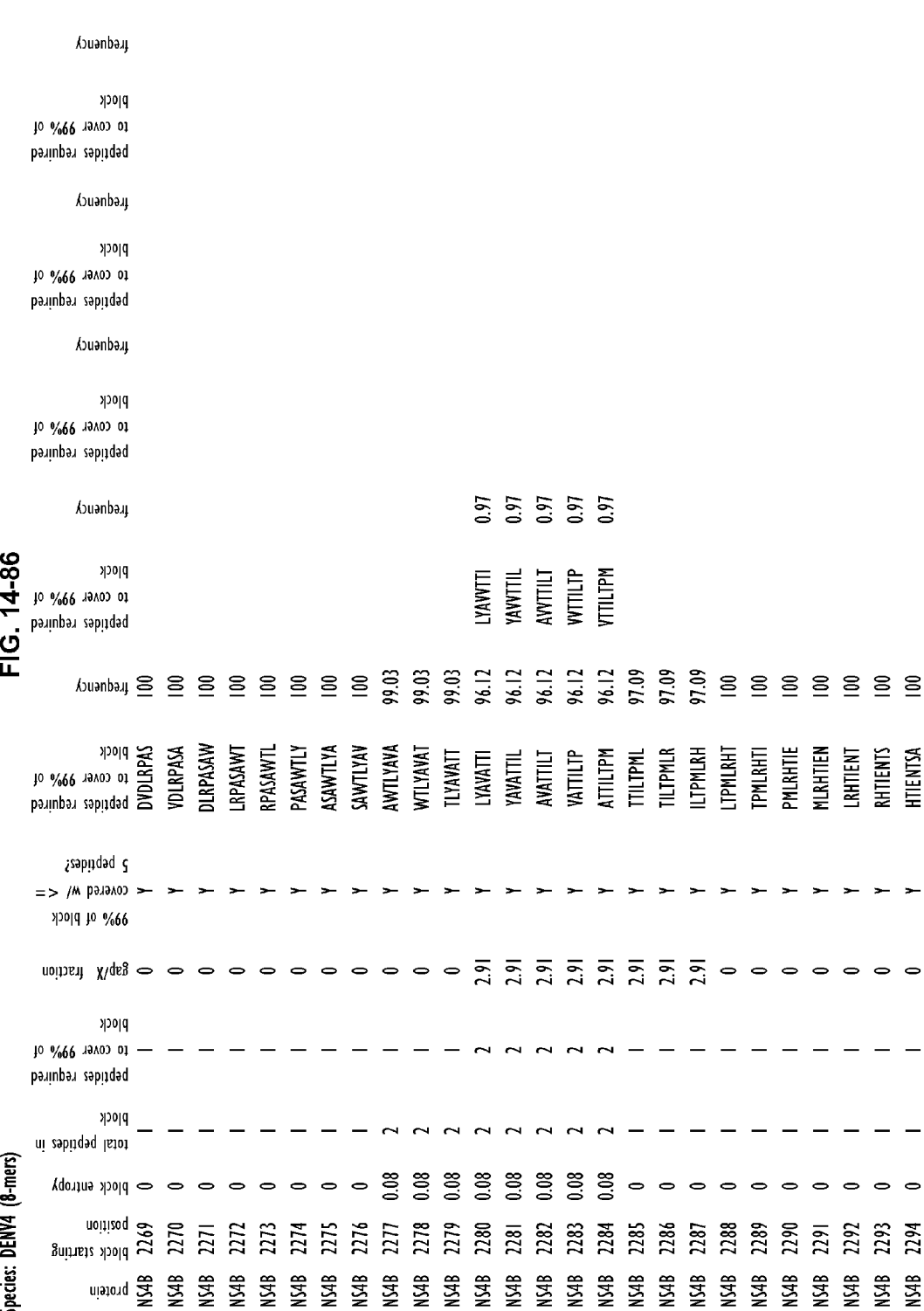

FIG. 14-87

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2295 | 0 | 1 | 1 | 0 | Y

FIG. 14-88

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG. 14-89

Species: DENV4

FIG. 14-90

Species: DENV4 (8-mers)

| protein | block starting position | block entropy | total pe

FIG. 14-91

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency |

FIG. 14-92

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2425 | 0.46 | 2 | 2 | 0 | Y | RTTWAFCE | 90.29 | RTTWALCE | 9.71 | | | | |
| NS4B | 2426 | 0.46 | 2 | 2 | 0 | Y | TTWAFCEV | 90.29 | TTWALCEV | 9.71 | | | | |
| NS4B | 2427 | 0.46 | 2 | 2 | 0 | Y | TWAFCEVL | 90.29 | TWALCEVL | 9.71 | | | | |
| NS4B | 2428 | 0.46 | 2 | 2 | 0 | Y | WAFCEVLT | 90.29 | WALCEVLT | 9.71 | | | | |
| NS4B | 2429 | 0.46 | 2 | 2 | 0 | Y | AFCEVLTL | 90.29 | ALCEVLTL | 9.71 | | | | |
| NS4B | 2430 | 0.54 | 3 | 2 | 0 | Y | FCEVLTLA | 89.32 | LCEVLTLA | 9.71 | | | | |
| NS4B | 2431 | 0.08 | 2 | 1 | 0 | Y | CEVLTLAT | 99.03 | | | | | | |
| NS4B | 2432 | 0.08 | 2 | 1 | 0 | Y | EVLTLATG | 99.03 | | | | | | |
| NS4B | 2433 | 0.08 | 2 | 1 | 0 | Y | VLTLATGP | 99.03 | | | | | | |
| NS4B | 2434 | 0.44 | 4 | 3 | 0 | Y | LTLATGPI | 93.2 | LTLATGPV | 4.85 | LTLATGPT | 0.97 | | |
| NS4B | 2435 | 0.89 | 5 | 4 | 0 | Y | TLATGPIL | 83.5 | TLATGPVL | 9.71 | TLATGPVI | 4.85 | TLSTGPAL | 0.97 |
| NS4B | 2436 | 0.89 | 5 | 4 | 0 | Y | LATGPILT | 83.5 | LATGPIMT | 9.71 | LATGPVLT | 4.85 | LATGPTLT | 0.97 |
| NS4B | 2437 | 0.89 | 5 | 4 | 0 | Y | ATGPILTL | 83.5 | ATGPIMTL | 9.71 | ATGPVLIL | 4.85 | STGPALTL | 0.97 |
| NS4B | 2438 | 0.89 | 5 | 4 | 0 | Y | TGPILTLW | 83.5 | TGPIMTLW | 9.71 | TGPVLTLW | 4.85 | TGPALTLWE | 0.97 |
| NS4B | 2439 | 0.89 | 5 | 4 | 0 | Y | GPILTLWE | 83.5 | GPIMTLWE | 9.71 | GPVLTLWE | 4.85 | GPALTLWE | 0.97 |
| NS4B | 2440 | 0.89 | 5 | 4 | 0 | Y | PILTLWEG | 83.5 | PIMTLWEG | 9.71 | PVLTLWEG | 4.85 | PALTLWEG | 0.97 |
| NS4B | 2441 | 0.54 | 3 | 2 | 0 | Y | ILTLWEGN | 83.5 | IMTLWEGN | 9.71 | VLTLWEGN | 4.85 | ALTLWEGG | 0.97 |
| NS4B | 2442 | 0.54 | 3 | 2 | 0 | Y | LTLWEGNP | 89.32 | MTLWEGNP | 9.71 | | | | |
| NS4B | 2443 | 0.08 | 2 | 1 | 0 | Y | TLWEGNPG | 99.03 | | | | | | |
| NS4B | 2444 | 0.08 | 2 | 1 | 0 | Y | LWEGNPGR | 99.03 | | | | | | |
| NS4B | 2445 | 0.08 | 2 | 1 | 0 | Y | WEGNPGRF | 99.03 | | | | | | |
| NS4B | 2446 | 0.08 | 2 | 1 | 0 | Y | EGNPGRFW | 99.03 | | | | | | |
| NS4B | 2447 | 0.08 | 2 | 1 | 0 | Y | GNPGRFWN | 99.03 | | | | | | |
| NS4B | 2448 | 0.08 | 2 | 1 | 0 | Y | NPGRFWNT | 99.03 | | | | | | |
| NS4B | 2449 | 0 | 1 | 1 | 0 | Y | PGRFWNTT | 100 | | | | | | |
| NS4B | 2450 | 0 | 1 | 1 | 0 | Y | GRFWNTTI | 100 | | | | | | |

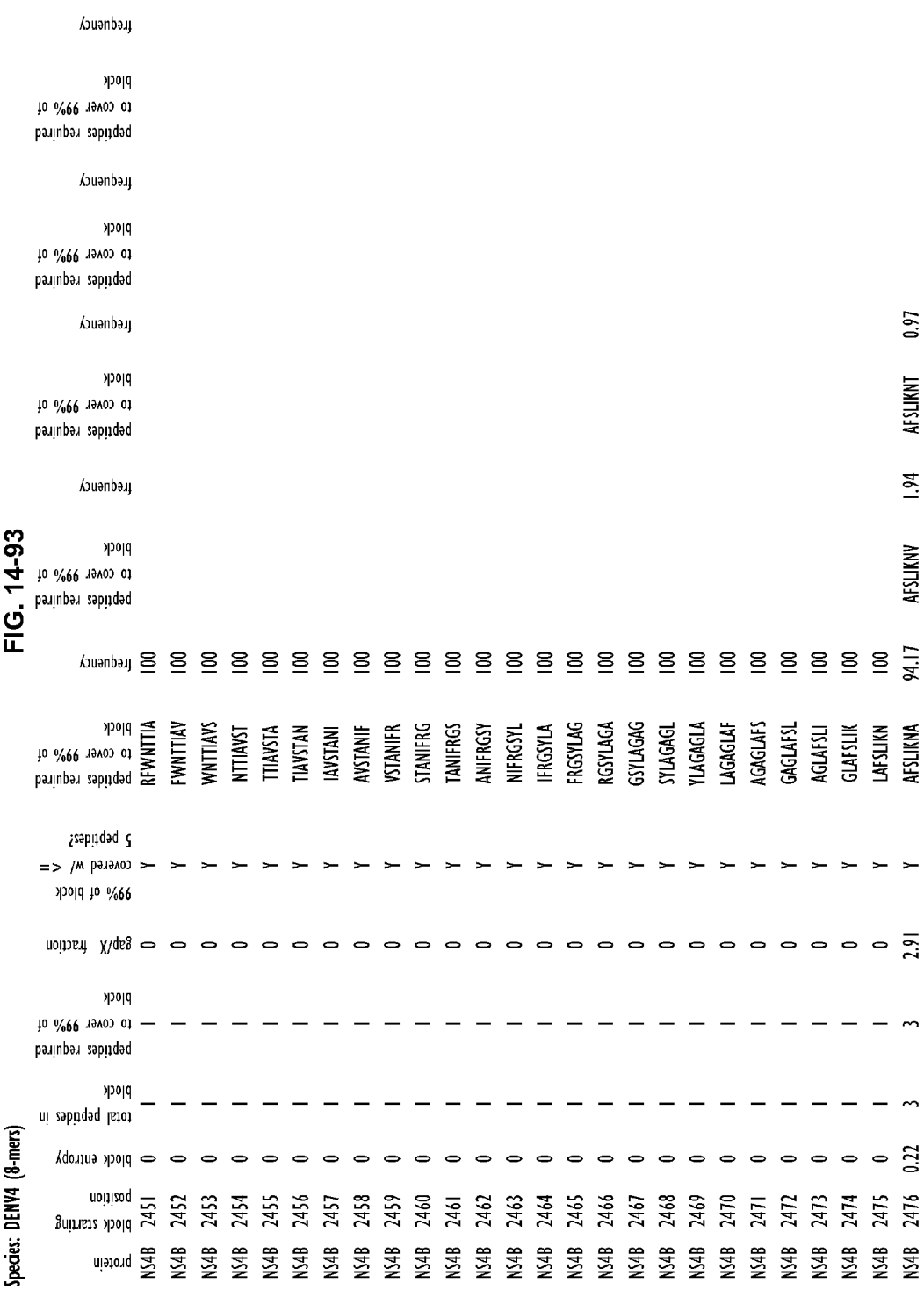

FIG. 14-94

Species: DENV4 (8-mers)

| protein | block starting position | block entropy | total peptides in block | peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS4B | 2477 | 0.22 | 3 | 3 | 2.91 | Y | FSLI

FIG. 14-95

Species: DENV4 (8-mers)

| protein | block starting position | block entropy | total

FIG. 14-96

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 2529 | 0.54 | 3 | 2 | 0

FIG. 14-97

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 2555 | 0.49 | 2 | 2 | 0 | Y | ERGMVKPK | 89.32 | ERGMIKPK | 10.68 | | | | |

FIG. 14-98

Species: DENV4 (8-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 2581 | 0 | 1 | 1 | 0 | Y | TLKNVTEV | 100 | | | | | | |
| NS5 | 2582 | 0.24 | 2 | 2 | 0 | Y | LKNVTEVK | 96.12 | LKNVTEVR | 3.88 | | | | |
| NS5 | 2583 | 0.24 | 2 | 2 | 0 | Y | KNVTEVKG | 96.12 | KNVTEVRG | 3.88 | | | | |
| NS5

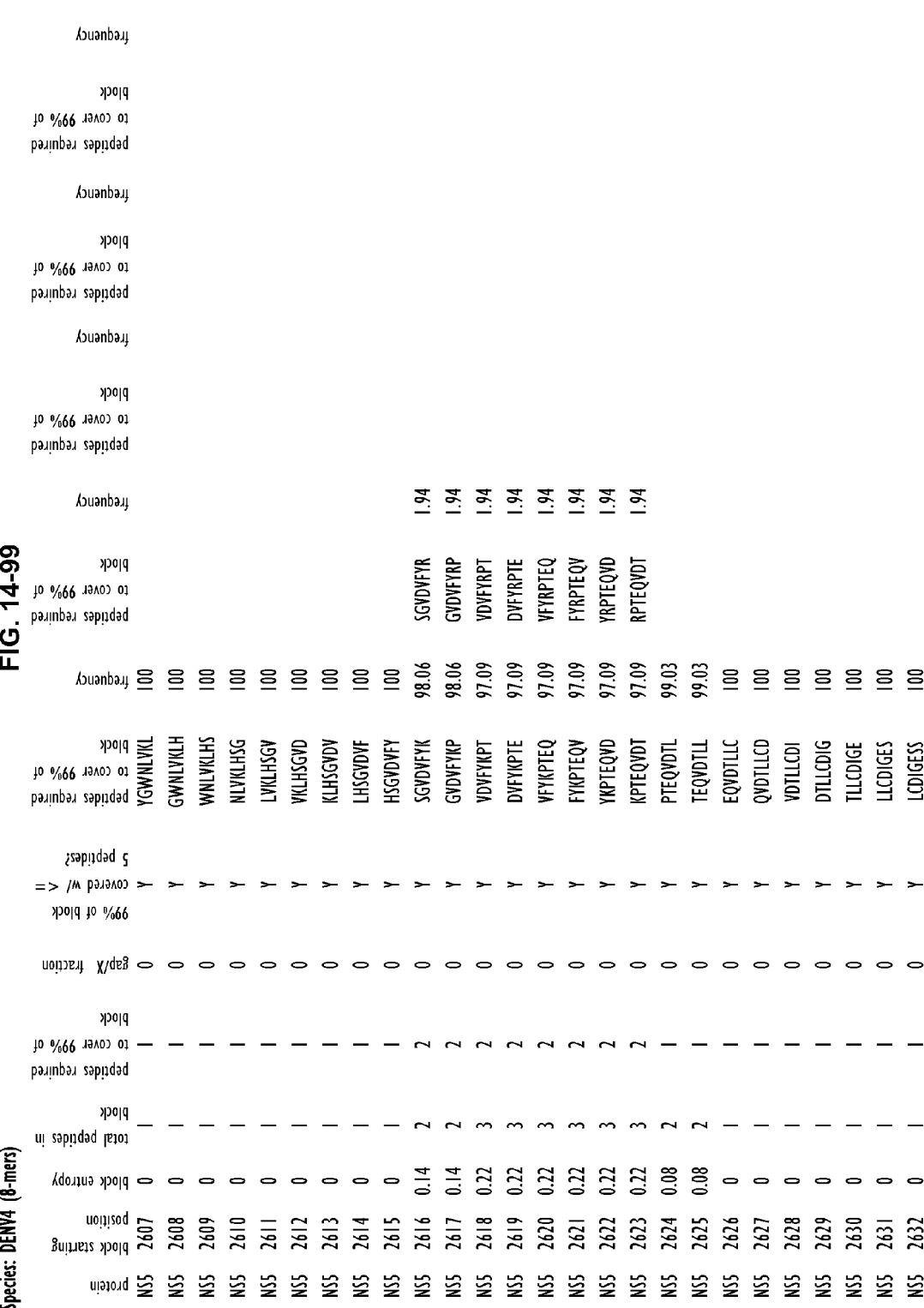

FIG. 14-100

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of

FIG. 14-101

Species: DENV4 (8-mers)

| protein | block starting position | block entropy | total peptides in block | peptides required to cover 99% of block | gap/X fraction | 99% of block covered w/

FIG. 14-102

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2685 | 0.95 | 5 | 4 | 0 | Y | LQRKHGGN | 81.55 | LQRRHGGS | 10.68 | LQRKHGGS | 5.83 | LQRKYGGN | 0.97 |
| NS5 | 2686 | 0.95 | 5 | 4 | 0 | Y | QRKHGGNL | 81.55 | QRRHGGSL | 10.68 | QRKHGGSL | 5.83 | QRKYGGNL | 0.97 |
| NS5 | 2687 | 1.01 | 6 | 5 | 0 | Y | RKHGGNLV | 81.55 | RRHGGSLV | 10.68 | RKHGGSLV | 3.88 | RKHGGSLI | 1.94 |
| NS5 | 2688 | 1.01 | 6 | 5 | 0 | Y | KHGGNLVR | 81.55 | RHGGSLVR | 10.68 | KHGGSLVR | 3.88 | KHGGSLIR | 1.94 |
| NS5 | 2689 | 0.88 | 5 | 4 | 0 | Y | HGGNLVRC | 81.55 | HGGSLVRC | 14.56 | HGGSLIRC | 1.94 | YGGSLVRC | 0.97 |
| NS5 | 2690 | 0.83 | 4 | 3 | 0 | Y | GGNLVRCP | 81.55 | GGSLVRCP | 15.53 | GGSLIRCP | 1.94 | | |
| NS5 | 2691 | 0.83 | 4 | 3 | 0 | Y | GNLVRCPL | 81.55 | GSLVRCPL | 15.53 | GSLIRCPL | 1.94 | | |
| NS5 | 2692 | 0.83 | 4 | 3 | 0 | Y | NLVRCPLS | 81.55 | SLVRCPLS | 15.53 | SLIRCPLS | 1.94 | | |
| NS5 | 2693 | 0.19 | 2 | 2 | 0 | Y | LVRCPLSR | 97.09 | LIRCPLSR | 2.91 | | | | |
| NS5 | 2694 | 0.19 | 2 | 2 | 0 | Y | VRCPLSRN | 97.09 | IRCPLSRN | 2.91 | | | | |
| NS5 | 2695 | 0 | 1 | 1 | 0 | Y | RCPLSRNS | 100 | | | | | | |
| NS5 | 2696 | 0 | 1 | 1 | 0 | Y | CPLSRNST | 100 | | | | | | |
| NS5 | 2697 | 0 | 1 | 1 | 0 | Y | PLSRNSTH | 100 | | | | | | |
| NS5 | 2698 | 0 | 1 | 1 | 0 | Y | LSRNSTHE | 100 | | | | | | |
| NS5 | 2699 | 0 | 1 | 1 | 0 | Y | SRNSTHEM | 100 | | | | | | |
| NS5 | 2700 | 0 | 1 | 1 | 0 | Y | RNSTHEMY | 100 | | | | | | |
| NS5 | 2701 | 0 | 1 | 1 | 0 | Y | NSTHEMYW | 100 | | | | | | |
| NS5 | 2702 | 0 | 1 | 1 | 0 | Y | STHEMYWV | 100 | | | | | | |
| NS5 | 2703 | 0 | 1 | 1 | 0 | Y | THEMYWVS | 100 | | | | | | |
| NS5 | 2704 | 0 | 1 | 1 | 0 | Y | HEMYWVSG | 100 | | | | | | |
| NS5 | 2705 | 0.32 | 2 | 2 | 0 | Y | EMYWVSGA | 94.17 | EMYWYSGV | 5.83 | | | | |
| NS5 | 2706 | 0.4 | 3 | 2 | 0 | Y | MYWVSGAS | 93.2 | MYWVSGVS | 5.83 | | | | |
| NS5 | 2707 | 0.4 | 3 | 2 | 0 | Y | YWVSGASG | 93.2 | YWVSGVSG | 5.83 | | | | |
| NS5 | 2708 | 0.4 | 3 | 2 | 0 | Y | WVSGASGN | 93.2 | WVSGVSGN | 5.83 | | | | |
| NS5 | 2709 | 0.4 | 3 | 2 | 0 | Y | VSGASGNI | 93.2 | VSGVSGNI | 5.83 | | | | |
| NS5 | 2710 | 0.4 | 3 | 2 | 0 | Y | SGASGNIV | 93.2 | SGVSGNIV | 5.83 | | | | |

FIG. 14-103

Species: DENV4 (8-mers)

| protein | block starting position | block entropy | total peptides in block | peptides required to cover 99% of block | gap/X fraction | 99% of

FIG. 14-105

Species: DENV4 (8-mers)

| protein | block starting position | block entropy | total peptides in block | peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2763 | 0.08 | 2 | 1 | 0 | Y | TIIGRRLQ | 99.03 | | | | | | |
| NS5 | 2764 | 0.08 | 2 | 1 | 0 | Y | IIGRRLQR | 99.03 | | | | | | |
| NS5 | 2765 | 0 | 1 | 1 | 0 | Y | IGRRLQRL | 100 | | | | | | |
| NS5 | 2766 | 0.46 | 2 | 2 | 0 | Y | GRRLQRLQ | 90.29 | GRRLQRLR | 9.71 | | | | |
| NS5 | 2767 | 0.46 | 2 | 2 | 0 | Y | RRLQRLQE | 90.29 | RRLQRLRE | 9.71 | | | | |
| NS5 | 2768 | 0.46 | 2 | 2 | 0 | Y | RLQRLQEE | 90.29 | RLQRLREE | 9.71 | | | | |
| NS5 | 2769 | 0.46 | 2 | 2 | 0 | Y | LQRLQEEH | 90.29 | LQRLREEH | 9.71 | | | | |
| NS5 | 2770 | 0.46 | 2 | 2 | 0 | Y | QRLQEEHK | 90.29 | QRLREEHK | 9.71 | | | | |
| NS5 | 2771 | 0.46 | 2 | 2 | 0 | Y | RLQEEHKE | 90.29 | RLREEHKE | 9.71 | | | | |
| NS5 | 2772 | 0.46 | 2 | 2 | 0 | Y | LQEEHKET | 90.29 | LREEHKET | 9.71 | | | | |
| NS5 | 2773 | 0.46 | 2 | 2 | 0 | Y | QEEHKETW | 90.29 | REEHKETW | 9.71 | | | | |
| NS5 | 2774 | 0 | 1 | 1 | 0 | Y | EEHKETWH | 100 | | | | | | |
| NS5 | 2775 | 0 | 1 | 1 | 0 | Y | EHKETWHY | 100 | | | | | | |
| NS5 | 2776 | 0 | 1 | 1 | 0 | Y | HKETWHYD | 100 | | | | | | |
| NS5 | 2777 | 0.14 | 2 | 2 | 0 | Y | KETWHYDQ | 98.06 | KETWHYDH | 1.94 | | | | |
| NS5 | 2778 | 0.14 | 2 | 2 | 0 | Y | ETWHYDQE | 98.06 | ETWHYDHE | 1.94 | | | | |
| NS5 | 2779 | 0.14 | 2 | 2 | 0 | Y | TWHYDQEN | 98.06 | TWHYDHEN | 1.94 | | | | |
| NS5 | 2780 | 0.14 | 2 | 2 | 0 | Y | WHYDQENP | 98.06 | WHYDHENP | 1.94 | | | | |
| NS5 | 2781 | 0.14 | 2 | 2 | 0 | Y | HYDQENPY | 98.06 | HYDHENPY | 1.94 | | | | |
| NS5 | 2782 | 0.14 | 2 | 2 | 0 | Y | YDQENPYR | 98.06 | YDHENPYR | 1.94 | | | | |
| NS5 | 2783 | 0.14 | 2 | 2 | 0 | Y | DQENPYRT | 98.06 | DHENPYRT | 1.94 | | | | |
| NS5 | 2784 | 0.14 | 2 | 2 | 0 | Y | QENPYRTW | 98.06 | HENPYRTW | 1.94 | | | | |
| NS5 | 2785 | 0 | 1 | 1 | 0 | Y | ENPYRTWA | 100 | | | | | | |
| NS5 | 2786 | 0 | 1 | 1 | 0 | Y | NPYRTWAY | 100 | | | | | | |
| NS5 | 2787 | 0 | 1 | 1 | 0 | Y | PYRTWAYH | 100 | | | | | | |
| NS5 | 2788 | 0 | 1 | 1 | 0 | Y | YRTWAYHG | 100 | | | | | | |

FIG. 14-106

Species: DENV4 (8-mers)

| protein | block star

FIG. 14-107

Species: DENV4 (8-mers)

| protein | block starting position | block entropy | total peptides in block | peptides required to cover 99% of block | gap/X fraction | covered w/ <= 5 peptides? 99% of block | peptides required to cover 99% of block | frequency | peptides required to cover 99% of block | frequency | pept

FIG. 14-108

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides

FIG. 14-109

Species: DENV4 (8-mers)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS5 | 2867 | 0.19 | 2 | 2 | 0 | Y | NWLWALLG | 97.09 | NWLWT

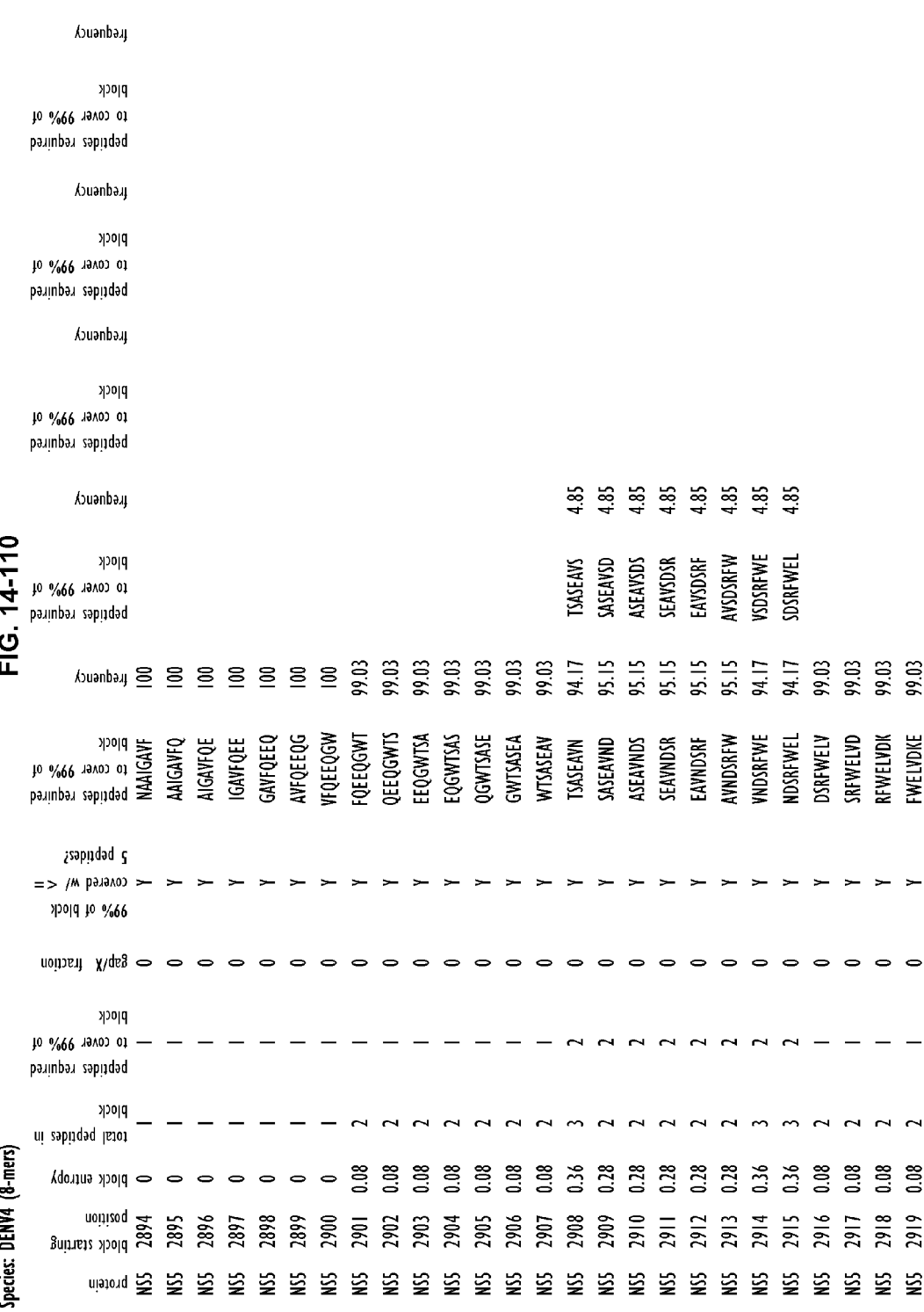

FIG. 14-111

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | block | frequency |
|---|---|---|---|---|---|---|---|---|---|---|---|
| NS5 | 2920 | 0.08 | 2 | 1 | 0 | Y | WELVDKER | 99.03 | | | |

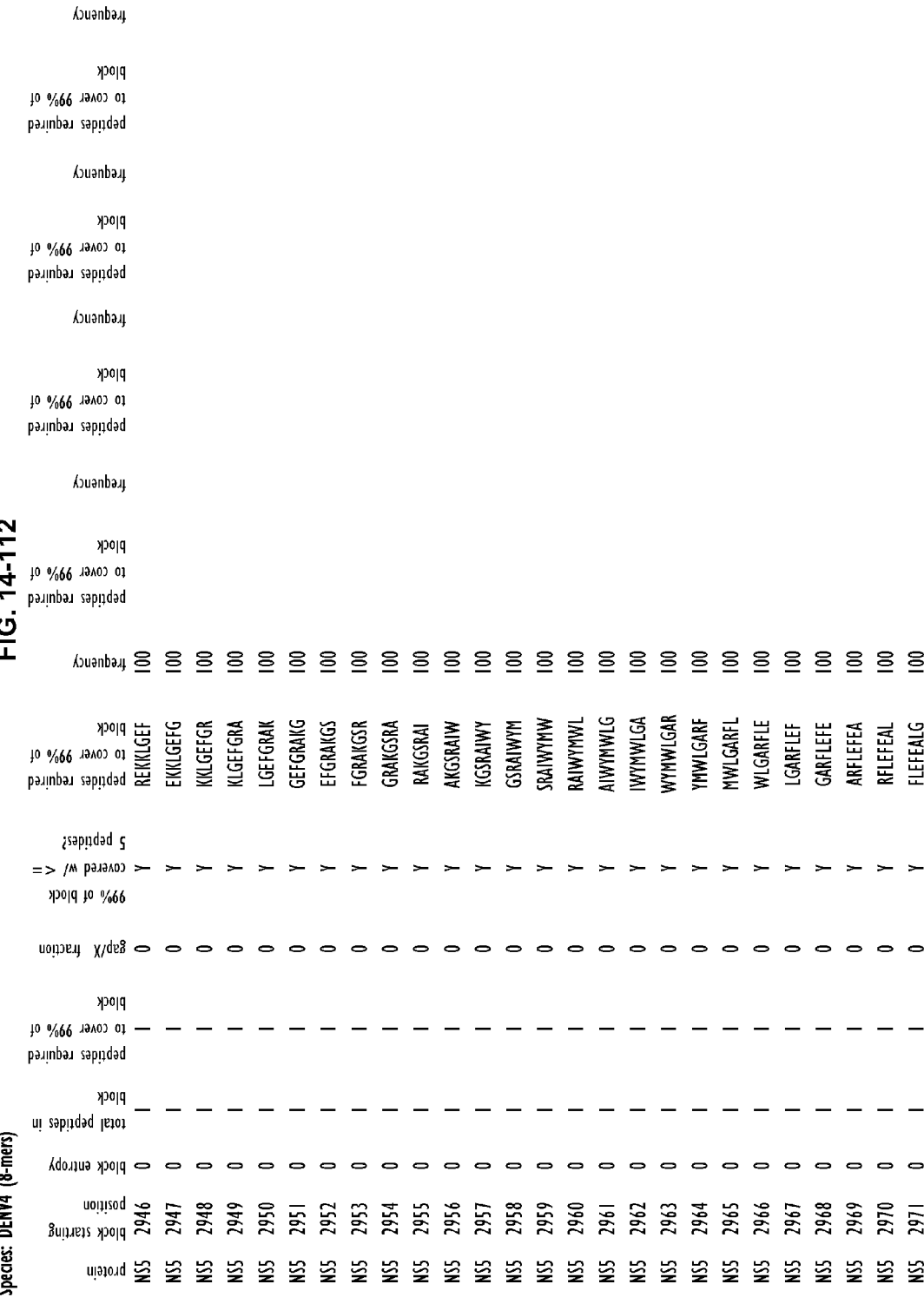

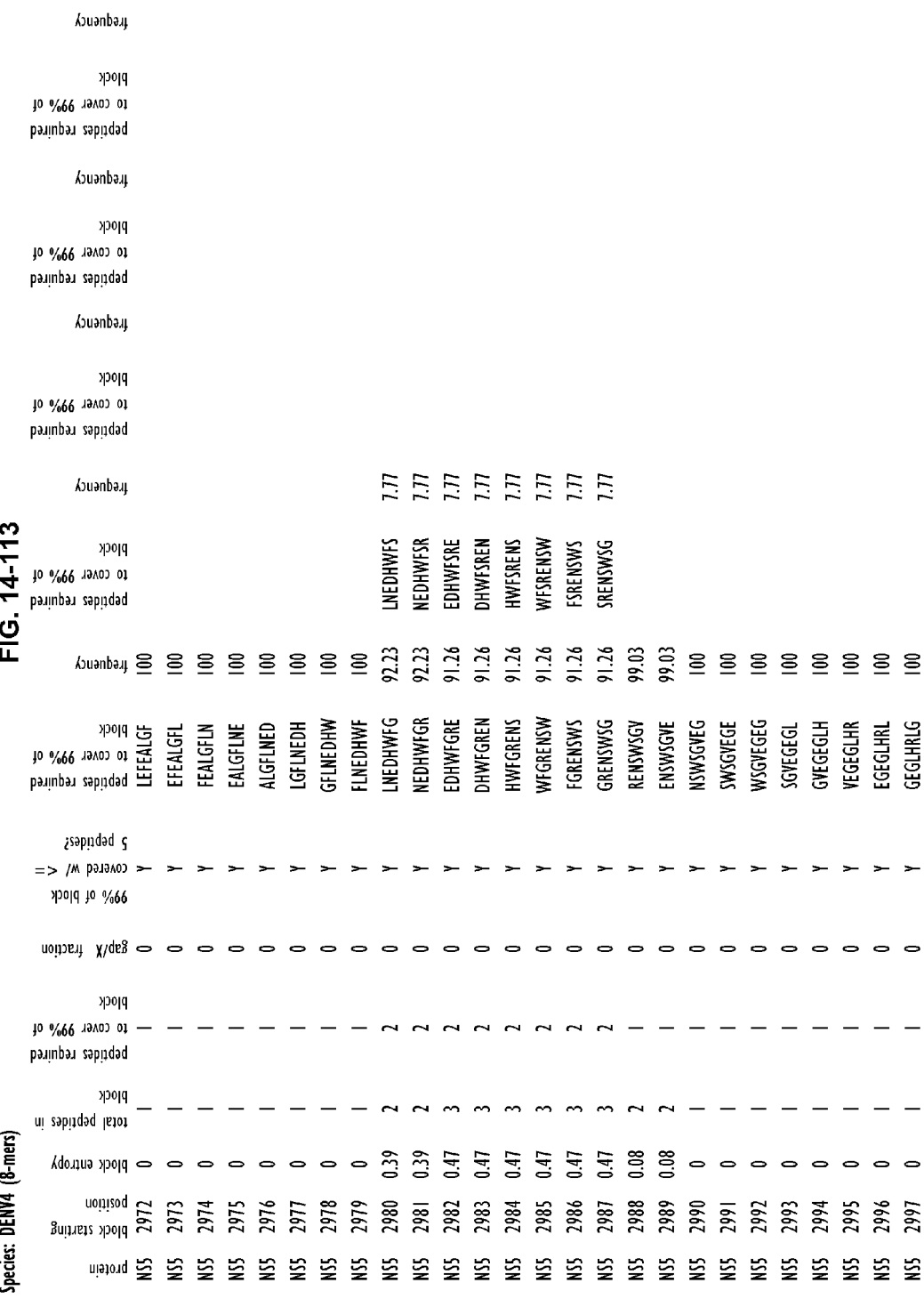

FIG. 14-114

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2998 | 0 | 1 | 1 | 0 | Y | EGLHRL

FIG. 14-115

Species: DENV4 (8-mers)

| protein | block starting position | block entropy | total peptides in block | peptides required to cover 99% of block | gap/X fraction | 99% of block covered w/ <= 5 peptides? | pe

FIG. 14-116

Species: DENV4 (8-mers)

| protein | block starting position | block entropy | total peptides in block | peptides required to cover 99% of block | gap/X fraction | 99% of block covered w/ <= 5 peptides? | block | frequency | peptides required to

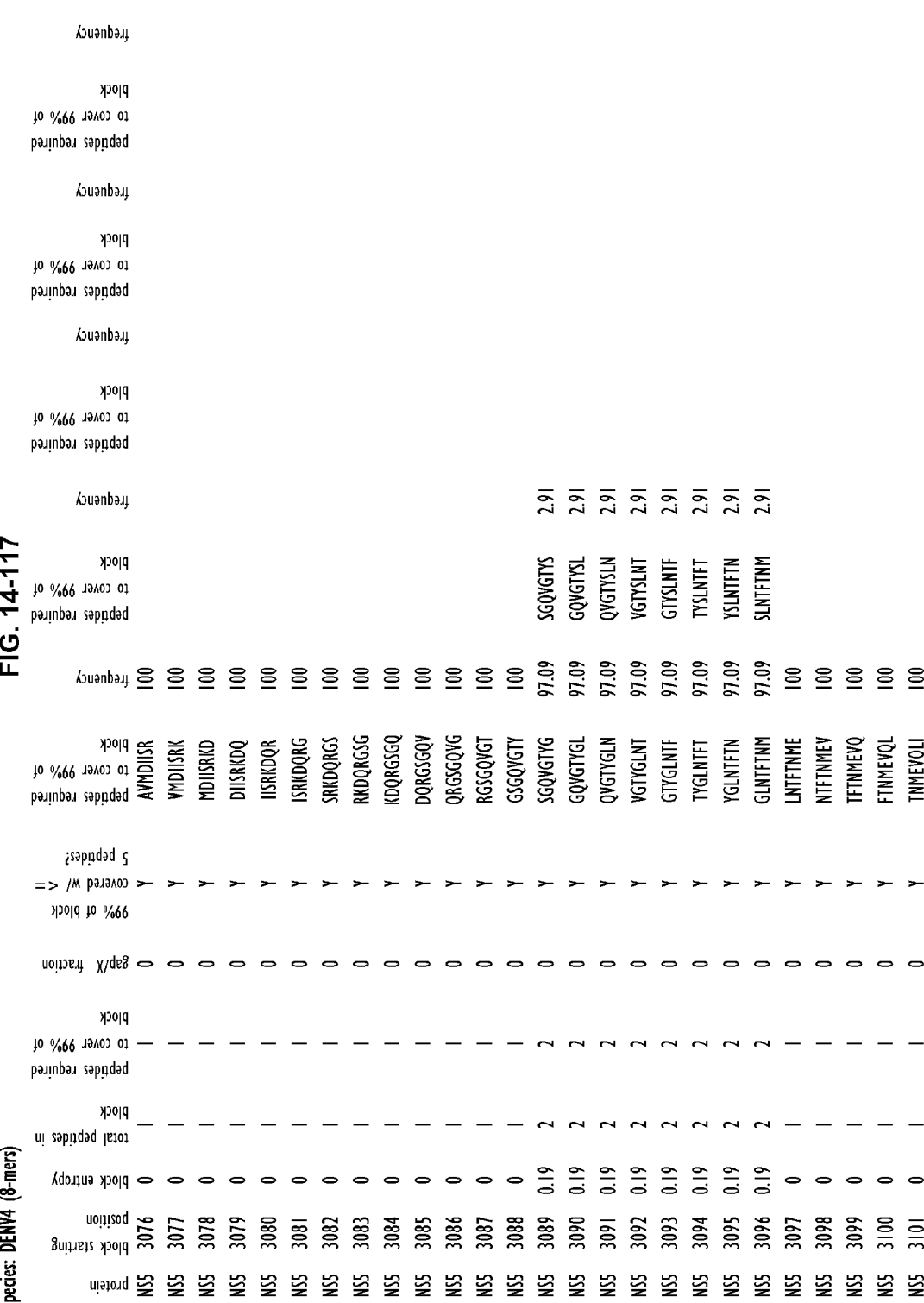

FIG. 14-118

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3102 | 0 | 1 | 1 | 0 | Y | NMEVQLIR | 100 | | | | | | | | |
| NS5 | 3103 | 0 | 1 | 1 | 0 | Y | MEVQLIRQ | 100 | | | | | | | | |
| NS5 | 3104 | 0 | 1 | 1 | 0 | Y | EVQLIRQM | 100 | | | | | | | | |
| NS5 | 3105 | 0 | 1 | 1 | 0 | Y | VQLIRQME | 100 | | | | | | | | |
| NS5 | 3106 | 0 | 1 | 1 | 0 | Y | QLIRQMEA | 100 | | | | | | | | |
| NS5 | 3107 | 0 | 1 | 1 | 0 | Y | LIRQMEAE | 100 | | | | | | | | |
| NS5 | 3108 | 0 | 1 | 1 | 0 | Y | IRQMEAEG | 100 | | | | | | | | |
| NS5 | 3109 | 0 | 1 | 1 | 0 | Y | RQMEAEGV | 100 | | | | | | | | |
| NS5 | 3110 | 0 | 1 | 1 | 0 | Y | QMEAEGVI | 100 | | | | | | | | |
| NS5 | 3111 | 0 | 1 | 1 | 0 | Y | MEAEGVIT | 100 | | | | | | | | |
| NS5 | 3112 | 0.19 | 2 | 2 | 0 | Y | EAEGVITQ | 97.09 | EAEGVITR | 2.91 | | | | | | |
| NS5 | 3113 | 0.19 | 2 | 2 | 0 | Y | AEGVITQD | 97.09 | AEGVITRD | 2.91 | | | | | | |
| NS5 | 3114 | 0.19 | 2 | 2 | 0 | Y | EGVITQDD | 97.09 | EGVITRDD | 2.91 | | | | | | |
| NS5 | 3115 | 0.19 | 2 | 2 | 0 | Y | GVITQDDM | 97.09 | GVITRDDM | 2.91 | | | | | | |
| NS5 | 3116 | 0.38 | 3 | 3 | 0 | Y | VITQDDMQ | 94.17 | VITRDDMH | 2.91 | VITQDDMH | 2.91 | | | | |
| NS5 | 3117 | 0.38 | 3 | 3 | 0 | Y | ITQDDMQN | 94.17 | ITRDDMHN | 2.91 | ITRDDMHN | 2.91 | | | | |
| NS5 | 3118 | 0.38 | 3 | 3 | 0 | Y | TQDDMQNP | 94.17 | TRDDMHNP | 2.91 | TQDDMHNP | 2.91 | | | | |
| NS5 | 3119 | 0.38 | 3 | 3 | 0 | Y | QDDMQNPK | 94.17 | RDDMHNPK | 2.91 | QDDMHNPK | 2.91 | | | | |
| NS5 | 3120 | 0.32 | 3 | 2 | 0 | Y | DDMQNPKG | 94.17 | DDMHNPKG | 5.83 | | | | | | |
| NS5 | 3121 | 0.32 | 3 | 2 | 0 | Y | DMQNPKGL | 94.17 | DMHNPKGL | 5.83 | | | | | | |
| NS5 | 3122 | 0.4 | 3 | 2 | 0 | Y | MQNPKGLK | 93.2 | MHNPKGLK | 5.83 | | | | | | |
| NS5 | 3123 | 0.4 | 3 | 2 | 0 | Y | QNPKGLKE | 93.2 | HNPKGLKE | 5.83 | | | | | | |
| NS5 | 3124 | 0.16 | 2 | 2 | 0 | Y | NPKGLKER | 98.06 | NPKGLKEK | 0.97 | | | | | | |
| NS5 | 3125 | 0.16 | 2 | 2 | 0 | Y | PKGLKERV | 98.06 | PKGLRERV | 0.97 | | | | | | |
| NS5 | 3126 | 0.16 | 2 | 2 | 0 | Y | KGLKERVE | 98.06 | KGLRERVE | 0.97 | | | | | | |
| NS5 | 3127 | 0.39 | 4 | 3 | 0 | Y | GLKERVEK | 94.17 | GLKERVEN | 3.88 | GLKEKVEK | 0.97 | | | | |

FIG. 14-119

Species: DENV4 (8-mers)

| protein | block starting position | block entropy | total peptides in block | peptides required to cover 99% of block | g

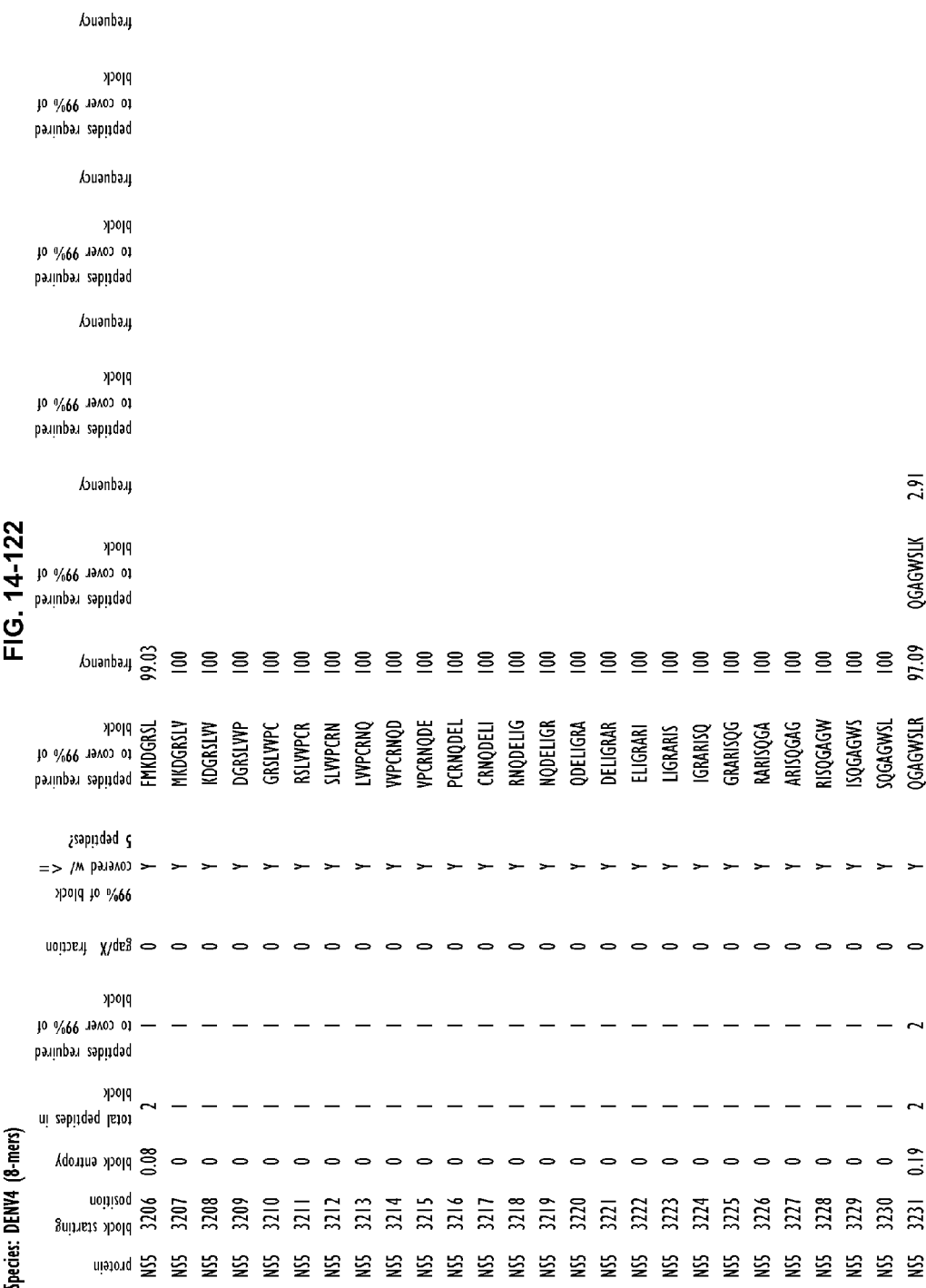

FIG. 14-123

Species: DENV4 (8-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3232 | 0.19 | 2 | 2 | 0 | Y | GAGWSLRE | 97.09 | GAGWSLKE | 2.91 | | | | |
| NS5 | 3233 | 0.19 | 2 | 2 | 0 | Y | AGWSLRET | 97.09 | AGWSLKET | 2.91 | | | | |
| NS5 | 3234 | 0.19 | 2 | 2 | 0 | Y | GWSLRETA | 97.09 | GWSLKETA | 2.91 | | | | |
| NS5 | 3235 | 0.19 | 2 | 2 | 0 | Y | WSLRETAC | 97.09 | WSLKETAC | 2.91 | | | | |
| NS5 | 3236 | 0.19 | 2 | 2 | 0 | Y | SLRETACL | 97.09 | SLKETACL | 2.91 | | | | |
| NS5 | 3237 | 0.19 | 2 | 2 | 0 | Y | LRETACLG | 97.09 | LKETACLG | 2.91 | | | | |
| NS5 | 3238 | 0.19 | 2 | 2 | 0 | Y | RETACLGK | 97.09 | KETACLGK | 2.91 | | | | |
| NS5 | 3239 | 0 | 1 | 1 | 0 | Y | ETACLGKA | 100 | | | | | | |
| NS5 | 3240 | 0 | 1 | 1 | 0 | Y | TACLGKAY | 100 | | | | | | |
| NS5 | 3241 | 0 | 1 | 1 | 0 | Y | ACLGKAYA | 100 | | | | | | |
| NS5 | 3242 | 0 | 1 | 1 | 0 | Y | CLGKAYAQ | 100 | | | | | | |
| NS5 | 3243 | 0 | 1 | 1 | 0 | Y | LGKAYAQM | 100 | | | | | | |
| NS5 | 3244 | 0 | 1 | 1 | 0 | Y | GKAYAQMW | 100 | | | | | | |
| NS5 | 3245 | 0 | 1 | 1 | 0 | Y | KAYAQMWS | 100 | | | | | | |
| NS5 | 3246 | 0 | 1 | 1 | 0 | Y | AYAQMWSL | 100 | | | | | | |
| NS5 | 3247 | 0 | 1 | 1 | 0 | Y | YAQMWSLM | 100 | | | | | | |
| NS5 | 3248 | 0 | 1 | 1 | 0 | Y | AQMWSLMY | 100 | | | | | | |
| NS5 | 3249 | 0 | 1 | 1 | 0 | Y | QMWSLMYF | 100 | | | | | | |
| NS5 | 3250 | 0 | 1 | 1 | 0 | Y | MWSLMYFH | 100 | | | | | | |
| NS5 | 3251 | 0 | 1 | 1 | 0 | Y | WSLMYFHR | 100 | | | | | | |
| NS5 | 3252 | 0 | 1 | 1 | 0 | Y | SLMYFHRR | 100 | | | | | | |
| NS5 | 3253 | 0 | 1 | 1 | 0 | Y | LMYFHRRD | 100 | | | | | | |
| NS5 | 3254 | 0 | 1 | 1 | 0 | Y | MYFHRRDL | 100 | | | | | | |
| NS5 | 3255 | 0 | 1 | 1 | 0 | Y | YFHRRDLR | 100 | | | | | | |
| NS5 | 3256 | 0 | 1 | 1 | 0 | Y | FHRRDLRL | 100 | | | | | | |
| NS5 | 3257 | 0 | 1 | 1 | 0 | Y | HRRDLRLA | 100 | | | | | | |

FIG. 14-124

Species: DENV4 (8-mers)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS5 | 3258 | 0 | 1 | 1 | 0 | Y | RRDLRLAS | 100 | | |
| NS5 | 3259 | 0 | 1 | 1 | 0 | Y | RDLRLASM | 100 | | |
| NS5 | 3260 | 0 | 1 | 1 | 0 | Y | DLRLASMA | 100 | | |
| NS5 | 3261 | 0 | 1 | 1 | 0 | Y | LRLASMAI | 100 | | |
| NS5 | 3262 | 0 | 1 | 1 | 0 | Y | RLASMAIC | 100 | | |
| NS5 | 3263 | 0 | 1 | 1 | 0 | Y | LASMAICS | 100 | | |
| NS5 | 3264 | 0 | 1 | 1 | 0 | Y | ASMAICSA | 100 | | |
| NS5 | 3265 | 0 | 1 | 1 | 0 | Y | SMAICSAV | 100 | | |
| NS5 | 3266 | 0 | 1 | 1 | 0 | Y | MAICSAVP | 100 | | |
| NS5 | 3267 | 0.08 | 2 | 1 | 0 | Y | AICSAVPT | 99.03 | | |
| NS5 | 3268 | 0.08 | 2 | 1 | 0 | Y | ICSAVPTE | 99.03 | | |
| NS5 | 3269 | 0.08 | 2 | 1 | 0 | Y | CSAVPTEW | 99.03 | | |
| NS5 | 3270 | 0.16 | 3 | 2 | 0 | Y | SAVPTEWF | 98.06 | SAVPTEWL | 0.97 |
| NS5 | 3271 | 0.16 | 3 | 2 | 0 | Y | AVPTEWFP | 98.06 | AVPVEWVP | 0.97 |
| NS5 | 3272 | 0.16 | 3 | 2 | 0 | Y | VPTEWFPT | 98.06 | VPVEWVPT | 0.97 |
| NS5 | 3273 | 0.16 | 3 | 2 | 0 | Y | PTEWFPTS | 98.06 | PTEWLPTS | 0.97 |
| NS5 | 3274 | 0.16 | 3 | 2 | 0 | Y | TEWFPTSR | 98.06 | VEWVPTSR | 0.97 |
| NS5 | 3275 | 0.16 | 3 | 2 | 0 | Y | EWFPTSRT | 98.06 | EWVPTSRT | 0.97 |
| NS5 | 3276 | 0.16 | 3 | 2 | 0 | Y | WFPTSRTT | 98.06 | WVPTSRTT | 0.97 |
| NS5 | 3277 | 0.16 | 3 | 2 | 0 | Y | FPTSRTTW | 98.06 | VPTSRTTW | 0.97 |
| NS5 | 3278 | 0 | 1 | 1 | 0 | Y | PTSRTTWS | 100 | | |
| NS5 | 3279 | 0 | 1 | 1 | 0 | Y | TSRTTWSI | 100 | | |
| NS5 | 3280 | 0 | 1 | 1 | 0 | Y | SRTTWSIH | 100 | | |

FIG. 14-126

Species: DENV4 (8-mers)

| protein | block starting position | block entropy | total peptides in block | peptides required to cover 99% of block | gap/X fraction | 99% of block covered w/ <= 5 peptides? | block | fr

FIG. 14-127

Species: DENV4 (8-mers)

| protein | block star

FIG. 14-128

Species: DENV4 (8-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required

FIG. 15-1

Species: DENV4 (9-mers)

| protein | block starting position | block entropy | total peptides in block | peptides required to cover 99% of block | gap/X fraction | 99% of block covered w/ <= 5 peptides? | block | fr

FIG. 15-2

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| anC | 28 | 0.55 | 4 | 4 | 0 | Y | GLVKRFSTG | 91.26 | QLTKRFSLG | 1.94 | | | | |
| anC | 29 | 0.55 | 4 | 4 | 0 | Y | LVKRFSTGL | 91.26 | LVKRFSIGL | 1.94 | GLVKRFSIG | 1.94 | | |
| anC | 30 | 0.55 | 4 | 4 | 0 | Y | VKRFSTGLF | 91.26 | VKRFSIGLF | 1.94 | LTKRFSLGM | 1.94 | | |
| anC | 31 | 0.55 | 4 | 4 | 0 | Y | KRFSTGLFS | 91.26 | KRFSIGLFS | 1.94 | TKRFSLGML | 1.94 | | |
| anC | 32 | 0.55 | 4 | 4 | 0 | Y | RFSTGLFSG | 91.26 | RFSIGLFSG | 1.94 | KRFSLGMLQ | 1.94 | | |
| anC | 33 | 0.55 | 4 | 4 | 0 | Y | FSTGLFSGK | 91.26 | FSIGLFSGK | 1.94 | RFSLGMLQG | 1.94 | | |
| anC | 34 | 0.55 | 4 | 4 | 0 | Y | STGLFSGKG | 91.26 | SIGLFSGKG | 1.94 | FSLGMLQGR | 1.94 | | |
| anC | 35 | 0.55 | 4 | 4 | 0 | Y | TGLFSGKGP | 91.26 | IGLFSGKGP | 1.94 | SLGMLQGRG | 1.94 | | |
| anC | 36 | 0.14 | 2 | 2 | 0 | Y | GLFSGKGPL | 98.06 | GMLQGRGPL | 1.94 | | | | |
| anC | 37 | 0.14 | 2 | 2 | 0 | Y | LFSGKGPLR | 98.06 | MLQGRGPLK | 1.94 | | | | |
| anC | 38 | 0.14 | 2 | 2 | 0 | Y | FSGKGPLRM | 98.06 | LQGRGPLKL | 1.94 | | | | |
| anC | 39 | 0.14 | 2 | 2 | 0 | Y | SGKGPLRMV | 98.06 | QGRGPLKLF | 1.94 | | | | |
| anC | 40 | 0.14 | 2 | 2 | 0 | Y | GKGPLRMVL | 98.06 | GRGPLKLFM | 1.94 | | | | |
| anC | 41 | 0.14 | 2 | 2 | 0 | Y | KGPLRMVLA | 98.06 | RGPLKLFMA | 1.94 | | | | |
| anC | 42 | 0.14 | 2 | 2 | 0 | Y | GPLRMVLAF | 98.06 | GPLKLFMAL | 1.94 | | | | |
| anC | 43 | 0.14 | 2 | 2 | 0 | Y | PLRMVLAFI | 98.06 | PLKLFMALV | 1.94 | | | | |
| anC | 44 | 0.14 | 2 | 2 | 0 | Y | LRMVLAFIT | 98.06 | LKLFMALVA | 1.94 | | | | |
| anC | 45 | 0.14 | 2 | 2 | 0 | Y | RMVLAFITF | 98.06 | KLFMALVAF | 1.94 | | | | |
| anC | 46 | 0.14 | 2 | 2 | 0 | Y | MVLAFITFL | 98.06 | LFMALVAFL | 1.94 | | | | |
| anC | 47 | 0.14 | 2 | 2 | 0 | Y | VLAFITFLR | 98.06 | FMALVAFLR | 1.94 | | | | |
| anC | 48 | 0.14 | 2 | 2 | 0 | Y | LAFITFLRV | 98.06 | MALVAFLRF | 1.94 | | | | |
| anC | 49 | 0.14 | 2 | 2 | 0 | Y | AFITFLRVL | 98.06 | ALVAFLRFL | 1.94 | | | | |
| anC | 50 | 0.14 | 2 | 2 | 0 | Y | FITFLRVLS | 98.06 | LVAFLRFLT | 1.94 | | | | |
| anC | 51 | 0.14 | 2 | 2 | 0 | Y | ITFLRVLSI | 98.06 | VAFLRFLTI | 1.94 | | | | |
| anC | 52 | 0.14 | 2 | 2 | 0 | Y | TFLRVLSIP | 98.06 | AFLRFLTIP | 1.94 | | | | |
| anC | 53 | 0.14 | 2 | 2 | 0 | Y | FLRVLSIPP | 98.06 | FLRFLTIPP | 1.94 | | | | |

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| anC | 80 | 0.7 | 4 | 3 | 0 | Y | ILIGFRKEI | 86.41 | ILIGFRKEI | 10.68 | VLRGFRKEI | 1.94 | | |
| anC | 81 | 0.63 | 3 | 3 | 0 | Y | LIGFRKEIG | 87.38 | LTGFRKEIG | 10.68 | LRGFRKEIG | 1.94 | | |
| anC | 82 | 0.63 | 3 | 3 | 0 | Y | IGFRKEIGR | 87.38 | TGFRKEIGR | 10.68 | RGFRKEIGR | 1.94 | | |
| anC | 83 | 0 | 1 | 1 | 0 | Y | GFRKEIGRM | 100 | | | | | | |
| anC | 84 | 0 | 1 | 1 | 0 | Y | FRKEIGRML | 100 | | | | | | |
| anC | 85 | 0 | 1 | 1 | 0 | Y | RKEIGRMLN | 100 | | | | | | |
| anC | 86 | 0 | 1 | 1 | 0 | Y | KEIGRMLNI | 100 | | | | | | |
| anC | 87 | 0 | 1 | 1 | 0 | Y | EIGRMLNIL | 100 | | | | | | |
| anC | 88 | 0 | 1 | 1 | 0 | Y | IGRMLNILN | 100 | | | | | | |
| anC | 89 | 0.46 | 2 | 2 | 0 | Y | GRMLNILNG | 90.29 | GRMLNILNR | 9.71 | | | | |
| anC | 90 | 0.46 | 2 | 2 | 0 | Y | RMLNILNGR | 90.29 | RMLNILNRR | 9.71 | | | | |
| anC | 91 | 0.67 | 4 | 4 | 0 | Y | MLNILNGRK | 88.35 | MLNILNRRR | 7.77 | MLNILNRRK | 1.94 | | |
| anC | 92 | 0.67 | 4 | 4 | 0 | Y | LNILNGRKR | 88.35 | LNILNRRRR | 7.77 | LNILNRRKR | 1.94 | | |
| anC | 93 | 0.73 | 5 | 5 | 0 | Y | NILNGRKRS | 88.35 | NILNRRRRS | 5.83 | NILNRRRRT | 1.94 | NILNGRRRS | 1.94 |
| anC | 94 | 0.73 | 5 | 5 | 0 | Y | ILNGRKRST | 88.35 | ILNRRRRST | 5.83 | ILNRRRKST | 1.94 | ILNRRRRTA | 1.94 |
| anC | 98 | 1.25 | 6 | 5 | 0 | Y | RKRSTITLL | 74.76 | RKRSTMTLL | 13.59 | RRRTAGMII | 6.8 | | |
| anC | 99 | 1.25 | 6 | 5 | 0 | Y | KRSTITLLC | 74.76 | KRSTMTLLC | 13.59 | KRSTVTLLC | 6.8 | RKRSTVTLL | 1.94 |
| anC | 100 | 1.04 | 4 | 4 | 0 | Y | RSTITLLCL | 74.76 | RSTMTLLCL | 20.39 | RSTVTLLCL | 2.91 | RTAGMIIML | 1.94 |
| anC | 101 | 1.04 | 4 | 4 | 0 | Y | STITLLCLI | 74.76 | STMTLLCLI | 20.39 | STVTLLCLI | 2.91 | TAGMIIMLI | 1.94 |
| anC | 102 | 1.04 | 4 | 4 | 0 | Y | TITLLCLIP | 74.76 | TMTLLCLIP | 20.39 | TVTLLCLIP | 2.91 | AGMIIMLIP | 1.94 |
| anC | 103 | 1.04 | 4 | 4 | 0 | Y | ITLLCLIPT | 74.76 | MTLLCLIPT | 20.39 | VTLLCLIPT | 2.91 | GMIIMLIPT | 1.94 |
| anC | 104 | 0.87 | 4 | 4 | 0 | Y | TLLCLIPTV | 83.5 | TLLCLIPTA | 9.71 | TLLCLIPTI | 4.85 | MIIMLIPTV | 1.94 |
| anC | 105 | 0.87 | 4 | 4 | 0 | Y | LLCLIPTVM | 83.5 | LLCLIPTAM | 9.71 | LLCLIPTIM | 4.85 | IIMLIPTYM | 1.94 |
| anC | 106 | 0.87 | 4 | 4 | 0 | Y | LCLIPTVMA | 83.5 | LCLIPTAMA | 9.71 | LCLIPTIMA | 4.85 | IMLIPTYMA | 1.94 |
| anC | 107 | 0.87 | 4 | 4 | 0 | Y | CLIPTVMAF | 83.5 | CLIPTAMAF | 9.71 | CLIPTIMAF | 4.85 | MLIPTYMAF | 1.94 |
| anC | 108 | 1.14 | 4 | 4 | 0 | Y | LIPTVMAFH | 76.7 | LIPTAMAFH | 9.71 | LIPTMAFS | 8.74 | LIPTIMAFH | 4.85 |

FIG.15-5

Species: DENV4 (9-mers)

| protein | block starting position | block entropy | total peptides in block | peptides required to cover 99% of block | gap/X fraction | 99% of block covered w/ <=5 peptides? | block | frequency | block | frequency | block | frequency | block | frequency | block | frequency |
|---|---|---|---|---|---|---|---|---|---|---|---|---|---|---|---|---|
| anC | 109 | 1.14 | 4 | 4 | 0 | Y | IPTVMAFHL | 76.7 | IPTAMAFHL | 9.71 | IPTVMAFSL | 8.74 | IPTIMAFHL | 4.85 | | |
| anC | 110 | 1.27 | 5 | 5 | 0 | Y | PTVMAFHLS | 74.76 | PTAMAFHLS | 9.71 | PTVMAFSLS | 8.74 | PTIMAFHLS | 4.85 | PTVMAFHLT | 1.94 |
| anC | 111 | 1.31 | 6 | 5 | 0 | Y | TVMAFHLST | 74.76 | TAMAFHLST | 9.71 | TVMAFSLST | 8.74 | TIMAFHLST | 3.88 | TVMAFHLIT | 1.94 |
| anC | 112 | 1.31 | 6 | 5 | 0 | Y | VMAFHLSTR | 74.76 | AMAFHLSTR | 9.71 | VMAFSLSTR | 8.74 | IMAFHLSTR | 3.88 | VMAFHLTTR | 1.94 |
| anC | 113 | 0.64 | 4 | 3 | 0 | Y | MAFHLSTRD | 88.35 | MAFSLSTRD | 8.74 | MAFHLTRN | 1.94 | | | | |
| anC | 114 | 0.64 | 4 | 3 | 0 | Y | AFHLSTRDG | 88.35 | AFSLSTRDG | 8.74 | AFHLTRNG | 1.94 | | | | |
| prM | 115 | 0.64 | 4 | 3 | 0 | Y | FHLSTRDGE | 88.35 | FSLSTRDGE | 8.74 | FHLTRNGE | 1.94 | | | | |
| prM | 116 | 0.64 | 4 | 3 | 0 | Y | HLSTRDGEP | 88.35 | SLSTRDGEP | 8.74 | HLTRNGEP | 1.94 | | | | |
| prM | 117 | 0.22 | 3 | 2 | 0 | Y | LSTRDGEPL | 97.09 | LTTRNGEPH | 1.94 | | | | | | |
| prM | 118 | 0.22 | 3 | 2 | 0 | Y | STRDGEPLM | 97.09 | TTRNGEPHM | 1.94 | | | | | | |
| prM | 119 | 0.22 | 3 | 2 | 0 | Y | TRDGEPLMI | 97.09 | TRNGEPHMI | 1.94 | | | | | | |
| prM | 120 | 0.14 | 2 | 2 | 0 | Y | RDGEPLMIV | 98.06 | RNGEPHMIV | 1.94 | | | | | | |
| prM | 121 | 0.22 | 3 | 2 | 0 | Y | DGEPLMIVA | 97.09 | NGEPHMIVS | 1.94 | | | | | | |
| prM | 122 | 0.3 | 4 | 3 | 0 | Y | GEPLMIVAK | 96.12 | GEPHMIVSR | 1.94 | GEPLMIVGK | 0.97 | | | | |
| prM | 123 | 0.3 | 4 | 3 | 0 | Y | EPLMIVAKH | 96.12 | EPHMIVSRQ | 1.94 | EPLMIVARH | 0.97 | | | | |
| prM | 124 | 0.3 | 4 | 3 | 0 | Y | PLMIVAKHE | 96.12 | PHMIVSRQE | 1.94 | PLMIVARHE | 0.97 | | | | |
| prM | 125 | 0.3 | 4 | 3 | 0 | Y | LMIVAKHER | 96.12 | HMIVSRQEK | 1.94 | LMIVGKHER | 0.97 | | | | |
| prM | 126 | 0.3 | 4 | 3 | 0 | Y | MIVAKHERG | 96.12 | MIVSRQEKG | 1.94 | MIVGKHERG | 0.97 | | | | |
| prM | 127 | 0.3 | 4 | 3 | 0 | Y | IVAKHERGR | 96.12 | IVSRQEKGK | 1.94 | IVGKHERGR | 0.97 | | | | |
| prM | 128 | 0.3 | 4 | 3 | 0 | Y | VAKHERGRP | 96.12 | VSRQEKGKS | 1.94 | VGKHERGRP | 0.97 | | | | |
| prM | 129 | 0.3 | 3 | 3 | 0 | Y | AKHERGRPL | 96.12 | SRQEKGKSL | 1.94 | ARHERGRPL | 0.97 | | | | |
| prM | 130 | 0.22 | 2 | 2 | 0 | Y | KHERGRPLL | 97.09 | RQEKGKSLL | 1.94 | | | | | | |
| prM | 131 | 0.14 | 2 | 2 | 0 | Y | HERGRPLLF | 98.06 | QEKGKSLLF | 1.94 | | | | | | |
| prM | 132 | 0.14 | 2 | 2 | 0 | Y | ERGRPLLFK | 98.06 | EKGKSLLFK | 1.94 | | | | | | |
| prM | 133 | 0.14 | 2 | 2 | 0 | Y | RGRPLLFKT | 98.06 | KGKSLLFKT | 1.94 | | | | | | |
| prM | 134 | 0.14 | 2 | 2 | 0 | Y | GRPLLFKTE | 98.06 | GKSLLFKTE | 1.94 | | | | | | |

FIG. 15-6

Species: DENV4 (9-mers)

| protein | block starting position | block entropy | total peptides in block | peptides required to cover 99% of block | gap/x fraction | 99% of block covered w/ <= 5 peptides? | block (to cover 99% of block) | frequency | block (to cover 99% of block) | frequency | block (to cover 99% of block) | frequency |
|---|---|---|---|---|---|---|---|---|---|---|---|---|
| prM | 135 | 0.14 | 2 | 2 | 0 | Y | RPLLFKTTE | 98.06 | KSLLFKTED | 1.94 | | |
| prM | 136 | 0.14 | 2 | 2 | 0 | Y | PLLFKTTEG | 98.06 | SLLFKTEDG | 1.94 | | |
| prM | 137 | 0.22 | 3 | 2 | 0 | Y | LLFKTTEGI | 97.09 | LLFKTEDGV | 1.94 | | |
| prM | 138 | 0.22 | 3 | 2 | 0 | Y | LFKTTEGIN | 97.09 | LFKTEDGVN | 1.94 | | |
| prM | 139 | 0.3 | 4 | 3 | 0 | Y | FKTTEGINK | 96.12 | FKTEDGVNM | 1.94 | FKTTEGINR | 0.97 |
| prM | 140 | 0.3 | 4 | 3 | 0 | Y | KTTEGINKC | 96.12 | KTEDGVNMC | 1.94 | KTTEGINRC | 0.97 |
| prM | 141 | 0.3 | 4 | 3 | 0 | Y | TTEGINKCT | 96.12 | TEDGVNMCT | 1.94 | TTEGINRCT | 0.97 |
| prM | 142 | 0.3 | 4 | 3 | 0 | Y | TEGINKCTL | 96.12 | EDGVNMCTL | 1.94 | TEGTNKCTL | 0.97 |
| prM | 143 | 0.3 | 4 | 3 | 0 | Y | EGINKCTLI | 96.12 | DGVNMCTLM | 1.94 | EGTNKCTLI | 0.97 |
| prM | 144 | 0.3 | 4 | 3 | 0 | Y | GINKCTLIA | 96.12 | GVNMCTLMA | 1.94 | GINRCTLIA | 0.97 |
| prM | 145 | 0.3 | 4 | 3 | 0 | Y | INKCTLIAM | 96.12 | VNMCTLMAM | 1.94 | INRCTLIAM | 0.97 |
| prM | 146 | 0.22 | 3 | 2 | 0 | Y | NKCTLIAMD | 97.09 | NMCTLMAMD | 1.94 | | |
| prM | 147 | 0.22 | 3 | 2 | 0 | Y | KCTLIAMDL | 97.09 | MCTLMAMDL | 1.94 | | |
| prM | 148 | 0.22 | 3 | 2 | 0 | Y | CTLIAMDLG | 97.09 | CTLMAMDLG | 1.94 | | |
| prM | 149 | 0.22 | 3 | 2 | 0 | Y | TLIAMDLGE | 97.09 | TLMAMDLGE | 1.94 | | |
| prM | 150 | 0.22 | 3 | 2 | 0 | Y | LIAMDLGEM | 97.09 | LMAMDLGEL | 1.94 | | |
| prM | 151 | 0.22 | 3 | 2 | 0 | Y | IAMDLGEMC | 97.09 | MAMDLGELC | 1.94 | | |
| prM | 152 | 0.22 | 3 | 2 | 0 | Y | AMDLGEMCE | 97.09 | AMDLGELCE | 1.94 | | |
| prM | 153 | 0.22 | 3 | 2 | 0 | Y | MDLGEMCED | 97.09 | MDLGELCED | 1.94 | | |
| prM | 154 | 0.22 | 3 | 2 | 0 | Y | DLGEMCEDT | 97.09 | DLGELCEDT | 1.94 | | |
| prM | 155 | 0.22 | 3 | 2 | 0 | Y | LGEMCEDTV | 97.09 | LGELCEDTI | 1.94 | | |
| prM | 156 | 0.14 | 2 | 2 | 0 | Y | GEMCEDTVT | 98.06 | GELCEDTIT | 1.94 | | |
| prM | 157 | 0.14 | 2 | 2 | 0 | Y | EMCEDTVTY | 98.06 | ELCEDTITY | 1.94 | | |
| prM | 158 | 0.28 | 3 | 3 | 0 | Y | MCEDTVTYK | 96.12 | LCEDTITYK | 1.94 | MCEDTVTYE | 1.94 |
| prM | 159 | 0.28 | 3 | 3 | 0 | Y | CEDTVTYKC | 96.12 | CEDTITYKC | 1.94 | CEDTITYKC | 1.94 |
| prM | 160 | 0.28 | 3 | 3 | 0 | Y | EDTVTYKCP | 96.12 | EDTITYKCP | 1.94 | EDTITYKCP | 1.94 |

FIG. 15-7

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 161 | 0.28 | 3 | 3 | 0 | Y | DTVTYKCPL | 96.12 | DTITYKCPL | 1.94 | DTVTYECPL | 1.94 | | |
| prM | 162 | 0.28 | 3 | 3 | 0 | Y | TVTYKCPLL | 96.12 | TITYKCPLL | 1.94 | TVTYECPLL | 1.94 | | |
| prM | 163 | 0.55 | 4 | 4 | 0 | Y | VTYKCPLLV | 91.26 | VTYKCPLLI | 4.85 | ITYKCPLLR | 1.94 | VTYECPLLV | 1.94 |
| prM | 164 | 0.55 | 4 | 4 | 0 | Y | TYKCPLLVN | 91.26 | TYKCPLLIN | 4.85 | TYECPLLVN | 1.94 | TYKCPLLRQ | 1.94 |
| prM | 165 | 0.55 | 4 | 4 | 0 | Y | YKCPLLVNT | 91.26 | YKCPLLINT | 4.85 | YECPLLVNT | 1.94 | YKCPLLRQN | 1.94 |
| prM | 166 | 0.55 | 4 | 4 | 0 | Y | KCPLLVNTE | 91.26 | KCPLLINTE | 4.85 | KCPLLRQNE | 1.94 | ECPLLVNTE | 1.94 |
| prM | 167 | 0.42 | 3 | 3 | 0 | Y | CPLLVNTEP | 93.2 | CPLLINTEP | 4.85 | CPLLRQNEP | 1.94 | | |
| prM | 168 | 0.42 | 3 | 3 | 0 | Y | PLLVNTEPE | 93.2 | PLLINTEPE | 4.85 | PLLRQNEPE | 1.94 | | |
| prM | 169 | 0.42 | 3 | 3 | 0 | Y | LLVNTEPED | 93.2 | LLINTEPED | 4.85 | LLRQNEPED | 1.94 | | |
| prM | 170 | 0.42 | 3 | 3 | 0 | Y | LVNTEPEDI | 93.2 | LINTEPEDI | 4.85 | LRQNEPEDI | 1.94 | | |
| prM | 171 | 0.42 | 3 | 3 | 0 | Y | VNTEPEDID | 93.2 | INTEPEDID | 4.85 | RQNEPEDID | 1.94 | | |
| prM | 172 | 0.14 | 2 | 2 | 0 | Y | NTEPEDIDC | 98.06 | QNEPEDIDC | 1.94 | | | | |
| prM | 173 | 0.14 | 2 | 2 | 0 | Y | TEPEDIDCW | 98.06 | NEPEDIDCW | 1.94 | | | | |
| prM | 174 | 0 | 1 | 1 | 0 | Y | EPEDIDCWC | 100 | | | | | | |
| prM | 175 | 0 | 1 | 1 | 0 | Y | PEDIDCWCN | 100 | | | | | | |
| prM | 176 | 0.19 | 2 | 2 | 0 | Y | EDIDCWCNL | 97.09 | EDIDCWCNS | 2.91 | | | | |
| prM | 177 | 0.19 | 2 | 2 | 0 | Y | DIDCWCNLT | 97.09 | DIDCWCNST | 2.91 | | | | |
| prM | 178 | 0.27 | 3 | 3 | 0 | Y | IDCWCNLTS | 96.12 | IDCWCNSTS | 2.91 | | | | |
| prM | 179 | 0.62 | 4 | 3 | 0 | Y | DCWCNLTST | 89.32 | DCWCNLTSA | 6.8 | DCWCNSTST | 2.91 | | |
| prM | 180 | 0.62 | 4 | 3 | 0 | Y | CWCNLTSTW | 89.32 | CWCNLTSAW | 6.8 | CWCNSTSTW | 2.91 | | |
| prM | 181 | 0.62 | 4 | 3 | 0 | Y | WCNLTSTWV | 89.32 | WCNLTSAWV | 6.8 | WCNSTSTWV | 2.91 | | |
| prM | 182 | 0.62 | 4 | 3 | 0 | Y | CNLTSTWVM | 89.32 | CNLTSAWVM | 6.8 | CNSTSTWVT | 2.91 | | |
| prM | 183 | 0.62 | 4 | 3 | 0 | Y | NLTSTWVMY | 89.32 | NLTSAWVMY | 6.8 | NSTSTWVTY | 2.91 | | |
| prM | 184 | 0.62 | 4 | 3 | 0 | Y | LTSTWVMYG | 89.32 | LTSAWVMYG | 6.8 | STSTWVTYG | 2.91 | | |
| prM | 185 | 0.62 | 4 | 3 | 0 | Y | TSTWVMYGT | 89.32 | TSAWVMYGT | 6.8 | TSTWVTYGT | 2.91 | | |
| prM | 186 | 0.62 | 4 | 3 | 0 | Y | STWVMYGTC | 89.32 | SAWVMYGTC | 6.8 | STWVTYGTC | 2.91 | | |

FIG. 15-8

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| prM | 187 | 0.55 | 3 | 3 | 0 | Y | TWVMYGTCT | 90.29 | AWVMYGTCT | 6.8 | TWVTYGTCT | 2.91 |
| prM | 188 | 0.22 | 3 | 2 | 0 | Y | WVMYGTCTQ | 97.09 | WVTYGTCTT | 1.94 | VTYGTCTTT | 1.94 |
| prM | 189 | 0.41 | 4 | 3 | 0 | Y | VMYGTCTQS | 94.17 | VMYGTCTQN | 2.91 | TYGTCTTTG | 1.94 |

FIG. 15-9

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99

FIG.15-10

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 239 | 0.22 | 3 | 2 | 0 | Y | SWILRNPGF | 97.09 | TWILRHPGF | 1.94 | | | | |
| prM | 240 | 0.22 | 3 | 2 | 0 | Y | WILRNPGFA | 97.09 | WILRHPGFT | 1.94 | | | | |
| prM | 241 | 0.22 | 3 | 2 | 0 | Y | ILRNPGFAL | 97.09 | ILRHPGFTI | 1.94 | | | | |
| prM | 242 | 0.14 | 2 | 2 | 0 | Y | LRNPGFALL | 98.06 | LRHPGFTIM | 1.94 | | | | |
| prM | 243 | 0.14 | 2 | 2 | 0 | Y | RNPGFALLA | 98.06 | RHPGFTIMA | 1.94 | | | | |
| prM | 244 | 0.14 | 2 | 2 | 0 | Y | NPGFALLAG | 98.06 | HPGFTIMAA | 1.94 | | | | |
| prM | 245 | 0.14 | 2 | 2 | 0 | Y | PGFALLAGF | 98.06 | PGFTIMAAI | 1.94 | | | | |
| prM | 246 | 0.14 | 2 | 2 | 0 | Y | GFALLAGFM | 98.06 | GFTIMAAIL | 1.94 | | | | |
| prM | 247 | 0.14 | 2 | 2 | 0 | Y | FALLAGFMA | 98.06 | FTIMAAILA | 1.94 | | | | |
| prM | 248 | 0.14 | 2 | 2 | 0 | Y | ALLAGFMAY | 98.06 | TIMAAILAY | 1.94 | | | | |
| prM | 249 | 0.14 | 2 | 2 | 0 | Y | LLAGFMAYM | 98.06 | IMAAILAYT | 1.94 | | | | |
| prM | 250 | 0.28 | 3 | 3 | 0 | Y | LAGFMAYMI | 96.12 | MAAILAYTI | 1.94 | LAGFMAYMV | 1.94 | | |
| prM | 251 | 0.28 | 3 | 3 | 0 | Y | AGFMAYMIG | 96.12 | AGFMAYMVG | 1.94 | AAILAYTIG | 1.94 | | |
| prM | 252 | 0.28 | 3 | 3 | 0 | Y | GFMAYMIGQ | 96.12 | GFMAYMVGQ | 1.94 | AILAYTIGT | 1.94 | | |
| prM | 253 | 0.28 | 3 | 3 | 0 | Y | FMAYMIGQT | 96.12 | ILAYTIGT | 1.94 | FMAYMVGQT | 1.94 | | |
| prM | 254 | 0.35 | 4 | 3 | 0 | Y | MAYMIGQTG | 95.15 | MAYMVGQTG | 1.94 | LAYTIGTTH | 1.94 | | |
| prM | 255 | 0.35 | 4 | 3 | 0 | Y | AYMIGQTGI | 95.15 | AYTIGTTHF | 1.94 | AYMVGQTGI | 1.94 | | |
| prM | 256 | 0.35 | 4 | 3 | 0 | Y | YMIGQTGIQ | 95.15 | YTIGTTHFQ | 1.94 | YMVGQTGIQ | 1.94 | | |
| prM | 257 | 0.35 | 4 | 3 | 0 | Y | MIGQTGIQR | 95.15 | TIGTTHFQR | 1.94 | MVGQTGIQR | 1.94 | | |
| prM | 258 | 0.43 | 5 | 4 | 0 | Y | IGQTGIQRT | 94.17 | VGQTGIQRT | 1.94 | IGTTHFQRA | 1.94 | IGQTRIQRT | 0.97 | |
| prM | 259 | 0.37 | 5 | 4 | 0 | Y | GQTGIQRTV | 95.15 | GTTHFQRAL | 1.94 | GQTGIQRTV | 1.94 | GQTGIQRAV | 0.97 | |
| prM | 260 | 0.37 | 5 | 4 | 0 | Y | QTGIQRTVF | 95.15 | TTHFQRALI | 1.94 | QTGIQRAVF | 0.97 | QTRIQRTVF | 0.97 | |
| prM | 261 | 0.37 | 5 | 4 | 0 | Y | TGIQRTVFF | 95.15 | THFQRALIF | 1.94 | TGIQRAVFF | 0.97 | TRIQRTVFF | 0.97 | |
| prM | 262 | 0.61 | 6 | 5 | 0 | Y | GIQRTVFFV | 91.26 | GIQRTVFFI | 3.88 | HFQRALIFI | 1.94 | RIQRTVFFV | 1.94 | GIQRAVFFV | 0.97 |
| prM | 263 | 0.53 | 5 | 4 | 0 | Y | IQRTVFFVL | 92.23 | IQRTVFFIL | 3.88 | FQRALIFIL | 1.94 | IQRTIFFVL | 1.94 | |
| prM | 264 | 0.53 | 5 | 4 | 0 | Y | QRTVFFVLM | 92.23 | QRTVFFILM | 3.88 | QRALIFILL | 1.94 | QRTIFFVLM | 1.94 | |

FIG. 15-11

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|

FIG. 15-12

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|

FIG. 15-13

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 317 | 0.14 | 2 | 2 | 0 | Y | GKPTLDFEL | 98.06 | NKPTLDFEL

FIG. 15-15

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 369 | 0.35 | 4 | 3 | 0 | Y | QYICRRDVW | 95.15 | QYICRRDMV | 1

FIG. 15-16

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency |
|---|---|---|---|---|---|---|---|---|---|---|---|---|
| E | 395 | 0.56 | 3 | 3 | 0 | Y | TCAKFSCSG | 89.32 | TCAKFLCSG | 8.74 | TCAMFTCKK | 1.94 |
| E | 396 | 0.56 | 3 | 3 | 0 | Y | CAKFSCSGK | 89.32 | CAKFLCSGK | 8.74 | CAMFTCKKN | 1.94 |
| E | 397 | 0.56 | 3 | 3 | 0 | Y | AKFSCSGKI | 89.32 | AKFLCSGKI | 8.74 | AMFTCKKNM | 1.94 |
| E | 398 | 0.56 | 3 | 3 | 0 | Y | KFSCSGKIT | 89.32 | KFLCSGKIT | 8.74 | MFTCKKNME | 1.94 |
| E | 399 | 0.56 | 3 | 3 | 0 | Y | FSCSGKITG | 89.32 | FLCSGKITG | 8.74 | FTCKKNMEG | 1.94 |
| E | 400 | 0.56 | 3 | 3 | 0 | Y | SCSGKITGN | 89.32 | LCSGKITG | 8.74 | TCKKNMEGK | 1.94 |
| E | 401 | 0.14 | 2 | 2 | 0 | Y | CSGKITGNL | 98.06 | CKKNMEGKV | 1.94 | | |
| E | 402 | 0.14 | 2 | 2 | 0 | Y | SGKITGNLV | 98.06 | KKNMEGKV | 1.94 | | |
| E | 403 | 0.14 | 2 | 2 | 0 | Y | GKITGNLVQ | 98.06 | KNMEGKWQ | 1.94 | | |
| E | 404 | 0.22 | 3 | 2 | 0 | Y | KITGNLVQI | 97.09 | NMEGKWQP | 1.94 | | |
| E | 405 | 0.22 | 3 | 2 | 0 | Y | ITGNLVQIE | 97.09 | MEGKWQPE | 1.94 | | |
| E | 406 | 0.22 | 3 | 2 | 0 | Y | TGNLVQIEN | 97.09 | EGKWQPEN | 1.94 | | |
| E | 407 | 0.22 | 3 | 2 | 0 | Y | GNLVQIENL | 97.09 | GKWQPENL | 1.94 | | |
| E | 408 | 0.22 | 3 | 2 | 0 | Y | NLVQIENLE | 97.09 | KWQPENLE | 1.94 | | |
| E | 409 | 0.22 | 3 | 2 | 0 | Y | LVQIENLEY | 97.09 | WQPENLEY | 1.94 | | |
| E | 410 | 0.22 | 3 | 2 | 0 | Y | VQIENLEYT | 97.09 | VQPENLEYT | 1.94 | | |
| E | 411 | 0.22 | 3 | 2 | 0 | Y | QIENLEYTV | 97.09 | QPENLEYTI | 1.94 | | |
| E | 412 | 0.22 | 3 | 2 | 0 | Y | IENLEYTVV | 97.09 | PENLEYTIV | 1.94 | | |
| E | 413 | 0.14 | 2 | 2 | 0 | Y | ENLEYTVVW | 98.06 | ENLEYTVI | 1.94 | | |
| E | 414 | 0.14 | 2 | 2 | 0 | Y | NLEYTVVVT | 98.06 | NLEYTIVI | 1.94 | | |
| E | 415 | 0.14 | 2 | 2 | 0 | Y | LEYTVVVTV | 98.06 | LEYTIVIT | 1.94 | | |
| E | 416 | 0.14 | 2 | 2 | 0 | Y | EYTVVVTVH | 98.06 | EYTIVITP | 1.94 | | |
| E | 417 | 0.14 | 2 | 2 | 0 | Y | YTVVVTVHN | 98.06 | YTIVITPH | 1.94 | | |
| E | 418 | 0.14 | 2 | 2 | 0 | Y | TVVVTVHNG | 98.06 | TIVITPHS | 1.94 | | |
| E | 419 | 0.14 | 2 | 2 | 0 | Y | VVVTVHNGD | 98.06 | IVITPHSG | 1.94 | | |
| E | 420 | 0.22 | 3 | 2 | 0 | Y | WTVHNGDT | 97.09 | VITPHSGEE | 1.94 | | |

FIG. 15-17

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 421 | 0.22 | 3 | 2 | 0 | Y | VTVHNGDTH | 97.09 | ITPH

FIG. 15-18

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 447 | 0.57 | 6 | 5 | 0 | Y | RSPSVEVKL | 92.23 | RSPSVEVEL | 1.94 | QSSITEAEL | 1.94 | RTPSVEVKL | 1.94 |
| E | 448 | 0.57 | 6 | 5 | 0 | Y | SPSVEVKLP | 92.23 | TPSVEVKLP | 1.94 | SPSVEVELP | 1.94 | SSITEAELT | 1.94 |
| E | 449 | 0.43 | 5 | 4 | 0 | Y | PSVEVKLPD | 94.17 | PSVEVELPD | 1.94 | SITEAELTG | 1.94 | |  |
| E | 450 | 0.43 | 5 | 4 | 0 | Y | SVEVKLPDY | 94.17 | SVEVELPDY | 1.94 | ITEAELTGY | 1.94 | |  |
| E | 451 | 0.43 | 5 | 4 | 0 | Y | VEVKLPDYG | 94.17 | VEVELPDYG | 1.94 | TEAELTGYG | 1.94 | |  |
| E | 452 | 0.35 | 4 | 3 | 0 | Y | EVKLPDYGE | 95.15 | EAELTGYGT | 1.94 | EVELPDYGE | 1.94 | |  |
| E | 453 | 0.35 | 4 | 3 | 0 | Y | VKLPDYGEL | 95.15 | VELPDYGEL | 1.94 | AELTGYGTV | 1.94 | |  |
| E | 454 | 0.35 | 4 | 3 | 0 | Y | KLPDYGELT | 95.15 | ELTGYGTVT | 1.94 | ELPDYGELS | 1.94 | |  |
| E | 455 | 0.28 | 3 | 3 | 0 | Y | LPDYGELTL | 96.12 | LPDYGELSL | 1.94 | LTGYGTVTM | 1.94 | |  |
| E | 456 | 0.28 | 3 | 3 | 0 | Y | PDYGELTLD | 96.12 | TGYGTVTME | 1.94 | PDYGELSLD | 1.94 | |  |
| E | 457 | 0.28 | 3 | 3 | 0 | Y | DYGELTLDC | 96.12 | DYGELSLDC | 1.94 | GYGTVTMEC | 1.94 | |  |
| E | 458 | 0.28 | 3 | 3 | 0 | Y | YGELTLDCE | 96.12 | YGTVTMECS | 1.94 | YGELSLDCE | 1.94 | |  |
| E | 459 | 0.28 | 3 | 3 | 0 | Y | GELTLDCEP | 96.12 | GTVTMECSP | 1.94 | GELSLDCEP | 1.94 | |  |
| E | 460 | 0.28 | 3 | 3 | 0 | Y | ELTLDCEPR | 96.12 | TVTMECSPR | 1.94 | ELSLDCEPR | 1.94 | |  |
| E | 461 | 0.28 | 3 | 3 | 0 | Y | LTLDCEPRS | 96.12 | LSLDCEPRS | 1.94 | VTMECSPRT | 1.94 | |  |
| E | 462 | 0.28 | 3 | 3 | 0 | Y | TLDCEPRSG | 96.12 | SLDCEPRSG | 1.94 | TMECSPRTG | 1.94 | |  |
| E | 463 | 0.14 | 2 | 2 | 0 | Y | LDCEPRSGI | 98.06 | MECSPRTGL | 1.94 | |  | |  |
| E | 464 | 0.14 | 2 | 2 | 0 | Y | DCEPRSGID | 98.06 | ECSPRTGLD | 1.94 | |  | |  |
| E | 465 | 0.14 | 2 | 2 | 0 | Y | CEPRSGIDF | 98.06 | CSPRTGLDF | 1.94 | |  | |  |
| E | 466 | 0.14 | 2 | 2 | 0 | Y | EPRSGIDFN | 98.06 | SPRTGLDFN | 1.94 | |  | |  |
| E | 467 | 0.14 | 2 | 2 | 0 | Y | PRSGIDFNE | 98.06 | PRTGLDFNE | 1.94 | |  | |  |
| E | 468 | 0.14 | 2 | 2 | 0 | Y | RSGIDFNEM | 98.06 | RTGLDFNEM | 1.94 | |  | |  |
| E | 469 | 0.14 | 2 | 2 | 0 | Y | SGIDFNEMI | 98.06 | TGLDFNEMV | 1.94 | |  | |  |
| E | 470 | 0.14 | 2 | 2 | 0 | Y | GIDFNEMIL | 98.06 | GLDFNEMVL | 1.94 | |  | |  |
| E | 471 | 0.14 | 2 | 2 | 0 | Y | IDFNEMILM | 98.06 | LDFNEMVLL | 1.94 | |  | |  |
| E | 472 | 0.41 | 4 | 4 | 0 | Y | DFNEMILMK | 94.17 | DFNEMILMR | 1.94 | DFNEMVLLQ | 1.94 | DFNEMILME | 1.94 |

FIG. 15-19

Species: DENV4 (9-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 473 | 0.41 | 4 | 4 | 0 | Y | FNEMILMKM | 94.17 | FNEMILMRM | 1.94 | FNEMYLLQM | 1.94 | | |
| E | 474 | 0.55 | 5 | 5 | 0 | Y | NEMILMKMK | 92.23 | NEMILMEMK | 1.94 | NEMILMRMK | 1.94 | NEMILMKME | 1.94 |
| E | 481 | 0.49 | 5 | 4 | 0 | Y | MKKKTWLVH | 93.2 | MEKKTWLVH | 1.94 | MENKAWLVH | 1.94 | MKTKTWLVH | 1.94 |
| E | 482 | 0.49 | 5 | 4 | 0 | Y | KKKTWLVHK | 93.2 | ENKAWLVHR | 1.94 | KTKTWLVHK | 1.94 | EKKTWLVHK | 1.94 |
| E | 483 | 0.35 | 4 | 3 | 0 | Y | KKTWLVHKQ | 95.15 | NKAWLVHRQ | 1.94 | TKTWLVHQ | 1.94 | | |
| E | 484 | 0.14 | 2 | 2 | 0 | Y | KTWLVHKQW | 98.06 | | | KAWLVHRQW | 1.94 | | |
| E | 485 | 0.14 | 2 | 2 | 0 | Y | TWLVHKQWF | 98.06 | | | AWLVHRQWF | 1.94 | | |
| E | 486 | 0.14 | 2 | 2 | 0 | Y | WLVHKQWFL | 98.06 | | | WLVHRQWFL | 1.94 | | |
| E | 487 | 0.14 | 2 | 2 | 0 | Y | LVHKQWFLD | 98.06 | | | LVHRQWFLD | 1.94 | | |
| E | 488 | 0.14 | 2 | 2 | 0 | Y | VHKQWFLDL | 98.06 | | | VHRQWFLDL | 1.94 | | |
| E | 489 | 0.14 | 2 | 2 | 0 | Y | HKQWFLDLP | 98.06 | | | HRQWFLDLP | 1.94 | | |
| E | 490 | 0.14 | 2 | 2 | 0 | Y | KQWFLDLPL | 98.06 | | | RQWFLDLPL | 1.94 | | |
| E | 491 | 0 | 1 | 1 | 0 | Y | QWFLDLPLP | 100 | | | | | | |
| E | 492 | 0 | 1 | 1 | 0 | Y | WFLDLPLPW | 100 | | | | | | |
| E | 493 | 0.33 | 3 | 3 | 0 | Y | FLDLPLPWT | 95.15 | FLDLPLPWA | 2.91 | FLDLPLPWL | 1.94 | | |
| E | 494 | 1.15 | 4 | 4 | 0 | Y | LDLPLPWTA | 67.96 | LDLPLPWTT | 27.18 | LDLPLPWAA | 2.91 | LDLPLPWLP | 1.94 |
| E | 495 | 1.15 | 4 | 4 | 0 | Y | DLPLPWTAG | 67.96 | DLPLPWTTG | 27.18 | DLPLPWAAG | 2.91 | DLPLPWLPG | 1.94 |
| E | 496 | 1.15 | 4 | 4 | 0 | Y | LPLPWTAGA | 67.96 | LPLPWTTGA | 27.18 | LPLPWAAGA | 2.91 | LPLPWLPGA | 1.94 |
| E | 497 | 1.15 | 4 | 4 | 0 | Y | PLPWTAGAD | 67.96 | PLPWTTGAD | 27.18 | PLPWAAGAD | 2.91 | PLPWLPGAD | 1.94 |
| E | 498 | 1.15 | 4 | 4 | 0 | Y | LPWTAGADT | 67.96 | LPWTTGADT | 27.18 | LPWAAGADT | 2.91 | LPWLPGADT | 1.94 |
| E | 499 | 1.28 | 5 | 5 | 0 | Y | PWTAGADTS | 66.02 | PWTTGADTS | 27.18 | PWAAGADTS | 2.91 | PWLPGADTQ | 1.94 | PWTAGADTL | 1.94 |
| E | 500 | 1.28 | 5 | 5 | 0 | Y | WTAGADTSE | 66.02 | WTTGADTSE | 27.18 | WAAGADTSE | 2.91 | WLPGADTQG | 1.94 | WTAGADTLE | 1.94 |
| E | 501 | 1.28 | 5 | 4 | 0 | Y | TAGADTSEV | 66.02 | TTGADTSEV | 27.18 | AAGADTSEV | 2.91 | LPGADTQGS | 1.94 | TAGADTLEV | 1.94 |
| E | 502 | 1.1 | 4 | 4 | 0 | Y | AGADTSEVH | 68.93 | TGADTSEVH | 27.18 | PGADTQGSN | 1.94 | AGADTLEVH | 1.94 | |
| E | 503 | 0.28 | 3 | 3 | 0 | Y | GADTSEVHW | 96.12 | GADTSEVH | 1.94 | GADTQGSNW | 1.94 | | |
| E | 504 | 0.28 | 3 | 3 | 0 | Y | ADTSEVHWN | 96.12 | ADTLEVHWN | 1.94 | ADTQGSNWI | 1.94 | | |

FIG. 15-20

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 505 | 0.46 | 4 | 4 | 0 | Y | DTSEVHWNY | 93.2 | DTSEVHWNH | 2.91 | DTLEVHWNH | 1.94 | DTQGSNWIQ | 1.94 |
| E | 506 | 0.46 | 4 | 4 | 0 | Y | TSEVHWNYK | 93.2 | TSEVHWNHK | 2.91 | TLEVHWNHK | 1.94 | TQGSNWIQK | 1.94 |
| E | 507 | 0.46 | 4 | 4 | 0 | Y | SEVHWNYKE | 93.2 | SEVHWNHKE | 2.91 | QGSNWIQKE | 1.94 | LEVHWNHKE | 1.94 |
| E | 508 | 0.42 | 3 | 3 | 0 | Y | EVHWNYKER | 93.2 | EVHWNHKER | 4.85 | GSNWIQKET | 1.94 | | |
| E | 509 | 0.42 | 3 | 3 | 0 | Y | VHWNYKERM | 93.2 | VHWNHKERM | 4.85 | SNWIQKETL | 1.94 | | |
| E | 510 | 0.42 | 3 | 3 | 0 | Y | HWNYKERMV | 93.2 | HWNHKERMV | 4.85 | NWIQKETLY | 1.94 | | |
| E | 511 | 0.42 | 3 | 3 | 0 | Y | WNYKERMVT | 93.2 | WNHKERMVT | 4.85 | WIQKETLVT | 1.94 | | |
| E | 512 | 0.42 | 3 | 3 | 0 | Y | NYKERMVTF | 93.2 | NHKERMVTF | 4.85 | IQKETLVTF | 1.94 | | |
| E | 513 | 0.42 | 3 | 3 | 0 | Y | YKERMVTFK | 93.2 | HKERMVTFK | 4.85 | QKETLVTFK | 1.94 | | |
| E | 514 | 0.14 | 2 | 2 | 0 | Y | KERMVTFKV | 98.06 | KETLVTFKN | 1.94 | | | | |
| E | 515 | 0.14 | 2 | 2 | 0 | Y | ERMVTFKVP | 98.06 | ETLVTFKNP | 1.94 | | | | |
| E | 516 | 0.14 | 2 | 2 | 0 | Y | RMVTFKVPH | 98.06 | TLVTFKNPH | 1.94 | | | | |
| E | 517 | 0.14 | 2 | 2 | 0 | Y | MVTFKVPHA | 98.06 | LVTFKNPHA | 1.94 | | | | |
| E | 518 | 0.14 | 2 | 2 | 0 | Y | VTFKVPHAK | 98.06 | VTFKNPHAK | 1.94 | | | | |
| E | 519 | 0.14 | 2 | 2 | 0 | Y | TFKVPHAKR | 98.06 | TFKNPHAKR | 1.94 | | | | |
| E | 520 | 0.14 | 2 | 2 | 0 | Y | FKVPHAKRQ | 98.06 | FKNPHAKKQ | 1.94 | | | | |
| E | 521 | 0.14 | 2 | 2 | 0 | Y | KVPHAKRQD | 98.06 | KNPHAKKQD | 1.94 | | | | |
| E | 522 | 0.14 | 2 | 2 | 0 | Y | VPHAKRQDV | 98.06 | NPHAKKQDV | 1.94 | | | | |
| E | 523 | 0.22 | 3 | 2 | 0 | Y | PHAKRQDVT | 98.06 | PHAKKQDVW | 1.94 | | | | |
| E | 524 | 0.22 | 3 | 2 | 0 | Y | HAKRQDVTV | 97.09 | HAKKQDVWV | 1.94 | | | | |
| E | 525 | 0.22 | 3 | 2 | 0 | Y | AKRQDVTYL | 97.09 | AKKQDVVVL | 1.94 | | | | |
| E | 526 | 0.22 | 3 | 2 | 0 | Y | KRQDVTVLG | 97.09 | KKQDVVVLG | 1.94 | | | | |
| E | 527 | 0.22 | 3 | 2 | 0 | Y | RQDVTVLGS | 97.09 | KQDVVVLGS | 1.94 | | | | |
| E | 528 | 0.22 | 3 | 2 | 0 | Y | QDVTVLGSQ | 97.09 | QDVWVLGSQ | 1.94 | | | | |
| E | 529 | 0.22 | 3 | 2 | 0 | Y | DVTVLGSQE | 97.09 | DVWVLGSQE | 1.94 | | | | |
| E | 530 | 0.22 | 3 | 2 | 0 | Y | VTVLGSQEG | 97.09 | VWVLGSQEG | 1.94 | | | | |

FIG. 15-21

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 531 | 0.22 | 3 | 2 | 0 | Y | TVLGSQEGA | 97.09 | VVLGSQEGA | 1.94 | | | | |
| E | 532 | 0 | 1 | 1 | 0 | Y | VLGSQEGAM | 100 | | | | | | |
| E | 533 | 0 | 1 | 1 | 0 | Y | LGSQEGAMH | 100 | | | | | | |
| E | 534 | 0.14 | 2 | 2 | 0 | Y | GSQEGAMHS | 98.06 | GSQEGAMHT | 1.94 | | | | |
| E | 535 | 0.14 | 2 | 2 | 0 | Y | SQEGAMHSA | 98.06 | SQEGAMHTA | 1.94 | | | | |
| E | 536 | 0.14 | 2 | 2 | 0 | Y | QEGAMHSAL | 98.06 | QEGAMHTAL | 1.94 | | | | |
| E | 537 | 0.49 | 3 | 3 | 0 | Y | EGAMHSALA | 91.26 | EGAMHSALT | 6.8 | EGAMHTALT | 1.94 | | |
| E | 538 | 0.49 | 3 | 3 | 0 | Y | GAMHSALAG | 91.26 | GAMHSALTG | 6.8 | GAMHTALTG | 1.94 | | |
| E | 539 | 0.49 | 3 | 3 | 0 | Y | AMHSALAGA | 91.26 | AMHSALTGA | 6.8 | AMHTALTGA | 1.94 | | |
| E | 540 | 0.49 | 3 | 3 | 0 | Y | MHSALAGAT | 91.26 | MHSALTGAT | 6.8 | MHTALTGAT | 1.94 | | |
| E | 541 | 0.49 | 3 | 3 | 0 | Y | HSALAGATE | 91.26 | HSALTGATE | 6.8 | HTALTGATE | 1.94 | | |
| E | 542 | 0.49 | 3 | 3 | 0 | Y | SALAGATEV | 91.26 | SALTGATEV | 6.8 | TALTGATEI | 1.94 | | |
| E | 543 | 0.49 | 3 | 3 | 0 | Y | ALAGATEVD | 91.26 | ALTGATEVD | 6.8 | ALTGATEIQ | 1.94 | | |
| E | 544 | 0.49 | 3 | 3 | 0 | Y | LAGATEVDS | 91.26 | LTGATEVDS | 6.8 | LTGATEIQM | 1.94 | | |
| E | 545 | 0.49 | 3 | 3 | 0 | Y | AGATEVDSG | 91.26 | TGATEVDSG | 6.8 | TGATEIQMS | 1.94 | | |
| E | 546 | 0.14 | 2 | 2 | 0 | Y | GATEVDSGD | 98.06 | GATEIQMSS | 1.94 | | | | |
| E | 547 | 0.22 | 3 | 2 | 0 | Y | ATEVDSGDG | 97.09 | ATEIQMSSG | 1.94 | | | | |
| E | 548 | 0.22 | 3 | 2 | 0 | Y | TEVDSGDGN | 97.09 | TEIQMSSGN | 1.94 | | | | |
| E | 549 | 0.22 | 3 | 2 | 0 | Y | EVDSGDGNH | 97.09 | EIQMSSGNL | 1.94 | | | | |
| E | 550 | 0.22 | 3 | 2 | 0 | Y | VDSGDGNHM | 97.09 | IQMSSGNLL | 1.94 | | | | |
| E | 551 | 0.22 | 3 | 2 | 0 | Y | DSGDGNHMF | 97.09 | QMSSGNLLF | 1.94 | | | | |
| E | 552 | 0.22 | 3 | 2 | 0 | Y | SGDGNHMFA | 97.09 | MSSGNLLFT | 1.94 | | | | |
| E | 553 | 0.22 | 3 | 2 | 0 | Y | GDGNHMFAG | 97.09 | SSGNLLFTG | 1.94 | | | | |
| E | 554 | 0.22 | 3 | 2 | 0 | Y | DGNHMFAGH | 97.09 | SGNLLFTGH | 1.94 | | | | |
| E | 555 | 0.22 | 3 | 2 | 0 | Y | GNHMFAGHL | 97.09 | GNLLFTGHL | 1.94 | | | | |
| E | 556 | 0.14 | 2 | 2 | 0 | Y | NHMFAGHLK | 98.06 | NLLFTGHLK | 1.94 | | | | |

FIG. 15-22

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 557 | 0.14 | 2 | 2 | 0 | Y | HMFAGH

FIG. 15-23

Species: DENV4 (9-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 583 | 0.28 | 3 | 3 | 0 | Y | SGKFSIDKE | 96.12 | SGKFSIDRE | 1.94 | TGKFKVWKE | 1.94 | | |
| E | 584 | 0.28 | 3 | 3 | 0 | Y | GKFSIDKEM | 96.12 | GKFKVWKEI | 1.94 | GKFSIDREM | 1.94 | | |
| E | 585 | 0.28 | 3 | 3 | 0 | Y | KFSIDKEMA | 96.12 | KFKVWKEIA | 1.94 | KFSIDREMA | 1.94 | | |
| E | 586 | 0.28 | 3 | 3 | 0 | Y | FSIDKEMAE | 96.12 | FKVWKEIAE | 1.94 | FSIDREMAE | 1.94 | | |
| E | 587 | 0.28 | 3 | 3 | 0 | Y | SIDKEMAET | 96.12 | SIDREMAET | 1.94 | KVWKEIAET | 1.94 | | |
| E | 588 | 0.28 | 3 | 3 | 0 | Y | IDKEMAETQ | 96.12 | IDREMAETQ | 1.94 | VWKEIAETQ | 1.94 | | |
| E | 589 | 0.28 | 3 | 3 | 0 | Y | DKEMAETQH | 96.12 | DREMAETQH | 1.94 | VKEIAETQH | 1.94 | | |
| E | 590 | 0.28 | 3 | 3 | 0 | Y | KEMAETQHG | 96.12 | REMAETQHG | 1.94 | KEIAETQHG | 1.94 | | |
| E | 591 | 0.14 | 2 | 2 | 0 | Y | EMAETQHGT | 98.06 | EIAETQHGT | 1.94 | | | | |
| E | 592 | 0.22 | 3 | 2 | 0 | Y | MAETQHGTT | 97.09 | IAETQHGTI | 1.94 | | | | |
| E | 593 | 0.22 | 3 | 2 | 0 | Y | AETQHGTTV | 97.09 | AETQHGTIV | 1.94 | | | | |
| E | 594 | 0.3 | 3 | 3 | 0 | Y | ETQHGTTVV | 96.12 | ETQHGTIVI | 1.94 | ETQHGTAVV | 0.97 | | |
| E | 595 | 0.3 | 3 | 3 | 0 | Y | TQHGTTVVK | 96.12 | TQHGTIVIR | 1.94 | TQHGTIVIK | 0.97 | | |
| E | 596 | 0.3 | 3 | 3 | 0 | Y | QHGTTVVKV | 96.12 | QHGTIVIRV | 1.94 | QHGTTVIKV | 0.97 | | |
| E | 597 | 0.3 | 3 | 3 | 0 | Y | HGTTVVKVK | 96.12 | HGTIVIRVQ | 1.94 | HGTTVIKVK | 0.97 | | |
| E | 598 | 0.3 | 3 | 3 | 0 | Y | GTTVVKVKY | 96.12 | GTIVIRVQY | 1.94 | GTAVVKVKY | 0.97 | | |
| E | 599 | 0.3 | 3 | 3 | 0 | Y | TTVVKVKYE | 96.12 | TIVIRVQYE | 1.94 | TTVVIKVKYE | 0.97 | | |
| E | 600 | 0.3 | 4 | 3 | 0 | Y | TVVKVKYEG | 96.12 | IVIRVQYEG | 1.94 | AVVKVKYEG | 0.97 | | |
| E | 601 | 0.49 | 4 | 3 | 0 | Y | VVKVKYEGA | 92.23 | VKVKYEGT | 4.85 | VVKVKYEGT | 1.94 | | |
| E | 602 | 0.49 | 4 | 3 | 0 | Y | VKVKYEGAG | 92.23 | VKVKYEGTG | 4.85 | VIRVQYEGD | 1.94 | | |
| E | 603 | 0.42 | 4 | 3 | 0 | Y | KVKYEGAGA | 93.2 | KVKYEGTGA | 4.85 | IRVQYEGDG | 1.94 | | |
| E | 604 | 0.42 | 4 | 3 | 0 | Y | VKYEGAGAP | 93.2 | VKYEGTGAP | 4.85 | RVQYEGDGS | 1.94 | | |
| E | 605 | 0.42 | 4 | 3 | 0 | Y | KYEGAGAPC | 93.2 | KYEGTGAPC | 4.85 | VQYEGDGSP | 1.94 | | |
| E | 606 | 0.42 | 4 | 3 | 0 | Y | YEGAGAPCK | 93.2 | YEGTGAPCK | 4.85 | QYEGDGSPC | 1.94 | | |
| E | 607 | 0.59 | 5 | 4 | 0 | Y | EGAGAPCKI | 91.26 | EGTGAPCKV | 3.88 | YEGDGSPCK | 1.94 | EGAGAPCKI | 1.94 |
| E | 608 | 0.59 | 5 | 4 | 0 | Y | GAGAPCKIP | 91.26 | GTGAPCKVP | 3.88 | EGDGSPCKI | 1.94 | GDGSPCKIP | 1.94 |

FIG. 15-24

Species: DENW4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 609 | 0.59 | 5 | 4 | 0 | Y | AGAPCKVPI | 91.26 | TGAPCKVPI | 3.88 | DGSPCKIPF | 1.94 | AGAPCKIPI | 1.94 | | |
| E | 610 | 0.33 | 3 | 3 | 0 | Y | GAPCKVPIE | 95.15 | GAPCKIPIE | 2.91 | GSPCKIPFE | 1.94 | | | | |
| E | 611 | 0.33 | 3 | 3 | 0 | Y | APCKVPIEI | 95.15 | APCKIPIEI | 2.91 | SPCKIPFEI | 1.94 | | | | |
| E | 612 | 0.35 | 4 | 3 | 0 | Y | PCKVPIEIR | 95.15 | PCKIPIEIM | 2.91 | PCKIPIEIR | 1.94 | | | | |
| E | 613 | 0.35 | 4 | 3 | 0 | Y | CKVPIEIRD | 95.15 | CKIPIEIRD | 1.94 | CKIPFEIMD | 1.94 | | | | |
| E | 614 | 0.35 | 4 | 3 | 0 | Y | KVPIEIRDV | 95.15 | KIPIEIRDV | 1.94 | KIPFEIMDL | 1.94 | | | | |
| E | 615 | 0.35 | 3 | 3 | 0 | Y | VPIEIRDVN | 95.15 | IPIEIRDVN | 1.94 | IPFEIMDLE | 1.94 | | | | |
| E | 616 | 0.22 | 3 | 2 | 0 | Y | PIEIRDVNK | 97.09 | PFEIMDLEK | 1.94 | | | | | | |
| E | 617 | 0.41 | 5 | 3 | 0 | Y | IEIRDVNKE | 94.17 | IEIRDVNKK | 2.91 | FEIMDLEKR | 1.94 | | | | |
| E | 618 | 0.48 | 5 | 4 | 0 | Y | EIRDVNKEK | 93.2 | EIRDVNKKK | 2.91 | EIMDLEKRH | 1.94 | EIRDVNKER | 0.97 | | |
| E | 619 | 0.48 | 5 | 4 | 0 | Y | IRDVNKEKV | 93.2 | IRDVNKKKV | 2.91 | IMDLEKRHV | 1.94 | IKDMNKEKV | 0.97 | | |
| E | 620 | 0.62 | 6 | 5 | 0 | Y | RDVNKEKVV | 91.26 | RDVNKKKVV | 2.91 | MDLEKRHVL | 1.94 | RDVNKEKVI | 1.94 | RDVNKERV | 0.97 |
| E | 621 | 0.62 | 6 | 5 | 0 | Y | DVNKEKVVG | 91.26 | DVNKKKVVG | 2.91 | DLEKRHVLG | 1.94 | DVNKEKVIG | 1.94 | DMNKEKVVG | 0.97 |
| E | 622 | 0.62 | 6 | 5 | 0 | Y | VNKEKVVGR | 91.26 | VNKKKVVGR | 2.91 | LEKRHVLGR | 1.94 | VNKEKVIGR | 1.94 | VNKEKVVGR | 1.94 |
| E | 638 | 0.73 | 6 | 5 | 0 | Y | AENTNSVTN | 89.32 | AENTNSATN | 2.91 | AESTNSVTN | 2.91 | VTEKDSPVN | 1.94 | AEYTNSVTN | 1.94 |
| E | 639 | 0.73 | 6 | 5 | 0 | Y | ENTNSVTNI | 89.32 | ENTNSATNI | 2.91 | ESTNSVTNI | 2.91 | TEKDSPVNI | 1.94 | EYTNSVTNI | 1.94 |
| E | 640 | 0.73 | 6 | 5 | 0 | Y | NTNSVTNIE | 89.32 | STNSVTNIE | 2.91 | NTNSATNIE | 2.91 | EKDSPVNIE | 1.94 | YTNSVTNIE | 1.94 |
| E | 641 | 0.41 | 4 | 3 | 0 | Y | TNSVTNIEL | 94.17 | TNSATNIEL | 2.91 | KDSPVNIEA | 1.94 | | | | |
| E | 642 | 0.41 | 4 | 3 | 0 | Y | NSVTNIELE | 94.17 | NSATNIELE | 2.91 | DSPVNIEAE | 1.94 | | | | |
| E | 643 | 0.41 | 4 | 3 | 0 | Y | SVTNIELEP | 94.17 | SATNIELEP | 2.91 | SPVNIEAEP | 1.94 | | | | |
| E | 644 | 0.41 | 4 | 3 | 0 | Y | VTNIELEPP | 94.17 | ATNIELEPP | 2.91 | PVNIEAEPP | 1.94 | | | | |
| E | 645 | 0.14 | 2 | 2 | 0 | Y | TNIELEPPF | 98.06 | VNIEAEPPF | 1.94 | | | | | | |
| E | 646 | 0.14 | 2 | 2 | 0 | Y | NIELEPPFG | 98.06 | NIEAEPPFG | 1.94 | | | | | | |
| E | 647 | 0.14 | 2 | 2 | 0 | Y | IELEPPFGD | 98.06 | IEAEPPFGD | 1.94 | | | | | | |
| E | 648 | 0.14 | 2 | 2 | 0 | Y | ELEPPFGDS | 98.06 | EAEPPFGDS | 1.94 | | | | | | |
| E | 649 | 0.14 | 2 | 2 | 0 | Y | LEPPFGDSY | 98.06 | AEPPFGDSY | 1.94 | | | | | | |

FIG. 15-25

Species: DENV4 (9-mers)

| protein | block starting position | block entropy | total peptides in block | peptides required to cover 99% of block | gap/X fraction | 99% of block covered w/ <= 5 peptides? | block to cover 99% of peptides required | frequency | block to cover 99% of peptides required | frequency |

FIG. 15-26

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 676 | 0.28 | 3 | 3 | 0 | Y | SSIGKMFES | 96.12 | SSIGKMLES | 1.94 | SSIGQMFET | 1.94 | | |
| E | 677 | 0.28 | 3 | 3 | 0 | Y | SIGKMFEST | 96.12 | SIGKMLEST | 1.94 | SIGQMFETT | 1.94 | | |
| E | 678 | 0.28 | 3 | 3 | 0 | Y | IGKMFESTY | 96.12 | IGKMLESTY | 1.94 | IGQMFETTM | 1.94 | | |
| E | 679 | 0.28 | 3 | 3 | 0 | Y | GKMFESTYR | 96.12 | GKMLESTYR | 1.94 | GQMFETTMR | 1.94 | | |
| E | 680 | 0.28 | 3 | 3 | 0 | Y | KMFESTYRG | 96.12 | QMFETTMRG | 1.94 | KMLESTYRG | 1.94 | | |
| E | 681 | 0.28 | 3 | 3 | 0 | Y | MFESTYRGA | 96.12 | MLESTYRGA | 1.94 | MFETTMRGA | 1.94 | | |
| E | 682 | 0.28 | 3 | 3 | 0 | Y | FESTYRGAK | 96.12 | FETTMRGAK | 1.94 | LESTYRGAK | 1.94 | | |
| E | 683 | 0.14 | 2 | 2 | 0 | Y | ESTYRGAKR | 98.06 | ETTMRGAKR | 1.94 | | | | |
| E | 684 | 0.14 | 2 | 2 | 0 | Y | STYRGAKRM | 98.06 | TTMRGAKRM | 1.94 | | | | |
| E | 685 | 0.14 | 2 | 2 | 0 | Y | TYRGAKRMA | 98.06 | TMRGAKRMA | 1.94 | | | | |
| E | 686 | 0.14 | 2 | 2 | 0 | Y | YRGAKRMAI | 98.06 | MRGAKRMAI | 1.94 | | | | |
| E | 687 | 0 | 1 | 1 | 0 | Y | RGAKRMAIL | 100 | | | | | | |
| E | 688 | 0 | 1 | 1 | 0 | Y | GAKRMAILG | 100 | | | | | | |
| E | 689 | 0.14 | 2 | 2 | 0 | Y | AKRMAILGE | 98.06 | AKRMAILGD | 1.94 | | | | |
| E | 690 | 0.14 | 2 | 2 | 0 | Y | KRMAILGET | 98.06 | KRMAILGDT | 1.94 | | | | |
| E | 691 | 0.14 | 2 | 2 | 0 | Y | RMAILGETA | 98.06 | RMAILGDTA | 1.94 | | | | |
| E | 692 | 0.14 | 2 | 2 | 0 | Y | MAILGETAW | 98.06 | MAILGDTAW | 1.94 | | | | |
| E | 693 | 0.14 | 2 | 2 | 0 | Y | AILGETAWD | 98.06 | AILGDTAWD | 1.94 | | | | |
| E | 694 | 0.14 | 2 | 2 | 0 | Y | ILGETAWDF | 98.06 | ILGDTAWDF | 1.94 | | | | |
| E | 695 | 0.14 | 2 | 2 | 0 | Y | LGETAWDFG | 98.06 | LGDTAWDFG | 1.94 | | | | |
| E | 696 | 0.14 | 2 | 2 | 0 | Y | GETAWDFGS | 98.06 | GDTAWDFGS | 1.94 | | | | |
| E | 697 | 0.14 | 2 | 2 | 0 | Y | ETAWDFGSV | 98.06 | DTAWDFGSL | 1.94 | | | | |
| E | 698 | 0.14 | 2 | 2 | 0 | Y | TAWDFGSVG | 98.06 | TAWDFGSLG | 1.94 | | | | |
| E | 699 | 0.14 | 2 | 2 | 0 | Y | AWDFGSVGG | 98.06 | AWDFGSLGG | 1.94 | | | | |
| E | 700 | 0.14 | 2 | 2 | 0 | Y | WDFGSVGGL | 98.06 | WDFGSLGGV | 1.94 | | | | |
| E | 701 | 0.46 | 3 | 3 | 0 | Y | DFGSVGGLF | 92.23 | DFGSVGGLL | 5.83 | DFGSLGGVF | 1.94 | | |

FIG. 15-27

Species: DENV4 (9-mers)

| protein | block starting position | block entropy | total peptides in block | peptides required to cover 99% of block | gap/X fraction | 99% of block covered w/ =< 5 peptides? | block to cover 99% of block | frequency | block to cover 99% of block | frequency | block to cover 99% of block | frequency | block to cover 99% of block | frequency

Species: DENV4 (9-mers)

FIG. 15-28

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency |

FIG. 15-29

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 756 | 0.32 | 3 | 2 | 0 | Y | AMTCIAVGG | 95.15 | AMSCIAVGG | 3.88 | | | | |
| E | 757 | 0.32 | 3 | 2 | 0 | Y | MTCIAVGGI | 95.15 | MSCIAVGGI | 3.88 | | | | |
| E | 758 | 0.32 | 3 | 2 | 0 | Y | TCIAVGGIT | 95.15 | SCIAVGG

FIG. 15-30

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 791 | 0.63 | 4 | 4 | 0 | Y | GSGIFVDNV | 89.32 | GSGIFVDN | 6.8 | GSGIFVADN | 1.94 | GSGIFVTDN | 1.94 |
| NS1 | 792 | 0.63 | 4 | 4 | 0 | Y | SGIFVDNVV | 89.32 | SGIFVDNV | 6.8 | SGIFVADNV | 1.94 | SGIFVTDNV | 1.94 |
| NS1 | 793 | 0.63 | 4 | 4 | 0 | Y | GIFVDNVH | 89.32 | GIFVDNVH | 6.8 | GIFVTDNVH | 1.94 | GIFVADNVH | 1.94 |
| NS1 | 794 | 0.63 | 4 | 4 | 0 | Y | IFVDNVHT | 89.32 | IFVDNVHT | 6.8 | IFVTDNVHT | 1.94 | IFVTDNVHT | 1.94 |
| NS1 | 795 | 0.63 | 4 | 4 | 0 | Y | FVDNVHTW | 89.32 | FVDNVHTW | 6.8 | FVADNVHT | 1.94 | FVTDNVHT | 1.94 |
| NS1 | 796 | 0.71 | 5 | 4 | 0 | Y | VDNVHTWT | 88.35 | VDNVHTWT | 6.8 | VADNVHTWT | 1.94 | VDNVHTWT | 1.94 |
| NS1 | 797 | 0.71 | 5 | 4 | 0 | Y | VDNVHTWTE | 88.35 | IDNVHTWTE | 6.8 | TDNVHTWTE | 1.94 | ADNVHTWTE | 1.94 |
| NS1 | 798 | 0.08 | 2 | 1 | 0 | Y | DNVHTWTEQ | 99.03 | | | | | | |
| NS1 | 799 | 0.16 | 3 | 2 | 0 | Y | NVHTWTEQY | 98.06 | NVHTWTEQH | 0.97 | | | | |
| NS1 | 800 | 0.3 | 4 | 3 | 0 | Y | VHTWTEQYK | 96.12 | VHTWTEQYQ | 1.94 | VHTWTEQHK | 0.97 | | |
| NS1 | 801 | 0.3 | 4 | 3 | 0 | Y | HTWTEQYKF | 96.12 | HTWTEQYQF | 1.94 | HTWIEQYKF | 0.97 | | |
| NS1 | 802 | 0.3 | 4 | 3 | 0 | Y | TWTEQYKFQ | 96.12 | TWTEQYQFQ | 1.94 | TWTEQHKFQ | 0.97 | | |
| NS1 | 803 | 0.3 | 4 | 3 | 0 | Y | WTEQYKFQP | 96.12 | WTEQYQFQP | 1.94 | WTEQHKFQP | 0.97 | | |
| NS1 | 804 | 0.3 | 4 | 3 | 0 | Y | TEQYKFQPE | 96.12 | TEQYQFQPE | 1.94 | TEQHKFQPE | 0.97 | | |
| NS1 | 805 | 0.22 | 3 | 2 | 0 | Y | EQYKFQPES | 97.09 | EQYQFQPES | 1.94 | | | | |
| NS1 | 806 | 0.22 | 3 | 2 | 0 | Y | QYKFQPESP | 97.09 | QYQFQPESP | 1.94 | | | | |
| NS1 | 807 | 0.22 | 3 | 2 | 0 | Y | YKFQPESPA | 97.09 | YQFQPESPA | 1.94 | | | | |
| NS1 | 808 | 0.14 | 2 | 2 | 0 | Y | KFQPESPAR | 98.06 | QFQPESPAR | 1.94 | | | | |
| NS1 | 809 | 0.14 | 2 | 2 | 0 | Y | FQPESPARL | 98.06 | FQPESPARV | 1.94 | | | | |
| NS1 | 810 | 0.14 | 2 | 2 | 0 | Y | QPESPARLA | 98.06 | QPESPARVA | 1.94 | | | | |
| NS1 | 811 | 0.14 | 2 | 2 | 0 | Y | PESPARLAS | 98.06 | PESPARVAS | 1.94 | | | | |
| NS1 | 812 | 0.14 | 2 | 2 | 0 | Y | ESPARLASA | 98.06 | ESPARVASA | 1.94 | | | | |
| NS1 | 813 | 0.14 | 2 | 2 | 0 | Y | SPARLASAI | 98.06 | SPARVASAI | 1.94 | | | | |
| NS1 | 814 | 0.14 | 2 | 2 | 0 | Y | PARLASAIL | 98.06 | PARVASAIL | 1.94 | | | | |
| NS1 | 815 | 0.22 | 3 | 2 | 0 | Y | ARLASAILN | 97.09 | ARVASAILN | 1.94 | | | | |
| NS1 | 816 | 0.22 | 3 | 2 | 0 | Y | RLASAILNA | 97.09 | RVASAILNA | 1.94 | | | | |

FIG. 15-31

Species: DENV4 (9-mers)

| protein | block starting position | block entropy | total

FIG. 15-32

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 843 | 0 | 1 | 1 | 0 | Y | WKQITNELN | 100 | | | | | | |
| NS1 | 844 | 0 | 1 | 1 | 0 | Y | KQITNELNY | 100 | | | | | | |
| NS1 | 845 | 0.08 | 2 | 1 | 0 | Y | QITNELNYV | 99.03 | | | | | | |
| NS1 | 846 | 0.08 | 2 | 1 | 0 | Y | ITNELNYVL | 99.03 | | | | | | |
| NS1 | 847 | 0.08 | 2 | 1 | 0 | Y | TNELNYVLW | 99.03 | | | | | | |
| NS1 | 848 | 0.08 | 2 | 1 | 0 | Y | NELNYVLWE | 99.03 | | | | | | |
| NS1 | 849 | 0.08 | 2 | 1 | 0 | Y | ELNYVLWEG | 99.03 | |

FIG. 15-33

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 869 | 0.53 | 4 | 3 | 0 | Y | KGVLTKGKR | 91.26 | KGVLSKGKR | 5.83 | KGVLVKGKR | 1.94 | | | | |
| NS1 | 870 | 0.61 | 5 | 4 | 0 | Y | GVLTKGKRA | 90.29 | GVLSKGKRA | 5.83 | GVLVKGKRA | 1.94 | GVLTKGKRV

FIG. 15-34

Species: DENV4 (9-mers)

| protein | block starting position | block entropy | total peptides in block | peptides required to cover 99% of block | gap/X fraction | 99% of block covered w/ <= 5 peptides? | block (pe

FIG. 15-35

Species: DENV4 (9-mers)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS1 | 931 | 0.08 | 2 | 1 | 0 | Y | EDYGFGMFT | 99.03 | | |
| NS1 | 932 | 0 | 1 | 1 | 0 | Y | DYGFGMFTT | 100 | | |
| NS1 | 933 | 0.14 | 2 | 2 | 0 | Y | YGFGMFTTN | 98.06 | YGFGMFTTS | 1.94 |
| NS1 | 934 | 0.14 | 2 | 2 | 0 | Y | GFGMFTTNI | 98.06 | GFGMFTTSI | 1.94 |
| NS1 | 935 | 0.14 | 2 | 2 | 0 | Y | FGMFTTNIW | 98.06 | FGMFTTSIW | 1.94 |
| NS1 | 936 | 0.14 | 2 | 2 | 0 | Y | GMFTTNIWM | 98.06 | GMFTTSIWM | 1.94 |
| NS1 | 937 | 0.14 | 2 | 2 | 0 | Y | MFTTNIWMK | 98.06 | MFTTSIWMK | 1.94 |
| NS1 | 938 | 0.22 | 3 | 2 | 0 | Y | FTTNIWMKF | 97.09 | FTTSIWMKF | 1.94 |
| NS1 | 939 | 0.22 | 3 | 2 | 0 | Y | TTNIWMKFR | 97.09 | TTSIWMKFR | 1.94 |
| NS1 | 940 | 0.22 | 3 | 2 | 0 | Y | TNIWMKFRE | 97.09 | TSIWMKFRE | 1.94 |
| NS1 | 941 | 0.22 | 3 | 2 | 0 | Y | NIWMKFREG | 97.09 | SIWMKFREG | 1.94 |
| NS1 | 942 | 0.08 | 2 | 1 | 0 | Y | IWMKFREGS | 99.03 | | |
| NS1 | 943 | 0.08 | 2 | 1 | 0 | Y | WMKFREGSS | 99.03 | | |
| NS1 | 944 | 0.08 | 2 | 1 | 0 | Y | MKFREGSSE | 99.03 | | |
| NS1 | 945 | 0.16 | 3 | 2 | 0 | Y | KFREGSSEV | 98.06 | KFREGSSEL | 0.97 |
| NS1 | 946 | 0.16 | 3 | 2 | 0 | Y | FREGSSEVC | 98.06 | FREGSSELC | 0.97 |
| NS1 | 947 | 0.08 | 2 | 1 | 0 | Y | REGSSEVCD | 99.03 | | |
| NS1 | 948 | 0.08 | 2 | 1 | 0 | Y | EGSSEVCDH | 99.03 | | |
| NS1 | 949 | 0.08 | 2 | 1 | 0 | Y | GSSEVCDHR | 99.03 | | |
| NS1 | 950 | 0.08 | 2 | 1 | 0 | Y | SSEVCDHRL | 99.03 | | |
| NS1 | 951 | 0.08 | 2 | 1 | 0 | Y | SEVCDHRLM | 99.03 | | |
| NS1 | 952 | 0.08 | 2 | 1 | 0 | Y | EVCDHRLMS | 99.03 | | |
| NS1 | 953 | 0.08 | 2 | 1 | 0 | Y | VCDHRLMSA | 99.03 | | |
| NS1 | 954 | 0 | 1 | 1 | 0 | Y | CDHRLMSAA | 100 | | |
| NS1 | 955 | 0.08 | 2 | 1 | 0 | Y | DHRLMSAAI | 99.03 | | |
| NS1 | 956 | 0.08 | 2 | 1 | 0 | Y | HRLMSAAIK | 99.03 | | |

FIG. 15-36

Species: DENV4 (9-mers)

| protein | block starting position | block entropy | total

FIG. 15-37

Species: DENV4 (9-mers)

| protein | block starting position | block entropy | total peptides in block | peptides required to cover 99% of block | gap/X fraction | 99% of block covered w/ <= 5 peptides? | block (peptides required to cover 99% of block) | frequency | block (peptides required to cover 99% of block) | frequency |
|---|---|---|---|---|---|---|---|---|---|---|
| NS1 | 983 | 0.98 | 2 | 2 | 0 | Y | QTWQIERAS | 58.25 | QTWQIERAS | 41.75 |
| NS1 | 984 | 0.98 | 2 | 2 | 0 | Y | TWQIERASL | 58.25 | TWQIERASL | 41.75 |
| NS1 | 985 | 0.98 | 2 | 2 | 0 | Y | WQIERASLI | 58.25 | WQIERASLI | 41.75 |
| NS1 | 986 | 0.98 | 2 | 2 | 0 | Y | QIERASLIE | 58.25 | QIERASLIE | 41.75 |
| NS1 | 987 | 0.98 | 2 | 2 | 0 | Y | IERASLIEV | 58.25 | IERASLIEV | 41.75 |
| NS1 | 988 | 0.98 | 2 | 2 | 0 | Y | EKASLIEVK | 58.25 | ERASLIEV | 41.75 |
| NS1 | 989 | 0.98 | 2 | 2 | 0 | Y | KASLIEVKT | 58.25 | RASLIEVKT | 41.75 |
| NS1 | 990 | 0 | 1 | 1 | 0 | Y | ASLIEVKTC | 100 | | |
| NS1 | 991 | 0 | 1 | 1 | 0 | Y | SLIEVKTCL | 100 | | |
| NS1 | 992 | 0 | 1 | 1 | 0 | Y | LIEVKTCLW | 100 | | |
| NS1 | 993 | 0 | 1 | 1 | 0 | Y | IEVKTCLWP | 100 | | |
| NS1 | 994 | 0 | 1 | 1 | 0 | Y | EVKTCLWPK | 100 | | |
| NS1 | 995 | 0 | 1 | 1 | 0 | Y | VKTCLWPKT | 100 | | |
| NS1 | 996 | 0 | 1 | 1 | 0 | Y | KTCLWPKTH | 100 | | |
| NS1 | 997 | 0 | 1 | 1 | 0 | Y | TCLWPKTHT | 100 | | |
| NS1 | 998 | 0 | 1 | 1 | 0 | Y | CLWPKTHTL | 100 | | |
| NS1 | 999 | 0 | 1 | 1 | 0 | Y | LWPKTHTLW | 100 | | |
| NS1 | 1000 | 0 | 1 | 1 | 0 | Y | WPKTHTLWS | 100 | | |
| NS1 | 1001 | 0 | 1 | 1 | 0 | Y | PKTHTLWSN | 100 | | |
| NS1 | 1002 | 0 | 1 | 1 | 0 | Y | KTHTLWSNG | 100 | | |
| NS1 | 1003 | 0 | 1 | 1 | 0 | Y | THTLWSNGV | 100 | | |
| NS1 | 1004 | 0 | 1 | 1 | 0 | Y | HTLWSNGVL | 100 | | |
| NS1 | 1005 | 0 | 1 | 1 | 0 | Y | TLWSNGVLE | 100 | | |
| NS1 | 1006 | 0 | 1 | 1 | 0 | Y | LWSNGVLES | 100 | | |
| NS1 | 1007 | 0 | 1 | 1 | 0 | Y | WSNGVLESQ | 100 | | |
| NS1 | 1008 | 0 | 1 | 1 | 0 | Y | SNGVLESQM | 100 | | |

FIG. 15-38

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1009 | 0 | 1 | 1 | 0 | Y | NGVLESQML | 100 | | | | | | |
| NS1 | 1010 | 0 | 1 | 1 | 0 | Y | GVLESQMLI | 100 | | | | | | |
| NS1 | 1011 | 0 | 1 | 1 | 0 | Y | VLESQMLIP | 100 | | | | | | |
| NS1 | 1012 | 0.46 | 2 | 2 | 0 | Y | LESQMLIPK | 90.29 | LESQMLIPR | 9.71 | | | | |
| NS1 | 1013 | 0.92 | 4 | 2 | 0 | Y | ESQMLIPKS | 81.55 | ESQMLIPRS | 9.71 | ESQMLIPKA | 7.77 | | |
| NS1 | 1014 | 0.92 | 4 | 3 | 0 | Y | SQMLIPKSY | 81.55 | SQMLIPRSY | 9.71 | SQMLIPKAY | 7.77 | | |
| NS1 | 1015 | 0.92 | 4 | 3 | 0 | Y | QMLIPKSYA | 81.55 | QMLIPRSYA | 9.71 | QMLIPKAYA | 7.77 | | |
| NS1 | 1016 | 0.92 | 4 | 3 | 0 | Y | MLIPKSYAG | 81.55 | MLIPRSYAG | 9.71 | MLIPKAYAG | 7.77 | | |
| NS1 | 1017 | 0.92 | 4 | 3 | 0 | Y | LIPKSYAGP | 81.55 | LIPRSYAGP | 9.71 | LIPKAYAGP | 7.77 | | |
| NS1 | 1018 | 0.98 | 5 | 4 | 0 | Y | IPKSYAGPF | 81.55 | IPRSYAGPF | 9.71 | IPKAYAGPF | 5.83 | IPKAYAGPI | 1.94 |
| NS1 | 1019 | 0.98 | 5 | 4 | 0 | Y | PKSYAGPFS | 81.55 | PRSYAGPFS | 9.71 | PKAYAGPFS | 5.83 | PKAYAGPIS | 1.94 |
| NS1 | 1020 | 1.16 | 6 | 5 | 0 | Y | KSYAGPFSQ | 78.64 | RSYAGPFSQ | 9.71 | KAYAGPFSQ | 5.83 | KSYAGPFSH | 2.91 |
| NS1 | 1021 | 0.72 | 4 | 4 | 0 | Y | SYAGPFSQH | 88.35 | AYAGPFSQH | 5.83 | SYAGPFSHH | 2.91 | AYAGPISQH | 1.94 |
| NS1 | 1022 | 0.41 | 3 | 3 | 0 | Y | YAGPFSQHN | 94.17 | YAGPFSHHN | 2.91 | YAGPISQHN | 1.94 | | |
| NS1 | 1023 | 0.41 | 3 | 3 | 0 | Y | AGPFSQHNY | 94.17 | AGPFSHHNY | 2.91 | AGPISQHNY | 1.94 | | |
| NS1 | 1024 | 0.41 | 3 | 3 | 0 | Y | GPFSQHNYR | 94.17 | GPFSHHNYR | 2.91 | GPISQHNYR | 1.94 | | |
| NS1 | 1025 | 0.41 | 3 | 3 | 0 | Y | PFSQHNYRQ | 94.17 | PESHHNYRQ | 2.91 | PISQHNYRQ | 1.94 | | |
| NS1 | 1026 | 0.41 | 3 | 3 | 0 | Y | FSQHNYRQG | 94.17 | FSHHNYRQG | 2.91 | ISQHNYRQG | 1.94 | | |
| NS1 | 1027 | 0.19 | 2 | 2 | 0 | Y | SQHNYRQGY | 97.09 | SHHNYRQGY | 2.91 | | | | |
| NS1 | 1028 | 0.19 | 2 | 2 | 0 | Y | QHNYRQGYA | 97.09 | HHNYRQGYA | 2.91 | | | | |
| NS1 | 1029 | 0 | 1 | 1 | 0 | Y | HNYRQGYAT | 100 | | | | | | |
| NS1 | 1030 | 0 | 1 | 1 | 0 | Y | NYRQGYATQ | 100 | | | | | | |
| NS1 | 1031 | 0.14 | 2 | 2 | 0 | Y | YRQGYATQI | 98.06 | YRQGYATQT | 1.94 | | | | |
| NS1 | 1032 | 0.73 | 4 | 4 | 0 | Y | RQGYATQTM | 87.38 | RQGYATQTI | 5.83 | RQGYATQTA | 4.85 | RQGYATQIA | 1.94 |
| NS1 | 1033 | 0.73 | 4 | 4 | 0 | Y | QGYATQTVG | 87.38 | QGYATQTMG | 5.83 | QGYATQTAG | 4.85 | QGYATQIAG | 1.94 |
| NS1 | 1034 | 0.73 | 4 | 4 | 0 | Y | GYATQTVGP | 87.38 | GYATQTMGP | 5.83 | GYATQTAGP | 4.85 | GYATQIAGP | 1.94 |

Additional entry at row 1020: KAYAGPISQ 1.94

FIG. 15-39

Species: DENV4 (9-mers)

| protein | block starting position | block entropy | total peptides in block | peptides required to cover 99% of block | gap/X fraction | covered w/ <= 5 peptides? | block (99% of block) | frequency | block (to cover 99% of) | frequency | block (to cover 99% of) | frequency | block (to cover 99% of) | frequency |
|---|---|---|---|---|---|---|---|---|---|---|---|---|---|---|
| NS1 | 1035 | 0.73 | 4 | 4 | 0 | Y | YATQTVGPW | 87.38 | YATQTMGPW | 5.83 | YATQTAGPW | 4.85 | YATQIAGPW | 1.94 | | |
| NS1 | 1036 | 0.73 | 4 | 4 | 0 | Y | ATQTVGPWH | 87.38 | ATQTMGPWH | 5.83 | ATQTAGPWH | 4.85 | ATQIAGPWH | 1.94 | | |
| NS1 | 1037 | 0.73 | 4 | 4 | 0 | Y | TQTVGPWHL | 87.38 | TQTMGPWHL | 5.83 | TQTAGPWHL | 4.85 | TQIAGPWHL | 1.94 | | |
| NS1 | 1038 | 0.73 | 4 | 4 | 0 | Y | QTVGPWHLG | 87.38 | QTMGPWHLG | 5.83 | QTAGPWHLG | 4.85 | QIAGPWHLG | 1.94 | |

FIG. 15-40

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS1 | 1065 | 0.99 | 4 | 3 | 0 | Y | DCD

FIG. 15-41

Species: DENV4 (9-mers)

| protein | block starting position | block entropy | total peptides in block | peptides required to cover 99% of block | gap/X fraction | 99% of block covered w

FIG. 15-42

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1117 | 0.28 | 3 | 3 | 0 | Y | EENMVKSQV | 96.12 | EENMVKSQA | 1.94 | EENMVRSQV | 1.94 | | |
| NS1 | 1118 | 1.3 | 5 | 5 | 0 | Y | ENMVKSQVT | 70.87 | ENMVKSQVA | 17.48 | ENMVKSQYS | 7.77 | ENMVKSQAT | 1.94 | ENMVRSQVT | 1.94 |
| NS1 | 1119 | 1.3 | 5 | 5 | 0 | Y | NMVKSQVTA | 70.87 | NMVKSQVAA | 17.48 | NMVKSQVSA | 7.77 | NMVKSQATA | 1.94 | NMVRSQVTA | 1.94 |
| NS1 | 1120 | 1.3 | 5 | 5 | 0 | Y | MVKSQVTAG | 70.87 | MVKSQVAAG | 17.48 | MVKSQVSAG | 7.77 | MVKSQATAG | 1.94 | MVRSQVTAG | 1.94 |
| NS1 | 1127 | 0.67 | 6 | 5 | 0 | Y | AGQGTSETF | 90.29 | AGQSTSETF | 3.88 | AGPGTSETF | 1.94 | AGQGSSETF | 1.94 | AGQGTPETF | 0.97 |
| NS2A | 1130 | 0.61 | 6 | 5 | 0 | Y | GTSETFSMG | 91.26 | STSETFSMG | 3.88 | GSSETFSMG | 1.94 | GPSETFSMG | 0.97 | GTSETFFMG | 0.97 |
| NS2A | 1131 | 0.37 | 5 | 4 | 0 | Y | TSETFSMGL | 95.15 | SSETFSMGL | 1.94 | PSETFSMGL | 0.97 | TPETFSMGL | 0.97 | |
| NS2A | 1132 | 0.16 | 3 | 2 | 0 | Y | SETFSMGLL | 98.06 | SETFFMGLL | 0.97 | | | | |
| NS2A | 1133 | 0.08 | 2 | 1 | 0 | Y | ETFSMGLLC | 99.03 | | | | | | |
| NS2A | 1134 | 0.08 | 2 | 1 | 0 | Y | TFSMGLLCL | 99.03 | | | | | | |
| NS2A | 1135 | 0.08 | 2 | 1 | 0 | Y | FSMGLLCLT | 99.03 | | | | | | |
| NS2A | 1136 | 0.08 | 2 | 1 | 0 | Y | SMGLLCLTL | 99.03 | | | | | | |
| NS2A | 1137 | 0 | 1 | 1 | 0 | Y | MGLLCLTLF | 100 | | | | | | |
| NS2A | 1138 | 0.42 | 3 | 3 | 0 | Y | GLLCLTLFV | 93.2 | GLLCLTLFM | 4.85 | GLLCLTLFI | 1.94 | | |
| NS2A | 1139 | 0.42 | 3 | 3 | 0 | Y | LLCLTLFVE | 93.2 | LLCLTLFME | 4.85 | LLCLTLFIE | 1.94 | | |
| NS2A | 1140 | 0.42 | 3 | 3 | 0 | Y | LCLTLFVEE | 93.2 | LCLTLFMEE | 4.85 | LCLTLFIEE | 1.94 | | |
| NS2A | 1141 | 0.42 | 3 | 3 | 0 | Y | CLTLFVEEC | 93.2 | CLTLFMEEC | 4.85 | CLTLFIEEC | 1.94 | | |
| NS2A | 1142 | 0.42 | 3 | 3 | 0 | Y | LTLFVEECL | 93.2 | LTLFMEECL | 4.85 | LTLFIEECL | 1.94 | | |
| NS2A | 1143 | 0.42 | 3 | 3 | 0 | Y | TLFVEECLR | 93.2 | TLFMEECLR | 4.85 | TLFIEECLR | 1.94 | | |
| NS2A | 1144 | 0.42 | 3 | 3 | 0 | Y | LFVEECLRR | 93.2 | LFMEECLRR | 4.85 | LFIEECLRR | 1.94 | | |
| NS2A | 1145 | 0.42 | 3 | 3 | 0 | Y | FVEECLRRR | 93.2 | FMEECLRRR | 4.85 | FIEECLRRK | 1.94 | |

FIG. 15-43

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---

FIG. 15-44

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1183 | 0.19 | 2 | 2 | 0 | Y | ALIMLGDTM | 97.09 | AIIMLGDTM | 2.91 | | | | |
| NS2A | 1184 | 0.22 | 3 | 2 | 0 | Y | LIMLGDTMS | 97.09 | IIMLGDTML | 1.94 | | | | |
| NS2A | 1185 | 0.3 | 4 | 3 | 0 | Y | IMLGDTMSG | 96.12 | IMLGDTMLS | 1.94 | IMLGDTMFG | 0.97 | | |
| NS

FIG. 15-45

Species: DENV4 (9-mers)

| protein | block starting position | block entropy | total peptides in block | peptides required to cover 99% of block | gap/X fraction | 99% of block covered w/ <= 5 peptides? | block (to cover 99% of block) | frequency | block (to cover 99% of block) | frequency | block (to cover 99% of block) | frequency | block (to cover 99% of block) | frequency |
|---|---|---|---|---|---|---|---|---|---|---|---|---|---|---|
| NS2A | 1212 | 0.32 | 2 | 2 | 0 | Y | GYVLGVFLR | 94.17 | GYVLGIFLR | 5.83 | | | | |
| NS2A | 1213 | 0.49 | 4 | 3 | 0 | Y | YVLGVFLRK | 92.23 | YVLGIFLRK | 4.85 | YVLGVFLRR | 1.94 | | |
| NS2A | 1214 | 0.49 | 4 | 3 | 0 | Y | VLGVFLRKL | 92.23 | VLGIFLRKL | 4.85 | VLGVFLRRL | 1.94 | | |
| NS2A | 1215 | 0.49 | 4 | 3 | 0 | Y | LGVFLRKLT | 92.23 | LGIFLRKLT | 4.85 | LGVFLRRLT | 1.94 | | |
| NS2A | 1216 | 0.49 | 4 | 3 | 0 | Y | GVFLRKLTS | 92.23 | GIFLRKLTS | 4.85 | GVFLRRLTS | 1.94 | | |
| NS2A | 1217 | 0.49 | 4 | 3 | 0 | Y | VFLRKLTSR | 92.23 | IFLRKLTSR | 4.85 | VFLRRLTSR | 1.94 | | |
| NS2A | 1218 | 0.19 | 2 | 2 | 0 | Y | FLRKLTSRE | 97.09 | FLRRLTSRE | 2.91 | | | | |
| NS2A | 1219 | 0.19 | 2 | 2 | 0 | Y | LRKLTSRET | 97.09 | LRRLTSRET | 2.91 | | | | |
| NS2A | 1220 | 0.19 | 2 | 2 | 0 | Y | RKLTSRETA | 97.09 | RRLTSRETA | 2.91 | | | | |
| NS2A | 1221 | 0.19 | 2 | 2 | 0 | Y | KLTSRETAL | 97.09 | RLTSRETAL | 2.91 | | | | |
| NS2A | 1222 | 0 | 1 | 1 | 0 | Y | LTSRETALM | 100 | | | | | | |
| NS2A | 1223 | 0 | 1 | 1 | 0 | Y | TSRETALMV | 100 | | | | | | |
| NS2A | 1224 | 0 | 1 | 1 | 0 | Y | SRETALMVI | 100 | | | | | | |
| NS2A | 1225 | 0 | 1 | 1 | 0 | Y | RETALMVIG | 100 | | | | | | |
| NS2A | 1226 | 0 | 1 | 1 | 0 | Y | ETALMVIGM | 100 | | | | | | |
| NS2A | 1227 | 0 | 1 | 1 | 0 | Y | TALMVIGMA | 100 | | | | | | |
| NS2A | 1228 | 0 | 1 | 1 | 0 | Y | ALMVIGMAM | 100 | | | | | | |
| NS2A | 1229 | 0 | 1 | 1 | 0 | Y | LMVIGMAMT | 100 | | | | | | |
| NS2A | 1230 | 0 | 1 | 1 | 0 | Y | MVIGMAMTT | 100 | | | | | | |
| NS2A | 1231 | 0.98 | 2 | 2 | 0 | Y | VIGMAMTTI | 58.25 | VIGMAMTTV | 41.75 | | | | |
| NS2A | 1232 | 1.53 | 4 | 4 | 0 | Y | IGMAMTTTL | 55.34 | IGMAMTTVL | 28.16 | IGMAMTTVF | 13.59 | IGMAMTTTF | 2.91 |
| NS2A | 1233 | 1.53 | 4 | 4 | 0 | Y | GMAMTTTLS | 55.34 | GMAMTTVLS | 28.16 | GMAMTTVFS | 13.59 | GMAMTTTFS | 2.91 |
| NS2A | 1234 | 1.53 | 4 | 4 | 0 | Y | MAMTTTLSI | 55.34 | MAMTTVLSI | 28.16 | MAMTTVFSI | 13.59 | MAMTTTFSI | 2.91 |
| NS2A | 1235 | 1.53 | 4 | 4 | 0 | Y | AMTTTLSIP | 55.34 | AMTTVLSIP | 28.16 | AMTTVFSIP | 13.59 | AMTTTFSIP | 2.91 |
| NS2A | 1236 | 1.58 | 5 | 4 | 0 | Y | MTTTLSIPH | 55.34 | MTTVLSIPH | 28.16 | MTTVFSIPH | 12.62 | MTTTFSIPH | 2.91 |
| NS2A | 1237 | 1.58 | 5 | 4 | 0 | Y | TTTLSIPHD | 55.34 | TTVLSIPHD | 28.16 | TTVFSIPHD | 12.62 | TTTFSIPHD | 2.91 |

FIG.15-46

Species: DENV4 (9-mers)

| protein | block starting position | block entropy | total peptides in block | peptides required to cover 99% of block | gap/X fraction | covered w/ <= 5 peptides? | block | frequency | block | frequency | block | frequency | block | frequency | block | frequency |
|---|---|---|---|---|---|---|---|---|---|---|---|---|---|---|---|---|
| NS2A | 1238 | 1.58 | 5 | 4 | 0 | Y | TTLSIPHDL | 55.34 | TVLSIPHDL | 28.16 | TVFSIPHDL | 12.62 | TTFSIPHDL | 2.91 | | |
| NS2A | 1239 | 1.58 | 5 | 4 | 0 | Y | TLSIPHDLM | 55.34 | VLSIPHDLM | 28.16 | VFSIPHDLM | 12.62 | TFSIPHDLM | 2.91 | | |
| NS2A | 1240 | 0.7 | 3 | 2 | 0 | Y | LSIPHDLME | 83.5 | FSIPHDLME | 15.53 | | | | | | |
| NS2A | 1241 | 0.36 | 3 | 2 | 0 | Y | SIPHDLMEL | 94.17 | SIPHDLMEF | 4.85 | | | | | | |
| NS2A | 1242 | 0.36 | 3 | 2 | 0 | Y | IPHDLMELI | 94.17 | IPHDLMEFI | 4.85 | | | | | | |
| NS2A | 1243 | 0.36 | 3 | 2 | 0 | Y | PHDLMELID | 94.17 | PHDLMEFID | 4.85 | | | | | | |
| NS2A | 1244 | 0.36 | 3 | 2 | 0 | Y | HDLMELIDG | 94.17 | HDLMEFIDG | 4.85 | | | | | | |
| NS2A | 1245 | 0.36 | 4 | 2 | 0 | Y | DLMELIDGI | 94.17 | DLMEFIDGI | 4.85 | | | | | | |
| NS2A | 1246 | 0.44 | 4 | 3 | 0 | Y | LMELIDGIS | 93.2 | LMEFIDGIS | 4.85 | LMEFIDGLS | 0.97 | | | | |
| NS2A | 1247 | 0.44 | 4 | 3 | 0 | Y | MELIDGISL | 93.2 | MEFIDGISL | 4.85 | MEFIDGLSL | 0.97 | | | | |
| NS2A | 1248 | 0.44 | 4 | 3 | 0 | Y | ELIDGISLG | 93.2 | EFIDGISLG | 4.85 | ELIDGIALG | 0.97 | | | | |
| NS2A | 1249 | 0.44 | 4 | 3 | 0 | Y | LIDGISLGL | 93.2 | FIDGISLGL | 4.85 | FIDGISLGL | 0.97 | | | | |
| NS2A | 1250 | 0.16 | 3 | 2 | 0 | Y | IDGISLGLI | 98.06 | IDGSLSLGJ | 0.97 | | | | | | |
| NS2A | 1251 | 0.16 | 3 | 2 | 0 | Y | DGISLGLIL | 98.06 | DGIALGLIL | 0.97 | | | | | | |
| NS2A | 1252 | 0.16 | 3 | 2 | 0 | Y | GISLGLILL | 98.06 | GISLGLILL | 0.97 | | | | | | |
| NS2A | 1253 | 0.16 | 3 | 2 | 0 | Y | ISLGLILLK | 98.06 | LSLGLILLK | 0.97 | | | | | | |
| NS2A | 1254 | 0.55 | 4 | 3 | 0 | Y | SLGLILLKM | 90.29 | SLGLILLKM | 7.77 | SLGLILLKT | 0.97 | | | | |
| NS2A | 1255 | 0.51 | 3 | 2 | 0 | Y | LGLILLKMY | 90.29 | LGLILLKMY | 8.74 | | | | | | |
| NS2A | 1256 | 0.55 | 4 | 3 | 0 | Y | GLILLKMVT | 90.29 | GLILLKMVT | 7.77 | GLILLKMW | 0.97 | | | | |
| NS2A | 1257 | 1.1 | 5 | 4 | 0 | Y | LILLKMVTH | 76.7 | LILLKMVTH | 13.59 | LILLKMVTH | 7.77 | LILLKMVVH | 0.97 | | |
| NS2A | 1258 | 1.1 | 5 | 4 | 0 | Y | ILLKMVTQF | 76.7 | ILLKMVTHF | 13.59 | ILLKMVTHF | 7.77 | ILLKMVVHF | 0.97 | | |
| NS2A | 1259 | 1.1 | 5 | 4 | 0 | Y | LLKMVTQFD | 76.7 | LLKMVTHFD | 13.59 | LLKMVTHFD | 7.77 | LLKMVVHFD | 0.97 | | |
| NS2A | 1263 | 1.05 | 6 | 5 | 0 | Y | VTQFDNTQV | 76.7 | VTHFDNTQV | 18.45 | VTHFDDTQV | 1.94 | VTQFDDTQV | 0.97 | VHHFDNAQL | 0.97 |
| NS2A | 1264 | 1.05 | 6 | 5 | 0 | Y | TQFDNTQVG | 76.7 | THFDNTQVG | 18.45 | THFDDTQVG | 1.94 | THFDSTQVG | 0.97 | VHFDNAQLG | 0.97 |
| NS2A | 1265 | 1.05 | 6 | 5 | 0 | Y | QFDNTQVGT | 76.7 | HFDNTQVGT | 18.45 | HFDDTQVGT | 1.94 | QFDDTQVGT | 0.97 | HFDNAQLGT | 0.97 |
| NS2A | 1266 | 0.35 | 4 | 3 | 0 | Y | FDDTQVGTL | 95.15 | FDNTQVGTL | 2.91 | FDNAQLGTL | 0.97 | | | | |

FIG. 15-47

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS2A | 1267 | 0.35 | 4 | 3 | 0 | Y | DNTQVGTLA | 95.15 | DDTQVGTLA | 2.91 | DNAQLGTLA | 0.97 | | |
| NS2A | 1268 | 0.35 | 4 | 3 | 0 | Y | NTQVGTLAL | 95.15 | DTQVGTLAL | 2.91 | STQVGTLAL | 0.97 | | |
| NS2A | 1269 | 0.16 | 3 | 2 | 0 | Y | TQVGTLALS | 98.06 | AQLGTLALS | 0.97 | | | | |
| NS2A | 1270 | 0.16 | 3 | 2 | 0 | Y | QVGTLALSL | 98.06 | QLGTLALSL | 0.97 | | | | |
| NS2A | 1271 | 0.16 | 3 | 2 | 0 | Y | VGTLALSLT | 98.06 | VGTLALALT | 0.97 | | | | |
| NS2A | 1272 | 0.08 | 2 | 1 | 0 | Y | GTLALSLTF | 99.03 | | | | | | |
| NS2A | 1273 | 0.08 | 2 | 1 | 0 | Y | TLALSLTFI | 99.03 | | | | | | |
| NS2A | 1274 | 0.35 | 4 | 3 | 0 | Y | LALSLTFIR | 95.15 | LALSLTFIK | 2.91 | LALSLTFIS | 0.97 | | |
| NS2A | 1275 | 0.37 | 5 | 4 | 0 | Y | ALSLTFIKS | 95.15 | ALSLTFIKS | 1.94 | ALALTFIKS | 0.97 | ALSLTFISS | 0.97 |
| NS2A | 1276 | 0.37 | 5 | 4 | 0 | Y | LSLTFIKST | 95.15 | LSLTFIKST | 1.94 | LALTFIKST | 0.97 | LSLTFIKTT | 0.97 |
| NS2A | 1286 | 1.24 | 4 | 4 | 0 | Y | SLVMAWRTI | 58.25 | PLVMAWRTI | 36.89 | PLIMAWRTI | 2.91 | PLTMAWRTI | 1.94 |
| NS2A | 1287 | 0.33 | 3 | 3 | 0 | Y | LVMAWRTIM | 95.15 | LIMAWRTIM | 2.91 | LTMAWRTIM | 1.94 | | |
| NS2A | 1288 | 0.35 | 3 | 3 | 0 | Y | VMAWRTIMA | 95.15 | IMAWRTIMA | 1.94 | TMAWRTIMA | 1.94 | | |
| NS2A | 1289 | 0.08 | 2 | 1 | 0 | Y | MAWRTIMAV | 99.03 | | | | | | |
| NS2A | 1290 | 0.47 | 3 | 2 | 0 | Y | AWRTIMAVL | 91.26 | AWRTIMAVF | 7.77 | | | | |
| NS2A | 1291 | 0.47 | 3 | 2 | 0 | Y | WRTIMAVLF | 91.26 | WRTIMAVFF | 7.77 | | | | |
| NS2A | 1292 | 0.61 | 4 | 3 | 0 | Y | RTIMAVLFV | 89.32 | RTIMAVFFV | 7.77 | RTIMAVLFA | 1.94 | | |
| NS2A | 1293 | 0.61 | 4 | 3 | 0 | Y | TIMAVLFVW | 89.32 | TIMAVFFVW | 7.77 | TIMAVLFAV | 1.94 | | |
| NS2A | 1294 | 0.61 | 4 | 3 | 0 | Y | IMAVLFVWT | 89.32 | IMAVFFVWT | 7.77 | IMAVLFAVT | 1.94 | | |
| NS2A | 1295 | 0.61 | 4 | 3 | 0 | Y | MAVLFVWTL | 89.32 | MAVFFVWTL | 7.77 | MAVLFAVTL | 1.94 | | |
| NS2A | 1296 | 0.61 | 4 | 3 | 0 | Y | AVLFVWTLI | 89.32 | AVFFVWTLI | 7.77 | AVLFAVTLI | 1.94 | | |
| NS2A | 1297 | 0.53 | 3 | 3 | 0 | Y | VLFVWTLIP | 90.29 | VFFVWTLIP | 7.77 | VLFAVTLIP | 1.94 | | |
| NS2A | 1298 | 0.53 | 3 | 3 | 0 | Y | LFVWTLIPL | 90.29 | FFVWTLIPL | 7.77 | LFAVTLIPL | 1.94 | | |
| NS2A | 1299 | 0.14 | 2 | 2 | 0 | Y | FVWTLIPLC | 98.06 | FAVTLIPLC | 1.94 | | | | |
| NS2A | 1300 | 0.14 | 2 | 2 | 0 | Y | VWTLIPLCR | 98.06 | AVTLIPLCR | 1.94 | | | | |
| NS2A | 1301 | 0 | 1 | 1 | 0 | Y | VTLIPLCRT | 100 | | | | | | |

FIG. 15-48

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1302 | 0 | 1 | 1 | 0 | Y | TL

FIG. 15-49

Species: DENV4 (9-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1328 | 0 | 1 | 1 | 0 | Y | AQALPVYLM | 100 | | | |

FIG. 15-50

Species: DENV

FIG. 15-51

| protein | block starting position | block entropy | total peptides in block | peptides required to cover 99% of block | gap/X fraction | 99% of block covered w/ <= 5 peptides? | block | frequency | peptides required to cover 99% of block | block | frequency | peptides required to cover 99% of block | block | frequency | peptides required to cover 99% of block | block | frequency |
|---|---|---|---|---|---|---|---|---|---|---|---|---|---|---|---|---|---|
| NS2A | 1380 | 0 | 1 | 1 | 0 | Y | GGLLLAAYV | 100 | | | | | | | | | |
| NS2A | 1381 | 0 | 1 | 1 | 0 | Y | GLLLAAYYM | 100 | | | | | | | | | |
| NS2A | 1382 | 0 | 1 | 1 | 0 | Y | LLLAAYYMS | 100 | | | | | | | | | |
| NS2A | 1383 | 0 | 1 | 1 | 0 | Y | LLAAYYMSG | 100 | | | | | | | | | |
| NS2A | 1384 | 0 | 1 | 1 | 0 | Y | LAAYYMSGS | 100 | | | | | | | | | |
| NS2A | 1385 | 0.08 | 2 | 1 | 0 | Y | AAYYMSGSS | 99.03 | | | | | | | | | |
| NS2A | 1386 | 0.08 | 2 | 1 | 0 | Y | AYYMSGSSA | 99.03 | | | | | | | | | |
| NS2A | 1387 | 0.08 | 2 | 1 | 0 | Y | YYMSGSSAD | 99.03 | | | | | | | | | |
| NS2A | 1388 | 0.08 | 2 | 1 | 0 | Y | YMSGSSADL | 99.03 | | | | | | | | | |
| NS2A | 1389 | 0.08 | 2 | 1 | 0 | Y | MSGSSADLS | 99.03 | | | | | | | | | |
| NS2A | 1390 | 0.08 | 2 | 1 | 0 | Y | SGSSADLSL | 99.03 | | | | | | | | | |
| NS2A | 1391 | 0.08 | 2 | 1 | 0 | Y | GSSADLSLE | 99.03 | | | | | | | | | |
| NS2A | 1392 | 0.22 | 3 | 2 | 0 | Y | SSADLSLER | 97.09 | SSADLSLER | 1.94 | | | | | | | |
| NS2A | 1393 | 0.22 | 3 | 2 | 0 | Y | SADLSLEKA | 97.09 | SADLSLERA | 1.94 | | | | | | | |
| NS2A | 1394 | 0.14 | 2 | 2 | 0 | Y | ADLSLEKAA | 98.06 | ADLSLERAA | 1.94 | | | | | | | |
| NS2A | 1395 | 0.37 | 3 | 3 | 0 | Y | DLSLEKAAN | 94.17 | DLSLERAAN | 3.88 | | | | | | | |
| NS2A | 1396 | 0.37 | 3 | 3 | 0 | Y | LSLEKAANV | 94.17 | LSLERAANV | 3.88 | | | | | | | |
| NS2A | 1397 | 0.37 | 3 | 3 | 0 | Y | SLEKAANVQ | 94.17 | SLERAANVQ | 3.88 | | | | | | | |
| NS2A | 1398 | 0.37 | 3 | 3 | 0 | Y | LEKAANVQW | 94.17 | LEKAASVQW | 3.88 | LERAANVQW | 1.94 | | | | | |
| NS2A | 1399 | 0.37 | 3 | 3 | 0 | Y | EKAANVQWD | 94.17 | EKAASVQWD | 3.88 | ERAANVQWD | 1.94 | | | | | |
| NS2A | 1400 | 0.37 | 3 | 3 | 0 | Y | KAANVQWDE | 94.17 | KAASVQWDE | 3.88 | RAANVQWDE | 1.94 | | | | | |
| NS2A | 1401 | 0.24 | 2 | 2 | 0 | Y | AANVQWDEM | 96.12 | AASVQWDEM | 3.88 | | | | | | | |
| NS2A | 1402 | 0.24 | 2 | 2 | 0 | Y | ANVQWDEMA | 96.12 | ASVQWDEMA | 3.88 | | | | | | | |
| NS2A | 1403 | 0.32 | 3 | 2 | 0 | Y | NVQWDEMAD | 95.15 | SVQWDEMAD | 3.88 | | | | | | | |
| NS2A | 1404 | 0.08 | 2 | 1 | 0 | Y | VQWDEMADI | 99.03 | | | | | | | | | |
| NS2A | 1405 | 0.08 | 2 | 1 | 0 | Y | QWDEMADIT | 99.03 | | | | | | | | | |

Species: DENV4 (9-mers)

FIG. 15-52

Species: DENV4 (9-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1406 | 0.08 | 2 | — | 0 | Y | WDEMADITG | 99.03 | | | | | | | | |
| NS2A | 1407 | 0.08 | 2 | — | 0 | Y | DEMADITGS | 99.03 | | | | | | | | |
| NS2A | 1408 | 0.08 | 2 | — | 0 | Y | EMADITGSS | 99.03 | | | | | | | | |
| NS2A | 1409 | 0.08 | 2 | — | 0 | Y | MADITGSSP | 99.03 | | | | | | | | |
| NS2A | 1410 | 0.16 | 3 | 2 | 0 | Y | ADITGSSPI | 98.06 | AAITGSSPI | 0.97 | | | | | | |
| NS2A | 1411 | 0.3 | 4 | 3 | 0 | Y | DITGSSPII | 96.12 | DITGSSPIV | 1.94 | | | | | | |
| NS2A | 1412 | 0.22 | 3 | 2 | 0 | Y | ITGSSPIIE | 97.09 | ITGSSPIVE | 1.94 | | | | | | |
| NS2A | 1413 | 0.22 | 3 | 2 | 0 | Y | TGSSPIIEV | 97.09 | TGSSPIVEV | 1.94 | | | | | | |
| NS2A | 1414 | 0.22 | 3 | 2 | 0 | Y | GSSPIIEVK | 97.09 | GSSPIVEVK | 1.94 | | | | | | |
| NS2A | 1415 | 0.22 | 3 | 2 | 0 | Y | SSPIIEVKQ | 97.09 | SSPIVEVKQ | 1.94 | | | | | | |
| NS2A | 1416 | 0.22 | 3 | 2 | 0 | Y | SPIIEVKQD | 97.09 | SPIVEVKQD | 1.94 | AITGSSPII | 0.97 | | | | |
| NS2A | 1417 | 0.3 | 4 | 3 | 0 | Y | PIIEVKQDE | 96.12 | PIVEVKQDE | 1.94 | | | | | | |
| NS2A | 1418 | 0.3 | 4 | 3 | 0 | Y | IIEVKQDED | 96.12 | IEVKQDED | 1.94 | PIIEVKQDD | 0.97 | | | | |
| NS2A | 1419 | 0.22 | 3 | 2 | 0 | Y | IEVKQDEDG | 97.09 | VEVKQDEDG | 1.94 | IIEVKQDDD | 0.97 | | | | |
| NS2A | 1420 | 0.08 | 2 | — | 0 | Y | EVKQDEDGS | 99.03 | | | | | | | | |
| NS2A | 1421 | 0.08 | 2 | — | 0 | Y | VKQDEDGSF | 99.03 | | | | | | | | |
| NS2A | 1422 | 0.08 | 2 | — | 0 | Y | KQDEDGSFS | 99.03 | | | | | | | | |
| NS2A | 1423 | 0.08 | 2 | — | 0.97 | Y | QDEDGSFSI | 98.06 | | | | | | | | |
| NS2A | 1424 | 0.08 | 2 | — | 0.97 | Y | DEDGSFSIR | 98.06 | | | | | | | | |
| NS2A | 1425 | 0.08 | 2 | — | 0.97 | Y | EDGSFSIRD | 98.06 | | | | | | | | |
| NS2A | 1426 | 0.24 | 2 | 2 | 0.97 | Y | DGSFSIRDV | 95.15 | DGSFSIRDI | 3.88 | | | | | | |
| NS2A | 1427 | 0.24 | 2 | 2 | 0.97 | Y | GSFSIRDVE | 95.15 | GSFSIRDIE | 3.88 | | | | | | |
| NS2A | 1428 | 0.24 | 2 | 2 | 0.97 | Y | SFSIRDVEE | 95.15 | SFSIRDIEE | 3.88 | | | | | | |
| NS2A | 1429 | 0.24 | 2 | 2 | 0.97 | Y | FSIRDVEET | 95.15 | FSIRDIEET | 3.88 | | | | | | |
| NS2A | 1430 | 0.24 | 2 | 2 | 0.97 | Y | SIRDVEETN | 95.15 | SIRDIEETN | 3.88 | | | | | | |
| NS2A | 1431 | 0.32 | 3 | 2 | 0.97 | Y | IRDVEETNM | 94.17 | IRDIEETNM | 3.88 | | | | | | |

FIG. 15-53

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency |

FIG.15-54

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1458 | 1.28 | 3 | 3 | 0 | Y | AIPVTMTLW | 63.11 | AIPITMTLW | 25.24 | AIPVTMALW | 11.65 | | |
| NS2A | 1459 | 1.28 | 3 | 3 | 0 | Y | IPVTMTLWY | 63.11 | IPITMTLWY | 25.24 | IPVTMALWY | 11.65 | | |
| NS2A | 1460 | 1.36 | 4 | 4 | 0 | Y | PVTMTLWYM | 63.11 | PITMTLWYM | 25.24 | PVTMALWYI | 9.71 | PVTMALWYM | 1.94 |
| NS2A | 1461 | 1.36 | 4 | 4 | 0 | Y | VTMTLWYMW | 63.11 | ITMTLWYMW | 25.24 | VTMALWYIW | 9.71 | VTMALWYMW | 1.94 |
| NS2A | 1462 | 0.59 | 3 | 3 | 0 | Y | TMTLWYMWQ | 88.35 | TMALWYIWQ | 9.71 | TMALWYMWQ | 1.94 | | |
| NS2A | 1463 | 0.59 | 3 | 3 | 0 | Y | MTLWYMWQV | 88.35 | MALWYIWQV | 9.71 | MALWYMWQV | 1.94 | | |
| NS2A | 1464 | 0.73 | 4 | 4 | 0 | Y | TLWYMWQVK | 86.41 | ALWYIWQVK | 9.71 | TLWYMWQVR | 1.94 | ALWYMWQVK | 1.94 |
| NS2A | 1465 | 0.59 | 3 | 3 | 0 | Y | LWYMWQVKT | 88.35 | LWYIWQVKT | 9.71 | LWYMWQVRT | 1.94 | | |
| NS2A | 1466 | 0.59 | 3 | 3 | 0 | Y | WYMWQVKTQ | 88.35 | WYIWQVKTQ | 9.71 | WYMWQVRTQ | 1.94 | | |
| NS2A | 1467 | 0.59 | 3 | 3 | 0 | Y | YMWQVKTQR | 88.35 | YMWQVKTQR | 9.71 | YMWQVRTQR | 1.94 | | |
| NS2A | 1468 | 0.59 | 3 | 3 | 0 | Y | MWQVKTQRS | 88.35 | IWQVKTQRS | 9.71 | MWQVRTQRS | 1.94 | | |
| NS2A | 1469 | 0.14 | 2 | 2 | 0 | Y | WQVKTQRSG | 98.06 | WQVRTQRSG | 1.94 | | | | |
| NS2A | 1470 | 0.14 | 2 | 2 | 0 | Y | QVKTQRSGA | 98.06 | QVRTQRSGA | 1.94 | | | | |
| NS2A | 1471 | 0.14 | 2 | 2 | 0 | Y | VKTQRSGAL | 98.06 | VRTQRSGAL | 1.94 | | | | |
| NS2A | 1472 | 0.14 | 2 | 2 | 0 | Y | KTQRSGALW | 98.06 | RTQRSGALW | 1.94 | | | | |
| NS2A | 1473 | 0 | 1 | 1 | 0 | Y | TQRSGALWD | 100 | | | | | | |
| NS2A | 1474 | 0 | 1 | 1 | 0 | Y | QRSGALWDV | 100 | | | | | | |
| NS2A | 1475 | 0 | 1 | 1 | 0 | Y | RSGALWDVP | 100 | | | | | | |
| NS2A | 1476 | 0 | 1 | 1 | 0 | Y | SGALWDVPS | 100 | | | | | | |
| NS2A | 1477 | 0 | 1 | 1 | 0 | Y | GALWDVPSP | 100 | | | | | | |
| NS3 | 1478 | 0 | 1 | 1 | 0 | Y | ALWDVPSPA | 100 | | | | | | |
| NS3 | 1479 | 0.24 | 2 | 2 | 0 | Y | LWDVPSPAA | 96.12 | LWDVPSPAT | 3.88 | | | | |
| NS3 | 1480 | 0.59 | 4 | 3 | 0 | Y | WDVPSPAAT | 90.29 | WDVPSPAAA | 5.83 | WDVPSPATA | 2.91 | | |
| NS3 | 1481 | 1.06 | 5 | 4 | 0 | Y | DVPSPAATQ | 79.61 | DVPSPAATK | 10.68 | DVPSPAAAQ | 5.83 | DVPSPATAQ | 2.91 |
| NS3 | 1482 | 1.06 | 5 | 4 | 0 | Y | VPSPAATQK | 79.61 | VPSPAATKK | 10.68 | VPSPAAAQK | 5.83 | VPSPATAQK | 2.91 |
| NS3 | 1483 | 1.06 | 5 | 4 | 0 | Y | PSPAATQKA | 79.61 | PSPAATKKA | 10.68 | PSPAAAQKA | 5.83 | PSPATAQKA | 2.91 |

FIG. 15-55

Species: DENV4 (9-mers)

| protein | block starting position | block entropy | total peptides in block | peptides required to cover 99% of block | gap/X fraction | covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1488 | 1.37 | 5 | 4 | 0 | Y | TQKAALSEG | 70.87 | TIKKAALSEG | 10.68 | TQKATLSEG | 9.71 | | |
| NS3 | 1489 | 1.37 | 5 | 4 | 0 | Y | QKAALSEGV | 70.87 | KKAALSEGV | 10.68 | QKATLSEGV | 9.71 | AQKATLTEG | 7.77 |
| NS3 | 1490 | 0.92 | 4 | 3 | 0 | Y | KAALSEGVY | 81.55 | KATLSEGVY | 9.71 | KATLTEGVY | 7.77 | QKATLTEGV | 7.77 |
| NS3 | 1491 | 0.92 | 4 | 3 | 0 | Y | AALSEGVYR | 81.55 | ATLSEGVYR | 9.71 | ATLTEGVYR | 7.77 | | |
| NS3 | 1492 | 0.92 | 4 | 3 | 0 | Y | ALSEGVYRI | 81.55 | TLSEGVYRI | 9.71 | TLTEGVYRI | 7.77 | | |
| NS3 | 1493 | 0.43 | 2 | 2 | 0 | Y | LSEGVYRIM | 91.26 | LTEGVYRIM | 8.74 | | | | |
| NS3 | 1494 | 0.43 | 2 | 2 | 0 | Y | SEGVYRIMQ | 91.26 | TEGVYRIMQ | 8.74 | | | | |
| NS3 | 1495 | 0 | 1 | 1 | 0 | Y | EGVYRIMQR | 100 | | | | | | |
| NS3 | 1496 | 0 | 1 | 1 | 0 | Y | GVYRIMQRG | 100 | | | | | | |
| NS3 | 1497 | 0 | 1 | 1 | 0 | Y | VYRIMQRGL | 100 | | | | | | |
| NS3 | 1498 | 0.32 | 2 | 2 | 0 | Y | YRIMQRGLF | 94.17 | YRIMQRGLL | 5.83 | | | | |
| NS3 | 1499 | 0.32 | 2 | 2 | 0 | Y | RIMQRGLFG | 94.17 | RIMQRGLLG | 5.83 | | | | |
| NS3 | 1500 | 0.36 | 3 | 2 | 0 | Y | IMQRGLFGK | 94.17 | IMQRGLLGK | 4.85 | | | | |
| NS3 | 1501 | 0.36 | 3 | 2 | 0 | Y | MQRGLFGKT | 94.17 | MQRGLLGKT | 4.85 | | | | |
| NS3 | 1502 | 0.36 | 3 | 2 | 0 | Y | QRGLFGKTQ | 94.17 | QRGLLGKTQ | 4.85 | | | | |
| NS3 | 1503 | 0.36 | 3 | 2 | 0 | Y | RGLFGKTQV | 94.17 | RGLLGKTQV | 4.85 | | | | |
| NS3 | 1504 | 0.36 | 3 | 2 | 0 | Y | GLFGKTQVG | 94.17 | GLLGKTQVG | 4.85 | | | | |
| NS3 | 1505 | 0.36 | 3 | 2 | 0 | Y | LFGKTQVGV | 94.17 | LLGKTQVGV | 4.85 | | | | |
| NS3 | 1506 | 0.16 | 3 | 2 | 0 | Y | FGKTQVGVG | 94.17 | LGKTQVGVG | 4.85 | | | | |
| NS3 | 1507 | 0.16 | 3 | 2 | 0 | Y | GKTQVGVGI | 98.06 | GRTQVGVGI | 0.97 | | | | |
| NS3 | 1508 | 0.39 | 4 | 3 | 0 | Y | KTQVGVGIH | 98.06 | RTQVGVGIH | 0.97 | | | | |
| NS3 | 1509 | 0.39 | 4 | 3 | 0 | Y | TQVGVGIHM | 94.17 | TQVGVGIHT | 3.88 | TQVGVGIHT | 0.97 | | |
| NS3 | 1510 | 0.39 | 4 | 3 | 0 | Y | QVGVGIHME | 94.17 | QVGVGIHIE | 3.88 | QVGVGIHVE | 0.97 | | |
| NS3 | 1511 | 0.39 | 4 | 3 | 0 | Y | VGVGIHMEG | 94.17 | VGVGIHIEG | 3.88 | VGVGIHTEG | 0.97 | | |
| NS3 | 1512 | 0.39 | 4 | 3 | 0 | Y | GVGIHMEGV | 94.17 | GVGIHIEGV | 3.88 | GVGIHTEGV | 0.97 | | |
| NS3 | 1513 | 0.39 | 4 | 3 | 0 | Y | VGIHMEGVF | 94.17 | VGIHIEGVF | 3.88 | VGIHVEGVF | 0.97 | | |

FIG. 15-56

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1514 | 0.39 | 4 | 3 | 0 | Y | GIHMEGVFH | 94.17 | GIHIEGVFH | 3.88 | GVHVEGVFH | 0.97 |
| NS3 | 1515 | 0.39 | 4 | 3 | 0 | Y | IHMEGVFHT | 94.17 | IHIEGVFHT | 3.88 | VHVEGVFHT | 0.97 |
| NS3 | 1516 | 0.39 | 4 | 3 | 0 | Y | HMEGVFHTM | 94.17 | HIEGVFHTM | 3.88 | HVEGVFHTM | 0.97 |
| NS3 | 1517 | 0.39 | 4 | 3 | 0 | Y | MEGVFHTMW | 94.17 | IEGVFHTMW | 3.88 | VEGVFHTMW | 0.97 |
| NS3 | 1518 | 0 | 1 | 1 | 0 | Y | EGVFHTMWH | 100 | | | | |
| NS3 | 1519 | 0 | 1 | 1 | 0 | Y | GVFHTMWHV | 100 | | | | |
| NS3 | 1520 | 0 | 1 | 1 | 0 | Y | VFHTMWHYT | 100 | | | | |
| NS3 | 1521 | 0 | 1 | 1 | 0 | Y | FHTMWHYTR | 100 | | | | |
| NS3 | 1522 | 0 | 1 | 1 | 0 | Y | HTMWHVTRG | 100 | | | | |
| NS3 | 1523 | 0 | 1 | 1 | 0 | Y | TMWHVTRGS | 100 | | | | |
| NS3 | 1524 | 0 | 1 | 1 | 0 | Y | MWHVTRGSY | 100 | | | | |
| NS3 | 1525 | 0 | 1 | 1 | 0 | Y | WHVTRGSVI | 100 | | | | |
| NS3 | 1526 | 0 | 1 | 1 | 0 | Y | HVTRGSVIC | 100 | | | | |
| NS3 | 1527 | 0 | 1 | 1 | 0 | Y | VTRGSVICH | 100 | | | | |
| NS3 | 1528 | 0 | 1 | 1 | 0 | Y | TRGSVICHE | 100 | | | | |
| NS3 | 1529 | 0.19 | 2 | 2 | 0 | Y | RGSVICHET | 97.09 | RGSVICHES | 2.91 | | |
| NS3 | 1530 | 0.19 | 2 | 2 | 0 | Y | GSVICHETG | 97.09 | GSVICHESG | 2.91 | | |
| NS3 | 1531 | 0.19 | 2 | 2 | 0 | Y | SVICHETGR | 97.09 | SVICHESGR | 2.91 | | |
| NS3 | 1532 | 0.19 | 2 | 2 | 0 | Y | VICHETGRL | 97.09 | VICHESGRL | 2.91 | | |
| NS3 | 1533 | 0.19 | 2 | 2 | 0 | Y | ICHETGRLE | 97.09 | ICHESGRLE | 2.91 | | |
| NS3 | 1534 | 0.19 | 2 | 2 | 0 | Y | CHETGRLEP | 97.09 | CHESGRLEP | 2.91 | | |
| NS3 | 1535 | 0.19 | 2 | 2 | 0 | Y | HETGRLEPS | 97.09 | HESGRLEPS | 2.91 | | |
| NS3 | 1536 | 0.19 | 2 | 2 | 0 | Y | ETGRLEPSW | 97.09 | ESGRLEPSW | 2.91 | | |
| NS3 | 1537 | 0.19 | 2 | 2 | 0 | Y | TGRLEPSWA | 97.09 | SGRLEPSWA | 2.91 | | |
| NS3 | 1538 | 0 | 1 | 1 | 0 | Y | GRLEPSWAD | 100 | | | | |
| NS3 | 1539 | 0 | 1 | 1 | 0 | Y | RLEPSWADV | 100 | | | | |

FIG. 15-57

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to

FIG. 15-58

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1566 | 0.24 | 2 | 2 | 0 | Y | KEEDVQVLA | 96.12 | REEDVQVLA | 3.88 | | | | |
| NS3 | 1567 | 0.19 | 2 | 2 | 0 | Y | EEDVQVLAI | 97.09 | EEDVQVLAV | 2.91 | | | | |
| NS3 | 1568 | 0.19 | 2 | 2 | 0 | Y | EDVQVLAIE | 97.09 | EDVQVLAVE | 2.91 | | | | |
| NS3 | 1569 | 0.19 | 2 | 2 | 0 | Y | DVQVLAIEP | 97.09 | DVQVLAVEP | 2.91 | | | | |
| NS3 | 1570 | 0.19 | 2 | 2 | 0 | Y | VQVLAIEPG | 97.09 | VQVLAVEPG | 2.91 | | | | |
| NS3 | 1571 | 0.19 | 2 | 2 | 0 | Y | QVLAIEPGK | 97.09 | QVLAVEPGK | 2.91 | | | | |
| NS3 | 1572 | 0.19 | 2 | 2 | 0 | Y | VLAIEPGKN | 97.09 | VLAVEPGKN | 2.91 | | | | |
| NS3 | 1573 | 0.19 | 2 | 2 | 0 | Y | LAIEPGKNP | 97.09 | LAVEPGKNP | 2.91 | | | | |
| NS3 | 1574 | 0.19 | 2 | 2 | 0 | Y | AIEPGKNPK | 97.09 | AVEPGKNPK | 2.91 | | | | |
| NS3 | 1575 | 0.19 | 2 | 2 | 0 | Y | IEPGKNPKH | 97.09 | VEPGKNPKH | 2.91 | | | | |
| NS3 | 1576 | 0 | 1 | 1 | 0 | Y | EPGKNPKHV | 100 | | | | | | |
| NS3 | 1577 | 0 | 1 | 1 | 0 | Y | PGKNPKHVQ | 100 | | | | | | |
| NS3 | 1578 | 0 | 1 | 1 | 0 | Y | GKNPKHVQT | 100 | | | | | | |
| NS3 | 1579 | 0 | 1 | 1 | 0 | Y | KNPKHVQTK | 100 | | | | | | |
| NS3 | 1580 | 0 | 1 | 1 | 0 | Y | NPKHVQTKP | 100 | | | | | | |
| NS3 | 1581 | 0 | 1 | 1 | 0 | Y | PKHVQTKPG | 100 | | | | | | |
| NS3 | 1582 | 0 | 1 | 1 | 0 | Y | KHVQTKPGL | 100 | | | | | | |
| NS3 | 1583 | 0 | 1 | 1 | 0 | Y | HVQTKPGLF | 100 | | | | | | |
| NS3 | 1584 | 0 | 1 | 1 | 0 | Y | VQTKPGLFK | 100 | | | | | | |
| NS3 | 1585 | 0 | 1 | 1 | 0 | Y | QTKPGLFKT | 100 | | | | | | |
| NS3 | 1586 | 0.14 | 2 | 2 | 0 | Y | TKPGLFKTL | 98.06 | TKPGLFKTI | 1.94 | | | | |
| NS3 | 1587 | 0.22 | 3 | 2 | 0 | Y | KPGLFKTLT | 97.09 | KPGLFKTIT | 1.94 | | | | |
| NS3 | 1588 | 0.22 | 3 | 2 | 0 | Y | PGLFKTLTG | 97.09 | PGLFKTITG | 1.94 | | | | |
| NS3 | 1589 | 0.22 | 3 | 2 | 0 | Y | GLFKTLTGE | 97.09 | GLFKTITGE | 1.94 | | | | |
| NS3 | 1590 | 0.22 | 3 | 2 | 0 | Y | LFKTLTGEI | 97.09 | LFKTITGEI | 1.94 | | | | |
| NS3 | 1591 | 0.22 | 3 | 2 | 0 | Y | FKTLTGEIG | 97.09 | FKTITGEIG | 1.94 | | | | |

FIG. 15-59

Species: DENV4 (9-mers)

| protein | block starting position | DENV4 block entropy | total peptides in block | peptides required to cover 99% of block | gap/X fraction | 99% of block covered w/ <= 5 peptides? | block peptides required to cover 99% of | frequency | block peptides required to cover 99% of | frequency | block peptides required to cover 99% of | frequency | block peptides required to cover 99% of | frequency |
|---|---|---|---|---|---|---|---|---|---|---|---|---|---|---|
| NS3 | 1592 | 0.22 | 3 | 2 | 0 | Y | KTLTGEIGA | 97.09 | | | KTLTGEIGA | 1.94 | | |
| NS3 | 1593 | 0.22 | 3 | 2 | 0 | Y | TLTGEIGAV

FIG.15-60

Species: DENV4 (9-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency |

FIG. 15-61

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 15-62

Species: DENV4 (9-mers)

| protein | block starting position | block entropy | total peptides in block | peptides required to cover 99% of block | g

FIG. 15-64

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block |

FIG. 15-65

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | fr

FIG. 15-66

Species: DENV4 (9-mers)

| protein

FIG. 15-67

Species: DENV4 (9-mers)

| protein | block starting position | block entropy | total

FIG. 15-68

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG. 15-69

Species: DENV4 (9-mers)

| protein | block starting position | block entropy | total peptides in block | peptides required to cover 99% of block | gap/X fraction | 99% of block covered w/ <= 5 peptides? | block | frequency | peptides required to cover 99% of block | block | frequency |
|---|---|---|---|---|---|---|---|---|---|---|---|
| NS3 | 1852 | 0.54 | 3 | 2 | 0 | Y | KSGKKVIQL | 89.32 | KSGKRVIQL | 9.71 |
| NS3 | 1853 | 0.54 | 3 | 2 | 0 | Y | SGKKVIQLS | 89.32 | SGKRVIQLS | 9.71 |
| NS3 | 1854 | 0.54 | 3 | 2 | 0 | Y | GKKVIQLSR | 89.32 | GKRVIQLSR | 9.71 |
| NS3 | 1855 | 0.54 | 3 | 2 | 0 | Y | KKVIQLSRK | 89.32 | KRVIQLSRK | 9.71 |
| NS3 | 1856 | 0.54 | 3 | 2 | 0 | Y | KVIQLSRKT | 89.32 | RVIQLSRKT | 9.71 |
| NS3 | 1857 | 0.08 | 2 | 1 | 0 | Y | VIQLSRKTF | 99.03 | | |
| NS3 | 1858 | 0.08 | 2 | 1 | 0 | Y | IQLSRKTFD | 99.03 | | |
| NS3 | 1859 | 0 | 1 | 1 | 0 | Y | QLSRKTFDT | 100 | | |
| NS3 | 1860 | 0 | 1 | 1 | 0 | Y | LSRKTFDTE | 100 | | |
| NS3 | 1861 | 0 | 1 | 1 | 0 | Y | SRKTFDTEY | 100 | | |
| NS3 | 1862 | 0 | 1 | 1 | 0 | Y | RKTFDTEYP | 100 | | |
| NS3 | 1863 | 0 | 1 | 1 | 0 | Y | KTFDTEYPK | 100 | | |
| NS3 | 1864 | 0 | 1 | 1 | 0 | Y | TFDTEYPKT | 100 | | |
| NS3 | 1865 | 0 | 1 | 1 | 0 | Y | FDTEYPKTK | 100 | | |
| NS3 | 1866 | 0 | 1 | 1 | 0 | Y | DTEYPKTKL | 100 | | |
| NS3 | 1867 | 0 | 1 | 1 | 0 | Y | TEYPKTKLT | 100 | | |
| NS3 | 1868 | 0 | 1 | 1 | 0 | Y | EYPKTKLTD | 100 | | |
| NS3 | 1869 | 0 | 1 | 1 | 0 | Y | YPKTKLTDW | 100 | | |
| NS3 | 1870 | 0 | 1 | 1 | 0 | Y | PKTKLTDWD | 100 | | |
| NS3 | 1871 | 0 | 1 | 1 | 0 | Y | KTKLTDWDF | 100 | | |
| NS3 | 1872 | 0 | 1 | 1 | 0 | Y | TKLTDWDFV | 100 | | |
| NS3 | 1873 | 0 | 1 | 1 | 0 | Y | KLTDWDFVV | 100 | | |
| NS3 | 1874 | 0 | 1 | 1 | 0 | Y | LTDWDFVVT | 100 | | |
| NS3 | 1875 | 0 | 1 | 1 | 0 | Y | TDWDFVVTT | 100 | | |
| NS3 | 1876 | 0 | 1 | 1 | 0 | Y | DWDFVVTTD | 100 | | |
| NS3 | 1877 | 0 | 1 | 1 | 0 | Y | WDFVVTTDI | 100 | | |

FIG. 15-70

Species: DENV4 (9-mers)

| protein | block starting position | block entropy | total peptides in block | peptides required to cover 99% of block | gap/X fraction | 99% of block covered w/ <= 5 peptides? | block | frequency | peptides required to cover 99% of block |

FIG. 15-71

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1904 | 0.63 | 3 | 3 | 0 | Y | LKPVILTDG | 87.38 | LKPVILPDG | 10.68 | LKPVISTDG | 1.94 | | |
| NS3 | 1905 | 0.7 | 4 | 3 | 0 | Y | KPVILTDGP | 86.41 | KPVILPDGP | 10.68 | KPVISTDGP | 1.94 | | |
| NS3 | 1906 | 0.7 | 4 | 3 | 0 | Y | PVILTDGPE | 86.41 | PVILPDGPE | 10.68 | PVISTDGPE | 1.94 | | |
| NS3 | 1907 | 0.7 | 4 | 3 | 0 | Y | VILTDGPER | 86.41 | VILPDGPER | 10.68 | VISTDGPER | 1.94 | | |
| NS3 | 1908 | 0.7 | 4 | 3 | 0 | Y | ILTDGPERV | 86.41 | ILPDGPERV | 10.68 | ISTDGPERV | 1.94 | | |
| NS3 | 1909 | 0.7 | 4 | 3 | 0 | Y | LTDGPERVI | 86.41 | LPDGPERVI | 10.68 | STDGPERVI | 1.94 | | |
| NS3 | 1910 | 0.57 | 3 | 3 | 0 | Y | TDGPERVIL | 88.35 | PDGPERVIL | 10.68 | | | | |
| NS3 | 1911 | 0.08 | 2 | 2 | 0 | Y | DGPERVILA | 99.03 | | | | | | |
| NS3 | 1912 | 0.08 | 2 | 2 | 0 | Y | GPERVILAG | 99.03 | | | | | | |
| NS3 | 1913 | 0.08 | 2 | 2 | 0 | Y | PERVILAGP | 99.03 | | | | | | |
| NS3 | 1914 | 0 | 1 | 1 | 0 | Y | ERVILAGPI | 100 | | | | | | |
| NS3 | 1915 | 0 | 1 | 1 | 0 | Y | RVILAGPIP | 100 | | | | | | |
| NS3 | 1916 | 0 | 1 | 1 | 0 | Y | VILAGPIPV | 100 | | | | | | |
| NS3 | 1917 | 0 | 1 | 1 | 0 | Y | ILAGPIPVT | 100 | | | | | | |
| NS3 | 1918 | 0 | 1 | 1 | 0 | Y | LAGPIPVTP | 100 | | | | | | |
| NS3 | 1919 | 0 | 1 | 1 | 0 | Y | AGPIPVTPA | 100 | | | | | | |
| NS3 | 1920 | 0 | 1 | 1 | 0 | Y | GPIPVTPAS | 100 | | | | | | |
| NS3 | 1921 | 0 | 1 | 1 | 0 | Y | PIPVTPASA | 100 | | | | | | |
| NS3 | 1922 | 0 | 1 | 1 | 0 | Y | IPVTPASAA | 100 | | | | | | |
| NS3 | 1923 | 0 | 1 | 1 | 0 | Y | PVTPASAAQ | 100 | | | | | | |
| NS3 | 1924 | 0 | 1 | 1 | 0 | Y | VTPASAAQR | 100 | | | | | | |
| NS3 | 1925 | 0 | 1 | 1 | 0 | Y | TPASAAQRR | 100 | | | | | | |
| NS3 | 1926 | 0 | 1 | 1 | 0 | Y | PASAAQRRG | 100 | | | | | | |
| NS3 | 1927 | 0 | 1 | 1 | 0 | Y | ASAAQRRGR | 100 | | | | | | |
| NS3 | 1928 | 0 | 1 | 1 | 0 | Y | SAAQRRGRI | 100 | | | | | | |
| NS3 | 1929 | 0 | 1 | 1 | 0 | Y | AAQRRGRIG | 100 | | | | | | |

FIG. 15-72

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99

FIG. 15-73

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---

FIG. 15-74

Species: DENW4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1982 | 0 | 1 | 1 | 0 | Y | TLFGPEREK | 100 | | | | | | |
| NS3 | 1983 | 0.22 | 3 | 2 | 0 | Y | LFGPEREKIT | 97.09 | LFGPEREKN | 1.94 | | | | |
| NS3 | 1984 | 0.22 | 3 | 2 | 0 | Y | FGPEREKTQ | 97.09 | FGPEREKNQ | 1.94 | | | | |
| NS3 | 1985 | 0.22 | 3 | 2 | 0 | Y | GPEREKTQA | 97.09 | GPEREKNQA | 1.94 | | | | |
| NS3 | 1986 | 0.22 | 3 | 2 | 0 | Y | PEREKTQAI | 97.09 | PEREKNQAI | 1.94 | | | | |
| NS3 | 1987 | 0.22 | 3 | 2 | 0 | Y | EREKTQAID | 97.09 | EREKNQAID | 1.94 | | | | |
| NS3 | 1988 | 0.22 | 3 | 2 | 0 | Y | REKTQAIDG | 97.09 | REKNQAIDG | 1.94 | | | | |
| NS3 | 1989 | 0.22 | 3 | 2 | 0 | Y | EKTQAIDGE | 97.09 | EKNQAIDGE | 1.94 | | | | |
| NS3 | 1990 | 0.22 | 3 | 2 | 0 | Y | KTQAIDGEF | 97.09 | KNQAIDGEF | 1.94 | | | | |
| NS3 | 1991 | 0.22 | 3 | 2 | 0 | Y | TQAIDGEFR | 97.09 | NQAIDGEFR | 1.94 | | | | |
| NS3 | 1992 | 0 | 1 | 1 | 0 | Y | QAIDGEFRL | 100 | | | | | | |
| NS3 | 1993 | 0 | 1 | 1 | 0 | Y | AIDGEFRLR | 100 | | | | | | |
| NS3 | 1994 | 0 | 1 | 1 | 0 | Y | IDGEFRLRG | 100 | | | | | | |
| NS3 | 1995 | 0 | 1 | 1 | 0 | Y | DGEFRLRGE | 100 | | | | | | |
| NS3 | 1996 | 0 | 1 | 1 | 0 | Y | GEFRLRGEQ | 100 | | | | | | |
| NS3 | 1997 | 0 | 1 | 1 | 0 | Y | EFRLRGEQR | 100 | | | | | | |
| NS3 | 1998 | 0 | 1 | 1 | 0 | Y | FRLRGEQRK | 100 | | | | | | |
| NS3 | 1999 | 0 | 1 | 1 | 0 | Y | RLRGEQRKT | 100 | | | | | | |
| NS3 | 2000 | 0 | 1 | 1 | 0 | Y | LRGEQRKTF | 100 | | | | | | |
| NS3 | 2001 | 0 | 1 | 1 | 0 | Y | RGEQRKTFV | 100 | | | | | | |
| NS3 | 2002 | 0 | 1 | 1 | 0 | Y | GEQRKTFVE | 100 | | | | | | |
| NS3 | 2003 | 0 | 1 | 1 | 0 | Y | EQRKTFVEL | 100 | | | | | | |
| NS3 | 2004 | 0 | 1 | 1 | 0 | Y | QRKTFVELM | 100 | | | | | | |
| NS3 | 2005 | 0.14 | 2 | 2 | 0 | Y | RKTFVELMR | 98.06 | RKTFVELMK | 1.94 | | | | |
| NS3 | 2006 | 0.14 | 2 | 2 | 0 | Y | KTFVELMRR | 98.06 | KTFVELMKR | 1.94 | | | | |
| NS3 | 2007 | 0.14 | 2 | 2 | 0 | Y | TFVELMRRG | 98.06 | TFVELMKRG | 1.94 | | | | |

FIG. 15-75

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 15-76

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequ

FIG. 15-77

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2060 | 0 | 1 | — | 0 | Y | EGEKKKLRP | 100 | | | | | | |
| NS3 | 2061 | 0.99 | 2 | 2 | 0 | Y | GEKKKLRPR | 54.37 | GEKKKLRPK | 45.63 | | | | |
| NS3 | 2062 | 0.99 | 2 | 2 | 0 | Y | EKKKLRPRW | 54.37 | EKKKLRPKW | 45.63 | | | | |
| NS3 | 2063 | 0.99 | 2 | 2 | 0 | Y | KKKLRPRWL | 54.37 | KKKLRPKWL | 45.63 | | | | |
| NS3 | 2064 | 0.99 | 2 | 2 | 0 | Y | KKLRPRWLD | 54.37 | KKLRPKWLD | 45.63 | | | | |
| NS3 | 2065 | 0.99 | 2 | 2 | 0 | Y | KLRPRWLDA | 54.37 | KLRPKWLDA | 45.63 | | | | |
| NS3 | 2066 | 0.99 | 2 | 2 | 0 | Y | LRPRWLDAR | 54.37 | LRPKWLDAR | 45.63 | | | | |
| NS3 | 2067 | 0.99 | 2 | 2 | 0 | Y | RPRWLDARV | 54.37 | RPKWLDARV | 45.63 | | | | |
| NS3 | 2068 | 0.99 | 2 | 2 | 0 | Y | PRWLDARVY | 54.37 | PKWLDARVY | 45.63 | | | | |
| NS3 | 2069 | 0.99 | 2 | 2 | 0 | Y | RWLDARVYA | 54.37 | KWLDARVYA | 45.63 | | | | |
| NS3 | 2070 | 0 | 1 | — | 0 | Y | WLDARVYAD | 100 | | | | | | |
| NS3 | 2071 | 0 | 1 | — | 0 | Y | LDARVYADP | 100 | | | | | | |
| NS3 | 2072 | 0 | 1 | — | 0 | Y | DARVYADPM | 100 | | | | | | |
| NS3 | 2073 | 0 | 1 | — | 0 | Y | ARVYADPMA | 100 | | | | | | |
| NS3 | 2074 | 0 | 1 | — | 0 | Y | RVYADPMAL | 100 | | | | | | |
| NS3 | 2075 | 0.08 | 2 | 1 | 0 | Y | VYADPMALK | 99.03 | | | | | | |
| NS3 | 2076 | 0.08 | 2 | 1 | 0 | Y | YADPMALKD | 99.03 | | | | | | |
| NS3 | 2077 | 0.08 | 2 | 1 | 0 | Y | ADPMALKDF | 99.03 | | | | | | |
| NS3 | 2078 | 0.08 | 2 | 1 | 0 | Y | DPMALKDFK | 99.03 | | | | | | |
| NS3 | 2079 | 0.08 | 2 | 1 | 0 | Y | PMALKDFKE | 99.03 | | | | | | |
| NS3 | 2080 | 0.08 | 2 | 1 | 0 | Y | MALKDFKEF | 99.03 | | | | | | |
| NS3 | 2081 | 0.08 | 2 | 1 | 0 | Y | ALKDFKEFA | 99.03 | | | | | | |
| NS3 | 2082 | 0.08 | 2 | 1 | 0 | Y | LKDFKEFAS | 99.03 | | | | | | |
| NS3 | 2083 | 0.08 | 2 | 1 | 0 | Y | KDFKEFASG | 99.03 | | | | | | |
| NS3 | 2084 | 0 | 1 | — | 0 | Y | DFKEFASGR | 100 | | | | | | |
| NS3 | 2085 | 0 | 1 | — | 0 | Y | FKEFASGRK | 100 | | | | | | |

FIG. 15-78

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 2086 | 0 | 1 | — | 0 | Y | KEFASGRKS | 100 | | | | | | | | |
| NS3 | 2087 | 0.08 | 2 | 1 | 0 | Y | EFASGRKSI | 99.03 | | | | | | | | |
| NS3 | 2088 | 0.08 | 2 | 1 | 0 | Y | FASGRKSIT | 99.03 | | | | | | | | |
| NS3 | 2089 | 0.08 | 2 | 1 | 0 | Y | ASGRKSITL | 99.03 | | | | | | | | |
| NS3 | 2090 | 0.08 | 2 | 1 | 0 | Y | SGRKSITLD | 99.03 | | | | | | | | |
| NS3 | 2091 | 0.08 | 2 | 1 | 0 | Y | GRKSITLDI | 99.03 | | | | | | | | |
| NS3 | 2092 | 0.08 | 2 | 1 | 0 | Y | RKSITLDIL | 99.03 | | | | | | | | |
| NS3 | 2093 | 0.08 | 2 | 1 | 0 | Y | KSITLDILT | 99.03 | | | | | | | | |
| NS3 | 2094 | 0.08 | 2 | 1 | 0 | Y | SITLDILTE | 99.03 | | | | | | | | |
| NS3 | 2095 | 0.08 | 2 | 1 | 0 | Y | ITLDILTEI | 99.03 | | | | | | | | |
| NS3 | 2096 | 0 | 1 | — | 0 | Y | TLDILTEIA | 100 | | | | | | | | |
| NS4A | 2097 | 0.43 | 2 | 2 | 0 | Y | LDILTEIAS | 91.26 | LDILTEIAT | 8.74 | | | | | | |
| NS4A | 2098 | 0.43 | 2 | 2 | 0 | Y | DILTEIASL | 91.26 | DILTEIATL | 8.74 | | | | | | |
| NS4A | 2099 | 0.43 | 2 | 2 | 0 | Y | ILTEIASLP | 91.26 | ILTEIATLP | 8.74 | | | | | | |
| NS4A | 2100 | 0.57 | 4 | 3 | 0 | Y | LTEIASLPT | 90.29 | LTEIATLPT | 6.8 | LTEIATLPA | 1.94 | | | | |
| NS4A | 2101 | 0.57 | 4 | 3 | 0 | Y | TEIASLPTY | 90.29 | TEIATLPTY | 6.8 | TEIATLPAY | 1.94 | | | | |
| NS4A | 2102 | 0.57 | 4 | 3 | 0 | Y | EIASLPTYL | 90.29 | EIATLPTYL | 6.8 | EIATLPAYL | 1.94 | | | | |
| NS4A | 2103 | 0.57 | 4 | 3 | 0 | Y | IASLPTYLS | 90.29 | IATLPTYLS | 6.8 | IATLPAYLS | 1.94 | | | | |
| NS4A | 2104 | 0.57 | 4 | 3 | 0 | Y | ASLPTYLSS | 90.29 | ATLPTYLSS | 6.8 | ATLPAYLSS | 1.94 | | | | |
| NS4A | 2105 | 0.65 | 5 | 4 | 0 | Y | SLPTYLSSR | 89.32 | TLPTYLSSK | 6.8 | TLPAYLSSK | 1.94 | | | | |
| NS4A | 2106 | 0.61 | 4 | 3 | 0 | Y | LPTYLSSRA | 89.32 | LPTYLSSKA | 7.77 | LPAYLSSKA | 1.94 | | | | |
| NS4A | 2107 | 0.61 | 4 | 3 | 0 | Y | PTYLSSRAK | 89.32 | PTYLSSKAK | 7.77 | PAYLSSKAK | 1.94 | | | | |
| NS4A | 2108 | 0.61 | 4 | 3 | 0 | Y | TYLSSRAKL | 89.32 | TYLSSKAKL | 7.77 | AYLSSKAKL | 1.94 | | | | |
| NS4A | 2109 | 0.46 | 2 | 2 | 0 | Y | YLSSRAKLA | 90.29 | YLSSKAKLA | 9.71 | | | SLPTYLSSK | 0.97 | | |
| NS4A | 2110 | 0.46 | 2 | 2 | 0 | Y | LSSRAKLAL | 90.29 | LSSKAKLAL | 9.71 | | | | | | |
| NS4A | 2111 | 0.46 | 2 | 2 | 0 | Y | SSRAKLALD | 90.29 | SSKAKLALD | 9.71 | | | | | | |

FIG. 15-79

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS4A | 2112 | 0.46 | 2 | 2 | 0 | Y | SRAKLALDN | 90.29 | SKAKLALDN | 9.71 | | | | |
| NS4A | 2113 | 0.46 | 2 | 2 | 0 | Y | RAKLALDNI | 90.29 | KAKLALDNI | 9.71 | | | | |
| NS4A | 2114 | 0 | 1 | 1 | 0 | Y | AKLALDNIV | 100 | |

FIG. 15-80

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG.15-81

Species: DENV4 (9-mers)

| protein | block starting position | block entropy | total peptides in block | peptides required to cover 99% of block | gap/X fraction | 99% of block covered w/ <= 5 peptides? |

FIG. 15-82

Species: DENV4 (9-mers)

| protein | block starting position | block entropy | total peptides in block | peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2190 | 0.42 | 3 | 3 | 0 | Y | VAEIQPQWI | 93.2 | VAELQPQWI | 4.85 | VAELQPQWI | 1.94 | | |
| NS4A | 2191 | 0.14 | 2 | 2 | 0 | Y | AEIQPQWIA | 98.06 | AELQPQWIA | 1.94 | | | | |
| NS4A | 2192 | 0.14 | 2 | 2 | 0 | Y | EIQPQWIAA | 98.06 | ELQPQWIAA | 1.94 | | | | |
| NS4A | 2193 | 0.14 | 2 | 2 | 0 | Y | IQPQWIAAS | 98.06 | LQPQWIAAS | 1.94 | | | | |
| NS4A | 2194 | 0 | 1 | 1 | 0 | Y | QPQWIAASI | 100 | | | | | | |
| NS4A | 2195 | 0 | 1 | 1 | 0 | Y | PQWIAASII | 100 | | | | | | |
| NS4A | 2196 | 0 | 1 | 1 | 0 | Y | QWIAASIIL | 100 | | | | | | |
| NS4A | 2197 | 0 | 1 | 1 | 0 | Y | WIAASIILE | 100 | | | | | | |
| NS4A | 2198 | 0 | 1 | 1 | 0 | Y | IAASIILEF | 100 | | | | | | |
| NS4A | 2199 | 0 | 1 | 1 | 0 | Y | AASIILEFF | 100 | | | | | | |
| NS4A | 2200 | 0 | 1 | 1 | 0 | Y | ASIILEFFL | 100 | | | | | | |
| NS4A | 2201 | 0 | 1 | 1 | 0 | Y | SIILEFFLM | 100 | | | | | | |
| NS4A | 2202 | 0 | 1 | 1 | 0 | Y | IILEFFLMV | 100 | | | | | | |
| NS4A | 2203 | 0 | 1 | 1 | 0 | Y | ILEFFLMVL | 100 | | | | | | |
| NS4A | 2204 | 0 | 1 | 1 | 0 | Y | LEFFLMVLL | 100 | | | | | | |
| NS4A | 2205 | 0.19 | 2 | 2 | 0 | Y | EFFLMVLLI | 97.09 | EFFLMVLLV | 2.91 | | | | |
| NS4A | 2206 | 0.19 | 2 | 2 | 0 | Y | FFLMVLLIP | 97.09 | FFLMVLLVP | 2.91 | | | | |
| NS4A | 2207 | 0.19 | 2 | 2 | 0 | Y | FLMVLLIPE | 97.09 | FLMVLLVPE | 2.91 | | | | |
| NS4A | 2208 | 0.19 | 2 | 2 | 0 | Y | LMVLLIPEP | 97.09 | LMVLLVPEP | 2.91 | | | | |
| NS4A | 2209 | 0.19 | 2 | 2 | 0 | Y | MVLLIPEPE | 97.09 | MVLLVPEPE | 2.91 | | | | |
| NS4A | 2210 | 0.19 | 2 | 2 | 0 | Y | VLLIPEPEK | 97.09 | VLLVPEPEK | 2.91 | | | | |
| NS4A | 2211 | 0.19 | 2 | 2 | 0 | Y | LLIPEPEKQ | 97.09 | LLVPEPEKQ | 2.91 | | | | |
| NS4A | 2212 | 0.19 | 2 | 2 | 0 | Y | LIPEPEKQR | 97.09 | LVPEPEKQR | 2.91 | | | | |
| NS4A | 2213 | 0.19 | 2 | 2 | 0 | Y | IPEPEKQRT | 97.09 | VPEPEKQRT | 2.91 | | | | |
| NS4A | 2214 | 0 | 1 | 1 | 0 | Y | PEPEKQRTP | 100 | | | | | | |
| NS4A | 2215 | 0 | 1 | 1 | 0 | Y | EPEKQRTPQ | 100 | | | | | | |

FIG. 15-83

Species: DENV4 (9-mers)

| protein | block starting position | total peptides in block | peptides required to cover 99% of block | gap/X fraction | 99% of block covered w/ <= 5 peptides? | peptides required to cover 99% of block | frequency | peptides required to cover 99% of block | frequency | pept

FIG. 15-84

Species: DENV4 (9-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2243 | 0 | 0 | 0 | 0 | Y | ANEMGLIEK | 100 | | | | | | |
| NS4B | 2244 | 0 | 0 | 0 | 0 | Y | NEMGLIEKT | 100 | | | | | | |
| NS4B | 2245 | 0 | 1 | 1 | 0 | Y | EMGLIEKTK | 100 | | | | | | |
| NS4B | 2246 | 0.19 | 2 | 2 | 0 | Y | MGLIEKTKT | 97.09 | MGLIEKTKA | 2.91 | | | | |
| NS4B | 2247 | 0.19 | 2 | 2 | 0 | Y | GLIEKTKTD | 97.09 | GLIEKTKAD | 2.91 | | | | |
| NS4B | 2248 | 0.19 | 2 | 2 | 0 | Y | LIEKTKTDF | 97.09 | LIEKTKADF | 2.91 | | | | |
| NS4B | 2249 | 0.19 | 2 | 2 | 0 | Y | IEKTKTDFG | 97.09 | IEKTKADFG | 2.91 | | | | |
| NS4B | 2250 | 0.19 | 2 | 2 | 0 | Y | EKTKTDFGF | 97.09 | EKTKADFGF | 2.91 | | | | |
| NS4B | 2251 | 0.19 | 2 | 2 | 0 | Y | KTKTDFGFY | 97.09 | KTKADFGFY | 2.91 | | | | |
| NS4B | 2252 | 0.19 | 2 | 2 | 0 | Y | TKTDFGFYQ | 97.09 | TKADFGFYQ | 2.91 |

FIG. 15-85

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2269 | 0 | 1 | 1 | 0 | Y | DVDLRPASA | 100 | | |
| NS4B | 2270 | 0 | 1 | 1 | 0 | Y | VDLRPASAW | 100 | | |
| NS4B | 2271 | 0 | 1 | 1 | 0 | Y | DLRPASAWT | 100 | | |
| NS4B | 2272 | 0 | 1 | 1 | 0 | Y | LRPASAWTL | 100 | | |
| NS4B | 2273 | 0 | 1 | 1 | 0 | Y | RPASAWTLY | 100 | | |
| NS4B | 2274 | 0 | 1 | 1 | 0 | Y | PASAWTLYA | 100 | | |
| NS4B | 2275 | 0 | 1 | 1 | 0 | Y | ASAWTLYAV | 100 | | |
| NS4B | 2276 | 0.08 | 2 | 1 | 0 | Y | SAWTLYAVA | 99.03 | | |
| NS4B | 2277 | 0.08 | 2 | 1 | 0 | Y | AWTLYAVAT | 99.03 | | |
| NS4B | 2278 | 0.08 | 2 | 1 | 0 | Y | WTLYAVATT | 99.03 | | |
| NS4B | 2279 | 0.08 | 2 | 2 | 2.91 | Y | TLYAVATTI | 96.12 | TLYAVVTTI | 0.97 |
| NS4B | 2280 | 0.08 | 2 | 2 | 2.91 | Y | LYAVATTIL | 96.12 | LYAVVTTIL | 0.97 |
| NS4B | 2281 | 0.08 | 2 | 2 | 2.91 | Y | YAVATTILT | 96.12 | YAVVTTILT | 0.97 |
| NS4B | 2282 | 0.08 | 2 | 2 | 2.91 | Y | AVATTILTP | 96.12 | AWTTILTP | 0.97 |
| NS4B | 2283 | 0.08 | 2 | 2 | 2.91 | Y | VATTILTPM | 96.12 | WTTILTPM | 0.97 |
| NS4B | 2284 | 0.08 | 2 | 2 | 2.91 | Y | ATTILTPML | 96.12 | VTTILTPML | 0.97 |
| NS4B | 2285 | 0 | 1 | 1 | 2.91 | Y | TTILTPMLR | 97.09 | | |
| NS4B | 2286 | 0 | 1 | 1 | 2.91 | Y | TILTPMLRH | 97.09 | | |
| NS4B | 2287 | 0 | 1 | 1 | 2.91 | Y | ILTPMLRHT | 97.09 | | |
| NS4B | 2288 | 0 | 1 | 1 | 0 | Y | LTPMLRHTI | 100 | | |
| NS4B | 2289 | 0 | 1 | 1 | 0 | Y | TPMLRHTIE | 100 | | |
| NS4B | 2290 | 0 | 1 | 1 | 0 | Y | PMLRHTIEN | 100 | | |
| NS4B | 2291 | 0 | 1 | 1 | 0 | Y | MLRHTIENT | 100 | | |
| NS4B | 2292 | 0 | 1 | 1 | 0 | Y | LRHTIENTS | 100 | | |
| NS4B | 2293 | 0 | 1 | 1 | 0 | Y | RHTIENTSA | 100 | | |
| NS4B | 2294 | 0 | 1 | 1 | 0 | Y | HTIENTSAN | 100 | | |

FIG. 15-86

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG.15-87

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2321 | 0.14 | 2 | 2 | 0 | Y | GWPLHRMDL | 98.06 | GWPLHRVDL | 1.94 |
| NS4B | 2322 | 0.22 | 3 | 2 | 0 | Y | WPLHRMDLG | 97.09 | WPLHRVDLG | 1.94 |
| NS4B | 2323 | 0.22 | 3 | 2 | 0 | Y | PLHRMDLGV | 97.09 | PLHRVDLGV | 1.94 |
| NS4B | 2324 | 0.22 | 3 | 2 | 0 | Y | LHRMDLGVP | 97.09 | LHRVDLGVP | 1.94 |
| NS4B | 2325 | 0.22 | 3 | 2 | 0 | Y | HRMDLGVPL | 97.09 | HRVDLGVPL | 1.94 |
| NS4B | 2326 | 0.22 | 3 | 2 | 0 | Y | RMDLGVPLL | 97.09 | RVDLGVPLL | 1.94 |
| NS4B | 2327 | 0.22 | 3 | 2 | 0 | Y | MDLGVPLLA | 97.09 | VDLGVPLLA | 1.94 |
| NS4B | 2328 | 0.08 | 2 | 1 | 0 | Y | DLGVPLLAM | 99.03 | | |
| NS4B | 2329 | 0.08 | 2 | 1 | 0 | Y | LGVPLLAMG | 99.03 | | |
| NS4B | 2330 | 0.08 | 2 | 1 | 0 | Y | GVPLLAMGC | 99.03 | | |
| NS4B | 2331 | 0.08 | 2 | 1 | 0 | Y | VPLLAMGCY | 99.03 | | |
| NS4B | 2332 | 0.08 | 2 | 1 | 0 | Y | PLLAMGCYS | 99.03 | | |
| NS4B | 2333 | 0.08 | 2 | 1 | 0 | Y | LLAMGCYSQ | 99.03 | | |
| NS4B | 2334 | 0.08 | 2 | 1 | 0 | Y | LAMGCYSQV | 99.03 | | |
| NS4B | 2335 | 0.08 | 2 | 1 | 0 | Y | AMGCYSQVN | 99.03 | | |
| NS4B | 2336 | 0.08 | 2 | 1 | 0 | Y | MGCYSQVNP | 99.03 | | |
| NS4B | 2337 | 0 | 1 | 1 | 0 | Y | GCYSQVNPT | 100 | | |
| NS4B | 2338 | 0 | 1 | 1 | 0 | Y | CYSQVNPTT | 100 | | |
| NS4B | 2339 | 0 | 1 | 1 | 0 | Y | YSQVNPTTL | 100 | | |
| NS4B | 2340 | 0.14 | 2 | 2 | 0 | Y | SQVNPTTLI | 98.06 | SQVNPTTLI | 1.94 |
| NS4B | 2341 | 0.14 | 2 | 2 | 0 | Y | QVNPTTLIA | 98.06 | QVNPTTLIA | 1.94 |
| NS4B | 2342 | 0.14 | 2 | 2 | 0 | Y | VNPTTLIAS | 98.06 | VNPTTLIAS | 1.94 |
| NS4B | 2343 | 0.14 | 2 | 2 | 0 | Y | NPTTLIASL | 98.06 | NPTTLIASL | 1.94 |
| NS4B | 2344 | 0.22 | 3 | 2 | 0 | Y | PTTLIASLV | 97.09 | PTTLIASLV | 1.94 |
| NS4B | 2345 | 0.22 | 3 | 2 | 0 | Y | TTLIASLVM | 97.09 | TTLIASLVM | 1.94 |
| NS4B | 2346 | 0.22 | 3 | 2 | 0 | Y | TLIASLVML | 97.09 | TLIASLVML | 1.94 |

FIG. 15-88

Species: DENV4 (9-mers)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS4B | 2347 | 0.53 | 5 | 4 | 0 | Y | LTAS

FIG.15-89

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS4B | 2373 | 0.08 | 2 | — | 0 | Y | AQKRTAAGI | 99.03 |
| NS4B | 2374 | 0.08 | 2 | — | 0 | Y | QKRTAAGIM | 99.03 |
| NS4B | 2375 | 0 | 1 | — | 0 | Y | KRTAAGIMK | 100 |
| NS4B | 2376 | 0 | 1 | — | 0 | Y | RTAAGIMKN | 100 |
| NS4B | 2377 | 0 | 1 | — | 0 | Y | TAAGIMKNP | 100 |
| NS4B | 2378 | 0 | 1 | — | 0 | Y | AAGIMKNPT | 100 |
| NS4B | 2379 | 0 | 1 | — | 0 | Y | AGIMKNPTV | 100 |
| NS4B | 2380 | 0 | 1 | — | 0 | Y | GIMKNPTVD | 100 |
| NS4B | 2381 | 0 | 1 | — | 0 | Y | IMKNPTVDG | 100 |
| NS4B | 2382 | 0 | 1 | — | 0 | Y | MKNPTVDGI | 100 |
| NS4B | 2383 | 0 | 1 | — | 0 | Y | KNPTVDGIT | 100 |
| NS4B | 2384 | 0 | 1 | — | 0 | Y | NPTVDGITV | 100 |
| NS4B | 2385 | 0 | 1 | — | 0 | Y | PTVDGITVI | 100 |
| NS4B | 2386 | 0 | 1 | — | 0 | Y | TVDGITVID | 100 |
| NS4B | 2387 | 0 | 1 | — | 0 | Y | VDGITVIDL | 100 |
| NS4B | 2388 | 0 | 1 | — | 0 | Y | DGITVIDLE | 100 |
| NS4B | 2389 | 0 | 1 | — | 0 | Y | GITVIDLEP | 100 |
| NS4B | 2390 | 0 | 1 | — | 0 | Y | ITVIDLEPI | 100 |
| NS4B | 2391 | 0 | 1 | — | 0 | Y | TVIDLEPIS | 100 |
| NS4B | 2392 | 0 | 1 | — | 0 | Y | VIDLEPISY | 100 |
| NS4B | 2393 | 0 | 1 | — | 0 | Y | IDLEPISYD | 100 |
| NS4B | 2394 | 0 | 1 | — | 0 | Y | DLEPISYDP | 100 |
| NS4B | 2395 | 0 | 1 | — | 0 | Y | LEPISYDPK | 100 |
| NS4B | 2396 | 0 | 1 | — | 0 | Y | EPISYDPKF | 100 |
| NS4B | 2397 | 0 | 1 | — | 0 | Y | PISYDPKFE | 100 |
| NS4B | 2398 | 0 | 1 | — | 0 | Y | ISYDPKFEK | 100 |

FIG. 15-90

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2399 | 0 | 1 | 1 | 0 | Y | SYDPKFEKQ | 100 | | | | | | |
| NS4B | 2400 | 0 | 1 | 1 | 0 | Y | YDPKFEKQL | 100 | | | | | | |
| NS4B | 2401 | 0 | 1 | 1 | 0 | Y | DPKFEKQLG | 100 | | | | | | |
| NS4B | 2402 | 0 | 1 | 1 | 0 | Y | PKFEKQLGQ | 100 | | | | | | |
| NS4B | 2403 | 0 | 1 | 1 | 0 | Y | KFEKQLGQV | 100 | | | | | | |
| NS4B | 2404 | 0 | 1 | 1 | 0 | Y | FEKQLGQVM | 100 | | | | | | |
| NS4B | 2405 | 0 | 1 | 1 | 0 | Y | EKQLGQVML | 100 | | | | | | |
| NS4B | 2406 | 0 | 1 | 1 | 0 | Y | KQLGQVMLL | 100 | | | | | | |
| NS4B | 2407 | 0.08 | 2 | 1 | 0 | Y | QLGQVMLLV | 99.03 | | | | | | |
| NS4B | 2408 | 0.08 | 2 | 1 | 0 | Y | LGQVMLLVL | 99.03 | | | | | | |
| NS4B | 2409 | 0.08 | 2 | 1 | 0 | Y | GQVMLLVLC | 99.03 | | | | | | |
| NS4B | 2410 | 0.54 | 3 | 2 | 0 | Y | QVMLLVLCA | 89.32 | QVMLLVLCV | 9.71 | | | | |
| NS4B | 2411 | 0.54 | 3 | 2 | 0 | Y | VMLLVLCAG | 89.32 | VMLLVLCVG | 9.71 | | | | |
| NS4B | 2412 | 0.54 | 3 | 2 | 0 | Y | MLLVLCAGQ | 89.32 | MLLVLCVGQ | 9.71 | | | | |
| NS4B | 2413 | 0.54 | 3 | 2 | 0 | Y | LLVLCAGQL | 89.32 | LLVLCVGQL | 9.71 | | | | |
| NS4B | 2414 | 0.67 | 4 | 3 | 0 | Y | LVLCAGQLL | 87.38 | LVLCVGQLL | 9.71 | LVLCAGQLF | 1.94 | | |
| NS4B | 2415 | 0.67 | 4 | 3 | 0 | Y | VLCAGQLLL | 87.38 | VLCVGQLLL | 9.71 | VLCAGQLFL | 1.94 | | |
| NS4B | 2416 | 0.59 | 3 | 3 | 0 | Y | LCAGQLLLM | 88.35 | LCVGQLLLM | 9.71 | LCAGQLFLM | 1.94 | | |
| NS4B | 2417 | 0.59 | 3 | 3 | 0 | Y | CAGQLLLMR | 88.35 | CVGQLLLMR | 9.71 | CAGQLFLMR | 1.94 | | |
| NS4B | 2418 | 0.59 | 3 | 3 | 0 | Y | AGQLLLMRT | 88.35 | VGQLLLMRT | 9.71 | AGQLFLMRT | 1.94 | | |
| NS4B | 2419 | 0.14 | 2 | 2 | 0 | Y | GQLLLMRTT | 98.06 | GQLFLMRTT | 1.94 | | | | |
| NS4B | 2420 | 0.14 | 2 | 2 | 0 | Y | QLLLMRTTW | 98.06 | QLFLMRTTW | 1.94 | | | | |
| NS4B | 2421 | 0.14 | 2 | 2 | 0 | Y | LLLMRTTWA | 98.06 | LFLMRTTWA | 1.94 | | | | |
| NS4B | 2422 | 0.59 | 3 | 3 | 0 | Y | LLMRTTWAF | 88.35 | LMRTTWAL | 9.71 | FLMRTTWAF | 1.94 | | |
| NS4B | 2423 | 0.46 | 2 | 2 | 0 | Y | LMRTTWAFC | 90.29 | LMRTTWALC | 9.71 | | | | |
| NS4B | 2424 | 0.46 | 2 | 2 | 0 | Y | MRTTWAFCE | 90.29 | MRTTWALCE | 9.71 | | | | |

FIG. 15-91

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 15-92

Species: DENV4 (9-mers)

| protein | block starting position | block entropy | total peptides in block | peptides required to cover 99% of block | g

FIG.15-93

Species: DENV4 (9-mers)

| protein | block starting position | block entropy | total peptides in block | peptides required to cover 99% of block | gap/X fraction | 99% of block covered w/ <= 5 peptides? | peptides required to cover

FIG. 15-94

Species: DENV4 (9-mers)

| protein | block starting position | block entropy | total peptides in block | peptides required to cover 99% of block | gap/X fraction | 99% of block covered w

FIG.15-95

Species: DENV4 (9-mers)

| protein | block starting position | block entropy | total peptides in block | peptides required to cover 99% of block | gap/X fraction | 99% of block covered w/ => 5 peptides? | block | frequency | block | frequency | block | frequency | block | frequency |
|---|---|---|---|---|---|---|---|---|---|---|---|---|---|---|
| NS5 | 2529 | 0.54 | 3 | 2 | 0 | Y | AKSALIKDGS | 89.32 | AKSALRDGS | 9.71 | | | | |
| NS5 | 2530 | 0.54 | 3 | 2 | 0 | Y | KSALKDGSK | 89.32 | KSALRDGSK | 9.71 | | | | |
| NS5 | 2531 | 0.88 | 5 | 4 | 0 | Y | SALKDGSKI | 84.47 | SALRDGSKI | 7.77 | SALKDGSKT | 4.85 | SALRDGSKT

FIG. 15-96

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|

FIG. 15-97

Species: DENV4 (9-mers)

| protein | block starting position | block entropy | total peptides in block | peptides required to cover 99% of block | gap/X fraction | 99% of block covered w

FIG. 15-98

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2607 | 0 | 1 | 1 | 0 | Y | YGWNLYKLH | 100 | | |
| NS5 | 2608 | 0 | 1 | 1 | 0 | Y | G

FIG. 15-99

Species: DENV4 (9-mers)

| protein | block starting position | block entropy | total peptides in block | peptides required to cover 99% of block | gap/

FIG. 15-100

Species: DENV4 (9-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2659 | 0 | 1 | 1 | 0 | Y | WLSSKPEF

FIG.15-101

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2685 | 0.95 | 5 | 4 | 0 | Y

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | fr

FIG. 15-104

Species: DENV4 N

FIG.15-105

Species: DENV4 (9-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2789 | 0 | 1 | 1 | 0 | Y | RTWAYHGSY | 100 | | | | | | |
| NS5 | 2790 | 0 | 1 | 1 | 0 | Y | TWAYHGSYE | 100 | | | | | | |
| NS5 | 2791 | 0 | 1 | 1 | 0 | Y | WAYHGSYEA | 100 | | | | | | |
| NS5 | 2792 | 0.08 | 2 | 1 | 0 | Y | AYHGSYEAP | 99.03 | | | | | | |
| NS5 | 2793 | 0.08 | 2 | 1 | 0 | Y | YHGSYEAPS | 99.03 | | | | | | |
| NS5 | 2794 | 0.08 | 2 | 1 | 0 | Y | HGSYEAPST | 99.03 | | | | | | |
| NS5 | 2795 | 0.08 | 2 | 1 | 0 | Y | GSYEAPSTG | 99.03 |

FIG. 15-106

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2815 | 0.42 | 3 | 3 | 0 | Y | LLTKPWDVI | 93.2 | LLTKPWDVV | 4.85 | LLTKPWDMI | 1.94 | | |
| NS5 | 2816 | 0.42 | 3 | 3 | 0 | Y | LTKPWDVIP | 93.2 | LTKPWDVVP | 4.85 | LTKPWDMIP | 1.94 | | |
| NS5 | 2817 | 0.42 | 3 | 3 | 0 | Y | TKPWDVIPM | 93.2 | TKPWDVVPM | 4.85 | TKPWDMIPM | 1.94 | | |
| NS5 | 2818 | 0.42 | 3 | 3 | 0 | Y | KPWDVIPMV | 93.2 | KPWDVVPMV | 4.85 | KPWDMIPMV | 1.94 | | |
| NS5 | 2819 | 0.42 | 3 | 3 | 0 | Y | PWDVIPMVT | 93.2 | PWDVVPMVT | 4.85 | PWDMIPMVT | 1.94 | | |
| NS5 | 2820 | 0.42 | 3 | 3 | 0 | Y | WDVIPMVTQ | 93.2 | WDVVPMVTQ | 4.85 | WDMIPMVTQ | 1.94 | | |
| NS5 | 2821 | 0.42 | 3 | 3 | 0 | Y | DVIPMVTQL | 93.2 | DVVPMVTQL | 4.85 | DMIPMVTQL | 1.94 | | |
| NS5 | 2822 | 0.42 | 3 | 3 | 0 | Y | VIPMVTQLA | 93.2 | VVPMVTQLA | 4.85 | MIPMVTQLA | 1.94 | | |
| NS5 | 2823 | 0.28 | 2 | 2 | 0 | Y | IPMVTQLAM | 95.15 | VPMVTQLAM | 4.85 | | | | |
| NS5 | 2824 | 0 | 1 | 1 | 0 | Y | PMVTQLAMT | 100 | | | | | | |
| NS5 | 2825 | 0 | 1 | 1 | 0 | Y | MVTQLAMTD | 100 | | | | | | |
| NS5 | 2826 | 0 | 1 | 1 | 0 | Y | VTQLAMTDT | 100 | | | | | | |
| NS5 | 2827 | 0 | 1 | 1 | 0 | Y | TQLAMTDTT | 100 | | | | | | |
| NS5 | 2828 | 0 | 1 | 1 | 0 | Y | QLAMTDTTP | 100 | | | | | | |
| NS5 | 2829 | 0 | 1 | 1 | 0 | Y | LAMTDTTPF | 100 | | | | | | |
| NS5 | 2830 | 0 | 1 | 1 | 0 | Y | AMTDTTPFG | 100 | | | | | | |
| NS5 | 2831 | 0 | 1 | 1 | 0 | Y | MTDTTPFGQ | 100 | | | | | | |
| NS5 | 2832 | 0 | 1 | 1 | 0 | Y | TDTTPFGQQ | 100 | | | | | | |
| NS5 | 2833 | 0 | 1 | 1 | 0 | Y | DTTPFGQQR | 100 | | | | | | |
| NS5 | 2834 | 0 | 1 | 1 | 0 | Y | TTPFGQQRV | 100 | | | | | | |
| NS5 | 2835 | 0 | 1 | 1 | 0 | Y | TPFGQQRVF | 100 | | | | | | |
| NS5 | 2836 | 0 | 1 | 1 | 0 | Y | PFGQQRVFK | 100 | | | | | | |
| NS5 | 2837 | 0 | 1 | 1 | 0 | Y | FGQQRVFKE | 100 | | | | | | |
| NS5 | 2838 | 0 | 1 | 1 | 0 | Y | GQQRVFKEK | 100 | | | | | | |
| NS5 | 2839 | 0 | 1 | 1 | 0 | Y | QQRVFKEKV | 100 | | | | | | |
| NS5 | 2840 | 0 | 1 | 1 | 0 | Y | QRVFKEKVD | 100 | | | | | | |

FIG.15-107

Species: DENV4 (9-mers)

| protein | block starting position | block entropy | total peptides in block | peptides required to cover 99% of block | gap/X fraction | 99% of block covered w/ <= 5 peptides? | block |

FIG. 15-108

Species: DENV4 (9-mers)

| protein | block starting position | block entropy | total peptides in block | peptides required to cover 99% of block | gap/X fraction | 99% of block covered w/ <= 5 peptides? | peptides required to cover 99% of

FIG.15-109

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2895 | 0 | 1 | 1 | 0 | Y | AAIGAVFQE | 100 | | | | | | |

FIG. 15-110

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 2921 | 0.16 | 3 | 2 | 0 | Y | ELVDKERAL | 98.06 | ELVDKERTL | 0.97 | | | | |
| NS5 | 2922 | 0.08 | 2 | 1 | 0 | Y | LVDKERALH | 99.03 | | | | | | |
| NS5 | 2923 | 0.08 | 2 | 1 | 0 | Y | VDKERALHQ | 99.03 | | | | | | |
| NS5 | 2924 | 0.08 | 2 | 1 | 0 | Y | DKERALHQE | 99.03 | | | | | | |
| NS5 | 2925 | 0.08 | 2 | 1 | 0 | Y | KERALHQEG | 99.03 | | | | | | |
| NS5 | 2926 | 0.16 | 3 | 2 | 0 | Y | ERALHQEGK | 98.06 | ERTLHQEGK | 0.97 | | | | |
| NS5 | 2927 | 0.16 | 3 | 2 | 0 | Y | RALHQEGKC | 98.06 | RALHQEGRC | 0.97 | | | | |
| NS5 | 2928 | 0.16 | 3 | 2 | 0 | Y | ALHQEGKCE | 98.06 | ALHQEGRCE | 0.97 | | | | |
| NS5 | 2929 | 0.08 | 2 | 1 | 0 | Y | LHQEGKCES | 99.03 | | | | | | |
| NS5 | 2930 | 0.08 | 2 | 1 | 0 | Y | HQEGKCESC | 99.03 | | | | | | |
| NS5 | 2931 | 0.08 | 2 | 1 | 0 | Y | QEGKCESCV | 99.03 | | | | | | |
| NS5 | 2932 | 0.08 | 2 | 1 | 0 | Y | EGKCESCV | 99.03 | | | | | | |
| NS5 | 2933 | 0.08 | 2 | 1 | 0 | Y | GKCESCVY | 99.03 | | | | | | |
| NS5 | 2934 | 0.08 | 2 | 1 | 0 | Y | KCESCVYN | 99.03 | | | | | | |
| NS5 | 2935 | 0 | 1 | 1 | 0 | Y | CESCVYNM | 100 | | | | | | |
| NS5 | 2936 | 0 | 1 | 1 | 0 | Y | ESCVYNMM | 100 | | | | | | |
| NS5 | 2937 | 0 | 1 | 1 | 0 | Y | SCVYNMMGK | 100 | | | | | | |
| NS5 | 2938 | 0 | 1 | 1 | 0 | Y | CVYNMMGKR | 100 | | | | | | |
| NS5 | 2939 | 0 | 1 | 1 | 0 | Y | VYNMMGKRE | 100 | | | | | | |
| NS5 | 2940 | 0 | 1 | 1 | 0 | Y | YNMMGKREK | 100 | | | | | | |
| NS5 | 2941 | 0 | 1 | 1 | 0 | Y | NMMGKREKK | 100 | | | | | | |
| NS5 | 2942 | 0 | 1 | 1 | 0 | Y | MMGKREKKL | 100 | | | | | | |
| NS5 | 2943 | 0 | 1 | 1 | 0 | Y | MGKREKKLG | 100 | | | | | | |
| NS5 | 2944 | 0 | 1 | 1 | 0 | Y | GKREKKLGE | 100 | | | | | | |
| NS5 | 2945 | 0 | 1 | 1 | 0 | Y | KREKKLGEF | 100 | | | | | | |
| NS5 | 2946 | 0 | 1 | 1 | 0 | Y | REKKLGEFG | 100 | | | | | | |

FIG.15-112

Species: DENV4 (9-mers)

| protein | block starting position | block ent

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 15-115

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|

FIG. 15-116

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG.15-117

Species: DENV4 (9-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS5 | 3103 | 0 | 1 | 1 | 0 | Y | MEVQLIRQM | 100 | | | | | | | | |
| NS5 | 3104 | 0 | 1 | 1 | 0 | Y | EVQLIRQME | 100 | | | | | | | | |
| NS5 | 3105 | 0 | 1 | 1 | 0 | Y | VQLIRQMEA | 100 | | | | | | | | |
| NS5 | 3106 | 0 | 1 | 1 | 0 | Y | QLIRQMEAE | 100 | | | | | | | | |
| NS5 | 3107 | 0 | 1 | 1 | 0 | Y | LIRQMEAEG | 100 | | | | | | | | |
| NS5 | 3108 | 0 | 1 | 1 | 0 | Y | IRQMEAEGV | 100 | | | | | | | | |
| NS5 | 3109 | 0 | 1 | 1 | 0 | Y | RQMEAEGVI | 100 | | | | | | | | |
| NS5 | 3110 | 0 | 1 | 1 | 0 | Y | QMEAEGVIT | 100 | | | | | | | | |
| NS5 | 3111 | 0.19 | 2 | 2 | 0 | Y | MEAEGVITQ | 97.09 | MEAEGVITR | 2.91 | | | | | | |
| NS5 | 3112 | 0.19 | 2 | 2 | 0 | Y | EAEGVITQD | 97.09 | EAEGVITRD | 2.91 | | | | | | |
| NS5 | 3113 | 0.19 | 2 | 2 | 0 | Y | AEGVITQDD | 97.09 | AEGVITRDD | 2.91 | | | | | | |
| NS5 | 3114 | 0.19 | 2 | 2 | 0 | Y | EGVITQDDM | 97.09 | EGVITRDDM | 2.91 | | | | | | |
| NS5 | 3115 | 0.38 | 3 | 3 | 0 | Y | GVITQDDMQ | 94.17 | GVITRDDMH | 2.91 | GVITQDDMH | 2.91 | | | | |
| NS5 | 3116 | 0.38 | 3 | 3 | 0 | Y | VITQDDMQN | 94.17 | VITRDDMHN | 2.91 | VITRDDMH | 2.91 | | | | |
| NS5 | 3117 | 0.38 | 3 | 3 | 0 | Y | ITQDDMQNP | 94.17 | ITRDDMHNP | 2.91 | ITQDDMHNP | 2.91 | | | | |
| NS5 | 3118 | 0.38 | 3 | 3 | 0 | Y | TQDDMQNPK | 94.17 | TQDDMHNPK | 2.91 | TRDDMHNPK | 2.91 | | | | |
| NS5 | 3119 | 0.38 | 3 | 3 | 0 | Y | QDDMQNPKG | 94.17 | RDDMHNPKG | 2.91 | QDDMHNPKG | 2.91 | | | | |
| NS5 | 3120 | 0.32 | 2 | 2 | 0 | Y | DDMQNPKGL | 94.17 | DDMHNPKGL | 5.83 | | | | | | |
| NS5 | 3121 | 0.4 | 3 | 2 | 0 | Y | DMQNPKGLK | 93.2 | DMHNPKGLK | 5.83 | | | | | | |
| NS5 | 3122 | 0.4 | 3 | 2 | 0 | Y | MQNPKGLKE | 93.2 | MHNPKGLKE | 5.83 | | | | | | |
| NS5 | 3123 | 0.48 | 3 | 3 | 0 | Y | QNPKGLKER | 92.23 | HNPKGLKER | 5.83 | QNPKGLRER | 0.97 | | | | |
| NS5 | 3124 | 0.16 | 2 | 2 | 0 | Y | NPKGLKERV | 98.06 | NPKGLKEKV | 0.97 | | | | | | |
| NS5 | 3125 | 0.16 | 2 | 2 | 0 | Y | PKGLKERVE | 98.06 | PKGLKEKVE | 0.97 | | | | | | |
| NS5 | 3126 | 0.39 | 4 | 3 | 0 | Y | KGLKERVEK | 94.17 | KGLKERVEN | 3.88 | KGLRERVEK | 0.97 | | | | |
| NS5 | 3127 | 0.39 | 4 | 3 | 0 | Y | GLKERVEKW | 94.17 | GLKERVENW | 3.88 | GLRERVEKW | 0.97 | | | | |
| NS5 | 3128 | 0.39 | 4 | 3 | 0 | Y | LKERVEKWL | 94.17 | LKERVENWL | 3.88 | LKEKVEKWL | 0.97 | | | | |

FIG.15-118

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3129 | 1.28 | 5 | 4 | 0 | Y | KERVEKWLR | 60.19 | KERVEKWLK | 33.98 | KERVENWLR | 3.88 | RERVEKWLK | 0.97 |
| NS5 | 3130 | 1.22 | 4 | 3 | 0 | Y | ERVEKWLRE | 60.19 | ERVEKWLKE | 34.95 | ERVENWLRE | 3.88 | | |
| NS5 | 3131 | 1.22 | 4 | 3 | 0 | Y | RVEKWLREC | 60.19 | RVEKWLKEC | 34.95 | RVENWLREC | 3.88 | | |
| NS5 | 3132 | 1.15 | 3 | 3 | 0 | Y | VEKWLRECG | 60.19 | VEKWLKECG | 35.92 | VENWLRECG | 3.88 | | |
| NS5 | 3133 | 1.15 | 3 | 3 | 0 | Y | EKWLRECGV | 60.19 | EKWLKECGV | 35.92 | ENWLRECGV | 3.88 | | |
| NS5 | 3134 | 1.15 | 3 | 3 | 0 | Y | KWLRECGVD | 60.19 | KWLKECGVD | 35.92 | NWLRECGVD | 3.88 | | |
| NS5 | 3135 | 0.94 | 2 | 2 | 0 | Y | WLRECGVDR | 64.08 | WLKECGVDR | 35.92 | | | | |
| NS5 | 3136 | 0.94 | 2 | 2 | 0 | Y | LRECGVDRL | 64.08 | LKECGVDRL | 35.92 | | | | |
| NS5 | 3137 | 0.94 | 2 | 2 | 0 | Y | RECGVDRLK | 64.08 | KECGVDRLK | 35.92 | | | | |
| NS5 | 3138 | 0 | 1 | 1 | 0 | Y | ECGVDRLKR | 100 | | | | | | |
| NS5 | 3139 | 0 | 1 | 1 | 0 | Y | CGVDRLKRM | 100 | | | | | | |
| NS5 | 3140 | 0 | 1 | 1 | 0 | Y | GVDRLKRMA | 100 | | | | | | |
| NS5 | 3141 | 0 | 1 | 1 | 0 | Y | VDRLKRMAI | 100 | | | | | | |
| NS5 | 3142 | 0 | 1 | 1 | 0 | Y | DRLKRMAIS | 100 | | | | | | |
| NS5 | 3143 | 0 | 1 | 1 | 0 | Y | RLKRMAISG | 100 | | | | | | |
| NS5 | 3144 | 0 | 1 | 1 | 0 | Y | LKRMAISGD | 100 | | | | | | |
| NS5 | 3145 | 0 | 1 | 1 | 0 | Y | KRMAISGDD | 100 | | | | | | |
| NS5 | 3146 | 0 | 1 | 1 | 0 | Y | RMAISGDDC | 100 | | | | | | |
| NS5 | 3147 | 0 | 1 | 1 | 0 | Y | MAISGDDCV | 100 | | | | | | |
| NS5 | 3148 | 0 | 1 | 1 | 0 | Y | AISGDDCVW | 100 | | | | | | |
| NS5 | 3149 | 0 | 1 | 1 | 0 | Y | ISGDDCVWK | 100 | | | | | | |
| NS5 | 3150 | 0 | 1 | 1 | 0 | Y | SGDDCVWKP | 100 | | | | | | |
| NS5 | 3151 | 0 | 1 | 1 | 0 | Y | GDDCVWKPL | 100 | | | | | | |
| NS5 | 3152 | 0 | 1 | 1 | 0 | Y | DDCVWKPLD | 100 | | | | | | |
| NS5 | 3153 | 0 | 1 | 1 | 0 | Y | DCVWKPLDE | 100 | | | | | | |
| NS5 | 3154 | 0 | 1 | 1 | 0 | Y | CVWKPLDER | 100 | | | | | | |

FIG.15-119

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3155 | 0 | 1 | 1 | 0 | Y | VWKPLDERF | 100 | | | | | | | | |
| NS5 | 3156 | 0.86 | 3 | 3 | 0 | Y | VKPLDERFG | 77.67 | VKPLDERFS | 20.39 | VKPLDERFA | 1.94 | | | | |
| NS5 | 3157 | 0.86 | 3 | 3 | 0 | Y | KPLDERFGT | 77.67 | KPLDERFST | 20.39 | KPLDERFAT | 1.94 | | | | |
| NS5 | 3158 | 0.86 | 3 | 3 | 0 | Y | PLDERFGTS | 77.67 | PLDERFSTS | 20.39 | PLDERFATS | 1.94 | | | | |
| NS5 | 3159 | 0.86 | 3 | 3 | 0 | Y | LDERFGTSL | 77.67 | LDERFSTSL | 20.39 | LDERFATSL | 1.94 | | | | |
| NS5 | 3160 | 0.86 | 3 | 3 | 0 | Y | DERFGTSLL | 77.67 | DERFSTSLL | 20.39 | DERFATSLL | 1.94 | | | | |
| NS5 | 3161 | 0.86 | 3 | 3 | 0 | Y | ERFGTSLLF | 77.67 | ERFSTSLLF | 20.39 | ERFATSLLF | 1.94 | | | | |
| NS5 | 3162 | 0.86 | 3 | 3 | 0 | Y | RFGTSLLFL | 77.67 | RFSTSLLFL | 20.39 | RFATSLLFL | 1.94 | | | | |
| NS5 | 3163 | 0.86 | 3 | 3 | 0 | Y | FGTSLLFLN | 77.67 | FSTSLLFLN | 20.39 | FATSLLFLN | 1.94 | | | | |
| NS5 | 3164 | 0.86 | 3 | 3 | 0 | Y | GTSLLFLND | 77.67 | STSLLFLND | 20.39 | ATSLLFLND | 1.94 | | | | |
| NS5 | 3165 | 0 | 1 | 1 | 0 | Y | TSLLFLNDM | 100 | | | | | | | | |
| NS5 | 3166 | 0 | 1 | 1 | 0 | Y | SLLFLNDMG | 100 | | | | | | | | |
| NS5 | 3167 | 0 | 1 | 1 | 0 | Y | LLFLNDMGK | 100 | | | | | | | | |
| NS5 | 3168 | 0 | 1 | 1 | 0 | Y | LFLNDMGKV | 100 | | | | | | | | |
| NS5 | 3169 | 0 | 1 | 1 | 0 | Y | FLNDMGKVR | 100 | | | | | | | | |
| NS5 | 3170 | 0 | 1 | 1 | 0 | Y | LNDMGKVRK | 100 | | | | | | | | |
| NS5 | 3171 | 0 | 1 | 1 | 0 | Y | NDMGKVRKD | 100 | | | | | | | | |
| NS5 | 3172 | 0 | 1 | 1 | 0 | Y | DMGKVRKDI | 100 | | | | | | | | |
| NS5 | 3173 | 0 | 1 | 1 | 0 | Y | MGKVRKDIP | 100 | | | | | | | | |
| NS5 | 3174 | 0 | 1 | 1 | 0 | Y | GKVRKDIPQ | 100 | | | | | | | | |
| NS5 | 3175 | 0 | 1 | 1 | 0 | Y | KVRKDIPQW | 100 | | | | | | | | |
| NS5 | 3176 | 0 | 1 | 1 | 0 | Y | VRKDIPQWE | 100 | | | | | | | | |
| NS5 | 3177 | 0 | 1 | 1 | 0 | Y | RKDIPQWEP | 100 | | | | | | | | |
| NS5 | 3178 | 0 | 1 | 1 | 0 | Y | KDIPQWEPS | 100 | | | | | | | | |
| NS5 | 3179 | 0 | 1 | 1 | 0 | Y | DIPQWEPSK | 100 | | | | | | | | |
| NS5 | 3180 | 0 | 1 | 1 | 0 | Y | IPQWEPSKG | 100 | | | | | | | | |

FIG. 15-120

Species: DENV4 (9-mers)

| protein | block starting position | block entropy | total peptides in block | peptides required to cover 99% of block | gap/X fraction | 99% of block covered w/ <= 5 peptides? | block | frequency

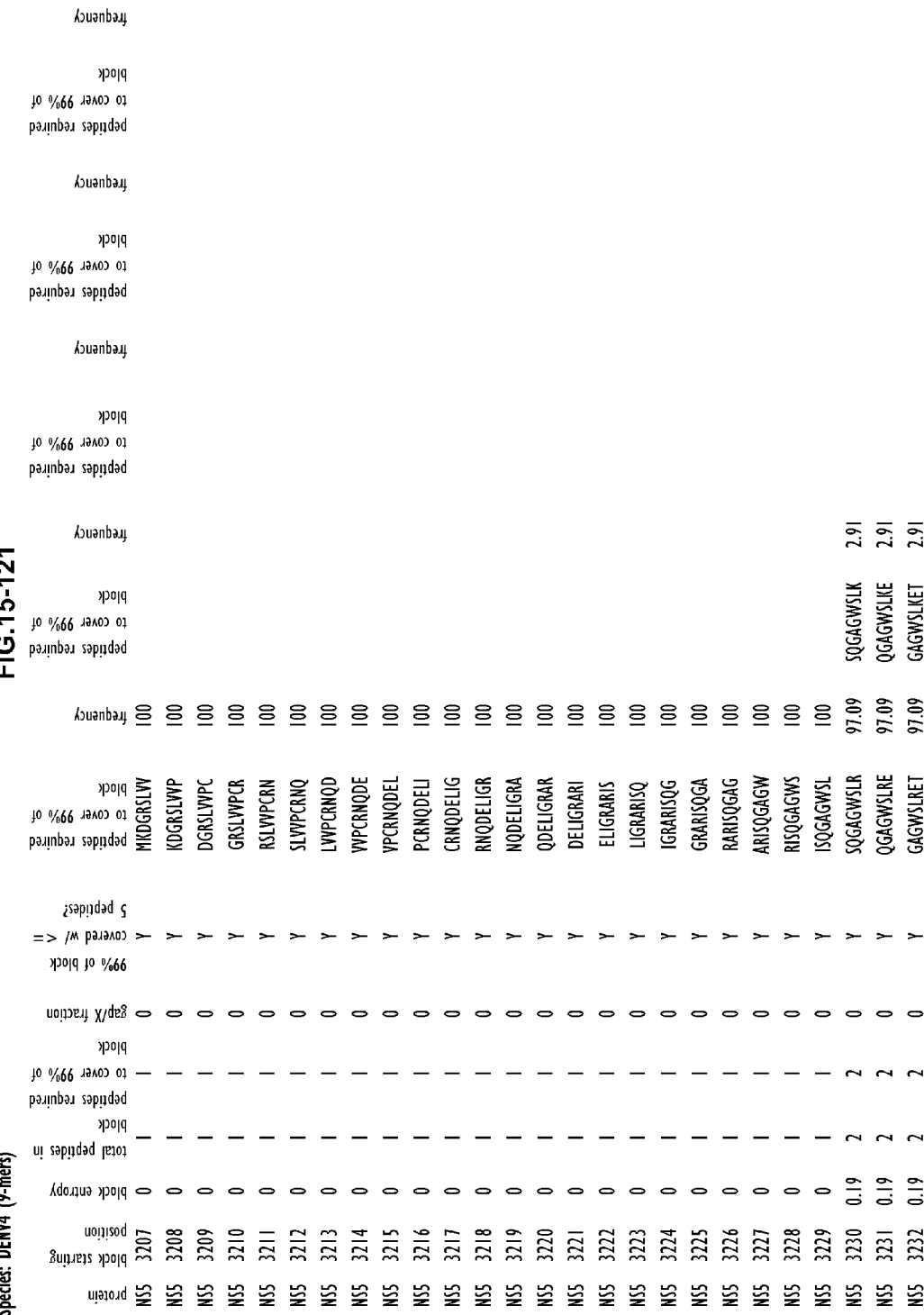

FIG. 15-122

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block

FIG.15-123

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required

FIG. 15-124

Species: DENV4 (9-mers)

| protein | block starting position | block entropy | total peptides in block | peptides required to cover 99% of block | gap/X f

FIG. 15-125

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 3311 | 1.19 | 3 | 3 | 0 | Y | PNMIDKTPV | 59.22 | PNMTDKTPV | 35.92 | PNMTDKTPI | 4.85 |
| NS5 | 3312 | 1.25 | 4 | 3 | 0 | Y | NMIDKTPVH | 59.22 | NMTDKTPVH | 34.95 | NMTDKTPIH | 4.85 |
| NS5 | 3313 | 1.25 | 4 | 3 | 0 | Y | MIDKTPVHS | 59.22 | MTDKTPVHS | 34.95 | MTDKTPIHS | 4.85 |
| NS5 | 3314 | 1.25 | 4 | 3 | 0 | Y | IDKTPVHSW | 59.22 | TDKTPVHSW | 34.95 | TDKTPIHSW | 4.85 |
| NS5 | 3315 | 0.36 | 3 | 2 | 0 | Y | DKTPVHSWE | 94.17 | DKTPIHSWE | 4.85 | | |
| NS5 | 3316 | 0.36 | 3 | 2 | 0 | Y | KTPVHSWED | 94.17 | KTPIHSWED | 4.85 | | |
| NS5 | 3317 | 0.49 | 4 | 3 | 0 | Y | TPVHSWEDI | 92.23 | TPIHSWEDI | 4.85 | TPVHSWEDV | 1.94 |
| NS5 | 3318 | 0.49 | 4 | 3 | 0 | Y | PVHSWEDIP | 92.23 | PIHSWEDIP | 4.85 | PVHSWEDVP | 1.94 |
| NS5 | 3319 | 0.49 | 4 | 3 | 0 | Y | VHSWEDIPY | 92.23 | IHSWEDIPY | 4.85 | VHSWEDVPY | 1.94 |
| NS5 | 3320 | 0.22 | 3 | 2 | 0 | Y | HSWEDIPYL | 97.09 | HSWEDVPYL | 1.94 | | |
| NS5 | 3321 | 0.14 | 2 | 2 | 0 | Y | SWEDIPYLG | 98.06 | SWEDVPYLG | 1.94 | | |
| NS5 | 3322 | 0.14 | 2 | 2 | 0 | Y | WEDIPYLGK | 98.06 | WEDVPYLGK | 1.94 | | |
| NS5 | 3323 | 0.14 | 2 | 2 | 0 | Y | EDIPYLGKR | 98.06 | EDVPYLGKR | 1.94 | | |
| NS5 | 3324 | 0.14 | 2 | 2 | 0 | Y | DIPYLGKRE | 98.06 | DVPYLGKRE | 1.94 | | |
| NS5 | 3325 | 0.14 | 2 | 2 | 0 | Y | IPYLGKRED | 98.06 | VPYLGKRED | 1.94 | | |
| NS5 | 3326 | 0 | 1 | 1 | 0 | Y | PYLGKREDL | 100 | | | | |
| NS5 | 3327 | 0 | 1 | 1 | 0 | Y | YLGKREDLW | 100 | | | | |
| NS5 | 3328 | 0 | 1 | 1 | 0 | Y | LGKREDLWC | 100 | | | | |
| NS5 | 3329 | 0 | 1 | 1 | 0 | Y | GKREDLWCG | 100 | | | | |
| NS5 | 3330 | 0 | 1 | 1 | 0 | Y | KREDLWCGS | 100 | | | | |
| NS5 | 3331 | 0 | 1 | 1 | 0 | Y | REDLWCGSL | 100 | | | | |
| NS5 | 3332 | 0 | 1 | 1 | 0 | Y | EDLWCGSLI | 100 | | | | |
| NS5 | 3333 | 0 | 1 | 1 | 0 | Y | DLWCGSLIG | 100 | | | | |
| NS5 | 3334 | 0 | 1 | 1 | 0 | Y | LWCGSLIGL | 100 | | | | |
| NS5 | 3335 | 0.08 | 2 | 1 | 0 | Y | WCGSLIGLS | 99.03 | | | | |
| NS5 | 3336 | 0.08 | 2 | 1 | 0 | Y | CGSLIGLSS | 99.03 | | | | |

FIG. 15-126

Species: DENV4 (9-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3337 | 0.08 | 2 | 1 | 0 | Y | GSLIGLSSR | 99.03 | | | | | | |
| NS5 | 3338 | 0.08 | 2 | 1 | 0 | Y | SLIGLSSRA | 99.03 | | | | | | |
| NS5 | 3339 | 0.08 | 2 | 1 | 0 | Y | LIGLSSRAT | 99.03 | | | | | | |
| NS5 | 3340 | 0.08 | 2 | 1 | 0 | Y | IGLSSRATW | 99.03 | | | | | | |
| NS5 | 3341 | 0.08 | 2 | 1 | 0 | Y | GLSSRATWA | 99.03 | | | | | | |
| NS5 | 3342 | 0.08 | 2 | 1 | 0 | Y | LSSRATWAK | 99.03 | | | | | | |
| NS5 | 3343 | 0.08 | 2 | 1 | 0 | Y | SSRATWAKN | 99.03 | | | | | | |
| NS5 | 3344 | 0 | 1 | 1 | 0 | Y | SRATWAKNI | 100 | | | | | | |
| NS5 | 3345 | 0.14 | 2 | 2 | 0 | Y | RATWAKNIH | 98.06 | RATWAKNIQ | 1.94 | | | | |
| NS5 | 3346 | 0.14 | 2 | 2 | 0 | Y | ATWAKNIHT | 98.06 | ATWAKNIQT | 1.94 | | | | |
| NS5 | 3347 | 0.14 | 2 | 2 | 0 | Y | TWAKNIHTA | 98.06 | TWAKNIQTA | 1.94 | | | | |
| NS5 | 3348 | 0.14 | 2 | 2 | 0 | Y | WAKNIHTAI | 98.06 | WAKNIQTAI | 1.94 | | | | |
| NS5 | 3349 | 0.28 | 3 | 3 | 0 | Y | AKNIHTAIT | 96.12 | AKNIQTAIT | 1.94 | AKNIQTAIT | 1.94 | | |
| NS5 | 3350 | 0.28 | 3 | 3 | 0 | Y | KNIHTAITQ | 96.12 | KNIQTAITQ | 1.94 | KNIHTAIAQ | 1.94 | | |
| NS5 | 3351 | 0.28 | 3 | 3 | 0 | Y | NIHTAITQV | 96.12 | NIQTAITQV | 1.94 | NIHTAIAQV | 1.94 | | |
| NS5 | 3352 | 0.28 | 3 | 3 | 0 | Y | IHTAITQVR | 96.12 | IHTAIAQVR | 1.94 | IQTAITQVR | 1.94 | | |
| NS5 | 3353 | 0.28 | 3 | 3 | 0 | Y | HTAITQVRN | 96.12 | QTAITQVRN | 1.94 | HTAIAQVRN | 1.94 | | |
| NS5 | 3354 | 0.14 | 2 | 2 | 0 | Y | TAITQVRNL | 98.06 | TAIAQVRNL | 1.94 | | | | |
| NS5 | 3355 | 0.14 | 2 | 2 | 0 | Y | AITQVRNLI | 98.06 | AIAQVRNLI | 1.94 | | | | |
| NS5 | 3356 | 0.14 | 2 | 2 | 0 | Y | ITQVRNLIG | 98.06 | IAQVRNLIG | 1.94 | | | | |
| NS5 | 3357 | 0.14 | 2 | 2 | 0 | Y | TQVRNLIGK | 98.06 | AQVRNLIGK | 1.94 | | | | |
| NS5 | 3358 | 0 | 1 | 1 | 0 | Y | QVRNLIGKE | 100 | | | | | | |
| NS5 | 3359 | 0 | 1 | 1 | 0 | Y | VRNLIGKEE | 100 | | | | | | |
| NS5 | 3360 | 0 | 1 | 1 | 0 | Y | RNLIGKEEY | 100 | | | | | | |
| NS5 | 3361 | 0.16 | 3 | 2 | 0 | Y | NLIGKEEYV | 98.06 | NLIGKEEYM | 0.97 | | | | |
| NS5 | 3362 | 0.16 | 3 | 2 | 0 | Y | LIGKEEYVD | 98.06 | LIGKEEYAD | 0.97 | | | | |

FIG.15-127

Species: DENV4 (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3363 | 0.16 | 3 | 2 | 0 | Y | IGKEEYDY | 98.06 | IGKEEYADY | 0.97 | | | | | | |
| NS5 | 3364 | 0.16 | 3 | 2 | 0 | Y | GKEEYDYM | 98.06 | GKEEYMDYM | 0.97 | | | | | | |
| NS5 | 3365 | 0.16 | 3 | 2 | 0 | Y | KEEYDYMP | 98.06 | KEEYMDYMP | 0.97 | | | | | | |
| NS5 | 3366 | 0.55 | 4 | 3 | 0 | Y | EEYDYMPV | 90.29 | EEYDYMPA | 7.77 | EEYADYMPV | 0.97 | | | | |
| NS5 | 3367 | 0.55 | 4 | 3 | 0 | Y | EYDYMPVM | 90.29 | EYDYMPAM | 7.77 | EYMDYMPVM | 0.97 | | | | |
| NS5 | 3368 | 0.68 | 5 | 4 | 0 | Y | YDYMPVMK | 88.35 | YDYMPAMK | 7.77 | YDYMPVMR | 1.94 | YMDYMPVMK | 0.97 | | |
| NS5 | 3369 | 0.68 | 5 | 4 | 0 | Y | VDYMPVMKR | 88.35 | VDYMPAMKR | 7.77 | VDYMPVMRR | 1.94 | ADYMPVMKR | 0.97 | | |
| NS5 | 3370 | 0.53 | 3 | 3 | 0 | Y | DYMPVMKRY | 90.29 | DYMPAMKRY | 7.77 | DYMPVMRRY | 1.94 | | | | |
| NS5 | 3371 | 0.53 | 3 | 3 | 0 | Y | YMPVMKRYS | 90.29 | YMPAMKRYS | 7.77 | YMPVMRRYS | 1.94 | | | | |
| NS5 | 3372 | 0.53 | 3 | 3 | 0 | Y | MPVMKRYSA | 90.29 | MPAMKRYSA | 7.77 | MPVMRRYSA | 1.94 | | | | |
| NS5 | 3373 | 0.73 | 6 | 5 | 0 | Y | PVMKRYSAP | 88.35 | PAMKRYSAP | 6.8 | PVMRRYSAL | 1.94 | PVMKRYSAH | 0.97 | PVMKRYSAL | 0.97 |
| NS5 | 3375 | 0.78 | 6 | 5 | 0 | Y | MKRYSAPSE | 87.38 | MKRYSAPFE | 6.8 | MRRYSALSE | 1.94 | MKRYSAHFE | 1.94 | MKRYSALSE | 0.97 |
| NS5 | 3377 | 0.83 | 6 | 5 | 0 | Y | RYSAPSESE | 86.41 | RYSAPFESE | 6.8 | RYSALSESE | 1.94 | RYSAHFESE | 1.94 | RYSAPSENE | 0.97 |
| NS5 | 3378 | 0.83 | 6 | 5 | 0 | Y | YSAPSESEG | 86.41 | YSAPFESEG | 6.8 | YSALSESEG | 1.94 | YSAHFESEG | 1.94 | YSAPSENEG | 0.97 |
| NS5 | 3379 | 0.83 | 6 | 5 | 0 | Y | SAPSESEGV | 86.41 | SAPFESEGV | 6.8 | SALSESEGV | 1.94 | SAHFESEGV | 1.94 | SAPLESEGV | 0.97 |
| NS5 | 3380 | 0.83 | 6 | 5 | 0 | Y | APSESEGVL | 86.41 | APFESEGVL | 6.8 | ALSESEGVL | 1.94 | AHFESEGVL | 1.94 | APLESEGVL | 0.97 |

FIG. 16-1

Species: DENW4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 2 | 0.41 | 4 | 3 | 1 | yes | MNQRKKVVRP | 93.2 | MNQRKKVARP | 2.91 | MNQRKKARNT | 1.94 | | |
| anC | 3 | 0.41 | 4 | 3 | 1 | yes | NQRKKVVRPP | 93.2 | NQRKKVARPP | 2.91 | NQRKKARNTP | 1.94 | | |
| anC | 4 | 0.41 | 4 | 3 | 1 | yes | QRKKVVRPPF | 93.2 | QRKKVARPPF | 2.91 | QRKKARNTPF | 1.94 | | |
| anC | 5 | 0.41 | 4 | 3 | 1 | yes | RKKVVRPPFN | 93.2 | RKKVARPPFN | 2.91 | RKKARNTPFN | 1.94 | | |
| anC | 6 | 0.48 | 5 | 4 | 0 | yes | KKVVRPPFNM | 93.2 | KKVARPPFNM | 2.91 | KKARNTPFNM | 1.94 | NKVVRPSFNM | 0.97 |
| anC | 7 | 0.48 | 5 | 4 | 0 | yes | KVVRPPFNML | 93.2 | KVARPPFNML | 2.91 | KARNTPFNML | 1.94 | RVVRPPFNML | 0.97 |
| anC | 8 | 0.41 | 4 | 3 | 0 | yes | VVRPPFNMLK | 93.2 | VARPPFNMLK | 2.91 | ARNTPFNMLK | 1.94 | | |
| anC | 9 | 0.41 | 4 | 3 | 0 | yes | VRPPFNMLKR | 93.2 | ARPPFNMLKR | 2.91 | RNTPFNMLKR | 1.94 | | |
| anC | 10 | 0.22 | 3 | 2 | 0 | yes | RPPFNMLKRE | 94.17 | NTPFNMLKRE | 2.91 | | | | |
| anC | 11 | 0.22 | 3 | 2 | 0 | yes | PPFNMLKRER | 94.17 | TPFNMLKRER | 2.91 | | | | |
| anC | 12 | 0.08 | 2 | 1 | 0 | yes | PFNMLKRERN | 99.03 | | | | | | |
| anC | 13 | 0 | 1 | 1 | 0 | yes | FNMLKRERNR | 100 | | | | | | |
| anC | 14 | 0 | 1 | 1 | 0 | yes | NMLKRERNRV | 100 | | | | | | |
| anC | 15 | 0 | 1 | 1 | 0 | yes | MLKRERNRVS | 100 | | | | | | |
| anC | 16 | 0 | 1 | 1 | 0 | yes | LKRERNRVST | 100 | | | | | | |
| anC | 17 | 0.22 | 3 | 2 | 0 | yes | KRERNRVSTP | 97.09 | KRERNRVSTV | 1.94 | | | | |
| anC | 18 | 0.22 | 3 | 2 | 0 | yes | RERNRVSTPQ | 97.09 | RERNRVSTVQ | 1.94 | | | | |
| anC | 19 | 0.22 | 3 | 2 | 0 | yes | ERNRVSTPQG | 97.09 | ERNRVSTVQQ | 1.94 | | | | |
| anC | 20 | 0.22 | 3 | 2 | 0 | yes | RNRVSTPQGL | 97.09 | RNRVSTVQQL | 1.94 | | | | |
| anC | 21 | 0.22 | 3 | 2 | 0 | yes | NRVSTPQGLV | 97.09 | NRVSTVQQLT | 1.94 | | | | |
| anC | 22 | 0.22 | 3 | 2 | 0 | yes | RVSTPQGLVK | 97.09 | RVSTVQQLTK | 1.94 | | | | |
| anC | 23 | 0.22 | 3 | 2 | 0 | yes | VSTPQGLVKR | 97.09 | VSTVQQLTKR | 1.94 | | | | |
| anC | 24 | 0.22 | 3 | 2 | 0 | yes | STPQGLVKRF | 97.09 | STVQQLTKRF | 1.94 | | | | |
| anC | 25 | 0.22 | 3 | 2 | 0 | yes | TPQGLVKRFS | 97.09 | TVQQLTKRFS | 1.94 | | | | |
| anC | 26 | 0.59 | 5 | 4 | 0 | yes | PQGLVKRFST | 91.26 | PQGLVKRFSS | 3.88 | VQQLTKRFSL | 1.94 | PQGLVKRFSI | 1.94 |

FIG. 16-2

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides required to c

FIG. 16-3

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 52 | 0.14 | 2 | 2 | 0 | yes | TFLRVLSIPP | 98.06 | AFLRF

FIG. 16-4

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 77 | 0.89 | 5 | 4 | 0 | y

FIG. 16-5

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | pe

FIG. 16-6

Species: DENV4 (10-mers)

| protein | block starting position | block entropy | total peptides in block | peptides to cover 99% of block | gap/x fraction | 99% of block covered w/ <= 5 peptides? | peptides to cover 99% of block | frequency | peptides required to cover 99% of block | frequency | peptides required to cover 99% of block | frequency |
|---|---|---|---|---|---|---|---|---|---|---|---|---|
| pM | 132 | 0.14 | 2 | 2 | 0 | yes | ERGRPLLFKT | 98.06 | ENGKSLLFKT | 1.94 | | |
| pM | 133 | 0.14 | 2 | 2 | 0 | yes | RGRPLLFKTT | 98.06 | KGKSLLFKTE | 1.94 | | |
| pM | 134 | 0.14 | 2 | 2 | 0 | yes | GRPLLFKTTE | 98.06 | GKSLLFKTED | 1.94 | | |
| pM | 135 | 0.14 | 2 | 2 | 0 | yes | RPLLFKTTEG | 98.06 | KSLLFKTEDG | 1.94 | | |
| pM | 136 | 0.22 | 3 | 2 | 0 | yes | PLLFKTTEGI | 97.09 | SLLFKTEDGV | 1.94 | | |
| pM | 137 | 0.22 | 3 | 2 | 0 | yes | LLFKTTEGIN | 97.09 | LLFKTEDGVN | 1.94 | | |
| pM | 138 | 0.3 | 4 | 3 | 0 | yes | LFKTTEGINK | 96.12 | LFKTEDGVNM | 1.94 | LFKTTEGINK | 0.97 |
| pM | 139 | 0.3 | 4 | 3 | 0 | yes | FKTTEGINKC | 96.12 | FKTEDGVNMC | 1.94 | FKTTEGTNKC | 0.97 |
| pM | 140 | 0.3 | 4 | 3 | 0 | yes | KTTEGINKCT | 96.12 | KTEDGVNMCT | 1.94 | KTTEGINRCT | 0.97 |
| pM | 141 | 0.3 | 4 | 3 | 0 | yes | TTEGINKCTL | 96.12 | TEDGVNMCTL | 1.94 | TTEGINKCTL | 0.97 |
| pM | 142 | 0.3 | 4 | 3 | 0 | yes | TEGINKCTLI | 96.12 | EDGVNMCTLM | 1.94 | TEGINKCTLI | 0.97 |
| pM | 143 | 0.3 | 4 | 3 | 0 | yes | EGINKCTLIA | 96.12 | DGVNMCTLMA | 1.94 | EGTNKCTLIA | 0.97 |
| pM | 144 | 0.3 | 4 | 3 | 0 | yes | GINKCTLIAM | 96.12 | GVNMCTLMAM | 1.94 | GINRCTLIAM | 0.97 |
| pM | 145 | 0.3 | 4 | 3 | 0 | yes | INKCTLIAMD | 96.12 | VNMCTLMAMD | 1.94 | INRCTLIAMD | 0.97 |
| pM | 146 | 0.22 | 3 | 2 | 0 | yes | NKCTLIAMDL | 97.09 | NMCTLMAMDL | 1.94 | | |
| pM | 147 | 0.22 | 3 | 2 | 0 | yes | KCTLIAMDLG | 97.09 | MCTLMAMDLG | 1.94 | | |
| pM | 148 | 0.22 | 3 | 2 | 0 | yes | CTLIAMDLGE | 97.09 | CTLMAMDLGE | 1.94 | | |
| pM | 149 | 0.22 | 3 | 2 | 0 | yes | TLIAMDLGEM | 97.09 | TLMAMDLGEL | 1.94 | | |
| pM | 150 | 0.22 | 3 | 2 | 0 | yes | LIAMDLGEMC | 97.09 | LMAMDLGELC | 1.94 | | |
| pM | 151 | 0.22 | 3 | 2 | 0 | yes | IAMDLGEMCE | 97.09 | MAMDLGELCE | 1.94 | | |
| pM | 152 | 0.22 | 3 | 2 | 0 | yes | AMDLGEMCED | 97.09 | AMDLGELCED | 1.94 | | |
| pM | 153 | 0.22 | 3 | 2 | 0 | yes | MDLGEMCEDT | 97.09 | MDLGELCEDT | 1.94 | | |
| pM | 154 | 0.22 | 3 | 2 | 0 | yes | DLGEMCEDTV | 97.09 | DLGELCEDTI | 1.94 | | |
| pM | 155 | 0.22 | 3 | 2 | 0 | yes | LGEMCEDTVT | 97.09 | LGELCEDTIT | 1.94 | | |
| pM | 156 | 0.14 | 2 | 2 | 0 | yes | GEMCEDTVTY | 98.06 | GELCEDTITY | 1.94 | | |

FIG. 16-7

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| pM | 157 | 0.28 | 3 | 3 | 0 | yes | EMCEDTVTYK | 96.12 | EMCEDTVTYE | 1.94 | | | | |
| pM | 158 | 0.28 | 3 | 3 | 0 | yes | MCEDTVTYKC | 96.12 | MCEDTVTYEC | 1.94 | | | | |
| pM | 159 | 0.28 | 3 | 3 | 0 | yes | CEDTVTYKCP | 96.12 | CEDTITYKCP | 1.94 | | | | |
| pM | 160 | 0.28 | 3 | 3 | 0 | yes | EDTVTYKCPL | 96.12 | EDTITYKCPL | 1.94 | | | | |
| pM | 161 | 0.28 | 3 | 3 | 0 | yes | DTVTYKCPLL | 96.12 | DTITYKCPLL | 1.94 | | | | |
| pM | 162 | 0.55 | 4 | 4 | 0 | yes | TVTYKCPLLV | 91.26 | TVTYKCPLLI | 4.85 | TITYKCPLLR | 1.94 | | |
| pM | 163 | 0.55 | 4 | 4 | 0 | yes | VTYKCPLLVN | 91.26 | VTYKCPLLIN | 4.85 | VTYECPLLVN | 1.94 | | |
| pM | 164 | 0.55 | 4 | 4 | 0 | yes | TYKCPLLVNT | 91.26 | TYKCPLLINT | 4.85 | TYECPLLVNT | 1.94 | | |
| pM | 165 | 0.55 | 4 | 4 | 0 | yes | YKCPLLVNTE | 91.26 | YKCPLLINTE | 4.85 | YKCPLLRQNE | 1.94 | | |
| pM | 166 | 0.55 | 4 | 4 | 0 | yes | KCPLLVNTEP | 91.26 | KCPLLINTEP | 4.85 | ECPLLVNTEP | 1.94 | KCPLLRQNEP | 1.94 |
| pM | 167 | 0.42 | 3 | 3 | 0 | yes | CPLLVNTEPE | 93.2 | CPLLINTEPE | 4.85 | CPLLRQNEPE | 1.94 | | |
| pM | 168 | 0.42 | 3 | 3 | 0 | yes | PLLVNTEPED | 93.2 | PLLINTEPED | 4.85 | PLLRQNEPED | 1.94 | | |
| pM | 169 | 0.42 | 3 | 3 | 0 | yes | LLVNTEPEDI | 93.2 | LLINTEPEDI | 4.85 | LLRQNEPEDI | 1.94 | | |
| pM | 170 | 0.42 | 3 | 3 | 0 | yes | LVNTEPEDID | 93.2 | LINTEPEDID | 4.85 | LRQNEPEDID | 1.94 | | |
| pM | 171 | 0.42 | 3 | 3 | 0 | yes | VNTEPEDIDC | 93.2 | INTEPEDIDC | 4.85 | RQNEPEDIDC | 1.94 | | |
| pM | 172 | 0.14 | 2 | 2 | 0 | yes | NTEPEDIDCW | 98.06 | QNEPEDIDCW | 1.94 | | | | |
| pM | 173 | 0.14 | 2 | 2 | 0 | yes | TEPEDIDCWC | 98.06 | NEPEDIDCWC | 1.94 | | | | |
| pM | 174 | 0 | 1 | 1 | 0 | yes | EPEDIDCWCN | 100 | | | | | | |
| pM | 175 | 0.19 | 2 | 2 | 0 | yes | PEDIDCWCNL | 97.09 | PEDIDCWCNS | 2.91 | | | | |
| pM | 176 | 0.19 | 2 | 2 | 0 | yes | EDIDCWCNLT | 97.09 | EDIDCWCNST | 2.91 | | | | |
| pM | 177 | 0.27 | 3 | 2 | 0 | yes | DIDCWCNLTS | 96.12 | DIDCWCNSTS | 2.91 | | | | |
| pM | 178 | 0.62 | 4 | 3 | 0 | yes | IDCWCNLTST | 89.32 | IDCWCNLTSA | 6.8 | IDCWCNSTST | 2.91 | | |
| pM | 179 | 0.62 | 4 | 3 | 0 | yes | DCWCNLTSTW | 89.32 | DCWCNLTSAW | 6.8 | DCWCNSTSTW | 2.91 | | |
| pM | 180 | 0.62 | 4 | 3 | 0 | yes | CWCNLTSTWV | 89.32 | CWCNLTSAWV | 6.8 | CWCNSTSTWV | 2.91 | | |
| pM | 181 | 0.62 | 4 | 3 | 0 | yes | WCNLTSTWVM | 89.32 | WCNLTSAWVM | 6.8 | WCNSTSTWVT | 2.91 | | |

FIG. 16-8

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 182 | 0.62 | 4 | 3 | 0 | yes | CNLTSTWMY | 89.32 | CNLTSAWWMY | 6.8 | CNSTSTWMTY | 2.91 | | |
| prM | 183 | 0.62 | 4 | 3 | 0 | yes | NLTSTWMYG | 89.32 | NLTSAWMYG | 6.8 | NSTSTWTYG | 2.91 | | |
| prM | 184 | 0.62 | 4 | 3 | 0 | yes | LTSTWMYGT | 89.32 | LTSAWMYGT | 6.8 | SISTWTYGT | 2.91 | | |
| prM | 185 | 0.62 | 4 | 3 | 0 | yes | TSTWMYGTC | 89.32 | TSAWMYGTC | 6.8 | TSTWTYGTC | 2.91 | | |
| prM | 186 | 0.62 | 4 | 3 | 0 | yes | STWMYGTCT | 89.32 | SAWMYGTCT | 6.8 | STWTYGTCT | 2.91 | | |
| prM | 187 | 0.57 | 4 | 3 | 0 | yes | TWMYGTCTQ | 90.29 | AWMYGTCTQ | 6.8 | TWTYGTCTT | 1.94 | | |
| prM | 188 | 0.41 | 4 | 3 | 0 | yes | WMYGTCTQS | 94.17 | WMYGTCTQN | 2.91 | WTYGTCTTT | 1.94 | | |
| prM | 189 | 0.41 | 4 | 3 | 0 | yes | MYGTCTQSG | 94.17 | VMYGTCTQNG | 2.91 | VTYGTCTTG | 1.94 | | |
| prM | 190 | 0.41 | 4 | 3 | 0 | yes | MYGTCTQSGE | 94.17 | MYGTCTQNGE | 2.91 | TYGTCTTTGE | 1.94 | | |
| prM | 191 | 0.33 | 3 | 3 | 0 | yes | YGTCTQSGER | 95.15 | YGTCTQNGER | 2.91 | YGTCTTTGEH | 1.94 | | |
| prM | 192 | 0.33 | 3 | 3 | 0 | yes | GTCTQSGERR | 95.15 | GTCTQNGERR | 2.91 | GTCTTTGEHR | 1.94 | | |
| prM | 193 | 0.33 | 3 | 3 | 0 | yes | TCTQSGERRE | 95.15 | TCTQNGERRE | 2.91 | TCTTTGEHRR | 1.94 | | |
| prM | 194 | 0.33 | 3 | 3 | 0 | yes | CTQSGERREK | 95.15 | CTQNGERREK | 2.91 | CTTTGEHRRE | 1.94 | | |
| prM | 195 | 0.33 | 3 | 3 | 0 | yes | TQSGERREKR | 95.15 | TQNGERREKR | 2.91 | TTTGEHRREK | 1.94 | | |
| prM | 196 | 0.33 | 3 | 3 | 0 | yes | QSGERREKRS | 95.15 | QNGERREKRS | 2.91 | TTGEHRREKR | 1.94 | | |
| prM | 197 | 0.33 | 3 | 3 | 0 | yes | SGERREKRSV | 95.15 | NGERREKRSV | 2.91 | TGEHRREKRS | 1.94 | | |
| prM | 198 | 0.14 | 2 | 2 | 0 | yes | GERREKRSVA | 98.06 | GEHRREKRSV | 1.94 | | | | |
| prM | 199 | 0.14 | 2 | 2 | 0 | yes | ERREKRSVAL | 98.06 | EHRREKRSVA | 1.94 | | | | |
| prM | 200 | 0.14 | 2 | 2 | 0 | yes | RREKRSVALT | 98.06 | HRREKRSVAL | 1.94 | | | | |
| prM | 201 | 0.22 | 3 | 2 | 0 | yes | RREKRSVALT | 97.09 | RREKRSVALV | 1.94 | | | | |
| prM | 202 | 0.22 | 3 | 2 | 0 | yes | REKRSVALTP | 97.09 | REKRSVALYP | 1.94 | | | | |
| prM | 203 | 0.22 | 3 | 2 | 0 | yes | EKRSVALTPH | 97.09 | EKRSVALVPH | 1.94 | | | | |
| prM | 204 | 0.22 | 3 | 2 | 0 | yes | KRSVALTPHS | 97.09 | KRSVALVPHV | 1.94 | | | | |
| prM | 205 | 0.22 | 3 | 2 | 0 | yes | RSVALTPHSG | 97.09 | RSVALVPHVG | 1.94 | | | | |
| prM | 206 | 0.22 | 3 | 2 | 0 | yes | SVALTPHSGM | 97.09 | SVALVPHVGM | 1.94 | | | | |

Species: DENV4 (10-mers)

FIG. 16-9

Species: DENV4 (10-mers)

| protein | block starting position | block entropy | total peptides in block | peptides to c

FIG. 16-10

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of

FIG. 16-11

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| pM | 257 | 0.43 | 5 | 4 | 0 | yes | MIGQTGIQRT | 94.17 | T

FIG. 16-12

Species: DENV4 (10-mers)

| protein | block starting position | block entropy | total peptides in block | peptides to cover 99% of block | gap/x fraction | 99% of block covered w/ =< 5 peptides? | peptides required to cover 99% of block

FIG. 16-13

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | pept

Species: DENV4 (10-mers)

| protein | block starting position | block entropy | total peptides | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 357 | 0.14 | 2 | 2 | 0 | yes | QGEPYLKEEQ | 98.06 | QGEPSLNEEQ | 1.94 | | | | |
| E | 358 | 0.14 | 2 | 2 | 0 | yes | GEPYLKEEQD | 98.06 | GEPSLNEEQD | 1.94 | | | | |
| E | 359 | 0.22 | 3 | 2 | 0 | yes | EPYLKEEQDQ | 97.09 | EPSLNEEQDK | 1.94 | | | | |
| E | 360 | 0.22 | 3 | 2 | 0 | yes | PYLKEEQDQQ | 97.09 | PSLNEEQDKR | 1.94 | | | | |
| E | 361 | 0.22 | 3 | 2 | 0 | yes | YLKEEQDQQY | 97.09 | SLNEEQDKRF | 1.94 | | | | |
| E | 362 | 0.22 | 3 | 2 | 0 | yes | LKEEQDQQYI | 97.09 | LNEEQDKRFV | 1.94 | | | | |
| E | 363 | 0.22 | 3 | 2 | 0 | yes | KEEQDQQYIC | 97.09 | NEEQDKRFVC | 1.94 | | | | |
| E | 364 | 0.22 | 3 | 2 | 0 | yes | EEQDQQYICR | 97.09 | EEQDKRFVCK | 1.94 | | | | |
| E | 365 | 0.22 | 3 | 2 | 0 | yes | EQDQQYICRR | 97.09 | EQDKRFVCKH | 1.94 | | | | |
| E | 366 | 0.3 | 4 | 3 | 0 | yes | QDQQYICRRD | 96.12 | QDKRFVCKHS | 1.94 | QDRQYICRRD | 0.97 | | |
| E | 367 | 0.43 | 5 | 4 | 0 | yes | DQQYICRRDV | 94.17 | DKRFVCKHSM | 1.94 | DQQYICRRDM | 1.94 | | |
| E | 368 | 0.43 | 5 | 4 | 0 | yes | QQYICRRDVV | 94.17 | QQYICRRDMV | 1.94 | KRFVCKHSMV | 1.94 | | |
| E | 369 | 0.35 | 4 | 3 | 0 | yes | QYICRRDVVD | 95.15 | RFVCKHSMVD | 1.94 | QYICRRDMVD | 1.94 | | |
| E | 370 | 0.35 | 4 | 3 | 0 | yes | YICRRDVVDR | 95.15 | YICRRDMVDR | 1.94 | FVCK

FIG. 16-16

Species: DENV4 (10-mers)

| protein | block starting position | entropy block | total peptides in block | peptides to cover 99% of block | gap/x fraction | 99% of block covered w/ => 5 peptides? | peptides to cover 99% of block | frequency | peptides to cover 99% of block | frequency | peptides to cover 99% of block | frequency | peptides required

FIG. 16-17

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover

FIG. 16-18

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 432 | 0.35 | 4 | 3 | 0 | yes | GNDTSNHGVT | 95.15 | GNDTGKHGKE | 1.94 | GNDIPNHGVT | 1.94 | | |
| E | 433 | 0.49 | 5 | 4 | 0 | yes | NDTSNHGVTA | 93.2 | NDTGKHGKEI | 1.94 | NDIPNHGVTA | 1.94 | | |
| E | 434 | 0.97 | 6 | 5 | 0 | yes | DTSNHGVTAT | 82.52 | DTSNHGVTAM | 10.68 | DTSNHGVTTT | 1.94 | DTGKHGKEIK | 1.94 |
| E | 435 | 0.94 | 5 | 5 | 0 | yes | TSNHGVTATI | 82.52 | TSNHGVTAMI | 10.68 | TSNHGVTTTI | 1.94 | TGKHGKEIKI | 1.94 |
| E | 436 | 0.94 | 5 | 5 | 0 | yes | SNHGVTATIT | 82.52 | SNHGVTAMIT | 10.68 | SNHGVTTTIT | 1.94 | PNHGVTATIT | 1.94 |
| E | 437 | 0.81 | 4 | 4 | 0 | yes | NHGVTATITP | 84.47 | NHGVTAMITP | 10.68 | NHGVTTTITP | 1.94 | | |
| E | 438 | 0.81 | 4 | 4 | 0 | yes | HGVTATITPR | 84.47 | HGVTAMITPR | 10.68 | HGVTTTITPR | 1.94 | | |
| E | 439 | 0.94 | 5 | 5 | 0 | yes | GVTATITPRS | 82.52 | GVTAMITPRS | 10.68 | GVTTTITPRS | 1.94 | GVTATITPRT | 1.94 | GKEIKITPQS | 1.94 |
| E | 440 | 0.94 | 5 | 5 | 0 | yes | VTATITPRSP | 82.52 | VTAMITPRSP | 10.68 | VTTTITPRSP | 1.94 | KEIKITPQSS | 1.94 | VTATITPRTP | 1.94 |
| E | 441 | 0.94 | 5 | 5 | 0 | yes | TATITPRSPS | 82.52 | TAMITPRSPS | 10.68 | TTTITPRSPS | 1.94 | TATITPRTPS | 1.94 | EIKITPQSSI | 1.94 |
| E | 442 | 1.02 | 6 | 4 | 0 | yes | ATITPRSPSV | 81.55 | AMITPRSPSV | 10.68 | TTITPRSPSV | 1.94 | ATITPRTPSV | 1.94 | IKITPQSSIT | 1.94 |
| E | 443 | 0.84 | 5 | 3 | 0 | yes | TITPRSPSVE | 84.47 | MITPRSPSVE | 10.68 | TITPRTPSVE | 1.94 | | |
| E | 444 | 0.35 | 4 | 3 | 0 | yes | ITPRSPSVEV | 95.15 | ITPRTPSVEV | 1.94 | KITPQSSITE | 1.94 | | |
| E | 445 | 0.57 | 6 | 5 | 0 | yes | TPRSPSVEVK | 92.23 | TPQSSITEAE | 1.94 | TPRSPSVEVE | 1.94 | TPRTPSVEVK | 1.94 | TPRSPSAEVK | 0.97 |
| E | 446 | 0.57 | 6 | 5 | 0 | yes | PRSPSVEVKL | 92.23 | PRTPSVEVKL | 1.94 | PQSSITEAEL | 1.94 | PRSPSVEVEL | 1.94 | PRSPSVEVQL | 0.97 |
| E | 447 | 0.57 | 6 | 4 | 0 | yes | RSPSVEVKLP | 92.23 | RTPSVEVKLP | 1.94 | RSPSVEVELP | 1.94 | QSSITEAELT | 1.94 | RSPSVEVQLP | 0.97 |
| E | 448 | 0.57 | 6 | 4 | 0 | yes | SPSVEVKLPD | 92.23 | TPSVEVKLPD | 1.94 | SPSVEVELPD | 1.94 | SSITEAELTG | 1.94 | SPSAEVKLPD | 0.97 |
| E | 449 | 0.43 | 5 | 3 | 0 | yes | PSVEVKLPDY | 94.17 | PSVEVELPDY | 1.94 | SITEAELTGY | 1.94 | PSAEVKLPDY | 0.97 | |
| E | 450 | 0.43 | 5 | 3 | 0 | yes | SVEVKLPDYG | 94.17 | ITEAELTGYG | 1.94 | SVEVELPDYG | 1.94 | SVEVQLPDYG | 0.97 | |
| E | 451 | 0.43 | 5 | 4 | 0 | yes | VEVKLPDYGE | 94.17 | VEVELPDYGE | 1.94 | TEAELTGYGT | 1.94 | VEVQLPDYGE | 0.97 | |
| E | 452 | 0.35 | 4 | 3 | 0 | yes | EVKLPDYGEL | 95.15 | EVELPDYGEL | 1.94 | EAELTGYGTV | 1.94 | | |
| E | 453 | 0.35 | 4 | 3 | 0 | yes | VKLPDYGELT | 95.15 | AELTGYGTVT | 1.94 | VELPDYGELS | 1.94 | | |
| E | 454 | 0.35 | 4 | 3 | 0 | yes | KLPDYGELTL | 95.15 | ELTGYGTVTM | 1.94 | ELPDYGELSL | 1.94 | | |
| E | 455 | 0.28 | 3 | 3 | 0 | yes | LPDYGELTLD | 96.12 | LTGYGTVTME | 1.94 | LPDYGELSLD | 1.94 | | |
| E | 456 | 0.28 | 3 | 3 | 0 | yes | PDYGELTLDC | 96.12 | TGYGTVTMEC | 1.94 | PDYGELSLDC | 1.94 | | |

FIG. 16-19

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 457 | 0.28 | 3 | 3 | 0 | yes | DYGELTLDCE | 96.12 | DYGELTLDCEP | 1.94 | GYGTVTMECS | 1.94 | | | | |
| E | 458 | 0.28 | 3 | 3 | 0 | yes | YGELTLDCEP | 96.12 | YGTVTMECSP | 1.94 | YGELSLDCEP | 1.94 | | | | |
| E | 459 | 0.28 | 3 | 3 | 0 | yes | GELTLDCEPR | 96.12 | GTVTMECSPR | 1.94 | GELSLDCEPR | 1.94 | | | | |
| E | 460 | 0.28 | 3 | 3 | 0 | yes | ELTLDCEPRS | 96.12 | ELSLDCEPRS | 1.94 | TVTMECSPRT | 1.94 | | | | |
| E | 461 | 0.28 | 3 | 3 | 0 | yes | LTLDCEPRSG | 96.12 | LSLDCEPRSG | 1.94 | VTMECSPRTG | 1.94 | | | | |
| E | 462 | 0.28 | 3 | 3 | 0 | yes | TLDCEPRSGI | 96.12 | SLDCEPRSGI | 1.94 | TMECSPRTGL | 1.94 | | | | |
| E | 463 | 0.14 | 2 | 2 | 0 | yes | LDCEPRSGID | 98.06 | MECSPRTGLD | 1.94 | | | | | | |
| E | 464 | 0.14 | 2 | 2 | 0 | yes | DCEPRSGIDF | 98.06 | ECSPRTGLDF | 1.94 | | | | | | |
| E | 465 | 0.14 | 2 | 2 | 0 | yes | CEPRSGIDFN | 98.06 | CSPRTGLDFN | 1.94 | | | | | | |
| E | 466 | 0.14 | 2 | 2 | 0 | yes | EPRSGIDFNE | 98.06 | SPRTGLDFNE | 1.94 | | | | | | |
| E | 467 | 0.14 | 2 | 2 | 0 | yes | PRSGIDFNEM | 98.06 | PRTGLDFNEM | 1.94 | | | | | | |
| E | 468 | 0.14 | 2 | 2 | 0 | yes | RSGIDFNEMI | 98.06 | RTGLDFNEMV | 1.94 | | | | | | |
| E | 469 | 0.14 | 2 | 2 | 0 | yes | SGIDFNEMIL | 98.06 | TGLDFNEMVL | 1.94 | | | | | | |
| E | 470 | 0.14 | 2 | 2 | 0 | yes | GIDFNEMILM | 98.06 | GLDFNEMVLL | 1.94 | | | | | | |
| E | 471 | 0.41 | 4 | 4 | 0 | yes | IDFNEMILMK | 94.17 | IDFNEMILME | 1.94 | IDFNEMILMR | 1.94 | LDFNEMVLLQ | 1.94 | | |
| E | 472 | 0.41 | 4 | 4 | 0 | yes | DFNEMILMKM | 94.17 | DFNEMILMEM | 1.94 | DFNEMILMQM | 1.94 | DFNEMILMRM | 1.94 | | |
| E | 473 | 0.55 | 5 | 5 | 0 | yes | FNEMILMKMK | 92.23 | FNEMILMEMK | 1.94 | FNEMILMKME | 1.94 | FNEMILMRMK | 1.94 | FNEMVLLQME | 1.94 |
| E | 481 | 0.49 | 4 | 4 | 0 | yes | MKKKTWLVHK | 93.2 | MEKKTWLVHK | 1.94 | MENKAWLVHR | 1.94 | MKTKTWLVHK | 1.94 | | |
| E | 482 | 0.49 | 4 | 4 | 0 | yes | KKKTWLVHKQ | 93.2 | EKKTWLVHKQ | 1.94 | KTKTWLVHKQ | 1.94 | ENKAWLVHRQ | 1.94 | | |
| E | 483 | 0.35 | 4 | 4 | 0 | yes | KKTWLVHKQW | 95.15 | NKAWLVHRQW | 1.94 | TKTWLVHKQW | 1.94 | | | | |
| E | 484 | 0.14 | 2 | 2 | 0 | yes | KTWLVHKQWF | 98.06 | KAWLVHRQWF | 1.94 | | | | | | |
| E | 485 | 0.14 | 2 | 2 | 0 | yes | TWLVHKQWFL | 98.06 | AWLVHRQWFL | 1.94 | | | | | | |
| E | 486 | 0.14 | 2 | 2 | 0 | yes | WLVHKQWFLD | 98.06 | WLVHRQWFLD | 1.94 | | | | | | |
| E | 487 | 0.14 | 2 | 2 | 0 | yes | LVHKQWFLDL | 98.06 | LVHRQWFLDL | 1.94 | | | | | | |
| E | 488 | 0.14 | 2 | 2 | 0 | yes | VHKQWFLDLP | 98.06 | VHRQWFLDLP | 1.94 | | | | | | |

Species: DENV4 (10-mers)

FIG. 16-20

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 489 | 0.14 | 2 | 2 | 0 | yes | HKQWFLDLPL | 98.06 | HRQWFLDLPL | 1.94 | | | | |
| E | 490 | 0.14 | 2 | 2 | 0 | yes | KQWFLDLPLP | 98.06 | RQWFLDLPLP | 1.94 | | | | |
| E | 491 | 0 | 1 | 1 | 0 | yes | QWFLDLPLPW | 100 | | | | | | |
| E | 492 | 0.33 | 3 | 3 | 0 | yes | WFLDLPLPWT | 95.15 | WFLDLPLPWL | 2.91 | WFLDLPLPWA | 1.94 | | |
| E | 493 | 1.15 | 4 | 4 | 0 | yes | FLDLPLPWTA | 67.96 | FLDLPLPWTT | 27.18 | FLDLPLPWAA | 2.91 | FLDLPLPWLP | 1.94 | |
| E | 494 | 1.15 | 4 | 4 | 0 | yes | LDLPLPWTAG | 67.96 | LDLPLPWTTG | 27.18 | LDLPLPWAAG | 2.91 | LDLPLPWLPG | 1.94 | |
| E | 495 | 1.15 | 4 | 4 | 0 | yes | DLPLPWTAGA | 67.96 | DLPLPWTTGA | 27.18 | DLPLPWAAGA | 2.91 | DLPLPWLPGA | 1.94 | |
| E | 496 | 1.15 | 4 | 4 | 0 | yes | LPLPWTAGAD | 67.96 | LPLPWTTGAD | 27.18 | LPLPWAAGAD | 2.91 | LPLPWLPGAD | 1.94 | |
| E | 497 | 1.15 | 4 | 4 | 0 | yes | PLPWTAGADT | 67.96 | PLPWTTGADT | 27.18 | PLPWAAGADT | 2.91 | PLPWLPGADT | 1.94 | LPWLPGADTQ | 1.94 |
| E | 498 | 1.28 | 5 | 5 | 0 | yes | LPWTAGADTS | 66.02 | LPWTGADTS | 27.18 | LPWAAGADTS | 2.91 | LPWTAGADTL | 1.94 | PWTAGADTLE | 1.94 |
| E | 499 | 1.28 | 5 | 5 | 0 | yes | PWTAGADTSE | 66.02 | PWTTGADTSE | 27.18 | PWAAGADTSE | 2.91 | PWLPGADTQG | 1.94 | WLPGADTQGS | 1.94 |
| E | 500 | 1.28 | 5 | 5 | 0 | yes | WTAGADTSEV | 66.02 | WTTGADTSEV | 27.18 | WAAGADTSEV | 2.91 | WTAGADTLEV | 1.94 | TAGADTLEVH | 1.94 |
| E | 501 | 1.28 | 5 | 4 | 0 | yes | TAGADTSEVH | 66.02 | TTGADTSEVH | 27.18 | AAGADTSEVH | 2.91 | LPGADTQGSN | 1.94 | |
| E | 502 | 1.1 | 4 | 3 | 0 | yes | AGADTSEVHW | 68.93 | TGADTSEVHW | 27.18 | PGADTQGSNW | 1.94 | AGADTLEVHW | 1.94 | |
| E | 503 | 0.28 | 3 | 3 | 0 | yes | GADTSEVHWN | 96.12 | GADTQGSNWI | 1.94 | GADTLEVHWN | 1.94 | | |
| E | 504 | 0.46 | 3 | 3 | 0 | yes | ADTSEVHWNY | 93.2 | ADTSEVHWNH | 2.91 | ADTQGSNWIQ | 1.94 | | |
| E | 505 | 0.46 | 3 | 3 | 0 | yes | DTSEVHWNYK | 93.2 | DTLEVHWNHK | 2.91 | DTQGSNWIQK | 1.94 | | |
| E | 506 | 0.46 | 3 | 3 | 0 | yes | TSEVHWNYKE | 93.2 | TSEVHWNHKE | 2.91 | TLEVHWNHKE | 1.94 | | |
| E | 507 | 0.46 | 3 | 3 | 0 | yes | SEVHWNYKER | 93.2 | SEVHWNHKER | 2.91 | LEVHWNHKER | 1.94 | | |
| E | 508 | 0.42 | 3 | 3 | 0 | yes | EVHWNYKERM | 93.2 | EVHWNHKERM | 4.85 | TQGSNWIQKE | 1.94 | | |
| E | 509 | 0.42 | 3 | 3 | 0 | yes | VHWNYKERMV | 93.2 | VHWNHKERMV | 4.85 | QGSNWIQKET | 1.94 | | |
| E | 510 | 0.42 | 3 | 3 | 0 | yes | HWNYKERMVT | 93.2 | HWNHKERMVT | 4.85 | GSNWIQKETL | 1.94 | | |
| E | 511 | 0.42 | 3 | 3 | 0 | yes | WNYKERMVTF | 93.2 | WNHKERMVTF | 4.85 | SNWIQKETLV | 1.94 | | |
| E | 512 | 0.42 | 3 | 3 | 0 | yes | NYKERMVTFK | 93.2 | NHKERMVTFK | 4.85 | NWIQKETLVT | 1.94 | | |
| E | 513 | 0.42 | 3 | 3 | 0 | yes | YKERMVTFKV | 93.2 | HKERMVTFKV | 4.85 | WIQKETLVTF | 1.94 | | |

FIG. 16-21

Species: DENV4 (10-mers)

| protein

FIG. 16-22

Species: DENV4 (10-mers)

| protein | block starting position | block entropy | total peptides in block | peptides to cover 99% of block | gap/x fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|

FIG. 16-23

Species: DENV4 (10-mers)

| protein | block starting position | block entropy | total peptides in block | peptides required to cover 99% of block | gap/x fraction | 99% of block covered w/ => 5 peptides? | peptides required to cover 99% of block | frequency | peptides required to cover 99

FIG. 16-24

Species: DENV4 (10-mers)

| protein | block starting position | entropy block | total peptides | peptides in block to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 589 | 0.28 | 3 | 3 | 0 | yes | DKEMAETQHG | 96.12 | DREMAETQHG | 1.94 | VKEIAETQHG | 1.94 | | |
| E | 590 | 0.28 | 3 | 3 | 0 | yes | KEMAETQHGT | 96.12 | KEIAETQHGT | 1.94 | REMAETQHGT | 1.94 | | |
| E | 591 | 0.22 | 3 | 2 | 0 | yes | EMAETQHGTT | 97.09 | EIAETQHGTI | 1.94 | | | | |
| E | 592 | 0.22 | 3 | 2 | 0 | yes | MAETQHGTTV | 97.09 | IAETQHGTIV | 1.94 | | | | |
| E | 593 | 0.3 | 4 | 3 | 0 | yes | AETQHGTTVV | 96.12 | AETQHGTIVI | 1.94 | AETQHGTIVI | 0.97 | | |
| E | 594 | 0.3 | 4 | 3 | 0 | yes | ETQHGTTVVK | 96.12 | ETQHGTIVIR | 1.94 | ETQHGTIVIK | 0.97 | | |
| E | 595 | 0.3 | 4 | 3 | 0 | yes | TQHGTTVVKV | 96.12 | TQHGTIVIRV | 1.94 | TQHGTAVVKV | 0.97 | | |
| E | 596 | 0.3 | 4 | 3 | 0 | yes | QHGTTVVKVK | 96.12 | QHGTIVIRVQ | 1.94 | QHGTAVVKVK | 0.97 | | |
| E | 597 | 0.3 | 4 | 3 | 0 | yes | HGTTVVKVKY | 96.12 | HGTIVIRVQY | 1.94 | HGTTVIKVKY | 0.97 | | |
| E | 598 | 0.3 | 4 | 3 | 0 | yes | GTTVVKVKYE | 96.12 | GTIVIRVQYE | 1.94 | GTAVVKVKYE | 0.97 | | |
| E | 599 | 0.3 | 4 | 3 | 0 | yes | TTVVKVKYEG | 96.12 | TIVIRVQYEG | 1.94 | TTVIKVKYEG | 0.97 | TVIKVKYEGA | 0.97 |
| E | 600 | 0.57 | 5 | 4 | 0 | yes | TVVKVKYEGA | 91.26 | TVVKVKYEGT | 4.85 | IVIRVQYEGD | 1.94 | | |
| E | 601 | 0.49 | 5 | 3 | 0 | yes | VVKVKYEGAG | 92.23 | VVKVKYEGTG | 4.85 | VIRVQYEGDG | 1.94 | | |
| E | 602 | 0.49 | 5 | 3 | 0 | yes | VKVKYEGAGA | 92.23 | VKVKYEGTGA | 4.85 | IRVQYEGDGS | 1.94 | | |
| E | 603 | 0.42 | 5 | 3 | 0 | yes | KVKYEGAGAP | 93.2 | KVKYEGTGAP | 4.85 | RVQYEGDGSP | 1.94 | | |
| E | 604 | 0.42 | 5 | 3 | 0 | yes | VKYEGAGAPC | 93.2 | VKYEGTGAPC | 4.85 | VQYEGDGSPC | 1.94 | | |
| E | 605 | 0.42 | 5 | 3 | 0 | yes | KYEGAGAPCK | 93.2 | KYEGTGAPCK | 4.85 | QYEGDGSPCK | 1.94 | | |
| E | 606 | 0.59 | 5 | 4 | 0 | yes | YEGAGAPCKV | 91.26 | YEGTGAPCKV | 3.88 | YEGDGSPCKI | 1.94 | YEGDGSPCKI | 1.94 |
| E | 607 | 0.59 | 5 | 4 | 0 | yes | EGAGAPCKVP | 91.26 | EGTGAPCKVP | 3.88 | EGDGSPCKIP | 1.94 | EGAGAPCKIP | 1.94 |
| E | 608 | 0.59 | 5 | 4 | 0 | yes | GAGAPCKVPI | 91.26 | GTGAPCKVPI | 3.88 | GAGAPCKIPI | 1.94 | GDGSPCKIPF | 1.94 |
| E | 609 | 0.59 | 3 | 3 | 0 | yes | AGAPCKVPIE | 95.15 | TGAPCKVPIE | 3.88 | DGSPCKIPFE | 1.94 | AGAPCKIPIE | 1.94 |
| E | 610 | 0.33 | 3 | 3 | 0 | yes | GAPCKVPIEI | 95.15 | GAPCKIPIEI | 2.91 | GSPCKIPFEI | 1.94 | | |
| E | 611 | 0.35 | 4 | 3 | 0 | yes | APCKVPIEIR | 95.15 | SPCKIPFEIM | 1.94 | APCKIPIEIR | 1.94 | | |
| E | 612 | 0.35 | 4 | 3 | 0 | yes | PCKVPIEIRD | 95.15 | PCKIPIEIRD | 1.94 | PCKIPFEIMD | 1.94 | | |
| E | 613 | 0.35 | 4 | 3 | 0 | yes | CKVPIEIRDV | 95.15 | CKIPIEIRDV | 1.94 | CKIPFEIMDL | 1.94 | | |

FIG. 16-25

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 614 | 0.35 | 4 | 3 | 0 | yes | KVPIEIRDV

FIG. 16-26

Species: DENV4 (10-mers)

| protein | block starting position | entropy block | total peptides in block | peptides to cover 99% of block | gap fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 655 | 1.04 | 6 | 5 | 0 | yes | yes | DSYIVIGVGN | 78.64 | DSYIVIGVGD | 15.53 | DSYIMIGVGN | 1.94 | DSYIVIGAGD | 0.97 |
| E | 656 | 1.04 | 6 | 5 | 0 | yes | yes | SYIVIGVGNS | 78.64 | SYIVIGVGDS | 15.53 | SYIMIGVGNS | 1.94 | SYIIIGVGDS | 0.97 |
| E | 657 | 1.04 | 6 | 5 | 0 | yes | yes | YIVIGVGNSA | 78.64 | YIVIGVGDSA | 15.53 | YIIIGVGNSA | 1.94 | YIVIGAGDSA | 0.97 |
| E | 658 | 1.04 | 6 | 5 | 0 | yes | yes | IVIGVGNSAL | 78.64 | IVIGVGDSAL | 15.53 | IMIGVGNSAL | 1.94 | IIGVGDSAL | 0.97 |
| E | 659 | 1.04 | 6 | 5 | 0 | yes | yes | VIGVGNSALT | 78.64 | VIGVGDSALT | 15.53 | MIGVGNSALT | 1.94 | IIGVGDSALT | 0.97 |
| E | 660 | 0.86 | 4 | 3 | 0 | yes | yes | IGVGNSALTL | 80.58 | IGVGDSALTL | 16.5 | IGVEPGQLKL | 1.94 | | |
| E | 661 | 0.86 | 4 | 3 | 0 | yes | yes | GVGNSALTLH | 80.58 | GVGDSALTLH | 16.5 | GVEPGQLKLN | 1.94 | | |
| E | 662 | 0.86 | 4 | 3 | 0 | yes | yes | VGNSALTLHW | 80.58 | VGDSALTLHW | 16.5 | VEPGQLKLNW | 1.94 | | |
| E | 663 | 0.8 | 3 | 3 | 0 | yes | yes | GNSALTLHWF | 80.58 | GDSALTLHWF | 17.48 | EPGQLKLNWF | 1.94 | | |
| E | 664 | 0.8 | 3 | 3 | 0 | yes | yes | NSALTLHWFR | 80.58 | DSALTLHWFR | 17.48 | PGQLKLNWFK | 1.94 | | |
| E | 665 | 0.22 | 3 | 2 | 0 | yes | yes | SALTLHWFRK | 97.09 | GQLKLNWFKK | 1.94 | | | | |
| E | 666 | 0.22 | 3 | 2 | 0 | yes | yes | ALTLHWFRKG | 97.09 | QLKLNWFKKG | 1.94 | | | | |
| E | 667 | 0.22 | 3 | 2 | 0 | yes | yes | LTLHWFRKGS | 97.09 | LKLNWFKKGS | 1.94 | | | | |
| E | 668 | 0.22 | 3 | 2 | 0 | yes | yes | TLHWFRKGSS | 97.09 | KLNWFKKGSS | 1.94 | | | | |
| E | 669 | 0.22 | 3 | 2 | 0 | yes | yes | LHWFRKGSSI | 97.09 | LNWFKKGSSI | 1.94 | | | | |
| E | 670 | 0.22 | 3 | 2 | 0 | yes | yes | HWFRKGSSIG | 97.09 | NWFKKGSSIG | 1.94 | | | | |
| E | 671 | 0.22 | 3 | 2 | 0 | yes | yes | WFRKGSSIGK | 97.09 | WFKKGSSIGQ | 1.94 | | | | |
| E | 672 | 0.22 | 3 | 2 | 0 | yes | yes | FRKGSSIGQM | 97.09 | FKKGSSIGQM | 1.94 | | | | |
| E | 673 | 0.35 | 4 | 3 | 0 | yes | yes | RKGSSIGQMF | 95.15 | KKGSSIGQMF | 1.94 | RKGSSIGKML | 1.94 | | |
| E | 674 | 0.35 | 4 | 3 | 0 | yes | yes | KGSSIGQMFE | 95.15 | KGSSIGKMLE | 1.94 | KGSSIGQMFE | 1.94 | | |
| E | 675 | 0.28 | 3 | 3 | 0 | yes | yes | GSSIGQMFES | 96.12 | GSSIGKMLES | 1.94 | GSSIGQMFET | 1.94 | | |
| E | 676 | 0.28 | 3 | 3 | 0 | yes | yes | SSIGQMFEST | 96.12 | SSIGKMLEST | 1.94 | SSIGQMFETT | 1.94 | | |
| E | 677 | 0.28 | 3 | 3 | 0 | yes | yes | SIGQMFESTY | 96.12 | SIGKMLESTY | 1.94 | SIGQMFETTM | 1.94 | | |
| E | 678 | 0.28 | 3 | 3 | 0 | yes | yes | IGQMFESTYR | 96.12 | IGKMLESTYR | 1.94 | IGQMFETTMR | 1.94 | | |
| E | 679 | 0.28 | 3 | 3 | 0 | yes | yes | GQMFESTYRG | 96.12 | GKMLESTYRG | 1.94 | GQMFETTMRG | 1.94 | | |

FIG. 16-27

Species: DENV4 (10-mers)

| protein | block starting position | entropy block | total peptides in block | peptides to cover 99% of block | gap/x fraction | 99% of block covered w/ <= 5 peptides? | peptides required to cover 99% of block | frequency | peptides required to cover 99

FIG. 16-28

Species: DENV4 (10-mers)

| protein | block starting position | entropy | total peptides in block | peptides required to cover 99% of block | gap fraction x | 99% of block covered w/ =< 5 peptides? | peptides required to cover 99% of block | fr

FIG. 16-29

Species: DENV4 (10-mers)

| protein | block starting position | block entropy | total peptides in block | peptides required to cover 99% of block | gap/x fraction | 99% of block covered w/ =>5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 730 | 0.76 | 4 | 3 | 0 | yes | GVSW

FIG. 16-30

| Species: DENV4 (10-mers) | | | | | | | | | | | | | |
|---|---|---|---|---|---|---|---|---|---|---|---|---|---|
| protein | block starting position | entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
| E | 758 | 0.32 | 3 | 2 | 0 | yes | TCIAVGGITL | 95.15 | SCIAVGGITL | 3.88 | | | | |
| E | 759 | 0.08 | 2 | 1 | 0 | yes | CIAVGGITLF | 99.03 | | | | | | |
| E | 760 | 0.08 | 2 | 1 | 0 | yes | IAVGGITLFL | 99.03 | | | | | | |
| E | 761 | 0.08 | 2 | 1 | 0 | yes | AVGGITLFLG | 99.03 | | | | | | |
| E | 762 | 0 | 1 | 1 | 0 | yes | VGGITLFLGF | 100 | | | | | | |
| E | 763 | 0 | 1 | 1 | 0 | yes | GGITLFLGFT | 100 | | | | | | |
| E | 764 | 0 | 1 | 1 | 0 | yes | GITLFLGFTV | 100 | | | | | | |
| E | 765 | 0.36 | 3 | 2 | 0 | yes | ITLFLGFTVQ | 94.17 | ITLFLGFTVH | 4.85 | | | | |
| E | 766 | 0.36 | 3 | 2 | 0 | yes | TLFLGFTVQA | 94.17 | TLFLGFTVHA | 4.85 | | | | |
| E | 767 | 0.36 | 3 | 2 | 0 | yes | LFLGFTVQAD | 94.17 | LFLGFTVHAD | 4.85 | | | | |
| E | 768 | 0.56 | 6 | 5 | 0 | yes | FLGFTVQADM | 92.23 | FLGFTVHADM | 2.91 | FLGFTVHADT | 1.94 | FLGFTVRADM | 0.97 | FLGFTVQADT | 0.97 |
| E | 769 | 0.56 | 6 | 5 | 0 | yes | LGFTVQADMG | 92.23 | LGFTVHADMG | 2.91 | LGFTVHADTG | 1.94 | LGFTVQADVG | 0.97 | LGFTVQADTG | 0.97 |
| E | 770 | 0.56 | 6 | 5 | 0 | yes | GFTVQADMGC | 92.23 | GFTVHADMGC | 2.91 | GFTVHADTGC | 1.94 | GFTVQADTGC | 0.97 | GFTVRADMGC | 0.97 |
| NS1 | 782 | 1.57 | 5 | 5 | 0 | yes | SWSGRELKCG | 59.22 | SWSGKELKCG | 25.24 | SWNGKELKCG | 9.71 | SWNGRELKCG | 3.88 | SWTGKELKCG | 1.94 |
| NS1 | 783 | 1.57 | 5 | 5 | 0 | yes | WSGRELKCGS | 59.22 | WSGKELKCGS | 25.24 | WNGKELKCGS | 9.71 | WNGRELKCGS | 3.88 | WTGKELKCGS | 1.94 |
| NS1 | 784 | 1.57 | 5 | 5 | 0 | yes | SGRELKCGSG | 59.22 | SGKELKCGSG | 25.24 | NGKELKCGSG | 9.71 | NGRELKCGSG | 3.88 | TGKELKCGSG | 1.94 |
| NS1 | 785 | 0.95 | 2 | 2 | 0 | yes | GRELKCGSGI | 63.11 | GKELKCGSGI | 36.89 | | | | | | |
| NS1 | 786 | 0.95 | 2 | 2 | 0 | yes | RELKCGSGIF | 63.11 | KELKCGSGIF | 36.89 | | | | | | |
| NS1 | 787 | 0 | 1 | 1 | 0 | yes | ELKCGSGIFV | 100 | | | | | | | | |
| NS1 | 788 | 0.63 | 4 | 4 | 0 | yes | LKCGSGIFVW | 89.32 | LKCGSGIFVI | 6.8 | LKCGSGIFVA | 1.94 | LKCGSGIFVT | 1.94 | | |
| NS1 | 789 | 0.63 | 4 | 4 | 0 | yes | KCGSGIFWD | 89.32 | KCGSGIFVID | 6.8 | KCGSGIFVAD | 1.94 | KCGSGIFVTD | 1.94 | | |
| NS1 | 790 | 0.63 | 4 | 4 | 0 | yes | CGSGIFWDN | 89.32 | CGSGIFVIDN | 6.8 | CGSGIFVADN | 1.94 | CGSGIFVTDN | 1.94 | | |
| NS1 | 791 | 0.63 | 4 | 4 | 0 | yes | GSGIFWDNV | 89.32 | GSGIFVIDNV | 6.8 | GSGIFVADNV | 1.94 | GSGIFVTDNV | 1.94 | | |
| NS1 | 792 | 0.63 | 4 | 4 | 0 | yes | SGIFWDNVH | 89.32 | SGIFVIDNVH | 6.8 | SGIFVADNVH | 1.94 | SGIFVTDNVH | 1.94 | | |
| NS1 | 793 | 0.63 | 4 | 4 | 0 | yes | GIFWDNVHT | 89.32 | GIFVIDNVHT | 6.8 | GIFVADNVHT | 1.94 | GIFVTDNVHT | 1.94 | | |

FIG. 16-31

Species: DENV4 (10-mers)

| protein | block starting position | block entropy | total peptides in block | peptides to cover 99% of block | gap/x fraction | 99% of block covered | w/ <= 5 peptides? | peptides required to cover 99% of block

FIG. 16-32

Species: DENV4 (10-mers)

| protein | block starting position | entropy block | total peptides in block | peptides to cover 99% of block | gap/x fraction | 99% of block covered w/ => 5 peptides? | peptides required to cover 99% of block | frequency | peptides required to cover 99% of block | frequency | pept

FIG. 16-33

Species: DENV4 (10-mers)

| protein | block star

FIG. 16-34

Species: DENV4 (10-mers)

| protein | block starting position | entropy block | total peptides in block | peptides to cover 99% of block | gap/x fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 869 | 0.69 | 6 | 5 | 0 | yes | KGVLTKGKRA | 89.32 | KGVLSKGKRA | 5.83 | KGVLVKGKRA | 1.94 | RGVLTKGKRA | 0.97 | KGVLTKGKRT | 0.97 |
| NS1 | 870 | 0.61 | 5 | 4 | 0 | yes | GVLTKGKRAL | 90.29 | GVLSKGKRAL | 5.83 | GVLVKGKRAL | 1.94 | GVLTKGKRTL | 0.97 | VLTKGKRTLT | 0.97 |
| NS1 | 871 | 0.75 | 6 | 5 | 0 | yes | VLTKGKRALT | 88.35 | VLSKGKRALA | 5.83 | VLVKGKRALT | 1.94 | VLTKGKRALA | 1.94 | LTKGKRVIAP | 0.97 |
| NS1 | 872 | 0.75 | 6 | 5 | 0 | yes | LTKGKRALTP | 88.35 | LSKGKRALAP | 5.83 | LVKGKRALTP | 1.94 | LTKGKRALAP | 1.94 | TKGKRVIAPP | 0.97 |
| NS1 | 873 | 0.75 | 6 | 5 | 0 | yes | TKGKRALTPP | 88.35 | SKGKRALAPP | 5.83 | VKGKRALTPP | 1.94 | TKGKRALAPP | 1.94 | KGKRTLTPPV | 0.97 |
| NS1 | 874 | 1.38 | 6 | 5 | 0 | yes | KGKRALTPPV | 65.05 | KGKRALTPPA | 25.24 | KGKRALAPPV | 5.83 | KGKRALAPPA | 1.94 | LAPPASDLKY | 1.94 |
| NS1 | 879 | 1.85 | 6 | 3 | 0 | yes | LTPPYSDLKY | 49.51 | LTPPASDLKY | 25.24 | LTPPVNDLKY | 16.5 | LAPPVNDLKY | 5.83 | APPASDLKYS | 1.94 |
| NS1 | 880 | 1.85 | 6 | 3 | 0 | yes | TPPYSDLKYS | 49.51 | TPPASDLKYS | 25.24 | TPPVNDLKYS | 16.5 | APPVNDLKYS | 5.83 | | |
| NS1 | 881 | 1.49 | 3 | 3 | 0 | yes | PPYSDLKYSW | 50.49 | PPASDLKYSW | 27.18 | PPVNDLKYSW | 22.33 | | | | |
| NS1 | 882 | 1.49 | 3 | 3 | 0 | yes | PYSDLKYSWK | 50.49 | PASDLKYSWK | 27.18 | PVNDLKYSWK | 22.33 | | | | |
| NS1 | 883 | 1.49 | 3 | 3 | 0 | yes | YSDLKYSWKT | 50.49 | ASDLKYSWKT | 27.18 | VNDLKYSWKT | 22.33 | | | | |
| NS1 | 884 | 0.77 | 2 | 2 | 0 | yes | SDLKYSWKTW | 77.67 | NDLKYSWKTW | 22.33 | | | | | | |
| NS1 | 885 | 0 | 1 | 1 | 0 | yes | DLKYSWKTWG | 100 | | | | | | | | |
| NS1 | 886 | 0 | 1 | 1 | 0 | yes | LKYSWKTWGK | 100 | | | | | | | | |
| NS1 | 887 | 0 | 1 | 1 | 0 | yes | KYSWKTWGKA | 100 | | | | | | | | |
| NS1 | 888 | 0.08 | 2 | 2 | 0 | yes | YSWKTWGKAK | 99.03 | | | | | | | | |
| NS1 | 889 | 0.08 | 2 | 2 | 0 | yes | SWKTWGKAKI | 99.03 | | | | | | | | |
| NS1 | 890 | 0.08 | 2 | 2 | 0 | yes | WKTWGKAKIF | 99.03 | | | | | | | | |
| NS1 | 891 | 0.16 | 3 | 2 | 0 | yes | KTWGKAKIFT | 98.06 | KTWGKAKIFA | 0.97 | | | | | | |

FIG. 16-35

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|

FIG. 16-36

Species: DENV4 (10-mers)

| protein | block starting position | entropy | total peptides in block | peptides required to cover 99% of block | gap/x fraction | 99% of block covered w/ <= 5 peptides? | cover 99% of block | fr

FIG. 16-37

Species: DENV4 (10-mers)

| protein | block starting position | entropy block | total peptides in block | peptides to cover 99% of block | gap/x fraction | 99% of block covered w/ <= 5 peptides? | peptides required to cover 99% of block | frequency |
|---|---|---|---|---|---|---|---|---|

FIG. 16-38

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 982 | 0.98 | 2 | 2 | 0 | yes | NQTWQIEKAS | 58.25 | NQTWQIERAS | 41.75 |
| NS1 | 983 | 0.98 | 2 | 2 | 0 | yes | QTWQIEKASL | 58.25 | QTWQIERASL | 41.75 |
| NS1 | 984 | 0.98 | 2 | 2 | 0 | yes | TWQIEKASLI | 58.25 | TWQIERASLI | 41.75 |
| NS1 | 985 | 0.98 | 2 | 2 | 0 | yes | WQIEKASLIE | 58.25 | WQIERASLIE | 41.75 |
| NS1 | 986 | 0.98 | 2 | 2 | 0 | yes | QIEKASLIEV | 58.25 | QIERASLIEV | 41.75 |
| NS1 | 987 | 0.98 | 2 | 2 | 0 | yes | IEKASLIEVK | 58.25 | IERASLIEVK | 41.75 |
| NS1 | 988 | 0.98 | 2 | 2 | 0 | yes | EKASLIEVKT | 58.25 | ERASLIEVKT | 41.75 |
| NS1 | 989 | 0.98 | 2 | 2 | 0 | yes | KASLIEVKTC | 58.25 | RASLIEVKTC | 41.75 |
| NS1 | 990 | 0 | 1 | 1 | 0 | yes | ASLIEVKTCL | 100 | | |
| NS1 | 991 | 0 | 1 | 1 | 0 | yes | SLIEVKTCLW | 100 | | |
| NS1 | 992 | 0 | 1 | 1 | 0 | yes | LIEVKTCLWP | 100 | | |
| NS1 | 993 | 0 | 1 | 1 | 0 | yes | IEVKTCLWPK | 100 | | |
| NS1 | 994 | 0 | 1 | 1 | 0 | yes | EVKTCLWPKT | 100 | | |
| NS1 | 995 | 0 | 1 | 1 | 0 | yes | VKTCLWPKTH | 100 | | |
| NS1 | 996 | 0 | 1 | 1 | 0 | yes | KTCLWPKTHT | 100 | | |
| NS1 | 997 | 0 | 1 | 1 | 0 | yes | TCLWPKTHTL | 100 | | |
| NS1 | 998 | 0 | 1 | 1 | 0 | yes | CLWPKTHTLW | 100 | | |
| NS1 | 999 | 0 | 1 | 1 | 0 | yes | LWPKTHTLWS | 100 | | |
| NS1 | 1000 | 0 | 1 | 1 | 0 | yes | WPKTHTLWSN | 100 | | |
| NS1 | 1001 | 0 | 1 | 1 | 0 | yes | PKTHTLWSNG | 100 | | |
| NS1 | 1002 | 0 | 1 | 1 | 0 | yes | KTHTLWSNGV | 100 | | |
| NS1 | 1003 | 0 | 1 | 1 | 0 | yes | THTLWSNGVL | 100 | | |
| NS1 | 1004 | 0 | 1 | 1 | 0 | yes | HTLWSNGVLE | 100 | | |
| NS1 | 1005 | 0 | 1 | 1 | 0 | yes | TLWSNGVLES | 100 | | |
| NS1 | 1006 | 0 | 1 | 1 | 0 | yes | LWSNGVLESQ | 100 | | |

FIG. 16-39

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99%

FIG. 16-40

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block |

FIG. 16-41

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of

FIG. 16-42

Species: DENV4 (10-mers)

| protein | block starting position | entropy | total peptides in block | peptides to cover 99% of block | gap/x fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1087 | 0 | 1 | 1 | 0 | yes | CCRSCTMPPL | 100 | | | | | | |
| NS1 | 1088 | 0 | 1 | 1 | 0 | yes | CRSCTMPPLR | 100 | | | | | | |
| NS1 | 1089 | 0 | 1 | 1 | 0 | yes | RSCTMPPLRF | 100 | | | | | | |
| NS1 | 1090 | 0 | 1 | 1 | 0 | yes | SCTMPPLRFL | 100 | | | | | | |
| NS1 | 1091 | 0 | 1 | 1 | 0 | yes | CTMPPLRFLG | 100 | | | | | | |
| NS1 | 1092 | 0 | 1 | 1 | 0 | yes | TMPPLRFLGE | 100 | | | | | | |
| NS1 | 1093 | 0 | 1 | 1 | 0 | yes | MPPLRFLGED | 100 | | | | | | |
| NS1 | 1094 | 0 | 1 | 1 | 0 | yes | PPLRFLGEDG | 100 | | | | | | |
| NS1 | 1095 | 0 | 1 | 1 | 0 | yes | PLRFLGEDGC | 100 | | | | | | |
| NS1 | 1096 | 0 | 1 | 1 | 0 | yes | LRFLGEDGCW | 100 | | | | | | |
| NS1 | 1097 | 0 | 1 | 1 | 0 | yes | RFLGEDGCWY | 100 | | | | | | |
| NS1 | 1098 | 0 | 1 | 1 | 0 | yes | FLGEDGCWYG | 100 | | | | | | |
| NS1 | 1099 | 0 | 1 | 1 | 0 | yes | LGEDGCWYGM | 100 | | | | | | |
| NS1 | 1100 | 0 | 1 | 1 | 0 | yes | GEDGCWYGME | 100 | | | | | | |
| NS1 | 1101 | 0 | 1 | 1 | 0 | yes | EDGCWYGMEI | 100 | | | | | | |
| NS1 | 1102 | 0 | 1 | 1 | 0 | yes | DGCWYGMEIR | 100 | | | | | | |
| NS1 | 1103 | 0 | 1 | 1 | 0 | yes | GCWYGMEIRP | 100 | | | | | | |
| NS1 | 1104 | 0.08 | 2 | 1 | 0 | yes | CWYGMEIRPL | 99.03 | | | | | | |
| NS1 | 1105 | 0.6 | 3 | 2 | 0 | yes | WYGMEIRPLS | 87.38 | WYGMEIRPLN | 11.65 | | | | |
| NS1 | 1106 | 0.6 | 3 | 2 | 0 | yes | YGMEIRPLSE | 87.38 | YGMEIRPLNE | 11.65 | | | | |
| NS1 | 1107 | 0.78 | 4 | 3 | 0 | yes | GMEIRPLSEK | 84.47 | GMEIRPLNEK | 11.65 | GMEIRPLSER | 2.91 | | |
| NS1 | 1108 | 0.78 | 4 | 3 | 0 | yes | MEIRPLSEKE | 84.47 | MEIRPLNEKE | 11.65 | MEIRPLSERE | 2.91 | | |
| NS1 | 1109 | 0.78 | 4 | 3 | 0 | yes | EIRPLSEKEE | 84.47 | EIRPLNEKEE | 11.65 | EIRPLSEREE | 2.91 | | |
| NS1 | 1110 | 0.78 | 4 | 3 | 0 | yes | IRPLSEKEEN | 84.47 | IRPLNEKEEN | 11.65 | IRPLSEREEN | 2.91 | | |
| NS1 | 1111 | 0.78 | 4 | 3 | 0 | yes | RPLSEKEENM | 84.47 | RPLNEKEENM | 11.65 | RPLSEREENM | 2.91 | | |

FIG. 16-43

Species: DENV4 (10-mers)

| protein | block starting position | block entropy | total peptides in block | peptides to cover 99% of block | gap/x fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1112 | 0.78 | 4 | 3 | 0 | yes | PLSEKEENMV | 84.47 | PLNEKEENMV | 11.65 | PLSEREENMV | 2.91 | | |
| NS1 | 1113 | 0.86 | 5 | 4 | 0 | yes | LSEKEENMVK | 84.47 | LNEKEENMVK | 9.71 | LSEREENMVK | 2.91 | LNEKEENMVR | 1.94 |
| NS1 | 1114 | 0.78 | 4 | 4 | 0 | yes | SEKEENMVKS | 85.44 | NEKEENMVKS | 9.71 | SEREENMVKS | 2.91 | NEKEENMVKS | 1.94 |
| NS1 | 1115 | 0.33 | 3 | 3 | 0 | yes | EKEENMVKSQ | 95.15 | EREENMVKSQ | 2.91 | EKEENMVRSQ | 1.94 | | |
| NS1 | 1116 | 0.46 | 4 | 4 | 0 | yes | KEENMVKSQV | 93.2 | REENMVKSQV | 2.91 | KEENMVKSQA | 1.94 | KEENMVRSQV | 1.94 |
| NS1 | 1117 | 1.3 | 5 | 5 | 0 | yes | EENMVKSQVT | 70.87 | EENMVKSQVA | 17.48 | EENMVKSQVS | 7.77 | EENMVRSQVT | 1.94 | EENMVKSQAT | 1.94 |
| NS1 | 1118 | 1.3 | 5 | 5 | 0 | yes | ENMVKSQVTA | 70.87 | ENMVKSQVAA | 17.48 | ENMVKSQVSA | 7.77 | ENMVKSQATA | 1.94 | ENMVRSQVTA | 1.94 |
| NS1 | 1119 | 1.3 | 5 | 5 | 0 | yes | NMVKSQVTAG | 70.87 | NMVKSQVAAG | 17.48 | NMVKSQVSAG | 7.77 | NMVKSQATAG | 1.94 | NMVRSQVTAG | 0.97 |
| NS1 | 1130 | 0.61 | 6 | 5 | 0 | yes | GTSETFSMGL | 91.26 | STSETFSMGL | 3.88 | GSSETFSMGL | 1.94 | GTPETFSMGL | 0.97 | GPSETFSMGL | 0.97 |
| NS1 | 1131 | 0.37 | 5 | 4 | 0 | yes | TSETFSMGLL | 95.15 | SSETFSMGLL | 1.94 | PSETFSMGLL | 0.97 | TPETFSMGLL | 0.97 | | |
| NS1 | 1132 | 0.16 | 3 | 2 | 0 | yes | SETFSMGLLC | 98.06 | PETFSMGLLC | 0.97 | | | | | | |
| NS1 | 1133 | 0.08 | 2 | 1 | 0 | yes | ETFSMGLLCL | 99.03 | | | | | | | | |
| NS1 | 1134 | 0.08 | 2 | 1 | 0 | yes | TFSMGLLCLT | 99.03 | | | | | | | | |
| NS1 | 1135 | 0.08 | 2 | 1 | 0 | yes | FSMGLLCLTL | 99.03 | | | | | | | | |
| NS1 | 1136 | 0.08 | 2 | 1 | 0 | yes | SMGLLCLTLF | 99.03 | | | | | | | | |
| NS2A | 1137 | 0.42 | 3 | 3 | 0 | yes | MGLLCLTLFV | 93.2 | MGLLCLTLFM | 4.85 | MGLLCLTLFI | 1.94 | | | | |
| NS2A | 1138 | 0.42 | 3 | 3 | 0 | yes | GLLCLTLFVE | 93.2 | GLLCLTLFME | 4.85 | GLLCLTLFIE | 1.94 | | | | |
| NS2A | 1139 | 0.42 | 3 | 3 | 0 | yes | LLCLTLFVEE | 93.2 | LLCLTLFMEE | 4.85 | LLCLTLFIEE | 1.94 | | | | |
| NS2A | 1140 | 0.42 | 3 | 3 | 0 | yes | LCLTLFVEEC | 93.2 | LCLTLFMEEC | 4.85 | LCLTLFIEEC | 1.94 | | | | |
| NS2A | 1141 | 0.42 | 3 | 3 | 0 | yes | CLTLFVEECL | 93.2 | CLTLFMEECL | 4.85 | CLTLFIEECL | 1.94 | | | | |
| NS2A | 1142 | 0.42 | 3 | 3 | 0 | yes | LTLFVEECLR | 93.2 | LTLFMEECLR | 4.85 | LTLFIEECLR | 1.94 | | | | |
| NS2A | 1143 | 0.42 | 3 | 3 | 0 | yes | TLFVEECLRR | 93.2 | TLFMEECLRR | 4.85 | TLFIEECLRR | 1.94 | | | | |
| NS2A | 1144 | 0.42 | 3 | 3 | 0 | yes | LFVEECLRRR | 93.2 | LFMEECLRRR | 4.85 | LFIEECLRRR | 1.94 | | | | |
| NS2A | 1145 | 0.42 | 3 | 3 | 0 | yes | FVEECLRRRV | 93.2 | FMEECLRRRV | 4.85 | FIEECLRRKV | 1.94 | | | | |
| NS2A | 1146 | 0.42 | 3 | 3 | 0 | yes | VEECLRRRVT | 93.2 | MEECLRRRVT | 4.85 | IEECLRRKVT | 1.94 | | | | |

FIG. 16-44

Species: DENV4 (10-mers)

| protein | block starting position | block entropy | total peptides in block | peptides required to cover 99% of block | gap/x fraction | 99% of block covered w/ => 5 peptides? | peptides required to cover 99% of block | frequency | peptides required to cover 99% of

FIG. 16-45

Species: DENV4 (10-mers)

| protein | block starting position | block entropy | total peptides in block | peptides to cover 99% of block | gap/x fraction | 99% of block covered w/ <= 5 peptides

FIG. 16-46

Species: DENW4 (10-mers)

| protein | block starting position | entropy | total peptides in block | peptides required to cover 99% of block | gap/x fraction | 99% of block covered w/ <= 5 peptides? | cover 99% of block | frequency | cover 99% of block | frequency | cover 99% of block | frequency | cover 99% of block | frequency |
|---|---|---|---|---|---|---|---|---|---|---|---|---|---|---|
| NS2A | 1208 | 0.32 | 2 | 2 | 0 | yes | KMSPGYVLGV

FIG. 16-47

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1233 | 1.53 | 4 | 4 | 0 | yes | GMAMTTTLSI | 55.34 | GMAMTTVLSI | 28.16 | GMAMTTVFSI | 13.59 | GMAMTTTFSI | 2.91 |
| NS2A | 1234 | 1.53 | 4 | 4 | 0 | yes | MAMTTTLSIP | 55.34 | MAMTTVLSIP | 28.16 | MAMTTVFSIP | 13.59 | MAMTTTFSIP | 2.91 |
| NS2A | 1235 | 1.58 | 5 | 4 | 0 | yes | AMTTTLSIPH | 55.34 | AMTTVLSIPH | 28.16 | AMTTVFSIPH | 12.62 | AMTTTFSIPH | 2.91 |
| NS2A | 1236 | 1.58 | 5 | 4 | 0 | yes | MTTTLSIPHD | 55.34 | MTTVLSIPHD | 28.16 | MTVFSIPHD | 12.62 | MTTTFSIPHD | 2.91 |
| NS2A | 1237 | 1.58 | 5 | 4 | 0 | yes | TTTLSIPHDL | 55.34 | TTVLSIPHDL | 28.16 | TTVFSIPHDL | 12.62 | TTFSIPHDL | 2.91 |
| NS2A | 1238 | 1.58 | 5 | 4 | 0 | yes | TTLSIPHDLM | 55.34 | TVLSIPHDLM | 28.16 | TVFSIPHDLM | 12.62 | TFSIPHDLM | 2.91 |
| NS2A | 1239 | 1.58 | 5 | 4 | 0 | yes | TLSIPHDLME | 55.34 | VLSIPHDLME | 28.16 | VFSIPHDLME | 12.62 | TFSIPHDLME | 2.91 |
| NS2A | 1240 | 0.97 | 4 | 3 | 0 | yes | LSIPHDLMEL | 78.64 | FSIPHDLMEL | 15.53 | LSIPHDLMEF | 4.85 | | |
| NS2A | 1241 | 0.36 | 3 | 2 | 0 | yes | SIPHDLMELI | 94.17 | SIPHDLMEFI | 4.85 | | | | |
| NS2A | 1242 | 0.36 | 3 | 2 | 0 | yes | IPHDLMELID | 94.17 | IPHDLMEFID | 4.85 | | | | |
| NS2A | 1243 | 0.36 | 3 | 2 | 0 | yes | PHDLMELIDG | 94.17 | PHDLMEFIDG | 4.85 | | | | |
| NS2A | 1244 | 0.36 | 3 | 2 | 0 | yes | HDLMELIDGI | 94.17 | HDLMEFIDGI | 4.85 | | | | |
| NS2A | 1245 | 0.44 | 4 | 3 | 0 | yes | DLMELIDGIS | 93.2 | DLMEFIDGIS | 4.85 | DLMEFIDGLS | 0.97 | | |
| NS2A | 1246 | 0.44 | 4 | 3 | 0 | yes | LMELIDGISL | 93.2 | LMEFIDGISL | 4.85 | LMELIDGIAL | 0.97 | | |
| NS2A | 1247 | 0.44 | 4 | 3 | 0 | yes | MELIDGISLG | 93.2 | MEFIDGISLG | 4.85 | MEFIDGLSLG | 0.97 | | |
| NS2A | 1248 | 0.44 | 4 | 3 | 0 | yes | ELIDGISLGL | 93.2 | EFIDGISLGL | 4.85 | EFIDGLSLGL | 0.97 | | |
| NS2A | 1249 | 0.44 | 4 | 3 | 0 | yes | LIDGISLGLI | 93.2 | FIDGISLGLI | 4.85 | FIDGLSLGLI | 0.97 | | |
| NS2A | 1250 | 0.16 | 3 | 2 | 0 | yes | IDGISLGLII | 98.06 | IDGLSLGLII | 0.97 | | | | |
| NS2A | 1251 | 0.16 | 3 | 2 | 0 | yes | DGISLGLIIL | 98.06 | DGLSLGLIIL | 0.97 | | | | |
| NS2A | 1252 | 0.16 | 3 | 2 | 0 | yes | GISLGLIILK | 98.06 | GIALGLIILK | 0.97 | | | | |
| NS2A | 1253 | 0.59 | 5 | 4 | 0 | yes | ISLGLIILKM | 90.29 | ISLGLIILKT | 6.8 | ISLGLIILKT | 0.97 | IALGLIILKM | 0.97 |
| NS2A | 1254 | 0.55 | 4 | 3 | 0 | yes | SLGLIILKIV | 90.29 | SLGLIILKMV | 7.77 | SLGLIILKTV | 0.97 | | |
| NS2A | 1255 | 0.55 | 4 | 3 | 0 | yes | LGLIILKIVT | 90.29 | LGLIILKMVT | 7.77 | LGLIILKTVT | 0.97 | | |
| NS2A | 1256 | 1.1 | 5 | 4 | 0 | yes | GLIILKIVTQ | 76.7 | GLIILKMVTH | 13.59 | GLIILKMVTH | 7.77 | GLIILKMVYH | 0.97 |
| NS2A | 1257 | 1.1 | 5 | 4 | 0 | yes | LIILKIVTQF | 76.7 | LIILKMVTHF | 13.59 | LIILKMVTHF | 7.77 | LIILKMVWHF | 0.97 |

FIG. 16-48

Species: DENV4 (10-mers)

| protein | block starting position | block entropy | total peptides | peptides in block to cover 99% of block | gap/x fraction | 99% of block covered w/ <= 5 peptides? | peptides required to cover 99% of block | frequency | peptides required to cover 99% of

FIG. 16-49

Species: DENV4 (10-mers)

| protein | block starting position | entropy block | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS2A | 1297 | 0.53 | 3 | 3 | 0 | yes | VLFWTLIPL | 90.29 | VFFWTLIPL | 7.77 | VLFAVTLIPL | 1.94 |
| NS2A | 1298 | 0.53 | 3 | 3 | 0 | yes | LFWTLIPLC | 90.29 | FFWTLIPLC | 7.77 | LFAVTLIPLC | 1.94 |
| NS2A | 1299 | 0.14 | 2 | 2 | 0 | yes | FWTLIPLCR | 98.06 | FAVTLIPLCR | 1.94 | | |
| NS2A | 1300 | 0.14 | 2 | 2 | 0 | yes | WTLIPLCRT | 98.06 | AVTLIPLCRT | 1.94 | | |
| NS2A | 1301 | 0 | 1 | 1 | 0 | yes | VTLIPLCRTS | 100 | | | | |
| NS2A | 1302 | 0 | 1 | 1 | 0 | yes | TLIPLCRTSC | 100 | | | | |
| NS2A | 1303 | 0 | 1 | 1 | 0 | yes | LIPLCRTSCL | 100 | | | | |
| NS2A | 1304 | 0 | 1 | 1 | 0 | yes | IPLCRTSCLQ | 100 | | | | |
| NS2A | 1305 | 0.08 | 2 | 2 | 0 | yes | PLCRTSCLQK | 99.03 | | | | |
| NS2A | 1306 | 0.08 | 2 | 2 | 0 | yes | LCRTSCLQKQ | 99.03 | | | | |
| NS2A | 1307 | 0.08 | 2 | 2 | 0 | yes | CRTSCLQKQS | 99.03 | | | | |
| NS2A | 1308 | 0.08 | 2 | 2 | 0 | yes | RTSCLQKQSH | 99.03 | | | | |
| NS2A | 1309 | 0.08 | 2 | 2 | 0 | yes | TSCLQKQSHW | 99.03 | | | | |
| NS2A | 1310 | 0.16 | 3 | 2 | 0 | yes | SCLQKQSHWV | 98.06 | SCLQKQSHWI | 0.97 | | |
| NS2A | 1311 | 0.16 | 3 | 2 | 0 | yes | CLQKQSHWVE | 98.06 | CLQNQSHWVE | 0.97 | | |
| NS2A | 1312 | 0.16 | 3 | 2 | 0 | yes | LQKQSHWVEI | 98.06 | LQNQSHWVEI | 0.97 | | |
| NS2A | 1313 | 0.16 | 3 | 2 | 0 | yes | QKQSHWVEIT | 98.06 | QNQSHWVEIT | 0.97 | | |
| NS2A | 1314 | 0.16 | 3 | 2 | 0 | yes | KQSHWVEITA | 98.06 | KQSHWIEITA | 0.97 | | |
| NS2A | 1315 | 0.27 | 3 | 3 | 0 | yes | QSHWVEITAL | 96.12 | QSHWVEITAI | 0.97 | | |
| NS2A | 1316 | 0.41 | 4 | 3 | 0 | yes | SHWVEITALI | 94.17 | SHWVEITAII | 2.91 | SHWVEITALT | 1.94 |
| NS2A | 1317 | 0.41 | 4 | 3 | 0 | yes | HWVEITALIL | 94.17 | HWVEITAIIL | 2.91 | HWVEITALTL | 1.94 |
| NS2A | 1318 | 0.41 | 4 | 3 | 0 | yes | WVEITALILG | 94.17 | WVEITAILLG | 2.91 | WVEITALTLG | 1.94 |
| NS2A | 1319 | 0.41 | 4 | 3 | 0 | yes | VEITALILGA | 94.17 | VEITAIILGA | 2.91 | VEITALTLGA | 1.94 |
| NS2A | 1320 | 0.33 | 3 | 3 | 0 | yes | EITALILGAQ | 95.15 | EITAIILGAQ | 2.91 | EITALTLGAQ | 1.94 |
| NS2A | 1321 | 0.33 | 3 | 3 | 0 | yes | ITALILGAQA | 95.15 | ITAIILGAQA | 2.91 | ITALTLGAQA | 1.94 |

FIG. 16-50

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of

FIG. 16-51

Species: DENV4 (10-mers)

| protein | block starting position | block entropy | total peptides in block | peptides to cover 99% of block | gap/x fraction | 99% of block covered w/ <= 5 peptides? | peptides required

FIG. 16-52

Species: DENV4 (10-mers)

| protein | block starting position | block entropy | total peptides in block | peptides to cover 99% of block | gap fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1372 | 0 | 1 | 1 | 0 | yes | PLAGPMVAG

FIG. 16-53

Species: DENV4 (10-mers)

| protein | block starting position | block entropy | total peptides in block | peptides to cover 99% of block | gap/x fraction | 99% of block covered | w/ <= 5 peptides? | peptides required to cover 99% of block | frequency | peptides required to cover 99% of block |

FIG. 16-54

Species: DENV4 (10-mers)

| protein | block starting position | entropy block | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1422 | 0

FIG. 16-55

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1447 | 0 | 1 | 1 | 0 | yes | ALITVSGLYP | 100 | | | | | | |
| NS2A | 1448 | 0 | 1 | 1 | 0 | yes | LITVSGLYPL | 100 | | | | | | |
| NS2A | 1449 | 0 | 1 | 1 | 0 | yes | ITVSGLYPLA | 100 | | | | | | |
| NS2A | 1450 | 0 | 1 | 1 | 0 | yes | TVSGLYPLAI | 100 | | | | | | |
| NS2A | 1451 | 0 | 1 | 1 | 0 | yes | VSGLYPLAIP | 100 | | | | | | |
| NS2A | 1452 | 0.82 | 2 | 2 | 0 | yes | SGLYPLAIPV | 74.76 | SGLYPLAIPI | 25.24 | | | | |
| NS2A | 1453 | 0.82 | 2 | 2 | 0 | yes | GLYPLAIPVT | 74.76 | GLYPLAIPIT | 25.24 | | | | |
| NS2A | 1454 | 0.82 | 2 | 2 | 0 | yes | LYPLAIPVTM | 74.76 | LYPLAIPITM | 25.24 | | | | |
| NS2A | 1455 | 1.28 | 3 | 3 | 0 | yes | YPLAIPVTMT | 63.11 | YPLAIPITMT | 25.24 | YPLAIPVTMA | 11.65 | | |
| NS2A | 1456 | 1.28 | 3 | 3 | 0 | yes | PLAIPVTMTL | 63.11 | PLAIPITMTL | 25.24 | PLAIPVTMAL | 11.65 | | |
| NS2A | 1457 | 1.28 | 3 | 3 | 0 | yes | LAIPVTMTLW | 63.11 | LAIPITMTLW | 25.24 | LAIPVTMALW | 11.65 | | |
| NS2A | 1458 | 1.28 | 3 | 3 | 0 | yes | AIPVTMTLWY | 63.11 | AIPITMTLWY | 25.24 | AIPVTMALWY | 11.65 | | |
| NS2A | 1459 | 1.36 | 4 | 4 | 0 | yes | IPVTMTLWYM | 63.11 | IPITMTLWYM | 25.24 | IPVTMALWYI | 9.71 | IPVTMALWYM | 1.94 |
| NS2A | 1460 | 1.36 | 4 | 4 | 0 | yes | PVTMTLWYMW | 63.11 | PITMTLWYMW | 25.24 | PVTMALWYIW | 9.71 | PVTMALWYMW | 1.94 |
| NS2A | 1461 | 1.36 | 4 | 4 | 0 | yes | VTMTLWYMWQ | 63.11 | ITMTLWYMWQ | 25.24 | VTMALWYIWQ | 9.71 | VTMALWYMWQ | 1.94 |
| NS2A | 1462 | 0.59 | 3 | 3 | 0 | yes | TMTLWYMWQV | 88.35 | TMALWYIWQV | 9.71 | TMALWYMWQV | 1.94 | | |
| NS2A | 1463 | 0.73 | 4 | 4 | 0 | yes | MTLWYMWQVK | 86.41 | MALWYIWQVK | 9.71 | MTLWYMWQVR | 1.94 | MALWYMWQVK | 1.94 |
| NS2A | 1464 | 0.73 | 4 | 4 | 0 | yes | TLWYMWQVKT | 86.35 | ALWYIWQVKT | 9.71 | TLWYMWQVRT | 1.94 | ALWYMWQVKT | 1.94 |
| NS2A | 1465 | 0.59 | 3 | 3 | 0 | yes | LWYMWQVKTQ | 88.35 | LWYIWQVKTQ | 9.71 | LWYMWQVRTQ | 1.94 | | |
| NS2A | 1466 | 0.59 | 3 | 3 | 0 | yes | WYMWQVKTQR | 88.35 | WYIWQVKTQR | 9.71 | WYMWQVRTQR | 1.94 | | |
| NS2A | 1467 | 0.59 | 3 | 3 | 0 | yes | YMWQVKTQRS | 88.35 | YIWQVKTQRS | 9.71 | YMWQVRTQRS | 1.94 | | |
| NS2A | 1468 | 0.59 | 3 | 3 | 0 | yes | MWQVKTQRSG | 88.35 | IWQVKTQRSG | 9.71 | MWQVRTQRSG | 1.94 | | |
| NS2A | 1469 | 0.14 | 2 | 2 | 0 | yes | WQVKTQRSGA | 98.06 | WQVRTQRSGA | 1.94 | | | | |
| NS2A | 1470 | 0.14 | 2 | 2 | 0 | yes | QVKTQRSGAL | 98.06 | QVRTQRSGAL | 1.94 | | | | |
| NS2A | 1471 | 0.14 | 2 | 2 | 0 | yes | VKTQRSGALW | 98.06 | VRTQRSGALW | 1.94 | | | | |

FIG. 16-56

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1472 | 0.14 | 2 | 2 | 0 | yes | KTQRSGALWD | 98.06 | RTQRSGALWD | 1.94 | | | | |
| NS2A | 1473 | 0 | 1 | 1 | 0 | yes | TQRSGALWDV | 100 | | | | | | |
| NS2A | 1474 | 0 | 1 | 1 | 0 | yes | QRSGALWDVP | 100 | | | | | | |
| NS2A | 1475 | 0 | 1 | 1 | 0 | yes | RSGALWDVPS | 100 | | | | | | |
| NS2A | 1476 | 0 | 1 | 1 | 0 | yes | SGALWDVPSP | 100 | | | | | | |
| NS2A | 1477 | 0 | 1 | 1 | 0 | yes | GALWDVPSPA | 100 | | | | | | |
| NS3 | 1478 | 0.24 | 2 | 2 | 0 | yes | ALWDVPSPAA | 96.12 | ALWDVPSPAT | 3.88 | | | | |
| NS3 | 1479 | 0.59 | 2 | 2 | 0 | yes | LWDVPSPAAT | 90.29 | LWDVPSPAAA | 5.83 | LWDVPSPATA | 2.91 | | |
| NS3 | 1480 | 1.06 | 4 | 3 | 0 | yes | WDVPSPAATQ | 79.61 | WDVPSPAATK | 10.68 | WDVPSPAAAQ | 5.83 | WDVPSPATAQ | 2.91 |
| NS3 | 1481 | 1.06 | 5 | 4 | 0 | yes | DVPSPAATQK | 79.61 | DVPSPAATKK | 10.68 | DVPSPAAAQK | 5.83 | DVPSPATAQK | 2.91 |
| NS3 | 1482 | 1.06 | 5 | 4 | 0 | yes | VPSPAATQKA | 79.61 | VPSPAATKKA | 10.68 | VPSPAAAQKA | 5.83 | VPSPATAQKA | 2.91 |
| NS3 | 1488 | 1.37 | 5 | 4 | 0 | yes | TQKAALSEGV | 70.87 | TIKKAALSEGV | 10.68 | TQKATLSEGV | 9.71 | AQKATLEGV | 7.77 |
| NS3 | 1489 | 1.37 | 5 | 4 | 0 | yes | QKAALSEGVY | 70.87 | KKAALSEGVY | 10.68 | QKATLSEGVY | 9.71 | QKATLTEGVY | 7.77 |
| NS3 | 1490 | 0.92 | 4 | 3 | 0 | yes | KAALSEGVYR | 81.55 | KATLSEGVYR | 9.71 | KATLTEGVYR | 7.77 | | |
| NS3 | 1491 | 0.92 | 4 | 3 | 0 | yes | AALSEGVYRI | 81.55 | ATLSEGVYRI | 9.71 | ATLTEGVYRI | 7.77 | | |
| NS3 | 1492 | 0.92 | 4 | 3 | 0 | yes | ALSEGVYRIM | 81.55 | TLSEGVYRIM | 9.71 | TLTEGVYRIM | 7.77 | | |
| NS3 | 1493 | 0.43 | 2 | 2 | 0 | yes | LSEGVYRIMQ | 91.26 | LTEGVYRIMQ | 8.74 | | | | |
| NS3 | 1494 | 0.43 | 2 | 2 | 0 | yes | SEGVYRIMQR | 91.26 | TEGVYRIMQR | 8.74 | | | | |
| NS3 | 1495 | 0 | 1 | 1 | 0 | yes | EGVYRIMQRG | 100 | | | | | | |
| NS3 | 1496 | 0 | 1 | 1 | 0 | yes | GVYRIMQRGL | 100 | | | | | | |
| NS3 | 1497 | 0.32 | 2 | 2 | 0 | yes | VYRIMQRGLF | 94.17 | VYRIMQRGLL | 5.83 | | | | |
| NS3 | 1498 | 0.32 | 2 | 2 | 0 | yes | YRIMQRGLFG | 94.17 | YRIMQRGLLG | 5.83 | | | | |
| NS3 | 1499 | 0.36 | 3 | 2 | 0 | yes | RIMQRGLFGK | 94.17 | RIMQRGLLGK | 4.85 | | | | |
| NS3 | 1500 | 0.36 | 3 | 2 | 0 | yes | IMQRGLFGKT | 94.17 | IMQRGLLGKT | 4.85 | | | | |
| NS3 | 1501 | 0.36 | 3 | 2 | 0 | yes | MQRGLFGKTQ | 94.17 | MQRGLLGKTQ | 4.85 | | | | |

FIG. 16-57

Species: DENV4 (10-mers)

| protein | block starting position | block entropy | total peptides in block | peptides to cover 99% of block | gap/x fraction | 99% of block covered | w/ <= 5 peptides? | peptides required to cover 99% of block | frequency | peptides required to cover 99% of block | frequency | peptides required to cover 99% of block | frequency

FIG. 16-58

Species: DENW4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1527 | 0 | 1 | 1 | 0 | yes | VTRGSVICHE | 100 | | | | | | |
| NS3 | 1528 | 0.19 | 2 | 2 | 0 | yes | TRGSVICHET | 97.09 | TRGSVICHES | 2.91 | | | | |
| NS3 | 1529 | 0.19 | 2 | 2 | 0 | yes | RGSVICHETG | 97.09 | RGSVICHESG | 2.91 | | | | |
| NS3 | 1530 | 0.19 | 2 | 2 | 0 | yes | GSVICHETGR | 97.09 | GSVICHESGR | 2.91 | | | | |
| NS3 | 1531 | 0.19 | 2 | 2 | 0 | yes | SVICHETGRL | 97.09 | SVICHESGRL | 2.91 | | | | |
| NS3 | 1532 | 0.19 | 2 | 2 | 0 | yes | VICHETGRLE | 97.09 | VICHESGRLE | 2.91 | | | | |
| NS3 | 1533 | 0.19 | 2 | 2 | 0 | yes | ICHETGRLEP | 97.09 | ICHESGRLEP | 2.91 | | | | |
| NS3 | 1534 | 0.19 | 2 | 2 | 0 | yes | CHETGRLEPS | 97.09 | CHESGRLEPS | 2.91 | | | | |
| NS3 | 1535 | 0.19 | 2 | 2 | 0 | yes | HETGRLEPSW | 97.09 | HESGRLEPSW | 2.91 | | | | |
| NS3 | 1536 | 0.19 | 2 | 2 | 0 | yes | ETGRLEPSWA | 97.09 | ESGRLEPSWA | 2.91 | | | | |
| NS3 | 1537 | 0.19 | 2 | 2 | 0 | yes | TGRLEPSWAD | 97.09 | SGRLEPSWAD | 2.91 | | | | |
| NS3 | 1538 | 0 | 1 | 1 | 0 | yes | GRLEPSWADV | 100 | | | | | | |
| NS3 | 1539 | 0 | 1 | 1 | 0 | yes | RLEPSWADVR | 100 | | | | | | |
| NS3 | 1540 | 0 | 1 | 1 | 0 | yes | LEPSWADVRN | 100 | | | | | | |
| NS3 | 1541 | 0 | 1 | 1 | 0 | yes | EPSWADVRND | 100 | | | | | | |
| NS3 | 1542 | 0 | 1 | 1 | 0 | yes | PSWADVRNDM | 100 | | | | | | |
| NS3 | 1543 | 0 | 1 | 1 | 0 | yes | SWADVRNDMI | 100 | | | | | | |
| NS3 | 1544 | 0 | 1 | 1 | 0 | yes | WADVRNDMIS | 100 | | | | | | |
| NS3 | 1545 | 0 | 1 | 1 | 0 | yes | ADVRNDMISY | 100 | | | | | | |
| NS3 | 1546 | 0 | 1 | 1 | 0 | yes | DVRNDMISYG | 100 | | | | | | |
| NS3 | 1547 | 0 | 1 | 1 | 0 | yes | VRNDMISYGG | 100 | | | | | | |
| NS3 | 1548 | 0 | 1 | 1 | 0 | yes | RNDMISYGGG | 100 | | | | | | |
| NS3 | 1549 | 0 | 1 | 1 | 0 | yes | NDMISYGGGW | 100 | | | | | | |
| NS3 | 1550 | 0 | 1 | 1 | 0 | yes | DMISYGGGWR | 100 | | | | | | |
| NS3 | 1551 | 0 | 1 | 1 | 0 | yes | MISYGGGWRL | 100 | | | | | | |

FIG. 16-59

Species: DENW4 (10-mers)

| protein | block starting position | entropy | total peptides in block | peptides to cover 99% of block | gap/x fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1552 | 0 | 1 | 1 | 0 | yes | ISYGGGWRLG | 100 | | | | | | |
| NS3 | 1553 | 0.08 | 2 | 1 | 0 | yes | SYGGGWRLGD | 99.03 | | | | | | |
| NS3 | 1554 | 0.08 | 2 | 1 | 0 | yes | YGGGWRLGDK | 99.03 | | | | | | |
| NS3 | 1555 | 0.08 | 2 | 1 | 0 | yes | GGGWRLGDKW | 99.03 | | | | | | |
| NS3 | 1556 | 0.08 | 2 | 1 | 0 | yes | GGWRLGDKWD | 99.03 | | | | | | |
| NS3 | 1557 | 0.32 | 3 | 2 | 0 | yes | GWRLGDKWDK | 95.15 | GWRLGDKWDR | 3.88 | | | | |
| NS3 | 1558 | 0.32 | 3 | 2 | 0 | yes | WRLGDKWDKE | 95.15 | WRLGDKWDRE | 3.88 | | | | |
| NS3 | 1559 | 0.32 | 3 | 2 | 0 | yes | RLGDKWDKEE | 95.15 | RLGDKWDREE | 3.88 | | | | |
| NS3 | 1560 | 0.32 | 3 | 2 | 0 | yes | LGDKWDKEED | 95.15 | LGDKWDREED | 3.88 | | | | |
| NS3 | 1561 | 0.32 | 3 | 2 | 0 | yes | GDKWDKEEDV | 95.15 | GDKWDREEDV | 3.88 | | | | |
| NS3 | 1562 | 0.32 | 3 | 2 | 0 | yes | DKWDKEEDVQ | 95.15 | DKWDREEDVQ | 3.88 | | | | |
| NS3 | 1563 | 0.24 | 2 | 2 | 0 | yes | KWDKEEDVQV | 96.12 | KWDREEDVQV | 3.88 | | | | |
| NS3 | 1564 | 0.24 | 2 | 2 | 0 | yes | WDKEEDVQVL | 96.12 | WDREEDVQVL | 3.88 | | | | |
| NS3 | 1565 | 0.24 | 2 | 2 | 0 | yes | DKEEDVQVLA | 96.12 | DREEDVQVLA | 3.88 | | | | |
| NS3 | 1566 | 0.43 | 3 | 3 | 0 | yes | KEEDVQVLAI | 93.2 | REEDVQVLAI | 3.88 | KEEDVQVLAV | 2.91 | | |
| NS3 | 1567 | 0.19 | 2 | 2 | 0 | yes | EEDVQVLAIE | 97.09 | EEDVQVLAVE | 2.91 | | | | |
| NS3 | 1568 | 0.19 | 2 | 2 | 0 | yes | EDVQVLAIEP | 97.09 | EDVQVLAVEP | 2.91 | | | | |
| NS3 | 1569 | 0.19 | 2 | 2 | 0 | yes | DVQVLAIEPG | 97.09 | DVQVLAVEPG | 2.91 | | | | |
| NS3 | 1570 | 0.19 | 2 | 2 | 0 | yes | VQVLAIEPGK | 97.09 | VQVLAVEPGK | 2.91 | | | | |
| NS3 | 1571 | 0.19 | 2 | 2 | 0 | yes | QVLAIEPGKN | 97.09 | QVLAVEPGKN | 2.91 | | | | |
| NS3 | 1572 | 0.19 | 2 | 2 | 0 | yes | VLAIEPGKNP | 97.09 | VLAVEPGKNP | 2.91 | | | | |
| NS3 | 1573 | 0.19 | 2 | 2 | 0 | yes | LAIEPGKNPK | 97.09 | LAVEPGKNPK | 2.91 | | | | |
| NS3 | 1574 | 0.19 | 2 | 2 | 0 | yes | AIEPGKNPKH | 97.09 | AVEPGKNPKH | 2.91 | | | | |
| NS3 | 1575 | 0.19 | 2 | 1 | 0 | yes | IEPGKNPKHV | 97.09 | VEPGKNPKHV | 2.91 | | | | |
| NS3 | 1576 | 0 | 1 | 1 | 0 | yes | EPGKNPKHVQ | 100 | | | | | | |

FIG. 16-60

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|

FIG. 16-61

Species: DENW4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1602 | 0.08 | 2 | 1 | 0 | yes | TLDFKPGTSG | 99.03 | | | | | | |
| NS3 | 1603 | 0.08 | 2 | 1 | 0 | yes | LDFKPGTSGS | 99.03 | | | | | | |
| NS3 | 1604 | 0.08 | 2 | 1 | 0 | yes | DFKPGTSGSP | 99.03 | | | | | | |
| NS3 | 1605 | 0.08 | 2 | 1 | 0 | yes | FKPGTSGSPI | 99.03 | | | | | | |
| NS3 | 1606 | 0.16 | 3 | 2 | 0 | yes | KPGTSGSPII | 98.06 | KPGTSGSPIV | 0.97 | | | | |
| NS3 | 1607 | 0.16 | 3 | 2 | 0 | yes | PGTSGSPIIN | 98.06 | PGTSGSPIVN | 0.97 | | | | |
| NS3 | 1608 | 0.75 | 4 | 3 | 0 | yes | GTSGSPIINR | 83.5 | GTSGSPIINK | 14.56 | GTSGSPIVNR | 0.97 | | |
| NS3 | 1609 | 0.75 | 4 | 3 | 0 | yes | TSGSPIINRK | 83.5 | TSGSPIINKK | 14.56 | SSGSPIINRK | 0.97 | | |
| NS3 | 1610 | 0.68 | 3 | 2 | 0 | yes | SGSPIINRKG | 84.47 | SGSPIINKKG | 14.56 | | | | |
| NS3 | 1611 | 0.68 | 3 | 2 | 0 | yes | GSPIINRKGK | 84.47 | GSPIINKKGK | 14.56 | | | | |
| NS3 | 1612 | 0.68 | 3 | 2 | 0 | yes | SPIINRKGKV | 84.47 | SPIINKKGKV | 14.56 | | | | |
| NS3 | 1613 | 0.68 | 3 | 2 | 0 | yes | PIINRKGKVI | 84.47 | PIINKKGKVI | 14.56 | | | | |
| NS3 | 1614 | 0.68 | 3 | 2 | 0 | yes | IINRKGKVIG | 84.47 | IINKKGKVIG | 14.56 | | | | |
| NS3 | 1615 | 0.68 | 3 | 2 | 0 | yes | INRKGKVIGL | 84.47 | INKKGKVIGL | 14.56 | | | | |
| NS3 | 1616 | 0.6 | 2 | 1 | 0 | yes | NRKGKVIGLY | 85.44 | NKKGKVIGLY | 14.56 | | | | |
| NS3 | 1617 | 0.6 | 2 | 1 | 0 | yes | RKGKVIGLYG | 85.44 | KKGKVIGLYG | 14.56 | | | | |
| NS3 | 1618 | 0 | 1 | 1 | 0 | yes | KGKVIGLYGN | 100 | | | | | | |
| NS3 | 1619 | 0 | 1 | 1 | 0 | yes | GKVIGLYGNG | 100 | | | | | | |
| NS3 | 1620 | 0 | 1 | 1 | 0 | yes | KVIGLYGNGV | 100 | | | | | | |
| NS3 | 1621 | 0 | 1 | 1 | 0 | yes | VIGLYGNGVV | 100 | | | | | | |
| NS3 | 1622 | 0 | 1 | 1 | 0 | yes | IGLYGNGVVT | 100 | | | | | | |
| NS3 | 1623 | 0 | 1 | 1 | 0 | yes | GLYGNGVVTK | 100 | | | | | | |
| NS3 | 1624 | 0 | 1 | 1 | 0 | yes | LYGNGVVTKS | 100 | | | | | | |
| NS3 | 1625 | 0 | 1 | 1 | 0 | yes | YGNGVVTKSG | 100 | | | | | | |
| NS3 | 1626 | 0 | 1 | 1 | 0 | yes | GNGVVTKSGD | 100 | | | | | | |

FIG. 16-62

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1627 | 0 | 1 | 1 | 0 | yes | NGWTKSGDY | 100 | | |
| NS3 | 1628 | 0 | 1 | 1 | 0 | yes | GWTKSGDYV | 100 | | |
| NS3 | 1629 | 0 | 1 | 1 | 0 | yes | WTKSGDYVS | 100 | | |
| NS3 | 1630 | 0 | 1 | 1 | 0 | yes | VTKSGDYVSA | 100 | | |
| NS3 | 1631 | 0 | 1 | 1 | 0 | yes | TKSGDYVSAI | 100 | | |
| NS3 | 1632 | 0 | 1 | 1 | 0 | yes | KSGDYVSAIT | 100 | | |
| NS3 | 1633 | 0 | 1 | 1 | 0 | yes | SGDYVSAITQ | 100 | | |
| NS3 | 1634 | 0 | 1 | 1 | 0 | yes | GDYVSAITQA | 100 | | |
| NS3 | 1635 | 0 | 1 | 1 | 0 | yes | DYVSAITQAE | 100 | | |
| NS3 | 1636 | 0.08 | 2 | 1 | 0 | yes | YVSAITQAER | 99.03 | | |
| NS3 | 1637 | 0.27 | 3 | 2 | 0 | yes | VSAITQAERT | 96.12 | VSAITQAERT | 2.91 |
| NS3 | 1638 | 0.27 | 3 | 2 | 0 | yes | SAITQAERTG | 96.12 | SAITQAERTG | 2.91 |
| NS3 | 1639 | 0.27 | 3 | 2 | 0 | yes | AITQAERTGE | 96.12 | AITQAERTGE | 2.91 |
| NS3 | 1640 | 0.27 | 3 | 2 | 0 | yes | ITQAERTGEP | 96.12 | ITQAERTGEP | 2.91 |
| NS3 | 1641 | 0.27 | 3 | 2 | 0 | yes | TQAERTGEPD | 96.12 | TQAERTGEPD | 2.91 |
| NS3 | 1642 | 0.27 | 3 | 2 | 0 | yes | QAERTGEPDY | 96.12 | QAERTGEPDY | 2.91 |
| NS3 | 1643 | 0.27 | 3 | 2 | 0 | yes | AERTGEPDYE | 96.12 | AERTGEPDYE | 2.91 |
| NS3 | 1644 | 0.27 | 3 | 2 | 0 | yes | ERTGEPDYEV | 96.12 | ERTGEPDYEV | 2.91 |
| NS3 | 1645 | 0.27 | 3 | 2 | 0 | yes | RTGEPDYEVD | 96.12 | RTGEPDYEVD | 2.91 |
| NS3 | 1646 | 0.19 | 2 | 1 | 0 | yes | TGEPDYEVDE | 97.09 | TGEPDYEVDE | 2.91 |
| NS3 | 1647 | 0 | 1 | 1 | 0 | yes | GEPDYEVDED | 100 | | |
| NS3 | 1648 | 0 | 1 | 1 | 0 | yes | EPDYEVDEDI | 100 | | |
| NS3 | 1649 | 0 | 1 | 1 | 0 | yes | PDYEVDEDIF | 100 | | |
| NS3 | 1650 | 0 | 1 | 1 | 0 | yes | DYEVDEDIFR | 100 | | |
| NS3 | 1651 | 0 | 1 | 1 | 0 | yes | YEVDEDIFRK | 100 | | |

FIG. 16-63

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency |
|---|---|---|---|---|---|---|---|---

FIG. 16-64

| Species: DEN4 (10-mers) | protein | block starting position | block entropy | total peptides in block | peptides required to cover 99% of block | gap/x fraction | 99% of block covered w/ <= 5 peptides? | peptides required to cover 99% of block | frequency |
|---|---|---|---|---|---|---|---|---|---|
| | NS3 | 1677 | 0 | — | — | 0 | yes | RILPS

FIG. 16-65

Species: DENV4 (10-mers)

| protein | block starting position | entropy block | total peptides in block | peptides to cover 99% of block | g

FIG. 16-67

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1752 | 0 | 1 | 1 | 0 | yes | NYNLIVMDEA | 100 | | | | | | |
| NS3 | 1753 | 0 | 1 | 1 | 0 | yes | YNLIVMDEAH | 100 | | | | | | |
| NS3 | 1754 | 0 | 1 | 1 | 0 | yes | NLIVMDEAHF | 100 | | | | | | |
| NS3 | 1755 | 0 | 1 | 1 | 0 | yes | LIVMDEAHFT | 100 | | | | | | |
| NS3 | 1756 | 0 | 1 | 1 | 0 | yes | IVMDEAHFTD | 100 | | | | | | |
| NS3 | 1757 | 0 | 1 | 1 | 0 | yes | VMDEAHFTDP | 100 | | | | | | |
| NS3 | 1758 | 0.46 | 2 | 2 | 0 | yes | MDEAHFTDPS | 90.29 | MDEAHFTDPC | 9.71 | | | | |
| NS3 | 1759 | 0.46 | 2 | 2 | 0 | yes | DEAHFTDPSS | 90.29 | DEAHFTDPCS | 9.71 | | | | |
| NS3 | 1760 | 0.46 | 2 | 2 | 0 | yes | EAHFTDPSSV | 90.29 | EAHFTDPCSV | 9.71 | | | | |
| NS3 | 1761 | 0.46 | 2 | 2 | 0 | yes | AHFTDPSSVA | 90.29 | AHFTDPCSVA | 9.71 | | | | |
| NS3 | 1762 | 0.46 | 2 | 2 | 0 | yes | HFTDPSSVAA | 90.29 | HFTDPCSVAA | 9.71 | | | | |
| NS3 | 1763 | 0.46 | 2 | 2 | 0 | yes | FTDPSSVAAR | 90.29 | FTDPCSVAAR | 9.71 | | | | |
| NS3 | 1764 | 0.46 | 2 | 2 | 0 | yes | TDPSSVAARG | 90.29 | TDPCSVAARG | 9.71 | | | | |
| NS3 | 1765 | 0.46 | 2 | 2 | 0 | yes | DPSSVAARGY | 90.29 | DPCSVAARGY | 9.71 | | | | |
| NS3 | 1766 | 0.46 | 2 | 2 | 0 | yes | PSSVAARGYI | 90.29 | PCSVAARGYI | 9.71 | | | | |
| NS3 | 1767 | 0.46 | 2 | 2 | 0 | yes | SSVAARGYIS | 90.29 | CSVAARGYIS | 9.71 | | | | |
| NS3 | 1768 | 0 | 1 | 1 | 0 | yes | SVAARGYIST | 100 | | | | | | |
| NS3 | 1769 | 0 | 1 | 1 | 0 | yes | VAARGYISTR | 100 | | | | | | |
| NS3 | 1770 | 0 | 1 | 1 | 0 | yes | AARGYISTRV | 100 | | | | | | |
| NS3 | 1771 | 0 | 1 | 1 | 0 | yes | ARGYISTRVE | 100 | | | | | | |
| NS3 | 1772 | 0 | 1 | 1 | 0 | yes | RGYISTRVEM | 100 | | | | | | |
| NS3 | 1773 | 0 | 1 | 1 | 0 | yes | GYISTRVEMG | 100 | | | | | | |
| NS3 | 1774 | 0 | 1 | 1 | 0 | yes | YISTRVEMGE | 100 | | | | | | |
| NS3 | 1775 | 0 | 1 | 1 | 0 | yes | ISTRVEMGEA | 100 | | | | | | |
| NS3 | 1776 | 0 | 1 | 1 | 0 | yes | STRVEMGEAA | 100 | | | | | | |

FIG. 16-68

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | pept

FIG. 16-69

Species: DENV4 (10-mers)

| protein | block starting position | entropy | total peptides in block | peptides required to cover 99% of block | gap/x fraction | 99% of block covered w/ <= 5 peptides? | peptides required to cover 99% of block | frequency |
|---|---|---|---|---|---|---|---|

FIG. 16-70

Species: DENV4 (10-mers)

| protein | block starting position | block entropy | total peptides in block | peptides to cover 99% of block | gap/x fraction | 99% of block covered w/ <= 5 peptides? | peptides required to cover 99% of block

FIG. 16-71

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1852 | 0.54 | 3 | 2 | 0 | yes | KSGKKVIQLS | 89.32 | KSGKRVIQLS | 9.71 | | | | |
| NS3 | 1853 | 0.54 | 3 | 2 | 0 | yes | SGKKVIQLSR | 89.32 | SGKRVIQLSR | 9.71 | | | | |
| NS3 | 1854 | 0.54 | 3 | 2 | 0 | yes | GKKVIQLSRK | 89.32 | GKRVIQLSRK | 9.71 | | | | |
| NS3 | 1855 | 0.54 | 3 | 2 | 0 | yes | KKVIQLSRKT | 89.32 | KRVIQLSRKT | 9.71 | | | | |
| NS3 | 1856 | 0.54 | 3 | 2 | 0 | yes | KVIQLSRKTF | 89.32 | RVIQLSRKTF | 9.71 | | | | |
| NS3 | 1857 | 0.08 | 2 | 1 | 0 | yes | VIQLSRKTFD | 99.03 | | | | | | |
| NS3 | 1858 | 0.08 | 2 | 1 | 0 | yes | IQLSRKTFDT | 99.03 | | | | | | |
| NS3 | 1859 | 0 | 1 | 1 | 0 | yes | QLSRKTFDTE | 100 | | | | | | |
| NS3 | 1860 | 0 | 1 | 1 | 0 | yes | LSRKTFDTEY | 100 | | | | | | |
| NS3 | 1861 | 0 | 1 | 1 | 0 | yes | SRKTFDTEYP | 100 | | | | | | |
| NS3 | 1862 | 0 | 1 | 1 | 0 | yes | RKTFDTEYPK | 100 | | | | | | |
| NS3 | 1863 | 0 | 1 | 1 | 0 | yes | KTFDTEYPKT | 100 | | | | | | |
| NS3 | 1864 | 0 | 1 | 1 | 0 | yes | TFDTEYPKTK | 100 | | | | | | |
| NS3 | 1865 | 0 | 1 | 1 | 0 | yes | FDTEYPKTKL | 100 | | | | | | |
| NS3 | 1866 | 0 | 1 | 1 | 0 | yes | DTEYPKTKLT | 100 | | | | | | |
| NS3 | 1867 | 0 | 1 | 1 | 0 | yes | TEYPKTKLTD | 100 | | | | | | |
| NS3 | 1868 | 0 | 1 | 1 | 0 | yes | EYPKTKLTDW | 100 | | | | | | |
| NS3 | 1869 | 0 | 1 | 1 | 0 | yes | YPKTKLTDWD | 100 | | | | | | |
| NS3 | 1870 | 0 | 1 | 1 | 0 | yes | PKTKLTDWDF | 100 | | | | | | |
| NS3 | 1871 | 0 | 1 | 1 | 0 | yes | KTKLTDWDFV | 100 | | | | | | |
| NS3 | 1872 | 0 | 1 | 1 | 0 | yes | TKLTDWDFVW | 100 | | | | | | |
| NS3 | 1873 | 0 | 1 | 1 | 0 | yes | KLTDWDFVWT | 100 | | | | | | |
| NS3 | 1874 | 0 | 1 | 1 | 0 | yes | LTDWDFVWTT | 100 | | | | | | |
| NS3 | 1875 | 0 | 1 | 1 | 0 | yes | TDWDFVWTTD | 100 | | | | | | |
| NS3 | 1876 | 0 | 1 | 1 | 0 | yes | DWDFVWTTDI | 100 | | | | | | |

FIG. 16-73

Species: DENV4

FIG. 16-74

Species: DENV4 (10-mers)

| protein | block starting position | block entropy | total peptides in block | peptides to block to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1927 | 0 | 1 | 1 | 0 | yes | ASAAQRRGRI | 100 | | | | | | |
| NS3 | 1928 | 0 | 1 | 1 | 0 | yes | SAAQRRGRIG | 100 | | | | | | |
| NS3 | 1929 | 0 | 1 | 1 | 0 | yes | AAQRRGRIGR | 100 | | | | | | |
| NS3 | 1930 | 0 | 1 | 1 | 0 | yes | AQRRGRIGRN | 100 | | | | | | |
| NS3 | 1931 | 0.24 | 2 | 2 | 0 | yes | QRRGRIGRNP | 96.12 | QRRGRIGRNL | 3.88 | | | | |
| NS3 | 1932 | 0.43 | 3 | 3 | 0 | yes | RRGRIGRNPA | 93.2 | RRGRIGRNLA | 3.88 | RRGRIGRNPT | 2.91 | | |
| NS3 | 1933 | 0.43 | 3 | 3 | 0 | yes | RGRIGRNPAQ | 93.2 | RGRIGRNLAQ | 3.88 | RGRIGRNPTQ | 2.91 | | |
| NS3 | 1934 | 0.43 | 3 | 3 | 0 | yes | GRIGRNPAQE | 93.2 | GRIGRNLAQE | 3.88 | GRIGRNPTQE | 2.91 | | |
| NS3 | 1935 | 0.43 | 3 | 3 | 0 | yes | RIGRNPAQED | 93.2 | RIGRNLAQED | 3.88 | RIGRNPTQED | 2.91 | | |
| NS3 | 1936 | 0.43 | 3 | 3 | 0 | yes | IGRNPAQEDD | 93.2 | IGRNLAQEDD | 3.88 | IGRNPTQEDD | 2.91 | | |
| NS3 | 1937 | 0.43 | 3 | 3 | 0 | yes | GRNPAQEDDQ | 93.2 | GRNLAQEDDQ | 3.88 | GRNPTQEDDQ | 2.91 | | |
| NS3 | 1938 | 0.43 | 3 | 3 | 0 | yes | RNPAQEDDQY | 93.2 | RNLAQEDDQY | 3.88 | RNPTQEDDQY | 2.91 | | |
| NS3 | 1939 | 0.43 | 3 | 3 | 0 | yes | NPAQEDDQYV | 93.2 | NLAQEDDQYV | 3.88 | NPTQEDDQYV | 2.91 | | |
| NS3 | 1940 | 0.43 | 3 | 3 | 0 | yes | PAQEDDQYVF | 93.2 | LAQEDDQYVF | 3.88 | PTQEDDQYVF | 2.91 | | |
| NS3 | 1941 | 0.19 | 2 | 2 | 0 | yes | AQEDDQYVFS | 97.09 | TQEDDQYVFS | 2.91 | | | | |
| NS3 | 1942 | 0 | 1 | 1 | 0 | yes | QEDDQYVFSG | 100 | | | | | | |
| NS3 | 1943 | 0 | 1 | 1 | 0 | yes | EDDQYVFSGD | 100 | | | | | | |
| NS3 | 1944 | 0 | 1 | 1 | 0 | yes | DDQYVFSGDP | 100 | | | | | | |
| NS3 | 1945 | 0 | 1 | 1 | 0 | yes | DQYVFSGDPL | 100 | | | | | | |
| NS3 | 1946 | 0.19 | 2 | 2 | 0 | yes | QYVFSGDPLK | 97.09 | QYVFSGDPLR | 2.91 | | | | |
| NS3 | 1947 | 0.19 | 2 | 2 | 0 | yes | YVFSGDPLKN | 97.09 | YVFSGDPLRN | 2.91 | | | | |
| NS3 | 1948 | 0.19 | 2 | 2 | 0 | yes | VFSGDPLKND | 97.09 | VFSGDPLRND | 2.91 | | | | |
| NS3 | 1949 | 0.19 | 2 | 2 | 0 | yes | FSGDPLKNDE | 97.09 | FSGDPLRNDE | 2.91 | | | | |
| NS3 | 1950 | 0.19 | 2 | 2 | 0 | yes | SGDPLKNDED | 97.09 | SGDPLRNDED | 2.91 | | | | |
| NS3 | 1951 | 0.19 | 2 | 2 | 0 | yes | GDPLKNDEDH | 97.09 | GDPLRNDEDH | 2.91 | | | | |

FIG. 16-75

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of

Species: DENW4 (10-mers)

| protein | block starting position | block entropy | total peptides in block | peptides to cover 99% of block | gap fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 2002 | 0 | 1 | 1 | 0 | yes | GEQRKTFVEL | 100 | | |
| NS3 | 2003 | 0 | 1 | 1 | 0 | yes | EQRKTFVELM | 100 | | |
| NS3 | 2004 | 0.14 | 2 | 2 | 0 | yes | QRKTFVELMR | 98.06 | QRKTFVELMK | 1.94 |
| NS3 | 2005 | 0.14 | 2 | 2 | 0 | yes | RKTFVELMRR | 98.06 | RKTFVELMKR | 1.94 |
| NS3 | 2006 | 0.14 | 2 | 2 | 0 | yes | KTFVELMRRG | 98.06 | KTFVELMKRG | 1.94 |
| NS3 | 2007 | 0.14 | 2 | 2 | 0 | yes | TFVELMRRGD | 98.06 | TFVELMKRGD | 1.94 |
| NS3 | 2008 | 0.14 | 2 | 2 | 0 | yes | FVELMRRGDL | 98.06 | FVELMKRGDL | 1.94 |
| NS3 | 2009 | 0.14 | 2 | 2 | 0 | yes | VELMRRGDLP | 98.06 | VELMKRGDLP | 1.94 |
| NS3 | 2010 | 0.14 | 2 | 2 | 0 | yes | ELMRRGDLPV | 98.06 | ELMKRGDLPV | 1.94 |
| NS3 | 2011 | 0.14 | 2 | 2 | 0 | yes | LMRRGDLPVW | 98.06 | LMKRGDLPVW | 1.94 |
| NS3 | 2012 | 0.14 | 2 | 2 | 0 | yes | MRRGDLPVWL | 98.06 | MKRGDLPVWL | 1.94 |
| NS3 | 2013 | 0.14 | 2 | 2 | 0 | yes | RRGDLPVWLS | 98.06 | KRGDLPVWLS | 1.94 |
| NS3 | 2014 | 0 | 1 | 1 | 0 | yes | RGDLPVWLSY | 100 | | |
| NS3 | 2015 | 0 | 1 | 1 | 0 | yes | GDLPVWLSYK | 100 | | |
| NS3 | 2016 | 0 | 1 | 1 | 0 | yes | DLPVWLSYKV | 100 | | |
| NS3 | 2017 | 0 | 1 | 1 | 0 | yes | LPVWLSYKVA | 100 | | |
| NS3 | 2018 | 0 | 1 | 1 | 0 | yes | PVWLSYKVAS | 100 | | |
| NS3 | 2019 | 0 | 1 | 1 | 0 | yes | VWLSYKVASA | 100 | | |
| NS3 | 2020 | 0 | 1 | 1 | 0 | yes | WLSYKVASAG | 100 | | |
| NS3 | 2021 | 0 | 1 | 1 | 0 | yes | LSYKVASAGI | 100 | | |
| NS3 | 2022 | 0 | 1 | 1 | 0 | yes | SYKVASAGIS | 100 | | |
| NS3 | 2023 | 0 | 1 | 1 | 0 | yes | YKVASAGISY | 100 | | |
| NS3 | 2024 | 0.22 | 3 | 2 | 0 | yes | KVASAGISYK | 97.09 | KVASAGISYE | 1.94 |
| NS3 | 2025 | 0.22 | 3 | 2 | 0 | yes | VASAGISYKD | 97.09 | VASAGISYED | 1.94 |
| NS3 | 2026 | 0.22 | 3 | 2 | 0 | yes | ASAGISYKDR | 97.09 | ASAGISYEDR | 1.94 |

FIG. 16-78

Species: DENW4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 2027 | 0.22 | 3 | 2 | 0 | yes | SAGISYKDRE | 97.09 | SAGISYEDRE | 1.94

FIG. 16-79

Species: DENW4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 2052 | 0 | 1 | 1 | 0 | yes | MEVEIWTREG | 100 | | |
| NS3 | 2053 | 0 | 1 | 1 | 0 | yes | EVEIWTREGE | 100 | | |
| NS3 | 2054 | 0 | 1 | 1 | 0 | yes | VEIWTREGEK | 100 | | |
| NS3 | 2055 | 0 | 1 | 1 | 0 | yes | EIWTREGEKK | 100 | | |
| NS3 | 2056 | 0 | 1 | 1 | 0 | yes | IWTREGEKKK | 100 | | |
| NS3 | 2057 | 0 | 1 | 1 | 0 | yes | WTREGEKKKL | 100 | | |
| NS3 | 2058 | 0 | 1 | 1 | 0 | yes | TREGEKKKLR | 100 | | |
| NS3 | 2059 | 0 | 1 | 1 | 0 | yes | REGEKKKLRP | 100 | | |
| NS3 | 2060 | 0.99 | 2 | 2 | 0 | yes | EGEKKKLRPR | 54.37 | EGEKKKLRPK | 45.63 |
| NS3 | 2061 | 0.99 | 2 | 2 | 0 | yes | GEKKKLRPRW | 54.37 | GEKKKLRPKW | 45.63 |
| NS3 | 2062 | 0.99 | 2 | 2 | 0 | yes | EKKKLRPRWL | 54.37 | EKKKLRPKWL | 45.63 |
| NS3 | 2063 | 0.99 | 2 | 2 | 0 | yes | KKKLRPRWLD | 54.37 | KKKLRPKWLD | 45.63 |
| NS3 | 2064 | 0.99 | 2 | 2 | 0 | yes | KKLRPRWLDA | 54.37 | KKLRPKWLDA | 45.63 |
| NS3 | 2065 | 0.99 | 2 | 2 | 0 | yes | KLRPRWLDAR | 54.37 | KLRPKWLDAR | 45.63 |
| NS3 | 2066 | 0.99 | 2 | 2 | 0 | yes | LRPRWLDARV | 54.37 | LRPKWLDARV | 45.63 |
| NS3 | 2067 | 0.99 | 2 | 2 | 0 | yes | RPRWLDARVY | 54.37 | RPKWLDARVY | 45.63 |
| NS3 | 2068 | 0.99 | 2 | 2 | 0 | yes | PRWLDARVYA | 54.37 | PKWLDARVYA | 45.63 |
| NS3 | 2069 | 0.99 | 2 | 2 | 0 | yes | RWLDARVYAD | 54.37 | KWLDARVYAD | 45.63 |
| NS3 | 2070 | 0 | 1 | 1 | 0 | yes | WLDARVYADP | 100 | | |
| NS3 | 2071 | 0 | 1 | 1 | 0 | yes | LDARVYADPM | 100 | | |
| NS3 | 2072 | 0 | 1 | 1 | 0 | yes | DARVYADPMA | 100 | | |
| NS3 | 2073 | 0 | 1 | 1 | 0 | yes | ARVYADPMAL | 100 | | |
| NS3 | 2074 | 0.08 | 2 | 1 | 0 | yes | RVYADPMALK | 99.03 | | |
| NS3 | 2075 | 0.08 | 2 | 1 | 0 | yes | VYADPMALKD | 99.03 | | |
| NS3 | 2076 | 0.08 | 2 | 1 | 0 | yes | YADPMALKDF | 99.03 | | |

FIG. 16-80

Species: DENV4 (10-mers)

| protein | block starting position | entropy | total peptides in block | peptides to cover 99% of block | gap/x fraction | 99% of block covered w/ <= 5 peptides? | peptides required

FIG. 16-81

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block |

FIG. 16-82

Species: DENV4 (10-mers)

| protein | block starting position | block entropy | total peptides in block | peptides to cover 99% of block | gap/x fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2127 | 0.86 | 3 | 3 | 0 | yes | TERGGRAYQH | 81.55 | TEKGGRAYQH | 12.62 | TERGGKAYQH | 5.83 | | |
| NS4A | 2128 | 0.86 | 3 | 3 | 0 | yes | ERGGRAYQHA | 81.55 | EKGGRAYQHA | 12.62 | ERGGKAYQHA | 5.83 | | |
| NS4A | 2129 | 0.86 | 3 | 3 | 0 | yes | RGGRAYQHAL | 81.55 | KGGRAYQHAL | 12.62 | RGGKAYQHAL | 5.83 | | |
| NS4A | 2130 | 0.32 | 2 | 2 | 0 | yes | GGRAYQHALN | 94.17 | GGKAYQHALN | 5.83 | | | | |
| NS4A | 2131 | 0.32 | 2 | 2 | 0 | yes | GRAYQHALNE | 94.17 | GKAYQHALNE | 5.83 | | | | |
| NS4A | 2132 | 0.32 | 2 | 2 | 0 | yes | RAYQHALNEL | 94.17 | KAYQHALNEL | 5.83 | | | | |
| NS4A | 2133 | 0 | 1 | 1 | 0 | yes | AYQHALNELP | 100 | | | | | | |
| NS4A | 2134 | 0 | 1 | 1 | 0 | yes | YQHALNELPE | 100 | | | | | | |
| NS4A | 2135 | 0 | 1 | 1 | 0 | yes | QHALNELPES | 100 | | | | | | |
| NS4A | 2136 | 0 | 1 | 1 | 0 | yes | HALNELPESL | 100 | | | | | | |
| NS4A | 2137 | 0 | 1 | 1 | 0 | yes | ALNELPESLE | 100 | | | | | | |
| NS4A | 2138 | 0 | 1 | 1 | 0 | yes | LNELPESLET | 100 | | | | | | |
| NS4A | 2139 | 0 | 1 | 1 | 0 | yes | NELPESLETL | 100 | | | | | | |
| NS4A | 2140 | 0 | 1 | 1 | 0 | yes | ELPESLETLM | 100 | | | | | | |
| NS4A | 2141 | 0 | 1 | 1 | 0 | yes | LPESLETLML | 100 | | | | | | |
| NS4A | 2142 | 0.14 | 2 | 2 | 0 | yes | PESLETLMLV | 98.06 | PESLETLMLI | 1.94 | | | | |
| NS4A | 2143 | 0.14 | 2 | 2 | 0 | yes | ESLETLMLVA | 98.06 | ESLETLMLIA | 1.94 | | | | |
| NS4A | 2144 | 0.14 | 2 | 2 | 0 | yes | SLETLMLVAL | 98.06 | SLETLMLIAL | 1.94 | | | | |
| NS4A | 2145 | 0.14 | 2 | 2 | 0 | yes | LETLMLVALL | 98.06 | LETLMLIALL | 1.94 | | | | |
| NS4A | 2146 | 0.14 | 2 | 2 | 0 | yes | ETLMLVALLG | 98.06 | ETLMLIALLG | 1.94 | | | | |
| NS4A | 2147 | 0.14 | 2 | 2 | 0 | yes | TLMLVALLGA | 98.06 | TLMLIALLGA | 1.94 | | | | |
| NS4A | 2148 | 0.14 | 2 | 2 | 0 | yes | LMLVALLGAM | 98.06 | LMLIALLGAM | 1.94 | | | | |
| NS4A | 2149 | 0.14 | 2 | 2 | 0 | yes | MLVALLGAMT | 98.06 | MLIALLGAMT | 1.94 | | | | |
| NS4A | 2150 | 0.14 | 2 | 2 | 0 | yes | LVALLGAMTA | 98.06 | LIALLGAMTA | 1.94 | | | | |
| NS4A | 2151 | 0.14 | 2 | 2 | 0 | yes | VALLGAMTAG | 98.06 | IALLGAMTAG | 1.94 | | | | |

FIG. 16-83

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | pept

FIG. 16-84

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency |

FIG. 16-85

Species: DENW4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|---|---|---|---|---|---|---|
| NS4A | 2202 | 0 | 1 | 1 | 0 | yes | IILEFFLMVL | 100 | | |
| NS4A | 2203 | 0 | 1 | 1 | 0 | yes | ILEFFLMVLL | 100 | | |
| NS4A | 2204 | 0.19 | 2 | 2 | 0 | yes | LEFFLMVLLI | 97.09 | LEFFLMVLLV | 2.91 |
| NS4A | 2205 | 0.19 | 2 | 2 | 0 | yes | EFFLMVLLIP | 97.09 | EFFLMVLLVP | 2.91 |
| NS4A | 2206 | 0.19 | 2 | 2 | 0 | yes | FFLMVLLIPE | 97.09 | FFLMVLLVPE | 2.91 |
| NS4A | 2207 | 0.19 | 2 | 2 | 0 | yes | FLMVLLIPEP | 97.09 | FLMVLLVPEP | 2.91 |
| NS4A | 2208 | 0.19 | 2 | 2 | 0 | yes | LMVLLIPEPE | 97.09 | LMVLLVPEPE | 2.91 |
| NS4A | 2209 | 0.19 | 2 | 2 | 0 | yes | MVLLIPEPEK | 97.09 | MVLLVPEPEK | 2.91 |
| NS4A | 2210 | 0.19 | 2 | 2 | 0 | yes | VLLIPEPEKQ | 97.09 | VLLVPEPEKQ | 2.91 |
| NS4A | 2211 | 0.19 | 2 | 2 | 0 | yes | LLIPEPEKQR | 97.09 | LLVPEPEKQR | 2.91 |
| NS4A | 2212 | 0.19 | 2 | 2 | 0 | yes | LIPEPEKQRT | 97.09 | LVPEPEKQRT | 2.91 |
| NS4A | 2213 | 0.19 | 2 | 2 | 0 | yes | IPEPEKQRTP | 97.09 | VPEPEKQRTP | 2.91 |
| NS4A | 2214 | 0 | 1 | 1 | 0 | yes | PEPEKQRTPQ | 100 | | |
| NS4A | 2215 | 0 | 1 | 1 | 0 | yes | EPEKQRTPQD | 100 | | |
| NS4A | 2216 | 0 | 1 | 1 | 0 | yes | PEKQRTPQDN | 100 | | |
| NS4A | 2217 | 0 | 1 | 1 | 0 | yes | EKQRTPQDNQ | 100 | | |
| NS4A | 2218 | 0 | 1 | 1 | 0 | yes | KQRTPQDNQL | 100 | | |
| NS4A | 2219 | 0 | 1 | 1 | 0 | yes | QRTPQDNQLI | 100 | | |
| NS4A | 2220 | 0 | 1 | 1 | 0 | yes | RTPQDNQLIY | 100 | | |
| 2K | 2221 | 0 | 1 | 1 | 0 | yes | TPQDNQLIYV | 100 | | |
| 2K | 2222 | 0 | 1 | 1 | 0 | yes | PQDNQLIYVI | 100 | | |
| 2K | 2223 | 0 | 1 | 1 | 0 | yes | QDNQLIYVIL | 100 | | |
| 2K | 2224 | 0.36 | 2 | 2 | 0 | yes | DNQLIYVILT | 93.2 | DNQLIYVILA | 6.8 |
| 2K | 2225 | 0.4 | 3 | 2 | 0 | yes | NQLIYVILTI | 93.2 | NQLIYVILAI | 5.83 |
| 2K | 2226 | 0.4 | 3 | 2 | 0 | yes | QLIYVILTIL | 93.2 | QLIYVILAIL | 5.83 |

FIG. 16-86

Species: DENV4 (10-mers)

|

FIG. 16-87

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2254 | 0.72 | 6 | 5 | 0 | yes | TDFGFYQV

FIG. 16-88

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2279 | 0.08 | 2 | 2 | 2.9 | yes | TLYAVATTIL | 96.12 | TLYAVTTIIL | 0.97 |
| NS4B | 2280 | 0.08 | 2 | 2 | 2.9 | yes | LYAVATTILT | 96.12 | LYAVVTTILT | 0.97 |
| NS4B | 2281 | 0.08 | 2 | 2 | 2.9 | yes | YAVATTILTP | 96.12 | YAVVTTILTP | 0.97 |
| NS4B | 2282 | 0.08 | 2 | 2 | 2.9 | yes | AVATTILTPM | 96.12 | AVVTTILTPM | 0.97 |
| NS4B | 2283 | 0.08 | 2 | 2 | 2.9 | yes | VATTILTPML | 96.12 | VTTILTPML | 0.97 |
| NS4B | 2284 | 0.08 | 2 | 2 | 2.9 | yes | ATTILTPMLR | 96.12 | VTTILTPMLR | 0.97 |
| NS4B | 2285 | 0 | 1 | 1 | 2.9 | yes | TTILTPMLRH | 97.09 | | |
| NS4B | 2286 | 0 | 1 | 1 | 2.9 | yes | TILTPMLRHT | 97.09 | | |
| NS4B | 2287 | 0 | 1 | 1 | 2.9 | yes | ILTPMLRHTI | 97.09 | | |
| NS4B | 2288 | 0 | 1 | 1 | 0 | yes | LTPMLRHTIE | 100 | | |
| NS4B | 2289 | 0 | 1 | 1 | 0 | yes | TPMLRHTIEN | 100 | | |
| NS4B | 2290 | 0 | 1 | 1 | 0 | yes | PMLRHTIENT | 100 | | |
| NS4B | 2291 | 0 | 1 | 1 | 0 | yes | MLRHTIENTS | 100 | | |
| NS4B | 2292 | 0 | 1 | 1 | 0 | yes | LRHTIENTSA | 100 | | |
| NS4B | 2293 | 0 | 1 | 1 | 0 | yes | RHTIENTSAN | 100 | | |
| NS4B | 2294 | 0 | 1 | 1 | 0 | yes | HTIENTSANL | 100 | | |
| NS4B | 2295 | 0 | 1 | 1 | 0 | yes | TIENTSANLS | 100 | | |
| NS4B | 2296 | 0 | 1 | 1 | 0 | yes | IENTSANLSL | 100 | | |
| NS4B | 2297 | 0.08 | 2 | 2 | 0 | yes | ENTSANLSLA | 99.03 | | |
| NS4B | 2298 | 0.08 | 2 | 2 | 0 | yes | NTSANLSLAA | 99.03 | | |
| NS4B | 2299 | 0.08 | 2 | 2 | 0 | yes | TSANLSLAAI | 99.03 | | |
| NS4B | 2300 | 0.08 | 2 | 2 | 0 | yes | SANLSLAAIA | 99.03 | | |
| NS4B | 2301 | 0.08 | 2 | 2 | 0 | yes | ANLSLAAIAN | 99.03 | | |
| NS4B | 2302 | 0.16 | 3 | 2 | 0 | yes | NLSLAAIANQ | 98.06 | NLSLTAIANQ | 0.97 |
| NS4B | 2303 | 0.16 | 3 | 2 | 0 | yes | LSLAAIANQA | 98.06 | LSLTAIANQA | 0.97 |

FIG. 16-89

Species: DENV4 (10-mers)

| protein | block

FIG. 16-90

Species: DENV4 (10-mers)

| protein | block starting position | block entropy | total peptides in block | peptides to cover 99% of block | gap/x fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2329 | 0.08 | 2 | 1 | 0 | yes | LGVPLLAMGC | 99.03 | | | | | | |
| NS4B | 2330 | 0.08 | 2 | 1 | 0 | yes | GVPLLAMGCY | 99.03 | | | | | | |
| NS4B | 2331 | 0.08 | 2 | 1 | 0 | yes | VPLLAMGCYS | 99.03 | | | | | | |
| NS4B | 2332 | 0.08 | 2 | 1 | 0 | yes | PLLAMGCYSQ | 99.03 | | | | | | |
| NS4B | 2333 | 0.08 | 2 | 1 | 0 | yes | LLAMGCYSQV | 99.03 | | | | | | |
| NS4B | 2334 | 0.08 | 2 | 1 | 0 | yes | LAMGCYSQVN | 99.03 | | | | | | |
| NS4B | 2335 | 0.08 | 2 | 1 | 0 | yes | AMGCYSQVNP | 99.03 | | | | | | |
| NS4B | 2336 | 0.08 | 2 | 1 | 0 | yes | MGCYSQVNPT | 99.03 | | | | | | |
| NS4B | 2337 | 0 | 1 | 1 | 0 | yes | GCYSQVNPTT | 100 | | | | | | |
| NS4B | 2338 | 0 | 1 | 1 | 0 | yes | CYSQVNPTTL | 100 | | | | | | |
| NS4B | 2339 | 0.14 | 2 | 2 | 0 | yes | YSQVNPTTLI | 98.06 | YSQVNPTTLI | 1.94 | | | | |
| NS4B | 2340 | 0.14 | 2 | 2 | 0 | yes | SQVNPTTLIA | 98.06 | SQVNPTTLIA | 1.94 | | | | |
| NS4B | 2341 | 0.14 | 2 | 2 | 0 | yes | QVNPTTLIAS | 98.06 | QVNPTTLIAS | 1.94 | | | | |
| NS4B | 2342 | 0.14 | 2 | 2 | 0 | yes | VNPTTLIASL | 98.06 | VNPTTLIASL | 1.94 | | | | |
| NS4B | 2343 | 0.22 | 3 | 2 | 0 | yes | NPTTLIASLV | 97.09 | NPTTLIASLV | 1.94 | | | | |
| NS4B | 2344 | 0.22 | 3 | 2 | 0 | yes | PTTLIASLVM | 97.09 | PTTLIASLVM | 1.94 | | | | |
| NS4B | 2345 | 0.22 | 3 | 2 | 0 | yes | TTLIASLVML | 97.09 | TTLIASLVML | 1.94 | | | | |
| NS4B | 2346 | 0.53 | 5 | 4 | 0 | yes | TLIASLVMLL | 92.23 | TLTASLVMLS | 3.88 | TLIASLVMLL | 3.88 | TLTASLVMLF | 0.97 |
| NS4B | 2347 | 0.53 | 5 | 4 | 0 | yes | LIASLVMLLV | 92.23 | LTASLVMLSV | 3.88 | LIASLVMLLV | 3.88 | LTASLAMLLV | 0.97 |
| NS4B | 2348 | 0.53 | 5 | 4 | 0 | yes | IASLVMLLVH | 92.23 | TASLVMLSVH | 3.88 | IASLVMLLVH | 3.88 | TASLVMLFVH | 0.97 |
| NS4B | 2349 | 0.39 | 4 | 3 | 0 | yes | ASLVMLLVHY | 94.17 | ASLVMLSVHY | 3.88 | ASLVMLFVHY | 0.97 | | |
| NS4B | 2350 | 0.39 | 4 | 3 | 0 | yes | SLVMLLVHYA | 94.17 | SLVMLSVHYA | 3.88 | SLVMLFVHYA | 0.97 | | |
| NS4B | 2351 | 0.39 | 4 | 3 | 0 | yes | LVMLLVHYAI | 94.17 | LVMLSVHYAI | 3.88 | LAMLLVHYAI | 0.97 | | |
| NS4B | 2352 | 0.39 | 4 | 3 | 0 | yes | VMLLVHYAII | 94.17 | VMLSVHYAII | 3.88 | VMLFVHYAII | 0.97 | | |
| NS4B | 2353 | 0.32 | 3 | 2 | 0 | yes | MLLVHYAIIG | 95.15 | MLSVHYAIIG | 3.88 | | | | |

FIG. 16-91

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2354 | 0.32 | 3 | 2 | 0 | yes | LLVHYAIIGP | 95.15 | LSVHYAIIGP | 3.88 | | | | |
| NS4B | 2355 | 0.32 | 3 | 2 | 0 | yes | LVHYAIIGPG | 95.15 | SVHYAIIGPG | 3.88 | | | | |
| NS4B | 2356 | 0 | 1 | 1 | 0 | yes | VHYAIIGPGL | 100 | | | | | | |
| NS4B | 2357 | 0 | 1 | 1 | 0 | yes | HYAIIGPGLQ | 100 | | | | | | |
| NS4B | 2358 | 0 | 1 | 1 | 0 | yes | YAIIGPGLQA | 100 | | | | | | |
| NS4B | 2359 | 0 | 1 | 1 | 0 | yes | AIIGPGLQAK | 100 | | | | | | |
| NS4B | 2360 | 0 | 1 | 1 | 0 | yes | IIGPGLQAKA | 100 | | | | | | |
| NS4B | 2361 | 0 | 1 | 1 | 0 | yes | IGPGLQAKAT | 100 | | | | | | |
| NS4B | 2362 | 0 | 1 | 1 | 0 | yes | GPGLQAKATR | 100 | | | | | | |
| NS4B | 2363 | 0 | 1 | 1 | 0 | yes | PGLQAKATRE | 100 | | | | | | |
| NS4B | 2364 | 0 | 1 | 1 | 0 | yes | GLQAKATREA | 100 | | | | | | |
| NS4B | 2365 | 0.08 | 2 | 1 | 0 | yes | LQAKATREAQ | 99.03 | | | | | | |
| NS4B | 2366 | 0.08 | 2 | 1 | 0 | yes | QAKATREAQK | 99.03 | | | | | | |
| NS4B | 2367 | 0.08 | 2 | 1 | 0 | yes | AKATREAQKR | 99.03 | | | | | | |
| NS4B | 2368 | 0.08 | 2 | 1 | 0 | yes | KATREAQKRT | 99.03 | | | | | | |
| NS4B | 2369 | 0.08 | 2 | 1 | 0 | yes | ATREAQKRTA | 99.03 | | | | | | |
| NS4B | 2370 | 0.08 | 2 | 1 | 0 | yes | TREAQKRTAA | 99.03 | | | | | | |
| NS4B | 2371 | 0.08 | 2 | 1 | 0 | yes | REAQKRTAAG | 99.03 | | | | | | |
| NS4B | 2372 | 0.08 | 2 | 1 | 0 | yes | EAQKRTAAGI | 99.03 | | | | | | |
| NS4B | 2373 | 0.08 | 2 | 1 | 0 | yes | AQKRTAAGIM | 99.03 | | | | | | |
| NS4B | 2374 | 0.08 | 2 | 1 | 0 | yes | QKRTAAGIMK | 99.03 | | | | | | |
| NS4B | 2375 | 0 | 1 | 1 | 0 | yes | KRTAAGIMKN | 100 | | | | | | |
| NS4B | 2376 | 0 | 1 | 1 | 0 | yes | RTAAGIMKNP | 100 | | | | | | |
| NS4B | 2377 | 0 | 1 | 1 | 0 | yes | TAAGIMKNPT | 100 | | | | | | |
| NS4B | 2378 | 0 | 1 | 1 | 0 | yes | AAGIMKNPTV | 100 | | | | | | |

FIG. 16-92

Species: DENW4 (10-mers)

| protein | block starting position | entropy | total peptides in block | peptides to cover 99% of block | gap/x fraction | 99% of block covered w/ => 5 peptides? | peptides required to cover 99% of block | frequency |
|---|---|---|---|---|---|---|---|---|
| NS4B | 2379 | 0 | — | — | 0 | yes | AGIMKNPTVD | 100 |
| NS4B | 2380 | 0 | — | — | 0 | yes | GIMKNPTVDG | 100 |
| NS4B | 2381 | 0 | — | — | 0 | yes | IMKNPTVDGI | 100 |
| NS4B | 2382 | 0 | — | — | 0 | yes | MKNPTVDGIT | 100 |
| NS4B | 2383 | 0 | — | — | 0 | yes | KNPTVDGITV | 100 |
| NS4B | 2384 | 0 | — | — | 0 | yes | NPTVDGITVI | 100 |
| NS4B | 2385 | 0 | — | — | 0 | yes | PTVDGITVID | 100 |
| NS4B | 2386 | 0 | — | — | 0 | yes | TVDGITVIDL | 100 |
| NS4B | 2387 | 0 | — | — | 0 | yes | VDGITVIDLE | 100 |
| NS4B | 2388 | 0 | — | — | 0 | yes | DGITVIDLEP | 100 |
| NS4B | 2389 | 0 | — | — | 0 | yes | GITVIDLEPI | 100 |
| NS4B | 2390 | 0 | — | — | 0 | yes | ITVIDLEPIS | 100 |
| NS4B | 2391 | 0 | — | — | 0 | yes | TVIDLEPISY | 100 |
| NS4B | 2392 | 0 | — | — | 0 | yes | VIDLEPISYD | 100 |
| NS4B | 2393 | 0 | — | — | 0 | yes | IDLEPISYDP | 100 |
| NS4B | 2394 | 0 | — | — | 0 | yes | DLEPISYDPK | 100 |
| NS4B | 2395 | 0 | — | — | 0 | yes | LEPISYDPKF | 100 |
| NS4B | 2396 | 0 | — | — | 0 | yes | EPISYDPKFE | 100 |
| NS4B | 2397 | 0 | — | — | 0 | yes | PISYDPKFEK | 100 |
| NS4B | 2398 | 0 | — | — | 0 | yes | ISYDPKFEKQ | 100 |
| NS4B | 2399 | 0 | — | — | 0 | yes | SYDPKFEKQL | 100 |
| NS4B | 2400 | 0 | — | — | 0 | yes | YDPKFEKQLG | 100 |
| NS4B | 2401 | 0 | — | — | 0 | yes | DPKFEKQLGQ | 100 |
| NS4B | 2402 | 0 | — | — | 0 | yes | PKFEKQLGQV | 100 |
| NS4B | 2403 | 0 | — | — | 0 | yes | KFEKQLGQVM | 100 |

FIG. 16-93

Species: DENV4 (10-mers)

| protein | block starting position | entropy | total peptides in block | peptides to cover 99% of block | gap/x fraction | 99% of block covered w/ <= 5 peptides?

FIG. 16-94

Species: DENW4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2429 | 0.54 | 3 | 2 | 0 | yes | AFCEVLTLAT | 89.32 | ALCEVLTLAT | 9.71 | | | | |
| NS4B | 2430 | 0.54 | 3 | 2 | 0 | yes | FCEVLTLATG | 89.32 | LCEVLTLATG | 9.71 | | | | |
| NS4B | 2431 | 0.08 | 2 | 1 | 0 | yes | CEVLTLATGP | 99.03 | | | | | | |
| NS4B | 2432 | 0.44 | 4 | 3 | 0 | yes | EVLTLATGPI | 93.2 | EVLTLATGPV | 4.85 | EVLTLATGPT | 0.97 | | |
| NS4B | 2433 | 0.89 | 5 | 4 | 0 | yes | VLTLATGPIL | 83.5 | VLTLATGPIM | 9.71 | VLTLATGPVL | 4.85 | VLTLSTGPAL | 0.97 |
| NS4B | 2434 | 0.89 | 5 | 4 | 0 | yes | LTLATGPILT | 83.5 | LTLATGPIMT | 9.71 | LTLATGPVLT | 4.85 | LTLATGPTLT | 0.97 |
| NS4B | 2435 | 0.89 | 5 | 4 | 0 | yes | TLATGPILTL | 83.5 | TLATGPIMTL | 9.71 | TLATGPVLTL | 4.85 | TLATGPTLIL | 0.97 |
| NS4B | 2436 | 0.89 | 5 | 4 | 0 | yes | LATGPILTLW | 83.5 | LATGPIMTLW | 9.71 | L

FIG. 16-95

Species: DENW4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2454 | 0 | 1 | 1 | 0 | yes | NTTIAVSTAN | 100 | | | | | | |
| NS4B | 2455 | 0 | 1 | 1 | 0 | yes | TTIAVSTANI | 100 | | | | | | |
| NS4B | 2456 | 0 | 1 | 1 | 0 | yes | TIAVSTANIF | 100 | | | | | | |
| NS4B | 2457 | 0 | 1 | 1 | 0 | yes | IAVSTANIFR | 100 | | | | | | |
| NS4B | 2458 | 0 | 1 | 1 | 0 | yes | AVSTANIFRG | 100 | | | | | | |
| NS4B | 2459 | 0 | 1 | 1 | 0 | yes | VSTANIFRGS | 100 | | | | | | |
| NS4B | 2460 | 0 | 1 | 1 | 0 | yes | STANIFRGSY | 100 | | | | | | |
| NS4B | 2461 | 0 | 1 | 1 | 0 | yes | TANIFRGSYL | 100 | | | | | | |
| NS4B | 2462 | 0 | 1 | 1 | 0 | yes | ANIFRGSYLA | 100 | | | | | | |
| NS4B | 2463 | 0 | 1 | 1 | 0 | yes | NIFRGSYLAG | 100 | | | | | | |
| NS4B | 2464 | 0 | 1 | 1 | 0 | yes | IFRGSYLAGA | 100 | | | | | | |
| NS4B | 2465 | 0 | 1 | 1 | 0 | yes | FRGSYLAGAG | 100 | | | | | | |
| NS4B | 2466 | 0 | 1 | 1 | 0 | yes | RGSYLAGAGL | 100 | | | | | | |
| NS4B | 2467 | 0 | 1 | 1 | 0 | yes | GSYLAGAGLA | 100 | | | | | | |
| NS4B | 2468 | 0 | 1 | 1 | 0 | yes | SYLAGAGLAF | 100 | | | | | | |
| NS4B | 2469 | 0 | 1 | 1 | 0 | yes | YLAGAGLAFS | 100 | | | | | | |
| NS4B | 2470 | 0 | 1 | 1 | 0 | yes | LAGAGLAFSL | 100 | | | | | | |
| NS4B | 2471 | 0 | 1 | 1 | 0 | yes | AGAGLAFSLI | 100 | | | | | | |
| NS4B | 2472 | 0 | 1 | 1 | 0 | yes | GAGLAFSLIK | 100 | | | | | | |
| NS4B | 2473 | 0 | 1 | 1 | 0 | yes | AGLAFSLIKN | 100 | | | | | | |
| NS4B | 2474 | 0.22 | 3 | 3 | 2.9 | yes | GLAFSLIKNA | 94.17 | GLAFSLIKNV | 1.94 | GLAFSLIKNT | 0.97 | | |
| NS4B | 2475 | 0.22 | 3 | 3 | 2.9 | yes | LAFSLIKNAQ | 94.17 | LAFSLIKNVQ | 1.94 | LAFSLIKNTQ | 0.97 | | |
| NS4B | 2476 | 0.3 | 4 | 4 | 2.9 | yes | AFSLIKNAQT | 93.2 | AFSLIKNVQT | 1.94 | AFSLIKNAQA | 0.97 | AFSLIKNTQT | 0.97 |
| NS4B | 2477 | 0.3 | 4 | 4 | 2.9 | yes | FSLIKNAQTP | 93.2 | FSLIKNVQTP | 1.94 | FSLIKNAQAP | 0.97 | FSLIKNTQTP | 0.97 |
| NS4B | 2478 | 0.3 | 4 | 4 | 2.9 | yes | SLIKNAQTPR | 93.2 | SLIKNVQTPR | 1.94 | SLIKNAQAPR | 0.97 | SLIKNTQTPR | 0.97 |

FIG. 16-96

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides

FIG. 16-97

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of

FIG. 16-98

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides

FIG. 16-99

Species: DENV4 (10-mers)

| protein | block starting position | block entropy | total peptides | peptides to cover 99% of block in block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2554 | 0.49 | 2 | 2 | 0 | yes | VERGMVK

FIG. 16-100

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | pe

FIG. 16-101

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99

FIG. 16-102

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency |
|---|---|---|---|---|---|---|---|---|
| NS5 | 2629 |

FIG. 16-104

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2679 | 0.49 | 2 | 2 | 0 | yes | IEEL

FIG. 16-105

Species: DENV4 (10-mers)

| protein | block starting position | block entropy | total peptides in block | peptides required to cover 99% of block | gap/x fraction | 99% of block covered w/ <= 5 peptides?

FIG. 16-106

Species: DENV4 (10-mers)

| protein | block starting position | block entropy | total peptides in block | peptides to cover 99% of block | gap/x fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2729 | 0.24 | 4 | 3 | 0 | yes | NRFTTRHRKP | 97.09 | NRFTTRHRKP | 0.97 | NRFTTRHRRP | | | |
| NS5 | 2730 | 0.24 | 4 | 3 | 0 | yes | RFTTRHRKPT | 97.09 | RFTTRHRRPT | 0.97 | RFTTKHRKPT | | | |
| NS5 | 2731 | 0.16 | 3 | 2 | 0 | yes | FTTRHRKPTY | 98.06 | FTTRHRRPTY | 0.97 | | | | |
| NS5 | 2732 | 0.16 | 3 | 2 | 0 | yes | TTRHRKPTYE | 98.06 | TTKHRKPTYE | 0.97 | | | | |
| NS5 | 2733 | 0.16 | 3 | 2 | 0 | yes | TRHRKPTYEK | 98.06 | TKHRKPTYEK | 0.97 | | | | |
| NS5 | 2734 | 0.16 | 3 | 2 | 0 | yes | RHRKPTYEKD | 98.06 | RHRRPTYEKD | 0.97 | | | | |
| NS5 | 2735 | 0.27 | 3 | 2 | 0 | yes | HRKPTYEKDV | 96.12 | HRKPTYEKDA | 2.91 | | | | |
| NS5 | 2736 | 0.27 | 3 | 2 | 0 | yes | RKPTYEKDVD | 96.12 | RKPTYEKDAD | 2.91 | | | | |
| NS5 | 2737 | 0.27 | 3 | 2 | 0 | yes | KPTYEKDVDL | 96.12 | KPTYEKDADL | 2.91 | | | | |
| NS5 | 2738 | 0.19 | 2 | 2 | 0 | yes | PTYEKDVDLG | 97.09 | PTYEKDADLG | 2.91 | | | | |
| NS5 | 2739 | 0.19 | 2 | 2 | 0 | yes | TYEKDVDLGA | 97.09 | TYEKDADLGA | 2.91 | | | | |
| NS5 | 2740 | 0.19 | 2 | 2 | 0 | yes | YEKDVDLGAG | 97.09 | YEKDADLGAG | 2.91 | | | | |
| NS5 | 2741 | 0.19 | 2 | 2 | 0 | yes | EKDVDLGAGT | 97.09 | EKDADLGAGT | 2.91 | | | | |
| NS5 | 2742 | 0.19 | 2 | 2 | 0 | yes | KDVDLGAGTR | 97.09 | KDADLGAGTR | 2.91 | | | | |
| NS5 | 2743 | 0.19 | 2 | 2 | 0 | yes | DVDLGAGTRS | 97.09 | DADLGAGTRS | 2.91 | | | | |
| NS5 | 2744 | 0.19 | 2 | 2 | 0 | yes | VDLGAGTRSV | 97.09 | ADLGAGTRSV | 2.91 | | | | |
| NS5 | 2745 | 0 | 1 | 1 | 0 | yes | DLGAGTRSVS | 100 | | | | | | |
| NS5 | 2746 | 0 | 1 | 1 | 0 | yes | LGAGTRSVST | 100 | | | | | | |
| NS5 | 2747 | 0 | 1 | 1 | 0 | yes | GAGTRSVSTE | 100 | | | | | | |
| NS5 | 2748 | 0.08 | 2 | 1 | 0 | yes | AGTRSVSTET | 99.03 | | | | | | |
| NS5 | 2749 | 0.08 | 2 | 1 | 0 | yes | GTRSVSTETE | 99.03 | | | | | | |
| NS5 | 2750 | 0.08 | 2 | 1 | 0 | yes | TRSVSTETEK | 99.03 | | | | | | |
| NS5 | 2751 | 0.08 | 2 | 1 | 0 | yes | RSVSTETEKP | 99.03 | | | | | | |
| NS5 | 2752 | 0.08 | 2 | 1 | 0 | yes | SVSTETEKPD | 99.03 | | | | | | |
| NS5 | 2753 | 0.08 | 2 | 1 | 0 | yes | VSTETEKPDM | 99.03 | | | | | | |

FIG. 16-107

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|

FIG. 16-108

Species: DENW4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2779 | 0.14 | 2 | 2 | 0 | yes | TWHYDQENPY | 98.06 | TWHYDHENPY | 1.94 | | | | |
| NS5 | 2780 | 0.14 | 2 | 2 | 0 | yes | WHYDQENPYR | 98.06 | WHYDHENPYR | 1.94 | | | | |
| NS5 | 2781 | 0.14 | 2 | 2 | 0 | yes | HYDQENPYRT | 98.06 | HYDHENPYRT | 1.94 | | | | |
| NS5 | 2782 | 0.14 | 2 | 2 | 0 | yes | YDQENPYRTW | 98.06 | YDHENPYRTW | 1.94 | | | | |
| NS5 | 2783 | 0.14 | 2 | 2 | 0 | yes | DQENPYRTWA | 98.06 | DHENPYRTWA | 1.94 | | | | |
| NS5 | 2784 | 0.14 | 2 | 2 | 0 | yes | QENPYRTWAY | 98.06 | HENPYRTWAY | 1.94 | | | | |
| NS5 | 2785 | 0 | 1 | 1 | 0 | yes | ENPYRTWAYH | 100 | | | | | | |
| NS5 | 2786 | 0 | 1 | 1 | 0 | yes | NPYRTWAYHG | 100 | | | | | | |
| NS5 | 2787 | 0 | 1 | 1 | 0 | yes | PYRTWAYHGS | 100 | | | | | | |
| NS5 | 2788 | 0 | 1 | 1 | 0 | yes | YRTWAYHGSY | 100 | | | | | | |
| NS5 | 2789 | 0 | 1 | 1 | 0 | yes | RTWAYHGSYE | 100 | | | | | | |
| NS5 | 2790 | 0 | 1 | 1 | 0 | yes | TWAYHGSYEA | 100 | | | | | | |
| NS5 | 2791 | 0.08 | 2 | 2 | 0 | yes | WAYHGSYEAP | 99.03 | | | | | | |
| NS5 | 2792 | 0.08 | 2 | 2 | 0 | yes | AYHGSYEAPS | 99.03 | | | | | | |
| NS5 | 2793 | 0.08 | 2 | 2 | 0 | yes | YHGSYEAPST | 99.03 | | | | | | |
| NS5 | 2794 | 0.08 | 2 | 2 | 0 | yes | HGSYEAPSTG | 99.03 | | | | | | |
| NS5 | 2795 | 0.08 | 2 | 2 | 0 | yes | GSYEAPSTGS | 99.03 | | | | | | |
| NS5 | 2796 | 0.16 | 3 | 2 | 0 | yes | SYEAPSTGSA | 98.06 | SYEASSTGSA | 0.97 | | | | |
| NS5 | 2797 | 0.16 | 3 | 2 | 0 | yes | YEAPSTGSAS | 98.06 | YEASSTGSAS | 0.97 | | | | |
| NS5 | 2798 | 0.16 | 3 | 2 | 0 | yes | EAPSTGSASS | 98.06 | EAPSTGSTSS | 0.97 | | | | |
| NS5 | 2799 | 0.16 | 3 | 2 | 0 | yes | APSTGSASSM | 98.06 | APSTGSTSSM | 0.97 | | | | |
| NS5 | 2800 | 0.24 | 4 | 3 | 0 | yes | PSTGSASSMV | 97.09 | PSTGSTSSMV | 0.97 | | | SSTGSASSMV | 0.97 |
| NS5 | 2801 | 0.16 | 3 | 2 | 0 | yes | STGSASSMVN | 98.06 | STGTSMVN | 0.97 | | | | |
| NS5 | 2802 | 0.16 | 3 | 2 | 0 | yes | TGSASSMVNG | 98.06 | TGSASSMYN | 0.97 | | | | |
| NS5 | 2803 | 0.16 | 3 | 2 | 0 | yes | GSASSMVNGV | 98.06 | GSTSSMVNGV | 0.97 | | | | |

FIG. 16-109

Species: DENV4 (10-mers)

| protein | block starting position | block entropy | total pe

FIG. 16-110

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2829 | 0 | 1 | 1 | 0 | yes | LAMTDTTPFG | 100 | | | | | | |
| NS5 | 2830 | 0 | 1 | 1 | 0 | yes | AMTDTTPFGQ | 100 | | | | | | |
| NS5 | 2831 | 0 | 1 | 1 | 0 | yes | MTDTTPFGQQ | 100 | | | | | | |
| NS5 | 2832 | 0 | 1 | 1 | 0 | yes | TDTTPFGQQR | 100 | | | | | | |
| NS5 | 2833 | 0 | 1 | 1 | 0 | yes | DTTPFGQQRV | 100 | | | | | | |
| NS5 | 2834 | 0 | 1 | 1 | 0 | yes | TTPFGQQRVF | 100 | | | | | | |
| NS5 | 2835 | 0 | 1 | 1 | 0 | yes | TPFGQQRVFK | 100 | | | | | | |
| NS5 | 2836 | 0 | 1 | 1 | 0 | yes | PFGQQRVFKE | 100 | | | | | | |
| NS5 | 2837 | 0 | 1 | 1 | 0 | yes | FGQQRVFKEK | 100 | | | | | | |
| NS5 | 2838 | 0 | 1 | 1 | 0 | yes | GQQRVFKEKV | 100 | | | | | | |
| NS5 | 2839 | 0 | 1 | 1 | 0 | yes | QQRVFKEKVD | 100 | | | | | | |
| NS5 | 2840 | 0 | 1 | 1 | 0 | yes | QRVFKEKVDT | 100 | | | | | | |
| NS5 | 2841 | 0 | 1 | 1 | 0 | yes | RVFKEKVDTR | 100 | | | | | | |
| NS5 | 2842 | 0 | 1 | 1 | 0 | yes | VFKEKVDTRI | 100 | | | | | | |
| NS5 | 2843 | 0 | 1 | 1 | 0 | yes | FKEKVDTRTP | 100 | | | | | | |
| NS5 | 2844 | 0 | 1 | 1 | 0 | yes | KEKVDTRTPQ | 100 | | | | | | |
| NS5 | 2845 | 0.08 | 2 | 2 | 0 | yes | EKVDTRTPQP | 99.03 | | | | | | |
| NS5 | 2846 | 0.08 | 2 | 2 | 0 | yes | KVDTRTPQPK | 99.03 | | | | | | |
| NS5 | 2847 | 0.22 | 3 | 2 | 0 | yes | VDTRTPQPKP | 97.09 | VDTRTPQPKL | 1.94 | | | | |
| NS5 | 2848 | 0.22 | 3 | 2 | 0 | yes | DTRTPQPKPG | 97.09 | DTRTPQPKLG | 1.94 | | | | |
| NS5 | 2849 | 0.22 | 3 | 2 | 0 | yes | TRTPQPKPGT | 97.09 | TRTPQPKLGT | 1.94 | | | | |
| NS5 | 2850 | 0.35 | 4 | 3 | 0 | yes | RTPQPKPGTR | 95.15 | RTPQPKLGTR | 1.94 | RTPQPKPGTQ | 1.94 | | |
| NS5 | 2851 | 0.63 | 5 | 4 | 0 | yes | TPQPKPGTRM | 90.29 | TPQPKLGTRV | 4.85 | TPQPKPGTQM | 1.94 | | |
| NS5 | 2852 | 1.16 | 6 | 5 | 0 | yes | PQPKPGTRMV | 77.67 | PQPKPGTRVV | 12.62 | PQPKPGTQMI | 1.94 | PQPKLGTRVV | 1.94 |
| NS5 | 2853 | 1.16 | 6 | 5 | 0 | yes | QPKPGTRMVM | 77.67 | QPKPGTRVVM | 12.62 | QPKPGTQMIM | 1.94 | QPKLGTRVVM | 1.94 |

FIG. 16-111

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequ

FIG. 16-113

Species: DENV4 (10-mers)

| protein | block starting position | block entropy | total peptides in block | peptides to cover 99% of block | gap/x fraction | 99% of block covered w/ => 5 peptides? | peptides required to cover 99% of block | frequency | peptides required to

FIG. 16-114

| Species: DENV4 (10-mers) protein | block starting position | block entropy | total peptides in block | peptides to c

FIG. 16-116

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2983 | 0.47 | 3 | 2 | 0 | yes | DHWFGRENSW | 91.26 | DHWFSRENSW | 7.77 | | | | |
| NS5 | 2984 | 0.47 | 3 | 2 | 0 | yes | HWFGRENSWS

FIG. 16-117

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3008 | 0.88 | 4 | 3 | 0 | yes | EEIDKKDGDL | 79.61 | EDIDKKDGDL | 17.48 | EDIDRKDGDL | 1.94 | | |
| NS5 | 3009 | 0.96 | 5 | 4 | 0 | yes | EIDKKDGDLM | 79.61 | DIDKKDGDLI | 15.53 | DIDRKDGDLM | 1.94 | DIDKKDGDLM | 1.94 |
| NS5 | 3010 | 0.83 | 4 | 3 | 0 | yes | IDKKDGDLMY | 81.55 | IDKKDGDLI

FIG. 16-118

Species: DENW4 (10-mers)

| protein | block starting position | block entropy | total peptides in block | peptides required to cover 99% of block | gap x/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3033 | 0.77 | 3 | 2 | 0 | yes | DDLQNEELIT | 80.58 | DDLNEELIT | 18.45 | | | | |
| NS5 | 3034 | 0.77 | 3 | 2 | 0 | yes | DLQNEELITE | 80.58 | DLNEELITE | 18.45 | | | | |
| NS5 | 3035 | 0.77 | 3 | 2 | 0 | yes | LQNEELITEQ | 80.58 | LLNEELITEQ | 18.45 | | | | |
| NS5 | 3036 | 0.77 | 3 | 2 | 0 | yes | QNEELITEQM | 80.58 | LNEELITEQM | 18.45 | | | | |
| NS5 | 3037 | 0.08 | 2 | 1 | 0 | yes | NEELITEQMA | 99.03 | | | | | | |
| NS5 | 3038 | 0.08 | 2 | 1 | 0 | yes | EELITEQMAP | 99.03 | | | | | | |
| NS5 | 3039 | 0.16 | 3 | 2 | 0 | yes | ELITEQMAPH | 98.06 | ELITEQMAPG | 0.97 | | | | |
| NS5 | 3040 | 0.16 | 3 | 2 | 0 | yes | LITEQMAPHH | 98.06 | LVTEQMAPHH | 0.97 | | | | |
| NS5 | 3041 | 0.3 | 3 | 3 | 0 | yes | ITEQMAPHHK | 96.12 | ITEQMAPHHR | 1.94 | ITEQMAPGHK | 0.97 | | |
| NS5 | 3042 | 0.67 | 4 | 3 | 0 | yes | TEQMAPHHKI | 87.38 | TEQMAPHHKT | 9.71 | TEQMAPHHRI | 1.94 | | |
| NS5 | 3043 | 0.67 | 4 | 3 | 0 | yes | EQMAPHHKIL | 87.38 | EQMAPHHKTL | 9.71 | EQMAPHHRIL | 1.94 | | |
| NS5 | 3044 | 0.67 | 4 | 3 | 0 | yes | QMAPHHKILA | 87.38 | QMAPHHKTLA | 9.71 | QMAPHHRILA | 1.94 | | |
| NS5 | 3045 | 0.67 | 4 | 3 | 0 | yes | MAPHHKILAK | 87.38 | MAPHHKTLAK | 9.71 | MAPHHRILAK | 1.94 | | |
| NS5 | 3046 | 0.67 | 4 | 3 | 0 | yes | APHHKILAKA | 87.38 | APHHKTLAKA | 9.71 | APHHRILAKA | 1.94 | | |
| NS5 | 3047 | 0.67 | 4 | 3 | 0 | yes | PHHKILAKAI | 87.38 | PHHKTLAKAI | 9.71 | PHHRILAKAI | 1.94 | | |
| NS5 | 3048 | 0.67 | 4 | 3 | 0 | yes | HHKILAKAIF | 87.38 | HHKTLAKAIF | 9.71 | HHRILAKAIF | 1.94 | | |

FIG. 16-119

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99%

FIG. 16-120

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3083 | 0 | 1 | 1 | 0 | yes | RKDQRGSGQV | 100 | | |
| NS5 | 3084 | 0 | 1 | 1 | 0 | yes | K

FIG. 16-121

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99%

FIG. 16-122

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3133 | 1.15 | 3 | 3 | 0 | yes | EKWLRECGVD | 60.19 | EKWLRECGVD | 35.92 | ENWLRECGVD | 3.88 | | |
| NS5 | 3134 | 1.15 | 3 | 3 | 0 | yes | KWLRECGVDR | 60.19 | KWLRECGVDR | 35.92 | NWLRECGVDR | 3.88 | | |
| NS5 | 3135 | 0.94 | 2 | 2 | 0 | yes | WLRECGVDRL | 64.08 | WLRECGVDRL | 35.92 | | | | |
| NS5 | 3136 | 0.94 | 2 | 2 | 0 | yes | LRECGVDRLK | 64.08 | LRECGVDRLK | 35.92 | | | | |
| NS5 | 3137 | 0.94 | 2 | 2 | 0 | yes | RECGVDRLKR | 64.08 | RECGVDRLKR | 35.92 | | | | |
| NS5 | 3138 | 0 | 1 | 1 | 0 | yes | ECGVDRLKRM | 100 | | | | | | |
| NS5 | 3139 | 0 | 1 | 1 | 0 | yes | CGVDRLKRMA | 100 | | | | | | |
| NS5 | 3140 | 0 | 1 | 1 | 0 | yes | GVDRLKRMAI | 100 | | | | | | |
| NS5 | 3141 | 0 | 1 | 1 | 0 | yes | VDRLKRMAIS | 100 | | | | | | |
| NS5 | 3142 | 0 | 1 | 1 | 0 | yes | DRLKRMAISG | 100 | | | | | | |
| NS5 | 3143 | 0 | 1 | 1 | 0 | yes | RLKRMAISGD | 100 | | | | | | |
| NS5 | 3144 | 0 | 1 | 1 | 0 | yes | LKRMAISGDD | 100 | | | | | | |
| NS5 | 3145 | 0 | 1 | 1 | 0 | yes | KRMAISGDDC | 100 | | | | | | |
| NS5 | 3146 | 0 | 1 | 1 | 0 | yes | RMAISGDDCV | 100 | | | | | | |
| NS5 | 3147 | 0 | 1 | 1 | 0 | yes | MAISGDDCVW | 100 | | | | | | |
| NS5 | 3148 | 0 | 1 | 1 | 0 | yes | AISGDDCVWK | 100 | | | | | | |
| NS5 | 3149 | 0 | 1 | 1 | 0 | yes | ISGDDCVWKP | 100 | | | | | | |
| NS5 | 3150 | 0 | 1 | 1 | 0 | yes | SGDDCVWKPL | 100 | | | | | | |
| NS5 | 3151 | 0 | 1 | 1 | 0 | yes | GDDCVWKPLD | 100 | | | | | | |
| NS5 | 3152 | 0 | 1 | 1 | 0 | yes | DDCVWKPLDE | 100 | | | | | | |
| NS5 | 3153 | 0 | 1 | 1 | 0 | yes | DCVWKPLDER | 100 | | | | | | |
| NS5 | 3154 | 0 | 1 | 1 | 0 | yes | CVWKPLDERF | 100 | | | | | | |
| NS5 | 3155 | 0.86 | 3 | 3 | 0 | yes | VWKPLDERFG | 77.67 | VWKPLDERFS | 20.39 | VWKPLDERFA | 1.94 | | |
| NS5 | 3156 | 0.86 | 3 | 3 | 0 | yes | WKPLDERFGT | 77.67 | WKPLDERFST | 20.39 | WKPLDERFAT | 1.94 | | |
| NS5 | 3157 | 0.86 | 3 | 3 | 0 | yes | KPLDERFGTS | 77.67 | KPLDERFSTS | 20.39 | KPLDERFATS | 1.94 | | |

FIG. 16-123

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block | frequency | pe

FIG. 16-124

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3183 | 0 | 1 | 1 | 0 | yes | WEPSKGWKNW | 100 | | | | | | | | |
| NS5 | 3184 | 0 | 1 | 1 | 0 | yes | EPSKGWKNWQ

FIG. 16-125

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block

FIG. 16-126

Species: DENV4 (10-mers)

| protein | block starting position | entropy | total peptides in block | peptides to cover 99% of block | gap/x fraction | 99% of block covered w/ <= 5 peptides? | peptides required to cover 99% of block | frequency | peptides required to cover 99% of

FIG. 16-128

Species: DENW4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency |
|---|---|---|---|---|---|---|---|---|---|---|
| NS5 |

FIG. 16-129

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides required to cover 99% of block | frequency | peptides

FIG. 16-130

Species: DENV4 (10-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency

FIG. 16-131

Species: DENV4 (10-mers)

| protein | block starting position | block entropy | total peptides in block | peptides to cover 99% of block | gap/x fraction | 99% of block covered w/ <= 5 peptides? | peptides required to cover 99% of block | frequency | peptides

FIG. 17-1

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to

FIG. 17-2

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 28 | 0.55 | 4 | 4 | 0 | Y | GLVKRFSTGLF | 91.26 | GLVKRFSSGLF | 4.85 | QLTKRFSLGML | 1.94 | GLVKRFSIGLF | 1.94 |
| anC | 29 | 0.55 | 4 | 4 | 0 | Y | LVKRFSTGLFS | 91.26 | LVKRFSSGLFS | 4.85 | LTKRFSLGMLQ | 1.94 | LVKRFSIGLFS | 1.94 |
| anC | 30 | 0.55 | 4 | 4 | 0 | Y | VKRFSTGLFSG | 91.26 | VKRFSSGLFSG | 4.85 | TKRFSLGMLQG | 1.94 | VKRFSIGLFSG | 1.94 |
| anC | 31 | 0.55 | 4 | 4 | 0 | Y | KRFSTGLFSGK | 91.26 | KRFSSGLFSGK | 4.85 | KRFSLGMLQGR | 1.94 | KRFSIGLFSGK | 1.94 |
| anC | 32 | 0.55 | 4 | 4 | 0 | Y | RFSTGLFSGKG | 91.26 | RFSSGLFSGKG | 4.85 | RFSLGMLQGRG | 1.94 | RFSIGLFSGKG | 1.94 |
| anC | 33 | 0.55 | 4 | 4 | 0 | Y | FSTGLFSGKGP | 91.26 | FSSGLFSGKGP | 4.85 | FSLGMLQGRGP | 1.94 | FSIGLFSGKGP | 1.94 |
| anC | 34 | 0.55 | 4 | 4 | 0 | Y | STGLFSGKGPL | 91.26 | SSGLFSGKGPL | 4.85 | SLGMLQGRGPL | 1.94 | SIGLFSGKGPL | 1.94 |
| anC | 35 | 0.55 | 4 | 4 | 0 | Y | TGLFSGKGPLR | 91.26 | SGLFSGKGPLR | 4.85 | LGMLQGRGPLK | 1.94 | IGLFSGKGPLR | 1.94 |
| anC | 36 | 0.14 | 2 | 2 | 0 | Y | GLFSGKGPLRM | 98.06 | GMLQGRGPLKL | 1.94 | | | | |
| anC | 37 | 0.14 | 2 | 2 | 0 | Y | LFSGKGPLRMV | 98.06 | MLQGRGPLKLF | 1.94 | | | | |
| anC | 38 | 0.14 | 2 | 2 | 0 | Y | FSGKGPLRMVL | 98.06 | LQGRGPLKLFM | 1.94 | | | | |
| anC | 39 | 0.14 | 2 | 2 | 0 | Y | SGKGPLRMVLA | 98.06 | QGRGPLKLFMA | 1.94 | | | | |
| anC | 40 | 0.14 | 2 | 2 | 0 | Y | GKGPLRMVLAF | 98.06 | GRGPLKLFMAL | 1.94 | | | | |
| anC | 41 | 0.14 | 2 | 2 | 0 | Y | KGPLRMVLAFI | 98.06 | RGPLKLFMALV | 1.94 | | | | |
| anC | 42 | 0.14 | 2 | 2 | 0 | Y | GPLRMVLAFIT | 98.06 | GPLKLFMALVA | 1.94 | | | | |
| anC | 43 | 0.14 | 2 | 2 | 0 | Y | PLRMVLAFITF | 98.06 | PLKLFMALVAF | 1.94 | | | | |
| anC | 44 | 0.14 | 2 | 2 | 0 | Y | LRMVLAFITFL | 98.06 | LKLFMALVAFL | 1.94 | | | | |
| anC | 45 | 0.14 | 2 | 2 | 0 | Y | RMVLAFITFLR | 98.06 | KLFMALVAFLR | 1.94 | | | | |
| anC | 46 | 0.14 | 2 | 2 | 0 | Y | MVLAFITFLRV | 98.06 | LFMALVAFLRF | 1.94 | | | | |
| anC | 47 | 0.14 | 2 | 2 | 0 | Y | VLAFITFLRVL | 98.06 | FMALVAFLRFL | 1.94 | | | | |
| anC | 48 | 0.14 | 2 | 2 | 0 | Y | LAFITFLRVLS | 98.06 | MALVAFLRFLT | 1.94 | | | | |
| anC | 49 | 0.14 | 2 | 2 | 0 | Y | AFITFLRVLSI | 98.06 | ALVAFLRFLTI | 1.94 | | | | |
| anC | 50 | 0.14 | 2 | 2 | 0 | Y | FITFLRVLSIP | 98.06 | LVAFLRFLTIP | 1.94 | | | | |
| anC | 51 | 0.14 | 2 | 2 | 0 | Y | ITFLRVLSIPP | 98.06 | VAFLRFLTIPP | 1.94 | | | | |
| anC | 52 | 0.14 | 2 | 2 | 0 | Y | TFLRVLSIPPT | 98.06 | AFLRFLTIPPT | 1.94 | | | | |
| anC | 53 | 0.14 | 2 | 2 | 0 | Y | FLRVLSIPPTA | 98.06 | FLRFLTIPPTA | 1.94 | | | | |

FIG. 17-3

Species: DENV4 (11-mers)

| protein | block starting position | block entropy | total peptides in block | peptides required to cover 99% of block | gap/x fraction | 99% of block covered w/ <= 5 peptides? | block (to cover 99% of peptides required) | frequency

FIG. 17-4

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 80 | 0.7 | 4 | 3 | 0 | Y | ILI

FIG. 17-5

Species: DENV4 (11-mers)

| protein | block starting position | block entropy | total peptides in block required to cover 99% of block | block required peptides to cover 99% of block | gap/X fraction | 99% of block covered w/ <= 5 peptides? | peptides required to cover 99% of block | block | frequency | peptides required to cover 99% of block | block | frequency | peptides required to cover 99% of block | block | frequency | peptides required to cover 99% of block | block

FIG. 17-6

Species: DENV4 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 139 | 0.3 | 4 | 3 | 0 | Y | FKTTEGINKCT | 96.12 | FKTEDGVNMCT | 1.94 | FKTTEGINKCT | 0.97 | | |
| prM | 140 | 0.3 | 4 | 3 | 0 | Y | KTTEGINKCTL | 96.12 | KTEDGVNMCTL | 1.94 | KTTEGINKCTL | 0.97 | | |
| prM | 141 | 0.3 | 4 | 3 | 0 | Y | TTEGINKCTLI | 96.12 | TEDGVNMCTLM | 1.94 | TTEGINKCTLI | 0.97 | | |
| prM | 142 | 0.3 | 4 | 3 | 0 | Y | TEGINKCTLIA | 96.12 | EDGVNMCTLMA | 1.94 | TEGINKCTLIA | 0.97 | | |
| prM | 143 | 0.3 | 4 | 3 | 0 | Y | EGINKCTLIAM | 96.12 | DGVNMCTLMAM | 1.94 | EGINRCTLIAM | 0.97 | | |
| prM | 144 | 0.3 | 4 | 3 | 0 | Y | GINKCTLIAMD | 96.12 | GVNMCTLMAMD | 1.94 | GINRCTLIAMD | 0.97 | | |
| prM | 145 | 0.3 | 4 | 3 | 0 | Y | INKCTLIAMDL | 96.12 | VNMCTLMAMDL | 1.94 | INRCTLIAMDV | 0.97 | | |
| prM | 146 | 0.22 | 3 | 2 | 0 | Y | NKCTLIAMDLG | 97.09 | NMCTLMAMDLG | 1.94 | | | | |
| prM | 147 | 0.22 | 3 | 2 | 0 | Y | KCTLIAMDLGE | 97.09 | MCTLMAMDLGE | 1.94 | | | | |
| prM | 148 | 0.22 | 3 | 2 | 0 | Y | CTLIAMDLGEM | 97.09 | CTLMAMDLGEL | 1.94 | | | | |
| prM | 149 | 0.22 | 3 | 2 | 0 | Y | TLIAMDLGEMC | 97.09 | TLMAMDLGELC | 1.94 | | | | |
| prM | 150 | 0.22 | 3 | 2 | 0 | Y | LIAMDLGEMCE | 97.09 | LMAMDLGELCE | 1.94 | | | | |
| prM | 151 | 0.22 | 3 | 2 | 0 | Y | IAMDLGEMCED | 97.09 | MAMDLGELCED | 1.94 | | | | |
| prM | 152 | 0.22 | 3 | 2 | 0 | Y | AMDLGEMCEDT | 97.09 | AMDLGELCEDT | 1.94 | | | | |
| prM | 153 | 0.22 | 3 | 2 | 0 | Y | MDLGEMCEDTV | 97.09 | MDLGELCEDTI | 1.94 | | | | |
| prM | 154 | 0.22 | 3 | 2 | 0 | Y | DLGEMCEDTVT | 97.09 | DLGELCEDTII | 1.94 | | | | |
| prM | 155 | 0.22 | 3 | 2 | 0 | Y | LGEMCEDTVTY | 97.09 | LGELCEDTIIY | 1.94 | | | | |
| prM | 156 | 0.28 | 3 | 3 | 0 | Y | GEMCEDTVTYK | 96.12 | GELCEDTIIYK | 1.94 | GEMCEDTVTYE | 1.94 | | |
| prM | 157 | 0.28 | 3 | 3 | 0 | Y | EMCEDTVTYKC | 96.12 | EMCEDTVTYEC | 1.94 | ELCEDTIIYKC | 1.94 | | |
| prM | 158 | 0.28 | 3 | 3 | 0 | Y | MCEDTVTYKCP | 96.12 | LCEDTIIYKCP | 1.94 | MCEDTVTYECP | 1.94 | | |
| prM | 159 | 0.28 | 3 | 3 | 0 | Y | CEDTVTYKCPL | 96.12 | CEDTIIYKCPL | 1.94 | CEDTVTYECP | 1.94 | | |
| prM | 160 | 0.28 | 3 | 3 | 0 | Y | EDTVTYKCPLL | 96.12 | EDTIIYKCPLL | 1.94 | EDTVT

FIG. 17-7

Species: DENV4 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 165 | 0.55 | 4 | 4 | 0 | Y | YKCPLLVNTEP | 91.26 | YKCPLLVNTEP | 4.85 | YECPLLVNTEP | 1.94 | YKCPLLRQNEP | 1.94 |
| prM | 166 | 0.55 | 4 | 4 | 0 | Y | KCPLLVNTEPE | 91.26 | KCPLLINTEPE | 4.85 | KCPLLRQNEPE | 1.94 | ECPLLVNTEPE | 1.94 |
| prM | 167 | 0.42 | 3 | 3 | 0 | Y | CPLLVNTEPED | 93.2 | CPLLINTEPED | 4.85 | CPLLRQNEPED | 1.94 | | |
| prM | 168 | 0.42 | 3 | 3 | 0 | Y | PLLVNTEPEDI | 93.2 | PLLINTEPEDI | 4.85 | PLLRQNEPEDI | 1.94 | | |
| prM | 169 | 0.42 | 3 | 3 | 0 | Y | LLVNTEPEDID | 93.2 | LLINTEPEDID | 4.85 | LLRQNEPEDID | 1.94 | | |
| prM | 170 | 0.42 | 3 | 3 | 0 | Y | LVNTEPEDIDC | 93.2 | LINTEPEDIDC | 4.85 | LRQNEPEDIDC | 1.94 | | |
| prM | 171 | 0.42 | 3 | 3 | 0 | Y | VNTEPEDIDCW | 93.2 | INTEPEDIDCW | 4.85 | RQNEPEDIDCW | 1.94 | | |
| prM | 172 | 0.14 | 2 | 2 | 0 | Y | NTEPEDIDCWC | 98.06 | QNEPEDIDCWC | 1.94 | | | | |
| prM | 173 | 0.14 | 2 | 2 | 0 | Y | TEPEDIDCWCN | 98.06 | NEPEDIDCWCN | 1.94 | | | | |
| prM | 174 | 0.19 | 2 | 2 | 0 | Y | EPEDIDCWCNL | 97.09 | EPEDIDCWCNS | 2.91 | | | | |
| prM | 175 | 0.19 | 2 | 2 | 0 | Y | PEDIDCWCNLT | 97.09 | PEDIDCWCNST | 2.91 | | | | |
| prM | 176 | 0.27 | 3 | 2 | 0 | Y | EDIDCWCNLTS | 96.12 | EDIDCWCNSTS | 2.91 | | | | |

FIG. 17-8

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | fr

FIG. 17-9

Species: DENV4 (11-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| pM | 217 | 0.19 | 2 | 2 | 0 | Y | LETRAETWMSS | 97.09 | LETRIETWMSS | 2.91 |
| pM | 218 | 0.19 | 2 | 2 | 0 | Y | ETRAETWMSSE | 97.09 | ETRIETWMSSE | 2.91 |
| pM | 219 | 0.19 | 2 | 2 | 0 | Y | TRAETWMSSEG | 97.09 | TRIETWMSSEG | 2.91 |
| pM | 220 | 0.19 | 2 | 2 | 0 | Y | RAETWMSSEGA | 97.09 | RIETWMSSEGA | 2.91 |
| pM | 221 | 0.19 | 2 | 2 | 0 | Y | AETWMSSEGAW | 97.09 | TETWMSSEGAW | 2.91 |

FIG. 17-10

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 243 | 0.14 | 2 | 2 | 0 | Y | RNPGFALLAGF | 98.06 | RHPGFTIMAAI | 1.94 | | | | | | |
| prM | 244 | 0.14 | 2 | 2 | 0 | Y | NPGFALLAGFM | 98.06 | HPGFTIMAAIL | 1.94 | | | | | | |
| prM | 245 | 0.14 | 2 | 2 | 0 | Y | PGFALLAGFMA | 98.06 | PGFTIMAAILA | 1.94 | | | | | | |
| prM | 246 | 0.14 | 2 | 2 | 0 | Y | GFALLAGFMAY | 98.06 | GFTIMAAILAY | 1.94 | | | | | | |
| prM | 247 | 0.14 | 2 | 2 | 0 | Y | FALLAGFMAYM | 98.06 | FTIMAAILAYT | 1.94 | | | | | | |
| prM | 248 | 0.28 | 3 | 2 | 0 | Y | ALLAGFMAYMI | 96.12 | TIMAAILAYTI | 1.94 | ALLAGFMAYMV | 1.94 | | | | |
| prM | 249 | 0.28 | 3 | 3 | 0 | Y | LLAGFMAYMIG | 96.12 | IMAAILAYTIG | 1.94 | LLAGFMAYMVG | 1.94 | | | | |
| prM | 250 | 0.28 | 3 | 3 | 0 | Y | LAGFMAYMIGQ | 96.12 | MAAILAYTIGT | 1.94 | MAAILAYTIGT | 1.94 | | | | |
| prM | 251 | 0.28 | 3 | 3 | 0 | Y | AGFMAYMIGQT | 96.12 | AAILAYTIGTH | 1.94 | AAILAYTIGTT | 1.94 | | | | |
| prM | 252 | 0.35 | 4 | 3 | 0 | Y | GFMAYMIGQTG | 95.15 | AILAYTIGTTH | 1.94 | AILAYTIGTTH | 1.94 | | | | |
| prM | 253 | 0.35 | 4 | 3 | 0 | Y | FMAYMIGQTGI | 95.15 | ILAYTIGTTHF | 1.94 | ILAYTIGTTHF | 1.94 | | | | |
| prM | 254 | 0.35 | 4 | 3 | 0 | Y | MAYMIGQTGIQ | 95.15 | MAYMVGQTGIQ | 1.94 | MAYMVGQTGIQ | 1.94 | | | | |
| prM | 255 | 0.35 | 4 | 3 | 0 | Y | AYMIGQTGIQR | 95.15 | AYTIGTTHFQR | 1.94 | AYTIGTTHFQR | 1.94 | | | | |
| prM | 256 | 0.43 | 5 | 4 | 0 | Y | YMIGQTGIQRT | 94.17 | YTIGTTHFQRA | 1.94 | YMYGQTGIQRT | 1.94 | YMIGQTGIQRA | 0.97 | | |
| prM | 257 | 0.51 | 6 | 5 | 0 | Y | MIGQTGIQRTV | 93.2 | MYGQTGIQRTV | 1.94 | TIGTTHFQRAL | 1.94 | MIGQTGIQRAV | 0.97 | MIGQTGIQRTI | 0.97 |
| prM | 258 | 0.51 | 6 | 5 | 0 | Y | IGQTGIQRTVF | 93.2 | IGTTHFQRALI | 1.94 | VGQTGIQRTVF | 1.94 | IGQTGIQRTIF | 0.97 | IGQTRIQRTVF | 0.97 |
| prM | 259 | 0.37 | 5 | 4 | 0 | Y | GQTGIQRTVFF | 95.15 | GTTHFQRALIF | 1.94 | GQTGIQRAVFF | 0.97 | GQTGIQRTIFF | 0.97 | | |
| prM | 260 | 0.61 | 6 | 5 | 0 | Y | QTGIQRTVFFV | 91.26 | QTGIQRTVFFI | 1.94 | TTHFQRALIFI | 1.94 | QTGIQRAVFFV | 0.97 | QTRIQRTVFFV | 0.97 |
| prM | 261 | 0.61 | 6 | 5 | 0 | Y | TGIQRTVFFVL | 91.26 | TGIQRTVFFIL | 1.94 | THFQRALIFIL | 1.94 | TGIQRAVFFVL | 0.97 | TRIQRTVFFVL | 0.97 |
| prM | 262 | 0.61 | 6 | 5 | 0 | Y | GIQRTVFFVLM | 91.26 | GIQRTVFFILM | 1.94 | HFQRALIFILL | 1.94 | GIQRAVFFVLM | 0.97 | RIQRTVFFVLM | 0.97 |
| prM | 263 | 0.53 | 5 | 4 | 0 | Y | IQRTVFFVLMM | 92.23 | IQRTVFFILMM | 3.88 | FQRALIFILLT | 1.94 | IQRAVFFVLMM | 0.97 | | |
| prM | 264 | 0.53 | 5 | 4 | 0 | Y | QRTVFFVLMML | 92.23 | QRTVFFILMML | 3.88 | QRALIFILLTA | 1.94 | QRAVFFVLMML | 0.97 | | |
| prM | 265 | 0.53 | 5 | 4 | 0 | Y | RTVFFVLMMLV | 92.23 | RTVFFILMMLV | 3.88 | RALIFILLTAV | 1.94 | RTIFFVLMMLV | 0.97 | | |
| prM | 266 | 0.53 | 5 | 4 | 0 | Y | TVFFVLMMLVA | 92.23 | TVFFILMMLVA | 3.88 | ALIFILLTAVA | 1.94 | TIFFVLMMLVA | 0.97 | | |
| prM | 267 | 0.45 | 4 | 3 | 0 | Y | VFFVLMMLVAP | 93.2 | VFFILMMLVAP | 3.88 | LIFILLTAVAP | 1.94 | | | | |
| prM | 268 | 0.37 | 3 | 3 | 0 | Y | FFVLMMLVAPS | 94.17 | FFILMMLVAPS | 3.88 | IFILLTAVAPS | 1.94 | | | | |

FIG. 17-11

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 269 | 0.37 | 3 | 3 | 0 | Y | FVLMMLVAPSY | 94.17 | FILMMLVAPSY | 3.88 | FILLTAVAPSM | 1.94 | | |
| prM | 270 | 0.37 | 3 | 3 | 0 | Y | VLMMLVAPS

FIG. 17-12

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 295 | 0.3 | 4 | 3 | 0 | Y | VSGGAWWDLVL | 96.12 | VSGGSWWDIVL | 1.94 | VSGGTWWDLVL | 0.97 | | |
| E | 296 | 0.3 | 4 | 3 | 0 | Y | SGGAWWDLVLE | 96.12 | SGGSWWDIVLE | 1.94 | SGGTWWDLVLE | 0.97 | | |
| E | 297 | 0.3 | 4 | 3 | 0 | Y | GGAWWDLVLEH | 96.12 | GGSWWDIVLEH | 1.94 | GGTWWDLVLEH | 0.97 | | |
| E | 298 | 0.3 | 4 | 3 | 0 | Y | GAWWDLVLEHG | 96.12 | GSWWDIVLEHG | 1.94 | GTWWDLVLEHG | 0.97 | | |
| E | 299 | 0.3 | 4 | 3 | 0 | Y | AWWDLVLEHGG | 96.12 | SWWDIVLEHGS | 1.94 | TWWDLVLEHGG | 0.97 | | |
| E | 300 | 0.14 | 2 | 2 | 0 | Y | WWDLVLEHGGC | 98.06 | WWDIVLEHGSC | 1.94 | | | | |
| E | 301 | 0.14 | 2 | 2 | 0 | Y | WDLVLEHGGCV | 98.06 | VDIVLEHGSCV | 1.94 | | | | |
| E | 302 | 0.14 | 2 | 2 | 0 | Y | DLVLEHGGCVT | 98.06 | DIVLEHGSCVT | 1.94 | | | | |
| E | 303 | 0.14 | 2 | 2 | 0 | Y | LVLEHGGCVTT | 98.06 | IVLEHGSCVTT | 1.94 | | | | |
| E | 304 | 0.14 | 2 | 2 | 0 | Y | VLEHGGCVTTM | 98.06 | VLEHG

FIG. 17-13

Species: DENV4 (11-mers)

| protein | block starting position | block entropy | total peptides in block | peptides required to cover 99% of block | gap/X fraction | 99% of block covered w/ <= 5 peptides? | block | frequency | block | frequency | block | frequency |
|---|---|---|---|---|---|---|---|---|---|---|---|---|
| E | 321 | 0.56 | 3 | 3 | 0 | Y | LDFELIKTTAK | 89.32 | LDFELIKTTAK | 8.74 | LDFELIKTEAK | 1

FIG. 17-14

Species: DENV4 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 347 | 0.14 | 2 | 2 | 0 | Y | NIT

FIG. 17-15

Species: DENV4 (11-mers)

| protein | starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 373 | 0.35 | 4 | 3 | 0 | Y | RRDVDRGWGNG | 95.15 | RDMVDRGWGN | 1.94 | | | | |
| E | 374 | 0.35 | 4 | 3 | 0 | Y | RDVDRGWGNGC | 95.15 | RDMVDRGWGNG | 1.94 | | | | |
| E | 375 | 0.35 | 4 | 3 | 0 | Y | DVDRGWGNGCG | 95.15 | SMVDRGWGNGC | 1.94 | DMVDRGWGNGC | 1.94 | | |
| E | 376 | 0.24 | 2 | 2 | 0 | Y | VDRGWGNGCGL | 96.12 | MVDRGWGNGCG | 3.88 | | | | |
| E | 377 | 0 | 1 | 1 | 0 | Y | VDRGWGNGCGL | 100 | | | | | | |
| E | 378 | 0 | 1 | 1 | 0 | Y | DRGWGNGCGLF | 100 | | | | | | |
| E | 379 | 0 | 1 | 1 | 0 | Y | RGWGNGCGLFG | 100 | | | | | | |
| E | 380 | 0 | 1 | 1 | 0 | Y | GWGNGCGLFGK | 100 | | | | | | |
| E | 381 | 0 | 1 | 1 | 0 | Y | WGNGCGLFGKG | 100 | | | | | | |
| E | 382 | 0 | 1 | 1 | 0 | Y | GNGCGLFGKGG | 100 | | | | | | |
| E | 383 | 0.14 | 2 | 2 | 0 | Y | NGCGLFGKGGV | 98.06 | NGCGLFGKGGI | 1.94 | | | | |
| E | 384 | 0.14 | 2 | 2 | 0 | Y | GCGLFGKGGVV | 98.06 | GCGLFGKGGIV | 1.94 | | | | |
| E | 385 | 0.14 | 2 | 2 | 0 | Y | CGLFGKGGVT | 98.06 | CGLFGKGGIVT | 1.94 | | | | |
| E | 386 | 0.14 | 2 | 2 | 0 | Y | GLFGKGGVTC | 98.06 | GLFGKGGIVTC | 1.94 | | | | |
| E | 387 | 0.14 | 2 | 2 | 0 | Y | LFGKGGVTCA | 98.06 | LFGKGGIVTCA | 1.94 | | | | |
| E | 388 | 0.14 | 2 | 2 | 0 | Y | FGKGGVTCAK | 98.06 | FGKGGIVTCAM | 1.94 | | | | |
| E | 389 | 0.14 | 2 | 2 | 0 | Y | GKGGVTCAKF | 98.06 | GKGGIVTCAMF | 1.94 | | | | |
| E | 390 | 0.56 | 3 | 3 | 0 | Y | KGGVTCAKFS | 89.32 | KGGVTCAKFL | 8.74 | KGGIVTCAMFT | 1.94 | | |
| E | 391 | 0.56 | 3 | 3 | 0 | Y | GGVTCAKFSC | 89.32 | GGVTCAKFLC | 8.74 | GGIVTCAMFTC | 1.94 | | |
| E | 392 | 0.56 | 3 | 3 | 0 | Y | GVTCAKFSCS | 89.32 | GVTCAKFLCS | 8.74 | GIVTCAMFTCK | 1.94 | | |
| E | 393 | 0.56 | 3 | 3 | 0 | Y | VTCAKFSCSG | 89.32 | VTCAKFLCSG | 8.74 | IVTCAMFTCKK | 1.94 | | |
| E | 394 | 0.56 | 3 | 3 | 0 | Y | VTCAKFSCSGK | 89.32 | VTCAKFLCSGK | 8.74 | VTCAMFTCKKN | 1.94 | | |
| E | 395 | 0.56 | 3 | 3 | 0 | Y | TCAKFSCSGKI | 89.32 | TCAKFLCSGKI | 8.74 | TCAMFTCKKN | 1.94 | | |
| E | 396 | 0.56 | 3 | 3 | 0 | Y | CAKFSCSGKIT | 89.32 | CAKFLCSGKIT | 8.74 | CAMFTCKKNME | 1.94 | | |
| E | 397 | 0.56 | 3 | 3 | 0 | Y | AKFSCSGKITG | 89.32 | AKFLCSGKITG | 8.74 | AMFTCKKNMEG | 1.94 | | |
| E | 398 | 0.56 | 3 | 3 | 0 | Y | KFSCSGKITGN | 89.32 | KFLCSGKITGN | 8.74 | MFTCKKNMEGK | 1.94 | | |

FIG. 17-16

Species: DENV4 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| E | 399 | 0.56 | 3 | 3 | 0 | Y | FSCSGKITGNL | 89.32 | FLCSGKITGNL | 8.74 | FTCKKNMEGKV | 1.94 | | |
| E | 400 | 0.56 | 3 | 3 | 0 | Y | SCSGKITGNLV | 89.32 | LCSGKITGNLV | 8.74 | TCKKNMEGKVV | 1.94 | | |
| E | 401 | 0.14 | 2 | 2 | 0 | Y | CSGKITGNLVQ | 98.06 | CKKNMEGKVVQ | 1.94 | | | |

FIG. 17-17

Species: DENV4 (11-mers)

| protein | block starting position | block entropy | total peptides in block | peptides required to cover 99% of block | gap/X fraction | 99% of block covered w/ <= 5 peptides? | block (peptides required to cover 99% of) | frequency | block

FIG. 17-18

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 451 | 0.43 | 5 | 4 | 0 | Y | VEVKLPDYGEL | 94.17 | TEAELTGYGTV | 1.94 | VEVELPDYGEL | 1.94 | VEVQLPDYGEL | 0.97 |
| E | 452 | 0.35 | 4 | 3 | 0 | Y | EVKLPDYGELT | 95.15 | EAELTGYGTVT | 1.94 | EVELPDYGELS | 1.94 | | |
| E | 453 | 0.35 | 4 | 3 | 0 | Y | VKLPDYGELTL | 95.15 | VELPDYGELSL | 1.94 | AELTGYGTVTM | 1.94 | | |
| E | 454 | 0.35 | 4 | 3 | 0 | Y | KLPDYGELTLD | 95.15 | ELTGYGTVTME | 1.94 | ELPDYGELSLD | 1.94 | | |
| E | 455 | 0.28 | 3 | 3 | 0 | Y | LPDYGELTLDC | 96.12 | LPDYGELSLDC | 1.94 | LTGYGTVTMEC | 1.94 | | |
| E | 456 | 0.28 | 3 | 3 | 0 | Y | PDYGELTLDCE | 96.12 | PDYGELSLDCE | 1.94 | TGYGTVTMECS | 1.94 | | |
| E | 457 | 0.28 | 3 | 3 | 0 | Y | DYGELTLDCEP | 96.12 | GYGTVTMECSP | 1.94 | DYGELSLDCEP | 1.94 | | |
| E | 458 | 0.28 | 3 | 3 | 0 | Y | YGELTLDCEPR | 96.12 | YGTVTMECSPR | 1.94 | YGELSLDCEPR | 1.94 | | |
| E | 459 | 0.28 | 3 | 3 | 0 | Y | GELTLDCEPRS | 96.12 | GTVTMECSPRT | 1.94 | GELSLDCEPRS | 1.94 | | |
| E | 460 | 0.28 | 3 | 3 | 0 | Y | ELTLDCEPRSG | 96.12 | ELSLDCEPRSG | 1.94 | TVTMECSPRTG | 1.94 | | |
| E | 461 | 0.28 | 3 | 3 | 0 | Y | LTLDCEPRSGI | 96.12 | VTMECSPRTGL | 1.94 | LSLDCEPRSGI | 1.94 | | |
| E | 462 | 0.28 | 3 | 3 | 0 | Y | TLDCEPRSGID | 96.12 | SLDCEPRSGID | 1.94 | TMECSPRTGLD | 1.94 | | |
| E | 463 | 0.14 | 2 | 2 | 0 | Y | LDCEPRSGIDF | 98.06 | MECSPRTGLDF | 1.94 | | | | |
| E | 464 | 0.14 | 2 | 2 | 0 | Y | DCEPRSGIDFN | 98.06 | ECSPRTGLDFN | 1.94 | | | | |
| E | 465 | 0.14 | 2 | 2 | 0 | Y | CEPRSGIDFNE | 98.06 | CSPRTGLDFNE | 1.94 | | | | |
| E | 466 | 0.14 | 2 | 2 | 0 | Y | EPRSGIDFNEM | 98.06 | SPRTGLDFNEM | 1.94 | | | | |
| E | 467 | 0.14 | 2 | 2 | 0 | Y | PRSGIDFNEMI | 98.06 | PRTGLDFNEMV | 1.94 | | | | |
| E | 468 | 0.14 | 2 | 2 | 0 | Y | RSGIDFNEMIL | 98.06 | RTGLDFNEMVL | 1.94 | | | | |
| E | 469 | 0.14 | 2 | 2 | 0 | Y | SGIDFNEMILM | 98.06 | TGLDFNEMVLL | 1.94 | | | | |
| E | 470 | 0.41 | 4 | 4 | 0 | Y | GIDFNEMILMK | 94.17 | GIDFNEMILME | 1.94 | GIDFNEMILMR | 1.94 | GLDFNEMVLLQ | 1.94 |
| E | 471 | 0.41 | 4 | 5 | 0 | Y | IDFNEMILMKM | 94.17 | LDFNEMVLLQM | 1.94 | IDFNEMILMRM | 1.94 | IDFNEMILMEM | 1.94 |
| E | 472 | 0.55 | 5 | 4 | 0 | Y | DFNEMILMKMK | 92.23 | DFNEMILMEMK | 1.94 | DFNEMILMRMK | 1.94 | DFNEMVLLQME | 1.94 |
| E | 481 | 0.49 | 5 | 4 | 0 | Y | MKKKTWLVHKQ | 93.2 | MENKAWLVHRQ | 1.94 | MKTKTWLVHKQ | 1.94 | MEKKTWLVHKQ | 1.94 |
| E | 482 | 0.49 | 5 | 4 | 0 | Y | KKKTWLVHKQW | 93.2 | KTKTWLVHKQW | 1.94 | EKKTWLVHKQW | 1.94 | ENKAWLVHRQW | 1.94 |
| E | 483 | 0.35 | 4 | 3 | 0 | Y | KKTWLVHKQWF | 95.15 | NKAWLVHRQWF | 1.94 | TKTWLVHKQWF | 1.94 | | |
| E | 484 | 0.14 | 2 | 2 | 0 | Y | KTWLVHKQWFL | 98.06 | KAWLVHRQWFL | 1.94 | | | | |

FIG. 17-19

Species: DENV4 (11-mers)

| protein | block starting position | block entropy | total peptides in block | peptides required to cover 99% of block | gap/X fraction | 99% of block covered w/ <= 5 peptides? | block peptides required to cover 99% of | frequency | block peptides required to cover 99% of | frequency | block peptides required to cover 99%

FIG. 17-20

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 511 | 0.42 | 3 | 3 | 0 | Y | WNYKERMVTFK | 93.2 | WNHKERMVTFK | 4

FIG. 17-21

Species: DENV4 (11-mers)

| protein | block starting position | block entropy | total peptides in block | peptides required to cover 99% of block | gap/X fraction | covered w/ <= 5 peptides? | block | frequency | block | frequency | block | frequency | block | frequency | block | frequency |
|---|---|---|---|---|---|---|---|---|---|---|---|---|---|---|---|---|
| E | 537 | 0.49 | 3 | 3 | 0 | Y | EGAMHSALAGA | 91.26 | EGAMHSALTGA | 6.8 | EGAMHTALTGA | 1.94 | | | | |
| E | 538 | 0.49 | 3 | 3 | 0 | Y | GAMHSALAGAT | 91.26 | GAMHSALTGAT | 6.8 | GAMHTALTGAT | 1.94 | | | | |
| E | 539 | 0.49 | 3 | 3 | 0 | Y | AMHSALAGATE | 91.26 | AMHSALTGATE | 6.8 | AMHTALTGATE | 1.94 | | | | |
| E | 540 | 0.49 | 3 | 3 | 0 | Y | MHSALAGATEV | 91.26 | MHSALTGATEV | 6.8 | MHTALTGATEI | 1.94 | | | | |
| E | 541 | 0.49 | 3 | 3 | 0 | Y | HSALAGATEVD | 91.26 | HSALTGATEVD | 6.8 | HTALTGATEIQ | 1.94 | | | | |
| E | 542 | 0.49 | 3 | 3 | 0 | Y | SALAGATEVDS | 91.26 | SALTGATEVDS | 6.8 | TALTGATEIQM | 1.94 | | | | |
| E | 543 | 0.49 | 3 | 3 | 0 | Y | ALAGATEVDSG | 91.26 | ALTGATEVDSG | 6.8 | ALTGATEIQMS | 1.94 | | | | |
| E | 544 | 0.49 | 3 | 3 | 0 | Y | LAGATEVDSGD | 91.26 | LTGATEVDSGD | 6.8 | LTGATEIQMSS | 1.94 | | |

FIG. 17-22

Species: DENV4 (11-mers)

| protein | block starting position | block entropy | total peptides in block required to cover 99% of block | gap/X fraction | covered w/ <= 5 peptides? | block required peptides to cover 99% of block | frequency | block required peptides to cover 99% of block | frequency | block required peptides to cover 99% of block | frequency | block required peptides to cover 99% of block | frequency |
|---|---|---|---|---|---|---|---|---|---|---|---|---|---|
| E | 563 | 0.3 | 4 | 3 | 0 | Y | LICKVRMEKLR | 96.12 | LKCRLRMDKLQ | 1.94 | LKCKI

FIG. 17-23

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block

FIG. 17-24

Species: DENV4 (11-mers)

| protein | block starting position | block entropy | total peptides in block | peptides required to cover 99% of block | gap/X fraction | 99% of block covered w/ <= 5 peptides? | block (99%) | frequency | block | frequency | block | frequency | block | frequency | block | frequency |
|---|---|---|---|---|---|---|---|---|---|---|---|---|---|---|---|---|
| E | 615 | 0.54 | 5 | 4 | 0 | Y | VPIEIRDVNKE | 92.23 | VPIEIRDVNKK | 2.91 | IPIEIRDVNKE | 1.94 | IPFEIMDLEKR | 1.94 | | |
| E | 616 | 0.48 | 5 | 4 | 0 | Y | PIEIRDVNKEK | 93.2 | PIEIRDVNKKK | 2.91 | PFEIMDLEKRH | 1.94 | PIEIKDMNKEK | 0.97 | | |
| E | 617 | 0.48 | 5 | 4 | 0 | Y | IEIRDVNKEKV | 93.2 | IEIRDVNKKKV | 2.91 | FEIMDLEKRHV | 1.94 | IEIKDMNKEKV | 0.97 | EIKDMNKEKV | 0.97 |
| E | 618 | 0.62 | 6 | 5 | 0 | Y | EIRDVNKEKVV | 91.26 | EIRDVNKKKVV | 2.91 | EIRDVNKEKVI | 1.94 | EIMDLEKRHVL | 1.94 | IKDMNKEKVVG | 0.97 |
| E | 619 | 0.62 | 6 | 5 | 0 | Y | IRDVNKEKVVG | 91.26 | IRDVNKKKVVG | 2.91 | IRDVNKEKVIG | 1.94 | IMDLEKRHVLG | 1.94 | KDMNKEKVVGR | 0.97 |
| E | 620 | 0.62 | 6 | 5 | 0 | Y | RDVNKEKVVGR | 91.26 | RDVNKKKVVGR | 2.91 | RDVNKEKVIGR | 1.94 | MDLEKRHVLGR | 1.94 | | |
| E | 638 | 0.73 | 6 | 5 | 0 | Y | AENTNSYTNIE | 89.32 | AENTNSATNIE | 2.91 | AESTNSYTNIE | 2.91 | VTEKDSPVNIE | 1.94 | AEYTNSYTNIE | 1.94 |
| E | 639 | 0.73 | 6 | 5 | 0 | Y | ENTNSYTNIEL | 89.32 | ESTNSYTNIEL | 2.91 | ENTNSATNIEL | 2.91 | TEKDSPVNIEA | 1.94 | EYTNSYTNIEL | 1.94 |
| E | 640 | 0.73 | 6 | 5 | 0 | Y | NTNSYTNIELE | 89.32 | STNSYTNIELE | 2.91 | NTNSATNIELE | 2.91 | YTNSYTNIELE | 1.94 | EKDSPVNIEAE | 1.94 |
| E | 641 | 0.41 | 4 | 3 | 0 | Y | TNSYTNIELEP | 94.17 | TNSATNIELEP | 2.91 | KDSPVNIEAEP | 1.94 | | | | |
| E | 642 | 0.41 | 4 | 3 | 0 | Y | NSYTNIELEPP | 94.17 | NSATNIELEPP | 2.91 | DSPVNIEAEPP | 1.94 | | | | |
| E | 643 | 0.41 | 4 | 3 | 0 | Y | SYTNIELEPPF | 94.17 | SATNIELEPPF | 2.91 | SPVNIEAEPPF | 1.94 | | | | |
| E | 644 | 0.41 | 4 | 3 | 0 | Y | VTNIELEPPFG | 94.17 | ATNIELEPPFG | 2.91 | PVNIEAEPPFG | 1.94 | | | | |
| E | 645 | 0.14 | 2 | 2 | 0 | Y | TNIELEPPFGD | 98.06 | VNIEAEPPFGD | 1.94 | | | | | | |
| E | 646 | 0.14 | 2 | 2 | 0 | Y | NIELEPPFGDS | 98.06 | NIEAEPPFGDS | 1.94 | | | | | | |
| E | 647 | 0.14 | 2 | 2 | 0 | Y | IELEPPFGDSY | 98.06 | IEAEPPFGDSY | 1.94 | | | | | | |
| E | 648 | 0.14 | 2 | 2 | 0 | Y | ELEPPFGDSYI | 98.06 | EAEPPFGDSYI | 1.94 | | | | | | |
| E | 649 | 0.35 | 4 | 3 | 0 | Y | LEPPFGDSYIV | 95.15 | AEPPFGDSYII | 2.91 | LEPPFGDSYIM | 1.94 | LEPPFGDSYIM | 0.97 | | |
| E | 650 | 0.33 | 3 | 3 | 0 | Y | EPPFGDSYIVI | 95.15 | EPPFGDSYIII | 2.91 | EPPFGDSYIMI | 1.94 | | | | |
| E | 651 | 0.33 | 3 | 3 | 0 | Y | PPFGDSYIVIG | 95.15 | PPFGDSYIIIG | 2.91 | PPFGDSYIMIG | 1.94 | | | | |
| E | 652 | 0.41 | 4 | 3 | 0 | Y | PFGDSYIVIGV | 94.17 | PFGDSYIIIGV | 2.91 | PFGDSYIMIGV | 1.94 | | | | |
| E | 653 | 0.43 | 5 | 4 | 0 | Y | FGDSYIVIGVG | 94.17 | FGDSYIIIGVG | 1.94 | FGDSYIMIGVG | 1.94 | FGDSYIWIGAG | 1.94 | | |
| E | 654 | 1.04 | 6 | 5 | 0 | Y | GDSYIVIGVGN | 78.64 | GDSYIIIGVGN | 15.53 | GDSYIMIGVGN | 1.94 | GDSYIMIGVEP | 1.94 | GDSYIWIGAGD | 0.97 |
| E | 655 | 1.04 | 6 | 5 | 0 | Y | DSYIVIGVGNS | 78.64 | DSYIIIGVGNS | 15.53 | DSYIMIGVGNS | 1.94 | DSYIIIGVEPG | 1.94 | DSYIIIGVGDS | 0.97 |
| E | 656 | 1.04 | 6 | 5 | 0 | Y | SYIVIGVGNSA | 78.64 | SYIIIGVGNSA | 15.53 | SYIMIGVGNSA | 1.94 | SYIIIGVEPGQ | 1.94 | SYIIIGVGDSA | 0.97 |
| E | 657 | 1.04 | 6 | 5 | 0 | Y | YIVIGVGNSAL | 78.64 | YIIIGVGNSAL | 15.53 | YIMIGVGNSAL | 1.94 | YIIIGVEPGQL | 1.94 | YIVIGAGDSAL | 0.97 |

FIG. 17-25

Species: DENV4 (11-mers)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| E | 658 | 1.04 | 6 | 5 | 0 | Y | IVIGVGNSALT | 78.64 | IVIGVGDSALT | 15.53 | IIIGVEPGQLK | 1.94 | IMIGVGNSALT | 1.94 | IVIGAGDSALT | 0.97 |
| E | 659 | 1.04 | 6 | 5 | 0 | Y | VIGVGNSALTL | 78.64 | VIGVGDSALTL | 15.53 | IIGVEPGQLKL | 1.94 | MIGVGNSALTL | 1.94 | VIGAGDSALTL | 0.97 |
| E | 660 | 0.86 | 4 | 3 | 0 | Y | IGVGNSALTLH | 80.58 | IGVGDSALTLH | 16.5 | IGVEPGQLKLN | 1.94 | | | | |
| E | 661 | 0.86 | 4 | 3 | 0 | Y | GVGNSALTLHW | 80.58 | GVGDSALTLHW | 16.5 | GVEPGQLKLNW | 1.94 | | | | |
| E | 662 | 0.86 | 4 | 3 | 0 | Y | VGNSALTLHWF | 80.58 | VGDSALTLHWF | 16.5 | VEPGQLKLNWF | 1.94 | | | | |
| E | 663 | 0.8 | 3 | 3 | 0 | Y | GNSALTLHWFR | 80.58 | GDSALTLHWFR | 17.48 | EPGQLKLNWFR | 1.94 | | | | |
| E | 664 | 0.88 | 4 | 3 | 0 | Y | NSALTLHWFRK | 79.61 | DSALTLHWFRK | 17.48 | PGQLKLNWFKK | 1.94 | | | | |
| E | 665 | 0.22 | 3 | 2 | 0 | Y | SALTLHWFRKG | 97.09 | GQLKLNWFKKG | 1.94 | | | | | | |
| E | 666 | 0.22 | 3 | 2 | 0 | Y | ALTLHWFRKGS | 97.09 | QLKLNWFKKGS | 1.94 | | | | | | |
| E | 667 | 0.22 | 3 | 2 | 0 | Y | LTLHWFRKGSS | 97.09 | LKLNWFKKGSS | 1.94 | | | | | | |
| E | 668 | 0.22 | 3 | 2 | 0 | Y | TLHWFRKGSSI | 97.09 | KLNWFKKGSSI | 1.94 | | | | | | |
| E | 669 | 0.22 | 3 | 2 | 0 | Y | LHWFRKGSSIG | 97.09 | LNWFKKGSSIG | 1.94 | | | | | | |
| E | 670 | 0.22 | 3 | 2 | 0 | Y | HWFRKGSSIGK | 97.09 | NWFKKGSSIGQ | 1.94 | | | | | | |
| E | 671 | 0.22 | 3 | 2 | 0 | Y | WFRKGSSIGKM | 97.09 | WFKKGSSIGQM | 1.94 | | | | | | |
| E | 672 | 0.35 | 4 | 3 | 0 | Y | FRKGSSIGKMF | 95.15 | FKKGSSIGQMF | 1.94 | FRKGSSIGKML | 1.94 | | | | |
| E | 673 | 0.35 | 4 | 3 | 0 | Y | RKGSSIGKMFE | 95.15 | RKGSSIGQMLE | 1.94 | KKGSSIGQMFE | 1.94 | | | | |
| E | 674 | 0.35 | 4 | 3 | 0 | Y | KGSSIGKMFES | 95.15 | KGSSIGKMLES | 1.94 | KGSSIGQMFET | 1.94 | | | | |
| E | 675 | 0.28 | 3 | 3 | 0 | Y | GSSIGKMFEST | 96.12 | GSSIGQMFETT | 1.94 | GSSIGKMLEST | 1.94 | | | | |
| E | 676 | 0.28 | 3 | 3 | 0 | Y | SSIGKMFESTY | 96.12 | SSIGQMFETTM | 1.94 | SSIGKMLESTY | 1.94 | | | | |
| E | 677 | 0.28 | 3 | 3 | 0 | Y | SIGKMFESTYR | 96.12 | SIGQMFETTMR | 1.94 | SIGKMLESTYR | 1.94 | | | | |
| E | 678 | 0.28 | 3 | 3 | 0 | Y | IGKMFESTYRG | 96.12 | IGQMFETTMRG | 1.94 | IGKMLESTYRG | 1.94 | | | | |
| E | 679 | 0.28 | 3 | 3 | 0 | Y | GKMFESTYRGA | 96.12 | GQMFETTMRGA | 1.94 | GKMLESTYRGA | 1.94 | | | | |
| E | 680 | 0.28 | 3 | 3 | 0 | Y | KMFESTYRGAK | 96.12 | QMFETTMRGAK | 1.94 | KMLESTYRGAK | 1.94 | | | | |
| E | 681 | 0.28 | 3 | 3 | 0 | Y | MFESTYRGAKR | 96.12 | MLESTYRGAKR | 1.94 | MFETTMRGAKR | 1.94 | | | | |
| E | 682 | 0.28 | 3 | 3 | 0 | Y | FESTYRGAKRM | 96.12 | FETTMRGAKRM | 1.94 | LESTYRGAKRM | 1.94 | | | | |
| E | 683 | 0.14 | 2 | 2 | 0 | Y | ESTYRGAKRMA | 98.06 | ETTMRGAKRMA | 1.94 | | | | | | |

FIG. 17-26

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 684 | 0.14 | 2 | 2 | 0 | Y | STYRGAKRMAI | 98.06 | TTMRGAKRMAI | 1.94 | | | | |
| E | 685 | 0.14 | 2 | 2 | 0 | Y | TYRGAKRMAIL | 98.06 | TMRGAKRMAIL | 1.94 | | | | |
| E | 686 | 0.14 | 2 | 2 | 0 | Y | YRGAKRMAILG | 98.06 | MRGAKRMAILG | 1.94 | | | | |
| E | 687 | 0.14 | 2 | 2 | 0 | Y | RGAKRMAILGE | 98.06 | RGAKRMAILGD | 1.94 | | | | |
| E | 688 | 0.14 | 2 | 2 | 0 | Y | GAKRMAILGET | 98.06 | GAKRMAILGDT | 1.94 | | | | |
| E | 689 | 0.14 | 2 | 2 | 0 | Y | AKRMAILGETA | 98.06 | AKRMAILGDTA | 1.94 | | | | |
| E | 690 | 0.14 | 2 | 2 | 0 | Y | KRMAILGETAW | 98.06 | KRMAILGDTAW | 1.94 | | | | |
| E | 691 | 0.14 | 2 | 2 | 0 | Y | RMAILGETAWD | 98.06 | RMAILGDTAWD | 1.94 | | | | |
| E | 692 | 0.14 | 2 | 2 | 0 | Y | MAILGETAWDF | 98.06 | MAILGDTAWDF | 1.94 | | | | |
| E | 693 | 0.14 | 2 | 2 | 0 | Y | AILGETAWDFG | 98.06 | AILGDTAWDFG | 1.94 | | | | |
| E | 694 | 0.14 | 2 | 2 | 0 | Y | ILGETAWDFGS | 98.06 | ILGDTAWDFGS | 1.94 | | | | |
| E | 695 | 0.14 | 2 | 2 | 0 | Y | LGETAWDFGSV | 98.06 | LGDTAWDFGSL | 1.94 | | | | |
| E | 696 | 0.14 | 2 | 2 | 0 | Y | GETAWDFGSVG | 98.06 | GDTAWDFGSLG | 1.94 | | | | |
| E | 697 | 0.14 | 2 | 2 | 0 | Y | ETAWDFGSVGG | 98.06 | DTAWDFGSLGG | 1.94 | | | | |
| E | 698 | 0.14 | 2 | 2 | 0 | Y | TAWDFGSVGGL | 98.06 | TAWDFGSLGGV | 1.94 | | | | |
| E | 699 | 0.46 | 3 | 3 | 0 | Y | AWDFGSVGGLF | 92.23 | AWDFGSVGGLL | 5.83 | AWDFGSLGGVF | 1.94 | | |
| E | 700 | 0.46 | 3 | 3 | 0 | Y | WDFGSVGGLFT | 92.23 | WDFGSVGGLLT | 5.83 | WDFGSLGGVFT | 1.94 | | |
| E | 701 | 0.46 | 3 | 3 | 0 | Y | DFGSVGGLFTS | 92.23 | DFGSVGGLLTS | 5.83 | DFGSLGGVFTS | 1.94 | | |
| E | 702 | 0.46 | 3 | 3 | 0 | Y | FGSVGGLFTSL | 92.23 | FGSVGGLLTSL | 5.83 | FGSLGGVFTSI | 1.94 | | |
| E | 703 | 0.46 | 3 | 3 | 0 | Y | GSVGGLFTSLG | 92.23 | GSVGGLLTSLG | 5.83 | GSLGGVFTSIG | 1.94 | | |
| E | 704 | 0.46 | 3 | 3 | 0 | Y | SVGGLFTSLGK | 92.23 | SVGGLLTSLGK | 5.83 | SLGGVFTSIGK | 1.94 | | |
| E | 705 | 0.46 | 3 | 3 | 0 | Y | VGGLFTSLGKA | 92.23 | VGGLLTSLGKA | 5.83 | LGGVFTSIGKA | 1.94 | | |
| E | 706 | 0.46 | 3 | 3 | 0 | Y | GGLFTSLGKAV | 92.23 | GGLLTSLGKAV | 5.83 | GGVFTSIGKAL | 1.94 | | |
| E | 707 | 0.46 | 3 | 3 | 0 | Y | GLFTSLGKAVH | 92.23 | GLLTSLGKAVH | 5.83 | GVFTSIGKALH | 1.94 | | |
| E | 708 | 0.46 | 3 | 3 | 0 | Y | LFTSLGKAVHQ | 92.23 | LLTSLGKAVHQ | 5.83 | VFTSIGKALHQ | 1.94 | | |
| E | 709 | 0.59 | 4 | 4 | 0 | Y | FTSLGKAVHQV | 90.29 | LTSLGKAVHQV | 5.83 | FTSIGKALHQV | 1.94 | FTSLGKAVHQI | 1.94 |

FIG. 17-27

Species: DENV4 (11-mers)

| protein | block starting position | block entropy | total peptides in block | peptides required to cover 99% of block | gap/X fraction | 99% of block covered w/ <= 5 peptides? | block to cover 99% of | frequency | block peptides required to cover 99% of | frequency | block peptides required to cover 99% of | frequency | block peptides required to cover 99% of | frequency |
|---|---|---|---|---|---|---|---|---|---|---|---|---|---|---|
| E | 710 | 0.28 | 3 | 3 | 0 | Y | TSLGKAVHQVF | 96.12 | TSLGKAVHQIF | 1.94 | TSIGKALHQVF | 1.94 |

FIG. 17-28

Species: DENV4 (11-mers)

| protein | block starting position | block entropy | total peptides in block | peptides required to cover 99% of block | gap/X fraction | 99% of block covered w/ <= 5 peptides? | block | frequency

FIG. 17-29

Species: DENV4 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 766 | 0.36 | 3 | 2 | 0 | Y | TLFLGFTVQAD | 94.17 | TLFLGFTVHAD | 4.85 | | | | |
| E | 767 | 0.56 | 6 | 5 | 0 | Y | LFLGFTVQADM | 92.23 | LFLGFTVHADM | 2.91 | LFLGFTVHADT | 1.94 | LFLGFTVQADV | 0.97 | LFLGFTVQADT | 0.97 |
| E | 768 | 0.56 | 6 | 5 | 0 | Y | FLGFTVQADMG | 92.23 | FLGFTVHADMG | 2.91 | FLGFTVHADTG | 1.94 | FLGFTVQADVG | 0.97 | FLGFTVQADTG | 0.97 |
| E | 769 | 0.56 | 6 | 5 | 0 | Y | LGFTVQADMGC | 92.23 | LGFTVHADMGC | 2.91 | LGFTVHADTGC | 1.94 | LGFTVQADVGC | 0.97 | LGFTVRADMGC | 1.94 |
| NS1 | 782 | 1.57 | 5 | 5 | 0 | Y | SWSGRELKCGS | 59.22 | SWSGKELKCGS | 25.24 | SWNGKELKCGS | 9.71 | SWNGRELKCGS | 3.88 | SWTGKELKCGS | 1.94 |
| NS1 | 783 | 1.57 | 5 | 5 | 0 | Y | WSGRELKCGSG | 59.22 | WSGKELKCGSG | 25.24 | WNGKELKCGSG | 9.71 | WNGRELKCGSG | 3.88 | WTGKELKCGSG | 1.94 |
| NS1 | 784 | 1.57 | 5 | 5 | 0 | Y | SGRELKCGSGI | 59.22 | SGKELKCGSGI | 25.24 | NGKELKCGSGI | 9.71 | NGRELKCGSGI | 3.88 | TGKELKCGSGI | 1.94 |
| NS1 | 785 | 0.95 | 2 | 2 | 0 | Y | GRELKCGSGIF | 63.11 | GKELKCGSGIF | 36.89 | | | | | | |
| NS1 | 786 | 0.95 | 2 | 2 | 0 | Y | RELKCGSGIFV | 63.11 | KELKCGSGIFV | 36.89 | | | | | | |
|

FIG. 17-30

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 804 | 0.3 | 4 | 3 | 0 | Y | TEQYKFQPESP | 96.12 | TEQYQFQPESP | 1.94 | IEQYKFQPESP | 0.97 | | |
| NS1 | 805 | 0.22 | 3 | 2 | 0 | Y | EQYKFQPESPA | 97.09 | EQYQFQPESPA | 1.94 | | | | |
| NS1 | 806 | 0.22 | 3 | 2 | 0 | Y | QYKFQPESPAR | 97.09 | QYQFQPESPAR | 1.94 | | | | |
| NS1 | 807 | 0.35 | 4 | 3 | 0 | Y | YKFQPESPARL | 95.15 | YQFQPESPARL | 1.94 | YKFQPESPARV | 1.94 | | |
| NS1 | 808 | 0.28 | 3 | 2 | 0 | Y | KFQPESPARLA | 96.12 | QFQPESPARLA | 1.94 | KFQPESPARVA | 1.94 | | |
| NS1 | 809 | 0.14 | 2 | 2 | 0 | Y | FQPESPARLAS | 98.06 | FQPESPARVAS | 1.94 | | | | |
| NS1 | 810 | 0.14 | 2 | 2 | 0 | Y | QPESPARLASA | 98.06 | QPESPARVASA | 1.94 | | | | |
| NS1 | 811 | 0.14 | 2 | 2 | 0 | Y | PESPARLASAI | 98.06 | PESPARVASAI | 1.94 | | | | |
| NS1 | 812 | 0.14 | 2 | 2 | 0 | Y | ESPARLASAIL | 98.06 | ESPARVASAIL | 1.94 | | | | |
| NS1 | 813 | 0.22 | 3 | 2 | 0 | Y | SPARLASAILN | 97.09 | SPARVASAILN | 1.94 | | | | |
| NS1 | 814 | 0.22 | 3 | 2 | 0 | Y | PARLASAILNA | 97.09 | PARVASAILNA | 1.94 | | | | |
| NS1 | 815 | 0.22 | 3 | 2 | 0 | Y | ARLASAILNAH | 97.09 | ARVASAILNAH | 1.94 | | | | |
| NS1 | 816 | 0.3 | 4 | 3 | 0 | Y | RLASAILNAHK | 96.12 | RVASAILNAHK | 1.94 | RLASAILAHK | 0.97 | | |
| NS1 | 817 | 0.37 | 5 | 4 | 0 | Y | LASAILNAHKD | 95.15 | VASAILNAHKD | 1.94 | LASAILNAHKE | 0.97 | LASAILNAHED | 0.97 |
| NS1 | 818 | 0.24 | 4 | 3 | 0 | Y | ASAILNAHKDG | 97.09 | ASAILIAHKDG | 0.97 | ASAILNAHKEG | 0.97 | | |
| NS1 | 819 | 0.24 | 4 | 3 | 0 | Y | SAILNAHKDGV | 97.09 | SAILIAHKDGV | 0.97 | SAILNAHEDGV | 0.97 | | |
| NS1 | 820 | 0.24 | 4 | 3 | 0 | Y | AILNAHKDGVC | 97.09 | AILIAHKDGVC | 0.97 | AILNAHEDGVC | 0.97 | | |
| NS1 | 821 | 0.31 | 5 | 4 | 0 | Y | ILNAHKDGVCG | 97.09 | ILNAHKEGVCG | 0.97 | ILAHKDGVC | 0.97 | | |
| NS1 | 822 | 0.31 | 5 | 4 | 0 | Y | LNAHKDGVCGI | 96.12 | LIAHKDGVCGI | 0.97 | LNAHKDGVCGV | 0.97 | LNAHEDGVCGI | 0.97 |
| NS1 | 823 | 0.24 | 4 | 4 | 0 | Y | NAHKDGVCGIR | 96.12 | NAHKEGVCGIR | 0.97 | NAHEDGVCGIR | 0.97 | NAHKDGVCGVR | 0.97 |
| NS1 | 824 | 0.24 | 4 | 3 | 0 | Y | AHKDGVCGIRS | 97.09 | AHEDGVCGIRS | 0.97 | AHKEGVCGIRS | 0.97 | | |
| NS1 | 825 | 0.24 | 4 | 3 | 0 | Y | HKDGVCGIRST | 97.09 | HEDGVCGIRST | 0.97 | HKDGVCGVRST | 0.97 | | |
| NS1 | 826 | 0.24 | 4 | 3 | 0 | Y | KDGVCGIRSTT | 97.09 | KEGVCGIRSTT | 0.97 | HEDGVCGIRSTT | 0.97 | | |
| NS1 | 827 | 0.16 | 3 | 2 | 0 | Y | DGVCGIRSTTR | 98.06 | EGVCGIRSTTR | 0.97 | | | | |
| NS1 | 828 | 0.08 | 2 | 1 | 0 | Y | GVCGIRSTTRL | 99.03 | | | | | | |
| NS1 | 829 | 0.08 | 2 | 1 | 0 | Y | VCGIRSTTRLE | 99.03 | | | | | | |

FIG. 17-31

Species: DENV4 (11-mers)

| protein | block starting position | block entropy | total peptides in block | peptides required to cover 99% of block | gap/Y fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 830 | 0.08 | 2 | 1 | 0 | Y | CGIRSTRLEN | 99.03 | GIRSTRLENI | 2.91 |
| NS1 | 831 | 0.27 | 3 | 2 | 0 | Y | GIRSTRLENV | 96.12 | IRSTRLENIM | 2.91 |
| NS1 | 832 | 0.27 | 3 | 2 | 0 | Y | IRSTRLENVM | 96.12 | RSTTRLENIMW | 2.91 |
| NS1 | 833 | 0.19 | 2 | 2 | 0 | Y | RSTTRLENVMW | 97.09 | STRLENIMWK | 2.91 |
| NS1 | 834 | 0.19 | 2 | 2 | 0 | Y | STRLENVMWK

FIG. 17-32

Species: DENV4 (11-mers)

| protein | block starting position | block entropy | total peptides in block | peptides required to cover 99% of block | gap/X fraction | covered w/ <=5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS1 | 856 | 0.16 | 3 | 2 | 0 | Y | EGGHDLTVWAG | 98.06 | EGGHDLTVWAG | 0.97 | | | | |
| NS1 | 857 | 0.16 | 3 | 2 | 0 | Y | GGHDLTVWAGD | 98.06 | GGHDLTVWAGD | 0.97 | | | | |
| NS1 | 858 | 0.3 | 4 | 3 | 0 | Y | GHDLTVWAGDV | 96.12 | GHDLTVWAGDA | 1.94 | GHDLTVWTGDV | 0.97 | | |
| NS1 | 859 | 0.37 | 5 | 4 | 0 | Y | HDLTVWAGDVK | 95.15 | HDLTVWAGDAK | 1.94 | HDLTVWAGDVR | 0.97 | HDLTVWTGDVK | 0.97 |
| NS1 | 860 | 0.37 | 5 | 4 | 0 | Y | DLTVWAGDVKG | 95.15 | DLTVWAGDAKG | 1.94 | DLTVWAGDVRG | 0.97 | DLTVWAGDVRG | 0.97 |
| NS1 | 861 | 0.37 | 5 | 4 | 0 | Y | LTVWAGDVKGV | 95.15 | LTVWAGDAKGV | 1.94 | LTVWAGDVRGV | 0.97 | LTVWAGDVRGV | 0.97 |
| NS1 | 862 | 0.37 | 5 | 4 | 0 | Y | TVWAGDVKGVL | 95.15 | TVWAGDAKGVL | 1.94 | TIVWAGDVKGV | 0.97 | TVWTGDVKGVL | 0.97 |
| NS1 | 864 | 0.75 | 6 | 5 | 0 | Y | VAGDVKGVLTK | 88.35 | VAGDVKGVLSK | 1.94 | VAGDVKGVLVK | 1.94 | VAGDAKGVLTK | 1.94 |
| NS1 | 865 | 0.75 | 6 | 5 | 0 | Y | AGDVKGVLTKG | 88.35 | AGDVKGVLSKG | 1.94 | AGDVKGVLTKG | 1.94 | AGDVKGVLVKG | 1.94 |
| NS1 | 866 | 0.67 | 5 | 4 | 0 | Y | GDVKGVLTKGK | 89.32 | GDVKGVLSKGK | 1.94 | GDVKGVLTKGK | 1.94 | GDAKGVLTKGK | 1.94 |
| NS1 | 867 | 0.67 | 5 | 4 | 0 | Y | DVKGVLTKGKR | 89.32 | DVKGVLSKGKR | 1.94 | DAKGVLTKGKR | 1.94 | DVKGVLVKGKR | 1.94 |
| NS1 | 869 | 0.69 | 6 | 5 | 0 | Y | KGVLTKGKRAL | 89.32 | KGVLSKGKRAL | 1.94 | KGVLTKGKRAL | 1.94 | KGVLTKGKRTL | 0.97 |
| NS1 | 870 | 0.75 | 6 | 5 | 0 | Y | GVLTKGKRALT | 88.35 | GVLSKGKRALA | 1.94 | GVLTKGKRALT | 1.94 | GVLTKGKRALA | 1.94 |
| NS1 | 871 | 0.75 | 6 | 5 | 0 | Y | VLTKGKRALTP | 88.35 | VLSKGKRALAP | 1.94 | VLTKGKRALTP | 1.94 | VLVKGKRVIAP | 1.94 |
| NS1 | 872 | 0.75 | 6 | 5 | 0 | Y | LTKGKRALTPP | 88.35 | LSKGKRALAPP | 1.94 | LVKGKRALTP | 1.94 | LTKGKRALTPP | 1.94 |
| NS1 | 879 | 1.85 | 6 | 5 | 0 | Y | LTPPYSDLKYS | 49.51 | LTPPASDLKYS | 5.83 | LTPPYNDLKYS | 1.94 | LAPPASDLKYS | 5.83 |
| NS1 | 880 | 1.85 | 6 | 5 | 0 | Y | TPPYSDLKYSW | 49.51 | TPPASDLKYSW | 5.83 | TPPYNDLKYSW | 16.5 | APPASDLKYSW | 5.83 |
| NS1 | 881 | 1.49 | 3 | 3 | 0 | Y | PPYSDLKYSWK | 50.49 | PPASDLKYSWK | 22.33 | PPYNDLKYSWK | 16.5 | APPYNDLKYSW | 1.94 |
| NS1 | 882 | 1.49 | 3 | 3 | 0 | Y | PYSDLKYSWKT | 50.49 | PASDLKYSWKT | 22.33 | PYNDLKYSWKT | 27.18 | | |
| NS1 | 883 | 1.49 | 3 | 3 | 0 | Y | YSDLKYSWKTW | 50.49 | ASDLKYSWKTW | 22.33 | YNDLKYSWKTW | 27.18 | | |
| NS1 | 884 | 0.77 | 2 | 2 | 0 | Y | SDLKYSWKTWG | 77.67 | NDLKYSWKTWG | 22.33 | VNDLKYSWKTW | 27.18 | | |
| NS1 | 885 | 0 | 1 | 1 | 0 | Y | DLKYSWKTWGK | 100 | | | | | | |
| NS1 | 886 | 0 | 1 | 1 | 0 | Y | LKYSWKTWGKA | 100 | | | | | | |
| NS1 | 887 | 0.08 | 2 | 1 | 0 | Y | KYSWKTWGKAK | 99.03 | | | | | | |
| NS1 | 888 | 0.08 | 2 | 1 | 0 | Y | YSWKTWGKAKI | 99.03 | | | | | | |
| NS1 | 889 | 0.08 | 2 | 1 | 0 | Y | SWKTWGKAKIF | 99.03 | | | | | | |

FIG. 17-33

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 890 | 0.16 | 3 | 2 | 0 | Y | WKTW

FIG. 17-34

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 926 | 1.78 | 5 | 4 | 0 | Y | NSLEVEDYGFG | 49.51 | NSFEVEDYGFG | 27.18 | NFLEVEDYGFG | 12.62 | NFFEVEDYGFG | 9.71 |
| NS1 | 927 | 1.78 | 5 | 4 | 0 | Y | SLEVEDYGFGM | 49.51 | SFEVEDYGFGM | 27.18 | FLEVEDYGFGM | 12.62 | FFEVEDYGFGM | 9.71 |
| NS1 | 928 | 1.02 | 3 | 2 | 0 | Y | LEVEDYGFGMF | 62.14 | FEVEDYGFGMF | 36.89 | | | | |
| NS1 | 929 | 0.08 | 2 | 1 | 0 | Y | EVEDYGFGMFT | 99.03 | | | | | | |
| NS1 | 930 | 0.08 | 2 | 1 | 0 | Y | VEDYGFGMFTT | 99.03 | | | | | | |
| NS1 | 931 | 0.22 | 3 | 2 | 0 | Y | EDYGFGMFTTN | 97.09 | EDYGFGMFTTS | 1.94 | | | | |
| NS1 | 932 | 0.14 | 2 | 2 | 0 | Y | DYGFGMFTTNI | 98.06 | DYGFGMFTTSI | 1.94 | | | | |
| NS1 | 933 | 0.14 | 2 | 2 | 0 | Y | YGFGMFTTNIW | 98.06 | YGFGMFTTSIW | 1.94 | | | | |
| NS1 | 934 | 0.14 | 2 | 2 | 0 | Y | GFGMFTTNIWM | 98.06 | GFGMFTTSIWM | 1.94 | | | | |
| NS1 | 935 | 0.14 | 2 | 2 | 0 | Y | FGMFTTNIWMK | 98.06 | FGMFTTSIWMK | 1.94 | | | | |
| NS1 | 936 | 0.22 | 3 | 2 | 0 | Y | GMFTTNIWMKF | 97.09 | GMFTTSIWMKF | 1.94 | | | | |
| NS1 | 937 | 0.22 | 3 | 2 | 0 | Y | MFTTNIWMKFR | 97.09 | MFTTSIWMKFR | 1.94 | | | | |
| NS1 | 938 | 0.22 | 3 | 2 | 0 | Y | FTTNIWMKFRE | 97.09 | FTTSIWMKFRE | 1.94 | | | | |
| NS1 | 939 | 0.22 | 3 | 2 | 0 | Y | TTNIWMKFREG | 97.09 | TTSIWMKFREG | 1.94 | | | | |
| NS1 | 940 | 0.22 | 3 | 2 | 0 | Y | TNIWMKFREGS | 97.09 | TSIWMKFREGS | 1.94 | | | | |
| NS1 | 941 | 0.22 | 3 | 2 | 0 | Y | NIWMKFREGSS | 97.09 | SIWMKFREGSS | 1.94 | | | | |
| NS1 | 942 | 0.08 | 2 | 1 | 0 | Y | IWMKFREGSSE | 99.03 | | | | | | |
| NS1 | 943 | 0.16 | 3 | 2 | 0 | Y | WMKFREGSSEV | 98.06 | WMKLREGSSEV | 0.97 | | | | |
| NS1 | 944 | 0.16 | 3 | 2 | 0 | Y | MKFREGSSEVC | 98.06 | MKFREGSSELC | 0.97 | | | | |
| NS1 | 945 | 0.16 | 3 | 2 | 0 | Y | KFREGSSEVCD | 98.06 | KLREGSSEVCD | 0.97 | | | | |
| NS1 | 946 | 0.16 | 3 | 2 | 0 | Y | FREGSSEVCDH | 98.06 | LREGSSEVCDH | 0.97 | | | | |
| NS1 | 947 | 0.08 | 2 | 1 | 0 | Y | REGSSEVCDHR | 99.03 | | | | | | |
| NS1 | 948 | 0.08 | 2 | 1 | 0 | Y | EGSSEVCDHRL | 99.03 | | | | | | |
| NS1 | 949 | 0.08 | 2 | 1 | 0 | Y | GSSEVCDHRLM | 99.03 | | | | | | |
| NS1 | 950 | 0.08 | 2 | 1 | 0 | Y | SSEVCDHRLMS | 99.03 | | | | | | |
| NS1 | 951 | 0.08 | 2 | 1 | 0 | Y | SEVCDHRLMSA | 99.03 | | | | | | |

FIG. 17-35

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to

FIG. 17-36

Species: DENV4 (11-mers)

| protein | block starting position | block entropy | total peptides in block | peptides required to cover 99% of block | gap/X fraction | 99% of block covered w/ <= 5 peptides? | block | frequency | block | frequency |
|---

FIG. 17-37

Species: DENV4 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1004 | 0 | 1 | 1 | 0 | Y | HTLWSNGVLES | 100 | | | | | | | | |
| NS1 | 1005 | 0 | 1 | 1 | 0 | Y | TLWSNGVLESQ | 100 | | | | | | | | |
| NS1 | 1006 | 0 | 1 | 1 | 0 | Y | LWSNGVLESQM | 100 | | | | | | | | |
| NS1 | 1007 | 0 | 1 | 1 | 0 | Y | WSNGVLESQML | 100 | | | | | | | | |
| NS1 | 1008 | 0 | 1 | 1 | 0 | Y | SNGVLESQMLI | 100 | | | | | | | | |
| NS1 | 1009 | 0 | 1 | 1 | 0 | Y | NGVLESQMLIP | 100 | | | | | | | |

FIG. 17-38

Species: DENV4 (11-mers)

| protein | block starting position | block entropy | total peptides in block | peptides required to cover 99% of block | gap/X fraction | covered w/ <= 5 peptides? | peptides required to cover 99% of block

FIG. 17-39

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1056 | 1.25 | 6 | 5 | 0 | Y | PGTT

FIG. 17-40

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 17-41

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1114 | 0.78 | 4 | 4 | 0 | Y | SEKEENMVKSQ | 85.44 | NEKEENMVKSQ | 9

FIG. 17-42

Species: DENV4 (11-mers)

| protein | block

FIG. 17-43

Species: DENV4 (11-mers)

| protein | block starting position | block entropy | total

FIG. 17-44

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|

FIG. 17-45

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1244 | 0.44 | 4 | 3 | 0 | Y | HDLMELIDGIS | 93.2 | HDLMEFIDGIS | 4.85 | HDLMEFIDGIA | 0.97 | | |
| NS2A | 1245 | 0

FIG. 17-46

Species: DENV4 (11-mers)

| protein | block starting position | block entropy | total peptides in block | peptides required to cover 99% of block | gap/X fraction | 99% of block covered w/ <= 5 peptides? | block to

FIG. 17-47

Species: DENV4 (11-mers)

| protein | block starting position | block entropy | total peptides in block | peptides required to cover 99% of block | gap/X fraction | covered w/ <= 5 peptides? | block | frequency | block | frequency | block | frequency | block | frequency | block | frequency |
|---|---|---|---|---|---|---|---|---|---|---|---|---|---|---|---|---|
| NS2A | 1312 | 0.16 | 3 | 2 | 0 | Y | LQKQSHWVE

FIG. 17-48

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG. 17-49

Species: DENV4 (11-mers)

| protein | block starting position | block entropy | total peptides in block required to cover 99% of block | gap/X fraction | 99% of block covered w/ <= 5 peptides? | peptides required to cover 99% of block | frequency |
|---|---|---|---|---|---|---|---|
| NS2A | 1364 | 0 | 1 | 0 | Y | SALLKNDVPLA | 100 |
| NS2A | 1365 | 0 | 1 | 0 | Y | ALLKNDVPLAG | 100 |
| NS2A | 1366 | 0 | 1 | 0 | Y | LLKNDVPLAGP | 100 |
| NS2A | 1367 | 0 | 1 | 0 | Y | LKNDVPLAGPM | 100 |
| NS2A | 1368 | 0 | 1 | 0 | Y | KNDVPLAGPMV | 100 |
| NS2A | 1369 | 0 | 1 | 0 | Y | NDVPLAGPMVA | 100 |
| NS2A | 1370 | 0 | 1 | 0 | Y | DVPLAGPMVAG | 100 |
| NS2A | 1371 | 0 | 1 | 0 | Y | VPLAGPMVAGG | 100 |
| NS2A | 1372 | 0 | 1 | 0 | Y | PLAGPMVAGGL | 100 |
| NS2A | 1373 | 0 | 1 | 0 | Y | LAGPMVAGGLL | 100 |
| NS2A | 1374 | 0 | 1 | 0 | Y | AGPMVAGGLLL | 100 |
| NS2A | 1375 | 0 | 1 | 0 | Y | GPMVAGGLLLA | 100 |
| NS2A | 1376 | 0 | 1 | 0 | Y | PMVAGGLLLAA | 100 |
| NS2A | 1377 | 0 | 1 | 0 | Y | MVAGGLLLAAY | 100 |
| NS2A | 1378 | 0 | 1 | 0 | Y | VAGGLLLAAYY | 100 |
| NS2A | 1379 | 0 | 1 | 0 | Y | AGGLLLAAYYM | 100 |
| NS2A | 1380 | 0 | 1 | 0 | Y | GGLLLAAYYMS | 100 |
| NS2A | 1381 | 0 | 1 | 0 | Y | GLLLAAYYMSG | 100 |
| NS2A | 1382 | 0 | 1 | 0 | Y | LLLAAYYMSGS | 100 |
| NS2A | 1383 | 0.08 | 2 | 0 | Y | LLAAYYMSGSS | 99.03 |
| NS2A | 1384 | 0.08 | 2 | 0 | Y | LAAYYMSGSSA | 99.03 |
| NS2A | 1385 | 0.08 | 2 | 0 | Y | AAYYMSGSSAD | 99.03 |
| NS2A | 1386 | 0.08 | 2 | 0 | Y | AYYMSGSSADL | 99.03 |
| NS2A | 1387 | 0.08 | 2 | 0 | Y | YYMSGSSADLS | 99.03 |
| NS2A | 1388 | 0.08 | 2 | 0 | Y | YMSGSSADLSL | 99.03 |
| NS2A | 1389 | 0.08 | 2 | 0 | Y | MSGSSADLSLE | 99.03 |

Species: DENV4 (11-mers)

| protein | block starting position | block entropy | total peptides in block | peptides required to cover 99% of block | gap/X fraction | 99% of block covered w/ <= 5 peptides? | block

FIG. 17-52

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover

FIG. 17-53

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1468 | 0.59 | 3 | 3 | 0 | Y | MWQVK

FIG. 17-54

Species: DENV4 (11-mers)

| protein | block starting position | block entropy | total peptides in block | peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS3 | 1500 | 0.36 | 3 | 2 | 0 | Y | IMQRGLFG

FIG. 17-55

Species: DENV4 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency |
|---|---|---|---|---|---|---|---|---|---|---|
| NS3 | 1526 | 0 | 1 | 1 | 0 | Y | HVTRGSVICHE | 100 | | |
| NS3 | 1527 | 0.19 | 2 | 2 | 0 | Y | VTRGSVICHET | 97.09 | VTRGSVICHES | 2.91 |
| NS3 | 1528 | 0.19 | 2 | 2 | 0 | Y | TRGSVICHETG | 97.09 | TRGSVICHESG | 2.91 |
| NS3 | 1529 | 0.19 | 2 | 2 | 0 | Y | RGSVICHETGR | 97.09 | RGSVICHESGR | 2.91 |
| NS3 | 1530 | 0.19 | 2 | 2 | 0 | Y | GSVICHETGRL | 97.09 | GSVICHESGRL | 2.91 |
| NS3 | 1531 | 0.19 | 2 | 2 | 0 | Y | SVICHETGRLE | 97.09 | SVICHESGRLE | 2.91 |
| NS3 | 1532 | 0.19 | 2 | 2 | 0 | Y | VICHETGRLEP | 97.09 | VICHESGRLEP | 2.91 |
| NS3 | 1533 | 0.19 | 2 | 2 | 0 | Y | ICHETGRLEPS | 97.09 | ICHESGRLEPS | 2.91 |
| NS3 | 1534 | 0.19 | 2 | 2 | 0 | Y | CHETGRLEPSW | 97.09 | CHESGRLEPSW | 2.91 |

FIG. 17-56

Species: DENV4 (11-mers)

| protein | block starting position | block entropy | total peptides in block | block peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1552 | 0.08 | 2 | 1 | 0 | Y | ISYGGWRLGD | 99.03 | | | | |
| NS3 | 1553 | 0.08 | 2 | 1 | 0 | Y | SYGGWRLGDK | 99.03 | | | | |
| NS3 | 1554 | 0.08 | 2 | 1 | 0 | Y | YGGWRLGDKW | 99.03 | | | | |
| NS3 | 1555 | 0.08 | 2 | 1 | 0 | Y | GGGWRLGDKWD | 99.03 | | | | |
| NS3 | 1556 | 0.32 | 3 | 2 | 0 | Y | GGWRLGDKWDK | 95.15 | GGWRLGDKWDR | 3.88 | | |
| NS3 | 1557 | 0.32 | 3 | 2 | 0 | Y | GWRLGDKWDKE | 95.15 | GWRLGDKWDRE | 3.88 | | |
| NS3 | 1558 | 0.32 | 3 | 2 | 0 | Y | WRLGDKWDKEE | 95.15 | WRLGDKWDREE | 3.88 | | |
| NS3 | 1559 | 0.32 | 3 | 2 | 0 | Y | RLGDKWDKEED | 95.15 | RLGDKWDREED | 3.88 | | |
| NS3 | 1560 | 0.32 | 3 | 2 | 0 | Y | LGDKWDKEEDV | 95.15 | LGDKWDREEDV | 3.88 | | |
| NS3 | 1561 | 0.32 | 3 | 2 | 0 | Y | GDKWDKEEDVQ | 95.15 | GDKWDREEDVQ | 3.88 | | |
| NS3 | 1562 | 0.32 | 3 | 2 | 0 | Y | DKWDKEEDVQV | 95.15 | DKWDREEDVQV | 3.88 | | |
| NS3 | 1563 | 0.24 | 2 | 2 | 0 | Y | KWDKEEDVQVL | 96.12 | KWDREEDVQVL | 3.88 | | |
| NS3 | 1564 | 0.24 | 2 | 2 | 0 | Y | WDKEEDVQVLA | 96.12 | WDREEDVQVLA | 3.88 | | |
| NS3 | 1565 | 0.43 | 3 | 3 | 0 | Y | DKEEDVQVLAI | 93.2 | DREEDVQVLAI | 3.88 | DKEEDVQVLAV | 2.91 |
| NS3 | 1566 | 0.43 | 3 | 3 | 0 | Y | KEEDVQVLAIE | 93.2 | REEDVQVLAIE | 3.88 | KEEDVQVLAVE | 2.91 |
| NS3 | 1567 | 0.19 | 2 | 2 | 0 | Y | EEDVQVLAIEP | 97.09 | EEDVQVLAVEP | 2.91 | | |
| NS3 | 1568 | 0.19 | 2 | 2 | 0 | Y | EDVQVLAIEPG | 97.09 | EDVQVLAVEPG | 2.91 | | |
| NS3 | 1569 | 0.19 | 2 | 2 | 0 | Y | DVQVLAIEPGK | 97.09 | DVQVLAVEPGK | 2.91 | | |
| NS3 | 1570 | 0.19 | 2 | 2 | 0 | Y | VQVLAIEPGKN | 97.09 | VQVLAVEPGKN | 2.91 | | |

FIG. 17-57

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block

FIG. 17-58

Species: DENV4 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|

FIG. 17-59

Species: DENV4 (11-mers)

| protein | block starting position | block entropy | total peptides in block | peptides required to cover 99% of block | peptides required to cover 99% of block | gap/X fraction | 99% of block covered w/ <= 5 peptides?

FIG. 17-60

Species: DENV4 (11-mers)

| protein | block starting position | block entropy | total peptides in block | peptides required to cover 99% of block | gap/x fraction | 99% of block covered w/ <= 5 peptides? | peptides required to cover 99% of block | frequency |
|---|---|---|---|---|---|---|---|---|
| NS3 | 1656 | 0.08 | 2 | 1 | 0 | Y | DIFRKKRLTIM | 99.03 |
| NS3 | 1657 | 0.08 | 2 | 1 | 0 | Y | IFRKKRLTIMD | 99.03 |
| NS3 | 1658 | 0.08 | 2 | 1 | 0 | Y | FRKKRLTIMDL | 99.03 |
| NS3 | 1659 | 0.08 | 2 | 1 | 0 | Y | RKKRLTIMDLH | 99.03 |
| NS3 | 1660 | 0.08 | 2 | 1 | 0 | Y | KKRLTIMDLHP | 99.03 |
| NS3 | 1661 | 0.08 | 2 | 1 | 0 | Y | KRLTIMDLHPG | 99.03 |
| NS3 | 1662 | 0.08 | 2 | 1 | 0 | Y | RLTIMDLHPGA | 99.03 |
| NS3 | 1663 | 0.08 | 2 | 1 | 0 | Y | LTIMDLHPGAG | 99.03 |
| NS3 | 1664 | 0.08 | 2 | 1 | 0 | Y | TIMDLHPGAGK | 99.03 |
| NS3 | 1665 | 0.08 | 2 | 1 | 0 | Y | IMDLHPGAGKT | 99.03 |
| NS3 | 1666 | 0 | 1 | 1 | 0 | Y | MDLHPGAGKTK | 100 |
| NS3 | 1667 | 0 | 1 | 1 | 0 | Y | DLHPGAGKTKR | 100 |
| NS3 | 1668 | 0 | 1 | 1 | 0 | Y | LHPGAGKTKRI | 100 |
| NS3 | 1669 | 0 | 1 | 1 | 0 | Y | HPGAGKTKRIL | 100 |
| NS3 | 1670 | 0 | 1 | 1 | 0 | Y | PGAGKTKRILP | 100 |
| NS3 | 1671 | 0 | 1 | 1 | 0 | Y | GAGKTKRILPS | 100 |
| NS3 | 1672 | 0 | 1 | 1 | 0 | Y | AGKTKRILPSI | 100 |
| NS3 | 1673 | 0 | 1 | 1 | 0 | Y | GKTKRILPSIV | 100 |
| NS3 | 1674 | 0 | 1 | 1 | 0 | Y | KTKRILPSIVR | 100 |
| NS3 | 1675 | 0 | 1 | 1 | 0 | Y | TKRILPSIVRE | 100 |
| NS3 | 1676 | 0 | 1 | 1 | 0 | Y | KRILPSIVREA | 100 |
| NS3 | 1677 | 0 | 1 | 1 | 0 | Y | RILPSIVREAL | 100 |
| NS3 | 1678 | 0 | 1 | 1 | 0 | Y | ILPSIVREALK | 100 |
| NS3 | 1679 | 0 | 1 | 1 | 0 | Y | LPSIVREALKR | 100 |
| NS3 | 1680 | 0 | 1 | 1 | 0 | Y | PSIVREALKRR | 100 |
| NS3 | 1681 | 0 | 1 | 1 | 0 | Y | SIVREALKRRL | 100 |

FIG. 17-61

Species: DENW4 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1682 | 0 | 1 | 1 | 0 | Y | IVREALKRRLR | 100 | | | | | | |
| NS3 | 1683 | 0 | 1 | 1 | 0 | Y | VREALKRRLRT | 100 | | | | | | |
| NS3 | 1684 | 0 | 1 | 1 | 0 | Y | REALKRRLRTL | 100 | | | | | | |
| NS3 | 1685 | 0 | 1 | 1 | 0 | Y | EALKRRLRTLI | 100 | | | | | | |
| NS3 | 1686 | 0 | 1 | 1 | 0 | Y | ALKRRLRTLIL | 100 | | | | | | |
| NS3 | 1687 | 0 | 1 | 1 | 0 | Y | LKRRLRTLILA | 100 | | | | | | |
| NS3 | 1688 | 0 | 1 | 1 | 0 | Y | KRRLRTLILAP | 100 | | | | | | |
| NS3 | 1689 | 0 | 1 | 1 | 0 | Y | RRLRTLILAPT | 100 | | | | | | |
| NS3 | 1690 | 0 | 1 | 1 | 0 | Y | RLRTLILAPTR | 100 | | | | | | |
| NS3 | 1691 | 0 | 1 | 1 | 0 | Y | LRTLILAPTRV | 100 | | | | | | |
| NS3 | 1692 | 0 | 1 | 1 | 0 | Y | RTLILAPTRVV | 100 | | | | | | |
| NS3 | 1693 | 0 | 1 | 1 | 0 | Y | TLILAPTRVVA | 100 | | | | | | |
| NS3 | 1694 | 0 | 1 | 1 | 0 | Y | LILAPTRVVAA | 100 | | | | | | |
| NS3 | 1695 | 0 | 1 | 1 | 0 | Y | ILAPTRVVAAE | 100 | | | | | | |
| NS3 | 1696 | 0 | 1 | 1 | 0 | Y | LAPTRVVAAEM | 100 | | | | | | |
| NS3 | 1697 | 0 | 1 | 1 | 0 | Y | APTRVVAAEME | 100 | | | | | | |
| NS3 | 1698 | 0 | 1 | 1 | 0 | Y | PTRVVAAEMEE | 100 | | | | | | |
| NS3 | 1699 | 0 | 1 | 1 | 0 | Y | TRVVAAEMEEA | 100 | | | | | | |
| NS3 | 1700 | 0 | 1 | 1 | 0 | Y | RVVAAEMEEAL | 100 | | | | | | |
| NS3 | 1701 | 0 | 1 | 1 | 0 | Y | VVAAEMEEALR | 100 | | | | | | |
| NS3 | 1702 | 0 | 1 | 1 | 0 | Y | VAAEMEEALRG | 100 | | | | | | |
| NS3 | 1703 | 0 | 1 | 1 | 0 | Y | AAEMEEALRGL | 100 | | | | | | |
| NS3 | 1704 | 0 | 1 | 1 | 0 | Y | AEMEEALRGLP | 100 | | | | | | |
| NS3 | 1705 | 0.08 | 2 | 1 | 0 | Y | EMEEALRGLPI | 99.03 | | | | | | |
| NS3 | 1706 | 0.08 | 2 | 1 | 0 | Y | MEEALRGLPIR | 99.03 | | | | | | |
| NS3 | 1707 | 0.08 | 2 | 1 | 0 | Y | EEALRGLPIRY | 99.03 | | | | | | |

FIG. 17-62

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1708 | 0.08 | 2 | 1 | 0 | Y | EALRGLPIRYQ | 99.03 | | | | | | |
| NS3 | 1709 | 0.08 | 2 | 1 | 0 | Y | ALRGLPIRYQT | 99.03 | | | | | | |
| NS3 | 1710 | 0.08 | 2 | 1 | 0 | Y | LRGLPIRYQTP | 99.03 | | | | | | |
| NS3 | 1711 | 0.08 | 2 | 1 | 0 | Y | RGLPIRYQTPA | 99.03 | | | | | | |
| NS3 | 1712 | 0.08 | 2 | 1 | 0 | Y | GLPIRYQTPAV | 99.03 | | | | | | |
| NS3 | 1713 | 0.08 | 2 | 1 | 0 | Y | LPIRYQTPAVK | 99.03 | | | | | | |
| NS3 | 1714 | 0.16 | 3 | 2 | 0 | Y | PIRYQTPAVKS | 98.06 | PIRYQTPAVKA | 0.97 | | | | |
| NS3 | 1715 | 0.24 | 4 | 3 | 0 | Y | IRYQTPAVKSE | 97.09 | IRYQTPAVKSD | 0.97 | | | IRYQTPAVK

FIG. 17-63

Species: DENV4 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|

FIG. 17-64

Species: DENV4 (11-mers)

| protein | block starting position | block entropy | total peptides in block | peptides required to cover 99% of block | gap/X fraction | 99% of block covered w/ <=

FIG. 17-65

Species: DENV4 (11-mers)

| protein | block starting position | block entropy | total peptides in block | peptides required to cover 99% of block | gap/X fraction | 99% of block covered w/ <= 5 peptides?

FIG. 17-66

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS3 | 1812 | 0 | — | — | 0 | Y | REIPERSWNTG | 100 |
| NS3 | 1813 | 0 | — | — | 0 | Y | EIPERSWNTGF | 100 |
| NS3 | 1814 | 0 | — | — | 0 | Y | IPERSWNTGFD | 100 |
| NS3 | 1815 | 0 | — | — | 0 | Y | PERSWNTGFDW | 100 |
| NS3 | 1816 | 0 | — | — | 0 | Y | ERSWNTGFDWI | 100 |
| NS3 | 1817 | 0 | — | — | 0 | Y | RSW

FIG. 17-67

Species: DENV4 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency |
|---|---|---|---|---|---|---|---|---|---|---|
| NS3 | 1838 | 0 | 1 | 1 | 0 | Y | PSIKAGNDIAN | 100 | | |
| NS3 | 1839 | 0 | 1 | 1 | 0 | Y | SIKAGNDIANC | 100 | | |
| NS3 | 1840 | 0 | 1 | 1 | 0 | Y | IKAGNDIANCL | 100 | | |
| NS3 | 1841 | 0 | 1 | 1 | 0 | Y | KAGNDIANCLR | 100 | | |
| NS3 | 1842 | 0 | 1 | 1 | 0 | Y | AGNDIANCLRK | 100 | | |
| NS3 | 1843 | 0 | 1 | 1 | 0 | Y | GNDIANCLRKS | 100 | | |
| NS3 | 1844 | 0 | 1 | 1 | 0 | Y | NDIANCLRKSG | 100 | |

FIG. 17-68

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|

FIG. 17-69

Species: DENV4 (11-mers)

| protein | block starting position | block entropy | total peptides in block | peptides required to cover 99% of block | gap/X fraction | covered w/ <= 5 peptides? | peptides required to cover 99% of block | frequency | peptides required to cover 99

FIG. 17-70

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1916 | 0 | 1 | 1 | 0 | Y | VILAGPIPVTP | 100 | | | | | | |
| NS3 | 1917 | 0 | 1 | 1 | 0 | Y | ILAGPIPVTPA | 100 | | | | | | |
| NS3 | 1918 | 0 | 1 | 1 | 0 | Y | LAGPIPVTPAS | 100 | | | | | | |
| NS3 | 1919 | 0 | 1 | 1 | 0 | Y | AGPIPVTPASA | 100 | | | | | | |
| NS3 | 1920 | 0 | 1 | 1 | 0 | Y | GPIPVTPASAA | 100 | | | | | | |
| NS3 | 1921 | 0 | 1 | 1 | 0 | Y | PIPVTPASAAQ | 100 | | | | | | |
| NS3 | 1922 | 0 | 1 | 1 | 0 | Y | IPVTPASAAQR | 100 | | | | | | |
| NS3 | 1923 | 0 | 1 | 1 | 0 | Y | PVTPASAAQRR | 100 | | | | | | |
| NS3 | 1924 | 0 | 1 | 1 | 0 | Y | VTPASAAQRRG | 100 | | | | | | |
| NS3 | 1925 | 0 | 1 | 1 | 0 | Y | TPASAAQRRGR | 100 | | | | | | |
| NS3 | 1926 | 0 | 1 | 1 | 0 | Y | PASAAQRRGRI | 100 | | | | | | |
| NS3 | 1927 | 0 | 1 | 1 | 0 | Y | ASAAQRRGRIG | 100 | | | | | | |
| NS3 | 1928 | 0 | 1 | 1 | 0 | Y | SAAQRRGRIGR | 100 | | | | | | |
| NS3 | 1929 | 0 | 1 | 1 | 0 | Y | AAQRRGRIGRN | 100 | | | | | | |
| NS3 | 1930 | 0.24 | 2 | 2 | 0 | Y | AQRRGRIGRNP | 96.12 | AQRRGRIGRNL | 3.88 | | | | |
| NS3 | 1931 | 0.43 | 3 | 3 | 0 | Y | QRRGRIGRNPA | 93.2 | QRRGRIGRNLA | 3.88 | QRRGRIGRNPT | 2.91 | | |
| NS3 | 1932 | 0.43 | 3 | 3 | 0 | Y | RRGRIGRNPAQ | 93.2 | RRGRIGRNLAQ | 3.88 | RRGRIGRNPTQ | 2.91 | | |
| NS3 | 1933 | 0.43 | 3 | 3 | 0 | Y | RGRIGRNPAQE | 93.2 | RGRIGRNLAQE | 3.88 | RGRIGRNPTQE | 2.91 | | |
| NS3 | 1934 | 0.43 | 3 | 3 | 0 | Y | GRIGRNPAQED | 93.2 | GRIGRNLAQED | 3.88 | GRIGRNPTQED | 2.91 | | |
| NS3 | 1935 | 0.43 | 3 | 3 | 0 | Y | RIGRNPAQEDD | 93.2 | RIGRNLAQEDD | 3.88 | RIGRNPTQEDD | 2.91 | | |
| NS3 | 1936 | 0.43 | 3 | 3 | 0 | Y | IGRNPAQEDDQ | 93.2 | IGRNLAQEDDQ | 3.88 | IGRNPTQEDDQ | 2.91 | | |
| NS3 | 1937 | 0.43 | 3 | 3 | 0 | Y | GRNPAQEDDQY | 93.2 | GRNLAQEDDQY | 3.88 | GRNPTQEDDQY | 2.91 | | |
| NS3 | 1938 | 0.43 | 3 | 3 | 0 | Y | RNPAQEDDQYV | 93.2 | RNLAQEDDQYV | 3.88 | RNPTQEDDQYV | 2.91 | | |
| NS3 | 1939 | 0.43 | 3 | 3 | 0 | Y | NPAQEDDQYVF | 93.2 | NLAQEDDQYVF | 3.88 | NPTQEDDQYVF | 2.91 | | |
| NS3 | 1940 | 0.43 | 3 | 3 | 0 | Y | PAQEDDQYVFS | 93.2 | LAQEDDQYVFS | 3.88 | PTQEDDQYVFS | 2.91 | | |
| NS3 | 1941 | 0.19 | 2 | 2 | 0 | Y | AQEDDQYVFSG | 97.09 | TQEDDQYVFSG | 2.91 | | | | |

FIG. 17-71

Species: DENV4 (11-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 1942 | 0 | 1 | 1 | 0 | Y | QEDDQYVFSGD | 100 | | |
| NS3 | 1943 | 0 | 1 | 1 | 0 | Y | EDDQYVFSGDP | 100 | | |
| NS3 | 1944 | 0 | 1 | 1 | 0 | Y | DDQYVFSGDPL | 100 | | |
| NS3 | 1945 | 0.19 | 2 | 2 | 0 | Y | DQYVFSGDPLK | 97.09 | DQYVFSGDPLR | 2.91 |
| NS3 | 1946 | 0.19 | 2 | 2 | 0 | Y | QYVFSGDPLKN | 97.09 | QYVFSGDPLRN | 2.91 |
| NS3 | 1947 | 0.19 | 2 | 2 | 0 | Y | YVFSGDPLKND | 97.09 | YVFSGDPLRND | 2.91 |
| NS3 | 1948 | 0.19 | 2 | 2 | 0 | Y | VFSGDPLKNDE | 97.09 | VFSGDPLRNDE | 2.91 |
| NS3 | 1949 | 0.19 | 2 | 2 | 0 | Y | FSGDPLKNDED | 97.09 | FSGDPLRNDED | 2.91 |
| NS3 | 1950 | 0.19 | 2 | 2 | 0 | Y | SGDPLKNDEDH | 97.09 | SGDPLRNDEDH | 2.91 |
| NS3 | 1951 | 0.19 | 2 | 2 | 0 | Y | GDPLKNDEDHA | 97.09 | GDPLRNDEDHA | 2.91 |
| NS3 | 1952 | 0.19 | 2 | 2 | 0 | Y | DPLKNDEDHAH | 97.09 | DPLRNDEDHAH | 2.91 |
| NS3 | 1953 | 0.19 | 2 | 2 | 0 | Y | PLKNDEDHAHW | 97.09 | PLRNDEDHAHW | 2.91 |
| NS3 | 1954 | 0.19 | 2 | 2 | 0 | Y | LKNDEDHAHWT | 97.09 | LRNDEDHAHWT | 2.91 |
| NS3 | 1955 | 0.19 | 2 | 2 | 0 | Y | KNDEDHAHWTE | 97.09 | RNDEDHAHWTE | 2.91 |
| NS3 | 1956 | 0 | 1 | 1 | 0 | Y | NDEDHAHWTEA | 100 | | |
| NS3 | 1957 | 0 | 1 | 1 | 0 | Y | DEDHAHWTEAK | 100 | | |
| NS3 | 1958 | 0 | 1 | 1 | 0 | Y | EDHAHWTEAKM | 100 | | |
| NS3 | 1959 | 0 | 1 | 1 | 0 | Y | DHAHWTEAKML | 100 | | |
| NS3 | 1960 | 0 | 1 | 1 | 0 | Y | HAHWTEAKMLL | 100 | | |
| NS3 | 1961 | 0 | 1 | 1 | 0 | Y | AHWTEAKMLLD | 100 | | |
| NS3 | 1962 | 0 | 1 | 1 | 0 | Y | HWTEAKMLLDN | 100 | | |
| NS3 | 1963 | 0 | 1 | 1 | 0 | Y | WTEAKMLLDNI | 100 | | |
| NS3 | 1964 | 0 | 1 | 1 | 0 | Y | TEAKMLLDNIY | 100 | | |
| NS3 | 1965 | 0 | 1 | 1 | 0 | Y | EAKMLLDNIYT | 100 | | |
| NS3 | 1966 | 0 | 1 | 1 | 0 | Y | AKMLLDNIYTP | 100 | | |
| NS3 | 1967 | 0 | 1 | 1 | 0 | Y | KMLLDNIYTPE | 100 | | |

FIG. 17-72

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG. 17-73

Species: DENV4 (11-mers)

| protein | block starting position | block entropy | total peptides in block | peptides required to cover 99

FIG. 17-74

Species: DENV4 (11-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS3 | 2020 | 0 | 1 | 1 | 0 | Y | WLSYKVASAGI | 100 | | |
| NS3 | 2021 | 0 | 1 | 1 | 0 | Y | LSYKVASAGIS | 100 | | |
| NS3 | 2022 | 0 | 1 | 1 | 0 | Y | SYKVASAGISY | 100 | | |
| NS3 | 2023 | 0.22 | 3 | 2 | 0 | Y | YKVASAGISYK | 97.09 | YKVASAGISYE | 1.94 |
| NS3 | 2024 | 0.22 | 3 | 2 | 0 | Y | KVASAGISYKD | 97.09 | KVASAGISYED | 1.94 |
| NS3 | 2025 | 0.22 | 3 | 2 | 0 | Y | VASAGISYKDR | 97.09 | VASAGISYEDR | 1.94 |
| NS3 | 2026 | 0.22 | 3 | 2 | 0 | Y | ASAGISYKDRE | 97.09 | ASAGISYEDRE | 1.94 |
| NS3 | 2027 | 0.22 | 3 | 2 | 0 | Y | SAGISYKDREW | 97.09 | SAGISYEDREW | 1.94 |
| NS3 | 2028 | 0.22 | 3 | 2 | 0 | Y | AGISYKDREWC | 97.09 | AGISYEDREWC | 1.94 |
| NS3 | 2029 | 0.22 | 3 | 2 | 0 | Y | GISYKDREWCF | 97.09 | GISYEDREWCF | 1.94 |
| NS3 | 2030 | 0.22 | 3 | 2 | 0 | Y | ISYKDREWCFT | 97.09 | ISYEDREWCFT | 1.94 |
| NS3 | 2031 | 0.22 | 3 | 2 | 0 | Y | SYKDREWCFTG | 97.09 | SYEDREWCFTG | 1.94 |
| NS3 | 2032 | 0.22 | 3 | 2 | 0 | Y | YKDREWCFTGE | 97.09 | YEDREWCFTGE | 1.94 |
| NS3 | 2033 | 0.22 | 3 | 2 | 0 | Y | KDREWCFTGER | 97.09 | EDREWCFTGER | 1.94 |
| NS3 | 2034 | 0 | 1 | 1 | 0 | Y | DREWCFTGERN | 100 | | |
| NS3 | 2035 | 0 | 1 | 1 | 0 | Y | REWCFTGERNN | 100 | | |
| NS3 | 2036 | 0 | 1 | 1 | 0 | Y | EWCFTGERNNQ | 100 | | |
| NS3 | 2037 | 0 | 1 | 1 | 0 | Y | WCFTGERNNQI | 100 | | |
| NS3 | 2038 | 0 | 1 | 1 | 0 | Y | CFTGERNNQIL | 100 | | |
| NS3 | 2039 | 0 | 1 | 1 | 0 | Y | FTGERNNQILE | 100 | | |
| NS3 | 2040 | 0 | 1 | 1 | 0 | Y | TGERNNQILEE | 100 | | |
| NS3 | 2041 | 0 | 1 | 1 | 0 | Y | GERNNQILEEN | 100 | | |
| NS3 | 2042 | 0 | 1 | 1 | 0 | Y | ERNNQILEENM | 100 | | |
| NS3 | 2043 | 0 | 1 | 1 | 0 | Y | RNNQILEENME | 100 | | |
| NS3 | 2044 | 0 | 1 | 1 | 0 | Y | NNQILEENMEV | 100 | | |
| NS3 | 2045 | 0 | 1 | 1 | 0 | Y | NQILEENMEVE | 100 | | |

FIG. 17-75

Species: DENV4 (11-mers)

| protein | block starting position | block entropy | total peptides in block | peptides required to cover 99% of block | gap/X fraction | covered w/ <= 5 peptides? | block | frequency | block | frequency |
|---|---|---|---|---|

FIG. 17-76

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS3 | 2072 | 0 | 1 | 1 | 0 | Y | DARYYADPMAL | 100 |
| NS3 | 2073 | 0.08 | 2 | 1 | 0 | Y | ARYYADPMALK | 99.03 |
| NS3 | 2074 | 0.08 | 2 | 1 | 0 | Y | RYYADPMALKD | 99.03 |
| NS3 | 2075 | 0.08 | 2 | 1 | 0 | Y | YYADPMALKDF | 99.03 |
| NS3 | 2076 | 0.08 | 2 | 1 | 0 | Y | YADPMALKDFK | 99.03 |
| NS3 | 2077 | 0.08 | 2 | 1 | 0 | Y | ADPMALKDFKE | 99.03 |
| NS3 | 2078 | 0.08 | 2 | 1 | 0 | Y | DPMALKDFKEF | 99.03 |
| NS3 | 2079 | 0.08 | 2 | 1 | 0 | Y | PMALKDFKEFA | 99.03 |
| NS3 | 2080 | 0.08 | 2 | 1 | 0 | Y | MALKDFKEFAS | 99.03 |
| NS3 | 2081 | 0.08 | 2 | 1 | 0 | Y | ALKDFKEFASG | 99.03 |
| NS3 | 2082 | 0.08 | 2 | 1 | 0 | Y | LKDFKEFASGR | 99.03 |
| NS3 | 2083 | 0.08 | 2 | 1 | 0 | Y | KDFKEFASGRK | 99.03 |
| NS3 | 2084 | 0 | 1 | 1 | 0 | Y | DFKEFASGRKS | 100 |
| NS3 | 2085 | 0.08 | 2 | 1 | 0 | Y | FKEFASGRKSI | 99.03 |
| NS3 | 2086 | 0.08 | 2 | 1 | 0 | Y | KEFASGRKSIT | 99.03 |
| NS3 | 2087 | 0.08 | 2 | 1 | 0 | Y | EFASGRKSITL | 99.03 |
| NS3 | 2088 | 0.08 | 2 | 1 | 0 | Y | FASGRKSITLD | 99.03 |
| NS3 | 2089 | 0.08 | 2 | 1 | 0 | Y | ASGRKSITLDI | 99.03 |
| NS3 | 2090 | 0.08 | 2 | 1 | 0 | Y | SGRKSITLDIL | 99.03 |
| NS3 | 2091 | 0.08 | 2 | 1 | 0 | Y | GRKSITLDILT | 99.03 |
| NS3 | 2092 | 0.08 | 2 | 1 | 0 | Y | RKSITLDILTE | 99.03 |
| NS3 | 2093 | 0.08 | 2 | 1 | 0 | Y | KSITLDILTEI | 99.03 |
| NS3 | 2094 | 0.08 | 2 | 1 | 0 | Y | SITLDILTEIA | 99.03 |
| NS4A | 2095 | 0.51 | 3 | 2 | 0 | Y | ITLDILTEIAS | 90.29 | ITLDILTEIAT | 8.74 |
| NS4A | 2096 | 0.43 | 2 | 2 | 0 | Y | TLDILTEIASL | 91.26 | TLDIL

FIG. 17-77

Species: DENV4 (11-mers)

| protein | block starting position | block entropy | total peptides in block | peptides required to cover 99% of block | gap/X fraction | 99% of block covered w/ <= 5 peptides?

FIG. 17-78

Species: DENV4 (11-mers)

| protein | block starting position | block entropy | total peptides in block | peptides required to cover 99% of block | gap/X fraction | 99% of block covered w/ ≤ 5 peptides? | peptides required to cover 99% of block | frequency | peptides required to cover 99% of block | frequency | peptides required

FIG. 17-79

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to

FIG. 17-80

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2176 | 1.18 | 5 | 4 | 0 | Y | MGLITIAVASG | 71.84 | MGLIAIAVASG | 21.36 | MGLITIAMASG | 3.88 | V

FIG. 17-81

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover

FIG. 17-82

Species: DENV4 (11-mers)

| protein | block starting position | block entropy | total peptides in block | peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency | block to cover 99% of | frequency |
|---|---|---|---|---|---|---|---|---|---|---|---|---|---|---|---|---|
| 2K | 2228 | 0.48 | 4 | 3 | 0 | Y | I

Species: DENV4 (11-mers)

| protein | block starting position | block entropy | total peptides in block | peptides required to cover 99% of block | gap/X fraction | 99% of block covered w/ <= 5 peptides? | pe

FIG. 17-85

Species: DENV4 (11-mers)

| protein | block starting position | block entropy | total peptides in block | peptides required to cover 99% of block | gap/X fraction | 99% of block covered w/ <= 5 peptides? | block (to cover 99% of block) | frequency | block (to cover 99% of block) | frequency |
|---|---|---|---|---|---|---|---|---|---|---|
| NS4B | 2309 | 0.08 | 2 | 1 | 0 | Y | ANQAAVLMGLG | 99.03 | | |
| NS4B | 2310 | 0.08 | 2 | 1 | 0 | Y | NQAAVLMGLGK | 99.03 | | |
| NS4B | 2311 | 0.08 | 2 | 1 | 0 | Y | QAAVLMGLGKG | 99.03 | | |
| NS4B | 2312 | 0 | 1 | 1 | 0 | Y | AAVLMGLGKGW | 100 | | |
| NS4B | 2313 | 0 | 1 | 1 | 0 | Y | AVLMGLGKGWP | 100 | | |
| NS4B | 2314 | 0 | 1 | 1 | 0 | Y | VLMGLGKGWPL | 100 | | |
| NS4B | 2315 | 0 | 1 | 1 | 0 | Y | LMGLGKGWPLH | 100 | | |
| NS4B | 2316 | 0 | 1 | 1 | 0 | Y | MGLGKGWPLHR | 100 | | |
| NS4B | 2317 | 0.14 | 2 | 2 | 0 | Y | GLGKGWPLHRM | 98.06 | GLGKGWPLHRV | 1.94 |
| NS4B | 2318 | 0.14 | 2 | 2 | 0 | Y | LGKGWPLHRMD | 98.06 | LGKGWPLHRVD | 1.94 |
| NS4B | 2319 | 0.14 | 2 | 2 | 0 | Y | GKGWPLHRMDL | 98.06 | GKGWPLHRVDL | 1.94 |
| NS4B | 2320 | 0.22 | 3 | 2 | 0 | Y | KGWPLHRMDLG | 97.09 | KGWPLHRVDLG | 1.94 |
| NS4B | 2321 | 0.22 | 3 | 2 | 0 | Y | GWPLHRMDLGV | 97.09 | GWPLHRVDLGV | 1.94 |
| NS4B | 2322 | 0.22 | 3 | 2 | 0 | Y | WPLHRMDLGVP | 97.09 | WPLHRVDLGVP | 1.94 |
| NS4B | 2323 | 0.22 | 3 | 2 | 0 | Y | PLHRMDLGVPL | 97.09 | PLHRVDLGVPL | 1.94 |
| NS4B | 2324 | 0.22 | 3 | 2 | 0 | Y | LHRMDLGVPLL | 97.09 | LHRVDLGVPLL | 1.94 |
| NS4B | 2325 | 0.22 | 3 | 2 | 0 | Y | HRMDLGVPLLA | 97.09 | HRVDLGVPLLA | 1.94 |
| NS4B | 2326 | 0.22 | 3 | 2 | 0 | Y | RMDLGVPLLAM | 97.09 | RVDLGVPLLAM | 1.94 |
| NS4B | 2327 | 0.22 | 3 | 2 | 0 | Y | MDLGVPLLAMG | 97.09 | VDLGVPLLAMG | 1.94 |
| NS4B | 2328 | 0.08 | 2 | 1 | 0 | Y | DLGVPLLAMGC | 99.03 | | |
| NS4B | 2329 | 0.08 | 2 | 1 | 0 | Y | LGVPLLAMGCY | 99.03 | | |
| NS4B | 2330 | 0.08 | 2 | 1 | 0 | Y | GVPLLAMGCYS | 99.03 | | |
| NS4B | 2331 | 0.08 | 2 | 1 | 0 | Y | VPLLAMGCYSQ | 99.03 | | |
| NS4B | 2332 | 0.08 | 2 | 1 | 0 | Y | PLLAMGCYSQV | 99.03 | | |
| NS4B | 2333 | 0.08 | 2 | 1 | 0 | Y | LLAMGCYSQVN | 99.03 | | |
| NS4B | 2334 | 0.08 | 2 | 1 | 0 | Y | LAMGCYSQVNP | 99.03 | | |

FIG. 17-86

Species: DENV4 (11-mers)

| protein | block starting position | block entropy | total peptides in block | peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS4B | 2335 | 0.08 | 2 | 1 | 0 | Y | AMGCYSQVNPT | 99.03 | | | | | | |
| NS4B | 2336 | 0.08 | 2 | 1 | 0 | Y | MGCYSQVNPT | 99.03 | | | | | | |
| NS4B | 2337 | 0 | 1 | | 0 | Y | GCYSQVNPTL | 100 | | | | | | |
| NS4B | 2338 | 0.14 | 2 | 2 | 0 | Y | CYSQVNPTLI | 98.06 | CYSQVNPTLI | 1.94 | | | | |
| NS4B | 2339 | 0.14 | 2 | 2 | 0 | Y | YSQVNPTTLIA | 98.06 | YSQVNPTTLIA | 1.94 | | | | |
| NS4B | 2340 | 0.14 | 2 | 2 | 0 | Y | SQVNPTTLIAS | 98.06 | SQVNPTTLIAS | 1.94 | | | | |
| NS4B | 2341 | 0.14 | 2 | 2 | 0 | Y | QVNPTTLIASL | 98.06 | QVNPTTLIASL | 1.94 | | | | |
| NS4B | 2342 | 0.22 | 3 | 2 | 0 | Y | VNPTTLIASLV | 97.09 | VNPTTLIASLV | 1.94 | | | | |
| NS4B | 2343 | 0.22 | 3 | 2 | 0 | Y | NPTTLIASLVM | 97.09 | NPTTLIASLVM | 1.94 | | | | |
| NS4B | 2344 | 0.22 | 3 | 2 | 0 | Y | PTTLIASLVML | 97.09 | PTTLIASLVML | 1.94 | | | | |
| NS4B | 2345 | 0.53 | 5 | 4 | 0 | Y | TTLIASLVMLL | 92.23 | TTLIASLVMLS | 3.88 | TTLIASLVMLL | 1.94 | TTLIASLVMLF | 0.97 |
| NS4B | 2346 | 0.53 | 5 | 4 | 0 | Y | TLIASLVMLLV | 92.23 | TLIASLVMLSV | 3.88 | TLIASLYMLLV | 1.94 | TLTASLAMLLV | 0.97 |
| NS4B | 2347 | 0.53 | 5 | 4 | 0 | Y | LIASLVMLLVH | 92.23 | LTASLVMLSVH | 3.88 | LIASLVMLLVH | 1.94 | LTASLAMLLVH | 0.97 |
| NS4B | 2348 | 0.53 | 5 | 4 | 0 | Y | TASLVMLLVHY | 92.23 | TASLVMLSVHY | 3.88 | IASLVMLLVHY | 1.94 | TASLAMLLVHY | 0.97 |
| NS4B | 2349 | 0.39 | 4 | 3 | 0 | Y | ASLVMLLVHYA | 94.17 | ASLVMLSVHYA | 3.88 | ASLAMLLVHYA | 0.97 | | |
| NS4B | 2350 | 0.39 | 4 | 3 | 0 | Y | SLVMLLVHYAI | 94.17 | SLVMLSVHYAI | 3.88 | SLAMLLVHYAI | 0.97 | | |
| NS4B | 2351 | 0.39 | 4 | 3 | 0 | Y | LVMLLVHYAII | 94.17 | LVMLSVHYAII | 3.88 | LAMLLVHYAII | 0.97 | | |
| NS4B | 2352 | 0.39 | 4 | 3 | 0 | Y | VMLLVHYAIIG | 94.17 | VMLSVHYAIIG | 3.88 | VMLFVHYAIIG | 0.97 | | |
| NS4B | 2353 | 0.32 | 3 | 2 | 0 | Y | MLLVHYAIIGP | 95.15 | MLSVHYAIIGP | 3.88 | | | | |
| NS4B | 2354 | 0.32 | 3 | 2 | 0 | Y | LLVHYAIIGPG | 95.15 | LSVHYAIIGPG | 3.88 | | | | |
| NS4B | 2355 | 0.32 | 3 | 2 | 0 | Y | LVHYAIIGPGL | 95.15 | SVHYAIIGPGL | 3.88 | | | | |
| NS4B | 2356 | 0 | 1 | 1 | 0 | Y | VHYAIIGPGLQ | 100 | | | | | | |
| NS4B | 2357 | 0 | 1 | 1 | 0 | Y | HYAIIGPGLQA | 100 | | | | | | |
| NS4B | 2358 | 0 | 1 | 1 | 0 | Y | YAIIGPGLQAK | 100 | | | | | | |
| NS4B | 2359 | 0 | 1 | 1 | 0 | Y | AIIGPGLQAKA | 100 | | | | | | |
| NS4B | 2360 | 0 | 1 | 1 | 0 | Y | IIGPGLQAKAT | 100 | | | | | | |

FIG. 17-87

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS4B | 2361 | 0 | 1 | 1 | 0 | Y | IGPGLQAKATR | 100 |
| NS4B | 2362 | 0 | 1 | 1 | 0 | Y | GPG

FIG. 17-88

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |

FIG. 17-89

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2413 | 0.67 | 4 | 3 | 0 | Y | LLVLCAGQLLL | 87.38 | LLVLCVGQLLL | 9.71 | LLVLCAGQLFL | 1.94 | | |
| NS4B | 2414 | 0.67 | 4 | 3 | 0 | Y | LVLCAGQLLLM | 87.38 | LVLCVGQLLLM | 9.71 | LVLCAGQLFLM | 1.94 | | |
| NS4B | 2415 | 0.67 | 4 | 3 | 0 | Y | VLCAGQLLLMR | 87.38 | VLCVGQLLLMR | 9.71 | VLCAGQLFLMR | 1.94 | | |
| NS4B | 2416 | 0.59 | 3 | 3 | 0 | Y | LCAGQLLLMRT | 88.35 | LCVGQLLLMRT | 9.71 | LCAGQLFLMRT | 1.94 | | |
| NS4B | 2417 | 0.59 | 3 | 3 | 0 | Y | CAGQLLLMRTT | 88.35 | CVGQLLLMRTT | 9.71 | CAGQLFLMRTT | 1.94 | | |
| NS4B | 2418 | 0.59 | 3 | 3 | 0 | Y | AGQLLLMRTTW | 88.35 | VGQLLLMRTTW | 9.71 | AGQLFLMRTTW | 1.94 | | |
| NS4B | 2419 | 0.14 | 2 | 2 | 0 | Y | GQLLLMRTTWA | 98.06 | GQLFLMRTTWA | 1.94 | | | | |
| NS4B | 2420 | 0.59 | 3 | 3 | 0 | Y | QLLLMRTTWAF | 88.35 | QLFLMRTTWAL | 9.71 | QLFLMRTTWAF | 1.94 | | |
| NS4B | 2421 | 0.59 | 3 | 3 | 0 | Y | LLLMRTTWAFC | 88.35 | LLFMRTTWALC | 9.71 | LFLMRTTWAFC | 1.94 | | |
| NS4B | 2422 | 0.59 | 3 | 3 | 0 | Y | LLMRTTWAFCE | 88.35 | LLMRTTWALCE | 9.71 | FLMRTTWAFCE | 1.94 | | |
| NS4B | 2423 | 0.46 | 3 | 2 | 0 | Y | LMRTTWAFCEV | 90.29 | LMRTTWALCEV | 9.71 | | | | |
| NS4B | 2424 | 0.46 | 3 | 2 | 0 | Y | MRTTWAFCEVL | 90.29 | MRTTWALCEVL | 9.71 | | | | |
| NS4B | 2425 | 0.46 | 3 | 2 | 0 | Y | RTTWAFCEVLT | 90.29 | RTTWALCEVLT | 9.71 | | | | |
| NS4B | 2426 | 0.46 | 3 | 2 | 0 | Y | TTWAFCEVLTL | 90.29 | TTWALCEVLTL | 9.71 | | | | |
| NS4B | 2427 | 0.54 | 3 | 2 | 0 | Y | TWAFCEVLTLA | 89.32 | TWALCEVLTLA | 9.71 | | | | |
| NS4B | 2428 | 0.54 | 3 | 2 | 0 | Y | WAFCEVLTLAT | 89.32 | WALCEVLTLAT | 9.71 | | | | |
| NS4B | 2429 | 0.54 | 3 | 2 | 0 | Y | AFCEVLTLATG | 89.32 | ALCEVLTLATG | 9.71 | | | | |
| NS4B | 2430 | 0.54 | 3 | 2 | 0 | Y | FCEVLTLATGP | 89.32 | LCEVLTLATGP | 9.71 | | | | |
| NS4B | 2431 | 0.44 | 4 | 3 | 0 | Y | CEVLTLATGPI | 93.2 | CEVLTLATGPV | 4.85 | CEVLTLSTGPA | 1.94 | CEVLTLSTGPA | 0.97 |
| NS4B | 2432 | 0.89 | 5 | 4 | 0 | Y | EVLTLATGPIL | 83.5 | EVLTLATGPIM | 9.71 | EVLTLATGPVL | 4.85 | EVLTLSTGPAL | 0.97 |
| NS4B | 2433 | 0.89 | 5 | 4 | 0 | Y | VLTLATGPILT | 83.5 | VLTLATGPIMT | 9.71 | VLTLATGPVLT | 4.85 | VLTLSTGPALT | 0.97 |
| NS4B | 2434 | 0.89 | 5 | 4 | 0 | Y | LTLATGPILTL | 83.5 | LTLATGPIMTL | 9.71 | LTLATGPVLTL | 4.85 | LTLSTGPALTL | 0.97 |
| NS4B | 2435 | 0.89 | 5 | 4 | 0 | Y | TLATGPILTLW | 83.5 | TLATGPIMTLW | 9.71 | TLATGPVLTLW | 4.85 | TLSTGPALTLW | 0.97 |
| NS4B | 2436 | 0.89 | 5 | 4 | 0 | Y | LATGPILTLWE | 83.5 | LATGPIMTLWE | 9.71 | LATGPVLTLWE | 4.85 | LATGPLTLWE | 0.97 |
| NS4B | 2437 | 0.89 | 5 | 4 | 0 | Y | ATGPILTLWEG | 83.5 | ATGPIMTLWEG | 9.71 | ATGPVLTLWEG | 4.85 | STGPALTLWEG | 0.97 |
| NS4B | 2438 | 0.89 | 5 | 4 | 0 | Y | TGPILTLWEGN | 83.5 | TGPIMTLWEGN | 9.71 | TGPVLTLWEGG | 4.85 | TGPALTLWEGG | 0.97 |

FIG. 17-90

Species: DENV4 (11-mers)

| protein | block starting position | block entropy | peptides required to cover 99% of block | total peptides in block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS4B | 2439 | 0.89 | 4 | 5 | 0 | Y | GPILTLWEGNP | 83.5 | GPIMTLWEGNP | 9.71 | GPVLTLWEGNP | 4.85 | GPTLTLWEGNP | 0.97 | | |
| NS4B | 2440 | 0.89 | 4 | 5 | 0 | Y | PILTLWEGNPG | 83.5 | PIMTLWEGNPG | 9.71 | PVLTLWEGNPG | 4.85 | PALTLWEGGPG | 0.97 | | |
| NS4B | 2441 | 0.89 | 4 | 5 | 0 | Y | ILTLWEGNPGR | 83.5 | IMTLWEGNPGR | 9.71 | VLTLWEGNPGR | 4.85 | ALTLWEGGPGR | 0.97 | | |
| NS4B | 2442 | 0.54 | 2 | 3 | 0 | Y | LTWEGNPGRF | 89.32 | MTLWEGNPGRF | 9.71 | | | | | | |
| NS4B | 2443 | 0.08 | 1 | 2 | 0 | Y | TLWEGNPGRFW | 99.03 | | | | | | | | |
| NS4B | 2444 | 0.08 | 1 | 2 | 0 | Y | LWEGNPGRFWN | 99.03 | | | | | | | | |
| NS4B | 2445 | 0.08 | 1 | 2 | 0 | Y | WEGNPGRFWNT | 99.03 | | | | | | | | |
| NS4B | 2446 | 0.08 | 1 | 2 | 0 | Y | EGNPGRFWNTT | 99.03 | | | | | | | | |
| NS4B | 2447 | 0.08 | 1 | 2 | 0 | Y | GNPGRFWNTTI | 99.03 | | | | | | | | |
| NS4B | 2448 | 0.08 | 1 | 2 | 0 | Y | NPGRFWNTTIA | 99.03 | | | | | | | | |
| NS4B | 2449 | 0 | 1 | 1 | 0 | Y | PGRFWNTTIAV | 100 | | | | | | | | |
| NS4B | 2450 | 0 | 1 | 1 | 0 | Y | GRFWNTTIAVS | 100 | | | | | | | | |
| NS4B | 2451 | 0 | 1 | 1 | 0 | Y | RFWNTTIAVST | 100 | | | | | | | | |
| NS4B | 2452 | 0 | 1 | 1 | 0 | Y | FWNTTIAVSTA | 100 | | | | | | | | |
| NS4B | 2453 | 0 | 1 | 1 | 0 | Y | WNTTIAVSTAN | 100 | | | | | | | | |
| NS4B | 2454 | 0 | 1 | 1 | 0 | Y | NTTIAVSTANI | 100 | | | | | | | | |
| NS4B | 2455 | 0 | 1 | 1 | 0 | Y | TTIAVSTANIF | 100 | | | | | | | | |
| NS4B | 2456 | 0 | 1 | 1 | 0 | Y | TIAVSTANIFR | 100 | | | | | | | | |
| NS4B | 2457 | 0 | 1 | 1 | 0 | Y | IAVSTANIFRG | 100 | | | | | | | | |
| NS4B | 2458 | 0 | 1 | 1 | 0 | Y | AVSTANIFRGS | 100 | | | | | | | | |
| NS4B | 2459 | 0 | 1 | 1 | 0 | Y | VSTANIFRGSY | 100 | | | | | | | | |
| NS4B | 2460 | 0 | 1 | 1 | 0 | Y | STANIFRGSYL | 100 | | | | | | | | |
| NS4B | 2461 | 0 | 1 | 1 | 0 | Y | TANIFRGSYLA | 100 | | | | | | | | |
| NS4B | 2462 | 0 | 1 | 1 | 0 | Y | ANIFRGSYLAG | 100 | | | | | | | | |
| NS4B | 2463 | 0 | 1 | 1 | 0 | Y | NIFRGSYLAGA | 100 | | | | | | | | |
| NS4B | 2464 | 0 | 1 | 1 | 0 | Y | IFRGSYLAGAG | 100 | | | | | | | | |

FIG. 17-91

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2465 | 0 | 1 | 1 | 0 | Y | FRGSYLAGAGL | 100 | | | | | | |
| NS4B | 2466 | 0 | 1 | 1 | 0 | Y | RGSYLAGAGLA | 100 | | | | | | |
| NS4B | 2467 | 0 | 1 | 1 | 0 | Y | GSYLAGAGLAF | 100 | | | | | | |
| NS4B | 2468 | 0 | 1 | 1 | 0 | Y | SYLAGAGLAFS | 100 | | | | | | |
| NS4B | 2469 | 0 | 1 | 1 | 0 | Y | YLAGAGLAFSL | 100 | | | | | | |
| NS4B | 2470 | 0 | 1 | 1 | 0 | Y | LAGAGLAFSLI | 100 | | | | | | |
| NS4B | 2471 | 0 | 1 | 1 | 0 | Y | AGAGLAFSLIK | 100 | | | | | | |
| NS4B | 2472 | 0 | 1 | 1 | 0 | Y | GAGLAFSLIKN | 100 | | | | | | |
| NS4B | 2473 | 0.22 | 3 | 3 | 2.91 | Y | AGLAFSLIKNA | 94.17 | AGLAFSLIKNV | 1.94 | AGLAFSLIKNT | 0.97 | | |
| NS4B | 2474 | 0.22 | 3 | 3 | 2.91 | Y | GLAFSLIKNAQ | 94.17 | GLAFSLIKNVQ | 1.94 | GLAFSLIKNTQ | 0.97 | | |
| NS4B | 2475 | 0.3 | 4 | 4 | 2.91 | Y | LAFSLIKNAQT | 93.2 | LAFSLIKNVQT | 1.94 | LAFSLIKNTQT | 0.97 | LAFSLIKNAQA | 0.97 |
| NS4B | 2476 | 0.3 | 4 | 4 | 2.91 | Y | AFSLIKNAQTP | 93.2 | AFSLIKNVQTP | 1.94 | AFSLIKNTQTP | 0.97 | AFSLIKNAQTP | 0.97 |
| NS4B | 2477 | 0.3 | 4 | 4 | 2.91 | Y | FSLIKNAQTPR | 93.2 | FSLIKNVQTPR | 1.94 | FSLIKNTQTPR | 0.97 | FSLIKNAQAPR | 0.97 |
| NS4B | 2478 | 0.3 | 4 | 4 | 2.91 | Y | SLIKNAQTPRR | 93.2 | SLIKNVQTPRR | 1.94 | SLIKNTQTPRR | 0.97 | SLIKNAQAPRR | 0.97 |
| NS4B | 2479 | 0.3 | 4 | 4 | 2.91 | Y | LIKNAQTPRRG | 93.2 | LIKNVQTPRRG | 1.94 | LIKNTQTPRRG | 0.97 | LIKNAQAPRRG | 0.97 |
| NS4B | 2480 | 0.3 | 4 | 4 | 2.91 | Y | IKNAQTPRRGT | 93.2 | IKNVQTPRRGT | 1.94 | IKNTQTPRRGT | 0.97 | IKNAQAPRRGT | 0.97 |
| NS4B | 2481 | 0.3 | 4 | 4 | 2.91 | Y | KNAQTPRRGTG | 93.2 | KNVQTPRRGTG | 1.94 | KNTQTPRRGTG | 0.97 | KNAQAPRRGTG | 0.97 |
| NS4B | 2482 | 0.3 | 4 | 4 | 2.91 | Y | NAQTPRRGTGT | 93.2 | NVQTPRRGTGT | 1.94 | NAQAPRRGTGT | 0.97 | NTQTPRRGTGI | 0.97 |
| NS4B | 2483 | 0.38 | 5 | 5 | 2.91 | Y | AQTPRRGTGTI | 92.23 | VQTPRRGTGTT | 1.94 | AQAPRRGTGTT | 0.97 | TQTPRRGTGTI | 0.97 | AQTPRRGTGTI | 0.97 |
| NS4B | 2484 | 0.24 | 4 | 3 | 0 | Y | QTPRRGTGTTG | 97.09 | QTPRRGTGTIG | 0.97 | QTPRRGTGTTE | 0.97 | | |
| NS4B | 2485 | 0.24 | 4 | 3 | 0 | Y | TPRRGTGTTGE | 97.09 | APRRGTGTTGE | 0.97 | | | | |
| NS4B | 2486 | 0.16 | 3 | 2 | 0 | Y | PRRGTGTTGET | 98.06 | | | | | | |
| NS4B | 2487 | 0.16 | 3 | 2 | 0 | Y | RRGTGTTGETL | 98.06 | | | | | | |
| NS4B | 2488 | 0.16 | 3 | 2 | 0 | Y | RGTGTTGETLG | 98.06 | | | | | | |
| NS5 | 2489 | 0.16 | 3 | 2 | 0 | Y | GTGTTGETLGE | 98.06 | | | | | | |
| NS5 | 2490 | 0.16 | 3 | 2 | 0 | Y | TGTTGETLGEK | 98.06 | | | | | | |

FIG. 17-92

Species: DENV4 (11-mers)

| protein | block starting position | block entropy | total peptides in block | peptides required to cover 99% of block | gap/X fraction | 99% of block covered w/ <= 5 peptides? | block | fr

FIG. 17-93

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2517 | 0.14 | 2 | 2 | 0 | Y | KRSGILEVDRT | 98.06 | KRSGILEVDRT | 1.94 | | | | |
| NS5 | 2518 | 0.22 | 3 | 2 | 0 | Y | RSGILEVDRTE | 97.09 | RSGILEVDRTE | 1.94 | | | | |
| NS5 | 2519 | 0.22 | 3 | 2 | 0 | Y | SGILEVDRTEA | 97.09 | SGILEVDRTEA | 1.94 | | | | |
| NS5 | 2520 | 0.22 | 3 | 2 | 0 | Y | GILEVDRTEAK | 97.09 | GILEVDRTEAK | 1.94 | | | | |
| NS5 | 2521 | 0.22 | 3 | 2 | 0 | Y | ILEVDRTEAKS | 97.09 | ILEVDRTEAKS | 1.94 | | | | |
| NS5 | 2522 | 0.22 | 3 | 2 | 0 | Y | LEVDRTEAKSA | 97.09 | LEVDRTEAKSA | 1.94 | | | | |
| NS5 | 2523 | 0.08 | 2 | 1 | 0 | Y | EVDRTEAKSAL | 99.03 | | | | | | |
| NS5 | 2524 | 0.54 | 3 | 2 | 0 | Y | VDRTEAKSALK | 89.32 | VDRTEAKSALR | 9.71 | | | | |
| NS5 | 2525 | 0.54 | 3 | 2 | 0 | Y | DRTEAKSALKD | 89.32 | DRTEAKSALRD | 9.71 | | | | |
| NS5 | 2526 | 0.54 | 3 | 2 | 0 | Y | RTEAKSALKDG | 89.32 | RTEAKSALRDG | 9.71 | | | | |
| NS5 | 2527 | 0.54 | 3 | 2 | 0 | Y | TEAKSALKDGS | 89.32 | TEAKSALRDGS | 9.71 | | | | |
| NS5 | 2528 | 0.54 | 3 | 2 | 0 | Y | EAKSALKDGSK | 89.32 | EAKSALRDGSK | 9.71 | | | | |
| NS5 | 2529 | 0.88 | 5 | 4 | 0 | Y | AKSALKDGSKI | 84.47 | AKSALRDGSKI | 7.77 | AKSALKDGSKT | 4.85 | AKSALRDGSKT | 1.94 |
| NS5 | 2530 | 0.88 | 5 | 4 | 0 | Y | KSALKDGSKIK | 84.47 | KSALRDGSKIK | 7.77 | KSALKDGSKTK | 4.85 | KSALRDGSKTK | 1.94 |
| NS5 | 2531 | 1.06 | 6 | 5 | 0 | Y | SALKDGSKIKH | 81.55 | SALRDGSKIKH | 7.77 | SALKDGSKIKY | 4.85 | SALRDGSKTKH | 1.94 |
| NS5 | 2532 | 0.99 | 5 | 5 | 0 | Y | ALKDGSKIKHA | 82.52 | ALRDGSKIKHA | 7.77 | ALKDGSKTKHA | 4.85 | ALRDGSKTKHA | 1.94 |
| NS5 | 2533 | 0.99 | 5 | 5 | 0 | Y | LKDGSKIKHAV | 82.52 | LRDGSKIKHAV | 7.77 | LKDGSKTKHAV | 4.85 | LRDGSKTKHAV | 1.94 |
| NS5 | 2534 | 0.99 | 5 | 5 | 0 | Y | KDGSKIKHAVS | 82.52 | RDGSKIKHAVS | 7.77 | KDGSKTKHAVS | 4.85 | RDGSKTKHAVS | 1.94 |
| NS5 | 2535 | 0.55 | 3 | 3 | 0 | Y | DGSKIKHAVSR | 90.29 | DGSKTKHAVSR | 6.8 | DGSKIKYAVSR | 2.91 | | |
| NS5 | 2536 | 0.55 | 3 | 3 | 0 | Y | GSKIKHAVSRG | 90.29 | GSKTKHAVSRG | 6.8 | GSKIKYAVSRG | 2.91 | | |
| NS5 | 2537 | 0.55 | 3 | 3 | 0 | Y | SKIKHAVSRGS | 90.29 | SKTKHAVSRGS | 6.8 | SKIKYAVSRGT | 2.91 | | |
| NS5 | 2538 | 0.55 | 3 | 3 | 0 | Y | KIKHAVSRGSS | 90.29 | KTKHAVSRGSS | 6.8 | KIKYAVSRGTS | 2.91 | | |
| NS5 | 2539 | 0.55 | 3 | 3 | 0 | Y | IKHAVSRGSSK | 90.29 | TKHAVSRGSSK | 6.8 | IKYAVSRGTSK | 2.91 | | |
| NS5 | 2540 | 0.19 | 2 | 2 | 0 | Y | KHAVSRGSSKI | 97.09 | KYAVSRGTSKI | 2.91 | | | | |
| NS5 | 2541 | 0.19 | 2 | 2 | 0 | Y | HAVSRGSSKIR | 97.09 | YAVSRGTSKIR | 2.91 | | | | |
| NS5 | 2542 | 0.19 | 2 | 2 | 0 | Y | AVSRGSSKIRW | 97.09 | AVSRGTSKIRW | 2.91 | | | | |

FIG. 17-94

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2543 | 0.19 | 2 | 2 | 0 | Y | VSRGSKIRWI | 97.09 | VSRGTSKIRWI | 2.91 | | | | |
| NS5 | 2544 | 0.19 | 2 | 2 | 0 | Y | SRGSKIRWIV | 97.09 | SRGTSKIRWIV | 2.91 | | | | |
| NS5 | 2545 | 0.19 | 2 | 2 | 0 | Y | RGSSKIRWIVE | 97.09 | RGTSKIRWIVE | 2.91 | | | | |
| NS5 | 2546 | 0.19 | 2 | 2 | 0 | Y | GSSKIRWIVER | 97.09 | GTSKIRWIVER | 2.91 | | | | |
| NS5 | 2547 | 0.19 | 2 | 2 | 0 | Y | SSKIRWIVERG | 97.09 | TSKIRWIVERG | 2.91 | | | | |
| NS5 | 2548 | 0 | 1 | 1 | 0 | Y | SKIRWIVERGM | 100 | | | | | | |
| NS5 | 2549 | 0.49 | 2 | 2 | 0 | Y | KIRWIVERGMN | 89.32 | KIRWIVERGMI | 10.68 | | | | |
| NS5 | 2550 | 0.49 | 2 | 2 | 0 | Y | IRWIVERGMNV | 89.32 | IRWIVERGMIK | 10.68 | | | | |
| NS5 | 2551 | 0.49 | 2 | 2 | 0 | Y | RWIVERGMNVK | 89.32 | RWIVERGMIKP | 10.68 | | | | |
| NS5 | 2552 | 0.49 | 2 | 2 | 0 | Y | WIVERGMNVKP | 89.32 | WIVERGMIKPK | 10.68 | | | | |
| NS5 | 2553 | 0.49 | 2 | 2 | 0 | Y | IVERGMNVKPK | 89.32 | IVERGMIKPKG | 10.68 | | | | |
| NS5 | 2554 | 0.49 | 2 | 2 | 0 | Y | VERGMNVKPKG | 89.32 | VERGMIKPKGK | 10.68 | | | | |
| NS5 | 2555 | 0.57 | 3 | 2 | 0 | Y | ERGMNVKPKGK | 88.35 | ERGMIKPKGKV | 10.68 | | | | |
| NS5 | 2556 | 0.64 | 4 | 3 | 0 | Y | RGMNVKPKGKV | 87.38 | RGMIKPKGKVV | 10.68 | RGMVKPKGKVV | 0.97 | RGMVKPKGKVI | 0.97 |
| NS5 | 2557 | 0.64 | 4 | 3 | 0 | Y | GMNVKPKGKVV | 87.38 | GMIKPKGKVVD | 10.68 | GMVKPKGKVVD | 0.97 | GMVKPKGKVID | 0.97 |
| NS5 | 2558 | 0.64 | 4 | 3 | 0 | Y | MNVKPKGKVVD | 87.38 | MIKPKGKVVDL | 10.68 | MVKPKGKVVDL | 0.97 | MVKPKGKVIDL | 0.97 |
| NS5 | 2559 | 0.64 | 4 | 3 | 0 | Y | VKPKGKVVDLG | 87.38 | IKPKGKVVDLG | 10.68 | VKPKGKVVDLG | 0.97 | VKPKGKVIDLG | 0.97 |
| NS5 | 2560 | 0.16 | 3 | 2 | 0 | Y | KPKGKVVDLGC | 98.06 | KPKGKVIDLGC | 0.97 | | | | |
| NS5 | 2561 | 0.16 | 3 | 2 | 0 | Y | PKGKVVDLGCG | 98.06 | PKGKVIDLGCG | 0.97 | | | | |
| NS5 | 2562 | 0.16 | 3 | 2 | 0 | Y | KGKVVDLGCGR | 98.06 | KGKVIDLGCGR | 0.97 | | | | |
| NS5 | 2563 | 0.16 | 3 | 2 | 0 | Y | GKVVDLGCGRG | 98.06 | GKVIDLGCGRG | 0.97 | | | | |
| NS5 | 2564 | 0.16 | 3 | 2 | 0 | Y | KVVDLGCGRGG | 98.06 | KVIDLGCGRGG | 0.97 | | | | |
| NS5 | 2565 | 0.16 | 3 | 2 | 0 | Y | VVDLGCGRGGW | 98.06 | VIDLGCGRGGW | 0.97 | | | | |
| NS5 | 2566 | 0.08 | 2 | 1 | 0 | Y | VDLGCGRGGWS | 99.03 | | | | | | |
| NS5 | 2567 | 0 | 1 | 1 | 0 | Y | DLGCGRGGWSY | 100 | | | | | | |
| NS5 | 2568 | 0 | 1 | 1 | 0 | Y | LGCGRGGWSYY | 100 | | | | | | |

FIG. 17-95

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2569 | 0.08 | 2 | 1 | 0 | Y | GCGRGGWSYYM | 99.03 | | | | | | |
| NS5 | 2570 | 0.08 | 2 | 1 | 0 | Y | CGRGGWSYYMA | 99.03 | | | | | | |
| NS5 | 2571 | 0.08 | 2 | 1 | 0 | Y | GRGGWSYYMAT | 99.03 | | | | | | |
| NS5 | 2572 | 0.08 | 2 | 1 | 0 | Y | RGGWSYYMATL | 99.03 | | | | | | |
| NS5 | 2573 | 0.08 | 2 | 1 | 0 | Y | GGWSYYMATLK | 99.03 | | | | | | |
| NS5 | 2574 | 0.08 | 2 | 1 | 0 | Y | GWSYYMATLKN | 99.03 | | | | | | |
| NS5 | 2575 | 0.08 | 2 | 1 | 0 | Y | WSYYMATLKNV | 99.03 | | | | | | |
| NS5 | 2576 | 0.08 | 2 | 1 | 0 | Y | SYYMATLKNVT | 99.03 | | | | | | |
| NS5 | 2577 | 0.08 | 2 | 1 | 0 | Y | YYMATLKNVTE | 99.03 | | | |

FIG. 17-96

Species: DENW4 (11-mers)

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS5 | 2595 | 0 | 1 | 1 | 0 | Y | GPGHEEPIPMA | 100 |
| NS5 | 2596 | 0 | 1 | 1 | 0 | Y | PGHEEPIPMAT | 100 |
| NS5 | 2597 | 0 | 1 | 1 | 0 | Y | GHEEPIPMATY | 100 |
| NS5 | 2598 | 0 | 1 | 1 | 0 | Y | HEEPIPMATYG | 100 |
| NS5 | 2599 | 0 | 1 | 1 | 0 | Y | EEPIPMATYGW | 100 |
| NS5 | 2600 | 0 | 1 | 1 | 0 | Y | EPIPMATYGWN | 100 |
| NS5 | 2601 | 0 | 1 | 1 | 0 | Y | P

FIG. 17-97

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency |

FIG. 17-98

Species: DENV4 (11-mers)

| protein | block starting position | block entropy | total peptides in block required to cover 99% of block | gap/X fraction | 99% of block covered w/ <= 5 peptides? | peptides required to cover 99% of block | frequency |
|---|

FIG. 17-99

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2673 | 0 | 1 | 1 | 0 | Y | PYMPTVIEELE | 100 | | | | | | |
| NS5 | 2674 | 0 | 1 | 1 | 0 | Y | YMPTVIEELEK | 100 | | | | | | |
| NS5 | 2675 | 0 | 1 | 1 | 0 | Y | MPTVIEELEKL | 100 | | | | | | |
| NS5 | 2676 | 0 | 1 | 1 | 0 | Y | PTVIEELEKLQ | 100 | | | | | | |
| NS5 | 2677 | 0 | 1 | 1 | 0 | Y | TVIEELEKLQR | 100 | | | | | | |
| NS5 | 2678 | 0.49 | 2 | 2 | 0 | Y | VIEELEKLQRK | 89.32 | VIEELEKLQRR | 10.68 | | | | |
| NS5 | 2679 | 0.63 | 3 | 2 | 0 | Y | IEELEKLQRKH | 87.38 | IEELEKLQRRH | 10.68 | IEELEKLQRKY | 1.94 | | |
| NS5 | 2680 | 0.63 | 3 | 3 | 0 | Y | EELEKLQRKHG | 87.38 | EELEKLQRRHG | 10.68 | EELEKLQRKYG | 1.94 | | |
| NS5 | 2681 | 0.63 | 3 | 3 | 0 | Y | ELEKLQRKHGG | 87.38 | ELEKLQRRHGG | 10.68 | ELEKLQRKYGG | 1.94 | | |
| NS5 | 2682 | 0.95 | 5 | 4 | 0 | Y | LEKLQRKHGGN | 81.55 | LEKLQRRHGGS | 10.68 | LEKLQRKHGGS | 5.83 | LEKLQRKYGGS | 0.97 |
| NS5 | 2683 | 0.95 | 5 | 4 | 0 | Y | EKLQRKHGGNL | 81.55 | EKLQRRHGGSL | 10.68 | EKLQRKHGGSL | 5.83 | EKLQRKYGGSL | 0.97 |
| NS5 | 2684 | 1.01 | 6 | 5 | 0 | Y | KLQRKHGGNLV | 81.55 | KLQRRHGGSLV | 10.68 | KLQRKHGGSLV | 3.88 | KLQRKHGGSLI | 1.94 | KLQRKYGGSLV | 0.97 |
| NS5 | 2685 | 1.01 | 6 | 5 | 0 | Y | LQRKHGGNLVR | 81.55 | LQRRHGGSLVR | 10.68 | LQRKHGGSLVR | 3.88 | LQRKHGGSLIR | 1.94 | LQRKYGGSLVR | 0.97 |
| NS5 | 2686 | 1.01 | 6 | 5 | 0 | Y | QRKHGGNLVRC | 81.55 | QRRHGGSLVRC | 10.68 | QRKHGGSLVRC | 3.88 | QRKHGGSLIRC | 1.94 | QRKYGGSLVRC | 0.97 |
| NS5 | 2687 | 1.01 | 6 | 5 | 0 | Y | RKHGGNLVRCP | 81.55 | RRHGGSLVRCP | 10.68 | RKHGGSLVRCP | 3.88 | RKHGGSLIRCP | 1.94 | RKYGGSLVRCP | 0.97 |
| NS5 | 2688 | 1.01 | 6 | 5 | 0 | Y | KHGGNLVRCPL | 81.55 | RHGGSLVRCPL | 10.68 | KHGGSLVRCPL | 3.88 | KHGGSLIRCPL | 1.94 | KYGGSLVRCPL | 0.97 |
| NS5 | 2689 | 0.88 | 5 | 4 | 0 | Y | HGGNLVRCPLS | 81.55 | HGGSLVRCPLS | 14.56 | HGGSLIRCPLS | 1.94 | YGGSLVRCPLS | 0.97 | | |
| NS5 | 2690 | 0.83 | 4 | 3 | 0 | Y | GGNLVRCPLSR | 81.55 | GGSLVRCPLSR | 15.53 | GGSLIRCPLSR | 1.94 | | | | |
| NS5 | 2691 | 0.83 | 4 | 3 | 0 | Y | GNLVRCPLSRN | 81.55 | GSLVRCPLSRN | 15.53 | GSLIRCPLSRN | 1.94 | | | | |
| NS5 | 2692 | 0.83 | 4 | 3 | 0 | Y | NLVRCPLSRNS | 81.55 | SLVRCPLSRNS | 15.53 | SLIRCPLSRNS | 1.94 | | | | |
| NS5 | 2693 | 0.19 | 2 | 2 | 0 | Y | LVRCPLSRNST | 97.09 | LIRCPLSRNST | 2.91 | | | | | | |
| NS5 | 2694 | 0.19 | 2 | 2 | 0 | Y | VRCPLSRNSTH | 97.09 | IRCPLSRNSTH | 2.91 | | | | | | |
| NS5 | 2695 | 0 | 1 | 1 | 0 | Y | RCPLSRNSTHE | 100 | | | | | | | |
| NS5 | 2696 | 0 | 1 | 1 | 0 | Y | CPLSRNSTHEM | 100 | | | | | | | |
| NS5 | 2697 | 0 | 1 | 1 | 0 | Y | PLSRNSTHEMY | 100 | | | | | | | |
| NS5 | 2698 | 0 | 1 | 1 | 0 | Y | LSRNSTHEMYW | 100 | | | | | | | |

FIG. 17-100

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2699 | 0 | 1 | 1 | 0 | Y | SRNSTHEMYWV | 100 | | | | | | |
| NS5 | 2700 | 0 | 1 | 1 | 0 | Y | RNSTHEMYWVS | 100 | | | | | | |
| NS5 | 2701 | 0 | 1 | 1 | 0 | Y | NSTHEMYWVSG | 100 | | | | | | |
| NS5 | 2702 | 0.32 | 2 | 2 | 0 | Y | STHEMYWVSGA | 94.17 | STHEMYWVSGV | 5.83 | | | | |
| NS5 | 2703 | 0.4 | 3 | 2 | 0 | Y | THEMYWVSGAS | 93.2 | THEMYWVSGVS | 5.83 | | | | |
| NS5 | 2704 | 0.4 | 3 | 2 | 0 | Y | HEMYWVSGASG | 93.2 | HEMYWVSGVSG | 5.83 | | | | |
| NS5 | 2705 | 0.4 | 3 | 2 | 0 | Y | EMYWVSGASGN | 93.2 | EMYWVSGVSGN | 5.83 | | | | |
| NS5 | 2706 | 0.4 | 3 | 2 | 0 | Y | MYWVSGASGNI | 93.2 | MYWVSGVSGNI | 5.83 | | | | |
| NS5 | 2707 | 0.4 | 3 | 2 | 0 | Y | YWVSGASGNIV | 93.2 | YWVSGVSGNIV | 5.83 | | | | |
| NS5 | 2708 | 0.4 | 3 | 2 | 0 | Y | WVSGASGNIVS | 93.2 | WVSGVSGNIVS | 5.83 | | | | |
| NS5 | 2709 | 0.4 | 3 | 2 | 0 | Y | VSGASGNIVSS | 93.2 | VSGVSGNIVSS | 5.83 | | | | |
| NS5 | 2710 | 0.4 | 3 | 2 | 0 | Y | SGASGNIVSSV | 93.2 | SGVSGNIVSSV | 5.83 | | | | |
| NS5 | 2711 | 0.4 | 4 | 2 | 0 | Y | GASGNIVSSVN | 93.2 | GVSGNIVSSVN | 5.83 | | | | |
| NS5 | 2712 | 0.4 | 3 | 2 | 0 | Y | ASGNIVSSVNT | 93.2 | VSGNIVSSVNT | 5.83 | | | | |
| NS5 | 2713 | 0.58 | 4 | 3 | 0 | Y | SGNIVSSVNTI | 89.32 | SGNIVSSVNTI | 8.74 | TGNIVSSVNTI | 0.97 | | | |
| NS5 | 2714 | 0.54 | 3 | 2 | 0 | Y | GNIVSSVNTIS | 89.32 | GNIVSSVNTIS | 9.71 | | | | |
| NS5 | 2715 | 0.54 | 3 | 2 | 0 | Y | NIVSSVNTISK | 89.32 | NIVSSVNTISK | 9.71 | | | | |
| NS5 | 2716 | 0.54 | 3 | 2 | 0 | Y | IVSSVNTISKM | 89.32 | IVSSVNTISKM | 9.71 | | | | |
| NS5 | 2717 | 0.54 | 3 | 2 | 0 | Y | VSSVNTISKML | 89.32 | VSSVNTISKML | 9.71 | | | | |
| NS5 | 2718 | 0.54 | 3 | 2 | 0 | Y | SSVNTISKMLL | 89.32 | SSVNTISKMLL | 9.71 | | | | |
| NS5 | 2719 | 0.54 | 3 | 2 | 0 | Y | SVNTISKMLLN | 89.32 | SVNTISKMLLN | 9.71 | | | | |
| NS5 | 2720 | 0.58 | 4 | 3 | 0 | Y | VNTISKMLLNR | 89.32 | VNTISKMLLNR | 8.74 | VNTVSKMLLNR | 0.97 | | | |
| NS5 | 2721 | 0.58 | 4 | 3 | 0 | Y | NTISKMLLNRF | 89.32 | NTISKMLLNRF | 8.74 | NTISKMLLNWF | 0.97 | | | |
| NS5 | 2722 | 0.58 | 4 | 3 | 0 | Y | TISKMLLNRFT | 89.32 | TISKMLLNRFT | 8.74 | TISKMLLNWFT | 0.97 | | | |
| NS5 | 2723 | 0.58 | 4 | 3 | 0 | Y | ISKMLLNRFTT | 89.32 | ISKMLLNRFTT | 8.74 | VSKMLLNRFTT | 0.97 | | | |
| NS5 | 2724 | 0.16 | 3 | 2 | 0 | Y | SKMLLNRFTTR | 98.06 | SKMLLNWF

FIG. 17-101

Species: DENV4 (11-mers)

| protein | block starting position | block entropy | total peptides in block | peptides required to cover 99% of block | gap/X fraction | 99% of block covered w/ <= 5 peptides? | block | frequency | block | frequency | block | frequency |
|---|---|---|---|---|---|---|---|---|---|---|---|---|
| NS5 | 2725 | 0.16 | 3 | 2 | 0 | Y | KMLLNRFTTRH | 98.06 | KMLLNWFTTRH | 0.97 | |

FIG. 17-102

Species: DENV4 (11-mers)

| protein | block starting position | block entropy | total peptides in block | peptides required to cover

FIG. 17-103

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2777 | 0.14 | 2 | 2 | 0 | Y | KETWHYDQENP | 98.06 | KETWHYDHENP | 1.94 | | | | |
| NS5 | 2778 | 0.14 | 2 | 2 | 0 | Y | ETWHYDQENPY | 98.06 | ETWHYDHENPY | 1.94 | | | | |
| NS5 | 2779 | 0.14 | 2 | 2 | 0 | Y | TWHYDQENPYR | 98.06 | TWHYDHENPYR | 1.94 | | | | |
| NS5 | 2780 | 0.14 | 2 | 2 | 0 | Y | WHYDQENPYRT | 98.06 | WHYDHENPYRT | 1.94 | | | | |
| NS5 | 2781 | 0.14 | 2 | 2 | 0 | Y | HYDQENPYRTW | 98.06 | HYDHENPYRTW | 1.94 | | | | |
| NS5 | 2782 | 0.14 | 2 | 2 | 0 | Y | YDQENPYRTWA | 98.06 | YDHENPYRTWA | 1.94 | | | | |
| NS5 | 2783 | 0.14 | 2 | 2 | 0 | Y | DQENPYRTWAY | 98.06 | DHENPYRTWAY | 1.94 | | | | |
| NS5 | 2784 | 0.14 | 2 | 2 | 0 | Y | QENPYRTWAYH | 98.06 | HENPYRTWAYH | 1.94 | | | | |
| NS5 | 2785 | 0 | 1 | 1 | 0 | Y | ENPYRTWAYHG | 100 | | | | | | |
| NS5 | 2786 | 0 | 1 | 1 | 0 | Y | NPYRTWAYHGS | 100 | | | | | | |
| NS5 | 2787 | 0 | 1 | 1 | 0 | Y | PYRTWAYHGSY | 100 | | | | | | |
| NS5 | 2788 | 0 | 1 | 1 | 0 | Y | YRTWAYHGSYE | 100 | | | | | | |
| NS5 | 2789 | 0 | 1 | 1 | 0 | Y | RTWAYHGSYEA | 100 | | | | | | |
| NS5 | 2790 | 0.08 | 2 | 2 | 0 | Y | TWAYHGSYEAP | 99.03 | | | | | | |
| NS5 | 2791 | 0.08 | 2 | 2 | 0 | Y | WAYHGSYEAPS | 99.03 | | | | | | |
| NS5 | 2792 | 0.08 | 2 | 2 | 0 | Y | AYHGSYEAPST | 99.03 | | | | | | |
| NS5 | 2793 | 0.08 | 2 | 2 | 0 | Y | YHGSYEAPSTG | 99.03 | | | | | | |
| NS5 | 2794 | 0.08 | 2 | 2 | 0 | Y | HGSYEAPSTGS | 99.03 | | | | | | |
| NS5 | 2795 | 0.16 | 3 | 2 | 0 | Y | GSYEAPSTGSA | 98.06 | GSYEAPSTGST | 0.97 | | | | |
| NS5 | 2796 | 0.16 | 3 | 2 | 0 | Y | SYEAPSTGSAS | 98.06 | SYEAPSTGSTS | 0.97 | | | | |
| NS5 | 2797 | 0.16 | 3 | 2 | 0 | Y | YEAPSTGSASS | 98.06 | YEASTGSASS | 0.97 | | | | |
| NS5 | 2798 | 0.16 | 3 | 2 | 0 | Y | EAPSTGSASSM | 98.06 | EAPSTGSTSSM | 0.97 | | | | |
| NS5 | 2799 | 0.24 | 4 | 3 | 0 | Y | APSTGSASSMV | 97.09 | APSTGSASSMI | 0.97 | ASSTGSASSMV | 0.97 | | |
| NS5 | 2800 | 0.24 | 4 | 3 | 0 | Y | PSTGSASSMVN | 97.09 | SSTGSASSMVN | 0.97 | PSTGSTSSMVN | 0.97 | | |
| NS5 | 2801 | 0.16 | 3 | 2 | 0 | Y | STGSASSMVNG | 98.06 | STGSTSSMVNG | 0.97 | | | | |
| NS5 | 2802 | 0.16 | 3 | 2 | 0 | Y | TGSASSMVNGV | 98.06 | TGSASSMINGV | 0.97 | | | | |

FIG. 17-104

Species: DENV4 (11-mers)

| protein | block starting position | block entropy | total peptides in block | peptides required to cover 99% of block | gap/X fraction | 99% of block covered w/ <= 5 peptides? | block | frequency | block | frequency | block | frequency | block | frequency |
|---|

FIG. 17-105

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | pe

FIG. 17-106

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2855 | 1.08 | 5 | 5 | 0 | Y | KPGT

FIG. 17-107

Species: DENV4 (11-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS5 | 2887 | 0.08 | 2 | 1 | 0 | Y | FISKVRSNA

FIG. 17-108

Species: DENV4 (11-mers)

| protein | block starting position | block entropy | total peptides in block | peptides required to cover 99% of block | gap/X fraction | 99% of block covered w/ <= 5 peptides? | peptides required to cover

FIG. 17-109

| protein | block starting position | block entropy | total peptides in block | peptides required to cover 99% of block | gap/X fraction | 99% of block covered w/ <= 5 peptides? | peptides required to cover 99% of block | frequency |
|---|---|---|---|---|---|---|---|---|
| NS5 | 2939 | 0 | – | – | 0 | Y | VYNMMGKREKK | 100 |
| NS5 | 2940 | 0 | – | – | 0 | Y | YNMMGKREKKL | 100 |
| NS5 | 2941 | 0 | – |

FIG. 17-110

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

FIG. 17-111

Species: DENV4 (11-mers)

| protein | block starting position | block entropy | total peptides in block required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|
| NS5 | 2991 | 0 | 1 | 0 | Y | SWSGVEGEGLH | 100 | | | | | | |
| N

FIG. 17-112

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3017 | 0.62 | 2 | 2 | 0 | Y | LMY

FIG. 17-113

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99

FIG. 17-114

Species: DENW4 (11-mers)

| protein | block starting position | block entropy | total peptides in block | peptides required to cover 99% of block | gap/X fraction | 99% of block covered w/ <= 5 peptides? | block | frequency | block | frequency |
|---|---|---|---|---|---|---|---|---|---|---|
| NS5 | 3069 | 0.69 | 2 | 2 | 0 | Y | LRPTPRGAVMD | 81.55 | LRPTPKGAVMD | 18.45 |
| NS

FIG. 17-115

Species: DENV4 (11-mers)

| protein | block starting position | block entropy | total peptides in block | peptides required to cover 99% of block | gap/X fraction | covered w/ <= 5 peptides? | block | frequency | peptides required to cover 99% of block | frequency | peptides required

FIG. 17-116

Species: DENV4 (11-mers)

| protein | block starting position | block entropy | total peptides in block | peptides required to cover 99% of block | gap/X fraction | 99% of block covered w/ <= 5 peptides? | block | frequency | block | frequency | block | frequency | peptides required to cover 99% of block | frequency |
|---|---|---|---|---|---|---|---|---|---|---|---|---|---|---|
| NS5 | 3121 | 0.48 | 4 | 3 | 0 | Y | DMQNPKGL

FIG. 17-117

Species: DENV4 (11-mers)

| protein | block starting position | block entropy | total peptides in block | peptides required to cover 99% of block | gap/X fraction | 99% of block covered w/ <= 5 peptides? | block | frequency | peptides required to cover 99% of block | frequency | peptides required to cover 99% of block | frequency |
|---|---|---|---|---|---|---|---|---|---|---|---|---|
| NS5 | 3147 | 0 | 1 | 1 | 0 | Y | MAISGDDCVWK | 100 | | | | |
| NS5 | 3148 | 0 | 1 | 1 | 0 | Y | AISGDDCVWKP | 100 | | | | |
| NS5 | 3149 | 0 | 1 | 1 | 0 | Y | ISGDDCVWKPL | 100 | | | | |
| NS5 | 3150 | 0 | 1 | 1 | 0 | Y | SGDDCVWKPLD | 100 | | | | |
| NS5 | 3151 | 0 | 1 | 1 | 0 | Y | GDDCVWKPLDE | 100 | | | | |
| NS5 | 3152 | 0 | 1 | 1 | 0 | Y | DDCVWKPLDER | 100 | | | | |
| NS5 | 3153 | 0 | 1 | 1 | 0 | Y | DCVWKPLDERF | 100 | | | | |
| NS5 | 3154 | 0.86 | 3 | 3 | 0 | Y | CVWKPLDERFG | 77.67 | CVWKPLDERFS | 20.39 | CVWKPLDERFA | 1.94 |
| NS5 | 3155 | 0.86 | 3 | 3 | 0 | Y | VWKPLDERFGT | 77.67 | VWKPLDERFST | 20.39 | VWKPLDERFAT | 1.94 |
| NS5 | 3156 | 0.86 | 3 | 3 | 0 | Y | VWKPLDERFGTS | 77.67 | VWKPLDERFSTS | 20.39 | VWKPLDERFATS | 1.94 |
| NS5 | 3157 | 0.86 | 3 | 3 | 0 | Y | KPLDERFGTSL | 77.67 | KPLDERFSTSL | 20.39 | KPLDERFATSL | 1.94 |
| NS5 | 3158 | 0.86 | 3 | 3 | 0 | Y | PLDERFGTSLL | 77.67 | PLDERFSTSLL | 20.39 | PLDERFATSLL | 1.94 |
| NS5 | 3159 | 0.86 | 3 | 3 | 0 | Y | LDERFGTSLLF | 77.67 | LDERFSTSLLF | 20.39 | LDERFATSLLF | 1.94 |
| NS5 | 3160 | 0.86 | 3 | 3 | 0 | Y | DERFGTSLLFL | 77.67 | DERFSTSLLFL | 20.39 | DERFATSLLFL | 1.94 |
| NS5 | 3161 | 0.86 | 3 | 3 | 0 | Y | ERFGTSLLFLN | 77.67 | ERFSTSLLFLN | 20.39 | ERFATSLLFLN | 1.94 |
| NS5 | 3162 | 0.86 | 3 | 3 | 0 | Y | RFGTSLLFLND | 77.67 | RFSTSLLFLND | 20.39 | RFATSLLFLND | 1.94 |
| NS5 | 3163 | 0.86 | 3 | 3 | 0 | Y | FGTSLLFLNDM | 77.67 | FSTSLLFLNDM | 20.39 | FATSLLFLNDM | 1.94 |
| NS5 | 3164 | 0.86 | 3 | 3 | 0 | Y | GTSLLFLNDMG | 77.67 | STSLLFLNDMG | 20.39 | ATSLLFLNDMG | 1.94 |
| NS5 | 3165 | 0 | 1 | 1 | 0 | Y | TSLLFLNDMGK | 100 | | | | |
| NS5 | 3166 | 0 | 1 | 1 | 0 | Y | SLLFLNDMGKV | 100 | | | | |
| NS5 | 3167 | 0 | 1 | 1 | 0 | Y | LLFLNDMGKVR | 100 | | | | |
| NS5 | 3168 | 0 | 1 | 1 | 0 | Y | LFLNDMGKVRK | 100 | | | | |
| NS5 | 3169 | 0 | 1 | 1 | 0 | Y | FLNDMGKVRKD | 100 | | | | |
| NS5 | 3170 | 0 | 1 | 1 | 0 | Y | LNDMGKVRKDI | 100 | | | | |
| NS5 | 3171 | 0 | 1 | 1 | 0 | Y | NDMGKVRKDIP | 100 | | | | |
| NS5 | 3172 | 0 | 1 | 1 | 0 | Y | DMGKVRKDIPQ | 100 | | | | |

FIG. 17-118

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 17-119

Species: DENW4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3199 | 0.16 | 3 | 2 | 0 | Y | SHHFHKIFMKD | 98.06 | SHHFHKIFMKD | 0.97 | | | | |
| NS5 | 3200 | 0.16 | 3 | 2 | 0 | Y | HHF

FIG. 17-120

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 17-121

Species: DENV4 (11-mers)

| protein | block starting position | block entropy | total peptides in block | peptides required to cover 99% of block | gap/X fraction | 99% of block covered w/ <= 5 peptides? | block | frequency | block | peptides required to cover 99% of block | frequency |
|---|---|---|---|---|---|---|---|---|---|---|---|
| NS5 | 3251 | 0 | 1 | 1 | 0 | Y | WSLMYFHRRDL | 100 | | | |
| NS5 | 3252 | 0 | 1 | 1 | 0 | Y | SLMYFHRRDLR | 100 | | | |
| NS5 | 3253 | 0 | 1 | 1 | 0 | Y | LMYFHRRDLRL | 100 | | | |
| NS5 | 3254 | 0 | 1 | 1 | 0 | Y | MYFHRRDLRLA | 100 | | | |
| NS5 | 3255 | 0 | 1 | 1 | 0 | Y | YFHRRDLRLAS | 100 | | | |
| NS5 | 3256 | 0 | 1 | 1 | 0 | Y | FHRRDLRLASM | 100 | | | |
| NS5 | 3257 | 0 | 1 | 1 | 0 | Y | HRRDLRLASMA | 100 | | | |
| NS5 | 3258 | 0 | 1 | 1 | 0 | Y | RRDLRLASMAI | 100 | | | |
| NS5 | 3259 | 0 | 1 | 1 | 0 | Y | RDLRLASMAIC | 100 | | | |
| NS5 | 3260 | 0 | 1 | 1 | 0 | Y | DLRLASMAICS | 100 | | | |
| NS5 | 3261 | 0 | 1 | 1 | 0 | Y | LRLASMAICSA | 100 | | | |
| NS5 | 3262 | 0 | 1 | 1 | 0 | Y | RLASMAICSAV | 100 | | | |
| NS5 | 3263 | 0 | 1 | 1 | 0 | Y | LASMAICSAVP | 100 | | | |
| NS5 | 3264 | 0.08 | 2 | 1 | 0 | Y | ASMAICSAVPT | 99.03 | | | |
| NS5 | 3265 | 0.08 | 2 | 1 | 0 | Y | SMAICSAVPTE | 99.03 | | | |
| NS5 | 3266 | 0.08 | 2 | 1 | 0 | Y | MAICSAVPTEW | 99.03 | | | |
| NS5 | 3267 | 0.16 | 3 | 2 | 0 | Y | AICSAVPTEWF | 98.06 | AICSAVPTEWL | | 0.97 |
| NS5 | 3268 | 0.16 | 3 | 2 | 0 | Y | ICSAVPTEWFP | 98.06 | ICSAVPTEWLP | | 0.97 |
| NS5 | 3269 | 0.16 | 3 | 2 | 0 | Y | CSAVPTEWFPT | 98.06 | CSAVPTEWLPT | | 0.97 |
| NS5 | 3270 | 0.16 | 3 | 2 | 0 | Y | SAVPTEWFPTS | 98.06 | SAVPTEWLPTS | | 0.97 |
| NS5 | 3271 | 0.16 | 3 | 2 | 0 | Y | AVPTEWFPTSR | 98.06 | AVPTEWLPTSR | | 0.97 |
| NS5 | 3272 | 0.16 | 3 | 2 | 0 | Y | VPTEWFPTSRT | 98.06 | VPTEWLPTSRT | | 0.97 |
| NS5 | 3273 | 0.16 | 3 | 2 | 0 | Y | PTEWFPTSRTT | 98.06 | PTEWVPTSRTT | | 0.97 |
| NS5 | 3274 | 0.16 | 3 | 2 | 0 | Y | TEWFPTSRTTW | 98.06 | TEWLPTSRTTW | | 0.97 |
| NS5 | 3275 | 0.16 | 3 | 2 | 0 | Y | EWFPTSRTTWS | 98.06 | EWLPTSRTTWS | | 0.97 |
| NS5 | 3276 | 0.16 | 3 | 2 | 0 | Y | WFPTSRTTWSI | 98.06 | WVPTSRTTWSI | | 0.97 |

FIG. 17-122

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3277 | 0.16 | 3 | 2 | 0 | Y | FPTSRTWSIH | 98.06 | LPTSRTWSIH | 0.

FIG. 17-123

Species: DENV4 (11-mers)

| protein | block starting position | block entropy | total peptides in block | peptides required to cover 99% of block | gap/X fraction | 99% of block covered w/ <= 5 peptides? | block to cover 99% of block | frequency | peptides required to cover 99% of block | block | frequency | peptides required to cover 99% of block | block | frequency |
|---|---|---|---|---|---|---|---|---|---|---|---|---|---|---|
| NS5 | 3303 | 0 | 1 | 1 | 0 | Y | NRWIEDNPNM | 100 | | | | | | |
| NS5 | 3304 | 0.98 | 2 | 2 | 0 | Y | RVWIEDNPNMI | 59.22 | RVWIEDNPNMT | 40.78 | | | | |
| NS5 | 3305 | 0.98 | 2 | 2 | 0 | Y | VWIEDNPNMID | 59.22 | VWIEDNPNMTD | 40.78 | | | | |
| NS5 | 3306 | 0.98 | 2 | 2 | 0 | Y | WIEDNPNMIDK | 59.22 | WIEDNPNMTDK | 40.78 | | | | |
| NS5 | 3307 | 0.98 | 2 | 2 | 0 | Y | IEDNPNMIDKT | 59.22 | IEDNPNMTDKT | 40.78 | | | | |
| NS5 | 3308 | 0.98 | 2 | 2 | 0 | Y | EDNPNMIDKTP | 59.22 | EDNPNMTDKTP | 40.78 | | | | |
| NS5 | 3309 | 1.19 | 3 | 3 | 0 | Y | DNPNMIDKTPV | 59.22 | DNPNMTDKTPV | 35.92 | DNPNMTDKTPI | 4.85 | | |
| NS5 | 3310 | 1.25 | 4 | 3 | 0 | Y | NPNMIDKTPVH | 59.22 | NPNMTDKTPVH | 34.95 | NPNMTDKTPIH | 4.85 | | |
| NS5 | 3311 | 1.25 | 4 | 3 | 0 | Y | PNMIDKTPVHS | 59.22 | PNMTDKTPVHS | 34.95 | PNMTDKTPIHS | 4.85 | | |
| NS5 | 3312 | 1.25 | 4 | 3 | 0 | Y | NMIDKTPVHSW | 59.22 | NMTDKTPVHSW | 34.95 | NMTDKTPIHSW | 4.85 | | |
| NS5 | 3313 | 1.25 | 4 | 3 | 0 | Y | MIDKTPVHSWE | 59.22 | MTDKTPVHSWE | 34.95 | MTDKTPIHSWE | 4.85 | | |
| NS5 | 3314 | 1.25 | 4 | 3 | 0 | Y | IDKTPVHSWED | 59.22 | TDKTPVHSWED | 34.95 | TDKTPIHSWED | 4.85 | | |
| NS5 | 3315 | 0.49 | 3 | 2 | 0 | Y | DKTPVHSWEDI | 92.23 | DKTPIHSWEDI | 4.85 | DKTPIHSWEDV

FIG. 17-124

Species: DENV4 (11-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3329 | 0 | 1 | 1 |

FIG. 17-125

Species: DENV4 (11-mers)

| protein | block starting position | block entropy | total peptides in block | peptides required to cover 99% of block | gap/X fraction | covered w/ <= 5 peptides? | block peptides required to cover 99% of | frequency | block

FIG. 18-1

| Species: DENVall (8-mers) | | | | | | | | | | | | | | | | | |
|---|---|---|---|---|---|---|---|---|---|---|---|---|---|---|---|---|---|
| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
| anC | 1 | 1.03 | 18 | 3 | 3.72 | Y | MNNQRKK

FIG. 18-2

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 36 | 1.75 | 12 | 4 | 0 | Y | GILSGQGP | 44.43 | GMLQGRGP | 30.72 | GLLNGQGP | 20.54 | | |
| anC | 37 | 1.74 | 12 | 4 | 0 | Y | LLSGQGPM | 44.28 | MLQGRGPL | 30.72 | LLNGQGPM | 20.8 | GLFSGKGP | 3.72 |
| anC | 38 | 1.76 | 13 | 4 | 0 | Y | LSGQGPMK | 44.28 | LQGRGPLK | 30.57 | LNGQGPMK | 20.69 | LFSGKGPL | 3.72 |
| anC | 40 | 1.27 | 13 | 5 | 0 | Y | GQGPMKLV | 63.94 | GRGPLKLF | 30.49 | GKGPLRMV | 3.72 | FSGK

FIG. 18-3

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 63 | 1.89 | 9 | 4 | 0 | Y | AGILARWG | 36.47 | AGILKRWG | 34.26 | AGVLARWG | 19.47 | AGILARWS | 9.22 |

FIG. 18-4

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 154 | 1.38 | 8 | 4 | 0 | Y | DLGELCED | 67.04 | DLGEMCDD | 20.83 | DLGEFCED | 7.74 | DLGEMCED | 3.69 |
| prM | 155 | 1.38 | 9 | 4 | 0 | Y | LGELCEDT | 67 | LGEMCDDT | 20.83 | LGEFCEDT | 7.74 | LGEMCEDT | 3.69 |
| prM | 161 | 1.68 | 10 | 4 | 0 | Y | DTMTYKCP | 44.1 | DTITYKCP | 28.98 | DTVTYKCP | 24.67 | DTITYNCP | 1.88 |
| prM | 174 | 1 | 5 | 2 | 0 | Y | EPEDIDCW | 55.38 | EPDDVDCW | 44.51 | | | | |
| prM | 175 | 1 | 5 | 2 | 0 | Y | PEDIDCWC | 55.38 | PDDVDCWC | 44.51 | | | | |
| prM | 176 | 1 | 5 | 2 | 0 | Y | EDIDCWCN | 55.38 | DDVDCWCN | 44.51 | | | | |
| prM | 177 | 1.65 | 10 | 4 | 0 | Y | DVDCWCNA | 43.36 | DIDCWCNS | 30.75 | DIDCWCNL | 24.45 | DVDCWCNT | 1.14 |
| prM | 178 | 1.65 | 10 | 4 | 0 | Y | VDCWCNAT | 43.36 | IDCWCNST | 30.75 | IDCWCNLT | 24.45 | VDCWCNTT | 1.14 |
| prM | 179 | 1.74 | 12 | 5 | 0 | Y | DCWCNATD | 41.96 | DCWCNSTS | 30.75 | DCWCNLTS | 24.41 | DCWCNATE | 1.4 |
| prM | 180 | 1.79 | 16 | 5 | 0 | Y | CWCNATDT | 41.81 | CWCNSTST | 30.72 | CWCNLTST | 24.08 | CWCNATET | 1.4 |
| prM | 181 | 1.78 | 15 | 5 | 0 | Y | WCNATDTW | 41.81 | WCNSTSTW | 30.75 | WCNLTSTW | 24.08 | WCNATETW | 1.4 |
| prM | 185 | 1.35 | 10 | 4 | 0 | Y | TSTWYTYG | 51.33 | TDTWYTYG | 42.99 | TSTWWYYG | 3.39 | TETWYTYG | 1.4 |
| prM | 186 | 1.35 | 10 | 4 | 0 | Y | STWYTYGT | 51.33 | DTWYTYGT | 42.99 | STWWYYGT | 3.39 | ETWYTYGT | 1.4 |
| prM | 187 | 0.3 | 6 | 2 | 0 | Y | TWYTYGTC | 95.72 | TWWMYGTC | 3.43 | | | | |
| prM | 188 | 1.74 | 8 | 4 | 0 | Y | WYTYGTCS | 45.13 | WYTYGTCT | 29.87 | WYTYGTCN | 20.72 | WYMYGTCT | 3.69 |
| prM | 198 | 1.28 | 13 | 4 | 0 | Y | GEHRRDKR | 61.73 | GERRREKR | 32.37 | GERRREKR | 3.76 | GERRRDKR | 1.66 |
| prM | 199 | 1.28 | 13 | 4 | 0 | Y | EHRRDKRS | 61.73 | ERRREKRS | 32.37 | ERRREKRS | 3.76 | ERRRDKRS | 1.66 |
| prM | 200 | 1.26 | 10 | 4 | 0 | Y | HRRDKRSV | 61.8 | RREKRSVA | 32.52 | RRREKRSV | 3.76 | RRRDKRSV | 1.66 |
| prM | 201 | 0.97 | 7 | 2 | 0 | Y | RRDKRSVA | 63.46 | REKRSVAL | 36.28 | EKRSVALT | 3.69 | EKRSVALA | 1.88 |
| prM | 202 | 0.97 | 7 | 2 | 0 | Y | RDKRSVAL | 63.46 | EKRSVALY | 36.28 | KRSVALTP | 3.69 | | |
| prM | 203 | 1.25 | 9 | 4 | 0 | Y | DKRSVALA | 63.46 | EKRSVALV | 30.72 | RSVALTPH | 3.69 | | |
| prM | 204 | 1.12 | 6 | 3 | 0 | Y | KRSVALAP | 65.38 | KRSVALVP | 30.75 | SVALTPHS | 3.69 | | |
| prM | 205 | 1.11 | 5 | 3 | 0 | Y | RSVALAPH | 65.49 | RSVALVPH | 30.75 | VALTPHSG | 3.69 | | |
| prM | 206 | 1.12 | 7 | 3 | 0 | Y | SVALAPHV | 65.41 | SVALVPHV | 30.75 | | | | |
| prM | 207 | 1.13 | 8 | 3 | 0 | Y | VALAPHVG | 65.41 | VALVPHVG | 30.57 | | | | |

FIG. 18-5

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 208 | 1.73 | 9 | 4 | 0 | Y | ALAPHVGL | 44.4 | ALVPHVGM | 30.57 | ALAPHVGM | 20.98 | ALTPHSGM | 3.69 | |
| prM | 209 | 1.73 | 9 | 4 | 0 | Y | LAPHVGLG | 44.4 | LVPHVGMG | 30.57 | LAPHVGMG | 20.98 | LTPHSGMG | 3.69 | |
| prM | 210 | 1.73 | 9 | 4 | 0 | Y | APHVGLGL | 44.4 | VPHVGMGL | 30.57 | APHVGMGL | 20.98 | TPHSGMGL | 3.69 | |
| prM | 211 | 1.73 | 9 | 4 | 0 | Y | PHVGLGLE | 44.4 | PHVGMGLE | 30.72 | PHVGMGLD | 20.8 | PHSGMGLE | 3.72 | |

FIG. 18-6

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 276 | 1.71 | 6 | 4 | 0 | Y | TPSMAMRC | 45.1 | APSMTMRC | 29.98 | TPSMTMRC | 21.02 | APSYGMRC | 3.72 | | |
| prM | 277 | 1.72 | 8 | 4 | 0 | Y | PSMAMRCV | 45.02 | PSMTMRCI | 30.6 | PSMTMRCV | 20.35 | PSYGMRCV | 3.65 | | |
| prM | 278 | 1.72 | 8 | 4 | 0 | Y | SMAMRCVG | 45.02 | SMTMRCIG | 30.6 | SMTMRCVG | 20.35 | SYGMRCVG | 3.65 | | |
| E | 281 | 2 | 12 | 5 | 0 | Y | MRCVGIGS | 32.85 | MRCIGISN | 29.98 | M

FIG. 18-7

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 303 | 1.69 | 4 | 4 | 0 | Y | WLEHGSC | 44.54 | WLEHGSC | 30.9 | | | | |
| E | 304 | 0.82 | 3 | 2 | 0 | Y | LEHGSCV | 75.29 | VLEHGGCV | 24.56 | | | | |
| E | 305 | 0.82 | 3 | 2 | 0 | Y | LEHGSCVT | 75.29 | LEHGGCVT | 24.56 | | | | |
| E | 306 | 0.83 | 5 | 2 | 0 | Y | EHGSCVTT | 75.22 | EHGGCVTT | 24.56 | | | | |
| E | 307 | 0.84 | 7 | 2 | 0 | Y | HGSCVTTM | 75.15 | HGGCVTTM | 24.52 | | | | |
| E | 308 | 0.85 | 8 | 2 | 0 | Y | GSCVTTMA | 75.15 | GGCVTTMA | 24.48 | | | | |
| E | 309 | 1.02 | 11 | 3 | 0 | Y | SCVTTMAK | 75.04 | GCVTTMAK | 20.65 | GCVTTMAQ

FIG. 18-8

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 350 | 1.2 | 6 | 4 | 0 | Y | TDSRCPTQ | 66.48 | TESRCPTQ | 27.84 | TATRCPTQ | 3.72 | TASRCPTQ | 1.88 |
| E | 351 | 1.19 | 5 | 4 | 0 | Y | DSRCPTQG | 66.52 | ESRCPTQG | 27.84 | ATRCPTQG | 3.72 | ASRCPTQG | 1.88 |
| E | 352 | 0.23 | 3 | 2 | 0 | Y | SRCPTQGE | 96.24 | TRCPTQGE | 3.72 | | | | |
| E | 353 | 0.94 | 3 | 2 | 0 | Y | RCPTQGEA | 65.34 | RCPTQGEP | 34.62 | | | | |
| E | 372 | 1.81 | 12 | 5 | 0 | Y | CRRTFVDR | 44.06 | CKHSMVDR | 30.13 | CKHTYVDR | 20.8 | CRRDWDR | 3.61 |
| E | 373 | 1.81 | 12 | 5 | 0 | Y | RRTFVDRG | 44.06 | KHSMVDRG | 30.13 | KHTYVDRG | 20.8 | RRDWDRG | 3.61 |
| E | 374 | 1.76 | 10 | 4 | 0 | Y | RTFVDRGW | 44.06 | HSMVDRGW | 30.68 | HTYVDRGW | 20.83 | RDVVDRGW | 3.61 |
| E | 375 | 1.76 | 10 | 4 | 0 | Y | TFVDRGWG | 44.06 | SMVDRGWG | 30.68 | TYVDRGWG | 20.83 | DVVDRGWG | 3.61 |
| E | 376 | 1.74 | 6 | 4 | 0 | Y | FVDRGWGN | 44.06 | MVDRGWGN | 30.75 | YVDRGWGN | 20.83 | VDRGWGN | 3.87 |
| E | 377 | 0 | 1 | 1 | 0 | Y | VDRGWGNG | 100 | | | | | | |
| E | 378 | 0 | 1 | 1 | 0 | Y | DRGWGNGC | 100 | | | | | | |
| E | 379 | 0 | 1 | 1 | 0 | Y | RGWGNGCG | 100 | | | | | | |
| E | 380 | 0 | 1 | 1 | 0 | Y | GWGNGCGL | 100 | | | | | | |
| E | 381 | 0 | 1 | 1 | 0 | Y | WGNGCGLF | 100 | | | | | | |
| E | 382 | 0 | 1 | 1 | 0 | Y | GNGCGLFG | 100 | | | | | | |
| E | 383 | 0 | 1 | 1 | 0 | Y | NGCGLFGK | 100 | | | | | | |
| E | 384 | 0 | 1 | 1 | 0 | Y | GCGLFGKG | 100 | | | | | | |
| E | 385 | 0.94 | 3 | 2 | 0 | Y | CGLFGKGS | 65.38 | CGLFGKGG | 34.55 | | | | |
| E | 386 | 1.11 | 4 | 3 | 0 | Y | GLFGKGSL | 65.38 | GLFGKGGI | 30.75 | GLFGKGGV | 3.8 | | |
| E | 387 | 2.08 | 7 | 5 | 0 | Y | LFGKGSLI | 33.92 | LFGKGSLV | 30.75 | LFGKGSLV | 20.83 | LFGKGSLL | 10.29 | LFGKGGV | 3.8 |
| E | 388 | 2.08 | 7 | 5 | 0 | Y | FGKGSLIT | 33.92 | FGKGSLVT | 30.75 | FGKGSLVT | 20.83 | FGKGSLLT | 10.29 | FGKGGVT | 3.8 |
| E | 389 | 2.08 | 8 | 5 | 0 | Y | GKGSLITC | 33.92 | GKGSLVTC | 30.75 | GKGSLVTC | 20.83 | GKGSLLTC | 10.29 | GKGGVTC | 3.8 |
| E | 390 | 2.09 | 11 | 5 | 0 | Y | KGSLITCA | 33.85 | KGSLVTCA | 30.72 | KGSLVTCA | 20.83 | KGSLLTCA | 10.25 | KGGVTCA | 3.72 |
| E | 391 | 2.11 | 14 | 5 | 0 | Y | GSLITCAK | 33.85 | GSLVTCAK | 30.53 | GSLVTCAK | 20.83 | GSLLTCAK | 10.25 | GGVTCAK | 3.72 |
| E | 392 | 2.11 | 14 | 5 | 0 | Y | SLITCAKF | 33.85 | GIVTCAMF | 30.53 | SLVTCAKF | 20.83 | SLLTCAKF | 10.25 | GVVTCAKF | 3.72 |

FIG. 18-9

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 410 | 1.6 | 12 | 5 | 0 | Y | VQENLKY | 60.29 | VQENLEY | 25.77 | VLPENLEY | 5.05 | VQHENLKY | 4.65 | VQIENLEY | 3.69 |
| E | 413 | 1.78 | 12 | 4 | 0 | Y | ENLKYSVI | 44.32 | ENLEYTIV | 29.98 | ENLKYTVI | 20.46 | ENLEYTVV | 4.5 | | |
| E | 420 | 2.04 | 14 | 5 | 0 | Y | ITVHTGD | 44.32 | VITPHSGE | 21.09 | IITVHTGD | 20.39 | VTPHSGE | 9.7 | VTVHNGD | 3.72 |
| E | 421 | 2 | 12 | 5 | 0 | Y | VTVHTGDQ | 44.43 | ITPHSGEE | 21.17 | ITVHTGDQ | 20.76 | VTPHSGEE | 9.7 | VTVHNGDT | 3.69 |
| E | 422 | 1.26 | 15 | 4 | 0 | Y | TVHTGDQH | 65.08 | TPHSGEEH | 28.91 | TVHNGDTH | 3.69 | TPHSGEEN | 1.84 | | |
| E | 423 | 1.27 | 17 | 4 | 0 | Y | VHTGDQHQ | 65.08 | PHSGEEHA | 28.83 | VHNGDTHA | 3.69 | PHSGEENA | 1.81 | | |
| E | 424 | 1.26 | 16 | 4 | 0 | Y | HTGDQHQV | 65.12 | HSGEEHAV | 28.83 | HNGDTHAV | 3.69 | HSGEENAV | 1.81 | | |
| E | 425 | 1.26 | 16 | 4 | 0 | Y | TGDQHQVG | 65.12 | SGEEHAVG | 28.83 | NGDTHAVG | 3.69 | SGEENAVG | 1.81 | | |
| E | 426 | 1.28 | 18 | 4 | 0 | Y | GDQHQVGN | 65.15 | GEEHAVGN | 28.65 | GDTHAVGN | 3.69 | GEENAVGN | 1.81 | | |
| E | 427 | 1.54 | 19 | 5 | 0.04 | Y | DQHQVGNE | 59.88 | EEHAVGND | 28.61 | DQHQVGND | 5.27 | DTHAVGND | 3.69 | EENAVGND | 1.81 |
| E | 461 | 1.77 | 12 | 4 | 0 | Y | LTLDCSPR | 44.47 | VTMECSPR | 30.2 | LGLECSPR | 28.61 | LTLDCEPR | 3.65 | | |
| E | 462 | 1.73 | 14 | 4 | 0 | Y | TLDCSPRT | 44.43 | TMECSPRT | 30.79 | GLECSPRT | 30.2 | TLDCEPRS | 3.65 | | |
| E | 463 | 1.75 | 11 | 3 | 0 | Y | LDCSPRTG | 44.51 | MECSPRTG | 30.38 | LECSPRTG | 30.79 | LDCEPRSG | 3.72 | | |
| E | 464 | 1.26 | 10 | 2 | 0 | Y | ECSPRTGL | 51.07 | DCSPRTGL | 44.51 | DCEPRSGI | 30.38 | | | | |
| E | 465 | 0.31 | 11 | 2 | 0 | Y | CSPRTGLD | 95.54 | CEPRSGID | 3.72 | | | | | | |
| E | 466 | 0.31 | 12 | 2 | 0 | Y | SPRTGLDF | 95.5 | EPRSGIDF | 3.72 | | | | | | |
| E | 467 | 0.33 | 15 | 2 | 0 | Y | PRTGLDFN | 95.39 | PRSGIDFN | 3.72 | | | | | | |
| E | 468 | 0.33 | 15 | 2 | 0 | Y | RTGLDFNE | 95.39 | RSGIDFNE | 3.72 | | | | | | |
| E | 469 | 0.34 | 17 | 2 | 0 | Y | TGLDFNEM | 95.28 | SGIDFNEM | 3.72 | | | | | | |
| E | 470 | 1.05 | 16 | 3 | 0 | Y | GLDFNEMV | 74.59 | GLDFNEMI | 20.76 | GIDFNEMI | 3.72 | | | | |
| E | 471 | 1.01 | 15 | 3 | 0.15 | Y | LDFNEMVL | 75 | LDFNEMIL | 20.61 | IDFNEMIL | 3.72 | | | | |
| E | 472 | 1.01 | 15 | 3 | 0.15 | Y | DFNEMVLL | 75.04 | DFNEMILL | 20.61 | DFNEMILM | 3.72 | | | | |
| E | 473 | 1.76 | 19 | 4 | 0.15 | Y | FNEMVLLT | 44.32 | FNEMILLT | 30.68 | FNEMILLT | 20.61 | FNEMILMK | 3.58 | | |
| E | 474 | 1.75 | 18 | 4 | 0.15 | Y | NEMVLLTM | 44.32 | NEMILLTM | 30.72 | NEMILLTM | 20.61 | NEMILMKM | 3.58 | | |
| E | 475 | 1.79 | 19 | 5 | 0.15 | Y | EMVLLTMK | 44.17 | EMILLTMK | 30.46 | EMILLTMK | 20.65 | EMILMKMK | 3.5 | EMYLLQMK | 0.22 |

FIG. 18-10

Species: DENVall (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 484 | 1.74 | 9 | 4 | 0 | Y | KSWLVHKQ | 44.1 | KAWLVHRQ | 30.86 | KTWLVHKQ | 3.72 | | |
| E | 485 | 1.73 | 8 | 4 | 0 | Y | SWLVHKQW | 44.17 | AWLVHRQW | 30.86 | TWLVHKQW | 3.72 | | |
| E | 486 | 1.52 | 6 | 3 | 0 | Y | WLVHKQWF | 48.19 | WLVHRQWF | 30.9 | | | | |
| E | 487 | 1.53 | 7 | 3 | 0 | Y | LVHKQWFL | 48.19 | LVHRQWFL | 30.9 | | | | |
| E | 488 | 1.52 | 5 | 3 | 0 | Y | VHKQWFLD | 48.19 | VHRQWFFD | 30.94 | | | | |
| E | 489 | 1.51 | 4 | 3 | 0 | Y | HKQWFLDL | 48.27 | HRQWFFDL | 30.94 | | | | |
| E | 490 | 1.51 | 4 | 3 | 0 | Y | KQWFLDLP | 48.27 | RQWFFDLP | 30.94 | | | | |
| E | 491 | 0.75 | 4 | 2 | 0 | Y | QWFLDLPL | 79.17 | QWFFDLP | 20.72 | | | | |
| E | 492 | 0.75 | 5 | 2 | 0 | Y | WFLDLPLP | 79.13 | WFFDLPLP | 20.72 | | | | |
| E | 493 | 0.75 | 5 | 2 | 0 | Y | FLDLPLPW | 79.13 | FFDLPLPW | 20.72 | | | | |
| E | 494 | 1.61 | 7 | 4 | 0 | Y | LDLPLPWT | 48.16 | LDLPLPWL | 30.86 | FDLPLPWT | 18.88 | FDLPLPWA | 1.92 | |
| E | 495 | 1.28 | 9 | 5 | 0.04 | Y | DLPLPWTS | 63.38 | DLPLPWLP | 30.83 | DLPLPWTA | 2.58 | DLPLPWAS | 1.92 | DLPLPWTT | 1.07 |
| E | 496 | 1.28 | 9 | 5 | 0 | Y | LPLPWTSG | 63.38 | LPLPWLPG | 30.83 | LPLPWTAG | 2.58 | LPLPWASG | 1.92 | LPLPWTTG | 1.07 |
| E | 497 | 1.32 | 12 | 5 | 0 | Y | PLPWTSGA | 63.02 | PLPWLPGA | 30.83 | PLPWTAGA | 2.58 | PLPWASGA | 1.92 | PLPWTTGA | 1.07 |
| E | 514 | 2 | 15 | 5 | 0 | Y | QDLLVTFK | 39.34 | KETLVTFK | 30.2 | KELLVTFK | 20.76 | KDLLVTFK | 5.01 | KERMVTFK | 3.72 |
| E | 515 | 1.77 | 13 | 4 | 0 | Y | DLLVTFKT | 44.4 | ETLVTFKN | 30.24 | ELLVTFKN | 20.76 | ERMVTFKV | 3.72 | |
| E | 516 | 1.76 | 12 | 4 | 0 | Y | LLVTFKTA | 44.4 | TLVTFKNP | 30.27 | LLVTFKNA | 20.76 | RMVTFKVP | 3.72 | |
| E | 517 | 1.72 | 10 | 4 | 0 | Y | LVTFKTAH | 44.4 | LVTFKNPH | 30.9 | LVTFKNAH | 20.76 | MVTFKVPH | 3.72 | |
| E | 518 | 1.71 | 9 | 4 | 0 | Y | VTFKTAHA | 44.43 | VTFKNPHA | 30.9 | VTFKNAHA | 20.76 | VTFKVPHA | 3.72 | |
| E | 519 | 1.7 | 7 | 4 | 0 | Y | TFKTAHAK | 44.47 | TFKNPHAK | 30.9 | TFKNAHAK | 20.8 | TFKVPHAK | 3.72 | |
| E | 520 | 1.75 | 9 | 4 | 0 | Y | FKTAHAKK | 44.43 | FKNPHAKK | 30.38 | FKNAHAKK | 20.8 | FKVPHAKR | 3.72 | |
| E | 521 | 1.75 | 9 | 4 | 0 | Y | KTAHAKKQ | 44.43 | KNPHAKKQ | 30.38 | KNAHAKKQ | 20.8 | KVPHAKRQ | 3.72 | |
| E | 522 | 1.74 | 7 | 4 | 0 | Y | TAHAKKQE | 44.47 | NPHAKKQD | 30.38 | NAHAKKQE | 20.83 | VPHAKRQD | 3.72 | |
| E | 523 | 1.14 | 6 | 3 | 0 | Y | AHAKKQEV | 65.19 | PHAKKQDV | 30.38 | PHAKRQDV | 4.24 | | |
| E | 524 | 1.18 | 11 | 3 | 0 | Y | HAKKQEVV | 65.12 | HAKKQDVT | 30.35 | HAKRQDVT | 3.69 | | |

FIG. 18-11

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 525 | 1.18 | 12 | 3 | 0 | Y | AKKQEVVW | 65.12 | AKKQDVWW | 30.27 | AKRQDVTV | 3.69 | | |
| E | 526 | 1.18 | 12 | 3 | 0 | Y | KKQEVVWL | 65.15 | KKQDVWWL | 30.24 | KRQDVTVL | 3.69 | | |
| E | 527 | 1.18 | 12 | 3 | 0 | Y | KQEVVWLG | 65.15 | KQDVWVLG | 30.24 | RQDVTVLG | 3.69 | | |
| E | 528 | 1.14 | 10 | 3 | 0 | Y | QEVVWLGS | 65.15 | QDVWVLGS | 30.75 | QDVTVLGS | 3.69 | | |
| E | 529 | 1.14 | 10 | 3 | 0 | Y | EVVWLGSQ | 65.15 | DVWVLGSQ | 30.75 | DVTVLGSQ | 3.69 | | |
| E | 530 | 0.28 | 8 | 2 | 0 | Y | VVWLGSQE | 95.91 | VTVLGSQE | 3.69 | | | | |
| E | 531 | 0.26 | 7 | 2 | 0 | Y | VWLGSQEG | 96.02 | TVLGSQEG | 3.69 | | | | |
| E | 532 | 0.02 | 4 | 1 | 0 | Y | VLGSQEGA | 99.85 | | | | | | |
| E | 533 | 0.01 | 3 | 1 | 0 | Y | LGSQEGAM | 99.93 | | |

FIG. 18-12

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 555 | 1.8 | 17 | 5 | 0 | Y | TTIIFAGH | 44.21 | GNLLFTGH | 30.35 | GTSIFAGH | 20.54 | GNHMFAGH | 3.69 | GNILFMGH | 0.44 |
| E | 556 | 1.78 | 14 | 5 | 0 | Y | TTIFAGHL | 44.36 | NLLFTGHL | 30.35 | TSIFAGHL | 20.54 | NHMFAGHL | 3.72 | NILFMGHL | 0.44 |
| E | 557 | 1.78 | 14 | 5 | 0 | Y | TIFAGHLK | 44.36 | LLFTGHLK | 30.35 | SIFAGHLK | 20.54 | HMFAGHLK | 3.72 | ILFMGHLK | 0.44 |
| E | 558 | 1.17 | 9 | 3 | 0 | Y | IFAGHLKC | 65.12 | LFTGHLKC | 30.35 | MFAGHLKC | 3.72 | | | | |
| E | 559 | 1.17 | 8 | 3 | 0 | Y | FAGHLKCR | 65.15 | FTGHLKCR | 30.35 | FAGHLKCK | 3.72 | | | | |
| E | 560 | 1.17 | 8 | 3 | 0 | Y | AGHLKCRL | 65.15 | TGHLKCRL | 30.38 | AGHLKCKV | 3.69 | | | | |
| E | 561 | 1.11 | 5 | 3 | 0 | Y | GHLKCRLK | 65.41 | GHLKCRLR | 30.83 | GHLKCKVR | 3.69 | | | | |
| E | 562 | 1.11 | 6 | 3 | 0 | Y | HLKCRLKM | 65.41 | HLKCRLRM | 30.79 | HLKCKVRM | 3.69 | | | | |
| E | 563 | 1.13 | 9 | 3 | 0 | Y | LKCRLKMD | 65.27 | LKCRLRMD | 30.75 | LKCKVRME | 3.65 | | | | |
| E | 564 | 1.14 | 11 | 3 | 0 | Y | KCRLKMDK | 65.23 | KCRLRMDK | 30.75 | KCKVRMEK | 3.65 | | | | |
| E | 565 | 1.14 | 10 | 3 | 0 | Y | CRLKMDKL | 65.27 | CRLRMDKL | 30.75 | CKVRMEKL | 3.65 | | | | |
| E | 566 | 1.76 | 16 | 4 | 0 | Y | RLKMDKLT | 44.21 | RLRMDKLQ | 30.75 | RLKMDKLE | 20.69 | KVRMEKLR | 3.65 | | |
| E | 567 | 1.76 | 16 | 4 | 0 | Y | LKMDKLTL | 44.21 | LRMDKLQL | 30.75 | LKMDKLEL | 20.69 | VRMEKLRI | 3.65 | | |
| E | 568 | 1.81 | 16 | 5 | 0 | Y | KMDKLTLK | 43.51 | RMDKLQLK | 30.75 | KMDKLELK | 20.69 | RMEKLRIK | 3.69 | KMDKLTLR | 0.7 |
| E | 569 | 1.8 | 15 | 5 | 0 | Y | MDKLTLKG | 43.51 | MDKLQLKG | 30.83 | MDKLELKG | 20.69 | MEKLRIKG | 3.69 | MDKLTLRG | 0.7 |
| E | 589 | 1.89 | 12 | 5 | 0 | Y | EKEVAETQ | 41.41 | VKEIAETQ | 30.83 | KKEVSETQ | 20.65 | DKEMAETQ | 3.65 | EKELAETQ | 3.06 |
| E | 590 | 1.87 | 9 | 5 | 0 | Y | KEVAETQH | 41.45 | KEIAETQH | 30.86 | KEVSETQH | 20.8 | KEMAETQH | 3.72 | KELAETQH | 3.06 |
| E | 591 | 1.86 | 6 | 5 | 0 | Y | EVAETQHG | 41.45 | EIAETQHG | 30.9 | EVSETQHG | 20.83 | EMAETQHG | 3.72 | ELAETQHG | 3.06 |
| E | 592 | 1.85 | 5 | 5 | 0 | Y | VAETQHGT | 41.48 | IAETQHGT | 30.9 | VSETQHGT | 20.83 | MAETQHGT | 3.72 | LAETQHGT | 3.06 |
| E | 593 | 1.71 | 7 | 4 | 0 | Y | AETQHGTV | 44.43 | AETQHGTI | 30.94 | SETQHGTI | 20.8 | AETQHGTT | 3.69 | | |
| E | 594 | 1.71 | 7 | 4 | 0 | Y | ETQHGTVL | 44.43 | ETQHGTIL | 30.79 | ETQHGTIL | 20.94 | ETQHGTTV | 3.69 | | |
| E | 595 | 1.76 | 12 | 4 | 0 | Y | TQHGTVLY | 44.36 | TQHGTIVI | 30.49 | TQHGTILI | 20.69 | TQHGTTVW | 3.65 | | |
| E | 596 | 1.77 | 14 | 4 | 0 | Y | QHGTVLVQ | 44.36 | QHGTIVIR | 30.46 | QHGTILIK | 20.69 | QHGTTVVK | 3.65 | | |
| E | 644 | 0.8 | 12 | 4 | 0 | Y | PVNIEAEP | 85.69 | PVNIETEP | 9.11 | VTNIELEP | 3.58 | PINIEAEP | 1.11 | | |
| E | 645 | 0.79 | 10 | 4 | 0 | Y | VNIEAEPP | 85.77 | VNIETEPP | 9.11 | TNIELEPP | 3.72 | INIEAEPP | 1.11 | | |

FIG. 18-13

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 646 | 0.7 | 9 | 3 | 0 | Y | NIEAEPPF | 86.84 | NIETEPPF | 9.14 | NIELEPPF | 3.72 | | | | |
| E | 647 | 0.69 | 7 | 3 | 0 | Y | IEAEPPFG | 86.91 | IETEPPFG | 9.14 | IELEPPFG | 3.72 | | | | |
| E | 648 | 1.5 | 7 | 4 | 0 | Y | EAEPPFGE | 56.16 | EAEPPFGD | 30.86 | ETEPPFGE | 9.14 | ELEPPFGD | 3.72 | | |
| E | 649 | 1.5 | 7 | 4 | 0 | Y | AEPPFGES | 56.16 | AEPPFGDS | 30.86 | TEPPFGES | 9.14 | LEPPFGDS | 3.72 | | |
| E | 650 | 1.54 | 7 | 3 | 0 | Y | EPPFGESY | 44.43 | EPPFGDSY | 34.59 | EPPFGESN | 20.8 | | | | |
| E | 651 | 1.56 | 10 | 3 | 0 | Y | PPFGESYI | 44.36 | PPFGDSYI | 34.51 | PPFGESNI | 20.76 | | | | |
| E | 671 | 1.1 | 11 | 4 | 0 | Y | WFKKGSSI | 73.86 | WYKKGSSI | 20.65 | WFRKGSSI | 3.95 | WFKRGSSI | 0.77 | | |
| E | 672 | 1.1 | 11 | 4 | 0 | Y | FKKGSSIG | 73.86 | YKKGSSIG | 20.65 | FRKGSSIG | 3.95 | FKRGSSIG | 0.77 | | |
| E | 673 | 1.25 | 10 | 3 | 0 | Y | KKGSSIGK | 63.79 | KKGSSIGQ | 30.68 | RKGSSIGK | 3.95 | KRGSSIGK | 0.81 | | |
| E | 674 | 1.01 | 6 | 3 | 0 | Y | KGSSIGKM | 67.74 | KGSSIGQM | 30.83 | RGSSIGKM | 0.85 | | | | |
| E | 675 | 0.99 | 8 | 3 | 0 | Y | GSSIGKMF | 68.4 | GSSIGQMF | 30.49 | GSSIGQMI | 0.33 | | | | |
| E | 676 | 1.03 | 13 | 4 | 0 | Y | SSIGKMFE | 68.25 | SSIGQMFE | 30.31 | STIGKMFE | 0.33 | SSIGQMIE | 0.33 | | |
| E | 677 | 1.25 | 18 | 5 | 0 | Y | SIGKMFEA | 64.53 | SIGQMFET | 30.27 | SIGKMFES | 3.65 | SIGQMIET | 0.33 | TIGKMFEA | 0.33 |
| E | 678 | 1.22 | 18 | 4 | 0 | Y | IGKMFEAT | 64.9 | IGQMFETT | 30.27 | IGKMFEST | 3.65 | IGQMIETT | 0.33 | | |
| E | 679 | 1.23 | 20 | 4 | 0 | Y | GKMFEATA | 64.82 | GQMFETTM | 30.24 | GKMFESTY | 3.65 | GQMIETTM | 0.33 | | |
| E | 680 | 1.23 | 21 | 4 | 0 | Y | KMFEATAR | 64.79 | QMFETTMR | 30.24 | KMFESTYR | 3.65 | QMIETTMR | 0.33 | | |
| E | 681 | 1.22 | 19 | 4 | 0 | Y | MFEATARG | 64.86 | MFETTMRG | 30.31 | MFESTYRG | 3.65 | MIETTMRG | 0.33 | | |
| E | 682 | 1.22 | 20 | 4 | 0 | Y | FEATARGA | 64.82 | FETTMRGA | 30.31 | FESTYRGA | 3.65 | IETTMRGA | 0.33 | | |
| E | 683 | 1.18 | 16 | 3 | 0 | Y | EATARGAR | 64.93 | ETTMRGAK | 30.64 | ESTYRGAK | 3.72 | | | | |
| E | 684 | 1.15 | 12 | 3 | 0 | Y | ATARGARR | 65.08 | TTMRGAKR | 30.79 | STYRGAKR | 3.72 | | | | |
| E | 685 | 1.14 | 11 | 3 | 0 | Y | TARGARRM | 65.12 | TMRGAKRM | 30.83 | TYRGAKRM | 3.72 | | | | |
| E | 686 | 1.13 | 9 | 3 | 0 | Y | ARGARRMA | 65.19 | MRGAKRMA | 30.83 | YRGAKRMA | 3.72 | | | | |
| E | 687 | 0.95 | 6 | 2 | 0 | Y | RGARRMAI | 65.27 | RGAKRMAI | 34.55 | | | | | | |
| E | 688 | 0.95 | 5 | 2 | 0 | Y | GARRMAIL | 65.3 | GAKRMAIL | 34.55 | | | | | | |
| E | 689 | 0.95 | 5 | 2 | 0 | Y | ARRMAILG | 65.3 | AKRMAILG | 34.55 | | | | | | |

FIG. 18-14

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 690 | 1.12 | 7 | 3 | 0 | Y | RRMAILGD | 65.3 | KRMAILGD | 30.79 | KRMAILGE | 3.72 | | |
| E | 691 | 0.26 | 7 | 2 | 0 | Y | RMAILGDT | 96.02 | RMAILGET | 3.72 | |

FIG. 18-15

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 746 | 1.82 | 17 | 5 | 0 | Y | LGLNSRST | 43.47 | IGMNSRST | 30.72 | IGLNSKNT | 20.69 | IGTNSRNT | 3.72 | LGLNSRSA | 0.44 |

FIG. 18-16

Species: DENVall (8-mers)

| protein | block starting position | block entropy | total peptides in block | #

FIG. 18-17

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 834 | 1.83 | 11 | 5 | 0 | Y | SAT

FIG. 18-18

Species: DENVall (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 |

FIG. 18-19

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 978 | 1.81 | 15 | 5 | 0 | Y | ESEKNETW | 43.95 | ESALNDTW | 30.05 | ESQKNGSW | 20.8 | ESSKNQTW | 3.8 | ESRLNDTW | 0.59 |
| NS1 | 979 | 1.82 | 16 | 5 | 0 | Y | SEKNETWK | 43.92 | SALNDTWK | 30.05 | SQKNGSWK | 20.8 | SSKNQTWQ | 3.8 | SRLNDTWK | 0.59 |
| NS1 | 981 | 2.09 | 17 | 5 | 0 | Y | KNETWKLA | 43.73 | KNGSWKLE | 20.8 | LNDTWKME | 17.44 | LNDTWKIE | 13.31 | KNQTWQIE | 3.8 |
| NS1 | 989 | 1.71 | 8 | 5 | 0 | Y | RASFIEVK | 44.06 | KASFIEVK | 34.96 | KASLIEVK | 17.33 | KASFIEIK | 1.81 | RASLIEVK | 1.62 |
| NS1 | 990 | 1.85 | 7 | 5 | 0 | Y | ASFIEVKT | 50.18 | ASLIEVKT | 18.95 | ASLIEVK | 18.95 | ASFIEVKN | 10.03 | ASFIEIKS | 1.81 |
| NS1 | 991 | 1.85 | 7 | 5 | 0 | Y | SFIEVKTC | 50.18 | SLIEVKTC | 18.95 | SFIEVKSC | 18.95 | SFIEVKNC | 10.03 | SFIEIKSC | 1.81 |
| NS1 | 1000 | 0.32 | 6 | 3 | 0 | Y | WPKSHTLW | 95.1 | WPKTHTLW | 3.8 | WPRSHTLW | 0.92 | | | | |
| NS1 | 1001 | 0.33 | 7 | 3 | 0 | Y | PKSHTLWS | 95.1 | PKTHTLWS | 3.8 | PRSHTLWS | 0.92 | | | | |
| NS1 | 1002 | 0.33 | 7 | 3 | 0 | Y | KSHTLWSN | 95.1 | KTHTLWSN | 3.8 | RSHTLWSN | 0.92 | | | | |
| NS1 | 1003 | 0.28 | 8 | 2 | 0 | Y | SHTLWSNG | 95.83 | THTLWSNG | 3.8 | | | | | | |
| NS1 | 1004 | 0.04 | 7 | 1 | 0 | Y | HTLWSNGV | 99.63 | | | | | | | | |
| NS1 | 1005 | 0.04 | 7 | 1 | 0 | Y | TLWSNGVL | 99.63 | | | | | | | | |
| NS1 | 1006 | 0.04 | 7 | 1 | 0 | Y | LWSNGVLE | 99.63 | | | | | | | | |
| NS1 | 1007 | 0.05 | 8 | 1 | 0 | Y | WSNGVLES | 99.59 | | | | | | | | |
| NS1 | 1008 | — | 10 | 3 | 0 | Y | SNGVLESE | 75.11 | SNGVLESD | 20.69 | SNGVLESQ | 3.8 | | | | |
| NS1 | 1009 | — | 9 | 3 | 0 | Y | NGVLESEM | 75.11 | NGVLESDM | 20.76 | NGVLESQM | 3.8 | | | | |
| NS1 | 1010 | 1.11 | 10 | 4 | 0 | Y | GVLESEMI | 73.49 | GVLESDMI | 20.72 | GVLESQML | 3.8 | GVLESEMV | 1.66 | | |
| NS1 | 1011 | 1.11 | 10 | 4 | 0 | Y | VLESEMII | 73.53 | VLESDMII | 20.72 | VLESQMLI | 3.8 | VLESEMVI | 1.66 | | |
| NS1 | 1012 | 1.11 | 10 | 4 | 0 | Y | LESEMIIP | 73.53 | LESDMIIP | 20.72 | LESQMLIP | 3.8 | LESEMVIP | 1.66 | | |
| NS1 | 1013 | 1.12 | 11 | 4 | 0 | Y | ESEMIIPK | 73.6 | ESDMIIPK | 20.69 | ESQMLIPK | 3.8 | ESEMVIPK | 1.66 | | |
| NS1 | 1023 | 1.78 | 8 | 5 | 0 | Y | GGPISQHN | 43.69 | AGPVSQHN | 30.79 | AGPISQHN | 20.87 | AGPFSQHN | 3.58 | GGPTSQHN | 0.48 |
| NS1 | 1027 | 0.78 | 8 | 4 | 0 | Y | SQHNYRPG | 85.62 | SQHNNRPG | 9.62 | SQHNYRQG | 3.69 | SQHNNRPG | 0.74 | | |
| NS1 | 1028 | 0.78 | 9 | 4 | 0 | Y | QHNYRPGY | 85.62 | QHNNRPGY | 9.62 | QHNYRQGY | 3.69 | QHNNRPGY | 0.74 | | |
| NS1 | 1037 | 0.9 | 9 | 4 | 0 | Y | TQTAGPWH | 84.07 | TQIAGPWH | 9.4 | TQTVGPWH | 3.36 | TQAAGPWH | 2.21 | | |
| NS1 | 1038 | 0.9 | 9 | 4 | 0 | Y | QTAGPWHL | 84.07 | QIAGPWHL | 9.4 | QTVGPWHL | 3.36 | QAAGPWHL | 2.21 | | |

FIG. 18-20

Species: DENVall (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | fr

FIG. 18-21

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1083 | 1.13 | 9 | 3 | 0 | Y | IHEWCCRS | 65.23 | ITEWCCRS | 30.72 | VTQWCCRS | 3.8 | | |
| NS1 | 1084 | 1.12 | 7 | 3 | 0 | Y | HEWCCRSC | 65.27 | TEWCCRSC | 30.75 | TQWCCRSC | 3.8 | | |
| NS1 | 1085 | 0.25 | 4 | 2 | 0 | Y | EWCCRSCT | 96.09 | QWCCRSCT | 3.8 | | | | |
| NS1 | 1086 | 0.25 | 4 | 2 | 0 | Y | WCCRSCTL | 96.09 | WCCRSCTM | 3.8 | | | | |
| NS1 | 1087 | 0.24 | 3 | 2 | 0 | Y | CCRSCTLP | 96.13 | CCRSCTMP | 3.8 | | | | |
| NS1 | 1088 | 0.24 | 3 | 2 | 0 | Y | CRSCTLPP | 96.13 | CRSCTMPP | 3.8 | | | | |
| NS1 | 1089 | 0.24 | 3 | 2 | 0 | Y | RSCTLPPL | 96.13 | RSCTMPPL | 3.8 | | | | |
| NS1 | 1090 | 0.24 | 3 | 2 | 0 | Y | SCTLPPLR | 96.13 | SCTMPPLR | 3.8 | | | | |
| NS1 | 1091 | 1.19 | 3 | 3 | 0 | Y | CTLPPLRY | 51.66 | CTLPPLRF | 44.54 | CTMPPLRF | 3.8 | | |
| NS1 | 1092 | 2.13 | 6 | 5 | 0 | Y | TLPPLRYR | 30.83 | TLPPLRFR | 27.1 | TLPPLRYM | 20.76 | TLPPLRFK | 17.44 |
| NS1 | 1093 | 2.14 | 7 | 5 | 0 | Y | LPPLRYRG | 30.83 | LPPLRFRG | 27.06 | LPPLRYMG | 20.76 | LPPLRFKG | 17.44 |
| NS1 | 1094 | 2.15 | 9 | 5 | 0 | Y | PPLRYRGE | 30.72 | PPLRFRGE | 27.06 | PPLRYMGE | 20.72 | PPLRFKGE | 17.44 |
| NS1 | 1095 | 2.16 | 11 | 5 | 0 | Y | PLRYRGED | 30.68 | PLRFRGED | 27.03 | PLRYMGED | 20.72 | PLRFKGED | 17.44 |
| NS1 | 1096 | 2.16 | 11 | 5 | 0 | Y | LRYRGEDG | 30.68 | LRFRGEDG | 27.03 | LRYMGEDG | 20.72 | LRFKGEDG | 17.44 |
| NS1 | 1097 | 2.16 | 11 | 5 | 0 | Y | RYRGEDGC | 30.68 | RFRGEDGC | 27.03 | RYMGEDGC | 20.72 | RFKGEDGC | 17.44 |
| NS1 | 1098 | 2.16 | 11 | 5 | 0 | Y | YRGEDGCW | 30.68 | FRGEDGCW | 27.03 | YMGEDGCW | 20.72 | FKGEDGCW | 17.44 |
| NS1 | 1099 | 1.58 | 10 | 4 | 0 | Y | RGEDGCWY | 57.71 | MGEDGCWY | 20.72 | KGEDGCWY | 17.44 | LGEDGCWY | 3.8 |
| NS1 | 1100 | 0.03 | 5 | 1 | 0 | Y | GEDGCWYG | 99.74 | | | | | | |
| NS1 | 1101 | 0.03 | 4 | 1 | 0 | Y | EDGCWYGM | 99.78 | | | | | | |
| NS1 | 1102 | 0.01 | 3 | 1 | 0 | Y | DGCWYGME | 99.93 | | | | | | |
| NS1 | 1103 | 0 | 1 | 1 | 0 | Y | GCWYGMEI | 100 | | | | | | |
| NS1 | 1104 | 0 | 2 | 1 | 0 | Y | CWYGMEIR | 99.96 | | | | | | |
| NS1 | 1105 | 0 | 2 | 1 | 0 | Y | WYGMEIRP | 99.96 | | | | | | |
| NS1 | 1106 | 1.54 | 7 | 3 | 0 | Y | YGMEIRPV | 44.84 | YGMEIR

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1349 | 1.72 | 8 | 4 | 0 | Y | PLNEGIMA | 47.82 | PLNEAIMA | 26.77 | PLNEGYMA | 20.83 | PLNEAVMA | 4.02 |
| NS2B | 1350 | 2.05 | 11 | 5 | 0 | Y | LNEGIMAV | 39.68 | LNEAIMAV | 26.77 | LNEGVMAV | 20.69 | LNEGIMAI | 8.15 | LNEAVMAV | 4.02 |
| NS2B | 1351 | 2.01 | 7 | 5 | 0 | Y | NEGIMAVG | 40.08 | NEAIMAVG | 26.81 | NEGVMAVG | 20.72 | NEGIMAIG | 8.19 | NEAVMAVG | 4.02 |
| NS2B | 1358 | 1.92 | 6 | 5 | 0 | Y | GIVSILLS | 39.49 | GMVSILAS | 30.83 | GLVSILAS | 20.83 | GVVSILLS | 5.01 | GLVSILG

FIG. 18-24

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1380 | 1.71 | 8 | 4 | 0 | Y | AGGMLIAC | 44.51 | AGGLLTVC | 30.79 | AGGLLAA | 3.8 | | |
| NS2B | 1381 | 1.71 | 7 | 4 | 0 | Y | GGMLIACY | 44.54 | GGLLTVCY | 30.76 | GGLLAAY | 3.8 | | |
| NS2B | 1382 | 1.71 | 7 | 4 | 0 | Y | GMLIACYV | 44.54 | GLLTVCYV | 30.76 | GLLAAYV | 3.8 | | |
| NS2B | 1383 | 1.71 | 7 | 4 | 0 | Y | MLIACYVI | 44.54 | LLTVCYVL | 30.76 | LLLAAYVM | 3.8 | | |
| NS2B | 1384 | 1.71 | 7 | 4 | 0 | Y | LIACYVIS | 44.47 | LTVCYVLT | 30.76 | LLAAYVMS | 3.8 | |

FIG. 18-25

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1429 | 1.77 | 15 | 4 | 0.04 | Y | TMKIKDDE | 44.21 | SMSIKNEE | 30.68 | TMRIKDDE | 20.61 | SFSIRDVE | 3.61 | | |
| NS2B | 1430 | 1.78 | 14 | 4 | 0.04 | Y | MKIKDEER | 44.14 | MSIKNEEE | 30.68 | MRIKDDET | 20.61 | FSIRDVEE | 3.61 | | |
| NS2B | 1431 | 1.78 | 14 | 4 | 0.04 | Y | KIKDEERD | 44.14 | SIKNEEEE | 30.68 | RIKDDETE | 20.61 | SIRDVEET | 3.61 | | |
| NS2B | 1432 | 1.89 | 15 | 5 | 0.04 | Y | IKDEERDD | 44.1 | IKNEEEEQ | 28.32 | IKDDETEN | 20.76 | IRDVEETN | 3.61 | IKNEEEEH | 2.29 |
| NS2B | 1440 | 1.83 | 13 | 5 | 0 | Y | TLTILIRT | 43.55 | TLTILIRT | 30.24 | ILTYLLKT | 20.8 | MTLLVK

FIG. 18-26

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1497 | 2.1 | 11 | 5 | 0 | Y | DGIYRIMQ | 33.7 | DGAYRIKQ | 30.68 | EGIYRIIKQ | 20.65 | DGIYRILQ

FIG. 18-27

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1544 | 1.8 | 12 | 5 | 0 | Y | PSWASYKK | 44.36 | PSWADVKK | 30.27 | PNWASYKK | 20.24 | PSWADVRN | 3.8 | PNWANVKK | 0.44 |
| NS3 | 1545 | 1.8 | 12 | 5 | 0 | Y | SWASVKKD | 44.36 | SWADVKKD | 30.27 | NWASVKKD | 20.24 | SWADVRND | 3.8 | NWANVKKD | 0.44 |
| NS3 | 1546 | 1.21 | 9 | 4 | 0 | Y | WASVKKDL | 64.6 | WADVKKDL | 30.46 | WADVRNDM | 3.8 | WANVKKDL | 0.44 | | |
| NS3 | 1547 | 1.24 | 11 | 5 | 0 | Y | ASVKKDLI | 64.56 | ADVKKDLI | 30.09 | ADVRNDMI | 3.8 | ANVKKDLI | 0.44 | ADVKKDLV | 0.37 |
| NS3 | 1548 | 1.24 | 11 | 5 | 0 | Y | SVKKDLIS | 64.56 | DVKKDLIS | 30.09 | DVRNDMIS | 3.8 | NVKKDLIS | 0.44 | DVRKDLIS | 0.37 |
| NS3 | 1549 | 0.33 | 6 | 2 | 0 | Y | VKKDLISY | 95.24 | VRNDMISY | 3.8 | | | | | | |
| NS3 | 1550 | 0.32 | 6 | 2 | 0 | Y | KKDLISYG | 95.28 | RNDMISYG | 3.8 | | | | | | |
| NS3 | 1551 | 0.28 | 5 | 2 | 0 | Y | KDLISYGG | 95.69 | NDMISYGG | 3.8 | | | |

FIG. 18-28

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1579 | 1.72 | 8 | 4 | 0 | Y | PGKNPKNV | 44.4 | PGKNPRAV | 30.79 | PGKNPKNF | 20.8 | PGKNPKHV | 3.8 | | |
| NS3 | 1580 | 1.72 | 8 | 4 | 0 | Y | GKNPKNVQ | 44.4 | GKNPRAVQ | 30.79 | GKNPKNFQ | 20.8 | GKNPKHVQ | 3.8 | | |
| NS3 | 1581 | 1.71 | 7 | 4 | 0 | Y | KNPKNVQT | 44.51 | KNPRAVQT | 30.79 | KNPKNFQT | 20.8 | KNPKHVQT | 3.8 | | |
| NS3 | 1597 | 1.85 | 15 | 5 | 0 | Y | EGEVGAIA | 44.47 | TGTIGAVS | 29.02 | TGEIGAIA | 20.54 | TGEIGAVT | 3.76 | AGTIGAVS | 1.59 |
| NS3 | 1598 | 1.73 | 10 | 4 | 0 | Y | GEVGAIAL | 44.47 | GTIGAVSL | 30.64 | GEIGAIAL | 20.72 | GEIGAVTL | 3.8 | | |
| NS3 | 1599 | 1.73 | 10 | 4 | 0 | Y | EVGAIALD | 44.47 | TIGAVSLD | 30.64 | EIGAIALD | 20.72 | EIGAVTLD | 3.8 | | |
| NS3 | 1600 | 1.72 | 8 | 4 | 0 | Y | VGAIALDF | 44.47 | IGAVSLDF | 30.79 | IGAIALDF | 20.72 | IGAVTLDF | 3.8 | | |
| NS3 | 1601 | 1.13 | 6 | 3 | 0 | Y | GAIALDFK | 65.19 | GAVSLDFK | 30.79 | GAVTLDFK | 3.8 | | | | |
| NS3 | 1602 | 1.13 | 6 | 3 | 0 | Y | AIALDFKP | 65.19 | AVSLDFSP | 30.79 | AVTLDFKP | 3.8 | | | | |
| NS3 | 1603 | 1.13 | 6 | 3 | 0 | Y | IALDFKPG | 65.19 | VSLDFSPG | 30.79 | VTLDFKPG | 3.8 | | | | |
| NS3 | 1604 | 1.11 | 4 | 3 | 0 | Y | ALDFKPGT | 65.38 | SLDFSPGT | 30.83 | TLDFKPGT | 3.76 | | | | |
| NS3 | 1605 | 0.9 | 3 | 2 | 0 | Y | LDFKPGTS | 69.14 | LDFSPGTS | 30.83 | | | | | | |
| NS3 | 1606 | 0.9 | 3 | 2 | 0 | Y | DFKPGTSG | 69.14 | DFSPGTSG | 30.83 | | | | | | |
| NS3 | 1607 | 0.9 | 3 | 2 | 0 | Y | FKPGTSGS | 69.14 | FSPGTSGS | 30.83 | | | | | | |
| NS3 | 1608 | 0.9 | 3 | 2 | 0 | Y | KPGTSGSP | 69.14 | SPGTSGSP | 30.83 | | | | | |

FIG. 18-29

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1626 | 0.01 | 2 | 1 | 0 | Y | LYGNGWT | 99.89 | | | | | | |
| NS3 | 1627 | 1.55 | 4 | 3 | 0 | Y | YGNGWTT | 44.54 | YGNGVVTR | 30.83 | YGNGVVTK | 24.52 | | |
| NS3 | 1628 | 1.74 | 9 | 4 | 0 | Y | GNGWTTS | 44.51 | GNGVVTRS | 30.53 | GNGVVTKN | 20.58 | GNGVVTKS | 3.95 |
| NS3 | 1629 | 1.74 | 9 | 4 | 0 | Y | NGWTTSG | 44.51 | NGVVTRSG | 30.53 | NGVVTKNG | 20.58 | NGVVTKSG | 3.95 |
| NS3 | 1630 | 1.88 | 13 | 5 | 0 | Y | GVVTTSGT | 44.47 | GVVTRSGA | 28.1 | GVVTKNGG | 20.58 | GVVTKSGD | 3.8 | GVVTRSGT | 2.4 |
| NS3 | 1631 | 1.88 | 13 | 5 | 0 | Y | VVTTSGTY | 44.47 | VVTRSGAY | 28.1 | VVTKNGGY | 20.58 | VVTKSGDY | 3.8 | VVTRSGTY | 2.4 |
| NS3 | 1632 | 1.88 | 13 | 5 | 0 | Y | VTTSGTYV | 44.47 | VTRSGAYV | 28.1 | VTKNGGYV | 20.58 | VTKSGDYV | 3.8 | VTRSGTYV | 2.4 |
| NS3 | 1633 | 1.87 | 12 | 5 | 0 | Y | TTSGTYVS | 44.47 | TRSGAYVS | 28.1 | TKNGGYVS | 20.58 | TKSGDYVS | 3.8 | TRSGTYVS | 2.4 |
| NS3 | 1635 | 1.78 | 13 | 5 | 0 | Y | SGTYVSAI | 46.28 | SGAYVSAI | 28.1 | NGGYVSGI | 20.69 | SGDYVSAI | 3.8 | SGTYVSSI | 0.55 |
| NS3 | 1636 | 1.73 | 8 | 4 | 0 | Y | GTYVSAIA | 46.31 | GAYVSAIA | 28.39 | GGYVSGIA | 20.69 | GDYVSAIT | 3.8 | |
| NS3 | 1637 | 1.73 | 8 | 4 | 0 | Y | TYVSAIAQ | 46.31 | AYVSAIAQ | 28.39 | GYVSGIAQ | 20.83 | DYVSAITQ | 3.8 | |
| NS3 | 1638 | 1.75 | 7 | 4 | 0 | Y | YVSAIAQA | 44.17 | YVSAIAQT | 30.53 | YVSGIAQT | 20.83 | YVSAITQA | 3.8 | |
| NS3 | 1660 | 2.22 | 12 | 5 | 0 | Y | VFKKRNLT | 35.62 | IFRKKRLT | 23.34 | MFKKRNLT | 20.58 | IFRKKRLT | 10.66 | VFKKRNLT | 8.89 |
| NS3 | 1661 | 1.95 | 10 | 4 | 0 | Y | FKKRNLTI | 35.77 | FKKRNLTI | 29.46 | FKKRNLTI | 23.34 | FRKRRLTI | 10.66 | |
| NS3 | 1662 | 1.95 | 10 | 4 | 0 | Y | RKRNLTIM | 35.77 | KKRNLTIM | 29.46 | KKRRLTIM | 23.34 | RKRRLTIM | 10.66 | |
| NS3 | 1663 | 1.3 | 8 | 3 | 0 | Y | KRNLTIMD | 65.23 | KKRLTIMD | 23.34 | KRRLTIMD | 10.66 | | | |
| NS3 | 1664 | 1.3 | 8 | 3 | 0 | Y | RNLTIMDL | 65.23 | KRLTIMDL | 23.34 | RRLTIMDL | 10.66 | | | |
| NS3 | 1665 | 0.99 | 6 | 2 | 0 | Y | NLTIMDLH | 65.27 | RLTIMDLH | 34 | | | | | |
| NS3 | 1666 | 0.01 | 4 | 1 | 0 | Y | LTIMDLHP | 99.89 | | | | | | | |
| NS3 | 1667 | 0.01 | 3 | 1 | 0 | Y | TIMDLHPG | 99.93 | | | | | | | |
| NS3 | 1668 | 0.94 | 4 | 2 | 0 | Y | IMDLHPGS | 65.34 | IMDLHPGA | 34.59 | | | | | |
| NS3 | 1669 | 0.93 | 2 | 2 | 0 | Y | MDLHPGSG | 65.38 | MDLHPGAG | 34.62 | | | | | |
| NS3 | 1670 | 0.93 | 2 | 2 | 0 | Y | DLHPGSGK | 65.38 | DLHPGAGK | 34.62 | | | | | |
| NS3 | 1671 | 0.93 | 3 | 2 | 0 | Y | LHPGSGKT | 65.38 | LHPGAGKT | 34.59 | | | | | |
| NS3 | 1672 | 0.94 | 4 | 2 | 0 | Y | HPGSGKTR | 65.34 | HPGAGKTK | 34.59 | | | | | |

FIG. 18-30

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1673 | 1.56 | 6 | 3 | 0 | Y | PGSGKTRR | 44.47 | PGAGKTKR | 34.14 | PGSGKTRK | 20.87 | | |
| NS3 | 1674 | 1.74 | 7 | 4 | 0 | Y | GSGKTRRY | 44.47 | GAGKTKRY | 30.35 | GSGKTRKY | 20.87 | | |
| NS3 | 1675 | 1.74 | 7 | 4 | 0 | Y | SGKTRRYL | 44.47 | AGKTKRYL | 30.35 | SGKTRKYL | 20.87 | | |
| NS3 | 1676 | 1.73 | 6 | 4 | 0 | Y | GKTRRYLP | 44.47 | GKTKRYLP | 30.38 | GKTRKYLP | 20.87 | | |
| NS3 | 1677 | 1.74 | 7 | 4 | 0 | Y | KTRRYLPA | 44.47 | KTRKYLPA | 30.38 | KTRKYLPA | 20.8 | | |
| NS3 | 1678 | 1.81 | 10 | 5 | 0 | Y | TRRYLPAI | 43.69 | TKRYLPAI | 30.38 | TRKYLPAI | 20.69 | TRRYLPAM | 0.74 |
| NS3 | 1680 | 1.13 | 11 | 5 | 0 | Y | RYLPAIVR | 73.97 | KYLPAIVR | 19.91 | RILPSIVR | 3.8 | RYLPAMVR | 0.74 |
| NS3 | 1681 | 0.43 | 10 | 4 | 0 | Y | YLPAIVRE | 93.84 | ILPSIVRE | 3.8 | YLPAIIRE | 1.29 | TKRILPSI | 3.8 |
| NS3 | 1682 | 0.43 | 10 | 4 | 0 | Y | LPAIVREA | 93.84 | LPSIVREA | 3.8 | LPAIIREA | 1.29 | KYLPAIIR | 1.22 |
| NS3 | 1683 | 0.45 | 12 | 5 | 0 | Y | PAIVREAI | 93.66 | PSIVREAL | 3.8 | PAIIREAI | 1.29 | YLPAMVRE | 0.74 |
| NS3 | 1684 | 0.54 | 14 | 5 | 0 | Y | AIVREAIK | 92.7 | SIVREALK | 3.8 | AIIREAIK | 1.29 | LPAMVREA | 0.74 |
| NS3 | 1685 | 0.54 | 14 | 5 | 0 | Y | IVREAIKR | 92.7 | IVREALKR | 3.8 | IIREAIKR | 1.29 | PAMVREAI | 0.74 |
| NS3 | 1687 | 1.84 | 17 | 5 | 0 | Y | REAIKRRL | 42.59 | REAIKRGL | 29.98 | REAIKRRL | 22.2 | AMVREAIK | 0.74 | AIVREAIR | 0.74 |
| NS3 | 1688 | 1.83 | 16 | 5 | 0 | Y | EAIKRRLR | 42.63 | EAIKRGLR | 29.98 | EAIKRRLR | 22.2 | IVREAIRR | 0.74 | MVREAIKR | 0.74 |
| NS3 | 1689 | 1.83 | 16 | 5 | 0 | Y | AIKRRLRT | 42.63 | AIKRGLRT | 29.98 | AIIKRRLRT | 22.2 | REALKRRL | 3.8 | REAIRRGL | 0.59 |
| NS3 | 1690 | 1.83 | 15 | 5 | 0 | Y | IKRRLRTL | 42.66 | IKRGLRT | 29.98 | IKRRLRT | 22.2 | EALKRRLR | 3.8 | EAIRRGLR | 0.59 |
| NS3 | 1691 | 1.75 | 13 | 4 | 0 | Y | KRRLRTLI | 41.74 | KRGLRTLI | 30.79 | KRRLRTLI | 25.74 | ALKRRLRT | 3.8 | AIRRGLRT | 0.59 |
| NS3 | 1692 | 1.68 | 10 | 4 | 0 | Y | RRLRTLIL | 41.78 | RGLRTLIL | 30.79 | RRLRTLIL | 25.74 | LKRRLRTL | 3.8 | IRRGLRTL | 0.59 |
| NS3 | 1693 | 1.68 | 9 | 2 | 0 | Y | RLRTLIIA | 41.85 | GLRTLILA | 30.79 | RLRTLILA | 25.74 | KRRLRTLV | 1.03 | RRGLRTLI | 0.59 |
| NS3 | 1694 | 0.13 | 6 | 2 | 0 | Y | LRTLILAP | 98.38 | LRTLVLAP | 1.36 | | | RRLRTLVL | 1.03 | |
| NS3 | 1695 | 0.11 | 3 | 2 | 0 | Y | RTLILAPT | 98.56 | RTLVLAPT | 1.4 | | | RLRTLVLA | 1.03 | |
| NS3 | 1696 | 0.11 | 3 | 2 | 0 | Y | TLILAPTR | 98.56 | TLVLAPTR | 1.4 | | | | | |
| NS3 | 1697 | 0.11 | 3 | 2 | 0 | Y | LILAPTRV | 98.56 | LVLAPTRV | 1.4 | | | | | |
| NS3 | 1698 | 0.11 | 3 | 2 | 0 | Y | ILAPTRVV | 98.56 | VLAPTRVV | 1.4 | | | | | |
| NS3 | 1699 | 0 | 2 | 1 | 0 | Y | LAPTRVVA | 99.96 | | | | | | | |

FIG. 18-31

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1700 | 1 | 3 | 2 | 0 | Y | APTRWAA | 55.46 | APTRWAS | 44.51 | | | | |
| NS3 | 1701 | 1 | 3 | 2 | 0 | Y | PTRWAAE | 55.46 | PTRWASE | 44.51 | | | | |
| NS3 | 1702 | 1 | 4 | 2 | 0 | Y | TRWAAEM | 55.46 | TRWASEM | 44.47 | | | | |
| NS3 | 1703 | 1 | 5 | 2 | 0 | Y | RWAAEME | 55.42 | RWASEMA | 44.47 | | | | |
| NS3 | 1704 | 1 | 5 | 2 | 0 | Y | WAAEMEE | 55.42 | WASEMAE | 44.47 | | | | |
| NS3 | 1705 | 1 | 5 | 2 | 0 | Y | AAEMEEA | 55.42 | VASEMAEA | 44.47 | | | | |
| NS3 | 1706 | 1.01 | 6 | 2 | 0 | Y | AEMEEAL | 55.38 | ASEMAEAL | 44.47 | | | | |
| NS3 | 1707 | 1.54 | 8 | 3 | 0 | Y | SEMAEALK | 44.47 | AEMEEALR | 44.51 | AEMEEALK | 20.72 | | |
| NS3 | 1708 | 1.54 | 7 | 3 | 0 | Y | EMAEALKG | 44.51 | EMEEALRG | 44.51 | EMEEALKG | 20.72 | | |
| NS3 | 1709 | 1.6 | 9 | 3 | 0 | Y | MAEALKGM | 43.81 | MEEALRGL | 43.84 | MEEALKGL | 20.72 | | |
| NS3 | 1710 | 1.59 | 8 | 3 | 0 | Y | AEALKGMP | 43.84 | EEALRGLP | 43.84 | EEALKGLP | 20.72 | | |
| NS3 | 1711 | 1.6 | 10 | 3 | 0 | Y | EALKGMPI | 43.84 | EALRGLPI

FIG. 18-32

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1732 | 0.95 | 4 | 2 | 0 | Y | REWDLMC | 64.27 | KEWDLMC | 35.66 | | | | | | |
| NS3 | 1733 | 0.01 | 3 | 1 | 0 | Y | EWDLMCH | 99.93 | | | | | | | | |
| NS3 | 1734 | 0.01 | 4 | 1 | 0 | Y | WDLMCHA | 99.89 | | | | | | | | |
| NS3 | 1735 | 0.02 | 5 | 1 | 0 | Y | VDLMCHAT | 99.85 | | | | | | | | |
| NS3 | 1736 | 0.02 | 5 | 1 | 0 | Y | DLMCHATF | 99.85 | | | | | | | | |
| NS3 | 1737 | 0.02 | 4 | 1 | 0 | Y | LMCHATFT | 99.85 | | | | | | | | |
| NS3 | 1738 | 0.25 | 5 | 2 | 0 | Y | MCHATFTM | 96.05 | MCHATFTT | 3.8 | | | | | | |
| NS3 | 1739 | 0.26 | 6 | 2 | 0 | Y | CHATFTMR | 96.05 | CHATFTTR | 3.72 | | | | | | |
| NS3 | 1740 | 0.25 | 5 | 2 | 0 | Y | HATFTMRL | 96.09 | HATFTTRL | 3.72 | | | | | | |
| NS3 | 1741 | 0.25 | 4 | 2 | 0 | Y | ATFTMRLL | 96.09 | ATFTTRLL | 3.72 | | | | | | |
| NS3 | 1742 | 0.25 | 4 | 2 | 0 | Y | TFTMRLLS | 96.13 | TFTTRLLS | 3.72 | | | | | | |
| NS3 | 1743 | 0.25 | 4 | 2 | 0 | Y | FTMRLLSP | 96.13 | FTTRLLSS | 3.72 | | | | | | |
| NS3 | 1744 | 0.44 | 7 | 3 | 0 | Y | TMRLLSPV | 93.22 | TRLLSST | 3.72 | TMRLLSPI | 2.84 | | | | |
| NS3 | 1745 | 0.44 | 7 | 3 | 0 | Y | MRLLSPVR | 93.22 | TRLLSSTR | 3.72 | MRLLSPIR | 2.84 | | | | |
| NS3 | 1746 | 0.44 | 7 | 3 | 0 | Y | RLLSPVRV | 93.22 | RLLSSTRV | 3.72 | RLLSPIRV | 2.84 | | | | |
| NS3 | 1747 | 0.44 | 7 | 3 | 0 | Y | LLSPVRVP | 93.18 | LLSSTRVP | 3.8 | LLSPIRVP | 2.84 | | | | |
| NS3 | 1748 | 0.44 | 7 | 3 | 0 | Y | LSPVRVPN | 93.18 | LSSTRVPN | 3.8 | LSPIRVPN | 2.84 | | | | |
| NS3 | 1749 | 0.44 | 7 | 3 | 0 | Y | SPVRVPNY | 93.18 | SSTRVPNY | 3.8 | SPIRVPNY | 2.84 | | | | |
| NS3 | 1750 | 0.44 | 7 | 3 | 0 | Y | PVRVPNYN | 93.18 | STRVPNYN | 3.8 | PIRVPNYN | 2.84 | | | | |
| NS3 | 1751 | 1.36 | 7 | 4 | 0 | Y | VRVPNYNM | 48.78 | VRVPNYNM | 44.47 | TRVPNYNL | 3.8 | IRVPNYNL | 2.84 | | |
| NS3 | 1752 | 1.1 | 4 | 3 | 0 | Y | RVPNYNLI | 53.76 | RVPNYNMI | 44.54 | RVPNYNLV | 1.66 | | | | |
| NS3 | 1753 | 1.33 | 7 | 4 | 0 | Y | VPNYNLII | 49.48 | VPNYNMII | 44.51 | VPNYNLIV | 4.28 | VPNYNLVI | 1.62 | | |
| NS3 | 1754 | 1.33 | 8 | 4 | 0 | Y | PNYNLIIM | 49.48 | PNYNMIIM | 44.47 | PNYNLIVM | 4.28 | PNYNLVIM | 1.62 | | |
| NS3 | 1755 | 1.33 | 7 | 4 | 0 | Y | NYNLIIMD | 49.52 | NYNMIIMD | 44.47 | NYNLIVMD | 4.28 | NYNLVIMD | 1.62 | | |
| NS3 | 1756 | 1.33 | 7 | 4 | 0 | Y | YNLIIMDE | 49.52 | YNMIIMDE | 44.47 | YNLIVMDE | 4.28 | YNLVIMDE | 1.62 | | |

FIG. 18-33

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1757 | 1.33 | 7 | 4 | 0 | Y | N

FIG. 18-34

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1782 | 1.14 | 6 | 3 | 0 | Y | VGMGEAAA | 64.97 | VEMGEAAG | 30.83 | VEMGEAAA | 3.8 | | |
| NS3 | 1783 | 1.14 | 6 | 3 | 0 | Y | GMGEAAAI | 64.97 | EMGEAAGI | 30.83 | EMGEAAAI | 3.8 | | |
| NS3 | 1784 | 0.93 | 5 | 2 | 0 | Y | MGEAAAIF | 68.77 | MGEAAGIF | 30.83 | | | | |
| NS3 | 1785 | 0.93 | 5 | 2 | 0 | Y | GEAAAIFM | 68.77 | GEAAGIFM | 30.83 | | | | |
| NS3 | 1786 | 0.93 | 5 | 2 | 0 | Y | EAAAIFMT | 68.77 | EAAGIFMT | 30.83 | | | | |
| NS3 | 1787 | 0.93 | 5 | 2 | 0 | Y | AAAIFMTA | 68.77 | AAGIFMTA | 30.83 | | | | |
| NS3 | 1788 | 0.9 | 3 | 2 | 0 | Y | AAIFMTAT | 69.06 | AGIFMTAT | 30.83 | | | | |
| NS3 | 1789 | 0.9 | 2 | 1 | 0 | Y | AIFMTATP | 69.14 | GIFMTATP | 30.83 | | | | |
| NS3 | 1790 | 0 | 2 | 1 | 0 | Y | IFMTATPP | 99.96 | | | | | | |
| NS3 | 1791 | 0 | 2 | 1 | 0 | Y | FMTATPPG | 99.96 | | | | | | |
| NS3 | 1792 | 0.95 | 5 | 3 | 0 | Y | MTATPPGS | 75.59 | MTATPPGT | 21.05 | MTATPPGA | 3.24 | | |
| NS3 | 1801 | 1.63 | 7 | 4 | 0 | Y | EAFPQSNA | 49.96 | DPFPQSNA | 30.75 | DAFPQSNA | 15.34 | DPFPQSNS | 3.8 |
| NS3 | 1802 | 1.77 | 10 | 5 | 0 | Y | AFPQSNAP | 43.81 | PFPQSNAP | 30.75 | AFPQSNAP | 20.76 | PFPQSNSP | 3.8 |
| NS3 | 1803 | 1.25 | 6 | 3 | 0 | Y | FPQSNAPI | 51.62 | FPQSNAVI | 43.81 | FPQSNSPI | 3.83 | | |
| NS3 | 1810 | 1.52 | 10 | 5 | 0 | Y | IQDEERDI | 64.2 | IMDEEREI | 19.76 | IIDEEREI | 10.55 | IEDIEREI | 3.8 |
| NS3 | 1811 | 1.52 | 10 | 5 | 0 | Y | QDEERDIP | 64.2 | MDEEREIP | 19.76 | IDEEREIP | 10.55 | EDIEREIP | 3.8 |
| NS3 | 1812 | 1.2 | 7 | 4 | 0 | Y | DEERDIPE | 64.2 | DEEREIPE | 30.79 | DIEREIPE | 3.8 | DEEKDIPE | 3.8 |
| NS3 | 1813 | 1.2 | 7 | 4 | 0 | Y | EERDIPER | 64.2 | EEREIPER | 30.79 | IEREIPER | 3.8 | EEKDIPER | 1.07 |
| NS3 | 1814 | 1.01 | 4 | 3 | 0 | Y | ERDIPERS | 64.27 | EREIPERS | 34.62 | EKDIPERS | 1.07 | | |
| NS3 | 1815 | 1.01 | 4 | 3 | 0 | Y | RDIPERSW | 64.27 | REIPERSW | 34.62 | KDIPERSW | 1.07 | | |
| NS3 | 1816 | 0.99 | 5 | 2 | 0 | Y | DIPERSWN | 65.27 | EIPERSWN | 34.03 | | | | |
| NS3 | 1817 | 0.33 | 2 | 2 | 0 | Y | IPERSWNS | 95.02 | IPERSWNT | 4.17 | | | | |
| NS3 | 1818 | 0.33 | 2 | 2 | 0 | Y | PERSWNSG | 95.02 | PERSWNTG | 4.17 | | | | |
| NS3 | 1819 | 1.79 | 11 | 5 | 0 | Y | ERSWNSGY | 43.58 | ERSWNSGN | 30.6 | ERSWNTGF | 3.8 | ERSWSSGH | 0.59 |
| NS3 | 1832 | 1.94 | 16 | 5 | 0 | Y | FPGKTVWF | 44.43 | FAGKTVWF | 30.6 | FVGKTVWF | 6.05 | YQGKTVWF | 3.76 |

Additional column (peptides to cover 99% of block / frequency):
- Row 1810: IQDEEKDI, 1.07
- Row 1811: QDEEKDIP, 1.07
- Row 1819: ERSWSSGH, (freq in prior col); rightmost — ERSWSSGH 0.59
- Row 1832: YQGKTVWF 3.76

FIG. 18-35

Species: DENVall (8-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1833 | 1.94 | 16 | 5 | 0 | Y | PGKTWFV | 44.4 | KGKTWFV | 30.64 | AGKTWFV | 14.49 | VGKTWF

FIG. 18-36

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1858 | 1.05 | 4 | 2 | 0 | Y | KRVIQLSR | 53.58 | KRVIQLSR | 45.69 | | | | |
| NS3 | 1859 | 1.06 | 5 | 2 | 0 | Y | KVIQLSRK | 53.58 | RVIQLSRK | 45.58 | | | | |
| NS3 | 1860 | 0.08 | 3 | 1 | 0 | Y | VIQLSRKT | 99.15 | | | | | | |
| NS3 | 1861 | 0.08 | 3 | 1 | 0 | Y | IQLSRKTF | 99.15 | | | | | | |
| NS3 | 1862 | 0.03 | 4 | 1 | 0 | Y | QLSRKTFD | 99.71 | | | | | | |
| NS3 | 1863 | 0.93 | 7 | 2 | 0 | Y | LSRKTFDT | 69.43 | LSRKTFDS | 30.16 | | | | |
| NS3 | 1864 | 0.93 | 7 | 2 | 0 | Y | SRKTFDTE | 69.43 | SRKTFDSE | 30.16 | | | | |
| NS3 | 1865 | 0.93 | 7 | 2 | 0 | Y | RKTFDTEY | 69.43 | RKTFDSEY | 30.16 | | | | |
| NS3 | 1866 | 1.29 | 12 | 5 | 0 | Y | KTFDTEYQ | 65.08 | KTFDSEYV | 28.69 | KTFDTEYP | 3.8 | KTFDSEYI | 1.18 | KTFDSEYA | 0.29 |
| NS3 | 1867 | 1.28 | 12 | 5 | 0 | Y | TFDTEYQK | 65.15 | TFDSEYVK | 28.69 | TFDTEYPK | 3.8 | TFDSEYIK | 1.18 | TFDSEYAK | 0.29 |
| NS3 | 1868 | 1.29 | 13 | 5 | 0 | Y | FDTEYQKT | 65.12 | FDSEYVKT | 28.69 | FDTEYPKT | 3.8 | FDSEYIKT | 1.18 | FDTEYTKT | 0.29 |
| NS3 | 1877 | 2.05 | 13 | 5 | 0 | Y | NNDWDYVW | 44.47 | LNDWDFVW | 20.76 | TNDWDFVW | 15.86 | ANDWDFVW | 14.6 | LTDWDFVW | 3.8 |
| NS3 | 1878 | 1.21 | 8 | 3 | 0 | Y | NDWDFVVT | 51.51 | NDWDYVVT | 44.51 | TDWDFVVT | 3.8 | | | |
| NS3 | 1879 | 1.01 | 6 | 2 | 0 | Y | DWDFVVTT | 55.35 | DWDYVVTT | 44.51 | | | | |
| NS3 | 1880 | 1 | 5 | 2 | 0 | Y | WDFVVTTD | 55.38 | WDYVVTTD | 44.51 | | | | |
| NS3 | 1881 | 1 | 5 | 2 | 0 | Y | DFVVTTDI | 55.38 | DYVVTTDI | 44.51 | | | | |
| NS3 | 1882 | 1 | 5 | 2 | 0 | Y | FVVTTDIS | 55.38 | YVVTTDIS | 44.51 | | | | |
| NS3 | 1883 | 0.01 | 4 | 1 | 0 | Y | VVTTDISE | 99.89 | | | | | | |
| NS3 | 1884 | 0.01 | 3 | 1 | 0 | Y | VTTDISEM | 99.93 | | | | | | |
| NS3 | 1885 | 0 | 1 | 1 | 0 | Y | TTDISEMG | 100 | | | | | | |
| NS3 | 1886 | 0 | 1 | 1 | 0 | Y | TDISEMGA | 100 | | | | | | |
| NS3 | 1887 | 0 | 1 | 1 | 0 | Y | DISEMGAN | 100 | | | | | | |
| NS3 | 1888 | 1 | 1 | 1 | 0 | Y | ISEMGANF | 100 | | | | | | |
| NS3 | 1889 | 1 | 3 | 2 | 0 | Y | SEMGANFR | 52.14 | SEMGANFK | 47.82 | | | | |
| NS3 | 1890 | 1.01 | 5 | 2 | 0 | Y | EMGANFRA | 52.14 | EMGANFKA | 47.75 | | | | |

FIG. 18-37

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1891 | 1.88 | 9 | 5 | 0 | Y | MGANFRAD | 44.54 | MGANFKAE | 27.06 | MGANFKAD | 20.69 | MGANFRAG | 3.8 | MGANFRAE | 3.69 |
| NS3 | 1892 | 1.88 | 9 | 5 | 0 | Y | GANFRADR | 44.54 | GANFKAER | 27.06 | GANFKADR | 20.69 | GANFRAGR | 3.8 | GANFRAER | 3.69 |
| NS3 | 1893 | 1.88 | 9 | 5 | 0 | Y | ANFRADRV | 44.54 | ANFKAERV | 27.06 | ANFKADRV | 20.69 | ANFRAGRV | 3.8 | ANFRAERV | 3.69 |
| NS3 | 1894 | 1.88 | 10 | 5 | 0 | Y | NFRADRVI | 44.51 | NFKAERVI | 27.06 | NFKADRVI | 20.69 | NFRAGRVI | 3.8 | NFRAERVI | 3.69 |
| NS3 | 1895 | 1.88 | 10 | 5 | 0 | Y | FRADRVID | 44.51 | FKAERVID | 27.06 | FKADRVID | 20.69 | FRAGRVID | 3.8 | FRAERVID | 3.69 |
| NS3 | 1896 | 1.88 | 10 | 5 | 0 | Y | RADRVIDP | 44.51 | KAERVIDP | 27.06 | KADRVIDP | 20.69 | RAGRVIDP | 3.8 | RAERVIDP | 3.69 |
| NS3 | 1897 | 1.13 | 7 | 3 | 0 | Y | ADRVIDPR | 65.23 | AERVIDPR | 30.75 | AGRVIDPR | 3.8 | | | | |
| NS3 | 1898 | 1.12 | 5 | 3 | 0 | Y | DRVIDPRR | 65.3 | ERVIDPRR | 30.75 | GRVIDPRR | 3.8 | | | | |
| NS3 | 1899 | 0 | 2 | 1 | 0 | Y | RVIDPRRC | 99.96 | | | | | | | | |
| NS3 | 1900 | 0.9 | 3 | 2 | 0 | Y | VIDPRRCL | 69.14 | VIDPRRCM | 30.83 | | | | | | |
| NS3 | 1901 | 0.9 | 3 | 2 | 0 | Y | IDPRRCLK | 69.14 | IDPRRCMK | 30.83 | | | | | | |
| NS3 | 1902 | 0.89 | 2 | 2 | 0 | Y | DPRRCLKP | 69.17 | DPRRCMKP | 30.83 | | | | | | |
| NS3 | 1903 | 0.9 | 3 | 2 | 0 | Y | PRRCLKPV | 69.14 | PRRCMKPV | 30.83 | | | | | | |
| NS3 | 1904 | 0.9 | 3 | 2 | 0 | Y | RRCLKPVI | 69.14 | RRCMKPVI | 30.83 | | | | | | |
| NS3 | 1905 | 0.91 | 4 | 2 | 0 | Y | RCLKPVIL | 68.99 | RCMKPVIL | 30.83 | | | | | | |
| NS3 | 1906 | 1.6 | 8 | 3 | 0 | Y | CLKPVILK | 44.43 | CMKPVILT | 30.75 | CLKPVILT | 24.15 | | | | |
|

FIG. 18-38

Species: DENVall (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---

FIG. 18-39

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1949 | 2.06 | 8 | 5 | 0 | Y | QYIYMGQP | 35.44 | QYIYMGEP | 30.83 | QYIFTGQP | 20.32 | QYYMGQP | 9.07 | QYVFSGDP | 3

FIG. 18-40

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1975 | 0.26 | 7 | 2 | 0 | Y | NINTPEGI | 95.98 | NIYTPEGI | 3.8 | | | | |
| NS3 | 1976 | 0.27 | 9 | 2 | 0 | Y | INTPEGII | 95.91 | IYTPEGII | 3.8 | | | | |
| NS3 | 1977 | 0.26 | 6 | 2 | 0 | Y | NTPEGIIP | 96.02 | YTPEGIIP | 3.8 | | | | |
| NS3 | 1978 | 1.12 | 6 | 3 | 0 | Y | TPEGIIPA | 65.23 | TPEGIIPS | 30.83 | TPEGIIPT | 3.8 | | |
| NS3 | 1979 | 1.13 | 7 | 3 | 0 | Y | PEGIIPAL | 65.23 | PEGIIPSM | 30.68 | PEGIIPTL | 3.8 | | |
| NS3 | 1980 | 1.14 | 8 | 3 | 0 | Y | EGIIPALF | 65.15 | EGIIPSMF | 30.68 | EGIIPTLF | 3.8 | | |
| NS3 | 1981 | 1.15 | 10 | 3 | 0 | Y | GIIPALFE | 65.12 | GIIPSMFE | 30.6 | GIIPTLFG | 3.8 | | |
| NS3 | 1982 | 1.15 | 9 | 3 | 0 | Y | IIPALFEP | 65.19 | IIPSMFEP | 30.6 | IIPTLFGP | 3.8 | | |
| NS3 | 1983 | 1.15 | 9 | 3 | 0 | Y | IPALFEPE | 65.19 | IPSMFEPE | 30.6 | IPTLFGPE | 3.8 | | |
| NS3 | 1984 | 1.15 | 7 | 3 | 0 | Y | PALFEPER | 65.27 | PSMFEPER | 30.6 | PTLFGPER | 3.8 | | |
| NS3 | 1985 | 1.15 | 9 | 3 | 0 | Y | ALFEPERE | 65.19 | SMFEPERE | 30.6 | TLFGPERE | 3.8 | | |
| NS3 | 1986 | 1.13 | 7 | 3 | 0 | Y | LFEPEREK | 65.34 | MFEPEREK | 30.6 | LFGPEREK | 3.8 | | |
| NS3 | 1987 | 1.14 | 10 | 3 | 0 | Y | FEPEREKS | 65.15 | FEPEREKV | 30.75 | FGPEREKT | 3.83 | | |
| NS3 | 1988 | 1.14 | 11 | 3 | 0 | Y | EPEREKSA | 65.19 | EPEREKVD | 30.75 | GPEREKTQ | 3.69 | | |
| NS3 | 1989 | 1.13 | 9 | 3 | 0 | Y | PEREKSAA | 65.23 | PEREKVDA | 30.83 | PEREKTQA | 3.69 | | |
| NS3 | 1990 | 1.3 | 11 | 4 | 0 | Y | EREKSAAI | 63.05 | EREKVDAI | 30.42 | EREKTQAI | 3.69 | EREKSAAV | 2.18 |
| NS3 | 1991 | 1.3 | 11 | 4 | 0 | Y | REKSAAID | 63.05 | REKVDAID | 30.42 | REKTQAID | 3.69 | REKSAAVD | 2.18 |
| NS3 | 1992 | 1.3 | 12 | 4 | 0 | Y | EKSAAIDG | 63.02 | EKVDAIDG | 30.42 | EKTQAIDG | 3.69 | EKSAAVDG | 2.18 |
| NS3 | 1993 | 1.3 | 11 | 4 | 0 | Y | KSAAIDGE | 63.05 | KVDAIDGE | 30.42 | KTQAIDGE | 3.69 | KSAAVDGE | 2.18 |
| NS3 | 1994 | 1.3 | 12 | 4 | 0 | Y | SAAIDGEY | 63.02 | VDAIDGEY | 30.42 | TQAIDGEF | 3.69 | SAAVDGEY | 2.18 |
| NS3 | 1995 | 1.29 | 9 | 4 | 0 | Y | AAIDGEYR | 63.05 | DAIDGEYR | 30.42 | QAIDGEFR | 3.69 | AAVDGEYR | 2.18 |
| NS3 | 1996 | 0.42 | 7 | 3 | 0 | Y | AIDGEYRL | 93.47 | AIDGEFRL | 3.8 | AVDGEYRL | 2.58 | | |
| NS3 | 1997 | 1.14 | 8 | 4 | 0 | Y | IDGEYRLK | 72.75 | IDGEFRLR | 20.72 | IDGEFRLR | 3.8 | VDGEYRLK | 2.58 |
| NS3 | 1998 | 0.97 | 7 | 3 | 0 | Y | DGEYRLRG | 75.33 | DGEYRLKG | 20.72 | DGEFRLRG | 3.8 | | |
| NS3 | 1999 | 0.97 | 7 | 3 | 0 | Y | GEYRLRGE | 75.33 | GEYRLKGE | 20.72 | GEFRLRGE | 3.8 | | |

FIG. 18-41

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2000 | 0.98 | 8 | 3 | 0 | Y | EYRLRGEA | 75.26 | EYRLKGES | 20.76 | EFRLRGEQ | 3.8 | | |
| NS3 | 2001 | 0.98 | 7 | 3 | 0 | Y | YRLRGEAR | 75.29 | YRLKGESR | 20.76 | FRLRGEQR | 3.8 | | |
| NS3 | 2002 | 0.99 | 8 | 3 | 0 | Y | RLRGEARK | 75.18 | RLKGESRK | 20.76 | RLRGEQRK | 3.8 | | |
| NS3 | 2003 | 0.99 | 8 | 3 | 0 | Y | LRGEARKT | 75.18 | LKGESRKT | 20.76 | LRGEQRKT | 3.8 | | |
| NS3 | 2004 | 0.98 | 7 | 3 | 0 | Y | RGEARKTF | 75.18 | KGESRKTF | 20.8 | RGEQRKTF | 3.8 | | |
| NS3 | 2005 | 0.98 | 7 | 3 | 0 | Y | GEARKTFV | 75.18 | GESRKTFV | 20.8 | GEQRKTFV | 3.8 | | |
| NS3 | 2006 | 1.72 | 8 | 4 | 0 | Y | EARKTFVE | 44.54 | EARKTFVD | 30.64 | ESRKTFVE | 20.8 | EQRKTFVE | 3.8 |
| NS3 | 2007 | 1.72 | 8 | 4 | 0 | Y | ARKTFVEL | 44.54 | ARKTFVDL | 30.64 | SRKTFVEL | 20.8 | QRKTFVEL | 3.8 |
| NS3 | 2008 | 0.91 | 6 | 2 | 0 | Y | RKTFVELM | 69.21 | RKTFVDLM | 30.6 | | | | |
| NS3 | 2009 | 0.96 | 8 | 2 | 0 | Y | KTFVELMR | 69.1 | KTFVDLMR | 30.09 | | | | |
| NS3 | 2010 | 0.95 | 6 | 2 | 0 | Y | TFVELMRR | 69.1 | TFVDLMRR | 30.2 | | | | |
| NS3 | 2011 | 0.95 | 6 | 2 | 0 | Y | FVELMRRG | 69.1 | FVDLMRRG | 30.2 | | | | |
| NS3 | 2012 | 0.96 | 8 | 2 | 0 | Y | VELMRRGD | 68.99 | VDLMRRGD | 30.2 | | | | |
| NS3 | 2013 | 0.96 | 7 | 2 | 0 | Y | ELMRRGDL | 69.03 | DLMRRGDL | 30.2 | | | | |
| NS3 | 2014 | 0.07 | 5 | 1 | 0 | Y | LMRRGDLP | 99.23 | | | | | | |
| NS3 | 2015 | 0.07 | 5 | 1 | 0 | Y | MRRGDLPV | 99.23 | | | | | | |
| NS3 | 2016 | 0.07 | 4 | 1 | 0 | Y | RRGDLPVW | 99.26 | | | | | | |
| NS3 | 2017 | 0.01 | 3 | 1 | 0 | Y | RGDLPVWL | 99.89 | | | | | | |
| NS3 | 2018 | 1.01 | 4 | 2 | 0 | Y | GDLPVWLA | 51.47 | GDLPVWLS | 48.41 | | | | |
| NS3 | 2019 | 1.58 | 7 | 4 | 0 | Y | DLPVWLSY | 47.79 | DLPVWLAY | 31.08 | DLPVWLSH | 20.1 | DLPVWLAH | 0.63 |
| NS3 | 2020 | 1.86 | 7 | 4 | 0 | Y | LPVWLSYK | 47.79 | LPVWLAYK | 20.61 | LPVWLAHK | 10.44 | | |
| NS3 | 2021 | 1.86 | 8 | 4 | 0 | Y | PVWLSYKV | 47.79 | PVWLAYKV | 20.61 | PVWLAHKV | 10.44 | | |
| NS3 | 2022 | 1.86 | 9 | 4 | 0 | Y | VWLSYKVA | 47.75 | VWLAYKVA | 20.61 | VWLAHKVA | 10.44 | | |
| NS3 | 2023 | 1.94 | 9 | 5 | 0 | Y | WLSYKVAS | 47.75 | WLAHKVAS | 20.21 | WLAYKVAA | 19.17 | WLAYRVAA | 10.44 |
| NS3 | 2028 | 1.78 | 12 | 5 | 0 | Y | VASEGFQY | 44.43 | VASEGIKY | 29.83 | VASEGINY | 20.83 | VASAGISY | 3.8 |

FIG. 18-42

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2031 | 1.79 | 16 | 5 | 0.04 | Y | EGF

FIG. 18-43

Species: DENVall (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2075 | 1.13 | 9 | 3 | 0 | Y | LDARTYSD | 65.78 | LDARIYSD | 30.09 | LDARYAD | 3.8 | | |
| NS3 | 2076 | 1.13 | 9 | 3 | 0 | Y | DARTYSDP | 65.78 | DARIYSDP | 30.09 | DARYADP | 3.8 | | |
| NS3 | 2077 | 1.14 | 10 | 3 | 0 | Y | ARTYSDPL | 65.74 | ARIYSDPL | 30.09 | ARYADPM | 3.8 | | |
| NS3 | 2078 | 1.14 | 10 | 3 | 0 | Y | RTYSDPLA | 65.74 | RIYSDPLA | 30.05 | RYADPMA | 3.8 | | |
| NS3 | 2079 | 1.14 | 9 | 3 | 0 | Y | TYSDPLAL | 65.71 | IYSDPLAL | 30.13 | VYADPMAL | 3.8 | | |
| NS3 | 2080 | 1.23 | 10 | 3 | 0.07 | Y | YSDPLALK | 51.4 | YSDPLALR | 44.4 | YADPMALK | 3.76 | | |
| NS3 | 2081 | 1.23 | 10 | 3 | 0.07 | Y | SDPLALKE | 51.4 | SDPLALRE | 44.4 | ADPMALKD | 3.76 | | |
| NS3 | 2082 | 1.24 | 12 | 3 | 0.07 | Y | DPLALKEF | 51.4 | DPLALREF | 44.32 | DPMALKDF | 3.76 | | |
| NS3 | 2083 | 1.24 | 12 | 3 | 0.07 | Y | PLALKEFK | 51.4 | PLALREFK | 44.32 | PMALKDFK | 3.76 | | |
| NS3 | 2084 | 1.74 | 13 | 4 | 0.07 | Y | LALREFKE | 44.32 | LALKEFKE | 31.19 | LALKEFKD | 20.21 | MALKDFKE | 3.76 |
| NS3 | 2085 | 1.73 | 11 | 4 | 0.07 | Y | ALREFKEF | 44.36 | ALKEFKEF | 31.23 | ALKEFKDF | 20.21 | ALKDFKEF | 3.76 |
| NS3 | 2086 | 1.72 | 10 | 4 | 0.07 | Y | LREFKEFA | 44.4 | LKEFKEFA | 31.27 | LKEFKDFA | 20.21 | LKDFKEFA | 3.76 |
| NS3 | 2087 | 1.72 | 8 | 4 | 0.07 | Y | REFKEFAA | 44.36 | KEFKEFAA | 31.27 | KEFKDFAA | 20.28 | KDFKEFAS | 3.76 |
| NS3 | 2088 | 0.97 | 8 | 3 | 0.07 | Y | EFKEFAAG | 75.63 | EFKDFAAG | 20.28 | DFKEFASG | 3.8 | | |
| NS3 | 2089 | 0.97 | 7 | 3 | 0.07 | Y | FKEFAAGR | 75.63 | FKDFAAGR | 20.28 | FKEFASGR | 3.8 | | |
| NS3 | 2090 | 1.71 | 8 | 4 | 0 | Y | KEFAAGRR | 44.32 | KEFAAGRK | 31.45 | KDFAAGRK | 20.28 | KEFASGRK | 3.76 |
| NS3 | 2091 | 1.71 | 11 | 4 | 0 | Y | EFAAGRRS | 44.32 | EFAAGRKS | 31.42 | DFAAGRKS | 20.28 | EFASGRKS | 3.8 |
| NS3 | 2092 | 1.75 | 14 | 5 | 0 | Y | FAAGRRSV | 44.14 | FAAGRKSL | 30.75 | FAAGRKSI | 20.83 | FASGRKSI | 3.76 |
| NS3 | 2093 | 1.8 | 17 | 5 | 0 | Y | AAGRRSVS | 44.1 | AAGRKSLT | 30.2 | AAGRKSIA | 20.76 | ASGRKSIT | 3.76 |
| NS3 | 2094 | 1.83 | 15 | 5 | 0 | Y | AGRRSVSG | 43.99 | AGRKSLTL | 30.2 | AGRKSIAL | 20.5 | SGRKSITL | 3.76 | AAGRKSLA | 0.55 |
| NS4A | 2101 | 1.81 | 14 | 5 | 0 | Y | GDLILEIG | 44.06 | LNLITEMG | 30.31 | LDLVTEIG | 20.54 | LDILTEIA | 3.8 | AGRKSLAL | 0.55 |
| NS4A | 2102 | 1.81 | 12 | 5 | 0 | Y | DLILEIGK | 44.17 | NLITEMGR | 30.16 | DLVTEIGR | 20.8 | DILTEIAS | 3.47 | LSLITEMG | 0.41 |
| NS4A | 2103 | 1.77 | 11 | 4 | 0 | Y | LILEIGKL | 44.21 | LITEMGRL | 30.57 | LVTEIGRV | 20.8 | ILTEIASL | 3.47 | SLITEMGR | 0.41 |
| NS4A | 2104 | 1.77 | 11 | 4 | 0 | Y | ILEIGKLP | 44.21 | ITEMGRLP | 30.6 | VTEIGRVP | 20.8 | LTEIASLP | 3.47 | | |
| NS4A | 2105 | 1.89 | 13 | 5 | 0 | Y | LEIGKLPQ | 44.25 | TEMGRLPT | 30.6 | TEIGRVPS | 17.74 | TEIASLPT | 3.43 | TEIGRVPT | 3.06 |

FIG. 18-44

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2106 | 1.87 | 12 | 5 | 0 | Y | EIGKLPQH | 44.54 | EMGRLPTF | 30.57 | EIGRVPSH | 17.74 | EIASLPTY | 3.43 | EIGR

FIG. 18-45

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2152 | 1.82 | 13 | 5 | 0 | Y | LMLLALIA | 43.88 | LLLTLLA | 30.13 | LLLLGLMI | 20.76 | LMLVALLG | 3.72 | LLLLGLLA | 0.59 |
| NS4A | 2157 | 1.77 | 13 | 4 | 0 | Y | LIAVLTGG | 44.36 | LLATVTGG | 30.2 | LMILLTGG | 20.72 | LLGAMTAG | 3.8 | | |
| NS4A | 2161 | 1.8 | 12 | 5 | 0 | Y | LTGGVTLF | 44.03 | VTGGIFLF | 30.64 | LTGGAMLF | 20.24 | MTAGIFLF | 3.69 | LTGGWMLF | 0.85 |
| NS4A | 2162 | 1.81 | 16 | 5 | 0 | Y | TGGVTLFF | 43.99 | TGGIFLFL | 30.72 | TGGAMLFL | 20.21 | TAGIFLFF | 3.69 | TGGVMLFL | 0.52 |
| NS4A | 2164 | 1.82 | 17 | 5 | 0 | Y | GVTLFFLS | 43.99 | GIFLFLMS | 30.72 | GAMLFLIS | 20.13 | GIFLFFMQ | 3.69 | GVMLFLIS | 0.52 |
| NS4A | 2176 | 1.76 | 12 | 4 | 0 | Y | GKTSIGLL | 44.43 | GKMTLGMC | 30.75 | GKTSIGLI | 20.35 | GKLSMGLI | 3.72 | | |
| NS4A | 2177 | 1.79 | 13 | 5 | 0 | Y | KTSIGLLC | 44.43 | KMTLGMCC | 30.75 | KTSIGLIC | 20.35 | KLSMGLIT | 2.88 | KLSMGLIA | 0.85 |
| NS4A | 2178 | 1.79 | 13 | 5 | 0 | Y | TSIGLLCV | 44.43 | MTLGMCCI | 30.75 | TSIGLICV | 20.35 | LSMGLITI | 2.88 | LSMGLIAI | 0.85 |
| NS4A | 2197 | 1.91 | 8 | 4 | 0 | Y | VEPHWIAA | 44.47 | IQPHWIAA | 30.83 | IPLQWIAS | 12.76 | VPLQWIAS | 8.08 | IQPQWIAA | 3.72 |
| NS4A | 2198 | 1.7 | 5 | 3 | 0 | Y | EPHWIAAS | 44.51 | QPHWIAAS | 30.83 | PLQWIASA | 20.83 | QPQWIAAS | 3.8 | | |
| NS4A | 2199 | 0.97 | 5 | 3 | 0 | Y | PHWIAASI | 75.33 | LQWIASAI | 20.76 | PQWIAASI | 3.8 | | | | |
| NS4A | 2200 | 1.01 | 8 | 3 | 0 | Y | HWIAASII | 75.26 | QWIASAIV | 20.39 | QWIAASII | 3.8 | | | | |
| NS4A | 2201 | 0.79 | 7 | 2 | 0 | Y | WIAASIIL | 79.06 | WIASAIVL | 20.39 | | | | | | |
| NS4A | 2202 | 0.82 | 9 | 2 | 0 | Y | IAASIILE | 78.76 | IASAIVLE | 20.39 | | | | | | |
| NS4A | 2203 | 0.82 | 9 | 2 | 0 | Y | AASIILEF | 78.76 | ASAIVLEF | 20.39 | | | | | | |
| NS4A | 2204 | 0.82 | 9 | 2 | 0 | Y | ASIILEFF | 78.76 | SAIVLEFF | 20.39 | | | | | | |
| NS4A | 2205 | 0.82 | 9 | 2 | 0 | Y | SIILEFFL | 78.76 | AIVLEFFM | 20.39 | | | | | | |
| NS4A | 2206 | 1.58 | 11 | 3 | 0 | Y | IILEFFLM | 48.23 | IILEFFLI | 30.49 | IVLEFFMM | 20.39 | | | | |
| NS4A | 2207 | 1.58 | 11 | 3 | 0 | Y | ILEFFLMV | 48.23 | ILEFFLIV | 30.46 | VLEFFMMV | 20.46 | | | | |
| NS4A | 2208 | 1.54 | 7 | 3 | 0 | Y | LEFFLMVL | 48.34 | LEFFLIVL | 30.46 | LEFFMMVL | 20.83 | | | | |
| NS4A | 2209 | 1.54 | 7 | 3 | 0 | Y | EFFLMVLL | 48.34 | EFFLIVLL | 30.46 | EFFMMVLL | 20.83 | | | | |
| NS4A | 2210 | 1.52 | 6 | 3 | 0 | Y | FFLMVLLI | 48.23 | FFLIVLLI | 30.72 | FFMMVLLI | 20.83 | | | | |
| NS4A | 2211 | 1.58 | 6 | 3 | 0 | Y | FLMVLLIP | 48.23 | FLIVLLIP | 30.72 | FMMVLLIP | 20.83 | | | | |
| NS4A | 2212 | 1.53 | 7 | 3 | 0 | Y | LMVLLIPE | 48.23 | LIVLLIPE | 30.72 | MMVLLIPE | 20.8 | | | | |
| NS4A | 2213 | 0.92 | 6 | 2 | 0 | Y | MVLLIPEP | 69.03 | IVLLIPEP | 30.72 | | | | | | |

FIG. 18-47

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2250 | 1.12 | 4 | 3 | 0 | Y | MGLLETTK | 65.23 | MGFLEKTK | 30.83 | MGLIEKTK | 3.8 | | |
| NS4B | 2251 | 1.73 | 7 | 4 | 0 | Y | GLLETTKK | 44.54 | GFLEKTKK | 30.68 | GLLETTKR | 20.69 | GLIEKTKT | 3.69 | |
| NS4B | 2252 | 1.73 | 8 | 4 | 0 | Y | LLETTKKD | 44.54 | FLEKTKKD | 30.68 | LLETTKRD | 20.65 | LIEKTKTD | 3.69 | |
| NS4B | 2253 | 1.84 | 9 | 5 | 0 | Y | LETTKKDL | 44.54 | LEKTKKDL | 28.43 | LETTKRDL | 20.8 | IEKTKTDF | 3.69 | LEKTKKDF | 2.25 |
| NS4B | 2254 | 1.84 | 9 | 5 | 0 | Y | ETTKKDLG | 44.54 | EKTKKDLG | 28.43 | ETTKRDLG | 20.8 | EKTKTDFG | 3.69 | EKTKKDFG | 2.25 |
| NS4B | 2280 | 1.37 | 4 | 3 | 0 | Y | LDVDLHPA | 57.26 | LDVDLRPA | 30.83 | LDVDLRPA | 11.58 | | | | |
| NS4B | 2281 | 1.37 | 4 | 3 | 0 | Y | DVDLHPAS | 57.26 | DIDLRPAS | 30.83 | DVDLRPAS | 11.58 | | | | |
| NS4B | 2282 | 1.37 | 4 | 3 | 0 | Y | VDLHPASA | 57.26 | IDLRPASA | 30.83 | VDLRPASA | 11.58 | | | | |
| NS4B | 2283 | 0.98 | 2 | 2 | 0 | Y | DLHPASAW | 57.6 | DLRPASAW | 42.4 | | | | | | |
| NS4B | 2284 | 0.99 | 3 | 2 | 0 | Y | LHPASAWT | 57.56 | LRPASAWT | 42.4 | | | | | | |
| NS4B | 2285 | 0.99 | 3 | 2 | 0 | Y | HPASAWTL | 57.56 | RPASAWTL | 42.4 | | | | | | |
| NS4B | 2286 | 0 | 2 | 1 | 0 | Y | PASAWTLY | 99.96 | | | | | | | | |
| NS4B | 2287 | 0 | 2 | 1 | 0 | Y | ASAWTLYA | 99.96 | | | | | | | | |
| NS4B | 2288 | 0 | 2 | 1 | 0 | Y | SAWTLYAV | 99.96 | | | | | | | | |
| NS4B | 2289 | 0.01 | 3 | 1 | 0 | Y | AWTLYAVA | 99.93 | | | | | | | | |
| NS4B | 2290 | 0.01 | 3 | 1 | 0 | Y | WTLYAVAT | 99.93 | | | | | | | | |
| NS4B | 2291 | 0.01 | 4 | 1 | 0 | Y | TLYAVATT | 99.89 | | | | | | | | |
| NS4B | 2292 | 1.59 | 6 | 3 | 0.11 | Y | LYAVATTI | 39.42 | LYAVATTF | 30.72 | LYAVATTV | 29.61 | YAVATTIL | 3.65 | YAVATTFI | 3.17 |
| NS4B | 2293 | 1.93 | 11 | 5 | 0.11 | Y | YAVATTII | 35.73 | YAVATTVI | 29.61 | YAVATTFV | 27.4 | AVATTILT | 3.65 | AVATTFIT | 3.17 |
| NS4B | 2294 | 1.93 | 11 | 5 | 0.11 | Y | AVATTIIT | 35.73 | AVATTVIT | 29.61 | AVATTFVT | 27.4 | VATTILTP | 3.65 | VATTFITP | 3.17 |
| NS4B | 2295 | 1.93 | 11 | 5 | 0.11 | Y | VATTIITP | 35.73 | VATTVITP | 29.61 | VATTFVTP | 27.4 | ATTILTPM | 3.65 | ATTFITPM | 3.17 |
| NS4B | 2296 | 1.93 | 12 | 5 | 0 | Y | ATTIITPM | 35.73 | ATTVITPM | 29.61 | ATTFVTPM | 27.4 | LTPMLRHT | 3.8 | ITPMLRHS | 3.13 |
| NS4B | 2300 | 1.86 | 9 | 5 | 0 | Y | ITPMMRHT | 44.47 | ITPMMRHS | 27.51 | ITPMLRHT | 20.87 | | | | |
| NS4B | 2301 | 1.55 | 4 | 3 | 0 | Y | TPMMRHTI | 44.51 | TPMLRHSI | 30.79 | TPMLRHTI | 24.67 | | | | |
| NS4B | 2302 | 1.55 | 4 | 3 | 0 | Y | PMMRHTIE | 44.51 | PMLRHSIE | 30.79 | PMLRHTIE | 24.67 | | | | |

FIG. 18-48

Species: DENVall (8-mers)

| protein | block starting position | block entropy | total peptides in block | # peptides required to cover 99% of block | gap/X fraction | 99% of block covered w/ => 5 peptides? | peptides required to cover 99% of block

FIG. 18-49

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2328 | 1.11 | 7 | 3 | 0 | Y | MGLDKGWP | 65.19 | MGLGKGWP | 31.45 | MGLGRGWP | 3.1 | | |
| NS4B | 2329 | 1.11 | 6 | 3 | 0 | Y | GLDKGWPI | 65.19 | GLGKGWPL | 31.49 | GLGRGWPL | 3.1 | | |
| NS4B | 2330 | 1.27 | 7 | 4 | 0 | Y | LDKGWPIS | 65.19 | LGKGWPLS | 27.69 | LGKGWPLH | 3.8 | LGRGWPLS | 3.1 |
| NS4B | 2331 | 1.28 | 8 | 4 | 0 | Y | DKGWPISK | 65.15 | GKGWPLSK | 27.69 | GKGWPLHR | 3.8 | GRGWPLSK | 3.1 |
| NS4B | 2332 | 1.27 | 8 | 4 | 0 | Y | KGWPISKM | 65.34 | KGWPLSKM | 27.65 | KGWPLHRM | 3.72 | RGWPLSKM | 3.1 |
| NS4B | 2333 | 1.12 | 7 | 3 | 0 | Y | GWPISKMD | 65.34 | GWPLSKMD | 30.75 | GWPLHRMD | 3.72 | | |
| NS4B | 2334 | 1.73 | 11 | 4 | 0 | Y | WPISKMDI | 44.1 | WPLSKMDI | 30.68 | WPLHRMDL | 3.72 | | |
| NS4B | 2335 | 1.73 | 12 | 4 | 0 | Y | PISKMDIG | 44.1 | PLSKMDLG | 30.68 | PLHRMDLG | 3.69 | | |
| NS4B | 2336 | 1.77 | 14 | 3 | 0 | Y | ISKMDIGV | 44.1 | LSKMDIGV | 30.13 | LHRMDLGV | 3.69 | | |
| NS4B | 2337 | 1.05 | 12 | 3 | 0 | Y | SKMDIGVP | 74.23 | SKMDLGVP | 21.17 | | | | |
| NS4B | 2338 | 1.05 | 11 | 2 | 0 | Y | KMDIGVPL | 74.26 | KMDLGVPL | 21.17 | | | | |
| NS4B | 2339 | 0.9 | 10 | 2 | 0 | Y | MDIGVPLL | 74.26 | MDLGVPLL | 24.85 | | | | |
| NS4B | 2340 | 0.9 | 11 | 4 | 0 | Y | DIGVPLLA | 74.19 | DLGVPLLA | 24.93 | | | | |
| NS4B | 2341 | 1.77 | 13 | 3 | 0 | Y | IGVPLLAL | 44.14 | LGVPLLAL | 30.09 | LGVPLLAM | 3.76 | | |
| NS4B | 2342 | 1.16 | 9 | 3 | 0 | Y | GVPLLALG | 65.34 | GVPLLAIG | 30.16 | | | | |
| NS4B | 2343 | 1.16 | 8 | 3 | 0 | Y | VPLLALGC | 65.38 | VPLLAIGC | 30.16 | | | | |
| NS4B | 2344 | 1.05 | 6 | 3 | 0 | Y | PLLALGCY | 65.41 | PLLAIGCY | 30.72 | | | | |
| NS4B | 2345 | 1.11 | 6 | 3 | 0 | Y | LLALGCYS | 65.41 | LLAIGCYS | 30.72 | | | | |
| NS4B | 2346 | 1.11 | 6 | 3 | 0 | Y | LALGCYSQ | 65.41 | LAIGCYSQ | 30.72 | | | | |
| NS4B | 2347 | 1.11 | 5 | 3 | 0 | Y | ALGCYSQV | 65.41 | AIGCYSQV | 30.72 | | | | |
| NS4B | 2348 | 1.11 | 3 | 1 | 0 | Y | LGCYSQVN | 99.93 | IGCYSQVN | 30.75 | | | | |
| NS4B | 2349 | 0.01 | 7 | 3 | 0 | Y | GCYSQVNP | 65.38 | CYSQVNPT | 30.53 | CYSQVNPI | 3.87 | | |
| NS4B | 2350 | 1.13 | 7 | 3 | 0 | Y | CYSQVNPL | 65.38 | YSQVNPTT | 30.53 | YSQVNPTT | 3.87 | | |
| NS4B | 2351 | 1.13 | 7 | 3 | 0 | Y | YSQVNPLT | 65.38 | SQVNPTTL | 30.53 | SQVNPTTL | 3.87 | | |
| NS4B | 2352 | 1.13 | 8 | 3 | 0 | Y | SQVNPLTL | 65.34 | | | | | | |

FIG. 18-50

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2353 | 1.21 | 10 | 4 | 0 | Y | QWNPLTLT | 64.49 | QWNPLTLT | 30.57 | QWNPTTLT | 3.8 | QWNPLTLI | 0.7 | | |
| NS4B | 2354 | 1.21 | 12 | 4 | 0 | Y | VNPLTLIA | 64.45 | VNPLTLIA | 30.53 | VNPTTLIA | 3.8 | VNPLTLIA | 0.7 | | |
| NS4B | 2355 | 1.26 | 17 | 5 | 0 | Y | NPLTLTAA | 64.05 | NPLTLTAA | 30.49 | NPTTLTAS | 3.72 | NPLTLIAA | 0.7 | NPLTLAVV | 0.22 |
| NS4B | 2356 | 1.27 | 19 | 5 | 0 | Y | PLTLTAAV | 63.97 | PLTLTAAL | 30.49 | PTTLTASL | 3.72 | PLTLIAAV | 0.7 | PLTLTAVV | 0.22 |
| NS4B | 2366 | 1.29 | 15 | 5 | 0 | Y | LVHAYII | 74.19 | LITHYAII | 13.02 | LVTHYAII | 7.74 | LLVHYAII | 3.61 | LIAHYAII | 0.55 |
| NS4B | 2367 | 1.3 | 17 | 5 | 0 | Y | VAHYAIIG | 74.12 | ITHYAIIG | 13.02 | VTHYAIIG | 7.74 | LVHYAIIG | 3.61 | IAHYAIIG | 0.55 |
| NS4B | 2368 | 0.99 | 9 | 3 | 0 | Y | AHYAIIGP | 75.15 | THYAIIGP | 20.83 | VHYAIIGP | 3.8 | | | | |
| NS4B | 2369 | 0.03 | 7 | 1 | 0 | Y | HYAIIGPG | 99.74 | | | | | | | | |
| NS4B | 2370 | 0.03 | 7 | 1 | 0 | Y | YAIIGPGL | 99.74 | | | | | | | | |
| NS4B | 2371 | 0.03 | 7 | 1 | 0 | Y | AIIGPGLQ | 99.74 | | | | | | | | |
| NS4B | 2372 | 0.03 | 7 | 1 | 0 | Y | IIGPGLQA | 99.74 | | | | | | | | |
| NS4B | 2373 | 0.04 | 8 | 1 | 0 | Y | IGPGLQAK | 99.71 | | | | | | | | |
| NS4B | 2374 | 0.03 | 7 | 1 | 0 | Y | GPGLQAKA | 99.74 | | | | | | | | |
| NS4B | 2375 | 0.03 | 6 | 1 | 0 | Y | PGLQAKAT | 99.78 | | | | | | | | |
| NS4B | 2376 | 0.03 | 6 | 1 | 0 | Y | GLQAKATR | 99.78 | | | | | | | | |
| NS4B | 2377 | 0.03 | 6 | 1 | 0 | Y | LQAKATRE | 99.78 | | | | | | | | |
| NS4B | 2378 | 0.03 | 5 | 1 | 0 | Y | QAKATREA | 99.82 | | | | | | | | |
| NS4B | 2379 | 0.02 | 7 | 1 | 0 | Y | AKATREAQ | 99.74 | | | | | | | | |
| NS4B | 2380 | 0.03 | 7 | 1 | 0 | Y | KATREAQK | 99.74 | | | | | | | | |
| NS4B | 2381 | 0.03 | 6 | 1 | 0 | Y | ATREAQKR | 99.78 | | | | | | | | |
| NS4B | 2382 | 0.03 | 7 | 2 | 0 | Y | TREAQKRT | 70.94 | TREAQKRA | 28.83 | | | | | | |
| NS4B | 2383 | 0.88 | 5 | 2 | 0 | Y | REAQKRTA | 70.94 | REAQKRAA | 28.95 | | | | | | |
| NS4B | 2384 | 0.88 | 5 | 2 | 0 | Y | EAQKRTAA | 70.98 | EAQKRAAA | 28.91 | | | | | | |
| NS4B | 2385 | 0.88 | 5 | 2 | 0 | Y | AQKRTAAG | 70.98 | AQKRAAAG | 28.91 | | | | | | |
| NS4B | 2386 | 0.89 | 6 | 2 | 0 | Y | QKRTAAGI | 70.94 | QKRAAAGI | 28.91 | | | | | | |

FIG. 18-51

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2387 | 0.88 | 5 | 2 | 0 | Y | KRTA

FIG. 18-52

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2417 | 1 | 3 | 2 | 0 | Y | EKQLGQVM | 55.64 | EKQLGQIM | 44.25 | | | | |
| NS4B | 2418 | 1 | 3 | 2 | 0 | Y | KQLGQVML | 55.64 | K

FIG. 18-53

Species: DENVall (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2446 | 1.09 | 9 | 3 | 0 | Y | LTLATGPL | 54.35 | LTLATGPL | 44.43 | LTLATGPV | 0.96 | | |
| NS4B | 2447 | 1.8 | 14 | 5 | 0 | Y | TLATGPLT | 44.43 | TLATGPIS | 30.01 | TLATGPIT | 20.8 | TLATGPIL | 3.17 | TLATGPVS | 0.74 |
| NS4B | 2448 | 1.8 | 14 | 5 | 0 | Y | LATGPLIT | 44.43 | LATGPIST | 30.01 | LATGPITT | 20.8 | LATGPILT | 3.17 | LATGPVST | 0.74 |
| NS4B | 2449 | 1.8 | 13 | 5 | 0 | Y | ATGPLITL | 44.43 | ATGPISTL | 30.05 | ATGPITTL | 20.8 | ATGPILTL | 3.17 | ATGPVSTL | 0.74 |
| NS4B | 2450 | 1.8 | 13 | 5 | 0 | Y | TGPLITLW | 44.43 | TGPISTLW | 30.05 | TGPITTLW | 20.8 | TGPILTLW | 3.17 | TGPVSTLW | 0.74 |
| NS4B | 2451 | 1.79 | 12 | 5 | 0 | Y | GPLITLWE | 44.51 | GPISTLWE | 30.05 | GPITTLWE | 20.8 | GPILTLWE | 3.17 | GPVSTLWE | 0.74 |
| NS4B | 2452 | 1.79 | 12 | 5 | 0 | Y | PLITLWEG | 44.51 | PISTLWEG | 30.05 | PITTLWEG | 20.8 | PILTLWEG | 3.17 | PVSTLWEG | 0.74 |
| NS4B | 2453 | 1.8 | 13 | 5 | 0 | Y | LTTLWEGS | 44.51 | ISTLWEGN | 30.05 | ITTLWEGS | 20.8 | ILTLWEGN | 3.17 | VSTLWEGN | 0.74 |
| NS4B | 2454 | 1.14 | 7 | 3 | 0 | Y | TTLWEGSP | 65.38 | STLWEGNP | 29.9 | LTLWEGNP | 3.39 | | |
| NS4B | 2455 | 0.94 | 4 | 2 | 0 | Y | TLWEGSPG | 65.52 | TLWEGNPG | 30.64 | | | |
| NS4B | 2456 | 1 | 6 | 2 | 0 | Y | LWEGSPGK | 65.38 | LWEGNPGR | 34.4 | | | |
| NS4B | 2457 | 1 | 7 | 2 | 0 | Y | WEGSPGKF | 65.38 | WEGNPGRF | 33.78 | | | |
| NS4B | 2458 | 1 | 6 | 2 | 0 | Y | EGSPGKFW | 65.38 | EGNPGRFW | 33.74 | | | |
| NS4B | 2459 | 1 | 6 | 2 | 0 | Y | GSPGKFWN | 65.38 | GNPGRFWN | 33.78 | | | |
| NS4B | 2460 | 1 | 6 | 2 | 0 | Y | SPGKFWNT | 65.38 | NPGRFWNT | 33.78 | | | |
| NS4B | 2461 | 0.93 | 3 | 2 | 0 | Y | PGKFWNTT | 66 | PGRFWNTT | 33.78 | | | |
| NS4B | 2462 | 0.93 | 3 | 2 | 0 | Y | GKFWNTTI | 66 | GRFWNTTI | 33.96 | | | |

FIG. 18-54

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2471 | 0.24 | 3 | 2 | 0 | Y | VSMANIFR | 96.17 | VSTANIFR | 3.8 | | | | |
| NS4B | 2472 | 0.24 | 3 | 2 | 0 | Y | SMANIFRG | 96.17 | STANIFRG | 3.8 | | | | |
| NS4B | 2473 | 0.25 | 4 | 2 | 0 | Y | MANIFRGS | 96.09 | TANIFRGS | 3.8 | | | | |
| NS4B | 2474 | 0.01 | 3 | 1 | 0 | Y | ANIFRGSY | 99.89 | | | | | | |
| NS4B | 2475 | 0.02 | 4 | 1 | 0 | Y | NIFRGSYL | 99.82 | | | | | | |
| NS4B | 2476 | 0.02 | 4 | 1 | 0 | Y | IFRGSYLA | 99.82 | | | | | | |
| NS4B | 2477 | 0.02 | 4 | 1 | 0 | Y | FRGSYLAG | 99.82 | | | | | | |
| NS4B | 2478 | 0.04 | 6 | 1 | 0 | Y | RGSYLAGA | 99.71 | | | | | | |
| NS4B | 2479 | 0.04 | 7 | 1 | 0 | Y | GSYLAGAG | 99.63 | | | | | | |
| NS4B | 2480 | 0.04 | 7 | 1 | 0 | Y | SYLAGAGL | 99.63 | | | | | | |
| NS4B | 2481 | 0.93 | 8 | 2 | 0 | Y | YLAGAGLA | 68.88 | YLAGAGLL | 30.79 | | | | |
| NS4B | 2482 | 0.93 | 9 | 2 | 0 | Y | LAGAGLAF | 68.84 | LAGAGLLF | 30.79 | | | | |
| NS4B | 2483 | 0.93 | 10 | 2 | 0 | Y | AGAGLAFS | 68.92 | AGAGLLFS | 30.72 | | | | |
| NS4B | 2484 | 1.56 | 14 | 3 | 0 | Y | GAGLAFSL | 48.16 | GAGLLFSI | 30.68 | GAGLAFSI | 20.61 | | |
| NS4B | 2485 | 1.76 | 16 | 4 | 0 | Y | AGLAFSLM | 44.36 | AGLLFSIM | 30.64 | AGLAFSIM | 20.61 | AGLAFSLI | 3.8 |
| NS4B | 2486 | 1.79 | 15 | 5 | 0 | Y | GLAFSLMK | 44.4 | GLLFSIMK | 30.13 | GLAFSIMK | 20.65 | GLAFSLIK | 3.8 |
| NS4B | 2487 | 1.79 | 14 | 4 | 0 | Y | LAFSLMKS | 44.51 | LLFSIMKN | 30.13 | LAFSIMKS | 20.61 | LAFSLIKN | 3.8 |
| NS4B | 2488 | 1.79 | 18 | 5 | 0 | Y | AFSLMKSL | 44.51 | LFSIMKNT | 30.09 | AFSIMKSV | 20.61 | AFSLIKNA | 3.58 |
| NS5 | 2505 | 1.38 | 11 | 5 | 0.11 | Y | QGETLGEK | 65.19 | IGETLGEK | 24.82 | TGETLGEK | 5.83 | MGETLGEK | 3.02 |
| NS5 | 2506 | 0.02 | 4 | 1 | 0 | Y | GETLGEKW | 99.85 | | | | | | |
| NS5 | 2507 | 0.01 | 3 | 1 | 0 | Y | ETLGEKWK | 99.89 | | | | | | |
| NS5 | 2508 | 1.63 | 8 | 4 | 0 | Y | TLGEKWKR | 48.41 | TLGEKWKS | 28.69 | TLGEKWKK | 20.61 | TLGEKWKN | 2.06 |
| NS5 | 2509 | 1.68 | 13 | 4 | 0 | Y | LGEKWKRQ | 48.27 | LGEKWKSR | 28.54 | LGEKWKKK | 20.35 | LGEKWKNR | 2.06 |
| NS5 | 2510 | 1.68 | 13 | 4 | 0 | Y | GEKWKRQL | 48.27 | GEKWKSRL | 28.54 | GEKWKKKL | 20.35 | GEKWKNRL | 2.06 |
| NS5 | 2511 | 1.68 | 13 | 4 | 0 | Y | EKWKRQLN | 48.27 | EKWKSRLN | 28.54 | EKWKKKLN | 20.35 | EKWKNRLN | 2.06 |

Additional columns (peptides required to cover 99% of block / frequency):
- Row 2485: AGLAFSLI / 3.8
- Row 2486: GLAFSLIK / 3.8
- Row 2487: LAFSLIKN / 3.8
- Row 2488: AFSLIKNA / 3.58

Further columns:
- Row 2486: GLLFSIMR / 0.52
- Row 2487: LFSIMRNT / 0.52
- Row 2488: VGETLGEK / 0.88

FIG. 18-55

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 18-56

Species: DENVall (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2575 | 1.59 | 9 | 3 | 0 | Y | GKVIDLGC | 44.54 | GKVVDLGC | 33.74 | GRVIDLGC | 20.83 | | | | |
| NS5 | 2576 | 1.6 | 10 | 3 | 0 | Y | KVIDLGCG | 44.54 | KVVDLGCG | 33.7 | RVIDLGCG | 20.83 | | | | |
| NS5 | 2577 | 1 | 8 | 2 | 0 | Y | VIDLGCGR | 65.38 | VVDLGCGR | 33.74 | | | | | | |
| NS5 | 2578 | 1 | 7 | 2 | 0 | Y | IDLGCGRG | 65.38 | VDLGCGRG | 33.74 | | | | | | |
| NS5 | 2579 | 0.01 | 4 | 1 | 0 | Y | DLGCGRGG | 99.89 | | | | | | | | |
| NS5 | 2580 | 0.01 | 4 | 1 | 0 | Y | LGCGRGGW | 99.89 | | | | | | | | |
| NS5 | 2581 | 0.01 | 4 | 1 | 0 | Y | GCGRGGWS | 99.89 | | | | | | | | |
| NS5 | 2582 | 0.01 | 4 | 1 | 0 | Y | CGRGGWSY | 99.89 | | | | | | | | |
| NS5 | 2583 | 0.01 | 4 | 1 | 0 | Y | GRGGWSYY | 99.89 | | | | | | | | |
| NS5 | 2584 | 0.25 | 5 | 2 | 0 | Y | RGGWSYYC | 96.13 | | | RGGWSYYM | 3.76 | | | | |
| NS5 | 2585 | 1.12 | 6 | 3 | 0 | Y | GGWSYYCA | 65.34 | GGWSYYCG | 30.79 | GGWSYYMA | 3.76 | | | | |
| NS5 | 2586 | 1.12 | 6 | 3 | 0 | Y | GWSYYCAG | 65.34 | GWSYYCGG | 30.79 | GWSYYMAT | 3.76 | | | | |
| NS5 | 2587 | 1.11 | 6 | 3 | 0 | Y | WSYYCAGL | 65.38 | WSYYCGGL | 30.75 | WSYYMATL | 3.76 | | | | |
| NS5 | 2588 | 1.13 | 6 | 3 | 0 | Y | SYYCAGLK | 65.34 | SYYCGGLK | 30.64 | SYYMATLK | 3.76 | | | | |
| NS5 | 2589 | 1.22 | 9 | 4 | 0 | Y | YYCAGLKK | 65.27 | YYCGGLKN | 29.46 | YYMATLKN | 3.76 | YYCGGLKD | — | | |
| NS5 | 2590 | 1.23 | 12 | 4 | 0 | Y | YCAGLKKV | 65.19 | YCGGLKNV | 29.46 | YMATLKNV | 3.76 | YCGGLKDV | — | | |
| NS5 | 2591 | 1.33 | 14 | 4 | 0.04 | Y | CAGLKKVT | 65.15 | CGGLKNVR | 27.62 | MATLKNVT | 3.76 | CGGLKNVK | 1.88 | CGGLKDVR | — |
| NS5 | 2592 | 1.33 | 15 | 4 | 0.07 | Y | AGLKKVTE | 65.15 | GGLKNVRE | 27.58 | ATLKNVTE | 3.76 | GGLKNVKE | 1.88 | GGLKDVRE | — |
| NS5 | 2593 | 1.33 | 15 | 5 | 0.07 | Y | GLKKVTEV | 65.12 | GLKNVREV | 27.58 | TLKNVTEV | 3.8 | GLKNVKEV | 1.88 | GLKDVREV | — |
| NS5 | 2597 | 1.63 | 15 | 5 | 0.07 | Y | VTEVKGYT | 48.08 | VREVKGYT | 28.91 | VTEVRGYT | 3.8 | VKEVKGLT | 1.88 | | |
| NS5 | 2598 | 1.64 | 9 | 4 | 0.07 | Y | TEVKGYTK | 48.12 | REVKGYTK | 28.83 | TEVRGYTK | 20.8 | KEVKGLTK | 1.88 | | |
| NS5 | 2599 | 1.54 | 9 | 4 | 0.07 | Y | EVKGYTKG | 48.12 | EVKGYTKG | 30.68 | EVRGYTKG | 20.8 | | | | |
| NS5 | 2600 | 1.54 | 11 | 3 | 0.07 | Y | VKGYTKGG | 48.08 | VKGLTKGG | 30.72 | VRGYTKGG | 20.8 | | | | |
| NS5 | 2601 | 1.58 | 11 | 3 | 0.07 | Y | KGYTKGGP | 47.64 | KGLTKGG | 30.72 | RGYTKGGP | 20.8 | | | | |
| NS5 | 2602 | 0.98 | | 2 | 0.04 | Y | GYTKGGPG | 68.44 | GLTKGGPG | 30.72 | | | | | | |

FIG. 18-57

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover

FIG. 18-58

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block

FIG. 18-59

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2664 | 1.05 | 12 | 3 | 0 | Y | VLKMVEPW | 68.95 | VLNLVENW | 28.54 | VLSLVENW | 2.06 | | |
| NS5 | 2665 | 1.03 | 7 | 3 | 0 | Y | LKMVEPWL | 69.06 | LNLVENWL | 28.58 | LSLVENWL | 2.1 | | |
| NS5 | 2666 | 1.87 | 14 | 5 | 0 | Y | KMVEPWLR | 45.39 | NLVENWLN | 27.91 | KMVEPWLK | 19.87 | KMVEPWLS | 3.76 |
| NS5 | 2677 | 1.35 | 6 | 4 | 0 | Y | QFCIKVLN | 48.78 | QFCIKILN | 44.73 | EFCIKVLN | 3.8 | QFCVKVLN | 2.58 |
| NS5 | 2678 | 1.15 | 4 | 3 | 0 | Y | FCIKVLNP | 52.65 | FCIKILNP | 44.73 | FCVKVLNP | 2.58 | | |
| NS5 | 2679 | 1.15 | 4 | 3 | 0 | Y | CIKVLNPY | 52.65 | CIKILNPY | 44.73 | CVKVLNPY | 2.58 | | |
| NS5 | 2680 | 1.15 | 4 | 2 | 0 | Y | IKVLNPYM | 52.65 | IKILNPYM | 44.73 | VKVLNPYM | 2.58 | | |
| NS5 | 2681 | 1 | 4 | 4 | 0 | Y | KVLNPYMP | 55.2 | KILNPYMP | 44.73 | | | | |
| NS5 | 2682 | 1.68 | 11 | 3 | 0 | Y | ILNPYMPS | 44.36 | VLNPYMPS | 30.83 | VLNPYMPT | 22.82 | VLNPYMPA | 1.29 |
| NS5 | 2683 | 0.92 | 8 | 4 | 0 | Y | LNPYMPSV | 75.18 | LNPYMPTV | 23.12 | LNPYMPAV | 1.29 | | |
| NS5 | 2684 | 1.68 | 11 | 4 | 0 | Y | NPYMPSVI | 44.43 | NPYMPTVI | 30.75 | NPYMPAVI | 1.29 | | |
| NS5 | 2685 | 1.68 | 10 | 4 | 0 | Y | PYMPSVIE | 44.43 | PYMPTVIE | 30.79 | PYMPAVIE | 1.29 | | |
| NS5 | 2701 | 1.46 | 14 | 5 | 0 | Y | HGGMLVRN | 60.29 | YGGMLVRN | 30.09 | HGGNLVRC | 3.1 | FGGALVRN | 0.59 |
| NS5 | 2702 | 1.15 | 10 | 3 | 0 | Y | GGMLVRNP | 65.27 | GGALVRNP | 30.79 | GNLVRCP | 3.1 | | |
| NS5 | 2703 | 1.15 | 10 | 3 | 0 | Y | GMLVRNPL | 65.27 | GALVRNPL | 30.79 | GNLVRCPL | 3.1 | | |
| NS5 | 2704 | 1.16 | 10 | 3 | 0 | Y | MLVRNPLS | 65.23 | ALVRNPLS | 30.79 | NLVRCPLS | 3.1 | | |
| NS5 | 2705 | 0.27 | 9 | 2 | 0 | Y | LVRNPLSR | 95.98 | LVRCPLSR | 3.69 | | | | |
| NS5 | 2706 | 0.26 | 8 | 2 | 0 | Y | VRNPLSRN | 96.02 | VRCPLSRN | 3.69 | | | | |
| NS5 | 2707 | 0.26 | 7 | 2 | 0 | Y | RNPLSRNS | 96.02 | RCPLSRNS | 3.8 | | | | |
| NS5 | 2708 | 0.27 | 8 | 2 | 0 | Y | NPLSRNST | 95.87 | CPLSRNST | 3.8 | | | | |
| NS5 | 2709 | 0.03 | 5 | 1 | 0 | Y | PLSRNSTH | 99.74 | | | | | | |
| NS5 | 2710 | 0.03 | 6 | 1 | 0 | Y | LSRNSTHE | 99.71 | | | | | | |
| NS5 | 2711 | 0.03 | 6 | 1 | 0 | Y | SRNSTHEM | 99.71 | | | | | | |
| NS5 | 2712 | 0.04 | 7 | 1 | 0 | Y | RNSTHEMY | 99.63 | | | | | | |
| NS5 | 2713 | 0.04 | 7 | 1 | 0 | Y | NSTHEMYW | 99.63 | | | | | | |

FIG. 18-60

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2714 | 0.78 | 10 | 2 | 0 | Y | STHEMYWV | 78.83 | STHEMYWI | 20.76 | | | | |
| NS5 | 2715 | 0.78 | 10 | 2 | 0 | Y | THEMYWVS | 78.83 | THEMYWIS | 20.76 | | | | |
| NS5 | 2716 | 1.72 | 10 | 4 | 0 | Y | HEMYWVSC | 44.51 | HEMYWISN | 30.72 | HEMYWVSG | 3.8 | | |
| NS5 | 2717 | 1.73 | 10 | 4 | 0 | Y | EMYWVSCG | 44.51 | EMYWISNG | 30.75 | EMYWVSGA | 3.58 | | |
| NS5 | 2718 | 2.04 | 12 | 5 | 0 | Y | MYWVSCGT | 44.51 | MYWVSNAT | 20.65 | MYWVSNAS | 13.94 | MYWVSGAS | 3.54 |
| NS5 | 2719 | 2.04 | 12 | 5 | 0 | Y | YWVSCGTG | 44.51 | YWVSNATG | 20.65 | YWVSNASG | 13.94 | YWVSGASG | 3.54 |
| NS5 | 2720 | 2.03 | 9 | 5 | 0 | Y | WVSCGTGN | 44.54 | WVSNATGN | 20.72 | WVSNASGN | 13.94 | WVSGASGN | 3.54 |
| NS5 | 2721 | 2.04 | 10 | 5 | 0 | Y | VSCGTGNI | 44.54 | VSNATGNI | 20.72 | VSNASGNI | 13.86 | VSGASGNI | 3.54 |
| NS5 | 2722 | 2.03 | 9 | 5 | 0 | Y | SCGTGNIV | 44.54 | SNATGNIV | 20.72 | SNASGNIV | 13.9 | SGASGNIV | 3.54 |
| NS5 | 2724 | 2.11 | 9 | 4 | 0 | Y | GTGNIVSA | 44.54 | ATGNIVSS | 17.44 | GTGNIVAS | 10.69 | GTGNIVSS | 10.03 |
| NS5 | 2725 | 1.85 | 7 | 3 | 0 | Y | TGNIVSAV | 44.43 | SGNIVSSY | 26.84 | TGNIVASY | 10.69 | | |
| NS5 | 2726 | 1.41 | 9 | 4 | 0 | Y | GNIVSSYN | 44.51 | GNIVASYN | 44.43 | | | | |
| NS5 | 2727 | 1.61 | 12 | 5 | 0 | Y | NIVSAYNM | 44.43 | NIVASYNM | 40.63 | NIVSSYNT | 3.87 | IVSSVNTT | |
| NS5 | 2728 | 1.96 | 11 | 5 | 0 | Y | IVSAVNMT | 44.43 | IVASYNMV | 30.72 | IVSSVNMV | 9.92 | VSSVNTTS | |
| NS5 | 2729 | 1.95 | 12 | 5 | 0 | Y | VSAVNMTS | 44.43 | VASVNMVS | 30.79 | VSSVNMVS | 9.92 | SSVNTTSK | |
| NS5 | 2730 | 1.95 | 12 | 4 | 0 | Y | SAVNMTSR | 44.43 | ASVNMVSR | 30.79 | SSVNMVSR | 9.92 | | |
| NS5 | 2731 | 1.75 | 11 | 4 | 0 | Y | AVNMTSRM | 44.43 | SVNMVSRL | 30.72 | SVNTTSKM | 20.69 | | |
| NS5 | 2732 | 1.75 | 10 | 4 | 0 | Y | VNMTSRML | 44.54 | VNMVSRLL | 30.75 | VNTTSKML | 20.69 | | |
| NS5 | 2733 | 1.74 | 10 | 4 | 0 | Y | NMTSRMLL | 44.54 | NMVSRLLL | 30.72 | N

FIG. 18-61

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2750 | 1.84 | 14 | 5 | 0 | Y | PTYERDVD | 42.99 | ATYEPDVD | 30.53 | PTIEKDVD | 20.54 | PTYEKDVD | 4.54 | PTFERDVD | 0.66 |
| NS5

FIG. 18-62

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2796 | 1.73 | 9 | 4 | 0 | Y | EDNPYKTW | 44.54 | QDHPYKTW | 30.64 | DENPYKTW | 20.69 | | |
| NS5 | 2797 | 1.71 | 6 | 4 | 0 | Y | DNPYKTWA | 44.54 | DHPYKTWA | 30.64 | ENPYKTWA | 20.8 | QENPYKTW | 3.72 |
| NS5 | 2798 | 1.12 | 5 | 3 | 0 | Y | NPYKTWAY | 65.34 | HPYKTWAY | 30.64 | NPYKTWAY | 3.83 | ENPYKTWA | 3.83 |
| NS5 | 2799 | 0.24 | 2 | 2 | 0 | Y | PYKTWAYH | 96.02 | PYRTWAYH | 3.98 | | | | |
| NS5 | 2800 | 0.24 | 2 | 2 | 0 | Y | YKTWAYHG | 96.02 | YRTWAYHG | 3.98 | | | | |
| NS5 | 2801 | 0.24 | 2 | 2 | 0 | Y | KTWAYHGS | 96.02 | RTWAYHGS | 3.98 | | | | |
| NS5 | 2802 | 0 | 1 | 1 | 0 | Y | TWAYHGSY | 100 | | | | | | |
| NS5 | 2803 | 0 | 1 | 1 | 0 | Y | WAYHGSYE | 99.96 | | | | | | |
| NS5 | 2804 | 1.12 | 5 | 3 | 0 | Y | AYHGSYEV | 65.27 | AYHGSYET | 30.79 | AYHGSYEA | 3.87 | | |
| NS5 | 2805 | 1.14 | 5 | 3 | 0 | Y | YHGSYEVK | 65.15 | YHGSYETK | 30.75 | YHGSYEAP | 3.76 | | |
| NS5 | 2806 | 1.74 | 9 | 4 | 0 | Y | HGSYEVKP | 44.25 | HGSYETKQ | 30.75 | HGSYEVKA | 20.83 | HGSYEAPS | 3.76 |
| NS5 | 2807 | 1.74 | 12 | 4 | 0 | Y | GSYEVKPS | 44.21 | GSYETKQT | 30.75 | GSYEVKAT | 20.83 | GSYEAPST | 3.76 |
| NS5 | 2808 | 1.74 | 13 | 4 | 0 | Y | SYEVKPSG | 44.21 | SYETKQTG | 30.75 | SYEVKATG | 20.83 | SYEAPSTG | 3.76 |
| NS5 | 2809 | 1.74 | 13 | 4 | 0 | Y | YEVKPSGS | 44.21 | YETKQTGS | 30.75 | YEVKATGS | 20.83 | YEAPSTGS | 3.76 |
| NS5 | 2810 | 1.74 | 13 | 4 | 0 | Y | EVKPSGAS | 44.21 | ETKQTGSA | 30.75 | EVKATGSA | 20.83 | EAPSTGSA | 3.72 |
| NS5 | 2811 | 1.74 | 14 | 4 | 0 | Y | VKPSGASS | 44.25 | TKQTGSAS | 30.75 | VKATGSAS | 20.83 | APSTGSAS | 3.72 |
| NS5 | 2812 | 1.74 | 13 | 4 | 0 | Y | KPSGASSS | 44.32 | KQTGSASS | 30.75 | KATGSASS | 20.83 | PSTGSASS | 3.72 |
| NS5 | 2813 | 1.73 | 11 | 4 | 0 | Y | PSGASSM | 44.43 | QTGSASSM | 30.75 | ATGSASSM | 20.83 | STGSASSM | 3.76 |
| NS5 | 2814 | 1.54 | 8 | 3 | 0 | Y | SGSASSMV | 44.47 | TGSASSMV | 34.51 | TGSASSMI | 20.87 | | |
| NS5 | 2815 | 0.76 | 7 | 2 | 0 | Y | GSASSMVN | 78.95 | GSASSMIN | 20.87 | | | | |
| NS5 | 2816 | 0.76 | 6 | 2 | 0 | Y | SASSMVNG | 78.95 | SASSMING | 20.87 | | | | |
| NS5 | 2817 | 0.76 | 6 | 2 | 0 | Y | ASSMVNGV | 78.95 | ASSMINGV | 20.87 | | | | |
| NS5 | 2818 | 0.77 | 6 | 2 | 0 | Y | SSMVNGVV | 78.91 | SSMINGVV | 20.87 | | | | |
| NS5 | 2819 | 1.55 | 8 | 3 | 0 | Y | SMVNGVVR | 39.75 | SMVNGVVK | 39.16 | SMINGVVK | 20.87 | | |
| NS5 | 2820 | 1.55 | 7 | 3 | 0 | Y | MVNGVVRL | 39.79 | MVNGVVKL | 39.16 | MINGVVKL | 20.87 | | |

FIG. 18-63

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|

FIG. 18-64

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2848 | 0.01 | 4 | 1 | 0.04 | Y | PFGQQRVF | 99.85 | | | | | | |
| NS5 | 2849 | 0.02 | 5 | 1 | 0.04 | Y | FGQQRVFK | 99.82 | | | | | | |
| NS5 | 2850 | 0.03 | 5 | 1 | 0.04 | Y | GQQRVFKE | 99.67 | | | | | | |
| NS5 | 2851 | 0.03 | 5 | 1 | 0.04 | Y | QQRVFKEK | 99.67 | | | | | | |
| NS5 | 2852 | 0.03 | 4 | 1 | 0 | Y | Q

FIG. 18-65

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 18-67

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2975 | 0.01 | 4 | 1 | 0 | Y | WYMWLGAR | 99.89 | | | | | | |
| NS5 | 2976 | 0.74 | 5 | 2 | 0 | Y | YMWLGARF | 79.61 | YMWLGARY | 20.28 | | | | |
| NS5 | 2977 | 0.74 | 5 | 2 | 0 | Y | MWLGARFL | 79.61 | MWLGARYL | 20.28 | | | | |
| NS5 | 2978 | 0.74 | 4 | 2 | 0 | Y | WLGARFLE | 79.65 | WLGARYLE | 20.28 | | | | |
| NS5 | 2979 | 0.74 | 4 | 2 | 0 | Y | LGARFLEF | 79.65 | LGARYLEF | 20.28 | | | | |
| NS5 | 2980 | 0.74 | 5 | 2 | 0 | Y | GARFLEFE | 79.65 | GARYLEFE | 20.28 | | | | |
| NS5 | 2981 | 0.74 | 4 | 2 | 0 | Y | ARFLEFEA | 79.61 | ARYLEFEA | 20.28 | | | | |
| NS5 | 2982 | 0.74 | 3 | 2 | 0 | Y | RFLEFEAL | 79.61 | RYLEFEAL | 20.32 | | | | |
| NS5 | 2983 | 0.73 | 2 | 1 | 0 | Y | FLEFEALG | 79.65 | YLEFEALG | 20.32 | | | | |
| NS5 | 2984 | 0 | 2 | 1 | 0 | Y | LEFEALGF | 99.96 | | | | | | |
| NS5 | 2985 | 1 | 5 | 2 | 0 | Y | EFEALGFL | 55.38 | EFEALGFM | 44.51 | | | | |
| NS5 | 2986 | 1 | 5 | 2 | 0 | Y | FEALGFLN | 55.38 | FEALGFMN | 44.51 | | | | |
| NS5 | 2987 | 1 | 5 | 2 | 0 | Y | EALGFLNE | 55.38 | EALGFMNE | 44.51 | | | | |
| NS5

FIG. 18-68

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3000 | 1.62 | 12 | 5 | 0 | Y | RENSLSGV

FIG. 18-69

Species: DENVall (8-mers)

| protein | block starting position | block entropy | total peptides in block | # peptides required to cover 99% of block | gap/X fraction | 99% of block covered w/ <= 5 peptides?

FIG. 18-70

Species: DENVall (8-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3095 | 0.88 | 4 | 2 | 0 | Y | RRDQRGSG | 70.98 | RKDQRGSG | 28.91 | | | | |
| NS5 | 3096 | 0.88 | 3 | 2 | 0 | Y | RDQRGSGQ | 71.02 | KDQRGSGQ | 28.91 | | | | |
| NS5 | 3097 | 0.02 | 3 | 1 | 0 | Y | DQRGSGQV | 99.85 | | | | | | |
| NS5 | 3098 | 0.14 | 4 | 2 | 0 | Y | QRGSGQVG | 98.19 | QRGSGQW | 1.7 | | | | |
| NS5 | 3099 | 0.14 | 4 | 2 | 0 | Y | RGSGQVGT | 98.19 | RGSGQWT | 1.7 | | | | |
| NS5 | 3100 | 0.14 | 5 | 2 | 0 | Y | GSGQVGTY | 98.19 | GSGQWTY | 1.7 | | | | |
| NS5 | 3101 | 0.15 | 5 | 2 | 0 | Y | SGQVGTYG | 98.05 | SGQWTYG | 1.7 | | | | |
| NS5 | 3102 | 0.15 | 5 | 2 | 0 | Y | GQVGTYGL | 98.05 | GQWTYGL | 1.7 | | | | |
| NS5 | 3103 | 0.15 | 5 | 2 | 0 | Y | QVGTYGLN | 98.05 | QWTYGLN | 1.7 | | | | |
| NS5 | 3104 | 0.15 | 5 | 2 | 0 | Y | VGTYGLNT | 98.05 | WTYGLNT | 1.7 | | | | |
| NS5 | 3113 | 0.66 | 9 | 2 | 0 | Y | FTNMEAQL | 85.99 | FTNMEVQL | 13.02 | | | | |
| NS5 | 3114 | 1.04 | 11 | 4 | 0 | Y | TNMEAQLI | 78.36 | TNMEVQLI | 12.94 | TNMEAQLV | 7.63 | TNMGAQLI | 0.52 | |
| NS5 | 3115 | 1.03 | 10 | 4 | 0 | Y | NMEAQLIR | 78.39 | NMEVQLIR | 12.94 | NMEAQLVR | 7.63 | NMGAQLIR | 0.52 | |
| NS5 | 3116 | 1.03 | 10 | 4 | 0 | Y | MEAQLIRQ | 78.43 | MEVQLIRQ | 12.91 | MEAQLVRQ | 7.63 | MGAQLIRQ | 0.52 | |
| NS5 | 3117 | 1.01 | 8 | 3 | 0 | Y | EAQLIRQM | 78.58 | EVQLIRQM | 12.94 | EAQLVRQM | 7.63 | | | |
| NS5 | 3118 | 0.96 | 7 | 3 | 0 | Y | AQLIRQME | 79.06 | VQLIRQME | 13.13 | AQLVRQME | 7.63 | | | |
| NS5 | 3119 | 1.52 | 8 | 4 | 0 | Y | QLIRQMES | 44.43 | QLIRQMEG | 43.95 | QLVRQMEG | 7.67 | QLIRQMEA | 3.8 | |
| NS5 | 3120 | 1.52 | 8 | 4 | 0 | Y | LIRQMESE | 44.43 | LIRQMEGE | 43.95 | LVRQMEGE | 7.67 | LIRQMEAE | 3.8 | |
| NS5 | 3121 | 1.57 | 12 | 4 | 0 | Y | IRQMESEG | 44.06 | IRQMEGEG | 43.92 | VRQMEGEG | 7.56 | IRQMEAEG | 3.8 | |
| NS5 | 3122 | 1.76 | 11 | 5 | 0 | Y | RQMESEGI | 44.1 | RQMEGEGV | 34.07 | RQMEGEGI | 16.81 | RQMEAEGV | 3.8 | RQMEGEGL | 0.59 |
| NS5 | 3156 | 1.33 | 12 | 5 | 0 | Y | ERLKRMAI | 63.24 | ERLSRMAI | 29.9 | DRLKRMAI | 3.83 | ERLRRMAI | 1.95 | ERLARMAI | 0.41 |
| NS5 | 3157 | 1.1 | 10 | 3 | 0 | Y | RLKRMAIS | 67.18 | RLSRMAIS | 29.9 | RLRRMAIS | 1.95 | | | |
| NS5 | 3158 | 1.1 | 10 | 3 | 0 | Y | LKRMAISG | 67.18 | LSRMAISG | 29.9 | LRRMAISG | 1.95 | | | |
| NS5 | 3159 | 1.1 | 10 | 3 | 0 | Y | KRMAISGD | 67.18 | SRMAISGD | 29.9 | RRMAISGD | 1.95 | | | |
| NS5 | 3160 | 0.02 | 4 | 1 | 0 | Y | RMAISGDD | 99.82 | | | | | | |

FIG. 18-71

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3161 | 0.02 | 4 | 1 | 0 | Y | MAISGDDC | 99.82 | | | | | | |
| NS5 | 3162 | 0.02 | 4 | 1 | 0 | Y | AISGDDCV | 99.82 | | | | | | |
| NS5 | 3163 | 0.01 | 3 | 1 | 0 | Y | ISGDDCVW | 99.89 | | | | | | |
| NS5 | 3164 | 0.01 | 2 | 1 | 0 | Y | SGDDCVWK | 99.93 | |

FIG. 18-72

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3195 | 1.78 | 7 | 4 | 0 | Y | PQWEPSKG | 48.3 | QQWEPSRG | 22.35 | PQWQPSKG | 20.76 | QQWEPSKG | 8.44 |
| NS5 | 3196 | 1.43 | 6 | 3 | 0 | Y | QWEPSKGW | 56.75 | QWEPSRGW | 22.38 | QWQPSKGW | 20.72 | WEPSKGWK | 3.8 | WEPSKGWS | 0.55 |
| NS5 | 3197 | 1.71 | 12 | 5 | 0 | Y | WEPSKGWN | 52.36 | WEPSRGWN | 22.31 | WQPSKGWH | 20.43 | EPSKGWKN | 3.8 | EPSKGWSD | 0.55 |
| NS5 | 3198 | 1.72 | 13 | 5 | 0 | Y | EPSKGWND | 52.29 | EPSRGWND | 22.31 | QPSKGWHD | 20.43 | PSKGWKNW | 3.8 | PSKGWSDW | 0.55 |
| NS5 | 3199 | 1.72 | 12 | 5 | 0 | Y | PSKGWNDW | 52.32 | PSRGWNDW | 22.31 | PSKGWHDW | 20.43 | GWKNWQEV | 3.8 | GWSDWTQV | 0.59 |
| NS5 | 3202 | 1.79 | 12 | 5 | 0 | Y | GWNDWQQV | 44.4 | GWNDWTQV | 30.16 | GWHDWQQV | 20.5 | WKNWQEVP | 3.8 | WSDWTQYP | 0.59 |
| NS5 | 3203 | 1.79 | 13 | 5 | 0 | Y | WNDWQQYP | 44.36 | WNDWTQVP | 30.16 | WHDWQQYP | 20.5 | KNWQEVPF | 3.8 | SDWTQVPF | 0.59 |
| NS5 | 3204 | 1.79 | 12 | 5 | 0 | Y | NDWQQYPF | 44.36 | NDWTQVPF | 30.16 | HDWQQYPF | 20.54 | | | |
| NS5 | 3205 | 1.14 | 8 | 3 | 0 | Y | DWQQYPFC | 65.08 | DWTQVPFC | 30.83 | NWQEVPFC | 3.8 | | | |
| NS5 | 3206 | 1.13 | 7 | 3 | 0 | Y | WQQYPFCS | 65.15 | WTQVPFCS | 30.83 | WQEVPFCS | 3.8 | | | |
| NS5 | 3207 | 1.13 | 7 | 3 | 0 | Y | QQYPFCSH | 65.15 | TQVPFCSH | 30.83 | QEVPFCSH | 3.8 | | | |
| NS5 | 3208 | 0.26 | 6 | 2 | 0 | Y | QYPFCSHH | 95.98 | EVPFCSHH | 3.8 | | | | | |
| NS5 | 3209 | 0.03 | 5 | 1 | 0 | Y | VPFCSHHF | 99.78 | | | | | | | |
| NS5 | 3210 | 0.02 | 4 | 1 | 0 | Y | PFCSHHFH | 99.82 | | | | | | | |
| NS5 | 3211 | 1.22 | 7 | 3 | 0 | Y | FCSHHFHE | 51.59 | FCSHHFHQ | 44.36 | FCSHHFHK | 3.76 | | | |
| NS5 | 3212 | 1.23 | 8 | 3 | 0 | Y | CSHHFHEL | 51.51 | CSHHFHQL | 44.4 | CSHHFHKI | 3.76 | | | |
| NS5 | 3213 | 1.67 | 10 | 4 | 0 | Y | SHHFHELI | 44.51 | SHHFHELV | 36.62 | SHHFHELV | 14.9 | SHHFHKIF | 3.72 | |
| NS5 | 3214 | 1.67 | 10 | 4 | 0 | Y | HHFHELIM | 44.51 | HHFHELIM | 36.62 | HHFHELVM | 14.9 | HHFHKIFM | 3.72 | |
| NS5 | 3215 | 1.67 | 10 | 4 | 0 | Y | HFHELIMK | 44.51 | HFHELIMK | 36.62 | HFHELVMK | 14.9 | HFHKIFMK | 3.72 | |
| NS5 | 3216 | 1.67 | 10 | 4 | 0 | Y | FHQLIMKD | 44.51 | FHELIMKD | 36.62 | FHELVMKD | 14.9 | FHKIFMKD | 3.72 | |
| NS5 | 3217 | 1.67 | 10 | 4 | 0 | Y | HQLIMKDG | 44.51 | HELIMKDG | 36.62 | HELVMKDG | 14.9 | HKIFMKDG | 3.72 | |
| NS5 | 3218 | 1.67 | 9 | 4 | 0 | Y | QLIMKDGR | 44.51 | ELIMKDGR | 36.62 | ELVMKDGR | 14.9 | KIFMKDGR | 3.72 | |
| NS5 | 3227 | 1.59 | 7 | 3 | 0 | Y | IVVPCRNQ | 44.36 | LVVPCRNQ | 34.11 | LVVPCRPQ | 20.76 | | | |
| NS5 | 3228 | 0.81 | 2 | 2 | 0 | Y | VVPCRNQD | 78.5 | VVPCRPQD | 20.76 | | | | | |
| NS5 | 3229 | 0.81 | 8 | 2 | 0 | Y | VPCRNQDE | 78.47 | VPCRPQDE | 20.76 | | | | | |

FIG. 18-73

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 18-74

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3255 | 0.82 | 6 | 2 | 0 | Y | ACLGKSYA | 75.26 | ACLGKAYA | 24.59 | | | | | | |
| NS5 | 3256 | 0.82 | 6 | 2 | 0 | Y | CLGKSYAQ | 75.26 | CLGKAYAQ | 24.59 | | | | | | |
| NS5 | 3257 | 0.82 | 5 | 2 | 0 | Y | LGKSYAQM | 75.29 | LGKAYAQM | 24.59 | | | | | | |
| NS5 | 3258 | 0.82 | 6 | 2 | 0 | Y | GKSYAQMW | 75.26 | GKAYAQMW | 24.59 | | | | | | |
| NS5 | 3259 | 1.98 | 10 | 5 | 0 | Y | KSYAQMWQ | 44.51 | KSYAQMWS | 22.42 | KSYAQMWS | 15.93 | KSYAQMWT | 14.82 | KAYAQMWA | 1.95 |
| NS5 | 3260 | 1.98 | 10 | 5 | 0 | Y | SYAQMWQL | 44.51 | AYAQMWSL | 22.42 | SYAQMWSL | 15.93 | SYAQMWTL | 14.82 | AYAQMWAL | 1.95 |
| NS5 | 3261 | 1.6 | 8 | 4 | 0 | Y | YAQMWQLM | 44.51 | YAQMWSLM | 38.24 | YAQMWTLM | 15.01 | YAQMWALM | 1.99 | | |
| NS5 | 3262 | 1.6 | 8 | 4 | 0 | Y | AQMWQLMY | 44.51 | AQMWSLMY | 38.24 | AQMWTLMY | 15.01 | AQMWALMY | 1.99 | | |
| NS5 | 3263 | 1.6 | 7 | 4 | 0 | Y | QMWQLMYF | 44.51 | QMWSLMYF | 38.24 | QMWTLMYF | 15.01 | QMWALMYF | 1.99 | | |
| NS5 | 3264 | 1.6 | 8 | 4 | 0 | Y | MWQLMYFH | 44.47 | MWSLMYFH | 38.27 | MWTLMYFH | 15.01 | MWALMYF | 1.99 | | |
| NS5 | 3265 | 1.61 | 10 | 4 | 0 | Y | WQLMYFHR | 44.43 | WSLMYFHR | 38.27 | WTLMYFHR | 14.97 | WALMYFH | 1.99 | | |
| NS5 | 3266 | 1.6 | 9 | 4 | 0 | Y | QLMYFHRR | 44.47 | SLMYFHRR | 38.27 | TLMYFHRR | 14.97 | ALMYFHRR | 1.99 | | |
| NS5 | 3267 | 0.03 | 4 | 1 | 0 | Y | LMYFHRRD | 99.78 | | | | | | | | |
| NS5 | 3268 | 0.03 | 4 | 1 | 0 | Y | MYFHRRDL | 99.78 | | | | | | | | |
| NS5 | 3269 | 0.01 | 3 | 1 | 0 | Y | YFHRRDLR | 99.89 | | | | | | | | |
| NS5 | 3270 | 0.01 | 3 | 1 | 0 | Y | FHRRDLRL | 99.89 | | | | | | | | |

FIG. 18-75

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|

FIG. 18-76

Species: DENVall (8-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3312 | 1.7 | 8 | 4 | 0 | Y | MLSVWNRV | 44.73 | MLTVWNRV | 35.14 | MLAVWNRV | 15.82 | MLKVWNRV | 3.8 |
| NS5 | 3313 | 1.7 | 8 | 4 | 0 | Y | LSVWNRVW | 44.73 | LTVWNRVW | 35.14 | LAVWNRVW | 15.82 | LKVWNRVW | 3.8 |
| NS5 | 3314 | 1.7 | 8 | 4 | 0 | Y | SVWNRVWI | 44.73 | TVWNRVWI | 35.14 | AVWNRVWI | 15.82 | KVWNRVWI | 3.8 |
| NS5 | 3315 | 1.21 | 9 | 4 | 0 | Y | VWNRVWIE | 69.1 | VWNRVWIQ | 22.86 | VWNRVWIR | 6.9 | VWNRVWIL | 0.66 |
| NS5 | 3323 | 1.06 | 10 | 4 | 0 | Y | ENPWMEDK | 75.7 | DNPWMEDK | 19.51 | DNPNMIDK | 2.25 | DNPNMTDK | 1.55 |
| NS5 | 3324 | 0.36 | 7 | 3 | 0 | Y | NPWMEDKT | 95.28 | NPNMIDKT | 2.25 | NPNMTDKT | 1.55 | | |
| NS5 | 3338 | 2 | 7 | 5 | 0 | Y | DVPYLGKR | 43.4 | EVPYLGKR | 26 | EIPYLGKR | 13.35 | NVPYLGKR | 12.76 |
| NS5 | 3339 | 0.68 | 4 | 2 | 0 | Y | VPYLGKRE | 82.15 | IPYLGKRE | 17.77 | | | | |
| NS5 | 3340 | 0.01 | 3 | 1 | 0 | Y | PYLGKRED | 99.93 | | | | | | |
| NS5 | 3341 | 0.25 | 5 | 2 | 0 | Y | YLGKREDQ | 96.09 | YLGKREDL | 3.8 | | | | |
| NS5 | 3342 | 0.25 | 5 | 2 | 0 | Y | LGKREDQW | 96.09 | LGKREDLW | 3.8 | | | | |
| NS5 | 3343 | 0.24 | 4 | 2 | 0 | Y | GKREDQWC | 96.13 | GKREDLWC | 3.8 | | | | |
| NS5 | 3344 | 0.24 | 3 | 2 | 0 | Y | KREDQWCG | 96.13 | KREDLWCG | 3.8 | | | | |
| NS5 | 3345 | 0.24 | 5 | 2 | 0 | Y | REDQWCGS | 96.17 | REDLWCGS | 3.8 | | | | |
| NS5 | 3346 | 0.26 | 5 | 2 | 0 | Y | EDQWCGSL | 95.98 | EDLWCGSL | 3.8 | | | | |
| NS5 | 3347 | 0.26 | 5 | 2 | 0 | Y | DQWCGSLI | 95.98 | DLWCGSLI | 3.8 | | | | |
| NS5 | 3348 | 0.26 | 5 | 2 | 0 | Y | QWCGSLIG | 95.98 | LWCGSLIG | 3.8 | | | | |
| NS5 | 3349 | 0.03 | 4 | 1 | 0 | Y | WCGSLIGL | 99.78 | | | | | | |
| NS5 | 3350 | 0.26 | 6 | 2 | 0 | Y | CGSLIGLT | 95.98 | CGSLIGLS | 3.76 | | | | |
| NS5 | 3351 | 1.23 | 9 | 3 | 0 | Y | GSLIGLTS | 51.44 | GSLIGLTA | 44.47 | GSLIGLSS | 3.76 | | |
| NS5 | 3352 | 1.23 | 11 | 3 | 0 | Y | SLIGLTSR | 51.44 | SLIGLTAR | 44.47 | SLIGLSSR | 3.76 | | |
| NS5 | 3353 | 1.23 | 9 | 3 | 0 | Y | LIGLTSRA | 51.36 | LIGLTARA | 44.47 | LIGLSSRA | 3.76 | | |
| NS5 | 3354 | 1.22 | 9 | 3 | 0 | Y | IGLTSRAT | 51.55 | IGLTARAT | 44.47 | IGLSSRAT | 3.76 | | |
| NS5 | 3355 | 1.22 | 9 | 3 | 0 | Y | GLTSRATW | 51.55 | GLTARATW | 44.47 | GLSSRATW | 3.76 | | |
| NS5 | 3356 | 1.22 | 9 | 3 | 0 | Y | LTSRATWA | 51.55 | LTARATWA | 44.47 | LSSRATWA | 3.76 | | |

FIG. 18-77

Species: DENVall (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3357 | 1.96 | 11 | 5 | 0 | Y | TARATWAT | 39.45 | TSRATWAK | 30.64 | TSRATWAQ | 20.76 | TARATWAS | 5.01 | SSRATWAK | 3.76 |
| NS5 | 3358 | 1.78 | 10 | 4 | 0 | Y | ARATWATN | 39.42 | SRATWAKN | 34.4 | SRATWAQN | 20.8 | ARATWASN | 5.01 | | |
| NS5 | 3359 | 1.79 | 10 | 4 | 0 | Y | RATWATNI | 39.31 | RATWAKNI | 34.4 | RATWAQNI | 20.8 | RATWASNI | 5.01 | | |
| NS5 | 3369 | 1.79 | 13 | 5 | 0 | Y | AINQVRRL | 44.36 | AINQVRSL | 30.05 | AIQQVRSL | 20.76 | AITQVRNL | 3.72 | AINQVRAL | 0.59 |
| NS5 | 3384 | 1.3 | 12 | 4 | 0 | Y | DYMPSMKR | 51.62 | DYMTSMKR | 43.66 | DYMPVMKR | 3.43 | DYMPAMKR | 0.33 | | |
| NS5 | 3385 | 1.29 | 12 | 4 | 0 | Y | YMPSMKRF | 51.62 | YMTSMKRF | 43.69 | YMPVMKRY | 3.43 | YMISMKRF | 0.33 | | |
| NS5 | 3386 | 1.27 | 10 | 3 | 0 | Y | MPSMKRFR | 51.55 | MTSMKRFK | 44.06 | MPVMKRYS | 3.43 | | | | |

FIG. 19-1

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 11 | 1.74 | 10 | 4 | 0 | Y | PSFNMLKRA | 44.36 | TPFNMLKRE | 30.64 | PSINMLKRV | 20.76 | PPFNMLKRE | 3.72 | | |
| anC | 12 | 1.55 | 7 | 3 | 0 | Y | SFNMLKRAR | 44.36 | PFNMLKRER | 34.55 | SINMLKRVR | 20.76 | | | | |
| anC | 13 | 1.55 | 5 | 3 | 0 | Y | FNMLKRARN | 44.36 | FNMLKRERN | 34.62 | INMLKRVRN | 20.76 | | | | |
| anC | 14 | 1.52 | 3 | 3 | 0 | Y | NMLKRARNR | 44.43 | NMLKRERNR | 34.62 | NMLKRVRNR | 20.94 | | | | |
| anC | 15 | 1.52 | 3 | 3 | 0 | Y | MLKRARNRV | 44.43 | MLKRERNRV | 34.62 | MLKRVRNRV | 20.94 | | | | |
| anC | 16 | 1.53 | 4 | 3 | 0 | Y | LKRARNRVS | 44.4 | LKRERNRVS | 34.62 | LKRVRNRVS | 20.94 | | | | |
| anC | 17 | 1.53 | 5 | 3 | 0 | Y | KRARNRVST | 44.4 | KRERNRVST | 34.59 | KRVRNRVST | 20.94 | | | | |
| anC | 20 | 1.85 | 15 | 5 | 0 | Y | RNRVSTVSQ | 35.29 | RNRVSTVQQ | 30.2 | RNRVSTGSQ | 29.72 | RNRVSTPQG | 3.69 | RNRVSTIQQ | 0.55 |
| anC | 21 | 1.85 | 15 | 5 | 0 | Y | NRVSTVSQL | 35.29 | NRVSTVQQL | 30.2 | NRVSTGSQL | 29.72 | NRVSTPQGL | 3.69 | NRVSTIQQL | 0.55 |
| anC | 22 | 1.85 | 16 | 5 | 0 | Y | RVSTVSQLA | 35.25 | RVSTVQQLT | 30.2 | RVSTGSQLA | 29.72 | RVSTPQGLV | 3.69 | RVSTIQQLT | 0.55 |
| anC | 23 | 1.86 | 17 | 5 | 0 | Y | VSTVSQLAK | 35.21 | VSTVQQLTK | 30.2 | VSTGSQLAK | 29.72 | VSTPQGLVK | 3.69 | VSTIQQLTK | 0.55 |
| anC | 24 | 1.86 | 18 | 5 | 0 | Y | STVSQLAKR | 35.18 | STVQQLTKR | 30.2 | STGSQLAKR | 29.72 | STPQGL

FIG. 19-2

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 40 | 1.27 | 14 | 5 | 0 | Y | GQGPMKLVM | 63.94 | GRGPLIKLFM | 30.46 | GKGPLRMVL | 3.72 | GQGPMKMVM | 0.81 | GQGPMKFVM | 0.29 |
| anC | 41 | 1.27 | 14 | 5 | 0 | Y | QGPMKLVMA | 63.94 | RGPLKLFMA | 30.46 | KGPLRMVLA | 3.72 | QGPMKMVMA | 0.81 | QGPMKFVMA | 0.29 |
| anC | 42 | 1.28 | 14 | 5 | 0 | Y | GPMKLVMAF | 63.9 | GPLKLFMAL | 30.31 | GPLRMVLAF | 3.72 | GPMKMVMAF | 0.81 | GPLKLFMAF | 0.29 |
| anC | 46 | 1.27 | 15 | 5 | 0 | Y | LVMAFIAFL | 64.01 | LFMALVAFL | 30.31 | MVLAFITFL | 3.72 | MVMAFIAFL | 0.85 | LFMAFVAFL | 0.29 |
| anC | 47 | 1.19 | 14 | 3 | 0 | Y | VMAFIAFLR | 65.12 | FMALVAFLR | 30.31 | VLAFITFLR | 3.72 | | | | |
| anC | 48 | 1.18 | 13 | 3 | 0 | Y | MAFIAFLRF | 65.12 | MALVAFLRF | 30.38 | LAFITFLRV | 3.72 | | | | |
| anC | 49 | 1.17 | 12 | 3 | 0 | Y | AFIAFLRFL | 65.12 | ALVAFLRFL | 30.42 | AFITFLRVL | 3.72 | | | | |
| anC | 50 | 1.17 | 12 | 3 | 0 | Y | FIAFLRFLA | 65.12 | LVAFLRFLT | 30.42 | FITFLRVLS | 3.72 | | | | |
| anC | 51 | 1.15 | 11 | 3 | 0 | Y | IAFLRFLAI | 65.15 | VAFLRFLTI | 30.68 | ITFLRVLSI | 3.72 | | | | |
| anC | 52 | 1.14 | 10 | 3 | 0 | Y | AFLRFLAIP | 65.27 | AFLRFLTIP | 30.64 | TFLRVLSIP | 3.72 | | | | |
| anC | 53 | 1.13 | 9 | 3 | 0 | Y | FLRFLAIPP | 65.27 | FLRFLTIPP | 30.75 | FLRVLSIPP | 3.72 | | | | |
| anC | 54 | 1.12 | 7 | 3 | 0 | Y | LRFLAIPPT | 65.34 | LRFLTIPPT | 30.79 | LRVLSIPPT | 3.72 | | | | |
| anC | 55 | 1.14 | 8 | 3 | 0 | Y | RFLAIPPTA | 65.34 | RFLTIPPTA | 30.49 | RVLSIPPTA | 3.72 | | | | |
| anC | 56 | 1.14 | 7 | 3 | 0 | Y | FLAIPPTAG | 65.38 | FLTIPPTAG | 30.49 | VLSIPPTAG | 3.72 | | | | |
| anC | 57 | 1.71 | 8 | 4 | 0 | Y | LAIPPTAGI | 45.91 | LTIPPTAGI | 30.49 | LAIPPTAGV | 19.47 | LSIPPTAGI | 3.72 | | |
| anC | 58 | 1.73 | 9 | 4 | 0 | Y | AIPPTAGIL | 45.72 | TIPPTAGIL | 30.49 | AIPPTAGVL | 19.47 | SIPPTAGIL | 3.72 | | |
| anC | 59 | 1.57 | 10 | 3 | 0 | Y | IPPTAGILA | 45.69 | IPPTAGILK | 34.18 | IPPTAGVLA | 19.47 | | | | |
| anC | 60 | 1.57 | 9 | 3 | 0 | Y | PPTAGILAR | 45.69 | PPTAGILKR | 34.22 | PPTAGVLAR | 19.47 | | | | |
| anC | 61 | 1.56 | 8 | 3 | 0 | Y | PTAGILARW | 45.69 | PTAGILKRW | 34.26 | PTAGVLARW | 19.47 | |

FIG. 19-3

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 117 | 1.73 | 9 | 4 | 0 | Y | LTRGGEPH | 44.4 | LTTRNGEPH | 30.83 | LTSRDGEPR | 20.72 | LSTRDGEPL | 3.69 | | |
| prM | 118 | 1.73 | 9 | 4 | 0 | Y | TTRGGEPHM | 44.4 | TTRNGEPHM | 30.83 | TSRDGEPRM | 20.72 | STRDGEPLM | 3.69 | | |
| prM | 119 | 1.77 | 12 | 4 | 0 | Y | TRGGEPHMI | 43.88 | TRNGEPHMI | 30.79 | SRDGEPRMI | 20.72 | TRDGEPLMI | 3.69 | | |
| prM | 120 | 1.76 | 10 | 4 | 0 | Y | RGGEPHMIV | 43.99 | RNGEPHMIV | 30.79 | RDGEPRMIV | 20.72 | RDGEPLMIV | 3.72 | | |
| prM | 131 | 1.78 | 14 | 3 | 0 | Y | QERGKSLLF | 44.32 | QEKGKSLLF | 30.31 | NERGKSLLF | 20.65 | HERGRPLLF | 3.72 | | |
| prM | 132 | 1.14 | 9 | 3 | 0 | Y | ERGKSLLFK | 65.04 | EKGKSLLFK | 30.9 | ERGRPLLFK | 3.72 | | | | |
| prM | 133 | 1.14 | 9 | 3 | 0 | Y | RGKSLLFKT | 65.04 | KGKSLLFKT | 30.9 | RGRPLLFKT | 3.72 | | | | |
| prM | 134 | 1.81 | 15 | 5 | 0 | Y | GKSLLFKTS | 44.21 | GKSLLFKTE | 30.01 | GKSLLFKTA | 20.65 | GRPLLFKTT | 3.72 | GKSLLFKTK | 0.74 |
|

FIG. 19-4

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 186 | 1.35 | 10 | 4 | 0 | Y | STWVTYGTC | 51.33 | DTWVTYGTC | 42.99 | STWVMYGTC | 3.39 | ETWVTYGTC | 1.4 | | |
| prM | 187 | 1.78 | 13 | 5 | 0 | Y | TWVTYGTCS | 44.99 | TWVTYGTCN | 29.83 | TWVTYGTCN | 20.65 | TWVMYGTCT | 3.43 | AWVMYGTCT | 0.26 |
| prM | 198 | 1.28 | 13 | 4 | 0 | Y | GEHRDKRS | 61.73 | GEHRREKRS | 32.37 | GERRDKRS | 3.76 | GERRDKRS | 1.66 | | |
| prM | 199 | 1.29 | 14 | 4 | 0 | Y | EHRRDKRSV | 61.69 | EHRREKRSV | 32.37 | ERRRDKRSV | 3.76 | ERRDKRSV | 1.66 | | |
| prM | 200 | 1.26 | 10 | 4 | 0 | Y | HRRDKRSVA | 61.8 | HRREKRSVA | 32.52 | RRREKRSVA | 3.76 | RRRDKRSVA | 1.66 | | |
| prM | 201 | 0.97 | 7 | 2 | 0 | Y | RRDKRSVAL | 63.46 | RREKRSVAL | 36.28 | | | | | | |
| prM | 202 | 1.25 | 9 | 4 | 0 | Y | RDKRSVALA | 63.46 | REKRSVALV | 30.72 | REKRSVALT | 3.69 | REKRSVALA | 1.88 | | |
| prM | 203 | 1.25 | 9 | 4 | 0 | Y | DKRSVALAP | 63.46 | EKRSVALVP | 30.72 | EKRSVALTP | 3.69 | EKRSVALAP | 1.88 | | |
| prM | 204 | 1.12 | 7 | 3 | 0 | Y | KRSVALAPH | 65.34 | KRSVALYPH | 30.75 | KRSVALTPH | 3.69 | | | | |
| prM | 205 | 1.13 | 7 | 3 | 0 | Y | RSVALAPHV | 65.41 | RSVALVPHV | 30.75 | RSVALTPHS | 3.69 | | | | |
| prM | 206 | 1.13 | 8 | 3 | 0 | Y | SVALAPHVG | 65.41 | SVALVPHVG | 30.57 | SVALTPHSG | 3.69 | | | | |
| prM | 207 | 1.73 | 10 | 4 | 0 | Y | VALAPHVGL | 44.36 | VALVPHVGM | 30.57 | VALVPHVGM | 30.57 | VALTPHSGM | 3.69 | | |
| prM | 208 | 1.73 | 9 | 4 | 0 | Y | ALAPHVGLG | 44.4 | ALVPHVGML | 30.57 | ALAPHVGMG | 20.98 | ALTPHSGMG | 3.69 | | |
| prM | 209 | 1.73 | 9 | 4 | 0 | Y | LAPHVGLGL | 44.4 | LVPHVGMGL | 30.57 | LAPHVGMGL | 20.98 | LTPHSGMGL | 3.69 | | |
| prM | 210 | 1.74 | 11 | 4 | 0 | Y | APHVGLGLE | 44.4 | VPHVGMGLE | 30.57 | APHVGMGLD | 20.98 | TPHSGMGLE

FIG. 19-5

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 224 | 0.85 | 10 | 3 | 0 | Y | WMSSEGAWK | 78.1 | WMSAEGAWR | 20.72 | | | | |
| prM | 225 | 1.62 | 12 | 4 | 0 | Y | MSSEGAWKQ | 44.17 | MSSEGAWKH | 33.92 | MSSEGAWRQ | 0.81 | | |
| prM | 226 | 2.01 | 14 | 5 | 0 | Y | SSEGAWKQI | 43.55 | SAEGAWRQV | 20.69 | SSEGAWKHA | 18.36 | SSEGAWRQ | 0.85 |
| prM | 227 | 2.01 | 14 | 5 | 0 | Y | SEGAWKQIQ | 43.55 | AEGAWRQVE | 20.69 | SEGAWKHAQ | 18.36 | SEGAWKHV | 15.56 | SEGAWRQIQ | 0.85 |
| prM | 237 | 1.38 | 12 | 5 | 0 | Y | VETWALRHP | 62.91 | IETWILRHP | 29.28 | VESWILRNP | 3.69 | VETWAFRHP | 2.03 | IETWVLRHP | 1.51 |
| prM | 238 | 1.36 | 11 | 5 | 0 | Y | ETWALRHPG | 62.91 | ETWILRHPG | 29.28 | ESWILRNPG | 3.69 | ETWAFRHPG | 2.03 | ETWV

FIG. 19-6

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 295 | 1.13 | 7 | 3 | 0 | Y | LSGAT

FIG. 19-7

Species: DENV all (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 320 | 1.72 | 11 | 4 | 0 | Y | TLDIELLKT | 44.4 | TLDFELLKT | 30.79 | TLDIELQKT | 20.83 | TLDFELIKT | 3.69 | | |
| E | 321 | 1.76 | 13 | 4 | 0 | Y | LDIELLKTE | 44.4 | LDFELLKTE | 30.46 | LDIELQKTE | 20.83 | LDFELIKTT | 3.39 | | |
| E | 322 | 1.76 | 13 | 4 | 0 | Y | DIELLKTEV | 44.4 | DFELLKTEA | 30.46 | DIELQKTEA | 20.83 | DFELIKTTA | 3.39 | | |
| E | 323 | 1.79 | 17 | 5 | 0 | Y | IELLKTEVT | 44.21 | FELLKTEAK | 30.38 | IELQKTEAT | 20.83 | FELIKTTAK | 3.39 | FELIKTTAK | 0.33 |
| E | 349 | 1.21 | 8 | 4 | 0 | Y | TTDSRCPTQ | 66.45 | TTESRCPTQ | 27.8 | TTATRCPTQ | 3.72 | TTASRCPTQ | 1.88 | | |
| E | 350 | 1.2 | 6 | 4 | 0 | Y | TDSRCPTQG | 66.48 | TESRCPTQG | 27.84 | TATRCPTQG | 3.72 | TASRCPTQG | 1.88 | | |
| E | 351 | 1.2 | 6 | 4 | 0 | Y | DSRCPTQGE | 66.48 | ESRCPTQGE | 27.84 | ATRCPTQGE | 3.72 | ASRCPTQGE | 1.88 | | |
| E | 352 | 1.11 | 4 | 3 | 0 | Y | SRCPTQGEA | 65.34 | SRCPTQGEP | 30.9 | TRCPTQGEP | 3.72 | | | | |
| E | 372 | 1.81 | 12 | 5 | 0 | Y | CRRTFVDRG | 44.06 | CKHSMVDRG | 30.13 | CKHTYVDRG | 20.8 | CRRDVDRG | 3.61 | CRHSMVDRG | 0.55 |
| E | 373 | 1.81 | 12 | 5 | 0 | Y | RRTFVDRGW | 44.06 | KHSMVDRGW | 30.13 | KHTYVDRGW | 20.8 | RRDVVDRGW | 3.61 | RHSMVDRGW | 0.55 |
| E | 374 | 1.76 | 10 | 4 | 0 | Y | RTFVDRGWG | 44.06 | HSMVDRGWG | 30.68 | HTYVDRGWG | 20.83 | RDVWDRGWG | 3.61 | | |
| E | 375 | 1.76 | 10 | 4 | 0 | Y | TFVDRGWGN | 44.06 | SMVDRGWGN | 30.68 | TYVDRGWGN | 20.83 | DVWDRGWGN | 3.61 | | |
| E | 376 | 1.74 | 6 | 4 | 0 | Y | FVDRGWGNG | 44.06 | MVDRGWGNG | 30.75 | YVDRGWGNG | 20.83 | VVDRGWGNG | 3.87 | | |
| E | 377 | 0 | 1 | 1 | 0 | Y | VDRGWGNGC | 100 | | | | | | | | |
| E | 378 | 0 | 1 | 1 | 0 | Y | DRGWGNGCG | 100 | | | | | | | | |
| E | 379 | 0 | 1 | 1 | 0 | Y | RGWGNGCGL | 100 | | | | | | | | |
| E | 380 | 0 | 1 | 1 | 0 | Y | GWGNGCGLF | 100 | | | | | | | | |
| E | 381 | 0 | 1 | 1 | 0 | Y | WGNGCGLFG | 100 | | | | | | | | |
| E | 382 | 0 | 1 | 1 | 0 | Y | GNGCGLFGK | 100 | | | | | | | | |
| E | 383 | 0 | 1 | 1 | 0 | Y | NGCGLFGKG | 100 | | | | | | | | |
| E | 384 | 0.94 | 3 | 2 | 0 | Y | GCGLFGKGS | 65.38 | GCGLFGKGG | 34.55 | CGLFGKGGV | 3.8 | | | | |
| E | 385 | 1.11 | 4 | 3 | 0 | Y | CGLFGKGSL | 65.38 | CGLFGKGGI | 30.75 | CGLFGKGGV | 20.83 | | | | |
| E | 386 | 2.08 | 7 | 5 | 0 | Y | GLFGKGSLI | 33.92 | GLFGKGGIV | 30.75 | GLFGKGSLV | 20.83 | GLFGKGSLL | 10.29 | GLFGKGGV | 3.8 |
| E | 387 | 2.08 | 7 | 5 | 0 | Y | LFGKGSLIT | 33.92 | LFGKGGWT | 30.75 | LFGKGSLVT | 20.83 | LFGKGSLLT | 10.29 | LFGKGGWT | 3.8 |
| E | 388 | 2.08 | 8 | 5 | 0 | Y | FGKGSLITC | 33.92 | FGKGGWTC | 30.72 | FGKGSLVTC | 20.83 | FGKGSLLTC | 10.29 | FGKGGWTC | 3.8 |

FIG. 19-8

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 389 | 2.09 | 11 | 5 | 0 | Y | GKGSLITCA | 33.85 | GKGGIVTCA | 30.72 | GKGSLVTCA | 20.83 | GKGGWTCA | 3.8 |
| E | 390 | 2.11 | 14 | 5 | 0 | Y | KGSLLTCAK | 33.85 | KGGIVTCAM | 30.53 | KGSLVTCAK | 20.83 | KGGWTCAK | 3.72 |
| E | 391 | 2.11 | 14 | 5 | 0 | Y | GSLITCAKF | 33.85 | GGIVTCAMF | 30.53 | GSLVTCAKF | 20.83 | GGVTCAKF | 3.72 |
| E | 420 | 2.05 | 17 | 5 | 0 | Y | IVTVHTGDQ | 44.32 | VITPHSGEE | 21.05 | IITVHTGDQ | 20.39 | VTVHNGDT | 3.69 |
| E | 422 | 1.27 | 17 | 4 | 0 | Y | TVHTGDQHQ | 65.08 | TPHSGEEHA | 28.83 | TVHNGDTHA | 28.83 | TPHSGEENA | 1.81 |
| E | 423 | 1.27 | 17 | 4 | 0 | Y | VHTGDQHQV | 65.08 | PHSGEEHAV | 28.83 | VHNGDTHAV | 28.83 | PHSGEENAV | 1.81 |
| E | 424 | 1.26 | 16 | 4 | 0 | Y | HTGDQHQVG | 65.12 | HSGEEHAVG | 28.83 | HNGDTHAVG | 28.83 | HSGEENAVG | 1.81 |
| E | 425 | 1.28 | 20 | 4 | 0 | Y | TGDQHQVGN | 65.08 | SGEEHAVGN | 28.65 | NGDTHAVGN | 28.65 | SGEENAVGN | 1.81 |
| E | 426 | 1.54 | 19 | 5 | 0.04 | Y | GDQHQVGNE | 59.88 | GEEHAVGND | 28.61 | GDQHAVGND | 5.27 | GEENAVGND | 3.69 |
| E | 461 | 1.78 | 15 | 5 | 0 | Y | LTLDCSPRT | 44.43 | VTMECSPRT | 30.16 | LGLECSPRT | 20.72 | TTMECSPRT | 0.63 |
| E | 462 | 1.76 | 15 | 4 | 0 | Y | TLDCSPRTG | 44.43 | TMECSPRTG | 30.38 | GLECSPRTG | 20.72 | TLDCEPRS | 3.65 |
| E | 463 | 1.75 | 12 | 4 | 0 | Y | LDCSPRTGL | 44.51 | MECSPRTGL | 30.31 | LECSPRTGL | 20.72 | TLDCEPRSG | 3.65 |
| E | 464 | 1.27 | 13 | 3 | 0 | Y | ECSPRTGLD | 51 | DCSPRTGLD | 44.47 | DCEPRSGID | 20.76 | LDCEPRSGI | 3.72 |
| E | 465 | 0.31 | 12 | 2 | 0 | Y | CSPRTGLDF | 95.5 | CEPRSGIDF | 3.72 | | | | |
| E | 466 | 0.33 | 12 | 2 | 0 | Y | SPRTGLDFN | 95.39 | EPRSGIDFN | 3.72 | | | | |
| E | 467 | 0.33 | 15 | 2 | 0 | Y | PRTGLDFNE | 95.35 | PRSGIDFNE | 3.72 | | | | |
| E | 468 | 0.34 | 16 | 2 | 0 | Y | RTGLDFNEM | 95.28 | RSGIDFNEM | 3.72 | | | | |
| E | 469 | 1.07 | 17 | 4 | 0 | Y | TGLDFNEMV | 74.52 | TGLDFNEMI | 20.72 | SGIDFNEMI | 3.72 | TSLDFNEMV | 0.41 |
| E | 470 | 1.05 | 19 | 3 | 0 | Y | GLDFNEMVL | 74.59 | GLDFNEMIL | 20.61 | GIDFNEMIL | 3.72 | | |
| E | 471 | 1.02 | 16 | 3 | 0 | Y | LDFNEMVLL | 74.96 | LDFNEMILL | 20.61 | IDFNEMILM | 3.72 | | |
| E | 472 | 1.77 | 16 | 4 | 0.15 | Y | DFNEMVLLQ | 44.28 | DFNEMVLLQ | 30.64 | DFNEMILM | 3.72 | DFNEMILMK | 3.58 |
| E | 473 | 1.76 | 21 | 4 | 0.15 | Y | FNEMVLLTM | 44.32 | FNEMVLLQM | 30.68 | FNEMILLTM | 20.61 | FNEMILMKM | 3.58 |
| E | 474 | 1.81 | 19 | 5 | 0.15 | Y | NEMVLLTMK | 44.14 | NEMVLLQME | 30.38 | NEMILLTMK | 20.61 | NEMILMKMK | 3.5 |
| E | 484 | 1.74 | 23 | 4 | 0.15 | Y | KSWLVHKQW | 44.1 | KAWLVHRQW | 30.86 | KAWMVHRQW | 20.8 | KTWLVHKQW | 3.72 |
| E | 485 | 1.74 | 9 | 4 | 0 | Y | SWLVHKQWF | 44.17 | AWLVHRQWF | 30.86 | AWMVHRQWF | 20.72 | TWLVHKQWF | 3.72 |

Additional column (far right): NEMYLQMK, frequency 0.22 (row 474)

FIG. 19-9

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 486 | 1.53 | 7 | 3 | 0 | Y | WLVHKQWFL | 48.19 | WLVHRQWFL | 30.9 | WMVHRQWFF | 20.69 | | |
| E | 487 | 1.53 | 7 | 3 | 0 | Y | LVHKQWFLD | 48.19 | LVHRQWFLD | 30.9 | MVHRQWFFD | 20.69 | | |
| E | 488 | 1.52 | 5 | 3 | 0 | Y | VHKQWFLDL | 48.19 | VHRQWFLDL | 30.94 | VHRQWFFDL | 20.72 | | |
| E | 489 | 1.51 | 4 | 3 | 0 | Y | HRQWFLDLP | 48.27 | HRQWFLDLP | 30.94 | HRQWFFDLP | 20.72 | | |
| E | 490 | 1.51 | 5 | 3 | 0 | Y | KQWFLDLPL | 48.27 | RQWFLDLPL | 30.9 | RQWFFDLPL | 20.72 | | |
| E | 491 | 0.75 | 5 | 2 | 0 | Y | QWFLDLPLP | 79.13 | QWFLDLPLP | 20.72 | | | | |
| E | 492 | 0.75 | 5 | 2 | 0 | Y | WFLDLPLPW | 79.13 | WFFDLPLPW | 20.72 | | | | |
| E | 493 | 1.62 | 8 | 4 | 0 | Y | FLDLPLPWT | 48.16 | FLDLPLPWL | 30.86 | FDLPLPWT | 18.81 | FDLPLPWA | 1.92 | |
| E | 495 | 1.28 | 9 | 5 | 0 | Y | DLPLPWTSG | 63.38 | DLPLPWLPG | 30.83 | DLPLPWTAG | 2.58 | DLPLPWASG | 1.92 | DLPLPWTTG | 1.07 |
| E | 496 | 1.32 | 12 | 5 | 0 | Y | LPLPWTSGA | 63.02 | LPLPWLPGA | 30.83 | LPLPWTAGA | 2.58 | LPLPWASGA | 1.92 | LPLPWTTGA | 1.07 |
| E | 514 | 2 | 15 | 5 | 0.04 | Y | QDLLVTFKT | 39.34 | KETLVTFKN | 30.2 | KELLVTFKN | 20.76 | KDLLVTFKT | 5.01 | KERMVTFKV | 3.72 |
| E | 515 | 1.77 | 13 | 4 | 0 | Y | DLLVTFKTA | 44.4 | ETLVTFKNP | 30.24 | ELLVTFKNA | 20.76 | ERMVTFKVP | 3.72 | |
| E | 516 | 1.76 | 12 | 4 | 0 | Y | LLVTFKTAH | 44.4 | TLVTFKNPH | 30.27 | LLVTFKNAH | 20.76 | RMVTFKVPH | 3.72 | |
| E | 517 | 1.72 | 10 | 4 | 0 | Y | LVTFKTAHA | 44.4 | LVTFKNPHA | 30.9 | LVTFKNAHA | 20.76 | MVTFKVPHA | 3.72 | |
| E | 518 | 1.71 | 9 | 4 | 0 | Y | VTFKTAHAK | 44.43 | VTFKNPHAK | 30.9 | VTFKNAHAK | 20.76 | VTFKVPHA

FIG. 19-10

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 529 | 1.14 | 10 | 3 | 0 | Y | EWVLGSQE | 65.15 | DWVLGSQE | 30.75 | DVTVLGSQE | 3.69 | | |
| E | 530 | 0.28 | 8 | 2 | 0 | Y | VWLGSQEG | 95.91 | VTVLGSQEG | 3.69 | | | | |
| E | 531 | 0.26 | 7 | 2 | 0 | Y | WLGSQEGA | 96.02 | TVLGSQEGA | 3.69 | | | | |
| E | 532 | 0.02 | 4 | 1 | 0 | Y | VLGSQEGAM | 99.85 | | | | | | |
| E | 533 | 0.01 | 4 | 1 | 0 | Y | LGSQEGAMH | 99.89 | | | | | | |
| E | 534 | 0.25 | 6 | 2 | 0 | Y | GSQEGAMHT | 96.09 | GSQEGAMHS | 3.72 | | | | |
| E | 535 | 0.26 | 8 | 2 | 0 | Y | SQEGAMHTA | 96.02 | SQEGAMHSA | 3.72 | | | | |
| E | 536 | 0.26 | 8 | 2 | 0 | Y | QEGAMHTAL | 96.02 | QEGAMHSAL | 3.72 | | | | |
| E | 537 | 0.28 | 10 | 2 | 0 | Y | EGAMHTALT | 95.98 | EGAMHSALA | 3.47 | | | | |
| E | 538 | 0.28 | 10 | 2 | 0 | Y | GAMHTALTG | 95.98 | GAMHSALAG | 3.47 | | | | |
| E | 539 | 0.29 | 12 | 2 | 0 | Y | AMHTALTGA | 95.91 | AMHSALAGA | 3.47 | | | | |
| E | 540 | 0.3 | 14 | 2 | 0 | Y | MHTALTGAT | 95.83 | MHSALAGAT | 3.47 | | | | |
| E | 541 | 0.3 | 14 | 2 | 0 | Y | HTALTGATE | 95.83 | HSALAGATE | 3.47 | | | | |
| E | 542 | 0.3 | 14 | 2 | 0 | Y | TALTGATEI | 95.83 | SALAGATEV | 3.47 | | | | |
| E | 543 | 0.29 | 13 | 2 | 0 | Y | ALTGATEIQ | 95.91 | ALAGATEVD | 3.47 | | | | |
| E | 544 | 1.71 | 14 | 4 | 0 | Y | LTGATEIQT | 46.68 | LTGATEIQM | 30.83 | LTGATEIQN | 18.44 | LAGATEVDS | 3.47 |
| E | 545 | 1.74 | 16 | 4 | 0 | Y | TGATEIQTS | 46.5 | TGATEIQMS | 30.83 | TGATEIQMS | 18.4 | AGATEVDSG | 3.47 |
| E | 546 | 1.76 | 18 | 4 | 0 | Y | GATEIQTSG | 46.46 | GATEIQMSS | 30.42 | GATEIQNSG | 18.4 | GATEVDSGD | 3.72 |
| E | 554 | 1.81 | 18 | 5 | 0 | Y | GTTTIFAGH | 44.21 | SGNLLFTGH | 30.35 | GGTSIFAGH | 20.54 | DGNHMFAGH | 3.69 |
| E | 555 | 1.8 | 17 | 5 | 0 | Y | TTTIFAGHL | 44.21 | GNLLFTGHL | 30.35 | GTSIFAGHL | 20.54 | GNHMFAGHL | 3.69 |
| E | 556 | 1.79 | 15 | 5 | 0 | Y | TTIFAGHLK | 44.32 | NLLFTGHLK | 30.35 | TSIFAGHLK | 20.54 | NHMFAGHLK | 3.72 |
| E | 557 | 1.78 | 14 | 5 | 0 | Y | TIFAGHLKC | 44.36 | LLFTGHLKC | 30.35 | SIFAGHLKC | 20.54 | HMFAGHLKC | 3.72 |
| E | 558 | 1.17 | 9 | 3 | 0 | Y | IFAGHLKCR | 65.12 | LFTGHLKCR | 30.35 | MFAGHLKCK | 3.72 | | |
| E | 559 | 1.17 | 9 | 3 | 0 | Y | FAGHLKCRL | 65.15 | FTGHLKCRL | 30.35 | FAGHLKCKV | 3.69 | | |
| E | 560 | 1.17 | 9 | 3 | 0 | Y | AGHLKCRLK | 65.15 | TGHLKCRLR | 30.31 | AGHLKCKVR | 3.69 | | |

| peptides required to cover 99% of block | frequency |
|---|---|
| LGNILFMGH | 0.29 |
| GNILFMGHL | 0.44 |
| NILFMGHLK | 0.44 |
| ILFMGHLKC | 0.44 |

FIG. 19-11

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 561 | 1.11 | 6 | 3 | 0 | Y | GHLKCRLKM | 65.41 | GHLKCRLRM | 30.79 | GHLKCRLRM | 3.69 | | |
| E | 562 | 1.13 | 9 | 3 | 0 | Y | HLKCRLRMD | 65.27 | HLKCRLRMD | 30.75 | HLKCRLRME | 3.69 | | |
| E | 563 | 1.14 | 11 | 3 | 0 | Y | LKCRLRMDK | 65.23 | LKCRLRMDK | 30.75 | LKCRLRMEK | 3.65 | | |
| E | 564 | 1.14 | 11 | 3 | 0 | Y | KCRLRMDKL | 65.23 | KCRLRMDKL | 30.75 | KCKVRMEKL | 3.65 | | |
| E | 565 | 1.76 | 16 | 4 | 0 | Y | CRLRMDKLT | 44.21 | CRLRMDKLQ | 30.75 | CRLRMDKLE | 20.69 | CKVRMEKLR | 3.65 | | |
| E | 566 | 1.76 | 16 | 4 | 0 | Y | RLRMDKLTL | 44.21 | RLRMDKLQL | 30.75 | RLRMDKLEL | 20.69 | KVRMEKLRI | 3.65 | | |
| E | 567 | 1.81 | 17 | 5 | 0 | Y | LRMDKLTLK | 43.51 | LRMDKLQLK | 30.75 | LRMDKLELK | 20.69 | VRMEKLRIK | 3.65 | | |
| E | 568 | 1.81 | 16 | 5 | 0 | Y | RMDKLTLKG | 43.51 | RMDKLQLKG | 30.75 | RMDKLELKG | 20.69 | RMEKLRIKG | 3.69 | | |
| E | 589 | 1.89 | 12 | 5 | 0 | Y | EKEVAETQH | 41.41 | VKEIAETQH | 30.83 | KKEVSETQH | 20.65 | DKEMAETQH | 3.65 | | |
| E | 590 | 1.87 | 9 | 5 | 0 | Y | KEVAETQHG | 41.45 | KEIAETQHG | 30.86 | KEVSETQHG | 20.8 | KEMAETQHG | 3.65 | | |
| E | 591 | 1.86 | 6 | 5 | 0 | Y | EVAETQHGT | 41.45 | EIAETQHGT | 30.9 | EVSETQHGT | 20.83 | EMAETQHGT | 3.72 | EKELAETQH | 3.06 |
| E | 592 | 1.88 | 9 | 5 | 0 | Y | VAETQHGTV | 41.33 | IAETQHGTI | 30.79 | VSETQHGTI | 20.8 | MAETQHGTT | 3.69 | KELAETQHG | 3.06 |
| E | 593 | 1.72 | 6 | 4 | 0 | Y | AETQHGTVL | 44.4 | AETQHGTIV | 30.79 | SETQHGTIL | 20.8 | AETQHGTIV | 3.69 | ELAETQHGT | 3.06 |
| E | 594 | 1.76 | 12 | 4 | 0 | Y | ETQHGTVLV | 44.36 | ETQHGTIVI | 30.49 | ETQHGTILI | 20.69 | ETQHGTIVV | 3.65 | LAETQHGTV | 3.06 |
| E | 595 | 1.77 | 14 | 4 | 0 | Y | TQHGTVLVQ | 44.36 | TQHGTIWI | 30.46 | TQHGTILIK | 20.69 | TQHGTIVK | 3.65 | | |
| E | 644 | 0.81 | 13 | 4 | 0 | Y | PYNIETEPP | 85.66 | PYNIETEPP | 9.11 | VTNIELEPP | 3.58 | PINIEAEPP | 1.11 | | |
| E | 645 | 0.79 | 11 | 3 | 0 | Y | VNIEAEPPF | 85.73 | VNIETEPPF | 9.11 | TNIELEPPF | 3.72 | INIEAEPPF | 1.11 | | |
| E | 646 | 0.7 | 9 | 3 | 0 | Y | NIEAEPPFG | 86.84 | NIETEPPFG | 9.14 | NIELEPPFG | 3.72 | | | | |
| E | 647 | 1.51 | 9 | 4 | 0 | Y | IEAEPPFGE | 56.12 | IEAEPPFGD | 30.79 | IETEPPFGE | 9.14 | IELEPPFGD | 3.72 | | |
| E | 648 | 1.5 | 7 | 4 | 0 | Y | EAEPPFGES | 56.16 | EAEPPFGDS | 30.86 | ETEPPFGES | 9.14 | ELEPPFGDS | 3.72 | | |
| E | 649 | 2.04 | 9 | 5 | 0 | Y | AEPPFGESY | 35.29 | AEPPFGESN | 30.86 | AEPPFGESN | 20.8 | TEPPFGESY | 9.14 | LEPPFGDSY | 3.72 |
| E | 650 | 1.56 | 10 | 3 | 0 | Y | EPPFGESYI | 44.36 | EPPFGDSYI | 34.51 | EPPFGESNI | 20.76 | | | | |
| E | 671 | 1.1 | 11 | 4 | 0 | Y | WFKKGSSIG | 73.86 | WYKKGSSIG | 20.65 | WFRKGSSIG | 3.95 | WFKRGSSIG | 0.77 | | |
| E | 673 | 1.25 | 10 | 4 | 0 | Y | KKGSSIGKM | 63.79 | KKGSSIGQM | 30.68 | RKGSSIGKM | 3.95 | KRGSSIGKM | 0.81 | | |
| E | 674 | 1.06 | 9 | 4 | 0 | Y | KGSSIGKMF | 67.55 | KGSSIGQMF | 30.49 | RGSSIGKMF | 0.85 | KGSTIGKMF | 0.33 | | |

FIG. 19-12

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 675 | 1.03 | 13 | 4 | 0 | Y | GSSIGKMFE | 68.25 | GSSIGQMFE | 30.31 | GSSIGQMIE | 0.33 | GSTIGKMFE | 0.33 | |

FIG. 19-13

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 700 | 1.8 | 11 | 5 | 0 | Y | WDFGSIGGV | 42.7 | WDFGSLGGV | 30.05 | WDFGSVGGV | 22.46 | WDFGSVGGL | 3

FIG. 19-14

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 797 | 1.15 | 13 | 3 | 0 | Y | TNEVHTWTE | 65.23 | TDNVHTWTE | 30.79 | VDNVHTWTE | 3.36 | | |
| NS1 | 798 | 0.97 | 11 | 2 | 0 | Y | NEVHTWTEQ | 65.19 | DNVHTWTEQ | 34.48 | | | | |
| NS1 | 799 | 0.97 | 12 | 2 | 0 | Y | EVHTWTEQY | 65.19 | N

FIG. 19-15

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 832 | 1.75 | 6 | 4 | 0 | Y | IRSATRLEN | 43.29 | IRSYTRLEN | 31.12 | IRSTRMEN | 20.83 | IRSTTRLEN | 4.54 | | |
| NS1 | 833 | 1.83 | 11 | 5 | 0 | Y | RSATRLENI | 42.99 | RSVTRLENL | 30.72 | RSTRMENL | 20.83 | RSTTRLENV | 3.69 | RSTTRLENI | 0.88 |
| NS1 | 834 | 1.83 | 11 | 5 | 0 | Y | SATRLENIM | 42.99 | SVTRLENLM | 30.72 | STTRMENLL | 20.83 | STTRLENVM | 3.69 | STTRLENIM | 0.88 |
| NS1 | 835 | 1.83 | 10 | 5 | 0 | Y | ATRLENIMW | 42.99 | VTRLENLMW | 30.75 | TTRMENLLW | 20.83 | TTRLENVMW | 3.69 | TTRLENIMW | 0.88 |
| NS1 | 836 | 1.8 | 8 | 5 | 0 | Y | TRLENIMWK | 43.29 | TRLENLMWK | 30.57 | TRMENLLWK | 20.83 | TRLENVMWK | 3.98 | TRLENIMWR | 1.03 |
| NS1 | 837 | 1.8 | 8 | 5 | 0 | Y | RLENIMWKQ | 43.29 | RLENLMWKQ | 30.57 | RMENLLWKQ | 20.83 | RLENVMWKQ | 3.98 | RLENIMWRQ | 1.03 |
| NS1 | 838 | 1.85 | 10 | 5 | 0 | Y | LENIMWKQI | 43.29 | LENLMWKQI | 30.46 | M

FIG. 19-16

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 937 | 1.52 | 14 | 5 | 0 | Y | VFTTNIWLK | 46.87 | IFTTNIWLK | 43.99 | MFTTNIWMK | 3.72 | VFSTNIWLK | 3.61 | VFTTNIWLR | 1.18 |
| NS1 | 938 | 0.64 | 11 | 4 | 0 | Y | FTTNIWLKL | 90.52 | FTTNIWMKF | 3.69 | FSTNIWLKL | 3.61 | FTTNIWLRL | 1.33 | | |
| NS1 | 954 | 0.93 | 10 | 2 | 0 | Y | CDHRLMSAA | 69.03 | CDSKLMSAA | 30.6 | | | | | | |
| NS1 | 955 | 1.52 | 12 | 4 | 0 | Y | DHRLMSAAI | 53.69 | DSKLMSAAI | 29.68 | DHRLMSAAV | 15.34 | DSKLMSAAV | 0.92 | | |
| NS1 | 956 | 1.52 | 13 | 4 | 0 | Y | HRLMSAAIK | 53.65 | SKLMSAAIK | 29.68 | HRLMSAAVK | 15.34 | SKLMSAAVK | 0.92 | | |
| NS1 | 957 | 1.52 | 12 | 4 | 0 | Y | RLMSAAIKD | 53.72 | KLMSAAIKD | 29.57 | RLMSAAVKD | 15.34 | KLMSAAVKD | 0.92 | | |
| NS1 | 964 | 1.81 | 17 | 5 | 0 | Y | KDSKAVHAD | 44.25 | KDNRAVHAD | 29.87 | KDERAVHAD | 20.76 | KDQKAVHAD | 3.76 | KDDRAVHAD | 0.52 |
| NS1 | 965 | 1.81 | 16 | 5 | 0 | Y | DSKAVHADM | 44.28 | DNRAVHADM | 29.87 | DERAVHADM | 20.76 | DQKAVHADM | 3.76 | DDRAVHADM | 0.52 |
| NS1 | 966 | 1.79 | 14 | 5 | 0 | Y | SKAVHADMG | 44.32 | NRAVHADMG | 30.05 | ERAVHADMG | 20.76 | QKAVHADMG | 3.76 | DRAVHADMG | 0.52 |
| NS1 | 967 | 1.02 | 5 | 2 | 0 | Y | RAVHADMGY | 51.66 | KAVHADMGY | 48.19 | | | | | | |
| NS1 | 968 | 0.02 | 4 | 1 | 0 | Y | AVHADMGYW | 99.85 | | | | | | | | |
| NS1 | 969 | 0.05 | 6 | 1 | 0 | Y | VHADMGYWI | 99.56 | | | | | | | | |
| NS1 | 970 | 0.04 | 4 | 1 | 0 | Y | HADMGYWIE | 99.67 | | | | | | | | |
| NS1 | 971 | 0.04 | 4 | 1 | 0 | Y | ADMGYWIES | 99.67 | | | | | | | | |
| NS1 | 972 | 1.78 | 12 | 5 | 0 | Y | DMGYWIESE | 44.47 | DMGYWIESA | 29.94 | DMGYWIESQ | 20.8 | DMGYWIESS | 3.76 | DMGYWIESR | 0.59 |
| NS1 | 973 | 1.82 | 16 | 5 | 0 | Y | MGYWIESEK | 44.06 | MGYWIESAL | 29.87 | MGYWIESQK | 20.8 | MGYWIESSK | 3.76 | MGYWIESRL | 0.59 |
| NS1 | 974 | 1.83 | 17 | 5 | 0 | Y | GYWIESEKN | 44.06 | GYWIESALN | 29.87 | GYWIESQKN | 20.76 | GYWIESSKN | 3.76 | GYWIESRLN | 0.59 |
| NS1 | 978 | 1.82 | 16 | 5 | 0 | Y | ESEKNETWK | 43.92 | ESALNDTWK | 30.05 | ESQKNGSWK | 20.8 | ESSKNQTWQ | 3.8 | ESRLNDTWK | 0.59 |
| NS1 | 990 | 1.85 | 7 | 3 | 0 | Y | ASFIEVKTC | 50.18 | ASFIEVKSC | 18.95 | ASL

FIG. 19-17

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1006 | 0.05 | 8 | 1 | 0 | Y | LWS

FIG. 19-18

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1075 | 1.76 | 12 | 4 | 0 | Y | TTTVTGKII | 43.88 | TTTVSGKLI | 30.75 | TTTVSGKLI | 20.8 | TTTASGKLI | 3.83 | | |
| NS1 | 1076 | 1.77 | 13 | 4 | 0 | Y | TTVTGKIIH | 43.84 | TTVSGKLIH | 30.72 | TTVSGKLIT | 20.83 | TTASGKLVT | 3.83 | | |
| NS1 | 1077 | 1.77 | 13 | 4 | 0 | Y | TVTGKIIHE | 43.88 | TVSGKLITE | 30.72 | TVSGKLITE | 20.83 | TASGKLVTQ | 3.8 | | |
| NS1 | 1078 | 1.77 | 14 | 4 | 0 | Y | VTGKIIHEW | 43.88 | VSGKLITEW | 30.68 | VSGKLIHEW | 20.83 | ASGKLVTQW | 3.8 | | |
| NS1 | 1079 | 1.76 | 12 | 4 | 0 | Y | TGKIIHEWC | 43.92 | SGKLITEWC | 30.72 | SGKLIHEWC | 20.83 | SGKLVTQWC | 3.8 | | |
| NS1 | 1080 | 1.76 | 11 | 4 | 0 | Y | GKIIHEWCC | 43.95 | GKLITEWCC | 30.72 | GKLIHEWCC | 20.83 | GKLVTQWCC | 3.8 | | |
| NS1 | 1081 | 1.76 | 11 | 4 | 0 | Y | KIIHEWCCR | 43.95 | KLITEWCCR | 30.72 | KLIHEWCCR | 20.83 | KLVTQWCCR | 3.8 | | |
| NS1 | 1082 | 1.77 | 12 | 4 | 0 | Y | IIHEWCCRS | 43.88 | LITEWCCRS | 30.72 | LIHEWCCRS | 20.83 | LVTQWCCRS | 3.8 | | |
| NS1 | 1083 | 1.13 | 9 | 3 | 0 | Y | IHEWCCRSC | 65.23 | ITEWCCRSC | 30.72 | VTQWCCRSC | 3.8 | | | | |
| NS1 | 1084 | 1.12 | 7 | 3 | 0 | Y | HEWCCRSCT | 65.27 | TEWCCRSCT | 30.75 | TQWCCRSCT | 3.8 | | | | |
| NS1 | 1085 | 0.25 | 4 | 2 | 0 | Y | EWCCRSCTL | 96.09 | QWCCRSCTM | 3.8 | | | | | | |
| NS1 | 1086 | 0.25 | 4 | 2 | 0 | Y | WCCRSCTLP | 96.09 | WCCRSCTMP | 3.8 | | | | | | |
| NS1 | 1087 | 0.24 | 3 | 2 | 0 | Y | CCRSCTLPP | 96.13 | CCRSCTMPP | 3.8 | | | | | | |
| NS1 | 1088 | 0.24 | 3 | 2 | 0 | Y | CRSCTLPPL | 96.13 | CRSCTMPPL | 3.8 | | | | | | |
| NS1 | 1089 | 0.24 | 3 | 2 | 0 | Y | RSCTLPPLR | 96.13 | RSCTMPPLR | 3.8 | | | | | | |
| NS1 | 1090 | 1.2 | 4 | 3 | 0 | Y | SCTLPPLRY | 51.66 | SCTLPPLRF | 44.47 | SCTMPPLRF | 3.8 | | | | |
| NS1 | 1091 | 2.13 | 6 | 5 | 0 | Y | CTLPPLRYR | 30.83 | CTLPPLRFR | 27.1 | CTLPPLRYM | 20.76 | CTLPPLRFK | 17.44 | CTMPPLRFL | 3.8 |
| NS1 | 1092 | 2.14 | 7 | 5 | 0 | Y | TLPPLRYRG | 30.83 | TLPPLRFRG | 27.06 | CTLPPLRYMG | 20.76 | TLPPLRFKG | 17.44 | TMPPLRFLG | 3.8 |
| NS1 | 1093 | 2.15 | 9 | 5 | 0 | Y | LPPLRYRGE | 30.72 | LPPLRFRGE | 27.06 | LPPLRYMGE | 20.72 | LPPLRFKGE | 17.44 | MPPLRFLGE | 3.8 |
| NS1 | 1094 | 2.16 | 11 | 5 | 0 | Y | PPLRYRGED | 30.68 | PPLRFRGED | 27.03 | PPLRYMGED | 20.72 | PPLRFKGED | 17.44 | PPLRFLGED | 3.8 |
| NS1 | 1095 | 2.16 | 11 | 5 | 0 | Y | PLRYRGEDG | 30.68 | PLRFRGEDG | 27.03 | PLRYMGEDG | 20.72 | PLRFKGEDG | 17.44 | PLRFLGEDG | 3.8 |
| NS1 | 1096 | 2.16 | 11 | 5 | 0 | Y | LRYRGEDGC | 30.68 | LRFRGEDGC | 27.03 | LRYMGEDGC | 20.72 | LRFKGEDGC | 17.44 | LRFLGEDGC | 3.8 |
| NS1 | 1097 | 2.16 | 11 | 5 | 0 | Y | RYRGEDGCW | 30.68 | RFRGEDGCW | 27.03 | RYMGEDGCW | 20.72 | RFKGEDGCW | 17.44 | RFLGEDGCW | 3.8 |
| NS1 | 1098 | 2.16 | 11 | 5 | 0 | Y | YRGEDGCWY | 30.68 | FRGEDGCWY | 27.03 | YMGEDGCWY | 20.72 | FKGEDGCWY | 17.44 | FLGEDGCWY | 3.8 |
| NS1 | 1099 | 1.58 | 10 | 4 | 0 | Y | RGEDGCWYG | 57.71 | MGEDGCWYG | 20.72 | KGEDGCWYG | 17.44 | LGEDGCWY | 3.8 | | |

FIG. 19-19

Species: DENVall (9-mers)

| protein | block starting position | block entropy | total peptides in block | # peptides required to cover 99% of block | gap/X fraction | 99% of block covered w/ <= 5 peptides?

FIG. 19-20

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1360 | 1.28 | 7 | 4 | 0 | Y | VSILASSLL | 51.25 | VSILLSSLL | 43.81 | VSLLGSALL | 3.8 | | |
| NS2B | 1361 | 1.78 | 8 | 5 | 0 | Y | SILLSSLLK | 43.81 | SILLSSLLK | 30.86 | SILASSLLR | 20.39 | VSILLSALL | 0.66 | SILLSALLIK | 0.66 |
| NS2B | 1362 | 1.79 | 10 | 5 | 0 | Y | ILLSSLLKN | 43.73 | ILASSLLKN | 30.83 | ILASSLLRN | 20.39 | SLLGSALLIK | 3.8 | ILLSALLKN

FIG. 19-21

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1385 | 1.71 | 8 | 4 | 0 | Y | IACYVISGS | 44.43 | TVCYVLTGR | 30.83 | IACYVITGT | 20.8 | LAAYYMSGG | 3.8 | | |
| NS2B | 1386 | 1.72 | 10 | 4 | 0 | Y | ACYVISGSS | 44.43 | VCYVLTGRS | 30.79 | ACYVITGTS | 20.8 | AAYVMSGSS | 3.76 | | |
| NS2B | 1387 | 1.72 | 10 | 4 | 0 | Y | CYVISGSSA | 44.43 | CYVLTGRSA | 30.79 | CYVITGTSA | 20.8 | AYVMSGSSA | 3.76 | | |
| NS2B | 1388 | 1.72 | 11 | 4 | 0 | Y | YVISGSSAD | 44.4 | YVLTGRSAD | 30.79 | YVITGTSAD | 20.8 | YVMSGSSAD | 3.76 | | |
| NS2B | 1389 | 1.72 | 11 | 4 | 0 | Y | VISGSSADL | 44.4 | VLTGRSADL | 30.79 | VITGTSADL | 20.8 | VMSGSSADL | 3.76 | | |
| NS2B | 1390 | 1.72 | 14 | 4 | 0 | Y | ISGSSADLS | 44.25 | LTGRSADLE | 30.79 | ITGTSADLT | 20.58 | MSGSSADLS | 3.76 | | |
| NS2B | 1391 | 1.57 | 13 | 3 | 0 | Y | SGSSADLSL | 48.01 | TGRSADLEL | 30.79 | TGTSADLT | 20.58 | | | | |
| NS2B | 1392 | 1.57 | 13 | 3 | 0 | Y | GSSADLSLE | 47.9 | GRSADLELE | 30.79 | GTSADLTVE | 20.61 | | | | |
| NS2B | 1393 | 1.65 | 16 | 4 | 0 | Y | SSADLSLEK | 47.75 | RSADLELER | 29.83 | TSADLTVEK | 20.58 | RSADLELEK | 0.96 | | |
| NS2B | 1410 | 2.01 | 14 | 5 | 0.04 | Y | EAEHSGASH | 37.87 | QAEISGSSP | 30.57 | EAEQTGVSH | 20.83 | EAEHSGTSH | 6.49 | MADITGSSP | 3.76 |
| NS2B | 1411 | 2.02 | 18 | 5 | 0.04 | Y | AEHSGASHN | 37.79 | AEISGSSPI | 30.6 | AEQTGVSHN | 20.8 | AEHSGTSHN | 6.49 | ADITGSSPI | 3.72 |
| NS2B | 1412 | 2.03 | 18 | 5 | 0.04 | Y | EHSGASHNI | 37.83 | EISGSSPIL | 30.6 | EQTGVSHNL | 20.8 | EHSGTSHNI | 6.45 | DITGSSPII | 3.65 |
| NS2B | 1413 | 2.05 | 20 | 5 | 0.04 | Y | HSGASHNIL | 37.57 | ISGSSPILS | 30.6 | QTGVSHNLM | 29.5 | HSGTSHNIL | 6.45 | ITGSSPIIE | 3.69 |
| NS2B | 1425 | 1.83 | 15 | 5 | 0.04 | Y | QDDGTMKIK | 44.25 | SEDGMSIK | 30.68 | DDDGTMRIK | 20.61 | DEDGSFSIR | 3.72 | AEDGSMSIK | 1.18 |
| NS2B | 1426 | 1.75 | 13 | 4 | 0 | Y | DDGTMKIKD | 44.36 | EDGSMSIKN | 30.68 | DDGTMRIKD | 20.65 | EDGSFSIRD | 3.72 | | |
| NS2B | 1427 | 1.77 | 15 | 4 | 0 | Y | DGTMKIKDE | 44.21 | DGSMSIKNE | 30.68 | DGTMRIKDD | 20.61 | DGSFSIRDV | 3.61 | | |
| NS2B | 1428 | 1.77 | 15 | 4 | 0 | Y | GTMKIKDEE | 44.21 | GSMSIKNEE | 30.68 | GTMRIKDDE | 20.61 | GSFSIRDVE | 3.61 | | |
| NS2B | 1429 | 1.8 | 16 | 5 | 0 | Y | TMKIKDEER | 43.92 | SMSIKNEEE | 30.68 | TMRIKDDET | 20.61 | SFSIRDVEE | 3.61 | TMKIKDEEK | 0.29 |
| NS2B | 1430 | 1.78 | 14 | 4 | 0 | Y | MKIKDEERD | 44.14 | MSIKNEEEE | 30.79 | MRIKDDETE | 20.61 | FSIRDVEET | 3.61 | | |
| NS2B | 1441 | 1.77 | 11 | 4 | 0 | Y | LTILLKATL | 43.73 | LTILIRTGL | 30.79 | LTVLLKTAL | 20.8 | ITLVKLAL | 3.8 | | |
| NS2B | 1442 | 1.71 | 8 | 4 | 0 | Y | TILLKATLL | 44.43 | TILIRTGLL | 30.79 | TVLLKTALL | 20.83 | TLLVKLALI | 3.8 | | |
| NS2B | 1443 | 1.73 | 10 | 4 | 0 | Y | ILLKATLLA | 44.25 | ILIRTGLLV | 30.79 | VLLKTALLI | 20.83 | LLVKLALIT | 3.8 | | |
| NS2B | 1444 | 1.85 | 12 | 5 | 0 | Y | LLKATLLAV | 44.25 | LIRTGLLVI | 30.72 | LLKTALLIV | 20.72 | LVKLALITV | 3.8 | LLKATLLAI | 1.62 |
| NS2B | 1445 | 1.85 | 12 | 5 | 0 | Y | LKATLLAVS | 42.59 | IRTGLLVIS | 30.72 | LKTALLIVS | 20.72 | VKLALITVS | 3.8 | LKATLLAIS | 1.62 |
| NS2B | 1446 | 1.85 | 12 | 5 | 0 | Y | KATLLAVSG | 42.59 | RTGLLVISG | 30.72 | KTALLIVSG | 20.72 | KLALITVSG | 3.8 | KATLLAISG | 1.62 |

FIG. 19-22

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1474 | 1.79 | 12 | 5 | 0 | Y | KKQRSGVLW | 44.4 | KKQRAGVLW | 30.79 | QTQRSGVLW | 19.8 | KTQRSGALW | 3.72 | QTRRSGVLW | 0.88 |
| NS2B | 1475 | 1.76 | 8 | 4 | 0 | Y | KQRSGVLWD | 44.47 | KQRAGVLWD | 30.83 | TQRSGVLWD | 19.91 | TQRSGALWD | 3.8 | RRSGVLWDV | 0.88 |
| NS2B | 1476 | 1.78 | 10 | 5 | 0 | Y | QRSGVLWDT | 44.36 | QRAGVLWDV | 30.68 | QRSGVLWDV | 19.91 | QRSGALWDV | 3.8 | | |
| NS2B | 1477 | 1.73 | 8 | 4 | 0 | Y | RSGVLWDTP | 44.4 | RAGVLWDVP | 30.68 | RSGVLWDVP | 20.8 | RSGALWDVP | 3.8 | | |
| NS2B | 1478 | 1.73 | 8 | 4 | 0 | Y | SGVLWDTPS | 44.4 | AGVLWDVPS | 30.68 | SGVLWDVPS | 20.8 | SGALWDVPS | 3.8 | | |
| NS3 | 1479 | 1.22 | 6 | 3 | 0 | Y | GVLWDVPSP | 51.47 | GVLWDTPSP | 44.4 | GALWDVPSP | 3.8 | | | | |
| NS3 | 1480 | 1.23 | 7 | 3 | 0 | Y | VLWDVPSPP | 51.4 | VLWDTPSPP | 44.4 | ALWDVPSPA | 3.8 | | | | |
| NS3 | 1481 | 1.79 | 12 | 5 | 0 | Y | LWDTPSPPE | 43.95 | LWDVPSPPP | 30.53 | LWDVPSPPE | 20.8 | LWDVPSPAA | 3.65 | LWDTPSPPK | 0.29 |
| NS3 | 1493 | 1.79 | 13 | 4 | 0 | Y | AVLDDGIYR | 44.21 | AELEDGAYR | 30.64 | AELEEGVYR | 20.76 | AALSEGVYR | 3.1 | ATLSEGVYR | 0.37 |
| NS3 | 1494 | 1.79 | 13 | 4 | 0 | Y | VLDDGIYRI | 44.21 | ELEDGAYRI | 30.64 | ELEEGVYRI | 20.76 | ALSEGVYRI | 3.1 | TLSEGVYRI | 0.37 |
| NS3 | 1495 | 2.12 | 12 | 5 | 0 | Y | LDDGIYRIM | 33.7 | LEDGAYRIK | 30.68 | LEEGVYRIK | 20.65 | LDDGIYRIL | 10.55 | LSEGVYRIM | 3.47 |
| NS3 | 1496 | 2.12 | 12 | 5 | 0 | Y | DDGIYRIMQ | 33.7 | EDGAYRIKQ | 30.68 | EEGVYRIKQ | 20.65 | DDGIYRILQ | 10.55 | SEGVYRIMQ | 3.47 |
| NS3 | 1508 | 1.8 | 13 | 4 | 0 | Y | LGRSQVGVG | 44.28 | LGTYSQIGAG | 27.06 | FGKTQVGVG | 23.82 | FGTYSQIGAG | 3.61 | LGKTQVGVG | 0.74 |
| NS3 | 1509 | 1.74 | 10 | 4 | 0 | Y | GRSQVGVGV | 44.28 | GYSQIGAGV | 30.68 | GKTQVGVGI | 20.69 | GKTQVGVGI | 3.87 | | |
| NS3 | 1510 | 1.76 | 13 | 4 | 0 | Y | RSQVGVGVF | 44.28 | YSQIGAGVY | 30.68 | KTQVGVGVQ | 20.58 | KTQVGVGIH | 3.72 | | |
| NS3 | 1511 | 1.76 | 13 | 4 | 0 | Y | SQVGVGVFQ | 44.51 | SQIGAGVYK | 30.6 | TQVGVGVQK | 20.54 | TQVGVGIHM | 3.58 | | |
| NS3 | 1512 | 2.09 | 15 | 5 | 0 | Y | QVGVGVFQE | 35.4 | QIGAGVYKE | 30.6 | QVGVGVQKE | 20.58 | QVGVGVFQD | 9.03 | QVGVGIHME | 3.58 |
| NS3 | 1520 | 1.89 | 17 | 4 | 0 | Y | ENVFHTMWH | 33.48 | EGTFHTMWH | 30.79 | EGVFHTMWH | 26.51 | DGVFHTMWH | 9.07 | | |
| NS3 | 1521 | 1.59 | 8 | 3 | 0 | Y | GVFHTMWHV | 35.66 | NVFHTMWHV | 33.48 | GTFHTMWHV | 30.79 | | | | |
| NS3 | 1522 | 0.9 | 5 | 2 | 0 | Y | VFHTMWHVT | 69.14 | THTMWHVT | 30.79 | | | | | | |
| NS3 | 1523 | 0.01 | 4 | 1 | 0 | Y | FHTMWHVTR | 99.93 | | | | | | | | |
| NS3 | 1524 | 0.01 | 3 | 1 | 0 | Y | HTMWHVTRG | 99.93 | | | | | | | | |
| NS3 | 1525 | 0.24 | 3 | 2 | 0 | Y | TMWHVTRGA | 96.13 | TMWHVTRGS | 3.8 | | | | | | |
| NS3 | 1526 | 0.24 | 4 | 2 | 0 | Y | MWHVTRGAV | 96.17 | MWHVTRGSV | 3.8 | | | | | | |
| NS3 | 1527 | 0.23 | 3 | 2 | 0 | Y | WHVTRGAVL | 96.2 | WHVTRGSVI | 3.8 | | | | | | |

FIG. 19-23

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1528 | 1.02 | 5 | 3 | 0 | Y | HVTRGAVLM | 74.41 | HVTRGAVLT | 21.17 | HVTRGSVIC | 3.8 | | |
| NS3 | 1529 | 1.96 | 8 | 5 | 0 | Y | VTRGAVLMY | 44.51 | VTRGAVLMH | 29.9 | VTRGAVLTY | 11.47 | VTRGAVLTH | 9.66 | VTRGSVICH | 3.8 |
| NS3 | 1538 | 2.04 | 11 | 5 | 0 | Y | QGKRLEPSW | 44.54 | NGKRLEPNW | 20.72 | RGKRLEPSW | 16.89 | KGKRLEPSW | 13.68 | ETGRLEPSW | 3.69 |
| NS3 | 1539 | 1.72 | 8 | 4 | 0 | Y | GKRLEPSWA | 44.65 | GKRLEPSWA | 30.57 | GKRLEPNWA | 20.72 | TGRLEPSWA | 3.69 | | |
| NS3 | 1540 | 1.77 | 10 | 4 | 0 | Y | KRLEPSWAS | 44.47 | KRIEPSWAD | 30.57 | KRLEPNWAS | 20.28 | GRLEPSWAD | 3.8 | | |
| NS3 | 1541 | 1.77 | 9 | 4 | 0 | Y | RLEPSWASV | 44.4 | RIEPSWADV | 30.57 | RLEPNWASV | 20.32 | RLEPSWADV | 3.83 | | |
| NS3 | 1542 | 1.8 | 12 | 5 | 0 | Y | LEPSWASVK | 44.4 | IEPSWADVK | 30.2 | LEPNWASVK | 20.28 | LEPSWADVR | 3.8 | LEPNWANVK | 0.44 |
| NS3 | 1543 | 1.8 | 12 | 5 | 0 | Y | EPSWASVKK | 44.36 | EPSWADVKK | 30.27 | EPNWASVKK | 20.24 | EPSWADVRN | 3.8 | EPNWANVKK | 0.44 |
| NS3 | 1544 | 1.8 | 12 | 5 | 0 | Y | PSWASVKKD | 44.36 | PSWADVKKD | 30.27 | PNWASVKKD | 20.24 | PSWADVRND | 3.8 | PNWANVKKD | 0.44 |
| NS3 | 1545 | 1.8 | 12 | 5 | 0 | Y | SWASVKKDL | 44.36 | SWADVKKDL | 30.27 | NWASVKKDL | 20.24 | SWADVRNDM | 3.8 | NWANVKKDL | 0.44 |
| NS3 | 1546 | 1.24 | 11 | 5 | 0 | Y | WASVKKDLI | 64.56 | WADVKKDLI | 30.09 | WADVRNDMI | 3.8 | WANVKKDLI | 0.44 | WADVKKDLI | 0.37 |
| NS3 | 1547 | 1.24 | 11 | 5 | 0 | Y | ASVKKDLIS | 64.56 | ADVKKDLIS | 30.09 | ADVRNDMIS | 3.8 | ANVKKDLIS | 0.44 | ADVKKDLIS | 0.37 |
| NS3 | 1548 | 1.24 | 11 | 5 | 0 | Y | SVKKDLISY | 64.56 | DVKKDLISY | 30.09 | DVRNDMISY | 3.8 | NVKKDLISY | 0.44 | DVKKDLVSY | 0.37 |
| NS3 | 1549 | 0.33 | 7 | 2 | 0 | Y | VKKDLISYG | 95.21 | VRNDMISYG | 3.8 | | | | | | |
| NS3 | 1550 | 0.32 | 6 | 2 | 0 | Y | KKDLISYGG | 95.28 | RNDMISYGG | 3.8 | | | | | | |
| NS3 | 1551 | 0.28 | 5 | 2 | 0 | Y | KDLISYGGG | 95.69 | NDMISYGGG | 3.8 | | | | | | |
| NS3 | 1552 | 0.28 | 4 | 2 | 0 | Y | DLISYGGGW | 95.76 | DMISYGGGW | 3.8 | | | | | | |
| NS3 | 1553 | 1.15 | 6 | 3 | 0 | Y | LISYGGGWR | 64.9 | LISYGGGWK | 30.86 | MISYGGGWR | 3.8 | | | | |
| NS3 | 1554 | 1.39 | 6 | 3 | 0 | Y | ISYGGGWRL | 56.97 | ISYGGGWKL | 30.86 | ISYGGGWRF | 11.73 | | | | |
| NS3 | 1566 | 1.81 | 15 | 5 | 0 | Y | WNTGEEVQV | 43.84 | WKEGEEVQV | 30.79 | WQKGEEVQV | 20.43 | WDKEEDVQV | 3.65 | WNAGEEVQV | 0.37 |
| NS3 | 1567 | 1.81 | 15 | 5 | 0 | Y | NTGEEVQVI | 43.81 | KEGEEVQVI | 30.79 | QKGEEVQVI | 20.46 | DKEEDVQVL | 3.65 | NAGEEVQVI | 0.37 |
| NS3 | 1568 | 1.78 | 12 | 4 | 0 | Y | TGEEVQVIA | 43.84 | EGEEVQVLA | 30.79 | KGEEVQVIA | 20.72 | KEEDVQVLA | 3.65 | | |
| NS3 | 1569 | 1.12 | 7 | 3 | 0 | Y | GEEVQVIAY | 65.3 | GEEVQVLAI | 30.79 | EEDVQVLAI | 3.69 | | | | |
| NS3 | 1570 | 1.13 | 8 | 3 | 0 | Y | EEVQVIAVE | 65.3 | EEVQVLAIE | 30.75 | EDVQVLAIE | 3.69 | | | | |
| NS3 | 1571 | 1.13 | 8 | 3 | 0 | Y | EVQVIAVEP | 65.3 | EVQVLALEP | 30.75 | DVQVLAIEP | 3.69 | | | | |

FIG. 19-24

Species: DENVall (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1572 | 1.14 | 8 | 3 | 0 | Y | VQVIAVEPG | 65.19 | VQVLAIEPG | 30.79 | VQVLAIEPG | 3.69 | | |
| NS3 | 1573 | 1.14 | 8 | 3 | 0 | Y | QVIAVEPGK | 65.19 | QVLAIEPGK | 30.79 | QVLAIEPGK | 3.69 | | |
| NS3 | 1574 | 1.14 | 8 | 3 | 0 | Y | VIAVEPGKN | 65.19 | VLAIEPGKN | 30.79 | VLAIEPGKN | 3.69 | | |
| NS3 | 1575 | 1.13 | 7 | 3 | 0 | Y | IAVEPGKNP | 65.23 | LAIEPGKNP | 30.79 | LAIEPGKNP | 3.69 | | |
| NS3 | 1576 | 1.12 | 6 | 3 | 0 | Y | AVEPGKNPK | 65.34 | ALEPGKNP | 30.79 | ALEPGKNPK | 3.69 | | |
| NS3 | 1577 | 1.14 | 9 | 3 | 0 | Y | VEPGKNPKN | 65.19 | LEPGKNPRA | 30.75 | IEPGKNPKH | 3.69 | | |
| NS3 | 1578 | 1.72 | 9 | 4 | 0 | Y | EPGKNPKNV | 44.4 | EPGKNPRAV | 30.79 | EPGKNPKNF | 20.8 | EPGKNPKHV | 3.8 |
| NS3 | 1579 | 1.72 | 8 | 4 | 0 | Y | PGKNPKNVQ | 44.4 | PGKNPRAVQ | 30.79 | PGKNPKNFQ | 20.8 | PGKNPKHVQ | 3.8 |
| NS3 | 1580 | 1.72 | 8 | 4 | 0 | Y | GKNPKNVQT | 44.4 | GKNPRAVQT | 30.79 | GKNPKNFQT | 20.8 | GKNPKHVQT | 3.8 |
| NS3 | 1597 | 1.85 | 15 | 5 | 0 | Y | EGEVGAIAL | 44.47 | TGTIGAVSL | 29.02 | TGEIGAIAL | 20.54 | TGEIGAVTL | 3.76 | AGTIGAVSL | 1.59 |
| NS3 | 1598 | 1.73 | 10 | 4 | 0 | Y | GEVGAIALD | 44.47 | GTIGAVSLD | 30.64 | GEIGAIALD | 20.72 | GEIGAVTLD | 3.8 |
| NS3 | 1599 | 1.73 | 10 | 4 | 0 | Y | EVGAIALDF | 44.47 | TIGAVSLDF | 30.64 | EIGAIALDF | 20.72 | EIGAVTLDF | 3.8 |
| NS3 | 1600 | 1.72 | 8 | 4 | 0 | Y | VGAIALDFK | 44.47 | IGAVSLDFS | 30.79 | IGAIALDFK | 20.72 | IGAVTLDFK | 3.8 |
| NS3 | 1601 | 1.13 | 6 | 3 | 0 | Y | GAIALDFKP | 65.19 | GAVSLDFSP | 30.79 | GAVTLDFKP | 3.8 | | |
| NS3 | 1602 | 1.13 | 6 | 3 | 0 | Y | AIALDFKPG | 65.19 | AVSLDFSPG | 30.79 | AVTLDFKPG | 3.8 | | |
| NS3 | 1603 | 1.13 | 7 | 3 | 0 | Y | IALDFKPGT | 65.19 | VSLDFSPGT | 30.79 | VTLDFKPGT | 3.76 | | |
| NS3 | 1604 | 1.11 | 4 | 3 | 0 | Y | ALDFKPGTS | 65.38 | SLDFSPGTS | 30.83 | TLDFKPGTS | 3.76 | | |
| NS3 | 1605 | 0.9 | 3 | 2 | 0 | Y | LDFKPGTSG | 69.14 | LDFSPGTSG | 30.83 | | | | |
| NS3 | 1606 | 0.9 | 3 | 2 | 0 | Y | DFKPGTSGS | 69.14 | DFSPGTSGS | 30.83 | | | | |
|

FIG. 19-25

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1621 | 1.23 | 8 | 3 | 0 | Y | GKWGLYGN | 51.14 | GKWIGLYGN | 44.69 | GKWIGLYGN | 3.8 | | |
| NS3 | 1622 | 1.21 | 6 | 3 | 0 | Y | KWGLYGNG | 51.14 | KWGLYGNG | 44.87 | KVIGLYGNG | 3.8 | | |
| NS3 | 1623 | 1.21 | 5 | 3 | 0 | Y | WGLYGNGV | 51.14 | WGLYGNGV | 44.91 | VIGLYGNGV | 3.8 | | |
| NS3 | 1624 | 0.26 | 4 | 2 | 0 | Y | VGLYGNGW | 95.94 | IGLYGNGV | 3.8 | | | | |
| NS3 | 1625 | 0.01 | 2 | 1 | 0 | Y | GLYGNGWT | 99.89 | | | | | | |
| NS3 | 1626 | 1.55 | 4 | 3 | 0 | Y | LYGNGWTT | 44.54 | LYGNGWTR | 30.83 | LYGNGWTK | 24.52 | | |
| NS3 | 1627 | 1.74 | 9 | 4 | 0 | Y | YGNGWTTS | 44.51 | YGNGWTRS | 30.53 | YGNGWTKN | 20.58 | YGNGWTKS | 3.95 |
| NS3 | 1628 | 1.74 | 9 | 4 | 0 | Y | GNGWTTSG | 44.51 | GNGWTRSG | 30.53 | GNGWTKNG | 20.58 | GNGWTKSG | 3.95 |
| NS3 | 1629 | 1.88 | 13 | 5 | 0 | Y | NGWTTSGT | 44.47 | NGWTRSGA | 28.1 | NGWTKNGG | 20.58 | NGWTKSGD | 3.8 | NGWTRSGT | 2.4 |
| NS3 | 1630 | 1.88 | 13 | 5 | 0 | Y | GWTTSGTY | 44.47 | GWTRSGAY | 28.1 | GWTKNGGY | 20.58 | GWTKSGDY | 3.8 | GWTRSGTY | 2.4 |
| NS3 | 1631 | 1.88 | 13 | 5 | 0 | Y | WTTSGTYV | 44.47 | WTRSGAYV | 28.1 | WTKNGGYV | 20.58 | WTKSGDYV | 3.8 | WTRSGTYV | 2.4 |
| NS3 | 1632 | 1.88 | 13 | 5 | 0 | Y | VTTSGTYVS | 44.47 | VTRSGAYVS | 28.1 | VTKNGGYVS | 20.58 | VTKSGDYVS | 3.8 | VTRSGTYVS | 2.4 |
| NS3 | 1635 | 1.78 | 13 | 5 | 0 | Y | SGTYVSAIA | 46.28 | SGAYVSAIA | 28.1 | NGGYVSGIA | 20.69 | SGDYVSAIT | 3.8 | SGTYVSSIA | 0.55 |
| NS3 | 1636 | 1.73 | 8 | 4 | 0 | Y | GTYVSAIAQ | 46.31 | GAYVSAIAQ | 28.39 | GGYVSGIAQ | 20.83 | GDYVSAITQ | 3.8 | | |
| NS3 | 1637 | 1.87 | 10 | 5 | 0 | Y | TYVSAIAQA | 44.14 | AYVSAIAQT | 28.36 | GVYVSGIAQT | 20.83 | DVVSAITQA | 3.8 | TYVSAIAQT | 2.18 |
| NS3 | 1660 | 2.23 | 14 | 4 | 0 | Y | VFKKRNLTI | 35.58 | IFRKKRLTI | 23.3 | MFKKRNLTI | 20.58 | IFRKRRLTI | 10.66 | VFKKRNLTI | 8.89 |
| NS3 | 1661 | 1.95 | 10 | 5 | 0 | Y | FKKRNLTIM | 35.77 | FKKRNLTIM | 29.46 | FRKKRNLTIM | 23.34 | FRKKRRLTIM | 10.66 | | |
| NS3 | 1662 | 1.95 | 10 | 5 | 0 | Y | RKKRNLTIMD | 35.77 | RKKRNLTIMD | 29.46 | RKKRNLTIMD | 23.34 | RKRRLTIMD | 10.66 | | |
| NS3 | 1663 | 1.3 | 8 | 3 | 0 | Y | KRNLTIMDL | 65.23 | KKRLTIMDL | 23.34 | KRRLTIMDL | 10.66 | | | |
| NS3 | 1664 | 1.3 | 8 | 3 | 0 | Y | RNLTIMDLH | 65.23 | KRLTIMDLH | 23.34 | | | | |
| NS3 | 1665 | 0.99 | 6 | 2 | 0 | Y | NLTIMDLHP | 65.27 | RLTIMDLHP | 34 | | | | |
| NS3 | 1666 | 0.01 | 4 | 1 | 0 | Y | LTIMDLHPG | 99.89 | | | | | | |
| NS3 | 1667 | 0.94 | 4 | 2 | 0 | Y | TIMDLHPGS | 65.34 | TIMDLHPGA | 34.59 | | | | |
| NS3 | 1668 | 0.94 | 4 | 2 | 0 | Y | IMDLHPGSG | 65.34 | IMDLHPGAG | 34.59 | | | | |
| NS3 | 1669 | 0.93 | 2 | 2 | 0 | Y | MDLHPGSGK | 65.38 | MDLHPGAGK | 34.62 | | | | |

FIG. 19-26

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1670 | 0.93 | 3 | 2 | 0 | Y | DLHPGSGKT | 65.38 | DLHPGAGKT | 34.59 | | | | |
| NS3 | 1671 | 0.94 | 4 | 2 | 0 | Y | LHPGSGKTR | 65.34 | LHPGAGKTK | 34.59 | | | | |
| NS3 | 1672 | 1.56 | 6 | 3 | 0 | Y | HPGSGKTRR | 44.47 | HPGAGKTKR | 34.14 | HPGSGKTRK | 20.87 | | |
| NS3 | 1673 | 1.74 | 7 | 4 | 0 | Y | PGSGKTRRY | 44.47 | PGAGKTKRY | 30.35 | PGSGKTRKY | 20.87 | PGAGKTKRI | 3.8 |
| NS3 | 1674 | 1.74 | 7 | 4 | 0 | Y | GSGKTRRYL | 44.47 | GAGKTKRYL | 30.35 | GSGKTRKYL | 20.87 | GAGKTKRIL | 3.8 |
| NS3 | 1675 | 1.74 | 7 | 4 | 0 | Y | SGKTRRYLP | 44.47 | AGKTKRYLP | 30.35 | SGKTRKYLP | 20.87 | AGKTKRILP | 3.8 |
| NS3 | 1676 | 1.74 | 7 | 4 | 0 | Y | GKTRRYLPA | 44.47 | GKTRKYLPA | 30.38 | GKTRKYLPA | 20.8 | GKTKRILPS | 3.8 |
| NS3 | 1677 | 1.81 | 10 | 5 | 0 | Y | KTRRYLPAI | 43.69 | KTRKYLPAI | 30.38 | KTRKYLPAI | 20.69 | KTKRILPSI | 3.8 | KTRRYLPAM | 0.74 |
| NS3 | 1680 | 1.14 | 12 | 5 | 0 | Y | RYLPAIVRE | 73.93 | RILPSIVRE | 19.91 | RILPSIVRE | 3.8 | KYLPAIIRE | 1.22 | RYLPAMVRE | 0.74 |
| NS3 | 1681 | 0.44 | 11 | 4 | 0 | Y | YLPAIVREA | 93.81 | ILPSIVREA | 3.8 | YLPAIIREA | 1.29 | YLPAMVREA | 0.74 | |
| NS3 | 1682 | 0.45 | 12 | 5 | 0 | Y | LPAIVREAI | 93.66 | LPSIVREAL | 3.8 | LPAIIREAI | 1.29 | LPAMVREAI | 0.74 | |
| NS3 | 1683 | 0.54 | 14 | 5 | 0 | Y | PAIVREAIK | 92.7 | PSIVREALK | 3.8 | PAIIREAIK | 1.29 | PAMVREAIK | 0.74 | PAIVREAIR | 0.74 |
| NS3 | 1684 | 0.55 | 15 | 5 | 0 | Y | AIVREAIKR | 92.63 | SIVREALKR | 3.8 | AIIREAIKR | 1.29 | AMVREAIKR | 0.74 | AIVREAIRR | 0.74 |
| NS3 | 1687 | 1.84 | 17 | 5 | 0 | Y | REAIKRRLR | 42.59 | REAIKRGLR | 29.98 | REALKRRLR | 22.2 | PAMVREAIK | 3.8 | REAIRRGLR | 0.59 |
| NS3 | 1688 | 1.84 | 17 | 5 | 0 | Y | EAIKRRLRT | 42.63 | EAIKRGLRT | 29.94 | EALKRRLRT | 22.2 | AMVREAIKR | 3.8 | EAIRRGLRT | 0.59 |
| NS3 | 1689 | 1.83 | 16 | 5 | 0 | Y | AIKRRLRTL | 41.74 | AIKRGLRTL | 29.98 | ALKRRLRTL | 22.2 | REALKRRLR | 3.8 | AIRRGLRTL | 0.59 |
| NS3 | 1691 | 1.75 | 13 | 5 | 0 | Y | KRLRTLILA | 41.78 | KRGLRTLIL | 30.79 | KRRLRTLVL | 25.74 | EALKRRLRT | 3.8 | RRGLRTLIL | 0.59 |
| NS3 | 1692 | 1.68 | 10 | 5 | 0 | Y | RKLRTLILA | 41.85 | RGLRTLILA | 30.79 | RKLRTLVLA | 25.74 | ALKRRLRTL | 3.8 | | |
| NS3 | 1693 | 1.68 | 9 | 4 | 0 | Y | KLRTLILAP | 41.85 | GLRTLILAP | 30.79 | KLRTLVLAP | 25.74 | KRRLRTLVL | 1.03 | | |
| NS3 | 1694 | 0.13 | 6 | 2 | 0 | Y | LRTLILAPT | 98.38 | LRTLVLAPT | 1.36 | | | RKRLRTLVA | 1.03 | | |
| NS3 | 1695 | 0.11 | 3 | 2 | 0 | Y | RTLILAPTR | 98.56 | RTLVLAPTR | 1.4 | | | KLRTLVLAP | 1.03 | | |
| NS3 | 1696 | 0.11 | 3 | 2 | 0 | Y | TLILAPTRV | 98.56 | TLVLAPTRV | 1.4 | | | | | | |
| NS3 | 1697 | 0.11 | 3 | 2 | 0 | Y | LILAPTRVV | 98.56 | LVLAPTRVV | 1.4 | | | | | | |
| NS3 | 1698 | 0.11 | 3 | 2 | 0 | Y | ILAPTRVVA | 98.56 | VLAPTRVVA | 1.4 | | | | | | |
| NS3 | 1699 | 1 | 3 | 2 | 0 | Y | LAPTRVVAA | 55.46 | LAPTRVVAS | 44.51 | | | | | | |

FIG. 19-27

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1700 | 1 | 3 | 2 | 0 | Y | APTRVVAAE | 55.46 | APTRVVASE | 44.51 | | | | |
| NS3 | 1701 | 1 | 4 | 2 | 0 | Y | PTRVVAAEM | 55.46 | PTRVVASEM | 44.47 | | | | |
| NS3 | 1702 | 1 | 5 | 2 | 0 | Y | TRVVAAEME | 55.42 | TRVVASEMA | 44.47 | | | | |
| NS3 | 1703 | 1 | 5 | 2 | 0 | Y | RVVAAEMEE | 55.42 | RVVASEMAE | 44.47 | | | | |
| NS3 | 1704 | 1 | 5 | 2 | 0 | Y | VVAAEMEEA | 55.42 | VVASEMAEA | 44.47 | | | | |
| NS3 | 1705 | 1.01 | 6 | 2 | 0 | Y | VAAEMEEAL | 55.38 | VASEMAEAL | 44.47 | | | | |
| NS3 | 1706 | 1.54 | 8 | 3 | 0 | Y | ASEMAEALK | 44.47 | AAEMEEALR | 44.47 | AAEMEEALK | 20.72 | | |
| NS3 | 1707 | 1.54 | 8 | 3 | 0 | Y | SEMAEALKG | 44.47 | AEMEEALRG | 44.47 | AEMEEALKG | 20.72 | | |
| NS3 | 1708 | 1.6 | 9 | 3 | 0 | Y | EMAEALKGM | 43.81 | EMEEALRGL | 43.81 | EMEEALKGL | 20.72 | | |
| NS3 | 1709 | 1.6 | 9 | 3 | 0 | Y | MAEALKGMP | 43.81 | MEEALRGLP | 43.81 | MEEALKGLP | 20.72 | | |
| NS3 | 1710 | 1.6 | 10 | 3 | 0 | Y | AEALKGMPI | 43.84 | EEALRGLPI | 43.84 | EEALKGLPI | 20.69 | | |
| NS3 | 1711 | 1.6 | 10 | 3 | 0 | Y | EALKGMPIR | 43.84 | EALRGLPIR | 43.84 | EALKGLPIR | 20.69 | | |
| NS3 | 1712 | 1.6 | 10 | 3 | 0 | Y | ALKGMPIRY | 43.84 | ALRGLPIRY | 43.84 | ALKGLPIRY | 20.69 | | |
| NS3 | 1713 | 1.6 | 9 | 3 | 0 | Y | LKGMPIRYQ | 43.84 | LRGLPIRYQ | 43.62 | LKGLPIRYQ | 20.69 | | |
| NS3 | 1714 | 1.59 | 8 | 3 | 0 | Y | KGMPIRYQT | 43.84 | RGLPIRYQT | 34.62 | KGLPIRYQT | 20.72 | | |
| NS3 | 1715 | 1.61 | 8 | 3 | 0 | Y | GMPIRYQTP | 43.84 | GLPIRYQTP | 32.56 | GLPIRYQT | 22.75 | | |
| NS3 | 1716 | 1.61 | 9 | 3 | 0 | Y | MPIRYQTTA | 43.84 | LPIRYQTTA | 32.56 | LPIRYQTTA | 22.68 | | |
| NS3 | 1717 | 1.85 | 10 | 5 | 0 | Y | PIRYQTTAV | 44.54 | PIRYQTPAI | 28.8 | PIRYQTTAT | 19.91 | PIRYQTPAV | 3.76 |
| NS3 | 1726 | 1.98 | 15 | 5 | 0.15 | Y | KSEHTGKEI | 35.47 | KSEHTGREI | 33.3 | RAEHTGREI | 21.72 | KTEHTGREI | 6.6 | PIRYQTAI | 2.73 |
| NS3 | 1727 | 1.86 | 12 | 4 | 0.15 | Y | SEHTGKEIV | 35.47 | SEHTGREIV | 33.41 | AEHTGREIV | 23.93 | TEHTGREIV | 6.64 | KAEHTGREI | 2.21 |
| NS3 | 1728 | 0.96 | 7 | 2 | 0.15 | Y | EHTGREIVD | 64.05 | EHTGKEIVD | 35.62 | | | | |
| NS3 | 1729 | 0.95 | 4 | 2 | 0 | Y | HTGREIVDL | 64.27 | HTGKEIVDL | 35.66 | | | | |
| NS3 | 1730 | 0.94 | 3 | 2 | 0 | Y | TGREIVDLM | 64.31 | TGKEIVDLM | 35.66 | | | | |
| NS3 | 1731 | 0.95 | 4 | 2 | 0 | Y | GREIVDLMC | 64.27 | GKEIVDLMC | 35.66 | | | | |
| NS3 | 1732 | 0.95 | 4 | 2 | 0 | Y | REIVDLMCH | 64.27 | KEIVDLMCH | 35.66 | | | | |

FIG. 19-28

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1733 | 0.01 | 4 | 1 | 0 | Y | EIVDLMCHA | 99.89 | | | | | | |
| NS3 | 1734 | 0.02 | 5 | 1 | 0 | Y | IVDLMCHAT | 99.85 | | | | | | |
| NS3 | 1735 | 0.02 | 5 | 1 | 0 | Y | VDLMCHATF | 99.85 | | | | | | |
| NS3 | 1736 | 0.02 | 5 | 1 | 0 | Y | DLMCHATFT | 99.85 | | | | | | |
| NS3 | 1737 | 0.25 | 5 | 2 | 0 | Y | LMCHATFTM | 96.05 | LMCHATFTT | 3.8 | | | | |
| NS3 | 1738 | 0.26 | 6 | 2 | 0 | Y | MCHATFTMR | 96.05 | MCHATFTTR | 3.72 | | | | |
| NS3 | 1739 | 0.26 | 6 | 2 | 0 | Y | CHATFTMRL | 96.05 | CHATFTTRL | 3.72 | | | | |
| NS3 | 1740 | 0.25 | 5 | 2 | 0 | Y | HATFTMRLL | 96.09 | HATFTTRLL | 3.72 | | | | |
| NS3 | 1741 | 0.25 | 5 | 2 | 0 | Y | ATFTMRLLS | 96.09 | ATFTTRLLS | 3.72 | | | | |
| NS3 | 1742 | 0.26 | 5 | 2 | 0 | Y | TFTMRLLSP | 96.05 | TFTTRLLSS | 3.72 | | | | |
| NS3 | 1743 | 0.44 | 7 | 3 | 0 | Y | FTMRLLSPV | 93.22 | FTTRLLSST | 3.72 | FTMRLLSP

FIG. 19-29

Species: DENVall (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1758 | 1.33 | 7 | 4 | 0 | Y | LIIMDEAHF | 49.52 | MIIMDEAHF | 44.47 | LIVMDEAHF | 4.28 | LVIMDEAHF | 1.62 |
| NS3 | 1759 | 0.38 | 5 | 3 | 0 | Y | IIMDEAHFT | 93.99 | IVMDEAHFT | 4.31 | VIMDEAHFT | 1.62 | | |
| NS3 | 1760 | 0.26 | 3 | 2 | 0 | Y | IMDEAHFTD | 95.61 | VMDEAHFTD | 4.35 | | | | |
| NS3 | 1761 | 0 | 2 | 1 | 0 | Y | MDEAHFTDP | 99.96 | | | | | | |
| NS3 | 1762 | 1 | 5 | 2 | 0 | Y | DEAHFTDPA | 62.72 | DEAHFTDPS | 36.76 | AHFTDPSSV | 3.47 | | |
| NS3 | 1763 | 1 | 6 | 3 | 0 | Y | EAHFTDPAS | 62.68 | EAHFTDPSS | 36.76 | HFTDPSSVA | 3.47 | | |
| NS3 | 1764 | 1.17 | 7 | 3 | 0 | Y | AHFTDPASI | 62.68 | AHFTDPSSI | 33.3 | FTDPSSVAA | 3.47 | | |
| NS3 | 1765 | 1.17 | 8 | 3 | 0 | Y | HFTDPASIA | 62.65 | HFTDPSSIA | 33.3 | TDPSSVAAR | 3.47 | | |
| NS3 | 1766 | 1.18 | 10 | 3 | 0 | Y | FTDPASIAA | 62.57 | FTDPSSIAA | 33.26 | DPSSVAARG | 3.47 | | |
| NS3 | 1767 | 1.18 | 10 | 3 | 0 | Y | TDPASIAAR | 62.57 | TDPSSIAAR | 33.26 | PSSVAARGY | 3.47 | | |
| NS3 | 1768 | 1.18 | 10 | 3 | 0 | Y | DPASIAARG | 62.57 | DPSSIAARG | 33.26 | SSVAARGYI | 3.47 | | |
| NS3 | 1769 | 1.18 | 10 | 3 | 0 | Y | PASIAARGY | 62.57 | PSSIAARGY | 33.26 | | | | |
| NS3 | 1770 | 1.18 | 10 | 3 | 0 | Y | ASIAARGYI | 62.57 | SSIAARGYI | 33.26 | | | | |
| NS3 | 1771 | 0.26 | 6 | 2 | 0 | Y | SIAARGYIS | 95.98 | SVAARGYIS | 3.83 | | | | |
| NS3 | 1772 | 0.25 | 5 | 2 | 0 | Y | IAARGYIST | 96.02 | VAARGYIST | 3.83 | | | | |
| NS3 | 1773 | 0.02 | 5 | 1 | 0 | Y | AARGYISTR | 99.82 | | | | | | |
| NS3 | 1774 | 0.02 | 4 | 1 | 0 | Y | ARGYISTRV | 99.85 | | | | | | |
| NS3 | 1775 | 0.94 | 3 | 2 | 0 | Y | RGYISTRVG | 65.34 | RGYISTRVE | 34.62 | | | | |
| NS3 | 1776 | 0.94 | 3 | 2 | 0 | Y | GYISTRVGM | 65.34 | GYISTRVEM | 34.62 | | | | |
| NS3 | 1777 | 0.94 | 3 | 2 | 0 | Y | YISTRVGMG | 65.34 | YISTRVEMG | 34.62 | | | | |
| NS3 | 1778 | 0.94 | 3 | 2 | 0 | Y | ISTRVGMGE | 65.34 | ISTRVEMGE | 34.62 | | | | |
| NS3 | 1779 | 0.97 | 4 | 2 | 0 | Y | STRVGMGEA | 65.01 | STRVEMGEA | 34.62 | | | | |
| NS3 | 1780 | 0.97 | 6 | 2 | 0 | Y | TRVGMGEAA | 64.93 | TRVEMGEAA | 34.62 | | | | |
| NS3 | 1781 | 1.15 | 7 | 3 | 0 | Y | RVGMGEAAA | 64.93 | RVEMGEAAA | 30.83 | RVEMGEAAA | 3.8 | | |
| NS3 | 1782 | 1.14 | 6 | 3 | 0 | Y | VGMGEAAAI | 64.97 | VEMGEAAAI | 30.83 | VEMGEAAAI | 3.8 | | |

FIG. 19-30

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1783 | 1.14 | 6 | 3 | 0 | Y | GMGEAAAIF | 64.97 | EMGEAAGIF | 30.83 | EMGEAAIF

FIG. 19-31

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1837 | 1.1 | 6 | 3 | 0 | Y | VWFVPSIKA | 55.31 | VWFVPSIKS | 43.33 | VWFVPSIKT | 0.74 | | | | |
| NS3 | 1838 | 1.1 | 6 | 3 | 0 | Y | WFVPSIKAG | 55.31 | WFVPSIKSG | 43.33 | WFVPSIKTG | 0.74 | | | | |
| NS3 | 1839 | 1.1 | 6 | 3 | 0 | Y | FVPSIKAGN | 55.31 | FVPSIKSGN | 43.33 | FVPSIKTGN | 0.74 | | | | |
| NS3 | 1840 | 1.1 | 8 | 3 | 0 | Y | VPSIKAGND | 55.24 | VPSIKSGND | 43.33 | VPSIKTGND | 0.74 | | | | |
| NS3 | 1841 | 1.11 | 9 | 3 | 0 | Y | PSIKAGNDI | 55.24 | PSIKSGNDI | 43.29 | PSIKTGNDI | 0.74 | | | | |
| NS3 | 1842 | 1.12 | 11 | 3 | 0 | Y | SIKAGNDIA | 55.16 | SIKSGNDIA | 43.29 | SIKTGNDIA | 0.74 | | | | |
| NS3 | 1843 | 1.66 | 11 | 4 | 0 | Y | IKAGNDIAA | 43.33 | IKSGNDIAA | 29.46 | IKAGNDIAN | 25.7 | IKTGNDIAA | 0.74 | | |
| NS3 | 1844 | 1.66 | 10 | 4 | 0 | Y | KSGNDIANC | 43.33 | KAGNDIANC | 29.46 | KAGNDIAAC | 25.7 | KTGNDIAAC | 0.74 | | |
| NS3 | 1845 | 1.62 | 9 | 3 | 0 | Y | SGNDIANCL | 43.33 | AGNDIANCL | 30.05 | AGNDIAACL | 25.7 | | | | |
| NS3 | 1846 | 0.92 | 8 | 2 | 0 | Y | GNDIANCLR | 69.03 | GNDIAACLR | 30.75 | | | | | | |
| NS3 | 1847 | 0.92 | 8 | 2 | 0 | Y | NDIANCLRK | 69.03 | NDIAACLRK | 30.75 | | | | | | |
| NS3 | 1848 | 1.13 | 9 | 3 | 0 | Y | DIANCLRKN | 65.23 | DIAACLRKN | 30.75 | DIANCLRKS | 3.8 | | | | |
| NS3 | 1849 | 1.12 | 8 | 3 | 0 | Y | IANCLRKNG | 65.3 | IAACLRKNG | 30.72 | IANCLRKSG | 3.8 | | | | |
| NS3 | 1850 | 1.12 | 7 | 3 | 0 | Y | ANCLRKNGK | 65.34 | AACLRKNGK | 30.72 | ANCLRKSGK | 3.8 | | | | |
| NS3 | 1851 | 1.8 | 8 | 5 | 0 | Y | NCLRKNGKR | 44.58 | ACLRKNGKK | 29.31 | NCLRKNGKK | 20.8 | NCLRKSGKK | 3.43 | ACLRKNGKR | 1.44 |
| NS3 | 1852 | 1.22 | 6 | 3 | 0 | Y | CLRKNGKKV | 50.11 | CLRKNGKRV | 46.02 | CLRKSGKKV | 3.43 | | | | |
| NS3 | 1853 | 1.28 | 8 | 4 | 0 | Y | LRKNGKKVI | 50.11 | LRKNGKRVI | 45.32 | LRKSGKKVI | 3.39 | LRKNGKRVW | 0.7 | | |
| NS3 | 1854 | 1.28 | 8 | 4 | 0 | Y | RKNGKKVIQ | 50.11 | RKNGKRVIQ | 45.32 | RKSGKKVIQ | 3.39 | RKNGKRVWQ | 0.7 | | |
| NS3 | 1855 | 1.27 | 8 | 4 | 0 | Y | KNGKKVIQL | 50.15 | KNGKRVIQL | 45.32 | KSGKKVIQL | 3.39 | KNGKRVWQL | 0.7 | | |
| NS3 | 1856 | 1.27 | 7 | 4 | 0 | Y | NGKKVIQLS | 50.15 | NGKRVIQLS | 45.32 | SGKKVIQLS | 3.39 | NGKRVWQLS | 0.7 | | |
| NS3 | 1857 | 1.06 | 7 | 2 | 0 | Y | GKKVIQLSR | 53.54 | GKRVIQLSR | 45.69 | | | | | | |
| NS3 | 1858 | 1.06 | 5 | 2 | 0 | Y | KKVIQLSRK | 53.58 | KRVIQLSRK | 45.58 | | | | | | |
| NS3 | 1859 | 1.06 | 5 | 2 | 0 | Y | KVIQLSRKT | 53.58 | RVIQLSRKT | 45.58 | | | | | | |
| NS3 | 1860 | 0.08 | 3 | 1 | 0 | Y | VIQLSRKTF | 99.15 | | | | | | | | |
| NS3 | 1861 | 0.1 | 5 | 2 | 0 | Y | IQLSRKTFD | 98.97 | VQLSRKTFD | 0.74 | | | | | | |

FIG. 19-32

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1862 | 0.93 | 7 | 2 | 0 | Y | QLSRKTFDT | 69.43 | QLSRKTFDS | 30.16 | | | | |
| NS3 | 1863 | 0.93 | 7 | 2 | 0 | Y | LSRKTFDTE | 69.43 | LSRKTFDSE | 30.16 | | | | |
| NS3 | 1864 | 0.93 | 7 | 2 | 0 | Y | SRKTFDTEY | 69.43 | SRKTFDSEY | 30.16 | | | | |
| NS3 | 1865 | 1.29 | 12 | 5 | 0 | Y | RKTFDTEYQ | 65.08 | RKTFDSEYV | 28.69 | RKTFDTEYP | 3.8 | RKTFDSEYI | 1.18 | RKTFDTEYT | 0.29 |
| NS3 | 1866 | 1.29 | 13 | 5 | 0 | Y | KTFDTEYQK | 65.04 | KTFDSEYVK | 28.69 | KTFDTEYPK | 3.8 | KTFDSEYIK | 1.18 | KTFDTEYIK | 0.29 |
| NS3 | 1867 | 1.29 | 13 | 5 | 0 | Y | TFDTEYQKT | 65.12 | TFDSEYVKT | 28.69 | TFDTEYPKT | 3.8 | TFDSEYIKT | 1.18 | TFDSEYAKT | 0.29 |
| NS3 | 1877 | 2.05 | 13 | 5 | 0 | Y | NNDWDFWVT | 44.47 | LNDWDFWVT | 20.76 | TNDWDFWVT | 15.86 | ANDWDFWVT | 14.6 | LTDWDFWVT | 3.8 |
| NS3 | 1878 | 1.21 | 8 | 3 | 0 | Y | NDWDFWVTT | 51.51 | NDWDYWVTD | 44.51 | TDWDFWVTT | 3.8 | | | | |
| NS3 | 1879 | 1.01 | 6 | 2 | 0 | Y | DWDFWVTTD | 55.35 | DWDYWVTTD | 44.51 | | | | | | |
| NS3 | 1880 | 1 | 5 | 2 | 0 | Y | WDFWVTTDI | 55.38 | WDYWVTTDI | 44.51 | | | | | | |
| NS3 | 1881 | 1 | 5 | 2 | 0 | Y | DFWVTTDIS | 55.38 | DYWVTTDIS | 44.51 | | | | | | |
| NS3 | 1882 | 1 | 5 | 2 | 0 | Y | FWVTTDISE | 55.38 | YWVTTDISE | 44.51 | | | | | | |
| NS3 | 1883 | 0.01 | 4 | 1 | 0 | Y | WVTTDISEM | 99.89 | | | | | | | | |
| NS3 | 1884 | 0.01 | 3 | 1 | 0 | Y | VTTDISEMG | 99.93 | | | | | | | | |
| NS3 | 1885 | 0 | 1 | 1 | 0 | Y | TTDISEMGA | 100 | | | | | | | | |
| NS3 | 1886 | 0 | 1 | 1 | 0 | Y | TDISEMGAN | 100 | | | | | | | | |
| NS3 | 1887 | 0 | 1 | 1 | 0 | Y | DISEMGANF | 100 | | | | | | | | |
| NS3 | 1888 | 1.01 | 3 | 2 | 0 | Y | ISEMGANFR | 52.14 | ISEMGANFK | 47.82 | | | | | | |
| NS3 | 1889 | 1.01 | 5 | 2 | 0 | Y | SEMGANFRA | 52.14 | SEMGANFKA | 47.75 | | | | | | |
| NS3 | 1890 | 1.88 | 9 | 5 | 0 | Y | EMGANFRAD | 44.54 | EMGANFKAE | 27.06 | EMGANFKAD | 20.69 | EMGANFRAG | 3.8 | EMGANFRAE | 3.69 |
| NS3 | 1891 | 1.88 | 9 | 5 | 0 | Y | MGANFRADR | 44.54 | MGANFKAER | 27.06 | MGANFKADR | 20.69 | MGANFRAGR | 3.8 | MGANFRAER | 3.69 |
| NS3 | 1892 | 1.88 | 9 | 5 | 0 | Y | GANFRADRV | 44.54 | GANFKAERV | 27.06 | GANFKADRV | 20.69 | GANFRAGRV | 3.8 | GANFRAERV | 3.69 |
| NS3 | 1893 | 1.88 | 10 | 5 | 0 | Y | ANFRADRVI | 44.51 | ANFKAERVI | 27.06 | ANFKADRVI | 20.69 | ANFRAGRVI | 3.8 | ANFRAERVI | 3.69 |
| NS3 | 1894 | 1.88 | 10 | 5 | 0 | Y | NFRADRVID | 44.51 | NFKAERVID | 27.06 | NFKADRVID | 20.69 | NFRAGRVID | 3.8 | NFRAERVID | 3.69 |
| NS3 | 1895 | 1.88 | 10 | 5 | 0 | Y | FRADRVIDP | 44.51 | FKAERVIDP | 27.06 | FKADRVIDP | 20.69 | FRAGRVIDP | 3.8 | FRAERVIDP | 3.69 |

FIG. 19-33

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1896 | 1.88 | 10 | 5 | 0 | Y | RADRVIDPR | 44.51 | KAERVIDPR | 27.06 | KADRVIDPR | 20.69 | RAGRVIDPR | 3.8 | RAERVIDPR | 3.69 |
| NS3 | 1897 | 1.13 | 7 | 3 | 0 | Y | ADRVIDPRR | 65.23 | AERVIDPRR | 30.75 | AGRVIDPRR | 3.8 | | | | |
| NS3 | 1898 | 1.12 | 5 | 3 | 0 | Y | DRVIDPRRC | 65.3 | ERVIDPRRC | 30.75 | GRVIDPRRC | 3.8 | | | | |
| NS3 | 1899 | 0.9 | 3 | 2 | 0 | Y | RVIDPRRCL | 69.14 | RVIDPRRCM | 30.83 | | | | | | |
| NS3 | 1900 | 0.9 | 3 | 2 | 0 | Y | VIDPRRCLK | 69.14 | VIDPRRCMK | 30.83 | | | | | | |
| NS3 | 1901 | 0.9 | 3 | 2 | 0 | Y | IDPRRCLKP | 69.14 | IDPRRCMKP | 30.83 | | | | | | |
| NS3 | 1902 | 0.9 | 3 | 2 | 0 | Y | DPRRCLKPV | 69.14 | DPRRCMKPV | 30.83 | | | | | | |
| NS3 | 1903 | 0.9 | 3 | 2 | 0 | Y | PRRCLKPVI | 69.14 | PRRCMKPVI | 30.83 | | | | | | |
| NS3 | 1904 | 0.91 | 4 | 2 | 0 | Y | RRCLKPVIL | 68.99 | RRCMKPVIL | 30.83 | | | | | | |
| NS3 | 1905 | 1.6 | 8 | 3 | 0 | Y | RCLKPVILK | 44.43 | RCMKPVILT | 30.75 | RCLKPVILT | 24.15 | | | | |
| NS3 | 1906 | 1.63 | 12 | 3 | 0 | Y | CLKPVILKD | 44.36 | CMKPVILTD | 30.53 | CLKPVILTD | 24.15 | | | | |
| NS3 | 1907 | 1.64 | 13 | 4 | 0 | Y | LKPVILKDG | 44.36 | MKPVILTDG | 30.46 | LKPVILTDG | 24.15 | LKPVILPDG | 0.41 | | |
| NS3 | 1908 | 1.65 | 16 | 4 | 0 | Y | KPVILKDGP | 44.25 | KPVILTDGE | 30.46 | KPVILTDGP | 24.08 | KPVILPDGP | 0.41 | | |
| NS3 | 1909 | 1.65 | 16 | 4 | 0 | Y | PVILKDGPE | 44.25 | PVILTDGEE | 30.46 | PVILTDGPE | 24.08 | PVILPDGPE | 0.41 | | |
| NS3 | 1910 | 1.65 | 16 | 4 | 0 | Y | VILKDGPER | 44.25 | VILTDGEER | 30.46 | VILTDGPER | 24.08 | VILPDGPER | 0.41 | | |
| NS3 | 1911 | 1.65 | 15 | 4 | 0 | Y | ILKDGPERV | 44.28 | ILTDGEERV | 30.46 | ILTDGPERV | 24.08 | ILPDGPERV | 0.41 | | |
| NS3 | 1912 | 1.69 | 17 | 5 | 0 | Y | LKDGPERVI | 44.28 | LTDGEERVI | 29.98 | LTDGPERVI | 24.08 | LTDGEERVV | 0.48 | LPDGPERVI | 0.41 |
| NS3 | 1913 | 1.67 | 15 | 5 | 0 | Y | KDGPERVIL | 44.36 | TDGEERVIL | 29.98 | TDGPERVIL | 24.15 | TDGEERVVL | 0.48 | PDGPERVIL | 0.41 |
| NS3 | 1914 | 0.99 | 11 | 3 | 0 | Y | DGPERVILA | 68.92 | DGEERVILA | 30.05 | DGEERVVLA | 0.48 | | | | |
| NS3 | 1915 | 0.96 | 6 | 2 | 0 | Y | GPERVILAG | 68.99 | GEERVILAG | 30.24 | | | | | | |
| NS3 | 1916 | 0.95 | 5 | 2 | 0 | Y | PERVILAGP | 68.99 | EERVILAGP | 30.31 | | | | | | |
| NS3 | 1917 | 0.28 | 3 | 2 | 0 | Y | ERVILAGPM | 95.58 | ERVILAGPI | 3.91 | | | | | | |
| NS3 | 1918 | 0.29 | 4 | 2 | 0 | Y | RVILAGPMP | 95.58 | RVILAGPIP | 3.91 | | | | | | |
| NS3 | 1919 | 0.29 | 5 | 2 | 0 | Y | VILAGPMPV | 95.54 | VILAGPIPV | 3.91 | | | | | | |
| NS3 | 1920 | 0.29 | 5 | 2 | 0 | Y | ILAGPMPVT | 95.54 | ILAGPIPVT | 3.91 | | | | | | |

FIG. 19-34

Species: DENVall (9-mers)

| protein | block starting position | block entropy | total peptides in block | # peptides required to cover 99% of block | gap/X fraction | w/ <= 5 peptides? 99% of block covered | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1921 | 1.68 | 7 | 4 | 0 | Y | LAGPMPVTV | 46.83 | LAGPMPVTH | 30.75 | LAGPMPVTA | 18.44 | LAGPIPVTP | 3.8 | |
| NS3 | 1922 | 1.7 | 8 | 4 | 0 | Y | AGPMPVTVA | 46.83 | AGPMPVTHS | 30.53 | AGPMPVTAA | 18.44 | AGPIPVTPA | 3.8 | |
| NS3 | 1923 | 1.71 | 9 | 4 | 0 | Y | GPMPVTVAS | 46.83 | GPMPVTHSS | 30.49 | GPMPVTAAS | 18.44 | GPIPVTPAS | 3.8 | |
| NS3 | 1924 | 1.71 | 9 | 4 | 0 | Y | PMPVTVASA | 46.83 | PMPVTHSSA | 30.49 | PMPVTAASA | 18.44 | PIPVTPASA | 3.8 | |
| NS3 | 1925 | 1.71 | 9 | 4 | 0 | Y | MPVTVASAA | 46.83 | MPVTHSSAA | 30.49 | MPVTAASAA | 18.44 | IPVTPASAA | 3.8 | |
| NS3 | 1926 | 1.7 | 8 | 4 | 0 | Y | PVTVASAAQ | 46.83 | PVTHSSAAQ | 30.49 | PVTAASAAQ | 18.44 | PVTPASAAQ | 3.8 | |
| NS3 | 1927 | 1.69 | 7 | 4 | 0 | Y | VTVASAAQR | 46.83 | VTHSSAAQR | 30.53 | VTAASAAQR | 18.55 | VTPASAAQR | 3.8 | |
| NS3 | 1928 | 1.69 | 6 | 4 | 0 | Y | TVASAAQRR | 46.83 | THSSAAQRR | 30.57 | TAASAAQRR | 18.55 | TPASAAQRR | 3.8 | |
| NS3 | 1929 | 1.69 | 6 | 4 | 0 | Y | VASAAQRRG | 46.83 | HSSAAQRRG | 30.57 | AASAAQRRG | 18.55 | PASAAQRRG | 3.8 | |
| NS3 | 1930 | 0.91 | 4 | 2 | 0 | Y | ASAAQRRGR | 69.17 | SSAAQRRGR | 30.57 | | | | | |
| NS3 | 1931 | 0.77 | 3 | 2 | 0 | Y | SAAQRRGRI | 77.62 | SAAQRRGRV | 22.35 | | | | | |
| NS3 | 1932 | 0.77 | 2 | 2 | 0 | Y | AAQRRGRIG | 77.62 | AAQRRGRVG | 22.38 | | | | | |
| NS3 | 1933 | 0.77 | 2 | 2 | 0 | Y | AQRRGRIGR | 77.62 | AQRRGRVGR | 22.38 | | | | | |
| NS3 | 1934 | 0.79 | 4 | 2 | 0 | Y | QRRGRIGRN | 77.43 | QRRGRVGRN | 22.38 | | | | | |
| NS3 | 1935 | 1.95 | 12 | 4 | 0 | Y | RRGRIGRNP | 33.08 | RRGRIGRNH | 32.74 | RRGRVGRNH | 22.23 | RRGRVGRNP | 11.36 | |
| NS3 | 1945 | 2.08 | 12 | 5 | 0 | Y | KEGDQYIYM | 35.44 | NENDQYIYM | 30.64 | KENDQYIFT | 20.28 | KEGDQYYYM | 9.03 | QEDDQYVFS | 3.8 |
| NS3 | 1946 | 2.08 | 12 | 5 | 0 | Y | EGDQYIYMG | 35.44 | ENDQYIYMG | 30.64 | ENDQYIFTG | 20.28 | EGDQYYYMG | 9.03 | EDDQYVFSG | 3.8 |
| NS3 | 1947 | 2.08 | 10 | 5 | 0 | Y | GDQYIYMGQ | 35.44 | NDQYIYMGE | 30.68 | NDQYIFTGQ | 20.28 | GDQYYYMGQ | 9.07 | DDQYVFSGD | 3.8 |
| NS3 | 1948 | 2.06 | 9 | 5 | 0 | Y | DQYIYMGQP | 35.36 | DQYIYMGEP | 30.83 | DQYIFTGQP | 20.28 | DQYYYMGQP | 9.07 | DQYVFSGDP | 3.8 |
| NS3 | 1949 | 2.07 | 11 | 5 | 0 | Y | QYIYMGQPL | 44.06 | QYIYMGEPL | 30.83 | QYIFTGQPL | 20.32 | QYYYMGQPL | 9.03 | QYVFSGDPL | 3.8 |
| NS3 | 1952 | 1.79 | 14 | 4 | 0 | Y | YMGQPLNND | 44.43 | YMGEPLEND | 30.79 | FTGQPLNND | 20.32 | FSGDPLKND | 3.69 | FMGQPLNND | 0.37 |
| NS3 | 1953 | 1.77 | 14 | 4 | 0 | Y | MGQPLNNDE | 64.79 | MGEPLENDE | 30.75 | TGQPLNNDE | 20.32 | SGDPLKNDE | 3.69 | |
| NS3 | 1954 | 1.18 | 13 | 3 | 0 | Y | GQPLNNDED | 64.79 | GEPLENDED | 30.72 | GDPLKNDED | 3.69 | | | |
| NS3 | 1955 | 1.18 | 13 | 3 | 0 | Y | QPLNNDEDH | 64.79 | EPLENDEDC | 30.72 | DPLKNDEDH | 3.69 | | | |
| NS3 | 1956 | 1.17 | 12 | 3 | 0 | Y | PLNNDEDHA | 64.79 | PLENDEDCA | 30.72 | PLKNDEDHA | 3.98 | | | |

FIG. 19-35

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1957 | 1.18 | 14 | 3 | 0 | Y | LNNDEDH

FIG. 19-36

Species: DENVall (9-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1982 | 1.15 | 9 | 3 | 0 | Y | IIPALF

FIG. 19-37

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2007 | 1.72 | 9 | 4 | 0 | Y | ARKTFVELM | 44.54 | ARKTFVDLM | 30.6 | SRKITFVELM | 20.8 | QRKITFVELM | 3.8 | | |
| NS3 | 2008 | 0.96 | 8 | 2 | 0 | Y | RKTFVELMR | 69.1 | RKTFVDLMR | 30.09 | | | | | | |
| NS3 | 2009 | 0.96 | 8 | 2 | 0 | Y | KTFVELMRR | 69.1 | KTFVDLMRR | 30.09 | | | | | | |
| NS3 | 2010 | 0.95 | 6 | 2 | 0 | Y | TFVELMRRG | 69.1 | TFVDLMRRG | 30.2 | | | | | | |
| NS3 | 2011 | 0.96 | 8 | 2 | 0 | Y | FVELMRRGD | 68.99 | FVDLMRRGD | 30.2 | | | | | | |
| NS3 | 2012 | 0.96 | 8 | 2 | 0 | Y | VELMRRGDL | 68.99 | VDLMRRGDL | 30.2 | | | | | | |
| NS3 | 2013 | 0.96 | 7 | 2 | 0 | Y | ELMRRGDLP | 69.03 | DLMRRGDLP | 30.2 | | | | | | |
| NS3 | 2014 | 0.07 | 5 | 1 | 0 | Y | LMRRGDLPV | 99.23 | | | | | | | | |
| NS3 | 2015 | 0.07 | 5 | 1 | 0 | Y | MRRGDLPVW | 99.23 | | | | | | | | |
| NS3 | 2016 | 0.07 | 4 | 1 | 0 | Y | RRGDLPVWL | 99.26 | | | | | | | | |
| NS3 | 2017 | 1.01 | 4 | 2 | 0 | Y | RGDLPVWLA | 51.47 | RGDLPWLS | 48.41 | | | | | | |
| NS3 | 2018 | 1.58 | 7 | 4 | 0 | Y | GDLPVWLSY | 47.79 | GDLPVWLAY | 31.08 | GDLPVWLAH | 20.1 | GDLPWLSH | 0.63 | | |
| NS3 | 2019 | 1.87 | 9 | 5 | 0 | Y | DLPVWLSYK | 47.79 | DLPVWLAYK | 20.61 | DLPVWLAHK | 20.1 | DLPVWLAYR | 10.44 | DLPVWLSHK | 0.63 |
| NS3 | 2020 | 1.86 | 7 | 4 | 0 | Y | LPVWLSYKV | 47.79 | LPVWLAYKV | 20.61 | LPVWLAHKV | 20.21 | LPVWLAYRV | 10.44 | | |
| NS3 | 2021 | 1.86 | 8 | 5 | 0 | Y | PVWLSYKVA | 47.75 | PVWLAYKVA | 20.61 | PVWLAHKVA | 20.21 | PVWLAYRVA | 10.44 | | |
| NS3 | 2022 | 1.94 | 9 | 5 | 0 | Y | VWLSYKVAS | 47.75 | VWLAHKVAS | 20.21 | VWLAYKVAA | 19.17 | VWLAYRVAA | 10.44 | VWLAYKVAS | 1.44 |
| NS3 | 2035 | 2.02 | 14 | 5 | 0.04 | Y | YSDRRWCFD | 44.32 | YTDRKWCFD | 21.02 | YADRRWCFD | 21.02 | YADRKWCFD | 9.4 | YKDREWCFT | 3.69 |
| NS3 | 2036 | 2.02 | 14 | 5 | 0.04 | Y | SDRRWCFDG | 44.32 | ADRRWCFDG | 21.02 | TDRKWCFDG | 21.02 | ADRKWCFDG | 9.4 | KDREWCFTG | 3.69 |
| NS3 | 2046 | 1.57 | 9 | 3 | 0 | Y | RNNQVLEEN | 44.43 | KNNQILEEN | 29.2 | RNNQILEEN | 26.14 | | | | |
| NS3 | 2047 | 1.58 | 9 | 3 | 0 | Y | NNQVLEENM | 44.4 | NNQILEENM | 31.86 | NNQILEENV | 23.34 | | | | |
| NS3 | 2048 | 1.88 | 11 | 4 | 0 | Y | NQVLEENMD | 44.4 | NQILEENVE | 23.3 | NQILEENMD | 23.3 | NQILEENME | 11.06 | | |
| NS3 | 2049 | 1.87 | 10 | 4 | 0 | Y | QVLEENMDV | 44.4 | QILEENVEV | 23.34 | QILEENMDV | 23.3 | QILEENMEV | 11.06 | | |
| NS3 | 2050 | 1.87 | 10 | 4 | 0 | Y | VLEENMDVE | 44.4 | ILEENVEVE | 23.34 | ILEENMDVE | 23.3 | ILEENMEVE | 11.06 | | |
| NS3 | 2051 | 1.33 | 13 | 4 | 0 | Y | LEENMDVEI | 65.12 | LEENVEVEI | 23.3 | LEENMEVEI | 10.55 | LEENMEVEV | 0.52 | | |
| NS3 | 2052 | 1.33 | 13 | 4 | 0 | Y | EENMDVEIW | 65.12 | EENVEVEIW | 23.3 | EENMEVEIW | 10.55 | EENMEVEVW | 0.52 | | |

FIG. 19-38

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2053 | 1.34 | 15 | 4 | 0 | Y | ENMDVEIWT | 65.04 | ENMEVEIWT | 23.23 | ENMEVEIWT | 10.55 | | |
| NS3 | 2054 | 1.44 | 15 | 5 | 0 | Y | NMDVEIWTK | 65.08 | NVEVEIWTK | 23.23 | NMEVEIWTK | 6.75 | NMEVEWTK | 0.52 |
| NS3 | 2055 | 1.44 | 15 | 5 | 0 | Y | MDVEIWTKE | 65.12 | VEVEIWTKE | 23.19 | MEVEIWTKE | 6.75 | MEVEWTKE | 0.52 |
| NS3 | 2056 | 1.18 | 9 | 3 | 0 | Y | DVEIWTKEG | 65.23 | EVEIWTKEG | 30.05 | EVEIWTREG | 3.8 | | |
| NS3 | 2066 | 1.61 | 13 | 4 | 0 | Y | ERKKLRPRW | 49.89 | ERKKLKPRW | 30.75 | EKKKLRPRW | 17.22 | EKKKLRPKW | 1.73 | | |
| NS3 | 2067 | 1.6 | 11 | 4 | 0 | Y | RKKLRPRWL | 49.96 | RKKLRPRWL | 30.75 | KKKLRPRWL | 17.22 | KKKLRPKWL | 1.73 | | |
| NS3 | 2068 | 1.03 | 8 | 3 | 0 | Y | KKLRPRWLD | 67.22 | KKLRPRWLD | 30.83 | KKLRPKWLD | 1.73 | | |
| NS3 | 2069 | 1.04 | 9 | 3 | 0 | Y | KLRPRWLDA | 67.26 | KLKPRWLDA | 30.75 | KLRPKWLDA | 1.73 | | |
| NS3 | 2070 | 1.04 | 9 | 3 | 0 | Y | LRPRWLDAR | 67.33 | LKPRWLDAR | 30.68 | LRPKWLDAR | 1.73 | | |
| NS3 | 2071 | 1.22 | 12 | 4 | 0 | Y | RPRWLDART | 65.12 | KPRWLDARI | 30.05 | RPRWLDARV | 2.18 | RPKWLDARV | 1.73 | | |
| NS3 | 2072 | 1.16 | 9 | 3 | 0 | Y | PRWLDARTY | 65.78 | PRWLDARIY | 30.09 | PRWLDARVY | 2.18 | PKWLDARVY | 1.73 | | |
| NS3 | 2073 | 1.17 | 10 | 4 | 0 | Y | RWLDARTYS | 65.78 | RWLDARIYS | 30.09 | RWLDARYA | 2.06 | KWLDARYA | 1.73 | | |
| NS3 | 2074 | 1.13 | 9 | 3 | 0 | Y | WLDARTYSD | 65.78 | WLDARIYSD | 30.09 | WLDARYAD | 3.8 | | |
| NS3 | 2075 | 1.13 | 9 | 3 | 0 | Y | LDARTYSDP | 65.78 | LDARIYSDP | 30.09 | LDARYADP | 3.8 | | |
| NS3 | 2076 | 1.14 | 10 | 3 | 0 | Y | DARTYSDPL | 65.74 | DARIYSDPL | 30.09 | DARYADPM | 3.8 | | |
| NS3 | 2077 | 1.15 | 11 | 3 | 0 | Y | ARTYSDPLA | 65.74 | ARIYSDPLA | 30.01 | ARYYADPMA | 3.8 | | |
| NS3 | 2078 | 1.15 | 11 | 3 | 0 | Y | RTYSDPLAL | 65.67 | RIYSDPLAL | 30.05 | RYYADPMAL | 3.8 | | |
| NS3 | 2079 | 1.75 | 12 | 4 | 0.07 | Y | TYSDPLALR | 44.28 | IYSDPLALK | 30.05 | TYSDPLALK | 21.35 | VYADPMALK | 3.76 | | |
| NS3 | 2080 | 1.23 | 10 | 3 | 0.07 | Y | YSDPLALKE | 51.4 | YSDPLALRE | 44.4 | YADPMALKD | 3.76 | | |
| NS3 | 2081 | 1.24 | 12 | 3 | 0.07 | Y | SDPLALKEF | 51.4 | SDPLALREF | 44.32 | ADPMALKDF | 3.76 | | |
| NS3 | 2082 | 1.24 | 12 | 3 | 0.07 | Y | DPLALKEFK | 51.4 | DPLALREFK | 44.32 | DPMALKDFK | 3.76 | | |
| NS3 | 2083 | 1.74 | 13 | 4 | 0.07 | Y | PLALREFKE | 44.32 | PLALKEFKE | 31.19 | PLALKEFKD | 20.21 | PMALKDFKE | 3.76 | | |
| NS3 | 2084 | 1.74 | 13 | 4 | 0.07 | Y | LALREFKEF | 44.32 | LALKEFKEF | 31.19 | LALKEFKDF | 20.21 | MALKDFKEF | 3.76 | | |
| NS3 | 2085 | 1.73 | 12 | 4 | 0.07 | Y | ALREFKEFA | 44.36 | ALKEFKEFA | 31.19 | ALKEFKDFA | 20.21 | ALKDFKEFA | 3.76 | | |
| NS3 | 2086 | 1.73 | 11 | 4 | 0.07 | Y | LREFKEFAA | 44.36 | LKEFKEFAA | 31.27 | LKEFKDFAA | 20.21 | LKDFKEFAS | 3.76 | | |

FIG. 19-39

| protein | block starting position (9-mers) | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2087 | 1.72 | 10 | 4 | 0.07 | Y | REFKEFAAG | 44.36 | KEFKEFAAG | 31.27 | KEFKEFAAG | 20.28 | | |
| NS3 | 2088 | 0.97 | 8 | 3 | 0.07 | Y | EFKEFAAGR | 75.63 | EFKDFAAGR | 20.28 | DFKEFAAGR | 3.8 | | |
| NS3 | 2089 | 1.72 | 9 | 4 | 0.07 | Y | FKEFAAGRR | 44.25 | FKEFAAGRK | 31.38 | FKDFAAGRK | 20.28 | FKEFASGRK | 3.8 |
| NS3 | 2090 | 1.71 | 8 | 4 | 0 | Y | KEFAAGRRS | 44.32 | KEFAAGRKS | 31.42 | KDFAAGRKS | 20.28 | KEFASGRKS | 3.8 |
| NS3 | 2091 | 1.78 | 12 | 5 | 0 | Y | EFAAGRSV | 44.14 | EFAAGRKSL | 30.75 | DFAAGRKSI | 20.28 | EFASGRKSI | 3.76 | EFAAGRKSI | 0.55 |
| NS3 | 2092 | 1.8 | 14 | 5 | 0 | Y | FAAGRSYS | 44.1 | FAAGRKSLT | 30.2 | FAAGRKSIA | 20.76 | FASGRKSIT | 3.76 | FAAGRKSLA | 0.55 |
| NS3 | 2093 | 1.83 | 17 | 5 | 0 | Y | AAGRRSVSG | 43.99 | AAGRKSLTL | 30.2 | AAGRKSIAL | 20.5 | ASGRKSLTL | 3.76 | AAGRKSLAL | 0.55 |
| NS3 | 2102 | 1.81 | 14 | 5 | 0 | Y | DLILEIGKL | 44.17 | NLITEMGRL | 30.16 | DLVTEIGRV | 20.8 | DILTEIASL | 3.47 | SLITEMGRL | 0.41 |
| NS3 | 2103 | 1.77 | 12 | 4 | 0 | Y | LILEIGKLP | 44.21 | LITEMGRLP | 30.57 | LVTEIGRVP | 20.8 | ILTEIASLP | 3.47 | |
| NS3 | 2104 | 1.9 | 15 | 5 | 0 | Y | ILEIGKLPQ | 44.21 | ITEMGRLPT | 30.6 | VTEIGRVPS | 17.7 | LTEIASLPT | 3.43 | VTEIGRVPT | 3.06 |
| NS3 | 2105 | 1.9 | 14 | 5 | 0 | Y | LEIGKLPQH | 44.25 | TEMGRLPTF | 30.57 | TEIGRVPSH | 17.74 | TEIASLPTY | 3.43 | TEIGRVPTH | 3.06 |
| NS3 | 2106 | 1.87 | 12 | 5 | 0 | Y | EIGKLPQHL | 44.54 | EMGRLPTFM | 30.57 | EIGRVPSHL | 17.74 | EIASLPTYL | 3.43 | EIGRVPTHL | 3.06 |
| NS3 | 2107 | 1.89 | 16 | 5 | 0 | Y | IGKLPQHLT | 44.43 | MGRLPTFMT | 30.57 | IGRVPSHLA | 17.7 | IASLPTYLS | 3.43 | IGRVPTHLA | 3.06 |
| NS3 | 2119 | 2.05 | 17 | 5 | 0 | Y | QNALDNLVM | 44.28 | RNALDNLYM | 20.69 | RDALDNLAV | 19.14 | RNALDNLAV | 11.47 | KLALDNIVM | 3.8 |
| NS4A | 2120 | 1.45 | 13 | 3 | 0 | Y | NALDNLVML | 64.97 | DALDNLAVL | 19.14 | NALDNLAVL | 11.62 | | |
| NS4A | 2121 | 1.14 | 10 | 3 | 0 | Y | ALDNLVMLH | 65.15 | ALDNLAVLH | 30.72 | ALDNIVMLH | 3.8 | | |
| NS4A | 2122 | 1.78 | 13 | 4 | 0 | Y | LDNLVMLHN | 44.32 | LDNLAVLHT | 30.2 | LDNLVMLHT | 20.76 | LDNIVMLHT | 3.8 | |
| NS4A | 2123 | 1.78 | 13 | 4 | 0 | Y | DNLVMLHNS | 44.32 | DNLAVLHTA | 30.2 | DNLVMLHTS | 20.76 | DNIVMLHTT | 3.8 | |
| NS4A | 2124 | 1.78 | 13 | 4 | 0 | Y | NLVMLHNSE | 44.32 | NLAVLHTAE | 30.2 | NLVMLHTSE | 20.76 | NIVMLHTTE | 3.8 | |
| NS4A | 2137 | 1.82 | 15 | 5 | 0 | Y | AYRHAMEEL | 43.95 | AYNHALSEL | 30.01 | AYRHAVEEL | 20.83 | AYQHALNEL | 3.8 | AYTHALSEL | 0.52 |
| NS4A | 2138 | 1.81 | 14 | 5 | 0 | Y | YRHAMEELP | 43.99 | YNHALSELP | 30.01 | YRHAVEELP | 20.83 | YQHALNELP | 3.8 | YTHALSELP | 0.52 |
| NS4A | 2139 | 1.81 | 15 | 5 | 0 | Y | RHAMEELPD | 43.95 | NHALSELPE | 30.13 | RHAVEELPE | 20.8 | QHALNELPE | 3.8 | THALSELPE | 0.52 |
| NS4A | 2140 | 1.77 | 13 | 4 | 0 | Y | HAMEELPDT | 44.03 | HALSELPET | 30.64 | HAVEELPET | 20.8 | HALNELPES | 3.8 | |
| NS4A | 2141 | 1.76 | 11 | 4 | 0 | Y | AMEELPDTI | 44.06 | ALSELPETL | 30.64 | AVEELPETM | 20.83 | ALNELPESL | 3.8 | |
| NS4A | 2142 | 1.76 | 11 | 4 | 0 | Y | MEELPDTIE | 44.06 | LSELPETLE | 30.64 | VEELPETME | 20.83 | LNELPESLE | 3.8 | |

FIG. 19-40

| protein | block starting position | block entropy (9-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2143 | 1.72 | 8 | 4 | 0 | Y | EELPDTIET | 44.51 | SELPETLET | 30.64 | EELPETMET | 20.83 | NELPESL

FIG. 19-41

Species: DENVall (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2210 | 1.52 | 6 | 3 | 0 | Y | FFLMVLLIP | 48.23 | FFLVILLI

FIG. 19-42

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

FIG. 19-43

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2302 | 1.55 | 4 | 3 | 0 | Y | PMMRHTIEN | 44.51 | PMLRHSIEN | 30.79 | PMLRHTIEN | 24.67 | | |
| NS4B | 2303 | 1.7 | 5 | 4 | 0 | Y | MMRHTIENT | 44.51 | MLRHSIENS | 30.79 | MLRHTIENS | 20.83 | MLRHTIENT | 3.83 |
| NS4B | 2304 | 1.7 | 5 | 4 | 0 | Y | MRHTIENTT | 44.51 | LRHSIENSS | 30.83 | LRHTIENST | 20.83 | LRHTIENTS | 3.8 |
| NS4B | 2305 | 1.69 | 4 | 4 | 0 | Y | RHTIENTTA | 44.54 | RHSIENSSY | 30.83 | RHTIENSTA | 20.83 | RHTIENTSA | 3.8 |
| NS4B | 2306 | 1.69 | 6 | 4 | 0 | Y | HTIENTTAN | 44.54 | HSIENSSYN | 30.83 | HTIENSTAN | 20.83 | HTIENTSAN | 3.8 |
| NS4B | 2307 | 1.71 | 6 | 4 | 0 | Y | TIENTTANI | 44.54 | SIENSSYNV | 30.6 | TIENSTANV | 20.83 | TIENTSANL | 3.8 |
| NS4B | 2308 | 1.71 | 6 | 4 | 0 | Y | IENTTANIS | 44.54 | IENSSYNVS | 30.6 | IENSTANVS | 20.83 | IENTSANLS | 3.8 |
| NS4B | 2309 | 1.71 | 7 | 4 | 0 | Y | ENTTANISL | 44.54 | ENSSYNVSL | 30.6 | ENSTANVSL | 20.83 | ENTSANLSL | 3.8 |
| NS4B | 2310 | 1.72 | 7 | 4 | 0 | Y | NTTANISLT | 44.54 | NSSYNVSLT | 30.6 | NSTANVSLA | 20.83 | NTSANLSLA | 3.76 |
| NS4B | 2311 | 1.72 | 8 | 4 | 0 | Y | TTANISLTA | 44.54 | SSYNVSLTA | 30.6 | STANVSLAA | 20.83 | TSANLSLAA | 3.76 |
| NS4B | 2312 | 1.73 | 8 | 4 | 0 | Y | TANISLTAI | 44.54 | SYNVSLTAI | 30.53 | TANVSLAAI | 20.83 | SANLSLAAI | 3.76 |
| NS4B | 2313 | 1.73 | 7 | 4 | 0 | Y | ANISLTAIA | 44.54 | YNVSLTAIA | 30.53 | ANVSLAAIA | 20.83 | ANLSLAAIA | 3.76 |
| NS4B | 2314 | 1.71 | 8 | 4 | 0 | Y | NISLTAIAN | 44.65 | NVSLTAIAN | 30.53 | NVSLAAIAN | 20.83 | NLSLAAIAN | 3.76 |
| NS4B | 2315 | 1.72 | 8 | 4 | 0 | Y | ISLTAIANQ | 44.65 | VSLTAIANQ | 30.53 | VSLAAIANQ | 20.83 | LSLAAIANQ | 3.72 |
| NS4B | 2316 | 0.82 | 4 | 2 | 0 | Y | SLTAIANQA | 75.33 | SLAAIANQA | 24.56 | | | | |
| NS4B | 2317 | 1.7 | 6 | 4 | 0 | Y | LTAIANQAA | 44.58 | LTAIANQAT | 30.75 | LAAIANQAA | 20.83 | LAAIANQAA | 3.72 |
| NS4B | 2318 | 1.7 | 7 | 4 | 0 | Y | TAIANQAAI | 44.54 | TAIANQATV | 30.75 | AAIANQAAV | 20.83 | AAIANQAAV | 3.72 |
| NS4B | 2319 | 1.71 | 6 | 4 | 0 | Y | AIANQAAIL | 44.54 | AIANQATVL | 30.75 | AIANQAAVL | 20.83 | AIANQAAVL | 3.76 |
| NS4B | 2320 | 1.71 | 7 | 4 | 0 | Y | IANQAAILM | 44.54 | IANQATVLM | 30.72 | IANQAAVLM | 20.83 | IANQAAVLM | 3.76 |
| NS4B | 2321 | 1.71 | 6 | 4 | 0 | Y | ANQAAILMG | 44.54 | ANQATVLMG | 30.79 | ANQAAVLMG | 20.83 | ANQAAVLMG | 3.76 |
| NS4B | 2322 | 1.72 | 6 | 4 | 0 | Y | NQAAILMGL | 44.54 | NQATVLMGL | 30.79 | NQAVLMGL | 20.83 | NQAAVLMGL | 3.76 |
| NS4B | 2323 | 1.72 | 8 | 4 | 0 | Y | QAAILMGLD | 44.43 | QATVLMGLG | 30.79 | QAVLMGLD | 20.76 | QAAVLMGLG | 3.76 |
| NS4B | 2324 | 1.86 | 8 | 5 | 0 | Y | AAILMGLDK | 44.43 | ATVLMGLGK | 27.69 | AVVLMGLDK | 20.76 | AAVLMGLGK | 3.8 | ATVLMGLGR | 3.1 |
| NS4B | 2325 | 1.86 | 8 | 5 | 0 | Y | AILMGLDKG | 44.43 | TVLMGLGKG | 27.69 | VVLMGLDKG | 20.76 | AVLMGLGKG | 3.8 | TVLMGLGRG | 3.1 |
| NS4B | 2326 | 1.69 | 7 | 4 | 0 | Y | ILMGLDKGW | 44.43 | VLMGLGKGW | 31.49 | VLMGLDKGW | 20.76 | VLMGLGR

FIG. 19-44

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2327 | 1.11 | 7 | 3 | 0 | Y | LMGLDKGWP | 65.19 | LMGLGKGWP | 31.45 | LMGLGRGWP | 3.1 | | |
| NS4B | 2328 | 1.11 | 7 | 3 | 0 | Y | MGLDKGWPI | 65.19 | MGLGKGWPL | 31.45 | MGLGRGWPL | 3.1 | |

FIG. 19-45

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2352 | 1.21 | 11 | 4 | 0 | Y | SQ

FIG. 19-46

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2387 | 0.88 | 5 | 2 | 0 | Y | KRTAAGIMK | 70.94 | KRAAAGIMK | 28.95 | | | | | | |
| NS4B | 2388 | 0.88 | 5 | 2 | 0 | Y | RTAAGIMKN | 70.94 | RAAAGIMKN | 28.95 | | | | | | |
| NS4B | 2389 | 0.88 | 5 | 2 | 0 | Y | TAAGIMKNP | 70.94 | AAAGIMKNP | 28.95 | | | | | | |
| NS4B | 2390 | 0.02 | 5 | 1 | 0 | Y | AAGIMKNPT | 99.85 | | | | | | |

FIG. 19-47

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2421 | 1.57 | 8 | 3 | 0 | Y | GQIMLLILC | 43.95 | GQVMLLILC | 34.11 | GQVMLLILC | 21.5 | | |
| NS4B | 2422 | 1.91 | 13 | 4 | 0 | Y | QIMLLILCT | 43.95 | QVMLLVLCA | 24 | QVMLLVLCV | 21.09 | QVMLLVLCV | 10.07 | | |
| NS4B | 2428 | 1.76 | 14 | 4 | 0 | Y | LCTSQLLLM | 44.47 | LCVTQVLMM | 30.75 | LCAGQLLLM | 20.58 | LCAGQLLLM | 3.36 | | |
| NS4B | 2429 | 1.76 | 15 | 4 | 0 | Y | CTSQLLLMR | 44.47 | CVTQVLMMR | 30.75 | CAVQLLLMR | 20.54 | CAGQLLLMR | 3.36 | | |
| NS4B | 2430 | 1.76 | 14 | 4 | 0 | Y | TSQLLLMRT | 44.51 | VTQVLMMRT | 30.75 | AVQLLLMRT | 20.54 | AGQLLLMRT | 3.36 | | |
| NS4B | 2431 | 1.73 | 11 | 4 | 0 | Y | SQLLLMRTT | 44.51 | TQVLMMRTT | 30.75 | VQLLLMRTS | 20.65 | GQLLLMRTT | 3.72 | | |
| NS4B | 2432 | 1.71 | 8 | 4 | 0 | Y | QLLLMRTTW | 44.54 | QVLMMRTTW | 30.75 | QLLLMRTSW | 20.8 | QLLLMRTTW | 3.72 | | |
|

FIG. 19-48

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2451 | 1.79 | 12 | 5 | 0 | Y | GPLITLWEG | 44.51 | GPISTLWEG | 30.05 | GPITTLWEG | 20.8 | GPILTLWEG | 3.17 | GPVSTLWEG |

FIG. 19-49

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2476 | 0.02 | 4 | 1 | 0 | Y | IFRGSYLAG | 99.82 | | | | | | |
| NS4B | 2477 | 0.04 | 6 | 1 | 0 | Y | FRGSYLAGA | 99.71 | | | | | | |
| NS4B | 2478 | 0.05 | 8 | 1 | 0 | Y | RGSYLAGAG | 99.59 | | | | | | |
| NS4B | 2479 | 0.04 | 7 | 1 | 0 | Y | GSYLAGAGL | 99.63 | | | | | | |
| NS4B | 2480 | 0.94 | 9 | 2 | 0 | Y | SYLAGAGLA | 68.81 | SYLAGAGLL | 30.79 | | | | |
| NS4B | 2481 | 0.93 | 9 | 2 | 0 | Y | YLAGAGLAF | 68.84 | YLAGAGLLF | 30.79 | | | | |
| NS4B | 2482 | 0.94 | 11 | 2 | 0 | Y | LAGAGLAFS | 68.84 | LAGAGLLFS | 30.72 | | | | |
| NS4B | 2483 | 1.56 | 14 | 3 | 0 | Y | AGAGLAFSL | 48.16 | AGAGLLFSI | 30.68 | AGAGLAFSI | 20.61 | | |
| NS4B | 2484 | 1.76 | 16 | 4 | 0 | Y | GAGLAFSLM | 44.36 | GAGLLFSIM | 30.64 | GAGLAFSIM | 20.61 | GAGLAFSLI | 3.8 |
| NS4B | 2485 | 1.8 | 18 | 5 | 0 | Y | AGLAFSLMK | 44.36 | AGLLFSIMK | 30.13 | AGLAFSIMK | 20.58 | AGLAFSLIK | 3.8 | AGLLFSIMR | 0.52 |
| NS4B | 2486 | 1.79 | 16 | 5 | 0 | Y | GLAFSLMKS | 44.4 | GLLFSIMKN | 30.13 | GLAFSIMKS | 20.61 | GLAFSLIKN | 3.8 | GLLFSIMR

FIG. 19-50

Species: DENVall (9-mers)

| protein | block starting position | block entropy | total peptides in block | # peptides required to cover 99% of block | cover 99% of block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2553 | 1.22 | 8 | 3 | 0 | Y | HAVSRGSAK | 51.11 | HAVSRGTAK | 44

FIG. 19-51

Species: DENVall (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2587 | 1.13 | 9 | 3 | 0 | Y | WSYYCAGLK | 65.34 | WSYYMATLK | 30.64 | | | | |
| NS5 | 2588 | 1.22 | 12 | 4 | 0 | Y | SYYCAGLKN | 65.27 | SYYMATLKN | 29.46 | SYYCGGLKD | — | | |
| NS5 | 2589 | 1.23 | 14 | 4 | 0 | Y | YCAGLKNV | 65.19 | YYMATLKNV | 29.46 | YYCGGLKDV | — | | |
| NS5 | 2590 | 1.33 | 16 | 5 | 0 | Y | YCAGLKNVT | 65.15 | YMATLKNVT | 27.62 | YCGGLKNVK | 1.84 | YCGGLKDVR | |
| NS5 | 2591 | 1.33 | 16 | 5 | 0 | Y | CAGLKNVTE | 65.15 | MATLKNVTE | 27.58 | CGGLKNVKE | 1.88 | CGGLKDVRE | |
| NS5 | 2592 | 1.33 | 15 | 5 | 0.04 | Y | AGLKNVTEV | 65.12 | ATLKNVTEV | 27.58 | GGLKNVKEV | 1.88 | GGLKDVREV | |
| NS5 | 2597 | 1.64 | 10 | 4 | 0.07 | Y | VTEVKGYTK | 48.08 | VTEVRGYTK | 28.83 | VKEVKGLTK | 1.88 | | |
| NS5 | 2598 | 1.64 | 11 | 4 | 0.07 | Y | TEVKGYTKG | 48.12 | TEVRGYTKG | 28.8 | KEVKGLTKG | 1.88 | | |
| NS5 | 2599 | 1.54 | 10 | 3 | 0.07 | Y | EVKGYTKGG | 48.08 | EVRGYTKGG | 30.68 | | | | |
| NS5 | 2600 | 1.58 | 11 | 3 | 0.07 | Y | VKGYTKGGP | 47.64 | VRGYTKGGP | 30.72 | | | | |
| NS5 | 2601 | 1.58 | 11 | 3 | 0.07 | Y | KGYTKGGPG | 47.64 | RGYTKGGPG | 30.72 | | | | |
| NS5 | 2602 | 0.98 | 12 | 2 | 0.04 | Y | GYTKGGPGH | 68.4 | | | | | | |
| NS5 | 2603 | 0.99 | 14 | 2 | 0 | Y | YTKGGPGHE | 68.36 | | | | | | |
| NS5 | 2604 | 0.1 | 13 | 1 | 0 | Y | TKGGPGHEE | 99.15 | | | | | | |
| NS5 | 2605 | 0.1 | 14 | 1 | 0 | Y | KGGPGHEEP | 99.12 | | | | | | |
| NS5 | 2606 | 0.84 | 15 | 2 | 0 | Y | GGPGHEEPI | 77.84 | GGPGHEEPV | 21.31 | | | | |
| NS5 | 2607 | 0.84 | 15 | 2 | 0 | Y | GPGHEEPIP | 77.8 | GPGHEEPVP | 21.35 | | | | |
| NS5 | 2608 | 0.84 | 15 | 2 | 0 | Y | PGHEEPIPM | 77.8 | PGHEEPVPM | 21.35 | | | | |
| NS5 | 2609 | 1.58 | 14 | 3 | 0 | Y | GHEEPIPMA | 47.71 | GHEEPIPMS | 30.49 | GHEEPVPMS | 21.09 | | |
| NS5 | 2610 | 1.58 | 15 | 3 | 0 | Y | HEEPIPMAT | 47.68 | HEEPIPMST | 30.49 | HEEPVPMST | 21.09 | | |
| NS5 | 2611 | 1.58 | 15 | 3 | 0 | Y | EEPIPMATY | 47.71 | EEPIPMSTY | 30.49 | EEPVPMSTY | 21.05 | | |
| NS5 | 2612 | 1.58 | 15 | 3 | 0 | Y | EPIPMATYG | 47.71 | EPIPMSTYG | 30.49 | EPVPMSTYG | 21.05 | | |
| NS5 | 2613 | 1.57 | 14 | 3 | 0 | Y | PIPMATYGW | 47.82 | PIPMSTYGW | 30.49 | PVPMSTYGW | 21.05 | | |
| NS5 | 2614 | 1.57 | 15 | 3 | 0 | Y | IPMATYGWN | 47.79 | IPMSTYGWN | 30.49 | VPMSTYGWN | 21.05 | | |
| NS5 | 2615 | 1.54 | 14 | 3 | 0 | Y | PMATYGWNL | 48.08 | PMSTYGWNL | 31.38 | PMSTYGWNI | 20.13 | | |

FIG. 19-52

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2616 | 1.55 | 14 | 3 | 0 | Y | MATYGWNLV | 48.08 | MSTYGWNLV | 31.42 | MSTYGWNLV | 20.02 | | |
| NS5 | 2617 | 1.61 | 16 | 4 | 0 | Y | ATYGWNLVK | 47.86 | STYGWNLVR | 30.83 | STYGWNLVK | 20.02 | STYGWNLVK | 0.59 |
| NS5 | 2618 | 1.54 | 13 | 3 | 0 | Y | TYGWNLVKL | 48.45 | TYGWNLVRL | 31.05 | TYGWNLVKL | 20.06 | | |
| NS5 | 2619 | 1.78 | 20 | 5 | 0 | Y | YGWNLVKLH | 45.17 | YGWNLVRLQ | 30.83 | YGWNLVKLM | 19.95 | YGWNLVKLY | 2.58 | YGWNLVKLM | 0.59 |
| NS5 | 2620 | 1.78 | 20 | 5 | 0 | Y | GWNLVKLHS | 45.17 | GWNLVRLQS | 30.83 | GWNLVKLMS | 19.87 | GWNLVKLYS | 2.58 | GWNLVKLMS | 0.59 |
| NS5 | 2621 | 1.78 | 19 | 5 | 0 | Y | WNLVKLHSG | 45.21 | WNLVRLQSG | 30.83 | WNLVKLMSG | 19.87 | WNLVKLYSG | 2.58 | WNLVKLMSG | 0.59 |
| NS5 | 2626 | 1.93 | 18 | 3 | 0 | Y | LHSGKDVFF | 41.56 | LQSGVDVFF | 30.46 | LMSGKDVFY | 20.61 | LHSGVDVFY | 3.8 | LYSGKDVFF | 2.58 |
| NS5 | 2636 | 0.34 | 10 | 3 | 0.04 | Y | PPEKCDTLL | 95.02 | PTEQVDTLL | 3.76 | PPERCDTLL | 0.81 | | | | |
| NS5 | 2637 | 0.34 | 9 | 3 | 0.04 | Y | PEKCDTLLC | 95.1 | TEQVDTLLC | 3.76 | PERCDTLLC | 0.81 | | | | |
| NS5 | 2638 | 0.33 | 8 | 3 | 0 | Y | EKCDTLLCD | 95.13 | EQVDTLLCD | 3.8 | ERCDTLLCD | 0.81 | | | | |
| NS5 | 2639 | 0.33 | 8 | 3 | 0 | Y | KCDTLLCDI | 95.13 | QVDTLLCDI | 3.8 | RCDTLLCDI | 0.81 | | | | |
| NS5 | 2640 | 0.26 | 7 | 2 | 0 | Y | CDTLLCDIG | 95.94 | VDTLLCDIG | 3.8 | | | | | | |
| NS5 | 2641 | 0.02 | 4 | 1 | 0 | Y | DTLLCDIGE | 99.82 | | | | | | | | |
| NS5 | 2642 | 0.01 | 2 | 1 | 0 | Y | TLLCDIGES | 99.93 | | | | | | | | |
| NS5 | 2643 | 0 | 1 | 1 | 0 | Y | LLCDIGESS | 100 | | | | | | | | |
| NS5 | 2644 | 0.23 | 2 | 2 | 0 | Y | LCDIGESSP | 96.17 | LCDIGESSS | 3.83 | | | | | | |
| NS5 | 2645 | 0.96 | 3 | 3 | 0 | Y | CDIGESSPN | 75.26 | CDIGESSPS | 20.91 | CDIGESSSN | 3.83 | | | | |
| NS5 | 2646 | 0.97 | 4 | 3 | 0 | Y | DIGESSPNP | 75.26 | DIGESSPSP | 20.87 | DIGESSSNP | 3.83 | | | | |
| NS5 | 2647 | 0.97 | 5 | 3 | 0 | Y | IGESSPNPT | 75.26 | IGESSPSPT | 20.8 | IGESSSNPT | 3.83 | | | | |
| NS5 | 2648 | 1.49 | 7 | 4 | 0 | Y | GESSPNPTI | 61.47 | GESSPSPTV | 20.76 | GESSPNPTV | 13.79 | GESSSNPTI | 3.83 | | |
| NS5 | 2649 | 1.5 | 8 | 4 | 0 | Y | ESSPNPTIE | 61.47 | ESSPSPTVE | 20.76 | ESSPNPTVE | 13.75 | ESSSNPTIE | 3.83 | | |
| NS5 | 2650 | 2.02 | 10 | 5 | 0 | Y | SSPNPTIEE | 44.47 | SSPSPTVEE | 20.72 | SSPNPTIEA | 17 | SSPNPTVEA | 13.75 | SSSNPTIEE | 3.83 |
| NS5 | 2651 | 2.03 | 12 | 5 | 0 | Y | SPNPTIEEG | 44.47 | SPSPTVEES | 20.61 | SPNPTIEAG | 17 | SPNPTVEAG | 13.75 | SSNPTIEEG | 3.83 |
| NS5 | 2652 | 2.04 | 13 | 5 | 0 | Y | PNPTIEEGR | 44.47 | PSPTVEESR | 20.61 | PNPTIEAGR | 17 | PNPTVEAGR | 13.72 | SNPTIEEGR | 3.83 |
| NS5 | 2653 | 1.84 | 12 | 4 | 0 | Y | NPTIEEGRT | 48.3 | SPTVEESRT | 20.61 | NPTIEAGRT | 17 | NPTVEAGRT | 13.72 | | |

FIG. 19-53

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2654 | 1.84 | 11 | 4 | 0 | Y | PTIEEGRTL | 48.34 | PTVEESRTI | 20.58 | PTIEA

FIG. 19-54

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2706 | 0.26 | 8 | 2 | 0 | Y | VRNPLSR

FIG. 19-55

Species: DEN/all (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2733 | 1.74 | 10 | 4 | 0 | Y | NMTSRMLLN | 44.54 | NMMTSRMLLN | 30.72 | NMVSRLLLN | 20.72 | NTTSKMLLN | 3.39 | | |
| NS5 | 2734 | 1.74 | 11 | 4 | 0 | Y | MTSRMLLNR | 44.54 | MISRMLLNR | 30.72 | MYSRLLLNR | 20.72 | TTSKMLLNR | 3.39 | | |
| NS5 | 2735 | 1.74 | 12 | 4 | 0 | Y | TSRMLLNRF | 44.51 | ISRMLLNRF | 30.72 | VSRLLLNRF | 20.72 | TSKMLLNRF | 3.39 | | |
| NS5 | 2736 | 1.71 | 8 | 4 | 0 | Y | SRMLLNRFT | 44.58 | SRMLLNRFT | 30.72 | SRLLLNRFT | 20.8 | SKMLLNRFT | 3.76 | | |
| NS5 | 2737 | 1.71 | 8 | 4 | 0 | Y | RMLLNRFTM | 44.58 | RMLLNRFTM | 30.72 | RLLLNRFTM | 20.8 | KMLLNRFTM | 3.76 | | |
| NS5 | 2750 | 1.84 | 14 | 5 | 0 | Y | PTYERDVDL | 42.99 | ATYEPDVDL | 30.53 | PTIEKDVDL | 20.54 | PTYEKDVDL | 4.54 | PTFERDVDL | 0.66 |
| NS5 | 2751 | 1.82 | 12 | 5 | 0 | Y | TYERDVDLG | 42.99 | TYEPDVDLG | 30.72 | TIEKDVDLG | 20.54 | TYEKDVDLG | 4.54 | TFERDVDLG | 0.66 |
| NS5 | 2753 | 1.71 | 10 | 4 | 0 | Y | ERDVDLGAG | 41.45 | EPDVDLGSG | 30.72 | EKDVDLGAG | 25.07 | ERDVDLGTG | 2.47 | | |
| NS5 | 2754 | 1.72 | 12 | 3 | 0 | Y | RDVDLGAGT | 41.41 | PDVDLGSGT | 30.72 | KDVDLGAGT | 25.04 | RDVDLGTGT | 2.47 | | |
| NS5 | 2755 | 1.07 | 7 | 4 | 0 | Y | DVDLGAGTR | 66.45 | DVDLGSGTR | 30.83 | DVDLGAGTRS | 2.47 | VDLGTGTR | 2.47 | | |
| NS5 | 2756 | 1.28 | 8 | 3 | 0 | Y | VDLGAGTRH | 62.76 | VDLGSGTRN | 30.83 | VDLGAGTRS | 3.69 | DLGTGTRHV | 2.47 | | |
| NS5 | 2757 | 1.28 | 9 | 4 | 0 | Y | DLGAGTRHV | 62.72 | DLGSGTRNI | 30.75 | DLGAGTRSV | 3.8 | DLGTGTRHV | 2.47 | | |
| NS5 | 2758 | 1.9 | 15 | 5 | 0 | Y | LGAGTRHVA | 41.59 | LGSGTRNIG | 30.72 | LGAGTRHVN | 30.46 | LGAGTRSYS | 3.8 | LGTGTRHVA | 2.47 |
| NS5 | 2759 | 1.93 | 18 | 5 | 0 | Y | GAGTRHVAY | 41.59 | GSGTRNIGI | 30.46 | GAGTRHVNA | 30.46 | GAGTRSVST | 3.8 | GTGTRHVAV | 2.47 |
| NS5 | 2760 | 1.93 | 19 | 5 | 0 | Y | AGTRHVAVE | 41.56 | SGTRNIGIE | 30.2 | AGTRHVNAE | 30.2 | AGTRSVSTE | 3.8 | TGTRHVAVE | 2.47 |
| NS5 | 2772 | 1.81 | 16 | 4 | 0 | Y | ANLDIIGQR | 44.03 | PNLDIIGKR | 30.2 | PNMDVIGER | 20.76 | PDMTIIGRR | 3.76 | PNMDIIGKR | 0.52 |
| NS5 | 2773 | 1.79 | 16 | 4 | 0 | Y | NLDIIGQRI | 44.25 | NLDIIGKRI | 30.64 | NMDVIGERI | 20.69 | DMTIIGRRL | 3.76 | NMDIIGKRI | 0.52 |
| NS5 | 2775 | 1.85 | 20 | 5 | 0 | Y | DIIGQRIEN | 44.36 | DIIGKRIEK | 30.64 | DVIGERIKR | 18.69 | TIIGRRLQR | 3.76 | DVIGERIRR | 1.92 |
| NS5 | 2776 | 1.85 | 20 | 5 | 0 | Y | IIGQRIENI | 44.4 | IIGKRIEKI | 30.64 | VIGERIKRI | 18.69 | IIGRRLQRL | 3.76 | VIGERIRRI | 1.92 |
| NS5 | 2777 | 1.86 | 19 | 5 | 0 | Y | IGQRIENIK | 44.43 | IGKRIEKIK | 30.6 | IGERIKRIK | 18.69 | IGRRLQRLQ | 3.43 | IGERIRRIK | 1.95 |
| NS5 | 2791 | 1.75 | 14 | 4 | 0 | Y | TWHYDEDNP | 44.43 | SWHYDQDHP | 30.64 | TWHYDDENP | 20.72 | TWHYDQENP | 3.72 | | |
| NS5 | 2792 | 1.74 | 13 | 4 | 0 | Y | WHYDEDNPY | 44.43 | WHYDQDHPY | 30.64 | WHYDDENPY | 20.72 | WHYDQENPY | 3.72 | | |
| NS5 | 2793 | 1.76 | 15 | 4 | 0 | Y | HYDEDNPYK | 44.43 | HYDQDHPYK | 30.49 | HYDDENPYK | 20.69 | HYDQENPYK | 3.72 | | |
| NS5 | 2794 | 1.75 | 12 | 4 | 0 | Y | YDEDNPYKT | 44.47 | YDQDHPYKT | 30.57 | YDDENPYKT | 20.69 | YDQENPYKT | 3.72 | | |
| NS5 | 2795 | 1.73 | 10 | 4 | 0 | Y | DEDNPYKTW | 44.51 | DQDHPYKTW | 30.64 | DDENPYKTW | 20.69 | DQENPYKTW | 3.72 | | |

FIG. 19-56

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2796 | 1.73 | 9 | 4 | 0 | Y | EDNPYKTWA | 44.54 | QDHPYKTWA | 30.64 | DENPYKTWA | 20.69 | QENPYKTWA | 3.72 |

FIG. 19-57

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2821 | 1.55 | 7 | 3 | 0 | Y | VN

FIG. 19-58

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2849 | 0.04 | 6 | 1 | 0.04 | Y | FGQQRVFKE | 99.63 | | | | | | |
| NS5 | 2850 | 0.03 | 5 | 1 | 0.04 | Y | GQQRVFKEK | 99.67 | | | | | | |
| NS5 | 2851 | 0.03 | 5 | 1 | 0.04 | Y | QQRVFKEKV | 99.67 | | | | | | |
| NS5 | 2852 | 0.03 | 4 | 1 | 0 | Y | QRVFKEKVD | 99.74 | | | | | | |
| NS5 | 2853 | 0.03 | 4 | 1 | 0 | Y | RVFKEKVDT | 99.74 | | | | | | |
| NS5 | 2854 | 0.03 | 4 | 1 | 0 | Y | VFKEKVDTR | 99.74 | | | | | | |
| NS5 | 2855 | 0.04 | 6 | 1 | 0 | Y | FKEKVDTRI | 99.67 | | | | | | |
| NS5 | 2856 | 0.92 | 6 | 2 | 0 | Y | KEKVDTRTP | 69.1 | KEKVDTRTQ | 30.6 | | | | |
| NS5 | 2857 | 1.78 | 8 | 4 | 0 | Y | EKVDTRTPK | 36.69 | EKVDTRTQE | 30.53 | EKVDTRTPR | 28.65 | | |
| NS5 | 2891 | 1.63 | 13 | 4 | 0 | Y | PRLCTREEF | 44.8 | PRMCTREEF | 29.61 | PRLCTREEF | 24.48 | | |
| NS5 | 2894 | 1.18 | 15 | 5 | 0 | Y | CTREEFTRK | 70.54 | CTREEFISK | 23.93 | CTREEFISK | 3.69 | CTREEFIRK | 0.41 |
| NS5 | 2895 | 1.18 | 15 | 5 | 0 | Y | TREEFTRKV | 70.58 | TREEFISKV | 23.89 | TREEFISKV | 3.69 | TREEFIRKV | 0.41 |
| NS5 | 2896 | 1.18 | 14 | 5 | 0 | Y | REEFTRKVR | 70.58 | REEFISKVR | 23.93 | RAEFCNKVR | 3.69 | REEFIRKVR | 0.41 |
| NS5 | 2901 | 1.93 | 14 | 5 | 0 | Y | RKVRSNAAI | 44.47 | RKVRSNAAL | 26.59 | KKVRTNAAM | 20.65 | SKVRSNAAI | 3.76 | KKVRSNAAL | 3.58 |
| NS5 | 2902 | 1.53 | 9 | 3 | 0 | Y | KVRSNAAIG | 48.27 | KVRSNAALG | 30.75 | KVRTNAAMG | 20.72 | | |
| NS5 | 2903 | 1.53 | 9 | 3 | 0 | Y | VRSNAAIGA | 48.27 | VRSNAALGA | 30.75 | VRTNAAMGA | 20.72 | | |
| NS5 | 2904 | 1.6 | 9 | 4 | 0 | Y | RSNAAIGAV | 48.27 | RSNAALGAV | 29.54 | RTNAAMGAV | 20.76 | RSNAALGAV | 1.22 | NAALGAVFT | 1.22 |
| NS5 | 2905 | 1.6 | 10 | 4 | 0 | Y | SNAAIGAVF | 48.23 | SNAALGAIF | 29.54 | TNAAMGAVF | 20.76 | SNAALGAVF | 1.22 | AALGAVFTD | 1.22 |
| NS5 | 2906 | 1.83 | 13 | 5 | 0 | Y | NAAIGAVFV | 44.06 | NAALGAIFT | 29.54 | NAAMGAVFT | 20.76 | NAAIGAVFQ | 1.22 | ALGAVFTDE | 1.22 |
| NS5 | 2907 | 1.83 | 14 | 5 | 0 | Y | AAIGAVFVD | 43.99 | AALGAIFTD | 29.54 | AAMGAVFTE | 20.8 | AAIGAVFQE | 3.8 | LGAVFTDEN | 1.22 |
| NS5 | 2908 | 1.83 | 13 | 5 | 0 | Y | AIGAVFVDE | 44.03 | ALGAIFTDE | 29.54 | AMGAVFTEE | 20.8 | AIGAVFQEE | 3.8 | GAVFTDENK | 1.22 |
| NS5 | 2909 | 1.83 | 13 | 5 | 0 | Y | IGAVFVDEN | 44.03 | LGAIFTDEN | 29.54 | MGAVFTEEN | 20.8 | IGAVFQEEQ | 3.8 | AVFTDENKW | 1.18 |
| NS5 | 2910 | 1.83 | 14 | 5 | 0 | Y | GAVFVDENQ | 44.03 | GAIFTDENK | 29.5 | GAVFTEENQ | 20.8 | GAVFQEEQG | 3.8 | VFTDENKWK | 1.18 |
| NS5 | 2911 | 1.84 | 16 | 5 | 0 | Y | AVFVDENQW | 44.03 | AIFTDENKW | 29.46 | AVFTEENQW | 20.8 | AVFQEEQGW | 3.8 | |
| NS5 | 2912 | 1.85 | 19 | 5 | 0 | Y | VFVDENQWN | 43.99 | IFTDENKWK | 29.46 | VFTEENQWD | 20.76 | VFQEEQGWT | 3.76 | |

FIG. 19-59

Species: DENVall (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2913 | 1.78 | 18 | 4 | 0 | Y | FVDENQWNS | 43.99 | FTDENKWKS | 30.64 | FTEENQWDS | 20.69 | FQEEQGWTS | 3

FIG. 19-60

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2955 | 0.03 | 4 | 1 | 0 | Y | MGKREKKLG

FIG. 19-61

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2980 | 0.74 | 5 | 2 | 0 | Y | GARFLEFEA

FIG. 19-62

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3005 | 0.06 | 10 | 1 | 0 | Y | SG

FIG. 19-63

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3071 | 0.82 | 6 | 2 | 0 | Y | LTYQNKVYR | 75.26 | LTYQNKVYK | 24.59 | | | | |
| NS5 | 3072 | 0.82 | 6 | 2 | 0 | Y | TYQNKVYRV | 75.26 | TYQNKVYKV | 24.59 | | | | |
| NS5 | 3073 | 0.98 | 7 | 3 | 0 | Y | YQNKVYRVQ | 75.26 | YQNKVYKVQ | 20.8 | YQNKVYKVL

FIG. 19-64

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3114 | 1.04 | 11 | 4 | 0 | Y | TNMEAQ

FIG. 19-65

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3185 | 0.52 | 8 | 2 | 0 | Y | NDMGKIRKD | 89.2 | NDMGKIRKD | 10.58 | | | | |
| NS5 | 3186 | 0.59 | 11 | 3 | 0 | Y | DMGKIRKDI | 88.38 | DMGKIRKDI | 10.58 | DMGKVRKDV | 0.74 | | |
| NS5 | 3187 | 1.27 | 12 | 4 | 0 | Y | MGKIRKDIP | 68.25 | MGKIRKDIQ | 20.21 | MGKIRKDIQ | 10.51 | | |
| NS5 | 3188 | 1.26 | 10 | 3 | 0 | Y | GKVRKDIPQ | 68.29 | GKVRKDIQQ | 20.21 | GKIRKDIQQ | 10.55 | | |
| NS5 | 3189 | 1.26 | 11 | 4 | 0 | Y | KVRKDIPQW | 68.29 | KIRKDIQQW | 20.21 | KIRKDIQQW | 10.55 | | |
| NS5 | 3190 | 1.87 | 8 | 3 | 0 | Y | VRKDIPQWE | 47.53 | VRKDIQQWE | 20.76 | | | | |
| NS5 | 3191 | 1.57 | 8 | 3 | 0 | Y | RKDIPQWEP | 47.6 | RKDIQQWQP | 30.75 | | | | |
| NS5 | 3192 | 1.57 | 11 | 4 | 0 | Y | KDIPQWEPS | 47.6 | KDIPQWQPS | 30.75 | | | | |
| NS5 | 3193 | 1.84 | 11 | 4 | 0 | Y | DIPQWEPSR | 47.57 | DIPQWEPSK | 22.31 | DIQQWEPSK | 8.44 | | |
| NS5 | 3194 | 1.84 | 8 | 4 | 0 | Y | IPQWEPSKG | 47.57 | IPQWQPSKG | 22.31 | IQQWEPSKG | 8.44 | | |
| NS5 | 3195 | 1.78 | 12 | 5 | 0 | Y | PQWEPSKGW | 48.3 | PQWQPSKGW | 22.35 | QQWEPSKGW | 8.44 | | |
| NS5 | 3196 | 1.71 | 13 | 5 | 0 | Y | QWEPSKGWN | 52.36 | QWQPSKGWH | 22.31 | QWEPSKGWK | 3.8 | | |
| NS5 | 3197 | 1.72 | 13 | 5 | 0 | Y | WEPSKGWND | 52.29 | WQPSKGWHD | 22.31 | WEPSKGWKN | 3.8 | | |
| NS5 | 3198 | 1.72 | 13 | 5 | 0 | Y | EPSKGWNDW | 52.29 | QPSKGWHDW | 22.31 | EPSKGWKNW | 3.8 | QWEPSKGWS | 0.55 |
| NS5 | 3202 | 1.79 | 13 | 5 | 0 | Y | GWNDWQQVP | 44.36 | GWHDWQQVP | 30.16 | GWKNWQEVP | 3.8 | WEPSKGWSD | 0.55 |
| NS5 | 3203 | 1.79 | 13 | 5 | 0 | Y | WNDWQQVPF | 44.36 | WHDWQQVPF | 30.16 | WKNWQEVPF | 3.8 | EPSKGWSDW | 0.55 |
| NS5 | 3204 | 1.8 | 13 | 5 | 0 | Y | NDWQQVPFC | 44.25 | HDWQQVPFC | 30.16 | KNWQEVPFC | 3.8 | GWSDWTQVP | 0.59 |
| NS5 | 3205 | 1.14 | 8 | 3 | 0 | Y | DWQQVPFCS | 65.08 | DWTQVPFCS | 30.83 | | | WSDWTQVPF | 0.59 |
| NS5 | 3206 | 1.13 | 7 | 3 | 0 | Y | WQQVPFCSH | 65.15 | WQQVPFCSH | 30.83 | | | SDWTQVPFC | 0.59 |
| NS5 | 3207 | 1.13 | 7 | 3 | 0 | Y | QQVPFCSHH | 65.15 | QEVPFCSHH | 30.83 | | | | |
| NS5 | 3208 | 0.26 | 6 | 2 | 0 | Y | QVPFCSHHF | 95.98 | | 3.8 | | | | |
| NS5 | 3209 | 0.03 | 5 | 1 | 0 | Y | VPFCSHHFH | 99.78 | | | | | | |
| NS5 | 3210 | 1.22 | 8 | 3 | 0 | Y | PFCSHHFHE | 51.59 | PFCSHHFHK | 44.36 | PFCSHHFHK | 3.76 | | |
| NS5 | 3211 | 1.23 | 9 | 3 | 0 | Y | FCSHHFHQL | 51.51 | FCSHHFHQL | 44.36 | FCSHHFHKI | 3.76 | | |
| NS5 | 3212 | 1.68 | 11 | 4 | 0 | Y | CSHHFHQLI | 44.36 | CSHHFHELV | 36.62 | CSHHFHKIF | 14.9 | CSHHFHKIF | 3.72 |

FIG. 19-66

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3213 | 1.67 | 10 | 4 | 0 | Y | SHHFHQLIM | 44.51 | SHHFHELIM | 36.62 | SHHFHELVM | 14.9 | SHHFHKIFM | 3

FIG. 19-67

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3247 | 0.87 | 11 | 2 | 0 | Y | AGWSLRETA | 74.56 | AGWSLKETA | 24.93 | | | | |
| NS5 | 3248 | 0.86 | 10 | 2 | 0 | Y | GWSLRETAC | 74.67 | GWSLKETAC | 24.93 | | | | |
| NS5 | 3249 | 0.85 | 9 | 2 | 0 | Y | WSLRETACL | 74.71 | WSLKETACL | 24.93 | | | | |
| NS5 | 3250 | 0.86 | 10 | 2 | 0 | Y | SLRETACLG | 74.63 | SLKETACLG | 24.93 | | | | |
| NS5 | 3251 | 0.84 | 7 | 4 | 0 | Y | LRETACLGK | 74.78 | LKETACLGK | 24.93 | | | | |
| NS5 | 3252 | 1.63 | 8 | 2 | 0 | Y | RETACLGKS | 58.08 | KETACLGKS | 17.18 | RETACLGKA | 16.85 | KETACLGKA | 7.74 |
| NS5 | 3253 | 0.82 | 6 | 2 | 0 | Y | ETACLGKSY | 75.26 | ETACLGKAY | 24.59 | | | | |
| NS5 | 3254 | 0.82 | 6 | 2 | 0 | Y | TACLGKSYA | 75.26 | TACLGKAYA | 24.59 | | | | |
| NS5 | 3255 | 0.82 | 6 | 2 | 0 | Y | ACLGKSYAQ | 75.26 | ACLGKAYAQ | 24.59 | | | | |
| NS5 | 3256 | 0.82 | 6 | 2 | 0 | Y | CLGKSYAQM | 75.26 | CLGKAYAQM | 24.59 | | | | |
| NS5 | 3257 | 0.82 | 6 | 2 | 0 | Y | LGKSYAQMW | 75.26 | LGKAYAQMW | 24.59 | | | | |
| NS5 | 3258 | 1.99 | 12 | 5 | 0 | Y | GKSYAQMWQ | 44.47 | GKAYAQMWS | 22.38 | GKSYAQMWT | 15.93 | GKAYAQMWA | 1.95 |
| NS5 | 3259 | 1.98 | 10 | 5 | 0 | Y | KSYAQMWQL | 44.51 | KAYAQMWSL | 22.42 | KSYAQMWTL | 15.93 | KAYAQMWAL | 1.95 |
| NS5 | 3260 | 1.99 | 11 | 5 | 0 | Y | SYAQMWQLM | 44.51 | AYAQMWSLM | 22.42 | SYAQMWTLM | 15.82 | AYAQMWALM | 1.95 |
| NS5 | 3261 | 1.6 | 8 | 4 | 0 | Y | YAQMWQLMY | 44.51 | YAQMWSLMY | 38.24 | YAQMWTLMY | 15.01 | YAQMWALMY | 1.99 |
| NS5 | 3262 | 1.6 | 8 | 4 | 0 | Y | AQMWQLMYF | 44.51 | AQMWSLMYF | 38.24 | AQMWTLMYF | 15.01 | AQMWALMYF | 1.99 |
| NS5 | 3263 | 1.6 | 8 | 4 | 0 | Y | QMWQLMYFH | 44.47 | QMWSLMYFH | 38.27 | QMWTLMYFH | 15.01 | QMWALMYFH | 1.99 |
| NS5 | 3264 | 1.61 | 10 | 4 | 0 | Y | MWQLMYFHR | 44.43 | MWSLMYFHR | 38.27 | MWTLMYFHR | 14.97 | MWALMYFHR | 1.99 |
| NS5 | 3265 | 1.61 | 10 | 4 | 0 | Y | WQLMYFHRR | 44.43 | WSLMYFHRR | 38.27 | WTLMYFHRR | 14.97 | WALMYFHRR | 1.99 |
| NS5 | 3266 | 1.6 | 9 | 4 | 0 | Y | QLMYFHRRD | 44.47 | SLMYFHRRD | 38.27 | TLMYFHRRD | 14.97 | ALMYFHRRD | 1.99 |
| NS5 | 3267 | 0.03 | 4 | 1 | 0 | Y | LMYFHRRDL | 99.78 | | | | | | |
| NS5 | 3268 | 0.03 | 4 | 1 | 0 | Y | MYFHRRDLR | 99.78 | | | | | | |
| NS5 | 3269 | 0.01 | 3 | 1 | 0 | Y | YFHRRDLRL | 99.89 | | | | | | |
| NS5 | 3270 | 0.02 | 4 | 1 | 0 | Y | FHRRDLRLA | 99.85 | | | | | | |
| NS5 | 3271 | 0.83 | 7 | 2 | 0 | Y | HRRDLRLAA | 75.15 | HRRDLRLAS | 24.63 | | | | |

FIG. 19-68

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3272 | 0.98 | 8 | 3 | 0 | Y | R

FIG. 19-69

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3305 | 0.95 | 5 | 2 | 0 | Y | QWMTTEDML | 68.66 | EWMTTEDML | 30.75 | | | | |
| NS5 | 3306 | 1.71 | 9 | 4 | 0 | Y | WMTTEDMLS | 44.4 | WMTTEDMLT | 35.32 | WMTTEDMLA | 15.82 | WMTTEDMLK | 3.8 | | |
| NS5 | 3307 | 1.7 | 8 | 4 | 0 | Y | MTTEDMLSV | 44.4 | MTTEDMLTV | 35.44 | MTTEDMLAV | 15.82 | MTTEDMLKV | 3.8 | | |
| NS5 | 3308 | 1.69 | 7 | 4 | 0 | Y | TTEDMLSYW | 44.4 | TTEDMLTVW | 35.51 | TTEDMLAVW | 15.82 | TTEDMLKVW | 3.8 | | |
| NS5 | 3309 | 1.69 | 9 | 4 | 0 | Y | TEDMLSVWN | 44.4 | TEDMLTVWN | 35.51 | TEDMLAVWN | 15.82 | TEDMLKVWN | 3.8 | | |
| NS5 | 3310 | 1.73 | 10 | 4 | 0 | Y | EDMLSVWNR | 44.36 | EDMLTVWNR | 35.14 | EDMLAVWNR | 15.82 | EDMLKVWNR | 3.8 | | |
| NS5 | 3311 | 1.73 | 8 | 4 | 0 | Y | DMLSYWNRV | 44.36 | DMLTVWNRV | 35.1 | DMLAVWNRV | 15.82 | DMLKVWNRV | 3.8 | | |
| NS5 | 3312 | 1.7 | 8 | 4 | 0 | Y | MLSYWNRVW | 44.73 | MLTVWNRVW | 35.14 | MLAVWNRVW | 15.82 | MLKVWNRVW | 3.8 | | |
| NS5 | 3313 | 1.7 | 10 | 4 | 0 | Y | LSVWNRVWI | 44.73 | LTVWNRVWI | 35.14 | LAVWNRVWI | 15.82 | LKVWNRVWI | 3.8 | | |
| NS5 | 3323 | 1.06 | 7 | 5 | 0 | Y | ENPWMEDKT | 75.7 | DNPWMEDKT | 19.51 | DNPNMTDKT | 2.25 | DNPNMTDKT | 1.55 | | |
| NS5 | 3338 | 2 | 4 | 2 | 0 | Y | DVPYLGKRE | 43.4 | EVPYLGKRE | 26 | EIPYLGKRE | 13.35 | NVPYLGKRE | 12.76 | DIPYLGKRE | 4.42 |
| NS5 | 3339 | 0.68 | 5 | 2 | 0 | Y | VPYLGKRED | 82.15 | IPYLGKRED | 17.77 | | | | |
| NS5 | 3340 | 0.25 | 5 | 2 | 0 | Y | PYLGKREDQ | 96.09 | PYLGKREDL | 3.8 | | | | |
| NS5 | 3341 | 0.25 | 5 | 2 | 0 | Y | YLGKREDQW | 96.09 | YLGKREDLW | 3.8 | | | | |
| NS5 | 3342 | 0.25 | 4 | 2 | 0 | Y | LGKREDQWC | 96.09 | LGKREDLWC | 3.8 | | | | |
| NS5 | 3343 | 0.24 | 4 | 2 | 0 | Y | GKREDQWCG | 96.13 | GKREDLWCG | 3.8 | | | | |
| NS5 | 3344 | 0.24 | 5 | 2 | 0 | Y | KREDQWCGS | 96.13 | KREDLWCGS | 3.8 | | | | |
| NS5 | 3345 | 0.26 | 5 | 2 | 0 | Y | REDQWCGSL | 95.98 | REDLWCGSL | 3.8 | | | | |
| NS5 | 3346 | 0.26 | 5 | 2 | 0 | Y | EDQWCGSLI | 95.98 | EDLWCGSLI | 3.8 | | | | |
| NS5 | 3347 | 0.26 | 6 | 2 | 0 | Y | DQWCGSLIG | 95.98 | DLWCGSLIG | 3.8 | | | | |
| NS5 | 3348 | 0.26 | 6 | 2 | 0 | Y | QWCGSLIGL | 95.94 | LWCGSLIGL | 3.8 | | | | |
| NS5 | 3349 | 0.26 | 9 | 2 | 0 | Y | WCGSLIGLT | 95.98 | WCGSLIGLS | 3.76 | | | | |
| NS5 | 3350 | 1.23 | 9 | 3 | 0 | Y | CGSLIGLTS | 51.44 | CGSLIGLTA | 44.47 | CGSLIGLSS | 3.76 | | | |
| NS5 | 3351 | 1.23 | 9 | 3 | 0 | Y | GSLIGLTSR | 51.44 | GSLIGLTAR | 44.47 | GSLIGLSSR | 3.76 | | | |
| NS5 | 3352 | 1.23 | 11 | 3 | 0 | Y | SLIGLTSRA | 51.36 | SLIGLTARA | 44.47 | SLIGLSSRA | 3.76 | | | |

FIG. 19-70

Species: DENVall (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3353 | 1.23 | 11 | 3 | 0 | Y | LIGLTSRAT | 51.36 | LIGLTARAT | 44.47 | LIGLSSRAT | 3.76 | | | | |
| NS5 | 3354 | 1.22 | 9 | 3 | 0 | Y | IGLTSRATW | 51.55 | IGLTARATW | 44.47 | IGLSSRATW | 3.76 | | | | |
| NS5 | 3355 | 1.22 | 9 | 3 | 0 | Y | GLTSRATWA | 51.55 | GLTARATWA | 44.47 | GLSSRATWA | 3.76 | | | | |
| NS5 | 3356 | 1.96 | 12 | 5 | 0 | Y | LTARATWAT | 39.45 | LTSRATWAK | 30.64 | LTSRATWAQ | 20.72 | LTARATWAS | 5.01 | LSSRATWAK | 3.76 |
| NS5 | 3357 | 1.96 | 12 | 5 | 0 | Y | TARATWATN | 39.42 | TSRATWAKN | 30.64 | TSRATWAQN | 20.76 | TARATWASN | 5.01 | SSRATWAKN | 3.76 |
| NS5 | 3358 | 1.8 | 11 | 4 | 0 | Y | ARATWATNI | 39.27 | SRATWAKNI | 34.4 | SRATWAQNI | 20.8 | ARATWASNI | 5.01 | | |
| NS5 | 3384 | 1.3 | 13 | 4 | 0 | Y | DYMPSMKRF | 51.62 | DYMTSMKRF | 43.66 | DYMPVMKRY | 3.43 | DYMISMKRF | 0.33 | | |
| NS5 | 3385 | 1.3 | 13 | 4 | 0 | Y | YMPSMKRFR | 51.55 | YMTSMKRFK | 43.69 | YMPVMKRYS | 3.43 | YMISMKRFK | 0.33 | | |

FIG. 20-1

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 11 | 1.74 | 10 | 4 | 0 | Y | PSFNMLKRAR | 44.36 | TPFNMLKRER

FIG. 20-2

Species: DENVall (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 48 | 1.18 | 13 | 3 | 0 | Y | MA

FIG. 20-3

Species: DENVall (10-mers)

| protein | block starting position | block entropy | total peptides in block | # peptides required to cover 99% of block | gap/x fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| pM | 146 | 1.45 | 10 | 4 | 0 | Y | NMCTLIAMDL | 65.15 | NMCTLMAIDL | 16.45 | NMCTLMAMDL | 14.27 | NMCTLIAMDL | 3.69 | | |
| pM | 147 | 1.45 | 10 | 4 | 0 | Y | MCTLIAMDLG | 65.15 | MCTLMAIDLG | 16.45 | MCTLMAMDLG | 14.27 | KCTLIAMDLG | 3.69 | | |
| pM | 148 | 1.24 | 9 | 3 | 0 | Y | CTLIAMDLGE | 68.84 | CTLMAIDLGE | 16.45 | CTLMAMDLGE | 14.27 | | | | |
| pM | 149 | 2.19 | 12 | 5 | 0 | Y | TLIAMDLGEL | 36.73 | TLIAMDLGEM | 24.52 | TLMAIDLGEL | 16.45 | TLIAMDLGEF | 7.63 | | |
| pM | 150 | 2.18 | 11 | 5 | 0 | Y | LIAMDLGELC | 36.73 | LIAMDLGEMC | 24.52 | LMAIDLGELC | 16.45 | LIAMDLGEFC | 7.63 | | |
| pM | 152 | 1.93 | 10 | 5 | 0 | Y | AMDLGELCED | 50.48 | AMDLGEMCDD | 20.83 | AIDLGELCED | 7.74 | AMDLGE

FIG. 20-4

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 208 | 1.73 | 9 | 4 | 0 | Y | ALAPHVGLGL | 44.4 | ALAPHVGMGL

FIG. 20-5

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 288 | 1.59 | 5 | 3 | 0 | Y | NRDFVEGVSG | 34.62 | SRDFVEGLSG | 32.89 | NRDFVEGLSG | 32.41 | | |
| E | 289 | 0.94 | 4 | 2 | 0 | Y | RDFVEGLSGA | 65.3 | RDFVEGVSGG | 34.62 | DFVEGVSGGA | 3.65 | | |
| E | 290 | 1.12 | 7 | 3 | 0 | Y | DFVEGLSGAT | 65.3 | DFVEGVSGGS | 30.9 | FVEGVSGGAW | 3.65 | | |
| E | 291 | 1.11 | 6 | 3 | 0 | Y | FVEGLSGATW | 65.34 | FVEGVSGGSW | 30.9 | VEGVSGGAWV | 3.65 | | |
| E | 292 | 1.13 | 7 | 3 | 0 | Y | VEGLSGATWV | 65.19 | VEGVSGGSWV | 30.9 | EGVSGGAWVD | 3.65 | | |
| E | 293 | 1.13 | 7 | 3 | 0 | Y | EGLSGATWVD | 65.19 | EGVSGGSWVD | 30.9 | GVSGGAWVDL | 3.65 | | |
| E | 294 | 1.13 | 7 | 3 | 0 | Y | GLSGATWVDY | 65.19 | GVSGGWVDI | 30.9 | VSGGAWVDLV | 3.65 | | |
| E | 295 | 1.13 | 7 | 3 | 0 | Y | LSGATWVDVV | 65.23 | VSGGSWVDIV | 30.9 | SGGAWVDLVL | 3.65 | | |
| E | 296 | 1.12 | 6 | 3 | 0 | Y | SGATWVDVVL | 65.23 | SGGSWVDIVL | 30.9 | GGAWVDLVLE | 3.65 | | |
| E | 297 | 1.12 | 6 | 3 | 0 | Y | GATWVDVVLE | 65.23 | GGSWVDIVLE | 30.9 | GAWVDLVLEH | 3.65 | | |
| E | 298 | 1.12 | 6 | 3 | 0 | Y | ATWVDVVLEH | 65.23 | GSWVDIVLEH | 30.9 | AWVDLVLEHG | 3.65 | | |
| E | 299 | 1.12 | 6 | 3 | 0 | Y | TWVDVVLEHG | 65.23 | SWVDIVLEHG | 30.9 | WVDLVLEHGG | 20.76 | WVDLVLEHGG | 3.72 | | |
| E | 300 | 1.71 | 6 | 4 | 0 | Y | WVDVVLEHGS | 44.47 | WVDIVLEHGS | 30.9 | VDLVLEHGGC | 20.76 | VDLVLEHGC | 3.72 | | |
| E | 301 | 1.71 | 6 | 4 | 0 | Y | VDVVLEHGSC | 44.47 | VDIVLEHGSC | 30.9 | DLVLEHGGCV | 20.83 | DIVLEHGGCV | 3.72 | | |
| E | 302 | 1.71 | 5 | 4 | 0 | Y | DVVLEHGSCV | 44.4 | DIVLEHGSCV | 30.9 | LVLEHGGCVT | 20.83 | LVLEHGGCVT | 3.72 | | |
| E | 303 | 1.71 | 5 | 4 | 0 | Y | VVLEHGSCVT | 44.4 | IVLEHGSCVT | 30.9 | VLEHGGCVT | 3.72 | | |
| E | 304 | 0.83 | 5 | 2 | 0 | Y | VLEHGSCVTT | 75.22 | VLEHGGCVTT | 24.56 | | | |
| E | 305 | 0.84 | 5 | 2 | 0 | Y | LEHGSCVTTM | 75.15 | LEHGGCVTTM | 24.52 | | | |
| E | 306 | 0.85 | 7 | 2 | 0 | Y | EHGSCVTTMA | 75.15 | EHGGCVTTMA | 24.48 | | | |
| E | 307 | 1.02 | 8 | 3 | 0 | Y | HGSCVTTMAK | 75.04 | HGGCVTTMAK | 20.65 | HGGCVTTMAQ | 3.72 | | |
| E | 308 | 1.86 | 11 | 5 | 0 | Y | GSCVTTMAKN | 39.38 | GSCVTTMAKN | 35.62 | GGCVTTMAKN | 18.88 | GGCVTTMAQG | 3.72 | | |
| E | 309 | 1.86 | 15 | 5 | 0 | Y | SCVTTMAKNK | 39.38 | SCVTTMAKNK | 35.62 | GCVTTMAKNK | 18.88 | GCVTTMAQGK | 3.72 | GGCVTTMAKS | 1.77 |
| E | 310 | 1.33 | 15 | 4 | 0 | Y | CVTTMAKNKP | 58.26 | CVTTMAKDKP | 35.62 | CVTTMAQGKP | 3.72 | CVTTMAKSKP | 1.77 | GCVTTMAKSK | 1.77 |
| E | 311 | 1.33 | 13 | 4 | 0 | Y | VTTMAKNKPT | 58.26 | VTTMAKDKPT | 35.62 | VTTMAQGKPT | 3.72 | VTTMAKSKPT | 1.77 | |

FIG. 20-6

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 312 | 1.31 | 12 | 4 | 0 | Y | | TTMAKNKPTL | 58.26 | TTMAKDKPTL | 35.77 | TTMAQGKPTL | 3.72 | TTMAKSKPTL | 1.77 |
| E | 313 | 1.31 | 12 | 4 | 0 | Y | | TMAKNKPTLD | 58.26 | TMAKDKPTLD | 35.77 | TMAQGKPTLD | 3.72 | TMAKSKPTLD | 1.77 |
| E | 314 | 1.9 | 13 | 5 | 0 | Y | | MAKDKPTLDI | 35.8 | MAKNKPTLDF | 30.79 | MAKNKPTLDI | 27.43 | MAQGKPTLDI | 3.72 |
| E | 315 | 1.89 | 13 | 5 | 0 | Y | | AKDKPTLDIE | 35.8 | AKNKPTLDFE | 30.79 | AKNKPTLDIE | 27.47 | AKSKPTLDIE | 1.77 |
| E | 316 | 1.89 | 12 | 5 | 0 | Y | | KDKPTLDIEL | 35.8 | KNKPTLDFEL | 30.79 | KNKPTLDIEL | 27.51 | KSKPTLDIEL | 1.77 |
| E | 318 | 1.72 | 10 | 4 | 0 | Y | | KPTLDIELLK | 44.43 | KPTLDFELIK | 30.79 | KPTLDIELQK | 20.83 | | |
| E | 319 | 1.72 | 11 | 4 | 0 | Y | | PTLDIELLKT | 44.4 | PTLDFELIKT | 30.79 | PTLDIELQKT | 20.83 | | |
| E | 320 | 1.76 | 13 | 4 | 0 | Y | | TLDIELLKTE | 44.4 | TLDFELIKTE | 30.46 | TLDIELQKTE | 20.83 | | |
| E | 321 | 1.76 | 13 | 5 | 0 | Y | | LDIELLKTEV | 44.4 | LDFELIKTEA | 30.46 | LDIELQKTEA | 20.83 | | |
| E | 322 | 1.79 | 17 | 4 | 0 | Y | | DIELLKTEVT | 44.21 | DFELIKTEAK | 30.38 | DIELQKTEAT | 20.83 | DFELIKTTAK | 0.33 |
| E | 349 | 1.21 | 8 | 5 | 0 | Y | | TTDSRCPTQG | 66.45 | TTESRCPTQG | 27.8 | TTATRCPTQG | 3.72 | | |
| E | 350 | 1.2 | 7 | 4 | 0 | Y | | TDSRCPTQGE | 66.45 | TESRCPTQGE | 27.84 | TATRCPTQGE | 3.72 | | |
| E | 351 | 1.28 | 7 | 5 | 0 | Y | | DSRCPTQGEA | 65.3 | ESRCPTQGEP | 27.84 | ATRCPTQGEP | 3.72 | DSRCPTQGEP | 1.18 |
| E | 372 | 1.81 | 12 | 5 | 0 | Y | | CRRTFVDRGW | 44.06 | CKHSMVDRGW | 30.13 | CKHTYVDRGW | 20.8 | CRHSMVDRGW | 0.55 |
| E | 373 | 1.81 | 12 | 5 | 0 | Y | | RRTFVDRGWG | 44.06 | KHSMVDRGWG | 30.13 | KHTYVDRGWG | 20.8 | RHSMVDRGWG | 0.55 |
| E | 374 | 1.76 | 10 | 4 | 0 | Y | | RTFVDRGWGN | 44.06 | HSMVDRGWGN | 30.68 | HTYVDRGWGN | 20.83 | | |
| E | 375 | 1.76 | 10 | 4 | 0 | Y | | TFVDRGWGNG | 44.06 | SMVDRGWGNG | 30.68 | TYVDRGWGNG | 20.83 | | |
| E | 376 | 1.74 | 6 | 4 | 0 | Y | | FVDRGWGNGC | 44.06 | MVDRGWGNGC | 30.75 | YVDRGWGNGC | 20.83 | | |
| E | 377 | 0 | 1 | 1 | 0 | Y | | VDRGWGNGCG | 100 | | | | | | |
| E | 378 | 0 | 1 | 1 | 0 | Y | | DRGWGNGCGL | 100 | | | | | | |
| E | 379 | 0 | 1 | 1 | 0 | Y | | RGWGNGCGLF | 100 | | | | | | |
| E | 380 | 0 | 1 | 1 | 0 | Y | | GWGNGCGLFG | 100 | | | | | | |
| E | 381 | 0 | 1 | 1 | 0 | Y | | WGNGCGLFGK | 100 | | | | | | |
| E | 382 | 0 | 1 | 1 | 0 | Y | | GNGCGLFGKG | 100 | | | | | | |

FIG. 20-7

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 383 | 0.94 | 3 | 2 | 0 | Y | Y | NCGLFGKGS | 65.38 | NCGLFGKGG | 34.55 | | | | |
| E | 384 | 1.11 | 4 | 3 | 0 | Y | Y | GCGLFGKGSL | 65.38 | GCGLFGKGGI | 30.75 | | | | |
| E | 385 | 2.08 | 7 | 5 | 0 | Y | Y | CGLFGKGSLI | 33.92 | CGLFGKGGIV | 30.75 | CGLFGKGSLL | 20.83 | CGLFGKGGV | 3.8 |
| E | 386 | 2.08 | 7 | 5 | 0 | Y | Y | GLFGKGSLIT | 33.92 | GLFGKGGIVT | 30.75 | GLFGKGSLLT | 20.83 | GLFGKGGWT | 3.8 |
| E | 387 | 2.08 | 7 | 5 | 0 | Y | Y | LFGKGSLITC | 33.92 | LFGKGGIVTC | 30.72 | LFGKGSLLTC | 20.83 | LFGKGGWTC | 3.8 |
| E | 388 | 2.09 | 8 | 5 | 0 | Y | Y | FGKGSLITCA | 33.85 | FGKGGIVTCA | 30.72 | FGKGSLLTCA | 20.83 | FGKGGWTCA | 3.8 |
| E | 389 | 2.11 | 11 | 5 | 0 | Y | Y | GKGSLITCAK | 33.85 | GKGGIVTCAM | 30.53 | GKGSLLTCAK | 20.83 | GKGGWTCAK | 3.72 |
| E | 390 | 2.11 | 14 | 5 | 0 | Y | Y | KGSLITCAKF | 33.85 | KGGIVTCAMF | 30.53 | KGSLLTCAKF | 20.83 | KGGWTCAKF | 3.72 |
| E | 422 | 1.27 | 14 | 4 | 0 | Y | Y | TVHTGDQHQV | 65.08 | TVHNGDTHAV | 28.83 | TPHSGEENAV | 3.69 | | |
| E | 423 | 1.27 | 17 | 4 | 0 | Y | Y | VHTGDQHQVG | 65.08 | VHNGDTHAVG | 28.83 | PHSGEENAVG | 3.69 | | |
| E | 424 | 1.28 | 17 | 4 | 0 | Y | Y | HTGDQHQVGN | 65.08 | HNGDTHAVGN | 28.65 | HSGEENAVGN | 3.69 | | |
| E | 425 | 1.55 | 20 | 5 | 0.04 | Y | Y | TGDQHQVGNE | 59.81 | TGDTHAVGND | 28.61 | NGDTHAVGND | 3.69 | | |
| E | 461 | 1.81 | 21 | 5 | 0 | Y | Y | LTLDCSPRTG | 44.43 | VTMECSPRTG | 29.76 | LGLECSPRTG | 5.27 | SGEENAVGND | 1.81 |
| E | 462 | 1.77 | 16 | 5 | 0 | Y | Y | TLDCSPRTGL | 44.43 | TMECSPRTGL | 30.31 | GLECSPRTGL | 20.72 | TLDCEPRSG | 3.65 | ITMECSPRTG | 0.63 |
| E | 463 | 1.77 | 16 | 4 | 0 | Y | Y | LDCSPRTGLD | 44.47 | MECSPRTGLD | 30.24 | LECSPRTGLD | 20.72 | TLDCEPRSGI | 3.72 | | |
| E | 464 | 1.27 | 15 | 4 | 0 | Y | Y | ECSPRTGLDF | 50.96 | DCSPRTGLDF | 44.47 | DCEPRSGIDF | 20.76 | LDCEPRSGID | 3.72 | | |
| E | 465 | 0.33 | 14 | 3 | 0 | Y | Y | CSPRTGLDFN | 95.39 | CEPRSGIDFN | 3.72 | | | | |
| E | 466 | 0.33 | 15 | 2 | 0 | Y | Y | SPRTGLDFNE | 95.35 | EPRSGIDFNE | 3.72 | | | | |
| E | 467 | 0.35 | 16 | 3 | 0 | Y | Y | PRTGLDFNEM | 95.24 | PRSGIDFNEM | 3.72 | PRTSLDFNEM | 0.41 | RTSLDFNEMY | 0.41 | | |
| E | 468 | 1.07 | 18 | 4 | 0 | Y | Y | RTGLDFNEMY | 74.52 | RTGLDFNEMI | 20.72 | RSGIDFNEMI | 3.72 | TSLDFNEMYL | 0.41 | | |
| E | 469 | 1.06 | 19 | 4 | 0.15 | Y | Y | TGLDFNEMYL | 74.52 | TGLDFNEMIL | 20.58 | SGIDFNEMIL | 3.72 | | | | |
| E | 470 | 1.06 | 17 | 3 | 0.15 | Y | Y | GLDFNEMYLL | 74.56 | GLDFNEMILM | 20.61 | GIDFNEMILM | 3.72 | | | | |
| E | 471 | 1.77 | 22 | 4 | 0.15 | Y | Y | LDFNEMYLLT | 44.28 | LDFNEMYLLQ | 30.57 | LDFNEMILLT | 20.61 | IDFNEMILMK | 3.58 | | |
| E | 472 | 1.77 | 21 | 4 | 0.15 | Y | Y | DFNEMYLLTM | 44.28 | DFNEMYLLQM | 30.64 | DFNEMILLTM | 20.61 | DFNEMILMKM | 3.58 | | |

FIG. 20-8

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 484 | 1.75 | 10 | 4 | 0 | Y | KSWLVHK

FIG. 20-9

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 528 | 1.14 | 10 | 3 | 0 | Y | QEVVVLGSQE | 65.15 | QDVVVLGSQE | 30.75 | | | | |
| E | 529 | 1.14 | 10 | 3 | 0 | Y | EVVVLGSQEG | 65.15 | DVVVLGSQEG | 30.75 | | | | |
| E | 530 | 0.28 | 8 | 2 | 0 | Y | VVVLGSQEGA | 95.91 | VTVLGSQEGA | 3.69 | | | | |
| E | 531 | 0.26 | 7 | 2 | 0 | Y | VVLGSQEGAM | 96.02 | TVLGSQEGAM | 3.69 | | | | |
| E | 532 | 0.02 | 5 | 1 | 0 | Y | VLGSQEGAMH | 99.82 | | | | | | |
| E | 533 | 0.26 | 7 | 2 | 0 | Y | LGSQEGAMHT | 96.05 | LGSQEGAMHS | 3.72 | | | | |
| E | 534 | 0.26 | 8 | 2 | 0 | Y | GSQEGAMHTA | 96.02 | GSQEGAMHSA | 3.72 | | | | |
| E | 535 | 0.27 | 9 | 2 | 0 | Y | SQEGAMHTAL | 95.98 | SQEGAMHSAL | 3.72 | | | | |
| E | 536 | 0.28 | 10 | 2 | 0 | Y | QEGAMHTALT | 95.98 | QEGAMHSALA | 3.47 | | | | |
| E | 537 | 0.28 | 12 | 2 | 0 | Y | EGAMHTALTG | 95.98 | EGAMHSALAG | 3.47 | | | | |
| E | 538 | 0.29 | 14 | 2 | 0 | Y | GAMHTALTGA | 95.91 | GAMHSALAGA | 3.47 | | | | |
| E | 539 | 0.3 | 14 | 2 | 0 | Y | AMHTALTGAT | 95.83 | AMHSALAGAT | 3.47 | | | | |
| E | 540 | 0.3 | 15 | 2 | 0 | Y | MHTALTGATE | 95.83 | MHSALAGATE | 3.47 | | | | |
| E | 541 | 0.3 | 15 | 2 | 0 | Y | HTALTGATEI | 95.8 | HSALAGATEV | 3.47 | | | | |
| E | 542 | 0.3 | 15 | 2 | 0 | Y | TALTGATEIQ | 95.8 | SALAGATEVD | 3.47 | | | | |
| E | 543 | 1.72 | 16 | 4 | 0 | Y | ALTGATEIQM | 46.64 | ALTGATEIQN | 30.83 | ALAGATEVDS | 18.4 | | |
| E | 544 | 1.74 | 17 | 4 | 0 | Y | LTGATEIQTS | 46.46 | LTGATEIQMS | 30.83 | LAGATEVDSG | 18.4 | | |
| E | 554 | 1.81 | 18 | 5 | 0 | Y | GTTIFAGHLK | 44.21 | GGTSIFAGHL | 30.35 | DGNHMFAGHL | 20.54 | LGNILFMGHL | 0.29 |
| E | 555 | 1.81 | 18 | 5 | 0 | Y | TTTIFAGHLK | 44.17 | GTSIFAGHLK | 30.35 | GNHMFAGHLK | 20.54 | GNILFMGHLK | 0.44 |
| E | 556 | 1.79 | 15 | 5 | 0 | Y | TTIFAGHLKC | 44.32 | TSIFAGHLKC | 30.35 | NHMFAGHLKC | 20.54 | NILFMGHLKC | 0.44 |
| E | 557 | 1.78 | 14 | 5 | 0 | Y | TIFAGHLKCR | 44.36 | SIFAGHLKCR | 30.35 | HMFAGHLKCK | 20.54 | ILFMGHL

FIG. 20-10

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 561 | 1.13 | 9 | 3 | 0 | Y | GHLKCRLRMD | 65.27 | GHLKCRLRMD | 30.75 | | | | |
| E | 562 | 1.14 | 11 | 3 | 0 | Y | HLKCRLRMDK | 65.23 | HLKCRLRMDK | 30.75 | | | | |
| E | 563 | 1.14 | 11 | 3 | 0 | Y | LKCRLRMDKL | 65.23 | LKCRLRMDKL | 30.75 | | | | |
| E | 564 | 1.77 | 17 | 4 | 0 | Y | KCRLRMDKLT | 44.17 | KCRLRMDKLQ | 30.75 | KCKVRMEKLR

FIG. 20-11

Species: DENVall (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 679 | 1.23 | 21 | 4 | 0 | Y | GKMFEATARG | 64.79 | GQMFETTMRG | 30.24 | GKMFESTYRG | 3.65 | GQMIETTMRG | 0.33 | | |
| E | 680 | 1.24 | 22 | 5 | 0 | Y | KMFEATARGA | 64.75 | QMFETTMRGA | 30.24 | KMFESTYRGA | 3.65 | QMIETTMRGA | 0.33 | QMFATTMRGA | 0.11 |
| E | 681 | 1.22 | 20 | 4 | 0 | Y | MFEATARGAR | 64.82 | MFETTMRGAK | 30.31 | MFESTYRGAK | 3.65 | MIETTMRGAK | 0.33 | | |
| E | 682 | 1.22 | 20 | 4 | 0 | Y | FEATARGARR | 64.82 | FETTMRGAKR | 30.31 | FESTYRGAKR | 3.65 | IETTMRGAKR | 0.33 | | |
| E | 683 | 1.18 | 17 | 3 | 0 | Y | EATARGARRM | 64.9 | ETTMRGAKRM | 30.64 | ESTYRGAKRM | 3.72 | | | | |
| E | 684 | 1.15 | 13 | 3 | 0 | Y | ATARGARRMA | 65.04 | TTMRGAKRMA | 30.79 | STYRGAKRMA | 3.72 | | | | |
| E | 685 | 1.15 | 12 | 3 | 0 | Y | TARGARRMAI | 65.12 | TMRGAKRMAI | 30.75 | TYRGAKRMAI | 3.72 | | | | |
| E | 686 | 1.14 | 10 | 3 | 0 | Y | ARGARRMAIL | 65.19 | MRGAKRMAIL | 30.75 | YRGAKRMAIL | 3.72 | | | | |
| E | 687 | 0.95 | 6 | 2 | 0 | Y | RGARRMAILG | 65.27 | RGAKRMAILG | 34.55 | | | | | | |
| E | 688 | 1.13 | 8 | 3 | 0 | Y | GARRMAILGD | 65.27 | GAKRMAILGD | 30.79 | GAKRMAILGE | 3.72 | | | | |
| E | 689 | 1.13 | 9 | 3 | 0 | Y | ARRMAILGDT | 65.19 | AKRMAILGDT | 30.79 | AKRMAILGET | 3.72 | | | | |
| E | 690 | 1.14 | 10 | 3 | 0 | Y | RRMAILGDTA | 65.19 | KRMAILGDTA | 30.75 | KRMAILGETA | 3.72 | | | | |
| E | 691 | 0.27 | 9 | 2 | 0 | Y | RMAILGDTAW | 95.94 | RMAILGETAW | 3.72 | | | | | | |
| E | 692 | 0.27 | 9 | 2 | 0 | Y | MAILGDTAWD | 95.94 | MAILGETAWD | 3.72 | | | | | | |
| E | 693 | 0.27 | 8 | 2 | 0 | Y | AILGDTAWDF | 95.98 | AILGETAWDF | 3.72 | | | | | | |
| E | 694 | 0.27 | 8 | 2 | 0 | Y | ILGDTAWDFG | 95.98 | ILGETAWDFG | 3.72 | | | | | | |
| E | 695 | 0.26 | 7 | 2 | 0 | Y | LGDTAWDFGS | 96.05 | LGETAWDFGS | 3.72 | | | | | | |
| E | 696 | 1.74 | 12 | 4 | 0 | Y | GDTAWDFGSI | 43.18 | GDTAWDFGSL | 30.27 | GDTAWDFGSV | 22.49 | GETAWDFGSV | 3.72 | | |
| E | 697 | 1.74 | 12 | 4 | 0 | Y | DTAWDFGSIG | 43.18 | DTAWDFGSLG | 30.27 | DTAWDFGSVG | 22.49 | ETAWDFGSVG | 3.72 | | |
| E | 698 | 1.58 | 9 | 3 | 0 | Y | TAWDFGSIGG | 43.22 | TAWDFGSLGG | 30.31 | TAWDFGSVGG | 26.22 | | | | |
| E | 699 | 1.81 | 13 | 5 | 0 | Y | AWDFGSIGGV | 42.66 | AWDFGSLGGV | 30.01 | AWDFGSVGGV | 22.46 | AWDFGSVGGL | 3.72 | AWDFGSIGGL | 0.44 |
| E | 723 | 1.78 | 13 | 5 | 0 | Y | AYGVLFSGVS | 44.47 | IYGAAFSGVS | 30.49 | AYTALFSGVS | 20.28 | VYTTMFGGVS | 3.72 | AYTALFGGVS | 0.48 |
| E | 724 | 1.78 | 13 | 5 | 0 | Y | YGVLFSGVSW | 44.47 | YGAAFSGVSW | 30.49 | YTALFSGVSW | 20.28 | YTTMFGGVSW | 3.72 | YTALFGGVSW | 0.48 |
| E | 728 | 1.27 | 16 | 5 | 0 | Y | FSGVSWTMKI | 74.67 | FSGVSWMKI | 13.02 | FSGVSWIMKI | 7.67 | FGGVSWMIRI | 3.21 | FGGVSWMVRI | 0.48 |

FIG. 20-12

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 742 | 1.9 | 14 | 5 | 0 | Y | LLTWLGLNSR | 44.28 | IITWIGMNSR | 27.4 | LLTWIGLNSK | 20.76 | LVLWIGTNSR | 3.72 | VITWIGMNSR |

FIG. 20-13

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS1 | 805 | 1.01 | 9 | 2 | 0.04 | | Y | EQYKFQADSP | 65.19 | E

FIG. 20-14

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS1 | 926 | 1.67 | 9 | 4 | 0 | Y | Y | NIWEVEDYGF | 44.47 | NSLEVEDYGF | 32.71 | NWWEVEDYGF | 20.83 | NSFEVEDYGF | 1.03 |

FIG. 20-15

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1000 | 0.34 | 8 | 3 | 0 | Y | WPKSHTLWSN | 95.06 | WPKTHTLWSN | 3.8 | WPRSHTLWSN | 0.92 | | |
| NS1 | 1001 | 0.36 | 10 | 3 | 0 | Y | PKSHTLWSNG | 94.87 | PKTHTLWSNG | 3.8 | PRSHTLWSNG | 0.92 | | |
| NS1 | 1002 | 0.35 | 9 | 3 | 0 | Y | KSHTLWSNGV | 94.91 | KTHTLWSNGV | 3.8 | RSHTLWSNGV | 0.92 | | |
| NS1 | 1003 | 0.29 | 10 | 2 | 0 | Y | SHTLWSNGVL | 95.76 | THTLWSNGVL | 3.8 | | | | |
| NS1 | 1004 | 0.05 | 9 | 1 | 0 | Y | HTLWSNGVLE | 99.56 | | | | | | |
| NS1 | 1005 | 0.05 | 8 | 1 | 0 | Y | TLWSNGVLES | 99.59 | | | | | | |
| NS1 | 1006 | 1 | 10 | 3 | 0 | Y | LWSNGVLESE | 75.11 | LWSNGVLESD | 20.69 | LWSNGVLESQ | 3.8 | | |
| NS1 | 1007 | 1 | 10 | 3 | 0 | Y | WSNGVLESEM | 75.11 | WSNGVLESDM | 20.69 | WSNGVLESQM | 3.8 | | |
| NS1 | 1008 | 1.12 | 12 | 4 | 0 | Y | SNGVLESEMI | 73.45 | SNGVLESDMI | 20.65 | SNGVLESQML | 3.8 | SNGVLESEMV | 1.66 |
| NS1 | 1009 | 1.13 | 13 | 4 | 0 | Y | NGVLESEMII | 73.34 | NGVLESDMII | 20.69 | NGVLESQMLI | 3.8 | NGVLESEMVI | 1.66 |
| NS1 | 1010 | 1.13 | 12 | 4 | 0 | Y | GVLESEMIIP | 73.38 | GVLESDMIIP | 20.69 | GVLESQMLIP | 3.8 | GVLESEMVIP | 1.66 |
| NS1 | 1011 | 1.13 | 12 | 4 | 0 | Y | VLESEMIIPK | 73.53 | VLESDMIIPK | 20.69 | VLESQMLIPK | 3.43 | VLESEMVIPK | 1.66 |
| NS1 | 1037 | 0.9 | 10 | 4 | 0 | Y | TQTAGPWHLG | 84.03 | TQIAGPWHLG | 9.4 | TQTVGPWHLG | 3.36 | TQAAGPWHLG | 2.21 |
| NS1 | 1038 | 0.97 | 11 | 5 | 0 | Y | QTAGPWHLGK | 83.22 | QIAGPWHLGK | 9.4 | QTVGPWHLGK | 3.36 | QAAGPWHLGK | 2.21 |
| NS1 | 1039 | 0.97 | 11 | 5 | 0 | Y | TAGPWHLGKL | 83.22 | IAGPWHLGKL | 9.4 | TVGPWHLGKL | 3.36 | AAGPWHLGKL | 2.21 |
| NS1 | 1040 | 0.38 | 8 | 4 | 0 | Y | AGPWHLGKLE | 94.73 | VGPWHLGKLE | 3.36 | AGPWHLGRLE | 0.81 | TGPWHLGKLE | 0.66 |
| NS1 | 1041 | 1.19 | 9 | 4 | 0 | Y | GPWHLGKLEL | 65.15 | GPWHLGKLEM | 29.98 | GPWHLGKLEI | 3.76 | GPWHLGRLEM | 0.74 |
| NS1 | 1042 | 1.19 | 10 | 4 | 0 | Y | PWHLGKLELD | 65.15 | PWHLGKLEMD | 29.98 | PWHLGKLEID | 3.72 | PWHLGRLEMD | 0.74 |
| NS1 | 1043 | 1.19 | 9 | 4 | 0 | Y | WHLGKLELDF | 65.19 | WHLGKLEMDF | 29.98 | WHLGKLEIDF | 3.72 | WHLGRLEMDF | 0.74 |
| NS1 | 1066 | 1.09 | 19 | 4 | 0 | Y | CGNRGPSLRT | 74.41 | CGTRGPSLRT | 20.5 | CDHRGPSLRT | 3.69 | CGSRGPSLRT | 0.44 |
| NS1 | 1067 | 1.09 | 19 | 4 | 0 | Y | GNRGPSLRTT | 74.41 | GTRGPSLRTT | 20.5 | DHRGPSLRTT | 3.69 | GSRGPSLRTT | 0.44 |
| NS1 | 1068 | 1.09 | 18 | 4 | 0 | Y | NRGPSLRTTT | 74.41 | TRGPSLRTTT | 20.5 | HRGPSLRTTT | 3.72 | SRGPSLRTTT | 0.44 |
| NS1 | 1069 | 0.99 | 14 | 2 | 0 | Y | RGPSLRTTTV | 64.93 | RGPSLRTTTA | 34.55 | | | | |
| NS1 | 1070 | 1.58 | 15 | 3 | 0 | Y | GPSLRTTTVT | 44.32 | GPSLRTTTAS | 34.51 | GPSLRTTTVS | 20.65 | | |

FIG. 20-16

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1071 | 1.57 | 14 | 3 | 0 | Y | PSLRTTVTG | 44.32 | PSLRTTTASG | 34.51 | PSLRTTTVSG | 20.69 | | |
| NS1 | 1072 | 1.55 | 11 | 3 | 0 | Y | SLRTTVTGK | 44.4 | SLRTTTASGK | 34.59 | SLRTTVSGK | 20.72 | | |
| NS1 | 1073 | 1.59 | 12 | 3 | 0 | Y | LRTTVTGKI | 43.88 | LRTTTASGKL | 34.59 | LRTTVSGKL | 20.76 | | |
| NS1 | 1074 | 1.77 | 14 | 4 | 0 | Y | RTTVTGKII | 43.84 | RTTTASGKLI | 30.75 | RTTVSGKLI | 20.76 | RTTASGKLV | 3.83 | |
| NS1 | 1075 | 1.77 | 14 | 4 | 0 | Y | TTVTGKIIH | 43.84 | TTTASGKLIT | 30.72 | TTVSGKLIH | 20.8 | TTASGKLVT | 3.83 | |
| NS1 | 1076 | 1.77 | 14 | 4 | 0 | Y | TVTGKIIHE | 43.84 | TTASGKLITE | 30.72 | TVSGKLIHE | 20.83 | TASGKLVTQ | 3.8 | |
| NS1 | 1077 | 1.77 | 14 | 4 | 0 | Y | VTGKIIHEW | 43.88 | TASGKLITEW | 30.68 | VSGKLIHEW | 20.83 | ASGKLVTQW | 3.8 | |
| NS1 | 1078 | 1.77 | 14 | 4 | 0 | Y | TGKIIHEWC | 43.88 | ASGKLITEWC | 30.68 | SGKLIHEWC | 20.83 | SGKLVTQWC | 3.8 | |
| NS1 | 1079 | 1.76 | 12 | 4 | 0 | Y | GKIIHEWCCR | 43.95 | SGKLITEWCCR | 30.72 | GKLIHEWCCR | 20.83 | GKLVTQWCCR | 3.8 | |
| NS1 | 1080 | 1.76 | 11 | 4 | 0 | Y | KIIHEWCCRS | 43.88 | GKLITEWCCRS | 30.72 | KLIHEWCCRS | 20.83 | KLVTQWCCRS | 3.8 | |
| NS1 | 1081 | 1.77 | 12 | 4 | 0 | Y | IIHEWCCRSC | 43.88 | KLITEWCCRS | 30.72 | LIHEWCCRS | 20.83 | LVTQWCCRSC | 3.8 | |
| NS1 | 1082 | 1.77 | 12 | 4 | 0 | Y | IHEWCCRSCT | 43.88 | LITEWCCRSCT | 30.72 | VTQWCCRSCT | 3.8 | | |
| NS1 | 1083 | 1.13 | 9 | 3 | 0 | Y | HEWCCRSCTL | 65.23 | ITEWCCRSCT | 30.75 | TQWCCRSCTM | 3.8 | | |
| NS1 | 1084 | 1.12 | 7 | 3 | 0 | Y | HEWCCRSCTL | 65.27 | TEWCCRSCTL | 30.75 | | | | |
| NS1 | 1085 | 0.25 | 4 | 2 | 0 | Y | EWCCRSCTLP | 96.09 | QWCCRSCTMP | 3.8 | | | | |
| NS1 | 1086 | 0.25 | 4 | 2 | 0 | Y | WCCRSCTLPP | 96.09 | WCCRSCTMPP | 3.8 | | | | |
| NS1 | 1087 | 0.24 | 3 | 2 | 0 | Y | CCRSCTLPPL | 96.13 | CCRSCTMPPL | 3.8 | | | | |
| NS1 | 1088 | 0.24 | 3 | 2 | 0 | Y | CRSCTLPPLR | 96.13 | CRSCTMPPLR | 3.8 | | | | |
| NS1 | 1089 | 1.2 | 4 | 3 | 0 | Y | RSCTLPPLRY | 51.66 | RSCTLPPLRF | 44.47 | RSCTMPPLRF | 3.8 | | |
| NS1 | 1090 | 2.14 | 7 | 5 | 0 | Y | SCTLPPLRYR | 30.83 | SCTLPPLRYM | 27.03 | SCTLPPLRFK | 17.44 | SCTMPPLRFL | |
| NS1 | 1091 | 2.14 | 7 | 5 | 0 | Y | CTLPPLRYRG | 30.83 | CTLPPLRYMG | 27.06 | CTLPPLRFKG | 17.44 | CTMPPLRFLG | |
| NS1 | 1092 | 2.15 | 9 | 5 | 0 | Y | TLPPLRYRGE | 30.72 | TLPPLRYMGE | 27.06 | TLPPLRFKGE | 17.44 | TMPPLRFLGE | |
| NS1 | 1093 | 2.16 | 11 | 5 | 0 | Y | LPPLRYRGED | 30.68 | LPPLRYMGED | 27.03 | LPPLRFKGED | 17.44 | MPPLRFLGED | |
| NS1 | 1094 | 2.16 | 11 | 5 | 0 | Y | PPLRYRGEDG | 30.68 | PPLRYMGEDG | 27.03 | PPLRFKGEDG | 17.44 | PPLRFLGEDG | |

FIG. 20-17

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1095 | 2.16 | 11 | 5 | 0 | Y | PLRYRGEDGC | 30.68 | PLRFRGEDGC | 30.68 | PLRYMGEDGC | 27.03 | PLRFKGEDGC | 20.72 | PLRF

FIG. 20-18

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---

FIG. 20-19

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1389 | 1.76 | 14 | 4 | 0 | Y | VISGXSADLS | 44.25 | VLTGRSADLE | 30.79 | VITGTSADLT | 20.58 | VMSGSSADLS | 3.76 | | |
| NS

FIG. 20-20

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1493 | 1.79 | 13 | 5 | 0 | Y | | AVLDDGIYRI | 44.21 | AELEDGAYRI | 30.64 | AELEEGVYRI | 20.76 | AALSEGVYRI | 3.1 | ATLSEGVYRI | 0.37 |
| NS3 | 1495 | 2.12 | 12 | 5 | 0 | Y | | LDDGIYRIMQ | 33.7 | LED

FIG. 20-21

Species: DENVall (10-mers)

| protein | block starting position | block entropy | total peptides in block | # peptides required to cover 99% of block | gap/x fraction | % of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 1549 | 0.33 | 7 | 2 | 0 | Y | VKKDLISYGG | 95.21 | VRNDMISYGG | 3.8 | | | | | |
| NS3 | 1550 | 0.32 | 6 | 2 | 0 | Y | KKDLISYGGG | 95.28 | RNDMISYGGG | 3.8 | | | | | |
| NS3 | 1551 | 0.28 | 5 | 2 | 0 | Y | KDLISYGGGW | 95.69 | NDMISYGGGW | 3.8 | | | | | |
| NS3 | 1552 | 1.15 | 6 | 3 | 0 | Y | DLISYGGGWR | 64.9 | DLISYGGGWK | 30.86 | DMISYGGGWR | 3.8 | | | |
| NS3 | 1553 | 1.59 | 7 | 4 | 0 | Y | LISYGGGWRL | 53.17 | LISYGGGWKL | 30.86 | LISYGGGWRF | 11.73 | MISYGGGWRL | 3.8 | |
| NS3 | 1566 | 1.81 | 16 | 5 | 0 | Y | WNTGEEVQVI | 43.81 | WKEGEEVQVL | 30.79 | WQKGEEVQVI | 20.43 | WDKEEDVQVL | 3.65 | WNAGEEVQVI 0.37 |
| NS3 | 1567 | 1.81 | 15 | 5 | 0 | Y | NTGEEVQVIA | 43.81 | KEGEEVQVLA | 30.79 | QKGEEVQVIA | 20.46 | DKEEDVQVLA | 3.65 | NAGEEVQVIA 0.37 |
| NS3 | 1568 | 1.79 | 13 | 5 | 0 | Y | TGEEVQVIAV | 43.84 | EGEEVQVLAL | 30.79 | KGEEVQVIAV | 20.72 | KEEDVQVLAI | 3.54 | AGEEVQVIAV 0.37 |
| NS3 | 1569 | 1.13 | 8 | 3 | 0 | Y | GEEVQVIAVE | 65.3 | GEEVQVLALE | 30.75 | EEDVQVLAIE | 3.69 | | | |
| NS3 | 1570 | 1.13 | 8 | 3 | 0 | Y | EEVQVIAVEP | 65.3 | EEVQVLALEP | 30.75 | EDVQVLAIEP | 3.69 | | | |
| NS3 | 1571 | 1.14 | 9 | 3 | 0 | Y | EVQVIAVEPG | 65.19 | EVQVLALEPG | 30.75 | DVQVLAIEPG | 3.69 | | | |
| NS3 | 1572 | 1.14 | 8 | 3 | 0 | Y | VQVIAVEPGK | 65.19 | VQVLALEPGK | 30.79 | VQVLAIEPGK | 3.69 | | | |
| NS3 | 1573 | 1.14 | 8 | 3 | 0 | Y | QVIAVEPGKN | 65.19 | QVLALEPGKN | 30.79 | QVLAIEPGKN | 3.69 | | | |
| NS3 | 1574 | 1.14 | 8 | 3 | 0 | Y | VIAVEPGKNP | 65.19 | VLALEPGKNP | 30.79 | VLAIEPGKNP | 3.69 | | | |
| NS3 | 1575 | 1.14 | 8 | 3 | 0 | Y | IAVEPGKNPK | 65.19 | LALEPGKNPK | 30.79 | LAIEPGKNPK | 3.69 | | | |
| NS3 | 1576 | 1.14 | 8 | 3 | 0 | Y | AVEPGKNPKN | 65.19 | ALEPGKNPRA | 30.75 | AIEPGKNPKH | 3.69 | | | |
| NS3 | 1577 | 1.73 | 10 | 4 | 0 | Y | VEPGKNPKNV | 44.4 | LEPGKNPRAV | 30.75 | VEPGKNPKNF | 20.8 | IEPGKNPKHV | 3.69 | |
| NS3 | 1578 | 1.72 | 9 | 4 | 0 | Y | EPGKNPKNVQ | 44.4 | EPGKNPRAVQ | 30.75 | EPGKNPKNFQ | 20.8 | EPGKNPKHVQ | 3.8 | |
| NS3 | 1579 | 1.72 | 8 | 4 | 0 | Y | PGKNPKNVQT | 44.4 | PGKNPRAVQT | 30.79 | PGKNPK

FIG. 20-22

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 1602 | 1.13 | 7 | 3 | 0 | Y | Y | AIALDFKPGT | 65.19 | AVSLDFSPGT | 30.79 | AVTLDFKPGT | 3.76 | | |
| NS3 | 1603 | 1.13 | 7 | 3 | 0 | Y | Y | IALDFKPGTS | 65.19 | VSLDFSPGTS | 30.79 | VTLDFKPGTS | 3.76 | | |
| NS3 | 1604 | 1.11 | 4 | 3 | 0 | Y | Y | ALDFKPGTSG | 65.38 | SLDFSPGTSG | 30.83 | TLDFKPGTSG | 3.76 | | |
| NS3 | 1605 | 0.9 | 3 | 2 | 0 | Y | Y | LDFKPGTSGS | 69.14 | LDFSPGTSGS | 30.83 | | | | |
| NS3 | 1606 | 0.9 | 4 | 2 | 0 | Y | Y | DFKPGTSGSP | 69.14 | DFSPGTSGSP | 30.79 | | | | |
| NS3 | 1607 | 0.9 | 4 | 2 | 0 | Y | Y | FKPGTSGSPI | 69.14 | FSPGTSGSPI | 30.79 | | | | |
| NS3 | 1608 | 1.84 | 7 | 4 | 0 | Y | Y | KPGTSGSPII | 44.58 | KPGTSGSPII | 24.56 | SPGTSGSPIV | 19.54 | SPGTSGSPII | 11.21 |
| NS3 | 1609 | 1.85 | 8 | 4 | 0 | Y | Y | PGTSGSPIIN | 44.54 | PGTSGSPIIN | 24.56 | PGTSGSPIVD | 19.54 | PGTSGSPIID | 11.21 |
| NS3 | 1610 | 2.01 | 11 | 5 | 0 | Y | Y | GTSGSPIVNR | 44.54 | GTSGSPIVNR | 23.93 | GTSGSPIVDR | 16.89 | GTSGSPIIDK | 11.17 |
| NS3 | 1620 | 1.73 | 10 | 4 | 0 | Y | Y | EGKWGLYGN | 44.69 | EGKWGLYGN | 30.79 | EGKWGLYGN | 20.32 | KGKVIGLYGN | 3.8 |
| NS3 | 1621 | 1.23 | 8 | 3 | 0 | Y | Y | GKIWGLYGNG | 51.14 | GKIWGLYGNG | 44.69 | GKVIGLYGN | 3.8 | | |
| NS3 | 1622 | 1.21 | 6 | 3 | 0 | Y | Y | KIWGLYGNGV | 51.14 | KIWGLYGNGV | 44.87 | KVIGLYGNGV | 3.8 | | |
| NS3 | 1623 | 1.22 | 6 | 3 | 0 | Y | Y | IWGLYGNGVV | 51.03 | IVGLYGNGV | 44.91 | VIGLYGNGV | 3.8 | | |
| NS3 | 1624 | 0.26 | 4 | 2 | 0 | Y | Y | VGLYGNGVT | 95.94 | IGLYGNGVT | 3.8 | | | | |
| NS3 | 1625 | 1.55 | 4 | 3 | 0 | Y | Y | GLYGNGWTT | 44.54 | GLYGNGWTR | 30.83 | GLYGNGWTK | 24.52 | | |
| NS3 | 1626 | 1.74 | 9 | 4 | 0 | Y | Y | LYGNGWTTS | 44.51 | LYGNGWTRS | 30.53 | LYGNGWTKN | 20.58 | LYGNGWTKS | 3.95 |
| NS3 | 1627 | 1.74 | 9 | 4 | 0 | Y | Y | YGNGWTTSG | 44.51 | YGNGWTRSG | 30.53 | YGNGWTKNG | 20.58 | YGNGWTKSG | 3.95 |
| NS3 | 1628 | 1.88 | 13 | 5 | 0 | Y | Y | GNGWTTSGT | 44.47 | GNGWTRSGA | 28.1 | GNGWTKNGG | 20.58 | GNGWTKSGD | 3.8 |
| NS3 | 1629 | 1.88 | 13 | 5 | 0 | Y | Y | NGWTTSGTY | 44.47 | NGWTRSGAY | 28.1 | NGWTKNGGY | 20.58 | NGWTKSGDY | 3.8 |
| NS3 | 1630 | 1.88 | 13 | 5 | 0 | Y | Y | GWTTSGTYV | 44.47 | GWTRSGAYV | 28.1 | GWTKNGGYV | 20.58 | GWTKSGDYV | 3.8 |
| NS3 | 1631 | 1.88 | 13 | 5 | 0 | Y | Y | WTTSGTYVS | 44.47 | WTRSGAYVS | 28.1 | WTKNGGYVS | 20.58 | WTKSGDYVS | 3.8 |
| NS3 | 1635 | 1.78 | 10 | 5 | 0 | Y | Y | SGTYVSAIAQ | 46.28 | SGAYVSAIAQ | 28.1 | NGGYVSAIAQ | 20.69 | SGDYVSAITQ | 3.8 |
| NS3 | 1636 | 1.87 | 14 | 5 | 0 | Y | Y | GTYVSAIAQA | 44.14 | GAYVSAIAQT | 28.36 | GGYVSGIAQT | 20.83 | GDYVSAITQA | 3.8 |
| NS3 | 1660 | 2.23 | 14 | 5 | 0 | Y | Y | VFKRNLTIM | 35.58 | IFKRKRLTIM | 23.3 | MFKKRNLTIM | 20.58 | IFKRKRLTIM | 10.66 |

| ... | peptides required to cover 99% of block | frequency |
|---|---|---|
| 1610 | GTSGSPIVDK | 2.65 |
| 1628 | GNGWTRSGT | 2.4 |
| 1629 | NGWTRSGTY | 2.4 |
| 1630 | GWTRSGTYV | 2.4 |
| 1631 | WTRSGTYVS | 2.4 |
| 1635 | SGTYVSSIAQ | 0.55 |
| 1636 | GTYVSAIAQT | 2.18 |
| 1660 | VFKKRNLTIM | 8.89 |

FIG. 20-23

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1661 | 1.95 | 10 | 4 | 0 | Y | FRKRNLTIMD | 35.77 | FRKRNLTIMD | 29.46 | FRKRRLTIMD | 23.34 | FRKKRLTIMD | 10.66 | | |
| NS3 | 1662 | 1.95 | 10 | 4 | 0 | Y | RKRNLTIMDL | 35.77 | KKRNLTIMDL | 29.46 | RKKRLTIMDL | 23.34 | RKRRLTIMDL | 10.66 | | |
| NS3 | 1663 | 1.3 | 8 | 3 | 0 | Y | KRNLTIMDLH | 65.23 | KKRLTIMDLH | 23.34 | KRRLTIMDLH | 10.66 | | | | |
| NS3 | 1664 | 1.3 | 8 | 3 | 0 | Y | RNLTIMDLHP | 65.23 | KRLTIMDLHP | 23.34 | RRLTIMDLHP | 10.66 | | | | |
| NS3 | 1665 | 0.99 | 6 | 2 | 0 | Y | NLTIMDLHPG | 65.27 | RLTIMDLHPG | 34 | | | | | | |
| NS3 | 1666 | 0.94 | 5 | 2 | 0 | Y | LTIMDLHPGS | 65.34 | LTIMDLHPGA | 34.55 | | | | | | |
| NS3 | 1667 | 0.94 | 4 | 2 | 0 | Y | TIMDLHPGSG | 65.34 | TIMDLHPGAG | 34.59 | | | | | | |
| NS3 | 1668 | 0.94 | 4 | 2 | 0 | Y | IMDLHPGSGK | 65.34 | IMDLHPGAGK | 34.59 | | | | | | |
| NS3 | 1669 | 0.93 | 3 | 2 | 0 | Y | MDLHPGSGKT | 65.38 | MDLHPGAGKT | 34.59 | | | | | | |
| NS3 | 1670 | 0.94 | 4 | 2 | 0 | Y | DLHPGSGKTR | 65.34 | DLHPGAGKTK | 34.59 | | | | | | |
| NS3 | 1671 | 1.56 | 6 | 3 | 0 | Y | LHPGSGKTRR | 44.47 | LHPGAGKTKR | 34.14 | LHPGSGKTRK | 20.87 | | | | |
| NS3 | 1672 | 1.74 | 7 | 4 | 0 | Y | HPGSGKTRRY | 44.47 | HPGAGKTKRY | 30.35 | HPGSGKTRKY | 20.87 | HPGAGKTKRI | 3.8 | | |
| NS3 | 1673 | 1.74 | 7 | 4 | 0 | Y | PGSGKTRRYL | 44.47 | PGAGKTKRYL | 30.35 | PGSGKTRKYL | 20.87 | PGAGKTKRIL | 3.8 | | |
| NS3 | 1674 | 1.74 | 7 | 4 | 0 | Y | GSGKTRRYLP | 44.47 | GAGKTKRYLP | 30.35 | GSGKTRKYLP | 20.87 | GAGKTKRILP | 3.8 | | |
| NS3 | 1675 | 1.74 | 8 | 4 | 0 | Y | SGKTRRYLPA | 44.47 | AGKTKRYLPA | 30.35 | SGKTRKYLPA | 20.8 | AGKTKRILPS | 3.8 | | |
| NS3 | 1676 | 1.81 | 10 | 5 | 0 | Y | GKTRRYLPAI | 43.69 | GKTRRYLPAI | 30.38 | GKTRKYLPAI | 20.69 | GKTKRILPSI | 3.8 | GKTRRYLPAM | 0.74 |
| NS3 | 1680 | 1.14 | 13 | 5 | 0 | Y | RYLPAIVREA | 73.89 | KYLPAIVREA | 19.91 | RILPSIVREA | 3.8 | KYLPAIIREA | 1.22 | RYLPAMVREA | 0.74 |
| NS3 | 1681 | 0.46 | 13 | 4 | 0 | Y | YLPAIVREAI | 93.62 | ILPSIVREAI | 3.8 | YLPAIIREAI | 1.29 | YLPAMVREAI | 0.74 | | |
| NS3 | 1682 | 0.54 | 14 | 5 | 0 | Y | LPAIVREAIK | 92.7 | LPSIVREALK | 3.8 | LPAIIREAIK | 1.29 | LPAIVREAIR | 0.74 | LPAMVREAIK | 0.74 |
| NS3 | 1683 | 0.55 | 15 | 5 | 0 | Y | PAIVREAIKR | 92.63 | PSIVREALKR | 3.8 | PAIIREAIKR | 1.29 | PAIVREAIRR | 0.74 | PAMVREAIKR | 0.74 |
| NS3 | 1687 | 1.84 | 18 | 5 | 0 | Y | REAIKRKLRT | 42.59 | REAIKRGLRT | 29.94 | REALKRRLRT | 22.2 | REALKRRLRT | 3.8 | REAIRRGLRT | 0.59 |
| NS3 | 1688 | 1.84 | 17 | 5 | 0 | Y | EAIKRKLRTL | 42.63 | EAIKRGLRTL | 29.94 | EALKRRLRTL | 22.2 | EALKRRLRTL | 3.8 | EAIRRGLRTL | 0.59 |
| NS3 | 1691 | 1.75 | 13 | 5 | 0 | Y | KRKLRTLILA | 41.74 | KRGLRTLILA | 29.98 | KRRLRTLILA | 25.74 | KRLRTLVLA | 1.03 | RRGLRTLILA | 0.59 |
| NS3 | 1692 | 1.68 | 10 | 4 | 0 | Y | RKLRTLILAP | 41.78 | RGLRTLILAP | 30.79 | RRLRTLILAP | 25.74 | RKLRTLVLAP | 1.03 | | |

FIG. 20-24

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 1693 | 1.68 | 9 | 4 | 0 | Y | KLRT

FIG. 20-25

Species: DENVall (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1726 | 1.98 | 15 | 5 | 0.15 | Y | KSEHTGKEIV | 35.47 | KSEHTGREIV | 33.3 | RAEHTGREIV | 21.72 | KTEHTGREIV | 6.6 | KAEHTGREIV | 2.21 |
| NS3 | 1727 | 1.86 | 12 | 4 | 0.15 | Y | SEHTGKEIVD | 35.47 | SEHTGREIVD | 33.41 | AEHTGREIVD | 23.93 | TEHTGREIVD | 6.64 | | |
| NS3 | 1728 | 0.96 | 7 | 2 | 0.15 | Y | EHTGREIVDL | 64.05 | EHTGKEIVDL | 35.62 | | | | | | |
| NS3 | 1729 | 0.95 | 4 | 2 | 0 | Y | HTGREIVDLM | 64.27 | HTGKEIVDLM | 35.66 | | | | | | |
| NS3 | 1730 | 0.95 | 4 | 2 | 0 | Y | TGREIVDLMC | 64.27 | TGKEIVDLMC | 35.66 | | | | | | |
| NS3 | 1731 | 0.95 | 5 | 2 | 0 | Y | GREIVDLMCH | 64.27 | GKEIVDLMCH | 35.66 | | | | | | |
| NS3 | 1732 | 0.95 | 5 | 2 | 0 | Y | REIVDLMCHA | 64.23 | KEIVDLMCHA | 35.66 | | | | | | |
| NS3 | 1733 | 0.02 | 5 | 1 | 0 | Y | EIVDLMCHAT | 99.85 | | | | | | | | |
| NS3 | 1734 | 0.02 | 5 | 1 | 0 | Y | IVDLMCHATF | 99.85 | | | | | | | | |
| NS3 | 1735 | 0.02 | 5 | 1 | 0 | Y | VDLMCHATFT | 99.85 | | | | | | | | |
| NS3 | 1736 | 0.25 | 6 | 2 | 0 | Y | DLMCHATFTM | 96.05 | DLMCHATFTT | 3.8 | | | | | | |
| NS3 | 1737 | 0.26 | 6 | 2 | 0 | Y | LMCHATFTMR | 96.05 | LMCHATFTTR | 3.72 | | | | | | |
| NS3 | 1738 | 0.26 | 6 | 2 | 0 | Y | MCHATFTMRL | 96.05 | MCHATFTTRL | 3.72 | | | | | | |
| NS3 | 1739 | 0.26 | 6 | 2 | 0 | Y | CHATFTMRLL | 96.05 | CHATFTTRLL | 3.72 | | | | | | |
| NS3 | 1740 | 0.25 | 5 | 2 | 0 | Y | HATFTMRLLS | 96.09 | HATFTTRLLS | 3.72 | | | | | | |
| NS3 | 1741 | 0.26 | 6 | 2 | 0 | Y | ATFTMRLLSP | 96.02 | ATFTTRLLSS | 3.72 | | | | | | |
| NS3 | 1742 | 0.45 | 8 | 3 | 0 | Y | TFTMRLLSPV | 93.14 | TFTTRLLSST | 3.72 | TFTMRLLSPI | 2.84 | | | | |
| NS3 | 1743 | 0.44 | 7 | 3 | 0 | Y | FTMRLLSPVR | 93.22 | FTTRLLSSTR | 3.72 | FTMRLLSPIR | 2.84 | | | | |
| NS3 | 1744 | 0.44 | 8 | 3 | 0 | Y | TMRLLSPVRV | 93.22 | TTRLLSSTRV | 3.72 | TMRLLSPIRV | 2.84 | | | | |
| NS3 | 1745 | 0.45 | 7 | 3 | 0 | Y | MRLLSPVRVP | 93.18 | TRLLSSTRVP | 3.72 | MRLLSPIRVP | 2.84 | | | | |
| NS3 | 1746 | 0.45 | 8 | 3 | 0 | Y | RLLSPVRVPN | 93.18 | RLLSSTRVPN | 3.72 | RLLSPIRVPN | 2.84 | | | | |
| NS3 | 1747 | 0.44 | 7 | 3 | 0 | Y | LLSPVRVPNY | 93.18 | LLSSTRVPNY | 3.72 | LLSPIRVPNY | 2.84 | | | | |
| NS3 | 1748 | 0.44 | 7 | 3 | 0 | Y | LSPVRVPNYN | 93.18 | LSSTRVPNYN | 3.8 | LSPIRVPNYN | 2.84 | | | | |
| NS3 | 1749 | 1.37 | 8 | 4 | 0 | Y | SPVRVPNYNM | 48.78 | SPVRVPNYNM | 44.4 | SSTRVPNYNL | 3.8 | SPIRVPNYNL | 2.84 | | |

FIG. 20-26

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1750 | 1.48 | 9 | 5 | 0 | Y | PVRVPNY

FIG. 20-27

Species: DENVall (10-mers)

| protein | block starting position | block entropy | total peptides in block | # peptides required to cover 99% of block | gap/x fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1774 | 0.95 | 5 | 2 | 0 | Y | ARGYISTRVG | 65.23 | ARGYISTRVE | 34.62 | | | | | | |
| NS3 | 1775 | 0.94 | 3 | 2 | 0 | Y | RGYISTRVGM | 65.34 | RGYISTRVEM | 34.62 | | | | | | |
| NS3 | 1776 | 0.94 | 3 | 2 | 0 | Y | GYISTRVGMG | 65.34 | GYISTRVEMG | 34.62 | | | | | | |
| NS3 | 1777 | 0.94 | 3 | 2 | 0 | Y | YISTRVGMGE | 65.34 | YISTRVEMGE | 34.62 | | | | | | |
| NS3 | 1778 | 0.97 | 4 | 2 | 0 | Y | ISTRVGMGEA | 65.01 | ISTRVEMGEA | 34.62 | | | | | | |
| NS3 | 1779 | 0.97 | 6 | 2 | 0 | Y | STRVGMGEAA | 64.93 | STRVEMGEAA | 34.62 | | | | | | |
| NS3 | 1780 | 1.15 | 7 | 3 | 0 | Y | TRVGMGEAAA | 64.93 | TRVEMGEAAG | 30.83 | TRVEMGEAAA | 3.8 | | | | |
| NS3 | 1781 | 1.15 | 7 | 3 | 0 | Y | RVGMGEAAAI | 64.93 | RVEMGEAAGI | 30.83 | RVEMGEAAAI | 3.8 | | | | |
| NS3 | 1782 | 1.14 | 6 | 3 | 0 | Y | VGMGEAAAIF | 64.97 | VEMGEAAGIF | 30.83 | VEMGEAAAIF | 3.8 | | | | |
| NS3 | 1783 | 1.14 | 6 | 3 | 0 | Y | GMGEAAAIFM | 64.97 | EMGEAAGIFM | 30.83 | EMGEAAAIFM | 3.8 | | | | |
| NS3 | 1784 | 0.93 | 5 | 2 | 0 | Y | MGEAAAIFMT | 68.77 | MGEAAGIFMT | 30.83 | | | | | | |
| NS3 | 1785 | 0.93 | 5 | 2 | 0 | Y | GEAAAIFMTA | 68.77 | GEAAGIFMTA | 30.83 | | | | | | |
| NS3 | 1786 | 0.94 | 6 | 2 | 0 | Y | EAAAIFMTAT | 68.73 | EAAGIFMTAT | 30.83 | | | | | | |
| NS3 | 1787 | 0.94 | 6 | 2 | 0 | Y | AAAIFMTATP | 68.73 | AAGIFMTATP | 30.83 | | | | | | |
| NS3 | 1788 | 0.9 | 5 | 2 | 0 | Y | AAIFMTATPP | 69.06 | AGIFMTATPP | 30.83 | | | | | | |
| NS3 | 1789 | 0.9 | 3 | 2 | 0 | Y | AIFMTATPPG | 69.14 | GIFMTATPPG | 30.83 | | | | | | |
| NS3 | 1790 | 0.95 | 5 | 3 | 0 | Y | IFMTATPPGS | 75.59 | IFMTATPPGT | 21.05 | IFMTATPPGA | 3.24 | | | | |
| NS3 | 1801 | 1.94 | 11 | 5 | 0 | Y | EAFPQSNAVI | 43.81 | DPFPQSNAPI | 30.75 | DAFPQSNAPI | 15.34 | EAFPQSNAPI | 5.42 | DPFPQSNSPI | 3.8 |
| NS3 | 1810 | 1.52 | 11 | 5 | 0 | Y | IQDEERDIPE | 64.16 | IMDEERDIPE | 19.76 | IIDEERDIPE | 10.55 | IEDIEREIPE | 3.8 | IQDEEKDIPE | 1.07 |
| NS3 | 1811 | 1.52 | 11 | 5 | 0 | Y | QDEERDIPER | 64.16 | MDEERDIPER | 19.76 | IDEERDIPER | 10.55 | EDIEREIPER | 3.8 | QDEEKDIPER | 1.07 |
| NS3 | 1812 | 1.2 | 7 | 4 | 0 | Y | DEERDIPERS | 64.2 | DEERDIPERS | 30.79 | DIEREIPERS | 3.8 | DEEKDIPERS | 1.07 | | |
| NS3 | 1813 | 1.2 | 7 | 4 | 0 | Y | EERDIPERSW | 64.2 | EEREIPERSW | 30.79 | IEREIPERSW | 3.8 | EEKDIPERSW | 1.07 | | |
| NS3 | 1814 | 1.07 | 6 | 3 | 0 | Y | ERDIPERSWN | 64.2 | EREIPERSWN | 34.03 | EKDIPERSWN | 1.07 | | | | |
| NS3 | 1815 | 1.26 | 10 | 4 | 0 | Y | RDIPERSWNS | 64.09 | REIPERSWNS | 29.87 | REIPERSWNT | 4.13 | KDIPERSWNS | 1.07 | | |

FIG. 20-28

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1816 | 1.18 | 9 | 3 | 0 | Y | DIPERSWNSG | 65.15 | EIPERSWN

FIG. 20-29

Species: DENVall (10-mers)

| protein | block starting position | block

FIG. 20-30

Species: DENVall (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1889 | 1.88 | 9 | 5 | 0 | Y | SEMGANFRAD | 44.54 | SEMGANFKAE | 27.06 | SEMGANFKAD | 20.69 | SEMGANFRAG | 3

FIG. 20-31

Species: DENWall (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1913 | 1.67 | 15 | 5 | 0 | Y | KDGPERVILA | 44.36 | TDGEERVILA | 29.98 | TDGEERVILA | 24.15 | TDGEERVVLA | 0.48 | PDGPERVILA | 0.41 |
| NS3 | 1914 | 0.99 | 11 | 3 | 0 | Y | DGPERVILAG | 68.92 | DGEERVILAG | 30.05 | DGEERVILAG | 0.48 | | | | |
| NS3 | 1915 | 0.96 | 6 | 2 | 0 | Y | GPERVILAGP | 68.99 | GEERVILAGP | 30.24 | | | | | | |
| NS3 | 1916 | 1.17 | 7 | 3 | 0 | Y | PERVILAGPM | 65.12 | EERVILAGPM | 30.31 | PERVILAGPI | 3.87 | | | | |
| NS3 | 1917 | 0.29 | 4 | 2 | 0 | Y | ERVILAGPMP | 95.58 | ERVILAGPIP | 3.91 | | | | | | |
| NS3 | 1918 | 0.29 | 5 | 2 | 0 | Y | RVILAGPMPV | 95.54 | RVILAGPIPV | 3.91 | | | | | | |
| NS3 | 1919 | 0.29 | 5 | 2 | 0 | Y | VILAGPMPVT | 95.54 | VILAGPIPVT | 3.91 | | | | | | |
| NS3 | 1920 | 1.72 | 8 | 4 | 0 | Y | ILAGPMPVTV | 46.83 | ILAGPMPVTH | 30.27 | ILAGPMPVTA | 18.44 | ILAGPIPVTP | 3.8 | | |
| NS3 | 1921 | 1.7 | 8 | 4 | 0 | Y | LAGPMPVTVA | 46.83 | LAGPMPVTHS | 30.53 | LAGPMPVTAA | 18.44 | LAGPIPVTPA | 3.8 | | |
| NS3 | 1922 | 1.71 | 9 | 4 | 0 | Y | AGPMPVTVAS | 46.83 | AGPMPVTHSS | 30.49 | AGPMPVTAAS | 18.44 | AGPIPVTPAS | 3.8 | | |
| NS3 | 1923 | 1.71 | 9 | 4 | 0 | Y | GPMPVTVASA | 46.83 | GPMPVTHSSA | 30.49 | GPMPVTAASA | 18.44 | GPIPVTPASA | 3.8 | | |
| NS3 | 1924 | 1.71 | 9 | 4 | 0 | Y | PMPVTVASAA | 46.83 | PMPVTHSSAA | 30.49 | PMPVTAASAA | 18.44 | PIPVTPASAA | 3.8 | | |
| NS3 | 1925 | 1.71 | 9 | 4 | 0 | Y | MPVTVASAAQ | 46.83 | MPVTHSSAAQ | 30.49 | MPVTAASAAQ | 18.44 | IPVTPASAAQ | 3.8 | | |
| NS3 | 1926 | 1.7 | 8 | 4 | 0 | Y | PVTVASAAQR | 46.83 | PVTHSSAAQR | 30.49 | PVTAASAAQR | 18.44 | PVTPASAAQR | 3.8 | | |
| NS3 | 1927 | 1.69 | 7 | 4 | 0 | Y | VTVASAAQRR | 46.83 | VTHSSAAQRR | 30.53 | VTAASAAQRR | 18.55 | VTPASAAQRR | 3.8 | | |
| NS3 | 1928 | 1.69 | 6 | 4 | 0 | Y | TVASAAQRRG | 46.83 | THSSAAQRRG | 30.57 | TAASAAQRRG | 18.55 | TPASAAQRRG | 3.8 | | |
| NS3 | 1929 | 1.69 | 6 | 4 | 0 | Y | VASAAQRRGR | 46.83 | HSSAAQRRGR | 30.57 | AASAAQRRGR | 18.55 | PASAAQRRGR | 3.8 | | |
| NS3 | 1930 | 1.61 | 6 | 4 | 0 | Y | ASAAQRRGRI | 48.3 | SSAAQRRGRV | 29.09 | ASAAQRRGRV | 18.55 | | | | |
| NS3 | 1931 | 0.77 | 3 | 2 | 0 | Y | SAAQRRGRIG | 77.62 | SAAQRRGRVG | 22.35 | SSAAQRRGRV | 20.87 | | | | |
| NS3 | 1932 | 0.77 | 2 | 2 | 0 | Y | AAQRRGRIGR | 77.62 | AAQRRGRVGR | 22.38 | | | | | | |
| NS3 | 1933 | 0.79 | 4 | 2 | 0 | Y | AQRRGRIGRN | 77.43 | AQRRGRVGRN | 22.38 | | | | | | |
| NS3 | 1934 | 1.95 | 12 | 4 | 0 | Y | QRRGRIGRNP | 33.08 | QRRGRIGRNH | 32.74 | QRRGRIGRNP | 22.23 | QRRGRIGRNQ | 11.36 | | |
| NS3 | 1945 | 2.08 | 12 | 5 | 0 | Y | KEGDQYIYMG | 35.44 | NENDQYIYMG | 30.64 | KENDQYIFTG | 20.28 | KEGDQYYMG | 9.03 | QEDDQYVFSG | 3.8 |
| NS3 | 1946 | 2.08 | 12 | 5 | 0 | Y | EGDQYIYMGQ | 35.44 | ENDQYIYMGE | 30.64 | EGDQYIFTGQ | 20.28 | EGDQYYMGQ | 9.03 | EDDQYVFSGD | 3.8 |

FIG. 20-32

Species: DENVall (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1947 | 2.08 | 10 | 5 | 0 | Y | GDQYIYMGQP | 35.44 | NDQYIYMGEP | 30.68 | NDQYIFTGQP | 20

FIG. 20-33

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 |

FIG. 20-34

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1998 | 0.98 | 9 | 3 | 0 | Y | DGEYRLRGEA | 75.26 | DGEYRLRGES | 20.72 | DGEF

FIG. 20-35

Species: DENVall (10-mers)

| protein | block starting position | block entropy | total peptides in block | # peptides required to cover 99% of block | gap/X fraction | % of block covered 99% | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 2035 | 2.02 | 14 | 5 | 0.04 | Y | YSDRRWCFDG | 44.32 | YTDRKWCFDG | 21.02 | YADRRWCFDG | 21.02 | YADRKWCFDG | 9.4 | YKDREWCFT

FIG. 20-36

Species: DENVall (10-mers)

| protein | block starting position | block entropy | total peptides in block | # peptides required to cover 99% of block | gap/X fraction | 99% of block covered | w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 2079 | 1.75 | 12 | 4 | 0.07 | Y | Y | TYSDPALRE | 44.28 | TYSDPLALKE | 30.05 | TYSDPLALKE | 21.35 | VYADPMALKD | 3.76 | |
| NS3 | 2080 | 1.24 | 12 | 3 | 0.07 | Y | Y | YSDPLALKEF | 51.4 | YSDPLALREF | 44.32 | YADPMALKDF | 3.76 | DPMALKDFKE | 3.76 | |
| NS3 | 2081 | 1.24 | 12 | 3 | 0.07 | Y | Y | SDPLALKEFK | 51.4 | SDPLALREFK | 44.32 | ADPMALKDFK | 3.76 | PMALKDFKEF | 3.76 | |
| NS3 | 2082 | 1.74 | 13 | 4 | 0.07 | Y | Y | DPLALREFKE | 44.32 | DPLALKEFKE | 31.19 | DPLALKEFKD | 20.21 | DPMALKDFKE | 3.76 | |
| NS3 | 2083 | 1.74 | 13 | 4 | 0.07 | Y | Y | PLALREFKEF | 44.32 | PLALKEFKEF | 31.19 | PLALKEFKDF | 20.21 | PMALKDFKEF | 3.76 | |
| NS3 | 2084 | 1.74 | 13 | 4 | 0.07 | Y | Y | LALREFKEFA | 44.32 | LALKEFKEFA | 31.19 | LALKEFKDFA | 20.21 | MALKDFKEFA | 3.76 | |
| NS3 | 2085 | 1.74 | 13 | 4 | 0.07 | Y | Y | ALREFKEFAA | 44.36 | ALKEFKEFAA | 31.19 | ALKEFKDFAA | 20.21 | ALKDFKEFAS | 3.76 | |
| NS3 | 2086 | 1.73 | 11 | 4 | 0.07 | Y | Y | LREFKEFAAG | 44.36 | LKEFKEFAAG | 31.27 | LKEFKDFAAG | 20.21 | LKDFKEFASG | 3.76 | |
| NS3 | 2087 | 1.72 | 10 | 4 | 0.07 | Y | Y | REFKEFAAGR | 44.36 | KEFKEFAAGR | 31.27 | KEFKDFAAGR | 20.28 | KDFKEFASGR | 3.76 | |

FIG. 20-37

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|---|
| NS4A | 2140 | 1.77 | 13 | 4 | 0 | Y | Y | HAMEELPDTI | 44.03 | HALSELPETL | 30.64 | HAVEELPETM | 20.8 | HALN

FIG. 20-38

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4A | 2209 | 1.55 | 8 | 3 | 0 | Y | EFFLMVLLIP | 48.19 | EFFLIVLLIP | 30.46 | EFFMVYLLIP | 20.83 | | | | |
| NS4A | 2210 | 1.53 | 7 | 3 | 0 | Y | FFLMVLLIPE | 48.23 | FFLIVLLIPE | 30.72 | FFMMVLLIPE | 20.8 | | | |

FIG. 20-39

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| 2K | 2246 | 1.18 | 7 | 3 | 0 | Y | | AANEMGLLET | 64.53 | MANEMGFLEK | 30.79 | AANEMGLIEK | 3.8 | | |
| 2K | 2247 | 1.13 | 6 | 3 | 0 | Y | | ANEMGLLET

FIG. 20-40

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2302 | 1.7 | 5 | 4 | 0 | Y | PMMRHTIENT | 44.51 | PMLRHSIENS | 30.79 | PMLRHTIENS | 20.83 | PMLRHTIENT | 3.83 | |
| NS4B | 2303 | 1.7 | 6 | 4 | 0 | Y | MMRHTIENTT | 44.51 | MLRHSIENSS | 30.79 | MLRHTIENST | 20.83 | MLRHTIENTS | 3.8 | |
| NS4B | 2304 | 1.7 | 5 | 4 | 0 | Y | MRHTIENTTA | 44.51 | LRHSIENSSV | 30.83 | LRHTIENSTA | 20.83 | LRHTIENTSA | 3.8 | |
| NS4B | 2305 | 1.69 | 4 | 4 | 0 | Y | RHTIENTTA

FIG. 20-41

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS4B | 2326 | 1.7 | 8 | 4 | 0 | Y | ILMGLDKGWP | 44.43 | VLMGLDKGWP | 31.45 | VLMGLDKGWP | 20.76 | VLMGLGRGWP | 3.1 | | |
| NS4B | 2327 | 1.11 | 7 | 3 | 0 | Y | LMGLDKGWPI | 65.19 | LMGLGKGWPL | 31.45 | LMGLGKGWPL | 3.1 | | | | |
| NS4B | 2328 | 1.28 | 8 | 4 | 0 | Y | MGLDKGWPIS | 65.19 | MGLGKGWPLH | 27.65 | MGLGKGWPLS | 3.8 | MGLGRGWPLS | 3.1 | | |
| NS4B | 2329 | 1.28 | 8 | 4 | 0 | Y | GLDKGWPISK | 65.15 | GLGKGWPLHR | 27.69 | GLGKGWPLSK | 3.8 | GLGRGWPLSK | 3.1 | | |
| NS4B | 2330 | 1.29 | 10 | 4 | 0 | Y | LDKGWPISKM | 65.15 | LGKGWPLHRM | 27.65 | LGKGWPLSKM | 3.72 | LGRGWPLSKM | 3.1 | | |
| NS4B | 2331 | 1.29 | 10 | 4 | 0 | Y | DKGWPISKMD | 65.15 | GKGWPLHRMD | 27.65 | GKGWPLSKMD | 3.72 | GRGWPLSKMD | 3.1 | | |
| NS4B | 2332 | 1.87 | 12 | 5 | 0 | Y | KGWPISKMDI | 44.1 | KGWPLSKMDL | 27.62 | KGWPLSKMDI | 21.2 | K

FIG. 20-42

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2350 | 1.13 | 8 | 3 | 0 | Y | CYSQVNPLTL

FIG. 20-43

Species: DENVall (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2386 | 0.89 | 7 | 2 | 0 | Y | QKRTAAGIMK | 70.91 | QKRAAAGIMK | 28.91 | | | | | | |
| NS4B | 2387 | 0.88 | 5 | 2 | 0 | Y | KRTAAGIMKN | 70.94 | KRAAAGIMKN | 28.95 | | | | | | |
| NS4B | 2388 | 0.88 | 5 | 2 | 0 | Y | RTAAGIMKNP | 70.94 | RAAAGIMKNP | 28.95 | | | | | | |
| NS4B | 2389 | 0.89 | 6 | 2 | 0 | Y | TAAGIMKNPT | 70.94 | AAAGIMKNPT | 28.91 | | | | | | |
| NS4B | 2390 | 0.11 | 6 | 2 | 0 | Y | AAGIMKNPTV | 98.71 | AAGIMKNPTI | 1.14 | | | | | | |
| NS4B | 2391 | 0.11 | 6 | 2 | 0 | Y | AGIMKNPTVD | 98.71 | AGIMKNPTID | 1.14 | | | | | | |
| NS4B | 2392 | 0.1 | 5 | 2 | 0 | Y | GIMKNPTVDG | 98.75 | GIMKNPTIDG | 1.14 | | | | | | |
| NS4B | 2393 | 0.16 | 7 | 2 | 0 | Y | IMKNPTVDGI | 98.08 | IMKNPTIDGI | 1.14 | | | | | | |
| NS4B | 2394 | 1.69 | 10 | 5 | 0 | Y | MKNPTVDGIV | 43.07 | MKNPTVDGIT | 33.92 | MKNPTVDGIM | 20.72 | MKNPTIDGIV | 1.14 | MKNPTVDGVT | 0.63 |
| NS4B | 2395 | 1.73 | 11 | 5 | 0 | Y | KNPTVDGIVA | 42.55 | KNPTVDGITV | 33.92 | KNPTVDGIMT | 20.76 | KNPTIDGIVA | 1.14 | KNPTVDGVTV | 0.63 |
| NS4B | 2396 | 1.73 | 11 | 5 | 0 | Y | NPTVDGIVAI | 42.55 | NPTVDGITVI | 33.92 | NPTVDGIMTI | 20.76 | NPTIDGIVAI | 1.14 | NPTVDGV

FIG. 20-44

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2421 | 1.91 | 13 | 4 | 0 | Y | GQMLLILCT | 43.95 | GQVMLLVLCA | 24 | GQVMLLILCV | 21.09 | GQVMLLVLCV | 10.07 | | |
| NS4B | 2428 | 1.76 | 15 | 4 | 0 | Y | LCTSQILLMR | 44.47 | LCVTQVLMMR | 30.75 | LCAVQLLLMR | 20.54 | LCAGQLLLMR | 3.36 | | |
| NS4B | 2429 | 1.76 | 15 | 4 | 0 | Y | CTSQILLMRT | 44.47 | CVTQVLMMRT | 30.75 | CAVQLLLMRT | 20.54 | CAGQLLLMRT | 3.36 | | |
| NS4B | 2430 | 1.76 | 14 | 4 | 0 | Y | TSQILLMRTT | 44.51 | VTQVLMMRTT | 30.75 | AVQLLLMRTS | 20.54 | AGQLLLMRTT | 3.36 | | |
| NS4B | 2431 | 1.73 | 11 | 4 | 0 | Y | SQILLMRTTW | 44.51 | TQVLMMRTTW | 30.75 | VQLLLMRTSW | 20.65 | GQLLLMRTTW | 3.72 | | |
| NS4B | 2432 | 1.71 | 8 | 4 | 0 | Y | QILLMRTTWA | 44.54 | QVLMMRTTWA | 30.75 | QLLLMRTSWA | 20.8 | QLLLMRTTWA | 3.72 | | |
| NS4B | 2433 | 1.82 | 11 | 4 | 0 | Y | ILLMRTTWAL | 44.54 | VLMMRTTWAL | 30.72 | LLLMRTSWAL | 18.88 | LLLMRTTWAF | 3.36 | LLLMRTSWAF | 1.92 |
| NS4B | 2434 | 1.8 | 11 | 5 | 0 | Y | LLMRTTWALC | 44.87 | LMMRTTWALC | 30.72 | LLMRTSWALC | 18.88 | LMRTTWAFC | 3.36 | LLMRTSWAFC | 1.92 |
| NS4B | 2435 | 1.79 | 9 | 5 | 0 | Y | LMRTTWALCE | 44.87 | MMRTTWALCE | 30.75 | LMRTSWALCE | 18.88 | LMRTTWAFCE | 3.43 | LMRTSWAFCE | 1.92 |
| NS4B | 2436 | 1.84 | 10 | 5 | 0 | Y | MRTTWALCES | 44.51 | MRTTWALCEA | 30.75 | MRTSWALCEA | 18.66 | MRTTWAFCEV | 3.43 | MRTSWAFCEA | 1.92 |
| NS4B | 2437 | 1.84 | 10 | 5 | 0 | Y | RTTWALCESI | 44.51 | RTTWALCEAL | 30.75 | RTSWALCEAL | 18.66 | RTTWAFCEVL | 3.43 | RTSWAFCEAL | 1.92 |
| NS4B | 2438 | 1.83 | 9 | 5 | 0 | Y | TTWALCESIT | 44.51 | TTWALCEALT | 30.75 | TSWALCEALT | 18.66 | TTWAFCEVLT | 3.43 | TSWAFCEALT | 1.92 |
| NS4B | 2439 | 1.84 | 10 | 5 | 0 | Y | TWALCESITL | 44.51 | TWALCEALTL | 30.72 | TWALCEALTL | 18.66 | TWAFCEVLTL | 3.43 | SWAFCEALTL | 1.92 |
| NS4B | 2440 | 1.37 | 10 | 4 | 0 | Y | WALCESITLA | 49.34 | WALCESITLA | 44.51 | WAFCEVLTLA | 3.39 | WAFCEALTLAT | 1.92 | | |
| NS4B | 2441 | 1.38 | 12 | 4 | 0 | Y | ALCESITLAT | 49.34 | ALCESITLAT | 44.4 | AFCEVLTLAT | 3.39 | AFCEALTLAT | 1.92 | | |
| NS4B | 2442 | 1.38 | 12 | 4 | 0 | Y | LCEALTLATG | 49.34 | LCESITLATG | 44.4 | FCEVLTLATG | 3.39 | FCEALTLATG | 1.92 | | |
| NS4B | 2443 | 1.23 | 9 | 3 | 0 | Y | CEALTLATGP | 51.29 | CESITLATGP | 44.43 | CEVLTLATGP | 4.06 | | | | |
| NS4B | 2444 | 1.3 | 11 | 4 | 0 | Y | EALTLATGPI | 50.52 | ESITLATGPL | 44.43 | EVLTLATGPI | 3.83 | EALTLATGPV | 0.77 | | |
| NS4B | 2446 | 1.8 | 14 | 5 | 0 | Y | ITLATGPLIT | 44.43 | LTLATGPIST | 30.01 | LTLATGPIT | 20.8 | LTLATGPILT | 3.17 | LTLATGPVST | 0.74 |
| NS4B | 2447 | 1.8 | 14 | 5 | 0 | Y | TLATGPLITL | 44.43 | TLATGPISTL | 30.01 | TLATGPITL | 20.8 | TLATGPILTL | 3.17 | TLATGPVSTL | 0.74 |
| NS4B | 2448 | 1.81 | 15 | 5 | 0 | Y | LATGPLTILW | 44.43 | LATGPISTLW | 29.98 | LATGPITTLW | 20.8 | LATGPILTLW | 3.17 | LATGPVSTLW | 0.74 |
| NS4B | 2449 | 1.8 | 14 | 5 | 0 | Y | ATGPLTILWE | 44.43 | ATGPISTLWE | 30.01 | ATGPITTLWE | 20.8 | ATGPILTLWE | 3.17 | ATGPVSTLWE | 0.74 |
| NS4B | 2450 | 1.8 | 13 | 5 | 0 | Y | TGPLITLWEG | 44.43 | TGPISTLWEG | 30.05 | TGPITTLWEG | 20.8 | TGPILTLWEG | 3.17 | TGPVSTLWEG | 0.74 |
| NS4B | 2451 | 1.8 | 13 | 5 | 0 | Y | GPLITLWEGS | 44.51 | GPISTLWEGN | 29.9 | GPITTLWEGS | 20.8 | GPILTLWEGN | 3.17 | GPVSTLWEGN | 0.74 |

FIG. 20-45

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2452 | 1.8 | 13 | 5 | 0 | Y | PLTTLWEGSP | 44.51 | PISTLWEGNP | 29.9 | PITTLWEGSP | 20.8 | PITTLWEGNP | 3.17 | PYSTLWEGNP

FIG. 20-46

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2476 | 0.04 | 6 | 1 | 0 | Y | IFRGSYLAGA | 99.71 | | | | | | | | |
| NS4B | 2477 | 0.05 | 8 | 1 | 0 | Y | FRGSYLAGAG | 99.59 | | | | | | | | |
| NS4B | 2478 | 0.05 | 8 | 1 | 0 | Y | RGSYLAGAGL | 99.59 | | | | | | | | |
| NS4B | 2479 | 0.94 | 9 | 2 | 0 | Y | GSYLAGAGLA | 68.81 | GSYLAGAGLL | 30.79 | | | | | | |
| NS4B | 2480 | 0.94 | 10 | 2 | 0 | Y | SYLAGAGLLF | 68.77 | SYLAGAGLF | 30.79 | | | | | | |
| NS4B | 2481 | 0.94 | 11 | 2 | 0 | Y | YLAGAGLLFS | 68.84 | YLAGAGLLFS | 30.72 | | | | | | |
| NS4B | 2482 | 1.57 | 15 | 3 | 0 | Y | LAGAGLAFSL | 48.16 | LAGAGLLFSI | 30.68 | LAGAGLAFSI | 20.54 | | | | |
| NS4B | 2483 | 1.76 | 16 | 4 | 0 | Y | AGAGLAFSLM | 44.36 | AGAGLLFSIM | 30.64 | AGAGLAFSLI | 20.61 | AGAGLAFSLI | 3.8 | | |
| NS4B | 2484 | 1.8 | 18 | 5 | 0 | Y | GAGLAFSLMK | 44.36 | GAGLLFSIMK | 30.13 | GAGLAFSLIK | 20.58 | GAGLAFSLIK | 3.8 | GAGLLFSIMR | 0.52 |
| NS4B | 2485 | 1.8 | 19 | 5 | 0 | Y | AGLAFSLMKS | 44.36 | AGLLFSIMKN | 30.13 | AGLAFSLIKN | 20.54 | AGLAFSLIKN | 3.8 | AGLLFSIMRN | 0.52 |
| NS4B | 2486 | 1.8 | 20 | 5 | 0.11 | N | GLAFSLMKSL | 44.4 | GLLFSIMKNT | 30.09 | GLAFSLIKNA | 20.61 | GLAFSLIKNA | 3.58 | GLLFSIMKNT | 0.52 |
| NS4B | 2505 | 1.38 | 11 | 5 | 0 | Y | QGETLGEKWK | 65.19 | IGETLGEKWK | 24.82 | TGETLGEKWK | 5.83 | MGETLGEKWK | 3.02 | VGETLGEKWK | 0.88 |
| NS5 | 2506 | 1.64 | 10 | 4 | 0 | Y | GETLGEKWKR | 48.41 | GETLGEKWKS | 28.61 | GETLGEKWKK | 20.61 | GETLGEKWKN | 2.06 | | |
| NS5 | 2507 | 1.69 | 14 | 4 | 0 | Y | ETLGEKWKRQ | 48.27 | ETLGEKWKSR | 28.5 | ETLGEKWKKK | 20.35 | ETLGEKWKNR | 2.06 | | |
| NS5 | 2508 | 1.68 | 13 | 4 | 0 | Y | TLGEKWKRQL | 48.27 | TLGEKWKSRL | 28.54 | TLGEKWKKKL | 20.35 | TLGEKWKNRL | 2.06 | | |
| NS5 | 2509 | 1.68 | 13 | 4 | 0 | Y | LGEKWKRQLN | 48.27 | LGEKWKSRLN | 28.54 | LGEKWKKKLN | 20.35 | LGEKWKNRLN | 2.06 | | |
| NS5 | 2535 | 1.75 | 12 | 4 | 0 | Y | EVDRSEAKEG | 44.47 | EVDRTLAKEG | 30.83 | EVDRTEAKEG | 20.24 | EVDRTEAKSA | 3.76 | | |
| NS5 | 2536 | 1.75 | 12 | 4 | 0 | Y | VDRSEAKEGL | 44.47 | VDRTLAKEGI | 30.83 | VDRTEAKEGL | 20.24 | VDRTEAKSAL | 3.76 | | |
| NS5 | 2540 | 1.26 | 12 | 3 | 0 | Y | EAKEGLKRGE | 63.83 | LAKEGIKRGE | 30.72 | EAKSALKDGS | 3.39 | EAKSALKDGS | 1.22 | | |
| NS5 | 2541 | 1.72 | 15 | 5 | 0 | Y | AKEGLKRGET | 51.33 | AKEGIKRGET | 30.72 | AKSALKDGSK | 12.46 | AKSALKDGSK | 3.39 | AKEGLRRGET | 1.14 |
| NS5 | 2552 | 1.51 | 12 | 5 | 0 | Y | HHAVSRGSAK | 51 | KHAVSRGTAK | 39.27 | RHAVSRGTAK | 5.01 | KHAVSRGSSK | 3.69 | HHAVSRGTAK | 0.44 |
| NS5 | 2553 | 1.22 | 8 | 3 | 0 | Y | HAVSRGSAKL | 51.11 | HAVSRGTAKL | 44.87 | HAVSRGTAKL | 3.69 | | | | |
| NS5 | 2554 | 1.75 | 9 | 4 | 0 | Y | AVSRGTAKLR | 44.43 | AVSRGSAKLR | 30.79 | AVSRGSAKLQ | 20.39 | AVSRGSSKIR | 3.69 | | |
| NS5 | 2555 | 1.75 | 9 | 4 | 0 | Y | VSRGTAKLRW | 44.43 | VSRGSAKLRW | 30.79 | VSRGSAKLQW | 20.39 | VSRGSSKIRW | 3.69 | | |

FIG. 20-47

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2556 | 1.76 | 11 | 4 | 0 | Y | SRGTAKLRWF | 44.4 | SRGSAKLRWF | 30.79 | SRGSAKLQWF | 20.35 | SRGSKIRWI | 3.69 | | |
| NS5 | 2557 | 1.76 | 11 | 4 | 0 | Y | RGTAKLRWFV | 44.4 | RGSAKLRWFV | 30.79 | RGSAKLQWFV | 20.35 | RGSSKIRWIV | 3.69 | | |
| NS5 | 2558 | 1.76 | 12 | 4 | 0 | Y | GTAKLRWFVE | 44.32 | GSAKLRWFVE | 30.79 | GSAKLQWFVE | 20.35 | GSSKIRWIVE | 3.69 | | |
| NS5 | 2559 | 1.76 | 12 | 4 | 0 | Y | TAKLRWFVER | 44.32 | SAKLRWFVER | 30.79 | SAKLQWFVER | 20.35 | SSKIRWIVER | 3.69 | | |
| NS5 | 2560 | 0.99 | 8 | 3 | 0 | Y | AKLRWFVERN | 75.15 | SKIRWIVERG | 20.8 | | | | | | |
| NS5 | 2561 | 1.72 | 10 | 4 | 0 | Y | KLRWFVERNL | 46.83 | KLQWFVERNM | 28.21 | KLQWFVERNM | 20.8 | KIRWIVERGM | 3.8 | | |
| NS5 | 2562 | 1.75 | 12 | 4 | 0 | Y | LRWFVERNLV | 46.83 | LQWFVERNMV | 28.1 | LQWFVERNMV | 20.8 | IRWIVERGMV | 3.39 | | |
| NS5 | 2573 | 1.76 | 11 | 4 | 0 | Y | PEGKVIDLGC | 44.51 | PEGKVIDLGC | 30.01 | PEGRVIDLGC | 20.83 | PKGKVVDLGC | 3.72 | | |
| NS5 | 2574 | 1.77 | 12 | 4 | 0 | Y | EGKVIDLGCG | 44.51 | EGKVIDLGCG | 29.98 | EGRVIDLGCG | 20.83 | KGKVVDLGCG | 3.72 | | |
| NS5 | 2575 | 1.6 | 10 | 3 | 0 | Y | GKVIDLGCGR | 44.54 | GRVIDLGCGR | 33.7 | GKVIDLGCGR | 20.83 | | | | |
| NS5 | 2576 | 1.6 | 10 | 3 | 0 | Y | KVIDLGCGRG | 44.54 | RVIDLGCGRG | 33.7 | KVIDLGCGRG | 20.83 | | | | |
| NS5 | 2577 | 1 | 8 | 2 | 0 | Y | VIDLGCGRGG | 65.38 | VDLGCGRGG | 33.74 | | | | | | |
| NS5 | 2578 | 1 | 7 | 2 | 0 | Y | IDLGCGRGGW | 65.38 | VDLGCGRGGW | 33.78 | | | | | | |
| NS5 | 2579 | 0.01 | 4 | 1 | 0 | Y | DLGCGRGGWS | 99.89 | | | | | | | | |
| NS5 | 2580 | 0.01 | 4 | 1 | 0 | Y | LGCGRGGWSY | 99.89 | | | | | | | | |
| NS5 | 2581 | 0.02 | 5 | 1 | 0 | Y | GCGRGGWSYY | 99.85 | | | | | | | | |
| NS5 | 2582 | 0.25 | 7 | 2 | 0 | Y | CGRGGWSYYC | 96.05 | CGRGGWSYYM | 3.76 | | | | | | |
| NS5 | 2583 | 1.12 | 7 | 3 | 0 | Y | GRGGWSYYCA | 65.34 | GRGGWSYYCG | 30.75 | GRGGWSYYMA | 3.76 | | | | |
| NS5 | 2584 | 1.12 | 6 | 3 | 0 | Y | RGGWSYYCAG | 65.34 | RGGWSYYCGG | 30.79 | RGGWSYYMAT | 3.76 | | | | |
| NS5 | 2585 | 1.12 | 7 | 3 | 0 | Y | GGWSYYCAGL | 65.34 | GGWSYYCGGL | 30.75 | GGWSYYMATL | 3.76 | | | | |
| NS5 | 2586 | 1.14 | 10 | 3 | 0 | Y | GWSYYCAGLK | 65.3 | GWSYYCGGLK | 30.64 | GWSYYMATLK | 3.76 | | | | |
| NS5 | 2587 | 1.22 | 12 | 4 | 0 | Y | WSYYCAGLKK | 65.27 | WSYYCGGLKN | 29.46 | WSYYMATLKN | 3.76 | WSYYCGGLKD | 1 | | |
| NS5 | 2588 | 1.23 | 14 | 4 | 0 | Y | SYYCAGLKKV | 65.19 | SYYCGGLKNV | 29.46 | SYMMATLKNV | 3.76 | SYYCGGLKDV | 1 | | |
| NS5 | 2589 | 1.33 | 16 | 5 | 0 | Y | YYCAGLKKVT | 65.15 | YYCGGLKNVT | 27.62 | YYMATLKNVT | 3.76 | YYCGGLKNVK | 1.84 | YYCGGLKDVR | 1 |

FIG. 20-48

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2590 | 1.34 | 17 | 5 | 0 | Y | YCAGLKKVTE | 65.15 | YCGGLKNVRE | 27.58 | YMATLKNVTE | 3.76 | YCGGLKNVKE | 1.84 | YCGGLKDVRE | |
| NS5 | 2591 | 1.33 | 16 | 5 | 0.04 | Y | CAGLKKVTEV | 65.12 | CGGLKNVREV | 27.58 | MATLKNVTEV | 3.76 | CGGLKNVKEV | 1.88 | CGGLKDVREV | |
| NS5 | 2597 | 1.65 | 12 | 4 | 0.07 | Y | VTEVKGYTKG | 48.08 | VREVKGLTKG | 28.8 | VTEVRGYTKG | 20.76 | VKEVKGLTKG | 1.88 | | |
| NS5 | 2598 | 1.65 | 12 | 4 | 0.07 | Y | TEVKGYTKGG | 48.08 | REVKGLTKGG | 28.8 | TEVRGYTKGG | 20.76 | KEVKGLTKGG | 1.88 | | |
| NS5 | 2599 | 1.58 | 12 | 3 | 0.07 | Y | EVKGYTKGGP | 47.64 | EVKGLTKGGP | 30.68 | EVRGYTKGGP | 20.8 | | | | |
| NS5 | 2600 | 1.58 | 11 | 3 | 0.07 | Y | VKGYTKGGPG | 47.64 | VKGLTKGGPG | 30.72 | VRGYTKGGPG | 20.8 | | | | |
| NS5 | 2601 | 1.58 | 12 | 3 | 0.07 | Y | KGYTKGGPGH | 47.6 | KGLTKGGPGH | 30.72 | RGYTKGGPGH | 20.8 | | | | |
| NS5 | 2602 | 0.99 | 13 | 2 | 0.04 | Y | GYTKGGPGHE | 68.36 | GLTKGGPGHE | 30.72 | | | | | | |
| NS5 | 2603 | 1 | 16 | 2 | 0 | Y | YTKGGPGHEE | 68.29 | LTKGGPGHEE | 30.72 | | | | | | |
| NS5 | 2604 | 0.1 | 14 | 1 | 0 | Y | TKGGPGHEEP | 99.12 | | | | | | | | |
| NS5 | 2605 | 0.85 | 16 | 2 | 0 | Y | KGGPGHEEPI | 77.77 | KGGPGHEEPV | 21.31 | | | | | | |
| NS5 | 2606 | 0.85 | 17 | 2 | 0 | Y | GGPGHEEPIP | 77.77 | GGPGHEEPVP | 21.31 | | | | | | |
| NS5 | 2607 | 0.84 | 15 | 2 | 0 | Y | GPGHEEPIPM | 77.8 | GPGHEEPVPM | 21.35 | | | | | | |
| NS5 | 2608 | 1.62 | 17 | 4 | 0 | Y | PGHEEPIPMA | 47.31 | PGHEEPIPMS | 30.49 | PGHEEPVPMS | 21.09 | PGHEEPVPMA | 0.26 | | |
| NS5 | 2609 | 1.58 | 15 | 3 | 0 | Y | GHEEPIPMAT | 47.68 | GHEEPIPMST | 30.49 | GHEEPVPMST | 21.09 | | | | |
| NS5 | 2610 | 1.58 | 16 | 3 | 0 | Y | HEEPIPMATY | 47.68 | HEEPIPMSTY | 30.49 | HEEPVPMSTY | 21.05 | | | | |
| NS5 | 2611 | 1.58 | 15 | 3 | 0 | Y | EEPIPMATYG | 47.71 | EEPIPMSTYG | 30.49 | EEPVPMSTYG | 21.05 | | | | |
| NS5 | 2612 | 1.58 | 15 | 3 | 0 | Y | EPIPMATYGW | 47.71 | EPIPMSTYGW | 30.49 | EPVPMSTYGW | 21.05 | | | | |
| NS5 | 2613 | 1.57 | 15 | 3 | 0 | Y | PIPMATYGWN | 47.79 | PIPMSTYGWN | 30.49 | PVPMSTYGWN | 21.05 | | | | |
| NS5 | 2614 | 1.63 | 17 | 3 | 0 | Y | IPMATYGWNL | 47.79 | IPMSTYGWNL | 30.49 | VPMSTYGWNL | 20.13 | VPMSTYGWNI | 0.88 | | |
| NS5 | 2615 | 1.56 | 16 | 3 | 0 | Y | PMATYGWNLV | 48.05 | PMSTYGWNLV | 31.38 | PMSTYGWNIV | 20.02 | | | | |
| NS5 | 2616 | 1.62 | 17 | 4 | 0 | Y | MATYGWNLVK | 47.82 | MSTYGWNLVR | 30.83 | MSTYGWNIVK | 20.02 | MSTYGWNLVK | 0.59 | | |
| NS5 | 2617 | 1.61 | 16 | 4 | 0 | Y | ATYGWNLVKL | 47.86 | STYGWNLVRL | 30.83 | STYGWNIVKL | 20.02 | STYGWNLVKL | 0.59 | | |
| NS5 | 2618 | 1.78 | 21 | 5 | 0 | Y | TYGWNLVKLH | 45.13 | TYGWNLVRLQ | 30.83 | TYGWNIVKLM | 19.95 | TYGWNLVKLY | 2.58 | TYGWNLVKLM | 0.59 |

FIG. 20-49

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|

FIG. 20-50

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2659 | 1.67 | 15 | 4 | 0 | Y | GRTLRVLKMV | 48.19 | GRTLRVLNLV | 28.61 | SRTIRVLKMV | 20.61 | GRTLRVLSLV | 2.06 | | |
| NS5 | 2660 | 1.66 | 14 | 4 | 0 | Y | RTLRVLKMVE | 48.19 | RTLRVLNLVE | 28.58 | RTIRVLKMVE | 20.72 | RTLRVLSLVE | 2.06 | | |
| NS5 | 2661 | 1.66 | 14 | 4 | 0 | Y | TLRVLKMVEP | 48.19 | TLRVLNLVEN | 28.54 | TIRVLKMVEP | 20.72 | TLRVLSLVEN | 2.06 | | |
| NS5 | 2662 | 1.66 | 14 | 4 | 0 | Y | LRVLKMVEPW | 48.19 | LRVLNLVENW | 28.54 | LRVLKMVEPW | 20.72 | LRVLSLVENW | 2.06 | | |
| NS5 | 2663 | 1.05 | 12 | 3 | 0 | Y | RVLKMVEPWL | 68.95 | RVLNLVENWL | 28.54 | RVLSLVENWL | 2.06 | | | | |
| NS5 | 2677 | 1.35 | 6 | 4 | 0 | Y | QFCIKVLNPY | 48.78 | QFCIKILNPY | 44.73 | EFCIKVLNPY | 3.8 | QFCVKLNPY | 2.58 | | |
| NS5 | 2678 | 1.15 | 4 | 3 | 0 | Y | FCIKVLNPYM | 52.65 | FCIKILNPYM | 44.73 | FCVKVLNPYM | 2.58 | | | | |
| NS5 | 2679 | 1.15 | 5 | 3 | 0 | Y | CIKVLNPYMP | 52.62 | CIKILNPYMP | 44.73 | CVKVLNPYMP | 2.58 | | | | |
| NS5 | 2680 | 1.8 | 12 | 5 | 0 | Y | IKILNPYMPS | 44.36 | IKVLNPYMPS | 28.24 | IKVLNPYMPT | 22.82 | VKVLNPYMPS | 2.58 | IKVLNPYMPA | 1.29 |
| NS5 | 2681 | 1.68 | 11 | 4 | 0 | Y | KILNPYMPSV | 44.36 | KVLNPYMPSV | 30.83 | KVLNPYMPTV | 22.82 | KVLNPYMPAV | 1.29 | | |
| NS5 | 2682 | 1.71 | 14 | 5 | 0 | Y | ILNPYMPSVV | 44.36 | VLNPYMPSVI | 30.75 | VLNPYMPTVI | 22.49 | VLNPYMPAVI | 1.29 | VLNPYMPTV | 0.33 |
| NS5 | 2683 | 1.68 | 11 | 4 | 0 | Y | LNPYMPSVIE | 44.43 | LNPYMPSVIE | 30.75 | LNPYMPTVIE | 22.75 | LNPYMPAVIE | 1.29 | | |
| NS5 | 2701 | 1.46 | 14 | 5 | 0 | Y | HGGMLVRNPL | 60.29 | YGGALVRNPL | 30.09 | YGGMLVRNPL | 4.98 | HGGNLVRCPL | 3.1 | FGGALVRNPL | 0.59 |
| NS5 | 2702 | 1.16 | 11 | 3 | 0 | Y | GGMLVRNPLS | 65.23 | GGALVRNPLS | 30.79 | GGNLVRCPLS | 3.1 | | | | |
| NS5 | 2703 | 1.16 | 12 | 3 | 0 | Y | GMLVRNPLSR | 65.23 | GALVRNPLSR | 30.75 | GNLVRCPLSR | 3.1 | | | | |
| NS5 | 2704 | 1.16 | 12 | 3 | 0 | Y | MLVRNPLSRN | 65.23 | ALVRNPLSRN | 30.75 | NLVRCPLSRN | 3.1 | | | | |
| NS5 | 2705 | 0.27 | 9 | 2 | 0 | Y | LVRNPLSRNS | 95.98 | LVRCPLSRNS | 30.75 | | | | | | |
| NS5 | 2706 | 0.28 | 10 | 2 | 0 | Y | VRNPLSRNST | 95.83 | VRCPLSRNST | 3.69 | | | | | | |
| NS5 | 2707 | 0.28 | 9 | 2 | 0 | Y | RNPLSRNSTH | 95.83 | RCPLSRNSTH | 3.69 | | | | | | |
| NS5 | 2708 | 0.28 | 9 | 2 | 0 | Y | NPLSRNSTHE | 95.83 | CPLSRNSTHE | 3.8 | | | | | | |
| NS5 | 2709 | 0.03 | 6 | 1 | 0 | Y | PLSRNSTHEM | 99.71 | | | | | | | | |
| NS5 | 2710 | 0.05 | 8 | 1 | 0 | Y | LSRNSTHEMY | 99.59 | | | | | | | | |
| NS5 | 2711 | 0.05 | 8 | 1 | 0 | Y | SRNSTHEMYW | 99.59 | | | | | | | | |
| NS5 | 2712 | 0.78 | 10 | 2 | 0 | Y | RNSTHEMYWI | 78.83 | RNSTHEMYWI | 20.76 | | | | | | |

FIG. 20-51

Species: DENVall (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---

FIG. 20-52

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2755 | 1.28 | 9 | 4 | 0 | Y | DVDLGAGTRH | 62.72 | DVDLGSGTRN | 30.83 | DVDLGAGTRS | 3.69 | DVDLGTGTRH | 2.47 |
| NS5 | 2756 | 1.29 | 10 | 4 | 0 | Y | VDLGAGTRHV | 62.72 | VDLGSGTRNI | 30.75 | VDLGAGTRSV | 3.69 | VDLGTGTRHV | 2.47 |
| N

FIG. 20-53

Species: DENVall (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2808 | 1.74 | 14 | 4 | 0 | Y | SYEVKPSGSA | 44.21 | SYETKQTGSA | 30.75 | SYEV

FIG. 20-54

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2836 | 1.64 | 12 | 4 | 0.04 | Y | PMVTQJAMTD | 44.17 | PMVTQMAMTD | 40.71 | PMVTQMAMTD | 10.58 | | |
| NS5 | 2837 | 1.63 | 10 | 4 | 0.07 | Y | MVTQJAMTDT | 44.21 | MVTQMAMTDT | 40.71 | MVTQMAMTDT | 10.58 | | |
| NS5 | 2838 | 1.25 | 9 | 3 | 0.07 | Y | VTQMAMTDTT | 51.29 | VTQJAMTDTT | 44.21 | VTQJAMTDTT | 3.8 | | |
| NS5 | 2839 | 1.26 | 10 | 3 | 0.04 | Y | TQMAMTDTTP | 51.29 | TQJAMTDTTP | 44.21 | TQJAMTDTTP | 3.8 | | |
| NS5 | 2840 | 1.22 | 7 | 3 | 0.04 | Y | QMAMTDTTPF | 51.7 | QJAMTDTTPF | 44.25 | QJAMTDTTPF | 3.8 | | |
| NS5 | 2841 | 1.22 | 7 | 3 | 0.04 | Y | MAMTDTTPFG | 51.7 | IAMTDTTPFG | 44.25 | LAMTDTTPFG | 3.8 | | |
| NS5 | 2842 | 0.01 | 3 | 1 | 0.07 | Y | AMTDTTPFGQ | 99.85 | | | | | | |
| NS5 | 2843 | 0 | 2 | 1 | 0.07 | Y | MTDTTPFGQQ | 99.89 | | | | | | |
| NS5 | 2844 | 0 | 2 | 1 | 0.07 | Y | TDTTPFGQQR | 99.89 | | | | | | |
| NS5 | 2845 | 0 | 2 | 1 | 0.07 | Y | DTTPFGQQRV | 99.89 | | | | | | |
| NS5 | 2846 | 0.01 | 3 | 1 | 0.07 | Y | TTPFGQQRVF | 99.85 | | | | | | |
| NS5 | 2847 | 0.02 | 5 | 1 | 0.04 | Y | TPFGQQRVFK | 99.82 | | | | | | |
| NS5 | 2848 | 0.04 | 6 | 1 | 0.04 | Y | PFGQQRVFKE | 99.63 | | | | | | |
| NS5 | 2849 | 0.04 | 6 | 1 | 0.04 | Y | FGQQRVFKEK | 99.63 | | | | | | |
| NS5 | 2850 | 0.03 | 5 | 1 | 0.04 | Y | GQQRVFKEKV | 99.67 | | | | | | |
| NS5 | 2851 | 0.03 | 5 | 1 | 0.04 | Y | QQRVFKEKVD | 99.67 | | | | | | |
| NS5 | 2852 | 0.03 | 4 | 1 | 0 | Y | QRVFKEKVDT | 99.74 | | | | | | |
| NS5 | 2853 | 0.03 | 4 | 1 | 0 | Y | RVFKEKVDTR | 99.74 | | | | | | |
| NS5 | 2854 | 0.04 | 6 | 1 | 0 | Y | VFKEKVDTRI | 99.67 | | | | | | |
| NS5 | 2855 | 0.93 | 7 | 2 | 0 | Y | FKEKVDTRTP | 69.06 | FKEKVDTRTQ | 30.6 | | | | |
| NS5 | 2856 | 1.79 | 9 | 4 | 0 | Y | KEKVDTRTPK | 36.69 | KEKVDTRTQE | 30.53 | KEKVDTRTPR | 28.61 | KEKVDTRTPQ | 3.8 |
| NS5 | 2894 | 1.19 | 16 | 5 | 0 | Y | CTREEFIRKV | 70.54 | CTREEFIKKV | 23.89 | CTREEFISKV | 23.69 | CTRAEFCNKV | 3.69 | CTREEFIRKV | 0.41 |
| NS5 | 2895 | 1.18 | 15 | 5 | 0 | Y | TREEFTRKVR | 70.58 | TREEFTKKVR | 23.89 | TREEFISKVR | 23.89 | TRAEFCNKVR | 3.69 | TREEFIRKVR | 0.41 |
| NS5 | 2901 | 1.93 | 14 | 5 | 0 | Y | RKVRSNAAIG | 44.47 | KKVRSNAALG | 26.59 | KKVRTNAAMG | 20.65 | SKVRSNAAIG | 3.76 | KKVRSNAALG | 3.58 |

FIG. 20-55

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block | frequency | peptides required to cover 99% of block | frequency | peptides required to cover 99% of block | frequency | peptides required to cover 99% of block | frequency |
|---|---

FIG. 20-56

Species: DENVall (10-mers)

| protein | block starting position | block entropy | total peptides in block | # peptides required to cover 99% of block | gap/X fraction | 99% of block covered | w/ <= 5 peptides? | peptides required to cover 99% of block

FIG. 20-57

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2968 | 0.02 | 6 | 1 | 0 | Y | AKGS

FIG. 20-58

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2992 | 1.68 | 13 | 4 | 0 | Y | MNEDHWFSRE | 44.28 | LNEDHWFSRE | 37.13 | LNEDHWFSRG | 14.56 | LNEDHWFGRE | 3.47 | | |
| NS5 | 2993 | 0.86 | 10 | 3 | 0 | Y | NEDHWFSREN | 81.49 | NEDHWFSRGN | 14.56 | NEDHWFGREN | 3.47 | | | | |
| NS5 | 2994 | 0.86 | 10 | 3 | 0 | Y | EDHWFSRENS | 81.49 | EDHWFSRGNS | 14.56 | EDHWFGRENS | 3.47 | | | | |
| NS5 | 2995 | 1.64 | 14 | 5 | 0 | Y | DHWFSRENSL | 59.33 | DHWFSRENSY | 20.69 | DHWFSRGNSL | 20.69 | DHWFGRENSW | 3.47 | DHWFSRENSF | 1.14 |
| NS5 | 2996 | 1.64 | 14 | 5 | 0 | Y | HWFSRENSLS | 59.33 | HWFSRENSYS | 20.69 | HWFSRGNSLS | 20.69 | HWFGRENSWS | 3.47 | HWFSRENSFS | 1.14 |
| NS5 | 2997 | 1.64 | 14 | 5 | 0 | Y | WFSRENSLSG | 59.33 | WFSRENSYSG | 20.69 | WFSRGNSLSG | 20.69 | WFGRENSWSG | 3.47 | WFSRENSFSG | 1.14 |
| NS5 | 2998 | 1.65 | 15 | 5 | 0 | Y | FSRENSLSGV | 59.29 | FSRENSYSGV | 20.69 | FSRGNSLSGV | 20.69 | FGRENSWSGV | 3.47 | FSRENSFSGV | 1.14 |
| NS5 | 2999 | 1.64 | 14 | 5 | 0 | Y | SRENSLSGVE | 59.33 | SRENSYSGVE | 20.69 | SRGNSLSGVE | 20.69 | GRENSWSGVE | 3.47 | SRENSFSGVE | 1.14 |
| NS5 | 3000 | 1.62 | 13 | 5 | 0 | Y | RENSLSGVEG | 59.4 | RENSYSGVEG | 20.69 | RGNSLSGVEG | 20.69 | RENSWSGVEG | 3.76 | RENSFSGVEG | 1.14 |
| NS5 | 3001 | 1.62 | 14 | 5 | 0 | Y | ENSLSGVEGE | 59.4 | ENSYSGVEGE | 20.69 | GNSLSGVEGE | 20.69 | ENSWSGVEGE | 3.76 | ENSFSGVEGE | 1.11 |
| NS5 | 3002 | 1.07 | 11 | 4 | 0 | Y | NSLSGVEGEG | 74.12 | NSYSGVEGEG | 20.72 | NSWSGVEGEG | 20.65 | NSFSGVEGEG | 1.11 | | |
| NS5 | 3003 | 1.08 | 12 | 4 | 0 | Y | SLSGVEGEGL | 74.08 | SYSGVEGEGL | 20.72 | SWSGVEGEGL | 20.65 | SFSGVEGEGL | 1.11 | | |
| NS5 | 3004 | 1.1 | 14 | 4 | 0 | Y | LSGVEGEGLH | 73.89 | YSGVEGEGLH | 20.72 | WSGVEGEGLH | 20.65 | FSGVEGEGLH | 1.11 | | |
| NS5 | 3005 | 0.7 | 11 | 2 | 0 | Y | SGVEGEGLHR | 83.08 | SGVEGEGLHR | 16.41 | | | | | | |
| NS5 | 3006 | 0.7 | 11 | 2 | 0 | Y | GVEGEGLHKL | 83.08 | GVEGEGLHRL | 16.41 | | | | | | |
| NS5 | 3007 | 0.71 | 12 | 2 | 0 | Y | VEGEGLHRLG | 83.04 | VEGEGLHRLG | 16.41 | | | | | | |
| NS5 | 3008 | 0.7 | 11 | 2 | 0 | Y | EGEGLHKLGY | 83.08 | EGEGLHRLGY | 16.41 | | | | | | |
| NS5 | 3009 | 0.7 | 11 | 2 | 0 | Y | GEGLHKLGYI | 83.08 | GEGLHRLGYI | 16.41 | | | | | | |
| NS5 | 3010 | 0.7 | 10 | 2 | 0 | Y | EGLHKLGYIL | 83.11 | EGLHRLGYIL | 16.41 | | | | | | |
| NS5 | 3011 | 0.82 | 11 | 3 | 0 | Y | GLHKLGYILR | 83.19 | GLHRLGYILR | 12.57 | GLHRLGYILE | 3.8 | | | | |
| NS5 | 3027 | 1.28 | 11 | 4 | 0 | Y | GGAMYADDTA | 51.44 | GGNMYADDTA | 44.06 | GDLMYADDTA | 3.21 | GDLIYADDTA | 0.59 | | |
| NS5 | 3028 | 1.28 | 11 | 4 | 0 | Y | GAMYADDTAG | 51.44 | GNMYADDTAG | 44.06 | DLMYADDTAG | 3.21 | DLIYADDTAG | 0.59 | | |
| NS5 | 3029 | 1.28 | 11 | 4 | 0 | Y | AMYADDTAGW | 51.44 | NMYADDTAGW | 44.06 | LMYADDTAGW | 3.21 | LIYADDTAGW | 0.59 | | |
| NS5 | 3030 | 0.08 | 4 | 1 | 0 | Y | MYADDTAGWD | 99.15 | | | | | | | | |

FIG. 20-59

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3031 | 0 | 2 | 1 | 0 | Y | YADDTAGWDT | 99.

FIG. 20-60

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---

FIG. 20-61

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3164 | 1.05 | 5 | 4 | 0 | Y | SGDDCWKPI | 71.46 | SGDDCWKPL | 25.07 | SGDDCWKPT | 1.92 | SGDDCWKPV | 1.47 | | |
| NS5 | 3165 | 1.05 | 5 | 4 | 0 | Y | GDDCWKPID | 71.46 | GDDCWKPLD | 25.07 | GDDCWKPTD | 1.92 | GDDCWKPVD | 1.47 | DDCWKPVDD | 1.44 |
| NS5 | 3166 | 1.22 | 8 | 5 | 0 | Y | DDCWKPIDD | 71.46 | DDCWKPLDD | 21.2 | DDCWKPT

FIG. 20-62

Species: DENVall (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3206 | 1.13 | 7 | 3 | 0 | Y | WQQVPFCSHH | 65.15 | WTQVPFCSHH | 30.83 | WQEVPFCSHH | 3.8 | | | | |
| NS5 | 3207 | 1.13 | 7 | 3 | 0 | Y | QQVPFCSHHF | 65.15 | TQVPFCSHHF | 30.83 | QEVPFCSHHF | 3.8 | | | | |
| NS5 | 3208 | 0.26 | 6 | 2 | 0 | Y | QVPFCSHHFH | 95.98 | EVPFCSHHFH | 3.8 | | | | | | |
| NS5 | 3209 | 1.23 | 9 | 3 | 0 | Y | VPFCSHHFHE | 51.59 | VPFCSHHFHK | 44.32 | VPFCSHHFHK | 3.76 | | | | |
| NS5 | 3210 | 1.23 | 10 | 3 | 0 | Y | PFCSHHFHEL | 51.51 | PFCSHHFHKI | 44.36 | PFCSHHFHKI | 3.76 | | | | |
| NS5 | 3211 | 1.68 | 12 | 4 | 0 | Y | FCSHHFHQLI | 44.32 | FCSHHFHELI | 36.62 | FCSHHFHELV | 14.9 | FCSHHFHKIF | 3.72 | | |
| NS5 | 3212 | 1.68 | 11 | 4 | 0 | Y | CSHHFHQLIM | 44.36 | CSHHFHELIM | 36.62 | CSHHFHELVM | 14.9 | CSHHFHKIFM | 3.72 | | |
| NS5 | 3213 | 1.67 | 10 | 4 | 0 | Y | SHHFHQLIMK | 44.51 | SHHFHELIMK | 36.62 | SHHFHELVMK | 14.9 | SHHFHKIFMK | 3.72 | | |
| NS5 | 3214 | 1.67 | 10 | 4 | 0 | Y | HHFHQLIMKD | 44.51 | HHFHELIMKD | 36.62 | HHFHELVMKD | 14.9 | HHFHKIFMKD | 3.72 | | |
| NS5 | 3215 | 1.67 | 10 | 4 | 0 | Y | HFHQLIMKDG | 44.51 | HFHELIMKDG | 36.62 | HFHELVMKDG | 14.9 | HFHKIFMKDG | 3.72 | | |
| NS5 | 3216 | 1.67 | 10 | 4 | 0 | Y | FHQLIMKDGR | 44.51 | FHELIMKDGR | 36.62 | FHELVMKDGR | 14.9 | FHKIFMKDGR | 3.72 | | |
| NS5 | 3227 | 1.6 | 10 | 3 | 0 | Y | IWPCRNQDE | 44.36 | LWPCRNQDE | 34.03 | LWPCRPQDE | 20.76 | | | | |
| NS5 | 3228 | 0.81 | 8 | 2 | 0 | Y | VWPCRNQDE | 78.47 | VWPCRPQDEL | 20.76 | | | | | | |
| NS5 | 3229 | 1.59 | 11 | 3 | 0 | Y | VPCRNQDELV | 44.47 | VPCRNQDELI | 33.96 | VPCRPQDELI | 20.76 | | | | |
| NS5 | 3230 | 1.59 | 11 | 3 | 0 | Y | PCRNQDELVG | 44.47 | PCRNQDELIG | 34 | PCRPQDELIG | 20.76 | | | | |
| NS5 | 3231 | 1.59 | 11 | 3 | 0 | Y | CRNQDELVGR | 44.47 | CRNQDELIGR | 34 | CRPQDELIGR | 20.76 | | | | |
| NS5 | 3232 | 1.59 | 11 | 3 | 0 | Y | RNQDELVGRA | 44.47 | RNQDELIGRA | 34 | RPQDELIGRA | 20.76 | | | | |
| NS5 | 3233 | 1.59 | 10 | 3 | 0 | Y | NQDELVGRAR | 44.47 | NQDELIGRAR | 34 | PQDELIGRAR | 20.76 | | | | |
| NS5 | 3234 | 1.03 | 8 | 2 | 0 | Y | QDELIGRARI | 55.24 | QDELVGRARV | 44.47 | | | | | | |
| NS5 | 3235 | 1.02 | 8 | 2 | 0 | Y | DELIGRARIS | 55.27 | DELVGRARVS | 44.51 | | | | | | |
| NS5 | 3236 | 1.02 | 7 | 2 | 0 | Y | ELIGRARISQ | 55.27 | ELVGRARVSQ | 44.51 | | | | | | |
| NS5 | 3237 | 1.02 | 9 | 2 | 0 | Y | LIGRARISQG | 55.27 | LVGRARVSQG | 44.51 | | | | | | |
| NS5 | 3238 | 1.03 | 8 | 2 | 0 | Y | IGRARISQGA | 55.16 | VGRARVSQGA | 44.51 | | | | | | |
| NS5 | 3239 | 1.02 | 8 | 2 | 0 | Y | GRARISQGAG | 55.2 | GRARVSQGAG | 44.51 | | | | | | |

FIG. 20-63

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---

FIG. 20-64

Species: DENVall (10-mers)

| protein | block starting position | block entropy | total peptides in block | # peptides required to cover 99% of block | gap/X fraction | 99% of block

FIG. 20-65

Species: DENVall (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|

FIG. 20-66

Species: DENVall (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3347 | 0.26 | 6 | 2 | 0 | Y | DQWCGSLIGL | 95.94 | DLWCGSLIGL | 3.8 | | | | | | |
| NS5 | 3348 | 0.27 | 8 | 2 | 0 | Y | QWCGSLIGLT | 95.91 | LWCGSLIGLS | 3.76 | | | | | | |
| NS5 | 3349 | 1.23 | 9 | 3 | 0 | Y | WCGSLIGLTS | 51.44 | WCGSLIGLTA | 44.47 | WCGSLIGLSS | 3.76 | | | | |
| NS5 | 3350 | 1.23 | 9 | 3 | 0 | Y | CGSLIGLTSR | 51.44 | CGSLIGLTAR | 44.47 | CGSLIGLSSR | 3.76 | | | | |
| NS5 | 3351 | 1.23 | 11 | 3 | 0 | Y | GSLIGLTSRA | 51.36 | GSLIGLTARA | 44.47 | GSLIGLSSRA | 3.76 | | | | |
| NS5 | 3352 | 1.23 | 11 | 3 | 0 | Y | SLIGLTSRAT | 51.36 | SLIGLTARAT | 44.47 | SLIGLSSRAT | 3.76 | | | | |
| NS5 | 3353 | 1.23 | 9 | 3 | 0 | Y | LIGLTSRATW | 51.36 | LIGLTARATW | 44.47 | LIGLSSRATW | 3.76 | | | | |
| NS5 | 3354 | 1.22 | 9 | 3 | 0 | Y | IGLTSRATWA | 51.55 | IGLTARATWA | 44.47 | IGLSSRATWA | 3.76 | | | | |
| NS5 | 3355 | 1.96 | 12 | 5 | 0 | Y | GLTARATWAT | 39.45 | GLTSRATWAK | 30.64 | GLTSRATWAQ | 20.72 | GLTARATWAS | 5.01 | GLSSRATWAK | 3.76 |
| NS5 | 3356 | 1.96 | 13 | 5 | 0 | Y | LTARATWATN | 39.42 | LTSRATWAKN | 30.64 | LTSRATWAQN | 20.72 | LTARATWASN | 5.01 | LSSRATWAKN | 3.76 |
| NS5 | 3357 | 1.97 | 13 | 5 | 0 | Y | TARATWATNI | 39.27 | TSRATWAKNI | 30.64 | TSRATWAQNI | 20.76 | TARATWASNI | 5.01 | SSRATWAKNI | 3.76 |
| NS5 | 3384 | 1.31 | 14 | 5 | 0 | Y | DYMPSMKRFR | 51.55 | DYMTSMKRFK | 43.66 | DYMPVMKRYS | 3.43 | DYMISMKRFK | 0.33 | DYMPAMKRYS | 0.29 |

FIG. 21-1

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 11 | 1.74 | 10 | 4 | 0 | Y | PSFNMLKRARN | 44.36 | TPFNMLKRERN | 30.64 | | | PPFNMLKRERN | 3.72 | | |
| anC | 12 | 1.55 | 7 | 3 | 0 | Y | SFNMLKRARNR | 44.36 | PFNMLKRERNR | 34.55 | SINMLKRVRNR | 20.76 | | |
| anC | 13 | 1.55 | 5 | 3 | 0 | Y | FNMLKRARNRV | 44.36 | FNMLKRERNRV | 34.62 | INMLKRVRNRV | 20.76 | | |
| anC | 14 | 1.53 | 4 | 3 | 0 | Y | NMLKRARNRVS | 44.40 | NMLKRERNRVS | 34.62 | NMLKRVRNRVS | 20.76 | | |
| anC | 15 | 1.53 | 5 | 3 | 0 | Y | MLKRARNRVST | 44.40 | MLKRERNRVST | 34.59 | MLKRVRNRVST | 20.94 | | |
| anC | 20 | 1.85 | 16 | 5 | 0 | Y | RNRVSTVSQLA | 35.25 | RNRVSTVQQLT | 30.20 | RNRVSTGSQLA | 29.72 | RNRVSTPQGLV | 3.69 | RNRVSTIQQLT | 0.55 |
| anC | 21 | 1.86 | 17 | 5 | 0 | Y | NRVSTVSQLAK | 35.21 | NRVSTVQQLTK | 30.20 | NRVSTGSQLAK | 29.72 | NRVSTPQGLVK | 3.69 | NRVSTIQQLTK | 0.55 |
| anC | 22 | 1.86 | 18 | 5 | 0 | Y | RVSTVSQLAKR | 35.18 | RVSTVQQLTKR | 30.20 | RVSTGSQLAKR | 29.72 | RVSTPQGLVKR | 3.69 | RVSTIQQLTKR | 0.55 |
| anC | 23 | 1.86 | 18 | 5 | 0 | Y | VSTVSQLAKRF | 35.18 | VSTVQQLTKRF | 30.20 | VSTGSQLAKRF | 29.72 | VSTPQGLVKRF | 3.69 | VSTIQQLTKRF | 0.55 |
| anC | 24 | 1.86 | 18 | 5 | 0 | Y | STVSQLAKRFS | 35.18 | STVQQLTKRFS | 30.20 | STGSQLAKRFS | 29.72 | STPQGLVKRFS | 3.69 | STIQQLTKRFS | 0.55 |
| anC | 27 | 1.53 | 17 | 4 | 0 | Y | SQLAKRFSKGL | 57.34 | QQLTKRFSLGM | 30.79 | SQLAKRFSRGL | 7.37 | QGLVKRFSTGL | 3.47 | SQLAKRFSKEL | 0.26 |
| anC | 28 | 1.51 | 14 | 4 | 0 | Y | QLAKRFSKGLL | 57.45 | QLTKRFSLGML | 30.83 | QLAKRFSRGLL | 7.49 | GLVKRFSTGLF | 3.47 | | |
| anC | 29 | 1.96 | 18 | 5 | 0 | Y | LAKRFSKGLLS | 44.28 | LTKRFSLGMLQ | 30.83 | LAKRFSRGLLN | 13.09 | LAKRFSRGLLN | 7.45 | LVKRFSTGLFS | 3.47 |
| anC | 30 | 1.96 | 18 | 5 | 0 | Y | AKRFSKGLLSG | 44.28 | TKRFSLGMLQG | 30.83 | AKRFSKGLLNG | 13.09 | AKRFSRGLLNG | 7.45 | VKRFSTGLFSG | 3.47 |
| anC | 31 | 1.96 | 19 | 5 | 0 | Y | KRFSKGLLSGQ | 44.32 | KRFSLGMLQGR | 30.68 | KRFSKGLLNGQ | 13.09 | KRFSRGLLNGQ | 7.45 | KRFSTGLFSGK | 3.47 |
| anC | 32 | 1.97 | 18 | 5 | 0 | Y | RFSKGLLSGQG | 44.36 | RFSLGMLQGRG | 30.68 | RFSKGLLNGQG | 13.09 | RESRGLLNGQG | 7.45 | RFSTGLFSGKG | 3.47 |
| anC | 33 | 1.97 | 17 | 5 | 0 | Y | FSKGLLSGQGP | 44.40 | FSLGMLQGRGP | 30.68 | FSKGLLNGQGP | 13.09 | FSRGLLNGQGP | 7.45 | FSTGLFSGKGP | 3.47 |
| anC | 46 | 1.28 | 16 | 3 | 0 | Y | LVMAFIAFLRF | 63.97 | LFMALVAFLRF | 30.31 | MVLAFITFLRV | 3.72 | MYMAFIAFLRF | 0.85 | FVMAFIAFLRF | 0.29 |
| anC | 47 | 1.19 | 14 | 3 | 0 | Y | VMAFIAFLRFL | 65.12 | FMALVAFLRFL | 30.31 | VLAFITFLRVL | 3.72 | | | | |
| anC | 48 | 1.18 | 13 | 3 | 0 | Y | MAFIAFLRFLA | 65.12 | MALVAFLRFLT | 30.38 | LAFITFLRVLS | 3.72 | | | | |
| anC | 49 | 1.18 | 13 | 3 | 0 | Y | AFIAFLRFLAI | 65.12 | ALVAFLRFLTI | 30.38 | AFITFLRVLSI | 3.72 | | | | |
| anC | 50 | 1.18 | 14 | 3 | 0 | Y | FIAFLRFLAIP | 65.12 | LVAFLRFLTIP | 30.35 | FITFLRVLSIP | 3.72 | | | | |
| anC | 51 | 1.15 | 12 | 3 | 0 | Y | IAFLRFLAIPP | 65.15 | VAFLRFLTIPP | 30.64 | ITFLRVLSIPP | 3.72 | | | | |
| anC | 52 | 1.14 | 10 | 3 | 0 | Y | AFLRFLAIPPT | 65.27 | AFLRFLTIPPT | 30.64 | TFLRVLSIPPT | 3.72 | | | | |
| anC | 53 | 1.16 | 11 | 3 | 0 | Y | FLRFLAIPPTA | 65.27 | FLRFLTIPPTA | 30.42 | FLRVLSIPPTA | 3.72 | | | | |

FIG. 21-2

ENVall (11-mers)

| protein | block start position | block entropy | total peptides in block | # peptides required to cover 99% of block | gap/X fraction | 99% of block covered w/ =>5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 54 | 1.15 | 9 | 3 | 0 | Y | LRFLAIPPTAG | 65.34 | LRFLTIPPTAG | 30.46 | LRVLSIPPTAG | 3.72 | | |
| anC | 55 | 1.72 | 9 | 4 | 0 | Y | RFLAIPPTAGI | 45.87 | RFLTIPPTAGI | 30.49 | RFLAIPPTAGV | 19.47 | RVLSIPPTAGI | 3.72 |
| anC | 56 | 1.73 | 9 | 4 | 0 | Y | FLAIPPTAGIL | 45.72 | FLTIPPTAGIL | 30.49 | FLAIPPTAGVL | 19.47 | VLSIPPTAGIL | 3.72 |
| anC | 57 | 1.74 | 11 | 4 | 0 | Y | LAIPPTAGILA | 45.69 | LTIPPTAGILK | 30.46 | LAIPPTAGVLA | 19.47 | LSIPPTAGILK | 3.72 |
| anC | 58 | 1.74 | 11 | 4 | 0 | Y | AIPPTAGILAR | 45.69 | TIPPTAGILKR | 30.46 | AIPPTAGVLAR | 19.47 | SIPPTAGILKR | 3.72 |
| anC | 59 | 1.57 | 10 | 3 | 0 | Y | IPPTAGILARW | 45.69 | IPPTAGILKRW | 34.18 | IPPTAGVLARW | 19.47 | | |
| anC | 60 | 1.9 | 10 | 4 | 0 | Y | PPTAGILARWG | 36.47 | PPTAGILKRWG | 34.22 | PPTAGVLARWG | 19.47 | PPTAGILARWS | 9.22 |
| anC | 114 | 1.79 | 10 | 5 | 0 | Y | AFHLTRGGEP | 43.69 | AFHLTRNGEP | 30.79 | AFHLTSRDGEP | 20.83 | AFHLTSRDGEP | 3.36 |
| pfM | 115 | 1.74 | 10 | 4 | 0 | Y | FHLTRGGEPH | 44.40 | FHLTRNGEPH | 30.83 | FHLTSRDGEPR | 20.72 | FHLTSRDGEPL | 3.36 |
| pfM | 116 | 1.74 | 10 | 4 | 0 | Y | HLTRGGEPHM | 44.40 | HLTRNGEPHM | 30.83 | HLTSRDGEPRM | 20.72 | HLSTRDGEPLM | 3.36 |
| pfM | 117 | 1.77 | 12 | 4 | 0 | Y | LTRGGEPHMI | 43.88 | LTRNGEPHMI | 30.79 | LTSRDGEPRMI | 20.72 | LSTRDGEPLMI | 3.69 |
| pfM | 118 | 1.78 | 13 | 4 | 0 | Y | TRGGEPHMIV | 43.84 | TRNGEPHMIV | 30.79 | TSRDGEPRMIV | 20.72 | STRDGEPLMIV | 3.69 |
| pfM | 131 | 1.78 | 14 | 4 | 0 | Y | QERGKSLLFKT | 44.32 | QEKGKSLLFKT | 30.31 | NERGKSLLFKT | 20.65 | HERGRPLLFKT | 3.72 |
| pfM | 132 | 1.81 | 15 | 5 | 0 | Y | ERGKSLLFKTS | 44.21 | EKGKSLLFKTE | 30.01 | ERGKSLLFKTA | 20.65 | ERGRPLLFKTT | 3.72 | EKGKSLLFKTK | 0.74 |
| pfM | 146 | 1.45 | 10 | 4 | 0 | Y | NMCTLMAIDLG | 65.15 | NMCTLMAIDLG | 16.45 | NMCTLMAMDLG | 14.27 | NKCTLIAMDLG | 3.69 |
| pfM | 147 | 1.45 | 10 | 4 | 0 | Y | MCTLMAIDLGE | 65.15 | MCTLMAIDLGE | 16.45 | MCTLMAMDLGE | 14.27 | KCTLIAMDLGE | 3.69 |
| pfM | 148 | 2.19 | 12 | 5 | 0 | Y | CTLMADLGEL | 36.69 | CTLMAIDLGEM | 24.52 | CTLMAIDLGEL | 16.45 | CTLMAMDLGEL | 14.27 | CTLIAMDLGEF | 7.63 |
| pfM | 149 | 2.19 | 12 | 5 | 0 | Y | TLIAMDLGELC | 36.69 | TLIAMDLGEMC | 24.52 | TLMAIDLGELC | 16.45 | TLMAMDLGELC | 14.27 | TLIAMDLGEFC | 7.63 |
| pfM | 152 | 1.93 | 13 | 5 | 0 | Y | AMDLGELCEDT | 50.44 | AMDLGEMCDDT | 20.83 | AIDLGELCEDT | 16.41 | AMDLGEFCEDT | 7.74 | AMDLGEMCEDT | 3.69 |
| pfM | 174 | 1.65 | 14 | 4 | 0 | Y | EPDDVDCWCNA | 43.33 | EPEDIDCWCNS | 30.75 | EPEDIDCWCNL | 24.45 | EPDDVDCWCNT | 1.14 |
| pfM | 175 | 1.65 | 15 | 4 | 0 | Y | PDDVDCWCNAT | 43.33 | PEDIDCWCNST | 30.75 | PEDIDCWCNLT | 24.45 | PDDVDCWCNTT | 1.14 |
| pfM | 176 | 1.75 | 13 | 5 | 0 | Y | DDVDCWCNATD | 41.92 | DDVDCWCNSTS | 30.75 | EDIDCWCNLTS | 24.41 | DDVDCWCNATE | 1.4 | DDVDCWCNTTD | 1.14 |
| pfM | 177 | 1.79 | 16 | 5 | 0 | Y | DVDCWCNATDT | 41.81 | DIDCWCNSTST | 30.72 | DIDCWCNLTST | 24.08 | DVDCWCNATET | 1.4 | DVDCWCNTTDT | 1.14 |
| pfM | 178 | 1.79 | 16 | 5 | 0 | Y | VDCWCNATDTW | 41.81 | IDCWCNSTSTW | 30.72 | IDCWCNLTSTW | 24.08 | VDCWCNATETW | 1.4 | VDCWCNTTDTW | 1.14 |
| pfM | 198 | 1.29 | 14 | 4 | 0 | Y | GEHRRDKRSVA | 61.69 | GEHRREKRSVA | 32.37 | GERRREKRSVA | 3.76 | GERRRDKRSVA | 1.66 |

FIG. 21-3

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 199 | 1.29 | 14 | 4 | 0 | Y | EHRRDKRSVAL | 61.69 | EHRREKRSVAL | 32.37 | EHRREKRSVAL | 3.76 | ERRDKRSVAL | 1.66 | RRRDKRSVALA | 1.66 |
| prM | 200 | 1.37 | 13 | 5 | 0 | Y | HRRDKRSVALA | 61.80 | HRREKRSVALV | 30.68 | HRREKRSVALT | 3.69 | HRREKRSVALA | 1.84 | | |
| prM | 201 | 1.25 | 9 | 4 | 0 | Y | RRDKRSVALAP | 63.46 | RREKRSVALTP | 30.72 | RREKRSVALTP | 3.69 | RREKRSVALAP | 1.88 | | |
| prM | 202 | 1.25 | 10 | 4 | 0 | Y | RDKRSVALAPH | 63.42 | REKRSVALTPH | 30.72 | REKRSVALTPH | 3.69 | REKRSVALAPH | 1.88 | | |
| prM | 203 | 1.26 | 12 | 4 | 0 | Y | DKRSVALAPHV | 63.38 | EKRSVALTPHS | 30.72 | EKRSVALTPHS | 3.69 | EKRSVALAPHV | 1.84 | | |
| prM | 204 | 1.15 | 10 | 3 | 0 | Y | KRSVALAPHVG | 65.27 | KRSVALTPHSG | 30.57 | KRSVALTPHSG | 3.69 | | | | |
| prM | 205 | 1.73 | 10 | 4 | 0 | Y | RSVALAPHVGL | 44.36 | RSVALAPHVGM | 30.57 | RSVALAPHVGM | 20.98 | RSVALTPHSGM | 3.69 | | |
| prM | 206 | 1.73 | 10 | 4 | 0 | Y | SVALAPHVGLG | 44.36 | SVALTPHVGMG | 30.57 | SVALAPHVGMG | 20.98 | SVALTPHSGMG | 3.69 | | |
| prM | 207 | 1.73 | 10 | 4 | 0 | Y | VALAPHVGLGL | 44.36 | VALVPHVGMGL | 30.57 | VALAPHVGMGL | 20.98 | VALTPHSGMGL | 3.69 | | |
| prM | 208 | 1.74 | 11 | 4 | 0 | Y | ALAPHVGLGLE | 44.40 | ALVPHVGMGLE | 30.57 | ALAPHVGMGLD | 20.8 | ALTPHSGMGLE | 3.69 | | |
| prM | 209 | 1.74 | 11 | 4 | 0 | Y | LAPHVGLGLET | 44.40 | LVPHVGMGLET | 30.57 | LAPHVGMGLDT | 20.8 | LTPHSGMGLET | 3.69 | | |
| prM | 210 | 1.74 | 11 | 4 | 0 | Y | APHVGLGLETR | 44.40 | VPHVGMGLETR | 30.57 | APHVGMGLDTR | 20.8 | TPHSGMGLETR | 3.69 | | |
| prM | 216 | 1.11 | 7 | 4 | 0 | Y | GLETRTETWMS | 73.41 | GLDTRTQTWMS | 19.62 | GLETRAETWMS | 5.72 | GLDTRAQTWMS | 1.14 | | |
| prM | 217 | 1.12 | 8 | 4 | 0 | Y | LETRTETWMSS | 73.41 | LDTRTQTWMSA | 19.54 | LETRAETWMSS | 5.72 | LDTRAQTWMSA | 1.14 | | |
| prM | 218 | 1.13 | 9 | 4 | 0 | Y | ETRTETWMSSE | 73.34 | DTRTQTWMSAE | 19.54 | ETRAETWMSSE | 5.72 | DTRAQTWMSAE | 1.14 | | |
| prM | 219 | 1.14 | 10 | 4 | 0 | Y | TRTETWMSSEG | 73.23 | TRTQTWMSAEG | 19.58 | TRAETWMSSEG | 5.72 | TRAQTWMSAEG | 1.14 | | |
| prM | 220 | 1.14 | 10 | 4 | 0 | Y | RTETWMSSEGA | 73.23 | RTQTWMSAEGA | 19.58 | RAETWMSSEGA | 5.72 | RAQTWMSAEGA | 1.14 | | |
| prM | 221 | 1.14 | 10 | 4 | 0 | Y | TETWMSSEGAW | 73.23 | TQTWMSAEGAW | 19.58 | AETWMSSEGAW | 5.72 | AQTWMSAEGAW | 1.14 | | |
| prM | 222 | 0.85 | 10 | 3 | 0 | Y | ETWMSSEGAWK | 78.10 | QTWMSSEGAWR | 20.72 | ETWMSSEGAWR | 0.81 | | | | |
| prM | 223 | 1.62 | 12 | 4 | 0 | Y | TWMSEGAWKQ | 44.17 | TWMSSEGAWKH | 33.92 | TWMSSEGAWRQ | 20.69 | TWMSSEGAWRQ | 0.81 | | |
| prM | 237 | 1.38 | 12 | 5 | 0 | Y | VETWALRHPGF | 62.91 | IETWILRHPGF | 29.28 | VESWILRNPGF | 3.69 | VETWAFRHPGF | 2.03 | IETWVLRHPGF | 1.51 |
| prM | 238 | 1.41 | 15 | 5 | 0 | Y | ETWALRHPGFT | 62.83 | ETWILRHPGFT | 28.76 | ESWILRNPGFA | 3.69 | ETWAFRHPGFT | 2.03 | ETWVLRHPGFT | 1.84 |
| E | 281 | 2.01 | 13 | 5 | 0 | Y | MRCVGIGSRDF | 32.82 | MRCIGISNRDF | 29.98 | MRCVGIGNRDF | 24.45 | MRCVGIGNRDF | 11.62 | MRCIGMSNRDF | 0.63 |
| E | 282 | 2 | 12 | 5 | 0 | Y | RCVGIGSRDFV | 32.82 | RCIGISNRDFV | 30.01 | RCVGIGNRDFV | 24.45 | RCVGIGNRDFV | 11.62 | RCIGMSNRDFV | 0.63 |
| E | 283 | 2 | 12 | 5 | 0 | Y | CVGIGSRDFVE | 32.82 | CIGISNRDFVE | 30.01 | CVGIGNRDFVE | 24.45 | CVGIGNRDFVE | 11.62 | CIGMSNRDFVE | 0.63 |

FIG. 21-4

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 284 | 2 | 12 | 5 | 0 | Y | VGIGSRDFVEG | 32.82 | IGISNRDFVEG | 30.01 | VGIGNRDFVEG | 24.45 | VGIGNRDFVEG | 0.63 |
| E | 287 | 1.77 | 7 | 4 | 0 | Y | GSRDFVEGLSG | 32.85 | GNRDFVEGLSG | 32.41 | SNRDFVEGVSG | 30.9 | GNRDFVEGVSG | |
| E | 288 | 1.59 | 5 | 3 | 0 | Y | NRDFVEGVSGG | 34.62 | SRDFVEGLSGA | 32.89 | NRDFVEGLSGA | 32.41 | | |
| E | 289 | 1.12 | 7 | 3 | 0 | Y | RDFVEGLSGAT | 65.30 | RDFVEGVSGGS | 30.90 | RDFVEGVSGGA | 3.65 | | |
| E | 290 | 1.12 | 7 | 3 | 0 | Y | DFVEGLSGATW | 65.30 | DFVEGVSGGSW | 30.90 | DFVEGVSGGAW | 3.65 | | |
| E | 291 | 1.13 | 7 | 3 | 0 | Y | FVEGLSGATWV | 65.19 | FVEGVSGGSWV | 30.90 | FVEGVSGGAWV | 3.65 | | |
| E | 292 | 1.13 | 7 | 3 | 0 | Y | VEGLSGATWVD | 65.19 | VEGVSGGSWVD | 30.90 | VEGVSGGAWVD | 3.65 | | |
| E | 293 | 1.13 | 7 | 3 | 0 | Y | EGLSGATWVDV | 65.19 | EGVSGGSWVDI | 30.90 | EGVSGGAWVDL | 3.65 | | |
| E | 294 | 1.13 | 7 | 3 | 0 | Y | GLSGATWVDVV | 65.19 | GVSGGSWVDIV | 30.90 | GVSGGAWVDLV | 3.65 | | |
| E | 295 | 1.13 | 7 | 3 | 0 | Y | LSGATWVDVVL | 65.19 | VSGGSWVDIVL | 30.90 | VSGGAWVDLVL | 3.65 | | |
| E | 296 | 1.12 | 7 | 3 | 0 | Y | SGATWVDVVLE | 65.23 | SGGSWVDIVLE | 30.90 | SGGAWVDLVLE | 3.65 | | |
| E | 297 | 1.12 | 6 | 3 | 0 | Y | GATWVDVVLEH | 65.23 | GGSWVDIVLEH | 30.90 | GGAWVDLVLEH | 3.65 | | |
| E | 298 | 1.12 | 6 | 3 | 0 | Y | ATWVDVVLEHG | 65.23 | GSWVDIVLEHG | 30.90 | GAWVDLVLEHG | 3.65 | | |
| E | 299 | 1.71 | 8 | 4 | 0 | Y | TWVDVVLEHGS | 44.47 | SWVDIVLEHGS | 30.90 | TWVDVVLEHGG | 20.76 | AWVDLVLEHGG | 3.65 |
| E | 300 | 1.71 | 6 | 4 | 0 | Y | WVDVVLEHGSC | 44.47 | WVDIVLEHGSC | 30.90 | WVDVVLEHGGC | 20.76 | WVDLVLEHGGC | 3.72 |
| E | 301 | 1.71 | 7 | 4 | 0 | Y | VDVVLEHGSCV | 44.40 | VDIVLEHGSCV | 30.90 | VDVVLEHGGCV | 20.76 | VDLVLEHGGCV | 3.72 |
| E | 302 | 1.71 | 5 | 4 | 0 | Y | DVVLEHGSCVT | 44.40 | DIVLEHGSCVT | 30.90 | DVVLEHGGCVT | 20.83 | DLVLEHGGCVT | 3.72 |
| E | 303 | 1.71 | 7 | 4 | 0 | Y | VVLEHGSCVTT | 44.32 | IVLEHGSCVTT | 30.90 | VVLEHGGCVTT | 20.83 | LVLEHGGCVTT | 3.72 |
| E | 304 | 0.84 | 7 | 2 | 0 | Y | VLEHGSCVTTM | 75.15 | VLEHGGCVTTM | 24.52 | | | | |
| E | 305 | 0.85 | 8 | 2 | 0 | Y | LEHGSCVTTMA | 75.15 | LEHGGCVTTMA | 24.48 | | | | |
| E | 306 | 1.02 | 11 | 3 | 0 | Y | EHGSCVTTMAK | 75.04 | EHGGCVTTMAK | 20.65 | EHGGCVTTMAQ | 3.72 | | |
| E | 307 | 1.86 | 15 | 5 | 0 | Y | HGSCVTTMAKN | 39.38 | HGGCVTTMAKD | 35.62 | HGGCVTTMAKN | 18.88 | HGGCVTTMAQG | 3.72 | HGGCVTTMAKS | 1.77 |
| E | 308 | 1.86 | 15 | 5 | 0 | Y | GSCVTTMAKNK | 39.38 | GGCVTTMAKDK | 35.62 | GGCVTTMAKNK | 18.88 | GGCVTTMAQGK | 3.72 | GGCVTTMAKSK | 1.77 |
| E | 309 | 1.86 | 15 | 5 | 0 | Y | SCVTTMAKNKP | 39.38 | GCVTTMAKDKP | 35.62 | GCVTTMAKNKP | 18.88 | GCVTTMAQGKP | 3.72 | GCVTTMAKSKP | 1.77 |
| E | 310 | 1.33 | 13 | 4 | 0 | Y | CVTTMAKNKPT | 58.26 | CVTTMAKDKPT | 35.62 | CVTTMAQGKPT | 3.72 | CVTTMAKSKPT | 1.77 | | |

FIG. 21-5

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 311 | 1.33 | 13 | 4 | 0 | Y | VTTMAKNKPTL | 58.26 | VTTMAKDKPTL | 35.62 | VTTMAQGKPTL | 3.72 | | |
| E | 312 | 1.31 | 13 | 4 | 0 | Y | TTMAKNKPTLD | 58.26 | TTMAKDKPTLD | 35.77 | TTMAQGKPTLD | 3.72 | | |
| E | 313 | 1.9 | 12 | 4 | 0 | Y | TMAKDKPTLDI | 35.77 | TMAKDKPTLDF | 30.79 | TMAKNKPTLDI | 27.43 | TMAKSKPTLDI | 1.77 |
| E | 314 | 1.9 | 15 | 5 | 0 | Y | MAKDKPTLDFE | 35.73 | MAKDKPTLDIE | 30.79 | MAKNKPTLDIE | 27.43 | MAKSKPTLDIE | 1.77 |
| E | 315 | 1.89 | 15 | 5 | 0 | Y | AKDKPTLDIEL | 35.80 | AKNKPTLDIEL | 30.79 | MAQGKPTLDFE | 27.47 | AKSKPTLDIEL | 1.77 |
| E | 318 | 1.72 | 13 | 4 | 0 | Y | KPTLDIELLKT | 44.40 | KPTLDFELIKT | 30.79 | KPTLDIELQKT | 20.83 | | |
| E | 319 | 1.76 | 11 | 4 | 0 | Y | PTLDIELLKTE | 44.40 | PTLDFELIKTE | 30.46 | PTLDIELQKTE | 20.83 | | |
| E | 320 | 1.76 | 13 | 4 | 0 | Y | TLDIELLKTEV | 44.40 | TLDFELIKTEA | 30.46 | TLDIELQKTEA | 20.83 | | |
| E | 321 | 1.79 | 13 | 4 | 0 | Y | LDIELLKTEYT | 44.21 | LDFELIKTEAK | 30.38 | LDIELQKTEAT | 20.83 | LDFELIKTTAK | 0.33 |
| E | 349 | 1.21 | 17 | 5 | 0 | Y | TTDSRCPTQGE | 66.41 | TTESRCPTQGE | 27.80 | TTATRCPTQGE | 3.72 | | |
| E | 350 | 1.29 | 9 | 4 | 0 | Y | TDSRCPTQGEA | 65.27 | TESRCPTQGEP | 27.84 | TATRCPTQGEP | 3.72 | TDSRCPTQGEP | 1.18 |
| E | 372 | 1.81 | 8 | 5 | 0 | Y | CRRTFVDRGWG | 44.06 | CKHSMVDRGWG | 30.13 | CKHTYVDRGWG | 20.8 | CRHSMVDRGWG | 0.55 |
| E | 373 | 1.81 | 12 | 5 | 0 | Y | RRTFVDRGWGN | 44.06 | KHSMVDRGWGN | 30.13 | KHTYVDRGWGN | 20.8 | RHSMVDRGWGN | 0.55 |
| E | 374 | 1.76 | 10 | 4 | 0 | Y | RTFVDRGWGNG | 44.06 | HSMVDRGWGNG | 30.68 | HTYVDRGWGNG | 20.83 | | |
| E | 375 | 1.76 | 6 | 4 | 0 | Y | TFVDRGWGNGC | 44.06 | SMVDRGWGNGC | 30.68 | TYVDRGWGNGC | 20.83 | | |
| E | 376 | 1.74 | 6 | 4 | 0 | Y | FVDRGWGNGCG | 44.06 | MVDRGWGNGCG | 30.75 | YVDRGWGNGCG | 20.83 | | |
| E | 377 | 0 | 1 | 1 | 0 | Y | VDRGWGNGCGL | 100.00 | | | | | | |
| E | 378 | 0 | 1 | 1 | 0 | Y | DRGWGNGCCLF | 100.00 | | | | | | |
| E | 379 | 0 | 1 | 1 | 0 | Y | RGWGNGCGLFG | 100.00 | | | | | | |
| E | 380 | 0 | 1 | 1 | 0 | Y | GWGNGCGLFGK | 100.00 | | | | | | |
| E | 381 | 0 | 1 | 1 | 0 | Y | WGNGCGLFGKG | 100.00 | | | | | | |
| E | 382 | 0.94 | 3 | 2 | 0 | Y | GNGCGLFGKGS | 65.38 | GNGCGLFGKGG | 34.55 | NGCGLFGKGGV | 3.8 | | |
| E | 383 | 1.11 | 4 | 3 | 0 | Y | NGCGLFGKGSL | 65.38 | NGCGLFGKGGI | 30.75 | GCGLFGKGSLV | 20.83 | | |
| E | 384 | 2.08 | 7 | 5 | 0 | Y | GCGLFGKGSLI | 33.92 | GCGLFGKGGIV | 30.75 | GCGLFGKGSLV | 20.83 | GCGLFGKGGW | 3.8 |
| E | 385 | 2.08 | 7 | 5 | 0 | Y | CGLFGKGSLIT | 33.92 | CGLFGKGGIVT | 30.75 | CGLFGKGSLVT | 20.83 | CGLFGKGGWT | 3.8 |

FIG. 21-6

| protein | block start position (11-mers) | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 386 | 2.08 | 8 | 5 | 0 | Y | GLFGKGSLLIT | 33.92 | GLFGKGGWVTC | 30.72 | GLFGKGSLVTC | 20.83 | GLFGKGSLLTC | 10.29 | GLFGKGGWVTC | 3.8 |
| E | 387 | 2.09 | 11 | 5 | 0 | Y | LFGKGSLLTCA | 33.85 | LFGKGGWVTCA | 30.72 | LFGKGSLVTCA | 20.83 | LFGKGSLLTCA | 10.25 | LFGKGGWVTCA | 3.8 |
| E | 388 | 2.11 | 14 | 5 | 0 | Y | FGKGSLLTCAK | 33.85 | FGKGGIVTCAM | 30.53 | FGKGSLVTCAK | 20.83 | FGKGSLLTCAK | 10.25 | FGKGGWVTCAK | 3.72 |
| E | 389 | 2.11 | 14 | 5 | 0 | Y | GKGSLLTCAKF | 33.85 | GKGGIVTCAMF | 30.53 | GKGSLVTCAKF | 20.83 | GKGSLLTCAKF | 10.25 | GKGGWVTCAKF | 3.72 |
| E | 422 | 1.27 | 17 | 4 | 0 | Y | TVHTGDQHQVG | 65.08 | TPHSGEEHAVG | 28.83 | TVHNGDTHAVG | 3.69 | TPHSGEENAVG | 1.81 | | |
| E | 423 | 1.29 | 21 | 4 | 0.04 | Y | VHTGDQHQVGN | 65.04 | PHSGEEHAVGN | 28.65 | VHNGDTHAVGN | 3.69 | PHSGEENAVGN | 1.81 | | |
| E | 424 | 1.55 | 21 | 5 | 0 | Y | HTGDQHQVGNE | 59.81 | HSGEEHAVGND | 28.61 | HTGDQHQVGND | 5.27 | HNGDTHAVGND | 3.69 | HSGEENAVGND | 1.81 |
| E | 461 | 1.82 | 17 | 5 | 0 | Y | LTLDCSPRTGL | 44.43 | VTMECSPRTGL | 29.68 | LGLECSPRTGL | 20.72 | LTLDCEPRSGI | 3.65 | ITMECSPRTGL | 0.63 |
| E | 462 | 1.78 | 19 | 4 | 0 | Y | TLDCSPRTGLD | 44.40 | TMECSPRTGLD | 30.24 | GLECSPRTGLD | 20.72 | TLDCEPRSGID | 3.65 | | |
| E | 463 | 1.77 | 16 | 4 | 0 | Y | LDCSPRTGLDF | 44.47 | MECSPRTGLDF | 30.20 | LECSPRTGLDF | 20.76 | LDCEPRSGIDF | 3.72 | | |
| E | 464 | 1.29 | 17 | 3 | 0 | Y | ECSPRTGLDFN | 50.88 | DCSPRTGLDFN | 44.43 | DCEPRSGIDFN | 3.72 | | | | |
| E | 465 | 0.33 | 16 | 2 | 0 | Y | CSPRTGLDFNE | 95.35 | CEPRSGIDFNE | 3.72 | | | | | | |
| E | 466 | 0.35 | 18 | 3 | 0 | Y | SPRTGLDFNEM | 95.24 | EPRSGIDFNEM | 3.72 | SPRTSLDFNEM | 0.41 | | | | |
| E | 467 | 1.07 | 20 | 4 | 0 | Y | PRTGLDFNEMY | 74.48 | PRTGIDFNEMI | 20.72 | PRSGIDFNEMI | 3.72 | PRTSLDFNEMY | 0.41 | | |
| E | 468 | 1.06 | 19 | 4 | 0.15 | Y | RTGLDFNEMVL | 74.52 | RTGIDFNEMIL | 20.58 | RSGIDFNEMIL | 3.72 | RTSLDFNEMVL | 0.41 | | |
| E | 469 | 1.07 | 20 | 4 | 0.15 | Y | TGLDFNEMILL | 74.48 | TGLDFNEMILL | 20.58 | SGIDFNEMILM | 3.72 | TSLDFNEMILL | 0.41 | | |
| E | 470 | 1.81 | 23 | 5 | 0.15 | Y | GLDFNEMVLLQ | 44.28 | GLDFNEMILLQ | 30.16 | GLDFNEMILLT | 20.61 | GIDFNEMILMK | 3.58 | | |
| E | 471 | 1.77 | 22 | 4 | 0.15 | Y | LDFNEMVLLTM | 44.28 | LDFNEMILLTM | 30.57 | LDFNEMILLTM | 20.61 | IDFNEMILMKM | 3.58 | | |
| E | 484 | 1.75 | 11 | 4 | 0 | Y | KSWLVHRQWFL | 44.10 | KAWLVHRQWFL | 30.86 | KAWMYHRQWFF | 20.69 | KTWLVHKQWFL | 3.72 | | |
| E | 485 | 1.74 | 10 | 4 | 0 | Y | SWLVHRQWFLD | 44.17 | AWLVHRQWFLD | 30.86 | AWMYHRQWFFD | 20.69 | TWLVHKQWFLD | 3.72 | | |
| E | 486 | 1.53 | 7 | 3 | 0 | Y | WLVHKQWFLDL | 48.19 | WLVHRQWFLDL | 30.90 | WMYHRQWFFDL | 20.69 | | | | |
| E | 487 | 1.53 | 7 | 3 | 0 | Y | LVHKQWFLDLP | 48.19 | LVHRQWFLDLP | 30.90 | MYHRQWFFDLP | 20.69 | | | | |
| E | 488 | 1.52 | 6 | 3 | 0 | Y | VHKQWFLDLPL | 48.19 | VHRQWFLDLPL | 30.90 | VHRQWFFDLPL | 20.72 | | | | |
| E | 489 | 1.52 | 6 | 3 | 0 | Y | HKQWFLDLPLP | 48.23 | HRQWFLDLPLP | 30.90 | HRQWFFDLPLP | 20.72 | | | SLDFNEMVLLQ | 0.41 |
| E | 490 | 1.52 | 6 | 3 | 0 | Y | KQWFLDLPLPW | 48.23 | RQWFLDLPLPW | 30.90 | RQWFFDLPLPW | 20.72 | | | | |

FIG. 21-7

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 491 | 1.62 | 8 | 4 | 0 | Y | QWFDLPLPWT | 48.16 | QWFDLPLPWL | 30.86 | QWFDLPLPWT | 18.81 | QWFFDLPLPWA | 1.92 |
| E | 514 | 2 | 15 | 5 | 0.04 | Y | QDLLVTFKTAH | 39.34 | KETLVTFKNPH | 30.20 | QWFFDLPLPWT | 20.76 | KDLLVTFKTAH | 5.01 | KERMYTFKVPH | 3.72 |
| E | 515 | 1.77 | 13 | 4 | 0 | Y | DLLVTFKTAHA | 44.40 | ETLVTFKNPHA | 30.24 | KELLVTFKNAH | 20.76 | ERMYTFKVPHA | 3.72 |
| E | 516 | 1.76 | 12 | 4 | 0 | Y | LLVTFKTAHAK | 44.40 | TLVTFKNPHAK | 30.27 | ELLVTFKNAHA | 20.76 | RMVTFKVPHAK | 3.72 |
| E | 517 | 1.75 | 11 | 4 | 0 | Y | LVTFKTAHAKK | 44.40 | LVTFKNPHAKK | 30.38 | LLVTFKNAHAK | 20.76 | MVTFKVPHAKR | 3.72 |
| E | 518 | 1.75 | 10 | 4 | 0 | Y | VTFKTAHAKKQ | 44.43 | VTFKNPHAKKQ | 30.38 | LVTFKNAHAKK | 20.76 | VTFKVPHAKRQ | 3.72 |
| E | 519 | 1.75 | 9 | 4 | 0 | Y | TFKTAHAKKQE | 44.43 | TFKNPHAKKQD | 30.38 | VTFKNAHAKKQ | 20.76 | TFKVPHAKRQD | 3.72 |
| E | 520 | 1.76 | 10 | 4 | 0 | Y | FKTAHAKKQEV | 44.32 | FKNPHAKKQDV | 30.38 | TFKNAHAKKQE | 20.8 | FKVPHAKRQDV | 3.72 |
| E | 521 | 1.77 | 14 | 4 | 0 | Y | KTAHAKKQEVV | 44.25 | KNPHAKKQDVV | 30.35 | FKNAHAKKQEV | 20.8 | KVPHAKRQDVT | 3.72 |
| E | 522 | 1.77 | 13 | 4 | 0 | Y | TAHAKKQEVVV | 44.28 | NPHAKKQDVVV | 30.27 | KNAHAKKQEVV | 20.8 | VPHAKRQDVTV | 3.69 |
| E | 523 | 1.19 | 13 | 3 | 0 | Y | AHAKKQEVVVL | 65.12 | PHAKKQDVVVL | 30.24 | NAHAKKQEVVV | 20.83 | PHAKRQDVTVL | 3.69 |
| E | 524 | 1.19 | 13 | 3 | 0 | Y | HAKKQEVVVLG | 65.12 | HAKKQDVVVLG | 30.24 | PHAKRQDVTVL | 3.69 |
| E | 525 | 1.19 | 14 | 3 | 0 | Y | AKKQEVVVLGS | 65.08 | AKKQDVVVLGS | 30.24 | HAKRQDVTVLG | 3.69 |
| E | 526 | 1.19 | 13 | 3 | 0 | Y | KKQEVVVLGSQ | 65.12 | KKQDVVVLGSQ | 30.24 | AKRQDVTVLGS | 3.69 |
| E | 527 | 1.19 | 13 | 3 | 0 | Y | KQEVVVLGSQE | 65.12 | KQDVVVLGSQE | 30.24 | KRQDVTVLGSQ | 3.69 |
| E | 528 | 1.19 | 13 | 3 | 0 | Y | QEVVVLGSQEG | 65.12 | QDVVVLGSQEG | 30.24 | RQDVTVLGSQE | 3.69 |
| E | 529 | 1.14 | 10 | 3 | 0 | Y | EVVVLGSQEGA | 65.15 | DVVVLGSQEGA | 30.75 | QDVTVLGSQEG | 3.69 |
| E | 530 | 0.28 | 8 | 2 | 0 | Y | VVVLGSQEGAM | 95.91 | VVVLGSQEGA | 30.75 | DVTVLGSQEGA | 3.69 |
| E | 531 | 0.27 | 8 | 2 | 0 | Y | VVLGSQEGAMH | 95.98 | VTVLGSQEGAM | 3.69 |
| E | 532 | 0.27 | 8 | 2 | 0 | Y | VLGSQEGAMHT | 95.98 | TVLGSQEGAMH | 3.69 |
| E | 533 | 0.27 | 9 | 2 | 0 | Y | LGSQEGAMHTA | 95.98 | VLGSQEGAMHS | 3.72 |
| E | 534 | 0.27 | 9 | 2 | 0 | Y | GSQEGAMHTAL | 95.98 | LGSQEGAMHSA | 3.72 |
| E | 535 | 0.28 | 11 | 2 | 0 | Y | SQEGAMHTALT | 95.94 | GSQEGAMHSAL | 3.72 |
| E | 536 | 0.28 | 10 | 2 | 0 | Y | QEGAMHTALTG | 95.98 | SQEGAMHSALA | 3.47 |
| E | 537 | 0.29 | 12 | 2 | 0 | Y | EGAMHTALIGA | 95.91 | QEGAMHSALAG | 3.47 |

FIG. 21-8

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 538 | 0.3 | 14 | 2 | 0 | Y | GAMHTALTIGAT | 95.83 | GAMHSALAGAT | 3.47 | | | | |
| E | 539 | 0.3 | 14 | 2 | 0 | Y | AMHTALTIGATE | 95.83 | AMHSALAGATE | 3.47 | | | | |
| E | 540 | 0.3 | 15 | 2 | 0 | Y | MHTALTIGATEI | 95.80 | MHSALAGATEV | 3.47 | | | | |
| E | 541 | 0.31 | 16 | 2 | 0 | Y | HTALTIGATEIQ | 95.76 | HSALAGATEVD | 3.47 | | | | |
| E | 542 | 1.74 | 19 | 4 | 0 | Y | TALTIGATEIQT | 46.61 | TALTIGATEIQM | 30.75 | TALTIGATEIQN | 18.4 | SALAGATEVDS | 3.47 |
| E | 543 | 1.75 | 19 | 4 | 0 | Y | ALTIGATEIQTS | 46.42 | ALTIGATEIQMS | 30.83 | ALTIGATEIQNS | 18.36 | ALAGATEVDSG | 3.47 |
| E | 554 | 1.81 | 19 | 5 | 0 | Y | GTTTIFAGHLK | 44.17 | SGNLLFTGHLK | 30.35 | GGTSIFAGHLK | 20.54 | DGNHMFAGHLK | 3.69 |
| E | 555 | 1.81 | 18 | 5 | 0 | Y | TTTIFAGHLKC | 44.17 | GNLLFTGHLKC | 30.35 | GTSIFAGHLKC | 20.54 | GNHMFAGHLK | 3.69 |
| E | 556 | 1.79 | 15 | 5 | 0 | Y | TTIFAGHLKCR | 44.32 | NLLFTGHLKCR | 30.35 | TSIFAGHLKCR | 20.54 | NHMFAGHLKCK | 3.72 |
| E | 557 | 1.79 | 15 | 5 | 0 | Y | TIFAGHLKCRL | 44.36 | LLFTGHLKCRL | 30.35 | SIFAGHLKCRL | 20.54 | HMFAGHLKCKV | 3.69 |
| E | 558 | 1.18 | 11 | 3 | 0 | Y | IFAGHLKCRLR | 65.12 | LFTGHLKCRLR | 30.27 | MFAGHLKCRLM | 3.69 | | |
| E | 559 | 1.18 | 11 | 3 | 0 | Y | FAGHLKCRLRM | 65.15 | FTGHLKCRLRM | 30.24 | FAGHLKCRLRM | 3.69 | | |
| E | 560 | 1.2 | 13 | 4 | 0 | Y | AGHLKCRLKMD | 65.01 | TGHLKCRLRMD | 30.24 | AGHLKCRLRME | 3.65 | MGHLKCRLRMD | 0.48 |
| E | 561 | 1.14 | 11 | 3 | 0 | Y | GHLKCRLKMDK | 65.23 | GHLKCRLRMDK | 30.75 | GHLKCRLRMEK | 3.65 | | |
| E | 562 | 1.14 | 11 | 3 | 0 | Y | HLKCRLKMDKL | 65.23 | HLKCRLRMDKL | 30.75 | HLKCRLRMEKL | 3.65 | | |
| E | 563 | 1.77 | 17 | 4 | 0 | Y | LKCRLKMDKLT | 44.17 | LKCRLRMDKLQ | 30.75 | LKCRLKMDKLE | 3.65 | LKCRLKMDKLR | 3.65 |
| E | 564 | 1.77 | 17 | 4 | 0 | Y | KCRLKMDKLTL | 44.17 | KCRLRMDKLQL | 30.75 | KCRLKMDKLEL | 3.65 | KCRLKMDKLR | 3.65 |
| E | 565 | 1.81 | 17 | 5 | 0 | Y | CRLKMDKLTLK | 43.51 | CRLRMDKLQLK | 30.75 | CRLKMDKLELK | 3.65 | CRLKMDKLRIK | 3.65 |
| E | 566 | 1.81 | 17 | 5 | 0 | Y | RLKMDKLTLKG | 43.51 | RLRMDKLQLKG | 30.75 | RLKMDKLELKG | 3.65 | RLKMDKLRIKG | 3.65 |
| E | 589 | 1.89 | 12 | 5 | 0 | Y | EKEVAETQHGT | 41.41 | VKEIAETQHGT | 30.83 | KKEVSETQHGT | 20.65 | DKEMAETQHGT | 3.61 |
| E | 590 | 1.9 | 14 | 5 | 0 | Y | KEVAETQHGTV | 41.30 | KEIAETQHGTI | 30.75 | KEVSETQHGTI | 20.76 | KEMAETQHGTT | 3.69 |
| E | 591 | 1.89 | 11 | 5 | 0 | Y | EVAETQHGTVL | 41.30 | EIAETQHGTIV | 30.79 | EVSETQHGTIL | 20.8 | EMAETQHGTTV | 3.65 |
| E | 592 | 1.93 | 14 | 5 | 0 | Y | VAETQHGTVLV | 41.30 | IAETQHGTIVI | 30.49 | VSETQHGTILI | 20.69 | MAETQHGTTVV | 3.69 |
| E | 593 | 1.77 | 14 | 4 | 0 | Y | AETQHGTVLVQ | 44.36 | AETQHGTIVIR | 30.46 | SETQHGTILIK | 20.69 | AETQHGTTVVK | 3.65 |
| E | 644 | 0.81 | 14 | 4 | 0 | Y | PYNIEAEPPFG | 85.62 | PYNIETEPPFG | 9.11 | VTNIELEPPFG | 3.58 | PINIELEPPFG | 1.11 |

FIG. 21-9

ENVall (11-mers)

| protein | block start position | block entropy | total peptides in block | # peptides required to cover 99% of block | gap/X fraction | 99% of block covered w/ <= 5 peptides? | cover 99% of block | frequency | cover 99% of block | frequency | cover 99% of block | frequency | cover 99% of block | frequency |
|---|---|---|---|---|---|---|---|---|---|---|---|---|---|---|
| E | 645 | 1.6 | 14 | 5 | 0 | Y | VNIEAEPPFGE | 55.75 | VNIEAEPPFGD | 29.98 | VNIETEPPFGE | 9.11 | TNIELEPPFGD | 3.72 | INIEAEPPFGD | 0.81 |
| E | 646 | 1.52 | 14 | 4 | 0 | Y | NIEAEPPFGES | 56.05 | NIEAEPPFGDS | 30.79 | NIETEPPFGES | 9.14 | NIELEPPFGDS | 3.72 | IELEPPFGDSY | 3.72 |
| E | 647 | 2.05 | 11 | 5 | 0 | Y | IEAEPPFGESY | 35.29 | IEAEPPFGDSY | 30.79 | IETEPPFGESY | 20.76 | IETEPPFGESY | 9.14 | ELEPPFGDSYI | 3.72 |
| E | 648 | 2.06 | 12 | 5 | 0 | Y | EAEPPFGESYI | 35.21 | EAEPPFGDSYI | 30.79 | EAEPPFGESNI | 20.76 | ETEPPFGESYI | 9.14 | GSTIGKMFEAT | 0.33 |
| E | 675 | 1.26 | 20 | 5 | 0 | Y | GSSIGKMFEAT | 64.45 | GSSIGKMFETT | 30.27 | GSSIGKMFEST | 3.65 | GSSIGQMETT | 0.33 | |  |
| E | 678 | 1.23 | 21 | 4 | 0 | Y | IGKMFEATARG | 64.79 | IGQMFETTMRG | 30.24 | IGKMFESTYRG | 3.65 | IGQMIETTMRG | 0.33 | GKMFVATARGA | 0.11 |
| E | 679 | 1.24 | 22 | 5 | 0 | Y | GKMFEATARGA | 64.75 | GQMFETTMRGA | 30.24 | GKMFESTYRGA | 3.65 | GQMIETTMRGA | 0.33 | QMFATTMRGAK | 0.11 |
| E | 680 | 1.24 | 22 | 5 | 0 | Y | KMFEATARGAR | 64.75 | QMFETTMRGAK | 30.24 | KMFESTYRGAK | 3.65 | QMIETTMRGAK | 0.33 | | |
| E | 681 | 1.22 | 20 | 4 | 0 | Y | MFEATARGARR | 64.82 | MFETTMRGAKR | 30.31 | MFESTYRGAKR | 3.65 | MIETTMRGAKR | 0.33 | | |
| E | 682 | 1.23 | 21 | 4 | 0 | Y | FEATARGARRM | 64.79 | FETTMRGAKRM | 30.31 | FESTYRGAKRM | 3.65 | IETTMRGAKRM | 0.33 | | |
| E | 683 | 1.18 | 17 | 3 | 0 | Y | EATARGARRMA | 64.90 | ETTMRGAKRMA | 30.64 | ESTYRGAKRMA | 3.72 | | | | |
| E | 684 | 1.16 | 14 | 3 | 0 | Y | ATARGARRMAI | 65.04 | TTMRGAKRMAI | 30.72 | STYRGAKRMAI | 3.72 | | | | |
| E | 685 | 1.15 | 12 | 3 | 0 | Y | TARGARRMAIL | 65.12 | TMRGAKRMAIL | 30.75 | TYRGAKRMAIL | 3.72 | | | | |
| E | 686 | 1.14 | 10 | 3 | 0 | Y | ARGARRMAILG | 65.19 | MRGAKRMAILG | 30.75 | YRGAKRMAILG | 3.72 | | | | |
| E | 687 | 1.13 | 9 | 3 | 0 | Y | RGARRMAILGD | 65.23 | RGAKRMAILGD | 30.79 | RGAKRMAILGE | 3.72 | | | | |
| E | 688 | 1.13 | 9 | 3 | 0 | Y | GARRMAILGDT | 65.19 | GAKRMAILGDT | 30.79 | GAKRMAILGET | 3.72 | | | | |
| E | 689 | 1.14 | 11 | 3 | 0 | Y | ARRMAILGDTA | 65.15 | AKRMAILGDTA | 30.75 | AKRMAILGETA | 3.72 | | | | |
| E | 690 | 1.14 | 10 | 3 | 0 | Y | RRMAILGDTAW | 65.19 | KRMAILGDTAW | 30.75 | KRMAILGETAW | 3.72 | | | | |
| E | 691 | 0.27 | 9 | 2 | 0 | Y | RMAILGDTAWD | 95.94 | RMAILGETAWD | 3.72 | | | | | | |
| E | 692 | 0.27 | 9 | 2 | 0 | Y | MAILGDTAWDF | 95.94 | MAILGETAWDF | 3.72 | | | | | | |
| E | 693 | 0.27 | 8 | 2 | 0 | Y | AILGDTAWDFG | 95.98 | AILGETAWDFG | 3.72 | | | | | | |
| E | 694 | 0.27 | 8 | 2 | 0 | Y | ILGDTAWDFGS | 95.98 | ILGETAWDFGS | 3.72 | | | | | | |
| E | 695 | 1.74 | 12 | 4 | 0 | Y | LGDTAWDFGSI | 43.18 | LGDTAWDFGSL | 30.27 | LGDTAWDFGSV | 22.49 | LGETAWDFGSV | 3.72 | | |
| E | 696 | 1.74 | 12 | 4 | 0 | Y | GDTAWDFGSIG | 43.18 | GDTAWDFGSLG | 30.27 | GDTAWDFGSVG | 22.49 | GETAWDFGSVG | 3.72 | | |
| E | 697 | 1.74 | 12 | 4 | 0 | Y | DTAWDFGSIGG | 43.18 | DTAWDFGSLGG | 30.27 | DTAWDFGSVGG | 22.49 | ETAWDFGSVGG | 3.72 | | |

FIG. 21-10

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 698 | 1.82 | 15 | 5 | 0 | Y | TAWDFGSIGGV | 42.63 | TAWDFGSLGGV | 30.01 | TAWDFGSVGGV | 22.42 | TAWDFGSVGGL | 3.72 | TAWDFGSIGGL | 0.44 |
| E | 723 | 1.78 | 13 | 5 | 0 | Y | AYGVLFSGVSW | 44.47 | IYGAAFSGVSW | 30.49 | AYTALFSGVSW | 20.28 | VYTTMFGGVSW | 3.72 | AYTALFGGVSW | 0.48 |
| NS1 | 785 | 1.66 | 12 | 4 | 0 | Y | GRELKCGSGIF | 46.90 | NKELKCGSGIF | 29.65 | GKELKCGSGIF | 21.5 | SKELKCGSGIF | 0.96 | | |
| NS1 | 786 | 1.61 | 11 | 4 | 0 | Y | RELKCGSGIFV | 46.83 | KELKCGSGIFI | 28.95 | KELKCGSGIFV | 23.19 | KELKCGSGIFV | 0.7 | | |
| NS1 | 787 | 1.18 | 11 | 4 | 0 | Y | ELKCGSGIFVT | 66.33 | ELKCGSGIFIT | 28.98 | ELKCGSGIFVW | 3.39 | ELKCGSGIFVT | 0.7 | | |
| NS1 | 788 | 1.3 | 11 | 5 | 0 | Y | LKCGSGIFVTN | 64.60 | LKCGSGIFTD | 28.98 | LKCGSGIFWD | 3.39 | LKCGSGIFVTD | 1.77 | LKCGNGIFVTN | 0.7 |
| NS1 | 789 | 1.3 | 12 | 5 | 0 | Y | KCGSGIFVTNE | 64.60 | KCGSGIFITDN | 28.95 | KCGSGIFVTDN | 3.39 | KCGSGIFVTDN | 1.81 | KCGNGIFVTNE | 0.7 |
| NS1 | 790 | 1.3 | 13 | 5 | 0 | Y | CGSGIFVTNEV | 64.56 | CGSGIFITDNV | 28.95 | CGSGIFVTDNV | 3.39 | CGSGIFVTDNV | 1.81 | CGNGIFVTNEV | 0.7 |
| NS1 | 791 | 1.31 | 13 | 5 | 0 | Y | GSGIFVTNEVH | 64.53 | GSGIFITDNVH | 28.95 | GSGIFVTDNVH | 3.39 | GSGIFVTDNVH | 1.81 | GNGIFVTNEVH | 0.7 |
| NS1 | 792 | 1.31 | 15 | 5 | 0 | Y | SGIFVTNEVHT | 64.49 | SGIFITDNVHT | 28.95 | SGIFVTDNVHT | 3.39 | SGIFVTDNVHT | 1.81 | NGIFVTNEVHT | 0.7 |
| NS1 | 793 | 1.25 | 13 | 4 | 0 | Y | GIFVTNEVHTW | 65.19 | GIFITDNVHTW | 28.98 | GIFVTDNVHTW | 3.39 | GIFVTDNVHTW | 1.81 | | |
| NS1 | 794 | 1.26 | 14 | 4 | 0 | Y | IFVTNEVHTWT | 65.19 | IFITDNVHTWT | 28.98 | IFVTDNVHTWT | 3.36 | IFVTDNVHTWT | 1.81 | | |
| NS1 | 795 | 1.26 | 15 | 4 | 0 | Y | FVTNEVHTWTE | 65.15 | FITDNVHTWTE | 28.98 | FVTDNVHTWTE | 3.36 | FVTDNVHTWTE | 1.81 | | |
| NS1 | 796 | 1.27 | 16 | 4 | 0 | Y | VTNEVHTWTEQ | 65.12 | ITDNVHTWTEQ | 28.98 | VTDNVHTWTEQ | 3.36 | VTDNVHTWTEQ | 1.81 | | |
| NS1 | 797 | 1.16 | 15 | 3 | 0 | Y | TNEVHTWTEQY | 65.19 | TDNVHTWTEQY | 30.79 | VDNVHTWTEQY | 3.36 | | | | |
| NS1 | 798 | 0.99 | 14 | 2 | 0.04 | Y | NEVHTWTEQYK | 65.08 | DNVHTWTEQYK | 34.33 | | | | | | |
| NS1 | 799 | 0.99 | 14 | 2 | 0.04 | Y | EVHTWTEQYKF | 65.08 | NVHTWTEQYKF | 34.33 | | | | | | |
| NS1 | 800 | 0.06 | 10 | 1 | 0.04 | Y | VHTWTEQYKFQ | 99.48 | | | | | | | | |
| NS1 | 801 | 0.98 | 10 | 2 | 0.04 | Y | HTWTEQYKFQA | 65.12 | HTWTEQYKFQP | 34.44 | | | | | | |
| NS1 | 802 | 1.01 | 10 | 2 | 0.04 | Y | TWTEQYKFQAD | 65.15 | TWTEQYKFQPE | 33.85 | | | | | | |
| NS1 | 803 | 1.01 | 10 | 2 | 0.04 | Y | WTEQYKFQADS | 65.19 | WTEQYKFQPES | 33.81 | | | | | | |
| NS1 | 804 | 1.01 | 10 | 2 | 0.04 | Y | TEQYKFQADSP | 65.19 | TEQYKFQPESP | 33.81 | | | | | | |
| NS1 | 805 | 1.19 | 12 | 3 | 0.04 | Y | EQYKFQADSPK | 65.15 | EQYKFQPESPS | 30.13 | EQYKFQPESPA | 3.69 | | | | |
| NS1 | 806 | 1.2 | 13 | 4 | 0.04 | Y | QYKFQADSPKR | 65.08 | QYKFQPESPSK | 30.13 | QYKFQPESPAR | 3.69 | QYKFQPDSPSK | 0.59 | | |
| NS1 | 807 | 1.2 | 14 | 4 | 0.04 | Y | YKFQADSPKRL | 65.08 | YKFQPESPSKL | 30.13 | YKFQPESPARL | 3.61 | YKFQPDSPSKL | 0.59 | | |

FIG. 21-11

ENVall (11-mers)

| protein | block start position | block entropy | total peptides in block | # peptides required to cover 99% of block | gap/X fraction | 99% of block covered w/ =>5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 808 | 1.79 | 16 | 5 | 0.04 | Y | KFQADSPKRLS | 44.40 | KFQPESPSKL

FIG. 21-12

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 935 | 1.52 | 14 | 5 | 0 | Y | FGVFTTNIWLK | 46.87 | FGIFTTNIWLK | 43.99 | FGMFTTNIWMK | 3.72 | FGVFSTNIWLK | 3.61

FIG. 21-13

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1040 | 1.27 | 15 | 5 | 0 | Y | AGPWHLGKLEL | 65.12 | AGPWHLGKLEM | 29.28 | VGPWHLGKLEI | 3.32 | AGPWHLGRLEM | 0.74 | TGPWHLGKLEM

FIG. 21-14

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1089 | 2.14 | 7 | 5 | 0 | Y | RSCTLPPLRYR | 30.83 | RSCTLPPLRFR | 27.03 | RSCTLPPLRYM | 20.76 | RSCTLPPLRFK | 17.44 | RSCTMPPLRFL | 3.8 |
| NS1 | 1

FIG. 21-15

ENVal (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|

FIG. 21-16

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1391 | 1.66 | 17 | 4 | 0 | Y | SGSSADLSLEK | 47.75 | TGRSADLELER | 29.83 | T

FIG. 21-17

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1527 | 1.96 | 8 | 5 | 0 | Y | WHVTRGAVLMY | 44.51 | WHVTRGAVLMH | 29.90 | WHVTRGAVLTY | 11.47 | WHVTRGAVLTH | 3.8 |
| NS3 | 1539 | 1.78 | 12 | 5 | 0 | Y | GKRLEPSW

FIG. 21-18

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1597 | 1.85 | 15 | 5 | 0 | Y | EGEVGAIALDF | 44.47 | TGTIGAVSLDF | 29.02 | TGEIGAIALDF | 20.54 | TGEIGAVTLDF | 3.76 | AGTIGAVSLDF | 1.59 |
| NS3 | 1598 | 1.73 | 10 | 4 | 0 | Y | GEVGAIALDFK | 44.47 | GTIGAVSLDFS | 30.64 | GEIGAIALDFK | 20.72 | GEIGAVTLDFK | 3.8 | | |
| NS3 | 1599 | 1.73 | 10 | 4 | 0 | Y | EVGAIALDFKP | 44.47 | TIGAVSLDFSP | 30.64 | EIGAIALDFKP | 20.72 | EIGAVTLDFKP | 3.8 | | |
| NS3 | 1600 | 1.72 | 8 | 3 | 0 | Y | VGAIALDFKPG | 44.47 | IGAVSLDFSPG | 30.79 | IGAIALDFKPG | 20.72 | IGAVTLDFKPG | 3.8 | | |
| NS3 | 1601 | 1.13 | 7 | 3 | 0 | Y | GAIALDFKPGT | 65.19 | GAVSLDFSPGT | 30.79 | GAVTLDFKPGT | 3.76 | | | | |
| NS3 | 1602 | 1.13 | 7 | 3 | 0 | Y | AIALDFKPGTS | 65.19 | AVSLDFSPGTS | 30.79 | AVTLDFKPGTS | 3.76 | | | | |
| NS3 | 1603 | 1.13 | 7 | 3 | 0 | Y | IALDFKPGTSG | 65.19 | VSLDFSPGTSG | 30.79 | VTLDFKPGTSG | 3.76 | | | | |
| NS3 | 1604 | 1.11 | 4 | 3 | 0 | Y | ALDFKPGTSGS | 65.38 | SLDFSPGTSGS | 30.83 | TLDFKPGTSGS | 3.76 | | | | |
| NS3 | 1605 | 0.9 | 4 | 2 | 0 | Y | LDFKPGTSGSP | 69.14 | LDFSPGTSGSP | 30.79 | | | | | | |
| NS3 | 1606 | 0.9 | 4 | 2 | 0 | Y | DFKPGTSGSPI | 69.14 | DFSPGTSGSPI | 30.79 | | | | | | |
| NS3 | 1607 | 1.84 | 7 | 4 | 0 | Y | FKPGTSGSPIV | 44.58 | FKPGTSGSPII | 24.56 | FSPGTSGSPIV | 19.54 | FSPGTSGSPII | 11.21 | | |

FIG. 21-19

| protein | block start position | block entropy (11-mers) ENVall | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1661 | 1.95 | 10 | 4 | 0 | Y | FRKRNLTIMDL | 35.77 | FRKRNLTIMDL | 29.46 | FRKRRLTIMDL | 23.34 | FRKRRLTIMDL | 10.66 |
| NS3 | 1662 | 1.95 | 10 | 4 | 0 | Y | RKRNLTIMDLH | 35.77 | KKRNLTIMDLH | 29.46 | RKRRLTIMDLH | 23.34 | RKRRLTIMDLH | 10.66 |
| NS3 | 1663 | 1.3 | 8 | 3 | 0 | Y | KRNLTIMDLHP | 65.23 | KKRLTIMDLHP | 23.34 | KRRLTIMDLH | 10.66 | | |
| NS3 | 1664 | 1.3 | 8 | 3 | 0 | Y | RNLTIMDLHPG | 65.23 | KRLTIMDLHPG | 23.34 | RRLTIMDLHPG | 10.66 | | |
| NS3 | 1665 | 0.99 | 7 | 2 | 0 | Y | NLTIMDLHPGS | 65.27 | RLTIMDLHPGA | 34.00 | | | | |
| NS3 | 1666 | 0.94 | 5 | 2 | 0 | Y | LTIMDLHPGSG | 65.34 | LTIMDLHPGAG | 34.55 | | | | |
| NS3 | 1667 | 0.94 | 4 | 2 | 0 | Y | TIMDLHPGSGK | 65.34 | TIMDLHPGAGK | 34.59 | | | | |
| NS3 | 1668 | 0.94 | 5 | 2 | 0 | Y | IMDLHPGSGKT | 65.34 | IMDLHPGAGKT | 34.59 | | | | |
| NS3 | 1669 | 0.94 | 4 | 2 | 0 | Y | MDLHPGSGKTR | 65.34 | MDLHPGAGKTK | 34.59 | | | | |
| NS3 | 1670 | 1.56 | 6 | 3 | 0 | Y | DLHPGSGKTRR | 44.47 | DLHPGAGKTKR | 34.14 | DLHPGSGKTRK | 20.87 | | |
| NS3 | 1671 | 1.74 | 7 | 4 | 0 | Y | LHPGSGKTRRY | 44.47 | LHPGAGKTKRY | 30.35 | LHPGSGKTRKY | 20.87 | LHPGAGKTKRI | 3.8 |
| NS3 | 1672 | 1.74 | 7 | 4 | 0 | Y | HPGSGKTRRYL | 44.47 | HPGAGKTKRYL | 30.35 | HPGSGKTRKYL | 20.87 | HPGAGKTKRIL | 3.8 |
| NS3 | 1673 | 1.74 | 7 | 4 | 0 | Y | PGSGKTRRYLP | 44.47 | PGAGKTKRYLP | 30.35 | PGSGKTRKYLP | 20.87 | PGAGKTKRILP | 3.8 |
| NS3 | 1674 | 1.74 | 8 | 4 | 0 | Y | GSGKTRRYLPA | 44.47 | GAGKTKRYLPA | 30.35 | GSGKTRKYLPA | 20.8 | GAGKTKRILPS | 3.8 |
| NS3 | 1675 | 1.81 | 11 | 5 | 0 | Y | SGKTRRYLPAI | 43.69 | AGKTKRYLPAI | 30.35 | SGKTRKYLPAI | 20.69 | AGKTKRILPSI | 3.8 |
| NS3 | 1680 | 1.16 | 15 | 5 | 0 | Y | RYLPAIVREAI | 73.71 | KYLPAIVREAI | 19.91 | RILPSIVREAL | 3.8 | KYLPAIIREAI | 1.22 |
| NS3 | 1681 | 0.54 | 15 | 5 | 0 | Y | YLPAIVREAIK | 92.66 | ILPSIVREALK | 3.80 | YLPAIVREAIK | 3.80 | YLPAIIREAIK | 0.74 |
| NS3 | 1682 | 0.55 | 15 | 5 | 0 | Y | LPAIVREAIKR | 92.63 | LPSIVREALKR | 3.80 | LPAIVREAIKR | 1.29 | LPAMVREAIKR | 0.74 |
| NS3 | 1687 | 1.84 | 18 | 5 | 0 | Y | REAIKRRLRTL | 42.59 | REAIKRGLRTL | 29.94 | REAIKRRLRTL | 22.2 | REAIKRLRTL | 3.8 |
| NS3 | 1691 | 1.75 | 13 | 4 | 0 | Y | KRRLRTLILAP | 41.74 | KRGLRTLILAP | 29.98 | KRRLRTLVLAP | 25.74 | KRKLRTLVLAP | 1.03 |
| NS3 | 1692 | 1.68 | 10 | 4 | 0 | Y | RRLRTLILAPT | 41.78 | RGLRTLILAPT | 30.79 | RRLRTLILAPT | 25.74 | RKLRTLVLAPT | 1.03 |
| NS3 | 1693 | 1.68 | 9 | 4 | 0 | Y | RLRTLILAPTR | 41.85 | GLRTLILAPTR | 30.79 | RLRTLILAPTR | 25.74 | KLRTLVLAPTR | 1.03 |
| NS3 | 1694 | 0.13 | 6 | 2 | 0 | Y | LRTLILAPTRV | 98.38 | LRTLVLAPTRV | 1.36 | | | | |
| NS3 | 1695 | 0.11 | 3 | 2 | 0 | Y | RTLILAPTRVV | 98.56 | RTLVLAPTRVV | 1.40 | | | | |
| NS3 | 1696 | 0.11 | 3 | 2 | 0 | Y | TLILAPTRVVA | 98.56 | TLVLAPTRVVA | 1.40 | | | | |

FIG. 21-20

| protein | block start position ENVall (11-mers) | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1697 | 1.09 | 4 | 3 | 0 | Y | LILAPTRVVAA | 55.46 | LILAPTRVVAS | 55.46 | LVLAPTRVVAS | 1.4 | | |
| NS3 | 1698 | 1.09 | 4 | 3 | 0 | Y | ILAPTRVVAAE | 55.46 | ILAPTRVVASE | 55.46 | VLAPTRVVASE | 1.4 | | |
| NS3 | 1699 | — | 4 | 2 | 0 | Y | LAPTRVVAAEM | 55.46 | LAPTRVVASEM | 44.47 | | | | |
| NS3 | 1700 | — | 5 | 2 | 0 | Y | APTRVVAAEME | 55.42 | APTRVVASEMA | 44.47 | | | | |
| NS3 | 1701 | — | 5 | 2 | 0 | Y | PTRVVAAEMEE | 55.42 | PTRVVASEMAE | 44.47 | | | | |
| NS3 | 1702 | — | 5 | 2 | 0 | Y | TRVVAAEMEEA | 55.42 | TRVVASEMAEA | 44.47 | | | | |
| NS3 | 1703 | 1.01 | 6 | 2 | 0 | Y | RVVAAEMEEAL | 55.38 | RVVASEMAEAL | 44.47 | | | | |
| NS3 | 1704 | 1.54 | 8 | 3 | 0 | Y | VVASEMAEALK | 44.47 | VVAAEMEEALK | 34.62 | VVAAEMEEALK | 20.72 | | |
| NS3 | 1705 | 1.54 | 8 | 3 | 0 | Y | VASEMAEALKG | 44.47 | VAAEMEEALRG | 34.62 | VAAEMEEALKG | 20.72 | | |
| NS3 | 1706 | 1.6 | 10 | 3 | 0 | Y | ASEMAEALKGM | 43.77 | AAEMEEALRGL | 34.62 | AAEMEEALKGL | 20.72 | | |
| NS3 | 1707 | 1.6 | 10 | 3 | 0 | Y | SEMAEALKGMP | 43.77 | AEMEEALRGLP | 34.62 | AEMEEALKGLP | 20.72 | | |
| NS3 | 1708 | 1.6 | 11 | 3 | 0 | Y | EMAEALKGMPI | 43.81 | EMEEALRGLPI | 34.59 | EMEEALKGLPI | 20.69 | | |
| NS3 | 1709 | 1.6 | 11 | 3 | 0 | Y | MAEALKGMPIR | 43.81 | MEEALRGLPIR | 34.59 | MEEALKGLPIR | 20.69 | | |
| NS3 | 1710 | 1.6 | 10 | 3 | 0 | Y | AEALKGMPIRY | 43.84 | EEALRGLPIRY | 34.59 | EEALKGLPIRY | 20.69 | | |
| NS3 | 1711 | 1.6 | 10 | 3 | 0 | Y | EALKGMPIRYQ | 43.84 | EALRGLPIRYQ | 34.59 | EALKGLPIRYQ | 20.69 | | |
| NS3 | 1712 | 1.6 | 11 | 3 | 0 | Y | ALKGMPIRYQT | 43.84 | ALRGLPIRYQT | 34.59 | ALKGLPIRYQT | 20.69 | | |
| NS3 | 1713 | 1.72 | 11 | 4 | 0 | Y | LKGMPIRYQTT | 43.84 | LRGLPIRYQTT | 32.56 | LKGLPIRYQT | 20.61 | LRGLPIRYQT | 2.06 |
| NS3 | 1714 | 1.72 | 11 | 4 | 0 | Y | KGMPIRYQTTA | 43.84 | RGLPIRYQTTA | 32.56 | KGLPIRYQTTA | 20.58 | RGLPIRYQTTA | 2.06 |
| NS3 | 1715 | 1.91 | 12 | 5 | 0.15 | Y | GMPIRYQTTAV | 43.84 | GLPIRYQTTPA | 28.80 | GLPIRYQTTAI | 19.91 | GLPIRYQTPAV | 3.76 | GLPIRYQTTAI | 2.73 |
| NS3 | 1726 | 1.98 | 15 | 5 | 0.15 | Y | KSEHTGKEIVD | 35.47 | KSEHTGREIVD | 33.30 | RAEHTGREIVD | 21.72 | KTEHTGREIVD | 6.6 | KAEHTGREIVD | 2.21 |
| NS3 | 1727 | 1.86 | 12 | 4 | 0.15 | Y | SEHTGKEIVDL | 35.47 | SEHTGREIVDL | 33.41 | AEHTGREIVDL | 23.93 | TEHTGREIVDL | 6.64 | | |
| NS3 | 1728 | 0.96 | 7 | 2 | 0 | Y | EHTGREIVDLM | 64.05 | EHTGKEIVDLM | 35.62 | | | | |
| NS3 | 1729 | 0.95 | 5 | 2 | 0 | Y | HTGREIVDLMC | 64.23 | HTGKEIVDLMC | 35.66 | | | | |
| NS3 | 1730 | 0.95 | 4 | 2 | 0 | Y | TGREIVDLMCH | 64.27 | TGKEIVDLMCH | 35.66 | | | | |
| NS3 | 1731 | 0.95 | 5 | 2 | 0 | Y | GREIVDLMCHA | 64.23 | GKEIVDLMCHA | 35.66 | | | | |

FIG. 21-21

ENVall (11-mers)

| protein | block start position | block entropy | total peptides in block | # peptides required to cover 99% of block | gap/X fraction | 99% of block covered w/ =<5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1732 | 0.96 | 6 | 2 | 0 | Y | REIVDLMCHAT | 64.20 | REIVDLMCHAT | 35.66 | | | | |
| NS3 | 1733 | 0.02 | 5 | 1 | 0 | Y | EIVDLMCHATF | 99.85 | | | | | | |
| NS3 | 1734 | 0.02 | 5 | 1 | 0 | Y | IVDLMCHATFT | 99.85 | | | | | | |
| NS3 | 1735 | 0.25 | 6 | 2 | 0 | Y | VDLMCHATFTM | 96.05 | VDLMCHATFTT | 3.80 | | | | |
| NS3 | 1736 | 0.26 | 7 | 2 | 0 | Y | DLMCHATFTMR | 96.05 | DLMCHATFTTR | 3.72 | | | | |
| NS3 | 1737 | 0.26 | 6 | 2 | 0 | Y | LMCHATFTMRL | 96.05 | LMCHATFTTRL | 3.72 | | | | |
| NS3 | 1738 | 0.26 | 6 | 2 | 0 | Y | MCHATFTMRLL | 96.05 | MCHATFTTRLL | 3.72 | | | | |
| NS3 | 1739 | 0.26 | 6 | 2 | 0 | Y | CHATFTMRLLS | 96.05 | CHATFTTRLLS | 3.72 | | | | |
| NS3 | 1740 | 0.26 | 6 | 2 | 0 | Y | HATFTMRLLSP | 96.02 | HATFTTRLLSS | 3.72 | | | | |
| NS3 | 1741 | 0.45 | 9 | 3 | 0 | Y | ATFTMRLLSPV | 93.10 | ATFTRLLSST | 3.72 | ATFTMRLLSPI | 2.84 | | |
| NS3 | 1742 | 0.45 | 8 | 3 | 0 | Y | TFTMRLLSPVR | 93.14 | TFTTRLLSSTR | 3.72 | TFTMRLLSPIR | 2.84 | | |
| NS3 | 1743 | 0.44 | 7 | 3 | 0 | Y | FTMRLLSPVRV | 93.22 | FTTRLLSSTRV | 3.72 | FTMRLLSPIRV | 2.84 | | |
| NS3 | 1744 | 0.45 | 8 | 3 | 0 | Y | TMRLLSPVRVP | 93.18 | TTRLLSSTRVP | 3.72 | TMRLLSPIRVP | 2.84 | | |
| NS3 | 1745 | 0.45 | 8 | 3 | 0 | Y | MRLLSPVRVPN | 93.18 | TRLLSSTRVPN | 3.72 | MRLLSPIRVPN | 2.84 | | |
| NS3 | 1746 | 0.45 | 8 | 3 | 0 | Y | RLLSPVRVPNY | 93.18 | RLLSSTRVPNY | 3.72 | RLLSPIRVPNY | 2.84 | | |
| NS3 | 1747 | 0.44 | 7 | 3 | 0 | Y | LLSPVRVPNYN | 93.18 | LLSSTRVPNYN | 3.80 | LLSPIRVPNYN | 2.84 | | |
| NS3 | 1748 | 1.37 | 8 | 4 | 0 | Y | LSPVRVPNYNL | 48.78 | LSPVRVPNYNM | 44.40 | LSPIRVPNYNL | 3.8 | LSPIRVPNYNL | 1.66 |
| NS3 | 1749 | 1.48 | 9 | 5 | 0 | Y | SPVRVPNYNLI | 47.12 | SPVRVPNYNMI | 44.40 | SPIRVPNYNLI | 3.8 | SPVRVPNYNLV | 1.62 |
| NS3 | 1750 | 1.52 | 12 | 5 | 0 | Y | PVRVPNYNLII | 46.64 | PVRVPNYNMII | 44.36 | PIRVPNYNLII | 3.8 | PVRVPNYNLVI | 1.62 |
| NS3 | 1751 | 1.52 | 12 | 5 | 0 | Y | VRVPNYNLIIM | 46.64 | VRVPNYNMIIM | 44.40 | IRVPNYNLIIM | 3.8 | VRVPNYNLVIM | 1.62 |
| NS3 | 1752 | 1.33 | 8 | 4 | 0 | Y | RVPNYNLIIMD | 49.48 | RVPNYNMIIMD | 44.47 | RVPNYNLVIMD | 4.28 | | |
| NS3 | 1753 | 1.33 | 8 | 4 | 0 | Y | VPNYNLIIMDE | 49.48 | VPNYNMIIMDE | 44.47 | VPNYNLVIMDE | 4.28 | | |
| NS3 | 1754 | 1.33 | 8 | 4 | 0 | Y | PNYNLIIMDEA | 49.48 | PNYNMIIMDEA | 44.47 | PNYNLVIMDEA | 4.28 | | |
| NS3 | 1755 | 1.33 | 7 | 4 | 0 | Y | NYNLIIMDEAH | 49.52 | NYNMIIMDEAH | 44.47 | NYNLVIMDEAH | 4.28 | | |
| NS3 | 1756 | 1.33 | 7 | 4 | 0 | Y | YNLIIMDEAHF | 49.52 | YNMIIMDEAHF | 44.47 | YNLVIMDEAHF | 4.28 | | |

FIG. 21-22

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1757 | 1.33 | 7 | 4 | 0 | Y | NLIIMDEAHFT | 49.52 | NMIIMDEAHFT | 44.47 | NLIVMDEAHFT | 1.62 | | |
| NS3 | 1758 | 1.33 | 7 | 4 | 0 | Y | LIIMDEAHFTD | 49.52 | MIIMDEAHFTD | 44.47 | LIVMDEAHFTD | 1.62 | | |
| NS3 | 1759 | 0.38 | 5 | 3 | 0 | Y | IIMDEAHFTDP | 93.99 | IVMDEAHFTDP | 4.31 | | | | |
| NS3 | 1760 | 1.21 | 8 | 4 | 0 | Y | IMDEAHFTDPA | 62.13 | IMDEAHFTDPS | 33.33 | VMDEAHFTDPA | 0.55 | VMDEAHFTDPS | 3.43 |
| NS3 | 1761 | 1.01 | 7 | 2 | 0 | Y | MDEAHFTDPAS | 62.65 | MDEAHFTDPSS | 36.76 | | | | |
| NS3 | 1762 | 1.17 | 7 | 3 | 0 | Y | DEAHFTDPASI | 62.68 | DEAHFTDPSSI | 33.30 | | | DEAHFTDPSSV | 3.47 |
| NS3 | 1763 | 1.17 | 8 | 3 | 0 | Y | EAHFTDPASIA | 62.65 | EAHFTDPSSIA | 33.30 | | | EAHFTDPSSVA | 3.47 |
| NS3 | 1764 | 1.18 | 10 | 3 | 0 | Y | AHFTDPASIAA | 62.57 | AHFTDPSSIAA | 33.26 | | | AHFTDPSSVAA | 3.47 |
| NS3 | 1765 | 1.18 | 10 | 3 | 0 | Y | HFTDPASIAAR | 62.57 | HFTDPSSIAAR | 33.26 | | | HFTDPSSVAAR | 3.47 |
| NS3 | 1766 | 1.18 | 10 | 3 | 0 | Y | FTDPASIAARG | 62.57 | FTDPSSIAARG | 33.26 | | | FTDPSSVAARG | 3.47 |
| NS3 | 1767 | 1.18 | 10 | 3 | 0 | Y | TDPASIAARGY | 62.57 | TDPSSIAARGY | 33.26 | | | TDPSSVAARGY | 3.47 |
| NS3 | 1768 | 1.18 | 10 | 3 | 0 | Y | DPASIAARGYI | 62.57 | DPSSIAARGYI | 33.26 | | | DPSSVAARGYI | 3.47 |
| NS3 | 1769 | 1.18 | 10 | 3 | 0 | Y | PASIAARGYIS | 62.57 | PSSIAARGYIS | 33.26 | | | PSSVAARGYIS | 3.47 |
| NS3 | 1770 | 1.18 | 10 | 3 | 0 | Y | ASIAARGYIST | 62.57 | SSIAARGYIST | 33.26 | | | SSVAARGYIST | 3.47 |
| NS3 | 1771 | 0.26 | 7 | 2 | 0 | Y | SIAARGYISTR | 62.57 | SVAARGYISTR | 3.83 | | | | |
| NS3 | 1772 | 0.26 | 6 | 2 | 0 | Y | IAARGYISTRV | 95.94 | VAARGYISTRV | 3.83 | | | | |
| NS3 | 1773 | 0.95 | 6 | 2 | 0 | Y | AARGYISTRVG | 95.98 | AARGYISTRVE | 34.62 | | | | |
| NS3 | 1774 | 0.95 | 5 | 2 | 0 | Y | ARGYISTRVGM | 65.19 | ARGYISTRVEM | 34.62 | | | | |
| NS3 | 1775 | 0.94 | 3 | 2 | 0 | Y | RGYISTRVGMG | 65.23 | RGYISTRVEMG | 34.62 | | | | |
| NS3 | 1776 | 0.94 | 3 | 2 | 0 | Y | GYISTRVGMGE | 65.34 | GYISTRVEMGE | 34.62 | | | | |
| NS3 | 1777 | 0.97 | 4 | 2 | 0 | Y | YISTRVGMGEA | 65.34 | YISTRVEMGEA | 34.62 | | | | |
| NS3 | 1778 | 0.97 | 6 | 2 | 0 | Y | ISTRVGMGEAA | 65.01 | ISTRVEMGEAA | 34.62 | | | | |
| NS3 | 1779 | 1.15 | 7 | 3 | 0 | Y | STRVGMGEAAA | 64.93 | STRVEMGEAAG | 30.83 | | | STRVEMGEAAA | 3.8 |
| NS3 | 1780 | 1.15 | 7 | 3 | 0 | Y | TRVGMGEAAAI | 64.93 | TRVEMGEAAGI | 30.83 | | | TRVEMGEAAAI | 3.8 |
| NS3 | 1781 | 1.15 | 7 | 3 | 0 | Y | RVGMGEAAAIF | 64.93 | RVEMGEAAGIF | 30.83 | | | RVEMGEAAAIF | 3.8 |

ENVall (11-mers)

FIG. 21-23

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1782 | 1.14 | 6 | 3 | 0 | Y | VGMGEAAAIFM | 64.97 | VEMGEAAGIFM | 30.83 | VEMGEAAAIFM | 3.8 | | |
| NS3 | 1783 | 1.14 | 6 | 3 | 0 | Y | GMGEAAAIFMT | 64.97 | EMGEAAGIFMT | 30.83 | EMGEAAAIFMT | 3.8 | | |
| NS3 | 1784 | 0.93 | 5 | 2 | 0 | Y | MGEAAAIFMTA | 68.77 | MGEAAGIFMTA | 30.83 | | | | |
| NS3 | 1785 | 0.94 | 6 | 2 | 0 | Y | GEAAAIFMTAT | 68.73 | GEAAGIFMTAT | 30.83 | | | | |
| NS3 | 1786 | 0.94 | 6 | 2 | 0 | Y | EAAAIFMTATP | 68.73 | EAAGIFMTATP | 30.83 | | | | |
| NS3 | 1787 | 0.94 | 6 | 2 | 0 | Y | AAAIFMTATPP | 68.73 | AAGIFMTATPP | 30.83 | | | | |
| NS3 | 1788 | 0.9 | 5 | 2 | 0 | Y | AAIFMTATPPG | 69.06 | AGIFMTATPPG | 30.83 | | | | |
| NS3 | 1789 | 1.69 | 6 | 4 | 0 | Y | AIFMTATPPGS | 44.84 | GIFMTATPPGS | 30.75 | AIFMTATPPGT | 21.05 | AIFMTATPPGA | 3.24 |
| NS3 | 1810 | 1.52 | 11 | 5 | 0 | Y | IQDEERDIPER | 64.16 | IMDEEREIPER | 19.76 | IIDEEREIPER | 10.55 | IEDIEREIPER | 3.8 |
| NS3 | 1811 | 1.52 | 11 | 5 | 0 | Y | QDEERDIPERS | 64.16 | MDEEREIPERS | 19.76 | IDEEREIPERS | 10.55 | EDIEREIPERS | 3.8 |
| NS3 | 1812 | 1.2 | 7 | 4 | 0 | Y | DEERDIPERSW | 64.20 | DEEREIPERSW | 30.79 | DIEREIPERSW | 3.8 | DEEKDIPERSW | 1.07 |
| NS3 | 1813 | 1.25 | 9 | 4 | 0 | Y | EERDIPERSWN | 64.12 | EEREIPERSWN | 30.20 | IE

FIG. 21-24

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1843 | 1.66 | 11 | 4 | 0 | Y | IKSGNDIANCL | 43.33 | IKAGNDIANCL | 29.46 | IKTGNDIAACL | 0.74 | | |
| NS3 | 1844 | 1.67 | 11 | 4 | 0 | Y | KSGNDIANCLR | 43.33 | KAGNDIANCLR | 29.42 | KTGNDIAACLR | 0.74 | | |
| NS3 | 1845 | 1.63 | 10 | 3 | 0 | Y | SGNDIANCLRK | 43.33 | AGNDIANCLRK | 30.01 | | | | |
| NS3 | 1846 | 1.13 | 9 | 3 | 0 | Y | GNDIANCLRKN | 65.23 | GNDIAACLRKS | 30.75 | | | | |
| NS3 | 1847 | 1.13 | 10 | 3 | 0 | Y | NDIANCLRKNG | 65.23 | NDIAACLRKSG | 30.72 | | | | |
| NS3 | 1848 | 1.13 | 10 | 3 | 0 | Y | DIANCLRKNGK | 65.23 | DIAACLRKSGK | 30.72 | | | | |
| NS3 | 1849 | 1.82 | 11 | 5 | 0 | Y | IANCLRKNGKR | 44.51 | IANCLRKNGKK | 29.28 | IANCLRKSGKK | 3.43 | IAACLRKNGKR | 1.44 |
| NS3 | 1850 | 1.81 | 10 | 5 | 0 | Y | ANCLRKNGKRV | 44.54 | ANCLRKNGKKV | 29.28 | ANCLRKSGKKV | 3.43 | AACLRKNGKRV | 1.44 |
| NS3 | 1852 | 1.28 | 8 | 4 | 0 | Y | CLRKNGKRVIQ | 50.11 | CLRKSGKKVIQ | 45.32 | CLRKNGKRVVQ | 0.7 | | |
| NS3 | 1853 | 1.28 | 8 | 4 | 0 | Y | LRKNGKRVIQL | 50.11 | LRKSGKKVIQL | 45.32 | LRKNGKRVWQL | 0.7 | | |
| NS3 | 1854 | 1.28 | 8 | 4 | 0 | Y | RKNGKRVIQLS | 50.11 | RKSGKKVIQLS | 45.32 | RKNGKRVVQLS | 0.7 | | |
| NS3 | 1855 | 1.27 | 7 | 4 | 0 | Y | KNGKRVIQLSR | 50.15 | KSGKKVIQLSR | 45.32 | KNGKRVVQLSR | 0.7 | | |
| NS3 | 1856 | 1.28 | 8 | 4 | 0 | Y | NGKRVIQLSRK | 50.15 | SGKKVIQLSRK | 45.21 | NGKRVVQLSRK | 0.7 | | |
| NS3 | 1857 | 1.07 | 6 | 2 | 0 | Y | GKRVIQLSRKT | 53.54 | | | | | | |
| NS3 | 1858 | 1.06 | 5 | 2 | 0 | Y | KRVIQLSRKTF | 53.58 | | | | | | |
| NS3 | 1859 | 1.08 | 8 | 3 | 0 | Y | RVIQLSRKTFD | 53.47 | RVVQLSRKTFD | 0.7 | | | | |
| NS3 | 1860 | 0.99 | 8 | 3 | 0 | Y | VIQLSRKTFDT | 68.69 | WQLSRKTFDT | 0.74 | | | | |
| NS3 | 1861 | 0.99 | 8 | 3 | 0 | Y | IQLSRKTFDTE | 68.69 | VQLSRKTFDTE | 0.74 | | | | |
| NS3 | 1862 | 0.93 | 7 | 2 | 0 | Y | QLSRKTFDTEY | 69.43 | | | | | | |
| NS3 | 1863 | 1.29 | 12 | 5 | 0 | Y | LSRKTFDTEYQ | 65.08 | LSRKTFDTEYP | 3.8 | LSRKTFDSEYI | 1.18 | LSRKTFDSEYA | 0.29 |
| NS3 | 1864 | 1.29 | 13 | 5 | 0 | Y | SRKTFDTEYQK | 65.04 | SRKTFDTEYPK | 3.8 | SRKTFDSEYIK | 1.18 | SRKTFDSEYAK | 0.29 |
| NS3 | 1877 | 2.05 | 13 | 5 | 0 | Y | NNDWDYWTTD | 44.47 | LNDWDFWTTD | 20.76 | ANDWDFWTTD | 14.6 | LTDWDFWTTD | 3.8 |
| NS3 | 1878 | 1.21 | 8 | 3 | 0 | Y | NDWDYWTTDI | 51.51 | NDWDFWTTDI | 44.51 | TDWDFWTTDI | 3.8 | | |
| NS3 | 1879 | 1.01 | 6 | 2 | 0 | Y | DWDYWTTDIS | 55.35 | DWDFWTTDIS | 44.51 | | | | |
| NS3 | 1880 | 1 | 5 | 2 | 0 | Y | WDYWTTDISE | 55.38 | WDFWTTDISE | 44.51 | | | | |

FIG. 21-25

ENVall (11-mers)

| protein | block start position | block entropy | total peptides in block | # peptides required to cover 99% of block | gap/X fraction | 99% of block covered w/ <= 5 peptides? | cover 99% of block | frequency | cover 99% of block | frequency | cover 99% of block | frequency | cover 99% of block | frequency |
|---|---|---|---|---|---|---|---|---|---|---|---|---|---|---|
| NS3 | 1881 | 1 | 5 | 2 | 0 | Y | DFWTTDISEM | 55.38 | DYWTTDISEM | 44.51 | | | | |
| NS3 | 1882 | 1 | 5 | 2 | 0 | Y | FWTTDISEMG | 55.38 | YWTTDISEMG | 44.51 | | | | |
| NS3 | 1883 | 0.01 | 4 | 1 | 0 | Y | WTTDISEMGA | 99.89 | | | | | | |
| NS3 | 1884 | 0.01 | 3 | 1 | 0 | Y | VTTDISEMGAN | 99.93 | | | | | | |
| NS3 | 1885 | 0 | 1 | 1 | 0 | Y | TTDISEMGANF | 100.00 | | | | | | |
| NS3 | 1886 | 1 | 3 | 2 | 0 | Y | TDISEMGANFR | 52.14 | TDISEMGANFK | 47.82 | | | | |
| NS3 | 1887 | 1.01 | 5 | 2 | 0 | Y | DISEMGANFRA | 52.14 | DISEMGANFKA | 47.75 | | | | |
| NS3 | 1888 | 1.88 | 9 | 5 | 0 | Y | ISEMGANFRAD | 44.54 | ISEMGANFKAE | 27.06 | ISEMGANFKAD | 20.69 | ISEMGANFRAE | 3.69 |
| NS3 | 1889 | 1.88 | 9 | 5 | 0 | Y | SEMGANFRADR | 44.54 | SEMGANFKAER | 27.06 | SEMGANFKADR | 20.69 | SEMGANFRAER | 3.69 |
| NS3 | 1890 | 1.88 | 9 | 5 | 0 | Y | EMGANFRADRV | 44.54 | EMGANFKAERV | 27.06 | EMGANFKADRV | 20.69 | EMGANFRAERV | 3.69 |
| NS3 | 1891 | 1.88 | 10 | 5 | 0 | Y | MGANFRADRVI | 44.51 | MGANFRAERVI | 27.06 | MGANFKADRVI | 20.69 | MGANFRAERVI | 3.69 |
| NS3 | 1892 | 1.88 | 10 | 5 | 0 | Y | GANFRADRVID | 44.51 | GANFKAERVID | 27.06 | GANFKADRVID | 20.69 | GANFRAERVID | 3.69 |
| NS3 | 1893 | 1.88 | 10 | 5 | 0 | Y | ANFRADRVIDP | 44.51 | ANFKAERVIDP | 27.06 | ANFKADRVIDP | 20.69 | ANFRAERVIDP | 3.69 |
| NS3 | 1894 | 1.88 | 10 | 5 | 0 | Y | NFRADRVIDPR | 44.51 | NFKAERVIDPR | 27.06 | NFKADRVIDPR | 20.69 | NFRAERVIDPR | 3.69 |
| NS3 | 1895 | 1.88 | 10 | 5 | 0 | Y | FRADRVIDPRR | 44.51 | FKAERVIDPRR | 27.06 | FKADRVIDPRR | 20.69 | FRAERVIDPRR | 3.69 |
| NS3 | 1896 | 1.88 | 10 | 5 | 0 | Y | RADRVIDPRRC | 44.51 | KAERVIDPRRC | 27.06 | KADRVIDPRRC | 20.69 | RAERVIDPRRC | 3.69 |
| NS3 | 1897 | 1.14 | 8 | 3 | 0 | Y | ADRVIDPRRCL | 65.15 | AERVIDPRRCM | 30.75 | AGRVIDPRRCL | 3.8 | | |
| NS3 | 1898 | 1.13 | 6 | 3 | 0 | Y | DRVIDPRRCLK | 65.23 | ERVIDPRRCMK | 30.75 | GRVIDPRRCLK | 3.8 | | |
| NS3 | 1899 | 0.9 | 3 | 2 | 0 | Y | RVIDPRRCLKP | 69.14 | RVIDPRRCMKP | 30.83 | | | | |
| NS3 | 1900 | 0.9 | 4 | 2 | 0 | Y | VIDPRRCLKPV | 69.10 | VIDPRRCMKPV | 30.83 | | | | |
| NS3 | 1901 | 0.9 | 4 | 2 | 0 | Y | IDPRRCLKPVI | 69.10 | IDPRRCMKPVI | 30.83 | | | | |
| NS3 | 1902 | 0.91 | 4 | 2 | 0 | Y | DPRRCLKPVIL | 68.99 | DPRRCMKPVIL | 30.83 | | | | |
| NS3 | 1903 | 1.6 | 8 | 3 | 0 | Y | PRRCLKPVILK | 44.43 | PRRCMKPVILT | 30.75 | PRRCL

FIG. 21-26

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1906 | 1.65 | 16 | 4 | 0 | Y | CLKPVILKDGP | 44.25 | CMKPVILTDGE | 30.46 | CLKPVILTDGP | 24.08 | | 0.41 |
| NS3 | 1907 | 1.65 | 16 | 4 | 0 | Y | LKPVILKDGPE | 44.25 | MKPVILTDGEE | 30.46 | LKPVILTDGPE | 24.08 | | 0.41 |
| NS3 | 1908 | 1.65 | 16 | 4 | 0 | Y | KPVILKDGPER | 44.25 | KPVILTDGEER | 30.46 | KPVILTDGPER | 24.08 | | 0.41 |
| NS3 | 1909 | 1.65 | 16 | 4 | 0 | Y | PVILKDGPERV | 44.25 | PVILTDGEERV | 30.46 | PVILTDGPERV | 24.08 | | 0.41 |
| NS3 | 1910 | 1.69 | 18 | 5 | 0 | Y | VILKDGPERVI | 44.25 | VILTDGEERVI | 29.98 | VILTDGPERVI | 24.08 | VILPDGPERVI | 0.41 |
| NS3 | 1911 | 1.69 | 17 | 5 | 0 | Y | ILKDGPERVIL | 44.28 | ILTDGEERVIL | 29.98 | ILTDGEERVVL | 24.08 | ILPDGPERVIL | 0.41 |
| NS3 | 1912 | 1.69 | 17 | 5 | 0 | Y | LKDGPERVILA | 44.28 | LTDGEERVILA | 29.98 | LTDGEERVILA | 24.08 | LPDGPERVILA | 0.41 |
| NS3 | 1913 | 1.67 | 15 | 5 | 0 | Y | KDGPERVILAG | 44.36 | TDGEERVILAG | 29.98 | TDGEERVILAG | 24.15 | PDGPERVILAG | 0.41 |
| NS3 | 1914 | 0.99 | 11 | 3 | 0 | Y | DGPERVILAGP | 68.92 | DGEERVILAGP | 30.05 | DGEERVILAGP | 0.48 | | |
| NS3 | 1915 | 1.17 | 8 | 3 | 0 | Y | GPERVILAGPM | 65.12 | GEERVILAGPM | 30.24 | GPERVILAGPI | 3.87 | | |
| NS3 | 1916 | 1.17 | 8 | 3 | 0 | Y | PERVILAGPMP | 65.12 | EERVILAGPMP | 30.31 | PERVILAGPIP | 3.87 | | |
| NS3 | 1917 | 0.29 | 5 | 2 | 0 | Y | ERVILAGPMPV | 95.54 | ERVILAGPIPV | 3.91 | | | | |
| NS3 | 1918 | 0.29 | 5 | 2 | 0 | Y | RVILAGPMPVT | 95.54 | RVILAGPIPVT | 3.91 | | | | |
| NS3 | 1919 | 1.72 | 8 | 4 | 0 | Y | VILAGPMPVTV | 46.83 | VILAGPMPVTH | 30.27 | VILAGPMPVTA | 18.44 | VILAGPIPVTP | 3.8 |
| NS3 | 1920 | 1.74 | 9 | 4 | 0 | Y | ILAGPMPVTVA | 46.83 | ILAGPMPVTHS | 30.05 | ILAGPMPVTAA | 18.44 | ILAGPIPVTPA | 3.8 |
| NS3 | 1921 | 1.71 | 9 | 4 | 0 | Y | LAGPMPVTVAS | 46.83 | LAGPMPVTHSS | 30.49 | LAGPMPVTAAS | 18.44 | LAGPIPVTPAS | 3.8 |
| NS3 | 1922 | 1.71 | 9 | 4 | 0 | Y | AGPMPVTVASA | 46.83 | AGPMPVTHSSA | 30.49 | AGPMPVTAASA | 18.44 | AGPIPVTPASA | 3.8 |
| NS3 | 1923 | 1.71 | 9 | 4 | 0 | Y | GPMPVTVASAA | 46.83 | GPMPVTHSSAA | 30.49 | GPMPVTAASAA | 18.44 | GPIPVTPASAA | 3.8 |
| NS3 | 1924 | 1.71 | 9 | 4 | 0 | Y | PMPVTVASAAQ | 46.83 | PMPVTHSSAAQ | 30.49 | PMPVTAASAAQ | 18.44 | PIPVTPASAAQ | 3.8 |
| NS3 | 1925 | 1.71 | 9 | 4 | 0 | Y | MPVTVASAAQR | 46.83 | MPVTHSSAAQR | 30.49 | MPVTAASAAQR | 18.44 | IPVTPASAAQR | 3.8 |
| NS3 | 1926 | 1.7 | 9 | 4 | 0 | Y | PVTVASAAQRR | 46.83 | PVTHSSAAQRR | 30.49 | PVTAASAAQRR | 18.44 | PVTPASAAQRR | 3.8 |
| NS3 | 1927 | 1.69 | 8 | 4 | 0 | Y | VTVASAAQRRG | 46.83 | VTHSSAAQRRG | 30.53 | VTAASAAQRRG | 18.55 | VTPASAAQRRG | 3.8 |
| NS3 | 1928 | 1.69 | 7 | 4 | 0 | Y | TVASAAQRRGR | 46.83 | THSSAAQRRGR | 30.57 | TAASAAQRRGR | 18.55 | TPASAAQRRGR | 3.8 |
| NS3 | 1930 | 1.61 | 6 | 4 | 0 | Y | ASAAQRRGRIG | 48.30 | SSAAQRRGRIG | 29.09 | ASAAQRRGRVG | 18.55 | SSAAQRRGRVG | 1.47 |
| NS3 | 1931 | 0.77 | 3 | 2 | 0 | Y | SAAQRRGRIGR | 77.62 | SAAQRRGRVGR | 22.35 | | | | |

FIG. 21-27

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1932 | 0.79 | 4 | 2 | 0 | Y | AAQRGRIGRN | 77.43 | AAQRGRVGRN | 22.38 | | | | |
| NS3 | 1933 | 1.95 | 12 | 4 | 0 | Y | AQRGRIGRNP | 33.08 | AQRGRIGRNH | 32.74 | AQRGRVGRNP | 22.23 | AQRGRIGRNQ | 11.36 |
| NS3 | 1945 | 2.08 | 12 | 5 | 0 | Y | KEGDQYIYMGQ | 35.44 | NENDQYIYMGE | 30.64 | KENDQYIFTGQ | 20.28 | KEGDQYYMGQ | 9.03 |
| NS3 | 1946 | 2.08 | 12 | 5 | 0 | Y | EGDQYIYMGQP | 35.44 | ENDQYIYMGEP | 30.64 | ENDQYIFTGQP | 20.28 | EGDQYYMGQP | 9.03 |
| NS3 | 1947 | 2.09 | 13 | 5 | 0 | Y | GDQYIYMGQPL | 35.36 | NDQYIYMGEPL | 30.68 | NDQYIFTGQPL | 20.28 | GDQYYMGQPL | 9.03 |
| NS3 | 1952 | 1.8 | 16 | 5 | 0 | Y | YMGQPLNNDED | 44.06 | YMGEPLENDED | 30.72 | FTGQPLNNDED | 20.32 | FSGDPLKNDED | 3.69 |
| NS3 | 1953 | 1.77 | 15 | 4 | 0 | Y | MGQPLNNDEDH | 44.43 | MGEPLENDEDC | 30.72 | TGQPLNNDEDH | 20.32 | SGDPLKNDEDH | 3.69 |
| NS3 | 1954 | 1.18 | 13 | 3 | 0 | Y | GQPLNNDEDHA | 64.79 | GEPLENDEDCA | 30.72 | GDPLKNDEDHA | 3.69 | | |
| NS3 | 1955 | 1.2 | 15 | 3 | 0 | Y | QPLNNDEDHAH | 64.75 | EPLENDEDCAH | 30.60 | DPLKNDEDHAH | 3.69 | | |
| NS3 | 1956 | 1.18 | 14 | 3 | 0 | Y | PLNNDEDHAHW | 64.75 | PLENDEDCAHW | 30.60 | PLKNDEDHAHW | 3.98 | | |
| NS3 | 1957 | 1.18 | 14 | 3 | 0 | Y | LNNDEDHAHWT | 64.75 | LENDEDCAHWK | 30.60 | LKNDEDHAHWT | 3.98 | | |
| NS3 | 1958 | 1.17 | 12 | 3 | 0 | Y | NNDEDHAHWTE | 64.86 | ENDEDCAHWKE | 30.60 | KNDEDHAHWTE | 3.98 | | |
| NS3 | 1959 | 0.94 | 9 | 2 | 0 | Y | NDEDHAHWTEA | 68.99 | NDEDCAHWKEA | 30.60 | | | | |
| NS3 | 1960 | 0.92 | 7 | 2 | 0 | Y | DEDHAHWTEAK | 69.10 | DEDCAHWKEAK | 30.64 | | | | |
| NS3 | 1961 | 0.92 | 6 | 2 | 0 | Y | EDHAHWTEAKM | 69.10 | EDCAHWKEAKM | 30.64 | | | | |
| NS3 | 1962 | 0.91 | 5 | 2 | 0 | Y | DHAHWTEAKML | 69.10 | DCAHWKEAKML | 30.68 | | | | |
| NS3 | 1963 | 0.91 | 4 | 2 | 0 | Y | HAHWTEAKMLL | 69.06 | CAHWKEAKMLL | 30.72 | | | | |
| NS3 | 1964 | 0.91 | 5 | 2 | 0 | Y | AHWTEAKMLLD | 69.06 | AHWKEAKMLLD | 30.72 | | | | |
| NS3 | 1965 | 0.91 | 5 | 2 | 0 | Y | HWTEAKMLLDN | 69.06 | HWKEAKMLLDN | 30.72 | | | | |
| NS3 | 1966 | 0.91 | 6 | 2 | 0 | Y | WTEAKMLLDNI | 69.03 | WKEAKMLLDNI | 30.83 | | | | |
| NS3 | 1967 | 1.13 | 8 | 3 | 0 | Y | TEAKMLLDNIN | 65.19 | KEAKMLLDNIN | 30.83 | TEAKMLLDNIY | 3.8 | | |
| NS3 | 1968 | 0.26 | 7 | 2 | 0 | Y | EAKMLLDNINT | 96.02 | EAKMLLDNIYT | 3.80 | | | | |
| NS3 | 1969 | 0.26 | 7 | 2 | 0 | Y | AKMLLDNINTP | 96.02 | AKMLLDNIYTP | 3.80 | | | | |
| NS3 | 1970 | 0.26 | 7 | 2 | 0 | Y | KMLLDNINTPE | 96.02 | KMLLDNIYTPE | 3.80 | | | | |
| NS3 | 1971 | 0.27 | 8 | 2 | 0 | Y | MLLDNINTPEG | 95.94 | MLLDNIYTPEG | 3.80 | | | | |

ENVall (11-mers)

FIG. 21-28

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1972 | 0.27 | 8 | 2 | 0 | Y | LLDNINTPEGI | 95.94 | LLDNIYTPEGI | 3.80 | | | | |
| NS3 | 1973 | 0.27 | 10 | 2 | 0 | Y | LDNINTPEGII | 95.87 | LDNIYTPEGII | 3.80 | | | | |
| NS3 | 1974 | 0.27 | 10 | 2 | 0 | Y | DNINTPEGIIP | 95.87 | DNIYTPEGIIP | 3.80 | | | | |
| NS3 | 1975 | 1.14 | 10 | 3 | 0 | Y | NINTPEGIIPA | 65.08 | NINTPEGIIPS | 30.83 | NINTPEGIIPT | 3.8 | | |
| NS3 | 1976 | 1.15 | 11 | 3 | 0 | Y | INTPEGIIPAL | 65.08 | INTPEGIIPSM | 30.68 | IYTPEGIIPTL | 3.8 | | |
| NS3 | 1977 | 1.15 | 9 | 3 | 0 | Y | NTPEGIIPALF | 65.12 | NTPEGIIPSMF | 30.68 | YTPEGIIPTLF | 3.8 | | |
| NS3 | 1978 | 1.15 | 10 | 3 | 0 | Y | TPEGIIPALFE | 65.12 | TPEGIIPSMFE | 30.60 | TPEGIIPTLFG | 3.8 | | |
| NS3 | 1979 | 1.15 | 10 | 3 | 0 | Y | PEGIIPALFEP | 65.12 | PEGIIPSMFEP | 30.60 | PEGIIPTLFGP | 3.8 | | |
| NS3 | 1980 | 1.15 | 10 | 3 | 0 | Y | EGIIPALFEPE | 65.12 | EGIIPSMFEPE | 30.60 | EGIIPTLFGPE | 3.8 | | |
| NS3 | 1981 | 1.15 | 10 | 3 | 0 | Y | GIIPALFEPER | 65.12 | GIIPSMFEPER | 30.60 | GIIPTLFGPER | 3.8 | | |
| NS3 | 1982 | 1.15 | 10 | 3 | 0 | Y | IIPALFEPERE | 65.12 | IIPSMFEPERE | 30.60 | IIPTLFGPERE | 3.8 | | |
| NS3 | 1983 | 1.16 | 11 | 3 | 0 | Y | IPALFEPEREK | 65.12 | IPSMFEPEREK | 30.60 | IPTLFGPEREK | 3.8 | | |
| NS3 | 1984 | 1.16 | 12 | 3 | 0 | Y | PALFEPEREKS | 65.15 | PSMFEPEREKV | 30.60 | PTLFGPEREKT | 3.69 | | |
| NS3 | 1985 | 1.16 | 13 | 3 | 0 | Y | ALFEPEREKSA | 65.12 | SMFEPEREKVD | 30.60 | TLFGPEREKTQ | 3.69 | | |
| NS3 | 1986 | 1.16 | 13 | 3 | 0 | Y | LFEPEREKSAA | 65.12 | MFEPEREKVDA | 30.60 | LFGPEREKTQA | 3.69 | | |
| NS3 | 1987 | 1.32 | 14 | 4 | 0 | Y | FEPEREKSAAI | 62.94 | FEPEREKVDAI | 30.35 | FGPEREKTQAI | 3.69 | FEPEREKSAAV | 2.18 | |
| NS3 | 1988 | 1.31 | 13 | 4 | 0 | Y | EPEREKSAAID | 63.02 | EPEREKVDAID | 30.35 | GPEREKTQAID | 3.69 | EPEREKSAAVD | 2.18 | |
| NS3 | 1989 | 1.3 | 12 | 4 | 0 | Y | PEREKSAAIDG | 63.02 | PEREKVDAIDG | 30.42 | PEREKTQAIDG | 3.69 | PEREKSAAVDG | 2.18 | |
| NS3 | 1990 | 1.31 | 13 | 4 | 0 | Y | EREKSAAIDGE | 62.98 | EREKVDAIDGE | 30.42 | EREKTQAIDGE | 3.69 | EREKSAAVDGE | 2.18 | |
| NS3 | 1991 | 1.31 | 14 | 4 | 0 | Y | REKSAAIDGEY | 62.94 | REKVDAIDGEY | 30.42 | REKTQAIDGEY | 3.69 | REKSAAVDGEY | 2.18 | |
| NS3 | 1992 | 1.31 | 14 | 4 | 0 | Y | EKSAAIDGEYR | 62.94 | EKVDAIDGEYR | 30.42 | EKTQAIDGEFR | 3.69 | EKSAAVDGEYR | 2.18 | |
| NS3 | 1993 | 1.31 | 13 | 4 | 0 | Y | KSAAIDGEYRL | 62.98 | KVDAIDGEYRL | 30.42 | KTQAIDGEFRL | 3.69 | KSAAVDGEYRL | 2.18 | |
| NS3 | 1994 | 1.88 | 14 | 5 | 0 | Y | SAAIDGEYRLR | 42.26 | VDAIDGEYRLR | 30.42 | SAAIDGEYRLK | 20.72 | TQAIDGEFRLR | 3.69 | SAAVDGEYRLR | 2.18 |
| NS3 | 1995 | 1.87 | 11 | 5 | 0 | Y | AAIDGEYRLRG | 42.29 | DAIDGEYRLRG | 30.42 | AAIDGEYRLKG | 20.72 | QAIDGEFRLRG | 3.8 | AAVDGEYRLRG | 2.18 |
| NS3 | 1996 | 1.14 | 8 | 4 | 0 | Y | AIDGEYRLRGE | 72.75 | AIDGEYRLKGE | 20.72 | AIDGEFRLRGE | 3.8 | AVDGEYRLRGE | 2.58 | |

ENVall (11-mers)

FIG. 21-29

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1997 | 1.15 | 10 | 4 | 0 | Y | IDGEYRLRGEA | 72.68 | IDGEYRLKGES | 20.72 | IDGEFRLRGEQ | 3.8 | VDGEYRLRGEA | 2.58 |
| NS3 | 1998 | 0.98 | 9 | 3 | 0 | Y | DGEYRLRGEAR | 75.26 | DGEYRLKGESR | 20.72 | DGEFRLRGEQR | 3.8 | | |
| NS3 | 1999 | 1 | 11 | 3 | 0 | Y | GEYRLRGEARK | 75.15 | GEYRLKGESRK | 20.72 | GEFRLRGEQRK | 3.8 | | |
| NS3 | 2000 | 0.99 | 10 | 3 | 0 | Y | EYRLRGEARKT | 75.15 | EYRLKGESRKT | 20.76 | EFRLRGEQRKT | 3.8 | | |
| NS3 | 2001 | 0.99 | 9 | 3 | 0 | Y | YRLRGEARKTF | 75.18 | YRLKGESRKTF | 20.72 | FRLRGEQRKTF | 3.8 | | |
| NS3 | 2002 | 0.99 | 9 | 3 | 0 | Y | RLRGEARKTFV | 75.18 | RLKGESRKTFV | 20.72 | RLRGEQRKTFV | 3.8 | | |
| NS3 | 2003 | 1.72 | 10 | 4 | 0 | Y | LRGEARKTFVE | 44.54 | LKGESRKTFVE | 30.64 | LRGEQRKTFVE | 20.72 | | |
| NS3 | 2004 | 1.72 | 9 | 4 | 0 | Y | RGEARKTFVEL | 44.54 | KGESRKTFVEL | 30.64 | RGEQRKTFVEL | 20.76 | | |
| NS3 | 2005 | 1.72 | 9 | 4 | 0 | Y | GEARKTFVELM | 44.54 | GESRKTFVELM | 30.60 | GEQRKTFVELM | 20.8 | | |
| NS3 | 2006 | 1.77 | 12 | 4 | 0 | Y | EARKTFVELMR | 44.51 | ESRKTFVELMR | 30.09 | EQRKTFVELMR | 20.8 | | |
| NS3 | 2007 | 1.77 | 12 | 4 | 0 | Y | ARKTFVELMRR | 44.51 | SRKTFVELMRR | 30.09 | QRKTFVELMRR | 20.8 | | |
| NS3 | 2008 | 0.96 | 8 | 2 | 0 | Y | RKTFVELMRRG | 69.10 | RKTFVDLMRRG | 30.09 | | | | |
| NS3 | 2009 | 0.97 | 10 | 2 | 0 | Y | KTFVELMRRGD | 68.99 | KTFVDLMRRGD | 30.09 | | | | |
| NS3 | 2010 | 0.96 | 8 | 2 | 0 | Y | TFVELMRRGDL | 68.99 | TFVDLMRRGDL | 30.20 | | | | |
| NS3 | 2011 | 0.96 | 8 | 2 | 0 | Y | FVELMRRGDLP | 68.99 | FVDLMRRGDLP | 30.20 | | | | |
| NS3 | 2012 | 0.96 | 8 | 2 | 0 | Y | VELMRRGDLPV | 68.99 | VDLMRRGDLPV | 30.20 | | | | |
| NS3 | 2013 | 0.96 | 7 | 2 | 0 | Y | ELMRRGDLPVW | 69.03 | DLMRRGDLPVW | 30.20 | | | | |
| NS3 | 2014 | 0.07 | 5 | 1 | 0 | Y | LMRRGDLPVWL | 99.23 | | | | | | |
| NS3 | 2015 | 1.07 | 7 | 2 | 0 | Y | MRRGDLPVWLA | 50.96 | MRRGDLPVWLS | 48.27 | | | | |
| NS3 | 2016 | 1.63 | 9 | 5 | 0 | Y | RRGDLPVWLSY | 47.68 | RRGDLPVWLAY | 30.57 | RRGDLPVWLAH | 20.1 | RRGDLPVWLSH | 0.63 | RRGDLPVWLAY | 0.52 |
| NS3 | 2017 | 1.87 | 9 | 5 | 0 | Y | RGDLPVWLSYK | 47.79 | RGDLPVWLAYK | 20.61 | RGDLPVWLAHK | 20.1 | RGDLPVWLAYR | 10.44 | RGDLPVWLSHK | 0.63 |
| NS3 | 2018 | 1.87 | 9 | 5 | 0 | Y | GDLPVWLSYKV | 47.79 | GDLPVWLAYKV | 20.61 | GDLPVWLAHKV | 20.1 | GDLPVWLAYRV | 10.44 | GDLPVWLSHKV | 0.63 |
| NS3 | 2019 | 1.88 | 10 | 5 | 0 | Y | DLPVWLSYKVA | 47.75 | DLPVWLAYKVA | 20.61 | DLPVWLAHKVA | 20.1 | DLPVWLAYRVA | 10.44 | DLPVWLSHKVA | 0.63 |
| NS3 | 2020 | 1.94 | 9 | 5 | 0 | Y | LPVWLSYKVAS | 47.75 | LPVWLAYKVAS | 20.21 | LPVWLAHKVAA | 20.1 | LPVWLAYRVAA | 10.44 | LPVWLAYKVAS | 1.44 |
| NS3 | 2047 | 1.88 | 12 | 4 | 0 | Y | NNQILEENMDV | 44.40 | NNQILEENVEV | 23.30 | NNQILEENMDV | 20.76 | NNQILEENMEV | 11.06 | | |

FIG. 21-30

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2048 | 1.88 | 11 | 4 | 0 | Y | NQILEENMDVE | 44.40 | NQILEENMEVE | 23.30 | NQILEENMEVE | 20.8 | NQILEENMEVEV | 11.06 | | |
| NS3 | 2049 | 1.92 | 14 | 5 | 0 | Y | QVLEENMDVEI | 44.32 | QILEENVEVEI | 23.30 | QILEENMDVEI | 20.8 | QILEENMEVEI | 10.55 | QILEENMEVEV | 0.52 |
| NS3 | 2050 | 1.92 | 14 | 5 | 0 | Y | VLEENMDVEIW | 44.32 | ILEENVEVEIW | 23.30 | ILEENMDVEIW | 20.8 | ILEENMEVEIW | 10.55 | ILEENMEVEVW | 0.52 |
| NS3 | 2051 | 1.34 | 15 | 4 | 0 | Y | LEENMDVEIWT | 65.04 | LEENVEVEIWT | 23.23 | LEENMEVEIWT | 10.55 | LEENMEVEIW | 0.52 | | |
| NS3 | 2052 | 1.44 | 16 | 5 | 0 | Y | EENMDVEIWTK | 65.04 | EENVEVEIWTK | 23.23 | EENMEVEIWT | 6.75 | EENMEVEIWTR | 3.8 | EENMEVEVTK | 0.52 |
| NS3 | 2053 | 1.45 | 17 | 5 | 0 | Y | ENMDVEIWTKE | 65.04 | ENVEVEIWTKE | 23.19 | ENMEVEIWTKE | 6.75 | ENMEVEIWTRE | 3.8 | ENMEVEVWTKE | 0.52 |
| NS3 | 2054 | 1.44 | 16 | 4 | 0 | Y | NMDVEIWTKEG | 65.08 | NVEVEIWTKEG | 23.19 | NMEVEIWTKEG | 6.75 | NMEVEIWTREG | 3.8 | NMEVEVWTKEG | 0.52 |
| NS3 | 2066 | 1.61 | 13 | 4 | 0 | Y | ERKKLRPWLD | 49.89 | ERKKKLRPWLD | 30.75 | EKKKLRPWLD | 17.22 | EKKKLRPKWLD | 1.73 | | |
| NS3 | 2067 | 1.61 | 13 | 3 | 0 | Y | RKKLRPRWLDA | 49.96 | RKKKLRPWLDA | 30.68 | KKKLRPWLDA | 17.22 | KKKLRPKWLDA | 1.73 | | |
| NS3 | 2068 | 1.05 | 12 | 5 | 0 | Y | KKLRPRWLDAR | 67.18 | KKLRPKWLDAR | 30.68 | KKLRPKWLDAR | 1.73 | | | | |
| NS3 | 2069 | 1.24 | 14 | 4 | 0 | Y | KLRPRWLDART | 65.01 | KLRPRWLDARI | 30.05 | KLRPRWLDARV | 2.18 | KLKPRWLDART | 0.63 | | |
| NS3 | 2070 | 1.22 | 12 | 5 | 0 | Y | LRPRWLDARTY | 65.12 | LRPRWLDARIY | 30.05 | LRPKWLDARV | 2.18 | | | | |
| NS3 | 2071 | 1.23 | 13 | 4 | 0 | Y | RPRWLDARTYS | 65.12 | KPRWLDARIYS | 30.05 | RPKWLDARYA | 2.06 | KPRWLDARTYS | 0.63 | | |
| NS3 | 2072 | 1.17 | 10 | 5 | 0 | Y | PRWLDARTYSD | 65.78 | PRWLDARIYSD | 30.09 | PKWLDARYAD | 2.06 | | | | |
| NS3 | 2073 | 1.17 | 10 | 4 | 0 | Y | RWLDARTYSDP | 65.78 | RWLDARIYSDP | 30.09 | KWLDARYADP | 2.06 | | | | |
| NS3 | 2074 | 1.14 | 10 | 3 | 0 | Y | WLDARTYSDPL | 65.74 | WLDARIYSDPL | 30.09 | WLDARYADPM | 3.8 | | | | |
| NS3 | 2075 | 1.15 | 11 | 3 | 0 | Y | LDARTYSDPLA | 65.74 | LDARIYSDPLA | 30.01 | LDARYADPMA | 3.8 | | | | |
| NS3 | 2076 | 1.15 | 12 | 3 | 0 | Y | DARTYSDPLAL | 65.67 | DARIYSDPLAL | 30.01 | DARYADPMAL | 3.8 | | | | |
| NS3 | 2077 | 1.76 | 15 | 4 | 0.07 | Y | ARTYSDPLALR | 44.25 | ARIYSDPLALK | 29.94 | ARTYSDPLALK | 21.35 | ARYADPMALK | 3.76 | | |
| NS3 | 2078 | 1.76 | 14 | 4 | 0.07 | Y | RTYSDPLALRE | 44.25 | RIYSDPLALKE | 29.98 | RTYSDPLALKE | 21.35 | RYADPMALKD | 3.76 | | |
| NS3 | 2079 | 1.75 | 14 | 3 | 0.07 | Y | TYSDPLALREF | 44.21 | IYSDPLALKEF | 30.05 | TYSDPLALKEF | 21.35 | VYADPMALKDF | 3.76 | | |
| NS3 | 2080 | 1.24 | 12 | 4 | 0.07 | Y | YSDPLALKEFK | 51.40 | YSDPLALKEFK | 44.32 | YADPMALKDFK | 3.76 | | | | |
| NS3 | 2081 | 1.74 | 13 | 4 | 0.07 | Y | SDPLALREFKE | 44.32 | SDPLALKEFKE | 44.32 | SDPLALKEFKD | 31.19 | ADPMALKDFKE | 3.76 | | |
| NS3 | 2082 | 1.74 | 13 | 4 | 0.07 | Y | DPLALREFKEF | 44.32 | DPLALKEFKEF | 44.32 | DPLALKEFKDF | 31.19 | DPMALKDFKEF | 3.76 | | |
| NS3 | 2083 | 1.74 | 13 | 4 | 0.07 | Y | PLALREFKEFA | 44.32 | PLALKEFKEFA | 44.32 | PLALKEFKDFA | 31.19 | PMALKDFKEFA | 3.76 | | |

FIG. 21-31

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2084 | 1.74 | 14 | 4 | 0.07 | Y | LALREFKEFAA | 44.28 | LALKEFKEFAA | 31.19 | LALKEFKDFAA | 20.21 | MALKDFKEFAS

FIG. 21-32

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2200 | 1.04 | 10 | 3 | 0 | Y | HWIAASIILEFF | 74.96 | QWIAASIVLEFF | 20.39 | QWIAASIILEF | 3.8 | | |
| NS4A | 2201 | 0.82 | 9 | 2 | 0 | Y | WIAASIILEFF | 78.76 | WIAASIVLEFF | 20.39 | | | | |
| NS4A | 2202 | 0.82 | 9 | 2 | 0 | Y | IAASIILEFFL | 78.76 | IASAIVLEFFM | 20.39 | | | | |
| NS4A | 2203 | 1.58 | 11 | 3 | 0 | Y | AASIILEFFLM | 48.23 | AASIILEFFLI | 30.49 | ASAIVLEFFMM | 20.39 | | |
| NS4A | 2204 | 1.58 | 12 | 3 | 0 | Y | ASIILEFFLMV | 48.23 | ASIILEFFLIV | 30.46 | SAIVLEFFMMV | 20.39 | | |
| NS4A | 2205 | 1.58 | 12 | 3 | 0 | Y | SIILEFFLMVL | 48.23 | SIILEFFLIVL | 30.46 | AIVLEFFMMVL | 20.39 | | |
| NS4A | 2206 | 1.58 | 12 | 3 | 0 | Y | IILEFFLMVLL | 48.23 | IILEFFLIVLI | 30.46 | IVLEFFMMVLL | 20.39 | | |
| NS4A | 2207 | 1.59 | 12 | 3 | 0 | Y | ILEFFLMVLLI | 48.08 | ILEFFLIVLLI | 30.46 | VLEFFMMVLLI | 20.46 | | |
| NS4A | 2208 | 1.55 | 8 | 3 | 0 | Y | LEFFLMVLLIP | 48.19 | LEFFLIVLLIP | 30.46 | LEFFMMVLLIP | 20.83 | | |
| NS4A | 2209 | 1.55 | 9 | 3 | 0 | Y | EFFLMVLLIPE | 48.19 | EFFLIVLLIPE | 30.46 | EFFMMVLLIPE | 20.8 | | |
| NS4A | 2210 | 1.53 | 7 | 4 | 0 | Y | FFLMVLLIPEP | 48.23 | FFLIVLLIPEP | 30.72 | FFMMVLLIPEP | 20.8 | | |
| NS4A | 2211 | 1.72 | 10 | 4 | 0 | Y | FLMVLLIPEPD | 44.51 | FLIVLLIPEPE | 30.72 | FMMVLLIPEPE | 20.8 | FLMVLLIPEPE | 3.72 |
| NS4A | 2212 | 1.74 | 10 | 3 | 0 | Y | LMVLLIPEPDR | 44.21 | LIVLLIPEPEK | 30.72 | MMVLLIPEPEK | 20.8 | LMVLLIPEPEK | 3.72 |
| NS4A | 2213 | 1.6 | 8 | 2 | 0 | Y | MVLLIPEPDRQ | 44.17 | MVLLIPEPEKQ | 30.72 | MVLLIPEPEKQ | 24.52 | | |
| NS4A | 2214 | 1.05 | 7 | 2 | 0 | Y | VLLIPEPEKQR | 55.27 | VLLIPEPDRQR | 44.17 | | | | |
| NS4A | 2215 | 1.04 | 7 | 2 | 0 | Y | LLIPEPEKQRT | 55.31 | LLIPEPDRQRT | 44.17 | | | | |
| NS4A | 2216 | 1.04 | 7 | 2 | 0 | Y | LIPEPEKQRTP | 55.31 | LIPEPDRQRTP | 44.17 | | | | |
| NS4A | 2217 | 1.04 | 5 | 2 | 0 | Y | IPEPEKQRTPQ | 55.31 | IPEPDRQRTPQ | 44.17 | | | | |
| NS4A | 2218 | 1.03 | 5 | 2 | 0 | Y | PEPEKQRTPQD | 55.42 | PEPDRQRTPQD | 44.21 | | | | |
| NS4A | 2219 | 1.03 | 5 | 2 | 0 | Y | EPEKQRTPQDN | 55.42 | EPDRQRTPQDN | 44.21 | | | | |
| NS4A | 2220 | 1.02 | 4 | 2 | 0 | Y | PEKQRTPQDNQ | 55.46 | PDRQRTPQDNQ | 44.21 | | | | |
| NS4A | 2221 | 1.02 | 5 | 2 | 0 | Y | EKQRTPQDNQL | 55.46 | DRQRTPQDNQL | 44.21 | | | | |
| NS4A | 2222 | 1.7 | 4 | 4 | 0 | Y | RQRTPQDNQLA | 44.21 | KQRTPQDNQLT | 30.83 | KQRTPQDNQLA | 21.13 | KQRTPQDNQLI | 3.8 |
| NS4A | 2223 | 1.11 | 5 | 3 | 0 | Y | QRTPQDNQLAY | 65.34 | QRTPQDNQLTY | 30.83 | QRTPQDNQLIY | 3.8 | | |
| NS4A | 2224 | 1.1 | 3 | 3 | 0 | Y | RTPQDNQLAYV | 65.38 | RTPQDNQLTYV | 30.83 | RTPQDNQLIYV | 3.8 | | |

FIG. 21-33

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2225 | 1.16 | 5 | 3 | 0 | Y | TPQDNQLAYYW | 65.34 | TPQDNQLTYW | 30.05 | TPQDNQLIYVI | 3.8 | | |
| 2K | 2226 | 1.16 | 6 | 3 | 0 | Y | PQDNQLAYYWI | 65.30 | PQDNQLTYWI | 30.05 | PQDNQLIYVIL | 3.8 | | |
| 2K | 2227 | 1.18 | 8 | 4 | 0 | Y | QDNQLAYYWIG | 65.27 | QDNQLTYWIA | 30.05 | QDNQLIYVILT | 3.54 | QDNQLTYVIIA | 0.77 | | |
| 2K | 2228 | 1.77 | 10 | 5 | 0 | Y | DNQLAYYVIGLL | 44.43 | DNQLTYVVIAI | 30.05 | DNQLAYYVIGI | 20.83 | DNQLIYVILTI | 3.54 | DNQLTYVIIAI | 0.77 |
| 2K | 2229 | 1.77 | 10 | 5 | 0 | Y | NQLAYYVIGLL | 44.43 | NQLTYVIAIL | 30.05 | NQLAYYVIGIL | 20.83 | NQLIYVILTIL | 3.54 | NQLTYVIIAIL | 0.77 |
| 2K | 2230 | 1.78 | 11 | 5 | 0 | Y | QLAYYVIGLLF | 44.43 | QLTYVIIALT | 30.05 | QLAYYVIGILT | 20.83 | QLIYVILTILT | 3.5 | QLTYVIIAILT | 0.77 |
| 2K | 2245 | 1.66 | 11 | 5 | 0 | Y | VAANEMGLLET | 51.55 | TMANEMGFLEK | 30.79 | IAANEMGLLET | 12.94 | IAANEMGLIEK | 3.61 | VTANEMGLLET | 0.66 |
| 2K | 2246 | 1.18 | 7 | 3 | 0 | Y | AANEMGLLETT | 64.53 | MANEMGFLEKT | 30.79 | AANEMGLLETT | 3.8 | | | |
| 2K | 2247 | 1.13 | 6 | 3 | 0 | Y | ANEMGLLETTK | 65.19 | ANEMGFLEKTK | 30.79 | ANEMGLIEKTK | 3.8 | | | |
| NS4B | 2248 | 1.73 | 8 | 4 | 0 | Y | NEMGLLETTKK | 44.51 | NEMGFLEKTKK | 30.68 | NEMGLLETTKR | 20.69 | NEMGLIEKTKT | 3.69 | | |
| NS4B | 2249 | 1.73 | 8 | 4 | 0 | Y | EMGLLETTKKD | 44.54 | EMGFLEKTKKD | 30.68 | EMGLLETTKRD | 20.65 | EMGLIEKTKTD | 3.69 | | |
| NS4B | 2250 | 1.85 | 10 | 5 | 0 | Y | MGLLETTKKDL | 44.54 | MGFLEKTKKDL | 30.68 | MGLLETTKRDL | 20.65 | MGLIEKTKDF | 3.69 | MGFLEKTKKDF | 2.25 |
| NS4B | 2251 | 1.85 | 10 | 5 | 0 | Y | GLLETTKKDLG | 44.54 | GFLEKTKKDLG | 28.43 | GLLETTKRDLG | 20.65 | GLIEKTKDFG | 3.69 | GFLEKTKDFG | 2.25 |
| NS4B | 2280 | 1.37 | 4 | 3 | 0 | Y | LDVDLHPASAW | 57.26 | LDIDLRPASAW | 30.83 | LDVDLRPASAW | 11.58 | | | | |
| NS4B | 2281 | 1.38 | 5 | 3 | 0 | Y | DVDLHPASAWT | 57.23 | DIDLRPASAWT | 30.83 | DVDLRPASAWT | 11.58 | | | | |
| NS4B | 2282 | 1.38 | 5 | 3 | 0 | Y | VDLHPASAWTL | 57.23 | IDLRPASAWTL | 30.83 | VDLRPASAWTL | 11.58 | | | | |
| NS4B | 2283 | 0.99 | 3 | 2 | 0 | Y | DLHPASAWTLY | 57.56 | DLRPASAWTLY | 42.40 | | | | | | |
| NS4B | 2284 | 0.99 | 3 | 2 | 0 | Y | LHPASAWTLYA | 57.56 | LRPASAWTLYA | 42.40 | | | | | | |
| NS4B | 2285 | 0.99 | 3 | 2 | 0 | Y | HPASAWTLYAV | 57.56 | RPASAWTLYAV | 42.40 | | | | | | |
| NS4B | 2286 | 0.01 | 3 | 1 | 0 | Y | PASAWTLYAVA | 99.93 | | | | | | | | |
| NS4B | 2287 | 0.01 | 3 | 1 | 0 | Y | ASAWTLYAVAT | 99.93 | | | | | | | | |
| NS4B | 2288 | 0.01 | 4 | 1 | 0 | Y | SAWTLYAVATT | 99.89 | | | | | | | | |
| NS4B | 2289 | 1.59 | 7 | 3 | 0.11 | Y | AWTLYAVATTI | 39.42 | AWTLYAVATTF | 30.72 | AWTLYAVATTV | 29.57 | | | | |
| NS4B | 2290 | 1.93 | 12 | 5 | 0.11 | Y | WTLYAVATTII | 35.73 | WTLYAVATTVI | 29.57 | WTLYAVATTFV | 27.4 | WTLYAVATTIL | 3.65 | WTLYAVATTFI | 3.17 |
| NS4B | 2291 | 1.93 | 12 | 5 | 0.11 | Y | TLYAVATTIIT | 35.73 | TLYAVATTVIT | 29.57 | TLYAVATTFVT | 27.4 | TLYAVATTILT | 3.65 | TLYAVATTFIT | 3.17 |

FIG. 21-34

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2292 | 1.93 | 11 | 5 | 0.11 | Y | LYAVATTIITP | 35.73 | LYAVATTVITP | 29.61 | LYAVATTVITP | 27.4 | LYAVATTFVTP | 3.65 | LYAVATTFITP | 3.17 |
| NS4B | 2293 | 1.93 | 12 | 5 | 0.11 | Y | YAVATTIITPM

FIG. 21-35

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| ENVall (11-mers) | | | | | | | | | | | | | | |
| NS4B | 2323 | 1.86 | 9 | 5 | 0 | Y | QAAILMGLDKG | 44.43 | QATVLMGLGKG | 27.69 | QAVLMGLDKG | 20.76 | QAAVLMGLG

FIG. 21-36

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2348 | 1.14 | 9 | 3 | 0 | Y | LGCYSQVNPLT | 65.38 | IGCYSQVNPIT | 30.53 | MGCYSQVNPTT | 3.76 | | |
| NS4B | 2349 | 1.13 | 8 | 3 | 0 | Y | GCYSQVNPLTL | 65.34 | GCYSQVNPITL | 30.53 | GCYSQVNPTTL | 3.87 | | |
| NS4B | 2350 | 1.21 | 11 | 4 | 0 | Y | CYSQVNPLTLI | 64.49 | CYSQVNPITLI | 30.53 | CYSQVNPTTLT | 3.8 | CYSQVNPLTLI | 0.7 | | |
| NS4B | 2351 | 1.22 | 13 | 4 | 0 | Y | YSQVNPLTLIA | 64.45 | YSQVNPITLIA | 30.49 | YSQVNPTTLTA | 3.8 | YSQVNPLTLIA | 0.7 | | |
| NS4B | 2352 | 1.27 | 18 | 5 | 0 | Y | SQVNPLTLIAA | 64.05 | SQVNPITLIAA | 30.46 | SQVNPTTLTAS | 3.72 | SQVNPLTLIAA | 0.7 | SQVNPLTLTAV | 0.22 |
| NS4B | 2353 | 1.27 | 19 | 5 | 0 | Y | QVNPLTLIAAV | 63.97 | QVNPITLIAAL | 30.49 | QVNPTTLTASL | 3.72 | QVNPLTLIAAV | 0.7 | QVNPLTLTAVV | 0.22 |
| NS4B | 2368 | 1 | 11 | 3 | 0 | Y | AHYAIIGPGLQ | 75.04 | THYAIIGPGLQ | 20.83 | VHYAIIGPGLQ | 3.8 | | |
| NS4B | 2369 | 0.04 | 8 | 1 | 0 | Y | HYAIIGPGLQA | 99.71 | | | | | | |
| NS4B | 2370 | 0.04 | 8 | 1 | 0 | Y | YAIIGPGLQAK | 99.71 | | | | | | |
| NS4B | 2371 | 0.04 | 8 | 1 | 0 | Y | AIIGPGLQAKA | 99.71 | | | | | | |
| NS4B | 2372 | 0.04 | 9 | 1 | 0 | Y | IIGPGLQAKAT | 99.67 | | | | | | |
| NS4B | 2373 | 0.05 | 10 | 1 | 0 | Y | IGPGLQAKATR | 99.63 | | | | | | |
| NS4B | 2374 | 0.04 | 9 | 1 | 0 | Y | GPGLQAKATRE | 99.67 | | | | | | |
| NS4B | 2375 | 0.03 | 7 | 1 | 0 | Y | PGLQAKATREA | 99.74 | | | | | | |
| NS4B | 2376 | 0.04 | 8 | 1 | 0 | Y | GLQAKATREAQ | 99.71 | | | | | | |
| NS4B | 2377 | 0.04 | 8 | 1 | 0 | Y | LQAKATREAQK | 99.71 | | | | | | |
| NS4B | 2378 | 0.03 | 7 | 1 | 0 | Y | QAKATREAQKR | 99.74 | | | | | | |
| NS4B | 2379 | 0.9 | 8 | 2 | 0 | Y | AKATREAQKRT | 70.91 | AKATREAQKRA | 28.83 | | | | |
| NS4B | 2380 | 0.9 | 8 | 2 | 0 | Y | KATREAQKRTA | 70.91 | KATREAQKRAA | 28.83 | | | | |
| NS4B | 2381 | 0.9 | 8 | 2 | 0 | Y | ATREAQKRTAA | 70.94 | ATREAQKRAAA | 28.80 | | | | |
| NS4B | 2382 | 0.9 | 8 | 2 | 0 | Y | TREAQKRTAAG | 70.94 | TREAQKRAAAG | 28.80 | | | | |
| NS4B | 2383 | 0.89 | 7 | 2 | 0 | Y | REAQKRTAAGI | 70.91 | REAQKRAAAGI | 28.91 | | | | |
| NS4B | 2384 | 0.89 | 7 | 2 | 0 | Y | EAQKRTAAGIM | 70.91 | EAQKRAAAGIM | 28.91 | | | | |
| NS4B | 2385 | 0.89 | 7 | 2 | 0 | Y | AQKRTAAGIMK | 70.91 | AQKRAAAGIMK | 28.91 | | | | |
| NS4B | 2386 | 0.89 | 7 | 2 | 0 | Y | QKRTAAGIMKN | 70.91 | QKRAAAGIMKN | 28.91 | | | | |

FIG. 21-37

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2387 | 0.88 | 5 | 2 | 0 | Y | KRTAAGIMKNP | 70.94 | KRAAAGIMKNP | 28.95 | | | | |
| NS4B | 2388 | 0.89 | 6 | 2 | 0 | Y | RTAAGIMKNPT | 70.94 | RAAAGIMKNPT | 28.91 | | | | |
| NS4B | 2389 | 0.97 | 7 | 3 | 0 | Y | TAAGIMKNPTV | 69.80 | AAAGIMKNPTV | 28.91 | TAAGIMKNPTI | 1.14 | | |
| NS4B | 2390 | 0.11 | 2 | 2 | 0 | Y | AAGIMKNPTVD | 98.71 | AAGIMKNPTID | 1.14 | | | | |
| NS4B | 2391 | 0.11 | 6 | 2 | 0 | Y | AGIMKNPTVDG | 98.71 | AGIMKNPTIDG | 1.14 | | | | |
| NS4B | 2392 | 0.16 | 7 | 2 | 0 | Y | GIMKNPTVDGI | 98.08 | GIMKNPTIDGI | 1.14 | | | | |
| NS4B | 2393 | 1.69 | 10 | 5 | 0 | Y | IMKNPTVDGIV | 43.07 | IMKNPTVDGIM | 33.92 | IMKNPTVDGIM | 20.72 | IMKNPTIDGIV | 1.14 | IMKNPTVDGVT | 0.63 |
| NS4B | 2395 | 1.73 | 11 | 4 | 0 | Y | KNPTVDGIVAI | 42.55 | KNPTVDGITVI | 33.92 | KNPTVDGIMTI | 20.76 | KNPTIDGIVAI | 1.14 | KNPTVDGVTVI | 0.63 |
| NS4B | 2409 | 1.78 | 9 | 4 | 0.04 | Y | PWYDAKFEKQL | 43.69 | PIPYDPKFEKQL | 30.75 | PWYDSKFEKQ | 20.72 | PISYDPKFEKQ | 3.8 | | |
| NS4B | 2410 | 1.78 | 9 | 4 | 0.04 | Y | VVYDAKFEKQL | 43.69 | IPYDPKFEKQL | 30.75 | VIYDSKFEKQL | 20.72 | ISYDPKFEKQL | 3.8 | | |
| NS4B | 2411 | 1.78 | 9 | 3 | 0 | Y | VYDAKFEKQLG | 43.69 | PYDPKFEKQLG | 30.79 | IYDSKFEKQLG | 20.72 | SYDPKFEKQLG | 3.8 | | |
| NS4B | 2412 | 1.6 | 7 | 4 | 0 | Y | YDAKFEKQLGQ | 43.69 | YDPKFEKQLGQ | 34.62 | YDSKFEKQLGQ | 20.72 | | | | |
| NS4B | 2413 | 1.63 | 8 | 4 | 0 | Y | DAKFEKQLGQI | 43.36 | DPKFEKQLGQV | 34.55 | DSKFEKQLGQV | 20.72 | DTKFEKQLGQI | 0.66 | | |
| NS4B | 2414 | 1.63 | 8 | 4 | 0 | Y | AKFEKQLGQIM | 43.36 | PKFEKQLGQVM | 34.55 | SKFEKQLGQVM | 20.76 | TKFEKQLGQIM | 0.66 | | |
| NS4B | 2415 | 1 | 3 | 2 | 0 | Y | KFEKQLGQVML | 55.64 | KFEKQLGQIML | 44.25 | | | | | | |
| NS4B | 2416 | 1 | 3 | 2 | 0 | Y | FEKQLGQVMLL | 55.64 | FEKQLGQIMLL | 44.25 | | | | | | |
| NS4B | 2417 | 1.57 | 7 | 3 | 0 | Y | EKQLGQVMLLV | 43.99 | EKQLGQVMLLV | 34.11 | EKQLGQVMLLI | 21.5 | | | | |
| NS4B | 2418 | 1.57 | 7 | 3 | 0 | Y | KQLGQIMLLIL | 43.99 | KQLGQVMLLIL | 34.11 | KQLGQVMLLIL | 21.5 | | | | |
| NS4B | 2419 | 1.57 | 8 | 3 | 0 | Y | QLGQIMLLILC | 43.95 | QLGQVMLLILC | 34.11 | QLGQVMLLILC | 21.5 | | | | |
| NS4B | 2420 | 1.91 | 13 | 4 | 0 | Y | LGQIMLLILCT | 43.95 | LGQVMLYLCA | 24.00 | LGQVMLLILCV | 21.09 | LGQVMLLVLCV | 10.07 | | |
| NS4B | 2428 | 1.76 | 15 | 4 | 0 | Y | LCTSQILLMRT | 44.47 | LCVTQVLMMRT | 30.75 | LCAVQLLLMRT | 20.54 | LCAGQLLLMRT | 3.36 | | |
| NS4B | 2429 | 1.76 | 15 | 4 | 0 | Y | CTSQILLMRTT | 44.47 | CVTQVLMMRTT | 30.75 | CAVQLLLMRTS | 20.54 | CAGQLLLMRTT | 3.36 | | |
| NS4B | 2430 | 1.76 | 14 | 4 | 0 | Y | TSQILLMRTTW | 44.51 | VTQVLMMRTTW | 30.75 | AVQLLLMRTSW | 20.54 | AGQLLLMRTTW | 3.36 | | |
| NS4B | 2431 | 1.73 | 11 | 4 | 0 | Y | SQILLMRTTWA | 44.51 | TQVLMMRTTWA | 30.75 | VQLLLMRTSWA | 20.65 | GQLLLMRTTWA | 3.72 | | |
| NS4B | 2432 | 1.82 | 11 | 5 | 0 | Y | QILLMRTTWAL | 44.54 | QVLMMRTTWAL | 30.72 | QLLLMRTSWAL | 18.88 | QLLMRTTWAF | 3.36 | QLLMRTSWAF | 1.92 |

FIG. 21-38

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2433 | 1.83 | 12 | 5 | 0 | Y | ILLMRTTWALC | 44.51 | VLLMRTSWALC | 30.72 | LLLMRTSWALC | 18.88 | LLLMRTSWAFC | 3.36 |
| NS4B | 2434 | 1.8 | 11 | 5 | 0 | Y | LLMRTTWALCE | 44.87 | LMMRTTWALCE | 30.72 | LLMRTSWALCE | 18.88 | LLMRTSWAFCE | 3.36 |
| NS4B | 2435 | 1.84 | 12 | 5 | 0 | Y | LMRTTWALCES | 44.51 | MMRTTWALCEA | 30.72 | LMRTSWALCEA | 18.66 | LMRTSWAFCEA | 3.43 |
| NS4B | 2436 | 1.84 | 10 | 5 | 0 | Y | MRTTWALCESI | 44.51 | MRTTWALCEAL | 30.75 | MRTSWALCEAL | 18.66 | MRTSWAFCEAL | 3.43 |
| NS4B | 2437 | 1.84 | 10 | 5 | 0 | Y | RTTWALCESIT | 44.51 | RTTWALCEALT | 30.75 | RTSWALCEALT | 18.66 | RTSWAFCEVLT | 3.43 |
| NS4B | 2438 | 1.84 | 12 | 5 | 0 | Y | TTWALCESITL | 44.51 | TTWALCEALTL | 30.72 | TSWALCEALTL | 18.66 | T

FIG. 21-39

ENVall (11-mers)

| protein | block start position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2461 | 0.93 | 3 | 2 | 0 | Y | PGKF

FIG. 21-40

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2506 | 1.69 | 15 | 4 | 0 | Y | GETLGEKWK

FIG. 21-41

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2584 | 1.12 | 7 | 3 | 0 | Y | RGGWSYYCAGL | 65.34 | RGGWSYYCGGL | 30.75 | RGGWSYYMATL | 3.76 | | |
| NS5 | 2585 | 1.14 | 10 | 3 | 0 | Y | GGWSYYCAGLK | 65.30 | GGWSYYCGGLK | 30.64 | GGWSYYMATLK | 3.76 | | |
| NS5 | 2586 | 1.22 | 13 | 4 | 0 | Y | GWSYYCAGLKK | 65.23 | GWSYYCGGLKN | 29.46 | GWSYYMATLK

FIG. 21-42

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2615 | 1.62 | 18 | 4 | 0 | Y | PMATYGWNLV

FIG. 21-43

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2658 | 1.67 | 15 | 4 | 0 | Y | EGRT

FIG. 21-44

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NSS | 2715 | 2.07 | 16 | 5 | 0 | Y | THEMYWVSCGT | 44.36 | THEMYWISNGT | 20.65 | THEMYWVSNAT | 16.85 | THEMYWVSNAS | 13.83 | THEMY

FIG. 21-45

ENVall (11-mers)

| protein | block start position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2795 | 1.73 | 10 | 4 | 0 | Y | DEDNP

FIG. 21-46

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2820 | 1.55 | 7 | 3 | 0 | Y | MVNGVVRLLTK | 39.79 | MVNGVVKLLTK | 39.16 | MVNGVVKLLTK | 20.87 | | |
| NS5 | 2821 | 1.55 | 7 | 3 | 0 | Y | VNGVVRLLTKP | 39.79 | VNGVVKLLTKP | 39.16 | INGVVKLLTKP | 20.87 | | |
| NS5 | 2822 | 0.98 | 4 | 2 | 0 | Y | NGVVRLLTKPW | 60.07 | NGVVRLLTKPW | 39.82 | | | | |
| NS5 | 2823 | 0.98 | 3 | 2 | 0 | Y | GVVRLLTKPWD | 60.07 | GVVRLLTKPWD | 39.86 | | | | |
| NS5 | 2824 | 1 | 7 | 2 | 0 | Y | VVRLLTKPWDV | 59.92 | VVRLLTKPWDV | 39.79 | | | | |
| NS5 | 2825 | 2.19 | 10 | 5 | 0 | Y | VKLLTKPWDVI | 36.87 | VKLLTKPWDVI | 23.05 | VRLLTKPWDVV | 16.67 | VRLLTKPWDVI | 13.86 | VRLLTKPWDVL | 9.26 |
| NS5 | 2826 | 2.19 | 10 | 5 | 0 | Y | KLLTKPWDVIP | 36.87 | KLLTKPWDVYP | 23.05 | RLLTKPWDVVP | 16.74 | RLLTKPWDVIP | 13.83 | RLLTKPWDVLP | 9.26 |
| NS5 | 2827 | 1.5 | 11 | 4 | 0 | Y | LLTKPWDVIPM | 50.55 | LLTKPWDVPM | 38.31 | LLTKPWDVLPT | 8.96 | LLTKPWDVIPT | 1.47 | | |
| NS5 | 2828 | 1.5 | 11 | 4 | 0.04 | Y | LTKPWDVIPMV | 50.52 | LTKPWDVPMV | 38.31 | LTKPWDVLPTV | 8.96 | LTKPWDVVPTV | 1.47 | | |
| NS5 | 2829 | 1.53 | 14 | 5 | 0.04 | Y | TKPWDVIPMVT | 50.48 | TKPWDVPMVT | 37.91 | TKPWDVLPTVT | 8.96 | TKPWDVVPTVT | 1.47 | TKPWDVPMVI | 0.37 |
| NS5 | 2830 | 1.53 | 14 | 5 | 0.04 | Y | KPWDVIPMVTQ | 50.48 | KPWDVPMVTQ | 37.91 | KPWDVLPTVTQ | 8.96 | KPWDVPTVTQ | 1.47 | KPWDVVPMVIQ | 0.37 |
| NS5 | 2836 | 1.63 | 11 | 4 | 0.07 | Y | PMVTQIAMTDT | 44.17 | PMVTQIAMTDT | 40.71 | PTVTQMAMTDT | 10.58 | PMVTQLAMTDT | 3.8 | | |
| NS5 | 2837 | 1.63 | 10 | 4 | 0.07 | Y | MVTQIAMTDTT | 44.21 | MVTQMAMTDTT | 40.71 | TVTQMAMTDTT | 10.58 | MVTQLAMTDTT | 3.8 | | |
| NS5 | 2838 | 1.25 | 9 | 3 | 0.07 | Y | VTQIAMTDTTP | 51.29 | VTQIAMTDTTP | 44.21 | VTQLAMTDTTP | 3.8 | | | |
| NS5 | 2839 | 1.26 | 10 | 3 | 0.04 | Y | TQIAMTDTTPF | 51.29 | TQIAMTDTTPF | 44.21 | TQLAMTDTTPF | 3.8 | | | |
| NS5 | 2840 | 1.22 | 7 | 3 | 0.07 | Y | QIAMTDTTPFG | 51.70 | QIAMTDTTPFG | 44.25 | QLAMTDTTPFG | 3.8 | | | |
| NS5 | 2841 | 1.22 | 7 | 3 | 0.07 | Y | MAMTDTTPFGQ | 51.66 | IAMTDTTPFGQ | 44.25 | LAMTDTTPFGQ | 3.8 | | | |
| NS5 | 2842 | 0.01 | 3 | 1 | 0.07 | Y | AMTDTTPFGQQ | 99.85 | | | | | | | |
| NS5 | 2843 | 0 | 2 | 1 | 0.07 | Y | MTDTTPFGQQR | 99.89 | | | | | | | |
| NS5 | 2844 | 0 | 2 | 1 | 0.07 | Y | TDTTPFGQQRV | 99.89 | | | | | | | |
| NS5 | 2845 | 0.01 | 3 | 1 | 0.07 | Y | DTTPFGQQRVF | 99.85 | | | | | | | |
| NS5 | 2846 | 0.01 | 4 | 1 | 0.07 | Y | TTPFGQQRVFK | 99.82 | | | | | | | |
| NS5 | 2847 | 0.04 | 6 | 1 | 0.04 | Y | TPFGQQRVFKE | 99.63 | | | | | | | |
| NS5 | 2848 | 0.04 | 6 | 1 | 0.04 | Y | PFGQQRVFKEK | 99.63 | | | | | | | |
| NS5 | 2849 | 0.04 | 6 | 1 | 0.04 | Y | FGQQRVFKEKV | 99.63 | | | | | | | |

FIG. 21-47

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2850 | 0.03 | 5 | 1 | 0.04 | Y | GQQ

FIG. 21-48

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2938 | 1.8 | 19 | 5 | 0 | Y | ERELHKQGKCA | 44.47 | ERNLHLEGKCE | 30.09 | ERELHKLGKCG | 20.46 | ERALHQEGKCE | 3

FIG. 21-49

ENVall (11-mers)

| protein | block start position | block entropy | total peptides in block | # peptides required to cover 99% of block | gap/X fraction | 99% of block covered w/ <= 5 peptides? | cover 99% of block peptides required to | frequency | cover 99% of block peptides required to | frequency | cover 99% of block peptides required to | frequency | cover 99% of block peptides required to | frequency |
|---|---|---|---|---|---|---|---|---|---|---|---|---|---|---|
| NS5 | 2963 | 0.26 | 6 | 2 | 0

FIG. 21-50

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2988 | 1.01 | 6 | 2 | 0 | Y | ALGFLNEDHWF | 55.38 | ALGFMNEDHWF | 44.47 | | | | | | |
| NS5 | 2989 | 1.2 | 7 | 3 | 0 | Y | LGFLNEDHWFS | 51.92 | LGFMNEDHWFS | 44.36 | LGFLNEDHWFG | 3.5 | | | | |
| NS5 | 2990 | 1.21 | 8 | 3 | 0 | Y | GFLNEDHWFSR | 51.92 | GFMNEDHWFSR | 44.32 | GFLNEDHWFGR | 3.5 | | | | |
| NS5 | 2991 | 1.68 | 13 | 4 | 0 | Y | FMNEDHWFSRE | 44.28 | FLNEDHWFSRE | 37.13 | FLNEDHWFSRG | 14.56 | FLNEDHWFGRE | 3.47 | | |
| NS5 | 2992 | 1.68 | 13 | 4 | 0 | Y | MNEDHWFSREN | 44.28 | LNEDHWFSREN | 37.13 | LNEDHWFSRGN | 14.56 | LNEDHWFGREN | 3.47 | | |
| NS5 | 2993 | 0.86 | 10 | 3 | 0 | Y | NEDHWFSRENS | 81.49 | NEDHWFSRGNS | 14.56 | NEDHWFGRENS | 3.47 | | | | |
| NS5 | 2994 | 1.64 | 14 | 5 | 0 | Y | EDHWFSRENSL | 59.33 | EDHWFSRENSY | 20.69 | EDHWFSRGNSL | 14.56 | EDHWFGRENSW | 3.47 | EDHWFSRENSF | 1.14 |
| NS5 | 2995 | 1.64 | 14 | 5 | 0 | Y | DHWFSRENSLS | 59.33 | DHWFSRENSYS | 20.69 | DHWFSRGNSLS | 14.56 | DHWFGRENSWS | 3.47 | DHWFSRENSFS | 1.14 |
| NS5 | 2996 | 1.64 | 14 | 5 | 0 | Y | HWFSRENSLSG | 59.33 | HWFSRENSYSG | 20.69 | HWFSRGNSLSG | 14.56 | HWFGRENSWSG | 3.47 | HWFSRENSFSG | 1.14 |
| NS5 | 2997 | 1.65 | 15 | 5 | 0 | Y | WFSRENSLSGV | 59.29 | WFSRENSYSGV | 20.69 | WFSRGNSLSGV | 14.56 | WFGRENSWSGV | 3.47 | WFSRENSFSGV | 1.14 |
| NS5 | 2998 | 1.65 | 15 | 5 | 0 | Y | FSRENSLSGVE | 59.29 | FSRENSYSGVE | 20.69 | FSRGNSLSGVE | 14.56 | FGRENSWSGVE | 3.47 | FSRENSFSGVE | 1.14 |
| NS5 | 2999 | 1.65 | 15 | 5 | 0 | Y | SRENSLSGVEG | 59.29 | SRENSYSGVEG | 20.69 | SRGNSLSGVEG | 14.56 | GRENSWSGVEG | 3.47 | SRENSFSGVEG | 1.14 |
| NS5 | 3000 | 1.63 | 15 | 5 | 0 | Y | RENSLSGVEGE | 59.37 | RENSYSGVEGE | 20.69 | RGNSLSGVEGE | 14.56 | RENSWSGVEGE | 3.76 | RENSFSGVEGE | 1.11 |
| NS5 | 3001 | 1.63 | 15 | 5 | 0 | Y | ENSLSGVEGEG | 59.37 | ENSYSGVEGEG | 20.69 | GNSLSGVEGEG | 14.56 | ENSWSGVEGEG | 3.76 | ENSFSGVEGEG | 1.11 |
| NS5 | 3002 | 1.08 | 16 | 4 | 0 | Y | NSLSGVEGEGL | 74.08 | NSYSGVEGEGL | 20.65 | NSWSGVEGEGL | 3.8 | NSFSGVEGEGL | 1.11 | | |
| NS5 | 3003 | 1.1 | 12 | 4 | 0 | Y | SLSGVEGEGLH | 73.89 | SYSGVEGEGLH | 20.65 | SWSGVEGEGLH | 3.8 | SFSGVEGEGLH | 1.11 | | |
| NS5 | 3004 | 1.59 | 14 | 5 | 0 | Y | LSGVEGEGLHK | 61.28 | YSGVEGEGLHK | 20.65 | LSGVEGEGLHR | 12.61 | WSGVEGEGLHK | 3.8 | FSGVEGEGLHK | 1.11 |
| NS5 | 3005 | 0.7 | 15 | 2 | 0 | Y | SGVEGEGLHKL | 83.08 | SGVEGEGLHRL | 16.41 | | | | | | |
| NS5 | 3006 | 0.71 | 11 | 2 | 0 | Y | GVEGEGLHKLG | 83.04 | GVEGEGLHRLG | 16.41 | | | | | | |
| NS5 | 3007 | 0.71 | 12 | 2 | 0 | Y | VEGEGLHKLGY | 83.04 | VEGEGLHRLGY | 16.41 | | | | | | |
| NS5 | 3008 | 0.7 | 12 | 2 | 0 | Y | EGEGLHKLGYI | 83.08 | EGEGLHRLGYI | 16.41 | | | | | | |
| NS5 | 3009 | 0.7 | 11 | 2 | 0 | Y | GEGLHKLGYIL | 83.08 | GEGLHRLGYIL | 16.41 | | | | | | |
| NS5 | 3010 | 0.83 | 11 | 3 | 0 | Y | EGLHKLGYILR | 83.11 | EGLHRLGYILR | 12.57 | EGLHRLGYILE | 3.8 | | | | |
| NS5 | 3027 | 1.28 | 12 | 3 | 0 | Y | GGAMYADDTAG | 51.44 | GGNMYADDTAG | 44.06 | GDLMYADDTAG | 3.21 | GDLIYADDTAG | 0.59 | | |
| NS5 | 3028 | 1.28 | 11 | 4 | 0 | Y | GAMYADDTAGW | 51.44 | GNMYADDTAGW | 44.06 | DLMYADDTAGW | 3.21 | DLIYADDTAGW | 0.59 | | |

FIG. 21-51

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NSS | 3029 | 1.28 | 11 | 4 | 0 | Y | AMYADDTAGWD | 51.44 | NMYADDTAGWD | 44.06 | LMYADDTAGWD | 3.21 | LIYADDTAGWD | 0.59 |
| NSS | 3030 | 0.08 | 4 | 1 | 0 | Y | MYADDTAGWDT | 99.15 | | | | | | |
| NSS | 3031 | 0.02 | 3 | 1 | 0 | Y | YADDTAGWDTR | 99.78 | | | | | | |
| NSS | 3032 | 0.05 | 4 | 1 | 0 | Y | ADDTAGWDTRI | 99.52 | | | | | | |
| NSS | 3033 | 0.06 | 6 | 1 | 0 | Y | DDTAGWDTRIT | 99.45 | | | | | | |
| NSS | 3034 | 1.04 | 10 | 4 | 0 | Y | DTAGWDTRITE | 68.77 | DTAGWDTRITL | 29.31 | DTAGWDTRITI | 0.74 | DTAGWDTRITS | 0.59 |
| NSS | 3035 | 1.04 | 10 | 4 | 0 | Y | TAGWDTRITED | 68.77 | TAGWDTRITLE | 29.31 | TAGWDTRITIE | 0.74 | TAGWDTRITSE | 0.59 |
| NSS | 3036 | 1.04 | 10 | 4 | 0 | Y | AGWDTRITEDD | 68.77 | AGWDTRITLED | 29.31 | AGWDTRITIED | 0.74 | AGWDTRITSED | 0.59 |
| NSS | 3037 | 1.04 | 10 | 4 | 0 | Y | GWDTRITEDDL | 68.77 | GWDTRITLEDL | 29.31 | GWDTRITIEDL | 0.74 | GWDTRITSEDL | 0.59 |
| NSS | 3067 | 1.02 | 9 | 2 | 0 | Y | AIFKLTYQNKV | 59.88 | SIFKLTYQNKV | 39.60 | | | | |
| NSS | 3068 | 0.06 | 7 | 1 | 0 | Y | IFKLTYQNKVV | 99.48 | | | | | | |
| NSS | 3069 | 0.85 | 7 | 2 | 0 | Y | FKLTYQNKVVR | 74.96 | FKLTYQNKVVK | 24.59 | | | | |
| NSS | 3070 | 0.85 | 7 | 2 | 0 | Y | KLTYQNKVVRV | 74.96 | KLTYQNKVVKV | 24.59 | | | | |
| NSS | 3071 | 0.98 | 7 | 3 | 0 | Y | LTYQNKVVRVQ | 75.26 | LTYQNKVVKVQ | 20.80 | LTYQNKVVKVL | 3.8 | | |
| NSS | 3072 | 0.98 | 8 | 3 | 0 | Y | TYQNKVVRVQR | 75.18 | TYQNKVVKVQR | 20.80 | TYQNKVVKVLR | 3.8 | | |
| NSS | 3073 | 0.98 | 8 | 3 | 0 | Y | YQNKVVRVQRP | 75.18 | YQNKVVKVQRP | 20.80 | YQNKVVKVLRP | 3.8 | | |
| NSS | 3074 | 1.73 | 11 | 4 | 0 | Y | QNKVVRVQRPA | 43.95 | QNKVVRVQRPT | 31.12 | QNKVVKVQRPT | 20.8 | QNKVVKVLRPT | 3.8 |
| NSS | 3075 | 1.83 | 15 | 5 | 0 | Y | NKVVRVQRPAK | 43.22 | NKVVRVQRPTP | 30.64 | NKVVRVQRPTP | 20.8 | NKVVKVLRPTP | 3.8 | NKVVRVQRPAR 0.7 |
| NSS | 3087 | 1.73 | 8 | 4 | 0 | Y | GTVMDVISRRD | 44.40 | GTVMDIISRRD | 26.51 | GTVMDIISRKD | 25.11 | GAVMDIISRKD | 3.8 |
| NSS | 3088 | 1.73 | 8 | 4 | 0 | Y | TVMDVISRRDQ | 44.40 | TVMDIISRRDQ | 26.51 | TVMDIISRKDQ | 25.11 | AVMDIISRKDQ | 3.8 |
| NSS | 3089 | 1.56 | 6 | 3 | 0 | Y | VMDVISRRDQR | 44.40 | VMDIISRRDQR | 28.91 | VMDIISRKDQR | 26.55 | | |
| NSS | 3090 | 1.56 | 6 | 3 | 0 | Y | MDVISRRDQRG | 44.40 | MDIISRRDQRG | 28.91 | MDIISRKDQRG | 26.55 | | |
| NSS | 3091 | 1.56 | 5 | 3 | 0 | Y | DVISRRDQRGS | 44.40 | DIISRRDQRGS | 28.91 | DIISRKDQRGS | 26.59 | | |
| NSS | 3092 | 1.56 | 5 | 3 | 0 | Y | VISRRDQRGSG | 44.40 | IISRRDQRGSG | 28.91 | IISRRDQRGSG | 26.59 | | |
| NSS | 3093 | 0.88 | 4 | 2 | 0 | Y | ISRRDQRGSGQ | 70.98 | ISRKDQRGSGQ | 28.91 | | | | |

FIG. 21-52

| protein | block start position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3094 | 0.89 | 5 | 2 | 0 | Y | SRRDQRGSGQV | 70.98 | SRKDQRGSGQV | 28.83 | | | | |
| NS5 | 3095 | 1.01 | 8 | 3

FIG. 21-53

ENVall (11-mers)

| protein | block start position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3184 | 0.59 | 11 | 3 | 0 | Y | LNDMGKVRKDI | 88.38 | LNDMGKIRKDI | 10.58 | LNDM

FIG. 21-54

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3227 | 1.6 | 11 | 3 | 0 | Y | IWPCRNQDEL | 44.36 | LWPCRNQDEL | 34.03 | LWPCRPQDEL | 20.76 | | |
| NS5 | 3228 | 1.59 | 11 | 3 | 0 | Y | WPCRNQDELV | 44.47 | WPCRNQDELI | 33.96 | WPCRPQDELI | 20.76 | | |
| NS5 | 3229 | 1.6 | 12 | 3 | 0 | Y | PCRNQDELVG | 44.47 | VPCRNQDELIG | 33.92 | VPCRPQDELIG | 20.76 | | |
| NS5 | 3230 | 1.59 | 11 | 3 | 0 | Y | PCRNQDELVGR | 44.47 | PCRNQDELIGR | 34.00 | PCRPQDELIGR | 20.76 | | |
| NS5 | 3231 | 1.59 | 11 | 3 | 0 | Y | CRNQDELVGRA | 44.47 | CRNQDELIGRA | 34.00 | CRPQDELIGRA | 20.76 | | |
| NS5 | 3232 | 1.59 | 11 | 3 | 0 | Y | RNQDELVGRAR | 44.47 | RNQDELIGRAR | 34.00 | RPQDELIGRAR | 20.76 | | |
| NS5 | 3233 | 1.6 | 13 | 3 | 0 | Y | NQDELVGRARV | 44.43 | NQDELIGRARI | 33.96 | PQDELIGRARI | 20.76 | | |
| NS5 | 3234 | 1.03 | 10 | 2 | 0 | Y | QDELIGRARIS | 55.24 | QDELVGRARVS | 44.47 | | | | |
| NS5 | 3235 | 1.02 | 9 | 2 | 0 | Y | DELIGRARISQ | 55.24 | DELVGRARVSQ | 44.51 | | | | |
| NS5 | 3236 | 1.02 | 8 | 2 | 0 | Y | ELIGRARISQG | 55.27 | ELVGRARVSQG | 44.51 | | | | |
| NS5 | 3237 | 1.03 | 9 | 2 | 0 | Y | LIGRARISQGA | 55.16 | LVGRARVSQGA | 44.51 | | | | |
| NS5 | 3238 | 1.03 | 10 | 2 | 0 | Y | IGRARISQGAG | 55.16 | VGRARVSQGAG | 44.47 | | | | |
| NS5 | 3239 | 1.02 | 8 | 2 | 0 | Y | GRARISQGAGW | 55.20 | GRARVSQGAGW | 44.51 | | | | |
| NS5 | 3240 | 1.04 | 10 | 2 | 0 | Y | RARISQGAGWS | 55.24 | RARVSQGAGWS | 44.36 | | | | |
| NS5 | 3241 | 1.05 | 12 | 2 | 0 | Y | ARISQGAGWSL | 55.09 | ARVSQGAGWSL | 44.36 | | | | |
| NS5 | 3242 | 1.62 | 14 | 3 | 0 | Y | RVSQGAGWSLR | 44.14 | RISQGAGWSLR | 30.46 | RISQGAGWSLK | 24.63 | | |
| NS5 | 3243 | 1.62 | 15 | 3 | 0 | Y | VSQGAGWSLRE | 44.10 | ISQGAGWSLRE | 30.46 | ISQGAGWSLKE | 24.63 | | |
| NS5 | 3244 | 0.87 | 12 | 2 | 0 | Y | SQGAGWSLRET | 74.56 | SQGAGWSLKET | 24.89 | | | | |
| NS5 | 3245 | 0.87 | 12 | 2 | 0 | Y | QGAGWSLRETA | 74.56 | QGAGWSLKETA | 24.89 | | | | |
| NS5 | 3246 | 0.87 | 12 | 2 | 0 | Y | GAGWSLRETAC | 74.52 | GAGWSLKETAC | 24.93 | | | | |
| NS5 | 3247 | 0.87 | 12 | 2 | 0 | Y | AGWSLRETACL | 74.52 | AGWSLKETACL | 24.93 | | | | |
| NS5 | 3248 | 0.87 | 11 | 2 | 0 | Y | GWSLRETACLG | 74.59 | GWSLKETACLG | 24.93 | | | | |
| NS5 | 3249 | 0.86 | 10 | 2 | 0 | Y | WSLRETACLGK | 74.63 | WSLKETACLGK | 24.93 | | | | |
| NS5 | 3250 | 1.66 | 13 | 4 | 0 | Y | SLRETACLGKS | 57.82 | SLKETACLGKS | 17.18 | SLRETACLGKA | 16.81 | SLKETACLGKA | 7.74 |
| NS5 | 3251 | 1.64 | 10 | 4 | 0 | Y | LRETACLGKSY | 57.96 | LKETACLGKSY | 17.18 | LRETACLGKAY | 16.81 | LKETACLGKAY | 7.74 |

ENVall (11-mers)

FIG. 21-55

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3252 | 1.63 | 9 | 4 | 0 | Y | RETACLGKSYA | 58.04 | KETACLGKSYA | 17.18 | RETACLGKAYA | 16.85 | KETACLGKAYA | 7.74 |
| NS5 | 3253 | 0.83 | 7 | 2 | 0 | Y | ETACLGKSYAQ | 75

FIG. 21-56

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3277 | 1.03 | 14 | 3 | 0 | Y | LAANAICSAVP | 74.78 | LASMAICSAVP | 20.83 | LASMAICSAVP | 3.8 | | |
| NS5 | 3289 | 1.82 | 15 | 5 | 0 | Y | HWPTSRTTWS | 48.38 | DWPTSRTTWS | 31.64 | DWIPTSRTTWS | 12.17 | HWIPTSRTTWS | 3.17 |
| NS5 | 3290 | 0.89 | 11 | 3 | 0 | Y | WVPTSRTTWSI | 80.49 | WIPTSRTTWSI | 15.41 | WFPTSRTTWSI | 3.72 | | |
| NS5 | 3291 | 0.89 | 11 | 3 | 0 | Y | VPTSRTTWSIH | 80.49 | IPTSRTTWSIH | 15.41 | FPTSRTTWSIH | 3.72 | | |
| NS5 | 3292 | 0.03 | 6 | 1 | 0 | Y | PTSRTTWSIHA | 99.71 | | | | | | |
| NS5 | 3293 | 1.12 | 11 | 4 | 0 | Y | TSRTTWSIHAH | 68.95 | TSRTTWSIHAK | 27.51 | TSRTTWSIHAT | 1.62 | TSRTTWSIHAS | 1.25 |
| NS5 | 3294 | 1.11 | 11 | 4 | 0 | Y | SRTTWSIHAHH | 69.10 | SRTTWSIHAKH | 27.47 | SRTTWSIHATH | 1.62 | SRTTWSIHASH | 1.25 |
| NS5 | 3295 | 1.11 | 11 | 4 | 0 | Y | RTTWSIHAHHQ | 69.14 | RTTWSIHAKHE | 27.43 | RTTWSIHATHE | 1.62 | RTTWSIHASHE | 1.25 |
| NS5 | 3296 | 1.12 | 12 | 4 | 0 | Y | TTWSIHAHHQW | 69.03 | TTWSIHAKHEW | 27.43 | TTWSIHATHEW | 1.62 | TTWSIHASHEW | 1.25 |
| NS5 | 3297 | 1.12 | 11 | 4 | 0 | Y | TWSIHAHHQWM | 69.03 | TWSIHAKHEWM | 27.47 | TWSIHATHEWM | 1.62 | TWSIHASHEWM | 1.25 |
| NS5 | 3298 | 1.11 | 10 | 4 | 0 | Y | WSIHAHHQWMT | 69.06 | WSIHAKHEWMT | 27.47 | WSIHATHEWMT | 1.62 | WSIHASHEWMT | 1.25 |
| NS5 | 3299 | 1.11 | 10 | 4 | 0 | Y | SIHAHHQWMTT | 69.06 | SIHAKHEWMTT | 27.47 | SIHATHEWMTT | 1.62 | SIHASHEWMTT | 1.25 |
| NS5 | 3300 | 1.11 | 10 | 4 | 0 | Y | IHAHHQWMTTE | 69.06 | IHAKHEWMTTE | 27.47 | IHATHEWMTTE | 1.62 | IHASHEWMTTE | 1.25 |
| NS5 | 3301 | 1.14 | 10 | 4 | 0 | Y | HAHHQWMTTED | 68.66 | HAKHEWMTTED | 27.51 | HATHEWMTTED | 1.62 | HASHEWMTTED | 1.25 |
| NS5 | 3302 | 1.14 | 10 | 4 | 0 | Y | AHHQWMTTEDM | 68.66 | AKHEWMTTEDM | 27.51 | ATHEWMTTEDM | 1.62 | ASHEWMTTEDM | 1.25 |
| NS5 | 3303 | 1.14 | 10 | 4 | 0 | Y | HHQWMTTEDML | 68.66 | KHEWMTTEDML | 27.51 | THEWMTTEDML | 1.62 | SHEWMTTEDML | 1.25 |
| NS5 | 3304 | 2.08 | 12 | 5 | 0 | Y | HQWMTTEDMLS | 44.40 | HQWMTTEDMLT | 20.13 | HEWMTTEDMLA | 15.56 | HEWMTTEDMLT | 15.19 |
| NS5 | 3305 | 2.08 | 11 | 5 | 0 | Y | QWMTTEDMLSV | 44.40 | QWMTTEDMLTV | 20.13 | EWMTTEDMLAV | 15.56 | EWMTTEDMLTV | 15.19 | QWMTTEDMLKV | 3.8 |
| NS5 | 3306 | 1.71 | 9 | 4 | 0 | Y | WMTTEDMLSVW | 44.40 | WMTTEDMLTVW | 35.32 | WMTTEDMLAVW | 15.82 | WMTTEDMLKYW | 3.8 |
| NS5 | 3307 | 1.7 | 8 | 4 | 0 | Y | MTTEDMLSVWN | 44.40 | MTTEDMLTVWN | 35.44 | MTTEDMLAVWN | 15.82 | MTTEDMLKYWN | 3.8 |
| NS5 | 3308 | 1.73 | 9 | 4 | 0 | Y | TTEDMLSVWNR | 44.36 | TTEDMLTVWNR | 35.14 | TTEDMLAVWNR | 15.82 | TTEDMLKYWNR | 3.8 |
| NS5 | 3309 | 1.73 | 10 | 4 | 0 | Y | TEDMLSVWNRV | 44.36 | TEDMLTVWNRV | 35.10 | TEDMLAVWNRV | 15.82 | TEDMLKYWNR | 3.8 |
| NS5 | 3310 | 1.73 | 10 | 4 | 0 | Y | EDMLSVWNRVW | 44.36 | EDMLTVWNRVW | 35.10 | EDMLAVWNRVW | 15.82 | EDMLKYWNRYW | 3.8 |
| NS5 | 3311 | 1.73 | 10 | 4 | 0 | Y | DMLSVWNRVWI | 44.36 | DMLTVWNRVWI | 35.10 | DMLAVWNRVWI | 15.82 | DMLKYWNRVWI | 3.8 |
| NS5 | 3338 | 2.04 | 10 | 5 | 0 | Y | DVPYLGKREDQ | 43.29 | EVPYLGKREDQ | 26.00 | EIPYLGKREDQ | 13.35 | NVPYLGKREDQ | 12.76 | DIPYLGKREDL | 3.72 |

FIG. 21-57

ENVall (11-mers)

| protein | block start position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3339 | 0.83 | 7 | 3 | 0 | Y | VPYLGKREDQW | 82.04 | IPYLGKREDQW | 14.05 | IPYLGKREDLW | 3.72 | | |
| NS5 | 3340 | 0.25 | 5 | 2 | 0 | Y | PYLGKREDQWC | 96.09 | PYLGKREDLWC | 3.80 | | | | |
| NS5 | 3341 | 0.25 | 5 | 2 | 0 | Y | YLGKREDQWCG | 96.09 | YLGKREDLWCG | 3.80 | | | | |
| NS5 | 3342 | 0.25 | 5 | 2 | 0 | Y | LGKREDQWCGS | 96.09 | LGKREDLWCGS | 3.80 | | | | |
| NS5 | 3343 | 0.26 | 6 | 2 | 0 | Y | GKREDQWCGSL | 95.94 | GKREDLWCGSL | 3.80 | | | | |
| NS5 | 3344 | 0.26 | 6 | 2 | 0 | Y | KREDQWCGSLI | 95.94 | KREDLWCGSLI | 3.80 | | | | |
| NS5 | 3345 | 0.26 | 5 | 2 | 0 | Y | REDQWCGSLIG | 95.98 | REDLWCGSLIG | 3.80 | | | | |
| NS5 | 3346 | 0.26 | 6 | 2 | 0 | Y | EDQWCGSLIGL | 95.94 | EDLWCGSLIGL | 3.80 | | | | |
| NS5 | 3347 | 0.27 | 8 | 2 | 0 | Y | DQWCGSLIGLT | 95.91 | DLWCGSLIGLS | 3.76 | | | | |
| NS5 | 3348 | 1.23 | 11 | 3 | 0 | Y | QWCGSLIGLTS | 51.40 | QWCGSLIGLTA | 44.43 | LWCGSLIGLSS | 3.76 | | |
| NS5 | 3349 | 1.23 | 9 | 3 | 0 | Y | WCGSLIGLTSR | 51.44 | WCGSLIGLTAR | 44.47 | WCGSLIGLSSR | 3.76 | | |
| NS5 | 3350 | 1.23 | 11 | 3 | 0 | Y | CGSLIGLTSRA | 51.36 | CGSLIGLTARA | 44.47 | CGSLIGLSSRA | 3.76 | | |
| NS5 | 3351 | 1.23 | 11 | 3 | 0 | Y | GSLIGLTSRAT | 51.36 | GSLIGLTARAT | 44.47 | GSLIGLSSRAT | 3.76 | | |
| NS5 | 3352 | 1.23 | 11 | 3 | 0 | Y | SLIGLTSRATW | 51.36 | SLIGLTARATW | 44.47 | SLIGLSSRATW | 3.76 | | |
| NS5 | 3353 | 1.23 | 11 | 3 | 0 | Y | LIGLTSRATWA | 51.36 | LIGLTARATWA | 44.47 | LIGLSSRATWA | 3.76 | | |
| NS5 | 3354 | 1.96 | 12 | 5 | 0 | Y | IGLTARATWAT | 39.45 | IGLTSRATWAK | 30.64 | IGLTSRATWAQ | 20.72 | IGLTARATWAS | 5.01 | IGLSSRATWAK | 3.76 |
| NS5 | 3355 | 1.96 | 13 | 5 | 0 | Y | GLTARATWATN | 39.42 | GLTSRATWAKN | 30.64 | GLTSRATWAQN | 20.72 | GLTARATWASN | 5.01 | GLSSRATWAKN | 3.76 |
| NS5 | 3356 | 1.98 | 14 | 5 | 0 | Y | LTARATWATNI | 39.27 | LTSRATWAKNI | 30.64 | LTSRATWAQNI | 20.72 | LTARATWASNI | 5.01 | LSSRATWAKNI | 3.76 |

FIG. 23-1

Species: WNV (8-mers)

| protein | block starting position | block entropy | total peptides in block | # peptides required to cover 99% of block | gap/X fraction | 99% of block covered w/ <= 5 peptides? | block (99% cover) | frequency | block (99% cover) | frequency | block (99% cover) | frequency | block (99% cover) | frequency | block (99% cover) | frequency |
|---|---|---|---|---|---|---|---|---|---|---|---|---|---|---|---|---|
| anC | 1 | 0.05 | 2 | 1 | 0 | Y | MSKKPGGP | 99.44 | | | | | | | | |
| anC | 2 | 0.05 | 2 | 1 | 0 | Y | SKKPGGPG | 99.44 | | | | | | | | |
| anC | 3 | 0.05 | 2 | 1 | 0 | Y | KKPGGPGK | 99.44 | | | | | | | | |
| anC | 4 | 0.56 | 3 | 2 | 0 | Y | KPGGPGKS | 88.14 | KPGGPGKN | 11.3 | | | | | | |
| anC | 5 | 0.56 | 3 | 2 | 0 | Y | PGGPGKSR | 88.14 | PGGPGKNR | 11.3 | | | | | | |
| anC | 6 | 0.56 | 3 | 2 | 0 | Y | GGPGKSRA | 88.14 | GGPGKNRA | 11.3 | | | | | | |
| anC | 7 | 0.56 | 3 | 2 | 0 | Y | GPGKSRAV | 88.14 | GPGKNRAV | 11.

FIG. 23-2

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| anC | 28 | 0.26 | 4 | 3 | 0 | Y | IGLKRAML | 96.61 | IGLKRAVL | 1.69 | | |
| anC | 29 | 0.14 | 3 | 2 | 0 | Y | GLKRAMLS | 98.31 | | 1.13 | | |
| anC | 30 | 0.14 | 3 | 2 | 0 | Y | LKRAMLSL | 98.31 | | 1.13 | | |
| anC | 31 | 0.14 | 3 | 2 | 0.56 | Y | KRAMLSLI | 98.31 | | 1.13 | | |
| anC | 32 | 0.14 | 3 | 2 | 0.56 | Y | RAMLSLID | 97.74 | | 1.13 | | |
| anC | 33 | 0.14 | 3 | 2 | 0.56 | Y | AMLSLIDG | 97.74 | | 1.13 | | |
| anC | 34 | 0.38 | 4 | 3 | 0.56 | Y | MLSLIDGK | 93.79 | | 3.95 | | |
| anC | 35 | 0.27 | 2 | 2 | 0.56 | Y | LSLIDGKG | 94.92 | VLSLIDGK | 4.52 | | |
| anC | 36 | 0.27 | 2 | 2 | 0.56 | Y | SLIDGKGP | 94.92 | | 4.52 | | |
| anC | 37 | 0.41 | 5 | 4 | 0.56 | Y | LIDGKGPI | 93.79 | LIDGRGPT | 2.82 | LIDGKGPV | 0.56 |
| anC | 38 | 0.41 | 5 | 4 | 0.56 | Y | IDGKGPIR | 93.79 | IDGRGPTR | 2.82 | IDGKGPVR | 0.56 |
| anC | 39 | 0.41 | 5 | 4 | 0.56 | Y | DGKGPIRF | 93.79 | DGRGPTRF | 2.82 | DGKGPTRF | 0.56 |
| anC | 40 | 0.41 | 5 | 4 | 0 | Y | GKGPIRFV | 94.35 | GRGPTRFV | 2.82 | GKGPTRFV | 0.56 |
| anC | 41 | 0.41 | 5 | 4 | 0 | Y | KGPIRFVL | 94.35 | RGPTRFVL | 2.82 | KGPVRFVL | 0.56 |
| anC | 42 | 0.21 | 3 | 2 | 0 | Y | GPIRFVLA | 97.18 | | 2.26 | | |
| anC | 43 | 0.21 | 3 | 2 | 0 | Y | PIRFVLAL | 97.18 | | 2.26 | | |
| anC | 44 | 0.21 | 3 | 2 | 0 | Y | IRFVLALL | 97.18 | | 2.26 | | |
| anC | 45 | 0.21 | 3 | 2 | 0 | Y | RFVLALLA | 97.18 | | 2.26 | | |
| anC | 46 | 0.21 | 3 | 2 | 0 | Y | FVLALLAF | 97.18 | | 2.26 | | |
| anC | 47 | 0.21 | 3 | 2 | 0 | Y | VLALLAFF | 97.18 | | 2.26 | | |
| anC | 48 | 0.29 | 4 | 3 | 0 | Y | LALLAFFR | 96.05 | LALLAFFK | 1.13 | | |
| anC | 49 | 0.29 | 4 | 3 | 0 | Y | ALLAFFRF | 96.05 | ALLAFFKF | 1.13 | | |
| anC | 50 | 0.29 | 4 | 3 | 0 | Y | LLAFFRFT | 96.05 | LLAFFKFT | 1.13 | | |
| anC | 51 | 0.29 | 4 | 3 | 0 | Y | LAFFRFTA | 96.05 | LAFFKFTA | 1.13 | | |
| anC | 52 | 0.34 | 5 | 4 | 0 | Y | AFFRFTAI | 95.48 | AFFKFTAI | 1.13 | VFFRFTAI | 0.56 |

FIG. 23-3

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of

FIG. 23-4

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
|

FIG. 23-5

Species: WNV (8-mers)

| protein | block starting position | block entropy | total peptides in block | # peptides required to cover 99% of block | gap/X fraction | 99% of block covered w/ <= 5 peptides? | block (peptides required to cover 99% of block) | frequency | block | frequency | block | frequency | block | frequency |
|---|---|---|---|---|---|---|---|---|---|---|---|---|---|---|
| prM | 124 | 0.26 | 4 | 3 | 0 | Y | VTLSNFQG | 96.61 | LTLSNFQG | 2.26 | VTLSDFQG | 0.56 | | |
| prM | 125 | 0.1 | 3 | 2 | 0 | Y | TLSNFQGK | 98.87 | TLSDFQGK | 0.56 | | | | |
| prM | 126 | 0.24 | 3 | 2 | 0 | Y | LSNFQGKV | 96.61 | LSNFQGKL | 2.82 | | | | |
| prM | 127 | 0.32 | 3 | 3 | 0 | Y | SNFQGKVM | 95.48 | SNFQGKLM | 2.82 | SNFQGKVI | 0.56 | | |
| prM | 128 | 0.27 | 4 | 3 | 0 | Y | NFQGKVMM | 95.48 | NFQGKLMM | 2.82 | NFQGKVIM | 1.13 | | |
| prM | 129 | 0.27 | 4 | 3 | 0 | Y | FQGKVMMT | 96.05 | FQGKLMMT | 2.82 | FQGKVIMT | 1.13 | | |
| prM | 130 | 0.34 | 5 | 4 | 0 | Y | QGKVMMTV | 95.48 | QGKLMMTI | 2.26 | QGKVIMTV | 1.13 | QGKVMMTI | 0.56 |
| prM | 131 | 0.34 | 5 | 4 | 0 | Y | GKVMMTVN | 95.48 | GKLMMTIN | 2.26 | GKVIMTVN | 1.13 | GKLMMTVN | 0.56 |
| prM | 132 | 0.34 | 5 | 4 | 0 | Y | KVMMTVNA | 95.48 | KLMMTINA | 2.26 | KVIMTVNA | 1.13 | KLMMTVNA | 0.56 |
| prM | 133 | 0.34 | 5 | 4 | 0 | Y | VMMTVNAT | 95.48 | LMMTINAT | 2.26 | VIMTVNAT | 1.13 | VMMTINAT | 0.56 |
| prM | 134 | 0.3 | 4 | 4 | 0 | Y | MMTVNATD | 96.05 | MMTINATD | 2.26 | IMTVNATD | 1.13 | IMTVNATD | 0.56 |
| prM | 135 | 0.35 | 5 | 4 | 0 | Y | MTVNATDV | 95.48 | MTYNATDI | 1.69 | MTINATDT | 1.13 | MTINATDT | 0.56 |
| prM | 136 | 0.4 | 6 | 5 | 0 | Y | TVNATDVT | 94.92 | TVNATDIT | 1.69 | TINATETT | 1.13 | TINATDT | 1.13 |
| prM | 145 | 0.29 | 4 | 3 | 0 | Y | VITIPTAA | 96.61 | IITIPTAA | 1.13 | IITIPTAS | 1.13 | AITIPTAA | 0.56 |
| prM | 146 | 0.15 | 3 | 3 | 0 | Y | ITIPTAAG | 98.31 | ITIPIASG | 0.56 | ITIPTASG | 0.56 | | |
| prM | 147 | 0.15 | 3 | 3 | 0 | Y | TIPTAAGK | 98.31 | TIPIASGK | 0.56 | TIPPAAGK | 0.56 | | |
| prM | 148 | 0.15 | 3 | 3 | 0 | Y | IPTAAGKN | 98.31 | IPPAAGKN | 0.56 | IPTASGKN | 0.56 | | |
| prM | 149 | 0.15 | 3 | 3 | 0 | Y | PTAAGKNL | 98.31 | PIASGKNL | 0.56 | PAAGKNL | 0.56 | | |
| prM | 150 | 0.15 | 3 | 3 | 0 | Y | TAAGKNLC | 98.31 | PAAGKNLC | 0.56 | TASGKNLC | 0.56 | | |
| prM | 151 | 0.3 | 4 | 4 | 0 | Y | AAGKNLCT | 95.48 | AAGKNLCI | 3.39 | ASGKNLCT | 1.13 | AGKNLCTV | 1.13 |
| prM | 152 | 0.33 | 3 | 3 | 0 | Y | AGKNLCIV | 95.48 | AGKNLCTI | 2.26 | SGKNLCTV | 2.26 | | |
| prM | 153 | 0.31 | 3 | 3 | 0 | Y | GKNLCIVR | 95.48 | GKNLCTIR | 2.26 | GKNLCTVR | 2.26 | | |
| prM | 154 | 0.31 | 3 | 3 | 0 | Y | KNLCIVRA | 95.48 | KNLCTIRA | 2.26 | KNLCTVRA | 2.26 | | |
| prM | 155 | 0.33 | 4 | 3 | 0 | Y | NLCIVRAM | 95.48 | NLCTIRAM | 2.26 | NLCTVRAM | 2.26 | | |
| prM | 156 | 0.33 | 4 | 3 | 0 | Y | LCIVRAMD | 95.48 | LCTIRAMD | 2.26 | LCTVRAMD | 1.69 | | |

FIG. 23-6

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block |

FIG. 23-7

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

FIG. 23-8

Species: WNV (8-mers)

| protein | block starting position | block entropy | total peptides in block | # peptides required to cover 99% of block | gap/X fraction | 99% of block covered w/ <= 5 peptides? | block (99%) | frequency | block | frequency | block | frequency | block | frequency |
|---|---|---|---|---|---|---|---|---|---|---|---|---|---|---|
| prM | 212 | 0.21 | 3 | 2 | 0 | Y | RSRRSLTV | 97.18 | RSRRSLNV | 2.26 | | | | |
| prM | 213 | 0.21 | 3 | 2 | 0 | Y | SRRSLTVQ | 97.18 | SRRSLNVQ | 2.26 | | | | |
| prM | 214 | 0.26 | 4 | 3 | 0 | Y | RRSLTVQT | 96.61 | RRSLNVQV | 2.26 | | | | |
| prM | 215 | 0.21 | 3 | 2 | 0 | Y | RSLTVQTH | 97.18 | RSLNVQVH | 2.26 | | | | |
| prM | 216 | 0.21 | 3 | 2 | 0 | Y | SLTVQTHG | 97.18 | SLNVQVHG | 2.26 | | | | |
| prM | 217 | 0.26 | 4 | 3 | 0 | Y | LTVQTHGE | 96.61 | LNVQVHGE | 2.26 | | | | |
| prM | 218 | 0.26 | 4 | 3 | 0.56 | Y | TVQTHGES | 96.05 | NVQVHGES | 2.26 | RRSLTVQA | 0.56 | | |
| prM | 219 | 0.26 | 4 | 3 | 0.56 | Y | VQTHGEST | 96.05 | VQVHGESS | 2.26 | LTVQTHGK | 0.56 | | |
| prM | 220 | 0.26 | 4 | 3 | 0.56 | Y | QTHGESTL | 96.05 | QVHGESSL | 2.26 | TVQTHGKS | 0.56 | | |
| prM | 221 | 0.43 | 6 | 5 | 0.56 | Y | THGESTLA | 93.79 | VHGESSLS | 2.26 | VQAHGEST | 0.56 | | |
| prM | 222 | 0.38 | 5 | 4 | 0.56 | Y | HGESTLAN | 94.35 | HGESSLSN | 2.26 | QTHGKSTL | 0.56 | | |
| prM | 223 | 0.38 | 5 | 4 | 0.56 | Y | GESTLANK | 94.35 | GESSLSNR | 2.26 | THGESTLS | 1.69 | THGESTLV | 0.56 |
| prM | 224 | 0.38 | 5 | 4 | 0.56 | Y | ESTLANKK | 94.35 | ESSLSNRK | 2.26 | HGESTLSN | 1.69 | HGESTLVN | 0.56 |
| prM | 225 | 0.33 | 4 | 3 | 0.56 | Y | STLANKKG | 94.92 | SSLSNRKG | 2.26 | GESTLSNK | 1.69 | GKSTLANK | 0.56 |
| prM | 226 | 0.33 | 4 | 3 | 0 | Y | TLANKKGA | 95.48 | SLSNRKGA | 2.26 | ESTLSNKK | 1.69 | KSTLANKK | 0.56 |
| prM | 227 | 0.33 | 4 | 3 | 0 | Y | LANKKGAW | 95.48 | LSNRKGAW | 2.26 | STLSNKKG | 1.69 | | |
| prM | 228 | 0.72 | 5 | 4 | 0 | Y | ANKKGAWM | 87.57 | ANKKGAWL | 2.26 | TLSNKKGA | 1.69 | | |
| prM | 229 | 0.62 | 4 | 3 | 0 | Y | NKKGAWMD | 88.7 | NKKGAWLD | 7.91 | LSNRKGAW | 2.26 | SNKKGAWM | 1.69 |
| prM | 230 | 0.62 | 4 | 3 | 0 | Y | KKGAWMDS | 88.7 | KKGAWLDS | 8.47 | SNRKGAWL | 2.26 | | |
| prM | 231 | 0.54 | 3 | 2 | 0 | Y | KGAWMDST | 88.7 | KGAWLDST | 8.47 | NRKGAWLD | 2.26 | | |
| prM | 232 | 0.54 | 3 | 2 | 0 | Y | GAWMDSTK | 88.7 | GAWLDSTK | 10.73 | RKGAWLDS | 2.26 | | |
| prM | 233 | 0.54 | 3 | 2 | 0 | Y | AWMDSTKA | 88.7 | AWLDSTKA | 10.73 | | | | |
| prM | 234 | 0.62 | 4 | 3 | 0 | Y | WMDSTKAT | 88.7 | WLDSTKAT | 10.73 | WLDSTKAS | 2.26 | | |
| prM | 235 | 0.62 | 4 | 3 | 0 | Y | MDSTKATR | 88.7 | LDSTKATR | 8.47 | LDSTKASR | 2.26 | | |
| prM | 236 | 0.21 | 3 | 2 | 0 | Y | DSTKATRY | 97.18 | DSTKASRY | 2.26 | | | | |

FIG. 23-9

Species: WNV (8-mers)

| protein | block starting position | block entropy | total peptides in block | # peptides required to cover 99% of block | gap/X fraction | 99% of block covered w/ <= 5 peptides? | pe

FIG. 23-10

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 262 | 0.1 | 3 | 2 | 0 | Y | AVIGWMLG | 98.87 | AVTGWMLG | 0.56 | | | | |
| prM | 263 | 0.05 | 2 | 1 | 0 | Y | VIGWMLGS | 99.44 | | | | | | |
| prM | 264 | 0.05 | 2 | 1 | 0 | Y | IGWMLGSN | 99.44 | | | | | | |
| prM | 265 | 0.05 | 2 | 1 | 0 | Y | GWMLGSNT | 99.44 | | | | | | |
| prM | 266 | 0.24 | 3 | 2 | 0 | Y | WMLGSNTM | 96.61 | WMLGSNTT | 2.82 | | | | |
| prM | 267 | 0.24 | 3 | 2 | 0 | Y | MLGSNTMQ | 96.61 | MLGSNTTQ | 2.82 | | | | |
| prM | 268 | 0.24 | 3 | 2 | 0 | Y | LGSNTMQR | 96.61 | LGSNTTQR | 2.82 | | | | |
| prM | 269 | 0.24 | 3 | 2 | 0 | Y | GSNTMQRV | 96.61 | GSNTTQRV | 2.82 | | | | |
| prM | 270 | 0.24 | 3 | 2 | 0 | Y | SNTMQRVV | 96.61 | SNTTQRVV | 2.82 | | | | |
| prM | 271 | 0.24 | 3 | 2 | 0 | Y | NTMQRVVF | 96.61 | NTTQRVVF | 2.82 | | | | |
| prM | 272 | 0.81 | 5 | 4 | 0 | Y | TMQRVVFV | 85.31 | TMQRVVFA | 9.6 | TTQRVVFM | 2.82 | TMQRVVFI | 1.69 |
| prM | 273 | 0.85 | 6 | 5 | 0 | Y | MQRVVFVV | 85.88 | MQRVVFAI | 7.34 | TQRVVFMI | 2.26 | MQRVVFAV | 2.26 | MQRVVFIV | 1.69 |
| prM | 274 | 0.85 | 6 | 5 | 0 | Y | QRVVFVVL | 85.88 | QRVVFAIL | 7.34 | QRVVFMIL | 2.26 | QRVVFAVL | 2.26 | QRVVFIVL | 1.69 |
| prM | 275 | 0.85 | 6 | 5 | 0 | Y | RVVFVVLL | 85.88 | RVVFAILL | 7.34 | RVVFAVLL | 2.26 | RVVFMILL | 2.26 | RVVFIVLL | 1.69 |
| prM | 276 | 0.85 | 6 | 5 | 0 | Y | VVFVVLLL | 85.88 | VVFAILLL | 7.34 | VVFAVLLL | 2.26 | VVFMILLL | 2.26 | VVFIVLLL | 1.69 |
| prM | 277 | 0.85 | 6 | 5 | 0 | Y | VFVVLLLL | 85.88 | VFAILLLL | 7.34 | VFAVLLLL | 2.26 | VFMILLLL | 2.26 | VFIVLLLL | 1.69 |
| prM | 278 | 0.85 | 6 | 5 | 0 | Y | FVVLLLLV | 85.88 | FAILLLLV | 7.34 | FMILLLLV | 2.26 | FAVLLLLV | 2.26 | FIVLLLLV | 1.69 |
| prM | 279 | 0.85 | 6 | 5 | 0 | Y | VVLLLLVA | 85.88 | AILLLLVA | 7.34 | MILLLLVA | 2.26 | AVLLLLVA | 2.26 | IVLLLLVA | 1.69 |
| prM | 280 | 0.46 | 2 | 2 | 0 | Y | VLLLLVAP | 90.4 | ILLLLVAP | 9.6 | | | | |
| prM | 281 | 0 | 1 | 1 | 0 | Y | LLLLVAPA | 100 | | | | | | |
| prM | 282 | 0 | 1 | 1 | 0 | Y | LLLVAPAY | 100 | | | | | | |
| prM | 283 | 0 | 1 | 1 | 0 | Y | LLVAPAYS | 100 | | | | | | |
| prM | 284 | 0 | 1 | 1 | 0 | Y | LVAPAYSF | 100 | | | | | | |
| prM | 285 | 0 | 1 | 1 | 0 | Y | VAPAYSFN | 100 | | | | | | |
| prM | 286 | 0 | 1 | 1 | 0 | Y | APAYSFNC | 100 | | | | | | |

FIG. 23-11

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

FIG. 23-12

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 312 | 0 | 1 | 1 | 0 | Y | DLVLEGDS | 100 | | | | | | |
| E | 313 | 0 | 1 | 1 | 0 | Y | LVLEGDSC | 100 | | | | | | |
| E | 314 | 0 | 1 | 1 | 0 | Y | VLEGDSCV | 100 | | | | | | |
| E | 315 | 0 | 1 | 1 | 0 | Y | LEGDSCVT | 100 | | | | | | |
| E | 316 | 0.05 | 2 | 1 | 0 | Y | EGDSCVTI | 99.44 | | | | | | |
| E | 317 | 0.1 | 3 | 2 | 0 | Y | GDSCVTIM | 98.87 | GDSCVTIT | 0.56 | | | | |
| E | 318 | 0.22 | 4 | 3 | 0 | Y | DSCVTIMS | 97.18 | DSCVTIMA | 1.69 | DSCVTITA | 0.56 | | |
| E | 319 | 0.22 | 4 | 3 | 0 | Y | SCVTIMSK | 97.18 | SCVTIMAK | 1.69 | SCVTLMSK | 0.56 | | |
| E | 320 | 0.27 | 5 | 4 | 0 | Y | CVTIMSKD | 96.61 | CVTIMAKD | 1.69 | CVTIMSKN | 0.56 | CVTITAKD | 0.56 |
| E | 321 | 0.27 | 5 | 4 | 0 | Y | VTIMSKDK | 96.61 | VTIMAKDR | 1.69 | VTITAKDR | 0.56 | VTIMSKNK | 0.56 |
| E | 322 | 0.27 | 5 | 4 | 0 | Y | TIMSKDKP | 96.61 | TIMAKDRP | 1.69 | TIMSKNKP | 0.56 | TLMSKDKP | 0.56 |
| E | 323 | 0.22 | 4 | 3 | 0 | Y | IMSKDKPT | 97.18 | IMAKDRPT | 1.69 | ITAKDRPT | 0.56 | IMSKNKPT | 0.56 |
| E | 324 | 0.22 | 4 | 3 | 0 | Y | MSKDKPTI | 97.18 | MAKDRPTI | 1.69 | MSKNKPTI | 0.56 | | |
| E | 325 | 0.21 | 3 | 2 | 0 | Y | SKDKPTID | 97.18 | AKDRPTID | 2.26 | | | | |
| E | 326 | 0.21 | 3 | 2 | 0 | Y | KDKPTIDV | 97.18 | KDRPTIDV | 2.26 | | | | |
| E | 327 | 0.21 | 3 | 2 | 0 | Y | DKPTIDVK | 97.18 | DRPTIDVK | 2.26 | | | | |
| E | 328 | 0.16 | 2 | 2 | 0 | Y | KPTIDVKM | 97.74 | RPTIDVKM | 2.26 | | | | |
| E | 329 | 0.21 | 3 | 2 | 0 | Y | PTIDVKMM | 97.18 | PTIDVKMV | 2.26 | | | | |
| E | 330 | 0.26 | 4 | 3 | 0 | Y | TIDVKMMN | 96.61 | TIDVKMVT | 2.26 | TIDVKMMK | 0.56 | | |
| E | 331 | 0.31 | 5 | 4 | 0 | Y | IDVKMMNM | 96.05 | IDVKMVTM | 2.26 | IDVKMMKM | 0.56 | IDVKMMNV | 0.56 |
| E | 332 | 0.31 | 5 | 4 | 0 | Y | DVKMMNME | 96.05 | DVKMYTMG | 2.26 | DVKMTNME | 0.56 | DVKMMKME | 0.56 |
| E | 333 | 0.31 | 5 | 4 | 0 | Y | VKMMNMEA | 96.05 | VKMVTMGA | 2.26 | VKMTNMEA | 0.56 | VKMMNVEA | 0.56 |
| E | 343 | 0.66 | 6 | 4 | 0 | Y | LAEVRSYC | 89.27 | LADVRSYC | 6.78 | MAEVRSYC | 2.26 | LAGVRDYC | 0.56 |
| E | 344 | 0.56 | 6 | 5 | 0 | Y | AEVRSYCY | 90.96 | ADVRSYCY | 6.78 | GDVRSYCY | 0.56 | AEVRSYCH | 0.56 |
| E | 345 | 0.71 | 6 | 5 | 0 | Y | EVRSYCYL | 88.14 | DVRSYCYL | 7.34 | EVRSYCYA | 2.82 | GVRDYCYL | 0.56 |

| peptides required to cover 99% of block | frequency |
|---|---|
| | |
| | |
| | |
| | |
| | |
| | |
| | |
| | |
| | |
| | |
| | |
| | |
| | |
| | |
| | |
| | |
| | |
| | |
| | |
| | |
| | |
| | |
| LGDVRSYC | 0.56 |
| ADVRHYCY | 0.56 |
| EVRSYCHL | 0.56 |

FIG. 23-13

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 346 | 0.34 | 5 | 4 | 0 | Y | VRSYCYLA | 95.48 | VRSYCYAA | 2.82 | VRDYCYLA | 0.56 | | |
| E | 355 | 0.69 | 6 | 5 | 0 | Y | VSDLSTKA | 89.27 | VSDLSTRA | 5.65 | VSELSTKA | 1.69 | VSELSTRA | 0.56 |
| E | 356 | 0.69 | 6 | 5 | 0 | Y | SDLSTKAA | 89.27 | SDLSTRAA | 5.65 | SELSTKAA | 1.69 | NDL

FIG. 23-14

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 387 | 0 | 1 | 1 | 0.56 | Y | V

FIG. 23-15

Species: WNY (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 412 | 1.36 | 5 | 4 | 0 | Y | STKAIGRT | 64.97 | STKAIGRT | 24.29 | TTKATGWI | 7.91 | SNKATGLT | 2.26 |
| E | 413 | 1.36 | 5 | 4 | 0 | Y | TKAIGRTI | 64.97 | TKATGRTI | 24.29 | TKATGWII | 7.91 | NKATGLTI | 2.26 |
| E | 414 | 1.33 | 4 | 4 | 0 | Y | KAIGRTIL | 64.97 | KATGRTIL | 24.29 | KATGWIIQ | 8.47 | KATGLTIQ | 2.26 |
| E | 415 | 1.33 | 4 | 4 | 0 | Y | AIGRTILK | 64.97 | ATGRTILK | 24.29 | ATGWIIQK | 8.47 | ATGLTIQR | 2.26 |
| E | 416 | 1.33 | 4 | 4 | 0 | Y | IGRTILKE | 64.97 | TGRTILKE | 24.29 | TGWIIQKE | 8.47 | TGLTIQRE | 2.26 |
| E | 417 | 0.62 | 4 | 3 | 0 | Y | GRTILKEN | 88.7 | GWIIQKEN | 8.47 | GLTIQREN | 2.26 | | |
| E | 418 | 0.62 | 4 | 3 | 0 | Y | RTILKENI | 88.7 | WIIQKENI | 8.47 | LTIQRENV | 2.26 | | |
| E | 419 | 0.62 | 4 | 3 | 0 | Y | TILKENIK | 88.7 | IIQKENIK | 8.47 | TIQRENVK | 2.26 | | |
| E | 420 | 0.62 | 4 | 3 | 0 | Y | ILKENIKY | 88.7 | IQKENIKY | 8.47 | IQRENVKY | 2.26 | | |
| E | 421 | 0.62 | 4 | 3 | 0 | Y | LKENIKYE | 88.7 | QKENIKYE | 8.47 | QRENVKYE | 2.26 | | |
| E | 422 | 0.21 | 3 | 2 | 0 | Y | KENIKYEV | 97.18 | RENVKYEV | 2.26 | | | | |
| E | 423 | 0.21 | 3 | 2 | 0 | Y | ENIKYEVA | 97.18 | ENVKYEVA | 2.26 | | | | |
| E | 424 | 0.22 | 4 | 3 | 0 | Y | NIKYEVAI | 97.18 | NVKYEVAA | 1.69 | BIKYEVAI | 0.56 | | |
| E | 425 | 0.17 | 3 | 2 | 0 | Y | IKYEVAIF | 97.74 | VKYEVAAF | 1.69 | | | | |
| E | 426 | 0.17 | 3 | 2 | 0 | Y | KYEVAIFV | 97.74 | KYEVAAFV | 1.69 | | | | |
| E | 427 | 0.17 | 3 | 2 | 0 | Y | YEVAIFVH | 97.74 | YEVAAFVH | 1.69 | | | | |
| E | 428 | 0.17 | 3 | 2 | 0 | Y | EVAIFVHG | 97.74 | EVAAFVHG | 1.69 | | | | |
| E | 429 | 0.17 | 3 | 2 | 0 | Y | VAIFVHGP | 97.74 | VAAFVHGP | 1.69 | | | | |
| E | 430 | 0.17 | 3 | 2 | 0 | Y | AIFVHGPT | 97.74 | AAFVHGPT | 1.69 | | | | |
| E | 431 | 0.17 | 2 | 1 | 0 | Y | IFVHGPTT | 97.74 | AFVHGPTT | 1.69 | | | | |
| E | 432 | 0.05 | 2 | 2 | 0 | Y | FVHGPTTV | 99.44 | | | | | | |
| E | 433 | 0.19 | 3 | 2 | 0 | Y | VHGPTTVE | 97.18 | VHGPTTVD | 2.82 | | | | |
| E | 434 | 0.21 | 3 | 2 | 0 | Y | HGPTTVES | 97.18 | HGPTTVDT | 2.26 | | | | |
| E | 435 | 0.21 | 3 | 2 | 0 | Y | GPTTVESH | 97.18 | GPTTVDTH | 2.26 | | | | |
| E | 436 | 0.26 | 4 | 3 | 0.56 | Y | PTTVESHG | 96.05 | PTTVDTHS | 1.69 | PTTVESHR | 1.13 | | |

Species: WNV (8-mers)

| protein | block starting position | block entropy | total peptides in block | # peptides required to cover 99% of block | gap/X fraction of 99% of block | covered w/ <= 5 peptides? | peptides required to cover 99% of block | frequency | peptides required to cover 99% of block | frequency |

FIG. 23-18

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 521 | 0.81 | 6 | 5 | 0.56 | Y | TWRNRET | 85.88 | TTWRNRET | 7.91 | NWWRNRET | 2.26 | TNWRNREA | 2.26 | TAWRNRET | 0.56 |
| E | 522 | 0.7 | 6 | 5 | 0.56 | Y | WRNRETL | 87.57 | TWRNRETL | 7.91 | NWRNREAL | 2.26 | VWRNRETF | 0.56 | AWRNRETL | 0.56 |
| E | 523 | 0.35 | 5 | 4 | 0.56 | Y | WRNRETLM | 94.92 | WRNREALV | 2.26 | WRNRETLV | 1.13 | WRNRETFM | 0.56 | |
| E | 524 | 0.34 | 5 | 4 | 0 | Y | RNRETLME | 95.48 | RNREALVE | 2.26 | RNRETLVE | 1.13 | RNRGTLME | 0.56 | |
| E | 525 | 0.34 | 5 | 4 | 0 | Y | NRETLMEF | 95.48 | NREALVEF | 2.26 | NRETLVEF | 1.13 | NRGTLMEF | 0.56 | |
| E | 526 | 0.34 | 5 | 4 | 0 | Y | RETLMEFE | 95.48 | REALVEFE | 2.26 | RETLVEFE | 1.13 | RGTLMEFE | 0.56 | |
| E | 527 | 0.34 | 5 | 4 | 0 | Y | ETLMEFEE | 95.48 | EALVEFEE | 2.26 | ETLVEFEE | 1.13 | ETFMEFEE | 0.56 | |
| E | 528 | 0.29 | 4 | 3 | 0 | Y | TLMEFEEP | 96.05 | ALVEFEEP | 2.26 | TLVEFEEP | 1.13 | | | |
| E | 529 | 0.29 | 4 | 3 | 0 | Y | LMEFEEPH | 96.05 | LVEFEEPH | 2.26 | LVEFEEPH | 1.13 | | | |
| E | 530 | 0.24 | 3 | 2 | 0 | Y | MEFEEPHA | 96.61 | VEFEEAHA | 2.26 | VEFEEPHA | 1.13 | | | |
| E | 531 | 0.16 | 2 | 2 | 0 | Y | EFEEPHAT | 97.74 | EFEEAHAT | 2.26 | | | | | |
| E | 532 | 0.16 | 2 | 2 | 0 | Y | FEEPHATK | 97.74 | FEEAHATK | 2.26 | | | | | |
| E | 533 | 0.21 | 3 | 2 | 0 | Y | EEPHATKQ | 97.18 | EEAHATKQ | 2.26 | | | | | |
| E | 534 | 0.21 | 3 | 2 | 0 | Y | EPHATKQS | 97.18 | EAHATKQS | 2.26 | | | | | |
| E | 535 | 0.21 | 3 | 2 | 0 | Y | PHATKQSV | 97.18 | AHATKQSV | 2.26 | | | | | |
| E | 536 | 0.54 | 3 | 2 | 0 | Y | HATKQSVI | 88.7 | HATKQSVV | 10.73 | | | | | |
| E | 537 | 0.54 | 3 | 2 | 0 | Y | ATKQSVIA | 88.7 | ATKQSVVA | 10.73 | | | | | |
| E | 538 | 0.54 | 3 | 2 | 0 | Y | TKQSVIAL | 88.7 | TKQSVVAL | 10.73 | | | | | |
| E | 539 | 0.54 | 3 | 2 | 0 | Y | KQSVIALG | 88.7 | KQSVVALG | 10.73 | | | | | |
| E | 540 | 0.54 | 3 | 2 | 0 | Y | QSVIALGS | 88.7 | QSVVALGS | 10.73 | | | | | |
| E | 541 | 0.51 | 2 | 2 | 0 | Y | SVIALGSQ | 88.7 | SVVALGSQ | 11.3 | | | | | |
| E | 542 | 0.51 | 2 | 2 | 0 | Y | VIALGSQE | 88.7 | VVALGSQE | 11.3 | | | | | |
| E | 543 | 0.51 | 2 | 2 | 0 | Y | IALGSQEG | 88.7 | VALGSQEG | 11.3 | | | | | |
| E | 544 | 0 | 1 | 1 | 0 | Y | ALGSQEGA | 100 | | | | | | | |
| E | 545 | 0 | 1 | 1 | 0 | Y | LGSQEGAL | 100 | | | | | | | |

FIG. 23-19

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 546 | 0.05 | 2 | 1 | 0 | Y | GSQEGALH | 99.44 | | | | | | |
| E | 547 | 0.05 | 2 | 1 | 0 | Y | SQEGALHQ | 99.44 | | | | | | |
| E | 548 | 0.05 | 2 | 1 | 0 | Y | QEGALHQA | 99.44 | | | | | | |
| E | 549 | 0.05 | 2 | 1 | 0 | Y | EGALHQAL | 99.44 | | | | | | |
| E | 550 | 0.05 | 2 | 1 | 0 | Y | GALHQALA | 99.44 | | | | | | |
| E | 551 | 0.05 | 3 | 1 | 0 | Y | ALHQALAG | 99.44 | | | | | | |
| E | 552 | 0.1 | 3 | 2 | 0 | Y | LHQALAGA | 98.87 | LHQALAGT | 0.56 | | | | |
| E | 553 | 0.1 | 2 | 2 | 0 | Y | HQALAGAI | 98.87 | QQALAGAI | 0.56 | | | | |
| E | 554 | 0.05 | 2 | 1 | 0 | Y | QALAGAIP | 99.44 | | | | | | |
| E | 555 | 0.1 | 3 | 2 | 0 | Y | AL

FIG. 23-20

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 571 | 0.16 | 2 | 2 | 0 | Y | LTSGHLKC | 97.74 | LSSGHLKC | 2.26 | | | | |
| E | 572 | 0.16 | 2 | 2 | 0 | Y | TSGHLKCR | 97.74 | SSGHLKCR | 2.26 | | | | |
| E | 573 | 0 | 1 | 1 | 0 | Y | SGHLKCRV | 100 | | | | | | |
| E | 574 | 0.29 | 2 | 2 | 0 | Y | GHLKCRVK | 94.92 | GHLKCRVR | 5.08 | | | | |
| E | 575 | 0.29 | 2 | 2 | 0 | Y | HLKCRVKM | 94.92 | HLKCRVRM | 5.08 | | | | |
| E | 576 | 0.34 | 3 | 2 | 0 | Y | LKCRVKME | 94.35 | LKCRVRME | 5.08 | | | | |
| E | 577 | 0.34 | 3 | 2 | 0 | Y | KCRVKMEK | 94.35 | KCRVRMEK | 5.08 | | | | |
| E | 578 | 0.34 | 3 | 2 | 0 | Y | CRVKMEKL | 94.35 | CRVRMEKL | 5.08 | | | | |
| E | 579 | 0.49 | 4 | 3 | 0 | Y | RVKMEKLQ | 92.09 | RVRMEKLQ | 5.08 | RVKMEKLK | 2.26 | | |
| E | 580 | 0.5 | 4 | 3 | 0.56 | Y | VKMEKLQL | 91.53 | VRMEKLQL | 5.08 | VKMEKLKL | 2.26 | | |
| E | 581 | 0.5 | 4 | 3 | 0.56 | Y | KMEKLQLK | 91.53 | RMEKLQLK | 5.08 | KMEKLKLK | 2.26 | | |
| E | 582 | 0.21 | 3 | 2 | 0.56 | Y | MEKLQLKG | 96.61 | MEKLKLKG | 2.26 | | | | |
| E | 583 | 0.19 | 2 | 2 | 0.56 | Y | EKLQLKGT | 96.61 | EKLKLKGT | 2.82 | | | | |
| E | 584 | 0.19 | 2 | 2 | 0.56 | Y | KLQLKGTT | 96.61 | KLKLKGTT | 2.82 | | | | |
| E | 585 | 0.19 | 2 | 2 | 0.56 | Y | LQLKGTTY | 96.61 | LKLKGTTY | 2.82 | | | | |
| E | 586 | 0.19 | 2 | 2 | 0.56 | Y | QLKGTTYG | 96.61 | KLKGTTYG | 2.82 | | | | |
| E | 587 | 0 | 1 | 1 | 0 | Y | LKGTTYGV | 99.44 | | | | | | |
| E | 588 | 0 | 1 | 1 | 0 | Y | KGTTYGVC | 100 | | | | | | |
| E | 589 | 0.19 | 2 | 2 | 0 | Y | GTTYGVCS | 97.18 | GTTYGVCA | 2.82 | | | | |
| E | 590 | 0.19 | 2 | 2 | 0 | Y | TTYGVCSK | 97.18 | TTYGVCAK | 2.82 | | | | |
| E | 591 | 0.19 | 2 | 2 | 0 | Y | TYGVCSKA | 97.18 | TYGVCAKA | 2.82 | | | | |
| E | 592 | 0.19 | 2 | 2 | 0 | Y | YGVCSKAF | 97.18 | YGVCAKAF | 2.82 | | | | |
| E | 593 | 0.33 | 4 | 3 | 0 | Y | GVCSKAFK | 95.48 | GVCAKAFR | 2.26 | GVCSKAFR | 1.69 | | |
| E | 594 | 0.33 | 4 | 3 | 0.56 | Y | VCSKAFKF | 94.92 | VCAKAFRF | 2.26 | VCSKAFRF | 1.69 | | |
| E | 603 | 0.39 | 4 | 3 | 0 | Y | GTPADTGH | 94.35 | RTPADTGH | 2.82 | NTPADTGH | 2.26 | | |

FIG. 23-21

Species: WNV (8-mers)

| protein | block starting position | block entropy | total peptides in block | # peptides required to cover 99% of block | gap/X fraction | 99% of block covered w/ <= 5 peptides? | block 99% of peptides required to cover |

FIG. 23-22

Species: WNV (8-mers)

| protein | block starting position | block entropy | total pe

FIG. 23-23

Species: WNV (8-mers)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 658 | 0.67 | 5 | 4 | 0 | Y | NAKVLIEL | 88.14 | NSKVLIEL | 8.47 | NAKILVEL | 2.26 | DAKVLIEL | 0.56 | | |
| E | 659 | 0.62 | 4 | 3 | 0 | Y | AKVLIELE | 88.7 | SKVLIELE | 8.47 | AKILVELE | 2.26 | | | | |
| E | 660 | 0.21 | 3 | 2 | 0 | Y | KVLIELEP | 97.18 | KILVELEP | 2.26 | | | | | | |
| E | 661 | 0.21 | 3 | 2 | 0 | Y | VLIELEPP | 97.18 | ILVELEPP | 2.26 | | | | | | |
| E | 662 | 0.19 | 2 | 2 | 0 | Y | LIELEPPF | 97.18 | LVELEPPF | 2.82 | | | | | | |
| E | 663 | 0.19 | 2 | 2 | 0 | Y | IELEPPFG | 97.18 | VELEPPFG | 2.82 | | | | | | |
| E | 664 | 0 | 1 | 1 | 0 | Y | ELEPPFGD | 100 | | | | | | | | |
| E | 665 | 0 | 1 | 1 | 0 | Y | LEPPFGDS | 100 | | | | | | | | |
| E | 666 | 0 | 1 | 1 | 0 | Y | EPPFGDSY | 100 | | | | | | | | |
| E | 667 | 0 | 1 | 1 | 0 | Y | PPFGDSYI | 100 | | | | | | | | |
| E | 668 | 0 | 1 | 1 | 0 | Y | PFGDSYIV | 100 | | | | | | | | |
| E | 669 | 0.16 | 2 | 2 | 0 | Y | FGDSYIVV | 97.74 | FGDSYIVI | 2.26 | | | | | | |
| E | 670 | 0.16 | 2 | 2 | 0 | Y | GDSYIVVG | 97.74 | GDSYIVIG | 2.26 | | | | | | |
| E | 671 | 0.16 | 2 | 2 | 0 | Y | DSYIVVGR | 97.74 | DSYIVIGK | 2.26 | | | | | | |
| E | 672 | 0.16 | 2 | 2 | 0 | Y | SYIVVGRG | 97.74 | SYIVIGKG | 2.26 | | | | | | |
| E | 673 | 0.16 | 2 | 2 | 0 | Y | YIVVGRGE | 97.74 | YIVIGKGD | 2.26 | | | | | | |
| E | 674 | 0.21 | 3 | 2 | 0 | Y | IVVGRGEQ | 97.18 | IVIGKGDQ | 2.26 | | | | | | |
| E | 675 | 0.21 | 3 | 2 | 0 | Y | VVGRGEQQ | 97.18 | VIGKGDQQ | 2.26 | | | | | | |
| E | 676 | 0.21 | 3 | 2 | 0 | Y | VGRGEQQI | 97.18 | IGKGDQQV | 2.26 | | | | | | |
| E | 677 | 0.26 | 4 | 3 | 0 | Y | GRGEQQIN | 96.61 | GKGDQQVT | 2.26 | GRGEHQIN | 0.56 | | | | |
| E | 678 | 0.26 | 4 | 3 | 0 | Y | RGEQQINH | 96.61 | KGDQQVTH | 2.26 | RGEQQISH | 0.56 | | | | |
| E | 679 | 0.26 | 4 | 3 | 0 | Y | GEQQINHH | 96.61 | GDQQVTHH | 2.26 | GEQQISHH | 0.56 | | | | |
| E | 680 | 0.26 | 4 | 3 | 0 | Y | EQQINHHW | 96.61 | DQQVTHHW | 2.26 | EHQINHHW | 0.56 | | | | |
| E | 681 | 0.31 | 5 | 4 | 0 | Y | QQINHHWH | 96.05 | QQVTHHWH | 2.26 | QQINHHWY | 0.56 | HQINHHWH | 0.56 | | |
| E | 682 | 0.26 | 4 | 3 | 0 | Y | QINHHWHK | 96.61 | QVTHHWHK | 2.26 | QISHHWHK | 0.56 | | | | |

FIG. 23-24

Species: WNV (8-mers)

| protein | block starting position | block entropy | total peptides in block | # peptides required to cover 99% of block | gap/X fraction 99% of block | covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 683 | 0.26 | 4 | 3 | 0 | Y | INHHWHKS | 96.61 | VTHHWHKS | 2.26 | ISHHWHKS | 0.56 | | |
| E | 684 | 0.26 | 4 | 3 | 0 | Y | NHHWHKSG | 96.61 | THHWHKSG | 2.26 | SHHWHKSG | 0.56 | | |
| E | 685 | 0.1 | 3 | 2 | 0 | Y | HHWHKSGS | 98.87 | HHWYKSGS | 0.56 | | | | |
| E | 686 | 0.1 | 3 | 2 | 0 | Y | HWHKSGSS | 98.87 | HWYKSGIS | 0.

FIG. 23-25

Species: WNV (8-mers)

| protein | block starting position | block entropy | total peptides in block | # peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| E | 708 | 0.16 | 2 | 2 | 0 | Y | LAALGDTA | 97.74 | LVSLGDTA | 2.26 | | | | |
| E | 709 | 0.16 | 2 | 2 | 0 | Y | AALGDTAW | 97.74 | VSLGDTAW | 2.26 | | | | |
| E | 710 | 0.16 | 2 | 2 | 0 | Y | ALGDTAWD | 97.74 | SLGDTAWD | 2.26 | | | | |
| E | 711 | 0 | 1 | 1 | 0 | Y | LGDTAWDF | 100 | | | | | | |
| E | 712 | 0 | 1 | 1 | 0 | Y | GDTAWDFG | 100 | | | | | | |
| E | 713 | 0 | 1 | 1 | 0 | Y | DTAWDFGS | 100 | | | | | | |
| E | 714 | 0.19 | 2 | 2 | 0 | Y | TAWDFGSV | 97.18 | TAWDFGSI | 2.82 | | | | |
| E | 715 | 0.19 | 2 | 2 | 0 | Y | AWDFGSVG | 97.18 | AWDFGSIG | 2.82 | | | | |
| E | 716 | 0.19 | 2 | 2 | 0 | Y | WDFGSVGG | 97.18 | WDFGSIGG | 2.82 | | | | |
| E | 717 | 0.24 | 3 | 3 | 0 | Y | DFGSVGGV | 96.61 | DFGSIGGV | 2.82 | FGSVGGVL | 0.56 | | |
| E | 718 | 0.29 | 4 | 4 | 0 | Y | FGSVGGVF | 96.05 | FGSIGGVF | 2.82 | GSVGGVFN | 2.26 | GSVGGIFT | 0.56 |
| E | 719 | 0.44 | 5 | 4 | 0 | Y | GSVGGVFT | 93.79 | GSIGGVFT | 2.82 | SVGGVFNS | 2.26 | SVGGIFTS | 0.56 |
| E | 720 | 0.44 | 5 | 4 | 0 | Y | SVGGVFTS | 93.79 | SIGGVFTS | 2.82 | VGGVFNSI | 2.26 | VGGVLTSV | 0.56 |
| E | 721 | 0.44 | 5 | 4 | 0 | Y | VGGVFTSY | 93.79 | IGGVFTSY | 2.82 | GGIFTSFG | 0.56 | | |
| E | 722 | 0.26 | 4 | 3 | 0 | Y | GGVFTSYG | 96.61 | GGVFNSIG | 2.26 | GIFTSFGK | 0.56 | | |
| E | 723 | 0.26 | 4 | 3 | 0 | Y | GVFTSYGK | 96.61 | GVFNSIGK | 2.26 | IFTSFGKA | 0.56 | | |
| E | 724 | 0.26 | 4 | 3 | 0 | Y | VFTSYGKA | 96.61 | VFNSIGKA | 2.26 | FNSIGKAV | 2.26 | FTSFGKAV | 0.56 |
| E | 725 | 0.73 | 5 | 4 | 0 | Y | FTSYGKAV | 86.44 | FTSVGKAI | 10.17 | NSIGKAVH | 2.26 | TSVGQAIH | 0.56 |
| E | 726 | 0.73 | 5 | 4 | 0 | Y | TSYGKAVH | 86.44 | TSVGKAIH | 10.17 | SIGKAVHQ | 2.26 | SFGKAVHQ | 0.56 |
| E | 727 | 0.73 | 5 | 4 | 0 | Y | SYGKAVHQ | 86.44 | SVGKAIHQ | 10.17 | IGKAVHQL | 2.26 | VGQAIHQV | 0.56 |
| E | 728 | 0.73 | 5 | 4 | 0 | Y | YGKAVHQV | 86.44 | VGKAIHQV | 10.17 | GKAVHQLF | 2.26 | | |
| E | 729 | 0.68 | 4 | 3 | 0 | Y | GKAVHQVF | 87.01 | GKAIHQVF | 10.17 | KAVHQLFG | 2.26 | | |
| E | 730 | 0.68 | 4 | 3 | 0 | Y | KAVHQVFG | 87.01 | KAIHQVFG | 10.17 | AVHQLFGG | 2.26 | | |
| E | 731 | 0.64 | 3 | 3 | 0 | Y | AVHQVFGG | 87.01 | AIHQVFGG | 10.73 | VHQLFGGA | 2.26 | | |
| E | 732 | 0.64 | 3 | 3 | 0 | Y | VHQVFGGA | 87.01 | IHQVFGGA | 10.73 | | | | |

FIG. 23-26

Species: WNV (8-mers)

| protein | block starting position | block entropy | total peptides in block | # peptides required to cover 99% of block | gap/X fraction 99% of block | covered w/ <= 5 peptides? | block | frequency | block | frequency | block | frequency | block | frequency |
|---|---|---|---|

FIG. 23-28

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 783 | 0.15 | 4 | 3 | 0.56 | Y | LFLSVNVH | 97.74 | LFLSANVH | 0.56 | LFLSVSYH | 0.56 | | |
| E | 784 | 0.15 | 4 | 3 | 0.56 | Y | FLSVNVHA | 97.74 | FLSANVHA | 0.56 | FLSINVHA | 0.56 | | |
|

FIG. 23-29

Species: WNV (8-mers)

| protein | block starting position | block entropy | total peptides in block | # peptides required to cover 99% of block | gap/X fraction 99% of block | covered w/ <= 5 peptides? | peptides required to cover 99% of block

FIG. 23-30

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 843 | 0.26 | 4 | 3 | 0.56 | Y | EGVCGLRS | 96.05 | EGVCGVRS | 2.26 | EGICGLRS | 0.56 | | |
| NS1 | 844 | 0.31 | 5 | 4 | 0.56 | Y | GVCGLRSV | 95.48 | GVCGVRSV | 2.26 | GVCGLRSA | 0.56 | GICGLRSV | 0.56 |
| NS1 | 845 | 0.31 | 5 | 4 | 0.56 | Y | VCGLRSVS | 95.48 | VCGVRSVS | 2.26 | TCGIRSVS | 0.56 | VCGLRSAS | 0.56 |
| NS1 | 846 | 0.26 | 4 | 3 | 0.56 | Y | CGLRSVSR | 96.05 | CGVRSVSR | 2.26 | CGIRSVSR | 0.56 | | |
| NS1 | 847 | 0.26 | 4 | 3 | 0 | Y | GLRSVSRL | 96.61 | GVRSVSRL | 2.26 | GIRSVSRL | 0.56 | | |
| NS1 | 848 | 0.26 | 4 | 3 | 0 | Y | LRSVSRLE | 96.61 | VRSVSRLE | 2.26 | LRSASRLE | 0.56 | | |
| NS1 | 849 | 0.05 | 2 | 1 | 0 | Y | RSVSRLEH | 99.44 | | | | | | |
| NS1 | 850 | 0.05 | 2 | 1 | 0 | Y | SVSRLEHQ | 99.44 | | | | | | |
| NS1 | 851 | 0.05 | 2 | 1 | 0 | Y | VSRLEHQM | 99.44 | | | | | | |
| NS1 | 852 | 0 | 1 | 1 | 0 | Y | SRLEHQMW | 100 | | | | | | |
| NS1 | 853 | 0.14 | 3 | 2 | 0 | Y | RLEHQMWE | 98.31 | RLEHQMWD | 1.13 | | | | |
| NS1 | 854 | 0.68 | 4 | 3 | 0 | Y | LEHQMWEA | 85.88 | LEHQMWES | 12.43 | LEHQMWDS | 1.13 | | |
| NS1 | 855 | 1.12 | 6 | 5 | 0 | Y | EHQMWEAV | 78.53 | EHQMWESV | 10.17 | EHQMWEAI | 7.34 | EHQMWESI | 2.26 | EHQMWDSV | 1.13 |
| NS1 | 856 | 1.13 | 6 | 5 | 0.56 | Y | HQMWEAVK | 77.97 | HQMWESVK | 10.17 | HQMWEAIK | 7.34 | HQMWESIK | 2.26 | HQMWDSVK | 1.13 |
| NS1 | 857 | 1.13 | 6 | 5 | 0.56 | Y | QMWEAVKD | 77.97 | QMWESVKD | 10.17 | QMWEAIKD | 7.34 | QMWESIKD | 2.26 | QMWDSVKD | 1.13 |
| NS1 | 858 | 1.13 | 6 | 5 | 0.56 | Y | MWEAVKDE | 77.97 | MWESVKDE | 10.17 | MWEAIKDE | 7.34 | MWESIKDE | 2.26 | MWDSVKDE | 1.13 |
| NS1 | 859 | 1.13 | 6 | 5 | 0.56 | Y | WEAVKDEL | 77.97 | WESVKDEL | 10.17 | WEAIKDEL | 7.34 | WESIKDEL | 2.26 | WDSVKDEL | 1.13 |
| NS1 | 860 | 1.13 | 6 | 5 | 0.56 | Y | EAVKDELN | 77.97 | ESVKDELN | 11.3 | EAIKDELN | 7.34 | ESIKDELN | 2.26 | DSVKDELN | 1.13 |
| NS1 | 861 | 1.05 | 4 | 4 | 0.56 | Y | AVKDELNT | 88.7 | SVKDELNT | 10.17 | AIKDELNT | 7.91 | SIKDELNT | 2.26 | | |
| NS1 | 862 | 0.53 | 3 | 2 | 0.56 | Y | VKDELNTL | 98.31 | IKDELNTL | 0.56 | | | | |
| NS1 | 863 | 0.1 | 3 | 2 | 0 | Y | KDELNTLK | 98.87 | KDELNTLF | 0.56 | | | | |
| NS1 | 864 | 0.1 | 3 | 2 | 0 | Y | DELNTLIK | 98.87 | DELNTPLK | 0.56 | | | | |
| NS1 | 865 | 0.1 | 3 | 2 | 0 | Y | ELNTLLKE | 98.87 | ELNTPLKE | 0.56 | | | | |
| NS1 | 866 | 0.1 | 3 | 2 | 0 | Y | LNTLLKEN | 98.87 | LNTLFREN | 0.56 | | | | |
| NS1 | 867 | 0.1 | 3 | 2 | 0 | Y | NTLLKENG | 98.87 | NTPLKENG | 0.56 | | | | |

FIG. 23-31

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover

FIG. 23-32

Species: WNV (8-mers)

| protein | block starting position | block entropy | total peptides in block | # peptides required to cover 99% of block | gap/X fraction 99% of block | Y covered w/ <= 5 peptides? | peptides required to cover 99% of block | frequency | peptides required to

FIG. 23-33

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |

FIG. 23-34

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 975 | 0.05 | 2 | 1 | 0 | Y | IGTAVKNN | 99.44 | | | | | | |
| NS1 | 976 | 0.52 | 3 | 2 | 0 | Y | GTAVKNNL | 89.27 | GTAVKNNM | 10.17 | | | | |
| NS1 | 977 | 0.52 | 3 | 2 | 0 | Y | TAVKNNLA | 89.27 | TAVKNNMA | 10.17 | | | | |
| NS1 | 978 | 0.57 | 4 | 3 | 0 | Y | AVKNNLAI | 88.7 | AVKNNMAV | 10.17 | AVKNNLAV | 0.56 | | |
| NS1 | 979 | 0.57 | 4 | 3 | 0 | Y | VKNNLAIH | 88.7 | VKNNMAVH | 10.17 | IKNNLAIH | 0.56 | | |
| NS1 | 980 | 0.52 | 3 | 2 | 0 | Y | KNNLAIHS | 89.27 | KNNMAVHS | 10.17 | | | | |
| NS1 | 981 | 0.52 | 3 | 2 | 0 | Y | NNLAIHSD | 89.27 | NNMAVHSD | 10.17 | | | | |
| NS1 | 982 | 0.52 | 3 | 2 | 0 | Y | NLAIHSDL | 89.27 | NMAVHSDL | 10.17 | | | | |
| NS1 | 983 | 0.52 | 3 | 2 | 0 | Y | LAIHSDLS | 89.27 | MAVHSDLS | 10.17 | | | | |
| NS1 | 984 | 0.49 | 2 | 2 | 0 | Y | AIHSDLSY | 89.27 | AVHSDLSY | 10.73 | | | | |
| NS1 | 985 | 0.49 | 2 | 2 | 0 | Y | IHSDLSYW | 89.27 | VHSDLSYW | 10.73 | | | | |
| NS1 | 986 | 0 | 1 | 1 | 0 | Y | HSDLSYWI | 100 | | | | | | |
| NS1 | 987 | 0 | 1 | 1 | 0 | Y | SDLSYWIE | 100 | | | | | | |
| NS1 | 988 | 0 | 1 | 1 | 0 | Y | DLSYWIES | 100 | | | | | | |
| NS1 | 989 | 0.51 | 2 | 2 | 0 | Y | LSYWIESR | 88.7 | LSYWIESG | 11.3 | | | | |
| NS1 | 990 | 0.8 | 4 | 4 | 0 | Y | SYWIESRL | 84.75 | SYWIESGL | 10.17 | SYWIESRF | 3.95 | SYWIESGF | 1.13 |
| NS1 | 991 | 0.83 | 5 | 4 | 0 | Y | YWIESRLN | 84.75 | YWIESGLN | 9.6 | YWIESRFN | 3.95 | YWIESGFN | 1.13 |
| NS1 | 997 | 0.62 | 6 | 5 | 0 | Y | LNDTWKLE | 90.96 | FNDTWKLE | 3.95 | LNET

FIG. 23-35

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1005 | 0 | 1 | — | 0 | Y | RAVLGEVK | 100 | | | | | | |
| NS1 | 1006 | 0 | 1 | — | 0 | Y | AVLGEVKS | 100 | | | | | | |
| NS1 | 1007 | 0 | 1 | — | 0 | Y | VLGEVKSC | 100 | | | | | | |
| NS1 | 1008 | 0 | 1 | — | 0 | Y | LGEVKSCT | 100 | | | | | | |
| NS1 | 1009 | 0 | 1 | — | 0 | Y | GEVKSCTW | 100 | | | | | | |
| NS1 | 1010 | 0 | 1 | — | 0 | Y | EVKSCTWP | 100 | | | | | | |
| NS1 | 1011 | 0 | 1 | — | 0 | Y | VKSCTWPE | 100 | | | | | | |
| NS1 | 1012 | 0 | 1 | — | 0 | Y | KSCTWPET | 100 | | | | | | |
| NS1 | 1013 | 0 | 1 | — | 0 | Y | SCTWPETH | 100 | | | | | | |
| NS1 | 1014 | 0 | 1 | — | 0 | Y | CTWPETHT | 100 | | | | | | |
| NS1 | 1015 | 0 | 1 | — | 0 | Y | TWPETHTL | 100 | | | | | | |
| NS1 | 1016 | 0 | 1 | — | 0 | Y | WPETHTLW | 100 | | | | | | |
| NS1 | 1017 | 0 | 1 | — | 0 | Y | PETHTLWG | 100 | | | | | | |
| NS1 | 1018 | 0.29 | 2 | 2 | 0.56 | Y | ETHTLWGD | 99.44 | ETHTLWGE | 5.08 | | | | |
| NS1 | 1019 | 0.29 | 2 | 2 | 0.56 | Y | THTLWGDG | 94.35 | THTLWGEG | 5.08 | | | | |
| NS1 | 1020 | 0.83 | 4 | 4 | 0.56 | Y | HTLWGDGI | 94.35 | HTLWGDGV | 10.73 | HTLWGEGI | 2.82 | HTLWGEGV | 2.26 |
| NS1 | 1021 | 0.89 | 6 | 5 | 0.56 | Y | TLWGDGIL | 83.62 | TLWGDGVL | 9.6 | TLWGEGIL | 2.82 | TLWGEGVQ | 2.26 | TLWGDGVI | 0.56 |
| NS1 | 1022 | 0.89 | 6 | 5 | 0.56 | Y | LWGDGILE | 83.62 | LWGDGVLE | 9.6 | LWGEGILE | 2.82 | LWGEGVQE | 2.26 | LWGDGVIE | 0.56 |
| NS1 | 1023 | 0.89 | 6 | 5 | 0.56 | Y | WGDGILES | 83.62 | WGDGVLES | 9.6 | WGEGILES | 2.26 | WGEGVQES | 2.26 | WGDGVIES | 0.56 |
| NS1 | 1026 | 0.74 | 6 | 5 | 0 | Y | GILESDLI | 87.01 | GVLESDLI | 9.04 | GVQESDLI | 2.26 | GVLESELI | 0.56 | GVIESELI | 0.56 |
| NS1 | 1027 | 0.74 | 6 | 5 | 0 | Y | ILESDLII | 87.01 | VLESDLII | 9.04 | VQESDLII | 2.26 | WESDLII | 0.56 | VIESELII | 0.56 |
| NS1 | 1028 | 0.31 | 5 | 4 | 0 | Y | LESDLIIP | 96.05 | QESDLIIP | 2.26 | LESELIIP | 0.56 | VESDLIIP | 0.56 | |
| NS1 | 1029 | 0.59 | 5 | 4 | 0 | Y | ESDLIIPV | 89.27 | ESDLIIPI | 9.04 | ESELIIPI | 0.56 | ESDLIIPA | 0.56 | |
| NS1 | 1030 | 0.59 | 5 | 4 | 0 | Y | SDLIIPYT | 89.27 | SDLIIPIT | 9.04 | SELIIPIT | 0.56 | SELIIPYT | 0.56 | |
| NS1 | 1031 | 0.59 | 5 | 4 | 0 | Y | DLIIPYTL | 89.27 | DLIIPITL | 9.04 | DLIIPATL | 0.56 | ELIIPYTL | 0.56 | |

FIG. 23-36

Species: WNV (8-mers)

| protein | block starting position | block entropy | total peptides in block | # peptides required to cover 99% of block | gap/X fraction | 99% of block covered w/ <= 5 peptides? | peptides required to cover 99% of block

FIG. 23-37

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1057 | 0.09 | 2 | 2 | 0 | Y | GPWDEGRV | 98.87 | GPWDEGRI | 1.13 | | | | |
| NS1 | 1058 | 0.09 | 2 | 2 | 0 | Y | PWDEGRVE | 98.87 | PWDEGRIE | 1.13 | | | | |
| NS1 | 1059 | 0.27 | 3 | 3 | 0 | Y | WDEGRVEI | 96.05 | WDEGRVEL | 2.82 | WDEGRIEI | 1.13 | | |
| NS1 | 1060 | 0.27 | 3 | 3 | 0 | Y | DEGRVEID | 96.05 | DEGRVELD | 2.82 | DEGRIEID | 1.13 | | |
| NS1 | 1061 | 0.27 | 3 | 3 | 0 | Y | EGRVEIDF | 96.05 | EGRVELDF | 2.82 | EGRIEIDF | 1.13 | | |
| NS1 | 1062 | 0.27 | 3 | 3 | 0 | Y | GRVEIDFD | 96.05 | GRVELDFD | 2.82 | GRIEIDFD | 1.13 | | |
| NS1 | 1063 | 0.27 | 3 | 3 | 0 | Y | RVEIDFDY | 96.05 | RVELDFDY | 2.82 | RIEIDFDY | 1.13 | | |
| NS1 | 1064 | 0.27 | 3 | 3 | 0 | Y | VEIDFDYC | 96.05 | VELDFDYC | 2.82 | IEIDFDYC | 1.13 | | |
| NS1 | 1065 | 0.19 | 2 | 2 | 0 | Y | EIDFDYCP | 97.18 | ELDFDYCP | 2.82 | | | | |
| NS1 | 1066 | 0.19 | 2 | 2 | 0 | Y | IDFDYCPG | 97.18 | LDFDYCPG | 2.82 | | | | |
| NS1 | 1067 | 0 | 1 | 1 | 0 | Y | DFDYCPGT | 100 | | | | | | |
| NS1 | 1068 | 0 | 1 | 1 | 0 | Y | FDYCPGTT | 100 | | | | | | |
| NS1 | 1069 | 0 | 1 | 1 | 0 | Y | DYCPGTTV | 100 | | | | | | |
| NS1 | 1070 | 0 | 1 | 1 | 0 | Y | YCPGTTVT | 100 | | | | | | |
| NS1 | 1071 | 0.47 | 3 | 2 | 0 | Y | CPGTTVTL | 90.96 | CPGTTVTI | 8.47 | | | | |
| NS1 | 1072 | 0.52 | 4 | 3 | 0 | Y | PGTTVTLS | 90.4 | PGTTVTIS | 8.47 | PGTTVTLR | 0.56 | | |
| NS1 | 1081 | 0.24 | 2 | 2 | 0 | Y | SCGHRGPA | 97.18 | SCEHRGPA | 1.13 | RCGHRGPA | 0.56 | NCGHRGPS | 0.56 |
| NS1 | 1082 | 1.03 | 5 | 4 | 0 | Y | CGHRGPAI | 80.23 | CGHRGPAA | 9.04 | CGHRGPA | 1.13 | CEHRGPAA | 1.13 |
| NS1 | 1083 | 1.03 | 6 | 5 | 0 | Y | GHRGPATR | 80.23 | GHRGPAAR | 9.04 | GHRGPAIR | 9.04 | EHRGPAAR | 1.13 |
| NS1 | 1084 | 0.98 | 5 | 5 | 0 | Y | HRGPATRT | 80.23 | HRGPAART | 10.17 | HRGPAIRT | 10.17 | HRGASTRT | 0.56 |
| NS1 | 1085 | 0.98 | 5 | 4 | 0 | Y | RGPATRTT | 80.23 | RGPAARTT | 10.17 | RGPAIRTT | 10.17 | RGASTRTT | 0.56 |
| NS1 | 1086 | 0.98 | 5 | 4 | 0 | Y | GPATRTTE | 80.23 | GPAARTTE | 10.17 | GPAIRTTE | 10.17 | GPSARTTE | 0.56 |
| NS1 | 1087 | 0.98 | 5 | 4 | 0 | Y | PATRTTTE | 80.23 | PAARTTTE | 10.17 | PAIRTTTE | 10.17 | PSARTTTE | 0.56 |
| NS1 | 1088 | 0.98 | 5 | 4 | 0 | Y | ATRTTESS | 80.23 | AARTTTESS | 10.17 | AIRTTESS | 10.17 | SARTTTES | 0.56 |
| NS1 | 1089 | 0.95 | 4 | 3 | 0.56 | Y | TRTTTESG | 79.66 | ARTTTESG | 10.73 | IRTTTESG | 8.47 | | |

FIG. 23-38

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1090 | 0.05 | 2 | 1 | 0.56 | Y | RTTESGK | 98.87 | | | | | | |
| NS1 | 1091 | 0.05 | 2 | 1 | 0.56 | Y | TTTESGKL | 98.87 | | | | | | |
| NS1 | 1092 | 0.05 | 2 | 1 | 0.56 | Y | TTESGKLI | 98.87 | | | | | | |
| NS1 | 1093 | 0.21 | 3 | 2 | 0.56 | Y | TESGKLIT | 96.61 | TESGKLIS | 2.26 | | | | |
| NS1 | 1094 | 0.21 | 3 | 2 | 0.56 | Y | ESGKLITD | 96.61 | ESGKLISD | 2.26 | | | | |
| NS1 | 1095 | 0.16 | 2 | 2 | 0.56 | Y | SGKLITDW | 97.18 | SGKLISDW | 2.26 | | | | |
| NS1 | 1096 | 0.21 | 3 | 2 | 0 | Y | GKLITDWC | 96.61 | GKLISDWC | 2.26 | | | | |
| NS1 | 1097 | 0.21 | 3 | 2 | 0 | Y | KLITDWCC | 97.18 | KLISDWCC | 2.26 | | | | |
| NS1 | 1098 | 0.21 | 3 | 2 | 0 | Y | LITDWCCR | 97.18 | LISDWCCR | 2.26 | | | | |
| NS1 | 1099 | 0.21 | 3 | 2 | 0 | Y | ITDWCCRS | 97.18 | ISDWCCRS | 2.26 | | | | |
| NS1 | 1100 | 0.21 | 3 | 2 | 0 | Y | TDWCCRSC | 97.18 | SDWCCRSC | 2.26 | | | | |
| NS1 | 1101 | 0.05 | 2 | 2 | 0 | Y | DWCCRSCT | 99.44 | | | | | | |
| NS1 | 1102 | 0.05 | 2 | 2 | 0 | Y | WCCRSCTL | 99.44 | | | | | | |
| NS1 | 1103 | 0.05 | 2 | 2 | 0 | Y | CCRSCTLP | 99.44 | | | | | | |
| NS1 | 1104 | 0 | 1 | 1 | 0 | Y | CRSCTLPP | 100 | | | | | | |
| NS1 | 1105 | 0 | 1 | 1 | 0 | Y | RSCTLPPL | 100 | | | | | | |
| NS1 | 1106 | 0 | 1 | 1 | 0 | Y | SCTLPPLR | 100 | | | | | | |
| NS1 | 1107 | 0.4 | 2 | 2 | 0 | Y | CTLPPLRY | 92.09 | CTLPPLRF | 7.91 | | | | |
| NS1 | 1108 | 0.63 | 5 | 4 | 0 | Y | TLPPLRYQ | 89.27 | TLPPLRFQ | 7.34 | TLPPLRYR | 2.26 | TLPPLRFK | 0.56 |
| NS1 | 1109 | 0.63 | 5 | 4 | 0 | Y | LPPLRYQT | 89.27 | LPPLRFQT | 7.34 | LPPLRYRT | 2.26 | LPPLRYTT | 0.56 |
| NS1 | 1110 | 0.66 | 6 | 5 | 0 | Y | PPLRYQTD | 89.27 | PPLRFQTE | 6.78 | PPLRYRTE | 2.26 | PPLRFQTR | 0.56 |
| NS1 | 1116 | 0.73 | 5 | 4 | 0.56 | Y | TDSGCWYG | 87.01 | TENGCWYG | 7.34 | TESGCWYG | 2.82 | TDNGCWYG | 1.69 |
| NS1 | 1117 | 0.73 | 5 | 4 | 0.56 | Y | DSGCWYGM | 87.01 | ENGCWYGM | 7.34 | ESGCWYGM | 2.82 | DNGCWYGM | 1.69 |
| NS1 | 1118 | 0.44 | 2 | 2 | 0.56 | Y | SGCWYGME | 90.4 | NGCWYGME | 9.04 | | | | |
| NS1 | 1119 | 0 | 1 | 1 | 0 | Y | GCWYGMEI | 100 | | | | | | |

FIG. 23-39

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1120 | 0 | 1 | — | 0 | Y | CWYGMEIR | 100 | | | | | | |
| NS1 | 1121 | 0 | 1 | — | 0 | Y | WYGMEIRP | 100 | | | | | | |
| NS1 | 1122 | 0.59 | 3 | 3 | 0 | Y | YGMEIRPQ | 89.27 | YGMEIRPT | 6.78 | YGMEIRPL | 3.95 | | |
| NS1 | 1123 | 0.67 | 5 | 4 | 0 | Y | GMEIRPQR | 88.7 | GMEIRPTR | 6.78 | GMEIRPLR | 3.39 | GMEIRPLK | 0.56 |
| NS1 | 1124 | 0.67 | 5 | 4 | 0 | Y | MEIRPQRH | 88.7 | MEIRPTRH | 6.78 | MEIRPLRH | 3.39 | MEIRPQKH | 0.56 |
| NS1 | 1125 | 0.67 | 5 | 4 | 0.56 | Y | EIRPQRHD | 88.14 | EIRPTRHD | 6.78 | EIRPLRHD | 3.39 | EIRPLKHD | 0.56 |
| NS1 | 1126 | 0.72 | 6 | 5 | 0.56 | Y | IRPQRHDE | 87.57 | IRPTRHDE | 6.78 | IRPLRHDE | 3.39 | IRPQKHDE | 0.56 | IRPLKHDE | 0.56 |
| NS1 | 1127 | 0.72 | 6 | 5 | 0.56 | Y | RPQRHDEK | 87.57 | RPTRHDEK | 6.78 | RPLRHDEK | 3.39 | RPQKHDEK | 0.56 | RPQKHDER | 0.56 |
| NS1 | 1128 | 0.72 | 6 | 5 | 0.56 | Y | PQRHDEKT | 87.57 | PTRHDEKT | 6.78 | PLRHDEKT | 3.39 | PQRHDGKT | 0.56 | PLKHDEKT | 0.56 |
| NS1 | 1129 | 0.72 | 6 | 5 | 0.56 | Y | QRHDEKTL | 87.57 | TRHDEKTL | 6.78 | LRHDEKTL | 3.39 | LIKHDEKTL | 0.56 | QKHDERTL | 0.56 |
| NS1 | 1130 | 0.15 | 4 | 3 | 0.56 | Y | RHDEKTLV | 97.74 | RHDGKTLV | 0.56 | KHDEKTLV | 0.56 | | |
| NS1 | 1131 | 0.1 | 3 | 2 | 0.56 | Y | HDEKTLVQ | 98.31 | HDGKTLVQ | 0.56 | | | | |
| NS1 | 1132 | 0.1 | 3 | 2 | 0.56 | Y | DEKTLVQS | 98.31 | DERTLVQS | 0.56 | | | | |
| NS1 | 1133 | 0.67 | 5 | 4 | 0 | Y | EKTLVQSQ | 88.14 | EKTLVQSR | 8.47 | EKTLVQSK | 2.26 | ERTLVQSQ | 0.56 | |
| NS1 | 1134 | 0.62 | 4 | 3 | 0 | Y | KTLVQSQV | 88.7 | KTLVQSRV | 8.47 | KTLVQSKV | 2.26 | | |
| NS1 | 1135 | 0.6 | 4 | 3 | 0 | Y | TLVQSQVN | 89.27 | TLVQSRVN | 7.91 | TLVQSKVT | 2.26 | | |
| NS1 | 1136 | 0.6 | 4 | 3 | 0 | Y | LVQSQVNA | 89.27 | LVQSRVNA | 7.91 | LVQSKVTA | 2.26 | | |
| NS1 | 1137 | 0.63 | 5 | 4 | 0 | Y | VQSQVNAY | 89.27 | VQSRVNAY | 7.34 | VQSKVTAY | 2.26 | VQSRVSAY | 0.56 | |
| NS1 | 1138 | 0.63 | 5 | 4 | 0 | Y | QSQVNAYN | 89.27 | QSRVNAYN | 7.34 | QSKVTAYN | 2.26 | QSRVNAHN | 0.56 | |
| NS1 | 1139 | 0.63 | 5 | 4 | 0 | Y | SQVNAYNA | 89.27 | SRVNAYNA | 7.34 | SKVTAYNA | 2.26 | SRVSAYKS | 0.56 | |
| NS1 | 1140 | 0.68 | 6 | 5 | 0 | Y | QVNAYNAD | 88.7 | RVNAYNAD | 7.34 | KVTAYNAD | 2.26 | RVNAHNAD | 0.56 | RVSAYKSD | 0.56 |
| NS1 | 1141 | 0.31 | 5 | 4 | 0 | Y | VNAYNADM | 96.05 | VTAYNADM | 2.26 | VNAYNAEM | 0.56 | VSAYKSDM | 0.56 | |
| NS1 | 1142 | 0.31 | 5 | 4 | 0 | Y | NAYNADMI | 96.05 | TAYNADMI | 2.26 | NAHNADMI | 0.56 | NAYNAEMI | 0.56 | |
| NS1 | 1143 | 0.15 | 4 | 3 | 0 | Y | AYNADMID | 98.31 | AHNADMID | 0.56 | AYKSDMID | 0.56 | | |
| NS2A | 1144 | 0.15 | 4 | 3 | 0 | Y | YNADMIDP | 98.31 | YNAEMIDP | 0.56 | YKSDMIDP | 0.56 | | |

Species: WNV (8-mers)

FIG. 23-40

Species: WNV (8-mers)

| protein | block star

FIG. 23-41

Species: WNV (8-mers)

| protein | block starting position | block entropy | total peptides in block | # peptides required to cover 99% of block | gap/X fraction | 99% of block covered w/ <= 5 peptides? | peptides required to cover

FIG. 23-42

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency |

FIG. 23-43

Species: WNY (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1224 | 0.37 | 4 | 4 | 0 | Y | ATFK

FIG. 23-44

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1252 | 0.57 | 2 | 2 | 0 | Y | LAAVFFQM | 86.44 | LAAAFFQM | 13.56 | | | | |
| NS2A | 1253 | 0.61 | 3 | 2 | 0 | Y | AAVFFQMA | 86.44 | AAAFFQMA | 12.99 | | | | |
| NS2A | 1254 | 0.61 | 3 | 2 | 0 | Y | AVFFQMAY | 86.44 | AAFFQMAY | 12.99 | | | | |
| NS2A | 1255 | 0.98 | 6 | 5 | 0 | Y | VFFQMAYH | 82.49 | AFFQMAYY | 9.6 | VFFQMAYY | 3.95 | AFFQMAYI | 2.26 | AFFQMAYH | 1.13 |
| NS2A | 1256 | 0.77 | 4 | 3 | 0 | Y | FFQMAYHD | 83.62 | FFQMAYYD | 13.56 | FFQMAYID | 2.26 | | | |
| NS2A | 1257 | 0.77 | 4 | 3 | 0 | Y | FQMAYHDA | 83.62 | FQMAYYDA | 13.56 | FQMAYIDS | 2.26 | | | |
| NS2A | 1258 | 0.91 | 5 | 4 | 0 | Y | QMAYHDAR | 83.62 | QMAYYDAK | 7.34 | QMAYYDAR | 6.21 | QMAYIDSQ | 2.26 | |
| NS2A | 1270 | 0.8 | 6 | 5 | 0 | Y | WEIPDVLN | 87.01 | WEVPDVLN | 6.78 | WEMPDVLN | 2.26 | WNIPDVLN | 2.26 | WGIPDVLN | 1.13 |
| NS2A | 1271 | 0.8 | 6 | 5 | 0 | Y | EIPDVLNS | 87.01 | EVPDVLNS | 6.78 | NIPDVLNS | 2.26 | EMPDVLNS | 2.26 | GIPDVLNS | 1.13 |
| NS2A | 1272 | 0.56 | 4 | 3 | 0 | Y | IPDVLNSL | 90.4 | VPDVLNSL | 6.78 | MPDVLNSL | 2.26 | | | |
| NS2A | 1273 | 0.52 | 3 | 2 | 0 | Y | PDVLNSLA | 89.27 | PDVLNSLS | 10.17 | | | | |
| NS2A | 1274 | 0.57 | 3 | 3 | 0 | Y | DVLNSLAV | 88.7 | DVLNSLSV | 10.17 | DVLNSLAA | 0.56 | | | |
| NS2A | 1275 | 0.57 | 3 | 3 | 0 | Y | VLNSLAVA | 88.7 | VLNSLSVA | 10.17 | VLNSLAIA | 0.56 | | | |
| NS2A | 1276 | 0.57 | 3 | 3 | 0 | Y | LNSLAVAW | 88.7 | LNSLSVAW | 10.17 | LNSLAIAW | 0.56 | | | |
| NS2A | 1277 | 0.57 | 3 | 3 | 0 | Y | NSLAVAWM | 88.7 | NSLSVAWM | 10.17 | NSLAAAWM | 0.56 | | | |
| NS2A | 1278 | 0.62 | 4 | 4 | 0 | Y | SLAVAWMI | 88.14 | SLSVAWMI | 10.17 | SLAAAWMI | 0.56 | SLAVAWMV | 0.56 | |
| NS2A | 1279 | 0.62 | 4 | 4 | 0 | Y | LAVAWMIL | 88.14 | LSVAWMIL | 10.17 | LAIAWMIL | 0.56 | LAAAWMIL | 0.56 | |
| NS2A | 1280 | 0.62 | 4 | 4 | 0 | Y | AVAWMILR | 88.14 | SVAWMILR | 10.17 | AVAWMVLR | 0.56 | AIAWMILR | 0.56 | |
| NS2A | 1281 | 0.15 | 2 | 3 | 0.56 | Y | VAWMILRA | 98.31 | IAWMILRA | 0.56 | VAWMVLRA | 0.56 | | | |
| NS2A | 1282 | 0.05 | 4 | 1 | 0.56 | Y | AWMILRAI | 98.87 | | | | | | | |
| NS2A | 1283 | 0.59 | 4 | 3 | 0.56 | Y | WMILRAIT | 88.7 | WMILRAIS | 8.47 | WMILRAIG | 1.69 | | | |
| NS2A | 1284 | 0.59 | 4 | 3 | 0.56 | Y | MILRAITF | 88.7 | MILRAISF | 8.47 | MILRAIGF | 1.69 | | | |
| NS2A | 1285 | 0.64 | 5 | 4 | 0 | Y | ILRAITFT | 88.14 | ILRAISFT | 8.47 | ILRAIGFT | 1.69 | ILRAITFP | 0.56 | |
| NS2A | 1291 | 0.67 | 5 | 4 | 0 | Y | FTTTSNVV | 88.14 | FTNTSNVV | 8.47 | FTTTSNVA | 2.26 | FTSTSNVV | 0.56 | |
| NS2A | 1292 | 0.67 | 5 | 4 | 0 | Y | TTTSNVVT | 88.14 | TNTSNVVT | 8.47 | TTTSNVAT | 2.26 | TSTSNVVV | 0.56 | |

FIG. 23-45

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1293 | 0.62 | 4 | 3 | 0 | Y | TTSNVWP | 88.7 | NTSNVWP | 8.47 | TTSNVATP | 2.26 | | |
| NS2A | 1294 | 0.21 | 3 | 2 | 0 | Y | TSNVWPL | 97.18 | TSNVATPL | 2.26 | | | | |
| NS2A | 1295 | 0.29 | 4 | 3 | 0 | Y | SNVWPLL | 96.05 | SNVATPLL | 2.26 | SNVWPLM | 1.13 | | |
| NS2A | 1296 | 0.29 | 4 | 3 | 0 | Y | NVWPLLA | 96.05 | NVATPLLA | 2.26 | NVWPLMA | 1.13 | | |
| NS2A | 1297 | 0.29 | 4 | 3 | 0 | Y | VWPLLAL | 96.05 | VATPLLAL | 2.26 | VWPLMAL | 1.13 | | |
| NS2A | 1298 | 0.29 | 4 | 3 | 0 | Y | VPLLALL | 96.05 | ATPLLALL | 2.26 | VPLMALL | 1.13 | | |
| NS2A | 1299 | 0.14 | 3 | 2 | 0 | Y | PLLALLT | 96.05 | TPLLALLT | 2.26 | VPLMALLT | 1.13 | | |
| NS2A | 1300 | 0.19 | 4 | 3 | 0 | Y | PLLALLTP | 98.31 | PLMALLTP | 1.13 | | | | |
| NS2A | 1301 | 0.19 | 4 | 3 | 0 | Y | LLALLTPG | 97.74 | LMALLTPG | 1.13 | LLALLTPR | 0.56 | | |
| NS2A | 1302 | 0.19 | 4 | 3 | 0 | Y | LALLTPGL | 97.74 | MALLTPGL | 1.13 | LALLTPRL | 0.56 | | |
| NS2A | 1303 | 0.57 | 4 | 3 | 0 | Y | ALLTPGLR | 88.7 | ALLTPGLK | 10.17 | ALLTPRLR | 0.56 | | |
| NS2A | 1304 | 0.57 | 4 | 3 | 0 | Y | LLTPGLRC | 88.7 | LLTPGLKC | 10.17 | FLTPGLKC | 0.56 | | |
| NS2A | 1305 | 0.54 | 3 | 2 | 0 | Y | LTPGLRCL | 88.7 | LTPGLKCL | 10.73 | | | | |
| NS2A | 1306 | 0.62 | 4 | 3 | 0 | Y | TPGLRCLN | 88.7 | TPGLKCLN | 8.47 | TPGLKCLH | 2.26 | | |
| NS2A | 1307 | 0.62 | 4 | 3 | 0 | Y | PGLRCLNL | 88.7 | PGLKCLNL | 8.47 | PGLKCLHL | 2.26 | | |
| NS2A | 1308 | 0.62 | 4 | 3 | 0 | Y | GLRCLNLD | 88.7 | GLKCLNLD | 8.47 | GLKCLHLD | 2.26 | | |
| NS2A | 1309 | 0.57 | 3 | 2 | 0 | Y | LRCLNLDV | 89.27 | LKCLNLDV | 8.47 | LKCLHLDI | 2.26 | | |
| NS2A | 1310 | 0.62 | 4 | 3 | 0 | Y | RCLNLDVY | 88.7 | KCLNLDVY | 8.47 | KCLHLDIY | 2.26 | | |
| NS2A | 1311 | 0.26 | 4 | 3 | 0 | Y | CLNLDVYR | 96.61 | CLHLDIYR | 2.26 | CLNLDVSR | 0.56 | | |
| NS2A | 1312 | 0.26 | 4 | 3 | 0 | Y | LNLDVYRI | 96.61 | LHLDIYRI | 2.26 | LNLDVSRI | 0.56 | | |
| NS2A | 1313 | 0.31 | 4 | 3 | 0 | Y | NLDVYRIL | 96.05 | HLDIYRIL | 2.26 | NLDVSRIL | 0.56 | NLDVRIV | 0.56 |
| NS2A | 1314 | 0.31 | 5 | 4 | 0 | Y | LDVYRILL | 96.05 | LDIYRILL | 2.26 | LDVYRILL | 0.56 | LDYYRIVL | 0.56 |
| NS2A | 1315 | 0.31 | 5 | 4 | 0 | Y | DVYRILLL | 96.05 | DIYRILLL | 2.26 | DVSRILLL | 0.56 | DVYKILLL | 0.56 |
| NS2A | 1316 | 0.31 | 5 | 4 | 0 | Y | VYRILLLM | 96.05 | IYRILLLM | 2.26 | VYKILLLM | 0.56 | VSRILLLM | 0.56 |
| NS2A | 1317 | 0.2 | 5 | 4 | 0 | Y | YRILLLMV | 97.74 | YKILLLMV | 0.56 | SRILLLMV | 0.56 | YRILLLMI | 0.56 |

FIG. 23-46

| Species: WNV (8-mers) | | | | | | | | | | | | | | | | | | |
|---|---|---|---|---|---|---|---|---|---|---|---|---|---|---|---|---|---|---|
| protein | block starting position | block entropy | total peptides in block | # peptides required to cover 99% of block | gap/X fraction of 99% of block | covered w/ <= 5 peptides? | peptides required to cover 99% of block | frequency | peptides required to cover 99% of block | frequency | peptides required

FIG. 23-47

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1346 | 0.54 | 3 | 2 | 0 | Y | LCLALAST | 88.7 | ICLALAST | 10.73 | | | | |
| NS2A | 1347 | 0.05 | 2 | 1 | 0.56 | Y | CLALASTG | 98.87 | | | | | | |
| NS2A | 1356 | 0.26 | 4 | 3 | 0 | Y | FNPMILAA | 96.61 | FNPLILVA | 2.26 | FSPITLAA | 0.56 | | |
| NS2A | 1357 | 0.26 | 4 | 3 | 0 | Y | NPMILAAG | 96.61 | NPLILVAG | 2.26 | SPITLAAG | 0.56 | | |
| NS2A | 1358 | 0.26 | 4 | 3 | 0 | Y | PMILAAGL | 96.61 | PLILVAGL | 2.26 | PLVLAAGL | 0.56 | | |
| NS2A | 1359 | 0.75 | 6 | 5 | 0 | Y | MILAAGLI | 87.57 | MILAAGLM | 7.34 | LILVAGLL | 2.26 | MILAAGLV | 1.69 | ITLAAGLM | 0.56 |
| NS2A | 1361 | 1.19 | 6 | 5 | 0 | Y | LAAGLIAC | 76.84 | LAAGLITC | 10.73 | LAAGLMAC | 7.91 | LVAGLIAC | 2.26 | LAAGLVAC | 1.69 |
| NS2A | 1362 | 1.19 | 6 | 5 | 0 | Y | AAGLIACD | 76.84 | AAGLITCD | 10.73 | AAGLMACD | 7.91 | VAGLIACD | 2.26 | AAGLVACD | 1.69 |
| NS2A | 1363 | 1.19 | 6 | 5 | 0 | Y | AGLIACDP | 76.84 | AGLITCDP | 10.73 | AGLMACDP | 7.91 | AGLIACDP | 2.26 | AGLVACDP | 1.69 |
| NS2A | 1364 | 1.19 | 6 | 5 | 0 | Y | GLIACDPN | 76.84 | GLITCDPN | 10.73 | GLMACDPN | 7.91 | GLIACDPN | 2.26 | GLVACDPN | 1.69 |
| NS2A | 1365 | 1.19 | 6 | 5 | 0 | Y | LIACDPNR | 76.84 | LITCDPNR | 10.73 | LMACDPNR | 7.91 | LIACDPNR | 2.26 | LVACDPNR | 1.69 |
| NS2A | 1366 | 1.19 | 6 | 5 | 0 | Y | IACDPNRK | 76.84 | ITCDPNRK | 10.73 | MACDPNRK | 7.91 | LACDPNRK | 2.26 | VACDPNRK | 1.69 |
| NS2A | 1367 | 0.54 | 3 | 2 | 0 | Y | ACDPNRKR | 88.7 | TCDPNRKR | 10.73 | | | | |
| NS2A | 1368 | 0 | 1 | 1 | 0 | Y | CDPNRKRG | 100 | | | | | | |
| NS2A | 1369 | 0 | 1 | 1 | 0 | Y | DPNRKRGW | 100 | | | | | | |
| NS2A | 1370 | 0 | 1 | 1 | 0 | Y | PNRKRGWP | 100 | | | | | | |
| NS2A | 1371 | 0 | 1 | 1 | 0 | Y | NRKRGWPA | 100 | | | | | | |
| NS2A | 1372 | 0 | 1 | 1 | 0 | Y | RKRGWPAT | 100 | | | | | | |
| NS2A | 1373 | 0 | 1 | 1 | 0 | Y | KRGWPATE | 100 | | | | | | |
| NS2A | 1374 | 0 | 1 | 1 | 0 | Y | RGWPATEV | 100 | | | | | | |
| NS2A | 1375 | 0 | 1 | 1 | 0 | Y | GWPATEVM | 100 | | | | | | |
| NS2A | 1376 | 0 | 1 | 1 | 0 | Y | WPATEVMT | 100 | | | | | | |
| NS2A | 1377 | 0 | 1 | 1 | 0 | Y | PATEVMTA | 100 | | | | | | |
| NS2B | 1378 | 0.05 | 2 | 1 | 0 | Y | ATEVMTAV | 99.44 | | | | | | |
| NS2B | 1379 | 0.05 | 2 | 1 | 0.56 | Y | TEVMTAVG | 98.87 | | | | | | |

FIG. 23-48

Species: WNV (8-mers)

| protein | block starting position | block entropy | total peptides in block | # peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1380 | 0.05 | 2 | 1 | 0.56 | Y | EWMTAVGL | 98.87 | | | | | | |
| NS2B | 1381 | 0.05 | 2 | 1 | 0.56 | Y | VMTAVGLM | 98.87 | | | | | | |
| NS2B | 1382 | 0.05 | 2 | 1 | 0.56 | Y | MTAVGLMF | 98.87 | | | | | | |
| NS2B | 1383 | 0.05 | 2 | 1 | 0.56 | Y | TAVGLMFA | 98.87 | | | | | | |
| NS2B | 1384 | 0.05 | 2 | 1 | 0.56 | Y | AVGLMFAI | 98.87 | | | | | | |
| NS2B | 1385 | 0.05 | 2 | 1 | 0.56 | Y | VGLMFAIV | 98.87 | | | | | | |
| NS2B | 1386 | 0 | 1 | 1 | 0.56 | Y | GLMFAIVG | 99.44 | | | | | | |
| NS2B | 1387 | 0 | 1 | — | 0 | Y | LMFAIVGG | 100 | | | | | | |
| NS2B | 1388 | 0 | 1 | — | 0 | Y | MFAIVGGL | 100 | | | | | | |
| NS2B | 1389 | 0 | 1 | — | 0 | Y | FAIVGGLA | 100 | | | | | | |
| NS2B | 1390 | 0 | 1 | — | 0 | Y | AIVGGLAE | 100 | | | | | | |
| NS2B | 1391 | 0 | 1 | — | 0 | Y | IVGGLAEL | 100 | | | | | | |
| NS2B | 1392 | 0 | 1 | — | 0 | Y | VGGLAELD | 100 | | | | | | |
| NS2B | 1393 | 0.1 | 3 | 2 | 0 | Y | GGLAELDI | 98.87 | GGLAELDV | 0.56 | | | | |
| NS2B | 1394 | 0.1 | 3 | 2 | 0 | Y | GLAELDID | 98.87 | GLAELDMD | 0.56 | | | | |
| NS2B | 1395 | 0.15 | 4 | 3 | 0 | Y | LAELDIDS | 98.31 | LAELDMDS | 0.56 | LAELDIDT | 0.56 | | |
| NS2B | 1396 | 0.15 | 4 | 3 | 0 | Y | AELDIDSM | 98.31 | AELDVDSM | 0.56 | AELDIDTM | 0.56 | | |
| NS2B | 1397 | 0.15 | 4 | 3 | 0 | Y | ELDIDSMA | 98.31 | ELDMDSMA | 0.56 | ELDIDTMA | 0.56 | | |
| NS2B | 1398 | 0.2 | 5 | 4 | 0 | Y | LDIDSMAI | 97.74 | LDVDSMAI | 0.56 | LDIDTMAI | 0.56 | LDIDSMAV | 0.56 |
| NS2B | 1399 | 0.2 | 5 | 4 | 0 | Y | DIDSMAIP | 97.74 | DVDSMAIP | 0.56 | DIDTMAIP | 0.56 | DMDSMAIP | 0.56 |
| NS2B | 1400 | 0.2 | 5 | 4 | 0 | Y | IDSMAIPM | 97.74 | IDSMAVPM | 0.56 | MDSMAIPM | 0.56 | IDTMAIPM | 0.56 |
| NS2B | 1401 | 0.1 | 3 | 2 | 0 | Y | DSMAIPMT | 98.87 | DTMAIPMT | 0.56 | | | | |
| NS2B | 1402 | 0.1 | 3 | 2 | 0 | Y | SMAIPMTI | 98.87 | TMAIPMTI | 0.56 | | | | |
| NS2B | 1403 | 0.05 | 2 | 1 | 0 | Y | MAIPMTIA | 99.44 | | | | | | |
| NS2B | 1404 | 0.05 | 2 | 1 | 0 | Y | AIPMTIAG | 99.44 | | | | | | |

FIG. 23-49

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 23-50

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to

FIG. 23-51

Species: WNV (8-mers)

| protein | block starting position | block entropy | total

FIG. 23-52

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1484 | 0.05 | 2 | 1 | 0 | Y | YTPWAILP | 99.44 | | | | | | | | |
| NS2B | 1485 | 0.05 | 2 | 1 | 0 | Y | TPWAILPS | 99.44 | | | | | | | | |
| NS2B | 1486 | 0.1 | 3 | 2 | 0 | Y | PWAILPSV | 98.87 | PWAVLPSV | 0.56 | | | | | | |
| NS2B | 1487 | 0.56 | 4 | 3 | 0 | Y | WAILPSVV | 89.27 | WAILPSVI | 9.6 | WAVLPSVV | 0.56 | | | | |
| NS2B | 1488 | 0.56 | 4 | 3 | 0 | Y | AILPSVVG | 89.27 | AILPSVIG | 9.6 | AILPSVVG | 0.56 | | | | |
| NS2B | 1489 | 0.56 | 4 | 3 | 0 | Y | ILPSVVGF | 89.27 | ILPSVIGF | 9.6 | ILPSVVGF | 0.56 | | | | |
| NS2B | 1490 | 0.51 | 3 | 2 | 0 | Y | LPSVVGFW | 89.83 | LPSVIGFW | 9.6 | | | | | | |
| NS2B | 1491 | 0.51 | 4 | 3 | 0 | Y | PSVVGFWI | 89.83 | PSVIGFWI | 9.6 | | | | | | |
| NS2B | 1492 | 0.56 | 4 | 3 | 0 | Y | SVVGFWIT | 89.27 | SVIGFWIT | 9.6 | SVVGFWIT | 0.56 | | | | |
| NS2B | 1493 | 0.56 | 4 | 3 | 0 | Y | VVGFWITL | 89.27 | VIGFWITL | 9.6 | VVGFWITL | 0.56 | | | | |
| NS2B | 1494 | 0.51 | 3 | 2 | 0 | Y | VGFWITLQ | 89.83 | IGFWITLQ | 9.6 | | | | | | |
| NS2B | 1495 | 0.05 | 2 | 1 | 0 | Y | GFWITLQY | 99.44 | | | | | | | | |
| NS2B | 1496 | 0.05 | 2 | 1 | 0 | Y | FWITLQYT | 99.44 | | | | | | | | |
| NS2B | 1497 | 0.05 | 2 | 1 | 0 | Y | WITLQYTK | 99.44 | | | | | | | | |
| NS2B | 1498 | 0.05 | 2 | 1 | 0 | Y | ITLQYTKR | 99.44 | | | | | | | | |
| NS2B | 1499 | 0.05 | 2 | 1 | 0 | Y | TLQYTKRG | 99.44 | | | | | | | | |
| NS2B | 1500 | 0 | 1 | 1 | 0 | Y | LQYTKRGG | 100 | | | | | | | | |
| NS2B | 1501 | 0 | 1 | 1 | 0 | Y | QYTKRGGV | 100 | | | | | | | | |
| NS2B | 1502 | 0 | 1 | 1 | 0 | Y | YTKRGGVL | 100 | | | | | | | | |
| NS2B | 1503 | 0 | 1 | 1 | 0 | Y | TKRGGVLW | 100 | | | | | | | | |
| NS2B | 1504 | 0 | 1 | 1 | 0 | Y | KRGGVLWD | 100 | | | | | | | | |
| NS2B | 1505 | 0 | 1 | 1 | 0 | Y | RGGVLWDT | 100 | | | | | | | | |
| NS2B | 1506 | 0 | 1 | 1 | 0 | Y | GGVLWDTP | 100 | | | | | | | | |
| NS3 | 1507 | 0 | 1 | 1 | 0 | Y | GVLWDTPS | 100 | | | | | | | | |
| NS3 | 1508 | 0 | 1 | 1 | 0 | Y | VLWDTPSP | 100 | | | | | | | | |

FIG. 23-53

Species: WNV (8-mers)

| protein | block starting position | block entropy | total peptides in block | # peptides required to cover 99% of block | gap/X fraction | 99% of block covered w/ <= 5 peptides? | peptides required to cover 99% of block

FIG. 23-55

Species: WNV (8-mers)

| protein | block starting position | block entropy | total peptides in block | # peptides required to cover 99% of block | gap/X fraction | 99% of block covered w/ <= 5 peptides? | peptides required to cover 99% of block

FIG. 23-56

Species: WNV (8-mers)

| prot

FIG. 23-57

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1613

Species: WNV (8-mers)

| protein | block starting position | block entropy | total peptides in block | # peptides required to cover 99% of block | gap/X fraction | covered w/ <= 5 peptides? | block (99% of block) | frequency | block

FIG. 23-60

Species: WNV (8-mers)

| protein | block starting position | block entropy | total peptides in block | # peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS3 | 1693 | 0.1 | 3 | 2 | 0 | Y | QITVLDLH | 98.87 | QISVLDLH | 0.56 | | | | |
| NS3 | 1694 | 0.05 | 2 | 1 | 0 | Y | ITVLDLHP | 99.44 | | | | | |

FIG. 23-61

| Species: WNV (8-mers) | | | | | | | | | | | | | | | |
|---|---|---|---|---|---|---|---|---|---|---|---|---|---|---|---|
| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
| NS3 | 1718 | 0.59 | 5 | 4 | 0 | Y | INRLRL

FIG. 23-62

Species: WNV (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1743 | 0.05 | 2 | 1 | 0 | Y | GLPIRYQT | 99.44 | | | | | | | | |
| NS3 | 1744 | 0.05 | 2 | 1 | 0 | Y | LPIRYQTS | 99.44 | | | | | | | | |
| NS3 | 1745 | 0.05 | 2 | 1 | 0 | Y | PIRYQTSA | 99.44 | | | | | | | | |
| NS3 | 1746 | 0.05 | 2 | 1 | 0 | Y | IRYQTSAV | 99.44 | | | | | | | | |
| NS3 | 1747 | 1.02 | 6 | 5 | 0 | Y | RYQTSAVP | 81.36 | RYQTSAVH | 7.91 | RYQTSAVT | 7.34 | RYQTSAVA | 2.26 | RYHTSAVT | 0.56 |
| NS3 | 1748 | 1.02 | 6 | 5 | 0 | Y | YQTSAVPR | 81.36 | YQTSAVHR | 7.91 | YQTSAVTR | 7.34 | YQTSAVAR | 2.26 | YQTSAVNR | 0.56 |
| NS3 | 1749 | 1.02 | 6 | 5 | 0 | Y | QTSAVPRE | 81.36 | QTSAVHRE | 7.91 | QTSAVTRE | 7.34 | QTSAVARE | 2.26 | QTSAVNRE | 0.56 |
| NS3 | 1750 | 0.99 | 5 | 4 | 0 | Y | TSAVPREH | 81.36 | TSAVHREH | 7.91 | TSAVTREH | 7.91 | TSAVAREH | 2.26 | | |
| NS3 | 1755 | 0.62 | 4 | 3 | 0 | Y | REHNGNEI | 88.7 | REHSGNEI | 8.47 | REHTGNEI | 2.26 | | | | |
| NS3 | 1756 | 0.62 | 4 | 3 | 0 | Y | EHNGNEIV | 88.7 | EHSGNEIV | 8.47 | EHTGNEIV | 2.26 | | | | |
| NS3 | 1757 | 0.62 | 4 | 3 | 0 | Y | HNGNEIVD | 88.7 | HSGNEIVD | 8.47 | HTGNEIVD | 2.26 | | | | |
| NS3 | 1758 | 0.62 | 4 | 3 | 0 | Y | NGNEIVDV | 88.7 | SGNEIVDV | 8.47 | TGNEIVDV | 2.26 | | | | |
| NS3 | 1759 | 0.05 | 2 | 1 | 0 | Y | GNEIVDVM | 99.44 | | | | | | | | |
| NS3 | 1760 | 0.05 | 2 | 1 | 0 | Y | NEIVDVMC | 99.44 | | | | | | | | |
| NS3 | 1761 | 0 | 1 | 1 | 0 | Y | EIVDVMCH | 100 | | | | | | | | |
| NS3 | 1762 | 0 | 1 | 1 | 0 | Y | IVDVMCHA | 100 | | | | | | | | |
| NS3 | 1763 | 0 | 1 | 1 | 0 | Y | VDVMCHAT | 100 | | | | | | | | |
| NS3 | 1764 | 0 | 1 | 1 | 0 | Y | DVMCHATL | 100 | | | | | | | | |
| NS3 | 1765 | 0 | 1 | 1 | 0 | Y | VMCHATLT | 100 | | | | | | | | |
| NS3 | 1766 | 0 | 1 | 1 | 0 | Y | MCHATLTH | 100 | | | | | | | | |
| NS3 | 1767 | 0 | 1 | 1 | 0 | Y | CHATLTHR | 100 | | | | | | | | |
| NS3 | 1768 | 0 | 1 | 1 | 0 | Y | HATLTHRL | 100 | | | | | | | | |
| NS3 | 1769 | 0 | 1 | 1 | 0 | Y | ATLTHRLM | 100 | | | | | | | | |
| NS3 | 1770 | 0 | 1 | 1 | 0 | Y | TLTHRLMS | 100 | | | | | | | | |
| NS3 | 1771 | 0 | 1 | 1 | 0 | Y | LTHRLMSP | 100 | | | | | | | | |

FIG. 23-63

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency |
|---|---|---|---|---|---|---|---|---|---|---|
| NS3 | 1772 | 0 | 1 | 1 | 0 | Y | THRLMSPH | 100 | | |
| NS3 | 1773 | 0 | 1 | 1 | 0 | Y | HRLMSPHR | 100 | | |
| NS3 | 1774 | 0 | 1 | 1 | 0 | Y | RLMSPHRV | 100 | | |
| NS3 | 1775 | 0 | 1 | 1 | 0 | Y | LMSPHRVP | 100 | | |
| NS3 | 1776 | 0 | 1 | 1 | 0 | Y | MSPHRVPN | 100 | | |
| NS3 | 1777 | 0 | 1 | 1 | 0 | Y | SPHRVPNY | 100 | | |
| NS3 | 1778 | 0 | 1 | 1 | 0 | Y | PHRVPNYN | 100 | | |
| NS3 | 1779 | 0 | 1 | 1 | 0 | Y | HRVPNYNL | 100 | | |
| NS3 | 1780 | 0 | 1 | 1 | 0 | Y | RVPNYNLF | 100 | | |
| NS3 | 1781 | 0.4 | 2 | 2 | 0 | Y | VPNYNLFV | 92.09 | VPNYNLFI | 7.91 |
| NS3 | 1782 | 0.4 | 2 | 2 | 0 | Y | PNYNLFVM | 92.09 | PNYNLFIM | 7.91 |
| NS3 | 1783 | 0.4 | 2 | 2 | 0 | Y | NYNLFVMD | 92.09 | NYNLFIMD | 7.91 |
| NS3 | 1784 | 0.4 | 2 | 2 | 0 | Y | YNLFVMDE | 92.09 | YNLFIMDE | 7.91 |
| NS3 | 1785 | 0.45 | 3 | 2 | 0 | Y | NLFVMDEA | 91.53 | NLFIMDEA | 7.91 |
| NS3 | 1786 | 0.45 | 3 | 2 | 0 | Y | LFVMDEAH | 91.53 | LFIMDEAH | 7.91 |
| NS3 | 1787 | 0.45 | 3 | 2 | 0 | Y | FVMDEAHF | 91.53 | FIMDEAHF | 7.91 |
| NS3 | 1788 | 0.45 | 3 | 2 | 0 | Y | VMDEAHFT | 91.53 | IMDEAHFT | 7.91 |
| NS3 | 1789 | 0.05 | 2 | 1 | 0 | Y | MDEAHFTD | 99.44 | | |
| NS3 | 1790 | 0.05 | 2 | 1 | 0 | Y | DEAHFTDP | 99.44 | | |
| NS3 | 1791 | 0.05 | 2 | 1 | 0 | Y | EAHFTDPA | 99.44 | | |
| NS3 | 1792 | 0.05 | 2 | 1 | 0 | Y | AHFTDPAS | 99.44 | | |
| NS3 | 1793 | 0 | 1 | 1 | 0 | Y | HFTDPASI | 100 | | |
| NS3 | 1794 | 0 | 1 | 1 | 0 | Y | FTDPASIA | 100 | | |
| NS3 | 1795 | 0 | 1 | 1 | 0 | Y | TDPASIAA | 100 | | |
| NS3 | 1796 | 0.05 | 2 | 1 | 0 | Y | DPASIAAR | 99.44 | | |

FIG. 23-64

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1797 | 0.05 | 2 | 1 | 0 | Y | PAS

FIG. 23-65

Species: WNV (8-mers)

| protein | block starting position | block entropy | total peptides in block | # peptides required to cover 99% of block | gap/Y fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1822 | 0.1 | 3 | 2 | 0

FIG. 23-66

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1855 | 1.33 | 5 | 4 | 0.56 | Y | EWITEYTG | 63.84 | EWITEYIG | 24.29 | EWITEYVG | 10.17 | EWITEYAG | 0.56 |
| NS3 | 1856 | 1.33 | 5 | 4 | 0.56 | Y | WITEYTGK | 63.84 | WITEYIGK | 24.29 | WITEYVGK | 10.17 | WITEFVGK | 0.56 |
| NS3 | 1857 | 1.33 | 5 | 4 | 0.56 | Y | ITEYTGKT | 63.84 | ITEYIGKT | 24.29 | ITEYVGKT | 10.17 | ITEFVGKT | 0.56 |
| NS3 | 1858 | 1.33 | 5 | 4 | 0.56 | Y | TEYTGKTV | 63.84 | TEYIGKTV | 24.29 | TEYVGKTV | 10.17 | TEYAGKTV | 0.56 |
| NS3 | 1859 | 1.33 | 5 | 4 | 0.56 | Y | EYTGKTVW | 63.84 | EYIGKTVW | 24.29 | EYVGKTVW | 10.17 | EYAGKTVW | 0.56 |
| NS3 | 1860 | 1.33 | 5 | 4 | 0.56 | Y | YTGKTVWF | 63.84 | YIGKTVWF | 24.29 | YVGKTVWF | 10.17 | FVGKTVWF | 0.56 |
| NS3 | 1861 | 1.29 | 4 | 3 | 0 | Y | TGKTVWFV | 64.41 | IGKTVWFV | 24.29 | VGKTVWFV | 10.73 | | |
| NS3 | 1862 | 0 | 1 | 1 | 0 | Y | GKTVWFVP | 100 | | | | | | |
| NS3 | 1863 | 0 | 1 | 1 | 0 | Y | KTVWF

FIG. 23-67

Species: WNV (8-mers)

| protein | block starting position | block entropy | total peptides in block | # peptides required to cover 99% of block | gap/X fraction | 99% of block covered w/ <= 5 peptides? | peptides required

FIG. 23-68

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1905 | 0.21 | 3 | 2 | 0 | Y | NDDWDFVI | 97.18 | NDDWDFW | 2.26 | | | | |
| NS3 | 1906 | 0.21 | 3 | 2 | 0 | Y | DDWDFVIT | 97.18 | DDWDFWT | 2.26 | | | | |
| NS3 | 1907 | 0.16 | 2 | 2 | 0 | Y | DWDFVITT | 97.74 | DWDFWTT | 2.26 | | | | |
| NS3 | 1908 | 0.16 | 2 | 2 | 0 | Y | WDFVITTD | 97.74 | WDFWTTD | 2.26 | | | | |
| NS3 | 1909 | 0.16 | 2 | 2 | 0 | Y | DFVITTDI | 97.74 | DFWTTDI | 2.26 | | | | |
| NS3 | 1910 | 0.16 | 2 | 2 | 0 | Y | FVITTDIS | 97.74 | FWTTDIS | 2.26 | | | | |
| NS3 | 1911 | 0.16 | 2 | 2 | 0 | Y | VITTDISE | 97.74 | VTTDISE | 2.26 | | | | |
| NS3 | 1912 | 0.16 | 2 | 2 | 0 | Y | ITTDISEM | 97.74 | VTTDISEM | 2.26 | | | | |
| NS3 | 1913 | 0 | 1 | 1 | 0 | Y | TTDISEMG | 100 | | | | | | |
| NS3 | 1914 | 0 | 1 | 1 | 0 | Y | TDISEMGA | 100 | | | | | | |
| NS3 | 1915 | 0 | 1 | 1 | 0 | Y | DISEMGAN | 100 | | | | | | |
| NS3 | 1916 | 0 | 1 | 1 | 0 | Y | ISEMGANF | 100 | | | | | | |
| NS3 | 1917 | 0.09 | 2 | 2 | 0 | Y | SEMGANFK | 98.87 | SEMGANFR | 1.13 | | | | |
| NS3 | 1918 | 0.09 | 2 | 2 | 0 | Y | EMGANFKA | 98.87 | EMGANFRA | 1.13 | | | | |
| NS3 | 1919 | 0.18 | 3 | 3 | 0 | Y | MGANFKAS | 97.74 | MGANFRAS | 1.13 | MGANFKAN | 1.13 | | |
| NS3 | 1920 | 0.18 | 3 | 3 | 0 | Y | GANFKASR | 97.74 | GANFKANR | 1.13 | GANFRASR | 1.13 | | |
| NS3 | 1921 | 0.18 | 3 | 3 | 0 | Y | ANFKASRV | 97.74 | ANFKANRV | 1.13 | ANFRASRV | 1.13 | | |
| NS3 | 1922 | 0.18 | 3 | 3 | 0 | Y | NFKASRVI | 97.74 | NFKANRVI | 1.13 | NFRASRVI | 1.13 | | |
| NS3 | 1923 | 0.18 | 3 | 3 | 0 | Y | FKASRVID | 97.74 | FRASRVID | 1.13 | FKANRVID | 1.13 | | |
| NS3 | 1924 | 0.18 | 3 | 3 | 0 | Y | KASRVIDS | 97.74 | KANRVIDS | 1.13 | RASRVIDS | 1.13 | | |
| NS3 | 1925 | 0.09 | 2 | 2 | 0 | Y | ASRVIDSR | 98.87 | ANRVIDSR | 1.13 | | | | |
| NS3 | 1926 | 0.09 | 2 | 2 | 0 | Y | SRVIDSRK | 98.87 | NRVIDSRK | 1.13 | | | | |
| NS3 | 1927 | 0 | 1 | 1 | 0 | Y | RVIDSRKS | 100 | | | | | | |
| NS3 | 1928 | 0 | 1 | 1 | 0 | Y | VIDSRKSV | 100 | | | | | | |
| NS3 | 1929 | 0 | 1 | 1 | 0 | Y | IDSRKSVK | 100 | | | | | | |

FIG. 23-69

Species: WNV (8-mers)

| protein | block starting position | block entropy | total peptides in block | # peptides required to cover 99% of block | gap/X fraction 99% of block | covered w/ <= 5 peptides? | block required to cover 99% of peptides | frequency | block required to cover 99% of peptides | frequency | block required to cover 99% of peptides | frequency | block required to cover 99% of peptides | frequency | block required to cover 99% of peptides | frequency |
|---|---|---|---|---|---|---|---|---|---|---|---|---|---|---|---|---|
| NS3 | 1930 | 0 | 1 | 1 | 0 | Y | DSRKSVKP | 100 | | | | | | | | |
| NS3 | 1931 | 0.05 | 2 | 1 | 0 | Y | SRKSVKPT | 99.44 | RKSVKPTS | 0.56 | | | | | | |
| NS3 | 1932 | 0.1 | 3 | 2 | 0 | Y | RKSVKPTI | 98.87 | KSVKPIII | 0.56 | | | | | | |
| NS3 | 1933 | 0.1 | 3 | 2 | 0 | Y | KSVKPTII | 98.87 | SVKPIIIE | 7.91 | | | | | | |
| NS3 | 1934 | 0.5 | 4 | 3 | 0 | Y | SVKPTIII | 90.96 | VKPTIIEE | 7.91 | | | | | | |
| NS3 | 1935 | 0.68 | 5 | 4 | 0 | Y | VKPTIIIE | 88.14 | KPTIIEEG | 7.91 | SVKPIIIT | 0.56 | | | | |
| NS3 | 1936 | 0.68 | 5 | 4 | 0 | Y | KPTIIIEG | 88.14 | PTIIEEGD | 7.91 | VKPTIIITD | 2.82 | | | | |
| NS3 | 1937 | 0.68 | 5 | 4 | 0 | Y | PTIIIEGE | 88.14 | IEEGDGRV | 7.91 | KPTIIITDG | 2.82 | | | | |
| NS3 | 1940 | 0.67 | 6 | 5 | 0 | Y | ITEGEGRV | 88.7 | EEGDGRVI | 7.91 | PTIIITDGE | 2.82 | | | | |
| NS3 | 1941 | 0.67 | 6 | 5 | 0 | Y | TEGEGRVI | 88.7 | EGDGRVIL | 7.91 | ITDGENRV | 1.69 | VKPIIITE | 0.56 | ITEGEARV | 0.56 |
| NS3 | 1942 | 0.67 | 6 | 5 | 0 | Y | EGEGRVIL | 88.7 | GDGRVILG | 7.91 | TDGENRVV | 1.69 | KPIIITEG | 0.56 | TDGESRVV | 0.56 |
| NS3 | 1943 | 0.67 | 6 | 5 | 0 | Y | GEGRVILG | 88.7 | DGRVILGE | 7.91 | DGENRVVL | 1.69 | PTSITEGE | 0.56 | DGESRVVL | 0.56 |
| NS3 | 1944 | 0.67 | 6 | 5 | 0 | Y | EGRVILGE | 88.7 | NRVVLGEP | 1.69 | GENRVVLG | 1.69 | ITDGESRV | 0.56 | GESRVVLG | 0.56 |
| NS3 | 1945 | 0.27 | 5 | 4 | 0 | Y | GRVILGEP | 96.61 | RVVLGEPS | 2.26 | ENRVVLGE | 1.69 | TEGEARVI | 0.56 | ESRVVLGE | 0.56 |
| NS3 | 1946 | 0.21 | 3 | 2 | 0 | Y | RVILGEPS | 97.18 | VVLGEPSA | 2.26 | ARVILGEP | 0.56 | EGEARVIL | 0.56 | | |
| NS3 | 1947 | 0.21 | 3 | 2 | 0 | Y | VILGEPSA | 97.18 | ILGEPSAI | 8.47 | | | GEARVILG | 0.56 | | |
| NS3 | 1948 | 0.62 | 4 | 3 | 0 | Y | ILGEPSAV | 88.7 | LGEPSAIT | 10.73 | VLGEPSAI | 2.26 | EGKVVLSE | 0.56 | | |
| NS3 | 1949 | 0.54 | 3 | 2 | 0 | Y | LGEPSAVT | 88.7 | GEPSAITA | 10.73 | | | SRVVLGEP | 0.56 | | |
| NS3 | 1950 | 0.54 | 3 | 2 | 0 | Y | GEPSAVTA | 88.7 | EPSAITAA | 11.3 | | | | | | |
| NS3 | 1951 | 0.51 | 2 | 2 | 0 | Y | EPSAVTAA | 88.7 | PSAITAAS | 11.3 | | | | | | |
| NS3 | 1952 | 0.51 | 2 | 2 | 0 | Y | PSAVTAAS | 88.7 | SAITAASA | 11.3 | | | | | | |
| NS3 | 1953 | 0.51 | 2 | 2 | 0 | Y | SAVTAASA | 88.7 | AITAASAA | 11.3 | | | | | | |
| NS3 | 1954 | 0.51 | 2 | 2 | 0 | Y | AVTAASAA | 88.7 | ITAASAAQ | 11.3 | | | | | | |
| NS3 | 1955 | 0.51 | 2 | 2 | 0 | Y | VTAASAAQ | 88.7 | | | | | | | | |
| NS3 | 1956 | 0 | 1 | 1 | 0 | Y | TAASAAQR | 100 | | | | | | | | |

FIG. 23-70

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|

FIG. 23-71

Species: WNV (8-mers)

| protein | block starting position | block entropy | total peptides in block | # peptides required to cover 99% of block | gap/X fraction 99% of block | covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1982 | 0 | 1 | 1 | 0 | Y | GHTNEDDS | 100 | | | | | | |
| NS3 | 1983 | 0 | 1 | 1 | 0 | Y | HTNEDDSN | 100 | | | | | | |
| NS3 | 1984 | 0.42 | 5 | 4 | 0.56 | Y | TNEDDSNF | 93.79 | TNEDDSNY | 1.69 | TNEDDSNL | 1.69 | TNEDDSNC | 1.69 |
| NS3 | 1985 | 0.42 | 5 | 4 | 0.56 | Y | NEDDSNFA | 93.79 | NEDDSNLA | 1.69 | NEDDSNYA | 1.69 | NEDDSNCA | 1.69 |
| NS3 | 1986 | 0.42 | 5 | 4 | 0.56 | Y | EDDSNFAH | 93.79 | EDDSNLAH | 1.69 | EDDSNCAH | 1.69 | EDDSNYAH | 1.69 |
| NS3 | 1987 | 0.42 | 5 | 4 | 0.56 | Y | DDSNFAHW | 93.79 | DDSNCAHW | 1.69 | DDSNYAHW | 1.69 | DDSNLAHW | 1.69 |
| NS3 | 1988 | 0.42 | 5 | 4 | 0.56 | Y | DSNFAHWT | 93.79 | DSNCAHWT | 1.69 | DSNYAHWT | 1.69 | DSNLAHWT | 1.69 |
| NS3 | 1989 | 0.42 | 5 | 4 | 0.56 | Y | SNFAHWTE | 93.79 | SNLAHWTE | 1.69 | SNCAHWTE | 1.69 | SNYAHWTE | 1.69 |
| NS3 | 1990 | 0.42 | 5 | 4 | 0.56 | Y | NFAHWTEA | 93.79 | NCAHWTEA | 1.69 | NLAHWTEA | 1.69 | NYAHWTEA | 1.69 |
| NS3 | 1991 | 0.42 | 5 | 4 | 0.56 | Y | FAHWTEAR | 93.79 | CAHWTEAR | 1.69 | LAHWTEAR | 1.69 | YAHWTEAR | 1.69 |
| NS3 | 1992 | 0 | 1 | 1 | 0 | Y | AHWTEARI | 100 | | | | | | |
| NS3 | 1993 | 0 | 1 | 1 | 0 | Y | HWTEARIM | 100 | | | | | | |
| NS3 | 1994 | 0.05 | 2 | 1 | 0 | Y | WTEARIML | 99.44 | | | | | | |
| NS3 | 1995 | 0.05 | 2 | 1 | 0 | Y | TEARIMLD | 99.44 | | | | | | |
| NS3 | 1996 | 0.05 | 2 | 1 | 0 | Y | EARIMLDN | 99.44 | | | | | | |
| NS3 | 1997 | 0.05 | 2 | 1 | 0 | Y | ARIMLDNI | 99.44 | | | | | | |
| NS3 | 1998 | 0.05 | 2 | 1 | 0 | Y | RIMLDNIN | 99.44 | | | | | | |
| NS3 | 1999 | 0.05 | 2 | 1 | 0 | Y | IMLDNINM | 99.44 | | | | | | |
| NS3 | 2000 | 0.05 | 2 | 1 | 0 | Y | MLDNINMP | 99.44 | | | | | | |
| NS3 | 2001 | 0.1 | 3 | 2 | 0.56 | Y | LDNINMPN | 98.31 | LDNINMPS | 0.56 | | | | |
| NS3 | 2002 | 0.05 | 2 | 1 | 0.56 | Y | DNINMPNG | 98.87 | | | | | | |
| NS3 | 2003 | 0.05 | 2 | 1 | 0.56 | Y | NINMPNGL | 98.87 | | | | | | |
| NS3 | 2004 | 0.53 | 3 | 2 | 0.56 | Y | INMPNGLI | 88.7 | INMPNGLV | 10.17 | | | | |
| NS3 | 2005 | 0.53 | 3 | 2 | 0.56 | Y | NMPNGLIA | 88.7 | NMPNGLVA | 10.17 | | | | |
| NS3 | 2006 | 0.53 | 3 | 2 | 0.56 | Y | MPNGLIAQ | 88.7 | MPNGLVAQ | 10.17 | | | | |

FIG. 23-72

Species: WNV (8-mers)

| protein | block starting position | block

FIG. 23-73

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides

FIG. 23-74

Species: W

FIG. 23-75

Species: WNV (8-mers)

| protein | position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2082 | 0.16 | 2 | 2 | 0 | Y | NNEVEVIT | 97.74 | NTEVEVIT | 2.26 | | | | |
| NS3 | 2083 | 0.16 | 2 | 2 | 0 | Y | NEVEVITK | 97.74 | TEVEVITK | 2.26 | | | | |
| NS3 | 2084 | 0.21 | 3 | 2 | 0 | Y | EVEVITKL | 97.18 | EVEVITKM | 2.26 | | | | |
| NS3 | 2085 | 0.21 | 3 | 2 | 0 | Y | VEVITKLG | 97.18 | VEVITKMG | 2.26 | | | | |
| NS3 | 2086 | 0.21 | 3 | 2 | 0 | Y | EVITKLGE | 97.18 | EIVTKMGE | 2.26 | | | | |
| NS3 | 2087 | 0.21 | 3 | 2 | 0 | Y | VITKLGER | 97.18 | IVTKMGER | 2.26 | | | | |
| NS3 | 2088 | 0.21 | 3 | 2 | 0 | Y | ITKLGERK | 97.18 | VTKMGERK | 2.26 | | | | |
| NS3 | 2089 | 0.21 | 3 | 2 | 0 | Y | TKLGERKI | 97.18 | TKMGERKI | 2.26 | | | | |
| NS3 | 2090 | 0.21 | 3 | 2 | 0 | Y | KLGERKIL | 97.18 | KMGERKIL | 2.26 | | | | |
| NS3 | 2091 | 0.21 | 3 | 2 | 0 | Y | LGERKILR | 97.18 | MGERKILR | 2.26 | | | | |
| NS3 | 2092 | 0 | 1 | 1 | 0 | Y | GERKILRP | 100 | | | | | | |
| NS3 | 2093 | 0.05 | 2 | 1 | 0 | Y | ERKILRPR | 99.44 | | | | | | |
| NS3 | 2094 | 0.05 | 2 | 1 | 0 | Y | RKILRPRW | 99.44 | | | | | | |
| NS3 | 2095 | 0.59 | 4 | 3 | 0 | Y | KILRPRWI | 88.7 | KILRPRWA | 9.6 | KILRPRWV | 1.13 | | |
| NS3 | 2096 | 0.59 | 4 | 3 | 0 | Y | ILRPRWID | 88.7 | ILRPRWAD | 9.6 | ILRPRWWD | 1.13 | | |
| NS3 | 2097 | 0.59 | 4 | 3 | 0 | Y | LRPRWIDA | 88.7 | LRPRWADA | 9.6 | LRPRWWDA | 1.13 | | |
| NS3 | 2098 | 0.59 | 4 | 3 | 0 | Y | RPRWIDAR | 88.7 | RPRWADAR | 9.6 | RPRWVDAR | 1.13 | | |
| NS3 | 2099 | 0.59 | 4 | 3 | 0 | Y | PRWIDARV | 88.7 | PRWADARV | 9.6 | PRWVDARV | 1.13 | | |
| NS3 | 2100 | 0.59 | 4 | 3 | 0 | Y | RWIDARVY | 88.7 | RWADARVY | 9.6 | RWVDARVY | 1.13 | | |
| NS3 | 2101 | 0.64 | 5 | 4 | 0 | Y | WIDARVYS | 88.14 | WADARVYS | 9.6 | WVDARVYS | 1.13 | WTDARVYS | 0.56 |
| NS3 | 2102 | 0.64 | 5 | 4 | 0 | Y | IDARVYSD | 88.14 | ADARVYSD | 9.6 | VDARVYSD | 1.13 | IDARVYLD | 0.56 |
| NS3 | 2103 | 0.05 | 2 | 1 | 0 | Y | DARVYSDH | 99.44 | | | | | | |
| NS3 | 2104 | 0.05 | 2 | 1 | 0 | Y | ARVYSDHQ | 99.44 | | | | | | |
| NS3 | 2105 | 0.05 | 2 | 1 | 0 | Y | RVYSDHQA | 99.44 | | | | | | |
| NS3 | 2106 | 0.05 | 2 | 1 | 0 | Y | VYSDHQAL | 99.44 | | | | | | |

FIG. 23-76

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2107 | 0.05 | 2 | 1 | 0 | Y | YSDHQALK | 99.44 | | | | | | |
| NS3 | 2108 | 0.68 | 4 | 3 | 0 | Y | SDHQALKA | 87.01 | SDHQALKS | 10.17 | SDHQALKL | 2.26 | | |
| NS3 | 2109 | 0.63 | 3 | 3 | 0 | Y | DHQALKAF | 87.57 | DHQALKSF | 10.17 | DHQALKLF | 2.26 | | |
| NS3 | 2110 | 0.63 | 3 | 3 | 0 | Y | HQALKAFK | 87.57 | HQALKSFK | 10.17 | HQALKLFK | 2.26 | | |
| NS3 | 2111 | 0.63 | 3 | 3 | 0 | Y | QALKAFKD | 87.57 | QALKSFKD | 10.17 | QALKLFKD | 2.26 | | |
| NS3 | 2112 | 0.63 | 3 | 3 | 0 | Y | ALKAFKDF | 87.57 | ALKSFKDF | 10.17 | ALKLFKDF | 2.26 | | |
| NS3 | 2113 | 0.63 | 3 | 3 | 0 | Y | LKAFKDFA | 87.57 | LKSFKDFA | 10.17 | LKLFKDFA | 2.26 | | |
| NS3 | 2114 | 0.66 | 4 | 3 | 0 | Y | KAFKDFAS | 87.57 | KSFKDFAS | 9.6 | KLFKDFAA | 2.26 | | |
| NS3 | 2115 | 0.66 | 4 | 3 | 0 | Y | AFKDFASG | 87.57 | SFKDFASG | 9.6 | LFKDFAAG | 2.26 | | |
| NS3 | 2116 | 0.21 | 3 | 2 | 0 | Y | FKDFASGK | 97.18 | FKDFAAGR | 2.26 | | | | |
| NS3 | 2117 | 0.21 | 3 | 2 | 0 | Y | KDFASGKR | 97.18 | KDFAAGRR | 2.26 | | | | |
| NS3 | 2118 | 0.21 | 3 | 2 | 0 | Y | DFASGKRS | 97.18 | DFAAGRRS | 2.26 | | | | |
| NS3 | 2119 | 0.21 | 3 | 2 | 0 | Y | FASGKRSQ | 97.18 | FAAGRRSQ | 2.26 | | | | |
| NS3 | 2120 | 0.31 | 5 | 4 | 0 | Y | ASGKRSQI | 96.05 | AAGRRSQI | 2.26 | ASGKRSQM | 0.56 | AAGKRSQI | 0.56 |
| NS3 | 2121 | 0.31 | 5 | 4 | 0 | Y | SGKRSQIG | 96.05 | AGRRSQIG | 2.26 | AGKRSQIG | 0.56 | SGKRSQMG | 0.56 |
| NS3 | 2122 | 0.38 | 5 | 4 | 0 | Y | GKRSQIGL | 94.92 | GRRSQIGL | 2.26 | GKRSQIGF | 1.69 | GKRSQMGL | 0.56 |
| NS3 | 2123 | 0.79 | 6 | 5 | 0 | Y | KRSQIGLI | 86.44 | KRSQIGLV | 2.26 | RRSQIGLV | 2.26 | KRSQIGFI | 1.69 |
| NS3 | 2124 | 0.71 | 5 | 4 | 0 | Y | RSQIGLIE | 86.44 | RSQIGLVE | 10.73 | RSQIGLV | 2.26 | RSQMGLIE | 0.56 |
| NS3 | 2125 | 0.71 | 5 | 4 | 0 | Y | SQIGLIEV | 86.44 | SQIGLVEV | 10.73 | SQIGFIEV | 2.26 | SQVGLIEV | 0.56 |
| NS3 | 2126 | 0.79 | 6 | 5 | 0 | Y | QIGLIEVL | 86.44 | QIGLVEVL | 8.47 | QIGFIEVL | 2.26 | QIGFIEV | 1.69 |
| NS4A | 2127 | 0.79 | 6 | 5 | 0 | Y | IGLIEVLG | 86.44 | IGLVEVLG | 8.47 | IGLVEVIG | 2.26 | IGFIEVLG | 1.69 | QVGLIEVL | 0.56 |
| NS4A | 2128 | 0.74 | 5 | 4 | 0 | Y | GLIEVLGK | 87.01 | GLVEVLGK | 8.47 | GLVEVLGR | 2.26 | GFIEVLGK | 1.69 | MGLIEVLG | 0.56 |
| NS4A | 2129 | 0.74 | 5 | 4 | 0 | Y | LIEVLGKM | 87.01 | LVEVLGKM | 8.47 | LVEVIGRM | 2.26 | FIEVLGKM | 1.69 | |
| NS4A | 2130 | 0.62 | 4 | 3 | 0 | Y | IEVLGKMP | 88.7 | VEVLGKMP | 8.47 | VEVIGRMP | 2.26 | | | |
| NS4A | 2131 | 0.59 | 3 | 3 | 0 | Y | EVLGKMPE | 88.7 | EVLGKMPE | 9.04 | EVIGRMPE | 2.26 | | | |

FIG. 23-77

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS4A | 2132 | 0.59 | 3 | 3 | 0 | Y | VLGKMPEH | 88.7 | VLGRMPEH | 9.04 | VLGRMPEH | 2.26 |
| NS4A | 2133 | 0.59 | 3 | 3 | 0 | Y | LGKMPEHF | 88.7 | LGRMPEHF | 9.04 | IGRMPEHF | 2.26 |
| NS4A | 2134 | 0.59 | 3 | 3 | 0 | Y | GKMPEHFM | 88.7 | GRMPEHFM | 9.04 | GRMPEHFV | 2.26 |
| NS4A | 2135 | 0.64 | 4 | 4 | 0 | Y | KMPEHFMG | 88.7 | RMPEHFMG | 7.91 | RMPEHFVG | 2.26 |
| NS4A | 2136 | 0.24 | 3 | 3 | 0 | Y | MPEHFMGK | 96.61 | MPEHFVGK | 2.26 | MPEHFVYK | 1.13 |
| NS4A | 2137 | 0.24 | 3 | 3 | 0 | Y | PEHFMGKT | 96.61 | PEHFVGKT | 2.26 | PEHFMVKT | 1.13 |
| NS4A | 2138 | 0.24 | 3 | 3 | 0 | Y | EHFMGKTW | 96.61 | EHFVGKTW | 2.26 | EHFMVKTW | 1.13 |
| NS4A | 2139 | 0.24 | 3 | 3 | 0 | Y | HFMGKTWE | 96.61 | HFVGKTWE | 2.26 | HFMVKTWE | 1.13 |
| NS4A | 2140 | 0.24 | 3 | 3 | 0 | Y | FMGKTWEA | 96.61 | FVGKTWEA | 2.26 | FMVKTWEA | 1.13 |
| NS4A | 2141 | 0.24 | 3 | 3 | 0 | Y | MGKTWEAL | 96.61 | VGKTWEAL | 2.26 | MVKTWEAL | 1.13 |
| NS4A | 2142 | 0.09 | 2 | 2 | 0 | Y | GKTWEALD | 98.87 | VKTWEALD | 1.13 | | |
| NS4A | 2143 | 0 | 1 | 1 | 0 | Y | KTWEALDT | 100 | | | | |
| NS4A | 2144 | 0 | 1 | 1 | 0 | Y | TWEALDTM | 100 | | | | |
| NS4A | 2145 | 0 | 1 | 1 | 0 | Y | WEALDTMY | 100 | | | | |
| NS4A | 2146 | 0 | 1 | 1 | 0 | Y | EALDTMYV | 100 | | | | |
| NS4A | 2147 | 0 | 1 | 1 | 0 | Y | ALDTMYV | 100 | | | | |
| NS4A | 2148 | 0 | 1 | 1 | 0 | Y | LDTMYVVA | 100 | | | | |
| NS4A | 2149 | 0 | 1 | 1 | 0 | Y | DTMYVVAT | 100 | | | | |
| NS4A | 2150 | 0 | 1 | 1 | 0 | Y | TMYVVATA | 100 | | | | |
| NS4A | 2151 | 0.05 | 2 | 2 | 0 | Y | MYVVATAE | 99.44 | | | | |
| NS4A | 2152 | 0.1 | 3 | 3 | 0 | Y | YVVATAEK | 98.87 | YVVATAER | 0.56 | | |
| NS4A | 2153 | 0.1 | 3 | 3 | 0 | Y | VVATAEKG | 98.87 | VVATAERG | 0.56 | | |
| NS4A | 2154 | 0.15 | 4 | 3 | 0 | Y | VATAEKGG | 98.31 | VATAEKGR | 0.56 | VATAERGG | 0.56 |
| NS4A | 2155 | 0.15 | 4 | 3 | 0 | Y | ATAEKGGR | 98.31 | ATAEKGRR | 0.56 | ATADKGGR | 0.56 |
| NS4A | 2156 | 0.15 | 4 | 3 | 0 | Y | TAEKGGRA | 98.31 | TAEKGRRA | 0.56 | TAERGGRA | 0.56 |

FIG. 23-78

Species: WNV (8-mers)

| protein | block starting position | block entropy | total peptides in block | # peptides required to cover 99% of block | gap/X fraction | 99% of block covered w/ <= 5 peptides? | peptides

FIG. 23-79

Species: WNV (8-mers)

| protein | block starting position | block entropy | total peptides in block | # peptides required to cover 99% of block | gap/X fraction | 99% of block covered w/ <= 5 peptides? | block (99% cover) | frequency | block (99% cover) | frequency | block (99% cover) | frequency | block (99% cover) | frequency |
|---|---|---|---|---|---|---|---|---|---|---|---|---|---|---|
| NS4A | 2183 | 0.65 | 5 | 4 | 0 | Y | LLSVMTMG | 88.7 | LLSVMSLG | 7.91 | LLSVMTLG | 2.26 | LLGVMTMG | 0.56 |
| NS4A | 2184 | 0.7 | 6 | 5 | 0 | Y | LSVMTMGV | 88.14 | LSVMSLGV | 7.91 | LSVMTLGV | 2.26 | LGVMTMGV | 0.56 |
| NS4A | 2185 | 0.7 | 6 | 5 | 0 | Y | SVMTMGVF | 88.14 | SVMSLGVF | 7.91 | SVMTLGVF | 2.26 | SVMSMGVF | 0.56 |
| NS4A | 2186 | 0.7 | 6 | 5 | 0 | Y | VMTMGVFF | 88.14 | VMSLGVFF | 7.91 | VMTLGVFC | 2.26 | VMSMGVFF | 0.56 |
| NS4A | 2187 | 0.7 | 6 | 5 | 0 | Y | MTMGVFFL | 88.14 | MSLGVFFL | 7.91 | MTLGVFCL | 2.26 | MTMGIFFL | 0.56 |
| NS4A | 2188 | 0.7 | 6 | 5 | 0 | Y | TMGVFLL | 88.14 | SLGVFFLL | 7.91 | TLGVFCLL | 2.26 | SMGVFFLL | 0.56 |
| NS4A | 2189 | 0.65 | 5 | 4 | 0 | Y | MGVFFLLM | 88.7 | LGVFFLLM | 7.91 | LGVFCLLM | 2.26 | MGIFFLLM | 0.56 |
| NS4A | 2190 | 0.26 | 4 | 3 | 0 | Y | GVFFLLMQ | 96.61 | GVFCLLMQ | 2.26 | GVFLLLMQ | 0.56 | | |
| NS4A | 2191 | 0.26 | 4 | 3 | 0 | Y | VFFLLMQR | 96.61 | VFCLLMQR | 2.26 | IFFLLMQR | 0.56 | | |
| NS4A | 2192 | 0.21 | 3 | 2 | 0 | Y | FFLLMQRK | 97.18 | FCLLMQRK | 2.26 | | | | |
| NS4A | 2193 | 0.21 | 3 | 2 | 0 | Y | FLLMQRKG | 97.18 | CLLMQRKG | 2.26 | | | | |
| NS4A | 2194 | 0.16 | 2 | 2 | 0 | Y | LLMQRKGI | 97.74 | LLMQRKGV | 2.26 | | | | |
| NS4A | 2195 | 0.16 | 2 | 2 | 0 | Y | LMQRKGIG | 97.74 | LMQRKGVS | 2.26 | | | | |
| NS4A | 2196 | 0.16 | 2 | 2 | 0 | Y | MQRKGIGK | 97.74 | MQRKGVSK | 2.26 | | | | |
| NS4A | 2197 | 0.16 | 2 | 2 | 0 | Y | QRKGIGKI | 97.74 | QRKGVSKI | 2.26 | | | | |
| NS4A | 2198 | 0.16 | 2 | 2 | 0 | Y | RKGIGKIG | 97.74 | RKGVSKIG | 2.26 | | | | |
| NS4A | 2199 | 0.16 | 2 | 2 | 0 | Y | KGIGKIGL | 97.74 | KGVSKIGL | 2.26 | | | | |
| NS4A | 2200 | 0.16 | 2 | 2 | 0 | Y | GIGKIGLG | 97.74 | GVSKIGLA | 2.26 | | | | |
| NS4A | 2201 | 0.16 | 2 | 2 | 0 | Y | IGKIGLGG | 97.74 | VSKIGLAG | 2.26 | | | | |
| NS4A | 2202 | 1.73 | 5 | 5 | 0 | Y | GKIGLGGA | 50.85 | GKIGLGGT | 22.6 | GKIGLGGV | 21.47 | GKIGLGGI | 2.82 | SKIGLAGV | 2.26 |
| NS4A | 2211 | 0.87 | 6 | 4 | 0.56 | Y | LGVATFFC | 83.62 | LGAATFFC | 10.73 | LGLATFFC | 2.26 | LGVATLFC | 1.69 | LAVATFFC | 0.56 |
| NS4A | 2212 | 0.82 | 5 | 4 | 0.56 | Y | GVATFFCW | 84.18 | GAATFFCW | 10.73 | GLATFFCW | 2.26 | GVATLFCW | 1.69 | |
| NS4A | 2213 | 0.77 | 4 | 4 | 0.56 | Y | VATFFCWM | 84.75 | AATFFCWM | 10.73 | LATFFCWM | 2.26 | VATLFCWM | 1.69 | |
| NS4A | 2214 | 0.12 | 2 | 2 | 0.56 | Y | ATFCWMA | 97.74 | ATLFCWMA | 1.69 | | | | |
| NS4A | 2215 | 0.25 | 3 | 3 | 0.56 | Y | TFFCWMAE | 96.05 | TFFCWMAD | 1.69 | TLFCWMAE | 1.69 | | |

FIG. 23-80

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | fr

FIG. 23-81

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99%

FIG. 23-82

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | fr

FIG. 23-83

Species: WNV (8-mers)

FIG. 23-84

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2343 | 0 | 1 | 1 | 0 | Y | LTSINVQA | 100 | | | | | | |
| NS4B | 2344 | 0 | 1 | 1 | 0 | Y | TSINVQAS | 100 | | | | | | |
| NS4B | 2345 | 0.09 | 2 | 2 | 0 | Y | SINVQASA | 98.87 | SINVQAST | 1.13 | | | | |
| NS4B | 2346 | 0.09 | 2 | 2 | 0 | Y | INVQASAL | 98.87 | INVQASTL | 1.13 | | | | |
| NS4B | 2347 | 0.24 | 3 | 2 | 0 | Y | NVQASALF | 96.61 | NVQASALY | 2.26 | NVQASTLF | 1.13 | | |
| NS4B | 2348 | 0.24 | 3 | 3 | 0 | Y | VQASALFT | 96.61 | VQASALYS | 2.26 | VQASTLFT | 1.13 | | |
| NS4B | 2349 | 0.24 | 3 | 3 | 0 | Y | QASALFTL | 96.61 | QASALYSL | 2.26 | QASTLFTL | 1.13 | | |
| NS4B | 2350 | 0.46 | 4 | 4 | 0 | Y | ASALFTLA | 93.22 | ASALYSLA | 2.26 | ASTLFTLA | 1.13 | | |
| NS4B | 2351 | 0.46 | 4 | 4 | 0 | Y | SALFTLAR | 93.22 | SALYSLAR | 2.26 | STLFTLAR | 1.13 | | |
| NS4B | 2352 | 0.46 | 4 | 4 | 0 | Y | ALFTLARG | 93.22 | ALYSLARG | 2.26 | TLFTLARG | 1.13 | | |
| NS4B | 2353 | 0.37 | 3 | 3 | 0 | Y | LFTLARGF | 94.35 | LYSLARGF | 2.26 | | | | |
| NS4B | 2354 | 0.37 | 3 | 3 | 0 | Y | FTLARGFP | 94.35 | YSLARGFP | 2.26 | | | | |
| NS4B | 2355 | 0.37 | 3 | 3 | 0 | Y | TLARGFPF | 94.35 | SLARGFPF | 2.26 | | | | |
| NS4B | 2356 | 0.21 | 2 | 2 | 0 | Y | LARGFPFV | 96.61 | | | | | | |
| NS4B | 2357 | 0.21 | 2 | 2 | 0 | Y | ARGFPFVD | 96.61 | | | | | | |
| NS4B | 2358 | 0 | 1 | 1 | 0 | Y | RGFPFVDV | 100 | | | | | | |
| NS4B | 2359 | 0 | 1 | 1 | 0 | Y | GFPFVDVG | 100 | | | | | | |
| NS4B | 2360 | 0.09 | 2 | 2 | 0 | Y | FPFVDVGV | 98.87 | FPFVDVGI | 1.13 | | | | |
| NS4B | 2361 | 0.09 | 2 | 2 | 0 | Y | PFVDVGVS | 98.87 | PFVDVGIS | 1.13 | | | | |
| NS4B | 2362 | 0.1 | 3 | 2 | 0 | Y | FVDVGVSA | 98.87 | FVDVGISS | 0.56 | | | | |
| NS4B | 2363 | 0.1 | 3 | 2 | 0 | Y | VDVGVSAL | 98.87 | VDVGISSL | 0.56 | | | | |
| NS4B | 2364 | 0.1 | 3 | 2 | 0 | Y | DVGVSALL | 98.87 | DVGISSLL | 0.56 | | | | |
| NS4B | 2365 | 0.1 | 3 | 2 | 0 | Y | VGVSALLL | 98.87 | VGISSLLL | 0.56 | | | | |
| NS4B | 2366 | 0.1 | 3 | 2 | 0 | Y | GVSALLLA | 98.87 | GISSLLLA | 0.56 | | | | |
| NS4B | 2367 | 0.19 | 4 | 3 | 0 | Y | VSALLLAA | 97.74 | VSALLLAV | 1.13 | ISSLLLAV | 0.56 | | |

FIG. 23-85

Species: WNV (8-mers)

| protein | block starting position | block entropy | total peptides in block | # peptides required to cover 99% of block | gap/X fraction | 99% of block covered w/ <= 5 peptides? | peptides required to cover 99% of block |

FIG. 23-86

Species: WNV (8-mers)

| prot

FIG. 23-87

Species: WNV (8-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2425 | 0.16 | 2 | 2 | 0 | Y | VDGIVATD | 97.74 | IDGMVATD | 2.26 | | | | |
| NS4B | 2426 | 0.16 | 2 | 2 | 0 | Y | DGIVATDV | 97.74 | DGMVATDV | 2.26 | | | | |
| NS4B | 2427 | 0.16 | 2 | 2 | 0 | Y | GIVATDVP | 97.74 | GMVATDVP | 2.26 | | | | |
| NS4B | 2428 | 0.16 | 2 | 2 | 0 | Y | IVATDVPE | 97.74 | MVATDVPE | 2.26 | | | | |
| NS4B | 2429 | 0 | 1 | 1 | 0 | Y | VATDVPEL | 100 | | | | | | |
| NS4B | 2430 | 0 | 1 | 1 | 0 | Y | ATDVPELE | 100 | | | | | | |
| NS4B | 2431 | 0 | 1 | 1 | 0 | Y | TDVPELER | 100 | | | | | | |
| NS4B | 2432 | 0.16 | 2 | 2 | 0 | Y | DVPELERT | 97.74 | DVPELERA | 2.26 | | | | |
| NS4B | 2433 | 0.16 | 2 | 2 | 0 | Y | VPELERTT | 97.74 | VPELERAT | 2.26 | | | | |
| NS4B | 2434 | 0.16 | 2 | 2 | 0 | Y | PELERTTP | 97.74 | PELERATP | 2.26 | | | | |
| NS4B | 2435 | 0.64 | 4 | 3 | 0 | Y | ELERTTPI | 87.57 | ELERATPV | 10.17 | ELERATPI | 1.69 | | |
| NS4B | 2436 | 0.64 | 4 | 3 | 0 | Y | LERTTPIM | 87.57 | LERTPYM | 10.17 | LERATPIM | 1.69 | | |
| NS4B | 2437 | 0.64 | 4 | 3 | 0 | Y | ERTTPIMQ | 87.57 | ERTTPYMQ | 10.17 | ERATPIMQ | 1.69 | | |
| NS4B | 2438 | 0.64 | 4 | 3 | 0 | Y | RTTPIMQK | 87.57 | RTTPVMQK | 10.17 | RATPIMQK | 1.69 | | |
| NS4B | 2439 | 0.64 | 4 | 3 | 0 | Y | TTPIMQKK | 87.57 | TTPVMQKK | 10.17 | ATPIMQKK | 1.69 | | |
| NS4B | 2440 | 0.57 | 4 | 3 | 0 | Y | TPIMQKKV | 88.7 | TPVMQKKV | 10.17 | TPMMQKKV | 0.56 | | |
| NS4B | 2441 | 0.57 | 4 | 3 | 0 | Y | PIMQKKVG | 88.7 | PVMQKKVG | 10.17 | PIMQKKIG | 0.56 | | |
| NS4B | 2442 | 0.57 | 4 | 3 | 0 | Y | IMQKKVGQ | 88.7 | VMQKKVGQ | 10.17 | MMQKKVGQ | 0.56 | | |
| NS4B | 2443 | 0.21 | 3 | 2 | 0 | Y | MQKKVGQI | 97.18 | MQKKVGQV | 2.26 | | | | |
| NS4B | 2444 | 0.33 | 4 | 3 | 0 | Y | QKKVGQIM | 95.48 | QKKVGQVM | 2.26 | QKKVGQII | 1.69 | | |
| NS4B | 2445 | 0.33 | 4 | 3 | 0 | Y | KKVGQIML | 95.48 | KKVGQYML | 2.26 | KKVGQIIL | 1.69 | | |
| NS4B | 2446 | 0.33 | 4 | 3 | 0 | Y | KVGQIMLI | 95.48 | KVGQVMLI | 2.26 | KVGQIILI | 1.69 | | |
| NS4B | 2447 | 0.38 | 5 | 4 | 0 | Y | VGQIMLIL | 94.92 | VGQVMLIL | 2.26 | VGQIILIL | 1.69 | IGQIMLIL | 0.56 |
| NS4B | 2448 | 0.33 | 4 | 3 | 0 | Y | GQIMLILV | 95.48 | GQVMLILV | 2.26 | GQIILILV | 1.69 | | |
| NS4B | 2449 | 0.33 | 4 | 3 | 0 | Y | QIMLILVS | 95.48 | QVMLILVS | 2.26 | QIILILVS | 1.69 | | |

FIG. 23-88

Species: WNV (8-mers)

| protein | block starting position | block

FIG. 23-89

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2476 | 0.65 | 5 | 4 | 0 | Y | ITAAAVTL | 88.7 | TIAAAVTL | 7.91 | VTAAAVTL | 2.26 | TSAAAVTL | 0.56 |
| NS4B | 2477 | 0.1 | 3 | 2 | 0 | Y | TAAAVTLW | 98.87 | SAAAVTLW | 0.56 | | | | |
| NS4B | 2478 | 0.05 | 2 | 1 | 0 | Y | AAAVTLWE | 99.44 | | | | | | |
| NS4B | 2479 | 0.1 | 3 | 2 | 0 | Y | AAVTLWEN | 98.87 | AAVTLWEK | 0.56 | | | | |
| NS4B | 2480 | 0.1 | 3 | 2 | 0 | Y | AVTLWENG | 98.87 | SVTLWENG | 0.56 | | | | |
| NS4B | 2481 | 0.05 | 2 | 1 | 0 | Y | VTLWENGA | 99.44 | | | | | | |
| NS4B | 2482 | 0.14 | 3 | 2 | 0 | Y | TLWENGAS | 98.31 | TLWENGAG | 1.13 | | | | |
| NS4B | 2483 | 0.14 | 3 | 2 | 0 | Y | LWENGASS | 98.31 | LWENGAGS | 1.13 | | | | |
| NS4B | 2484 | 0.14 | 3 | 2 | 0 | Y | WENGASSV | 98.31 | WENGAGSV | 1.13 | | | | |
| NS4B | 2485 | 0.14 | 3 | 2 | 0 | Y | ENGASSVW | 98.31 | ENGAGSVW | 1.13 | | | | |
| NS4B | 2486 | 0.14 | 3 | 2 | 0.56 | Y | NGASSVWN | 97.74 | NGAGSVWN | 1.13 | | | | |
| NS4B | 2487 | 0.09 | 2 | 2 | 0.56 | Y | GASSVWNA | 98.31 | GAGSVWNA | 1.13 | | | | |
| NS4B | 2488 | 0.09 | 2 | 2 | 0.56 | Y | ASSVWNAT | 98.31 | AGSVWNAT | 1.13 | | | | |
| NS4B | 2489 | 0.09 | 2 | 2 | 0.56 | Y | SSVWNATT | 98.31 | GSVWNATT | 1.13 | | | | |
| NS4B | 2490 | 0 | 1 | 1 | 0.56 | Y | SVWNATTA | 99.44 | | | | | | |
| NS4B | 2491 | 0 | 1 | 1 | 0.56 | Y | VWNATTAI | 99.44 | | | | | | |
| NS4B | 2492 | 0 | 1 | 1 | 0.56 | Y | WNATTAIG | 99.44 | | | | | | |
| NS4B | 2493 | 0 | 1 | 1 | 0.56 | Y | NATTAIGL | 99.44 | | | | | | |
| NS4B | 2494 | 0 | 1 | 1 | 0 | Y | ATTAIGLC | 100 | | | | | | |
| NS4B | 2495 | 0 | 1 | 1 | 0 | Y | TTAIGLCH | 100 | | | | | | |
| NS4B | 2496 | 0.21 | 2 | 2 | 0 | Y | TAIGLCHI | 96.61 | TAIGLCHV | 3.39 | | | | |
| NS4B | 2497 | 0.21 | 2 | 2 | 0 | Y | AIGLCHIM | 96.61 | AIGLCHVM | 3.39 | | | | |
| NS4B | 2498 | 0.21 | 2 | 2 | 0 | Y | IGLCHIMR | 96.61 | IGLCHVMR | 3.39 | | | | |
| NS4B | 2499 | 0.26 | 3 | 2 | 0 | Y | GLCHIMRG | 96.05 | GLCHVMRG | 3.39 | | | | |
| NS4B | 2500 | 0.26 | 3 | 2 | 0 | Y | LCHIMRGG | 96.05 | LCHVMRGG | 3.39 | | | | |

FIG. 23-90

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2501 | 0.26 | 3 | 2 | 0 | Y | CHIMRGGW | 96.05 | CHVMRGGW | 3.39 | | | | |
| NS4B | 2502 | 0.26 | 3 | 2 | 0 | Y | HIMRGGWL | 96.05 | HVMRGGWL | 3.39 | | | | |
| NS4B | 2503 | 0.26 | 3 | 2 | 0 | Y | IMRGGWLS | 96.05 | VMRGGWLS | 3.39 | | | | |
| NS4B | 2504 | 0.05 | 2 | 1 | 0 | Y | MRGGWLSC | 99.44 | | | | | | |
| NS4B | 2505 | 0.1 | 3 | 2 | 0 | Y | RGGWLSCL | 98.87 | REGWLSCL | 0.56 | | | | |
| NS4B | 2506 | 0.1 | 3 | 2 | 0 | Y | GGWLSCLS | 98.87 | EGWLSCLS | 0.56 | | | | |
| NS4B | 2507 | 0.21 | 3 | 2 | 0 | Y | GWLSCLSI | 97.18 | GWLSCLSM | 2.26 | | | | |
| NS4B | 2508 | 0.45 | 5 | 4 | 0.56 | Y | WLSCLSIT | 93.22 | WLSCLSIM | 2.26 | WLSCLSMT | 2.26 | WLSCLSIA | 1.13 |
| NS4B | 2509 | 0.45 | 5 | 4 | 0.56 | Y | LSCLSITW | 93.22 | LSCLSIMW | 2.26 | LSCLSMTW | 2.26 | LSCLSIAW | 1.13 |
| NS4B | 2510 | 0.45 | 5 | 4 | 0.56 | Y | SCLSITWT | 93.22 | SCLSIMWT | 2.26 | SCLSMTWT | 2.26 | SCLSIAWT | 1.13 |
| NS4B | 2511 | 0.45 | 5 | 4 | 0.56 | Y | CLSITWTL | 93.22 | CLSIMWTL | 2.26 | CLSMTWTL | 2.26 | CLSIAWTL | 1.13 |
| NS4B | 2513 | 0.8 | 6 | 5 | 0 | Y | SITWTLVK | 86.44 | SITWTLIK | 6.78 | SMTWTLIK | 2.26 | SIMWTLIK | 2.26 |
| NS4B | 2520 | 0.74 | 6 | 5 | 0 | Y | KNMEKPGL | 86.44 | KNMDKPGL | 10.17 | KNMGKPGL | 1.69 | KNMEKPVL | 0.56 |
| NS4B | 2521 | 0.74 | 6 | 5 | 0 | Y | NMEKPGLK | 86.44 | NMDKPGLK | 10.17 | NMGKPGLK | 1.69 | SMEKPVLK | 0.56 |
| NS4B | 2522 | 0.74 | 6 | 5 | 0 | Y | MEKPGLKR | 86.44 | MDKPGLKR | 10.17 | MGKPGLKR | 1.69 | NLEKPGLK | 0.56 |
| NS4B | 2523 | 0.69 | 5 | 4 | 0 | Y | EKPGLKRG | 87.01 | DKPGLKRG | 10.17 | GKPGLKRG | 1.69 | MEKPVLKR | 0.56 |
| NS4B | 2524 | 0.1 | 3 | 2 | 0 | Y | KPGLKRGG | 98.87 | KPGIKRGG | 0.56 | | | | |
| NS4B | 2525 | 0.1 | 3 | 2 | 0 | Y | PGLKRGGA | 98.87 | PGIKRGGA | 0.56 | | | | |
| NS4B | 2526 | 0.1 | 3 | 2 | 0 | Y | GLKRGGAK | 98.87 | VLKRGGAK | 0.56 | | | | |
| NS4B | 2527 | 0.05 | 2 | 1 | 0 | Y | LKRGGAKG | 99.44 | | | | | | |
| NS4B | 2528 | 0 | 1 | 1 | 0 | Y | KRGGAKGR | 100 | | | | | | |
| NS4B | 2529 | 0 | 1 | 1 | 0 | Y | RGGAKGRT | 100 | | | | | | |
| NS5 | 2530 | 0 | 1 | 1 | 0 | Y | GGAKGRTL | 100 | | | | | | |
| NS5 | 2531 | 0 | 1 | 1 | 0 | Y | GAKGRTLG | 100 | | | | | | |
| NS5 | 2532 | 0 | 1 | 1 | 0 | Y | AKGRTLGE | 100 | | | | | | |

FIG. 23-91

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 23-92

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2563 | 0.31 | 5 | 4 | 0 | Y | EVDRSAAK | 96.05 | EVDRSAAR | 2.26 | EVDRSAAQ | 0.56 | EVDRSTAK | 0.56 |
| NS5 | 2572 | 0.68 | 5 | 4 | 0 | Y | ARKEGNVT | 87.57 | ARREGNIT | 9.6 | ARKERNIT | 1.69 | ARREGNVT | 0.56 |
| NS5 | 2573 | 0.68 | 5 | 4 | 0 | Y | RKEGNVTG | 87.57 | RREGNITG | 9.6 | RKERNITG | 1.69 | RREGNVTG | 0.56 |
| NS5 | 2574 | 0.68 | 5 | 4 | 0 | Y | KEGNVTGG | 87.57 | REGNITGG | 9.6 | KERNITGG | 1.69 | REGNVTGG | 0.56 |
| NS5 | 2575 | 0.64 | 4 | 3 | 0 | Y | EGNVTGGH | 87.57 | EGNITGGH | 10.17 | ERNITGGH | 1.69 | | |
| NS5 | 2576 | 0.73 | 5 | 4 | 0 | Y | GNVTGGHP | 86.44 | GNITGGHP | 10.17 | RNITGGHP | 1.13 | GNVTGGHS | 1.13 |
| NS5 | 2577 | 0.66 | 4 | 3 | 0 | Y | NVTGGHPV | 86.44 | NITGGHPV | 11.86 | RMITGGHP | 1.13 | | |
| NS5 | 2578 | 0.66 | 4 | 3 | 0 | Y | VTGGHPVS | 86.44 | ITGGHPVS | 11.86 | NVTGGHSV | 1.13 | | |
| NS5 | 2579 | 0.14 | 3 | 2 | 0 | Y | TGGHPVSR | 98.31 | TGGHPVSR | 1.13 | VTGGHSVS | 1.13 | | |
| NS5 | 2580 | 0.14 | 3 | 2 | 0 | Y | GGHPVSRG | 98.31 | GGHSVSRG | 1.13 | | | | |
| NS5 | 2581 | 0.19 | 4 | 3 | 0 | Y | GHPVSRGT | 97.74 | GHSVSRGT | 1.13 | GYPVSRGT | 0.56 | | |
| NS5 | 2582 | 0.19 | 4 | 3 | 0 | Y | HPVSRGTA | 97.74 | HSVSRGTA | 1.13 | YPVSRGTA | 0.56 | | |
| NS5 | 2583 | 0.14 | 3 | 2 | 0 | Y | PVSRGTAK | 98.31 | SVSRGTAK | 1.13 | | | | |
| NS5 | 2584 | 0.05 | 2 | 1 | 0 | Y | VSRGTAKL | 99.44 | | | | | | |
| NS5 | 2585 | 0.05 | 2 | 1 | 0 | Y | SRGTAKLR | 99.44 | | | | | | |
| NS5 | 2586 | 0.05 | 2 | 1 | 0 | Y | RGTAKLRW | 99.44 | | | | | | |
| NS5 | 2587 | 0.05 | 2 | 1 | 0 | Y | GTAKLRWL | 99.44 | | | | | | |
| NS5 | 2588 | 0.05 | 2 | 1 | 0 | Y | TAKLRWLV | 99.44 | | | | | | |
| NS5 | 2589 | 0 | 1 | 1 | 0 | Y | AKLRWLVE | 100 | | | | | | |
| NS5 | 2590 | 0 | 1 | 1 | 0 | Y | KLRWLVER | 100 | | | | | | |
| NS5 | 2591 | 0.05 | 2 | 1 | 0 | Y | LRWLVERR | 99.44 | | | | | | |
| NS5 | 2592 | 0.05 | 2 | 1 | 0 | Y | RWLVERRF | 99.44 | | | | | | |
| NS5 | 2593 | 0.05 | 2 | 1 | 0 | Y | WLVERRFL | 99.44 | | | | | | |
| NS5 | 2594 | 0.21 | 3 | 2 | 0 | Y | LVERRFLE | 97.18 | LVERRFLD | 2.26 | | | | |
| NS5 | 2595 | 0.21 | 3 | 2 | 0 | Y | VERRFLEP | 97.18 | VERRFLDP | 2.26 | | | | |

FIG. 23-93

Species: WNV (8-mers)

| protein | block starting position | block entropy | total peptides in block | # peptides required to cover 99% of block | gap/X fraction 99% of block | covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS5 | 2596 | 0.26 | 4 | 3 | 0 | Y | ERRFLEPV | 96.61 | ERRFLDPI

FIG. 23-94

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2621 | 0.05 | 2 | 1 | 0 | Y |

FIG. 23-95

| protein | block starting position | block entropy (8-mers) | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2646 | 0.12 | 2 | 2 | 0 | Y | QSYGWNIV | 98.31 | QSYGWNIV | 1.69 | | | | |
| NS5 | 2647 | 0.12 | 2 | 2 | 0 | Y | SYGWNIVT | 98.31 | SYGWNIVT | 1.69 | | | | |
| NS5 | 2648 | 0.12 | 2 | 2 | 0 | Y | YGWNIVTM | 98.31 | YGWNIVTM | 1.69 | | | | |
| NS5 | 2649 | 0.12 | 2 | 2 | 0 | Y | GWNIVTMK | 98.31 | GWNIVTMK | 1.69 | | | | |
| NS5 | 2650 | 0.12 | 2 | 2 | 0 | Y | WNIVTMKS | 98.31 | WNIVTMKS | 1.69 | | | | |
| NS5 | 2651 | 0.17 | 3 | 2 | 0 | Y | NIVTMKSG | 97.74 | NTVTMKSG | 1.69 | | | | |
| NS5 | 2652 | 0.17 | 3 | 2 | 0 | Y | IVTMKSGV | 97.74 | TVTMKSGV | 1.69 | | | | |
| NS5 | 2653 | 0.05 | 2 | 1 | 0 | Y | VTMKSGVD | 99.44 | | | | | | |
| NS5 | 2654 | 0.05 | 2 | 1 | 0 | Y | TMKSGVDV | 99.44 | | | | | | |
| NS5 | 2655 | 0.21 | 3 | 2 | 0 | Y | MKSGVDVF | 97.18 | MKSGVDVY | 2.26 | | | | |
| NS5 | 2656 | 0.21 | 3 | 2 | 0 | Y | KSGVDVFY | 97.18 | KSGVDYYY | 2.26 | | | | |
| NS5 | 2657 | 0.21 | 3 | 2 | 0 | Y | SGVDVFYR | 97.18 | SGVDVYYR | 2.26 | | | | |
| NS5 | 2658 | 0.21 | 3 | 2 | 0 | Y | GVDVFYRP | 97.18 | GVDVYYRA | 2.26 | | | | |
| NS5 | 2659 | 0.21 | 3 | 2 | 0 | Y | VDVFYRPS | 97.18 | VDVYYRAS | 2.26 | | | | |
| NS5 | 2660 | 0.21 | 3 | 2 | 0 | Y | DVFYRPSE | 97.18 | DVYYRASE | 2.26 | | | | |
| NS5 | 2661 | 0.68 | 6 | 5 | 0.56 | Y | VFYRPSEC | 88.7 | VYYRASEA | 2.26 | VFYRPSES | 0.56 | VFYRTSEA | 0.56 |
| NS5 | 2662 | 0.68 | 6 | 5 | 0.56 | Y | FYRPSECC | 88.7 | YYRASEAS | 2.26 | FYRPSEVS | 0.56 | FYRTSEAS | 0.56 |
| NS5 | 2663 | 0.68 | 6 | 5 | 0.56 | Y | YRPSECCD | 88.7 | YRASEASD | 2.26 | YRPSEVSD | 0.56 | YRTSEASD | 0.56 |
| NS5 | 2664 | 0.68 | 6 | 5 | 0.56 | Y | RPSECCDT | 88.14 | RASEASDT | 2.26 | RTSEASDT | 0.56 | RPSESCDT | 0.56 |
| NS5 | 2665 | 0.68 | 6 | 5 | 0.56 | Y | PSECCDTL | 88.14 | ASEASDTL | 2.26 | PSESCDTL | 0.56 | TSEASDTL | 0.56 |
| NS5 | 2666 | 0.58 | 4 | 3 | 0.56 | Y | SECCDTLL | 88.14 | SEASDTLL | 0.56 | | | | |
| NS5 | 2667 | 0.58 | 4 | 3 | 0.56 | Y | ECCDTLLC | 88.14 | EASDTLLC | 0.56 | | | | |
| NS5 | 2668 | 0.58 | 4 | 3 | 0.56 | Y | CCDTLLCD | 88.14 | ASDTLLCD | 0.56 | | | | |
| NS5 | 2669 | 0.49 | 2 | 2 | 0.56 | Y | CDTLLCDI | 88.7 | SDTLLCDI | 10.73 | | | | |
| NS5 | 2670 | 0 | 1 | 1 | 0.56 | Y | DTLLCDIG | 99.44 | | | | | | |

Species: WNV

FIG. 23-96

Species: WNV (8

FIG. 23-97

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2696 | 0.05 | 2 | — | 0 | Y | MVEDWLHR | 99.44 | | | | | | |
| NS5 | 2697 | 0 | 1 | — | 0 | Y | VEDWLHRG | 100 | | | | | | |
| NS5 | 2698 | 0 | 1 | — | 0 | Y | EDWLHRGP | 100 | | | | | | |
| NS5 | 2699 | 0.62 | 2 | 2 | 0 | Y | DWLHRGPR | 84.75 | DWLHRGPK | 15.25 | | | | |
| NS5 | 2700 | 0.62 | 2 | 2 | 0 | Y | WLHRGPRE | 84.75 | WLHRGPKE | 15.25 | | | | |
| NS5 | 2701 | 0.62 | 2 | 2 | 0 | Y | LHRGPREF | 84.75 | LHRGPKEF | 15.25 | | | | |
| NS5 | 2702 | 0.62 | 2 | 2 | 0 | Y | HRGPREFC | 84.75 | HRGPKEFC | 15.25 | | | | |
| NS5 | 2703 | 0.81 | 4 | 3 | 0 | Y | RGPREFCV | 84.18 | RGPKEFCI | 9.6 | RGPKEFCV | 5.65 | | |
| NS5 | 2704 | 0.81 | 4 | 3 | 0 | Y | GPREFCVK | 84.18 | GPKEFCIK | 9.6 | GPKEFCVK | 5.65 | | |
| NS5 | 2705 | 0.81 | 4 | 3 | 0 | Y | PREFCVKV | 84.18 | PKEFCIKV | 9.6 | PKEFCVKV | 5.65 | | |
| NS5 | 2706 | 0.81 | 4 | 3 | 0 | Y | REFCVKVL | 84.18 | KEFCIKVL | 9.6 | KEFCVKVL | 5.65 | | |
| NS5 | 2707 | 0.47 | 2 | 2 | 0 | Y | EFCVKVLC | 89.83 | EFCIKVLC | 10.17 | | | | |
| NS5 | 2708 | 0.47 | 2 | 2 | 0 | Y | FCVKVLCP | 89.83 | FCIKVLCP | 10.17 | | | | |
| NS5 | 2709 | 0.47 | 2 | 2 | 0 | Y | CVKVLCPY | 89.83 | CIKVLCPY | 10.17 | | | | |
| NS5 | 2710 | 0.47 | 2 | 2 | 0 | Y | VKVLCPYM | 89.83 | IKVLCPYM | 10.17 | | | | |
| NS5 | 2711 | 0 | 1 | — | 0 | Y | KVLCPYMP | 100 | | | | | | |
| NS5 | 2712 | 0.05 | 2 | — | 0 | Y | VLCPYMPK | 99.44 | CPYMPRVI | 0.56 | | | | |
| NS5 | 2713 | 0.05 | 2 | — | 0 | Y | LCPYMPKV | 99.44 | PYMPRVIE | 0.56 | | | | |
| NS5 | 2714 | 0.1 | 3 | 2 | 0 | Y | CPYMPKVI | 98.87 | YMPRVIEK | 0.56 | | | | |
| NS5 | 2715 | 0.1 | 3 | 2 | 0 | Y | PYMPKVIE | 98.87 | MPRVIEKM | 0.56 | | | | |
| NS5 | 2716 | 0.1 | 3 | 2 | 0 | Y | YMPKVIEK | 98.87 | PKVIEKME | 0.56 | | | | |
| NS5 | 2717 | 0.1 | 3 | 2 | 0 | Y | MPKVIEKM | 98.87 | | | | | | |
| NS5 | 2718 | 0.1 | 3 | 2 | 0 | Y | PKVIEKME | 98.87 | | | | | | |
| NS5 | 2719 | 0.71 | 6 | 5 | 0 | Y | KVIEKMEL | 88.7 | KVIEKMET | 6.21 | KVIEKMEV | 2.82 | KVIEKMEI | 1.13 | RVIEKMET | 0.56 |
| NS5 | 2720 | 0.68 | 5 | 4 | 0 | Y | VIEKMELL | 88.7 | VIEKMETL | 6.78 | VIEKMEVL | 2.82 | VIEKMEIL | 1.13 | |

FIG. 23-98

| protein | block starting position | block entropy | total peptides in block | # peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2721 | 0.68 | 5 | 4 | 0 | Y | IEKMEILQ | 88.7 | | | IEKMEVLQ | 2.82 | IEKMEILQ | 1.13 |
| NS5 | 2722 | 0.7 | 5 | 4 | 0 | Y | EKMEILQR | 88.14 | | | EKMEVLQR | 3.39 | EKMEILQR | 1.13 |
| NS5 | 2723 | 0.7 | 5 | 4 | 0 | Y | KMEILQRR | 88.14 | | | KMEVLQRR | 3.39 | KMEILQRR | 1.13 |
| NS5 | 2724 | 0.7 | 5 | 4 | 0 | Y | MEILQRRY | 88.14 | | | MEVLQRRY | 3.39 | MEILQRRY | 1.13 |
| NS5 | 2725 | 0.7 | 5 | 4 | 0 | Y | ETLQRRYG | 88.14 | | | EVLQRRYG | 3.39 | EILQRRYG | 1.13 |
| NS5 | 2726 | 0.7 | 5 | 4 | 0 | Y | TLQRRYGG | 88.14 | | | VLQRRYGG | 3.39 | LQRRYGG | 1.13 |
| NS5 | 2727 | 0.05 | 2 | 1 | 0 | Y | LQRRYGGG | 99.44 | | | | | | |
| NS5 | 2728 | 0.05 | 2 | 1 | 0 | Y | QRRYGGGL | 99.44 | | | | | | |
| NS5 | 2729 | 0.17 | 3 | 2 | 0 | Y | RRYGGGLV | 97.74 | RRYGGGLI | 1.69 | | | | |
| NS5 | 2730 | 0.12 | 2 | 2 | 0 | Y | RYGGGLVR | 98.31 | RYGGGLIR | 1.69 | | | | |
| NS5 | 2731 | 0.12 | 2 | 2 | 0 | Y | YGGGLVRN | 98.31 | YGGGLIRN | 1.69 | | | | |
| NS5 | 2732 | 0.12 | 2 | 2 | 0 | Y | GGGLVRNP | 98.31 | GGGLIRNP | 1.69 | | | | |
| NS5 | 2733 | 0.12 | 2 | 2 | 0 | Y | GGLVRNPL | 98.31 | GGLIRNPL | 1.69 | | | | |
| NS5 | 2734 | 0.12 | 2 | 2 | 0 | Y | GLVRNPLS | 98.31 | GLIRNPLS | 1.69 | | | | |
| NS5 | 2735 | 0.12 | 2 | 2 | 0 | Y | LVRNPLSR | 98.31 | LIRNPLSR | 1.69 | | | | |
| NS5 | 2736 | 0.12 | 2 | 2 | 0 | Y | VRNPLSRN | 98.31 | IRNPLSRN | 1.69 | | | | |
| NS5 | 2737 | 0 | 1 | 1 | 0 | Y | RNPLSRNS | 100 | | | | | | |
| NS5 | 2738 | 0 | 1 | 1 | 0 | Y | NPLSRNST | 100 | | | | | | |
| NS5 | 2739 | 0 | 1 | 1 | 0 | Y | PLSRNSTH | 100 | | | | | | |
| NS5 | 2740 | 0 | 1 | 1 | 0 | Y | LSRNSTHE | 100 | | | | | | |
| NS5 | 2741 | 0 | 1 | 1 | 0 | Y | SRNSTHEM | 100 | | | | | | |
| NS5 | 2742 | 0 | 1 | 1 | 0 | Y | RNSTHEMY | 100 | | | | | | |
| NS5 | 2743 | 0 | 1 | 1 | 0 | Y | NSTHEMYW | 100 | | | | | | |
| NS5 | 2744 | 0 | 1 | 1 | 0 | Y | STHEMYWV | 100 | | | | | | |
| NS5 | 2745 | 0 | 1 | 1 | 0 | Y | THEMYWVS | 100 | | | | | | |

Species: WNV (8-mers)

FIG. 23-99

Species: WNV (8-mers)

| protein | block starting position | block entropy | total peptides in block | # peptides required to cover 99% of block | gap/X fraction 99% of block | covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| NS5 | 2746 | 0.47 | 3 | 2 | 0 | Y | HEMYWVSR | 90.96 | HEMYWVSH | 8.47 | | | | |
| NS5 | 2747 | 0.47 | 3 | 2 | 0 | Y | EMYWVSRA | 90.96 | EMYWVSHA | 8.47 | | | | |
| NS5 | 2748 | 0.47 | 3 | 2 | 0 | Y | MYWVSRAS | 90.96 | MYWVSHAS | 8.47 | | | | |
| NS5 | 2749 | 0.57 | 5 | 4 | 0 | Y | YWVSRASG | 89.83 | YWVSHASG | 8.47 | YWVSRASS | 0.56 | YWVSRASR | 0.56 | |
| NS5 | 2750 | 0.57 | 5 | 4 | 0 | Y | WVSRASGN | 89.83 | WVSHASGN | 8.47 | WVSRASRN | 0.56 | WVSQASGN | 0.56 | |
| NS5 | 2751 | 0.72 | 6 | 5 | 0 | Y | VSRASGNV | 87.57 | VSHASGNI | 8.47 | VSRASGNI | 2.26 | VSQASGNI | 0.56 | |
| NS5 | 2752 | 0.72 | 6 | 5 | 0 | Y | SRASGNVV | 87.57 | SHASGNIV | 8.47 | SRASGNIV | 2.26 | SRASSNVV | 0.56 | VSRASRNV | 0.56 |
| NS5 | 2753 | 0.72 | 6 | 5 | 0 | Y | RASGNVVH | 87.57 | HASGNIVH | 8.47 | RASGNIVH | 2.26 | QASGNIVH | 0.56 | SRASRNVV | 0.56 |
| NS5 | 2754 | 0.74 | 6 | 4 | 0 | Y | ASGNVVHS | 87.57 | ASGNIVHS | 7.91 | ASGNIVNS | 2.26 | ASGNIVHA | 1.13 | RASSNVVH | 0.56 |
| NS5 | 2757 | 0.67 | 5 | 4 | 0 | Y | NVVHSVNM | 88.7 | NIVHSVNM | 7.34 | NIVNSVSM | 2.26 | NIVHAVNM | 1.13 | ASSNVVHS | 0.56 |
| NS5 | 2758 | 0.67 | 5 | 4 | 0 | Y | VVHSVNMT | 88.7 | IVHSVNMT | 7.34 | IVNSVSMT | 2.26 | IVHAVNMT | 1.13 | |
| NS5 | 2759 | 0.29 | 4 | 3 | 0 | Y | VHSVNMTS | 96.05 | VNSVMTS | 2.26 | VHAVNMTS | 2.26 | | | |
| NS5 | 2760 | 0.29 | 4 | 3 | 0 | Y | HSVNMTSQ | 96.05 | NSVMTSQ | 2.26 | HAVNMTSQ | 2.26 | | | |
| NS5 | 2761 | 0.29 | 4 | 3 | 0 | Y | SVNMTSQV | 96.05 | SVSMTSQV | 2.26 | AVNMTSQV | 2.26 | | | |
| NS5 | 2762 | 0.21 | 3 | 2 | 0 | Y | VNMTSQVL | 97.18 | VSMTSQVL | 2.26 | | | | |
| NS5 | 2763 | 0.16 | 2 | 2 | 0 | Y | NMTSQVLL | 97.74 | SMTSQVLL | 2.26 | | | | |
| NS5 | 2764 | 0 | 1 | 1 | 0 | Y | MTSQVLLG | 100 | | | | | | |
| NS5 | 2765 | 0 | 1 | 1 | 0 | Y | TSQVLLGR | 100 | | | | | | |
| NS5 | 2766 | 0 | 1 | 1 | 0 | Y | SQVLLGRM | 100 | | | | | | |
| NS5 | 2767 | 0 | 1 | 1 | 0 | Y | QVLLGRME | 100 | | | | | | |
| NS5 | 2768 | 0 | 1 | 1 | 0 | Y | VLLGRMEK | 100 | | | | | | |
| NS5 | 2769 | 0.54 | 2 | 2 | 0 | Y | LLGRMEKR | 87.57 | LLGRMEKK | 12.43 | | | | |
| NS5 | 2770 | 0.54 | 2 | 2 | 0 | Y | LGRMEKRT | 87.57 | LGRMEKKT | 12.43 | | | | |
| NS5 | 2771 | 0.54 | 2 | 2 | 0 | Y | GRMEKRTW | 87.57 | GRMEKKTW | 12.43 | | | | |
| NS5 | 2772 | 0.54 | 2 | 2 | 0 | Y | RMEKRTWK | 87.57 | RMEKKTWK | 12.43 | | | | |

FIG. 23-100

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2773 | 0.54 | 2 | 2 | 0 | Y | MEKRTWKG | 87.57 | MEKRTWKG | 12.43 | | | | |
| NS5 | 2774 | 0.63 | 3 | 3 | 0 | Y | EKRTWKGP | 87.57 | EKKTWKGP | 10.17 | EKKTWKGA | 2.26 | | |
| NS5 | 2775 | 0.66 | 4 | 3 | 0 | Y | KRTWKGPQ | 87.57 | KKTWKGPQ | 9.6 | KKTWKGAH | 2.26 | | |
| NS5 | 2776 | 0.79 | 6 | 5 | 0 | Y | RTWKGPQY | 87.01 | KTWKGPQF | 6.78 | KTWKGPQY | 2.82 | KTWKGAHY | 2.26 | KTWKGPHY | 0.56 |
| NS5 | 2777 | 0.58 | 4 | 3 | 0 | Y | TWKGPQYE | 89.83 | TWKGPQFE | 7.34 | TWKGAHYE | 2.26 | | |
| NS5 | 2778 | 0.58 | 4 | 3 | 0 | Y | WKGPQYEE | 89.83 | WKGPQFEE | 7.34 | WKGAHYEE | 2.26 | | |
| NS5 | 2779 | 0.58 | 4 | 3 | 0 | Y | KGPQYEED | 89.83 | KGPQFEED | 7.34 | KGAHYEED | 2.26 | | |
| NS5 | 2780 | 0.76 | 5 | 4 | 0 | Y | GPQYEEDV | 87.01 | GPQFEEDV | 7.34 | GPQYEEDA | 2.82 | GAHYEEDV | 2.26 | PQYEEDVS | 0.56 |
| NS5 | 2781 | 0.81 | 6 | 5 | 0 | Y | PQYEEDVN | 86.44 | PQFEEDVN | 7.34 | PQYEEDAN | 2.82 | AHYEEDVN | 2.26 | | |
| NS5 | 2782 | 0.79 | 5 | 4 | 0 | Y | QYEEDVNL | 86.44 | QFEEDVNL | 7.34 | HYEEDVNL | 2.82 | QYEEDANL | 2.82 | | |
| NS5 | 2783 | 0.61 | 4 | 3 | 0 | Y | YEEDVNLG | 89.27 | FEEDVNLG | 7.34 | YEEDANLG | 2.82 | | |
| NS5 | 2784 | 0.24 | 3 | 2 | 0 | Y | EEDVNLGS | 96.61 | EEDANLGS | 2.82 | | | | |
| NS5 | 2785 | 0.24 | 3 | 2 | 0 | Y | EDVNLGSG | 96.61 | EDANLGSG | 2.82 | | | | |
| NS5 | 2786 | 0.24 | 3 | 2 | 0 | Y | DVNLGSGT | 96.61 | DANLGSGT | 2.82 | | | | |
| NS5 | 2787 | 0.24 | 3 | 2 | 0 | Y | VNLGSGTR | 96.61 | ANLGSGTR | 2.82 | | | | |
| NS5 | 2788 | 0.05 | 2 | 1 | 0 | Y | NLGSGTRA | 99.44 | | | | | | |
| NS5 | 2789 | 0 | 1 | 1 | 0 | Y | LGSGTRAV | 100 | | | | | | |
| NS5 | 2790 | 0 | 1 | 1 | 0 | Y | GSGTRAVG | 100 | | | | | | |
| NS5 | 2791 | 0.05 | 2 | 1 | 0 | Y | SGTRAVGK | 99.44 | | | | | | |
| NS5 | 2792 | 0.05 | 2 | 1 | 0 | Y | GTRAVGKP | 99.44 | | | | | | |
| NS5 | 2793 | 0.05 | 2 | 1 | 0 | Y | TRAVGKPL | 99.44 | | | | | | |
| NS5 | 2794 | 0.05 | 2 | 1 | 0 | Y | RAVGKPLL | 99.44 | | | | | | |
| NS5 | 2795 | 0.1 | 3 | 2 | 0 | Y | AVGKPLLN | 98.87 | AVGRPLLN | 0.56 | | | | |
| NS5 | 2796 | 0.1 | 3 | 2 | 0 | Y | VGKPLLNS | 98.87 | VGKPLLSS | 0.56 | | | | |
| NS5 | 2797 | 0.1 | 3 | 2 | 0 | Y | GKPLLNSD | 98.87 | GKPLLSSD | 0.56 | | | | |

FIG. 23-101

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 23-102

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block |

FIG. 23-103

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2863 | 0.15 | 4 | 3 | 0 | Y | WDTITNVT | 98.31 | WDVITNVT | 0.56 | WDTIMNVT | 0.56 |
| NS5 | 2864 | 0.15 | 4 | 3 | 0 | Y | DTITNVTT | 98.31 | DTIMNVTT | 0.56 | DTITSVTT | 0.56 |
| NS5 | 2865 | 0.15 | 4 | 3 | 0 | Y | TITNVTTM | 98.31 | TIMNVTTM | 0.56 | TITSVTTM | 0.56 |
| NS5 | 2866 | 0.1 | 3 | 2 | 0 | Y | ITNVTTMA | 98.87 | ITSVTTMA | 0.56 | | |
| NS5 | 2867 | 0.1 | 3 | 2 | 0 | Y | TNVTTMAM | 98.87 | MNVTTMAM | 0.56 | | |
| NS5 | 2868 | 0.05 | 2 | 1 | 0 | Y | NVTTMAMT | 99.44 | | | | |
| NS5 | 2869 | 0 | 1 | 1 | 0 | Y | VTTMAMTD | 100 | | | | |
| NS5 | 2870 | 0 | 1 | 1 | 0 | Y | TTMAMTDT | 100 | | | | |
| NS5 | 2871 | 0 | 1 | 1 | 0 | Y | TMAMTDTT | 100 | | | | |
| NS5 | 2872 | 0 | 1 | 1 | 0 | Y | MAMTDTTP | 100 | | | | |
| NS5 | 2873 | 0 | 1 | 1 | 0 | Y | AMTDTTPF | 100 | | | | |
| NS5 | 2874 | 0 | 1 | 1 | 0 | Y | MTDTTPFG | 100 | | | | |
| NS5 | 2875 | 0 | 1 | 1 | 0 | Y | TDTTPFGQ | 100 | | | | |
| NS5 | 2876 | 0 | 1 | 1 | 0 | Y | DTTPFGQQ | 100 | | | | |
| NS5 | 2877 | 0 | 1 | 1 | 0 | Y | TTPFGQQR | 100 | | | | |
| NS5 | 2878 | 0 | 1 | 1 | 0 | Y | TPFGQQRV | 100 | | | | |
| NS5 | 2879 | 0 | 1 | 1 | 0 | Y | PFGQQRVF | 100 | | | | |
| NS5 | 2880 | 0 | 1 | 1 | 0 | Y | FGQQRVFK | 100 | | | | |
| NS5 | 2881 | 0 | 1 | 1 | 0 | Y | GQQRVFKE | 100 | | | | |
| NS5 | 2882 | 0 | 1 | 1 | 0 | Y | QQRVFKEK | 100 | | | | |
| NS5 | 2883 | 0 | 1 | 1 | 0 | Y | QRVFKEKV | 100 | | | | |
| NS5 | 2884 | 0 | 1 | 1 | 0 | Y | RVFKEKVD | 100 | | | | |
| NS5 | 2885 | 0 | 1 | 1 | 0 | Y | VFKEKVDT | 100 | | | | |
| NS5 | 2886 | 0 | 1 | 1 | 0 | Y | FKEKVDTK | 100 | | | | |
| NS5 | 2887 | 0 | 1 | 1 | 0 | Y | KEKVDTKA | 100 | | | | |

FIG. 23-104

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2888 | 0 | 1 | 1 | 0 | Y | EKVDTKAP | 100 | | | | | | |
| NS5 | 2889 | 0 | 1 | 1 | 0 | Y | KVDTKAPE | 100 | | | | | | |
| NS5 | 2890 | 0 | 1 | 1 | 0 | Y | VDTKAPEP | 100 | | | | | | |
| NS5 | 2891 | 0.16 | 2 | 2 | 0 | Y | DTKAPEPP | 97.74 | DTKAPEPA | 2.26 | | | | |
| NS5 | 2892 | 0.21 | 3 | 2 | 0 | Y | TKAPEPPE | 97.18 | TKAPEPAE | 2.26 | | | | |
| NS5 | 2893 | 0.21 | 3 | 2 | 0 | Y | KAPEPPEG | 97.18 | KAPEPAEG | 2.26 | | | | |
| NS5 | 2894 | 0.26 | 4 | 3 | 0 | Y | APEPPEGV | 96.61 | APEPAEGV | 2.26 | APEPPAGV | 0.56 | | |
| NS5 | 2895 | 0.31 | 5 | 2 | 0 | Y | PEPPEGVK | 96.05 | PEPAEGVK | 2.26 | PEPPEGAK | 0.56 | PEPPEGVR | 0.56 |
| NS5 | 2904 | 0.1 | 3 | 2 | 0 | Y | VLNETTNW | 98.87 | ALNETTNW | 0.56 | | | | |
| NS5 | 2905 | 0.05 | 2 | 1 | 0 | Y | LNETTNWL | 99.44 | | | | | | |
| NS5 | 2906 | 0.05 | 2 | 1 | 0 | Y | NETTNWLW | 99.44 | | | | | | |
| NS5 | 2907 | 0.21 | 3 | 2 | 0 | Y | ETTNWLWA | 97.18 | ETTNWLWT | 2.26 | | | | |
| NS5 | 2908 | 0.26 | 4 | 3 | 0 | Y | TTNWLWAF | 96.61 | TTNWLWTF | 2.26 | TTNWLWAY | 0.56 | | |
| NS5 | 2909 | 0.26 | 4 | 3 | 0 | Y | TNWLWAFL | 96.61 | TNWLWTFL | 2.26 | TNWLWSHL | 0.56 | NWLWSHLE | 0.56 |
| NS5 | 2910 | 0.31 | 5 | 4 | 0 | Y | NWLWAFLA | 96.05 | NWLWTFLA | 2.26 | NWLWAFLS | 0.56 | WLWAYLAR | 0.56 |
| NS5 | 2911 | 0.31 | 5 | 4 | 0 | Y | WLWAFLAR | 96.05 | WLWTFLAR | 2.26 | WLWAFLSR | 0.56 | | |
| NS5 | 2918 | 0.75 | 6 | 5 | 0 | Y | REKRPRMC | 87.57 | RDKKPRMC | 7.34 | RNKRPRMC | 2.26 | RGKRPRMC | 1.69 |
| NS5 | 2919 | 0.75 | 6 | 5 | 0 | Y | EKRPRMCS | 87.57 | DKKPRMCS | 7.34 | NKRPRMCT | 2.26 | GKRPRMCS | 1.69 |
| NS5 | 2920 | 0.6 | 4 | 3 | 0 | Y | KRPRMCSR | 89.27 | KRPMCSR | 7.91 | KRPRMCTR | 2.26 | | |
| NS5 | 2921 | 0.6 | 4 | 3 | 0 | Y | RPRMCSRE | 89.27 | RPMCSRE | 7.91 | RPRMCTRE | 2.26 | | |
| NS5 | 2922 | 0.21 | 3 | 2 | 0 | Y | PRMCSREE | 97.18 | PRMCTREE | 2.26 | | | | |
| NS5 | 2923 | 0.21 | 3 | 2 | 0 | Y | RMCSREEF | 97.18 | RMCTREEF | 2.26 | | | | |
| NS5 | 2924 | 0.21 | 3 | 2 | 0 | Y | MCSREEFI | 97.18 | MCTREEFI | 2.26 | | | | |
| NS5 | 2925 | 0.79 | 6 | 5 | 0 | Y | CSREEFIR | 87.01 | CSREEFIG | 6.78 | CSREEFIK | 2.82 | CTREEFIS | 2.26 | CSREEFIS | 0.56 |
| NS5 | 2926 | 0.79 | 6 | 5 | 0 | Y | SREEFIRK | 87.01 | SREEFIGK | 6.78 | SREEFIKK | 2.82 | TREEFISK | 2.26 | SREEFISK | 0.56 |

FIG. 23-105

Species: WNV (8-mers)

| protein | block starting position | block entropy | total pe

FIG. 23-106

| Species: WNV (8-mers) protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2952 | 0.56 | 3 | 3 | 0 | Y | SAREAVED | 88.7 | NAREAVED | 10.17 | SARAAVED | 1.13 | | |
| NS5 | 2953 | 0.28 | 5 | 4 | 0 | Y | AREAVEDP | 96.61 | A

FIG. 23-107

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2977 | 0.57 | 3 | 3 | 0 | Y | ECHTC

FIG. 23-109

Species: WNV (8

FIG. 23-110

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3062 | 0.05 | 2 | — | 0 | Y | YADDTAGW | 99.44 | | | | | | |
| NS5 | 3063 | 0 | 1 | — | 0 | Y | ADDTAGWD | 100 | | | | | | |
| NS5 | 3064 | 0 | 1 | — | 0 | Y | DDTAGWDT | 100 | | | | | | |
| NS5 | 3065 | 0.05 | 2 | — | 0 | Y | DTAGWDTR | 99.44 | | | | | | |
| NS5 | 3066 | 0.05 | 2 | — | 0 | Y | TAGWDTRI | 99.44 | | | | | | |
| NS5 | 3067 | 0.05 | 2 | — | 0 | Y | AGWDTRIT | 99.44 | | | | | | |
| NS5 | 3068 | 0.57 | 4 | 3 | 0 | Y | GWDTRITR | 88.7 | GWDTRITK | 10.17 | GWDTRITM | 0.56 | | |
| NS5 | 3069 | 0.57 | 4 | 3 | 0 | Y | WDTRITRA | 88.7 | WDTRITKA | 10.17 | WDTRITMT | 0.56 | | |
| NS5 | 3070 | 0.57 | 4 | 3 | 0 | Y | DTRITRAD | 88.7 | DTRITKAD | 10.17 | DTRITMTD | 0.56 | | |
| NS5 | 3071 | 0.57 | 4 | 3 | 0 | Y | TRITRADL | 88.7 | TRITKADL | 10.17 | TRITMTDL | 0.56 | | |
| NS5 | 3072 | 0.57 | 4 | 3 | 0 | Y | RITRADLE | 88.7 | RITKADLE | 10.17 | PITKADLE | 0.56 | | |
| NS5 | 3073 | 0.54 | 3 | 2 | 0 | Y | ITRADLEN | 88.7 | ITKADLEN | 10.73 | | | | |
| NS5 | 3074 | 0.54 | 3 | 2 | 0 | Y | TRADLENE | 88.7 | TKADLENE | 10.73 | | | | |
| NS5 | 3075 | 0.54 | 3 | 2 | 0 | Y | RADLENEA | 88.7 | KADLENEA | 10.73 | | | | |
| NS5 | 3076 | 0.05 | 2 | — | 0 | Y | ADLENEAK | 99.44 | | | | | | |
| NS5 | 3077 | 0 | 1 | — | 0 | Y | DLENEAKV | 100 | | | | | | |
| NS5 | 3078 | 0 | 1 | — | 0 | Y | LENEAKVL | 100 | | | | | | |
| NS5 | 3079 | 0 | 1 | — | 0 | Y | ENEAKVLE | 100 | | | | | | |
| NS5 | 3080 | 0.16 | 2 | 2 | 0 | Y | NEAKVLEL | 97.74 | NEAKVLEF | 2.26 | | | | |
| NS5 | 3081 | 0.16 | 2 | 2 | 0 | Y | EAKVLELL | 97.74 | EAKVLEFL | 2.26 | | | | |
| NS5 | 3082 | 0.21 | 3 | 2 | 0 | Y | AKVLELLD | 97.18 | AKVLEFLD | 2.26 | | | | |
| NS5 | 3083 | 0.26 | 4 | 3 | 0 | Y | KVLELLDG | 96.61 | KVLEFLDG | 2.26 | KVLELLDR | 0.56 | | |
| NS5 | 3084 | 0.26 | 4 | 3 | 0 | Y | VLELLDGE | 96.61 | VLEFLDGE | 2.26 | VLELLEGE | 0.56 | | |
| NS5 | 3085 | 0.26 | 4 | 3 | 0 | Y | LELLDGEH | 96.61 | LEFLDGEH | 2.26 | LELLEGEH | 0.56 | | |
| NS5 | 3086 | 0.26 | 4 | 3 | 0 | Y | ELLDGEHR | 96.61 | EFLDGEHR | 2.26 | ELLEGEHR | 0.56 | | |

FIG. 23-111

| Species: WNV (8-mers) | | | | | | | | | | | | | | | | | | |
|---|---|---|---|---|---|---|---|---|---|---|---|---|---|---|---|---|---|---|
| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block

FIG. 23-112

Species: WNV (8-mers)

| protein | block starting position | block entropy | total peptides in block | #

FIG. 23-113

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3137 | 0.09 | 2 | 2 | 0 | Y | VTTALNTF | 98.87 | VTTALNPF | 1.13 | | | | |
| NS5 | 3138 | 0.1 | 3 | 2 | 0 | Y | TYALNTFT | 98.87 | TYALNPFT | 0.56 | | | | |
| NS5 | 3139 | 0.1 | 3 | 2 | 0 | Y | YALNTFTN | 98.87 | YALNPFSN | 0.56 | | | | |
| NS5 | 3140 | 0.1 | 3 | 2 | 0 | Y | ALNTFTNL | 98.87 | ALNPFSNL | 0.56 | | | | |
| NS5 | 3141 | 0.19 | 4 | 3 | 0 | Y | LNTFTNLA | 97.74 | LNTFTNLS | 1.13 | LNPFSNLA | | | |
| NS5 | 3142 | 0.19 | 4 | 3 | 0 | Y | NTFTNLAV | 97.74 | NTFTNLSV | 1.13 | NPFTNLAF | | | |
| NS5 | 3143 | 0.19 | 4 | 3 | 0 | Y | TFTNLAVQ | 97.74 | TFTNLSVQ | 1.13 | PFTNLAFQ | | | |
| NS5 | 3144 | 0.19 | 4 | 3 | 0 | Y | FTNLAVQL | 97.74 | FTNLSVQL | 1.13 | FSNLAVQL | | | |
| NS5 | 3145 | 0.19 | 4 | 3 | 0 | Y | TNLAVQLV | 97.74 | TNLSVQLV | 1.13 | SNLAVQLV | 0.56 | | |
| NS5 | 3146 | 0.14 | 3 | 2 | 0 | Y | NLAVQLVR | 98.31 | NLSVQLVR | 1.13 | | | | |
| NS5 | 3147 | 0.19 | 4 | 3 | 0 | Y | LAVQLVRM | 97.74 | LSVQLVRM | 1.13 | LAFQLGRR | 0.56 | | |
| NS5 | 3148 | 0.19 | 4 | 3 | 0 | Y | AVQLVRMM | 97.74 | SVQLVRMM | 1.13 | AVQLVRRR | 0.56 | | |
| NS5 | 3149 | 0.1 | 3 | 2 | 0 | Y | VQLVRMME | 98.87 | FQLGRRRE | 0.56 | | | | |
| NS5 | 3150 | 0.1 | 3 | 2 | 0 | Y | QLVRMMEG | 98.87 | QLVRRREG | 0.56 | | | | |
| NS5 | 3151 | 0.1 | 3 | 2 | 0 | Y | LVRMMEGE | 98.87 | LVRRREGE | 0.56 | | | | |
| NS5 | 3152 | 0.1 | 3 | 2 | 0 | Y | VRMMEGEG | 98.87 | VRRREGEG | 0.56 | | | | |
| NS5 | 3153 | 0.09 | 2 | 2 | 0 | Y | RMMEGEGV | 98.87 | RREGEGVI | 1.13 | | | | |
| NS5 | 3154 | 0.53 | 3 | 3 | 0 | Y | MMEGEGVV | 89.83 | MMEGEGVV | 9.04 | REGEGVIG | 1.13 | | |
| NS5 | 3155 | 0.57 | 4 | 3 | 0 | Y | MEGEGVIG | 89.27 | MEGEGWG | 9.04 | GEGVITPD | 0.56 | GEGVIGPE | 0.56 |
| NS5 | 3156 | 0.49 | 3 | 4 | 0 | Y | EGEGVIGP | 90.4 | EGEGWGP | 9.04 | EGVIGPYD | 0.56 | EGVIGPED | 0.56 |
| NS5 | 3157 | 0.59 | 5 | 4 | 0 | Y | GEGVIGPD | 89.27 | GEGWGPD | 9.04 | EGVIGPYD | 0.56 | GVIGPEDV | 0.56 |
| NS5 | 3158 | 0.59 | 5 | 4 | 0 | Y | EGVIGPDD | 89.27 | EGWGPDD | 9.04 | GVITPDDV | 0.56 | VITPDDVE | 0.56 |
| NS5 | 3159 | 0.64 | 6 | 5 | 0 | Y | GVIGPDDV | 88.7 | GWGPDDV | 9.04 | GVITPDDV | 0.56 | GVIGPEDV | 0.56 | GVIGPDDI | 0.56 |
| NS5 | 3160 | 0.64 | 6 | 5 | 0 | Y | VIGPDDVE | 88.7 | VIGPDDVE | 9.04 | VIGPEDVE | 0.56 | VIGPDYVE | 0.56 | VIGPYDVE | 0.56 |
| NS5 | 3162 | 0.25 | 6 | 5 | 0 | Y | GPDDVEKL | 97.18 | TPDDVEKL | 0.56 | GPYDVEKL | 0.56 | GPEDVEKL | 0.56 | GPDDVERL | 0.56 |

FIG. 23-114

Species: WNV (8-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3163 | 0.65 | 6 | 5 | 0 | Y | PDDVEKLT | 88.14 | PDDVEKLG | 9.6 | PDDVEKLE | 0.56 | PDDVERLG | 0.56 | PEDVEKLT | 0.56 |
| NS5 | 3171 | 0.34 | 5 | 4 | 0 | Y | KGKGPKVR | 95.48 | KGKGWKVR | 2.26 | KRKGPKVR | 1.13 | RGKGPKVR | 0.56 | | |
| NS5 | 3172 | 0.29 | 4 | 3 | 0 | Y | GKGPKVRT | 96.05 | GKGWKVRV | 2.26 | RKGPKVRT | 1.13 | | | | |
| NS5 | 3173 | 0.21 | 3 | 2 | 0 | Y | KGPKVRTW | 97.18 | KGVKVRTW | 2.26 | | | | | | |
| NS5 | 3174 | 0.16 | 2 | 2 | 0 | Y | GPKVRTWL | 97.74 | GVKVRVWL | 2.26 | | | | | | |
| NS5 | 3175 | 0.28 | 3 | 3 | 0 | Y | PKVRTWLF | 96.05 | VKVRVWLF | 2.26 | PKVRTWLS | 1.69 | | | | |
| NS5 | 3176 | 0.28 | 3 | 3 | 0 | Y | KVRTWLFE | 96.05 | KVRVWLFE | 2.26 | KVRTWLSE | 1.69 | | | | |
| NS5 | 3177 | 0.28 | 3 | 3 | 0 | Y | VRTWLFEN | 96.05 | VRVWLFEN | 2.26 | VRTWLSEN | 1.69 | | | | |
| NS5 | 3178 | 0.28 | 3 | 3 | 0 | Y | RTWLFENG | 96.05 | RVWLFENG | 2.26 | RTWLSENG | 1.69 | | | | |
| NS5 | 3179 | 0.33 | 4 | 3 | 0 | Y | TWLFENGE | 95.48 | VWLFENGE | 2.26 | TWLSENGE | 1.69 | | | | |
| NS5 | 3180 | 0.17 | 3 | 2 | 0 | Y | WLFENGEE | 97.74 | WLSENGEE | 1.69 | | | | | | |
| NS5 | 3181 | 0.17 | 3 | 2 | 0 | Y | LFENGEER | 97.74 | LSENGEER | 1.69 | | | | | | |
| NS5 | 3182 | 0.17 | 3 | 2 | 0 | Y | FENGEERL | 97.74 | SENGEERL | 1.69 | | | | | | |
| NS5 | 3183 | 0.1 | 3 | 2 | 0 | Y | ENGEERLS | 98.87 | ENGEERLG | 0.56 | | | | | | |
| NS5 | 3184 | 0.15 | 4 | 3 | 0 | Y | NGEERLSR | 98.87 | NGKERLGR | 0.56 | | | | | | |
| NS5 | 3185 | 0.15 | 4 | 3 | 0 | Y | GEERLSRM | 98.31 | GEERLGRM | 0.56 | GEERLSRT | 0.56 | | | | |
| NS5 | 3186 | 0.15 | 3 | 2 | 0 | Y | EERLSRMA | 98.31 | KERLGRMA | 0.56 | EERLGRMA | 0.56 | | | | |
| NS5 | 3187 | 0.14 | 3 | 2 | 0 | Y | ERLSRMAV | 98.31 | ERLGRMAV | 1.13 | | | | | | |
| NS5 | 3188 | 0.14 | 3 | 2 | 0 | Y | RLSRMAVS | 98.31 | RLGRMAVS | 1.13 | | | | | | |
| NS5 | 3189 | 0.14 | 3 | 2 | 0 | Y | LSRMAVSG | 98.31 | LGRMAVSG | 1.13 | | | | | | |
| NS5 | 3190 | 0.14 | 3 | 2 | 0 | Y | SRMAVSGD | 98.31 | GRMAVSGD | 1.13 | | | | | | |
| NS5 | 3191 | 0.05 | 2 | 1 | 0 | Y | RMAVSGDD | 99.44 | | | | | | | | |
| NS5 | 3192 | 0.05 | 2 | 1 | 0 | Y | MAVSGDDC | 99.44 | | | | | | | | |
| NS5 | 3193 | 0 | 1 | 1 | 0 | Y | AVSGDDCV | 100 | | | | | | | | |
| NS5 | 3194 | 0 | 1 | 1 | 0 | Y | VSGDDCVV | 100 | | | | | | | | |

FIG. 23-115

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3195 | 0 | 1 | 1 | 0 | Y | SGDDCVWK | 100 | | | | | | |
| NS5 | 3196 | 0 | 1 | 1 | 0 | Y | GDDCVWKP | 100 | | | | | | |
| NS5 | 3197 | 0 | 1 | 1 | 0 | Y | DDCVWKPL | 100 | | | | | | |
| NS5 | 3198 | 0 | 1 | 1 | 0 | Y | DCVWKPLD | 100 | | | | | | |
| NS5 | 3199 | 0 | 1 | 1 | 0 | Y | CVWKPLDD | 100 | | | | | | |
| NS5 | 3200 | 0 | 1 | 1 | 0 | Y | VWKPLDDR | 100 | | | | | | |
| NS5 | 3201 | 0 | 1 | 1 | 0 | Y | WKPLDDRF | 100 | | | | | | |
| NS5 | 3202 | 0 | 1 | 1 | 0 | Y | KPLDDRFA | 100 | | | | | | |
| NS5 | 3203 | 0.1 | 3 | 2 | 0 | Y | PLDDRFAT | 98.87 | PLDDRFAI | 0.56 | | | | |
| NS5 | 3204 | 0.41 | 4 | 3 | 0 | Y | LDDRFATS | 93.22 | LDDRFATA | 5.65 | LDDRFASS | 0.56 | | |
| NS5 | 3205 | 0.41 | 4 | 3 | 0 | Y | DDRFATSL | 93.22 | DDRFATAL | 5.65 | DDRFASSL | 0.56 | | |
| NS5 | 3206 | 0.41 | 4 | 3 | 0 | Y | DRFATSLH | 93.22 | DRFATALH | 5.65 | DRFASSLH | 0.56 | | |
| NS5 | 3207 | 0.41 | 4 | 3 | 0 | Y | RFATSLHF | 93.22 | RFATALHF | 5.65 | RFAISLHF | 0.56 | | |
| NS5 | 3208 | 0.41 | 4 | 3 | 0 | Y | FATSLHFL | 93.22 | FATALHFL | 5.65 | FASSLHFL | 0.56 | | |
| NS5 | 3209 | 0.41 | 4 | 3 | 0 | Y | ATSLHFLN | 93.22 | ATALHFLN | 5.65 | ASSLHFLN | 0.56 | | |
| NS5 | 3210 | 0.46 | 5 | 4 | 0 | Y | TSLHFLNA | 92.66 | TALHFLNA | 5.65 | SSLHFLNA | 0.56 | TSLHFLND | 0.56 |
| NS5 | 3211 | 0.36 | 3 | 2 | 0 | Y | SLHFLNAM | 93.79 | ALHFLNAM | 5.65 | | | | |
| NS5 | 3212 | 0.1 | 3 | 2 | 0 | Y | LHFLNAMS | 98.87 | LHFLNAMP | 0.56 | | | | |
| NS5 | 3213 | 0.15 | 4 | 3 | 0 | Y | HFLNAMSK | 98.31 | HFLNDMSK | 0.56 | HFLNAMPK | 0.56 | | |
| NS5 | 3214 | 0.15 | 4 | 3 | 0 | Y | FLNAMSKV | 98.31 | FLNAMSQV | 0.56 | FLNAMPKV | 0.56 | | |
| NS5 | 3215 | 0.15 | 4 | 3 | 0 | Y | LNAMSKVR | 98.31 | LNAMPKVR | 0.56 | LNDMSKVR | 0.56 | | |
| NS5 | 3216 | 0.15 | 4 | 3 | 0 | Y | NAMSKVRK | 98.31 | NAMSQVRK | 0.56 | NAMPKVRK | 0.56 | | |
| NS5 | 3217 | 0.15 | 4 | 3 | 0 | Y | AMSKVRKD | 98.31 | DMSKVRKD | 0.56 | AMSQVRKD | 0.56 | | |
| NS5 | 3218 | 0.1 | 3 | 2 | 0 | Y | MSKVRKDI | 98.87 | MPKVRKDI | 0.56 | | | | |
| NS5 | 3219 | 0.1 | 3 | 2 | 0 | Y | SKVRKDIQ | 98.87 | PKVRKDIQ | 0.56 | | | | |

FIG. 23-116

Species: WNV (8-mers)

| protein | block starting position | block entropy | total peptides in block | #

FIG. 23-117

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3245 | 0.05 | 2 | 1 | 0 | Y | NHFTELIM | 99.44 | | |
| NS5 | 3246 | 0.05 | 2 | 1 | 0 | Y | HFTELIMK | 99.44 | | |
| NS5 | 3247 | 0.05 | 2 | 1 | 0 | Y | FTELIMKD | 99.44 | | |
| NS5 | 3248 | 0.05 | 2 | 1 | 0 | Y | TELIMKDG | 99.44 | | |
| NS5 | 3249 | 0.05 | 2 | 1 | 0 | Y | ELIMKDGR | 99.44 | | |
| NS5 | 3250 | 0.05 | 2 | 1 | 0 | Y | LIMKDGRT | 99.44 | | |
| NS5 | 3251 | 0.05 | 2 | 1 | 0 | Y | IMKDGRTL | 99.44 | | |
| NS5 | 3252 | 0 | 1 | 1 | 0 | Y | MKDGRTLV | 100 | | |
| NS5 | 3253 | 0.17 | 3 | 2 | 0 | Y | KDGRTLVW | 97.74 | KDGRTLVT | 1.69 |
| NS5 | 3254 | 0.17 | 3 | 2 | 0 | Y | DGRTLVVP | 97.74 | DGRTLVTP | 1.69 |
| NS5 | 3255 | 0.17 | 3 | 2 | 0 | Y | GRTLVVPC | 97.74 | GRTLVTPC | 1.69 |
| NS5 | 3256 | 0.17 | 3 | 2 | 0 | Y | RTLVVPCR | 97.74 | RTLVTPCR | 1.69 |
| NS5 | 3257 | 0.17 | 3 | 2 | 0 | Y | TLVVPCRG | 97.74 | TLVTPCRG | 1.69 |
| NS5 | 3258 | 0.17 | 3 | 2 | 0 | Y | LVVPCRGQ | 97.74 | LVTPCRGQ | 1.69 |
| NS5 | 3259 | 0.17 | 3 | 2 | 0 | Y | VVPCRGQD | 97.74 | VTPCRGQD | 1.69 |
| NS5 | 3260 | 0.17 | 3 | 2 | 0 | Y | VPCRGQDE | 97.74 | TPCRGQDE | 1.69 |
| NS5 | 3261 | 0 | 1 | 1 | 0 | Y | PCRGQDEL | 100 | | |
| NS5 | 3262 | 0.49 | 2 | 2 | 0 | Y | CRGQDELV | 89.27 | CRGQDELI | 10.73 |
| NS5 | 3263 | 0.49 | 2 | 2 | 0 | Y | RGQDELVG | 89.27 | RGQDELIG | 10.73 |
| NS5 | 3264 | 0.49 | 2 | 2 | 0 | Y | GQDELVGR | 89.27 | GQDELIGR | 10.73 |
| NS5 | 3265 | 0.49 | 2 | 2 | 0 | Y | QDELVGRA | 89.27 | QDELIGRA | 10.73 |
| NS5 | 3266 | 0.49 | 2 | 2 | 0 | Y | DELVGRAR | 89.27 | DELIGRAR | 10.73 |
| NS5 | 3267 | 0.49 | 2 | 2 | 0 | Y | ELVGRARI | 89.27 | ELIGRARI | 10.73 |
| NS5 | 3268 | 0.49 | 2 | 2 | 0 | Y | LVGRARIS | 89.27 | LIGRARIS | 10.73 |
| NS5 | 3269 | 0.49 | 2 | 2 | 0 | Y | VGRARISP | 89.27 | IGRARISP | 10.73 |

FIG. 23-118

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 23-119

Species: WNV (8-mers)

| protein | block starting position | block entropy | total peptides in block | # peptides required to cover 99% of block | gap/X fraction of 99% of block | covered w/ <= 5 peptides? | peptides required to cover 99% of block | frequency | peptides required to cover 99% of block | frequency | peptides required to cover 99% of block

FIG. 23-120

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency

FIG. 23-121

Species: WNV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3345 | 0.65 | 5 | 4 | 0.56 | Y | EVWNRVWI | 88.7 | AVWNRVWI | 6.78 | GVWNRVWI | 2.26 | SVWNRVWI | 1.13 |
| NS5 | 3346 | 0.05 | 2 | 1 | 0.56 | Y | VWNRVWIE | 98.87 | | | | | | |
| NS5 | 3347 | 0.05 | 2 | 1 | 0.56 | Y | WNRVWIEE | 98.87 | | | | | | |
| NS5 | 3348 | 0.05 | 2 | 1 | 0 | Y | NRVWIEEN | 99.44 | | | | | | |
| NS5 | 3349 | 0.1 | 3 | 2 | 0 | Y | RVWIEENE | 98.87 | KVWIEENE | 0.56 | | | | |
| NS5 | 3350 | 0.05 | 2 | 1 | 0 | Y | VWIEENEW | 99.44 | | | | | | |
| NS5 | 3351 | 0.05 | 2 | 1 | 0 | Y | WIEENEWM | 99.44 | | | | | | |
| NS5 | 3352 | 0.05 | 2 | 1 | 0 | Y | IEENEWME | 99.44 | | | | | | |
| NS5 | 3353 | 0.05 | 2 | 1 | 0 | Y | EENEWMED | 99.44 | | | | | | |
| NS5 | 3354 | 0.05 | 2 | 1 | 0 | Y | ENEWMEDK | 99.44 | | | | | | |
| NS5 | 3355 | 0.05 | 2 | 1 | 0 | Y | NEWMEDKT | 99.44 | | | | | | |
| NS5 | 3356 | 0.05 | 2 | 1 | 0 | Y | EWMEDKTP | 99.44 | | | | | | |
| NS5 | 3357 | 0 | 1 | 1 | 0 | Y | WMEDKTPV | 100 | | | | | | |
| NS5 | 3358 | 0 | 1 | 1 | 0 | Y | MEDKTPVE | 100 | | | | | | |
| NS5 | 3359 | 0.47 | 2 | 2 | 0 | Y | EDKTPVEK | 89.83 | EDKTPVER | 10.17 | | | | |
| NS5 | 3360 | 0.47 | 2 | 2 | 0 | Y | DKTPVEKW | 89.83 | DKTPVERW | 10.17 | | | | |
| NS5 | 3361 | 0.47 | 2 | 2 | 0 | Y | KTPVEKWS | 89.83 | KTPVERWS | 10.17 | | | | |
| NS5 | 3362 | 0.47 | 2 | 2 | 0 | Y | TPVEKWSD | 89.83 | TPVERWSD | 10.17 | | | | |
| NS5 | 3363 | 0.53 | 3 | 3 | 0 | Y | PVEKWSDV | 89.83 | PVERWSDV | 9.04 | PVERWSDI | 1.13 | | |
| NS5 | 3364 | 0.53 | 3 | 3 | 0 | Y | VEKWSDVP | 89.83 | VERWSDVP | 9.04 | VERWSDIP | 1.13 | | |
| NS5 | 3365 | 0.53 | 3 | 3 | 0 | Y | EKWSDVPY | 89.83 | ERWSDVPY | 9.04 | ERWSDIPY | 1.13 | | |
| NS5 | 3366 | 0.53 | 3 | 3 | 0 | Y | KWSDVPYS | 89.83 | RWSDVPYS | 9.04 | RWSDIPYS | 1.13 | | |
| NS5 | 3367 | 0.09 | 2 | 2 | 0 | Y | WSDVPYSG | 98.87 | WSDIPYSG | 1.13 | | | | |
| NS5 | 3368 | 0.09 | 2 | 2 | 0 | Y | SDVPYSGK | 98.87 | SDIPYSGK | 1.13 | | | | |
| NS5 | 3369 | 0.09 | 2 | 2 | 0 | Y | DVPYSGKR | 98.87 | DIPYSGKR | 1.13 | | | | |

FIG. 23-122

Species: WNV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3370 | 0.09 | 2 | 2 | 0 | Y | VPYSGKRE | 98.87 | IPYSGKRE | 1.13 | | | | |
| NS5 | 3371 | 0 | 1 | 1 | 0 | Y | PYSGKRED | 100 | | | | | | |
| NS5 | 3372 | 0 | 1 | 1 | 0 | Y | YSGKREDI | 100 | | | | | | |
| NS5 | 3373 | 0 | 1 | 1 | 0 | Y | SGKREDIW | 100 | | | | | | |
| NS5 | 3374 | 0 | 1 | 1 | 0 | Y | GKREDIWC | 100 | | | | | | |
| NS5 | 3375 | 0 | 1 | 1 | 0 | Y | KREDIWCG | 100 | | | | | | |
| NS5 | 3376 | 0 | 1 | 1 | 0 | Y | REDIWCGS | 100 | | | | | | |
| NS5 | 3377 | 0 | 1 | 1 | 0 | Y | EDIWCGSL | 100 | | | | | | |
| NS5 | 3378 | 0 | 1 | 1 | 0 | Y | DIWCGSLI | 100 | | | | | | |
| NS5 | 3379 | 0 | 1 | 1 | 0 | Y | IWCGSLIG | 100 | | | | | | |
| NS5 | 3380 | 0 | 1 | 1 | 0 | Y | WCGSLIGT | 100 | | | | | | |
| NS5 | 3381 | 0 | 1 | 1 | 0 | Y | CGSLIGTR | 100 | | | | | | |
| NS5 | 3382 | 0.66 | 3 | 3 | 0 | Y | GSLIGTRA | 86.44 | GSLIGTRT | 11.3 | GSLIGTRS | 2.26 | | |
| NS5 | 3383 | 0.66 | 3 | 3 | 0 | Y | SLIGTRAR | 86.44 | SLIGTRTR | 11.3 | SLIGTRSR | 2.26 | | |
| NS5 | 3384 | 0.66 | 3 | 3 | 0 | Y | LIGTRARA | 86.44 | LIGTRTRA | 11.3 | LIGTRSRA | 2.26 | | |
| NS5 | 3385 | 0.71 | 4 | 3 | 0 | Y | IGTRARAT | 85.88 | IGTRTRAT | 11.3 | IGTRSRAT | 2.26 | | |
| NS5 | 3386 | 0.71 | 4 | 3 | 0 | Y | GTRARATW | 85.88 | GTRTRATW | 11.3 | GTRSRATW | 2.26 | | |
| NS5 | 3387 | 0.71 | 4 | 3 | 0 | Y | TRARATWA | 85.88 | TRTRATWA | 11.3 | TRSRATWA | 2.26 | | |
| NS5 | 3388 | 0.71 | 4 | 3 | 0 | Y | RARATWAE | 85.88 | RTRATWAE | 11.3 | RSRATWAE | 2.26 | | |
| NS5 | 3389 | 0.71 | 4 | 3 | 0 | Y | ARATWAEN | 85.88 | TRATWAEN | 11.3 | SRATWAEN | 2.26 | | |
| NS5 | 3390 | 0.05 | 2 | 1 | 0 | Y | RATWAENI | 99.44 | | | | | | |
| NS5 | 3391 | 0.45 | 3 | 2 | 0 | Y | ATWAENIQ | 91.53 | ATWAENIH | 7.91 | | | | |
| NS5 | 3392 | 0.45 | 3 | 2 | 0 | Y | TWAENIQV | 91.53 | TWAENIHV | 7.91 | | | | |
| NS5 | 3393 | 0.4 | 2 | 2 | 0 | Y | WAENIQVA | 92.09 | WAENIHVA | 7.91 | | | | |
| NS5 | 3394 | 0.4 | 2 | 2 | 0 | Y | AENIQVAI | 92.09 | AENIHVAI | 7.91 | | | | |

FIG. 23-123

| Species: WNV (8-mers) protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3395 | 0.45 | 3 | 2 | 0 | Y | ENIQVAIN | 91.53 | ENIHVAIN | 7.91 | | | | |
| NS5 | 3396 | 0.45 | 3 | 2 | 0 | Y | NIQVAINQ | 91.53 | NIHVAINQ | 7.91 | | | | |
| NS5 | 3397 | 0.45 | 3 | 2 | 0 | Y | IQVAINQV | 91.53 | IHVAINQV | 7.91 | | | | |
| NS5 | 3398 | 0.5 | 4 | 3 | 0 | Y | QVAINQVR | 90.96 | HVAINQVR | 7.91 | QVAIGQVR | 0.56 | | |
| NS5 | 3399 | 0.56 | 4 | 3 | 0 | Y | VAINQVRA | 89.27 | VAINQVRS | 9.6 | VAIGQVRS | 0.56 | | |
| NS5 | 3407 | 0.59 | 4 | 3 | 0 | Y | IIGDEKYV | 88.7 | VIGEEKYV | 9.6 | IIGEEKYV | 1.13 | | |
| NS5 | 3408 | 0.54 | 3 | 2 | 0 | Y | IGDEKYVD | 88.7 | IGEEKYVD | 10.73 | | | | |
| NS5 | 3409 | 0.54 | 3 | 2 | 0 | Y | GDEKYVDY | 88.7 | GEEKYVDY | 10.73 | | | | |
| NS5 | 3410 | 0.54 | 3 | 2 | 0 | Y | DEKYVDYM | 88.7 | EEKYVDYM | 10.73 | | | | |
| NS5 | 3411 | 0.24 | 2 | 2 | 0 | Y | EKYVDYMS | 96.61 | EKYVDYMG | 2.82 | | | | |
| NS5 | 3412 | 0.19 | 2 | 2 | 0 | Y | KYVDYMSS | 97.18 | KYVDYMGS | 2.82 | | | | |
| NS5 | 3413 | 0.19 | 2 | 2 | 0 | Y | YVDYMSSL | 97.18 | YVDYMGSL | 2.82 | | | | |
| NS5 | 3414 | 0.6 | 4 | 3 | 0 | Y | VDYMSSLR | 89.27 | VDYMSSLR | 7.91 | VDYMGSLK | 2.26 | | |
| NS5 | 3415 | 0.6 | 4 | 3 | 0 | Y | DYMSSLRR | 89.27 | DYMSSLRR | 7.91 | DYMGSLKR | 2.26 | | |
| NS5 | 3416 | 0.6 | 4 | 3 | 0 | Y | YMSSLRRY | 89.27 | YMSSLRRY | 7.91 | YMGSLKRY | 2.26 | | |
| NS5 | 3417 | 0.6 | 5 | 3 | 0 | Y | MSSLRRYE | 89.27 | MSSLRRYE | 7.34 | MGSLKRYE | 2.26 | | |
| NS5 | 3418 | 0.63 | 5 | 4 | 0 | Y | SSLKRYED | 89.27 | SSLRRYED | 7.34 | GSLKRYEE | 2.26 | GSLRRYED | 0.56 |
| NS5 | 3419 | 0.68 | 6 | 5 | 0 | Y | SLKRYEDT | 88.7 | SLRRYEDT | 7.34 | SLKRYEEP | 2.26 | SLRRYEDA | 0.56 |

Additional column for row NS5 3419: SLKRYEDV, frequency 0.56

FIG. 24-1

Species: WNV (9-mers)

| protein | block starting position | block entropy | total peptides in block | # peptides required to cover 99% of block | gap/X fraction | 99% of block covered w/ <= 5 peptides? | peptides required to cover 99% of block

FIG. 24-2

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 30 | 0.14 | 3 | 2 | 0 | Y | LKRAMLSLI | 98.31 | LKRAVLSLI | 1.13 | | | | |
| anC | 31 | 0.14 | 3 | 2 | 0.56 | Y | KRAMLSLID | 97.74 | KRAVLSLID | 1.13 | | | | |
| anC | 32 | 0.14 | 3 | 2 | 0.56 | Y | RAMLSLIDG | 97.74 | RAVLSLIDG | 1.13 | | | | |
| anC | 33 | 0.38 | 4 | 3 | 0.56 | Y | AMLSLIDGK | 93.79 | AMLSLIDGR | 3.95 | AVLSLIDGK | 1.13 | | |
| anC | 34 | 0.38 | 4 | 3 | 0.56 | Y | MLSLIDGKG | 93.79 | MLSLIDGRG | 3.95 | VLSLIDGKG | 1.13 | | |
| anC | 35 | 0.27 | 2 | 2 | 0.56 | Y | LSLIDGKGP | 94.92 | LSLIDGRGP | 4.52 | | | | |
| anC | 36 | 0.41 | 5 | 4 | 0.56 | Y | SLIDGKGPI | 93.79 | SLIDGRGPI | 2.82 | SLIDGKGPT | 1.69 | SLIDGKGPT | 0.56 |
| anC | 37 | 0.41 | 5 | 4 | 0.56 | Y | LIDGKGPIR | 93.79 | LIDGRGPIR | 2.82 | LIDGKGPTR | 1.69 | LIDGKGPTR | 0.56 |
| anC | 38 | 0.41 | 5 | 4 | 0.56 | Y | IDGKGPIRF | 93.79 | IDGRGPIRF | 2.82 | IDGKGPTRF | 1.69 | IDGKGPVRF | 0.56 |
| anC | 39 | 0.41 | 5 | 4 | 0.56 | Y | DGKGPIRFV | 93.79 | DGRGPIRFV | 2.82 | DGRGPTRFV | 1.69 | DGKGPVRFV | 0.56 |
| anC | 40 | 0.41 | 5 | 4 | 0 | Y | GKGPIRFVL | 94.35 | GRGPIRFVL | 2.82 | GRGPTRFVL | 1.69 | GKGPTRFVL | 0.56 |
| anC | 41 | 0.41 | 5 | 4 | 0 | Y | KGPIRFVLA | 94.35 | RGPIRFVLA | 2.26 | RGPTRFVLA | 1.69 | KGPYRFVLA | 0.56 |
| anC | 42 | 0.21 | 3 | 2 | 0 | Y | GPIRFVLAL | 97.18 | GPTRFVLAL | 2.26 | | | | |
| anC | 43 | 0.21 | 3 | 2 | 0 | Y | PIRFVLALL | 97.18 | PTRFVLALL | 2.26 | | | | |
| anC | 44 | 0.41 | 5 | 4 | 0 | Y | IRFVLALLA | 94.35 | TRFVLALLA | 2.26 | IRFVLALLT | 1.13 | | |
| anC | 45 | 0.21 | 3 | 2 | 0 | Y | RFVLALLAF | 97.18 | RFVLALLTF | 2.26 | | | VRFVLALLA | 0.56 |
| anC | 46 | 0.21 | 3 | 2 | 0 | Y | FVLALLAFF | 97.18 | FVLALLTFF | 2.26 | | | | |
| anC | 47 | 0.29 | 4 | 3 | 0 | Y | VLALLAFFR | 96.05 | VLALLTFFR | 2.26 | VLALLAFFK | 1.13 | | |
| anC | 48 | 0.29 | 4 | 3 | 0 | Y | LALLAFFRF | 96.05 | LALLTFFRF | 2.26 | LALLAFFKF | 1.13 | | |
| anC | 49 | 0.29 | 4 | 3 | 0 | Y | ALLAFFRFT | 96.05 | ALLTFFRFT | 2.26 | ALLAFFKFT | 1.13 | | |
| anC | 50 | 0.29 | 4 | 3 | 0 | Y | LLAFFRFTA | 96.05 | LLTFFRFTA | 2.26 | LLAFFKFTA | 1.13 | | |
| anC | 51 | 0.34 | 5 | 4 | 0 | Y | LAFFRFTAI | 95.48 | LTFFRFTAI | 2.26 | LAFFKFTAI | 1.13 | LAFFRFTAV | 0.56 |
| anC | 52 | 0.34 | 5 | 4 | 0 | Y | AFFRFTAIA | 95.48 | TFFRFTAIA | 2.26 | AFFKFTAIA | 1.13 | VFFRFTAIA | 0.56 |
| anC | 53 | 0.14 | 3 | 2 | 0 | Y | FFRFTAIAP | 98.31 | FFKFTAIAP | 1.13 | | | | |
| anC | 54 | 0.14 | 3 | 2 | 0 | Y | FRFTAIAPT | 98.31 | FKFTAIAPT | 1.13 | | | | |

FIG. 24-3

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| anC | 55 | 0.14 | 3 | 2 | 0 | Y | RFTAIAPTR | 98.31 | KFTAIAPTR | 1.13 | | | | | | |
| anC | 56 | 0.05 | 2 | 1 | 0 | Y | FTAIAPTRA | 99.44 | | | | | | | | |
| anC | 57 | 0.24 | 3 | 2 | 0 | Y | TAIAPTRAV | 96.61 | TAIAPTRAL | 2.82 | | | | | | |
| anC | 58 | 0.24 | 3 | 2 | 0 | Y | AIAPTRAVL | 96.61 | AIAPTRALL | 2.82 | | | | | | |
| anC | 59 | 0.34 | 5 | 4 | 0 | Y | IAPTRAVLD | 95.48 | IAPTRALLD | 2.82 | IAPTRAVLN | 0.56 | | | | |
| anC | 60 | 0.29 | 4 | 3 | 0 | Y | APTRAVLDR | 96.05 | APTRALLDR | 2.82 | APTRAVLER | 0.56 | VAPTRAVLD | 0.56 | | |
| anC | 61 | 0.29 | 4 | 3 | 0 | Y | PTRAVLDRW | 96.05 | PTRALLDRW | 2.82 | PTRAVLERW | 0.56 | | | | |
| anC | 62 | 0.29 | 4 | 3 | 0 | Y | TRAVLDRWR | 96.05 | TRALLDRWR | 2.82 | TRAVLERWR | 0.56 | | | | |
| anC | 63 | 0.41 | 5 | 4 | 0 | Y | RAVLDRWRG | 94.35 | RALLDRWRG | 2.82 | RAVLDRWRS | 1.69 | RAVLERWRG | 0.56 | | |
| anC | 64 | 0.41 | 5 | 4 | 0 | Y | AVLDRWRGV | 94.35 | ALLDRWRGV | 2.82 | AVLDRWRSV | 1.69 | AVLERWRGV | 0.56 | | |
| anC | 65 | 0.43 | 6 | 5 | 0 | Y | VLDRWRGVN | 94.92 | LLDRWRGVN | 2.26 | VLDRWRSVN | 1.69 | LLDRWRGV | 0.56 | VLERWRGVN | 0.56 |
| anC | 66 | 0.38 | 5 | 4 | 0 | Y | LDRWRGVNK | 94.92 | LDRWRGVRK | 2.26 | LDRWRSYNK | 1.69 | LNRWRGVNK | 0.56 | | |
| anC | 67 | 0.38 | 5 | 4 | 0 | Y | DRWRGVNKQ | 94.92 | DRWRGVRKQ | 2.26 | DRWRSVNKQ | 1.69 | NRWRGVNKQ | 0.56 | | |
| anC | 68 | 0.28 | 3 | 3 | 0 | Y | RWRGVNKQT | 96.05 | RWRGVRKQT | 2.26 | RWRSVNKQT | 1.69 | | | | |
| anC | 69 | 0.28 | 3 | 3 | 0 | Y | WRGVNKQTA | 96.05 | WRGVRKQTA | 2.26 | WRSVNKQTA | 1.69 | | | | |
| anC | 70 | 0.28 | 3 | 3 | 0 | Y | RGVNKQTAM | 96.05 | RGVRKQTAM | 2.26 | RSVNKQTAM | 1.69 | | | | |
| anC | 71 | 0.28 | 3 | 3 | 0 | Y | GVNKQTAMK | 96.05 | GVRKQTAMK | 2.26 | SVNKQTAMK | 1.69 | | | | |
| anC | 72 | 0.16 | 2 | 2 | 0 | Y | VNKQTAMKH | 97.74 | VRKQTAMKH | 2.26 | | | | | | |
| anC | 73 | 0.16 | 2 | 2 | 0 | Y | NKQTAMKHL | 97.18 | RKQTAMKHL | 2.26 | | | | | | |
| anC | 74 | 0.05 | 2 | 1 | 0.56 | Y | KQTAMKHLL | 98.87 | | | | | | | | |
| anC | 75 | 0.05 | 2 | 1 | 0.56 | Y | QTAMKHLLS | 98.87 | | | | | | | | |
| anC | 76 | 0.05 | 2 | 1 | 0.56 | Y | TAMKHLLSF | 98.87 | | | | | | | | |
| anC | 77 | 0.05 | 2 | 1 | 0.56 | Y | AMKHLLSFK | 98.87 | | | | | | | | |
| anC | 78 | 0.1 | 3 | 2 | 0.56 | Y | MKHLLSFKK | 98.31 | MKHLTSFKK | 0.56 | | | | | | |
| anC | 79 | 0.1 | 3 | 2 | 0.56 | Y | KHLLSFKKE | 98.31 | KHLLSFKRE | 0.56 | | | | | | |

FIG. 24-4

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 80 | 0.1 | 3 | 2 | 0.56 | Y | HLLSFKKEL | 98.31 | HLLSFKREL | 0.56 | | | | | | |
| anC | 81 | 0.1 | 3 | 2 | 0.56 | Y | LLSFKKEL

FIG. 24-5

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 128 | 0.32 | 4 | 3 | 0 | Y | NFQGKVMMT | 95.48 | NFQGKLMMT | 2.82 | NFQGKVMT | 1.13 | | |
| prM | 129 | 0.34 | 5 | 4 | 0 | Y | FQGKVMMTV | 95.48 | FQGKLMMTI | 2.26 | FQGKVMTV | 1.13 | FQGKLMMTV | 0.56 |
| prM | 130 | 0.34 | 5 | 4 | 0 | Y | QGKVMMTVN | 95.48 | QGKLMMTIN | 2.26 | QGKVMMTIN | 1.13 | QGKVMMTIN | 0.56 |
| prM | 131 | 0.34 | 5 | 4 | 0 | Y | GKVMMTVNA | 95.48 | GKLMMTINA | 2.26 | GKVIMTVNA | 1.13 | GKLMMTVNA | 0.56 |
| prM | 132 | 0.34 | 5 | 4 | 0 | Y | KVMMTVNAT | 95.48 | KLMMTINAT | 2.26 | KVIMTVNAT | 1.13 | KLMMTVNAT | 0.56 |
| prM | 133 | 0.37 | 6 | 5 | 0 | Y | VMMTVNATD | 95.48 | VIMTVNATD | 1.13 | LMMTVNATD | 1.13 | LMMTVNATD | 0.56 |
| prM | 134 | 0.44 | 6 | 5 | 0 | Y | MMTVNATDV | 94.35 | MMTINATDI | 1.69 | IMTVNATDV | 1.13 | MMTINATET | 1.13 |
| prM | 135 | 0.4 | 6 | 5 | 0 | Y | MTVNATDVT | 94.92 | MTVNATDIT | 1.69 | MTINATDIT | 1.13 | MTVNATDVA | 0.56 |
| prM | 145 | 0.29 | 4 | 3 | 0 | Y | VITIPTAAG | 96.61 | IITIPTAAG | 1.13 | IITIPIASG | 0.56 | AITIPIAAG | 0.56 |
| prM | 146 | 0.15 | 4 | 3 | 0 | Y | ITIPTAAGK | 98.31 | ITIPIASGK | 0.56 | | | | |
| prM | 147 | 0.15 | 4 | 3 | 0 | Y | TIPTAAGKN | 98.31 | TIPTASGKN | 0.56 | | | | |
| prM | 148 | 0.15 | 4 | 3 | 0 | Y | IPTAAGKNL | 98.31 | IPTASGKNL | 0.56 | | | | |
| prM | 149 | 0.15 | 4 | 3 | 0 | Y | PTAAGKNLC | 98.31 | PTASGKNLC | 0.56 | PAAGKNLCI | 0.56 | | |
| prM | 150 | 0.36 | 5 | 4 | 0 | Y | TAAGKNLCI | 94.92 | TAAGKNLCT | 3.39 | ASGKNLCTV | 1.13 | | |
| prM | 151 | 0.33 | 4 | 3 | 0 | Y | AAGKNLCIV | 95.48 | AAGKNLCTI | 2.26 | AGKNLCTVR | 1.13 | | |
| prM | 152 | 0.33 | 3 | 3 | 0 | Y | AGKNLCIVR | 95.48 | AGKNLCTIR | 2.26 | SGKNLCTVR | 1.13 | | |
| prM | 153 | 0.31 | 3 | 3 | 0 | Y | GKNLCIVRA | 95.48 | GKNLCTIRA | 2.26 | GKNLCTVRA | 2.26 | | |
| prM | 154 | 0.33 | 4 | 3 | 0 | Y | KNLCIVRAM | 95.48 | KNLCTIRAM | 2.26 | KNLCTVRAM | 1.69 | | |
| prM | 155 | 0.33 | 4 | 3 | 0 | Y | NLCIVRAMD | 95.48 | NLCTIRAMD | 2.26 | NLCTVRAMD | 1.69 | | |
| prM | 156 | 0.33 | 4 | 3 | 0 | Y | LCIVRAMDV | 95.48 | LCTIRAMDV | 2.26 | LCTVRAMDV | 1.69 | | |
| prM | 157 | 0.33 | 4 | 3 | 0 | Y | CIVRAMDVG | 95.48 | CTIRAMDVG | 2.26 | CTVRAMDVG | 1.69 | | |
| prM | 158 | 0.47 | 6 | 5 | 0 | Y | IVRAMDVGY | 93.79 | TIRAMDVGF | 2.26 | IVRAMDVGH | 1.69 | TVRAMDVGY | 1.13 | TVRAMDVGF | 0.56 |
| prM | 159 | 0.77 | 6 | 5 | 0 | Y | VRAMDVGYM | 87.01 | VRAMDVGYL | 7.91 | IRAMDVGFM | 2.26 | VRAMDVGHM | 1.69 | VRAIDVGFL | 0.56 |
| prM | 160 | 0.75 | 5 | 4 | 0 | Y | RAMDVGYMC | 87.01 | RAMDVGYLC | 7.91 | RAMDVGFMC | 2.82 | RAMDVGHMC | 1.69 | | |
| prM | 161 | 0.75 | 5 | 4 | 0 | Y | AMDVGYMCD | 87.01 | AMDVGYLCE | 7.91 | AMDVGFMCD | 2.82 | AMDVGHMCD | 2.82 | | |

FIG. 24-6

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 162 | 0.75 | 5 | 4 | 0 | Y | MDVGYMCDD | 87.01 | MDVGYLCED | 7.91 | MDVGFMCDD | 2.82 | MDVGHMCDD | 1.69 | | |
| prM | 163 | 0.75 | 5 | 4 | 0 | Y | DVGYMCDDT | 87.01 | DVGYLCEDT | 7.91 | DVGFMCDDT | 2.82 | DVGHMCDDT | 1.69 | | |
| prM | 164 | 0.75 | 5 | 4 | 0.56 | Y | VGYMCDDTI | 86.44 | VGYLCEDTI | 7.91 | VGFMCDDTI | 2.82 | VGHMCDDTI | 1.69 | | |
| prM | 165 | 0.78 | 6 | 5 | 0.56 | Y | GYMCDDTIT | 86.44 | GYLCEDTIT | 7.91 | GFMCDDTIA | 2.26 | GHMCDDTIT | 1.69 | GFMCDDTIT | 0.56 |
| prM | 166 | 0.78 | 6 | 5 | 0.56 | Y | YMCDDTITY | 86.44 | YLCEDTITY | 7.91 | MCDDTIAY | 2.26 | HMCDDTITY | 1.69 | FMCDDTITY | 0.56 |
| prM | 167 | 0.6 | 4 | 3 | 0.56 | Y | MCDDTITYE | 88.7 | LCEDTITYE | 7.91 | MCDDTIAYE | 2.26 | | | | |
| prM | 168 | 0.55 | 3 | 3 | 0.56 | Y | CDDTITYEC | 89.27 | CEDTITYEC | 7.91 | CDDTIAYEC | 2.26 | | | | |
| prM | 169 | 0.6 | 4 | 3 | 0.56 | Y | DDTITYECP | 88.7 | EDTITYECP | 7.91 | DDTIAYECP | 2.26 | | | | |
| prM | 170 | 0.26 | 3 | 3 | 0.56 | Y | DTITYECPV | 96.05 | DTIAYECPA | 2.26 | DTITYECSV | 0.56 | | | | |
| prM | 171 | 0.26 | 3 | 3 | 0.56 | Y | TITYECPVL | 96.05 | TIAYECPAL | 2.26 | TITYECSVL | 0.56 | | | | |
| prM | 172 | 0.67 | 4 | 4 | 0 | Y | ITYECPVLS | 87.57 | ITYECPVLA | 8.47 | IAYECPALM | 2.26 | ITYECSVLS | 0.56 | | |
| prM | 173 | 0.67 | 4 | 4 | 0 | Y | TYECPVLSA | 88.14 | TECPVLAA | 8.47 | AYECPALME | 2.26 | TYECPALAA | 0.56 | | |
| prM | 174 | 0.67 | 4 | 4 | 0 | Y | YECPVLSAG | 88.14 | YECPVLAAG | 8.47 | YECPALMEG | 2.26 | YECPALAAG | 0.56 | | |
| prM | 175 | 0.67 | 4 | 4 | 0 | Y | ECPVLSAGN | 88.14 | ECPVLAAGN | 8.47 | ECPALMEGN | 2.26 | ECSVLSAGN | 0.56 | | |
| prM | 176 | 0.67 | 4 | 4 | 0 | Y | CPVLSAGND | 88.14 | CPVLAAGND | 8.47 | CPALMEGND | 2.26 | CPALAAGND | 0.56 | | |
| prM | 177 | 0.67 | 4 | 4 | 0 | Y | PVLSAGNDP | 88.14 | PVLAAGNDP | 8.47 | PALMEGNDP | 2.26 | SVLSAGNDP | 0.56 | | |
| prM | 178 | 0.62 | 4 | 4 | 0 | Y | VLSAGNDPE | 88.7 | VLAAGNDPE | 8.47 | ALMEGNDPE | 2.26 | | | | |
| prM | 179 | 0.59 | 3 | 3 | 0 | Y | LSAGNDPED | 88.7 | LAAGNDPED | 9.04 | LMEGNDPED | 2.26 | | | | |
| prM | 180 | 0.64 | 4 | 3 | 0 | Y | SAGNDPEDI | 88.14 | AAGNDPEDI | 9.04 | MEGNDPEDI | 2.26 | | | | |
| prM | 181 | 0.21 | 3 | 2 | 0 | Y | AGNDPEDID | 97.18 | EGNDPEDID | 2.26 | | | | | | |
| prM | 182 | 0.05 | 2 | 1 | 0 | Y | GNDPEDIDC | 99.44 | | | | | | | | |
| prM | 183 | 0.05 | 2 | 1 | 0 | Y | NDPEDIDCW | 99.44 | | | | | | | | |
| prM | 184 | 0.05 | 2 | 1 | 0 | Y | DPEDIDCWC | 99.44 | | | | | | | | |
| prM | 185 | 0.05 | 2 | 1 | 0 | Y | PEDIDCWCT | 99.44 | | | | | | | | |
| prM | 186 | 0.05 | 2 | 1 | 0 | Y | EDIDCWCTK | 99.44 | | | | | | | | |

FIG. 24-7

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 187 | 0.26 | 4 | 3 | 0 | Y | DI

FIG. 24-8

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99

FIG. 24-9

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| prM | 243 | 0.16 | 2 | 2 | 0 | Y | YLVKTESWI | 97.74 | YLMKAESWI | 2.26 |
| prM | 244 | 0.16 | 2 | 2 | 0 | Y | LVKTESWIL | 97.74 | LMKAESWIL | 2.26 |
| prM | 245 | 0.16 | 2 | 2 | 0 | Y | VKTESWILR | 97.74 | MKAESWILR | 2.26 |
| prM | 246 | 0.16 | 2 | 2 | 0 | Y | KTESWIL

FIG. 24-10

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

FIG. 24-11

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 294 | 0.29 | 4 | 3 | 0 | Y | LGMSNRDFL | 96.05 | LGMSNR

FIG. 24-12

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 319 | 0.27 | 5 | 4 | 0 | Y | SCVTIMSKD | 96.61 | SCVTIMAKD | 1.69 | SCVTLMSKD | 0.56 | SCVTITAKD | 0.56 | | |
| E | 320 | 0.27 | 5 | 4 | 0 | Y | CVTIMSKDK | 96.61 | CVTIMAKDR | 1.69 | CVTITAKDR | 0.56 | CVTIMSKNK | 0.56 | | |
| E | 321 | 0.27 | 5 | 4 | 0 | Y | VTIMSKDKP | 96.61 | VTIMAKDRP | 1.69 | VTIMSKNKP | 0.56 | VTLMSKDKP | 0.56 | | |
| E | 322 | 0.27 | 5 | 4 | 0 | Y | TIMSKDKPT | 96.61 | TIMAKDRPT | 1.69 | TIMSKNKPT | 0.56 | TITAKDRPT | 0.56 | | |
| E | 323 | 0.27 | 5 | 4 | 0 | Y | IMSKDKPTI | 96.61 | IMAKDRPTI | 1.69 | ITAKDRPTI | 0.56 | LMSKDKPTI | 0.56 | | |
| E | 324 | 0.22 | 4 | 3 | 0 | Y | MSKDKPTID | 97.18 | MAKDRPTID | 1.69 | TAKDRPTID | 0.56 | | | | |
| E | 325 | 0.21 | 3 | 2 | 0 | Y | SKDKPTIDV | 97.18 | AKDRPTIDV | 2.26 | | | | | | |
| E | 326 | 0.21 | 3 | 2 | 0 | Y | KDKPTIDVK | 97.18 | KDRPTIDVK | 2.26 | | | | | | |
| E | 327 | 0.21 | 3 | 2 | 0 | Y | DKPTIDVKM | 97.18 | DRPTIDVKM | 2.26 | | | | | | |
| E | 328 | 0.21 | 3 | 2 | 0 | Y | KPTIDVKMV | 97.18 | RPTIDVKMV | 2.26 | | | | | | |
| E | 329 | 0.26 | 4 | 3 | 0 | Y | PTIDVKMMN | 96.61 | PTIDVKMVT | 2.26 | PTIDVKMTN | 0.56 | | | | |
| E | 330 | 0.31 | 5 | 4 | 0 | Y | TIDVKMNM | 96.05 | TIDVKMVTM | 2.26 | TIDVKMKM | 0.56 | TIDVKMNV | 0.56 | | |
| E | 331 | 0.31 | 5 | 4 | 0 | Y | IDVKMMNME | 96.05 | IDVKMVTMG | 2.26 | IDVKMMNVE | 0.56 | IDVKMTNME | 0.56 | | |
| E | 332 | 0.31 | 5 | 4 | 0 | Y | DVKMMNMEA | 96.05 | DVKMVTMGA | 2.26 | DVKMTNMEA | 0.56 | DVKMMKMEA | 0.56 | | |
| E | 345 | 0.71 | 6 | 5 | 0 | Y | EVRSYCYLA | 88.14 | DVRSYCYLA | 7.34 | EVRSYCYAA | 2.82 | EVRSYCHLA | 1.69 | GVRDYCYLA | 0.56 |
| E | 355 | 0.69 | 6 | 5 | 0 | Y | VSDLSTKAA | 89.27 | VSDLSTRAA | 5.65 | ATEISSSAA | 2.26 | VSELSTKAA | 1.69 | VNDLSPRAA | 0.56 |
| E | 356 | 0.69 | 6 | 5 | 0 | Y | SDLSTKAAC | 89.27 | SDLSTRAAC | 5.65 | TEISSSAAC | 2.26 | SELSTKAAC | 1.69 | SELSTRAAC | 0.56 |
| E | 357 | 0.69 | 6 | 5 | 0 | Y | DLSTKAACP | 89.27 | DLSTRAACP | 5.65 | EISSSAACP | 2.26 | ELSTKAACP | 1.69 | DLSPRAACP | 0.56 |
| E | 358 | 0.59 | 5 | 4 | 0 | Y | LSTKAACPT | 90.4 | LSTRAACPT | 6.21 | ISSAACPT | 2.26 | LSTKAACPA | 0.56 | | |
| E | 359 | 0.59 | 5 | 4 | 0 | Y | STKAACPTM | 90.4 | STRAACPTM | 6.21 | SSAACPTM | 2.26 | STKAACPAM | 0.56 | | |
| E | 360 | 0.59 | 5 | 4 | 0 | Y | TKAACPTMG | 90.4 | TRAACPTMG | 6.21 | SSAACPTMG | 2.26 | PRAACPTMG | 0.56 | | |
| E | 361 | 0.61 | 5 | 4 | 0 | Y | KAACPTMGE | 89.83 | RAACPTMGE | 6.78 | SAACPTMGE | 2.26 | KAACPTMGD | 0.56 | | |
| E | 362 | 0.1 | 3 | 2 | 0 | Y | AACPTMGEA | 98.87 | AACPTMGDA | 0.56 | | | | | | |
| E | 363 | 0.1 | 3 | 2 | 0 | Y | ACPTMGEAH | 98.87 | ACPAMGEAH | 0.56 | | | | | | |
| E | 364 | 0.1 | 3 | 2 | 0 | Y | CPTMGEAHN | 98.87 | CPTMGDAHN | 0.56 | | | | | | |

FIG. 24-13

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 365 | 0.59 | 4 | 3 | 0 | Y | PTMGEAHND | 88.14 | PTMGEAHNE | 10.73 | PAMGEAHND | 0.56 | | |
| E | 366 | 0.59 | 4 | 3 | 0 | Y | TMGEAHNDK | 88.14 | TMGEAHNEK | 10.73 | AMGEAHNDK | 0.56 | | |
| E | 367 | 0.54 | 3 | 2 | 0 | Y | MGEAHNDKR | 88.7 | MGEAHNEKR | 10.73 | | | | |
| E | 368 | 0.62 | 4 | 3 | 0 | Y | GEAHNDKRA | 88.7 | GEAHNEKRA | 8.47 | GEAHNEKRT | 2.26 | | |
| E | 369 | 0.62 | 4 | 3 | 0 | Y | EAHNDKRAD | 88.7 | EAHNEKRAD | 8.47 | EAHNEKRTD | 2.

FIG. 24-14

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 399 | 0 | 1 | 1 | 0 | Y | GKGSIDTCA | 100 | |

FIG. 24-15

Species: WNV (9-mers)

| protein | block starting position | block ent

FIG. 24-16

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 472 | 0.31 | 5 | 4 | 0 | Y | EYGEVTVDC | 96.05 | DYGEVTFDC | 2.26 | GYGEVTVDC | 0.56 | | |
| E | 473 | 0.26 | 4 | 3 | 0 | Y | YGEVTVDCE | 96.61 | YGEVTFDCE | 2.26 | | | | |
| E | 474 | 0.26 | 4 | 3 | 0 | Y | GEVTVDCEP | 96.61 | GEVTFDCEP | 2.26 | | | | |
| E | 475 | 0.26 | 4 | 3 | 0 | Y | EVTVDCEPR | 96.61 | EVTFDCEPR | 2.26 | | | | |
| E | 476 | 0.26 | 4 | 3 | 0 | Y | VTVDCEPRS | 96.61 | VTFDCEPRS | 2.26 | | | | |
| E | 477 | 0.26 | 4 | 3 | 0 | Y | TVDCEPRSG | 96.61 | TFDCEPRSG | 2.26 | | | | |
| E | 478 | 0.26 | 4 | 3 | 0 | Y | VDCEPRSGI | 96.61 | FDCEPRSGI | 2.26 | | | | |
| E | 479 | 0.16 | 2 | 2 | 0 | Y | DCEPRSGID | 97.74 | DCEPRSGVD | 2.26 | | | | |
| E | 480 | 0.16 | 2 | 2 | 0 | Y | CEPRSGIDT | 97.74 | CEPRSGVDV | 2.26 | | | | |
| E | 481 | 0.64 | 4 | 3 | 0 | Y | EPRSGIDTN | 88.14 | EPRSGIDTS | 2.26 | | | EPRSGVDVD | 9.04 | |
| E | 482 | 0.64 | 4 | 3 | 0 | Y | PRSGIDTNA | 88.14 | PRSGIDTSA | 2.26 | | | PRSGVDVDA | 9.04 | |
| E | 483 | 0.64 | 4 | 3 | 0 | Y | RSGIDTNAY | 88.14 | RSGIDTSAY | 2.26 | | | RSGVDVDAF | 9.04 | |
| E | 484 | 0.64 | 4 | 3 | 0 | Y | SGIDTNAYY | 88.14 | SGIDTSAYY | 2.26 | | | SGVDVDAFY | 9.04 | |
| E | 485 | 0.64 | 4 | 3 | 0 | Y | GIDTNAYYV | 88.14 | GIDTSAYYV | 2.26 | | | GVDVDAFYV | 9.04 | |
| E | 486 | 0.64 | 4 | 3 | 0 | Y | IDTNAYYVM | 88.14 | IDTSAYYVM | 2.26 | | | VDVDAFYVM | 9.04 | |
| E | 487 | 0.75 | 6 | 5 | 0 | Y | DTNAYYVMT | 87.57 | DTSAYYVM | 2.26 | DTSAYYVMT | 1.69 | DVDAFYVMT | 7.34 | DTNAYYVMS | 0.56 |
| E | 488 | 0.75 | 6 | 5 | 0 | Y | TNAYYVMTV | 87.57 | TSAYYVMT | 2.26 | TSAYYVMTV | 1.69 | VDAFYVMTV | 7.34 | TGAYYVMSV | 0.56 |
| E | 489 | 0.75 | 6 | 5 | 0 | Y | NAYYVMTVG | 87.57 | SAYYVMTVG | 2.26 | SAYYVMTVG | 1.69 | DAFYVMTVG | 7.34 | NAYYVMSVG | 0.56 |
| E | 499 | 0.49 | 2 | 2 | 0 | Y | KTFLVHREW | 89.27 | KSFLVHREW | 10.73 | | | | |
| E | 500 | 0.49 | 2 | 2 | 0 | Y | TFLVHREWF | 89.27 | SFLVHREWF | 10.73 | | | | |
| E | 501 | 0.05 | 2 | 1 | 0 | Y | FLVHREWFM | 99.44 | | | | | | |
| E | 502 | 0.05 | 2 | 1 | 0 | Y | LVHREWFMD | 99.44 | | | | | | |
| E | 503 | 0.05 | 2 | 1 | 0 | Y | VHREWFMDL | 99.44 | | | | | | |
| E | 504 | 0.05 | 2 | 1 | 0 | Y | HREWFMDLN | 99.44 | | | | | | |
| E | 505 | 0.1 | 3 | 2 | 0 | Y | REWFMDLNL | 98.87 | REWFMDLNM | 0.56 | | | | |

FIG. 24-17

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 506 | 0.1 | 3 | 2 | 0 | Y | EWFMDLNLP | 98.87 | EWFMDLNMP | 0.56 | | | | |
| E | 507 | 0.1 | 3 | 2 | 0 | Y | WFMDLNLPW | 98.87 | WFTDLNLPW | 0.56 | | | | |
| E | 508 | 0.1 | 3 | 2 | 0 | Y | FMDLNLPWS | 98.87 | FTDLNLPWS | 0.56 | | | | |
| E | 509 | 0.1 | 3 | 2 | 0 | Y | MDLNLPWSS | 98.87 | TDLNLPWSS | 0.56 | | | | |
| E | 510 | 0.21 | 4 | 2 | 0 | Y | DLNLPWSSA | 97.18 | DLNLPWSSP | 2.26 | | | | |
| E | 511 | 0.33 | 5 | 3 | 0 | Y | LNLPWSSAG | 95.48 | LNLPWSSPG | 2.26 | LNLPWSSAE | 1.69 | | |
| E | 512 | 0.42 | 6 | 4 | 0 | Y | NLPWSSAGG | 94.35 | NLPWSSPGN | 2.26 | NLPWSSAES | 1.69 | NLPWSSAGG | 1.13 |
| E | 513 | 0.43 | 5 | 5 | 0 | Y | LPWSSAGST | 94.35 | LPWSSPGNT | 2.26 | LPWSSAESN | 1.69 | LPWSSAGGT | 0.56 | LPWSSAGGN | 0.56 |
| E | 523 | 0.35 | 5 | 4 | 0.56 | Y | WRNRETLME | 94.92 | WRNREALVE | 2.26 | WRNRETLVE | 1.13 | WRNRETFME | 0.56 | |
| E | 524 | 0.34 | 4 | 4 | 0 | Y | RNRETLMEF | 95.48 | RNREALVEF | 2.26 | RNRETLVEF | 1.13 | RNRETFMEF | 0.56 | |
| E | 525 | 0.34 | 4 | 4 | 0 | Y | NRETLMEFE | 95.48 | NREALVEFE | 2.26 | NRETLVEFE | 1.13 | NRETFMEFE | 0.56 | |
| E | 526 | 0.34 | 5 | 4 | 0 | Y | RETLMEFEE | 95.48 | REALVEFEE | 2.26 | RETLVEFEE | 1.13 | RGTLMEFEE | 0.56 | |
| E | 527 | 0.34 | 5 | 4 | 0 | Y | ETLMEFEEP | 95.48 | EALVEFEEA | 2.26 | ETLVEFEEP | 1.13 | GTLMEFEEP | 0.56 | |
| E | 528 | 0.29 | 5 | 3 | 0 | Y | TLMEFEEPH | 96.05 | ALVEFEEAH | 2.26 | TLVEFEEPH | 1.13 | | | |
| E | 529 | 0.29 | 4 | 3 | 0 | Y | LMEFEEPHA | 96.05 | LVEFEEAHA | 2.26 | LVEFEEPHA | 1.13 | | | |
| E | 530 | 0.24 | 4 | 3 | 0 | Y | MEFEEPHAT | 96.61 | VEFEEAHAT | 2.26 | VEFEEPHAT | 1.13 | | | |
| E | 531 | 0.16 | 3 | 2 | 0 | Y | EFEEPHATK | 97.74 | EFEEAHATK | 2.26 | | | | | |
| E | 532 | 0.21 | 2 | 2 | 0 | Y | FEEPHATKQ | 97.18 | FEEAHATKQ | 2.26 | | | | | |
| E | 533 | 0.21 | 3 | 2 | 0 | Y | EEPHATKQS | 97.18 | EEAHATKQS | 2.26 | | | | | |
| E | 534 | 0.21 | 3 | 2 | 0 | Y | EPHATKQSV | 97.18 | EAHATKQSV | 2.26 | | | | | |
| E | 535 | 0.62 | 4 | 3 | 0 | Y | PHATKQSVI | 88.7 | PHATKQSVV | 8.47 | AHATKQSVV | 2.26 | | | |
| E | 536 | 0.54 | 3 | 2 | 0 | Y | HATKQSVIA | 88.7 | HATKQSVVA | 10.73 | | | | | |
| E | 537 | 0.54 | 3 | 2 | 0 | Y | ATKQSVIAL | 88.7 | ATKQSVVAL | 10.73 | | | | | |
| E | 538 | 0.54 | 3 | 2 | 0 | Y | TKQSVIALG | 88.7 | TKQSVVALG | 10.73 | | | | | |
| E | 539 | 0.54 | 3 | 2 | 0 | Y | KQSVIALGS | 88.7 | KQSVVALGS | 10.73 | | | | | |

FIG. 24-18

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 540 | 0.54 | 3 | 2 | 0 | Y | QSVVALGSQ | 88

FIG. 24-19

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 565 | 0.26 | 4 | 3 | 0.56 | Y | SSNTVKLTS | 96.05 | KNSVVKLSS | 2.26 | SSNTVTLTS | 0.56 | | |
| E | 566 | 0.21 | 3 | 2 | 0.56 | Y | SNTVKLTSG | 96.61 | NSVVKLSSG | 2.26 | | | | |
| E | 567 | 0.21 | 3 | 2 | 0.56 | Y | NTVKLTSGH | 96.61 | SVVKLSSGH | 2.26 | | | | |
| E | 568 | 0.21 | 3 | 2 | 0 | Y | TVKLTSGHL | 97.18 | VVKLSSGHL | 2.26 | | | | |
| E | 569 | 0.21 | 3 | 2 | 0 | Y | VKLTSGHLK | 97.18 | VKLSSGHLK | 2.26 | | | | |
| E | 570 | 0.21 | 2 | 2 | 0 | Y | KLTSGHLKC | 97.74 | KLSSGHLKC | 2.26 | | | | |
| E | 571 | 0.16 | 2 | 2 | 0 | Y | LTSGHLKCR | 97.74 | LSSGHLKCR | 2.26 | | | | |
| E | 572 | 0.16 | 2 | 2 | 0 | Y | TSGHLKCRV | 97.74 | SSGHLKCRV | 2.26 | | | | |
| E | 573 | 0.29 | 3 | 2 | 0 | Y | SGHLKCRVK | 94.92 | SGHLKCRVR | 2.26 | | | | |
| E | 574 | 0.29 | 3 | 2 | 0 | Y | GHLKCRVKM | 94.92 | GHLKCRVRM | 5.08 | | | | |
| E | 575 | 0.34 | 3 | 2 | 0 | Y | HLKCRVKME | 94.35 | HLKCRVRME | 5.08 | | | | |
| E | 576 | 0.34 | 3 | 2 | 0 | Y | LKCRVKMEK | 94.35 | LKCRVRMEK | 5.08 | | | | |
| E | 577 | 0.34 | 3 | 2 | 0 | Y | KCRVKMEKL | 94.35 | KCRVRMEKL | 5.08 | | | | |
| E | 578 | 0.49 | 4 | 3 | 0.56 | Y | CRVKMEKLQ | 92.09 | CRVRMEKLQ | 5.08 | CRVKMEKLK | 2.26 | | |
| E | 579 | 0.5 | 4 | 3 | 0.56 | Y | RVKMEKLQL | 91.53 | RVRMEKLQL | 5.08 | RVKMEKLKL | 2.26 | | |
| E | 580 | 0.5 | 4 | 3 | 0.56 | Y | VKMEKLQLK | 91.53 | VRMEKLQLK | 5.08 | VKMEKLKLK | 2.26 | | |
| E | 581 | 0.5 | 4 | 3 | 0.56 | Y | KMEKLQLKG | 91.53 | RMEKLQLKG | 5.08 | KMEKLKLKG | 2.26 | | |
| E | 582 | 0.21 | 3 | 3 | 0.56 | Y | MEKLQLKGT | 96.61 | MEKLKLKGT | 2.26 | | | | |
| E | 583 | 0.21 | 3 | 3 | 0.56 | Y | EKLQLKGTT | 96.61 | EKLKLKGTT | 2.26 | | | | |
| E | 584 | 0.19 | 2 | 2 | 0.56 | Y | KLQLKGTTY | 96.61 | KLKLKGTTY | 2.82 | | | | |
| E | 585 | 0.19 | 2 | 2 | 0.56 | Y | LQLKGTTYG | 96.61 | LKLKGTTYG | 2.82 | | | | |
| E | 586 | 0.19 | 2 | 2 | 0.56 | Y | QLKGTTYGV | 96.61 | KLKGTTYGV | 2.82 | | | | |
| E | 587 | 0 | 1 | 1 | 0 | Y | LKGTTYGVC | 99.44 | | | | | | |
| E | 588 | 0.19 | 2 | 2 | 0 | Y | KGTTYGVCS | 97.18 | KGTTYGVCA | 2.82 | | | | |
| E | 589 | 0.19 | 2 | 2 | 0 | Y | GTTYGVCSK | 97.18 | GTTYGVCAK | 2.82 | | | | |

FIG. 24-20

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 590 | 0.19 | 2 | 2 | 0 | Y | TTYGVCSKA | 97.18 | TTYGVCAKA | 2.82 | | | | |
| E | 591 | 0.19 | 2 | 2 | 0 | Y | TYGVCSKAF | 97.18 | TYGVCAKAF | 2.82 | | | | |
| E | 592 | 0.33 | 4 | 3 | 0 | Y | YGVCSKAFK | 95.48 | YGVCAKAFR | 2.26 | YGVCSKAFR | 1.69 | | |
| E | 593 | 0.33 | 4 | 3 | 0.56 | Y | GVCSKAFKF | 94.92 | GVCAKAFRF | 2.26 | GVCSKAFRF | 1.69 | | |
| E | 603 | 0.39 | 4 | 3 | 0 | Y | GTPADTGHG | 94.35 | RTPADTGHG | 2.82 | NTPADTGHG | 2.26 | | |
| E | 604 | 0.05 | 2 | 1 | 0 | Y | TPADTGHGT | 99.44 | | | | | | |
| E | 605 | 0 | 1 | 1 | 0 | Y | PADTGHGTV | 100 | | | | | | |
| E | 606 | 0 | 1 | 1 | 0 | Y | ADTGHGTVW | 100 | | | | | | |
| E | 607 | 0.16 | 2 | 2 | 0 | Y | DTGHGTVWL | 97.74 | DTGHGTVWM | 2.26 | | | | |
| E | 608 | 0.16 | 2 | 2 | 0 | Y | TGHGTVWLE | 97.74 | TGHGTVWME | 2.26 | | | | |
| E | 609 | 0.16 | 2 | 2 | 0 | Y | GHGTVWLEL | 97.74 | GHGTVWMEL | 2.26 | | | | |
| E | 610 | 0.16 | 2 | 2 | 0 | Y | HGTVWLELQ | 97.74 | HGTVWMELQ | 2.26 | | | | |
| E | 611 | 0.16 | 2 | 2 | 0 | Y | GTVWLELQY | 97.74 | GTVWMELQY | 2.26 | | | | |
| E | 612 | 0.16 | 2 | 2 | 0 | Y | TVWLELQYT | 97.74 | TVWMELQYT | 2.26 | | | | |
| E | 613 | 0.16 | 2 | 2 | 0 | Y | VWLELQYTG | 97.74 | VWMELQYTG | 2.26 | | | | |
| E | 614 | 0.24 | 3 | 2 | 0 | Y | WLELQYTGT | 96.61 | WMELQYTGT | 2.26 | VLELQYTGK | 1.13 | | |
| E | 615 | 0.24 | 3 | 2 | 0 | Y | LELQYTGTD | 96.61 | MELQYTGTD | 2.26 | LELQYTGKD | 1.13 | | |
| E | 616 | 0.09 | 2 | 2 | 0 | Y | ELQYTGTDG | 98.87 | ELQYTGKDG | 1.13 | | | | |
| E | 617 | 0.09 | 2 | 2 | 0 | Y | LQYTGTDGP | 98.87 | LQYTGKDGP | 1.13 | | | | |
| E | 618 | 0.09 | 2 | 2 | 0 | Y | QYTGTDGPC | 98.87 | QYTGKDGPC | 1.13 | | | | |
| E | 619 | 0.09 | 2 | 2 | 0 | Y | YTGTDGPCK | 98.87 | YTGKDGPCK | 1.13 | | | | |
| E | 620 | 0.35 | 3 | 2 | 0 | Y | TGTDGPCKV | 94.35 | TGTDGPCKI | 4.52 | TGKDGPCKV | 1.13 | | |
| E | 621 | 0.35 | 3 | 2 | 0 | Y | GTDGPCKVP | 94.35 | GTDGPCKIP | 4.52 | GKDGPCKVP | 1.13 | | |
| E | 622 | 0.4 | 3 | 3 | 0 | Y | TDGPCKVPI | 93.79 | TDGPCKIPI | 4.52 | KDGPCKVPI | 1.13 | | |
| E | 623 | 0.36 | 4 | 3 | 0 | Y | DGPCKVPIS | 94.92 | DGPCKIPIS | 2.26 | DGPCKIPIT | 2.26 | | |

FIG. 24-21

Species: WNV (9-mers)

| protein | block starting position |

FIG. 24-22

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 649 | 0.43 | 6 | 5 | 0 | Y | NPFYSVATA | 94.35 | NPFVSVSTA | 1.69 | NPFVSMATA | 0.56 | NPFVAAATA | 0.56 |
| E | 656 | 0.72 | 6 | 5 | 0 | Y | TANAKVLIE | 87.57 | TANAKILVE | 2.26 | AANAKVLIE | 0.56 | TADAKVLIE | 0.56 |
| E | 657 | 0.67 | 5 | 4 | 0 | Y | ANAKVLIEL | 88.14 | ANAKILVEL | 2.26 | ADAKVLIEL | 0.56 | | |
| E | 658 | 0.67 | 5 | 4 | 0 | Y | NAKVLIELE | 88.14 | NAKILVELE | 2.26 | DAKVLIELE | 0.56 | | |
| E | 659 | 0.62 | 4 | 3 | 0 | Y | AKVLIELEP | 88.7 | AKILVELEP | 2.26 | | | | |
| E | 660 | 0.21 | 3 | 2 | 0 | Y | KVLIELEPP | 97.18 | KILVELEPP | 2.26 | | | | |
| E | 661 | 0.21 | 3 | 2 | 0 | Y | VLIELEPPF | 97.18 | ILVELEPPF | 2.26 | | | | |
| E | 662 | 0.19 | 2 | 2 | 0 | Y | LIELEPPFG | 97.18 | LVELEPPFG | 2.82 | | | | |
| E | 663 | 0.19 | 2 | 2 | 0 | Y | IELEPPFGD | 97.18 | VELEPPFGD | 2.82 | | | | |
| E | 664 | 0 | 1 | 1 | 0 | Y | ELEPPFGDS | 100 | | | | | | |
| E | 665 | 0 | 1 | 1 | 0 | Y | LEPPFGDSY | 100 | | | | | | |
| E | 666 | 0 | 1 | 1 | 0 | Y | EPPFGDSYI | 100 | | | | | | |
| E | 667 | 0 | 1 | 1 | 0 | Y | PPFGDSYIV | 100 | | | | | | |
| E | 668 | 0.16 | 2 | 2 | 0 | Y | PFGDSYIVW | 97.74 | PFGDSYIVI | 2.26 | | | | |
| E | 669 | 0.16 | 2 | 2 | 0 | Y | FGDSYIVWG | 97.74 | FGDSYIVIG | 2.26 | | | | |
| E | 670 | 0.16 | 2 | 2 | 0 | Y | GDSYIVWGR | 97.74 | GDSYIVIGK | 2.26 | | | | |
| E | 671 | 0.16 | 2 | 2 | 0 | Y | DSYIVWGRG | 97.74 | DSYIVIGKG | 2.26 | | | | |
| E | 672 | 0.21 | 3 | 2 | 0 | Y | SYIVWGRGE | 97.74 | SYIVIGKGD | 2.26 | | | | |
| E | 673 | 0.21 | 3 | 2 | 0 | Y | YIVWGRGEQ | 97.18 | YIVIGKGDQ | 2.26 | | | | |
| E | 674 | 0.21 | 3 | 2 | 0 | Y | IVWGRGEQQ | 97.18 | IVIGKGDQQ | 2.26 | | | | |
| E | 675 | 0.21 | 3 | 2 | 0 | Y | VWGRGEQQI | 97.18 | VIGKGDQQV | 2.26 | | | | |
| E | 676 | 0.26 | 4 | 3 | 0 | Y | VGRGEQQIN | 96.61 | IGKGDQQVT | 2.26 | | | VGRGEHQIN | 0.56 |
| E | 677 | 0.26 | 4 | 3 | 0 | Y | GRGEQQINH | 96.61 | GKGDQQVTH | 2.26 | | | GRGEHQINH | 0.56 |
| E | 678 | 0.26 | 4 | 3 | 0 | Y | RGEQQINHH | 96.61 | KGDQQVTHH | 2.26 | | | RGEHQINHH | 0.56 |
| E | 679 | 0.26 | 4 | 3 | 0 | Y | GEQQINHHW | 96.61 | GDQQVTHHW | 2.26 | | | GEHQINHHW | 0.56 |

FIG. 24-23

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 680 | 0.31 | 5 | 4 | 0 | Y | EQQINHHWH | 96.05 | DQQINHHWH | 2.26 | EQQISHHWH | 0.56 | EQQINHHWY | 0.56 |
| E | 681 | 0.31 | 5 | 4 | 0 | Y | QQINHHWHK | 96.05 | QQVTHHWHK | 2.26 | QQINHHWYK | 0.56 | HQINHHWHK | 0.56 |
| E | 682 | 0.26 | 4 | 3 | 0 | Y | QINHHWHKS | 96.61 | QVTHHWHKS | 2.26 | QINHHWYKS | 0.56 | | |
| E | 683 | 0.26 | 4 | 3 | 0 | Y | INHHWHKSG | 96.61 | VTHHWHKSG | 2.26 | INHHWYKSG | 0.56 | | |
| E | 684 | 0.31 | 5 | 4 | 0 | Y | NHHWHKSGS | 96.05 | THHWHKSGS | 2.26 | NHHWYKSGS | 0.56 | NHHWHKSGI | 0.56 |
| E | 685 | 0.1 | 3 | 2 | 0 | Y | HHWHKSGSS | 98.87 | HHWYKSGSS | 0.56 | | | | |
| E | 686 | 0.1 | 3 | 2 | 0 | Y | HWHKSGSSI | 98.87 | HWYKSGSSI | 0.56 | | | | |
| E | 687 | 0.1 | 3 | 2 | 0 | Y | WHKSGSSIG | 98.87 | WHKSGISIG | 0.56 | | | | |
| E | 688 | 0.1 | 3 | 2 | 0 | Y | HKSGSSIGK | 98.87 | YKSGSSIGK | 0.56 | | | | |
| E | 689 | 0.05 | 2 | 1 | 0 | Y | KSGSSIGKA | 99.44 | | | | | | |
| E | 690 | 0.05 | 2 | 1 | 0 | Y | SGSSIGKAF | 99.44 | | | | | | |
| E | 691 | 0.21 | 3 | 2 | 0 | Y | GSSIGKAFT | 97.18 | GSSIGKAFA | 2.26 | | | | |
| E | 692 | 0.33 | 4 | 3 | 0 | Y | SSIGKAFTT | 95.48 | SSIGKAFAT | 2.26 | SSIGKAFTA | 1.69 | | |
| E | 693 | 0.28 | 3 | 3 | 0 | Y | SIGKAFTTT | 96.05 | SIGKAFATT | 2.26 | SIGKAFTAT | 1.69 | | |
| E | 694 | 0.28 | 3 | 3 | 0 | Y | IGKAFTTTL | 96.05 | IGKAFATTL | 2.26 | IGKAFTATL | 1.69 | | |
| E | 695 | 0.67 | 4 | 4 | 0 | Y | GKAFTTTLK | 88.14 | GKAFATTLQ | 7.91 | GKAFATTLR | 2.26 | GKAFTATLK | 1.69 |
| E | 696 | 0.67 | 4 | 4 | 0 | Y | KAFTTTLKG | 88.14 | KAFATTLQG | 7.91 | KAFATTTLR | 2.26 | KAFTATLKG | 1.69 |
| E | 697 | 0.67 | 4 | 4 | 0 | Y | AFTTTLKGA | 88.14 | AFATTLQGA | 7.91 | AFTTTLRGA | 2.26 | AFTATLKGA | 1.69 |
| E | 698 | 0.67 | 4 | 4 | 0 | Y | FTTTLKGAQ | 88.14 | FATTLQGAQ | 7.91 | FTTTLRGAQ | 2.26 | FTATLKGAQ | 1.69 |
| E | 699 | 0.67 | 4 | 4 | 0 | Y | TTTLKGAQR | 88.14 | ATTLQGAQR | 7.91 | TTTLRGAQR | 2.26 | TATLKGAQR | 1.69 |
| E | 700 | 0.67 | 4 | 4 | 0 | Y | TTLKGAQRL | 88.14 | TTLQGAQRL | 7.91 | TTLRGAQRL | 2.26 | ATLKGAQRL | 1.69 |
| E | 701 | 0.55 | 3 | 3 | 0 | Y | TLKGAQRLA | 89.83 | TLQGAQRLA | 7.91 | TLRGAQRLA | 2.26 | | |
| E | 702 | 0.55 | 3 | 3 | 0 | Y | LKGAQRLAA | 89.83 | LQGAQRLVS | 7.91 | LRGAQRLAA | 2.26 | | |
| E | 703 | 0.55 | 3 | 3 | 0 | Y | KGAQRLAAL | 89.83 | QGAQRLVSL | 7.91 | RGAQRLAAL | 2.26 | | |
| E | 704 | 0.16 | 2 | 2 | 0 | Y | GAQRLAALG | 97.74 | GAQRLVSLG | 2.26 | | | | |

FIG. 24-24

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 24-25

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 730 | 0.68 | 4 | 3 | 0 | Y | KAVHQVFGG | 87.01 | KAIHQVFGG | 10.17 | KAVHQLFGG | 2.26 |
| E | 731 | 0.64 | 3 | 3 | 0 | Y | AVHQVFGGA | 87.01 | AIHQVFGGA | 10.73 | AVHQLFGGA | 2.26 |
| E | 732 | 0.64 | 3 | 3 | 0 | Y | VHQVFGGAF | 87.01 | IHQVFGGAF | 10.73 | VHQLFGGAF | 2.26 |
| E | 733 | 0.16 | 2 | 2 | 0 | Y | HQVFGGAFR | 97.74 | HQLFGGAFR | 2.26 | QVFGGAFRL | 1.69 |
| E | 734 | 0.28 | 3 | 3 | 0 | Y | QVFGGAFRS | 96.05 | QLFGGAFRS | 2.26 | VFGGAFRLL | 1.69 |
| E | 735 | 0.28 | 3 | 3 | 0 | Y | VFGGAFRSL | 96.05 | LFGGAFRSL | 2.26 | | |
| E | 736 | 0.12 | 2 | 2 | 0 | Y | FGGAFRSLF | 98.31 | FGGAFRLLF | 1.69 | | |
| E | 737 | 0.12 | 2 | 2 | 0 | Y | GGAFRSLFG | 98.31 | GGAFRLLFG | 1.69 | | |
| E | 738 | 0.12 | 2 | 2 | 0 | Y | GAFRSLFGG | 98.31 | GAFRLLFGG | 1.69 | | |
| E | 739 | 0.12 | 2 | 2 | 0 | Y | AFRSLFGGM | 98.31 | AFRLLFGGM | 1.69 | | |
| E | 740 | 0.12 | 2 | 2 | 0 | Y | FRSLFGGMS | 98.31 | FRLLFGGMS | 1.69 | | |
| E | 741 | 0.12 | 2 | 2 | 0 | Y | RSLFGGMSW | 98.31 | RLLFGGMSW | 1.69 | | |
| E | 742 | 0.12 | 2 | 2 | 0 | Y | SLFGGMSWI | 98.31 | LLFGGMSWI | 1.69 | | |
| E | 743 | 0 | 1 | 1 | 0 | Y | LFGGMSWIT | 100 | | | | |
| E | 744 | 0 | 1 | 1 | 0 | Y | FGGMSWITQ | 100 | | | | |
| E | 745 | 0 | 1 | 1 | 0 | Y | GGMSWITQG | 100 | | | | |
| E | 746 | 0 | 1 | 1 | 0 | Y | GMSWITQGL | 100 | | | | |
| E | 747 | 0.05 | 2 | 1 | 0 | Y | MSWITQGLL | 99.44 | | | | |
| E | 748 | 0.05 | 2 | 1 | 0 | Y | SWITQGLLG | 99.44 | | | | |
| E | 749 | 0.05 | 2 | 1 | 0 | Y | WITQGLLGA | 99.44 | | | | |
| E | 750 | 0.05 | 2 | 1 | 0 | Y | ITQGLLGAL | 99.44 | | | | |
| E | 751 | 0.05 | 2 | 1 | 0 | Y | TQGLLGALL | 99.44 | | | | |
| E | 752 | 0.05 | 2 | 1 | 0 | Y | QGLLGALLL | 99.44 | | | | |
| E | 753 | 0.05 | 2 | 1 | 0 | Y | GLLGALLLW | 99.44 | | | | |
| E | 754 | 0.05 | 2 | 1 | 0 | Y | LLGALLLWM | 99.44 | | | | |

FIG. 24-26

Species: WNV (9-mers)

| protein | block starting position | block entropy | total peptides in block | # peptides required to cover 99% of block | gap/X fraction | 99% of block covered w/ <=5 pe

FIG. 24-27

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 780 | 0.2 | 5 | 4 | 0 | Y | GVLLF

FIG. 24-28

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|

FIG. 24-29

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 845 | 0.31 | 5 | 4 | 0.56 | Y | VCGLRSVSR | 95.48 | VCGVRSVSR | 2.26 | ICGLRSVSR | 0.56 | VCGLRSASR | 0.56 | | |
| NS1 | 846 | 0.26 | 4 | 3 | 0.56 | Y | CGLRSVSRL | 96.05 | CGVRSVSRL | 2.26 | CGLRSASRL | 0.56 | | | | |
| NS1 | 847 | 0.26 | 4 | 3 | 0 | Y | GLRSVSRLE | 96.61 | GVRSVSRLE | 2.26 | GLRSASRLE | 0.56 | | | | |
| NS1 | 848 | 0.26 | 4 | 3 | 0 | Y | LRSVSRLEH | 96.61 | VRSVSRLEH | 2.26 | IRSVSRLEH | 0.56 | | | | |
| NS1 | 849 | 0.05 | 2 | 1 | 0 | Y | RSVSRLEHQ | 99.44 | | | | | | | | |
| NS1 | 850 | 0.05 | 2 | 1 | 0 | Y | SVSRLEHQM | 99.44 | | | | | | | | |
| NS1 | 851 | 0.05 | 2 | 1 | 0 | Y | VSRLEHQMW | 99.44 | | | | | | | | |
| NS1 | 852 | 0.14 | 3 | 2 | 0 | Y | SRLEHQMWE | 98.31 | SRLEHQMWD | 1.13 | | | | | | |
| NS1 | 853 | 0.68 | 4 | 3 | 0 | Y | RLEHQMWEA | 85.88 | RLEHQMWES | 12.43 | RLEHQMWDS | 1.13 | | | | |
| NS1 | 854 | 1.12 | 6 | 5 | 0 | Y | LEHQMWEAV | 78.53 | LEHQMWESV | 10.17 | LEHQMWEAI | 7.34 | LEHQMWESI | 2.26 | LEHQMWDSV | 1.13 |
| NS1 | 855 | 1.13 | 6 | 5 | 0.56 | Y | EHQMWEAVK | 77.97 | EHQMWESVK | 10.17 | EHQMWEAIK | 7.34 | EHQMWESIK | 2.26 | EHQMWDSVK | 1.13 |
| NS1 | 856 | 1.13 | 6 | 5 | 0.56 | Y | HQMWEAVKD | 77.97 | HQMWESVKD | 10.17 | HQMWEAIKD | 7.34 | HQMWESIKD | 2.26 | HQMWDSVKD | 1.13 |
| NS1 | 857 | 1.13 | 6 | 5 | 0.56 | Y | QMWEAVKDE | 77.97 | QMWESVKDE | 10.17 | QMWEAIKDE | 7.34 | QMWESIKDE | 2.26 | QMWDSVKDE | 1.13 |
| NS1 | 858 | 1.13 | 6 | 5 | 0.56 | Y | MWEAVKDEL | 77.97 | MWESVKDEL | 10.17 | MWEAIKDEL | 7.34 | MWESIKDEL | 2.26 | MWDSVKDEL | 1.13 |
| NS1 | 859 | 1.13 | 6 | 5 | 0.56 | Y | WEAVKDELN | 77.97 | WESVKDELN | 10.17 | WEAIKDELN | 7.34 | WESIKDELN | 2.26 | WDSVKDELN | 1.13 |
| NS1 | 860 | 1.09 | 6 | 5 | 0.56 | Y | EAVKDELNT | 77.97 | ESVKDELNT | 10.17 | EAIKDELNT | 7.34 | ESIKDELNT | 2.26 | DSVKDELNT | 1.13 |
| NS1 | 861 | 1.09 | 5 | 4 | 0.56 | Y | AVKDELNTL | 77.4 | SVKDELNTL | 11.3 | AIKDELNTL | 7.91 | SIKDELNTL | 2.26 | | |
| NS1 | 862 | 0.58 | 4 | 3 | 0.56 | Y | VKDELNTLL | 88.14 | IKDELNTLL | 10.17 | | | | | | |
| NS1 | 863 | 0.1 | 3 | 2 | 0 | Y | KDELNTLLK | 98.31 | KDELNTLFR | 0.56 | | | | | | |
| NS1 | 864 | 0.1 | 2 | 2 | 0 | Y | DELNTLLKE | 98.87 | DELNTLFRE | 0.56 | | | | | | |
| NS1 | 865 | 0.1 | 3 | 2 | 0 | Y | ELNTLLKEN | 98.87 | ELNTPLKEN | 0.56 | | | | | | |
| NS1 | 866 | 0.1 | 2 | 2 | 0 | Y | LNTLLKENG | 98.87 | LNTLFRENG | 0.56 | | | | | | |
| NS1 | 867 | 0.19 | 4 | 3 | 0 | Y | NTLLKENGV | 97.74 | NTLLKENGI | 1.13 | NTLFRENGI | 0.56 | | | | |
| NS1 | 868 | 0.19 | 4 | 3 | 0 | Y | TLLKENGID | 97.74 | TLLKENGID | 1.13 | TLFRENGID | 0.56 | | | | |
| NS1 | 869 | 0.24 | 5 | 4 | 0 | Y | LLKENGVDL | 97.18 | LLKENGIDL | 1.13 | LLKENGVDF | 0.56 | PLKENGVDL | 0.56 | | |

FIG. 24-30

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 870 | 0.24 | 5 | 4 | 0 | Y | LKENGVDLS | 97.18 | LKENGVDLS | 1.13 | LKENGVDFS | 0.56 | | | | |
| NS1 | 871 | 0.5 | 5 | 5 | 0 | Y | KENGVDLSV | 92.66 | KENGVDLSI | 4.52 | KENGIDLS | 1.13 | FRENGIDLS | 0.56 | KENGVDFSV | 0.56 |
| NS1 | 872 | 0.5 | 6 | 5 | 0 | Y | ENGVDLSVV | 92.66 | ENGIDLSIV | 4.52 | ENGIDLSIV | 1.13 | RENGIDLSM | 0.56 | ENGVDFSVV | 0.56 |
| NS1 | 873 | 0.5 | 6 | 5 | 0 | Y | NGVDLSVVV | 92.66 | NGIDLSIVV | 4.52 | NGIDLSIVV | 1.13 | ENGVDLTVV | 0.56 | NGVDFSVVV | 0.56 |
| NS1 | 874 | 0.5 | 6 | 5 | 0 | Y | GVDLSVVVE | 92.66 | GIDLSIVVE | 4.52 | GIDLSIVVE | 1.13 | NGVDLTVVV | 0.56 | GVDFSVVVE | 0.56 |
| NS1 | 875 | 0.5 | 6 | 5 | 0 | Y | VDLSVVVEK | 92.66 | IDLSIVVEK | 4.52 | IDLSIVVEK | 1.13 | GVDLTVVVE | 0.56 | IDLSMVVEK | 0.56 |
| NS1 | 876 | 0.46 | 6 | 4 | 0 | Y | DLSVVVEKQ | 92.66 | DLSIVVEKQ | 5.65 | DLTVVVEKQ | 0.56 | VDLTVVVEK | 0.56 | | |
| NS1 | 897 | 0.72 | 5 | 5 | 0 | Y | ATEKLEIG | 87.57 | ATEKLEMG | 8.47 | ATENLEIG | 2.26 | ATSEKLEIG | 0.56 | ATTDKLEIG | 0.56 |
| NS1 | 898 | 0.72 | 6 | 5 | 0 | Y | TTEKLEIGW | 87.57 | TTEKLEMGW | 8.47 | TTENLEIGW | 2.26 | TEKFEIGW | 0.56 | TTDKLEIGW | 0.56 |
| NS1 | 899 | 0.72 | 6 | 5 | 0 | Y | TEKLEIGWK | 87.57 | TEKLEMGWK | 8.47 | TENLEIGWK | 2.26 | TEKFEIGWK | 0.56 | SEKLEIGWK | 0.56 |
| NS1 | 900 | 0.67 | 5 | 4 | 0 | Y | EKLEIGWKA | 88.14 | EKLEMGWKA | 8.47 | ENLEIGWKA | 2.26 | EKFEIGWKA | 0.56 | | |
| NS1 | 901 | 0.62 | 4 | 3 | 0 | Y | KLEIGWKAW | 88.7 | KLEMGWKAW | 8.47 | NLEIGWKAW | 2.26 | | | | |
| NS1 | 902 | 0.47 | 3 | 2 | 0 | Y | LEIGWKAWG | 90.96 | LEMGWKAWG | 8.47 | | | | | | |
| NS1 | 903 | 0.42 | 2 | 2 | 0 | Y | EIGWKAWGK | 91.53 | EMGWKAWGK | 8.47 | | | | | | |
| NS1 | 904 | 0.42 | 2 | 2 | 0 | Y | IGWKAWGKS | 91.53 | MGWKAWGKS | 8.47 | | | | | | |
| NS1 | 905 | 0 | 1 | 1 | 0 | Y | GWKAWGKSI | 100 | | | | | | | | |
| NS1 | 906 | 0.54 | 3 | 2 | 0 | Y | WKAWGKSIL | 88.7 | WKAWGKSII | 10.73 | | | | | | |
| NS1 | 907 | 0.54 | 3 | 2 | 0 | Y | KAWGKSILF | 88.7 | KAWGKSIIF | 10.73 | | | | | | |
| NS1 | 908 | 0.54 | 3 | 2 | 0 | Y | AWGKSILFA | 88.7 | AWGKSIIFA | 10.73 | | | | | | |
| NS1 | 909 | 0.54 | 3 | 2 | 0 | Y | WGKSILFAP | 88.7 | WGKSIIFAP | 10.73 | | | | | | |
| NS1 | 910 | 0.54 | 3 | 2 | 0 | Y | GKSILFAPE | 88.7 | GKSIIFAPE | 10.73 | | | | | | |
| NS1 | 911 | 0.62 | 5 | 4 | 0 | Y | KSILFAPEL | 88.14 | KSIIFAPEL | 10.17 | KSIIFAPEI | 0.56 | KSIIFAPEI | 0.56 | | |
| NS1 | 912 | 0.62 | 5 | 4 | 0 | Y | SILFAPELA | 88.14 | SIIFAPELA | 10.17 | SIIFAPELA | 0.56 | SILFAPELA | 0.56 | | |
| NS1 | 913 | 0.62 | 5 | 4 | 0 | Y | ILFAPELAN | 88.14 | IIFAPELAN | 10.17 | IIFAPELAN | 0.56 | IMFASELAN | 0.56 | | |
| NS1 | 914 | | | | | | | | | | | | | | | |
| NS1 | 915 | 0.34 | 5 | 4 | 0 | Y | FAPELANHT | 95.48 | FAPELANHT | 2.26 | FAPELANNT | 1.13 | FASELANHT | 1.13 | | |

FIG. 24-31

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | fr

FIG. 24-32

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 24-33

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 984 | 0.49 | 2 | 2 | 0 | Y | AIHSDLSYW | 89.27 | AVHSDLSYW | 10.73 | | | | |
| NS1 | 985 | 0.49 | 2 | 2 | 0 | Y | IHSDLSYWI | 89.27 | VHSDLSYWI | 10.73 | | | | |
| NS1 | 986 | 0 | 1 | 1 | 0 | Y | HSDLSYWIE | 100 | | | | | | |
| NS1 | 987 | 0 | 1 | 1 | 0 | Y | SDLSYWIES | 100 | | | | | | |
| NS1 | 988 | 0.51 | 2 | 2 | 0 | Y | DLSYWIESR | 88.7 | DLSYWIESG | 11.3 | | | | |
| NS1 | 989 | 0.8 | 4 | 4 | 0 | Y | LSYWIESRL | 84.75 | LSYWIESGL | 10.17 | LSYWIESRF | 3.95 | LSYWIESGF | 1.13 |
| NS1 | 990 | 0.83 | 5 | 4 | 0 | Y | SYWIESRLN | 84.75 | SYWIESGLN | 9.6 | SYWIESRFN | 3.95 | SYWIESGFN | 1.13 |
| NS1 | 997 | 0.62 | 6 | 5 | 0 | Y | LNDTWKLER | 90.96 | FNDTWKLER | 3.95 | LNETWKLER | 2.26 | FNETWKLER | 1.13 |
| NS1 | 998 | 0.35 | 4 | 3 | 0 | Y | NDTWKLERA | 94.92 | NETWKLERA | 3.39 | NHTWKLERA | 1.13 | | |
| NS1 | 999 | 0.33 | 3 | 3 | 0 | Y | DTWKLERAV | 94.92 | ETWKLERAV | 3.95 | HTWKLERAV | 1.13 | LNHTWKLER | 1.13 |
| NS1 | 1000 | 0 | 1 | 1 | 0 | Y | TWKLERAVL | 100 | | | | | | |
| NS1 | 1001 | 0 | 1 | 1 | 0 | Y | WKLERAVLG | 100 | | | | | | |
| NS1 | 1002 | 0 | 1 | 1 | 0 | Y | KLERAVLGE | 100 | | | | | | |
| NS1 | 1003 | 0 | 1 | 1 | 0 | Y | LERAVLGEV | 100 | | | | | | |
| NS1 | 1004 | 0 | 1 | 1 | 0 | Y | ERAVLGEVK | 100 | | | | | | |
| NS1 | 1005 | 0 | 1 | 1 | 0 | Y | RAVLGEVKS | 100 | | | | | | |
| NS1 | 1006 | 0 | 1 | 1 | 0 | Y | AVLGEVKSC | 100 | | | | | | |
| NS1 | 1007 | 0 | 1 | 1 | 0 | Y | VLGEVKSCT | 100 | | | | | | |
| NS1 | 1008 | 0 | 1 | 1 | 0 | Y | LGEVKSCTW | 100 | | | | | | |
| NS1 | 1009 | 0 | 1 | 1 | 0 | Y | GEVKSCTWP | 100 | | | | | | |
| NS1 | 1010 | 0 | 1 | 1 | 0 | Y | EVKSCTWPE | 100 | | | | | | |
| NS1 | 1011 | 0 | 1 | 1 | 0 | Y | VKSCTWPET | 100 | | | | | | |
| NS1 | 1012 | 0 | 1 | 1 | 0 | Y | KSCTWPETH | 100 | | | | | | |
| NS1 | 1013 | 0 | 1 | 1 | 0 | Y | SCTWPETHT | 100 | | | | | | |
| NS1 | 1014 | 0 | 1 | 1 | 0 | Y | CTWPETHTL | 100 | | | | | | |

FIG. 24-34

Species: WNV (9-mers)

| protein | block starting position | block

FIG. 24-35

Species: WN

FIG. 24-36

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1069 | 0 | 1 | 1 | 0 | Y | DYCPGTTVT | 100 | | | | | | |
| NS1 | 1070 | 0.47 | 3 | 2 | 0 | Y | YCPGTTVTL | 90.96 | YCPGTTVTI | 8.47 | | | | |
| NS1 | 1071 | 0.52 | 4 | 3 | 0 | Y | CPGTTVTLS | 90.4 | CPGTTVTIS | 8.47 | CPGTTVTYS | 0.56 | | |
| NS1 | 1082 | 1.03 | 6 | 5 | 0 | Y | CGHRGPATR | 80.23 | CGHRGPAAR | 9.04 | CGHRGPAIR | 8.47 | CEHRGPAAR | 1.13 |
| NS1 | 1083 | 1.03 | 6 | 5 | 0 | Y | GHRGPATRT | 80.23 | GHRGPAART | 9.04 | GHRGPAIRT | 8.47 | EHRGPAART | 1.13 |
| NS1 | 1084 | 0.98 | 5 | 4 | 0 | Y | HRGPATRIT | 80.23 | HRGPAARTT | 9.04 | HRGPAIRTT | 8.47 | HRGPSARTT | 0.56 |
| NS1 | 1085 | 0.98 | 5 | 4 | 0 | Y | RGPATRTTT | 80.23 | RGPAARTTT | 9.04 | RGPAIRTTT | 8.47 | RGASTRTTT | 0.56 |
| NS1 | 1086 | 0.98 | 5 | 4 | 0 | Y | GPATRTTTE | 80.23 | GPAARTTTE | 9.04 | GPAIRTTTE | 8.47 | GPSARTTTE | 0.56 |
| NS1 | 1087 | 0.98 | 5 | 4 | 0 | Y | PATRTTTES | 80.23 | PAARTTTES | 9.04 | PAIRTTTES | 8.47 | ASTRTTTDS | 0.56 |
| NS1 | 1088 | 0.98 | 5 | 4 | 0.56 | Y | ATRTTTESG | 79.66 | AARTTTESG | 9.04 | AIRTTTESG | 8.47 | STRTTTDSG | 0.56 |
| NS1 | 1089 | 0.95 | 4 | 3 | 0.56 | Y | TRTTTESGK | 79.66 | ARTTTESGK | 9.04 | IRTTTESGK | 8.47 | | |
| NS1 | 1090 | 0.05 | 2 | 1 | 0.56 | Y | RTTTESGKL | 98.87 | | | | | | |
| NS1 | 1091 | 0.05 | 2 | 1 | 0.56 | Y | TTTESGKLI | 98.87 | | | | | | |
| NS1 | 1092 | 0.21 | 3 | 2 | 0.56 | Y | TTESGKLIT | 96.61 | TTESGKLIS | 2.26 | | | | |
| NS1 | 1093 | 0.21 | 3 | 2 | 0.56 | Y | TESGKLITD | 96.61 | TESGKLISD | 2.26 | | | | |
| NS1 | 1094 | 0.21 | 3 | 2 | 0.56 | Y | ESGKLITDW | 96.61 | ESGKLISDW | 2.26 | | | | |
| NS1 | 1095 | 0.21 | 3 | 2 | 0.56 | Y | SGKLITDWC | 96.61 | SGKLISDWC | 2.26 | | | | |
| NS1 | 1096 | 0.21 | 3 | 2 | 0.56 | Y | GKLITDWCC | 96.61 | GKLISDWCC | 2.26 | | | | |
| NS1 | 1097 | 0.21 | 3 | 2 | 0 | Y | KLITDWCCR | 97.18 | KLISDWCCR | 2.26 | | | | |
| NS1 | 1098 | 0.21 | 3 | 2 | 0 | Y | LITDWCCRS | 97.18 | LISDWCCRS | 2.26 | | | | |
| NS1 | 1099 | 0.21 | 3 | 2 | 0 | Y | ITDWCCRSC | 97.18 | ISDWCCRSC | 2.26 | | | | |
| NS1 | 1100 | 0.21 | 3 | 2 | 0 | Y | TDWCCRSCT | 97.18 | SDWCCRSCT | 2.26 | | | | |
| NS1 | 1101 | 0.05 | 2 | 1 | 0 | Y | DWCCRSCTL | 99.44 | | | | | | |
| NS1 | 1102 | 0.05 | 2 | 1 | 0 | Y | WCCRSCTLP | 99.44 | | | | | | |
| NS1 | 1103 | 0.05 | 2 | 1 | 0 | Y | CCRSCTLPP | 99.44 | | | | | | |

FIG. 24-37

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1104 | 0 | 1 | 1 | 0 | Y | CRSCTLPPL | 100 | | | | | | |
| NS1 | 1105 | 0 | 1 | 1 | 0 | Y | RSCTLPPLR | 100 | | | | | | |
| NS1 | 1106 | 0.4 | 2 | 2 | 0 | Y | SCTLPPLRY | 92.09 | SCTLPLRF | 7.91 | | | | |
| NS1 | 1107 | 0.63 | 5 | 4 | 0 | Y | CTLPPLRYQ | 89.27 | CTLPPLRFQ | 7.34 | CTLPPLRYR | 2.26 | CTLPPLRFK | 0.56 | |
| NS1 | 1108 | 0.63 | 5 | 4 | 0 | Y | TLPPLRYQT | 89.27 | TLPPLRFQT | 7.34 | TLPPLRYRT | 2.26 | TLPPLRFKT | 0.56 | |
| NS1 | 1109 | 0.66 | 6 | 5 | 0.56 | Y | LPPLRYQTD | 89.27 | LPPLRFQTE | 6.78 | LPPLRYRTE | 2.26 | LPPLRFQTR | 0.56 | LPPLRYTTE | 0.56 |
| NS1 | 1116 | 0.73 | 5 | 4 | 0.56 | Y | TDSGCWYGM | 87.01 | TENGCWYGM | 7.34 | TESGCWYGM | 2.82 | TDNGCWYGM | 1.69 | |
| NS1 | 1117 | 0.73 | 5 | 4 | 0.56 | Y | DSGCWYGME | 87.01 | ENGCWYGME | 7.34 | ESGCWYGME | 2.82 | DNGCWYGME | 1.69 | |
| NS1 | 1118 | 0.44 | 2 | 2 | 0.56 | Y | SGCWYGMEI | 90.4 | NGCWYGMEI | 9.04 | | | | | |
| NS1 | 1119 | 0 | 1 | 1 | 0 | Y | GCWYGMEIR | 100 | | | | | | |
| NS1 | 1120 | 0 | 1 | 1 | 0 | Y | CWYGMEIRP | 100 | | | | | | |
| NS1 | 1121 | 0.59 | 3 | 3 | 0 | Y | WYGMEIRPQ | 89.27 | WYGMEIRPT | 6.78 | WYGMEIRPL | 3.95 | | | |
| NS1 | 1122 | 0.67 | 5 | 4 | 0 | Y | YGMEIRPQR | 88.7 | YGMEIRPTR | 6.78 | YGMEIRPLR | 3.39 | YGMEIRPLK | 0.56 | |
| NS1 | 1123 | 0.67 | 5 | 4 | 0 | Y | GMEIRPQRH | 88.7 | GMEIRPTRH | 6.78 | GMEIRPLRH | 3.39 | GMEIRPQKH | 0.56 | |
| NS1 | 1124 | 0.67 | 5 | 4 | 0.56 | Y | MEIRPQRHD | 88.14 | MEIRPTRHD | 6.78 | MEIRPLRHD | 3.39 | MEIRPQKHD | 0.56 | |
| NS1 | 1125 | 0.72 | 6 | 5 | 0.56 | Y | EIRPQRHDE | 87.57 | EIRPTRHDE | 6.78 | EIRPLRHDE | 3.39 | EIRPQKHDE | 0.56 | EIRPLKHDE | 0.56 |
| NS1 | 1126 | 0.72 | 6 | 5 | 0.56 | Y | IRPQRHDEK | 87.57 | IRPTRHDEK | 6.78 | IRPLRHDEK | 3.39 | IRPQKHDGK | 0.56 | IRPQKHDER | 0.56 |
| NS1 | 1127 | 0.72 | 6 | 5 | 0.56 | Y | RPQRHDEKT | 87.57 | RPTRHDEKT | 6.78 | RPLRHDEKT | 3.39 | RPQKHDERT | 0.56 | RPQRHDGKT | 0.56 |
| NS1 | 1128 | 0.72 | 6 | 5 | 0.56 | Y | PQRHDEKTL | 87.57 | PTRHDEKTL | 6.78 | PLRHDEKTL | 3.39 | PQKHDERTL | 0.56 | PQRHDGKTL | 0.56 |
| NS1 | 1129 | 0.72 | 6 | 5 | 0.56 | Y | QRHDEKTLV | 87.57 | TRHDEKTLV | 6.78 | LRHDEKTLV | 3.39 | LKHDEKTLV | 0.56 | QRHDGKTLV | 0.56 |
| NS1 | 1130 | 0.15 | 4 | 3 | 0.56 | Y | RHDEKTLVQ | 97.74 | KHDEKTLVQ | 0.56 | RHDGKTLVQ | 0.56 | | | |
| NS1 | 1131 | 0.1 | 3 | 2 | 0.56 | Y | HDEKTLVQS | 98.31 | HDGKTLVQS | 0.56 | | | | | |
| NS1 | 1132 | 0.67 | 5 | 4 | 0 | Y | DEKTLVQSQ | 87.57 | DEKTLVQSR | 8.47 | DEKTLVQSK | 2.26 | DERTLVQSQ | 0.56 | |
| NS1 | 1133 | 0.67 | 5 | 4 | 0 | Y | EKTLVQSQV | 88.14 | EKTLVQSRV | 8.47 | EKTLVQSKV | 2.26 | GKTLVQSQV | 0.56 | |
| NS1 | 1134 | 0.65 | 5 | 4 | 0 | Y | KTLVQSQVN | 88.7 | KTLVQSRVN | 7.91 | KTLVQSKVT | 2.26 | RTLVQSQVN | 0.56 | |

FIG. 24-38

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1135 | 0.6 | 4 | 3 | 0 | Y | TLVQSQVNA | 89.27 | TLVQSRVNA | 7.91 | TLVQSKVTA | 2.26 | | | | |
| NS1 | 1136 | 0.63 | 5 | 4 | 0 | Y | LVQSQVNAY | 89.27 | LVQSRVNAY | 7.34 | LVQSKVTAY | 2.26 | LVQSRVNAH | 0.56 | | |
| NS1 | 1137 | 0.63 | 5 | 4 | 0 | Y | VQSQVNAYN | 89.27 | VQSRVNAYN | 7.34 | VQSKVTAYN | 2.26 | VQSRVNAHN | 0.56 | | |
| NS1 | 1138 | 0.63 | 5 | 4 | 0 | Y | QSQVNAYNA | 89.27 | QSRVNAYNA | 7.34 | QSKVTAYNA | 2.26 | QSRVNAHNA | 0.56 | | |
| NS1 | 1139 | 0.68 | 6 | 5 | 0 | Y | SQVNAYNAD | 88.7 | SRVNAYNAD | 7.34 | SKVTAYNAD | 2.26 | SRVSAYKSD | 0.56 | SRVNAHNAD | 0.56 |
| NS1 | 1140 | 0.68 | 6 | 5 | 0 | Y | QVNAYNADM | 88.7 | RVNAYNADM | 7.34 | KVTAYNADM | 2.26 | RVSAYKSDM | 0.56 | RVNAHNADM | 0.56 |
| NS1 | 1141 | 0.31 | 5 | 4 | 0 | Y | VNAYNADMI | 96.05 | VTAYNADMI | 2.26 | VNAHNADMI | 0.56 | VSAYKSDMI | 0.56 | | |
| NS1 | 1142 | 0.31 | 5 | 4 | 0 | Y | NAYNADMID | 96.05 | TAYNADMID | 2.26 | SAYKSDMID | 0.56 | NAHNADMID | 0.56 | | |
| NS1 | 1143 | 0.15 | 4 | 3 | 0 | Y | AYNADMIDP | 98.31 | AHNADMIDP | 0.56 | AYKSDMIDP | 0.56 | | | | |
| NS1 | 1144 | 0.15 | 4 | 3 | 0 | Y | YNADMIDPF | 98.31 | YKSDMIDPF | 0.56 | HNADMIDPF | 0.56 | | | | |
| NS1 | 1145 | 0.1 | 3 | 2 | 0 | Y | NADMIDPFQ | 98.87 | NAEMIDPFQ | 0.56 | | | | | | |
| NS2A | 1146 | 0.1 | 3 | 2 | 0 | Y | ADMIDPFQL | 98.87 | AEMIDPFQL | 0.56 | | | | | | |
| NS2A | 1147 | 0.05 | 2 | 1 | 0 | Y | DMIDPFQLG | 99.44 | | | | | | | | |
| NS2A | 1148 | 0 | 1 | 1 | 0 | Y | MIDPFQLGL | 100 | | | | | | | | |
| NS2A | 1149 | 0.09 | 2 | 2 | 0 | Y | IDPFQLGLL | 98.87 | IDPFQLGLM | 1.13 | | | | | | |
| NS2A | 1150 | 0.14 | 3 | 2 | 0 | Y | DPFQLGLLV | 98.31 | DPFQLGLMV | 1.13 | | | | | | |
| NS2A | 1151 | 0.14 | 3 | 2 | 0 | Y | PFQLGLLVV | 98.31 | PFQLGLMVV | 1.13 | | | | | | |
| NS2A | 1152 | 0.19 | 4 | 3 | 0 | Y | FQLGLLVWF | 97.74 | FQLGLMVWF | 1.13 | FQLGLLVVW | 0.56 | | | | |
| NS2A | 1153 | 0.19 | 4 | 3 | 0 | Y | QLGLLVWFL | 97.74 | QLGLMVWFL | 1.13 | QLGLLVWWL | 0.56 | | | | |
| NS2A | 1154 | 0.24 | 5 | 4 | 0 | Y | LGLLVWFLA | 97.18 | LGLMVWFLA | 1.13 | LGLLVWFLV | 0.56 | LGLLVWFLA | 0.56 | | |
| NS2A | 1155 | 0.24 | 5 | 4 | 0 | Y | GLLVWFLAT | 97.18 | GLMVWFLAT | 1.13 | GLLVWLAT | 0.56 | GLLVWFLAT | 0.56 | | |
| NS2A | 1156 | 0.29 | 6 | 5 | 0 | Y | LLVWFLATQ | 96.61 | LMVWFLATQ | 1.13 | LLVWFLATQ | 0.56 | LLVWFLATQ | 0.56 | LLVWFLVTQ | 0.56 |
| NS2A | 1157 | 0.29 | 6 | 5 | 0 | Y | LVWFLATQE | 96.61 | MVWFLATQE | 1.13 | LVWFLATKE | 0.56 | LVWFLATQE | 0.56 | LVWFLVTQE | 0.56 |
| NS2A | 1158 | 0.2 | 5 | 4 | 0 | Y | VWFLATQEV | 97.74 | VVFLATKEV | 1.13 | VVFLVTQEV | 0.56 | IVFLATQEV | 0.56 | | |
| NS2A | 1159 | 0.15 | 4 | 3 | 0 | Y | VFLATQEVL | 98.31 | VFLVTQEVL | 0.56 | VFLATKEVL | 0.56 | | | | |

FIG. 24-39

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1160 | 0.15 | 4 | 3 | 0 | Y | FLATQEVLR | 98.31 | FLATKEVLR | 0.56 | FLVTQEVLR | 0.56 | | | | |
| NS2A | 1161 | 0.15 | 4 | 3 | 0 | Y | LATQEVLRK | 98.31 | LATKEVLRK | 0.56 | LATQEVLRR | 0.56 | | | | |
| NS2A | 1162 | 0.15 | 4 | 3 | 0 | Y | ATQEVLRKR | 98.31 | VTQEVLRKR | 0.56 | ATKEVLRKR | 0.56 | | | | |
| NS2A | 1163 | 0.1 | 3 | 2 | 0 | Y | TQEVLRKRW | 98.87 | TKEVLRKRW | 0.56 | | | | | | |
| NS2A | 1164 | 0.1 | 3 | 2 | 0 | Y | QEVLRKRWT | 98.87 | KEVLRKRWT | 0.56 | | | | | | |
| NS2A | 1165 | 0.05 | 2 | 1 | 0 | Y | EVLRKRWTA | 99.44 | | | | | | | | |
| NS2A | 1166 | 0.05 | 2 | 1 | 0 | Y | VLRKRWTAK | 99.44 | | | | | | | | |
| NS2A | 1167 | 0.05 | 2 | 1 | 0 | Y | LRKRWTAKI | 99.44 | | | | | | | | |
| NS2A | 1168 | 0.05 | 2 | 1 | 0 | Y | RKRWTAKIS | 99.44 | | | | | | | | |
| NS2A | 1169 | 0.78 | 6 | 5 | 0 | Y | KRWTAKISM | 87.01 | KRWTAKISI | 7.34 | KRWTAKISV | 2.82 | KRWTAKISL | 1.69 | RRWTAKISM | 0.56 |
| NS2A | 1170 | 0.73 | 5 | 4 | 0 | Y | RWTAKISMP | 87.57 | RWTAKISIP | 7.34 | RWTAKISVP | 2.82 | RWTAKISLP | 1.69 | | |
| NS2A | 1171 | 0.73 | 5 | 4 | 0 | Y | WTAKISMPA | 87.57 | WTAKISIPA | 7.34 | WTAKISVPA | 2.82 | WTAKISLPA | 1.69 | | |
| NS2A | 1172 | 0.73 | 5 | 4 | 0 | Y | TAKISMPAI | 87.57 | TAKISIPAI | 7.34 | TAKISVPAI | 2.82 | TAKISLPAI | 1.69 | | |
| NS2A | 1178 | 0.68 | 6 | 5 | 0 | Y | PAILIALLV | 88.7 | PAIMLALLV | 7.34 | PAIIIALLT | 2.26 | PAIMIALLV | 0.56 | PAILLALLV | 0.56 |
| NS2A | 1179 | 0.68 | 5 | 4 | 0 | Y | AILIALLVL | 88.7 | AIMLALLVL | 7.34 | AIILALLTL | 2.26 | AILLALLVL | 0.56 | AILVALAVL | 0.56 |
| NS2A | 1180 | 0.68 | 5 | 4 | 0 | Y | ILIALLVLV | 88.7 | IMLALLVLV | 7.34 | IIIALLTLV | 2.26 | IMIALLVLV | 0.56 | ILVALAVLV | 0.56 |
| NS2A | 1181 | 0.68 | 5 | 4 | 0 | Y | LIALLVLVF | 88.7 | MLALLVLVF | 7.34 | IIALLTLVF | 2.26 | MIALLVLVL | 0.56 | LLALLVLVF | 0.56 |
| NS2A | 1182 | 0.65 | 6 | 5 | 0 | Y | IALLVLVFG | 88.7 | LALLVLVFG | 7.91 | IALLTLVFG | 2.26 | IALLVLVLG | 0.56 | | |
| NS2A | 1183 | 0.26 | 4 | 3 | 0 | Y | ALLVLVFGG | 96.61 | ALLTLVFGG | 2.26 | ALLVLVLGG | 0.56 | | | | |
| NS2A | 1184 | 0.31 | 5 | 4 | 0 | Y | LLVLVFGGI | 96.05 | LLTLVFGGV | 2.26 | LLVLVLGGI | 0.56 | LLVLVFGGV | 0.56 | | |
| NS2A | 1185 | 0.31 | 5 | 4 | 0 | Y | LVLVFGGIT | 96.05 | LLTLVFGGV | 2.26 | AVLVLGGIT | 0.56 | LVLVFGGVT | 0.56 | | |
| NS2A | 1186 | 0.29 | 4 | 3 | 0 | Y | VLVFGGITY | 96.05 | TLVFGGVTY | 2.26 | VLVLGGITY | 0.56 | | | | |
| NS2A | 1187 | 0.37 | 5 | 4 | 0 | Y | LVFGGITYT | 94.92 | LVFGGVTYT | 2.82 | LVLGGITYT | 1.13 | LVFGGITYI | 0.56 | | |
| NS2A | 1188 | 0.37 | 5 | 4 | 0 | Y | VFGGITYTD | 94.92 | VFGGVTYTD | 2.82 | VLGGITYTD | 1.13 | VFGGITYID | 0.56 | | |
| NS2A | 1189 | 0.39 | 6 | 5 | 0 | Y | FGGITYTDV | 94.92 | FGGITYTDL | 2.26 | LGGITYTDV | 1.13 | FGGITYADV | 0.56 | FGGVTYTDV | 0.56 |

FIG. 24-40

Species: WNV (9-mers)

| protein | block starting position | block entropy |

FIG. 24-41

Species: WNV (9

FIG. 24-42

Species: WNV (9

FIG. 24-43

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 24-44

Species: WNV (9-mers)

| protein | block starting position | block entropy | total peptides in block | # peptides required to cover 99% of block | gap/X fraction | 99% of block covered w/ <= 5 pe

FIG. 24-45

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1345 | 0.54 | 3 | 2 | 0 | Y | LLCLALAST | 88.7 | LLCLALAST | 10.73 | | | | |
| NS2A | 1346 | 0.54 | 3 | 2 | 0.56 | Y | LCLALASTG | 88.14 | ICLALASTG | 10.73 | | | | |
| NS2A | 1356 | 0.26 | 4 | 3 | 0 | Y | FNPMILAAG | 96.61 | FNPLILVAG | 2.26 | | | | |
| NS2A | 1357 | 0.26 | 4 | 3 | 0 | Y | NPMILAAGL | 96.61 | NPLILVAGL | 2.26 | | | | |
| NS2A | 1358 | 0.75 | 6 | 5 | 0 | Y | PMILAAGLI | 87.57 | PMILAAGLM | 7.34 | FSPITLAAG | 0.56 | | |
| NS2A | 1361 | 1.19 | 6 | 5 | 0 | Y | LAAGLIACD | 76.84 | LAAGLITCD | 10.73 | SPITLAAGL | 0.56 | | |
| NS2A | 1362 | 1.19 | 6 | 5 | 0 | Y | AAGLIACDP | 76.84 | AAGLITCDP | 10.73 | PLILVAGLL | 2.26 | PMILAAGLV | 1.69 |
| NS2A | 1363 | 1.19 | 6 | 5 | 0 | Y | AGLIACDPN | 76.84 | AGLITCDPN | 10.73 | LAAGLMACD | 7.91 | LVAGLLACD | 2.26 | LAAGLVACD | 1.69 |
| NS2A | 1364 | 1.19 | 6 | 5 | 0 | Y | GLIACDPNR | 76.84 | GLITCDPNR | 10.73 | AAGLMACDP | 7.91 | VAGLLACDP | 2.26 | AAGLVACDP | 1.69 |
| NS2A | 1365 | 1.19 | 6 | 5 | 0 | Y | LIACDPNRK | 76.84 | LITCDPNRK | 10.73 | AGLMACDPN | 7.91 | AGLLACDPN | 2.26 | AGLVACDPN | 1.69 |
| NS2A | 1366 | 1.19 | 6 | 5 | 0 | Y | IACDPNRKR | 76.84 | ITCDPNRKR | 10.73 | GLMACDPNR | 7.91 | GLLACDPNR | 2.26 | GLVACDPNR | 1.69 |
| NS2A | 1367 | 0.54 | 3 | 2 | 0 | Y | ACDPNRKRG | 88.7 | TCDPNRKRG | 10.73 | LMACDPNRK | 7.91 | LLACDPNRK | 2.26 | LVACDPNRK | 1.69 |
| NS2A | 1368 | 0 | 1 | 1 | 0 | Y | CDPNRKRGW | 100 | | | MACDPNRKR | 7.91 | LACDPNRKR | 2.26 | VACDPNRKR | 1.69 |
| NS2A | 1369 | 0 | 1 | 1 | 0 | Y | DPNRKRGWP | 100 | | | | | | |
| NS2A | 1370 | 0 | 1 | 1 | 0 | Y | PNRKRGWPA | 100 | | | | | | |
| NS2A | 1371 | 0 | 1 | 1 | 0 | Y | NRKRGWPAT | 100 | | | | | | |
| NS2A | 1372 | 0 | 1 | 1 | 0 | Y | RKRGWPATE | 100 | | | | | | |
| NS2A | 1373 | 0 | 1 | 1 | 0 | Y | KRGWPATEV | 100 | | | | | | |
| NS2A | 1374 | 0 | 1 | 1 | 0 | Y | RGWPATEVM | 100 | | | | | | |
| NS2A | 1375 | 0 | 1 | 1 | 0 | Y | GWPATEVMT | 100 | | | | | | |
| NS2B | 1376 | 0 | 1 | 1 | 0 | Y | WPATEVMTA | 100 | | | | | | |
| NS2B | 1377 | 0.05 | 2 | 1 | 0.56 | Y | PATEVMTAV | 99.44 | | | | | | |
| NS2B | 1378 | 0.05 | 2 | 1 | 0.56 | Y | ATEVMTAVG | 98.87 | | | | | | |
| NS2B | 1379 | 0.05 | 2 | 1 | 0.56 | Y | TEVMTAVGL | 98.87 | | | | | | |
| NS2B | 1380 | 0.05 | 2 | 1 | 0.56 | Y | EVMTAVGLM | 98.87 | | | | | | |

FIG. 24-46

Species: WNV (9-mers)

| protein | block starting position | block entropy | total peptides in block | # peptides required to cover 99% of block | gap/X fraction | 99% of block covered w/ <= 5 peptides? | peptides required

FIG. 24-47

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 24-48

Species: WNV (9

FIG. 24-49

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 24-50

Species: WNV (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1487 | 0.56 | 4 | 3 | 0 | Y | WAILPSWG | 89.27 | WAILPSWG | 9.6 | WAVLPSWG | 0.56 | | | | |
| NS2B | 1488 | 0.56 | 4 | 3 | 0 | Y | AILPSWGF | 89.27 | AILPSWGF | 9.6 | AILPSWGF | 0.56 | | | | |
| NS2B | 1489 | 0.56 | 4 | 3 | 0 | Y | ILPSWGFW | 89.27 | ILPSWGFW | 9.6 | VLPSWGFW | 0.56 | | | | |
| NS2B | 1490 | 0.51 | 3 | 2 | 0 | Y | LPSWGFWI | 89.83 | LPSWGFWI | 9.6 | | | | | | |
| NS2B | 1491 | 0.56 | 4 | 3 | 0 | Y | PSWGFWIT | 89.27 | PSWGFWIT | 9.6 | PSWGFWIT | 0.56 | | | | |
| NS2B | 1492 | 0.56 | 4 | 3 | 0 | Y | SWGFWITL | 89.27 | SWGFWITL | 9.6 | SWGFWISL | 0.56 | | | | |
| NS2B | 1493 | 0.56 | 4 | 3 | 0 | Y | WGFWITLQ | 89.27 | WGFWITLQ | 9.6 | WGFWISLQ | 0.56 | | | | |
| NS2B | 1494 | 0.51 | 3 | 2 | 0 | Y | GFWITLQY | 89.83 | IGFWITLQY | 9.6 | | | | | | |
| NS2B | 1495 | 0.05 | 2 | 1 | 0 | Y | GFWITLQYT | 99.44 | | | | | | | | |
| NS2B | 1496 | 0.05 | 2 | 1 | 0 | Y | FWITLQYTK | 99.44 | | | | | | | | |
| NS2B | 1497 | 0.05 | 2 | 1 | 0 | Y | WITLQYTKR | 99.44 | | | | | | | | |
| NS2B | 1498 | 0.05 | 2 | 1 | 0 | Y | ITLQYTKRG | 99.44 | | | | | | | | |
| NS2B | 1499 | 0.05 | 2 | 1 | 0 | Y | TLQYTKRGG | 99.44 | | | | | | | | |
| NS2B | 1500 | 0 | 1 | 1 | 0 | Y | LQYTKRGGV | 100 | | | | | | | | |
| NS2B | 1501 | 0 | 1 | 1 | 0 | Y | QYTKRGGVL | 100 | | | | | | | | |
| NS2B | 1502 | 0 | 1 | 1 | 0 | Y | YTKRGGVLW | 100 | | | | | | | | |
| NS2B | 1503 | 0 | 1 | 1 | 0 | Y | TKRGGVLWD | 100 | | | | | | | | |
| NS2B | 1504 | 0 | 1 | 1 | 0 | Y | KRGGVLWDT | 100 | | | | | | | | |
| NS2B | 1505 | 0 | 1 | 1 | 0 | Y | RGGVLWDTP | 100 | | | | | | | | |
| NS2B | 1506 | 0 | 1 | 1 | 0 | Y | GGVLWDTPS | 100 | | | | | | | | |
| NS2B | 1507 | 0 | 1 | 1 | 0 | Y | GVLWDTPSP | 100 | | | | | | | | |
| NS3 | 1508 | 0.19 | 2 | 2 | 0 | Y | VLWDTPSPK | 97.18 | VLWDTPSPR | 2.82 | | | | | | |
| NS3 | 1509 | 0.24 | 3 | 2 | 0 | Y | LWDTPSPKE | 96.61 | LWDTPSPRE | 2.82 | | | | | | |
| NS3 | 1510 | 0.24 | 3 | 2 | 0 | Y | WDTPSPKEY | 96.61 | WDTPSPREY | 2.82 | | | | | | |
| NS3 | 1511 | 0.36 | 6 | 5 | 0 | Y | DTPSPKEYK | 95.48 | DTPSPREYK | 1.69 | DTPSPREYR | 1.13 | DTPSPKEYE | 0.56 | DTPSPKVYK | 0.56 |

FIG. 24-51

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1517 | 0.36 | 6 | 5 | 0 | Y | EYKKGDTTT | 95.48 | EYKRGDTTT | 1.69 | EYRKGDTTT | 1.13 | VYKKGDTTT | 0.56 | EYRKGDTA

FIG. 24-52

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1542 | 0.19 | 2 | 2 | 0 | Y | GAGVMVEGV | 97.18 |

FIG. 24-53

Species: WNV (9-mers)

| protein | block starting position | block entropy | total peptides in block | # peptides required to cover 99% of block | gap/x fraction | 99% of block covered w/ <= 5 peptides? | peptides required

FIG. 24-54

Species: WNV (9-mers)

| protein | block starting position | block entropy | total peptides in block | # peptides required to cover 99% of block | gap/X fraction | 99%

FIG. 24-55

Species: WNV (9-mers)

| protein | block starting position | block entropy | total peptides in block | # peptides required to cover 99% of block | gap/X fraction | 99% of block covered w/ <= 5 peptides? | cover 99% of block | frequency | cover 99% of block | frequency | cover 99% of block | frequency | cover 99% of block | frequency |
|---|---|---|---|---|---|---|---|---|---|---|---|---|---|---|
| NS3 | 1617 | 0.19 | 2 | 2 | 0.56 | Y | KPGVFKTPE | 96.61 | KPGVFK

FIG. 24-56

Species: WNV

FIG. 24-57

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1667 | 0 | 1 | 1 | 0 | Y | ISAI

FIG. 24-58

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1698 | 0.05 | 2 | 1 | 0 | Y | DLHPGAGKT | 99.44 | | | | | | |
| NS3 | 1699 | 0.05 | 2 | 1 | 0 | Y | LHPGAGKTR | 99.44 | | | | | | |
| NS3 | 1700 | 0.56 | 3 | 2 | 0 | Y | HPGAGKTRR | 88.14 | HPGAGKTRK | 11.3 | | | | |
| NS3 | 1701 | 0.56 | 3 | 2 | 0 | Y | PGAGKTRRI | 88.14 | PGAGKTRKI | 11.3 | | | | |
| NS3 | 1702 | 0.56 | 3 | 2 | 0 | Y | GAGKTRRIL | 88.14 | GAGKTRKIL | 11.3 | | | | |
| NS3 | 1703 | 0.51 | 2 | 2 | 0 | Y | AGKTRRILP | 88.7 | AGKTRKILP | 11.3 | | | | |
| NS3 | 1704 | 0.51 | 2 | 2 | 0 | Y | GKTRRILPQ | 88.7 | GKTRKILPQ | 11.3 | | | | |
| NS3 | 1705 | 0.51 | 2 | 2 | 0 | Y | KTRRILPQI | 88.7 | KTRKILPQI | 11.3 | | | | |
| NS3 | 1706 | 0.51 | 2 | 2 | 0 | Y | TRRILPQII | 88.7 | TRKILPQII | 11.3 | | | | |
| NS3 | 1707 | 0.56 | 3 | 3 | 0 | Y | RRILPQIIK | 88.7 | RKILPQIIK | 10.17 | RKILPQIIR | 1.13 | | | |
| NS3 | 1708 | 0.56 | 3 | 3 | 0 | Y | RILPQIIKE | 88.7 | KILPQIIRE | 10.17 | KILPQIIRE | 1.13 | | | |
| NS3 | 1709 | 0.09 | 2 | 2 | 0 | Y | ILPQIIKEA | 98.87 | ILPQIIREA | 1.13 | | | | |
| NS3 | 1710 | 0.14 | 3 | 2 | 0 | Y | LPQIIKEAI | 98.31 | LPQIIREAI | 1.13 | | | | |
| NS3 | 1711 | 0.24 | 5 | 4 | 0 | Y | PQIIKEAIN | 97.18 | PQIIKEAMN | 1.13 | PQIIKEAID | 0.56 | | |
| NS3 | 1712 | 0.67 | 6 | 5 | 0 | Y | QIIKEAINR | 88.14 | QIREAINRR | 9.04 | QIIKEAMNR | 1.13 | QIIKEAIDR | 0.56 |
| NS3 | 1713 | 0.67 | 6 | 5 | 0 | Y | IIKEAINRR | 88.14 | IREAINRRL | 9.04 | IIKEAISKR | 1.13 | IIKEAIDRR | 0.56 |
| NS3 | 1714 | 0.67 | 6 | 5 | 0 | Y | IKEAINRRL | 88.14 | IREAINRRL | 9.04 | IKEAIDRRL | 1.13 | IKEAISKRL | 0.56 |
| NS3 | 1715 | 0.67 | 6 | 5 | 0 | Y | KEAINRRLR | 88.14 | REAINRRLR | 9.04 | KEAIDRRLR | 1.13 | KEAMNRRLR | 0.56 |
| NS3 | 1716 | 0.59 | 5 | 4 | 0 | Y | EAINRRLRT | 89.27 | EAMNRRLRT | 9.04 | EAISKRLRT | 0.56 | | |
| NS3 | 1717 | 0.59 | 5 | 4 | 0 | Y | AINRRLRTA | 89.27 | AMNRRLRTA | 9.04 | AISKRLRTA | 0.56 | | |
| NS3 | 1719 | 0.66 | 5 | 5 | 0 | Y | NRRLRTAVL | 89.83 | NKRLRTAVL | 6.78 | NRRLRTAIL | 2.26 | SKRLRTAIL | 0.56 |
| NS3 | 1720 | 0.59 | 5 | 4 | 0 | Y | RRLRTAVLA | 89.83 | KRLRTAVLA | 6.78 | KRLRTAILA | 2.82 | | |
| NS3 | 1721 | 0.21 | 2 | 2 | 0 | Y | RLRTAVLAP | 96.61 | RLRTAILAP | 3.39 | | | | |
| NS3 | 1722 | 0.21 | 2 | 2 | 0 | Y | LRTAVLAPT | 96.61 | LRTAILAPT | 3.39 | | | | |
| NS3 | 1723 | 0.21 | 2 | 2 | 0 | Y | RTAVLAPTR | 96.61 | RTAILAPTR | 3.39 | | | | |

FIG. 24-59

Species: WNV (9-mers)

| protein | block starting position | block entropy | total peptides in block | # peptides required to cover 99% of block | gap/X fraction | 99% of block covered w/ <= 5 peptides? | peptides required to cover 99% of block

FIG. 24-60

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1749 | 1.02 | 6 | 5 | 0 | Y | QTSAVPREH | 81.36 | QTSAVHREH | 7.91 | QTSAVTREH | 7.34 | QTSAVAREH | 2.26 | QTSAVNREH | 0.56 |
| NS3 | 1755 | 0.62 | 4 | 3 | 0 | Y | REHNGNEIV | 88.7 | REHSGNEIV | 8.47 | REHTGNEIV | 2.26 | | | | |
| NS3 | 1756 | 0.62 | 4 | 3 | 0 | Y | EHNGNEIVD | 88.7 | EHSGNEIVD | 8.47 | EHTGNEIVD | 2.26 | | | | |
| NS3 | 1757 | 0.62 | 4 | 3 | 0 | Y | HNGNEIVDV | 88.7 | HSGNEIVDV | 8.47 | HTGNEIVDV | 2.26 | | | | |
| NS3 | 1758 | 0.62 | 4 | 3 | 0 | Y | NGNEIVDVM | 88.7 | SGNEIVDVM | 8.47 | TGNEIVDVM | 2.26 | | | | |
| NS3 | 1759 | 0.05 | 2 | 1 | 0 | Y | GNEIVDVMC | 99.44 | | | | | | | | |
| NS3 | 1760 | 0.05 | 2 | 1 | 0 | Y | NEIVDVMCH | 99.44 | | | | | | | | |
| NS3 | 1761 | 0 | 1 | 1 | 0 | Y | EIVDVMCHA | 100 | | | | | | | | |
| NS3 | 1762 | 0 | 1 | 1 | 0 | Y | IVDVMCHAT | 100 | | | | | | | | |
| NS3 | 1763 | 0 | 1 | 1 | 0 | Y | VDVMCHATL | 100 | | | | | | | | |
| NS3 | 1764 | 0 | 1 | 1 | 0 | Y | DVMCHATLT | 100 | | | | | | | | |
| NS3 | 1765 | 0 | 1 | 1 | 0 | Y | VMCHATLTH | 100 | | | | | | | | |
| NS3 | 1766 | 0 | 1 | 1 | 0 | Y | MCHATLTHR | 100 | | | | | | | | |
| NS3 | 1767 | 0 | 1 | 1 | 0 | Y | CHATLTHRL | 100 | | | | | | | | |
| NS3 | 1768 | 0 | 1 | 1 | 0 | Y | HATLTHRLM | 100 | | | | | | | | |
| NS3 | 1769 | 0 | 1 | 1 | 0 | Y | ATLTHRLMS | 100 | | | | | | | | |
| NS3 | 1770 | 0 | 1 | 1 | 0 | Y | TLTHRLMSP | 100 | | | | | | | | |
| NS3 | 1771 | 0 | 1 | 1 | 0 | Y | LTHRLMSPH | 100 | | | | | | | | |
| NS3 | 1772 | 0 | 1 | 1 | 0 | Y | THRLMSPHR | 100 | | | | | | | | |
| NS3 | 1773 | 0 | 1 | 1 | 0 | Y | HRLMSPHRV | 100 | | | | | | | | |
| NS3 | 1774 | 0 | 1 | 1 | 0 | Y | RLMSPHRVP | 100 | | | | | | | | |
| NS3 | 1775 | 0 | 1 | 1 | 0 | Y | LMSPHRVPN | 100 | | | | | | | | |
| NS3 | 1776 | 0 | 1 | 1 | 0 | Y | MSPHRVPNY | 100 | | | | | | | | |
| NS3 | 1777 | 0 | 1 | 1 | 0 | Y | SPHRVPNYN | 100 | | | | | | | | |
| NS3 | 1778 | 0 | 1 | 1 | 0 | Y | PHRVPNYNL | 100 | | | | | | | | |

FIG. 24-61

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1779 | 0 | 1 | 1 | 0 | Y | HRVPNYNL

FIG. 24-62

Species: WNV (9-mers)

| protein | block starting position | block entropy | total peptides in block | # peptides required

FIG. 24-63

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1829 | 0.61 | 3 | 2 | 0.56 | Y | DPFPESNSP | 85.88 | DPFPESNAP | 12.99 | PFPESNAPV | 2.82 | | |
| NS3 | 1830 | 0.71 | 4 | 3 | 0.56 | Y | PFPESNSPI | 85.88 | PFPESNAPI | 10.17 | DIQTEIPDR | 2.82 | | |
| NS3 | 1840 | 0.65 | 4 | 3 | 0 | Y | DLQTEIPDR | 88.14 | DMQTEIPDR | 8.47 | IQTEIPDRA | 2.82 | | |
| NS3 | 1841 | 0.65 | 4 | 3 | 0 | Y | LQTEIPDRA | 88.14 | MQTEIPDRA | 8.47 | | | | |
| NS3 | 1842 | 0 | 1 | 1 | 0 | Y | QTEIPDRAW | 100 | | | | | | |
| NS3 | 1843 | 0 | 1 | 1 | 0 | Y | TEIPDRAWN | 100 | | | | | | |
| NS3 | 1844 | 0.43 | 3 | 2 | 0 | Y | EIPDRAWNS | 92.09 | EIPDRAWNT | 7.34 | | | | |
| NS3 | 1845 | 0.43 | 3 | 2 | 0 | Y | IPDRAWNSG | 92.09 | IPDRAWNTG | 7.34 | | | | |
| NS3 | 1846 | 0.43 | 3 | 2 | 0 | Y | PDRAWNSGY | 92.09 | PDRAWNTGY | 7.34 | | | | |
| NS3 | 1847 | 0.43 | 3 | 2 | 0 | Y | DRAWNSGYE | 92.09 | DRAWNTGYE | 7.34 | | | | |
| NS3 | 1848 | 0.43 | 3 | 2 | 0 | Y | RAWNSGYEW | 92.09 | RAWNTGYEW | 7.34 | | | | |
| NS3 | 1849 | 0.43 | 3 | 2 | 0 | Y | AWNSGYEWI | 92.09 | AWNTGYEWI | 7.34 | | | | |
| NS3 | 1850 | 0.43 | 3 | 2 | 0 | Y | WNSGYEWIT | 92.09 | WNTGYEWIT | 7.34 | | | | |
| NS3 | 1851 | 0.43 | 3 | 2 | 0 | Y | NSGYEWITE | 92.09 | NTGYEWITE | 7.34 | | | | |
| NS3 | 1852 | 0.43 | 3 | 2 | 0.56 | Y | SGYEWITEY | 91.53 | TGYEWITEY | 7.34 | | | | |
| NS3 | 1853 | 1.33 | 5 | 4 | 0.56 | Y | GYEWITEYT | 63.84 | GYEWITEYI | 24.29 | GYEWITEYV | 10.17 | GYEWITEFV | 0.56 |
| NS3 | 1854 | 1.33 | 5 | 4 | 0.56 | Y | YEWITEYTG | 63.84 | YEWITEYIG | 24.29 | YEWITEYYG | 10.17 | YEWITEYAG | 0.56 |
| NS3 | 1855 | 1.33 | 5 | 4 | 0.56 | Y | EWITEYTGK | 63.84 | EWITEYIGK | 24.29 | EWITEYGK | 10.17 | EWITEFYGK | 0.56 |
| NS3 | 1856 | 1.33 | 5 | 4 | 0.56 | Y | WITEYTGKT | 63.84 | WITEYIGKT | 24.29 | WITEYGKT | 10.17 | WITEYAGKT | 0.56 |
| NS3 | 1857 | 1.33 | 5 | 4 | 0.56 | Y | ITEYTGKTV | 63.84 | ITEYIGKTV | 24.29 | ITEYYGKTV | 10.17 | ITEYAGKTV | 0.56 |
| NS3 | 1858 | 1.33 | 5 | 4 | 0.56 | Y | TEYTGKTVW | 63.84 | TEYIGKTVW | 24.29 | TEYYGKTVW | 10.17 | TEFVGKTVW | 0.56 |
| NS3 | 1859 | 1.33 | 5 | 4 | 0.56 | Y | EYTGKTVWF | 63.84 | EYIGKTVWF | 24.29 | EYVGKTVWF | 10.17 | EFVGKTVWF | 0.56 |
| NS3 | 1860 | 1.33 | 5 | 4 | 0.56 | Y | YTGKTVWFV | 63.84 | YIGKTVWFV | 24.29 | YYGKTVWFV | 10.17 | FVGKTVWFV | 0.56 |
| NS3 | 1861 | 1.29 | 4 | 3 | 0 | Y | TGKTVWFVP | 64.41 | IGKTVWFVP | 24.29 | VGKTVWFVP | 10.73 | | |
| NS3 | 1862 | 0 | 1 | 1 | 0 | Y | GKTVWFVPS | 100 | | | | | | |

FIG. 24-64

Species: WNV (9-mers)

| prot

FIG. 24-65

Species: WNV (9-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1888 | 0.61 | 3 | 2 | 0 | Y | VIQLNRKSY | 86.44 | VIQLNRKSY | 12.99 | | | | |
| NS3 | 1889 | 0.56 | 2 | 2 | 0 | Y | VQLNRKSYE | 87.01 | IQLNRKSYE | 12.99 | | | | |
| NS3 | 1890 | 0 | 1 | 1 | 0 | Y | QLNRKSYET | 100 | | | | | | |
| NS3 | 1891 | 0 | 1 | 1 | 0 | Y | LNRKSYETE | 100 | | | | | | |
| NS3 | 1892 | 0 | 1 | 1 | 0 | Y | NRKSYETEY | 100 | | | | | | |
| NS3 | 1893 | 0 | 1 | 1 | 0 | Y | RKSYETEYP | 100 | | | | | | |
| NS3 | 1894 | 0 | 1 | 1 | 0 | Y | KSYETEYPK | 100 | | | | | | |
| NS3 | 1895 | 0 | 1 | 1 | 0 | Y | SYETEYPKC | 100 | | | | | | |
| NS3 | 1896 | 0 | 1 | 1 | 0 | Y | YETEYPKCK | 100 | | | | | | |
| NS3 | 1897 | 0 | 1 | 1 | 0 | Y | ETEYPKCKN | 100 | | | | | | |
| NS3 | 1898 | 0.05 | 2 | 1 | 0 | Y | TEYPKCKND | 99.44 | | | | | | |
| NS3 | 1899 | 0.05 | 2 | 1 | 0 | Y | EYPKCKNDD | 99.44 | | | | | | |
| NS3 | 1900 | 0.05 | 2 | 1 | 0 | Y | YPKCKNDDW | 99.44 | | | | | | |
| NS3 | 1901 | 0.05 | 2 | 1 | 0 | Y | PKCKNDDWD | 99.44 | | | | | | |
| NS3 | 1902 | 0.05 | 2 | 1 | 0 | Y | KCKNDDWDF | 99.44 | | | | | | |
| NS3 | 1903 | 0.05 | 2 | 1 | 0 | Y | CKNDDWDFV | 99.44 | | | | | | |
| NS3 | 1904 | 0.21 | 3 | 2 | 0 | Y | KNDDWDFVI | 97.18 | KNDDWDFVV | 2.26 | | | | |
| NS3 | 1905 | 0.21 | 3 | 2 | 0 | Y | NDDWDFVIT | 97.18 | NDDWDFWT | 2.26 | | | | |
| NS3 | 1906 | 0.21 | 3 | 2 | 0 | Y | DDWDFVITT | 97.18 | DDWDFWTT | 2.26 | | | | |
| NS3 | 1907 | 0.16 | 2 | 2 | 0 | Y | DWDFVITTD | 97.74 | DWDFWTTD | 2.26 | | | | |
| NS3 | 1908 | 0.16 | 2 | 2 | 0 | Y | WDFVITTDI | 97.74 | WDFWTTDI | 2.26 | | | | |
| NS3 | 1909 | 0.16 | 2 | 2 | 0 | Y | DFVITTDIS | 97.74 | DFWTTDIS | 2.26 | | | | |
| NS3 | 1910 | 0.16 | 2 | 2 | 0 | Y | FVITTDISE | 97.74 | FWTTDISE | 2.26 | | | | |
| NS3 | 1911 | 0.16 | 2 | 2 | 0 | Y | VITTDISEM | 97.74 | VTTDISEM | 2.26 | | | | |
| NS3 | 1912 | 0.16 | 2 | 2 | 0 | Y | ITTDISEMG | 97.74 | VTTDISEMG | 2.26 | | | | |

FIG. 24-66

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 24-67

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1941 | 0.67 | 6 | 5 | 0 | Y | TEGEGRVIL | 88.7 |

FIG. 24-68

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1966 | 0.27 | 5 | 4 | 0 | Y | RIGRNPSQV | 96.61 | RIGRNSSQV | 1.69 | RVGRNPSQV | 0.56 | RIGRNPTQV | 0.56 |
| NS3 | 1967 | 0.27 | 5 | 4 | 0 | Y | IGRNPSQVG | 96.61 | IGRNSSQVG | 1.69 | TGRNPSQAG | 0.56 | IGRNPTQVG | 0.56 |
| NS3 | 1968 | 0.22 | 4 | 3 | 0 | Y | GRNPSQVGD | 97.18 | GRNSSQVGD | 1.69 | GRNPSQAGD | 0.56 | | |
| NS3 | 1969 | 0.22 | 4 | 3 | 0 | Y | RNPSQVGDE | 97.18 | RNSSQVGDE | 1.69 | RNPTQVGDE | 0.56 | | |
| NS3 | 1970 | 0.22 | 4 | 3 | 0 | Y | NPSQVGDEY | 97.18 | NSSQVGDEY | 1.69 | NPTQVGDEY | 0.56 | | |
| NS3 | 1971 | 0.22 | 4 | 3 | 0 | Y | PSQVGDEYC | 97.18 | SSQVGDEYC | 1.69 | PSQAGDEYC | 0.56 | | |
| NS3 | 1972 | 0.1 | 3 | 2 | 0 | Y | SQVGDEYCYG | 98.87 | SQAGDEYC | 0.56 | | | | |
| NS3 | 1973 | 0.05 | 2 | 1 | 0 | Y | QVGDEYCYG | 99.44 | | | | | | |
| NS3 | 1974 | 0.05 | 2 | 1 | 0 | Y | VGDEYCYGG | 99.44 | | | | | | |
| NS3 | 1975 | 0 | 1 | 1 | 0 | Y | GDEYCYGGH | 100 | | | | | | |
| NS3 | 1976 | 0 | 1 | 1 | 0 | Y | DEYCYGGHT | 100 | | | | | | |
| NS3 | 1977 | 0 | 1 | 1 | 0 | Y | EYCYGGHTN | 100 | | | | | | |
| NS3 | 1978 | 0 | 1 | 1 | 0 | Y | YCYGGHTNE | 100 | | | | | | |
| NS3 | 1979 | 0 | 1 | 1 | 0 | Y | CYGGHTNED | 100 | | | | | | |
| NS3 | 1980 | 0 | 1 | 1 | 0 | Y | YGGHTNEDD | 100 | | | | | | |
| NS3 | 1981 | 0 | 1 | 1 | 0 | Y | GGHTNEDDS | 100 | | | | | | |
| NS3 | 1982 | 0 | 1 | 1 | 0 | Y | GHTNEDDSN | 100 | | | | | | |
| NS3 | 1983 | 0.42 | 5 | 4 | 0.56 | Y | HTNEDDSNF | 93.79 | HTNEDDSNC | 1.69 | HTNEDDSNY | 1.69 | HTNEDDSNL | 1.69 |
| NS3 | 1984 | 0.42 | 5 | 4 | 0.56 | Y | TNEDDSNFA | 93.79 | TNEDDSNYA | 1.69 | TNEDDSNCA | 1.69 | TNEDDSNLA | 1.69 |
| NS3 | 1985 | 0.42 | 5 | 4 | 0.56 | Y | NEDDSNFAH | 93.79 | NEDDSNYAH | 1.69 | NEDDSNCAH | 1.69 | NEDDSNLAH | 1.69 |
| NS3 | 1986 | 0.42 | 5 | 4 | 0.56 | Y | EDDSNFAHW | 93.79 | EDDSNCAHW | 1.69 | EDDSNYAHW | 1.69 | EDDSNLAHW | 1.69 |
| NS3 | 1987 | 0.42 | 5 | 4 | 0.56 | Y | DDSNFAHWT | 93.79 | DDSNYAHWT | 1.69 | DDSNYAHWT | 1.69 | DDSNCAHWT | 1.69 |
| NS3 | 1988 | 0.42 | 5 | 4 | 0.56 | Y | DSNFAHWTE | 93.79 | DSNLAHWTE | 1.69 | DSNYAHWTE | 1.69 | DSNCAHWTE | 1.69 |
| NS3 | 1989 | 0.42 | 5 | 4 | 0.56 | Y | SNFAHWTEA | 93.79 | SNYAHWTEA | 1.69 | SNLAHWTEA | 1.69 | SNCAHWTEA | 1.69 |
| NS3 | 1990 | 0.42 | 5 | 4 | 0.56 | Y | NFAHWTEAR | 93.79 | NCAHWTEAR | 1.69 | NYAHWTEAR | 1.69 | NLAHWTEAR | 1.69 |

FIG. 24-69

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1991 | 0.42 | 5 | 4 | 0.56 | Y | FAHWTEARI | 93.79 | YAHWTEARI | 1.69 | | | | |
| NS3 | 1992 | 0 | 1 | 1 | 0 | Y | AHWTEARIM | 100 | | | | | | |
| NS3 | 1993 | 0.05 | 2 | 1 | 0 | Y | HWTEARIML | 99.44 | | | | | | |
| NS3 | 1994 | 0.05 | 2 | 1 | 0 | Y | WTEARIMLD | 99.44 | | | | | | |
| NS3 | 1995 | 0.05 | 2 | 1 | 0 | Y | TEARIMLDN | 99.44 | | | | | | |
| NS3 | 1996 | 0.05 | 2 | 1 | 0 | Y | EARIMLDNI | 99.44 | | | | | | |
| NS3 | 1997 | 0.05 | 2 | 1 | 0 | Y | ARIMLDNIN | 99.44 | | | | | | |
| NS3 | 1998 | 0.05 | 2 | 1 | 0 | Y | RIMLDNINM | 99.44 | | | | | | |
| NS3 | 1999 | 0.05 | 2 | 1 | 0 | Y | IMLDNINMP | 99.44 | | | | | | |
| NS3 | 2000 | 0.1 | 3 | 2 | 0.56 | Y | MLDNINMPN | 98.31 | MPDNINMPN | 0.56 | | | | |
| NS3 | 2001 | 0.1 | 3 | 2 | 0.56 | Y | LDNINMPNG | 98.31 | PDNINMPNG | 0.56 | | | | |
| NS3 | 2002 | 0.05 | 2 | 1 | 0.56 | Y | DNINMPNGL | 98.87 | | | | | | |
| NS3 | 2003 | 0.53 | 3 | 2 | 0.56 | Y | NINMPNGLI | 88.7 | NINMPNGLV | 10.17 | | | | |
| NS3 | 2004 | 0.53 | 3 | 2 | 0.56 | Y | INMPNGLIA | 88.7 | INMPNGLVA | 10.17 | | | | |
| NS3 | 2005 | 0.53 | 3 | 2 | 0.56 | Y | NMPNGLIAQ | 88.7 | NMPNGLVAQ | 10.17 | | | | |
| NS3 | 2006 | 0.61 | 4 | 3 | 0.56 | Y | MPNGLIAQF | 87.57 | MPNGLVAQL | 10.17 | MPNGLIAQL | 1.13 | | |
| NS3 | 2007 | 0.61 | 4 | 3 | 0.56 | Y | PNGLIAQFY | 87.57 | PNGLVAQLY | 10.17 | PNGLIAQLY | 1.13 | | |
| NS3 | 2008 | 0.61 | 4 | 3 | 0.56 | Y | NGLIAQFYQ | 87.57 | NGLVAQLYQ | 10.17 | NGLIAQLYQ | 1.13 | | |
| NS3 | 2009 | 0.56 | 3 | 3 | 0 | Y | GLIAQFYQP | 88.7 | GLVAQLYQP | 10.17 | GLIAQLYQP | 1.13 | | |
| NS3 | 2010 | 0.56 | 3 | 3 | 0 | Y | LIAQFYQPE | 88.7 | LVAQLYQPE | 10.17 | LIAQLYQPE | 1.13 | | |
| NS3 | 2011 | 0.56 | 3 | 3 | 0 | Y | IAQFYQPER | 88.7 | VAQLYQPER | 10.17 | IAQLYQPER | 1.13 | | |
| NS3 | 2012 | 0.51 | 2 | 2 | 0 | Y | AQFYQPERE | 88.7 | AQLYQPERE | 11.3 | | | | |
| NS3 | 2013 | 0.51 | 2 | 2 | 0 | Y | QFYQPEREK | 88.7 | QLYQPEREK | 11.3 | | | | |
| NS3 | 2014 | 0.51 | 2 | 2 | 0 | Y | FYQPEREKV | 88.7 | LYQPEREKV | 11.3 | | | | |
| NS3 | 2015 | 0.1 | 3 | 2 | 0 | Y | YQPEREKVY | 98.87 | YQPEREKVH | 0.56 | | | | |

FIG. 24-70

Species: WNV (9-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2016 | 0.1 | 3 | 2 | 0 | Y | QPEREKVYT | 98.87 | QPEREKVHT | 0.56 | | | | |
| NS3 | 2017 | 0.1 | 3 | 2 | 0 | Y | PEREKVYTM | 98.87 | PEREKVHTM | 0.56 | | | | |
| NS3 | 2018 | 0.15 | 4 | 3 | 0 | Y | EREKVYTMD | 98.31 | EREKVYTME | 0.56 | EREKVYTMD | 0.56 | | |
| NS3 | 2019 | 0.15 | 4 | 3 | 0 | Y | REKVYTMDG | 98.31 | REKVHTMDG | 0.56 | REKVYTMEG | 0.56 | | |
| NS3 | 2020 | 0.15 | 4 | 3 | 0 | Y | EKVYTMDGE | 98.31 | EKVCTMDGE | 0.56 | EKVYTMEGE | 0.56 | | |
| NS3 | 2021 | 0.15 | 4 | 3 | 0 | Y | KVYTMDGEY | 98.31 | KVCTMDGEY | 0.56 | KVYTMEGEY | 0.56 | | |
| NS3 | 2022 | 0.31 | 5 | 4 | 0 | Y | VYTMDGEYR | 96.05 | VYTMDGEYK | 2.26 | VHTMDGEYR | 0.56 | VYTMEGEYR | 0.56 |
| NS3 | 2023 | 0.31 | 5 | 4 | 0 | Y | YTMDGEYRL | 96.05 | YTMDGEYKL | 2.26 | YTMEGEYRL | 0.56 | CTMDGEYRL | 0.56 |
| NS3 | 2024 | 0.21 | 3 | 2 | 0 | Y | TMDGEYRLR | 97.18 | TMDGEYKLR | 2.26 | | | | |
| NS3 | 2025 | 0.21 | 3 | 2 | 0 | Y | MDGEYRLRG | 97.18 | MDGEYKLRG | 2.26 | | | | |
| NS3 | 2026 | 0.16 | 2 | 2 | 0 | Y | DGEYRLRGE | 97.74 | DGEYKLRGE | 2.26 | | | | |
| NS3 | 2027 | 0.16 | 2 | 2 | 0 | Y | GEYRLRGEE | 97.74 | GEYKLRGEE | 2.26 | | | | |
| NS3 | 2028 | 0.16 | 2 | 2 | 0 | Y | EYRLRGEER | 97.74 | EYKLRGEER | 2.26 | | | | |
| NS3 | 2029 | 0.16 | 2 | 2 | 0 | Y | YRLRGEERK | 97.74 | YKLRGEERK | 2.26 | | | | |
| NS3 | 2030 | 0.16 | 2 | 2 | 0 | Y | RLRGEERKN | 97.74 | KLRGEERKN | 2.26 | | | | |
| NS3 | 2031 | 0 | 1 | 1 | 0 | Y | LRGEERKNF | 100 | | | | | | |
| NS3 | 2032 | 0 | 1 | 1 | 0 | Y | RGEERKNFL | 100 | | | | | | |
| NS3 | 2033 | 0 | 1 | 1 | 0 | Y | GEERKNFLE | 100 | | | | | | |
| NS3 | 2034 | 0.4 | 2 | 2 | 0 | Y | EERKNFLEL | 92.09 | EERKNFLEF | 7.91 | | | | |
| NS3 | 2035 | 0.4 | 2 | 2 | 0 | Y | ERKNFLELL | 92.09 | ERKNFLEFL | 7.91 | | | | |
| NS3 | 2036 | 0.45 | 3 | 2 | 0 | Y | RKNFLELLR | 91.53 | RKNFLEFLR | 7.91 | | | | |
| NS3 | 2037 | 0.45 | 3 | 2 | 0 | Y | KNFLELLRT | 91.53 | KNFLEFLRT | 7.91 | | | | |
| NS3 | 2038 | 0.45 | 3 | 2 | 0 | Y | NFLELLRTA | 91.53 | NFLEFLRTA | 7.91 | | | | |
| NS3 | 2039 | 0.45 | 3 | 2 | 0 | Y | FLELLRTAD | 91.53 | FLEFLRTAD | 7.91 | | | | |
| NS3 | 2040 | 0.45 | 3 | 2 | 0 | Y | LELLRTADL | 91.53 | LEFLRTADL | 7.91 | | | | |

FIG. 24-71

Species: WNV (9-mers)

| protein | block starting position | block

FIG. 24-72

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |

FIG. 24-73

Species: WNV (9-mers)

| prot

FIG. 24-74

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2117 | 0.21 | 3 | 2 | 0 | Y | KDFASGKRS | 97.18 | KDFAAGRRS | 2.26 | | | | |
| NS3 | 2118 | 0.21 | 3 | 2 | 0 | Y | DFASGKRSQ | 97.18 | DFAAGRRSQ | 2.26 | | | | |
| NS3 | 2119 | 0.31 | 5 | 4 | 0 | Y | FASGKRSQI | 96.05 | FAAGRRSQI | 2.26 | FASGKRSQM | 0.56 | | |
| NS3 | 2120 | 0.31 | 5 | 4 | 0 | Y | ASGKRSQIG | 96.05 | AAGRRSQIG | 2.26 | ASGKRSQMG | 0.56 | | |
| NS3 | 2121 | 0.43 | 6 | 5 | 0 | Y | SGKRSQIGL | 94.35 | SGKRSQIGF | 2.26 | SGKRSQVGL | 0.56 | AGKRSQIGL | 0.56 |
| NS3 | 2122 | 0.79 | 6 | 5 | 0 | Y | GKRSQIGLI | 86.44 | GRRSQIGLV | 8.47 | GKRSQIGLV | 1.69 | GKRSQVGLI | 0.56 |
| NS3 | 2123 | 0.79 | 6 | 5 | 0 | Y | KRSQIGLIE | 86.44 | RRSQIGLVE | 8.47 | KRSQIGFIE | 1.69 | KRSQMGLIE | 0.56 |
| NS3 | 2124 | 0.71 | 5 | 4 | 0 | Y | RSQIGLIEV | 86.44 | RSQIGLVEV | 10.73 | RSQMGLIEV | 0.56 | | |
| NS3 | 2125 | 0.79 | 6 | 5 | 0 | Y | SQIGLIEVL | 86.44 | SQIGLVEVL | 8.47 | SQIGFIEVL | 2.26 | SQVGLIEVL | 0.56 |
| NS3 | 2126 | 0.79 | 6 | 5 | 0 | Y | QIGLIEVLG | 86.44 | QIGLVEVLG | 8.47 | QIGFIEVLG | 2.26 | QMGLIEVLG | 0.56 |
| NS3 | 2127 | 0.79 | 6 | 5 | 0 | Y | IGLIEVLGK | 86.44 | IGLVEVLGR | 8.47 | IGFIEVLGK | 1.69 | MGLIEVLGK | 0.56 |
| NS3 | 2128 | 0.74 | 5 | 4 | 0 | Y | GLIEVLGKM | 87.01 | GLVEVLGRM | 8.47 | GFIEVLGKM | 1.69 | | |
| NS3 | 2129 | 0.74 | 5 | 4 | 0 | Y | LIEVLGKMP | 87.01 | LVEVLGRMP | 8.47 | FIEVLGKMP | 1.69 | | |
| NS3 | 2130 | 0.62 | 4 | 3 | 0 | Y | IEVLGKMPE | 88.7 | VEVLGRMPE | 8.47 | | | | |
| NS3 | 2131 | 0.59 | 3 | 3 | 0 | Y | EVLGKMPEH | 88.7 | EVIGRMPEH | 9.04 | | | | |
| NS3 | 2132 | 0.59 | 3 | 3 | 0 | Y | VLGKMPEHF | 88.7 | VIGRMPEHF | 9.04 | | | | |
| NS3 | 2133 | 0.59 | 3 | 3 | 0 | Y | LGKMPEHFM | 88.7 | IGRMPEHFM | 9.04 | | | | |
| NS4A | 2134 | 0.64 | 4 | 4 | 0 | Y | GKMPEHFMG | 88.7 | GRMPEHFMG | 7.91 | GRMPEHFMV | 1.13 | | |
| NS4A | 2135 | 0.64 | 4 | 4 | 0 | Y | KMPEHFMGK | 88.7 | RMPEHFMGK | 7.91 | RMPEHFMVK | 1.13 | | |
| NS4A | 2136 | 0.24 | 3 | 3 | 0 | Y | MPEHFMGKT | 96.61 | MPEHFMVKT | 2.26 | | | | |
| NS4A | 2137 | 0.24 | 3 | 3 | 0 | Y | PEHFMGKTW | 96.61 | PEHFMVKTW | 2.26 | | | | |
| NS4A | 2138 | 0.24 | 3 | 3 | 0 | Y | EHFMGKTWE | 96.61 | EHFMVKTWE | 2.26 | | | | |
| NS4A | 2139 | 0.24 | 3 | 3 | 0 | Y | HFMGKTWEA | 96.61 | HFMVKTWEA | 2.26 | | | | |
| NS4A | 2140 | 0.24 | 3 | 3 | 0 | Y | FMGKTWEAL | 96.61 | FMVKTWEAL | 2.26 | | | | |
| NS4A | 2141 | 0.24 | 3 | 3 | 0 | Y | MGKTWEALD | 96.61 | MVKTWEALD | 2.26 | | | | |

FIG. 24-75

Species: WNV (9-mers)

| protein | block starting position | block entropy | total peptides in block | # peptides required to cover 99% of block | gap/X fraction | 99% of block covered w/ <= 5 peptides? | peptides required

FIG. 24-76

Species: WNV (9-mers)

| protein | block starting position | block entropy | total peptides in block | # peptides required to cover 99% of block | gap/X fraction | 99% of block covered w/ <= 5 peptides?

FIG. 24-77

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2195 | 0.16 | 2 | 2 | 0 | Y | LMQRKGIGK | 97.74 | LMQRKGVSK | 2.26 | | | | |
| NS4A | 2196 | 0.16 | 2 | 2 | 0 | Y | MQRKGIGKI | 97.74 | MQRKGVSKI | 2.26 | | | | |
| NS4A | 2197 | 0.16 | 2 | 2 | 0 | Y | QRKGIGKIG | 97.74 | QRKGVSKIG | 2.26 | | | | |
| NS4A | 2198 | 0.16 | 2 | 2 | 0 | Y | RKGIGKIGL | 97.74 | RKGVSKIGL | 2.26 | | | | |
| NS4A | 2199 | 0.16 | 2 | 2 | 0 | Y | KGIGKIGLG | 97.74 | KGVSKIGLA | 2.26 | | | | |
| NS4A | 2200 | 0.16 | 2 | 2 | 0 | Y | GIGKIGLGG | 97.74 | GVSKIGLAG | 2.26 | | | | |
| NS4A | 2201 | 1.73 | 5 | 5 | 0 | Y | IGKIGLGGA | 97.74 | IGKIGLGGT | 22.6 | IGKIGLGGV | 21.47 | IGKIGLGGI | 2.82 |
| NS4A | 2211 | 0.87 | 6 | 5 | 0.56 | Y | LGVATFFCW | 50.85 | LGAATFFCW | 10.73 | LGLATFFCW | 2.26 | LGVATLFCW | 1.69 |
| NS4A | 2212 | 0.82 | 5 | 4 | 0.56 | Y | GVATFFCWM | 83.62 | GAATFFCWM | 10.73 | GLATFFCWM | 2.26 | GVATLFCWM | 1.69 |
| NS4A | 2213 | 0.77 | 4 | 4 | 0.56 | Y | VATFFCWMA | 84.18 | AATFFCWMA | 10.73 | LATFFCWMA | 2.26 | VATLFCWMA | 1.69 |
| NS4A | 2214 | 0.25 | 3 | 3 | 0.56 | Y | ATFFCWMAE | 84.75 | ATFFCWMAD | 1.69 | ATLFCWMAE | 1.69 | | |
| NS4A | 2215 | 0.25 | 3 | 3 | 0.56 | Y | TFFCWMAEV | 96.05 | TFFCWMADV | 1.69 | TLFCWMAEV | 1.69 | | |
| NS4A | 2216 | 0.43 | 5 | 4 | 0.56 | Y | FFCWMAEVP | 96.05 | FFCWMAEVS | 2.82 | FFCWMADVP | 1.69 | LFCWMAEVP | 1.69 |
| NS4A | 2217 | 0.31 | 3 | 3 | 0 | Y | FCWMAEVPG | 93.22 | FCWMAEVSG | 2.82 | FCWMADVPG | 1.69 | | |
| NS4A | 2218 | 0.31 | 3 | 3 | 0 | Y | CWMAEVPGT | 95.48 | CWMAEVSGT | 2.82 | CWMADVPGT | 1.69 | | |
| NS4A | 2219 | 0.31 | 3 | 3 | 0 | Y | WMAEVPGTK | 95.48 | WMAEVSGTK | 2.82 | WMADVPGTK | 1.69 | | |
| NS4A | 2220 | 0.31 | 3 | 3 | 0 | Y | MAEVPGTKI | 95.48 | MAEVSGTKI | 2.82 | MADVPGTKI | 1.69 | | |
| NS4A | 2221 | 0.31 | 3 | 3 | 0 | Y | AEVPGTKIA | 95.48 | AEVSGTKIA | 2.82 | ADVPGTKIA | 1.69 | | |
| NS4A | 2222 | 0.31 | 3 | 3 | 0 | Y | EVPGTKIAG | 95.48 | EVSGTKIAG | 2.82 | DVPGTKIAG | 1.69 | | |
| NS4A | 2223 | 0.19 | 2 | 2 | 0 | Y | VPGTKIAGM | 97.18 | VSGTKIAGM | 2.82 | | | | |
| NS4A | 2224 | 0.19 | 2 | 2 | 0 | Y | PGTKIAGML | 97.18 | SGTKIAGML | 2.82 | | | | |
| NS4A | 2225 | 0 | 1 | 1 | 0 | Y | GTKIAGMLL | 100 | | | | | | |
| NS4A | 2226 | 0 | 1 | 1 | 0 | Y | TKIAGMLLL | 100 | | | | | | |
| NS4A | 2227 | 0 | 1 | 1 | 0 | Y | KIAGMLLLS | 100 | | | | | | |
| NS4A | 2228 | 0 | 1 | 1 | 0 | Y | IAGMLLLSL | 100 | | | | | | |

FIG. 24-78

Species: WNV (9-mers)

| protein | block starting position | block entropy | total peptides in block | # peptides required to c

FIG. 24-79

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency

FIG. 24-80

Species: WNV (9-mers)

| protein | block starting position | block entropy | total peptides in block | # peptides required to cover 99% of block | gap/X fraction | 99% of block covered w/ <= 5 peptides? | peptides required to cover 99% of block

FIG. 24-81

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2334 | 0.05 | 2 | 1 | 0 | Y | ITS

FIG. 24-82

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2359 | 0.09 | 2 | 2 | 0 | Y | GFPFVDVGV | 98.87 | GFPFVDVGI | 1.13 | | | | |
| NS4B | 2360 | 0.09 | 2 | 2 | 0 | Y | FPFVDVGVS | 98.87 | FPFVDVGIS | 1.13 | | | | |
| NS4B | 2361 | 0.1 | 3 | 2 | 0 | Y | PFVDVGVSA | 98.87 | PFVDVGISA | 0.56 | | | | |
| NS4B | 2362 | 0.1 | 3 | 2 | 0 | Y | FVDVGVSAL | 98.87 | FVDVGISSL | 0.56 | | | | |
| NS4B | 2363 | 0.1 | 3 | 2 | 0 | Y | VDVGVSALL | 98.87 | VDVGISSLL | 0.56 | | | | |
| NS4B | 2364 | 0.1 | 3 | 2 | 0 | Y | DVGVSALLL | 98.87 | DYGISSLLL | 0.56 | | | | |
| NS4B | 2365 | 0.1 | 3 | 2 | 0 | Y | VGVSALLLA | 98.87 | VGISALLLA | 0.56 | | | | |
| NS4B | 2366 | 0.19 | 4 | 3 | 0 | Y | GVSALLLAA | 97.74 | GVSALLLAV | 1.13 | GISSLLLAV | 0.56 | | |
| NS4B | 2367 | 0.19 | 4 | 3 | 0 | Y | VSALLLAAG | 97.74 | VSALLLAVG | 1.13 | ISALLLAAG | 0.56 | | |
| NS4B | 2368 | 0.14 | 3 | 2 | 0 | Y | SALLLAAGC | 98.31 | SALLLAVGC | 1.13 | | | | |
| NS4B | 2369 | 0.14 | 3 | 2 | 0 | Y | ALLLAAGCW | 98.31 | ALLLAVGCW | 1.13 | | | | |
| NS4B | 2370 | 0.17 | 3 | 2 | 0 | Y | LLLAAGCWG | 97.74 | LLLAVGCWG | 1.69 | | | | |
| NS4B | 2371 | 0.17 | 3 | 2 | 0 | Y | LLAAGCWGQ | 97.74 | LLAVGCWGQ | 1.69 | | | | |
| NS4B | 2372 | 0.17 | 3 | 2 | 0 | Y | LAAGCWGQV | 97.74 | LAVGCWGQV | 1.69 | | | | |
| NS4B | 2373 | 0.17 | 3 | 2 | 0 | Y | AAGCWGQVT | 97.74 | AVGCWGQVT | 1.69 | | | | |
| NS4B | 2374 | 0.17 | 3 | 2 | 0 | Y | AGCWGQVTL | 97.74 | VGCWGQVTL | 1.69 | | | | |
| NS4B | 2375 | 0.05 | 2 | 1 | 0 | Y | GCWGQVTLI | 99.44 | | | | | | |
| NS4B | 2376 | 0.05 | 2 | 1 | 0 | Y | CWGQVTLIV | 99.44 | | | | | | |
| NS4B | 2377 | 0.1 | 3 | 2 | 0 | Y | WGQVTLIVT | 98.87 | WGQVTLTVA | 0.56 | | | | |
| NS4B | 2378 | 0.1 | 3 | 2 | 0 | Y | GQVTLIVTV | 98.87 | GQVTLTVAV | 0.56 | | | | |
| NS4B | 2379 | 0.05 | 2 | 1 | 0 | Y | QVTLIVTVT | 99.44 | | | | | | |
| NS4B | 2380 | 0.17 | 3 | 2 | 0 | Y | VTLIVTVTA | 97.74 | VTLTVTVTS | 1.69 | | | | |
| NS4B | 2381 | 0.3 | 4 | 3 | 0 | Y | TLIVTVTAA | 96.05 | TLTVTVTSA | 1.69 | TLTVTVTAT | 1.69 | | |
| NS4B | 2390 | 0.68 | 5 | 4 | 0.56 | Y | TLLFCHYAY | 86.44 | ALLFCHYAY | 10.73 | TLLCHYAY | 1.13 | VLLFCHYAY | 0.56 |
| NS4B | 2391 | 0.09 | 2 | 2 | 0.56 | Y | LLFCHYAYM | 98.31 | LLLCHYAYM | 1.13 | | | | |

FIG. 24-83

Species: WNV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency |
|---|---|---|---|---|---|---|---|---|---|---|
| NS4B | 2392 | 0.14 | 3 | 2 | 0.56 | Y | LFCHYAYMV | 97.74 | LLCHYAYMV | 1.13 |
| NS4B | 2393 | 0.14 | 3 | 2 | 0.56 | Y | FCHYAYMVP | 97.74 | LCHYAYMVP | 1.13 |
| NS4B | 2394 | 0.05 | 2 | 1 | 0 | Y | CHYAYMVPG | 99.44 | | |
| NS4B | 2395 | 0.1 | 3 | 2 | 0 | Y | HYAYMVPGW | 98.87 | HYAYMIPGW | 0.56 |
| NS4B | 2396 | 0.1 | 3 | 2 | 0 | Y | YAYMVPGWQ | 98.87 | YAYMIPGGQ | 0.56 |
| NS4B | 2397 | 0.1 | 3 | 2 | 0 | Y | AYMVPGWQA | 98.87 | AYMIPGWQA | 0.56 |
| NS4B | 2398 | 0.1 | 3 | 2 | 0 | Y | YMVPGWQAE | 98.87 | YMVPGGQAE | 0.56 |
| NS4B | 2399 | 0.1 | 3 | 2 | 0 | Y | MVPGWQAEA | 98.87 | MIPGWQAEA | 0.56 |
| NS4B | 2400 | 0.1 | 3 | 2 | 0 | Y | VPGWQAEAM | 98.87 | IPGWQAEAM | 0.56 |
| NS4B | 2401 | 0.05 | 2 | 1 | 0 | Y | PGWQAEAMR | 99.44 | | |
| NS4B | 2402 | 0.21 | 3 | 2 | 0 | Y | GWQAEAMRS | 97.18 | GWQAEAMRA | 2.26 |
| NS4B | 2403 | 0.21 | 3 | 2 | 0 | Y | WQAEAMRSA | 97.18 | WQAEAMRAA | 2.26 |
| NS4B | 2404 | 0.16 | 2 | 2 | 0 | Y | QAEAMRSAQ | 97.74 | QAEAMRAAQ | 2.26 |
| NS4B | 2405 | 0.16 | 2 | 2 | 0 | Y | AEAMRSAQR | 97.74 | AEAMRAAQR | 2.26 |
| NS4B | 2406 | 0.16 | 2 | 2 | 0 | Y | EAMRSAQRR | 97.74 | EAMRAAQRR | 2.26 |
| NS4B | 2407 | 0.16 | 2 | 2 | 0 | Y | AMRSAQRRT | 97.74 | AMRAAQRRT | 2.26 |
| NS4B | 2408 | 0.16 | 2 | 2 | 0 | Y | MRSAQRRTA | 97.74 | MRAAQRRTA | 2.26 |
| NS4B | 2409 | 0.16 | 2 | 2 | 0 | Y | RSAQRRTAA | 97.74 | RAAQRRTAA | 2.26 |
| NS4B | 2410 | 0.16 | 2 | 2 | 0 | Y | SAQRRTAAG | 97.74 | AAQRRTAAG | 2.26 |
| NS4B | 2411 | 0 | 1 | 1 | 0 | Y | AQRRTAAGI | 100 | | |
| NS4B | 2412 | 0 | 1 | 1 | 0 | Y | QRRTAAGIM | 100 | | |
| NS4B | 2413 | 0 | 1 | 1 | 0 | Y | RRTAAGIMK | 100 | | |
| NS4B | 2414 | 0 | 1 | 1 | 0 | Y | RTAAGIMKN | 100 | | |
| NS4B | 2415 | 0.16 | 2 | 2 | 0 | Y | TAAGIMKNA | 97.74 | TAAGIMKNV | 2.26 |
| NS4B | 2416 | 0.16 | 2 | 2 | 0 | Y | AAGIMKNAV | 97.74 | AAGIMKNVV | 2.26 |

FIG. 24-84

Species: WNV (9-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B

FIG. 24-85

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

Species: WNV (9-mers)

| prot

FIG. 24-88

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2528 | 0 | 1 | 1 | 0 | Y | KRGGAKGRT | 100 | | | | | | |
| NS4B | 2529 | 0 | 1 | 1 | 0 | Y | RGGAKGRTL | 100 | | | | | | |
| NS5 | 2530 | 0 | 1 | 1 | 0 | Y | GGAKGRTLG | 100 | | | | | | |
| NS5 | 2531 | 0 | 1 | 1 | 0 | Y | GAKGRTLGE | 100 | | | | | | |
| NS5 | 2532 | 0.05 | 2 | 1 | 0 | Y | AKGRTLGEV | 99.44 | | | | | | |
| NS5 | 2533 | 0.05 | 2 | 1 | 0 | Y | KGRTLGEVW | 99.44 | | | | | | |
| NS5 | 2534 | 0.05 | 2 | 1 | 0 | Y | GRTLGEVWK | 99.44 | | | | | | |
| NS5 | 2535 | 0.21 | 3 | 2 | 0 | Y | RTLGEVWKE | 97.18 | RTLGEVWKD | 2.26 | | | | |
| NS5 | 2536 | 0.26 | 4 | 3 | 0 | Y | TLGEVWKER | 96.61 | TLGEVWKDR | 2.26 | TLGEAWKER | 0.56 | | |
| NS5 | 2537 | 0.26 | 4 | 3 | 0 | Y | LGEVWKERL | 96.61 | LGEVWKDRL | 2.26 | LGEAWKERL | 0.56 | | |
| NS5 | 2538 | 0.26 | 4 | 3 | 0 | Y | GEVWKERLN | 96.61 | GEVWKDRLN | 2.26 | GEVWKEKLN | 0.56 | | |
| NS5 | 2539 | 0.68 | 6 | 5 | 0 | Y | EVWKERLNQ | 88.7 | EVWKERLNH | 7.34 | EVWKDRLNR | 2.26 | EVWKERLNY | 0.56 |
| NS5 | 2540 | 0.68 | 6 | 5 | 0 | Y | VWKERLNQM | 88.7 | VWKERLNHM | 7.34 | VWKDRLNRL | 2.26 | VWKERLNQM | 0.56 | VWKERLNYM | 0.56 |
| NS5 | 2541 | 0.68 | 6 | 5 | 0 | Y | WKERLNQMT | 88.7 | WKERLNHMT | 7.34 | WKDRLNRLT | 2.26 | WKERLNYMT | 0.56 | WKEKLNQMS | 0.56 |
| NS5 | 2548 | 0.46 | 5 | 4 | 0 | Y | MTKEEFTRY | 93.79 | LTKEEFIRY | 2.82 | MTKEEFIRY | 1.69 | MTREEFTRY | 0.56 | MTKEEFARY | 0.56 |
| NS5 | 2549 | 0.27 | 5 | 4 | 0 | Y | TKEEFTRYR | 96.61 | TKEEFIRYR | 1.69 | TKEEFARYR | 0.56 | TREEFTRYR | 0.56 | |
| NS5 | 2550 | 0.32 | 6 | 5 | 0 | Y | KEEFTRYRK | 96.05 | KEEFIRYRK | 1.69 | KEEFARYRK | 0.56 | KEEFSRYRK | 0.56 | KEEFARYRK | 0.56 |
| NS5 | 2551 | 0.27 | 5 | 4 | 0 | Y | EEFTRYRKE | 96.61 | EEFIRYRKE | 1.69 | EEFARYRKE | 0.56 | EEFSRYRKE | 0.56 | |
| NS5 | 2552 | 0.27 | 5 | 4 | 0 | Y | EFTRYRKEA | 96.61 | EFIRYRKEA | 1.69 | EFARYRKEA | 0.56 | EFSRYRKEA | 0.56 | |
| NS5 | 2553 | 0.27 | 5 | 4 | 0 | Y | FTRYRKEAI | 96.61 | FIRYRKEAI | 1.69 | FARYRKEAI | 0.56 | FTRYRREAI | 0.56 | |
| NS5 | 2554 | 0.65 | 6 | 5 | 0 | Y | TRYRKEAIT | 89.27 | TRYRKEAIT | 7.34 | IRYRKEAIT | 1.69 | ARYRKEAIT | 0.56 | TRYRREAIT | 0.56 |
| NS5 | 2555 | 0.51 | 3 | 2 | 0 | Y | RYRKEAIIE | 89.83 | RYRKEAITE | 9.6 | | | | | |
| NS5 | 2556 | 0.51 | 3 | 2 | 0 | Y | YRKEAIIEV | 89.83 | YRKEAITEV | 9.6 | | | | | |
| NS5 | 2557 | 0.51 | 3 | 2 | 0 | Y | RKEAIIEVD | 89.83 | RKEAITEVD | 9.6 | | | | | |
| NS5 | 2558 | 0.51 | 3 | 2 | 0 | Y | KEAIIEVDR | 89.83 | KEAITEVDR | 9.6 | | | | | |

FIG. 24-89

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2559 | 0.51 | 3 | 2 | 0 | Y | EAIIEVDRS | 89.83 | EAIIEVDRS | 9.6 | | | | | | |
| NS5 | 2560 | 0.56 | 4 | 3 | 0 | Y | AIIEVDRSA | 89.27 | AIIEVDRSA | 9.6 | AITEVDRAP | 0.56 | | | | |
| NS5 | 2561 | 0.56 | 4 | 3 | 0 | Y | IIEVDRSAA | 89.27 | ITEVDRSAA | 9.6 | IEVDRSTA | 0.56 | | | | |
| NS5 | 2562 | 0.76 | 6 | 5 | 0 | Y | IEVDRSAAK | 86.44 | TEVDRSAAK | 9.6 | IEVDRSAAR | 2.26 | TEVDRAPAK | 0.56 | IEVDRSTAK | 0.56 |
| NS5 | 2572 | 0.68 | 5 | 4 | 0 | Y | ARKEGNVTG | 87.57 | ARREGNITG | 9.6 | ARKERNITG | 1.69 | ARREGNVTG | 0.56 | REGNVTGGH | 0.56 |
| NS5 | 2573 | 0.68 | 5 | 4 | 0 | Y | RKEGNVTGG | 87.57 | RREGNITGG | 9.6 | RKERNITGG | 1.69 | RREGNVTGG | 0.56 | | |
| NS5 | 2574 | 0.73 | 6 | 5 | 0 | Y | KEGNVTGGH | 87.01 | REGNITGGH | 9.6 | KERNITGGH | 1.69 | KEGNITGGH | 0.56 | | |
| NS5 | 2575 | 0.73 | 5 | 4 | 0 | Y | EGNVTGGHP | 86.44 | EGNITGGHP | 10.17 | ERNITGGHP | 1.69 | EGNVTGGHS | 1.13 | | |
| NS5 | 2576 | 0.73 | 5 | 4 | 0 | Y | GNVTGGHPV | 86.44 | GNITGGHPV | 10.17 | RNITGGHPV | 1.69 | GNVTGGHSV | 1.13 | | |
| NS5 | 2577 | 0.66 | 4 | 3 | 0 | Y | NVTGGHPYS | 86.44 | NITGGHPYS | 11.86 | NVTGGHSVS | 1.13 | | | | |
| NS5 | 2578 | 0.66 | 4 | 3 | 0 | Y | VTGGHPYSR | 86.44 | ITGGHPYSR | 11.86 | VTGGHSVSR | 1.13 | | | | |
| NS5 | 2579 | 0.14 | 3 | 2 | 0 | Y | TGGHPYSRG | 98.31 | TGGHSVSRG | 1.13 | | | | | | |
| NS5 | 2580 | 0.19 | 4 | 3 | 0 | Y | GGHPYSRGT | 97.74 | GGHSVSRGT | 1.13 | GGYPYSRGT | 0.56 | | | | |
| NS5 | 2581 | 0.19 | 4 | 3 | 0 | Y | GHPYSRGTA | 97.74 | GHSVSRGTA | 1.13 | GYPYSRGTA | 0.56 | | | | |
| NS5 | 2582 | 0.19 | 4 | 3 | 0 | Y | HPYSRGTAK | 97.74 | HSVSRGTAK | 1.13 | YPYSRGTAK | 0.56 | | | | |
| NS5 | 2583 | 0.14 | 3 | 2 | 0 | Y | PYSRGTAKL | 98.31 | SVSRGTAKL | 1.13 | | | | | | |
| NS5 | 2584 | 0.05 | 2 | 1 | 0 | Y | YSRGTAKLR | 99.44 | | | | | | | | |
| NS5 | 2585 | 0.05 | 2 | 1 | 0 | Y | SRGTAKLRW | 99.44 | | | | | | | | |
| NS5 | 2586 | 0.05 | 2 | 1 | 0 | Y | RGTAKLRWL | 99.44 | | | | | | | | |
| NS5 | 2587 | 0.05 | 2 | 1 | 0 | Y | GTAKLRWLV | 99.44 | | | | | | | | |
| NS5 | 2588 | 0.05 | 2 | 1 | 0 | Y | TAKLRWLVE | 99.44 | | | | | | | | |
| NS5 | 2589 | 0 | 1 | 1 | 0 | Y | AKLRWLVER | 100 | | | | | | | | |
| NS5 | 2590 | 0.05 | 2 | 1 | 0 | Y | KLRWLVERR | 99.44 | | | | | | | | |
| NS5 | 2591 | 0.05 | 2 | 1 | 0 | Y | LRWLVERRF | 99.44 | | | | | | | | |
| NS5 | 2592 | 0.05 | 2 | 1 | 0 | Y | RWLVERRFL | 99.44 | | | | | | | | |

FIG. 24-90

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2593 | 0.21 | 3 | 2 | 0 | Y | WLVERRFLE | 97.18 | WLVERRFLD | 2.26 | | | | |
| NS5 | 2594 | 0.21 | 3 | 2 | 0 | Y | LVERRFLEP | 97.18 | LVERRFLDP | 2.26 | | | | |
| NS5 | 2595 | 0.26 | 4 | 3 | 0 | Y | VERRFLEPV | 96.61 | VERRFLDPI | 2.26 | VERRFLEPI | 0.56 | | |
| NS5 | 2596 | 0.26 | 4 | 3 | 0 | Y | ERRFLEPVG | 96.61 | ERRFLDPIG | 2.26 | ERRFLEPIG | 0.56 | | |
| NS5 | 2597 | 0.26 | 4 | 3 | 0 | Y | RRFLEPVGK | 96.61 | RRFLDPIGK | 2.26 | RRFLEPIGK | 0.56 | | |
| NS5 | 2598 | 0.26 | 4 | 3 | 0 | Y | RFLEPVGKV | 96.61 | RFLDPIGKV | 2.26 | KFVEPVGKV | 0.56 | | |
| NS5 | 2599 | 0.63 | 5 | 4 | 0 | Y | FLEPVGKVI | 89.27 | FLEPVGKVD | 7.34 | FLDPIGKVV | 2.26 | FVEPVGRVI | 0.56 |
| NS5 | 2600 | 0.63 | 5 | 4 | 0 | Y | LEPVGKVID | 89.27 | LEPVGKVDL | 7.34 | LDPIGKVVD | 2.26 | VEPVGRVID | 0.56 |
| NS5 | 2601 | 0.63 | 5 | 4 | 0 | Y | EPVGKVIDL | 89.27 | EPVGKVDLG | 7.34 | DPIGKVVDL | 2.26 | EPIGKVVIDL | 0.56 |
| NS5 | 2602 | 0.63 | 5 | 4 | 0 | Y | PVGKVIDLG | 89.27 | PVGKVDLGC | 7.34 | PIGKVVDLG | 2.26 | PVGRVIDLG | 0.56 |
| NS5 | 2603 | 0.63 | 5 | 4 | 0 | Y | VGKVIDLGC | 89.27 | VGKVDLGCG | 7.34 | IGKVVDLGC | 2.26 | VGRVIDLGC | 0.56 |
| NS5 | 2604 | 0.51 | 3 | 2 | 0 | Y | GKVIDLGCG | 89.83 | GKVVDLGCG | 9.6 | | | | |
| NS5 | 2605 | 0.51 | 3 | 2 | 0 | Y | KVIDLGCGR | 89.83 | KVVDLGCGR | 9.6 | | | | |
| NS5 | 2606 | 0.46 | 2 | 2 | 0 | Y | VIDLGCGRG | 90.4 | VVDLGCGRG | 9.6 | | | | |
| NS5 | 2607 | 0.46 | 2 | 2 | 0 | Y | IDLGCGRGG | 90.4 | VDLGCGRGG | 9.6 | | | | |
| NS5 | 2608 | 0 | 1 | 1 | 0 | Y | DLGCGRGGW | 100 | | | | | | |
| NS5 | 2609 | 0 | 1 | 1 | 0 | Y | LGCGRGGWC | 100 | | | | | | |
| NS5 | 2610 | 0 | 1 | 1 | 0 | Y | GCGRGGWCY | 100 | | | | | | |
| NS5 | 2611 | 0 | 1 | 1 | 0 | Y | CGRGGWCY | 100 | | | | | | |
| NS5 | 2612 | 0 | 1 | 1 | 0 | Y | GRGGWCYM | 100 | | | | | | |
| NS5 | 2613 | 0 | 1 | 1 | 0 | Y | RGGWCYYM | 100 | | | | | | |
| NS5 | 2614 | 0 | 1 | 1 | 0 | Y | GGWCYYMA | 100 | | | | | | |
| NS5 | 2615 | 0 | 1 | 1 | 0 | Y | GWCYYMAT | 100 | | | | | | |
| NS5 | 2616 | 0 | 1 | 1 | 0 | Y | WCYYMATQ | 100 | | | | | | |
| NS5 | 2617 | 0.05 | 2 | 1 | 0 | Y | CYYMATQKR | 99.44 | | | | | | |

FIG. 24-91

Species: WNV (9-mers)

| protein | block starting position | block entropy | total peptides in block | # peptides required to cover 99% of block | gap/X fraction | 99% of block covered w/ =<5 peptides? | peptides required to cover 99% of block | frequency | peptides required to cover 99% of block | frequency |
|---|---|---|

FIG. 24-92

Species: WNV (9-mers)

| protein

FIG. 24-93

Species: WNV (9-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2668 | 0.58 | 4 | 3 | 0.56 | Y | CCDTLLCDI | 88.14 | ASDTLLCDI | 10.17 | VSDTLLCDI | 0.56 | | |
| NS5 | 2669 | 0.49 | 2 | 2 | 0.56 | Y | CDTLLCDIG | 88.7 | SDTLLCDIG | 10.73 | | | | |
| NS5 | 2670 | 0 | 1 | 1 | 0.56 | Y | DTLLCDIGE | 99.44 | | | | | | |
| NS5 | 2671 | 0 | 1 | 1 | 0.56 | Y | TLLCDIGES | 99.44 | | | | | | |
| NS5 | 2672 | 0.16 | 2 | 2 | 0 | Y | LLCDIGESS | 97.74 | LLCDIGESA | 2.26 | | | | |
| NS5 | 2673 | 0.16 | 2 | 2 | 0 | Y | LCDIGESSS | 97.74 | LCDIGESAS | 2.26 | | | | |
| NS5 | 2674 | 0.16 | 2 | 2 | 0 | Y | CDIGESSSS | 97.74 | CDIGESASS | 2.26 | | | | |
| NS5 | 2675 | 0.16 | 2 | 2 | 0 | Y | DIGESSSSA | 97.74 | DIGESASSA | 2.26 | | | | |
| NS5 | 2676 | 0.16 | 2 | 2 | 0 | Y | IGESSSSAE | 97.74 | IGESASSAE | 2.26 | | | | |
| NS5 | 2677 | 0.16 | 2 | 2 | 0 | Y | GESSSSAEV | 97.74 | GESASSAEV | 2.26 | | | | |
| NS5 | 2678 | 0.16 | 2 | 2 | 0 | Y | ESSSSAEVE | 97.74 | ESASSAEVE | 2.26 | | | | |
| NS5 | 2679 | 0.16 | 2 | 2 | 0 | Y | SSSSAEVEE | 97.74 | SASSAEVEE | 2.26 | | | | |
| NS5 | 2680 | 0.16 | 2 | 2 | 0 | Y | SSSAEVEEH | 97.74 | ASSAEVEEH | 2.26 | | | | |
| NS5 | 2681 | 0 | 1 | 1 | 0 | Y | SSAEVEEHR | 100 | | | | | | |
| NS5 | 2682 | 0 | 1 | 1 | 0 | Y | SAEVEEHRT | 100 | | | | | | |
| NS5 | 2683 | 0.69 | 4 | 3 | 0 | Y | AEVEEHRTI | 86.44 | AEVEEHRTV | 10.73 | AEVEEHRTL | 2.26 | | |
| NS5 | 2684 | 0.69 | 4 | 3 | 0 | Y | EVEEHRTIR | 86.44 | EVEEHRTVR | 10.73 | EVEEHRTLR | 2.26 | | |
| NS5 | 2685 | 0.69 | 4 | 3 | 0 | Y | VEEHRTIRV | 86.44 | VEEHRTVRV | 10.73 | VEEHRTLRV | 2.26 | | |
| NS5 | 2686 | 0.69 | 4 | 3 | 0 | Y | EEHRTIRVL | 86.44 | EEHRTVRVL | 10.73 | EEHRTLRVL | 2.26 | | |
| NS5 | 2687 | 0.69 | 4 | 3 | 0 | Y | EHRTIRVLE | 86.44 | EHRTVRVLE | 10.73 | EHRTLRVLE | 2.26 | | |
| NS5 | 2688 | 0.74 | 5 | 4 | 0 | Y | HRTIRVLEM | 85.88 | HRTVRVLEM | 10.73 | HRTLRVLEM | 2.26 | HRTMRVLEM | 0.56 |
| NS5 | 2689 | 0.74 | 5 | 4 | 0 | Y | RTIRVLEMV | 85.88 | RTVRVLEMV | 10.73 | RTLRVLEMV | 2.26 | RTIRVLEIV | 0.56 |
| NS5 | 2690 | 0.74 | 5 | 4 | 0 | Y | TIRVLEMVE | 85.88 | TVRVLEMVE | 10.73 | TLRVLEMVE | 2.26 | TIRVLEIVE | 0.56 |
| NS5 | 2691 | 0.74 | 5 | 4 | 0 | Y | IRVLEMVED | 85.88 | VRVLEMVED | 10.73 | LRVLEMVED | 2.26 | IRVLEIVED | 0.56 |
| NS5 | 2692 | 0.05 | 2 | 1 | 0 | Y | RVLEMVEDW | 99.44 | | | | | | |

FIG. 24-94

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2693 | 0.05 | 2 | 1 | 0 | Y | VLEMVEDWL | 99.44 | | | | |
| NS5 | 2694 | 0.05 | 2 | 1 | 0 | Y | LEMVEDWLH | 99.44 | | | | |
| NS5 | 2695 | 0.05 | 2 | 1 | 0 | Y | EMVEDWLHR | 99.44 | | | | |
| NS5 | 2696 | 0.05 | 2 | 1 | 0 | Y | MVEDWLHRG | 99.44 | | | | |
| NS5 | 2697 | 0 | 1 | 1 | 0 | Y | VEDWLHRGP | 100 | | | | |
| NS5 | 2698 | 0.62 | 2 | 2 | 0 | Y | EDWLHRGPR | 84.75 | EDWLHRGPK | 15.25 | | |
| NS5 | 2699 | 0.62 | 2 | 2 | 0 | Y | DWLHRGPRE | 84.75 | DWLHRGPKE | 15.25 | | |
| NS5 | 2700 | 0.62 | 2 | 2 | 0 | Y | WLHRGPREF | 84.75 | WLHRGPKEF | 15.25 | | |
| NS5 | 2701 | 0.62 | 2 | 2 | 0 | Y | LHRGPREFC | 84.75 | LHRGPKEFC | 15.25 | | |
| NS5 | 2702 | 0.81 | 4 | 3 | 0 | Y | HRGPREFCV | 84.18 | HRGPKEFCI | 9.6 | HRGPKEFCV | 5.65 |
| NS5 | 2703 | 0.81 | 4 | 3 | 0 | Y | RGPREFCVK | 84.18 | RGPKEFCIK | 9.6 | RGPKEFCVK | 5.65 |
| NS5 | 2704 | 0.81 | 4 | 3 | 0 | Y | GPREFCVKV | 84.18 | GPKEFCIKV | 9.6 | GPKEFCVKV | 5.65 |
| NS5 | 2705 | 0.81 | 4 | 3 | 0 | Y | PREFCVKVL | 84.18 | PKEFCIKVL | 9.6 | PKEFCVKVL | 5.65 |
| NS5 | 2706 | 0.81 | 4 | 3 | 0 | Y | REFCVKVLC | 84.18 | KEFCIKVLC | 9.6 | KEFCVKVLC | 5.65 |
| NS5 | 2707 | 0.47 | 2 | 2 | 0 | Y | EFCVKVLCP | 89.83 | EFCIKVLCP | 10.17 | | |
| NS5 | 2708 | 0.47 | 2 | 2 | 0 | Y | FCVKVLCPY | 89.83 | FCIKVLCPY | 10.17 | | |
| NS5 | 2709 | 0.47 | 2 | 2 | 0 | Y | CVKVLCPYM | 89.83 | CIKVLCPYM | 10.17 | | |
| NS5 | 2710 | 0.47 | 2 | 2 | 0 | Y | VKVLCPYMP | 89.83 | IKVLCPYMP | 10.17 | | |
| NS5 | 2711 | 0.05 | 2 | 1 | 0 | Y | KVLCPYMPK | 99.44 | | | | |
| NS5 | 2712 | 0.05 | 2 | 1 | 0 | Y | VLCPYMPKV | 99.44 | | | | |
| NS5 | 2713 | 0.1 | 3 | 2 | 0 | Y | LCPYMPKVI | 98.87 | LCPYMPRVI | 0.56 | | |
| NS5 | 2714 | 0.1 | 3 | 2 | 0 | Y | CPYMPKVIE | 98.87 | CPYMPKVVE | 0.56 | | |
| NS5 | 2715 | 0.1 | 3 | 2 | 0 | Y | PYMPKVIEK | 98.87 | PYMPKVVEK | 0.56 | | |
| NS5 | 2716 | 0.1 | 3 | 2 | 0 | Y | YMPKVIEKM | 98.87 | YMPKVVEKM | 0.56 | | |
| NS5 | 2717 | 0.1 | 3 | 2 | 0 | Y | MPKVIEKME | 98.87 | MPRVIEKME | 0.56 | | |

FIG. 24-95

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2718 | 0.71 | 6 | 5 | 0 | Y | PKVIEKMEL | 88.7 | PKVIEKMET | 6.21 | PKVIEKMEV | 2.82 | PKVIEKMEI | 1.13 | PKVIEKMET | 0.56 |
| NS5 | 2719 | 0.71 | 6 | 5 | 0 | Y | KVIEKMELL | 88.7 | KVIEKMETL | 6.21 | KVIEKMEVL | 2.82 | KVIEKMEIL | 1.13 | RVIEKMETL | 0.56 |
| NS5 | 2720 | 0.68 | 5 | 4 | 0 | Y | VIEKMELLQ | 88.7 | VIEKMETLQ | 6.78 | VIEKMEVLQ | 2.82 | VIEKMEILQ | 1.13 | VEKMEVLQR | 0.56 |
| NS5 | 2721 | 0.73 | 6 | 5 | 0 | Y | IEKMELLQR | 88.14 | IEKMETLQR | 6.78 | IEKMEVLQR | 2.82 | IEKMEILQR | 1.13 | | |
| NS5 | 2722 | 0.7 | 5 | 4 | 0 | Y | EKMELLQRR | 88.14 | EKMETLQRR | 6.78 | EKMEVLQRR | 3.39 | EKMEILQRR | 1.13 | | |
| NS5 | 2723 | 0.7 | 5 | 4 | 0 | Y | KMELLQRRY | 88.14 | KMETLQRRY | 6.78 | KMEVLQRRY | 3.39 | KMEILQRRY | 1.13 | | |
| NS5 | 2724 | 0.7 | 5 | 4 | 0 | Y | MELLQRRYG | 88.14 | METLQRRYG | 6.78 | MEVLQRRYG | 3.39 | MEILQRRYG | 1.13 | | |
| NS5 | 2725 | 0.7 | 5 | 4 | 0 | Y | ELLQRRYGG | 88.14 | ETLQRRYGG | 6.78 | EVLQRRYGG | 3.39 | EILQRRYGG | 1.13 | | |
| NS5 | 2726 | 0.7 | 5 | 4 | 0 | Y | LLQRRYGGG | 88.14 | TLQRRYGGG | 6.78 | VLQRRYGGG | 3.39 | ILQRRYGGG | 1.13 | | |
| NS5 | 2727 | 0.05 | 2 | 1 | 0 | Y | LQRYGGGL | 99.44 | | | | | | | | |
| NS5 | 2728 | 0.17 | 3 | 2 | 0 | Y | QRRYGGGLV | 97.74 | QRRYGGGLI | 1.69 | | | | | | |
| NS5 | 2729 | 0.17 | 3 | 2 | 0 | Y | RRYGGGLVR | 97.74 | RRYGGGLIR | 1.69 | | | | | | |
| NS5 | 2730 | 0.12 | 2 | 2 | 0 | Y | RYGGGLVRN | 98.31 | RYGGGLIRN | 1.69 | | | | | | |
| NS5 | 2731 | 0.12 | 2 | 2 | 0 | Y | YGGGLVRNP | 98.31 | YGGGLIRNP | 1.69 | | | | | | |
| NS5 | 2732 | 0.12 | 2 | 2 | 0 | Y | GGGLVRNPL | 98.31 | GGGLIRNPL | 1.69 | | | | | | |
| NS5 | 2733 | 0.12 | 2 | 2 | 0 | Y | GGLVRNPLS | 98.31 | GGLIRNPLS | 1.69 | | | | | | |
| NS5 | 2734 | 0.12 | 2 | 2 | 0 | Y | GLVRNPLSR | 98.31 | GLIRNPLSR | 1.69 | | | | | | |
| NS5 | 2735 | 0.12 | 2 | 2 | 0 | Y | LVRNPLSRN | 98.31 | LIRNPLSRN | 1.69 | | | | | | |
| NS5 | 2736 | 0.12 | 2 | 2 | 0 | Y | VRNPLSRNS | 98.31 | IRNPLSRNS | 1.69 | | | | | | |
| NS5 | 2737 | 0 | 1 | 1 | 0 | Y | RNPLSRNST | 100 | | | | | | | | |
| NS5 | 2738 | 0 | 1 | 1 | 0 | Y | NPLSRNSTH | 100 | | | | | | | | |
| NS5 | 2739 | 0 | 1 | 1 | 0 | Y | PLSRNSTHE | 100 | | | | | | | | |
| NS5 | 2740 | 0 | 1 | 1 | 0 | Y | LSRNSTHEM | 100 | | | | | | | | |
| NS5 | 2741 | 0 | 1 | 1 | 0 | Y | SRNSTHEMY | 100 | | | | | | | | |
| NS5 | 2742 | 0 | 1 | 1 | 0 | Y | RNSTHEMYW | 100 | | | | | | | | |

FIG. 24-96

Species: WNV (9-mers)

| protein | block starting position | block entropy | total peptides in block | # peptides required to cover 99% of block | gap/X fraction | 99% of block covered w

FIG. 24-97

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 24-98

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2797 | 0.1 | 3 | 2 | 0 | Y | GKPLLNSDT | 98.87 | GRPLLNSDT | 0.56 | | | | |
| NS5 | 2798 | 0.31 | 5 | 4 | 0 | Y | KPLLNSDTS | 96.05 | KPLLNSDTG | 2.26 | RPLLNSDTS | 0.56 | | |
| NS5 | 2799 | 0.31 | 5 | 4 | 0 | Y | PLLNSDTSK | 96.05 | PLLNSDTGK | 2.26 | PLLNSDTRK | 0.56 | | |
| NS5 | 2800 | 0.31 | 5 | 4 | 0 | Y | LLNSDTSKI | 96.05 | LLNSDTGKI | 2.26 | LLSDTSKI | 0.56 | | |
| NS5 | 2801 | 0.36 | 6 | 5 | 0 | Y | LNSDTSKIK | 95.48 | LNSDTGKIR | 2.26 | LNSDTSKIN | 0.56 | LNSDTRKIIK | 0.56 |
| NS5 | 2803 | 0.36 | 6 | 5 | 0 | Y | SDTSKIKNR | 95.48 | SDTGKIRNR | 2.26 | SDTSKINNR | 0.56 | SDTRKIKNR | 0.56 |
| NS5 | 2810 | 0.67 | 6 | 5 | 0 | Y | NRIERLRRE | 88.14 | NRIERLKKE | 9.04 | NRIERLKRE | 1.13 | NRIEKLKKE | 0.56 |
| NS5 | 2811 | 0.62 | 6 | 4 | 0 | Y | RIERLRREY | 88.14 | RIERLKKEY | 10.17 | RVERLKREY | 0.56 | | |
| NS5 | 2812 | 0.65 | 6 | 5 | 0 | Y | IERLRREYS | 88.14 | IERLKKEYS | 9.6 | IERLKREYS | 0.56 | IERLKKEYN | 0.56 |
| NS5 | 2826 | 0.7 | 6 | 5 | 0 | Y | DENHPYRTW | 88.7 | DANHPYRTW | 6.78 | DDNHPYRTW | 2.26 | DGNHPYRTW | 1.13 |
| NS5 | 2827 | 0.7 | 6 | 5 | 0 | Y | ENHPYRTWN | 88.7 | ANHPYRTWN | 6.78 | DNHPYRTWN | 2.26 | GNHPYRTWN | 1.13 |
| NS5 | 2828 | 0 | 1 | 1 | 0 | Y | NHPYRTWNY | 100 | | | | | | |
| NS5 | 2829 | 0 | 1 | 1 | 0 | Y | HPYRTWNYH | 100 | | | | | | |
| NS5 | 2830 | 0 | 1 | 1 | 0 | Y | PYRTWNYHG | 100 | | | | | | |
| NS5 | 2831 | 0 | 1 | 1 | 0 | Y | YRTWNYHGS | 100 | | | | | | |
| NS5 | 2832 | 0 | 1 | 1 | 0 | Y | RTWNYHGSY | 100 | | | | | | |
| NS5 | 2833 | 0.57 | 2 | 2 | 0 | Y | TWNYHGSYD | 86.44 | TWNYHGSYE | 13.56 | | | | |
| NS5 | 2834 | 0.57 | 2 | 2 | 0 | Y | WNYHGSYDV | 86.44 | WNYHGSYEV | 13.56 | | | | |
| NS5 | 2835 | 1.2 | 5 | 4 | 0 | Y | NYHGSYDVK | 72.32 | NYHGSYDVR | 13.56 | NYHGSYEVK | 12.99 | NYHGSYEVN | 0.56 |
| NS5 | 2836 | 1.2 | 5 | 4 | 0 | Y | YHGSYDVKP | 72.32 | YHGSYDVRP | 13.56 | YHGSYEVKP | 12.99 | YHGSYDVNP | 0.56 |
| NS5 | 2837 | 1.2 | 5 | 4 | 0 | Y | HGSYDVKPT | 72.32 | HGSYDVRPT | 13.56 | HGSYEVKPT | 12.99 | HGSYEVNPL | 0.56 |
| NS5 | 2838 | 1.2 | 5 | 4 | 0 | Y | GSYDVKPTG | 72.32 | GSYDVRPTG | 13.56 | GSYEVKPTG | 12.99 | GSYDVNPTG | 0.56 |
| NS5 | 2839 | 1.2 | 5 | 4 | 0 | Y | SYDVKPTGS | 72.32 | SYDVRPTGS | 13.56 | SYEVKPTGS | 12.99 | SYDVNPTGS | 0.56 |
| NS5 | 2840 | 1.2 | 5 | 4 | 0 | Y | YDVKPTGSA | 72.32 | YDVRPTGSA | 13.56 | YEVKPTGSA | 12.99 | YEVNPLVSA | 0.56 |
| NS5 | 2841 | 1.2 | 5 | 4 | 0 | Y | DVKPTGSAS | 72.32 | DVRPTGSAS | 13.56 | EVKPTGSAS | 12.99 | EVNPLVSAS | 0.56 |

FIG. 24-99

Species: WNV (9-mers)

| protein | block starting position | block entropy | total peptides in block | #

FIG. 24-101

Species: WNV (9-mers)

| prot

FIG. 24-102

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2933 | 0 | 1 | 1 | 0 | Y | KWNSNAALG | 100 | | | | | | |
| NS5 | 2934 | 0 | 1 | 1 | 0 | Y | VNSNAALGA | 100 | | | | | | |
| NS5 | 2935 | 0 | 1 | 1 | 0 | Y | NSNAALGAM | 100 | | | | | | |
| NS5 | 2936 | 0 | 1 | 1 | 0 | Y | SNAALGAMF | 100 | | | | | | |
| NS5 | 2937 | 0 | 1 | 1 | 0 | Y | NAALGAMFE | 100 | | | | | | |
| NS5 | 2938 | 0 | 1 | 1 | 0 | Y | AALGAMFEE | 100 | | | | | | |
| NS5 | 2939 | 0 | 1 | 1 | 0 | Y | ALGAMFEEQ | 100 | | | | | | |
| NS5 | 2940 | 0 | 1 | 1 | 0 | Y | LGAMFEEQN | 100 | | | | | | |
| NS5 | 2941 | 0 | 1 | 1 | 0 | Y | GAMFEEQNQ | 100 | | | | | | |
| NS5 | 2942 | 0 | 1 | 1 | 0 | Y | AMFEEQNQW | 100 | | | | | | |
| NS5 | 2943 | 0.68 | 3 | 3 | 0 | Y | MFEEQNQWR | 85.88 | MFEEQNQWK | 11.86 | MFEEQNQWS | 2.26 | | |
| NS5 | 2944 | 0.79 | 4 | 4 | 0 | Y | FEEQNQWRS | 85.88 | FEEQNQWKN | 7.91 | FEEQNQWKS | 3.95 | FEEQNQWSN | 2.26 | |
| NS5 | 2945 | 0.79 | 4 | 4 | 0 | Y | EEQNQWRSA | 85.88 | EEQNQWKNA | 7.91 | EEQNQWKSA | 3.95 | EEQNQWSNA | 2.26 | |
| NS5 | 2946 | 0.79 | 4 | 4 | 0 | Y | EQNQWRSAR | 85.88 | EQNQWKNAR | 7.91 | EQNQWKSAR | 3.95 | EQNQWSNAR | 2.26 | |
| NS5 | 2947 | 0.87 | 5 | 5 | 0 | Y | QNQWRSARE | 84.75 | QNQWKNARE | 7.91 | QNQWKSARE | 3.95 | QNQWSNARE | 2.26 | QNQWRSARA | 1.13 |
| NS5 | 2948 | 0.87 | 5 | 5 | 0 | Y | NQWRSAREA | 84.75 | NQWKNAREA | 7.91 | NQWKSAREA | 3.95 | NQWSNAREA | 2.26 | NQWRSARAA | 1.13 |
| NS5 | 2949 | 0.87 | 5 | 5 | 0 | Y | QWRSAREAV | 84.75 | QWKNAREAV | 7.91 | QWKSAREAV | 3.95 | QWSNAREAV | 2.26 | QWRSARAAV | 1.13 |
| NS5 | 2950 | 0.87 | 5 | 5 | 0 | Y | WRSAREAVE | 84.75 | WKNAREAVE | 7.91 | WKSAREAVE | 3.95 | WSNAREAVE | 2.26 | WRSARAAVE | 1.13 |
| NS5 | 2951 | 0.87 | 6 | 5 | 0 | Y | RSAREAVED | 86.44 | KNAREAVED | 7.91 | KSAREAVED | 3.95 | SNAREAVED | 2.26 | RSARAAVED | 1.13 |
| NS5 | 2952 | 0.75 | 5 | 5 | 0 | Y | SAREAVEDP | 96.61 | NAREAVEDP | 10.17 | SAREAVEDL | 1.13 | SAREAVEDP | 1.13 | SAREAVEDS | 0.56 |
| NS5 | 2953 | 0.28 | 5 | 4 | 0 | Y | AREAVEDPK | 96.61 | ARAAVEDPK | 1.13 | AREAVEDLK | 1.13 | AREAVEDQK | 0.56 | | |
| NS5 | 2954 | 0.28 | 5 | 4 | 0 | Y | REAVEDPKF | 96.61 | REAVEDLKF | 1.13 | RAAVEDPKF | 1.13 | REAVEDSTF | 0.56 | | |
| NS5 | 2955 | 0.28 | 5 | 4 | 0 | Y | EAVEDPKFW | 97.74 | AAVEDPKFW | 1.13 | EAVEDLKFW | 1.13 | EAVEDSTFW | 0.56 | | |
| NS5 | 2956 | 0.19 | 4 | 3 | 0 | Y | AVEDPKFWE | 96.61 | AVEDLKFWE | 1.13 | AVEDQKFWE | 0.56 | | | |
| NS5 | 2957 | 0.28 | 5 | 4 | 0 | Y | VEDPKFWEM | 96.61 | VEDLKFWEM | 1.13 | VEDPKFWEI | 1.13 | VEDQKFWEM | 0.56 | | |

FIG. 24-103

Species: WNV (9-mers)

| protein | block starting position

FIG. 24-104

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
|

FIG. 24-105

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

FIG. 24-106

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3033 | 0 | 1 | 1 | 0 | Y | NSGGGVEGL

FIG. 24-107

Species: WNV (9-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3069 | 0.57 | 4 | 3 | 0 | Y | WDTRITRAD | 88.7 | WDTRITKAD | 10.17 | WDTRITMTD | 0.56 | | |
| NS5 | 3070 | 0.57 | 4 | 3 | 0 | Y | DTRITRADL | 88.7 | DTRITKADL | 10.17 | DTRITMTDL | 0.56 | | |
| NS5 | 3071 | 0.57 | 4 | 3 | 0 | Y | TRITRADLE | 88.7 | TRITKADLE | 10.17 | TPITKADLE | 0.56 | | |
| NS5 | 3072 | 0.57 | 4 | 3 | 0 | Y | RITRADLEN | 88.7 | RITKADLEN | 10.17 | PITKADLEN | 0.56 | | |
| NS5 | 3073 | 0.54 | 3 | 2 | 0 | Y | ITRADLENE | 88.7 | ITKADLENE | 10.73 | | | | |
| NS5 | 3074 | 0.54 | 3 | 2 | 0 | Y | TRADLENEA | 88.7 | TKADLENEA | 10.73 | | | | |
| NS5 | 3075 | 0.54 | 3 | 2 | 0 | Y | RADLENEAK | 88.7 | KADLENEAK | 10.73 | | | | |
| NS5 | 3076 | 0.05 | 2 | 1 | 0 | Y | ADLENEAKV | 99.44 | | | | | | |
| NS5 | 3077 | 0 | 1 | 1 | 0 | Y | DLENEAKVL | 100 | | | | | | |
| NS5 | 3078 | 0 | 1 | 1 | 0 | Y | LENEAKVLE | 100 | | | | | | |
| NS5 | 3079 | 0.16 | 2 | 2 | 0 | Y | ENEAKVLEL | 97.74 | ENEAKVLEF | 2.26 | | | | |
| NS5 | 3080 | 0.16 | 2 | 2 | 0 | Y | NEAKVLELL | 97.74 | NEAKVLEFL | 2.26 | | | | |
| NS5 | 3081 | 0.21 | 3 | 2 | 0 | Y | EAKVLELLD | 97.18 | EAKVLEFLD | 2.26 | | | | |
| NS5 | 3082 | 0.26 | 4 | 3 | 0 | Y | AKVLELLDG | 96.61 | AKVLEFLDG | 2.26 | AKVLELLEG | 0.56 | | |
| NS5 | 3083 | 0.26 | 4 | 3 | 0 | Y | KVLELLDGE | 96.61 | KVLEFLDGE | 2.26 | KVLELLEGE | 0.56 | | |
| NS5 | 3084 | 0.26 | 4 | 3 | 0 | Y | VLELLDGEH | 96.61 | VLEFLDGEH | 2.26 | VLELLEGEH | 0.56 | | |
| NS5 | 3085 | 0.26 | 4 | 3 | 0 | Y | LELLDGEHR | 96.61 | LEFLDGEHR | 2.26 | LELLEGEHR | 0.56 | | |
| NS5 | 3086 | 0.26 | 4 | 3 | 0 | Y | ELLDGEHRR | 96.61 | EFLDGEHRR | 2.26 | ELLDREHRR | 0.56 | | |
| NS5 | 3087 | 0.26 | 4 | 3 | 0 | Y | LLDGEHRRL | 96.61 | FLDGEHRRL | 2.26 | LLDREHRRL | 0.56 | | |
| NS5 | 3088 | 0.1 | 3 | 2 | 0 | Y | LDGEHRRLA | 98.87 | LDREHRRLA | 0.56 | | | | |
| NS5 | 3089 | 0.1 | 3 | 2 | 0 | Y | DGEHRRLAR | 98.87 | EGEHRRLAR | 0.56 | | | | |
| NS5 | 3090 | 0.56 | 3 | 2 | 0 | Y | GEHRRLARA | 88.14 | GEHRRLARS | 11.3 | | | | |
| NS5 | 3091 | 0.59 | 3 | 3 | 0 | Y | EHRRLARAI | 88.7 | EHRRLARSI | 9.04 | EHRRLARSV | 2.26 | | |
| NS5 | 3092 | 0.59 | 3 | 3 | 0 | Y | HRRLARAII | 88.7 | HRRLARSII | 9.04 | HRRLARSVI | 2.26 | | |
| NS5 | 3093 | 0.62 | 4 | 3 | 0 | Y | RRLARAIIE | 88.7 | RRLARSIIE | 8.47 | RRLARSVIE | 2.26 | | |

FIG. 24-108

Species: WNV (9-mers)

| protein | block starting position | block

FIG. 24-110

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3144 | 0.19 | 4 | 3 | 0 | Y | FTNLAVQLV | 97.74 | FTNLSVQLV | 1.13 | FTNLAFQLG | 0.56 | | |
| NS5 | 3145 | 0.19 | 4 | 3 | 0 | Y | TNLAVQLVR | 97.74 | TNLSVQLVR | 1.13 | SNLAVQLVR | 0.56 | | |
| NS5 | 3146 | 0.19 | 4 | 3 | 0 | Y | NLAVQLVRM | 97.74 | NLSVQLVRM | 1.13 | NLAVQLVRR | 0.56 | | |
| NS5 | 3147 | 0.19 | 4 | 3 | 0 | Y | LAVQLVRMM | 97.74 | LSVQLVRMM | 1.13 | LAVQLVRRE | 0.56 | | |
| NS5 | 3148 | 0.19 | 3 | 3 | 0 | Y | AVQLVRMME | 97.74 | SVQLVRMME | 1.13 | AVQLVRRRE | 0.56 | | |
| NS5 | 3149 | 0.1 | 3 | 2 | 0 | Y | VQLVRMMEG | 98.87 | FQLGRRREG | 0.56 | | | | |
| NS5 | 3150 | 0.1 | 3 | 2 | 0 | Y | QLVRMMEGE | 98.87 | QLVRRREGE | 0.56 | | | | |
| NS5 | 3151 | 0.1 | 3 | 2 | 0 | Y | LVRMMEGEG | 98.87 | LGRRREGEG | 0.56 | | | | |
| NS5 | 3152 | 0.1 | 3 | 2 | 0 | Y | VRMMEGEGV | 98.87 | GRRREGEGV | 0.56 | | | | |
| NS5 | 3153 | 0.53 | 4 | 3 | 0 | Y | RMMEGEGVI | 89.83 | RMMEGEGVW | 9.04 | RRREGEGVI | 1.13 | | |
| NS5 | 3154 | 0.57 | 4 | 3 | 0 | Y | MMEGEGVIG | 89.27 | MMEGEGVWG | 9.04 | RREGEGVIG | 1.13 | | |
| NS5 | 3155 | 0.57 | 4 | 3 | 0 | Y | MEGEGVIGP | 89.27 | MEGEGVWGP | 9.04 | REGEGVIGP | 1.13 | | |
| NS5 | 3156 | 0.59 | 5 | 4 | 0 | Y | EGEGVIGPD | 89.27 | EGEGVWGPD | 9.04 | EGEGVITPD | 0.56 | EGEGVIGPY | 0.56 |
| NS5 | 3157 | 0.59 | 5 | 4 | 0 | Y | GEGVIGPDD | 89.27 | GEGVWGPDD | 9.04 | GEGVIGPYD | 0.56 | GEGVIGPED | 0.56 |
| NS5 | 3158 | 0.64 | 6 | 4 | 0 | Y | EGVIGPDDV | 88.7 | EGVWGPDDV | 9.04 | EGVIGPDDI | 0.56 | EGVITPDDV | 0.56 |
| NS5 | 3159 | 0.64 | 6 | 4 | 0 | Y | GVIGPDDVE | 88.7 | GVWGPDDVE | 9.04 | GVIGPDYVE | 0.56 | GVITPDDVE | 0.56 |
| NS5 | 3171 | 0.34 | 5 | 5 | 0 | Y | KGKGPKVRT | 95.48 | KGKGVKVRV | 2.26 | KRKGPKVRT | 1.13 | RGKGPKVRT | 0.56 |
| NS5 | 3172 | 0.29 | 4 | 4 | 0 | Y | GKGPKVRTW | 96.05 | GKGWKVRVW | 2.26 | RKGPKVRTW | 1.13 | | |
| NS5 | 3173 | 0.21 | 3 | 2 | 0 | Y | KGPKVRTWL | 97.18 | KGVKVRVWL | 2.26 | | | | |
| NS5 | 3174 | 0.28 | 3 | 3 | 0 | Y | GPKVRTWLF | 96.05 | GVKVRVWLF | 2.26 | GPKVRTWLS | 1.69 | | |
| NS5 | 3175 | 0.28 | 3 | 2 | 0 | Y | PKVRTWLFE | 96.05 | VKVRVWLFE | 2.26 | PKVRTWLSE | 1.69 | | |
| NS5 | 3176 | 0.28 | 3 | 3 | 0 | Y | KVRTWLFEN | 96.05 | KVRVWLFEN | 2.26 | KVRTWLSEN | 1.69 | | |
| NS5 | 3177 | 0.28 | 3 | 3 | 0 | Y | VRTWLFENG | 96.05 | VRVWLFENG | 2.26 | VRTWLSENG | 1.69 | | |
| NS5 | 3178 | 0.33 | 4 | 3 | 0 | Y | RTWLFENGE | 95.48 | RVWLFENGE | 2.26 | RTWLSENGE | 1.69 | | |
| NS5 | 3179 | 0.33 | 4 | 3 | 0 | Y | TWLFENGEE | 95.48 | VWLFENGEE | 2.26 | TWLSENGEE | 1.69 | | |

FIG. 24-111

Species: WNV (9-mers)

| prot

FIG. 24-112

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 24-113

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 24-114

Species: WNV (9-mers)

| protein | block starting position | block entropy | total peptides in block | # peptides required to cover 99% of block | gap/X fraction | 99% of block covered w/ <= 5 peptides? | peptides required to cover 99% of block

FIG. 24-115

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3280 | 0 | 1 | 1 | 0 | Y | WNVRDTACL | 100 | | |
| NS5 | 3281 | 0 | 1 | 1 | 0 | Y | NVRDTACLA | 100 | | |
| NS5 | 3282 | 0 | 1 | 1 | 0 | Y | VRDTACLAK | 100 | | |
| NS5 | 3283 | 0 | 1 | 1 | 0 | Y | RDTACLAKS | 100 | | |
| NS5 | 3284 | 0 | 1 | 1 | 0 | Y | DTACLAKSY | 100 | | |
| NS5 | 3285 | 0 | 1 | 1 | 0 | Y | TACLAKSYA | 100 | | |
| NS5 | 3286 | 0 | 1 | 1 | 0 | Y | ACLAKSYAQ | 100 | | |
| NS5 | 3287 | 0 | 1 | 1 | 0 | Y | CLAKSYAQM | 100 | | |
| NS5 | 3288 | 0 | 1 | 1 | 0 | Y | LAKSYAQMW | 100 | | |
| NS5 | 3289 | 0.16 | 2 | 2 | 0 | Y | AKSYAQMWL | 97.74 | AKSYAQMWQ | 2.26 |
| NS5 | 3290 | 0.16 | 2 | 2 | 0 | Y | KSYAQMWLL | 97.74 | KSYAQMWQL | 2.26 |
| NS5 | 3291 | 0.16 | 2 | 2 | 0 | Y | SYAQMWLLL | 97.74 | SYAQMWQLL | 2.26 |
| NS5 | 3292 | 0.16 | 2 | 2 | 0 | Y | YAQMWLLLY | 97.74 | YAQMWQLLY | 2.26 |
| NS5 | 3293 | 0.16 | 2 | 2 | 0 | Y | AQMWLLLYF | 97.74 | AQMWQLLYF | 2.26 |
| NS5 | 3294 | 0.16 | 2 | 2 | 0 | Y | QMWLLLYFH | 97.74 | QMWQLLYFH | 2.26 |
| NS5 | 3295 | 0.16 | 2 | 2 | 0 | Y | MWLLLYFHR | 97.74 | MWQLLYFHR | 2.26 |
| NS5 | 3296 | 0.16 | 2 | 2 | 0 | Y | WLLLYFHRR | 97.74 | WQLLYFHRR | 2.26 |
| NS5 | 3297 | 0.16 | 2 | 2 | 0 | Y | LLLYFHRRD | 97.74 | QLLYFHRRD | 2.26 |
| NS5 | 3298 | 0 | 1 | 1 | 0 | Y | LLYFHRRDL | 100 | | |
| NS5 | 3299 | 0 | 1 | 1 | 0 | Y | LYFHRRDLR | 100 | | |
| NS5 | 3300 | 0 | 1 | 1 | 0 | Y | YFHRRDLRL | 100 | | |
| NS5 | 3301 | 0 | 1 | 1 | 0 | Y | FHRRDLRLM | 100 | | |
| NS5 | 3302 | 0 | 1 | 1 | 0 | Y | HRRDLRLMA | 100 | | |
| NS5 | 3303 | 0 | 1 | 1 | 0.56 | Y | RRDLRLMAN | 99.44 | | |
| NS5 | 3304 | 0 | 1 | 1 | 0.56 | Y | RDLRLMANA | 99.44 | | |

FIG. 24-116

Species: WNV (9-mers)

| protein | block starting position | block entropy | total peptides in block | # peptides required to cover 99% of block | gap/X fraction | 99% of block covered w/ <= 5 peptides? | peptides required to cover 99% of block

FIG. 24-117

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 24-118

Species: WNV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3355 | 0.05 | 2 | 1 | 0 | Y | NEWMEDKTP | 99.44 | | | | | | |
| NS5 | 3356 | 0.05 | 2 | 1 | 0 | Y | EWMEDKTPV | 99.44 | | | | | | |
| NS5 | 3357 | 0 | 1 | 1 | 0 | Y | WMEDKTPVE | 100 | | | | | | |
| NS5 | 3358 | 0.47 | 2 | 2 | 0 | Y | MEDKTPVEK | 89.83 | MEDKTPVER | 10.17 | | | | |
| NS5 | 3359 | 0.47 | 2 | 2 | 0 | Y | EDKTPVEKW | 89.83 | EDKTPVERW | 10.17 | | | | |
| NS5 | 3360 | 0.47 | 2 | 2 | 0 | Y | DKTPVEKWS | 89.83 | DKTPVERWS | 10.17 | | | | |
| NS5 | 3361 | 0.47 | 2 | 2 | 0 | Y | KTPVEKWSD | 89.83 | KTPVERWSD | 10.17 | | | | |
| NS5 | 3362 | 0.53 | 3 | 3 | 0 | Y | TPVEKWSDV | 89.83 | TPVERWSDV | 9.04 | TPVERWSDI | 1.13 | | |
| NS5 | 3363 | 0.53 | 3 | 3 | 0 | Y | PVEKWSDVP | 89.83 | PVERWSDVP | 9.04 | PVERWSDIP | 1.13 | | |
| NS5 | 3364 | 0.53 | 3 | 3 | 0 | Y | VEKWSDVPY | 89.83 | VERWSDVPY | 9.04 | VERWSDIPY | 1.13 | | |
| NS5 | 3365 | 0.53 | 3 | 3 | 0 | Y | EKWSDVPYS | 89.83 | ERWSDVPYS | 9.04 | ERWSDIPYS | 1.13 | | |
| NS5 | 3366 | 0.53 | 3 | 3 | 0 | Y | KWSDVPYSG | 89.83 | RWSDVPYSG | 9.04 | RWSDIPYSG | 1.13 | | |
| NS5 | 3367 | 0.09 | 2 | 2 | 0 | Y | WSDVPYSGK | 98.87 | WSDIPYSGK | 1.13 | | | | |
| NS5 | 3368 | 0.09 | 2 | 2 | 0 | Y | SDVPYSGKR | 98.87 | SDIPYSGKR | 1.13 | | | | |
| NS5 | 3369 | 0.09 | 2 | 2 | 0 | Y | DVPYSGKRE | 98.87 | DIPYSGKRE | 1.13 | | | | |
| NS5 | 3370 | 0.09 | 2 | 2 | 0 | Y | VPYSGKRED | 98.87 | IPYSGKRED | 1.13 | | | | |
| NS5 | 3371 | 0 | 1 | 1 | 0 | Y | PYSGKREDI | 100 | | | | | | |
| NS5 | 3372 | 0 | 1 | 1 | 0 | Y | YSGKREDIW | 100 | | | | | | |
| NS5 | 3373 | 0 | 1 | 1 | 0 | Y | SGKREDIWC | 100 | | | | | | |
| NS5 | 3374 | 0 | 1 | 1 | 0 | Y | GKREDIWCG | 100 | | | | | | |
| NS5 | 3375 | 0 | 1 | 1 | 0 | Y | KREDIWCGS | 100 | | | | | | |
| NS5 | 3376 | 0 | 1 | 1 | 0 | Y | REDIWCGSL | 100 | | | | | | |
| NS5 | 3377 | 0 | 1 | 1 | 0 | Y | EDIWCGSLI | 100 | | | | | | |
| NS5 | 3378 | 0 | 1 | 1 | 0 | Y | DIWCGSLIG | 100 | | | | | | |
| NS5 | 3379 | 0 | 1 | 1 | 0 | Y | IWCGSLIGT | 100 | | | | | | |

FIG. 24-119

Species: WNV (9-mers)

| protein | block starting position | block entropy | total peptides in block | # peptides required to cover 99% of block | gap/X fraction | 99% of block covered w/ =< 5 peptides? | peptides required to cover 99% of block | frequency | peptides

FIG. 24-120

Species: WNV (9-mers)

| protein | block starting position | block entropy | total peptides in block | #

FIG. 25-1

Species: WNV (10-mers)

| protein | block starting position | block entropy | total pe

FIG. 25-2

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 32

FIG. 25-3

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 57 |

FIG. 25-4

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

FIG. 25-5

Species: WNV (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 146 | 0.15 | 4 | 3 | 0 | Y | ITIPTAAGKN | 98.31 | ITIPIASGKN | 0.56 | | | | |
| prM | 147 | 0.15 | 4 | 3 | 0 | Y | TIPTAAGKNL | 98.31 | TIPIASGKNL | 0.56 | | | | |
| prM | 148 | 0.15 | 4 | 3 | 0 | Y | IPTAAGKNLC | 98.31 | IPIASGKNLC | 0.56 | | | | |
| prM | 149 | 0.36 | 5 | 4 | 0 | Y | PTAAGKNLCI | 94.92 | PTASGKNLCT | 3.39 | | | | |
| prM | 150 | 0.39 | 6 | 5 | 0 | Y | TAAGKNLCIV | 94.92 | TAAGKNLCTI | 2.26 | PAAGKNLCI | 0.56 | | |
| prM | 151 | 0.33 | 4 | 4 | 0 | Y | AAGKNLCIVR | 95.48 | AAGKNLCTIR | 2.26 | TASGKNLCTV | 0.56 | IASGKNLCTV | 0.56 |
| prM | 152 | 0.33 | 4 | 3 | 0 | Y | AGKNLCIVRA | 95.48 | AGKNLCTIRA | 2.26 | AAGKNLCTVR | 1.13 | | |
| prM | 153 | 0.33 | 4 | 3 | 0 | Y | GKNLCIVRAM | 95.48 | GKNLCTIRAM | 2.26 | AGKNLCTVRA | 1.13 | | |
| prM | 154 | 0.33 | 4 | 3 | 0 | Y | KNLCIVRAMD | 95.48 | KNLCTIRAMD | 2.26 | | | | |
| prM | 155 | 0.33 | 4 | 3 | 0 | Y | NLCIVRAMDV | 95.48 | NLCTIRAMDV | 2.26 | | | | |
| prM | 156 | 0.33 | 4 | 3 | 0 | Y | LCIVRAMDVG | 95.48 | LCTIRAMDVG | 2.26 | | | | |
| prM | 157 | 0.47 | 5 | 5 | 0 | Y | CIVRAMDVGY | 93.79 | CTIRAMDVGF | 2.26 | CTVRAMDVGY | 1.69 | CTVRAIDVGF | 0.56 |
| prM | 158 | 0.77 | 5 | 5 | 0 | Y | VRAMDVGYMC | 87.01 | VRAMDVGYLC | 7.91 | VRAMDVGHMC | 1.69 | VRAIDVGFLC | 0.56 |
| prM | 159 | 0.75 | 4 | 4 | 0 | Y | RAMDVGYMCD | 87.01 | RAMDVGYLCE | 7.91 | RAMDVGHMCD | 1.69 | | |
| prM | 160 | 0.75 | 4 | 4 | 0 | Y | AMDVGYMCDD | 87.01 | AMDVGYLCED | 7.91 | AMDVGHMCDD | 1.69 | | |
| prM | 161 | 0.75 | 4 | 4 | 0 | Y | MDVGYMCDDT | 87.01 | MDVGYLCEDT | 7.91 | MDVGHMCDDT | 1.69 | | |
| prM | 162 | 0.75 | 4 | 4 | 0.56 | Y | DVGYMCDDTI | 86.44 | DVGYLCEDTI | 7.91 | DVGHMCDDTI | 1.69 | | |
| prM | 163 | 0.78 | 6 | 5 | 0.56 | Y | VGYMCDDTII | 86.44 | VGYLCEDTIT | 7.91 | VGHMCDDTI | 1.69 | VGFLCDDTIT | 0.56 |
| prM | 164 | 0.78 | 6 | 5 | 0.56 | Y | GYMCDDTITY | 86.44 | GYLCEDTITY | 7.91 | GHMCDDTITY | 1.69 | GFLCDDTITY | 0.56 |
| prM | 165 | 0.78 | 6 | 5 | 0.56 | Y | YMCDDTITYE | 86.44 | YLCEDTITYE | 7.91 | HMCDDTITYE | 1.69 | FMCDDTITYE | 0.56 |
| prM | 166 | 0.6 | 4 | 5 | 0.56 | Y | MCDDTITYEC | 88.7 | LCEDTITYEC | 7.91 | | | | |
| prM | 167 | 0.6 | 5 | 3 | 0.56 | Y | CDDTITYECP | 88.7 | CEDTITYECP | 7.91 | | | | |
| prM | 168 | 0.65 | 4 | 3 | 0.56 | Y | DDTITYECPV | 88.14 | EDTITYECPV | 7.91 | DDTITYECPA | 0.56 | | |
| prM | 169 | 0.26 | 3 | 3 | 0.56 | Y | DTITYECPVL | 96.05 | DTIAYECPAL | 2.26 | | | | |
| prM | 170 | 0.67 | 5 | 4 | 0.56 | Y | TITYECPVLS | 87.57 | TIAYECPVLA | 8.47 | TITYECSVLS | 0.56 | | |

FIG. 25-6

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 172 | 0.67 | 5 | 4 | 0.56 | Y | ITYEC

FIG. 25-7

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 205 | 0.31 | 5 | 4 | 0 | Y | TKTRHSRRSR | 96.05 | TRTRNSRRSR | 2.26 | TKTRQSRRSR | 0.56 | TRTRHSRRSR | 0.56 | |
| prM | 206 | 0.31 | 5 | 4 | 0 | Y | KTRHSRRSRR | 96.05 | RTRNSRRSRR | 2.26 | KTRQSRRSRR | 0.56 | KTRHSRRSKR | 0.56 | |
| prM | 207 | 0.26 | 4 | 3 | 0 | Y | TRHSRRSRRS | 96.61 | TRNSRRSRRS | 2.26 | TRQSRRSRRS | 0.56 | | | |
| prM | 208 | 0.26 | 4 | 3 | 0 | Y | RHSRRSRRSL | 96.61 | RNSRRSRRSL | 2.26 | RQSRRSRRSL | 0.56 | | | |
| prM | 209 | 0.26 | 4 | 3 | 0 | Y | HSRRSRRSLT | 96.61 | NSRRSRRSLN | 2.26 | QSRRSRRSLT | 0.56 | | | |
| prM | 210 | 0.21 | 3 | 2 | 0 | Y | SRRSRRSLTV | 97.18 | SRRSRRSLNV | 2.26 | | | | | |
| prM | 211 | 0.21 | 3 | 2 | 0 | Y | RRSRRSLTVQ | 97.18 | RRSRRSLNVQ | 2.26 | | | | | |
| prM | 212 | 0.26 | 4 | 3 | 0 | Y | RSRRSLTVQT | 96.61 | RSRRSLNVQV | 2.26 | RSKRSLTVQT | 0.56 | | | |
| prM | 213 | 0.26 | 4 | 3 | 0 | Y | SRRSLTVQTH | 96.61 | SRRSLNVQVH | 2.26 | SRRSLTVQAH | 0.56 | | | |
| prM | 214 | 0.26 | 4 | 3 | 0 | Y | RRSLTVQTHG | 96.61 | RRSLNVQVHG | 2.26 | KRSLTVQTHG | 0.56 | | | |
| prM | 215 | 0.26 | 4 | 3 | 0 | Y | RSLTVQTHGE | 96.61 | RSLNVQVHGE | 2.26 | RSLTVQAHGE | 0.56 | | | |
| prM | 216 | 0.26 | 4 | 3 | 0.56 | Y | SLTVQTHGES | 96.05 | SLNVQVHGES | 2.26 | SLTVQAHGES | 0.56 | | | |
| prM | 217 | 0.26 | 4 | 3 | 0.56 | Y | LTVQTHGEST | 96.05 | LNVQVHGESS | 2.26 | LTVQAHGEST | 0.56 | | | |
| prM | 218 | 0.26 | 4 | 3 | 0.56 | Y | TVQTHGESTL | 96.05 | NVQVHGESSL | 2.26 | TVQTHGKSTL | 0.56 | | | |
| prM | 219 | 0.43 | 6 | 5 | 0.56 | Y | VQTHGESTLA | 93.79 | VQVHGESSLS | 2.26 | VQTHGKSTLA | 1.69 | VQTHGKSTLA | 0.56 | VQAHGESTLA | 0.56 |
| prM | 220 | 0.43 | 6 | 5 | 0.56 | Y | QTHGESTLAN | 93.79 | QVHGESSLSN | 2.26 | QTHGKSTLAN | 1.69 | QTHGKSTLAN | 0.56 | QAHGESTLAN | 0.56 |
| prM | 221 | 0.43 | 6 | 5 | 0.56 | Y | THGESTLANK | 93.79 | VHGESSLSNR | 2.26 | THGESTLSNK | 1.69 | AHGESTLANK | 0.56 | THGESTLVNK | 0.56 |
| prM | 222 | 0.38 | 5 | 4 | 0.56 | Y | HGESTLANKK | 94.35 | HGESSLSNRK | 2.26 | HGESTLSNKK | 1.69 | HGESTLVNKK | 0.56 | | |
| prM | 223 | 0.38 | 5 | 4 | 0.56 | Y | GESTLANKKG | 94.35 | GESSLSNRKG | 2.26 | GESTLVNKKG | 1.69 | GESTLVNKKG | 0.56 | | |
| prM | 224 | 0.38 | 5 | 4 | 0.56 | Y | ESTLANKKGA | 94.35 | ESSLSNRKGA | 2.26 | ESTLVNKKGA | 1.69 | ESTLVNKKGA | 0.56 | | |
| prM | 225 | 0.33 | 4 | 3 | 0.56 | Y | STLANKKGAW | 94.92 | SSLSNRKGAW | 2.26 | STLSNKKGAW | 1.69 | | | | |
| prM | 226 | 0.72 | 5 | 4 | 0 | Y | TLANKKGAWM | 87.57 | TLANKKGAWL | 7.91 | SLSNRKGAWL | 1.69 | TLSNKKGAWM | 1.69 | LANKKGAWMB | 0.56 |
| prM | 227 | 0.77 | 6 | 5 | 0 | Y | LANKKGAWMD | 87.01 | LANKKGAWLD | 7.91 | LSNRKGAWLD | 1.69 | LSNKKGAWMD | 1.69 | ANKKGAWMBS | 0.56 |
| prM | 228 | 0.77 | 6 | 5 | 0 | Y | ANKKGAWMDS | 87.01 | ANKKGAWLDS | 7.91 | SNRKGAWLDS | 1.69 | SNKKGAWMDS | 1.69 | | |
| prM | 229 | 0.62 | 4 | 3 | 0 | Y | NKKGAWMDST | 88.7 | NKKGAWLDST | 8.47 | NRKGAWLDST | 2.26 | | | | |

FIG. 25-8

Species: WNV (10-mers)

| protein | block starting position | block entropy | total peptides in block | # peptides required to cover 99% of block | gap/X fraction | 99% of block covered w/ <= 5 peptides?

FIG. 25-9

Species: WNV (10-mers)

| protein | block starting position | block entropy | total peptides in block | # peptides required to cover 99% of block | gap/λ fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 255 | 0.1 | 3 | 2 | 0 | Y | PGYALVAAVI | 98.87 | PGYALVAAVT | 0.56 | | | | |
| prM | 256 | 0.1 | 3 | 2 | 0 | Y | GYALVAAVI

FIG. 25-10

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 25-11

Species: WNV (10-mers)

| protein | block starting position | block entropy | total peptides in block | # peptides required to cover 99% of block | gap/X fraction | covered w/ <= 5 99% of block peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 307 | 0.14 | 3 | 2 | 0 | Y | GATWMDLVLE | 98.31 | GATWMDLVLE | 1.13 | | | | | | |
| E | 308 | 0.14 | 3 | 2 | 0 | Y | ATWMDLVLEG | 98.31 | ATWMDLVLEG | 1.13 | | | | | | |
| E | 309 | 0.14 | 3 | 2 | 0 | Y | TWMDLVLEGD | 98.31 | TWMDLVLEGD | 1.13 | | | | | | |
| E | 310 | 0.14 | 3 | 2 | 0 | Y | WMDLVLEGDS | 98.31 | WMDLVLEGDS | 1.13 | | | | | | |
| E | 311 | 0.14 | 3 | 2 | 0 | Y | VDLVLEGDSC | 98.31 | MDLVLEGDSC | 1.13 | | | | | | |
| E | 312 | 0 | 1 | 1 | 0 | Y | DLVLEGDSCV | 100 | | | | | | | | |
| E | 313 | 0 | 1 | 1 | 0 | Y | LVLEGDSCVT | 100 | | | | | | | | |
| E | 314 | 0.05 | 2 | 2 | 0 | Y | VLEGDSCVTI | 99.44 | | | | | | | | |
| E | 315 | 0.1 | 3 | 2 | 0 | Y | LEGDSCVTIM | 98.87 | LEGDSCVTIT | 0.56 | EGDSCVTLMS | 0.56 | | | | |
| E | 316 | 0.22 | 4 | 3 | 0 | Y | EGDSCVTIMS | 97.18 | EGDSCVTIMA | 1.69 | GDSCVTIMAK | 0.56 | | | | |
| E | 317 | 0.22 | 4 | 3 | 0 | Y | GDSCVTIMSK | 97.18 | GDSCVTIMAK | 1.69 | DSCVTIMAKD | 0.56 | DSCVTIMSKN | 0.56 | | |
| E | 318 | 0.27 | 5 | 4 | 0 | Y | DSCVTIMSKD | 96.61 | DSCVTIMAKD | 1.69 | SCVTLMSKDK | 0.56 | SCVTIMSKNK | 0.56 | | |
| E | 319 | 0.27 | 5 | 4 | 0 | Y | SCVTIMSKDK | 96.61 | SCVTIMAKDR | 1.69 | CVTITAKDRP | 0.56 | CVTIMSKNKP | 0.56 | | |
| E | 320 | 0.27 | 5 | 4 | 0 | Y | CVTIMSKDRP | 96.61 | CVTIMAKDRP | 1.69 | VTITAKDRPT | 0.56 | VTIMSKNKPT | 0.56 | | |
| E | 321 | 0.27 | 5 | 4 | 0 | Y | VTIMSKDKPT | 96.61 | VTIMAKDRPT | 1.69 | TITAKDRPTI | 0.56 | TIMSKNKPTI | 0.56 | | |
| E | 322 | 0.27 | 5 | 4 | 0 | Y | TIMSKDRPTI | 96.61 | TIMAKDRPTI | 1.69 | IMSKNKPTID | 0.56 | LMSKDKPTID | 0.56 | | |
| E | 323 | 0.27 | 5 | 4 | 0 | Y | IMSKDKPTID | 96.61 | IMAKDRPTID | 1.69 | MSKNKPTIDV | 0.56 | | | | |
| E | 324 | 0.22 | 4 | 3 | 0 | Y | MSKDKPTIDV | 97.18 | MAKDRPTIDV | 1.69 | | | | | | |
| E | 325 | 0.21 | 3 | 2 | 0 | Y | SKDKPTIDVK | 97.18 | AKDRPTIDVK | 2.26 | | | | | | |
| E | 326 | 0.21 | 3 | 2 | 0 | Y | KDRPTIDVKM | 96.61 | KDRPTIDVKM | 2.26 | DRPTIDVKMT | 0.56 | | | | |
| E | 327 | 0.26 | 4 | 3 | 0 | Y | DRPTIDVKMM | 96.61 | DRPTIDVKMV | 2.26 | KPTIDVKMMK | 0.56 | | | | |
| E | 328 | 0.26 | 4 | 3 | 0 | Y | KPTIDVKMMN | 96.61 | RPTIDVKMVT | 2.26 | PTIDVKMTNM | 0.56 | PTIDVKMMNV | 0.56 | | |
| E | 329 | 0.31 | 5 | 4 | 0 | Y | PTIDVKMMNM | 96.05 | PTIDVKMVTM | 2.26 | TIDVKMTNMG | 0.56 | TIDVKMMNVE | 0.56 | TIDVKMMKME | 0.56 | | |
| E | 330 | 0.31 | 5 | 4 | 0 | Y | TIDVKMMNME | 96.05 | TIDVKMVTMG | 2.26 | IDVKMTNMEA | 0.56 | | | | |
| E | 331 | 0.31 | 5 | 4 | 0 | Y | IDVKMMNMEA | 96.05 | IDVKMVTMGA | 2.26 | IDVKMTNMEA | 0.56 | IDVKMMKMEA | 0.56 | | |

FIG. 25-12

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 355 | 0.69 | 6 | 5 | 0 | Y | VSDLSTKAAC | 89.27 | VSDLSTRAAC | 5.65 | ATEISSSAAC | 2.26 | VSELSTKAAC | 1.69 | VNDLSPRAAC | 0.56 |
| E | 356 | 0.69 | 6 | 5 | 0 | Y | SDLSTKAACP | 89.27 | SDLSTRAACP | 5.65 | TEISSSAACP | 2.26 | SELSTKAACP | 1.69 | NDLSPRAACP | 0.56 |
| E | 357 | 0.59 | 5 | 4 | 0 | Y | LSTKAACPTM | 90.4 | LSTRAACPTM | 6.21 | ISSSAACPTM | 2.26 | LSPRAACPTM | 0.56 | TKAACPTMGD | 0.56 |
| E | 358 | 0.59 | 5 | 4 | 0 | Y | STKAACPTMG | 90.4 | STRAACPTMG | 6.21 | SSSAACPTMG | 2.26 | STKAACPAMG | 0.56 | | |
| E | 359 | 0.64 | 6 | 5 | 0 | Y | TKAACPTMGE | 89.83 | TRAACPTMGE | 6.21 | SSAACPTMGE | 2.26 | PRAACPTMGE | 0.56 | | |
| E | 360 | 0.61 | 5 | 4 | 0 | Y | KAACPTMGEA | 89.83 | RAACPTMGEA | 6.78 | SAACPTMGEA | 2.26 | KAACPTMGDA | 0.56 | | |
| E | 361 | 0.1 | 3 | 2 | 0 | Y | AACPTMGEAH | 98.87 | AACPAMGEAH | 0.56 | CPAMGEAHND | 0.56 | | | | |
| E | 362 | 0.1 | 3 | 2 | 0 | Y | ACPTMGEAHN | 98.87 | ACPAMGEAH | 0.56 | PAMGEAHNDK | 0.56 | | | | |
| E | 363 | 0.59 | 4 | 3 | 0 | Y | CPTMGEAHND | 88.14 | CPTMGEAHNE | 10.73 | TMGDAHNDKR | 0.56 | | | | |
| E | 364 | 0.59 | 4 | 3 | 0 | Y | PTMGEAHNDK | 88.14 | PTMGEAHNEK | 10.73 | MGEAHNEKRT | 2.26 | | | | |
| E | 365 | 0.59 | 4 | 3 | 0 | Y | TMGEAHNDKR | 88.14 | TMGEAHNEKR | 10.73 | GEAHNEKRTD | 2.26 | | | | |
| E | 366 | 0.62 | 4 | 3 | 0 | Y | MGEAHNDKRA | 88.7 | MGEAHNEKRA | 8.47 | EAHNEKRTDS | 2.26 | EAHNDKRADS | 1.69 | | |
| E | 367 | 0.62 | 4 | 3 | 0 | Y | GEAHNDKRAD | 88.7 | GEAHNEKRAD | 8.47 | YCRQGVDR | 8.47 | YFCKQGVVDR | 0.56 | | |
| E | 368 | 0.77 | 6 | 5 | 0 | Y | EAHNDKRADP | 87.01 | EAHNEKRADP | 7.91 | | | | | DAHNDKRADP | 0.56 |
| E | 369 | 1.11 | 5 | 4 | 0 | Y | FVCRQGVDR | 75.14 | FVCKQGVDR | 15.25 | | | | | | |
| E | 380 | 0.68 | 3 | 2 | 0 | Y | VCRQGVDRG | 83.62 | VCKQGVDRG | 15.82 | | | | | | |
| E | 381 | 0.65 | 2 | 2 | 0.56 | Y | CRQGVDRGW | 83.05 | CKQGVDRGW | 16.38 | | | | | | |
| E | 382 | 0.65 | 2 | 2 | 0.56 | Y | RQGVDRGWG | 83.05 | KQGVDRGWG | 16.38 | | | | | | |
| E | 383 | 0 | 1 | 1 | 0.56 | Y | QGVDRGWGN | 99.44 | | | | | | | | |
| E | 384 | 0 | 1 | 1 | 0.56 | Y | GVDRGWGNG | 99.44 | | | | | | | | |
| E | 385 | 0 | 1 | 1 | 0.56 | Y | VDRGWGNGC | 99.44 | | | | | | | | |
| E | 386 | 0 | 1 | 1 | 0.56 | Y | DRGWGNGCG | 99.44 | | | | | | | | |
| E | 387 | 0 | 1 | 1 | 0.56 | Y | RGWGNGCGL | 99.44 | | | | | | | | |
| E | 388 | 0 | 1 | 1 | 0.56 | Y | GWGNGCGLF | 99.44 | | | | | | | | |
| E | 389 | 0 | 1 | 1 | 0.56 | Y | WGNGCGLFG | 99.44 | | | | | | | | |

FIG. 25-13

Species: WNV (10-mers)

| protein | block starting position | block entropy | total peptides in block | # peptides required to cover 99% of block | gap/X fraction | covered w/ <= 5 peptides? 99% of block | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 391 | 0 | 1 | 1 | 0.56 | Y | WGNGCGLFGK | 99.44 | | | | | | |
| E | 392 | 0 | 1 | 1 | 0 | Y | GNGCGLFGKG | 100 | | | | | | |
| E | 393 | 0 | 1 | 1 | 0 | Y | NGCGLFGKGS | 100 | | | | | | |
| E | 394 | 0 | 1 | 1 | 0 | Y | GCGLFGKGSI | 100 | | | | | | |
| E | 395 | 0 | 1 | 1 | 0 | Y | CGLFGKGSID | 100 | | | | | | |
| E | 396 | 0 | 1 | 1 | 0 | Y | GLFGKGSIDT | 100 | | | | | | |
| E | 397 | 0 | 1 | 1 | 0 | Y | LFGKGSIDTC | 100 | | | | | | |
| E | 398 | 0 | 1 | 1 | 0 | Y | FGKGSIDTCA | 100 | | | | | | |
| E | 399 | 0.05 | 2 | 1 | 0 | Y | GKGSIDTCAK | 99.44 | | | | | | |
| E | 400 | 0.05 | 2 | 1 | 0 | Y | KGSIDTCAKF | 99.44 | | | | | | |
| E | 401 | 0.21 | 3 | 2 | 0 | Y | GSIDTCAKFA | 97.18 | GSIDTCAKFT | 2.26 | | | | |
| E | 402 | 0.21 | 3 | 2 | 0 | Y | SIDTCAKFAC | 97.18 | SIDTCAKFTC | 2.26 | | | | |
| E | 403 | 0.62 | 3 | 3 | 0 | Y | IDTCAKFACS | 88.7 | IDTCAKFACT | 8.47 | IDTCAKFTCS | 2.26 | | |
| E | 404 | 0.65 | 3 | 4 | 0 | Y | DTCAKFACST | 88.7 | DTCAKFACTT | 7.91 | DTCAKFTCSN | 2.26 | DTCAKFACTS | 2.26 |
| E | 405 | 0.65 | 3 | 4 | 0 | Y | TCAKFACSTK | 88.7 | TCAKFACTTK | 7.91 | TCAKFTCSNK | 2.26 | TCARFACSTK | 2.26 |
| E | 406 | 0.65 | 3 | 4 | 0 | Y | CAKFACSTKA | 88.7 | CAKFACTTKA | 7.91 | CAKFTCSNKA | 2.26 | CAKFACTSKA | 2.26 |
| E | 407 | 1.39 | 6 | 5 | 0 | Y | AKFACSTKAI | 64.97 | AKFACTTKAT | 23.73 | AKFACTTKAT | 7.91 | AKFTCSNKAT | 2.26 |
| E | 408 | 1.39 | 6 | 5 | 0 | Y | KFACSTKAIG | 64.97 | KFACTTKATG | 23.73 | KFACTTKATG | 7.91 | KFTCSNKATG | 2.26 |
| E | 409 | 1.36 | 5 | 4 | 0 | Y | FACSTKAIGR | 64.97 | FACSTKATGR | 24.29 | FACTTKATGW | 7.91 | FTCSNKATGL | 2.26 |
| E | 410 | 1.36 | 5 | 4 | 0 | Y | ACSTKAIGRT | 64.97 | ACSTKATGRT | 24.29 | ACTTKATGWI | 7.91 | TCSNKATGLI | 2.26 |
| E | 411 | 1.36 | 5 | 4 | 0 | Y | CSTKAIGRTI | 64.97 | CSTKATGRTI | 24.29 | CTTKATGWII | 7.91 | CSNKATGLTI | 2.26 |
| E | 412 | 1.36 | 5 | 4 | 0 | Y | STKAIGRTIL | 64.97 | STKATGRTIL | 24.29 | TIKATGWIIQ | 7.91 | SNKATGLTIQ | 2.26 |
| E | 413 | 1.36 | 5 | 4 | 0 | Y | TKAIGRTILK | 64.97 | TKATGRTILK | 24.29 | TKATGWIIQK | 7.91 | NKATGLTIQR | 2.26 |
| E | 414 | 1.33 | 4 | 4 | 0 | Y | KAIGRTILKE | 64.97 | KATGRTILKE | 24.29 | KATGWIIQKE | 8.47 | KATGLTIQRE | 2.26 |
| E | 415 | 1.37 | 5 | 4 | 0 | Y | AIGRTILKEN | 64.41 | ATGRTILKEN | 24.29 | ATGWIIQKEN | 8.47 | ATGLTIQREN | 2.26 |

FIG. 25-14

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 416 | 1.37 | 5 | 4 | 0 | Y | IGRTILKENI | 64.41 | TGRTILKENI | 24.29 | TGWIIQKENI | 8.47 | | |
| E | 417 | 0.62 | 4 | 3 | 0 | Y | GRTILKENIK | 88.7 | GWIIQKENIK | 8.47 | GLTIQRENVK | 2.26 | | |
| E | 418 | 0.62 | 4 | 3 | 0 | Y | RTILKENIKY | 88.7 | WIIQKENIKY | 8.47 | LTIQRENVKY | 2.26 | | |
| E | 419 | 0.62 | 4 | 3 | 0 | Y | TILKENIKYE | 88.7 | IIQKENIKYE | 8.47 | TIQRENVKYE | 2.26 | | |
| E | 420 | 0.62 | 4 | 3 | 0 | Y | ILKENIKYEV | 88.7 | IQKENIKYEV | 8.47 | IQRENVKYEV | 2.26 | | |
| E | 421 | 0.62 | 4 | 3 | 0 | Y | LKENIKYEVA | 88.7 | QKENIKYEVA | 8.47 | QRENVKYEVA | 2.26 | | |
| E | 422 | 0.22 | 3 | 3 | 0 | Y | KENIKYEVAI | 97.18 | RENVKYEVAA | 1.69 | KEBIKYEVAI | 0.56 | | |
| E | 423 | 0.22 | 3 | 3 | 0 | Y | ENIKYEVAIF | 97.18 | ENVKYEVAAF | 1.69 | EBIKYEVAIF | 0.56 | | |
| E | 424 | 0.22 | 3 | 3 | 0 | Y | NIKYEVAIFV | 97.18 | NVKYEVAAFV | 1.69 | BIKYEVAIFV | 0.56 | | |
| E | 425 | 0.17 | 3 | 2 | 0 | Y | IKYEVAIFVH | 97.74 | VKYEVAAFVH | 1.69 | | | | |
| E | 426 | 0.17 | 3 | 2 | 0 | Y | KYEVAIFVHG | 97.74 | KYEVAAFVHG | 1.69 | | | | |
| E | 427 | 0.17 | 3 | 2 | 0 | Y | YEVAIFVHGP | 97.74 | YEVAAFVHGP | 1.69 | | | | |
| E | 428 | 0.17 | 3 | 2 | 0 | Y | EVAIFVHGPT | 97.74 | EVAAFVHGPT | 1.69 | | | | |
| E | 429 | 0.17 | 3 | 2 | 0 | Y | VAIFVHGPTT | 97.74 | VAAFVHGPTT | 1.69 | | | | |
| E | 430 | 0.17 | 3 | 2 | 0 | Y | AIFVHGPTTV | 97.74 | AAFVHGPTTV | 1.69 | | | | |
| E | 431 | 0.22 | 4 | 3 | 0 | Y | IFVHGPTTVE | 97.18 | AFVHGPTTVD | 1.69 | VSVHGPTTVD | 0.56 | | |
| E | 432 | 0.22 | 3 | 3 | 0 | Y | FVHGPTTVES | 97.18 | FVHGPTTVDT | 1.69 | FVHGPTTVDS | 0.56 | | |
| E | 433 | 0.21 | 3 | 2 | 0 | Y | VHGPTTVDTH | 97.18 | VHGPTTVDTH | 1.69 | | | | |
| E | 434 | 0.26 | 4 | 3 | 0.56 | Y | HGPTTVESHG | 96.05 | HGPTTVDTHS | 1.69 | HGPTTVESHR | 1.13 | | |
| E | 450 | 0.5 | 6 | 5 | 0.56 | Y | GATQAGRFSI | 92.66 | AANQAGRFSV | 2.26 | GAAQAGRFSI | 2.26 | GATQAGRLSI | 1.69 | GATQAGRFSV | 0.56 |
| E | 451 | 0.5 | 6 | 5 | 0.56 | Y | ATQAGRFSIT | 92.66 | AVQAGRFSVS | 2.26 | AAQAGRFSIT | 2.26 | ATQAGRLSIT | 1.69 | ATQAGRFTVS | 0.56 |
| E | 452 | 0.5 | 6 | 5 | 0.56 | Y | TQAGRFSITP | 92.66 | VQAGRFSVSP | 2.26 | AQAGRFSITP | 2.26 | TQAGRLSITP | 1.69 | TQAGRFSVTP | 0.56 |
| E | 453 | 0.78 | 6 | 5 | 0.56 | Y | QAGRFSITPA | 86.44 | QAGRFSVSPA | 7.91 | QAGRFSITPA | 2.26 | QAGRLSITPA | 1.69 | QAGRFSVTPA | 0.56 |
| E | 454 | 0.78 | 6 | 5 | 0.56 | Y | AGRFSITPAA | 86.44 | AGRFSVSPAA | 7.91 | AGRFSITPAA | 2.26 | AGRLSITPAA | 1.69 | AGRFSVTPAA | 0.56 |
| E | 455 | 0.78 | 6 | 5 | 0.56 | Y | GRFSITPAAP | 86.44 | GRFSVSPAAP | 7.91 | GRFSITPAAP | 2.26 | GRLSITPAAP | 1.69 | GRFTVSPAAP | 0.56 |

FIG. 25-15

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 456 | 0.78 | 6 | 5 | 0.56 | Y | RFSITPAAPS | 86.44 | RFSITPSAPS | 7.91 | RFSVSPAAPT | 2.26 | RLSITPAAPS | 1

FIG. 25-16

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 502 | 0.05 | 2 | 1 | 0 | Y | LVHRE

FIG. 25-17

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequ

FIG. 25-18

Species: WNV (10-mers)

| protein | block starting position | block entropy | total peptides in block | # peptides required to cover 99% of block | gap/X fraction | covered w/ <=5 99% of block? peptides | peptides required to cover 99% of block | frequency | peptides required to cover 99% of block | frequency | peptides

FIG. 25-19

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 587 | 0.19 | 2 | 2 | 0.56 | Y | LKGTTYGVCS | 96.61 | LKGTTYGVCA | 2.82 | | |
| E | 588 | 0.19 | 2 | 2 | 0 | Y | KGTTYGVCSK | 97.18 | KGTTYGVCAK | 2.82 | | |
| E | 589 | 0.19 | 2 | 2 | 0 | Y | GTTYGVCSKA | 97.18 | GTTYGVCAKA | 2.82 | | |
| E | 590 | 0.19 | 2 | 2 | 0 | Y | TTYGVCSKAF | 97.18 | TTYGVCAKAF | 2.82 | | |
| E | 591 | 0.33 | 4 | 3 | 0.56 | Y | TYGVCSKAFK | 95.48 | TYGVCAKAFR | 2.26 | TYGVCSKAFR | 1.69 |
| E | 592 | 0.33 | 4 | 3 | 0 | Y | YGVCSKAFKF | 94.92 | YGVCAKAFRF | 2.26 | YGVCSKAFRF | 1.69 |
| E | 603 | 0.39 | 4 | 3 | 0 | Y | GTPADTGHGT | 94.35 | RTPADTGHGT | 2.26 | NTPADTGHGT | 2.26 |
| E | 604 | 0.05 | 2 | 1 | 0 | Y | TPADTGHGTV | 99.44 | | | | |
| E | 605 | 0 | 1 | 1 | 0 | Y | PADTGHGTVW | 100 | | | | |
| E | 606 | 0.16 | 2 | 2 | 0 | Y | ADTGHGTVWL | 97.74 | ADTGHGTVWM | 2.26 | | |
| E | 607 | 0.16 | 2 | 2 | 0 | Y | DTGHGTVWLE | 97.74 | DTGHGTVWME | 2.26 | | |
| E | 608 | 0.16 | 2 | 2 | 0 | Y | TGHGTVWLEL | 97.74 | TGHGTVWMEL | 2.26 | | |
| E | 609 | 0.16 | 2 | 2 | 0 | Y | GHGTVWLELQ | 97.74 | GHGTVWMELQ | 2.26 | | |
| E | 610 | 0.16 | 2 | 2 | 0 | Y | HGTVWLELQY | 97.74 | HGTVWMELQY | 2.26 | | |
| E | 611 | 0.16 | 2 | 2 | 0 | Y | GTVWLELQYT | 97.74 | GTVWMELQYT | 2.26 | | |
| E | 612 | 0.16 | 2 | 2 | 0 | Y | TVWLELQYTG | 97.74 | TVWMELQYTG | 2.26 | | |
| E | 613 | 0.24 | 3 | 3 | 0 | Y | VWLELQYTGT | 96.61 | VWMELQYTGT | 2.26 | WLELQYTGK | 1.13 |
| E | 614 | 0.24 | 3 | 3 | 0 | Y | VLELQYTGTD | 96.61 | VMELQYTGTD | 2.26 | WLELQYTGKD | 1.13 |
| E | 615 | 0.24 | 3 | 3 | 0 | Y | LELQYTGTDG | 96.61 | MELQYTGTDG | 2.26 | LELQYTGKDG | 1.13 |
| E | 616 | 0.09 | 2 | 2 | 0 | Y | ELQYTGTDGP | 98.87 | ELQYTGKDGP | 1.13 | | |
| E | 617 | 0.09 | 2 | 2 | 0 | Y | LQYTGTDGPC | 98.87 | LQYTGKDGPC | 1.13 | | |
| E | 618 | 0.09 | 2 | 2 | 0 | Y | QYTGTDGPCK | 98.87 | QYTGKDGPCK | 1.13 | | |
| E | 619 | 0.35 | 3 | 3 | 0 | Y | YTGTDGPCKV | 94.35 | YTGTDGPCKI | 4.52 | YTGKDGPCKV | 1.13 |
| E | 620 | 0.35 | 3 | 3 | 0 | Y | TGTDGPCKVP | 94.35 | TGTDGPCKIP | 4.52 | TGKDGPCKVP | 1.13 |
| E | 621 | 0.4 | 4 | 3 | 0 | Y | GTDGPCKVPI | 93.79 | GTDGPCKIPI | 4.52 | GKDGPCKVPI | 1.13 |

FIG. 25-20

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 622 | 0.45 | 5 | 4 | 0 | Y | TDGPCKVPIS | 93.79 | TDGPCKIPIT | 2.26 | TDGPCKIPIS | 2.26 | KDGPCKVPIS | 1.13 |
| E | 623 | 0.36 | 4 | 3 | 0 | Y | DGPCKVPISS | 94.92 | DGPCKIPISS | 2.26 | DGPCKIPITS | 2.26 | | |
| E | 624 | 0.36 | 4 | 3 | 0 | Y | GPCKVPISSV | 94.92 | GPCKIPISSV | 2.26 | GPCKIPITSV | 2.26 | | |
| E | 625 | 0.36 | 4 | 3 | 0 | Y | PCKVPISSVA | 94.92 | PCKIPISSVA | 2.26 | PCKIPITSVA | 2.26 | | |
| E | 626 | 0.36 | 4 | 3 | 0 | Y | CKVPISSVAS | 94.92 | CKIPISSVAS | 2.26 | CKIPITSVAS | 2.26 | | |
| E | 627 | 0.36 | 4 | 3 | 0 | Y | KVPISSVASL | 94.92 | KIPISSVASL | 2.26 | KIPITSVASL | 2.26 | | |
| E | 628 | 0.36 | 4 | 3 | 0 | Y | VPISSVASLN | 94.92 | IPISSVASLN | 2.26 | IPITSVASLN | 2.26 | | |
| E | 629 | 0.21 | 3 | 2 | 0 | Y | PISSVASLND | 97.18 | PITSVASLND | 2.26 | | | | |
| E | 630 | 0.21 | 3 | 2 | 0 | Y | ISSVASLNDL | 97.18 | ITSVASLNDL | 2.26 | | | | |
| E | 631 | 0.16 | 2 | 2 | 0 | Y | SSVASLNDLT | 97.74 | TSVASLNDLT | 2.26 | | | | |
| E | 632 | 0 | 1 | 1 | 0 | Y | SVASLNDLTP | 100 | | | | | | |
| E | 633 | 0 | 1 | 1 | 0 | Y | VASLNDLTPV | 100 | | | | | | |
| E | 634 | 0 | 1 | 1 | 0 | Y | ASLNDLTPVG | 100 | | | | | | |
| E | 635 | 0 | 1 | 1 | 0 | Y | SLNDLTPVGR | 100 | | | | | | |
| E | 636 | 0 | 1 | 1 | 0 | Y | LNDLTPVGRL | 100 | | | | | | |
| E | 637 | 0 | 1 | 1 | 0 | Y | NDLTPVGRLV | 100 | | | | | | |
| E | 638 | 0 | 1 | 1 | 0 | Y | DLTPVGRLVT | 100 | | | | | | |
| E | 639 | 0 | 1 | 1 | 0 | Y | LTPVGRLVTV | 100 | | | | | | |
| E | 640 | 0 | 1 | 1 | 0 | Y | TPVGRLVTVN | 100 | | | | | | |
| E | 641 | 0 | 1 | 1 | 0 | Y | PVGRLVTVNP | 100 | | | | | | |
| E | 642 | 0.16 | 2 | 2 | 0 | Y | VGRLVTVNPF | 97.74 | VGRLVTVNPY | 2.26 | | | | |
| E | 643 | 0.16 | 2 | 2 | 0 | Y | GRLVTVNPFV | 97.74 | GRLVTVNPYV | 2.26 | | | | |
| E | 644 | 0.21 | 3 | 2 | 0 | Y | RLVTVNPFVS | 97.18 | RLVTVNPYVS | 2.26 | | | | |
| E | 645 | 0.26 | 4 | 3 | 0 | Y | LVTVNPFVSV | 96.61 | LVTVNPYVSV | 2.26 | LVTVNPFVAA | 0.56 | | |
| E | 646 | 0.38 | 5 | 4 | 0 | Y | VTVNPFVSVA | 94.92 | VTVNPYVSVA | 2.26 | VTVNPFVSVS | 1.69 | VTVNPFVSMA | 0.56 |

FIG. 25-21

Species: WNV (10-mers)

| protein | block

FIG. 25-22

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 679 | 0.31 | 5 | 4 | 0 | Y | GEQQINHHWH | 96.05 | GDQQVT

FIG. 25-23

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 704 | 0.16 | 2 | 2 | 0 | Y | GAQRLAALGD | 97.74 | GAQRLVSLGD | 2.26 | | | | |
| E | 705 | 0.16 | 2 | 2 | 0 | Y | AQRLAALGDT | 97.74 | AQRLVSLGDT | 2.26 | | | | |
| E | 706 | 0.16 | 2 | 2 | 0 | Y | QRLAALGDTA | 97.74 | QRLVSLGDTA | 2.26 | | | | |
| E | 707 | 0.16 | 2 | 2 | 0 | Y | RLAALGDTAW | 97.74 | RLVSLGDTAW | 2.26 | | | | |
| E | 708 | 0.16 | 2 | 2 | 0 | Y | LAALGDTAWD | 97.74 | LVSLGDTAWD | 2.26 | | | | |
| E | 709 | 0.16 | 2 | 2 | 0 | Y | AALGDTAWDF | 97.74 | VSLGDTAWDF | 2.26 | | | | |
| E | 710 | 0.16 | 2 | 2 | 0 | Y | ALGDTAWDFG | 97.74 | SLGDTAWDFG | 2.26 | | | | |
| E | 711 | 0 | 1 | 1 | 0 | Y | LGDTAWDFGS | 100 | | | | | | |
| E | 712 | 0.19 | 2 | 2 | 0 | Y | GDTAWDFGSV | 97.18 | GDTAWDFGSI | 2.82 | | | | |
| E | 713 | 0.19 | 2 | 2 | 0 | Y | DTAWDFGSVG | 97.18 | DTAWDFGSIG | 2.82 | | | | |
| E | 714 | 0.19 | 2 | 2 | 0 | Y | TAWDFGSVGG | 97.18 | TAWDFGSIGG | 2.82 | | | | |
| E | 715 | 0.24 | 3 | 3 | 0 | Y | AWDFGSVGGV | 96.61 | AWDFGSIGGV | 2.82 | WDFGSVGGVL | 0.56 | | |
| E | 716 | 0.29 | 4 | 4 | 0 | Y | WDFGSVGGVF | 96.05 | WDFGSIGGVF | 2.82 | DFGSVGGVFN | 2.26 | DFGSVGGVLT | 0.56 |
| E | 717 | 0.44 | 5 | 4 | 0 | Y | DFGSVGGVFT | 93.79 | DFGSIGGVFT | 2.82 | FGSVGGVFNS | 2.26 | FGSVGGIFTS | 0.56 |
| E | 718 | 0.44 | 5 | 4 | 0 | Y | FGSVGGVFTS | 93.79 | FGSIGGVFTS | 2.82 | GSVGGVFNSI | 2.26 | GSVGGIFTSF | 0.56 |
| E | 719 | 0.44 | 5 | 4 | 0 | Y | GSVGGVFTSV | 93.79 | GSIGGVFTSV | 2.82 | SVGGVFNSIG | 2.26 | SVGGVLTSVG | 0.56 |
| E | 720 | 0.44 | 5 | 4 | 0 | Y | SVGGVFTSVG | 93.79 | SIGGVFTSVG | 2.82 | VGGVFNSIGK | 2.26 | VGGVLTSVGQ | 0.56 |
| E | 721 | 0.44 | 5 | 4 | 0 | Y | VGGVFTSVGK | 93.79 | IGGVFTSVGK | 2.82 | GGVFNSIGKA | 2.26 | | |
| E | 722 | 0.26 | 4 | 3 | 0 | Y | GGVFTSVGKA | 96.61 | GGVFTSFGKA | 2.26 | GIFTSFGKAV | 0.56 | | |
| E | 723 | 0.73 | 5 | 4 | 0 | Y | GVFTSVGKAI | 86.44 | GVFNSIGKAV | 10.17 | GVFTSFGKAV | 2.26 | VLTSVGQAIH | 0.56 |
| E | 724 | 0.73 | 5 | 4 | 0 | Y | VFTSVGKAIH | 86.44 | VFNSIGKAVH | 10.17 | VFTSFGKAV | 2.26 | LTSVGQAIHQ | 0.56 |
| E | 725 | 0.73 | 5 | 4 | 0 | Y | FTSVGKAIHQ | 86.44 | FNSIGKAVHQ | 10.17 | FTSVGKAVH | 2.26 | TSFGKAVHQV | 0.56 |
| E | 726 | 0.73 | 5 | 4 | 0 | Y | TSVGKAIHQV | 86.44 | NSIGKAVHQV | 10.17 | TSVGKAIHQ | 2.26 | SFGKAVHQVF | 0.56 |
| E | 727 | 0.73 | 5 | 4 | 0 | Y | SVGKAIHQVF | 86.44 | SIGKAVHQVF | 10.17 | SVGKAVHQLF | 2.26 | FGKAVHQVFG | 0.56 |
| E | 728 | 0.73 | 5 | 4 | 0 | Y | VGKAIHQVFG | 86.44 | IGKAVHQLFG | 10.17 | VGKAVHQVFG | 2.26 | | |

FIG. 25-24

Species: WNV (10-mers)

| protein | block starting position | block entropy | total peptides in block | # peptides required to cover 99% of block | to cover 99% of block | gap/X fraction | 99% of block covered w/ <= 5 peptides? | peptides required

FIG. 25-25

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 754 | 0.05 | 2 | 1 | 0 | Y | LLGALLLWMG | 99.44 | | | | | | |
| E | 755 | 0.1 | 3 | 2 | 0 | Y | LGALLLWMGI | 98.87 | LGALLLWMGV | 0.56 | | | | |
| E | 756 | 0.15 | 4 | 3 | 0 | Y | GALLLWMGIN | 98.31 | GALLLWMGVN | 0.56 | GALLLWMGIS | 0.56 | | |
| E | 757 | 0.31 | 5 | 4 | 0 | Y | ALLLWMGINA | 96.05 | ALLLWMGINS | 2.26 | ALLWMGINA | 0.56 | ALLLWMGVNA | 0.56 |
| E | 758 | 0.31 | 5 | 4 | 0 | Y | LLLWMGINAR | 96.05 | LLWMGINSR | 2.26 | ALLWMGINA | 0.56 | LLWMGISAR | 0.56 |
| E | 759 | 0.31 | 5 | 4 | 0 | Y | LLWMGINARD | 96.05 | LWMGINSRD | 2.26 | LLWMGINAR | 0.56 | LWMGISARD | 0.56 |
| E | 760 | 0.31 | 5 | 4 | 0 | Y | LWMGINARDR | 96.05 | LWMGINSRDR | 2.26 | LWMGINARD | 0.56 | LWMGVNARDR | 0.56 |
| E | 761 | 0.31 | 5 | 4 | 0 | Y | WMGINARDRS | 96.05 | WMGINSRDRS | 2.26 | WMGISARDRS | 0.56 | | |
| E | 762 | 0.31 | 5 | 4 | 0 | Y | MGINARDRSI | 96.05 | MGINSRDRSI | 2.26 | MGISARDRSI | 0.56 | | |
| E | 763 | 0.31 | 5 | 4 | 0 | Y | GINARDRSIA | 96.05 | GINSRDRSIA | 2.26 | GISARDRSIA | 0.56 | | |
| E | 766 | 0.67 | 6 | 4 | 0 | Y | ARDRSIALTF | 88.7 | ARDRSIAMTF | 7.91 | SRDRSIAMTF | 1.13 | SRDRSIALTF | 0.56 | ARDRSIALMF | 0.56 |
| E | 767 | 0.54 | 5 | 3 | 0 | Y | RDRSIALTFL | 89.83 | RDRSIAMTFL | 9.04 | RDKSIALTFL | 0.56 | | |
| E | 768 | 0.54 | 5 | 3 | 0 | Y | DRSIALTFLA | 89.83 | DRSIAMTFLA | 9.04 | DKSIALTFLA | 0.56 | | |
| E | 769 | 0.62 | 5 | 4 | 0 | Y | RSIALTFLAV | 88.7 | RSIAMTFLAV | 9.04 | RSIALTFLAI | 1.13 | RSIALMFLAV | 0.56 |
| E | 770 | 0.57 | 4 | 3 | 0 | Y | SIALTFLAVG | 89.27 | SIAMTFLAVG | 9.04 | SIALTFLAIG | 1.13 | | |
| E | 771 | 0.57 | 4 | 3 | 0 | Y | IALTFLAVGG | 89.27 | IAMTFLAVGG | 9.04 | IALTFLAIGG | 1.13 | | |
| E | 772 | 0.65 | 5 | 5 | 0 | Y | ALTFLAVGGV | 88.7 | AMTFLAVGGV | 8.47 | ALTFLAIGGV | 1.13 | ALMFLAVGGV | 0.56 | ALTFLAVGGI | 0.56 |
| E | 773 | 0.65 | 5 | 5 | 0 | Y | LTFLAVGGVL | 88.7 | MTFLAVGGVL | 8.47 | LTFLAIGGVL | 1.13 | LTFLAVGGIL | 0.56 | MTFLAVGGIL | 0.56 |
| E | 774 | 0.23 | 4 | 3 | 0 | Y | TFLAVGGVLL | 97.18 | TFLAVGGILL | 1.13 | TFLAIGGVLL | 1.13 | | |
| E | 775 | 0.18 | 3 | 3 | 0 | Y | FLAVGGVLLF | 97.74 | FLAVGGILLF | 1.13 | FLAIGGVLLF | 1.13 | | |
| E | 776 | 0.18 | 3 | 3 | 0 | Y | LAVGGVLLFL | 97.74 | LAVGGILLFL | 1.13 | LAIGGVLLFL | 1.13 | | |
| E | 777 | 0.18 | 3 | 3 | 0 | Y | AVGGVLLFLS | 97.74 | AIGGVLLFLS | 1.13 | AVGGILLFLS | 1.13 | | |
| E | 778 | 0.2 | 5 | 4 | 0 | Y | VGGVLLFLSV | 97.74 | VGGILLFLSV | 0.56 | IGGVLLFLSI | 1.13 | VGGILLFLSV | 0.56 |
| E | 779 | 0.2 | 5 | 4 | 0 | Y | GGVLLFLSVN | 97.74 | GGILLFLSAN | 0.56 | GGVLLFLSIN | 1.13 | GGVLLFLSVS | 0.56 |
| E | 780 | 0.2 | 5 | 4 | 0 | Y | GVLLFLSVNV | 97.74 | GILLFLSANV | 0.56 | GVLLFLSINV | 1.13 | GILLFLSANV | 0.56 |

FIG. 25-26

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|

FIG. 25-27

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 807 | 0.1 | 3 | 2 | 0 | Y | GSGVFIHNDV | 98.87 | GSGVFIYNDV | 0.56 | | | | | | |
| NS1 | 808 | 0.15 | 4 | 3 | 0 | Y | SGVFIHNDVE | 98.31 | SGVFIYNDVE | 0.56 | NGVFIHNDVE | 0.56 | | | | |
| NS1 | 809 | 0.15 | 4 | 3 | 0 | Y | GVFIHNDVEA | 98.31 | GVFIHNDVEV | 0.56 | GVFIHNDVKA | 0.56 | | | | |
| NS1 | 810 | 0.15 | 4 | 3 | 0 | Y | VFIHNDVEAW | 98.31 | VFIYNDVEAW | 0.56 | VFIHNDVKAW | 0.56 | | | | |
| NS1 | 814 | 0.47 | 6 | 5 | 0 | Y | NDVEAWMDRY | 93.79 | NDVEAWYDRY | 2.26 | NDVEAWIDRY | 1.69 | NDVEAWTDRY | 1.13 | NDVKAWMDRY | 0.56 |
| NS1 | 815 | 0.47 | 6 | 5 | 0 | Y | DVEAWMDRYK | 93.79 | DVEAWYDRYK | 2.26 | DVEAWIDRYK | 1.69 | DVEAWTDRYK | 1.13 | DVKAWMDRYK | 0.56 |
| NS1 | 821 | 0.76 | 6 | 5 | 0 | Y | DRYKYPETP | 87.57 | DRYRYHPETP | 7.34 | DRYKFYPETP | 2.26 | DRYKFHPETP | 1.13 | DRYKYHPETP | 1.13 |
| NS1 | 822 | 0.76 | 6 | 5 | 0 | Y | RYKYPETPQ | 87.57 | RYRYHPETPQ | 7.34 | RYKFYPETPQ | 2.26 | RYKFHPETPQ | 1.13 | RYKYHPETPQ | 1.13 |
| NS1 | 823 | 0.76 | 6 | 5 | 0 | Y | YKYPETPQG | 87.57 | YRYHPETPQG | 7.34 | YKFYPETPQG | 2.26 | YKFHPETPQG | 1.13 | YKYHPETPQG | 1.13 |
| NS1 | 824 | 0.76 | 6 | 5 | 0 | Y | KYPETPQGL | 87.57 | KYHPETPQGL | 7.34 | KFYPETPQGL | 2.26 | KFHPETPQGL | 1.13 | KFHPETPQGL | 1.13 |
| NS1 | 825 | 0.73 | 5 | 4 | 0 | Y | YPETPQGLA | 87.57 | YHPETPQGLA | 7.34 | FYPETPQGLA | 2.26 | FHPETPQGLA | 1.13 | | |
| NS1 | 826 | 0.39 | 5 | 4 | 0 | Y | PETPQGLAK | 94.35 | HPETPQGLAK | 3.95 | YPETPQGLAK | 0.56 | | | | |
| NS1 | 827 | 0.2 | 5 | 3 | 0 | Y | ETPQGLAKI | 97.74 | YLETPQGLAK | 0.56 | LETPQGLAKI | 0.56 | | | | |
| NS1 | 828 | 0.15 | 5 | 4 | 0 | Y | TPQGLAKII | 98.31 | ETPQGLARVI | 0.56 | | | | | | |
| NS1 | 829 | 0.31 | 5 | 4 | 0 | Y | PQGLAKIIQ | 96.05 | TPQGLAKIIH | 2.26 | TPQGLARIIQ | 0.56 | | | | |
| NS1 | 830 | 0.31 | 5 | 4 | 0 | Y | QGLAKIIQK | 96.05 | PQGLAKIIHN | 2.26 | PQGLARVIQK | 0.56 | | | | |
| NS1 | 831 | 0.31 | 5 | 4 | 0 | Y | GLAKIIQKA | 96.05 | QGLAKIIHNA | 2.26 | QGLARVIQKA | 0.56 | | | | |
| NS1 | 832 | 0.31 | 5 | 4 | 0 | Y | LAKIIQKAH | 96.05 | GLAKIIHNAH | 2.26 | GLAKVIQKAH | 0.56 | | | | |
| NS1 | 843 | 0.31 | 5 | 4 | 0.56 | Y | EGVCGLRSVS | 95.48 | SGTCGIRSVS | 2.26 | EGVCGLRSAS | 0.56 | | | | |
| NS1 | 844 | 0.31 | 5 | 4 | 0.56 | Y | GVCGLRSVSR | 95.48 | GTCGIRSVSR | 2.26 | GVCGLRSASR | 0.56 | | | | |
| NS1 | 845 | 0.31 | 5 | 4 | 0.56 | Y | VCGLRSVSRL | 95.48 | TCGIRSVSRL | 2.26 | VCGLRSASRL | 0.56 | | | | |
| NS1 | 846 | 0.26 | 4 | 3 | 0 | Y | CGLRSVSRLE | 96.05 | CGLRSASRLE | 2.26 | | | | | | |
| NS1 | 847 | 0.26 | 4 | 3 | 0 | Y | GLRSVSRLEH | 96.61 | GIRSVSRLEH | 2.26 | | | | | | |
| NS1 | 848 | 0.26 | 4 | 3 | 0 | Y | LRSVSRLEHQ | 96.61 | IRSVSRLEHQ | 2.26 | | | | | | |
| NS1 | 849 | 0.05 | 2 | 1 | 0 | Y | RSVSRLEHQM | 99.44 | | | | | | | | |

FIG. 25-28

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 850 | 0.05 | 2 | 1 | 0 | Y | SV

FIG. 25-29

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides

FIG. 25-30

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 924 | 0.82 | 5 | 4 | 0 | Y | FWDGPETKE | 85.31 | FWDGPETEE | 7.91 | FVIDGPETKE | 5.08 | FWDGPETRE | 1.13 | | |
| NS1 | 925 | 0.82 | 5 | 4 | 0 | Y | VDGPETKEC | 85.31 | VIDGPETEEC | 7.91 | VIDGPETKEC | 5.08 | VDGSETRECI | 1.13 | VDGPETEECP | 0.56 |
| NS1 | 926 | 0.87 | 6 | 5 | 0 | Y | VDGPETKECP | 84.75 | DGPETEECP | 7.91 | IDGPETKECP | 5.08 | VDGSETRECP | 1.13 | DGPETKECST | 0.56 |
| NS1 | 927 | 0.74 | 6 | 5 | 0 | Y | DGPETKECPT | 87.57 | DGPETEECPT | 7.91 | DGPETKECPS | 2.26 | DGSETRECPT | 1.13 | | |
| NS1 | 938 | 0.7 | 5 | 4 | 0 | Y | NRAWNSLEVE | 88.14 | NRAWNSMEVE | 7.34 | DRAWNSLEVE | 2.26 | SRAWNSMEVE | 1.69 | | |
| NS1 | 939 | 0.49 | 3 | 2 | 0 | Y | RAWNSLEVED | 90.4 | RAWNSMEVED | 9.04 | | | | | | |
| NS1 | 940 | 0.49 | 3 | 2 | 0 | Y | AWNSLEVEDF | 90.4 | AWNSMEVEDF | 9.04 | | | | | | |
| NS1 | 941 | 0.49 | 3 | 2 | 0 | Y | WNSLEVEDFG | 90.4 | WNSMEVEDFG | 9.04 | | | | | | |
| NS1 | 942 | 0.49 | 3 | 2 | 0 | Y | NSLEVEDFGF | 90.4 | NSMEVEDFGF | 9.04 | | | | | | |
| NS1 | 943 | 0.49 | 3 | 2 | 0 | Y | SLEVEDFGFG | 90.4 | SMEVEDFGFG | 9.04 | | | | | | |
| NS1 | 944 | 0.44 | 2 | 1 | 0 | Y | LEVEDFGFGL | 90.96 | MEVEDFGFGL | 9.04 | | | | | | |
| NS1 | 945 | 0.05 | 2 | 1 | 0 | Y | EVEDFGFGLT | 99.44 | FGFGLTSTRI | 0.56 | | | | | | |
| NS1 | 946 | 0.05 | 2 | 1 | 0 | Y | VEDFGFGLTS | 99.44 | GFGLTSTRIF | 0.56 | | | | | | |
| NS1 | 947 | 0.05 | 2 | 1 | 0 | Y | EDFGFGLTST | 99.44 | | | | | | | | |
| NS1 | 948 | 0.05 | 2 | 1 | 0 | Y | DFGFGLTSTR | 99.44 | | | | | | | | |
| NS1 | 949 | 0.1 | 3 | 2 | 0.56 | Y | FGFGLTSTRI | 98.87 | FGLTSTRIFL | 1.13 | FGLTSTRIFL | 0.56 | | | | |
| NS1 | 950 | 0.1 | 3 | 2 | 0 | Y | GFGLTSTRIF | 98.87 | GFGLTSTRIF | 11.3 | GLTSTRIFLK | 1.13 | GLTSTRIFLK | 0.56 | | |
| NS1 | 951 | 0.19 | 4 | 3 | 0 | Y | FGLTSTRMF | 97.74 | FGLTSTRMFL | 7.34 | WREGNTTECD | 2.26 | IREVNTTECD | 1.13 | | |
| NS1 | 952 | 0.69 | 5 | 4 | 0 | Y | GLTSTRMFLK | 86.44 | GLTSTRMFLR | 7.34 | WREGNTTECD | 2.26 | IREVNTTECD | 1.13 | ARESNTTECD | 0.56 |
| NS1 | 962 | 0.66 | 6 | 5 | 0 | Y | VRESNTTECD | 88.7 | IRETNTTECD | 7.34 | WREGNTTECD | 2.26 | | | | |
| NS1 | 966 | 0.29 | 4 | 3 | 0 | Y | NTTECDTKII | 96.05 | NTTECDSKII | 2.26 | NTTECDSKII | 1.13 | | | | |
| NS1 | 967 | 0.29 | 4 | 3 | 0 | Y | TTECDTKIIG | 96.05 | TTECDSKIIG | 2.26 | TTECDSKIIG | 1.13 | | | | |
| NS1 | 968 | 0.29 | 4 | 3 | 0 | Y | TECDTKIIGT | 96.05 | TECDSKTIGT | 2.26 | TECDSKTIGT | 1.13 | | | | |
| NS1 | 969 | 0.29 | 4 | 3 | 0 | Y | ECDSKIIGTA | 96.05 | ECDTKIIGTA | 2.26 | ECDSKTIGTA | 1.13 | | | | |
| NS1 | 970 | 0.34 | 5 | 4 | 0 | Y | CDSKIIGTAV | 95.48 | CDTKIIGTAV | 2.26 | CDSKTIGTAV | 1.13 | CDSKIIGTAI | 0.56 | | |

FIG. 25-31

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 971 | 0.34 | 5 | 4 | 0 | Y | DSKIIGTAVK | 95.48 | DSKIIGTAVK | 2.26 | DSKTIGTAVK | 1.13 | DSKIIGTAIK | 0.56 | |
| NS1 | 972 | 0.34 | 5 | 4 | 0 | Y | SKIIGTAVKN | 95.48 | SKIIGTAVKN | 2.26 | SKTIGTAVKN | 1.13 | SKIIGTAIKN | 0.56 | |
| NS1 | 973 | 0.14 | 3 | 2 | 0 | Y | KIIGTAVKNN | 98.31 | KTIGTAVKNN | 1.13 | | | | | |
| NS1 | 974 | 0.61 | 4 | 3 | 0 | Y | IIGTAVKNNL | 88.14 | IGTAVKNNM | 10.17 | TIGTAVKNNL | 1.13 | | | |
| NS1 | 975 | 0.52 | 3 | 2 | 0 | Y | IGTAVKNNLA | 89.27 | IGTAVKNNMA | 10.17 | | | | | |
| NS1 | 976 | 0.57 | 4 | 3 | 0 | Y | GTAVKNNLAIH | 88.7 | GTAVKNNMAV | 10.17 | GTAIKNNLAI | 0.56 | | | |
| NS1 | 977 | 0.57 | 4 | 3 | 0 | Y | TAVKNNLAIH | 88.7 | TAVKNNMAVH | 10.17 | TAVKNNLAVH | 0.56 | | | |
| NS1 | 978 | 0.57 | 4 | 3 | 0 | Y | AVKNNLAIHS | 88.7 | AVKNNMAVHS | 10.17 | AIKNNLAIHS | 0.56 | | | |
| NS1 | 979 | 0.57 | 4 | 3 | 0 | Y | VKNNLAIHSD | 88.7 | VKNNMAVHSD | 10.17 | VKNNLAVHSD | 0.56 | | | |
| NS1 | 980 | 0.52 | 3 | 2 | 0 | Y | KNNLAIHSDL | 89.27 | KNNMAVHSDL | 10.17 | | | | | |
| NS1 | 981 | 0.52 | 3 | 2 | 0 | Y | NNLAIHSDLS | 89.27 | NNMAVHSDLS | 10.17 | | | | | |
| NS1 | 982 | 0.52 | 3 | 2 | 0 | Y | NLAIHSDLSY | 89.27 | NMAVHSDLSY | 10.17 | | | | | |
| NS1 | 983 | 0.52 | 3 | 2 | 0 | Y | LAIHSDLSYW | 89.27 | MAVHSDLSYW | 10.17 | | | | | |
| NS1 | 984 | 0.49 | 3 | 2 | 0 | Y | AIHSDLSYWI | 89.27 | AVHSDLSYWI | 10.73 | | | | | |
| NS1 | 985 | 0.49 | 3 | 2 | 0 | Y | IHSDLSYWIE | 89.27 | VHSDLSYWIE | 10.73 | | | | | |
| NS1 | 986 | 0 | 1 | 1 | 0 | Y | HSDLSYWIES | 100 | | | | | | | |
| NS1 | 987 | 0.51 | 2 | 2 | 0 | Y | SDLSYWIESR | 88.7 | SDLSYWIESG | 11.3 | | | | | |
| NS1 | 988 | 0.8 | 4 | 4 | 0 | Y | DLSYWIESRL | 84.75 | DLSYWIESGL | 10.17 | DLSYWIESRF | 3.95 | DLSYWIESGF | 1.13 | |
| NS1 | 989 | 0.83 | 5 | 4 | 0 | Y | LSYWIESRLN | 84.75 | LSYWIESGLN | 9.6 | LSYWIESRFN | 3.95 | LSYWIESGFN | 1.13 | |
| NS1 | 997 | 0.62 | 6 | 5 | 0 | Y | LNDTWKLERA | 90.96 | FNDTWKLERA | 3.95 | LNETWKLERA | 2.26 | LNHTWKLERA | 1.13 | FNETWKLERA | 1.13 |
| NS1 | 998 | 0.35 | 4 | 3 | 0 | Y | NDTWKLERAV | 94.92 | NETWKLERAV | 3.39 | NHTWKLERAV | 1.13 | | | |
| NS1 | 999 | 0.33 | 3 | 3 | 0 | Y | DTWKLERAVL | 94.92 | ETWKLERAVL | 3.95 | HTWKLERAVL | 1.13 | | | |
| NS1 | 1000 | 0 | 1 | 1 | 0 | Y | TWKLERAVLG | 100 | | | | | | | |
| NS1 | 1001 | 0 | 1 | 1 | 0 | Y | WKLERAVLGE | 100 | | | | | | | |
| NS1 | 1002 | 0 | 1 | 1 | 0 | Y | KLERAVLGEV | 100 | | | | | | | |

FIG. 25-32

Species: WNV (10-mers)

| protein | block starting position | block

FIG. 25-33

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1034 | 0.61 | 5 | 4 | 0 | Y | IPVTLAGPRS | 89.27 | IPITLAGPRS | 8.47 | IPITLAGLRS | 1.13 | IPVTLAGPKS | 0.56 |
| NS1 | 1035 | 0.61 | 5 | 4 | 0 | Y | PVTLAGPRSN | 89.27 | PITLAGPRSN | 8.47 | PITLAGLRSN | 1.13 | PATLAGPRSN | 0.56 | ATLAGPRSNH | 0.56 |
| NS1 | 1036 | 0.65 | 5 | 5 | 0 | Y | VTLAGPRSNH | 88.7 | ITLAGPRSNH | 8.47 | ITLAGLRSNH | 1.13 | VTLAGPRSNY | 0.56 |
| NS1 | 1037 | 0.19 | 6 | 3 | 0 | Y | TLAGPRSNHN | 97.74 | TLAGLRSNHN | 1.13 | TLAGPRSNYN | 0.56 |
| NS1 | 1038 | 0.19 | 4 | 3 | 0 | Y | LAGPRSNHNR | 97.74 | LAGLRSNHNR | 1.13 | LAGPRSNYNR | 0.56 |
| NS1 | 1039 | 0.19 | 4 | 3 | 0 | Y | AGPRSNHNRR | 97.74 | AGLRSNHNRR | 1.13 | AGPRSNYNRR | 0.56 |
| NS1 | 1040 | 0.19 | 4 | 3 | 0 | Y | GPRSNHNRRP | 97.74 | GLRSNHNRRP | 1.13 | GPRSNYNRRP | 0.56 |
| NS1 | 1041 | 0.1 | 4 | 3 | 0 | Y | PRSNHNRRPG | 97.74 | LRSNHNRRPG | 1.13 | PRSNYNRRPG | 0.56 |
| NS1 | 1042 | 0.1 | 3 | 2 | 0 | Y | RSNHNRRPGY | 98.87 | KSNHNRRPGY | 0.56 |
| NS1 | 1043 | 0.15 | 4 | 2 | 0 | Y | SNHNRRPGYK | 98.87 | SNYNRRPGYK | 0.56 |
| NS1 | 1044 | 0.15 | 4 | 3 | 0 | Y | NHNRRPGYKT | 98.31 | NYNRRPGYKT | 0.56 | NHNKRPGYKT | 0.56 |
| NS1 | 1045 | 0.15 | 4 | 3 | 0 | Y | HNRRPGYKTQ | 98.31 | YNRRPGYKTQ | 0.56 |
| NS1 | 1046 | 0.22 | 4 | 3 | 0 | Y | NRRPGYKTQS | 97.18 | NKRPGYKTQN | 0.56 |
| NS1 | 1047 | 0.22 | 4 | 3 | 0 | Y | RRPGYKTQNQ | 97.18 | RRPGYKTQSQ | 0.56 |
| NS1 | 1048 | 0.17 | 3 | 2 | 0 | Y | RPGYKTQNQG | 97.74 | RPGYKTQSQG | 1.69 |
| NS1 | 1049 | 0.17 | 3 | 2 | 0 | Y | PGYKTQNQGP | 97.74 | PGYKTQSQGP | 1.69 |
| NS1 | 1050 | 0.17 | 3 | 2 | 0 | Y | GYKTQNQGPW | 97.74 | GYKTQSQGPW | 1.69 |
| NS1 | 1051 | 0.17 | 3 | 2 | 0 | Y | YKTQNQGPWD | 97.74 | YKTQSQGPWD | 1.69 |
| NS1 | 1052 | 0.17 | 3 | 2 | 0 | Y | KTQNQGPWDE | 97.74 | KTQSQGPWDE | 1.69 |
| NS1 | 1053 | 0.17 | 3 | 2 | 0 | Y | TQNQGPWDEG | 97.74 | TQSQGPWDEG | 1.69 |
| NS1 | 1054 | 0.12 | 2 | 2 | 0 | Y | QNQGPWDEGR | 98.31 | QSQGPWDEGR | 1.69 |
| NS1 | 1055 | 0.21 | 3 | 3 | 0 | Y | NQGPWDEGRV | 97.18 | SQGPWDEGRV | 1.69 | NQGPWDEGRI | 1.13 |
| NS1 | 1056 | 0.09 | 2 | 2 | 0 | Y | QGPWDEGRVE | 98.87 | QGPWDEGRIE | 1.13 |
| NS1 | 1057 | 0.27 | 3 | 3 | 0 | Y | GPWDEGRVEI | 96.05 | GPWDEGRVEL | 2.82 | GPWDEGRIEI | 1.13 |
| NS1 | 1058 | 0.27 | 3 | 3 | 0 | Y | PWDEGRVEID | 96.05 | PWDEGRVELD | 2.82 | PWDEGRIEID | 1.13 |

FIG. 25-34

Species: WNV (10-mers)

| protein | block starting position | total peptides in block | # peptides required to cover 99% of block | gap/X fraction | covered w/ <= 5 99% of block peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|
| NS1 | 1059 | 3 | 3 | 0 | Y | WDEGRVELDF | 96.05 | WDEGRVELDF | 2.82 | WDEGRV

FIG. 25-35

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1095 | 0.21 | 3 | 2 | 0.56 | Y | SGKLITDWCC | 96.61 | SGKLISDWCC | 2.26 | | | | |
| NS1 | 1096 | 0.21 | 3 | 2 | 0.56 | Y | GKLITDWCCR | 96.61 | GKLISDWCCR | 2.26 | | | | |
| NS1 | 1097 | 0.21 | 3 | 2 | 0 | Y | KLITDWCCRS | 97.18 | KLISDWCCRS | 2.26 | | | | |
| NS1 | 1098 | 0.21 | 3 | 2 | 0 | Y | LITDWCCRSC | 97.18 | LISDWCCRSC | 2.26 | | | | |
| NS1 | 1099 | 0.21 | 3 | 2 | 0 | Y | ITDWCCRSCT | 97.18 | ISDWCCRSCT | 2.26 | | | | |
| NS1 | 1100 | 0.21 | 3 | 2 | 0 | Y | TDWCCRSCTL | 97.18 | SDWCCRSCTL | 2.26 | | | | |
| NS1 | 1101 | 0.05 | 2 | 1 | 0 | Y | DWCCRSCTLP | 99.44 | | | | | | |
| NS1 | 1102 | 0.05 | 2 | 1 | 0 | Y | WCCRSCTLPP | 99.44 | | | | | | |
| NS1 | 1103 | 0.05 | 2 | 1 | 0 | Y | CCRSCTLPPL | 99.44 | | | | | | |
| NS1 | 1104 | 0 | 1 | 1 | 0 | Y | CRSCTLPPLR | 100 | | | | | | |
| NS1 | 1105 | 0.4 | 2 | 2 | 0.56 | Y | RSCTLPPLRY | 92.09 | RSCTLPPLRF | 7.91 | | | | |
| NS1 | 1106 | 0.63 | 5 | 4 | 0.56 | Y | SCTLPPLRYQ | 89.27 | SCTLPPLRFQ | 7.34 | SCTLPPLRYR | 2.26 | SCTLPPLRFK | 0.56 | |
| NS1 | 1107 | 0.63 | 5 | 4 | 0.56 | Y | CTLPPLRYQT | 89.27 | CTLPPLRFQT | 7.34 | CTLPPLRYRT | 2.26 | CTLPPLRYTT | 0.56 | |
| NS1 | 1108 | 0.66 | 5 | 4 | 0 | Y | TLPPLRYQTD | 89.27 | TLPPLRFQTE | 6.78 | TLPPLRYRTE | 2.26 | TLPPLRFQTR | 0.56 | TLPPLRFKTE |
| NS1 | 1116 | 0.73 | 5 | 4 | 0.56 | Y | TDSGCWYGME | 87.01 | TENGCWYGME | 7.34 | TESGCWYGME | 2.82 | TDNGCWYGME | 1.69 | |
| NS1 | 1117 | 0.73 | 5 | 4 | 0.56 | Y | DSGCWYGMEI | 87.01 | ENGCWYGMEI | 7.34 | ESGCWYGMEI | 2.82 | DNGCWYGMEI | 1.69 | |
| NS1 | 1118 | 0.44 | 2 | 2 | 0.56 | Y | SGCWYGMEIR | 90.4 | NGCWYGMEIR | 9.04 | | | | |
| NS1 | 1119 | 0 | 1 | 1 | 0 | Y | GCWYGMEIRP | 100 | | | | | | |
| NS1 | 1120 | 0.59 | 3 | 3 | 0 | Y | CWYGMEIRPQ | 89.27 | CWYGMEIRPT | 6.78 | CWYGMEIRPL | 3.95 | | | |
| NS1 | 1121 | 0.67 | 5 | 4 | 0.56 | Y | WYGMEIRPQR | 88.7 | WYGMEIRPTR | 6.78 | WYGMEIRPLR | 3.39 | WYGMEIRPLK | 0.56 | |
| NS1 | 1122 | 0.67 | 5 | 4 | 0 | Y | YGMEIRPQRH | 88.7 | YGMEIRPTRH | 6.78 | YGMEIRPLRH | 3.39 | YGMEIRPLKH | 0.56 | |
| NS1 | 1123 | 0.67 | 5 | 4 | 0.56 | Y | GMEIRPQRHD | 88.14 | GMEIRPTRHD | 6.78 | GMEIRPLRHD | 3.39 | GMEIRPLKHD | 0.56 | |
| NS1 | 1124 | 0.72 | 6 | 5 | 0.56 | Y | MEIRPQRHDE | 87.57 | MEIRPTRHDE | 6.78 | MEIRPLRHDE | 3.39 | MEIRPQRHDG | 0.56 | MEIRPQKHDE |
| NS1 | 1125 | 0.72 | 6 | 5 | 0.56 | Y | EIRPQRHDEK | 87.57 | EIRPTRHDEK | 6.78 | EIRPLRHDEK | 3.39 | EIRPQRHDGK | 0.56 | EIRPLKHDEK |
| NS1 | 1126 | 0.72 | 6 | 5 | 0.56 | Y | IRPQRHDEKT | 87.57 | IRPTRHDEKT | 6.78 | IRPLRHDEKT | 3.39 | IRPQRHDGKT | 0.56 | IRPQKHDERT |

FIG. 25-36

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1127 | 0.72 | 6 | 5 | 0.56 | Y | RPQRHDEKTL | 87.57 | RPTRHDEKTL | 6.78 | RPLRHDEKTL | 3.39 | RPQKHDERTL | 0.56 | RPLK

FIG. 25-37

Species: WNV (10-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1152 | 0

FIG. 25-38

Species: WNV (10-mers)

| protein | block starting position | block entropy | total peptides in block | # peptides required to cover 99% of block | gap/X fraction | 99% of block covered w/ <= 5 peptides? | peptides required to cover 99% of block

FIG. 25-39

Species: WNV (10-mers)

| protein | block starting position | block entropy | total peptides in block | # peptides required to cover 99% of block | gap/X fraction | covered w/ <= 5 99% of block pe

FIG. 25-40

Species: WNV (10-mers)

| protein | block starting position | block entropy | total peptides in block | # peptides required to cover 99% of block | gap/X fraction | 99% of block covered w/ >= 5 peptides? | peptides required

FIG. 25-41

Species: WNV (10-mers)

| protein | block star

FIG. 25-42

Species: WNV (10-mers)

| protein | block starting position | block entropy | total peptides in block | # peptides required to cover 99% of block | gap/X

FIG. 25-43

Species: WNV (10-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1362 | 1.19 | 6 | 5 | 0 | Y | AAGLIACDPN | 76.84 | AAGLITCDPN | 10.73 | AAGLMACDPN | 7.91 | VAGLLACDPN | 2.26 | AAGLVACDPN | 1.69 |
| NS2A | 1363 | 1.19 | 6 | 5 | 0 | Y | AGLIACDPNR | 76.84 | AGLITCDPNR | 10.73 | AGLMACDPNR | 7.91 | AGLLACDPNR | 2.26 | AGLVACDPNR | 1.69 |
| NS2A | 1364 | 1.19 | 6 | 5 | 0 | Y | GLIACDPNRK | 76.84 | GLITCDPNRK | 10.73 | GLMACDPNRK | 7.91 | GLLACDPNRK | 2.26 | GLVACDPNRK | 1.69 |
| NS2A | 1365 | 1.19 | 6 | 5 | 0 | Y | LIACDPNRKR | 76.84 | LITCDPNRKR | 10.73 | LMACDPNRKR | 7.91 | LLACDPNRKR | 2.26 | LVACDPNRKR | 1.69 |
| NS2A | 1366 | 1.19 | 6 | 5 | 0 | Y | IACDPNRKRG | 76.84 | ITCDPNRKRG | 10.73 | MACDPNRKRG | 7.91 | LACDPNRKRG | 2.26 | VACDPNRKRG | 1.69 |
| NS2A | 1367 | 0.54 | 3 | 2 | 0 | Y | ACDPNRKRGW | 88.7 | TCDPNRKRGW | 10.73 | | | | | | |
| NS2A | 1368 | 0 | 1 | 1 | 0 | Y | CDPNRKRGWP | 100 | | | | | | | | |
| NS2A | 1369 | 0 | 1 | 1 | 0 | Y | DPNRKRGWPA | 100 | | | | | | | | |
| NS2A | 1370 | 0 | 1 | 1 | 0 | Y | PNRKRGWPAT | 100 | | | | | | | | |
| NS2A | 1371 | 0 | 1 | 1 | 0 | Y | NRKRGWPATE | 100 | | | | | | | | |
| NS2A | 1372 | 0 | 1 | 1 | 0 | Y | RKRGWPATEV | 100 | | | | | | | | |
| NS2A | 1373 | 0 | 1 | 1 | 0 | Y | KRGWPATEVM | 100 | | | | | | | | |
| NS2A | 1374 | 0 | 1 | 1 | 0 | Y | RGWPATEVMT | 100 | | | | | | | | |
| NS2A | 1375 | 0 | 1 | 1 | 0 | Y | GWPATEVMTA | 100 | | | | | | | | |
| NS2B | 1376 | 0.05 | 2 | 1 | 0.56 | Y | WPATEVMTAV | 99.44 | | | | | | | | |
| NS2B | 1377 | 0.05 | 2 | 1 | 0.56 | Y | PATEVMTAVG | 98.87 | | | | | | | | |
| NS2B | 1378 | 0.05 | 2 | 1 | 0.56 | Y | ATEVMTAVGL | 98.87 | | | | | | | | |
| NS2B | 1379 | 0.05 | 2 | 1 | 0.56 | Y | TEVMTAVGLM | 98.87 | | | | | | | | |
| NS2B | 1380 | 0.05 | 2 | 1 | 0.56 | Y | EVMTAVGLMF | 98.87 | | | | | | | | |
| NS2B | 1381 | 0.05 | 2 | 1 | 0.56 | Y | VMTAVGLMFA | 98.87 | | | | | | | | |
| NS2B | 1382 | 0.05 | 2 | 1 | 0.56 | Y | MTAVGLMFAI | 98.87 | | | | | | | | |
| NS2B | 1383 | 0.05 | 2 | 1 | 0.56 | Y | TAVGLMFAIV | 98.87 | | | | | | | | |
| NS2B | 1384 | 0.05 | 2 | 1 | 0.56 | Y | AVGLMFAIVG | 98.87 | | | | | | | | |
| NS2B | 1385 | 0.05 | 2 | 1 | 0.56 | Y | VGLMFAIVGG | 98.87 | | | | | | | | |
| NS2B | 1386 | 0 | 1 | 1 | 0.56 | Y | GLMFAIVGGL | 99.44 | | | | | | | | |

FIG. 25-44

Species: WNV (10

FIG. 25-45

Species: WNV (10-mers)

| protein | block starting position | block entropy | total peptides in block | # peptides required to cover 99% of block | gap/X fraction |

FIG. 25-46

Species: WNV (10

FIG. 25-47

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 25-48

Species: WNV (10-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1496 | 0.05 | 2 | 1 | 0 | Y | FWITLQYTKR | 99.44 | | | | | | | | |
| NS2B | 1497 | 0.05 | 2 | 1 | 0 | Y | WITLQYTKRG | 99.44 | | | | | | | | |
| NS2B | 1498 | 0.05 | 2 | 1 | 0 | Y | ITLQYTKRGG | 99.44 | | | | | | | | |
| NS2B | 1499 | 0.05 | 2 | 1 | 0 | Y | TLQYTKRGGV | 99.44 | | | | | | | | |
| NS2B | 1500 | 0 | 1 | 1 | 0 | Y | LQYTKRGGVL | 100 | | | | | | | | |
| NS2B | 1501 | 0 | 1 | 1 | 0 | Y | QYTKRGGVLW | 100 | | | | | | | | |
| NS2B | 1502 | 0 | 1 | 1 | 0 | Y | YTKRGGVLWD | 100 | | | | | | | | |
| NS2B | 1503 | 0 | 1 | 1 | 0 | Y | TKRGGVLWDT | 100 | | | | | | | | |
| NS2B | 1504 | 0 | 1 | 1 | 0 | Y | KRGGVLWDTP | 100 | | | | | | | | |
| NS2B | 1505 | 0 | 1 | 1 | 0 | Y | RGGVLWDTPS | 100 | | | | | | | | |
| NS2B | 1506 | 0 | 1 | 1 | 0 | Y | GGVLWDTPSP | 100 | | | | | | | | |
| NS3 | 1507 | 0.19 | 2 | 2 | 0 | Y | GVLWDTPSPK | 97.18 | GVLWDTPSPR | 2.82 | | | | | | |
| NS3 | 1508 | 0.24 | 3 | 2 | 0 | Y | VLWDTPSPKE | 96.61 | VLWDTPSPRE | 2.82 | | | | | | |
| NS3 | 1509 | 0.24 | 3 | 2 | 0 | Y | LWDTPSPKEY | 96.61 | LWDTPSPREY | 2.82 | | | | | | |
| NS3 | 1510 | 0.36 | 6 | 5 | 0 | Y | WDTPSPKEYK | 95.48 | WDTPSPREYK | 1.69 | WDTPSPREYR | 1.13 | WDTPSPKEYR | 0.56 | WDTPSPKVYK | 0.56 |
| NS3 | 1517 | 0.36 | 6 | 5 | 0 | Y | EYKKGDTTTG | 95.48 | EYRKGDTTTG | 1.69 | EYRKGDTTTG | 1.13 | EYRKGDTATG | 0.56 | EYEKGDTTTG | 0.56 |
| NS3 | 1518 | 0.31 | 5 | 4 | 0 | Y | YKKGDTTTGV | 96.05 | YKRGDTTTGV | 1.69 | YRKGDTTTGV | 1.13 | YEKGDTTTGV | 0.56 | | |
| NS3 | 1519 | 0.31 | 5 | 4 | 0 | Y | KKGDTTTGVY | 96.05 | KRGDTTTGVY | 1.69 | RKGDTTTGVY | 1.13 | EKGDTTTGVY | 0.56 | | |
| NS3 | 1520 | 0.17 | 3 | 2 | 0 | Y | KGDTTTGVYR | 97.74 | RGDTTTGVYR | 1.69 | | | | | | |
| NS3 | 1521 | 0.05 | 2 | 1 | 0 | Y | GDTTTGVYRI | 99.44 | | | | | | | | |
| NS3 | 1522 | 0.05 | 2 | 1 | 0 | Y | DTTTGVYRIM | 99.44 | | | | | | | | |
| NS3 | 1523 | 0.05 | 2 | 1 | 0 | Y | TTTGVYRIMT | 99.44 | | | | | | | | |
| NS3 | 1524 | 0.05 | 2 | 1 | 0 | Y | TTGVYRIMTR | 99.44 | | | | | | | | |
| NS3 | 1525 | 0 | 1 | 1 | 0 | Y | TGVYRIMTRG | 100 | | | | | | | | |
| NS3 | 1526 | 0.19 | 2 | 2 | 0 | Y | GVYRIMTRGL | 97.18 | GVYRIMTRGI | 2.82 | | | | | | |

FIG. 25-49

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block |

FIG. 25-50

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1552 | 0 | 1 | 1 | 0 | Y | HTLWHTTKGA | 100 | | |
| NS3

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1602 | 0.31 | 5 | 4 | 0 | Y | MIVVEPGKNV | 96.05 | MIVAEPGRNT | 1.69 | MIVVEPGKNA | 1.13 | MIVVKPGESV | 0.56 |
| NS3 | 1603 | 0.31 | 5 | 4 | 0 | Y | IVVEPGKNVK | 96.05 | IVAEPGRNTR | 1.69 | IVVEPGKNAK | 1.13 | IVVKPGESVK | 0.56 |
| NS3 | 1604 | 0.31 | 5 | 4 | 0 | Y | VVEPGKNVKN | 96.05 | VAEPGRNTRN | 1.69 | VVEPGKNAKN | 1.13 | VVKPGESVKN | 0.56 |
| NS3 | 1605 | 0.31 | 5 | 4 | 0 | Y | VEPGKNVKNV | 96.05 | AEPGRNTRNV | 1.69 | VEPGKNAKNV | 1.13 | VKPGESVKNV | 0.56 |
| NS3 | 1606 | 0.31 | 5 | 4 | 0 | Y | EPGKNVKNVQ | 96.05 | EPGRNTRNVQ | 1.69 | EPGKNAKNVQ | 1.13 | EPGRKTRNVQ | 0.56 |
| NS3 | 1607 | 0.31 | 5 | 4 | 0 | Y | PGKNVKNVQT | 96.05 | PGRNTRNVQT | 1.69 | PGKNAKNVQT | 1.13 | PGESVKNVQT | 0.56 |
| NS3 | 1608 | 0.31 | 5 | 4 | 0 | Y | GKNVKNVQTK | 96.05 | GRNTRNVQTK | 1.69 | GKNAKNVQTK | 1.13 | GESVKNVQTK | 0.56 |
| NS3 | 1609 | 0.31 | 5 | 4 | 0 | Y | KNVKNVQTKP | 96.05 | RNTRNVQTKP | 1.69 | KNAKNVQTKP | 1.13 | ESVKNVQTKP | 0.56 |
| NS3 | 1610 | 0.31 | 5 | 4 | 0 | Y | NVKNVQTKPG | 96.05 | NTRNVQTKPG | 1.69 | NAKNVQTKPG | 1.13 | SVKNVQTKPG | 0.56 |
| NS3 | 1611 | 0.24 | 3 | 3 | 0 | Y | VKNVQTKPGV | 97.74 | TRNVQTKPGV | 2.26 | AKNVQTKPGV | 1.13 | | |
| NS3 | 1612 | 0.16 | 2 | 2 | 0 | Y | KNVQTKPGVF | 99.44 | RNVQTKPGVF | 2.26 | | | | |
| NS3 | 1613 | 0 | 1 | 1 | 0.56 | Y | NVQTKPGVFK | 99.44 | | | | | | |
| NS3 | 1614 | 0 | 1 | 1 | 0.56 | Y | VQTKPGVFKT | 99.44 | | | | | | |
| NS3 | 1615 | 0 | 1 | 1 | 0.56 | Y | QTKPGVFKTP | 99.44 | | | | | | |
| NS3 | 1616 | 0.19 | 2 | 2 | 0.56 | Y | TKPGVFKTPE | 96.61 | TKPGVFKTPD | 2.82 | | | | |
| NS3 | 1617 | 0.19 | 2 | 2 | 0.56 | Y | KPGVFKTPEG | 96.61 | KPGVFKTPDG | 2.82 | | | | |
| NS3 | 1618 | 0.19 | 2 | 2 | 0.56 | Y | PGVFKTPEGE | 96.61 | PGVFKTPDGE | 2.82 | | | | |
| NS3 | 1619 | 0.19 | 2 | 2 | 0.56 | Y | GVFKTPEGEI | 96.61 | GVFKTPDGEI | 2.82 | | | | |
| NS3 | 1620 | 0.19 | 2 | 2 | 0.56 | Y | VFKTPEGEIG | 96.61 | VFKTPDGEIG | 2.82 | | | | |
| NS3 | 1621 | 0.24 | 3 | 2 | 0.56 | Y | FKTPEGEIGA | 96.05 | FKTPDGEIGA | 2.82 | | | | |
| NS3 | 1622 | 0.24 | 3 | 2 | 0.56 | Y | KTPEGEIGAV | 96.05 | KTPDGEIGAV | 2.82 | | | | |
| NS3 | 1623 | 0.24 | 3 | 2 | 0 | Y | TPEGEIGAVT | 96.61 | TPDGEIGAVT | 2.82 | | | | |
| NS3 | 1624 | 0.24 | 3 | 2 | 0 | Y | PEGEIGAVTL | 96.61 | PDGEIGAVTL | 2.82 | | | | |
| NS3 | 1625 | 0.24 | 3 | 2 | 0 | Y | EGEIGAVTLD | 96.61 | DGEIGAVTLD | 2.82 | | | | |
| NS3 | 1626 | 0.54 | 3 | 2 | 0 | Y | GEIGAVTLDF | 88.7 | GEIGAVTLDY | 10.73 | | | | |

FIG. 25-53

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | fr

FIG. 25-54

Species: WNV (10-

FIG. 25-55

Species: WNV (10-mers)

| protein | block starting position | block entropy | total peptides in block | # peptides required to cover 99% of block | gap/X fraction | 99% of block covered w/ <= 5 peptides? | peptides

FIG. 25-56

Species: WNV (10

FIG. 25-57

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1736 | 0.43 | 3 | 2 | 0 | Y | EMAEALRGLP | 92.09 | EMSEALRGLP | 7.34 | | | | | | |
| NS3 | 1737 | 0.43 | 3 | 2 | 0 | Y | MAEALRGLPI | 92.09 | MSEALRGLPI | 7.34 | | | | | | |
| NS3 | 1738 | 0.43 | 3 | 2 | 0 | Y | AEALRGLPIR | 92.09 | SEALRGLPIR | 7.34 | | | | | | |
| NS3 | 1739 | 0.05 | 2 | 1 | 0 | Y | EALRGLPIRY | 99.44 | | | | | | | | |
| NS3 | 1740 | 0.05 | 2 | 1 | 0 | Y | ALRGLPIRYQ | 99.44 | | | | | | | | |
| NS3 | 1741 | 0.05 | 2 | 1 | 0 | Y | LRGLPIRYQT | 99.44 | | | | | | | | |
| NS3 | 1742 | 0.05 | 2 | 1 | 0 | Y | RGLPIRYQTS | 99.44 | | | | | | | | |
| NS3 | 1743 | 0.05 | 2 | 1 | 0 | Y | GLPIRYQTSA | 99.44 | | | | | | | | |
| NS3 | 1744 | 0.05 | 2 | 1 | 0 | Y | LPIRYQTSAV | 99.44 | | | | | | | | |
| NS3 | 1745 | 1.02 | 6 | 5 | 0 | Y | PIRYQTSAVP | 81.36 | PIRYQTSAVH | 7.91 | PIRYQTSAVT | 7.34 | PIRYQTSAVA | 2.26 | PIRYQTSAVN | 0.56 |
| NS3 | 1746 | 1.02 | 6 | 5 | 0 | Y | IRYQTSAVPR | 81.36 | IRYQTSAVHR | 7.91 | IRYQTSAVTR | 7.34 | IRYQTSAVAR | 2.26 | IRYQTSAVNR | 0.56 |
| NS3 | 1747 | 1.02 | 6 | 5 | 0 | Y | RYQTSAVPRE | 81.36 | RYQTSAVHRE | 7.91 | RYQTSAVTRE | 7.34 | RYQTSAVARE | 2.26 | RYQTSAVNRE | 0.56 |
| NS3 | 1748 | 1.02 | 6 | 5 | 0 | Y | YQTSAVPREH | 81.36 | YQTSAVHREH | 7.91 | YQTSAVTREH | 7.34 | YQTSAVAREH | 2.26 | YQTSAVNREH | 0.56 |
| NS3 | 1755 | 0.62 | 4 | 3 | 0 | Y | REHNGNEIVD | 88.7 | REHSGNEIVD | 8.47 | REHTGNEIVD | 2.26 | | | | |
| NS3 | 1756 | 0.62 | 4 | 3 | 0 | Y | EHNGNEIVDV | 88.7 | EHSGNEIVDV | 8.47 | EHTGNEIVDV | 2.26 | | | | |
| NS3 | 1757 | 0.62 | 4 | 3 | 0 | Y | HNGNEIVDVM | 88.7 | HSGNEIVDVM | 8.47 | HTGNEIVDVM | 2.26 | | | | |
| NS3 | 1758 | 0.62 | 4 | 3 | 0 | Y | NGNEIVDVMC | 88.7 | SGNEIVDVMC | 8.47 | TGNEIVDVMC | 2.26 | | | | |
| NS3 | 1759 | 0.05 | 2 | 1 | 0 | Y | GNEIVDVMCH | 99.44 | | | | | | | | |
| NS3 | 1760 | 0.05 | 2 | 1 | 0 | Y | NEIVDVMCHA | 99.44 | | | | | | | | |
| NS3 | 1761 | 0 | 1 | 1 | 0 | Y | EIVDVMCHAT | 100 | | | | | | | | |
| NS3 | 1762 | 0 | 1 | 1 | 0 | Y | IVDVMCHATL | 100 | | | | | | | | |
| NS3 | 1763 | 0 | 1 | 1 | 0 | Y | VDVMCHATLT | 100 | | | | | | | | |
| NS3 | 1764 | 0 | 1 | 1 | 0 | Y | DVMCHATLTH | 100 | | | | | | | | |
| NS3 | 1765 | 0 | 1 | 1 | 0 | Y | VMCHATLTHR | 100 | | | | | | | | |
| NS3 | 1766 | 0 | 1 | 1 | 0 | Y | MCHATLTHRL | 100 | | | | | | | | |

FIG. 25-58

Species: WNV (10-mers)

| protein | block starting position | block entropy | total peptides in block | # peptides required to cover 99% of block | gap/X fraction | 99% of block covered w

FIG. 25-59

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1792 | 0.05 | 2 | 1 | 0 | Y | AHFTDPASIA | 99.44 | | | | | | |
| NS3 | 1793 | 0 | 1 | 1 | 0 | Y | HFTDPASIAA | 100 | | | | | | |
| NS3 | 1794 | 0.05 | 2 | 1 | 0 | Y | FTDPASIAAR | 99.44 | | | | | | |
| NS3 | 1795 | 0.05 | 2 | 1 | 0 | Y | TDPASIAARG | 99.44 | | | | | | |
| NS3 | 1796 | 0.05 | 2 | 1 | 0 | Y | DPASIAARGY | 99.44 | | | | | | |
| NS3 | 1797 | 0.05 | 2 | 1 | 0 | Y | PASIAARGYI | 99.44 | | | | | | |
| NS3 | 1798 | 0.43 | 3 | 2 | 0 | Y | ASIAARGYIS | 92.09 | ASIAARGYIA | 7.34 | | | | |
| NS3 | 1799 | 0.43 | 3 | 2 | 0 | Y | SIAARGYIST | 92.09 | SIAARGYIAT | 7.34 | | | | |
| NS3 | 1800 | 0.72 | 5 | 4 | 0 | Y | IAARGYISTK | 87.57 | IAARGYIATK | 6.78 | IAARGYISTR | 4.52 | IAARGYIATR | 0.56 |
| NS3 | 1801 | 0.72 | 5 | 4 | 0 | Y | AARGYISTKV | 87.57 | AARGYIATKV | 6.78 | AARGYISTRV | 4.52 | AARGYIATRV | 0.56 |
| NS3 | 1802 | 0.72 | 5 | 4 | 0 | Y | ARGYISTKVE | 87.57 | ARGYIATKVE | 6.78 | ARGYISTRVE | 4.52 | AGGYIATKVE | 0.56 |
| NS3 | 1803 | 0.72 | 5 | 4 | 0 | Y | RGYISTKVEL | 87.57 | RGYIATKVEL | 6.78 | RGYISTRVEL | 4.52 | RGYIATRVEL | 0.56 |
| NS3 | 1804 | 0.69 | 4 | 3 | 0 | Y | GYISTKVELG | 87.57 | GYIATKVELG | 7.34 | GVISTRVELG | 4.52 | | |
| NS3 | 1805 | 0.71 | 5 | 4 | 0 | Y | YISTKVELGE | 87.57 | YIATKVELGE | 7.34 | YISTRVELGE | 3.95 | YISTRVELGD | 0.56 |
| NS3 | 1806 | 0.71 | 5 | 4 | 0 | Y | ISTKVELGEA | 87.57 | IATKVELGEA | 7.34 | ISTRVELGEA | 3.95 | IATRVELGEA | 0.56 |
| NS3 | 1807 | 0.71 | 5 | 4 | 0 | Y | STKVELGEAA | 87.57 | ATKVELGEAA | 7.34 | STRVELGEAA | 3.95 | STRVELGDAA | 0.56 |
| NS3 | 1808 | 0.32 | 3 | 2 | 0 | Y | TKVELGEAAA | 94.92 | TRVELGEAAA | 4.52 | | | | |
| NS3 | 1809 | 0.32 | 3 | 2 | 0 | Y | KVELGEAAAI | 94.92 | RVELGEAAAI | 4.52 | | | | |
| NS3 | 1810 | 0.05 | 2 | 1 | 0 | Y | VELGEAAAIF | 99.44 | | | | | | |
| NS3 | 1811 | 0.05 | 2 | 1 | 0 | Y | ELGEAAAIFM | 99.44 | | | | | | |
| NS3 | 1812 | 0.05 | 2 | 1 | 0 | Y | LGEAAAIFMT | 99.44 | | | | | | |
| NS3 | 1813 | 0.05 | 2 | 1 | 0 | Y | GEAAAIFMTA | 99.44 | | | | | | |
| NS3 | 1814 | 0.05 | 2 | 1 | 0 | Y | EAAAIFMTAT | 99.44 | | | | | | |
| NS3 | 1815 | 0 | 1 | 1 | 0 | Y | AAAIFMTATP | 100 | | | | | | |
| NS3 | 1816 | 0 | 1 | 1 | 0 | Y | AAIFMTATPP | 100 | | | | | | |

FIG. 25-60

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1817 | 0 | 1 | 1 | 0 | Y | AIFMTATPPG | 100 | | | | | | |
| NS3 | 1818 | 0.05 | 2 | 1 | 0 | Y | IFMTATPPGT | 99.44 | | | | | | |
| NS3 | 1819 | 0.1 | 3 | 2 | 0 | Y | FMTATPPGTS | 98.87 | FMTATPPGTH | 0.56 | | | | |
| NS3 | 1820 | 0.1 | 3 | 2 | 0 | Y | MTATPPGTSD | 98.87 | MTATPPGTHD | 0.56 | | | | |
| NS3 | 1821 | 0.1 | 3 | 2 | 0 | Y | TATPPGTSDP | 98.87 | TATPPGTHDP | 0.56 | | | | |
| NS3 | 1822 | 0.1 | 3 | 2 | 0 | Y | ATPPGTSDPF | 98.87 | ATPPGTHDPF | 0.56 | | | | |
| NS3 | 1823 | 0.1 | 3 | 2 | 0 | Y | TPPGTSDPFP | 98.87 | TPPGTHDPFP | 0.56 | | | | |
| NS3 | 1824 | 0.15 | 4 | 3 | 0 | Y | PPGTSDPFPE | 98.31 | PPGTHDPFPE | 0.56 | PPGTSDPFPK | 0.56 | | |
| NS3 | 1825 | 0.15 | 4 | 3 | 0 | Y | PGTSDPFPES | 98.31 | PGSSDPFPES | 0.56 | PGTSDPFPKS | 0.56 | | |
| NS3 | 1826 | 0.15 | 4 | 3 | 0 | Y | GTSDPFPESN | 98.31 | GTHDPFPESN | 0.56 | GTSDPFPKSN | 0.56 | | |
| NS3 | 1827 | 0.68 | 5 | 4 | 0.56 | Y | TSDPFPESNS | 85.88 | TSDPFPESNA | 11.86 | TSDPFPKSNS | 0.56 | SSDPFPESNA | 0.56 |
| NS3 | 1828 | 0.64 | 4 | 3 | 0.56 | Y | SDPFPESNSP | 85.88 | SDPFPESNAP | 12.43 | HDPFPESNAP | 0.56 | | |
| NS3 | 1829 | 0.71 | 4 | 3 | 0.56 | Y | DPFPESNSPI | 85.88 | DPFPESNAPI | 10.17 | DPFPESNAPV | 2.82 | | |
| NS3 | 1840 | 0.65 | 4 | 3 | 0 | Y | DLQTEIPDRA | 88.14 | DMQTEIPDRA | 8.47 | DIQTEIPDRA | 2.82 | | |
| NS3 | 1841 | 0.65 | 4 | 3 | 0 | Y | LQTEIPDRAW | 88.14 | MQTEIPDRAW | 8.47 | IQTEIPDRAW | 2.82 | | |
| NS3 | 1842 | 0 | 1 | 1 | 0 | Y | QTEIPDRAWN | 100 | | | | | | |
| NS3 | 1843 | 0.43 | 3 | 2 | 0 | Y | TEIPDRAWNS | 92.09 | TEIPDRAWNT | 7.34 | | | | |
| NS3 | 1844 | 0.43 | 3 | 2 | 0 | Y | EIPDRAWNSG | 92.09 | EIPDRAWNTG | 7.34 | | | | |
| NS3 | 1845 | 0.43 | 3 | 2 | 0 | Y | IPDRAWNSGY | 92.09 | IPDRAWNTGY | 7.34 | | | | |
| NS3 | 1846 | 0.43 | 3 | 2 | 0 | Y | PDRAWNSGYE | 92.09 | PDRAWNTGYE | 7.34 | | | | |
| NS3 | 1847 | 0.43 | 3 | 2 | 0 | Y | DRAWNSGYEW | 92.09 | DRAWNTGYEW | 7.34 | | | | |
| NS3 | 1848 | 0.43 | 3 | 2 | 0 | Y | RAWNSGYEWI | 92.09 | RAWNTGYEWI | 7.34 | | | | |
| NS3 | 1849 | 0.43 | 3 | 2 | 0 | Y | AWNSGYEWIT | 92.09 | AWNTGYEWIT | 7.34 | | | | |
| NS3 | 1850 | 0.43 | 3 | 2 | 0 | Y | WNSGYEWITE | 92.09 | WNTGYEWITE | 7.34 | | | | |
| NS3 | 1851 | 0.43 | 3 | 2 | 0.56 | Y | NSGYEWITEY | 91.53 | NTGYEWITEY | 7.34 | | | | |

FIG. 25-61

Species: WNV (10-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1852 | 1.42 | 6 | 5 | 0.56 | Y | SGYEWITEYT | 63.84 | SGYEWITEYI | 24.29 | TGYEWITEYV | 7.34 | SGYEWITEYV | 2.82 |
| NS3 | 1853 | 1.33 | 5 | 4 | 0.56 | Y | GYEWITEYTG | 63.84 | GYEWITEYIG | 24.29 | GYEWITEYVG | 7.34 | GYEWITEYAG | 0.56 |
| NS3 | 1854 | 1.33 | 5 | 4 | 0.56 | Y | YEWITEYTGK | 63.84 | YEWITEYIGK | 24.29 | YEWITEYVGK | 7.34 | YEWITEFVGK | 0.56 |
| NS3 | 1855 | 1.33 | 5 | 4 | 0.56 | Y | EWITEYTGKT | 63.84 | EWITEYIGKT | 24.29 | EWITEYVGKT | 7.34 | EWITEFVGKT | 0.56 |
| NS3 | 1856 | 1.33 | 5 | 4 | 0.56 | Y | WITEYTGKTV | 63.84 | WITEYIGKTV | 24.29 | WITEYVGKTV | 7.34 | WITEFVGKTV | 0.56 |
| NS3 | 1857 | 1.33 | 5 | 4 | 0.56 | Y | ITEYTGKTVW | 63.84 | ITEYIGKTVW | 24.29 | ITEYVGKTVW | 7.34 | ITEYAGKTVW | 0.56 |
| NS3 | 1858 | 1.33 | 5 | 4 | 0.56 | Y | TEYTGKTVWF | 63.84 | TEYIGKTVWF | 24.29 | TEYVGKTVWF | 7.34 | TEFVGKTVWF | 0.56 |
| NS3 | 1859 | 1.33 | 5 | 4 | 0.56 | Y | EYTGKTVWFV | 63.84 | EYIGKTVWFV | 24.29 | EYVGKTVWFV | 7.34 | EYAGKTVWFV | 0.56 |
| NS3 | 1860 | 1.33 | 5 | 4 | 0.56 | Y | YTGKTVWFVP | 63.84 | YIGKTVWFVP | 24.29 | YVGKTVWFVP | 7.34 | YAGKTVWFVP | 0.56 |
| NS3 | 1861 | 1.29 | 4 | 3 | 0.56 | Y | TGKTVWFVPS | 63.84 | IGKTVWFVPS | 24.29 | VGKTVWFVPS | 10.73 | | |
| NS3 | 1862 | 0 | 1 | 1 | 0 | Y | GKTVWFVPSV | 100 | | | | | | |
| NS3 | 1863 | 0.19 | 2 | 2 | 0 | Y | KTVWFVPSVK | 97.18 | KTVWFVPSVR | 2.82 | | | | |
| NS3 | 1864 | 0.19 | 2 | 2 | 0 | Y | TVWFVPSVKM | 97.18 | TVWFVPSVRM | 2.82 | | | | |
| NS3 | 1865 | 0.21 | 3 | 2 | 0 | Y | VWFVPSVKMG | 97.18 | VWFVPSVRMG | 2.26 | | | | |
| NS3 | 1866 | 0.21 | 3 | 2 | 0 | Y | WFVPSVKMGN | 97.18 | WFVPSVRMGN | 2.26 | | | | |
| NS3 | 1867 | 0.21 | 3 | 2 | 0 | Y | FVPSVKMGNE | 97.18 | FVPSVRMGNE | 2.26 | | | | |
| NS3 | 1868 | 0.21 | 3 | 2 | 0 | Y | VPSVKMGNEI | 97.18 | VPSVRMGNEM | 2.26 | | | | |
| NS3 | 1869 | 0.21 | 3 | 2 | 0 | Y | PSVKMGNEIA | 97.18 | PSVRMGNEMA | 2.26 | | | | |
| NS3 | 1870 | 0.21 | 3 | 2 | 0 | Y | SVKMGNEIAL | 97.18 | SVRMGNEMAQ | 2.26 | | | | |
| NS3 | 1871 | 0.21 | 3 | 2 | 0 | Y | VKMGNEIALC | 97.18 | VRMGNEMAQC | 2.26 | | | | |
| NS3 | 1872 | 0.21 | 3 | 2 | 0 | Y | KMGNEIALCL | 97.18 | RMGNEMAQCL | 2.26 | | | | |
| NS3 | 1873 | 0.21 | 3 | 2 | 0 | Y | MGNEIALCLQ | 97.18 | MGNEMAQCLQ | 2.26 | | | | |
| NS3 | 1874 | 0.21 | 3 | 2 | 0 | Y | GNEIALCLQR | 97.18 | GNEMAQCLQR | 2.26 | | | | |
| NS3 | 1875 | 0.19 | 2 | 2 | 0 | Y | NEIALCLQRA | 97.18 | NEMAQCLQRA | 2.82 | | | | |
| NS3 | 1876 | 0.19 | 2 | 2 | 0 | Y | EIALCLQRAG | 97.18 | EMAQCLQRAG | 2.82 | | | | |

FIG. 25-62

Species: WNV (10-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | pept

FIG. 25-63

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 25-64

Species: WNV (10-mers)

| protein | block starting position | block entropy | total peptides in block | # peptides required to cover 99% of block | gap/X fraction | 99% of block covered w/ <= 5 peptides? | peptides required to cover 99% of block

FIG. 25-65

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1956 | 0 | 1 | 1 | 0 | Y | TAASAAQRRG | 100 | | | | | | | | |
| NS3 | 1957 | 0 | 1 | 1 | 0 | Y | AASAAQRRGR | 100 | | | | | | | | |
| NS3 | 1958 | 0.1 | 3 | 2 | 0 | Y | ASAAQRRGRI | 98.87 | ASAAQRRGRT | 0.56 | | | | | | |
| NS3 | 1959 | 0.1 | 3 | 2 | 0 | Y | SAAQRRGRIG | 98.87 | SAAQRRGRTG | 0.56 | | | | | | |
| NS3 | 1960 | 0.1 | 3 | 2 | 0 | Y | AAQRRGRIGR | 98.87 | AAQRRGRTGR | 0.56 | | | | | | |
| NS3 | 1961 | 0.1 | 3 | 2 | 0 | Y | AQRRGRIGRN | 98.87 | AQRRGRTGRN | 0.56 | | | | | | |
| NS3 | 1962 | 0.22 | 4 | 3 | 0 | Y | QRRGRIGRNP | 97.18 | QRRGRIGRNS | 1.69 | QRRGRVGRNP | 0.56 | | | | |
| NS3 | 1963 | 0.27 | 5 | 4 | 0 | Y | RRGRIGRNPS | 96.61 | RRGRIGRNSS | 1.69 | RRGRIGRNPT | 0.56 | RRGRVGRNPS | 0.56 | | |
| NS3 | 1964 | 0.27 | 5 | 4 | 0 | Y | RGRIGRNPSQ | 96.61 | RGRIGRNSSQ | 1.69 | RGRIGRNPTQ | 0.56 | RGRVGRNPSQ | 0.56 | | |
| NS3 | 1965 | 0.27 | 5 | 4 | 0 | Y | GRIGRNPSQV | 96.61 | GRIGRNSSQV | 1.69 | GRTGRNPSQA | 0.56 | GRVGRNPSQV | 0.56 | | |
| NS3 | 1966 | 0.27 | 5 | 4 | 0 | Y | RIGRNPSQVG | 96.61 | RIGRNSSQVG | 1.69 | RTGRNPSQAG | 0.56 | RIGRNPTQVG | 0.56 | | |
| NS3 | 1967 | 0.27 | 5 | 4 | 0 | Y | IGRNPSQVGD | 96.61 | IGRNSSQVGD | 1.69 | IGRNPTQVGD | 0.56 | TGRNPSQAGD | 0.56 | | |
| NS3 | 1968 | 0.22 | 4 | 3 | 0 | Y | GRNPSQVGDE | 97.18 | GRNSSQVGDE | 1.69 | GRNPSQAGDE | 0.56 | | | | |
| NS3 | 1969 | 0.22 | 4 | 3 | 0 | Y | RNPSQVGDEY | 97.18 | RNSSQVGDEY | 1.69 | RNPTQVGDEY | 0.56 | | | | |
| NS3 | 1970 | 0.22 | 4 | 3 | 0 | Y | NPSQVGDEYC | 97.18 | NSSQVGDEYC | 1.69 | NPSQAGDEYC | 0.56 | | | | |
| NS3 | 1971 | 0.22 | 4 | 3 | 0 | Y | PSQVGDEYCY | 97.18 | SSQVGDEYCY | 1.69 | PSQAGDEYCY | 0.56 | | | | |
| NS3 | 1972 | 0.1 | 3 | 2 | 0 | Y | SQVGDEYCYG | 98.87 | SQAGDEYCYG | 0.56 | | | | | | |
| NS3 | 1973 | 0.05 | 2 | 1 | 0 | Y | QVGDEYCYGG | 99.44 | | | | | | | | |
| NS3 | 1974 | 0.05 | 2 | 1 | 0 | Y | VGDEYCYGGH | 99.44 | | | | | | | | |
| NS3 | 1975 | 0 | 1 | 1 | 0 | Y | GDEYCYGGHT | 100 | | | | | | | | |
| NS3 | 1976 | 0 | 1 | 1 | 0 | Y | DEYCYGGHTN | 100 | | | | | | | | |
| NS3 | 1977 | 0 | 1 | 1 | 0 | Y | EYCYGGHTNE | 100 | | | | | | | | |
| NS3 | 1978 | 0 | 1 | 1 | 0 | Y | YCYGGHTNED | 100 | | | | | | | | |
| NS3 | 1979 | 0 | 1 | 1 | 0 | Y | CYGGHTNEDD | 100 | | | | | | | | |
| NS3 | 1980 | 0 | 1 | 1 | 0 | Y | YGGHTNEDDS | 100 | | | | | | | | |

FIG. 25-66

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1981 | 0 | 5 | 1 | 0 | Y | GGHTNEDDSN | 100 | | | | | | | |
| NS3 | 1982 | 0.42 | 5 | 4 | 0.56 | Y | GHTNEDDSNF | 93.79 | GHTNEDDSNC | 1.69 | GHTNEDDSNY | 1.69 | GHTNEDDSNL | 1.69 | | |
| NS3 | 1983 | 0.42 | 5 | 4 | 0.56 | Y | HTNEDDSNFA | 93.79 | HTNEDDSNCA | 1.69 | HTNEDDSNYA

FIG. 25-67

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2006 | 0.61 | 4 | 3 | 0.56 | Y | MPNGLIAQFY | 87.57 | MPNGLVAQLY | 10.17 | MPNGLIAQLY | 1.13 | | |
| NS3 | 2007 | 0.61 | 4 | 3 | 0.56 | Y | PNGLIAQFYQ | 87.57 | PNGLVAQLYQ | 10.17 | PNGLIAQLYQ | 1.13 | | |
| NS3 | 2008 | 0.61 | 4 | 3 | 0.56 | Y | NGLIAQFYQP | 87.57 | NGLVAQLYQP | 10.17 | NGLIAQLYQP | 1.13 | | |
| NS3 | 2009 | 0.56 | 3 | 3 | 0 | Y | GLIAQFYQPE | 88.7 | GLVAQLYQPE | 10.17 | GLIAQLYQPE | 1.13 | | |

FIG. 25-68

Species: WNV (10-mers)

| protein | block starting position | block entropy | total peptides in block | # peptides required to cover 99% of block | gap/X fraction | 99% of block covered w/ <= 5 peptides?

FIG. 25-69

Species: WNV (10-mers)

| protein | block starting position | block entropy | total peptides in block | # peptides required to cover 99% of block | gap/X fraction | 99% of block covered w/ <= 5 peptides? | peptides required to cover 99% of block

FIG. 25-70

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

FIG. 25-71

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2108 | 0.68 | 4 | 3 | 0 | Y | SDHQALKAFK | 87.01 | SDHQALKSFK | 10.17 | SDHQALKLFK | 2.26 | | |
| NS3 | 2109 | 0.63 | 3 | 3 | 0 | Y | DHQALKAFKD | 87.57 | DHQALKSFKD | 10.17 | DHQALKLFKD | 2.26 | | |
| NS3 | 2110 | 0.63 | 3 | 3 | 0 | Y | HQALKAFKDF | 87.57 | HQALKSFKDF | 10.17 | HQALKLFKDF | 2.26 | | |
| NS3 | 2111 | 0.63 | 3 | 3 | 0 | Y | QALKAFKDFA | 87.57 | QALKSFKDFA | 10.17 | QALKLFKDFA | 2.26 | | |
| NS3 | 2112 | 0.66 | 4 | 3 | 0 | Y | ALKAFKDFAS | 87.57 | ALKSFKDFAS | 9.6 | ALKLFKDFAA | 2.26 | | |
| NS3 | 2113 | 0.66 | 4 | 3 | 0 | Y | LKAFKDFASG | 87.57 | LKSFKDFASG | 9.6 | LKLFKDFAAG | 2.26 | | |
| NS3 | 2114 | 0.66 | 4 | 3 | 0 | Y | KAFKDFASGK | 87.57 | KSFKDFASGK | 9.6 | KLFKDFAAGR | 2.26 | | |
| NS3 | 2115 | 0.66 | 4 | 3 | 0 | Y | AFKDFASGKR | 87.57 | SFKDFASGKR | 9.6 | LFKDFAAGRR | 2.26 | | |
| NS3 | 2116 | 0.21 | 3 | 2 | 0 | Y | FKDFASGKRS | 97.18 | FKDFAAGRRS | 2.26 | | | | |
| NS3 | 2117 | 0.21 | 3 | 2 | 0 | Y | KDFASGKRSQ | 97.18 | KDFAAGRRSQ | 2.26 | | | | |
| NS3 | 2118 | 0.31 | 5 | 4 | 0 | Y | DFASGKRSQI | 96.05 | DFAAGRRSQI | 2.26 | DFASGKRSQM | 0.56 | DFASGKRSQV | 0.56 |
| NS3 | 2119 | 0.31 | 5 | 4 | 0 | Y | FASGKRSQIG | 96.05 | FAAGRRSQIG | 2.26 | FASGKRSQMG | 0.56 | FAAGKRSQIG | 0.56 |
| NS3 | 2120 | 0.43 | 6 | 5 | 0 | Y | ASGKRSQIGL | 94.35 | AAGRRSQIGL | 2.26 | ASGKRSQIGF | 1.69 | ASGKRSQMGL | 0.56 |
| NS3 | 2122 | 0.79 | 6 | 5 | 0 | Y | GKRSQIGLIE | 86.44 | GKRSQIGLVE | 2.26 | GKRSQIGFIE | 2.26 | GKRSQIGFIE | 1.69 |
| NS3 | 2123 | 0.79 | 6 | 5 | 0 | Y | KRSQIGLIEV | 86.44 | KRSQIGLVEV | 2.26 | KRSQIGFIEV | 2.26 | KRSQIGFIEV | 1.69 |
| NS3 | 2124 | 0.79 | 6 | 5 | 0 | Y | RSQIGLIEVL | 86.44 | RSQIGLVEVI | 2.26 | RSQIGFIEVL | 2.26 | RSQIGFIEVL | 1.69 |
| NS3 | 2125 | 0.79 | 6 | 5 | 0 | Y | SQIGLIEVLG | 86.44 | SQIGLVEVLG | 2.26 | SQIGFIEVLG | 2.26 | SQMGLIEVLG | 1.69 |
| NS3 | 2126 | 0.79 | 6 | 5 | 0 | Y | QIGLIEVLGK | 86.44 | QIGLVEVIGR | 2.26 | QIGFIEVLGK | 2.26 | QMGLIEVLGK | 1.69 |
| NS3 | 2127 | 0.74 | 6 | 5 | 0 | Y | IGLIEVLGKM | 87.01 | IGLVEVIGRM | 2.26 | IGFIEVLGKM | 2.26 | MGLIEVLGKM | 1.69 |
| NS4A | 2128 | 0.74 | 5 | 5 | 0 | Y | GLIEVLGKMP | 87.01 | GLVEVIGRMP | 2.26 | GFIEVLGKMP | 2.26 | | |
| NS4A | 2129 | 0.62 | 5 | 4 | 0 | Y | LIEVLGKMPE | 88.7 | LVEVIGRMPE | 2.26 | FIEVLGKMPE | 2.26 | | |
| NS4A | 2130 | 0.59 | 4 | 4 | 0 | Y | IEVLGKMPEH | 88.7 | VEVIGRMPEH | 2.26 | | | | |
| NS4A | 2131 | 0.59 | 3 | 3 | 0 | Y | EVLGKMPEHF | 88.7 | EVIGRMPEHF | 2.26 | | | | |
| NS4A | 2132 | 0.59 | 3 | 3 | 0 | Y | VLGKMPEHFM | 88.7 | VIGRMPEHFV | 9.04 | | | | |
| NS4A | 2133 | 0.64 | 4 | 4 | 0 | Y | LGKMPEHFMG | 88.7 | IGRMPEHFMG | 7.91 | IGRMPEHFVG | 2.26 | LGRMPEHFMV | 1.13 |

FIG. 25-72

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99

FIG. 25-73

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2159 | 0.31 | 5 | 4 | 0 | Y | KGGRAHRMAL | 96.05 | KGGRAHRTAL | 2.26 | KGGRAHSMAL | 0.56 | KGRRAHRMAL | 0.56 |
| NS4A | 2160 | 0.31 | 5 | 4 | 0 | Y | GGRAHRMALE | 96.05 | GGRAHRTALE | 2.26 | GGRAHRSALE | 0.56 | GRAHRMALE | 0.56 |
| NS4A | 2161 | 0.31 | 5 | 4 | 0 | Y | GRAHRMALEE | 96.05 | GRAHRTALEE | 2.26 | RAHRSALEE | 0.56 | GRAHSMALEE | 0.56 |
| NS4A | 2162 | 0.26 | 4 | 3 | 0 | Y | RAHRMALEEL | 96.61 | RAHRTALEEL | 2.26 | RAHRSALEEL | 0.56 | | |
| NS4A | 2163 | 0.26 | 4 | 3 | 0 | Y | AHRMALEELP | 96.61 | AHRTALEELP | 2.26 | AHSMALEELP | 0.56 | | |
| NS4A | 2164 | 0.26 | 4 | 3 | 0 | Y | HRMALEELPD | 96.61 | HRTALEELPD | 2.26 | HRSALEELPD | 0.56 | | |
| NS4A | 2165 | 0.26 | 4 | 3 | 0 | Y | RMALEELPDA | 96.61 | RTALEELPDA | 2.26 | RSALEELPDA | 0.56 | | |
| NS4A | 2166 | 0.21 | 3 | 2 | 0 | Y | MALEELPDAL | 97.18 | TALEELPDAL | 2.26 | | | | |
| NS4A | 2167 | 0 | 1 | 1 | 0 | Y | ALEELPDALQ | 100 | | | | | | |
| NS4A | 2168 | 0 | 1 | 1 | 0 | Y | LEELPDALQT | 100 | | | | | | |
| NS4A | 2169 | 0.05 | 2 | 1 | 0 | Y | EELPDALQTI | 99.44 | | | | | | |
| NS4A | 2170 | 0.19 | 4 | 3 | 0 | Y | ELPDALQTIA | 97.74 | ELPDALQTIV | 1.13 | ELPDALQTVA | 0.56 | | |
| NS4A | 2171 | 0.19 | 4 | 3 | 0 | Y | LPDALQTIAL | 97.74 | LPDALQTIVL | 1.13 | LPDALQTVAL | 0.56 | | |
| NS4A | 2172 | 0.19 | 4 | 3 | 0 | Y | PDALQTIALI | 97.74 | PDALQTIVLI | 1.13 | PDALQTIILI | 0.56 | | |
| NS4A | 2173 | 0.69 | 5 | 4 | 0 | Y | DALQTIALIA | 86.44 | DALQTIVLIA | 1.13 | DALQTIVLIA | 1.13 | DALQTVALIA | 0.56 |
| NS4A | 2174 | 0.69 | 5 | 4 | 0 | Y | ALQTIALIAL | 86.44 | ALQTIVLIAL | 1.13 | ALQTIVLIAL | 1.13 | ALQTIILITL | 0.56 |
| NS4A | 2175 | 0.69 | 5 | 4 | 0 | Y | LQTIALIALL | 86.44 | LQTIVLIALL | 1.13 | LQTIVLIALL | 1.13 | LQTVALIALL | 0.56 |
| NS4A | 2176 | 0.69 | 5 | 4 | 0 | Y | QTIALIALLS | 86.44 | QTIALITLL | 1.13 | QTIVLIALLS | 1.13 | QTIILITLS | 0.56 |
| NS4A | 2177 | 0.69 | 5 | 4 | 0 | Y | TIALIALLSV | 86.44 | TIALITLLSV | 1.13 | TIVLIALLSV | 1.13 | TVALIALLGV | 0.56 |
| NS4A | 2178 | 0.69 | 5 | 4 | 0 | Y | IALIALLSVM | 86.44 | IALITLLSVM | 1.13 | IVLIALLSVM | 1.13 | VALIALLGVM | 0.56 |
| NS4A | 2183 | 0.7 | 6 | 5 | 0 | Y | LLSVMTMGVF | 88.14 | LLSVMSLGVF | 2.26 | LLSVMTLGVF | 2.26 | LLSVMTMGIF | 0.56 | LLGVMTMGVF | 0.56 |
| NS4A | 2186 | 0.7 | 6 | 5 | 0 | Y | VMTMGVFFLL | 88.14 | VMSLGVFFLL | 2.26 | VMTLGVFCLL | 2.26 | VMTMGIFFLL | 0.56 | VMTMGVFLLL | 0.56 |
| NS4A | 2187 | 0.7 | 6 | 5 | 0 | Y | MTMGVFFLLM | 88.14 | MSLGVFFLLM | 2.26 | MTLGVFCLLM | 2.26 | MTMGVFFLLM | 0.56 | MSMGVFFLLM | 0.56 |
| NS4A | 2188 | 0.7 | 6 | 5 | 0 | Y | TMGVFFLLMQ | 88.14 | SLGVFFLLMQ | 2.26 | TLGVFCLLMQ | 2.26 | TMGVFFLLMQ | 0.56 | TMGIFFLLMQ | 0.56 |
| NS4A | 2189 | 0.65 | 5 | 4 | 0 | Y | MGVFFLLMQR | 88.7 | LGVFFLLMQR | 7.91 | LGVFCLLMQR | 7.91 | MGIFFLLMQR | 2.26 | | |

FIG. 25-74

Species: WNV (10-mers)

| protein | block starting position | block entropy | total peptides in block | # peptides required to cover 99% of block | gap/X fraction | 99% of block covered w/ <=

FIG. 25-75

Species: WNV (10-mers)

| protein | block starting position | block entropy | total peptides in block | # peptides required to cover 99% of block | gap/X fraction | 99% of block covered w

FIG. 25-76

Species: WNV (10-mers)

| protein | block starting position | block entropy | total peptides in block | # peptides required to cover 99% of block | gap/X fraction | 99% of block covered w/ <= 5 peptides? | peptides required to cover 99% of block

FIG. 25-77

Species: WNV (10-mers)

| protein | block starting position | block entropy (10-mers) | total peptides in block | # peptides required to cover 99% of block | gap/X fraction | 99% of block covered w/

FIG. 25-78

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2332 | 0.24 | 3 | 2 | 0 | Y | HLITSDYINT | 96.61 | HVITSDYINT | 2.82 | | | | |
| NS4B | 2333 | 0.24 | 3 | 2 | 0 | Y | LITSDYINTS | 96.61 | VITSDYINTS | 2.82 | | | | |
| NS4B | 2334 | 0.05 | 2 | 1 | 0 | Y | ITSDYINTSL | 99.44 | | | | | | |
| NS4B | 2335 | 0.05 | 2 | 1 | 0 | Y | TSDYINTSLT | 99.44 | | | | | | |
| NS4B | 2336 | 0.05 | 2 | 1 | 0 | Y | SDYINTSLTS | 99.44 | | | | | | |
| NS4B | 2337 | 0.05 | 2 | 1 | 0 | Y | DYINTSLTSI | 99.44 | | | | | | |
| NS4B | 2338 | 0.05 | 2 | 1 | 0 | Y | YINTSLTSIN | 99.44 | | | | | | |
| NS4B | 2339 | 0.05 | 2 | 1 | 0 | Y | INTSLTSINV | 99.44 | | | | | | |
| NS4B | 2340 | 0.05 | 2 | 1 | 0 | Y | NTSLTSINVQ | 99.44 | | | | | | |
| NS4B | 2341 | 0 | 1 | 1 | 0 | Y | TSLTSINVQA | 100 | | | | | | |
| NS4B | 2342 | 0 | 1 | 1 | 0 | Y | SLTSINVQAS | 100 | | | | | | |
| NS4B | 2343 | 0.09 | 2 | 2 | 0 | Y | LTSINVQASA | 98.87 | LTSINVQAST | 1.13 | | | | |
| NS4B | 2344 | 0.09 | 2 | 2 | 0 | Y | TSINVQASAL | 98.87 | TSINVQASTL | 1.13 | | | | |
| NS4B | 2345 | 0.24 | 3 | 3 | 0 | Y | SINVQASALF | 96.61 | SINVQASALY | 2.26 | SINVQASTLF | 1.13 | | |
| NS4B | 2346 | 0.24 | 3 | 3 | 0 | Y | INVQASALFT | 96.61 | INVQASALYS | 2.26 | INVQASTLFT | 1.13 | | |
| NS4B | 2347 | 0.24 | 3 | 3 | 0 | Y | NVQASALFTL | 96.61 | NVQASALYSL | 2.26 | NVQASTLFTL | 1.13 | | |
| NS4B | 2348 | 0.46 | 4 | 4 | 0 | Y | VQASALFTLA | 93.22 | VQASALFTLS | 3.39 | VQASALYSLA | 2.26 | VQASTLFTLA | 1.13 |
| NS4B | 2349 | 0.46 | 4 | 4 | 0 | Y | QASALFTLAR | 93.22 | QASALFTLSR | 3.39 | QASALYSLAR | 2.26 | QASTLFTLAR | 1.13 |
| NS4B | 2350 | 0.46 | 4 | 4 | 0 | Y | ASALFTLARG | 93.22 | ASALFTLSRG | 3.39 | ASALYSLARG | 2.26 | ASTLFTLARG | 1.13 |
| NS4B | 2351 | 0.46 | 4 | 4 | 0 | Y | SALFTLARGF | 93.22 | SALFTLSRGF | 3.39 | SALYSLARGF | 2.26 | STLFTLARGF | 1.13 |
| NS4B | 2352 | 0.46 | 4 | 4 | 0 | Y | ALFTLARGFP | 93.22 | ALFTLSRGFP | 3.39 | ALYSLARGFP | 2.26 | TLFTLARGFP | 1.13 |
| NS4B | 2353 | 0.37 | 3 | 3 | 0 | Y | LFTLARGFPF | 94.35 | LFTLSRGFPF | 3.39 | LYSLARGFPF | 2.26 | | |
| NS4B | 2354 | 0.37 | 3 | 3 | 0 | Y | FTLARGFPFV | 94.35 | FTLSRGFPFV | 3.39 | YSLARGFPFV | 2.26 | | |
| NS4B | 2355 | 0.37 | 3 | 3 | 0 | Y | TLARGFPFVD | 94.35 | TLSRGFPFVD | 3.39 | SLARGFPFVD | 2.26 | | |
| NS4B | 2356 | 0.21 | 2 | 2 | 0 | Y | LARGFPFVDV | 96.61 | LSRGFPFVDV | 3.39 | | | | |

FIG. 25-79

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 25-80

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 25-81

Species: WNV (10-mers)

| protein | block starting position | block entropy | total peptides in block | # peptides required

FIG. 25-82

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|

FIG. 25-83

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 25-84

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

FIG. 25-85

Species: WNV (10-mers)

| protein | block starting position | block entropy | total pe

FIG. 25-86

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 25-87

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---

FIG. 25-88

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | fr

FIG. 25-89

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2649 | 0.17 | 3 | 2 | 0 | Y | GWNTVTMKSG | 97.74 | GWNTVTMKSG | 1.69 | | | | |
| NS5 | 2650 | 0.17 | 3 | 2 | 0 | Y | WNTVTMKSGV | 97.74 | WNTVTMKSGV | 1.69 | | | | |
| NS5 | 2651 | 0.17 | 3 | 2 | 0 | Y | NTVTMKSGVD | 97.74 | NTVTMKSGVD | 1.69 | | | | |
| NS5 | 2652 | 0.17 | 3 | 2 | 0 | Y | TVTMKSGVDV | 97.74 | TVTMKSGVDV | 1.69 | | | | |
| NS5 | 2653 | 0.21 | 3 | 2 | 0 | Y | VTMKSGVDVF | 97.18 | VTMKSGVDVY | 2.26 | | | | |
| NS5 | 2654 | 0.21 | 3 | 2 | 0 | Y | TMKSGVDVFY | 97.18 | TMKSGVDVYY | 2.26 | | | | |
| NS5 | 2655 | 0.21 | 3 | 2 | 0 | Y | MKSGVDVFYR | 97.18 | MKSGVDVYYR | 2.26 | | | | |
| NS5 | 2656 | 0.21 | 3 | 2 | 0 | Y | KSGVDVFYRP | 97.18 | KSGVDVYYRA | 2.26 | | | | |
| NS5 | 2657 | 0.21 | 3 | 2 | 0 | Y | SGVDVFYRPS | 97.18 | SGVDVYYRAS | 2.26 | | | | |
| NS5 | 2658 | 0.21 | 3 | 2 | 0 | Y | GVDVFYRPSE | 97.18 | GVDVYYRASE | 2.26 | | | | |
| NS5 | 2659 | 0.68 | 6 | 5 | 0.56 | Y | VDVFYRPSEC | 88.7 | VDVFYRPSEA | 7.34 | VDVYYRASEA | 2.26 | VDVFYRTSEA | 0.56 |
| NS5 | 2660 | 0.68 | 6 | 5 | 0.56 | Y | DVFYRPSECC | 88.7 | DVFYRPSEAS | 7.34 | DVYYRASEAS | 2.26 | DVFYRPSEVS | 0.56 |
| NS5 | 2661 | 0.68 | 6 | 5 | 0.56 | Y | VFYRPSECCD | 88.7 | VFYRPSEASD | 7.34 | VYYRASEASD | 2.26 | VFYRPSESCD | 0.56 |
| NS5 | 2662 | 0.68 | 6 | 5 | 0.56 | Y | FYRPSECCDT | 88.14 | FYRPSEASDT | 7.34 | YYRASEASDT | 2.26 | FYRPSESCDT | 0.56 |
| NS5 | 2663 | 0.68 | 6 | 5 | 0.56 | Y | YRPSECCDTL | 88.14 | YRPSEASDTL | 7.34 | YRASEASDTL | 2.26 | YRPSEVSDTL | 0.56 |
| NS5 | 2664 | 0.68 | 6 | 5 | 0.56 | Y | RPSECCDTLL | 88.14 | RPSEASDTLL | 7.34 | RASEASDTLL | 2.26 | RPSEVSDTLL | 0.56 |
| NS5 | 2665 | 0.68 | 6 | 5 | 0.56 | Y | PSECCDTLLC | 88.14 | PSEASDTLLC | 7.34 | ASEASDTLLC | 2.26 | PSESCDTLLC | 0.56 |
| NS5 | 2666 | 0.58 | 4 | 3 | 0.56 | Y | SECCDTLLCD | 88.14 | SEASDTLLCD | 10.17 | SEVSDTLLCD | 0.56 | | |
| NS5 | 2667 | 0.58 | 4 | 3 | 0.56 | Y | ECCDTLLCDI | 88.14 | EASDTLLCDI | 10.17 | ESCDTLLCDI | 0.56 | | |
| NS5 | 2668 | 0.58 | 4 | 3 | 0.56 | Y | CCDTLLCDIG | 88.14 | ASDTLLCDIG | 10.17 | SCDTLLCDIG | 0.56 | | |
| NS5 | 2669 | 0.49 | 2 | 2 | 0.56 | Y | CDTLLCDIGE | 88.7 | SDTLLCDIGE | 10.73 | | | | |
| NS5 | 2670 | 0 | 1 | 1 | 0.56 | Y | DTLLCDIGES | 99.44 | | | | | | |
| NS5 | 2671 | 0.16 | 2 | 2 | 0 | Y | TLLCDIGESS | 97.18 | TLLCDIGESA | 2.26 | | | | |
| NS5 | 2672 | 0.16 | 2 | 2 | 0 | Y | LLCDIGESSS | 97.74 | LLCDIGESAS | 2.26 | | | | |
| NS5 | 2673 | 0.16 | 2 | 2 | 0 | Y | LCDIGESSSS | 97.74 | LCDIGESASS | 2.26 | | | | |

FIG. 25-90

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|

FIG. 25-91

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 25-92

Species: WNV (10-mers)

| protein | block starting position | block entropy | total peptides in block | # peptides required to cover 99% of block | gap/X fraction | 99% of block covered w/ <= 5 peptides? | peptides required

FIG. 25-93

Species: WNV (10-mers)

| protein | block starting position | block entropy | total peptides in block | # peptides required to cover 99% of block | gap/X fraction | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|
| NS5 | 2749 | 0.72 | 6 | 5 | 0 | YWVSRASGNV | 87.57 | YWVSHASGNI | 8.47 | YWVSRASGNI | 2.26 | YWVSRASRNV | 0.56 | YWVSQASGNI | 0.56 |
| NS5 | 2750 | 0.72 | 6 | 5 | 0 | WVSRASGNVV | 87.57 | WVSHASGNIV | 8.47 | WVSRASGNIV | 2.26 | WVSRASSNVV | 0.56 | WVSRASRNVV | 0.56 |
| NS5 | 2751 | 0.72 | 6 | 5 | 0 | VSRASGNVVH | 87.57 | VSHASGNIVH | 8.47 | VSRASGNIVN | 2.26 | VSRASRNVVH | 0.56 | VSQASGNIVH | 0.56 |
| NS5 | 2757 | 0.67 | 5 | 4 | 0 | NVVHSVNMTS | 88.7 | NIVHSVNMTS | 7.34 | NIVNSVSMTS | 2.26 | NIVHAVNMTS | 1.13 | | |
| NS5 | 2758 | 0.67 | 5 | 4 | 0 | VVHSVNMTSQ | 88.7 | IVHSVNMTSQ | 7.34 | IVNSVSMTSQ | 2.26 | IVHAVNMTSQ | 1.13 | | |
| NS5 | 2759 | 0.29 | 4 | 3 | 0 | VHSVNMTSQV | 96.05 | VHSVNMTSQV | 2.26 | VNVNSVSMTSQV | 2.26 | | | | |
| NS5 | 2760 | 0.29 | 4 | 3 | 0 | HSVNMTSQVL | 96.05 | NSVSMTSQVL | 2.26 | HAVNMTSQVL | 1.13 | | | | |
| NS5 | 2761 | 0.29 | 4 | 3 | 0 | SVNMTSQVLL | 96.05 | SVSMTSQVLL | 2.26 | AVNMTSQVLL | 1.13 | | | | |
| NS5 | 2762 | 0.21 | 3 | 2 | 0 | VNMTSQVLLG | 97.18 | VSMTSQVLLG | 2.26 | | | | | | |
| NS5 | 2763 | 0.16 | 2 | 2 | 0 | NMTSQVLLGR | 97.74 | SMTSQVLLGR | 2.26 | | | | | | |
| NS5 | 2764 | 0 | 1 | 1 | 0 | MTSQVLLGRM | 100 | | | | | | | | |
| NS5 | 2765 | 0 | 1 | 1 | 0 | TSQVLLGRME | 100 | | | | | | | | |
| NS5 | 2766 | 0 | 1 | 1 | 0 | SQVLLGRMEK | 100 | | | | | | | | |
| NS5 | 2767 | 0.54 | 2 | 2 | 0 | QVLLGRMEKK | 87.57 | QVLLGRMEKK | 12.43 | | | | | | |
| NS5 | 2768 | 0.54 | 2 | 2 | 0 | VLLGRMEKKT | 87.57 | VLLGRMEKKT | 12.43 | | | | | | |
| NS5 | 2769 | 0.54 | 2 | 2 | 0 | LLGRMEKKTW | 87.57 | LLGRMEKKTW | 12.43 | | | | | | |
| NS5 | 2770 | 0.54 | 2 | 2 | 0 | LGRMEKKTWK | 87.57 | LGRMEKKTWK | 12.43 | | | | | | |
| NS5 | 2771 | 0.54 | 2 | 2 | 0 | GRMEKKTWKG | 87.57 | GRMEKKTWKG | 12.43 | | | | | | |
| NS5 | 2772 | 0.63 | 3 | 3 | 0 | RMEKRTWKGP | 87.57 | RMEKKTWKGP | 10.17 | RMEKKTWKGA | 2.26 | | | | |
| NS5 | 2773 | 0.66 | 4 | 3 | 0 | MEKRTWKGPQ | 87.57 | MEKKTWKGPQ | 9.6 | MEKKTWKGAH | 2.26 | | | | |
| NS5 | 2774 | 0.79 | 6 | 5 | 0 | EKRTWKGPQY | 87.01 | EKKTWKGPQF | 6.78 | EKRTWKGPQY | 2.82 | EKKTWKGAHY | 2.26 | EKRTWKGPQF | 0.56 |
| NS5 | 2775 | 0.79 | 6 | 5 | 0 | KRTWKGPQYE | 87.01 | KKTWKGPQFE | 6.78 | KKTWKGPQYE | 2.82 | KKTWKGAHYE | 2.26 | KRTWKGPQFE | 0.56 |
| NS5 | 2776 | 0.79 | 6 | 5 | 0 | RTWKGPQYEE | 87.01 | KTWKGPQFEE | 6.78 | KTWKGPQYEE | 2.82 | KTWKGAHYEE | 2.26 | KTWKGPHYEE | 0.56 |
| NS5 | 2777 | 0.58 | 4 | 3 | 0 | TWKGPQYEED | 89.83 | TWKGPQFEED | 7.34 | TWKGAHYEED | 2.26 | | | | |
| NS5 | 2778 | 0.76 | 5 | 4 | 0 | WKGPQYEEDV | 87.01 | WKGPQFEEDV | 7.34 | WKGPQYEEDA | 2.82 | WKGAHYEEDV | 2.26 | | |

FIG. 25-94

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 25-95

Species: WNV (10

FIG. 25-96

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 25-97

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 25-98

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2920 | 0.6 | 4 | 3 | 0 | Y | KRPRMCSREE | 89.27 | KRPRMCSREE | 7.91 | KRPRMCTREE | 2.26 | | |
| NS5 | 2921 | 0.6 | 4 | 3 | 0 | Y | RPRMCSREEF | 89.27 | KPRMCSREEF | 7.91 | RPRMCTREEF | 2.26 | | |
| NS5 | 2922 | 0.21 | 3 | 2 | 0 | Y | PRMCSREEFI | 97.18 | PRMCTREEFI | 2.26 | | | | |
| NS5 | 2923 | 0.79 | 6 | 5 | 0 | Y | RMCSREEFIR | 87.01 | RMCSREEFIG | 6.78 | RMCSREEFIK | 2.82 | RMCTREEFIS | 2.26 | RMCSREEFIS | 0.56 |
| NS5 | 2924 | 0.79 | 6 | 5 | 0 | Y | MCSREEFIRK | 87.01 | MCSREEFIGK | 6.78 | MCSREEFIKK | 2.82 | MCTREEFISK | 2.26 | LCSREEFKRK | 0.56 |
| NS5 | 2925 | 0.79 | 6 | 5 | 0 | Y | CSREEFIRKV | 87.01 | CSREEFIGKV | 6.78 | CSREEFIKKV | 2.82 | CTREEFISKV | 2.26 | CSREEFKRKV | 0.56 |
| NS5 | 2926 | 0.79 | 6 | 5 | 0 | Y | SREEFIRKVN | 87.01 | SREEFIGKVN | 6.78 | SREEFIKKVN | 2.82 | TREEFISKVN | 2.26 | SREEFKRKVN | 0.56 |
| NS5 | 2927 | 0.77 | 5 | 4 | 0 | Y | REEFIRKVNS | 87.01 | REEFIGKVNS | 6.78 | REEFIKKVNS | 2.82 | REEFISKVNS | 2.26 | | |
| NS5 | 2928 | 0.77 | 5 | 4 | 0 | Y | EEFIRKVNSN | 87.01 | EEFIGKVNSN | 6.78 | EEFIKKVNSN | 2.82 | EEFISKVNSN | 2.26 | | |
| NS5 | 2929 | 0.77 | 5 | 4 | 0 | Y | EFIRKVNSNA | 87.01 | EFIGKVNSNA | 6.78 | EFIKKVNSNA | 2.82 | EFISKVNSNA | 2.26 | | |
| NS5 | 2930 | 0.77 | 5 | 4 | 0 | Y | FIRKVNSNAA | 87.01 | FIGKVNSNAA | 6.78 | FIKKVNSNAA | 2.82 | FISKVNSNAA | 2.26 | | |
| NS5 | 2931 | 0.77 | 5 | 4 | 0 | Y | IRKVNSNAAL | 87.01 | IGKVNSNAAL | 6.78 | IKKVNSNAAL | 2.82 | ISKVNSNAAL | 2.26 | | |
| NS5 | 2932 | 0.72 | 5 | 4 | 0 | Y | RKVNSNAALG | 87.57 | GKVNSNAALG | 6.78 | SKVNSNAALG | 2.82 | KKVNSNAALG | 2.26 | | |
| NS5 | 2933 | 0 | 1 | 1 | 0 | Y | KVNSNAALGA | 100 | | | | | | | |
| NS5 | 2934 | 0 | 1 | 1 | 0 | Y | VNSNAALGAM | 100 | | | | | | | |
| NS5 | 2935 | 0 | 1 | 1 | 0 | Y | NSNAALGAMF | 100 | | | | | | | |
| NS5 | 2936 | 0 | 1 | 1 | 0 | Y | SNAALGAMFE | 100 | | | | | | | |
| NS5 | 2937 | 0 | 1 | 1 | 0 | Y | NAALGAMFEE | 100 | | | | | | | |
| NS5 | 2938 | 0 | 1 | 1 | 0 | Y | AALGAMFEEQ | 100 | | | | | | | |
| NS5 | 2939 | 0 | 1 | 1 | 0 | Y | ALGAMFEEQN | 100 | | | | | | | |
| NS5 | 2940 | 0 | 1 | 1 | 0 | Y | LGAMFEEQNQ | 100 | | | | | | | |
| NS5 | 2941 | 0 | 1 | 1 | 0 | Y | GAMFEEQNQW | 100 | | | | | | | |
| NS5 | 2942 | 0.68 | 3 | 3 | 0 | Y | AMFEEQNQWR | 85.88 | AMFEEQNQWK | 11.86 | AMFEEQNQWS | 2.26 | | | |
| NS5 | 2943 | 0.79 | 4 | 4 | 0 | Y | MFEEQNQWRS | 85.88 | MFEEQNQWKN | 7.91 | MFEEQNQWKS | 3.95 | MFEEQNQWSN | 2.26 | | |
| NS5 | 2944 | 0.79 | 4 | 4 | 0 | Y | FEEQNQWRSA | 85.88 | FEEQNQWKNA | 7.91 | FEEQNQWKSA | 3.95 | FEEQNQWSNA | 2.26 | | |

FIG. 25-99

Species: WNV (10

FIG. 25-100

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 25-101

Species: WNV (10-mers)

| protein | block starting position | block entropy | total peptides in block | # peptides required to cover

FIG. 25-102

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3021 | 0.05 | 2 | 1 | 0 | Y | GFLNEDHWLG | 99.44 | | | | | | |
| NS5 | 3022 | 0.05 | 2 | 1 | 0 | Y | FLNEDHWLGR | 99.44 | | | | | | |
| NS5 | 3023 | 0.26 | 3 | 2 | 0 | Y | LNEDHWLGRK | 96.05 | LNEDHWLGRE | 3.39 | | | | |
| NS5 | 3024 | 0.26 | 3 | 2 | 0 | Y | NEDHWLGRKN | 96.05 | NEDHWLGREN | 3.39 | | | | |
| NS5 | 3025 | 0.26 | 3 | 2 | 0 | Y | EDHWLGRKNS | 96.05 | EDHWLGRENS | 3.39 | | | | |
| NS5 | 3026 | 0.26 | 3 | 2 | 0 | Y | DHWLGRKNSG | 96.05 | DHWLGRENSG | 3.39 | | | | |
| NS5 | 3027 | 0.26 | 3 | 2 | 0 | Y | HWLGRKNSGG | 96.05 | HWLGRENSGG | 3.39 | | | | |
| NS5 | 3028 | 0.26 | 3 | 2 | 0 | Y | WLGRKNSGGG | 96.05 | WLGRENSGGG | 3.39 | | | | |
| NS5 | 3029 | 0.26 | 3 | 2 | 0 | Y | LGRKNSGGGV | 96.05 | LGRENSGGGV | 3.39 | | | | |
| NS5 | 3030 | 0.26 | 3 | 2 | 0 | Y | GRKNSGGGVE | 96.05 | GRENSGGGVE | 3.39 | | | | |
| NS5 | 3031 | 0.21 | 2 | 2 | 0 | Y | RKNSGGGVEG | 96.61 | RENSGGGVEG | 3.39 | | | | |
| NS5 | 3032 | 0.21 | 2 | 2 | 0 | Y | KNSGGGVEGL | 96.61 | ENSGGGVEGL | 3.39 | | | | |
| NS5 | 3033 | 0 | 1 | 1 | 0 | Y | NSGGGVEGLG | 100 | | | | | | |
| NS5 | 3034 | 0 | 1 | 1 | 0 | Y | SGGGVEGLGL | 100 | | | | | | |
| NS5 | 3035 | 0 | 1 | 1 | 0 | Y | GGGVEGLGLQ | 100 | | | | | | |
| NS5 | 3036 | 0 | 1 | 1 | 0 | Y | GGVEGLGLQK | 100 | | | | | | |
| NS5 | 3037 | 0 | 1 | 1 | 0 | Y | GVEGLGLQKL | 100 | | | | | | |
| NS5 | 3038 | 0 | 1 | 1 | 0 | Y | VEGLGLQKLG | 100 | | | | | | |
| NS5 | 3039 | 0 | 1 | 1 | 0 | Y | EGLGLQKLGY | 100 | | | | | | |
| NS5 | 3040 | 0.19 | 2 | 2 | 0 | Y | GLGLQKLGYI | 97.18 | GLGLQKLGYV | 2.82 | | | | |
| NS5 | 3041 | 0.19 | 2 | 2 | 0 | Y | LGLQKLGYIL | 97.18 | LGLQKLGYL | 2.82 | | | | |
| NS5 | 3042 | 0.58 | 3 | 3 | 0 | Y | GLQKLGYILR | 89.27 | GLQKLGYILK | 7.91 | GLQKLGYLR | 2.82 | | |
| NS5 | 3043 | 0.61 | 4 | 3 | 0 | Y | LQKLGYILRE | 89.27 | LQKLGYILKE | 7.34 | LQKLGYVLRE | 2.82 | | |
| NS5 | 3044 | 0.61 | 4 | 3 | 0 | Y | QKLGYILREV | 89.27 | QKLGYILKEV | 7.34 | QKLGYVLRE | 2.82 | | |
| NS5 | 3045 | 0.61 | 4 | 3 | 0 | Y | KLGYILREVG | 89.27 | KLGYILKEVG | 7.34 | KLGYILREVG | 2.82 | | |

FIG. 25-103

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3058 | 0.59 | 6 | 5 | 0 | Y | GGKIYADDTA | 91.53 | GGKMYADDTA | 2.82 | GGKIYADDTA | 2.26 | GGRIYADDTA | 2.26 | GGKIYADDTA | 0.56 |
| NS5 | 3059 | 0.59 | 6 | 5 | 0 | Y | GKIYADDTAG | 91.53 | GKMYADDTAG | 2.82 | GKIYADDTAG | 2.26 | GRIYADDTAG | 2.26 | GKIYADDTAG | 0.56 |
| NS5 | 3060 | 0.59 | 6 | 5 | 0 | Y | KIYADDTAGW | 91.53 | KMYADDTAGW | 2.82 | KIYADDTAGW | 2.26 | RIYADDTAGW | 2.26 | KIYADDTAGW | 0.56 |
| NS5 | 3061 | 0.44 | 5 | 4 | 0 | Y | IYADDTAGWD | 93.79 | MYADDTAGWD | 2.82 | IYADDTAGWD | 2.26 | IFADDTAGWD | 0.56 | | |
| NS5 | 3062 | 0.05 | 2 | 1 | 0 | Y | YADDTAGWDT | 99.44 | | | | | | | | |
| NS5 | 3063 | 0.05 | 2 | 1 | 0 | Y | ADDTAGWDTR | 99.44 | | | | | | | | |
| NS5 | 3064 | 0.05 | 2 | 1 | 0 | Y | DDTAGWDTRI | 99.44 | | | | | | | | |
| NS5 | 3065 | 0.05 | 2 | 1 | 0 | Y | DTAGWDTRIT | 99.44 | | | | | | | | |
| NS5 | 3066 | 0.57 | 4 | 3 | 0 | Y | TAGWDTRITR | 88.7 | TAGWDTRITK | 10.17 | TAGWDTRITM | 0.56 | | | | |
| NS5 | 3067 | 0.57 | 4 | 3 | 0 | Y | AGWDTRITRA | 88.7 | AGWDTRITKA | 10.17 | AGWDTRITMT | 0.56 | | | | |
| NS5 | 3068 | 0.57 | 4 | 3 | 0 | Y | GWDTRITRAD | 88.7 | GWDTRITKAD | 10.17 | GWDTPITKAD | 0.56 | | | | |
| NS5 | 3069 | 0.57 | 4 | 3 | 0 | Y | WDTRITRADL | 88.7 | WDTRITKADL | 10.17 | WDTRITMTDL | 0.56 | | | | |
| NS5 | 3070 | 0.57 | 4 | 3 | 0 | Y | DTRITRADLE | 88.7 | DTRITKADLE | 10.17 | DTPITKADLE | 0.56 | | | | |
| NS5 | 3071 | 0.57 | 4 | 3 | 0 | Y | TRITRADLEN | 88.7 | TRITKADLEN | 10.17 | TPITKADLEN | 0.56 | | | | |
| NS5 | 3072 | 0.57 | 4 | 3 | 0 | Y | RITRADLENE | 88.7 | RITKADLENE | 10.17 | RITMTDLENE | 0.56 | | | | |
| NS5 | 3073 | 0.54 | 3 | 2 | 0 | Y | ITRADLENEA | 88.7 | ITKADLENEA | 10.73 | | | | | | |
| NS5 | 3074 | 0.54 | 3 | 2 | 0 | Y | TRADLENEAK | 88.7 | TKADLENEAK | 10.73 | | | | | | |
| NS5 | 3075 | 0.54 | 3 | 2 | 0 | Y | RADLENEAKV | 88.7 | KADLENEAKV | 10.73 | | | | | | |
| NS5 | 3076 | 0.05 | 2 | 1 | 0 | Y | ADLENEAKVL | 99.44 | | | | | | | | |
| NS5 | 3077 | 0 | 1 | 1 | 0 | Y | DLENEAKVLE | 100 | | | | | | | | |
| NS5 | 3078 | 0.16 | 2 | 2 | 0 | Y | LENEAKVLEL | 97.74 | LENEAKVLEF | 2.26 | | | | | | |
| NS5 | 3079 | 0.16 | 2 | 2 | 0 | Y | ENEAKVLELL | 97.74 | ENEAKVLEFL | 2.26 | | | | | | |
| NS5 | 3080 | 0.21 | 3 | 2 | 0 | Y | NEAKVLELLD | 97.18 | NEAKVLEFLD | 2.26 | | | | | | |
| NS5 | 3081 | 0.26 | 4 | 3 | 0 | Y | EAKVLELLDG | 96.61 | EAKVLEFLDG | 2.26 | EAKVLELLEG | 0.56 | | | | |
| NS5 | 3082 | 0.26 | 4 | 3 | 0 | Y | AKVLELLDGE | 96.61 | AKVLEFLDGE | 2.26 | AKVLELLEGE | 0.56 | | | | |

FIG. 25-104

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 25-105

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3108 | 0.21 | 3 | 2 |

FIG. 25-106

Species: WNV (10-mers)

| protein | block starting position | block

FIG. 25-107

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3158 | 0.64 | 6 | 5 | 0 | Y | EGVIGPDDVE | 88.7 | EGVVGPDDVE | 9.04 | EGVIGPDVE | 0.56 | EGVIGPEDVE | 0.56 | EGVITPDDVE | 0.56 |
| NS5 | 3171 | 0.34 | 5 | 4 | 0 | Y | KGKGPKVRTW | 95.48 | KGKGVKVRVW | 2.26 | KRKGPKVRTW | 1.13 | RGKGPKVRTW | 0.56 | | |
| NS5 | 3172 | 0.29 | 4 | 3 | 0 | Y | GKGPKVRTWL | 96.05 | GKGVKVRVWL | 2.26 | RKGPKVRTWL | 1.13 | | | | |
| NS5 | 3173 | 0.33 | 4 | 3 | 0 | Y | KGPKVRTWLF | 95.48 | KGVKVRVWLF | 2.26 | KGPKVRTWLS | 1.69 | | | | |
| NS5 | 3174 | 0.28 | 3 | 3 | 0 | Y | GPKVRTWLFE | 96.05 | GVKVRVWLFE | 2.26 | GPKVRTWLSE | 1.69 | | | | |
| NS5 | 3175 | 0.28 | 3 | 3 | 0 | Y | PKVRTWLFEN | 96.05 | VKVRVWLFEN | 2.26 | PKVRTWLSEN | 1.69 | | | | |
| NS5 | 3176 | 0.28 | 3 | 3 | 0 | Y | KVRTWLFENG | 96.05 | KVRVWLFENG | 2.26 | KVRTWLSENG | 1.69 | | | | |
| NS5 | 3177 | 0.33 | 4 | 3 | 0 | Y | VRTWLFENGE | 95.48 | VRVWLFENGE | 2.26 | VRTWLSENGE | 1.69 | | | | |
| NS5 | 3178 | 0.33 | 4 | 3 | 0 | Y | RTWLFENGEE | 95.48 | RVWLFENGEE | 2.26 | RTWLSENGEE | 1.69 | | | | |
| NS5 | 3179 | 0.33 | 4 | 3 | 0 | Y | TWLFENGEER | 95.48 | VWLFENGEER | 2.26 | TWLSENGEER | 1.69 | | | | |
| NS5 | 3180 | 0.17 | 3 | 2 | 0 | Y | WLFENGEERL | 97.74 | WLSENGEERL | 1.69 | | | | | | |
| NS5 | 3181 | 0.22 | 4 | 3 | 0 | Y | LFENGEERLS | 97.18 | LSENGEERLS | 1.69 | LFENGEERLG | 0.56 | | | | |
| NS5 | 3182 | 0.22 | 4 | 3 | 0 | Y | FENGEERLSR | 97.18 | SENGEERLSR | 1.69 | FENGEERLGR | 0.56 | | | | |
| NS5 | 3183 | 0.15 | 3 | 2 | 0 | Y | ENGEERLSRM | 98.31 | ENGKERLGRM | 0.56 | ENGEERLGRM | 0.56 | | | | |
| NS5 | 3184 | 0.15 | 3 | 2 | 0 | Y | NGEERLSRMA | 98.31 | NGKERLGRMA | 0.56 | NGEERLGRMA | 0.56 | | | | |
| NS5 | 3185 | 0.15 | 3 | 2 | 0 | Y | GEERLSRMAV | 98.31 | GEERLGRMAV | 0.56 | GEERLSRTAV | 0.56 | | | | |
| NS5 | 3186 | 0.15 | 3 | 2 | 0 | Y | EERLSRMAVS | 98.31 | KERLGRMAVS | 0.56 | EERLSRTAVS | 0.56 | | | | |
| NS5 | 3187 | 0.14 | 3 | 2 | 0 | Y | ERLSRMAVSG | 98.31 | ERLGRMAVSG | 1.13 | | | | | | |
| NS5 | 3188 | 0.14 | 3 | 2 | 0 | Y | RLSRMAVSGD | 98.31 | RLGRMAVSGD | 1.13 | | | | | | |
| NS5 | 3189 | 0.14 | 3 | 2 | 0 | Y | LSRMAVSGDD | 98.31 | LGRMAVSGDD | 1.13 | | | | | | |
| NS5 | 3190 | 0.14 | 3 | 2 | 0 | Y | SRMAVSGDDC | 98.31 | GRMAVSGDDC | 1.13 | | | | | | |
| NS5 | 3191 | 0.05 | 2 | 1 | 0 | Y | RMAVSGDDCV | 99.44 | | | | | | | | |
| NS5 | 3192 | 0.05 | 2 | 1 | 0 | Y | MAVSGDDCVW | 99.44 | | | | | | | | |
| NS5 | 3193 | 0 | 1 | 1 | 0 | Y | AVSGDDCVWK | 100 | | | | | | | | |
| NS5 | 3194 | 0 | 1 | 1 | 0 | Y | VSGDDCVWKP | 100 | | | | | | | | |

FIG. 25-108

Species: WNV (10-mers)

| protein | block starting position | block entropy | total peptides in block | # peptides required to cover 99% of block | gap/X fraction | 99% of block covered w/ <= 5 peptides? | peptides required to cover 99% of block

FIG. 25-109

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3220 | 0.05 | 2 | 1 | 0 | Y | KVRKDIQEWK | 99.44 | | | | | | |
| NS5 | 3221 | 0 | 1 | 1 | 0 | Y | VRKDIQEWKP | 100 | | | | | | |
| NS5 | 3222 | 0 | 1 | 1 | 0 | Y | RKDIQEWKPS | 100 | | | | | | |
| NS5 | 3223 | 0.05 | 2 | 1 | 0 | Y | KDIQEWKPST | 99.44 | | | | | | |
| NS5 | 3224 | 0.05 | 2 | 1 | 0 | Y | DIQEWKPSTG | 99.44 | | | | | | |
| NS5 | 3225 | 0.05 | 2 | 1 | 0 | Y | IQEWKPSTGW | 99.44 | | | | | | |
| NS5 | 3226 | 0.05 | 2 | 1 | 0 | Y | QEWKPSTGWY | 99.44 | | | | | | |
| NS5 | 3227 | 0.05 | 2 | 1 | 0 | Y | EWKPSTGWYD | 99.44 | | | | | | |
| NS5 | 3228 | 0.05 | 2 | 1 | 0 | Y | WKPSTGWYDW | 99.44 | | | | | | |
| NS5 | 3229 | 0.05 | 2 | 1 | 0 | Y | KPSTGWYDWQ | 99.44 | | | | | | |
| NS5 | 3230 | 0.1 | 3 | 2 | 0 | Y | PSTGWYDWQQ | 98.87 | PSTGWYDWQK | 0.56 | | | | |
| NS5 | 3231 | 0.1 | 3 | 2 | 0 | Y | STGWYDWQQV | 98.87 | SYGWYDWQQV | 0.56 | | | | |
| NS5 | 3232 | 0.19 | 4 | 3 | 0 | Y | TGWYDWQQVP | 97.74 | TGWYDWQQVQ | 1.13 | VGWYDWQQVP | 0.56 | | |
| NS5 | 3233 | 0.14 | 3 | 2 | 0 | Y | GWYDWQQVPF | 98.31 | GWYDWQQVQF | 1.13 | | | | |
| NS5 | 3234 | 0.14 | 3 | 2 | 0 | Y | WYDWQQVPFC | 98.31 | WYDWQQVQFC | 1.13 | | | | |
| NS5 | 3235 | 0.14 | 3 | 2 | 0 | Y | YDWQQVPFCS | 98.31 | YDWQQVQFCS | 1.13 | | | | |
| NS5 | 3236 | 0.14 | 3 | 2 | 0 | Y | DWQQVPFCSN | 98.31 | DWQQVQFCSN | 1.13 | | | | |
| NS5 | 3237 | 0.14 | 3 | 2 | 0 | Y | WQQVPFCSNH | 98.31 | WQQVQFCSNH | 1.13 | | | | |
| NS5 | 3238 | 0.14 | 3 | 2 | 0 | Y | QQVPFCSNHF | 98.31 | QQVQFCSNHF | 1.13 | | | | |
| NS5 | 3239 | 0.14 | 3 | 2 | 0 | Y | QVPFCSNHFT | 98.31 | QVQFCSNHFT | 1.13 | | | | |
| NS5 | 3240 | 0.12 | 2 | 2 | 0 | Y | VPFCSNHFTE | 98.31 | VQFCSNHFTE | 1.69 | | | | |
| NS5 | 3241 | 0.12 | 2 | 2 | 0 | Y | PFCSNHFTEL | 98.31 | QFCSNHFTEL | 1.69 | | | | |
| NS5 | 3242 | 0.05 | 2 | 1 | 0 | Y | FCSNHFTELI | 99.44 | | | | | | |
| NS5 | 3243 | 0.05 | 2 | 1 | 0 | Y | CSNHFTELIM | 99.44 | | | | | | |
| NS5 | 3244 | 0.05 | 2 | 1 | 0 | Y | SNHFTELIMK | 99.44 | | | | | | |

FIG. 25-110

Species: WNV (10-mers)

| protein | block starting position | block entropy | total peptides in block | # peptides required to cover 99% of block | gap/X fraction | 99% of block covered w/ <= 5 peptides? | cover 99% of block peptides required to | frequency | cover 99% of block peptides required to | frequency | cover 99% of block peptides required to | frequency | cover 99% of block peptides required to | frequency |
|---|---|---|---|---|---|---|---|---|---|---|---|---|---|---|
| NS5 | 3245 | 0.05 | 2 | 1 | 0 | Y | NHFTELIMKD | 99.44 | | | | | | |
| NS5 | 3246 | 0.05 | 2 | 1 | 0 | Y | HFTELIMKDG | 99.44 | | | | | | |
| NS5 | 3247 | 0.05 | 2 | 1 | 0 | Y | FTELIMKDGR | 99.44 | | | | | | |
| NS5 | 3248 | 0.05 | 2 | 1 | 0 | Y | TELIMKDGRT | 99.44 | | | | | | |
| NS5 | 3249 | 0.05 | 2 | 1 | 0 | Y | ELIMKDGRTL | 99.44 | | | | | | |
| NS5 | 3250 | 0.05 | 2 | 1 | 0 | Y | LIMKDGRTLV | 99.44 | | | | | | |
| NS5 | 3251 | 0.22 | 4 | 3 | 0 | Y | IMKDGRTLVW | 97.18 | IMKDGRTLVT | 1.69 | IMKDGRTLVA | 0.56 | | |
| NS5 | 3252 | 0.17 | 3 | 2 | 0 | Y | MKDGRTLVWP | 97.74 | MKDGRTLVTP | 1.69 | | | | |
| NS5 | 3253 | 0.17 | 3 | 2 | 0 | Y | KDGRTLVWPC | 97.74 | KDGRTLVTPC | 1.69 | | | | |
| NS5 | 3254 | 0.17 | 3 | 2 | 0 | Y | DGRTLVWPCR | 97.74 | DGRTLVTPCR | 1.69 | | | | |
| NS5 | 3255 | 0.17 | 3 | 2 | 0 | Y | GRTLVWPCRG | 97.74 | GRTLVTPCRG | 1.69 | | | | |
| NS5 | 3256 | 0.17 | 3 | 2 | 0 | Y | RTLVWPCRGQ | 97.74 | RTLVTPCRGQ | 1.69 | | | | |
| NS5 | 3257 | 0.17 | 3 | 2 | 0 | Y | TLVWPCRGQD | 97.74 | TLVTPCRGQD | 1.69 | | | | |
| NS5 | 3258 | 0.17 | 3 | 2 | 0 | Y | LVWPCRGQDE | 97.74 | LVTPCRGQDE | 1.69 | | | | |
| NS5 | 3259 | 0.17 | 3 | 2 | 0 | Y | VWPCRGQDEL | 97.74 | VTPCRGQDEL | 1.69 | | | | |
| NS5 | 3260 | 0.66 | 4 | 3 | 0 | Y | VPCRGQDELV | 87.01 | VPCRGQDELI | 10.73 | TPCRGQDELV | 1.69 | | |
| NS5 | 3261 | 0.49 | 2 | 2 | 0 | Y | PCRGQDELVG | 89.27 | PCRGQDELIG | 10.73 | | | | |
| NS5 | 3262 | 0.49 | 2 | 2 | 0 | Y | CRGQDELVGR | 89.27 | CRGQDELIGR | 10.73 | | | | |
| NS5 | 3263 | 0.49 | 2 | 2 | 0 | Y | RGQDELVGRA | 89.27 | RGQDELIGRA | 10.73 | | | | |
| NS5 | 3264 | 0.49 | 2 | 2 | 0 | Y | GQDELVGRAR | 89.27 | GQDELIGRAR | 10.73 | | | | |
| NS5 | 3265 | 0.49 | 2 | 2 | 0 | Y | QDELVGRARI | 89.27 | QDELIGRARI | 10.73 | | | | |
| NS5 | 3266 | 0.49 | 2 | 2 | 0 | Y | DELVGRARIS | 89.27 | DELIGRARIS | 10.73 | | | | |
| NS5 | 3267 | 0.49 | 2 | 2 | 0 | Y | ELVGRARISP | 89.27 | ELIGRARISP | 10.73 | | | | |
| NS5 | 3268 | 0.49 | 2 | 2 | 0 | Y | LVGRARISPG | 89.27 | LIGRARISPG | 10.73 | | | | |
| NS5 | 3269 | 0.49 | 2 | 2 | 0 | Y | VGRARISPGA | 89.27 | IGRARISPGA | 10.73 | | | | |

FIG. 25-112

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3295 |

FIG. 25-113

Species: WNV (10-mers)

| protein | block starting position | block entropy | total peptides in block | # peptides required to cover 99% of block | gap/X fraction | 99% of block covered w/ <= 5 peptides? | peptides required to cover 99% of block

FIG. 25-114

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3346 | 0.05 | 2 | 1 | 0.56 | Y | VWNRVWIEEN | 98.87 | | | | | | | | |
| NS5 | 3347 | 0.1 | 3 | 2 | 0.56 | Y | WNRVWIEENE | 98.31 | WNKVWIEENE | 0.56 | | | | | | |
| NS5 | 3348 | 0.1 | 3 | 2 | 0 | Y | NRVWIEENEW | 98.87 | NKVWIEENEW | 0.56 | | | | | | |
| NS5 | 3349 | 0.1 | 3 | 2 | 0 | Y | RVWIEENEWM | 98.87 | KVWIEENEWM | 0.56 | | | | | | |
| NS5 | 3350 | 0.05 | 2 | 1 | 0 | Y | VWIEENEWME | 99.44 | | | | | | | | |
| NS5 | 3351 | 0.05 | 2 | 1 | 0 | Y | WIEENEWMED | 99.44 | | | | | | | | |
| NS5 | 3352 | 0.05 | 2 | 1 | 0 | Y | IEENEWMEDK | 99.44 | | | | | | | | |
| NS5 | 3353 | 0.05 | 2 | 1 | 0 | Y | EENEWMEDKT | 99.44 | | | | | | | | |
| NS5 | 3354 | 0.05 | 2 | 1 | 0 | Y | ENEWMEDKTP | 99.44 | | | | | | | | |
| NS5 | 3355 | 0.05 | 2 | 1 | 0 | Y | NEWMEDKTPV | 99.44 | | | | | | | | |
| NS5 | 3356 | 0.05 | 2 | 1 | 0 | Y | EWMEDKTPVE | 99.44 | | | | | | | | |
| NS5 | 3357 | 0.47 | 2 | 2 | 0 | Y | WMEDKTPVEK | 89.83 | WMEDKTPVER | 10.17 | | | | | | |
| NS5 | 3358 | 0.47 | 2 | 2 | 0 | Y | MEDKTPVEKW | 89.83 | MEDKTPVERW | 10.17 | | | | | | |
| NS5 | 3359 | 0.47 | 2 | 2 | 0 | Y | EDKTPVEKWS | 89.83 | EDKTPVERWS | 10.17 | | | | | | |
| NS5 | 3360 | 0.47 | 2 | 2 | 0 | Y | DKTPVEKWSD | 89.83 | DKTPVERWSD | 10.17 | | | | | | |
| NS5 | 3361 | 0.53 | 3 | 3 | 0 | Y | KTPVEKWSDY | 89.83 | KTPVERWSDV | 9.04 | KTPVERWSDI | 1.13 | | | | |
| NS5 | 3362 | 0.53 | 3 | 3 | 0 | Y | TPVEKWSDYP | 89.83 | TPVERWSDVP | 9.04 | TPVERWSDIP | 1.13 | | | | |
| NS5 | 3363 | 0.53 | 3 | 3 | 0 | Y | PVEKWSDVPY | 89.83 | PVERWSDVPY | 9.04 | PVERWSDIPY | 1.13 | | | | |
| NS5 | 3364 | 0.53 | 3 | 3 | 0 | Y | VEKWSDVPYS | 89.83 | VERWSDVPYS | 9.04 | VERWSDIPYS | 1.13 | | | | |
| NS5 | 3365 | 0.53 | 3 | 3 | 0 | Y | EKWSDVPYSG | 89.83 | ERWSDVPYSG | 9.04 | ERWSDIPYSG | 1.13 | | | | |
| NS5 | 3366 | 0.53 | 3 | 3 | 0 | Y | KWSDVPYSGK | 89.83 | RWSDVPYSGK | 9.04 | RWSDIPYSGK | 1.13 | | | | |
| NS5 | 3367 | 0.09 | 2 | 2 | 0 | Y | WSDVPYSGKR | 98.87 | WSDIPYSGKR | 1.13 | | | | | | |
| NS5 | 3368 | 0.09 | 2 | 2 | 0 | Y | SDVPYSGKRE | 98.87 | SDIPYSGKRE | 1.13 | | | | | | |
| NS5 | 3369 | 0.09 | 2 | 2 | 0 | Y | DVPYSGKRED | 98.87 | DIPYSGKRED | 1.13 | | | | | | |
| NS5 | 3370 | 0.09 | 2 | 2 | 0 | Y | VPYSGKREDI | 98.87 | IPYSGKREDI | 1.13 | | | | | | |

FIG. 25-115

Species: WNV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3371 | 0 | 1 | 1 |

FIG. 25-116

Species: WNV (10-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3396 | 0.5 | 4 | 3 | 0 | Y | NIQVAINQVR | 90.96 | NIHVAINQVR | 7.91 | NIQVAINQVK | 0.56 | | |
| NS5 | 3397 | 0.62 | 5 | 4 | 0 | Y | IQVAINQVRA | 89.27 | IHVAINQVRS | 7.91 | IQVAINQVRS | 1.69 | IQVAINQVKA | 0.56 |
| NS5 | 3407 | 0.59 | 4 | 3 | 0 | Y | IIGDEKYVDY | 88.7 | VIGEEKYVDY | 9.6 | IIGEEKYVDY | 1.13 | | |
| NS5 | 3408 | 0.54 | 3 | 2 | 0 | Y | IGDEKYVDYM | 88.7 | IGEEKYVDYM | 10.73 | | | | |
| NS5 | 3409 | 0.63 | 4 | 3 | 0 | Y | GDEKYVDYMS | 88.7 | GEEKYVDYMS | 7.91 | GEEKYVDYMG | 2.82 | | |
| NS5 | 3410 | 0.63 | 4 | 3 | 0 | Y | DEKYVDYMSS | 88.7 | EEKYVDYMSS | 7.91 | EEKYVDYMGS | 2.82 | | |
| NS5 | 3411 | 0.24 | 3 | 2 | 0 | Y | EKYVDYMSSL | 96.61 | EKYVDYMGSL | 2.82 | | | | |
| NS5 | 3412 | 0.6 | 4 | 3 | 0 | Y | KYVDYMSSLK | 89.27 | KYVDYMSSLR | 7.91 | KYVDYMGSLK | 2.26 | | |
| NS5 | 3413 | 0.6 | 4 | 3 | 0 | Y | YVDYMSSLKR | 89.27 | YVDYMSSLRR | 7.91 | YVDYMGSLKR | 2.26 | | |
| NS5 | 3414 | 0.6 | 4 | 3 | 0 | Y | VDYMSSLKRY | 89.27 | VDYMSSLRRY | 7.91 | VDYMGSLKRY | 2.26 | | |
| NS5 | 3415 | 0.6 | 4 | 3 | 0 | Y | DYMSSLKRYE | 89.27 | DYMSSLRRYE | 7.91 | DYMGSLKRYE | 2.26 | | |
| NS5 | 3416 | 0.63 | 5 | 4 | 0 | Y | YMSSLKRYED | 89.27 | YMSSLRRYED | 7.34 | YMGSLKRYEE | 2.26 | YMSSLRRYEE | 0.56 |

FIG. 26-1

Species: WNV (11-mers)

| protein | block starting position | block entropy | total peptides in block | # peptides required to cover 99% of block | gap/X fraction | 99% of block covered w/ <= 5 peptides? | peptides required

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|

FIG. 26-4

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| anC | 86 | 0.36 | 6 | 5 | 0 | Y | KELGILTSAIN | 95.48 | KELGALTNAMN | 2.26 | KELGALTSAIN | 0.56 | KELGLTNAMN | 0.56 | KELGILTNAIS | 0.56 |
| anC | 87 | 0.31 | 5 | 4 | 0 | Y | ELGILTSAINR | 96.05 | ELGALTNAMNK | 2.26 | ELGILTNAISR | 0.56 | ELGLTNAMNR | 0.56 | | |
| anC | 88 | 0.31 | 5 | 4 | 0 | Y | LGTLTSAINRR | 96.05 | LGALTNAMNKR | 2.26 | LGTLTNAMNRR | 0.56 | LGALTSAINRR | 0.56 | | |
| anC | 89 | 0.31 | 5 | 4 | 0 | Y | GTLTSAINRRS | 96.05 | GALTNAMNKRS | 2.26 | GTLTNAMNRRS | 0.56 | GALTSAINRRS | 0.56 | | |
| anC | 96 | 0.65 | 6 | 5 | 2.26 | Y | NRRSSQKQKRG | 87.01 | NRRSTKQKKRG | 2.26 | NRRSLKQKKRG | 1.13 | NRRSAKQKKRG | 0.56 | NRRSSKEKKRG | 0.56 |
| anC | 97 | 0.65 | 6 | 5 | 2.26 | Y | RRSSKQKKRGG | 87.01 | RRSTKQKKRGG | 2.26 | RRSLKQKKRGG | 1.13 | RRSAKQKKRGG | 0.56 | RRSSKEKKRGG | 0.56 |
| anC | 122 | 0.36 | 6 | 5 | 0 | Y | GAVTLSNFQGK | 95.48 | SAVTLSNFQGK | 2.26 | GAVTLSDFQGK | 0.56 | RAVTLSNFQGK | 0.56 | GSVTLSNFQGK | 0.56 |
| anC | 123 | 0.31 | 5 | 4 | 0 | Y | AVTLSNFQGKV | 96.05 | ALTLSNFQGKL | 2.26 | AVVLSNFQGKL | 0.56 | AVTLSDFQGKV | 0.56 | | |
| prM | 124 | 0.34 | 5 | 4 | 0 | Y | VTLSNFQGKVM | 95.48 | LTLSNFQGKLM | 2.26 | VTLSNFQGKVI | 1.13 | VTLSDFQGKVM | 0.56 | | |
| prM | 125 | 0.34 | 5 | 3 | 0 | Y | TLSNFQGKVMM | 95.48 | TLSNFQGKLMM | 2.82 | TLSNFQGKVIM | 1.13 | TLSDFQGKVMM | 0.56 | | |
| prM | 126 | 0.32 | 4 | 4 | 0 | Y | LSNFQGKVMMT | 95.48 | LSNFQGKLMMT | 2.26 | LSNFQGKVIMT | 1.13 | | | | |
| prM | 127 | 0.39 | 6 | 4 | 0 | Y | SNFQGKVMMTV | 94.92 | SNFQGKLMMTI | 2.26 | SNFQGKVIMTV | 1.13 | SNFQGKVMMTI | 0.56 | SDFQGKVMMTV | 0.56 |
| prM | 128 | 0.39 | 6 | 4 | 0 | Y | NFQGKVMMTVN | 94.92 | NFQGKLMMTIN | 2.26 | NFQGKVIMTVN | 1.13 | NFQGKLMMTIN | 0.56 | NFQGKLMMTVN | 0.56 |
| prM | 129 | 0.34 | 5 | 4 | 0 | Y | FQGKVMMTVNA | 95.48 | FQGKLMMTINA | 2.26 | FQGKVIMTVNA | 1.13 | | | | |
| prM | 130 | 0.34 | 5 | 4 | 0 | Y | QGKVMMTVNAT | 95.48 | QGKLMMTINAT | 2.26 | QGKVIMTVNAT | 1.13 | | | | |
| prM | 131 | 0.37 | 6 | 3 | 0 | Y | GKVMMTVNATD | 95.48 | GKLMMTINATE | 1.13 | GKLMMTINATD | 1.13 | GKLMMTINATD | 0.56 | GKLMMTVNATD | 0.56 |
| prM | 145 | 0.29 | 4 | 4 | 0 | Y | VITIPTAAGKN | 96.61 | IITIPTAAGKN | 1.13 | IITIPTASGKN | 0.56 | IITIPTASGKN | 0.56 | VITIPTASGKN | 0.56 |
| prM | 146 | 0.15 | 4 | 3 | 0 | Y | ITIPTAAGKNL | 98.31 | ITIPIASGKNL | 0.56 | ITIPTASGKNL | 0.56 | | | | |
| prM | 147 | 0.15 | 4 | 3 | 0 | Y | TIPTAAGKNLC | 98.31 | TIPIASGKNLC | 0.56 | TIPTASGKNLC | 0.56 | | | | |
| prM | 148 | 0.36 | 5 | 4 | 0 | Y | IPTAAGKNLCI | 94.92 | IPTAAGKNLCT | 3.39 | IPIASGKNLCT | 0.56 | IPTASGKNLCT | 0.56 | | |
| prM | 149 | 0.39 | 6 | 5 | 0 | Y | PTAAGKNLCIV | 94.92 | PTAAGKNLCTI | 2.26 | PTAAGKNLCTV | 1.13 | PPAAGKNLCIV | 0.56 | PTASGKNLCTV | 0.56 |
| prM | 150 | 0.39 | 6 | 4 | 0 | Y | TAAGKNLCIVR | 94.92 | TAAGKNLCTIR | 2.26 | TAAGKNLCTVR | 1.13 | PAAGKNLCTV | 0.56 | PAAGKNLCIVR | 0.56 |
| prM | 151 | 0.33 | 5 | 4 | 0 | Y | AAGKNLCIVRA | 95.48 | AAGKNLCTIRA | 2.26 | AAGKNLCTVRA | 1.13 | IASGKNLCTVR | 0.56 | | |
| prM | 152 | 0.34 | 5 | 4 | 0 | Y | AGKNLCIVRAM | 95.48 | AGKNLCTIRAM | 2.26 | AGKNLCTVRAM | 1.13 | SGKNLCTVRAI | 0.56 | | |
| prM | 153 | 0.33 | 4 | 3 | 0 | Y | GKNLCIVRAMD | 95.48 | GKNLCTIRAMD | 2.26 | GKNLCTVRAMD | 1.69 | | | | |

FIG. 26-5

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

FIG. 26-6

Species: WNV (11-mers)

| protein | block starting position | block entropy | total peptides in block | # peptides required to cover 99% of block | gap/X fraction | 99% of block covered w/ <= 5 peptides? | peptides required to cover 99% of block

FIG. 26-7

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 26-8

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 240 | 0.16 | 2 | 2 | 0 | Y | ATRYLVKTESW | 97.74 | ASRYLMKAESW | 2.26 | | | | |
| prM | 241 | 0.16 | 2 | 2 | 0 | Y | TRYLVKTESWI | 97.74 | SRYLMKAESW

FIG. 26-9

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 265 | 0.24 | 3 | 2 | 0 | Y | GWMLGSNTMQR | 96.61 | GWMLGSNTQR | 2.82 | | | | |
| prM | 266 | 0.24 | 3 | 2 | 0 | Y | WMLGSNTMQRV | 96.61 | WMLGSNTTQRV | 2.82 | | | | |
| prM | 267 | 0.24 | 3 | 2 | 0 | Y | MLGSNTMQRVV | 96.61 | MLGSNTTQRVV | 2.82 | | | | |
| prM | 268 | 0.24 | 3 | 2 | 0 | Y | LGSNTMQRVVF | 96.61 | LGSNTTQRVVF | 2.82 | | | | |
| prM | 269 | 0.81 | 5 | 4 | 0 | Y | GSNTMQRVVFV | 85.31 | GSNTMQRVVFA | 9.6 | GSNTTQRVVFM | 2.82 | GSNTMQRVVFI | 1.69 |
| prM | 273 | 0.85 | 6 | 5 | 0 | Y | MQRVVFVVLLL | 85.88 | MQRVVFAILLL | 7.34 | MQRVVFAVLLL | 2.26 | MQRVVFMILLL | 2.26 | MQRVVFIVLLL | 1.69 |
| prM | 274 | 0.85 | 6 | 5 | 0 | Y | QRVVFVVLLLL | 85.88 | QRVVFAILLLL | 7.34 | QRVVFAVLLLL | 2.26 | QRVVFMILLLL | 2.26 | QRVVFIVLLLL | 1.69 |
| prM | 275 | 0.85 | 6 | 5 | 0 | Y | RVVFVVLLLLV | 85.88 | RVVFAILLLLV | 7.34 | RVVFAVLLLLV | 2.26 | RVVFMILLLLV | 2.26 | RVVFIVLLLLV | 1.69 |
| prM | 276 | 0.85 | 6 | 5 | 0 | Y | VVFVVLLLLVA | 85.88 | VVFAILLLLVA | 7.34 | VVFAVLLLLVA | 2.26 | VVFMILLLLVA | 2.26 | VVFIVLLLLVA | 1.69 |
| prM | 277 | 0.85 | 6 | 5 | 0 | Y | VFVVLLLLVAP | 85.88 | VFAILLLLVAP | 7.34 | VFAVLLLLVAP | 2.26 | VFMILLLLVAP | 2.26 | VFIVLLLLVAP | 1.69 |
| prM | 278 | 0.85 | 6 | 5 | 0 | Y | FVVLLLLVAPA | 85.88 | FAILLLLVAPA | 7.34 | FAVLLLLVAPA | 2.26 | FMILLLLVAPA | 2.26 | FIVLLLLVAPA | 1.69 |
| prM | 279 | 0.85 | 6 | 5 | 0 | Y | VVLLLLVAPAY | 85.88 | AILLLLVAPAY | 7.34 | AVLLLLVAPAY | 2.26 | MILLLLVAPAY | 2.26 | IVLLLLVAPAY | 1.69 |
| prM | 280 | 0.46 | 6 | 2 | 0 | Y | VLLLLVAPAYS | 90.4 | ILLLLVAPAYS | 9.6 | | | | |
| prM | 281 | 0 | 2 | 1 | 0 | Y | LLLLVAPAYSF | 100 | | | | | | |
| prM | 282 | 0 | 1 | 1 | 0 | Y | LLLVAPAYSFN | 100 | | | | | | |
| prM | 283 | 0 | 1 | 1 | 0 | Y | LLVAPAYSFNC | 100 | | | | | | |
| prM | 284 | 0.05 | 2 | 2 | 0 | Y | LVAPAYSFNCL | 99.44 | | | | | | |
| prM | 285 | 0.05 | 2 | 2 | 0 | Y | VAPAYSFNCLG | 99.44 | | | | | | |
| prM | 286 | 0.05 | 2 | 2 | 0 | Y | APAYSFNCLGM | 99.44 | | | | | | |
| prM | 287 | 0.05 | 2 | 2 | 0 | Y | PAYSFNCLGMS | 99.44 | | | | | | |
| prM | 288 | 0.14 | 3 | 2 | 0 | Y | AYSFNCLGMSN | 98.31 | AYSFNCLGMSS | 1.13 | | | | |
| prM | 289 | 0.14 | 3 | 2 | 0 | Y | YSFNCLGMSNR | 98.31 | YSFNCLGMSSR | 1.13 | | | | |
| prM | 290 | 0.14 | 3 | 2 | 0 | Y | SFNCLGMSNRD | 98.31 | SFNCLGMSSRD | 1.13 | | | | |
| E | 291 | 0.14 | 3 | 2 | 0 | Y | FNCLGMSNRDF | 98.31 | FNCLGMSSRDF | 1.13 | | | | |
| E | 292 | 0.29 | 4 | 3 | 0 | Y | NCLGMSNRDFL | 96.05 | NCLGMSNRDFI | 2.26 | NCLGMSSRDFL | 1.13 | | |

FIG. 26-10

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

FIG. 26-11

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 318 | 0.27 | 5 | 4 | 0 | Y | DSCVTIMSKDK | 96.61 | DSCVTIMAKDR | 1.69 | DSCVTIMSKNK | 0.56 | DSCVTITAKDR | 0.56 | | |
| E | 319 | 0.27 | 5 | 4 | 0 | Y | SCVTIMSKDKP | 96.61 | SCVTIMAKDRP | 1.69 | SCVTITAKDRP | 0.56 | SCVTIMSKNKP | 0.56 | | |
| E | 320 | 0.27 | 5 | 4 | 0 | Y | CVTIMSKDKPT | 96.61 | CVTIMAKDRPT | 1.69 | CVTLMSKDKPT | 0.56 | CVTIMSKNKPT | 0.56 | | |
| E | 321 | 0.27 | 5 | 4 | 0 | Y | VTIMSKDKPTI | 96.61 | VTIMAKDRPTI | 1.69 | VTITAKDRPTI | 0.56 | VTIMSKNKPTI | 0.56 | | |
| E | 322 | 0.27 | 5 | 4 | 0 | Y | TIMSKDKPTID | 96.61 | TIMAKDRPTID | 1.69 | TLMSKDKPTID | 0.56 | TIMSKNKPTID | 0.56 | | |
| E | 323 | 0.27 | 5 | 4 | 0 | Y | IMSKDKPTIDV | 96.61 | IMAKDRPTIDV | 1.69 | LMSKDKPTIDV | 0.56 | IMSKNKPTIDV | 0.56 | | |
| E | 324 | 0.22 | 4 | 3 | 0 | Y | MSKDKPTIDVK | 97.18 | MAKDRPTIDVK | 1.69 | TAKDRPTIDVK | 0.56 | | | | |
| E | 325 | 0.21 | 3 | 2 | 0 | Y | SKDKPTIDVKM | 97.18 | AKDRPTIDVKM | 1.69 | | | | | | |
| E | 326 | 0.26 | 4 | 3 | 0 | Y | KDKPTIDVKMM | 96.61 | KDRPTIDVKMV | 2.26 | KNKPTIDVKMM | 0.56 | NKPTIDVKMMN | 0.56 | | |
| E | 327 | 0.31 | 5 | 4 | 0 | Y | DKPTIDVKMMN | 96.05 | DRPTIDVKMVT | 2.26 | DKPTIDVKMTN | 0.56 | KPTIDVKMTNM | 0.56 | | |
| E | 328 | 0.31 | 5 | 4 | 0 | Y | KPTIDVKMMNM | 96.05 | RPTIDVKMVTM | 2.26 | KPTIDVKMKM | 0.56 | PTIDVKMMKME | 0.56 | | |
| E | 329 | 0.31 | 5 | 4 | 0 | Y | PTIDVKMMNME | 96.05 | PTIDVKMVTMG | 2.26 | PTIDVKMMNVE | 0.56 | TIDVKMMNVEA | 0.56 | | |
| E | 330 | 0.31 | 5 | 4 | 0 | Y | TIDVKMMNMEA | 96.05 | TIDVKMVTMGA | 2.26 | TIDVKMMNVEA | 0.56 | VSELSTRAACP | 1.69 | VSELSTRAACP | 0.56 |
| E | 355 | 0.69 | 6 | 5 | 0 | Y | VSDLSTKAACP | 89.27 | VSDLSTRAACP | 5.65 | ATEISSSAACP | 2.26 | VSELSTKAACP | 1.69 | | |
| E | 358 | 0.59 | 5 | 4 | 0 | Y | LSTKAACPTMG | 90.4 | LSTRAACPTMG | 6.21 | ISSSAACPTMG | 2.26 | LSPRAACPTMG | 0.56 | SPRAACPTMGE | 0.56 |
| E | 359 | 0.64 | 6 | 5 | 0 | Y | STKAACPTMGE | 89.83 | STRAACPTMGE | 6.21 | SSSAACPTMGE | 2.26 | STKAACPTMGD | 0.56 | TKAACPTMGDA | 0.56 |
| E | 360 | 0.64 | 6 | 5 | 0 | Y | TKAACPTMGEA | 89.83 | TRAACPTMGEA | 6.21 | SSAACPTMGEA | 2.26 | PRAACPTMGEA | 0.56 | | |
| E | 361 | 0.61 | 5 | 4 | 0 | Y | KAACPTMGEAH | 89.83 | RAACPTMGEAH | 6.78 | SAACPTMGEAH | 2.26 | KAACPAMGEAH | 0.56 | | |
| E | 362 | 0.1 | 3 | 2 | 0 | Y | AACPTMGEAHN | 98.87 | AACPTMGDAHN | 0.56 | ACPAMGEAHND | 0.56 | | | | |
| E | 363 | 0.59 | 4 | 3 | 0 | Y | ACPTMGEAHND | 88.14 | ACPTMGEAHNE | 10.73 | ACPAMGEAHND | 0.56 | | | | |
| E | 364 | 0.59 | 4 | 3 | 0 | Y | CPTMGEAHNDK | 88.14 | CPTMGEAHNEK | 10.73 | CPTMGDAHNDK | 0.56 | | | | |
| E | 365 | 0.59 | 4 | 3 | 0 | Y | PTMGEAHNDKR | 88.14 | PTMGEAHNEKR | 10.73 | PTMGDAHNDKR | 0.56 | | | | |
| E | 366 | 0.67 | 5 | 4 | 0 | Y | TMGEAHNDKRA | 88.14 | TMGEAHNEKRT | 8.47 | TMGEAHNEKRA | 0.56 | TMGDAHNDKRA | 0.56 | | |
| E | 367 | 0.62 | 4 | 3 | 0 | Y | MGEAHNDKRAD | 88.7 | MGEAHNEKRTD | 8.47 | MGEAHNEKRTD | 1.69 | | | | |
| E | 368 | 0.77 | 6 | 5 | 0 | Y | GEAHNDKRADP | 87.01 | GEAHNEKRADP | 7.91 | GEAHNEKRTDS | 2.26 | GEAHNDKRADS | 1.69 | GDAHNDKRADP | 0.56 |

FIG. 26-12

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 380 | 1.11 | 5 | 4 | 0 | Y | FVCRQGVDRG | 75.14 | FVCKQGVDRG | 15.25 | YVCRQGVDRG | 8.47 | YFCKQGVDRG | 0.56 |
| E | 381 | 0.68 | 3 | 2 | 0.56 | Y | VCRQGVDRGW | 83.05 | VCKQGVDRGW | 15.82 | | | | |
| E | 382 | 0.65 | 2 | 2 | 0.56 | Y | CRQGVDRGWG | 83.05 | CKQGVDRGWG | 16.38 | | | | |
| E | 383 | 0.65 | 2 | 2 | 0.56 | Y | RQGVDRGWGN | 83.05 | KQGVDRGWGN | 16.38 | | | | |
| E | 384 | 0 | 1 | 1 | 0.56 | Y | QGVDRGWGNG | 99.44 | | | | | | |
| E | 385 | 0 | 1 | 1 | 0.56 | Y | GVDRGWGNGC | 99.44 | | | | | | |
| E | 386 | 0 | 1 | 1 | 0.56 | Y | VDRGWGNGCG | 99.44 | | | | | | |
| E | 387 | 0 | 1 | 1 | 0.56 | Y | DRGWGNGCGL | 99.44 | | | | | | |
| E | 388 | 0 | 1 | 1 | 0.56 | Y | RGWGNGCGLF | 99.44 | | | | | | |
| E | 389 | 0 | 1 | 1 | 0.56 | Y | GWGNGCGLFG | 99.44 | | | | | | |
| E | 390 | 0 | 1 | 1 | 0.56 | Y | WGNGCGLFGK | 99.44 | | | | | | |
| E | 391 | 0 | 1 | 1 | 0 | Y | GNGCGLFGKG | 100 | | | | | | |
| E | 392 | 0 | 1 | 1 | 0 | Y | NGCGLFGKGS | 100 | | | | | | |
| E | 393 | 0 | 1 | 1 | 0 | Y | GCGLFGKGSI | 100 | | | | | | |
| E | 394 | 0 | 1 | 1 | 0 | Y | CGLFGKGSID | 100 | | | | | | |
| E | 395 | 0 | 1 | 1 | 0 | Y | GLFGKGSIDT | 100 | | | | | | |
| E | 396 | 0 | 1 | 1 | 0 | Y | LFGKGSIDTC | 100 | | | | | | |
| E | 397 | 0 | 1 | 1 | 0 | Y | FGKGSIDTCA | 100 | | | | | | |
| E | 398 | 0.05 | 2 | 2 | 0 | Y | GKGSIDTCAK | 99.44 | KGSIDTCAKF | 2.26 | | | | |
| E | 399 | 0.05 | 2 | 2 | 0 | Y | GIGSIDTCAKF | 99.44 | GSIDTCAKFC | 2.26 | | | | |
| E | 400 | 0.21 | 3 | 3 | 0 | Y | KGSIDTCAKFA | 97.18 | SIDTCAKFACT | 8.47 | SIDTCAKFTCS | 2.26 | | |
| E | 401 | 0.21 | 3 | 3 | 0 | Y | GSIDTCAKFAC | 97.18 | IDTCAKFACTT | 7.91 | IDTCAKFTCSN | 2.26 | | |
| E | 402 | 0.62 | 4 | 4 | 0 | Y | SIDTCAKFACS | 88.7 | DTCAKFACTTK | 7.91 | DTCAKFTCSNK | 2.26 | | |
| E | 403 | 0.65 | 5 | 4 | 0 | Y | IDTCAKFACST | 88.7 | | | IDTCAKFACTS | | | |
| E | 404 | 0.65 | 5 | 4 | 0 | Y | DTCAKFACSTK | 88.7 | | | DTCAKFACTSK | | | |

FIG. 26-13

Species: WNV (11-mers)

| protein | block starting position | block entropy | total peptides in block | # peptides required to cover 99% of block | 99% of block covered w/ <= 5 peptides? | peptides required to cover 99% of block | frequency | peptides required to cover

FIG. 26-14

Species: WNV (11-mers)

| protein | block starting position | block entropy | total peptides in block | # peptides required to cover 99% of block | gap/X fraction | 99% of block covered w/ <= 5 peptides? | peptides required to cover 99% of block

FIG. 26-15

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 485 | 0.75 | 6 | 5 | 0 | Y | GIDTNAYYVMT | 87.57 | GIDTS

Species: WNV (11-mers)

| protein | block starting position | block entropy | total peptides in block | # peptides required to cover 99% of block | gap/k fraction | 99% of block covered w/ <= 5 peptides? | peptides required to cover 99% of block | frequency | peptides required to cover 99% of

FIG. 26-18

Species: WNV (11-mers)

| protein | block starting position | block entropy | total peptides in block | # peptides required to cover 99% of block | gap/X fraction | 99% of block covered w/ <= 5 peptides? | peptides required to cover 99% of block

FIG. 26-19

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 618 | 0.35 | 3 | 3 | 0 | Y | QYTGTDGPCKV | 94.35 | QYTGTDGPCKI | 4.52 | QYTGKDGPCKV | 1.13 | | |
| E | 619 | 0.35 | 3 | 3 | 0 | Y | YTGTDGPCKVP | 94.35 | YTGTDGPCKIP | 4.52 | YTGKDGPCKVP | 1.13 | | |
| E | 620 | 0.4 | 3 | 3 | 0 | Y | TGTDGPCKVPI | 93.79 | TGTDGPCKIPI | 4.52 | TGKDGPCKVPI | 1.13 | | |
| E | 621 | 0.45 | 4 | 4 | 0 | Y | GTDGPCKVPIS | 93.79 | GTDGPCKIPIS | 2.26 | GTDGPCKIPIT | 2.26 | GKDGPCKVPIS | 1.13 |
| E | 622 | 0.45 | 5 | 4 | 0 | Y | TDGPCKVPISS | 93.79 | TDGPCKIPISS | 2.26 | TDGPCKIPITS | 2.26 | KDGPCKVPISS | 1.13 |
| E | 623 | 0.36 | 5 | 3 | 0 | Y | DGPCKVPISSV | 94.92 | DGPCKIPITSV | 2.26 | DGPCKIPISSV | 2.26 | | |
| E | 624 | 0.36 | 4 | 3 | 0 | Y | GPCKVPISSVA | 94.92 | GPCKIPITSVA | 2.26 | GPCKIPISSVA | 2.26 | | |
| E | 625 | 0.36 | 4 | 3 | 0 | Y | PCKVPISSVAS | 94.92 | PCKIPITSVAS | 2.26 | PCKIPISSVAS | 2.26 | | |
| E | 626 | 0.36 | 4 | 3 | 0 | Y | CKVPISSVASL | 94.92 | CKIPITSVASL | 2.26 | CKIPISSVASL | 2.26 | | |
| E | 627 | 0.36 | 4 | 3 | 0 | Y | KVPISSVASLN | 94.92 | KIPITSVASLN | 2.26 | KIPISSVASLN | 2.26 | | |
| E | 628 | 0.36 | 4 | 3 | 0 | Y | VPISSVASLND | 94.92 | IPITSVASLND | 2.26 | IPISSVASLND | 2.26 | | |
| E | 629 | 0.21 | 3 | 2 | 0 | Y | PISSVASLNDL | 97.18 | PITSVASLNDL | 2.26 | | | | |
| E | 630 | 0.21 | 3 | 2 | 0 | Y | ISSVASLNDLT | 97.18 | ITSVASLNDLT | 2.26 | | | | |
| E | 631 | 0.16 | 2 | 2 | 0 | Y | SSVASLNDLTP | 97.74 | TSVASLNDLTP | 2.26 | | | | |
| E | 632 | 0 | 1 | 1 | 0 | Y | SVASLNDLTPV | 100 | | | | | | |
| E | 633 | 0 | 1 | 1 | 0 | Y | VASLNDLTPVG | 100 | | | | | | |
| E | 634 | 0 | 1 | 1 | 0 | Y | ASLNDLTPVGR | 100 | | | | | | |
| E | 635 | 0 | 1 | 1 | 0 | Y | SLNDLTPVGRL | 100 | | | | | | |
| E | 636 | 0 | 1 | 1 | 0 | Y | LNDLTPVGRLV | 100 | | | | | | |
| E | 637 | 0 | 1 | 1 | 0 | Y | NDLTPVGRLVT | 100 | | | | | | |
| E | 638 | 0 | 1 | 1 | 0 | Y | DLTPVGRLVTV | 100 | | | | | | |
| E | 639 | 0 | 1 | 1 | 0 | Y | LTPVGRLVTVN | 100 | | | | | | |
| E | 640 | 0 | 1 | 1 | 0 | Y | TPVGRLVTVNP | 100 | | | | | | |
| E | 641 | 0.16 | 2 | 2 | 0 | Y | PVGRLVTVNPF | 97.74 | PVGRLVTVNPY | 2.26 | | | | |
| E | 642 | 0.16 | 2 | 2 | 0 | Y | VGRLVTVNPFV | 97.74 | VGRLVTVNPY | 2.26 | | | | |

FIG. 26-20

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 643 | 0.21 | 3 | 2 | 0 | Y | GRLVTNPFYS | 97.18 | GRLVTNPYVS | 2.26 | | | | |
| E | 644 | 0.26 | 4 | 3 | 0 | Y | RLVTNPYVSV | 96.61 | RLVTNPYVSV | 2.26 | RLVTNPFVAA | 0.56 | | |
| E | 645 | 0.38 | 5 | 4 | 0 | Y | LVTNPFVSVA | 94.92 | LVTNPYYSVA | 2.26 | LVTNPFVSVS | 1.69 | LVTNPFVAAA | 0.56 |
| E | 646 | 0.43 | 6 | 5 | 0 | Y | VTNPFVSVAT | 94.35 | VTNPYVSVAT | 2.26 | VTNPFVSVST | 1.69 | VTNPFVSMAT | 0.56 |
| E | 647 | 0.43 | 6 | 5 | 0 | Y | TNPFVSVATA | 94.35 | TNPYVSVATA | 2.26 | TNPFVSVSTA | 1.69 | TNPFVSMATA | 0.56 |
| E | 656 | 0.72 | 6 | 5 | 0 | Y | TANAKVLIELE | 87.57 | TANS

FIG. 26-21

Species: WNV (11-mers)

| prot

FIG. 26-22

Species: WNV (11-mers)

| protein | block starting position | block

FIG. 26-23

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 726 | 0.73 | 5 | 4 | 0 | Y | TSVGKAVHQVF | 86.44 | TSVGKAIHQVF | 10.17 | NSIGKAVHQLF | 2.26 | TSVGQAIHQVF | 0.56 |
| E | 727 | 0.73 | 5 | 4 | 0 | Y | SVGKAVHQVFG | 86.44 | SVGKAIHQVFG | 10.17 | SIGKAVHQLFG | 2.26 | SFGKAVHQVFG | 0.56 |
| E | 728 | 0.73 | 5 | 4 | 0 | Y | VGKAVHQVFGG | 86.44 | VGKAIHQVFGG | 10.17 | IGKAVHQLFGG | 2.26 | VGQAIHQVFGG | 0.56 |
| E | 729 | 0.68 | 4 | 3 | 0 | Y | GKAVHQVFGGA | 87.01 | GKAIHQVFGGA | 10.17 | GKAVHQLFGGA | 2.26 | | |
| E | 730 | 0.68 | 4 | 3 | 0 | Y | KAVHQVFGGAF | 87.01 | KAIHQVFGGAF | 10.17 | KAVHQLFGGAF | 2.26 | | |
| E | 731 | 0.64 | 3 | 3 | 0 | Y | AVHQVFGGAFR | 87.01 | AIHQVFGGAFR | 10.73 | AVHQLFGGAFR | 2.26 | | |
| E | 732 | 0.76 | 4 | 4 | 0 | Y | VHQVFGGAFRS | 85.31 | IHQVFGGAFRS | 10.73 | VHQLFGGAFRS | 2.26 | VHQVFGGAFRL | 1.69 |
| E | 733 | 0.28 | 3 | 3 | 0 | Y | HQVFGGAFRSL | 96.05 | HQLFGGAFRSL | 2.26 | HQVFGGAFRLL | 1.69 | | |
| E | 734 | 0.28 | 3 | 3 | 0 | Y | QVFGGAFRSLF | 96.05 | QLFGGAFRSLF | 2.26 | QVFGGAFRLLF | 1.69 | | |
| E | 735 | 0.28 | 3 | 3 | 0 | Y | VFGGAFRSLFG | 96.05 | LFGGAFRSLFG | 2.26 | VFGGAFRLLFG | 1.69 | | |
| E | 736 | 0.12 | 2 | 2 | 0 | Y | FGGAFRSLFGG | 98.31 | FGGAFRLLFGG | 1.69 | | | | |
| E | 737 | 0.12 | 2 | 2 | 0 | Y | GGAFRSLFGGM | 98.31 | GGAFRLLFGGM | 1.69 | | | | |
| E | 738 | 0.12 | 2 | 2 | 0 | Y | GAFRSLFGGMS | 98.31 | GAFRLLFGGMS | 1.69 | | | | |
| E | 739 | 0.12 | 2 | 2 | 0 | Y | AFRSLFGGMSW | 98.31 | AFRLLFGGMSW | 1.69 | | | | |
| E | 740 | 0.12 | 2 | 2 | 0 | Y | FRSLFGGMSWI | 98.31 | FRLLFGGMSWI | 1.69 | | | | |
| E | 741 | 0.12 | 2 | 2 | 0 | Y | RSLFGGMSWIT | 98.31 | RLLFGGMSWIT | 1.69 | | | | |
| E | 742 | 0.12 | 2 | 2 | 0 | Y | SLFGGMSWITQ | 98.31 | LLFGGMSWITQ | 1.69 | | | | |
| E | 743 | 0 | 1 | 1 | 0 | Y | LFGGMSWITQG | 100 | | | | | | |
| E | 744 | 0 | 1 | 1 | 0 | Y | FGGMSWITQGL | 100 | | | | | | |
| E | 745 | 0.05 | 2 | 2 | 0 | Y | GGMSWITQGLL | 99.44 | | | | | | |
| E | 746 | 0.05 | 2 | 2 | 0 | Y | GMSWITQGLLG | 99.44 | | | | | | |
| E | 747 | 0.05 | 2 | 2 | 0 | Y | MSWITQGLLGA | 99.44 | | | | | | |
| E | 748 | 0.05 | 2 | 2 | 0 | Y | SWITQGLLGAL | 99.44 | | | | | | |
| E | 749 | 0.05 | 2 | 2 | 0 | Y | WITQGLLGALL | 99.44 | | | | | | |
| E | 750 | 0.05 | 2 | 2 | 0 | Y | ITQGLLGALLL | 99.44 | | | | | | |

FIG. 26-24

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

FIG. 26-25

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 779 | 0.2 | 5 | 4 | 0 | Y | GGVLLFLSVNV | 97.74 | GGVLLFLSVSY

FIG. 26-26

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | fr

FIG. 26-27

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 853 | 1.13 | 6 | 5 | 0.56 | Y | RLEHQMWEAVK | 77.97 | RLEHQM

FIG. 26-28

Species: WNV (11

FIG. 26-29

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 945 | 0.05 | 2 | 1 | 0 | Y | EVEDFGFGLTS | 99.44 | | | | | | |
| NS1 | 946 | 0.05 | 2 | 1 | 0 | Y | VEDFGFGLTST | 99.44 | | | | | | |
| NS1 | 947 | 0.05 | 2 | 1 | 0 | Y | EDFGFGLTSTR | 99.44 | | | | | | |
| NS1 | 948 | 0.1 | 3 | 2 | 0 | Y | DFGFGLTSTRM | 98.87 | DFGFGLTSTRI | 0.56 | | | | |
| NS1 | 949 | 0.1 | 3 | 2 | 0 | Y | FGFGLTSTRMF | 98.87 | FGFGLTSTRIF | 0.56 | | | | |
| NS1 | 950 | 0.19 | 4 | 3 | 0 | Y | GFGLTSTRMFL | 97.74 | GFGLTSTRMFM | 1.13 | GFGLTSTRIFL | 0.56 | | |
| NS1 | 951 | 0.69 | 5 | 4 | 0 | Y | FGLTSTRMFLK | 86.44 | FGLTSTRMFLR | 11.3 | FGLTSTRMFMK | 1.13 | FGLTSTRIFLK | 0.56 |
| NS1 | 966 | 0.29 | 4 | 3 | 0 | Y | NTTECDSKIIG | 96.05 | NTTECDTKIIG | 2.26 | NTTECDSKTIG | 1.13 | | |
| NS1 | 967 | 0.29 | 4 | 3 | 0 | Y | TTECDSKIIGT | 96.05 | TTECDTKIIGT | 2.26 | TTECDSKITGT | 1.13 | | |
| NS1 | 968 | 0.29 | 4 | 3 | 0 | Y | TECDSKIIGTA | 96.05 | TECDTKIIGTA | 2.26 | TECDSKITIGTA | 1.13 | | |
| NS1 | 969 | 0.34 | 5 | 4 | 0 | Y | ECDSKIIGTAV | 95.48 | ECDTKIIGTAV | 2.26 | ECDSKITIGTAV | 1.13 | ECDSKIIGTAI | 0.56 |
| NS1 | 970 | 0.34 | 5 | 4 | 0 | Y | CDSKIIGTAVK | 95.48 | CDTKIIGTAVK | 2.26 | CDSKITIGTAVK | 1.13 | CDAKIIGTAVK | 0.56 |
| NS1 | 971 | 0.34 | 5 | 4 | 0 | Y | DSKIIGTAVKN | 95.48 | DTKIIGTAVKN | 2.26 | DSKITIGTAVKN | 1.13 | DAKIIGTAVKN | 0.56 |
| NS1 | 972 | 0.34 | 5 | 4 | 0 | Y | SKIIGTAVKNN | 95.48 | TKIIGTAVKNN | 2.26 | SKITIGTAVKNN | 1.13 | SKIIGTAIKNN | 0.56 |
| NS1 | 973 | 0.61 | 4 | 3 | 0 | Y | KIIGTAVKNNL | 88.14 | KIIGTAVKNNM | 10.17 | KTIGTAVKNNL | 1.13 | | |
| NS1 | 974 | 0.61 | 4 | 3 | 0 | Y | IIGTAVKNNLA | 88.14 | IIGTAVKNNMA | 10.17 | TIGTAVKNNLA | 1.13 | | |
| NS1 | 975 | 0.57 | 4 | 3 | 0 | Y | IGTAVKNNLAI | 88.7 | IGTAVKNNMAV | 10.17 | IGTAIKNNLAI | 0.56 | | |
| NS1 | 976 | 0.57 | 4 | 3 | 0 | Y | GTAVKNNLAIH | 88.7 | GTAVKNNMAVH | 10.17 | GTAIKNNLAIH | 0.56 | | |
| NS1 | 977 | 0.57 | 4 | 3 | 0 | Y | TAVKNNLAIHS | 88.7 | TAVKNNMAVHS | 10.17 | TAIKNNLAIHS | 0.56 | | |
| NS1 | 978 | 0.57 | 4 | 3 | 0 | Y | AVKNNLAIHSD | 88.7 | AVKNNMAVHSD | 10.17 | AVKNNLAVHSD | 0.56 | | |
| NS1 | 979 | 0.57 | 3 | 2 | 0 | Y | VKNNLAIHSDL | 88.7 | VKNNMAVHSDL | 10.17 | IKNNLAIHSDL | 0.56 | | |
| NS1 | 980 | 0.52 | 3 | 2 | 0 | Y | KNNLAIHSDLS | 89.27 | KNNMAVHSDLS | 10.17 | | | | |
| NS1 | 981 | 0.52 | 3 | 2 | 0 | Y | NNLAIHSDLSY | 89.27 | NNMAVHSDLSY | 10.17 | | | | |
| NS1 | 982 | 0.52 | 3 | 2 | 0 | Y | NLAIHSDLSYW | 89.27 | NMAVHSDLSYW | 10.17 | | | | |
| NS1 | 983 | 0.52 | 3 | 2 | 0 | Y | LAIHSDLSYWI | 89.27 | MAVHSDLSYWI | 10.17 | | | | |

FIG. 26-30

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 984 | 0.49 | 2 | 2 | 0 | Y | AIHSDLSYWIE | 89.27 | AVHSDLSYWIE | 10.73 | | | | |
| NS1 | 985 | 0.49 | 2 | 2 | 0 | Y | IHSDLSYWIES | 89.27 | VHSDLSYWIES | 10.73 | | | | |
| NS1 | 986 | 0.51 | 2 | 2 | 0 | Y | HSDLSYWIESR | 88.7 | HSDLSYWIESG | 11.3 | | | | |
| NS1 | 987 | 0.8 | 4 | 4 | 0 | Y | SDLSYWIESRL | 84.75 | SDLSYWIESGL | 10.17 | SDLSYWIESRF | 3.95 | SDLSYWIESGF | 1.13 |
| NS1 | 988 | 0.83 | 5 | 4 | 0 | Y | DLSYWIESRLN | 84.75 | DLSYWIESGLN | 9.6 | DLSYWIESRFN | 3.95 | DLSYWIESGFN | 1.13 |
| NS1 | 997 | 0.62 | 6 | 5 | 0 | Y | LNDTWKLERAV | 90.96 | FNDTWKLERAV | 3.95 | LNETWKLERAV | 3.95 | FNETWKLERAV | 1.13 |
| NS1 | 998 | 0.35 | 4 | 3 | 0 | Y | NDTWKLERAVL | 94.92 | NETWKLERAVL | 3.39 | NHTWKLERAVL | 1.13 | LNHTWKLERAV | 1.13 |
| NS1 | 999 | 0.33 | 3 | 3 | 0 | Y | DTWKLERAVLG | 94.92 | ETWKLERAVLG | 3.95 | HTWKLERAVLG | 1.13 | | |
| NS1 | 1000 | 0 | 1 | 1 | 0 | Y | TWKLERAVLGE | 100 | | | | | | |
| NS1 | 1001 | 0 | 1 | 1 | 0 | Y | WKLERAVLGEV | 100 | | | | | | |
| NS1 | 1002 | 0 | 1 | 1 | 0 | Y | KLERAVLGEVK | 100 | | | | | | |
| NS1 | 1003 | 0 | 1 | 1 | 0 | Y | LERAVLGEVKS | 100 | | | | | | |
| NS1 | 1004 | 0 | 1 | 1 | 0 | Y | ERAVLGEVKSC | 100 | | | | | | |
| NS1 | 1005 | 0 | 1 | 1 | 0 | Y | RAVLGEVKSCT | 100 | | | | | | |
| NS1 | 1006 | 0 | 1 | 1 | 0 | Y | AVLGEVKSCTW | 100 | | | | | | |
| NS1 | 1007 | 0 | 1 | 1 | 0 | Y | VLGEVKSCTWP | 100 | | | | | | |
| NS1 | 1008 | 0 | 1 | 1 | 0 | Y | LGEVKSCTWPE | 100 | | | | | | |
| NS1 | 1009 | 0 | 1 | 1 | 0 | Y | GEVKSCTWPET | 100 | | | | | | |
| NS1 | 1010 | 0 | 1 | 1 | 0 | Y | EVKSCTWPETH | 100 | | | | | | |
| NS1 | 1011 | 0 | 1 | 1 | 0 | Y | VKSCTWPETHT | 100 | | | | | | |
| NS1 | 1012 | 0 | 1 | 1 | 0 | Y | KSCTWPETHTL | 100 | | | | | | |
| NS1 | 1013 | 0 | 1 | 1 | 0 | Y | SCTWPETHTLW | 100 | | | | | | |
| NS1 | 1014 | 0 | 1 | 1 | 0.56 | Y | CTWPETHTLWG | 99.44 | | | | | | |
| NS1 | 1015 | 0.29 | 2 | 2 | 0.56 | Y | TWPETHTLWGD | 94.35 | TWPETHTLWGE | 5.08 | | | | |
| NS1 | 1016 | 0.29 | 2 | 2 | 0.56 | Y | WPETHTLWGDG | 94.35 | WPETHTLWGEG | 5.08 | | | | |

FIG. 26-31

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1017 | 0.83 | 4 | 4 | 0.56 | Y | PETHTLWGDGI | 83.62 | PETHTLWGDGV | 10.73 | PETHTLWGEGI | 2.82 | PETHTLWGEGV | 2.26 | ETHTLWGDGVI | 0.56 |
| NS1 | 1018 | 0.89 | 6 | 5 | 0.56 | Y | ETHTLWGDGIL | 83.62 | ETHTLWGDGVL | 9.6 | ETHTLWGEGIL | 2.82 | ETHTLWGEGVQ | 2.26 | THTLWGDGVIE | 0.56 |
| NS1 | 1019 | 0.89 | 6 | 5 | 0.56 | Y | THTLWGDGILE | 83.62 | THTLWGDGVLE | 9.6 | THTLWGEGILE | 2.82 | THTLWGEGVQE | 2.26 | HTLWGDGVIES | 0.56 |
| NS1 | 1020 | 0.89 | 6 | 4 | 0.56 | Y | HTLWGDGILES | 83.62 | HTLWGDGVLES | 9.6 | HTLWGEGILES | 2.82 | HTLWGEGVQES | 2.26 | | |
| NS1 | 1029 | 0.59 | 5 | 5 | 0 | Y | ESDLIIPITLA | 89.27 | ESDLIIPITLA | 9.04 | ESELIIPITLA | 0.56 | ESDLIIPATLA | 0.56 | | |
| NS1 | 1030 | 0.59 | 5 | 5 | 0 | Y | SDLIIPVTLAG | 89.27 | SDLIIPITLAG | 9.04 | SELIIPVTLAG | 0.56 | SDLIIPATLAG | 0.56 | | |
| NS1 | 1031 | 0.64 | 6 | 4 | 0 | Y | DLIIPITLAGP | 89.27 | DLIIPITLAGP | 7.91 | DLIIPITLAGL | 1.13 | ELIIPITLAGP | 0.56 | DLIIPATLAGP | 0.56 |
| NS1 | 1032 | 0.61 | 5 | 4 | 0 | Y | LIIPVTLAGPR | 89.27 | LIIPITLAGPR | 8.47 | LIIPITLAGLR | 1.13 | LIIPVTLAGPK | 0.56 | | |
| NS1 | 1033 | 0.61 | 5 | 4 | 0 | Y | IIPYTLAGPRS | 89.27 | IIPITLAGPRS | 8.47 | IIPITLAGLRS | 1.13 | IIPATLAGPRS | 0.56 | | |
| NS1 | 1034 | 0.61 | 5 | 5 | 0 | Y | IPVTLAGPRSN | 89.27 | IPITLAGPRSN | 8.47 | IPITLAGLRSN | 1.13 | IPATLAGPKSN | 0.56 | | |
| NS1 | 1035 | 0.65 | 6 | 5 | 0 | Y | PVTLAGPRSNH | 88.7 | PITLAGPRSNH | 8.47 | PITLAGLRSNH | 1.13 | PVTLAGPRSNY | 0.56 | PATLAGPRSNH | 0.56 |
| NS1 | 1036 | 0.65 | 6 | 5 | 0 | Y | VTLAGPRSNHN | 88.7 | ITLAGLRSNHN | 8.47 | ITLAGLRSNHH | 1.13 | ATLAGPRSNHN | 0.56 | VTLAGPRSNYN | 0.56 |
| NS1 | 1037 | 0.19 | 4 | 3 | 0 | Y | TLAGPRSNHNR | 97.74 | TLAGPRSNYNR | 1.13 | TLAGLRSNHNR | 0.56 | | | | |
| NS1 | 1038 | 0.19 | 4 | 3 | 0 | Y | LAGPRSNHNRR | 97.74 | LAGPRSNYNHR | 1.13 | LAGLRSNHNKR | 0.56 | | | | |
| NS1 | 1039 | 0.19 | 4 | 3 | 0 | Y | AGPRSNHNRRP | 97.74 | AGPRSNYNRRP | 1.13 | AGPKSNHNKRR | 0.56 | | | | |
| NS1 | 1040 | 0.19 | 4 | 3 | 0 | Y | GPRSNHNRRPG | 97.74 | GLRSNHNRRPG | 1.13 | GPKSNHNKRRP | 0.56 | | | | |
| NS1 | 1041 | 0.19 | 4 | 3 | 0 | Y | PRSNHNRRPGY | 97.74 | LRSNHNRRPGY | 1.13 | PKSNHNKRPGY | 0.56 | | | | |
| NS1 | 1042 | 0.1 | 3 | 2 | 0 | Y | RSNHNRRPGYK | 98.87 | KSNHNKRPGYK | 0.56 | | | | | | |
| NS1 | 1043 | 0.15 | 4 | 3 | 0 | Y | SNHNRRPGYKT | 98.31 | SNHNRRPGYKM | 0.56 | SNYNRRPGYKT | 0.56 | | | | |
| NS1 | 1044 | 0.15 | 4 | 3 | 0 | Y | NHNRRPGYKTQ | 98.31 | NHNKRPGYKTQ | 0.56 | NYNRRPGYKTQ | 0.56 | | | | |
| NS1 | 1045 | 0.27 | 5 | 4 | 0 | Y | HNRRPGYKTQN | 96.61 | HNRRPGYKTQS | 1.13 | HNIKRPGYKTQN | 0.56 | HNRRPGYKMQN | 0.56 | | |
| NS1 | 1046 | 0.22 | 4 | 3 | 0 | Y | NRRPGYKTQNQ | 97.18 | NRRPGYKTQSQ | 1.69 | NRRPGYKMQNQ | 0.56 | | | | |
| NS1 | 1047 | 0.22 | 4 | 3 | 0 | Y | RRPGYKTQNQG | 97.18 | RRPGYKTQSQG | 1.69 | RRPGYKMQNQG | 0.56 | | | | |
| NS1 | 1048 | 0.17 | 3 | 2 | 0 | Y | RPGYKTQNQGP | 97.74 | RPGYKTQSQGP | 1.69 | | | | | | |
| NS1 | 1049 | 0.17 | 3 | 2 | 0 | Y | PGYKTQNQGPW | 97.74 | PGYKTQSQGPW | 1.69 | | | | | | |

FIG. 26-32

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1050 | 0.17 | 3 | 2 | 0 | Y | GYKTQNQGPWD | 97.74 | GYKTQSQGPWD | 1.69 | | | | |
| NS1 | 1051 | 0.17 | 3 | 2 | 0 | Y | YKTQNQGPWDE | 97.74 | YKTQSQGPWDE | 1.69 | | | | |
| NS1 | 1052 | 0.17 | 3 | 2 | 0 | Y | KTQNQGPWDEG | 97.74 | KTQSQGPWDEG | 1.69 | | | | |
| NS1 | 1053 | 0.17 | 3 | 2 | 0 | Y | TQNQGPWDEGR | 97.74 | TQSQGPWDEGR | 1.69 | | | | |
| NS1 | 1054 | 0.21 | 3 | 3 | 0 | Y | QNQGPWDEGRV | 97.18 | QSQGPWDEGRV | 1.69 | QNQGPWDEGRI | 1.13 | | |
| NS1 | 1055 | 0.21 | 3 | 3 | 0 | Y | NQGPWDEGRVE | 97.18 | SQGPWDEGRVE | 1.69 | NQGPWDEGRIE | 1.13 | | |
| NS1 | 1056 | 0.27 | 3 | 3 | 0 | Y | QGPWDEGRVEI | 96.05 | QGPWDEGRVEL | 2.82 | QGPWDEGRIEI | 1.13 | | |
| NS1 | 1057 | 0.27 | 3 | 3 | 0 | Y | GPWDEGRVEID | 96.05 | GPWDEGRVELD | 2.82 | GPWDEGRIEID | 1.13 | | |
| NS1 | 1058 | 0.27 | 3 | 3 | 0 | Y | PWDEGRVEIDF | 96.05 | PWDEGRVELDF | 2.82 | PWDEGRIEIDF | 1.13 | | |
| NS1 | 1059 | 0.27 | 3 | 3 | 0 | Y | WDEGRVEIDFD | 96.05 | WDEGRVELDFD | 2.82 | WDEGRIEIDFD | 1.13 | | |
| NS1 | 1060 | 0.27 | 3 | 3 | 0 | Y | DEGRVEIDFDY | 96.05 | DEGRVELDFDY | 2.82 | DEGRIEIDFDY | 1.13 | | |
| NS1 | 1061 | 0.27 | 3 | 3 | 0 | Y | EGRVEIDFDYC | 96.05 | EGRVELDFDYC | 2.82 | EGRIEIDFDYC | 1.13 | | |
| NS1 | 1062 | 0.27 | 3 | 3 | 0 | Y | GRVEIDFDYCP | 96.05 | GRVELDFDYCP | 2.82 | GRIEIDFDYCP | 1.13 | | |
| NS1 | 1063 | 0.27 | 3 | 3 | 0 | Y | RVEIDFDYCPG | 96.05 | RVELDFDYCPG | 2.82 | RIEIDFDYCPG | 1.13 | | |
| NS1 | 1064 | 0.27 | 3 | 3 | 0 | Y | VEIDFDYCPGT | 96.05 | VELDFDYCPGT | 2.82 | IEIDFDYCPGT | 1.13 | | |
| NS1 | 1065 | 0.19 | 2 | 2 | 0 | Y | EIDFDYCPGTT | 97.18 | ELDFDYCPGTT | 2.82 | | | | |
| NS1 | 1066 | 0.19 | 2 | 2 | 0 | Y | IDFDYCPGTTV | 97.18 | LDFDYCPGTTV | 2.82 | | | | |
| NS1 | 1067 | 0 | 1 | 1 | 0 | Y | DFDYCPGTTVT | 100 | | | | | | |
| NS1 | 1068 | 0.47 | 3 | 2 | 0 | Y | FDYCPGTTVTL | 90.96 | FDYCPGTTVTI | 8.47 | DYCPGTTVTVS | 0.56 | | |
| NS1 | 1069 | 0.52 | 4 | 3 | 0 | Y | DYCPGTTVTLS | 90.4 | DYCPGTTVTIS | 8.47 | DYCPGTTVTVS | 0.56 | | |
| NS1 | 1082 | 1.03 | 6 | 5 | 0 | Y | CGHRGPATRTT | 80.23 | CGHRGPAIRTT | 9.04 | CGHRGPAARTT | 1.13 | CEHRGPAARTT | 1.13 | CGHRGPSARTT | 0.56 |
| NS1 | 1083 | 1.03 | 6 | 5 | 0 | Y | GHRGPATRTTT | 80.23 | GHRGPAIRTTT | 9.04 | GHRGPAARTTT | 1.13 | EHRGPAARTTT | 1.13 | GHRGPSARTTT | 0.56 |
| NS1 | 1084 | 0.98 | 5 | 4 | 0 | Y | HRGPATRTTTE | 80.23 | HRGPAIRTTTE | 10.17 | HRGPAARTTTE | 0.56 | HRGPSARTTTE | 0.56 | |
| NS1 | 1085 | 0.98 | 5 | 4 | 0 | Y | RGPATRTTTES | 80.23 | RGPAIRTTTES | 10.17 | RGPAARTTTES | 0.56 | RGPSARTTTES | 0.56 | |
| NS1 | 1086 | 0.98 | 5 | 4 | 0.56 | Y | GPATRTTTESG | 79.66 | GPAIRTTTESG | 10.17 | GPAARTTTESG | 0.56 | GPSARTTTESG | 0.56 | |

FIG. 26-33

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1087 | 0.98 | 5 | 4 | 0.56 | Y | PATRTTESGK | 79.66 | PAARTTESGK | 10.17 | PAIRTTESGK | 8.47 | PSARTTESGK | 0.56 |
| NS1 | 1088 | 0.98 | 5 | 4 | 0.56 | Y | ATRTTESGKL | 79.66 | AARTTESGKL | 10.17 | AIRTTESGKL | 8.47 | SARTTESGKL | 0.56 |
| NS1 | 1089 | 0.95 | 4 | 3 | 0.56 | Y | TRTTESGKLI | 79.66 | ARTTESGKLI | 10.73 | IRTTTESGKLI | 8.47 | | |
| NS1 | 1090 | 0.21 | 3 | 2 | 0.56 | Y | RTTESGKLIT | 96.61 | RTTESGKLIS | 2.26 | | | | |
| NS1 | 1091 | 0.21 | 3 | 2 | 0.56 | Y | TTESGKLITD | 96.61 | TTESGKLISD | 2.26 | | | | |
| NS1 | 1092 | 0.21 | 3 | 2 | 0.56 | Y | TTESGKLITDW | 96.61 |

FIG. 26-34

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1120 | 0.67 | 5 | 4 | 0 | Y | CWYGMEIRPQR | 88.7 | CWYGMEIRPTR | 6.78 | CWYGMEIRPQK | 0.56 | | |
| NS1 | 1121 | 0.67 | 5 | 4 | 0 | Y | WYGMEIRPQRH | 88.7 | WYGMEIRPTRH | 6.78 | WYGMEIRPQKH | 0.56 | | |
| NS1 | 1122 | 0.67 | 5 | 4 | 0.56 | Y | YGMEIRPQRHD | 88.14 | YGMEIRPTRHD | 6.78 | YGMEIRPLKHD | 0.56 | | |
| NS1 | 1123 | 0.72 | 6 | 5 | 0.56 | Y | GMEIRPQRHDE | 87.57 | GMEIRPTRHDE | 6.78 | GMEIRPQRHDG | 0.56 | GMEIRPQKHDE | 0.56 |
| NS1 | 1124 | 0.72 | 6 | 5 | 0.56 | Y | MEIRPQRHDEK | 87.57 | MEIRPTRHDEK | 6.78 | MEIRPLKHDEK | 0.56 | MEIRPQRHDGK | 0.56 |
| NS1 | 1125 | 0.72 | 6 | 5 | 0.56 | Y | EIRPQRHDEKT | 87.57 | EIRPTRHDEKT | 6.78 | EIRPQKHDEKT | 0.56 | EIRPQRHDGKT | 0.56 |
| NS1 | 1126 | 0.72 | 6 | 5 | 0.56 | Y | IRPQRHDEKTL | 87.57 | IRPTRHDEKTL | 6.78 | IRPQKHDEKTL | 0.56 | IRPLKHDEKTL | 0.56 |
| NS1 | 1127 | 0.72 | 6 | 5 | 0.56 | Y | RPQRHDEKTLV | 87.57 | RPTRHDEKTLV | 6.78 | RPLKHDEKTLV | 0.56 | RPQKHDERTLV | 0.56 |
| NS1 | 1128 | 0.72 | 6 | 5 | 0.56 | Y | PQRHDEKTLVQ | 87.57 | PTRHDEKTLVQ | 6.78 | PQRHDGKTLVQ | 0.56 | PLKHDEKTLVQ | 0.56 |
| NS1 | 1129 | 0.72 | 6 | 5 | 0.56 | Y | QRHDEKTLVQS | 87.57 | TRHDEKTLVQS | 6.78 | QKHDERTLVQS | 0.56 | LKHDEKTLVQS | 0.56 |
| NS1 | 1130 | 0.7 | 6 | 5 | 0.56 | Y | RHDEKTLVQSQ | 87.57 | RHDEKTLVQSR | 7.91 | KHDERTLVQSQ | 0.56 | RHDGKTLVQSQ | 0.56 |
| NS1 | 1131 | 0.67 | 6 | 4 | 0.56 | Y | HDEKTLVQSQV | 87.57 | HDEKTLVQSRV | 8.47 | HDGKTLVQSQV | 0.56 | | |
| NS1 | 1132 | 0.7 | 6 | 5 | 0.56 | Y | DEKTLVQSQVN | 87.57 | DEKTLVQSKVT | 7.91 | DGKTLVQSQVN | 0.56 | DEKTLVQSRVS | 0.56 |
| NS1 | 1133 | 0.7 | 6 | 5 | 0 | Y | EKTLVQSQVNA | 88.14 | EKTLVQSRVNA | 7.91 | EKTLVQSKVTA | 2.26 | GKTLVQSRVNA | 0.56 |
| NS1 | 1134 | 0.68 | 6 | 4 | 0 | Y | KTLVQSQVNAY | 88.7 | KTLVQSRVNAY | 7.34 | KTLVQSKVTAY | 2.26 | KTLVQSRVSAY | 0.56 |
| NS1 | 1135 | 0.63 | 6 | 5 | 0 | Y | TLVQSQVNAYN | 89.27 | TLVQSRVNAYN | 7.34 | TLVQSKVTAYN | 2.26 | | |
| NS1 | 1136 | 0.63 | 6 | 5 | 0 | Y | LVQSQVNAYNA | 89.27 | LVQSRVNAYNA | 7.34 | LVQSKVTAYNA | 2.26 | | |
| NS1 | 1137 | 0.68 | 6 | 4 | 0 | Y | VQSQVNAYNAD | 88.7 | VQSRVNAYNAD | 7.34 | VQSKVTAYNAD | 2.26 | VQSRVSAYKSD | 0.56 |
| NS1 | 1138 | 0.68 | 6 | 4 | 0 | Y | QSQVNAYNADM | 88.7 | QSRVNAYNADM | 7.34 | QSKVTAYNADM | 2.26 | QSRVNAHNADM | 0.56 |
| NS1 | 1139 | 0.68 | 6 | 5 | 0 | Y | SQVNAYNADMI | 88.7 | SRVNAYNADMI | 7.34 | SKVTAYNADMI | 2.26 | SRYSAYKSDMI | 0.56 |
| NS1 | 1140 | 0.68 | 6 | 5 | 0 | Y | QVNAYNADMID | 88.7 | RVNAYNADMID | 7.34 | KVTAYNADMID | 2.26 | RVSAYKSDMID | 0.56 |
| NS1 | 1141 | 0.31 | 5 | 4 | 0 | Y | VNAYNADMIDP | 96.05 | VTAYNADMIDP | 2.26 | VNAHNADMIDP | 2.26 | | |
| NS1 | 1142 | 0.31 | 5 | 4 | 0 | Y | NAYNADMIDPF | 96.05 | TAYNADMIDPF | 2.26 | VNAYNAEMIDP | 0.56 | | |
| NS1 | 1143 | 0.15 | 4 | 3 | 0 | Y | AYNADMIDPFQ | 98.31 | AYNAEMIDPFQ | 0.56 | NAHNADMIDPF | 0.56 | | |
| NS2A | 1144 | 0.15 | 4 | 3 | 0 | Y | YNADMIDPFQL | 98.31 | HNADMIDPFQL | 0.56 | YKSDMIDPFQL | 0.56 | | |

FIG. 26-35

Species: WNV (11-mers)

| protein | block starting position | block entropy | total peptides in block | # peptides required to cover 99% of block | gap/X fraction | 99% of block covered w/ <= 5 peptides? | peptides required to cover 99% of block

FIG. 26-36

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1170 | 0.73 | 5 | 4 | 0 | Y | RWTAKISMPAI | 87.57 | RWTAKISIPAI | 7.34 | RWTAKISVPAI | 2.82 | RWTAKISLPAI | 1.69 |
| NS2A | 1178 | 0.68 | 6 | 5 | 0 | Y | PAILALLVLV | 88.7 | PAIMLALLVLV | 7.34 | PAIIIALLTLV | 2.26 | PAILLALLVLV | 2.26 |
| NS2A | 1179 | 0.68 | 6 | 5 | 0 | Y | AILIALLVLVF | 88.7 | AIMLALLVLVF | 7.34 | AIIIALLTLVF | 2.26 | AILVALAVLVL | 0.56 |
| NS2A | 1180 | 0.68 | 6 | 5 | 0 | Y | ILALLVLVFG | 88.7 | IMLALLVLVFG | 7.34 | IIALLTLVFG | 2.26 | ILVALAVLVLG | 0.56 |
| NS2A | 1181 | 0.68 | 6 | 5 | 0 | Y | LALLVLVFGG | 88.7 | MLALLVLVFGG | 7.34 | IALLTLVFGG | 2.26 | LVALAVLVLGG | 0.56 |
| NS2A | 1182 | 0.68 | 6 | 5 | 0 | Y | IALLVLVFGGI | 88.7 | LALLVLVFGGI | 7.34 | IALLTLVFGGV | 2.26 | IALLVLGGI | 0.56 |
| NS2A | 1183 | 0.31 | 5 | 4 | 0 | Y | ALLVLVFGGIT | 96.05 | ALLTLVFGGVT | 2.26 | ALLVLVFGGVT | 0.56 | ALLVLGGIT | 0.56 |
| NS2A | 1184 | 0.31 | 5 | 4 | 0 | Y | LLVLVFGGITY | 96.05 | LLTLVFGGVTY | 2.26 | LLVLVFGGVTY | 0.56 | LLVLVLGGITY | 0.56 |
| NS2A | 1186 | 0.39 | 6 | 5 | 0 | Y | VLVFGGITYTD | 94.92 | TLVFGGVTYTD | 2.26 | VLVFGGVTYAD | 0.56 | VLVFGGITYID | 0.56 |
| NS2A | 1187 | 0.39 | 6 | 5 | 0 | Y | LVFGGITYTDV | 94.92 | LVFGGVTYTDL | 2.26 | LVFGGVTYIDV | 0.56 | LVFGGVTYADV | 0.56 |
| NS2A | 1188 | 0.39 | 6 | 5 | 0 | Y | VFGGITYTDV | 94.92 | VFGGVTYTDLI | 2.26 | VFGGVTYIDVL | 0.56 | VFGGVTYADVL | 0.56 |
| NS2A | 1189 | 0.39 | 6 | 5 | 0 | Y | FGGITYTDVLR | 94.92 | FGGVTYTDVLR | 2.26 | FGGVTYIDVLR | 0.56 | FGGITYADVLR | 0.56 |
| NS2A | 1190 | 0.31 | 5 | 4 | 0 | Y | GGITYTDVLRY | 96.05 | GGVTYTDVLRY | 2.26 | GGITYADVLRY | 0.56 | GITYIDVLRYV | 0.56 |
| NS2A | 1191 | 0.36 | 6 | 5 | 0 | Y | GITYTDVLRYV | 95.48 | GVTYTDVLRYV | 2.26 | GITYADVLRY | 0.56 | TYTDVLRYIL | 0.56 |
| NS2A | 1193 | 0.36 | 6 | 5 | 0 | Y | TYTDVLRYIL | 95.48 | TYIDVLRYIL | 2.26 | TYADVLRYIL | 0.56 | | |
| NS2A | 1196 | 0.31 | 5 | 4 | 0 | Y | DVLRYILVGA | 96.05 | DVLRYNLVGA | 2.26 | DVLRYILAGA | 0.56 | | |
| NS2A | 1197 | 0.31 | 5 | 4 | 0.56 | Y | VLRYILVGAA | 95.48 | LIRYILVGAA | 2.26 | VLRYILAGAA | 0.56 | | |
| NS2A | 1198 | 0.31 | 5 | 4 | 0.56 | Y | LRYILVGAAF | 95.48 | IRYILVGAAF | 2.26 | LRYILAGAAF | 0.56 | | |
| NS2A | 1199 | 0.15 | 4 | 3 | 0.56 | Y | RYILVGAAFA | 97.74 | RYILAGAAFA | 2.26 | RYNLVGAAFA | 0.56 | | |
| NS2A | 1200 | 0.15 | 4 | 3 | 0.56 | Y | YILVGAAFAE | 97.74 | YVNLVGAAFAE | 0.56 | YILAGAAFMEA | 0.56 | | |
| NS2A | 1201 | 0.55 | 5 | 4 | 0.56 | Y | VILVGAAFAES | 89.83 | VILAGAAFAEA | 0.56 | VNLVGAAFAES | 0.56 | | |
| NS2A | 1202 | 0.55 | 5 | 4 | 0.56 | Y | ILVGAAFAESN | 89.83 | ILVGAAFMEAN | 0.56 | NLVGAAFAESN | 0.56 | | |
| NS2A | 1203 | 0.5 | 4 | 3 | 0.56 | Y | LVGAAFAESNS | 90.4 | LAGAAFAESNS | 0.56 | | | | |
| NS2A | 1204 | 0.5 | 4 | 3 | 0.56 | Y | VGAAFAESNSG | 90.4 | VGAAFMEANSG | 0.56 | | | | |
| NS2A | 1205 | 0.45 | 3 | 2 | 0.56 | Y | GAAFAESNSGG | 90.96 | GAAFMEANSGG | 7.91 | | | | |

FIG. 26-37

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 26-38

Species: WNV (11-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency |

FIG. 26-39

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 26-40

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1322 | 0.93 | 6 | 5 | 0 | Y | LMVGIGSLI

FIG. 26-41

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 26-42

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Species: WNV (11-mers)

| protein | block starting position | block entropy | total peptides in block | # peptides required to cover 99% of block | gap/X fraction | 99% of block covered w

FIG. 26-45

Species: WNV (11

FIG. 26-46

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1508 | 0.24 | 3 | 2 | 0 | Y | VLWDTPSPKEY | 96.61 | VLWDTPSPREY | 2.82 | | | | |
| NS3 | 1509 | 0.36 | 6 | 5 | 0 | Y | LWDTPSPKEYK | 95.48 | LWDTPSPREYK | 1.69 | LWDTPSPREYR | 0.56 | LWDTPSPKVYK | 0.56 |
| NS3 | 1517 | 0.36 | 6 | 5 | 0 | Y | EYKKGDTTTGV | 95.48 | EYKRGDTTTGV | 1.69 | EYRKGDTTTGV | 0.56 | EYRKGDTATGV | 0.56 |
| NS3 | 1518 | 0.31 | 5 | 4 | 0 | Y | YKKGDTTTGVY | 96.05 | YKRGDTTTGVY | 1.69 | VYKKGDTTTGV | 0.56 | | |
| NS3 | 1519 | 0.31 | 5 | 4 | 0 | Y | KKGDTTTGVYR | 96.05 | KRGDTTTGVYR | 1.69 | YEKGDTTTGVY | 0.56 | | |
| NS3 | 1520 | 0.17 | 3 | 2 | 0 | Y | KGDTTTGVYRI | 97.74 | RGDTTTGVYRI | 1.69 | RKGDTTATGVYR | 0.56 | | |
| NS3 | 1521 | 0.05 | 2 | 1 | 0 | Y | GDTTTGVYRIM | 99.44 | | | | | | |
| NS3 | 1522 | 0.05 | 2 | 1 | 0 | Y | DTTTGVYRIMT | 99.44 | | | | | | |
| NS3 | 1523 | 0.05 | 2 | 1 | 0 | Y | TTTGVYRIMTR | 99.44 | | | | | | |
| NS3 | 1524 | 0.05 | 2 | 1 | 0 | Y | TTGVYRIMTRG | 99.44 | | | | | | |
| NS3 | 1525 | 0.19 | 3 | 2 | 0 | Y | TGVYRIMTRGL | 97.18 | TGVYRIMTRGI | 2.82 | | | | |
| NS3 | 1526 | 0.19 | 3 | 2 | 0 | Y | GVYRIMTRGLL | 97.18 | GVYRIMTRGIL | 2.82 | | | | |
| NS3 | 1527 | 0.19 | 3 | 2 | 0 | Y | VYRIMTRGLLG | 97.18 | VYRIMTRGILG | 2.82 | | | | |
| NS3 | 1528 | 0.24 | 3 | 2 | 0 | Y | YRIMTRGLLGS | 96.61 | YRIMTRGILGS | 2.82 | | | | |
| NS3 | 1529 | 0.24 | 3 | 2 | 0 | Y | RIMTRGLLGSY | 96.61 | RIMTRGILGSY | 2.82 | | | | |
| NS3 | 1530 | 0.24 | 3 | 2 | 0 | Y | IMTRGLLGSYQ | 96.61 | IMTRGILGSYQ | 2.82 | | | | |
| NS3 | 1531 | 0.24 | 3 | 2 | 0 | Y | MTRGLLGSYQA | 96.61 | MTRGILGSYQA | 2.82 | | | | |
| NS3 | 1532 | 0.24 | 3 | 2 | 0 | Y | TRGLLGSYQAG | 96.61 | TRGILGSYQAG | 2.82 | | | | |
| NS3 | 1533 | 0.26 | 4 | 3 | 0 | Y | RGLLGSYQAGA | 96.61 | RGILGSYQAGA | 2.26 | RGLLGNYQAGV | 0.56 | | |
| NS3 | 1534 | 0.26 | 4 | 3 | 0 | Y | GLLGSYQAGAG | 96.61 | GILGSYQAGVG | 2.26 | GILGSYQAGAG | 0.56 | | |
| NS3 | 1535 | 0.26 | 4 | 3 | 0 | Y | LLGSYQAGAGV | 96.61 | ILGSYQAGVGV | 2.26 | LLGNYQAGVGV | 0.56 | | |
| NS3 | 1536 | 0.21 | 3 | 2 | 0 | Y | LGSYQAGAGVM | 97.18 | LGSYQAGVGVM | 2.26 | | | | |
| NS3 | 1537 | 0.21 | 3 | 2 | 0 | Y | GSYQAGAGVMV | 97.18 | GSYQAGVGVMV | 2.26 | | | | |
| NS3 | 1538 | 0.21 | 3 | 2 | 0 | Y | SYQAGAGVMVE | 97.18 | SYQAGVGVMVE | 2.26 | | | | |
| NS3 | 1539 | 0.19 | 2 | 2 | 0 | Y | YQAGAGVMVEG | 97.18 | YQAGVGVMVEG | 2.82 | | | | |

FIG. 26-47

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1540 | 0.19 | 2 | 2 | 0 | Y | QAGAGVMVEGV | 97.18 | QAGVGVMVEGV | 2.82 |
| NS3 | 1541 | 0.24 | 3 | 2 | 0 | Y | AGAGVMVEGVF | 96.61 | AGVGVMVEGVF | 2.82 |
| NS3 | 1542 | 0.24 | 3 | 2 | 0 | Y | GAGVMVEGVFH | 96.61 | GVGVMVEGVFH | 2.82 |
| NS3 | 1543 | 0.24 | 3 | 2 | 0 | Y | AGVMVEGVFHT | 96.61 | VGVMVEGVFHT | 2.82 |
| NS3 | 1544 | 0.05 | 2 | 1 | 0 | Y | GVMVEGVFHTL | 99.44 | | |
| NS3 | 1545 | 0.05 | 2 | 1 | 0 | Y | VMVEGVFHTLW | 99.44 | | |
| NS3 | 1546 | 0.05 | 2 | 1 | 0 | Y | MVEGVFHTLWH | 99.44 | | |
| NS3 | 1547 | 0.05 | 2 | 1 | 0 | Y | VEGVFHTLWHT | 99.44 | | |
| NS3 | 1548 | 0.05 | 2 | 1 | 0 | Y | EGVFHTLWHT | 99.44 | | |
| NS3 | 1549 | 0.05 | 2 | 1 | 0 | Y | GVFHTLWHTTK | 99.44 | | |
| NS3 | 1550 | 0.05 | 2 | 1 | 0 | Y | VFHTLWHTTKG | 99.44 | | |
| NS3 | 1551 | 0.05 | 2 | 1 | 0 | Y | FHTLWHTTKGA | 99.44 | | |
| NS3 | 1552 | 0 | 1 | 1 | 0 | Y | HTLWHTTKGAA | 100 | | |
| NS3 | 1553 | 0 | 1 | 1 | 0 | Y | TLWHTTKGAAL | 100 | | |
| NS3 | 1554 | 0 | 1 | 1 | 0 | Y | LWHTTKGAALM | 100 | | |
| NS3 | 1555 | 0 | 1 | 1 | 0 | Y | WHTTKGAALMS | 100 | | |
| NS3 | 1556 | 0 | 1 | 1 | 0 | Y | HTTKGAALMSG | 100 | | |
| NS3 | 1557 | 0.16 | 2 | 2 | 0 | Y | TTKGAALMSGE | 97.74 | TTKGAALMSGT | 2.26 |
| NS3 | 1558 | 0.16 | 2 | 2 | 0 | Y | TKGAALMSGEG | 97.74 | TKGAALMSGTG | 2.26 |
| NS3 | 1559 | 0.16 | 2 | 2 | 0 | Y | KGAALMSGEGR | 97.74 | KGAALMSGTGR | 2.26 |
| NS3 | 1560 | 0.16 | 2 | 2 | 0 | Y | GAALMSGEGRL | 97.74 | GAALMSGTGRL | 2.26 |
| NS3 | 1561 | 0.16 | 2 | 2 | 0 | Y | AALMSGEGRLD | 97.74 | AALMSGTGRLD | 2.26 |
| NS3 | 1562 | 0.16 | 2 | 2 | 0 | Y | ALMSGEGRLDP | 97.74 | ALMSGTGRLDP | 2.26 |
| NS3 | 1563 | 0.16 | 2 | 2 | 0 | Y | LMSGEGRLDPY | 97.74 | LMSGTGRLDPY | 2.26 |
| NS3 | 1564 | 0.16 | 2 | 2 | 0 | Y | MSGEGRLDPYW | 97.74 | MSGTGRLDPYW | 2.26 |

FIG. 26-48

Species: WNV (11-mers)

| protein | block starting position | block entropy | total peptides in block | # peptides required to cover 99% of block | gap/X fraction | 99% of block covered w/ <= 5 peptides? | peptides required to cover

FIG. 26-49

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1590 | 0.72 | 6 | 5 | 0.56 | Y | LQHKWNGQDEV | 87.01 | LQHKWNGHDEV | 8.47 | LQHKWNGLDEV | 2.26 | LQHRWNGQDEV | 0.56 | LGHRWNGMDEV | 0.56 |
| NS3 | 1591 | 0.72 | 6 | 5 | 0.56 | Y | QHKWNGQDEVQ | 87.01 | QHKWNGHDEVQ | 8.47 | QRKWNGLDEVQ | 2.26 | QCKWNGQDEVQ | 0.56 | QHRWNGQDEVQ | 0.56 |
| NS3 | 1592 | 0.72 | 6 | 5 | 0.56 | Y | HKWNGQDEVQM | 87.01 | HKWNGHDEVQM | 8.47 | RKWNGLDEVQM | 2.26 | HRWNGQDEVQM | 0.56 | CKWNGQDEVQM | 0.56 |
| NS3 | 1593 | 0.67 | 5 | 4 | 0.56 | Y | KWNGQDEVQMI | 87.57 | KWNGHDEVQMI | 8.47 | KWNGLDEVQMI | 2.26 | RWNGQDEVQMI | 0.56 | | |
| NS3 | 1594 | 0.62 | 4 | 3 | 0 | Y | WNGQDEVQMIV | 88.7 | WNGHDEVQMIV | 8.47 | WNGLDEVQMIV | 2.26 | | | | |
| NS3 | 1595 | 0.62 | 4 | 3 | 0 | Y | NGQDEVQMIVW | 88.7 | NGHDEVQMIVW | 8.47 | NGLDEVQMIVA | 2.26 | | | | |
| NS3 | 1596 | 0.65 | 5 | 4 | 0 | Y | GQDEVQMIVVE | 88.7 | GHDEVQMIVVE | 7.91 | GLDEVQMIVAE | 2.26 | GMDEVQMIVVE | 0.56 | | |
| NS3 | 1597 | 0.65 | 5 | 4 | 0 | Y | QDEVQMIVVEP | 88.7 | HDEVQMIVVEP | 7.91 | LDEVQMIVAEP | 2.26 | HDEVQMIVVKP | 0.56 | | |
| NS3 | 1598 | 0.21 | 3 | 2 | 0 | Y | DEVQMIVVEPG | 97.18 | DEVQMIVAEPG | 2.26 | | | | | | |
| NS3 | 1599 | 0.21 | 3 | 2 | 0 | Y | EVQMIVVEPGK | 97.18 | EVQMIVAEPGR | 2.26 | | | | | | |
| NS3 | 1600 | 0.22 | 4 | 3 | 0 | Y | VQMIVVEPGKN | 97.18 | VQMIVAEPGRN | 1.69 | VQMIVAEPGRK | 0.56 | | | | |
| NS3 | 1601 | 0.31 | 5 | 4 | 0 | Y | QMIVVEPGKNV | 96.05 | QMIVAEPGRNT | 1.69 | QMIVAEPGKNA | 1.13 | QMIVAEPGRKT | 0.56 | | |
| NS3 | 1602 | 0.31 | 5 | 4 | 0 | Y | MIVVEPGKNVK | 96.05 | MIVAEPGRNTR | 1.69 | MIVVEPGKNAK | 1.13 | MIVAEPGRKTR | 0.56 | | |
| NS3 | 1603 | 0.31 | 5 | 4 | 0 | Y | IVVEPGKNVKN | 96.05 | IVAEPGRNTRN | 1.69 | IVVEPGKNAKN | 1.13 | IVVKPGESVKN | 0.56 | | |
| NS3 | 1604 | 0.31 | 5 | 4 | 0 | Y | VVEPGKNVKNV | 96.05 | VAEPGRNTRNV | 1.69 | VVEPGKNAKNV | 1.13 | VAEPGRKTRNV | 0.56 | | |
| NS3 | 1605 | 0.31 | 5 | 4 | 0 | Y | VEPGKNVKNVQ | 96.05 | AEPGRNTRNVQ | 1.69 | VEPGKNAKNVQ | 1.13 | VKPGESVKNVQ | 0.56 | | |
| NS3 | 1606 | 0.31 | 5 | 4 | 0 | Y | EPGKNVKNVQT | 96.05 | EPGRNTRNVQT | 1.69 | EPGKNAKNVQT | 1.13 | EPGRKTRNVQT | 0.56 | | |
| NS3 | 1607 | 0.31 | 5 | 4 | 0 | Y | PGKNVKNVQTK | 96.05 | PGRNTRNVQTK | 1.69 | PGKNAKNVQTK | 1.13 | PGRKTRNVQTK | 0.56 | | |
| NS3 | 1608 | 0.31 | 5 | 4 | 0 | Y | GKNVKNVQTKP | 96.05 | GRNTRNVQTKP | 1.69 | GKNAKNVQTKP | 1.13 | GRKTRNVQTKP | 0.56 | | |
| NS3 | 1609 | 0.31 | 5 | 4 | 0 | Y | KNVKNVQTKPG | 96.05 | RNTRNVQTKPG | 1.69 | KNAKNVQTKPG | 1.13 | ESVKNVQTKPG | 0.56 | | |
| NS3 | 1610 | 0.31 | 5 | 4 | 0 | Y | NVKNVQTKPGV | 96.05 | NTRNVQTKPGV | 1.69 | NAKNVQTKPGV | 1.13 | KTRNVQTKPGV | 0.56 | | |
| NS3 | 1611 | 0.24 | 3 | 3 | 0 | Y | VKNVQTKPGVF | 96.61 | TRNVQTKPGVF | 2.26 | AKNVQTKPGVF | 1.13 | | | | |
| NS3 | 1612 | 0.16 | 2 | 2 | 0.56 | Y | KNVQTKPGVFK | 97.18 | RNVQTKPGVFK | 2.26 | | | | | | |
| NS3 | 1613 | 0 | 1 | 1 | 0.56 | Y | NVQTKPGVFKT | 99.44 | | | | | | | | |
| NS3 | 1614 | 0 | 1 | 1 | 0.56 | Y | VQTKPGVFKTP | 99.44 | | | | | | | | |

FIG. 26-50

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required

FIG. 26-51

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1640 | 0.19 | 4 | 3 | 0 | Y | SGPIVDKNGD | 97.74 | SGPIVDRNGD | 1.13 | SGPIVDKSGD | 0.56 |
| NS3 | 1641 | 0.19 | 4 | 3 | 0 | Y | GSPIVDKNGDV | 97.74 | GSPIVDRNGDV | 1.13 | GSPIVDKSGDV | 0.56 |
| NS3 | 1642 | 0.19 | 4 | 3 | 0 | Y | SPIVDKNGDVI | 97.74 | SPIVDRNGDVI | 1.13 | SPIVDKSGDVI | 0.56 |
| NS3 | 1643 | 0.19 | 4 | 3 | 0 | Y | PIVDKNGDVIG | 97.74 | PIVDRNGDVIG | 1.13 | PIVDKSGDVIG | 0.56 |
| NS3 | 1644 | 0.19 | 4 | 3 | 0 | Y | IVDKNGDVIGL | 97.74 | IVDRNGDVIGL | 1.13 | IVDKNSDVIG | 0.56 |
| NS3 | 1645 | 0.19 | 4 | 3 | 0 | Y | VDKNGDVIGLY | 97.74 | VDRNGDVIGLY | 1.13 | VDKNSDVIGLY | 0.56 |
| NS3 | 1646 | 0.19 | 4 | 3 | 0 | Y | DKNGDVIGLYG | 97.74 | DRNGDVIGLYG | 1.13 | DKSGDVIGLYG | 0.56 |
| NS3 | 1647 | 0.19 | 4 | 3 | 0 | Y | KNGDVIGLYGN | 97.74 | RNGDVIGLYGN | 1.13 | KNSDVIGLYGN | 0.56 |
| NS3 | 1648 | 0.1 | 3 | 2 | 0 | Y | NGDVIGLYGNG | 98.87 | SGDVIGLYGNG | 0.56 | | |
| NS3 | 1649 | 0.05 | 2 | 1 | 0 | Y | GDVIGLYGNGV | 99.44 | | | | |
| NS3 | 1650 | 0 | 1 | 1 | 0 | Y | DVIGLYGNGVI | 100 | | | | |
| NS3 | 1651 | 0 | 1 | 1 | 0 | Y | VIGLYGNGVIM | 100 | | | | |
| NS3 | 1652 | 0 | 1 | 1 | 0 | Y | IGLYGNGVIMP | 100 | | | | |
| NS3 | 1653 | 0.09 | 2 | 2 | 0 | Y | GLYGNGVIMPN | 98.87 | GLYGNGVIMPS | 1.13 | | |
| NS3 | 1654 | 0.09 | 2 | 2 | 0 | Y | LYGNGVIMPNG | 98.87 | LYGNGVIMPSG | 1.13 | | |
| NS3 | 1655 | 0.21 | 3 | 3 | 0 | Y | YGNGVIMPNGS | 97.18 | YGNGVIMPNGA | 1.69 | YGNGVIMPSGS | 1.13 |
| NS3 | 1656 | 0.21 | 3 | 3 | 0 | Y | GNGVIMPNGSY | 97.18 | GNGVIMPNGAY | 1.69 | GNGVIMPSGSY | 1.13 |
| NS3 | 1657 | 0.21 | 3 | 3 | 0 | Y | NGVIMPNGSYI | 97.18 | NGVIMPNGAYI | 1.69 | NGVIMPSGSYI | 1.13 |
| NS3 | 1658 | 0.21 | 3 | 3 | 0 | Y | GVIMPNGSYIS | 97.18 | GVIMPNGAYIS | 1.69 | GVIMPSGSYIS | 1.13 |
| NS3 | 1659 | 0.21 | 3 | 3 | 0 | Y | VIMPNGSYISA | 97.18 | VIMPNGAYISA | 1.69 | VIMPSGSYISA | 1.13 |
| NS3 | 1660 | 0.21 | 3 | 3 | 0 | Y | IMPNGSYISAI | 97.18 | IMPNGAYISAI | 1.69 | IMPSGSYISAI | 1.13 |
| NS3 | 1661 | 0.21 | 3 | 3 | 0 | Y | MPNGSYISAIV | 97.18 | MPNGAYISAIV | 1.69 | MPSGSYISAIV | 1.13 |
| NS3 | 1662 | 0.21 | 3 | 3 | 0 | Y | PNGSYISAIVQ | 97.18 | PNGAYISAIVQ | 1.69 | PSGSYISAIVQ | 1.13 |
| NS3 | 1663 | 0.21 | 3 | 3 | 0 | Y | NGSYISAIVQG | 97.18 | NGAYISAIVQG | 1.69 | SGSYISAIVQG | 1.13 |
| NS3 | 1664 | 0.12 | 2 | 2 | 0 | Y | GSYISAIVQGE | 98.31 | GAYISAIVQGE | 1.69 | | |

FIG. 26-52

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1665 | 0.12 | 2 | 2 | 0 | Y

FIG. 26-53

Species: WNV (11-mers)

| protein | block starting position | block entropy | total peptides in block | # peptides required to cover 99% of block | gap/X fraction | 99% of block covered w

FIG. 26-54

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1727 | 0.24 | 3 | 2 | 0 | Y | LAPTRVVAAEM | 96.61 | LAPTRVVASEM | 2.82 | |

FIG. 26-55

Species: WNV (11-mers)

| protein | block starting position | block entropy | total pe

FIG. 26-56

Species: WNV (11-mers)

| protein

FIG. 26-57

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1809 | 0.32 | 3 | 2 | 0 | Y | KVELGEAAAIF | 94.92 | RVELGEAAAIF | 4.52 | | | | |
| NS3 | 1810 | 0.05 | 2 | 1 | 0 | Y | VELGEAAAIFM | 99.44 | | | | | | |
| NS3 | 1811 | 0.05 | 2 | 1 | 0 | Y | ELGEAAAIFMT | 99.44 | | | | | | |
| NS3 | 1812 | 0.05 | 2 | 1 | 0 | Y | LGEAAAIFMTA | 99.44 | | | | | | |
| NS3 | 1813 | 0.05 | 2 | 1 | 0 | Y | GEAAAIFMTAT | 99.44 | | | | | | |
| NS3 | 1814 | 0.05 | 2 | 1 | 0 | Y | EAAAIFMTATP | 99.44 | | | | | | |
| NS3 | 1815 | 0 | 1 | 1 | 0 | Y | AAAIFMTATPP | 100 | | | | | | |
| NS3 | 1816 | 0 | 1 | 1 | 0 | Y | AAIFMTATPPG | 100 | | | | | | |
| NS3 | 1817 | 0.05 | 2 | 1 | 0 | Y | AIFMTATPPGT | 99.44 | | | | | | |
| NS3 | 1818 | 0.1 | 3 | 2 | 0 | Y | IFMTATPPGTS | 98.87 | IFMTATPPGSS | 0.56 | | | | |
| NS3 | 1819 | 0.1 | 3 | 2 | 0 | Y | FMTATPPGTSD | 98.87 | FMTATPPGSSD | 0.56 | | | | |
| NS3 | 1820 | 0.1 | 3 | 2 | 0 | Y | MTATPPGTSDP | 98.87 | MTATPPGTHDP | 0.56 | | | | |
| NS3 | 1821 | 0.1 | 3 | 2 | 0 | Y | TATPPGTSDPF | 98.87 | TATPPGTHDPF | 0.56 | | | | |
| NS3 | 1822 | 0.1 | 3 | 2 | 0 | Y | ATPPGTSDPFP | 98.87 | ATPPGTHDPFP | 0.56 | | | | |
| NS3 | 1823 | 0.15 | 4 | 3 | 0 | Y | TPPGTSDPFPE | 98.31 | TPPGTHDPFPE | 0.56 | TPPGSSDPFPE | 0.56 | | |
| NS3 | 1824 | 0.15 | 4 | 3 | 0 | Y | PPGTSDPFPES | 98.31 | PPGSSDPFPES | 0.56 | PPGTSDPFPKS | 0.56 | | |
| NS3 | 1825 | 0.15 | 4 | 3 | 0 | Y | PGTSDPFPESN | 98.31 | PGTSDPFPKSN | 0.56 | PGTHDPFPESN | 0.56 | | |
| NS3 | 1826 | 0.68 | 5 | 4 | 0.56 | Y | GTSDPFPESNS | 85.88 | GTSDPFPESNA | 11.86 | GTHDPFPESNA | 0.56 | GTSDPFPKSNS | 0.56 |
| NS3 | 1827 | 0.68 | 5 | 4 | 0.56 | Y | TSDPFPESNSP | 85.88 | TSDPFPESNAP | 11.86 | TSDPFPESNA | 0.56 | SDPFPESNAP | 0.56 |
| NS3 | 1828 | 0.68 | 5 | 4 | 0.56 | Y | SDPFPESNSPI | 85.88 | SDPFPESNAPI | 9.6 | SDPFPESNAPV | 2.82 | SDPFPKSNSPI | 0.56 |
| NS3 | 1840 | 0.65 | 4 | 3 | 0 | Y | DLQTEIPDRAW | 88.14 | DMQTEIPDRAW | 8.47 | DIQTEIPDRAW | 2.82 | | |
| NS3 | 1841 | 0.65 | 4 | 3 | 0 | Y | LQTEIPDRAWN | 88.14 | MQTEIPDRAWN | 8.47 | IQTEIPDRAWN | 2.82 | | |
| NS3 | 1842 | 0.43 | 3 | 2 | 0 | Y | QTEIPDRAWNS | 92.09 | QTEIPDRAWNT | 7.34 | | | | |
| NS3 | 1843 | 0.43 | 3 | 2 | 0 | Y | TEIPDRAWNSG | 92.09 | TEIPDRAWNTG | 7.34 | | | | |
| NS3 | 1844 | 0.43 | 3 | 2 | 0 | Y | EIPDRAWNSGY | 92.09 | EIPDRAWNTGY | 7.34 | | | | |

FIG. 26-58

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 26-59

Species: WNV (11-mers)

| protein | block starting position | block entropy |

FIG. 26-60

Species: WNV (11-mers)

| protein | block star

FIG. 26-61

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 26-62

Species: WNV (11-mers)

| protein

FIG. 26-63

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|

FIG. 26-64

Species: WNV (11-mers)

| protein | block starting position | block entropy | total peptides in block | # peptides required to cover 99% of block | block gap/X fraction | 99% of block covered w/ <= 5 peptides? | peptides required

FIG. 26-65

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2025 | 0.21 | 3 | 2 | 0 | Y | MDGEYKLRGEE | 97.18 | MDGEYKLRGEE | 2.26 | | | | |
| NS3 | 2026 | 0.21 | 3 | 2 | 0 | Y | DGEYKLRGEER | 97.18 | DGEYKLRGEER | 2.26 | | | | |
| NS3 | 2027 | 0.16 | 2 | 2 | 0 | Y | GEYKLRGEERK | 97.74 | GEYKLRGEERK | 2.26 | | | | |
| NS3 | 2028 | 0.16 | 2 | 2 | 0 | Y | EYKLRGEERKN | 97.74 | EYKLRGEERKN | 2.26 | | | | |
| NS3 | 2029 | 0.16 | 2 | 2 | 0 | Y | YKLRGEERKNF | 97.74 | YKLRGEERKNF | 2.26 | | | | |
| NS3 | 2030 | 0.16 | 2 | 1 | 0 | Y | RLRGEERKNFL | 97.74 | KLRGEERKNFL | 2.26 | | | | |
| NS3 | 2031 | 0 | 1 | 2 | 0 | Y | LRGEERKNFLE | 100 | | | | | | |
| NS3 | 2032 | 0.4 | 2 | 2 | 0 | Y | RGEERKNFLEL | 92.09 | RGEERKNFLEF | 7.91 | | | | |
| NS3 | 2033 | 0.4 | 2 | 2 | 0 | Y | GEERKNFLELL | 92.09 | GEERKNFLEFL | 7.91 | | | | |
| NS3 | 2034 | 0.45 | 3 | 2 | 0 | Y | EERKNFLELLR | 91.53 | EERKNFLEFLR | 7.91 | | | | |
| NS3 | 2035 | 0.45 | 3 | 2 | 0 | Y | ERKNFLELLRT | 91.53 | ERKNFLEFLRT | 7.91 | | | | |
| NS3 | 2036 | 0.45 | 3 | 2 | 0 | Y | RKNFLELLRTA | 91.53 | RKNFLEFLRTA | 7.91 | | | | |
| NS3 | 2037 | 0.45 | 3 | 2 | 0 | Y | KNFLELLRTAD | 91.53 | KNFLEFLRTAD | 7.91 | | | | |
| NS3 | 2038 | 0.45 | 3 | 2 | 0 | Y | NFLELLRTADL | 91.53 | NFLEFLRTADL | 7.91 | | | | |
| NS3 | 2039 | 0.45 | 3 | 2 | 0 | Y | FLELLRTADLP | 91.53 | FLEFLRTADLP | 7.91 | | | | |
| NS3 | 2040 | 0.45 | 3 | 2 | 0 | Y | LELLRTADLPV | 91.53 | LEFLRTADLPV | 7.91 | | | | |
| NS3 | 2041 | 0.45 | 3 | 2 | 0 | Y | ELLRTADLPVW | 91.53 | EFLRTADLPVW | 7.91 | | | | |
| NS3 | 2042 | 0.45 | 3 | 2 | 0 | Y | LLRTADLPVWL | 91.53 | FLRTADLPVWL | 7.91 | | | | |
| NS3 | 2043 | 0.05 | 2 | 1 | 0 | Y | LRTADLPVWLA | 99.44 | | | | | | |
| NS3 | 2044 | 0.1 | 3 | 2 | 0 | Y | RTADLPVWLAY | 98.87 | KTADLPVWLAY | 0.56 | | | | |
| NS3 | 2045 | 0.21 | 3 | 2 | 0 | Y | TADLPVWLAYK | 97.18 | TADLPVWLAYQ | 2.26 | | | | |
| NS3 | 2046 | 0.26 | 4 | 3 | 0 | Y | ADLPVWLAYKV | 96.61 | ADLPVWLAYQV | 2.26 | ADLPVWLAHKV | 0.56 | | |
| NS3 | 2047 | 0.26 | 4 | 3 | 0 | Y | DLPVWLAYKVA | 96.61 | DLPVWLAYQVA | 2.26 | DLPVWLAHKVA | 0.56 | | |
| NS3 | 2048 | 0.31 | 5 | 4 | 0 | Y | LPVWLAYKVAA | 96.05 | LPVWLAYQVAA | 2.26 | LPVWLAYKVAS | 0.56 | LPVWLAYKAAA | 0.56 |
| NS3 | 2049 | 0.31 | 5 | 4 | 0 | Y | PVWLAYKVAAA | 96.05 | PVWLAYQVAAA | 2.26 | PVWLAYKVAAA | 0.56 | PVWLAHKVAAA | 0.56 |

FIG. 26-66

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 2050 | 0.31 | 5 | 4 | 0 | Y | VWLA

FIG. 26-67

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2078 | 0.21 | 3 | 2 | 0 | Y | ILEDNNEVEVI | 97.18 | VLEENT

FIG. 26-68

Species: WNV (11-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2103 | 0.05 | 2 | 1 | 0 | Y | DARVYSDHQAL | 99.44 | | | | | | |
| NS3 | 2104 | 0.05 | 2 | 1 | 0 | Y | ARVYSDHQALK | 99.44 | | | | | | |
| NS3 | 2105 | 0.68 | 4 | 3 | 0 | Y | RVYSDHQALKA | 87.01 | RVYSDHQALKS | 10.17 | RVYSDHQALKL | 2.26 | | |
| NS3 | 2106 | 0.68 | 4 | 3 | 0 | Y | VYSDHQALKAF | 87.01 | VYSDHQALKSF | 10.17 | VYSDHQALKLF | 2.26 | | |
| NS3 | 2107 | 0.68 | 4 | 3 | 0 | Y | YSDHQALKAFK | 87.01 | YSDHQALKSFK | 10.17 | YSDHQALKLFK | 2.26 | | |
| NS3 | 2108 | 0.68 | 4 | 3 | 0 | Y | SDHQALKAFKD | 87.01 | SDHQALKSFKD | 10.17 | SDHQALKLFKD | 2.26 | | |
| NS3 | 2109 | 0.63 | 3 | 3 | 0 | Y | DHQALKAFKDF | 87.57 | DHQALKSFKDF | 10.17 | DHQALKLFKDF | 2.26 | | |
| NS3 | 2110 | 0.63 | 3 | 3 | 0 | Y | HQALKAFKDFA | 87.57 | HQALKSFKDFA | 10.17 | HQALKLFKDFA | 2.26 | | |
| NS3 | 2111 | 0.66 | 4 | 3 | 0 | Y | QALKAFKDFAS | 87.57 | QALKSFKDFAS | 9.6 | QALKLFKDFAA | 2.26 | | |
| NS3 | 2112 | 0.66 | 4 | 3 | 0 | Y | ALKAFKDFASG | 87.57 | ALKSFKDFASG | 9.6 | ALKLFKDFAAG | 2.26 | | |
| NS3 | 2113 | 0.66 | 4 | 3 | 0 | Y | LKAFKDFASGK | 87.57 | LKSFKDFASGK | 9.6 | LKLFKDFAAGR | 2.26 | | |
| NS3 | 2114 | 0.66 | 4 | 3 | 0 | Y | KAFKDFASGKR | 87.57 | KSFKDFASGKR | 9.6 | KLFKDFAAGRR | 2.26 | | |
| NS3 | 2115 | 0.66 | 4 | 3 | 0 | Y | AFKDFASGKRS | 87.57 | SFKDFASGKRS | 9.6 | LFKDFAAGRRS | 2.26 | | |
| NS3 | 2116 | 0.21 | 3 | 2 | 0 | Y | FKDFASGKRSQ | 97.18 | FKDFAAGKRSQ | 2.26 | | | | |
| NS3 | 2117 | 0.31 | 5 | 4 | 0 | Y | KDFASGKRSQI | 96.05 | KDFASGKRSQM | 2.26 | KDFAAGKRSQI | 0.56 | KDFAAGKRSQM | 0.56 |
| NS3 | 2118 | 0.31 | 5 | 4 | 0 | Y | DFASGKRSQIG | 96.05 | DFAAGKRSQIG | 2.26 | DFASGKRSQMG | 0.56 | DFASGKRSQMG | 0.56 |
| NS3 | 2119 | 0.43 | 6 | 5 | 0 | Y | FASGKRSQIGL | 94.35 | FAAGKRSQIGL | 2.26 | FASGKRSQIGF | 1.69 | FASGKRSQVGL | 0.56 |
| NS3 | 2122 | 0.79 | 6 | 5 | 0 | Y | GKRSQIGLIEV | 86.44 | GRRSQIGLVEV | 2.26 | GKRSQIGFIEV | 2.26 | GKRSQVGLIEV | 0.56 |
| NS3 | 2123 | 0.79 | 6 | 5 | 0 | Y | KRSQIGLIEVL | 86.44 | RRSQIGLVEVL | 2.26 | KRSQIGFIEVL | 1.69 | KRSQVGLIEVL | 0.56 |
| NS3 | 2124 | 0.79 | 6 | 5 | 0 | Y | RSQIGLIEVLG | 86.44 | RSQIGLVEVIG | 2.26 | RSQIGFIEVLG | 1.69 | RSQMGLIEVLG | 0.56 |
| NS3 | 2125 | 0.79 | 6 | 5 | 0 | Y | SQIGLIEVLGK | 86.44 | SQIGLVEVLGR | 2.26 | SQIGFIEVLGK | 1.69 | SQMGLIEVLGK | 0.56 |
| NS3 | 2126 | 0.79 | 6 | 5 | 0 | Y | QIGLIEVLGKM | 86.44 | QIGLVEVIGRM | 2.26 | QIGFIEVLGKM | 1.69 | QMGLIEVLGKM | 0.56 |
| NS3 | 2127 | 0.79 | 6 | 5 | 0 | Y | IGLIEVLGKMP | 86.44 | IGLVEVIGRMP | 2.26 | IGFIEVLGKMP | 1.69 | MGLIEVLGKMP | 0.56 |
| NS4A | 2128 | 0.74 | 5 | 4 | 0 | Y | GLIEVLGKMPE | 87.01 | GLVEVIGRMPE | 2.26 | GFIEVLGKMPE | 1.69 | | |
| NS4A | 2129 | 0.74 | 5 | 4 | 0 | Y | LIEVLGKMPEH | 87.01 | LVEVIGRMPEH | 2.26 | FIEVLGKMPEH | 1.69 | | |

FIG. 26-69

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2130 | 0.62 | 4 | 3 | 0 | Y | IEVLGKMPEHF | 88.7 | VEVLGRMPEHF | 8.47 | VEVIGRMPEHF | 2.26 | | |
| NS4A | 2131 | 0.59 | 3 | 3 | 0 | Y | EVLGKMPEHFM | 88.7 | EVLGRMPEHFM | 9.04 | EVIGRMPEHFV | 2.26 | | |
| NS4A | 2132 | 0.64 | 4 | 4 | 0 | Y | VLGKMPEHFMG | 88.7 | VLGRMPEHFMG | 7.91 | VIGRMPEHFVG | 2.26 | VLGRMPEHFMV | 1.13 |
| NS4A | 2133 | 0.64 | 4 | 4 | 0 | Y | LGKMPEHFMGK | 88.7 | LGRMPEHFMGK | 7.91 | IGRMPEHFVGK | 2.26 | LGRMPEHFMVK | 1.13 |
| NS4A | 2134 | 0.64 | 4 | 4 | 0 | Y | GKMPEHFMGKT | 88.7 | GRMPEHFMGKT | 7.91 | GRMPEHFVGKT | 2.26 | GRMPEHFMVKT | 1.13 |
| NS4A | 2135 | 0.64 | 4 | 4 | 0 | Y | KMPEHFMGKTW | 88.7 | RMPEHFMGKTW | 7.91 | RMPEHFVGKTW | 2.26 | RMPEHFMVKTW | 1.13 |
| NS4A | 2136 | 0.24 | 3 | 3 | 0 | Y | MPEHFMGKTWE | 96.61 | MPEHFVGKTWE | 2.26 | MPEHFMVKTWE | 1.13 | | |
| NS4A | 2137 | 0.24 | 3 | 3 | 0 | Y | PEHFMGKTWEA | 96.61 | PEHFVGKTWEA | 2.26 | PEHFMVKTWEA | 1.13 | | |
| NS4A | 2138 | 0.24 | 3 | 3 | 0 | Y | EHFMGKTWEAL | 96.61 | EHFVGKTWEAL | 2.26 | EHFMVKTWEAL | 1.13 | | |
| NS4A | 2139 | 0.24 | 3 | 3 | 0 | Y | HFMGKTWEALD | 96.61 | HFVGKTWEALD | 2.26 | HFMVKTWEALD | 1.13 | | |
| NS4A | 2140 | 0.24 | 3 | 3 | 0 | Y | FMGKTWEALDT | 96.61 | FVGKTWEALDT | 2.26 | FMVKTWEALDT | 1.13 | | |
| NS4A | 2141 | 0.24 | 3 | 3 | 0 | Y | MGKTWEALDTM | 96.61 | VGKTWEALDTM | 2.26 | MVKTWEALDTM | 1.13 | | |
| NS4A | 2142 | 0.09 | 3 | 2 | 0 | Y | GKTWEALDTMY | 98.87 | VKTWEALDTMY | 1.13 | | | | |
| NS4A | 2143 | 0 | 2 | 1 | 0 | Y | KTWEALDTMYV | 100 | | | | | | |
| NS4A | 2144 | 0 | 2 | 1 | 0 | Y | TWEALDTMYVV | 100 | | | | | | |
| NS4A | 2145 | 0 | 2 | 1 | 0 | Y | WEALDTMYVVA | 100 | | | | | | |
| NS4A | 2146 | 0 | 2 | 1 | 0 | Y | EALDTMYVVAT | 100 | | | | | | |
| NS4A | 2147 | 0 | 2 | 1 | 0 | Y | ALDTMYVVATA | 100 | | | | | | |
| NS4A | 2148 | 0.05 | 2 | 2 | 0 | Y | LDTMYVVATAE | 99.44 | | | | | | |
| NS4A | 2149 | 0.1 | 3 | 2 | 0 | Y | DTMYVVATAEK | 98.87 | DTMYVVATAER | 0.56 | | | | |
| NS4A | 2150 | 0.1 | 3 | 2 | 0 | Y | TMYVVATAEKG | 98.87 | TMYVVATAERG | 0.56 | | | | |
| NS4A | 2151 | 0.15 | 4 | 3 | 0 | Y | MYVVATAEKGG | 98.31 | MYVVATAERGG | 0.56 | MYVVATAEKGR | 0.56 | | |
| NS4A | 2152 | 0.15 | 4 | 3 | 0 | Y | YVVATAEKGGR | 98.31 | YVVATAEKGRR | 0.56 | YVVATADKGGR | 0.56 | | |
| NS4A | 2153 | 0.15 | 4 | 3 | 0 | Y | VVATAEKGGRA | 98.31 | VVATAEKGGRR | 0.56 | VVATAERGGRA | 0.56 | | |
| NS4A | 2154 | 0.15 | 4 | 3 | 0 | Y | VATAEKGGRAH | 98.31 | VATAERGGRAH | 0.56 | VATAEKGRRAH | 0.56 | | |

FIG. 26-70

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2155 | 0.2 | 5 | 4 | 0 | Y | ATAEKGGRAHR | 97.74 | ATAEKGGRAHR | 0.56 | ATADKGGRAHR | 0.56 | ATAERGGRAHR | 0.56 | | |
| NS4A | 2156 | 0.36 | 6 | 5 | 0 | Y | TAEKGGRAHRM | 95.48 | TAEKGGRAHRT | 2.26 | TADKGGRAHRM | 2.26 | TAEKGGRAHR | 0.56 | TAEKGGRAHSM | 0.56 |
| NS4A | 2157 | 0.36 | 6 | 5 | 0 | Y | AEKGGRAHRMA | 95.48 | AEKGGRAHRTA | 2.26 | AEKGGRAHSMA | 2.26 | AEKGRRAHRMA | 0.56 | AERGGRAHRSA | 0.56 |
| NS4A | 2158 | 0.36 | 6 | 5 | 0 | Y | EKGGRAHRMAL | 95.48 | EKGGRAHRTAL | 2.26 | EKGGRAHSMAL | 2.26 | ERGGRAHRSAL | 0.56 | EKGRRAHRMAL | 0.56 |
| NS4A | 2159 | 0.31 | 5 | 4 | 0 | Y | KGGRAHRMALE | 96.05 | KGGRAHRTALE | 2.26 | RGGRAHRSALE | 0.56 | KGRRAHRMALE | 0.56 | | |
| NS4A | 2160 | 0.31 | 5 | 4 | 0 | Y | GGRAHRMALEE | 96.05 | GGRAHRTALEE | 2.26 | GGRAHSMALEE | 0.56 | GRRAHRMALEE | 0.56 | | |
| NS4A | 2161 | 0.31 | 5 | 4 | 0 | Y | GRAHRMALEEL | 96.05 | GRAHRTALEEL | 2.26 | GRAHSMALEEL | 0.56 | RRAHRMALEEL | 0.56 | | |
| NS4A | 2162 | 0.26 | 4 | 3 | 0 | Y | RAHRMALEELP | 96.61 | RAHRTALEELP | 2.26 | RAHSMALEELP | 0.56 | | | | |
| NS4A | 2163 | 0.26 | 4 | 3 | 0 | Y | AHRMALEELPD | 96.61 | AHRTALEELPD | 2.26 | AHSMALEELPD | 0.56 | | | | |
| NS4A | 2164 | 0.26 | 4 | 3 | 0 | Y | HRMALEELPDA | 96.61 | HRTALEELPDA | 2.26 | HRSALEELPDA | 0.56 | | | | |
| NS4A | 2165 | 0.26 | 4 | 3 | 0 | Y | RMALEELPDAL | 96.61 | RTALEELPDAL | 2.26 | SMALEELPDAL | 0.56 | | | | |
| NS4A | 2166 | 0.21 | 3 | 2 | 0 | Y | MALEELPDALQ | 97.18 | TALEELPDALQ | 2.26 | | | | | | |
| NS4A | 2167 | 0 | 1 | 1 | 0 | Y | ALEELPDALQT | 100 | | | | | | | | |
| NS4A | 2168 | 0.05 | 2 | 1 | 0 | Y | LEELPDALQTI | 99.44 | | | | | | | | |
| NS4A | 2169 | 0.19 | 4 | 3 | 0 | Y | EELPDALQTIA | 97.74 | EELPDALQTIV | 1.13 | EELPDALQTVA | 0.56 | | | | |
| NS4A | 2170 | 0.19 | 4 | 3 | 0 | Y | ELPDALQTIAL | 97.74 | ELPDALQTIVL | 1.13 | ELPDALQTIIL | 0.56 | | | | |
| NS4A | 2171 | 0.19 | 4 | 3 | 0 | Y | LPDALQTIALI | 97.74 | LPDALQTIVLI | 1.13 | LPDALQTVALI | 0.56 | | | | |
| NS4A | 2172 | 0.69 | 5 | 4 | 0 | Y | PDALQTIALIA | 86.44 | PDALQTIVLIA | 1.13 | PDALQTIVLIA | 0.56 | PDALQTVALIA | 0.56 | | |
| NS4A | 2173 | 0.69 | 5 | 4 | 0 | Y | DALQTIALITL | 86.44 | DALQTIVLIAL | 1.13 | DALQTIVLIAL | 0.56 | DALQTIILITL | 0.56 | | |
| NS4A | 2174 | 0.69 | 5 | 4 | 0 | Y | ALQTIALITLL | 86.44 | ALQTIALITLL | 1.13 | ALQTIVLIALL | 0.56 | ALQTIILITLL | 0.56 | | |
| NS4A | 2175 | 0.69 | 5 | 4 | 0 | Y | LQTIALIALLS | 86.44 | LQTIALITLLS | 1.13 | LQTIVLIALLS | 0.56 | LQTIILITLLS | 0.56 | | |
| NS4A | 2176 | 0.69 | 5 | 4 | 0 | Y | QTIALIALLSV | 86.44 | QTIALITLLSV | 1.13 | QTIVLIALLSV | 0.56 | QTIILITLLS | 0.56 | | |
| NS4A | 2177 | 0.69 | 5 | 4 | 0 | Y | TIALIALLSVM | 86.44 | TIALITLLSVM | 1.13 | TIVLIALLSVM | 0.56 | TVALIALLGVM | 0.56 | | |
| NS4A | 2186 | 0.7 | 6 | 5 | 0 | Y | VMTMGIFFLLM | 88.14 | VMSLGVFFLLM | 2.26 | VMTLGVFCLLM | 2.26 | VMSMGVFFLLM | 0.56 | VMTMGIFFLLM | 0.56 |
| NS4A | 2187 | 0.7 | 6 | 5 | 0 | Y | MTMGVFFLLMQ | 88.14 | MSLGVFFLLMQ | 2.26 | MTLGVFCLLMQ | 2.26 | MTMGVFLLLMQ | 0.56 | MTMGIFFLLMQ | 0.56 |

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4A | 2224 | 0.19 | 2 | 2 | 0 | Y | PGTKIAGMLLL | 97.18 | SGTKIAGMLLL | 2

FIG. 26-73

Species: WNV (11-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2249 | 0.16 | 2 | 2 | 0.56 | Y | QRSQTDNQLAV | 97.18 | QRSQTDNQLAM | 2.26 | | | | |
| NS4A | 2250 | 0.16 | 2 | 2 | 0.56 | Y | RSQTDNQLAVF | 97.18 | RSQTDNQLAMF | 2.26 | | | | |
| NS4A | 2251 | 0.21 | 3 | 2 | 0.56 | Y | SQTDNQLAVFL | 96.61 | SQTDNQLAMFL | 2.26 | | | | |
| 2K | 2252 | 0.21 | 3 | 2 | 0.56 | Y | QTDNQLAVFLI | 96.61 | QTDNQLAMFLI | 2.26 | | | | |
| 2K | 2253 | 0.21 | 3 | 2 | 0.56 | Y | TDNQLAVFLIC | 96.61 | TDNQLAMFLIC | 2.26 | | | | |
| 2K | 2254 | 0.21 | 3 | 3 | 0.56 | Y | DNQLAVFLICV | 96.61 | DNQLAMFLICV | 2.26 | | | | |
| 2K | 2255 | 0.84 | 4 | 3 | 0.56 | Y | NQLAVFLICVM | 80.23 | NQLAVFLICVL | 16.38 | NQLAMFLICVM | 2.26 | | |
| 2K | 2256 | 0.84 | 4 | 3 | 0.56 | Y | QLAVFLICVMT | 80.23 | QLAVFLICVLT | 16.38 | QLAMFLICVMT | 2.26 | | |
| 2K | 2257 | 0.93 | 6 | 5 | 0.56 | Y | LAVFLICVMTL | 79.66 | LAVFLICVLTL | 15.82 | LAMFLICVMTL | 2.26 | LAVFMICVMTL | 0.56 |
| 2K | 2258 | 0.93 | 6 | 5 | 0.56 | Y | AVFLICVMTLV | 79.66 | AVFLICVLTLV | 15.82 | AMFLICVMTLV | 2.26 | AVFMICVMTLV | 0.56 |
| 2K | 2266 | 0.52 | 5 | 4 | 0 | Y | TLVSAVAANEM | 92.09 | TLVGAVAANEM | 4.52 | TLVGTVAANEM | 2.26 | TPVSAVAANEM | 0.56 |
| 2K | 2267 | 0.52 | 5 | 4 | 0 | Y | LVSAVAANEMG | 92.09 | LVGAVAANEMG | 4.52 | LVGTVAANEMG | 2.26 | PVSAVAANEMG | 0.56 |
| 2K | 2268 | 0.47 | 4 | 3 | 0 | Y | VSAVAANEMGW | 92.66 | VGAVAANEMGW | 4.52 | VGTVAANEMGW | 2.26 | | |
| 2K | 2269 | 0.42 | 3 | 3 | 0 | Y | SAVAANEMGWL | 93.22 | GAVAANEMGWL | 4.52 | GTVAANEMGWL | 2.26 | | |
| 2K | 2270 | 0.16 | 2 | 2 | 0 | Y | AVAANEMGWLD | 97.74 | TVAANEMGWLD | 2.26 | | | | |
| 2K | 2271 | 0.19 | 2 | 2 | 0 | Y | VAANEMGWLDR | 97.18 | VAANEMGWLDK | 2.82 | | | | |
| 2K | 2272 | 0.19 | 2 | 2 | 0 | Y | AANEMGWLDRT | 97.18 | AANEMGWLDKT | 2.82 | | | | |
| 2K | 2273 | 0.19 | 2 | 2 | 0 | Y | ANEMGWLDRTK | 97.18 | ANEMGWLDKTK | 2.82 | | | | |
| NS4B | 2274 | 0.69 | 3 | 3 | 0.56 | Y | NEMGWLDKTKS | 85.88 | NEMGWLDRTKS | 11.3 | NEMGWLDKTKN | 2.82 | | |
| NS4B | 2275 | 0.69 | 3 | 3 | 0 | Y | EMGWLDKTKSD | 85.88 | EMGWLDRTKSD | 11.3 | EMGWLDKTKND | 2.82 | | |
| NS4B | 2276 | 0.77 | 5 | 4 | 0.56 | Y | MGWLDKTKSDI | 84.75 | MGWLDRTKSDI | 10.73 | MGWLDKTKNDI | 2.82 | MGWLDKTKNDM | 0.56 |
| NS4B | 2304 | 0.68 | 6 | 5 | 0 | Y | GEFLLDLRPAT | 88.7 | ESFLLDLRPAT | 7.34 | ESFLLDLKPAT | 2.26 | ADLLLDLKPAT | 0.56 |
| NS4B | 2305 | 0.68 | 6 | 5 | 0 | Y | EFLLDLRPATA | 88.7 | SFLLDLRPATA | 7.34 | SFLLDLKPATA | 2.26 | EFFLDLRPATA | 0.56 |
| NS4B | 2306 | 0.26 | 3 | 3 | 0 | Y | FLLDLRPATAW | 96.61 | FLLDLKPATAW | 2.26 | FFLDLRPATAW | 0.56 | GEFFLDLRPAT | 0.56 |
| NS4B | 2307 | 0.24 | 2 | 2 | 0 | Y | LLDLRPATAWS | 96.61 | LLDLKPATAWS | 2.82 | | | DLLLDLKPATA | 0.56 |

FIG. 26-74

Species: WNV (11-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2308 | 0.19 | 2 | 2 | 0 | Y | LDLRPATAWSL | 97.18 | LDLRPATAWSL | 2.82 | | | | | | |
| NS4B | 2309 | 0.19 | 2 | 2 | 0 | Y | DLRPATAWSLY | 97.18 | DLKPATAWSLY | 2.82 | | | | | | |
| NS4B | 2310 | 0.19 | 2 | 2 | 0 | Y | LRPATAWSLYA | 97.18 | LKPATAWSLYA | 2.82 | | | | | | |
| NS4B | 2311 | 0.21 | 3 | 2 | 0 | Y | RPATAWSLYAV | 97.18 | KPATAWSLYAV | 2.82 | | | | | | |
| NS4B | 2312 | 0.26 | 4 | 3 | 0 | Y | PATAWSLYAVT | 96.61 | PATAWSLYAVS | 2.26 | PATAWSLYAIS | 0.56 | | | | |
| NS4B | 2313 | 0.26 | 4 | 3 | 0 | Y | ATAWSLYAVTT | 96.61 | ATAWSLYAVST | 2.26 | ATAWSLYAIST | 0.56 | | | | |
| NS4B | 2314 | 0.26 | 4 | 3 | 0 | Y | TAWSLYAVTTA | 96.61 | TAWSLYAVSTA | 2.26 | TAWSLYAVATA | 0.56 | | | | |
| NS4B | 2315 | 0.31 | 5 | 4 | 0 | Y | AWSLYAVTTAV | 96.05 | AWSLYAVSTAV | 2.26 | AWSLYAVTTAF | 0.56 | AWSLYAISTAF | 0.56 | | |
| NS4B | 2316 | 0.31 | 5 | 4 | 0 | Y | WSLYAVTTAVL | 96.05 | WSLYAVSTAVM | 2.26 | WSLYAISTAFM | 0.56 | WSLYAVATAVL | 0.56 | | |
| NS4B | 2317 | 0.31 | 5 | 4 | 0 | Y | SLYAVTTAVLT | 96.05 | SLYAVSTAVMT | 2.26 | SLYAISTAFMT | 0.56 | SLYAVATAVLT | 0.56 | | |
| NS4B | 2318 | 0.31 | 5 | 4 | 0 | Y | LYAVTTAVLTP | 96.05 | LYAVSTAVMTP | 2.26 | LYAVTTAFLTP | 0.56 | LYAISTAFMTP | 0.56 | TTAFLTPLLKH | 0.56 |
| NS4B | 2319 | 0.31 | 5 | 4 | 0 | Y | YAVTTAVLTPL | 96.05 | YAVSTAVMTPL | 2.26 | YAVTTAFLTPL | 0.56 | YAISTAFMTPL | 0.56 | TAVLTPLLKH | 0.56 |
| NS4B | 2320 | 0.36 | 6 | 5 | 0 | Y | AVTTAVLTPLL | 95.48 | AVSTAVMTPLL | 2.26 | AVTTAFLTPLL | 0.56 | AVTTAVLTPLI | 0.56 | AVLTPLIKHL | 0.56 |
| NS4B | 2321 | 0.36 | 6 | 5 | 0 | Y | VTTAVLTPLLK | 95.48 | VSTAVMTPLLK | 2.26 | VTTAFLTPLLK | 0.56 | VTTAVLTPLIK | 0.56 | FLTPLLKHLIT | 0.56 |
| NS4B | 2322 | 0.36 | 6 | 5 | 0 | Y | TTAVLTPLLKH | 95.48 | STAVMTPLLKH | 2.26 | ATAVLTPLLKH | 0.56 | TTAVLTPLLIK | 0.56 | | |
| NS4B | 2323 | 0.36 | 6 | 5 | 0 | Y | TAVLTPLLKHL | 95.48 | TAVMTPLLKHL | 2.26 | TAFMTPLLKHL | 0.56 | TAVLTPLLKHV | 0.56 | | |
| NS4B | 2324 | 0.36 | 6 | 5 | 0 | Y | AVLTPLLKHLI | 95.48 | AVMTPLLKHVI | 2.26 | AFMTPLLKHVI | 0.56 | AVLTPLLKHVI | 0.56 | | |
| NS4B | 2325 | 0.36 | 6 | 5 | 0 | Y | VLTPLLKHLIT | 95.48 | VMTPLLKHVIT | 2.26 | VLTPLLKHVI | 0.56 | VLTPLLKHVIT | 0.56 | | |
| NS4B | 2326 | 0.31 | 5 | 4 | 0 | Y | LTPLLKHLITS | 96.05 | MTPLLKHVITS | 2.26 | LTPLLKHVITS | 0.56 | LTPLLKHLITS | 0.56 | | |
| NS4B | 2327 | 0.24 | 3 | 2 | 0 | Y | TPLLKHLITSD | 96.61 | TPLLKHVITSD | 2.82 | | | | | | |
| NS4B | 2328 | 0.24 | 3 | 2 | 0 | Y | PLLKHLITSDY | 96.61 | PLLKHVITSDY | 2.82 | | | | | | |
| NS4B | 2329 | 0.24 | 3 | 2 | 0 | Y | LLKHLITSDYI | 96.61 | LLKHVITSDYI | 2.82 | | | | | | |
| NS4B | 2330 | 0.29 | 4 | 3 | 0 | Y | LKHLITSDYIN | 96.05 | LKHVITSDYIN | 2.82 | LKHLITSDYIT | 0.56 | | | | |
| NS4B | 2331 | 0.24 | 3 | 2 | 0 | Y | KHLITSDYINT | 96.61 | KHVITSDYINT | 2.82 | | | | | | |
| NS4B | 2332 | 0.24 | 3 | 2 | 0 | Y | HLITSDYINTS | 96.61 | HVITSDYINTS | 2.82 | | | | | | |

FIG. 26-75

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2333 | 0.24 | 3 | 2 | 0 | Y | LITSDYINTSL | 96.61 | VITSDYINTSL | 2.82 | | | | | | |
| NS4B | 2334 | 0.05 | 2 | 1 | 0 | Y | ITSDYINTSLT | 99.44 | | | | | | | | |
| NS4B | 2335 | 0.05 | 2 | 1 | 0 | Y | TSDYINTSLTS | 99.44 | | | | | | | | |
| NS4B | 2336 | 0.05 | 2 | 1 | 0 | Y | SDYINTSLTSI | 99.44 | | | | | | | | |
| NS4B | 2337 | 0.05 | 2 | 1 | 0 | Y | DYINTSLTSIN | 99.44 | | | | | | | | |
| NS4B | 2338 | 0.05 | 2 | 1 | 0 | Y | YINTSLTSINV | 99.44 | | | | | | | | |
| NS4B | 2339 | 0.05 | 2 | 1 | 0 | Y | INTSLTSINVQ | 99.44 | | | | | | | | |
| NS4B | 2340 | 0.05 | 2 | 1 | 0 | Y | NTSLTSINVQA | 99.44 | | | | | | | | |
| NS4B | 2341 | 0 | 1 | 1 | 0 | Y | TSLTSINVQAS | 100 | | | | | | | | |
| NS4B | 2342 | 0.09 | 2 | 2 | 0 | Y | SLTSINVQASA | 98.87 | SLTSINVQAST | 1.13 | | | | | | |
| NS4B | 2343 | 0.09 | 2 | 2 | 0 | Y | LTSINVQASAL | 98.87 | LTSINVQASTL | 1.13 | | | | | | |
| NS4B | 2344 | 0.24 | 3 | 3 | 0 | Y | TSINVQASALF | 96.61 | TSINVQASALY | 2.26 | TSINVQASTLF | 1.13 | | | | |
| NS4B | 2345 | 0.24 | 3 | 3 | 0 | Y | SINVQASALFT | 96.61 | SINVQASALYS | 2.26 | SINVQASTLFT | 1.13 | | | | |
| NS4B | 2346 | 0.24 | 3 | 3 | 0 | Y | INVQASALFTL | 96.61 | INVQASALYSL | 2.26 | INVQASTLFTL | 1.13 | | | | |
| NS4B | 2347 | 0.46 | 4 | 4 | 0 | Y | NVQASALFTLA | 93.22 | NVQASALFTLS | 3.39 | NVQASALYSLA | 2.26 | NVQASTLFTLA | 1.13 | | |
| NS4B | 2348 | 0.46 | 4 | 4 | 0 | Y | VQASALFTLAR | 93.22 | VQASALFTLSR | 3.39 | VQASALYSLAR | 2.26 | VQASTLFTLAR | 1.13 | | |
| NS4B | 2349 | 0.46 | 4 | 4 | 0 | Y | QASALFTLARG | 93.22 | QASALFTLSRG | 3.39 | QASALYSLARG | 2.26 | QASTLFTLARG | 1.13 | | |
| NS4B | 2350 | 0.46 | 4 | 4 | 0 | Y | ASALFTLARGF | 93.22 | ASALFTLSRGF | 3.39 | ASALYSLARGF | 2.26 | ASTLFTLARGF | 1.13 | | |
| NS4B | 2351 | 0.46 | 4 | 4 | 0 | Y | SALFTLARGFP | 93.22 | SALFTLSRGFP | 3.39 | SALYSLARGFP | 2.26 | STLFTLARGFP | 1.13 | | |
| NS4B | 2352 | 0.46 | 4 | 4 | 0 | Y | ALFTLARGFPP | 93.22 | ALFTLSRGFPP | 3.39 | ALYSLARGFPP | 2.26 | TLFTLARGFPF | 1.13 | | |
| NS4B | 2353 | 0.37 | 3 | 3 | 0 | Y | LFTLARGFPPV | 94.35 | LFTLSRGFPPV | 3.39 | LYSLARGFPPV | 2.26 | | | | |
| NS4B | 2354 | 0.37 | 3 | 3 | 0 | Y | FTLARGFPPVD | 94.35 | FTLSRGFPPVD | 3.39 | YSLARGFPPVD | 2.26 | | | | |
| NS4B | 2355 | 0.37 | 3 | 3 | 0 | Y | TLARGFPPVDV | 94.35 | TLSRGFPPVDV | 3.39 | SLARGFPPVDV | 2.26 | | | | |
| NS4B | 2356 | 0.21 | 2 | 2 | 0 | Y | LARGFPPVDVG | 96.61 | LSRGFPPVDVG | 3.39 | | | | | | |
| NS4B | 2357 | 0.3 | 3 | 3 | 0 | Y | ARGFPPVDVGV | 95.48 | SRGFPPVDVGV | 3.39 | ARGFPPVDVGI | 1.13 | | | | |

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2393 | 0.19 | 4 | 3 | 0.56 | Y | FCHYAYMVPGW | 97.18 | LCHYAYMVPGW | 1.13 | FCHYAYMVPGG | 0.56 | | |
| NS4B | 2394 | 0.1 | 3 | 2 | 0 | Y | CHYAYMVPGWQ | 98.87 | CHYAYMIPGWQ | 0.56 | | | | |
| NS4B | 2395 | 0.1 | 3 | 2 | 0 | Y | HYAYMVPGWQA | 98.87 | HYAYM

Species: WNV (11-mers)

| protein | block starting position | block entropy | total peptides in block | # peptides required to cover 99% of block | gap/k fraction | 99% of block covered w/ <= 5 peptides? | peptides required to cover 99% of block | frequency | peptides required to cover 99% of block |

FIG. 26-80

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required

FIG. 26-81

Species: WNV (11-mers)

| protein | block starting position | block entropy | total peptides in

FIG. 26-82

Species: WNV (11-mers)

| protein | block starting position | block entropy | total peptides in block | # peptides required to cover 99% of block | gap/X fraction | 99% of block covered w/ <= 5 peptides?

FIG. 26-83

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 26-84

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2609 | 0 | 1 | 1 | 0 | Y | LGCGRGGWCYY | 100 | | | | | | |
| NS5 | 2610 | 0 | 1 | 1 | 0 | Y | GCGRGGWCYYM | 100 | | | | | | |
| NS5 | 2611 | 0 | 1 | 1 | 0 | Y | CGRGGWCYYMA | 100 | | | | | | |
| NS5 | 2612 | 0 | 1 | 1 | 0 | Y | GRGGWCYYMAT | 100 | | | | | | |
| NS5 | 2613 | 0 | 1 | 1 | 0 | Y | RGGWCYYMATQ | 100 | | | | | | |
| NS5 | 2614 | 0 | 1 | 1 | 0 | Y | GGWCYYMATQK | 100 | | | | | | |
| NS5 | 2615 | 0.05 | 2 | 1 | 0 | Y | GWCYYMATQKR | 99.44 | | | | | | |
| NS5 | 2616 | 0.05 | 2 | 1 | 0 | Y | WCYYMATQKRV | 99.44 | | | | | | |
| NS5 | 2617 | 0.05 | 2 | 1 | 0 | Y | CYYMATQKRVQ | 99.44 | | | | | | |
| NS5 | 2618 | 0.05 | 2 | 1 | 0 | Y | YYMATQKRVQE | 99.44 | | | | | | |
| NS5 | 2619 | 0.05 | 2 | 1 | 0 | Y | YMATQKRVQEV | 99.44 | | | | | | |
| NS5 | 2620 | 0.51 | 3 | 2 | 0 | Y | MATQKRVQEVR | 89.83 | MATQKRVQEVK | 9.6 | | | | |
| NS5 | 2621 | 0.51 | 3 | 2 | 0 | Y | ATQKRVQEVRG | 89.83 | ATQKRVQEVKG | 9.6 | | | | |
| NS5 | 2622 | 0.51 | 3 | 2 | 0 | Y | TQKRVQEVRGY | 89.83 | TQKRVQEVKGY | 9.6 | | | | |
| NS5 | 2623 | 0.51 | 3 | 2 | 0 | Y | QKRVQEVRGYT | 89.83 | QKRVQEVKGYT | 9.6 | | | | |
| NS5 | 2624 | 0.51 | 3 | 2 | 0 | Y | KRVQEVRGYTK | 89.83 | KRVQEVKGYTK | 9.6 | | | | |
| NS5 | 2625 | 0.56 | 4 | 3 | 0.56 | Y | RVQEVRGYTKG | 88.7 | RVQEVKGYTKG | 9.6 | RVQEVRGYTKR | 0.56 | | |
| NS5 | 2626 | 0.53 | 3 | 2 | 0.56 | Y | VQEVRGYTKGG | 88.7 | VQEVKGYTKGG | 10.17 | | | | |
| NS5 | 2627 | 0.53 | 3 | 2 | 0.56 | Y | QEVRGYTKGGP | 88.7 | QEVKGYTKGGP | 10.17 | | | | |
| NS5 | 2628 | 0.53 | 3 | 2 | 0.56 | Y | EVRGYTKGGPG | 88.7 | EVKGYTKGGPG | 10.17 | | | | |
| NS5 | 2629 | 0.53 | 3 | 2 | 0.56 | Y | VRGYTKGGPGH | 88.7 | VRGYTKGGPGH | 10.17 | | | | |
| NS5 | 2630 | 0.53 | 3 | 2 | 0.56 | Y | RGYTKGGPGHE | 88.7 | KGYTKGGPGHE | 10.17 | | | | |
| NS5 | 2631 | 0.05 | 2 | 1 | 0.56 | Y | GYTKGGPGHEE | 98.87 | | | | | | |
| NS5 | 2632 | 0.05 | 2 | 1 | 0.56 | Y | YTKGGPGHEEP | 98.87 | | | | | | |
| NS5 | 2633 | 0.05 | 2 | 1 | 0.56 | Y | TKGGPGHEEPQ | 98.87 | | | | | | |

FIG. 26-85

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | fr

FIG. 26-86

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|

FIG. 26-87

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2684 | 0.69 | 4 | 3 | 0 | Y | EVEEHRTIRVL | 86.44 | EVEEHRTVRVL | 10.73 | EVEEHRTLRVL | 2.26 | | |
| NS5 | 2685 | 0.69 | 4 | 3 | 0 | Y | VEEHRTIRVLE | 86.44 | VEEHRTVRVLE | 10.73 | VEEHRTLRVLE | 2.26 | | |
| NS5 | 2686 | 0.74 | 5 | 4 | 0 | Y | EEHRTIRVLEM | 85.88 | EEHRTVRVLEM | 10.73 | EEHRTLRVLEM | 2.26 | EEHRTMRVLEM | 0.56 |
| NS5 | 2687 | 0.74 | 5 | 4 | 0 | Y | EHRTIRVLEMV | 85.88 | EHRTVRVLEMV | 10.73 | EHRTLRVLEMV | 2.26 | EHRTMRVLEMV | 0.56 |
| NS5 | 2688 | 0.74 | 5 | 4 | 0 | Y | HRTIRVLEMVE | 85.88 | HRTVRVLEMVE | 10.73 | HRTLRVLEMVE | 2.26 | HRTIRVLEIVE | 0.56 |
| NS5 | 2689 | 0.74 | 5 | 4 | 0 | Y | RTIRVLEMVED | 85.88 | RTVRVLEMVED | 10.73 | RTLRVLEMVED | 2.26 | RTIRVLEIVED | 0.56 |
| NS5 | 2690 | 0.74 | 5 | 4 | 0 | Y | TIRVLEMVEDW | 85.88 | TVRVLEMVEDW | 10.73 | TLRVLEMVEDW | 2.26 | TIRVLEIVEDW | 0.56 |
| NS5 | 2691 | 0.74 | 5 | 4 | 0 | Y | IRVLEMVEDWL | 85.88 | VRVLEMVEDWL | 10.73 | LRVLEMVEDWL | 2.26 | IRVLEIVEDWL | 0.56 |
| NS5 | 2692 | 0.05 | 2 | 1 | 0 | Y | RVLEMVEDWLH | 99.44 | | | | | | |
| NS5 | 2693 | 0.05 | 2 | 1 | 0 | Y | VLEMVEDWLHR | 99.44 | | | | | | |
| NS5 | 2694 | 0.05 | 2 | 1 | 0 | Y | LEMVEDWLHRG | 99.44 | | | | | | |
| NS5 | 2695 | 0.05 | 2 | 1 | 0 | Y | EMVEDWLHRGP | 99.44 | | | | | | |
| NS5 | 2696 | 0.67 | 3 | 2 | 0 | Y | MVEDWLHRGPR | 84.18 | MVEDWLHRGPK | 15.25 | | | | |
| NS5 | 2697 | 0.62 | 2 | 2 | 0 | Y | VEDWLHRGPRE | 84.75 | VEDWLHRGPKE | 15.25 | | | | |
| NS5 | 2698 | 0.62 | 2 | 2 | 0 | Y | EDWLHRGPREF | 84.75 | EDWLHRGPKEF | 15.25 | | | | |
| NS5 | 2699 | 0.62 | 2 | 2 | 0 | Y | DWLHRGPREFC | 84.75 | DWLHRGPKEFC | 15.25 | | | | |
| NS5 | 2700 | 0.81 | 4 | 3 | 0 | Y | WLHRGPREFCV | 84.18 | WLHRGPKEFCI | 9.6 | WLHRGPKEFCV | 5.65 | | |
| NS5 | 2701 | 0.81 | 4 | 3 | 0 | Y | LHRGPREFCVK | 84.18 | LHRGPKEFCIK | 9.6 | LHRGPKEFCVK | 5.65 | | |
| NS5 | 2702 | 0.81 | 4 | 3 | 0 | Y | HRGPREFCVKV | 84.18 | HRGPKEFCIKV | 9.6 | HRGPKEFCVKV | 5.65 | | |
| NS5 | 2703 | 0.81 | 4 | 3 | 0 | Y | RGPREFCVKVL | 84.18 | RGPKEFCIKVL | 9.6 | RGPKEFCVKVL | 5.65 | | |
| NS5 | 2704 | 0.81 | 4 | 3 | 0 | Y | GPREFCVKVLC | 84.18 | GPKEFCIKVLC | 9.6 | GPKEFCVKVLC | 5.65 | | |
| NS5 | 2705 | 0.81 | 4 | 3 | 0 | Y | PREFCVKVLCP | 84.18 | PKEFCIKVLCP | 9.6 | PKEFCVKVLCP | 5.65 | | |
| NS5 | 2706 | 0.81 | 4 | 3 | 0 | Y | REFCVKVLCPY | 84.18 | KEFCIKVLCPY | 9.6 | KEFCVKVLCPY | 5.65 | | |
| NS5 | 2707 | 0.47 | 2 | 2 | 0 | Y | EFCVKVLCPYM | 89.83 | EFCIKVLCPYM | 10.17 | | | | |
| NS5 | 2708 | 0.47 | 2 | 2 | 0 | Y | FCVKVLCPYMP | 89.83 | FCIKVLCPYMP | 10.17 | | | | |

FIG. 26-88

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 26-89

Species: WNV (11-mers)

| protein | block starting position | block entropy | total peptides in block | # peptides required to cover 99% of block | gap/X fraction | 99% of block covered w/ <= 5 peptides? | peptides required to cover 99% of block

FIG. 26-90

Species: WNV (11-mers)

| protein | block starting position | block entropy | total peptides in block | # peptides required to cover 99% of block | gap/K fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2767 | 0.54 | 2 | 2 | 0 | Y | QVLLGRMEKRT | 87.57 | QVLLGRMEKKT | 12.43 | | | | |
| NS5 | 2768 | 0.54 | 2 | 2 | 0 | Y | VLLGRMEKRTW | 87.57 | VLLGRMEKKTW | 12.43 | | | | |
| NS5 | 2769 | 0.54 | 2 | 2 | 0 | Y | LLGRMEKRTWK | 87.57 | LLGRMEKKTWK | 12.43 | | | | |
| NS5 | 2770 | 0.54 | 2 | 2 | 0 | Y | LGRMEKRTWKG | 87.57 | LGRMEKKTWKG | 12.43 | | | | |
| NS5 | 2771 | 0.63 | 3 | 3 | 0 | Y | GRMEKRTWKGP | 87.57 | GRMEKKTWKGP | 10.17 | GRMEKKTWKGA | 2.26 | | |
| NS5 | 2772 | 0.66 | 4 | 3 | 0 | Y | RMEKRTWKGPQ | 87.57 | RMEKKTWKGPQ | 9.6 | RMEKKTWKGAH | 2.26 | | |
| NS5 | 2773 | 0.79 | 6 | 5 | 0 | Y | MEKRTWKGPQY | 87.01 | MEKKTWKGPQF | 6.78 | MEKKTWKGAHY | 2.26 | MEKRTWKGPQF | 0.56 |
| NS5 | 2774 | 0.79 | 6 | 5 | 0 | Y | EKRTWKGPQYE | 87.01 | EKKTWKGPQFE | 6.78 | EKKTWKGAHYE | 2.26 | EKRTWKGPQFE | 0.56 |
| NS5 | 2775 | 0.79 | 6 | 5 | 0 | Y | KRTWKGPQYEE | 87.01 | KKTWKGPQFEE | 6.78 | KKTWKGAHYEE | 2.26 | KRTWKGPQFEE | 0.56 |
| NS5 | 2776 | 0.79 | 6 | 5 | 0 | Y | RTWKGPQYEED | 87.01 | KTWKGPQFEED | 6.78 | KTWKGAHYEED | 2.26 | KTWKGPHYEED | 0.56 |
| NS5 | 2777 | 0.76 | 6 | 5 | 0 | Y | TWKGPQYEEDV | 87.01 | TWKGPQFEEDV | 7.34 | TWKGAHYEEDV | 2.26 | | |
| NS5 | 2778 | 0.81 | 6 | 5 | 0 | Y | WKGPQYEEDVN | 86.44 | WKGPQFEEDVN | 7.34 | WKGAHYEEDVN | 2.26 | WKGPQYEEDVS | 0.56 |
| NS5 | 2779 | 0.81 | 6 | 5 | 0 | Y | KGPQYEEDVNL | 86.44 | KGPQFEEDVNL | 7.34 | KGAHYEEDVNL | 2.26 | KGPHYEEDVNL | 0.56 |
| NS5 | 2780 | 0.81 | 6 | 5 | 0 | Y | GPQYEEDVNLG | 86.44 | GPQFEEDVNLG | 7.34 | GAHYEEDVNLG | 2.26 | GPHYEEDVNLG | 0.56 |
| NS5 | 2781 | 0.81 | 6 | 5 | 0 | Y | PQYEEDVNLGS | 86.44 | PQFEEDVNLGS | 7.34 | AHYEEDVNLGS | 2.26 | PHYEEDVNLGS | 0.56 |
| NS5 | 2782 | 0.79 | 5 | 4 | 0 | Y | QYEEDVNLGSG | 86.44 | QFEEDVNLGSG | 7.34 | QYEEDANLGSG | 2.82 | | |
| NS5 | 2783 | 0.61 | 4 | 3 | 0 | Y | YEEDVNLGSGT | 89.27 | FEEDVNLGSGT | 7.34 | YEEDANLGSGT | 2.82 | | |
| NS5 | 2784 | 0.24 | 3 | 2 | 0 | Y | EEDVNLGSGTR | 96.61 | EEDANLGSGTR | 2.82 | | | | |
| NS5 | 2785 | 0.24 | 3 | 2 | 0 | Y | EDVNLGSGTRA | 96.61 | EDANLGSGTRA | 2.82 | | | | |
| NS5 | 2786 | 0.24 | 3 | 2 | 0 | Y | DVNLGSGTRAV | 96.61 | DANLGSGTRAV | 2.82 | | | | |
| NS5 | 2787 | 0.24 | 3 | 2 | 0 | Y | VNLGSGTRAVG | 96.61 | ANLGSGTRAVG | 2.82 | | | | |
| NS5 | 2788 | 0.1 | 3 | 2 | 0 | Y | NLGSGTRAVGK | 98.87 | SLGSGTRAVGK | 0.56 | | | | |
| NS5 | 2789 | 0.05 | 2 | 1 | 0 | Y | LGSGTRAVGKP | 99.44 | | | | | | |
| NS5 | 2790 | 0.05 | 2 | 1 | 0 | Y | GSGTRAVGKPL | 99.44 | | | | | | |
| NS5 | 2791 | 0.05 | 2 | 1 | 0 | Y | SGTRAVGKPLL | 99.44 | | | | | | |

FIG. 26-91

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 26-92

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2843 | 0.67 | 4 | 3 | 0 | Y | KPTGSASSLVN | 85.31 | RPTGSASSLVN | 13.56 | NPTGSASSLVN | 0.56 | | |
| NS5 | 2844 | 0.05 | 2 | 1 | 0 | Y | PTGSASSLVNG | 99.44 | | | | | | |
| NS5 | 2845 | 0.05 | 2 | 1 | 0 | Y | TGSASSLVNGV | 99.44 | | | | | | |
| NS5 | 2846 | 0.05 | 2 | 1 | 0 | Y | GSASSLVNGVV | 99.44 | | | | | | |
| NS5 | 2847 | 0 | 1 | 1 | 0 | Y | SASSLVNGVVR | 100 | | | | | | |
| NS5 | 2848 | 0 | 1 | 1 | 0 | Y | ASSLVNGVVRL | 100 | | | | | | |
| NS5 | 2849 | 0 | 1 | 1 | 0 | Y | SSLVNGVVRLL | 100 | | | | | | |
| NS5 | 2850 | 0 | 1 | 1 | 0 | Y | SLVNGVVRLLS | 100 | | | | | | |
| NS5 | 2851 | 0 | 1 | 1 | 0 | Y | LVNGVVRLLSK | 100 | | | | | | |
| NS5 | 2852 | 0 | 1 | 1 | 0 | Y | VNGVVRLLSKP | 100 | | | | | | |
| NS5 | 2853 | 0 | 1 | 1 | 0 | Y | NGVVRLLSKPW | 100 | | | | | | |
| NS5 | 2854 | 0 | 1 | 1 | 0 | Y | GVVRLLSKPWD | 100 | | | | | | |
| NS5 | 2855 | 0.05 | 2 | 2 | 0 | Y | VVRLLSKPWDT | 99.44 | | | | | | |
| NS5 | 2856 | 0.05 | 2 | 2 | 0 | Y | VRLLSKPWDTI | 99.44 | | | | | | |
| NS5 | 2857 | 0.1 | 3 | 3 | 0 | Y | RLLSKPWDTIT | 98.87 | RLLSKPWDVIT | 0.56 | LLSKPWDVITN | 0.56 | | |
| NS5 | 2858 | 0.15 | 4 | 3 | 0 | Y | LLSKPWDTITN | 98.31 | LLSKPWDTITS | 0.56 | LSKPWDTITSV | 0.56 | | |
| NS5 | 2859 | 0.15 | 4 | 3 | 0 | Y | LSKPWDTITNV | 98.31 | LSKPWDVITNV | 0.56 | SKPWDVITNVT | 0.56 | | |
| NS5 | 2860 | 0.15 | 4 | 3 | 0 | Y | SKPWDTITNVT | 98.31 | SKPWDTITSVT | 0.56 | KPWDVITNVTT | 0.56 | | |
| NS5 | 2861 | 0.15 | 4 | 3 | 0 | Y | KPWDTITNVTT | 98.31 | KPWDTITSVTT | 0.56 | PWDVITNVTTM | 0.56 | | |
| NS5 | 2862 | 0.15 | 4 | 3 | 0 | Y | PWDTITNVTTM | 98.31 | PWDTIMNVTTM | 0.56 | WDVITNVTTMA | 0.56 | | |
| NS5 | 2863 | 0.15 | 4 | 3 | 0 | Y | WDTITNVTTMA | 98.31 | WDTIMNVTTMA | 0.56 | DTIMNVTTMAM | 0.56 | | |
| NS5 | 2864 | 0.15 | 4 | 3 | 0 | Y | DTITNVTTMAM | 98.31 | DTITSVTTMAM | 0.56 | DTIMNVTTMAM | 0.56 | | |
| NS5 | 2865 | 0.15 | 4 | 3 | 0 | Y | TITNVTTMAMT | 98.31 | TITSVTTMAMT | 0.56 | TITNVTTMAMT | 0.56 | | |
| NS5 | 2866 | 0.1 | 3 | 2 | 0 | Y | ITNVTTMAMTD | 98.87 | IMNVTTMAMTD | 0.56 | | | | |
| NS5 | 2867 | 0.1 | 3 | 2 | 0 | Y | TNVTTMAMTDT | 98.87 | TSVTTMAMTDT | 0.56 | | | | |

FIG. 26-93

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2868 | 0.05 | 2 | 1 | 0 | Y | NVTTMAMTDIT | 99.44 | | | | | | |
| NS5 | 2869 | 0 | 1 | 1 | 0 | Y | VTTMAMTDTTP | 100 | | | | | | |
| NS5 | 2870 | 0 | 1 | 1 | 0 | Y | TTMAMTDTTPF | 100 | | | | | | |
| NS5 | 2871 | 0 | 1 | 1 | 0 | Y | TMAMTDTTPFG | 100 | | | | | | |
| NS5 | 2872 | 0 | 1 | 1 | 0 | Y | MAMTDTTPFGQ | 100 | | | | | | |
| NS5 | 2873 | 0 | 1 | 1 | 0 | Y | AMTDTTPFGQQ | 100 | | | | | | |
| NS5 | 2874 | 0 | 1 | 1 | 0 | Y | MTDTTPFGQQR | 100 | | | | | | |
| NS5 | 2875 | 0 | 1 | 1 | 0 | Y | TDTTPFGQQRV | 100 | | | | | | |
| NS5 | 2876 | 0 | 1 | 1 | 0 | Y | DTTPFGQQRVF | 100 | | | | | | |
| NS5 | 2877 | 0 | 1 | 1 | 0 | Y | TTPFGQQRVFK | 100 | | | | | | |
| NS5 | 2878 | 0 | 1 | 1 | 0 | Y | TPFGQQRVFKE | 100 | | | | | | |
| NS5 | 2879 | 0 | 1 | 1 | 0 | Y | PFGQQRVFKEK | 100 | | | | | | |
| NS5 | 2880 | 0 | 1 | 1 | 0 | Y | FGQQRVFKEKV | 100 | | | | | | |
| NS5 | 2881 | 0 | 1 | 1 | 0 | Y | GQQRVFKEKVD | 100 | | | | | | |
| NS5 | 2882 | 0 | 1 | 1 | 0 | Y | QQRVFKEKVDT | 100 | | | | | | |
| NS5 | 2883 | 0 | 1 | 1 | 0 | Y | QRVFKEKVDTK | 100 | | | | | | |
| NS5 | 2884 | 0 | 1 | 1 | 0 | Y | RVFKEKVDTKA | 100 | | | | | | |
| NS5 | 2885 | 0 | 1 | 1 | 0 | Y | VFKEKVDTKAP | 100 | | | | | | |
| NS5 | 2886 | 0 | 1 | 1 | 0 | Y | FKEKVDTKAPE | 100 | | | | | | |
| NS5 | 2887 | 0 | 1 | 1 | 0 | Y | KEKVDTKAPEP | 100 | | | | | | |
| NS5 | 2888 | 0.16 | 2 | 2 | 0 | Y | EKVDTKAPEPP | 97.74 | EKVDTKAPEPA | 2.26 | | | | |
| NS5 | 2889 | 0.21 | 3 | 2 | 0 | Y | KVDTKAPEPPE | 97.18 | KVDTKAPEPAE | 2.26 | | | | |
| NS5 | 2890 | 0.21 | 3 | 2 | 0 | Y | VDTKAPEPPEG | 97.18 | VDTKAPEPAEG | 2.26 | | | | |
| NS5 | 2891 | 0.26 | 4 | 3 | 0 | Y | DTKAPEPPEGV | 96.61 | DTKAPEPAEGV | 2.26 | DTKAPEPPAGV | 0.56 | | |
| NS5 | 2892 | 0.31 | 5 | 4 | 0 | Y | TKAPEPPEGVK | 96.05 | TKAPEPAEGVK | 2.26 | TKAPEPPEGVK | 0.56 | TKAPEPPAGVK | 0.56 |

FIG. 26-94

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 26-95

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2938 | 0 | 1 | 1 | 0 | Y | AALGAMFEEQN | 100 | | | | | | |
| NS5 | 2939 | 0 | 1 | 1 | 0 | Y | ALGAMFEEQNQ | 100 | | | | | | |
| NS5 | 2940 | 0 | 1 | 1 | 0 | Y | LGAMFEEQNQW | 100 | | | | | | |
| NS5 | 2941 | 0.68 | 3 | 3 | 0 | Y | GAMFEEQNQWR | 85.88 | GAMFEEQNQWK | 11.86 | GAMFEEQNQWS | 2.26 | | |
| NS5 | 2942 | 0.79 | 4 | 4 | 0 | Y | AMFEEQNQWRS | 85.88 | AMFEEQNQWKN | 7.91 | AMFEEQNQWKS | 3.95 | AMFEEQNQWSN | 2.26 | |
| NS5 | 2943 | 0.79 | 4 | 4 | 0 | Y | MFEEQNQWRSA | 85.88 | MFEEQNQWKNA | 7.91 | MFEEQNQWKSA | 3.95 | MFEEQNQWSNA | 2.26 | |
| NS5 | 2944 | 0.79 | 4 | 4 | 0 | Y | FEEQNQWRSAR | 85.88 | FEEQNQWKNAR | 7.91 | FEEQNQWKSAR | 3.95 | FEEQNQWSNAR | 2.26 | |
| NS5 | 2945 | 0.87 | 5 | 5 | 0 | Y | EEQNQWRSARE | 84.75 | EEQNQWKNARE | 7.91 | EEQNQWKSARE | 3.95 | EEQNQWSNARE | 2.26 | EEQNQWRSARA | 1.13 |
| NS5 | 2946 | 0.87 | 5 | 5 | 0 | Y | EQNQWRSAREA | 84.75 | EQNQWKNAREA | 7.91 | EQNQWKSAREA | 3.95 | EQNQWSNAREA | 2.26 | EQNQWRSARAA | 1.13 |
| NS5 | 2947 | 0.87 | 5 | 5 | 0 | Y | QNQWRSAREAV | 84.75 | QNQWKNAREAV | 7.91 | QNQWKSAREAV | 3.95 | QNQWSNAREAV | 2.26 | QNQWRSARAAV | 1.13 |
| NS5 | 2948 | 0.87 | 5 | 5 | 0 | Y | NQWRSAREAVE | 84.75 | NQWKNAREAVE | 7.91 | NQWKSAREAVE | 3.95 | NQWSNAREAVE | 2.26 | NQWRSARAAVE | 1.13 |
| NS5 | 2949 | 0.87 | 5 | 5 | 0 | Y | QWRSAREAVED | 84.75 | QWKNAREAVED | 7.91 | QWKSAREAVED | 3.95 | QWSNAREAVED | 2.26 | QWRSARAAVED | 1.13 |
| NS5 | 2952 | 0.75 | 6 | 5 | 0 | Y | SAREAVEDPKF | 86.44 | NAREAVEDPKF | 10.17 | SAREAVEDLKF | 1.13 | SAREAVEDSTF | 1.13 | |
| NS5 | 2953 | 0.28 | 5 | 4 | 0 | Y | AREAVEDPKFW | 96.61 | ARAAVEDPKFW | 1.13 | AREAVEDLKFW | 1.13 | AREAVEDSTFW | 0.56 | |
| NS5 | 2954 | 0.28 | 5 | 4 | 0 | Y | REAVEDPKFWE | 96.61 | RAAVEDPKFWE | 1.13 | REAVEDLKFWE | 1.13 | REAVEDSTFWE | 0.56 | |
| NS5 | 2955 | 0.28 | 5 | 4 | 0 | Y | EAVEDPKFWEM | 96.61 | AAVEDPKFWEM | 1.13 | EAVEDLKFWEM | 1.13 | EAVEDSTFWEM | 0.56 | |
| NS5 | 2956 | 0.28 | 5 | 4 | 0 | Y | AVEDPKFWEMV | 96.61 | AVEDPKFWEIV | 1.13 | AVEDLKFWEMV | 1.13 | AVEDQKFWEMV | 0.56 | |
| NS5 | 2957 | 0.28 | 5 | 4 | 0 | Y | VEDPKFWEMVD | 96.61 | VEDLKFWEMVD | 1.13 | VEDPKFWEIVD | 1.13 | VEDQKFWEMVD | 0.56 | |
| NS5 | 2958 | 0.43 | 6 | 5 | 0 | Y | EDPKFWEMVDE | 94.35 | EDPKFWEMVDD | 2.26 | EDPKFWEIVDE | 1.13 | EDLKFWEMVDE | 1.13 | EDSTFWEMVDE | 0.56 |
| NS5 | 2959 | 0.43 | 6 | 5 | 0 | Y | DPKFWEMVDEE | 94.35 | DPKFWEMVDDE | 2.26 | DPKFWEIVDEE | 1.13 | DLKFWEMVDEE | 1.13 | DQKFWEMVDEE | 0.56 |
| NS5 | 2960 | 0.43 | 6 | 5 | 0 | Y | PKFWEMVDEER | 94.92 | PKFWEMVDDER | 2.26 | PKFWEIVDEER | 1.13 | LKFWEMVDEER | 1.13 | STFWEMVDEER | 0.56 |
| NS5 | 2961 | 0.3 | 4 | 3 | 1.13 | Y | KFWEMVDEERE | 94.92 | KFWEMVDDERE | 2.26 | KFWEIVDEERE | 1.13 | | | |
| NS5 | 2962 | 0.25 | 3 | 3 | 1.13 | Y | FWEMVDEEREA | 95.48 | FWEMVDDEREA | 2.26 | FWEIVDEEREA | 1.13 | | | |
| NS5 | 2963 | 0.25 | 3 | 3 | 1.13 | Y | WEMVDEEREAH | 95.48 | WEMVDDEREAH | 2.26 | WEIVDEEREAH | 1.13 | | | |
| NS5 | 2964 | 0.25 | 3 | 3 | 1.13 | Y | EMVDEEREAHL | 95.48 | EMVDDEREAHL | 2.26 | EIVDEEREAHL | 1.13 | | | |

FIG. 26-96

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2965 | 0.25 | 3 | 3 | 1.13 | Y | MVDEEREAHLR | 95.48 | MVDDEREAHLR | 2.26 | IVDEEREAHLR | 1.13 |
| NS5 | 2966 | 0.16 | 2 | 2 | 1.13 | Y | VDEEREAHLRG | 96.61 | VDDEREAHLRG | 2.26 | | |
| NS5 | 2967 | 0.16 | 2 | 2 | 1.13 | Y | DEEREAHLRGE | 96.61 | DDEREAHLRGE | 2.26 | | |
| NS5 | 2968 | 0.16 | 2 | 2 | 1.13 | Y | EEREAHLRGEC | 96.61 | DEREAHLRGEC | 2.26 | | |
| NS5 | 2969 | 0.58 | 3 | 3 | 1.13 | Y | EREAHLRGECH | 88.14 | EREAHLRGECN | 2.26 | EREAHLRGECY | 2.26 |
| NS5 | 2970 | 0.58 | 3 | 3 | 1.13 | Y | REAHLRGECHT | 88.14 | REAHLRGECNT | 2.26 | REAHLRGECYT | 2.26 |
| NS5 | 2971 | 0.58 | 3 | 3 | 1.13 | Y | EAHLRGECHTC | 88.14 | EAHLRGECNTC | 2.26 | EAHLRGECYTC | 2.26 |
| NS5 | 2972 | 0.57 | 3 | 3 | 0 | Y | AHLRGECHTCI | 89.27 | AHLRGECNTCI | 8.47 | AHLRGECYTCI | 2.26 |
| NS5 | 2973 | 0.57 | 3 | 3 | 0 | Y | HLRGECHTCIY | 89.27 | HLRGECNTCIY | 8.47 | HLRGECYTCIY | 2.26 |
| NS5 | 2974 | 0.57 | 3 | 3 | 0 | Y | LRGECHTCIYN | 89.27 | LRGECNTCIYN | 8.47 | LRGECYTCIYN | 2.26 |
| NS5 | 2975 | 0.57 | 3 | 3 | 0 | Y | RGECHTCIYNM | 89.27 | RGECNTCIYNM | 8.47 | RGECYTCIYNM | 2.26 |
| NS5 | 2976 | 0.57 | 3 | 3 | 0 | Y | GECHTCIYNMM | 89.27 | GECNTCIYNMM | 8.47 | GECYTCIYNMM | 2.26 |
| NS5 | 2977 | 0.57 | 3 | 3 | 0 | Y | ECHTCIYNMMG | 89.27 | ECNTCIYNMMG | 8.47 | ECYTCIYNMMG | 2.26 |
| NS5 | 2978 | 0.57 | 3 | 3 | 0 | Y | CHTCIYNMMGK | 89.27 | CNTCIYNMMGK | 8.47 | CYTCIYNMMGK | 2.26 |
| NS5 | 2979 | 0.57 | 3 | 3 | 0 | Y | HTCIYNMMGKR | 89.27 | NTCIYNMMGKR | 8.47 | YTCIYNMMGKR | 2.26 |
| NS5 | 2980 | 0 | 1 | 1 | 0 | Y | TCIYNMMGKRE | 100 | | | | |
| NS5 | 2981 | 0 | 1 | 1 | 0 | Y | CIYNMMGKREK | 100 | | | | |
| NS5 | 2982 | 0.05 | 2 | 1 | 0 | Y | IYNMMGKREKK | 99.44 | | | | |
| NS5 | 2983 | 0.05 | 2 | 1 | 0 | Y | YNMMGKREKKP | 99.44 | | | | |
| NS5 | 2984 | 0.05 | 2 | 1 | 0 | Y | NMMGKREKKPG | 99.44 | | | | |
| NS5 | 2985 | 0.05 | 2 | 1 | 0 | Y | MMGKREKKPGE | 99.44 | | | | |
| NS5 | 2986 | 0.05 | 2 | 1 | 0 | Y | MGKREKKPGEF | 99.44 | | | | |
| NS5 | 2987 | 0.05 | 2 | 1 | 0 | Y | GKREKKPGEFG | 99.44 | | | | |
| NS5 | 2988 | 0.05 | 2 | 1 | 0 | Y | KREKKPGEFGK | 99.44 | | | | |
| NS5 | 2989 | 0.05 | 2 | 1 | 0 | Y | REKKPGEFGKA | 99.44 | | | | |

FIG. 26-97

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|

FIG. 26-98

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 26-99

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 26-100

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

FIG. 26-101

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3103 | 0.15 | 4 | 3 | 0 | Y | TYRHKVVKVMR | 98.31 | TYRHKVVKVMR | 0.56 | | | | |
| NS5 | 3104 | 0.15

FIG. 26-102

Species: WNV (11-mers)

|

FIG. 26-103

Species: WNV (11-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---

FIG. 26-104

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3191 | 0.05 | 2 | 1 | 0 | Y | RMAVSGDDCVW | 99.44 | | | | | | |
| NS5 | 3192 | 0.05 | 2 | 1 | 0 | Y | MAVSGDDCVVK | 99.44 | | | | | | |
| NS5 | 3193 | 0 | 1 | 1 | 0 | Y | AVSGDDCVVKP | 100 | | | | | | |
| NS5 | 3194 | 0 | 1 | 1 | 0 | Y | VSGDDCVVKPL | 100 | | | | | | |
| NS5 | 3195 | 0 | 1 | 1 | 0 | Y | SGDDCVVKPLD | 100 | | | | | | |
| NS5 | 3196 | 0 | 1 | 1 | 0 | Y | GDDCVVKPLDD | 100 | | | | | | |
| NS5 | 3197 | 0 | 1 | 1 | 0 | Y | DDCVVKPLDDR | 100 | | | | | | |
| NS5 | 3198 | 0 | 1 | 1 | 0 | Y | DCVVKPLDDRF | 100 | | | | | | |
| NS5 | 3199 | 0 | 1 | 1 | 0 | Y | CVVKPLDDRFA | 100 | | | | | | |
| NS5 | 3200 | 0.1 | 3 | 2 | 0 | Y | VVKPLDDRFAT | 98.87 | VVKPLDDRFAS | 0.56 | | | | |
| NS5 | 3201 | 0.41 | 4 | 3 | 0 | Y | VKPLDDRFATS | 93.22 | VKPLDDRFATA | 5.65 | VKPLDDRFASS | 0.56 | | |
| NS5 | 3202 | 0.41 | 4 | 3 | 0 | Y | KPLDDRFATSL | 93.22 | KPLDDRFATAL | 5.65 | KPLDDRFASSL | 0.56 | | |
| NS5 | 3203 | 0.41 | 4 | 3 | 0 | Y | PLDDRFATSLH | 93.22 | PLDDRFATALH | 5.65 | PLDDRFAISLH | 0.56 | | |
| NS5 | 3204 | 0.41 | 4 | 3 | 0 | Y | LDDRFATSLHF | 93.22 | LDDRFATALHF | 5.65 | LDDRFAISLHF | 0.56 | | |
| NS5 | 3205 | 0.41 | 4 | 3 | 0 | Y | DDRFATSLHFL | 93.22 | DDRFATALHFL | 5.65 | DDRFAISLHFL | 0.56 | | |
| NS5 | 3206 | 0.41 | 4 | 3 | 0 | Y | DRFATSLHFLN | 93.22 | DRFATALHFLN | 5.65 | DRFAISLHFLN | 0.56 | | |
| NS5 | 3207 | 0.46 | 5 | 4 | 0 | Y | RFATSLHFLNA | 92.66 | RFATALHFLNA | 5.65 | RFAISLHFLNA | 0.56 | RFAISLHFLNA | 0.56 |
| NS5 | 3208 | 0.46 | 5 | 4 | 0 | Y | FATSLHFLNAM | 92.66 | FATALHFLNAM | 5.65 | FATSLHFLNDM | 0.56 | FAISLHFLNAM | 0.56 |
| NS5 | 3209 | 0.51 | 6 | 5 | 0 | Y | ATSLHFLNAMS | 92.09 | ATALHFLNAMS | 5.65 | AISLHFLNAMS | 0.56 | ASSLHFLNAMS | 0.56 |
| NS5 | 3211 | 0.46 | 5 | 4 | 0 | Y | SLHFLNAMSKV | 92.66 | ALHFLNAMSKV | 5.65 | SLHFLNAMSQV | 0.56 | SLHFLNAMPKV | 0.56 |
| NS5 | 3212 | 0.15 | 4 | 3 | 0 | Y | LHFLNAMSKVR | 98.31 | LHFLNAMSKVR | 0.56 | LHFLNAMPKVR | 0.56 | | |
| NS5 | 3213 | 0.15 | 4 | 3 | 0 | Y | HFLNAMSKVRK | 98.31 | HFLNAMPKVRK | 0.56 | HFLNAMSQVRK | 0.56 | | |
| NS5 | 3214 | 0.15 | 4 | 3 | 0 | Y | FLNAMSKVRKD | 98.31 | FLNAMPKVRKD | 0.56 | FLNDMSKVRKD | 0.56 | | |
| NS5 | 3215 | 0.15 | 4 | 3 | 0 | Y | LNAMSKVRKDI | 98.31 | LNDMSKVRKDI | 0.56 | LNAMSQVRKDI | 0.56 | | |
| NS5 | 3216 | 0.15 | 4 | 3 | 0 | Y | NAMSKVRKDIQ | 98.31 | NAMSKVRKDIQ | 0.56 | NAMPKVRKDIQ | 0.56 | | |

FIG. 26-105

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3217 | 0.15 | 4 | 3 | 0 | Y | AMSKVRKDIQE | 98.31 | DMSKVRKDIQE | 0.56 | AMPKVRKDIQE | 0.56 | | |
| NS5 | 3218 | 0.1 | 3 | 2 | 0 | Y | MSKVRKDIQEW | 98.87 | MSQVRKDIQEW | 0.56 | | | | |
| NS5 | 3219 | 0.1 | 3 | 2 | 0 | Y | SKVRKDIQEWK | 98.87 | PKVRKDIQEWK | 0.56 | | | | |
| NS5 | 3220 | 0.05 | 2 | 1 | 0 | Y | KVRKDIQEWKP | 99.44 | | | | | | |
| NS5 | 3221 | 0 | 1 | 1 | 0 | Y | VRKDIQEWKPS | 100 | | | | | | |
| NS5 | 3222 | 0.05 | 2 | 1 | 0 | Y | RKDIQEWKPST | 99.44 | | | | | | |
| NS5 | 3223 | 0.05 | 2 | 1 | 0 | Y | KDIQEWKPSTG | 99.44 | | | | | | |
| NS5 | 3224 | 0.05 | 2 | 1 | 0 | Y | DIQEWKPSTGW | 99.44 | | | | | | |
| NS5 | 3225 | 0.05 | 2 | 1 | 0 | Y | IQEWKPSTGWY | 99.44 | | | | | | |
| NS5 | 3226 | 0.05 | 2 | 1 | 0 | Y | QEWKPSTGWYD | 99.44 | | | | | | |
| NS5 | 3227 | 0.05 | 2 | 1 | 0 | Y | EWKPSTGWYDW | 99.44 | | | | | | |
| NS5 | 3228 | 0.05 | 2 | 1 | 0 | Y | WKPSTGWYDWQ | 99.44 | | | | | | |
| NS5 | 3229 | 0.1 | 3 | 2 | 0 | Y | KPSTGWYDWQQ | 98.87 | KPSYGWYDWQQ | 0.56 | | | | |
| NS5 | 3230 | 0.1 | 3 | 2 | 0 | Y | PSTGWYDWQQV | 98.87 | PSTGWYDWQKV | 0.56 | | | | |
| NS5 | 3231 | 0.19 | 4 | 3 | 0 | Y | STGWYDWQQVP | 97.74 | STGWYDWQQVQ | 1.13 | STGWYDWQKVQ | 0.56 | | |
| NS5 | 3232 | 0.19 | 4 | 3 | 0 | Y | TGWYDWQQVPF | 97.74 | TGWYDWQQVQF | 1.13 | TGWYDWQKVQF | 0.56 | | |
| NS5 | 3233 | 0.14 | 3 | 2 | 0 | Y | GWYDWQQVPFC | 98.31 | GWYDWQQVQFC | 1.13 | | | | |
| NS5 | 3234 | 0.14 | 3 | 2 | 0 | Y | WYDWQQVPFCS | 98.31 | WYDWQQVQFCS | 1.13 | | | | |
| NS5 | 3235 | 0.14 | 3 | 2 | 0 | Y | YDWQQVPFCSN | 98.31 | YDWQQVQFCSN | 1.13 | | | | |
| NS5 | 3236 | 0.14 | 3 | 2 | 0 | Y | DWQQVPFCSNH | 98.31 | DWQQVQFCSNH | 1.13 | | | | |
| NS5 | 3237 | 0.14 | 3 | 2 | 0 | Y | WQQVPFCSNHF | 98.31 | WQQVQFCSNHF | 1.13 | | | | |
| NS5 | 3238 | 0.14 | 3 | 2 | 0 | Y | QQVPFCSNHFT | 98.31 | QQVQFCSNHFT | 1.13 | | | | |
| NS5 | 3239 | 0.14 | 3 | 2 | 0 | Y | QVPFCSNHFTE | 98.31 | QVQFCSNHFTE | 1.13 | | | | |
| NS5 | 3240 | 0.12 | 2 | 2 | 0 | Y | VPFCSNHFTEL | 98.31 | VQFCSNHFTEL | 1.69 | | | | |
| NS5 | 3241 | 0.17 | 3 | 2 | 0 | Y | PFCSNHFTELI | 97.74 | QFCSNHFTELI | 1.69 | | | | |

FIG. 26-106

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS

FIG. 26-107

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3267 | 0.49 | 2 | 2 | 0 | Y | ELVGRARISPG | 89.27 | ELIGRARISPG | 10.73 | | | | |
| NS5 | 3268 | 0.49 | 2 | 2 | 0 | Y | LVGRARISPGA | 89.27 | LIGRARISPGA | 10.73 | | | | |
| NS5 | 3269 | 0.49 | 2 | 2 | 0 | Y | VGRARISPGAG | 89.27 | IGRARISPGAG | 10.73 | | | | |
| NS5 | 3270 | 0 | 1 | 1 | 0 | Y | GRARISPGAGW | 100 | | | | | | |
| NS5 | 3271 | 0 | 1 | 1 | 0 | Y | RARISPGAGWN | 100 | | | | | | |
| NS5 | 3272 | 0 | 1 | 1 | 0 | Y | ARISPGAGWNV | 100 | | | | | | |
| NS5 | 3273 | 0 | 1 | 1 | 0 | Y | RISPGAGWNVR | 100 | | | | | | |
| NS5 | 3274 | 0 | 1 | 1 | 0 | Y | ISPGAGWNVRD | 100 | | | | | | |
| NS5 | 3275 | 0 | 1 | 1 | 0 | Y | SPGAGWNVRDT | 100 | | | | | | |
| NS5 | 3276 | 0 | 1 | 1 | 0 | Y | PGAGWNVRDTA | 100 | | | | | | |
| NS5 | 3277 | 0 | 1 | 1 | 0 | Y | GAGWNVRDTAC | 100 | | | | | | |
| NS5 | 3278 | 0 | 1 | 1 | 0 | Y | AGWNVRDTACL | 100 | | | | | | |
| NS5 | 3279 | 0 | 1 | 1 | 0 | Y | GWNVRDTACLA | 100 | | | | | | |
| NS5 | 3280 | 0 | 1 | 1 | 0 | Y | WNVRDTACLAK | 100 | | | | | | |
| NS5 | 3281 | 0 | 1 | 1 | 0 | Y | NVRDTACLAKS | 100 | | | | | | |
| NS5 | 3282 | 0 | 1 | 1 | 0 | Y | VRDTACLAKSY | 100 | | | | | | |
| NS5 | 3283 | 0 | 1 | 1 | 0 | Y | RDTACLAKSYA | 100 | | | | | | |
| NS5 | 3284 | 0 | 1 | 1 | 0 | Y | DTACLAKSYAQ | 100 | | | | | | |
| NS5 | 3285 | 0 | 1 | 1 | 0 | Y | TACLAKSYAQM | 100 | | | | | | |
| NS5 | 3286 | 0 | 1 | 1 | 0 | Y | ACLAKSYAQMW | 100 | | | | | | |
| NS5 | 3287 | 0.16 | 2 | 2 | 0 | Y | CLAKSYAQMWL | 97.74 | CLAKSYAQMWQ | 2.26 | | | | |
| NS5 | 3288 | 0.16 | 2 | 2 | 0 | Y | LAKSYAQMWLL | 97.74 | LAKSYAQMWQL | 2.26 | | | | |
| NS5 | 3289 | 0.16 | 2 | 2 | 0 | Y | AKSYAQMWLLL | 97.74 | AKSYAQMWQLL | 2.26 | | | | |
| NS5 | 3290 | 0.16 | 2 | 2 | 0 | Y | KSYAQMWLLLY | 97.74 | KSYAQMWQLLY | 2.26 | | | | |
| NS5 | 3291 | 0.16 | 2 | 2 | 0 | Y | SYAQMWLLLYF | 97.74 | SYAQMWQLLYF | 2.26 | | | | |

FIG. 26-108

Species: WNV (11-mers)

| protein | block starting position | block entropy | total peptides

FIG. 26-109

Species: WNV (11-mers)

| protein | block starting position | block entropy | total peptides in block | # peptides required to cover 99% of block | gap/X fraction | 99% of block covered w/ <= 5 peptides? | peptides required

FIG. 26-110

Species: WNV (11-mers)

| protein | block starting position | block entropy | total peptides in block | # peptides required to cover 99% of block | gap/X fraction | 99% of block covered w/ <= 5 peptides?

FIG. 26-111

Species: WNV (11

FIG. 26-112

Species: WNV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3395 | 0.5 | 4 | 3 | 0 | Y | ENIQVAINQVR | 90.96 | ENIHVAINQVR | 7.91 | ENIQVAIGQVR | 0.56 | | |
| NS5 | 3396 | 0.62 | 5 | 4 | 0 | Y | NIQVAINQVRA | 89.27 | NIHVAINQVRS | 7.91 | NIQVAINQVRS | 1.69 | NIQVAINQVKA | 0.56 |
| NS5 | 3407 | 0.59 | 4 | 3 | 0 | Y | IIGDEKYVDYM | 88.7 | VIGEEKYVDYM | 9.6 | IIGEEKYVDYM | 1.13 | | |
| NS5 | 3408 | 0.63 | 4 | 3 | 0 | Y | IGDEKYVDYMS | 88.7 | IGEEKYVDYMS | 7.91 | IGEEKYVDYMG | 2.82 | | |
| NS5 | 3409 | 0.63 | 4 | 3 | 0 | Y | GDEKYVDYMSS | 88.7 | GEEKYVDYMSS | 7.91 | GEEKYVDYMGS | 2.82 | | |
| NS5 | 3410 | 0.63 | 5 | 4 | 0 | Y | DEKYVDYMSSL | 89.27 | EEKYVDYMSSL | 7.91 | EEKYVDYMGSL | 2.82 | | |
| NS5 | 3411 | 0.63 | 4 | 3 | 0 | Y | EKYVDYMSSLK | 89.27 | EKYVDYMSSLR | 7.34 | EKYVDYMGSLK | 2.26 | GKYVDYMSSLR | 0.56 |
| NS5 | 3412 | 0.6 | 4 | 3 | 0 | Y | KYVDYMSSLKR | 89.27 | KYVDYMSSLRR | 7.91 | KYVDYMGSLKR | 2.26 | | |
| NS5 | 3413 | 0.6 | 4 | 3 | 0 | Y | YVDYMSSLKRY | 89.27 | YVDYMSSLRRY | 7.91 | YVDYMGSLKRY | 2.26 | | |
| NS5 | 3414 | 0.6 | 4 | 3 | 0 | Y | VDYMSSLKRYE | 89.27 | VDYMSSLRRYE | 7.91 | VDYMGSLKRYE | 2.26 | | |
| NS5 | 3415 | 0.63 | 5 | 4 | 0 | Y | DYMSSLKRYED | 89.27 | DYMSSLRRYED | 7.34 | DYMGSLKRYEE | 2.26 | DYMSSLRRYEE | 0.56 |

Fig. 27-1

Species: YFV (8-mers)

| protein | block starting position | entropy | total peptides in block | # peptides required to cover 99% of block | gap/X fraction | 99% of block covered w/ <= 5 peptides? | peptides required to cover 99% of block | frequency | pe

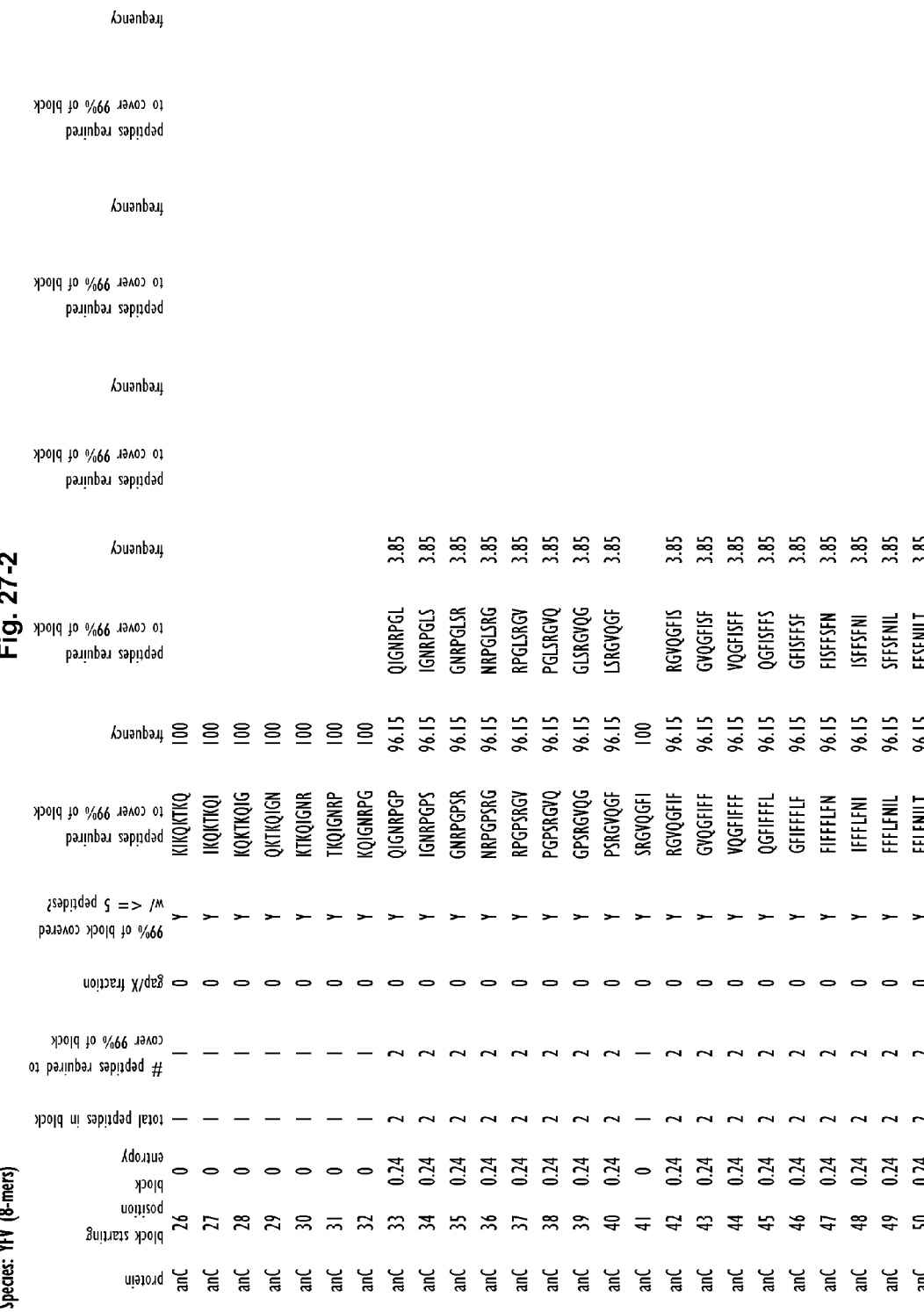

Fig. 27-3

Species: YFV (8-mers)

| protein | block starting position | entropy | total peptides in block | # peptides required to cover 99% of block | gap/X fraction | 99% of block covered w/

Fig. 27-4

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 76 | 0.62 | 3 | 3 | 0 | Y | QGLAVLRK | 88.46 | QGLAALRK | 7.69 | QGLTVLRK | 3.85 | | |
| anC | 77 | 0.62 | 3 | 3 | 0 | Y | GLAVLRKV | 88.46 | GLAALRKV | 7.69 | GLTVLRKV | 3.85 | | |
| anC | 78 | 0.62 | 3 | 3 | 0 | Y | LAVLRKVK | 88.46 | LAALRKVK | 7.69 | LTVLRKVK | 3.85 | | |
| anC | 79 | 0.62 | 3 | 3 | 0 | Y | AVLRKVKR | 88.46 | AALRKVKR | 7.69 | TVLRKVKR | 3.85 | | |
| anC | 80 | 0.39 | 2 | 2 | 0 | Y | VLRKVKRV | 92.31 | ALRKVKRV | 7.69 | | | | |
| anC | 81 | 0 | 1 | 1 | 0 | Y | LRKVKRVV | 100 | | | | | | |
| anC | 82 | 0 | 1 | 1 | 0 | Y | RKVKRVVA | 100 | | | | | | |
| anC | 83 | 0.52 | 2 | 2 | 0 | Y | KVKRVVAS | 88.46 | KVKRVVAG | 11.54 | | | | |
| anC | 84 | 0.52 | 2 | 2 | 0 | Y | VKRVVASL | 88.46 | VKRVVAGL | 11.54 | | | | |
| anC | 85 | 0.52 | 2 | 2 | 0 | Y | KRVVASLM | 88.46 | KRVVAGLM | 11.54 | | | | |
| anC | 86 | 0.74 | 3 | 3 | 0 | Y | RVVASLMR | 84.62 | RVVAGLMR | 11.54 | RVVASLMI | 3.85 | | |
| anC | 87 | 0.74 | 3 | 3 | 0 | Y | VVASLMRG | 84.62 | VVAGLMRG | 11.54 | VVASLMIG | 3.85 | | |
| anC | 88 | 0.74 | 3 | 3 | 0 | Y | VASLMRGL | 84.62 | VAGLMRGL | 11.54 | VASLMIGL | 3.85 | | |
| anC | 89 | 0.74 | 3 | 3 | 0 | Y | ASLMRGLS | 84.62 | AGLMRGLS | 11.54 | ASLMIGLS | 3.85 | | |
| anC | 90 | 0.74 | 3 | 3 | 0 | Y | SLMRGLSS | 84.62 | GLMRGLSS | 11.54 | SLMIGLSS | 3.85 | | |
| anC | 91 | 0.24 | 2 | 2 | 0 | Y | LMRGLSSR | 96.15 | LMIGLSSR | 3.85 | | | | |
| anC | 92 | 0.24 | 2 | 2 | 0 | Y | MRGLSSRK | 96.15 | MIGLSSRK | 3.85 | | | | |
| anC | 93 | 0.24 | 2 | 2 | 0 | Y | RGLSSRKR | 96.15 | IGLSSRKR | 3.85 | | | | |
| anC | 94 | 0 | 1 | 1 | 0 | Y | GLSSRKRR | 100 | | | | | | |
| anC | 95 | 0 | 1 | 1 | 0 | Y | LSSRKRRS | 100 | | | | | | |
| anC | 96 | 0.62 | 3 | 3 | 0 | Y | SSRKRRSH | 88.46 | SSRKRRSN | 7.69 | SSRKRRSS | 3.85 | RKRRSSEM | 3.85 |
| anC | 97 | 0.62 | 3 | 3 | 0 | Y | SRKRRSHD | 88.46 | SRKRRSNE | 7.69 | SRKRRSSE | 3.85 | KRRSSEMT | 3.85 |
| anC | 98 | 1 | 4 | 4 | 0 | Y | RKRRSHDV | 80.77 | RKRRSNEM | 7.69 | RKRRSHDA | 7.69 | TVQLILLG | 3.85 |
| anC | 99 | 1 | 4 | 4 | 0 | Y | KRRSHDVL | 80.77 | KRRSNEMA | 7.69 | KRRSHDAL | 7.69 | | |
| anC | 107 | 1.08 | 5 | 5 | 0 | Y | TVQFLILG | 80.77 | MMPLLILS | 7.69 | AVQFLILG | 3.85 | LFPLLLLG | 3.85 |

Fig. 27-5

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 108 | 0.85 | 4 | 4 | 0 | Y | VQFLILGM | 84.62 | MPLLILSM | 7.69 | FPLLLLGL | 3.85 | VQLLILGM | 3.85 |
| anC | 109 | 0.85 | 4 | 4 | 0 | Y | QFLILGML | 84.62 | PLLILSMV | 7.69 | QLLILGMI | 3.85 | PLLLLGLL | 3.85 |
| anC | 110 | 0.85 | 4 | 4 | 0 | Y | FLILGMLL | 84.62 | LLILSMVI | 7.69 | LLLILGLLA | 3.85 | LLILGMIL | 3.85 |
| anC | 111 | 0.85 | 4 | 4 | 0 | Y | LILGMLLM | 84.62 | LILSMVIL | 7.69 | LILGMILM | 3.85 | LLLGLLAL | 3.85 |
| anC | 117 | 1.19 | 5 | 5 | 0 | Y | LMTGGVTL | 76.92 | LMAGGVTL | 11.54 | ILAGGVTL | 3.85 | ILGGGVTL | 3.85 |
| anC | 119 | 1.29 | 5 | 5 | 0 | Y | TGGVTLVR | 73.08 | AGGVTLMRK | 15.38 | SGGVTLVR | 3.85 | GGGVTLVR | 3.85 |
| anC | 120 | 0.24 | 2 | 2 | 0 | Y | GGVTLVRK | 96.15 | GGVTLMRK | 3.85 | | | | |
| anC | 121 | 0.24 | 2 | 2 | 0 | Y | GVTLVRKN | 96.15 | GVTLMRKN | 3.85 | | | | |
| anC | 122 | 0.24 | 2 | 2 | 0 | Y | VTLVRKNR | 96.15 | VTLMRKNR | 3.85 | | | | |
| anC | 123 | 0.24 | 2 | 2 | 0 | Y | TLVRKNRW | 96.15 | TLMRKNRW | 3.85 | | | | |
| anC | 124 | 0.24 | 2 | 2 | 0 | Y | LVRKNRWL | 96.15 | LMRKNRWL | 3.85 | | | | |
| anC | 125 | 0.24 | 2 | 2 | 0 | Y | VRKNRWLL | 96.15 | MRKNRWLL | 3.85 | | | | |
| prM | 126 | 0 | 1 | 1 | 0 | Y | RKNRWLLL | 100 | | | | | | |
| prM | 127 | 0 | 1 | 1 | 0 | Y | KNRWLLLN | 100 | | | | | | |
| prM | 128 | 0 | 1 | 1 | 0 | Y | NRWLLLNV | 100 | | | | | | |
| prM | 129 | 0 | 1 | 1 | 0 | Y | RWLLLNVT | 100 | | | | | | |
| prM | 130 | 0.52 | 2 | 2 | 0 | Y | WLLLNVTS | 88.46 | WLLLNVTA | 11.54 | | | | |
| prM | 131 | 0.52 | 2 | 2 | 0 | Y | LLLNVTSE | 88.46 | LLLNVTAE | 11.54 | | | | |
| prM | 132 | 0.52 | 2 | 2 | 0 | Y | LLNVTSED | 88.46 | LLNVTAED | 11.54 | | | | |
| prM | 133 | 0.52 | 2 | 2 | 0 | Y | LNVTSEDL | 88.46 | LNVTAEDL | 11.54 | | | | |
| prM | 134 | 0.52 | 2 | 2 | 0 | Y | NVTSEDLG | 88.46 | NVTAEDLG | 11.54 | | | | |
| prM | 135 | 0.52 | 2 | 2 | 0 | Y | VTSEDLGK | 88.46 | VTAEDLGK | 11.54 | | | | |
| prM | 136 | 0.52 | 2 | 2 | 0 | Y | TSEDLGKT | 88.46 | TAEDLGKT | 11.54 | | | | |
| prM | 137 | 0.52 | 2 | 2 | 0 | Y | SEDLGKTF | 88.46 | AEDLGKTF | 11.54 | ALSGGVTL | | | |
| prM | 138 | 0 | 1 | 1 | 0 | Y | EDLGKTFS | 100 | | | TGGVTLMR | | | |

Fig. 27-6

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 139 | 0.7 | 4 | 4 | 0 | Y | DLGKTFSV | 88.46 | DLGKTFSM | 3.85 | DLGKTFSI | 3.85 | DLGKTFSL | 3.85 |
| prM | 140 | 0.7 | 4 | 4 | 0 | Y | LGKTFSVG | 88.46 | LGKTFSIG | 3.85 | LGKTFSLG | 3.85 | LGKTFSMG | 3.85 |
| prM | 141 | 0.93 | 5 | 5 | 0 | Y | GKTFSVGT | 84.62 | GKTFSIGT | 3.85 | GKTFSMGT | 3.85 | GKTFSLGT | 3.85 |
| prM | 142 | 0.93 | 5 | 5 | 0 | Y | KTFSVGTG | 84.62 | KTFSIGTG | 3.85 | KTFSMGTG | 3.85 | KTFSIGTG | 3.85 |
| prM | 143 | 0.93 | 5 | 5 | 0 | Y | TFSVGTGN | 84.62 | TFSLGTGN | 3.85 | TFSVGAGN | 3.85 | TFSMGTGN | 3.85 |
| prM | 144 | 0.93 | 5 | 5 | 0 | Y | FSVGTGNC | 84.62 | FSIGTGNC | 3.85 | FSMGTGNC | 3.85 | FSVGAGNC | 3.85 |
| prM | 145 | 0.93 | 5 | 5 | 0 | Y | SVGTGNCT | 84.62 | SMGTGNCT | 3.85 | SLGTGNCT | 3.85 | SVGAGNCT | 3.85 |
| prM | 146 | 0.93 | 5 | 5 | 0 | Y | VGTGNCTT | 84.62 | VGAGNCTT | 3.85 | LGTGNCTT | 3.85 | IGTGNCTT | 3.85 |
| prM | 147 | 0.24 | 2 | 2 | 0 | Y | GTGNCTTN | 96.15 | GAGNCTTN | 3.85 | | | | |
| prM | 148 | 0.24 | 2 | 2 | 0 | Y | TGNCTTNI | 96.15 | AGNCTTNI | 3.85 | | | | |
| prM | 149 | 0 | 1 | 1 | 0 | Y | GNCTTNIL | 100 | | | | | | |
| prM | 150 | 0 | 1 | 1 | 0 | Y | NCTTNILE | 100 | | | | | | |
| prM | 151 | 0 | 1 | 1 | 0 | Y | CTTNILEA | 100 | | | | | | |
| prM | 152 | 0 | 1 | 1 | 0 | Y | TTNILEAK | 100 | | | | | | |
| prM | 153 | 0 | 1 | 1 | 0 | Y | TNILEAKY | 100 | | | | | | |
| prM | 154 | 0 | 1 | 1 | 0 | Y | NILEAKYW | 100 | | | | | | |
| prM | 155 | 0 | 1 | 1 | 0 | Y | ILEAKYWC | 100 | | | | | | |
| prM | 156 | 0 | 1 | 1 | 0 | Y | LEAKYWCP | 100 | | | | | | |
| prM | 157 | 0 | 1 | 1 | 0 | Y | EAKYWCPD | 100 | | | | | | |
| prM | 158 | 0 | 1 | 1 | 0 | Y | AKYWCPDS | 100 | | | | | | |
| prM | 159 | 0 | 1 | 1 | 0 | Y | KYWCPDSM | 100 | | | | | | |
| prM | 160 | 0 | 1 | 1 | 0 | Y | YWCPDSME | 100 | | | | | | |
| prM | 161 | 0 | 1 | 1 | 0 | Y | WCPDSMEY | 100 | | | | | | |
| prM | 162 | 0 | 1 | 1 | 0 | Y | CPDSMEYN | 100 | | | | | | |
| prM | 163 | 0 | 1 | 1 | 0 | Y | PDSMEYNC | 100 | | | | | | |

Additional fifth-peptide column (where applicable):
- Row 141: GKTFSVGA, 3.85
- Row 142: KTFSLGTG, 3.85
- Row 143: TFSJGTGN, 3.85
- Row 144: FSLGTGNC, 3.85
- Row 145: SIGTGNCT, 3.85
- Row 146: MGTGNCTT, 3.85

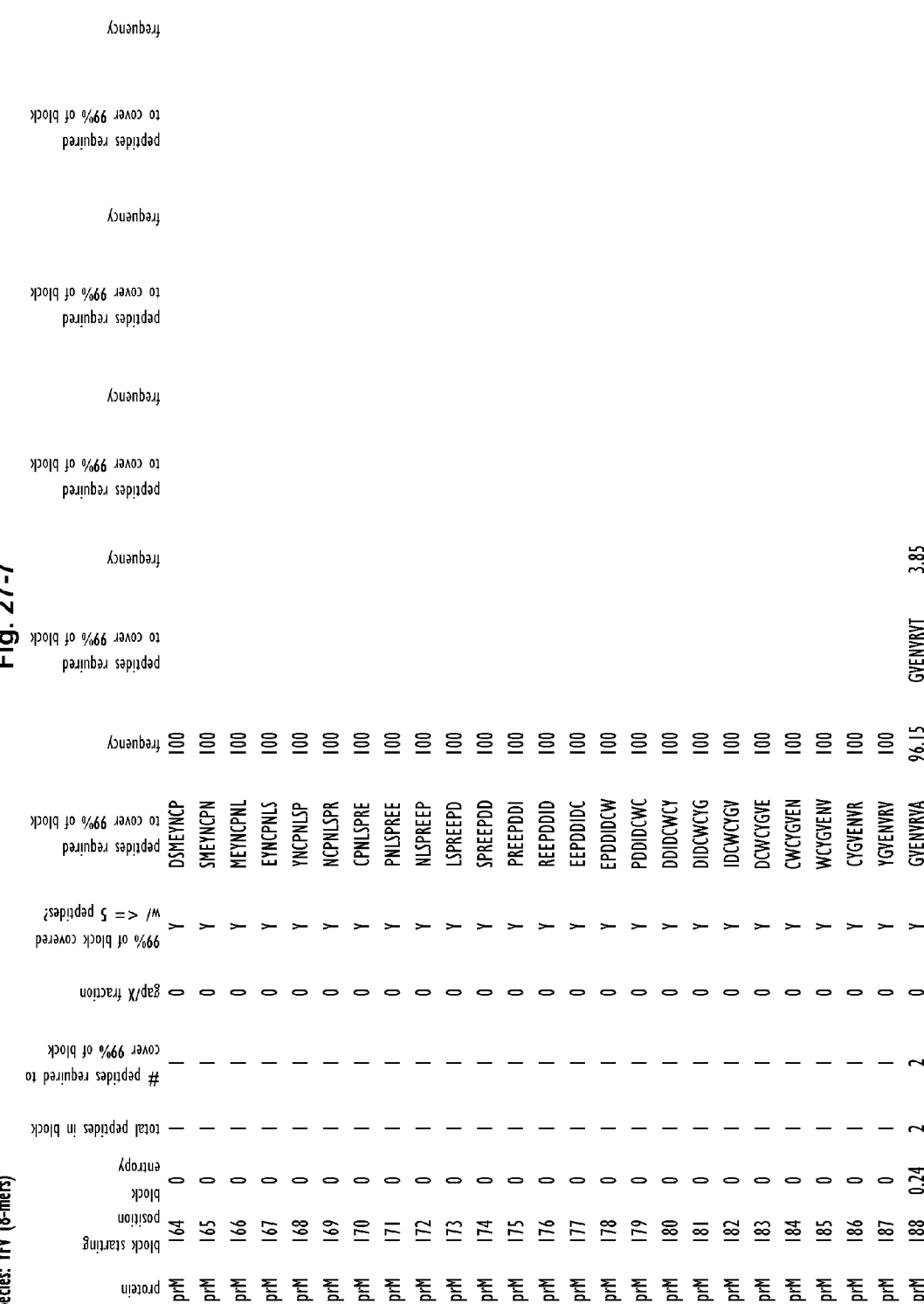

Fig. 27-8

Species: YFV (8-mers)

| protein | block starting position | block entropy | total

Fig. 27-10

Species: YFV (8

Fig. 27-11

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 264 | 0.7 | 4 | 4 | 0 | Y | GSNMTQRV | 88.46 | GNNTQRV | 3.85 | GNNKTQRV | 3.85 | GNNMTQRV | 3.85 | | |
| prM | 265 | 0.7 | 4 | 4 | 0 | Y | SNMTQRVV | 88.46 | NNKTQRVV | 3.85 | NNKTQRVV | 3.85 | NNMTQRVV | 3.85 | | |
| prM | 266 | 0.47 | 3 | 3 | 0 | Y | NMTQRVVI | 92.31 | NTTQRVVI | 3.85 | NKTQRVVI | 3.85 | | | | |
| prM | 267 | 0.47 | 3 | 3 | 0 | Y | MTQRVVIA | 92.31 | TTQRVVIA | 3.85 | KTQRVVIA | 3.85 | | | | |
| prM | 268 | 0 | 1 | 1 | 0 | Y | TQRVVIAL | 100 | | | | | | | | |
| prM | 269 | 0 | 1 | 1 | 0 | Y | QRVVIALL | 100 | | | | | | | | |
| prM | 270 | 0 | 1 | 1 | 0 | Y | RVVIALLV | 100 | | | | | | | | |
| prM | 271 | 0 | 1 | 1 | 0 | Y | VVIALLVL | 100 | | | | | | | | |
| prM | 272 | 0 | 1 | 1 | 0 | Y | VIALLVLA | 100 | | | | | | | | |
| prM | 273 | 0 | 1 | 1 | 0 | Y | IALLVLAV | 100 | | | | | | | | |
| prM | 274 | 0 | 1 | 1 | 0 | Y | ALLVLAVG | 100 | | | | | | | | |
| prM | 275 | 0 | 1 | 1 | 0 | Y | LLVLAVGP | 100 | | | | | | | | |
| prM | 276 | 0 | 1 | 1 | 0 | Y | LVLAVGPA | 100 | | | | | | | | |
| prM | 277 | 0 | 1 | 1 | 0 | Y | VLAVGPAY | 100 | | | | | | | | |
| prM | 278 | 0 | 1 | 1 | 0 | Y | LAVGPAYS | 100 | | | | | | | | |
| prM | 279 | 0 | 1 | 1 | 0 | Y | AVGPAYSA | 100 | | | | | | | | |
| prM | 280 | 0 | 1 | 1 | 0 | Y | VGPAYSAH | 100 | | | | | | | | |
| prM | 281 | 0 | 1 | 1 | 0 | Y | GPAYSAHC | 100 | | | | | | | | |
| prM | 282 | 0 | 1 | 1 | 0 | Y | PAYSAHCI | 100 | | | | | | | | |
| prM | 283 | 0 | 1 | 1 | 0 | Y | AYSAHCIG | 100 | | | | | | | | |
| prM | 284 | 0.24 | 2 | 2 | 0 | Y | YSAHCIGI | 96.15 | YSAHCIGV | 3.85 | | | | | | |
| prM | 285 | 0.24 | 2 | 2 | 0 | Y | SAHCIGIT | 96.15 | SAHCIGVA | 3.85 | | | | | | |
| prM | 286 | 0.24 | 2 | 2 | 0 | Y | AHCIGITD | 96.15 | AHCIGVAD | 3.85 | | | | | | |
| E | 287 | 0.24 | 2 | 2 | 0 | Y | HCIGITDR | 96.15 | HCIGVADR | 3.85 | | | | | | |
| E | 288 | 0.24 | 2 | 2 | 0 | Y | CIGITDRD | 96.15 | CIGVADRD | 3.85 | | | | | | |

Fig. 27-12

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 289 | 0.24 | 2 | 2 | 0 | Y | IGITDRDF | 96.15 | IGVADRDF | 3.85 | | | | |
| E | 290 | 0.24 | 2 | 2 | 0 | Y | GITDRDFI | 96.15 | GVADRDFI | 3.85 | | | | |
| E | 291 | 0.24 | 2 | 2 | 0 | Y | ITDRDFIE | 96.15 | VADRDFIE | 3.85 | | | | |
| E | 292 | 0.24 | 2 | 2 | 0 | Y | TDRDFIEG | 96.15 | ADRDFIEG | 3.85 | | | | |
| E | 293 | 0 | 1 | 1 | 0 | Y | DRDFIEGV | 100 | | | | | | |
| E | 294 | 0 | 1 | 1 | 0 | Y | RDFIEGVH | 100 | | | | | | |
| E | 295 | 0 | 1 | 1 | 0 | Y | DFIEGVHG | 100 | | | | | | |
| E | 296 | 0 | 1 | 1 | 0 | Y | FIEGVHGG | 100 | | | | | | |
| E | 297 | 0 | 1 | 1 | 0 | Y | IEGVHGGT | 100 | | | | | | |
| E | 298 | 0 | 1 | 1 | 0 | Y | EGVHGGTW | 100 | | | | | | |
| E | 299 | 0 | 1 | 1 | 0 | Y | GVHGGTWV | 100 | | | | | | |
| E | 300 | 0 | 1 | 1 | 0 | Y | VHGGTWVS | 100 | | | | | | |
| E | 301 | 0 | 1 | 1 | 0 | Y | HGGTWVSA | 100 | | | | | | |
| E | 302 | 0.24 | 2 | 2 | 0 | Y | GGTWVSAT | 96.15 | GGTWVSAS | 3.85 | | | | |
| E | 303 | 0.24 | 2 | 2 | 0 | Y | GTWVSATL | 96.15 | GTWVSASL | 3.85 | | | | |
| E | 304 | 0.24 | 2 | 2 | 0 | Y | TWVSATLE | 96.15 | TWVSASLE | 3.85 | | | | |
| E | 305 | 0.24 | 2 | 2 | 0 | Y | WVSATLEQ | 96.15 | WVSASLEQ | 3.85 | | | | |
| E | 306 | 0.47 | 3 | 3 | 0 | Y | VSATLEQD | 92.31 | VSATLEQG | 3.85 | VSASLEQD | 3.85 | | |
| E | 307 | 0.47 | 3 | 3 | 0 | Y | SATLEQDK | 92.31 | SATLEQGK | 3.85 | SASLEQDK | 3.85 | | |
| E | 308 | 0.47 | 3 | 3 | 0 | Y | ATLEQDKC | 92.31 | ATLEQGKC | 3.85 | ASLEQDKC | 3.85 | | |
| E | 309 | 0.47 | 3 | 3 | 0 | Y | TLEQDKCV | 92.31 | TLEQGKCV | 3.85 | TLEQGKCV | 3.85 | | |
| E | 310 | 0.24 | 2 | 2 | 0 | Y | LEQDKCVT | 96.15 | LEQGKCVT | 3.85 | | | | |
| E | 311 | 0.24 | 2 | 2 | 0 | Y | EQDKCVTV | 96.15 | EQGKCVTV | 3.85 | | | | |
| E | 312 | 0.24 | 2 | 2 | 0 | Y | QDKCVTVM | 96.15 | QGKCVTVM | 3.85 | | | | |
| E | 313 | 0.24 | 2 | 2 | 0 | Y | DKCVTVMA | 96.15 | GKCVTVMA | 3.85 | | | | |

Fig. 27-13

Species: YFV (8-mers)

| protein | block starting position | block ent

Fig. 27-14

| Species: YFV (8-mers) protein | block starting position | block

Fig. 27-15

Species: YFV (8-mers)

| protein

Fig. 27-16

Species: YFV (8-mers)

| protein | block starting position | block

Fig. 27-17

Species: YFV (8-mers)

| protein | block starting position | block entropy | total peptides in block | # peptides required to cover 99

Fig. 27-18

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 439 | 0.52 | 2 | 2 | 0 | Y | TDIKTLKF | 88.46 | TSIKTLKF | 11.54 | | | | | | |
| E | 440 | 0.52 | 2 | 2 | 0 | Y | DIKTLKFD | 88.46 | SIKTLKFD | 11.54 | | | | | | |
| E | 441 | 0.24 | 2 | 2 | 0 | Y | IKTLKFDA | 96.15 | IKTLKFDV | 3.85 | | | | | | |
| E | 442 | 0.24 | 2 | 2 | 0 | Y | KTLKFDAL | 96.15 | KTLKFDVL | 3.85 | | | | | | |
| E | 443 | 0.24 | 2 | 2 | 0 | Y | TLKFDALS | 96.15 | TLKFDVLS | 3.85 | | | | | | |
| E | 444 | 0.24 | 2 | 2 | 0 | Y | LKFDALSG | 96.15 | LKFDVLSG | 3.85 | | | | | | |
| E | 445 | 0.24 | 2 | 2 | 0 | Y | KFDALSGS | 96.15 | KFDVLSGS | 3.85 | | | | | | |
| E | 446 | 0.24 | 2 | 2 | 0 | Y | FDALSGSQ | 96.15 | FDVLSGSQ | 3.85 | | | | | | |
| E | 447 | 0.24 | 2 | 2 | 0 | Y | DALSGSQE | 96.15 | DVLSGSQE | 3.85 | | | | | | |
| E | 448 | 1.14 | 3 | 2 | 0 | Y | ALSGQEV | 61.54 | ALSGSQEA | 34.62 | VLSGSQEA | 3.85 | | | | |
| E | 449 | 0.96 | 2 | 3 | 0 | Y | LSGSQEVE | 61.54 | LSGSQEAE | 38.46 | | | | | | |
| E | 450 | 0.96 | 2 | 3 | 0 | Y | SGSQEVEF | 61.54 | SGSQEAEF | 38.46 | | | | | | |
| E | 451 | 1.17 | 3 | 3 | 0 | Y | GSQEVEFI | 57.69 | GSQEAEFT | 38.46 | GSQEVEFT | 3.85 | | | | |
| E | 452 | 1.17 | 3 | 3 | 0 | Y | SQEVEFIG | 57.69 | SQEAEFTG | 38.46 | SQEVEFTG | 3.85 | | | | |
| E | 453 | 1.17 | 3 | 3 | 0 | Y | QEVEFIGY | 57.69 | QEAEFTGY | 38.46 | QEVEFTGY | 3.85 | | | | |
| E | 454 | 1.17 | 3 | 3 | 0 | Y | EVEFIGYG | 57.69 | EAEFTGYG | 38.46 | EVEFTGYG | 3.85 | | | | |
| E | 455 | 1.17 | 3 | 3 | 0 | Y | VEFIGYGK | 57.69 | AEFTGYGK | 38.46 | VEFTGYGK | 3.85 | | | | |
| E | 456 | 1.17 | 3 | 3 | 0 | Y | EFIGYGKA | 57.69 | EFTGYGKA | 38.46 | EFTGYGKA | 3.85 | | | | |
| E | 457 | 1.17 | 3 | 3 | 0 | Y | FIGYGKAT | 57.69 | FTGYGKAT | 38.46 | FTGYGKVT | 3.85 | | | | |
| E | 458 | 1.17 | 3 | 3 | 0 | Y | IGYGKATL | 57.69 | TGYGKATL | 38.46 | TGYGKVTL | 3.85 | | | | |
| E | 459 | 0.24 | 2 | 2 | 0 | Y | GYGKATLE | 96.15 | GYGKVTLE | 3.85 | | | | | | |
| E | 460 | 0.24 | 2 | 2 | 0 | Y | YGKATLEC | 96.15 | YGKVTLEC | 3.85 | | | | | | |
| E | 461 | 0.47 | 3 | 3 | 0 | Y | GKATLECQ | 92.31 | GKATLECR | 3.85 | GKVTLECQ | 3.85 | | | | |
| E | 462 | 0.47 | 3 | 3 | 0 | Y | KATLECQV | 92.31 | KATLECRV | 3.85 | KVTLECQV | 3.85 | | | | |
| E | 463 | 0.47 | 3 | 3 | 0 | Y | ATLECQVQ | 92.31 | ATLECRVQ | 3.85 | VTLECQVQ | 3.85 | | | | |

Fig. 27-19

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 464 | 0.24 | 2 | 2 | 0 | Y | TLECVQT | 96.15 | TLECRVQT | 3.85 | | | | |
| E | 465 | 0.24 | 2 | 2 | 0 | Y | LECQVQTA | 96.15 | LECRVQTA | 3.85 | | | | |
| E | 466 | 0.24 | 2 | 2 | 0 | Y | ECQVQTAV | 96.15 | ECRVQTAV | 3.85 | | | | |
| E | 467 | 0.24 | 2 | 2 | 0 | Y | CQVQTAVD | 96.15 | CRVQTAVD | 3.85 | | | | |
| E | 468 | 0.24 | 2 | 2 | 0 | Y | QVQTAVDF | 96.15 | RVQTAVDF | 3.85 | | | | |
| E | 469 | 0 | 1 | 1 | 0 | Y | VQTAVDFG | 100 | | | | | | |
| E | 470 | 0 | 1 | 1 | 0 | Y | QTAVDFGN | 100 | | | | | | |
| E | 471 | 0 | 1 | 1 | 0 | Y | TAVDFGNS | 100 | | | | | | |
| E | 472 | 0 | 1 | 1 | 0 | Y | AVDFGNSY | 100 | | | | | | |
| E | 473 | 0 | 1 | 1 | 0 | Y | VDFGNSYI | 100 | | | | | | |
| E | 474 | 0 | 1 | 1 | 0 | Y | DFGNSYIA | 100 | | | | | | |
| E | 475 | 0 | 1 | 1 | 0 | Y | FGNSYIAE | 100 | | | | | | |
| E | 476 | 0 | 1 | 1 | 0 | Y | GNSYIAEM | 100 | | | | | | |
| E | 477 | 0 | 1 | 1 | 0 | Y | NSYIAEME | 100 | | | | | | |
| E | 478 | 0.96 | 2 | 2 | 0 | Y | SYIAEMET | 61.54 | SYIAEMEK | 38.46 | | | | |
| E | 479 | 1.3 | 3 | 3 | 0 | Y | YIAEMETE | 61.54 | YIAEMEKE | 26.92 | YIAEMEKD | 11.54 | | |
| E | 480 | 1.3 | 3 | 3 | 0 | Y | IAEMETES | 61.54 | IAEMEKES | 26.92 | IAEMEKDS | 11.54 | | |
| E | 481 | 1.3 | 3 | 3 | 0 | Y | AEMETESW | 61.54 | AEMEKESW | 26.92 | AEMEKDSW | 11.54 | | |
| E | 482 | 1.3 | 3 | 3 | 0 | Y | EMETESWI | 61.54 | EMEKESWI | 26.92 | EMEKDSWI | 11.54 | | |
| E | 483 | 1.3 | 3 | 3 | 0 | Y | METESWIV | 61.54 | MEKESWIV | 26.92 | MEKDSWIV | 11.54 | | |
| E | 484 | 1.3 | 3 | 3 | 0 | Y | ETESWIVD | 61.54 | EKESWIVD | 26.92 | EKDSWIVD | 11.54 | | |
| E | 485 | 1.3 | 3 | 3 | 0 | Y | TESWIVDR | 61.54 | KESWIVDR | 26.92 | KDSWIVDR | 11.54 | | |
| E | 486 | 0.52 | 2 | 2 | 0 | Y | ESWIVDRQ | 88.46 | DSWIVDRQ | 11.54 | | | | |
| E | 487 | 0 | 1 | 1 | 0 | Y | SWIVDRQW | 100 | | | | | | |
| E | 488 | 0 | 1 | 1 | 0 | Y | WIVDRQWA | 100 | | | | | | |

Fig. 27-20

Species: YFV (8-mers)

| protein | block starting position | entropy | total peptides in block | # peptides required to cover 99% of block | gap/X fraction |

Fig. 27-21

Species: YFV (8-mers)

| prot

Fig. 27-22

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 539 | 0 | 1 | 1 | 0 | Y | LKTALTGA | 100 | | |
| E | 540 | 0 | 1 | 1 | 0 | Y | KTALTGAM | 100 | | |
| E | 541 | 0 | 1 | 1 | 0 | Y | TALTGAMR | 100 | | |
| E | 542 | 0 | 1 | 1 | 0 | Y | ALTGAMRV | 100 | | |
| E | 543 | 0 | 1 | 1 | 0 | Y | LTGAMRVT | 100 | | |
| E | 544 | 0 | 1 | 1 | 0 | Y | TGAMRVTK | 100 | | |
| E | 545 | 0 | 1 | 1 | 0 | Y | GAMRVTKD | 100 | | |
| E | 546 | 0.52 | 2 | 2 | 0 | Y | AMRVTKDT | 88.46 | AMRVTKDE | 11.54 |
| E | 547 | 0.52 | 2 | 2 | 0 | Y | MRVTKDTN | 88.46 | MRVTKDEN | 11.54 |
| E | 548 | 0.52 | 2 | 2 | 0 | Y | RVTKDTND | 88.46 | RVTKDEND | 11.54 |
| E | 549 | 0.52 | 2 | 2 | 0 | Y | VTKDTNDN | 88.46 | VTKDENDN | 11.54 |
| E | 550 | 0.52 | 2 | 2 | 0 | Y | TKDTNDNN | 88.46 | TKDENDNN | 11.54 |
| E | 551 | 0.52 | 2 | 2 | 0 | Y | KDTNDNNL | 88.46 | KDENDNNL | 11.54 |
| E | 552 | 0.52 | 2 | 2 | 0 | Y | DTNDNNLY | 88.46 | DENDNNLY | 11.54 |
| E | 553 | 0.52 | 2 | 2 | 0 | Y | TNDNNLYK | 88.46 | ENDNNLYK | 11.54 |
| E | 554 | 0 | 1 | 1 | 0 | Y | NDNNLYKL | 100 | | |
| E | 555 | 0 | 1 | 1 | 0 | Y | DNNLYKLH | 100 | | |
| E | 556 | 0 | 1 | 1 | 0 | Y | NNLYKLHG | 100 | | |
| E | 557 | 0 | 1 | 1 | 0 | Y | NLYKLHGG | 100 | | |
| E | 558 | 0 | 1 | 1 | 0 | Y | LYKLHGGH | 100 | | |
| E | 559 | 0 | 1 | 1 | 0 | Y | YKLHGGHV | 100 | | |
| E | 560 | 0 | 1 | 1 | 0 | Y | KLHGGHVS | 100 | | |
| E | 561 | 0 | 1 | 1 | 0 | Y | LHGGHVSC | 100 | | |
| E | 562 | 0 | 1 | 1 | 0 | Y | HGGHVSCR | 100 | | |
| E | 563 | 0 | 1 | 1 | 0 | Y | GGHVSCRV | 100 | | |

Fig. 27-23

Species: YFV (8

Fig. 27-24

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 589 | 0.96 | 2 | 2 | 0 | Y | MFFVKNPT | 61.54 | MSFVKNPT | 38.46 |
| E | 590 | 0.96 | 2 | 2 | 0 | Y | FFVKNPTD | 61.54 | SFVKNPTD | 38.46 |
| E | 591 | 0 | 1 | 1 | 0 | Y | FVKNPTDT | 100 | | |
| E | 592 | 0.24 | 2 | 2 | 0 | Y | VKNPTDTG | 96.15 | VKNPTDTD | 3.85 |
| E | 593 | 0.24 | 2 | 2 | 0 | Y | KNPTDTGH | 96.15 | KNPTDTDH | 3.85 |
| E | 594 | 0.24 | 2 | 2 | 0 | Y | NPTDTGHG | 96.15 | NPTDTDHG | 3.85 |
| E | 595 | 0.24 | 2 | 2 | 0 | Y | PTDTGHGT | 96.15 | PTDTDHGT | 3.85 |
| E | 596 | 0.24 | 2 | 2 | 0 | Y | TDTGHGTV | 96.15 | TDTDHGTV | 3.85 |
| E | 597 | 0.24 | 2 | 2 | 0 | Y | DTGHGTVW | 96.15 | DTDHGTVW | 3.85 |
| E | 598 | 0.24 | 2 | 2 | 0 | Y | TGHGTVWM | 96.15 | TDHGTVWM | 3.85 |
| E | 599 | 0.24 | 2 | 2 | 0 | Y | GHGTVWMQ | 96.15 | DHGTVWMQ | 3.85 |
| E | 600 | 0 | 1 | 1 | 0 | Y | HGTVWMQV | 100 | | |
| E | 601 | 0 | 1 | 1 | 0 | Y | GTVWMQVK | 100 | | |
| E | 602 | 0 | 1 | 1 | 0 | Y | TVWMQVKV | 100 | | |
| E | 603 | 1 | 2 | 2 | 0 | Y | VWMQVKVP | 53.85 | VWMQVKVS | 46.15 |
| E | 604 | 1 | 2 | 2 | 0 | Y | WMQVKVPK | 53.85 | VMQVKVSK | 46.15 |
| E | 605 | 1 | 2 | 2 | 0 | Y | MQVKVPKG | 53.85 | MQVKVSKG | 46.15 |
| E | 606 | 1 | 2 | 2 | 0 | Y | QVKVPKGA | 53.85 | QVKVSKGA | 46.15 |
| E | 607 | 1 | 2 | 2 | 0 | Y | VKVPKGAP | 53.85 | VKVSKGAP | 46.15 |
| E | 608 | 1 | 2 | 2 | 0 | Y | KVPKGAPC | 53.85 | KVSKGAPC | 46.15 |
| E | 609 | 1.53 | 3 | 3 | 0 | Y | VPKGAPCR | 46.15 | VPKGAPCK | 30.77 | VPKGAPCR | 23.08 |
| E | 610 | 1.53 | 3 | 3 | 0 | Y | PKGAPCRI | 46.15 | PKGAPCKI | 30.77 | PKGAPCRI | 23.08 |
| E | 611 | 0.89 | 2 | 2 | 0 | Y | KGAPCRIP | 69.23 | KGAPCKIP | 30.77 | | |
| E | 612 | 0.89 | 2 | 2 | 0 | Y | GAPCRIPV | 69.23 | GAPCKIPV | 30.77 | | |
| E | 613 | 0.89 | 2 | 2 | 0 | Y | APCRIPVI | 69.23 | APCKIPVI | 30.77 | | |

Fig. 27-25

Species: YFV (8-mers)

| protein | block starting position | block entropy | total peptides in block | # peptides required to cover 99% of block | gap/X fraction | 99% of block covered w/ <= 5 peptides? | peptides required

Fig. 27-26

Species: YFV (8-mers)

| protein | block starting position | block entropy | total

Fig. 27-27

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 664 | 0.96 | 2 | 2 | 0 | Y | GRGDSRLT | 61.54 | GTGDSRLT | 38.46 |
| E | 665 | 0.96 | 2 | 2 | 0 | Y | RGDSRLTY | 61.54 | TGDSRLTY | 38.46 |
| E | 666 | 0 | 1 | 1 | 0 | Y | GDSRLTYQ | 100 | | |
| E | 667 | 0 | 1 | 1 | 0 | Y | DSRLTYQW | 100 | | |
| E | 668 | 0 | 1 | 1 | 0 | Y | SRLTYQWH | 100 | | |
| E | 669 | 0 | 1 | 1 | 0 | Y | RLTYQWHK | 100 | | |
| E | 670 | 0 | 1 | 1 | 0 | Y | LTYQWHKE | 100 | | |
| E | 671 | 0 | 1 | 1 | 0 | Y | TYQWHKEG | 100 | | |
| E | 672 | 0 | 1 | 1 | 0 | Y | YQWHKEGS | 100 | | |
| E | 673 | 0 | 1 | 1 | 0 | Y | QWHKEGSS | 100 | | |
| E | 674 | 0 | 1 | 1 | 0 | Y | WHKEGSSI | 100 | | |
| E | 675 | 0 | 1 | 1 | 0 | Y | HKEGSSIG | 100 | | |
| E | 676 | 0 | 1 | 1 | 0 | Y | KEGSSIGK | 100 | | |
| E | 677 | 0 | 1 | 1 | 0 | Y | EGSSIGKL | 100 | | |
| E | 678 | 0 | 1 | 1 | 0 | Y | GSSIGKLF | 100 | | |
| E | 679 | 0 | 1 | 1 | 0 | Y | SSIGKLFT | 100 | | |
| E | 680 | 0 | 1 | 1 | 0 | Y | SIGKLFTQ | 100 | | |
| E | 681 | 0 | 1 | 1 | 0 | Y | IGKLFTQT | 100 | | |
| E | 682 | 0 | 1 | 1 | 0 | Y | GKLFTQTM | 100 | | |
| E | 683 | 0 | 1 | 1 | 0 | Y | KLFTQTMK | 100 | | |
| E | 684 | 0 | 1 | 1 | 0 | Y | LFTQTMKG | 100 | | |
| E | 685 | 0.89 | 2 | 2 | 0 | Y | FTQTMKGV | 69.23 | FTQTMKGA | 30.77 |
| E | 686 | 0.89 | 2 | 2 | 0 | Y | TQTMKGVE | 69.23 | TQTMKGAE | 30.77 |
| E | 687 | 0.89 | 2 | 2 | 0 | Y | QTMKGVER | 69.23 | QTMKGAER | 30.77 |
| E | 688 | 0.89 | 2 | 2 | 0 | Y | TMKGVERL | 69.23 | TMKGAERL | 30.77 |

Fig. 27-28

Species: YFV (8-mers)

| protein | block starting position | block

Species: YFV (8-mers) — Fig. 27-29

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 714 | 0.24 | 2 | 2 | 0 | Y | SVGKGIHT | 96.15 | SIGKGSHT | 3.85 | | | | |
| E | 715 | 0.24 | 2 | 2 | 0 | Y | VGKGIHTV | 96.15 | IGKGSHTV | 3.85 | | | | |
| E | 716 | 0.24 | 2 | 2 | 0 | Y | GKGIHTVF | 96.15 | GKGSHTVF | 3.85 | | | | |
| E | 717 | 0.24 | 2 | 2 | 0 | Y | KGIHTVFG | 96.15 | KGSHTVFG | 3.85 | | | | |
| E | 718 | 0.24 | 2 | 2 | 0 | Y | GIHTVFGS | 96.15 | GSHTVFGS | 3.85 | | | | |
| E | 719 | 0.24 | 2 | 2 | 0 | Y | IHTVFGSA | 96.15 | SHTVFGSA | 3.85 | | | | |
| E | 720 | 0 | 1 | 1 | 0 | Y | HTVFGSAF | 100 | | | | | | |
| E | 721 | 0 | 1 | 1 | 0 | Y | TVFGSAFQ | 100 | | | | | | |
| E | 722 | 0 | 1 | 1 | 0 | Y | VFGSAFQG | 100 | | | | | | |
| E | 723 | 0 | 1 | 1 | 0 | Y | FGSAFQGL | 100 | | | | | | |
| E | 724 | 0 | 1 | 1 | 0 | Y | GSAFQGLF | 100 | | | | | | |
| E | 725 | 0 | 1 | 1 | 0 | Y | SAFQGLFG | 100 | | | | | | |
| E | 726 | 0 | 1 | 1 | 0 | Y | AFQGLFGG | 100 | | | | | | |
| E | 727 | 0 | 1 | 1 | 0 | Y | FQGLFGGL | 100 | | | | | | |
| E | 728 | 0.78 | 2 | 2 | 0 | Y | QGLFGGLN | 76.92 | QGLFGGLS | 23.08 | | | | |
| E | 729 | 0.78 | 2 | 2 | 0 | Y | GLFGGLNW | 76.92 | GLFGGLSW | 23.08 | | | | |
| E | 730 | 0.78 | 2 | 2 | 0 | Y | LFGGLNWI | 76.92 | LFGGLSWI | 23.08 | | | | |
| E | 731 | 0.78 | 2 | 2 | 0 | Y | FGGLNWIT | 76.92 | FGGLSWIT | 23.08 | | | | |
| E | 732 | 0.78 | 2 | 2 | 0 | Y | GGLNWITK | 76.92 | GGLSWITK | 23.08 | | | | |
| E | 733 | 0.78 | 2 | 2 | 0 | Y | GLNWITKV | 76.92 | GLSWITKV | 23.08 | | | | |
| E | 734 | 0.78 | 2 | 2 | 0 | Y | LNWITKVI | 76.92 | LSWITKVI | 23.08 | | | | |
| E | 735 | 1 | 3 | 3 | 0 | Y | NWITKVIM | 73.08 | SWITKVIM | 23.08 | NWITKVII | 3.85 | | |
| E | 736 | 0.24 | 2 | 2 | 0 | Y | WITKVIMG | 96.15 | WITKVIIG | 3.85 | | | | |
| E | 737 | 0.47 | 3 | 3 | 0 | Y | ITKVIMGA | 92.31 | ITKVIMGV | 3.85 | ITKVIIGA | 3.85 | | |
| E | 738 | 0.47 | 3 | 3 | 0 | Y | TKVIMGAV | 92.31 | TKVIMGAV | 3.85 | TKVIMGVV | 3.85 | | |

Fig. 27-30

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 739 | 0.47 | 3 | 3 | 0 | Y | KVIMGAVL | 92.31 | KVIIGAVL | 3.85 | KVIMGVVL | 3.85 | | |
| E | 740 | 0.47 | 3 | 3 | 0 | Y | VIMGAVLI | 92.31 | VIMGVVLI | 3.85 | VIIGAVLI | 3.85 | | |
| E | 741 | 0.47 | 3 | 3 | 0 | Y | IMGAVLIW | 92.31 | IIGAVLIW | 3.85 | IMGVVLIW | 3.85 | | |
| E | 742 | 0.47 | 3 | 3 | 0 | Y | MGAVLIWV | 92.31 | IGAVLIWV | 3.85 | MGVVLIWV | 3.85 | | |
| E | 743 | 0.24 | 2 | 2 | 0 | Y | GAVLIWVG | 96.15 | GVVLIWVG | 3.85 | | | | |
| E | 744 | 0.47 | 3 | 3 | 0 | Y | AVLIWVGI | 92.31 | VVLIWVGI | 3.85 | AVLIWVGF | 3.85 | | |
| E | 745 | 0.24 | 2 | 2 | 0 | Y | VLIWVGIN | 96.15 | VLIWVGFN | 3.85 | | | | |
| E | 746 | 0.24 | 2 | 2 | 0 | Y | LIWVGINT | 96.15 | LIWVGFNT | 3.85 | | | | |
| E | 747 | 0.24 | 2 | 2 | 0 | Y | IWVGINTR | 96.15 | IWVGFNTR | 3.85 | | | | |
| E | 748 | 0.24 | 2 | 2 | 0 | Y | WVGINTRN | 96.15 | WVGFNTRN | 3.85 | | | | |
| E | 749 | 0.24 | 2 | 2 | 0 | Y | VGINTRNM | 96.15 | VGFNTRNM | 3.85 | | | | |
| E | 750 | 0.24 | 2 | 2 | 0 | Y | GINTRNMT | 96.15 | GFNTRNMT | 3.85 | | | | |
| E | 751 | 0.24 | 2 | 2 | 0 | Y | INTRNMTM | 96.15 | FNTRNMTM | 3.85 | | | | |
| E | 752 | 0 | 1 | 1 | 0 | Y | NTRNMTMS | 100 | | | | | | |
| E | 753 | 0 | 1 | 1 | 0 | Y | TRNMTMSM | 100 | | | | | | |
| E | 754 | 0 | 1 | 1 | 0 | Y | RNMTMSMS | 100 | | | | | | |
| E | 755 | 0 | 1 | 1 | 0 | Y | NMTMSMSM | 100 | | | | | | |
| E | 756 | 0 | 1 | 1 | 0 | Y | MTMSMSMI | 100 | | | | | | |
| E | 757 | 0.24 | 2 | 2 | 0 | Y | TMSMSMIL | 96.15 | TMSMSMIM | 3.85 | | | | |
| E | 758 | 0.24 | 2 | 2 | 0 | Y | MSMSMILV | 96.15 | MSMSMIMV | 3.85 | | | | |
| E | 759 | 0.24 | 2 | 2 | 0 | Y | SMSMILVG | 96.15 | SMSMIMVG | 3.85 | | | | |
| E | 760 | 0.24 | 2 | 2 | 0 | Y | MSMILVGV | 96.15 | MSMIMVGV | 3.85 | | | | |
| E | 761 | 0.24 | 2 | 2 | 0 | Y | SMILVGVI | 96.15 | SMIMVGVI | 3.85 | | | | |
| E | 762 | 0.24 | 2 | 2 | 0 | Y | MILVGVIM | 96.15 | MIMVGVIM | 3.85 | | | | |
| E | 763 | 0.24 | 2 | 2 | 0 | Y | ILVGVIMM | 96.15 | IMVGVIMM | 3.85 | | | | |

Fig. 27-31

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 764 | 0.24 | 2 | 2 | 0 | Y | LVGVIMMF | 96.15 | MVGVIMMF | 3.85 | | | | |
| E | 765 | 0 | 1 | 1 | 0 | Y | VGVIMMFL | 100 | | | | | | |
| E | 766 | 0 | 1 | 1 | 0 | Y | GVIMMFLS | 100 | | | | | | |
| E | 767 | 0 | 1 | 1 | 0 | Y | VIMMFLSL | 100 | | | | | | |
| E | 768 | 0 | 1 | 1 | 0 | Y | IMMFLSLG | 100 | | | | | | |
| E | 769 | 0 | 1 | 1 | 0 | Y | MMFLSLGV | 100 | | | | | | |
| E | 770 | 0 | 1 | 1 | 0 | Y | MFLSLGVG | 100 | | | | | | |
| E | 771 | 0 | 1 | 1 | 0 | Y | FLSLGVGA | 100 | | | | | | |
| E | 772 | 0 | 1 | 1 | 0 | Y | LSLGVGAD | 100 | | | | | | |
| E | 773 | 0 | 1 | 1 | 0 | Y | SLGVGADQ | 100 | | | | | | |
| E | 774 | 0 | 1 | 1 | 0 | Y | LGVGADQG | 100 | | | | | | |
| E | 775 | 0 | 1 | 1 | 0 | Y | GVGADQGC | 100 | | | | | | |
| E | 776 | 0 | 1 | 1 | 0 | Y | VGADQGCA | 100 | | | | | | |
| E | 777 | 0.52 | 2 | 2 | 0 | Y | GADQGCAI | 88.46 | GADQGCAV | 11.54 | | | | |
| E | 778 | 0.52 | 2 | 2 | 0 | Y | ADQGCAIN | 88.46 | ADQGCAVN | 11.54 | | | | |
| E | 779 | 0.52 | 2 | 2 | 0 | Y | DQGCAINF | 88.46 | DQGCAVNF | 11.54 | | | | |
| NS1 | 780 | 0.74 | 3 | 3 | 0 | Y | QGCAINFG | 84.62 | QGCAVNFG | 11.54 | QGCAINFA | 3.85 | | |
| NS1 | 781 | 0.74 | 3 | 3 | 0 | Y | GCAINFGK | 84.62 | GCAVNFGK | 11.54 | GCAINFAK | 3.85 | | |
| NS1 | 782 | 0.74 | 3 | 3 | 0 | Y | CAINFGKR | 84.62 | CAVNFGKR | 11.54 | CAINFAKR | 3.85 | | |
| NS1 | 783 | 0.74 | 3 | 3 | 0 | Y | AINFGKRE | 84.62 | AVNFGKRE | 11.54 | AINFAKRE | 3.85 | | |
| NS1 | 784 | 0.74 | 3 | 3 | 0 | Y | INFGKREL | 84.62 | VNFGKREL | 11.54 | INFAKREL | 3.85 | | |
| NS1 | 785 | 0.24 | 2 | 2 | 0 | Y | NFGKRELK | 96.15 | NFAKRELK | 3.85 | | | | |
| NS1 | 786 | 0.24 | 2 | 2 | 0 | Y | FGKRELKC | 96.15 | FAKRELKC | 3.85 | | | | |
| NS1 | 787 | 0.24 | 2 | 2 | 0 | Y | GKRELKCG | 96.15 | AKRELKCG | 3.85 | | | | |
| NS1 | 788 | 0 | 1 | 1 | 0 | Y | KRELKCGD | 100 | | | | | | |

Fig. 27-32

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 789 | 0 | 1 | 1 | 0 | Y | RELKCGDG | 100 | | |
| NS1 | 790 | 0 | 1 | 1 | 0 | Y | ELKCGDGI | 100 | | |
| NS1 | 791 | 0 | 1 | 1 | 0 | Y | LKCGDGIF | 100 | | |
| NS1 | 792 | 0.52 | 2 | 2 | 0 | Y | KCGDGIFI | 88.46 | KCGDGIFV | 11.54 |
| NS1 | 793 | 0.52 | 2 | 2 | 0 | Y | CGDGIFIF | 88.46 | CGDGIFVF | 11.54 |
| NS1 | 794 | 0.52 | 2 | 2 | 0 | Y | GDGIFIFR | 88.46 | GDGIFVFR | 11.54 |
| NS1 | 795 | 0.52 | 2 | 2 | 0 | Y | DGIFIFRD | 88.46 | DGIFVFRD | 11.54 |
| NS1 | 796 | 0.52 | 2 | 2 | 0 | Y | GIFIFRDS | 88.46 | GIFVFRDS | 11.54 |
| NS1 | 797 | 0.52 | 2 | 2 | 0 | Y | IFIFRDSD | 88.46 | IFVFRDSD | 11.54 |
| NS1 | 798 | 0.52 | 2 | 2 | 0 | Y | FIFRDSDD | 88.46 | FVFRDSDD | 11.54 |
| NS1 | 799 | 0.52 | 2 | 2 | 0 | Y | IFRDSDDW | 88.46 | VFRDSDDW | 11.54 |
| NS1 | 800 | 0 | 2 | 1 | 0 | Y | FRDSDDWL | 100 | | |
| NS1 | 801 | 0.52 | 2 | 2 | 0 | Y | RDSDDWLN | 88.46 | RDSDDWLT | 11.54 |
| NS1 | 802 | 0.52 | 2 | 2 | 0 | Y | DSDDWLNK | 88.46 | DSDDWLTK | 11.54 |
| NS1 | 803 | 0.52 | 2 | 2 | 0 | Y | SDDWLNKY | 88.46 | SDDWLTKY | 11.54 |
| NS1 | 804 | 0.52 | 2 | 2 | 0 | Y | DDWLNKYS | 88.46 | DDWLTKYS | 11.54 |
| NS1 | 805 | 0.52 | 2 | 2 | 0 | Y | DWLNKYSY | 88.46 | DWLTKYSY | 11.54 |
| NS1 | 806 | 0.52 | 2 | 2 | 0 | Y | WLNKYSYY | 88.46 | WLTKYSYY | 11.54 |
| NS1 | 807 | 0.52 | 2 | 2 | 0 | Y | LNKYSYYP | 88.46 | LTKYSYYP | 11.54 |
| NS1 | 808 | 0.52 | 2 | 2 | 0 | Y | NKYSYYPE | 88.46 | TKYSYYPE | 11.54 |
| NS1 | 809 | 0 | 1 | 1 | 0 | Y | KYSYYPED | 100 | | |
| NS1 | 810 | 0 | 1 | 1 | 0 | Y | YSYYPEDP | 100 | | |
| NS1 | 811 | 0 | 1 | 1 | 0 | Y | SYYPEDPV | 100 | | |
| NS1 | 812 | 0 | 1 | 1 | 0 | Y | YYPEDPVK | 100 | | |
| NS1 | 813 | 0 | 1 | 1 | 0 | Y | YPEDPVKL | 100 | | |

Fig. 27-33

Species: YFV (8-mers)

| protein | block starting position | block entropy | total

Fig. 27-34

Species: YFV (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency |
|---|---|---|---|---|---|---|---|---|---|---|
| NS1 | 839 | 0.24 | 2 | 2 | 0 | Y | DSLEHEMW | 96.15 | DSLDHEMW | 3.85 |
| NS1 | 840 | 0.24 | 2 | 2 | 0 | Y | SLEHEMWR | 96.15 | SLDHEMWR | 3.85 |
| NS1 | 841 | 0.24 | 2 | 2 | 0 | Y | LEHEMWRS | 96.15 | LDHEMWRS | 3.85 |
| NS1 | 842 | 0.24 | 2 | 2 | 0 | Y | EHEMWRSR | 96.15 | DHEMWRSR | 3.85 |
| NS1 | 843 | 0 | 1 | 1 | 0 | Y | HEMWRSRA | 100 | | |
| NS1 | 844 | 0 | 1 | 1 | 0 | Y | EMWRSRAD | 100 | | |
| NS1 | 845 | 0 | 1 | 1 | 0 | Y | MWRSRADE | 100 | | |
| NS1 | 846 | 0 | 1 | 1 | 0 | Y | WRSRADEI | 100 | | |
| NS1 | 847 | 0 | 1 | 1 | 0 | Y | RSRADEIN | 100 | | |
| NS1 | 848 | 0 | 1 | 1 | 0 | Y | SRADEINA | 100 | | |
| NS1 | 849 | 0 | 1 | 1 | 0 | Y | RADEINAI | 100 | | |
| NS1 | 850 | 0.84 | 2 | 2 | 0 | Y | ADEINAIF | 73.08 | ADEINAIL | 26.92 |
| NS1 | 851 | 0.84 | 2 | 2 | 0 | Y | DEINAIFE | 73.08 | DEINAILE | 26.92 |
| NS1 | 852 | 0.84 | 2 | 2 | 0 | Y | EINAIFEE | 73.08 | EINAILEE | 26.92 |
| NS1 | 853 | 0.84 | 2 | 2 | 0 | Y | INAIFEEN | 73.08 | INAILEEN | 26.92 |
| NS1 | 854 | 0.84 | 2 | 2 | 0 | Y | NAIFEENE | 73.08 | NAILEENE | 26.92 |
| NS1 | 855 | 0.84 | 2 | 2 | 0 | Y | AIFEENEV | 73.08 | AILEENEV | 26.92 |
| NS1 | 856 | 0.84 | 2 | 2 | 0 | Y | IFEENEVD | 73.08 | ILEENEVD | 26.92 |
| NS1 | 857 | 0.84 | 2 | 2 | 0 | Y | FEENEVDI | 73.08 | LEENEVDI | 26.92 |
| NS1 | 858 | 0 | 1 | 1 | 0 | Y | EENEVDIS | 100 | | |
| NS1 | 859 | 0.24 | 2 | 2 | 0 | Y | ENEVDISV | 96.15 | ENEVDISI | 3.85 |
| NS1 | 860 | 0.24 | 2 | 2 | 0 | Y | NEVDISVV | 96.15 | NEVDISIV | 3.85 |
| NS1 | 861 | 0.24 | 2 | 2 | 0 | Y | EVDISVVV | 96.15 | EVDISIVV | 3.85 |
| NS1 | 862 | 0.24 | 2 | 2 | 0 | Y | VDISVVQ | 96.15 | VDISIVVQ | 3.85 |
| NS1 | 863 | 0.24 | 2 | 2 | 0 | Y | DISVVQD | 96.15 | DISIVVQD | 3.85 |

Fig. 27-35

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 864 | 0.24 | 2 | 2 | 0 | Y | ISVWQDP | 96.15 | ISVWQDP | 3.85 | | | | |
| NS1 | 865 | 0.24 | 2 | 2 | 0 | Y | SVWQDPK | 96.15 | SVWQDPK | 3.85 | | | | |
| NS1 | 866 | 0.24 | 2 | 2 | 0 | Y | VWQDPKN | 96.15 | IWQDPKN | 3.85 | | | | |
| NS1 | 867 | 0.52 | 2 | 2 | 0 | Y | WQDPKNV | 88.46 | VWQDPKNI | 11.54 | | | | |
| NS1 | 868 | 0.52 | 2 | 2 | 0 | Y | QDPKNVY | 88.46 | VQDPKNIY | 11.54 | | | | |
| NS1 | 869 | 0.52 | 2 | 2 | 0 | Y | DPKNVYQ | 88.46 | QDPKNIYQ | 11.54 | | | | |
| NS1 | 870 | 0.52 | 2 | 2 | 0 | Y | PKNVYQR | 88.46 | DPKNIYQR | 11.54 | | | | |
| NS1 | 871 | 0.52 | 2 | 2 | 0 | Y | KNVYQRG | 88.46 | PKNIYQRG | 11.54 | | | | |
| NS1 | 872 | 0.52 | 2 | 2 | 0 | Y | NVYQRGT | 88.46 | KNIYQRGT | 11.54 | | | | |
| NS1 | 873 | 0.52 | 2 | 2 | 0 | Y | VYQRGTH | 88.46 | NIYQRGTH | 11.54 | | | | |
| NS1 | 874 | 0.52 | 2 | 2 | 0 | Y | YQRGTHP | 88.46 | IYQRGTHP | 11.54 | | | | |
| NS1 | 875 | 0 | 1 | 1 | 0 | Y | QRGTHPF | 100 | | | | | | |
| NS1 | 876 | 0 | 1 | 1 | 0 | Y | RGTHPFS | 100 | | | | | | |
| NS1 | 877 | 0 | 1 | 1 | 0 | Y | GTHPFSR | 100 | | | | | | |
| NS1 | 878 | 0 | 1 | 1 | 0 | Y | THPFSRI | 100 | | | | | | |
| NS1 | 879 | 0 | 1 | 1 | 0 | Y | HPFSRIR | 100 | | | | | | |
| NS1 | 880 | 0 | 1 | 1 | 0 | Y | PFSRIRD | 100 | | | | | | |
| NS1 | 881 | 0 | 1 | 1 | 0 | Y | FSRIRDG | 100 | | | | | | |
| NS1 | 882 | 0 | 1 | 1 | 0 | Y | SRIRDGL | 100 | | | | | | |
| NS1 | 883 | 0 | 1 | 1 | 0 | Y | RIRDGLQ | 100 | | | | | | |
| NS1 | 884 | 0 | 1 | 1 | 0 | Y | IRDGLQY | 100 | | | | | | |
| NS1 | 885 | 0 | 1 | 1 | 0 | Y | RDGLQYG | 100 | | | | | | |
| NS1 | 886 | 0 | 1 | 1 | 0 | Y | DGLQYGW | 100 | | | | | | |
| NS1 | 887 | 0 | 1 | 1 | 0 | Y | GLQYGWK | 100 | | | | | | |
| NS1 | 888 | 0 | 1 | 1 | 0 | Y | LQYGWKT | 100 | | | | | | |

Fig. 27-36

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 889 | 0 | 1 | 1 | 0 | Y | LQYGWKTW | 100 | | | | | | |
| NS1 | 890 | 0 | 1 | 1 | 0 | Y | QYGWKTWG | 100 | | | | | | |
| NS1 | 891 | 0 | 1 | 1 | 0 | Y | YGWKTWGK | 100 | | | | | | |
| NS1 | 892 | 0.24 | 2 | 2 | 0 | Y | GWKTWGKN | 96.15 | GWKTWGKS | 3.85 | | | | |
| NS1 | 893 | 0.24 | 2 | 2 | 0 | Y | WKTWGKNL | 96.15 | WKTWGKSL | 3.85 | | | | |
| NS1 | 894 | 0.62 | 3 | 3 | 0 | Y | KTWGKNLV | 88.46 | KTWGKNLI | 7.69 | KTWGKSLV | 3.85 | | |
| NS1 | 895 | 0.62 | 3 | 3 | 0 | Y | TWGKNLVF | 88.46 | TWGKNLIF | 7.69 | TWGKSLVF | 3.85 | | |
| NS1 | 896 | 0.62 | 3 | 3 | 0 | Y | WGKNLVFS | 88.46 | WGKNLIFS | 7.69 | WGKSLVFS | 3.85 | | |
| NS1 | 897 | 0.62 | 3 | 3 | 0 | Y | GKNLVFSP | 88.46 | GKNLIFSP | 7.69 | GKSLVFSP | 3.85 | | |
| NS1 | 898 | 0.62 | 3 | 3 | 0 | Y | KNLVFSPG | 88.46 | KNLIFSPG | 7.69 | KSLVFSPG | 3.85 | | |
| NS1 | 899 | 0.62 | 3 | 3 | 0 | Y | NLVFSPGR | 88.46 | NLIFSPGR | 7.69 | SLVFSPGR | 3.85 | | |
| NS1 | 900 | 0.39 | 2 | 2 | 0 | Y | LVFSPGRK | 92.31 | LIFSPGRK | 7.69 | | | | |
| NS1 | 901 | 0.39 | 2 | 2 | 0 | Y | VFSPGRKN | 92.31 | IFSPGRKN | 7.69 | | | | |
| NS1 | 902 | 0 | 1 | 1 | 0 | Y | FSPGRKNG | 100 | | | | | | |
| NS1 | 903 | 0 | 1 | 1 | 0 | Y | SPGRKNGS | 100 | | | | | | |
| NS1 | 904 | 0 | 1 | 1 | 0 | Y | PGRKNGSF | 100 | | | | | | |
| NS1 | 905 | 0 | 1 | 1 | 0 | Y | GRKNGSFI | 100 | | | | | | |
| NS1 | 906 | 0 | 1 | 1 | 0 | Y | RKNGSFII | 100 | | | | | | |
| NS1 | 907 | 0 | 1 | 1 | 0 | Y | KNGSFIID | 100 | | | | | | |
| NS1 | 908 | 0 | 1 | 1 | 0 | Y | NGSFIIDG | 100 | | | | | | |
| NS1 | 909 | 0 | 1 | 1 | 0 | Y | GSFIIDGK | 100 | | | | | | |
| NS1 | 910 | 0 | 1 | 1 | 0 | Y | SFIIDGKS | 100 | | | | | | |
| NS1 | 911 | 0 | 1 | 1 | 0 | Y | FIIDGKSR | 100 | | | | | | |
| NS1 | 912 | 0 | 1 | 1 | 0 | Y | IIDGKSRK | 100 | | | | | | |
| NS1 | 913 | 0 | 1 | 1 | 0 | Y | IDGKSRKE | 100 | | | | | | |

Fig. 27-37

Species: YFV (8-mers)

| protein | block starting position | block ent

Fig. 27-38

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS1 | 939 | 0.52 | 2 | 2 | 0 | Y | GVFTTRVY | 88.46 | GVFTTRVF | 11.54 | | |
| NS1 | 940 | 0.52 | 2 | 2 | 0 | Y | VFTTRVYM | 88.46 | VFTTRVFM | 11.54 | | |
| NS1 | 941 | 0.52 | 2 | 2 | 0 | Y | FTTRVYMD | 88.46 | FTTRVFMD | 11.54 | | |
| NS1 | 942 | 0.52 | 2 | 2 | 0 | Y | TTRVYMDA | 88.46 | TTRVFMDA | 11.54 | | |
| NS1 | 943 | 0.62 | 3 | 3 | 0 | Y | TRVYMDAV | 88.46 | TRVFMDAV | 7.69 | TRVFMDAT | 3.85 |
| NS1 | 944 | 0.62 | 3 | 3 | 0 | Y | RVYMDAVF | 88.46 | RVFMDAVF | 7.69 | RVFMDATF | 3.85 |
| NS1 | 945 | 0.62 | 3 | 3 | 0 | Y | VYMDAVFE | 88.46 | VFMDAVFD | 7.69 | VFMDATFD | 3.85 |
| NS1 | 946 | 0.62 | 3 | 3 | 0 | Y | YMDAVFEY | 88.46 | FMDAVFDY | 7.69 | FMDATFDY | 3.85 |
| NS1 | 947 | 0.62 | 3 | 3 | 0 | Y | MDAVFEYT | 88.46 | MDAVFDYS | 7.69 | MDATFDYS | 3.85 |
| NS1 | 948 | 0.62 | 3 | 3 | 0 | Y | DAVFEYTI | 88.46 | DAVFDYSV | 7.69 | DATFDYSV | 3.85 |
| NS1 | 949 | 0.62 | 3 | 3 | 0 | Y | AVFEYTID | 88.46 | AVFDYSVD | 7.69 | ATFDYSVD | 3.85 |
| NS1 | 950 | 0.62 | 3 | 3 | 0 | Y | VFEYTIDC | 88.46 | VFDYSVDC | 7.69 | TFDYSVDC | 3.85 |
| NS1 | 951 | 0.52 | 2 | 2 | 0 | Y | FEYTIDCD | 88.46 | FDYSVDCD | 11.54 | | |
| NS1 | 952 | 0.52 | 2 | 2 | 0 | Y | EYTIDCDG | 88.46 | DYSVDCDG | 11.54 | | |
| NS1 | 953 | 0.52 | 2 | 2 | 0 | Y | YTIDCDGS | 88.46 | YSVDCDGA | 11.54 | | |
| NS1 | 954 | 0.52 | 2 | 2 | 0 | Y | TIDCDGSI | 88.46 | SVDCDGAI | 11.54 | | |
| NS1 | 955 | 0.52 | 2 | 2 | 0 | Y | IDCDGSIL | 88.46 | VDCDGAIL | 11.54 | | |
| NS1 | 956 | 0.52 | 2 | 2 | 0 | Y | DCDGSILG | 88.46 | DCDGAILG | 11.54 | | |
| NS1 | 957 | 0.52 | 2 | 2 | 0 | Y | CDGSILGA | 88.46 | CDGAILGA | 11.54 | | |
| NS1 | 958 | 0.52 | 2 | 2 | 0 | Y | DGSILGAA | 88.46 | DGAILGAA | 11.54 | | |
| NS1 | 959 | 0.52 | 2 | 2 | 0 | Y | GSILGAAV | 88.46 | GAILGAAV | 11.54 | | |
| NS1 | 960 | 0.52 | 2 | 2 | 0 | Y | SILGAAVN | 88.46 | AILGAAVN | 11.54 | | |
| NS1 | 961 | 0 | 1 | 1 | 0 | Y | ILGAAVNG | 100 | | | | |
| NS1 | 962 | 0 | 1 | 1 | 0 | Y | LGAAVNGK | 100 | | | | |
| NS1 | 963 | 0 | 1 | 1 | 0 | Y | GAAVNGKK | 100 | | | | |

Fig. 27-39

Species: YFV (8-mers)

| protein | block starting position | block entropy | total peptides in block | # peptides required to cover 99% of block | gap/λ fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 964 | 0 | 1 | 1 | 0 | Y | AAVNGKKS | 100 | | | | | | |
| NS1 | 965 | 0 | 1 | 1 | 0 | Y | AVNGKKSA | 100 | | | | | | |
| NS1 | 966 | 0 | 1 | 1 | 0 | Y | VNGKKSAH | 100 | | | | | | |
| NS1 | 967 | 0 | 1 | 1 | 0 | Y | NGKKSAHG | 100 | | | | | | |
| NS1 | 968 | 0 | 1 | 1 | 0 | Y | GKKSAHGS | 100 | | | | | | |
| NS1 | 969 | 0 | 1 | 1 | 0 | Y | KKSAHGSP | 100 | | | | | | |
| NS1 | 970 | 0 | 1 | 1 | 0 | Y | KSAHGSPT | 100 | | | | | | |
| NS1 | 971 | 0 | 1 | 1 | 0 | Y | SAHGSPTF | 100 | | | | | | |
| NS1 | 972 | 0 | 1 | 1 | 0 | Y | AHGSPTFW | 100 | | | | | | |
| NS1 | 973 | 0 | 1 | 1 | 0 | Y | HGSPTFWM | 100 | | | | | | |
| NS1 | 974 | 0 | 1 | 1 | 0 | Y | GSPTFWMG | 100 | | | | | | |
| NS1 | 975 | 0 | 1 | 1 | 0 | Y | SPTFWMGS | 100 | | | | | | |
| NS1 | 976 | 0 | 1 | 1 | 0 | Y | PTFWMGSH | 100 | | | | | | |
| NS1 | 977 | 0 | 1 | 1 | 0 | Y | TFWMGSHE | 100 | | | | | | |
| NS1 | 978 | 0 | 1 | 1 | 0 | Y | FWMGSHEV | 100 | | | | | | |
| NS1 | 979 | 0 | 1 | 1 | 0 | Y | WMGSHEVN | 100 | | | | | | |
| NS1 | 980 | 0 | 1 | 1 | 0 | Y | MGSHEVNG | 100 | | | | | | |
| NS1 | 981 | 0 | 1 | 1 | 0 | Y | GSHEVNGT | 100 | | | | | | |
| NS1 | 982 | 0 | 1 | 1 | 0 | Y | SHEVNGTW | 100 | | | | | | |
| NS1 | 983 | 0 | 1 | 1 | 0 | Y | HEVNGTWM | 100 | | | | | | |
| NS1 | 984 | 0.47 | 3 | 3 | 0 | Y | EVNGTWMI | 92.31 | EVNGTWMV | 3.85 | EVNGTWMM | 3.85 | | |
| NS1 | 985 | 0.47 | 3 | 3 | 0 | Y | VNGTWMIH | 92.31 | VNGTWMYH | 3.85 | VNGTWMMH | 3.85 | | |
| NS1 | 986 | 0.47 | 3 | 3 | 0 | Y | NGTWMIHT | 92.31 | NGTWMYHT | 3.85 | NGTWMYHT | 3.85 | | |
| NS1 | 987 | 0.47 | 3 | 3 | 0 | Y | GTWMIHTL | 92.31 | GTWMYHTL | 3.85 | GTWMMHTL | 3.85 | | |
| NS1 | 988 | 0.47 | 3 | 3 | 0 | Y | TWMIHTLE | 92.31 | TWMYHTLE | 3.85 | TWMMHTLE | 3.85 | | |

Fig. 27-40

Species: YFV (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 989 | 0.85 | 4 | 4 | 0 | Y | WMIHTLEA | 84.62 | WMIHTLET | 7.69 | WMWHTLET | 3.85 | WMMHTLET | 3.85 |
| NS1 | 990 | 0.85 | 4 | 4 | 0 | Y | MIHTLEAL | 84.62 | MIHTLETL | 7.69 | MVHTLETL | 3.85 | MMHTLETL | 3.85 |
| NS1 | 991 | 0.85 | 4 | 4 | 0 | Y | IHTLEALD | 84.62 | IHTLETLD | 7.69 | MHTLETLD | 3.85 | VHTLETLD | 3.85 |
| NS1 | 992 | 0.62 | 2 | 2 | 0 | Y | HTLEALDY | 84.62 | HTLETLDY | 15.38 | | | | |
| NS1 | 993 | 0.62 | 2 | 2 | 0 | Y | TLEALDYK | 84.62 | TLETLDYK | 15.38 | | | | |
| NS1 | 994 | 0.62 | 2 | 2 | 0 | Y | LEALDYKE | 84.62 | LETLDYKE | 15.38 | | | | |
| NS1 | 995 | 0.62 | 2 | 2 | 0 | Y | EALDYKEC | 84.62 | ETLDYKEC | 15.38 | | | | |
| NS1 | 996 | 0.62 | 2 | 2 | 0 | Y | ALDYKECE | 84.62 | TLDYKECE | 15.38 | | | | |
| NS1 | 997 | 0 | 1 | 1 | 0 | Y | LDYKECEW | 100 | | | | | | |
| NS1 | 998 | 0 | 1 | 1 | 0 | Y | DYKECEWP | 100 | | | | | | |
| NS1 | 999 | 0.24 | 2 | 2 | 0 | Y | YKECEWPL | 96.15 | YKECEWPP | 3.85 | | | | |
| NS1 | 1000 | 0.24 | 2 | 2 | 0 | Y | KECEWPLT | 96.15 | KECEWPPT | 3.85 | | | | |
| NS1 | 1001 | 0.24 | 2 | 2 | 0 | Y | ECEWPLTH | 96.15 | ECEWPPTH | 3.85 | | | | |
| NS1 | 1002 | 0.24 | 2 | 2 | 0 | Y | CEWPLTHT | 96.15 | CEWPPTHT | 3.85 | | | | |
| NS1 | 1003 | 0.24 | 2 | 2 | 0 | Y | EWPLTHTI | 96.15 | EWPPTHTI | 3.85 | | | | |
| NS1 | 1004 | 0.24 | 2 | 2 | 0 | Y | WPLTHTIG | 96.15 | WPPTHTIG | 3.85 | | | | |
| NS1 | 1005 | 0.24 | 2 | 2 | 0 | Y | PLTHTIGT | 96.15 | PPTHTIGT | 3.85 | | | | |
| NS1 | 1006 | 0.24 | 2 | 2 | 0 | Y | LTHTIGTS | 96.15 | PTHTIGTS | 3.85 | | | | |
| NS1 | 1007 | 0 | 1 | 1 | 0 | Y | THTIGTSV | 100 | | | | | | |
| NS1 | 1008 | 0 | 1 | 1 | 0 | Y | HTIGTSVE | 100 | | | | | | |
| NS1 | 1009 | 0 | 1 | 1 | 0 | Y | TIGTSVEE | 100 | | | | | | |
| NS1 | 1010 | 0 | 1 | 1 | 0 | Y | IGTSVEES | 100 | | | | | | |
| NS1 | 1011 | 0.62 | 2 | 2 | 0 | Y | GTSVEESE | 84.62 | GTSVEESD | 15.38 | | | | |
| NS1 | 1012 | 0.62 | 2 | 2 | 0 | Y | TSVEESEM | 84.62 | TSVEESDM | 15.38 | | | | |
| NS1 | 1013 | 0.62 | 2 | 2 | 0 | Y | SVEESEMF | 84.62 | SVEESDMF | 15.38 | | | | |

Fig. 27-41

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 1014 | 0.62 | 2 | 2 | 0 | Y | VEESEMFM | 84.62 | VEESDMFM | 15.38 |
| NS1 | 1015 | 0.62 | 2 | 2 | 0 | Y | EESEMFMP | 84.62 | EESDMFMP | 15.38 |
| NS1 | 1016 | 0.62 | 2 | 2 | 0 | Y | ESEMFMPR | 84.62 | ESDMFMPR | 15.38 |
| NS1 | 1017 | 0.62 | 2 | 2 | 0 | Y | SEMFMPRS | 84.62 | SDMFMPRS | 15.38 |
| NS1 | 1018 | 0.62 | 2 | 2 | 0 | Y | EMFMPRSI | 84.62 | DMFMPRSI | 15.38 |
| NS1 | 1019 | 0 | 1 | 1 | 0 | Y | MFMPRSIG | 100 | | |
| NS1 | 1020 | 0 | 1 | 1 | 0 | Y | FMPRSIGG | 100 | | |
| NS1 | 1021 | 0 | 1 | 1 | 0 | Y | MPRSIGGP | 100 | | |
| NS1 | 1022 | 0 | 1 | 1 | 0 | Y | PRSIGGPV | 100 | | |
| NS1 | 1023 | 0 | 1 | 1 | 0 | Y | RSIGGPVS | 100 | | |
| NS1 | 1024 | 0 | 1 | 1 | 0 | Y | SIGGPVSS | 100 | | |
| NS1 | 1025 | 0 | 1 | 1 | 0 | Y | IGGPVSSH | 100 | | |
| NS1 | 1026 | 0 | 1 | 1 | 0 | Y | GGPVSSHN | 100 | | |
| NS1 | 1027 | 0.24 | 2 | 2 | 0 | Y | GPVSSHNH | 96.15 | GPVSSHNR | 3.85 |
| NS1 | 1028 | 0.24 | 2 | 2 | 0 | Y | PVSSHNHI | 96.15 | PVSSHNRI | 3.85 |
| NS1 | 1029 | 0.24 | 2 | 2 | 0 | Y | VSSHNHIP | 96.15 | VSSHNRIP | 3.85 |
| NS1 | 1030 | 0.24 | 2 | 2 | 0 | Y | SSHNHIPG | 96.15 | SSHNRIPG | 3.85 |
| NS1 | 1031 | 0.24 | 2 | 2 | 0 | Y | SHNHIPGY | 96.15 | SHNRIPGY | 3.85 |
| NS1 | 1032 | 0.24 | 2 | 2 | 0 | Y | HNHIPGYK | 96.15 | HNRIPGYK | 3.85 |
| NS1 | 1033 | 0.24 | 2 | 2 | 0 | Y | NHIPGYKV | 96.15 | NRIPGYKV | 3.85 |
| NS1 | 1034 | 0.24 | 2 | 2 | 0 | Y | HIPGYKVQ | 96.15 | RIPGYKVQ | 3.85 |
| NS1 | 1035 | 0 | 1 | 1 | 0 | Y | IPGYKVQT | 100 | | |
| NS1 | 1036 | 0 | 1 | 1 | 0 | Y | PGYKVQTN | 100 | | |
| NS1 | 1037 | 0 | 1 | 1 | 0 | Y | GYKVQTNG | 100 | | |
| NS1 | 1038 | 0 | 1 | 1 | 0 | Y | YKVQTNGP | 100 | | |

Fig. 27-42

Species: YFV (8-mers)

| protein | block star

Fig. 27-43

Species: YFV (8

Fig. 27-44

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1089 | 0 | 1 | 1 | 0 | Y | WCCRSCTM | 100 | | | | | | |
| NS1 | 1090 | 0 | 1 | 1 | 0 | Y | CCRSCTMP | 100 | | | | | | |
| NS1 | 1091 | 0 | 1 | 1 | 0 | Y | CRSCTMPP | 100 | | | | | | |
| NS1 | 1092 | 0 | 1 | 1 | 0 | Y | RSCTMPPV | 100 | | | | | | |
| NS1 | 1093 | 0 | 1 | 1 | 0 | Y | SCTMPPVS | 100 | | | | | | |
| NS1 | 1094 | 0 | 1 | 1 | 0 | Y | CTMPPVSF | 100 | | | | | | |
| NS1 | 1095 | 0 | 1 | 1 | 0 | Y | TMPPYSFH | 100 | | | | | | |
| NS1 | 1096 | 0 | 1 | 1 | 0 | Y | MPPYSFHG | 100 | | | | | | |
| NS1 | 1097 | 0.24 | 2 | 2 | 0 | Y | PPYSFHGS | 96.15 | PPYSFHGN | 3.85 | | | | |
| NS1 | 1098 | 0.24 | 2 | 2 | 0 | Y | PYSFHGSD | 96.15 | PYSFHGND | 3.85 | | | | |
| NS1 | 1099 | 0.24 | 2 | 2 | 0 | Y | YSFHGSDG | 96.15 | VSFHGNDG | 3.85 | | | | |
| NS1 | 1100 | 0.24 | 2 | 2 | 0 | Y | SFHGSDGC | 96.15 | SFHGNDGC | 3.85 | | | | |
| NS1 | 1101 | 0.24 | 2 | 2 | 0 | Y | FHGSDGCW | 96.15 | FHGNDGCW | 3.85 | | | | |
| NS1 | 1102 | 0.24 | 2 | 2 | 0 | Y | HGSDGCWY | 96.15 | HGNDGCWY | 3.85 | | | | |
| NS1 | 1103 | 0.24 | 2 | 2 | 0 | Y | GSDGCWYP | 96.15 | GNDGCWYP | 3.85 | | | | |
| NS1 | 1104 | 0.24 | 2 | 2 | 0 | Y | SDGCWYPM | 96.15 | NDGCWYPM | 3.85 | | | | |
| NS1 | 1105 | 0 | 1 | 1 | 0 | Y | DGCWYPME | 100 | | | | | | |
| NS1 | 1106 | 0 | 1 | 1 | 0 | Y | GCWYPMEI | 100 | | | | | | |
| NS1 | 1107 | 0 | 1 | 1 | 0 | Y | CWYPMEIR | 100 | | | | | | |
| NS1 | 1108 | 0 | 1 | 1 | 0 | Y | WYPMEIRP | 100 | | | | | | |
| NS1 | 1109 | 0.62 | 2 | 2 | 0 | Y | YPMEIRPR | 84.62 | YPMEIRPM | 15.38 | | | | |
| NS1 | 1110 | 0.62 | 2 | 2 | 0 | Y | PMEIRPRK | 84.62 | PMEIRPMK | 15.38 | | | | |
| NS1 | 1111 | 0.85 | 2 | 2 | 0 | Y | MEIRPRKT | 80.77 | MEIRPMKT | 15.38 | MEIRPRKA | 3.85 | | |
| NS1 | 1112 | 0.97 | 4 | 3 | 0 | Y | EIRPRKTH | 80.77 | EIRPMKTH | 11.54 | EIRPRKAH | 3.85 | EIRPMKTS | 3.85 |
| NS1 | 1113 | 0.97 | 4 | 4 | 0 | Y | IRPRKTHE | 80.77 | IRPMKTHE | 11.54 | IRPRKAHE | 3.85 | IRPMKTSD | 3.85 |

Fig. 27-45

Species: YFV (8-mers)

| protein | block starting position | entropy | total

Fig. 27-46

Species: YFV (8-mers)

| protein | block starting position | block entropy | total

Fig. 27-47

Species: YFV (8-mers)

| protein | block star

Fig. 27-48

Species: YFV (8-mers)

| protein | block starting position | entropy | total

Fig. 27-49

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1221 | 0 | 1 | 1 | 0 | Y | GLRTLWSP | 100 | | | | | | |
| NS2A | 1222 | 0 | 1 | 1 | 0 | Y | LRTLWSPR | 100 | | | | | | |
| NS2A | 1223 | 0 | 1 | 1 | 0 | Y | RTLWSPRE | 100 | | | | | | |
| NS2A | 1224 | 0 | 1 | 1 | 0 | Y | TLWSPRER | 100 | | | | | | |
| NS2A | 1225 | 0 | 1 | 1 | 0 | Y | LWSPRERL | 100 | | | | | | |
| NS2A | 1226 | 0 | 1 | 1 | 0 | Y | WSPRERLV | 100 | | | | | | |
| NS2A | 1227 | 0.52 | 2 | 2 | 0 | Y | SPRERLVL | 88.46 | SPRERLVM | 11.54 | | | | |
| NS2A | 1228 | 0.89 | 3 | 3 | 0 | Y | PRERLVLT | 80.77 | PRERLVMA | 11.54 | PRERLVLA | 7.69 | | |
| NS2A | 1229 | 0.89 | 3 | 3 | 0 | Y | RERLVLTL | 80.77 | RERLVMAF | 11.54 | RERLVLAL | 7.69 | | |
| NS2A | 1230 | 0.89 | 3 | 3 | 0 | Y | ERLVLTLG | 80.77 | ERLVMAFG | 11.54 | ERLVLALG | 7.69 | | |
| NS2A | 1231 | 0.89 | 3 | 3 | 0 | Y | RLVLTLGA | 80.77 | RLVMAFGA | 11.54 | RLVLALGA | 7.69 | | |
| NS2A | 1232 | 0.89 | 3 | 3 | 0 | Y | LVLTLGAA | 80.77 | LVMAFGAA | 11.54 | LVLALGAA | 7.69 | | |
| NS2A | 1233 | 0.89 | 3 | 3 | 0 | Y | VLTLGAAM | 80.77 | VMAFGAAM | 11.54 | VLALGAAM | 7.69 | | |
| NS2A | 1234 | 0.89 | 3 | 3 | 0 | Y | LTLGAAMV | 80.77 | MAFGAAMV | 11.54 | LALGAAMV | 7.69 | | |
| NS2A | 1235 | 0.62 | 3 | 3 | 0 | Y | TLGAAMVE | 80.77 | AFGAAMVE | 11.54 | ALGAAMVE | 7.69 | | |
| NS2A | 1236 | 0.39 | 2 | 2 | 0 | Y | LGAAMVEI | 88.46 | FGAAMVEI | 7.69 | FGAAMVEI | 3.85 | | |
| NS2A | 1237 | 0.39 | 2 | 2 | 0 | Y | GAAMVEIA | 92.31 | GAAMVEVA | 7.69 | | | | |
| NS2A | 1238 | 0.39 | 2 | 2 | 0 | Y | AAMVEIAL | 92.31 | AAMVEVAL | 7.69 | | | | |
| NS2A | 1239 | 0.39 | 2 | 2 | 0 | Y | AMVEIALG | 92.31 | AMVEVALG | 7.69 | | | | |
| NS2A | 1240 | 0.39 | 2 | 2 | 0 | Y | MVEIALGG | 92.31 | MVEVALGG | 7.69 | | | | |
| NS2A | 1241 | 1.24 | 3 | 3 | 0 | Y | VEIALGGV | 61.54 | VEIALGGM | 30.77 | VEVALGGM | 7.69 | | |
| NS2A | 1242 | 1.24 | 3 | 3 | 0 | Y | EIALGGVM | 61.54 | EIALGGMM | 30.77 | EVALGGMM | 7.69 | | |
| NS2A | 1243 | 1.24 | 3 | 3 | 0 | Y | IALGGVMG | 61.54 | IALGGMMG | 30.77 | VALGGMMG | 7.69 | | |
| NS2A | 1244 | 0.96 | 2 | 2 | 0 | Y | ALGGVMGG | 61.54 | ALGGMMGG | 38.46 | | | | |
| NS2A | 1245 | 0.96 | 2 | 2 | 0 | Y | LGGVMGGL | 61.54 | LGGMMGGL | 38.46 | | | | |

Fig. 27-50

Species: YFV (8-mers)

| protein | block starting position | block entropy | total

Fig. 27-51

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1271 | 0.7 | 4 | 4 | 0 | Y | SRKASNTI | 88.46 | SRKASNMI | 3.85 | SRKASNAV | 3.85 | SRKASNAI | 3.85 |
| NS2A | 1272 | 0.7 | 4 | 4 | 0 | Y | RKASNTIL | 88.46 | RKASNMIL | 3.85 | RKASNAVL | 3.85 | RKASNAIL | 3.85 |
| NS2A | 1273 | 0.7 | 4 | 4 | 0 | Y | KASNTILP | 88.46 | KASNVLP | 3.85 | KASNMILP | 3.85 | KASNAILP | 3.85 |
| NS2A | 1274 | 0.7 | 4 | 4 | 0 | Y | ASNTILPL | 88.46 | ASNAILPL | 3.85 | ASNVLPL | 3.85 | ASNMILPL | 3.85 |
| NS2A | 1275 | 0.7 | 4 | 4 | 0 | Y | SNTILPLM | 88.46 | SNAILPLM | 3.85 | SNMILPLM | 3.85 | SNAVLPLM | 3.85 |
| NS2A | 1276 | 0.7 | 4 | 4 | 0 | Y | NTILPLMA | 88.46 | NMILPLMA | 3.85 | NAVLPLMA | 3.85 | NAILPLMA | 3.85 |
| NS2A | 1277 | 0.7 | 4 | 4 | 0 | Y | TILPLMAL | 88.46 | AILPLMAL | 3.85 | MILPLMAL | 3.85 | AVLPLMAL | 3.85 |
| NS2A | 1278 | 0.47 | 3 | 3 | 0 | Y | ILPLMALL | 92.31 | VLPLMALL | 3.85 | ILPLMALM | 3.85 | | |
| NS2A | 1279 | 0.24 | 2 | 2 | 0 | Y | LPLMALLT | 96.15 | LPLMALMT | 3.85 | | | | |
| NS2A | 1280 | 0.24 | 2 | 2 | 0 | Y | PLMALLTP | 96.15 | PLMALMTP | 3.85 | | | | |
| NS2A | 1281 | 0.24 | 2 | 2 | 0 | Y | LMALLTPV | 96.15 | LMALMTPM | 3.85 | | | | |
| NS2A | 1282 | 0.24 | 2 | 2 | 0 | Y | MALLTPVT | 96.15 | MALMTPMT | 3.85 | | | | |
| NS2A | 1283 | 0.24 | 2 | 2 | 0 | Y | ALLTPVTM | 96.15 | ALMTPMTM | 3.85 | | | | |
| NS2A | 1284 | 0.7 | 4 | 4 | 0 | Y | LLTPVTMA | 88.46 | LLTPVTMY | 3.85 | LLTPVTMY | 3.85 | LMTPMTMH | 3.85 |
| NS2A | 1285 | 0.7 | 4 | 4 | 0 | Y | LTPVTMAE | 88.46 | LTPVTMHE | 3.85 | LTPVTMYE | 3.85 | MTPMTMHE | 3.85 |
| NS2A | 1286 | 0.7 | 4 | 4 | 0 | Y | TPVTMAEV | 88.46 | TPVTMHEV | 3.85 | TPMTMHEV | 3.85 | TPVTMYEV | 3.85 |
| NS2A | 1287 | 0.7 | 4 | 4 | 0 | Y | PVTMAEVR | 88.46 | PVTMHEVR | 3.85 | PVTMHEVR | 3.85 | PMTMHEVR | 3.85 |
| NS2A | 1288 | 0.7 | 4 | 4 | 0 | Y | VTMAEVRL | 88.46 | VTMHEVRM | 3.85 | VMHEVRM | 3.85 | MTMHEVRM | 3.85 |
| NS2A | 1289 | 0.62 | 3 | 3 | 0 | Y | TMAEVRLA | 88.46 | TMHEVRMA | 7.69 | TMYEVRMA | 3.85 | | |
| NS2A | 1290 | 1.35 | 4 | 4 | 0 | Y | MAEVRLAA | 65.38 | MAEVRLAT | 23.08 | MHEVRMA | 7.69 | MYEVRMAT | 3.85 |
| NS2A | 1291 | 1.35 | 4 | 4 | 0 | Y | AEVRLAAM | 65.38 | AEVRLATM | 23.08 | HEVRMATM | 7.69 | YEVRMATM | 3.85 |
| NS2A | 1292 | 1.82 | 4 | 4 | 0 | Y | EVRLAAMF | 46.15 | EVRLATML | 23.08 | EVRMATML | 19.23 | EVRMATML | 11.54 |
| NS2A | 1293 | 1.97 | 5 | 5 | 0 | Y | VRLAAMFF | 46.15 | VRLATML | 19.23 | VRLATML | 19.23 | VRMATMLF | 11.54 | VRLATMLL |
| NS2A | 1294 | 1.97 | 5 | 5 | 0 | Y | RLAAMFFC | 46.15 | RLATMLF | 19.23 | RLAAMLF | 19.23 | RMATMLFC | 11.54 | RLATMLLC |
| NS2A | 1296 | 1.82 | 5 | 5 | 0 | Y | AAMFFCAV | 46.15 | ATMLFCTV | 30.77 | RLAAMLFCAV | 15.38 | AAMLFCTV | 3.85 | ATMLLCAV |

Fig. 27-52

Species: YFV (8-mers)

| protein

Fig. 27-53

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1322 | 0.52 | 2 | 2 | 0 | Y | IPVALTL | 88.46 | IPVALTL | 11.54 | | | | |
| NS2A | 1323 | 0.52 | 2 | 2 | 0 | Y | PVALTLT | 88.46 | PVALTLT | 11.54 | | | | |
| NS2A | 1324 | 0.52 | 2 | 2 | 0 | Y | LVALTLTS | 88.46 | IVALTLTS | 11.54 | | | | |
| NS2A | 1325 | 0 | 1 | 1 | 0 | Y | VALTLTSY | 100 | | | | | | |
| NS2A | 1326 | 0.52 | 2 | 2 | 0 | Y | ALTLTSYL | 88.46 | ALTLTSYM | 11.54 | | | | |
| NS2A | 1327 | 0.52 | 2 | 2 | 0 | Y | LTLTSYLG | 88.46 | LTLTSYMG | 11.54 | | | | |
| NS2A | 1328 | 0.52 | 2 | 2 | 0 | Y | TLTSYLGL | 88.46 | TLTSYMGL | 11.54 | | | | |
| NS2A | 1329 | 0.52 | 2 | 2 | 0 | Y | LTSYLGLT | 88.46 | LTSYMGLT | 11.54 | | | | |
| NS2A | 1330 | 0.52 | 2 | 2 | 0 | Y | TSYLGLTQ | 88.46 | TSYMGLTQ | 11.54 | | | | |
| NS2A | 1331 | 0.52 | 2 | 2 | 0 | Y | SYLGLTQP | 88.46 | SYMGLTQP | 11.54 | | | | |
| NS2A | 1332 | 0.52 | 2 | 2 | 0 | Y | YLGLTQPF | 88.46 | YMGLTQPF | 11.54 | | | | |
| NS2A | 1333 | 0.52 | 2 | 2 | 0 | Y | LGLTQPFL | 88.46 | MGLTQPFL | 11.54 | | | | |
| NS2A | 1334 | 0 | 1 | 1 | 0 | Y | GLTQPFLG | 100 | | | | | | |
| NS2A | 1335 | 0 | 1 | 1 | 0 | Y | LTQPFLGL | 100 | | | | | | |
| NS2A | 1336 | 0 | 1 | 1 | 0 | Y | TQPFLGLC | 100 | | | | | | |
| NS2A | 1337 | 0 | 1 | 1 | 0 | Y | QPFLGLCA | 100 | | | | | | |
| NS2A | 1338 | 0.52 | 2 | 2 | 0 | Y | PFLGLCAF | 88.46 | PFLGLCAY | 11.54 | | | | |
| NS2A | 1339 | 0.52 | 2 | 2 | 0 | Y | FLGLCAFL | 88.46 | FLGLCAYM | 11.54 | | | | |
| NS2A | 1340 | 0.52 | 2 | 2 | 0 | Y | LGLCAFLA | 88.46 | LGLCAYMS | 11.54 | | | | |
| NS2A | 1341 | 0.52 | 2 | 2 | 0 | Y | GLCAFLAT | 88.46 | GLCAYMST | 11.54 | | | | |
| NS2A | 1342 | 0.52 | 2 | 2 | 0 | Y | LCAFLATR | 88.46 | LCAYMSTQ | 11.54 | | | | |
| NS2A | 1343 | 0.89 | 3 | 3 | 0 | Y | CAFLATRI | 80.77 | CAYMSTQV | 11.54 | CAFLATRL | 7.69 | | |
| NS2A | 1344 | 0.89 | 3 | 3 | 0 | Y | AFLATRIF | 80.77 | AYMSTQVF | 11.54 | AFLATRLF | 7.69 | | |
| NS2A | 1345 | 0.89 | 3 | 3 | 0 | Y | FLATRIFG | 80.77 | YMSTQVFG | 11.54 | FLATRLFG | 7.69 | | |
| NS2A | 1346 | 0.89 | 3 | 3 | 0 | Y | LATRIFGR | 80.77 | MSTQVFGR | 11.54 | LATRLFGR | 7.69 | | |

Fig. 27-54

Species: YFV (8-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1347 | 0.89 | 3 | 3 | 0 | Y | ATRIFGRR | 80.77 | STQVFGRR | 11.54 | ATRLFGRR | 7.69 | | |
| NS2A | 1348 | 0.89 | 3 | 3 | 0 | Y | TRIFGRRS | 80.77 | TQVFGRRS | 11.54 | TRLFGRRS | 7.69 | | |
| NS2A | 1349 | 0.89 | 3 | 3 | 0 | Y | RIFGRRSI | 80.77 | QVFGRRSI | 11.54 | RLFGRRSI | 7.69 | | |
| NS2A | 1350 | 0.89 | 3 | 3 | 0 | Y | IFGRRSIP | 80.77 | VFGRRSIP | 11.54 | LFGRRSIP | 7.69 | | |
| NS2A | 1351 | 0 | 1 | 1 | 0 | Y | FGRRSIPV | 100 | | | | | | |
| NS2A | 1352 | 0 | 1 | 1 | 0 | Y | GRRSIPVN | 100 | | | | | | |
| NS2A | 1353 | 0 | 1 | 1 | 0 | Y | RRSIPVNE | 100 | | | | | | |
| NS2A | 1354 | 0 | 1 | 1 | 0 | Y | RSIPVNEA | 100 | | | | | | |
| NS2A | 1355 | 0 | 1 | 1 | 0 | Y | SIPVNEAL | 100 | | | | | | |
| NS2A | 1356 | 0 | 1 | 1 | 0 | Y | IPVNEALA | 100 | | | | | | |
| NS2A | 1357 | 0 | 1 | 1 | 0 | Y | PVNEALAA | 100 | | | | | | |
| NS2B | 1358 | 0.24 | 2 | 2 | 0 | Y | VNEALAAA | 96.15 | VNEALAAT | 3.85 | | | | |
| NS2B | 1359 | 0.24 | 2 | 2 | 0 | Y | NEALAAAG | 96.15 | NEALAATG | 3.85 | | | | |
| NS2B | 1360 | 0.24 | 2 | 2 | 0 | Y | EALAAAGL | 96.15 | EALAATGL | 3.85 | | | | |
| NS2B | 1361 | 0.24 | 2 | 2 | 0 | Y | ALAAAGLV | 96.15 | ALAATGLV | 3.85 | | | | |
| NS2B | 1362 | 0.24 | 2 | 2 | 0 | Y | LAAAGLVG | 96.15 | LAATGLVG | 3.85 | | | | |
| NS2B | 1363 | 0.24 | 2 | 2 | 0 | Y | AAAGLVGV | 96.15 | AATGLVGV | 3.85 | | | | |
| NS2B | 1364 | 0.24 | 2 | 2 | 0 | Y | AAGLVGVL | 96.15 | ATGLVGVL | 3.85 | | | | |
| NS2B | 1365 | 0.24 | 2 | 2 | 0 | Y | AGLVGVLA | 96.15 | TGLVGVLA | 3.85 | | | | |
| NS2B | 1366 | 0 | 1 | 1 | 0 | Y | GLVGVLAG | 100 | | | | | | |
| NS2B | 1367 | 0 | 1 | 1 | 0 | Y | LVGVLAGL | 100 | | | | | | |
| NS2B | 1368 | 0 | 1 | 1 | 0 | Y | VGVLAGLA | 100 | | | | | | |
| NS2B | 1369 | 0 | 1 | 1 | 0 | Y | GVLAGLAF | 100 | | | | | | |
| NS2B | 1370 | 0 | 1 | 1 | 0 | Y | VLAGLAFQ | 100 | | | | | | |
| NS2B | 1371 | 0.52 | 2 | 2 | 0 | Y | LAGLAFQE | 88.46 | LAGLAFQD | 11.54 | | | | |

Fig. 27-55

Species: YFV (8-mers)

| protein | block starting position | block

Fig. 27-56

Species: YFV (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1397 | 0.39 | 2 | 2 | 0 | Y | SVAGRVDG | 92.31 | SVAGKVDG | 7.69 | | | | |
| NS2B | 1398 | 0.39 | 2 | 2 | 0 | Y | VAGRVDGL | 92.31 | VAGKVDGL | 7.69 | | | | |
| NS2B | 1399 | 0.39 | 2 | 2 | 0 | Y | AGRVDGLE | 92.31 | AGKVDGLE | 7.69 | | | | |
| NS2B | 1400 | 0.39 | 2 | 2 | 0 | Y | GRVDGLEL | 92.31 | GKVDGLEL | 7.69 | | | | |
| NS2B | 1401 | 0.77 | 3 | 3 | 0 | Y | RVDGLELK | 84.62 | RVDGLELK | 7.69 | RVDGLELR | 7.69 | | |
| NS2B | 1402 | 0.39 | 2 | 2 | 0 | Y | VDGLELKK | 92.31 | VDGLELRK | 7.69 | | | | |
| NS2B | 1403 | 0.39 | 2 | 2 | 0 | Y | DGLELKKL | 92.31 | DGLELRKL | 7.69 | | | | |
| NS2B | 1404 | 0.39 | 2 | 2 | 0 | Y | GLELKKLG | 92.31 | GLELRKLG | 7.69 | | | | |
| NS2B | 1405 | 0.39 | 2 | 2 | 0 | Y | LELKKLGE | 92.31 | LELRKLGE | 7.69 | | | | |
| NS2B | 1406 | 0.62 | 3 | 3 | 0 | Y | ELKKLGEV | 88.46 | ELRKLGEV | 7.69 | ELKKLGEI | 3.85 | | |
| NS2B | 1407 | 0.85 | 4 | 4 | 0 | Y | LKKLGEVS | 84.62 | LRKLGEVS | 7.69 | LKKLGEVA | 3.85 | LKKLGEIS | 3.85 |
| NS2B | 1408 | 0.85 | 4 | 4 | 0 | Y | KKLGEVSW | 84.62 | RKLGEVSW | 7.69 | KKLGEISW | 3.85 | KKLGEVAW | 3.85 |
| NS2B | 1409 | 0.47 | 3 | 3 | 0 | Y | KLGEVSWE | 92.31 | KLGEISWE | 3.85 | KLGEVAWE | 3.85 | | |
| NS2B | 1410 | 0.47 | 3 | 3 | 0 | Y | LGEVSWEE | 92.31 | LGEISWEE | 3.85 | LGEVAWEE | 3.85 | | |
| NS2B | 1411 | 0.47 | 3 | 3 | 0 | Y | GEVSWEEE | 92.31 | GEISWEEE | 3.85 | GEVAWEEE | 3.85 | | |
| NS2B | 1412 | 0.47 | 3 | 3 | 0 | Y | EVSWEEEA | 92.31 | EISWEEEA | 3.85 | EVAWEEEA | 3.85 | | |
| NS2B | 1413 | 0.47 | 3 | 3 | 0 | Y | VSWEEEAE | 92.31 | ISWEEEAE | 3.85 | VAWEEEAE | 3.85 | | |
| NS2B | 1414 | 0.24 | 2 | 2 | 0 | Y | SWEEEAEI | 96.15 | AWEEEAEI | 3.85 | | | | |
| NS2B | 1415 | 0 | 1 | 1 | 0 | Y | WEEEAEIS | 100 | | | | | | |
| NS2B | 1416 | 0 | 1 | 1 | 0 | Y | EEEAEISG | 100 | | | | | | |
| NS2B | 1417 | 0 | 1 | 1 | 0 | Y | EEAEISGS | 100 | | | | | | |
| NS2B | 1418 | 0 | 1 | 1 | 0 | Y | EAEISGSS | 100 | | | | | | |
| NS2B | 1419 | 0.52 | 2 | 2 | 0 | Y | AEISGSSA | 88.46 | AEISGSSS | 11.54 | | | | |
| NS2B | 1420 | 0.52 | 2 | 2 | 0 | Y | EISGSSAR | 88.46 | EISGSSSR | 11.54 | | | | |
| NS2B | 1421 | 0.52 | 2 | 2 | 0 | Y | ISGSSARY | 88.46 | ISGSSSRY | 11.54 | | | | |

Fig. 27-57

Species: YFV (8-mers)

| protein | block

Fig. 27-58

Species: YFV (8-mers)

| protein | block starting position | block ent

Fig. 27-59

Species: YFV (8-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1472 | 0.62 | 3 | 3 | 0 | Y | LAGWLFHV | 88.46 | LGGWLFHI | 7.69 | LGGWLFHI | 3.85 | | |
| NS2B | 1473 | 1.12 | 4 | 4 | 0 | Y | AGWLFHVR | 76.92 | AGWLFHVK | 11.54 | GGWVLFHI | 7.69 | GGWILHIK | 3.85 |
| NS2B | 1474 | 1.48 | 5 | 5 | 0 | Y | GWLFHVRG | 69.23 | GWLFHVKG | 11.54 | GWLFHVRR | 7.69 | GWVLHIKG | 7.69 |
| NS2B | 1475 | 1.48 | 5 | 5 | 0 | Y | WLFHVRGA | 69.23 | WLFHVKGA | 11.54 | WLFHVRRA | 7.69 | WVLHIKGA | 7.69 |
| NS2B | 1476 | 1.48 | 5 | 4 | 0 | Y | LFHVRGAR | 69.23 | LFHVRGAR | 11.54 | LFHVRRAR | 7.69 | VLHIKGAR | 7.69 |
| NS2B | 1477 | 1.37 | 4 | 4 | 0 | Y | FHVRGARR | 69.23 | FHVKGARR | 11.54 | FHVKGARR | 11.54 | FHVRRARR | 7.69 |
| NS2B | 1478 | 1.37 | 4 | 4 | 0 | Y | HVRGARRS | 69.23 | HVKGARRS | 11.54 | HIKGARRS | 11.54 | HVRRARRS | 7.69 |
| NS2B | 1479 | 1.37 | 4 | 4 | 0 | Y | VRGARRSG | 69.23 | VKGARRSG | 11.54 | IKGARRSG | 11.54 | VRARRSG | 7.69 |
| NS2B | 1480 | 1.14 | 3 | 3 | 0 | Y | RGARRSGD | 69.23 | KGARRSGD | 23.08 | RRARRSGD | 7.69 | | |
| NS2B | 1481 | 0.39 | 2 | 2 | 0 | Y | GARRSGDV | 92.31 | RARRSGDV | 7.69 | | | | |
| NS2B | 1482 | 0 | 1 | 1 | 0 | Y | ARKSGDVL | 100 | | | | | | |
| NS2B | 1483 | 0 | 1 | 1 | 0 | Y | RRSGDVLW | 100 | | | | | | |
| NS2B | 1484 | 0 | 1 | 1 | 0 | Y | RSGDVLWD | 100 | | | | | | |
| NS2B | 1485 | 0 | 1 | 1 | 0 | Y | SGDVLWDI | 100 | | | | | | |
| NS3 | 1486 | 0 | 1 | 1 | 0 | Y | GDVLWDIP | 100 | | | | | | |
| NS3 | 1487 | 0 | 1 | 1 | 0 | Y | DVLWDIPT | 100 | | | | | | |
| NS3 | 1488 | 0 | 1 | 1 | 0 | Y | VLWDIPTP | 100 | | | | | | |
| NS3 | 1489 | 0 | 1 | 1 | 0 | Y | LWDIPTPK | 100 | | | | | | |
| NS3 | 1490 | 0.62 | 2 | 2 | 0 | Y | WDIPTPKI | 84.62 | WDIPTPKV | 15.38 | | | | |
| NS3 | 1491 | 0.62 | 2 | 2 | 0 | Y | DIPTPKII | 84.62 | DIPTPKVI | 15.38 | | | | |
| NS3 | 1492 | 0.62 | 2 | 2 | 0 | Y | IPTPKIIE | 84.62 | IPTPKVIE | 15.38 | | | | |
| NS3 | 1493 | 0.62 | 2 | 2 | 0 | Y | PTPKIIEE | 84.62 | PTPKVIEE | 15.38 | | | | |
| NS3 | 1494 | 0.62 | 2 | 2 | 0 | Y | TPKIIEEC | 84.62 | TPKVIEEC | 15.38 | | | | |
| NS3 | 1495 | 0.62 | 2 | 2 | 0 | Y | PKIIEECE | 84.62 | PKVIEECE | 15.38 | | | | |
| NS3 | 1496 | 0.74 | 3 | 3 | 0 | Y | KIIEECEH | 84.62 | KVIEECEH | 11.54 | KVIEECEY | 3.85 | | |

Fig. 27-60

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1497 | 0.74 | 3 | 3 | 0 | Y | IIEECEHL | 84.62 | VIEECEHL | 11.54 | VIEECEYL | 3.85 | | |
| NS3 | 1498 | 0.24 | 2 | 2 | 0 | Y | IEECEHLE | 96.15 | IEECEYLE | 3.85 | | | | |
| NS3 | 1499 | 0.24 | 2 | 2 | 0 | Y | EECEHLED | 96.15 | EECEYLED | 3.85 | | | | |
| NS3 | 1500 | 0.24 | 2 | 2 | 0 | Y | ECEHLEDG | 96.15 | ECEYLEDG | 3.85 | | | | |
| NS3 | 1501 | 0.24 | 2 | 2 | 0 | Y | CEHLEDGI | 96.15 | CEYLEDGI | 3.85 | | | | |
| NS3 | 1502 | 0.47 | 3 | 3 | 0 | Y | EHLEDGIY | 92.31 | EHLEDGIS | 3.85 | EYLEDGIY | 3.85 | | |
| NS3 | 1503 | 0.47 | 3 | 3 | 0 | Y | HLEDGIYG | 92.31 | HLEDGISG | 3.85 | YLEDGIYG | 3.85 | | |
| NS3 | 1504 | 0.24 | 2 | 2 | 0 | Y | LEDGIYGI | 96.15 | LEDGISGI | 3.85 | | | | |
| NS3 | 1505 | 0.24 | 2 | 2 | 0 | Y | EDGIYGIF | 96.15 | EDGISGIF | 3.85 | | | | |
| NS3 | 1506 | 0.24 | 2 | 2 | 0 | Y | DGIYGIFQ | 96.15 | DGISGIFQ | 3.85 | | | | |
| NS3 | 1507 | 0.24 | 2 | 2 | 0 | Y | GIYGIFQS | 96.15 | GISGIFQS | 3.85 | | | | |
| NS3 | 1508 | 0.24 | 2 | 2 | 0 | Y | IYGIFQST | 96.15 | ISGIFQST | 3.85 | | | | |
| NS3 | 1509 | 0.24 | 2 | 2 | 0 | Y | YGIFQSTF | 96.15 | SGIFQSTF | 3.85 | | | | |
| NS3 | 1510 | 0 | 1 | 1 | 0 | Y | GIFQSTFL | 100 | | | | | | |
| NS3 | 1511 | 0 | 1 | 1 | 0 | Y | IFQSTFLG | 100 | | | | | | |
| NS3 | 1512 | 0 | 1 | 1 | 0 | Y | FQSTFLGA | 100 | | | | | | |
| NS3 | 1513 | 0 | 1 | 1 | 0 | Y | QSTFLGAS | 100 | | | | | | |
| NS3 | 1514 | 0 | 1 | 1 | 0 | Y | STFLGASQ | 100 | | | | | | |
| NS3 | 1515 | 0 | 1 | 1 | 0 | Y | TFLGASQR | 100 | | | | | | |
| NS3 | 1516 | 0 | 1 | 1 | 0 | Y | FLGASQRG | 100 | | | | | | |
| NS3 | 1517 | 0 | 1 | 1 | 0 | Y | LGASQRGV | 100 | | | | | | |
| NS3 | 1518 | 0 | 1 | 1 | 0 | Y | GASQRGVG | 100 | | | | | | |
| NS3 | 1519 | 0 | 1 | 1 | 0 | Y | ASQRGVGV | 100 | | | | | | |
| NS3 | 1520 | 0 | 1 | 1 | 0 | Y | SQRGVGVA | 100 | | | | | | |
| NS3 | 1521 | 0 | 1 | 1 | 0 | Y | QRGVGVAQ | 100 | | | | | | |

Fig. 27-61

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1522 | 0 | 1 | 1 | 0 | Y | RGVGVAQG | 100 | | | | | | |
| NS3 | 1523 | 0 | 1 | 1 | 0 | Y | GVGVAQGG | 100 | | | | | | |
| NS3 | 1524 | 0 | 1 | 1 | 0 | Y | VGVAQGGV | 100 | | | | | | |
| NS3 | 1525 | 0 | 1 | 1 | 0 | Y | GVAQGGVF | 100 | | | | | | |
| NS3 | 1526 | 0 | 1 | 1 | 0 | Y | VAQGGVFH | 100 | | | | | | |
| NS3 | 1527 | 0 | 1 | 1 | 0 | Y | AQGGVFHT | 100 | | | | | | |
| NS3 | 1528 | 0 | 1 | 1 | 0 | Y | QGGVFHTM | 100 | | | | | | |
| NS3 | 1529 | 0 | 1 | 1 | 0 | Y | GGVFHTMW | 100 | | | | | | |
| NS3 | 1530 | 0 | 1 | 1 | 0 | Y | GVFHTMWH | 100 | | | | | | |
| NS3 | 1531 | 0 | 1 | 1 | 0 | Y | VFHTMWHV | 100 | | | | | | |
| NS3 | 1532 | 0 | 1 | 1 | 0 | Y | FHTMWHVT | 100 | | | | | | |
| NS3 | 1533 | 0 | 1 | 1 | 0 | Y | HTMWHVTR | 100 | | | | | | |
| NS3 | 1534 | 0 | 1 | 1 | 0 | Y | TMWHVTRG | 100 | | | | | | |
| NS3 | 1535 | 0 | 1 | 1 | 0 | Y | MWHVTRGA | 100 | | | | | | |
| NS3 | 1536 | 0 | 1 | 1 | 0 | Y | WHVTRGAF | 100 | | | | | | |
| NS3 | 1537 | 0 | 1 | 1 | 0 | Y | HVTRGAFL | 100 | | | | | | |
| NS3 | 1538 | 0.52 | 2 | 2 | 0 | Y | VTRGAFLV | 88.46 | VTRGAFLL | 11.54 | | | | |
| NS3 | 1539 | 0.74 | 3 | 3 | 0 | Y | TRGAFLVR | 84.62 | TRGAFLLR | 11.54 | TRGAFLVW | 3.85 | | |
| NS3 | 1540 | 0.74 | 3 | 3 | 0 | Y | RGAFLVRN | 84.62 | RGAFLLRN | 11.54 | RGAFLVWN | 3.85 | | |
| NS3 | 1541 | 0.74 | 3 | 3 | 0 | Y | GAFLVRNG | 84.62 | GAFLLRNG | 11.54 | GAFLVWNG | 3.85 | | |
| NS3 | 1542 | 0.74 | 3 | 3 | 0 | Y | AFLVRNGK | 84.62 | AFLLRNGK | 11.54 | AFLVWNGK | 3.85 | | |
| NS3 | 1543 | 0.74 | 3 | 3 | 0 | Y | FLVRNGKK | 84.62 | FLLRNGKK | 11.54 | FLVWNGKK | 3.85 | | |
| NS3 | 1544 | 0.74 | 3 | 3 | 0 | Y | LVRNGKKL | 84.62 | LLRNGKKL | 11.54 | LVWNGKKL | 3.85 | | |
| NS3 | 1545 | 0.74 | 3 | 3 | 0 | Y | VRNGKKLI | 84.62 | LRNGKKLI | 11.54 | VWNGKKLI | 3.85 | | |
| NS3 | 1546 | 0.74 | 3 | 3 | 0 | Y | RNGKKLIP | 84.62 | RNGKKLVP | 11.54 | WNGKKLIP | 3.85 | | |

Fig. 27-62

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1547 | 0.52 | 2 | 2 | 0 | Y | NGKKLIPS | 88.46 | NGKKLVPS | 11.54 | | | | |
| NS3 | 1548 | 0.52 | 2 | 2 | 0 | Y | GKKLIPSW | 88.46 | GKKLVPSW | 11.54 | | | | |
| NS3 | 1549 | 0.52 | 2 | 2 | 0 | Y | KKLIPSWA | 88.46 | KKLVPSWA | 11.54 | | | | |
| NS3 | 1550 | 0.52 | 2 | 2 | 0 | Y | KLIPSWAS | 88.46 | KLVPSWAS | 11.54 | | | | |
| NS3 | 1551 | 0.52 | 2 | 2 | 0 | Y | LIPSWASV | 88.46 | LVPSWASV | 11.54 | | | | |
| NS3 | 1552 | 0.52 | 2 | 2 | 0 | Y | IPSWASVK | 88.46 | VPSWASVK | 11.54 | | | | |
| NS3 | 1553 | 0 | 1 | 1 | 0 | Y | PSWASVKE | 100 | | | | | | |
| NS3 | 1554 | 0 | 1 | 1 | 0 | Y | SWASVKED | 100 | | | | | | |
| NS3 | 1555 | 0 | 1 | 1 | 0 | Y | WASVKEDL | 100 | | | | | | |
| NS3 | 1556 | 0 | 1 | 1 | 0 | Y | ASVKEDLV | 100 | | | | | | |
| NS3 | 1557 | 0 | 1 | 1 | 0 | Y | SVKEDLVA | 100 | | | | | | |
| NS3 | 1558 | 0 | 1 | 1 | 0 | Y | VKEDLVAY | 100 | | | | | | |
| NS3 | 1559 | 0 | 1 | 1 | 0 | Y | KEDLVAYG | 100 | | | | | | |
| NS3 | 1560 | 0 | 1 | 1 | 0 | Y | EDLVAYGG | 100 | | | | | | |
| NS3 | 1561 | 0 | 1 | 1 | 0 | Y | DLVAYGGS | 100 | | | | | | |
| NS3 | 1562 | 0 | 1 | 1 | 0 | Y | LVAYGGSW | 100 | | | | | | |
| NS3 | 1563 | 0 | 1 | 1 | 0 | Y | VAYGGSWK | 100 | | | | | | |
| NS3 | 1564 | 0 | 1 | 1 | 0 | Y | AYGGSWKL | 100 | | | | | | |
| NS3 | 1565 | 0.52 | 2 | 2 | 0 | Y | YGGSWKLE | 88.46 | YGGSWKLD | 11.54 | | | | |
| NS3 | 1566 | 0.52 | 2 | 2 | 0 | Y | GGSWKLEG | 88.46 | GGSWKLDG | 11.54 | | | | |
| NS3 | 1567 | 0.62 | 3 | 3 | 0 | Y | GSWKLEGR | 88.46 | GSWKLDGK | 7.69 | GSWKLDGR | 3.85 | | |
| NS3 | 1568 | 0.62 | 3 | 3 | 0 | Y | SWKLEGRW | 88.46 | SWKLDGKW | 7.69 | SWKLDGRW | 3.85 | | |
| NS3 | 1569 | 0.62 | 3 | 3 | 0 | Y | WKLEGRWD | 88.46 | WKLDGKWD | 7.69 | WKLDGRWD | 3.85 | | |
| NS3 | 1570 | 0.62 | 3 | 3 | 0 | Y | KLEGRWDG | 88.46 | KLDGKWDG | 7.69 | KLDGRWDG | 3.85 | | |
| NS3 | 1571 | 0.62 | 3 | 3 | 0 | Y | LEGRWDGE | 88.46 | LDGKWDGE | 7.69 | LDGRWDGE | 3.85 | | |

Species: YFV (8-mers)

Fig. 27-63

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1572 | 0.62 | 3 | 3 | 0 | Y | EGRWDGEE | 88.46 | DGRWDGEE | 7.69 | DGRWDGEE | 3.85 | | |
| NS3 | 1573 | 0.39 | 2 | 2 | 0 | Y | GRWDGEEE | 92.31 | GKWDGEEE | 7.69 | | | | |
| NS3 | 1574 | 0.39 | 2 | 2 | 0 | Y | RWDGEEEV | 92.31 | KWDGEEEV | 7.69 | | | | |
| NS3 | 1575 | 0 | 1 | 1 | 0 | Y | WDGEEEVQ | 100 | | | | | | |
| NS3 | 1576 | 0 | 1 | 1 | 0 | Y | DGEEEVQL | 100 | | | | | | |
| NS3 | 1577 | 0 | 1 | 1 | 0 | Y | GEEEVQLI | 100 | | | | | | |
| NS3 | 1578 | 0 | 1 | 1 | 0 | Y | EEEVQLIA | 100 | | | | | | |
| NS3 | 1579 | 0 | 1 | 1 | 0 | Y | EEVQLIAA | 100 | | | | | | |
| NS3 | 1580 | 0.24 | 2 | 2 | 0 | Y | EVQLIAAV | 96.15 | EVQLIAAA | 3.85 | | | | |
| NS3 | 1581 | 0.24 | 2 | 2 | 0 | Y | VQLIAAVP | 96.15 | VQLIAAAP | 3.85 | | | | |
| NS3 | 1582 | 0.24 | 2 | 2 | 0 | Y | QLIAAVPG | 96.15 | QLIAAAPG | 3.85 | | | | |
| NS3 | 1583 | 0.24 | 2 | 2 | 0 | Y | LIAAVPGK | 96.15 | LIAAAPGK | 3.85 | | | | |
| NS3 | 1584 | 0.85 | 4 | 4 | 0 | Y | IAAVPGKN | 84.62 | IAAVPGKS | 7.69 | IAAAPGKN | 3.85 | | |
| NS3 | 1585 | 0.85 | 4 | 4 | 0 | Y | AAVPGKNV | 84.62 | AAVPGKSV | 7.69 | AAAPGKNV | 3.85 | | |
| NS3 | 1586 | 0.85 | 4 | 4 | 0 | Y | AVPGKNVV | 84.62 | AVPGKSVW | 7.69 | AAPGKNVV | 3.85 | | |
| NS3 | 1587 | 0.85 | 4 | 4 | 0 | Y | VPGKNVVN | 84.62 | APGKNVVN | 7.69 | VPGKSVWN | 3.85 | | |
| NS3 | 1588 | 0.62 | 3 | 3 | 0 | Y | PGKNVVNV | 88.46 | PGKSVWNV | 7.69 | | | | |
| NS3 | 1589 | 0.62 | 3 | 3 | 0 | Y | GKNVVNVQ | 88.46 | GKAVVNVQ | 7.69 | | | | |
| NS3 | 1590 | 0.62 | 3 | 3 | 0 | Y | KNVVNVQT | 88.46 | KAVVNVQT | 7.69 | | | | |
| NS3 | 1591 | 0.62 | 3 | 3 | 0 | Y | NVVNVQTK | 88.46 | AVVNVQTK | 7.69 | | | | |
| NS3 | 1592 | 0 | 1 | 1 | 0 | Y | VVNVQTKP | 100 | | | | | | |
| NS3 | 1593 | 0 | 1 | 1 | 0 | Y | VNVQTKPS | 100 | | | | | | |
| NS3 | 1594 | 0.24 | 2 | 2 | 0 | Y | NVQTKPSL | 96.15 | NVQTKPSV | 3.85 | | | | |
| NS3 | 1595 | 0.24 | 2 | 2 | 0 | Y | VQTKPSLF | 96.15 | VQTKPSVF | 3.85 | | | | |
| NS3 | 1596 | 0.47 | 3 | 3 | 0 | Y | QTKPSLFK | 92.31 | QTKPSVFK | 3.85 | QTKPSLFR | 3.85 | | |

Fig. 27-64

Species: YFV (8-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1597 | 0.47 | 3 | 3 | 0 | Y | TKPSLFKV | 92.31 | TKPSLFRV | 3.85 | TKPSVFKV | 3.85 | | |
| NS3 | 1598 | 0.47 | 3 | 3 | 0 | Y | KPSLFKVR | 92.31 | KPSLFRVK | 3.85 | KPSVFKVR | 3.85 | | |
| NS3 | 1599 | 0.47 | 3 | 3 | 0 | Y | PSLFKVRN | 92.31 | PSLFRVKN | 3.85 | PSVFKVRN | 3.85 | | |
| NS3 | 1600 | 0.47 | 3 | 3 | 0 | Y | SLFKVRNG | 92.31 | SVFKVRNG | 3.85 | SLFRVKNG | 3.85 | | |
| NS3 | 1601 | 0.47 | 3 | 3 | 0 | Y | LFKVRNGG | 92.31 | VFKVRNGG | 3.85 | LFRVKNGG | 3.85 | | |
| NS3 | 1602 | 0.24 | 2 | 2 | 0 | Y | FKVRNGGE | 96.15 | FRVKNGGE | 3.85 | | | | |
| NS3 | 1603 | 0.24 | 2 | 2 | 0 | Y | KVRNGGEI | 96.15 | RVKNGGEI | 3.85 | | | | |
| NS3 | 1604 | 0.24 | 2 | 2 | 0 | Y | VRNGGEIG | 96.15 | VKNGGEIG | 3.85 | | | | |
| NS3 | 1605 | 0.24 | 2 | 2 | 0 | Y | RNGGEIGA | 96.15 | KNGGEIGA | 3.85 | | | | |
| NS3 | 1606 | 0 | 1 | 1 | 0 | Y | NGGEIGAV | 100 | | | | | | |
| NS3 | 1607 | 0 | 1 | 1 | 0 | Y | GGEIGAVA | 100 | | | | | | |
| NS3 | 1608 | 0 | 1 | 1 | 0 | Y | GEIGAVAL | 100 | | | | | | |
| NS3 | 1609 | 0 | 1 | 1 | 0 | Y | EIGAVALD | 100 | | | | | | |
| NS3 | 1610 | 0 | 1 | 1 | 0 | Y | IGAVALDY | 100 | | | | | | |
| NS3 | 1611 | 0 | 1 | 1 | 0 | Y | GAVALDYP | 100 | | | | | | |
| NS3 | 1612 | 0 | 1 | 1 | 0 | Y | AVALDYPS | 100 | | | | | | |
| NS3 | 1613 | 0 | 1 | 1 | 0 | Y | VALDYPSG | 100 | | | | | | |
| NS3 | 1614 | 0 | 1 | 1 | 0 | Y | ALDYPSGT | 100 | | | | | | |
| NS3 | 1615 | 0 | 1 | 1 | 0 | Y | LDYPSGTS | 100 | | | | | | |
| NS3 | 1616 | 0 | 1 | 1 | 0 | Y | DYPSGTSG | 100 | | | | | | |
| NS3 | 1617 | 0 | 1 | 1 | 0 | Y | YPSGTSGS | 100 | | | | | | |
| NS3 | 1618 | 0 | 1 | 1 | 0 | Y | PSGTSGSP | 100 | | | | | | |
| NS3 | 1619 | 0 | 1 | 1 | 0 | Y | SGTSGSPI | 100 | | | | | | |
| NS3 | 1620 | 0 | 1 | 1 | 0 | Y | GTSGSPIV | 100 | | | | | | |
| NS3 | 1621 | 0 | 1 | 1 | 0 | Y | TSGSPIVN | 100 | | | | | | |

Fig. 27-65

Species: YFV (8-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1622 | 0 | 1 | 1 | 0 | Y | SGSPIVNR | 100 | | | | | | |
| NS3 | 1623 | 0.39 | 2 | 2 | 0 | Y | GSPIVNRN | 92.31 | GSPIVNRS | 7.69 | | | | |
| NS3 | 1624 | 0.39 | 2 | 2 | 0 | Y | SPIVNRNG | 92.31 | SPIVNRSG | 7.69 | | | | |
| NS3 | 1625 | 0.39 | 2 | 2 | 0 | Y | PIVNRNGE | 92.31 | PIVNRSGE | 7.69 | | | | |
| NS3 | 1626 | 0.39 | 2 | 2 | 0 | Y | IVNRNGEV | 92.31 | IVNRSGEV | 7.69 | | | | |
| NS3 | 1627 | 0.62 | 3 | 3 | 0 | Y | VNRNGEVI | 88.46 | VNRSGEVV | 7.69 | VNRNGEVV | 3.85 | | |
| NS3 | 1628 | 0.62 | 3 | 3 | 0 | Y | NRNGEVIG | 88.46 | NRSGEVVG | 7.69 | NRNGEVVG | 3.85 | | |
| NS3 | 1629 | 0.62 | 3 | 3 | 0 | Y | RNGEVIGL | 88.46 | RSGEVVGL | 7.69 | RNGEVVGL | 3.85 | | |
| NS3 | 1630 | 0.62 | 3 | 3 | 0 | Y | NGEVIGLY | 88.46 | SGEVVGLY | 7.69 | NGEVVGLY | 3.85 | | |
| NS3 | 1631 | 0.52 | 2 | 2 | 0 | Y | GEVIGLYG | 88.46 | GEVVGLYG | 11.54 | | | | |
| NS3 | 1632 | 0.52 | 2 | 2 | 0 | Y | EVIGLYGN | 88.46 | EVVGLYGN | 11.54 | | | | |
| NS3 | 1633 | 0.52 | 2 | 2 | 0 | Y | VIGLYGNG | 88.46 | VVGLYGNG | 11.54 | | | | |
| NS3 | 1634 | 0.52 | 2 | 2 | 0 | Y | IGLYGNGI | 88.46 | VGLYGNGI | 11.54 | | | | |
| NS3 | 1635 | 0 | 1 | 1 | 0 | Y | GLYGNGIL | 100 | | | | | | |
| NS3 | 1636 | 0 | 1 | 1 | 0 | Y | LYGNGILV | 100 | | | | | | |
| NS3 | 1637 | 0 | 1 | 1 | 0 | Y | YGNGILVG | 100 | | | | | | |
| NS3 | 1638 | 0 | 1 | 1 | 0 | Y | GNGILVGD | 100 | | | | | | |
| NS3 | 1639 | 0 | 1 | 1 | 0 | Y | NGILVGDN | 100 | | | | | | |
| NS3 | 1640 | 0 | 1 | 1 | 0 | Y | GILVGDNS | 100 | | | | | | |
| NS3 | 1641 | 0 | 1 | 1 | 0 | Y | ILVGDNSF | 100 | | | | | | |
| NS3 | 1642 | 0 | 1 | 1 | 0 | Y | LVGDNSFV | 100 | | | | | | |
| NS3 | 1643 | 0 | 1 | 1 | 0 | Y | VGDNSFVS | 100 | | | | | | |
| NS3 | 1644 | 0 | 1 | 1 | 0 | Y | GDNSFVSA | 100 | | | | | | |
| NS3 | 1645 | 0 | 1 | 1 | 0 | Y | DNSFVSAI | 100 | | | | | | |
| NS3 | 1646 | 0 | 1 | 1 | 0 | Y | NSFVSAIS | 100 | | | | | | |

Fig. 27-66

Species: YFV (8-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1647 | 0 | 1 | 1 | 0 | Y | SFVSAISQ | 100 | | | | | | |
| NS3 | 1648 | 0 | 1 | 1 | 0 | Y | FVSAISQT | 100 | | | | | | |
| NS3 | 1649 | 0 | 1 | 1 | 0 | Y | VSAISQTE | 100 | | | | | | |
| NS3 | 1650 | 0.24 | 2 | 2 | 0 | Y | SAISQTEV | 96.15 | SAISQTEL | 3.85 | | | | |
| NS3 | 1651 | 0.24 | 2 | 2 | 0 | Y | AISQTEVK | 96.15 | AISQTELK | 3.85 | | | | |
| NS3 | 1652 | 0.24 | 2 | 2 | 0 | Y | ISQTEVKE | 96.15 | ISQTELKE | 3.85 | | | | |
| NS3 | 1653 | 0.24 | 2 | 2 | 0 | Y | SQTEVKEE | 96.15 | SQTELKEE | 3.85 | | | | |
| NS3 | 1654 | 0.62 | 3 | 3 | 0 | Y | QTEVKEEG | 88.46 | QTEVKEES | 7.69 | QTELKEES | 3.85 | | |
| NS3 | 1655 | 0.62 | 3 | 3 | 0 | Y | TEVKEEGK | 88.46 | TEVKEESK | 7.69 | TELKEESK | 3.85 | | |
| NS3 | 1656 | 0.62 | 3 | 3 | 0 | Y | EVKEEGKE | 88.46 | EVKEESKE | 7.69 | ELKEESKE | 3.85 | | |
| NS3 | 1657 | 0.62 | 3 | 3 | 0 | Y | VKEEGKEE | 88.46 | VKEESKEE | 7.69 | LKEESKEE | 3.85 | | |
| NS3 | 1658 | 0.52 | 2 | 2 | 0 | Y | KEEGKEEL | 88.46 | KEESKEEL | 11.54 | | | | |
| NS3 | 1659 | 1.01 | 3 | 3 | 0 | Y | EEGKEELQ | 76.92 | EESKEELQ | 11.54 | EEGKEELR | 11.54 | | |
| NS3 | 1660 | 1.01 | 3 | 3 | 0 | Y | EGKEELQE | 76.92 | EGKEELRE | 11.54 | ESKEELQE | 11.54 | | |
| NS3 | 1661 | 1.01 | 3 | 3 | 0 | Y | GKEELQEI | 76.92 | GKEELREI | 11.54 | SKEELQEI | 11.54 | | |
| NS3 | 1662 | 0.74 | 3 | 3 | 0 | Y | KEELQEIP | 84.62 | KEELREIP | 11.54 | KEELQEIS | 3.85 | | |
| NS3 | 1663 | 0.74 | 3 | 3 | 0 | Y | EELQEIPT | 84.62 | EELREIPT | 11.54 | EELQEIST | 3.85 | | |
| NS3 | 1664 | 0.74 | 3 | 3 | 0 | Y | ELQEIPTM | 84.62 | ELREIPTM | 11.54 | ELQEISTM | 3.85 | | |
| NS3 | 1665 | 0.74 | 3 | 3 | 0 | Y | LQEIPTML | 84.62 | LREIPTML | 11.54 | LQEISTML | 3.85 | | |
| NS3 | 1666 | 0.74 | 3 | 3 | 0 | Y | QEIPTMLK | 84.62 | REIPTMLK | 11.54 | QEISTMLK | 3.85 | | |
| NS3 | 1667 | 0.24 | 2 | 2 | 0 | Y | EIPTMLKK | 96.15 | EISTMLKK | 3.85 | | | | |
| NS3 | 1668 | 0.24 | 2 | 2 | 0 | Y | IPTMLKKG | 96.15 | ISTMLKKG | 3.85 | | | | |
| NS3 | 1669 | 0.62 | 3 | 3 | 0 | Y | PTMLKKGM | 88.46 | PTMLKKGK | 7.69 | STMLKKGM | 3.85 | | |
| NS3 | 1670 | 0.39 | 2 | 2 | 0 | Y | TMLKKGMT | 92.31 | TMLKKGKT | 7.69 | | | | |
| NS3 | 1671 | 0.39 | 2 | 2 | 0 | Y | MLKKGMTT | 92.31 | MLKKGKTT | 7.69 | | | | |

Fig. 27-67

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1672 | 1.31 | 3 | 3 | 0 | Y | LKKGMTTI | 46.15 | LKKGMTTV | 46.15 | LKKGKTTI | 7.69 | | |
| NS3 | 1673 | 1.31 | 3 | 3 | 0 | Y | KKGMTTVL | 46.15 | KKGMTTIL | 46.15 | KKGKTTIL | 7.69 | | |
| NS3 | 1674 | 1.31 | 3 | 3 | 0 | Y | KGMTTILD | 46.15 | KGMTTYLD | 46.15 | KGKTTILD | 7.69 | | |
| NS3 | 1675 | 1.51 | 4 | 4 | 0 | Y | GMTTVLDF | 46.15 | GMTTILDF | 42.31 | GKTTILDF | 7.69 | GMTTILDY | 3.85 |
| NS3 | 1676 | 1.51 | 4 | 4 | 0 | Y | MTTVLDFH | 46.15 | MTTILDFH | 42.31 | KTTILDFH | 7.69 | MTTILDYH | 3.85 |
| NS3 | 1677 | 1.2 | 3 | 3 | 0 | Y | TTILDFHP | 50 | TTVLDFHP | 46.15 | TTILDYHP | 3.85 | | |
| NS3 | 1678 | 1.2 | 3 | 3 | 0 | Y | TILDFHPG | 50 | TVLDFHPG | 46.15 | TILDYHPG | 3.85 | | |
| NS3 | 1679 | 1.2 | 3 | 3 | 0 | Y | ILDFHPGA | 50 | VLDFHPGA | 46.15 | ILDYHPGA | 3.85 | | |
| NS3 | 1680 | 0.24 | 2 | 2 | 0 | Y | LDFHPGAG | 96.15 | LDYHPGAG | 3.85 | | | | |
| NS3 | 1681 | 0.24 | 2 | 2 | 0 | Y | DFHPGAGK | 96.15 | DYHPGAGK | 3.85 | | | | |
| NS3 | 1682 | 0.24 | 2 | 2 | 0 | Y | FHPGAGKT | 96.15 | YHPGAGKT | 3.85 | | | | |
| NS3 | 1683 | 0 | 1 | 1 | 0 | Y | HPGAGKTR | 100 | | | | | | |
| NS3 | 1684 | 0 | 1 | 1 | 0 | Y | PGAGKTRR | 100 | | | | | | |
| NS3 | 1685 | 0 | 1 | 1 | 0 | Y | GAGKTRRF | 100 | | | | | | |
| NS3 | 1686 | 0 | 1 | 1 | 0 | Y | AGKTRRFL | 100 | | | | | | |
| NS3 | 1687 | 0 | 1 | 1 | 0 | Y | GKTRRFLP | 100 | | | | | | |
| NS3 | 1688 | 0 | 1 | 1 | 0 | Y | KTRRFLPQ | 100 | | | | | | |
| NS3 | 1689 | 0 | 1 | 1 | 0 | Y | TRRFLPQI | 100 | | | | | | |
| NS3 | 1690 | 0 | 1 | 1 | 0 | Y | RRFLPQIL | 100 | | | | | | |
| NS3 | 1691 | 0 | 1 | 1 | 0 | Y | RFLPQILA | 100 | | | | | | |
| NS3 | 1692 | 0 | 1 | 1 | 0 | Y | FLPQILAE | 100 | | | | | | |
| NS3 | 1693 | 0 | 1 | 1 | 0 | Y | LPQILAEC | 100 | | | | | | |
| NS3 | 1694 | 0 | 1 | 1 | 0 | Y | PQILAECA | 100 | | | | | | |
| NS3 | 1695 | 0 | 1 | 1 | 0 | Y | QILAECAR | 100 | | | | | | |
| NS3 | 1696 | 0 | 1 | 1 | 0 | Y | ILAECARR | 100 | | | | | | |

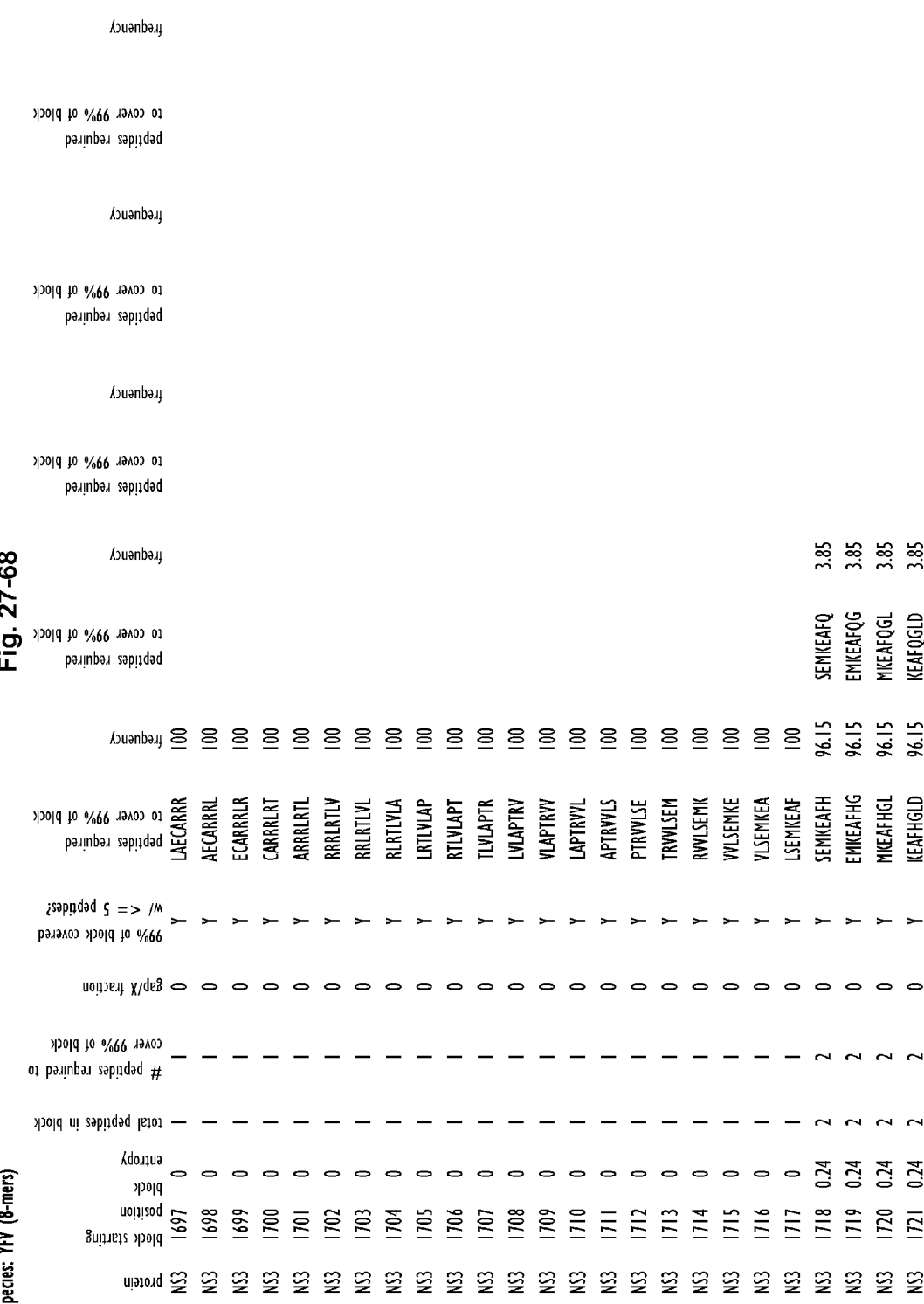

Fig. 27-69

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1722 | 0.24 | 2 | 2 | 0 | Y | EAFHGLDV | 96.15 | EAFQGLDV | 3.85 | | | | |
| NS3 | 1723 | 0.24 | 2 | 2 | 0 | Y | AFHGLDVK | 96.15 | AFQGLDVK | 3.85 | | | | |
| NS3 | 1724 | 0.24 | 2 | 2 | 0 | Y | FHGLDVKF | 96.15 | FQGLDVKF | 3.85 | | | | |
| NS3 | 1725 | 0.24 | 2 | 2 | 0 | Y | HGLDVKFH | 96.15 | QGLDVKFH | 3.85 | | | | |
| NS3 | 1726 | 0 | 1 | 1 | 0 | Y | GLDVKFHT | 100 | | | | | | |
| NS3 | 1727 | 0 | 1 | 1 | 0 | Y | LDVKFHTQ | 100 | | | | | | |
| NS3 | 1728 | 0 | 1 | 1 | 0 | Y | DVKFHTQA | 100 | | | | | | |
| NS3 | 1729 | 0 | 1 | 1 | 0 | Y | VKFHTQAF | 100 | | | | | | |
| NS3 | 1730 | 0 | 1 | 1 | 0 | Y | KFHTQAFS | 100 | | | | | | |
| NS3 | 1731 | 0 | 1 | 1 | 0 | Y | FHTQAFSA | 100 | | | | | | |
| NS3 | 1732 | 0 | 1 | 1 | 0 | Y | HTQAFSAH | 100 | | | | | | |
| NS3 | 1733 | 0 | 1 | 1 | 0 | Y | TQAFSAHG | 100 | | | | | | |
| NS3 | 1734 | 0 | 1 | 1 | 0 | Y | QAFSAHGS | 100 | | | | | | |
| NS3 | 1735 | 0 | 1 | 1 | 0 | Y | AFSAHGSG | 100 | | | | | | |
| NS3 | 1736 | 0.52 | 2 | 2 | 0 | Y | FSAHGSGR | 88.46 | FSAHGSGK | 11.54 | | | | |
| NS3 | 1737 | 0.52 | 2 | 2 | 0 | Y | SAHGGRE | 88.46 | SAHGSGKE | 11.54 | | | | |
| NS3 | 1738 | 0.52 | 2 | 2 | 0 | Y | AHGSGREV | 88.46 | AHGSGKEV | 11.54 | | | | |
| NS3 | 1739 | 0.52 | 2 | 2 | 0 | Y | HGSGREVI | 88.46 | HGSGKEVI | 11.54 | | | | |
| NS3 | 1740 | 0.52 | 2 | 2 | 0 | Y | GSGREVID | 88.46 | GSGKEVID | 11.54 | | | | |
| NS3 | 1741 | 0.74 | 3 | 3 | 0 | Y | SGREVIDA | 84.62 | SGKEVIDA | 11.54 | SGREVIDV | 3.85 | | |
| NS3 | 1742 | 0.74 | 3 | 3 | 0 | Y | GREVIDAM | 84.62 | GKEVIDAM | 11.54 | GREVIDVM | 3.85 | | |
| NS3 | 1743 | 0.74 | 3 | 3 | 0 | Y | REVIDAMC | 84.62 | KEVIDAMC | 11.54 | REVIDVMC | 3.85 | | |
| NS3 | 1744 | 0.24 | 2 | 2 | 0 | Y | EVIDAMCH | 96.15 | EVIDVMCH | 3.85 | | | | |
| NS3 | 1745 | 0.24 | 2 | 2 | 0 | Y | VIDAMCHA | 96.15 | VIDVMCHA | 3.85 | | | | |
| NS3 | 1746 | 0.24 | 2 | 2 | 0 | Y | IDAMCHAT | 96.15 | IDVMCHAT | 3.85 | | | | |

Fig. 27-70

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1747 | 0.24 | 2 | 2 | 0 | Y | DAMCHATL | 96.15 | DVMCHATL | 3.85 | | | | |
| NS3 | 1748 | 0.24 | 2 | 2 | 0 | Y | AMCHATLT | 96.15 | VMCHATLT | 3.85 | | | | |
| NS3 | 1749 | 0 | 1 | 1 | 0 | Y | MCHATLTY | 100 | | | | | | |
| NS3 | 1750 | 0 | 1 | 1 | 0 | Y | CHATLTYR | 100 | | | | | | |
| NS3 | 1751 | 0 | 1 | 1 | 0 | Y | HATLTYRM | 100 | | | | | | |
| NS3 | 1752 | 0 | 1 | 1 | 0 | Y | ATLTYRML | 100 | | | | | | |
| NS3 | 1753 | 0 | 1 | 1 | 0 | Y | TLTYRMLE | 100 | | | | | | |
| NS3 | 1754 | 0 | 1 | 1 | 0 | Y | LTYRMLEP | 100 | | | | | | |
| NS3 | 1755 | 0 | 1 | 1 | 0 | Y | TYRMLEPT | 100 | | | | | | |
| NS3 | 1756 | 0 | 1 | 1 | 0 | Y | YRMLEPTR | 100 | | | | | | |
| NS3 | 1757 | 1 | 3 | 3 | 0 | Y | RMLEPTRV | 73.08 | RMLEPTRI | 23.08 | RMLEPTRA | 3.85 | | |
| NS3 | 1758 | 1 | 3 | 3 | 0 | Y | MLEPTRVN | 73.08 | MLEPTRIV | 23.08 | MLEPTRAV | 3.85 | | |
| NS3 | 1759 | 1 | 3 | 3 | 0 | Y | LEPTRVNW | 73.08 | LEPTRIVN | 23.08 | LEPTRAVN | 3.85 | | |
| NS3 | 1760 | 1 | 3 | 3 | 0 | Y | EPTRVNWE | 73.08 | EPTRIVNW | 23.08 | EPTRAVNW | 3.85 | | |
| NS3 | 1761 | 1 | 3 | 3 | 0 | Y | PTRVNWEV | 73.08 | PTRIVNWE | 23.08 | PTRAVNWE | 3.85 | | |
| NS3 | 1762 | 1 | 3 | 3 | 0 | Y | TRVNWEVI | 73.08 | TRIVNWEV | 23.08 | TRAVNWEV | 3.85 | | |
| NS3 | 1763 | 1 | 3 | 3 | 0 | Y | RVNWEVII | 73.08 | RIVNWEVI | 23.08 | RAVNWEVI | 3.85 | | |
| NS3 | 1764 | 1 | 3 | 3 | 0 | Y | VNWEVIIM | 73.08 | IVNWEVII | 23.08 | AVNWEVII | 3.85 | | |
| NS3 | 1765 | 0 | 1 | 1 | 0 | Y | VNWEVIIM | 100 | | | | | | |
| NS3 | 1766 | 0 | 1 | 1 | 0 | Y | NWEVIIMD | 100 | | | | | | |
| NS3 | 1767 | 0 | 1 | 1 | 0 | Y | WEVIIMDE | 100 | | | | | | |
| NS3 | 1768 | 0 | 1 | 1 | 0 | Y | EVIIMDEA | 100 | | | | | | |
| NS3 | 1769 | 0 | 1 | 1 | 0 | Y | VIIMDEAH | 100 | | | | | | |
| NS3 | 1770 | 0 | 1 | 1 | 0 | Y | IIMDEAHF | 100 | | | | | | |
| NS3 | 1771 | 0 | 1 | 1 | 0 | Y | IMDEAHFL | 100 | | | | | | |

Fig. 27-72

Species: YFV (8-mers)

| protein | block starting position | block entropy | total peptides in block | # peptides required to cover 99

Fig. 27-73

Species: YFV (8-mers)

| protein | block starting position | block entropy | total

Fig. 27-74

| Species: YFV (8-mers) | protein | block starting position | block entropy | total peptides in block | #

Fig. 27-75

Species: YFV (8-mers)

| protein | block starting position | block entropy | total peptides in block | # peptides required to cover 99% of block | g

Fig. 27-76

Species: YFV (8-mers)

| protein | block starting position | block entropy | total

Fig. 27-77

Species: YFV (8-mers)

| protein | block starting position | block entropy | total pe

Fig. 27-78

Species: YFV (8-mers)

| protein | block starting position

Fig. 27-79

Species: YFV (8-mers)

| protein | block starting position | entropy block

Fig. 27-80

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1997 | 0.85 | 3 | 3 | 0 | Y | YGVEGTKT | 80.77 | YGIEGTKT | 15.38 | YGVEGIKT | 3.85 |
| NS3 | 1998 | 0.85 | 3 | 3 | 0 | Y | GVEGTKTP | 80.77 | GIEGTKTP | 15.38 | GVEGIKTP | 3.85 |
| NS3 | 1999 | 0.85 | 3 | 3 | 0 | Y | VEGTKTPV | 80.77 | IEGTKTPV | 15.38 | VEGIKTPV | 3.85 |
| NS3 | 2000 | 0.24 | 2 | 2 | 0 | Y | EGTKTPVS | 96.15 | EGIKTPVS | 3.85 | | |
| NS3 | 2001 | 0.24 | 2 | 2 | 0 | Y | GTKTPVSP | 96.15 | GIKTPVSP | 3.85 | | |
| NS3 | 2002 | 0.24 | 2 | 2 | 0 | Y | TKTPVSPG | 96.15 | IKTPVSPG | 3.85 | | |
| NS3 | 2003 | 0 | 1 | 1 | 0 | Y | KTPVSPGE | 100 | | | | |
| NS3 | 2004 | 0 | 1 | 1 | 0 | Y | TPVSPGEM | 100 | | | | |
| NS3 | 2005 | 0 | 1 | 1 | 0 | Y | PVSPGEMR | 100 | | | | |
| NS3 | 2006 | 0 | 1 | 1 | 0 | Y | VSPGEMRL | 100 | | | | |
| NS3 | 2007 | 0 | 1 | 1 | 0 | Y | SPGEMRLR | 100 | | | | |
| NS3 | 2008 | 0 | 1 | 1 | 0 | Y | PGEMRLRD | 100 | | | | |
| NS3 | 2009 | 0 | 1 | 1 | 0 | Y | GEMRLRDD | 100 | | | | |
| NS3 | 2010 | 0 | 1 | 1 | 0 | Y | EMRLRDDQ | 100 | | | | |
| NS3 | 2011 | 0 | 1 | 1 | 0 | Y | MRLRDDQR | 100 | | | | |
| NS3 | 2012 | 0.62 | 2 | 2 | 0 | Y | RLRDDQRK | 84.62 | RLRDDQRR | 15.38 | | |
| NS3 | 2013 | 0.62 | 2 | 2 | 0 | Y | LRDDQRKV | 84.62 | LRDDQRRV | 15.38 | | |
| NS3 | 2014 | 0.74 | 3 | 3 | 0 | Y | RDDQRKVF | 84.62 | RDDQRRVF | 11.54 | RDDQRRVS | 3.85 |
| NS3 | 2015 | 0.74 | 3 | 3 | 0 | Y | DDQRKVFR | 84.62 | DDQRRVFR | 11.54 | DDQRRVSR | 3.85 |
| NS3 | 2016 | 0.74 | 3 | 3 | 0 | Y | DQRKVFRE | 84.62 | DQRRVFRE | 11.54 | DQRRVSRE | 3.85 |
| NS3 | 2017 | 0.74 | 3 | 3 | 0 | Y | QRKVFREL | 84.62 | QRRVFREL | 11.54 | QRRVSREL | 3.85 |
| NS3 | 2018 | 0.74 | 3 | 3 | 0 | Y | RKVFRELV | 84.62 | RRVFRELV | 11.54 | RRVSRELV | 3.85 |
| NS3 | 2019 | 0.74 | 3 | 3 | 0 | Y | KVFRELVR | 84.62 | RVFRELVR | 11.54 | RVSRELVR | 3.85 |
| NS3 | 2020 | 0.74 | 3 | 3 | 0 | Y | VFRELVRN | 84.62 | VFRELVRG | 11.54 | VSRELVRN | 3.85 |
| NS3 | 2021 | 0.74 | 3 | 3 | 0 | Y | FRELVRNC | 84.62 | FRELVRGC | 11.54 | SRELVRNC | 3.85 |

Fig. 27-81

Species: YFV (8-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2022 | 0.52 | 2 | 2 | 0 | Y | RELVRNCD | 88.46 | RELVRGCD | 11.54 | ELVRNCDQ | 3.85 | | |
| NS3 | 2023 | 0.76 | 3 | 3 | 3.85 | Y | ELVRNCDL | 80.77 | ELVRGCDL | 11.54 | LVRNCDQP | 3.85 | | |
| NS3 | 2024 | 0.76 | 3 | 3 | 3.85 | Y | LVRNCDLP | 80.77 | LVRGCDLP | 11.54 | VRNCDQPV | 3.85 | | |
| NS3 | 2025 | 0.76 | 3 | 3 | 3.85 | Y | VRNCDLPV | 80.77 | VRGCDLPV | 11.54 | RNCDQPVW | 3.85 | | |
| NS3 | 2026 | 0.76 | 3 | 3 | 3.85 | Y | RNCDLPVW | 80.77 | RGCDLPVW | 11.54 | NCDQPVWL | 3.85 | | |
| NS3 | 2027 | 0.76 | 3 | 3 | 3.85 | Y | NCDLPVWL | 80.77 | GCDLPVWL | 11.54 | CDLPVWLA | 3.85 | | |
| NS3 | 2028 | 0.48 | 3 | 3 | 3.85 | Y | CDLPVWLS | 88.46 | CDQPVWLS | 3.85 | DLPVWLAW | 3.85 | | |
| NS3 | 2029 | 0.48 | 3 | 3 | 3.85 | Y | DLPVWLSW | 88.46 | DQPVWLSW | 3.85 | QPVWLSWQ | 3.85 | | |
| NS3 | 2030 | 0.48 | 3 | 3 | 3.85 | Y | LPVWLSWQ | 88.46 | LPVWLAWQ | 3.85 | | | | |
| NS3 | 2031 | 0.24 | 2 | 2 | 0 | Y | PVWLSWQV | 96.15 | PWWLAWQV | 3.85 | | | | |
| NS3 | 2032 | 0.24 | 2 | 2 | 0 | Y | VWLSWQVA | 96.15 | VWLAWQVA | 3.85 | | | | |
| NS3 | 2033 | 0.24 | 2 | 2 | 0 | Y | WLSWQVAK | 96.15 | WLAWQVAK | 3.85 | | | | |
| NS3 | 2034 | 0.47 | 3 | 3 | 0 | Y | LSWQVAKA | 92.31 | LSWQVAKP | 3.85 | LAWQVAKA | 3.85 | | |
| NS3 | 2035 | 0.47 | 3 | 3 | 0 | Y | SWQVAKAG | 92.31 | SWQVAKPG | 3.85 | AWQVAKAG | 3.85 | | |
| NS3 | 2036 | 0.24 | 2 | 2 | 0 | Y | WQVAKAGL | 96.15 | WQVAKPGL | 3.85 | | | | |
| NS3 | 2037 | 0.24 | 2 | 2 | 0 | Y | QVAKAGLK | 96.15 | QVAKPGLK | 3.85 | | | | |
| NS3 | 2038 | 0.24 | 2 | 2 | 0 | Y | VAKAGLKT | 96.15 | VAKPGLKT | 3.85 | | | | |
| NS3 | 2039 | 0.24 | 2 | 2 | 0 | Y | AKAGLKTN | 96.15 | AKPGLKTN | 3.85 | | | | |
| NS3 | 2040 | 0.24 | 2 | 2 | 0 | Y | KAGLKTND | 96.15 | KPGLKTND | 3.85 | | | | |
| NS3 | 2041 | 0.24 | 2 | 2 | 0 | Y | AGLKTNDR | 96.15 | PGLKTNDR | 3.85 | | | | |
| NS3 | 2042 | 0 | 1 | 1 | 0 | Y | GLKTNDRK | 100 | | | | | | |
| NS3 | 2043 | 0 | 1 | 1 | 0 | Y | LKTNDRKW | 100 | | | | | | |
| NS3 | 2044 | 0 | 1 | 1 | 0 | Y | KTNDRKWC | 100 | | | | | | |
| NS3 | 2045 | 0 | 1 | 1 | 0 | Y | TNDRKWCF | 100 | | | | | | |
| NS3 | 2046 | 0.24 | 2 | 2 | 0 | Y | NDRKWCFE | 96.15 | NDRKWCFD | 3.85 | | | | |

Fig. 27-82

Species: YFV (8-mers)

| protein | block starting position | block entropy | total peptides in block | # peptides required to cover 99% of block | gap/X fraction |

Fig. 27-83

Species: YFV (8-mers)

| protein | block starting position | entropy | total

Fig. 27-84

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2097 | 0.78 | 2 | 2 | 0 | Y | SEFIKFAE | 76.92 | ADFIKFAE | 23.08 | | | | |
| NS3 | 2098 | 0.78 | 2 | 2 | 0 | Y | EFIKFAEG | 76.92 | DFIKFAEG | 23.08 | | | | |
| NS3 | 2099 | 0 | 1 | 1 | 0 | Y | FIKFAEGR | 100 | | | | | | |
| NS3 | 2100 | 0 | 1 | 1 | 0 | Y | IKFAEGRR | 100 | | | | | | |
| NS3 | 2101 | 0 | 1 | 1 | 0 | Y | KFAEGRRG | 100 | | | | | | |
| NS3 | 2102 | 0 | 1 | 1 | 0 | Y | FAEGRRGA | 100 | | | | | | |
| NS3 | 2103 | 0 | 1 | 1 | 0 | Y | AEGRRGAA | 100 | | | | | | |
| NS3 | 2104 | 0.24 | 2 | 2 | 0 | Y | EGRRGAAE | 96.15 | EGRRGAAD | 3.85 | | | | |
| NS3 | 2105 | 0.97 | 4 | 4 | 0 | Y | GRRGAAEV | 80.77 | GRRGAAEM | 11.54 | GRRGAAEI | 3.85 | GRRGAADV | 3.85 |
| NS3 | 2106 | 0.97 | 4 | 4 | 0 | Y | RRGAAEVL | 80.77 | RRGAAEML | 11.54 | RRGAAEIL | 3.85 | RRGAADVL | 3.85 |
| NS3 | 2107 | 0.97 | 4 | 4 | 0 | Y | RGAAEVLV | 80.77 | RGAADVLV | 11.54 | RGAAEILV | 3.85 | RGAAEILY | 3.85 |
| NS4A | 2108 | 1.08 | 5 | 5 | 0 | Y | GAAEVLVW | 80.77 | GAAEMLVI | 7.69 | GAAEMLVW | 3.85 | GAAEILVW | 3.85 |
| NS4A | 2109 | 1.08 | 5 | 5 | 0 | Y | AAEVLVWL | 80.77 | AAEMLVIL | 7.69 | AAEMLVWL | 3.85 | AAEILVWL | 3.85 |
| NS4A | 2110 | 1.08 | 5 | 5 | 0 | Y | AEVLVWLS | 80.77 | AEMLVILT | 7.69 | AEILVWLS | 3.85 | AEMLVILT | 3.85 |
| NS4A | 2111 | 1.08 | 5 | 5 | 0 | Y | EVLVWLSE | 80.77 | EMLVILTE | 7.69 | EILVWLSE | 3.85 | EMLVILTE | 3.85 |
| NS4A | 2112 | 0.85 | 4 | 4 | 0 | Y | VLVWLSEL | 84.62 | MLVILTEL | 7.69 | | | | |
| NS4A | 2113 | 0.62 | 3 | 3 | 0 | Y | LVWLSELP | 88.46 | LVILTELP | 7.69 | ILVWLSEL | 3.85 | | |
| NS4A | 2114 | 0.62 | 3 | 3 | 0 | Y | VWLSELPD | 88.46 | VILTELPD | 7.69 | | | | |
| NS4A | 2115 | 0.62 | 3 | 3 | 0 | Y | VLSELPDF | 88.46 | VILTELPDF | 7.69 | | | | |
| NS4A | 2116 | 0.52 | 2 | 2 | 0 | Y | LSELPDFL | 88.46 | LTELPDFL | 11.54 | | | | |
| NS4A | 2117 | 0.52 | 2 | 2 | 0 | Y | SELPDFLA | 88.46 | TELPDFLA | 11.54 | | | | |
| NS4A | 2118 | 0 | 1 | 1 | 0 | Y | ELPDFLAK | 100 | | | | | | |
| NS4A | 2119 | 0 | 1 | 1 | 0 | Y | LPDFLAKK | 100 | | | | | | |
| NS4A | 2120 | 0 | 1 | 1 | 0 | Y | PDFLAKKG | 100 | | | | | | |
| NS4A | 2121 | 0 | 1 | 1 | 0 | Y | DFLAKKGG | 100 | | | | | | |

Fig. 27-85

Species: YFV (8

Fig. 27-86

Species: YFV (8-mers)

| protein | block starting position | block entropy | total peptides in block | # peptides required to cover 99% of block | gap/X fraction | 99% of block covered w/ <= 5 peptides? | peptides required

Fig. 27-87

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2172 | 0.24 | 2 | 2 | 0 | Y | SGMVIFFM | 96.15 | SGAVIFFM | 3.85 | | | | |
| NS4A | 2173 | 0.24 | 2 | 2 | 0 | Y | GMVIFFMS | 96.15 | GAVIFFMS | 3.85 | | | | |
| NS4A | 2174 | 0.24 | 2 | 2 | 0 | Y | MVIFFMSP | 96.15 | AVIFFMSP | 3.85 | | | | |
| NS4A | 2175 | 0 | 1 | 1 | 0 | Y | VIFFMSPK | 100 | | | | | | |
| NS4A | 2176 | 0 | 1 | 1 | 0 | Y | IFFMSPKG | 100 | | | | | | |
| NS4A | 2177 | 0.52 | 2 | 2 | 0 | Y | FFMSPKGI | 88.46 | FFMSPKGM | 11.54 | | | | |
| NS4A | 2178 | 0.52 | 2 | 2 | 0 | Y | FMSPKGIS | 88.46 | FMSPKGMS | 11.54 | | | | |
| NS4A | 2179 | 0.52 | 2 | 2 | 0 | Y | MSPKGISR | 88.46 | MSPKGMSR | 11.54 | | | | |
| NS4A | 2180 | 0.52 | 2 | 2 | 0 | Y | SPKGISRM | 88.46 | SPKGMSRM | 11.54 | | | | |
| NS4A | 2181 | 0.52 | 2 | 2 | 0 | Y | PKGISRMS | 88.46 | PKGMSRMS | 11.54 | | | | |
| NS4A | 2182 | 0.52 | 2 | 2 | 0 | Y | KGISRMSM | 88.46 | KGMSRMSM | 11.54 | | | | |
| NS4A | 2183 | 0.52 | 2 | 2 | 0 | Y | GISRMSMA | 88.46 | GMSRMSMA | 11.54 | | | | |
| NS4A | 2184 | 0.74 | 3 | 3 | 0 | Y | ISRMSMAM | 84.62 | MSRMSMAM | 11.54 | ISRMSMAK | 3.85 | | |
| NS4A | 2185 | 0.24 | 2 | 2 | 0 | Y | SRMSMAMG | 96.15 | SRMSMAKG | 3.85 | | | | |
| NS4A | 2186 | 0.24 | 2 | 2 | 0 | Y | RMSMAMGT | 96.15 | RMSMAKGT | 3.85 | | | | |
| NS4A | 2187 | 0.24 | 2 | 2 | 0 | Y | MSMAMGTM | 96.15 | MSMAKGTM | 3.85 | | | | |
| NS4A | 2188 | 0.24 | 2 | 2 | 0 | Y | SMAMGTMA | 96.15 | SMAKGTMA | 3.85 | | | | |
| NS4A | 2189 | 0.24 | 2 | 2 | 0 | Y | MAMGTMAG | 96.15 | MAKGTMAG | 3.85 | | | | |
| NS4A | 2190 | 0.74 | 3 | 3 | 0 | Y | AMGTMAGC | 84.62 | AMGTMAGS | 11.54 | AKGTMAGC | 3.85 | | |
| NS4A | 2191 | 0.74 | 3 | 3 | 0 | Y | MGTMAGCG | 84.62 | MGTMAGSG | 11.54 | KGTMAGCG | 3.85 | | |
| NS4A | 2192 | 0.52 | 2 | 2 | 0 | Y | GTMAGCGY | 88.46 | GTMAGSGY | 11.54 | | | | |
| NS4A | 2193 | 0.52 | 2 | 2 | 0 | Y | TMAGCGY | 88.46 | TMAGSGYL | 11.54 | | | | |
| NS4A | 2194 | 0.52 | 2 | 2 | 0 | Y | MAGCGYLM | 88.46 | MAGGGYLM | 11.54 | | | | |
| NS4A | 2195 | 0.52 | 2 | 2 | 0 | Y | AGCGYLMF | 88.46 | AGGGYLMF | 11.54 | | | | |
| NS4A | 2196 | 0.52 | 2 | 2 | 0 | Y | GCGYLMFL | 88.46 | GSGYLMFL | 11.54 | | | | |

Fig. 27-88

Species: YFV (8-mers)

| protein | block starting position | entropy | total peptides in block | # peptides required to cover 99% of block | gap/X

Fig. 27-89

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2222 | 0.39 | 2 | 2 | 0 | Y | MVWIPEP | 92.31 | MVWIIPEP | 7.69 | | | | |
| NS4A | 2223 | 0.39 | 2 | 2 | 0 | Y | VWIPEPG | 92.31 | VWIIPEPG | 7.69 | | | | |
| NS4A | 2224 | 0.39 | 2 | 2 | 0 | Y | VIPEPGQ | 92.31 | VIIPEPGQ | 7.69 | | | | |
| NS4A | 2225 | 0.39 | 2 | 2 | 0 | Y | VIPEPGQQ | 92.31 | IIPEPGQQ | 7.69 | | | | |
| NS4A | 2226 | 0 | 1 | 1 | 0 | Y | IPEPGQQR | 100 | | | | | | |
| NS4A | 2227 | 0.39 | 2 | 2 | 0 | Y | PEPGQQRS | 92.31 | PEPGQQRT | 7.69 | | | | |
| NS4A | 2228 | 0.39 | 2 | 2 | 0 | Y | EPGQQRSI | 92.31 | EPGQQRTI | 7.69 | | | | |
| NS4A | 2229 | 0.39 | 2 | 2 | 0 | Y | PGQQRSIQ | 92.31 | PGQQRTIQ | 7.69 | | | | |
| NS4A | 2230 | 0.39 | 2 | 2 | 0 | Y | GQQRSIQD | 92.31 | GQQRTIQD | 7.69 | | | | |
| NS4A | 2231 | 0.39 | 2 | 2 | 0 | Y | QQRSIQDN | 92.31 | QQRTIQDN | 7.69 | | | | |
| NS4A | 2232 | 0.39 | 2 | 2 | 0 | Y | QRSIQDNQ | 92.31 | QRTIQDNQ | 7.69 | | | | |
| NS4A | 2233 | 0.39 | 2 | 2 | 0 | Y | RSIQDNQV | 92.31 | RTIQDNQV | 7.69 | | | | |
| NS4A | 2234 | 0.39 | 2 | 2 | 0 | Y | SIQDNQVA | 92.31 | TIQDNQVA | 7.69 | | | | |
| NS4A | 2235 | 0.39 | 2 | 2 | 0 | Y | IQDNQVAY | 92.31 | IQDNQVAF | 7.69 | | | | |
| NS4A | 2236 | 0.39 | 2 | 2 | 0 | Y | QDNQVAYL | 92.31 | QDNQVAFL | 7.69 | | | | |
| NS4A | 2237 | 0.39 | 2 | 2 | 0 | Y | DNQVAYLI | 92.31 | DNQVAFLI | 7.69 | | | | |
| NS4A | 2238 | 0.39 | 2 | 2 | 0 | Y | NQVAYLII | 92.31 | NQVAFLII | 7.69 | | | | |
| NS4A | 2239 | 0.39 | 2 | 2 | 0 | Y | QVAYLIIG | 92.31 | QVAFLIIG | 7.69 | | | | |
| NS4A | 2240 | 0.39 | 2 | 2 | 0 | Y | VAYLIIGI | 92.31 | VAFLIIGI | 7.69 | | | | |
| NS4A | 2241 | 0.39 | 2 | 2 | 0 | Y | AYLIIGIL | 92.31 | AFLIIGIL | 7.69 | | | | |
| NS4A | 2242 | 0.39 | 2 | 2 | 0 | Y | YLIIGILT | 92.31 | FLIIGILT | 7.69 | | | | |
| 2K | 2243 | 0 | 1 | 1 | 0 | Y | LIIGILTL | 100 | | | | | | |
| 2K | 2244 | 0.52 | 2 | 2 | 0 | Y | IIGILTLV | 88.46 | IIGILTL | 11.54 | | | | |
| 2K | 2245 | 0.52 | 2 | 2 | 0 | Y | IGILTLVS | 88.46 | IGILTLLS | 11.54 | | | | |
| 2K | 2246 | 1.41 | 4 | 4 | 0 | Y | GILTLVSA | 61.54 | GILTLVSV | 26.92 | GILTLSV | 7.69 | GILTLLSI | 3.85 |

Fig. 27-90

Species: YFV (8-mers)

| protein | block starting position | block entropy | total pe

Fig. 27-91

Species: YFV (8-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2281 | 0.62 | 3 | 3 | 0 | Y | ASPWSWPD | 88.46 | TIPWSWPD | 7.69 | AIPWSWPD | 3.85 | | | | |
| NS4B | 2282 | 0.52 | 2 | 2 | 0 | Y | SPWSWPDL | 88.46 | IPWSWPDL | 11.54 | | | | | | |
| NS4B | 2283 | 0 | 1 | 1 | 0 | Y | PWSWPDLD | 100 | | | | | | | | |
| NS4B | 2284 | 0 | 1 | 1 | 0 | Y | WSWPDLDL | 100 | | | | | | | | |
| NS4B | 2285 | 0 | 1 | 1 | 0 | Y | SWPDLDLK | 100 | | | | | | | | |
| NS4B | 2286 | 0 | 1 | 1 | 0 | Y | WPDLDLKP | 100 | | | | | | | | |
| NS4B | 2287 | 0 | 1 | 1 | 0 | Y | PDLDLKPG | 100 | | | | | | | | |
| NS4B | 2288 | 0 | 1 | 1 | 0 | Y | DLDLKPGA | 100 | | | | | | | | |
| NS4B | 2289 | 0 | 1 | 1 | 0 | Y | LDLKPGAA | 100 | | | | | | | | |
| NS4B | 2290 | 0 | 1 | 1 | 0 | Y | DLKPGAAW | 100 | | | | | | | | |
| NS4B | 2291 | 0 | 1 | 1 | 0 | Y | LKPGAAWT | 100 | | | | | | | | |
| NS4B | 2292 | 0 | 1 | 1 | 0 | Y | KPGAAWTV | 100 | | | | | | | | |
| NS4B | 2293 | 0 | 1 | 1 | 0 | Y | PGAAWTVY | 100 | | | | | | | | |
| NS4B | 2294 | 0 | 1 | 1 | 0 | Y | GAAWTVYV | 100 | | | | | | | | |
| NS4B | 2295 | 0 | 1 | 1 | 0 | Y | AAWTVYVG | 100 | | | | | | | | |
| NS4B | 2296 | 0 | 1 | 1 | 0 | Y | AWTVYVGI | 100 | | | | | | | | |
| NS4B | 2297 | 0 | 1 | 1 | 0 | Y | WTVYVGIV | 100 | | | | | | | | |
| NS4B | 2298 | 0 | 1 | 1 | 0 | Y | TVYVGIVT | 100 | | | | | | | | |
| NS4B | 2299 | 0.24 | 2 | 2 | 0 | Y | YVVGIVTM | 96.15 | YVVGIVTI | 3.85 | | | | | | |
| NS4B | 2300 | 0.24 | 2 | 2 | 0 | Y | YVGIVTML | 96.15 | YVGIVTIL | 3.85 | | | | | | |
| NS4B | 2301 | 0.24 | 2 | 2 | 0 | Y | VGIVTMLS | 96.15 | VGIVTILS | 3.85 | | | | | | |
| NS4B | 2302 | 0.24 | 2 | 2 | 0 | Y | GIVTMLSP | 96.15 | GIVTILSP | 3.85 | | | | | | |
| NS4B | 2303 | 0.24 | 2 | 2 | 0 | Y | IVTMLSPM | 96.15 | IVTILSPM | 3.85 | | | | | | |
| NS4B | 2304 | 0.24 | 2 | 2 | 0 | Y | VTMLSPML | 96.15 | VTILSPML | 3.85 | | | | | | |
| NS4B | 2305 | 0.24 | 2 | 2 | 0 | Y | TMLSPMLH | 96.15 | TILSPMLH | 3.85 | | | | | | |

Fig. 27-92

Species: YFV (8-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4B | 2306 | 0.24 | 2 | 2 | 0 | Y | MLSPMLHH | 96.15 | ILSPMLHH | 3.85 |
| NS4B | 2307 | 0 | 1 | 1 | 0 | Y | LSPMLHHW | 100 | | |
| NS4B | 2308 | 0 | 1 | 1 | 0 | Y | SPMLHHWI | 100 | | |
| NS4B | 2309 | 0 | 1 | 1 | 0 | Y | PMLHHWIK | 100 | | |
| NS4B | 2310 | 0 | 1 | 1 | 0 | Y | MLHHWIKV | 100 | | |
| NS4B | 2311 | 0 | 1 | 1 | 0 | Y | LHHWIKVE | 100 | | |
| NS4B | 2312 | 0 | 1 | 1 | 0 | Y | HHWIKVEY | 100 | | |
| NS4B | 2313 | 0 | 1 | 1 | 0 | Y | HWIKVEYG | 100 | | |
| NS4B | 2314 | 0 | 1 | 1 | 0 | Y | WIKVEYGN | 100 | | |
| NS4B | 2315 | 0 | 1 | 1 | 0 | Y | IKVEYGNL | 100 | | |
| NS4B | 2316 | 0 | 1 | 1 | 0 | Y | KVEYGNLS | 100 | | |
| NS4B | 2317 | 0 | 1 | 1 | 0 | Y | VEYGNLSL | 100 | | |
| NS4B | 2318 | 0 | 1 | 1 | 0 | Y | EYGNLSLS | 100 | | |
| NS4B | 2319 | 0 | 1 | 1 | 0 | Y | YGNLSLSG | 100 | | |
| NS4B | 2320 | 0 | 1 | 1 | 0 | Y | GNLSLSGI | 100 | | |
| NS4B | 2321 | 0 | 1 | 1 | 0 | Y | NLSLSGIA | 100 | | |
| NS4B | 2322 | 0 | 1 | 1 | 0 | Y | LSLSGIAQ | 100 | | |
| NS4B | 2323 | 0 | 1 | 1 | 0 | Y | SLSGIAQS | 100 | | |
| NS4B | 2324 | 0 | 1 | 1 | 0 | Y | LSGIAQSA | 100 | | |
| NS4B | 2325 | 0 | 1 | 1 | 0 | Y | SGIAQSAS | 100 | | |
| NS4B | 2326 | 0 | 1 | 1 | 0 | Y | GIAQSASV | 100 | | |
| NS4B | 2327 | 0 | 1 | 1 | 0 | Y | IAQSASVL | 100 | | |
| NS4B | 2328 | 0 | 1 | 1 | 0 | Y | AQSASVLS | 100 | | |
| NS4B | 2329 | 0 | 1 | 1 | 0 | Y | QSASVLSF | 100 | | |
| NS4B | 2330 | 0 | 1 | 1 | 0 | Y | SASVLSFM | 100 | | |

Fig. 27-93

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2331 | 0 | 1 | 1 | 0 | Y | ASVLSFMD | 100 | | | | | | |
| NS4B | 2332 | 0 | 1 | 1 | 0 | Y | SVLSFMDK | 100 | | | | | | |
| NS4B | 2333 | 0 | 1 | 1 | 0 | Y | VLSFMDKG | 100 | | | | | | |
| NS4B | 2334 | 0.24 | 2 | 2 | 0 | Y | LSFMDKGI | 96.15 | LSFMDKGV | 3.85 | | | | |
| NS4B | 2335 | 0.24 | 2 | 2 | 0 | Y | SFMDKGIP | 96.15 | SFMDKGVP | 3.85 | | | | |
| NS4B | 2336 | 0.24 | 2 | 2 | 0 | Y | FMDKGIPF | 96.15 | FMDKGVPF | 3.85 | | | | |
| NS4B | 2337 | 0.24 | 2 | 2 | 0 | Y | MDKGIPFM | 96.15 | MDKGVPFM | 3.85 | | | | |
| NS4B | 2338 | 0.24 | 2 | 2 | 0 | Y | DKGIPFMK | 96.15 | DKGVPFMK | 3.85 | | | | |
| NS4B | 2339 | 0.24 | 2 | 2 | 0 | Y | KGIPFMKM | 96.15 | KGVPFMKM | 3.85 | | | | |
| NS4B | 2340 | 0.24 | 2 | 2 | 0 | Y | GIPFMKMN | 96.15 | GVPFMKMN | 3.85 | | | | |
| NS4B | 2341 | 0.24 | 2 | 2 | 0 | Y | IPFMKMNI | 96.15 | VPFMKMNI | 3.85 | | | | |
| NS4B | 2342 | 0 | 1 | 1 | 0 | Y | PFMKMNIS | 100 | | | | | | |
| NS4B | 2343 | 0 | 1 | 1 | 0 | Y | FMKMNISV | 100 | | | | | | |
| NS4B | 2344 | 0.52 | 2 | 2 | 0 | Y | MKMNISVI | 88.46 | MKMNISVV | 11.54 | KMNISVVI | 11.54 | | |
| NS4B | 2345 | 1.18 | 3 | 3 | 0 | Y | KMNISVIM | 69.23 | KMNISVII | 19.23 | MNISVVIL | 11.54 | | |
| NS4B | 2346 | 1.18 | 3 | 3 | 0 | Y | MNISVIML | 69.23 | MNISVIIL | 19.23 | NISVVILL | 11.54 | | |
| NS4B | 2347 | 1.18 | 3 | 3 | 0 | Y | NISVIMLL | 69.23 | NISVIILL | 19.23 | ISVVILLV | 11.54 | ISVVMLLI | 3.85 |
| NS4B | 2348 | 1.4 | 4 | 4 | 0 | Y | ISVIMLLV | 65.38 | ISVIILLV | 19.23 | SVVILLVS | 11.54 | SVVMLLIS | 3.85 |
| NS4B | 2349 | 1.4 | 4 | 4 | 0 | Y | SVIMLLVS | 65.38 | SVIILLVS | 19.23 | VILLVSG | 11.54 | VIMLLISG | 3.85 |
| NS4B | 2350 | 1.4 | 4 | 4 | 0 | Y | VIMLLVSG | 65.38 | VIILLVSG | 19.23 | ILLVSGWN | 11.54 | IMLLISGW | 3.85 |
| NS4B | 2351 | 1.1 | 3 | 4 | 0 | Y | IMLLVSGW | 65.38 | ILLVSGWN | 19.23 | MLLISGWN | 3.85 | | |
| NS4B | 2352 | 1.1 | 3 | 4 | 0 | Y | MLLVSGWN | 65.38 | ILLVSGWNS | 30.77 | | | | |
| NS4B | 2353 | 0.24 | 2 | 2 | 0 | Y | LLVSGWNS | 96.15 | LLSGWNS | 3.85 | | | | |
| NS4B | 2354 | 0.24 | 2 | 2 | 0 | Y | LVSGWNSI | 96.15 | LSGWNSI | 3.85 | | | | |
| NS4B | 2355 | 0.24 | 2 | 2 | 0 | Y | VSGWNSIT | 96.15 | SGWNSIT | 3.85 | | | | |

Fig. 27-94

Species: YFV (8-mers)

| protein | block starting position | block entropy | total peptides in block | # peptides required to cover 99% of block | gap/X fraction | 99% of block covered w/ <= 5 peptides?

Fig. 27-95

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|

Fig. 27-96

Species: YFV (8-mers)

| protein | block star

Fig. 27-97

Species: YFV (8-mers)

| protein | block starting position | entropy block | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2431 | 0 | 1 | 1 | 0 | Y | YLLLALSL | 100 | | | | | | |
| NS4B | 2432 | 0.74 | 3 | 3 | 0 | Y | LLLALSLA | 84.62 | LLLALSLM | 11.54 | LLLALSLS | 3.85 | | |
| NS4B | 2433 | 0.74 | 3 | 3 | 0 | Y | LLALSLAS | 84.62 | LLALSLMS | 11.54 | LLALSLSS | 3.85 | | |
| NS4B | 2434 | 0.74 | 3 | 3 | 0 | Y | LALSLASV | 84.62 | LALSLMSV | 11.54 | LALSLSSV | 3.85 | | |
| NS4B | 2435 | 0.74 | 3 | 3 | 0 | Y | ALSLASVA | 84.62 | ALSLMSVA | 11.54 | ALSLSSVA | 3.85 | | |
| NS4B | 2436 | 0.74 | 3 | 3 | 0 | Y | LSLASVAM | 84.62 | LSLMSVAM | 11.54 | LSLSSVAM | 3.85 | | |
| NS4B | 2437 | 0.74 | 3 | 3 | 0 | Y | SLASVAMC | 84.62 | SLMSVAMC | 11.54 | SLSSVAMC | 3.85 | | |
| NS4B | 2438 | 0.74 | 3 | 3 | 0 | Y | LASVAMCR | 84.62 | LMSVAMCR | 11.54 | LSSVAMCR | 3.85 | | |
| NS4B | 2439 | 0.74 | 3 | 3 | 0 | Y | ASVAMCRT | 84.62 | MSVAMCRT | 11.54 | SSVAMCRT | 3.85 | | |
| NS4B | 2440 | 0 | 1 | 1 | 0 | Y | SVAMCRTP | 100 | | | | | | |
| NS4B | 2441 | 0 | 1 | 1 | 0 | Y | VAMCRTPF | 100 | | | | | | |
| NS4B | 2442 | 0 | 1 | 1 | 0 | Y | AMCRTPFS | 100 | | | | | | |
| NS4B | 2443 | 0 | 1 | 1 | 0 | Y | MCRTPFSL | 100 | | | | | | |
| NS4B | 2444 | 0.24 | 2 | 2 | 0 | Y | CRTPFSLA | 96.15 | CRTPFSLD | 3.85 | | | | |
| NS4B | 2445 | 0.24 | 2 | 2 | 0 | Y | RTPFSLAE | 96.15 | RTPFSLDE | 3.85 | | | | |
| NS4B | 2446 | 0.24 | 2 | 2 | 0 | Y | TPFSLAEG | 96.15 | TPFSLDEG | 3.85 | | | | |
| NS4B | 2447 | 0.24 | 2 | 2 | 0 | Y | PFSLAEGI | 96.15 | PFSLDEGI | 3.85 | | | | |
| NS4B | 2448 | 0.24 | 2 | 2 | 0 | Y | FSLAEGIV | 96.15 | FSLDEGIV | 3.85 | | | | |
| NS4B | 2449 | 0.24 | 2 | 2 | 0 | Y | SLAEGIVL | 96.15 | SLDEGIVL | 3.85 | | | | |
| NS4B | 2450 | 0.74 | 3 | 3 | 0 | Y | LAEGIVLA | 84.62 | LAEGIVLS | 11.54 | LDEGIVLA | 3.85 | | |
| NS4B | 2451 | 0.74 | 3 | 3 | 0 | Y | AEGIVLAS | 84.62 | AEGIVLSS | 11.54 | DEGIVLAS | 3.85 | | |
| NS4B | 2452 | 0.52 | 2 | 2 | 0 | Y | EGIVLASA | 88.46 | EGIVLSSA | 11.54 | | | | |
| NS4B | 2453 | 0.52 | 2 | 2 | 0 | Y | GIVLASAA | 88.46 | GIVLSSAA | 11.54 | | | | |
| NS4B | 2454 | 1.11 | 3 | 3 | 0 | Y | IVLASAAL | 73.08 | IVLASAAS | 15.38 | IVLSSAAL | 11.54 | | |
| NS4B | 2455 | 1.11 | 3 | 3 | 0 | Y | VLASAALG | 73.08 | VLASAASG | 15.38 | VLSSAALG | 11.54 | | |

Fig. 27-98

Species: YFV (8-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2456 | 1.11 | 3 | 3 | 0 | Y | LASAALGP | 73.08 | LASAASGP | 15.38 | LSSAALGP | 11.54 | | |
| NS4B | 2457 | 1.11 | 3 | 3 | 0 | Y | ASAALGPL | 73.08 | ASAASGPL | 15.38 | SSAALGPL | 11.54 | | |
| NS4B | 2458 | 0.62 | 3 | 2 | 0 | Y | SAALGPLI | 84.62 | SAASGPLI | 15.38 | | | | |
| NS4B | 2459 | 0.62 | 2 | 2 | 0 | Y | AALGPLIE | 84.62 | AASGPLIE | 15.38 | | | | |
| NS4B | 2460 | 0.62 | 2 | 2 | 0 | Y | ALGPLIEG | 84.62 | ASGPLIEG | 15.38 | | | | |
| NS4B | 2461 | 0.62 | 2 | 2 | 0 | Y | LGPLIEGN | 84.62 | SGPLIEGN | 15.38 | | | | |
| NS4B | 2462 | 0 | 1 | 1 | 0 | Y | GPLIEGNT | 100 | | | | | | |
| NS4B | 2463 | 0 | 1 | 1 | 0 | Y | PLIEGNTS | 100 | | | | | | |
| NS4B | 2464 | 0 | 1 | 1 | 0 | Y | LIEGNTSL | 100 | | | | | | |
| NS4B | 2465 | 0 | 1 | 1 | 0 | Y | IEGNTSLL | 100 | | | | | | |
| NS4B | 2466 | 0 | 1 | 1 | 0 | Y | EGNTSLLW | 100 | | | | | | |
| NS4B | 2467 | 0 | 1 | 1 | 0 | Y | GNTSLLWN | 100 | | | | | | |
| NS4B | 2468 | 0 | 1 | 1 | 0 | Y | NTSLLWNG | 100 | | | | | | |
| NS4B | 2469 | 0 | 1 | 1 | 0 | Y | TSLLWNGP | 100 | | | | | | |
| NS4B | 2470 | 0 | 1 | 1 | 0 | Y | SLLWNGPM | 100 | | | | | | |
| NS4B | 2471 | 0 | 1 | 1 | 0 | Y | LLWNGPMA | 100 | | | | | | |
| NS4B | 2472 | 0 | 1 | 1 | 0 | Y | LWNGPMAV | 100 | | | | | | |
| NS4B | 2473 | 0 | 1 | 1 | 0 | Y | WNGPMAVS | 100 | | | | | | |
| NS4B | 2474 | 0 | 1 | 1 | 0 | Y | NGPMAVSM | 100 | | | | | | |
| NS4B | 2475 | 0 | 1 | 1 | 0 | Y | GPMAVSMT | 100 | | | | | | |
| NS4B | 2476 | 0 | 1 | 1 | 0 | Y | PMAVSMTG | 100 | | | | | | |
| NS4B | 2477 | 0 | 1 | 1 | 0 | Y | MAVSMTGV | 100 | | | | | | |
| NS4B | 2478 | 0 | 1 | 1 | 0 | Y | AVSMTGVM | 100 | | | | | | |
| NS4B | 2479 | 0 | 1 | 1 | 0 | Y | VSMTGVMR | 100 | | | | | | |
| NS4B | 2480 | 0 | 1 | 1 | 0 | Y | SMTGVMRG | 100 | | | | | | |

Fig. 27-99

Species: YFV (8-mers)

| protein | block starting position | ent

Fig. 27-100

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2510 | 0.39 | 2 | 2 | 0 | Y | ANGKTLGE | 92.31 | ASGKTLGE | 7.69 | | | | |
| NS5 | 2511 | 0.39 | 2 | 2 | 0 | Y | NGKTLGEV | 92.31 | SGKTLGEV | 7.69 | | | | |
| NS5 | 2512 | 0 | 1 | 1 | 0 | Y | GKTLGEVW | 100 | | | | | | |
| NS5 | 2513 | 0 | 1 | 1 | 0 | Y | KTLGEVWK | 100 | | | | | | |
| NS5 | 2514 | 0 | 1 | 1 | 0 | Y | TLGEVWKR | 100 | | | | | | |
| NS5 | 2515 | 0 | 1 | 1 | 0 | Y | LGEVWKRE | 100 | | | | | | |
| NS5 | 2516 | 0 | 1 | 1 | 0 | Y | GEVWKREL | 100 | | | | | | |
| NS5 | 2517 | 0 | 1 | 1 | 0 | Y | EVWKRELN | 100 | | | | | | |
| NS5 | 2518 | 0 | 1 | 1 | 0 | Y | VWKRELNL | 100 | | | | | | |
| NS5 | 2519 | 0 | 1 | 1 | 0 | Y | WKRELNLL | 100 | | | | | | |
| NS5 | 2520 | 0 | 1 | 1 | 0 | Y | KRELNLLD | 100 | | | | | | |
| NS5 | 2521 | 0.24 | 2 | 2 | 0 | Y | RELNLLDK | 96.15 | RELNLLDR | 3.85 | | | | |
| NS5 | 2522 | 1.2 | 3 | 3 | 0 | Y | ELNLLDKQ | 50 | ELNLLDKR | 46.15 | ELNLLDRQ | 3.85 | | |
| NS5 | 2523 | 1.2 | 3 | 3 | 0 | Y | LNLLDKQQ | 50 | LNLLDKRQ | 46.15 | LNLLDRQQ | 3.85 | | |
| NS5 | 2524 | 1.2 | 3 | 3 | 0 | Y | NLLDKQQF | 50 | NLLDKRQF | 46.15 | NLLDRQQF | 3.85 | | |
| NS5 | 2525 | 1.2 | 3 | 3 | 0 | Y | LLDKQQFE | 50 | LLDKRQFE | 46.15 | LLDRQQFE | 3.85 | | |
| NS5 | 2526 | 1.39 | 4 | 4 | 0 | Y | LDKQQFEL | 46.15 | LDKRQFEL | 46.15 | LDKQQFEM | 3.85 | LDRQQFEL | 3.85 |
| NS5 | 2527 | 1.39 | 4 | 4 | 0 | Y | DKQQFELY | 46.15 | DKRQFELY | 46.15 | DKQQFEMY | 3.85 | DRQQFELY | 3.85 |
| NS5 | 2528 | 1.39 | 4 | 4 | 0 | Y | KQQFELYK | 46.15 | KRQFELYK | 46.15 | KQQFEMYK | 3.85 | RQQFELYK | 3.85 |
| NS5 | 2529 | 1.2 | 3 | 3 | 0 | Y | QQFELYKR | 50 | RQFELYKR | 46.15 | QQFEMYKR | 3.85 | | |
| NS5 | 2530 | 0.24 | 2 | 2 | 0 | Y | QFELYKRT | 96.15 | QFEMYKRT | 3.85 | | | | |
| NS5 | 2531 | 0.24 | 2 | 2 | 0 | Y | FELYKRTD | 96.15 | FEMYKRTD | 3.85 | | | | |
| NS5 | 2532 | 0.24 | 2 | 2 | 0 | Y | ELYKRTDI | 96.15 | EMYKRTDI | 3.85 | | | | |
| NS5 | 2533 | 0.62 | 3 | 3 | 0 | Y | LYKRTDIV | 88.46 | LYKRTDIT | 7.69 | MYKRTDII | 3.85 | | |
| NS5 | 2534 | 0.62 | 3 | 3 | 0 | Y | YKRTDIVE | 88.46 | YKRTDITE | 7.69 | YKRTDIIE | 3.85 | | |

Fig. 27-101

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2535 | 0.62 | 3 | 3 | 0 | Y | KRTDIIEV | 88.46 | KRTDIIEV | 7.69 | KRTDIIEV | 3.85 |
| NS5 | 2536 | 0.62 | 3 | 3 | 0 | Y | RTDIIEVD | 88.46 | RTDIIEVD | 7.69 | RTDIIEVD | 3.85 |
| NS5 | 2537 | 0.62 | 3 | 3 | 0 | Y | TDIIEVDR | 88.46 | TDIIEVDR | 7.69 | TDIIEVDR | 3.85 |
| NS5 | 2538 | 0.62 | 3 | 3 | 0 | Y | DIIEVDRD | 88.46 | DIIEVDRD | 7.69 | DIIEVDRD | 3.85 |
| NS5 | 2539 | 0.62 | 3 | 3 | 0 | Y | IIEVDRDT | 88.46 | IEVDRDM | 7.69 | IEVDRDM | 3.85 |
| NS5 | 2540 | 0.62 | 3 | 3 | 0 | Y | IEVDRDTA | 88.46 | TEVDRDMA | 7.69 | IEVDRDMA | 3.85 |
| NS5 | 2541 | 0.52 | 2 | 2 | 0 | Y | EVDRDTAR | 88.46 | EVDRDMAR | 11.54 | | |
| NS5 | 2542 | 0.52 | 2 | 2 | 0 | Y | VDRDTARR | 88.46 | VDRDMARR | 11.54 | | |
| NS5 | 2543 | 0.52 | 2 | 2 | 0 | Y | DRDTARRH | 88.46 | DRDMARRH | 11.54 | | |
| NS5 | 2544 | 0.52 | 2 | 2 | 0 | Y | RDTARRHL | 88.46 | RDMARRHL | 11.54 | | |
| NS5 | 2545 | 0.52 | 2 | 2 | 0 | Y | DTARRHLA | 88.46 | DMARRHLA | 11.54 | | |
| NS5 | 2546 | 0.52 | 2 | 2 | 0 | Y | TARRHLAE | 88.46 | MARRHLAE | 11.54 | | |
| NS5 | 2547 | 0 | 1 | 1 | 0 | Y | ARRHLAEG | 100 | | | | |
| NS5 | 2548 | 0 | 1 | 1 | 0 | Y | RRHLAEGK | 100 | | | | |
| NS5 | 2549 | 0 | 1 | 1 | 0 | Y | RHLAEGKV | 100 | | | | |
| NS5 | 2550 | 0 | 1 | 1 | 0 | Y | HLAEGKVD | 100 | | | | |
| NS5 | 2551 | 0 | 1 | 1 | 0 | Y | LAEGKVDT | 100 | | | | |
| NS5 | 2552 | 0 | 1 | 1 | 0 | Y | AEGKVDTG | 100 | | | | |
| NS5 | 2553 | 0 | 1 | 1 | 0 | Y | EGKVDTGV | 100 | | | | |
| NS5 | 2554 | 0 | 1 | 1 | 0 | Y | GKVDTGVA | 100 | | | | |
| NS5 | 2555 | 0 | 1 | 1 | 0 | Y | KVDTGVAV | 100 | | | | |
| NS5 | 2556 | 0 | 1 | 1 | 0 | Y | VDTGVAVS | 100 | | | | |
| NS5 | 2557 | 0 | 1 | 1 | 0 | Y | DTGVAVSR | 100 | | | | |
| NS5 | 2558 | 0 | 1 | 1 | 0 | Y | TGVAVSRG | 100 | | | | |
| NS5 | 2559 | 0 | 1 | 1 | 0 | Y | GVAVSRGT | 100 | | | | |

Fig. 27-102

Species: YFV (8-mers)

| protein | block starting position | block

Fig. 27-103

Species: YFV (8-mers)

| protein | block star

Fig. 27-104

Species: YFV (8-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2610 | 0.74 | 3 | 3 | 0 | Y | FTLGRDGH | 84.62 | YTLGRDGH | 11.54 | FTLGREGH | 3.85 | | |
| NS5 | 2611 | 0.24 | 2 | 2 | 0 | Y | TLGRDGHE | 96.15 | TLGREGHE | 3.85 | | | | |
| NS5 | 2612 | 0.24 | 2 | 2 | 0 | Y | LGRDGHEK | 96.15 | LGREGHEK | 3.85 | | | | |
| NS5 | 2613 | 0.24 | 2 | 2 | 0 | Y | GRDGHEKP | 96.15 | GREGHEKP | 3.85 | | | | |
| NS5 | 2614 | 0.24 | 2 | 2 | 0 | Y | RDGHEKPM | 96.15 | REGHEKPM | 3.85 | | | | |
| NS5 | 2615 | 0.24 | 2 | 2 | 0 | Y | DGHEKPMN | 96.15 | EGHEKPMN | 3.85 | | | | |
| NS5 | 2616 | 0 | 1 | 1 | 0 | Y | GHEKPMNV | 100 | | | | | | |
| NS5 | 2617 | 0.24 | 2 | 2 | 0 | Y | HEKPMNVQ | 96.15 | HEKPMNVR | 3.85 | | | | |
| NS5 | 2618 | 0.24 | 2 | 2 | 0 | Y | EKPMNVQS | 96.15 | EKPMNVRS | 3.85 | | | | |
| NS5 | 2619 | 0.24 | 2 | 2 | 0 | Y | KPMNVQSL | 96.15 | KPMNVRSL | 3.85 | | | | |
| NS5 | 2620 | 0.24 | 2 | 2 | 0 | Y | PMNVQSLG | 96.15 | PMNVRSLG | 3.85 | | | | |
| NS5 | 2621 | 0.24 | 2 | 2 | 0 | Y | MNVQSLGW | 96.15 | MNVRSLGW | 3.85 | | | | |
| NS5 | 2622 | 0.24 | 2 | 2 | 0 | Y | NVQSLGWN | 96.15 | NVRSLGWN | 3.85 | | | | |
| NS5 | 2623 | 0.24 | 2 | 2 | 0 | Y | VQSLGWNI | 96.15 | VRSLGWNI | 3.85 | | | | |
| NS5 | 2624 | 0.74 | 3 | 3 | 0 | Y | QSLGWNII | 84.62 | QSLGWNIV | 11.54 | RSLGWNII | 3.85 | | |
| NS5 | 2625 | 0.52 | 2 | 2 | 0 | Y | SLGWNIIT | 88.46 | SLGWNIVT | 11.54 | | | | |
| NS5 | 2626 | 0.52 | 2 | 2 | 0 | Y | LGWNIITF | 88.46 | LGWNIVTF | 11.54 | | | | |
| NS5 | 2627 | 0.52 | 2 | 2 | 0 | Y | GWNIITFK | 88.46 | GWNIVTFK | 11.54 | | | | |
| NS5 | 2628 | 0.52 | 2 | 2 | 0 | Y | WNIITFKD | 88.46 | WNIVTFKD | 11.54 | | | | |
| NS5 | 2629 | 0.52 | 2 | 2 | 0 | Y | NIITFKDK | 88.46 | NIVTFKDK | 11.54 | | | | |
| NS5 | 2630 | 0.52 | 2 | 2 | 0 | Y | IITFKDKT | 88.46 | IVTFKDKT | 11.54 | | | | |
| NS5 | 2631 | 0.52 | 2 | 2 | 0 | Y | ITFKDKTD | 88.46 | VTFKDKTD | 11.54 | | | | |
| NS5 | 2632 | 0.39 | 2 | 2 | 0 | Y | TFKDKTDI | 92.31 | TFKDKTDV | 7.69 | | | | |
| NS5 | 2633 | 0.39 | 2 | 2 | 0 | Y | FKDKTDIH | 92.31 | FKDKTDVH | 7.69 | | | | |
| NS5 | 2634 | 0.7 | 4 | 4 | 0 | Y | KDKTDIHR | 88.46 | KDKTDIHH | 3.85 | KDKTDVHR | 3.85 | KDKTDVHP | 3.85 |

Fig. 27-105

Species: YFV (8-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2635 | 0.7 | 4 | 4 | 0 | Y | DKTDIHRL | 88.46 | DKTDVHRL | 3.85 | DKTDVHPL | 3.85 | DKTDIHHL | 3.85 | | |
| NS5 | 2636 | 0.7 | 4 | 4 | 0 | Y | KTDIHRLE | 88.46 | KTDIHHLE | 3.85 | KTDVHPLE | 3.85 | KTDVHRLE | 3.85 | | |
| NS5 | 2637 | 0.93 | 5 | 5 | 0 | Y | TDIHRLEP | 84.62 | TDVHRLEP | 3.85 | TDIHRLES | 3.85 | TDIHHLEP | 3.85 | TDVHPLEP | 3.85 |
| NS5 | 2642 | 1.08 | 5 | 5 | 0 | Y | LEPYKCDT | 80.77 | LEPAKCET | 7.69 | LEPMKCDT | 3.85 | LEPLKCET | 3.85 | LESVKCDT | 3.85 |
| NS5 | 2643 | 1.08 | 5 | 5 | 0 | Y | EPYKCDTL | 80.77 | EPAKCETL | 7.69 | EPMKCDTL | 3.85 | EPLKCETL | 3.85 | ESVKCDTL | 3.85 |
| NS5 | 2644 | 1.08 | 5 | 4 | 0 | Y | PYKCDTLL | 80.77 | PAKCETLL | 7.69 | PLKCETLL | 3.85 | PMKCDTLL | 3.85 | SVKCDTLL | 3.85 |
| NS5 | 2645 | 0.85 | 4 | 2 | 0 | Y | YKCDTLLC | 84.62 | AKCETLLC | 7.69 | LKCETLLC | 3.85 | MKCDTLLC | 3.85 | | |
| NS5 | 2646 | 0.52 | 2 | 2 | 0 | Y | KCDTLLCD | 88.46 | KCETLLCD | 11.54 | | | | | | |
| NS5 | 2647 | 0.52 | 2 | 2 | 0 | Y | CDTLLCDI | 88.46 | CETLLCDI | 11.54 | | | | | | |
| NS5 | 2648 | 0.52 | 2 | 2 | 0 | Y | DTLLCDIG | 88.46 | ETLLCDIG | 11.54 | | | | | | |
| NS5 | 2649 | 0 | 1 | 1 | 0 | Y | TLLCDIGE | 100 | | | | | | | | |
| NS5 | 2650 | 0 | 1 | 1 | 0 | Y | LLCDIGES | 100 | | | | | | | | |
| NS5 | 2651 | 0 | 1 | 1 | 0 | Y | LCDIGESS | 100 | | | | | | | | |
| NS5 | 2652 | 0.52 | 2 | 2 | 0 | Y | CDIGESSS | 88.46 | CDIGESSP | 11.54 | | | | | | |
| NS5 | 2653 | 0.52 | 2 | 2 | 0 | Y | DIGESSSS | 88.46 | DIGESSPS | 11.54 | | | | | | |
| NS5 | 2654 | 0.52 | 2 | 2 | 0 | Y | IGESSSSS | 88.46 | IGESSPSS | 11.54 | | | | | | |
| NS5 | 2655 | 0.85 | 4 | 4 | 0 | Y | GESSSSSV | 84.62 | GESSPSSV | 7.69 | GESPSSA | 3.85 | GESSSSSI | 3.85 | | |
| NS5 | 2656 | 0.85 | 4 | 4 | 0 | Y | ESSSSSVT | 84.62 | ESSPSSVT | 7.69 | ESSSSSIT | 3.85 | ESSPSSAT | 3.85 | | |
| NS5 | 2657 | 0.85 | 4 | 4 | 0 | Y | SSSSSVTE | 84.62 | SSPSSVTE | 7.69 | SSPSSATE | 3.85 | SSSSITE | 3.85 | | |
| NS5 | 2658 | 0.85 | 4 | 4 | 0 | Y | SSSSVTEG | 84.62 | SPSSVTEG | 7.69 | SPSSATEG | 3.85 | SSSSITEG | 3.85 | | |
| NS5 | 2659 | 0.85 | 4 | 4 | 0 | Y | SSSVTEGE | 84.62 | PSSVTEGE | 7.69 | PSSATEGE | 3.85 | SSSITEGE | 3.85 | | |
| NS5 | 2660 | 0.47 | 3 | 3 | 0 | Y | SSVTEGER | 92.31 | SSITEGER | 3.85 | SSATEGER | 3.85 | | | | |
| NS5 | 2661 | 0.47 | 3 | 3 | 0 | Y | SVTEGERT | 92.31 | SITEGERT | 3.85 | SATEGERT | 3.85 | | | | |
| NS5 | 2662 | 1.34 | 5 | 5 | 0 | Y | VTEGERTV | 73.08 | VTEGERTM | 11.54 | VTEGERTL | 7.69 | ATEGERTL | 3.85 | ITEGERTV | 3.85 |
| NS5 | 2663 | 1.01 | 3 | 3 | 0 | Y | TEGERTVR | 76.92 | TEGERTMR | 11.54 | TEGERTLR | 11.54 | | | | |

Fig. 27-106

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2664 | 1.01 | 3 | 3 | 0 | Y | EGERTVRV | 76.92 | EGERTMRV | 11.54 | EGERTLRV | 11.54 | | |
| NS5 | 2665 | 1.01 | 3 | 3 | 0 | Y | GERTVRVL | 76.92 | GERTMRVL | 11.54 | GERTLRVL | 11.54 | | |
| NS5 | 2666 | 1.12 | 4 | 4 | 0 | Y | ERTVRVLD | 76.92 | ERTMRVLD | 11.54 | ERTLRVLE | 7.69 | ERTLRVLD | 3.85 |
| NS5 | 2667 | 1.12 | 4 | 4 | 0 | Y | RTVRVLDT | 76.92 | RTMRVLDT | 11.54 | RTLRVLET | 7.69 | RTLRVLDT | 3.85 |
| NS5 | 2668 | 1.19 | 5 | 5 | 0 | Y | TVRVLDTV | 76.92 | TMRVLDTV | 11.54 | TLRVLDTV | 3.85 | TLRVLETV | 3.85 |
| NS5 | 2669 | 1.19 | 5 | 5 | 0 | Y | VRVLDTVE | 76.92 | MRVLDTVE | 11.54 | LRVLDTVE | 3.85 | LRVLETVE | 3.85 |
| NS5 | 2670 | 0.47 | 3 | 3 | 0 | Y | RVLDTVEK | 92.31 | RVLETIEK | 3.85 | RVLETVEK | 3.85 | | |
| NS5 | 2671 | 0.47 | 3 | 3 | 0 | Y | VLDTVEKW | 92.31 | VLETIEKW | 3.85 | VLETVEKW | 3.85 | | |
| NS5 | 2672 | 0.47 | 3 | 3 | 0 | Y | LDTVEKWL | 92.31 | LETIEKWL | 3.85 | LETVEKWL | 3.85 | | |
| NS5 | 2673 | 0.47 | 3 | 3 | 0 | Y | DTVEKWLA | 92.31 | ETIEKWLA | 3.85 | ETVEKWLA | 3.85 | | |
| NS5 | 2674 | 0.24 | 2 | 2 | 0 | Y | TVEKWLAC | 96.15 | TIEKWLAC | 3.85 | | | | |
| NS5 | 2675 | 0.24 | 2 | 2 | 0 | Y | VEKWLACG | 96.15 | IEKWLACG | 3.85 | | | | |
| NS5 | 2676 | 0 | 1 | 1 | 0 | Y | EKWLACGV | 100 | | | | | | |
| NS5 | 2677 | 0 | 1 | 1 | 0 | Y | KWLACGVD | 100 | | | | | | |
| NS5 | 2678 | 0 | 1 | 1 | 0 | Y | WLACGVDN | 100 | | | | | | |
| NS5 | 2679 | 0 | 1 | 1 | 0 | Y | LACGVDNF | 100 | | | | | | |
| NS5 | 2680 | 0 | 1 | 1 | 0 | Y | ACGVDNFC | 100 | | | | | | |
| NS5 | 2681 | 0.24 | 2 | 2 | 0 | Y | CGVDNFCV | 96.15 | CGVDNFCI | 3.85 | | | | |
| NS5 | 2682 | 0.24 | 2 | 2 | 0 | Y | GVDNFCVK | 96.15 | GVDNFCIK | 3.85 | | | | |
| NS5 | 2683 | 0.24 | 2 | 2 | 0 | Y | VDNFCVKV | 96.15 | VDNFCIKV | 3.85 | | | | |
| NS5 | 2684 | 0.24 | 2 | 2 | 0 | Y | DNFCVKVL | 96.15 | DNFCIKVL | 3.85 | | | | |
| NS5 | 2685 | 0.24 | 2 | 2 | 0 | Y | NFCVKVLA | 96.15 | NFCIKVLA | 3.85 | | | | |
| NS5 | 2686 | 0.24 | 2 | 2 | 0 | Y | FCVKVLAP | 96.15 | FCIKVLAP | 3.85 | | | | |
| NS5 | 2687 | 0.24 | 2 | 2 | 0 | Y | CVKVLAPY | 96.15 | CIKVLAPY | 3.85 | | | | |
| NS5 | 2688 | 0.24 | 2 | 2 | 0 | Y | VKVLAPYM | 96.15 | IKVLAPYM | 3.85 | | | | |

Fig. 27-107

Species: YFV (8-mers)

| protein | block starting position | block entropy | total peptides in block | # peptides required to cover 99% of block | gap/X fraction | 99% of block covered w/

Fig. 27-109

Species: YFV (8-mers)

| protein | block starting position | block

Fig. 27-110

Species: YFV (8-mers)

| protein

Fig. 27-111

Species: YFV (8-mers)

| protein | block starting position | block entropy | total pe

Fig. 27-112

Species: YFV (8-mers)

| protein | block starting position | block entropy | total

Fig. 27-113

Species: YFV (8-mers)

| protein | block starting position | block |

Fig. 27-114

Species: YFV (8-mers)

| protein | block starting position | entropy | total pe

Fig. 27-115

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2896 | 0.85 | 3 | 3 | 0 | Y | EKNPRLCT | 80.77 | EKSPRLCT | 15.38 | EKKPRLCT | 3.85 |
| NS5 | 2897 | 0.85 | 3 | 3 | 0 | Y | KNPRLCTK | 80.77 | KSPRLCTK | 15.38 | KKPRLCTK | 3.85 |
| NS5 | 2898 | 0.85 | 3 | 3 | 0 | Y | NPRLCTKE | 80.77 | SPRLCTKE | 15.38 | KPRLCTKE | 3.85 |
| NS5 | 2899 | 0 | 1 | 1 | 0 | Y | PRLCTKEE | 100 | | | | |
| NS5 | 2900 | 0 | 1 | 1 | 0 | Y | RLCTKEEF | 100 | | | | |
| NS5 | 2901 | 0 | 1 | 1 | 0 | Y | LCTKEEFI | 100 | | | | |
| NS5 | 2902 | 0 | 1 | 1 | 0 | Y | CTKEEFIA | 100 | | | | |
| NS5 | 2903 | 0 | 1 | 1 | 0 | Y | TKEEFIAK | 100 | | | | |
| NS5 | 2904 | 0 | 1 | 1 | 0 | Y | KEEFIAKV | 100 | | | | |
| NS5 | 2905 | 0 | 1 | 1 | 0 | Y | EEFIAKVR | 100 | | | | |
| NS5 | 2906 | 0 | 1 | 1 | 0 | Y | EFIAKVRS | 100 | | | | |
| NS5 | 2907 | 0 | 1 | 1 | 0 | Y | FIAKVRSH | 100 | | | | |
| NS5 | 2908 | 0 | 1 | 1 | 0 | Y | IAKVRSHA | 100 | | | | |
| NS5 | 2909 | 0 | 1 | 1 | 0 | Y | AKVRSHAA | 100 | | | | |
| NS5 | 2910 | 0.39 | 2 | 2 | 0 | Y | KVRSHAAI | 92.31 | KVRSHAAV | 7.69 | | |
| NS5 | 2911 | 0.39 | 2 | 2 | 0 | Y | VRSHAAIG | 92.31 | VRSHAAVG | 7.69 | | |
| NS5 | 2912 | 0.39 | 2 | 2 | 0 | Y | RSHAAIGA | 92.31 | RSHAAVGA | 7.69 | | |
| NS5 | 2913 | 0.62 | 3 | 3 | 0 | Y | SHAAIGAY | 88.46 | SHAAVGAF | 7.69 | SHAAIGAF | 3.85 |
| NS5 | 2914 | 0.62 | 3 | 3 | 0 | Y | HAAIGAYL | 88.46 | HAAVGAFL | 7.69 | HAAIGAFL | 3.85 |
| NS5 | 2915 | 0.62 | 3 | 3 | 0 | Y | AAIGAYLE | 88.46 | AAVGAFLE | 7.69 | AAIGAFLE | 3.85 |
| NS5 | 2916 | 0.62 | 3 | 3 | 0 | Y | AIGAYLEE | 88.46 | AVGAFLEE | 7.69 | AIGAFLEE | 3.85 |
| NS5 | 2917 | 0.62 | 3 | 3 | 0 | Y | IGAYLEEQ | 88.46 | VGAFLEEQ | 7.69 | IGAFLEEQ | 3.85 |
| NS5 | 2918 | 0.74 | 3 | 3 | 0 | Y | GAYLEEQE | 84.62 | GAFLEEQE | 11.54 | GAYLEEQD | 3.85 |
| NS5 | 2919 | 0.74 | 3 | 3 | 0 | Y | AYLEEQEQ | 84.62 | AFLEEQEQ | 11.54 | AYLEEQDQ | 3.85 |
| NS5 | 2920 | 0.74 | 3 | 3 | 0 | Y | YLEEQEQW | 84.62 | FLEEQEQW | 11.54 | YLEEQDQW | 3.85 |

Fig. 27-116

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2921 | 0.24 | 2 | 2 | 0 | Y | LEEQEQWK | 96.15 | LEEQDQWK | 3.85 | | | | |
| NS5 | 2922 | 0.24 | 2 | 2 | 0 | Y | EEQEQWKT | 96.15 | EEQDQWKT | 3.85 | | | | |
| NS5 | 2923 | 0.24 | 2 | 2 | 0 | Y | EQEQWKTA | 96.15 | EQDQWKTA | 3.85 | | | | |
| NS5 | 2924 | 0.24 | 2 | 2 | 0 | Y | QEQWKTAN | 96.15 | QDQWKTAN | 3.85 | | | | |
| NS5 | 2925 | 0.24 | 2 | 2 | 0 | Y | EQWKTANE | 96.15 | DQWKTANE | 3.85 | | | | |
| NS5 | 2926 | 0 | 1 | 1 | 0 | Y | QWKTANEA | 100 | | | | | | |
| NS5 | 2927 | 0 | 1 | 1 | 0 | Y | WKTANEAV | 100 | | | | | | |
| NS5 | 2928 | 0 | 1 | 1 | 0 | Y | KTANEAVQ | 100 | | | | | | |
| NS5 | 2929 | 0 | 1 | 1 | 0 | Y | TANEAVQD | 100 | | | | | | |
| NS5 | 2930 | 0 | 1 | 1 | 0 | Y | ANEAVQDP | 100 | | | | | | |
| NS5 | 2931 | 0 | 1 | 1 | 0 | Y | NEAVQDPK | 100 | | | | | | |
| NS5 | 2932 | 0 | 1 | 1 | 0 | Y | EAVQDPKF | 100 | | | | | | |
| NS5 | 2933 | 0 | 1 | 1 | 0 | Y | AVQDPKFW | 100 | | | | | | |
| NS5 | 2934 | 0 | 1 | 1 | 0 | Y | VQDPKFWE | 100 | | | | | | |
| NS5 | 2935 | 0.52 | 2 | 2 | 0 | Y | QDPKFWEL | 88.46 | QDPKFWEM | 11.54 | | | | |
| NS5 | 2936 | 0.52 | 2 | 2 | 0 | Y | DPKFWELV | 88.46 | DPKFWEMV | 11.54 | | | | |
| NS5 | 2937 | 0.52 | 2 | 2 | 0 | Y | PKFWELVD | 88.46 | PKFWEMVD | 11.54 | | | | |
| NS5 | 2938 | 0.52 | 2 | 2 | 0 | Y | KFWELVDE | 88.46 | KFWEMVDA | 11.54 | | | | |
| NS5 | 2939 | 0.52 | 2 | 2 | 0 | Y | FWELVDEE | 88.46 | FWEMVDAE | 11.54 | | | | |
| NS5 | 2940 | 0.52 | 2 | 2 | 0 | Y | WELVDEER | 88.46 | WEMVDAER | 11.54 | | | | |
| NS5 | 2941 | 0.74 | 3 | 3 | 0 | Y | ELVDEERK | 84.62 | EMVDAERK | 11.54 | ELVDEERR | 3.85 | | |
| NS5 | 2942 | 0.74 | 3 | 3 | 0 | Y | LVDEERKL | 84.62 | MVDAERKL | 11.54 | LVDEERRL | 3.85 | | |
| NS5 | 2943 | 0.74 | 3 | 3 | 0 | Y | VDEERKLH | 84.62 | VDAERKLH | 11.54 | VDEERRLH | 3.85 | | |
| NS5 | 2944 | 0.74 | 3 | 3 | 0 | Y | DEERKLHQ | 84.62 | DAERKLHQ | 11.54 | DEERRLHQ | 3.85 | | |
| NS5 | 2945 | 0.74 | 3 | 3 | 0 | Y | EERKLHQQ | 84.62 | AERKLHQQ | 11.54 | EERRLHQQ | 3.85 | | |

Fig. 27-117

Species: YFV (8-mers)

| protein | block starting position | block ent

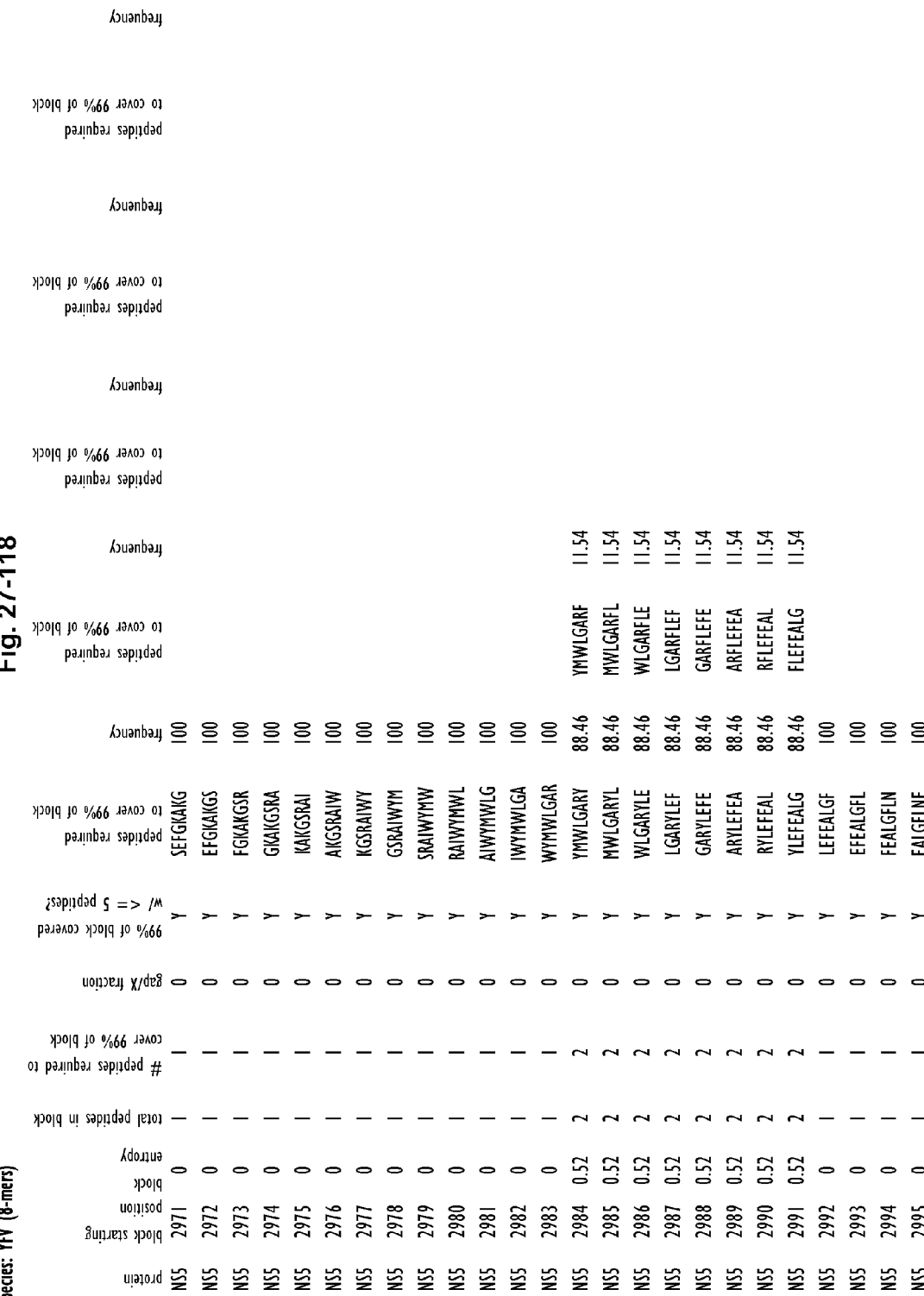

Fig. 27-119

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

Fig. 27-120

Species: YFV (8-mers)

| protein | block starting position | entropy block | total peptides in block | # peptides required to cover 99% of block | gap/X fraction | 99% of block covered w/ => 5 peptides? | peptides required to cover 99% of block | frequency | peptides required to cover 99% of block | frequ

Fig. 27-121

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3046 | 0 | 1 | 1 | 0 | Y | WDTRITEA | 100 | | | | | | |
| NS5 | 3047 | 0 | 1 | 1 | 0 | Y | DTRITEAD | 100 | | | | | | |
| NS5 | 3048 | 0 | 1 | 1 | 0 | Y | TRITEADL | 100 | | | | | | |
| NS5 | 3049 | 0 | 1 | 1 | 0 | Y | RITEADLD | 100 | | | | | | |
| NS5 | 3050 | 0 | 1 | 1 | 0 | Y | ITEADLDD | 100 | | | | | | |
| NS5 | 3051 | 0 | 1 | 1 | 0 | Y | TEADLDDE | 100 | | | | | | |
| NS5 | 3052 | 0 | 1 | 1 | 0 | Y | EADLDDEQ | 100 | | | | | | |
| NS5 | 3053 | 0 | 1 | 1 | 0 | Y | ADLDDEQE | 100 | | | | | | |
| NS5 | 3054 | 0 | 1 | 1 | 0 | Y | DLDDEQEI | 100 | | | | | | |
| NS5 | 3055 | 0.52 | 2 | 2 | 0 | Y | LDDEQEIL | 88.46 | LDDEQEIM | 11.54 | | | | |
| NS5 | 3056 | 0.52 | 2 | 2 | 0 | Y | DDEQEILN | 88.46 | DDEQEIMS | 11.54 | | | | |
| NS5 | 3057 | 0.52 | 2 | 2 | 0 | Y | DEQEILNY | 88.46 | DEQEIMSY | 11.54 | | | | |
| NS5 | 3058 | 0.52 | 2 | 2 | 0 | Y | EQEILNYM | 88.46 | EQEIMSYM | 11.54 | | | | |
| NS5 | 3059 | 0.62 | 3 | 3 | 0 | Y | QEILNYMS | 88.46 | QEIMSYMN | 7.69 | QEIMSYMS | 3.85 | | |
| NS5 | 3060 | 0.85 | 4 | 4 | 0 | Y | EILNYMSP | 84.62 | EIMSYMNA | 7.69 | EIMSYMSP | 3.85 | EILNYMSS | 3.85 |
| NS5 | 3061 | 0.85 | 4 | 4 | 0 | Y | ILNYMSPH | 84.62 | IMSYMNAE | 7.69 | IMSYMSPE | 3.85 | ILNYMSSH | 3.85 |
| NS5 | 3062 | 0.85 | 4 | 4 | 0 | Y | LNYMSPHH | 84.62 | MSYMNAEQ | 7.69 | MSYMSPEQ | 3.85 | LNYMSSHH | 3.85 |
| NS5 | 3063 | 0.85 | 4 | 4 | 0 | Y | NYMSPHHK | 84.62 | SYMNAEQR | 7.69 | SYMSPEQR | 3.85 | NYMSSHHK | 3.85 |
| NS5 | 3064 | 0.85 | 4 | 4 | 0 | Y | YMSPHHKK | 84.62 | YMNAEQRK | 7.69 | YMSPEQRK | 3.85 | YMSSHHKK | 3.85 |
| NS5 | 3065 | 0.85 | 4 | 4 | 0 | Y | MSPHHKKL | 84.62 | MNAEQRKL | 7.69 | MSPEQRKL | 3.85 | MSSHHKKL | 3.85 |
| NS5 | 3066 | 0.85 | 4 | 4 | 0 | Y | SPHHKKLA | 84.62 | NAEQRKLA | 7.69 | SSHHKKLA | 3.85 | SPEQRKLA | 3.85 |
| NS5 | 3067 | 0.85 | 4 | 4 | 0 | Y | PHHKKLAQ | 84.62 | AEQRKLAW | 7.69 | PEQRKLAW | 3.85 | SHHKKLAQ | 3.85 |
| NS5 | 3068 | 0.52 | 2 | 2 | 0 | Y | HHKKLAQA | 88.46 | EQRKLAWA | 11.54 | | | | |
| NS5 | 3069 | 0.62 | 3 | 3 | 0 | Y | HKKLAQAV | 88.46 | QRKLAWAV | 7.69 | QRKLAWAI | 3.85 | | |
| NS5 | 3070 | 0.62 | 3 | 3 | 0 | Y | KKLAQAVM | 88.46 | RKLAWAVM | 7.69 | RKLAWAIM | 3.85 | | |

Fig. 27-122

Species: YFV

| protein | block star

Fig. 27-123

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3096 | 0.52 | 2 | 2 | 0 | Y | KAYMDVIS | 88.46 | KAFMDIIS | 11.54 |
| NS5 | 3097 | 0.52 | 2 | 2 | 0 | Y | AYMDVISR | 88.46 | AFMDIISR | 11.54 |
| NS5 | 3098 | 0.52 | 2 | 2 | 0 | Y | YMDVISRR | 88.46 | FMDIISRR | 11.54 |
| NS5 | 3099 | 0.52 | 2 | 2 | 0 | Y | MDVISRRD | 88.46 | MDIISRRD | 11.54 |
| NS5 | 3100 | 0.52 | 2 | 2 | 0 | Y | DVISRRDQ | 88.46 | DIISRRDQ | 11.54 |
| NS5 | 3101 | 0.52 | 2 | 2 | 0 | Y | VISRRDQR | 88.46 | IISRRDQR | 11.54 |
| NS5 | 3102 | 0 | 1 | 1 | 0 | Y | ISRRDQRG | 100 | | |
| NS5 | 3103 | 0 | 1 | 1 | 0 | Y | SRRDQRGS | 100 | | |
| NS5 | 3104 | 0.24 | 2 | 2 | 0 | Y | RRDQRGSG | 96.15 | RRDQRGSR | 3.85 |
| NS5 | 3105 | 0.24 | 2 | 2 | 0 | Y | RDQRGSGQ | 96.15 | RDQRGSRQ | 3.85 |
| NS5 | 3106 | 0.24 | 2 | 2 | 0 | Y | DQRGSGQV | 96.15 | DQRGSRQV | 3.85 |
| NS5 | 3107 | 0.24 | 2 | 2 | 0 | Y | QRGSGQVW | 96.15 | QRGSRQVW | 3.85 |
| NS5 | 3108 | 0.24 | 2 | 2 | 0 | Y | RGSGQWT | 96.15 | RGSRQWT | 3.85 |
| NS5 | 3109 | 0.24 | 2 | 2 | 0 | Y | GSGQWTY | 96.15 | GSRQWTY | 3.85 |
| NS5 | 3110 | 0.24 | 2 | 2 | 0 | Y | SGQWTYA | 96.15 | SRQWTYA | 3.85 |
| NS5 | 3111 | 0.24 | 2 | 2 | 0 | Y | GQWTYAL | 96.15 | RQWTYAL | 3.85 |
| NS5 | 3112 | 0 | 1 | 1 | 0 | Y | QWTYALN | 100 | | |
| NS5 | 3113 | 0 | 1 | 1 | 0 | Y | WTYALNT | 100 | | |
| NS5 | 3114 | 0 | 1 | 1 | 0 | Y | VTYALNTI | 100 | | |
| NS5 | 3115 | 0 | 1 | 1 | 0 | Y | TYALNTIT | 100 | | |
| NS5 | 3116 | 0 | 1 | 1 | 0 | Y | YALNTITN | 100 | | |
| NS5 | 3117 | 0 | 1 | 1 | 0 | Y | ALNTITNL | 100 | | |
| NS5 | 3118 | 0 | 1 | 1 | 0 | Y | LNTITNLK | 100 | | |
| NS5 | 3119 | 0 | 1 | 1 | 0 | Y | NTITNLKV | 100 | | |
| NS5 | 3120 | 0 | 1 | 1 | 0 | Y | TITNLKVQ | 100 | | |

Fig. 27-124

Species: YFV (8-mers)

| protein | block starting position | entropy | total pe

Fig. 27-125

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3152 | 1.22 | 5 | 5 | 0 | Y | TRLEAWLT | 76.92 | ARLEAWLT | 7.69 | | | | |
| NS5 | 3153 | 0.85 | 4 | 4 | 0 | Y | RLEAWLTE | 84.62 | ARLDAWLA | 7.69 | ARLDAWLA | 7.69 | | |
| NS5 | 3154 | 0.85 | 4 | 4 | 0 | Y | LEAWLTEH | 84.62 | RLDAWLAE | 7.69 | ERLETWLA | 3.85 | VRLEAWLI | 3.85 |
| NS5 | 3155 | 0.85 | 4 | 4 | 0 | Y | EAWLTEHG | 84.62 | LDAWLAEN | 7.69 | RLETWLAE | 3.85 | | |
| NS5 | 3156 | 0.85 | 4 | 4 | 0 | Y | AWLTEHGC | 84.62 | DAWLAENG | 7.69 | LETWLAEN | 3.85 | | |
| NS5 | 3157 | 1.4 | 4 | 4 | 0 | Y | WLTEHGCN | 65.38 | AWLAENGC | 7.69 | EAWLIEHG | 3.85 | | |
| NS5 | 3158 | 1.4 | 4 | 4 | 0 | Y | LTEHGCNR | 65.38 | WLAENGCD | 19.23 | TWLAENGC | 3.85 | | |
| NS5 | 3159 | 1.4 | 4 | 4 | 0 | Y | TEHGCNRL | 65.38 | LAENGCDR | 19.23 | WLIEHGCD | 3.85 | | |
| NS5 | 3165 | 1.22 | 5 | 5 | 0 | Y | RLRRMAVS | 76.92 | AENGCDRL | 19.23 | LIEHGCDR | 3.85 | | |
| NS5 | 3166 | 1.22 | 5 | 5 | 0 | Y | LRMAVSG | 76.92 | RLARMAVS | 7.69 | IEHGCDRL | 3.85 | | |
| NS5 | 3167 | 1.22 | 5 | 5 | 0 | Y | KRMAVSGD | 76.92 | LARMAVSG | 7.69 | RLNKRMAVN | 3.85 | RLSRMAVS | 3.85 |
| NS5 | 3168 | 0.24 | 2 | 2 | 0 | Y | RMAVSGDD | 96.15 | ARMAVSGD | 7.69 | LNRMAVNG | 3.85 | LSRMAVSG | 3.85 |
| NS5 | 3169 | 0.24 | 2 | 2 | 0 | Y | MAVSGDDC | 96.15 | RMAVNGDD | 3.85 | NRMAVNGD | 3.85 | SRMAVSGD | 3.85 |
| NS5 | 3170 | 0.24 | 2 | 2 | 0 | Y | AVSGDDCV | 96.15 | MAVNGDDC | 3.85 | | | | |
| NS5 | 3171 | 0.24 | 2 | 2 | 0 | Y | VSGDDCVW | 96.15 | AVNGDDCV | 3.85 | | | | |
| NS5 | 3172 | 0.47 | 3 | 3 | 0 | Y | SGDDCVWR | 92.31 | VNGDDCVW | 3.85 | | | | |
| NS5 | 3173 | 0.24 | 2 | 2 | 0 | Y | GDDCVWRP | 96.15 | NGDDCVWR | 3.85 | | | | |
| NS5 | 3174 | 0.62 | 3 | 3 | 0 | Y | DDCVWRPI | 88.46 | SGDDCVWK | 3.85 | | | | |
| NS5 | 3175 | 0.62 | 3 | 3 | 0 | Y | DCVWRPID | 88.46 | GDDCWKP | 3.85 | | | | |
| NS5 | 3176 | 0.62 | 3 | 3 | 0 | Y | CVWRPIDD | 88.46 | DDCVWRPV | 3.85 | | | | |
| NS5 | 3177 | 0.62 | 3 | 3 | 0 | Y | VWRPIDDR | 88.46 | DCWRPVD | 3.85 | | | | |
| NS5 | 3178 | 0.62 | 3 | 3 | 0 | Y | VRPIDDRF | 88.46 | CVWKPVDD | 3.85 | | | | |
| NS5 | 3179 | 0.62 | 3 | 3 | 0 | Y | RPIDDRFG | 88.46 | VWKPVDDR | 3.85 | | | | |
| NS5 | 3180 | 0.74 | 3 | 3 | 0 | Y | PIDDRFGL | 84.62 | VKPVDDRF | 7.69 | | | | |
| NS5 | 3181 | 0.74 | 3 | 3 | 0 | Y | IDDRFGLA | 84.62 | KPVDDRFG | 7.69 | | | | |
| NS5 | | | | | | | | | PIDDRFGM | 11.54 | | | | |
| NS5 | | | | | | | | | IDDRFGMA | 11.54 | | | | |

Fig. 27-126

Species: YFV (8-mers)

| protein | block starting position | block entropy | total peptides in block | # peptides required to cover 99% of block | gap/X fraction | 99% of block covered w/ <= 5 peptides? | peptides required

Fig. 27-127

Species: YFV (8-mers)

| protein | block starting position | block entropy | total peptides in block | # peptides required to cover 99% of block | gap/X fraction | 99% of block covered w/ <= 5 peptides? |

Fig. 27-128

Species: YFV (8-mers)

| protein | block starting position | block entropy | total peptides in

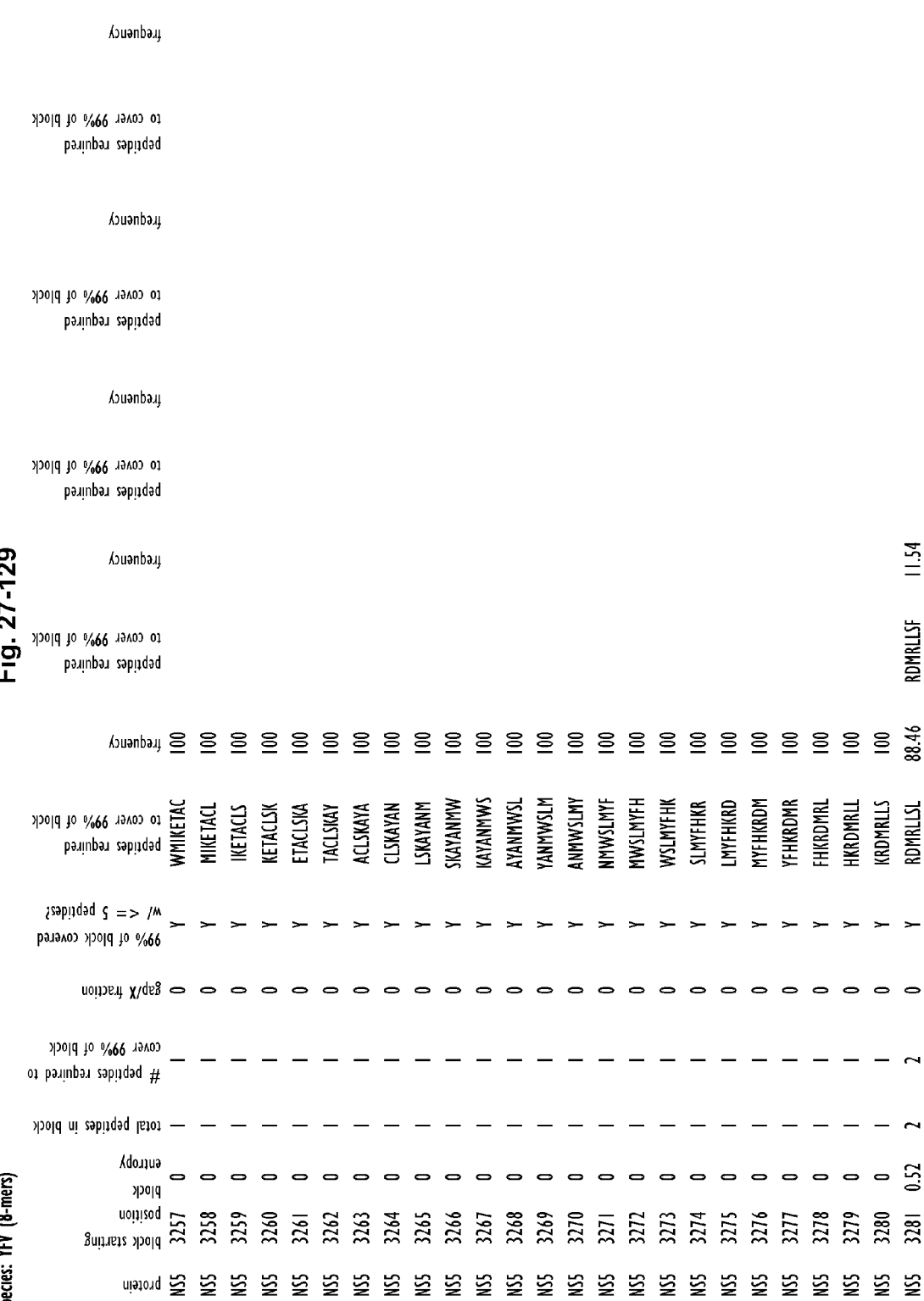

Fig. 27-130

Species: YFV (8-mers)

| protein | block starting position | block entropy | total

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NSS | 3332 | 0.62 | 3 | 3 | 0 | Y | NPHMQDKT | 88.46 | NPHMKDKT | 7.69 | | | NPHMTDKT | 3.85 |
| NSS | 3333 | 1.12 | 4 | 4 | 0 | Y | PHMQDKTM | 76.92 | PHMQDKTV | 11.54 | PHMKDKTT | 7.69 | PHMTDKTT | 3.85 |
| NSS | 3334 | 1.12 | 4 | 4 | 0 | Y | HMQDKTMV | 76.92 | HMQDKTVV | 11.54 | HMKDKTTV | 7.69 | HMTDKTTI | 3.85 |
| NSS | 3335 | 1.12 | 4 | 4 | 0 | Y | MQDKTMVK | 76.92 | MQDKTVVK | 11.54 | MKDKTTVK | 7.69 | MTDKTTIK | 3.85 |
| NSS | 3336 | 1.67 | 5 | 5 | 0 | Y | QDKTMVKK | 61.54 | QDKTVVKE | 15.38 | KDKTTVKE | 7.69 | | |
| NSS | 3337 | 1.67 | 5 | 5 | 0 | Y | DKTMVKKW | 61.54 | DKTMVKEW | 15.38 | DKTTVKEW | 7.69 | DKTTIKEW | 3.85 |
| NSS | 3338 | 1.67 | 5 | 5 | 0 | Y | KTMVKKWR | 61.54 | KTMVKEWR | 15.38 | KTTVKEWR | 7.69 | KTTIKEWR | 3.85 |
| NSS | 3339 | 1.67 | 5 | 5 | 0 | Y | TMVKKWRD | 61.54 | TMVKEWRD | 15.38 | TVVKEWRD | 7.69 | TTIKEWRD | 3.85 |
| NSS | 3340 | 1.67 | 5 | 5 | 0 | Y | MVKKWRDV | 61.54 | MVKEWRDV | 15.38 | VVKEWRDV | 7.69 | TIKEWRDV | 3.85 |
| NSS | 3341 | 1.14 | 3 | 3 | 0 | Y | VKKWRDVP | 61.54 | VKEWRDVP | 34.62 | IKEWRDVP | 3.85 | | |
| NSS | 3342 | 0.96 | 2 | 2 | 0 | Y | KKWRDVPY | 61.54 | KEWRDVPY | 38.46 | | | | |
| NSS | 3343 | 0.96 | 2 | 2 | 0 | Y | KWRDVPYL | 61.54 | EWRDVPYL | 38.46 | | | | |
| NSS | 3344 | 0 | 1 | 1 | 0 | Y | WRDVPYLT | 100 | | | | | | |
| NSS | 3345 | 0 | 1 | 1 | 0 | Y | RDVPYLTK | 100 | | | | | | |
| NSS | 3346 | 0 | 1 | 1 | 0 | Y | DVPYLTKR | 100 | | | | | | |
| NSS | 3347 | 0 | 1 | 1 | 0 | Y | VPYLTKRQ | 100 | | | | | | |
| NSS | 3348 | 0 | 1 | 1 | 0 | Y | PYLTKRQD | 100 | | | | | | |
| NSS | 3349 | 0 | 1 | 1 | 0 | Y | YLTKRQDK | 100 | | | | | | |
| NSS | 3350 | 0 | 1 | 1 | 0 | Y | LTKRQDKL | 100 | | | | | | |
| NSS | 3351 | 0 | 1 | 1 | 0 | Y | TKRQDKLC | 100 | | | | | | |
| NSS | 3352 | 0 | 1 | 1 | 0 | Y | KRQDKLCG | 100 | | | | | | |
| NSS | 3353 | 0 | 1 | 1 | 0 | Y | RQDKLCGS | 100 | | | | | | |
| NSS | 3354 | 0 | 1 | 1 | 0 | Y | QDKLCGSL | 100 | | | | | | |
| NSS | 3355 | 0 | 1 | 1 | 0 | Y | DKLCGSLI | 100 | | | | | | |
| NSS | 3356 | 0 | 1 | 1 | 0 | Y | KLCGSLIG | 100 | | | | | | |

Fig. 27-133

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3357 | 0 | — | — | 0 | Y | LCGSLIGM | 100 | | | | | | |
| NS5 | 3358 | 0 | — | — | 0 | Y | CGSLIGMT | 100 | | | | | | |
| NS5 | 3359 | 0 | — | — | 0 | Y | GSLIGMTN | 100 | | | | | | |
| NS5 | 3360 | 0 | — | — | 0 | Y | SLIGMTNR | 100 | | | | | | |
| NS5 | 3361 | 0 | — | — | 0 | Y | LIGMTNRA | 100 | | | | | | |
| NS5 | 3362 | 0 | — | — | 0 | Y | IGMTNRAT | 100 | | | | | | |
| NS5 | 3363 | 0 | — | — | 0 | Y | GMTNRATW | 100 | | | | | | |
| NS5 | 3364 | 0 | — | — | 0 | Y | MTNRATWA | 100 | | | | | | |
| NS5 | 3365 | 0 | — | — | 0 | Y | TNRATWAS | 100 | | | | | | |
| NS5 | 3366 | 0.24 | 2 | 2 | 0 | Y | NRATWASH | 96.15 | NRATWASN | 3.85 | | | | |
| NS5 | 3367 | 0.24 | 2 | 2 | 0 | Y | RATWASHI | 96.15 | RATWASNI | 3.85 | | | | |
| NS5 | 3368 | 0.24 | 2 | 2 | 0 | Y | ATWASHIH | 96.15 | ATWASNIH | 3.85 | | | | |
| NS5 | 3369 | 0.24 | 2 | 2 | 0 | Y | TWASHIHL | 96.15 | TWASNIHL | 3.85 | | | | |
| NS5 | 3370 | 0.24 | 2 | 2 | 0 | Y | WASHIHLV | 96.15 | WASNIHLV | 3.85 | | | | |
| NS5 | 3371 | 0.24 | 2 | 2 | 0 | Y | ASHIHLVI | 96.15 | ASNIHLVI | 3.85 | | | | |
| NS5 | 3372 | 0.24 | 2 | 2 | 0 | Y | SHIHLVIH | 96.15 | SNIHLVIH | 3.85 | | | | |
| NS5 | 3373 | 0.24 | 2 | 2 | 0 | Y | HIHLVIHR | 96.15 | NIHLVIHR | 3.85 | | | | |
| NS5 | 3374 | 0 | — | — | 0 | Y | IHLVIHRI | 100 | | | | | | |
| NS5 | 3375 | 0 | — | — | 0 | Y | HLVIHRIR | 100 | | | | | | |
| NS5 | 3376 | 0.24 | 2 | 2 | 0 | Y | LVIHRIRT | 96.15 | LVIHRIRN | 3.85 | | | | |
| NS5 | 3377 | 0.24 | 2 | 2 | 0 | Y | VIHRIRTL | 96.15 | VIHRIRNL | 3.85 | | | | |
| NS5 | 3378 | 0.62 | 3 | 3 | 0 | Y | IHRIRTLI | 88.46 | IHRIRTLV | 7.69 | IHRIRNLI | 3.85 | | |
| NS5 | 3379 | 0.62 | 3 | 3 | 0 | Y | HRIRTLIG | 88.46 | HRIRTLVG | 7.69 | HRIRNLIG | 3.85 | | |
| NS5 | 3380 | 0.62 | 3 | 3 | 0 | Y | RIRTLIGQ | 88.46 | RIRTLVGQ | 7.69 | RIRNLIGQ | 3.85 | | |
| NS5 | 3381 | 0.62 | 3 | 3 | 0 | Y | IRTLIGQE | 88.46 | IRTLVGQE | 7.69 | IRNLIGQE | 3.85 | | |

Fig. 27-134

Species: YFV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3382 | 0.62 | 3 | 3 | 0 | Y | RTLIGQEK | 88.46 | RTLVGQEK | 7.69 | RNLIGQEK | 3.85 | NLIGQEKY | 3.85 |
| NS5 | 3383 | 0.85 | 4 | 4 | 0 | Y | TLIGQEKY | 84.62 | TLVGQEKY | 7.69 | TLIGQEKF | 3.85 | | |
| NS5 | 3384 | 0.62 | 3 | 3 | 0 | Y | LIGQEKYT | 88.46 | LVGQEKYT | 7.69 | LIGQEKFT | 3.85 | | |
| NS5 | 3385 | 0.62 | 3 | 3 | 0 | Y | IGQEKYTD | 88.46 | VGQEKYTD | 7.69 | IGQEKFTD | 3.85 | | |
| NS5 | 3386 | 0.24 | 2 | 2 | 0 | Y | GQEKYTDY | 96.15 | GQEKFTDY | 3.85 | | | | |
| NS5 | 3387 | 0.24 | 2 | 2 | 0 | Y | QEKYTDYL | 96.15 | QEKFTDYL | 3.85 | | | | |
| NS5 | 3388 | 0.24 | 2 | 2 | 0 | Y | EKYTDYLT | 96.15 | EKFTDYLT | 3.85 | | | | |
| NS5 | 3389 | 0.24 | 2 | 2 | 0 | Y | KYTDYLTV | 96.15 | KFTDYLTV | 3.85 | | | | |
| NS5 | 3390 | 0.24 | 2 | 2 | 0 | Y | YTDYLTVM | 96.15 | FTDYLTVM | 3.85 | | | | |
| NS5 | 3391 | 0 | 1 | 1 | 0 | Y | TDYLTVMD | 100 | | | | | | |
| NS5 | 3392 | 0 | 1 | 1 | 0 | Y | DYLTVMDR | 100 | | | | | | |
| NS5 | 3393 | 0 | 1 | 1 | 0 | Y | YLTVMDRY | 100 | | | | | | |
| NS5 | 3394 | 0 | 1 | 1 | 0 | Y | LTVMDRYS | 100 | | | | | | |
| NS5 | 3395 | 0 | 1 | 1 | 0 | Y | TVMDRYSV | 100 | | | | | | |
| NS5 | 3396 | 0 | 1 | 1 | 0 | Y | VMDRYSVD | 100 | | | | | | |
| NS5 | 3397 | 0 | 1 | 1 | 0 | Y | MDRYSVDA | 100 | | | | | | |
| NS5 | 3398 | 0 | 1 | 1 | 0 | Y | DRYSVDAD | 100 | | | | | | |
| NS5 | 3399 | 0 | 1 | 1 | 0 | Y | RYSVDADL | 100 | | | | | | |
| NS5 | 3400 | 0 | 1 | 1 | 0 | Y | YSVDADLQ | 100 | | | | | | |
| NS5 | 3401 | 0.96 | 2 | 2 | 0 | Y | SVDADLQL | 61.54 | SVDADLQP | 38.46 | | | | |
| NS5 | 3402 | 0.96 | 2 | 2 | 0 | Y | VDADLQLG | 61.54 | VDADLQPG | 38.46 | | | | |
| NS5 | 3403 | 0.96 | 2 | 2 | 0 | Y | DADLQLGE | 61.54 | DADLQPGE | 38.46 | | | | |
| NS5 | 3404 | 0.96 | 2 | 2 | 0 | Y | ADLQLGEL | 61.54 | ADLQPGEL | 38.46 | | | | |
| NS5 | 3405 | 0.96 | 2 | 2 | 0 | Y | DLQLGELI | 61.54 | DLQPGELI | 38.46 | | | | |

Fig. 28-2

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 26 | 0 | 1 | 1 | 0 | Y | KIKQKTKQI | 100 | | | | | | |
| anC | 27 | 0 | 1 | 1 | 0 | Y | IKQKTKQIG | 100 | | | | | | |
| anC | 28 | 0 | 1 | 1 | 0 | Y | KQKTKQIGN | 100 | | | | | | |
| anC | 29 | 0 | 1 | 1 | 0 | Y | QKTKQIGNR | 100 | | | | | | |
| anC | 30 | 0 | 1 | 1 | 0 | Y | KTKQIGNRP | 100 | | | | | | |
| anC | 31 | 0 | 1 | 1 | 0 | Y | TKQIGNRPG | 100 | | | | | | |
| anC | 32 | 0.24 | 2 | 2 | 0 | Y | KQIGNRPGP | 96.15 | KQIGNRPGL | 3.85 | | | | |
| anC | 33 | 0.24 | 2 | 2 | 0 | Y | QIGNRPGPS | 96.15 | QIGNRPGLS | 3.85 | | | | |
| anC | 34 | 0.24 | 2 | 2 | 0 | Y | IGNRPGPSR | 96.15 | IGNRPGLSR | 3.85 | | | | |
| anC | 35 | 0.24 | 2 | 2 | 0 | Y | GNRPGPSRG | 96.15 | GNRPGLSRG | 3.85 | | | | |
| anC | 36 | 0.24 | 2 | 2 | 0 | Y | NRPGPSRGV | 96.15 | NRPGLSRGV | 3.85 | | | | |
| anC | 37 | 0.24 | 2 | 2 | 0 | Y | RPGPSRGVQ | 96.15 | RPGLSRGVQ | 3.85 | | | | |
| anC | 38 | 0.24 | 2 | 2 | 0 | Y | PGPSRGVQG | 96.15 | PGLSRGVQG | 3.85 | | | | |
| anC | 39 | 0.24 | 2 | 2 | 0 | Y | GPSRGVQGF | 96.15 | GLSRGVQGF | 3.85 | | | | |
| anC | 40 | 0.24 | 2 | 2 | 0 | Y | PSRGVQGFI | 96.15 | LSRGVQGFI | 3.85 | | | | |
| anC | 41 | 0.24 | 2 | 2 | 0 | Y | SRGVQGFIF | 96.15 | SRGVQGFIS | 3.85 | | | | |
| anC | 42 | 0.24 | 2 | 2 | 0 | Y | RGVQGFIFF | 96.15 | RGVQGFISF | 3.85 | | | | |
| anC | 43 | 0.24 | 2 | 2 | 0 | Y | GVQGFIFFF | 96.15 | GVQGFISFF | 3.85 | | | | |
| anC | 44 | 0.24 | 2 | 2 | 0 | Y | VQGFIFFFL | 96.15 | VQGFISFFS | 3.85 | | | | |
| anC | 45 | 0.24 | 2 | 2 | 0 | Y | QGFIFFFLF | 96.15 | QGFISFFSF | 3.85 | | | | |
| anC | 46 | 0.24 | 2 | 2 | 0 | Y | GFIFFFLFN | 96.15 | GFISFFSFN | 3.85 | | | | |
| anC | 47 | 0.24 | 2 | 2 | 0 | Y | FIFFFLFNI | 96.15 | FISFFSFNI | 3.85 | | | | |
| anC | 48 | 0.24 | 2 | 2 | 0 | Y | IFFFLFNIL | 96.15 | ISFFSFNIL | 3.85 | | | | |
| anC | 49 | 0.24 | 2 | 2 | 0 | Y | FFFLFNILT | 96.15 | SFFSFNILT | 3.85 | | | | |
| anC | 50 | 0.24 | 2 | 2 | 0 | Y | FFLFNILTG | 96.15 | FFSFNILTG | 3.85 | | | | |

Fig. 28-3

Species: YFV (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| anC | 51 | 0.24 | 2 | 2 | 0 | Y | FLFNILTGK | 96.15 | FSFNILTGK | 3.85 | | | | |
| anC | 52 | 0.24 | 2 | 2 | 0 | Y | LFNILTGKK | 96.15 | SFNILTGKK | 3.85 | | | | |
| anC | 53 | 0.52 | 2 | 2 | 0 | Y | FNILTGKKI | 88.46 | FNILTGKKL | 11.54 | | | | |
| anC | 54 | 0.52 | 2 | 2 | 0 | Y | NILTGKKIT | 88.46 | NILTGKKLT | 11.54 | | | | |
| anC | 55 | 0.62 | 3 | 3 | 0 | Y | ILTGKKITA | 88.46 | ILTGKKLT | 7.69 | ILTGKKLTA | 3.85 | | |
| anC | 56 | 0.85 | 4 | 4 | 0 | Y | LTGKKITAH | 84.62 | LTGKKLTTH | 7.69 | LTGKKITAQ | 3.85 | LTGKKLTAH | 3.85 |
| anC | 57 | 0.85 | 4 | 4 | 0 | Y | TGKKITAHL | 84.62 | TGKKLTHL | 7.69 | TGKKLTAHL | 3.85 | TGKKITAQL | 3.85 |
| anC | 58 | 0.85 | 4 | 4 | 0 | Y | GKKITAHLK | 84.62 | GKKLTTHLK | 7.69 | GKKLTAHLK | 3.85 | GKKITAQLK | 3.85 |
| anC | 59 | 0.85 | 4 | 4 | 0 | Y | KKITAHLKR | 84.62 | KKLTTHLKR | 7.69 | KKLTAHLKK | 3.85 | KKITAQLKR | 3.85 |
| anC | 60 | 0.85 | 4 | 4 | 0 | Y | KITAHLKRL | 84.62 | KLTTHLKRL | 7.69 | KITAQLKRL | 3.85 | KLTAHLKKL | 3.85 |
| anC | 61 | 0.85 | 4 | 4 | 0 | Y | ITAHLKRLW | 84.62 | LTTHLKRLW | 7.69 | LTAHLKRLW | 3.85 | ITAQLKRLW | 3.85 |
| anC | 62 | 0.85 | 4 | 4 | 0 | Y | TAHLKRLWK | 84.62 | TTHLKRLWR | 7.69 | TAQLKRLWK | 3.85 | TAHLKKLWR | 3.85 |
| anC | 63 | 0.85 | 4 | 4 | 0 | Y | AHLKRLWKM | 84.62 | THLKRLWRM | 7.69 | AHLKRLWRM | 3.85 | AQLKRLWKM | 3.85 |
| anC | 64 | 0.85 | 4 | 4 | 0 | Y | HLKRLWKML | 84.62 | HLKRLWRML | 7.69 | QLKRLWKML | 3.85 | HLKKLWRML | 3.85 |
| anC | 65 | 0.62 | 3 | 3 | 0 | Y | LKRLWKMLD | 88.46 | LKRLWRMLD | 7.69 | LKKLWRMLD | 3.85 | | |
| anC | 66 | 0.62 | 3 | 3 | 0 | Y | KRLWKMLDP | 88.46 | KRLWRMLDP | 7.69 | KKLWRMLDP | 3.85 | | |
| anC | 67 | 0.62 | 3 | 3 | 0 | Y | RLWKMLDPR | 88.46 | RLWRMLDPR | 7.69 | KLWRMLDPR | 3.85 | | |
| anC | 68 | 0.52 | 2 | 2 | 0 | Y | LWKMLDPRQ | 88.46 | LWRMLDPRQ | 11.54 | | | | |
| anC | 69 | 0.52 | 2 | 2 | 0 | Y | WKMLDPRQG | 88.46 | WRMLDPRQG | 11.54 | | | | |
| anC | 70 | 0.52 | 2 | 2 | 0 | Y | KMLDPRQGL | 88.46 | RMLDPRQGL | 11.54 | | | | |
| anC | 71 | 0.24 | 2 | 2 | 0 | Y | MLDPRQGLA | 96.15 | MLDPRQGLT | 3.85 | | | | |
| anC | 72 | 0.62 | 3 | 3 | 0 | Y | LDPRQGLAV | 88.46 | LDPRQGLAA | 7.69 | LDPRQGLTV | 3.85 | | |
| anC | 73 | 0.62 | 3 | 3 | 0 | Y | DPRQGLAVL | 88.46 | DPRQGLAAL | 7.69 | DPRQGLTVL | 3.85 | | |
| anC | 74 | 0.62 | 3 | 3 | 0 | Y | PRQGLAVLR | 88.46 | PRQGLAALR | 7.69 | PRQGLTVLR | 3.85 | | |
| anC | 75 | 0.62 | 3 | 3 | 0 | Y | RQGLAVLRK | 88.46 | RQGLAALRK | 7.69 | RQGLTVLRK | 3.85 | | |

Fig. 28-4

Species: YFV (9-mers)

| protein | block starting position | ent

Fig. 28-5

Species: YFV (9-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 109 | 0.85 | 4 | 4 | 0 | Y | QFLILGMLL | 84.62 | PLILLGLLA | 3.85 | QLLILGMIL | 3.85 | | |
| anC | 110 | 0.85 | 4 | 4 | 0 | Y | FLILGMLLM | 84.62 | LLLLGLLAL | 3.85 | LLILGMILM | 3.85 | | |
| anC | 119 | 1.29 | 5 | 5 | 0 | Y | TGGVTLVRK | 73.08 | SGGVTLVRK | 3.85 | GGGVTLVRK | 3.85 | TGGVTLMRK | 3.85 |
| anC | 120 | 0.24 | 2 | 2 | 0 | Y | GGVTLVRKN | 96.15 | | | | | | |
| anC | 121 | 0.24 | 2 | 2 | 0 | Y | GVTLVRKNR | 96.15 | | | | | | |
| prM | 122 | 0.24 | 2 | 2 | 0 | Y | VTLVRKNRW | 96.15 | | | | | | |
| prM | 123 | 0.24 | 2 | 2 | 0 | Y | TLVRKNRWL | 96.15 | | | | | | |
| prM | 124 | 0.24 | 2 | 2 | 0 | Y | LVRKNRWLL | 96.15 | | | | | | |
| prM | 125 | 0.24 | 2 | 2 | 0 | Y | VRKNRWLLL | 96.15 | | | | | | |
| prM | 126 | 0 | 1 | 1 | 0 | Y | RKNRWLLLN | 100 | | | | | | |
| prM | 127 | 0 | 1 | 1 | 0 | Y | KNRWLLLNV | 100 | | | | | | |
| prM | 128 | 0 | 1 | 1 | 0 | Y | NRWLLLNVT | 100 | | | | | | |
| prM | 129 | 0.52 | 2 | 2 | 0 | Y | RWLLLNVTS | 88.46 | | | | | | |
| prM | 130 | 0.52 | 2 | 2 | 0 | Y | WLLLNVTSE | 88.46 | | | | | | |
| prM | 131 | 0.52 | 2 | 2 | 0 | Y | LLLNVTSED | 88.46 | | | | | | |
| prM | 132 | 0.52 | 2 | 2 | 0 | Y | LLNVTSEDL | 88.46 | | | | | | |
| prM | 133 | 0.52 | 2 | 2 | 0 | Y | LNVTSEDLG | 88.46 | | | | | | |
| prM | 134 | 0.52 | 2 | 2 | 0 | Y | NVTSEDLGK | 88.46 | | | | | | |
| prM | 135 | 0.52 | 2 | 2 | 0 | Y | VTSEDLGKT | 88.46 | | | | | | |
| prM | 136 | 0.52 | 2 | 2 | 0 | Y | TSEDLGKTF | 88.46 | | | | | | |
| prM | 137 | 0.52 | 2 | 2 | 0 | Y | SEDLGKTFS | 88.46 | | | | | | |
| prM | 138 | 0.7 | 4 | 4 | 0 | Y | EDLGKTFSV | 88.46 | EDLGKTFSM | 3.85 | EDLGKTFSL | 3.85 | | |
| prM | 139 | 0.7 | 4 | 4 | 0 | Y | DLGKTFSVG | 88.46 | DLGKTFSMG | 3.85 | DLGKTFSLG | 3.85 | | |
| prM | 140 | 0.93 | 5 | 5 | 0 | Y | LGKTFSVGT | 84.62 | LGKTFSLGT | 3.85 | LGKTFSMGT | 3.85 | LGKTFSJGT | 3.85 |
| prM | 141 | 0.93 | 5 | 5 | 0 | Y | GKTFSVGTG | 84.62 | GKTFSMGTG | 3.85 | GKTFSLGTG | 3.85 | GKTFSVGAG | 3.85 |

Fig. 28-6

Species: YFV (9-mers)

| protein | block starting position | block entropy | total peptides in block | #

Fig. 28-7

Species: YFV (9-mers)

| protein | block starting position | block ent

Fig. 28-8

Species: YFV (9-mers)

| protein

Fig. 28-9

Species: YFV (9-mers)

| protein | block starting position | entropy | total peptides in block | # peptides required to cover 99% of block | gap/X fraction | 99% of block covered w/ <= 5 peptides? | block | frequency | peptides required to cover 99% of block | frequency |
|---

Fig. 28-10

Species: YFV (9-mers)

| protein | block starting position | block

Fig. 28-12

Species: YFV (9-mers)

| protein | block starting position | block entropy | total pe

Fig. 28-13

Species: YFV (9-mers)

| protein | block starting position | block entropy | total peptides in block | # peptides required to cover 99% of block | gap/X fraction | 99% of block covered w/ <= 5 peptides? | block to cover 99% of | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| E | 317 | 0 | 1 | 1 | 0 | Y | TVMAPDKPS | 100 | | | | | | |
| E | 318 | 0 | 1 | 1 | 0 | Y | VMAPDKPSL | 100 | | | | | | |
| E | 319 | 0 | 1 | 1 | 0 | Y | MAPDKPSLD | 100 | | | | | | |
| E | 320 | 0 | 1 | 1 | 0 | Y | APDKPSLDI | 100 | | | | | | |
| E | 321 | 0 | 1 | 1 | 0 | Y | PDKPSLDIS | 100 | | | | | | |
| E | 322 | 0 | 1 | 1 | 0 | Y | DKPSLDISL | 100 | | | | | | |
| E | 323 | 0.52 | 2 | 2 | 0 | Y | KPSLDISLE | 88.46 | KPSLDISLQ | 11.54 | | | | |
| E | 324 | 0.52 | 2 | 2 | 0 | Y | PSLDISLET | 88.46 | PSLDISLQT | 11.54 | | | | |
| E | 325 | 0.52 | 2 | 2 | 0 | Y | SLDISLETV | 88.46 | SLDISLQTV | 11.54 | | | | |
| E | 326 | 0.52 | 2 | 2 | 0 | Y | LDISLETVA | 88.46 | LDISLQTVA | 11.54 | | | | |
| E | 327 | 0.52 | 2 | 2 | 0 | Y | DISLETVAI | 88.46 | DISLQTVAI | 11.54 | | | | |
| E | 328 | 0.52 | 2 | 2 | 0 | Y | ISLETVAID | 88.46 | ISLQTVAID | 11.54 | | | | |
| E | 329 | 1.3 | 3 | 2 | 0 | Y | SLETVAIDR | 61.54 | SLETVAIDG | 26.92 | SLQTVAIDG | 11.54 | | |
| E | 330 | 1.3 | 3 | 2 | 0 | Y | LETVAIDRP | 61.54 | LETVAIDGP | 26.92 | LQTVAIDGP | 11.54 | | |
| E | 331 | 1.53 | 3 | 3 | 0 | Y | ETVAIDRPA | 61.54 | ETVAIDGPA | 19.23 | QTVAIDGPA | 11.54 | ETVAIDGPV | 7.69 |
| E | 332 | 1.24 | 3 | 3 | 0 | Y | TVAIDRPAE | 61.54 | TVAIDGPAE | 30.77 | TVAIDGPVE | 7.69 | VAIDGPVEA | 7.69 |
| E | 333 | 1.74 | 4 | 4 | 0 | Y | VAIDRPAEV | 46.15 | VAIDGPAEA | 30.77 | VAIDRPAEA | 15.38 | AIDGPVEAR | 7.69 |
| E | 334 | 1.74 | 4 | 3 | 0 | Y | AIDRPAEVR | 46.15 | AIDGPAEAR | 30.77 | AIDRPAEAR | 15.38 | IDGPVEARK | 7.69 |
| E | 335 | 1.74 | 4 | 4 | 0 | Y | IDRPAEVRK | 46.15 | IDGPAEARK | 30.77 | IDRPAEARK | 15.38 | DGPVEARKV | 7.69 |
| E | 336 | 1.74 | 4 | 4 | 0 | Y | DRPAEVRKV | 46.15 | DGPAEARKV | 30.77 | DRPAEARKV | 15.38 | GPVEARKVC | 7.69 |
| E | 337 | 1.74 | 4 | 4 | 0 | Y | RPAEVRKVC | 46.15 | GPAEARKVC | 30.77 | RPAEARKVC | 15.38 | | |
| E | 338 | 1.31 | 3 | 3 | 0 | Y | PAEARKVCY | 46.15 | PAEVRKVCY | 46.15 | PVEARKVCY | 7.69 | | |
| E | 339 | 1.69 | 4 | 4 | 0 | Y | AEVRKVCY | 46.15 | AEARKVCYN | 34.62 | AEARKVCYS | 11.54 | VEARKVCYN | 7.69 |
| E | 340 | 1.4 | 3 | 3 | 0 | Y | EVRKVCYNA | 46.15 | EARKVCYNA | 42.31 | EARKVCYSA | 11.54 | | |
| E | 341 | 1.4 | 3 | 3 | 0 | Y | VRKVCYNAV | 46.15 | ARKVCYNAV | 42.31 | ARKVCYSAV | 11.54 | | |

Species: YFV (9-mers)

| protein | block

Fig. 28-16

Species: YFV (9-mers)

| protein | block starting position | block

Fig. 28-17

Species: YFV (9

Fig. 28-18

Species: YFV (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 442 | 0.24 | 2 | 2 | 0 | Y | KTLKFDALS | 96.15 | KTLKFDVLS | 3.85 | | | | |
| E | 443 | 0.24 | 2 | 2 | 0 | Y | TLKFDALSG | 96.15 | TLKFDVLSG | 3.85 | | | | |
| E | 444 | 0.24 | 2 | 2 | 0 | Y | LKFDALSGS | 96.15 | LKFDVLSGS | 3.85 | | | | |
| E | 445 | 0.24 | 2 | 2 | 0 | Y | KFDALSGSQ | 96.15 | KFDVLSGSQ | 3.85 | | | | |
| E | 446 | 0.24 | 2 | 2 | 0 | Y | FDALSGSQE | 96.15 | FDVLSGSQE | 3.85 | | | | |
| E | 447 | 1.14 | 3 | 3 | 0 | Y | DALSGSQEV | 61.54 | DALSGSQEA | 34.62 | DVLSGSQEA | 3.85 | | |
| E | 448 | 1.14 | 3 | 3 | 0 | Y | ALSGSQEVE | 61.54 | ALSGSQEAE | 34.62 | VLSGSQEAE | 3.85 | | |
| E | 449 | 0.96 | 2 | 2 | 0 | Y | LSGSQEVEF | 61.54 | LSGSQEAEF | 38.46 | | | | |
| E | 450 | 1.17 | 3 | 3 | 0 | Y | SGSQEVEFI | 57.69 | SGSQEAEFT | 38.46 | SGSQEVEFT | 3.85 | | |
| E | 451 | 1.17 | 3 | 3 | 0 | Y | GSQEVEFIG | 57.69 | GSQEAEFTG | 38.46 | GSQEVEFTG | 3.85 | | |
| E | 452 | 1.17 | 3 | 3 | 0 | Y | SQEVEFIGY | 57.69 | SQEAEFTGY | 38.46 | SQEVEFTGY | 3.85 | | |
| E | 453 | 1.17 | 3 | 3 | 0 | Y | QEVEFIGYG | 57.69 | QEAEFTGYG | 38.46 | QEVEFTGYG | 3.85 | | |
| E | 454 | 1.17 | 3 | 3 | 0 | Y | EVEFIGYGK | 57.69 | EAEFTGYGK | 38.46 | EVEFTGYGK | 3.85 | | |
| E | 455 | 1.35 | 4 | 4 | 0 | Y | VEFIGYGKA | 57.69 | AEFTGYGKA | 34.62 | AEFTGYGKV | 3.85 | VEFTGYGKA | 3.85 |
| E | 456 | 1.17 | 3 | 3 | 0 | Y | EFIGYGKAT | 57.69 | EFTGYGKAT | 38.46 | EFTGYGKV | 3.85 | | |
| E | 457 | 1.17 | 3 | 3 | 0 | Y | FIGYGKATL | 57.69 | FTGYGKATL | 38.46 | FTGYGKVTL | 3.85 | | |
| E | 458 | 1.17 | 3 | 3 | 0 | Y | IGYGKATLE | 57.69 | TGYGKATLE | 38.46 | TGYGKVTLE | 3.85 | | |
| E | 459 | 0.24 | 2 | 2 | 0 | Y | GYGKATLEC | 96.15 | GYGKVTLEC | 3.85 | | | | |
| E | 460 | 0.47 | 3 | 3 | 0 | Y | YGKATLECQ | 92.31 | YGKATLECR | 3.85 | YGKVTLECQ | 3.85 | | |
| E | 461 | 0.47 | 3 | 3 | 0 | Y | GKATLECQV | 92.31 | GKATLECRV | 3.85 | GKVTLECQV | 3.85 | | |
| E | 462 | 0.47 | 3 | 3 | 0 | Y | KATLECQVQ | 92.31 | KATLECRVQ | 3.85 | KATLECRVQ | 3.85 | | |
| E | 463 | 0.47 | 3 | 3 | 0 | Y | ATLECQVQT | 92.31 | ATLECRVQT | 3.85 | VTLECQVQT | 3.85 | | |
| E | 464 | 0.24 | 2 | 2 | 0 | Y | TLECQVQTA | 96.15 | TLECRVQTA | 3.85 | | | | |
| E | 465 | 0.24 | 2 | 2 | 0 | Y | LECQVQTAV | 96.15 | LECRVQTAV | 3.85 | | | | |
| E | 466 | 0.24 | 2 | 2 | 0 | Y | ECQVQTAVD | 96.15 | ECRVQTAVD | 3.85 | | | | |

Fig. 28-19

Species: YFV (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 467 | 0.24 | 2 | 2 | 0 | Y | CQQTAVDF | 96.15 | CRVQTAVDF | 3.85 | | | | | | |
| E | 468 | 0.24 | 2 | 2 | 0 | Y | QVQTAVDFG | 96.15 | RVQTAVDFG | 3.85 | | | | | | |
| E | 469 | 0 | 1 | 1 | 0 | Y | VQTAVDFGN | 100 | | | | | | | | |
| E | 470 | 0 | 1 | 1 | 0 | Y | QTAVDFGNS | 100 | | | | | | | | |
| E | 471 | 0 | 1 | 1 | 0 | Y | TAVDFGNSY | 100 | | | | | | | | |
| E | 472 | 0 | 1 | 1 | 0 | Y | AVDFGNSYI | 100 | | | | | | | | |
| E | 473 | 0 | 1 | 1 | 0 | Y | VDFGNSYIA | 100 | | | | | | | | |
| E | 474 | 0 | 1 | 1 | 0 | Y | DFGNSYIAE | 100 | | | | | | | | |
| E | 475 | 0 | 1 | 1 | 0 | Y | FGNSYIAEM | 100 | | | | | | | | |
| E | 476 | 0 | 1 | 1 | 0 | Y | GNSYIAEME | 100 | | | | | | | | |
| E | 477 | 0.96 | 2 | 2 | 0 | Y | NSYIAEMET | 61.54 | NSYIAEMEK | 38.46 | | | | | | |
| E | 478 | 1.3 | 3 | 3 | 0 | Y | SYIAEMETE | 61.54 | SYIAEMEKE | 26.92 | SYIAEMEKD | 11.54 | | | | |
| E | 479 | 1.3 | 3 | 3 | 0 | Y | YIAEMETES | 61.54 | YIAEMEKES | 26.92 | YIAEMEKDS | 11.54 | | | | |
| E | 480 | 1.3 | 3 | 3 | 0 | Y | IAEMETESW | 61.54 | IAEMEKESW | 26.92 | IAEMEKDSW | 11.54 | | | | |
| E | 481 | 1.3 | 3 | 3 | 0 | Y | AEMETESWI | 61.54 | AEMEKESWI | 26.92 | AEMEKDSWI | 11.54 | | | | |
| E | 482 | 1.3 | 3 | 3 | 0 | Y | EMETESWIV | 61.54 | EMEKESWIV | 26.92 | EMEKDSWIV | 11.54 | | | | |
| E | 483 | 1.3 | 3 | 3 | 0 | Y | METESWIVD | 61.54 | MEKESWIVD | 26.92 | MEKDSWIVD | 11.54 | | | | |
| E | 484 | 1.3 | 3 | 3 | 0 | Y | ETESWIVDR | 61.54 | EKESWIVDR | 26.92 | EKDSWIVDR | 11.54 | | | | |
| E | 485 | 1.3 | 3 | 3 | 0 | Y | TESWIVDRQ | 61.54 | KESWIVDRQ | 26.92 | KDSWIVDRQ | 11.54 | | | | |
| E | 486 | 0.52 | 2 | 2 | 0 | Y | ESWIVDRQW | 88.46 | DSWIVDRQW | 11.54 | | | | | | |
| E | 487 | 0 | 1 | 1 | 0 | Y | SWIVDRQWA | 100 | | | | | | | | |
| E | 488 | 0 | 1 | 1 | 0 | Y | WIVDRQWAQ | 100 | | | | | | | | |
| E | 489 | 0 | 1 | 1 | 0 | Y | IVDRQWAQD | 100 | | | | | | | | |
| E | 490 | 0 | 1 | 1 | 0 | Y | VDRQWAQDL | 100 | | | | | | | | |
| E | 491 | 0 | 1 | 1 | 0 | Y | DRQWAQDLT | 100 | | | | | | | | |

Fig. 28-20

Species: YFV (9-mers)

| protein | block starting position | entropy block | total

Fig. 28-21

Species: YFV (9-mers)

| protein

Fig. 28-22

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 542 | 0 | 1 | 1 | 0 | Y | ALTGAMRVT | 100 | | | | | | | | |
| E | 543 | 0 | 1 | 1 | 0 | Y | LTGAMRVTK | 100 | | | | | | | | |
| E | 544 | 0 | 1 | 1 | 0 | Y | TGAMRVTKD | 100 | | | | | | | | |
| E | 545 | 0.52 | 2 | 2 | 0 | Y | GAMRVTKDT | 88.46 | GAMRVTKDE | 11.54 | | | | | | |
| E | 546 | 0.52 | 2 | 2 | 0 | Y | AMRVTKDTN | 88.46 | AMRVTKDEN | 11.54 | | | | | | |
| E | 547 | 0.52 | 2 | 2 | 0 | Y | MRVTKDTND | 88.46 | MRVTKDEND | 11.54 | | | | | | |
| E | 548 | 0.52 | 2 | 2 | 0 | Y | RVTKDTNDN | 88.46 | RVTKDENDN | 11.54 | | | | | | |
| E | 549 | 0.52 | 2 | 2 | 0 | Y | VTKDTNDNN | 88.46 | VTKDENDNN | 11.54 | | | | | | |
| E | 550 | 0.52 | 2 | 2 | 0 | Y | TKDTNDNNL | 88.46 | TKDENDNNL | 11.54 | | | | | | |
| E | 551 | 0.52 | 2 | 2 | 0 | Y | KDTNDNNLY | 88.46 | KDENDNNLY | 11.54 | | | | | | |
| E | 552 | 0.52 | 2 | 2 | 0 | Y | DTNDNNLYK | 88.46 | DENDNNLYK | 11.54 | | | | | | |
| E | 553 | 0.52 | 2 | 2 | 0 | Y | TNDNNLYKL | 88.46 | ENDNNLYKL | 11.54 | | | | | | |
| E | 554 | 0 | 1 | 1 | 0 | Y | NDNNLYKLH | 100 | | | | | | | | |
| E | 555 | 0 | 1 | 1 | 0 | Y | DNNLYKLHG | 100 | | | | | | | | |
| E | 556 | 0 | 1 | 1 | 0 | Y | NNLYKLHGG | 100 | | | | | | | | |
| E | 557 | 0 | 1 | 1 | 0 | Y | NLYKLHGGH | 100 | | | | | | | | |
| E | 558 | 0 | 1 | 1 | 0 | Y | LYKLHGGHV | 100 | | | | | | | | |
| E | 559 | 0 | 1 | 1 | 0 | Y | YKLHGGHVS | 100 | | | | | | | | |
| E | 560 | 0 | 1 | 1 | 0 | Y | KLHGGHVSC | 100 | | | | | | | | |
| E | 561 | 0 | 1 | 1 | 0 | Y | LHGGHVSCR | 100 | | | | | | | | |
| E | 562 | 0 | 1 | 1 | 0 | Y | HGGHVSCRV | 100 | | | | | | | | |
| E | 563 | 0 | 1 | 1 | 0 | Y | GGHVSCRVK | 100 | | | | | | | | |
| E | 564 | 0 | 1 | 1 | 0 | Y | GHVSCRVKL | 100 | | | | | | | | |
| E | 565 | 0 | 1 | 1 | 0 | Y | HVSCRVKLS | 100 | | | | | | | | |
| E | 566 | 0 | 1 | 1 | 0 | Y | VSCRVKLSA | 100 | | | | | | | | |

Fig. 28-23

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

Fig. 28-24

Species: YFV (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 592 | 0.24 | 2 | 2 | 0 | Y | VKNPTDTGH | 96.15 | VKNPTDTDH | 3.85 | | |
| E | 593 | 0.24 | 2 | 2 | 0 | Y | KNPTDTGHG | 96.15 | KNPTDTDHG | 3.85 | | |
| E | 594 | 0.24 | 2 | 2 | 0 | Y | NPTDTGHGT | 96.15 | NPTDTDHGT | 3.85 | | |
| E | 595 | 0.24 | 2 | 2 | 0 | Y | PTDTGHGTV | 96.15 | PTDTDHGTV | 3.85 | | |
| E | 596 | 0.24 | 2 | 2 | 0 | Y | TDTGHGTVW | 96.15 | TDTDHGTVW | 3.85 | | |
| E | 597 | 0.24 | 2 | 2 | 0 | Y | DTGHGTVWM | 96.15 | DTDHGTVWM | 3.85 | | |
| E | 598 | 0.24 | 2 | 2 | 0 | Y | TGHGTVWMQ | 96.15 | TDHGTVWMQ | 3.85 | | |
| E | 599 | 0.24 | 2 | 2 | 0 | Y | GHGTVWMQV | 96.15 | DHGTVWMQV | 3.85 | | |
| E | 600 | 0 | 1 | 1 | 0 | Y | HGTVWMQVK | 100 | | | | |
| E | 601 | 0 | 1 | 1 | 0 | Y | GTVWMQVKV | 100 | | | | |
| E | 602 | 1 | 2 | 2 | 0 | Y | TVWMQVKVP | 53.85 | TVWMQVKVS | 46.15 | | |
| E | 603 | 1 | 2 | 2 | 0 | Y | VWMQVKVPK | 53.85 | VWMQVKVSK | 46.15 | | |
| E | 604 | 1 | 2 | 2 | 0 | Y | VMQVKVPKG | 53.85 | VMQVKVSKG | 46.15 | | |
| E | 605 | 1 | 2 | 2 | 0 | Y | MQVKVPKGA | 53.85 | MQVKVSKGA | 46.15 | | |
| E | 606 | 1 | 2 | 2 | 0 | Y | QVKVPKGAP | 53.85 | QVKVSKGAP | 46.15 | | |
| E | 607 | 1 | 2 | 2 | 0 | Y | VKVPKGAPC | 53.85 | VKVSKGAPC | 46.15 | | |
| E | 608 | 1.53 | 3 | 3 | 0 | Y | KVSKGAPCR | 46.15 | KVPKGAPCK | 30.77 | KVPKGAPCR | 23.08 |
| E | 609 | 1.53 | 3 | 3 | 0 | Y | VSKGAPCRI | 46.15 | VPKGAPCKI | 30.77 | VPKGAPCRI | 23.08 |
| E | 610 | 1.53 | 3 | 3 | 0 | Y | SKGAPCRIP | 46.15 | PKGAPCKIP | 30.77 | PKGAPCRIP | 23.08 |
| E | 611 | 0.89 | 2 | 2 | 0 | Y | KGAPCRIPV | 69.23 | KGAPCKIPV | 30.77 | | |
| E | 612 | 0.89 | 2 | 2 | 0 | Y | GAPCRIPVI | 69.23 | GAPCKIPVI | 30.77 | | |
| E | 613 | 0.89 | 2 | 2 | 0 | Y | APCRIPVIV | 69.23 | APCKIPVIV | 30.77 | | |
| E | 614 | 0.89 | 2 | 2 | 0 | Y | PCRIPVIVA | 69.23 | PCKIPVIVA | 30.77 | | |
| E | 615 | 0.89 | 2 | 2 | 0 | Y | CRIPVIVAD | 69.23 | CKIPVIVAD | 30.77 | | |
| E | 616 | 0.89 | 2 | 2 | 0 | Y | RIPVIVADD | 69.23 | KIPVIVADD | 30.77 | | |

Fig. 28-25

Species: YFV (9-mers)

| protein | block starting position | entropy block | total pe

Fig. 28-26

Species: YFV (9-mers)

| protein | block starting position | block entropy | total

Fig. 28-27

Species: YFV (9-mers)

| protein | block starting position | entropy

Fig. 28-28

Species: YFV (9

Fig. 28-29

Species: YFV (9-mers)

| protein | block star

Fig. 28-30

Species: YFV (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 742 | 0.47 | 3 | 3 | 0 | Y | MGAVLIWWG | 92.31 | MGVVLIWVG | 3.85 | IGAVLIWWG | 3.85 |
| E | 743 | 0.47 | 3 | 3 | 0 | Y | GAVLIWWGI | 92.31 | GAVLIWGF | 3.85 | GVVLIWVGI | 3.85 |
| E | 744 | 0.47 | 3 | 3 | 0 | Y | AVLIWWGIN | 92.31 | AVLIWWGFN | 3.85 | VVLIWVGIN | 3.85 |
| E | 745 | 0.24 | 2 | 2 | 0 | Y | VLIWWGINT | 96.15 | VLIWVGFNT | 3.85 | | |
| E | 746 | 0.24 | 2 | 2 | 0 | Y | LIWWGINTR | 96.15 | LIWVGFNTR | 3.85 | | |
| E | 747 | 0.24 | 2 | 2 | 0 | Y | IWWGINTRN | 96.15 | IWVGFNTRN | 3.85 | | |
| E | 748 | 0.24 | 2 | 2 | 0 | Y | WWGINTRNM | 96.15 | WVGFNTRNM | 3.85 | | |
| E | 749 | 0.24 | 2 | 2 | 0 | Y | VGINTRNMT | 96.15 | VGFNTRNMT | 3.85 | | |
| E | 750 | 0.24 | 2 | 2 | 0 | Y | GINTRNMTM | 96.15 | GFNTRNMTM | 3.85 | | |
| E | 751 | 0.24 | 2 | 2 | 0 | Y | INTRNMTMS | 96.15 | FNTRNMTMS | 3.85 | | |
| E | 752 | 0 | 1 | 1 | 0 | Y | NTRNMTMSM | 100 | | | | |
| E | 753 | 0 | 1 | 1 | 0 | Y | TRNMTMSMS | 100 | | | | |
| E | 754 | 0 | 1 | 1 | 0 | Y | RNMTMSMSM | 100 | | | | |
| E | 755 | 0 | 1 | 1 | 0 | Y | NMTMSMSMI | 100 | | | | |
| E | 756 | 0.24 | 2 | 2 | 0 | Y | MTMSMSMIL | 96.15 | MTMSMSMIM | 3.85 | | |
| E | 757 | 0.24 | 2 | 2 | 0 | Y | TMSMSMILV | 96.15 | TMSMSMIMV | 3.85 | | |
| E | 758 | 0.24 | 2 | 2 | 0 | Y | MSMSMILVG | 96.15 | MSMSMIMVG | 3.85 | | |
| E | 759 | 0.24 | 2 | 2 | 0 | Y | SMSMILVGV | 96.15 | SMSMIMVGV | 3.85 | | |
| E | 760 | 0.24 | 2 | 2 | 0 | Y | MSMILVGVI | 96.15 | MSMIMVGVI | 3.85 | | |
| E | 761 | 0.24 | 2 | 2 | 0 | Y | SMILVGVIM | 96.15 | SMIMVGVIM | 3.85 | | |
| E | 762 | 0.24 | 2 | 2 | 0 | Y | MILVGVIMM | 96.15 | MIMVGVIMM | 3.85 | | |
| E | 763 | 0.24 | 2 | 2 | 0 | Y | ILVGVIMMF | 96.15 | IMVGVIMMF | 3.85 | | |
| E | 764 | 0.24 | 2 | 2 | 0 | Y | LVGVIMMFL | 96.15 | MVGVIMMFL | 3.85 | | |
| E | 765 | 0 | 2 | 1 | 0 | Y | VGVIMMFLS | 100 | | | | |
| E | 766 | 0 | 2 | 1 | 0 | Y | GVIMMFLSL | 100 | | | | |

Fig. 28-31

Species: YFV (9-mers)

| protein | block starting position | block entropy | total peptides in block | # peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 767 | 0 | 1 | 1 | 0 | Y | VIMMFLSLG | 100 | | | | | | |
| E | 768 | 0 | 1 | 1 | 0 | Y | IMMFLSLGV | 100 | | | | | | |
| E | 769 | 0 | 1 | 1 | 0 | Y | MMFLSLGVG | 100 | | | | | | |
| E | 770 | 0 | 1 | 1 | 0 | Y | MFLSLGVGA | 100 | | | | | | |
| E | 771 | 0 | 1 | 1 | 0 | Y | FLSLGVGAD | 100 | | | | | | |
| E | 772 | 0 | 1 | 1 | 0 | Y | LSLGVGADQ | 100 | | | | | | |
| E | 773 | 0 | 1 | 1 | 0 | Y | SLGVGADQG | 100 | | | | | | |
| E | 774 | 0 | 1 | 1 | 0 | Y | LGVGADQGC | 100 | | | | | | |
| E | 775 | 0 | 1 | 1 | 0 | Y | GVGADQGCA | 100 | | | | | | |
| E | 776 | 0.52 | 2 | 2 | 0 | Y | VGADQGCAI | 88.46 | VGADQGCAV | 11.54 | | | | |
| E | 777 | 0.52 | 2 | 2 | 0 | Y | GADQGCAIN | 88.46 | GADQGCAVN | 11.54 | | | | |
| E | 778 | 0.52 | 2 | 2 | 0 | Y | ADQGCAINF | 88.46 | ADQGCAVNF | 11.54 | | | | |
| NS1 | 779 | 0.74 | 3 | 3 | 0 | Y | DQGCAINFG | 84.62 | DQGCAVNFG | 11.54 | DQGCAINFA | 3.85 | | |
| NS1 | 780 | 0.74 | 3 | 3 | 0 | Y | QGCAINFGK | 84.62 | QGCAVNFGK | 11.54 | QGCAINFAK | 3.85 | | |
| NS1 | 781 | 0.74 | 3 | 3 | 0 | Y | GCAINFGKR | 84.62 | GCAVNFGKR | 11.54 | GCAINFAKR | 3.85 | | |
| NS1 | 782 | 0.74 | 3 | 3 | 0 | Y | CAINFGKRE | 84.62 | CAVNFGKRE | 11.54 | CAINFAKRE | 3.85 | | |
| NS1 | 783 | 0.74 | 3 | 3 | 0 | Y | AINFGKREL | 84.62 | AVNFGKREL | 11.54 | AINFAKREL | 3.85 | | |
| NS1 | 784 | 0.74 | 3 | 3 | 0 | Y | INFGKRELK | 84.62 | VNFGKRELK | 11.54 | INFAKRELK | 3.85 | | |
| NS1 | 785 | 0.24 | 2 | 2 | 0 | Y | NFGKRELKC | 96.15 | NFAKRELK | 3.85 | | | | |
| NS1 | 786 | 0.24 | 2 | 2 | 0 | Y | FGKRELKCG | 96.15 | FAKRELKCG | 3.85 | | | | |
| NS1 | 787 | 0.24 | 2 | 2 | 0 | Y | GKRELKCGD | 96.15 | AKRELKCGD | 3.85 | | | | |
| NS1 | 788 | 0 | 1 | 1 | 0 | Y | KRELKCGDG | 100 | | | | | | |
| NS1 | 789 | 0 | 1 | 1 | 0 | Y | RELKCGDGI | 100 | | | | | | |
| NS1 | 790 | 0 | 1 | 1 | 0 | Y | ELKCGDGIF | 100 | | | | | | |
| NS1 | 791 | 0.52 | 2 | 2 | 0 | Y | LKCGDGIFI | 88.46 | LKCCGDGIFV | 11.54 | | | | |

Fig. 28-32

Species: YFV (9-mers)

| protein | block starting position | ent

Fig. 28-33

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 817 | 0.52 | 2 | 2 | 0 | Y | PVKLASIVK | 88.46 | PVKLASIIK | 11.54 | | | | |
| NS1 | 818 | 0.52 | 2 | 2 | 0 | Y | VKLASIVKA | 88.46 | VKLASIIKA | 11.54 | | | | |
| NS1 | 819 | 0.52 | 2 | 2 | 0 | Y | KLASIVKAS | 88.46 | KLASIIKAS | 11.54 | | | | |
| NS1 | 820 | 0.62 | 3 | 3 | 0 | Y | LASIVKASF | 88.46 | LASIIKASH | 7.69 | LASIIKASY | 3.85 | | |
| NS1 | 821 | 0.62 | 3 | 3 | 0 | Y | ASIVKASFE | 88.46 | ASIIKASHE | 7.69 | ASIIKASYE | 3.85 | | |
| NS1 | 822 | 0.62 | 3 | 3 | 0 | Y | SIVKASFEE | 88.46 | SIIKASHEE | 7.69 | SIIKASYEE | 3.85 | | |
| NS1 | 823 | 0.62 | 3 | 3 | 0 | Y | IVKASFEEG | 88.46 | IIKASHEEG | 7.69 | IIKASYEEG | 3.85 | | |
| NS1 | 824 | 0.62 | 3 | 3 | 0 | Y | VKASFEEGK | 88.46 | IKASHEEGK | 7.69 | IKASYEEGK | 3.85 | | |
| NS1 | 825 | 0.62 | 3 | 3 | 0 | Y | KASFEEGKC | 88.46 | KASHEEGKC | 7.69 | KASYEEGKC | 3.85 | | |
| NS1 | 826 | 0.62 | 3 | 3 | 0 | Y | ASFEEGKCG | 88.46 | ASHEEGKCG | 7.69 | ASYEEGKCG | 3.85 | | |
| NS1 | 827 | 0.62 | 3 | 3 | 0 | Y | SFEEGKCGL | 88.46 | SHEEGKCGL | 7.69 | SYEEGKCGL | 3.85 | | |
| NS1 | 828 | 0.62 | 3 | 3 | 0 | Y | FEEGKCGLN | 88.46 | HEEGKCGLN | 7.69 | YEEGKCGLN | 3.85 | | |
| NS1 | 829 | 0 | 1 | 1 | 0 | Y | EEGKCGLNS | 100 | | | | | | |
| NS1 | 830 | 0 | 1 | 1 | 0 | Y | EGKCGLNSV | 100 | | | | | | |
| NS1 | 831 | 0 | 1 | 1 | 0 | Y | GKCGLNSVD | 100 | | | | | | |
| NS1 | 832 | 0 | 1 | 1 | 0 | Y | KCGLNSVDS | 100 | | | | | | |
| NS1 | 833 | 0 | 1 | 1 | 0 | Y | CGLNSVDSL | 100 | | | | | | |
| NS1 | 834 | 0.24 | 2 | 2 | 0 | Y | GLNSVDSLE | 96.15 | GLNSVDSLD | 3.85 | | | | |
| NS1 | 835 | 0.24 | 2 | 2 | 0 | Y | LNSVDSLEH | 96.15 | LNSVDSLDH | 3.85 | | | | |
| NS1 | 836 | 0.24 | 2 | 2 | 0 | Y | NSVDSLEHE | 96.15 | NSVDSLDHE | 3.85 | | | | |
| NS1 | 837 | 0.24 | 2 | 2 | 0 | Y | SVDSLEHEM | 96.15 | SVDSLDHEM | 3.85 | | | | |
| NS1 | 838 | 0.24 | 2 | 2 | 0 | Y | VDSLEHEMW | 96.15 | VDSLDHEMW | 3.85 | | | | |
| NS1 | 839 | 0.24 | 2 | 2 | 0 | Y | DSLEHEMWR | 96.15 | DSLDHEMWR | 3.85 | | | | |
| NS1 | 840 | 0.24 | 2 | 2 | 0 | Y | SLEHEMWRS | 96.15 | SLDHEMWRS | 3.85 | | | | |
| NS1 | 841 | 0.24 | 2 | 2 | 0 | Y | LEHEMWRSR | 96.15 | LDHEMWRSR | 3.85 | | | | |

Fig. 28-34

Species: YFV (9-mers)

| prot

Fig. 28-35

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 867 | 0.52 | 2 | 2 | 0 | Y | VVQDPKNV | 88.46 | VVQDPKNIY | 11.54 | | | | |
| NS1 | 868 | 0.52 | 2 | 2 | 0 | Y | VQDPKNVYQ | 88.46 | VQDPKNIYQ | 11.54 | | | | |
| NS1 | 869 | 0.52 | 2 | 2 | 0 | Y | QDPKNVYQR | 88.46 | QDPKNIYQR | 11.54 | | | | |
| NS1 | 870 | 0.52 | 2 | 2 | 0 | Y | DPKNVYQRG | 88.46 | DPKNIYQRG | 11.54 | | | | |
| NS1 | 871 | 0.52 | 2 | 2 | 0 | Y | PKNVYQRGT | 88.46 | PKNIYQRGT | 11.54 | | | | |
| NS1 | 872 | 0.52 | 2 | 2 | 0 | Y | KNVYQRGTH | 88.46 | KNIYQRGTH | 11.54 | | | | |
| NS1 | 873 | 0.52 | 2 | 2 | 0 | Y | NVYQRGTHP | 88.46 | NIYQRGTHP | 11.54 | | | | |
| NS1 | 874 | 0.52 | 2 | 2 | 0 | Y | VYQRGTHPF | 88.46 | IYQRGTHPF | 11.54 | | | | |
| NS1 | 875 | 0 | 1 | 1 | 0 | Y | YQRGTHPFS | 100 | | | | | | |
| NS1 | 876 | 0 | 1 | 1 | 0 | Y | QRGTHPFSR | 100 | | | | | | |
| NS1 | 877 | 0 | 1 | 1 | 0 | Y | RGTHPFSRI | 100 | | | | | | |
| NS1 | 878 | 0 | 1 | 1 | 0 | Y | GTHPFSRIR | 100 | | | | | | |
| NS1 | 879 | 0 | 1 | 1 | 0 | Y | THPFSRIRD | 100 | | | | | | |
| NS1 | 880 | 0 | 1 | 1 | 0 | Y | HPFSRIRDG | 100 | | | | | | |
| NS1 | 881 | 0 | 1 | 1 | 0 | Y | PFSRIRDGL | 100 | | | | | | |
| NS1 | 882 | 0 | 1 | 1 | 0 | Y | FSRIRDGLQ | 100 | | | | | | |
| NS1 | 883 | 0 | 1 | 1 | 0 | Y | SRIRDGLQY | 100 | | | | | | |
| NS1 | 884 | 0 | 1 | 1 | 0 | Y | RIRDGLQYG | 100 | | | | | | |
| NS1 | 885 | 0 | 1 | 1 | 0 | Y | IRDGLQYGW | 100 | | | | | | |
| NS1 | 886 | 0 | 1 | 1 | 0 | Y | RDGLQYGWK | 100 | | | | | | |
| NS1 | 887 | 0 | 1 | 1 | 0 | Y | DGLQYGWKT | 100 | | | | | | |
| NS1 | 888 | 0 | 1 | 1 | 0 | Y | GLQYGWKTW | 100 | | | | | | |
| NS1 | 889 | 0 | 1 | 1 | 0 | Y | LQYGWKTWG | 100 | | | | | | |
| NS1 | 890 | 0 | 1 | 1 | 0 | Y | QYGWKTWGK | 100 | | | | | | |
| NS1 | 891 | 0.24 | 2 | 2 | 0 | Y | YGWKTWGKN | 96.15 | YGWKTWGKS | 3.85 | | | | |

Fig. 28-36

Species: YFV (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS1 | 892 | 0.24 | 2 | 2 | 0 | Y | GWKTWGKNL | 96.15 | GWKTWGKSL | 3.85 | | |
| NS1 | 893 | 0.62 | 3 | 3 | 0 | Y | WKTWGKNLV | 88.46 | WKTWGKNLI | 7.69 | WKTWGKSLV | 3.85 |
| NS1 | 894 | 0.62 | 3 | 3 | 0 | Y | KTWGKNLVF | 88.46 | KTWGKNLIF | 7.69 | KTWGKSLVF | 3.85 |
| NS1 | 895 | 0.62 | 3 | 3 | 0 | Y | TWGKNLVFS | 88.46 | TWGKNLIFS | 7.69 | TWGKSLVFS | 3.85 |
| NS1 | 896 | 0.62 | 3 | 3 | 0 | Y | WGKNLVFSP | 88.46 | WGKNLIFSP | 7.69 | WGKSLVFSP | 3.85 |
| NS1 | 897 | 0.62 | 3 | 3 | 0 | Y | GKNLVFSPG | 88.46 | GKNLIFSPG | 7.69 | GKSLVFSPG | 3.85 |
| NS1 | 898 | 0.62 | 3 | 3 | 0 | Y | KNLVFSPGR | 88.46 | KNLIFSPGR | 7.69 | KSLVFSPGR | 3.85 |
| NS1 | 899 | 0.62 | 3 | 3 | 0 | Y | NLVFSPGRK | 88.46 | NLIFSPGRK | 7.69 | SLVFSPGRK | 3.85 |
| NS1 | 900 | 0.39 | 2 | 2 | 0 | Y | LVFSPGRKN | 92.31 | LIFSPGRKN | 7.69 | | |
| NS1 | 901 | 0.39 | 2 | 2 | 0 | Y | VFSPGRKNG | 92.31 | IFSPGRKNG | 7.69 | | |
| NS1 | 902 | 0 | 1 | 1 | 0 | Y | FSPGRKNGS | 100 | | | | |
| NS1 | 903 | 0 | 1 | 1 | 0 | Y | SPGRKNGSF | 100 | | | | |
| NS1 | 904 | 0 | 1 | 1 | 0 | Y | PGRKNGSFI | 100 | | | | |
| NS1 | 905 | 0 | 1 | 1 | 0 | Y | GRKNGSFII | 100 | | | | |
| NS1 | 906 | 0 | 1 | 1 | 0 | Y | RKNGSFIID | 100 | | | | |
| NS1 | 907 | 0 | 1 | 1 | 0 | Y | KNGSFIIDG | 100 | | | | |
| NS1 | 908 | 0 | 1 | 1 | 0 | Y | NGSFIIDGK | 100 | | | | |
| NS1 | 909 | 0 | 1 | 1 | 0 | Y | GSFIIDGKS | 100 | | | | |
| NS1 | 910 | 0 | 1 | 1 | 0 | Y | SFIIDGKSR | 100 | | | | |
| NS1 | 911 | 0 | 1 | 1 | 0 | Y | FIIDGKSRK | 100 | | | | |
| NS1 | 912 | 0 | 1 | 1 | 0 | Y | IIDGKSRKE | 100 | | | | |
| NS1 | 913 | 0 | 1 | 1 | 0 | Y | IDGKSRKEC | 100 | | | | |
| NS1 | 914 | 0 | 1 | 1 | 0 | Y | DGKSRKECP | 100 | | | | |
| NS1 | 915 | 0 | 1 | 1 | 0 | Y | GKSRKECPF | 100 | | | | |
| NS1 | 916 | 0 | 1 | 1 | 0 | Y | KSRKECPFS | 100 | | | | |

Fig. 28-37

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 917 | 0 | 1 | 1 | 0 | Y | SRKECPFSN | 100 | | | | | | |
| NS1 | 918 | 0 | 1 | 1 | 0 | Y | RKECPFSNR | 100 | | | | | | |
| NS1 | 919 | 0 | 1 | 1 | 0 | Y | KECPFSNRV | 100 | | | | | | |
| NS1 | 920 | 0 | 1 | 1 | 0 | Y | ECPFSNRVW | 100 | | | | | | |
| NS1 | 921 | 0 | 1 | 1 | 0 | Y | CPFSNRVWN | 100 | | | | | | |
| NS1 | 922 | 0 | 1 | 1 | 0 | Y | PFSNRVWNS | 100 | | | | | | |
| NS1 | 923 | 0 | 1 | 1 | 0 | Y | FSNRVWNSF | 100 | | | | | | |
| NS1 | 924 | 0 | 1 | 1 | 0 | Y | SNRVWNSFQ | 100 | | | | | | |
| NS1 | 925 | 0 | 1 | 1 | 0 | Y | NRVWNSFQI | 100 | | | | | | |
| NS1 | 926 | 0 | 1 | 1 | 0 | Y | RVWNSFQIE | 100 | | | | | | |
| NS1 | 927 | 0 | 1 | 1 | 0 | Y | VWNSFQIEE | 100 | | | | | | |
| NS1 | 928 | 0 | 1 | 1 | 0 | Y | WNSFQIEEF | 100 | | | | | | |
| NS1 | 929 | 0 | 1 | 1 | 0 | Y | NSFQIEEFG | 100 | | | | | | |
| NS1 | 930 | 0.52 | 2 | 2 | 0 | Y | SFQIEEFGT | 88.46 | SFQIEEFGM | 11.54 | | | | |
| NS1 | 931 | 0.52 | 2 | 2 | 0 | Y | FQIEEFGTG | 88.46 | FQIEEFGMG | 11.54 | | | | |
| NS1 | 932 | 0.52 | 2 | 2 | 0 | Y | QIEEFGTGV | 88.46 | QIEEFGMGV | 11.54 | | | | |
| NS1 | 933 | 0.52 | 2 | 2 | 0 | Y | IEEFGTGVF | 88.46 | IEEFGMGVF | 11.54 | | | | |
| NS1 | 934 | 0.52 | 2 | 2 | 0 | Y | EEFGTGVFT | 88.46 | EEFGMGVFT | 11.54 | | | | |
| NS1 | 935 | 0.52 | 2 | 2 | 0 | Y | EFGTGVFTT | 88.46 | EFGMGVFTT | 11.54 | | | | |
| NS1 | 936 | 0.52 | 2 | 2 | 0 | Y | FGTGVFTTR | 88.46 | FGMGVFTTR | 11.54 | | | | |
| NS1 | 937 | 0.52 | 2 | 2 | 0 | Y | GTGVFTTRV | 88.46 | GMGVFTTRV | 11.54 | | | | |
| NS1 | 938 | 0.52 | 2 | 2 | 0 | Y | TGVFTTRVY | 88.46 | MGVFTTRVF | 11.54 | | | | |
| NS1 | 939 | 0.52 | 2 | 2 | 0 | Y | GVFTTRVYM | 88.46 | GVFTTRVFM | 11.54 | | | | |
| NS1 | 940 | 0.52 | 2 | 2 | 0 | Y | VFTTRVYMD | 88.46 | VFTRVFMD | 11.54 | | | | |
| NS1 | 941 | 0.52 | 2 | 2 | 0 | Y | FTTRVYMDA | 88.46 | FTTRVFMDA | 11.54 | | | | |

Fig. 28-38

Species: YFV (9-mers)

| protein | block starting position | entropy block | total

Fig. 28-39

Species: YFV (9-mers)

Fig. 28-40

Species: YFV (

Fig. 28-41

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 1017 | 0.62 | 2 | 2 | 0 | Y | SEMFMPRSI | 84.62 | SDMFMPRSI | 15.38 |
| NS1 | 1018 | 0.62 | 2 | 2 | 0 | Y | EMFMPRSIG | 84.62 | DMFMPRSIG | 15.38 |
| NS1 | 1019 | 0 | 1 | 1 | 0 | Y | MFMPRSIGG | 100 | | |
| NS1 | 1020 | 0 | 1 | 1 | 0 | Y | FMPRSIGGP | 100 | | |
| NS1 | 1021 | 0 | 1 | 1 | 0 | Y | MPRSIGGPV | 100 | | |
| NS1 | 1022 | 0 | 1 | 1 | 0 | Y | PRSIGGPVS | 100 | | |
| NS1 | 1023 | 0 | 1 | 1 | 0 | Y | RSIGGPVSS | 100 | | |
| NS1 | 1024 | 0 | 1 | 1 | 0 | Y | SIGGPVSSH | 100 | | |
| NS1 | 1025 | 0 | 1 | 1 | 0 | Y | IGGPVSSHN | 100 | | |
| NS1 | 1026 | 0.24 | 2 | 2 | 0 | Y | GGPVSSHNH | 96.15 | GGPVSSHNR | 3.85 |
| NS1 | 1027 | 0.24 | 2 | 2 | 0 | Y | GPVSSHNHI | 96.15 | GPVSSHNRI | 3.85 |
| NS1 | 1028 | 0.24 | 2 | 2 | 0 | Y | PVSSHNHIP | 96.15 | PVSSHNRIP | 3.85 |
| NS1 | 1029 | 0.24 | 2 | 2 | 0 | Y | VSSHNHIPG | 96.15 | VSSHNRIPG | 3.85 |
| NS1 | 1030 | 0.24 | 2 | 2 | 0 | Y | SSHNHIPGY | 96.15 | SSHNRIPGY | 3.85 |
| NS1 | 1031 | 0.24 | 2 | 2 | 0 | Y | SHNHIPGYK | 96.15 | SHNRIPGYK | 3.85 |
| NS1 | 1032 | 0.24 | 2 | 2 | 0 | Y | HNHIPGYKV | 96.15 | HNRIPGYKV | 3.85 |
| NS1 | 1033 | 0.24 | 2 | 2 | 0 | Y | NHIPGYKVQ | 96.15 | NRIPGYKVQ | 3.85 |
| NS1 | 1034 | 0.24 | 2 | 2 | 0 | Y | HIPGYKVQT | 96.15 | RIPGYKVQT | 3.85 |
| NS1 | 1035 | 0 | 1 | 1 | 0 | Y | IPGYKVQTN | 100 | | |
| NS1 | 1036 | 0 | 1 | 1 | 0 | Y | PGYKVQTNG | 100 | | |
| NS1 | 1037 | 0 | 1 | 1 | 0 | Y | GYKVQTNGP | 100 | | |
| NS1 | 1038 | 0 | 1 | 1 | 0 | Y | YKVQTNGPW | 100 | | |
| NS1 | 1039 | 0 | 1 | 1 | 0 | Y | KVQTNGPWM | 100 | | |
| NS1 | 1040 | 0 | 1 | 1 | 0 | Y | VQTNGPWMQ | 100 | | |
| NS1 | 1041 | 0 | 1 | 1 | 0 | Y | QTNGPWMQV | 100 | | |

Fig. 28-42

Species: YFV (9-mers)

| protein | block starting position | entropy | total peptides in block | #

Fig. 28-43

Species: YFV (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS1 | 1067 | 0.7 | 4 | 4 | 0 | Y | GNCDGRGKS | 88.46 | TGCDGRGKS | 3.85 | SNCDGRGKS | 3.85 | TSCDGRGKS | 3.85 | | |
| NS1 | 1068 | 0.7 | 4 | 4 | 0 | Y | NCDGRGKST | 88.46 | SCDGRGKST | 3.85 | NCDGRGKSA | 3.85 | GCDGRGKST | 3.85 | | |
| NS1 | 1069 | 0.24 | 2 | 2 | 0 | Y | CDGRGKSTR | 96.15 | CDGRGKSAR | 3.85 | | | | | | |
| NS1 | 1070 | 0.24 | 2 | 2 | 0 | Y | DGRGKSTRS | 96.15 | DGRGKSARS | 3.85 | | | | | | |
| NS1 | 1071 | 0.24 | 2 | 2 | 0 | Y | GRGKSTRST | 96.15 | GRGKSARST | 3.85 | | | | | | |
| NS1 | 1072 | 0.24 | 2 | 2 | 0 | Y | RGKSTRSTT | 96.15 | RGKSARSTT | 3.85 | | | | | | |
| NS1 | 1073 | 0.24 | 2 | 2 | 0 | Y | GKSTRSTTD | 96.15 | GKSARSTTD | 3.85 | | | | | | |
| NS1 | 1074 | 0.24 | 2 | 2 | 0 | Y | KSTRSTTDS | 96.15 | KSARSTTD | 3.85 | | | | | | |
| NS1 | 1075 | 0.24 | 2 | 2 | 0 | Y | STRSTTDSG | 96.15 | SARSTTDSG | 3.85 | | | | | | |
| NS1 | 1076 | 0.24 | 2 | 2 | 0 | Y | TRSTTDSGK | 96.15 | ARSTTDSGK | 3.85 | | | | | | |
| NS1 | 1077 | 0.96 | 2 | 2 | 0 | Y | RSTTDSGKV | 61.54 | RSTTDSGKI | 38.46 | | | | | | |
| NS1 | 1078 | 0.96 | 2 | 2 | 0 | Y | STTDSGKVI | 61.54 | STTDSGKII | 38.46 | | | | | | |
| NS1 | 1079 | 0.96 | 2 | 2 | 0 | Y | TTDSGKVIP | 61.54 | TTDSGKIIP | 38.46 | | | | | | |
| NS1 | 1080 | 0.96 | 2 | 2 | 0 | Y | TDSGKVIPE | 61.54 | TDSGKIIPE | 38.46 | | | | | | |
| NS1 | 1081 | 0.96 | 2 | 2 | 0 | Y | DSGKVIPEW | 61.54 | DSGKIIPEW | 38.46 | | | | | | |
| NS1 | 1082 | 0.96 | 2 | 2 | 0 | Y | SGKVIPEWC | 61.54 | SGKIIPEWC | 38.46 | | | | | | |
| NS1 | 1083 | 0.96 | 2 | 2 | 0 | Y | GKVIPEWCC | 61.54 | GKIIPEWCC | 38.46 | | | | | | |
| NS1 | 1084 | 0.96 | 2 | 2 | 0 | Y | KVIPEWCCR | 61.54 | KIIPEWCCR | 38.46 | | | | | | |
| NS1 | 1085 | 0.96 | 2 | 2 | 0 | Y | VIPEWCCRS | 61.54 | IIPEWCCRS | 38.46 | | | | | | |
| NS1 | 1086 | 0 | 1 | 1 | 0 | Y | IPEWCCRSC | 100 | | | | | | | | |
| NS1 | 1087 | 0 | 1 | 1 | 0 | Y | PEWCCRSCT | 100 | | | | | | | | |
| NS1 | 1088 | 0 | 1 | 1 | 0 | Y | EWCCRSCTM | 100 | | | | | | | | |
| NS1 | 1089 | 0 | 1 | 1 | 0 | Y | WCCRSCTMP | 100 | | | | | | | | |
| NS1 | 1090 | 0 | 1 | 1 | 0 | Y | CCRSCTMPP | 100 | | | | | | | | |
| NS1 | 1091 | 0 | 1 | 1 | 0 | Y | CRSCTMPPV | 100 | | | | | | | | |

Fig. 28-44

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | pe

Fig. 28-45

Species: YFV (9-mers)

| protein | block starting position | ent

Fig. 28-46

Species: YFV (9-mers)

| prot

Fig. 28-47

Species: YFV (9-mers)

| protein | block

Fig. 28-48

Species: YFV (9-mers)

| protein | block starting position | block entropy | total peptides in block | # peptides required to cover 99% of block | gap/X fraction | 99% of block covered w/ <= 5 peptides? | peptides required to cover 99%

Fig. 28-49

Species: YFV (9-mers)

| protein | block starting position | entropy block | total peptides in block | # peptides required to cover 99% of block | gap/X fraction | 99% of block covered w/ <= 5 peptides? | peptides required to cover 99% of block | fr

Fig. 28-50

Species: YFV (9

Fig. 28-51

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1275 | 0.7 | 4 | 4 | 0 | Y | SNTILPLMA | 88.46 | SNAVLPLMA | 3.85 | SNAILPLMA | 3.85 | SNMILPLMA | 3.85 |
| NS2A | 1276 | 0.7 | 4 | 4 | 0 | Y | NTILPLMAL | 88.46 | NAVLPLMAL | 3.85 | NMILPLMAL | 3.85 | NAILPLMAL | 3.85 |
| NS2A | 1277 | 0.7 | 4 | 4 | 0 | Y | TILPLMALL | 88.46 | AILPLMALL | 3.85 | AVLPLMALT | 3.85 | MILPLMALM | 3.85 |
| NS2A | 1278 | 0.47 | 3 | 3 | 0 | Y | ILPLMALLT | 92.31 | VLPLMALLT | 3.85 | ILPLMALMT | 3.85 | | |
| NS2A | 1279 | 0.24 | 2 | 2 | 0 | Y | LPLMALLTP | 96.15 | | | LPLMALMTP | 3.85 | | |
| NS2A | 1280 | 0.24 | 2 | 2 | 0 | Y | PLMALLTPV | 96.15 | | | PLMALMTPM | 3.85 | | |
| NS2A | 1281 | 0.24 | 2 | 2 | 0 | Y | LMALLTPVT | 96.15 | | | LMALMTPMT | 3.85 | | |
| NS2A | 1282 | 0.24 | 2 | 2 | 0 | Y | MALLTPVTM | 96.15 | | | MALMTPMTM | 3.85 | | |
| NS2A | 1283 | 0.7 | 4 | 4 | 0 | Y | ALLTPVTMA | 88.46 | ALMTPMTMH | 3.85 | ALMTPMTMH | 3.85 | ALLTPVTMH | 3.85 |
| NS2A | 1284 | 0.7 | 4 | 4 | 0 | Y | LLTPVTMAE | 88.46 | LMTPMTMHE | 3.85 | LMTPMTMHE | 3.85 | LLTPVTMHE | 3.85 |
| NS2A | 1285 | 0.7 | 4 | 4 | 0 | Y | LTPVTMAEV | 88.46 | MTPMTMHEV | 3.85 | LTPVTMHEV | 3.85 | LTPVTMYEV | 3.85 |
| NS2A | 1286 | 0.7 | 4 | 4 | 0 | Y | TPVTMAEVR | 88.46 | TPMTMHEVR | 3.85 | TPMTMHEVR | 3.85 | TPVTMHEVR | 3.85 |
| NS2A | 1287 | 0.7 | 4 | 4 | 0 | Y | PVTMAEVRL | 88.46 | PVTMHEVRM | 3.85 | PVTMHEVRM | 3.85 | PMTMHEVRM | 3.85 |
| NS2A | 1288 | 0.7 | 4 | 4 | 0 | Y | VTMAEVRLA | 88.46 | VTMYEVRLA | 3.85 | VTMHEVRMA | 3.85 | MTMHEVRMA | 3.85 |
| NS2A | 1289 | 1.35 | 5 | 5 | 0 | Y | TMAEVRLAA | 65.38 | TMAEVRLAT | 23.08 | TMHEVRMAT | 7.69 | TMYEVRMAT | 3.85 |
| NS2A | 1290 | 1.35 | 5 | 5 | 0 | Y | MAEVRLAAM | 65.38 | MAEVRLATM | 23.08 | MHEVRMATM | 7.69 | MYEVRMATM | 3.85 |
| NS2A | 1291 | 1.93 | 5 | 5 | 0 | Y | AEVRLAAMF | 46.15 | AEVRLATML | 23.08 | AEVRLAAML | 19.23 | HEVRMATML | 7.69 |
| NS2A | 1292 | 1.97 | 5 | 5 | 0 | Y | EVRLAAMFF | 46.15 | EVRLATMLF | 19.23 | EVRLAAMLF | 19.23 | EVRMATMLF | 11.54 |
| NS2A | 1293 | 1.97 | 5 | 5 | 0 | Y | VRLAAMFFC | 46.15 | VRLATMLFC | 19.23 | VRLAAMLFC | 19.23 | VRMATMLFC | 11.54 |
| NS2A | 1296 | 1.82 | 5 | 5 | 0 | Y | AAMFFCAVV | 46.15 | ATMLFCTVV | 30.77 | AAMLFCAVV | 15.38 | AAMLFCTVV | 3.85 |
| NS2A | 1297 | 1.82 | 5 | 5 | 0 | Y | AMFFCAVVI | 46.15 | TMLFCTVVI | 30.77 | AMLFCAVVI | 15.38 | AMLFCTVVI | 3.85 |
| NS2A | 1298 | 1.91 | 5 | 5 | 0 | Y | MFFCAVVII | 46.15 | MLFCTVVII | 26.92 | MLFCAVVII | 15.38 | MLFCTVVII | 3.85 |
| NS2A | 1299 | 1.91 | 5 | 5 | 0 | Y | FFCAVVIIG | 46.15 | LFCTVVIIG | 26.92 | LFCAVVIIG | 15.38 | LFCTVVIIG | 7.69 |
| NS2A | 1300 | 1.41 | 4 | 4 | 0 | Y | FCAVVIIGV | 61.54 | FCTVVIIGV | 26.92 | FCTVVIIGV | 7.69 | LCAVVIIGV | 3.85 |
| NS2A | 1301 | 1.2 | 3 | 3 | 0 | Y | CAVVIIGVL | 65.38 | CTVVIIGVL | 26.92 | CTVVIIGVL | 7.69 | | |

Fig. 28-52

Species: YFV (9-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1302 | 1.35 | 4 | 4 | 0 | Y | AWIIGVLH | 65.38 | TWIIGVLH | 23.08 | TWIIGVLH | 7.69 | | |
| NS2A | 1303 | 0.62 | 3 | 3 | 0 | Y | WIIGVLHQ | 88.46 | WIIGVLHQ | 7.69 | WIIGVLY | 3.85 | | |
| NS2A | 1304 | 0.62 | 3 | 3 | 0 | Y | IIGVLHQN | 88.46 | IIGVLHQN | 7.69 | | | | |
| NS2A | 1305 | 1.48 | 5 | 5 | 0 | Y | IGVLHQNF | 61.54 | IGVLHQNS | 26.92 | IVGVLHQNA | 3.85 | IIGVLYQNS | 3.85 |
| NS2A | 1306 | 1.48 | 5 | 5 | 0 | Y | IGVLHQNFK | 61.54 | IGVLHQNSK | 26.92 | VGVLHQNSK | 3.85 | VGVLHQNAK | 3.85 |
| NS2A | 1307 | 1.32 | 4 | 4 | 0 | Y | GVLHQNFKD | 61.54 | GVLHQNSKD | 30.77 | GVLHQNAKD | 3.85 | | |
| NS2A | 1308 | 1.32 | 4 | 4 | 0 | Y | VLHQNFKDT | 61.54 | VLYQNSKDT | 30.77 | VLHQNAKDT | 3.85 | | |
| NS2A | 1309 | 1.32 | 4 | 4 | 0 | Y | LHQNFKDTS | 61.54 | LHQNSKDTS | 30.77 | LHQNAKDTS | 3.85 | | |
| NS2A | 1310 | 1.14 | 3 | 3 | 0 | Y | HQNFKDTSM | 61.54 | HQNSKDTSM | 30.77 | YQNSKDTSM | 3.85 | | |
| NS2A | 1311 | 1.14 | 3 | 3 | 0 | Y | QNFKDTSMQ | 61.54 | QNSKDTSMQ | 34.62 | | | | |
| NS2A | 1312 | 1.14 | 3 | 3 | 0 | Y | NFKDTSMQK | 61.54 | NSKDTSMQK | 34.62 | | | | |
| NS2A | 1313 | 1.14 | 3 | 3 | 0 | Y | FKDTSMQKT | 61.54 | SKDTSMQKT | 34.62 | | | | |
| NS2A | 1314 | 0 | 1 | 1 | 0 | Y | KDTSMQKTI | 100 | | | | | | |
| NS2A | 1315 | 0 | 1 | 1 | 0 | Y | DTSMQKTIP | 100 | | | | | | |
| NS2A | 1316 | 0.52 | 2 | 2 | 0 | Y | TSMQKTIPL | 88.46 | TSMQKTIPI | 11.54 | | | | |
| NS2A | 1317 | 0.52 | 2 | 2 | 0 | Y | SMQKTIPLV | 88.46 | SMQKTIPIV | 11.54 | | | | |
| NS2A | 1318 | 0.52 | 2 | 2 | 0 | Y | MQKTIPLVA | 88.46 | MQKTIPIVA | 11.54 | | | | |
| NS2A | 1319 | 0.52 | 2 | 2 | 0 | Y | QKTIPLVAL | 88.46 | QKTIPIVAL | 11.54 | | | | |
| NS2A | 1320 | 0.52 | 2 | 2 | 0 | Y | KTIPLVALT | 88.46 | KTIPIVALT | 11.54 | | | | |
| NS2A | 1321 | 0.52 | 2 | 2 | 0 | Y | TIPLVALTL | 88.46 | TIPIVALTL | 11.54 | | | | |
| NS2A | 1322 | 0.52 | 2 | 2 | 0 | Y | IPLVALTLT | 88.46 | IPIVALTLT | 11.54 | | | | |
| NS2A | 1323 | 0.52 | 2 | 2 | 0 | Y | PLVALTLTS | 88.46 | PIVALTLTS | 11.54 | | | | |
| NS2A | 1324 | 0.52 | 2 | 2 | 0 | Y | LVALTLTSY | 88.46 | IVALTLTSY | 11.54 | | | | |
| NS2A | 1325 | 0.52 | 2 | 2 | 0 | Y | VALTLTSYL | 88.46 | VALTLTSYM | 11.54 | | | | |
| NS2A | 1326 | 0.52 | 2 | 2 | 0 | Y | ALTLTSYLG | 88.46 | ALTLTSYMG | 11.54 | | | | |

Fig. 28-53

Species: YFV (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1327 | 0.52 | 2 | 2 | 0 | Y | LTLTSYLGL | 88.46 | LTLTSYMGL | 11.54 | | | | |
| NS2A | 1328 | 0.52 | 2 | 2 | 0 | Y | TLTSYLGLT | 88.46 | TLTSYMGLT | 11.54 | | | | |
| NS2A | 1329 | 0.52 | 2 | 2 | 0 | Y | LTSYLGLTQ | 88.46 | LTSYMGLTQ | 11.54 | | | | |
| NS2A | 1330 | 0.52 | 2 | 2 | 0 | Y | TSYLGLTQP | 88.46 | TSYMGLTQP | 11.54 | | | | |
| NS2A | 1331 | 0.52 | 2 | 2 | 0 | Y | SYLGLTQPF | 88.46 | SYMGLTQPF | 11.54 | | | | |
| NS2A | 1332 | 0.52 | 2 | 2 | 0 | Y | YLGLTQPFL | 88.46 | YMGLTQPFL | 11.54 | | | | |
| NS2A | 1333 | 0.52 | 2 | 2 | 0 | Y | LGLTQPFLG | 88.46 | MGLTQPFLG | 11.54 | | | | |
| NS2A | 1334 | 0 | 1 | 1 | 0 | Y | GLTQPFLGL | 100 | | | | | | |
| NS2A | 1335 | 0 | 1 | 1 | 0 | Y | LTQPFLGLC | 100 | | | | | | |
| NS2A | 1336 | 0 | 1 | 1 | 0 | Y | TQPFLGLCA | 100 | | | | | | |
| NS2A | 1337 | 0.52 | 2 | 2 | 0 | Y | QPFLGLCAF | 88.46 | QPFLGLCAY | 11.54 | | | | |
| NS2A | 1338 | 0.52 | 2 | 2 | 0 | Y | PFLGLCAFL | 88.46 | PFLGLCAYM | 11.54 | | | | |
| NS2A | 1339 | 0.52 | 2 | 2 | 0 | Y | FLGLCAFLA | 88.46 | FLGLCAYMS | 11.54 | | | | |
| NS2A | 1340 | 0.52 | 2 | 2 | 0 | Y | LGLCAFLAT | 88.46 | LGLCAYMST | 11.54 | | | | |
| NS2A | 1341 | 0.52 | 2 | 2 | 0 | Y | GLCAFLATR | 88.46 | GLCAYMSTQ | 11.54 | | | | |
| NS2A | 1342 | 0.89 | 3 | 3 | 0 | Y | LCAFLATRI | 80.77 | LCAYMSTQV | 11.54 | LCAFLATRL | 7.69 | | |
| NS2A | 1343 | 0.89 | 3 | 3 | 0 | Y | CAFLATRIF | 80.77 | CAYMSTQVF | 11.54 | CAFLATRLF | 7.69 | | |
| NS2A | 1344 | 0.89 | 3 | 3 | 0 | Y | AFLATRIFG | 80.77 | AYMSTQVFG | 11.54 | AFLATRLFG | 7.69 | | |
| NS2A | 1345 | 0.89 | 3 | 3 | 0 | Y | FLATRIFGR | 80.77 | YMSTQVFGR | 11.54 | FLATRLFGR | 7.69 | | |
| NS2A | 1346 | 0.89 | 3 | 3 | 0 | Y | LATRIFGRR | 80.77 | MSTQVFGRR | 11.54 | LATRLFGRR | 7.69 | | |
| NS2A | 1347 | 0.89 | 3 | 3 | 0 | Y | ATRIFGRRS | 80.77 | STQVFGRRS | 11.54 | ATRLFGRRS | 7.69 | | |
| NS2A | 1348 | 0.89 | 3 | 3 | 0 | Y | TRIFGRRSI | 80.77 | TQVFGRRSI | 11.54 | TRLFGRRSI | 7.69 | | |
| NS2A | 1349 | 0.89 | 3 | 3 | 0 | Y | RIFGRRSIP | 80.77 | QVFGRRSIP | 11.54 | RLFGRRSIP | 7.69 | | |
| NS2A | 1350 | 0.89 | 3 | 3 | 0 | Y | IFGRRSIPV | 80.77 | VFGRRSIPV | 11.54 | LFGRRSIPV | 7.69 | | |
| NS2A | 1351 | 0 | 1 | 1 | 0 | Y | FGRRSIPVN | 100 | | | | | | |

Fig. 28-54

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

Fig. 28-55

Species: YFV (9-mers)

| protein | block starting position | block

Fig. 28-56

Species: YFV (9-mers)

| protein | block starting position | entropy block | total pe

Fig. 28-57

Species: YFV (9-mers)

| protein | block star

Fig. 28-58

Species: YFV (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS2B | 1452 | 0 | 1 | 1 | 0 | Y | VMTSLALVG | 100 | | | | | | | | |
| NS2B | 1453 | 0 | 1 | 1 | 0 | Y | MTSLALVGA | 100 | | | | | | | | |
| NS2B | 1454 | 0 | 1 | 1 | 0 | Y | TSLALVGAA | 100 | | | | | | | | |
| NS2B | 1455 | 0.96 | 2 | 2 | 0 | Y | SLALVGAAL | 61.54 | SLALVGAAI | 38.46 | | | | | | |
| NS2B | 1456 | 0.96 | 2 | 2 | 0 | Y | LALVGAALH | 61.54 | LALVGAAIH | 38.46 | | | | | | |
| NS2B | 1457 | 0.96 | 2 | 2 | 0 | Y | ALVGAALHP | 61.54 | ALVGAAIHP | 38.46 | | | | | | |
| NS2B | 1458 | 1.14 | 3 | 3 | 0 | Y | LVGAALHPF | 61.54 | LVGAAIHPF | 34.62 | LVGAAIHPS | 3.85 | | | | |
| NS2B | 1459 | 1.14 | 3 | 3 | 0 | Y | VGAALHPFA | 61.54 | VGAAIHPFA | 34.62 | VGAAIHPSA | 3.85 | | | | |
| NS2B | 1460 | 1.14 | 3 | 3 | 0 | Y | GAALHPFAL | 61.54 | GAAIHPFAL | 34.62 | GAAIHPSAL | 3.85 | | | | |
| NS2B | 1461 | 1.14 | 3 | 3 | 0 | Y | AALHPFALL | 61.54 | AAIHPFALL | 34.62 | AAIHPSALL | 3.85 | | | | |
| NS2B | 1462 | 1.14 | 3 | 3 | 0 | Y | ALHPFALLL | 61.54 | AIHPFALLL | 34.62 | AIHPSALLL | 3.85 | | | | |
| NS2B | 1463 | 1.14 | 3 | 3 | 0 | Y | LHPFALLLV | 61.54 | IHPFALLLV | 34.62 | IHPSALLLV | 3.85 | | | | |
| NS2B | 1464 | 0.24 | 2 | 2 | 0 | Y | HPFALLLVL | 96.15 | HPSALLLVL | 3.85 | | | | | | |
| NS2B | 1465 | 0.74 | 3 | 3 | 0 | Y | PFALLLVLA | 84.62 | PFALLLVLG | 11.54 | PSALLLVLA | 3.85 | | | | |
| NS2B | 1466 | 0.74 | 3 | 3 | 0 | Y | FALLLVLAG | 84.62 | FALLLVLGG | 11.54 | SALLLVLAG | 3.85 | | | | |
| NS2B | 1467 | 0.52 | 3 | 3 | 0 | Y | ALLLVLAGW | 88.46 | ALLLVLGGW | 7.69 | LLLVLGGWI | 3.85 | | | | |
| NS2B | 1468 | 0.62 | 3 | 3 | 0 | Y | LLLVLAGWL | 88.46 | LLLVLGGWL | 7.69 | LLVLGGWIL | 3.85 | | | | |
| NS2B | 1469 | 0.62 | 3 | 3 | 0 | Y | LLVLAGWLF | 88.46 | LLVLGGWVL | 7.69 | LVLGGWILH | 3.85 | | | | |
| NS2B | 1470 | 0.62 | 3 | 3 | 0 | Y | LVLAGWLFH | 88.46 | LVLGGWVLH | 7.69 | VLGGWILHI | 3.85 | | | | |
| NS2B | 1471 | 0.62 | 3 | 3 | 0 | Y | VLAGWLFHV | 88.46 | VLGGWVLHI | 7.69 | LGGWILHIK | 3.85 | | | | |
| NS2B | 1472 | 1.12 | 4 | 4 | 0 | Y | LAGWLFHVK | 76.92 | LAGWLFHYK | 11.54 | LGGWVLHIK | 7.69 | LGGWILHIK | 3.85 | | |
| NS2B | 1473 | 1.48 | 5 | 5 | 0 | Y | AGWLFHVRG | 69.23 | AGWLFHVKG | 11.54 | AGWLFHYRA | 7.69 | GGWVLHIKG | 7.69 | GGWILHIKG | 3.85 |
| NS2B | 1474 | 1.48 | 5 | 5 | 0 | Y | GWLFHVRGA | 69.23 | GWLFHVKGA | 11.54 | GWLFHYRRA | 7.69 | GWVLHIKGA | 7.69 | GWILHIKGA | 3.85 |
| NS2B | 1475 | 1.48 | 5 | 5 | 0 | Y | WLFHVRGAR | 69.23 | WLFHVKGAR | 11.54 | WLFHYRRAR | 7.69 | WLFHVRRAR | 7.69 | WILHIKGAR | 3.85 |
| NS2B | 1476 | 1.48 | 5 | 5 | 0 | Y | LFHVRGARR | 69.23 | LFHVKGARR | 11.54 | LFHYRRARR | 7.69 | LFHVRRARR | 7.69 | ILHIKGARR | 3.85 |

Fig. 28-59

Species: YFV (9-mers)

| protein | block starting position | block entropy | total

Species: YFV (9-mers)

| protein | block starting position | block entropy | total peptides in block | # peptides required to cover 99% of block | gap/X fraction | 99% of block covered w/ <= 5 peptides? | block peptides required to c

Fig. 28-62

Species: YFV (9-mers)

| protein | block starting position | entropy block | total pe

Fig. 28-63

Species: YFV (9-mers)

| protein | block starting position | entropy block | total peptides in block | # peptides required to cover 99% of block | gap/X fraction | 99% of block covered w/ <= 5 peptides? | block to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1577 | 0 | 1 | 1 | 0 | Y | GEEVQLIA | 100 | | | | | | |
| NS3 | 1578 | 0 | 1 | 1 | 0 | Y | EEEVQLIAA | 100 | | | | | | |
| NS3 | 1579 | 0.24 | 2 | 2 | 0 | Y | EEVQLIAAV | 96.15 | EEVQLIAAA | 3.85 | | | | |
| NS3 | 1580 | 0.24 | 2 | 2 | 0 | Y | EVQLIAAVP | 96.15 | EVQLIAAAP | 3.85 | | | | |
| NS3 | 1581 | 0.24 | 2 | 2 | 0 | Y | VQLIAAVPG | 96.15 | VQLIAAAPG | 3.85 | | | | |
| NS3 | 1582 | 0.24 | 2 | 2 | 0 | Y | QLIAAVPGK | 96.15 | QLIAAAPGK | 3.85 | | | | |
| NS3 | 1583 | 0.85 | 4 | 4 | 0 | Y | LIAAVPGKN | 84.62 | LIAAAPGKN | 7.69 | LIAAAPGKS | 3.85 | | |
| NS3 | 1584 | 0.85 | 4 | 4 | 0 | Y | IAAVPGKNV | 84.62 | IAAAPGKNV | 7.69 | IAAVPGKSV | 3.85 | | |
| NS3 | 1585 | 0.85 | 4 | 4 | 0 | Y | AAVPGKNVV | 84.62 | AAVPGKAVV | 7.69 | AAAPGKNVV | 3.85 | | |
| NS3 | 1586 | 0.85 | 4 | 4 | 0 | Y | AVPGKNVVN | 84.62 | AVPGKAVVN | 7.69 | AAPGKNVVN | 3.85 | | |
| NS3 | 1587 | 0.85 | 4 | 4 | 0 | Y | VPGKNVVNV | 84.62 | VPGKAVVNV | 7.69 | VPGKSVVNV | 3.85 | APGKNVVNV | 3.85 |
| NS3 | 1588 | 0.62 | 3 | 3 | 0 | Y | PGKNVVNVQ | 88.46 | PGKAVVNVQ | 7.69 | PGKSVVNVQ | 3.85 | | |
| NS3 | 1589 | 0.62 | 3 | 3 | 0 | Y | GKNVVNVQT | 88.46 | GKAVVNVQT | 7.69 | GKSVVNVQT | 3.85 | | |
| NS3 | 1590 | 0.62 | 3 | 3 | 0 | Y | KNVVNVQTK | 88.46 | KAVVNVQTK | 7.69 | KSVVNVQTK | 3.85 | | |
| NS3 | 1591 | 0.62 | 3 | 3 | 0 | Y | NVVNVQTKP | 88.46 | AVVNVQTKP | 7.69 | SVVNVQTKP | 3.85 | | |
| NS3 | 1592 | 0 | 1 | 1 | 0 | Y | VVNVQTKPS | 100 | | | | | | |
| NS3 | 1593 | 0.24 | 2 | 2 | 0 | Y | VNVQTKPSL | 96.15 | VNVQTKPSY | 3.85 | | | | |
| NS3 | 1594 | 0.24 | 2 | 2 | 0 | Y | NVQTKPSLF | 96.15 | NVQTKPSVF | 3.85 | | | | |
| NS3 | 1595 | 0.47 | 3 | 3 | 0 | Y | VQTKPSLFK | 92.31 | VQTKPSLFR | 3.85 | VQTKPSVF | 3.85 | | |
| NS3 | 1596 | 0.47 | 3 | 3 | 0 | Y | QTKPSLFKV | 92.31 | QTKPSLFRV | 3.85 | QTKPSVFKV | 3.85 | | |
| NS3 | 1597 | 0.47 | 3 | 3 | 0 | Y | TKPSLFKVR | 92.31 | TKPSLFRVK | 3.85 | TKPSVFKVR | 3.85 | | |
| NS3 | 1598 | 0.47 | 3 | 3 | 0 | Y | KPSLFKVRN | 92.31 | KPSLFRVKN | 3.85 | KPSVFKVRN | 3.85 | | |
| NS3 | 1599 | 0.47 | 3 | 3 | 0 | Y | PSLFKVRNG | 92.31 | PSLFRVKNG | 3.85 | PSVFKVRNG | 3.85 | | |
| NS3 | 1600 | 0.47 | 3 | 3 | 0 | Y | SLFKVRNGG | 92.31 | SLFRVKNGG | 3.85 | SVFKVRNGG | 3.85 | | |
| NS3 | 1601 | 0.47 | 3 | 3 | 0 | Y | LFKVRNGGE | 92.31 | LFRVKNGGE | 3.85 | VFKVRNGGE | 3.85 | | |

Fig. 28-64

Species: YFV (9-mers)

| protein | block starting position | block

Fig. 28-65

Species: YFV (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1627 | 0.62 | 3 | 3 | 0 | Y | VNRNGEVIG | 88.46 | VNRSGEVWG | 7.69 | VNRNGEVWG | 3.85 | | |
| NS3 | 1628 | 0.62 | 3 | 3 | 0 | Y | NRNGEVIGL | 88.46 | NRSGEVWGL | 7.69 | NRNGEVWGL | 3.85 | | |
| NS3 | 1629 | 0.62 | 3 | 3 | 0 | Y | RNGEVIGLY | 88.46 | RSGEVWGLY | 7.69 | RNGEVWGLY | 3.85 | | |
| NS3 | 1630 | 0.62 | 3 | 3 | 0 | Y | NGEVIGLYG | 88.46 | SGEVWGLYG | 7.69 | NGEVWGLYG | 3.85 | | |
| NS3 | 1631 | 0.52 | 2 | 2 | 0 | Y | GEVIGLYGN | 88.46 | GEVWGLYGN | 11.54 | | | | |
| NS3 | 1632 | 0.52 | 2 | 2 | 0 | Y | EVIGLYGNG | 88.46 | EVWGLYGNG | 11.54 | | | | |
| NS3 | 1633 | 0.52 | 2 | 2 | 0 | Y | VIGLYGNGI | 88.46 | VWGLYGNGI | 11.54 | | | | |
| NS3 | 1634 | 0.52 | 2 | 2 | 0 | Y | IGLYGNGIL | 88.46 | VGLYGNGIL | 11.54 | | | | |
| NS3 | 1635 | 0 | 1 | 1 | 0 | Y | GLYGNGILY | 100 | | | | | | |
| NS3 | 1636 | 0 | 1 | 1 | 0 | Y | LYGNGILVG | 100 | | | | | | |
| NS3 | 1637 | 0 | 1 | 1 | 0 | Y | YGNGILVGD | 100 | | | | | | |
| NS3 | 1638 | 0 | 1 | 1 | 0 | Y | GNGILVGDN | 100 | | | | | | |
| NS3 | 1639 | 0 | 1 | 1 | 0 | Y | NGILVGDNS | 100 | | | | | | |
| NS3 | 1640 | 0 | 1 | 1 | 0 | Y | GILVGDNSF | 100 | | | | | | |
| NS3 | 1641 | 0 | 1 | 1 | 0 | Y | ILVGDNSFV | 100 | | | | | | |
| NS3 | 1642 | 0 | 1 | 1 | 0 | Y | LVGDNSFVS | 100 | | | | | | |
| NS3 | 1643 | 0 | 1 | 1 | 0 | Y | VGDNSFVSA | 100 | | | | | | |
| NS3 | 1644 | 0 | 1 | 1 | 0 | Y | GDNSFVSAI | 100 | | | | | | |
| NS3 | 1645 | 0 | 1 | 1 | 0 | Y | DNSFVSAIS | 100 | | | | | | |
| NS3 | 1646 | 0 | 1 | 1 | 0 | Y | NSFVSAISQ | 100 | | | | | | |
| NS3 | 1647 | 0 | 1 | 1 | 0 | Y | SFVSAISQT | 100 | | | | | | |
| NS3 | 1648 | 0 | 1 | 1 | 0 | Y | FVSAISQTE | 100 | | | | | | |
| NS3 | 1649 | 0.24 | 2 | 2 | 0 | Y | VSAISQTEV | 96.15 | VSAISQTEL | 3.85 | | | | |
| NS3 | 1650 | 0.24 | 2 | 2 | 0 | Y | SAISQTEVK | 96.15 | SAISQTELK | 3.85 | | | | |
| NS3 | 1651 | 0.24 | 2 | 2 | 0 | Y | AISQTEVKE | 96.15 | AISQTELKE | 3.85 | | | | |

Fig. 28-66

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1652 | 0.24 | 2 | 2 | 0 | Y | ISQTEWKEE | 96.15 | ISQTELKEE | 3.85 | | | | |
| NS3 | 1653 | 0.62 | 3 | 3 | 0 | Y | SQTEWKEEG | 88.46 | SQTEWKEES | 7.69 | SQTELKEES | 3.85 | | |
| NS3 | 1654 | 0.62 | 3 | 3 | 0 | Y | QTEWKEEGK | 88.46 | QTEWKEESK | 7.69 | QTELKEESK | 3.85 | | |
| NS3 | 1655 | 0.62 | 3 | 3 | 0 | Y | TEWKEEGKE | 88.46 | TEVKEESKE | 7.69 | TELKEESKE | 3.85 | | |
| NS3 | 1656 | 0.62 | 3 | 3 | 0 | Y | EVKEEGKEE | 88.46 | EVKEESKEE | 7.69 | ELKEESKEE | 3.85 | | |
| NS3 | 1657 | 0.62 | 3 | 3 | 0 | Y | VKEEGKEEL | 88.46 | VKEESKEEL | 7.69 | LKEESKEEL | 3.85 | | |
| NS3 | 1658 | 1.01 | 3 | 3 | 0 | Y | KEEGKEELQ | 76.92 | KEESKEELQ | 11.54 | KEEGKEELR | 11.54 | | |
| NS3 | 1659 | 1.01 | 3 | 3 | 0 | Y | EEGKEELQE | 76.92 | EELREIRE | 11.54 | EESKEELQE | 11.54 | | |
| NS3 | 1660 | 1.01 | 3 | 3 | 0 | Y | EGKEELQEI | 76.92 | EGKEELREI | 11.54 | ESKEELQEI | 11.54 | | |
| NS3 | 1661 | 1.23 | 4 | 4 | 0 | Y | GKEELQEIP | 73.08 | GKEELREIP | 11.54 | SKEELQEIP | 3.85 | GKEELQEIS | 3.85 |
| NS3 | 1662 | 0.74 | 3 | 3 | 0 | Y | KEELQEIPT | 84.62 | KEELREIPT | 11.54 | KEELQEIST | 3.85 | | |
| NS3 | 1663 | 0.74 | 3 | 3 | 0 | Y | EELQEIPTM | 84.62 | EELREIPTM | 11.54 | EELQEISTM | 3.85 | | |
| NS3 | 1664 | 0.74 | 3 | 3 | 0 | Y | ELQEIPTML | 84.62 | ELREIPTML | 11.54 | ELQEISTML | 3.85 | | |
| NS3 | 1665 | 0.74 | 3 | 3 | 0 | Y | LQEIPTMLK | 84.62 | LREIPTMLK | 11.54 | LQEISTMLK | 3.85 | | |
| NS3 | 1666 | 0.74 | 3 | 3 | 0 | Y | QEIPTMLKK | 84.62 | REIPTMLKK | 11.54 | QEISTMLKK | 3.85 | | |
| NS3 | 1667 | 0.24 | 2 | 2 | 0 | Y | EIPTMLKKG | 96.15 | EISTMLKKG | 3.85 | | | | |
| NS3 | 1668 | 0.62 | 3 | 3 | 0 | Y | IPTMLKKGM | 88.46 | IPTMLKKGK | 7.69 | ISTMLKKGM | 3.85 | | |
| NS3 | 1669 | 0.62 | 3 | 3 | 0 | Y | PTMLKKGMT | 88.46 | PTMLKKGKT | 7.69 | STMLKKGMT | 3.85 | | |
| NS3 | 1670 | 0.39 | 2 | 2 | 0 | Y | TMLKKGMTT | 92.31 | TMLKKGKTT | 7.69 | | | | |
| NS3 | 1671 | 1.31 | 3 | 3 | 0 | Y | MLKKGMTTV | 46.15 | MLKKGMTTI | 46.15 | MLKKGMTTI | 7.69 | | |
| NS3 | 1672 | 1.31 | 3 | 3 | 0 | Y | LKKGMTTVL | 46.15 | LKKGMTTIL | 46.15 | LKKGMTTIL | 7.69 | | |
| NS3 | 1673 | 1.31 | 3 | 3 | 0 | Y | KKGMTTILD | 46.15 | KKGMTTVLD | 46.15 | KKGKTTILD | 7.69 | | |
| NS3 | 1674 | 1.51 | 4 | 4 | 0 | Y | KGMTTVLDF | 46.15 | KGMTTILDF | 42.31 | KGKTTILDF | 7.69 | KGMTTILDY | 3.85 |
| NS3 | 1675 | 1.51 | 4 | 4 | 0 | Y | GMTTVLDFH | 46.15 | GMTTILDFH | 42.31 | GKTTILDFH | 7.69 | GMTTILDYH | 3.85 |
| NS3 | 1676 | 1.51 | 4 | 4 | 0 | Y | MTTVLDFHP | 46.15 | MTTILDFHP | 42.31 | KTTILDFHP | 7.69 | MTTILDYHP | 3.85 |

Fig. 28-67

Species: YFV (9-mers)

| protein | block starting position | block entropy | total pe

Fig. 28-68

Species: YFV (9-mers)

| protein | block star

Fig. 28-69

Species: YFV (9-mers)

| protein | block starting position | block

Fig. 28-70

Species: YFV (9-mers)

| protein | block starting position | entropy block | total peptides in block | # peptides required to cover 99% of block | gap/X fraction | 99% of block covered w/ <= 5 pe

Fig. 28-71

Species: YFV (9-mers)

| prot

Fig. 28-73

Species: YFV (9-mers)

| protein | block starting position | block entropy | total pe

Fig. 28-74

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1852 | 0 | 1 | 1 | 0 | Y | PSIRAANVM | 100 | | |
| NS3 | 1853 | 0 | 1 | 1 | 0 | Y | SIRAANVMA | 100 | | |
| NS3 | 1854 | 0 | 1 | 1 | 0 | Y | IRAANVMAA | 100 | | |
| NS3 | 1855 | 0 | 1 | 1 | 0 | Y | RAANVMAAS | 100 | | |
| NS3 | 1856 | 0 | 1 | 1 | 0 | Y | AANVMAASL | 100 | | |
| NS3 | 1857 | 0 | 1 | 1 | 0 | Y | ANVMAASLR | 100 | | |
| NS3 | 1858 | 0 | 1 | 1 | 0 | Y | NVMAASLRK | 100 | | |
| NS3 | 1859 | 0 | 1 | 1 | 0 | Y | VMAASLRKA | 100 | | |
| NS3 | 1860 | 0 | 1 | 1 | 0 | Y | MAASLRKAG | 100 | | |
| NS3 | 1861 | 0.39 | 2 | 2 | 0 | Y | AASLRKAGK | 100 | | |
| NS3 | 1862 | 0.39 | 2 | 2 | 0 | Y | ASLRKAGKS | 92.31 | ASLRKAGKN | 7.69 |
| NS3 | 1863 | 0.39 | 2 | 2 | 0 | Y | SLRKAGKSV | 92.31 | SLRKAGKNV | 7.69 |
| NS3 | 1864 | 0.39 | 2 | 2 | 0 | Y | LRKAGKSVV | 92.31 | LRKAGKNVV | 7.69 |
| NS3 | 1865 | 0.39 | 2 | 2 | 0 | Y | RKAGKSVVV | 92.31 | RKAGKNVVV | 7.69 |
| NS3 | 1866 | 0.39 | 2 | 2 | 0 | Y | KAGKSVVVL | 92.31 | KAGKNVVVL | 7.69 |
| NS3 | 1867 | 0.39 | 2 | 2 | 0 | Y | AGKSVVVLN | 92.31 | AGKNVVVLN | 7.69 |
| NS3 | 1868 | 0.39 | 2 | 2 | 0 | Y | GKSVVVLNR | 92.31 | GKNVVVLNR | 7.69 |
| NS3 | 1869 | 0.39 | 2 | 2 | 0 | Y | KSVVVLNRK | 92.31 | KNVVVLNRK | 7.69 |
| NS3 | 1870 | 0.39 | 2 | 2 | 0 | Y | SVVVLNRKT | 92.31 | NVVVLNRKT | 7.69 |
| NS3 | 1871 | 0 | 1 | 1 | 0 | Y | VVVLNRKTF | 100 | | |
| NS3 | 1872 | 0 | 1 | 1 | 0 | Y | VVLNRKTFE | 100 | | |
| NS3 | 1873 | 0.62 | 2 | 2 | 0 | Y | VLNRKTFER | 84.62 | VLNRKTFEK | 15.38 |
| NS3 | 1874 | 0.62 | 2 | 2 | 0 | Y | LNRKTFERE | 84.62 | LNRKTFEKE | 15.38 |
| NS3 | 1875 | 0.62 | 2 | 2 | 0 | Y | NRKTFEREY | 84.62 | NRKTFEKEY | 15.38 |
| NS3 | 1876 | 0.62 | 2 | 2 | 0 | Y | RKTFEREYP | 84.62 | RKTFEKEYP | 15.38 |

Fig. 28-75

Species: YFV (9-mers)

| protein | block starting position | block entropy | total

Fig. 28-76

Species: YFV (9-mers)

| protein | block starting position | block entropy | total

Fig. 28-77

Species: YFV (9-mers)

| protein | block starting position | entropy block | total peptides in block | # peptides required to cover 99

Fig. 28-78

Species: YFV (9-mers)

| protein | block starting position | block entropy | total

Fig. 28-79

Species: YFV (9-mers)

| protein | block starting position | block

Fig. 28-80

Species: YFV (9-mers)

| protein | block starting position | block entropy | total pe

Fig. 28-81

Species: YFV (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2027 | 0.87 | 4 | 4 | 3.85 | Y | NCDLPWLS | 80.77 | GCDLPWLS | 7.69 | GCDLPWLA | 3.85 | NCDQPWLS | 3.85 |
| NS3 | 2028 | 0.48 | 3 | 3 | 3.85 | Y | CDLPWLSW | 88.46 | CDLPWLAW | 3.85 | CDQPWLSW | 3.85 | | |
| NS3 | 2029 | 0.48 | 3 | 3 | 3.85 | Y | DLPWLSWQ | 88.46 | DLPWLAWQ | 3.85 | DQPWLSWQ | 3.85 | | |
| NS3 | 2030 | 0.48 | 3 | 3 | 3.85 | Y | LPWLSWQV | 88.46 | QPWLSWQV | 3.85 | LPWLAWQV | 3.85 | | |
| NS3 | 2031 | 0.24 | 2 | 2 | 0 | Y | PWLSWQVA | 96.15 | PWLAWQVA | 3.85 | | | | |
| NS3 | 2032 | 0.24 | 2 | 2 | 0 | Y | VWLSWQYAK | 96.15 | VWLSWQVAK | 3.85 | | | | |
| NS3 | 2033 | 0.47 | 3 | 3 | 0 | Y | WLSWQVAKA | 92.31 | WLAWQVAKA | 3.85 | WLSWQVAKP | 3.85 | | |
| NS3 | 2034 | 0.47 | 3 | 3 | 0 | Y | LSWQVAKAG | 92.31 | LAWQVAKAG | 3.85 | LSWQVAKPG | 3.85 | | |
| NS3 | 2035 | 0.47 | 3 | 3 | 0 | Y | SWQVAKAGL | 92.31 | SWQVAKPGL | 3.85 | AWQVAKAGL | 3.85 | | |
| NS3 | 2036 | 0.24 | 2 | 2 | 0 | Y | WQVAKAGLK | 96.15 | WQVAKPGLK | 3.85 | | | | |
| NS3 | 2037 | 0.24 | 2 | 2 | 0 | Y | QVAKAGLKT | 96.15 | QVAKPGLKT | 3.85 | | | | |
| NS3 | 2038 | 0.24 | 2 | 2 | 0 | Y | VAKAGLKTN | 96.15 | VAKPGLKTN | 3.85 | | | | |
| NS3 | 2039 | 0.24 | 2 | 2 | 0 | Y | AKAGLKTND | 96.15 | AKPGLKTND | 3.85 | | | | |
| NS3 | 2040 | 0.24 | 2 | 2 | 0 | Y | KAGLKTNDR | 96.15 | KPGLKTNDR | 3.85 | | | | |
| NS3 | 2041 | 0.24 | 2 | 2 | 0 | Y | AGLKTNDRK | 96.15 | PGLKTNDRK | 3.85 | | | | |
| NS3 | 2042 | 0 | 1 | 1 | 0 | Y | GLKTNDRKW | 100 | | | | | | |
| NS3 | 2043 | 0 | 1 | 1 | 0 | Y | LKTNDRKWC | 100 | | | | | | |
| NS3 | 2044 | 0 | 1 | 1 | 0 | Y | KTNDRKWCF | 100 | | | | | | |
| NS3 | 2045 | 0.24 | 2 | 2 | 0 | Y | TNDRKWCFE | 96.15 | TNDRKWCFD | 3.85 | | | | |
| NS3 | 2046 | 0.24 | 2 | 2 | 0 | Y | NDRKWCFEG | 96.15 | NDRKWCFDG | 3.85 | | | | |
| NS3 | 2047 | 0.24 | 2 | 2 | 0 | Y | DRKWCFEGP | 96.15 | DRKWCFDGP | 3.85 | | | | |
| NS3 | 2048 | 0.47 | 3 | 3 | 0 | Y | RKWCFEGPE | 92.31 | RKWCFDGPK | 3.85 | RKWCFEGPD | 3.85 | | |
| NS3 | 2049 | 0.47 | 3 | 3 | 0 | Y | KWCFEGPEE | 92.31 | KWCFDGPKE | 3.85 | KWCFEGPDE | 3.85 | | |
| NS3 | 2050 | 0.47 | 3 | 3 | 0 | Y | WCFEGPEEH | 92.31 | WCFDGPKEH | 3.85 | WCFEGPDEH | 3.85 | | |
| NS3 | 2051 | 0.47 | 3 | 3 | 0 | Y | CFEGPEEHE | 92.31 | CFDGPKEHE | 3.85 | CFEGPDEHE | 3.85 | | |

Species: YFV (9-mers)

Fig. 28-82

| protein | block starting position | block ent

Fig. 28-83

Species: YFV (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 2077 | 0.85 | 4 | 4 | 0 | Y | KKPLRPRWC | 84.62 | KKALRPRWC | 7.69 | KRALRPRWC | 3.85 | KRPLRPRWC | 3.85 | | |
| NS3 | 2078 | 0.85 | 4 | 4 | 0 | Y | KPLRPRWCD | 84.62 | KALRPRWCD | 7.69 | RALRPRWCD | 3.85 | RPLRPRWCD | 3.85 | | |
| NS3 | 2079 | 0.52 | 2 | 2 | 0 | Y | PLRPRWCDE | 88.46 | ALRPRWCDE | 11.54 | | | | | | |
| NS3 | 2080 | 0 | 1 | 1 | 0 | Y | LRPRWCDER | 100 | | | | | | | | |
| NS3 | 2081 | 0 | 1 | 1 | 0 | Y | RPRWCDERV | 100 | | | | | | | | |
| NS3 | 2082 | 0 | 1 | 1 | 0 | Y | PRWCDERVS | 100 | | | | | | | | |
| NS3 | 2083 | 0 | 1 | 1 | 0 | Y | RWCDERVSS | 100 | | | | | | | | |
| NS3 | 2084 | 0 | 1 | 1 | 0 | Y | WCDERVSSD | 100 | | | | | | | | |
| NS3 | 2085 | 0 | 1 | 1 | 0 | Y | CDERVSSDQ | 100 | | | | | | | | |
| NS3 | 2086 | 0 | 1 | 1 | 0 | Y | DERVSSDQS | 100 | | | | | | | | |
| NS3 | 2087 | 0 | 1 | 1 | 0 | Y | ERVSSDQSA | 100 | | | | | | | | |
| NS3 | 2088 | 0 | 1 | 1 | 0 | Y | RVSSDQSAL | 100 | | | | | | | | |
| NS3 | 2089 | 0.78 | 2 | 2 | 0 | Y | VSSDQSALS | 76.92 | VSSDQSALA | 23.08 | | | | | | |
| NS3 | 2090 | 0.78 | 2 | 2 | 0 | Y | SSDQSALSE | 76.92 | SSDQSALAD | 23.08 | | | | | | |
| NS3 | 2091 | 0.78 | 2 | 2 | 0 | Y | SDQSALSEF | 76.92 | SDQSALADF | 23.08 | | | | | | |
| NS3 | 2092 | 0.78 | 2 | 2 | 0 | Y | DQSALSEFI | 76.92 | DQSALADFI | 23.08 | | | | | | |
| NS3 | 2093 | 0.78 | 2 | 2 | 0 | Y | QSALSEFIK | 76.92 | QSALADFIK | 23.08 | | | | | | |
| NS3 | 2094 | 0.78 | 2 | 2 | 0 | Y | SALSEFIKF | 76.92 | SALADFIKF | 23.08 | | | | | | |
| NS3 | 2095 | 0.78 | 2 | 2 | 0 | Y | ALSEFIKFA | 76.92 | ALADFIKFA | 23.08 | | | | | | |
| NS3 | 2096 | 0.78 | 2 | 2 | 0 | Y | LSEFIKFAE | 76.92 | LADFIKFAE | 23.08 | | | | | | |
| NS3 | 2097 | 0.78 | 2 | 2 | 0 | Y | SEFIKFAEG | 76.92 | ADFIKFAEG | 23.08 | | | | | | |
| NS3 | 2098 | 0.78 | 2 | 2 | 0 | Y | EFIKFAEGR | 76.92 | DFIKFAEGR | 23.08 | | | | | | |
| NS3 | 2099 | 0 | 1 | 1 | 0 | Y | FIKFAEGRR | 100 | | | | | | | | |
| NS3 | 2100 | 0 | 1 | 1 | 0 | Y | IKFAEGRRG | 100 | | | | | | | | |
| NS3 | 2101 | 0 | 1 | 1 | 0 | Y | KFAEGRRGA | 100 | | | | | | | | |

Fig. 28-84

Species: YFV (9-mers)

| protein | block starting position | ent

Fig. 28-85

Species: YFV (9-mers)

| protein | block starting position | block

Fig. 28-86

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2152 | 0 | 1 | 1 | 0 | Y | SMMPEAMTI | 100 | | | | | | |
| NS4A | 2153 | 0.24 | 2 | 2 | 0 | Y | MMPEAMTIV | 96.15 | MMPEAMTIA | 3.85 | | | | |
| NS4A | 2154 | 0.24 | 2 | 2 | 0 | Y | MPEAMTIVM | 96.15 | MPEAMTIAM | 3.85 | | | | |
| NS4A | 2155 | 0.24 | 2 | 2 | 0 | Y | PEAMTIVML | 96.15 | PEAMTIAML | 3.85 | | | | |
| NS4A | 2156 | 0.24 | 2 | 2 | 0 | Y | EAMTIVMLF | 96.15 | EAMTIAMLF | 3.85 | | | | |
| NS4A | 2157 | 0.62 | 3 | 3 | 0 | Y | AMTIVMLFI | 88.46 | AMTIVMLFL | 7.69 | AMTIAMLFI | 3.85 | | |
| NS4A | 2158 | 0.62 | 3 | 3 | 0 | Y | MTIVMLFIL | 88.46 | MTIVMLFLL | 7.69 | MTIAMLFIL | 3.85 | | |
| NS4A | 2159 | 0.62 | 3 | 3 | 0 | Y | TIVMLFILA | 88.46 | TIVMLFLLA | 7.69 | TIAMLFILA | 3.85 | | |
| NS4A | 2160 | 0.62 | 3 | 3 | 0 | Y | IVMLFILAG | 88.46 | IVMLFLLAG | 7.69 | IAMLFILAG | 3.85 | | |
| NS4A | 2161 | 0.62 | 3 | 3 | 0 | Y | VMLFILAGL | 88.46 | VMLFLLAGL | 7.69 | AMLFILAGL | 3.85 | | |
| NS4A | 2162 | 0.39 | 2 | 2 | 0 | Y | MLFILAGLL | 92.31 | MLFLLAGLL | 7.69 | | | | |
| NS4A | 2163 | 0.39 | 2 | 2 | 0 | Y | LFILAGLLT | 92.31 | LFLLAGLLT | 7.69 | | | | |
| NS4A | 2164 | 0.39 | 2 | 2 | 0 | Y | FILAGLLTS | 92.31 | FLAGLLTS | 7.69 | | | | |
| NS4A | 2165 | 0.39 | 2 | 2 | 0 | Y | ILAGLLTSG | 92.31 | LLAGLLTSG | 7.69 | | | | |
| NS4A | 2166 | 0.24 | 2 | 2 | 0 | Y | LAGLLTSGM | 96.15 | LAGLLTSGA | 3.85 | | | | |
| NS4A | 2167 | 0.24 | 2 | 2 | 0 | Y | AGLLTSGMV | 96.15 | AGLLTSGAV | 3.85 | | | | |
| NS4A | 2168 | 0.24 | 2 | 2 | 0 | Y | GLLTSGMVI | 96.15 | GLLTSGAVI | 3.85 | | | | |
| NS4A | 2169 | 0.24 | 2 | 2 | 0 | Y | LLTSGMVIF | 96.15 | LLTSGAVIF | 3.85 | | | | |
| NS4A | 2170 | 0.24 | 2 | 2 | 0 | Y | LTSGMVIFF | 96.15 | LTSGAVIFF | 3.85 | | | | |
| NS4A | 2171 | 0.24 | 2 | 2 | 0 | Y | TSGMVIFFM | 96.15 | TSGAVIFFM | 3.85 | | | | |
| NS4A | 2172 | 0.24 | 2 | 2 | 0 | Y | SGMVIFFMS | 96.15 | SGAVIFFMS | 3.85 | | | | |
| NS4A | 2173 | 0.24 | 2 | 2 | 0 | Y | GMVIFFMSP | 96.15 | GAVIFFMSP | 3.85 | | | | |
| NS4A | 2174 | 0.24 | 2 | 2 | 0 | Y | MVIFFMSPK | 96.15 | AVIFFMSPK | 3.85 | | | | |
| NS4A | 2175 | 0 | 1 | 1 | 0 | Y | VIFFMSPKG | 100 | | | | | | |
| NS4A | 2176 | 0.52 | 2 | 2 | 0 | Y | IFFMSPKGI | 88.46 | IFFMSPKGM | 11.54 | | | | |

Species: YFV (9-mers)

Fig. 28-87

Species: YFV (9-mers)

| protein | block starting position | block entropy | total

Fig. 28-88

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2202 | 0.47 | 3 | 3 | 0 | Y | FLGGVKPTH | 92.31 | FLGGAKPTH | 3.85 | FLGGVEPTH | 3.85 | | |
| NS4A | 2203 | 0.47 | 3 | 3 | 0 | Y | LGGVKPTHI | 92.31 | LGGAKPTHI | 3.85 | LGGVEPTHI | 3.85 | | |
| NS4A | 2204 | 0.47 | 3 | 3 | 0 | Y | GGVKPTHIS | 92.31 | GGVEPTHIS | 3.85 | GGAKPTHIS | 3.85 | | |
| NS4A | 2205 | 0.47 | 3 | 3 | 0 | Y | GVKPTHISY | 92.31 | GVEPTHISY | 3.85 | GAKPTHISY | 3.85 | | |
| NS4A | 2206 | 1.32 | 4 | 4 | 0 | Y | VKPTHISYI | 61.54 | VKPTHISYV | 3.85 | VEPTHISYI | 3.85 | | |
| NS4A | 2207 | 1.1 | 3 | 3 | 0 | Y | KPTHISYIM | 65.38 | KPTHISYVM | 30.77 | EPTHISYIM | 3.85 | AKPTHISYI | 3.85 |
| NS4A | 2208 | 0.89 | 2 | 2 | 0 | Y | PTHISYIML | 69.23 | PTHISYVML | 30.77 | | | | |
| NS4A | 2209 | 0.89 | 2 | 2 | 0 | Y | THISYIMLI | 69.23 | THISYVMLI | 30.77 | | | | |
| NS4A | 2210 | 0.89 | 2 | 2 | 0 | Y | HISYIMLIF | 69.23 | HISYVMLIF | 30.77 | | | | |
| NS4A | 2211 | 0.89 | 2 | 2 | 0 | Y | ISYIMLIFF | 69.23 | ISYVMLIFF | 30.77 | | | | |
| NS4A | 2212 | 0.89 | 2 | 2 | 0 | Y | SYIMLIFFV | 69.23 | SYVMLIFFV | 30.77 | | | | |
| NS4A | 2213 | 0.89 | 2 | 2 | 0 | Y | YIMLIFFVL | 69.23 | YVMLIFFVL | 30.77 | | | | |
| NS4A | 2214 | 0.89 | 2 | 2 | 0 | Y | IMLIFFVLM | 69.23 | VMLIFFVLM | 30.77 | | | | |
| NS4A | 2215 | 0 | 1 | 1 | 0 | Y | MLIFFVLMV | 100 | | | | | | |
| NS4A | 2216 | 0 | 1 | 1 | 0 | Y | LIFFVLMVV | 100 | | | | | | |
| NS4A | 2217 | 0.39 | 2 | 2 | 0 | Y | IFFVLMVW | 92.31 | IFFVLMWI | 7.69 | | | | |
| NS4A | 2218 | 0.39 | 2 | 2 | 0 | Y | FFVLMVWI | 92.31 | FFVLMWII | 7.69 | | | | |
| NS4A | 2219 | 0.39 | 2 | 2 | 0 | Y | FVLMVWIP | 92.31 | FVLMWIIP | 7.69 | | | | |
| NS4A | 2220 | 0.39 | 2 | 2 | 0 | Y | VLMVWIPE | 92.31 | VLMVIIPE | 7.69 | | | | |
| NS4A | 2221 | 0.39 | 2 | 2 | 0 | Y | LMVWIPEP | 92.31 | LMVIIPEP | 7.69 | | | | |
| NS4A | 2222 | 0.39 | 2 | 2 | 0 | Y | MVWIPEPG | 92.31 | MVIIPEPG | 7.69 | | | | |
| NS4A | 2223 | 0.39 | 2 | 2 | 0 | Y | VWIPEPGQ | 92.31 | VIIPEPGQ | 7.69 | | | | |
| NS4A | 2224 | 0.39 | 2 | 2 | 0 | Y | WIPEPGQQ | 92.31 | IIPEPGQQ | 7.69 | | | | |
| NS4A | 2225 | 0.39 | 2 | 2 | 0 | Y | VIPEPGQQR | 92.31 | IIPEPGQQR | 7.69 | | | | |
| NS4A | 2226 | 0.39 | 2 | 2 | 0 | Y | IPEPGQQRS | 92.31 | IPEPGQQRT | 7.69 | | | | |

Fig. 28-89

Species: YFV (9-mers)

| protein | block starting position | entropy | total

Fig. 28-90

Species: YFV (9-mers)

| protein | block starting position | block entropy | total

Fig. 28-92

Species: YFV (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2312 | 0 | 1 | 1 | 0 | Y | HHWIKVEYG | 100 | | | | | | |
| NS4B | 2313 | 0 | 1 | 1 | 0 | Y | HWIKVEYGN | 100 | | | | | | |
| NS4B | 2314 | 0 | 1 | 1 | 0 | Y | WIKVEYGNL | 100 | | | | | | |
| NS4B | 2315 | 0 | 1 | 1 | 0 | Y | IKVEYGNLS | 100 | | | | | | |
| NS4B | 2316 | 0 | 1 | 1 | 0 | Y | KVEYGNLSL | 100 | | | | | | |
| NS4B | 2317 | 0 | 1 | 1 | 0 | Y | VEYGNLSLS | 100 | | | | | | |
| NS4B | 2318 | 0 | 1 | 1 | 0 | Y | EYGNLSLSG | 100 | | | | | | |
| NS4B | 2319 | 0 | 1 | 1 | 0 | Y | YGNLSLSGI | 100 | | | | | | |
| NS4B | 2320 | 0 | 1 | 1 | 0 | Y | GNLSLSGIA | 100 | | | | | | |
| NS4B | 2321 | 0 | 1 | 1 | 0 | Y | NLSLSGIAQ | 100 | | | | | | |
| NS4B | 2322 | 0 | 1 | 1 | 0 | Y | LSLSGIAQS | 100 | | | | | | |
| NS4B | 2323 | 0 | 1 | 1 | 0 | Y | SLSGIAQSA | 100 | | | | | | |
| NS4B | 2324 | 0 | 1 | 1 | 0 | Y | LSGIAQSAS | 100 | | | | | | |
| NS4B | 2325 | 0 | 1 | 1 | 0 | Y | SGIAQSASV | 100 | | | | | | |
| NS4B | 2326 | 0 | 1 | 1 | 0 | Y | GIAQSASVL | 100 | | | | | | |
| NS4B | 2327 | 0 | 1 | 1 | 0 | Y | IAQSASVLS | 100 | | | | | | |
| NS4B | 2328 | 0 | 1 | 1 | 0 | Y | AQSASVLSF | 100 | | | | | | |
| NS4B | 2329 | 0 | 1 | 1 | 0 | Y | QSASVLSFM | 100 | | | | | | |
| NS4B | 2330 | 0 | 1 | 1 | 0 | Y | SASVLSFMD | 100 | | | | | | |
| NS4B | 2331 | 0 | 1 | 1 | 0 | Y | ASVLSFMDK | 100 | | | | | | |
| NS4B | 2332 | 0 | 1 | 1 | 0 | Y | SVLSFMDKG | 100 | | | | | | |
| NS4B | 2333 | 0.24 | 2 | 2 | 0 | Y | VLSFMDKGI | 96.15 | VLSFMDKGV | 3.85 | | | | |
| NS4B | 2334 | 0.24 | 2 | 2 | 0 | Y | LSFMDKGIP | 96.15 | LSFMDKGVP | 3.85 | | | | |
| NS4B | 2335 | 0.24 | 2 | 2 | 0 | Y | SFMDKGIPF | 96.15 | SFMDKGVPF | 3.85 | | | | |
| NS4B | 2336 | 0.24 | 2 | 2 | 0 | Y | FMDKGIPFM | 96.15 | FMDKGVPFM | 3.85 | | | | |

Fig. 28-93

Species: YFV (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2337 | 0.24 | 2 | 2 | 0 | Y | MDKGIPFMK | 96.15 | MDKGIPFMK | 3.85 | | | | |
| NS4B | 2338 | 0.24 | 2 | 2 | 0 | Y | DKGIPFMKM | 96.15 | DKGIPFMKM | 3.85 | | | | |
| NS4B | 2339 | 0.24 | 2 | 2 | 0 | Y | KGIPFMKMN | 96.15 | KGIPFMKMN | 3.85 | | | | |
| NS4B | 2340 | 0.24 | 2 | 2 | 0 | Y | GIPFMKMNI | 96.15 | GVPFMKMNI | 3.85 | | | | |
| NS4B | 2341 | 0.24 | 2 | 2 | 0 | Y | IPFMKMNIS | 96.15 | VPFMKMNIS | 3.85 | | | | |
| NS4B | 2342 | 0 | 1 | 1 | 0 | Y | PFMKMNISV | 100 | | | | | | |
| NS4B | 2343 | 0.52 | 2 | 2 | 0 | Y | FMKMNISVI | 88.46 | FMKMNISVW | 11.54 | MKMNISVWI | 11.54 | | |
| NS4B | 2344 | 1.18 | 3 | 3 | 0 | Y | MKMNISVIM | 69.23 | MKMNISVII | 19.23 | KMNISVIIL | 11.54 | | |
| NS4B | 2345 | 1.18 | 3 | 3 | 0 | Y | KMNISVIML | 69.23 | KMNISVIIL | 19.23 | MNISVIILL | 11.54 | | |
| NS4B | 2346 | 1.18 | 3 | 3 | 0 | Y | MNISVIMLL | 69.23 | MNISVIILL | 19.23 | NISVIILLV | 11.54 | | |
| NS4B | 2347 | 1.4 | 4 | 4 | 0 | Y | NISVIMLLV | 65.38 | NISVIILLV | 19.23 | ISVIILLVS | 11.54 | NISVIMLLI | 3.85 |
| NS4B | 2348 | 1.4 | 4 | 4 | 0 | Y | ISVIMLLVS | 65.38 | ISVIILLVS | 19.23 | SVIILLVSG | 11.54 | ISVIMLLIS | 3.85 |
| NS4B | 2349 | 1.4 | 4 | 4 | 0 | Y | SVIMLLVSG | 65.38 | SVIILLVSG | 19.23 | VIILLVSGW | 11.54 | SVIMLLISG | 3.85 |
| NS4B | 2350 | 1.4 | 4 | 4 | 0 | Y | VIMLLVSGW | 65.38 | VIILLVSGW | 19.23 | VILLVSGWN | 11.54 | VIMLLISGW | 3.85 |
| NS4B | 2351 | 1.4 | 4 | 4 | 0 | Y | IMLLVSGWN | 65.38 | IILLVSGWN | 19.23 | VILLVSGWN | 11.54 | IMLLISGWN | 3.85 |
| NS4B | 2352 | 1.1 | 3 | 3 | 0 | Y | MLLVSGWNS | 65.38 | ILLVSGWNS | 30.77 | MLLISGWNS | 3.85 | | |
| NS4B | 2353 | 0.24 | 2 | 2 | 0 | Y | LLVSGWNSI | 96.15 | LLISGWNSI | 3.85 | | | | |
| NS4B | 2354 | 0.24 | 2 | 2 | 0 | Y | LVSGWNSIT | 96.15 | LISGWNSIT | 3.85 | | | | |
| NS4B | 2355 | 0.24 | 2 | 2 | 0 | Y | VSGWNSITV | 96.15 | ISGWNSITV | 3.85 | | | | |
| NS4B | 2356 | 0.52 | 2 | 2 | 0 | Y | SGWNSITVM | 88.46 | SGWNSITVI | 11.54 | | | | |
| NS4B | 2357 | 0.52 | 2 | 2 | 0 | Y | GWNSITVMP | 88.46 | GWNSITVIP | 11.54 | | | | |
| NS4B | 2358 | 0.52 | 2 | 2 | 0 | Y | WNSITVMPL | 88.46 | WNSITVIPL | 11.54 | | | | |
| NS4B | 2359 | 0.52 | 2 | 2 | 0 | Y | NSITVMPLL | 88.46 | NSITVIPLL | 11.54 | | | | |
| NS4B | 2360 | 0.52 | 2 | 2 | 0 | Y | SITVMPLLC | 88.46 | SITVIPLLC | 11.54 | | | | |
| NS4B | 2361 | 0.52 | 2 | 2 | 0 | Y | ITVMPLLCG | 88.46 | ITVIPLLCG | 11.54 | | | | |

Fig. 28-94

Species: YFV (9-mers)

| protein | block starting position | block entropy | total peptides in

Fig. 28-95

Species: YFV (9-mers)

| protein | block starting position | block entropy | total peptides

Fig. 28-96

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2412 | 0.52 | 2 | 2 | 0 | Y | VDIEEAPEM | 88.46 | ADIEEAPEM | 11.54 | | | | |
| NS4B | 2413 | 0 | 1 | 1 | 0 | Y | DIEEAPEMP | 100 | | | | | | |
| NS4B | 2414 | 0.24 | 2 | 2 | 0 | Y | IEEAPEMPA | 96.15 | IEEAPEMPV | 3.85 | | | | |
| NS4B | 2415 | 0.24 | 2 | 2 | 0 | Y | EEAPEMPAL | 96.15 | EEAPEMPVL | 3.85 | | | | |
| NS4B | 2416 | 0.24 | 2 | 2 | 0 | Y | EAPEMPALY | 96.15 | EAPEMPVLY | 3.85 | | | | |
| NS4B | 2417 | 0.24 | 2 | 2 | 0 | Y | APEMPALYE | 96.15 | APEMPVLYE | 3.85 | | | | |
| NS4B | 2418 | 0.24 | 2 | 2 | 0 | Y | PEMPALYEK | 96.15 | PEMPVLYEK | 3.85 | | | | |
| NS4B | 2419 | 0.24 | 2 | 2 | 0 | Y | EMPALYEKK | 96.15 | EMPVLYEKK | 3.85 | | | | |
| NS4B | 2420 | 0.24 | 2 | 2 | 0 | Y | MPALYEKKL | 96.15 | MPVLYEKKL | 3.85 | | | | |
| NS4B | 2421 | 0.24 | 2 | 2 | 0 | Y | PALYEKKLA | 96.15 | PVLYEKKLA | 3.85 | | | | |
| NS4B | 2422 | 0.24 | 2 | 2 | 0 | Y | ALYEKKLAL | 96.15 | VLYEKKLAL | 3.85 | | | | |
| NS4B | 2423 | 0 | 1 | 1 | 0 | Y | LYEKKLALY | 100 | | | | | | |
| NS4B | 2424 | 0 | 1 | 1 | 0 | Y | YEKKLALYL | 100 | | | | | | |
| NS4B | 2425 | 0 | 1 | 1 | 0 | Y | EKKLALYLL | 100 | | | | | | |
| NS4B | 2426 | 0 | 1 | 1 | 0 | Y | KKLALYLLL | 100 | | | | | | |
| NS4B | 2427 | 0 | 1 | 1 | 0 | Y | KLALYLLLA | 100 | | | | | | |
| NS4B | 2428 | 0 | 1 | 1 | 0 | Y | LALYLLLAL | 100 | | | | | | |
| NS4B | 2429 | 0 | 1 | 1 | 0 | Y | ALYLLLALS | 100 | | | | | | |
| NS4B | 2430 | 0 | 1 | 1 | 0 | Y | LYLLLALSL | 100 | | | | | | |
| NS4B | 2431 | 0.74 | 3 | 3 | 0 | Y | YLLLALSLA | 84.62 | YLLLALSLM | 11.54 | YLLLALSLS | 3.85 | | |
| NS4B | 2432 | 0.74 | 3 | 3 | 0 | Y | LLLALSLAS | 84.62 | LLLALSLMS | 11.54 | LLLALSLSS | 3.85 | | |
| NS4B | 2433 | 0.74 | 3 | 3 | 0 | Y | LLALSLASV | 84.62 | LLALSLMSV | 11.54 | LLALSLSSV | 3.85 | | |
| NS4B | 2434 | 0.74 | 3 | 3 | 0 | Y | LALSLASVA | 84.62 | LALSLMSVA | 11.54 | LALSLSSVA | 3.85 | | |
| NS4B | 2435 | 0.74 | 3 | 3 | 0 | Y | ALSLASVAM | 84.62 | ALSLMSVAM | 11.54 | ALSLSSVAM | 3.85 | | |
| NS4B | 2436 | 0.74 | 3 | 3 | 0 | Y | LSLASVAMC | 84.62 | LSLMSVAMC | 11.54 | LSLSSVAMC | 3.85 | | |

Fig. 28-97

Species: YFV (9-mers)

| protein | block starting position | block

Fig. 28-98

Species: YFV (9-mers)

| protein | block starting position | block entropy | total peptides in block | # peptides required to cover 99% of block | gap/X fraction | 99% of block covered w/ <= 5 peptides? | peptides required

Fig. 28-99

Species: YFV (9-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2487 | 0.96 | 2 | 2 | 0 | Y | GNHYAFVGV | 61.54 | GNYYAFVGV | 38.46 | | | | |
| NS4B | 2488 | 1.14 | 2 | 2 | 0 | Y | NHYAFVGVM | 61.54 | NYYAFVGVM | 34.62 | NYYAFVGVA | 3.85 | | |
| NS4B | 2489 | 1.14 | 3 | 3 | 0 | Y | HYAFVGVMY | 61.54 | YYAFVGVMY | 34.62 | YYAFVGVAY | 3.85 | | |
| NS4B | 2490 | 0.24 | 3 | 2 | 0 | Y | YAFVGVMYN | 96.15 | YAFVGVAYN | 3.85 | | | | |
| NS4B | 2491 | 0.24 | 2 | 2 | 0 | Y | AFVGVMYNL | 96.15 | AFVGVAYNL | 3.85 | | | | |
| NS4B | 2492 | 0.24 | 2 | 2 | 0 | Y | FVGVMYNLW | 96.15 | FVGVAYNLW | 3.85 | | | | |
| NS4B | 2493 | 0.24 | 2 | 2 | 0 | Y | VGVMYNLWK | 96.15 | VGVAYNLWK | 3.85 | | | | |
| NS4B | 2494 | 0.24 | 2 | 2 | 0 | Y | GVMYNLWKM | 96.15 | GVAYNLWKM | 3.85 | | | | |
| NS4B | 2495 | 0.62 | 3 | 3 | 0 | Y | VMYNLWKMK | 88.46 | VMYNLWKME | 7.69 | VAYNLWKMK | 3.85 | | |
| NS4B | 2496 | 0.62 | 3 | 3 | 0 | Y | MYNLWKMKT | 88.46 | MYNLWKMET | 7.69 | AYNLWKMKT | 3.85 | | |
| NS4B | 2497 | 0.85 | 4 | 4 | 0 | Y | YNLWKMKTG | 84.62 | YNLWKMETG | 7.69 | YNLWKMKTA | 3.85 | YNLWKMKTE | 3.85 |
| NS4B | 2498 | 0.85 | 4 | 4 | 0 | Y | NLWKMKTGR | 84.62 | NLWKMETGR | 7.69 | NLWKMKTAR | 3.85 | NLWKMKTER | 3.85 |
| NS4B | 2499 | 0.85 | 4 | 4 | 0 | Y | LWKMKTGRR | 84.62 | LWKMETGRR | 7.69 | LWKMKTERR | 3.85 | LWKMKTARR | 3.85 |
| NS4B | 2500 | 0.85 | 4 | 4 | 0 | Y | WKMKTGRRG | 84.62 | WKMETGRRG | 7.69 | WKMKTARRG | 3.85 | WKMKTERRG | 3.85 |
| NS4B | 2506 | 1.35 | 4 | 4 | 0 | Y | RRGSANGKT | 69.23 | RRGRANGKT | 7.69 | RRGSASGKT | 7.69 | RRGTANGKT | 7.69 |
| NS4B | 2507 | 1.35 | 4 | 4 | 0 | Y | RGSANGKTL | 69.23 | RGRANGKTL | 7.69 | RGSASGKTL | 7.69 | RGTANGKTL | 7.69 |
| NS4B | 2508 | 1.35 | 4 | 4 | 0 | Y | GSANGKTLG | 69.23 | GRANGKTLG | 7.69 | GTANGKTLG | 7.69 | GSASGKTLG | 7.69 |
| NS4B | 2509 | 1.35 | 4 | 4 | 0 | Y | SANGKTLGE | 69.23 | RANGKTLGE | 7.69 | SASGKTLGE | 7.69 | TANGKTLGE | 7.69 |
| NS4B | 2510 | 0.39 | 2 | 2 | 0 | Y | ANGKTLGEV | 92.31 | ASGKTLGEV | 7.69 | | | | |
| NS4B | 2511 | 0.39 | 2 | 2 | 0 | Y | NGKTLGEVW | 92.31 | SGKTLGEVW | 7.69 | | | | |
| NS5 | 2512 | 0 | 1 | 1 | 0 | Y | GKTLGEVWK | 100 | | | | | | |
| NS5 | 2513 | 0 | 1 | 1 | 0 | Y | KTLGEVWKR | 100 | | | | | | |
| NS5 | 2514 | 0 | 1 | 1 | 0 | Y | TLGEVWKRE | 100 | | | | | | |
| NS5 | 2515 | 0 | 1 | 1 | 0 | Y | LGEVWKREL | 100 | | | | | | |
| NS5 | 2516 | 0 | 1 | 1 | 0 | Y | GEVWKRELN | 100 | | | | | | |

Fig. 28-100

Species: YFV (9-mers)

| protein | block starting position | entropy block | total

Fig. 28-101

Species: YFV (9-mers)

| protein | block starting position | entropy block | total pe

Fig. 28-102

Species: YFV (9-mers)

| protein | block starting position | block ent

Fig. 28-103

Species: YFV (9-mers)

| protein | block starting position | block entropy | total peptides in block | # peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2592 | 0 | 1 | 1 | 0 | Y | GGWCYAAA | 100 | | | | | | |
| NS5 | 2593 | 0 | 1 | 1 | 0 | Y | GWCYAAAQ | 100 | | | | | | |
| NS5 | 2594 | 0 | 1 | 1 | 0 | Y | WCYAAAQK | 100 | | | | | | |
| NS5 | 2595 | 0 | 1 | 1 | 0 | Y | CYAAAQKE | 100 | | | | | | |
| NS5 | 2596 | 0 | 1 | 1 | 0 | Y | YAAAQKEV | 100 | | | | | | |
| NS5 | 2597 | 0 | 1 | 1 | 0 | Y | AAAQKEVS | 100 | | | | | | |
| NS5 | 2598 | 0 | 1 | 1 | 0 | Y | AAQKEVSG | 100 | | | | | | |
| NS5 | 2599 | 0 | 1 | 1 | 0 | Y | AQKEVSGV | 100 | | | | | | |
| NS5 | 2600 | 0 | 1 | 1 | 0 | Y | QKEVSGVK | 100 | | | | | | |
| NS5 | 2601 | 0 | 1 | 1 | 0 | Y | KEVSGVKG | 100 | | | | | | |
| NS5 | 2602 | 0.52 | 2 | 2 | 0 | Y | KEVSGVKGF | 88.46 | KEVSGVKGY | 11.54 | | | | |
| NS5 | 2603 | 0.52 | 2 | 2 | 0 | Y | EVSGVKGFT | 88.46 | EVSGVKGYT | 11.54 | | | | |
| NS5 | 2604 | 0.52 | 2 | 2 | 0 | Y | VSGVKGFTL | 88.46 | VSGVKGYTL | 11.54 | | | | |
| NS5 | 2605 | 0.52 | 2 | 2 | 0 | Y | SGVKGFTLG | 88.46 | SGVKGYTLG | 11.54 | | | | |
| NS5 | 2606 | 0.52 | 2 | 2 | 0 | Y | GVKGFTLGR | 88.46 | GVKGYTLGR | 11.54 | | | | |
| NS5 | 2607 | 0.74 | 3 | 3 | 0 | Y | VKGFTLGRD | 84.62 | VKGYTLGRD | 11.54 | VKGFTLGRE | 3.85 | | |
| NS5 | 2608 | 0.74 | 3 | 3 | 0 | Y | KGFTLGRDG | 84.62 | KGYTLGRDG | 11.54 | KGFTLGREG | 3.85 | | |
| NS5 | 2609 | 0.74 | 3 | 3 | 0 | Y | GFTLGRDGH | 84.62 | GYTLGRDGH | 11.54 | GFTLGREGH | 3.85 | | |
| NS5 | 2610 | 0.74 | 3 | 3 | 0 | Y | FTLGRDGHE | 84.62 | YTLGRDGHE | 11.54 | FTLGREGHE | 3.85 | | |
| NS5 | 2611 | 0.24 | 2 | 2 | 0 | Y | TLGRDGHEK | 96.15 | TLGREGHEK | 3.85 | | | | |
| NS5 | 2612 | 0.24 | 2 | 2 | 0 | Y | LGRDGHEKP | 96.15 | LGREGHEKP | 3.85 | | | | |
| NS5 | 2613 | 0.24 | 2 | 2 | 0 | Y | GRDGHEKPM | 96.15 | GREGHEKPM | 3.85 | | | | |
| NS5 | 2614 | 0.24 | 2 | 2 | 0 | Y | RDGHEKPMN | 96.15 | REGHEKPMN | 3.85 | | | | |
| NS5 | 2615 | 0.24 | 2 | 2 | 0 | Y | DGHEKPMNV | 96.15 | EGHEKPMNV | 3.85 | | | | |
| NS5 | 2616 | 0.24 | 2 | 2 | 0 | Y | GHEKPMNVQ | 96.15 | GHEKPMNVR | 3.85 | | | | |

Fig. 28-104

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2617 | 0.24 | 2 | 2 | 0 | Y | HEKPMNVQS | 96.15 | HEKPMNVRS | 3.85 | | | | | | |
| NS5 | 2618 | 0.24 | 2 | 2 | 0 | Y | EKPMNVQSL | 96.15 | EKPMNVRSL | 3.85 | | | | | | |
| NS5 | 2619 | 0.24 | 2 | 2 | 0 | Y | KPMNVQSLG | 96.15 | KPMNVRSLG | 3.85 | | | | | | |
| NS5 | 2620 | 0.24 | 2 | 2 | 0 | Y | PMNVQSLGW | 96.15 | PMNVRSLGW | 3.85 | | | | | | |
| NS5 | 2621 | 0.24 | 2 | 2 | 0 | Y | MNVQSLGWN | 96.15 | MNVRSLGWN | 3.85 | | | | | | |
| NS5 | 2622 | 0.24 | 2 | 2 | 0 | Y | NVQSLGWNI | 96.15 | NVRSLGWNI | 3.85 | | | | | | |
| NS5 | 2623 | 0.74 | 3 | 3 | 0 | Y | VQSLGWNII | 84.62 | VQSLGWNIV | 11.54 | VRSLGWNII | 3.85 | | | | |
| NS5 | 2624 | 0.74 | 3 | 3 | 0 | Y | QSLGWNIIT | 84.62 | QSLGWNIVT | 11.54 | RSLGWNIIT | 3.85 | | | | |
| NS5 | 2625 | 0.52 | 2 | 2 | 0 | Y | SLGWNIITF | 88.46 | SLGWNIVTF | 11.54 | | | | | | |
| NS5 | 2626 | 0.52 | 2 | 2 | 0 | Y | LGWNIITFK | 88.46 | LGWNIVTFK | 11.54 | | | | | | |
| NS5 | 2627 | 0.52 | 2 | 2 | 0 | Y | GWNIITFKD | 88.46 | GWNIVTFKD | 11.54 | | | | | | |
| NS5 | 2628 | 0.52 | 2 | 2 | 0 | Y | WNIITFKDK | 88.46 | WNIVTFKDK | 11.54 | | | | | | |
| NS5 | 2629 | 0.52 | 2 | 2 | 0 | Y | NIITFKDKT | 88.46 | NIVTFKDKT | 11.54 | | | | | | |
| NS5 | 2630 | 0.52 | 2 | 2 | 0 | Y | IITFKDKTD | 88.46 | IVTFKDKTD | 11.54 | | | | | | |
| NS5 | 2631 | 0.85 | 4 | 4 | 0 | Y | ITFKDKTDI | 84.62 | VTFKDKTDI | 7.69 | ITFKDKTDV | 3.85 | VTFKDKTDV | 3.85 | | |
| NS5 | 2632 | 0.39 | 2 | 2 | 0 | Y | TFKDKTDIH | 92.31 | TFKDKTDVH | 7.69 | | | | | | |
| NS5 | 2633 | 0.7 | 4 | 4 | 0 | Y | FKDKTDIHR | 88.46 | FKDKTDIHH | 3.85 | FKDKTDVHP | 3.85 | FKDKTDVHR | 3.85 | | |
| NS5 | 2634 | 0.7 | 4 | 4 | 0 | Y | KDKTDIHRL | 88.46 | KDKTDIHHL | 3.85 | KDKTDVHPL | 3.85 | KDKTDVHRL | 3.85 | | |
| NS5 | 2635 | 0.93 | 4 | 4 | 0 | Y | DKTDIHRLE | 88.46 | DKTDIHHLE | 3.85 | DKTDVHPLE | 3.85 | DKTDIHHLE | 3.85 | | |
| NS5 | 2636 | 1.08 | 5 | 5 | 0 | Y | KTDIHRLEP | 84.62 | KTDIHRLES | 3.85 | KTDVHPLEP | 3.85 | KTDIHRLES | 3.85 | KTDIHHLEP | 3.85 |
| NS5 | 2642 | 1.08 | 5 | 5 | 0 | Y | LEPVKCDTL | 80.77 | LEPLKCETL | 3.85 | LEPAKCETL | 7.69 | LESVKCDTL | 3.85 | LEPMKCDTL | 3.85 |
| NS5 | 2643 | 1.08 | 5 | 5 | 0 | Y | EPVKCDTLL | 80.77 | EPLKCETLL | 3.85 | EPAKCETLL | 7.69 | EPMKCDTLL | 3.85 | ESVKCDTLL | 3.85 |
| NS5 | 2644 | 0.85 | 4 | 5 | 0 | Y | PVKCDTLLC | 80.77 | PLKCETLLC | 3.85 | PAKCETLLC | 7.69 | SVKCDTLLC | 3.85 | PMKCDTLLC | 3.85 |
| NS5 | 2645 | 0.85 | 4 | 4 | 0 | Y | VKCDTLLCD | 84.62 | LKCETLLCD | 3.85 | AKCETLLCD | 7.69 | MKCDTLLCD | 3.85 | | |
| NS5 | 2646 | 0.52 | 2 | 2 | 0 | Y | KCDTLLCDI | 88.46 | KCETLLCDI | 11.54 | | | | | | |

Fig. 28-105

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2647 | 0.52 | 2 | 2 | 0 | Y | CDTLLCDIG | 88.46 | CETLLCDIG | 11.54 | | | | |
| NS5 | 2648 | 0.52 | 2 | 2 | 0 | Y | DTLLCDIGE | 88.46 | ETLLCDIGE | 11.54 | | | | |
| NS5 | 2649 | 0 | 1 | 1 | 0 | Y | TLLCDIGES | 100 | | | | | | |
| NS5 | 2650 | 0 | 1 | 1 | 0 | Y | LLCDIGESS | 100 | | | | | | |
| NS5 | 2651 | 0.52 | 2 | 2 | 0 | Y | LCDIGESSS | 88.46 | LCDIGESSP | 11.54 | | | | |
| NS5 | 2652 | 0.52 | 2 | 2 | 0 | Y | CDIGESSSS | 88.46 | CDIGESSPS | 11.54 | | | | |
| NS5 | 2653 | 0.52 | 2 | 2 | 0 | Y | DIGESSSSS | 88.46 | DIGESSPSS | 11.54 | | | | |
| NS5 | 2654 | 0.85 | 4 | 4 | 0 | Y | IGESSSSSV | 84.62 | IGESPSSV | 7.69 | IGESSPSSA | 3.85 | IGESSSSSI | 3.85 | |
| NS5 | 2655 | 0.85 | 4 | 4 | 0 | Y | GESSSSVT | 84.62 | GESSPSSVT | 7.69 | GESSSSIT | 3.85 | GESSPSSAT | 3.85 | |
| NS5 | 2656 | 0.85 | 4 | 4 | 0 | Y | ESSSSVTE | 84.62 | ESSPSSVTE | 7.69 | ESSPSSATE | 3.85 | ESSSSITE | 3.85 | |
| NS5 | 2657 | 0.85 | 4 | 4 | 0 | Y | SSSSVTEG | 84.62 | SSPSSVTEG | 7.69 | SSPSSATEG | 3.85 | SSSSITEG | 3.85 | |
| NS5 | 2658 | 0.85 | 4 | 4 | 0 | Y | SSSVTEGE | 84.62 | SPSSVTEGE | 7.69 | SPSSATEGE | 3.85 | SSSITEGE | 3.85 | |
| NS5 | 2659 | 0.85 | 4 | 4 | 0 | Y | SSVTEGER | 84.62 | PSSVTEGER | 7.69 | PSSATEGER | 3.85 | SSITEGER | 3.85 | |
| NS5 | 2660 | 0.47 | 3 | 3 | 0 | Y | SVTEGERT | 92.31 | SSATEGERT | 3.85 | SSITEGERT | 3.85 | | |
| NS5 | 2661 | 1.34 | 5 | 5 | 0 | Y | SVTEGERTV | 73.08 | SVTEGERTM | 11.54 | SVTEGERTL | 11.54 | SATEGERTL | 3.85 | SITEGERTV | 3.85 |
| NS5 | 2662 | 1.34 | 5 | 5 | 0 | Y | VTEGERTYR | 73.08 | VTEGERTMR | 11.54 | VTEGERTLR | 11.54 | ITEGERTVR | 3.85 | ATEGERTLR | 3.85 |
| NS5 | 2663 | 1.01 | 3 | 3 | 0 | Y | TEGERTVRV | 76.92 | TEGERTLRV | 11.54 | TEGERTMRV | 11.54 | | | |
| NS5 | 2664 | 1.01 | 3 | 3 | 0 | Y | EGERTVRVL | 76.92 | EGERTLRVL | 11.54 | EGERTMRVL | 11.54 | | | |
| NS5 | 2665 | 1.12 | 4 | 4 | 0 | Y | GERTVRVLD | 76.92 | GERTMRVLD | 11.54 | GERTLRVLE | 7.69 | GERTLRVLD | 3.85 | |
| NS5 | 2666 | 1.12 | 4 | 4 | 0 | Y | ERTVRVLDT | 76.92 | ERTMRVLDT | 11.54 | ERTLRVLET | 7.69 | ERTLRVLDT | 3.85 | |
| NS5 | 2667 | 1.19 | 5 | 5 | 0 | Y | RTVRVLDTV | 76.92 | RTMRVLDTV | 11.54 | RTLRVLDTV | 3.85 | RTLRVLETI | 3.85 | RTLRVLETV | 3.85 |
| NS5 | 2668 | 1.19 | 5 | 5 | 0 | Y | TVRVLDTVE | 76.92 | TMRVLDTVE | 11.54 | TLRVLETIE | 3.85 | TLRVLETVE | 3.85 | TLRVLDTVE | 3.85 |
| NS5 | 2669 | 1.19 | 5 | 5 | 0 | Y | VRVLDTVEK | 76.92 | MRVLDTVEK | 11.54 | LRVLETIEK | 3.85 | LRVLETVEK | 3.85 | LRVLETIEK | 3.85 |
| NS5 | 2670 | 0.47 | 3 | 3 | 0 | Y | RVLDTVEKW | 92.31 | RVLETIEKW | 3.85 | RVLETVEKW | 3.85 | | | |
| NS5 | 2671 | 0.47 | 3 | 3 | 0 | Y | VLDTVEKWL | 92.31 | VLETIEKWL | 3.85 | VLETVEKWL | 3.85 | | | |

Fig. 28-106

Species: YFV (9-mers)

| protein | block starting position | block

Fig. 28-107

Species: YFV (9-mers)

| protein | block starting position | entropy block | total peptides in block | # peptides required to c

Fig. 28-108

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2722 | 0 | 1 | 1 | 0 | Y | STHEMYYS | 100 | | | | | | |
| NS5 | 2723 | 0 | 1 | 1 | 0 | Y | THEMYYSG | 100 | | | | | | |
| NS5 | 2724 | 0 | 1 | 1 | 0 | Y | HEMYYSGA | 100 | | | | | | |
| NS5 | 2725 | 0 | 1 | 1 | 0 | Y | EMYYSGAR | 100 | | | | | | |
| NS5 | 2726 | 0 | 1 | 1 | 0 | Y | MYYSGARS | 100 | | | | | | |
| NS5 | 2727 | 0 | 1 | 1 | 0 | Y | YYSGARSN | 100 | | | | | | |
| NS5 | 2728 | 0.52 | 2 | 2 | 0 | Y | YVSGARSNV | 88.46 | YVSGARSNI | 11.54 | | | | |
| NS5 | 2729 | 0.52 | 2 | 2 | 0 | Y | VSGARSNVT | 88.46 | VSGARSNIT | 11.54 | | | | |
| NS5 | 2730 | 0.52 | 2 | 2 | 0 | Y | SGARSNVTF | 88.46 | SGARSNITF | 11.54 | | | | |
| NS5 | 2731 | 0.52 | 2 | 2 | 0 | Y | GARSNVTFT | 88.46 | GARSNITFT | 11.54 | | | | |
| NS5 | 2732 | 0.52 | 2 | 2 | 0 | Y | ARSNVTFTV | 88.46 | ARSNITFTV | 11.54 | | | | |
| NS5 | 2733 | 0.52 | 2 | 2 | 0 | Y | RSNVTFTVN | 88.46 | RSNITFTVN | 11.54 | | | | |
| NS5 | 2734 | 0.52 | 2 | 2 | 0 | Y | SNVTFTVNQ | 88.46 | SNITFTVNQ | 11.54 | | | | |
| NS5 | 2735 | 0.52 | 2 | 2 | 0 | Y | NVTFTVNQT | 88.46 | NITFTVNQT | 11.54 | | | | |
| NS5 | 2736 | 0.52 | 2 | 2 | 0 | Y | VTFTVNQTS | 88.46 | ITFTVNQTS | 11.54 | | | | |
| NS5 | 2737 | 0 | 1 | 1 | 0 | Y | TFTVNQTSR | 100 | | | | | | |
| NS5 | 2738 | 0 | 1 | 1 | 0 | Y | FTVNQTSRL | 100 | | | | | | |
| NS5 | 2739 | 0 | 1 | 1 | 0 | Y | TVNQTSRLL | 100 | | | | | | |
| NS5 | 2740 | 0 | 1 | 1 | 0 | Y | VNQTSRLLM | 100 | | | | | | |
| NS5 | 2741 | 0 | 1 | 1 | 0 | Y | NQTSRLLMR | 100 | | | | | | |
| NS5 | 2742 | 0 | 1 | 1 | 0 | Y | QTSRLLMRR | 100 | | | | | | |
| NS5 | 2743 | 0 | 1 | 1 | 0 | Y | TSRLLMRRM | 100 | | | | | | |
| NS5 | 2744 | 0 | 1 | 1 | 0 | Y | SRLLMRRMR | 100 | | | | | | |
| NS5 | 2745 | 0 | 1 | 1 | 0 | Y | RLLMRRMRR | 100 | | | | | | |
| NS5 | 2746 | 0 | 1 | 1 | 0 | Y | LLMRRMRRP | 100 | | | | | | |

Fig. 28-109

Species: YFV (9-mers)

| protein | block star

Fig. 28-110

Species: YFV (9-mers)

| protein | block starting position | entropy | total pe

Fig. 28-111

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2805 | 0 | 1 | 1 | 0 | Y | DNPYRTWHY | 100 | | | | | | |
| NS5 | 2806 | 0 | 1 | 1 | 0 | Y | NPYRTWHYC | 100 | | | | | | |
| NS5 | 2807 | 0 | 1 | 1 | 0 | Y | PYRTWHYCG | 100 | | | | | | |
| NS5 | 2808 | 0 | 1 | 1 | 0 | Y | YRTWHYCGS | 100 | | | | | | |
| NS5 | 2809 | 0 | 1 | 1 | 0 | Y | RTWHYCGSY | 100 | | | | | | |
| NS5 | 2810 | 0.39 | 2 | 2 | 0 | Y | TWHYCGSYV | 92.31 | TWHYCGSYI | 7.69 | | | | |
| NS5 | 2811 | 0.39 | 2 | 2 | 0 | Y | WHYCGSYVT | 92.31 | WHYCGSYIT | 7.69 | | | | |
| NS5 | 2812 | 0.39 | 2 | 2 | 0 | Y | HYCGSYVTK | 92.31 | HYCGSYITK | 7.69 | | | | |
| NS5 | 2813 | 0.39 | 2 | 2 | 0 | Y | YCGSYVTKT | 92.31 | YCGSYITKT | 7.69 | | | | |
| NS5 | 2814 | 0.39 | 2 | 2 | 0 | Y | CGSYVTKTS | 92.31 | CGSYITKTS | 7.69 | | | | |
| NS5 | 2815 | 0.39 | 2 | 2 | 0 | Y | GSYVTKTSG | 92.31 | GSYITKTSG | 7.69 | | | | |
| NS5 | 2816 | 0.39 | 2 | 2 | 0 | Y | SYVTKTSGS | 92.31 | SYITKTSGS | 7.69 | | | | |
| NS5 | 2817 | 0.39 | 2 | 2 | 0 | Y | YVTKTSGSA | 92.31 | YITKTSGSA | 7.69 | | | | |
| NS5 | 2818 | 0.39 | 2 | 2 | 0 | Y | VTKTSGSAA | 92.31 | ITKTSGSAA | 7.69 | | | | |
| NS5 | 2819 | 0 | 1 | 1 | 0 | Y | TKTSGSAAS | 100 | | | | | | |
| NS5 | 2820 | 0 | 1 | 1 | 0 | Y | KTSGSAASM | 100 | | | | | | |
| NS5 | 2821 | 0.52 | 2 | 2 | 0 | Y | TSGSAASMV | 88.46 | TSGAASMI | 11.54 | | | | |
| NS5 | 2822 | 0.52 | 2 | 2 | 0 | Y | SGSAASMVN | 88.46 | SGSAASMIN | 11.54 | | | | |
| NS5 | 2823 | 0.52 | 2 | 2 | 0 | Y | GSAASMVNG | 88.46 | GSAASMING | 11.54 | | | | |
| NS5 | 2824 | 0.52 | 2 | 2 | 0 | Y | SAASMVNGV | 88.46 | SAASMINGV | 11.54 | | | | |
| NS5 | 2825 | 0.52 | 2 | 2 | 0 | Y | AASMVNGVI | 88.46 | AASMINGVI | 11.54 | | | | |
| NS5 | 2826 | 0.52 | 2 | 2 | 0 | Y | ASMVNGVIK | 88.46 | ASMINGVIK | 11.54 | | | | |
| NS5 | 2827 | 0.74 | 3 | 3 | 0 | Y | SMVNGVIKI | 84.62 | SMINGVIKI | 11.54 | SMVNGVIKL | 3.85 | | |
| NS5 | 2828 | 0.74 | 3 | 3 | 0 | Y | MVNGVIKIL | 84.62 | MINGVIKIL | 11.54 | MVNGVIKLL | 3.85 | | |
| NS5 | 2829 | 0.74 | 3 | 3 | 0 | Y | VNGVIKILT | 84.62 | INGVIKILT | 11.54 | VNGVIKLLT | 3.85 | | |

Fig. 28-112

Species: YFV (9-mers)

| prot

Fig. 28-113

Species: YFV (9-mers)

| protein | block star

Fig. 28-114

Species: YFV (9-mers)

| protein | block starting position | ent

Fig. 28-115

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2905 | 0 | 1 | 1 | 0 | Y | EEFIAKVRS | 100 | | | | | | |
| NS5 | 2906 | 0 | 1 | 1 | 0 | Y | EFIAKVRSH | 100 | | | | | | |
| NS5 | 2907 | 0 | 1 | 1 | 0 | Y | FIAKVRSHA | 100 | | | | | | |
| NS5 | 2908 | 0 | 1 | 1 | 0 | Y | IAKVRSHAA | 100 | | | | | | |
| NS5 | 2909 | 0.39 | 2 | 2 | 0 | Y | AKVRSHAAI | 92.31 | AKVRSHAAV | 7.69 | | | | |
| NS5 | 2910 | 0.39 | 2 | 2 | 0 | Y | KVRSHAAIG | 92.31 | KVRSHAAVG | 7.69 | | | | |
| NS5 | 2911 | 0.39 | 2 | 2 | 0 | Y | VRSHAAIGA | 92.31 | VRSHAAVGA | 7.69 | | | | |
| NS5 | 2912 | 0.62 | 3 | 3 | 0 | Y | RSHAAIGAY | 88.46 | RSHAAVGAF | 7.69 | RSHAAIGAF | 3.85 | | |
| NS5 | 2913 | 0.62 | 3 | 3 | 0 | Y | SHAAIGAYL | 88.46 | SHAAVGAFL | 7.69 | SHAAIGAFL | 3.85 | | |
| NS5 | 2914 | 0.62 | 3 | 3 | 0 | Y | HAAIGAYLE | 88.46 | HAAVGAFLE | 7.69 | HAAIGAFLE | 3.85 | | |
| NS5 | 2915 | 0.62 | 3 | 3 | 0 | Y | AAIGAYLEE | 88.46 | AAVGAFLEE | 7.69 | AAIGAFLEE | 3.85 | | |
| NS5 | 2916 | 0.62 | 3 | 3 | 0 | Y | AIGAYLEEQ | 88.46 | AVGAFLEEQ | 7.69 | AIGAFLEEQ | 3.85 | | |
| NS5 | 2917 | 0.85 | 4 | 4 | 0 | Y | IGAYLEEQE | 84.62 | VGAFLEEQE | 7.69 | IGAFLEEQE | 3.85 | IGAYLEEQD | 3.85 |
| NS5 | 2918 | 0.74 | 3 | 3 | 0 | Y | GAYLEEQEQ | 84.62 | GAFLEEQEQ | 11.54 | GAFLEEQDQ | 3.85 | | |
| NS5 | 2919 | 0.74 | 3 | 3 | 0 | Y | AYLEEQEQW | 84.62 | AFLEEQEQW | 11.54 | AYLEEQDQW | 3.85 | | |
| NS5 | 2920 | 0.74 | 3 | 3 | 0 | Y | YLEEQEQWK | 84.62 | FLEEQEQWK | 11.54 | YLEEQDQWK | 3.85 | | |
| NS5 | 2921 | 0.24 | 2 | 2 | 0 | Y | LEEQEQWKT | 96.15 | LEEQDQWKT | 3.85 | | | | |
| NS5 | 2922 | 0.24 | 2 | 2 | 0 | Y | EEQEQWKTA | 96.15 | EEQDQWKTA | 3.85 | | | | |
| NS5 | 2923 | 0.24 | 2 | 2 | 0 | Y | EQEQWKTAN | 96.15 | EQDQWKTAN | 3.85 | | | | |
| NS5 | 2924 | 0.24 | 2 | 2 | 0 | Y | QEQWKTANE | 96.15 | QDQWKTANE | 3.85 | | | | |
| NS5 | 2925 | 0.24 | 2 | 2 | 0 | Y | EQWKTANEA | 96.15 | DQWKTANEA | 3.85 | | | | |
| NS5 | 2926 | 0 | 1 | 1 | 0 | Y | QWKTANEAV | 100 | | | | | | |
| NS5 | 2927 | 0 | 1 | 1 | 0 | Y | WKTANEAVQ | 100 | | | | | | |
| NS5 | 2928 | 0 | 1 | 1 | 0 | Y | KTANEAVQD | 100 | | | | | | |
| NS5 | 2929 | 0 | 1 | 1 | 0 | Y | TANEAVQDP | 100 | | | | | | |

Fig. 28-116

Species: YFV (9-mers)

| prot

Fig. 28-117

Species: YFV (9-mers)

| protein | block starting position | ent

Fig. 28-118

Species: YFV (9

Fig. 28-119

Species: YFV (9-mers)

| protein | block starting position | entropy block | total peptides in block | # peptides required to cover 99% of block | gap/X fraction | 99% of block covered w

Fig. 28-120

Species: YFV (9-mers)

| protein | block starting position | block entropy | total peptides in block | # peptides required to cover 99% of block | gap/k fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3030 | 0.85 | 4 | 4 | 0 | Y | LAAMDGGGF | 84.62 | LSTKEGGGF | 7.69 | LSAKEGGGF | 3.85 | LAAMDGGGL | 3.85 |
| NS5 | 3031 | 0.85 | 4 | 4 | 0 | Y | AAMDGGGFY | 84.62 | STKEGGGFY | 7.69 | SAKEGGGFY | 3.85 | AAMDGGGLY | 3.85 |
| NS5 | 3032 | 0.85 | 4 | 4 | 0 | Y | AMDGGGFYA | 84.62 | TKEGGGFYA | 7.69 | AKEGGGFYA | 3.85 | AMDGGGLYA | 3.85 |
| NS5 | 3033 | 0.74 | 3 | 3 | 0 | Y | MDGGGFYAD | 84.62 | KEGGGFYAD | 11.54 | MDGGGLYAD | 3.85 | | |
| NS5 | 3034 | 0.74 | 3 | 3 | 0 | Y | DGGGFYADD | 84.62 | EGGGFYADD | 11.54 | DGGGLYADD | 3.85 | | |
| NS5 | 3035 | 0.24 | 2 | 2 | 0 | Y | GGGFYADDT | 96.15 | GGGLYADDT | 3.85 | | | | |
| NS5 | 3036 | 0.24 | 2 | 2 | 0 | Y | GGFYADDTA | 96.15 | GGLYADDTA | 3.85 | | | | |
| NS5 | 3037 | 0.24 | 2 | 2 | 0 | Y | GFYADDTAG | 96.15 | GLYADDTAG | 3.85 | | | | |
| NS5 | 3038 | 0.24 | 2 | 2 | 0 | Y | FYADDTAGW | 96.15 | LYADDTAGW | 3.85 | | | | |
| NS5 | 3039 | 0 | 1 | 1 | 0 | Y | YADDTAGWD | 100 | | | | | | |
| NS5 | 3040 | 0 | 1 | 1 | 0 | Y | ADDTAGWDT | 100 | | | | | | |
| NS5 | 3041 | 0 | 1 | 1 | 0 | Y | DDTAGWDTR | 100 | | | | | | |
| NS5 | 3042 | 0 | 1 | 1 | 0 | Y | DTAGWDTRI | 100 | | | | | | |
| NS5 | 3043 | 0 | 1 | 1 | 0 | Y | TAGWDTRIT | 100 | | | | | | |
| NS5 | 3044 | 0 | 1 | 1 | 0 | Y | AGWDTRITE | 100 | | | | | | |
| NS5 | 3045 | 0 | 1 | 1 | 0 | Y | GWDTRITEA | 100 | | | | | | |
| NS5 | 3046 | 0 | 1 | 1 | 0 | Y | WDTRITEAD | 100 | | | | | | |
| NS5 | 3047 | 0 | 1 | 1 | 0 | Y | DTRITEADL | 100 | | | | | | |
| NS5 | 3048 | 0 | 1 | 1 | 0 | Y | TRITEADLD | 100 | | | | | | |
| NS5 | 3049 | 0 | 1 | 1 | 0 | Y | RITEADLDD | 100 | | | | | | |
| NS5 | 3050 | 0 | 1 | 1 | 0 | Y | ITEADLDDE | 100 | | | | | | |
| NS5 | 3051 | 0 | 1 | 1 | 0 | Y | TEADLDDEQ | 100 | | | | | | |
| NS5 | 3052 | 0 | 1 | 1 | 0 | Y | EADLDDEQE | 100 | | | | | | |
| NS5 | 3053 | 0 | 1 | 1 | 0 | Y | ADLDDEQEI | 100 | | | | | | |
| NS5 | 3054 | 0.52 | 2 | 2 | 0 | Y | DLDDEQEIL | 88.46 | DLDDEQEIM | 11.54 | | | | |

Fig. 28-121

Species: YFV (9-mers)

| protein | block starting position | block entropy | total peptides in block | # peptides required to cover 99% of block | gap/X fraction | 99% of block covered w/ => 5 peptides? | block | frequency | block | frequency | block | frequency |
|---|---|---|---|---|---|---|---|---|---|---|---|---|
| NS5 | 3055 | 0.52 | 2 | 2 | 0 | Y | LDDE

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 3105 | 0.24 | 2 | 2 | 0 | Y | RDQRGSGQV | 96.15 | RDQRGRQV | 3.85 |
| NS5 | 3106 | 0.24 | 2 | 2 | 0 | Y | DQRGSGQVV | 96.15 | DQRGRQVV | 3.85 |
| NS5 | 3107 | 0.24 | 2 | 2 | 0 | Y | QRGSGQVVT | 96.15 | QRGSRQVVT | 3.85 |
| NS5 | 3108 | 0.24 | 2 | 2 | 0 | Y | RGSGQVVTY | 96.15 | RGSRQVVTY | 3.85 |
| NS5 | 3109 | 0.24 | 2 | 2 | 0 | Y | GSGQVVTYA | 96.15 | GSRQVVTYA | 3.85 |
| NS5 | 3110 | 0.24 | 2 | 2 | 0 | Y | SGQVVTYAL | 96.15 | SRQVVTYAL | 3.85 |
| NS5 | 3111 | 0.24 | 2 | 2 | 0 | Y | GQVVTYALN | 96.15 | RQVVTYALN | 3.85 |
| NS5 | 3112 | 0 | 1 | 1 | 0 | Y | QVVTYALNT | 100 | | |
| NS5 | 3113 | 0 | 1 | 1 | 0 | Y | VVTYALNTI | 100 | | |
| NS5 | 3114 | 0 | 1 | 1 | 0 | Y | VTYALNTIT | 100 | | |
| NS5 | 3115 | 0 | 1 | 1 | 0 | Y | TYALNTITN | 100 | | |
| NS5 | 3116 | 0 | 1 | 1 | 0 | Y | YALNTITNL | 100 | | |
| NS5 | 3117 | 0 | 1 | 1 | 0 | Y | ALNTITNLK | 100 | | |
| NS5 | 3118 | 0 | 1 | 1 | 0 | Y | LNTITNLKV | 100 | | |
| NS5 | 3119 | 0 | 1 | 1 | 0 | Y | NTITNLKVQ | 100 | | |
| NS5 | 3120 | 0 | 1 | 1 | 0 | Y | TITNLKVQL | 100 | | |
| NS5 | 3121 | 0 | 1 | 1 | 0 | Y | ITNLKVQLI | 100 | | |
| NS5 | 3122 | 0 | 1 | 1 | 0 | Y | TNLKVQLIR | 100 | | |
| NS5 | 3123 | 0 | 1 | 1 | 0 | Y | NLKVQLIRM | 100 | | |
| NS5 | 3124 | 0 | 1 | 1 | 0 | Y | LKVQLIRMA | 100 | | |
| NS5 | 3125 | 0 | 1 | 1 | 0 | Y | KVQLIRMAE | 100 | | |
| NS5 | 3126 | 0 | 1 | 1 | 0 | Y | VQLIRMAEA | 100 | | |
| NS5 | 3127 | 0 | 1 | 1 | 0 | Y | QLIRMAEAE | 100 | | |
| NS5 | 3128 | 0.24 | 2 | 2 | 0 | Y | LIRMAEAEM | 96.15 | LIRMAEAEN | 3.85 |
| NS5 | 3129 | 0.24 | 2 | 2 | 0 | Y | IRMAEAEMV | 96.15 | IRMAEAENV | 3.85 |

Fig. 28-124

Species: YFV (9

Fig. 28-125

Species: YFV (9-mers)

| protein | block starting position | entropy block | total

Fig. 28-126

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3194 | 0 | 1 | 1 | 0 | Y | AMSKVRKDI | 100 | | | | | | | | |
| NS5 | 3195 | 0 | 1 | 1 | 0 | Y | MSKVRKDIS | 100 | | | | | | | | |
| NS5 | 3196 | 0 | 1 | 1 | 0 | Y | SKVRKDISE | 100 | | | | | | | | |
| NS5 | 3197 | 0 | 1 | 1 | 0 | Y | KVRKDISEW | 100 | | | | | | | | |
| NS5 | 3198 | 0 | 1 | 1 | 0 | Y | VRKDISEWQ | 100 | | | | | | | | |
| NS5 | 3199 | 0 | 1 | 1 | 0 | Y | RKDISEWQP | 100 | | | | | | | | |
| NS5 | 3200 | 0 | 1 | 1 | 0 | Y | KDISEWQPS | 100 | | | | | | | | |
| NS5 | 3201 | 0 | 1 | 1 | 0 | Y | DISEWQPSK | 100 | | | | | | | | |
| NS5 | 3202 | 0.24 | 2 | 2 | 0 | Y | ISEWQPSKG | 96.15 | ISEWQPSKE | 3.85 | | | | | | |
| NS5 | 3203 | 0.24 | 2 | 2 | 0 | Y | SEWQPSKGW | 96.15 | SEWQPSKEW | 3.85 | | | | | | |
| NS5 | 3204 | 0.62 | 3 | 3 | 0 | Y | EWQPSKGWN | 88.46 | EWQPSKGWT | 7.69 | EWQPSKEWT | 3.85 | | | | |
| NS5 | 3205 | 0.62 | 3 | 3 | 0 | Y | WQPSKGWND | 88.46 | WQPSKGWTD | 7.69 | WQPSKEWTD | 3.85 | | | | |
| NS5 | 3206 | 0.62 | 3 | 3 | 0 | Y | QPSKGWNDW | 88.46 | QPSKGWTDW | 7.69 | QPSKEWTDW | 3.85 | | | | |
| NS5 | 3207 | 0.62 | 3 | 3 | 0 | Y | PSKGWNDWE | 88.46 | PSKGWTDWE | 7.69 | PSKEWTDWE | 3.85 | | | | |
| NS5 | 3208 | 0.7 | 4 | 4 | 0 | Y | SKGWNDWEN | 88.46 | SKGWTDWEN | 3.85 | SKEWTDWEN | 3.85 | SKGWTDWES | 3.85 | | |
| NS5 | 3209 | 0.7 | 4 | 4 | 0 | Y | KGWNDWENV | 88.46 | KEWTDWENV | 3.85 | KGWTDWENV | 3.85 | KGWTDWENV | 3.85 | | |
| NS5 | 3210 | 0.7 | 4 | 4 | 0 | Y | GWNDWENVP | 88.46 | EWTDWENVP | 3.85 | GWTDWENVP | 3.85 | GWTDWENVP | 3.85 | | |
| NS5 | 3211 | 0.62 | 3 | 3 | 0 | Y | WNDWENVPF | 88.46 | WTDWENVPF | 7.69 | WTDWESVPF | 3.85 | | | | |
| NS5 | 3212 | 0.62 | 3 | 3 | 0 | Y | NDWENVPFC | 88.46 | TDWENVPFC | 7.69 | TDWESVPFC | 3.85 | | | | |
| NS5 | 3213 | 0.24 | 2 | 2 | 0 | Y | DWENVPFCS | 96.15 | DWESVPFCS | 3.85 | | | | | | |
| NS5 | 3214 | 0.24 | 2 | 2 | 0 | Y | WENVPFCSH | 96.15 | WESVPFCSH | 3.85 | | | | | | |
| NS5 | 3215 | 0.47 | 3 | 3 | 0 | Y | ENVPFCSHH | 92.31 | ENVPFCSHR | 3.85 | ESVPFCSHH | 3.85 | | | | |
| NS5 | 3216 | 0.47 | 3 | 3 | 0 | Y | NVPFCSHHF | 92.31 | SVPFCSHHF | 3.85 | NVPFCSHRF | 3.85 | | | | |
| NS5 | 3217 | 0.24 | 2 | 2 | 0 | Y | VPFCSHHFH | 96.15 | VPFCSHRFH | 3.85 | | | | | | |
| NS5 | 3218 | 0.24 | 2 | 2 | 0 | Y | PFCSHHFHE | 96.15 | PFCSHRFHE | 3.85 | | | | | | |

Fig. 28-127

Species: YFV (9-mers)

| protein | block starting position | block entropy | total

Fig. 28-128

Species: YFV (9-mers)

| protein | block

Fig. 28-129

Species: YFV (9

Fig. 28-130

Species: YFV (9-mers)

| protein | block starting position

Fig. 28-131

Species: YFV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3319 | 1.12 | 4 | 4 | 0 | Y | DMLEVWNRV | 76.92 | DMLDVWNRV | 11.54 | DMLGVWNRV | 7.69 | DRLEVWNRV | 3.85 | |
| NS5 | 3320 | 1.12 | 4 | 4 | 0 | Y | MLEVWNRVW | 76.92 | MLDVWNRVW | 11.54 | MLGVWNRVW | 7.69 | RLEVWNRVW | 3.85 | |
| NS5 | 3321 | 0.89 | 3 | 3 | 0 | Y | LEVWNRVWI | 80.77 | LDVWNRVWI | 11.54 | LGVWNRVWI | 7.69 | | | |
| NS5 | 3322 | 0.89 | 3 | 3 | 0 | Y | EVWNRVWIT | 80.77 | DVWNRVWIT | 11.54 | GVWNRVWIT | 7.69 | | | |
| NS5 | 3323 | 0.52 | 2 | 2 | 0 | Y | VWNRVWITN | 88.46 | VWNRVWVLN | 11.54 | | | | | |
| NS5 | 3324 | 0.52 | 2 | 2 | 0 | Y | WNRVWITNN | 88.46 | WNRVWVLNN | 11.54 | | | | | |
| NS5 | 3325 | 0.52 | 2 | 2 | 0 | Y | NRVWITNNP | 88.46 | NRVWVLNNP | 11.54 | | | | | |
| NS5 | 3326 | 0.52 | 2 | 2 | 0 | Y | RVWITNNPH | 88.46 | RVWVLNNPH | 11.54 | | | | | |
| NS5 | 3327 | 0.52 | 2 | 2 | 0 | Y | VWITNNPHM | 88.46 | VWVLNNPHM | 11.54 | | | | | |
| NS5 | 3328 | 0.62 | 3 | 3 | 0 | Y | WITNNPHMQ | 88.46 | WVLNNPHMK | 7.69 | WVLNNPHMT | 3.85 | | | |
| NS5 | 3329 | 0.62 | 3 | 3 | 0 | Y | ITNNPHMQD | 88.46 | VLNNPHMKD | 7.69 | VLNNPHMTD | 3.85 | | | |
| NS5 | 3330 | 0.62 | 3 | 3 | 0 | Y | TNNPHMQDK | 88.46 | LNNPHMKDK | 7.69 | LNNPHMTDK | 3.85 | | | |
| NS5 | 3331 | 0.62 | 3 | 3 | 0 | Y | NNPHMQDKT | 88.46 | NNPHMKDKT | 7.69 | NNPHMTDKT | 3.85 | | | |
| NS5 | 3332 | 1.12 | 4 | 4 | 0 | Y | NPHMQDKTV | 76.92 | NPHMKDKTV | 11.54 | NPHMTDKTV | 7.69 | NPHMTDKTT | 3.85 | |
| NS5 | 3333 | 1.12 | 4 | 4 | 0 | Y | PHMQDKTVK | 76.92 | PHMKDKTVW | 11.54 | PHMKDKTTV | 7.69 | PHMTDKTTI | 3.85 | |
| NS5 | 3334 | 1.12 | 4 | 4 | 0 | Y | HMQDKTVKK | 76.92 | HMKDKTVWK | 11.54 | HMKDKTTVK | 7.69 | HMTDKTTIK | 3.85 | |
| NS5 | 3335 | 1.67 | 5 | 5 | 0 | Y | MQDKTMVKK | 61.54 | MQDKTVKE | 11.54 | MQDKTVKE | 7.69 | MKDKTTVKE | 7.69 | |
| NS5 | 3336 | 1.67 | 5 | 5 | 0 | Y | QDKTMVKKW | 61.54 | QDKTMVKEW | 15.38 | QDKTVKEW | 7.69 | KDKTTVKEW | 7.69 | |
| NS5 | 3337 | 1.67 | 5 | 5 | 0 | Y | DKTMVKKWR | 61.54 | DKTMVKEWR | 15.38 | DKTVKEWR | 7.69 | DKTTVKEWR | 7.69 | |
| NS5 | 3338 | 1.67 | 5 | 5 | 0 | Y | KTMVKKWRD | 61.54 | KTMVKEWRD | 15.38 | KTVKEWRD | 7.69 | KTTVKEWRD | 7.69 | |
| NS5 | 3339 | 1.67 | 5 | 5 | 0 | Y | TMVKKWRDV | 61.54 | TMVKEWRDV | 15.38 | TVKEWRDV | 7.69 | TTVKEWRDV | 7.69 | |
| NS5 | 3340 | 1.67 | 5 | 5 | 0 | Y | MVKKWRDVP | 61.54 | MVKEWRDVP | 15.38 | VVKEWRDVP | 7.69 | TVKEWRDVP | 7.69 | |
| NS5 | 3341 | 1.14 | 3 | 3 | 0 | Y | VKKWRDVPY | 61.54 | VKEWRDVPY | 34.62 | IKEWRDVPY | 3.85 | | | |
| NS5 | 3342 | 0.96 | 2 | 2 | 0 | Y | KKWRDVPYL | 61.54 | KEWRDVPYL | 38.46 | | | | | |
| NS5 | 3343 | 0.96 | 2 | 2 | 0 | Y | KWRDVPYLT | 61.54 | EWRDVPYLT | 38.46 | | | | | |

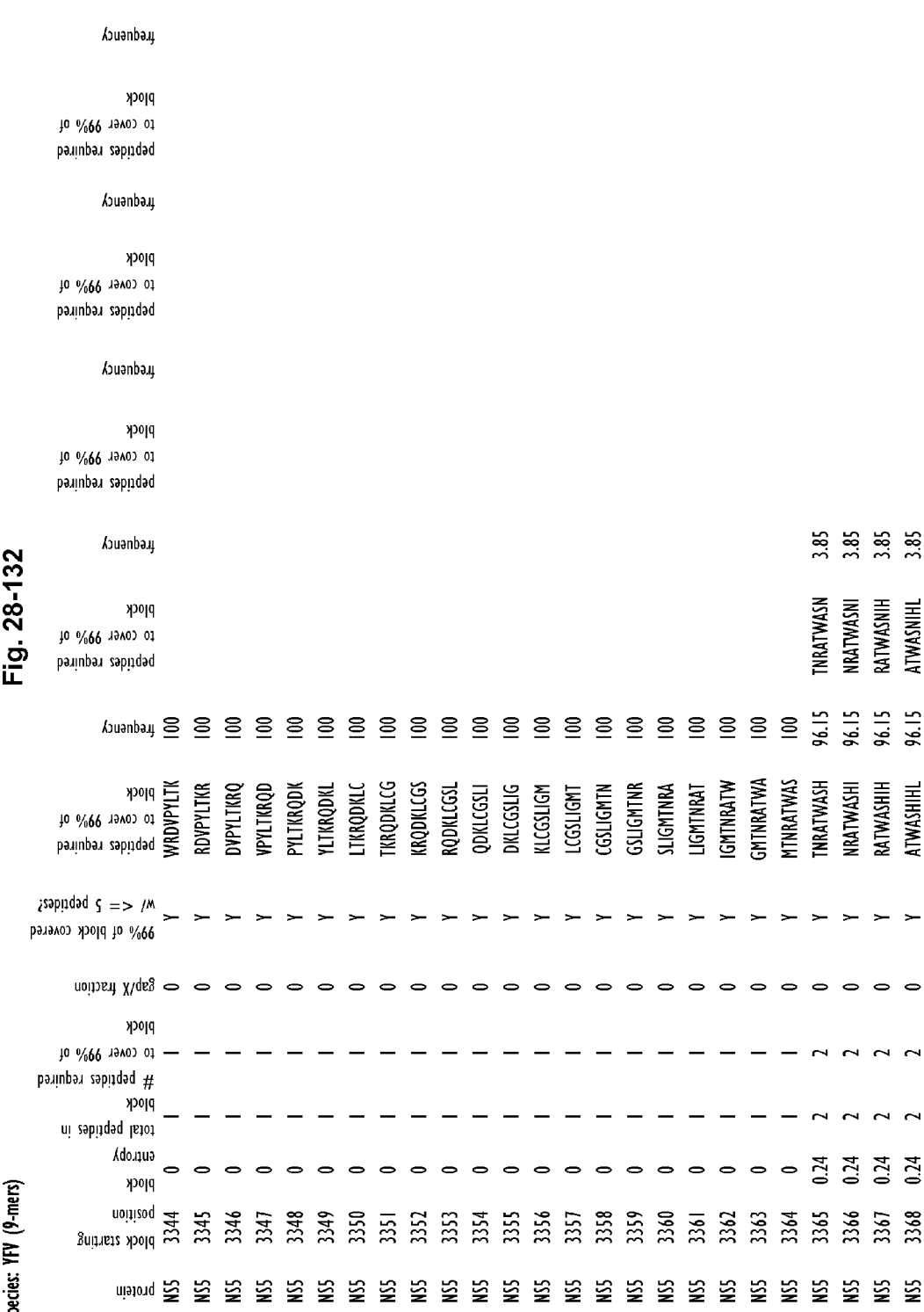

Fig. 28-133

Species: YFV (9-mers)

|

Fig. 28-134

Species: YFV (9-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3394 | 0 | 1 | 1 | 0 | Y | LTYMDRYSV | 100 | | | | | | |
| NS5 | 3395 | 0 | 1 | 1 | 0 | Y | TYMDRYSVD | 100 | | | | | | |
| NS5 | 3396 | 0 | 1 | 1 | 0 | Y | YMDRYSVDA | 100 | | | | | | |
| NS5 | 3397 | 0 | 1 | 1 | 0 | Y | MDRYSVDAD | 100 | | | | | | |
| NS5 | 3398 | 0 | 1 | 1 | 0 | Y | DRYSVDADL | 100 | | | | | | |
| NS5 | 3399 | 0 | 1 | 1 | 0 | Y | RYSVDADLQ | 100 | | | | | | |
| NS5 | 3400 | 0.96 | 2 | 2 | 0 | Y | YSVDADLQL | 61.54 | YSVDADLQP | 38.46 | | | | |
| NS5 | 3401 | 0.96 | 2 | 2 | 0 | Y | SVDADLQLG | 61.54 | SVDADLQPG | 38.46 | | | | |
| NS5 | 3402 | 0.96 | 2 | 2 | 0 | Y | VDADLQLGE | 61.54 | VDADLQPGE | 38.46 | | | | |
| NS5 | 3403 | 0.96 | 2 | 2 | 0 | Y | DADLQLGEL | 61.54 | DADLQPGEL | 38.46 | | | | |
| NS5 | 3404 | 0.96 | 2 | 2 | 0 | Y | ADLQLGELI | 61.54 | ADLQPGELI | 38.46 | | | | |

Fig. 29-1

Species: YFV (10-mers)

| protein | block starting position | entropy | total peptides in block | #

Fig. 29-2

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 26 | 0 | 1 | 1 | 0 | Y | KIKQKTKQIG | 100 | | | | | | |
| anC | 27 | 0 | 1 | 1 | 0 | Y | IKQKTKQIGN | 100 | | | | | | |
| anC | 28 | 0 | 1 | 1 | 0 | Y | KQKTKQIGNR | 100 | | | | | | |
| anC | 29 | 0 | 1 | 1 | 0 | Y | QKTKQIGNRP | 100 | | | | | | |
| anC | 30 | 0 | 1 | 1 | 0 | Y | KTKQIGNRPG | 100 | | | | | | |
| anC | 31 | 0.24 | 2 | 2 | 0 | Y | TKQIGNRPGP | 96.15 | TKQIGNRPGL | 3.85 | | | | |
| anC | 32 | 0.24 | 2 | 2 | 0 | Y | KQIGNRPGPS | 96.15 | KQIGNRPGLS | 3.85 | | | | |
| anC | 33 | 0.24 | 2 | 2 | 0 | Y | QIGNRPGPSR | 96.15 | QIGNRPGLSR | 3.85 | | | | |
| anC | 34 | 0.24 | 2 | 2 | 0 | Y | IGNRPGPSRG | 96.15 | IGNRPGLSRG | 3.85 | | | | |
| anC | 35 | 0.24 | 2 | 2 | 0 | Y | GNRPGPSRGV | 96.15 | GNRPGLSRGV | 3.85 | | | | |
| anC | 36 | 0.24 | 2 | 2 | 0 | Y | NRPGPSRGVQ | 96.15 | NRPGLSRGVQ | 3.85 | | | | |
| anC | 37 | 0.24 | 2 | 2 | 0 | Y | RPGPSRGVQG | 96.15 | RPGLSRGVQG | 3.85 | | | | |
| anC | 38 | 0.24 | 2 | 2 | 0 | Y | PGPSRGVQGF | 96.15 | PGLSRGVQGF | 3.85 | | | | |
| anC | 39 | 0.24 | 2 | 3 | 0 | Y | GPSRGVQGFI | 96.15 | GLSRGVQGFI | 3.85 | | | | |
| anC | 40 | 0.47 | 3 | 2 | 0 | Y | PSRGVQGFIF | 92.31 | LSRGVQGFIF | 3.85 | PSRGVQGFIS | 3.85 | | |
| anC | 41 | 0.24 | 2 | 2 | 0 | Y | SRGVQGFIFF | 96.15 | SRGVQGFISF | 3.85 | | | | |
| anC | 42 | 0.24 | 2 | 2 | 0 | Y | RGVQGFIFFF | 96.15 | RGVQGFISFF | 3.85 | | | | |
| anC | 43 | 0.24 | 2 | 2 | 0 | Y | GVQGFIFFFL | 96.15 | GVQGFISFFS | 3.85 | | | | |
| anC | 44 | 0.24 | 2 | 2 | 0 | Y | VQGFIFFFLF | 96.15 | VQGFISFFSF | 3.85 | | | | |
| anC | 45 | 0.24 | 2 | 2 | 0 | Y | QGFIFFFLFN | 96.15 | QGFISFFSFN | 3.85 | | | | |
| anC | 46 | 0.24 | 2 | 2 | 0 | Y | GFIFFFLFNI | 96.15 | GFISFFSFNI | 3.85 | | | | |
| anC | 47 | 0.24 | 2 | 2 | 0 | Y | FIFFFLFNIL | 96.15 | FISFFSFNIL | 3.85 | | | | |
| anC | 48 | 0.24 | 2 | 2 | 0 | Y | IFFFLFNILT | 96.15 | ISFFSFNILT | 3.85 | | | | |
| anC | 49 | 0.24 | 2 | 2 | 0 | Y | FFFLFNILTG | 96.15 | SFFSFNILTG | 3.85 | | | | |
| anC | 50 | 0.24 | 2 | 2 | 0 | Y | FFLFNILTGK | 96.15 | FFSFNILTGK | 3.85 | | | | |

Fig. 29-3

Species: YFV (10-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| anC | 51 | 0.24 | 2

Fig. 29-4

Species: YFV (10-mers)

| protein | block starting position | block ent

Fig. 29-5

Species: YFV (10-mers)

| protein | block starting position | entropy block | total peptides in block | # peptides required to cover 99% of block |

Fig. 29-6

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| pM | 144 | 0.93 | 5 | 5 | 0 | Y | FSVGTGNCTT | 84.62 | FSLGTGNCTT | 3.85 | FSIGTGNCTT | 3.85 | FSMGTGNCTT | 3.85 | FSVGAGNCTT | 3.85 |
| pM | 145 | 0.93 | 5 | 5 | 0 | Y | SVGTGNCTTN | 84.62 | SIGTGNCTTN | 3.85 | SMGTGNCTTN | 3.85 | SLGTGNCTTN | 3.85 | SVGAGNCTTN | 3.85 |
| pM | 146 | 0.93 | 5 | 5 | 0 | Y | VGTGNCTTNI | 84.62 | LGTGNCTTNI | 3.85 | MGTGNCTTNI | 3.85 | VGAGNCTTNI | 3.85 | IGTGNCTTNI | 3.85 |
| pM | 147 | 0.24 | 2 | 2 | 0 | Y | GTGNCTTNIL | 96.15 | GAGNCTTNIL | 3.85 | | | | | | |
| pM | 148 | 0.24 | 2 | 2 | 0 | Y | TGNCTTNILE | 96.15 | AGNCTTNILE | 3.85 | | | | | | |
| pM | 149 | 0 | 1 | 1 | 0 | Y | GNCTTNILEA | 100 | | | | | | | | |
| pM | 150 | 0 | 1 | 1 | 0 | Y | NCTTNILEAK | 100 | | | | | | | | |
| pM | 151 | 0 | 1 | 1 | 0 | Y | CTTNILEAKY | 100 | | | | | | | | |
| pM | 152 | 0 | 1 | 1 | 0 | Y | TTNILEAKYW | 100 | | | | | | | | |
| pM | 153 | 0 | 1 | 1 | 0 | Y | TNILEAKYWC | 100 | | | | | | | | |
| pM | 154 | 0 | 1 | 1 | 0 | Y | NILEAKYWCP | 100 | | | | | | | | |
| pM | 155 | 0 | 1 | 1 | 0 | Y | ILEAKYWCPD | 100 | | | | | | | | |
| pM | 156 | 0 | 1 | 1 | 0 | Y | LEAKYWCPDS | 100 | | | | | | | | |
| pM | 157 | 0 | 1 | 1 | 0 | Y | EAKYWCPDSM | 100 | | | | | | | | |
| pM | 158 | 0 | 1 | 1 | 0 | Y | AKYWCPDSME | 100 | | | | | | | | |
| pM | 159 | 0 | 1 | 1 | 0 | Y | KYWCPDSMEY | 100 | | | | | | | | |
| pM | 160 | 0 | 1 | 1 | 0 | Y | YWCPDSMEYN | 100 | | | | | | | | |
| pM | 161 | 0 | 1 | 1 | 0 | Y | WCPDSMEYNC | 100 | | | | | | | | |
| pM | 162 | 0 | 1 | 1 | 0 | Y | CPDSMEYNCP | 100 | | | | | | | | |
| pM | 163 | 0 | 1 | 1 | 0 | Y | PDSMEYNCPN | 100 | | | | | | | | |
| pM | 164 | 0 | 1 | 1 | 0 | Y | DSMEYNCPNL | 100 | | | | | | | | |
| pM | 165 | 0 | 1 | 1 | 0 | Y | SMEYNCPNLS | 100 | | | | | | | | |
| pM | 166 | 0 | 1 | 1 | 0 | Y | MEYNCPNLSP | 100 | | | | | | | | |
| pM | 167 | 0 | 1 | 1 | 0 | Y | EYNCPNLSPR | 100 | | | | | | | | |
| pM | 168 | 0 | 1 | 1 | 0 | Y | YNCPNLSPRE | 100 | | | | | | | | |

Fig. 29-7

Species: YFV (10

Fig. 29-8

Species: YFV (10-mers)

| protein | block starting position | entropy block | total peptides in block | # peptides required to cover 99% of block | gap/X fraction 99% of block | covered w/ <= 5 peptides? | block | frequency | block | frequency | block | frequency | block | frequency | block | frequency |
|---|---|---|---|---|---|---|---|---|---|---|---|---|---|---|---|---|
| prM | 194 | 0.74 | 3 | 3 | 0 | Y | VAYGKCDSAG | 84.62 | VAYGKCDAVG | 11.54 | VTYGKCDSAG | 3.85 | | | | |
| prM | 195 | 0.74 | 3 | 3 | 0 | Y | AYGKCDSAGR | 84.62 | AYGRCDAVGR | 11.54 | TYGKCDSAGR | 3.85 | | | | |
| prM | 196 | 0.52 | 2 | 2 | 0 | Y | YGKCDSAGRS | 88.46 | YGRCDAVGRS | 11.54 | | | | | | |
| prM | 197 | 0.52 | 2 | 2 | 0 | Y | GKCDSAGRSR | 88.46 | GRCDAVGRSK | 11.54 | | | | | | |
| prM | 198 | 0.52 | 2 | 2 | 0 | Y | KCDSAGRSRS | 88.46 | RCDAVGRSKR | 11.54 | | | | | | |
| prM | 199 | 0.52 | 2 | 2 | 0 | Y | CDSAGRSRRS | 88.46 | CDAVGRSKRS | 11.54 | | | | | | |
| prM | 200 | 0.52 | 2 | 2 | 0 | Y | DSAGRSRSR | 88.46 | DAVGRSKRSR | 11.54 | | | | | | |
| prM | 201 | 0.52 | 2 | 2 | 0 | Y | SAGRSRSR | 88.46 | AVGRSKRSRR | 11.54 | | | | | | |
| prM | 202 | 0.52 | 2 | 2 | 0 | Y | AGRSRSRSR | 88.46 | VGRSKRSRRA | 11.54 | | | | | | |
| prM | 203 | 0.52 | 2 | 2 | 0 | Y | GRSRSRRAI | 88.46 | GRSKRSRRAI | 11.54 | | | | | | |
| prM | 204 | 0.52 | 2 | 2 | 0 | Y | RSRSRRAID | 88.46 | RSKRSRRAID | 11.54 | | | | | | |
| prM | 205 | 0.52 | 2 | 2 | 0 | Y | SRSRRAIDL | 88.46 | SKRSRRAIDL | 11.54 | | | | | | |
| prM | 206 | 0.52 | 2 | 2 | 0 | Y | RSRRAIDLP | 88.46 | KRSRRAIDLP | 11.54 | | | | | | |
| prM | 207 | 0 | 1 | 1 | 0 | Y | RSRRAIDLPT | 100 | | | | | | | | |
| prM | 208 | 0 | 1 | 1 | 0 | Y | SRRAIDLPTH | 100 | | | | | | | | |
| prM | 209 | 0 | 1 | 1 | 0 | Y | RRAIDLPTHE | 100 | | | | | | | | |
| prM | 210 | 0 | 1 | 1 | 0 | Y | RAIDLPTHEN | 100 | | | | | | | | |
| prM | 211 | 0 | 1 | 1 | 0 | Y | AIDLPTHENH | 100 | | | | | | | | |
| prM | 212 | 0 | 1 | 1 | 0 | Y | IDLPTHENHG | 100 | | | | | | | | |
| prM | 213 | 0 | 1 | 1 | 0 | Y | DLPTHENHGL | 100 | | | | | | | | |
| prM | 214 | 0 | 1 | 1 | 0 | Y | LPTHENHGLK | 100 | | | | | | | | |
| prM | 215 | 0 | 1 | 1 | 0 | Y | PTHENHGLKT | 100 | | | | | | | | |
| prM | 216 | 0 | 1 | 1 | 0 | Y | THENHGLKTR | 100 | | | | | | | | |
| prM | 217 | 0 | 1 | 1 | 0 | Y | HENHGLKTRQ | 100 | | | | | | | | |
| prM | 218 | 0 | 1 | 1 | 0 | Y | ENHGLKTRQE | 100 | | | | | | | | |

Fig. 29-9

Species: YFV (10-mers)

| protein | block starting position | entropy block | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| prM | 219 | 0 | 1 | 1 | 0 | Y | NHGLKTRQEK | 100 | | | | | | |
| prM | 220 | 0 | 1 | 1 | 0 | Y | HGLKTRQEKW | 100 | | | | | | |
| prM | 221 | 0 | 1 | 1 | 0 | Y | GLKTRQEKWM | 100 | | | | | | |
| prM | 222 | 0.24 | 2 | 2 | 0 | Y | LKTRQEKWMT | 96.15 | LKTRQEKWMA | 3.85 | | | | |
| prM | 223 | 0.24 | 2 | 2 | 0 | Y | KTRQEKWMTG | 96.15 | KTRQEKWMAG | 3.85 | | | | |
| prM | 224 | 0.24 | 2 | 2 | 0 | Y | TRQEKWMTGR | 96.15 | TRQEKWMAGR | 3.85 | | | | |
| prM | 225 | 0.24 | 2 | 2 | 0 | Y | RQEKWMTGRM | 96.15 | RQEKWMAGRM | 3.85 | | | | |
| prM | 226 | 0.24 | 2 | 2 | 0 | Y | QEKWMTGRMG | 96.15 | QEKWMAGRMG | 3.85 | | | | |
| prM | 227 | 0.24 | 2 | 2 | 0 | Y | EKWMTGRMGE | 96.15 | EKWMAGRMGE | 3.85 | | | | |
| prM | 228 | 0.24 | 2 | 2 | 0 | Y | KWMTGRMGER | 96.15 | KWMAGRMGER | 3.85 | | | | |
| prM | 229 | 0.24 | 2 | 2 | 0 | Y | WMTGRMGERQ | 96.15 | WMAGRMGERQ | 3.85 | | | | |
| prM | 230 | 0.24 | 2 | 2 | 0 | Y | MTGRMGERQL | 96.15 | MAGRMGERQL | 3.85 | | | | |
| prM | 231 | 0.24 | 2 | 2 | 0 | Y | TGRMGERQLQ | 96.15 | AGRMGERQLQ | 3.85 | | | | |
| prM | 232 | 0 | 1 | 1 | 0 | Y | GRMGERQLQK | 100 | | | | | | |
| prM | 233 | 0 | 1 | 1 | 0 | Y | RMGERQLQKI | 100 | | | | | | |
| prM | 234 | 0 | 1 | 1 | 0 | Y | MGERQLQKIE | 100 | | | | | | |
| prM | 235 | 0 | 1 | 1 | 0 | Y | GERQLQKIER | 100 | | | | | | |
| prM | 236 | 0 | 1 | 1 | 0 | Y | ERQLQKIERW | 100 | | | | | | |
| prM | 237 | 0.89 | 2 | 2 | 0 | Y | RQLQKIERWF | 69.23 | RQLQKIERWL | 30.77 | | | | |
| prM | 238 | 0.89 | 2 | 2 | 0 | Y | QLQKIERWFV | 69.23 | QLQKIERWLV | 30.77 | | | | |
| prM | 239 | 0.89 | 2 | 2 | 0 | Y | LQKIERWFVR | 69.23 | LQKIERWLVR | 30.77 | | | | |
| prM | 240 | 0.89 | 2 | 2 | 0 | Y | QKIERWFVRN | 69.23 | QKIERWLVRN | 30.77 | | | | |
| prM | 241 | 0.89 | 2 | 2 | 0 | Y | KIERWFVRNP | 69.23 | KIERWLVRNP | 30.77 | | | | |
| prM | 242 | 0.89 | 2 | 2 | 0 | Y | IERWFVRNPF | 69.23 | IERWLVRNPF | 30.77 | | | | |
| prM | 243 | 0.89 | 2 | 2 | 0 | Y | ERWFVRNPFF | 69.23 | ERWLVRNPFF | 30.77 | | | | |

Fig. 29-10

Species: YFV (10-mers)

| protein | block starting position | entropy block | total peptides in block | # peptides required to cover 99% of block | gap/X fraction | 99% of block covered w/ <= 5 peptides? | block (to cover 99%) | frequency | block (to cover 99%) | frequency | block (to cover 99%) | frequency | block (to cover 99%) | frequency |
|---|---|---|---|---|---|---|---|---|---|---|---|---|---|---|
| prM | 244 | 0.89 | 2 | 2 | 0 | Y | RWFVRNPFFA | 69.23 | RWLVRNPFFA | 30.77 | | | | |
| prM | 245 | 1.06 | 3 | 3 | 0 | Y | WFVRNPFFAV | 69.23 | WLVRNPFFAV | 26.92 | WLVRNPFFAI | 3.85 | | |
| prM | 246 | 1.06 | 3 | 3 | 0 | Y | FVRNPFFAVT | 69.23 | LVRNPFFAVT | 26.92 | LVRNPFFAIT | 3.85 | | |
| prM | 247 | 0.24 | 2 | 2 | 0 | Y | VRNPFFAVTA | 96.15 | VRNPFFAITA | 3.85 | | | | |
| prM | 248 | 0.24 | 2 | 2 | 0 | Y | RNPFFAVTAL | 96.15 | RNPFFAITAL | 3.85 | | | | |
| prM | 249 | 0.74 | 3 | 3 | 0 | Y | NPFFAVTALT | 84.62 | NPFFAVTALA | 11.54 | NPFFAITALA | 3.85 | | |
| prM | 250 | 0.74 | 3 | 3 | 0 | Y | PFFAVTALTI | 84.62 | PFFAVTALAI | 11.54 | PFFAITALAI | 3.85 | | |
| prM | 251 | 0.74 | 3 | 3 | 0 | Y | FFAVTALTIA | 84.62 | FFAVTALAIA | 11.54 | FFAITALAIA | 3.85 | | |
| prM | 252 | 0.74 | 3 | 3 | 0 | Y | FAVTALTIAY | 84.62 | FAVTALAIAY | 11.54 | FAITALAIAY | 3.85 | | |
| prM | 253 | 0.74 | 3 | 3 | 0 | Y | AVTALTIAYL | 84.62 | AVTALAIAYL | 11.54 | AITALAIAYL | 3.85 | | |
| prM | 254 | 0.74 | 3 | 3 | 0 | Y | VTALTIAYLV | 84.62 | VTALAIAYLV | 11.54 | ITALAIAYLV | 3.85 | | |
| prM | 255 | 0.62 | 2 | 2 | 0 | Y | TALTIAYLVG | 84.62 | TALAIAYLVG | 15.38 | | | | |
| prM | 256 | 0.74 | 3 | 3 | 0 | Y | ALTIAYLVGS | 84.62 | ALAIAYLVGN | 11.54 | ALAIAYLVGS | 3.85 | | |
| prM | 257 | 0.74 | 3 | 3 | 0 | Y | LTIAYLVGSN | 84.62 | LAIAYLVGNN | 11.54 | LAIAYLVGN | 3.85 | | |
| prM | 258 | 0.93 | 5 | 5 | 0 | Y | TIAYLVGSNM | 84.62 | AIAYLVGNNM | 3.85 | AIAYLVGSNM | 3.85 | AIAYLVGNNM | 3.85 | AIAYLVGNNT | 3.85 |
| prM | 259 | 0.7 | 4 | 4 | 0 | Y | IAYLVGSNMT | 88.46 | IAYLVGNNKT | 3.85 | IAYLVGNNMT | 3.85 | IAYLVGNNMT | 3.85 | |
| prM | 260 | 0.7 | 4 | 4 | 0 | Y | AYLVGSNMTQ | 88.46 | AYLVGNNMTQ | 3.85 | AYLVGNNKTQ | 3.85 | AYLVGNNTQ | 3.85 | |
| prM | 261 | 0.7 | 4 | 4 | 0 | Y | YLVGSNMTQR | 88.46 | YLVGNNMTQR | 3.85 | YLVGNNKTQR | 3.85 | YLVGNNMTQR | 3.85 | |
| prM | 262 | 0.7 | 4 | 4 | 0 | Y | LVGSNMTQRV | 88.46 | LVGNNMTQRV | 3.85 | LVGNNKTQRV | 3.85 | LVGNNMTQRV | 3.85 | |
| prM | 263 | 0.7 | 4 | 4 | 0 | Y | VGSNMTQRVV | 88.46 | VGNNMTQRVV | 3.85 | VGNNKTQRV | 3.85 | VGNNMTQRVV | 3.85 | |
| prM | 264 | 0.7 | 4 | 4 | 0 | Y | GSNMTQRVVI | 88.46 | GNNMTQRVVI | 3.85 | GNNKTQRVVI | 3.85 | GNNKTQRVVI | 3.85 | |
| prM | 265 | 0.7 | 4 | 4 | 0 | Y | SNMTQRVVIA | 88.46 | NNMTQRVVIA | 3.85 | NNMTQRVVIA | 3.85 | NNKTQRVVIA | 3.85 | |
| prM | 266 | 0.47 | 3 | 3 | 0 | Y | NMTQRVVIAL | 92.31 | NKTQRVVIAL | 3.85 | NTQRVVIAL | 3.85 | | |
| prM | 267 | 0.47 | 3 | 3 | 0 | Y | MTQRVVIALL | 92.31 | TTQRVVIALL | 3.85 | KTQRVVIALL | 3.85 | | |
| prM | 268 | 0 | 1 | 1 | 0 | Y | TQRVVIALLV | 100 | | | | | | |

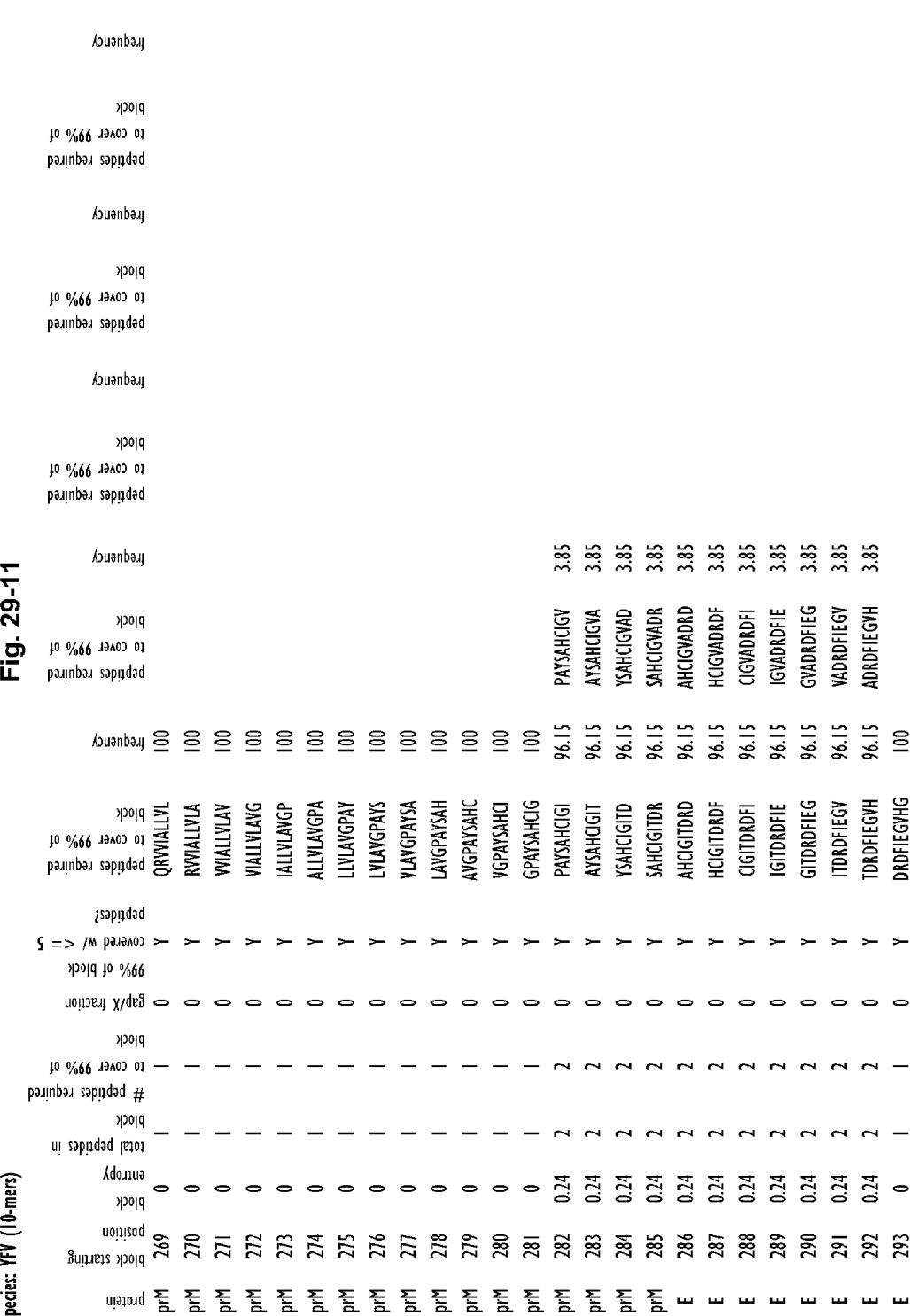

Fig. 29-12

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

Fig. 29-13

Species: YFV (10-mers)

| protein | block starting position | block entropy | total

Fig. 29-14

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block

Fig. 29-15

Species: YFV (10-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|

Fig. 29-16

Species: YFV (10-mers)

| protein | block starting position | entropy | total peptides in block | # peptides required to cover 99% of block | gap/X fraction | cov

Fig. 29-17

Species: YFV (10-mers)

| protein | block starting position

Fig. 29-18

Species: YFV (10-mers)

| protein | block starting position | block entropy | total peptides in block | # peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| E | 444 | 0.24 | 2 | 2 | 0 | Y | LKFDALSGSQ | 96.15 | LKFDV

Fig. 29-19

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 469 | 0 | 1 | 1 | 0 | Y | VQTAVDFGNS | 100 | | | | | | |
| E | 470 | 0 | 1 | 1 | 0 | Y | QTAVDFGNSY | 100 | | | | | | |
| E | 471 | 0 | 1 | 1 | 0 | Y | TAVDFGNSYI | 100 | | | | | | |
| E | 472 | 0 | 1 | 1 | 0 | Y | AVDFGNSYIA | 100 | | | | | | |
| E | 473 | 0 | 1 | 1 | 0 | Y | VDFGNSYIAE | 100 | | | | | | |
| E | 474 | 0 | 1 | 1 | 0 | Y | DFGNSYIAEM | 100 | | | | | | |
| E | 475 | 0 | 1 | 1 | 0 | Y | FGNSYIAEME | 100 | | | | | | |
| E | 476 | 0.96 | 2 | 2 | 0 | Y | GNSYIAEMET | 61.54 | GNSYIAEMEK | 38.46 | | | | |
| E | 477 | 1.3 | 3 | 3 | 0 | Y | NSYIAEMETE | 61.54 | NSYIAEMEKE | 26.92 | NSYIAEMEKD | 11.54 | | |
| E | 478 | 1.3 | 3 | 3 | 0 | Y | SYIAEMETES | 61.54 | SYIAEMEKES | 26.92 | SYIAEMEKDS | 11.54 | | |
| E | 479 | 1.3 | 3 | 3 | 0 | Y | YIAEMETESW | 61.54 | YIAEMEKESW | 26.92 | YIAEMEKDSW | 11.54 | | |
| E | 480 | 1.3 | 3 | 3 | 0 | Y | IAEMETESWI | 61.54 | IAEMEKESWI | 26.92 | IAEMEKDSWI | 11.54 | | |
| E | 481 | 1.3 | 3 | 3 | 0 | Y | AEMETESWIV | 61.54 | AEMEKESWIV | 26.92 | AEMEKDSWIV | 11.54 | | |
| E | 482 | 1.3 | 3 | 3 | 0 | Y | EMETESWIVD | 61.54 | EMEKESWIVD | 26.92 | EMEKDSWIVD | 11.54 | | |
| E | 483 | 1.3 | 3 | 3 | 0 | Y | METESWIVDR | 61.54 | MEKESWIVDR | 26.92 | MEKDSWIVDR | 11.54 | | |
| E | 484 | 1.3 | 3 | 3 | 0 | Y | ETESWIVDRQ | 61.54 | EKESWIVDRQ | 26.92 | EKDSWIVDRQ | 11.54 | | |
| E | 485 | 1.3 | 3 | 3 | 0 | Y | TESWIVDRQW | 61.54 | KESWIVDRQW | 26.92 | KDSWIVDRQW | 11.54 | | |
| E | 486 | 0.52 | 2 | 2 | 0 | Y | ESWIVDRQWA | 88.46 | DSWIVDRQWA | 11.54 | | | | |
| E | 487 | 0 | 1 | 1 | 0 | Y | SWIVDRQWAQ | 100 | | | | | | |
| E | 488 | 0 | 1 | 1 | 0 | Y | WIVDRQWAQD | 100 | | | | | | |
| E | 489 | 0 | 1 | 1 | 0 | Y | IVDRQWAQDL | 100 | | | | | | |
| E | 490 | 0 | 1 | 1 | 0 | Y | VDRQWAQDLT | 100 | | | | | | |
| E | 491 | 0 | 1 | 1 | 0 | Y | DRQWAQDLTL | 100 | | | | | | |
| E | 492 | 0 | 1 | 1 | 0 | Y | RQWAQDLTLP | 100 | | | | | | |
| E | 493 | 0 | 1 | 1 | 0 | Y | QWAQDLTLPW | 100 | | | | | | |

Fig. 29-20

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 494 | 0 | 1 | 1 | 0 | Y | WAQDLTLPWQ | 100 | | | | | | |
| E | 495 | 0 | 1 | 1 | 0 | Y | AQDLTLPWQS | 100 | | | | | | |
| E | 496 | 0 | 1 | 1 | 0 | Y | QDLTLPWQSG | 100 | | | | | | |
| E | 497 | 0 | 1 | 1 | 0 | Y | DLTLPWQSGS | 100 | | | | | | |
| E | 498 | 0 | 1 | 1 | 0 | Y | LTLPWQSGSG | 100 | | | | | | |
| E | 499 | 0 | 1 | 1 | 0 | Y | TLPWQSGSGG | 100 | | | | | | |
| E | 500 | 0.52 | 2 | 2 | 0 | Y | LPWQSGSGGV | 88.46 | LPWQSGSGGI | 11.54 | | | | |
| E | 501 | 0.52 | 2 | 2 | 0 | Y | PWQSGSGGVW | 88.46 | PWQSGSGGIW | 11.54 | | | | |
| E | 502 | 0.52 | 2 | 2 | 0 | Y | WQSGSGGVWR | 88.46 | WQSGSGGIWR | 11.54 | | | | |
| E | 503 | 0.74 | 3 | 3 | 0 | Y | QSGSGGVWRE | 84.62 | QSGSGGIWRE | 11.54 | QSGSGGWWRG | 3.85 | | |
| E | 504 | 0.74 | 3 | 3 | 0 | Y | SGSGGVWREM | 84.62 | SGSGGIWREM | 11.54 | SGSGGVWRGM | 3.85 | | |
| E | 505 | 0.74 | 3 | 3 | 0 | Y | GSGGVWREMH | 84.62 | GSGGIWREMH | 11.54 | GSGGVWRGMH | 3.85 | | |
| E | 506 | 0.74 | 3 | 3 | 0 | Y | SGGVWREMHH | 84.62 | SGGIWREMHH | 11.54 | SGGVWRGMHH | 3.85 | | |
| E | 507 | 0.74 | 3 | 3 | 0 | Y | GGVWREMHHL | 84.62 | GGIWREMHHL | 11.54 | GGVWRGMHHL | 3.85 | | |
| E | 508 | 0.74 | 3 | 3 | 0 | Y | GVWREMHHLV | 84.62 | GIWREMHHLV | 11.54 | GVWRGMHHLV | 3.85 | | |
| E | 509 | 0.24 | 2 | 2 | 0 | Y | VWREMHHLVE | 84.62 | IWREMHHLVE | 11.54 | VWRGMHHLVE | 3.85 | | |
| E | 510 | 0.24 | 2 | 2 | 0 | Y | WREMHHLVEF | 96.15 | WRGMHHLVEF | 3.85 | | | | |
| E | 511 | 0.24 | 2 | 2 | 0 | Y | REMHHLVEFE | 96.15 | RGMHHLVEFE | 3.85 | | | | |
| E | 512 | 0.24 | 2 | 2 | 0 | Y | EMHHLVEFEP | 96.15 | GMHHLVEFEP | 3.85 | | | | |
| E | 513 | 0 | 1 | 1 | 0 | Y | MHHLVEFEPP | 100 | | | | | | |
| E | 514 | 0 | 1 | 1 | 0 | Y | HHLVEFEPPH | 100 | | | | | | |
| E | 515 | 0 | 1 | 1 | 0 | Y | HLVEFEPPHA | 100 | | | | | | |
| E | 516 | 0.24 | 2 | 2 | 0 | Y | LVEFEPPHAA | 96.15 | LVEFEPPHAV | 3.85 | | | | |
| E | 517 | 0.24 | 2 | 2 | 0 | Y | VEFEPPHAAT | 96.15 | VEFEPPHAVT | 3.85 | | | | |
| E | 518 | 0.24 | 2 | 2 | 0 | Y | EFEPPHAATI | 96.15 | EFEPPHAVTI | 3.85 | | | | |

Fig. 29-21

Species: YFV (10-mers)

| protein | block starting position | entropy in block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 519 | 0.24 | 2 | 2 | 0 | Y | FEPPHAATIR | 96.15 | FEPPHAVTIR | 3.85 | | | | |
| E | 520 | 0.24 | 2 | 2 | 0 | Y | EPPHAATIRV | 96.15 | EPPHAVTIRV | 3.85 | | | | |
| E | 521 | 0.24 | 2 | 2 | 0 | Y | PPHAATIRVL | 96.15 | PPHAVTIRVL | 3.85 | | | | |
| E | 522 | 0.24 | 2 | 2 | 0 | Y | PHAATIRVLA | 96.15 | PHAVTIRVLA | 3.85 | | | | |
| E | 523 | 0.24 | 2 | 2 | 0 | Y | HAATIRVLAL | 96.15 | HAVTIRVLAL | 3.85 | | | | |
| E | 524 | 0.24 | 2 | 2 | 0 | Y | AATIRVLALG | 96.15 | AVTIRVLALG | 3.85 | | | | |
| E | 525 | 0.62 | 3 | 3 | 0 | Y | ATIRVLALGD | 88.46 | ATIRVLALGD | 7.69 | VTIRVLALGN | 3.85 | | |
| E | 526 | 0.39 | 2 | 2 | 0 | Y | TIRVLALGNQ | 92.31 | TIRVLALGDQ | 7.69 | | | | |
| E | 527 | 0.39 | 2 | 2 | 0 | Y | IRVLALGNQE | 92.31 | IRVLALGDQE | 7.69 | | | | |
| E | 528 | 0.39 | 2 | 2 | 0 | Y | RVLALGNQEG | 92.31 | RVLALGDQEG | 7.69 | | | | |
| E | 529 | 0.39 | 2 | 2 | 0 | Y | VLALGNQEGS | 92.31 | VLALGDQEGS | 7.69 | | | | |
| E | 530 | 0.39 | 2 | 2 | 0 | Y | LALGNQEGSL | 92.31 | LALGDQEGSL | 7.69 | | | | |
| E | 531 | 0.39 | 2 | 2 | 0 | Y | ALGNQEGSLK | 92.31 | ALGDQEGSLK | 7.69 | | | | |
| E | 532 | 0.39 | 2 | 2 | 0 | Y | LGNQEGSLKT | 92.31 | LGDQEGSLKT | 7.69 | | | | |
| E | 533 | 0.39 | 2 | 2 | 0 | Y | GNQEGSLKTA | 92.31 | GDQEGSLKTA | 7.69 | | | | |
| E | 534 | 0.39 | 2 | 2 | 0 | Y | NQEGSLKTAL | 92.31 | DQEGSLKTAL | 7.69 | | | | |
| E | 535 | 0 | 1 | 1 | 0 | Y | QEGSLKTALT | 100 | | | | | | |
| E | 536 | 0 | 1 | 1 | 0 | Y | EGSLKTALTG | 100 | | | | | | |
| E | 537 | 0 | 1 | 1 | 0 | Y | GSLKTALTGA | 100 | | | | | | |
| E | 538 | 0 | 1 | 1 | 0 | Y | SLKTALTGAM | 100 | | | | | | |
| E | 539 | 0 | 1 | 1 | 0 | Y | LKTALTGAMR | 100 | | | | | | |
| E | 540 | 0 | 1 | 1 | 0 | Y | KTALTGAMRV | 100 | | | | | | |
| E | 541 | 0 | 1 | 1 | 0 | Y | TALTGAMRVT | 100 | | | | | | |
| E | 542 | 0 | 1 | 1 | 0 | Y | ALTGAMRVTK | 100 | | | | | | |
| E | 543 | 0 | 1 | 1 | 0 | Y | LTGAMRVTKD | 100 | | | | | | |

Fig. 29-22

Species: YFV (10-mers)

| protein | block starting position | block entropy | total

Fig. 29-23

Species: YFV (10-mers)

| protein | block starting position | entropy |

Fig. 29-24

Species: YFV (10

Fig. 29-25

Species: YFV (10-mers)

| protein | block star

Fig. 29-26

Species: YFV (10-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 644 | 0 | 1 | 1 | 0 | Y | NDDEVLIEVN | 100 | | | | | | |
| E | 645 | 0 | 1 | 1 | 0 | Y | DDEVLIEVNP | 100 | | | | | | |
| E | 646 | 0 | 1 | 1 | 0 | Y | DEVLIEVNPP | 100 | | | | | | |
| E | 647 | 0 | 1 | 1 | 0 | Y | EVLIEVNPPF | 100 | | | | | | |
| E | 648 | 0 | 1 | 1 | 0 | Y | VLIEVNPPFG | 100 | | | | | | |
| E | 649 | 0 | 1 | 1 | 0 | Y | LIEVNPPFGD | 100 | | | | | | |
| E | 650 | 0 | 1 | 1 | 0 | Y | IEVNPPFGDS | 100 | | | | | | |
| E | 651 | 0 | 1 | 1 | 0 | Y | EVNPPFGDSY | 100 | | | | | | |
| E | 652 | 0 | 1 | 1 | 0 | Y | VNPPFGDSYI | 100 | | | | | | |
| E | 653 | 0 | 1 | 1 | 0 | Y | NPPFGDSYII | 100 | | | | | | |
| E | 654 | 0.24 | 2 | 2 | 0 | Y | PPFGDSYIIV | 96.15 | PPFGDSYIII | 3.85 | | | | |
| E | 655 | 0.24 | 2 | 2 | 0 | Y | PFGDSYIIVG | 96.15 | PFGDSYIIIG | 3.85 | | | | |
| E | 656 | 1.14 | 3 | 3 | 0 | Y | FGDSYIIVGR | 61.54 | FGDSYIIVGT | 34.62 | FGDSYIIIGT | 3.85 | | |
| E | 657 | 1.14 | 3 | 3 | 0 | Y | GDSYIIVGRG | 61.54 | GDSYIIVGTG | 34.62 | GDSYIIIGTG | 3.85 | | |
| E | 658 | 1.14 | 3 | 3 | 0 | Y | DSYIIVGRGD | 61.54 | DSYIIVGTGD | 34.62 | DSYIIIGTGD | 3.85 | | |
| E | 659 | 1.14 | 3 | 3 | 0 | Y | SYIIVGRGDS | 61.54 | SYIIVGTGDS | 34.62 | SYIIIGTGDS | 3.85 | | |
| E | 660 | 1.14 | 3 | 3 | 0 | Y | YIIVGRGDSR | 61.54 | YIIVGTGDSR | 34.62 | YIIIGTGDSR | 3.85 | | |
| E | 661 | 1.14 | 3 | 3 | 0 | Y | IIVGRGDSRL | 61.54 | IIVGTGDSRL | 34.62 | IIIGTGDSRL | 3.85 | | |
| E | 662 | 1.14 | 3 | 3 | 0 | Y | IVGRGDSRLT | 61.54 | IVGTGDSRLT | 34.62 | IIGTGDSRLT | 3.85 | | |
| E | 663 | 1.14 | 3 | 2 | 0 | Y | VGRGDSRLTY | 61.54 | VGTGDSRLTY | 34.62 | IGTGDSRLTY | 3.85 | | |
| E | 664 | 0.96 | 2 | 2 | 0 | Y | GRGDSRLTYQ | 61.54 | GTGDSRLTYQ | 38.46 | | | | |
| E | 665 | 0.96 | 2 | 2 | 0 | Y | RGDSRLTYQW | 61.54 | TGDSRLTYQW | 38.46 | | | | |
| E | 666 | 0 | 1 | 1 | 0 | Y | GDSRLTYQWH | 100 | | | | | | |
| E | 667 | 0 | 1 | 1 | 0 | Y | DSRLTYQWHK | 100 | | | | | | |
| E | 668 | 0 | 1 | 1 | 0 | Y | SRLTYQWHKE | 100 | | | | | | |

Fig. 29-27

Species: YFV (10-mers)

| protein | block starting position | entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 669 | 0 | 1 | 1 | 0 | Y | RLTYQWHKEG | 100 | | | | | | |
| E | 670 | 0 | 1 | 1 | 0 | Y | LTYQWHKEGS | 100 | | | | | | |
| E | 671 | 0 | 1 | 1 | 0 | Y | TYQWHKEGSS | 100 | | | | | | |
| E | 672 | 0 | 1 | 1 | 0 | Y | YQWHKEGSSI | 100 | | | | | | |
| E | 673 | 0 | 1 | 1 | 0 | Y | QWHKEGSSIG | 100 | | | | | | |
| E | 674 | 0 | 1 | 1 | 0 | Y | WHKEGSSIGK | 100 | | | | | | |
| E | 675 | 0 | 1 | 1 | 0 | Y | HKEGSSIGKL | 100 | | | | | | |
| E | 676 | 0 | 1 | 1 | 0 | Y | KEGSSIGKLF | 100 | | | | | | |
| E | 677 | 0 | 1 | 1 | 0 | Y | EGSSIGKLFT | 100 | | | | | | |
| E | 678 | 0 | 1 | 1 | 0 | Y | GSSIGKLFTQ | 100 | | | | | | |
| E | 679 | 0 | 1 | 1 | 0 | Y | SSIGKLFTQT | 100 | | | | | | |
| E | 680 | 0 | 1 | 1 | 0 | Y | SIGKLFTQTM | 100 | | | | | | |
| E | 681 | 0 | 1 | 1 | 0 | Y | IGKLFTQTMK | 100 | | | | | | |
| E | 682 | 0 | 1 | 1 | 0 | Y | GKLFTQTMKG | 100 | | | | | | |
| E | 683 | 0.89 | 2 | 2 | 0 | Y | KLFTQTMKGV | 69.23 | KLFTQTMKGA | 30.77 | | | | |
| E | 684 | 0.89 | 2 | 2 | 0 | Y | LFTQTMKGVE | 69.23 | LFTQTMKGAE | 30.77 | | | | |
| E | 685 | 0.89 | 2 | 2 | 0 | Y | FTQTMKGVER | 69.23 | FTQTMKGAER | 30.77 | | | | |
| E | 686 | 0.89 | 2 | 2 | 0 | Y | TQTMKGVERL | 69.23 | TQTMKGAERL | 30.77 | | | | |
| E | 687 | 0.89 | 2 | 2 | 0 | Y | QTMKGVERLA | 69.23 | QTMKGAERLA | 30.77 | | | | |
| E | 688 | 0.89 | 2 | 2 | 0 | Y | TMKGVERLAV | 69.23 | TMKGAERLAV | 30.77 | | | | |
| E | 689 | 0.89 | 2 | 2 | 0 | Y | MKGVERLAVM | 69.23 | MKGAERLAVM | 30.77 | | | | |
| E | 690 | 0.89 | 2 | 2 | 0 | Y | KGVERLAVMG | 69.23 | KGAERLAVMG | 30.77 | | | | |
| E | 691 | 0.89 | 2 | 2 | 0 | Y | GVERLAVMGD | 69.23 | GAERLAVMGD | 30.77 | | | | |
| E | 692 | 1.67 | 4 | 4 | 0 | Y | VERLAVMGDT | 50 | AERLAVMGDA | 38.46 | VERLAVMGDV | 11.54 | VERLAVMGDA | 7.69 |
| E | 693 | 1.39 | 3 | 3 | 0 | Y | ERLAVMGDTA | 50 | ERLAVMGDAA | 30.77 | ERLAVMGDVA | 11.54 | | |

Fig. 29-28

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 694 | 1.39 | 3 | 3 | 0 | Y | RLAVMGDTAW | 50 | RLAVMGDAAW | 38.46 | RLAVMGDVAW | 11.54 | | | | |
| E | 695 | 1.39 | 3 | 3 | 0 | Y | LAVMGDTAWD | 50 | LAVMGDAAWD | 38.46 | LAVMGDVAWD | 11.54 | | | | |
| E | 696 | 1.39 | 3 | 3 | 0 | Y | AVMGDTAWDF | 50 | AVMGDAAWDF | 38.46 | AVMGDVAWDF | 11.54 | | | | |
| E | 697 | 1.39 | 3 | 3 | 0 | Y | VMGDTAWDFS | 50 | VMGDAAWDFS | 38.46 | VMGDVAWDFS | 11.54 | | | | |
| E | 698 | 1.39 | 3 | 3 | 0 | Y | MGDTAWDFSS | 50 | MGDAAWDFSS | 38.46 | MGDVAWDFSS | 11.54 | | | | |
| E | 699 | 1.39 | 3 | 3 | 0 | Y | GDTAWDFSSA | 50 | GDAAWDFSSA | 38.46 | GDVAWDFSSA | 11.54 | | | | |
| E | 700 | 1.39 | 3 | 3 | 0 | Y | DTAWDFSSAG | 50 | DAAWDFSSAG | 38.46 | DVAWDFSSAG | 11.54 | | | | |
| E | 701 | 1.39 | 3 | 3 | 0 | Y | TAWDFSSAGG | 50 | AAWDFSSAGG | 38.46 | VAWDFSSAGG | 11.54 | | | | |
| E | 702 | 0.24 | 2 | 2 | 0 | Y | AWDFSSAGGF | 96.15 | AWDFSSAGGL | 3.85 | | | | | | |
| E | 703 | 0.47 | 3 | 3 | 0 | Y | WDFSSAGGFF | 92.31 | WDFSSAGGLF | 3.85 | WDFSSAGGFL | 3.85 | | | | |
| E | 704 | 0.47 | 3 | 3 | 0 | Y | DFSSAGGFFT | 92.31 | DFSSAGGLFT | 3.85 | DFSSAGGFLT | 3.85 | | | | |
| E | 705 | 0.47 | 3 | 3 | 0 | Y | FSSAGGFFTS | 92.31 | FSSAGGLFTS | 3.85 | FSSAGGFLTS | 3.85 | | | | |
| E | 706 | 0.47 | 3 | 3 | 0 | Y | SSAGGFFTSV | 92.31 | SSAGGLFTSV | 3.85 | SSAGGFLTSI | 3.85 | | | | |
| E | 707 | 0.47 | 3 | 3 | 0 | Y | SAGGFFTSVG | 92.31 | SAGGLFTSIG | 3.85 | SAGGFLTSIG | 3.85 | | | | |
| E | 708 | 0.47 | 3 | 3 | 0 | Y | AGGFFTSVGK | 92.31 | AGGLFTSIGK | 3.85 | AGGFLTSVGK | 3.85 | | | | |
| E | 709 | 0.47 | 3 | 3 | 0 | Y | GGFFTSVGKG | 92.31 | GGLFTSIGKG | 3.85 | GGFLTSVGKG | 3.85 | | | | |
| E | 710 | 0.47 | 3 | 3 | 0 | Y | GFFTSVGKGI | 92.31 | GFLTSVGKGI | 3.85 | GLFTSIGKGS | 3.85 | | | | |
| E | 711 | 0.47 | 3 | 3 | 0 | Y | FFTSVGKGIH | 92.31 | FLTSVGKGIH | 3.85 | FLTSIGKGSH | 3.85 | | | | |
| E | 712 | 0.47 | 3 | 3 | 0 | Y | FTSVGKGIHT | 92.31 | FTSIGKGSHT | 3.85 | LTSVGKGIHT | 3.85 | | | | |
| E | 713 | 0.24 | 2 | 2 | 0 | Y | TSVGKGIHTV | 96.15 | TSIGKGSHTV | 3.85 | | | | | | |
| E | 714 | 0.24 | 2 | 2 | 0 | Y | SVGKGIHTVF | 96.15 | SIGKGSHTVF | 3.85 | | | | | | |
| E | 715 | 0.24 | 2 | 2 | 0 | Y | VGKGIHTVFG | 96.15 | IGKGSHTVFG | 3.85 | | | | | | |
| E | 716 | 0.24 | 2 | 2 | 0 | Y | GKGIHTVFGS | 96.15 | GKGSHTVFGS | 3.85 | | | | | | |
| E | 717 | 0.24 | 2 | 2 | 0 | Y | KGIHTVFGSA | 96.15 | KGSHTVFGSA | 3.85 | | | | | | |
| E | 718 | 0.24 | 2 | 2 | 0 | Y | GIHTVFGSAF | 96.15 | GSHTVFGSAF | 3.85 | | | | | | |

Fig. 29-29

Species: YFV (10-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 719 | 0.24 | 2 | 2 | 0 | Y | IHTYFGSAFQ | 96.15 | SHTVFGSAFQ | 3.85 | | | | |
| E | 720 | 0 | 1 | 1 | 0 | Y | HTVFGSAFQG | 100 | | | | | | |
| E | 721 | 0 | 1 | 1 | 0 | Y | TVFGSAFQGL | 100 | | | | | | |
| E | 722 | 0 | 1 | 1 | 0 | Y | VFGSAFQGLF | 100 | | | | | | |
| E | 723 | 0 | 1 | 1 | 0 | Y | FGSAFQGLFG | 100 | | | | | | |
| E | 724 | 0 | 1 | 1 | 0 | Y | GSAFQGLFGG | 100 | | | | | | |
| E | 725 | 0 | 1 | 1 | 0 | Y | SAFQGLFGGL | 100 | | | | | | |
| E | 726 | 0.78 | 2 | 2 | 0 | Y | AFQGLFGGLN | 76.92 | AFQGLFGGLS | 23.08 | | | | |
| E | 727 | 0.78 | 2 | 2 | 0 | Y | FQGLFGGLNW | 76.92 | FQGLFGGLSW | 23.08 | | | | |
| E | 728 | 0.78 | 2 | 2 | 0 | Y | QGLFGGLNWI | 76.92 | QGLFGGLSWI | 23.08 | | | | |
| E | 729 | 0.78 | 2 | 2 | 0 | Y | GLFGGLNWIT | 76.92 | GLFGGLSWIT | 23.08 | | | | |
| E | 730 | 0.78 | 2 | 2 | 0 | Y | LFGGLNWITK | 76.92 | LFGGLSWITK | 23.08 | | | | |
| E | 731 | 0.78 | 2 | 2 | 0 | Y | FGGLNWITKV | 76.92 | FGGLSWITKV | 23.08 | | | | |
| E | 732 | 0.78 | 2 | 2 | 0 | Y | GGLNWITKVI | 76.92 | GGLSWITKVI | 23.08 | | | | |
| E | 733 | 1 | 3 | 3 | 0 | Y | GLNWITKVIM | 73.08 | GLSWITKVIM | 23.08 | GLNWITKVII | 3.85 | | |
| E | 734 | 1 | 3 | 3 | 0 | Y | LNWITKVIMG | 73.08 | LSWITKVIMG | 23.08 | LNWITKVIIG | 3.85 | | |
| E | 735 | 1.22 | 4 | 4 | 0 | Y | NWITKVIMGA | 69.23 | SWITKVIMGA | 23.08 | NWITKVIIGV | 3.85 | NWITKVIIGA | 3.85 |
| E | 736 | 0.47 | 3 | 3 | 0 | Y | WITKVIMGAV | 92.31 | WITKVIMGV | 3.85 | WITKVIIGAV | 3.85 | | |
| E | 737 | 0.47 | 3 | 3 | 0 | Y | ITKVIMGAVL | 92.31 | ITKVIIGAVL | 3.85 | ITKVIMGVL | 3.85 | | |
| E | 738 | 0.47 | 3 | 3 | 0 | Y | TKVIMGAVLI | 92.31 | TKVIIGAVLI | 3.85 | TKVIMGVLI | 3.85 | | |
| E | 739 | 0.47 | 3 | 3 | 0 | Y | KVIMGAVLIW | 92.31 | KVIIGAVLI | 3.85 | KVIIGAVLIW | 3.85 | | |
| E | 740 | 0.47 | 3 | 3 | 0 | Y | VIMGAVLIWV | 92.31 | VIMGVLIWV | 3.85 | VIIGAVLIW | 3.85 | | |
| E | 741 | 0.47 | 3 | 3 | 0 | Y | IMGAVLIWVG | 92.31 | IMGVLIWVG | 3.85 | IIGAVLIWVG | 3.85 | | |
| E | 742 | 0.7 | 4 | 4 | 0 | Y | MGAVLIWVGI | 88.46 | MGVLIWVGI | 3.85 | MGAVLIWVGF | 3.85 | IGAVLIWVGI | 3.85 |
| E | 743 | 0.47 | 3 | 3 | 0 | Y | GAVLIWVGIN | 92.31 | GAVLIWVGFN | 3.85 | GVLIWVGIN | 3.85 | | |

Fig. 29-30

Species: YFV (10

Fig. 29-31

Species: YFV (10-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 769 | 0 | 1 | 1 | 0 | Y | MMFLSLGVGA | 100 | | | | | | |
| E | 770 | 0 | 1 | 1 | 0 | Y | MFLSLGVGAD | 100 | | | | | | |
| E | 771 | 0 | 1 | 1 | 0 | Y | FLSLGVGADQ | 100 | | | | | | |
| E | 772 | 0 | 1 | 1 | 0 | Y | LSLGVGADQG | 100 | | | | | | |
| E | 773 | 0 | 1 | 1 | 0 | Y | SLGVGADQGC | 100 | | | | | | |
| E | 774 | 0 | 1 | 1 | 0 | Y | LGVGADQGCA | 100 | | | | | | |
| E | 775 | 0.52 | 2 | 2 | 0 | Y | GVGADQGCAI | 88.46 | GVGADQGCAV | 11.54 | | | | |
| E | 776 | 0.52 | 2 | 2 | 0 | Y | VGADQGCAIN | 88.46 | VGADQGCAVN | 11.54 | | | | |
| E | 777 | 0.52 | 2 | 2 | 0 | Y | GADQGCAINF | 88.46 | GADQGCAVNF | 11.54 | | | | |
| E | 778 | 0.74 | 3 | 3 | 0 | Y | ADQGCAINFG | 84.62 | ADQGCAVNFG | 11.54 | ADQGCAINFA | 3.85 | | |
| NS1 | 779 | 0.74 | 3 | 3 | 0 | Y | DQGCAINFGK | 84.62 | DQGCAVNFGK | 11.54 | DQGCAINFAK | 3.85 | | |
| NS1 | 780 | 0.74 | 3 | 3 | 0 | Y | QGCAINFGKR | 84.62 | QGCAVNFGKR | 11.54 | QGCAINFAKR | 3.85 | | |
| NS1 | 781 | 0.74 | 3 | 3 | 0 | Y | GCAINFGKRE | 84.62 | GCAVNFGKRE | 11.54 | GCAINFAKRE | 3.85 | | |
| NS1 | 782 | 0.74 | 3 | 3 | 0 | Y | CAINFGKREL | 84.62 | CAVNFGKREL | 11.54 | CAINFAKREL | 3.85 | | |
| NS1 | 783 | 0.74 | 3 | 3 | 0 | Y | AINFGKRELK | 84.62 | AVNFGKRELK | 11.54 | AINFAKRELK | 3.85 | | |
| NS1 | 784 | 0.74 | 3 | 3 | 0 | Y | INFGKRELKC | 84.62 | VNFGKRELKC | 11.54 | INFAKRELKC | 3.85 | | |
| NS1 | 785 | 0.24 | 2 | 2 | 0 | Y | NFGKRELKCG | 96.15 | NFAKRELKCG | 3.85 | | | | |
| NS1 | 786 | 0.24 | 2 | 2 | 0 | Y | FGKRELKCGD | 96.15 | FAKRELKCGD | 3.85 | | | | |
| NS1 | 787 | 0.24 | 2 | 2 | 0 | Y | GKRELKCGDG | 96.15 | AKRELKCGDG | 3.85 | | | | |
| NS1 | 788 | 0 | 1 | 1 | 0 | Y | KRELKCGDGI | 100 | | | | | | |
| NS1 | 789 | 0 | 1 | 1 | 0 | Y | RELKCGDGIF | 100 | | | | | | |
| NS1 | 790 | 0.52 | 2 | 2 | 0 | Y | ELKCGDGIFI | 88.46 | ELKCGDGIFV | 11.54 | | | | |
| NS1 | 791 | 0.52 | 2 | 2 | 0 | Y | LKCGDGIFIF | 88.46 | LKCGDGIFVF | 11.54 | | | | |
| NS1 | 792 | 0.52 | 2 | 2 | 0 | Y | KCGDGIFIFR | 88.46 | KCGDGIFVFR | 11.54 | | | | |
| NS1 | 793 | 0.52 | 2 | 2 | 0 | Y | CGDGIFIFRD | 88.46 | CGDGIFVFRD | 11.54 | | | | |

Fig. 29-32

Species: YFV (10-mers)

| protein |

Fig. 29-33

Species: YFV (10

Fig. 29-34

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 844 | 0 | 1 | 1 | 0 | Y | EMWRSRADEI | 100 | | | | | | |
| NS1 | 845 | 0 | 1 | 1 | 0 | Y | MWRSRADEIN | 100 | | | | | | |
| NS1 | 846 | 0 | 1 | 1 | 0 | Y | WRSRADEINA | 100 | | | | | | |
| NS1 | 847 | 0 | 1 | 1 | 0 | Y | RSRADEINAI | 100 | | | | | | |
| NS1 | 848 | 0.84 | 2 | 2 | 0 | Y | SRADEINAIF | 73.08 | SRADEINAIL | 26.92 | | | | |
| NS1 | 849 | 0.84 | 2 | 2 | 0 | Y | RADEINAIFE | 73.08 | RADEINAILE | 26.92 | | | | |
| NS1 | 850 | 0.84 | 2 | 2 | 0 | Y | ADEINAIFEE | 73.08 | ADEINAILEE | 26.92 | | | | |
| NS1 | 851 | 0.84 | 2 | 2 | 0 | Y | DEINAIFEEN | 73.08 | DEINAILEEN | 26.92 | | | | |
| NS1 | 852 | 0.84 | 2 | 2 | 0 | Y | EINAIFEENE | 73.08 | EINAILEENE | 26.92 | | | | |
| NS1 | 853 | 0.84 | 2 | 2 | 0 | Y | INAIFEENEV | 73.08 | INAILEENEV | 26.92 | | | | |
| NS1 | 854 | 0.84 | 2 | 2 | 0 | Y | NAIFEENEVD | 73.08 | NAILEENEVD | 26.92 | | | | |
| NS1 | 855 | 0.84 | 2 | 2 | 0 | Y | AIFEENEVDI | 73.08 | AILEENEVDI | 26.92 | | | | |
| NS1 | 856 | 0.84 | 2 | 2 | 0 | Y | IFEENEVDIS | 73.08 | ILEENEVDIS | 26.92 | | | | |
| NS1 | 857 | 1.06 | 3 | 3 | 0 | Y | FEENEVDISV | 69.23 | LEENEVDISV | 26.92 | FEENEVDISI | 3.85 | | |
| NS1 | 858 | 0.24 | 2 | 2 | 0 | Y | EENEVDISVV | 96.15 | EENEVDISIV | 3.85 | | | | |
| NS1 | 859 | 0.24 | 2 | 2 | 0 | Y | ENEVDISVVQ | 96.15 | ENEVDISIVV | 3.85 | | | | |
| NS1 | 860 | 0.24 | 2 | 2 | 0 | Y | NEVDISVVQD | 96.15 | NEVDISIVVQ | 3.85 | | | | |
| NS1 | 861 | 0.24 | 2 | 2 | 0 | Y | EVDISVVQDP | 96.15 | EVDISIVVQD | 3.85 | | | | |
| NS1 | 862 | 0.24 | 2 | 2 | 0 | Y | VDISVVQDPK | 96.15 | VDISIVVQDP | 3.85 | | | | |
| NS1 | 863 | 0.24 | 2 | 2 | 0 | Y | DISVVQDPKN | 96.15 | DISIVVQDPK | 3.85 | | | | |
| NS1 | 864 | 0.24 | 2 | 2 | 0 | Y | ISVVQDPKNI | 96.15 | ISIVVQDPKN | 3.85 | | | | |
| NS1 | 865 | 0.62 | 3 | 3 | 0 | Y | SVVQDPKNIY | 88.46 | SVVQDPKNI | 7.69 | SIVVQDPKNI | 3.85 | | |
| NS1 | 866 | 0.62 | 3 | 3 | 0 | Y | VVQDPKNIYQ | 88.46 | VVQDPKNIY | 7.69 | IVVQDPKNIY | 3.85 | | |
| NS1 | 867 | 0.52 | 2 | 2 | 0 | Y | VQDPKNIYQR | 88.46 | VQDPKNIYQ | 11.54 | | | | |
| NS1 | 868 | 0.52 | 2 | 2 | 0 | Y | VQDPKNIYQR | 88.46 | VQDPKNIYQR | 11.54 | | | | |

Fig. 29-35

| Species: YFV (10-mers) | protein | block starting position | entropy block | total peptides in block | # peptides required to cover 99% of block | gap/

Fig. 29-36

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 894 | 0.62 | 3 | 3 | 0 | Y | KTWGKNLVFS | 88.46 | KTWGKNLIFS | 7.69 | KTWGKSLVFS | 3.85 | | |
| NS1 | 895 | 0.62 | 3 | 3 | 0 | Y | TWGKNLVFSP | 88.46 | TWGKNLIFSP | 7.69 | TWGKSLVFSP | 3.85 | | |
| NS1 | 896 | 0.62 | 3 | 3 | 0 | Y | WGKNLVFSPG | 88.46 | WGKNLIFSPG | 7.69 | WGKSLVFSPG | 3.85 | | |
| NS1 | 897 | 0.62 | 3 | 3 | 0 | Y | GKNLVFSPGR | 88.46 | GKNLIFSPGR | 7.69 | GKSLVFSPGR | 3.85 | | |
| NS1 | 898 | 0.62 | 3 | 3 | 0 | Y | KNLVFSPGRK | 88.46 | KNLIFSPGRK | 7.69 | KSLVFSPGRK | 3.85 | | |
| NS1 | 899 | 0.62 | 3 | 3 | 0 | Y | NLVFSPGRKN | 88.46 | NLIFSPGRKN | 7.69 | SLVFSPGRKN | 3.85 | | |
| NS1 | 900 | 0.39 | 2 | 2 | 0 | Y | LVFSPGRKNG | 92.31 | LIFSPGRKNG | 7.69 | | | | |
| NS1 | 901 | 0.39 | 2 | 2 | 0 | Y | VFSPGRKNGS | 92.31 | IFSPGRKNGS | 7.69 | | | | |
| NS1 | 902 | 0 | 1 | 1 | 0 | Y | FSPGRKNGSF | 100 | | | | | | |
| NS1 | 903 | 0 | 1 | 1 | 0 | Y | SPGRKNGSFI | 100 | | | | | | |
| NS1 | 904 | 0 | 1 | 1 | 0 | Y | PGRKNGSFII | 100 | | | | | | |
| NS1 | 905 | 0 | 1 | 1 | 0 | Y | GRKNGSFIID | 100 | | | | | | |
| NS1 | 906 | 0 | 1 | 1 | 0 | Y | RKNGSFIIDG | 100 | | | | | | |
| NS1 | 907 | 0 | 1 | 1 | 0 | Y | KNGSFIIDGK | 100 | | | | | | |
| NS1 | 908 | 0 | 1 | 1 | 0 | Y | NGSFIIDGKS | 100 | | | | | | |
| NS1 | 909 | 0 | 1 | 1 | 0 | Y | GSFIIDGKSR | 100 | | | | | | |
| NS1 | 910 | 0 | 1 | 1 | 0 | Y | SFIIDGKSRK | 100 | | | | | | |
| NS1 | 911 | 0 | 1 | 1 | 0 | Y | FIIDGKSRKE | 100 | | | | | | |
| NS1 | 912 | 0 | 1 | 1 | 0 | Y | IIDGKSRKEC | 100 | | | | | | |
| NS1 | 913 | 0 | 1 | 1 | 0 | Y | IDGKSRKECP | 100 | | | | | | |
| NS1 | 914 | 0 | 1 | 1 | 0 | Y | DGKSRKECPF | 100 | | | | | | |
| NS1 | 915 | 0 | 1 | 1 | 0 | Y | GKSRKECPFS | 100 | | | | | | |
| NS1 | 916 | 0 | 1 | 1 | 0 | Y | KSRKECPFSN | 100 | | | | | | |
| NS1 | 917 | 0 | 1 | 1 | 0 | Y | SRKECPFSNR | 100 | | | | | | |
| NS1 | 918 | 0 | 1 | 1 | 0 | Y | RKECPFSNRV | 100 | | | | | | |

Fig. 29-37

Species: YFV (10-mers)

| protein | block starting position | ent

Fig. 29-38

Species: YFV (10-mers)

| protein | block starting position | block entropy | total peptides in block | #

Fig. 29-39

Species: YFV (10-mers)

| protein | block starting position | block entropy | total peptides in block | # peptides required

Fig. 29-40

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 994 | 0.62 | 2 | 2 | 0 | Y | LEALDYKECE | 84.62 | LETLDYKECE | 15.38 |
| NS1 | 995 | 0.62 | 2 | 2 | 0 | Y | EALDYKECEW | 84.62 | ETLDYKECEW | 15.38 |
| NS1 | 996 | 0.62 | 2 | 2 | 0 | Y | ALDYKECEWP | 84.62 | TLDYKECEWP | 15.38 |
| NS1 | 997 | 0.24 | 2 | 2 | 0 | Y | LDYKECEWPL | 96.15 | LDYKECEWPP | 3.85 |
| NS1 | 998 | 0.24 | 2 | 2 | 0 | Y | DYKECEWPLT | 96.15 | DYKECEWPPT | 3.85 |
| NS1 | 999 | 0.24 | 2 | 2 | 0 | Y | YKECEWPLTH | 96.15 | YKECEWPPTH | 3.85 |
| NS1 | 1000 | 0.24 | 2 | 2 | 0 | Y | KECEWPLTHT | 96.15 | KECEWPPTHT | 3.85 |
| NS1 | 1001 | 0.24 | 2 | 2 | 0 | Y | ECEWPLTHTI | 96.15 | ECEWPPTHTI | 3.85 |
| NS1 | 1002 | 0.24 | 2 | 2 | 0 | Y | CEWPLTHTIG | 96.15 | CEWPPTHTIG | 3.85 |
| NS1 | 1003 | 0.24 | 2 | 2 | 0 | Y | EWPLTHTIGT | 96.15 | EWPPTHTIGT | 3.85 |
| NS1 | 1004 | 0.24 | 2 | 2 | 0 | Y | WPLTHTIGTS | 96.15 | WPPTHTIGTS | 3.85 |
| NS1 | 1005 | 0.24 | 2 | 2 | 0 | Y | PLTHTIGTSV | 96.15 | PPTHTIGTSV | 3.85 |
| NS1 | 1006 | 0.24 | 2 | 2 | 0 | Y | LTHTIGTSVE | 96.15 | PTHTIGTSVE | 3.85 |
| NS1 | 1007 | 0 | 1 | 1 | 0 | Y | THTIGTSVEE | 100 | | |
| NS1 | 1008 | 0 | 1 | 1 | 0 | Y | HTIGTSVEES | 100 | | |
| NS1 | 1009 | 0.62 | 2 | 2 | 0 | Y | TIGTSVEESE | 84.62 | TIGTSVEESD | 15.38 |
| NS1 | 1010 | 0.62 | 2 | 2 | 0 | Y | IGTSVEESEM | 84.62 | IGTSVEESDM | 15.38 |
| NS1 | 1011 | 0.62 | 2 | 2 | 0 | Y | GTSVEESEMF | 84.62 | GTSVEESDMF | 15.38 |
| NS1 | 1012 | 0.62 | 2 | 2 | 0 | Y | TSVEESEMFM | 84.62 | TSVEESDMFM | 15.38 |
| NS1 | 1013 | 0.62 | 2 | 2 | 0 | Y | SVEESEMFMP | 84.62 | SVEESDMFMP | 15.38 |
| NS1 | 1014 | 0.62 | 2 | 2 | 0 | Y | VEESEMFMPR | 84.62 | VEESDMFMPR | 15.38 |
| NS1 | 1015 | 0.62 | 2 | 2 | 0 | Y | EESEMFMPRS | 84.62 | EESDMFMPRS | 15.38 |
| NS1 | 1016 | 0.62 | 2 | 2 | 0 | Y | ESEMFMPRSI | 84.62 | ESDMFMPRSI | 15.38 |
| NS1 | 1017 | 0.62 | 2 | 2 | 0 | Y | SEMFMPRSIG | 84.62 | SDMFMPRSIG | 15.38 |
| NS1 | 1018 | 0.62 | 2 | 2 | 0 | Y | EMFMPRSIGG | 84.62 | DMFMPRSIGG | 15.38 |

Fig. 29-41

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 1019 | 0 | 1 | 1 | 0 | Y | MFMPRSIGGP | 100 | | |
| NS1 | 1020 | 0 | 1 | 1 | 0 | Y | FMPRSIGGPV | 100 | | |
| NS1 | 1021 | 0 | 1 | 1 | 0 | Y | MPRSIGGPVS | 100 | | |
| NS1 | 1022 | 0 | 1 | 1 | 0 | Y | PRSIGGPVSS | 100 | | |
| NS1 | 1023 | 0 | 1 | 1 | 0 | Y | RSIGGPVSSH | 100 | | |
| NS1 | 1024 | 0 | 1 | 1 | 0 | Y | SIGGPVSSHN | 100 | | |
| NS1 | 1025 | 0.24 | 2 | 2 | 0 | Y | IGGPVSSHNH | 96.15 | IGGPVSSHNR | 3.85 |
| NS1 | 1026 | 0.24 | 2 | 2 | 0 | Y | GGPVSSHNHI | 96.15 | GGPVSSHNRI | 3.85 |
| NS1 | 1027 | 0.24 | 2 | 2 | 0 | Y | GPVSSHNHIP | 96.15 | GPVSSHNRIP | 3.85 |
| NS1 | 1028 | 0.24 | 2 | 2 | 0 | Y | PVSSHNHIPG | 96.15 | PVSSHNRIPG | 3.85 |
| NS1 | 1029 | 0.24 | 2 | 2 | 0 | Y | VSSHNHIPGY | 96.15 | VSSHNRIPGY | 3.85 |
| NS1 | 1030 | 0.24 | 2 | 2 | 0 | Y | SSHNHIPGYK | 96.15 | SSHNRIPGYK | 3.85 |
| NS1 | 1031 | 0.24 | 2 | 2 | 0 | Y | SHNHIPGYKV | 96.15 | SHNRIPGYKV | 3.85 |
| NS1 | 1032 | 0.24 | 2 | 2 | 0 | Y | HNHIPGYKVQ | 96.15 | HNRIPGYKVQ | 3.85 |
| NS1 | 1033 | 0.24 | 2 | 2 | 0 | Y | NHIPGYKVQT | 96.15 | NRIPGYKVQT | 3.85 |
| NS1 | 1034 | 0.24 | 2 | 2 | 0 | Y | HIPGYKVQTN | 96.15 | RIPGYKVQTN | 3.85 |
| NS1 | 1035 | 0 | 1 | 1 | 0 | Y | IPGYKVQTNG | 100 | | |
| NS1 | 1036 | 0 | 1 | 1 | 0 | Y | PGYKVQTNGP | 100 | | |
| NS1 | 1037 | 0 | 1 | 1 | 0 | Y | GYKVQTNGPW | 100 | | |
| NS1 | 1038 | 0 | 1 | 1 | 0 | Y | YKVQTNGPWM | 100 | | |
| NS1 | 1039 | 0 | 1 | 1 | 0 | Y | KVQTNGPWMQ | 100 | | |
| NS1 | 1040 | 0 | 1 | 1 | 0 | Y | VQTNGPWMQV | 100 | | |
| NS1 | 1041 | 0 | 1 | 1 | 0 | Y | QTNGPWMQVP | 100 | | |
| NS1 | 1042 | 0 | 1 | 1 | 0 | Y | TNGPWMQVPL | 100 | | |
| NS1 | 1043 | 0 | 1 | 1 | 0 | Y | NGPWMQVPLE | 100 | | |

Fig. 29-42

Species: YFV (10-mers)

| protein | block starting position | entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 1044 | 0 | 1 | 1 | 0 | Y | GPWMQVPLEV | 100 | | | | | | |
| NS1 | 1045 | 0.62 | 2 | 2 | 0 | Y | PWMQVPLEVK | 84.62 | PWMQVPLEVR | 15.38 | | | | |
| NS1 | 1046 | 0.62 | 2 | 2 | 0 | Y | WMQVPLEVKR | 84.62 | WMQVPLEVRR | 15.38 | | | | |
| NS1 | 1047 | 0.62 | 2 | 2 | 0 | Y | MQVPLEVKRE | 84.62 | MQVPLEVRRE | 15.38 | | | | |
| NS1 | 1048 | 1 | 4 | 4 | 0 | Y | QVPLEVKREA | 80.77 | QVPLEVRREP | 7.69 | QVPLEVRREA | 7.69 | QVPLEVKREV | 3.85 |
| NS1 | 1049 | 1 | 4 | 4 | 0 | Y | VPLEVKREAC | 80.77 | VPLEVRREPC | 7.69 | VPLEVRREAC | 7.69 | VPLEVKREVC | 3.85 |
| NS1 | 1050 | 1 | 4 | 4 | 0 | Y | PLEVKREACP | 80.77 | PLEVRREPCP | 7.69 | PLEVRREACP | 7.69 | PLEVKREVCP | 3.85 |
| NS1 | 1051 | 1 | 4 | 4 | 0 | Y | LEVKREACPG | 80.77 | LEVRREPCPG | 7.69 | LEVRREACPG | 7.69 | LEVKREVCPG | 3.85 |
| NS1 | 1052 | 1 | 4 | 4 | 0 | Y | EVKREACPGT | 80.77 | EVRREPCPGT | 7.69 | EVRREACPGT | 7.69 | EVKREVCPGT | 3.85 |
| NS1 | 1053 | 1 | 4 | 4 | 0 | Y | VKREACPGTS | 80.77 | VRREPCPGTS | 7.69 | VRREACPGTS | 7.69 | VKREVCPGTS | 3.85 |
| NS1 | 1054 | 1 | 4 | 4 | 0 | Y | KREACPGTSV | 80.77 | RREPCPGTSV | 7.69 | RREACPGTSV | 7.69 | KREVCPGTSV | 3.85 |
| NS1 | 1055 | 0.62 | 3 | 3 | 0 | Y | REACPGTSVI | 88.46 | REPCPGTSVW | 7.69 | REVCPGTSVW | 3.85 | | |
| NS1 | 1056 | 0.7 | 4 | 4 | 0 | Y | EACPGTSVII | 88.46 | EPCPGTSVWL | 3.85 | EVCPGTSVWV | 3.85 | EPCPGTSVW | 3.85 |
| NS1 | 1057 | 0.7 | 4 | 4 | 0 | Y | ACPGTSVIID | 88.46 | PCPGTSVWLD | 3.85 | VCPGTSVWVD | 3.85 | PCPGTSVWD | 3.85 |
| NS1 | 1058 | 0.7 | 4 | 4 | 0 | Y | CPGTSVIIDG | 88.46 | CPGTSVWLDT | 3.85 | CPGTSVWVDT | 3.85 | CPGTSVWLDT | 3.85 |
| NS1 | 1059 | 0.7 | 4 | 4 | 0 | Y | PGTSVIIDGN | 88.46 | PGTSVWLDTG | 3.85 | PGTSVWVDTS | 3.85 | PGTSVWDSN | 3.85 |
| NS1 | 1060 | 0.7 | 4 | 4 | 0 | Y | GTSVIIDGNC | 88.46 | GTSVWLDTGC | 3.85 | GTSVWLDTGC | 3.85 | GTSVWDSNC | 3.85 |
| NS1 | 1061 | 0.7 | 4 | 4 | 0 | Y | TSVIIDGNCD | 88.46 | TSVWLDTGCD | 3.85 | TSVWLDTGCD | 3.85 | TSVWDSNCD | 3.85 |
| NS1 | 1062 | 0.7 | 4 | 4 | 0 | Y | SVIIDGNCDG | 88.46 | SVWLDTGCDG | 3.85 | SVWDTSCDG | 3.85 | SVWDSNCDG | 3.85 |
| NS1 | 1063 | 0.7 | 4 | 4 | 0 | Y | VIIDGNCDGR | 88.46 | VWLDTGCDGR | 3.85 | VWDTSCDGR | 3.85 | VWDTSCDGR | 3.85 |
| NS1 | 1064 | 0.7 | 4 | 4 | 0 | Y | IIDGNCDGRG | 88.46 | VLDTGCDGRG | 3.85 | WDTSCDGRG | 3.85 | WDTSCDGRG | 3.85 |
| NS1 | 1065 | 0.7 | 4 | 4 | 0 | Y | IDGNCDGRGK | 88.46 | LDTGCDGRGK | 3.85 | VDTSCDGRGK | 3.85 | VDTSCDGRGK | 3.85 |
| NS1 | 1066 | 0.7 | 4 | 4 | 0 | Y | DGNCDGRGKS | 88.46 | DSNCDGRGKS | 3.85 | DTSCDGRGKS | 3.85 | DTCDGRGKS | 3.85 |
| NS1 | 1067 | 0.93 | 5 | 5 | 0 | Y | GNCDGRGKST | 84.62 | SNCDGRGKST | 3.85 | TGCDGRGKST | 3.85 | TSCDGRGKST | 3.85 | GNCDGRGKSA | 3.85 |
| NS1 | 1068 | 0.7 | 4 | 4 | 0 | Y | NCDGRGKSTR | 88.46 | GCDGRGKSTR | 3.85 | NCDGRGKSAR | 3.85 | SCDGRGKSTR | 3.85 |

Fig. 29-43

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1069 | 0.24 | 2 | 2 | 0 | Y | CDGRGKSTRS | 96.15 | CDGRGKSARS | 3.85 | | | | |
| NS1 | 1070 | 0.24 | 2 | 2 | 0 | Y | DGRGKSTRST | 96.15 | DGRGKSARST | 3.85 | | | | |
| NS1 | 1071 | 0.24 | 2 | 2 | 0 | Y | GRGKSTRSTT | 96.15 | GRGKSARSTT | 3.85 | | | | |
| NS1 | 1072 | 0.24 | 2 | 2 | 0 | Y | RGKSTRSTTD | 96.15 | RGKSARSTTD | 3.85 | | | | |
| NS1 | 1073 | 0.24 | 2 | 2 | 0 | Y | GKSTRSTTDS | 96.15 | GKSARSTTDS | 3.85 | | | | |
| NS1 | 1074 | 0.24 | 2 | 2 | 0 | Y | KSTRSTTDSG | 96.15 | KSARSTTDSG | 3.85 | | | | |
| NS1 | 1075 | 0.24 | 2 | 2 | 0 | Y | STRSTTDSGK | 96.15 | SARSTTDSGK | 3.85 | | | | |
| NS1 | 1076 | 1.14 | 3 | 3 | 0 | Y | TRSTTDSGKV | 61.54 | TRSTTDSGKI | 34.62 | ARSTTDSGKI | 3.85 | | |
| NS1 | 1077 | 0.96 | 2 | 2 | 0 | Y | RSTTDSGKVI | 61.54 | RSTTDSGKII | 38.46 | | | | |
| NS1 | 1078 | 0.96 | 2 | 2 | 0 | Y | STTDSGKVIP | 61.54 | STTDSGKIIP | 38.46 | | | | |
| NS1 | 1079 | 0.96 | 2 | 2 | 0 | Y | TTDSGKVIPE | 61.54 | TTDSGKIIPE | 38.46 | | | | |
| NS1 | 1080 | 0.96 | 2 | 2 | 0 | Y | TDSGKVIPEW | 61.54 | TDSGKIIPEW | 38.46 | | | | |
| NS1 | 1081 | 0.96 | 2 | 2 | 0 | Y | DSGKVIPEWC | 61.54 | DSGKIIPEWC | 38.46 | | | | |
| NS1 | 1082 | 0.96 | 2 | 2 | 0 | Y | SGKVIPEWCC | 61.54 | SGKIIPEWCC | 38.46 | | | | |
| NS1 | 1083 | 0.96 | 2 | 2 | 0 | Y | GKVIPEWCCR | 61.54 | GKIIPEWCCR | 38.46 | | | | |
| NS1 | 1084 | 0.96 | 2 | 2 | 0 | Y | KVIPEWCCRS | 61.54 | KIIPEWCCRS | 38.46 | | | | |
| NS1 | 1085 | 0.96 | 2 | 2 | 0 | Y | VIPEWCCRSC | 61.54 | IIPEWCCRSC | 38.46 | | | | |
| NS1 | 1086 | 0 | 1 | 1 | 0 | Y | IPEWCCRSCT | 100 | | | | | | |
| NS1 | 1087 | 0 | 1 | 1 | 0 | Y | PEWCCRSCTM | 100 | | | | | | |
| NS1 | 1088 | 0 | 1 | 1 | 0 | Y | EWCCRSCTMP | 100 | | | | | | |
| NS1 | 1089 | 0 | 1 | 1 | 0 | Y | WCCRSCTMPP | 100 | | | | | | |
| NS1 | 1090 | 0 | 1 | 1 | 0 | Y | CCRSCTMPPV | 100 | | | | | | |
| NS1 | 1091 | 0 | 1 | 1 | 0 | Y | CRSCTMPPYS | 100 | | | | | | |
| NS1 | 1092 | 0 | 1 | 1 | 0 | Y | RSCTMPPYSF | 100 | | | | | | |
| NS1 | 1093 | 0 | 1 | 1 | 0 | Y | SCTMPPYSFH | 100 | | | | | | |

Species: YFV (10-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 1119 | 0.24 | 2 | 2 | 0 | Y | HESHLVRSWV | 96.15 | SDSHLVRSWV | 3.85 |
| NS1 | 1120 | 0.24 | 2 | 2 | 0 | Y | ESHLVRSWVT | 96.15 | DSHLVRSWVT | 3.85 |
| NS1 | 1121 | 0 | 1 | 1 | 0 | Y | SHLVRSWVTA | 100 | | |
| NS1 | 1122 | 0 | 1 | 1 | 0 | Y | HLVRSWVTAG | 100 | | |
| NS1 | 1123 | 0 | 1 | 1 | 0 | Y | LVRSWVTAGE | 100 | | |
| NS1 | 1124 | 0.52 | 2 | 2 | 0 | Y | VRSWVTAGEI | 88.46 | VRSWVTAGEV | 11.54 |
| NS1 | 1125 | 0.52 | 2 | 2 | 0 | Y | RSWVTAGEIH | 88.46 | RSWVTAGEVH | 11.54 |
| NS1 | 1126 | 0.52 | 2 | 2 | 0 | Y | SWVTAGEIHA | 88.46 | SWVTAGEVHA | 11.54 |
| NS1 | 1127 | 0.52 | 2 | 2 | 0 | Y | WVTAGEIHAV | 88.46 | WVTAGEVHAV | 11.54 |
| NS1 | 1128 | 0.52 | 2 | 2 | 0 | Y | VTAGEIHAVP | 88.46 | VTAGEVHAVP | 11.54 |
| NS1 | 1129 | 0.52 | 2 | 2 | 0 | Y | TAGEIHAVPF | 88.46 | TAGEVHAVPF | 11.54 |
| NS1 | 1130 | 0.52 | 2 | 2 | 0 | Y | AGEIHAVPFG | 88.46 | AGEVHAVPFG | 11.54 |
| NS1 | 1131 | 0.52 | 2 | 2 | 0 | Y | GEIHAVPFGL | 88.46 | GEVHAVPFGL | 11.54 |
| NS1 | 1132 | 0.52 | 2 | 2 | 0 | Y | EIHAVPFGLV | 88.46 | EVHAVPFGLV | 11.54 |
| NS1 | 1133 | 0.52 | 2 | 2 | 0 | Y | IHAVPFGLVS | 88.46 | VHAVPFGLVS | 11.54 |
| NS1 | 1134 | 0 | 1 | 1 | 0 | Y | HAVPFGLVSM | 100 | | |
| NS2A | 1135 | 0 | 1 | 1 | 0 | Y | AVPFGLVSMM | 100 | | |
| NS2A | 1136 | 0 | 1 | 1 | 0 | Y | VPFGLVSMMI | 100 | | |
| NS2A | 1137 | 0 | 1 | 1 | 0 | Y | PFGLVSMMIA | 100 | | |
| NS2A | 1138 | 0.24 | 2 | 2 | 0 | Y | FGLVSMMIAM | 96.15 | FGLVSMMIAL | 3.85 |
| NS2A | 1139 | 0.24 | 2 | 2 | 0 | Y | GLVSMMIAME | 96.15 | GLVSMMIALE | 3.85 |
| NS2A | 1140 | 0.24 | 2 | 2 | 0 | Y | LVSMMIAMEV | 96.15 | LVSMMIALEV | 3.85 |
| NS2A | 1141 | 0.24 | 2 | 2 | 0 | Y | VSMMIAMEVV | 96.15 | VSMMIALEVV | 3.85 |
| NS2A | 1142 | 0.24 | 2 | 2 | 0 | Y | SMMIAMEVVL | 96.15 | SMMIALEVVL | 3.85 |
| NS2A | 1143 | 0.24 | 2 | 2 | 0 | Y | MMIAMEVVLR | 96.15 | MMIALEVVLR | 3.85 |

Fig. 29-46

Species: YFV (10-mers)

| protein | block starting position | ent

Species: YFV (10-mers)

Fig. 29-47

| protein | block starting position | entropy (10-mers) | total peptides in block | # peptides required to cover 99% of block | gap/X fraction of block | covered w/ <= 5 peptides? | block | frequency | block | frequency | block | frequency | block | frequency |
|---|---|---|---|---|---|---|---|---|---|---|---|---|---|---|
| NS2A | 1169 | 0.62 | 3 | 3 | 0 | Y | GAMLVGQVTL | 88.46 | GAMLVGQVTV | 7.69 | GAMLVGQVTM | 3.85 | | |
| NS2A | 1170 | 0.62 | 3 | 3 | 0 | Y | AMLVGQVTLL | 88.46 | AMLVGQVTVL | 7.69 | AMLVGQVTML | 3.85 | | |
| NS2A | 1171 | 0.62 | 3 | 3 | 0 | Y | MLVGQVTLLD | 88.46 | MLVGQVTVLD | 7.69 | MLVGQVTMLD | 3.85 | | |
| NS2A | 1172 | 0.62 | 3 | 3 | 0 | Y | LVGQVTLLDL | 88.46 | LVGQVTVLDL | 7.69 | LVGQVTMLDL | 3.85 | | |
| NS2A | 1173 | 0.62 | 3 | 3 | 0 | Y | VGQVTLLDLL | 88.46 | VGQVTVLDLV | 7.69 | VGQVTMLDLV | 3.85 | | |
| NS2A | 1174 | 0.85 | 4 | 4 | 0 | Y | GQVTLLDLLK | 84.62 | GQVTVLDLVK | 7.69 | GQVTMLDLVK | 3.85 | GQVTLLDLLE | 3.85 |
| NS2A | 1184 | 1.19 | 5 | 5 | 0 | Y | LTVAGLHFH | 76.92 | LIVAGLHFH | 11.54 | FVVAGLHFH | 3.85 | LTMAVGLHFH | 3.85 |
| NS2A | 1185 | 0.97 | 4 | 4 | 0 | Y | TVAVGLHFHE | 80.77 | IVAVGLHFHE | 11.54 | TMAVGLHFHE | 3.85 | WAVGLHFHE | 3.85 |
| NS2A | 1186 | 0.74 | 3 | 3 | 0 | Y | VAVGLHFHEM | 84.62 | VAVGLHFHEI | 11.54 | MAVGLHFHEM | 3.85 | FTVAVGLHFH | 3.85 |
| NS2A | 1187 | 0.52 | 2 | 2 | 0 | Y | AVGLHFHEMN | 88.46 | AVGLHFHEIN | 11.54 | | | | |
| NS2A | 1188 | 0.52 | 2 | 2 | 0 | Y | VGLHFHEMNN | 88.46 | VGLHFHEINN | 11.54 | | | | |
| NS2A | 1189 | 0.52 | 2 | 2 | 0 | Y | GLHFHEMNNG | 88.46 | GLHFHEINNG | 11.54 | | | | |
| NS2A | 1190 | 0.52 | 2 | 2 | 0 | Y | LHFHEMNNGG | 88.46 | LHFHEINNGG | 11.54 | | | | |
| NS2A | 1191 | 0.52 | 2 | 2 | 0 | Y | HFHEMNNGGD | 88.46 | HFHEINNGGD | 11.54 | | | | |
| NS2A | 1192 | 0.52 | 2 | 2 | 0 | Y | FHEMNNGGDA | 88.46 | FHEINNGGDA | 11.54 | | | | |
| NS2A | 1193 | 0.52 | 2 | 2 | 0 | Y | HEMNNGGDAM | 88.46 | HEINNGGDAM | 11.54 | | | | |
| NS2A | 1194 | 0.52 | 2 | 2 | 0 | Y | EMNNGGDAMY | 88.46 | EINNGGDAMY | 11.54 | | | | |
| NS2A | 1195 | 0.52 | 2 | 2 | 0 | Y | MNNGGDAMYM | 88.46 | INNGGDAMYM | 11.54 | | | | |
| NS2A | 1196 | 0 | 1 | 1 | 0 | Y | NNGGDAMYMA | 100 | | | | | | |
| NS2A | 1197 | 0 | 1 | 1 | 0 | Y | NGGDAMYMAL | 100 | | | | | | |
| NS2A | 1198 | 0 | 1 | 1 | 0 | Y | GGDAMYMALI | 100 | | | | | | |
| NS2A | 1199 | 0 | 1 | 1 | 0 | Y | GDAMYMALIA | 100 | | | | | | |
| NS2A | 1200 | 0.52 | 2 | 2 | 0 | Y | DAMYMALIAA | 88.46 | DAMYMALIAS | 11.54 | | | | |
| NS2A | 1201 | 0.52 | 2 | 2 | 0 | Y | AMYMALIAAF | 88.46 | AMYMALIASF | 11.54 | | | | |
| NS2A | 1202 | 0.52 | 2 | 2 | 0 | Y | MYMALIAAFS | 88.46 | MYMALIASFS | 11.54 | | | | |

Fig. 29-48

Species: YFV (10-mers)

| protein | block starting position | block entropy | total pe

Fig. 29-49

Species: YFV (10-mers)

| protein | block starting position | block entropy | total peptides in block | # peptides required to cover 99% of block | gap/X fraction | 99% of block covered w/ <= 5 pe

Fig. 29-50

Species: YFV (10-mers)

| protein | block starting position | block entropy (10-mers) | total peptides in block | # peptides required to cover 99% of block | gap/X fraction | 99% of block covered w/ <=

Fig. 29-51

Species: YFV (10-mers)

| protein | block starting position | entropy block

Fig. 29-52

Species: YFV (10-mers)

|

Fig. 29-53

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

Fig. 29-54

Species: YFV (10-mers)

| protein | block starting position | block entropy | total pe

Fig. 29-55

Species: YFV (10-mers)

| protein | block starting position | entropy block

Fig. 29-56

Species: YFV (10-mers)

| protein | block starting position | block

Fig. 29-57

Species: YFV (10-mers)

| protein | block star

Fig. 29-58

Species: YFV (10-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1458 | 1.14 | 3 | 3 | 0 | Y | LVGAALHPFA | 61.54 | LVGAAIHPFA | 34.62 | LVGAAIHPSA | 3.85 | | | | |
| NS2B | 1459 | 1.14 | 3 | 3 | 0 | Y | VGAALHPFAL | 61.54 | VGAAIHPFAL | 34.62 | VGAAIHPSAL | 3.85 | | | | |
| NS2B | 1460 | 1.14 | 3 | 3 | 0 | Y | GAALHPFALL | 61.54 | GAAIHPFALL | 34.62 | GAAIHPSALL | 3.85 | | | | |
| NS2B | 1461 | 1.14 | 3 | 3 | 0 | Y | AALHPFALLL | 61.54 | AAIHPFALLL | 34.62 | AAIHPSALLL | 3.85 | | | | |
| NS2B | 1462 | 1.14 | 3 | 3 | 0 | Y | ALHPFALLLV | 61.54 | AIHPFALLLV | 34.62 | AIHPSALLLV | 3.85 | | | | |
| NS2B | 1463 | 1.14 | 3 | 3 | 0 | Y | LHPFALLLVL | 61.54 | IHPFALLLVL | 34.62 | IHPSALLLVL | 3.85 | | | | |
| NS2B | 1464 | 0.74 | 3 | 3 | 0 | Y | HPFALLLVLA | 84.62 | HPFALLLVLG | 11.54 | HPSALLLVLA | 3.85 | | | | |
| NS2B | 1465 | 0.74 | 3 | 3 | 0 | Y | PFALLLVLAG | 84.62 | PFALLLVLGG | 11.54 | PSALLVLAG | 3.85 | | | | |
| NS2B | 1466 | 0.74 | 3 | 3 | 0 | Y | FALLLVLAGW | 84.62 | FALLVLGGW | 11.54 | SALLVLAGW | 3.85 | | | | |
| NS2B | 1467 | 0.62 | 3 | 3 | 0 | Y | ALLLVLAGWL | 88.46 | ALLVLGGWV | 7.69 | ALLVLGGWI | 3.85 | | | | |
| NS2B | 1468 | 0.62 | 3 | 3 | 0 | Y | LLLVLAGWLF | 88.46 | LLVLGGWVL | 7.69 | LLLVLGGWIL | 3.85 | | | | |
| NS2B | 1469 | 0.62 | 3 | 3 | 0 | Y | LLVLAGWLFH | 88.46 | LLVLGGWVLH | 7.69 | LLVLGGWILH | 3.85 | | | | |
| NS2B | 1470 | 0.62 | 3 | 3 | 0 | Y | LVLAGWLFHV | 88.46 | LVLGGWVLHI | 7.69 | LVLGGWILHI | 3.85 | | | | |
| NS2B | 1471 | 1.12 | 3 | 3 | 0 | Y | VLAGWLFHVR | 76.92 | VLAGWLFHVK | 11.54 | VLGGWVLHIK | 3.85 | VLGGWILHIK | 3.85 | | |
| NS2B | 1472 | 1.48 | 4 | 4 | 0 | Y | LAGWLFHVRG | 69.23 | LAGWLFHVKG | 11.54 | LAGWLFHVR | 11.54 | LGGWVLHIKG | 7.69 | LGGWILHIKG | 3.85 |
| NS2B | 1473 | 1.48 | 5 | 5 | 0 | Y | AGWLFHVRGA | 69.23 | AGWLFHVKGA | 11.54 | AGWLFHVRRA | 11.54 | GGWVLHIKGA | 7.69 | GGWILHIKGA | 3.85 |
| NS2B | 1474 | 1.48 | 5 | 5 | 0 | Y | GWLFHVRGAR | 69.23 | GWLFHVKGAR | 11.54 | GWLFHVRRAR | 11.54 | GWVLHIKGAR | 7.69 | GWILHIKGAR | 3.85 |
| NS2B | 1475 | 1.48 | 5 | 5 | 0 | Y | WLFHVRGARR | 69.23 | WLFHVRGARR | 11.54 | WLFHVRRARR | 11.54 | WVLHIKGARR | 7.69 | WILHIKGARR | 3.85 |
| NS2B | 1476 | 1.48 | 4 | 4 | 0 | Y | LFHVRGARRS | 69.23 | LFHVKGARRS | 11.54 | VLHIKGARRS | 11.54 | LFHVRRARRS | 7.69 | ILHIKGARRS | 3.85 |
| NS2B | 1477 | 1.37 | 4 | 4 | 0 | Y | FHVRGARRSG | 69.23 | LHIKGARRSG | 11.54 | FHVKGARRSG | 11.54 | FHVRRARRSG | 7.69 | | |
| NS2B | 1478 | 1.37 | 4 | 4 | 0 | Y | HVRGARRSGD | 69.23 | HIKGARRSGD | 11.54 | HVKGARRSGD | 11.54 | HVRRARRSGD | 7.69 | | |
| NS2B | 1479 | 1.37 | 4 | 4 | 0 | Y | VRGARRSGDV | 69.23 | VKGARRSGDV | 11.54 | IKGARRSGDV | 11.54 | VRRARRSGDV | 7.69 | | |
| NS2B | 1480 | 1.14 | 3 | 3 | 0 | Y | RGARRSGDVL | 69.23 | KGARRSGDVL | 23.08 | RAARRSGDVL | 7.69 | | | | |
| NS2B | 1481 | 0.39 | 2 | 2 | 0 | Y | GARRSGDVLW | 92.31 | RARRSGDVLW | 7.69 | | | | | | |
| NS2B | 1482 | 0 | 1 | 1 | 0 | Y | ARRSGDVLWD | 100 | | | | | | | | |

Fig. 29-59

Species: YFV (10-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS2B | 1483 | 0 | 1 | 1 | 0 | Y | RRSGDVLWDI | 100 | | | | | | |
| NS2B | 1484 | 0 | 1 | 1 | 0 | Y | RSGDVLWDIP | 100 | | | | | | |
| NS3 | 1485 | 0 | 1 | 1 | 0 | Y | SGDVLWDIPT | 100 | | | | | | |
| NS3 | 1486 | 0 | 1 | 1 | 0 | Y | GDVLWDIPTP | 100 | | | | | | |
| NS3 | 1487 | 0 | 1 | 1 | 0 | Y | DVLWDIPTPK | 100 | | | | | | |
| NS3 | 1488 | 0.62 | 2 | 2 | 0 | Y | VLWDIPTPKV | 84.62 | VLWDIPTPKI | 15.38 | | | | |
| NS3 | 1489 | 0.62 | 2 | 2 | 0 | Y | LWDIPTPKII | 84.62 | LWDIPTPKVI | 15.38 | | | | |
| NS3 | 1490 | 0.62 | 2 | 2 | 0 | Y | WDIPTPKIIE | 84.62 | WDIPTPKVIE | 15.38 | | | | |
| NS3 | 1491 | 0.62 | 2 | 2 | 0 | Y | DIPTPKIIEE | 84.62 | DIPTPKVIEE | 15.38 | | | | |
| NS3 | 1492 | 0.62 | 2 | 2 | 0 | Y | IPTPKIIEEC | 84.62 | IPTPKVIEEC | 15.38 | | | | |
| NS3 | 1493 | 0.62 | 2 | 2 | 0 | Y | PTPKIIEECE | 84.62 | PTPKVIEECE | 15.38 | | | | |
| NS3 | 1494 | 0.74 | 3 | 3 | 0 | Y | TPKIIEECEH | 84.62 | TPKVIEECEY | 11.54 | TPKVIEECEY | 3.85 | | |
| NS3 | 1495 | 0.74 | 3 | 3 | 0 | Y | PKIIEECEHL | 84.62 | PKVIEECEHL | 11.54 | PKVIEECEYL | 3.85 | | |
| NS3 | 1496 | 0.74 | 3 | 3 | 0 | Y | KIIEECEHLE | 84.62 | KVIEECEHLE | 11.54 | KVIEECEYLE | 3.85 | | |
| NS3 | 1497 | 0.74 | 3 | 3 | 0 | Y | IIEECEHLED | 84.62 | VIEECEHLED | 11.54 | VIEECEYLED | 3.85 | | |
| NS3 | 1498 | 0.24 | 2 | 2 | 0 | Y | IEECEHLEDG | 96.15 | IEECEYLEDG | 3.85 | | | | |
| NS3 | 1499 | 0.24 | 2 | 2 | 0 | Y | EECEHLEDGI | 96.15 | EECEYLEDGI | 3.85 | | | | |
| NS3 | 1500 | 0.47 | 3 | 3 | 0 | Y | ECEHLEDGIY | 92.31 | ECEYLEDGIY | 3.85 | ECEHLEDGIS | 3.85 | | |
| NS3 | 1501 | 0.47 | 3 | 3 | 0 | Y | CEHLEDGIYG | 92.31 | CEYLEDGIYG | 3.85 | CEHLEDGISG | 3.85 | | |
| NS3 | 1502 | 0.47 | 3 | 3 | 0 | Y | EHLEDGIYGI | 92.31 | EYLEDGIYGI | 3.85 | EHLEDGISGI | 3.85 | | |
| NS3 | 1503 | 0.47 | 3 | 3 | 0 | Y | HLEDGIYGIF | 92.31 | YLEDGIYGIF | 3.85 | YLEDGIYGIF | 3.85 | | |
| NS3 | 1504 | 0.24 | 2 | 2 | 0 | Y | LEDGIYGIFQ | 96.15 | LEDGISGIFQ | 3.85 | | | | |
| NS3 | 1505 | 0.24 | 2 | 2 | 0 | Y | EDGIYGIFQS | 96.15 | EDGISGIFQS | 3.85 | | | | |
| NS3 | 1506 | 0.24 | 2 | 2 | 0 | Y | DGIYGIFQST | 96.15 | DGISGIFQST | 3.85 | | | | |
| NS3 | 1507 | 0.24 | 2 | 2 | 0 | Y | GIYGIFQSTF | 96.15 | GISGIFQSTF | 3.85 | | | | |

Fig. 29-60

Species: YFV (10-mers)

| protein | block starting position | ent

Fig. 29-61

Species: YFV (10-mers)

| protein | block starting position | block entropy | total

Fig. 29-62

Species: YFV (10-mers)

| prot

Fig. 29-63

Species: YFV (10-mers)

| protein

Fig. 29-64

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1608 | 0 | 1 | 1 | 0 | Y | GEIGAVALDY | 100 | | | | | | |
| NS3 | 1609 | 0 | 1 | 1 | 0 | Y | EIGAVALDYP | 100 | | | | | | |
| NS3 | 1610 | 0 | 1 | 1 | 0 | Y | IGAVALDYPS | 100 | | | | | | |
| NS3 | 1611 | 0 | 1 | 1 | 0 | Y | GAVALDYPSG | 100 | | | | | | |
| NS3 | 1612 | 0 | 1 | 1 | 0 | Y | AVALDYPSGT | 100 | | | | | | |
| NS3 | 1613 | 0 | 1 | 1 | 0 | Y | VALDYPSGTS | 100 | | | | | | |
| NS3 | 1614 | 0 | 1 | 1 | 0 | Y | ALDYPSGTSG | 100 | | | | | | |
| NS3 | 1615 | 0 | 1 | 1 | 0 | Y | LDYPSGTSGS | 100 | | | | | | |
| NS3 | 1616 | 0 | 1 | 1 | 0 | Y | DYPSGTSGSP | 100 | | | | | | |
| NS3 | 1617 | 0 | 1 | 1 | 0 | Y | YPSGTSGSPI | 100 | | | | | | |
| NS3 | 1618 | 0 | 1 | 1 | 0 | Y | PSGTSGSPIV | 100 | | | | | | |
| NS3 | 1619 | 0 | 1 | 1 | 0 | Y | SGTSGSPIVN | 100 | | | | | | |
| NS3 | 1620 | 0 | 1 | 1 | 0 | Y | GTSGSPIVNR | 100 | | | | | | |
| NS3 | 1621 | 0.39 | 2 | 2 | 0 | Y | TSGSPIVNRN | 92.31 | TSGSPIVNRS | 7.69 | | | | |
| NS3 | 1622 | 0.39 | 2 | 2 | 0 | Y | SGSPIVNRNG | 92.31 | SGSPIVNRSG | 7.69 | | | | |
| NS3 | 1623 | 0.39 | 2 | 2 | 0 | Y | GSPIVNRNGE | 92.31 | GSPIVNRSGE | 7.69 | | | | |
| NS3 | 1624 | 0.39 | 2 | 2 | 0 | Y | SPIVNRNGEV | 92.31 | SPIVNRSGEV | 7.69 | | | | |
| NS3 | 1625 | 0.62 | 3 | 3 | 0 | Y | PIVNRNGEVI | 88.46 | PIVNRSGEVV | 7.69 | PIVNRNGEVV | 3.85 | | |
| NS3 | 1626 | 0.62 | 3 | 3 | 0 | Y | IVNRNGEVIG | 88.46 | IVNRSGEVVG | 7.69 | IVNRNGEVVG | 3.85 | | |
| NS3 | 1627 | 0.62 | 3 | 3 | 0 | Y | VNRNGEVIGL | 88.46 | VNRSGEVVGL | 7.69 | VNRNGEVVGL | 3.85 | | |
| NS3 | 1628 | 0.62 | 3 | 3 | 0 | Y | NRNGEVIGLY | 88.46 | NRSGEVVGLY | 7.69 | NRNGEVVGLY | 3.85 | | |
| NS3 | 1629 | 0.62 | 3 | 3 | 0 | Y | RNGEVIGLYG | 88.46 | RSGEVVGLYG | 7.69 | RNGEVVGLYG | 3.85 | | |
| NS3 | 1630 | 0.62 | 3 | 3 | 0 | Y | NGEVIGLYGN | 88.46 | SGEVVGLYGN | 7.69 | NGEVVGLYGN | 3.85 | | |
| NS3 | 1631 | 0.52 | 2 | 2 | 0 | Y | GEVIGLYGNG | 88.46 | GEVVGLYGNG | 11.54 | | | | |
| NS3 | 1632 | 0.52 | 2 | 2 | 0 | Y | EVIGLYGNGI | 88.46 | EVVGLYGNGI | 11.54 | | | | |

Fig. 29-65

Species: YFV (10-mers)

| protein | block starting position | entropy | total

Fig. 29-66

Species: YFV (10-mers)

| protein | block starting position

Fig. 29-67

Species: YFV (10-mers)

| prot

Fig. 29-68

Species: YFV (10-mers)

| protein | block starting position | ent

Fig. 29-69

Species: YFV (10-mers)

| protein | block starting position | entropy | total peptides in block | # peptides required to cover 99% of block | gap/X fraction | 99% of block covered w/ <= 5 peptides? | block (99% cover) | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1733 | 0 | 1 | 1 | 0 | Y | TQAFSAHGSG | 100 | | | | | | |
| NS3 | 1734 | 0.52 | 2 | 2 | 0 | Y | QAFSAHGSGR | 88.46 | QAFSAHGSGK | 11.54 | | | | |
| NS3 | 1735 | 0.52 | 2 | 2 | 0 | Y | AFSAHGSGRE | 88.46 | AFSAHGSGKE | 11.54 | | | | |
| NS3 | 1736 | 0.52 | 2 | 2 | 0 | Y | FSAHGSGREV | 88.46 | FSAHGSGKEV | 11.54 | | | | |
| NS3 | 1737 | 0.52 | 2 | 2 | 0 | Y | SAHGSGREVI | 88.46 | SAHGSGKEVI | 11.54 | | | | |
| NS3 | 1738 | 0.52 | 2 | 2 | 0 | Y | AHGSGREVID | 88.46 | AHGSGKEVID | 11.54 | | | | |
| NS3 | 1739 | 0.74 | 3 | 3 | 0 | Y | HGSGREVIDA | 84.62 | HGSGKEVIDA | 11.54 | HGSGREVIDV | 3.85 | | |
| NS3 | 1740 | 0.74 | 3 | 3 | 0 | Y | GSGREVIDAM | 84.62 | GSGKEVIDAM | 11.54 | GSGREVIDVM | 3.85 | | |
| NS3 | 1741 | 0.74 | 3 | 3 | 0 | Y | SGREVIDAMC | 84.62 | SGKEVIDAMC | 11.54 | SGREVIDVMC | 3.85 | | |
| NS3 | 1742 | 0.74 | 3 | 3 | 0 | Y | GREVIDAMCH | 84.62 | GREVIDAMCH | 11.54 | GREVIDVMCH | 3.85 | | |
| NS3 | 1743 | 0.74 | 3 | 3 | 0 | Y | REVIDAMCHA | 84.62 | KEVIDAMCHA | 11.54 | REVIDVMCHA | 3.85 | | |
| NS3 | 1744 | 0.24 | 2 | 2 | 0 | Y | EVIDAMCHAT | 96.15 | EVIDVMCHAT | 3.85 | | | | |
| NS3 | 1745 | 0.24 | 2 | 2 | 0 | Y | VIDAMCHATL | 96.15 | VIDVMCHATL | 3.85 | | | | |
| NS3 | 1746 | 0.24 | 2 | 2 | 0 | Y | IDAMCHATLT | 96.15 | IDVMCHATLT | 3.85 | | | | |
| NS3 | 1747 | 0.24 | 2 | 2 | 0 | Y | DAMCHATLTY | 96.15 | DVMCHATLTY | 3.85 | | | | |
| NS3 | 1748 | 0.24 | 2 | 2 | 0 | Y | AMCHATLTYR | 96.15 | VMCHATLTYR | 3.85 | | | | |
| NS3 | 1749 | 0 | 1 | 1 | 0 | Y | MCHATLTYRM | 100 | | | | | | |
| NS3 | 1750 | 0 | 1 | 1 | 0 | Y | CHATLTYRML | 100 | | | | | | |
| NS3 | 1751 | 0 | 1 | 1 | 0 | Y | HATLTYRMLE | 100 | | | | | | |
| NS3 | 1752 | 0 | 1 | 1 | 0 | Y | ATLTYRMLEP | 100 | | | | | | |
| NS3 | 1753 | 0 | 1 | 1 | 0 | Y | TLTYRMLEPT | 100 | | | | | | |
| NS3 | 1754 | 0 | 1 | 1 | 0 | Y | LTYRMLEPTR | 100 | | | | | | |
| NS3 | 1755 | 1 | 3 | 3 | 0 | Y | TYRMLEPTRV | 73.08 | TYRMLEPTRI | 23.08 | TYRMLEPTRA | 3.85 | | |
| NS3 | 1756 | 1 | 3 | 3 | 0 | Y | YRMLEPTRVV | 73.08 | YRMLEPTRIV | 23.08 | YRMLEPTRAV | 3.85 | | |
| NS3 | 1757 | 1 | 3 | 3 | 0 | Y | RMLEPTRVVN | 73.08 | RMLEPTRIVN | 23.08 | RMLEPTRAVN | 3.85 | | |

Fig. 29-70

Species: YFV (10-mers)

| protein | block starting position | block | entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 1758 | | 1 | 3 | 3 | 0 | Y | MLEPTRVNW | 73.08 | MLEPTRIVNW | 23.08 | MLEPTRAVNW | 3.85 | | |
| NS3 | 1759 | | 1 | 3 | 3 | 0 | Y | LEPTRVNWE | 73.08 | LEPTRIVNWE | 23.08 | LEPTRAVNWE | 3.85 | | |
| NS3 | 1760 | | 1 | 3 | 3 | 0 | Y | EPTRVNWEV | 73.08 | EPTRIVNWEV | 23.08 | EPTRAVNWEV | 3.85 | | |
| NS3 | 1761 | | 1 | 3 | 3 | 0 | Y | PTRVNWEVI | 73.08 | PTRIVNWEVI | 23.08 | PTRAVNWEVI | 3.85 | | |
| NS3 | 1762 | | 1 | 3 | 3 | 0 | Y | TRVNWEVII | 73.08 | TRIVNWEVII | 23.08 | TRAVNWEVII | 3.85 | | |
| NS3 | 1763 | | 1 | 3 | 3 | 0 | Y | RVNWEVIIM | 73.08 | RIVNWEVIIM | 23.08 | RAVNWEVIIM | 3.85 | | |
| NS3 | 1764 | | 1 | 3 | 3 | 0 | Y | VNWEVIIMD | 73.08 | IVNWEVIIMD | 23.08 | AVNWEVIIMD | 3.85 | | |
| NS3 | 1765 | | 0 | 1 | 1 | 0 | Y | VNWEVIIMDE | 100 | | | | | | |
| NS3 | 1766 | | 0 | 1 | 1 | 0 | Y | NWEVIIMDEA | 100 | | | | | | |
| NS3 | 1767 | | 0 | 1 | 1 | 0 | Y | WEVIIMDEAH | 100 | | | | | | |
| NS3 | 1768 | | 0 | 1 | 1 | 0 | Y | EVIIMDEAHF | 100 | | | | | | |
| NS3 | 1769 | | 0 | 1 | 1 | 0 | Y | VIIMDEAHFL | 100 | | | | | | |
| NS3 | 1770 | | 0 | 1 | 1 | 0 | Y | IIMDEAHFLD | 100 | | | | | | |
| NS3 | 1771 | | 0 | 1 | 1 | 0 | Y | IMDEAHFLDP | 100 | | | | | | |
| NS3 | 1772 | | 0 | 1 | 1 | 0 | Y | MDEAHFLDPA | 100 | | | | | | |
| NS3 | 1773 | | 0 | 1 | 1 | 0 | Y | DEAHFLDPAS | 100 | | | | | | |
| NS3 | 1774 | | 0 | 1 | 1 | 0 | Y | EAHFLDPASI | 100 | | | | | | |
| NS3 | 1775 | | 0 | 1 | 1 | 0 | Y | AHFLDPASIA | 100 | | | | | | |
| NS3 | 1776 | | 0 | 1 | 1 | 0 | Y | HFLDPASIAA | 100 | | | | | | |
| NS3 | 1777 | | 0 | 1 | 1 | 0 | Y | FLDPASIAAR | 100 | | | | | | |
| NS3 | 1778 | | 0 | 1 | 1 | 0 | Y | LDPASIAARG | 100 | | | | | | |
| NS3 | 1779 | | 0 | 1 | 1 | 0 | Y | DPASIAARGW | 100 | | | | | | |
| NS3 | 1780 | | 0 | 1 | 1 | 0 | Y | PASIAARGWA | 100 | | | | | | |
| NS3 | 1781 | | 0 | 1 | 1 | 0 | Y | ASIAARGWAA | 100 | | | | | | |
| NS3 | 1782 | | 0 | 1 | 1 | 0 | Y | SIAARGWAAH | 100 | | | | | | |

Fig. 29-71

Species: YFV (10-mers)

| protein | block starting position | entropy block | total pe

Fig. 29-72

Species: YFV (10-mers)

| protein

Fig. 29-73

Species: YFV (10-mers)

| protein | block starting position | block entropy | total peptides in block | # peptides required

Fig. 29-74

Species: YFV (10-mers)

| protein | block starting position | block entropy | total

Fig. 29-75

| protein | block starting position | entropy block | total pe

Fig. 29-76

Species: YFV (10-mers)

| protein | block starting position | entropy block | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1908 | 0.24 | 2 | 2 | 0 | Y | VERVLDCRTA | 96.15 | VDRVLDCRTA | 3.85 | DRVLDCRTAF | 3.85 | | |
| NS3 | 1909 | 0.74 | 3 | 3 | 0 | Y | ERVLDCRTAF | 84.62 | ERVLDCRTAY | 11.54 | | | | |
| NS3 | 1910 | 0.52 | 2 | 2 | 0 | Y | RVLDCRTAFK | 88.46 | RVLDCRTAYK | 11.54 | | | | |
| NS3 | 1911 | 0.52 | 2 | 2 | 0 | Y | VLDCRTAFKP | 88.46 | VLDCRTAYKP | 11.54 | | | | |
| NS3 | 1912 | 0.52 | 2 | 2 | 0 | Y | LDCRTAFKPV | 88.46 | LDCRTAYKPV | 11.54 | | | | |
| NS3 | 1913 | 0.52 | 2 | 2 | 0 | Y | DCRTAFKPVL | 88.46 | DCRTAYKPVL | 11.54 | | | | |
| NS3 | 1914 | 0.52 | 2 | 2 | 0 | Y | CRTAFKPVLV | 88.46 | CRTAYKPVLV | 11.54 | | | | |
| NS3 | 1915 | 0.52 | 2 | 2 | 0 | Y | RTAFKPVLVD | 88.46 | RTAYKPVLVD | 11.54 | | | | |
| NS3 | 1916 | 0.52 | 2 | 2 | 0 | Y | TAFKPVLVDE | 88.46 | TAYKPVLVDE | 11.54 | | | | |
| NS3 | 1917 | 0.52 | 2 | 2 | 0 | Y | AFKPVLVDEG | 88.46 | AYKPVLVDEG | 11.54 | | | | |
| NS3 | 1918 | 0.62 | 3 | 3 | 0 | Y | FKPVLVDEGR | 88.46 | YKPVLVDEGR | 7.69 | YKPVLVDEGK | 3.85 | | |
| NS3 | 1919 | 0.24 | 2 | 2 | 0 | Y | KPVLVDEGKK | 96.15 | KPVLVDEGKV | 3.85 | | | | |
| NS3 | 1920 | 0.24 | 2 | 2 | 0 | Y | PVLVDEGKKV | 96.15 | PVLVDEGRKV | 3.85 | | | | |
| NS3 | 1921 | 0.24 | 2 | 2 | 0 | Y | VLVDEGKKVA | 96.15 | VLVDEGRKVA | 3.85 | | | | |
| NS3 | 1922 | 0.24 | 2 | 2 | 0 | Y | LVDEGKKVAI | 96.15 | LVDEGRKVAI | 3.85 | | | | |
| NS3 | 1923 | 0.24 | 2 | 2 | 0 | Y | VDEGKKVAIK | 96.15 | VDEGRKVAIK | 3.85 | | | | |
| NS3 | 1924 | 0.24 | 2 | 2 | 0 | Y | DEGKKVAIKG | 96.15 | DEGRKVAIKG | 3.85 | | | | |
| NS3 | 1925 | 0.24 | 2 | 2 | 0 | Y | EGKKVAIKGP | 96.15 | EGRKVAIKGP | 3.85 | | | | |
| NS3 | 1926 | 0.24 | 2 | 2 | 0 | Y | GKKVAIKGPL | 96.15 | GRKVAIKGPL | 3.85 | | | | |
| NS3 | 1927 | 0.24 | 2 | 2 | 0 | Y | KKVAIKGPLR | 96.15 | RKVAIKGPLR | 3.85 | | | | |
| NS3 | 1928 | 0 | 1 | 1 | 0 | Y | KVAIKGPLRI | 100 | | | | | | |
| NS3 | 1929 | 0 | 1 | 1 | 0 | Y | VAIKGPLRIS | 100 | | | | | | |
| NS3 | 1930 | 0 | 1 | 1 | 0 | Y | AIKGPLRISA | 100 | | | | | | |
| NS3 | 1931 | 0 | 1 | 1 | 0 | Y | IKGPLRISAS | 100 | | | | | | |
| NS3 | 1932 | 0 | 1 | 1 | 0 | Y | KGPLRISASS | 100 | | | | | | |

Fig. 29-77

Species: YFV (10-mers)

| protein | block starting position | entropy | total peptides in block

Fig. 29-78

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1958 | 0 | 1 | 1 | 0 | Y | DSYYSEPTS | 100 | | | | | | |
| NS3 | 1959 | 0 | 1 | 1 | 0 | Y | SYYYSEPTSE | 100 | | | | | | |
| NS3 | 1960 | 0.96 | 2 | 2 | 0 | Y | YYSEPTSEN | 61.54 | YYYSEPTSED | 38.46 | | | | |
| NS3 | 1961 | 0.96 | 2 | 2 | 0 | Y | YSEPTSENN | 61.54 | YYSEPTSEDN | 38.46 | | | | |
| NS3 | 1962 | 0.96 | 2 | 2 | 0 | Y | YSEPTSENNA | 61.54 | YSEPTSEDNA | 38.46 | | | | |
| NS3 | 1963 | 0.96 | 2 | 2 | 0 | Y | SEPTSENNAH | 61.54 | SEPTSEDNAH | 38.46 | | | | |
| NS3 | 1964 | 0.96 | 2 | 2 | 0 | Y | EPTSENNAHH | 61.54 | EPTSEDNAHH | 38.46 | | | | |
| NS3 | 1965 | 0.96 | 2 | 2 | 0 | Y | PTSENNAHHV | 61.54 | PTSEDNAHHV | 38.46 | | | | |
| NS3 | 1966 | 0.96 | 2 | 2 | 0 | Y | TSENNAHHVC | 61.54 | TSEDNAHHVC | 38.46 | | | | |
| NS3 | 1967 | 0.96 | 2 | 2 | 0 | Y | SENNAHHVCW | 61.54 | SEDNAHHVCW | 38.46 | | | | |
| NS3 | 1968 | 0.96 | 2 | 2 | 0 | Y | ENNAHHVCWL | 61.54 | EDNAHHVCWL | 38.46 | | | | |
| NS3 | 1969 | 0.96 | 2 | 2 | 0 | Y | NNAHHVCWLE | 61.54 | DNAHHVCWLE | 38.46 | | | | |
| NS3 | 1970 | 0 | 1 | 1 | 0 | Y | NAHHVCWLEA | 100 | | | | | | |
| NS3 | 1971 | 0 | 1 | 1 | 0 | Y | AHHVCWLEAS | 100 | | | | | | |
| NS3 | 1972 | 0 | 1 | 1 | 0 | Y | HHVCWLEASM | 100 | | | | | | |
| NS3 | 1973 | 0 | 1 | 1 | 0 | Y | HVCWLEASML | 100 | | | | | | |
| NS3 | 1974 | 0 | 1 | 1 | 0 | Y | VCWLEASMLL | 100 | | | | | | |
| NS3 | 1975 | 0 | 1 | 1 | 0 | Y | CWLEASMLLD | 100 | | | | | | |
| NS3 | 1976 | 0 | 1 | 1 | 0 | Y | WLEASMLLDN | 100 | | | | | | |
| NS3 | 1977 | 0 | 1 | 1 | 0 | Y | LEASMLLDNM | 100 | | | | | | |
| NS3 | 1978 | 0 | 1 | 1 | 0 | Y | EASMLLDNME | 100 | | | | | | |
| NS3 | 1979 | 0 | 1 | 1 | 0 | Y | ASMLLDNMEV | 100 | | | | | | |
| NS3 | 1980 | 0 | 1 | 1 | 0 | Y | SMLLDNMEVR | 100 | | | | | | |
| NS3 | 1981 | 0 | 1 | 1 | 0 | Y | MLLDNMEVRG | 100 | | | | | | |
| NS3 | 1982 | 0 | 1 | 1 | 0 | Y | LLDNMEVRGG | 100 | | | | | | |

Fig. 29-79

Species: YFV (10-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1983 | 0 | 1 | 1 | 0 | Y | LDNMEVRGGM | 100 | | | | | | |
| NS3 | 1984 | 0 | 1 | 1 | 0 | Y | DNMEVRGGMV | 100 | | | | | | |
| NS3 | 1985 | 0 | 1 | 1 | 0 | Y | NMEVRGGMVA | 100 | | | | | | |
| NS3 | 1986 | 0 | 1 | 1 | 0 | Y | MEVRGGMVAP | 100 | | | | | | |
| NS3 | 1987 | 0 | 1 | 1 | 0 | Y | EVRGGMVAPL | 100 | | | | | | |
| NS3 | 1988 | 0 | 1 | 1 | 0 | Y | VRGGMVAPLY | 100 | | | | | | |
| NS3 | 1989 | 0 | 1 | 1 | 0 | Y | RGGMVAPLYG | 100 | | | | | | |
| NS3 | 1990 | 0.62 | 2 | 2 | 0 | Y | GGMVAPLYGV | 84.62 | GGMVAPLYGI | 15.38 | | | | |
| NS3 | 1991 | 0.62 | 2 | 2 | 0 | Y | GMVAPLYGVE | 84.62 | GMVAPLYGIE | 15.38 | | | | |
| NS3 | 1992 | 0.62 | 2 | 2 | 0 | Y | MVAPLYGVEG | 84.62 | MVAPLYGIEG | 15.38 | | | | |
| NS3 | 1993 | 0.85 | 3 | 3 | 0 | Y | VAPLYGVEGT | 80.77 | VAPLYGIEGT | 15.38 | VAPLYGVEGI | 3.85 | | |
| NS3 | 1994 | 0.85 | 3 | 3 | 0 | Y | APLYGVEGTK | 80.77 | APLYGIEGTK | 15.38 | APLYGVEGIK | 3.85 | | |
| NS3 | 1995 | 0.85 | 3 | 3 | 0 | Y | PLYGVEGTKT | 80.77 | PLYGIEGTKT | 15.38 | PLYGVEGIKT | 3.85 | | |
| NS3 | 1996 | 0.85 | 3 | 3 | 0 | Y | LYGVEGTKTP | 80.77 | LYGIEGTKTP | 15.38 | LYGVEGIKTP | 3.85 | | |
| NS3 | 1997 | 0.85 | 3 | 3 | 0 | Y | YGVEGTKTPV | 80.77 | YGIEGTKTPV | 15.38 | YGVEGIKTPV | 3.85 | | |
| NS3 | 1998 | 0.85 | 3 | 3 | 0 | Y | GVEGTKTPVS | 80.77 | GIEGTKTPVS | 15.38 | GVEGIKTPVS | 3.85 | | |
| NS3 | 1999 | 0.85 | 3 | 3 | 0 | Y | VEGTKTPVSP | 80.77 | IEGTKTPVSP | 15.38 | VEGIKTPVSP | 3.85 | | |
| NS3 | 2000 | 0.24 | 2 | 2 | 0 | Y | EGTKTPVSPG | 96.15 | EGIKTPVSPG | 3.85 | | | | |
| NS3 | 2001 | 0.24 | 2 | 2 | 0 | Y | GTKTPVSPGE | 96.15 | GIKTPVSPGE | 3.85 | | | | |
| NS3 | 2002 | 0.24 | 2 | 2 | 0 | Y | TKTPVSPGEM | 96.15 | IKTPVSPGEM | 3.85 | | | | |
| NS3 | 2003 | 0 | 1 | 1 | 0 | Y | KTPVSPGEMR | 100 | | | | | | |
| NS3 | 2004 | 0 | 1 | 1 | 0 | Y | TPVSPGEMRL | 100 | | | | | | |
| NS3 | 2005 | 0 | 1 | 1 | 0 | Y | PVSPGEMRLR | 100 | | | | | | |
| NS3 | 2006 | 0 | 1 | 1 | 0 | Y | VSPGEMRLRD | 100 | | | | | | |
| NS3 | 2007 | 0 | 1 | 1 | 0 | Y | SPGEMRLRDD | 100 | | | | | | |

Fig. 29-80

Species: YFV (10-mers)

| protein | block starting position | ent

Fig. 29-81

Species: YFV (10-mers)

| protein | block starting position | entropy block | total peptides in block | # peptides required to cover 99% of block | gap/X fraction 99% of block | covered w/ <= 5 peptides? | peptides required to cover 99% of block | frequency | peptides required to cover 99

Fig. 29-82

Species: YFV (10-mers)

| protein | block starting position | entropy block | total pe

Fig. 29-83

Species: YFV (10-mers)

| protein | block starting position | ent

Fig. 29-84

Species: YFV (10-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2108 | 1.08 | 5 | 5 | 0 | Y | GAAEVLWLS | 80.77 | GAAEMLWLT | 7.69 | GAAEILWLS | 3.85 | GAAEMLVILT | 3.85 | GAADVLWLS | 3.85 |
| NS4A | 2109 | 1.08 | 5 | 5 | 0 | Y | AAEVLWLSE | 80.77 | AAEMLWLTE | 7.69 | AADVLWLSE | 3.85 | AAEMLVILTE | 3.85 | AAEILWLSE | 3.85 |
| NS4A | 2110 | 1.08 | 5 | 5 | 0 | Y | AEVLWLSEL | 80.77 | AEMLWLTEL | 7.69 | ADVLWLSEL | 3.85 | AEMLVILTEL | 3.85 | AEILWLSEL | 3.85 |
| NS4A | 2111 | 1.08 | 5 | 5 | 0 | Y | EVLWLSELP | 80.77 | EMLWLTELP | 7.69 | EILWLSELP | 3.85 | EMLVILTELP | 3.85 | DVLWLSELP | 3.85 |
| NS4A | 2112 | 0.85 | 4 | 4 | 0 | Y | VLWLSELPD | 84.62 | MLWLTELPD | 7.69 | MLVILTELPD | 3.85 | ILVWLSELPD | 3.85 | |
| NS4A | 2113 | 0.62 | 3 | 3 | 0 | Y | LWLSELPDF | 88.46 | LWLTELPDF | 7.69 | LVILTELPDF | 3.85 | | |
| NS4A | 2114 | 0.62 | 3 | 3 | 0 | Y | WLSELPDFL | 88.46 | WLTELPDFL | 7.69 | VILTELPDFL | 3.85 | | |
| NS4A | 2115 | 0.62 | 3 | 3 | 0 | Y | VLSELPDFLA | 88.46 | VLTELPDFLA | 7.69 | ILTELPDFLA | 3.85 | | |
| NS4A | 2116 | 0.52 | 2 | 2 | 0 | Y | LSELPDFLAK | 88.46 | LTELPDFLAK | 11.54 | | | |
| NS4A | 2117 | 0.52 | 2 | 2 | 0 | Y | SELPDFLAKK | 88.46 | TELPDFLAKK | 11.54 | | | |
| NS4A | 2118 | 0 | 1 | 1 | 0 | Y | ELPDFLAKKG | 100 | | | | |
| NS4A | 2119 | 0 | 1 | 1 | 0 | Y | LPDFLAKKGG | 100 | | | | |
| NS4A | 2120 | 0 | 1 | 1 | 0 | Y | PDFLAKKGGE | 100 | | | | |
| NS4A | 2121 | 0 | 1 | 1 | 0 | Y | DFLAKKGGEA | 100 | | | | |
| NS4A | 2122 | 0 | 1 | 1 | 0 | Y | FLAKKGGEAM | 100 | | | | |
| NS4A | 2123 | 0 | 1 | 1 | 0 | Y | LAKKGGEAMD | 100 | | | | |
| NS4A | 2124 | 0 | 1 | 1 | 0 | Y | AKKGGEAMDT | 100 | | | | |
| NS4A | 2125 | 0 | 1 | 1 | 0 | Y | KKGGEAMDTI | 100 | | | | |
| NS4A | 2126 | 0 | 1 | 1 | 0 | Y | KGGEAMDTIS | 100 | | | | |
| NS4A | 2127 | 0 | 1 | 1 | 0 | Y | GGEAMDTISV | 100 | | | | |
| NS4A | 2128 | 0.24 | 2 | 2 | 0 | Y | GEAMDTISVF | 96.15 | GEAMDTISVL | 3.85 | | | |
| NS4A | 2129 | 0.24 | 2 | 2 | 0 | Y | EAMDTISVFL | 96.15 | EAMDTISVLL | 3.85 | | | |
| NS4A | 2130 | 0.24 | 2 | 2 | 0 | Y | AMDTISVFLH | 96.15 | AMDTISVLLH | 3.85 | | | |
| NS4A | 2131 | 0.24 | 2 | 2 | 0 | Y | MDTISVFLHS | 96.15 | MDTISVLLHS | 3.85 | | | |
| NS4A | 2132 | 0.24 | 2 | 2 | 0 | Y | DTISVFLHSE | 96.15 | DTISVLLHSE | 3.85 | | | |

Fig. 29-85

Species: YFV (10-mers)

| protein | block starting position | entropy block | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2133 | 0.24 | 2 | 2 | 0 | Y | TISVFLHSEE | 96.15 | TISVLLHSEE | 3.85 | | | | |
| NS4A | 2134 | 0.24 | 2 | 2 | 0 | Y | ISVFLHS

Fig. 29-86

Species: YFV (10-mers)

| protein | block starting position | entropy block | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2158 | 0.62 | 3 | 3 | 0 | Y | MTIVMLFILA | 88.46 | MTIVMLFILA | 7.69 | MTIAMLFILA | 3.85 | | |
| NS4A | 2159 | 0.62 | 3 | 3 | 0 | Y | TIVMLFILAG | 88.46 | TIVMLFILAG | 7.69 | TIAMLFILAG | 3.85 | | |
| NS4A | 2160 | 0.62 | 3 | 3 | 0 | Y | IVMLFILAGL | 88.46 | IVMLFILAGL | 7.69 | IAMLFILAGL | 3.85 | | |
| NS4A | 2161 | 0.62 | 3 | 3 | 0 | Y | VMLFILAGLL | 88.46 | VMLFILAGLL | 7.69 | AMLFILAGLL | 3.85 | | |
| NS4A | 2162 | 0.39 | 2 | 2 | 0 | Y | MLFILAGLLT | 92.31 | MLFILAGLLT | 7.69 | | | | |
| NS4A | 2163 | 0.39 | 2 | 2 | 0 | Y | LFILAGLLTS | 92.31 | LFILAGLLTS | 7.69 | | | | |
| NS4A | 2164 | 0.39 | 2 | 2 | 0 | Y | FILAGLLTSG | 92.31 | FILAGLLTSG | 7.69 | | | | |
| NS4A | 2165 | 0.47 | 3 | 3 | 0 | Y | ILAGLLTSGM | 92.31 | LLAGLLTSGM | 3.85 | LLAGLLTSGA | 3.85 | | |
| NS4A | 2166 | 0.24 | 2 | 2 | 0 | Y | LAGLLTSGMV | 96.15 | LAGLLTSGAV | 3.85 | | | | |
| NS4A | 2167 | 0.24 | 2 | 2 | 0 | Y | AGLLTSGMVI | 96.15 | AGLLTSGAVI | 3.85 | | | | |
| NS4A | 2168 | 0.24 | 2 | 2 | 0 | Y | GLLTSGMVIF | 96.15 | GLLTSGAVIF | 3.85 | | | | |
| NS4A | 2169 | 0.24 | 2 | 2 | 0 | Y | LLTSGMVIFF | 96.15 | LLTSGAVIFF | 3.85 | | | | |
| NS4A | 2170 | 0.24 | 2 | 2 | 0 | Y | LTSGMVIFFM | 96.15 | LTSGAVIFFM | 3.85 | | | | |
| NS4A | 2171 | 0.24 | 2 | 2 | 0 | Y | TSGMVIFFMS | 96.15 | TSGAVIFFMS | 3.85 | | | | |
| NS4A | 2172 | 0.24 | 2 | 2 | 0 | Y | SGMVIFFMSP | 96.15 | SGAVIFFMSP | 3.85 | | | | |
| NS4A | 2173 | 0.24 | 2 | 2 | 0 | Y | GMVIFFMSPK | 96.15 | GAVIFFMSPK | 3.85 | | | | |
| NS4A | 2174 | 0.24 | 2 | 2 | 0 | Y | MVIFFMSPKG | 96.15 | AVIFFMSPKG | 3.85 | | | | |
| NS4A | 2175 | 0.52 | 2 | 2 | 0 | Y | VIFFMSPKGI | 88.46 | VIFFMSPKGM | 11.54 | | | | |
| NS4A | 2176 | 0.52 | 2 | 2 | 0 | Y | IFFMSPKGIS | 88.46 | IFFMSPKGMS | 11.54 | | | | |
| NS4A | 2177 | 0.52 | 2 | 2 | 0 | Y | FFMSPKGISR | 88.46 | FFMSPKGMSR | 11.54 | | | | |
| NS4A | 2178 | 0.52 | 2 | 2 | 0 | Y | FMSPKGISRM | 88.46 | FMSPKGMSRM | 11.54 | | | | |
| NS4A | 2179 | 0.52 | 2 | 2 | 0 | Y | MSPKGISRMS | 88.46 | MSPKGMSRMS | 11.54 | | | | |
| NS4A | 2180 | 0.52 | 2 | 2 | 0 | Y | SPKGISRMSM | 88.46 | SPKGMSRMSM | 11.54 | | | | |
| NS4A | 2181 | 0.52 | 2 | 2 | 0 | Y | PKGISRMSMA | 88.46 | PKGMSRMSMA | 11.54 | | | | |
| NS4A | 2182 | 0.74 | 3 | 3 | 0 | Y | KGISRMSMAM | 84.62 | KGMSRMSMAM | 11.54 | KGISRMSMAK | 3.85 | | |

Species: YFV (10-mers)

Fig. 29-87

| protein | block starting position | block entropy | total

Fig. 29-88

Species: YFV (10-mers)

| protein | block starting position | entropy block | total peptides in block | # peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS4A | 2208 | 0.89 | 2 | 2 | 0 | Y | PTHISYIMLI | 69.23 | PTHISYMLI | 30.77 | | | | |
| NS4A | 2209 | 0.89 | 2 | 2 | 0 | Y | THISYIMLIF | 69.23 | THISYMLIF | 30.77 | | | | |
| NS4A | 2210 | 0.89 | 2 | 2 | 0 | Y | HISYIMLIFF | 69.23 | HISYMLIFF | 30.77 | | | | |
| NS4A | 2211 | 0.89 | 2 | 2 | 0 | Y | ISYIMLIFFV | 69.23 | ISYYMLIFFV | 30.77 | | | | |
| NS4A | 2212 | 0.89 | 2 | 2 | 0 | Y | SYIMLIFFVL | 69.23 | SYYMLIFFVL | 30.77 | | | | |
| NS4A | 2213 | 0.89 | 2 | 2 | 0 | Y | YIMLIFFVLM | 69.23 | YYMLIFFVLM | 30.77 | | | | |
| NS4A | 2214 | 0.89 | 2 | 2 | 0 | Y | IMLIFFVLMV | 69.23 | YMLIFFVLMV | 30.77 | | | | |
| NS4A | 2215 | 0 | 1 | 1 | 0 | Y | MLIFFVLMVV | 100 | | | | | | |
| NS4A | 2216 | 0.39 | 2 | 2 | 0 | Y | LIFFVLMVVV | 92.31 | LIFFVLMVVI | 7.69 | | | | |
| NS4A | 2217 | 0.39 | 2 | 2 | 0 | Y | IFFVLMVVVI | 92.31 | IFFVLMVVII | 7.69 | | | | |
| NS4A | 2218 | 0.39 | 2 | 2 | 0 | Y | FFVLMVVIIP | 92.31 | FFVLMVVIIP | 7.69 | | | | |
| NS4A | 2219 | 0.39 | 2 | 2 | 0 | Y | FVLMVVIIPE | 92.31 | FVLMVVIIPE | 7.69 | | | | |
| NS4A | 2220 | 0.39 | 2 | 2 | 0 | Y | VLMVVIIPEP | 92.31 | VLMVVIIPEP | 7.69 | | | | |
| NS4A | 2221 | 0.39 | 2 | 2 | 0 | Y | LMVVIIPEPG | 92.31 | LMVVIIPEPG | 7.69 | | | | |
| NS4A | 2222 | 0.39 | 2 | 2 | 0 | Y | MVVIIPEPGQ | 92.31 | MVVIIPEPGQ | 7.69 | | | | |
| NS4A | 2223 | 0.39 | 2 | 2 | 0 | Y | VVIIPEPGQQ | 92.31 | VVIIPEPGQQ | 7.69 | | | | |
| NS4A | 2224 | 0.39 | 2 | 2 | 0 | Y | VIIPEPGQQR | 92.31 | VIIPEPGQQR | 7.69 | | | | |
| NS4A | 2225 | 0.7 | 4 | 4 | 0 | Y | VIPEPGQQRS | 88.46 | VIPEPGQQRT | 3.85 | IIPEPGQQRT | 3.85 | IIPEPGQQRS | 3.85 |
| NS4A | 2226 | 0.39 | 2 | 2 | 0 | Y | IPEPGQQRSI | 92.31 | IPEPGQQRTI | 7.69 | | | | |
| NS4A | 2227 | 0.39 | 2 | 2 | 0 | Y | PEPGQQRSIQ | 92.31 | PEPGQQRTIQ | 7.69 | | | | |
| NS4A | 2228 | 0.39 | 2 | 2 | 0 | Y | EPGQQRSIQD | 92.31 | EPGQQRTIQD | 7.69 | | | | |
| NS4A | 2229 | 0.39 | 2 | 2 | 0 | Y | PGQQRSIQDN | 92.31 | PGQQRTIQDN | 7.69 | | | | |
| NS4A | 2230 | 0.39 | 2 | 2 | 0 | Y | GQQRSIQDNQ | 92.31 | GQQRTIQDNQ | 7.69 | | | | |
| NS4A | 2231 | 0.39 | 2 | 2 | 0 | Y | QQRSIQDNQV | 92.31 | QQRTIQDNQV | 7.69 | | | | |
| NS4A | 2232 | 0.39 | 2 | 2 | 0 | Y | QRSIQDNQVA | 92.31 | QRTIQDNQVA | 7.69 | | | | |

Fig. 29-89

Species: YFV (10-mers)

| protein | block starting position | block entropy | total peptides in block | # peptides required to cover 99% of block | gap/X fraction of 99% of block | covered w/ <= 5 peptides? | block | frequency | block | frequency | block | frequency | block | frequency |
|---|---|---|---|---|---|---|---|---|

Fig. 29-90

Species: YFV (10-mers)

| protein | block starting position | entropy block | total pe

Fig. 29-91

Species: YFV (10-mers)

| prot

Fig. 29-92

Species: YFV (10-mers)

| protein | block starting position | entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS4B | 2319 | 0 | 1 | 1 | 0 | Y | YGNLSLSGIA | 100 |
| NS4B | 2320 | 0 | 1 | 1 | 0 | Y | GNLSLSGIAQ | 100 |
| NS4B | 2321 | 0 | 1 | 1 | 0 | Y | NLSLSGIAQS | 100 |
| NS4B | 2322 | 0 | 1 | 1 | 0 | Y | LSLSGIAQSA | 100 |
| NS4B | 2323 | 0 | 1 | 1 | 0 | Y | SLSGIAQSAS | 100 |
| NS4B | 2324 | 0 | 1 | 1 | 0 | Y | LSGIAQSASV | 100 |
| NS4B | 2325 | 0 | 1 | 1 | 0 | Y | SGIAQSASVL | 100 |
| NS4B | 2326 | 0 | 1 | 1 | 0 | Y | GIAQSASVLS | 100 |
| NS4B | 2327 | 0 | 1 | 1 | 0 | Y | IAQSASVLSF | 100 |
| NS4B | 2328 | 0 | 1 | 1 | 0 | Y | AQSASVLSFM | 100 |
| NS4B | 2329 | 0 | 1 | 1 | 0 | Y | QSASVLSFMD | 100 |
| NS4B | 2330 | 0 | 1 | 1 | 0 | Y | SASVLSFMDK | 100 |
| NS4B | 2331 | 0 | 1 | 1 | 0 | Y | ASVLSFMDKG | 100 |
| NS4B | 2332 | 0.24 | 2 | 2 | 0 | Y | SVLSFMDKGI | 96.15 | SVLSFMDKGV | 3.85 |
| NS4B | 2333 | 0.24 | 2 | 2 | 0 | Y | VLSFMDKGIP | 96.15 | VLSFMDKGVP | 3.85 |
| NS4B | 2334 | 0.24 | 2 | 2 | 0 | Y | LSFMDKGIPF | 96.15 | LSFMDKGVPF | 3.85 |
| NS4B | 2335 | 0.24 | 2 | 2 | 0 | Y | SFMDKGIPFM | 96.15 | SFMDKGVPFM | 3.85 |
| NS4B | 2336 | 0.24 | 2 | 2 | 0 | Y | FMDKGIPFMK | 96.15 | FMDKGVPFMK | 3.85 |
| NS4B | 2337 | 0.24 | 2 | 2 | 0 | Y | MDKGIPFMKM | 96.15 | MDKGVPFMKM | 3.85 |
| NS4B | 2338 | 0.24 | 2 | 2 | 0 | Y | DKGIPFMKMN | 96.15 | DKGVPFMKMN | 3.85 |
| NS4B | 2339 | 0.24 | 2 | 2 | 0 | Y | KGIPFMKMNI | 96.15 | KGVPFMKMNI | 3.85 |
| NS4B | 2340 | 0.24 | 2 | 2 | 0 | Y | GIPFMKMNIS | 96.15 | GVPFMKMNIS | 3.85 |
| NS4B | 2341 | 0.24 | 2 | 2 | 0 | Y | IPFMKMNISV | 96.15 | VPFMKMNISV | 3.85 |
| NS4B | 2342 | 0.52 | 2 | 2 | 0 | Y | PFMKMNISVI | 88.46 | PFMKMNISVV | 11.54 |
| NS4B | 2343 | 1.18 | 3 | 3 | 0 | Y | FMKMNISVIM | 69.23 | FMKMNISVI | 19.23 | FMKMNISVVI | 11.54 |

Fig. 29-93

Species: YFV (10-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2344 | 1.18 | 3 | 3 | 0 | Y | MKMNISVIML | 69.23 | MKMNISVIIL | 19.23 | MKMNISWIL | 11.54 | | |
| NS4B | 2345 | 1.18 | 3 | 3 | 0 | Y | KMNISVIMLL | 69.23 | KMNISVIILL | 19.23 | KMNISVIILL | 11.54 | | |
| NS4B | 2346 | 1.4 | 4 | 4 | 0 | Y | MNISVIMLLV | 65.38 | MNISVIILLV | 19.23 | MNISVIILLV | 11.54 | MNISVIMLLI | 3.85 | |
| NS4B | 2347 | 1.4 | 4 | 4 | 0 | Y | NISVIMLLVS | 65.38 | NISVIILLVS | 19.23 | NISVIILLVS | 11.54 | NISVIMLLIS | 3.85 | |
| NS4B | 2348 | 1.4 | 4 | 4 | 0 | Y | ISVIMLLVSG | 65.38 | ISVIILLVSG | 19.23 | ISVIILLVSG | 11.54 | ISVIMLLISG | 3.85 | |
| NS4B | 2349 | 1.4 | 4 | 4 | 0 | Y | SVIMLLVSGW | 65.38 | SVIILLVSGW | 19.23 | SVIILLVSGW | 11.54 | SVIMLLISGW | 3.85 | |
| NS4B | 2350 | 1.4 | 4 | 4 | 0 | Y | VIMLLVSGWN | 65.38 | VIILLVSGWN | 19.23 | VIILLVSGWN | 11.54 | VIMLLISGWN | 3.85 | |
| NS4B | 2351 | 1.4 | 3 | 4 | 0 | Y | IMLLYSGWNS | 65.38 | IILLYSGWNS | 19.23 | VILLYSGWNS | 11.54 | IMLLISGWNS | 3.85 | |
| NS4B | 2352 | 1.1 | 2 | 3 | 0 | Y | MLLVSGWNSI | 65.38 | ILLVSGWNSI | 30.77 | MLLISGWNSI | 3.85 | | |
| NS4B | 2353 | 0.24 | 2 | 2 | 0 | Y | LLVSGWNSIT | 96.15 | LLSGWNSIT | 3.85 | | | |
| NS4B | 2354 | 0.24 | 2 | 2 | 0 | Y | LVSGWNSITV | 96.15 | LLSGWNSITY | 3.85 | | | |
| NS4B | 2355 | 0.74 | 3 | 3 | 0 | Y | VSGWNSITVM | 84.62 | VSGWNSITVI | 11.54 | ISGWNSITYM | 3.85 | | |
| NS4B | 2356 | 0.52 | 2 | 2 | 0 | Y | SGWNSITVMP | 88.46 | SGWNSITVIP | 11.54 | | | |
| NS4B | 2357 | 0.52 | 2 | 2 | 0 | Y | GWNSITVMPL | 88.46 | GWNSITVIPL | 11.54 | | | |
| NS4B | 2358 | 0.52 | 2 | 2 | 0 | Y | WNSITVMPLL | 88.46 | WNSITVIPLL | 11.54 | | | |
| NS4B | 2359 | 0.52 | 2 | 2 | 0 | Y | NSITVMPLLC | 88.46 | NSITVIPLL | 11.54 | | | |
| NS4B | 2360 | 0.52 | 2 | 2 | 0 | Y | SITVMPLLCG | 88.46 | SITVIPLLCG | 11.54 | | | |
| NS4B | 2361 | 0.62 | 3 | 3 | 0 | Y | ITVMPLLCGI | 88.46 | ITVIPLLCGV | 7.69 | ITVIPLLCGI | 3.85 | | |
| NS4B | 2362 | 0.62 | 3 | 3 | 0 | Y | TVMPLLCGIG | 88.46 | TVIPLLCGVG | 7.69 | TVIPLLCGIG | 3.85 | | |
| NS4B | 2363 | 0.62 | 3 | 3 | 0 | Y | VMPLLCGIGC | 88.46 | VIPLLCGVGG | 7.69 | VIPLLCGIGG | 3.85 | | |
| NS4B | 2364 | 0.62 | 3 | 3 | 0 | Y | MPLLCGIGCA | 88.46 | IPLLCGVGGA | 7.69 | IPLLCGIGGA | 3.85 | | |
| NS4B | 2365 | 0.85 | 4 | 4 | 0 | Y | PLLCGIGGAM | 84.62 | PLLCGVGGAM | 7.69 | PLLCGIGCAT | 3.85 | PLLCGIGGAM | 3.85 |
| NS4B | 2366 | 0.85 | 4 | 4 | 0 | Y | LLCGIGGCAML | 84.62 | LLCGVGGAML | 7.69 | LLCGIGGAML | 3.85 | LLCGIGCATL | 3.85 |
| NS4B | 2367 | 0.85 | 4 | 4 | 0 | Y | LCGIGGAMLH | 84.62 | LCGVGGAMLH | 7.69 | LCGIGGAMLH | 3.85 | LCGIGGAMLH | 3.85 |
| NS4B | 2368 | 0.85 | 4 | 4 | 0 | Y | CGIGGAMLHW | 84.62 | CGVGGAMLHW | 7.69 | CGIGGAMLHW | 3.85 | CGIGCATLHW | 3.85 |

Species: YFV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2394 | 0.89 | 3 | 3 | 0 | Y | RRVFHGVAKN | 80.77 | KRVFHGVAKN | 11.54 | RRVFHGVAEN | 7.69 | | |
| NS4B | 2395 | 0.39 | 2 | 2 | 0 | Y | RVFHGVAKNP | 92.31 | RVFHGVAENP | 7.69 | | | | |
| NS4B | 2396 | 0.39 | 2 | 2 | 0 | Y | VFHGVAKNPV | 92.31 | VFHGVAENPV | 7.69 | | | | |
| NS4B | 2397 | 0.39 | 2 | 2 | 0 | Y | FHGVAKNPVV | 92.31 | FHGVAENPVV | 7.69 | | | | |
| NS4B | 2398 | 0.39 | 2 | 2 | 0 | Y | HGVAKNPVVD | 92.31 | HGVAENPVVD | 7.69 | | | | |
| NS4B | 2399 | 0.39 | 2 | 2 | 0 | Y | GVAKNPVVDG | 92.31 | GVAENPVVDG | 7.69 | | | | |
| NS4B | 2400 | 0.39 | 2 | 2 | 0 | Y | VAKNPVVDGN | 92.31 | VAENPVVDGN | 7.69 | | | | |
| NS4B | 2401 | 0.39 | 2 | 2 | 0 | Y | AKNPVVDGNP | 92.31 | AENPVVDGNP | 7.69 | | | | |
| NS4B | 2402 | 0.39 | 2 | 2 | 0 | Y | KNPVVDGNPT | 92.31 | ENPVVDGNPT | 7.69 | | | | |
| NS4B | 2403 | 0.52 | 2 | 2 | 0 | Y | NPVVDGNPTV | 88.46 | NPVVDGNPTA | 11.54 | | | | |
| NS4B | 2404 | 0.52 | 2 | 2 | 0 | Y | PVVDGNPTVD | 88.46 | PVVDGNPTAD | 11.54 | | | | |
| NS4B | 2405 | 0.52 | 2 | 2 | 0 | Y | VVDGNPTVDI | 88.46 | VVDGNPTADI | 11.54 | | | | |
| NS4B | 2406 | 0.52 | 2 | 2 | 0 | Y | VDGNPTVDIE | 88.46 | VDGNPTADIE | 11.54 | | | | |
| NS4B | 2407 | 0.52 | 2 | 2 | 0 | Y | DGNPTVDIEE | 88.46 | DGNPTADIEE | 11.54 | | | | |
| NS4B | 2408 | 0.52 | 2 | 2 | 0 | Y | GNPTVDIEEA | 88.46 | GNPTADIEEA | 11.54 | | | | |
| NS4B | 2409 | 0.52 | 2 | 2 | 0 | Y | NPTVDIEEAP | 88.46 | NPTADIEEAP | 11.54 | | | | |
| NS4B | 2410 | 0.52 | 2 | 2 | 0 | Y | PTVDIEEAPE | 88.46 | PTADIEEAPE | 11.54 | | | | |
| NS4B | 2411 | 0.52 | 2 | 2 | 0 | Y | TVDIEEAPEM | 88.46 | TADIEEAPEM | 11.54 | | | | |
| NS4B | 2412 | 0.52 | 2 | 2 | 0 | Y | VDIEEAPEMP | 88.46 | ADIEEAPEMP | 11.54 | | | | |
| NS4B | 2413 | 0.24 | 2 | 2 | 0 | Y | DIEEAPEMPA | 96.15 | DIEEAPEMPV | 3.85 | | | | |
| NS4B | 2414 | 0.24 | 2 | 2 | 0 | Y | IEEAPEMPAL | 96.15 | IEEAPEMPVL | 3.85 | | | | |
| NS4B | 2415 | 0.24 | 2 | 2 | 0 | Y | EEAPEMPALY | 96.15 | EEAPEMPVLY | 3.85 | | | | |
| NS4B | 2416 | 0.24 | 2 | 2 | 0 | Y | EAPEMPALYE | 96.15 | EAPEMPVLYE | 3.85 | | | | |
| NS4B | 2417 | 0.24 | 2 | 2 | 0 | Y | APEMPALYEK | 96.15 | APEMPVLYEK | 3.85 | | | | |
| NS4B | 2418 | 0.24 | 2 | 2 | 0 | Y | PEMPALYEKK | 96.15 | PEMPVLYEKK | 3.85 | | | | |

Fig. 29-96

Species: YFV (10-mers)

| protein | block starting position | block

Fig. 29-97

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2444 | 0.24 | 2 | 2 | 0 | Y | CRTPFSLAEG | 96.15 | CRTPFSLDEG | 3.85 | | | | |
| NS4B | 2445 | 0.24 | 2 | 2 | 0 | Y | RTPFSLAEGI | 96.15 | RTPFSLDEGI | 3.85 | | | | |
| NS4B | 2446 | 0.24 | 2 | 2 | 0 | Y | TPFSLAEGIV | 96.15 | TPFSLDEGIV | 3.85 | | | | |
| NS4B | 2447 | 0.24 | 2 | 2 | 0 | Y | PFSLAEGIVL | 96.15 | PFSLDEGIVL | 3.85 | | | | |
| NS4B | 2448 | 0.74 | 3 | 3 | 0 | Y | FSLAEGIVLA | 84.62 | FSLAEGIVLS | 11.54 | FSLDEGIVLA | 3.85 | | |
| NS4B | 2449 | 0.74 | 3 | 3 | 0 | Y | SLAEGIVLAS | 84.62 | SLAEGIVLSS | 11.54 | SLDEGIVLAS | 3.85 | | |
| NS4B | 2450 | 0.74 | 3 | 3 | 0 | Y | LAEGIVLASA | 84.62 | LAEGIVLSSA | 11.54 | LDEGIVLASA | 3.85 | | |
| NS4B | 2451 | 0.74 | 3 | 3 | 0 | Y | AEGIVLASAA | 84.62 | AEGIVLSSAA | 11.54 | DEGIVLASAA | 3.85 | | |
| NS4B | 2452 | 1.11 | 3 | 3 | 0 | Y | EGIVLASAAL | 73.08 | EGIVLASAAS | 15.38 | EGIVLSSAAL | 11.54 | | |
| NS4B | 2453 | 1.11 | 3 | 3 | 0 | Y | GIVLASAALG | 73.08 | GIVLASAASG | 15.38 | GIVLSSAALG | 11.54 | | |
| NS4B | 2454 | 1.11 | 3 | 3 | 0 | Y | IVLASAALGP | 73.08 | IVLASAASGP | 15.38 | IVLSSAALGP | 11.54 | | |
| NS4B | 2455 | 1.11 | 3 | 3 | 0 | Y | VLASAALGPL | 73.08 | VLASAASGPL | 15.38 | VLSSAALGPL | 11.54 | | |
| NS4B | 2456 | 1.11 | 3 | 3 | 0 | Y | LASAALGPLI | 73.08 | LASAASGPLI | 15.38 | LSSAALGPLI | 11.54 | | |
| NS4B | 2457 | 0.62 | 2 | 2 | 0 | Y | ASAALGPLIE | 84.62 | ASAASGPLIE | 15.38 | SSAALGPLIE | 11.54 | | |
| NS4B | 2458 | 0.62 | 2 | 2 | 0 | Y | SAALGPLIEG | 84.62 | SAASGPLIEG | 15.38 | | | | |
| NS4B | 2459 | 0.62 | 2 | 2 | 0 | Y | AALGPLIEGN | 84.62 | AASGPLIEGN | 15.38 | | | | |
| NS4B | 2460 | 0.62 | 2 | 2 | 0 | Y | ALGPLIEGNT | 84.62 | ASGPLIEGNT | 15.38 | | | | |
| NS4B | 2461 | 0.62 | 2 | 2 | 0 | Y | LGPLIEGNTS | 84.62 | SGPLIEGNTS | 15.38 | | | | |
| NS4B | 2462 | 0 | 1 | 1 | 0 | Y | GPLIEGNTSL | 100 | | | | | | |
| NS4B | 2463 | 0 | 1 | 1 | 0 | Y | PLIEGNTSLL | 100 | | | | | | |
| NS4B | 2464 | 0 | 1 | 1 | 0 | Y | LIEGNTSLLW | 100 | | | | | | |
| NS4B | 2465 | 0 | 1 | 1 | 0 | Y | IEGNTSLLWN | 100 | | | | | | |
| NS4B | 2466 | 0 | 1 | 1 | 0 | Y | EGNTSLLWNG | 100 | | | | | | |
| NS4B | 2467 | 0 | 1 | 1 | 0 | Y | GNTSLLWNGP | 100 | | | | | | |
| NS4B | 2468 | 0 | 1 | 1 | 0 | Y | NTSLLWNGPM | 100 | | | | | | |

Fig. 29-98

Species: YFV (10-mers)

| protein | block starting position | block entropy | total

Fig. 29-99

Species: YFV (10-mers)

| prot

Fig. 29-100

Species: YFV (10-mers)

| protein | block starting position | block entropy (10-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2525 | 1.39 | 4 | 4 | 0 | Y | LLDKQQFELY | 46.15 | LLDKQQFELY | 46.15 | LLDKQQFEMY | 3.85 | LLDRQQFELY | 3.85 |
| NS5 | 2526 | 1.39 | 4 | 4 | 0 | Y | LDKQQFELYK | 46.15 | LDKQQFELYK | 46.15 | LDRQQFELYK | 3.85 | LDKQQFEMYK | 3.85 |
| NS5 | 2527 | 1.39 | 4 | 4 | 0 | Y | DKQFELYKR | 46.15 | DKQQFELYKR | 46.15 | DRQQFELYKR | 3.85 | DKQQFEMYKR | 3.85 |
| NS5 | 2528 | 1.39 | 4 | 4 | 0 | Y | KQQFELYKRT | 46.15 | KQQFELYKRT | 46.15 | RQQFELYKRT | 3.85 | KQQFEMYKRT | 3.85 |
| NS5 | 2529 | 1.2 | 3 | 3 | 0 | Y | QQFELYKRTD | 50 | RQFELYKRTD | 46.15 | QQFEMYKRTD | 3.85 | | |
| NS5 | 2530 | 0.24 | 2 | 2 | 0 | Y | QFELYKRTDI | 96.15 | QFEMYKRTDI | 3.85 | | | | |
| NS5 | 2531 | 0.62 | 3 | 3 | 0 | Y | FELYKRTDIV | 88.46 | FELYKRTDIT | 7.69 | FEMYKRTDII | 3.85 | | |
| NS5 | 2532 | 0.62 | 3 | 3 | 0 | Y | ELYKRTDIVE | 88.46 | ELYKRTDITE | 7.69 | EMYKRTDIIE | 3.85 | | |
| NS5 | 2533 | 0.62 | 3 | 3 | 0 | Y | LYKRTDIVEV | 88.46 | LYKRTDITEV | 7.69 | MYKRTDIIEV | 3.85 | | |
| NS5 | 2534 | 0.62 | 3 | 3 | 0 | Y | YKRTDIVEVD | 88.46 | YKRTDITEVD | 7.69 | YKRTDIIEVD | 3.85 | | |
| NS5 | 2535 | 0.62 | 3 | 3 | 0 | Y | KRTDIVEVDR | 88.46 | KRTDITEVDR | 7.69 | KRTDIIEVDR | 3.85 | | |
| NS5 | 2536 | 0.62 | 3 | 3 | 0 | Y | RTDIVEVDRD | 88.46 | RTDITEVDRD | 7.69 | RTDIIEVDRD | 3.85 | | |
| NS5 | 2537 | 0.62 | 3 | 3 | 0 | Y | TDIVEVDRDT | 88.46 | TDITEVDRDM | 7.69 | TDIIEVDRDM | 3.85 | | |
| NS5 | 2538 | 0.62 | 3 | 3 | 0 | Y | DIVEVDRDTA | 88.46 | DITEVDRDMA | 7.69 | DIIEVDRDMA | 3.85 | | |
| NS5 | 2539 | 0.62 | 3 | 3 | 0 | Y | IEVDRDTAR | 88.46 | ITEVDRDMAR | 7.69 | IIEVDRDMAR | 3.85 | | |
| NS5 | 2540 | 0.62 | 3 | 3 | 0 | Y | VEVDRDTARR | 88.46 | TEVDRDMARR | 7.69 | IEVDRDMARR | 3.85 | | |
| NS5 | 2541 | 0.52 | 2 | 2 | 0 | Y | EVDRDTARRH | 88.46 | EVDRDMARRH | 11.54 | | | | |
| NS5 | 2542 | 0.52 | 2 | 2 | 0 | Y | VDRDTARRHL | 88.46 | VDRDMARRHL | 11.54 | | | | |
| NS5 | 2543 | 0.52 | 2 | 2 | 0 | Y | DRDTARRHLA | 88.46 | DRDMARRHLA | 11.54 | | | | |
| NS5 | 2544 | 0.52 | 2 | 2 | 0 | Y | RDTARRHLAE | 88.46 | RDMARRHLAE | 11.54 | | | | |
| NS5 | 2545 | 0.52 | 2 | 2 | 0 | Y | DTARRHLAEG | 88.46 | DMARRHLAEG | 11.54 | | | | |
| NS5 | 2546 | 0.52 | 2 | 2 | 0 | Y | TARRHLAEGK | 88.46 | MARRHLAEGK | 11.54 | | | | |
| NS5 | 2547 | 0 | 1 | 1 | 0 | Y | ARRHLAEGKV | 100 | | | | | | |
| NS5 | 2548 | 0 | 1 | 1 | 0 | Y | RRHLAEGKVD | 100 | | | | | | |
| NS5 | 2549 | 0 | 1 | 1 | 0 | Y | RHLAEGKVDT | 100 | | | | | | |

Fig. 29-101

Species: YFV (10-mers)

| protein | block starting position | block entropy | total

Fig. 29-102

Species: YFV (10-mers)

| protein | block starting position | entropy block | total peptides in block | # peptides required to cover 99% of block | gap/X fraction | 99% of

Fig. 29-103

Species: YFV (10-mers)

| protein | block starting position | ent

Fig. 29-104

Species: YFV (10-mers)

| protein | block starting position | block entropy | total peptides in block | # peptides required to cover 99% of block | gap/X fraction of block | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2625 | 0.52 | 2 | 2 | 0 | Y | SLGWNIITFK | 88.46 | SLGWNIVTFK | 11.54 | | | | | | |
| NS5 | 2626 | 0.52 | 2 | 2 | 0 | Y | LGWNIITFKD | 88.46 | LGWNIVTFKD | 11.54 | | | | | | |
| NS5 | 2627 | 0.52 | 2 | 2 | 0 | Y | GWNIITFKDK | 88.46 | GWNIVTFKDK | 11.54 | | | | | | |
| NS5 | 2628 | 0.52 | 2 | 2 | 0 | Y | WNIITFKDKT | 88.46 | WNIVTFKDKT | 11.54 | | | | | | |
| NS5 | 2629 | 0.52 | 2 | 2 | 0 | Y | NIITFKDKTD | 88.46 | NIVTFKDKTD | 11.54 | | | | | | |
| NS5 | 2630 | 0.85 | 4 | 4 | 0 | Y | IITFKDKTDI | 84.62 | IVTFKDKTDI | 7.69 | IITFKDKTDV | 3.85 | IVTFKDKTDV | 3.85 | | |
| NS5 | 2631 | 0.85 | 4 | 4 | 0 | Y | ITFKDKTDIH | 84.62 | VTFKDKTDIH | 7.69 | ITFKDKTDVH | 3.85 | VTFKDKTDVH | 3.85 | | |
| NS5 | 2632 | 0.7 | 4 | 4 | 0 | Y | TFKDKTDIHR | 88.46 | TFKDKTDVHR | 3.85 | TFKDKTDIHH | 3.85 | TFKDKTDVHP | 3.85 | | |
| NS5 | 2633 | 0.7 | 4 | 4 | 0 | Y | FKDKTDIHRL | 88.46 | FKDKTDVHPL | 3.85 | FKDKTDIHHL | 3.85 | FKDKTDVHRL | 3.85 | | |
| NS5 | 2634 | 0.7 | 4 | 4 | 0 | Y | KDKTDIHRLE | 88.46 | KDKTDIHHLE | 3.85 | KDKTDVHPLE | 3.85 | KDKTDVHRLE | 3.85 | | |
| NS5 | 2635 | 0.93 | 5 | 5 | 0 | Y | DKTDIHRLEP | 84.62 | DKTDIHHLEP | 3.85 | DKTDVHPLEP | 3.85 | DKTDIHRLES | 3.85 | DKTDVHRLEP | 3.85 |
| NS5 | 2642 | 1.08 | 5 | 5 | 0 | Y | LEPVKCDTLL | 80.77 | LEPAKCETLL | 7.69 | LESVKCDTLL | 3.85 | LEPMKCDTLL | 3.85 | LEPLKCETLL | 3.85 |
| NS5 | 2643 | 1.08 | 5 | 5 | 0 | Y | EPVKCDTLLC | 80.77 | EPAKCETLLC | 7.69 | ESVKCDTLLC | 3.85 | EPLKCETLLC | 3.85 | EPMKCDTLLC | 3.85 |
| NS5 | 2644 | 1.08 | 5 | 5 | 0 | Y | PVKCDTLLCD | 80.77 | PAKCETLLCD | 7.69 | PMKCDTLLCD | 3.85 | PLKCETLLCD | 3.85 | SVKCDTLLCD | 3.85 |
| NS5 | 2645 | 0.85 | 4 | 4 | 0 | Y | VKCDTLLCDI | 84.62 | AKCETLLCDI | 7.69 | MKCDTLLCDI | 3.85 | LKCETLLCDI | 3.85 | | |
| NS5 | 2646 | 0.52 | 2 | 2 | 0 | Y | KCDTLLCDIG | 88.46 | KCETLLCDIG | 11.54 | | | | | | |
| NS5 | 2647 | 0.52 | 2 | 2 | 0 | Y | CDTLLCDIGE | 88.46 | CETLLCDIGE | 11.54 | | | | | | |
| NS5 | 2648 | 0.52 | 2 | 2 | 0 | Y | DTLLCDIGES | 88.46 | ETLLCDIGES | 11.54 | | | | | | |
| NS5 | 2649 | 0 | 1 | 1 | 0 | Y | TLLCDIGESS | 100 | | | | | | | | |
| NS5 | 2650 | 0.52 | 2 | 2 | 0 | Y | LLCDIGESSS | 88.46 | LLCDIGESSP | 11.54 | | | | | | |
| NS5 | 2651 | 0.52 | 2 | 2 | 0 | Y | LCDIGESSSS | 88.46 | LCDIGESSPS | 11.54 | | | | | | |
| NS5 | 2652 | 0.52 | 2 | 2 | 0 | Y | CDIGESSSSS | 88.46 | CDIGESSPSS | 11.54 | | | | | | |
| NS5 | 2653 | 0.85 | 4 | 4 | 0 | Y | DIGESSSSSV | 84.62 | DIGESSPSSV | 7.69 | DIGESSSSI | 3.85 | DIGESSPSSA | 3.85 | | |
| NS5 | 2654 | 0.85 | 4 | 4 | 0 | Y | IGESSSSSVT | 84.62 | IGESSPSSVT | 7.69 | IGESSSSSIT | 3.85 | IGESSPSSAT | 3.85 | | |
| NS5 | 2655 | 0.85 | 4 | 4 | 0 | Y | GESSSSSVTE | 84.62 | GESSPSSVTE | 7.69 | GESSPSSATE | 3.85 | GESSSSSITE | 3.85 | | |

Fig. 29-105

Species: YFV (10-mers)

| protein | block starting position | block entropy | total

Fig. 29-106

Species: YFV (10-mers)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS5 | 2681 | 0.24 | 2 | 2 | 0 | Y | CGVDNFCVKV | 96.15 | CGVDNFCIKV | 3.85 | | | | |
| NS5 | 2682 | 0.24 | 2 | 2 | 0 | Y | GVDNFCVKVL | 96.15 | GVDNFCIKVL | 3.85 | | | | |
| NS5 | 2683 | 0.24 | 2 | 2 | 0 | Y | VDNFCVKVLA | 96.15 | VDNFCIKVLA | 3.85 | | | | |
| NS5 | 2684 | 0.24 | 2 | 2 | 0 | Y | DNFCVKVLAP | 96.15 | DNFCIKVLAP | 3.85 | | | | |
| NS5 | 2685 | 0.24 | 2 | 2 | 0 | Y | NFCVKVLAPY | 96.15 | NFCIKVLAPY | 3.85 | | | | |
| NS5 | 2686 | 0.24 | 2 | 2 | 0 | Y | FCVKVLAPYM | 96.15 | FCIKVLAPYM | 3.85 | | | | |
| NS5 | 2687 | 0.47 | 3 | 3 | 0 | Y | CVKVLAPYMP | 92.31 | CIKVLAPYMP | 3.85 | CVKVLAPYMR | 3.85 | | |
| NS5 | 2688 | 0.47 | 3 | 3 | 0 | Y | VKVLAPYMPD | 92.31 | VKVLAPYMRD | 3.85 | IKVLAPYMPD | 3.85 | | |
| NS5 | 2689 | 0.24 | 2 | 2 | 0 | Y | KVLAPYMPDV | 96.15 | KVLAPYMRDV | 3.85 | | | | |
| NS5 | 2690 | 0.74 | 3 | 3 | 0 | Y | VLAPYMPDVL | 84.62 | VLAPYMPDVI | 11.54 | VLAPYMRDVL | 3.85 | | |
| NS5 | 2691 | 0.74 | 3 | 3 | 0 | Y | LAPYMPDVLE | 84.62 | LAPYMPDVIE | 11.54 | LAPYMRDVLE | 3.85 | | |
| NS5 | 2692 | 0.74 | 3 | 3 | 0 | Y | APYMPDVLEK | 84.62 | APYMPDVIEK | 11.54 | APYMRDVLEK | 3.85 | | |
| NS5 | 2693 | 0.74 | 3 | 3 | 0 | Y | PYMPDVLEKL | 84.62 | PYMPDVIEKL | 11.54 | PYMRDVLEKL | 3.85 | | |
| NS5 | 2694 | 0.74 | 3 | 3 | 0 | Y | YMPDVLEKLE | 84.62 | YMPDVIEKLE | 11.54 | YMRDVLEKLE | 3.85 | | |
| NS5 | 2695 | 0.74 | 3 | 3 | 0 | Y | MPDVLEKLEL | 84.62 | MPDVIEKLEL | 11.54 | MRDVLEKLEL | 3.85 | | |
| NS5 | 2696 | 0.74 | 3 | 3 | 0 | Y | PDVLEKLELL | 84.62 | PDVIEKLELL | 11.54 | RDVLEKLELL | 3.85 | | |
| NS5 | 2697 | 0.52 | 2 | 2 | 0 | Y | DVLEKLELLQ | 88.46 | DVIEKLELLQ | 11.54 | | | | |
| NS5 | 2698 | 0.52 | 2 | 2 | 0 | Y | VLEKLELLQR | 88.46 | VIEKLELLQR | 11.54 | | | | |
| NS5 | 2699 | 0.52 | 2 | 2 | 0 | Y | LEKLELLQRR | 88.46 | IEKLELLQRR | 11.54 | | | | |
| NS5 | 2700 | 0 | 1 | 1 | 0 | Y | EKLELLQRRF | 100 | | | | | | |
| NS5 | 2701 | 0 | 1 | 1 | 0 | Y | KLELLQRRFG | 100 | | | | | | |
| NS5 | 2702 | 0 | 1 | 1 | 0 | Y | LELLQRRFGG | 100 | | | | | | |
| NS5 | 2703 | 0 | 1 | 1 | 0 | Y | ELLQRRFGGT | 100 | | | | | | |
| NS5 | 2704 | 0.24 | 2 | 2 | 0 | Y | LLQRRFGGTV | 96.15 | LLQRRFGGTI | 3.85 | | | | |
| NS5 | 2705 | 0.24 | 2 | 2 | 0 | Y | LQRRFGGTVI | 96.15 | LQRRFGGTII | 3.85 | | | | |

Fig. 29-107

Species: YFV (10-mers)

| protein | block starting position | block ent

Fig. 29-108

Species: YFV (10-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 2731 | 0.52 | 2 | 2 | 0 | Y | GARSNVTFTV | 88.46 | GARSNITFTV | 11.54 | | | | |
| NS5 | 2732 | 0.52 | 2 | 2 | 0 | Y | ARSNVTFTVN | 88.46 | ARSNITFTVN | 11.54 | | | | |
| NS5 | 2733 | 0.52 | 2 | 2 | 0 | Y | RSNVTFTVNQ | 88.46 | RSNITFTVNQ | 11.54 | | | | |
| NS5 | 2734 | 0.52 | 2 | 2 | 0 | Y | SNVTFTVNQT | 88.46 | SNITFTVNQT | 11.54 | | | | |
| NS5 | 2735 | 0.52 | 2 | 2 | 0 | Y | NVTFTVNQTS | 88.46 | NITFTVNQTS | 11.54 | | | | |
| NS5 | 2736 | 0.52 | 2 | 2 | 0 | Y | VTFTVNQTSR | 88.46 | ITFTVNQTSR | 11.54 | | | | |
| NS5 | 2737 | 0 | 1 | 1 | 0 | Y | TFTVNQTSRL | 100 | | | | | | |
| NS5 | 2738 | 0 | 1 | 1 | 0 | Y | FTVNQTSRLL | 100 | | | | | | |
| NS5 | 2739 | 0 | 1 | 1 | 0 | Y | TVNQTSRLLM | 100 | | | | | | |
| NS5 | 2740 | 0 | 1 | 1 | 0 | Y | VNQTSRLLMR | 100 | | | | | | |
| NS5 | 2741 | 0 | 1 | 1 | 0 | Y | NQTSRLLMRR | 100 | | | | | | |
| NS5 | 2742 | 0 | 1 | 1 | 0 | Y | QTSRLLMRRM | 100 | | | | | | |
| NS5 | 2743 | 0 | 1 | 1 | 0 | Y | TSRLLMRRMR | 100 | | | | | | |
| NS5 | 2744 | 0 | 1 | 1 | 0 | Y | SRLLMRRMRR | 100 | | | | | | |
| NS5 | 2745 | 0 | 1 | 1 | 0 | Y | RLLMRRMRRP | 100 | | | | | | |
| NS5 | 2746 | 0 | 1 | 1 | 0 | Y | LLMRRMRRPT | 100 | | | | | | |
| NS5 | 2747 | 0 | 1 | 1 | 0 | Y | LMRRMRRPTG | 100 | | | | | | |
| NS5 | 2748 | 0 | 1 | 1 | 0 | Y | MRRMRRPTGK | 100 | | | | | | |
| NS5 | 2749 | 0 | 1 | 1 | 0 | Y | RRMRRPTGKV | 100 | | | | | | |
| NS5 | 2750 | 0 | 1 | 1 | 0 | Y | RMRRPTGKVT | 100 | | | | | | |
| NS5 | 2751 | 0 | 1 | 1 | 0 | Y | MRRPTGKVTL | 100 | | | | | | |
| NS5 | 2752 | 0 | 1 | 1 | 0 | Y | RRPTGKVTLE | 100 | | | | | | |
| NS5 | 2753 | 0.39 | 2 | 2 | 0 | Y | RPTGKVTLEA | 92.31 | RPTGKVTLEP | 7.69 | | | | |
| NS5 | 2754 | 0.39 | 2 | 2 | 0 | Y | PTGKVTLEAD | 92.31 | PTGKVTLEPD | 7.69 | | | | |
| NS5 | 2755 | 0.39 | 2 | 2 | 0 | Y | TGKVTLEADV | 92.31 | TGKVTLEPDV | 7.69 | | | | |

Fig. 29-109

Species: YFV (10-mers)

| protein | block starting position | block entropy | total peptides in block | # peptides required to cover 99% of block | gap/X fraction | 99% of block covered w/ <= 5 peptides? | block to cover 99%

Fig. 29-110

Species: YFV (10-mers)

| protein | block starting position | entropy |

Fig. 29-111

Species: YFV (10-mers)

| protein | block starting position | entropy block | total peptides in block | #

Fig. 29-112

Species: YFV (10-mers)

| protein | block starting position | entropy block | total

Fig. 29-113

Species: YFV (10-mers)

| protein | block starting position | block

Fig. 29-114

Species: YFV (10-mers)

| protein | block starting position | ent

Fig. 29-115

Species: YFV (10-mers)

| protein | block starting position | block entropy | total

Fig. 29-116

Species: YFV (10-mers)

| protein | block starting position | entropy block | total pe

Fig. 29-117

Species: YFV (10-mers)

| protein | block star

Fig. 29-118

Species: YFV (10-mers)

| protein | block

Fig. 29-119

Species: YFV (10-mers)

| protein | block starting position | entropy block | total peptides in block | # peptides required to cover 99% of block | gap/X fraction | 99% of block

Fig. 29-120

Species: YFV (10-mers)

| protein | block starting position | entropy block | total peptides in block | # peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3040 | 0 | 1 | 1 | 0 | Y | ADDTAGWDTR | 100 | | | | | | |
| NS5 | 3041 | 0 | 1 | 1 | 0 | Y | DDTAGWDTRI | 100 | | | | | | |
| NS5 | 3042 | 0 | 1 | 1 | 0 | Y | DTAGWDTRIT | 100 | | | | | | |
| NS5 | 3043 | 0 | 1 | 1 | 0 | Y | TAGWDTRITE | 100 | | | | | | |
| NS5 | 3044 | 0 | 1 | 1 | 0 | Y | AGWDTRITEA | 100 | | | | | | |
| NS5 | 3045 | 0 | 1 | 1 | 0 | Y | GWDTRITEAD | 100 | | | | | | |
| NS5 | 3046 | 0 | 1 | 1 | 0 | Y | WDTRITEADL | 100 | | | | | | |
| NS5 | 3047 | 0 | 1 | 1 | 0 | Y | DTRITEADLD | 100 | | | | | | |
| NS5 | 3048 | 0 | 1 | 1 | 0 | Y | TRITEADLDD | 100 | | | | | | |
| NS5 | 3049 | 0 | 1 | 1 | 0 | Y | RITEADLDDE | 100 | | | | | | |
| NS5 | 3050 | 0 | 1 | 1 | 0 | Y | ITEADLDDEQ | 100 | | | | | | |
| NS5 | 3051 | 0 | 1 | 1 | 0 | Y | TEADLDDEQE | 100 | | | | | | |
| NS5 | 3052 | 0 | 1 | 1 | 0 | Y | EADLDDEQEI | 100 | | | | | | |
| NS5 | 3053 | 0.52 | 2 | 2 | 0 | Y | ADLDDEQEIL | 88.46 | ADLDDEQEIM | 11.54 | | | | |
| NS5 | 3054 | 0.52 | 2 | 2 | 0 | Y | DLDDEQEILN | 88.46 | DLDDEQEIMS | 11.54 | | | | |
| NS5 | 3055 | 0.52 | 2 | 2 | 0 | Y | LDDEQEILNY | 88.46 | LDDEQEIMSY | 11.54 | | | | |
| NS5 | 3056 | 0.52 | 2 | 2 | 0 | Y | DDEQEILNYM | 88.46 | DDEQEIMSYM | 11.54 | | | | |
| NS5 | 3057 | 0.62 | 3 | 3 | 0 | Y | DEQEILNYMS | 88.46 | DEQEIMSYMN | 7.69 | DEQEIMSYMS | 3.85 | | |
| NS5 | 3058 | 0.85 | 4 | 4 | 0 | Y | EQEILNYMSP | 84.62 | EQEIMSYMNA | 7.69 | EQEIMSYMSP | 3.85 | EQEILNYMSS | 3.85 |
| NS5 | 3059 | 0.85 | 4 | 4 | 0 | Y | QEILNYMSPH | 84.62 | QEIMSYMNAE | 7.69 | QEIMSYMSSH | 3.85 | QEIMSYMSPE | 3.85 |
| NS5 | 3060 | 0.85 | 4 | 4 | 0 | Y | EILNYMSPHH | 84.62 | EIMSYMNAEQ | 7.69 | EIMSYMSPEQ | 3.85 | EILNYMSSHH | 3.85 |
| NS5 | 3061 | 0.85 | 4 | 4 | 0 | Y | ILNYMSPHHK | 84.62 | IMSYMNAEQR | 7.69 | ILNYMSSHHK | 3.85 | IMSYMSPEQR | 3.85 |
| NS5 | 3062 | 0.85 | 4 | 4 | 0 | Y | LNYMSPHHKK | 84.62 | MSYMNAEQRK | 7.69 | MSYMSPEQRK | 3.85 | LNYMSSHHKK | 3.85 |
| NS5 | 3063 | 0.85 | 4 | 4 | 0 | Y | NYMSPHHKKL | 84.62 | SYMNAEQRKL | 7.69 | NYMSSHHKKL | 3.85 | SYMSPEQRKL | 3.85 |
| NS5 | 3064 | 0.85 | 4 | 4 | 0 | Y | YMSPHHKKLA | 84.62 | YMNAEQRKLA | 7.69 | YMSSHHKKLA | 3.85 | YMSPEQRKLA | 3.85 |

Fig. 29-121

Species: YFV (10-mers)

| protein | block starting position | entropy of block | total peptides in block | # peptides required to cover 99% of block | gap/X fraction of block | 99% covered w/ <= 5 pe

Fig. 29-122

Species: YFV (10-mers)

| protein | block starting position

Fig. 29-123

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3115 | 0 | 1 | 1 | 0 | Y | TYALNTITNL | 100 | | | | | | |
| NS5 | 3116 | 0 | 1 | 1 | 0 | Y | YALNTITNLK | 100 | | | | | | |
| NS5 | 3117 | 0 | 1 | 1 | 0 | Y | ALNTITNLKV | 100 | | | | | | |
| NS5 | 3118 | 0 | 1 | 1 | 0 | Y | LNTITNLKVQ | 100 | | | | | | |
| NS5 | 3119 | 0 | 1 | 1 | 0 | Y | NTITNLKVQL | 100 | | | | | | |
| NS5 | 3120 | 0 | 1 | 1 | 0 | Y | TITNLKVQLI | 100 | | | | | | |
| NS5 | 3121 | 0 | 1 | 1 | 0 | Y | ITNLKVQLIR | 100 | | | | | | |
| NS5 | 3122 | 0 | 1 | 1 | 0 | Y | TNLKVQLIRM | 100 | | | | | | |
| NS5 | 3123 | 0 | 1 | 1 | 0 | Y | NLKVQLIRMA | 100 | | | | | | |
| NS5 | 3124 | 0 | 1 | 1 | 0 | Y | LKVQLIRMAE | 100 | | | | | | |
| NS5 | 3125 | 0 | 1 | 1 | 0 | Y | KVQLIRMAEA | 100 | | | | | | |
| NS5 | 3126 | 0 | 1 | 1 | 0 | Y | VQLIRMAEAE | 100 | | | | | | |
| NS5 | 3127 | 0.24 | 2 | 2 | 0 | Y | QLIRMAEAEM | 96.15 | QLIRMAEAEN | 3.85 | | | | |
| NS5 | 3128 | 0.24 | 2 | 2 | 0 | Y | LIRMAEAEMV | 96.15 | LIRMAEAENV | 3.85 | | | | |
| NS5 | 3129 | 0.24 | 2 | 2 | 0 | Y | IRMAEAEMVI | 96.15 | IRMAEAENVI | 3.85 | | | | |
| NS5 | 3130 | 0.74 | 3 | 3 | 0 | Y | RMAEAEMVIH | 84.62 | RMAEAENVIH | 11.54 | RMAEAENVIH | 3.85 | | |
| NS5 | 3131 | 0.74 | 3 | 3 | 0 | Y | MAEAEMVIHH | 84.62 | MAEAENVIH | 11.54 | MAEAENVIHH | 3.85 | | |
| NS5 | 3132 | 0.97 | 4 | 4 | 0 | Y | AEAEMVIHHQ | 80.77 | AEAEMVINHQ | 11.54 | AEAEMVIHH | 3.85 | AEAENVIHHQ | 3.85 |
| NS5 | 3133 | 0.97 | 4 | 4 | 0 | Y | EAEMVIHHQH | 80.77 | EAEMVINHQH | 11.54 | EAENVIHHQH | 3.85 | EAEMVIHHH | 3.85 |
| NS5 | 3134 | 0.97 | 4 | 4 | 0 | Y | AEMVIHHQHV | 80.77 | AEMVINHQHV | 11.54 | AENVIHHQHV | 3.85 | AEMVIHHHV | 3.85 |
| NS5 | 3135 | 1.08 | 5 | 5 | 0 | Y | EMVIHHQHVQ | 80.77 | EMVINHQHVN | 7.69 | EMVINHQHVQ | 3.85 | ENVIHHQHVQ | 3.85 | EMVIHHHHVQ | 3.85 |
| NS5 | 3136 | 1.08 | 5 | 5 | 0 | Y | MVIHHQHVQD | 80.77 | MVINHQHVNE | 7.69 | MVINHQHVQD | 3.85 | NVIHHQHVQD | 3.85 | MVINHQHVQE | 3.85 |
| NS5 | 3137 | 0.85 | 4 | 4 | 0 | Y | VIHHQHVQDC | 84.62 | VINHQHVNEC | 7.69 | VIHHHHVQDC | 3.85 | VINHQHVQEC | 3.85 | | |
| NS5 | 3138 | 0.85 | 4 | 4 | 0 | Y | IHHQHVQDCD | 84.62 | INHQHVNECD | 7.69 | INHQHVQECG | 3.85 | IHHHHVQDCD | 3.85 | | |
| NS5 | 3139 | 0.85 | 4 | 4 | 0 | Y | HHQHVQDCDE | 84.62 | NHQHVNECDE | 7.69 | NHQHVQECGE | 3.85 | HHHHVQDCDD | 3.85 | | |

Fig. 29-124

Species: YFV (10-mers)

| protein | block starting position | block entropy | total peptides in block | # peptides required to cover 99% of block | gap/X fraction | 99% of block cov

Fig. 29-125

Species: YFV (10-mers)

| protein | block starting position | entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3182 | 0.24 | 2 | 2 | 0 | Y | DDRFGLALSH | 96.15 | DDRFGMALSH | 3.85 | | | | |
| NS5 | 3183 | 0.24 | 2 | 2 | 0 | Y | DRFGLALSHL | 96.15 | DRFGMALSHL | 3.85 | | | | |
| NS5 | 3184 | 0.24 | 2 | 2 | 0 | Y | RFGLALSHLN | 96.15 | RFGMALSHLN | 3.85 | | | | |
| NS5 | 3185 | 0.24 | 2 | 2 | 0 | Y | FGLALSHLNA | 96.15 | FGMALSHLNA | 3.85 | | | | |
| NS5 | 3186 | 0.24 | 2 | 2 | 0 | Y | GLALSHLNAM | 96.15 | GMALSHLNAM | 3.85 | | | | |
| NS5 | 3187 | 0.24 | 2 | 2 | 0 | Y | LALSHLNAMS | 96.15 | MALSHLNAMS | 3.85 | | | | |
| NS5 | 3188 | 0 | 1 | 1 | 0 | Y | ALSHLNAMSK | 100 | | | | | | |
| NS5 | 3189 | 0 | 1 | 1 | 0 | Y | LSHLNAMSKV | 100 | | | | | | |
| NS5 | 3190 | 0 | 1 | 1 | 0 | Y | SHLNAMSKVR | 100 | | | | | | |
| NS5 | 3191 | 0 | 1 | 1 | 0 | Y | HLNAMSKVRK | 100 | | | | | | |
| NS5 | 3192 | 0 | 1 | 1 | 0 | Y | LNAMSKVRKD | 100 | | | | | | |
| NS5 | 3193 | 0 | 1 | 1 | 0 | Y | NAMSKVRKDI | 100 | | | | | | |
| NS5 | 3194 | 0 | 1 | 1 | 0 | Y | AMSKVRKDIS | 100 | | | | | | |
| NS5 | 3195 | 0 | 1 | 1 | 0 | Y | MSKVRKDISE | 100 | | | | | | |
| NS5 | 3196 | 0 | 1 | 1 | 0 | Y | SKVRKDISEW | 100 | | | | | | |
| NS5 | 3197 | 0 | 1 | 1 | 0 | Y | KVRKDISEWQ | 100 | | | | | | |
| NS5 | 3198 | 0 | 1 | 1 | 0 | Y | VRKDISEWQP | 100 | | | | | | |
| NS5 | 3199 | 0 | 1 | 1 | 0 | Y | RKDISEWQPS | 100 | | | | | | |
| NS5 | 3200 | 0 | 1 | 1 | 0 | Y | KDISEWQPSK | 100 | | | | | | |
| NS5 | 3201 | 0.24 | 2 | 2 | 0 | Y | DISEWQPSKG | 96.15 | DISEWQPSKE | 3.85 | | | | |
| NS5 | 3202 | 0.24 | 2 | 2 | 0 | Y | ISEWQPSKGW | 96.15 | ISEWQPSKEW | 3.85 | | | | |
| NS5 | 3203 | 0.62 | 3 | 3 | 0 | Y | SEWQPSKGWN | 88.46 | SEWQPSKGWT | 7.69 | SEWQPSKEWT | 3.85 | | |
| NS5 | 3204 | 0.62 | 3 | 3 | 0 | Y | EWQPSKGWND | 88.46 | EWQPSKGWTD | 7.69 | EWQPSKEWTD | 3.85 | | |
| NS5 | 3205 | 0.62 | 3 | 3 | 0 | Y | WQPSKGWNDW | 88.46 | WQPSKGWTDW | 7.69 | WQPSKEWTDW | 3.85 | | |
| NS5 | 3206 | 0.62 | 3 | 3 | 0 | Y | QPSKGWNDWE | 88.46 | QPSKGWTDWE | 7.69 | QPSKEWTDWE | 3.85 | | |

Fig. 29-126

Species: YFV (10-mers)

| protein | block starting position | entropy block | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3207 | 0.7 | 4 | 4 | 0 | Y | PSKGWNDWEN | 88.46 | PSKGWTDWES | 3.85 | PSKGWTDWEN | 3.85 | PSKEWTDWEN | 3.85 |
| NS5 | 3208 | 0.7 | 4 | 4 | 0 | Y | SKGWNDWENV | 88.46 | SKEWTDWENV | 3.85 | SKGWTDWENV | 3.85 | SKGWTDWESV | 3.85 |
| NS5 | 3209 | 0.7 | 4 | 4 | 0 | Y | KGWNDWENVP | 88.46 | KGWTDWESVP | 3.85 | KGWTDWENVP | 3.85 | KEWTDWENVP | 3.85 |
| NS5 | 3210 | 0.7 | 4 | 4 | 0 | Y | GWNDWENVPF | 88.46 | GWTDWENVPF | 3.85 | GWTDWENVPF | 3.85 | EWTDWENVPF | 3.85 |
| NS5 | 3211 | 0.62 | 3 | 3 | 0 | Y | WNDWENVPFC | 88.46 | WTDWENVPFC | 3.85 | WTDWESVPFC | 3.85 | | |
| NS5 | 3212 | 0.62 | 3 | 3 | 0 | Y | NDWENVPFCS | 88.46 | TDWENVPFCS | 7.69 | TDWESVPFCS | 3.85 | | |
| NS5 | 3213 | 0.24 | 2 | 2 | 0 | Y | DWENVPFCSH | 96.15 | DWESVPFCSH | 7.69 | | | | |
| NS5 | 3214 | 0.47 | 3 | 3 | 0 | Y | WENVPFCSHH | 92.31 | WESVPFCSHH | 3.85 | WENVPFCSHR | 3.85 | | |
| NS5 | 3215 | 0.47 | 3 | 3 | 0 | Y | ENVPFCSHHF | 92.31 | ESVPFCSHHF | 3.85 | ENVPFCSHRF | 3.85 | | |
| NS5 | 3216 | 0.47 | 3 | 3 | 0 | Y | NVPFCSHHFH | 92.31 | NVPFCSHRFH | 3.85 | SVPFCSHHFH | 3.85 | | |
| NS5 | 3217 | 0.24 | 2 | 2 | 0 | Y | VPFCSHHFHE | 96.15 | VPFCSHRFHE | 3.85 | | | | |
| NS5 | 3218 | 0.24 | 2 | 2 | 0 | Y | PFCSHHFHEL | 96.15 | PFCSHRFHEL | 3.85 | | | | |
| NS5 | 3219 | 1.12 | 4 | 4 | 0 | Y | FCSHHFHELQ | 76.92 | FCSHHFHELV | 11.54 | FCSHHFHELH | 7.69 | FCSHRFHELQ | 3.85 |
| NS5 | 3220 | 1.12 | 4 | 4 | 0 | Y | CSHHFHELQL | 76.92 | CSHHFHELVL | 11.54 | CSHHFHELHL | 7.69 | CSHRFHELQL | 3.85 |
| NS5 | 3221 | 1.12 | 4 | 4 | 0 | Y | SHHFHELQLK | 76.92 | SHHFHELVLK | 11.54 | SHHFHELHLK | 7.69 | SHRFHELQLK | 3.85 |
| NS5 | 3222 | 1.12 | 4 | 4 | 0 | Y | HHFHELQLKD | 76.92 | HHFHELVLKD | 11.54 | HHFHELHLKD | 7.69 | HRFHELQLKD | 3.85 |
| NS5 | 3223 | 1.12 | 4 | 4 | 0 | Y | HFHELQLKDG | 76.92 | HFHELVLKDG | 11.54 | HFHELHLKDG | 7.69 | RFHELQLKDG | 3.85 |
| NS5 | 3224 | 0.89 | 3 | 3 | 0 | Y | FHELQLKDGR | 80.77 | FHELVLKDGR | 11.54 | FHELHLKDGR | 7.69 | | |
| NS5 | 3225 | 0.89 | 3 | 3 | 0 | Y | HELQLKDGRR | 80.77 | HELVLKDGRK | 11.54 | HELHLKDGRK | 7.69 | | |
| NS5 | 3226 | 1 | 4 | 4 | 0 | Y | ELQLKDGRRI | 80.77 | ELVLKDGRRI | 7.69 | ELHLKDGRRI | 7.69 | ELVLKDGRKI | 3.85 |
| NS5 | 3227 | 1 | 4 | 4 | 0 | Y | LQLKDGRRIV | 80.77 | LVLKDGRRIV | 7.69 | LHLKDGRRIV | 7.69 | LVLKDGRKIV | 3.85 |
| NS5 | 3228 | 1 | 4 | 4 | 0 | Y | QLKDGRRIVW | 80.77 | VLKDGRRIVW | 7.69 | HLKDGRRIVW | 7.69 | VLKDGRKIVW | 3.85 |
| NS5 | 3229 | 0.62 | 3 | 3 | 0 | Y | LKDGRRIVWP | 88.46 | LKDGRKIVWP | 7.69 | LKDGRKIVWP | 3.85 | | |
| NS5 | 3230 | 0.62 | 3 | 3 | 0 | Y | KDGRRIVWPC | 88.46 | KDGRKIVWPC | 7.69 | KDGRKIVWPC | 3.85 | | |
| NS5 | 3231 | 0.62 | 3 | 3 | 0 | Y | DGRRIVWPCR | 88.46 | DGRKIVWPCR | 7.69 | DGRKIVWPCR | 3.85 | | |

Fig. 29-127

Species: YFV (10-mers)

| protein | block starting position | entropy block | total peptides in block | #

Fig. 29-128

Species: YFV (10-mers)

| protein | block starting position | entropy block | total peptides in block | # peptides required to c

Fig. 29-129

Species: YFV (10-mers)

| protein

Fig. 29-130

Species: YFV (10-mers)

| protein | block starting position

Fig. 29-131

Species: YFV (10-mers)

| protein | block starting position | block

Fig. 29-132

Species: YFV (10-mers)

| protein | block starting position | block entropy | total peptides in block | # peptides required to cover 99% of block | gap/X fraction of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3357 | 0 | 1 | 1 | 0 | Y | LCGSLIGMTN | 100 | | | | | | |
| NS5 | 3358 | 0 | 1 | 1 | 0 | Y | CGSLIGMTNR | 100 | | | | | | |
| NS5 | 3359 | 0 | 1 | 1 | 0 | Y | GSLIGMTNRA | 100 | | | | | | |
| NS5 | 3360 | 0 | 1 | 1 | 0 | Y | SLIGMTNRAT | 100 | | | | | | |
| NS5 | 3361 | 0 | 1 | 1 | 0 | Y | LIGMTNRATW | 100 | | | | | | |
| NS5 | 3362 | 0 | 1 | 1 | 0 | Y | IGMTNRATWA | 100 | | | | | | |
| NS5 | 3363 | 0 | 1 | 1 | 0 | Y | GMTNRATWAS | 100 | | | | | | |
| NS5 | 3364 | 0.24 | 2 | 2 | 0 | Y | MTNRATWASH | 96.15 | MTNRATWASN | 3.85 | | | | |
| NS5 | 3365 | 0.24 | 2 | 2 | 0 | Y | TNRATWASHI | 96.15 | TNRATWASNI | 3.85 | | | | |
| NS5 | 3366 | 0.24 | 2 | 2 | 0 | Y | NRATWASHIH | 96.15 | NRATWASNIH | 3.85 | | | | |
| NS5 | 3367 | 0.24 | 2 | 2 | 0 | Y | RATWASHIHL | 96.15 | RATWASNIHL | 3.85 | | | | |
| NS5 | 3368 | 0.24 | 2 | 2 | 0 | Y | ATWASHIHLV | 96.15 | ATWASNIHLV | 3.85 | | | | |
| NS5 | 3369 | 0.24 | 2 | 2 | 0 | Y | TWASHIHLVI | 96.15 | TWASNIHLVI | 3.85 | | | | |
| NS5 | 3370 | 0.24 | 2 | 2 | 0 | Y | WASHIHLVIH | 96.15 | WASNIHLVIH | 3.85 | | | | |
| NS5 | 3371 | 0.24 | 2 | 2 | 0 | Y | ASHIHLVIHR | 96.15 | ASNIHLVIHR | 3.85 | | | | |
| NS5 | 3372 | 0.24 | 2 | 2 | 0 | Y | SHIHLVIHRI | 96.15 | SNIHLVIHRI | 3.85 | | | | |
| NS5 | 3373 | 0.24 | 2 | 2 | 0 | Y | HIHLVIHRIR | 96.15 | NIHLVIHRIR | 3.85 | | | | |
| NS5 | 3374 | 0.24 | 2 | 2 | 0 | Y | IHLVIHRIRT | 96.15 | IHLVIHRIRN | 3.85 | | | | |
| NS5 | 3375 | 0.24 | 2 | 2 | 0 | Y | HLVIHRIRTL | 96.15 | HLVIHRIRNL | 3.85 | | | | |
| NS5 | 3376 | 0.62 | 3 | 3 | 0 | Y | LVIHRIRTLI | 88.46 | LVIHRIRTLV | 7.69 | LVIHRIRNLI | 3.85 | | |
| NS5 | 3377 | 0.62 | 3 | 3 | 0 | Y | VIHRIRTLIG | 88.46 | VIHRIRTLVG | 7.69 | VIHRIRNLIG | 3.85 | | |
| NS5 | 3378 | 0.62 | 3 | 3 | 0 | Y | IHRIRTLIGQ | 88.46 | IHRIRTLVGQ | 7.69 | IHRIRNLIGQ | 3.85 | | |
| NS5 | 3379 | 0.62 | 3 | 3 | 0 | Y | HRIRTLIGQE | 88.46 | HRIRTLVGQE | 7.69 | HRIRNLIGQE | 3.85 | | |
| NS5 | 3380 | 0.62 | 3 | 3 | 0 | Y | RIRTLIGQEK | 88.46 | RIRTLVGQEK | 7.69 | RIRNLIGQEK | 3.85 | | |
| NS5 | 3381 | 0.85 | 4 | 4 | 0 | Y | IRTLIGQEKY | 84.62 | IRTLVGQEKY | 7.69 | IRNLIGQEKY | 3.85 | IRTLIGQEKF | 3.85 |

Fig. 29-133

Species: YFV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3382 | 0.85 | 4 | 4 | 0 | Y | RTLIGQEKYT | 84.62 | RTLVGQEKYT | 7.69 | RTLIGQEKFT | 3.85 | RNLIGQEKYT | 3.85 |
| NS5 | 3383 | 0.85 | 4 | 4 | 0 | Y | TLIGQEKYTD | 84.62 | TLVGQEKYTD | 7.69 | TLIGQEKFTD | 3.85 | NLIGQEKYTD | 3.85 |
| NS5 | 3384 | 0.62 | 3 | 3 | 0 | Y | LIGQEKYTDY | 88.46 | LVGQEKYTDY | 7.69 | LIGQEKFTDY | 3.85 | | |
| NS5 | 3385 | 0.62 | 3 | 3 | 0 | Y | IGQEKYTDYL | 88.46 | VGQEKYTDYL | 7.69 | IGQEKFTDYL | 3.85 | | |
| NS5 | 3386 | 0.24 | 2 | 2 | 0 | Y | GQEKYTDYLT | 96.15 | GQEKFTDYLT | 3.85 | | | | |
| NS5 | 3387 | 0.24 | 2 | 2 | 0 | Y | QEKYTDYLTV | 96.15 | QEKFTDYLTV | 3.85 | | | | |
| NS5 | 3388 | 0.24 | 2 | 2 | 0 | Y | EKYTDYLTVM | 96.15 | EKFTDYLTVM | 3.85 | | | | |
| NS5 | 3389 | 0.24 | 2 | 2 | 0 | Y | KYTDYLTVMD | 96.15 | KFTDYLTVMD | 3.85 | | | | |
| NS5 | 3390 | 0.24 | 2 | 2 | 0 | Y | YTDYLTVMDR | 96.15 | FTDYLTVMDR | 3.85 | | | | |
| NS5 | 3391 | 0 | 1 | 1 | 0 | Y | TDYLTVMDRY | 100 | | | | | | |
| NS5 | 3392 | 0 | 1 | 1 | 0 | Y | DYLTVMDRYS | 100 | | | | | | |
| NS5 | 3393 | 0 | 1 | 1 | 0 | Y | YLTVMDRYSV | 100 | | | | | | |
| NS5 | 3394 | 0 | 1 | 1 | 0 | Y | LTVMDRYSVD | 100 | | | | | | |
| NS5 | 3395 | 0 | 1 | 1 | 0 | Y | TVMDRYSVDA | 100 | | | | | | |
| NS5 | 3396 | 0 | 1 | 1 | 0 | Y | VMDRYSVDAD | 100 | | | | | | |
| NS5 | 3397 | 0 | 1 | 1 | 0 | Y | MDRYSVDADL | 100 | | | | | | |
| NS5 | 3398 | 0 | 1 | 1 | 0 | Y | DRYSVDADLQ | 100 | | | | | | |
| NS5 | 3399 | 0.96 | 2 | 2 | 0 | Y | RYSVDADLQL | 61.54 | RYSVDADLQP | 38.46 | | | | |
| NS5 | 3400 | 0.96 | 2 | 2 | 0 | Y | YSVDADLQLG | 61.54 | YSVDADLQPG | 38.46 | | | | |
| NS5 | 3401 | 0.96 | 2 | 2 | 0 | Y | SVDADLQLGE | 61.54 | SVDADLQPGE | 38.46 | | | | |
| NS5 | 3402 | 0.96 | 2 | 2 | 0 | Y | VDADLQLGEL | 61.54 | VDADLQPGEL | 38.46 | | | | |
| NS5 | 3403 | 0.96 | 2 | 2 | 0 | Y | DADLQLGELI | 61.54 | DADLQPGELI | 38.46 | | | | |

Fig. 30-1

Species: YFV (11-mers)

| protein | block starting position | block entropy | total peptides in block | # peptides required to cover 99% of block | gap/X fraction | 99% of block covered w/

Fig. 30-2

Species: YFV (11-mers)

| protein | block starting position | block

Fig. 30-3

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 51 | 0.74 | 3 | 3 | 0 | Y | FLFNILTGKKI | 84.62 | FLFNILTGKKL | 11.54 | FSFNILTGKKI | 3.85 | | |
| anC | 52 | 0.74 | 3 | 3 | 0 | Y | LFNILTGKKIT | 84.62 | LFNILTGKKLT | 11.54 | SFNILTGKKIT | 3.85 | | |
| anC | 53 | 0.62 | 3 | 3 | 0 | Y | FNILTGKKITA | 88.46 | FNILTGKKLIT | 7.69 | FNILTGKKLTA | 3.85 | | |
| anC | 54 | 0.85 | 4 | 4 | 0 | Y | NILTGKKITAH | 84.62 | NILTGKKLTTH | 7.69 | NILTGKKITAQ | 3.85 | NILTGKKLTAH | 3.85 |
| anC | 55 | 0.85 | 4 | 4 | 0 | Y | ILTGKKITAHL | 84.62 | ILTGKKLTTHL | 7.69 | ILTGKKITAQL | 3.85 | ILTGKKLTAHL | 3.85 |
| anC | 56 | 0.85 | 4 | 4 | 0 | Y | LTGKKITAHLK | 84.62 | LTGKKLTTHLK | 7.69 | LTGKKITAQLK | 3.85 | LTGKKLTAHLK | 3.85 |
| anC | 57 | 0.85 | 4 | 4 | 0 | Y | TGKKITAHLKR | 84.62 | TGKKLTTHLKR | 7.69 | TGKKITAQLKR | 3.85 | TGKKLTAHLKR | 3.85 |
| anC | 58 | 0.85 | 4 | 4 | 0 | Y | GKKITAHLKRL | 84.62 | GKKLTTHLKRL | 7.69 | GKKITAQLKRL | 3.85 | GKKLTAHLKRL | 3.85 |
| anC | 59 | 0.85 | 4 | 4 | 0 | Y | KKITAHLKRLW | 84.62 | KKLTTHLKRLW | 7.69 | KKITAQLKRLW | 3.85 | KKLTAHLKRLW | 3.85 |
| anC | 60 | 0.85 | 4 | 4 | 0 | Y | KITAHLKRLWK | 84.62 | KLTTHLKRLWR | 7.69 | KITAQLKRLWK | 3.85 | KLTAHLKRLWR | 3.85 |
| anC | 61 | 0.85 | 4 | 4 | 0 | Y | ITAHLKRLWKM | 84.62 | LTTHLKRLWRM | 7.69 | ITAQLKRLWKM | 3.85 | LTAHLKRLWRM | 3.85 |
| anC | 62 | 0.85 | 4 | 4 | 0 | Y | TAHLKRLWKML | 84.62 | TTHLKRLWRML | 7.69 | TAQLKRLWKML | 3.85 | TAHLKRLWRML | 3.85 |
| anC | 63 | 0.85 | 4 | 4 | 0 | Y | AHLKRLWKMLD | 84.62 | THLKRLWRMLD | 7.69 | AQLKRLWKMLD | 3.85 | AHLKRLWRMLD | 3.85 |
| anC | 64 | 0.85 | 4 | 4 | 0 | Y | HLKRLWKMLDP | 84.62 | HLKRLWRMLDP | 7.69 | HLKKLWRMLDP | 3.85 | QLKRLWKMLDP | 3.85 |
| anC | 65 | 0.62 | 3 | 3 | 0 | Y | LKRLWKMLDPR | 88.46 | LKRLWRMLDPR | 7.69 | | | LKKLWRMLDPR | 3.85 |
| anC | 66 | 0.62 | 3 | 3 | 0 | Y | KRLWKMLDPRQ | 88.46 | KRLWRMLDPRQ | 7.69 | | | KKLWRMLDPRQ | 3.85 |
| anC | 67 | 0.62 | 3 | 3 | 0 | Y | RLWKMLDPRQG | 88.46 | RLWRMLDPRQG | 7.69 | | | KLWRMLDPRQG | 3.85 |
| anC | 68 | 0.52 | 2 | 2 | 0 | Y | LWKMLDPRQGL | 88.46 | LWRMLDPRQGL | 11.54 | | | | |
| anC | 69 | 0.62 | 3 | 3 | 0 | Y | WKMLDPRQGLA | 80.77 | WRMLDPRQGLA | 7.69 | WRMLDPRQGLT | 7.69 | | |
| anC | 70 | 1.00 | 4 | 4 | 0 | Y | KMLDPRQGLAVL | 88.46 | RMLDPRQGLAV | 7.69 | KMLDPRQGLAA | 3.85 | RMLDPRQGLTV | 3.85 |
| anC | 71 | 0.62 | 3 | 3 | 0 | Y | MLDPRQGLAVL | 88.46 | MLDPRQGLTVL | 7.69 | MLDPRQGLAAL | 3.85 | | |
| anC | 72 | 0.62 | 3 | 3 | 0 | Y | LDPRQGLAVLR | 88.46 | LDPRQGLTVLR | 7.69 | LDPRQGLAALR | 3.85 | | |
| anC | 73 | 0.62 | 3 | 3 | 0 | Y | DPRQGLAVLRK | 88.46 | DPRQGLTVLRK | 7.69 | DPRQGLAALRK | 3.85 | | |
| anC | 74 | 0.62 | 3 | 3 | 0 | Y | PRQGLAVLRKV | 88.46 | PRQGLTVLRKV | 7.69 | PRQGLAALRKV | 3.85 | | |
| anC | 75 | 0.62 | 3 | 3 | 0 | Y | RQGLAVLRKVK | 88.46 | RQGLTVLRKVK | 7.69 | RQGLAALRKVK | 3.85 | | |

Fig. 30-4

Species: YFV (11-mers)

| protein | block starting position | block entropy | total peptides in block | # peptides required to cover 99% of block | gap/X fraction | 99% of block covered w/ <= 5 peptides? | peptides required

Fig. 30-5

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

Fig. 30-7

Species: YFV (11-mers)

| protein | block star

Fig. 30-8

Species: YFV (11

Fig. 30-9

Species: YFV (11-mers)

| protein | block starting position | block

Fig. 30-10

Species: YFV (11-mers)

| protein | block starting position | block entropy | total pe

Fig. 30-11

Species: YFV (11-mers)

| protein | block starting position | block entropy | total peptides in block | # peptides required to cover 99% of block | gap/X

Fig. 30-12

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 296 | 0.00 | 1 | 1 | 0 | Y | FIEGVHGTWV | 100 | | | | | | |
| E | 297 | 0.00 | 1 | 1 | 0 | Y | IEGVHGGTWVS | 100 | | | | | | |
| E | 298 | 0.00 | 1 | 1 | 0 | Y | EGVHGGTWVSA | 100 | | | | | | |
| E | 299 | 0.24 | 2 | 2 | 0 | Y | GVHGGTWVSAT | 96.15 | GVHGGTWVSAS | 3.85 | | | | |
| E | 300 | 0.24 | 2 | 2 | 0 | Y | VHGGTWVSATL | 96.15 | VHGGTWVSASL | 3.85 | | | | |
| E | 301 | 0.24 | 2 | 2 | 0 | Y | HGGTWVSATLE | 96.15 | HGGTWVSASLE | 3.85 | | | | |
| E | 302 | 0.24 | 2 | 2 | 0 | Y | GGTWVSATLEQ | 96.15 | GGTWVSASLEQ | 3.85 | | | | |
| E | 303 | 0.47 | 3 | 3 | 0 | Y | GTWVSATLEQD | 92.31 | GTWVSATLEQG | 3.85 | GTWVSASLEQD | 3.85 | | |
| E | 304 | 0.47 | 3 | 3 | 0 | Y | TWVSATLEQDK | 92.31 | TWVSATLEQGK | 3.85 | TWVSASLEQDK | 3.85 | | |
| E | 305 | 0.47 | 3 | 3 | 0 | Y | WVSATLEQDKC | 92.31 | WVSATLEQGKC | 3.85 | WVSASLEQDKC | 3.85 | | |
| E | 306 | 0.47 | 3 | 3 | 0 | Y | VSATLEQDKCV | 92.31 | VSATLEQGKCV | 3.85 | VSASLEQDKCV | 3.85 | | |
| E | 307 | 0.47 | 3 | 3 | 0 | Y | SATLEQDKCVT | 92.31 | SASLEQDKCVT | 3.85 | SATLEQGKCVT | 3.85 | | |
| E | 308 | 0.47 | 3 | 3 | 0 | Y | ATLEQDKCVTV | 92.31 | ATLEQGKCVTV | 3.85 | ASLEQDKCVTV | 3.85 | | |
| E | 309 | 0.47 | 3 | 3 | 0 | Y | TLEQDKCVTVM | 92.31 | SLEQDKCVTVM | 3.85 | TLEQGKCVTVM | 3.85 | | |
| E | 310 | 0.24 | 2 | 2 | 0 | Y | LEQDKCVTVMA | 96.15 | LEQGKCVTVMA | 3.85 | | | | |
| E | 311 | 0.24 | 2 | 2 | 0 | Y | EQDKCVTVMAP | 96.15 | EQGKCVTVMAP | 3.85 | | | | |
| E | 312 | 0.24 | 2 | 2 | 0 | Y | QDKCVTVMAPD | 96.15 | QGKCVTVMAPD | 3.85 | | | | |
| E | 313 | 0.24 | 2 | 2 | 0 | Y | DKCVTVMAPDK | 96.15 | GKCVTVMAPDK | 3.85 | | | | |
| E | 314 | 0.00 | 1 | 1 | 0 | Y | KCVTVMAPDKP | 100 | | | | | | |
| E | 315 | 0.00 | 1 | 1 | 0 | Y | CVTVMAPDKPS | 100 | | | | | | |
| E | 316 | 0.00 | 1 | 1 | 0 | Y | VTVMAPDKPSL | 100 | | | | | | |
| E | 317 | 0.00 | 1 | 1 | 0 | Y | TVMAPDKPSLD | 100 | | | | | | |
| E | 318 | 0.00 | 1 | 1 | 0 | Y | VMAPDKPSLDI | 100 | | | | | | |
| E | 319 | 0.00 | 1 | 1 | 0 | Y | MAPDKPSLDIS | 100 | | | | | | |
| E | 320 | 0.00 | 1 | 1 | 0 | Y | APDKPSLDISL | 100 | | | | | | |

Fig. 30-13

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

Fig. 30-14

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 346 | 0.74 | 3 | 3 | 0 | Y | YNAVLTHVKIN | 84.62 | YSAVLTHVKIN | 11.54 | YNAVLTHVKID | 3.85 | | | | |
| E | 347 | 0.74 | 3 | 3 | 0 | Y | NAVLTHVKIND | 84.62 | SAVLTHVKIND | 11.54 | NAVLTHVKIDD | 3.85 | | | | |
| E | 348 | 0.24 | 2 | 2 | 0 | Y | AVLTHVKINDK | 96.15 | AVLTHVKIDDK | 3.85 | | | | | | |
| E | 349 | 0.24 | 2 | 2 | 0 | Y | VLTHVKINDKC | 96.15 | VLTHVKIDDKC | 3.85 | | | | | | |
| E | 350 | 0.24 | 2 | 2 | 0 | Y | LTHVKINDKCP | 96.15 | LTHVKIDDKCP | 3.85 | | | | | | |
| E | 351 | 0.24 | 2 | 2 | 0 | Y | THVKINDKCPS | 96.15 | THVKIDDKCPS | 3.85 | | | | | | |
| E | 352 | 0.24 | 2 | 2 | 0 | Y | HVKINDKCPST | 96.15 | HVKIDDKCPST | 3.85 | | | | | | |
| E | 353 | 0.24 | 2 | 2 | 0 | Y | VKINDKCPSTG | 96.15 | VKIDDKCPSTG | 3.85 | | | | | | |
| E | 354 | 0.24 | 2 | 2 | 0 | Y | KINDKCPSTGE | 96.15 | KIDDKCPSTGE | 3.85 | | | | | | |
| E | 355 | 0.24 | 2 | 2 | 0 | Y | INDKCPSTGEA | 96.15 | IDDKCPSTGEA | 3.85 | | | | | | |
| E | 356 | 0.24 | 2 | 2 | 0 | Y | NDKCPSTGEAH | 96.15 | DDKCPSTGEAH | 3.85 | | | | | | |
| E | 357 | 0.00 | 1 | 1 | 0 | Y | DKCPSTGEAHL | 100 | | | | | | | | |
| E | 358 | 0.00 | 1 | 1 | 0 | Y | KCPSTGEAHLA | 100 | | | | | | | | |
| E | 359 | 0.00 | 1 | 1 | 0 | Y | CPSTGEAHLAE | 100 | | | | | | | | |
| E | 360 | 0.00 | 1 | 1 | 0 | Y | PSTGEAHLAEE | 100 | | | | | | | | |
| E | 361 | 0.00 | 1 | 1 | 0 | Y | STGEAHLAEEN | 100 | | | | | | | | |
| E | 362 | 0.52 | 2 | 2 | 0 | Y | TGEAHLAEENE | 88.46 | TGEAHLAEEND | 11.54 | | | | | | |
| E | 363 | 0.52 | 2 | 2 | 0 | Y | GEAHLAEENEG | 88.46 | GEAHLAEENDG | 11.54 | | | | | | |
| E | 364 | 0.52 | 2 | 2 | 0 | Y | EAHLAEENEGD | 88.46 | EAHLAEENDGD | 11.54 | | | | | | |
| E | 365 | 0.52 | 2 | 2 | 0 | Y | AHLAEENEGDN | 88.46 | AHLAEENDGDN | 11.54 | | | | | | |
| E | 366 | 0.52 | 2 | 2 | 0 | Y | HLAEENEGDNA | 88.46 | HLAEENDGDNA | 11.54 | | | | | | |
| E | 367 | 0.52 | 2 | 2 | 0 | Y | LAEENEGDNAC | 88.46 | LAEENDGDNAC | 11.54 | | | | | | |
| E | 368 | 0.52 | 2 | 2 | 0 | Y | AEENEGDNACK | 88.46 | AEENDGDNACK | 11.54 | | | | | | |
| E | 369 | 0.52 | 2 | 2 | 0 | Y | EENEGDNACKR | 88.46 | EENDGDNACKR | 11.54 | | | | | | |
| E | 370 | 0.52 | 2 | 2 | 0 | Y | ENEGDNACKRT | 88.46 | ENDGDNACKRT | 11.54 | | | | | | |

Fig. 30-15

Species: YFV (11

Fig. 30-16

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 30-17

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

Fig. 30-18

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

Fig. 30-19

Species: YFV (11-mers)

| protein | block starting position | block

Fig. 30-20

Species: YFV (11

Fig. 30-21

Species: YFV (11-mers)

| protein | block starting position | block entropy | total peptides in block | # peptides required to cover 99% of block | gap/X fraction | 99% of block

Fig. 30-22

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 546 | 0.52 | 2 | 2 | 0 | Y | AMRYTKDTNDN | 88.46 | AMRVTKDENDN | 11.54 | | | | |
| E | 547 | 0.52 | 2 | 2 | 0 | Y | MRYTKDTNDNN | 88.46 | MRVTKDENDNN | 11.54 | | | | |
| E | 548 | 0.52 | 2 | 2 | 0 | Y | RYTKDTNDNNL | 88.46 | RVTKDENDNNL | 11.54 | | | | |
| E | 549 | 0.52 | 2 | 2 | 0 | Y | YTKDTNDNNLY | 88.46 | VTKDENDNNLY | 11.54 | | | | |
| E | 550 | 0.52 | 2 | 2 | 0 | Y | TKDTNDNNLYK | 88.46 | TKDENDNNLYK | 11.54 | | | | |
| E | 551 | 0.52 | 2 | 2 | 0 | Y | KDTNDNNLYKL | 88.46 | KDENDNNLYKL | 11.54 | | | | |
| E | 552 | 0.52 | 2 | 2 | 0 | Y | DTNDNNLYKLH | 88.46 | DENDNNLYKLH | 11.54 | | | | |
| E | 553 | 0.52 | 2 | 2 | 0 | Y | TNDNNLYKLHG | 88.46 | ENDNNLYKLHG | 11.54 | | | | |
| E | 554 | 0.00 | 1 | 1 | 0 | Y | NDNNLYKLHGG | 100 | | | | | | |
| E | 555 | 0.00 | 1 | 1 | 0 | Y | DNNLYKLHGGH | 100 | | | | | | |
| E | 556 | 0.00 | 1 | 1 | 0 | Y | NNLYKLHGGHV | 100 | | | | | | |
| E | 557 | 0.00 | 1 | 1 | 0 | Y | NLYKLHGGHVS | 100 | | | | | | |
| E | 558 | 0.00 | 1 | 1 | 0 | Y | LYKLHGGHVSC | 100 | | | | | | |
| E | 559 | 0.00 | 1 | 1 | 0 | Y | YKLHGGHVSCR | 100 | | | | | | |
| E | 560 | 0.00 | 1 | 1 | 0 | Y | KLHGGHVSCRV | 100 | | | | | | |
| E | 561 | 0.00 | 1 | 1 | 0 | Y | LHGGHVSCRVK | 100 | | | | | | |
| E | 562 | 0.00 | 1 | 1 | 0 | Y | HGGHVSCRVKL | 100 | | | | | | |
| E | 563 | 0.00 | 1 | 1 | 0 | Y | GGHVSCRVKLS | 100 | | | | | | |
| E | 564 | 0.00 | 1 | 1 | 0 | Y | GHVSCRVKLSA | 100 | | | | | | |
| E | 565 | 0.00 | 1 | 1 | 0 | Y | HVSCRVKLSAL | 100 | | | | | | |
| E | 566 | 0.00 | 1 | 1 | 0 | Y | VSCRVKLSALT | 100 | | | | | | |
| E | 567 | 0.00 | 1 | 1 | 0 | Y | SCRVKLSALTL | 100 | | | | | | |
| E | 568 | 0.00 | 1 | 1 | 0 | Y | CRVKLSALTLK | 100 | | | | | | |
| E | 569 | 0.00 | 1 | 1 | 0 | Y | RVKLSALTLKG | 100 | | | | | | |
| E | 570 | 0.00 | 1 | 1 | 0 | Y | VKLSALTLKGT | 100 | | | | | | |

Fig. 30-23

Species: YFV (11-mers)

| protein | block starting position | block entropy | total peptides in block | # peptides required to cover 99% of block | gap/X fraction | 99% of block covered w/ <= 5 peptides? | peptides required to cover

Fig. 30-24

Species: YFV (11

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 646 | 0.00 | 1 | 1 | 0 | Y | DEVLEVNPPF | 100 | | | | | | |
| E | 647 | 0.00 | 1 | 1 | 0 | Y | EVLEVNPPFG | 100 | | | | | | |
| E | 648 | 0.00 | 1 | 1 | 0 | Y | VLEVNPPFGD | 100 | | | | | | |
| E | 649 | 0.00 | 1 | 1 | 0 | Y | LEVNPPFGDS | 100 | | | | | | |
| E | 650 | 0.00 | 1 | 1 | 0 | Y | EVNPPFGDSY | 100 | | | | | | |
| E | 651 | 0.00 | 1 | 1 | 0 | Y | VNPPFGDSYI | 100 | | | | | | |
| E | 652 | 0.00 | 1 | 1 | 0 | Y | NPPFGDSYII | 100 | | | | | | |
| E | 653 | 0.24 | 2 | 2 | 0 | Y | PPFGDSYIIV | 96.15 | NPPFGDSYIII | 3.85 | | | | |
| E | 654 | 0.24 | 2 | 2 | 0 | Y | PFGDSYIIVG | 96.15 | PPFGDSYIIIG | 3.85 | | | | |
| E | 655 | 1.14 | 3 | 3 | 0 | Y | FGDSYIIVGR | 61.54 | PFGDSYIIVGT | 34.62 | PFGDSYIIIGT | 3.85 | | |
| E | 656 | 1.14 | 3 | 3 | 0 | Y | GDSYIIVGRG | 61.54 | FGDSYIIVGTG | 34.62 | FGDSYIIIGTG | 3.85 | | |
| E | 657 | 1.14 | 3 | 3 | 0 | Y | DSYIIVGRGD | 61.54 | GDSYIIVGTGD | 34.62 | GDSYIIIGTGD | 3.85 | | |
| E | 658 | 1.14 | 3 | 3 | 0 | Y | SYIIVGRGDS | 61.54 | DSYIIVGTGDS | 34.62 | DSYIIIGTGDS | 3.85 | | |
| E | 659 | 1.14 | 3 | 3 | 0 | Y | YIIVGRGDSR | 61.54 | SYIIVGTGDSR | 34.62 | SYIIIGTGDSR | 3.85 | | |
| E | 660 | 1.14 | 3 | 3 | 0 | Y | IIVGRGDSRL | 61.54 | YIIVGTGDSRL | 34.62 | YIIIGTGDSRL | 3.85 | | |
| E | 661 | 1.14 | 3 | 3 | 0 | Y | IVGRGDSRLT | 61.54 | IIVGTGDSRLT | 34.62 | IIGTGDSRLT | 3.85 | | |
| E | 662 | 1.14 | 3 | 3 | 0 | Y | VGRGDSRLTY | 61.54 | IVGTGDSRLTY | 34.62 | IIGTGDSRLTY | 3.85 | | |
| E | 663 | 1.14 | 3 | 3 | 0 | Y | GRGDSRLTYQ | 61.54 | VGTGDSRLTYQ | 34.62 | IGTGDSRLTYQ | 3.85 | | |
| E | 664 | 0.96 | 2 | 2 | 0 | Y | RGDSRLTYQW | 61.54 | GTGDSRLTYQW | 38.46 | | | | |
| E | 665 | 0.96 | 2 | 2 | 0 | Y | GDSRLTYQWH | 61.54 | TGDSRLTYQWH | 38.46 | | | | |
| E | 666 | 0.00 | 1 | 1 | 0 | Y | DSRLTYQWHK | 100 | | | | | | |
| E | 667 | 0.00 | 1 | 1 | 0 | Y | SRLTYQWHKE | 100 | | | | | | |
| E | 668 | 0.00 | 1 | 1 | 0 | Y | RLTYQWHKEG | 100 | | | | | | |
| E | 669 | 0.00 | 1 | 1 | 0 | Y | LTYQWHKEGS | 100 | | | | | | |
| E | 670 | 0.00 | 1 | 1 | 0 | Y | TYQWHKEGSS | 100 | | | | | | |

Fig. 30-27

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 671 | 0.00 | 1 | 1 | 0 | Y | TQWHKEGSSI | 100 | | | | | | |
| E | 672 | 0.00 | 1 | 1 | 0 | Y | QWHKEGSSIG | 100 | | | | | | |
| E | 673 | 0.00 | 1 | 1 | 0 | Y | QWHKEGSSIGK | 100 | | | | | | |
| E | 674 | 0.00 | 1 | 1 | 0 | Y | WHKEGSSIGKL | 100 | | | | | | |
| E | 675 | 0.00 | 1 | 1 | 0 | Y | HKEGSSIGKLF | 100 | | | | | | |
| E | 676 | 0.00 | 1 | 1 | 0 | Y | KEGSSIGKLFT | 100 | | | | | | |
| E | 677 | 0.00 | 1 | 1 | 0 | Y | EGSSIGKLFTQ | 100 | | | | | | |
| E | 678 | 0.00 | 1 | 1 | 0 | Y | GSSIGKLFTQT | 100 | | | | | | |
| E | 679 | 0.00 | 1 | 1 | 0 | Y | SSIGKLFTQTM | 100 | | | | | | |
| E | 680 | 0.00 | 1 | 1 | 0 | Y | SIGKLFTQTMK | 100 | | | | | | |
| E | 681 | 0.00 | 1 | 1 | 0 | Y | IGKLFTQTMKG | 100 | | | | | | |
| E | 682 | 0.89 | 2 | 2 | 0 | Y | GKLFTQTMKGV | 69.23 | GKLFTQTMKGA | 30.77 | | | | |
| E | 683 | 0.89 | 2 | 2 | 0 | Y | KLFTQTMKGVE | 69.23 | KLFTQTMKGAE | 30.77 | | | | |
| E | 684 | 0.89 | 2 | 2 | 0 | Y | LFTQTMKGVER | 69.23 | LFTQTMKGAER | 30.77 | | | | |
| E | 685 | 0.89 | 2 | 2 | 0 | Y | FTQTMKGVERL | 69.23 | FTQTMKGAERL | 30.77 | | | | |
| E | 686 | 0.89 | 2 | 2 | 0 | Y | TQTMKGVERLA | 69.23 | TQTMKGAERLA | 30.77 | | | | |
| E | 687 | 0.89 | 2 | 2 | 0 | Y | QTMKGVERLAV | 69.23 | QTMKGAERLAV | 30.77 | | | | |
| E | 688 | 0.89 | 2 | 2 | 0 | Y | TMKGVERLAVM | 69.23 | TMKGAERLAVM | 30.77 | | | | |
| E | 689 | 0.89 | 2 | 2 | 0 | Y | MKGVERLAVMG | 69.23 | MKGAERLAVMG | 30.77 | | | | |
| E | 690 | 0.89 | 2 | 2 | 0 | Y | KGVERLAVMGD | 69.23 | KGAERLAVMGD | 30.77 | | | | |
| E | 691 | 1.67 | 4 | 4 | 0 | Y | GVERLAVMGDT | 50 | GAERLAVMGDA | 30.77 | GVERLAVMGDV | 11.54 | GVERLAVMGDA | 7.69 |
| E | 692 | 1.67 | 4 | 4 | 0 | Y | VERLAVMGDTA | 50 | AERLAVMGDAA | 30.77 | VERLAVMGDVA | 11.54 | VERLAVMGDAA | 7.69 |
| E | 693 | 1.39 | 3 | 3 | 0 | Y | ERLAVMGDTAW | 50 | ERLAVMGDAAW | 38.46 | ERLAVMGDVAW | 11.54 | | |
| E | 694 | 1.39 | 3 | 3 | 0 | Y | RLAVMGDTAWD | 50 | RLAVMGDAAWD | 38.46 | RLAVMGDVAWD | 11.54 | | |
| E | 695 | 1.39 | 3 | 3 | 0 | Y | LAVMGDTAWDF | 50 | LAVMGDAAWDF | 38.46 | LAVMGDVAWDF | 11.54 | | |

Fig. 30-28

Species: YFV (11-mers)

| protein | block starting position | block

Fig. 30-29

Species: YFV (11-mers)

| prot

Fig. 30-30

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 746 | 0.24 | 2 | 2 | 0 | Y | LIWVGINTRNM | 96.15 | LIWVGFNTRNM | 3.85 | | | | |
| E | 747 | 0.24 | 2 | 2 | 0 | Y | IWVGINTRNMT | 96.15 | IWVGFNTRNMT | 3.85 | | | | |
| E | 748 | 0.24 | 2 | 2 | 0 | Y | WVGINTRNMTM | 96.15 | WVGFNTRNMTM | 3.85 | | | | |
| E | 749 | 0.24 | 2 | 2 | 0 | Y | VGINTRNMTMS | 96.15 | VGFNTRNMTMS | 3.85 | | | | |
| E | 750 | 0.24 | 2 | 2 | 0 | Y | GINTRNMTMSM | 96.15 | GFNTRNMTMSM | 3.85 | | | | |
| E | 751 | 0.24 | 2 | 2 | 0 | Y | INTRNMTMSMS | 96.15 | FNTRNMTMSMS | 3.85 | | | | |
| E | 752 | 0.00 | 1 | 1 | 0 | Y | NTRNMTMSMSM | 100 | | | | | | |
| E | 753 | 0.00 | 1 | 1 | 0 | Y | TRNMTMSMSMI | 100 | | | | | | |
| E | 754 | 0.24 | 2 | 2 | 0 | Y | RNMTMSMSMIL | 96.15 | RNMTMSMSMIM | 3.85 | | | | |
| E | 755 | 0.24 | 2 | 2 | 0 | Y | NMTMSMSMILV | 96.15 | NMTMSMSMIMV | 3.85 | | | | |
| E | 756 | 0.24 | 2 | 2 | 0 | Y | MTMSMSMILVG | 96.15 | MTMSMSMIMVG | 3.85 | | | | |
| E | 757 | 0.24 | 2 | 2 | 0 | Y | TMSMSMILVGV | 96.15 | TMSMSMIMVGV | 3.85 | | | | |
| E | 758 | 0.24 | 2 | 2 | 0 | Y | MSMSMILVGVI | 96.15 | MSMSMIMVGVI | 3.85 | | | | |
| E | 759 | 0.24 | 2 | 2 | 0 | Y | SMSMILVGVIM | 96.15 | SMSMIMVGVIM | 3.85 | | | | |
| E | 760 | 0.24 | 2 | 2 | 0 | Y | MSMILVGVIMM | 96.15 | MSMIMVGVIMM | 3.85 | | | | |
| E | 761 | 0.24 | 2 | 2 | 0 | Y | SMILVGVIMMF | 96.15 | SMIMVGVIMMF | 3.85 | | | | |
| E | 762 | 0.24 | 2 | 2 | 0 | Y | MILVGVIMMFL | 96.15 | MIMVGVIMMFL | 3.85 | | | | |
| E | 763 | 0.24 | 2 | 2 | 0 | Y | ILVGVIMMFLS | 96.15 | IMVGVIMMFLS | 3.85 | | | | |
| E | 764 | 0.24 | 2 | 2 | 0 | Y | LVGVIMMFLSL | 96.15 | MVGVIMMFLSL | 3.85 | | | | |
| E | 765 | 0.00 | 1 | 1 | 0 | Y | VGVIMMFLSLG | 100 | | | | | | |
| E | 766 | 0.00 | 1 | 1 | 0 | Y | GVIMMFLSLGV | 100 | | | | | | |
| E | 767 | 0.00 | 1 | 1 | 0 | Y | VIMMFLSLGVG | 100 | | | | | | |
| E | 768 | 0.00 | 1 | 1 | 0 | Y | IMMFLSLGVGA | 100 | | | | | | |
| E | 769 | 0.00 | 1 | 1 | 0 | Y | MMFLSLGVGAD | 100 | | | | | | |
| E | 770 | 0.00 | 1 | 1 | 0 | Y | MFLSLGVGADQ | 100 | | | | | | |

Fig. 30-31

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 771 | 0.00 | 1 | 1 | 0 | Y | FLSLGVGADQG | 100 | | | | | | |
| E | 772 | 0.00 | 1 | 1 | 0 | Y | LSLGVGADQGC | 100 | | | | | | |
| E | 773 | 0.00 | 1 | 1 | 0 | Y | SLGVGADQGCA | 100 | | | | | | |
| E | 774 | 0.52 | 2 | 2 | 0 | Y | LGVGADQGCAI | 88.46 | LGVGADQGCAV | 11.54 | | | | |
| E | 775 | 0.52 | 2 | 2 | 0 | Y | GVGADQGCAIN | 88.46 | GVGADQGCAVN | 11.54 | | | | |
| E | 776 | 0.52 | 2 | 2 | 0 | Y | VGADQGCAINF | 88.46 | VGADQGCAVNF | 11.54 | | | | |
| E | 777 | 0.74 | 3 | 3 | 0 | Y | GADQGCAINFG | 84.62 | GADQGCAVNFG | 11.54 | GADQGCAINFA | 3.85 | | |
| E | 778 | 0.74 | 3 | 3 | 0 | Y | ADQGCAINFGK | 84.62 | ADQGCAVNFGK | 11.54 | ADQGCAINFAK | 3.85 | | |
| NS1 | 779 | 0.74 | 3 | 3 | 0 | Y | DQGCAINFGKR | 84.62 | DQGCAVNFGKR | 11.54 | DQGCAINFAKR | 3.85 | | |
| NS1 | 780 | 0.74 | 3 | 3 | 0 | Y | QGCAINFGKRE | 84.62 | QGCAVNFGKRE | 11.54 | QGCAINFAKRE | 3.85 | | |
| NS1 | 781 | 0.74 | 3 | 3 | 0 | Y | GCAINFGKREL | 84.62 | GCAVNFGKREL | 11.54 | GCAINFAKREL | 3.85 | | |
| NS1 | 782 | 0.74 | 3 | 3 | 0 | Y | CAINFGKRELK | 84.62 | CAVNFGKRELK | 11.54 | CAINFAKRELK | 3.85 | | |
| NS1 | 783 | 0.74 | 3 | 3 | 0 | Y | AINFGKRELKC | 84.62 | AVNFGKRELKC | 11.54 | AINFAKRELKC | 3.85 | | |
| NS1 | 784 | 0.74 | 3 | 3 | 0 | Y | INFGKRELKCG | 84.62 | VNFGKRELKCG | 11.54 | INFAKRELKCG | 3.85 | | |
| NS1 | 785 | 0.24 | 2 | 2 | 0 | Y | NFGKRELKCGD | 96.15 | NFAKRELKCGD | 3.85 | | | | |
| NS1 | 786 | 0.24 | 2 | 2 | 0 | Y | FGKRELKCGDG | 96.15 | FAKRELKCGDG | 3.85 | | | | |
| NS1 | 787 | 0.24 | 2 | 2 | 0 | Y | GKRELKCGDGI | 96.15 | AKRELKCGDGI | 3.85 | | | | |
| NS1 | 788 | 0.00 | 1 | 1 | 0 | Y | KRELKCGDGIF | 100 | | | | | | |
| NS1 | 789 | 0.52 | 2 | 2 | 0 | Y | RELKCGDGIFI | 88.46 | RELKCGDGIFV | 11.54 | | | | |
| NS1 | 790 | 0.52 | 2 | 2 | 0 | Y | ELKCGDGIFIF | 88.46 | ELKCGDGIFVF | 11.54 | | | | |
| NS1 | 791 | 0.52 | 2 | 2 | 0 | Y | LKCGDGIFIFR | 88.46 | LKCGDGIFVFR | 11.54 | | | | |
| NS1 | 792 | 0.52 | 2 | 2 | 0 | Y | KCGDGIFIFRD | 88.46 | KCGDGIFVFRD | 11.54 | | | | |
| NS1 | 793 | 0.52 | 2 | 2 | 0 | Y | CGDGIFIFRDS | 88.46 | CGDGIFVFRDS | 11.54 | | | | |
| NS1 | 794 | 0.52 | 2 | 2 | 0 | Y | GDGIFIFRDSD | 88.46 | GDGIFVFRDSD | 11.54 | | | | |
| NS1 | 795 | 0.52 | 2 | 2 | 0 | Y | DGIFIFRDSDD | 88.46 | DGIFVFRDSDD | 11.54 | | | | |

Fig. 30-32

Species: YFV (11-mers)

| protein | block starting position | block

Fig. 30-33

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 821 | 0.62 | 3 | 3 | 0 | Y | ASIIKASFEEG | 88.46 | ASIIKASHEEG | 7.69 | ASIIKASYEEG | 3.85 | | |
| NS1 | 822 | 0.62 | 3 | 3 | 0 | Y | SIVKASFEEGK | 88.46 | SIIKASHEEGK | 7.69 | SIIKASYEEGK | 3.85 | | |
| NS1 | 823 | 0.62 | 3 | 3 | 0 | Y | IVKASFEEGKC | 88.46 | IIKASHEEGKC | 7.69 | IIKASYEEGKC | 3.85 | | |
| NS1 | 824 | 0.62 | 3 | 3 | 0 | Y | VKASFEEGKCG | 88.46 | IKASHEEGKCG | 7.69 | IKASYEEGKCG | 3.85 | | |
| NS1 | 825 | 0.62 | 3 | 3 | 0 | Y | KASFEEGKCGL | 88.46 | KASHEEGKCGL | 7.69 | KASYEEGKCGL | 3.85 | | |
| NS1 | 826 | 0.62 | 3 | 3 | 0 | Y | ASFEEGKCGLN | 88.46 | ASHEEGKCGLN | 7.69 | ASYEEGKCGLN | 3.85 | | |
| NS1 | 827 | 0.62 | 3 | 3 | 0 | Y | SFEEGKCGLNS | 88.46 | SHEEGKCGLNS | 7.69 | SYEEGKCGLNS | 3.85 | | |
| NS1 | 828 | 0.62 | 3 | 3 | 0 | Y | FEEGKCGLNSV | 88.46 | HEEGKCGLNSV | 7.69 | YEEGKCGLNSV | 3.85 | | |
| NS1 | 829 | 0.00 | 1 | 1 | 0 | Y | EEGKCGLNSVD | 100 | | | | | | |
| NS1 | 830 | 0.00 | 1 | 1 | 0 | Y | EGKCGLNSVDS | 100 | | | | | | |
| NS1 | 831 | 0.00 | 1 | 1 | 0 | Y | GKCGLNSVDSL | 100 | | | | | | |
| NS1 | 832 | 0.24 | 2 | 2 | 0 | Y | KCGLNSVDSLE | 96.15 | KCGLNSVDSLD | 3.85 | | | | |
| NS1 | 833 | 0.24 | 2 | 2 | 0 | Y | CGLNSVDSLEH | 96.15 | CGLNSVDSLDH | 3.85 | | | | |
| NS1 | 834 | 0.24 | 2 | 2 | 0 | Y | GLNSVDSLEHE | 96.15 | GLNSVDSLDHE | 3.85 | | | | |
| NS1 | 835 | 0.24 | 2 | 2 | 0 | Y | LNSVDSLEHEM | 96.15 | LNSVDSLDHEM | 3.85 | | | | |
| NS1 | 836 | 0.24 | 2 | 2 | 0 | Y | NSVDSLEHEMW | 96.15 | NSVDSLDHEMW | 3.85 | | | | |
| NS1 | 837 | 0.24 | 2 | 2 | 0 | Y | SVDSLEHEMWR | 96.15 | SVDSLDHEMWR | 3.85 | | | | |
| NS1 | 838 | 0.24 | 2 | 2 | 0 | Y | VDSLEHEMWRS | 96.15 | VDSLDHEMWRS | 3.85 | | | | |
| NS1 | 839 | 0.24 | 2 | 2 | 0 | Y | DSLEHEMWRSR | 96.15 | DSLDHEMWRSR | 3.85 | | | | |
| NS1 | 840 | 0.24 | 2 | 2 | 0 | Y | SLEHEMWRSRA | 96.15 | SLDHEMWRSRA | 3.85 | | | | |
| NS1 | 841 | 0.24 | 2 | 2 | 0 | Y | LEHEMWRSRAD | 96.15 | LDHEMWRSRAD | 3.85 | | | | |
| NS1 | 842 | 0.24 | 2 | 2 | 0 | Y | EHEMWRSRADE | 96.15 | DHEMWRSRADE | 3.85 | | | | |
| NS1 | 843 | 0.00 | 1 | 1 | 0 | Y | HEMWRSRADEI | 100 | | | | | | |
| NS1 | 844 | 0.00 | 1 | 1 | 0 | Y | EMWRSRADEIN | 100 | | | | | | |
| NS1 | 845 | 0.00 | 1 | 1 | 0 | Y | MWRSRADEINA | 100 | | | | | | |

Fig. 30-34

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 846 | 0.00 | 1 | 1 | 0 | Y | WRSRADEINAI | 100 | | | | | | |
| NS1 | 847 | 0.84 | 2 | 2 | 0 | Y | RSRADEINAIF | 73.08 | RSRADEINAIL | 26.92 | | | | |
| NS1 | 848 | 0.84 | 2 | 2 | 0 | Y | SRADEINAIFE | 73.08 | SRADEINAILE | 26.92 | | | | |
| NS1 | 849 | 0.84 | 2 | 2 | 0 | Y | RADEINAIFEE | 73.08 | RADEINAILEE | 26.92 | | | | |
| NS1 | 850 | 0.84 | 2 | 2 | 0 | Y | ADEINAIFEEN | 73.08 | ADEINAILEEN | 26.92 | | | | |
| NS1 | 851 | 0.84 | 2 | 2 | 0 | Y | DEINAIFEENE | 73.08 | DEINAILEENE | 26.92 | | | | |
| NS1 | 852 | 0.84 | 2 | 2 | 0 | Y | EINAIFEENEV | 73.08 | EINAILEENEV | 26.92 | | | | |
| NS1 | 853 | 0.84 | 2 | 2 | 0 | Y | INAIFEENEVD | 73.08 | INAILEENEVD | 26.92 | | | | |
| NS1 | 854 | 0.84 | 2 | 2 | 0 | Y | NAIFEENEVDI | 73.08 | NAILEENEVDI | 26.92 | | | | |
| NS1 | 855 | 0.84 | 2 | 2 | 0 | Y | AIFEENEVDIS | 73.08 | AILEENEVDIS | 26.92 | | | | |
| NS1 | 856 | 1.06 | 3 | 3 | 0 | Y | IFEENEVDISV | 69.23 | ILEENEVDISV | 26.92 | IFEENEVDISI | 3.85 | | |
| NS1 | 857 | 1.06 | 3 | 3 | 0 | Y | FEENEVDISVV | 69.23 | LEENEVDISVV | 26.92 | FEENEVDISIV | 3.85 | | |
| NS1 | 858 | 0.24 | 2 | 2 | 0 | Y | EENEVDISVVV | 96.15 | EENEVDISIVV | 3.85 | | | | |
| NS1 | 859 | 0.24 | 2 | 2 | 0 | Y | ENEVDISVVVQ | 96.15 | ENEVDISIVVQ | 3.85 | | | | |
| NS1 | 860 | 0.24 | 2 | 2 | 0 | Y | NEVDISVVVQD | 96.15 | NEVDISIVVQD | 3.85 | | | | |
| NS1 | 861 | 0.24 | 2 | 2 | 0 | Y | EVDISVVVQDP | 96.15 | EVDISIVVQDP | 3.85 | | | | |
| NS1 | 862 | 0.24 | 2 | 2 | 0 | Y | VDISVVVQDPK | 96.15 | VDISIVVQDPK | 3.85 | | | | |
| NS1 | 863 | 0.24 | 2 | 2 | 0 | Y | DISVVVQDPKN | 96.15 | DISIVVQDPKN | 3.85 | | | | |
| NS1 | 864 | 0.62 | 3 | 3 | 0 | Y | ISVVVQDPKNV | 88.46 | ISVVQDPKNIV | 7.69 | ISVVQDPKNI | 3.85 | | |
| NS1 | 865 | 0.62 | 3 | 3 | 0 | Y | SVVVQDPKNVY | 88.46 | SVVQDPKNIYQ | 7.69 | SVVQDPKNIY | 3.85 | | |
| NS1 | 866 | 0.62 | 3 | 3 | 0 | Y | VVVQDPKNVYQ | 88.46 | VVQDPKNIYQR | 7.69 | VVQDPKNIYQ | 3.85 | | |
| NS1 | 867 | 0.52 | 2 | 2 | 0 | Y | VVQDPKNVYQR | 88.46 | VQDPKNIYQRG | 11.54 | | | | |
| NS1 | 868 | 0.52 | 2 | 2 | 0 | Y | VQDPKNVYQRG | 88.46 | QDPKNIYQRGT | 11.54 | | | | |
| NS1 | 869 | 0.52 | 2 | 2 | 0 | Y | QDPKNVYQRGT | 88.46 | DPKNIYQRGTH | 11.54 | | | | |
| NS1 | 870 | 0.52 | 2 | 2 | 0 | Y | DPKNVYQRGTH | 88.46 | DPKNIYQRGTH | 11.54 | | | | |

Fig. 30-35

Species: YFV (11

Fig. 30-36

Species: YFV (11-mers)

| protein | block starting position | block entropy | total pe

Fig. 30-37

Species: YFV (11-mers)

| protein | block starting position

Fig. 30-38

Species: YFV (11-mers)

| protein | block starting position | block

Fig. 30-39

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 30-40

Species: YFV (11-mers)

| protein | block starting position | block entropy | total peptides in block | # peptides required to cover 99% of block | gap/X fraction | 99% of block covered w/ <= 5 peptides? | pept

Fig. 30-41

Species: YFV (11

Fig. 30-42

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 30-43

Species: YFV (11-mers)

| protein | block

Fig. 30-44

Species: YFV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1096 | 0.24 | 2 | 2 | 0 | Y | MPPVSFHGSDG | 96.15 | MPPVSFHGNDG | 3.85 | | | | |
| NS1 | 1097 | 0.24 | 2 | 2 | 0 | Y | PPVSFHGSDGC | 96.15 | PPVSFHGNDGC | 3.85 | | | | |
| NS1 | 1098 | 0.24 | 2 | 2 | 0 | Y | PVSFHGSDGCW | 96.15 | PVSFHGNDGCW | 3.85 | | | | |
| NS1 | 1099 | 0.24 | 2 | 2 | 0 | Y | VSFHGSDGCWY | 96.15 | VSFHGNDGCWY | 3.85 | | | | |
| NS1 | 1100 | 0.24 | 2 | 2 | 0 | Y | SFHGSDGCWYP | 96.15 | SFHGNDGCWYP | 3.85 | | | | |
| NS1 | 1101 | 0.24 | 2 | 2 | 0 | Y | FHGSDGCWYPM | 96.15 | FHGNDGCWYPM | 3.85 | | | | |
| NS1 | 1102 | 0.24 | 2 | 2 | 0 | Y | HGSDGCWYPME | 96.15 | HGNDGCWYPME | 3.85 | | | | |
| NS1 | 1103 | 0.24 | 2 | 2 | 0 | Y | GSDGCWYPMEI | 96.15 | GNDGCWYPMEI | 3.85 | | | | |
| NS1 | 1104 | 0.24 | 2 | 2 | 0 | Y | SDGCWYPMEIR | 96.15 | NDGCWYPMEIR | 3.85 | | | | |
| NS1 | 1105 | 0.00 | 1 | 1 | 0 | Y | DGCWYPMEIRP | 100 | | | | | | |
| NS1 | 1106 | 0.62 | 2 | 2 | 0 | Y | GCWYPMEIRPR | 84.62 | GCWYPMEIRPM | 15.38 | | | | |
| NS1 | 1107 | 0.62 | 2 | 2 | 0 | Y | CWYPMEIRPRK | 84.62 | CWYPMEIRPMK | 15.38 | | | | |
| NS1 | 1108 | 0.85 | 3 | 3 | 0 | Y | WYPMEIRPRKT | 80.77 | WYPMEIRPMKT | 15.38 | WYPMEIRPRKA | 3.85 | | |
| NS1 | 1109 | 0.97 | 4 | 4 | 0 | Y | YPMEIRPRKTH | 80.77 | YPMEIRPMKTH | 11.54 | YPMEIRPMKTS | 3.85 | YPMEIRPRKAH | 3.85 |
| NS1 | 1110 | 0.97 | 4 | 4 | 0 | Y | PMEIRPRKTHE | 80.77 | PMEIRPMKTHE | 11.54 | PMEIRPRKAHE | 3.85 | PMEIRPMKTSD | 3.85 |
| NS1 | 1111 | 0.97 | 4 | 4 | 0 | Y | MEIRPRKTHES | 80.77 | MEIRPMKTHES | 11.54 | MEIRPMKTSDS | 3.85 | MEIRPRKAHES | 3.85 |
| NS1 | 1112 | 0.97 | 4 | 4 | 0 | Y | EIRPRKTHESH | 80.77 | EIRPMKTHESH | 11.54 | EIRPRKAHESH | 3.85 | EIRPMKTSDSH | 3.85 |
| NS1 | 1113 | 0.97 | 4 | 4 | 0 | Y | IRPRKTHESHL | 80.77 | IRPMKTHESHL | 11.54 | IRPMKTSDSHL | 3.85 | IRPRKAHESHL | 3.85 |
| NS1 | 1114 | 0.97 | 4 | 4 | 0 | Y | RPRKTHESHLV | 80.77 | RPMKTHESHLV | 11.54 | RPRKAHESHLV | 3.85 | RPMKTSDSHLV | 3.85 |
| NS1 | 1115 | 0.97 | 4 | 4 | 0 | Y | PRKTHESHLVR | 80.77 | PMKTHESHLVR | 11.54 | PRKAHESHLVR | 3.85 | PMKTSDSHLVR | 3.85 |
| NS1 | 1116 | 0.97 | 4 | 4 | 0 | Y | RKTHESHLVRS | 80.77 | MKTHESHLVRS | 11.54 | RKAHESHLVRS | 3.85 | MKTSDSHLVRS | 3.85 |
| NS1 | 1117 | 0.47 | 3 | 3 | 0 | Y | KTHESHLVRSW | 92.31 | KAHESHLVRSW | 3.85 | KTSDSHLVRSW | 3.85 | | |
| NS1 | 1118 | 0.47 | 3 | 3 | 0 | Y | THESHLVRSWV | 92.31 | TSDSHLVRSWV | 3.85 | AHESHLVRSWV | 3.85 | | |
| NS1 | 1119 | 0.24 | 2 | 2 | 0 | Y | HESHLVRSWVT | 96.15 | SDSHLVRSWVT | 3.85 | | | | |
| NS1 | 1120 | 0.24 | 2 | 2 | 0 | Y | ESHLVRSWVTA | 96.15 | DSHLVRSWVTA | 3.85 | | | | |

Fig. 30-45

Species: YFV (11-mers)

| protein | block starting position | block ent

Fig. 30-46

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1146 | 0.47 | 3 | 3 | 0 | Y | AMEVLRRRQG | 92.31 | ALEVLRKRQG | 3.85 | AMEVLRRRQG | 3.85 | | |
| NS2A | 1147 | 0.47 | 3 | 3 | 0 | Y | MEVLRRRQGP | 92.31 | LEVLRKRQGP | 3.85 | MEVLRRRQGP | 3.85 | | |
| NS2A | 1148 | 0.24 | 2 | 2 | 0 | Y | EVLRKRRQGPK | 96.15 | EWLRRRQGPK | 3.85 | | | | |
| NS2A | 1149 | 0.24 | 2 | 2 | 0 | Y | VLRKRRQGPKQ | 96.15 | WLRRRQGPKQ | 3.85 | | | | |
| NS2A | 1150 | 0.47 | 3 | 3 | 0 | Y | VLRRQGPKQM | 92.31 | VLRKRQGPKQY | 3.85 | VLRRRQGPKQM | 3.85 | | |
| NS2A | 1151 | 0.47 | 3 | 3 | 0 | Y | LRRQGPKQML | 92.31 | LRRRQGPKQVL | 3.85 | LRRRQGPKQML | 3.85 | | |
| NS2A | 1152 | 0.47 | 3 | 3 | 0 | Y | RRQGPKQMLV | 92.31 | RRRQGPKQMLV | 3.85 | RKRQGPKQVLV | 3.85 | | |
| NS2A | 1153 | 0.47 | 3 | 3 | 0 | Y | RQGPKQMLVG | 92.31 | KRQGPKQMLV | 3.85 | RRQGPKQMLVG | 3.85 | | |
| NS2A | 1154 | 0.24 | 2 | 2 | 0 | Y | QGPKQMLVGG | 96.15 | RQGPKQVLVGG | 3.85 | | | | |
| NS2A | 1155 | 0.85 | 4 | 4 | 0 | Y | GPKQMLVGGV | 84.62 | QGPKQMLVGGI | 7.69 | QGPKQMLVGGM | 3.85 | QGPKQVLVGGV | 3.85 |
| NS2A | 1156 | 0.85 | 4 | 4 | 0 | Y | PKQMLVGGVW | 84.62 | GPKQMLVGGII | 7.69 | GPKQMLVGGVV | 3.85 | GPKQMLVGGMV | 3.85 |
| NS2A | 1157 | 0.85 | 4 | 4 | 0 | Y | KQMLVGGVWL | 84.62 | PKQMLVGGIII | 7.69 | PIKQVLVGGWL | 3.85 | PKQMLVGGWL | 3.85 |
| NS2A | 1158 | 0.85 | 4 | 4 | 0 | Y | QMLVGGVWLL | 84.62 | KQMLVGGIIIL | 7.69 | KQMLVGGMVLL | 3.85 | KQVLVGGWLL | 3.85 |
| NS2A | 1159 | 0.85 | 4 | 4 | 0 | Y | MLVGGVWLLG | 84.62 | QMLVGGIIILLG | 7.69 | QMLVGGMVLLG | 3.85 | QVLVGGWLLG | 3.85 |
| NS2A | 1160 | 0.85 | 4 | 4 | 0 | Y | LVGGVWLLGA | 84.62 | MLVGGIIILLGA | 7.69 | MLVGGMVLLGA | 3.85 | VLVGGVWLLGA | 3.85 |
| NS2A | 1161 | 0.62 | 3 | 3 | 0 | Y | VGGVWLLGAM | 88.46 | LVGGIIILLGAM | 7.69 | LVGGMVLLGAM | 3.85 | | |
| NS2A | 1162 | 0.62 | 3 | 3 | 0 | Y | GGVWLLGAML | 88.46 | VGGIIILLGAML | 7.69 | VGGMVLLGAMLV | 3.85 | | |
| NS2A | 1163 | 0.62 | 3 | 3 | 0 | Y | GVWLLGAMLV | 88.46 | GGIIILLGAMLV | 7.69 | GGMVLLGAMLV | 3.85 | | |
| NS2A | 1164 | 0.62 | 3 | 3 | 0 | Y | VWLLGAMLVG | 88.46 | GIIILLGAMLVG | 7.69 | GMVLLGAMLVG | 3.85 | | |
| NS2A | 1165 | 0.62 | 3 | 3 | 0 | Y | WLLGAMLVGQ | 88.46 | IIILLGAMLVGQ | 7.69 | MVLLGAMLVGQ | 3.85 | | |
| NS2A | 1166 | 0.39 | 2 | 2 | 0 | Y | VLLGAMLVGQV | 92.31 | ILLGAMLVGQV | 7.69 | | | | |
| NS2A | 1167 | 0.00 | 1 | 1 | 0 | Y | LLGAMLVGQVT | 100 | | | | | | |
| NS2A | 1168 | 0.62 | 3 | 3 | 0 | Y | LGAMLVGQVTL | 88.46 | LGAMLVGQVTV | 7.69 | LGAMLVGQVTM | 3.85 | | |
| NS2A | 1169 | 0.62 | 3 | 3 | 0 | Y | GAMLVGQVTLL | 88.46 | GAMLVGQVTVL | 7.69 | GAMLVGQVTML | 3.85 | | |
| NS2A | 1170 | 0.62 | 3 | 3 | 0 | Y | AMLVGQVTLLD | 88.46 | AMLVGQVTVLD | 7.69 | AMLVGQVTMLD | 3.85 | | |

Fig. 30-47

Species: YFV (11-mers)

| protein

Fig. 30-48

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1206 | 0.89 | 3 | 3 | 0 | Y | LIAAFSIRPGL | 80.77 | LIASFSIRPGL | 11.54 | LIAAFSVRPGL | 7.69 | | |
| NS2A | 1207 | 0.89 | 3 | 3 | 0 | Y | IAAFSIRPGLL | 80.77 | IASFSIRPGLL | 11.54 | IAAFSVRPGLL | 7.69 | | |
| NS2A | 1208 | 1.08 | 5 | 5 | 0 | Y | AAFSIRPGLLI | 80.77 | AAFSVRPGLLI | 7.69 | ASFSIRPGLLI | 3.85 | ASFSIRPGLLM | 3.85 | ASFSIRPGLLI | 3.85 |
| NS2A | 1209 | 1.08 | 5 | 5 | 0 | Y | AFSIRPGLLIG | 80.77 | AFSVRPGLLIG | 7.69 | SFSIRPGLLIG | 3.85 | SFSIRPGLLVG | 3.85 | SFSIRPGLLMG | 3.85 |
| NS2A | 1210 | 0.85 | 4 | 4 | 0 | Y | FSIRPGLLIGF | 84.62 | FSVRPGLLIGF | 7.69 | FSIRPGLLMGF | 3.85 | FSIRPGLLVGF | 3.85 | |
| NS2A | 1211 | 0.85 | 4 | 4 | 0 | Y | SIRPGLLIGFG | 84.62 | SVRPGLLIGFG | 7.69 | SIRPGLLVGFG | 3.85 | SIRPGLLMGFG | 3.85 | |
| NS2A | 1212 | 0.85 | 4 | 4 | 0 | Y | IRPGLLIGFGL | 84.62 | VRPGLLIGFGL | 7.69 | IRPGLLMGFGL | 3.85 | IRPGLLVGFGL | 3.85 | |
| NS2A | 1213 | 0.47 | 3 | 3 | 0 | Y | RPGLLIGFGLR | 92.31 | RPGLLMGFGLR | 3.85 | RPGLLVGFGLR | 3.85 | | |
| NS2A | 1214 | 0.47 | 3 | 3 | 0 | Y | PGLLIGFGLRT | 92.31 | PGLLVGFGLRT | 3.85 | PGLLMGFGLRT | 3.85 | | |
| NS2A | 1215 | 0.47 | 3 | 3 | 0 | Y | GLLIGFGLRTL | 92.31 | GLLMGFGLRTL | 3.85 | GLLVGFGLRTL | 3.85 | | |
| NS2A | 1216 | 0.47 | 3 | 3 | 0 | Y | LLIGFGLRTLW | 92.31 | LLVGFGLRTLW | 3.85 | LLMGFGLRTLW | 3.85 | | |
| NS2A | 1217 | 0.47 | 3 | 3 | 0 | Y | LIGFGLRTLWS | 92.31 | LMGFGLRTLWS | 3.85 | LVGFGLRTLWS | 3.85 | | |
| NS2A | 1218 | 0.47 | 3 | 3 | 0 | Y | IGFGLRTLWSP | 92.31 | MGFGLRTLWSP | 3.85 | VGFGLRTLWSP | 3.85 | | |
| NS2A | 1219 | 0.00 | 1 | 1 | 0 | Y | GFGLRTLWSPR | 100 | | | | | | |
| NS2A | 1220 | 0.00 | 1 | 1 | 0 | Y | FGLRTLWSPRE | 100 | | | | | | |
| NS2A | 1221 | 0.00 | 1 | 1 | 0 | Y | GLRTLWSPRER | 100 | | | | | | |
| NS2A | 1222 | 0.00 | 1 | 1 | 0 | Y | LRTLWSPRERL | 100 | | | | | | |
| NS2A | 1223 | 0.00 | 1 | 1 | 0 | Y | RTLWSPRERLV | 100 | | | | | | |
| NS2A | 1224 | 0.52 | 2 | 2 | 0 | Y | TLWSPRERLVL | 88.46 | TLWSPRERLVM | 11.54 | | | | |
| NS2A | 1225 | 0.89 | 3 | 3 | 0 | Y | LWSPRERLVLT | 80.77 | LWSPRERLVMA | 11.54 | LWSPRERLVLA | 7.69 | | |
| NS2A | 1226 | 0.89 | 3 | 3 | 0 | Y | WSPRERLVLTL | 80.77 | WSPRERLVMAF | 11.54 | WSPRERLVLAL | 7.69 | | |
| NS2A | 1227 | 0.89 | 3 | 3 | 0 | Y | SPRERLVLTLG | 80.77 | SPRERLVMAFG | 11.54 | SPRERLVLALG | 7.69 | | |
| NS2A | 1228 | 0.89 | 3 | 3 | 0 | Y | PRERLVLTLGA | 80.77 | PRERLVMAFGA | 11.54 | PRERLVLALGA | 7.69 | | |
| NS2A | 1229 | 0.89 | 3 | 3 | 0 | Y | RERLVLTLGAA | 80.77 | RERLVMAFGAA | 11.54 | RERLVLALGAA | 7.69 | | |
| NS2A | 1230 | 0.89 | 3 | 3 | 0 | Y | ERLVLTLGAAM | 80.77 | ERLVMAFGAAM | 11.54 | ERLVLALGAAM | 7.69 | | |

Species: YFV (11-m

Fig. 30-50

Species: YFV (11-mers)

| protein | block star

Fig. 30-51

Species: YFV (11-mers)

| protein | block starting position | block entropy | total

Fig. 30-52

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1314 | 0.52 | 2 | 2 | 0 | Y | KDTSMQKTIPL | 88.46 | KDTSMQKTIPI | 11.54 | | | | | | |
| NS2A | 1315 | 0.52 | 2 | 2 | 0 | Y | DTSMQKTIPLV | 88.46 | DTSMQKTIPIV | 11.54 | | | | | | |
| NS2A | 1316 | 0.52 | 2 | 2 | 0 | Y | TSMQKTIPLVA | 88.46 | TSMQKTIPIVA | 11.54 | | | | | | |
| NS2A | 1317 | 0.52 | 2 | 2 | 0 | Y | SMQKTIPLVAL | 88.46 | SMQKTIPIVAL | 11.54 | | | | | | |
| NS2A | 1318 | 0.52 | 2 | 2 | 0 | Y | MQKTIPLVALT | 88.46 | MQKTIPIVALT | 11.54 | | | | | | |
| NS2A | 1319 | 0.52 | 2 | 2 | 0 | Y | QKTIPLVALTL | 88.46 | QKTIPIVALTL | 11.54 | | | | | | |
| NS2A | 1320 | 0.52 | 2 | 2 | 0 | Y | KTIPLVALTLI | 88.46 | KTIPIVALTLI | 11.54 | | | | | | |
| NS2A | 1321 | 0.52 | 2 | 2 | 0 | Y | TIPLVALTLIS | 88.46 | TIPIVALTLIS | 11.54 | | | | | | |
| NS2A | 1322 | 0.52 | 2 | 2 | 0 | Y | IPLVALTLISY | 88.46 | IPIVALTLISY | 11.54 | | | | | | |
| NS2A | 1323 | 0.52 | 2 | 2 | 0 | Y | PLVALTLISYL | 88.46 | PIVALTLISYM | 11.54 | | | | | | |
| NS2A | 1324 | 0.52 | 2 | 2 | 0 | Y | LVALTLISYLG | 88.46 | IVALTLISYMG | 11.54 | | | | | | |
| NS2A | 1325 | 0.52 | 2 | 2 | 0 | Y | VALTLISYLGL | 88.46 | VALTLISYMGL | 11.54 | | | | | | |
| NS2A | 1326 | 0.52 | 2 | 2 | 0 | Y | ALTLISYLGLT | 88.46 | ALTLISYMGLT | 11.54 | | | | | | |
| NS2A | 1327 | 0.52 | 2 | 2 | 0 | Y | LTLISYLGLTQ | 88.46 | LTLISYMGLTQ | 11.54 | | | | | | |
| NS2A | 1328 | 0.52 | 2 | 2 | 0 | Y | TLISYLGLTQP | 88.46 | TLISYMGLTQP | 11.54 | | | | | | |
| NS2A | 1329 | 0.52 | 2 | 2 | 0 | Y | LISYLGLTQPF | 88.46 | LISYMGLTQPF | 11.54 | | | | | | |
| NS2A | 1330 | 0.52 | 2 | 2 | 0 | Y | ISYLGLTQPFL | 88.46 | ISYMGLTQPFL | 11.54 | | | | | | |
| NS2A | 1331 | 0.52 | 2 | 2 | 0 | Y | SYLGLTQPFLG | 88.46 | SYMGLTQPFLG | 11.54 | | | | | | |
| NS2A | 1332 | 0.52 | 2 | 2 | 0 | Y | YLGLTQPFLGL | 88.46 | YMGLTQPFLGL | 11.54 | | | | | | |
| NS2A | 1333 | 0.52 | 2 | 2 | 0 | Y | LGLTQPFLGLC | 88.46 | MGLTQPFLGLC | 11.54 | | | | | | |
| NS2A | 1334 | 0.00 | 1 | 1 | 0 | Y | GLTQPFLGLCA | 100 | | | | | | | | |
| NS2A | 1335 | 0.52 | 2 | 2 | 0 | Y | LTQPFLGLCAF | 88.46 | LTQPFLGLCAY | 11.54 | | | | | | |
| NS2A | 1336 | 0.52 | 2 | 2 | 0 | Y | TQPFLGLCAFL | 88.46 | TQPFLGLCAYM | 11.54 | | | | | | |
| NS2A | 1337 | 0.52 | 2 | 2 | 0 | Y | QPFLGLCAFLA | 88.46 | QPFLGLCAYMS | 11.54 | | | | | | |
| NS2A | 1338 | 0.52 | 2 | 2 | 0 | Y | PFLGLCAFLAT | 88.46 | PFLGLCAYMST | 11.54 | | | | | | |

Fig. 30-53

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1339 | 0.52 | 2 | 2 | 0 | Y | FLGLCAFLATR | 88.46 | FLGLCAYMSTQ | 11.54 | | | | |
| NS2A | 1340 | 0.89 | 3 | 3 | 0 | Y | LGLCAFLATRI | 80.77 | LGLCAYMSTQV | 11.54 | LGLCAFLATRL | 7.69 | | |
| NS2A | 1341 | 0.89 | 3 | 3 | 0 | Y | GLCAFLATRIF | 80.77 | GLCAYMSTQVF | 11.54 | GLCAFLATRLF | 7.69 | | |
| NS2A | 1342 | 0.89 | 3 | 3 | 0 | Y | LCAFLATRIFG | 80.77 | LCAYMSTQVFG | 11.54 | LCAFLATRLFG | 7.69 | | |
| NS2A | 1343 | 0.89 | 3 | 3 | 0 | Y | CAFLATRIFGR | 80.77 | CAYMSTQVFGR | 11.54 | CAFLATRLFGR | 7.69 | | |
| NS2A | 1344 | 0.89 | 3 | 3 | 0 | Y | AFLATRIFGRR | 80.77 | AYMSTQVFGRR | 11.54 | AFLATRLFGRR | 7.69 | | |
| NS2A | 1345 | 0.89 | 3 | 3 | 0 | Y | FLATRIFGRRS | 80.77 | YMSTQVFGRRS | 11.54 | FLATRLFGRRS | 7.69 | | |
| NS2A | 1346 | 0.89 | 3 | 3 | 0 | Y | LATRIFGRRSI | 80.77 | MSTQVFGRRSI | 11.54 | LATRLFGRRSI | 7.69 | | |
| NS2A | 1347 | 0.89 | 3 | 3 | 0 | Y | ATRIFGRRSIP | 80.77 | STQVFGRRSIP | 11.54 | ATRLFGRRSIP | 7.69 | | |
| NS2A | 1348 | 0.89 | 3 | 3 | 0 | Y | TRIFGRRSIPV | 80.77 | TQVFGRRSIPV | 11.54 | TRLFGRRSIPV | 7.69 | | |
| NS2A | 1349 | 0.89 | 3 | 3 | 0 | Y | RIFGRRSIPVN | 80.77 | QVFGRRSIPVN | 11.54 | RLFGRRSIPVN | 7.69 | | |
| NS2A | 1350 | 0.89 | 3 | 3 | 0 | Y | IFGRRSIPVNE | 80.77 | VFGRRSIPVNE | 11.54 | LFGRRSIPVNE | 7.69 | | |
| NS2A | 1351 | 0.00 | 1 | 1 | 0 | Y | FGRRSIPVNEA | 100 | | | | | | |
| NS2A | 1352 | 0.00 | 1 | 1 | 0 | Y | GRRSIPVNEAL | 100 | | | | | | |
| NS2A | 1353 | 0.00 | 1 | 1 | 0 | Y | RRSIPVNEALA | 100 | | | | | | |
| NS2A | 1354 | 0.00 | 1 | 1 | 0 | Y | RSIPVNEALAA | 100 | | | | | | |
| NS2B | 1355 | 0.24 | 2 | 2 | 0 | Y | SIPVNEALAAA | 96.15 | SIPVNEALAAT | 3.85 | | | | |
| NS2B | 1356 | 0.24 | 2 | 2 | 0 | Y | IPVNEALAAAG | 96.15 | IPVNEALAATG | 3.85 | | | | |
| NS2B | 1357 | 0.24 | 2 | 2 | 0 | Y | PVNEALAAAGL | 96.15 | PVNEALAATGL | 3.85 | | | | |
| NS2B | 1358 | 0.24 | 2 | 2 | 0 | Y | VNEALAAAGLV | 96.15 | VNEALAATGLV | 3.85 | | | | |
| NS2B | 1359 | 0.24 | 2 | 2 | 0 | Y | NEALAAAGLVG | 96.15 | NEALAATGLVG | 3.85 | | | | |
| NS2B | 1360 | 0.24 | 2 | 2 | 0 | Y | EALAAAGLVGV | 96.15 | EALAATGLVGV | 3.85 | | | | |
| NS2B | 1361 | 0.24 | 2 | 2 | 0 | Y | ALAAAGLVGVL | 96.15 | ALAATGLVGVL | 3.85 | | | | |
| NS2B | 1362 | 0.24 | 2 | 2 | 0 | Y | LAAAGLVGVLA | 96.15 | LAATGLVGVLA | 3.85 | | | | |
| NS2B | 1363 | 0.24 | 2 | 2 | 0 | Y | AAAGLVGVLAG | 96.15 | AATGLVGVLAG | 3.85 | | | | |

Fig. 30-54

Species: YFV (11-mers)

| protein

Fig. 30-55

Species: YFV (11-mers)

| protein | block starting position | block entropy | total

Fig. 30-56

Species: YFV (11-mers)

| protein | block starting position | block

Fig. 30-57

Species: YFV (11-mers)

| protein | block starting position | block entropy (11-mers) | total peptides in block | # peptides required to cover 99% of block | gap/X fraction | 99% of block covered w/ <= 5 peptides? | peptides required to cover 99% of block | frequency | peptides required to c

Fig. 30-58

Species: YFV (11-mers)

| protein | block starting position | block entropy | total peptides in block | # peptides required to cover

Fig. 30-59

Species: YFV (11-mers)

| protein | block starting position | block entropy | total

Fig. 30-60

Species: YFV (11-mers)

| protein | block starting position | block

Fig. 30-61

Species: YFV (11-mers)

| protein | block

Fig. 30-62

Species: YFV (11-mers)

| protein | block starting position | block entropy | total peptides in block | # peptides required to cover 99% of block | gap/X fraction | 99% of block

Fig. 30-63

Species: YFV (11-mers)

| protein | block starting position | block entropy | total

Fig. 30-64

Species: YFV (11-mers)

| protein | block starting position | block entropy | total

Fig. 30-65

Species: YFV (11-mers)

| protein | block

Fig. 30-66

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1664 | 0.74 | 3 | 3 | 0 | Y | ELQEIPTMLKK | 84.62 | ELREIPTMLKK | 11.54 | ELQEISTMLKK | 3.85 | | |
| NS3 | 1665 | 0.74 | 3 | 3 | 0 | Y | LQEIPTMLKKG | 84.62 | LREIPTMLKKG | 11.54 | LQEISTMLKKG | 3.85 | | |
| NS3 | 1666 | 1.12 | 4 | 4 | 0 | Y | QEIPTMLKKGM | 76.92 | REIPTMLKKGM | 11.54 | QEIPTMLKKGK | 7.69 | QEISTMLKKGM | 3.85 |
| NS3 | 1667 | 0.62 | 3 | 3 | 0 | Y | EIPTMLKKGMT | 88.46 | EIPTMLKKGKT | 7.69 | EISTMLKKGMT | 3.85 | | |
| NS3 | 1668 | 0.62 | 3 | 3 | 0 | Y | IPTMLKKGMTT | 88.46 | IPTMLKKGKTT | 7.69 | ISTMLKKGMTT | 3.85 | | |
| NS3 | 1669 | 1.51 | 4 | 4 | 0 | Y | PTMLKKGMTTV | 46.15 | PTMLKKGMTTI | 42.31 | PTMLKKGKTTI | 7.69 | | |
| NS3 | 1670 | 1.31 | 3 | 3 | 0 | Y | TMLKKGMTTVL | 46.15 | TMLKKGMTTIL | 46.15 | TMLKKGKTTIL | 7.69 | | |
| NS3 | 1671 | 1.31 | 3 | 3 | 0 | Y | MLKKGMTTVLD | 46.15 | MLKKGMTTILD | 46.15 | MLKKGKTTILD | 7.69 | | |
| NS3 | 1672 | 1.51 | 4 | 4 | 0 | Y | LKKGMTTVLDF | 46.15 | LKKGMTTILDF | 42.31 | LKKGKTTILDF | 7.69 | LKKGMTTILDY | 3.85 |
| NS3 | 1673 | 1.51 | 4 | 4 | 0 | Y | KKGMTTVLDFH | 46.15 | KKGMTTILDFH | 42.31 | KKGKTTILDFH | 7.69 | KKGMTTILDYH | 3.85 |
| NS3 | 1674 | 1.51 | 4 | 4 | 0 | Y | KGMTTVLDFHP | 46.15 | KGMTTILDFHP | 42.31 | KGKTTILDFHP | 7.69 | KGMTTILDYHP | 3.85 |
| NS3 | 1675 | 1.51 | 4 | 4 | 0 | Y | GMTTVLDFHPG | 46.15 | GMTTILDFHPG | 42.31 | GKTTILDFHPG | 7.69 | GMTTILDYHPG | 3.85 |
| NS3 | 1676 | 1.51 | 4 | 4 | 0 | Y | MTTVLDFHPGA | 46.15 | MTTILDFHPGA | 42.31 | KTTILDFHPGA | 7.69 | MTTILDYHPGA | 3.85 |
| NS3 | 1677 | 1.20 | 3 | 3 | 0 | Y | TTILDFHPGAG | 50 | TTVLDFHPGAG | 46.15 | TTILDFHPGAG | 3.85 | | |
| NS3 | 1678 | 1.20 | 3 | 3 | 0 | Y | TILDFHPGAGK | 50 | TVLDFHPGAGK | 46.15 | TILDFHPGAGK | 3.85 | | |
| NS3 | 1679 | 1.20 | 3 | 3 | 0 | Y | ILDFHPGAGKT | 50 | VLDFHPGAGKT | 46.15 | ILDYHPGAGKT | 3.85 | | |
| NS3 | 1680 | 0.24 | 2 | 2 | 0 | Y | LDFHPGAGKTR | 96.15 | LDYHPGAGKTR | 3.85 | | | | |
| NS3 | 1681 | 0.24 | 2 | 2 | 0 | Y | DFHPGAGKTRR | 96.15 | DYHPGAGKTRR | 3.85 | | | | |
| NS3 | 1682 | 0.24 | 2 | 2 | 0 | Y | FHPGAGKTRRF | 96.15 | YHPGAGKTRRF | 3.85 | | | | |
| NS3 | 1683 | 0.00 | 1 | 1 | 0 | Y | HPGAGKTRRFL | 100 | | | | | | |
| NS3 | 1684 | 0.00 | 1 | 1 | 0 | Y | PGAGKTRRFLP | 100 | | | | | | |
| NS3 | 1685 | 0.00 | 1 | 1 | 0 | Y | GAGKTRRFLPQ | 100 | | | | | | |
| NS3 | 1686 | 0.00 | 1 | 1 | 0 | Y | AGKTRRFLPQI | 100 | | | | | | |
| NS3 | 1687 | 0.00 | 1 | 1 | 0 | Y | GKTRRFLPQIL | 100 | | | | | | |
| NS3 | 1688 | 0.00 | 1 | 1 | 0 | Y | KTRRFLPQILA | 100 | | | | | | |

Fig. 30-67

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS3 | 1689 | 0.00 | 1 | 1 | 0 | Y | TRRFLPQILAE | 100 |
| NS3 | 1690 | 0.00 | 1 | 1 | 0 | Y | RRFLPQILAEC | 100 |
| NS3 | 1691 | 0.00 | 1 | 1 | 0 | Y | RFLPQILAECA | 100 |
| NS3 | 1692 | 0.00 | 1 | 1 | 0 | Y | FLPQILAECAR | 100 |
| NS3 | 1693 | 0.00 | 1 | 1 | 0 | Y | LPQILAECARR | 100 |
| NS3 | 1694 | 0.00 | 1 | 1 | 0 | Y | PQILAECARRR | 100 |
| NS3 | 1695 | 0.00 | 1 | 1 | 0 | Y | QILAECARRRL | 100 |
| NS3 | 1696 | 0.00 | 1 | 1 | 0 | Y | ILAECARRRLR | 100 |
| NS3 | 1697 | 0.00 | 1 | 1 | 0 | Y | LAECARRRLRT | 100 |
| NS3 | 1698 | 0.00 | 1 | 1 | 0 | Y | AECARRRLRTL | 100 |
| NS3 | 1699 | 0.00 | 1 | 1 | 0 | Y | ECARRRLRTLV | 100 |
| NS3 | 1700 | 0.00 | 1 | 1 | 0 | Y | CARRRLRTLVL | 100 |
| NS3 | 1701 | 0.00 | 1 | 1 | 0 | Y | ARRRLRTLVLA | 100 |
| NS3 | 1702 | 0.00 | 1 | 1 | 0 | Y | RRRLRTLVLAP | 100 |
| NS3 | 1703 | 0.00 | 1 | 1 | 0 | Y | RRLRTLVLAPT | 100 |
| NS3 | 1704 | 0.00 | 1 | 1 | 0 | Y | RLRTLVLAPTR | 100 |
| NS3 | 1705 | 0.00 | 1 | 1 | 0 | Y | LRTLVLAPTRV | 100 |
| NS3 | 1706 | 0.00 | 1 | 1 | 0 | Y | RTLVLAPTRVW | 100 |
| NS3 | 1707 | 0.00 | 1 | 1 | 0 | Y | TLVLAPTRVVL | 100 |
| NS3 | 1708 | 0.00 | 1 | 1 | 0 | Y | LVLAPTRVVLS | 100 |
| NS3 | 1709 | 0.00 | 1 | 1 | 0 | Y | VLAPTRVVLSE | 100 |
| NS3 | 1710 | 0.00 | 1 | 1 | 0 | Y | LAPTRVVLSEM | 100 |
| NS3 | 1711 | 0.00 | 1 | 1 | 0 | Y | APTRVVLSEMK | 100 |
| NS3 | 1712 | 0.00 | 1 | 1 | 0 | Y | PTRVVLSEMKE | 100 |
| NS3 | 1713 | 0.00 | 1 | 1 | 0 | Y | TRVVLSEMKEA | 100 |

Fig. 30-68

Species: YFV (11-mers)

| protein | block starting position | block

Fig. 30-69

Species: YFV (11-mers)

| prot

Fig. 30-71

Species: YFV (11-mers)

| protein | block starting position | block entropy | total peptides in block | # peptides required to cover 99% of block | gap/X

Fig. 30-72

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1814 | 0.00 | 1 | 1 | 0 | Y | FPHSNGEIEDV | 100 | | | | | | |
| NS3 | 1815 | 0.00 | 1 | 1 | 0 | Y | PHSNGEIEDVQ | 100 | | | | | | |
| NS3 | 1816 | 0.00 | 1 | 1 | 0 | Y | HSNGEIEDVQT | 100 | | | | | | |
| NS3 | 1817 | 0.00 | 1 | 1 | 0 | Y | SNGEIEDVQTD | 100 | | | | | | |
| NS3 | 1818 | 0.00 | 1 | 1 | 0 | Y | NGEIEDVQTDI | 100 | | | | | | |
| NS3 | 1819 | 0.00 | 1 | 1 | 0 | Y | GEIEDVQTDIP | 100 | | | | | | |
| NS3 | 1820 | 0.00 | 1 | 1 | 0 | Y | EIEDVQTDIPS | 100 | | | | | | |
| NS3 | 1821 | 0.00 | 1 | 1 | 0 | Y | IEDVQTDIPSE | 100 | | | | | | |
| NS3 | 1822 | 0.00 | 1 | 1 | 0 | Y | EDVQTDIPSEP | 100 | | | | | | |
| NS3 | 1823 | 0.00 | 1 | 1 | 0 | Y | DVQTDIPSEPW | 100 | | | | | | |
| NS3 | 1824 | 0.52 | 2 | 2 | 0 | Y | VQTDIPSEPWN | 88.46 | VQTDIPSEPWT | 11.54 | | | | |
| NS3 | 1825 | 0.62 | 3 | 3 | 0 | Y | QTDIPSEPWNT | 88.46 | QTDIPSEPWTS | 7.69 | QTDIPSEPWTA | 3.85 | | |
| NS3 | 1826 | 0.62 | 3 | 3 | 0 | Y | TDIPSEPWNTG | 88.46 | TDIPSEPWTSG | 7.69 | TDIPSEPWTAG | 3.85 | | |
| NS3 | 1827 | 0.62 | 3 | 3 | 0 | Y | DIPSEPWNTGH | 88.46 | DIPSEPWTSGH | 7.69 | DIPSEPWTAGH | 3.85 | | |
| NS3 | 1828 | 0.62 | 3 | 3 | 0 | Y | IPSEPWNTGHD | 88.46 | IPSEPWTSGHE | 7.69 | IPSEPWTAGHE | 3.85 | | |
| NS3 | 1829 | 0.62 | 3 | 3 | 0 | Y | PSEPWNTGHDW | 88.46 | PSEPWTSGHEW | 7.69 | PSEPWTAGHEW | 3.85 | | |
| NS3 | 1830 | 0.62 | 3 | 3 | 0 | Y | SEPWNTGHDWI | 88.46 | SEPWTSGHEWI | 7.69 | SEPWTAGHEWI | 3.85 | | |
| NS3 | 1831 | 0.62 | 3 | 3 | 0 | Y | EPWNTGHDWIL | 88.46 | EPWTSGHEWIL | 7.69 | EPWTAGHEWIL | 3.85 | | |
| NS3 | 1832 | 0.62 | 3 | 3 | 0 | Y | PWNTGHDWILA | 88.46 | PWTSGHEWILA | 7.69 | PWTAGHEWILA | 3.85 | | |
| NS3 | 1833 | 0.62 | 3 | 3 | 0 | Y | WNTGHDWILAD | 88.46 | WTSGHEWILAD | 7.69 | WTAGHEWILAD | 3.85 | | |
| NS3 | 1834 | 0.62 | 3 | 3 | 0 | Y | NTGHDWILADK | 88.46 | TSGHEWILADK | 7.69 | TAGHEWILADK | 3.85 | | |
| NS3 | 1835 | 0.62 | 3 | 3 | 0 | Y | TGHDWILADKR | 88.46 | SGHEWILADKR | 7.69 | AGHEWILADKR | 3.85 | | |
| NS3 | 1836 | 0.52 | 2 | 2 | 0 | Y | GHDWILADKRP | 88.46 | GHEWILADKRP | 11.54 | | | | |
| NS3 | 1837 | 0.52 | 2 | 2 | 0 | Y | HDWILADKRPT | 88.46 | HEWILADKRPT | 11.54 | | | | |
| NS3 | 1838 | 0.52 | 2 | 2 | 0 | Y | DWILADKRPTA | 88.46 | EWILADKRPTA | 11.54 | | | | |

Fig. 30-73

Species: YFV (11-mers)

| protein | block starting position | block entropy | total

Fig. 30-74

Species: YFV (11-mers)

| protein | block starting position | block entropy | total peptides in block | # peptides required to cover 99

Fig. 30-75

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1889 | 0.39 | 2 | 2 | 0 | Y | KKPDFILATDI | 92.31 | KRPDFILATDI | 7.69 | | | | |
| NS3 | 1890 | 0.39 | 2 | 2 | 0 | Y | KPDFILATDIA | 92.31 | RPDFILATDIA | 7.69 | | | | |
| NS3 | 1891 | 0.00 | 1 | 1 | 0 | Y | PDFILATDIAE | 100 | | | | | | |
| NS3 | 1892 | 0.00 | 1 | 1 | 0 | Y | DFILATDIAEM | 100 | | | | | | |
| NS3 | 1893 | 0.00 | 1 | 1 | 0 | Y | FILATDIAEMG | 100 | | | | | | |
| NS3 | 1894 | 0.00 | 1 | 1 | 0 | Y | ILATDIAEMGA | 100 | | | | | | |
| NS3 | 1895 | 0.00 | 1 | 1 | 0 | Y | LATDIAEMGAN | 100 | | | | | | |
| NS3 | 1896 | 0.00 | 1 | 1 | 0 | Y | ATDIAEMGANL | 100 | | | | | | |
| NS3 | 1897 | 0.00 | 1 | 1 | 0 | Y | TDIAEMGANLC | 100 | | | | | | |
| NS3 | 1898 | 0.00 | 1 | 1 | 0 | Y | DIAEMGANLCV | 100 | | | | | | |
| NS3 | 1899 | 0.24 | 2 | 2 | 0 | Y | IAEMGANLCVE | 96.15 | IAEMGANLCVD | 3.85 | | | | |
| NS3 | 1900 | 0.24 | 2 | 2 | 0 | Y | AEMGANLCVER | 96.15 | AEMGANLCVDR | 3.85 | | | | |
| NS3 | 1901 | 0.24 | 2 | 2 | 0 | Y | EMGANLCVERV | 96.15 | EMGANLCVDRV | 3.85 | | | | |
| NS3 | 1902 | 0.24 | 2 | 2 | 0 | Y | MGANLCVERVL | 96.15 | MGANLCVDRVL | 3.85 | | | | |
| NS3 | 1903 | 0.24 | 2 | 2 | 0 | Y | GANLCVERVLD | 96.15 | GANLCVDRVLD | 3.85 | | | | |
| NS3 | 1904 | 0.24 | 2 | 2 | 0 | Y | ANLCVERVLDC | 96.15 | ANLCVDRVLDC | 3.85 | | | | |
| NS3 | 1905 | 0.24 | 2 | 2 | 0 | Y | NLCVERVLDCR | 96.15 | NLCVDRVLDCR | 3.85 | | | | |
| NS3 | 1906 | 0.24 | 2 | 2 | 0 | Y | LCVERVLDCRT | 96.15 | LCVDRVLDCRT | 3.85 | | | | |
| NS3 | 1907 | 0.24 | 2 | 2 | 0 | Y | CVERVLDCRTA | 96.15 | CVDRVLDCRTA | 3.85 | | | | |
| NS3 | 1908 | 0.74 | 3 | 3 | 0 | Y | VERVLDCRTAF | 84.62 | VERVLDCRTAY | 11.54 | VDRVLDCRTAF | 3.85 | | |
| NS3 | 1909 | 0.74 | 3 | 3 | 0 | Y | ERVLDCRTAFK | 84.62 | ERVLDCRTAYK | 11.54 | DRVLDCRTAFK | 3.85 | | |
| NS3 | 1910 | 0.52 | 2 | 2 | 0 | Y | RVLDCRTAFKP | 88.46 | RVLDCRTAYKP | 11.54 | | | | |
| NS3 | 1911 | 0.52 | 2 | 2 | 0 | Y | VLDCRTAFKPV | 88.46 | VLDCRTAYKPV | 11.54 | | | | |
| NS3 | 1912 | 0.52 | 2 | 2 | 0 | Y | LDCRTAFKPVL | 88.46 | LDCRTAYKPVL | 11.54 | | | | |
| NS3 | 1913 | 0.52 | 2 | 2 | 0 | Y | DCRTAFKPVLY | 88.46 | DCRTAYKPVLY | 11.54 | | | | |

Species: YFV (11-mers)

Fig. 30-76

| protein | block starting position | block entropy | total peptides in block | # pe

Fig. 30-77

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1939 | 0.00 | 1 | 1 | 0 | Y | ASSAAQRRGRI | 100 | | |
| NS3 | 1940 | 0.00 | 1 | 1 | 0 | Y | SSAAQRRGRIG | 100 | | |
| NS3 | 1941 | 0.00 | 1 | 1 | 0 | Y | SAAQRRGRIGR | 100 | | |
| NS3 | 1942 | 0.00 | 1 | 1 | 0 | Y | AAQRRGRIGRN | 100 | | |
| NS3 | 1943 | 0.00 | 1 | 1 | 0 | Y | AQRRGRIGRNP | 100 | | |
| NS3 | 1944 | 0.00 | 1 | 1 | 0 | Y | QRRGRIGRNPN | 100 | | |
| NS3 | 1945 | 0.00 | 1 | 1 | 0 | Y | RRGRIGRNPNR | 100 | | |
| NS3 | 1946 | 0.00 | 1 | 1 | 0 | Y | RGRIGRNPNRD | 100 | | |
| NS3 | 1947 | 0.00 | 1 | 1 | 0 | Y | GRIGRNPNRDG | 100 | | |
| NS3 | 1948 | 0.00 | 1 | 1 | 0 | Y | RIGRNPNRDGD | 100 | | |
| NS3 | 1949 | 0.00 | 1 | 1 | 0 | Y | IGRNPNRDGDS | 100 | | |
| NS3 | 1950 | 0.00 | 1 | 1 | 0 | Y | GRNPNRDGDSY | 100 | | |
| NS3 | 1951 | 0.00 | 1 | 1 | 0 | Y | RNPNRDGDSYY | 100 | | |
| NS3 | 1952 | 0.00 | 1 | 1 | 0 | Y | NPNRDGDSYYY | 100 | | |
| NS3 | 1953 | 0.00 | 1 | 1 | 0 | Y | PNRDGDSYYYS | 100 | | |
| NS3 | 1954 | 0.00 | 1 | 1 | 0 | Y | NRDGDSYYSE | 100 | | |
| NS3 | 1955 | 0.00 | 1 | 1 | 0 | Y | RDGDSYYYSEP | 100 | | |
| NS3 | 1956 | 0.00 | 1 | 1 | 0 | Y | DGDSYYYSEPT | 100 | | |
| NS3 | 1957 | 0.00 | 1 | 1 | 0 | Y | GDSYYYSEPTS | 100 | | |
| NS3 | 1958 | 0.00 | 1 | 1 | 0 | Y | DSYYYSEPTSE | 100 | | |
| NS3 | 1959 | 0.96 | 2 | 2 | 0 | Y | SYYYSEPTSEN | 61.54 | SYYYSEPTSED | 38.46 |
| NS3 | 1960 | 0.96 | 2 | 2 | 0 | Y | YYYSEPTSENN | 61.54 | YYYSEPTSEDN | 38.46 |
| NS3 | 1961 | 0.96 | 2 | 2 | 0 | Y | YYSEPTSENNA | 61.54 | YYSEPTSEDNA | 38.46 |
| NS3 | 1962 | 0.96 | 2 | 2 | 0 | Y | YSEPTSENNAH | 61.54 | YSEPTSEDNAH | 38.46 |
| NS3 | 1963 | 0.96 | 2 | 2 | 0 | Y | SEPTSENNAHH | 61.54 | SEPTSEDNAHH | 38.46 |

Fig. 30-78

Species: YFV (11-mers)

| protein

Species: YFV (11-mers) — Fig. 30-79

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1989 | 0.62 | 2 | 2 | 0 | Y | RGGMVAPLYGV | 84.62 | RGGMVAPLYGI | 15.38 | | | | |
| NS3 | 1990 | 0.62 | 2 | 2 | 0 | Y | GGMVAPLYGVE | 84.62 | GGMVAPLYGIE | 15.38 | | | | |
| NS3 | 1991 | 0.62 | 2 | 2 | 0 | Y | GMVAPLYGVEG | 84.62 | GMVAPLYGIEG | 15.38 | | | | |
| NS3 | 1992 | 0.85 | 3 | 3 | 0 | Y | MVAPLYGVEGT | 80.77 | MVAPLYGIEGT | 15.38 | MVAPLYGVEGI | 3.85 | | |
| NS3 | 1993 | 0.85 | 3 | 3 | 0 | Y | VAPLYGVEGTK | 80.77 | VAPLYGIEGTK | 15.38 | VAPLYGVEGIK | 3.85 | | |
| NS3 | 1994 | 0.85 | 3 | 3 | 0 | Y | APLYGVEGTKT | 80.77 | APLYGIEGTKT | 15.38 | APLYGVEGIKT | 3.85 | | |
| NS3 | 1995 | 0.85 | 3 | 3 | 0 | Y | PLYGVEGTKTP | 80.77 | PLYGIEGTKTP | 15.38 | PLYGVEGIKTP | 3.85 | | |
| NS3 | 1996 | 0.85 | 3 | 3 | 0 | Y | LYGVEGTKTPV | 80.77 | LYGIEGTKTPV | 15.38 | LYGVEGIKTPV | 3.85 | | |
| NS3 | 1997 | 0.85 | 3 | 3 | 0 | Y | YGVEGTKTPVS | 80.77 | YGIEGTKTPVS | 15.38 | YGVEGIKTPVS | 3.85 | | |
| NS3 | 1998 | 0.85 | 3 | 3 | 0 | Y | GVEGTKTPVSP | 80.77 | GIEGTKTPVSP | 15.38 | GVEGIKTPVSP | 3.85 | | |
| NS3 | 1999 | 0.85 | 3 | 3 | 0 | Y | VEGTKTPVSPG | 80.77 | IEGTKTPVSPG | 15.38 | VEGIKTPVSPG | 3.85 | | |
| NS3 | 2000 | 0.24 | 2 | 2 | 0 | Y | EGTKTPVSPGE | 96.15 | EGIKTPVSPGE | 3.85 | | | | |
| NS3 | 2001 | 0.24 | 2 | 2 | 0 | Y | GTKTPVSPGEM | 96.15 | GIKTPVSPGEM | 3.85 | | | | |
| NS3 | 2002 | 0.24 | 2 | 2 | 0 | Y | TKTPVSPGEMR | 96.15 | IKTPVSPGEMR | 3.85 | | | | |
| NS3 | 2003 | 0.00 | 1 | 1 | 0 | Y | KTPVSPGEMRL | 100 | | | | | | |
| NS3 | 2004 | 0.00 | 1 | 1 | 0 | Y | TPVSPGEMRLR | 100 | | | | | | |
| NS3 | 2005 | 0.00 | 1 | 1 | 0 | Y | PVSPGEMRLRD | 100 | | | | | | |
| NS3 | 2006 | 0.00 | 1 | 1 | 0 | Y | VSPGEMRLRDD | 100 | | | | | | |
| NS3 | 2007 | 0.00 | 1 | 1 | 0 | Y | SPGEMRLRDDQ | 100 | | | | | | |
| NS3 | 2008 | 0.00 | 1 | 1 | 0 | Y | PGEMRLRDDQR | 100 | | | | | | |
| NS3 | 2009 | 0.62 | 2 | 2 | 0 | Y | GEMRLRDDQRK | 84.62 | GEMRLRDDQRR | 15.38 | | | | |
| NS3 | 2010 | 0.62 | 2 | 2 | 0 | Y | EMRLRDDQRKV | 84.62 | EMRLRDDQRRV | 15.38 | | | | |
| NS3 | 2011 | 0.74 | 3 | 3 | 0 | Y | MRLRDDQRKVF | 84.62 | MRLRDDQRRVF | 11.54 | MRLRDDQRRVS | 3.85 | | |
| NS3 | 2012 | 0.74 | 3 | 3 | 0 | Y | RLRDDQRKVFR | 84.62 | RLRDDQRRVFR | 11.54 | RLRDDQRRVSR | 3.85 | | |
| NS3 | 2013 | 0.74 | 3 | 3 | 0 | Y | LRDDQRKVFRE | 84.62 | LRDDQRRVFRE | 11.54 | LRDDQRRVSRE | 3.85 | | |

Fig. 30-80

Species: YFV (11-mers)

| protein | block star

Fig. 30-81

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2039 | 0.24 | 2 | 2 | 0 | Y | AMAGLKTNDRK | 96.15 | AMPGLKTNDRK | 3.85 | | | | |
| NS3 | 2040 | 0.24 | 2 | 2 | 0 | Y | KAGLKTNDRKW | 96.15 | KPGLKTNDRKW | 3.85 | | | | |
| NS3 | 2041 | 0.24 | 2 | 2 | 0 | Y | AGLKTNDRKWC | 96.15 | PGLKTNDRKWC | 3.85 | | | | |
| NS3 | 2042 | 0.00 | 1 | 1 | 0 | Y | GLKTNDRKWCF | 100 | | | | | | |
| NS3 | 2043 | 0.24 | 2 | 2 | 0 | Y | LKTNDRKWCFE | 96.15 | LKTNDRKWCFD | 3.85 | | | | |
| NS3 | 2044 | 0.24 | 2 | 2 | 0 | Y | KTNDRKWCFEG | 96.15 | KTNDRKWCFDG | 3.85 | | | | |
| NS3 | 2045 | 0.24 | 2 | 2 | 0 | Y | TNDRKWCFEGP | 96.15 | TNDRKWCFDGP | 3.85 | | | | |
| NS3 | 2046 | 0.47 | 3 | 3 | 0 | Y | NDRKWCFEGPE | 92.31 | NDRKWCFDGPK | 3.85 | NDRKWCFEGPD | 3.85 | | |
| NS3 | 2047 | 0.47 | 3 | 3 | 0 | Y | DRKWCFEGPEE | 92.31 | DRKWCFDGPKE | 3.85 | DRKWCFEGPDE | 3.85 | | |
| NS3 | 2048 | 0.47 | 3 | 3 | 0 | Y | RKWCFEGPEEH | 92.31 | RKWCFDGPKEH | 3.85 | RKWCFEGPDEH | 3.85 | | |
| NS3 | 2049 | 0.47 | 3 | 3 | 0 | Y | KWCFEGPEEHE | 92.31 | KWCFEGPDEHE | 3.85 | KWCFDGPKEHE | 3.85 | | |
| NS3 | 2050 | 0.47 | 3 | 3 | 0 | Y | WCFEGPEEHEI | 92.31 | WCFDGPKEHEI | 3.85 | WCFEGPDEHEI | 3.85 | | |
| NS3 | 2051 | 0.47 | 3 | 3 | 0 | Y | CFEGPEEHEIL | 92.31 | CFEGPDEHEIL | 3.85 | CFDGPKEHEIL | 3.85 | | |
| NS3 | 2052 | 0.47 | 3 | 3 | 0 | Y | FEGPEEHEILN | 92.31 | FDGPKEHEILN | 3.85 | FEGPDEHEILN | 3.85 | | |
| NS3 | 2053 | 0.47 | 3 | 3 | 0 | Y | EGPEEHEILND | 92.31 | DGPKEHEILND | 3.85 | EGPDEHEILND | 3.85 | | |
| NS3 | 2054 | 0.97 | 4 | 4 | 0 | Y | GPEEHEILNDS | 80.77 | GPEEHEILNDN | 11.54 | GPKEHEILNDS | 3.85 | GPDEHEILNDS | 3.85 |
| NS3 | 2055 | 0.97 | 4 | 4 | 0 | Y | PEEHEILNDSG | 80.77 | PEEHEILNDNG | 11.54 | PDEHEILNDSG | 3.85 | PKEHEILNDSG | 3.85 |
| NS3 | 2056 | 0.97 | 4 | 4 | 0 | Y | EEHEILNDSGE | 80.77 | EEHEILNDNGE | 11.54 | KEHEILNDSGE | 3.85 | DEHEILNDSGE | 3.85 |
| NS3 | 2057 | 0.52 | 2 | 2 | 0 | Y | EHEILNDSGET | 88.46 | EHEILNDNGET | 11.54 | | | | |
| NS3 | 2058 | 0.52 | 2 | 2 | 0 | Y | HEILNDSGETV | 88.46 | HEILNDNGETV | 11.54 | | | | |
| NS3 | 2059 | 0.52 | 2 | 2 | 0 | Y | EILNDSGETVK | 88.46 | EILNDNGETVK | 11.54 | | | | |
| NS3 | 2060 | 0.52 | 2 | 2 | 0 | Y | ILNDSGETVKC | 88.46 | ILNDNGETVKC | 11.54 | | | | |
| NS3 | 2061 | 0.52 | 2 | 2 | 0 | Y | LNDSGETVKCR | 88.46 | LNDNGETVKCR | 11.54 | | | | |
| NS3 | 2062 | 0.74 | 3 | 3 | 0 | Y | NDSGETVKCRA | 84.62 | NDNGETVKCRS | 11.54 | NDSGETVKCRT | 3.85 | | |
| NS3 | 2063 | 0.74 | 3 | 3 | 0 | Y | DSGETVKCRAP | 84.62 | DNGETVKCRSP | 11.54 | DSGETVKCRTP | 3.85 | | |

Fig. 30-82

Species: YFV (11-mers)

| protein | block starting position | block entropy | # total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2064 | 0.74 | 3 | 3 | 0 | Y | SGETVKCRAPG | 84.62 | SGETVKCRTPG | 11.54 | | | | |
| NS3 | 2065 | 0.74 | 3 | 3 | 0 | Y | GETVKCRAPGG | 84.62 | GETVKCRTPGG | 11.54 | | | | |
| NS3 | 2066 | 0.74 | 3 | 3 | 0 | Y | ETVKCRAPGGA | 84.62 | ETVKCRTPGGA | 11.54 | | | | |
| NS3 | 2067 | 0.74 | 3 | 3 | 0 | Y | TVKCRAPGGAK | 84.62 | TVKCRTPGGAK | 11.54 | | | | |
| NS3 | 2068 | 1.08 | 5 | 5 | 0 | Y | VKCRAPGGAKK | 80.77 | VKCRAPGGAKR | 7.69 | VKCRTPGGAKK | 3.85 | VKCRSPGGAKR | 3.85 |
| NS3 | 2069 | 1.08 | 5 | 5 | 0 | Y | KCRAPGGAKKP | 80.77 | KCRSPGGAKRA | 7.69 | KCRTPGGAKKP | 3.85 | KCRAPGGAKRP | 3.85 |
| NS3 | 2070 | 1.08 | 5 | 5 | 0 | Y | CRAPGGAKKPL | 80.77 | CRSPGGAKKAL | 7.69 | CRAPGGAKRPL | 3.85 | CRSPGGAKRAL | 3.85 |
| NS3 | 2071 | 1.08 | 5 | 5 | 0 | Y | RAPGGAKKPLR | 80.77 | RSPGGAKKALR | 7.69 | RSPGGAKRALR | 3.85 | RAPGGAKRPLR | 3.85 |
| NS3 | 2072 | 1.08 | 5 | 5 | 0 | Y | APGGAKKPLRP | 80.77 | SPGGAKKALRP | 7.69 | TPGGAKKPLRP | 3.85 | APGGAKRPLRP | 3.85 |
| NS3 | 2073 | 0.85 | 4 | 4 | 0 | Y | PGGAKKPLRPR | 84.62 | PGGAKKALRPR | 7.69 | PGGAKRPLRPR | 3.85 | | |
| NS3 | 2074 | 0.85 | 4 | 4 | 0 | Y | GGAKKPLRPRW | 84.62 | GGAKKALRPRW | 7.69 | GGAKRPLRPRW | 3.85 | | |
| NS3 | 2075 | 0.85 | 4 | 4 | 0 | Y | GAKKPLRPRWC | 84.62 | GAKKALRPRWC | 7.69 | GAKRPLRPRWC | 3.85 | | |
| NS3 | 2076 | 0.85 | 4 | 4 | 0 | Y | AKKPLRPRWCD | 84.62 | AKKALRPRWCD | 7.69 | AKRALRPRWCD | 3.85 | | |
| NS3 | 2077 | 0.85 | 4 | 4 | 0 | Y | KKPLRPRWCDE | 84.62 | KKALRPRWCDE | 7.69 | KRALRPRWCDE | 3.85 | | |
| NS3 | 2078 | 0.85 | 4 | 4 | 0 | Y | KPLRPRWCDER | 84.62 | KALRPRWCDER | 7.69 | RALRPRWCDER | 3.85 | | |
| NS3 | 2079 | 0.52 | 2 | 2 | 0 | Y | PLRPRWCDERV | 88.46 | ALRPRWCDERV | 11.54 | | | | |
| NS3 | 2080 | 0.00 | 1 | 1 | 0 | Y | LRPRWCDERVS | 100 | | | | | | |
| NS3 | 2081 | 0.00 | 1 | 1 | 0 | Y | RPRWCDERVSS | 100 | | | | | | |
| NS3 | 2082 | 0.00 | 1 | 1 | 0 | Y | PRWCDERVSSD | 100 | | | | | | |
| NS3 | 2083 | 0.00 | 1 | 1 | 0 | Y | RWCDERVSSDQ | 100 | | | | | | |
| NS3 | 2084 | 0.00 | 1 | 1 | 0 | Y | WCDERVSSDQS | 100 | | | | | | |
| NS3 | 2085 | 0.00 | 1 | 1 | 0 | Y | CDERVSSDQSA | 100 | | | | | | |
| NS3 | 2086 | 0.00 | 1 | 1 | 0 | Y | DERVSSDQSAL | 100 | | | | | | |
| NS3 | 2087 | 0.78 | 2 | 2 | 0 | Y | ERVSSDQSALS | 76.92 | ERVSSDQSALA | 23.08 | | | | |
| NS3 | 2088 | 0.78 | 2 | 2 | 0 | Y | RVSSDQSALSE | 76.92 | RVSSDQSALAD | 23.08 | | | | |

Fig. 30-83

Species: YFV (11-mers)

| protein | block starting position | block entropy | total peptides in block | # peptides required to cover 99% of block | gap/X fraction | 99% of block covered w/ <= 5 peptides?

Fig. 30-84

Species: YFV (11-mers)

| protein | block

Fig. 30-85

Species: YFV (11-mers)

| protein | block starting position | block entropy | total peptides in block | #

Fig. 30-86

Species: YFV (11-mers)

| protein | block starting position | block entropy | total

Fig. 30-87

Species: YFV (11-mers)

| protein

Species: YFV (11-mers)

Fig. 30-89

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2239 | 0.39 | 2 | 2 | 0 | Y | QVAYLIIGILT | 92.31 | QVAFLIIGILT | 7.69 | | | | |
| 2K | 2240 | 0.39 | 2 | 2 | 0 | Y | VAYLIIGILTL | 92.31 | VAFLIIGILTL | 7.69 | | | | |
| 2K | 2241 | 0.89 | 3 | 3 | 0 | Y | AYLIIGILTLV | 80.77 | AYLIIGILTLL | 11.54 | | | | |
| 2K | 2242 | 0.89 | 3 | 3 | 0 | Y | YLIIGILTLVS | 80.77 | YLIIGILTLLS | 11.54 | | | | |
| 2K | 2243 | 1.41 | 4 | 4 | 0 | Y | LIIGILTLVSV | 61.54 | LIIGILTLVS | 26.92 | AFLIIGILTLV | 7.69 | LIIGILTLLSI | 3.85 |
| 2K | 2244 | 1.41 | 4 | 4 | 0 | Y | IIGILTLVSAV | 61.54 | IIGILTLVSVV | 26.92 | FLIIGILTLVS | 7.69 | IIGILTLLSIV | 3.85 |
| 2K | 2245 | 1.41 | 4 | 4 | 0 | Y | IGILTLVSAVA | 61.54 | IGILTLVSVVA | 26.92 | LIIGILTLVSV | 7.69 | IGILTLLSIVA | 3.85 |
| 2K | 2246 | 1.41 | 4 | 4 | 0 | Y | GILTLVSAVAA | 61.54 | GILTLVSVVAA | 26.92 | IIGILTLVSVV | 7.69 | GILTLLSIVAA | 3.85 |
| 2K | 2247 | 1.41 | 4 | 4 | 0 | Y | ILTLVSAVAAN | 61.54 | ILTLVSVVAAN | 26.92 | IGILTLVSVVA | 7.69 | ILTLLSIVAAN | 3.85 |
| 2K | 2248 | 1.41 | 4 | 4 | 0 | Y | LTLVSAVAANE | 61.54 | LTLVSVVAANE | 26.92 | GILTLVSVVAA | 7.69 | LTLLSIVAANE | 3.85 |
| 2K | 2249 | 1.41 | 4 | 4 | 0 | Y | TLVSAVAANEL | 61.54 | TLVSVVAANEL | 26.92 | ILTLVSVVAAN | 7.69 | TLLSIVAANEL | 3.85 |
| 2K | 2250 | 1.41 | 4 | 4 | 0 | Y | LVSAVAANELG | 61.54 | LVSVVAANELG | 26.92 | LTLVSVVAANE | 7.69 | LLSIVAANELG | 3.85 |
| 2K | 2251 | 1.41 | 4 | 4 | 0 | Y | VSAVAANELGM | 61.54 | VSVVAANELGM | 26.92 | TLVSVVAANEL | 7.69 | LSIVAANELGM | 3.85 |
| 2K | 2252 | 1.14 | 3 | 3 | 0 | Y | SAVAANELGML | 61.54 | SVVAANELGML | 34.62 | LVSVVAANELG | 7.69 | | |
| 2K | 2253 | 1.14 | 3 | 3 | 0 | Y | AVAANELGMLE | 61.54 | VVAANELGMLE | 34.62 | SVVAANELGML | 3.85 | | |
| 2K | 2254 | 0.24 | 2 | 2 | 0 | Y | VAANELGMLEK | 96.15 | VAANELGMLER | 3.85 | VVAANELGMLE | 3.85 | | |
| 2K | 2255 | 0.24 | 2 | 2 | 0 | Y | AANELGMLEKT | 96.15 | AANELGMLERT | 3.85 | | | | |
| 2K | 2256 | 0.24 | 2 | 2 | 0 | Y | ANELGMLEKTK | 96.15 | ANELGMLERTK | 3.85 | | | | |
| 2K | 2257 | 0.24 | 2 | 2 | 0 | Y | NELGMLEKTKE | 96.15 | NELGMLERTKE | 3.85 | | | | |
| 2K | 2258 | 0.24 | 2 | 2 | 0 | Y | ELGMLEKTKED | 96.15 | ELGMLERTKED | 3.85 | | | | |
| NS4B | 2259 | 0.74 | 3 | 3 | 0 | Y | LGMLEKTKEDL | 84.62 | LGMLEKTKEDF | 11.54 | LGMLERTKEDL | 3.85 | | |
| NS4B | 2260 | 0.74 | 3 | 3 | 0 | Y | GMLEKTKEDLF | 84.62 | GMLEKTKEDFF | 11.54 | GMLERTKEDLF | 3.85 | | |
| NS4B | 2261 | 0.74 | 3 | 3 | 0 | Y | MLEKTKEDLFG | 84.62 | MLEKTKEDFFG | 11.54 | MLERTKEDLFG | 3.85 | | |
| NS4B | 2262 | 0.85 | 4 | 4 | 0 | Y | LEKTKEDLFGK | 84.62 | LEKTKEDFFGR | 7.69 | LEKTKEDLFG | 3.85 | LERTKEDLFGK | 3.85 |
| NS4B | 2263 | 0.85 | 4 | 4 | 0 | Y | EKTKEDLFGKK | 84.62 | EKTKEDFFGRR | 7.69 | EKTKEDFFGR | 3.85 | ERTKEDLFGKK | 3.85 |

Fig. 30-90

Species: YFV (11-mers)

| protein | block starting position | block entropy | total peptides in block | # peptides required to cover 99% of block | gap/X fraction | 99% of block

Fig. 30-91

Species: YFV (11

Species: YFV (11-mers)

Fig. 30-92

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2327 | 0.00 | 1 | 1 | 0 | Y | IAQSASVLSFM | 100 | | | | | | |
| NS4B | 2328 | 0.00 | 1 | 1 | 0 | Y | AQSASVLSFMD | 100 | | | | | | |
| NS4B | 2329 | 0.00 | 1 | 1 | 0 | Y | QSASVLSFMDK | 100 | | | | | | |
| NS4B | 2330 | 0.00 | 1 | 1 | 0 | Y | SASVLSFMDKG | 100 | | | | | | |
| NS4B | 2331 | 0.24 | 2 | 2 | 0 | Y | ASVLSFMDKGI | 96.15 | ASVLSFMDKGV | 3.85 | | | | |
| NS4B | 2332 | 0.24 | 2 | 2 | 0 | Y | SVLSFMDKGIP | 96.15 | SVLSFMDKGVP | 3.85 | | | | |
| NS4B | 2333 | 0.24 | 2 | 2 | 0 | Y | VLSFMDKGIPF | 96.15 | VLSFMDKGVPF | 3.85 | | | | |
| NS4B | 2334 | 0.24 | 2 | 2 | 0 | Y | LSFMDKGIPFM | 96.15 | LSFMDKGVPFM | 3.85 | | | | |
| NS4B | 2335 | 0.24 | 2 | 2 | 0 | Y | SFMDKGIPFMK | 96.15 | SFMDKGVPFMK | 3.85 | | | | |
| NS4B | 2336 | 0.24 | 2 | 2 | 0 | Y | FMDKGIPFMKM | 96.15 | FMDKGVPFMKM | 3.85 | | | | |
| NS4B | 2337 | 0.24 | 2 | 2 | 0 | Y | MDKGIPFMKMN | 96.15 | MDKGVPFMKMN | 3.85 | | | | |
| NS4B | 2338 | 0.24 | 2 | 2 | 0 | Y | DKGIPFMKMNI | 96.15 | DKGVPFMKMNI | 3.85 | | | | |
| NS4B | 2339 | 0.24 | 2 | 2 | 0 | Y | KGIPFMKMNIS | 96.15 | KGVPFMKMNIS | 3.85 | | | | |
| NS4B | 2340 | 0.24 | 2 | 2 | 0 | Y | GIPFMKMNISV | 96.15 | GVPFMKMNISV | 3.85 | | | | |
| NS4B | 2341 | 0.62 | 3 | 3 | 0 | Y | IPFMKMNISVI | 88.46 | IPFMKMNISVW | 7.69 | VPFMKMNISVI | 3.85 | | |
| NS4B | 2342 | 1.18 | 3 | 3 | 0 | Y | PFMKMNISVII | 69.23 | PFMKMNISVIM | 19.23 | PFMKMNISVWI | 11.54 | | |
| NS4B | 2343 | 1.18 | 3 | 3 | 0 | Y | FMKMNISVIIL | 69.23 | FMKMNISVIML | 19.23 | FMKMNISVWIL | 11.54 | | |
| NS4B | 2344 | 1.18 | 3 | 3 | 0 | Y | MKMNISVIILL | 69.23 | MKMNISVIMLL | 19.23 | MKMNISVWILL | 11.54 | | |
| NS4B | 2345 | 1.40 | 4 | 4 | 0 | Y | KMNISVIILLV | 65.38 | KMNISVIMLLV | 19.23 | KMNISVWILLV | 11.54 | KMNISVIMLLI | 3.85 |
| NS4B | 2346 | 1.40 | 4 | 4 | 0 | Y | MNISVIILLVS | 65.38 | MNISVIMLLVS | 19.23 | MNISVWILLVS | 11.54 | MNISVIMLLIS | 3.85 |
| NS4B | 2347 | 1.40 | 4 | 4 | 0 | Y | NISVIILLVSG | 65.38 | NISVIMLLVSG | 19.23 | NISVWILLVSG | 11.54 | NISVIMLLISG | 3.85 |
| NS4B | 2348 | 1.40 | 4 | 4 | 0 | Y | ISVIILLVSGW | 65.38 | ISVIMLLVSGW | 19.23 | ISVWILLVSGW | 11.54 | ISVIMLLISGW | 3.85 |
| NS4B | 2349 | 1.40 | 4 | 4 | 0 | Y | SVIILLVSGWN | 65.38 | SVIMLLVSGWN | 19.23 | SVWILLVSGWN | 11.54 | SVIMLLISGWN | 3.85 |
| NS4B | 2350 | 1.40 | 4 | 4 | 0 | Y | VIILLVSGWNS | 65.38 | VIMLLVSGWNS | 19.23 | VWILLVSGWNS | 11.54 | VIMLLISGWNS | 3.85 |
| NS4B | 2351 | 1.40 | 4 | 4 | 0 | Y | IILLVSGWNSI | 65.38 | IMLLVSGWNSI | 19.23 | VILLVSGWNSI | 11.54 | IMLLISGWNSI | 3.85 |

Fig. 30-93

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2352 | 1.10 | 3 | 3 | 0 | Y | MLLVSGWNSIT | 65.38 | ILLVSGWNSIT | 30.77 | | | | |
| NS4B | 2353 | 0.24 | 2 | 2 | 0 | Y | LLVSGWNSITV | 96.15 | LLISGWNSITV | 3.85 | MLLISGWNSIT | | | |
| NS4B | 2354 | 0.74 | 3 | 3 | 0 | Y | LVSGWNSITVM | 84.62 | LVSGWNSITVI | 11.54 | LISGWNSITVM | | | |
| NS4B | 2355 | 0.74 | 3 | 3 | 0 | Y | VSGWNSITVMP | 84.62 | VSGWNSITVIP | 11.54 | ISGWNSITVMP | | | |
| NS4B | 2356 | 0.52 | 2 | 2 | 0 | Y | SGWNSITVMPL | 88.46 | SGWNSITVIPL | 11.54 | | | | |
| NS4B | 2357 | 0.52 | 2 | 2 | 0 | Y | GWNSITVMPLL | 88.46 | GWNSITVIPLL | 11.54 | | | | |
| NS4B | 2358 | 0.52 | 2 | 2 | 0 | Y | WNSITVMPLLC | 88.46 | WNSITVIPLLC | 11.54 | | | | |
| NS4B | 2359 | 0.52 | 2 | 3 | 0 | Y | NSITVMPLLCG | 88.46 | NSITVIPLLCG | 11.54 | | | | |
| NS4B | 2360 | 0.62 | 3 | 3 | 0 | Y | SITVMPLLCGI | 88.46 | SITVIPLLCGV | 7.69 | SITVIPLLCGI | 3.85 | | |
| NS4B | 2361 | 0.62 | 3 | 3 | 0 | Y | ITVMPLLCGIG | 88.46 | ITVIPLLCGVG | 7.69 | ITVIPLLCGIG | 3.85 | | |
| NS4B | 2362 | 0.62 | 3 | 3 | 0 | Y | TVMPLLCGIGC | 88.46 | TVIPLLCGVGG | 7.69 | TVIPLLCGIGG | 3.85 | | |
| NS4B | 2363 | 0.62 | 3 | 3 | 0 | Y | VMPLLCGIGCA | 88.46 | VIPLLCGVGGA | 7.69 | VIPLLCGIGGA | 3.85 | | |
| NS4B | 2364 | 0.85 | 4 | 4 | 0 | Y | MPLLCGIGGAM | 84.62 | IPLLCGVGGAM | 7.69 | MPLLCGIGCAT | 3.85 | IPLLCGIGGAM | 3.85 |
| NS4B | 2365 | 0.85 | 4 | 4 | 0 | Y | PLLCGIGGAML | 84.62 | PLLCGVGGAML | 7.69 | PLLCGIGCATL | 3.85 | PLLCGIGGAML | 3.85 |
| NS4B | 2366 | 0.85 | 4 | 4 | 0 | Y | LLCGIGGAMLH | 84.62 | LLCGVGGAMLH | 7.69 | LLCGIGCATLH | 3.85 | LLCGIGGAMLH | 3.85 |
| NS4B | 2367 | 0.85 | 4 | 4 | 0 | Y | LCGIGGAMLHW | 84.62 | LCGVGGAMLHW | 7.69 | LCGIGGAMLHW | 3.85 | LCGIGCATLHW | 3.85 |
| NS4B | 2368 | 1.08 | 5 | 5 | 0 | Y | CGIGGAMLHWS | 80.77 | CGVGGAMLHWT | 7.69 | CGIGGAMLHWT | 3.85 | CGIGCATLHWS | 3.85 | CGIGCAMLHWT | 3.85 |
| NS4B | 2369 | 1.08 | 5 | 5 | 0 | Y | GIGGAMLHWSL | 80.77 | GVGGAMLHWTL | 7.69 | GIGGAMLHWTL | 3.85 | GIGCATLHWSL | 3.85 | GIGGAMLHWTL | 3.85 |
| NS4B | 2370 | 1.08 | 5 | 5 | 0 | Y | IGGAMLHWSLI | 80.77 | VGGAMLHWTLI | 7.69 | IGGAMLHWTLI | 3.85 | IGCATLHWSLI | 3.85 | IGCAMLHWTLI | 3.85 |
| NS4B | 2371 | 0.97 | 4 | 4 | 0 | Y | GGAMLHWSLIL | 80.77 | GGAMLHWTLIL | 7.69 | GCATLHWSLIL | 3.85 | GCAMLHWTLIL | 3.85 |
| NS4B | 2372 | 0.97 | 4 | 4 | 0 | Y | GAMLHWSLILP | 80.77 | GAMLHWTLILP | 11.54 | CATLHWSLILP | 3.85 | | |
| NS4B | 2373 | 0.85 | 3 | 3 | 0 | Y | AMLHWSLILPG | 80.77 | AMLHWTLILPG | 15.38 | ATLHWSLILPG | 3.85 | | |
| NS4B | 2374 | 0.85 | 3 | 3 | 0 | Y | MLHWSLILPGI | 80.77 | MLHWTLILPGI | 15.38 | TLHWSLILPGI | 3.85 | | |
| NS4B | 2375 | 0.62 | 2 | 2 | 0 | Y | LHWSLILPGIK | 84.62 | LHWTLILPGIK | 15.38 | | | | |
| NS4B | 2376 | 0.62 | 2 | 2 | 0 | Y | HWSLILPGIKA | 84.62 | HWTLILPGIKA | 15.38 | | | | |

Fig. 30-94

Species: YFV (11-

Fig. 30-95

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2402 | 0.89 | 3 | 3 | 0 | Y | KNPVVDGNPTV | 80.77 | KNPVVDGNPTA | 11.54 | ENPVVDGNPTV | 7.69 | | | | |
| NS4B | 2403 | 0.52 | 2 | 2 | 0 | Y | NPVVDGNPTVD | 88.46 | NPVVDGNPTAD | 11.54 | | | | | | |
| NS4B | 2404 | 0.52 | 2 | 2 | 0 | Y | PVVDGNPTVDI | 88.46 | PVVDGNPTADI | 11.54 | | | | | | |
| NS4B | 2405 | 0.52 | 2 | 2 | 0 | Y | VVDGNPTVDIE | 88.46 | VVDGNPTADIE | 11.54 | | | | | | |
| NS4B | 2406 | 0.52 | 2 | 2 | 0 | Y | VDGNPTVDIEE | 88.46 | VDGNPTADIEE | 11.54 | | | | | | |
| NS4B | 2407 | 0.52 | 2 | 2 | 0 | Y | DGNPTVDIEEA | 88.46 | DGNPTADIEEA | 11.54 | | | | | | |
| NS4B | 2408 | 0.52 | 2 | 2 | 0 | Y | GNPTVDIEEAP | 88.46 | GNPTADIEEAP | 11.54 | | | | | | |
| NS4B | 2409 | 0.52 | 2 | 2 | 0 | Y | NPTVDIEEAPE | 88.46 | NPTADIEEAPE | 11.54 | | | | | | |
| NS4B | 2410 | 0.52 | 2 | 2 | 0 | Y | PTVDIEEAPEM | 88.46 | PTADIEEAPEM | 11.54 | | | | | | |
| NS4B | 2411 | 0.52 | 2 | 2 | 0 | Y | TVDIEEAPEMP | 88.46 | TADIEEAPEMP | 11.54 | | | | | | |
| NS4B | 2412 | 0.74 | 3 | 3 | 0 | Y | VDIEEAPEMPA | 84.62 | ADIEEAPEMPA | 11.54 | VDIEEAPEMPV | 3.85 | | | | |
| NS4B | 2413 | 0.24 | 2 | 2 | 0 | Y | DIEEAPEMPAL | 96.15 | DIEEAPEMPVL | 3.85 | | | | | | |
| NS4B | 2414 | 0.24 | 2 | 2 | 0 | Y | IEEAPEMPALY | 96.15 | IEEAPEMPVLY | 3.85 | | | | | | |
| NS4B | 2415 | 0.24 | 2 | 2 | 0 | Y | EEAPEMPALYE | 96.15 | EEAPEMPVLYE | 3.85 | | | | | | |
| NS4B | 2416 | 0.24 | 2 | 2 | 0 | Y | EAPEMPALYEK | 96.15 | EAPEMPVLYEK | 3.85 | | | | | | |
| NS4B | 2417 | 0.24 | 2 | 2 | 0 | Y | APEMPALYEKK | 96.15 | APEMPVLYEKK | 3.85 | | | | | | |
| NS4B | 2418 | 0.24 | 2 | 2 | 0 | Y | PEMPALYEKKL | 96.15 | PEMPVLYEKKL | 3.85 | | | | | | |
| NS4B | 2419 | 0.24 | 2 | 2 | 0 | Y | EMPALYEKKLA | 96.15 | EMPVLYEKKLA | 3.85 | | | | | | |
| NS4B | 2420 | 0.24 | 2 | 2 | 0 | Y | MPALYEKKLAL | 96.15 | MPVLYEKKLAL | 3.85 | | | | | | |
| NS4B | 2421 | 0.24 | 2 | 2 | 0 | Y | PALYEKKLALY | 96.15 | PVLYEKKLALY | 3.85 | | | | | | |
| NS4B | 2422 | 0.24 | 2 | 2 | 0 | Y | ALYEKKLALYL | 96.15 | VLYEKKLALYL | 3.85 | | | | | | |
| NS4B | 2423 | 0.00 | 1 | 1 | 0 | Y | LYEKKLALYLL | 100 | | | | | | | | |
| NS4B | 2424 | 0.00 | 1 | 1 | 0 | Y | YEKKLALYLLL | 100 | | | | | | | | |
| NS4B | 2425 | 0.00 | 1 | 1 | 0 | Y | EKKLALYLLLA | 100 | | | | | | | | |
| NS4B | 2426 | 0.00 | 1 | 1 | 0 | Y | KKLALYLLLAL | 100 | | | | | | | | |

Fig. 30-96

Species: YFV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2427 | 0.00 | 1 | 1 | 0 | Y | KLALYLLLALS | 100 | | | | | | | | |
| NS4B | 2428 | 0.00 | 1 | 1 | 0 | Y | LALYLLLALSL | 100 | | | | | | | | |
| NS4B | 2429 | 0.74 | 3 | 3 | 0 | Y | ALYLLLALSLA | 84.62 | ALYLLLALSLM | 11.54 | ALYLLLALSLS | 3.85 | | | | |
| NS4B | 2430 | 0.74 | 3 | 3 | 0 | Y | LYLLLALSLAS | 84.62 | LYLLLALSLMS | 11.54 | LYLLLALSLSS | 3.85 | | | | |
| NS4B | 2431 | 0.74 | 3 | 3 | 0 | Y | YLLLALSLASV | 84.62 | YLLLALSLMSV | 11.54 | YLLLALSLSSV | 3.85 | | | | |
| NS4B | 2432 | 0.74 | 3 | 3 | 0 | Y | LLLALSLASVA | 84.62 | LLLALSLMSVA | 11.54 | LLLALSLSSVA | 3.85 | | | | |
| NS4B | 2433 | 0.74 | 3 | 3 | 0 | Y | LLALSLASVAM | 84.62 | LLALSLMSVAM | 11.54 | LLALSLSSVAM | 3.85 | | | | |
| NS4B | 2434 | 0.74 | 3 | 3 | 0 | Y | LALSLASVAMC | 84.62 | LALSLMSVAMC | 11.54 | LALSLSSVAMC | 3.85 | | | | |
| NS4B | 2435 | 0.74 | 3 | 3 | 0 | Y | ALSLASVAMCR | 84.62 | ALSLMSVAMCR | 11.54 | ALSLSSVAMCR | 3.85 | | | | |
| NS4B | 2436 | 0.74 | 3 | 3 | 0 | Y | LSLASVAMCRT | 84.62 | LSLMSVAMCRT | 11.54 | LSLSSVAMCRT | 3.85 | | | | |
| NS4B | 2437 | 0.74 | 3 | 3 | 0 | Y | SLASVAMCRTP | 84.62 | SLMSVAMCRTP | 11.54 | SLSSVAMCRTP | 3.85 | | | | |
| NS4B | 2438 | 0.74 | 3 | 3 | 0 | Y | LASVAMCRTPF | 84.62 | LMSVAMCRTPF | 11.54 | LSSVAMCRTPF | 3.85 | | | | |
| NS4B | 2439 | 0.74 | 3 | 3 | 0 | Y | ASVAMCRTPFS | 84.62 | MSVAMCRTPFS | 11.54 | SSVAMCRTPFS | 3.85 | | | | |
| NS4B | 2440 | 0.00 | 1 | 1 | 0 | Y | SVAMCRTPFSL | 100 | | | | | | | | |
| NS4B | 2441 | 0.24 | 2 | 2 | 0 | Y | VAMCRTPFSLA | 96.15 | VAMCRTPFSLD | 3.85 | | | | | | |
| NS4B | 2442 | 0.24 | 2 | 2 | 0 | Y | AMCRTPFSLAE | 96.15 | AMCRTPFSLDE | 3.85 | | | | | | |
| NS4B | 2443 | 0.24 | 2 | 2 | 0 | Y | MCRTPFSLAEG | 96.15 | MCRTPFSLDEG | 3.85 | | | | | | |
| NS4B | 2444 | 0.24 | 2 | 2 | 0 | Y | CRTPFSLAEGI | 96.15 | CRTPFSLDEGI | 3.85 | | | | | | |
| NS4B | 2445 | 0.24 | 2 | 2 | 0 | Y | RTPFSLAEGIV | 96.15 | RTPFSLDEGIV | 3.85 | | | | | | |
| NS4B | 2446 | 0.24 | 2 | 2 | 0 | Y | TPFSLAEGIVL | 96.15 | TPFSLDEGIVL | 3.85 | | | | | | |
| NS4B | 2447 | 0.74 | 3 | 3 | 0 | Y | PFSLAEGIVLA | 84.62 | PFSLDEGIVLA | 11.54 | PFSLDEGIVLA | 3.85 | | | | |
| NS4B | 2448 | 0.74 | 3 | 3 | 0 | Y | FSLAEGIVLAS | 84.62 | FSLAEGIVLSS | 11.54 | FSLDEGIVLAS | 3.85 | | | | |
| NS4B | 2449 | 0.74 | 3 | 3 | 0 | Y | SLAEGIVLASA | 84.62 | SLAEGIVLSSA | 11.54 | SLDEGIVLASA | 3.85 | | | | |
| NS4B | 2450 | 0.74 | 3 | 3 | 0 | Y | LAEGIVLASAA | 84.62 | LAEGIVLSSAA | 11.54 | LDEGIVLASAA | 3.85 | | | | |
| NS4B | 2451 | 1.32 | 4 | 4 | 0 | Y | AEGIVLASAAL | 69.23 | AEGIVLASAAS | 15.38 | AEGIVLSSAAL | 11.54 | DEGIVLASAAL | 3.85 | | |

Fig. 30-97

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

Fig. 30-98

Species: YFV (11-mers)

| protein | block starting position | block entropy | total

Fig. 30-99

Species: YFV (11-mers)

| protein | block starting position | block

Fig. 30-100

Species: YFV (11

Fig. 30-101

Species: YFV (11-mers)

| protein | block starting position | block entropy | total peptides in block | # peptides required to cover 99% of block | gap/X fraction | 99%

Fig. 30-102

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2584 | 0.99 | 3 | 3 | 0 | Y | VIDLGCGRGGW | 76.92 | VTDLGCGRGGW | 15.38 | VMDLGCGRGGW | 7.69 | | |
| NS5 | 2585 | 0.99 | 3 | 3 | 0 | Y | IDLGCGRGGWC | 76.92 | TDLGCGRGGWC | 15.38 | MDLGCGRGGWC | 7.69 | | |
| NS5 | 2586 | 0.00 | 1 | 1 | 0 | Y | DLGCGRGGWCY | 100 | | | | | | |
| NS5 | 2587 | 0.00 | 1 | 1 | 0 | Y | LGCGRGGWCYY | 100 | | | | | | |
| NS5 | 2588 | 0.00 | 1 | 1 | 0 | Y | GCGRGGWCYYA | 100 | | | | | | |
| NS5 | 2589 | 0.00 | 1 | 1 | 0 | Y | CGRGGWCYYAA | 100 | | | | | | |
| NS5 | 2590 | 0.00 | 1 | 1 | 0 | Y | GRGGWCYYAAA | 100 | | | | | | |
| NS5 | 2591 | 0.00 | 1 | 1 | 0 | Y | RGGWCYYAAAQ | 100 | | | | | | |
| NS5 | 2592 | 0.00 | 1 | 1 | 0 | Y | GGWCYYAAAQK | 100 | | | | | | |
| NS5 | 2593 | 0.00 | 1 | 1 | 0 | Y | GWCYYAAAQKE | 100 | | | | | | |
| NS5 | 2594 | 0.00 | 1 | 1 | 0 | Y | WCYYAAAQKEV | 100 | | | | | | |
| NS5 | 2595 | 0.00 | 1 | 1 | 0 | Y | CYYAAAQKEVS | 100 | | | | | | |
| NS5 | 2596 | 0.00 | 1 | 1 | 0 | Y | YYAAAQKEVSG | 100 | | | | | | |
| NS5 | 2597 | 0.00 | 1 | 1 | 0 | Y | YAAAQKEVSGV | 100 | | | | | | |
| NS5 | 2598 | 0.00 | 1 | 1 | 0 | Y | AAAQKEVSGVK | 100 | | | | | | |
| NS5 | 2599 | 0.00 | 1 | 1 | 0 | Y | AAQKEVSGVKG | 100 | | | | | | |
| NS5 | 2600 | 0.52 | 2 | 2 | 0 | Y | AQKEVSGVKGF | 88.46 | AQKEVSGVKGY | 11.54 | | | | |
| NS5 | 2601 | 0.52 | 2 | 2 | 0 | Y | QKEVSGVKGFT | 88.46 | QKEVSGVKGYT | 11.54 | | | | |
| NS5 | 2602 | 0.52 | 2 | 2 | 0 | Y | KEVSGVKGFTL | 88.46 | KEVSGVKGYTL | 11.54 | | | | |
| NS5 | 2603 | 0.52 | 2 | 2 | 0 | Y | EVSGVKGFTLG | 88.46 | EVSGVKGYTLG | 11.54 | | | | |
| NS5 | 2604 | 0.52 | 2 | 2 | 0 | Y | VSGVKGFTLGR | 88.46 | VSGVKGYTLGR | 11.54 | | | | |
| NS5 | 2605 | 0.74 | 3 | 3 | 0 | Y | SGVKGFTLGRD | 84.62 | SGVKGYTLGRD | 11.54 | SGVKGFTLGRE | 3.85 | | |
| NS5 | 2606 | 0.74 | 3 | 3 | 0 | Y | GVKGFTLGRDG | 84.62 | GVKGYTLGRDG | 11.54 | GVKGFTLGREG | 3.85 | | |
| NS5 | 2607 | 0.74 | 3 | 3 | 0 | Y | VKGFTLGRDGH | 84.62 | VKGYTLGRDGH | 11.54 | VKGFTLGREGH | 3.85 | | |
| NS5 | 2608 | 0.74 | 3 | 3 | 0 | Y | KGFTLGRDGHE | 84.62 | KGYTLGRDGHE | 11.54 | KGFTLGREGHE | 3.85 | | |

Fig. 30-103

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2609 | 0.74 | 3 | 3 | 0 | Y | GFTLGRDGHEK | 84.62 | GYTLGRDGHEK | 11.54 | GFTLGREGHEK | 3.85 | | | | |
| NS5 | 2610 | 0.74 | 3 | 3 | 0 | Y | FTLGRDGHEKP | 84.62 | YTLGRDGHEKP | 11.54 | FTLGREGHEKP | 3.85 | | | | |
| NS5 | 2611 | 0.24 | 2 | 2 | 0 | Y | TLGRDGHEKPM | 96.15 | TLGREGHEKPM | 3.85 | | | | | | |
| NS5 | 2612 | 0.24 | 2 | 2 | 0 | Y | LGRDGHEKPMN | 96.15 | LGREGHEKPMN | 3.85 | | | | | | |
| NS5 | 2613 | 0.24 | 2 | 2 | 0 | Y | GRDGHEKPMNV | 96.15 | GREGHEKPMNV | 3.85 | | | | | | |
| NS5 | 2614 | 0.24 | 2 | 2 | 0 | Y | RDGHEKPMNVQ | 96.15 | REGHEKPMNVR | 3.85 | | | | | | |
| NS5 | 2615 | 0.24 | 2 | 2 | 0 | Y | DGHEKPMNVQS | 96.15 | EGHEKPMNVRS | 3.85 | | | | | | |
| NS5 | 2616 | 0.24 | 2 | 2 | 0 | Y | GHEKPMNVQSL | 96.15 | GHEKPMNVRSL | 3.85 | | | | | | |
| NS5 | 2617 | 0.24 | 2 | 2 | 0 | Y | HEKPMNVQSLG | 96.15 | HEKPMNVRSLG | 3.85 | | | | | | |
| NS5 | 2618 | 0.24 | 2 | 2 | 0 | Y | EKPMNVQSLGW | 96.15 | EKPMNVRSLGW | 3.85 | | | | | | |
| NS5 | 2619 | 0.24 | 2 | 2 | 0 | Y | KPMNVQSLGWN | 96.15 | KPMNVRSLGWN | 3.85 | | | | | | |
| NS5 | 2620 | 0.24 | 2 | 2 | 0 | Y | PMNVQSLGWNI | 96.15 | PMNVRSLGWNI | 3.85 | | | | | | |
| NS5 | 2621 | 0.74 | 3 | 3 | 0 | Y | MNVQSLGWNII | 84.62 | MNVQSLGWNIV | 11.54 | MNVRSLGWNII | 3.85 | | | | |
| NS5 | 2622 | 0.74 | 3 | 3 | 0 | Y | NVQSLGWNIIT | 84.62 | NVQSLGWNIVT | 11.54 | NVRSLGWNIIT | 3.85 | | | | |
| NS5 | 2623 | 0.74 | 3 | 3 | 0 | Y | VQSLGWNIITF | 84.62 | VQSLGWNIVTF | 11.54 | VRSLGWNIITF | 3.85 | | | | |
| NS5 | 2624 | 0.74 | 3 | 3 | 0 | Y | QSLGWNIITFK | 84.62 | QSLGWNIVTFK | 11.54 | RSLGWNIITFK | 3.85 | | | | |
| NS5 | 2625 | 0.52 | 2 | 2 | 0 | Y | SLGWNIITFKD | 88.46 | SLGWNIVTFKD | 11.54 | | | | | | |
| NS5 | 2626 | 0.52 | 2 | 2 | 0 | Y | LGWNIITFKDK | 88.46 | LGWNIVTFKDK | 11.54 | | | | | | |
| NS5 | 2627 | 0.52 | 2 | 2 | 0 | Y | GWNIITFKDKT | 88.46 | GWNIVTFKDKT | 11.54 | | | | | | |
| NS5 | 2628 | 0.52 | 2 | 2 | 0 | Y | WNIITFKDKTD | 88.46 | WNIVTFKDKTD | 11.54 | | | | | | |
| NS5 | 2629 | 0.85 | 4 | 4 | 0 | Y | NIITFKDKTDI | 84.62 | NIVTFKDKTDI | 11.54 | NIVTFKDKTDV | 3.85 | NIITFKDKTDV | 3.85 | | |
| NS5 | 2630 | 0.85 | 4 | 4 | 0 | Y | IITFKDKTDIH | 84.62 | IVTFKDKTDIH | 11.54 | IVTFKDKTDVH | 3.85 | IITFKDKTDVH | 3.85 | | |
| NS5 | 2631 | 1.08 | 5 | 5 | 0 | Y | ITFKDKTDIHR | 80.77 | VTFKDKTDIHR | 7.69 | ITFKDKTDVHR | 7.69 | VTFKDKTDVHR | 3.85 | ITFKDKTDIHH | 3.85 |
| NS5 | 2632 | 0.70 | 4 | 4 | 0 | Y | TFKDKTDIHRL | 88.46 | TFKDKTDVHRL | 3.85 | TFKDKTDVHPL | 3.85 | TFKDKTDIHHL | 3.85 | | |
| NS5 | 2633 | 0.70 | 4 | 4 | 0 | Y | FKDKTDIHRLE | 88.46 | FKDKTDVHRLE | 3.85 | FKDKTDVHPLE | 3.85 | FKDKTDIHHLE | 3.85 | | |

Fig. 30-104

Species: YFV (11-mers)

| prot

Fig. 30-105

Species: YFV (11-mers)

| protein | block starting position

Fig. 30-106

Species: YFV (11-mers)

| protein | block

Fig. 30-107

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2716 | 0.00 | 1 | 1 | 0 | Y | NPLSRNSTHEM | 100 | | |
| NS5 | 2717 | 0.00 | 1 | 1 | 0 | Y | PLSRNSTHEMY | 100 | | |
| NS5 | 2718 | 0.00 | 1 | 1 | 0 | Y | LSRNSTHEMYY | 100 | | |
| NS5 | 2719 | 0.00 | 1 | 1 | 0 | Y | SRNSTHEMYYV | 100 | | |
| NS5 | 2720 | 0.00 | 1 | 1 | 0 | Y | RNSTHEMYYVS | 100 | | |
| NS5 | 2721 | 0.00 | 1 | 1 | 0 | Y | NSTHEMYYVSG | 100 | | |
| NS5 | 2722 | 0.00 | 1 | 1 | 0 | Y | STHEMYYVSGA | 100 | | |
| NS5 | 2723 | 0.00 | 1 | 1 | 0 | Y | THEMYYVSGAR | 100 | | |
| NS5 | 2724 | 0.00 | 1 | 1 | 0 | Y | HEMYYVSGARS | 100 | | |
| NS5 | 2725 | 0.00 | 1 | 1 | 0 | Y | EMYYVSGARSN | 100 | | |
| NS5 | 2726 | 0.52 | 2 | 2 | 0 | Y | MYYVSGARSNV | 88.46 | MYVVSGARSNI | 11.54 |
| NS5 | 2727 | 0.52 | 2 | 2 | 0 | Y | YVSGARSNVT | 88.46 | YVVSGARSNIT | 11.54 |
| NS5 | 2728 | 0.52 | 2 | 2 | 0 | Y | YVSGARSNVTF | 88.46 | YVSGARSNITF | 11.54 |
| NS5 | 2729 | 0.52 | 2 | 2 | 0 | Y | VSGARSNVTFT | 88.46 | VSGARSNITFT | 11.54 |
| NS5 | 2730 | 0.52 | 2 | 2 | 0 | Y | SGARSNVTFTV | 88.46 | SGARSNITFTV | 11.54 |
| NS5 | 2731 | 0.52 | 2 | 2 | 0 | Y | GARSNVTFTVN | 88.46 | GARSNITFTVN | 11.54 |
| NS5 | 2732 | 0.52 | 2 | 2 | 0 | Y | ARSNVTFTVNQ | 88.46 | ARSNITFTVNQ | 11.54 |
| NS5 | 2733 | 0.52 | 2 | 2 | 0 | Y | RSNVTFTVNQT | 88.46 | RSNITFTVNQTS | 11.54 |
| NS5 | 2734 | 0.52 | 2 | 2 | 0 | Y | SNVTFTVNQTS | 88.46 | SNITFTVNQTS | 11.54 |
| NS5 | 2735 | 0.52 | 2 | 2 | 0 | Y | NVTFTVNQTSR | 88.46 | NITFTVNQTSR | 11.54 |
| NS5 | 2736 | 0.52 | 2 | 2 | 0 | Y | VTFTVNQTSRL | 88.46 | ITFTVNQTSRL | 11.54 |
| NS5 | 2737 | 0.00 | 1 | 1 | 0 | Y | TFTVNQTSRLL | 100 | | |
| NS5 | 2738 | 0.00 | 1 | 1 | 0 | Y | FTVNQTSRLLM | 100 | | |
| NS5 | 2739 | 0.00 | 1 | 1 | 0 | Y | TVNQTSRLLMR | 100 | | |
| NS5 | 2740 | 0.00 | 1 | 1 | 0 | Y | VNQTSRLLMRR | 100 | | |

Fig. 30-108

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2741 | 0.00 | 1 | 1 | 0 | Y | NQTSRLLMRRM | 100 | | | | | | |
| NS5 | 2742 | 0.00 | 1 | 1 | 0 | Y | QTSRLLMRRMR | 100 | | | | | | |
| NS5 | 2743 | 0.00 | 1 | 1 | 0 | Y | TSRLLMRRMRR | 100 | | | | | | |
| NS5 | 2744 | 0.00 | 1 | 1 | 0 | Y | SRLLMRRMRRP | 100 | | | | | | |
| NS5 | 2745 | 0.00 | 1 | 1 | 0 | Y | RLLMRRMRRPT | 100 | | | | | | |
| NS5 | 2746 | 0.00 | 1 | 1 | 0 | Y | LLMRRMRRPTG | 100 | | | | | | |
| NS5 | 2747 | 0.00 | 1 | 1 | 0 | Y | LMRRMRRPTGK | 100 | | | | | | |
| NS5 | 2748 | 0.00 | 1 | 1 | 0 | Y | MRRMRRPTGKV | 100 | | | | | | |
| NS5 | 2749 | 0.00 | 1 | 1 | 0 | Y | RRMRRPTGKVT | 100 | | | | | | |
| NS5 | 2750 | 0.00 | 1 | 1 | 0 | Y | RMRRPTGKVTL | 100 | | | | | | |
| NS5 | 2751 | 0.00 | 1 | 1 | 0 | Y | MRRPTGKVTLE | 100 | | | | | | |
| NS5 | 2752 | 0.39 | 2 | 2 | 0 | Y | RRPTGKVTLEA | 92.31 | RRPTGKVTLEP | 7.69 | | | | |
| NS5 | 2753 | 0.39 | 2 | 2 | 0 | Y | RPTGKVTLEAD | 92.31 | RPTGKVTLEPD | 7.69 | | | | |
| NS5 | 2754 | 0.39 | 2 | 2 | 0 | Y | PTGKVTLEADV | 92.31 | PTGKVTLEPDV | 7.69 | | | | |
| NS5 | 2755 | 0.77 | 3 | 3 | 0 | Y | TGKVTLEADVI | 84.62 | TGKVTLEPDVI | 7.69 | TGKVTLEADVT | 7.69 | | |
| NS5 | 2756 | 0.77 | 3 | 3 | 0 | Y | GKVTLEADVIL | 84.62 | GKVTLEPDVIL | 7.69 | GKVTLEADVTL | 7.69 | | |
| NS5 | 2757 | 0.77 | 3 | 3 | 0 | Y | KVTLEADVILP | 84.62 | KVTLEPDVILP | 7.69 | KVTLEADVTLP | 7.69 | | |
| NS5 | 2758 | 0.77 | 3 | 3 | 0 | Y | VTLEADVILPI | 84.62 | VTLEPDVILPI | 7.69 | VTLEADVTLPI | 7.69 | | |
| NS5 | 2759 | 0.77 | 3 | 3 | 0 | Y | TLEADVILPIG | 84.62 | TLEPDVILPIG | 7.69 | TLEPDVILPIG | 7.69 | | |
| NS5 | 2760 | 0.77 | 3 | 3 | 0 | Y | LEADVILPIGT | 84.62 | LEPDVILPIGT | 7.69 | LEADVTLPIGT | 7.69 | | |
| NS5 | 2761 | 0.77 | 3 | 3 | 0 | Y | EADVILPIGTR | 84.62 | EPDVILPIGTR | 7.69 | EADVTLPIGTR | 7.69 | | |
| NS5 | 2762 | 0.77 | 3 | 3 | 0 | Y | ADVILPIGTRS | 84.62 | PDVILPIGTRS | 7.69 | ADVTLPIGTRS | 7.69 | | |
| NS5 | 2763 | 0.39 | 2 | 2 | 0 | Y | DVILPIGTRSV | 92.31 | DVTLPIGTRSV | 7.69 | | | | |
| NS5 | 2764 | 0.39 | 2 | 2 | 0 | Y | VILPIGTRSVE | 92.31 | VTLPIGTRSVE | 7.69 | | | | |
| NS5 | 2765 | 0.39 | 2 | 2 | 0 | Y | ILPIGTRSVET | 92.31 | TLPIGTRSVET | 7.69 | | | | |

Fig. 30-110

Species: YFV (11-mers)

| protein | block starting position | block entropy | total

Fig. 30-111

Species: YFV (11-mers)

| protein | block starting position | block entropy | total

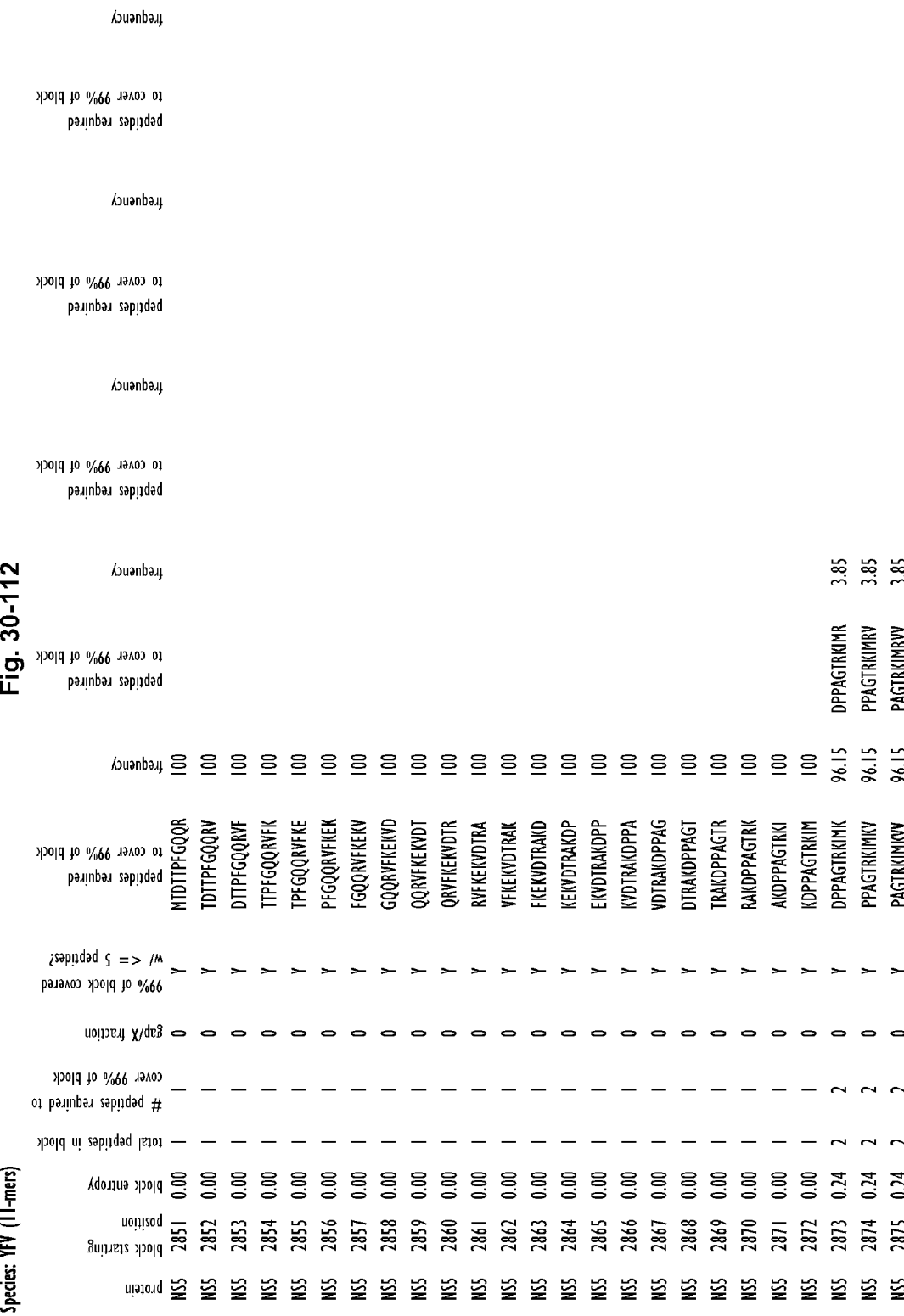

Fig. 30-113

Species: YFV (11-mers)

| protein | block star

Fig. 30-114

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2901 | 0.00 | 1 | 1 | 0 | Y | LCTKEEFIAKV | 100 | | | | | | |
| NS5 | 2902 | 0.00 | 1 | 1 | 0 | Y | CTKEEFIAKVR | 100 | | | | | | |
| NS5 | 2903 | 0.00 | 1 | 1 | 0 | Y | TKEEFIAKVRS | 100 | | | | | | |
| NS5 | 2904 | 0.00 | 1 | 1 | 0 | Y | KEEFIAKVRSH | 100 | | | | | | |
| NS5 | 2905 | 0.00 | 1 | 1 | 0 | Y | EEFIAKVRSHA | 100 | | | | | | |
| NS5 | 2906 | 0.00 | 1 | 1 | 0 | Y | EFIAKVRSHAA | 100 | | | | | | |
| NS5 | 2907 | 0.39 | 2 | 2 | 0 | Y | FIAKVRSHAAI | 92.31 | FIAKVRSHAAV | 7.69 | | | | |
| NS5 | 2908 | 0.39 | 2 | 2 | 0 | Y | IAKVRSHAAIG | 92.31 | IAKVRSHAAVG | 7.69 | | | | |
| NS5 | 2909 | 0.39 | 2 | 2 | 0 | Y | AKVRSHAAIGA | 92.31 | AKVRSHAAVGA | 7.69 | | | | |
| NS5 | 2910 | 0.62 | 3 | 3 | 0 | Y | KVRSHAAIGAY | 88.46 | KVRSHAAVGAF | 7.69 | KVRSHAAIGAF | 3.85 | | |
| NS5 | 2911 | 0.62 | 3 | 3 | 0 | Y | VRSHAAIGAYL | 88.46 | VRSHAAVGAFL | 7.69 | VRSHAAIGAFL | 3.85 | | |
| NS5 | 2912 | 0.62 | 3 | 3 | 0 | Y | RSHAAIGAYLE | 88.46 | RSHAAVGAFLE | 7.69 | RSHAAIGAFLE | 3.85 | | |
| NS5 | 2913 | 0.62 | 3 | 3 | 0 | Y | SHAAIGAYLEE | 88.46 | SHAAVGAFLEE | 7.69 | SHAAIGAFLEE | 3.85 | | |
| NS5 | 2914 | 0.62 | 3 | 3 | 0 | Y | HAAIGAYLEEQ | 88.46 | HAAVGAFLEEQ | 7.69 | HAAIGAFLEEQ | 3.85 | | |
| NS5 | 2915 | 0.85 | 4 | 4 | 0 | Y | AAIGAYLEEQE | 84.62 | AAVGAFLEEQE | 7.69 | AAIGAFLEEQE | 3.85 | AAIGAYLEEQD | 3.85 |
| NS5 | 2916 | 0.85 | 4 | 4 | 0 | Y | AIGAYLEEQEQ | 84.62 | AVGAFLEEQEQ | 7.69 | AIGAFLEEQDQ | 3.85 | AIGAFLEEQEQ | 3.85 |
| NS5 | 2917 | 0.85 | 4 | 4 | 0 | Y | IGAYLEEQEQW | 84.62 | VGAFLEEQEQW | 7.69 | IGAYLEEQDQW | 3.85 | IGAFLEEQEQW | 3.85 |
| NS5 | 2918 | 0.74 | 3 | 3 | 0 | Y | GAYLEEQEQWK | 84.62 | GAFLEEQEQWK | 11.54 | GAYLEEQDQWK | 3.85 | | |
| NS5 | 2919 | 0.74 | 3 | 3 | 0 | Y | AYLEEQEQWKT | 84.62 | AFLEEQEQWKT | 11.54 | AYLEEQDQWKT | 3.85 | | |
| NS5 | 2920 | 0.74 | 3 | 3 | 0 | Y | YLEEQEQWKTA | 84.62 | FLEEQEQWKTA | 11.54 | YLEEQDQWKTA | 3.85 | | |
| NS5 | 2921 | 0.24 | 2 | 2 | 0 | Y | LEEQEQWKTAN | 96.15 | LEEQDQWKTAN | 3.85 | | | | |
| NS5 | 2922 | 0.24 | 2 | 2 | 0 | Y | EEQEQWKTANE | 96.15 | EEQDQWKTANE | 3.85 | | | | |
| NS5 | 2923 | 0.24 | 2 | 2 | 0 | Y | EQEQWKTANEA | 96.15 | EQDQWKTANEA | 3.85 | | | | |
| NS5 | 2924 | 0.24 | 2 | 2 | 0 | Y | QEQWKTANEAV | 96.15 | QDQWKTANEAV | 3.85 | | | | |
| NS5 | 2925 | 0.24 | 2 | 2 | 0 | Y | EQWKTANEAVQ | 96.15 | DQWKTANEAVQ | 3.85 | | | | |

Fig. 30-115

Species: YFV (11-mers)

| protein | block starting position | block entropy | total

Fig. 30-116

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2951 | 0.52 | 2 | 2 | 0 | Y | QQGRCRTCVYN | 88.46 | QQGRCQSCVYN | 11.54 |
| NS5 | 2952 | 0.52 | 2 | 2 | 0 | Y | QGRCRTCVYNM | 88.46 | QGRCQSCVYNM | 11.54 |
| NS5 | 2953 | 0.52 | 2 | 2 | 0 | Y | GRCRTCVYNMM | 88.46 | GRCQSCVYNMM | 11.54 |
| NS5 | 2954 | 0.52 | 2 | 2 | 0 | Y | RCRTCVYNMMG | 88.46 | RCQSCVYNMMG | 11.54 |
| NS5 | 2955 | 0.52 | 2 | 2 | 0 | Y | CRTCVYNMMGK | 88.46 | CQSCVYNMMGK | 11.54 |
| NS5 | 2956 | 0.52 | 2 | 2 | 0 | Y | RTCVYNMMGKR | 88.46 | QSCVYNMMGKR | 11.54 |
| NS5 | 2957 | 0.52 | 2 | 2 | 0 | Y | TCVYNMMGKRE | 88.46 | SCVYNMMGKRE | 11.54 |
| NS5 | 2958 | 0.00 | 1 | 1 | 0 | Y | CVYNMMGKREK | 100 | | |
| NS5 | 2959 | 0.00 | 1 | 1 | 0 | Y | VYNMMGKREKK | 100 | | |
| NS5 | 2960 | 0.00 | 1 | 1 | 0 | Y | YNMMGKREKKL | 100 | | |
| NS5 | 2961 | 0.00 | 1 | 1 | 0 | Y | NMMGKREKKLS | 100 | | |
| NS5 | 2962 | 0.00 | 1 | 1 | 0 | Y | MMGKREKKLSE | 100 | | |
| NS5 | 2963 | 0.00 | 1 | 1 | 0 | Y | MGKREKKLSEF | 100 | | |
| NS5 | 2964 | 0.00 | 1 | 1 | 0 | Y | GKREKKLSEFG | 100 | | |
| NS5 | 2965 | 0.00 | 1 | 1 | 0 | Y | KREKKLSEFGK | 100 | | |
| NS5 | 2966 | 0.00 | 1 | 1 | 0 | Y | REKKLSEFGKA | 100 | | |
| NS5 | 2967 | 0.00 | 1 | 1 | 0 | Y | EKKLSEFGKAK | 100 | | |
| NS5 | 2968 | 0.00 | 1 | 1 | 0 | Y | KKLSEFGKAKG | 100 | | |
| NS5 | 2969 | 0.00 | 1 | 1 | 0 | Y | KLSEFGKAKGS | 100 | | |
| NS5 | 2970 | 0.00 | 1 | 1 | 0 | Y | LSEFGKAKGSR | 100 | | |
| NS5 | 2971 | 0.00 | 1 | 1 | 0 | Y | SEFGKAKGSRA | 100 | | |
| NS5 | 2972 | 0.00 | 1 | 1 | 0 | Y | EFGKAKGSRAI | 100 | | |
| NS5 | 2973 | 0.00 | 1 | 1 | 0 | Y | FGKAKGSRAIW | 100 | | |
| NS5 | 2974 | 0.00 | 1 | 1 | 0 | Y | GKAKGSRAIWY | 100 | | |
| NS5 | 2975 | 0.00 | 1 | 1 | 0 | Y | KAKGSRAIWYM | 100 | | |

Fig. 30-117

Species: YFV (11-mers)

| protein | block starting position | block entropy | total pe

Fig. 30-118

Species: YFV (11-mers)

| protein | block starting position | block entropy | total peptides in block | # peptides required to cover 99% of block | gap/X fraction | 99% of block covered w/ <= 5 peptides? | peptides required to cover 99% of block

Fig. 30-119

Species: YFV (11-mers)

| protein | block starting position | block

Fig. 30-120

Species: YFV (11-mers)

| protein | block star

Fig. 30-121

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

Fig. 30-122

Species: YFV (11-mers)

| protein |

Species: YFV (11-mers)

Fig. 30-123

| protein | block starting position | block entropy |

Fig. 30-124

Species: YFV (11-mers)

| protein | block starting position | block entropy | total

Fig. 30-125

Species: YFV (11-mers)

| protein | block starting position | block

Fig. 30-126

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to

Fig. 30-127

| Species: YFV (11-mers) | protein | block starting position | block entropy | total peptides in block | # peptides required to c

Fig. 30-128

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | fr

Fig. 30-129

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3295 | 0.62 | 3 | 3 | 0 | Y | PTSWVPQGRIT | 88.46 | PTAWVPSGRIT | 7.69 | PMAWVPSGRIT | 3.85 | | |
| NS5 | 3296 | 0.62 | 3 | 3 | 0 | Y | TSWVPQGRITW | 88.46 | TAWVPSGRITW | 7.69 | MAWVPSGRITW | 3.85 | | |
| NS5 | 3297 | 0.52 | 2 | 2 | 0 | Y | SWVPQGRITWS | 88.46 | AWVPSGRITWS | 11.54 | | | | |
| NS5 | 3298 | 0.52 | 2 | 2 | 0 | Y | WVPQGRITWSI | 88.46 | WVPSGRITWSV | 11.54 | | | | |
| NS5 | 3299 | 0.52 | 2 | 2 | 0 | Y | VPQGRITWSIH | 88.46 | VPSGRITWSVH | 11.54 | | | | |
| NS5 | 3300 | 0.52 | 2 | 2 | 0 | Y | PQGRITWSIHG | 88.46 | PSGRITWSVHG | 11.54 | | | | |
| NS5 | 3301 | 0.62 | 3 | 3 | 0 | Y | QGRITWSIHGK | 88.46 | SGRITWSVHGK | 7.69 | SGRITWSVHGR | 3.85 | | |
| NS5 | 3302 | 0.62 | 3 | 3 | 0 | Y | GRITWSIHGKG | 88.46 | GRITWSVHGKG | 7.69 | GRITWSVHGRG | 3.85 | | |
| NS5 | 3303 | 0.62 | 3 | 3 | 0 | Y | RITWSIHGKGE | 88.46 | RITWSVHGKGE | 7.69 | RTTWSVHGRGE | 3.85 | | |
| NS5 | 3304 | 0.62 | 3 | 3 | 0 | Y | TTWSIHGKGEW | 88.46 | TTWSVHGKGEW | 7.69 | TTWSYHGKGEW | 3.85 | | |
| NS5 | 3305 | 0.62 | 3 | 3 | 0 | Y | TWSIHGKGEWM | 88.46 | TWSVHGKGEWM | 7.69 | TWSYHGRGEWM | 3.85 | | |
| NS5 | 3306 | 0.62 | 3 | 3 | 0 | Y | WSIHGKGEWMT | 88.46 | WSVHGKGEWMT | 7.69 | WSYHGRGEWMT | 3.85 | | |
| NS5 | 3307 | 0.62 | 3 | 3 | 0 | Y | SIHGKGEWMTT | 88.46 | SVHGKGEWMTT | 7.69 | SVHGRGEWMTT | 3.85 | | |
| NS5 | 3308 | 0.70 | 4 | 4 | 0 | Y | IHGKGEWMTTE | 88.46 | VHGKGEWMTTE | 3.85 | VHGRGEWMTTE | 3.85 | VHGKGEWMTTE | 3.85 |
| NS5 | 3309 | 0.47 | 3 | 3 | 0 | Y | HGKGEWMTTED | 92.31 | HGRGEWMTTED | 3.85 | HGKGEWMTTQD | 3.85 | | |
| NS5 | 3310 | 0.70 | 4 | 4 | 0 | Y | GKGEWMTTEDM | 88.46 | GKGEWMTTEDM | 3.85 | GRGEWMTTEDM | 3.85 | GKGEWMTTEDR | 3.85 |
| NS5 | 3311 | 0.70 | 4 | 4 | 0 | Y | KGEWMTTEDML | 88.46 | KGEWMTTQDML | 3.85 | RGEWMTTEDML | 3.85 | KGEWMTTEDRL | 3.85 |
| NS5 | 3312 | 1.22 | 5 | 5 | 0 | Y | GEWMTTEDMLE | 76.92 | GEWMTTEDMLG | 7.69 | GEWMTTEDMLD | 3.85 | GEWMTTEDRLE | 3.85 |
| NS5 | 3313 | 1.22 | 5 | 5 | 0 | Y | EWMTTEDMLEV | 76.92 | EWMTTEDMLGV | 7.69 | EWMTTEDMLDV | 3.85 | EWMTTEDRLEV | 3.85 |
| NS5 | 3314 | 1.22 | 5 | 5 | 0 | Y | WMTTEDMLEVW | 76.92 | WMTTEDMLGVW | 7.69 | WMTTEDMLDVW | 3.85 | WMTTEDRLEVW | 3.85 |
| NS5 | 3315 | 1.22 | 5 | 5 | 0 | Y | MTTEDMLEVWN | 76.92 | MTTEDMLGVWN | 7.69 | MTTEDMLDVWN | 3.85 | MTTQDMLDVWN | 3.85 |
| NS5 | 3316 | 1.22 | 5 | 5 | 0 | Y | TTEDMLEVWNR | 76.92 | TTEDMLGVWNR | 7.69 | TTEDRLEVWNR | 3.85 | TTQDMLDVWNR | 3.85 |
| NS5 | 3317 | 1.22 | 5 | 5 | 0 | Y | TEDMLEVWNRV | 76.92 | TEDMLGVWNRV | 7.69 | TEDRLEVWNRV | 3.85 | TQDMLDVWNRV | 3.85 |
| NS5 | 3318 | 1.22 | 5 | 5 | 0 | Y | EDMLEVWNRVW | 76.92 | EDMLGVWNRVW | 7.69 | EDMLGVWNRVW | 3.85 | EDRLEVWNRVW | 3.85 |
| NS5 | 3319 | 1.12 | 4 | 4 | 0 | Y | DMLEVWNRVWI | 76.92 | DMLGVWNRVWI | 11.54 | DMLGVWNRVWI | 7.69 | DRLEVWNRVWI | |

Fig. 30-130

Species: YFV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3320 | 1.12 | 4 | 4 | 0 | Y | MLEVWNRVWIT | 76.92 | MLDVWNRVWYL | 11.54 | MLGVWNRVWIT | 7.69 | RLEVWNRVWIT | 3.85 | | |
| NS5 | 3321 | 0.89 | 3 | 3 | 0 | Y | LEVWNRVWITN | 80.77 | LDVWNRVWVLN | 11.54 | LGVWNRVWITN | 7.69 | | | | |
| NS5 | 3322 | 0.89 | 3 | 3 | 0 | Y | EVWNRVWITNN | 80.77 | DVWNRVWVLNN | 11.54 | GVWNRVWITNN | 7.69 | | | | |
| NS5 | 3323 | 0.52 | 2 | 2 | 0 | Y | VWNRVWITNNP | 88.46 | VWNRVWVLNNP | 11.54 | | | | | | |
| NS5 | 3324 | 0.52 | 2 | 2 | 0 | Y | WNRVWITNNPH | 88.46 | WNRVWVLNNPH | 11.54 | | | | | | |
| NS5 | 3325 | 0.52 | 2 | 2 | 0 | Y | NRVWITNNPHM | 88.46 | NRVWVLNNPHM | 11.54 | | | | | | |
| NS5 | 3326 | 0.62 | 3 | 3 | 0 | Y | RVWITNNPHMQ | 88.46 | RVWVLNNPHMK | 7.69 | RVWWLNNPHMT | 3.85 | | | | |
| NS5 | 3327 | 0.62 | 3 | 3 | 0 | Y | VWITNNPHMQD | 88.46 | VWVLNNPHMKD | 7.69 | VWVLNNPHMTD | 3.85 | | | | |
| NS5 | 3328 | 0.62 | 3 | 3 | 0 | Y | WITNNPHMQDK | 88.46 | WVLNNPHMKDK | 7.69 | WVLNNPHMTDK | 3.85 | | | | |
| NS5 | 3329 | 0.62 | 3 | 3 | 0 | Y | ITNNPHMQDKT | 88.46 | VLNNPHMKDKT | 7.69 | VLNNPHMTDK | 3.85 | | | | |
| NS5 | 3330 | 1.12 | 4 | 4 | 0 | Y | TNNPHMQDKTM | 76.92 | TNNPHMQDKTV | 11.54 | LNNPHMQDKTV | 7.69 | LNNPHMTDKTT | 3.85 | | |
| NS5 | 3331 | 1.12 | 4 | 4 | 0 | Y | NNPHMQDKTMV | 76.92 | NNPHMQDKTVK | 11.54 | NNPHMKDKTTV | 7.69 | NNPHMTDKTTI | 3.85 | | |
| NS5 | 3332 | 1.12 | 4 | 4 | 0 | Y | NPHMQDKTMVK | 76.92 | NPHMQDKTVYK | 11.54 | NPHMKDKTTVK | 7.69 | NPHMTDKTTIK | 3.85 | | |
| NS5 | 3333 | 1.67 | 5 | 5 | 0 | Y | PHMQDKTMVKK | 61.54 | PHMQDKTMVKE | 15.38 | PHMQDKTVKE | 11.54 | PHMTDKTTVKE | 7.69 | PHMTDKTTIKE | 3.85 |
| NS5 | 3334 | 1.67 | 5 | 5 | 0 | Y | HMQDKTMVKKW | 61.54 | HMQDKTMVKEW | 15.38 | HMQDKTVKEW | 11.54 | HMKDKTTVKEW | 7.69 | HMTDKTTIKEW | 3.85 |
| NS5 | 3335 | 1.67 | 5 | 5 | 0 | Y | MQDKTMVKKWR | 61.54 | MQDKTMVKEWR | 15.38 | MQDKTVKEWR | 11.54 | MKDKTTVKEWR | 7.69 | MTDKTTIKEWR | 3.85 |
| NS5 | 3336 | 1.67 | 5 | 5 | 0 | Y | QDKTMVKKWRD | 61.54 | QDKTMVKEWRD | 15.38 | QDKTVKEWRD | 11.54 | KDKTTVKEWRD | 7.69 | TDKTTIKEWRD | 3.85 |
| NS5 | 3337 | 1.67 | 5 | 5 | 0 | Y | DKTMVKKWRDV | 61.54 | DKTMVKEWRDV | 15.38 | DKTVKEWRDV | 11.54 | DKTTVKEWRDV | 7.69 | DKTTIKEWRDV | 3.85 |
| NS5 | 3338 | 1.67 | 5 | 5 | 0 | Y | KTMVKKWRDVP | 61.54 | KTMVKEWRDVP | 15.38 | KTVKEWRDVP | 11.54 | KTTVKEWRDVP | 7.69 | KTTIKEWRDVP | 3.85 |
| NS5 | 3339 | 1.67 | 5 | 5 | 0 | Y | TMVKKWRDVPY | 61.54 | TMVKEWRDVPY | 15.38 | TVKEWRDVPY | 11.54 | TTVKEWRDVPY | 7.69 | TTIKEWRDVPY | 3.85 |
| NS5 | 3340 | 1.67 | 5 | 5 | 0 | Y | MVKKWRDVPYL | 61.54 | MVKEWRDVPYL | 15.38 | VVKEWRDVPYL | 11.54 | TVKEWRDVPYL | 7.69 | TIKEWRDVPYL | 3.85 |
| NS5 | 3341 | 1.14 | 3 | 3 | 0 | Y | VKKWRDVPYLT | 61.54 | VKEWRDVPYLT | 34.62 | IKEWRDVPYLT | 3.85 | | | | |
| NS5 | 3342 | 0.96 | 2 | 2 | 0 | Y | KKWRDVPYLTK | 61.54 | KEWRDVPYLTK | 38.46 | | | | | | |
| NS5 | 3343 | 0.96 | 2 | 2 | 0 | Y | KWRDVPYLTKR | 61.54 | EWRDVPYLTKR | 38.46 | | | | | | |
| NS5 | 3344 | 0.00 | 1 | 1 | 0 | Y | WRDVPYLTKRQ | 100 | | | | | | | | |

Fig. 30-131

Species: YFV (11-mers)

| protein | block starting position | block entropy | total pe

Fig. 30-132

Species: YFV (11-mers)

| protein | block starting position | block

Fig. 30-133

Species: YFV (11-mers)

| protein | block starting position | block entropy | total pe

Fig. 31-1

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 1 | 1.46 | 3 | 3 | 0 | Y | MAGKAILKG | 53.12 | MVKKAILKG | 25 | MARKAILKG | 21.88 | | |
| anC | 2 | 1.46 | 3 | 3 | 0 | Y | AGKAILKGK | 53.12 | VKKAILKGK | 25 | ARKAILKGK | 21.88 | | |
| anC | 3 | 1.46 | 3 | 3 | 0 | Y | GKAILKGKG | 53.12 | KKAILKGKG | 25 | RKAILKGKG | 21.88 | | |
| anC | 4 | 0 | 1 | 1 | 0 | Y | KAILKGKGG | 100 | | | | | | |
| anC | 5 | 0 | 1 | 1 | 0 | Y | AILKGKGGG | 100 | | | | | | |
| anC | 6 | 0 | 1 | 1 | 0 | Y | ILKGKGGGP | 100 | | | | | | |
| anC | 7 | 0 | 1 | 1 | 0 | Y | LKGKGGGPP | 100 | | | | | | |
| anC | 8 | 0 | 1 | 1 | 0 | Y | KGKGGGPPR | 100 | | | | | | |
| anC | 9 | 0 | 1 | 1 | 0 | Y | GKGGGPPRR | 100 | | | | | | |
| anC | 10 | 0.2 | 2 | 2 | 0 | Y | KGGGPPRRV | 96.88 | KGGGPPRRA | 3.12 | | | | |
| anC | 11 | 0.2 | 2 | 2 | 0 | Y | GGGPPRRVS | 96.88 | GGGPPRRAS | 3.12 | | | | |
| anC | 12 | 0.2 | 2 | 2 | 0 | Y | GGPPRRVSK | 96.88 | GGPPRRASK | 3.12 | | | | |
| anC | 13 | 0.2 | 2 | 2 | 0 | Y | GPPRRVSKE | 96.88 | GPPRRASKE | 3.12 | | | | |
| anC | 14 | 0.4 | 3 | 3 | 0 | Y | PPRRVSKET | 93.75 | PPRRASKET | 3.12 | PPRRASKET | 3.12 | | |
| anC | 15 | 0.4 | 3 | 3 | 0 | Y | PRRVSKETA | 93.75 | PRRASKETA | 3.12 | PRRVSKEAA | 3.12 | | |
| anC | 16 | 1.49 | 5 | 5 | 0 | Y | RRVSKETAK | 62.5 | RRVSKETAT | 25 | RRVSKETAR | 6.25 | RRVSKEAAK | 3.12 | RRASKETAK | 3.12 |
| anC | 17 | 1.49 | 5 | 5 | 0 | Y | RVSKETAKK | 62.5 | RVSKETATK | 25 | RVSKETARK | 6.25 | RASKETAKK | 3.12 | RVSKEAAKK | 3.12 |
| anC | 18 | 1.49 | 5 | 5 | 0 | Y | VSKETAKKT | 62.5 | VSKETATKT | 25 | VSKETARKT | 6.25 | ASKETAKKT | 3.12 | VSKEAAKKT | 3.12 |
| anC | 19 | 1.31 | 4 | 4 | 0 | Y | SKETAKKTR | 65.62 | SKETATKTR | 25 | SKETARKTR | 6.25 | SKEAAKKTR | 3.12 | |
| anC | 20 | 1.31 | 4 | 4 | 0 | Y | KETAKKTRQ | 65.62 | KETATKTRQ | 25 | KETARKTRQ | 6.25 | KEAAKKTRQ | 3.12 | |
| anC | 21 | 1.31 | 4 | 4 | 0 | Y | ETAKKTRQS | 65.62 | ETATKTRQP | 25 | ETARKTRQS | 6.25 | EAAKKTRQS | 3.12 | |
| anC | 22 | 1.12 | 3 | 3 | 0 | Y | TAKKTRQSR | 68.75 | TATKTRQPR | 25 | TARKTRQSR | 6.25 | AAKKTRQSR | 3.12 | |
| anC | 23 | 1.12 | 3 | 3 | 0 | Y | AKKTRQSRV | 68.75 | ATKTRQPRV | 25 | ARKTRQPRV | 6.25 | | | |
| anC | 24 | 1.79 | 4 | 4 | 0 | Y | KKTRQSRVQ | 40.62 | KKTRQSRVR | 28.12 | TKTRQPRVQ | 25 | RKTRQSRVQ | 6.25 | |
| anC | 25 | 1.53 | 3 | 3 | 0 | Y | KTRQSRVQM | 46.88 | KTRQSRVRM | 28.12 | KTRQPRVQM | 25 | | | |

Fig. 31-2

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 26 | 1.53 | 3 | 3 | 0 | Y | TRQSRVQMP | 46.88 | TRQSRVRMP | 28.12 | TRQPRVQMP | 25 | | |
| anC | 27 | 1.69 | 4 | 4 | 0 | Y | RQSRVQMPN | 43.75 | RQSRVRMPN | 28.12 | RQPRVQMPN | 25 | RQSRVQMPS | 3.12 |
| anC | 28 | 1.69 | 4 | 4 | 0 | Y | QSRVQMPNG | 43.75 | QSRVRMPNG | 28.12 | QPRVQMPNG | 25 | QSRVQMPSG | 3.12 |
| anC | 29 | 1.69 | 4 | 4 | 0 | Y | SRVQMPNGL | 43.75 | SRVRMPNGL | 28.12 | PRVQMPNGL | 25 | SRVQMPSGL | 3.12 |
| anC | 30 | 1.04 | 3 | 3 | 0 | Y | RVQMPNGLV | 68.75 | RVRMPNGLV | 28.12 | RVQMPSGLV | 3.12 | | |
| anC | 31 | 1.04 | 3 | 3 | 0 | Y | VQMPNGLVL | 68.75 | VRMPNGLVL | 28.12 | VQMPSGLVL | 3.12 | | |
| anC | 32 | 1.04 | 3 | 3 | 0 | Y | QMPNGLVLM | 68.75 | RMPNGLVLM | 28.12 | QMPSGLVLM | 3.12 | | |
| anC | 33 | 0.2 | 2 | 2 | 0 | Y | MPNGLVLMR | 96.88 | MPSGLVLMR | 3.12 | | | | |
| anC | 34 | 0.2 | 2 | 2 | 0 | Y | PNGLVLMRM | 96.88 | PSGLVLMRM | 3.12 | | | | |
| anC | 35 | 0.64 | 3 | 3 | 0 | Y | NGLVLMRMM | 87.5 | NGLVLMRML | 9.38 | SGLVLMRMM | 3.12 | | |
| anC | 36 | 0.45 | 2 | 2 | 0 | Y | GLVLMRMMG | 90.62 | GLVLMRMLG | 9.38 | | | | |
| anC | 37 | 0.64 | 3 | 3 | 0 | Y | LVLMRMMGI | 87.5 | LVLMRMLGI | 9.38 | LVLMRMMGF | 3.12 | | |
| anC | 38 | 0.64 | 3 | 3 | 0 | Y | VLMRMMGIL | 87.5 | VLMRMLGIL | 9.38 | VLMRMMGFL | 3.12 | | |
| anC | 39 | 0.64 | 3 | 3 | 0 | Y | LMRMMGILW | 87.5 | LMRMLGILW | 9.38 | LMRMMGFLW | 3.12 | | |
| anC | 40 | 0.64 | 3 | 3 | 0 | Y | MRMMGILWH | 87.5 | MRMLGILWH | 9.38 | MRMMGFLWH | 3.12 | | |
| anC | 41 | 0.64 | 3 | 3 | 0 | Y | RMMGILWHA | 87.5 | RMLGILWHA | 9.38 | RMMGFLWHA | 3.12 | | |
| anC | 42 | 1.3 | 4 | 4 | 0 | Y | MMGILWHAV | 68.75 | MGILWHAI | 18.75 | MLGILWHAV | 9.38 | MMGFLWHAI | 3.12 |
| anC | 43 | 1.3 | 4 | 4 | 0 | Y | MGILWHAVA | 68.75 | MGILWHAIA | 18.75 | LGILWHAVA | 9.38 | MGFLWHAIA | 3.12 |
| anC | 44 | 0.89 | 3 | 3 | 0 | Y | GILWHAVAG | 78.12 | GILWHAIAG | 18.75 | GFLWHAIAG | 3.12 | | |
| anC | 45 | 0.89 | 3 | 3 | 0 | Y | ILWHAVAGT | 78.12 | ILWHAIAGT | 18.75 | FLWHAIAGT | 3.12 | | |
| anC | 46 | 0.95 | 3 | 3 | 0 | Y | LWHAVAGTA | 75 | LWHAIAGTA | 18.75 | LWHAVAGTV | 3.12 | | |
| anC | 47 | 0.95 | 3 | 3 | 0 | Y | WHAVAGTAR | 75 | WHAIAGTAR | 21.88 | WHAVAGTV | 3.12 | | |
| anC | 48 | 1.64 | 4 | 4 | 0 | Y | HAVAGTARS | 50 | HAVAGTARN | 21.88 | HAIAGTARS | 25 | HAVAGTVRS | 3.12 |
| anC | 49 | 1.64 | 4 | 4 | 0 | Y | AVAGTARSP | 50 | AVAGTARNP | 21.88 | AIAGTARSP | 25 | AVAGTVRSP | 3.12 |
| anC | 50 | 1.64 | 4 | 4 | 0 | Y | VAGTARSPV | 50 | VAGTARNPV | 21.88 | IAGTARSPV | 25 | VAGTVRSPV | 3.12 |

Fig. 31-3

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 51 | — | 3 | 3 | 0 | Y | AG

Fig. 31-4

Species: TBEV (8-mers)

| protein | block starting position | block entropy | total peptides in block | # peptides required to cover 99% of block | gap/X fraction | 99% of block covered w/ <=5 peptides? | pe

Fig. 31-5

Species: TBEV (8-mers)

| protein | block starting position | block entropy (8-mers) | total peptides in block | # peptides required to cover 99% of block | gap/Y fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 128 | 0.2 | 2 | 2 | 0 | Y | VIRAEGKDA | 96.88 | VIRAEGRDA | 3.12 | | | | |
| prM | 129 | 0.2 | 2 | 2 | 0 | Y | IRAEGKDAA | 96.88 | IRAEGRDAA | 3.12 | | | | |
| prM | 130 | 0.2 | 2 | 2 | 0 | Y | RAEGKDAAT | 96.88 | RAEGRDAAT | 3.12 | | | | |
| prM | 131 | 0.2 | 2 | 2 | 0 | Y | AEGKDAATQ | 96.88 | AEGRDAATQ | 3.12 | | | | |
| prM | 132 | 0.2 | 2 | 2 | 0 | Y | EGKDAATQV | 96.88 | EGRDAATQV | 3.12 | | | | |
| prM | 133 | 0.2 | 2 | 2 | 0 | Y | GKDAATQVR | 96.88 | GRDAATQVR | 3.12 | | | | |
| prM | 134 | 0.2 | 2 | 2 | 0 | Y | KDAATQVRV | 96.88 | RDAATQVRV | 3.12 | | | | |
| prM | 135 | 0 | 1 | 1 | 0 | Y | DAATQVRVE | 100 | | | | | | |
| prM | 136 | 0 | 1 | 1 | 0 | Y | AATQVRVEN | 100 | | | | | | |
| prM | 137 | 0 | 1 | 1 | 0 | Y | ATQVRVENG | 100 | | | | | | |
| prM | 138 | 0 | 1 | 1 | 0 | Y | TQVRVENGT | 100 | | | | | | |
| prM | 139 | 0 | 1 | 1 | 0 | Y | QVRVENGTC | 100 | | | | | | |
| prM | 140 | 0 | 1 | 1 | 0 | Y | VRVENGTCV | 100 | | | | | | |
| prM | 141 | 0 | 1 | 1 | 0 | Y | RVENGTCVI | 100 | | | | | | |
| prM | 142 | 0.2 | 2 | 2 | 0 | Y | VENGTCVIL | 96.88 | VENGTCVIM | 3.12 | | | | |
| prM | 143 | 0.64 | 3 | 3 | 0 | Y | ENGTCVILA | 87.5 | ENGTCVILY | 9.38 | ENGTCVIMA | 3.12 | | |
| prM | 144 | 0.64 | 3 | 3 | 0 | Y | NGTCVILAT | 87.5 | NGTCVILVT | 9.38 | NGTCVIMAT | 3.12 | | |
| prM | 145 | 0.64 | 3 | 3 | 0 | Y | GTCVILATD | 87.5 | GTCVILVTD | 9.38 | GTCVIMATD | 3.12 | | |
| prM | 146 | 0.64 | 3 | 3 | 0 | Y | TCVILATDM | 87.5 | TCVILVTDM | 9.38 | TCVIMATDM | 3.12 | | |
| prM | 147 | 0.64 | 3 | 3 | 0 | Y | CVILATDMG | 87.5 | CVILVTDMG | 9.38 | CVIMATDMG | 3.12 | | |
| prM | 148 | 0.84 | 4 | 4 | 0 | Y | VILATDMGS | 84.38 | VILVTDMGS | 9.38 | VIMATDMGS | 3.12 | VILATDMGA | 3.12 |
| prM | 149 | 0.84 | 4 | 4 | 0 | Y | ILATDMGSW | 84.38 | ILVTDMGSW | 9.38 | IMATDMGSW | 3.12 | ILATDMGAW | 3.12 |
| prM | 150 | 0.84 | 4 | 4 | 0 | Y | LATDMGSWC | 84.38 | LVTDMGSWC | 9.38 | LATDMGAWC | 3.12 | MATDMGSWC | 3.12 |
| prM | 151 | 0.64 | 3 | 3 | 0 | Y | ATDMGSWCD | 87.5 | VTDMGSWCD | 9.38 | ATDMGAWCD | 3.12 | | |
| prM | 152 | 0.2 | 2 | 2 | 0 | Y | TDMGWCDD | 96.88 | TDMGAWCDD | 3.12 | | | | |

Fig. 31-6

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 153 | 0.2 | 2 | 2 | 0 | Y | DMGSWCDDS | 96.88 | DMGAWCDDS | 3.12 | | | | |
| prM | 154 | 0.2 | 2 | 2 | 0 | Y | MGSWCDDSL | 96.88 | MGAWCDDSL | 3.12 | | | | |
| prM | 155 | 1.15 | 3 | 3 | 0 | Y | GSWCDDSLT | 56.25 | GSWCDDSL | 40.62 | GAWCDDSLS | 3.12 | | |
| prM | 156 | 1.15 | 3 | 3 | 0 | Y | SWCDDSLTY | 56.25 | SWCDDSLY | 40.62 | AWCDDSLY | 3.12 | | |
| prM | 157 | 0.99 | 2 | 2 | 0 | Y | WCDDSLTYE | 56.25 | WCDDSLYE | 43.75 | | | | |
| prM | 158 | 0.99 | 2 | 2 | 0 | Y | CDDSLTYEC | 56.25 | CDDSLYEC | 43.75 | | | | |
| prM | 159 | 0.99 | 2 | 2 | 0 | Y | DDSLTYECV | 56.25 | DDSLYECV | 43.75 | | | | |
| prM | 160 | 0.99 | 2 | 2 | 0 | Y | DSLTYECVT | 56.25 | DSLYECVT | 43.75 | | | | |
| prM | 161 | 0.99 | 2 | 2 | 0 | Y | SLTYECVTI | 56.25 | SLYECVTI | 43.75 | | | | |
| prM | 162 | 0.99 | 2 | 2 | 0 | Y | LTYECVTID | 56.25 | LSYECVTID | 43.75 | | | | |
| prM | 163 | 0.99 | 2 | 2 | 0 | Y | TYECVTIDQ | 56.25 | SYECVTIDQ | 43.75 | | | | |
| prM | 164 | 0 | 1 | 1 | 0 | Y | YECVTIDQG | 100 | | | | | | |
| prM | 165 | 0 | 1 | 1 | 0 | Y | ECVTIDQGE | 100 | | | | | | |
| prM | 166 | 0 | 1 | 1 | 0 | Y | CVTIDQGEE | 100 | | | | | | |
| prM | 167 | 0 | 1 | 1 | 0 | Y | VTIDQGEEP | 100 | | | | | | |
| prM | 168 | 0 | 1 | 1 | 0 | Y | TIDQGEEPV | 100 | | | | | | |
| prM | 169 | 0 | 1 | 1 | 0 | Y | IDQGEEPVD | 100 | | | | | | |
| prM | 170 | 0 | 1 | 1 | 0 | Y | DQGEEPVDV | 100 | | | | | | |
| prM | 171 | 0 | 1 | 1 | 0 | Y | QGEEPVDVD | 100 | | | | | | |
| prM | 172 | 0 | 1 | 1 | 0 | Y | GEEPVDVDC | 100 | | | | | | |
| prM | 173 | 0 | 1 | 1 | 0 | Y | EEPVDVDCF | 100 | | | | | | |
| prM | 174 | 0 | 1 | 1 | 0 | Y | EPVDVDCFC | 100 | | | | | | |
| prM | 175 | 0 | 1 | 1 | 0 | Y | PVDVDCFCR | 100 | | | | | | |
| prM | 176 | 0 | 1 | 1 | 0 | Y | VDVDCFCRN | 100 | | | | | | |
| prM | 177 | 0 | 1 | 1 | 0 | Y | DVDCFCRNV | 100 | | | | | | |

Fig. 31-7

Species: TBEV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 178 | 0 | 1 | 1 | 0 | Y | VDCFCRNVD | 100 | | | | | | |
| prM | 179 | 0.2 | 2 | 2 | 0 | Y | DCFCRNVDG | 96.88 | DCFCRNVDR | 3.12 | | | | |
| prM | 180 | 0.2 | 2 | 2 | 0 | Y | CFCRNVDGV | 96.88 | CFCRNVDRV | 3.12 | | | | |
| prM | 181 | 0.53 | 3 | 3 | 0 | Y | FCRNVDGVY | 90.62 | FCRNVDGVH | 6.25 | FCRNVDRVY | 3.12 | | |
| prM | 182 | 0.53 | 3 | 3 | 0 | Y | CRNVDGVYL | 90.62 | CRNVDGVHL | 6.25 | CRNVDRVYL | 3.12 | | |
| prM | 183 | 0.53 | 3 | 3 | 0 | Y | RNVDGVYLE | 90.62 | RNVDGVHLE | 6.25 | RNVDRVYLE | 3.12 | | |
| prM | 184 | 0.53 | 3 | 3 | 0 | Y | NVDGVYLEY | 90.62 | NVDGVHLEY | 6.25 | NVDRVYLEY | 3.12 | | |
| prM | 185 | 0.53 | 3 | 3 | 0 | Y | VDGVYLEYG | 90.62 | VDGVHLEYG | 6.25 | VDRVYLEYG | 3.12 | | |
| prM | 186 | 0.53 | 3 | 3 | 0 | Y | DGVYLEYGR | 90.62 | DGVHLEYGR | 6.25 | DRVYLEYGR | 3.12 | | |
| prM | 187 | 0.53 | 3 | 3 | 0 | Y | GVYLEYGRC | 90.62 | GVHLEYGRC | 6.25 | RVYLEYGRC | 3.12 | | |
| prM | 188 | 0.34 | 2 | 2 | 0 | Y | VYLEYGRCG | 93.75 | VHLEYGRCG | 6.25 | | | | |
| prM | 189 | 0.34 | 2 | 2 | 0 | Y | YLEYGRCGK | 93.75 | HLEYGRCGK | 6.25 | | | | |
| prM | 190 | 0 | 1 | 1 | 0 | Y | LEYGRCGKQ | 100 | | | | | | |
| prM | 191 | 0 | 1 | 1 | 0 | Y | EYGRCGKQE | 100 | | | | | | |
| prM | 192 | 0 | 1 | 1 | 0 | Y | YGRCGKQEG | 100 | | | | | | |
| prM | 193 | 0 | 1 | 1 | 0 | Y | GRCGKQEGS | 100 | | | | | | |
| prM | 194 | 0 | 1 | 1 | 0 | Y | RCGKQEGSR | 100 | | | | | | |
| prM | 195 | 0 | 1 | 1 | 0 | Y | CGKQEGSRT | 100 | | | | | | |
| prM | 196 | 0 | 1 | 1 | 0 | Y | GKQEGSRTR | 100 | | | | | | |
| prM | 197 | 0 | 1 | 1 | 0 | Y | KQEGSRTRR | 100 | | | | | | |
| prM | 198 | 0 | 1 | 1 | 0 | Y | QEGSRTRRS | 100 | | | | | | |
| prM | 199 | 0 | 1 | 1 | 0 | Y | EGSRTRRSV | 100 | | | | | | |
| prM | 200 | 0 | 1 | 1 | 0 | Y | GSRTRRSVL | 100 | | | | | | |
| prM | 201 | 0 | 1 | 1 | 0 | Y | SRTRRSVLI | 100 | | | | | | |
| prM | 202 | 0.2 | 2 | 2 | 0 | Y | RTRRSVLIP | 96.88 | RTRRSVLIR | 3.12 | | | | |

Fig. 31-8

Species: TBEV (8-mers)

| protein | block starting position | block entropy | total

Fig. 31-9

Species: TBEV (8-mers)

| protein | block starting position | block entropy | total peptides in block | # peptides required to cover 99% of block | gap/X fraction | 99% of block covered w/ <= 5

Fig. 31-10

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| E | 279

Fig. 31-11

Species: TBEV (8-mers)

| protein | block starting position | block entropy | total peptides in block | # peptides required to cover 99% of block | gap/X fraction | 99% of block covered w/ <= 5 peptides? | block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 304 | 0 | 1 | 1 | 0 | Y | VLELGGCVT | 100 | | | | | | | | |
| E | 305 | 0 | 1 | 1 | 0 | Y | LELGGCVTI | 100 | | | | | | | | |
| E | 306 | 0 | 1 | 1 | 0 | Y | ELGGCVTIT | 100 | | | | | | | | |
| E | 307 | 0 | 1 | 1 | 0 | Y | LGGCVTITA | 100 | | | | | | | | |
| E | 308 | 0 | 1 | 1 | 0 | Y | GGCVTITAE | 100 | | | | | | | | |
| E | 309 | 0 | 1 | 1 | 0 | Y | GCVTITAEG | 100 | | | | | | | | |
| E | 310 | 0 | 1 | 1 | 0 | Y | CVTITAEGK | 100 | | | | | | | | |
| E | 311 | 0 | 1 | 1 | 0 | Y | VTITAEGKP | 100 | | | | | | | | |
| E | 312 | 0 | 1 | 1 | 0 | Y | TITAEGKPS | 100 | | | | | | | | |
| E | 313 | 0 | 1 | 1 | 0 | Y | ITAEGKPSM | 100 | | | | | | | | |
| E | 314 | 0 | 1 | 1 | 0 | Y | TAEGKPSMD | 100 | | | | | | | | |
| E | 315 | 0 | 1 | 1 | 0 | Y | AEGKPSMDV | 100 | | | | | | | | |
| E | 316 | 0 | 1 | 1 | 0 | Y | EGKPSMDVW | 100 | | | | | | | | |
| E | 317 | 0 | 1 | 1 | 0 | Y | GKPSMDVWL | 100 | | | | | | | | |
| E | 318 | 0 | 1 | 1 | 0 | Y | KPSMDVWLD | 100 | | | | | | | | |
| E | 319 | 0.81 | 2 | 2 | 0 | Y | PSMDVWLDS | 75 | PSMDVWLDA | 25 | | | | | | |
| E | 320 | 0.81 | 2 | 2 | 0 | Y | SMDVWLDSI | 75 | SMDVWLDAI | 25 | | | | | | |
| E | 321 | 0.81 | 2 | 2 | 0 | Y | MDVWLDSIY | 75 | MDVWLDAIY | 25 | | | | | | |
| E | 322 | 0.81 | 2 | 2 | 0 | Y | DVWLDSIYQ | 75 | DVWLDAIYQ | 25 | | | | | | |
| E | 323 | 0.81 | 2 | 2 | 0 | Y | VWLDSIYQE | 75 | VWLDAIYQE | 25 | | | | | | |
| E | 324 | 1.14 | 4 | 4 | 0 | Y | WLDSIYQEN | 75 | WLDAIYQEN | 15.62 | WLDAIYQES | 6.25 | WLDAIYQEK | 3.12 | | |
| E | 325 | 1.14 | 4 | 4 | 0 | Y | LDSIYQENP | 75 | LDAIYQENP | 15.62 | LDAIYQESP | 6.25 | LDAIYQEKP | 3.12 | | |
| E | 326 | 1.14 | 4 | 4 | 0 | Y | DSIYQENPA | 75 | DAIYQENPA | 15.62 | DAIYQESPA | 6.25 | DAIYQEKPA | 3.12 | | |
| E | 327 | 1.25 | 5 | 5 | 0 | Y | SIYQENPAK | 75 | AIYQENPAK | 12.5 | AIYQESPAK | 6.25 | AIYQEKPAK | 3.12 | AIYQENPAQ | 3.12 |
| E | 328 | 0.73 | 4 | 4 | 0 | Y | IYQENPAKT | 87.5 | IYQESPAKT | 6.25 | IYQEKPAKT | 3.12 | IYQENPAQT | 3.12 | | |

Fig. 31-12

Species: TBEV (8-mers)

| protein | block starting position | block entropy | total peptides in block | # peptides required to cover 99% of block | gap/X fraction | 99% of block covered w/ <= 5 peptides? | block to cover 99% of | frequency | block

Fig. 31-14

Species: TBEV (8-mers)

| protein | block starting position | block entropy | total peptides in block | # peptides required to cover 99% of block | gap/X fraction | 99% of block covered w/ <= 5 peptides? | block to cover 99% of | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 379 | 0 | 1 | 1 | 0 | Y | RGWGNHCGL | 100 | | | | | | |
| E | 380 | 0 | 1 | 1 | 0 | Y | GWGNHCGLF | 100 | | | | | | |
| E | 381 | 0 | 1 | 1 | 0 | Y | WGNHCGLFG | 100 | | | | | | |
| E | 382 | 0 | 1 | 1 | 0 | Y | GNHCGLFGK | 100 | | | | | | |
| E | 383 | 0 | 1 | 1 | 0 | Y | NHCGLFGKG | 100 | | | | | | |
| E | 384 | 0 | 1 | 1 | 0 | Y | HCGLFGKGS | 100 | | | | | | |
| E | 385 | 0 | 1 | 1 | 0 | Y | CGLFGKGSI | 100 | | | | | | |
| E | 386 | 0 | 1 | 1 | 0 | Y | GLFGKGSIV | 100 | | | | | | |
| E | 387 | 0.81 | 2 | 2 | 0 | Y | LFGKGSIVT | 75 | LFGKGSIVA | 25 | | | | |
| E | 388 | 0.81 | 2 | 2 | 0 | Y | FGKGSIVTC | 75 | FGKGSIVAC | 25 | | | | |
| E | 389 | 0.81 | 2 | 2 | 0 | Y | GKGSIVTCV | 75 | GKGSIVACV | 25 | | | | |
| E | 390 | 0.81 | 2 | 2 | 0 | Y | KGSIVTCVK | 75 | KGSIVACVK | 25 | | | | |
| E | 391 | 1.3 | 3 | 3 | 0 | Y | GSIVTCVKA | 62.5 | GSIVACVKA | 25 | GSIVTCVKV | 12.5 | | |
| E | 392 | 1.69 | 5 | 5 | 0 | Y | SIVTCVKAS | 56.25 | SIVACVKAA | 25 | SIVTCVKVA | 9.38 | SIVTCVKAA | 6.25 | SIVTCVKVS | 3.12 |
| E | 393 | 1.69 | 5 | 5 | 0 | Y | IVTCVKASC | 56.25 | IVACVKAAC | 25 | IVTCVKVAC | 9.38 | IVTCVKAAC | 6.25 | IVTCVKVSC | 3.12 |
| E | 394 | 1.69 | 5 | 5 | 0 | Y | VTCVKASCE | 56.25 | VACVKAACE | 25 | VTCVKVACE | 9.38 | VTCVKAACE | 6.25 | VTCVKVSCE | 3.12 |
| E | 395 | 1.69 | 5 | 5 | 0 | Y | TCVKASCEA | 56.25 | ACVKAACEA | 25 | TCVKVACEA | 9.38 | TCVKAACEA | 6.25 | TCVKVSCEA | 3.12 |
| E | 396 | 1.47 | 4 | 4 | 0 | Y | CVKASCEAK | 56.25 | CVKAACEAK | 25 | CVKVACEAK | 9.38 | CVKVSCEAK | 3.12 | |
| E | 397 | 1.47 | 4 | 4 | 0 | Y | VKASCEAKK | 56.25 | VKAACEAKK | 25 | VKVACEAKK | 9.38 | VKYSCEAKK | 3.12 | |
| E | 398 | 1.47 | 4 | 4 | 0 | Y | KASCEAKKK | 56.25 | KAACEAKKK | 25 | KVACEAKKK | 9.38 | KVSCEAKKK | 3.12 | |
| E | 399 | 1.47 | 4 | 4 | 0 | Y | ASCEAKKKA | 56.25 | AACEAKKKA | 25 | VACEAKKKA | 9.38 | VSCEAKKKA | 3.12 | |
| E | 400 | 0.97 | 2 | 2 | 0 | Y | SCEAKKKAT | 59.38 | ACEAKKKAT | 40.62 | | | | |
| E | 401 | 0 | 1 | 1 | 0 | Y | CEAKKKATG | 100 | | | | | | |
| E | 402 | 0 | 1 | 1 | 0 | Y | EAKKKATGH | 100 | | | | | | |
| E | 403 | 0 | 1 | 1 | 0 | Y | AKKKATGHV | 100 | | | | | | |

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 429 | 0.4 | 3 | 3 | 0 | Y | DYYAANETH | 93.75 | DYYAVNETH | 3.12 | DYYAPHETH | 3.12 | | |
| E | 430 | 0.4 | 3 | 3 | 0 | Y | YYAANETHS | 93.75 | YYAVNETHS | 3.12 | YVAVNETHS | 3.12 | | |
| E | 431 | 0.4 | 3 | 3 | 0 | Y | VAANETHSG | 93.75 | VAPHETHSG | 3.12 | VAVNETHSG | 3.12 | | |
| E | 432 | 0.4 | 3 | 3 | 0 | Y | AANETHSGR | 93.75 | APHETHSGR | 3.12 | AVNETHSGR | 3.12 | | |
| E | 433 | 0.4 | 3 | 3 | 0 | Y | ANETHSGRK | 93.75 | PHETHSGRK | 3.12 | VNETHSGRK | 3.12 | | |
| E | 434 | 0.2 | 2 | 2 | 0 | Y | NETHSGRKT | 96.88 | HETHSGRKT | 3.12 | | | | |
| E | 435 | 0.2 | 2 | 2 | 0 | Y | ETHSGRKTA | 96.88 | ETHSGRKTP | 3.12 | | | | |
| E | 436 | 0.2 | 2 | 2 | 0 | Y | THSGRKTAS | 96.88 | THSGRKTPS | 3.12 | | | | |
| E | 437 | 0.2 | 2 | 2 | 0 | Y | HSGRKTASF | 96.88 | HSGRKTPSF | 3.12 | | | | |
| E | 438 | 0.2 | 2 | 2 | 0 | Y | SGRKTASFT | 96.88 | SGRKTPSF | 3.12 | | | | |
| E | 439 | 0.53 | 3 | 3 | 0 | Y | GRKTASFTV | 90.62 | GRKTASFTI | 6.25 | GRKTPSFTV | 3.12 | | |
| E | 440 | 0.53 | 3 | 3 | 0 | Y | RKTASFTVS | 90.62 | RKTASFTIS | 6.25 | RKTPSFTVS | 3.12 | | |
| E | 441 | 0.53 | 3 | 3 | 0 | Y | KTASFTVSS | 90.62 | KTASFTISS | 6.25 | KTPSFTVSS | 3.12 | | |
| E | 442 | 0.53 | 3 | 3 | 0 | Y | TASFTVSSE | 90.62 | TASFTISSE | 6.25 | TPSFTVSSE | 3.12 | | |
| E | 443 | 0.53 | 3 | 3 | 0 | Y | ASFTVSSEK | 90.62 | ASFTISSEK | 6.25 | PSFTVSSEK | 3.12 | | |
| E | 444 | 0.34 | 2 | 2 | 0 | Y | SFTVSSEKT | 93.75 | SFTISSEKT | 6.25 | | | | |
| E | 445 | 0.34 | 2 | 2 | 0 | Y | FTVSSEKTI | 93.75 | FTISSEKTI | 6.25 | | | | |
| E | 446 | 0.34 | 2 | 2 | 0 | Y | TVSSEKTIL | 93.75 | TISSEKTIL | 6.25 | | | | |
| E | 447 | 0.53 | 3 | 3 | 0 | Y | VSSEKTILT | 90.62 | ISSEKTILT | 6.25 | VSSEKTILN | 3.12 | | |
| E | 448 | 0.2 | 2 | 2 | 0 | Y | SSEKTILTM | 96.88 | SSEKTILNM | 3.12 | | | | |
| E | 449 | 0.2 | 2 | 2 | 0 | Y | SEKTILTMG | 96.88 | SEKTILNMG | 3.12 | | | | |
| E | 450 | 1 | 3 | 3 | 0 | Y | EKTILTMGD | 71.88 | EKTILTMGE | 25 | EKTILNMGD | 3.12 | | |
| E | 451 | 1 | 3 | 3 | 0 | Y | KTILTMGDY | 71.88 | KTILTMGEY | 25 | KTILNMGDY | 3.12 | | |
| E | 452 | 1 | 3 | 3 | 0 | Y | TILTMGDYG | 71.88 | TILTMGEYG | 25 | TILNMGDYG | 3.12 | | |
| E | 453 | 1 | 3 | 3 | 0 | Y | ILTMGDYGD | 71.88 | ILTMGEYGD | 25 | ILNMGDYGD | 3.12 | | |

Fig. 31-17

Species: TBEV (8-mers)

| protein | block starting position | block entropy | total peptides in block | # peptides required to cover 99% of block | gap/X fraction | 99% of block covered w/ <= 5 peptides? | block (peptides required to cover 99% of block) | frequency | block (peptides required to cover 99% of block) | frequency | block (peptides required to cover 99% of block) | frequency | block (peptides required to cover 99% of block) | frequency | block (peptides required to cover 99% of block) | frequency |
|---|---|---|---|---|---|---|---|---|---|---|---|---|---|---|---|---|
| E | 454 | 1 | 3 | 3 | 0 | Y | LTMGDYGDV | 71.88 | LTMGEYGDV | 25 | LNMGDYGDV | 3.12 | | | | |
| E | 455 | 1 | 3 | 3 | 0 | Y | TMGDYGDYS | 71.88 | TMGEYGDYS | 25 | NMGDYGDYS | 3.12 | | | | |
| E | 456 | 0.81 | 2 | 2 | 0 | Y | MGDYGDYSL | 75 | MGEYGDYSL | 25 | | | | | | |
| E | 457 | 0.81 | 2 | 2 | 0 | Y | GDYGDYSLL | 75 | GEYGDYSLL | 25 | | | | | | |
| E | 458 | 0.81 | 2 | 2 | 0 | Y | DYGDYSLLC | 75 | EYGDYSLLC | 25 | | | | | | |
| E | 459 | 0.2 | 2 | 2 | 0 | Y | YGDVSLLCR | 96.88 | YGDVSLLCK | 3.12 | | | | | | |
| E | 460 | 0.2 | 2 | 2 | 0 | Y | GDVSLLCRV | 96.88 | GDVSLLCKV | 3.12 | | | | | | |
| E | 461 | 0.2 | 2 | 2 | 0 | Y | DVSLLCRVA | 96.88 | DVSLLCKVP | 3.12 | | | | | | |
| E | 462 | 0.2 | 2 | 2 | 0 | Y | VSLLCRVAS | 96.88 | VSLLCKVPS | 3.12 | | | | | | |
| E | 463 | 0.2 | 2 | 2 | 0 | Y | SLLCRVASG | 96.88 | SLLCKVPSG | 3.12 | | | | | | |
| E | 464 | 0.2 | 2 | 2 | 0 | Y | LLCRVASGV | 96.88 | LLCKVPSGV | 3.12 | | | | | | |
| E | 465 | 0.2 | 2 | 2 | 0 | Y | LCRVASGVD | 96.88 | LCKVPSGVD | 3.12 | | | | | | |
| E | 466 | 0.2 | 2 | 2 | 0 | Y | CRVASGVDL | 96.88 | CKVPSGVDL | 3.12 | | | | | | |
| E | 467 | 0.2 | 2 | 2 | 0 | Y | RVASGVDLA | 96.88 | KVPSGVDLA | 3.12 | | | | | | |
| E | 468 | 0.2 | 2 | 2 | 0 | Y | VASGVDLAQ | 96.88 | VPSGVDLAQ | 3.12 | | | | | | |
| E | 469 | 0.2 | 2 | 2 | 0 | Y | ASGVDLAQT | 96.88 | PSGVDLAQT | 3.12 | | | | | | |
| E | 470 | 0 | 1 | 1 | 0 | Y | SGVDLAQTV | 100 | | | | | | | | |
| E | 471 | 0 | 1 | 1 | 0 | Y | GVDLAQTVI | 100 | | | | | | | | |
| E | 472 | 0 | 1 | 1 | 0 | Y | VDLAQTVIL | 100 | | | | | | | | |
| E | 473 | 0 | 1 | 1 | 0 | Y | DLAQTVILE | 100 | | | | | | | | |
| E | 474 | 0 | 1 | 1 | 0 | Y | LAQTVILEL | 100 | | | | | | | | |
| E | 475 | 0 | 1 | 1 | 0 | Y | AQTVILELD | 100 | | | | | | | | |
| E | 476 | 0 | 1 | 1 | 0 | Y | QTVILELDK | 100 | | | | | | | | |
| E | 477 | 0 | 1 | 1 | 0 | Y | TVILELDKT | 100 | | | | | | | | |
| E | 478 | 1.42 | 3 | 3 | 0 | Y | VILELDKTS | 56.25 | VILELDKTV | 25 | VILELDKTL | 18.75 | | | | |

Fig. 31-18

Species: TBEV (8-mers)

| protein | block starting position | block entropy | total pe

Fig. 31-19

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 504 | 0.53 | 3 | 3 | 0 | Y | ALPWKHEGA | 90.62 | ALPWRHEGA | 6.25 | | | | | | |
| E | 505 | 0.73 | 4 | 4 | 0 | Y | LPWKHEGAQ | 87.5 | LPWRHEGAQ | 6.25 | | | | | | |
| E | 509 | 1.16 | 5 | 5 | 0 | Y | HEGAQWNN | 78.12 | HEGAQQWNN | 9.38 | ALPWRHEGV | 3.12 | | | | |
| E | 510 | 1.16 | 5 | 5 | 0 | Y | EGAQWNNA | 78.12 | EGAQQWNNA | 9.38 | LPWKHEGAR | 3.12 | | | | |
| E | 511 | 1.16 | 5 | 5 | 0 | Y | GAQWNNAE | 78.12 | GAQQWNNAE | 9.38 | HEGAQHWNN | 6.25 | LPWRHEGVQ | 3.12 | | |
| E | 512 | 1.16 | 5 | 5 | 0 | Y | AQWNNAER | 78.12 | AQQWNNAER | 9.38 | EGAQHWNNA | 6.25 | HEGVQNWNN | 3.12 | HEGARNWNN | 3.12 |
| E | 513 | 0.97 | 4 | 4 | 0 | Y | QWNNAERL | 81.25 | QQWNNAERL | 9.38 | GAQHWNNAE | 6.25 | EGARNWNNA | 3.12 | EGVQNWNNA | 3.12 |
| E | 514 | 0.78 | 3 | 3 | 0 | Y | NWNNAERLV | 84.38 | QWNNAERLV | 9.38 | AQHWNNAER | 6.25 | GVQNWNNAE | 3.12 | GARNWNNAE | 3.12 |
| E | 515 | 0 | 1 | 1 | 0 | Y | WNNAERLVE | 100 | | | QHWNNAERL | 6.25 | ARNWNNAER | 3.12 | VQNWNNAER | 3.12 |
| E | 516 | 0 | 1 | 1 | 0 | Y | NNAERLVEF | 100 | | | HWNNAERLV | 6.25 | RNWNNAERL | 3.12 | | |
| E | 517 | 0 | 1 | 1 | 0 | Y | NAERLVEFG | 100 | | | | | | | | |
| E | 518 | 0.2 | 2 | 2 | 0 | Y | AERLVEFGA | 96.88 | AERLVEFGV | 3.12 | | | | | | |
| E | 519 | 0.2 | 2 | 2 | 0 | Y | ERLVEFGAP | 96.88 | ERLVEFGVP | 3.12 | | | | | | |
| E | 520 | 0.2 | 2 | 2 | 0 | Y | RLVEFGAPH | 96.88 | RLVEFGVPH | 3.12 | | | | | | |
| E | 521 | 0.2 | 2 | 2 | 0 | Y | LVEFGAPHA | 96.88 | LVEFGVPHA | 3.12 | | | | | | |
| E | 522 | 0.2 | 2 | 2 | 0 | Y | VEFGAPHAV | 96.88 | VEFGVPHAV | 3.12 | | | | | | |
| E | 523 | 0.2 | 2 | 2 | 0 | Y | EFGAPHAVK | 96.88 | EFGVPHAVK | 3.12 | | | | | | |
| E | 524 | 0.2 | 2 | 2 | 0 | Y | FGAPHAVKM | 96.88 | FGVPHAVKM | 3.12 | | | | | | |
| E | 525 | 0.2 | 2 | 2 | 0 | Y | GAPHAVKMD | 96.88 | GVPHAVKMD | 3.12 | | | | | | |
| E | 526 | 0.2 | 2 | 2 | 0 | Y | APHAVKMDV | 96.88 | VPHAVKMDV | 3.12 | | | | | | |
| E | 527 | 0 | 1 | 1 | 0 | Y | PHAVKMDVY | 100 | | | | | | | | |
| E | 528 | 0 | 1 | 1 | 0 | Y | HAVKMDVYN | 100 | | | | | | | | |
| E | 529 | 0 | 1 | 1 | 0 | Y | AVKMDVYNL | 100 | | | | | | | | |
| E | 530 | 0 | 1 | 1 | 0 | Y | VKMDVYNLG | 100 | | | | | | | | |
| E | 531 | 0 | 1 | 1 | 0 | Y | KMDVYNLGD | 100 | | | | | | | | |

Fig. 31-20

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 532 | 0 | 1 | 1 | 0 | Y | MDVYNLGDQ | 100 | | | | | | |
| E | 533 | 0 | 1 | 1 | 0 | Y | DVYNLGDQT | 100 | | | | | | |
| E | 534 | 0 | 1 | 1 | 0 | Y | VYNLGDQTG | 100 | | | | | | |
| E | 535 | 0 | 1 | 1 | 0 | Y | YNLGDQTGV | 100 | | | | | | |
| E | 536 | 0 | 1 | 1 | 0 | Y | NLGDQTGVL | 100 | | | | | | |
| E | 537 | 0 | 1 | 1 | 0 | Y | LGDQTGVLL | 100 | | | | | | |
| E | 538 | 0 | 1 | 1 | 0 | Y | GDQTGVLLK | 100 | | | | | | |
| E | 539 | 0.81 | 2 | 2 | 0 | Y | DQTGVLLKS | 75 | DQTGVLLKA | 25 | | | | |
| E | 540 | 0.81 | 2 | 2 | 0 | Y | QTGVLLKSL | 75 | QTGVLLKAL | 25 | | | | |
| E | 541 | 0.81 | 2 | 2 | 0 | Y | TGVLLKSLA | 75 | TGVLLKALA | 25 | | | | |
| E | 542 | 0.81 | 2 | 2 | 0 | Y | GVLLKSLAG | 75 | GVLLKALAG | 25 | | | | |
| E | 543 | 0.81 | 2 | 2 | 0 | Y | VLLKSLAGV | 75 | VLLKALAGV | 25 | | | | |
| E | 544 | 0.81 | 2 | 2 | 0 | Y | LLKSLAGVP | 75 | LLKALAGVP | 25 | | | | |
| E | 545 | 0.81 | 2 | 2 | 0 | Y | LKSLAGVPV | 75 | LKALAGVPP | 25 | | | | |
| E | 546 | 0.81 | 2 | 2 | 0 | Y | KSLAGVPVA | 75 | KALAGVPVA | 25 | | | | |
| E | 547 | 0.81 | 2 | 2 | 0 | Y | SLAGVPVAH | 75 | ALAGVPVAH | 25 | | | | |
| E | 548 | 0 | 1 | 1 | 0 | Y | LAGVPVAHI | 100 | | | | | | |
| E | 549 | 0.81 | 2 | 2 | 0 | Y | AGVPVAHID | 75 | AGVPVAHIE | 25 | | | | |
| E | 550 | 0.81 | 2 | 2 | 0 | Y | GVPVAHIDG | 75 | GVPVAHIEG | 25 | | | | |
| E | 551 | 1.12 | 3 | 3 | 0 | Y | VPVAHIDGT | 68.75 | VPVAHIEGT | 25 | VPVAHIDGA | 6.25 | | |
| E | 552 | 1.12 | 3 | 3 | 0 | Y | PVAHIDGTK | 68.75 | PVAHIEGTK | 25 | PVAHIDGAK | 6.25 | | |
| E | 553 | 1.12 | 3 | 3 | 0 | Y | VAHIDGTKY | 68.75 | VAHIEGTKY | 25 | VAHIDGAKY | 6.25 | | |
| E | 554 | 1.12 | 3 | 3 | 0 | Y | AHIDGTKYH | 68.75 | AHIEGTKYH | 25 | AHIDGAKYH | 6.25 | | |
| E | 555 | 1.12 | 3 | 3 | 0 | Y | HIDGTKYHL | 68.75 | HIEGTKYHL | 25 | HIDGAKYHL | 6.25 | | |
| E | 556 | 1.12 | 3 | 3 | 0 | Y | IDGTKYHLK | 68.75 | IEGTKYHLK | 25 | IDGAKYHLK | 6.25 | | |

Fig. 31-21

Species: TBEV (8-mers)

| protein | block starting position | block entropy | total peptides in block | # peptides required to cover 99% of block | gap/X fraction | covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 557 | 1.12 | 3 | 3 | 0 | Y | DGTKYHLKS | 68.75 | EGTKYHLKS | 25 | DGAKYHLKS | 6.25 | | |
| E | 558 | 0.34 | 2 | 2 | 0 | Y | GTKYHLKSG | 93.75 | GAKYHLKSG | 6.25 | | | | |
| E | 559 | 0.34 | 2 | 2 | 0 | Y | TKYHLKSGH | 93.75 | AKYHLKSGH | 6.25 | | | | |
| E | 560 | 0 | 1 | 1 | 0 | Y | KYHLKSGHV | 100 | | | | | | |
| E | 561 | 0 | 1 | 1 | 0 | Y | YHLKSGHVT | 100 | | | | | | |
| E | 562 | 0 | 1 | 1 | 0 | Y | HLKSGHVTC | 100 | | | | | | |
| E | 563 | 0 | 1 | 1 | 0 | Y | LKSGHVTCE | 100 | | | | | | |
| E | 564 | 0 | 1 | 1 | 0 | Y | KSGHVTCEV | 100 | | | | | | |
| E | 565 | 0 | 1 | 1 | 0 | Y | SGHVTCEVG | 100 | | | | | | |
| E | 566 | 0 | 1 | 1 | 0 | Y | GHVTCEVGL | 100 | | | | | | |
| E | 567 | 0 | 1 | 1 | 0 | Y | HVTCEVGLE | 100 | | | | | | |
| E | 568 | 0 | 1 | 1 | 0 | Y | VTCEVGLEK | 100 | | | | | | |
| E | 569 | 0 | 1 | 1 | 0 | Y | TCEVGLEKL | 100 | | | | | | |
| E | 570 | 0 | 1 | 1 | 0 | Y | CEVGLEKLK | 100 | | | | | | |
| E | 571 | 0 | 1 | 1 | 0 | Y | EVGLEKLKM | 100 | | | | | | |
| E | 572 | 0.2 | 2 | 2 | 0 | Y | VGLEKLKMK | 96.88 | VGLEKLKMN | 3.12 | | | | |
| E | 573 | 0.2 | 2 | 2 | 0 | Y | GLEKLKMKG | 96.88 | GLEKLKMNG | 3.12 | | | | |
| E | 574 | 0.2 | 2 | 2 | 0 | Y | LEKLKMKGL | 96.88 | LEKLKMNGL | 3.12 | | | | |
| E | 575 | 0.2 | 2 | 2 | 0 | Y | EKLKMKGLT | 96.88 | EKLKMNGLT | 3.12 | | | | |
| E | 576 | 0.2 | 2 | 2 | 0 | Y | KLKMKGLTY | 96.88 | KLKMNGLTY | 3.12 | | | | |
| E | 577 | 0.2 | 3 | 3 | 0 | Y | LKMKGLTYT | 96.88 | LKMNGLTY | 6.25 | KMNGLTYTM | 3.12 | | |
| E | 578 | 0.53 | 3 | 3 | 0 | Y | KMKGLTYTM | 90.62 | MKGLTYTMC | 6.25 | MNGLTYTMC | 3.12 | | |
| E | 579 | 0.53 | 3 | 3 | 0 | Y | MKGLTYTMC | 90.62 | KGLTYTMCD | 6.25 | NGLTYTMCD | 3.12 | | |
| E | 580 | 0.53 | 3 | 3 | 0 | Y | KGLTYTMCD | 90.62 | GLTYTMCDK | 6.25 | | | | |
| E | 581 | 0.34 | 2 | 2 | 0 | Y | GLTYTMCDK | 93.75 | | | | | | |

Fig. 31-22

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to c

Fig. 31-23

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 31-24

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block

Fig. 31-25

Species: TBEV (8-mers)

| protein | block starting position | block entropy | total peptides in block | # peptides required to cover 99% of block | block gap/X fraction | 99% of block covered w/ =< 5 peptides? | peptides required

Fig. 31-26

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 682 | — | 3 | 3 | 0 | Y | VFQKTRKGI | 71.88 | VFQKTRKGI | 25 | VFQKTRRGI | 3.12 | | |
| E | 683 | — | 3 | 3 | 0 | Y | FQKTRKGIE | 71.88 | FQKTKKGIE | 25 | FQKTRRGIE | 3.12 | | |
| E | 684 | — | 3 | 3 | 0 | Y | QKTRKGIER | 71.88 | QKTKKGIER | 25 | QKTRRGIER | 3.12 | | |
| E | 685 | — | 3 | 3 | 0 | Y | KTRKGIERL | 71.88 | KTKKGIERL | 25 | KTRRGIERL | 3.12 | | |
| E | 686 | — | 3 | 3 | 0 | Y | TRKGIERLT | 71.88 | TKKGIERLT | 25 | TRRGIERLT | 3.12 | | |
| E | 687 | — | 3 | 3 | 0 | Y | RKGIERLTV | 71.88 | KKGIERLTV | 25 | RRGIERLTV | 3.12 | | |
| E | 688 | 0.2 | 2 | 2 | 0 | Y | KGIERLTVI | 96.88 | RGIERLTVI | 3.12 | | | | |
| E | 689 | 0 | 1 | 1 | 0 | Y | GIERLTVIG | 100 | | | | | | |
| E | 690 | 0 | 1 | 1 | 0 | Y | IERLTVIGE | 100 | | | | | | |
| E | 691 | 0 | 1 | 1 | 0 | Y | ERLTVIGEH | 100 | | | | | | |
| E | 692 | 0 | 1 | 1 | 0 | Y | RLTVIGEHA | 100 | | | | | | |
| E | 693 | 0 | 1 | 1 | 0 | Y | LTVIGEHAW | 100 | | | | | | |
| E | 694 | 0 | 1 | 1 | 0 | Y | TVIGEHAWD | 100 | | | | | | |
| E | 695 | 0 | 1 | 1 | 0 | Y | VIGEHAWDF | 100 | | | | | | |
| E | 696 | 0 | 1 | 1 | 0 | Y | IGEHAWDFG | 100 | | | | | | |
| E | 697 | 0 | 1 | 1 | 0 | Y | GEHAWDFGS | 100 | | | | | | |
| E | 698 | 0.81 | 2 | 2 | 0 | Y | EHAWDFGST | 75 | EHAWDFGSA | 25 | | | | |
| E | 699 | 0.81 | 2 | 2 | 0 | Y | HAWDFGSTG | 75 | HAWDFGSAG | 25 | | | | |
| E | 700 | 0.81 | 2 | 2 | 0 | Y | AWDFGSTGG | 75 | AWDFGSAGG | 25 | | | | |
| E | 701 | 1.22 | 3 | 3 | 0 | Y | WDFGSTGGF | 65.62 | WDFGSAGGF | 25 | WDFGSTGGL | 9.38 | | |
| E | 702 | 1.22 | 3 | 3 | 0 | Y | DFGSTGGFL | 65.62 | DFGSAGGFL | 25 | DFGSTGGLL | 9.38 | | |
| E | 703 | 1.68 | 4 | 4 | 0 | Y | FGSTGGFLT | 53.12 | FGSAGGFLS | 25 | FGSTGGFLA | 12.5 | FGSTGGLLT | 9.38 |
| E | 704 | 1.68 | 4 | 4 | 0 | Y | GSTGGFLTS | 53.12 | GSAGGFLSS | 25 | GSTGGFLAS | 12.5 | GSTGGLLTS | 9.38 |
| E | 705 | 1.68 | 4 | 4 | 0 | Y | STGGFLTSV | 53.12 | SAGGFLSSI | 25 | STGGFLASV | 12.5 | STGGLLTSV | 9.38 |
| E | 706 | 1.68 | 4 | 4 | 0 | Y | TGGFLTSVG | 53.12 | AGGFLSSIG | 25 | TGGFLASVG | 12.5 | TGGLLTSVG | 9.38 |

Fig. 31-27

Species: TBEV (8-mers)

| protein | block starting position | block

Fig. 31-28

Species: TBEV (8-mers)

| protein | block starting position | block entropy | total peptides in block | # peptides required to cover 99% of block | gap/X fraction | covered w/ <= 5 99% of block peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 732 | 1.6 | 5 | 5 | 0 | Y | VGFLPKILV | 46.88 | VGFLPKILLL | 40.62 | VGFLPKILM | 6.25 | VGFLPKILI | 3.12 |
| E | 733 | 1.6 | 5 | 5 | 0 | Y | GFLPKILVG | 46.88 | GFLPKLLLG | 40.62 | GFLPKILMG | 6.25 | VGFLPKLLL | 3.12 |
| E | 741 | 1.13 | 4 | 4 | 0 | Y | GVALAWLGL | 71.88 | GVVLAWLGL | 21.88 | GMALAWLGL | 3.12 | VGFLPKILI | 3.12 |
| E | 742 | 1.13 | 4 | 4 | 0 | Y | VALAWLGLN | 71.88 | VVLAWLGLN | 21.88 | AALAWLGLN | 3.12 | GFLPKLLLG | 3.12 |
| E | 743 | 0.76 | 2 | 2 | 0 | Y | ALAWLGLNM | 78.12 | VLAWLGLNM | 21.88 | | | | |
| E | 744 | 0 | 1 | 1 | 0 | Y | LAWLGLNMR | 100 | | | | | | |
| E | 745 | 0 | 1 | 1 | 0 | Y | AWLGLNMRN | 100 | | | | | | |
| E | 746 | 0 | 1 | 1 | 0 | Y | WLGLNMRNP | 100 | | | | | | |
| E | 747 | 0 | 1 | 1 | 0 | Y | LGLNMRNPT | 100 | | | | | | |
| E | 748 | 0 | 1 | 1 | 0 | Y | GLNMRNPTM | 100 | | | | | | |
| E | 749 | 0 | 1 | 1 | 0 | Y | LNMRNPTMS | 100 | | | | | | |
| E | 750 | 0 | 1 | 1 | 0 | Y | NMRNPTMSM | 100 | | | | | | |
| E | 751 | 0.45 | 2 | 2 | 0 | Y | MRNPTMSMS | 90.62 | MRNPTMSMG | 9.38 | | | | |
| E | 752 | 0.45 | 2 | 2 | 0 | Y | RNPTMSMSF | 90.62 | RNPTMSMGF | 9.38 | | | | |
| E | 753 | 0.45 | 2 | 2 | 0 | Y | NPTMSMSFL | 90.62 | NPTMSMGFL | 9.38 | | | | |
| E | 754 | 0.45 | 2 | 2 | 0 | Y | PTMSMSFLL | 90.62 | PTMSMGFLL | 9.38 | | | | |
| E | 755 | 0.45 | 2 | 2 | 0 | Y | TMSMSFLLA | 90.62 | TMSMGFLLA | 9.38 | | | | |
| E | 756 | 0.45 | 2 | 2 | 0 | Y | MSMSFLLAG | 90.62 | MSMGFLLAG | 9.38 | | | | |
| E | 757 | 0.64 | 3 | 3 | 0 | Y | SMSFLLAGG | 87.5 | SMGFLLAGG | 9.38 | SMSFLLAGV | 3.12 | | |
| E | 758 | 0.64 | 3 | 3 | 0 | Y | MSFLLAGGL | 87.5 | MGFLLAGGL | 9.38 | MSFLLAGVL | 3.12 | | |
| E | 759 | 0.64 | 3 | 3 | 0 | Y | SFLLAGGLV | 87.5 | GFLLAGGLV | 9.38 | SFLLAGVLV | 3.12 | | |
| E | 760 | 0.2 | 2 | 2 | 0 | Y | FLLAGGLVL | 96.88 | FLLAGVLVL | 3.12 | | | | |
| E | 761 | 0.2 | 2 | 2 | 0 | Y | LLAGGLVLA | 96.88 | LLAGVLVLA | 3.12 | | | | |
| E | 762 | 0.2 | 2 | 2 | 0 | Y | LAGGLVLAM | 96.88 | LAGVLVLAM | 3.12 | | | | |
| E | 763 | 0.2 | 2 | 2 | 0 | Y | AGGLVLAMT | 96.88 | AGVLVLAMT | 3.12 | | | | |

Fig. 31-29

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 764 | 0.2 | 2 | 2 | 0 | Y | GGLVLAMTL | 96.88 | GVLVLAMTL | 3.12 | | | | |
| E | 765 | 0.2 | 2 | 2 | 0 | Y | GLVLAMTLG | 96.88 | VLVLAMTLG | 3.12 | | | | |
| E | 766 | 0 | 1 | 1 | 0 | Y | LVLAMTLGV | 100 | | | | | | |
| E | 767 | 0 | 1 | 1 | 0 | Y | VLAMTLGVG | 100 | | | | | | |
| E | 768 | 0 | 1 | 1 | 0 | Y | LAMTLGVGA | 100 | | | | | | |
| E | 769 | 0 | 1 | 1 | 0 | Y | AMTLGVGAD | 100 | | | | | | |
| E | 770 | 0 | 1 | 1 | 0 | Y | MTLGVGADV | 100 | | | | | | |
| E | 771 | 0 | 1 | 1 | 0 | Y | TLGVGADVG | 100 | | | | | | |
| E | 772 | 0.34 | 2 | 2 | 0 | Y | LGVGADVGC | 93.75 | LGVGADVGG | 6.25 | | | | |
| E | 773 | 0.34 | 2 | 2 | 0 | Y | GVGADVGCA | 93.75 | GVGADVGGA | 6.25 | | | | |
| E | 774 | 0.34 | 2 | 2 | 0 | Y | VGADVGCAV | 93.75 | VGADVGGAV | 6.25 | | | | |
| E | 775 | 0.34 | 2 | 2 | 0 | Y | GADVGCAVD | 93.75 | GADVGGAVD | 6.25 | | | | |
| E | 776 | 0.34 | 2 | 2 | 0 | Y | ADVGCAVDT | 93.75 | ADVGGAVDT | 6.25 | | | | |
| E | 777 | 0.34 | 2 | 2 | 0 | Y | DVGCAVDTE | 93.75 | DVGGAVDTE | 6.25 | | | | |
| E | 778 | 0.34 | 2 | 2 | 0 | Y | VGCAVDTER | 93.75 | VGGAVDTER | 6.25 | | | | |
| E | 779 | 0.34 | 2 | 2 | 0 | Y | GCAVDTERM | 93.75 | GGAVDTERM | 6.25 | | | | |
| E | 780 | 0.34 | 2 | 2 | 0 | Y | CAVDTERME | 93.75 | GAVDTERME | 6.25 | | | | |
| NS1 | 781 | 0 | 1 | 1 | 0 | Y | AVDTERMEL | 100 | | | | | | |
| NS1 | 782 | 0 | 1 | 1 | 0 | Y | VDTERMELR | 100 | | | | | | |
| NS1 | 783 | 0 | 1 | 1 | 0 | Y | DTERMELRC | 100 | | | | | | |
| NS1 | 784 | 0 | 1 | 1 | 0 | Y | TERMELRCG | 100 | | | | | | |
| NS1 | 785 | 0 | 1 | 1 | 0 | Y | ERMELRCGE | 100 | | | | | | |
| NS1 | 786 | 0 | 1 | 1 | 0 | Y | RMELRCGEG | 100 | | | | | | |
| NS1 | 787 | 0 | 1 | 1 | 0 | Y | MELRCGEGL | 100 | | | | | | |
| NS1 | 788 | 0 | 1 | 1 | 0 | Y | ELRCGEGLV | 100 | | | | | | |

Fig. 31-30

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | pe

Fig. 31-31

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | pe

Fig. 31-32

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99%

Species: TBEV (8-mers)

Fig. 31-33

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 864 | 1 | 3 | 3 | 0 | Y | VWDKLDPT | 71.88 | VWDKFDPT | 25 | VWDKFDPT | 3.12 | | |
| NS1 | 865 | 1 | 3 | 3 | 0 | Y | WDKLDPTD | 71.88 | VWDKFDPTD | 25 | MVDKFDPTD | 3.12 | | |
| NS1 | 866 | 0.86 | 2 | 2 | 0 | Y | VDKLDPTDY | 71.88 | VDKFDPTDY | 28.12 | | | | |
| NS1 | 867 | 0.86 | 2 | 2 | 0 | Y | DKLDPTDYR | 71.88 | DKFDPTDYR | 28.12 | | | | |
| NS1 | 868 | 0.86 | 2 | 2 | 0 | Y | KLDPTDYRG | 71.88 | KFDPTDYRG | 28.12 | | | | |
| NS1 | 869 | 0.86 | 2 | 2 | 0 | Y | LDPTDYRGG | 71.88 | FDPTDYRGG | 28.12 | | | | |
| NS1 | 870 | 0.97 | 2 | 2 | 0 | Y | DPTDYRGGI | 59.38 | DPTDYRGGV | 40.62 | | | | |
| NS1 | 871 | 1.13 | 3 | 3 | 0 | Y | PTDYRGGIP | 59.38 | PTDYRGGVP | 37.5 | PTDYRGGVS | 3.12 | | |
| NS1 | 872 | 1.13 | 3 | 3 | 0 | Y | TDYRGGIPG | 59.38 | TDYRGGVPG | 37.5 | TDYRGGVSG | 3.12 | | |
| NS1 | 873 | 1.13 | 3 | 3 | 0 | Y | DYRGGIPGL | 59.38 | DYRGGVPGL | 37.5 | DYRGGVSGL | 3.12 | | |
| NS1 | 874 | 1.13 | 3 | 3 | 0 | Y | YRGGIPGLL | 59.38 | YRGGVPGLL | 37.5 | YRGGVSGLL | 3.12 | | |
| NS1 | 875 | 1.31 | 4 | 4 | 0 | Y | RGGIPGLLK | 56.25 | RGGVPGLLK | 37.5 | RGGVSGLLK | 3.12 | RGGIPGLLR | 3.12 |
| NS1 | 876 | 1.31 | 4 | 4 | 0 | Y | GGIPGLLKK | 56.25 | GGVPGLLKK | 37.5 | GGVSGLLRK | 3.12 | GGVSGLLRK | 3.12 |
| NS1 | 877 | 1.31 | 4 | 4 | 0 | Y | GIPGLLKKG | 56.25 | GVPGLLKKG | 37.5 | GIPGLLRKG | 3.12 | GVSGLLRKG | 3.12 |
| NS1 | 878 | 1.31 | 4 | 3 | 0 | Y | IPGLLKKGK | 56.25 | VPGLLKKGK | 37.5 | VSGLLRKGK | 3.12 | IPGLLRKGK | 3.12 |
| NS1 | 879 | 0.4 | 3 | 2 | 0 | Y | PGLLKKGKD | 93.75 | SGLLRKGKD | 3.12 | PGLLRKGKD | 3.12 | | |
| NS1 | 880 | 0.34 | 2 | 3 | 0 | Y | GLLKKGKDI | 93.75 | GLLRKGKDI | 6.25 | | | | |
| NS1 | 881 | 0.53 | 3 | 3 | 0 | Y | LLKKGKDIK | 90.62 | LLRKGKDIK | 6.25 | LLKKGKDIR | 3.12 | | |
| NS1 | 882 | 0.53 | 3 | 3 | 0 | Y | LKKGKDIKV | 90.62 | LRKGKDIKV | 6.25 | LKKGKDIRV | 3.12 | | |
| NS1 | 883 | 0.53 | 3 | 3 | 0 | Y | KKGKDIKVS | 90.62 | RKGKDIKVS | 6.25 | KKGKDIRYS | 3.12 | | |
| NS1 | 884 | 0.2 | 2 | 2 | 0 | Y | KGKDIKYSW | 96.88 | KGKDIRYSW | 3.12 | | | | |
| NS1 | 885 | 0.4 | 3 | 3 | 0 | Y | GKDIKYSWK | 93.75 | GKDIRYSWK | 3.12 | GKDIKYSWR | 3.12 | | |
| NS1 | 886 | 0.4 | 3 | 3 | 0 | Y | KDIKYSWKS | 93.75 | KDIRYSWKS | 3.12 | KDIKYSWRS | 3.12 | | |
| NS1 | 887 | 0.4 | 3 | 3 | 0 | Y | DIKYSWKSW | 93.75 | DIRYSWKSW | 3.12 | DIKYSWRSW | 3.12 | | |
| NS1 | 888 | 0.4 | 3 | 3 | 0 | Y | IKYSWKSWG | 93.75 | IRYSWKSWG | 3.12 | IKYSWRSWG | 3.12 | | |

Fig. 31-34

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 889 | 1.08 | 4 | 4 | 0 | Y | KVSWKSWGH | 75 | KVSWKSWGQ | 18.75 | | | | |
| NS1 | 890 | 1.01 | 4 | 4 | 0 | Y | VSWKSWGHS | 78.12 | VSWKSWGQS | 15.62 | RVSWKSWGH | 3.12 | | |
| NS1 | 894 | 1.12 | 5 | 5 | 0 | Y | SWGHSMIWS | 78.12 | SWGQSMIWS | 12.5 | VSWRSWGHS | 3.12 | SWGHSIIWS | 3.12 |
| NS1 | 898 | 1.48 | 5 | 5 | 0 | Y | SMIWSVPEA | 53.12 | SMIWSIPEA | 37.5 | SWGQAMIWS | 3.12 | SVIWSIPEA | 3.12 |
| NS1 | 899 | 1.48 | 5 | 5 | 0 | Y | MIWSVPEAP | 53.12 | MIWSIPEAP | 37.5 | SIIWSIPEA | 3.12 | VIWSIPEAP | 3.12 |
| NS1 | 900 | 1.16 | 3 | 3 | 0 | Y | IWSVPEAPR | 53.12 | IWSIPEAPR | 43.75 | IIWSIPEAP | 3.12 | | |
| NS1 | 901 | 1.16 | 3 | 3 | 0 | Y | WSVPEAPRR | 53.12 | WSIPEAPRR | 43.75 | | | | |
| NS1 | 902 | 1.16 | 3 | 3 | 0 | Y | SVPEAPRRF | 53.12 | SIPEAPRRF | 43.75 | | | | |
| NS1 | 903 | 1.16 | 3 | 3 | 0 | Y | VPEAPRRFM | 53.12 | IPEASRRFM | 43.75 | | | | |
| NS1 | 904 | 0.2 | 2 | 2 | 0 | Y | PEAPRRFMV | 96.88 | PEASRRFMV | 3.12 | | | | |
| NS1 | 905 | 0.2 | 2 | 2 | 0 | Y | EAPRRFMVG | 96.88 | EASRRFMVG | 3.12 | | | | |
| NS1 | 906 | 0.4 | 3 | 3 | 0 | Y | APRRFMVGT | 93.75 | APRRFMVGI | 3.12 | ASRRFMVGT | 3.12 | | |
| NS1 | 907 | 0.4 | 3 | 3 | 0 | Y | PRRFMVGTE | 93.75 | PRRFMVGIE | 3.12 | SRRFMVGTE | 3.12 | | |
| NS1 | 908 | 0.2 | 2 | 2 | 0 | Y | RRFMVGTEG | 96.88 | RRFMVGIEG | 3.12 | | | | |
| NS1 | 909 | 1.72 | 4 | 4 | 0 | Y | RFMVGTEGG | 37.5 | RFMVGTEGQ | 34.38 | RFMVGIEGS | 3.12 | | |
| NS1 | 918 | 0.89 | 3 | 3 | 0 | Y | SECPLERRK | 78.12 | SECPPERRK | 18.75 | | | | |
| NS1 | 919 | 0.2 | 2 | 2 | 0 | Y | ECPLERRKT | 96.88 | ECPPERRKT | 3.12 | | | | |
| NS1 | 920 | 0.2 | 2 | 2 | 0 | Y | CPLERRKTG | 96.88 | CPPERRKTG | 3.12 | | | | |
| NS1 | 921 | 0.4 | 3 | 3 | 0 | Y | PLERRKTGV | 93.75 | PPERRKTGV | 3.12 | PLERRKTGI | 3.12 | | |
| NS1 | 922 | 0.4 | 3 | 3 | 0 | Y | LERRKTGVF | 93.75 | LERRKTGIF | 3.12 | PERRKTGVF | 3.12 | | |
| NS1 | 923 | 0.2 | 2 | 2 | 0 | Y | ERRKTGVFT | 96.88 | ERRKTGIFT | 3.12 | | | | |
| NS1 | 924 | 0.2 | 2 | 2 | 0 | Y | RRKTGVFTV | 96.88 | RRKTGIFTV | 3.12 | | | | |
| NS1 | 925 | 0.2 | 2 | 2 | 0 | Y | RKTGVFTVA | 96.88 | RKTGIFTVA | 3.12 | | | | |
| NS1 | 926 | 0.2 | 2 | 2 | 0 | Y | KTGVFTVAE | 96.88 | KTGIFTVAE | 3.12 | | | | |
| NS1 | 927 | 0.2 | 2 | 2 | 0 | Y | TGVFTVAEF | 96.88 | TGIFTVAEF | 3.12 | | | | |

Fig. 31-35

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 928 | 0.2 | 2 | 2 | 0 | Y | GVFTVAEFG | 96.88 | GIFTVAEFG | 3.12 | | | | |
| NS1 | 929 | 0.2 | 2 | 2 | 0 | Y | VFTVAEFGV | 96.88 | IFTVAEFGV | 3.12 | | | | |
| NS1 | 930 | 0 | 1 | 1 | 0 | Y | FTVAEFGVG | 100 | | | | | | |
| NS1 | 931 | 0 | 1 | 1 | 0 | Y | TVAEFGVGL | 100 | | | | | | |
| NS1 | 932 | 0 | 1 | 1 | 0 | Y | VAEFGVGLR | 100 | | | | | | |
| NS1 | 933 | 0 | 1 | 1 | 0 | Y | AEFGVGLRT | 100 | | | | | | |
| NS1 | 934 | 0 | 1 | 1 | 0 | Y | EFGVGLRTK | 100 | | | | | | |
| NS1 | 935 | 0 | 1 | 1 | 0 | Y | FGVGLRTKV | 100 | | | | | | |
| NS1 | 936 | 0 | 1 | 1 | 0 | Y | GVGLRTKVF | 100 | | | | | | |
| NS1 | 937 | 0.2 | 2 | 2 | 0 | Y | VGLRTKVFL | 96.88 | VGLRTKVFV | 3.12 | | | | |
| NS1 | 938 | 0.2 | 2 | 2 | 0 | Y | GLRTKVFLD | 96.88 | GLRTKVFVD | 3.12 | | | | |
| NS1 | 939 | 0.2 | 2 | 2 | 0 | Y | LRTKVFLDF | 96.88 | LRTKVFVDF | 3.12 | | | | |
| NS1 | 940 | 0.2 | 2 | 2 | 0 | Y | RTKVFLDFR | 96.88 | RTKVFVDFR | 3.12 | | | | |
| NS1 | 941 | 0.2 | 2 | 2 | 0 | Y | TKVFLDFRQ | 96.88 | TKVFVDFRQ | 3.12 | | | | |
| NS1 | 942 | 0.2 | 2 | 2 | 0 | Y | KVFLDFRQE | 96.88 | KVFVDFRQE | 3.12 | | | | |
| NS1 | 943 | 1.33 | 4 | 4 | 0 | Y | VFLDFRQES | 53.12 | VFLDFRQEP | 40.62 | VFVDFRQES | 3.12 | VFLDFRQEA | 3.12 |
| NS1 | 944 | 1.33 | 4 | 4 | 0 | Y | FLDFRQEST | 53.12 | FLDFRQEPT | 40.62 | FVDFRQEST | 3.12 | FLDFRQEAT | 3.12 |
| NS1 | 945 | 1.33 | 4 | 4 | 0 | Y | LDFRQESTH | 53.12 | LDFRQEPTH | 40.62 | VDFRQESTH | 3.12 | LDFRQEATH | 3.12 |
| NS1 | 946 | 1.15 | 3 | 3 | 0 | Y | DFRQESTHE | 56.25 | DFRQEPTHE | 40.62 | DFRQEATHE | 3.12 | | |
| NS1 | 947 | 1.15 | 3 | 3 | 0 | Y | FRQESTHEC | 56.25 | FRQEPTHEC | 40.62 | FRQEATHEC | 3.12 | | |
| NS1 | 948 | 1.15 | 3 | 3 | 0 | Y | RQESTHECD | 56.25 | RQEPTHECD | 40.62 | RQEATHECD | 3.12 | | |
| NS1 | 949 | 1.15 | 3 | 3 | 0 | Y | QESTHECDT | 56.25 | QEPTHECDT | 40.62 | QEATHECDT | 3.12 | | |
| NS1 | 950 | 1.15 | 3 | 3 | 0 | Y | ESTHECDTG | 56.25 | EPTHECDTG | 40.62 | EATHECDTG | 3.12 | | |
| NS1 | 951 | 1.15 | 3 | 3 | 0 | Y | STHECDTGV | 56.25 | PTHECDTGV | 40.62 | ATHECDTGV | 3.12 | | |
| NS1 | 952 | 0 | 1 | 1 | 0 | Y | THECDTGVM | 100 | | | | | | |

Fig. 31-36

Species: TBEV (8-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS1 | 953 | 0 | 1 | 1 | 0 | Y | HECDTGVMG | 100 | | | | | | |
| NS1 | 954 | 0 | 1 | 1 | 0 | Y | ECDTGVMGA | 100 | | | | | | |
| NS1 | 955 | 0 | 1 | 1 | 0 | Y | CDTGVMGAA | 100 | | | | | | |
| NS1 | 956 | 0 | 1 | 1 | 0 | Y | DTGVMGAAV | 100 | | | | | | |
| NS1 | 957 | 0 | 1 | 1 | 0 | Y | TGVMGAAVK | 100 | | | | | | |
| NS1 | 958 | 0 | 1 | 1 | 0 | Y | GVMGAAVKN | 100 | | | | | | |
| NS1 | 959 | 0 | 1 | 1 | 0 | Y | VMGAAVKNG | 100 | | | | | | |
| NS1 | 960 | 0 | 1 | 1 | 0 | Y | MGAAVKNGM | 100 | | | | | | |
| NS1 | 961 | 0 | 1 | 1 | 0 | Y | GAAVKNGMA | 100 | | | | | | |
| NS1 | 962 | 0.81 | 2 | 2 | 0 | Y | AAVKNGMAV | 75 | AAVKNGMAI | 25 | | | | |
| NS1 | 963 | 0.81 | 2 | 2 | 0 | Y | AVKNGMAVH | 75 | AVKNGMAIH | 25 | | | | |
| NS1 | 964 | 0.81 | 2 | 2 | 0 | Y | VKNGMAVHT | 75 | VKNGMAIHT | 25 | | | | |
| NS1 | 965 | 0.81 | 2 | 2 | 0 | Y | KNGMAVHTD | 75 | KNGMAIHTD | 25 | | | | |
| NS1 | 966 | 0.81 | 2 | 2 | 0 | Y | NGMAVHTDQ | 75 | NGMAIHTDQ | 25 | | | | |
| NS1 | 967 | 0.81 | 2 | 2 | 0 | Y | GMAVHTDQS | 75 | GMAIHTDQS | 25 | | | | |
| NS1 | 968 | 0.81 | 2 | 2 | 0 | Y | MAVHTDQSL | 75 | MAIHTDQSL | 25 | | | | |
| NS1 | 969 | 0.81 | 2 | 2 | 0 | Y | AVHTDQSLW | 75 | AIHTDQSLW | 25 | | | | |
| NS1 | 970 | 0.81 | 2 | 2 | 0 | Y | VHTDQSLWM | 75 | IHTDQSLWM | 25 | | | | |
| NS1 | 971 | 0.7 | 2 | 2 | 0 | Y | HTDQSLWMK | 81.25 | HTDQSLWMR | 18.75 | | | | |
| NS1 | 972 | 0.7 | 2 | 2 | 0 | Y | TDQSLWMKS | 81.25 | TDQSLWMRS | 18.75 | | | | |
| NS1 | 973 | 1.12 | 3 | 3 | 0 | Y | DQSLWMKSV | 71.88 | DQSLWMRSM | 18.75 | DQSLWMKSM | 9.38 | | |
| NS1 | 974 | 1.66 | 4 | 4 | 0 | Y | QSLWMKSVR | 56.25 | QSLWMRSMK | 18.75 | QSLWMKSVK | 15.62 | QSLWMKSMK | 9.38 |
| NS1 | 975 | 1.66 | 4 | 4 | 0 | Y | SLWMKSVRN | 56.25 | SLWMRSMKN | 18.75 | SLWMKSVKN | 15.62 | SLWMKSMKN | 9.38 |
| NS1 | 976 | 1.94 | 5 | 5 | 0 | Y | LWMKSVRND | 50 | LWMRSMKND | 18.75 | LWMKSVKND | 15.62 | LWMKSMKND | 9.38 | LWMKSVRNE | 6.25 |
| NS1 | 977 | 1.94 | 5 | 5 | 0 | Y | WMKSVRNDT | 50 | WMRSMKNDT | 18.75 | WMKSVKNDT | 15.62 | WMKSMKNDT | 9.38 | WMKSVRNET | 6.25 |

Fig. 31-37

Species: TBEV (8-mers)

| protein | block starting position | block entropy | total peptides in block | # peptides required to cover 99% of block | gap/X fraction of 99% of block | covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 978 | 1.94 | 5 | 5 | 0 | Y | MKSVRNDTG | 50 | MRSMKNDTG | 18.75 | MKSVKNDTG | 15.62 | MKSMKNDTG | 9.38 | MKSVRNETG | 6.25 |
| NS1 | 979 | 1.94 | 5 | 5 | 0 | Y | KSVRNDTGT | 50 | RSMKNDTGT | 18.75 | KSVKNDTGT | 15.62 | KSMKNDTGT | 9.38 | KSVRNETGT | 6.25 |
| NS1 | 980 | 1.68 | 4 | 4 | 0 | Y | SVRNDTGTY | 50 | SMKNDTGTY | 28.12 | SVKNDTGTY | 15.62 | SVRNETGTY | 6.25 | | |
| NS1 | 981 | 1.68 | 4 | 4 | 0 | Y | VRNDTGTYI | 50 | MKNDTGTYI | 28.12 | VKNDTGTYI | 15.62 | VRNETGTYI | 6.25 | | |
| NS1 | 982 | 1.27 | 3 | 3 | 0 | Y | RNDTGTYIV | 50 | KNDTGTYIV | 43.75 | RNETGTYIV | 6.25 | | | | |
| NS1 | 983 | 0.34 | 2 | 2 | 0 | Y | NDTGTYIVE | 93.75 | NETGTYIVE | 6.25 | | | | | | |
| NS1 | 984 | 0.34 | 2 | 2 | 0 | Y | DTGTYIVEL | 93.75 | ETGTYIVEL | 6.25 | | | | | | |
| NS1 | 985 | 0 | 1 | 1 | 0 | Y | TGTYIVELL | 100 | | | | | | | | |
| NS1 | 986 | 0 | 1 | 1 | 0 | Y | GTYIVELLV | 100 | | | | | | | | |
| NS1 | 987 | 0 | 1 | 1 | 0 | Y | TYIVELLVT | 100 | | | | | | | | |
| NS1 | 988 | 0 | 1 | 1 | 0 | Y | YIVELLVTD | 100 | | | | | | | | |
| NS1 | 989 | 0 | 1 | 1 | 0 | Y | IVELLVTDL | 100 | | | | | | | | |
| NS1 | 990 | 0 | 1 | 1 | 0 | Y | VELLVTDLR | 100 | | | | | | | | |
| NS1 | 991 | 0 | 1 | 1 | 0 | Y | ELLVTDLRN | 100 | | | | | | | | |
| NS1 | 992 | 0 | 1 | 1 | 0 | Y | LLVTDLRNC | 100 | | | | | | | | |
| NS1 | 993 | 0 | 1 | 1 | 0 | Y | LVTDLRNCS | 100 | | | | | | | | |
| NS1 | 994 | 0 | 1 | 1 | 0 | Y | VTDLRNCSW | 100 | | | | | | | | |
| NS1 | 995 | 0 | 1 | 1 | 0 | Y | TDLRNCSWP | 100 | | | | | | | | |
| NS1 | 996 | 0 | 1 | 1 | 0 | Y | DLRNCSWPA | 100 | | | | | | | | |
| NS1 | 997 | 0 | 1 | 1 | 0 | Y | LRNCSWPAS | 100 | | | | | | | | |
| NS1 | 998 | 0 | 1 | 1 | 0 | Y | RNCSWPASH | 100 | | | | | | | | |
| NS1 | 999 | 0 | 1 | 1 | 0 | Y | NCSWPASHT | 100 | | | | | | | | |
| NS1 | 1000 | 0 | 1 | 1 | 0 | Y | CSWPASHTI | 100 | | | | | | | | |
| NS1 | 1001 | 0 | 1 | 1 | 0 | Y | SWPASHTID | 100 | | | | | | | | |
| NS1 | 1002 | 0 | 1 | 1 | 0 | Y | WPASHTIDN | 100 | | | | | | | | |

Fig. 31-38

Species: TBEV (8-mers)

| prot

Fig. 31-39

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | pe

Fig. 31-40

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1065 | 1.72 | 5 | 5 | 0 | Y | NADCDKRGA | 53.12 | NAKCDKRGA | 25 | SADCDKRGA | 15.62 | TADCDKRGA | 3.12 | SADCDKRGA | 3.12 |
| NS1 | 1066 | 1 | 3 | 3 | 0 | Y | ADCDKRGAS | 71.88 | AKCDKRGAS | 25 | ADCDRRGAS | 3.12 | | | | |
| NS1 | 1067 | 1 | 3 | 3 | 0 | Y | DCDKRGASV | 71.88 | KCDKRGASV | 25 | DCDRRGASV | 3.12 | | | | |
| NS1 | 1068 | 0.2 | 2 | 2 | 0 | Y | CDKRGASVR | 96.88 | CDRRGASVR | 3.12 | | | | | | |
| NS1 | 1069 | 0.2 | 2 | 2 | 0 | Y | DKRGASVRS | 96.88 | DRRGASVRS | 3.12 | | | | | | |
| NS1 | 1070 | 0.2 | 2 | 2 | 0 | Y | KRGASVRST | 96.88 | RRGASVRST | 3.12 | | | | | | |
| NS1 | 1071 | 0 | 1 | 1 | 0 | Y | RGASVRSTT | 100 | | | | | | | | |
| NS1 | 1072 | 0 | 1 | 1 | 0 | Y | GASVRSTTE | 100 | | | | | | | | |
| NS1 | 1073 | 0 | 1 | 1 | 0 | Y | ASVRSTTES | 100 | | | | | | | | |
| NS1 | 1074 | 0 | 1 | 1 | 0 | Y | SVRSTTESG | 100 | | | | | | | | |
| NS1 | 1075 | 0 | 1 | 1 | 0 | Y | VRSTTESGK | 100 | | | | | | | | |
| NS1 | 1076 | 0 | 1 | 1 | 0 | Y | RSTTESGKV | 100 | | | | | | | | |
| NS1 | 1077 | 0 | 1 | 1 | 0 | Y | STTESGKVI | 100 | | | | | | | | |
| NS1 | 1078 | 0 | 1 | 1 | 0 | Y | TTESGKVIP | 100 | | | | | | | | |
| NS1 | 1079 | 0 | 1 | 1 | 0 | Y | TESGKVIPE | 100 | | | | | | | | |
| NS1 | 1080 | 0 | 1 | 1 | 0 | Y | ESGKVIPEW | 100 | | | | | | | | |
| NS1 | 1081 | 0 | 1 | 1 | 0 | Y | SGKVIPEWC | 100 | | | | | | | | |
| NS1 | 1082 | 0 | 1 | 1 | 0 | Y | GKVIPEWCC | 100 | | | | | | | | |
| NS1 | 1083 | 0 | 1 | 1 | 0 | Y | KVIPEWCCR | 100 | | | | | | | | |
| NS1 | 1084 | 0.81 | 2 | 2 | 0 | Y | VIPEWCCRT | 75 | VIPEWCCRA | 25 | | | | | | |
| NS1 | 1085 | 0.81 | 2 | 2 | 0 | Y | IPEWCCRTC | 75 | IPEWCCRAC | 25 | | | | | | |
| NS1 | 1086 | 0.81 | 2 | 2 | 0 | Y | PEWCCRTCT | 75 | PEWCCRACT | 25 | | | | | | |
| NS1 | 1087 | 0.81 | 2 | 2 | 0 | Y | EWCCRTCTL | 75 | EWCCRACTM | 25 | | | | | | |
| NS1 | 1088 | 0.81 | 2 | 2 | 0 | Y | WCCRTCTLP | 75 | WCCRACTMP | 25 | | | | | | |
| NS1 | 1089 | 0.81 | 2 | 2 | 0 | Y | CCRTCTLPP | 75 | CCRACTMPP | 25 | | | | | | |

Fig. 31-41

Species: TBEV (8-mers)

| protein | block starting position | block entropy | total peptides in block | # peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS1 | 1090 | 0.81 | 2 | 2 | 0 | Y | CRTCTLPPV | 75 | CRACTMPPV | 25 | | | | |
| NS1 | 1091 | 0.81 | 2 | 2 | 0 | Y | RTCTLPPVT | 75 | RACTMPPVT | 25 | | | | |
| NS1 | 1092 | 1 | 3 | 3 | 0 | Y | TCTLPPVTF | 71.88 | ACTMPPVTF | 25 | TCTLPPVTI | 3.12 | | |
| NS1 | 1093 | 1 | 3 | 3 | 0 | Y | CTLPPVTFR | 71.88 | CTMPPVTFR | 25 | CTLPPVTIR | 3.12 | | |
| NS1 | 1094 | 1 | 3 | 3 | 0 | Y | TLPPVTFRT | 71.88 | TMPPVTFRT | 25 | TLPPVTIRT | 3.12 | | |
| NS1 | 1095 | 1 | 3 | 3 | 0 | Y | LPPVTFRTG | 71.88 | MPPVTFRTG | 25 | LPPVTIRTG | 3.12 | | |
| NS1 | 1096 | 0.2 | 2 | 2 | 0 | Y | PPVTFRTGT | 96.88 | PPVTIRTGT | 3.12 | | | | |
| NS1 | 1097 | 0.2 | 2 | 2 | 0 | Y | PVTFRTGTD | 96.88 | PVTIRTGTD | 3.12 | | | | |
| NS1 | 1098 | 0.2 | 2 | 2 | 0 | Y | VTFRTGTDC | 96.88 | VTIRTGTDC | 3.12 | | | | |
| NS1 | 1099 | 0.2 | 2 | 2 | 0 | Y | TFRTGTDCW | 96.88 | TIRTGTDCW | 3.12 | | | | |
| NS1 | 1100 | 0.2 | 2 | 2 | 0 | Y | FRTGTDCWY | 96.88 | IRTGTDCWY | 3.12 | | | | |
| NS1 | 1101 | 0 | 1 | 1 | 0 | Y | RTGTDCWYA | 100 | | | | | | |
| NS1 | 1102 | 0 | 1 | 1 | 0 | Y | TGTDCWYAM | 100 | | | | | | |
| NS1 | 1103 | 0 | 1 | 1 | 0 | Y | GTDCWYAME | 100 | | | | | | |
| NS1 | 1104 | 0 | 1 | 1 | 0 | Y | TDCWYAMEI | 100 | | | | | | |
| NS1 | 1105 | 0 | 1 | 1 | 0 | Y | DCWYAMEIR | 100 | | | | | | |
| NS1 | 1106 | 0 | 1 | 1 | 0 | Y | CWYAMEIRP | 100 | | | | | | |
| NS1 | 1107 | 0 | 1 | 1 | 0 | Y | WYAMEIRPV | 100 | | | | | | |
| NS1 | 1108 | 0 | 1 | 1 | 0 | Y | YAMEIRPVH | 100 | | | | | | |
| NS1 | 1109 | 0 | 1 | 1 | 0 | Y | AMEIRPVHD | 100 | | | | | | |
| NS1 | 1110 | 0 | 1 | 1 | 0 | Y | MEIRPVHDQ | 100 | | | | | | |
| NS1 | 1111 | 0 | 1 | 1 | 0 | Y | EIRPVHDQG | 100 | | | | | | |
| NS1 | 1112 | 0 | 1 | 1 | 0 | Y | IRPVHDQGG | 100 | | | | | | |
| NS1 | 1113 | 0 | 1 | 1 | 0 | Y | RPVHDQGGL | 100 | | | | | | |
| NS1 | 1114 | 0.2 | 2 | 2 | 0 | Y | PVHDQGGLV | 96.88 | PVHDQGGLI | 3.12 | | | | |

Fig. 31-42

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS1 | 1115 | 0.2 | 2 | 2 | 0 | Y | VHDQGGLVR | 96.88 | VHDQGGLIR | 3.12 | | |
| NS1 | 1116 | 0.2 | 2 | 2 | 0 | Y | HDQGGLVRS | 96.88 | HDQGGLIRS | 3.12 | | |
| NS1 | 1117 | 0.4 | 3 | 3 | 0 | Y | DQGGLVRSM | 93.75 | DQGGLIRSM | 3.12 | DQGGLVRST | 3.12 |
| NS1 | 1118 | 0.4 | 3 | 3 | 0 | Y | QGGLVRSMV | 93.75 | QGGLIRSMV | 3.12 | QGGLVRSMV | 3.12 |
| NS1 | 1119 | 0.4 | 3 | 3 | 0 | Y | GGLVRSMVV | 93.75 | GGLIRSMVV | 3.12 | GGLVRSTVV | 3.12 |
| NS1 | 1120 | 0.4 | 3 | 3 | 0 | Y | GLVRSMVVA | 93.75 | GLIRSMVVA | 3.12 | GLVRSTVVA | 3.12 |
| NS1 | 1121 | 0.4 | 3 | 3 | 0 | Y | LVRSMVVAD | 93.75 | LVRSTVVAD | 3.12 | LIRSMVVAD | 3.12 |
| NS1 | 1122 | 0.4 | 3 | 3 | 0 | Y | VRSMVVADN | 93.75 | IRSMVVADN | 3.12 | VRSTVVADN | 3.12 |
| NS1 | 1123 | 0.2 | 2 | 2 | 0 | Y | RSMVVADNG | 96.88 | RSTVVADNG | 3.12 | | |
| NS1 | 1124 | 0.2 | 2 | 2 | 0 | Y | SMVVADNGE | 96.88 | STVVADNGE | 3.12 | | |
| NS1 | 1125 | 0.2 | 2 | 2 | 0 | Y | MVVADNGEL | 96.88 | TVVADNGEL | 3.12 | | |
| NS1 | 1126 | 0 | 1 | 1 | 0 | Y | VVADNGELL | 100 | | | | |
| NS1 | 1127 | 0 | 1 | 1 | 0 | Y | VADNGELLS | 100 | | | | |
| NS1 | 1128 | 0 | 1 | 1 | 0 | Y | ADNGELLSE | 100 | | | | |
| NS1 | 1129 | 0 | 1 | 1 | 0 | Y | DNGELLSEG | 100 | | | | |
| NS1 | 1130 | 0 | 1 | 1 | 0 | Y | NGELLSEGG | 100 | | | | |
| NS2A | 1131 | 1 | 2 | 2 | 0 | Y | GELLSEGGI | 50 | GELLSEGGV | 50 | | |
| NS2A | 1132 | 1 | 2 | 2 | 0 | Y | ELLSEGGIP | 50 | ELLSEGGVP | 50 | | |
| NS2A | 1133 | 1 | 2 | 2 | 0 | Y | LLSEGGIPG | 50 | LLSEGGVPG | 50 | | |
| NS2A | 1134 | 1 | 2 | 2 | 0 | Y | LSEGGIPGI | 50 | LSEGGVPGI | 50 | | |
| NS2A | 1135 | 1 | 2 | 2 | 0 | Y | SEGGIPGIV | 50 | SEGGVPGIV | 50 | | |
| NS2A | 1136 | 1 | 2 | 2 | 0 | Y | EGGIPGIVA | 50 | EGGVPGIVA | 50 | | |
| NS2A | 1137 | 1 | 2 | 2 | 0 | Y | GGIPGIVAL | 50 | GGVPGIVAL | 50 | | |
| NS2A | 1138 | 1 | 2 | 2 | 0 | Y | GVPGIVALF | 50 | GIPGIVALF | 50 | | |
| NS2A | 1139 | 1 | 2 | 2 | 0 | Y | IPGIVALFV | 50 | VPGIVALFV | 50 | | |

Fig. 31-43

Species: TBEV (8-mers)

| protein | block starting position | total peptides in block | # peptides required to cover 99% of block | gap/X fraction | 99% of block covered w/ <= 5 peptides? | block entropy | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1140 | 1 | 1 | 0 | Y | 0 | PGIVALFVW | 100 | | | | | | |
| NS2A | 1141 | 1 | 1 | 0 | Y | 0 | GIVALFVVL | 100 | | | | | | |
| NS2A | 1142 | 1 | 1 | 0 | Y | 0 | IVALFVVLE | 100 | | | | | | |
| NS2A | 1143 | 1 | 1 | 0 | Y | 0 | VALFVVLEY | 100 | | | | | | |
| NS2A | 1144 | 2 | 2 | 0 | Y | 0.81 | ALFVVLEYV | 75 | ALFVVLEYI | 25 | | | | |
| NS2A | 1145 | 2 | 2 | 0 | Y | 0.81 | LFVVLEYVI | 75 | LFVVLEYII | 25 | | | | |
| NS2A | 1146 | 2 | 2 | 0 | Y | 0.81 | FVVLEYVIR | 75 | FVVLEYIIR | 25 | | | | |
| NS2A | 1147 | 2 | 2 | 0 | Y | 0.81 | VVLEYVIRR | 75 | VVLEYIIRR | 25 | | | | |
| NS2A | 1148 | 2 | 2 | 0 | Y | 0.81 | VLEYVIRRR | 75 | VLEYIIRRR | 25 | | | | |
| NS2A | 1149 | 2 | 2 | 0 | Y | 0.81 | LEYVIRRRP | 75 | LEYIIRRRP | 25 | | | | |
| NS2A | 1150 | 2 | 2 | 0 | Y | 0.81 | EYVIRRRPA | 75 | EYIIRRRPS | 25 | | | | |
| NS2A | 1151 | 2 | 2 | 0 | Y | 0.81 | YVIRRRPAT | 75 | YIIRRRPST | 25 | | | | |
| NS2A | 1152 | 2 | 2 | 0 | Y | 0.81 | VIRRRPATG | 75 | IIRRRPSTG | 25 | | | | |
| NS2A | 1153 | 3 | 3 | 0 | Y | 0.95 | IRRRPATGT | 75 | IRRRPSTGT | 21.88 | IRRRPSTGS | 3.12 | | | |
| NS2A | 1154 | 4 | 4 | 0 | Y | 1.5 | RRRPATGTT | 59.38 | RRRPSTGTT | 21.88 | RRRPATGTA | 21.88 | | | |
| NS2A | 1155 | 4 | 4 | 0 | Y | 1.5 | RRPATGTTA | 59.38 | RRPSTGTTV | 21.88 | RRPATGTAV | 21.88 | | | |
| NS2A | 1156 | 5 | 5 | 0 | Y | 1.68 | RPATGTTAM | 56.25 | RPSTGTTVV | 21.88 | RPATGTAV | 21.88 | RRPSTGST | 3.12 | RPATGTAV | 3.12 |
| NS2A | 1157 | 5 | 5 | 0 | Y | 1.68 | PATGTTAMW | 56.25 | PSTGTTVVW | 21.88 | PATGTAVW | 21.88 | RRPSTGSTV | 3.12 | PATGTTAVW | 3.12 |
| NS2A | 1158 | 5 | 5 | 0 | Y | 1.68 | ATGTTAMWG | 56.25 | STGTTVVWG | 21.88 | ATGTAVWG | 21.88 | RPSTGSTVW | 3.12 | ATGTTAVWG | 3.12 |
| NS2A | 1159 | 5 | 5 | 0 | Y | 1.68 | TGTTAMWGG | 56.25 | TGTTVVWGG | 21.88 | TGTAVWGG | 21.88 | PSTGSTVVWG | 3.12 | TGSTVVWGG | 3.12 |
| NS2A | 1165 | 5 | 5 | 0 | Y | 1.32 | WGGIVVLAL | 71.88 | WGGVVLAL | 21.88 | WGGFVVLAL | 15.62 | STGSTVVWG | 3.12 | WGGIVLAL | 3.12 |
| NS2A | 1166 | 5 | 5 | 0 | Y | 1.32 | GGIVVLALL | 71.88 | GGVVLALLV | 15.62 | GGFVVLALL | 15.62 | TGTAVWGG | 3.12 | GGIVWFALL | 3.12 |
| NS2A | 1167 | 5 | 5 | 0 | Y | 1.32 | GIVVLALLV | 71.88 | GVVLALLV | 15.62 | GFVVLALLV | 15.62 | GGIVLALL | 3.12 | GIVVFALLV | 3.12 |
| NS2A | 1168 | 5 | 5 | 0 | Y | 1.32 | IVVLALLVT | 71.88 | VVLALLVT | 15.62 | FVVLALLVT | 15.62 | GIVVLALLV | 3.12 | IVVFALLVT | 3.12 |
| NS2A | 1169 | 3 | 3 | 0 | Y | 0.4 | VVLALLVTG | 93.75 | VVFALLVTG | 3.12 | IVVLALLVTG | 3.12 | LIVLALLVT | 3.12 | | |

Fig. 31-44

Species: TBEV (8-mers)

| protein | block starting position | block entropy | total peptides in block | # peptides required to cover 99% of block | gap/X fraction 99% of block | covered w/ <= 5 peptides? | peptides required

Fig. 31-45

Species: TBEV (8-mers)

| protein | block starting position | block entropy | total peptides in block | # peptides required to cover 99% of block | gap/X fraction | 99% of block | covered w

Fig. 31-46

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---

Fig. 31-47

Species: TBEV (8-mers)

| protein | block starting position | block entropy | total peptides in block | # peptides required to cover 99% of block | gap/X fraction | 99% of block covered w/ <= 5 peptides? | block to cover 99% of |

Fig. 31-48

Species: TBEV (8-mers)

| protein | block starting position | block entropy | total peptides in block | # peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| NS2A | 1315 | 1.79 | 5 | 5 | 0 | Y | KLIRGHREQ | 53.12 | RLIRGHREQ | 21.88 | RLLRGHREQ | 15.62 | RLLRGHREQ | 6.25 | RLLEGHREQ | 3.12 |
| NS2A | 1316 | 1.14 | 4 | 4 | 0 | Y | LIRGHREQK | 75 | LLR

Fig. 31-49

Species: TBEV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1344 | 1.04 | 3 | 3 | 0 | Y | RLLAFWELA | 68.75 | RLLAFWELS | 28.12 | RLLSFWELS | 3.12 | | |
| NS2A | 1354 | 1.44 | 4 | 4 | 0 | Y | HRGRRSFSE | 46.88 | HGRRRSFSE | 43.75 | HGKRRSFSE | 6.25 | SGRRRSFSE | 3.12 |
| NS2A | 1355 | 1.27 | 3 | 3 | 0 | Y | RGRRSFSEP | 46.88 | GRRRSFSEP | 46.88 | GKRRSFSEP | 6.25 | | |
| NS2A | 1356 | 1.27 | 3 | 3 | 0 | Y | GRRSFSEPL | 46.88 | RRRSFSEPL | 46.88 | KRRSFSEPL | 6.25 | | |
| NS2A | 1357 | 0 | 1 | 1 | 0 | Y | RRSFSEPLT | 100 | | | | | | |
| NS2A | 1358 | 0 | 1 | 1 | 0 | Y | RSFSEPLTV | 100 | | | | | | |
| NS2A | 1359 | 0 | 1 | 1 | 0 | Y | SFSEPLTVW | 100 | | | | | | |
| NS2B | 1360 | 0 | 1 | 1 | 0 | Y | FSEPLTVWG | 100 | | | | | | |
| NS2B | 1361 | 0 | 1 | 1 | 0 | Y | SEPLTVWGV | 100 | | | | | | |
| NS2B | 1362 | 0 | 1 | 1 | 0 | Y | EPLTVWGVM | 100 | | | | | | |
| NS2B | 1363 | 0 | 1 | 1 | 0 | Y | PLTVWGVML | 100 | | | | | | |
| NS2B | 1364 | 0 | 1 | 1 | 0 | Y | LTVWGVMLT | 100 | | | | | | |
| NS2B | 1365 | 0 | 1 | 1 | 0 | Y | TVWGVMLTL | 100 | | | | | | |
| NS2B | 1366 | 0 | 1 | 1 | 0 | Y | VWGVMLTLA | 100 | | | | | | |
| NS2B | 1367 | 0.63 | 2 | 2 | 0 | Y | VGVMLTLAS | 84.38 | VGVMLTLAG | 15.62 | | | | |
| NS2B | 1368 | 0.63 | 2 | 2 | 0 | Y | GVMLTLASG | 84.38 | GVMLTLAGG | 15.62 | | | | |
| NS2B | 1369 | 0.63 | 2 | 2 | 0 | Y | VMLTLASGM | 84.38 | VMLTLAGGM | 15.62 | | | | |
| NS2B | 1370 | 0.63 | 2 | 2 | 0 | Y | MLTLASGMM | 84.38 | MLTLAGGMM | 15.62 | | | | |
| NS2B | 1371 | 0.63 | 2 | 2 | 0 | Y | LTLASGMMR | 84.38 | LTLAGGMMR | 15.62 | | | | |
| NS2B | 1372 | 0.63 | 2 | 2 | 0 | Y | TLASGMMRH | 84.38 | TLAGGMMRH | 15.62 | | | | |
| NS2B | 1373 | 0.63 | 2 | 2 | 0 | Y | LASGMMRHT | 84.38 | LAGGMMRHT | 15.62 | | | | |
| NS2B | 1374 | 0.82 | 3 | 3 | 0 | Y | ASGMMRHTS | 81.25 | AGGMMRHTS | 15.62 | ASGMMRHTP | 3.12 | | |
| NS2B | 1375 | 0.82 | 3 | 3 | 0 | Y | SGMMRHTSQ | 81.25 | GGMMRHTSQ | 15.62 | SGMMRHTPQ | 3.12 | | |
| NS2B | 1376 | 0.2 | 2 | 2 | 0 | Y | GMMRHTSQE | 96.88 | GMMRHTPQE | 3.12 | | | | |
| NS2B | 1377 | 0.2 | 2 | 2 | 0 | Y | MMRHTSQEA | 96.88 | MMRHTPQEA | 3.12 | | | | |

Fig. 31-50

Species: TBEV (8-mers)

| protein | block starting position | block entropy | total peptides in block | # peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency | block to cover 99% of block | frequency |
|---|---|---|---|---|---|---|---|---|---|---|---|---|---|---|---|---|
| NS2B | 1378 | 0.2 | 2 | 2 | 0 | Y | MRHTSQEAL | 96.88 | MRHTPQEAL | 3.12 | | | | | | |
| NS2B | 1379 | 0.2 | 2 | 2 | 0 | Y | RHTSQEALC | 96.88 | RHTPQEALC | 3.12 | | | | | | |
| NS2B | 1380 | 0.2 | 2 | 2 | 0 | Y | HTSQEALCA | 96.88 | HTPQEALCA | 3.12 | | | | | | |
| NS2B | 1381 | 0.2 | 2 | 2 | 0 | Y | TSQEALCAL | 96.88 | TPQEALCAL | 3.12 | | | | | | |
| NS2B | 1382 | 0.2 | 2 | 2 | 0 | Y | SQEALCALA | 96.88 | PQEALCALA | 3.12 | | | | | | |
| NS2B | 1383 | 0 | 1 | 1 | 0 | Y | QEALCALAV | 100 | | | | | | | | |
| NS2B | 1384 | 0 | 1 | 1 | 0 | Y | EALCALAVA | 100 | | | | | | | | |
| NS2B | 1385 | 0 | 1 | 1 | 0 | Y | ALCALAVAS | 100 | | | | | | | | |
| NS2B | 1386 | 0 | 1 | 1 | 0 | Y | LCALAVASF | 100 | | | | | | | | |
| NS2B | 1387 | 0 | 1 | 1 | 0 | Y | CALAVASFL | 100 | | | | | | | | |
| NS2B | 1388 | 0 | 1 | 1 | 0 | Y | ALAVASFLL | 100 | | | | | | | | |
| NS2B | 1389 | 0 | 1 | 1 | 0 | Y | LAVASFLLL | 100 | | | | | | | | |
| NS2B | 1390 | 0 | 1 | 1 | 0 | Y | AVASFLLLM | 100 | | | | | | | | |
| NS2B | 1391 | 0 | 1 | 1 | 0 | Y | VASFLLLML | 100 | | | | | | | | |
| NS2B | 1392 | 0 | 1 | 1 | 0 | Y | ASFLLLMLV | 100 | | | | | | | | |
| NS2B | 1393 | 0 | 1 | 1 | 0 | Y | SFLLLMLVL | 100 | | | | | | | | |
| NS2B | 1394 | 0 | 1 | 1 | 0 | Y | FLLLMLVLG | 100 | | | | | | | | |
| NS2B | 1395 | 0 | 1 | 1 | 0 | Y | LLLMLVLGT | 100 | | | | | | | | |
| NS2B | 1396 | 0 | 1 | 1 | 0 | Y | LLMLVLGTR | 100 | | | | | | | | |
| NS2B | 1397 | 0 | 1 | 1 | 0 | Y | LMLVLGTRK | 100 | | | | | | | | |
| NS2B | 1398 | 0 | 1 | 1 | 0 | Y | MLVLGTRKM | 100 | | | | | | | | |
| NS2B | 1399 | 0 | 1 | 1 | 0 | Y | LVLGTRKMQ | 100 | | | | | | | | |
| NS2B | 1400 | 0 | 1 | 1 | 0 | Y | VLGTRKMQL | 100 | | | | | | | | |
| NS2B | 1401 | 0 | 1 | 1 | 0 | Y | LGTRKMQLV | 100 | | | | | | | | |
| NS2B | 1402 | 0 | 1 | 1 | 0 | Y | GTRKMQLVA | 100 | | | | | | | | |

Fig. 31-51

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1403 | 0 | 1 | 1 | 0 | Y | TRKMQLVAE | 100 | | | | | | | | |
| NS2B | 1404 | 0 | 1 | 1 | 0 | Y | RKMQLVAEW | 100 | | | | | | | | |
| NS2B | 1405 | 0 | 1 | 1 | 0 | Y | KMQLVAEWS | 100 | | | | | | | | |
| NS2B | 1406 | 0 | 1 | 1 | 0 | Y | MQLVAEWSG | 100 | | | | | | | | |
| NS2B | 1407 | 0 | 1 | 1 | 0 | Y | QLVAEWSGC | 100 | | | | | | | | |
| NS2B | 1408 | 0 | 1 | 1 | 0 | Y | LVAEWSGCV | 100 | | | | | | | | |
| NS2B | 1409 | 0 | 1 | 1 | 0 | Y | VAEWSGCVE | 100 | | | | | | | | |
| NS2B | 1410 | 0 | 1 | 1 | 0 | Y | AEWSGCVEW | 100 | | | | | | | | |
| NS2B | 1411 | 0.34 | 2 | 2 | 0 | Y | EWSGCVEWH | 93.75 | EWSGCVEWY | 6.25 | | | | | | |
| NS2B | 1412 | 0.34 | 2 | 2 | 0 | Y | WSGCVEWHP | 93.75 | WSGCVEWYP | 6.25 | | | | | | |
| NS2B | 1413 | 0.34 | 2 | 2 | 0 | Y | SGCVEWHPE | 93.75 | SGCVEWYPE | 6.25 | | | | | | |
| NS2B | 1414 | 0.34 | 2 | 2 | 0 | Y | GCVEWHPEL | 93.75 | GCVEWYPEL | 6.25 | | | | | | |
| NS2B | 1415 | 1.25 | 3 | 3 | 0 | Y | CVEWHPELM | 56.25 | CVEWHPELV | 37.5 | CVEWYPELV | 6.25 | | | | |
| NS2B | 1416 | 1.25 | 3 | 3 | 0 | Y | VEWHPELMN | 56.25 | VEWHPELVN | 37.5 | VEWYPELVN | 6.25 | | | | |
| NS2B | 1417 | 1.25 | 3 | 3 | 0 | Y | EWHPELMNE | 56.25 | EWHPELVNE | 37.5 | EWYPELVNE | 6.25 | | | | |
| NS2B | 1418 | 1.25 | 3 | 3 | 0 | Y | WHPELMNEG | 56.25 | WHPELVNEG | 37.5 | WYPELVNEG | 6.25 | | | | |
| NS2B | 1419 | 1.25 | 3 | 3 | 0 | Y | HPELMNEGG | 56.25 | HPELVNEGG | 37.5 | YPELVNEGG | 6.25 | | | | |
| NS2B | 1420 | 0.99 | 2 | 2 | 0 | Y | PELMNEGGE | 56.25 | PELVNEGGE | 43.75 | | | | | | |
| NS2B | 1421 | 0.99 | 2 | 2 | 0 | Y | ELMNEGGEV | 56.25 | ELVNEGGEV | 43.75 | | | | | | |
| NS2B | 1422 | 0.99 | 2 | 2 | 0 | Y | LMNEGGEVS | 56.25 | LVNEGGEVS | 43.75 | | | | | | |
| NS2B | 1423 | 0.99 | 2 | 2 | 0 | Y | MNEGGEVSL | 56.25 | VNEGGEVSL | 43.75 | | | | | | |
| NS2B | 1424 | 0 | 1 | 1 | 0 | Y | NEGGEVSLR | 100 | | | | | | | | |
| NS2B | 1425 | 0 | 1 | 1 | 0 | Y | EGGEVSLRV | 100 | | | | | | | | |
| NS2B | 1426 | 0 | 1 | 1 | 0 | Y | GGEVSLRVR | 100 | | | | | | | | |
| NS2B | 1427 | 0 | 1 | 1 | 0 | Y | GEVSLRVRQ | 100 | | | | | | | | |

Fig. 31-52

Species: TBEV (8-mers)

| protein | block starting position | block entropy | total peptides in block | # peptides required to cover 99% of block | gap/X fraction | 99% of block covered w/ <= 5 peptides? | peptides required to cover 99

Fig. 31-53

Species: TBEV

Fig. 31-54

Species: TBEV (8-mers)

| protein | block starting position | block entropy (8-mers) | total peptides in block | # peptides required to cover 99% of block | gap/X fraction | 99% of block covered w/ <=5 peptides? | block to cover 99% of peptides required

Fig. 31-55

| protein | block starting position | block entropy (8-mers) | total peptides in block | # peptides required to cover 99% of block | gap/X fraction | 99% of block covered w/ <= 5 peptides? | block (to cover 99% of block) | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1513 | 0 | 1 | 1 | 0 | Y | YRIFSPGL | 100 | | | | | | |
| NS3 | 1514 | 0.86 | 2 | 2 | 0 | Y | YRIFSPGLL | 71.88 | YRIFSPGLF | 28.12 | | | | |
| NS3 | 1515 | 0.86 | 2 | 2 | 0 | Y | RIFSPGLLW | 71.88 | RIFSPGLFW | 28.12 | | | | |
| NS3 | 1516 | 0.86 | 2 | 2 | 0 | Y | IFSPGLLWG | 71.88 | IFSPGLFWG | 28.12 | | | | |
| NS3 | 1517 | 0.86 | 2 | 2 | 0 | Y | FSPGLLWGQ | 71.88 | FSPGLFWGQ | 28.12 | | | | |
| NS3 | 1518 | 1.13 | 4 | 4 | 0 | Y | SPGLLWGQR | 71.88 | SPGLFWGQN | 21.88 | SPGLFWGQR | 3.12 | SPGLFWGQS | 3.12 |
| NS3 | 1519 | 1.13 | 4 | 4 | 0 | Y | PGLLWGQRQ | 71.88 | PGLFWGQNQ | 21.88 | PGLFWGQRQ | 3.12 | PGLFWGQSQ | 3.12 |
| NS3 | 1520 | 1.13 | 4 | 4 | 0 | Y | GLLWGQRQV | 71.88 | GLFWGQNQV | 21.88 | GLFWGQSQV | 3.12 | GLFWGQRQV | 3.12 |
| NS3 | 1521 | 1.13 | 4 | 4 | 0 | Y | LLWGQRQVG | 71.88 | LFWGQNQVG | 21.88 | LFWGQSQVG | 3.12 | LFWGQRQVG | 3.12 |
| NS3 | 1522 | 1.13 | 4 | 4 | 0 | Y | LWGQRQVGV | 71.88 | FWGQNQVGV | 21.88 | FWGQSQVGV | 3.12 | FWGQRQVGV | 3.12 |
| NS3 | 1523 | 0.95 | 3 | 3 | 0 | Y | WGQRQVGVG | 75 | WGQNQVGVG | 21.88 | WGQSQVGVG | 3.12 | | |
| NS3 | 1524 | 0.95 | 3 | 3 | 0 | Y | GQRQVGVGY | 75 | GQNQVGVGY | 21.88 | GQSQVGVGY | 3.12 | | |
| NS3 | 1525 | 0.95 | 3 | 3 | 0 | Y | QRQVGVGYG | 75 | QNQVGVGYG | 21.88 | QSQVGVGYG | 3.12 | | |
| NS3 | 1526 | 1.68 | 4 | 4 | 0 | Y | RQVGVGYGF | 43.75 | RQVGVGYGS | 31.25 | NQVGVGYGS | 21.88 | SQVGVGYGS | 3.12 |
| NS3 | 1527 | 1.15 | 3 | 3 | 0 | Y | QVGVGYGSK | 56.25 | QVGVGYGFK | 40.62 | QVGVGYGFR | 3.12 | | |
| NS3 | 1528 | 1.15 | 3 | 3 | 0 | Y | VGVGYGSKG | 56.25 | VGVGYGFKG | 40.62 | VGVGYGFRG | 3.12 | | |
| NS3 | 1529 | 1.15 | 3 | 3 | 0 | Y | GVGYGSKGV | 56.25 | GVGYGFKGV | 40.62 | GVGYGFRGV | 3.12 | | |
| NS3 | 1530 | 1.15 | 3 | 3 | 0 | Y | VGYGSKGVL | 56.25 | VGYGFKGVL | 40.62 | VGYGFRGVL | 3.12 | | |
| NS3 | 1531 | 1.15 | 3 | 3 | 0 | Y | GYGSKGVLH | 56.25 | GYGFKGVLH | 40.62 | GYGFRGVLH | 3.12 | | |
| NS3 | 1532 | 1.15 | 3 | 3 | 0 | Y | YGSKGVLHT | 56.25 | YGFKGVLHT | 40.62 | YGFRGVLHT | 3.12 | | |
| NS3 | 1533 | 1.15 | 3 | 3 | 0 | Y | GSKGVLHTM | 56.25 | GFKGVLHTM | 40.62 | GFRGVLHTM | 3.12 | | |
| NS3 | 1534 | 1.15 | 3 | 3 | 0 | Y | SKGVLHTMW | 56.25 | FKGVLHTMW | 40.62 | FRGVLHTMW | 3.12 | | |
| NS3 | 1535 | 0.2 | 2 | 2 | 0 | Y | KGVLHTMWH | 96.88 | RGVLHTMWH | 3.12 | | | | |
| NS3 | 1536 | 0 | 1 | 1 | 0 | Y | GVLHTMWHV | 100 | | | | | | |
| NS3 | 1537 | 0 | 1 | 1 | 0 | Y | VLHTMWHVT | 100 | | | | | | |

Species: TBEV

Fig. 31-56

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to

Fig. 31-57

Species: TBEV (8-mers)

| protein | block starting position | block entropy | total peptides in block | # peptides required to cover 99% of block | gap/X fraction | 99% of block covered w/ <= 5 peptides? | block to cover 99% of | frequency | block

Fig. 31-58

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | fr

Fig. 31-59

Species: TBEV (8-mers)

| protein | block starting position | block entropy | total peptides in block | # peptides required to cover 99% of block | gap/X fraction | 99% of block

Fig. 31-60

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1647 | 0.2 | 2 | 2 | 0 | Y | KTNETYSS | 96.88 | KTNGTYSS | 3.12 | | | | |
| NS3 | 1648 | 0.2 | 2 | 2 | 0 | Y | TNETYSSI | 96.88 | TNGTYSSI | 3.12 | | | | |
| NS3 | 1649 | 0.2 | 2 | 2 | 0 | Y | NETYSSIA | 96.88 | NGTYSSIA | 3.12 | | | | |
| NS3 | 1650 | 0.2 | 2 | 2 | 0 | Y | ETYSSIAQ | 96.88 | GTYSSIAQ | 3.12 | | | | |
| NS3 | 1651 | 0 | 1 | 1 | 0 | Y | TYSSIAQG | 100 | | | | | | |
| NS3 | 1652 | 0 | 1 | 1 | 0 | Y | YSSIAQGE | 100 | | | | | | |
| NS3 | 1653 | 0.45 | 2 | 2 | 0 | Y | VSSIAQGEA | 90.62 | VSSIAQGEV | 9.38 | | | | |
| NS3 | 1654 | 0.45 | 2 | 2 | 0 | Y | SSIAQGEAE | 90.62 | SSIAQGEVE | 9.38 | | | | |
| NS3 | 1655 | 0.64 | 3 | 3 | 0 | Y | SIAQGEAEK | 87.5 | SIAQGEVEK | 9.38 | SIAQGEAER | 3.12 | | |
| NS3 | 1656 | 0.64 | 3 | 3 | 0 | Y | IAQGEAEKS | 87.5 | IAQGEVEKS | 9.38 | IAQGEAERS | 3.12 | | |
| NS3 | 1657 | 0.64 | 3 | 3 | 0 | Y | AQGEAEKSR | 87.5 | AQGEVEKSR | 9.38 | AQGEAERSR | 3.12 | | |
| NS3 | 1658 | 0.64 | 3 | 3 | 0 | Y | QGEAEKSRP | 87.5 | QGEVEKSRP | 9.38 | QGEAERSRP | 3.12 | | |
| NS3 | 1659 | 0.84 | 4 | 4 | 0 | Y | GEAEKSRPN | 84.38 | GEVEKSRPN | 9.38 | GEAERSRPN | 3.12 | GEAERSRPN | 3.12 |
| NS3 | 1660 | 0.84 | 4 | 4 | 0 | Y | EAEKSRPNL | 84.38 | EVEKSRPNL | 9.38 | EAERSRPNL | 3.12 | EAEKSRPSL | 3.12 |
| NS3 | 1661 | 0.84 | 4 | 4 | 0 | Y | AEKSRPNLP | 84.38 | VEKSRPNLP | 9.38 | AERSRPNLP | 3.12 | AEKSRPSLP | 3.12 |
| NS3 | 1662 | 1.33 | 4 | 4 | 0 | Y | EKSRPNLPP | 50 | EKSRPNLPQ | 43.75 | EKSRPSLPP | 3.12 | ERSRPNLPQ | 3.12 |
| NS3 | 1663 | 1.33 | 4 | 4 | 0 | Y | KSRPNLPPA | 50 | KSRPNLPQA | 43.75 | RSRPSLPPA | 3.12 | KSRPSLPPA | 3.12 |
| NS3 | 1664 | 1.17 | 3 | 3 | 0 | Y | SRPNLPPAV | 50 | SRPNLPQAV | 46.88 | SRPSLPPAV | 3.12 | | |
| NS3 | 1674 | 1.52 | 5 | 5 | 0 | Y | GTGWTAKGQ | 59.38 | GTGWTSKGQ | 28.12 | GMGWTAKGQ | 6.25 | GIGWTAKGQ | 3.12 |
| NS3 | 1675 | 1.52 | 5 | 5 | 0 | Y | TGWTAKGQI | 59.38 | TGWTSKGQI | 28.12 | MGWTAKGQI | 6.25 | IGWTAKGQI | 3.12 |
| NS3 | 1676 | 0.86 | 2 | 2 | 0 | Y | GWTAKGQIT | 71.88 | GWTSKGQIT | 28.12 | | | | |
| NS3 | 1677 | 0.86 | 2 | 2 | 0 | Y | WTAKGQITV | 71.88 | WTSKGQITV | 28.12 | | | | |
| NS3 | 1678 | 0.86 | 2 | 2 | 0 | Y | TAKGQITVL | 71.88 | TSKGQITVL | 28.12 | | | | |
| NS3 | 1679 | 0.86 | 2 | 2 | 0 | Y | AKGQITVLD | 71.88 | SKGQITVLD | 28.12 | | | | |
| NS3 | 1680 | 0 | 1 | 1 | 0 | Y | KGQITVLDM | 100 | | | | | | |

Additional 5th column entries:
- Position 1674: GSGWTAKGQ, frequency 3.12
- Position 1675: SGWTAKGQI, frequency 3.12

Fig. 31-61

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1681 | 0 | 1 | 1 | 0 | Y | GQITVLDMH | 100 | | |
| NS3 | 1682 | 0 | 1 | 1 | 0 | Y | QITVLDMHP | 100 | | |
| NS3 | 1683 | 0 | 1 | 1 | 0 | Y | ITVLDMHPG | 100 | | |
| NS3 | 1684 | 0 | 1 | 1 | 0 | Y | TVLDMHPGS | 100 | | |
| NS3 | 1685 | 0 | 1 | 1 | 0 | Y | VLDMHPGSG | 100 | | |
| NS3 | 1686 | 0 | 1 | 1 | 0 | Y | LDMHPGSGK | 100 | | |
| NS3 | 1687 | 0 | 1 | 1 | 0 | Y | DMHPGSGKT | 100 | | |
| NS3 | 1688 | 0 | 1 | 1 | 0 | Y | MHPGSGKTH | 100 | | |
| NS3 | 1689 | 0 | 1 | 1 | 0 | Y | HPGSGKTHR | 100 | | |
| NS3 | 1690 | 0 | 1 | 1 | 0 | Y | PGSGKTHRV | 100 | | |
| NS3 | 1691 | 0 | 1 | 1 | 0 | Y | GSGKTHRVL | 100 | | |
| NS3 | 1692 | 0 | 1 | 1 | 0 | Y | SGKTHRVLP | 100 | | |
| NS3 | 1693 | 0 | 1 | 1 | 0 | Y | GKTHRVLPE | 100 | | |
| NS3 | 1694 | 0 | 1 | 1 | 0 | Y | KTHRVLPEL | 100 | | |
| NS3 | 1695 | 0 | 1 | 1 | 0 | Y | THRVLPELI | 100 | | |
| NS3 | 1696 | 0 | 1 | 1 | 0 | Y | HRVLPELIR | 100 | | |
| NS3 | 1697 | 0 | 1 | 1 | 0 | Y | RVLPELIRQ | 100 | | |
| NS3 | 1698 | 0 | 1 | 1 | 0 | Y | VLPELIRQC | 100 | | |
| NS3 | 1699 | 0.2 | 2 | 2 | 0 | Y | LPELIRQCI | 96.88 | LPELIRQCT | 3.12 |
| NS3 | 1700 | 0.2 | 2 | 2 | 0 | Y | PELIRQCID | 96.88 | PELIRQCTD | 3.12 |
| NS3 | 1701 | 0.2 | 2 | 2 | 0 | Y | ELIRQCIDR | 96.88 | ELIRQCTDR | 3.12 |
| NS3 | 1702 | 0.2 | 2 | 2 | 0 | Y | LIRQCIDRR | 96.88 | LIRQCTDRR | 3.12 |
| NS3 | 1703 | 0.2 | 2 | 2 | 0 | Y | IRQCIDRRL | 96.88 | IRQCTDRRL | 3.12 |
| NS3 | 1704 | 0.2 | 2 | 2 | 0 | Y | RQCIDRRLR | 96.88 | RQCTDRRLR | 3.12 |
| NS3 | 1705 | 0.2 | 2 | 2 | 0 | Y | QCIDRRLRT | 96.88 | QCTDRRLRT | 3.12 |

Fig. 31-62

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of

Fig. 31-63

Species: TBEV (8-mers)

| protein | block starting position | block

Fig. 31-64

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1763 | 0 | 1 | 1 | 0 | Y | RRLLPQGRQ | 100 | | |
| NS3 | 1764 | 0 | 1 | 1 | 0 | Y | RLLPQGRQN | 100 | | |
| NS3 | 1765 | 0 | 1 | 1 | 0 | Y | LLPQGRQNW | 100 | | |
| NS3 | 1766 | 0 | 1 | 1 | 0 | Y | LPQGRQNWE | 100 | | |
| NS3 | 1

Fig. 31-65

Species: TBEV (8

Fig. 31-66

Species: TBEV (8-mers)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block

Fig. 31-67

Species: TBEV (8-mers)

| protein | block starting position | block entropy | total pe

Fig. 31-68

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1864 | 1.64 | 4 | 4 | 0 | Y | GIIARTLRQ | 50 | GIIARTLRQ | 25 | GVIARTLRQ | 21.88 | GIIARALRQ | 3.12 |
| NS3 | 1865 | 1.64 | 4 | 4 | 0 | Y | IIARTLRQK | 50 | AIARTLRQK | 25 | VIARTLRQK | 21.88 | IIARALRQK | 3.12 |
| NS3 | 1866 | 0.2 | 2 | 2 | 0 | Y | IARTLRQKG | 96.88 | IARALRQKG | 3.12 | | | | |
| NS3 | 1867 | 0.2 | 2 | 2 | 0 | Y | ARTLRQKGK | 96.88 | ARALRQKGK | 3.12 | | | | |
| NS3 | 1868 | 0.2 | 2 | 2 | 0 | Y | RTLRQKGKS | 96.88 | RALRQKGKS | 3.12 | | | | |
| NS3 | 1869 | 0.2 | 2 | 2 | 0 | Y | TLRQKGKSV | 96.88 | ALRQKGKSV | 3.12 | | | | |
| NS3 | 1870 | 0 | 1 | 1 | 0 | Y | LRQKGKSVI | 100 | | | | | | |
| NS3 | 1871 | 0 | 1 | 1 | 0 | Y | RQKGKSVIC | 100 | | | | | | |
| NS3 | 1872 | 0 | 1 | 1 | 0 | Y | QKGKSVICL | 100 | | | | | | |
| NS3 | 1873 | 0 | 1 | 1 | 0 | Y | KGKSVICLN | 100 | | | | | | |
| NS3 | 1874 | 0 | 1 | 1 | 0 | Y | GKSVICLNS | 100 | | | | | | |
| NS3 | 1875 | 0 | 1 | 1 | 0 | Y | KSVICLNSK | 100 | | | | | | |
| NS3 | 1876 | 0 | 1 | 1 | 0 | Y | SVICLNSKT | 100 | | | | | | |
| NS3 | 1877 | 0 | 1 | 1 | 0 | Y | VICLNSKTF | 100 | | | | | | |
| NS3 | 1878 | 0 | 1 | 1 | 0 | Y | ICLNSKTFE | 100 | | | | | | |
| NS3 | 1879 | 0 | 1 | 1 | 0 | Y | CLNSKTFEK | 100 | | | | | | |
| NS3 | 1880 | 0 | 1 | 1 | 0 | Y | LNSKTFEKD | 100 | | | | | | |
| NS3 | 1881 | 0 | 1 | 1 | 0 | Y | NSKTFEKDY | 100 | | | | | | |
| NS3 | 1882 | 0.63 | 2 | 2 | 0 | Y | SKTFEKDYS | 84.38 | SKTFEKDYT | 15.62 | | | | |
| NS3 | 1883 | 0.63 | 2 | 2 | 0 | Y | KTFEKDYSR | 84.38 | KTFEKDYTR | 15.62 | | | | |
| NS3 | 1884 | 0.63 | 2 | 2 | 0 | Y | TFEKDYSRV | 84.38 | TFEKDYTRV | 15.62 | | | | |
| NS3 | 1885 | 0.63 | 2 | 2 | 0 | Y | FEKDYSRVR | 84.38 | FEKDYTRVR | 15.62 | | | | |
| NS3 | 1886 | 0.63 | 2 | 2 | 0 | Y | EKDYSRVRD | 84.38 | EKDYTRVRD | 15.62 | | | | |
| NS3 | 1887 | 0.63 | 2 | 2 | 0 | Y | KDYSRVRDE | 84.38 | KDYTRVRDE | 15.62 | | | | |
| NS3 | 1888 | 0.63 | 2 | 2 | 0 | Y | DYSRVRDEK | 84.38 | DYTRVRDEK | 15.62 | | | | |

Fig. 31-69

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 31-70

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1914 | 0 | 1 | 1 | 0 | Y | VSRVIDGRT | 100 | | | | | | |
| NS3 | 1915 | 0 | 1 | 1 | 0 | Y | SRVIDGRTN | 100 | | | | | | |
| NS3 | 1916 | 0 | 1 | 1 | 0 | Y | RVIDGRTNI | 100 | | | | | | |
| NS3 | 1917 | 0 | 1 | 1 | 0 | Y | VIDGRTNIK | 100 | | | | | | |
| NS3 | 1918 | 0 | 1 | 1 | 0 | Y | IDGRTNIKP | 100 | | | | | | |
| NS3 | 1919 | 0 | 1 | 1 | 0 | Y | DGRTNIKPE | 100 | | | | | | |
| NS3 | 1920 | 0 | 1 | 1 | 0 | Y | GRTNIKPEE | 100 | | | | | | |
| NS3 | 1921 | 0 | 1 | 1 | 0 | Y | RTNIKPEEV | 100 | | | | | | |
| NS3 | 1922 | 0 | 1 | 1 | 0 | Y | TNIKPEEVD | 100 | | | | | | |
| NS3 | 1923 | 0 | 1 | 1 | 0 | Y | NIKPEEVDG | 100 | | | | | | |
| NS3 | 1924 | 0.81 | 2 | 2 | 0 | Y | IKPEEVDGR | 75 | IKPEEVDGK | 25 | | | | |
| NS3 | 1925 | 0.81 | 2 | 2 | 0 | Y | KPEEVDGRV | 75 | KPEEVDGKV | 25 | | | | |
| NS3 | 1926 | 0.81 | 2 | 2 | 0 | Y | PEEVDGRVE | 75 | PEEVDGKVE | 25 | | | | |
| NS3 | 1927 | 0.81 | 2 | 2 | 0 | Y | EEVDGRVEL | 75 | EEVDGKVEL | 25 | | | | |
| NS3 | 1928 | — | 3 | 3 | 0 | Y | EVDGRVELT | 71.88 | EVDGKVELT | 25 | EVDGRVELI | 3.12 | | |
| NS3 | 1929 | — | 3 | 3 | 0 | Y | VDGRVELTG | 71.88 | VDGKVELTG | 25 | VDGRVELIG | 3.12 | | |
| NS3 | 1930 | — | 3 | 3 | 0 | Y | DGRVELTGT | 71.88 | DGKVELTGT | 25 | DGRVELIGT | 3.12 | | |
| NS3 | 1931 | — | 3 | 3 | 0 | Y | GRVELTGTR | 71.88 | GKVELTGTR | 25 | GRVELIGTR | 3.12 | | |
| NS3 | 1932 | 0.2 | 3 | 2 | 0 | Y | RVELTGTRR | 96.88 | KVELTGTRR | 25 | RVELIGTRR | 3.12 | | |
| NS3 | 1933 | 0.2 | 3 | 2 | 0 | Y | VELTGTRRV | 96.88 | VELIGTRRV | 3.12 | | | | |
| NS3 | 1934 | 0.2 | 3 | 2 | 0 | Y | ELTGTRRVT | 96.88 | ELIGTRRVT | 3.12 | | | | |
| NS3 | 1935 | 0.2 | 3 | 2 | 0 | Y | LTGTRRVTT | 96.88 | LIGTRRVTT | 3.12 | | | | |
| NS3 | 1936 | 0.2 | 3 | 2 | 0 | Y | TGTRRVTTA | 96.88 | IGTRRVTTA | 3.12 | | | | |
| NS3 | 1937 | 0 | 1 | 1 | 0 | Y | GTRRVTTAS | 100 | | | | | | |
| NS3 | 1938 | 0 | 1 | 1 | 0 | Y | TRRVTTASA | 100 | | | | | | |

Fig. 31-71

Species: TBEV (8-mers)

| protein | block starting position | block entropy | total peptides in block | # peptides required to cover 99% of block | gap/X fraction | 99% of block covered w/ <= 5 peptides? | peptides required to cover 99

Fig. 31-72

Species: TBEV (8-mers)

| protein | block starting position | block entropy |

Fig. 31-73

Species: TBEV (8-mers)

| protein | block starting position | block entropy | total peptides in block | # peptides required to cover 99% of block | gap/X fraction | 99% of block covered w/ <= 5 peptides? | peptides required

Fig. 31-74

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |

Fig. 31-75

Species: TBEV (8-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 2039 | 0.2 | 2 | 2 | 0 | Y | WHVAANVSS | 96.88 | WHVAANVSG | 3.12 | | | | |
| NS3 | 2040 | 0.2 | 2 | 2 | 0 | Y | HVAANVSSV | 96.88 | HVAANVSGV | 3.12 | | | | |
| NS3 | 2041 | 0.2 | 2 | 2 | 0 | Y | VAANVSSVT | 96.88 | VAANVSGVT | 3.12 | | | | |
| NS3 | 2042 | 1 | 3 | 3 | 0 | Y | AANVSSVTS | 71.88 | AANVSSVTD | 25 | AANVSGVTS | 3.12 | | |
| NS3 | 2043 | 1 | 3 | 3 | 0 | Y | ANVSSVTSR | 71.88 | ANVSSVTDR | 25 | ANVSGVTSR | 3.12 | | |
| NS3 | 2044 | 1.18 | 4 | 4 | 0 | Y | NVSSVTSRN | 68.75 | NVSSVTDRS | 25 | NVSGVTSRS | 3.12 | NVSGVTSRN | 3.12 |
| NS3 | 2045 | 1.18 | 4 | 4 | 0 | Y | VSSVTSRNW | 68.75 | VSSVTDRSW | 25 | VSGVTSRSW | 3.12 | VSGVTSRNW | 3.12 |
| NS3 | 2046 | 1.18 | 4 | 4 | 0 | Y | SSVTSRNWT | 68.75 | SSVTDRSWT | 25 | SGVTSRSWT | 3.12 | SSVTSRSWT | 3.12 |
| NS3 | 2047 | 1.18 | 4 | 4 | 0 | Y | SVTSRNWTW | 68.75 | SVTDRSWTW | 25 | GVTSRNWTW | 3.12 | SVTSRSWTW | 3.12 |
| NS3 | 2048 | 1 | 3 | 3 | 0 | Y | VTSRNWTWE | 71.88 | VTDRSWTWE | 25 | VTSRSWTWE | 3.12 | | |
| NS3 | 2049 | 1 | 3 | 3 | 0 | Y | TSRNWTWEG | 71.88 | TDRSWTWEG | 25 | TSRWTWEG | 3.12 | | |
| NS3 | 2050 | 1 | 3 | 3 | 0 | Y | SRNWTWEGP | 71.88 | DRSWTWEGP | 25 | SRSWTWEGP | 3.12 | | |
| NS3 | 2051 | 0.86 | 2 | 2 | 0 | Y | RNWTWEGPE | 71.88 | RSWTWEGPE | 28.12 | | | | |
| NS3 | 2052 | 1 | 3 | 3 | 0 | Y | NWTWEGPEE | 75 | SWTWEGPEA | 25 | SWTWEGPEE | 3.12 | | |
| NS3 | 2053 | 0.81 | 2 | 2 | 0 | Y | WTWEGPEEN | 50 | WTWEGPEAN | 25 | | | | |
| NS3 | 2054 | 1.5 | 3 | 3 | 0 | Y | TWEGPEENT | 50 | TWEGPEENA | 25 | TWEGPEANA | 25 | | |
| NS3 | 2055 | 1.5 | 3 | 3 | 0 | Y | WEGPEENTV | 50 | WEGPEENAV | 25 | WEGPEENAV | 25 | | |
| NS3 | 2056 | 1.5 | 3 | 3 | 0 | Y | EGPEENTVD | 50 | EGPEANAVD | 25 | EGPEANAVD | 25 | | |
| NS3 | 2057 | 1.5 | 3 | 3 | 0 | Y | GPEENTVDE | 50 | GPEENAVDE | 25 | GPEANAVD | 25 | | |
| NS3 | 2058 | 1.5 | 3 | 3 | 0 | Y | PEENTVDEA | 50 | PEENAVDEA | 25 | PEAMAVDEA | 25 | | |
| NS3 | 2059 | 1.5 | 3 | 3 | 0 | Y | EENTVDEAN | 50 | EANAVDEAS | 25 | EENAVDEAN | 25 | | |
| NS3 | 2060 | 1.5 | 3 | 3 | 0 | Y | ENTVDEANG | 50 | ANAVDEASG | 25 | ENAVDEANG | 25 | | |
| NS3 | 2061 | 1.64 | 4 | 4 | 0 | Y | NTVDEANGD | 50 | NAVDEANGD | 25 | NAVDEASGD | 21.88 | NAVDEASGG | 3.12 |
| NS3 | 2062 | 1.64 | 4 | 4 | 0 | Y | TVDEANGDL | 50 | AVDEANGDL | 25 | AVDEASGDL | 21.88 | AVDEASGGL | 3.12 |
| NS3 | 2063 | 0.95 | 3 | 3 | 0 | Y | VDEANGDLV | 75 | VDEASGDLV | 21.88 | VDEASGGLV | 3.12 | | |

Fig. 31-76

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to c

Fig. 31-77

Species: TBEV (

Fig. 31-78

Species: TBEV (8-mers)

| protein | block starting position | block entropy | total peptides in block | #

Fig. 31-79

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 31-80

Species: TBEV (8-mers)

| protein | block starting position | block entropy | total peptides in block | # peptides required to cover 99% of block | gap/X fraction | 99% of block covered w/ <= 5 peptides? | block (to cover 99%) | frequency | block (to cover 99%) | frequency | block (to cover 99%) | frequency | block (to cover 99%) | frequency |
|---|---|---|---|---|---|---|---|---|---|---|---|---|---|---|
| NS4A | 2170 | 1.15 | 3 | 3 | 0 | Y | LGLATLGVW | 56.25 | LGLATLGVI | 40.62 | LGLGTLGVI | 3.12 | | |
| NS4A | 2171 | 1.15 | 3 | 3 | 0 | Y | GLATLGVVW | 56.25 | GLATLGVIW | 40.62 | GLGTLGVVW | 3.12 | | |
| NS4A | 2172 | 1.15 | 3 | 3 | 0 | Y | LATLGVWC | 56.25 | LATLGVIWC | 40.62 | LGTLGVVWC | 3.12 | | |
| NS4A | 2173 | 1.15 | 3 | 3 | 0 | Y | ATLGVWCF | 56.25 | ATLGVIWCF | 40.62 | GTLGVVWCF | 3.12 | | |
| NS4A | 2174 | 0.97 | 2 | 2 | 0 | Y | TLGVWCFV | 59.38 | TLGVIWCFV | 40.62 | | | | |
| NS4A | 2175 | 1.15 | 3 | 3 | 0 | Y | LGVWCFVV | 56.25 | LGVIWCFVV | 40.62 | LGVWCFVA | 3.12 | | |
| NS4A | 2176 | 1.15 | 3 | 3 | 0 | Y | GVWCFVVR | 56.25 | GVIWCFVV | 40.62 | GVWCFVAR | 3.12 | | |
| NS4A | 2177 | 1.33 | 4 | 4 | 0 | Y | VWCFVVRT | 53.12 | VWCFVVRT | 40.62 | VWCFVART | 3.12 | VWCFVVRA | 3.12 |
| NS4A | 2178 | 1.33 | 4 | 4 | 0 | Y | VWCFVVRTS | 53.12 | WCFVVRTS | 40.62 | WCFVVRAS | 3.12 | VWCFVARTS | 3.12 |
| NS4A | 2179 | 0.4 | 3 | 3 | 0 | Y | WCFVVRTSI | 93.75 | WCFVVRTSI | 3.12 | WCFVVRASI | 3.12 | | |
| NS4A | 2180 | 0.4 | 3 | 3 | 0 | Y | CFVVRTSIS | 93.75 | CFVVRTSIS | 3.12 | CFVVRASIS | 3.12 | | |
| NS4A | 2181 | 0.4 | 3 | 3 | 0 | Y | FVVRTSISR | 93.75 | FVVRTSISR | 3.12 | FVVRASISR | 3.12 | | |
| NS4A | 2182 | 0.4 | 3 | 3 | 0 | Y | VVRTSISRM | 93.75 | VVRTSISRM | 3.12 | VARTSISRM | 3.12 | | |
| NS4A | 2183 | 0.4 | 3 | 3 | 0 | Y | VRTSISRMM | 93.75 | ARTSISRMM | 3.12 | VRASISRMM | 3.12 | | |
| NS4A | 2184 | 0.2 | 2 | 2 | 0 | Y | RTSISRMML | 96.88 | RASISRMML | 3.12 | | | | |
| NS4A | 2185 | 0.2 | 2 | 2 | 0 | Y | TSISRMMLG | 96.88 | ASISRMMLG | 3.12 | | | | |
| NS4A | 2186 | 0 | 1 | 1 | 0 | Y | SISRMMLGT | 100 | | | | | | |
| NS4A | 2187 | 0 | 1 | 1 | 0 | Y | ISRMMLGTL | 100 | | | | | | |
| NS4A | 2188 | 0 | 1 | 1 | 0 | Y | SRMMLGTLV | 100 | | | | | | |
| NS4A | 2189 | 0 | 1 | 1 | 0 | Y | RMMLGTLVL | 100 | | | | | | |
| NS4A | 2190 | 0 | 1 | 1 | 0 | Y | MMLGTLVLL | 100 | | | | | | |
| NS4A | 2191 | 0 | 1 | 1 | 0 | Y | MLGTLVLLA | 100 | | | | | | |
| NS4A | 2192 | 0 | 1 | 1 | 0 | Y | LGTLVLLAS | 100 | | | | | | |
| NS4A | 2193 | 0 | 1 | 1 | 0 | Y | GTLVLLASL | 100 | | | | | | |
| NS4A | 2194 | 1 | 3 | 3 | 0 | Y | TLVLLASLA | 71.88 | TLVLLASLL | 25 | TLVLLASLV | 3.12 | | |

Fig. 31-81

Species: TBEV (8-mers)

| protein | block starting position | block

Fig. 31-82

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block |

Fig. 31-83

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2245 | 0.2 | 2 | 2 | 0 | Y | YFLLTLCSL | 96.88 | YFLLTLCSV | 3.12 | | | | |
| 2K | 2246 | 0.2 | 2 | 2 | 0 | Y | FLLTLCSLA | 96.88 | FLLTLCSVA | 3.12 | | | | |
| 2K | 2247 | 0.2 | 2 | 2 | 0 | Y | LLTLCSLAG | 96.88 | LLTLCSVAG | 3.12 | | | | |
| 2K | 2248 | 0.2 | 2 | 2 | 0 | Y | LTLCSLAGL | 96.88 | LTLCSVAGL | 3.12 | | | | |
| 2K | 2249 | 0.2 | 2 | 2 | 0 | Y | TLCSLAGLV | 96.88 | TLCSVAGLV | 3.12 | | | | |
| 2K | 2250 | 0.2 | 2 | 2 | 0 | Y | LCSLAGLVA | 96.88 | LCSVAGLVA | 3.12 | | | | |
| 2K | 2251 | 0.2 | 2 | 2 | 0 | Y | CSLAGLVAA | 96.88 | CSVAGLVAA | 3.12 | | | | |
| 2K | 2252 | 0.2 | 2 | 2 | 0 | Y | SLAGLVAAN | 96.88 | SVAGLVAAN | 3.12 | | | | |
| 2K | 2253 | 0.2 | 2 | 2 | 0 | Y | LAGLVAANE | 96.88 | VAGLVAANE | 3.12 | | | | |
| 2K | 2254 | 0 | 1 | 1 | 0 | Y | AGLVAANEM | 100 | | | | | | |
| 2K | 2255 | 0 | 1 | 1 | 0 | Y | GLVAANEMG | 100 | | | | | | |
| 2K | 2256 | 0.2 | 2 | 2 | 0 | Y | LVAANEMGF | 96.88 | LVAANEMGL | 3.12 | | | | |
| 2K | 2257 | 0.2 | 2 | 2 | 0 | Y | VAANEMGFL | 96.88 | VAANEMGLL | 3.12 | | | | |
| 2K | 2258 | 0.2 | 2 | 2 | 0 | Y | AANEMGFLE | 96.88 | AANEMGLLE | 3.12 | | | | |
| 2K | 2259 | 0.89 | 3 | 3 | 0 | Y | ANEMGFLEK | 78.12 | ANEMGFLER | 18.75 | ANEMGLLER | 3.12 | | |
| NS4B | 2260 | 0.89 | 3 | 3 | 0 | Y | NEMGFLEKT | 78.12 | NEMGFLERT | 18.75 | NEMGLLERT | 3.12 | | |
| NS4B | 2261 | 0.89 | 3 | 3 | 0 | Y | EMGFLEKTK | 78.12 | EMGFLERTK | 18.75 | EMGLLERTK | 3.12 | | |
| NS4B | 2262 | 0.89 | 3 | 3 | 0 | Y | MGFLEKTKA | 78.12 | MGFLERTKA | 18.75 | MGLLERTKA | 3.12 | | |
| NS4B | 2263 | 0.89 | 3 | 3 | 0 | Y | GFLEKTKAD | 78.12 | GFLERTKAD | 18.75 | GLLERTKAD | 3.12 | | |
| NS4B | 2264 | 0.89 | 3 | 3 | 0 | Y | FLEKTKADL | 78.12 | FLERTKADL | 18.75 | LLERTKADL | 3.12 | | |
| NS4B | 2265 | 0.76 | 2 | 2 | 0 | Y | LEKTKADLS | 78.12 | LERTKADLS | 21.88 | EKTKADLSA | 3.12 | | |
| NS4B | 2266 | 0.95 | 3 | 3 | 0 | Y | EKTKADLST | 75 | ERTKADLST | 21.88 | KTKADLSTA | 3.12 | KTKADLSAV | 3.12 |
| NS4B | 2267 | 1.26 | 4 | 4 | 0 | Y | KTKADLSTV | 68.75 | RTKADLSTV | 21.88 | TKADLSAVL | 6.25 | | |
| NS4B | 2268 | 0.53 | 3 | 3 | 0 | Y | TKADLSTVL | 90.62 | TKADLSTAL | 6.25 | KADLSAVIL | 3.12 | | |
| NS4B | 2269 | 0.53 | 3 | 3 | 0 | Y | KADLSTVLW | 90.62 | KADLSTALW | 6.25 | KADLSAVLW | 3.12 | | |

Fig. 31-84

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

Fig. 31-85

Species: TBEV (8-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS4B | 2306 | 0.2 | 2 | 2 | 0 | Y | VVSLFTPYI | 96.88 | VVSLFTPYM | 3.12 | | | | |
| NS4B | 2307 | 0.2 | 2 | 2 | 0 | Y | VSLFTPYII | 96.88 | VSLFTPYMI | 3.12 | | | | |
| NS4B | 2308 | 0.2 | 2 | 2 | 0 | Y | SLFTPYIIH | 96.88 | SLFTPYMIH | 3.12 | | | | |
| NS4B | 2309 | 0.2 | 2 | 2 | 0 | Y | LFTPYIIHQ | 96.88 | LFTPYMIHQ | 3.12 | | | | |
| NS4B | 2310 | 0.2 | 2 | 2 | 0 | Y | FTPYIIHQL | 96.88 | FTPYMIHQL | 3.12 | | | | |
| NS4B | 2311 | 0.2 | 2 | 2 | 0 | Y | TPYIIHQLQ | 96.88 | TPYMIHQLQ | 3.12 | | | | |
| NS4B | 2312 | 0.2 | 2 | 2 | 0 | Y | PYIIHQLQT | 96.88 | PYMIHQLQT | 3.12 | | | | |
| NS4B | 2313 | 0.2 | 2 | 2 | 0 | Y | YIIHQLQTK | 96.88 | YMIHQLQTK | 3.12 | | | | |
| NS4B | 2314 | 0.2 | 2 | 2 | 0 | Y | IIHQLQTKI | 96.88 | MIHQLQTKI | 3.12 | | | | |
| NS4B | 2315 | 0 | 1 | 1 | 0 | Y | IHQLQTKIQ | 100 | | | | | | |
| NS4B | 2316 | 0 | 1 | 1 | 0 | Y | HQLQTKIQQ | 100 | | | | | | |
| NS4B | 2317 | 0 | 1 | 1 | 0 | Y | QLQTKIQQL | 100 | | | | | | |
| NS4B | 2318 | 0 | 1 | 1 | 0 | Y | LQTKIQQLV | 100 | | | | | | |
| NS4B | 2319 | 0 | 1 | 1 | 0 | Y | QTKIQQLVN | 100 | | | | | | |
| NS4B | 2320 | 0 | 1 | 1 | 0 | Y | TKIQQLVNS | 100 | | | | | | |
| NS4B | 2321 | 0 | 1 | 1 | 0 | Y | KIQQLVNSA | 100 | | | | | | |
| NS4B | 2322 | 0 | 1 | 1 | 0 | Y | IQQLVNSAV | 100 | | | | | | |
| NS4B | 2323 | 0.2 | 2 | 2 | 0 | Y | QQLVNSAVA | 96.88 | QQLVNSAVV | 3.12 | | | | |
| NS4B | 2324 | 1.15 | 3 | 3 | 0 | Y | QLVNSAVAT | 56.25 | QLVNSAVAS | 40.62 | QLVNSAVVT | 3.12 | | |
| NS4B | 2325 | 1.15 | 3 | 3 | 0 | Y | LVNSAVATG | 56.25 | LVNSAVASG | 40.62 | LVNSAVVTG | 3.12 | | |
| NS4B | 2326 | 1.15 | 3 | 3 | 0 | Y | VNSAVATGA | 56.25 | VNSAVASGA | 40.62 | VNSAVVTGA | 3.12 | | |
| NS4B | 2327 | 1.15 | 3 | 3 | 0 | Y | NSAVATGAQ | 56.25 | NSAVASGAQ | 40.62 | NSAVVTGAQ | 3.12 | | |
| NS4B | 2328 | 1.15 | 3 | 3 | 0 | Y | SAVATGAQA | 56.25 | SAVASGAQA | 40.62 | SAVVTGAQA | 3.12 | | |
| NS4B | 2329 | 1.15 | 3 | 3 | 0 | Y | AVATGAQAM | 56.25 | AVASGAQAM | 40.62 | AVVTGAQAM | 3.12 | | |
| NS4B | 2330 | 1.15 | 3 | 3 | 0 | Y | VATGAQAMR | 56.25 | VASGAQAMR | 40.62 | VVTGAQAMR | 3.12 | | |

Fig. 31-86

Species: TBEV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2331 | 1.15 | 3 | 3 | 0 | Y | ATGAQAMRD | 56.25 | ASGAQAMRD | 40.62 | VTGAQAMRD | 3.12 | | |
| NS4B | 2332 | 0.97 | 2 | 2 | 0 | Y | TGAQAMRDL | 59.38 | SGAQAMRDL | 40.62 | | | | |
| NS4B | 2333 | 0 | 1 | 1 | 0 | Y | GAQAMRDLG | 100 | | | | | | |
| NS4B | 2334 | 0 | 1 | 1 | 0 | Y | AQAMRDLGG | 100 | | | | | | |
| NS4B | 2335 | 0 | 1 | 1 | 0 | Y | QAMRDLGGG | 100 | | | | | | |
| NS4B | 2336 | 0.63 | 2 | 2 | 0 | Y | AMRDLGGGA | 84.38 | AMRDLGGGT | 15.62 | | | | |
| NS4B | 2337 | 0.63 | 2 | 2 | 0 | Y | MRDLGGGAP | 84.38 | MRDLGGGTP | 15.62 | | | | |
| NS4B | 2338 | 0.63 | 2 | 2 | 0 | Y | RDLGGGAPF | 84.38 | RDLGGGTPF | 15.62 | | | | |
| NS4B | 2339 | 1.01 | 4 | 4 | 0 | Y | DLGGGAPFF | 78.12 | DLGGGTPFF | 15.62 | DLGGGAPFL | 3.12 | DLGGGAPFI | 3.12 |
| NS4B | 2340 | 1.01 | 4 | 4 | 0 | Y | LGGGAPFFG | 78.12 | LGGGTPFFG | 15.62 | LGGGAPFLG | 3.12 | LGGGAPFIG | 3.12 |
| NS4B | 2341 | 1.2 | 5 | 5 | 0 | Y | GGGAPFFGV | 75 | GGGTPFFGV | 15.62 | GGGAPFIGV | 3.12 | GGGAPFFGI | 3.12 |
| NS4B | 2342 | 1.2 | 5 | 5 | 0 | Y | GGAPFFGVA | 75 | GGTPFFGVA | 15.62 | GGAPFIGVA | 3.12 | GGAPFLGVA | 3.12 |
| NS4B | 2343 | 1.2 | 5 | 5 | 0 | Y | GAPFFGVAG | 75 | GTPFFGVAG | 15.62 | GAPFIGVAG | 3.12 | GAPFLGVAG | 3.12 |
| NS4B | 2344 | 1.2 | 5 | 4 | 0 | Y | APFFGVAGH | 75 | TPFFGVAGH | 15.62 | APFIGVAGH | 3.12 | APFFGIAGH | 3.12 |
| NS4B | 2345 | 0.6 | 2 | 2 | 0 | Y | PFFGVAGHV | 90.62 | PFIGVAGHV | 3.12 | PFLGVAGHV | 3.12 | | |
| NS4B | 2346 | 1.32 | 5 | 5 | 0 | Y | FFGVAGHVM | 68.75 | FFGIAGHVM | 21.88 | FLGVAGHVM | 3.12 | FIGVAGHVM | 3.12 |
| NS4B | 2348 | 2.08 | 5 | 5 | 0 | Y | GVAGHVMAL | 34.38 | GVAGHVMTL | 25 | GVAGHVMSL | 15.62 | GIAGHVMAL | 3.12 |
| NS4B | 2349 | 2.08 | 5 | 5 | 0 | Y | VAGHVMALG | 34.38 | VAGHVMTLG | 25 | VAGHVMSLG | 15.62 | IAGHVMALG | 3.12 |
| NS4B | 2350 | 1.93 | 4 | 4 | 0 | Y | AGHVMALGV | 37.5 | AGHVMTLGV | 25 | AGHVMSLGV | 15.62 | | |
| NS4B | 2351 | 1.93 | 4 | 4 | 0 | Y | GHVMALGVV | 37.5 | GHVMTLGVV | 25 | GHVMSLGVV | 15.62 | | |
| NS4B | 2352 | 1.93 | 4 | 4 | 0 | Y | HVMALGVVS | 37.5 | HVMTLGVVS | 25 | HVMSLGVVS | 15.62 | | |
| NS4B | 2353 | 1.93 | 4 | 4 | 0 | Y | VMALGVVSL | 37.5 | VMTLGVVSL | 25 | VMSLGVVSL | 15.62 | | |
| NS4B | 2354 | 1.93 | 4 | 4 | 0 | Y | MALGVVSLV | 37.5 | MTLGVVSLI | 25 | MSLGVVSLV | 15.62 | | |
| NS4B | 2355 | 1.36 | 3 | 3 | 0 | Y | ALGVVSLVG | 59.38 | TLGVVSLIG | 25 | SLGVVSLVG | 15.62 | | |
| NS4B | 2356 | 0.81 | 2 | 2 | 0 | Y | LGVVSLVGA | 75 | LGVVSLIGA | 25 | | | | |

Fig. 31-87

Species: TBEV (8-mers)

| protein | block starting position | block entropy |

Fig. 31-88

Species: TBEV (8-mers)

| protein | block starting position | block entropy | total peptides in block | # peptides required to cover 99% of block | gap/X fraction | covered w/ <= 5 peptides? | block | frequency | peptides required to cover 99% of block | frequency |
|---|---|---|---|---|---|---|---|---|---|---|

Fig. 31-89

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2407 | 0.2 | 2 | 2 | 0 | Y | PMVDGDVIN | 96.88 | PMLDGDVIY | 3.12 | | | | |
| NS4B | 2408 | 0.2 | 2 | 2 | 0 | Y | MVDGDVINP | 96.88 | MLDGDVIYP | 3.12 | | | | |
| NS4B | 2409 | 0.2 | 2 | 2 | 0 | Y | VDGDVINPF | 96.88 | LDGDVIYPF | 3.12 | | | | |
| NS4B | 2410 | 0.2 | 2 | 2 | 0 | Y | DGDVINPFG | 96.88 | DGDVIYPFG | 3.12 | | | | |
| NS4B | 2411 | 0.2 | 2 | 2 | 0 | Y | GDVINPFGE | 96.88 | GDVIYPFGE | 3.12 | | | | |
| NS4B | 2412 | 0.2 | 2 | 2 | 0 | Y | DVINPFGEG | 96.88 | DVIYPFGEG | 3.12 | | | | |
| NS4B | 2413 | 0.2 | 2 | 2 | 0 | Y | VINPFGEGE | 96.88 | VIYPFGEGE | 3.12 | | | | |
| NS4B | 2414 | 0.64 | 3 | 3 | 0 | Y | INPFGEGEA | 87.5 | INPFGEGET | 9.38 | IYPFGEGET | 3.12 | | |
| NS4B | 2415 | 0.64 | 3 | 3 | 0 | Y | NPFGEGEAK | 87.5 | NPFGEGETK | 9.38 | YPFGEGETK | 3.12 | | |
| NS4B | 2416 | 0.54 | 2 | 2 | 0 | Y | PFGEGEAKP | 87.5 | PFGEGETKP | 12.5 | | | | |
| NS4B | 2417 | 0.54 | 2 | 2 | 0 | Y | FGEGEAKPA | 87.5 | FGEGETKPA | 12.5 | | | | |
| NS4B | 2418 | 0.54 | 2 | 2 | 0 | Y | GEGEAKPAL | 87.5 | GEGETKPAL | 12.5 | | | | |
| NS4B | 2419 | 0.54 | 2 | 2 | 0 | Y | EGEAKPALY | 87.5 | EGETKPALY | 12.5 | | | | |
| NS4B | 2420 | 0.54 | 2 | 2 | 0 | Y | GEAKPALYE | 87.5 | GETKPALYE | 12.5 | | | | |
| NS4B | 2421 | 0.54 | 2 | 2 | 0 | Y | EAKPALYER | 87.5 | ETKPALYER | 12.5 | | | | |
| NS4B | 2422 | 0.74 | 3 | 3 | 0 | Y | AKPALYERK | 84.38 | TKPALYERK | 12.5 | AKPALYERR | 3.12 | | |
| NS4B | 2423 | 0.2 | 2 | 2 | 0 | Y | KPALYERKM | 96.88 | KPALYERRM | 3.12 | | | | |
| NS4B | 2424 | 0.2 | 2 | 2 | 0 | Y | PALYERKMS | 96.88 | PALYERRMS | 3.12 | | | | |
| NS4B | 2425 | 0.2 | 2 | 2 | 0 | Y | ALYERKMSL | 96.88 | ALYERRMSL | 3.12 | | | | |
| NS4B | 2426 | 0.2 | 2 | 2 | 0 | Y | LYERKMSLV | 96.88 | LYERRMSLV | 3.12 | | | | |
| NS4B | 2427 | 0.2 | 2 | 2 | 0 | Y | YERKMSLVL | 96.88 | YERRMSLVL | 3.12 | | | | |
| NS4B | 2428 | 0.2 | 2 | 2 | 0 | Y | ERKMSLVLA | 96.88 | ERRMSLVLA | 3.12 | | | | |
| NS4B | 2429 | 0.2 | 4 | 4 | 0 | Y | RKMSLVLAI | 71.88 | RKMSLVLAV | 18.75 | RKMSLVLAT | 6.25 | RRMSLVLAI | 3.12 |
| NS4B | 2431 | 1.2 | 5 | 5 | 0 | Y | MSLVLAIWL | 50 | MSLVLAIAL | 25 | MSLVLAWL | 15.62 | MSLVLATVL | 6.25 | MSLVLAVAL | 3.12 |
| NS4B | 2432 | 1.82 | 5 | 5 | 0 | Y | SLVLAIVLC | 50 | SLVLAIALC | 25 | SLVLAVVLC | 15.62 | SLVLATVLC | 6.25 | SLVLAVALC | 3.12 |

Fig. 31-90

Species: TBEV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2433 | 1.82 | 5 | 5 | 0 | Y | LVLAVVLCL | 50 | LVLAIALCL | 25 | LVLAVVLCL | 15.62 | LVLATVLCL | 6.25 | LVLAVALCL | 3.12 |
| NS4B | 2438 | 1.68 | 4 | 4 | 0 | Y | VLCLMSVVM | 50 | ALCLMSVVM | 28.12 | VLCLMAVVM | 15.62 | VLCLISVVM | 6.25 | | |
| NS4B | 2439 | 0.95 | 3 | 3 | 0 | Y | LCLMSVVMN | 78.12 | LCLMAVVMN | 15.62 | LCLISVVMN | 6.25 | | | | |
| NS4B | 2440 | 0.95 | 3 | 3 | 0 | Y | CLMSVVMNR | 78.12 | CLMAVVMNR | 15.62 | CLISVVMNR | 6.25 | | | | |
| NS4B | 2441 | 0.95 | 3 | 3 | 0 | Y | LMSVVMNRT | 78.12 | LMAVVMNRT | 15.62 | LISVVMNRT | 6.25 | | | | |
| NS4B | 2442 | 1.14 | 4 | 4 | 0 | Y | MSVVMNRTV | 75 | MAVVMNRTV | 25 | ISVVMNRTV | 6.25 | MSVVMNRTM | 3.12 | | |
| NS4B | 2443 | 1.72 | 5 | 5 | 0 | Y | SVVMNRTVP | 53.12 | SVVMNRTVA | 25 | AVVMNRTVA | 15.62 | SVVMNRTMA | 3.12 | SVVMNRTVL | 3.12 |
| NS4B | 2444 | 1.33 | 4 | 4 | 0 | Y | VVMNRTVPS | 53.12 | VVMNRTVAS | 40.62 | VVMNRTVLS | 3.12 | VVMNRTMAS | 3.12 | | |
| NS4B | 2445 | 1.33 | 4 | 4 | 0 | Y | VMNRTVPSI | 53.12 | VMNRTVASI | 40.62 | VMNRTVLSI | 3.12 | VMNRTMASI | 3.12 | | |
| NS4B | 2446 | 1.33 | 4 | 4 | 0 | Y | MNRTVPSIT | 53.12 | MNRTVASIT | 40.62 | MNRTVLSIT | 3.12 | MNRTMASIT | 3.12 | | |
| NS4B | 2447 | 1.33 | 4 | 4 | 0 | Y | NRTVPSITE | 53.12 | NRTVASITE | 40.62 | NRTMASITE | 3.12 | NRTVLSITE | 3.12 | | |
| NS4B | 2448 | 1.33 | 4 | 4 | 0 | Y | RTVPSITEA | 53.12 | RTVASITEA | 40.62 | RTMASITEA | 3.12 | RTVLSITEA | 3.12 | | |
| NS4B | 2449 | 1.5 | 5 | 5 | 0 | Y | TVPSITEAS | 50 | TVASITEAS | 40.62 | TVLSITEAS | 3.12 | TMASITEAS | 3.12 | TVPSITEAA | 3.12 |
| NS4B | 2450 | 1.5 | 5 | 5 | 0 | Y | VPSITEASA | 50 | VASITEASA | 40.62 | VPSITEAAA | 3.12 | MASITEASA | 3.12 | VLSITEASA | 3.12 |
| NS4B | 2451 | 1.33 | 4 | 4 | 0 | Y | PSITEASAV | 50 | ASITEASAV | 43.75 | PSITEAAAV | 3.12 | LSITEASAV | 3.12 | | |
| NS4B | 2452 | 0.2 | 2 | 2 | 0 | Y | SITEASAVG | 96.88 | SITEAAAVG | 3.12 | | | | | | |
| NS4B | 2453 | 0.2 | 2 | 2 | 0 | Y | ITEASAVGL | 96.88 | ITEAAAVGL | 3.12 | | | | | | |
| NS4B | 2454 | 0.2 | 2 | 2 | 0 | Y | TEASAVGLA | 96.88 | TEAAAVGLA | 3.12 | | | | | | |
| NS4B | 2455 | 0.2 | 2 | 2 | 0 | Y | EASAVGLAA | 96.88 | EAAAVGLAA | 3.12 | | | | | | |
| NS4B | 2456 | 0.84 | 4 | 4 | 0 | Y | ASAVGLAAA | 84.38 | ASAVGLAAV | 9.38 | AAAVGLAAA | 3.12 | ASAVGLAAL | 3.12 | | |
| NS4B | 2457 | 0.84 | 4 | 4 | 0 | Y | SAVGLAAAG | 84.38 | SAVGLAAVG | 9.38 | AAVGLAAAG | 3.12 | SAVGLAALG | 3.12 | | |
| NS4B | 2458 | 0.64 | 3 | 3 | 0 | Y | AVGLAAAGQ | 87.5 | AVGLAAVGQ | 9.38 | AVGLAALGQ | 3.12 | | | | |
| NS4B | 2459 | 0.64 | 3 | 3 | 0 | Y | VGLAAAGQL | 87.5 | VGLAAVGQL | 9.38 | VGLAALGQL | 3.12 | | | | |
| NS4B | 2460 | 0.64 | 3 | 3 | 0 | Y | GLAAAGQLL | 87.5 | GLAAVGQLL | 9.38 | GLAALGQLL | 3.12 | | | | |
| NS4B | 2461 | 1.16 | 5 | 5 | 0 | Y | LAAAGQLLR | 78.12 | LAAVGQLLR | 9.38 | LAAAGQLLS | 6.25 | LAALGQLLR | 3.12 | LAAAGQLLK | 3.12 |

Fig. 31-91

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

Fig. 31-92

Species: TBEV (8-mers)

| protein | block starting position | block entropy | total peptides in block | # peptides required to cover 99% of block | gap/X fraction | 99% of block covered w/ <= 5 peptides? | block to cover 99% of block | frequency | block

Fig. 31-93

Species: TBEV (8-mers)

| protein | block starting position | block entropy | total peptides in block | # peptides required to cover 99% of block | gap/X fraction | 99% of block cov

Fig. 31-94

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block |

Fig. 31-95

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---|---|---|---|---|
| NS5 | 2572 | 0 | — | — | 0 | Y | KLAWLEERG | 100 |
| NS5 | 2573 | 0 | — | — | 0 | Y | LAWLEERGY | 100 |
| NS5 | 2574 | 0 | — | — | 0 | Y | AWLEERGYA | 100 |
| NS5 | 2575 | 0 | — | — | 0 | Y | WLEERGYAT | 100 |
| NS5 | 2576 | 0 | — | — | 0 | Y | LEERGYATL | 100 |
| NS5 | 2577 | 0 | — | — | 0 | Y | EERGYATLK | 100 |
| NS5 | 2578 | 0 | — | — | 0 | Y | ERGYATLKG | 100 |
| NS5 | 2579 | 0 | — | — | 0 | Y | RGYATLKGE | 100 |
| NS5 | 2580 | 0 | — | — | 0 | Y | GYATLKGEV | 100 |
| NS5 | 2581 | 0 | — | — | 0 | Y | YATLKGEVW | 100 |
| NS5 | 2582 | 0 | — | — | 0 | Y | ATLKGEVWD | 100 |
| NS5 | 2583 | 0 | — | — | 0 | Y | TLKGEVWDL | 100 |
| NS5 | 2584 | 0 | — | — | 0 | Y | LKGEVWDLG | 100 |
| NS5 | 2585 | 0 | — | — | 0 | Y | KGEVWDLGC | 100 |
| NS5 | 2586 | 0 | — | — | 0 | Y | GEVWDLGCG | 100 |
| NS5 | 2587 | 0 | — | — | 0 | Y | EVWDLGCGR | 100 |
| NS5 | 2588 | 0 | — | — | 0 | Y | VWDLGCGRG | 100 |
| NS5 | 2589 | 0 | — | — | 0 | Y | WDLGCGRGG | 100 |
| NS5 | 2590 | 0 | — | — | 0 | Y | DLGCGRGGW | 100 |
| NS5 | 2591 | 0 | — | — | 0 | Y | LGCGRGGWS | 100 |
| NS5 | 2592 | 0 | — | — | 0 | Y | GCGRGGWSY | 100 |
| NS5 | 2593 | 0 | — | — | 0 | Y | CGRGGWSYY | 100 |
| NS5 | 2594 | 0 | — | — | 0 | Y | GRGGWSYYA | 100 |
| NS5 | 2595 | 0 | — | — | 0 | Y | RGGWSYYAA | 100 |
| NS5 | 2596 | 0 | — | — | 0 | Y | GGWSYYAAS | 100 |

Fig. 31-96

Species: TBEV (8-mers)

| protein | block starting position | block entropy | total peptides in block | # peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency |
|---|---|---|---|---|---|---|---|---|---|---|---|---|---|---|
| NS5 | 2597 | 0 | 1 | 1 | 0 | Y | GWSYYAASR | 100 | | | | | | |
| NS5 | 2598 | 0 | 1 | 1 | 0 | Y | WSYYAASRP | 100 | | | | | | |
| NS5 | 2599 | 0.2 | 2 | 2 | 0 | Y | SYYAASRPA | 96.88 | SYYAASRPS | 3.12 | | | | |
| NS5 | 2600 | 0.2 | 2 | 2 | 0 | Y | YYAASRPAV | 96.88 | YYAASRPSV | 3.12 | | | | |
| NS5 | 2601 | 0.2 | 2 | 2 | 0 | Y | YAASRPAVM | 96.88 | YAASRPSYM | 3.12 | | | | |
| NS5 | 2602 | 0.4 | 3 | 3 | 0 | Y | AASRPAVMS | 93.75 | AASRPVMN | 3.12 | AASRPAVMN | 3.12 | | |
| NS5 | 2603 | 0.4 | 3 | 3 | 0 | Y | ASRPAVMSV | 93.75 | ASRPAVMNV | 3.12 | ASRPSYMSV | 3.12 | | |
| NS5 | 2604 | 1.23 | 4 | 4 | 0 | Y | SRPAVMSVK | 65.62 | SRPAVMSVR | 28.12 | SRPSYMSVK | 3.12 | SRPAVMNVR | 3.12 |
| NS5 | 2605 | 1.23 | 4 | 4 | 0 | Y | RPAVMSVKA | 65.62 | RPAVMSYRA | 28.12 | RPSYMSVKA | 3.12 | RPAVMNVRA | 3.12 |
| NS5 | 2606 | 1.23 | 4 | 4 | 0 | Y | PAVMSVKAY | 65.62 | PAVMSYRAY | 28.12 | PSVMSVKAY | 3.12 | PAVMNVRAY | 3.12 |
| NS5 | 2607 | 1.23 | 4 | 4 | 0 | Y | AVMSVKAYT | 65.62 | AVMSYRAYT | 28.12 | SVMSVKAYT | 3.12 | AVMNVRAYT | 3.12 |
| NS5 | 2608 | 1.04 | 3 | 3 | 0 | Y | VMSVKAYTI | 68.75 | VMSYRAYTI | 28.12 | VMNVRAYTI | 3.12 | | |
| NS5 | 2609 | 1.04 | 3 | 3 | 0 | Y | MSVKAYTIG | 68.75 | MSYRAYTIG | 28.12 | MNVRAYTIG | 3.12 | | |
| NS5 | 2610 | 1.04 | 3 | 3 | 0 | Y | SVKAYTIGG | 68.75 | SYRAYTIGG | 28.12 | NVRAYTIGG | 3.12 | | |
| NS5 | 2611 | 1.38 | 4 | 4 | 0 | Y | VKAYTIGGK | 65.62 | VRAYTIGGR | 18.75 | VKAYTIGGR | 12.5 | VRAYTIGGR | 3.12 |
| NS5 | 2612 | 1.38 | 4 | 4 | 0 | Y | KAYTIGGKG | 65.62 | RAYTIGGRG | 18.75 | KAYTIGGKG | 12.5 | RAYTIGGRG | 3.12 |
| NS5 | 2613 | 0.76 | 2 | 2 | 0 | Y | AYTIGGRGH | 78.12 | AYTIGGRGH | 21.88 | | | | |
| NS5 | 2614 | 0.76 | 2 | 2 | 0 | Y | YTIGGKGHE | 78.12 | YTIGGRGHE | 21.88 | | | | |
| NS5 | 2615 | 1.2 | 4 | 4 | 0 | Y | TIGGKGHET | 71.88 | TIGGRGHEA | 18.75 | TIGGRGHET | 6.25 | TIGGRGHET | 3.12 |
| NS5 | 2616 | 1.2 | 4 | 4 | 0 | Y | IGGKGHETP | 71.88 | IGGKGHEAP | 18.75 | IGGRGHETP | 6.25 | IGGRGHETP | 3.12 |
| NS5 | 2617 | 1.39 | 5 | 5 | 0 | Y | GGKGHETPK | 68.75 | GGKGHEAPK | 18.75 | GGKGHEAPK | 6.25 | GGRGHETPK | 3.12 | GGKGHETPR | 3.12 |
| NS5 | 2618 | 1.39 | 5 | 5 | 0 | Y | GKGHETPKM | 68.75 | GRGHETPKM | 18.75 | GKGHEAPKM | 6.25 | GKGHETPKM | 3.12 | GRGHETPKM | 3.12 |
| NS5 | 2619 | 1.39 | 5 | 5 | 0 | Y | KGHETPKMV | 68.75 | RGHETPKMV | 18.75 | KGHEAPKMV | 6.25 | KGHETPKMV | 3.12 | KGHETPRMV | 3.12 |
| NS5 | 2620 | 1 | 3 | 3 | 0 | Y | GHETPKMVT | 71.88 | GHEAPKMVT | 25 | GHETPRMVT | 3.12 | | |
| NS5 | 2621 | 1 | 3 | 3 | 0 | Y | HETPKMVTS | 71.88 | HEAPKMVTS | 25 | HETPRMVTS | 3.12 | | |

Fig. 31-98

Species: TBEV (8-mers)

| protein | block starting position | block entropy | total peptides in block | # peptides required to cover 99% of block | gap/X fraction 99% of block | covered w/ <= 5 peptides? | block | frequency | block | frequency | block | frequency | block | frequency |
|---|---|---|---|---|---|---|---|---|---|---|---|---|---|---|
| NS5 | 2647 | 0.76 | 2 | 2 | 0 | Y | QPHRADTIM | 78.12 | QPHRADTVM | 21.88 | | | | |
| NS5 | 2648 | 0.76 | 2 | 2 | 0 | Y | PHRADTIMC | 78.12 | PHRADTVMC | 21.88 | | | | |
| NS5 | 2649 | 0.76 | 2 | 2 | 0 | Y | HRADTIMCD | 78.12 | HRADTVMCD | 21.88 | | | | |
| NS5 | 2650 | 0.76 | 2 | 2 | 0 | Y | RADTIMCDI | 78.12 | RADTVMCDI | 21.88 | | | | |
| NS5 | 2651 | 0.76 | 2 | 2 | 0 | Y | ADTIMCDIG | 78.12 | ADTVMCDIG | 21.88 | | | | |
| NS5 | 2652 | 0.76 | 2 | 2 | 0 | Y | DTIMCDIGE | 78.12 | DTVMCDIGE | 21.88 | | | | |
| NS5 | 2653 | 0.76 | 2 | 2 | 0 | Y | TIMCDIGES | 78.12 | TVMCDIGES | 21.88 | | | | |
| NS5 | 2654 | 1.45 | 4 | 4 | 0 | Y | IMCDIGESN | 62.5 | VMCDIGESS | 18.75 | IMCDIGESS | 15.62 | VMCDIGESN | 3.12 |
| NS5 | 2655 | 0.93 | 2 | 2 | 0 | Y | MCDIGESNP | 65.62 | MCDIGESSP | 34.38 | | | | |
| NS5 | 2656 | 0.93 | 2 | 2 | 0 | Y | CDIGESNPD | 65.62 | CDIGESSPD | 34.38 | | | | |
| NS5 | 2657 | 0.93 | 2 | 2 | 0 | Y | DIGESNPDA | 65.62 | DIGESSPDA | 34.38 | | | | |
| NS5 | 2658 | 1.32 | 3 | 3 | 0 | Y | IGESNPDAV | 56.25 | IGESSPDAA | 34.38 | IGESNPDAA | 9.38 | | |
| NS5 | 2659 | 1.32 | 3 | 3 | 0 | Y | GESNPDAVV | 56.25 | GESSPDAAV | 34.38 | GESNPDAAV | 9.38 | | |
| NS5 | 2660 | 1.32 | 3 | 3 | 0 | Y | ESNPDAVVE | 56.25 | ESSPDAAVE | 34.38 | ESNPDAAVE | 9.38 | | |
| NS5 | 2661 | 1.32 | 3 | 3 | 0 | Y | SNPDAVVEG | 56.25 | SSPDAAVEG | 34.38 | SNPDAAVEG | 9.38 | | |
| NS5 | 2662 | 1.32 | 3 | 3 | 0 | Y | NPDAVVEGE | 56.25 | SPDAAVEGE | 34.38 | NPDAAVEGE | 9.38 | | |
| NS5 | 2663 | 1.16 | 3 | 3 | 0 | Y | PDAVVEGER | 53.12 | PDAAVEGER | 43.75 | PDAVVEGEK | 3.12 | | |
| NS5 | 2664 | 1.16 | 3 | 3 | 0 | Y | DAVVEGERT | 53.12 | DAAVEGERT | 43.75 | DAVVEGEKT | 3.12 | | |
| NS5 | 2665 | 1.16 | 3 | 3 | 0 | Y | AVVEGERTR | 53.12 | AAVEGERTR | 43.75 | AVVEGEKTR | 3.12 | | |
| NS5 | 2666 | 1.57 | 4 | 4 | 0 | Y | VVEGERTRK | 53.12 | AVEGERTRK | 28.12 | AVEGERTRR | 15.62 | VVEGEKTRK | 3.12 |
| NS5 | 2667 | 0.82 | 3 | 3 | 0 | Y | VEGERTRKV | 81.25 | VEGEKTRKV | 15.62 | VEGEKTRKV | 3.12 | | |
| NS5 | 2668 | 0.82 | 3 | 3 | 0 | Y | EGERTRKVI | 81.25 | EGERTRKVI | 15.62 | EGERTRKVI | 3.12 | | |
| NS5 | 2669 | 0.82 | 3 | 3 | 0 | Y | GERTRKVIL | 81.25 | GERTRRVIL | 15.62 | GEKTRKVIL | 3.12 | | |
| NS5 | 2670 | 0.82 | 3 | 3 | 0 | Y | ERTRKVILL | 81.25 | ERTRRVILL | 15.62 | EKTRKVILL | 3.12 | | |
| NS5 | 2671 | 0.82 | 3 | 3 | 0 | Y | RTRKVILLM | 81.25 | RTRRVILLM | 15.62 | KTRKVILLM | 3.12 | | |

Fig. 31-99

Species: TBEV (8-mers)

| protein | block starting position | block entropy | total peptides in block | # peptides required to cover 99% of block | gap/X fraction | 99% of block covered w

Fig. 31-100

Species: TBEV (8-mers)

| protein | block

Fig. 31-101

Species: TBEV (8-mers)

| protein | block starting position | block

Fig. 31-102

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2747 | 0.7 | 2 | 2 | 0 | Y | IQSRKLLAR | 81.25 | VQSRKLLAR | 18.75 | | | | | | |
| NS5 | 2748 | 0 | 1 | 1 | 0 | Y | QSRKLLARF | 100 | | | | | | | | |
| NS5 | 2749 | 0.2 | 2 | 2 | 0 | Y | SRKLLARFG | 96.88 | SRKLLARFA | 3.12 | | | | | | |
| NS5 | 2750 | 0.2 | 2 | 2 | 0 | Y | RKLLARFGD | 96.88 | RKLLARFAG | 3.12 | | | | | | |
| NS5 | 2751 | 0.2 | 2 | 2 | 0 | Y | KLLARFGDQ | 96.88 | KLLARFAGQ | 3.12 | | | | | | |
| NS5 | 2752 | 0.2 | 2 | 2 | 0 | Y | LLARFGDQR | 96.88 | LLARFAGQR | 3.12 | | | | | | |
| NS5 | 2753 | 0.2 | 2 | 2 | 0 | Y | LARFGDQRG | 96.88 | LARFAGQRG | 3.12 | | | | | | |
| NS5 | 2754 | 0.2 | 2 | 2 | 0 | Y | ARFGDQRGP | 96.88 | ARFAGQRGP | 3.12 | | | | | | |
| NS5 | 2755 | 0.2 | 2 | 2 | 0 | Y | RFGDQRGPT | 96.88 | RFAGQRGPT | 3.12 | | | | | | |
| NS5 | 2756 | 0.53 | 3 | 3 | 0 | Y | FGDQRGPTR | 90.62 | FGDQRGPTK | 6.25 | FAGQRGPTR | 3.12 | | | | |
| NS5 | 2757 | 0.53 | 3 | 3 | 0 | Y | GDQRGPTRV | 90.62 | GDQRGPTKV | 6.25 | AGQRGPTRV | 3.12 | | | | |
| NS5 | 2758 | 0.53 | 3 | 3 | 0 | Y | DQRGPTRVP | 90.62 | DQRGPTKVP | 6.25 | GQRGPTRVP | 3.12 | | | | |
| NS5 | 2759 | 0.34 | 2 | 2 | 0 | Y | QRGPTRVPE | 93.75 | QRGPTKVPE | 6.25 | | | | | | |
| NS5 | 2760 | 0.34 | 2 | 2 | 0 | Y | RGPTRVPEL | 93.75 | RGPTKVPEL | 6.25 | | | | | | |
| NS5 | 2761 | 0.34 | 2 | 2 | 0 | Y | GPTRVPELD | 93.75 | GPTKVPELD | 6.25 | | | | | | |
| NS5 | 2762 | 0.34 | 2 | 2 | 0 | Y | PTRVPELDL | 93.75 | PTKVPELDL | 6.25 | | | | | | |
| NS5 | 2763 | 0.34 | 2 | 2 | 0 | Y | TRVPELDLG | 93.75 | TKVPELDLG | 6.25 | | | | | | |
| NS5 | 2764 | 0.78 | 3 | 3 | 0 | Y | RVPELDLGV | 84.38 | RVPELDLGI | 9.38 | KVPELDLGV | 6.25 | | | | |
| NS5 | 2765 | 0.45 | 2 | 2 | 0 | Y | VPELDLGVG | 90.62 | VPELDLGI | 9.38 | | | | | | |
| NS5 | 2766 | 0.45 | 2 | 2 | 0 | Y | PELDLGVGT | 90.62 | PELDLGIG | 9.38 | | | | | | |
| NS5 | 2767 | 0.45 | 2 | 2 | 0 | Y | ELDLGVGTR | 90.62 | ELDLGIGTR | 9.38 | | | | | | |
| NS5 | 2768 | 0.45 | 2 | 2 | 0 | Y | LDLGVGTRC | 90.62 | LDLGIGTRC | 9.38 | | | | | | |
| NS5 | 2769 | 0.45 | 2 | 2 | 0 | Y | DLGVGTRCV | 90.62 | DLGIGTRCV | 9.38 | | | | | | |
| NS5 | 2770 | 0.64 | 3 | 3 | 0 | Y | LGVGTRCVV | 87.5 | LGIGTRCVV | 9.38 | LGVGTRCVF | 3.12 | | | | |
| NS5 | 2771 | 0.64 | 3 | 3 | 0 | Y | GVGTRCVVL | 87.5 | GIGTRCVVL | 9.38 | GVGTRCVFL | 3.12 | | | | |

Fig. 31-103

Species: TBEV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency |

Fig. 31-104

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block

Fig. 31-105

Species: TBEV (8-mers)

| protein | block starting position | block entropy | total pe

Fig. 31-106

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

Fig. 31-107

Species: TBEV (8-mers)

| protein | block starting position | block entropy | total peptides in block | # peptides required to cover 99% of block | gap/X fraction | 99% of block covered w/ <= 5 peptides? | block (99% c

Fig. 31-108

Species: TBEV (8-mers)

| protein | block starting position | block entropy | total peptides in block | # peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS5 | 2920 | 0.4 | 3 | 3 | 0 | Y | ALGAWSDEQ | 93.75 | ALGAWSEEQ | 3.12 | | | | |
| NS5 | 2921 | 0.4 | 3 | 3 | 0 | Y | LGAWSDEQN | 93.75 | LGAWSEEQN | 3.12 | | | | |
| NS5 | 2922 | 0.4

Fig. 31-109

Species: TBEV (8-mers)

| protein | block starting position | block entropy | total peptides in block | # peptides required to cover 99% of block | gap/X fraction 99% of block | covered w/ <= 5 peptides? | peptides required to cover 99% of block

Fig. 31-110

Species: TBEV (8-mers)

| protein | block starting position | block entropy |

Fig. 31-111

Species: TBEV (8

Fig. 31-112

Species: TBEV (8-mers)

| protein | block starting position | block entropy | total peptides in block | # peptides required to cover 99% of block | gap/X

Fig. 31-113

Species: TBEV (8-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3060 | 1 | 2 | 2 | 0 | Y | EDEEQLLRY | 53.12 | EDEEQLLRY | 46.88 | | | | |
| NS5 | 3061 | 1 | 2 | 2 | 0 | Y | DEEQLLRYM | 53.12 | DEEQLLRYM | 46.88 | | | | |
| NS5 | 3062 | 1 | 2 | 2 | 0 | Y | EEQLLRYME | 53.12 | EEQILRYME | 46.88 | | | | |
| NS5 | 3063 | 1 | 2 | 2 | 0 | Y | EQLLRYMEG | 53.12 | EQILRYMEG | 46.88 | | | | |
| NS5 | 3064 | 1 | 2 | 2 | 0 | Y | QLLRYMEGE | 53.12 | QILRYMEGE | 46.88 | | | | |
| NS5 | 3065 | 1 | 2 | 2 | 0 | Y | LLRYMEGEH | 53.12 | ILRYMEGEH | 46.88 | | | | |
| NS5 | 3066 | 0.76 | 2 | 2 | 0 | Y | LRYMEGEHK | 78.12 | LRYMEGEHR | 21.88 | | | | |
| NS5 | 3067 | 0.76 | 2 | 2 | 0 | Y | RYMEGEHKQ | 78.12 | RYMEGEHRQ | 21.88 | | | | |
| NS5 | 3068 | 0.76 | 2 | 2 | 0 | Y | YMEGEHKQL | 78.12 | YMEGEHRQL | 21.88 | | | | |
| NS5 | 3069 | 0.76 | 2 | 2 | 0 | Y | MEGEHKQLA | 78.12 | MEGEHRQLA | 21.88 | | | | |
| NS5 | 3070 | 1.49 | 3 | 3 | 0 | Y | EGEHKQLAA | 50 | EGEHKQLAT | 28.12 | EGEHRQLAA | 21.88 | | |
| NS5 | 3071 | 1.49 | 3 | 3 | 0 | Y | GEHKQLAAT | 50 | GEHKQLATT | 28.12 | GEHRQLAAT | 21.88 | | |
| NS5 | 3072 | 1.66 | 4 | 4 | 0 | Y | EHKQLAATI | 46.88 | EHKQLATTI | 28.12 | EHRQLAATI | 21.88 | EHKQLAATV | 3.12 |
| NS5 | 3073 | 1.66 | 4 | 4 | 0 | Y | HKQLAATIM | 46.88 | HKQLATTIM | 28.12 | HRQLAATIM | 21.88 | HKQLAATVM | 3.12 |
| NS5 | 3074 | 1.66 | 4 | 4 | 0 | Y | KQLAATIMQ | 46.88 | KQLATTIMQ | 28.12 | RQLAATIMQ | 21.88 | KQLAATVMQ | 3.12 |
| NS5 | 3075 | 1.04 | 3 | 3 | 0 | Y | QLAATIMQK | 68.75 | QLATTIMQK | 28.12 | QLAATVMQK | 3.12 | | |
| NS5 | 3076 | 1.04 | 3 | 3 | 0 | Y | LAATIMQKA | 68.75 | LATTIMQKA | 28.12 | LAATVMQKA | 3.12 | | |
| NS5 | 3077 | 1.04 | 3 | 3 | 0 | Y | AATIMQKAY | 68.75 | ATTIMQKAY | 28.12 | AATVMQKAY | 3.12 | | |
| NS5 | 3078 | 1.04 | 3 | 3 | 0 | Y | ATIMQKAYH | 68.75 | TTIMQKAYH | 28.12 | ATVMQKAYH | 3.12 | | |
| NS5 | 3079 | 0.2 | 2 | 2 | 0 | Y | TIMQKAYHA | 96.88 | TMQKAYHA | 3.12 | | | | |
| NS5 | 3080 | 0.2 | 2 | 2 | 0 | Y | IMQKAYHAK | 96.88 | VMQKAYHAK | 3.12 | | | | |
| NS5 | 3081 | 0 | 1 | 1 | 0 | Y | MQKAYHAKV | 100 | | | | | | |
| NS5 | 3082 | 0 | 1 | 1 | 0 | Y | QKAYHAKVV | 100 | | | | | | |
| NS5 | 3083 | 0 | 1 | 1 | 0 | Y | KAYHAKVVK | 100 | | | | | | |
| NS5 | 3084 | 0 | 1 | 1 | 0 | Y | AYHAKVVKV | 100 | | | | | | |

Fig. 31-114

Species: TBEV (8-mers)

| protein | block starting position | block entropy | total

Fig. 31-115

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | fr

Fig. 31-116

Species: TBEV (8-mers)

| protein | block starting position | block entropy | total peptides in block | # peptides required to cover 99% of block | gap/X fraction | 99% of block covered w/ <= 5 peptides?

Fig. 31-117

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3165 | 0 | 1 | 1 | 0 | Y | ERLGRMLVS | 100 | | | | | | |
| NS5 | 3166 | 0 | 1 | 1 | 0 | Y | RLGRMLVSG | 100 | | | | | | |
| NS5 | 3167 | 0 | 1 | 1 | 0 | Y | LGRMLVSGD | 100 | | | | | | |
| NS5 | 3168 | 0 | 1 | 1 | 0 | Y | GRMLVSGDD | 100 | | | | | | |
| NS5 | 3169 | 0 | 1 | 1 | 0 | Y | RMLVSGDDC | 100 | | | | | | |
| NS5 | 3170 | 0 | 1 | 1 | 0 | Y | MLVSGDDCV | 100 | | | | | | |
| NS5 | 3171 | 0 | 1 | 1 | 0 | Y | LVSGDDCVV | 100 | | | | | | |
| NS5 | 3172 | 0 | 1 | 1 | 0 | Y | VSGDDCVVR | 100 | | | | | | |
| NS5 | 3173 | 0.2 | 2 | 2 | 0 | Y | SGDDCVVRP | 96.88 | SGDDCVVRG | 3.12 | | | | |
| NS5 | 3174 | 1.48 | 4 | 4 | 0 | Y | GDDCVVRPV | 59.38 | GDDCVVRPL | 12.5 | GDDCVVRPI | 12.5 | GDDCVVRGI | 3.12 |
| NS5 | 3175 | 1.48 | 4 | 4 | 0 | Y | DDCVVRPVD | 59.38 | DDCVVRPLD | 12.5 | DDCVVRPID | 12.5 | DDCVVRGID | 3.12 |
| NS5 | 3176 | 1.48 | 4 | 4 | 0 | Y | DCVVRPVDD | 59.38 | DCVVRPLDD | 12.5 | DCVVRPIDD | 12.5 | DCVVRGIDD | 3.12 |
| NS5 | 3177 | 1.48 | 4 | 4 | 0 | Y | CVVRPVDDR | 59.38 | CVVRPLDDR | 12.5 | CVVRPIDDR | 12.5 | CVVRGIDDR | 3.12 |
| NS5 | 3178 | 1.48 | 4 | 4 | 0 | Y | VVRPVDDRF | 59.38 | VVRPLDDRF | 12.5 | VVRPIDDRF | 12.5 | VRGIDDRFG | 3.12 |
| NS5 | 3179 | 1.85 | 5 | 5 | 0 | Y | VRPVDDRFS | 50 | VRPLDDRFG | 12.5 | VRPIDDRFG | 12.5 | VRGIDDRFG | 9.38 |
| NS5 | 3183 | 1.91 | 5 | 5 | 0 | Y | DDRFGKALY | 43.75 | DDRFSKALY | 25 | DDRFSRALY | 21.88 | DDRFSGALY | 6.25 |
| NS5 | 3184 | 1.91 | 5 | 5 | 0 | Y | DRFGKALYF | 43.75 | DRFSKALYF | 25 | DRFSRALYF | 21.88 | DRFSGALYF | 6.25 |
| NS5 | 3185 | 1.91 | 5 | 5 | 0 | Y | RFGKALYFL | 43.75 | RFSKALYFL | 25 | RFSRALYFL | 21.88 | RFSGALYFL | 6.25 |
| NS5 | 3186 | 1.91 | 5 | 5 | 0 | Y | FGKALYFLN | 43.75 | FSKALYFLN | 25 | FSRALYFLN | 21.88 | FSGALYFLN | 6.25 |
| NS5 | 3187 | 1.91 | 5 | 5 | 0 | Y | GKALYFLND | 43.75 | SKALYFLND | 25 | SRALYFLND | 21.88 | SGALYFLND | 6.25 |
| NS5 | 3188 | 1.04 | 3 | 3 | 0 | Y | KALYFLNDM | 68.75 | RALYFLNDM | 28.12 | GALYFLNDM | 3.12 | | |
| NS5 | 3189 | 0 | 1 | 1 | 0 | Y | ALYFLNDMA | 100 | | | | | | |
| NS5 | 3190 | 0 | 1 | 1 | 0 | Y | LYFLNDMAK | 100 | | | | | | |
| NS5 | 3191 | 0 | 1 | 1 | 0 | Y | YFLNDMAKT | 100 | | | | | | |
| NS5 | 3192 | 0 | 1 | 1 | 0 | Y | FLNDMAKTR | 100 | | | | | | |

Fig. 31-118

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

Fig. 31-119

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3226 | 0 | 1 | 1 | 0 | Y | HELVMKDGR | 100 | | | | | | |
| NS5 | 3227 | 1.5 | 3 | 3 | 0 | Y | ELVMKDGRA | 50 | ELVMKDGRT | 25 | ELVMKDGRS | 25 | | |
| NS5 | 3228 | 1.5 | 3 | 3 | 0 | Y | LVMKDGRAL | 50 | LVMKDGRSL | 25 | LVMKDGRTL | 25 | | |
| NS5 | 3229 | 1.91 | 4 | 4 | 0 | Y | VMKDGRALI | 37.5 | VMKDGRTLV | 25 | VMKDGRSLI | 25 | VMKDGRALV | 12.50 |
| NS5 | 3230 | 1.91 | 4 | 4 | 0 | Y | MKDGRALIV | 37.5 | MKDGRTLVV | 25 | MKDGRSLIV | 25 | MKDGRALVV | 12.50 |
| NS5 | 3231 | 1.91 | 4 | 4 | 0 | Y | KDGRALIVP | 37.5 | KDGRSLIVP | 25 | KDGRTLVVP | 25 | KDGRALVVP | 12.50 |
| NS5 | 3232 | 1.91 | 4 | 4 | 0 | Y | DGRALIVPC | 37.5 | DGRSLIVPC | 25 | DGRTLVVPC | 25 | DGRALVVPC | 12.50 |
| NS5 | 3233 | 1.91 | 4 | 4 | 0 | Y | GRALIVPCR | 37.5 | GRSLIVPCR | 25 | GRTLVVPCR | 25 | GRALVVPCR | 12.50 |
| NS5 | 3234 | 1.91 | 4 | 4 | 0 | Y | RALIVPCRD | 37.5 | RSLIVPCRD | 25 | RTLVVPCRD | 25 | RALVVPCRD | 12.50 |
| NS5 | 3235 | 1.91 | 4 | 4 | 0 | Y | ALIVPCRDQ | 37.5 | SLIVPCRDQ | 25 | TLVVPCRDQ | 25 | ALVVPCRDQ | 12.50 |
| NS5 | 3236 | 0.95 | 2 | 2 | 0 | Y | LIVPCRDQD | 62.5 | LVVPCRDQD | 37.5 | | | | |
| NS5 | 3237 | 0.95 | 2 | 2 | 0 | Y | IVPCRDQDE | 62.5 | VVPCRDQDE | 37.5 | | | | |
| NS5 | 3238 | 0 | 1 | 1 | 0 | Y | VPCRDQDEL | 100 | | | | | | |
| NS5 | 3239 | 0 | 1 | 1 | 0 | Y | PCRDQDELV | 100 | | | | | | |
| NS5 | 3240 | 0 | 1 | 1 | 0 | Y | CRDQDELVG | 100 | | | | | | |
| NS5 | 3241 | 0 | 1 | 1 | 0 | Y | RDQDELVGR | 100 | | | | | | |
| NS5 | 3242 | 0 | 1 | 1 | 0 | Y | DQDELVGRA | 100 | | | | | | |
| NS5 | 3243 | 0.2 | 2 | 2 | 0 | Y | QDELVGRAR | 96.88 | QDELVGRAP | 3.12 | | | | |
| NS5 | 3244 | 1 | 3 | 3 | 0 | Y | DELVGRARV | 71.88 | DELVGRARI | 25 | DELVGRAPV | 3.12 | | |
| NS5 | 3245 | 1 | 3 | 3 | 0 | Y | ELVGRARVS | 71.88 | ELVGRARIS | 25 | ELVGRAPVS | 3.12 | | |
| NS5 | 3246 | 1 | 3 | 3 | 0 | Y | LVGRARVSP | 71.88 | LVGRARISP | 25 | LVGRAPVSP | 3.12 | | |
| NS5 | 3247 | 1 | 3 | 3 | 0 | Y | VGRARVSPG | 71.88 | VGRARISPG | 25 | VGRAPVSPG | 3.12 | | |
| NS5 | 3248 | 1 | 3 | 3 | 0 | Y | GRARVSPGC | 71.88 | GRARISPGC | 25 | GRAPVSPGC | 3.12 | | |
| NS5 | 3249 | 1 | 3 | 3 | 0 | Y | RARVSPGCG | 71.88 | RARISPGCG | 25 | RAPVSPGCG | 3.12 | | |
| NS5 | 3250 | 1 | 3 | 3 | 0 | Y | ARVSPGCGW | 71.88 | ARISPGCGW | 25 | APVSPGCGW | 3.12 | | |

Fig. 31-120

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 31-121

Species: TBEV (8-mers)

| protein | block starting position | block entropy (8-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3276 | 0 | — | — | 0 | Y | LSYFHRRDL | 100 | | | | | | |
| NS5 | 3277 | 0 | — | — | 0 | Y | SYFHRRDLR | 100 | | | | | | |
| NS5 | 3278 | 0 | — | — | 0 | Y | YFHRRDLRT | 100 | | | | | | |
| NS5 | 3279 | 0 | — | — | 0 | Y | FHRRDLRTL | 100 | | | | | | |
| NS5 | 3280 | 0 | — | — | 0 | Y | HRRDLRTLG | 100 | | | | | | |
| NS5 | 3281 | 0.2 | 2 | 2 | 0 | Y | RRDLRTLGL | 96.88 | RRDLRTLGF | 3.12 | RDLRTLGFA | 3.12 | | |
| NS5 | 3282 | 0.4 | 3 | 3 | 0 | Y | RDLRTLGLA | 93.75 | RDLRTLGLT | 3.12 | DLRTLGFAI | 3.12 | | |
| NS5 | 3283 | 0.4 | 3 | 3 | 0 | Y | DLRTLGLAI | 93.75 | DLRTLGLTI | 3.12 | LRTLGFAIC | 3.12 | LRTLGFAIC | 3.12 |
| NS5 | 3284 | 1.32 | 5 | 5 | 0 | Y | LRTLGLAIC | 68.75 | LRTLGLAIN | 21.88 | LRTLGLTIC | 3.12 | RTLGFAICS | 3.12 |
| NS5 | 3285 | 1.32 | 5 | 5 | 0 | Y | RTLGLAICS | 68.75 | RTLGLAINS | 21.88 | RTLGLTICS | 3.12 | TLGFAICSA | 3.12 |
| NS5 | 3286 | 1.32 | 5 | 5 | 0 | Y | TLGLAICSA | 68.75 | TLGLAINSA | 21.88 | TLGLTICSA | 3.12 | LGFAICSAV | 3.12 |
| NS5 | 3287 | 1.32 | 5 | 5 | 0 | Y | LGLAICSAV | 68.75 | LGLAINSAV | 21.88 | LGLTICSAV | 3.12 | GLAISSAVP | 3.12 |
| NS5 | 3288 | 1.32 | 5 | 5 | 0 | Y | GLAICSAVP | 68.75 | GLAINSAVP | 21.88 | GLTICSAVP | 3.12 | | |
| NS5 | 3293 | 0.86 | 4 | 4 | 0 | Y | SAVPDWVP | 84.38 | SAVPIDWVP | 6.25 | SAVPADWVP | 6.25 | SAVPTDWVP | 3.12 |
| NS5 | 3294 | 0.86 | 4 | 4 | 0 | Y | AVPDWVPT | 84.38 | AVPIDWVPT | 6.25 | AVPADWVPT | 6.25 | AVPTDWVPT | 3.12 |
| NS5 | 3295 | 0.86 | 4 | 4 | 0 | Y | VPVDWVPTG | 84.38 | VPIDWVPTG | 6.25 | VPADWVPTG | 6.25 | VPTDWVPTG | 3.12 |
| NS5 | 3296 | 0.86 | 4 | 4 | 0 | Y | PVDWVPTGR | 84.38 | PIDWVPTGR | 6.25 | PADWVPTGR | 6.25 | PTDWVPTGR | 3.12 |
| NS5 | 3297 | 0.86 | 4 | 4 | 0 | Y | VDWVPTGRT | 84.38 | ADWVPTGRT | 6.25 | IDWVPTGRT | 6.25 | TDWVPTGRT | 3.12 |
| NS5 | 3298 | 0 | — | — | 0 | Y | DWVPTGRIT | 100 | | | | | | |
| NS5 | 3299 | 0 | — | — | 0 | Y | WVPTGRTTW | 100 | | | | | | |
| NS5 | 3300 | 0 | — | — | 0 | Y | VPTGRTTWSI | 100 | | | | | | |
| NS5 | 3301 | 0 | — | — | 0 | Y | PTGRTTWSI | 100 | | | | | | |
| NS5 | 3302 | 0 | — | — | 0 | Y | TGRTTWSIH | 100 | | | | | | |
| NS5 | 3303 | 0 | — | — | 0 | Y | GRTTWSIHA | 100 | | | | | | |
| NS5 | 3304 | 0 | — | — | 0 | Y | RTTWSIHAS | 100 | | | | | | |

Fig. 31-122

Species: TBEV (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover

Fig. 31-123

Species: TBEV (8-mers)

| protein | block starting position | block entropy | total peptides in block | # peptides required to cover 99% of block | gap/K fraction | 99% of block covered w/ <= 5 peptides? | block | frequency | block | frequency | block | frequency | block | frequency |
|---|---|---|---|---|---|---|---|---|---|---|---|---|---|---|
| NS5 | 3330 | 1.17 | 3 | 3 | 0 | Y | ILDNPFMHS | 50 | ILDNPFMQN | 46.88 | ILDNPFMHG | 3.12 | | |
| NS5 | 3331 | 1.17 | 3 | 3 | 0 | Y | LDNPFMHSK | 50 | LDNPFMQNK | 46.88 | LDNPFMHGK | 3.12 | | |
| NS5 | 3332 | 1.33 | 4 | 4 | 0 | Y | DNPFMHSKE | 50 | DNPFMQNKE | 43.75 | DNPFMQNKG | 3.12 | DNPFMHGKE | 3.12 |
| NS5 | 3333 | 1.66 | 5 | 5 | 0 | Y | NPFMHSKEK | 50 | NPFMQNKEK | 34.38 | NPFMQNKER | 9.38 | NPFMHGKEK | 3.12 | NPFMQNKGK | 3.12 |
| NS5 | 3344 | 0.95 | 3 | 3 | 0 | Y | EWRDVPYLP | 78.12 | EWRDIPYLP | 15.62 | EWRNVPYLP | 6.25 | | |
| NS5 | 3345 | 0.95 | 3 | 3 | 0 | Y | WRDVPYLPK | 78.12 | WRDIPYLPK | 15.62 | WRNVPYLPK | 6.25 | | |
| NS5 | 3346 | 1.65 | 4 | 4 | 0 | Y | RDVPYLPKS | 53.12 | RDVPYLPKA | 25 | RDIPYLPKA | 15.62 | RNVPYLPKA | 6.25 | |
| NS5 | 3348 | 1.77 | 5 | 5 | 0 | Y | VPYLPKSHD | 53.12 | VPYLPKAQD | 25 | IPYLPKAHD | 12.5 | VPYLPKAHD | 6.25 | IPYLPKAQD | 3.12 |
| NS5 | 3349 | 1.45 | 3 | 3 | 0 | Y | PYLPKSHDM | 53.12 | PYLPKAQDM | 28.12 | PYLPKAHDM | 18.75 | | |
| NS5 | 3350 | 1.45 | 3 | 3 | 0 | Y | YLPKSHDML | 53.12 | YLPKAQDML | 28.12 | YLPKAHDML | 18.75 | | |
| NS5 | 3351 | 1.45 | 3 | 3 | 0 | Y | LPKSHDMLC | 53.12 | LPKAQDMLC | 28.12 | LPKAHDMLC | 18.75 | | |
| NS5 | 3352 | 1.45 | 3 | 3 | 0 | Y | PKSHDMLCS | 53.12 | PKAQDMLCS | 28.12 | PKAHDMLCS | 18.75 | | |
| NS5 | 3353 | 1.45 | 3 | 3 | 0 | Y | KSHDMLCSS | 53.12 | KAQDMLCSS | 28.12 | KAHDMLCSS | 18.75 | | |
| NS5 | 3354 | 1.45 | 3 | 3 | 0 | Y | SHDMLCSSL | 53.12 | AQDMLCSSL | 28.12 | AHDMLCSSL | 18.75 | | |
| NS5 | 3355 | 0.86 | 2 | 2 | 0 | Y | HDMLCSSLV | 71.88 | QDMLCSSLV | 28.12 | | | | |
| NS5 | 3356 | 0 | 1 | 1 | 0 | Y | DMLCSSLVG | 100 | | | | | | |
| NS5 | 3357 | 0 | 1 | 1 | 0 | Y | MLCSSLVGR | 100 | | | | | | |
| NS5 | 3358 | 0.64 | 3 | 3 | 0 | Y | LCSSLVGRK | 87.5 | LCSSLVGRR | 9.38 | LCSSLVGRT | 3.12 | | |
| NS5 | 3359 | 0.64 | 3 | 3 | 0 | Y | CSSLVGRKE | 87.5 | CSSLVGRRE | 9.38 | CSSLVGRTE | 3.12 | | |
| NS5 | 3360 | 0.64 | 3 | 3 | 0 | Y | SSLVGRKER | 87.5 | SSLVGRRER | 9.38 | SSLVGRTER | 3.12 | | |
| NS5 | 3361 | 0.64 | 3 | 3 | 0 | Y | SLVGRKERA | 87.5 | SLVGRRERA | 9.38 | SLVGRTERA | 3.12 | | |
| NS5 | 3362 | 0.64 | 3 | 3 | 0 | Y | LVGRKERAE | 87.5 | LVGRRERAE | 9.38 | LVGRTERAE | 3.12 | | |
| NS5 | 3363 | 0.64 | 3 | 3 | 0 | Y | VGRKERAEW | 87.5 | VGRRERAEW | 9.38 | VGRTERAEW | 3.12 | | |
| NS5 | 3364 | 0.64 | 3 | 3 | 0 | Y | GRKERAEWA | 87.5 | GRRERAEWA | 9.38 | GRTERAEWA | 3.12 | | |
| NS5 | 3365 | 0.97 | 4 | 4 | 0 | Y | RKERAEWAK | 81.25 | RRERAEWAK | 9.38 | RKERAEWAR | 6.25 | RTERAEWAK | 3.12 | |

Species: TBEV (8-mers)

Fig. 31-124

| protein | block starting position | block entropy | total peptides in block | # peptides required to cover 99%

Fig. 31-125

Species: TBEV (8-mers)

| protein | block star

Fig. 32-1

Species: TBEV (9-mers)

| protein | block starting position | block entropy | total peptides in block | # peptides required to cover 99% of block | gap/X fraction | 99% of block covered w/ <=5 peptides? | block (to cover 99% of block) | frequency | block (to cover 99% of block) | frequency | block (to cover 99% of block) | frequency | block (to cover 99% of block) | frequency |
|---|---|---|---|---|---|---|---|---|---|---|---|---|---|---|
| anC | 1 | 1.46 | 3 | 3 | 0 | Y | MAGKAILKG | 53.12 | MVKKAILKG | 25 | MARKAILKG | 21.88 | | |
| anC | 2 | 1.46 | 3 | 3 | 0 | Y | AGKAILKGK | 53.12 | VKKAILKGK | 25 | ARKAILKGK | 21.88 | | |
| anC | 3 | 1.46 | 3 | 3 | 0 | Y | GKAILKGKG | 53.12 | KKAILKGKG | 25 | RKAILKGKG | 21.88 | | |
| anC | 4 | 0 | 1 | 1 | 0 | Y | KAILKGKGG | 100 | | | | | | |
| anC | 5 | 0 | 1 | 1 | 0 | Y | AILKGKGGG | 100 | | | | | | |
| anC | 6 | 0 | 1 | 1 | 0 | Y | ILKGKGGGP | 100 | | | | | | |
| anC | 7 | 0 | 1 | 1 | 0 | Y | LKGKGGGPP | 100 | | | | | | |
| anC | 8 | 0 | 1 | 1 | 0 | Y | KGKGGGPPR | 100 | | | | | | |
| anC | 9 | 0 | 1 | 1 | 0 | Y | GKGGGPPRR | 100 | | | | | | |
| anC | 10 | 0.2 | 2 | 2 | 0 | Y | KGGGPPRRV | 96.88 | KGGGPPRRA | 3.12 | | | | |
| anC | 11 | 0.2 | 2 | 2 | 0 | Y | GGGPPRRVS | 96.88 | GGGPPRRAS | 3.12 | | | | |
| anC | 12 | 0.2 | 2 | 2 | 0 | Y | GGPPRRVSK | 96.88 | GGPPRRASK | 3.12 | | | | |
| anC | 13 | 0.2 | 2 | 2 | 0 | Y | GPPRRVSKE | 96.88 | GPPRRASKE | 3.12 | | | | |
| anC | 14 | 0.4 | 3 | 3 | 0 | Y | PPRRVSKET | 93.75 | PPRRASKET | 3.12 | PPRASKET | 3.12 | | |
| anC | 15 | 0.4 | 3 | 3 | 0 | Y | PRRVSKETA | 93.75 | PRRASKETA | 3.12 | PRRVSKEAA | 3.12 | | |
| anC | 16 | 1.49 | 5 | 5 | 0 | Y | RRVSKETAK | 62.5 | RRVSKETAT | 3.12 | RRVSKETAR | 6.25 | RRVSKEAAK | 3.12 |
| anC | 17 | 1.49 | 5 | 5 | 0 | Y | RVSKETAKK | 62.5 | RVSKETATK | 3.12 | RVSKETARK | 6.25 | RASKETAKK | 3.12 |
| anC | 18 | 1.49 | 5 | 5 | 0 | Y | VSKETAKKT | 62.5 | VSKETATKT | 3.12 | VSKETARKT | 6.25 | ASKETAKKT | 3.12 |
| anC | 19 | 1.31 | 4 | 4 | 0 | Y | SKETAKKTR | 65.62 | SKETATKTR | 6.25 | SKETARKTR | 6.25 | SKEAAKKTR | 3.12 |
| anC | 20 | 1.31 | 4 | 4 | 0 | Y | KETAKKTRQ | 65.62 | KETATKTRQ | 6.25 | KETARKTRQ | 6.25 | KEAAKKTRQ | 3.12 |
| anC | 21 | 1.31 | 4 | 4 | 0 | Y | ETAKKTRQS | 65.62 | ETATKTRQS | 6.25 | ETARKTRQS | 6.25 | EAAKKTRQS | 3.12 |
| anC | 22 | 1.31 | 4 | 4 | 0 | Y | TAKKTRQSR | 65.62 | TATKTRQPR | 6.25 | TARKTRQSR | 6.25 | AAKKTRQSR | 3.12 |
| anC | 23 | 1.12 | 3 | 3 | 0 | Y | AKKTRQSRV | 68.75 | ATKTRQPRV | 6.25 | ARKTRQSRV | 6.25 | | |
| anC | 24 | 1.79 | 4 | 4 | 0 | Y | KKTRQSRVQ | 40.62 | KKTRQSRVR | 28.12 | TKTRQPRVQ | 25 | RKTRQSRVQ | 6.25 |
| anC | 25 | 1.53 | 3 | 3 | 0 | Y | KTRQSRVQM | 46.88 | KTRQSRVRM | 28.12 | KTRQPRVQM | 25 | | |

Fig. 32-2

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | fr

Fig. 32-3

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 51 | — | 3 | 3 | 0 | Y | AGTARSPYL | 71.88 | AGTARNPYL | 25 | AGTVRSPVL | 3.12 | | |
| anC | 52 | — | 3 | 3 | 0 | Y | GTARSPVLK | 71.88 | GTARNPVLK | 25 | GTVRSPVLK | 3.12 | | |
| anC | 53 | — | 3 | 3 | 0 | Y | TARSPVLKS | 71.88 | TARNPVLKA | 25 | TVRSPVLKS | 3.12 | | |
| anC | 54 | — | 3 | 3 | 0 | Y | ARSPVLKSF | 71.88 | ARNPVLKAF | 25 | VRSPVLKSF | 3.12 | | |
| anC | 55 | 0.81 | 2 | 2 | 0 | Y | RSPVLKSFW | 75 | RNPVLKAFW | 25 | | | | |
| anC | 56 | 1.36 | 3 | 3 | 0 | Y | SPVLKSFWN | 59.38 | NPVLKAFWN | 25 | SPVLKSFWK | 15.62 | | |
| anC | 57 | 1.48 | 4 | 4 | 0 | Y | PVLKSFWNS | 59.38 | PVLKAFWNS | 25 | PVLKSFWKS | 12.5 | PVLKSFWKP | 3.12 |
| anC | 58 | 1.48 | 4 | 4 | 0 | Y | VLKSFWNSV | 59.38 | VLKAFWNSV | 25 | VLKSFWKSV | 12.5 | VLKSFWKPV | 3.12 |
| anC | 59 | 1.48 | 4 | 4 | 0 | Y | LKSFWNSVP | 59.38 | LKAFWNSVP | 25 | LKSFWKSVP | 12.5 | LKSFWKPVP | 3.12 |
| anC | 60 | 1.48 | 4 | 4 | 0 | Y | KSFWNSVPL | 59.38 | KAFWNSVPL | 25 | KSFWKSVPL | 12.5 | KSFWKPVPL | 3.12 |
| anC | 61 | 2.06 | 5 | 5 | 0 | Y | SFWNSVPLK | 34.38 | SFWNSVPLR | 25 | AFWNSVPLK | 25 | SFWKSVPLK | 12.5 |
| anC | 62 | 1.48 | 4 | 4 | 0 | Y | FWNSVPLKQ | 59.38 | FWNSVPLRQ | 25 | FWKSVPLKQ | 12.5 | FWKPVPLKQ | 3.12 |
| anC | 63 | 1.48 | 4 | 4 | 0 | Y | WNSVPLKQA | 59.38 | WNSVPLRQA | 25 | WKSVPLKQA | 12.5 | WKPVPLKQA | 3.12 |
| anC | 64 | 1.77 | 5 | 5 | 0 | Y | NSVPLKQAT | 53.12 | NSVPLRQAT | 25 | KSVPLKQAT | 12.5 | NSVPLKQAM | 6.25 |
| anC | 65 | 1.49 | 5 | 4 | 0 | Y | SVPLKQATA | 62.5 | SVPLRQATA | 25 | SVPLKQAMA | 6.25 | SVPLKQATT | 3.12 |
| anC | 66 | 1.31 | 4 | 4 | 0 | Y | VPLKQATAA | 65.62 | VPLRQATAA | 25 | VPLKQAMAA | 6.25 | VPLKQATTA | 3.12 |
| anC | 67 | 1.31 | 4 | 4 | 0 | Y | PLKQATAAL | 65.62 | PLRQATAAL | 25 | PLKQAMAAL | 6.25 | PLKQATTAL | 3.12 |
| anC | 68 | 1.31 | 4 | 4 | 0 | Y | LKQATAALR | 65.62 | LRQATAALR | 25 | LKQAMAALR | 6.25 | LKQATTALR | 3.12 |
| anC | 69 | 1.31 | 4 | 4 | 0 | Y | KQATAALRK | 65.62 | RQATAALRK | 25 | KQAMAALRK | 6.25 | KQATTALRK | 3.12 |
| anC | 70 | 0.53 | 3 | 3 | 0 | Y | QATAALRKI | 90.62 | QAMAALRKI | 6.25 | QATTALRKI | 3.12 | | |
| anC | 71 | 0.53 | 3 | 3 | 0 | Y | ATAALRKII | 90.62 | AMAALRKII | 6.25 | ATTALRKII | 3.12 | | |
| anC | 72 | 1.34 | 4 | 4 | 0 | Y | TAALRKIIK | 62.5 | TAALRKIIKR | 28.12 | MAALRKIIK | 6.25 | TTALRKIIKM | 3.12 |
| anC | 73 | 1.18 | 4 | 4 | 0 | Y | AALRKIIKA | 68.75 | AALRKIIKMA | 25 | TALRKIIKMA | 3.12 | AALRKIIKRA | 3.12 |
| anC | 74 | 1.18 | 4 | 4 | 0 | Y | ALRKIIKAV | 68.75 | ALRKIIKMAV | 25 | ALRKIIKMAV | 3.12 | ALRKIIKRAV | 3.12 |
| anC | 75 | 1.18 | 4 | 4 | 0 | Y | LRKIIKAVS | 68.75 | LRKIIKMAVS | 25 | LRKIIKMAVS | 3.12 | LRKIIKRAVS | 3.12 |

Fig. 32-4

Species: TBEV (9-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 76 | 1.37 | 5 | 5 | 0 | Y | RKIKKAVST | 65.62 | RKIKRTVSA | 25 | RKIKKAVSA | 3.12 | RKIKKAVST | 3.12 | RKIKM

Fig. 32-5

Species: TBEV (9-mers)

| protein | block starting position | block entropy | total peptides in block | # peptides required to cover 99% of block | gap/X fraction 99% of block | 99% of block covered w/ <= 5 peptides? | peptides required

Fig. 32-6

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block

Fig. 32-7

Species: TBEV (9-mers

Fig. 32-8

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 203 | 0.2 | 2 | 2 | 0 | Y | TRRSVLIPS | 96.88 | TRRSVLIRS | 3.12 | | | | | | |
| prM | 204 | 0.2 | 2 | 2 | 0 | Y | RRSVLIPSH | 96.88 | RRSVLIRSH | 3.12 | | | | | | |
| prM | 205 | 0.2 | 2 | 2 | 0 | Y | RSVLIPSHA | 96.88 | RSVLIRSHA | 3.12 | | | | | | |
| prM | 206 | 0.2 | 2 | 2 | 0 | Y | SVLI

Fig. 32-9

Species: TBEV (9-mers)

| protein | block starting position | block entropy | total peptides in block | # peptides required to cover 99% of block | gap/X fraction 99% of block | covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 228 | 0 | 1 | 1 | 0 | Y | DSLRTHLTR | 100 | | | | | | |
| prM | 229 | 0 | 1 | 1 | 0 | Y | SLRTHLTRV | 100 | | | | | | |
| prM | 230 | 0 | 1 | 1 | 0 | Y | LRTHLTRVE | 100 | | | | | | |
| prM | 231 | 0 | 1 | 1 | 0 | Y | RTHLTRVEG | 100 | | | | | | |
| prM | 232 | 0 | 1 | 1 | 0 | Y | THLTRVEGW | 100 | | | | | | |
| prM | 233 | 0 | 1 | 1 | 0 | Y | HLTRVEGWV | 100 | | | | | | |
| prM | 234 | 0 | 1 | 1 | 0 | Y | LTRVEGWVW | 100 | | | | | | |
| prM | 235 | 0 | 1 | 1 | 0 | Y | TRVEGWVWK | 100 | | | | | | |
| prM | 236 | 0 | 1 | 1 | 0 | Y | RVEGWVWKN | 100 | | | | | | |
| prM | 237 | 0.2 | 2 | 2 | 0 | Y | VEGWVWKNK | 96.88 | VEGWVWKNR | 3.12 | | | | |
| prM | 254 | 1.49 | 5 | 5 | 0 | Y | VWLTVESV | 62.5 | VVWLTLESV | 25 | IVWLTVESV | 6.25 | | |
| prM | 255 | 1.12 | 3 | 3 | 0 | Y | VWLTVESVW | 68.75 | VWLTLESVV | 25 | VVWMTVESV | 6.25 | VWWMTVESV | 3.12 |
| prM | 256 | 1.32 | 4 | 4 | 0 | Y | WLTVESVVT | 68.75 | WLTLESVVT | 18.75 | WMTVESVVT | 6.25 | | |
| prM | 257 | 1.32 | 4 | 4 | 0 | Y | LTVESVVTR | 68.75 | LTLESVVTR | 18.75 | LTLESVVA | 6.25 | | |
| prM | 258 | 1.68 | 5 | 5 | 0 | Y | TVESVVTRV | 59.38 | TLESVVTR | 18.75 | MTVESVVTR | 6.25 | | |
| prM | 269 | 1.37 | 5 | 5 | 0 | Y | TVESWTRV | 65.62 | TLESVVAR | 25 | TVESVVTRI | 6.25 | | |
| prM | 270 | 0.6 | 4 | 4 | 0 | Y | VWLLCLAP | 90.62 | LVLLCLAP | 3.12 | VVWLFCLAP | 3.12 | TVESVVTRT | |
| prM | 271 | 0.4 | 3 | 3 | 0 | Y | WLLCLAPV | 93.75 | VVLFCLAPV | 3.12 | AVLLCLAPV | 3.12 | VAVLLCLAP | 3.12 |
| prM | 272 | 0.2 | 2 | 2 | 0 | Y | VLLCLAPVY | 96.88 | ALLCLAPVY | 3.12 | VLFCLAPVY | 3.12 | VALLCLAPV | 3.12 |
| prM | 273 | 0.2 | 2 | 2 | 0 | Y | LLCLAPVYA | 96.88 | LFCLAPVYA | 3.12 | | | | |
| prM | 274 | 0 | 1 | 1 | 0 | Y | LCLAPVYAS | 100 | FCLAPVYAS | 3.12 | | | | |
| prM | 275 | 0 | 1 | 1 | 0 | Y | CLAPVYASR | 100 | | | | | | |
| prM | 276 | 0 | 1 | 1 | 0 | Y | LAPVYASRC | 100 | | | | | | |
| prM | 277 | 0 | 1 | 1 | 0 | Y | APVYASRCT | 100 | | | | | | |
| prM | 277 | 0 | 1 | 1 | 0 | Y | PVYASRCTH | 100 | | | | | | |
| prM | 278 | 0 | 1 | 1 | 0 | Y | VYASRCTHL | 100 | | | | | | |

Fig. 32-10

Species: TBEV (9-mers)

| protein | block starting position | block ent

Fig. 32-12

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 329 | 0.73 | 4 | 4 | 0 | Y | YQENPAKTR | 87.5 | YQESPAKTR | 6.25 | YQENPAQTR | 3.12 | YQEKPAKTR | 3.12 |
| E | 330 | 0.73 | 4 | 4 | 0 | Y | QENPAKTRE | 87.5 | QESPAKTRE | 6.25 | QEKPAKTRE | 3.12 | QENPAQTRE | 3.12 |
| E | 331 | 0.73 | 4 | 4 | 0 | Y | ENPAKTREY | 87.5 | ESPAKTREY | 6.25 | EKPAKTREY | 3.12 | ENPAQTREY | 3.12 |
| E | 332 | 0.73 | 4 | 4 | 0 | Y | NPAKTREYC | 87.5 | SPAKTREYC | 6.25 | NPAQTREYC | 3.12 | KPAKTREYC | 3.12 |
| E | 333 | 0.2 | 2 | 2 | 0 | Y | PAKTREYCL | 96.88 | PAQTREYCL | 3.12 | | | | |
| E | 334 | 0.2 | 2 | 2 | 0 | Y | AKTREYCLH | 96.88 | AQTREYCLH | 3.12 | | | | |
| E | 335 | 0.4 | 3 | 3 | 0 | Y | KTREYCLHA | 93.75 | KTREYCLHV | 3.12 | QTREYCLHA | 3.12 | | |
| E | 336 | 0.2 | 2 | 2 | 0 | Y | TREYCLHAK | 96.88 | TREYCLHVK | 3.12 | | | | |
| E | 337 | 0.2 | 2 | 2 | 0 | Y | REYCLHAKL | 96.88 | REYCLHVKL | 3.12 | | | | |
| E | 338 | 0.2 | 2 | 2 | 0 | Y | EYCLHAKLS | 96.88 | EYCLHVKLS | 3.12 | | | | |
| E | 339 | 0.2 | 2 | 2 | 0 | Y | YCLHAKLSD | 96.88 | YCLHVKLSD | 3.12 | | | | |
| E | 340 | 0.2 | 2 | 2 | 0 | Y | CLHAKLSDT | 96.88 | CLHVKLSDT | 3.12 | | | | |
| E | 341 | 0.2 | 2 | 2 | 0 | Y | LHAKLSDTK | 96.88 | LHVKLSDTK | 3.12 | | | | |
| E | 342 | 0.2 | 2 | 2 | 0 | Y | HAKLSDTKV | 96.88 | HVKLSDTKV | 3.12 | | | | |
| E | 343 | 0.2 | 2 | 2 | 0 | Y | AKLSDTKVA | 96.88 | VKLSDTKVA | 3.12 | | | | |
| E | 344 | 0 | 1 | 1 | 0 | Y | KLSDTKVAA | 100 | | | | | | |
| E | 345 | 0 | 1 | 1 | 0 | Y | LSDTKVAAR | 100 | | | | | | |
| E | 346 | 0 | 1 | 1 | 0 | Y | SDTKVAARC | 100 | | | | | | |
| E | 347 | 0 | 1 | 1 | 0 | Y | DTKVAARCP | 100 | | | | | | |
| E | 348 | 0 | 1 | 1 | 0 | Y | TKVAARCPT | 100 | | | | | | |
| E | 349 | 0.2 | 2 | 2 | 0 | Y | KVAARCPTM | 96.88 | KVAARCPTT | 3.12 | | | | |
| E | 350 | 0.2 | 2 | 2 | 0 | Y | VAARCPTMG | 96.88 | VAARCPTTG | 3.12 | | | | |
| E | 351 | 0.2 | 2 | 2 | 0 | Y | AARCPTMGP | 96.88 | AARCPTTGP | 3.12 | | | | |
| E | 352 | 0.2 | 2 | 2 | 0 | Y | ARCPTMGPA | 96.88 | ARCPTTGPA | 3.12 | | | | |
| E | 353 | 0.2 | 2 | 2 | 0 | Y | RCPTMGPAT | 96.88 | RCPTGPAT | 3.12 | | | | |

Fig. 32-13

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | pe

Fig. 32-14

Species: TBEV (

Fig. 32-15

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 404 | 0 | 1 | 1 | 0 | Y | KKKATGHY | 100 | | | | | | |
| E | 405 | 0 | 1 | 1 | 0 | Y | KKATGHYD | 100 | | | | | | |
| E | 406 | 0.2 | 2

Fig. 32-16

Species: TBEV (9-mers)

| protein | block starting position | block entropy | total peptides in block | # peptides required to cover 99% of block | gap/X fraction 99% of block | covered w/ <= 5

Fig. 32-17

Species: TBEV (9-mers)

| protein | block starting position | block entropy | total peptides in block | # peptides required to cover 99% of block | gap/X fraction 99% of block | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 454 | 1 | 3 | 3 | 0 | Y | LTMGDYGDV | 71.88 | LTMGEYGDV | 25 | LNMGDYGDV | 3.12 |
| E | 455 | 1 | 3 | 3 | 0 | Y | TMGDYGDVS | 71.88 | TMGEYGDVS | 25 | NMGDYGDVS | 3.12 |
| E | 456 | 0.81 | 2 | 2 | 0 | Y | MGDYGDVSL | 75 | MGEYGDVSL | 25 | | |
| E | 457 | 0.81 | 2 | 2 | 0 | Y | GDYGDVSLL | 75 | GEYGDVSLL | 25 | | |
| E | 458 | 0.81 | 2 | 2 | 0 | Y | DYGDVSLLC | 75 | EYGDVSLLC | 25 | | |
| E | 459 | 0.2 | 2 | 2 | 0 | Y | YGDVSLLCR | 96.88 | YGDVSLLCK | 3.12 | | |
| E | 460 | 0.2 | 2 | 2 | 0 | Y | GDVSLLCRV | 96.88 | GDVSLLCKV | 3.12 | | |
| E | 461 | 0.2 | 2 | 2 | 0 | Y | DVSLLCRVA | 96.88 | DVSLLCKVP | 3.12 | | |
| E | 462 | 0.2 | 2 | 2 | 0 | Y | VSLLCRVAS | 96.88 | VSLLCKVPS | 3.12 | | |
| E | 463 | 0.2 | 2 | 2 | 0 | Y | SLLCRVASG | 96.88 | SLLCKVPSG | 3.12 | | |
| E | 464 | 0.2 | 2 | 2 | 0 | Y | LLCRVASGV | 96.88 | LLCKVPSGV | 3.12 | | |
| E | 465 | 0.2 | 2 | 2 | 0 | Y | LCRVASGVD | 96.88 | LCKVPSGVD | 3.12 | | |
| E | 466 | 0.2 | 2 | 2 | 0 | Y | CRVASGVDL | 96.88 | CKVPSGVDL | 3.12 | | |
| E | 467 | 0.2 | 2 | 2 | 0 | Y | RVASGVDLA | 96.88 | KVPSGVDLA | 3.12 | | |
| E | 468 | 0.2 | 2 | 2 | 0 | Y | VASGVDLAQ | 96.88 | VPSGVDLAQ | 3.12 | | |
| E | 469 | 0.2 | 2 | 2 | 0 | Y | ASGVDLAQT | 96.88 | PSGVDLAQT | 3.12 | | |
| E | 470 | 0 | 1 | 1 | 0 | Y | SGVDLAQTV | 100 | | | | |
| E | 471 | 0 | 1 | 1 | 0 | Y | GVDLAQTVI | 100 | | | | |
| E | 472 | 0 | 1 | 1 | 0 | Y | VDLAQTVIL | 100 | | | | |
| E | 473 | 0 | 1 | 1 | 0 | Y | DLAQTVILE | 100 | | | | |
| E | 474 | 0 | 1 | 1 | 0 | Y | LAQTVILEL | 100 | | | | |
| E | 475 | 0 | 1 | 1 | 0 | Y | AQTVILELD | 100 | | | | |
| E | 476 | 0 | 1 | 1 | 0 | Y | QTVILELDK | 100 | | | | |
| E | 477 | 0 | 1 | 1 | 0 | Y | TVILELDKT | 100 | | | | |
| E | 478 | 1.42 | 3 | 3 | 0 | Y | VILELDKTS | 56.25 | VILELDKTV | 25 | VILELDKTL | 18.75 |

Fig. 32-18

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 479 | 1.42 | 3 | 3 | 0 | Y | ILELDKTSE | 56.25 | ILELDKTVE | 25 | ILELDKTLE | 18.75 | | |
| E | 480 | 1.42 | 3 | 3 | 0 | Y | LELDKTSEH | 56.25 | LELDKTVEH | 25 | LELDKTLEH | 18.75 | | |
| E | 481 | 1.42 | 3 | 3 | 0 | Y | ELDKTSEHL | 56.25 | ELDKTVEHL | 25 | ELDKTLEHL | 18.75 | | |
| E | 482 | 1.42 | 3 | 3 | 0 | Y | LDKTSEHLP | 56.25 | LDKTVEHLP | 25 | LDKTLEHLP | 18.75 | | |
| E | 483 | 1.42 | 3 | 3 | 0 | Y | DKTSEHLPT | 56.25 | DKTVEHLPT | 25 | DKTLEHLPT | 18.75 | | |
| E | 484 | 1.42 | 3 | 3 | 0 | Y | KTSEHLPTA | 56.25 | KTVEHLPTA | 25 | KTLEHLPTA | 18.75 | | |
| E | 485 | 1.42 | 3 | 3 | 0 | Y | TSEHLPTAW | 56.25 | TVEHLPTAW | 25 | TLEHLPTAW | 18.75 | | |
| E | 486 | 1.42 | 3 | 3 | 0 | Y | SEHLPTAWQ | 56.25 | VEHLPTAWQ | 25 | LEHLPTAWQ | 18.75 | | |
| E | 487 | 0 | 1 | 1 | 0 | Y | EHLPTAWQV | 100 | | | | | | |
| E | 488 | 0.2 | 2 | 2 | 0 | Y | HLPTAWQVH | 96.88 | HLPTAWQVR | 3.12 | | | | |
| E | 489 | 0.2 | 2 | 2 | 0 | Y | LPTAWQVHR | 96.88 | LPTAWQVRR | 3.12 | | | | |
| E | 490 | 0.2 | 2 | 2 | 0 | Y | PTAWQVHRD | 96.88 | PTAWQVRRD | 3.12 | | | | |
| E | 491 | 0.2 | 2 | 2 | 0 | Y | TAWQVHRDW | 96.88 | TAWQVRRDW | 3.12 | | | | |
| E | 492 | 0.2 | 2 | 2 | 0 | Y | AWQVHRDWF | 96.88 | AWQVRRDWF | 3.12 | | | | |
| E | 493 | 0.2 | 2 | 2 | 0 | Y | WQVHRDWFN | 96.88 | WQVRRDWFN | 3.12 | | | | |
| E | 494 | 0.2 | 2 | 2 | 0 | Y | QVHRDWFND | 96.88 | QVRRDWFND | 3.12 | | | | |
| E | 495 | 0.2 | 2 | 2 | 0 | Y | VHRDWFNDL | 96.88 | VRRDWFNDL | 3.12 | | | | |
| E | 496 | 0.2 | 2 | 2 | 0 | Y | HRDWFNDLA | 96.88 | RRDWFNDLA | 3.12 | | | | |
| E | 497 | 0 | 1 | 1 | 0 | Y | RDWFNDLAL | 100 | | | | | | |
| E | 498 | 0 | 1 | 1 | 0 | Y | DWFNDLALP | 100 | | | | | | |
| E | 499 | 0 | 1 | 1 | 0 | Y | WFNDLALPW | 100 | | | | | | |
| E | 500 | 0.45 | 2 | 2 | 0 | Y | FNDLALPWK | 90.62 | FNDLALPWR | 9.38 | | | | |
| E | 501 | 0.45 | 2 | 2 | 0 | Y | NDLALPWKH | 90.62 | NDLALPWRH | 9.38 | | | | |
| E | 502 | 0.45 | 2 | 2 | 0 | Y | DLALPWKHE | 90.62 | DLALPWRHE | 9.38 | | | | |
| E | 503 | 0.45 | 2 | 2 | 0 | Y | LALPWKHEG | 90.62 | LALPWRHEG | 9.38 | | | | |

Fig. 32-19

Species: TBEV (9-mers)

| protein | block starting position | block entropy | total peptides in block | # peptides required to cover 99% of block | gap/X fraction | 99% of block covered w/ <= 5 peptides? | peptides required

Fig. 32-20

Species: TBEV (9-mers)

| protein | block starting position | block entropy | total pept

Fig. 32-21

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 557 | 1.12 | 3 | 3 | 0 | Y | DGTKYHLKS | 68.75 | EGTKYHLKS | 25 | DGAKYHLKS | 6.25 | | |
| E | 558 | 0.34 | 2 | 2 | 0 | Y | GTKYHLKSG | 93.75 | GAKYHLKSG | 6.25 | | | | |
| E | 559 | 0.34 | 2 | 2 | 0 | Y | TKYHLKSGH | 93.75 | AKYHLKSGH | 6.25 | | | | |
| E | 560 | 0 | 1 | 1 | 0 | Y | KYHLKSGHV | 100 | | | | | | |
| E | 561 | 0 | 1 | 1 | 0 | Y | YHLKSGHVT | 100 | | | | | | |
| E | 562 | 0 | 1 | 1 | 0 | Y | HLKSGHVTC | 100 | | | | | | |
| E | 563 | 0 | 1 | 1 | 0 | Y | LKSGHVTCE | 100 | | | | | | |
| E | 564 | 0 | 1 | 1 | 0 | Y | KSGHVTCEV | 100 | | | | | | |
| E | 565 | 0 | 1 | 1 | 0 | Y | SGHVTCEVG | 100 | | | | | | |
| E | 566 | 0 | 1 | 1 | 0 | Y | GHVTCEVGL | 100 | | | | | | |
| E | 567 | 0 | 1 | 1 | 0 | Y | HVTCEVGLE | 100 | | | | | | |
| E | 568 | 0 | 1 | 1 | 0 | Y | VTCEVGLEK | 100 | | | | | | |
| E | 569 | 0 | 1 | 1 | 0 | Y | TCEVGLEKL | 100 | | | | | | |
| E | 570 | 0 | 1 | 1 | 0 | Y | CEVGLEKLK | 100 | | | | | | |
| E | 571 | 0 | 1 | 1 | 0 | Y | EVGLEKLKM | 100 | | | | | | |
| E | 572 | 0.2 | 2 | 2 | 0 | Y | VGLEKLKMK | 96.88 | VGLEKLKMN | 3.12 | | | | |
| E | 573 | 0.2 | 2 | 2 | 0 | Y | GLEKLKMKG | 96.88 | GLEKLKMNG | 3.12 | | | | |
| E | 574 | 0.2 | 2 | 2 | 0 | Y | LEKLKMKGL | 96.88 | LEKLKMNGL | 3.12 | | | | |
| E | 575 | 0.2 | 2 | 2 | 0 | Y | EKLKMKGLI | 96.88 | EKLKMNGLI | 3.12 | | | | |
| E | 576 | 0.2 | 2 | 2 | 0 | Y | KLKMKGLIY | 96.88 | KLKMNGLIY | 3.12 | | | | |
| E | 577 | 0.2 | 2 | 2 | 0 | Y | LKMKGLIYT | 96.88 | LKMNGLIYT | 3.12 | | | | |
| E | 578 | 0.53 | 3 | 3 | 0 | Y | KMKGLIYTM | 90.62 | KMKGLIYTV | 6.25 | KMNGLIYTM | 3.12 | | |
| E | 579 | 0.53 | 3 | 3 | 0 | Y | MKGLIYTMC | 90.62 | MKGLIYTVC | 6.25 | MNGLIYTMC | 3.12 | | |
| E | 580 | 0.53 | 3 | 3 | 0 | Y | KGLIYTMCD | 90.62 | KGLIYTVCD | 6.25 | NGLIYTMCD | 3.12 | | |
| E | 581 | 0.34 | 2 | 2 | 0 | Y | GLIYTMCDK | 93.75 | GLIYTVCDK | 6.25 | | | | |

Fig. 32-22

Species: TBEV (9-mers)

| protein | block starting position | block entropy | total peptides in block | # peptides required to cover 99% of block | gap/X fraction | 99% of block covered w/ <= 5 peptides? | block to cover 99% of block | frequency | block to cover 99% of block | frequency | block to cover 99% of block | frequency | block to cover 99% of block | frequency | block to cover 99% of block | frequency |
|---|---|---|---|---|---|---|---|---|---|---|---|---|---|---|---|---|
| E | 582 | 0.34 | 2 | 2 | 0 | Y | LTYTMCDKT | 93.75 | LTYTYCDKT | 6.25 | | | | | | |
| E | 583 | 0.34 | 2 | 2 | 0 | Y | TYTMCDKTK | 93.75 | TYTVCDKTK | 6.25 | | | | | | |
| E | 584 | 0.34 | 2 | 2 | 0 | Y | YTMCDKTKF | 93.75 | YTVCDKTKF | 6.25 | | | | | | |
| E | 585 | 0.87 | 3 | 3 | 0 | Y | TMCDKTKFT | 81.25 | TMCDKTKFA | 12.5 | TVCDKTKFT | 6.25 | | | | |
| E | 586 | 0.87 | 3 | 3 | 0 | Y | MCDKTKFTW | 81.25 | MCDKTKFAW | 12.5 | VCDKTKFTW | 6.25 | | | | |
| E | 587 | 0.74 | 3 | 3 | 0 | Y | CDKTKFTWK | 84.38 | CDKTKFAWK | 12.5 | CDKTKFTWR | 3.12 | | | | |
| E | 588 | 0.74 | 3 | 3 | 0 | Y | DKTKFTWKR | 84.38 | DKTKFAWKR | 12.5 | DKTKFTWRR | 3.12 | | | | |
| E | 589 | 1.85 | 5 | 5 | 0 | Y | KTKFTWKRI | 50 | KTKFTWKRA | 25 | KTKFAWKRT | 12.5 | KTKFTWKRT | 9.38 | KTKFTWRRT | 3.12 |
| E | 590 | 1.85 | 5 | 5 | 0 | Y | TKFTWKRIP | 50 | TKFTWKRAP | 25 | TKFAWKRTP | 12.5 | TKFTWKRTP | 9.38 | TKFTWRRTP | 3.12 |
| E | 591 | 1.85 | 5 | 5 | 0 | Y | KFTWKRIPT | 50 | KFTWKRAPT | 25 | KFAWKRTPT | 12.5 | KFTWKRTPT | 9.38 | KFTWRRTPT | 3.12 |
| E | 592 | 1.85 | 5 | 5 | 0 | Y | FTWKRIPTD | 50 | FTWKRAPTD | 25 | FAWKRTPTD | 12.5 | FTWKRTPTD | 9.38 | FTWRRTPTD | 3.12 |
| E | 593 | 1.85 | 5 | 5 | 0 | Y | TWKRIPTDS | 50 | TWKRAPTDS | 25 | AWKRTPTDS | 12.5 | TWKRTPTDS | 9.38 | TWRRTPTDS | 3.12 |
| E | 594 | 1.64 | 4 | 4 | 0 | Y | WKRIPTDSG | 50 | WKRAPTDSG | 25 | WKRTPTDSG | 21.88 | WRRTPTDSG | 3.12 | | |
| E | 595 | 1.64 | 4 | 4 | 0 | Y | KRIPTDSGH | 50 | KRAPTDSGH | 25 | KRTPTDSGH | 21.88 | RRTPTDSGH | 3.12 | | |
| E | 596 | 1.5 | 3 | 3 | 0 | Y | RIPTDSGHD | 50 | RAPTDSGHD | 25 | RTPTDSGHD | 25 | | | | |
| E | 597 | 1.5 | 3 | 3 | 0 | Y | IPTDSGHDT | 50 | TPTDSGHDT | 25 | APTDSGHDT | 25 | | | | |
| E | 598 | 0 | 1 | 1 | 0 | Y | PTDSGHDTV | 100 | | | | | | | | |
| E | 599 | 0 | 1 | 1 | 0 | Y | TDSGHDTVW | 100 | | | | | | | | |
| E | 600 | 0 | 1 | 1 | 0 | Y | DSGHDTVWM | 100 | | | | | | | | |
| E | 601 | 0 | 1 | 1 | 0 | Y | SGHDTVWME | 100 | | | | | | | | |
| E | 602 | 0 | 1 | 1 | 0 | Y | GHDTVWMEV | 100 | | | | | | | | |
| E | 603 | 1.23 | 3 | 3 | 0 | Y | HDTVWMEVA | 59.38 | HDTVWMEVT | 34.38 | HDTVWMEVS | 6.25 | | | | |
| E | 604 | 1.23 | 3 | 3 | 0 | Y | DTVWMEVAF | 59.38 | DTVWMEVTF | 34.38 | DTVWMEVSF | 6.25 | | | | |
| E | 605 | 1.23 | 3 | 3 | 0 | Y | TVWMEVAFS | 59.38 | TVWMEVTFS | 34.38 | TVWMEVSFS | 6.25 | | | | |
| E | 606 | 1.23 | 3 | 3 | 0 | Y | VWMEVAFSG | 59.38 | VWMEVTFSG | 34.38 | VWMEVSFSG | 6.25 | | | | |

Fig. 32-23

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 607 | 1.23 | 3 | 3 | 0 | Y | VMEVAFSGT | 59.38 | VMEVTFSGT | 34.38 | VMEVSFSGT | 6.25 | | |
| E | 608 | 1.23 | 3 | 3 | 0 | Y | MEVAFSGTK | 59.38 | MEVTFSGTK | 34.38 | MEVSFSGTK | 6.25 | | |
| E | 609 | 1.23 | 3 | 3 | 0 | Y | EVAFSGTKP | 59.38 | EVTFSGTKP | 34.38 | EVSFSGTKP | 6.25 | | |
| E | 610 | 1.23 | 3 | 3 | 0 | Y | VAFSGTKPC | 59.38 | VTFSGTKPC | 34.38 | VSFSGTKPC | 6.25 | | |
| E | 611 | 1.23 | 3 | 3 | 0 | Y | AFSGTKPCR | 59.38 | TFSGTKPCR | 34.38 | SFSGTKPCR | 6.25 | | |
| E | 612 | 0 | 1 | 1 | 0 | Y | FSGTKPCRI | 100 | | | | | | |
| E | 613 | 0 | 1 | 1 | 0 | Y | SGTKPCRIP | 100 | | | | | | |
| E | 614 | 0 | 1 | 1 | 0 | Y | GTKPCRIPV | 100 | | | | | | |
| E | 615 | 0 | 1 | 1 | 0 | Y | TKPCRIPVR | 100 | | | | | | |
| E | 616 | 0 | 1 | 1 | 0 | Y | KPCRIPVRA | 100 | | | | | | |
| E | 617 | 0 | 1 | 1 | 0 | Y | PCRIPVRAV | 100 | | | | | | |
| E | 618 | 0 | 1 | 1 | 0 | Y | CRIPVRAVA | 100 | | | | | | |
| E | 619 | 0 | 1 | 1 | 0 | Y | RIPVRAVAH | 100 | | | | | | |
| E | 620 | 0 | 1 | 1 | 0 | Y | IPVRAVAHG | 100 | | | | | | |
| E | 621 | 0.34 | 2 | 2 | 0 | Y | PVRAVAHGS | 93.75 | PVRAVAHGF | 6.25 | | | | |
| E | 622 | 0.34 | 2 | 2 | 0 | Y | VRAVAHGSP | 93.75 | VRAVAHGFP | 6.25 | | | | |
| E | 623 | 0.34 | 2 | 2 | 0 | Y | RAVAHGSPD | 93.75 | RAVAHGFPD | 6.25 | | | | |
| E | 624 | 0.34 | 2 | 2 | 0 | Y | AVAHGSPDV | 93.75 | AVAHGFPDV | 6.25 | | | | |
| E | 625 | 0.34 | 2 | 2 | 0 | Y | VAHGSPDVN | 93.75 | VAHGFPDVN | 6.25 | | | | |
| E | 626 | 0.34 | 2 | 2 | 0 | Y | AHGSPDVNV | 93.75 | AHGFPDVNV | 6.25 | | | | |
| E | 627 | 0.34 | 2 | 2 | 0 | Y | HGSPDVNVA | 93.75 | HGFPDVNVA | 6.25 | | | | |
| E | 628 | 0.34 | 2 | 2 | 0 | Y | GSPDVNVAM | 93.75 | GFPDVNVAM | 6.25 | | | | |
| E | 629 | 0.34 | 2 | 2 | 0 | Y | SPDVNVAML | 93.75 | FPDVNVAML | 6.25 | | | | |
| E | 630 | 0 | 1 | 1 | 0 | Y | PDVNVAMLI | 100 | | | | | | |
| E | 631 | 0 | 1 | 1 | 0 | Y | DVNVAMLIT | 100 | | | | | | |

Fig. 32-24

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|

Fig. 32-25

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 657 | 0 | 1 | 1 | 0 | Y | PPG Fig.

Fig. 32-27

Species: TBEV (9-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 707 | 1.68 | 4 | 4 | 0 | Y | GGFLTSVGK | 53.12 | GGFLASVGK | 12.5 | GGLLTSVGK | 9.38 | | |
| E | 708 | 1.68 | 4 | 4 | 0 | Y | GFLTSVGKA | 53.12 | GFLASVGKA | 12.5 | GLLTSVGKA | 9.38 | | |
| E | 709 | 1.82 | 5 | 5 | 0 | Y | FLTSVGKAL | 53.12 | FLASVGKAL | 12.5 | LLTSVGKAL | 9.38 | FLSSIGKAL | 3.12 |
| E | 710 | 1.43 | 4 | 4 | 0 | Y | LTSVGKALH | 62.5 | LASVGKALH | 12.5 | LSSIGKALH | 3.12 | | |
| E | 711 | 1.43 | 4 | 4 | 0 | Y | TSVGKALHT | 62.5 | ASVGKALHT | 12.5 | SSIGKALHT | 3.12 | | |
| E | 712 | 0.95 | 3 | 3 | 0 | Y | SVGKALHTV | 75 | SIGKALHTV | 12.5 | | | | |
| E | 713 | 0.95 | 3 | 3 | 0 | Y | VGKALHTVL | 75 | IGKALHTVL | 12.5 | | | | |
| E | 714 | 0.76 | 2 | 2 | 0 | Y | GKALHTVLG | 78.12 | | | | | | |
| E | 715 | 0.76 | 2 | 2 | 0 | Y | KALHTVLGG | 78.12 | | | | | | |
| E | 716 | 0.76 | 2 | 2 | 0 | Y | ALHTVLGGA | 78.12 | | | | | | |
| E | 717 | 0.76 | 2 | 2 | 0 | Y | LHTVLGGAF | 78.12 | | | | | | |
| E | 718 | 0 | 1 | 1 | 0 | Y | HTVLGGAFN | 100 | | | | | | |
| E | 719 | 0 | 1 | 1 | 0 | Y | TVLGGAFNS | 100 | | | | | | |
| E | 720 | 0.97 | 2 | 2 | 0 | Y | VLGGAFNSL | 59.38 | VLGGAFNSI | 40.62 | | | | |
| E | 721 | 0.97 | 2 | 2 | 0 | Y | LGGAFNSLF | 59.38 | LGGAFNSIF | 40.62 | | | | |
| E | 722 | 0.97 | 2 | 2 | 0 | Y | GGAFNSLFG | 59.38 | GGAFNSIFG | 40.62 | | | | |
| E | 723 | 0.97 | 2 | 2 | 0 | Y | GAFNSLFGG | 59.38 | GAFNSIFGG | 40.62 | | | | |
| E | 724 | 0.97 | 2 | 2 | 0 | Y | AFNSLFGGV | 59.38 | AFNSIFGGV | 40.62 | | | | |
| E | 725 | 0.97 | 2 | 2 | 0 | Y | FNSLFGGVG | 59.38 | FNSIFGGVG | 40.62 | | | | |
| E | 726 | 0.97 | 2 | 2 | 0 | Y | NSLFGGVGF | 59.38 | NSIFGGVGF | 40.62 | | | | |
| E | 727 | 1.15 | 3 | 3 | 0 | Y | SLFGGVGFL | 56.25 | SIFGGVGFL | 40.62 | SLFGGVGFI | 3.12 | | |
| E | 728 | 1.15 | 3 | 3 | 0 | Y | LFGGVGFLP | 56.25 | IFGGVGFLP | 40.62 | LFGGVGFIP | 3.12 | | |
| E | 729 | 0.2 | 2 | 2 | 0 | Y | FGGVGFLPK | 96.88 | FGGVGFIPK | 3.12 | | | | |
| E | 730 | 1.15 | 3 | 3 | 0 | Y | GGVGFLPKI | 56.25 | GGVGFLPKL | 40.62 | GGVGFIPKL | 3.12 | | |
| E | 731 | 1.15 | 3 | 3 | 0 | Y | GVGFLPKIL | 56.25 | GVGFLPKLL | 40.62 | GVGFIPKLL | 3.12 | | |

Fig. 32-28

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 732 | 1.6 | 5 | 5 | 0 | Y | VGFLPKILV | 46.88 | VGFLPKILM | 6.25 | VGFLPKILI | 3.12 | VGFIPKLLL | 3.12 |
| E | 733 | 1.6 | 5 | 5 | 0 | Y | GFLPKILVG | 46.88 | GFLPKILMG | 6.25 | GFIPKLLLG | 3.12 | GFLPKILLG | 3.12 |
| E | 741 | 1.13 | 4 | 4 | 0 | Y | GVALAWLGL | 71.88 | GMALAWLGL | 3.12 | GAALAWLGL | 3.12 | | |
| E | 742 | 1.13 | 4 | 4 | 0 | Y | VALAWLGLN | 71.88 | AALAWLGLN | 3.12 | MALAWLGLN | 3.12 | | |
| E | 743 | 0.76 | 2 | 2 | 0 | Y | ALAWLGLNM | 78.12 | | | | | | |
| E | 744 | 0 | 1 | 1 | 0 | Y | LAWLGLNMR | 100 | | | | | | |
| E | 745 | 0 | 1 | 1 | 0 | Y | AWLGLNMRN | 100 | | | | | | |
| E | 746 | 0 | 1 | 1 | 0 | Y | WLGLNMRNP | 100 | | | | | | |
| E | 747 | 0 | 1 | 1 | 0 | Y | LGLNMRNPT | 100 | | | | | | |
| E | 748 | 0 | 1 | 1 | 0 | Y | GLNMRNPTM | 100 | | | | | | |
| E | 749 | 0 | 1 | 1 | 0 | Y | LNMRNPTMS | 100 | | | | | | |
| E | 750 | 0 | 1 | 1 | 0 | Y | NMRNPTMSM | 100 | | | | | | |
| E | 751 | 0.45 | 2 | 2 | 0 | Y | MRNPTMSMS | 90.62 | MRNPTMSMG | 9.38 | | | | |
| E | 752 | 0.45 | 2 | 2 | 0 | Y | RNPTMSMSF | 90.62 | RNPTMSMGF | 9.38 | | | | |
| E | 753 | 0.45 | 2 | 2 | 0 | Y | NPTMSMSFL | 90.62 | NPTMSMGFL | 9.38 | | | | |
| E | 754 | 0.45 | 2 | 2 | 0 | Y | PTMSMSFLL | 90.62 | PTMSMGFLL | 9.38 | | | | |
| E | 755 | 0.45 | 2 | 2 | 0 | Y | TMSMSFLLA | 90.62 | TMSMGFLLA | 9.38 | | | | |
| E | 756 | 0.45 | 2 | 2 | 0 | Y | MSMSFLLAG | 90.62 | MSMGFLLAG | 9.38 | | | | |
| E | 757 | 0.64 | 3 | 3 | 0 | Y | SMSFLLAGG | 87.5 | SMGFLLAGG | 9.38 | SMSFLLAGV | 3.12 | | |
| E | 758 | 0.64 | 3 | 3 | 0 | Y | MSFLLAGGL | 87.5 | MGFLLAGGL | 9.38 | MSFLLAGVL | 3.12 | | |
| E | 759 | 0.64 | 3 | 3 | 0 | Y | SFLLAGGLV | 87.5 | GFLLAGGLV | 9.38 | SFLLAGVLV | 3.12 | | |
| E | 760 | 0.2 | 2 | 2 | 0 | Y | FLLAGGLVL | 96.88 | FLLAGVLVL | 3.12 | | | | |
| E | 761 | 0.2 | 2 | 2 | 0 | Y | LLAGGLVLA | 96.88 | LLAGVLVLA | 3.12 | | | | |
| E | 762 | 0.2 | 2 | 2 | 0 | Y | LAGGLVLAM | 96.88 | LAGVLVLAM | 3.12 | | | | |
| E | 763 | 0.2 | 2 | 2 | 0 | Y | AGGLVLAMT | 96.88 | AGVLVLAMT | 3.12 | | | | |

Fig. 32-29

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 764 | 0.2 | 2 | 2 | 0 | Y | GGLVLAMTL | 96.88 | GVLVLAMTL | 3.12 |
| E | 765 | 0.2 | 2 | 2 | 0 | Y | GLVLAMTLG | 96.88 | VLVLAMTLG | 3.12 |
| E | 766 | 0 | 1 | 1 | 0 | Y | LVLAMTLGV | 100 | | |
| E | 767 | 0 | 1 | 1 | 0 | Y | VLAMTLGVG | 100 | | |
| E | 768 | 0 | 1 | 1 | 0 | Y | LAMTLGVGA | 100 | | |
| E | 769 | 0 | 1 | 1 | 0 | Y | AMTLGVGAD | 100 | | |
| E | 770 | 0 | 1 | 1 | 0 | Y | MTLGVGADV | 100 | | |
| E | 771 | 0 | 1 | 1 | 0 | Y | TLGVGADVG | 100 | | |
| E | 772 | 0.34 | 2 | 2 | 0 | Y | LGVGADVGC | 93.75 | LGVGADVGG | 6.25 |
| E | 773 | 0.34 | 2 | 2 | 0 | Y | GVGADVGCA | 93.75 | GVGADVGGA | 6.25 |
| E | 774 | 0.34 | 2 | 2 | 0 | Y | VGADVGCAV | 93.75 | VGADVGGAV | 6.25 |
| E | 775 | 0.34 | 2 | 2 | 0 | Y | GADVGCAVD | 93.75 | GADVGGAVD | 6.25 |
| E | 776 | 0.34 | 2 | 2 | 0 | Y | ADVGCAVDT | 93.75 | ADVGGAVDT | 6.25 |
| E | 777 | 0.34 | 2 | 2 | 0 | Y | DVGCAVDTE | 93.75 | DVGGAVDTE | 6.25 |
| E | 778 | 0.34 | 2 | 2 | 0 | Y | VGCAVDTER | 93.75 | VGGAVDTER | 6.25 |
| E | 779 | 0.34 | 2 | 2 | 0 | Y | GCAVDTERM | 93.75 | GGAVDTERM | 6.25 |
| E | 780 | 0.34 | 2 | 2 | 0 | Y | CAVDTERME | 93.75 | GAVDTERME | 6.25 |
| NS1 | 781 | 0 | 1 | 1 | 0 | Y | AVDTERMEL | 100 | | |
| NS1 | 782 | 0 | 1 | 1 | 0 | Y | VDTERMELR | 100 | | |
| NS1 | 783 | 0 | 1 | 1 | 0 | Y | DTERMELRC | 100 | | |
| NS1 | 784 | 0 | 1 | 1 | 0 | Y | TERMELRCG | 100 | | |
| NS1 | 785 | 0 | 1 | 1 | 0 | Y | ERMELRCGE | 100 | | |
| NS1 | 786 | 0 | 1 | 1 | 0 | Y | RMELRCGEG | 100 | | |
| NS1 | 787 | 0 | 1 | 1 | 0 | Y | MELRCGEGL | 100 | | |
| NS1 | 788 | 0 | 1 | 1 | 0 | Y | ELRCGEGLV | 100 | | |

Fig. 32-30

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | fr

Fig. 32-31

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block

Fig. 32-32

Species: TBEV (9

Fig. 32-33

Species: TBEV (9-mers)

| protein | position | block entropy | total peptides in block | # peptides required to cover 99% of block | 99% of block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 864 | — | 3 | 3 | 0 | Y | VVDKLDPT | 71.88 | VVDKFDPT | 25 | | | | |
| NS1 | 865 | — | 3 | 3 | 0 | Y | VVDKLDPTD | 71.88 | VVDKFDPTD | 25 | MVDKFDPTD | 3.12 | | |
| NS1 | 866 | 0.86 | 2 | 2 | 0 | Y | VDKLDPTDY | 71.88 | VDKFDPTDY | 28.12 | | | | |
| NS1 | 867 | 0.86 | 2 | 2 | 0 | Y | DKLDPTDYR | 71.88 | DKFDPTDYR | 28.12 | | | | |
| NS1 | 868 | 0.86 | 2 | 2 | 0 | Y | KLDPTDYRG | 71.88 | KFDPTDYRG | 28.12 | | | | |
| NS1 | 869 | 0.86 | 2 | 2 | 0 | Y | LDPTDYRGG | 71.88 | FDPTDYRGG | 28.12 | | | | |
| NS1 | 870 | 0.97 | 3 | 3 | 0 | Y | DPTDYRGGI | 59.38 | DPTDYRGGV | 40.62 | | | | |
| NS1 | 871 | 1.13 | 3 | 3 | 0 | Y | PTDYRGGIP | 59.38 | PTDYRGGVP | 37.5 | PTDYRGGVS | 3.12 | | |
| NS1 | 872 | 1.13 | 3 | 3 | 0 | Y | TDYRGGIPG | 59.38 | TDYRGGVPG | 37.5 | TDYRGGVSG | 3.12 | | |
| NS1 | 873 | 1.13 | 3 | 3 | 0 | Y | DYRGGIPGL | 59.38 | DYRGGVPGL | 37.5 | DYRGGVSGL | 3.12 | | |
| NS1 | 874 | 1.13 | 3 | 3 | 0 | Y | YRGGIPGLL | 59.38 | YRGGVPGLL | 37.5 | YRGGVSGLL | 3.12 | | |
| NS1 | 875 | 1.31 | 4 | 4 | 0 | Y | RGGIPGLLK | 56.25 | RGGVPGLLK | 37.5 | RGGVSGLLR | 3.12 | RGGIPGLLR | 3.12 |
| NS1 | 876 | 1.31 | 4 | 4 | 0 | Y | GGIPGLLKK | 56.25 | GGVPGLLKK | 37.5 | GGIPGLLRK | 3.12 | GGVSGLLRK | 3.12 |
| NS1 | 877 | 1.31 | 4 | 4 | 0 | Y | GIPGLLKKG | 56.25 | GVPGLLKKG | 37.5 | GIPGLLRKG | 3.12 | GVSGLLRKG | 3.12 |
| NS1 | 878 | 1.31 | 4 | 4 | 0 | Y | IPGLLKKGK | 56.25 | VPGLLKKGK | 37.5 | VSGLLRKGK | 3.12 | IPGLLRKGK | 3.12 |
| NS1 | 879 | 0.4 | 3 | 3 | 0 | Y | PGLLKKGKD | 93.75 | SGLLRKGKD | 3.12 | PGLLRKGKD | 3.12 | | |
| NS1 | 880 | 0.34 | 2 | 2 | 0 | Y | GLLKKGKDI | 93.75 | GLLRKGKDI | 6.25 | | | | |
| NS1 | 881 | 0.53 | 3 | 3 | 0 | Y | LLKKGKDIK | 90.62 | LLRKGKDIK | 6.25 | LLKKGKDIR | 3.12 | | |
| NS1 | 882 | 0.53 | 3 | 3 | 0 | Y | LKKGKDIKV | 90.62 | LRKGKDIKV | 6.25 | LKKGKDIRV | 3.12 | | |
| NS1 | 883 | 0.53 | 3 | 3 | 0 | Y | KKGKDIKVS | 90.62 | RKGKDIKVS | 6.25 | KKGKDIRVS | 3.12 | | |
| NS1 | 884 | 0.2 | 2 | 2 | 0 | Y | KGKDIKVSW | 96.88 | KGKDIRVSW | 3.12 | | | | |
| NS1 | 885 | 0.4 | 3 | 3 | 0 | Y | GKDIKVSWK | 93.75 | GKDIRVSWK | 3.12 | GKDIKVSWR | 3.12 | | |
| NS1 | 886 | 0.4 | 3 | 3 | 0 | Y | KDIKVSWKS | 93.75 | KDIRVSWKS | 3.12 | KDIKVSWRS | 3.12 | | |
| NS1 | 887 | 0.4 | 3 | 3 | 0 | Y | DIKVSWKSW | 93.75 | DIRVSWKSW | 3.12 | DIKVSWRSW | 3.12 | | |
| NS1 | 888 | 0.4 | 3 | 3 | 0 | Y | IKVSWKSWG | 93.75 | IRVSWKSWG | 3.12 | IKVSWRSWG | 3.12 | | |

Fig. 32-34

Species: TBEV (9-mers)

| protein | block starting position | block entropy | total peptides in block | # peptides required to cover 99% of block | gap/X fraction | 99% of block covered w/ <= 5 peptides? | block (99% cover) | frequency | block | frequency | block | frequency | block | frequency |
|---|---|---|---|---|---|---|---|---|---|---|---|---|---|---|
| NS1 | 889 | 1.08 | 4 | 4 | 0 | Y | KVSWKSWGH | 75 | KVSWKSWGQ | 18.75 | KVSWRSWGH | 3.12 | RVSWKSWGH | 3.12 |
| NS1 | 890 | 1.01 | 4 | 4 | 0 | Y | VSWKSWGHS | 78.12 | VSWKSWGQS | 15.62 | VSWKSWGQA | 3.12 | VSWRSWGHS | 3.12 |
| NS1 | 894 | 1.12 | 5 | 5 | 0 | Y | SWGHSMIWS | 78.12 | SWGQSMIWS | 12.5 | SWGQSVIWS | 3.12 | SWGQAMIWS | 3.12 | SWGHSIIWS | 3.12 |
| NS1 | 898 | 1.48 | 5 | 5 | 0 | Y | SMIWSVPEA | 53.12 | SMIWSIPEA | 37.5 | AMIWSIPEA | 3.12 | SIIWSIPEA | 3.12 | SVIWSIPEA | 3.12 |
| NS1 | 899 | 1.48 | 5 | 5 | 0 | Y | MIWSVPEAP | 53.12 | MIWSIPEAP | 37.5 | MIWSIPEAS | 3.12 | IIWSIPEAP | 3.12 | VIWSIPEAP | 3.12 |
| NS1 | 900 | 1.16 | 3 | 3 | 0 | Y | IWSVPEAPR | 53.12 | IWSIPEAPR | 43.75 | IWSIPEASR | 3.12 | | | | |
| NS1 | 901 | 1.16 | 3 | 3 | 0 | Y | WSVPEAPRR | 53.12 | WSIPEAPRR | 43.75 | WSIPEASRR | 3.12 | | | | |
| NS1 | 902 | 1.16 | 3 | 3 | 0 | Y | SVPEAPRRF | 53.12 | SIPEAPRRF | 43.75 | SIPEASRRF | 3.12 | | | | |
| NS1 | 903 | 1.16 | 3 | 3 | 0 | Y | VPEAPRRFM | 53.12 | IPEAPRRFM | 43.75 | IPEASRRFM | 3.12 | | | | |
| NS1 | 904 | 0.2 | 2 | 2 | 0 | Y | PEAPRRFMV | 96.88 | PEASRRFMV | 3.12 | | | | | | |
| NS1 | 905 | 0.2 | 2 | 2 | 0 | Y | EAPRRFMVG | 96.88 | EASRRFMVG | 3.12 | | | | | | |
| NS1 | 906 | 0.4 | 3 | 3 | 0 | Y | APRRFMVGT | 93.75 | APRRFMVGI | 3.12 | ASRRFMVGT | 3.12 | | | | |
| NS1 | 907 | 0.4 | 3 | 3 | 0 | Y | PRRFMVGTE | 93.75 | PRRFMVGIE | 3.12 | SRRFMVGTE | 3.12 | | | | |
| NS1 | 908 | 0.2 | 2 | 2 | 0 | Y | RRFMVGTEG | 96.88 | RRFMVGIEG | 3.12 | | | | | | |
| NS1 | 909 | 1.72 | 4 | 4 | 0 | Y | RFMVGTEGG | 37.5 | RFMVGTEGS | 34.38 | RFMVGTEGQ | 25 | RFMVGIEGS | 3.12 | | |
| NS1 | 918 | 0.89 | 3 | 3 | 0 | Y | SECPLERRK | 78.12 | NECPLERRK | 18.75 | SECPPERRK | 3.12 | | | | |
| NS1 | 919 | 0.2 | 2 | 2 | 0 | Y | ECPLERRKT | 96.88 | ECPPERRKT | 3.12 | | | | | | |
| NS1 | 920 | 0.2 | 2 | 2 | 0 | Y | CPLERRKTG | 96.88 | CPPERRKTG | 3.12 | | | | | | |
| NS1 | 921 | 0.4 | 3 | 3 | 0 | Y | PLERRKTGV | 93.75 | PPERRKTGV | 3.12 | PLERRKTGI | 3.12 | | | | |
| NS1 | 922 | 0.4 | 3 | 3 | 0 | Y | LERRKTGVF | 93.75 | LERRKTGIF | 3.12 | PERRKTGVF | 3.12 | | | | |
| NS1 | 923 | 0.2 | 2 | 2 | 0 | Y | ERRKTGVFT | 96.88 | ERRKTGIFT | 3.12 | | | | | | |
| NS1 | 924 | 0.2 | 2 | 2 | 0 | Y | RRKTGVFTV | 96.88 | RRKTGIFTV | 3.12 | | | | | | |
| NS1 | 925 | 0.2 | 2 | 2 | 0 | Y | RKTGVFTVA | 96.88 | RKTGIFTVA | 3.12 | | | | | | |
| NS1 | 926 | 0.2 | 2 | 2 | 0 | Y | KTGVFTVAE | 96.88 | KTGIFTVAE | 3.12 | | | | | | |
| NS1 | 927 | 0.2 | 2 | 2 | 0 | Y | TGVFTVAEF | 96.88 | TGIFTVAEF | 3.12 | | | | | | |

Fig. 32-35

Species: TBEV (9-mers)

| protein | block starting position | block entropy | total peptides in block | # peptides required to cover 99% of block | gap/X fraction | 99% of block covered w

Fig. 32-36

Species: TBEV (9-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 953 | 0 | 1 | 1 | 0 | Y | HECDTGVMG | 100 | | | | | | | | |
| NS1 | 954 | 0 | 1 | 1 | 0 | Y | ECDTGVMGA | 100 | | | | | | | | |
| NS1 | 955 | 0 | 1 | 1 | 0 | Y | CDTGVMGAA | 100 | | | | | | | | |
| NS1 | 956 | 0 | 1 | 1 | 0 | Y | DTGVMGAAV | 100 | | | | | | | | |
| NS1 | 957 | 0 | 1 | 1 | 0 | Y | TGVMGAAVK | 100 | | | | | | | | |
| NS1 | 958 | 0 | 1 | 1 | 0 | Y | GVMGAAVKN | 100 | | | | | | | | |
| NS1 | 959 | 0 | 1 | 1 | 0 | Y | VMGAAVKNG | 100 | | | | | | | | |
| NS1 | 960 | 0 | 1 | 1 | 0 | Y | MGAAVKNGM | 100 | | | | | | | | |
| NS1 | 961 | 0 | 1 | 1 | 0 | Y | GAAVKNGMA | 100 | | | | | | | | |
| NS1 | 962 | 0.81 | 2 | 2 | 0 | Y | AAVKNGMAV | 75 | AAVKNGMAI | 25 | | | | | | |
| NS1 | 963 | 0.81 | 2 | 2 | 0 | Y | AVKNGMAVH | 75 | AVKNGMAIH | 25 | | | | | | |
| NS1 | 964 | 0.81 | 2 | 2 | 0 | Y | VKNGMAVHT | 75 | VKNGMAIHT | 25 | | | | | | |
| NS1 | 965 | 0.81 | 2 | 2 | 0 | Y | KNGMAVHTD | 75 | KNGMAIHTD | 25 | | | | | | |
| NS1 | 966 | 0.81 | 2 | 2 | 0 | Y | NGMAVHTDQ | 75 | NGMAIHTDQ | 25 | | | | | | |
| NS1 | 967 | 0.81 | 2 | 2 | 0 | Y | GMAVHTDQS | 75 | GMAIHTDQS | 25 | | | | | | |
| NS1 | 968 | 0.81 | 2 | 2 | 0 | Y | MAVHTDQSL | 75 | MAIHTDQSL | 25 | | | | | | |
| NS1 | 969 | 0.81 | 2 | 2 | 0 | Y | AVHTDQSLW | 75 | AIHTDQSLW | 25 | | | | | | |
| NS1 | 970 | 0.81 | 2 | 2 | 0 | Y | VHTDQSLWM | 75 | IHTDQSLWM | 25 | | | | | | |
| NS1 | 971 | 1.12 | 2 | 2 | 0 | Y | HTDQSLWMK | 81.25 | HTDQSLWMR | 18.75 | | | | | | |
| NS1 | 972 | 0.7 | 2 | 2 | 0 | Y | TDQSLWMKS | 81.25 | TDQSLWMRS | 18.75 | | | | | | |
| NS1 | 973 | 1.12 | 3 | 3 | 0 | Y | DQSLWMKSV | 71.88 | DQSLWMRSM | 18.75 | DQSLWMKSM | 9.38 | | | | |
| NS1 | 974 | 1.66 | 4 | 4 | 0 | Y | QSLWMKSVR | 56.25 | QSLWMRSMK | 18.75 | QSLWMKSVK | 15.62 | QSLWMKSMK | 9.38 | | |
| NS1 | 975 | 1.66 | 4 | 4 | 0 | Y | SLWMKSVRN | 56.25 | SLWMRSMKN | 18.75 | SLWMKSVKN | 15.62 | SLWMKSMKN | 9.38 | | |
| NS1 | 976 | 1.94 | 5 | 5 | 0 | Y | LWMKSVRND | 50 | LWMRSMKND | 18.75 | LWMKSVKND | 15.62 | LWMKSMKND | 9.38 | LWMKSVRNE | 6.25 |
| NS1 | 977 | 1.94 | 5 | 5 | 0 | Y | WMKSVRNDT | 50 | WMRSMKNDT | 18.75 | WMKSVKNDT | 15.62 | WMKSMKNDT | 9.38 | WMKSVRNET | 6.25 |

Fig. 32-37

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of Species: TBEV (9-mers)

Fig. 32-38

| protein | block starting position | block entropy | total

Fig. 32-39

Species: TBEV (9-mers)

| protein | block starting position | block entropy | total peptides in block | # peptides required to cover 99% of block | gap/X fraction 99% of block | covered w/ <= 5 peptides? | peptides required to cover 99

Fig. 32-40

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

Fig. 32-41

Species: TBEV (9-mers)

| protein | block starting position | block entropy | total peptides in block | # peptides required to cover 99% of block | gap/X fraction | covered w/ <= 5 peptides? | peptides required to cover 99% of block

Fig. 32-42

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1115 | 0.2 | 2 | 2 | 0 | Y | VHDQGGLVR | 96.88 | VHDQGGLIR | 3.12 | | | | |
| NS1 | 1116 | 0.2 | 2 | 2 | 0 | Y | HDQGGLVRS | 96.88 | HDQGGLIRS | 3.12 | | | | |
| NS1 | 1117 | 0.4 | 3 | 3 | 0 | Y | DQGGLVRSM | 93.75 | DQGGLIRSM | 3.12 | DQGGLVRST | 3.12 | | |
| NS1 | 1118 | 0.4 | 3 | 3 | 0 | Y | QGGLVRSMV | 93.75 | QGGLIRSMV | 3.12 | QGGLVRSMV | 3.12 | | |
| NS1 | 1119 | 0.4 | 3 | 3 | 0 | Y | GGLVRSMVV | 93.75 | GGLIRSMV | 3.12 | GGLVRSTV | 3.12 | | |
| NS1 | 1120 | 0.4 | 3 | 3 | 0 | Y | GLVRSMVVA | 93.75 | GLVRSMVV | 3.12 | GLVRSTVV | 3.12 | | |
| NS1 | 1121 | 0.4 | 3 | 3 | 0 | Y | LVRSMVVAD | 93.75 | LVRSTVVAD | 3.12 | LIRSMVVAD | 3.12 | | |
| NS1 | 1122 | 0.4 | 3 | 3 | 0 | Y | VRSMVVADN | 93.75 | IRSMVVADN | 3.12 | VRSTVVADN | 3.12 | | |
| NS1 | 1123 | 0.2 | 2 | 2 | 0 | Y | RSMVVADNG | 96.88 | RSTVVADNG | 3.12 | | | | |
| NS1 | 1124 | 0.2 | 2 | 2 | 0 | Y | SMVVADNGE | 96.88 | STVVADNGE | 3.12 | | | | |
| NS1 | 1125 | 0.2 | 2 | 2 | 0 | Y | MVVADNGEL | 96.88 | TVVADNGEL | 3.12 | | | | |
| NS1 | 1126 | 0 | 1 | 1 | 0 | Y | VVADNGELL | 100 | | | | | | |
| NS1 | 1127 | 0 | 1 | 1 | 0 | Y | VADNGELLS | 100 | | | | | | |
| NS1 | 1128 | 0 | 1 | 1 | 0 | Y | ADNGELLSE | 100 | | | | | | |
| NS1 | 1129 | 0 | 1 | 1 | 0 | Y | DNGELLSEG | 100 | | | | | | |
| NS1 | 1130 | 0 | 1 | 1 | 0 | Y | NGELLSEGG | 100 | | | | | | |
| NS2A | 1131 | 1 | 2 | 2 | 0 | Y | GELLSEGGI | 50 | GELLSEGGV | 50 | | | | |
| NS2A | 1132 | 1 | 2 | 2 | 0 | Y | ELLSEGGIP | 50 | ELLSEGGVP | 50 | | | | |
| NS2A | 1133 | 1 | 2 | 2 | 0 | Y | LLSEGGIPG | 50 | LLSEGGVPG | 50 | | | | |
| NS2A | 1134 | 1 | 2 | 2 | 0 | Y | LSEGGIPGI | 50 | LSEGGIPGI | 50 | | | | |
| NS2A | 1135 | 1 | 2 | 2 | 0 | Y | SEGGIPGIV | 50 | SEGGVPGIV | 50 | | | | |
| NS2A | 1136 | 1 | 2 | 2 | 0 | Y | EGGIPGIVA | 50 | EGGVPGIVA | 50 | | | | |
| NS2A | 1137 | 1 | 2 | 2 | 0 | Y | GGIPGIVAL | 50 | GGVPGIVAL | 50 | | | | |
| NS2A | 1138 | 1 | 2 | 2 | 0 | Y | GVPGIVALF | 50 | GIPGIVALF | 50 | | | | |
| NS2A | 1139 | 1 | 2 | 2 | 0 | Y | IPGIVALFV | 50 | VPGIVALFV | 50 | | | | |

Fig. 32-43

Species: TBEV (9-mers)

| protein | block starting position | block entropy | total peptides in block | # peptides required to cover 99% of block | 99% of block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1140 | 0 | 1 | 1 | 0 | Y | PGIWALFW | 100 | | | | | | |
| NS2A | 1141 | 0 | 1 | 1 | 0 | Y | GIWALFWL | 100 | | | | | | |
| NS2A | 1142 | 0 | 1 | 1 | 0 | Y | IWALFWLE | 100 | | | | | | |
| NS2A | 1143 | 0 | 1 | 1 | 0 | Y | WALFWLEY | 100 | | | | | | |
| NS2A | 1144 | 0.81 | 2 | 2 | 0 | Y | ALFWLEYV | 75 | ALFWLEYI | 25 | | | | |
| NS2A | 1145 | 0.81 | 2 | 2 | 0 | Y | LFWLEYVI | 75 | LFWLEYII | 25 | | | | |
| NS2A | 1146 | 0.81 | 2 | 2 | 0 | Y | FWLEYVIR | 75 | FWLEYIIR | 25 | | | | |
| NS2A | 1147 | 0.81 | 2 | 2 | 0 | Y | WLEYVIRR | 75 | WLEYIIRR | 25 | | | | |
| NS2A | 1148 | 0.81 | 2 | 2 | 0 | Y | LEYVIRRR | 75 | LEYIIRRP | 25 | | | | |
| NS2A | 1149 | 0.81 | 2 | 2 | 0 | Y | EYVIRRRP | 75 | EYIIRRPS | 25 | | | | |
| NS2A | 1150 | 0.81 | 2 | 2 | 0 | Y | YVIRRRPA | 75 | YIIRRPST | 25 | | | | |
| NS2A | 1151 | 0.81 | 2 | 2 | 0 | Y | VIRRRPAT | 75 | IIRRPSTG | 25 | | | | |
| NS2A | 1152 | 0.81 | 2 | 2 | 0 | Y | IRRRPATG | 75 | IRRPSTGT | 25 | | | | |
| NS2A | 1153 | 0.95 | 3 | 3 | 0 | Y | RRRPATGT | 59.38 | RRPSTGTI | 21.88 | IRRPSTGS | 3.12 | | |
| NS2A | 1154 | 1.5 | 4 | 4 | 0 | Y | RRPATGTT | 59.38 | RRPSTGTT | 21.88 | RRRPATGTA | | | |
| NS2A | 1155 | 1.5 | 4 | 4 | 0 | Y | RPATGTTA | 56.25 | RPSTGTTV | 21.88 | RRPATGTAV | | | |
| NS2A | 1156 | 1.68 | 5 | 5 | 0 | Y | PATGTTAM | 56.25 | PSTGTTVW | 21.88 | RPATGTAVV | 15.62 | RRPSTGST | 15.62 | RPATGTAV | 3.12 |
| NS2A | 1157 | 1.68 | 5 | 5 | 0 | Y | ATGTTAMW | 56.25 | STGTTVWW | 21.88 | PATGTAVVW | 15.62 | RRPSTGSTV | 15.62 | PATGTTAVW | 3.12 |
| NS2A | 1158 | 1.68 | 5 | 5 | 0 | Y | TGTTAMWG | 56.25 | TGTTVWWG | 21.88 | ATGTAVVWG | 15.62 | RPSTGSTVW | 15.62 | ATGTTAVWG | 3.12 |
| NS2A | 1159 | 1.68 | 5 | 5 | 0 | Y | GTTAMWGG | 56.25 | GTTVWWGG | 21.88 | TGTAVVWGG | 15.62 | PSTGSTVWW | 15.62 | TGSTVWWGG | 3.12 |
| NS2A | 1165 | 1.32 | 5 | 5 | 0 | Y | WGGIWLAL | 71.88 | WGGVVLAL | 15.62 | WGGFVVLAL | 6.25 | STGSTVWWG | 15.62 | WGGLIVLAL | 3.12 |
| NS2A | 1166 | 1.32 | 5 | 5 | 0 | Y | GGIWLALL | 71.88 | GGVVLALL | 15.62 | GGFVVLALL | 6.25 | TGTTAVWWGG | 15.62 | GGIWFALL | 3.12 |
| NS2A | 1167 | 1.32 | 5 | 5 | 0 | Y | GIWLALLV | 71.88 | GVVLALLV | 15.62 | GFVVLALLV | 6.25 | WGGIVFAL | 15.62 | GIWFALLV | 3.12 |
| NS2A | 1168 | 1.32 | 5 | 5 | 0 | Y | IWLALLVT | 71.88 | VVLALLVT | 15.62 | FVVLALLVT | 6.25 | GGIVLALL | 6.25 | IVFALLVT | 3.12 |
| NS2A | 1169 | 0.4 | 3 | 3 | 0 | Y | WLALLVTG | 93.75 | VLALLVTG | 3.12 | IVLALLVTG | 3.12 | GLIVLALLV | 6.25 | | |

Fig. 32-44

Species: TBEV (9-mers)

| protein | block starting position | block entropy | total peptides in block | # peptides required to cover 99% of block | gap/X fraction 99% of block | covered w/

Fig. 32-45

Species: TBEV (9

Fig. 32-46

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency |

Fig. 32-47

Species: TBEV (9-mers)

| protein | block starting position | block entropy | total peptides in block | # peptides required to cover 99% of block | gap/X fraction | 99% of block covered w/ <= 5 peptides? | pe

Fig. 32-48

Species: TBEV (

Fig. 32-49

Species: TBEV (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS2A | 1344 | 1.04 | 3 | 3 | 0 | Y | RLLAFWELA | 68.75 | RLLAFWELS | 28.12 | RLLSFWELS | 3.12 | | |
| NS2A | 1354 | 1.44 | 4 | 4 | 0 | Y | HRGRRSFSE | 46.88 | HGRRSFSE | 43.75 | HGKRRSFSE | 6.25 | SGRRRSFSE | 3.12 |
| NS2A | 1355 | 1.27 | 3 | 3 | 0 | Y | RGRRSFSEP | 46.88 | GRRSFSEP | 46.88 | GKRRSFSEP | 6.25 | | |
| NS2A | 1356 | 1.27 | 3 | 3 | 0 | Y | GRRSFSEPL | 46.88 | RRSFSEPL | 46.88 | KRRSFSEPL | 6.25 | | |
| NS2A | 1357 | 0 | 1 | 1 | 0 | Y | RRSFSEPLT | 100 | | | | | | |
| NS2A | 1358 | 0 | 1 | 1 | 0 | Y | RSFSEPLTV | 100 | | | | | | |
| NS2A | 1359 | 0 | 1 | 1 | 0 | Y | SFSEPLTVW | 100 | | | | | | |
| NS2B | 1360 | 0 | 1 | 1 | 0 | Y | FSEPLTVWG | 100 | | | | | | |
| NS2B | 1361 | 0 | 1 | 1 | 0 | Y | SEPLTVWGV | 100 | | | | | | |
| NS2B | 1362 | 0 | 1 | 1 | 0 | Y | EPLTVWGVM | 100 | | | | | | |
| NS2B | 1363 | 0 | 1 | 1 | 0 | Y | PLTVWGVML | 100 | | | | | | |
| NS2B | 1364 | 0 | 1 | 1 | 0 | Y | LTVWGVMLT | 100 | | | | | | |
| NS2B | 1365 | 0 | 1 | 1 | 0 | Y | TVWGVMLTL | 100 | | | | | | |
| NS2B | 1366 | 0 | 1 | 1 | 0 | Y | VWGVMLTLA | 100 | | | | | | |
| NS2B | 1367 | 0.63 | 2 | 2 | 0 | Y | VGVMLTLAS | 84.38 | VGVMLTLAG | 15.62 | | | | |
| NS2B | 1368 | 0.63 | 2 | 2 | 0 | Y | GVMLTLASG | 84.38 | GVMLTLAGG | 15.62 | | | | |
| NS2B | 1369 | 0.63 | 2 | 2 | 0 | Y | VMLTLASGM | 84.38 | VMLTLAGGM | 15.62 | | | | |
| NS2B | 1370 | 0.63 | 2 | 2 | 0 | Y | MLTLASGMM | 84.38 | MLTLAGGMM | 15.62 | | | | |
| NS2B | 1371 | 0.63 | 2 | 2 | 0 | Y | LTLASGMMR | 84.38 | LTLAGGMMR | 15.62 | | | | |
| NS2B | 1372 | 0.63 | 2 | 2 | 0 | Y | TLASGMMRH | 84.38 | TLAGGMMRH | 15.62 | | | | |
| NS2B | 1373 | 0.63 | 2 | 2 | 0 | Y | LASGMMRHT | 84.38 | LAGGMMRHT | 15.62 | | | | |
| NS2B | 1374 | 0.82 | 3 | 3 | 0 | Y | ASGMMRHTS | 81.25 | AGGMMRHTS | 15.62 | ASGMMRHTP | 3.12 | | |
| NS2B | 1375 | 0.82 | 3 | 3 | 0 | Y | SGMMRHTSQ | 81.25 | GGMMRHTSQ | 15.62 | SGMMRHTPQ | 3.12 | | |
| NS2B | 1376 | 0.2 | 2 | 2 | 0 | Y | GMMRHTSQE | 96.88 | GMMRHTPQE | 3.12 | | | | |
| NS2B | 1377 | 0.2 | 2 | 2 | 0 | Y | MMRHTSQEA | 96.88 | MMRHTPQEA | 3.12 | | | | |

Fig. 32-50

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency |

Fig. 32-51

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1403 | 0 | 1 | 1 | 0 | Y | TRKMQLVAE | 100 | | |

Fig. 32-52

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1428 | 0 | 1 | 1 | 0 | Y | EVSLRVRQD | 100 | | | | | | |
| NS2B | 1429 | 0.81 | 2 | 2 | 0 | Y | VSLRVRQDS | 75 | VSLRVRQDA | 25 | | | | |
| NS2B | 1430 | 0.81 | 2 | 2 | 0 | Y | SLRVRQDSM | 75 | SLRVRQDAM | 25 | | | | |
| NS2B | 1431 | 0.81 | 2 | 2 | 0 | Y | LRVRQDSMG | 75 | LRVRQDAMG | 25 | | | | |
| NS2B | 1432 | 0.81 | 2 | 2 | 0 | Y | RVRQDSMGN | 75 | RVRQDAMGN | 25 | | | | |
| NS2B | 1433 | 0.81 | 2 | 2 | 0 | Y | VRQDSMGNF | 75 | VRQDAMGNF | 25 | | | | |
| NS2B | 1434 | 0.81 | 2 | 2 | 0 | Y | RQDSMGNFH | 75 | RQDAMGNFH | 25 | | | | |
| NS2B | 1435 | 0.81 | 2 | 2 | 0 | Y | QDSMGNFHL | 75 | QDAMGNFHL | 25 | | | | |
| NS2B | 1436 | 0.81 | 2 | 2 | 0 | Y | DSMGNFHLT | 75 | DAMGNFHLT | 25 | | | | |
| NS2B | 1437 | 0.81 | 2 | 2 | 0 | Y | SMGNFHLTE | 75 | AMGNFHLTE | 25 | | | | |
| NS2B | 1438 | 0 | 1 | 1 | 0 | Y | MGNFHLTEL | 100 | | | | | | |
| NS2B | 1439 | 0 | 1 | 1 | 0 | Y | GNFHLTELE | 100 | | | | | | |
| NS2B | 1440 | 0 | 1 | 1 | 0 | Y | NFHLTELEK | 100 | | | | | | |
| NS2B | 1441 | 0 | 1 | 1 | 0 | Y | FHLTELEKE | 100 | | | | | | |
| NS2B | 1442 | 0 | 1 | 1 | 0 | Y | HLTELEKEE | 100 | | | | | | |
| NS2B | 1443 | 0 | 1 | 1 | 0 | Y | LTELEKEER | 100 | | | | | | |
| NS2B | 1444 | 0.81 | 2 | 2 | 0 | Y | TELEKEERV | 75 | TELEKEERM | 25 | | | | |
| NS2B | 1445 | 0.81 | 2 | 2 | 0 | Y | ELEKEERVM | 75 | ELEKEERMM | 25 | | | | |
| NS2B | 1446 | 0.81 | 2 | 2 | 0 | Y | LEKEERVMA | 75 | LEKEERMMA | 25 | | | | |
| NS2B | 1447 | 0.81 | 2 | 2 | 0 | Y | EKEERVMAF | 75 | EKEERMMAF | 25 | | | | |
| NS2B | 1448 | 0.81 | 2 | 2 | 0 | Y | KEERVMAFW | 75 | KEERMMAFW | 25 | | | | |
| NS2B | 1449 | 0.81 | 2 | 2 | 0 | Y | EERVMAFWL | 75 | EERMMAFWL | 25 | | | | |
| NS2B | 1450 | 1.05 | 3 | 3 | 0 | Y | ERVMAFWLL | 75 | ERMMAFWLL | 15.62 | ERMMAFWLI | 9.38 | | |
| NS2B | 1451 | 1.05 | 3 | 3 | 0 | Y | RVMAFWLLA | 75 | RMMAFWLLA | 15.62 | RMMAFWLIA | 9.38 | | |
| NS2B | 1452 | 1.05 | 3 | 3 | 0 | Y | VMAFWLLAG | 75 | MMAFWLLAG | 15.62 | MMAFWLIAG | 9.38 | | |

Fig. 32-53

Species: TBEV (9-mers)

| protein | block starting position | block entropy | total peptides in block | # peptides required to cover 99% of block | gap/X fraction | 99% of block covered w/ <= 5 peptides? | block to cover 99% of peptides required | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS2B | 1453 | 0.45 | 2 | 2 | 0 | Y | MAFWLLAGL | 90.62 | MAFWLIAGL | 9.38 | | | | |
| NS2B | 1454 | 0.64 | 3 | 3 | 0 | Y | AFWLLAGLA | 87.5 | AFWLIAGLA | 9.38 | AFWLLAGLS | 3.12 | | | |
| NS2B | 1455 | 0.64 | 3 | 3 | 0 | Y | FWLLAGLAA | 87.5 | FWLIAGLAA | 9.38 | FWLLAGLSA | 3.12 | | | |
| NS2B | 1456 | 0.64 | 3 | 3 | 0 | Y | WLLAGLAAS | 87.5 | WLIAGLAAS | 9.38 | WLLAGLSAS | 3.12 | | | |
| NS2B | 1457 | 0.64 | 3 | 3 | 0 | Y | LLAGLAASA | 87.5 | LIAGLAASA | 9.38 | LLAGLSASA | 3.12 | | | |
| NS2B | 1459 | 1.8 | 5 | 5 | 0 | Y | AGLAASAFH | 46.88 | AGLAASAIH | 25 | AGLSASAVH | 21.88 | AGLSASAFH | 3.12 | AGLAASALH | 3.12 |
| NS2B | 1460 | 1.8 | 5 | 5 | 0 | Y | GLAASAFHW | 46.88 | GLAASAIHW | 25 | GLAASAVHW | 21.88 | GLSASAFHW | 3.12 | GLAASALHW | 3.12 |
| NS2B | 1461 | 1.8 | 5 | 5 | 0 | Y | LAASAFHWS | 46.88 | LAASAIHWS | 25 | LAASAVHWS | 21.88 | LAASAFHWS | 3.12 | LSASAFHWS | 3.12 |
| NS2B | 1462 | 1.8 | 5 | 5 | 0 | Y | AASAFHWSG | 46.88 | AASAIHWSG | 25 | AASAVHWSG | 21.88 | SASAFHWSG | 3.12 | AASALHWSG | 3.12 |
| NS2B | 1463 | 1.64 | 4 | 4 | 0 | Y | ASAFHWSGI | 50 | ASAVHWSGI | 25 | ASAVHWSGI | 21.88 | ASALHWSGI | 3.12 | |
| NS2B | 1464 | 1.77 | 5 | 5 | 0 | Y | SAFHWSGIL | 50 | SAVHWSGIL | 25 | SAIHWSGIL | 21.88 | SALHWSGIL | 3.12 | SAIHWSGII | 3.12 |
| NS2B | 1465 | 1.77 | 5 | 5 | 0 | Y | AFHWSGILG | 50 | AIHWSGILG | 25 | AVHWSGILG | 21.88 | AIHWSGIIG | 3.12 | ALHWSGILG | 3.12 |
| NS2B | 1466 | 1.77 | 5 | 5 | 0 | Y | FHWSGILGV | 50 | VHWSGILGV | 25 | IHWSGILGV | 21.88 | IHWSGIIGV | 3.12 | LHWSGILGV | 3.12 |
| NS2B | 1467 | 0.2 | 2 | 2 | 0 | Y | HWSGILGVM | 96.88 | HWSGIIGVM | 3.12 | | | | |
| NS2B | 1468 | 0.2 | 2 | 2 | 0 | Y | WSGILGVMG | 96.88 | WSGIIGVMG | 3.12 | | | | |
| NS2B | 1469 | 0.2 | 2 | 2 | 0 | Y | SGILGVMGL | 96.88 | SGIIGVMGL | 3.12 | | | | |
| NS2B | 1470 | 0.2 | 2 | 2 | 0 | Y | GILGVMGLW | 96.88 | GIIGVMGLW | 3.12 | | | | |
| NS2B | 1471 | 0.2 | 2 | 2 | 0 | Y | ILGVMGLWT | 96.88 | IIGVMGLWT | 3.12 | | | | |
| NS2B | 1472 | 0.2 | 2 | 2 | 0 | Y | LGVMGLWTL | 96.88 | IGVMGLWTL | 3.12 | | | | |
| NS2B | 1473 | 0.81 | 2 | 2 | 0 | Y | GVMGLWTLS | 75 | GVMGLWTLT | 25 | | | | |
| NS2B | 1474 | 0.95 | 3 | 3 | 0 | Y | VMGLWTLSE | 75 | VMGLWTLTE | 21.88 | VMGLWTLTK | 3.12 | | |
| NS2B | 1475 | 0.95 | 3 | 3 | 0 | Y | MGLWTLSEM | 75 | MGLWTLTEM | 21.88 | MGLWTLTKM | 3.12 | | |
| NS2B | 1476 | 1.5 | 4 | 4 | 0 | Y | GLWTLSEML | 59.38 | GLWTLTEML | 21.88 | GLWTLSEMM | 15.62 | GLWTLTKML | 3.12 | |
| NS2B | 1477 | 1.68 | 5 | 5 | 0 | Y | LWTLSEMLR | 56.25 | LWTLTEMLR | 21.88 | LWTLSEMMR | 15.62 | LWTLTKMLR | 3.12 | LWTLSEMLK | 3.12 |
| NS2B | 1487 | 1.18 | 4 | 4 | 0 | Y | ARRSDLVFS | 68.75 | SRRSDLVFS | 25 | ARRSGLVFS | 3.12 | ARRSDLAFS | 3.12 | |

Fig. 32-54

Species: TBEV (9-mers)

| protein | block starting position | block entropy | total peptides in block | # peptides required to cover 99% of block | gap/X fraction | 99% of block covered w/ <= 5 peptides? | block (peptides required to cover 99% of block) | frequency | block | frequency | block | frequency | block | frequency |
|---|---|---|---|---|---|---|---|---|---|---|---|---|---|---|
| NS2B | 1488 | 0.4 | 3 | 3 | 0 | Y | RRSDLVFSG | 93.75 | RRSDLAFSG | 3.12 | | | | |
| NS2B | 1489 | 0.4 | 3 | 3 | 0 | Y | RSDLVFSGQ | 93.75 | RSDLAFSGQ | 3.12 | RSGLVFSGQ | 3.12 | | |
| NS3 | 1490 | 0.4 | 3 | 3 | 0 | Y | SDLVFSGQG | 93.75 | SGLVFSGQG | 3.12 | SDLAFSGQG | 3.12 | | |
| NS3 | 1491 | 0.79 | 5 | 5 | 0 | Y | DLVFSGQGG | 87.5 | DLVFSGQGN | 3.12 | GLVFSGQGG | 3.12 | DLAFSGQGG | 3.12 |
| NS3 | 1492 | 0.6 | 4 | 4 | 0 | Y | LVFSGQGGR | 90.62 | LAFSGQGGR | 3.12 | LVFSGQGNR | 3.12 | | |
| NS3 | 1493 | 0.6 | 4 | 4 | 0 | Y | VFSGQGGRE | 90.62 | VFSGQGNRE | 3.12 | AFSGQGGRE | 3.12 | | |
| NS3 | 1494 | 0.4 | 3 | 3 | 0 | Y | FSGQGGRER | 93.75 | FSGQGNRER | 3.12 | | | | |
| NS3 | 1495 | 0.4 | 3 | 3 | 0 | Y | SGQGGRERG | 93.75 | SGQGNRERG | 3.12 | | | | |
| NS3 | 1496 | 0.4 | 3 | 3 | 0 | Y | GQGGRERGD | 93.75 | GQGNRERGD | 3.12 | | | | |
| NS3 | 1497 | 1.26 | 4 | 4 | 0 | Y | QGGRERGDR | 62.5 | QGNRERGDR | 3.12 | QGRGERGDK | 3.12 | | |
| NS3 | 1498 | 1.26 | 4 | 4 | 0 | Y | GGRERGDRP | 62.5 | GRERGDKP | 3.12 | GNRERGDRP | 3.12 | | |
| NS3 | 1499 | 1.26 | 4 | 4 | 0 | Y | GRERGDRPF | 62.5 | RGERGDKPF | 3.12 | NRERGDRPF | 3.12 | | |
| NS3 | 1500 | 1.08 | 3 | 3 | 0 | Y | RERGDRPFE | 65.62 | GERGDKPFE | 3.12 | | | | |
| NS3 | 1501 | 0.93 | 2 | 2 | 0 | Y | ERGDRPFEV | 65.62 | ERGDKPFEV | 3.12 | | | | |
| NS3 | 1502 | 1.55 | 4 | 4 | 0 | Y | RGDRPFEVK | 56.25 | RGDKPFEVR | 9.38 | RGDKPFEVR | 6.25 | | |
| NS3 | 1503 | 1.55 | 4 | 4 | 0 | Y | GDRPFEVKD | 56.25 | GDRPFEVRD | 9.38 | GDKPFEVRD | 6.25 | | |
| NS3 | 1504 | 1.55 | 4 | 4 | 0 | Y | DRPFEVKDG | 56.25 | DRPFEVRDG | 9.38 | DRPFEVRDG | 6.25 | | |
| NS3 | 1505 | 1.55 | 4 | 4 | 0 | Y | RPFEVKDGV | 56.25 | RPFEVRDGV | 9.38 | KPFEVRDGV | 6.25 | | |
| NS3 | 1506 | 0.63 | 2 | 2 | 0 | Y | PFEVKDGVY | 84.38 | | | | | | |
| NS3 | 1507 | 0.63 | 2 | 2 | 0 | Y | FEVKDGVYR | 84.38 | | | | | | |
| NS3 | 1508 | 0.63 | 2 | 2 | 0 | Y | EVKDGVYRI | 84.38 | | | | | | |
| NS3 | 1509 | 0.63 | 2 | 2 | 0 | Y | VKDGVYRIF | 84.38 | | | | | | |
| NS3 | 1510 | 0.63 | 2 | 2 | 0 | Y | KDGVYRIFS | 84.38 | | | | | | |
| NS3 | 1511 | 0 | 1 | 1 | 0 | Y | DGVYRIFSP | 100 | | | | | | |
| NS3 | 1512 | 0 | 1 | 1 | 0 | Y | GVYRIFSPG | 100 | | | | | | |

Fig. 32-55

Species: TBEV (9-mers)

| protein | block starting position | block

Fig. 32-56

Species: TBEV (9-mers)

| protein | block starting position | block entropy | total peptides in block | # peptides required to cover 99% of block | 99% of block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1538 | 0 | 1 | 1 | 0 | Y | LHTMWHVTR | 100 | | | | | | |
| NS3 | 1539 | 0 | 1 | 1 | 0 | Y | HTMWHVTRG | 100 | | | | | | |
| NS3 | 1540 | 0 | 1 | 1 | 0 | Y | TMWHVTRGA | 100 | | | | | | |
| NS3 | 1541 | 0 | 1 | 1 | 0 | Y | MWHVTRGAA | 100 | | | | | | |
| NS3 | 1542 | 0 | 1 | 1 | 0 | Y | WHVTRGAAL | 100 | | | | | | |
| NS3 | 1543 | 0.2 | 2 | 2 | 0 | Y | HVTRGAALS | 96.88 | HVTRGAALY | 3.12 | | | | |
| NS3 | 1544 | 0.4 | 3 | 3 | 0 | Y | VTRGAALSI | 93.75 | VTRGAALYI | 3.12 | | | | |
| NS3 | 1545 | 0.93 | 4 | 4 | 0 | Y | TRGAALSID | 81.25 | TRGAALSIN | 12.5 | TRGAALSV | 3.12 | TRGAALYID | 3.12 | |
| NS3 | 1546 | 0.93 | 4 | 4 | 0 | Y | RGAALSIDD | 81.25 | RGAALSIND | 12.5 | TRGAALSYD | 3.12 | RGAALYIDD | 3.12 | |
| NS3 | 1547 | 0.93 | 4 | 4 | 0 | Y | GAALSIDDA | 81.25 | GAALSINDA | 12.5 | RGAALSVDD | 3.12 | GAALSVDDA | 3.12 | |
| NS3 | 1548 | 0.93 | 4 | 4 | 0 | Y | AALSIDDAV | 81.25 | AALSINDAV | 12.5 | GAALSVDDA | 3.12 | AALYIDDAV | 3.12 | |
| NS3 | 1549 | 1.12 | 5 | 5 | 0 | Y | ALSIDDAVA | 78.12 | ALSINDAVA | 12.5 | AALSVDDAV | 3.12 | ALSVDDAVV | 3.12 | ALYIDDAVA | 3.12 |
| NS3 | 1550 | 1.12 | 5 | 5 | 0 | Y | LSIDDAVAG | 78.12 | LSINDAVAG | 12.5 | ALSVDDAVV | 3.12 | LYIDDAVAG | 3.12 | LSIDDAVVG | 3.12 |
| NS3 | 1551 | 1.12 | 5 | 5 | 0 | Y | SIDDAVAGP | 78.12 | SINDAVAGP | 12.5 | LSVDDAVVG | 3.12 | SIDDAVVGP | 3.12 | SVDDAVVGP | 3.12 |
| NS3 | 1552 | 0.93 | 4 | 4 | 0 | Y | IDDAVAGPY | 81.25 | INDAVAGPY | 12.5 | YIDDAVAGP | 3.12 | IDDAVVGPY | 3.12 | |
| NS3 | 1553 | 0.87 | 3 | 3 | 0 | Y | DDAVAGPYW | 81.25 | NDAVAGPYW | 12.5 | VDDAVVGPY | 6.25 | DDAVVGPYW | 3.12 | |
| NS3 | 1554 | 0.53 | 3 | 3 | 0 | Y | DAVAGPYWA | 90.62 | DAVVGPYWA | 6.25 | DDAVGPYW | 3.12 | | | |
| NS3 | 1555 | 0.73 | 3 | 4 | 0 | Y | AVAGPYWAD | 87.5 | AWGPYWAD | 6.25 | AVAGPYWSD | 3.12 | AVAGPYWAE | 3.12 | |
| NS3 | 1556 | 0.73 | 3 | 4 | 0 | Y | VAGPYWADV | 87.5 | VGPYWADV | 6.25 | VAGPYWAEV | 3.12 | VAGPYWSDV | 3.12 | |
| NS3 | 1557 | 1.52 | 5 | 5 | 0 | Y | AGPYWADVK | 59.38 | AGPYWADVR | 28.12 | VGPYWADVK | 6.25 | AGPYWSDVR | 3.12 | AGPYWAEVK | 3.12 |
| NS3 | 1558 | 1.23 | 4 | 4 | 0 | Y | GPYWADVKE | 65.62 | GPYWADVRE | 28.12 | GPYWSDVRE | 3.12 | GPYWSDVRE | 3.12 | |
| NS3 | 1559 | 1.23 | 4 | 4 | 0 | Y | PYWADVKED | 65.62 | PYWADVRED | 28.12 | PYWSDVRED | 3.12 | PYWAEVKED | 3.12 | |
| NS3 | 1560 | 1.23 | 4 | 4 | 0 | Y | YWADVKEDV | 65.62 | YWADVREDV | 28.12 | YWSDVREDV | 3.12 | YWAEVKEDV | 3.12 | |
| NS3 | 1561 | 1.23 | 4 | 4 | 0 | Y | WADVKEDVV | 65.62 | WADVREDVV | 28.12 | WSDVREDVV | 3.12 | WAEVKEDVV | 3.12 | |
| NS3 | 1562 | 1.23 | 4 | 4 | 0 | Y | ADVKEDVVC | 65.62 | ADVREDVVC | 28.12 | SDVREDVVC | 3.12 | AEVKEDVVC | 3.12 | |

Fig. 32-57

Species: TBEV (9-mers)

| protein | block star

Fig. 32-58

Species: TBEV (9

Fig. 32-59

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

Fig. 32-60

Species: TBEV (9-mers)

| protein | block starting position | block entropy | total peptides in block | # peptides required to cover 99% of block | gap/X fraction of block | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1647 | 0.2 | 2 | 2 | 0 | Y | KTNETYVSS | 96.88 | KTNGTYVSS | 3.12 | | | | |
| NS3 | 1648 | 0.2 | 2 | 2 | 0 | Y | TNETYVSSI | 96.88 | TNGTYVSSI | 3.12 | | | | |
| NS3 | 1649 | 0.2 | 2 | 2 | 0 | Y | NETYVSSIA | 96.88 | NGTYVSSIA | 3.12 | | | | |
| NS3 | 1650 | 0.2 | 2 | 1 | 0 | Y | ETYVSSIAQ | 96.88 | GTYVSSIAQ | 3.12 | | | | |
| NS3 | 1651 | 0 | 2 | 1 | 0 | Y | TYVSSIAQG | 100 | | | | | | |
| NS3 | 1652 | 0 | 2 | 2 | 0 | Y | YVSSIAQGE | 100 | | | | | | |
| NS3 | 1653 | 0.45 | 2 | 2 | 0 | Y | VSSIAQGEA | 90.62 | VSSIAQGEV | 9.38 | | | | |
| NS3 | 1654 | 0.45 | 2 | 2 | 0 | Y | SSIAQGEAE | 90.62 | SSIAQGEVE | 9.38 | | | | |
| NS3 | 1655 | 0.64 | 3 | 3 | 0 | Y | SIAQGEAEK | 87.5 | SIAQGEVEK | 9.38 | SIAQGEAER | 3.12 | | |
| NS3 | 1656 | 0.64 | 3 | 3 | 0 | Y | IAQGEAEKS | 87.5 | IAQGEVEKS | 9.38 | IAQGEAERS | 3.12 | | |
| NS3 | 1657 | 0.64 | 3 | 3 | 0 | Y | AQGEAEKSR | 87.5 | AQGEVEKSR | 9.38 | AQGEAERSR | 3.12 | | |
| NS3 | 1658 | 0.64 | 3 | 3 | 0 | Y | QGEAEKSRP | 87.5 | QGEVEKSRP | 9.38 | QGEAERSRP | 3.12 | | |
| NS3 | 1659 | 0.84 | 4 | 4 | 0 | Y | GEAEKSRPN | 84.38 | GEVEKSRPN | 9.38 | GEAERSRP | 3.12 | GEAERSRPN | 3.12 |
| NS3 | 1660 | 0.84 | 4 | 4 | 0 | Y | EAEKSRPNL | 84.38 | EVEKSRPNL | 9.38 | EAERSRPNL | 3.12 | EAEKSRPSL | 3.12 |
| NS3 | 1661 | 0.84 | 4 | 4 | 0 | Y | AEKSRPNLP | 84.38 | VEKSRPNLP | 9.38 | AERSRPNLP | 3.12 | AEKSRPSLP | 3.12 |
| NS3 | 1662 | 1.33 | 4 | 4 | 0 | Y | EKSRPNLPP | 50 | EKSRPNLPQ | 43.75 | EKSRPSLPP | 3.12 | ERSRPNLPQ | 3.12 |
| NS3 | 1663 | 1.33 | 4 | 4 | 0 | Y | KSRPNLPPA | 50 | KSRPNLPQA | 43.75 | KSRPSLPPA | 3.12 | KSRPSLPP | 3.12 |
| NS3 | 1664 | 1.17 | 3 | 3 | 0 | Y | SRPNLPPAV | 50 | SRPNLPQAV | 46.88 | SRPSLPPAV | 3.12 | | |
| NS3 | 1674 | 1.52 | 5 | 5 | 0 | Y | GTGWTAKGQ | 59.38 | GTGWTSKGQ | 28.12 | GMGWTAKGQ | 6.25 | GIGWTAKGQ | 3.12 | GSGWTAKGQ | 3.12 |
| NS3 | 1675 | 1.52 | 5 | 5 | 0 | Y | TGWTAKGQI | 59.38 | TGWTSKGQI | 28.12 | MGWTAKGQI | 6.25 | IGWTAKGQI | 3.12 | SGWTAKGQI | 3.12 |
| NS3 | 1676 | 0.86 | 2 | 2 | 0 | Y | GWTAKGQIT | 71.88 | GWTSKGQIT | 28.12 | | | | |
| NS3 | 1677 | 0.86 | 2 | 2 | 0 | Y | WTAKGQITV | 71.88 | WTSKGQITV | 28.12 | | | | |
| NS3 | 1678 | 0.86 | 2 | 2 | 0 | Y | TAKGQITVL | 71.88 | TSKGQITVL | 28.12 | | | | |
| NS3 | 1679 | 0.86 | 2 | 2 | 0 | Y | AKGQITVLD | 71.88 | SKGQITVLD | 28.12 | | | | |
| NS3 | 1680 | 0 | 1 | 1 | 0 | Y | KGQITVLDM | 100 | | | | | | |

Fig. 32-62

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1706 | 0.2 | 2 | 2 | 0 | Y | CIDRRLRTL | 96.88 | CTDRRLRTL | 3.12 | | | | |
| NS3 | 1707 | 0.2 | 2 | 2 | 0 | Y | IDRRLRTLV | 96.88 | TDRRLRTLV | 3

Fig. 32-63

Species: TBEV (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency

Fig. 32-64

Species: TBEV (9-mers)

| protein | block star

Fig. 32-65

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|

Fig. 32-66

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1813 | 0.2 | 2 | 2 | 0 | Y | PPGKSEPFP | 96.88 | RPGKSEPFP | 3.12 | | | | | | |
| NS3 | 1814 | 0 | 1 | 1 | 0 | Y | PGKSEPFPE | 100 | | | | | | | | |
| NS3 | 1815 | 0 | 1 | 1 | 0 | Y | GKSEPFPES | 100 | | | | | | | | |
| NS3 | 1816 | 0 | 1 | 1 | 0 | Y | KSEPFPESN | 100 | | | | | | | | |
| NS3 | 1817 | 0.2 | 2 | 2 | 0 | Y | SEPFPESNG | 96.88 | SEPPPESNR | 3.12 | | | | | | |
| NS3 | 1818 | 0.2 | 2 | 2 | 0 | Y | EPFPESNGA | 96.88 | EPFPESNRG | 3.12 | | | | | | |
| NS3 | 1819 | 0.2 | 2 | 2 | 0 | Y | PFPESNGAI | 96.88 | PFPESNRGI | 3.12 | | | | | | |
| NS3 | 1820 | 1.16 | 3 | 3 | 0 | Y | FPESNGAIT | 53.12 | FPESNRGIT | 43.75 | FPESNRGIT | 3.12 | | | | |
| NS3 | 1821 | 1.16 | 3 | 3 | 0 | Y | PESNGAITS | 53.12 | PESNRGITS | 43.75 | PESNRGITS | 3.12 | | | | |
| NS3 | 1822 | 1.16 | 3 | 3 | 0 | Y | ESNGAITSE | 53.12 | ESNRGITSE | 43.75 | ESNRGITSE | 3.12 | | | | |
| NS3 | 1823 | 1.16 | 3 | 3 | 0 | Y | SNGAITSEE | 53.12 | SNGAITSEE | 43.75 | SNRGITSEV | 3.12 | | | | |
| NS3 | 1824 | 1.69 | 4 | 4 | 0 | Y | NGAISSEEK | 43.75 | NGAITSEEK | 28.12 | NGAITSEER | 25 | NRGITSEVK | 3.12 | | |
| NS3 | 1825 | 1.69 | 4 | 4 | 0 | Y | GAISSEEKQ | 43.75 | GAITSEEKQ | 28.12 | GAITSEERQ | 25 | RGITSEVKQ | 3.12 | | |
| NS3 | 1826 | 1.69 | 4 | 4 | 0 | Y | AISSEEKQI | 43.75 | AITSEEKQI | 28.12 | AITSEERQI | 25 | GITSEVKQI | 3.12 | | |
| NS3 | 1827 | 1.69 | 4 | 4 | 0 | Y | ISSEEKQIP | 43.75 | ITSEEKQIP | 28.12 | ITSEERQIP | 25 | ITSEVKQIP | 3.12 | | |
| NS3 | 1829 | 1.61 | 5 | 5 | 0 | Y | SEEKQIPDG | 59.38 | SEERQIPDG | 21.88 | SEEKQIPEG | 12.5 | SEVKQIPEG | 3.12 | | |
| NS3 | 1830 | 1.61 | 5 | 5 | 0 | Y | EEKQIPDGE | 59.38 | EERQIPDGE | 21.88 | EEKQIPEGE | 12.5 | EERQIPNGE | 3.12 | | |
| NS3 | 1831 | 1.61 | 5 | 5 | 0 | Y | EKQIPDGEW | 59.38 | ERQIPDGEW | 21.88 | EKQIPEGEW | 12.5 | VKQIPEGEW | 3.12 | | |
| NS3 | 1832 | 1.5 | 4 | 4 | 0 | Y | KQIPDGEWR | 59.38 | RQIPDGEWR | 21.88 | KQIPEGEWR | 15.62 | RQIPNGEWR | 3.12 | | |
| NS3 | 1833 | 0.82 | 3 | 3 | 0 | Y | QIPDGEWRD | 81.25 | QIPEGEWRD | 15.62 | QIPNGEWRD | 3.12 | | | SEERQIPNG | 3.12 |
| NS3 | 1834 | 0.82 | 3 | 3 | 0 | Y | IPDGEWRDG | 81.25 | IPEGEWRDG | 15.62 | IPNGEWRDG | 3.12 | | | EVKQIPEGE | 3.12 |
| NS3 | 1835 | 0.82 | 3 | 3 | 0 | Y | PDGEWRDGF | 81.25 | PEGEWRDGF | 15.62 | PNGEWRDGF | 3.12 | | | ERQIPNGEW | 3.12 |
| NS3 | 1836 | 0.82 | 3 | 3 | 0 | Y | DGEWRDGFD | 81.25 | EGEWRDGFD | 15.62 | NGEWRDGFD | 3.12 | | | | |
| NS3 | 1837 | 0 | 1 | 1 | 0 | Y | GEWRDGFDW | 100 | | | | | | | | |
| NS3 | 1838 | 0 | 1 | 1 | 0 | Y | EWRDGFDWI | 100 | | | | | | | | |

Fig. 32-67

Species: TBEV (9-mers)

| protein | block starting position | block

Fig. 32-68

Species: TBEV (9-mers)

| protein | block starting position | block entropy | total peptides in block | # peptides required to cover 99% of block | gap/x fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1864 | 1.64 | 4 | 4 | 0 | Y | GIIARTLRQ | 50 | GVIARTLRQ | 21.88 | GIIARALRQ | 3.12 | | |
| NS3 | 1865 | 1.64 | 4 | 4 | 0 | Y | IIARTLRQK | 50 | VIARTLRQK | 21.88 | IIARALRQK | 3.12 | | |
| NS3 | 1866 | 0.2 | 2 | 2 | 0 | Y | IARTLRQKG | 96.88 | IARALRQKG | 3.12 | | | | |
| NS3 | 1867 | 0.2 | 2 | 2 | 0 | Y | ARTLRQKGK | 96.88 | ARALRQKGK | 3.12 | | | | |
| NS3 | 1868 | 0.2 | 2 | 2 | 0 | Y | RTLRQKGKS | 96.88 | RALRQKGKS | 3.12 | | | | |
| NS3 | 1869 | 0.2 | 2 | 2 | 0 | Y | TLRQKGKSV | 96.88 | ALRQKGKSV | 3.12 | | | | |
| NS3 | 1870 | 0 | 1 | 1 | 0 | Y | LRQKGKSVI | 100 | | | | | | |
| NS3 | 1871 | 0 | 1 | 1 | 0 | Y | RQKGKSVIC | 100 | | | | | | |
| NS3 | 1872 | 0 | 1 | 1 | 0 | Y | QKGKSVICL | 100 | | | | | | |
| NS3 | 1873 | 0 | 1 | 1 | 0 | Y | KGKSVICLN | 100 | | | | | | |
| NS3 | 1874 | 0 | 1 | 1 | 0 | Y | GKSVICLNS | 100 | | | | | | |
| NS3 | 1875 | 0 | 1 | 1 | 0 | Y | KSVICLNSK | 100 | | | | | | |
| NS3 | 1876 | 0 | 1 | 1 | 0 | Y | SVICLNSKT | 100 | | | | | | |
| NS3 | 1877 | 0 | 1 | 1 | 0 | Y | VICLNSKTF | 100 | | | | | | |
| NS3 | 1878 | 0 | 1 | 1 | 0 | Y | ICLNSKTFE | 100 | | | | | | |
| NS3 | 1879 | 0 | 1 | 1 | 0 | Y | CLNSKTFEK | 100 | | | | | | |
| NS3 | 1880 | 0 | 1 | 1 | 0 | Y | LNSKTFEKD | 100 | | | | | | |
| NS3 | 1881 | 0 | 1 | 1 | 0 | Y | NSKTFEKDY | 100 | | | | | | |
| NS3 | 1882 | 0.63 | 2 | 2 | 0 | Y | SKTFEKDYS | 84.38 | SKITFEKDYT | 15.62 | | | | |
| NS3 | 1883 | 0.63 | 2 | 2 | 0 | Y | KTFEKDYSR | 84.38 | KTFEKDYTR | 15.62 | | | | |
| NS3 | 1884 | 0.63 | 2 | 2 | 0 | Y | TFEKDYSRV | 84.38 | TFEKDYTRV | 15.62 | | | | |
| NS3 | 1885 | 0.63 | 2 | 2 | 0 | Y | FEKDYSRVR | 84.38 | FEKDYTRVR | 15.62 | | | | |
| NS3 | 1886 | 0.63 | 2 | 2 | 0 | Y | EKDYSRVRD | 84.38 | EKDYTRVRD | 15.62 | | | | |
| NS3 | 1887 | 0.63 | 2 | 2 | 0 | Y | KDYSRVRDE | 84.38 | KDYTRVRDE | 15.62 | | | | |
| NS3 | 1888 | 0.63 | 2 | 2 | 0 | Y | DYSRVRDEK | 84.38 | DYTRVRDEK | 15.62 | | | | |

Fig. 32-69

Species: TBEV (9-mers)

| protein | block starting position | block entropy | total peptides in block | # peptides required to c

Fig. 32-70

Species: TBEV (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS3 | 1914 | 0 | 1 | — | 0 | Y | VSRVIDGRT | 100 | | | | | | |
| NS3 | 1915 | 0 | 1 | — | 0 | Y | SRVIDGRTN | 100 | | | | | | |
| NS3 | 1916 | 0 | 1 | — | 0 | Y | RVIDGRTNI | 100 | | | | | | |
| NS3 | 1917 | 0 | 1 | — | 0 | Y | VIDGRTNIK | 100 | | | | | | |
| NS3 | 1918 | 0 | 1 | — | 0 | Y | IDGRTNIKP | 100 | | | | | | |
| NS3 | 1919 | 0 | 1 | — | 0 | Y | DGRTNIKPE | 100 | | | | | | |
| NS3 | 1920 | 0 | 1 | — | 0 | Y | GRTNIKPEE | 100 | | | | | | |
| NS3 | 1921 | 0 | 1 | — | 0 | Y | RTNIKPEEV | 100 | | | | | | |
| NS3 | 1922 | 0 | 1 | — | 0 | Y | TNIKPEEVD | 100 | | | | | | |
| NS3 | 1923 | 0 | 1 | — | 0 | Y | NIKPEEVDG | 100 | | | | | | |
| NS3 | 1924 | 0.81 | 2 | 2 | 0 | Y | IKPEEVDGR | 75 | IKPEEVDGK | 25 | | | | |
| NS3 | 1925 | 0.81 | 2 | 2 | 0 | Y | KPEEVDGRV | 75 | KPEEVDGKV | 25 | | | | |
| NS3 | 1926 | 0.81 | 2 | 2 | 0 | Y | PEEVDGRVE | 75 | PEEVDGKVE | 25 | | | | |
| NS3 | 1927 | 0.81 | 2 | 2 | 0 | Y | EEVDGRVEL | 75 | EEVDGKVEL | 25 | | | | |
| NS3 | 1928 | — | 3 | 3 | 0 | Y | EVDGRVELT | 71.88 | EVDGKVELT | 25 | EVDGRVELI | 3.12 | | |
| NS3 | 1929 | — | 3 | 3 | 0 | Y | VDGRVELTG | 71.88 | VDGKVELTG | 25 | VDGRVELIG | 3.12 | | |
| NS3 | 1930 | — | 3 | 3 | 0 | Y | DGRVELTGT | 71.88 | DGKVELTGT | 25 | DGRVELIGT | 3.12 | | |
| NS3 | 1931 | — | 3 | 3 | 0 | Y | GRVELTGTR | 71.88 | GKVELTGTR | 25 | GRVELIGTR | 3.12 | | |
| NS3 | 1932 | 0.2 | 2 | 2 | 0 | Y | RVELTGTRR | 96.88 | RVELIGTRR | 3.12 | | | | |
| NS3 | 1933 | 0.2 | 2 | 2 | 0 | Y | VELTGTRRV | 96.88 | VELIGTRRV | 3.12 | | | | |
| NS3 | 1934 | 0.2 | 2 | 2 | 0 | Y | ELTGTRRVT | 96.88 | ELIGTRRVT | 3.12 | | | | |
| NS3 | 1935 | 0.2 | 2 | 2 | 0 | Y | LTGTRRVTT | 96.88 | LIGTRRVTT | 3.12 | | | | |
| NS3 | 1936 | 0 | 1 | — | 0 | Y | TGTRRVTTA | 100 | | | | | | |
| NS3 | 1937 | 0 | 1 | — | 0 | Y | GTRRVTTAS | 100 | | | | | | |
| NS3 | 1938 | 0 | 1 | — | 0 | Y | TRRVTTASA | 100 | | | | | | |

Fig. 32-71

Species: TBEV (9-mers)

| protein | block starting position | block entropy | total peptides in block | # peptides required to cover 99% of block | gap/X fraction | 99% of block covered w/ <= 5 peptides? |

Fig. 32-72

Species: TBEV (9-mers)

| protein | block starting position | block entropy | total peptides in block | # peptides required to cover 99% of block | gap/X fraction | 99% of block covered w/

Fig. 32-73

| Species: TBEV (9-mers) | | | | | | | | | | | | | | | | | |
|---|---|---|---|---|---|---|---|---|---|---|---|---|---|---|---|---|---|
| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
| NS3 |

Fig. 32-74

Species: TBEV (9-mers)

| protein | block starting position | block entropy | total

Fig. 32-75

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---

Fig. 32-76

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2064 | 0.95 | 3 | 3 | 0 | Y | DEANGDLVT | 75 | DEASGDLVT | 21.88 | DEASGDLVT | 3.12 | | |
| NS3 | 2065 | 0.95 | 3 | 3 | 0 | Y | EANGDLVTF | 75 | EASGDLVTF | 21.88 | EASGDLVTF | 3.12 | | |
| NS3 | 2066 | 1.26 | 4 | 4 | 0 | Y | ANGDLVTFR | 68.75 | ASGDLVTFR | 21.88 | ANGDLVTFK | 6.25 | ASGGLVTFR | 3.12 |
| NS3 | 2067 | 1.26 | 4 | 4 | 0 | Y | NGDLVTFRS | 68.75 | SGDLVTFRS | 21.88 | NGDLVTFKS | 6.25 | SGGLVTFRS | 3.12 |
| NS3 | 2068 | 0.53 | 3 | 3 | 0 | Y | GDLVTFRSP | 90.62 | GDLVTFKSP | 6.25 | GGLVTFRSP | 3.12 | | |
| NS3 | 2069 | 0.53 | 3 | 3 | 0 | Y | DLVTFRSPN | 90.62 | DLVTFKSPN | 6.25 | GLVTFRSPN | 3.12 | | |
| NS3 | 2070 | 0.34 | 2 | 2 | 0 | Y | LVTFRSPNG | 93.75 | LVTFKSPNG | 6.25 | | | | |
| NS3 | 2071 | 0.34 | 2 | 2 | 0 | Y | VTFRSPNGA | 93.75 | VTFKSPNGA | 6.25 | | | | |
| NS3 | 2072 | 0.34 | 2 | 2 | 0 | Y | TFRSPNGAE | 93.75 | TFKSPNGAE | 6.25 | | | | |
| NS3 | 2073 | 0.34 | 2 | 2 | 0 | Y | FRSPNGAER | 93.75 | FKSPNGAER | 6.25 | | | | |
| NS3 | 2074 | 0.34 | 2 | 2 | 0 | Y | RSPNGAERT | 93.75 | KSPNGAERT | 6.25 | | | | |
| NS3 | 2075 | 0 | 1 | 1 | 0 | Y | SPNGAERTL | 100 | | | | | | |
| NS3 | 2076 | 0.2 | 2 | 2 | 0 | Y | PNGAERTLR | 96.88 | PNGAERTLK | 3.12 | | | | |
| NS3 | 2077 | 0.2 | 2 | 2 | 0 | Y | NGAERTLRP | 96.88 | NGAERTLKP | 3.12 | | | | |
| NS3 | 2078 | 0.2 | 2 | 2 | 0 | Y | GAERTLRPV | 96.88 | GAERTLKPV | 3.12 | | | | |
| NS3 | 2079 | 0.2 | 2 | 2 | 0 | Y | AERTLRPVW | 96.88 | AERTLKPVW | 3.12 | | | | |
| NS3 | 2080 | 1 | 3 | 3 | 0 | Y | ERTLRPVWK | 71.88 | ERTLRPVWK | 25 | ERTLKPVWR | 3.12 | | |
| NS3 | 2081 | 1 | 3 | 3 | 0 | Y | RTLRPVWRD | 71.88 | RTLRPVWKD | 25 | RTLKPVWRD | 3.12 | | |
| NS3 | 2082 | 1 | 3 | 3 | 0 | Y | TLRPVWRDA | 71.88 | TLRPVWKDA | 25 | TLKPVWRDA | 3.12 | | |
| NS3 | 2083 | 1 | 3 | 3 | 0 | Y | LRPVWRDAR | 71.88 | LRPVWKDAR | 25 | LKPVWRDA | 3.12 | | |
| NS3 | 2084 | 1 | 3 | 3 | 0 | Y | RPVWRDARM | 71.88 | RPVWKDARM | 25 | KPVWRDARM | 3.12 | | |
| NS3 | 2085 | 0.81 | 2 | 2 | 0 | Y | PVWRDARMF | 75 | PVWKDARMF | 25 | | | | |
| NS3 | 2086 | 0.81 | 2 | 2 | 0 | Y | VWRDARMFR | 75 | VWKDARMFK | 25 | | | | |
| NS3 | 2087 | 0.81 | 2 | 2 | 0 | Y | WRDARMFRE | 75 | WKDARMFKE | 25 | | | | |
| NS3 | 2088 | 0.81 | 2 | 2 | 0 | Y | RDARMFREG | 75 | KDARMFKEG | 25 | | | | |

Fig. 32-77

Species: TBEV (9-mers)

| protein | block starting position | block entropy | total peptides in block | #

Fig. 32-78

Species: TBEV (9-mers)

| protein | block starting position | block entropy | total

Fig. 32-79

Species: TBEV (9-mers)

| protein | block starting position | block entropy | total peptides in block | #

Fig. 32-80

Species: TBEV (9-mers)

|

Fig. 32-81

Species: TBEV (9-mers)

| protein | block star

Fig. 32-82

Species: TBEV (9-mers)

| protein | block starting position | block entropy | total peptides in block | # peptides required to cover 99% of block | gap/X fraction | 99% of block covered w/ <= 5 peptides?

Fig. 32-83

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2245 | 0.2 | 2 | 2 | 0 | Y | YFLLTLCSL | 96.88 | YFLLTLCSV | 3.12 | | | | |
| 2K | 2246 | 0.2 | 2 | 2 | 0 | Y | FLLTLCSLA | 96.88 | FLLTLCSVA | 3.12 | | | | |
| 2K | 2247 | 0.2 | 2 | 2 | 0 | Y | LLTLCSLAG | 96.88 | LLTLCSVAG | 3.12 | | | | |
| 2K | 2248 | 0.2 | 2 | 2 | 0 | Y | LTLCSLAGL | 96.88 | LTLCSVAGL | 3.12 | | | | |
| 2K | 2249 | 0.2 | 2 | 2 | 0 | Y | TLCSLAGLV | 96.88 | TLCSVAGLV | 3.12 | | | | |
| 2K | 2250 | 0.2 | 2 | 2 | 0 | Y | LCSLAGLVA | 96.88 | LCSVAGLVA | 3.12 | | | | |
| 2K | 2251 | 0.2 | 2 | 2 | 0 | Y | CSLAGLVAA | 96.88 | CSVAGLVAA | 3.12 | | | | |
| 2K | 2252 | 0.2 | 2 | 2 | 0 | Y | SLAGLVAAN | 96.88 | SVAGLVAAN | 3.12 | | | | |
| 2K | 2253 | 0.2 | 2 | 2 | 0 | Y | LAGLVAANE | 96.88 | VAGLVAANE | 3.12 | | | | |
| 2K | 2254 | 0 | 1 | 1 | 0 | Y | AGLVAANEM | 100 | | | | | | |
| 2K | 2255 | 0 | 1 | 1 | 0 | Y | GLVAANEMG | 100 | | | | | | |
| 2K | 2256 | 0.2 | 2 | 2 | 0 | Y | LVAANEMGF | 96.88 | LVAANEMGL | 3.12 | | | | |
| 2K | 2257 | 0.2 | 2 | 2 | 0 | Y | VAANEMGFL | 96.88 | VAANEMGLL | 3.12 | | | | |
| 2K | 2258 | 0.2 | 2 | 2 | 0 | Y | AANEMGFLE | 96.88 | AANEMGLLE | 3.12 | | | | |
| 2K | 2259 | 0.89 | 3 | 3 | 0 | Y | ANEMGFLEK | 78.12 | ANEMGFLER | 18.75 | ANEMGLLER | 3.12 | | |
| NS4B | 2260 | 0.89 | 3 | 3 | 0 | Y | NEMGFLEKT | 78.12 | NEMGFLERT | 18.75 | NEMGLLERT | 3.12 | | |
| NS4B | 2261 | 0.89 | 3 | 3 | 0 | Y | EMGFLEKTK | 78.12 | EMGFLERTK | 18.75 | EMGLLERTK | 3.12 | | |
| NS4B | 2262 | 0.89 | 3 | 3 | 0 | Y | MGFLEKTKA | 78.12 | MGFLERTKA | 18.75 | MGLLERTKA | 3.12 | | |
| NS4B | 2263 | 0.89 | 3 | 3 | 0 | Y | GFLEKTKAD | 78.12 | GFLERTKAD | 18.75 | GLLERTKAD | 3.12 | | |
| NS4B | 2264 | 0.89 | 3 | 3 | 0 | Y | FLEKTKADL | 78.12 | FLERTKADL | 18.75 | LLERTKADL | 3.12 | | |
| NS4B | 2265 | 0.76 | 2 | 2 | 0 | Y | LEKTKADLS | 78.12 | LERTKADLS | 21.88 | | | | |
| NS4B | 2266 | 0.95 | 3 | 3 | 0 | Y | EKTKADLST | 75 | ERTKADLST | 21.88 | EKTKADLSA | 3.12 | | |
| NS4B | 2267 | 1.26 | 4 | 4 | 0 | Y | KTKADLSTV | 68.75 | RTKADLSTV | 21.88 | KTKADLSTA | 6.25 | KTKADLSAV | 3.12 |
| NS4B | 2268 | 0.53 | 3 | 3 | 0 | Y | TKADLSTVL | 90.62 | TKADLSTAL | 6.25 | TKADLSAVL | 3.12 | | |
| NS4B | 2269 | 0.53 | 3 | 3 | 0 | Y | KADLSTVLW | 90.62 | KADLSTALW | 6.25 | KADLSAVLW | 3.12 | | |

Fig. 32-84

Species: TBEV (9-mers)

| protein | block starting position | block entropy | total pept

Fig. 32-85

Species: TBEV

Fig. 32-86

Species: TBEV (9-mers)

| protein | block starting position | block entropy |

Fig. 32-87

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency |

Fig. 32-88

Species: TBEV (9-mers)

| protein | block star

Fig. 32-89

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block

Fig. 32-90

Species: TBEV (9-mers)

| protein | block starting position | block entropy | total peptides in block | # peptides required to cover 99% of block | gap/X fraction | 99% of block covered w/ <= 5 pe

Fig. 32-91

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block |

Fig. 32-92

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2488 | 0.2 | 2 | 2 | 0 | Y | VRGSLWGFL | 96.88 | VTGSLWGFL | 3.12 | | | | |
| NS4B | 2489 | 0.2 | 2 | 2 | 0 | Y | RGSLWGFLP | 96.88

Fig. 32-93

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block |

Fig. 32-94

Species: TBEV (9-mers)

| protein | block starting position | block entropy | total peptides in block | # pept

Fig. 32-95

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency |

Fig. 32-96

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

Fig. 32-97

Species: TBEV (

Fig. 32-98

Species: TBEV (9-mers)

| protein | block starting position | block entropy | total peptides in block | # peptides required to cover 99% of block | gap/X fraction 99% of block | covered w/ <= 5 peptides? | block to cover 99% of peptides required | frequency |

Fig. 32-99

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2672 | 0.63 | 2 | 2 | 0 | Y | TRKVILLME | 84.38 | TRKVILLME | 15.62 | | | | |
| NS5 | 2673 | 0.63 | 2 | 2 | 0 | Y | RKVILLMEQ | 84.38 | RRVILLMEQ | 15.62 | | | | |
| NS5 | 2674 | 0.63 | 2 | 2 | 0 | Y | KVILLMEQW | 84.38 | RVILLMEQW | 15.62 | | | | |
| NS5 | 2675 | 0 | 1 | 1 | 0 | Y | VILLMEQWK | 100 | | | | | | |
| NS5 | 2676 | 0.2 | 2 | 2 | 0 | Y | ILLMEQWKN | 96.88 | ILLMEQWKI | 3.12 | | | | |
| NS5 | 2677 | 0.2 | 2 | 2 | 0 | Y | LLMEQWKNR | 96.88 | LMEQWKIR | 3.12 | | | | |
| NS5 | 2678 | 0.2 | 2 | 2 | 0 | Y | LMEQWKNRN | 96.88 | LMEQWKIRN | 3.12 | | | | |
| NS5 | 2679 | 0.2 | 2 | 2 | 0 | Y | MEQWKNRNP | 96.88 | MEQWKIRNP | 3.12 | | | | |
| NS5 | 2680 | 0.4 | 3 | 3 | 0 | Y | EQWKNRNPT | 93.75 | EQWKIRNPT | 3.12 | EQWKIRNPT | 3.12 | | |
| NS5 | 2681 | 0.4 | 3 | 3 | 0 | Y | QWKNRNPTA | 93.75 | QWKIRNPTA | 3.12 | QWKNRNPAA | 3.12 | | |
| NS5 | 2682 | 1.26 | 4 | 4 | 0 | Y | WKNRNPTAT | 62.5 | WKNRNPTAA | 3.12 | WKNRNPAAA | 3.12 | WKIRNPTAT | 3.12 |
| NS5 | 2683 | 1.26 | 4 | 4 | 0 | Y | KNRNPTATC | 62.5 | KNRNPTAAC | 31.25 | KIRNPTAAC | 3.12 | KNRNPAAAC | 3.12 |
| NS5 | 2684 | 1.26 | 4 | 4 | 0 | Y | NRNPTATCV | 62.5 | NRNPTAACV | 31.25 | NRNPAAACV | 3.12 | IRNPTATCV | 3.12 |
| NS5 | 2685 | 1.08 | 3 | 3 | 0 | Y | RNPTATCVF | 65.62 | RNPTAACVF | 31.25 | RNPAAACVF | 3.12 | | |
| NS5 | 2686 | 1.08 | 3 | 3 | 0 | Y | NPTATCVFK | 65.62 | NPTAACVFK | 31.25 | NPAAACVFK | 3.12 | | |
| NS5 | 2687 | 1.08 | 3 | 3 | 0 | Y | PTATCVFKV | 65.62 | PTAACVFKV | 31.25 | PAAACVFKV | 3.12 | | |
| NS5 | 2688 | 1.08 | 3 | 3 | 0 | Y | TATCVFKVL | 65.62 | TAACVFKVL | 31.25 | AAACVFKVL | 3.12 | | |
| NS5 | 2689 | 0.93 | 2 | 2 | 0 | Y | ATCVFKVLA | 65.62 | AACVFKVLA | 34.38 | | | | |
| NS5 | 2690 | 0.93 | 2 | 2 | 0 | Y | TCVFKVLAP | 65.62 | ACVFKVLAP | 34.38 | | | | |
| NS5 | 2691 | 0 | 1 | 1 | 0 | Y | CVFKVLAPY | 100 | | | | | | |
| NS5 | 2692 | 0 | 1 | 1 | 0 | Y | VFKVLAPYR | 100 | | | | | | |
| NS5 | 2693 | 0 | 1 | 1 | 0 | Y | FKVLAPYRP | 100 | | | | | | |
| NS5 | 2694 | 0.2 | 2 | 2 | 0 | Y | KVLAPYRPE | 96.88 | KVLAPYRPK | 3.12 | | | | |
| NS5 | 2695 | 0.2 | 2 | 2 | 0 | Y | VLAPYRPEV | 96.88 | VLAPYRPKV | 3.12 | | | | |
| NS5 | 2696 | 0.2 | 2 | 2 | 0 | Y | LAPYRPEVI | 96.88 | LAPYRPKVI | 3.12 | | | | |

Fig. 32-100

Species: TBEV (9-mers)

| protein | block starting position | block entropy | total peptides in block | # peptides required to cover 99% of block | gap/X fraction

Fig. 32-101

Species: TBEV (9-mers)

| protein | block starting position | block entropy | total peptides in block | # peptides required to cover 99% of block | 99% of block gap/X fraction | 99% of block covered w/ <= 5 peptides?

Fig. 32-102

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 32-103

Species: TBEV (9-mers)

| protein | block starting position | block entropy | total peptides in block | # peptides required to cover 99% of block | gap/X fraction 99% of block | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2772 | 0.64 | 3 | 3 | 0 | Y | VGTRCVFLA | 87.5 | IGTRCVFLA | 9.38 | | | | |
| NS5 | 2773 | 0.4 | 3 | 3 | 0 | Y | GTRCVFLAE | 93.75 | GTRCVFLAD | 3.12 | | | | |
| NS5 | 2774 | 0.4 | 3 | 3 | 0 | Y | TRCVFLAED | 93.75 | TRCVFLAED | 3.12 | | | | |
| NS5 | 2775 | 0.84 | 4 | 4 | 0 | Y | RCVFLAEDK | 84.38 | RCVFLAEDR | 9.38 | RCVFLAEDK | 3.12 | | |
| NS5 | 2776 | 0.84 | 4 | 4 | 0 | Y | CVFLAEDKV | 84.38 | CVFLAEDRV | 9.38 | CVFLAEDKV | 3.12 | | |
| NS5 | 2777 | 1.16 | 5 | 5 | 0 | Y | VFLAEDKVK | 78.12 | VFLAEDKVR | 9.38 | VFLAEDKVK | 3.12 | VFLADDKVK | 3.12 |
| NS5 | 2778 | 1.16 | 5 | 5 | 0 | Y | FLAEDKVKE | 78.12 | FLAEDKVRE | 9.38 | FLAEDKVKE | 3.12 | FLADDKVKE | 3.12 |
| NS5 | 2779 | 1.69 | 5 | 5 | 0 | Y | LAEDKVKEQ | 56.25 | LAEDKVKEQ | 25 | LAEDKVREK | 6.25 | LADDKVKEK | 3.12 |
| NS5 | 2780 | 1.69 | 5 | 5 | 0 | Y | AEDKVKEKD | 56.25 | AEDKVKEQD | 25 | AEDKVREKD | 6.25 | ADDKVKEKD | 3.12 |
| NS5 | 2781 | 1.69 | 5 | 5 | 0 | Y | EDKVKEKDV | 56.25 | EDKVKEQDV | 25 | EDKVREKDV | 6.25 | DDKVKEKDV | 3.12 |
| NS5 | 2782 | 1.65 | 5 | 5 | 0 | Y | DKVKEKDVQ | 59.38 | DKVKEQDVQ | 21.88 | DKVREKDVQ | 6.25 | DKVKEQDVR | 3.12 |
| NS5 | 2783 | 1.65 | 5 | 5 | 0 | Y | KVKEKDVQE | 59.38 | KVKEQDVQE | 21.88 | KVREKDVQE | 6.25 | KVKEQDVRE | 3.12 |
| NS5 | 2784 | 1.5 | 4 | 4 | 0 | Y | VKEKDVQER | 59.38 | VKEQDVQER | 21.88 | VKEQDVRER | 3.12 | | |
| NS5 | 2785 | 1.5 | 4 | 4 | 0 | Y | KEKDVQERI | 59.38 | KEQDVQERI | 21.88 | KEQDVRERI | 3.12 | | |
| NS5 | 2788 | 1.47 | 5 | 5 | 0 | Y | DVQERISAL | 56.25 | DVQERINAL | 34.38 | DVRERIRAL | 3.12 | DVQERIKAL | 3.12 |
| NS5 | 2791 | 1.47 | 5 | 5 | 0 | Y | ERISALREQ | 56.25 | ERINALREQ | 34.38 | ERIRALREQ | 3.12 | ERIKALREQ | 3.12 |
| NS5 | 2792 | 1.47 | 5 | 5 | 0 | Y | RISALREQY | 56.25 | RINALREQY | 34.38 | RIRALREQY | 3.12 | RIKALREQY | 3.12 |
| NS5 | 2795 | 1.04 | 3 | 3 | 0 | Y | ALREQYGET | 68.75 | ALREQYSET | 28.12 | | | | |
| NS5 | 2796 | 1.04 | 3 | 3 | 0 | Y | LREQYGETW | 68.75 | LREQYSETW | 28.12 | | | | |
| NS5 | 2797 | 1.04 | 3 | 3 | 0 | Y | REQYGETWH | 68.75 | REQYSETWH | 28.12 | KEQYGETWH | 3.12 | | |
| NS5 | 2807 | 1.68 | 5 | 5 | 0 | Y | DREHPYRTW | 56.25 | DEEHPYRTW | 21.88 | DGEHPYRTW | 15.62 | NGEHPYRTW | 3.12 | DAEHPYRTW | 3.12 |
| NS5 | 2808 | 1.56 | 4 | 4 | 0 | Y | REHPYRTWQ | 56.25 | EEHPYRTWQ | 21.88 | GEHPYRTWQ | 18.75 | AEHPYRTWQ | 3.12 | | |
| NS5 | 2809 | 0 | 1 | 1 | 0 | Y | EHPYRTWQY | 100 | | | | | | |
| NS5 | 2810 | 0 | 1 | 1 | 0 | Y | HPYRTWQYW | 100 | | | | | | |
| NS5 | 2811 | 0 | 1 | 1 | 0 | Y | PYRTWQYWG | 100 | | | | | | |

Fig. 32-104

Species: TBEV (9-mers)

| protein | block starting position | block entropy | total peptides in block | # peptides required to cover 99% of block | gap/x fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS5 | 2812 | 0 | 1 | 1 | 0 | | Y | YRTWQYWGS | 100 | | | | | | |
| NS5 | 2813 | 0 | 1 | 1 | 0 | | Y | RTWQYWGSY | 100 | | | | | | |
| NS5 | 2814 | 0 | 1 | 1 | 0 | | Y | TWQYWGSYR | 100 | | | | | | |
| NS5 | 2815 | 0 | 1 | 1 | 0 | | Y | WQYWGSYRT | 100 | | | | | | |
| NS5 | 2816 | 0 | 1 | 1 | 0 | | Y | QYWGSYRTA | 100 | | | | | | |
| NS5 | 2817 | 0 | 1 | 1 | 0 | | Y | YWGSYRTAP | 100 | | | | | | |
| NS5 | 2818 | 0 | 1 | 1 | 0 | | Y | WGSYRTAPT | 100 | | | | | | |
| NS5 | 2819 | 0 | 1 | 1 | 0 | | Y | GSYRTAPTG | 100 | | | | | | |
| NS5 | 2820 | 0 | 1 | 1 | 0 | | Y | SYRTAPTGS | 100 | | | | | | |
| NS5 | 2821 | 0 | 1 | 1 | 0 | | Y | YRTAPTGSA | 100 | | | | | | |
| NS5 | 2822 | 0 | 1 | 1 | 0 | | Y | RTAPTGSAA | 100 | | | | | | |
| NS5 | 2823 | 0 | 1 | 1 | 0 | | Y | TAPTGSAAS | 100 | | | | | | |
| NS5 | 2824 | 0 | 1 | 1 | 0 | | Y | APTGSAASL | 100 | | | | | | |
| NS5 | 2825 | 0.2 | 2 | 2 | 0 | | Y | PTGSAASLI | 96.88 | PTGSAASLT | 3.12 | | | | |
| NS5 | 2826 | 0.2 | 2 | 2 | 0 | | Y | TGSAASLIN | 96.88 | TGSAASLTN | 3.12 | | | | |
| NS5 | 2827 | 0.2 | 2 | 2 | 0 | | Y | GSAASLING | 96.88 | GSAASLTNG | 3.12 | | | | |
| NS5 | 2828 | 0.2 | 2 | 2 | 0 | | Y | SAASLINGV | 96.88 | SAASLTNGV | 3.12 | | | | |
| NS5 | 2829 | 0.2 | 2 | 2 | 0 | | Y | AASLINGVW | 96.88 | AASLTNGVW | 3.12 | | | | |
| NS5 | 2830 | 0.2 | 2 | 2 | 0 | | Y | ASLINGVWK | 96.88 | ASLTNGVWK | 3.12 | | | | |
| NS5 | 2831 | 0.2 | 2 | 2 | 0 | | Y | SLINGVWKL | 96.88 | SLTNGVWKL | 3.12 | | | | |
| NS5 | 2832 | 0.2 | 2 | 2 | 0 | | Y | LINGVWKLL | 96.88 | LTNGVWKLL | 3.12 | | | | |
| NS5 | 2833 | 0.2 | 2 | 2 | 0 | | Y | INGVWKLLS | 96.88 | TNGVWKLLS | 3.12 | | | | |
| NS5 | 2834 | 0 | 1 | 1 | 0 | | Y | NGVWKLLSW | 100 | | | | | | |
| NS5 | 2835 | 0 | 1 | 1 | 0 | | Y | GVWKLLSWP | 100 | | | | | | |
| NS5 | 2836 | 0 | 1 | 1 | 0 | | Y | VWKLLSWPW | 100 | | | | | | |

Fig. 32-105

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2837 | 0 | 1 | 1 | 0 | Y | VKLLSWPWN | 100 | | | | | | |
| NS5 | 2838 | 0 | 1 | 1 | 0 | Y | KLLSWPWNA | 100 | | | | | | |
| NS5 | 2839 | 0 | 1 | 1 | 0 | Y | LLSWPWNAR | 100 | | | | | | |
| NS5 | 2840 | 0 | 1 | 1 | 0 | Y | LSWPWNARE | 100 | | | | | | |
| NS5 | 2841 | 0 | 1 | 1 | 0 | Y | SWPWNARED | 100 | | | | | | |
| NS5 | 2842 | 0 | 1 | 1 | 0 | Y | WPWNAREDV | 100 | | | | | | |
| NS5 | 2843 | 0 | 1 | 1 | 0 | Y | PWNAREDVV | 100 | | | | | | |
| NS5 | 2844 | 0 | 1 | 1 | 0 | Y | WNAREDVVR | 100 | | | | | | |
| NS5 | 2845 | 0 | 1 | 1 | 0 | Y | NAREDVVRM | 100 | | | | | | |
| NS5 | 2846 | 0 | 1 | 1 | 0 | Y | AREDVVRMA | 100 | | | | | | |
| NS5 | 2847 | 0 | 1 | 1 | 0 | Y | REDVVRMAM | 100 | | | | | | |
| NS5 | 2848 | 0 | 1 | 1 | 0 | Y | EDVVRMAMT | 100 | | | | | | |
| NS5 | 2849 | 0 | 1 | 1 | 0 | Y | DVVRMAMTD | 100 | | | | | | |
| NS5 | 2850 | 0.2 | 2 | 2 | 0 | Y | VVRMAMTDT | 96.88 | VVRMAMTDP | 3.12 | | | | |
| NS5 | 2851 | 0.2 | 2 | 2 | 0 | Y | VRMAMTDTT | 96.88 | VRMAMTDPT | 3.12 | | | | |
| NS5 | 2852 | 0.2 | 2 | 2 | 0 | Y | RMAMTDTTA | 96.88 | RMAMTDPTP | 3.12 | | | | |
| NS5 | 2853 | 0.2 | 2 | 2 | 0 | Y | MAMTDTTAF | 96.88 | MAMTDPTPA | 3.12 | | | | |
| NS5 | 2854 | 0.2 | 2 | 2 | 0 | Y | AMTDTTAFG | 96.88 | AMTDPTPAW | 3.12 | | | | |
| NS5 | 2855 | 0.2 | 2 | 2 | 0 | Y | MTDTTAFGQ | 96.88 | MTDPTPAWQ | 3.12 | | | | |
| NS5 | 2856 | 0.2 | 2 | 2 | 0 | Y | TDTTAFGQQ | 96.88 | TDPTPAWQQ | 3.12 | | | | |
| NS5 | 2857 | 0.2 | 2 | 2 | 0 | Y | DTTAFGQQR | 96.88 | DPTPAWQQR | 3.12 | | | | |
| NS5 | 2858 | 0.2 | 2 | 2 | 0 | Y | TTAFGQQRV | 96.88 | PTPAWQQRV | 3.12 | | | | |
| NS5 | 2859 | 0.2 | 2 | 2 | 0 | Y | TAFGQQRVF | 96.88 | TPAWQQRVF | 3.12 | | | | |
| NS5 | 2860 | 0.2 | 2 | 2 | 0 | Y | AFGQQRVFK | 96.88 | PAWQQRVFK | 3.12 | | | | |
| NS5 | 2861 | 1.04 | 3 | 3 | 0 | Y | FGQQRVFKE | 68.75 | FGQQRVFKD | 28.12 | AWQQRVFKK | 3.12 | | |

Fig. 32-106

Species: TBEV (9-mers)

| protein | block starting position | block entropy | total peptides in block | # peptides required to cover 99% of block | gap/X fraction of 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2862 | 1.04 | 3 | 3 | 0 | Y | GQQRVFKEK | 68.75 | GQQRVFKDK | 28.12 | WQQRVFKKN | 3.12 | | |
| NS5 | 2863 | 1.04 | 3 | 3 | 0 | Y | QQRVFKEKV | 68.75 | QQRVFKDKV | 28.12 | QQRVFKKNA | 3.12 | | |
| NS5 | 2864 | 1.04 | 3 | 3 | 0 | Y | QRVFKEKVD | 68.75 | QRVFKDKVD | 28.12 | QRVFKKNAD | 3.12 | | |
| NS5 | 2865 | 1.04 | 3 | 3 | 0 | Y | RVFKEKVDT | 68.75 | RVFKDKVDT | 28.12 | RVFKKNADT | 3.12 | | |
| NS5 | 2866 | 1.04 | 3 | 3 | 0 | Y | VFKEKVDTK | 68.75 | VFKDKVDTK | 28.12 | VFKKNADTK | 3.12 | | |
| NS5 | 2867 | 1.04 | 3 | 3 | 0 | Y | FKEKVDTKA | 68.75 | FKDKVDTKA | 28.12 | FKKNADTKA | 3.12 | | |
| NS5 | 2868 | 1.04 | 3 | 3 | 0 | Y | KEKVDTKAQ | 68.75 | KDKVDTKAQ | 28.12 | KKNADTKAQ | 3.12 | | |
| NS5 | 2869 | 1.04 | 3 | 3 | 0 | Y | EKVDTKAQE | 68.75 | DKVDTKAQE | 28.12 | KNADTKAQE | 3.12 | | |
| NS5 | 2870 | 0.2 | 2 | 2 | 0 | Y | KVDTKAQEP | 96.88 | NADTKAQEP | 3.12 | | | | |
| NS5 | 2871 | 0.2 | 2 | 2 | 0 | Y | VDTKAQEPQ | 96.88 | ADTKAQEPQ | 3.12 | | | | |
| NS5 | 2872 | 0 | 1 | 1 | 0 | Y | DTKAQEPQP | 100 | | | | | | |
| NS5 | 2873 | 0 | 1 | 1 | 0 | Y | TKAQEPQPG | 100 | | | | | | |
| NS5 | 2874 | 0 | 1 | 1 | 0 | Y | KAQEPQPGT | 100 | | | | | | |
| NS5 | 2875 | 0.81 | 2 | 2 | 0 | Y | AQEPQPGTK | 75 | AQEPQPGTR | 25 | | | | |
| NS5 | 2876 | 0.81 | 2 | 2 | 0 | Y | QEPQPGTKV | 75 | QEPQPGTRV | 25 | | | | |
| NS5 | 2877 | 0.81 | 2 | 2 | 0 | Y | EPQPGTKVI | 75 | EPQPGTRVI | 25 | | | | |
| NS5 | 2878 | 0.81 | 2 | 2 | 0 | Y | PQPGTKVIM | 75 | PQPGTRVIM | 25 | | | | |
| NS5 | 2879 | 0.81 | 2 | 2 | 0 | Y | QPGTKVIMR | 75 | QPGTRVIMR | 25 | | | | |
| NS5 | 2880 | 0.81 | 2 | 2 | 0 | Y | PGTKVIMRA | 75 | PGTRVIMRA | 25 | | | | |
| NS5 | 2881 | 0.81 | 2 | 2 | 0 | Y | GTKVIMRAV | 75 | GTRVIMRAV | 25 | | | | |
| NS5 | 2882 | 0.81 | 2 | 2 | 0 | Y | TKVIMRAVN | 75 | TRVIMRAVN | 25 | | | | |
| NS5 | 2883 | 0.81 | 2 | 2 | 0 | Y | KVIMRAVND | 75 | RVIMRAVND | 25 | | | | |
| NS5 | 2884 | 0 | 1 | 1 | 0 | Y | VIMRAVNDW | 100 | | | | | | |
| NS5 | 2885 | 0.2 | 2 | 2 | 0 | Y | IMRAVNDWI | 96.88 | IMRAVNDWM | 3.12 | | | | |
| NS5 | 2886 | 0.2 | 2 | 2 | 0 | Y | MRAVNDWIL | 96.88 | MRAVNDWML | 3.12 | | | | |

Fig. 32-107

Species: TBEV (9-mers)

| protein | block starting position | block entropy | total peptides in block | # peptides required to cover 99% of block | gap/X

Fig. 32-108

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2920 | 0.4 | 3 | 3 | 0 | Y | ALGAWSDEQ | 93.75 | ALGAWSNEQ | 3.12 | ALGAWSEEQ | 3.12 | | |
| NS5 | 2921 | 0.4 | 3 | 3 | 0 | Y | LGAWSDEQN | 93.75 | LGAWSNEQN | 3.12 | LGAWSEEQN | 3.12 | | |
| NS5 | 2922 | 0.4 | 3 | 3 | 0 | Y | GAWSDEQNR | 93.75 | GAWSNEQNR | 3.12 | GAWSEEQNR | 3.12 | | |
| NS5 | 2

Fig. 32-109

Species: TBEV (9-mers)

| protein | block starting position | block entropy | total peptides in block | # peptides required to cover 99% of block | gap/X fraction of block | 99% of block covered w/ <= 5 peptides? | block to cover 99% of | frequency | block to cover 99% of | frequency | block to cover

Fig. 32-110

Species: TBEV (9-mers)

| prot

Fig. 32-111

Species: TBEV (9-mers)

| protein | block starting position | block entropy | total

Fig. 32-112

Species: TBEV (9-mers)

| protein | block starting position | block entropy | total peptides in block | # peptides required to cover 99% of block | gap/X fraction | 99% of block covered w/ <= 5 peptides? | block required to cover 99% of | frequency | block required to cover 99% of | frequency | block required to cover 99% of | frequency | block required to cover 99% of | frequency |
|---|---|---|---|---|---|---|---|---|---|---|---|---|---|---|
| NS5 | 3035 | 1.31 | 4 | 4 | 0 | Y | STLEGGLFY | 65.62 | STLNGGLFY | 25 | SILEGGLFY | 6.25 | | |
| NS5 | 3036 | 1.31 | 4 | 4 | 0 | Y | TLEGGLFYA | 65.62 | TLNGGLFYA | 25 | ILEGGLFYA | 6.25 | STPEGGLFY | 3.12 |
| NS5 | 3037 | — | 3 | 3 | 0 | Y | LEGGLFYAD | 71.88 | LNGGLFYAD | 25 | PEGGLFYAD | 3.12 | TPEGGLFYA | 3.12 |
| NS5 | 3038 | 0.81 | 2 | 2 | 0 | Y | EGGLFYADD | 75 | NGGLFYADD | 25 | | | | |
| NS5 | 3039 | 0 | 1 | 1 | 0 | Y | GGLFYADDT | 100 | | | | | | |
| NS5 | 3040 | 0 | 1 | 1 | 0 | Y | GLFYADDTA | 100 | | | | | | |
| NS5 | 3041 | 0 | 1 | 1 | 0 | Y | LFYADDTAG | 100 | | | | | | |
| NS5 | 3042 | 0 | 1 | 1 | 0 | Y | FYADDTAGW | 100 | | | | | | |
| NS5 | 3043 | 0 | 1 | 1 | 0 | Y | YADDTAGWD | 100 | | | | | | |
| NS5 | 3044 | 0 | 1 | 1 | 0 | Y | ADDTAGWDT | 100 | | | | | | |
| NS5 | 3045 | 0 | 1 | 1 | 0 | Y | DDTAGWDTK | 100 | | | | | | |
| NS5 | 3046 | 0 | 1 | 1 | 0 | Y | DTAGWDTKV | 100 | | | | | | |
| NS5 | 3047 | 0 | 1 | 1 | 0 | Y | TAGWDTKVT | 100 | | | | | | |
| NS5 | 3048 | 0 | 1 | 1 | 0 | Y | AGWDTKVTN | 100 | | | | | | |
| NS5 | 3049 | 0 | 1 | 1 | 0 | Y | GWDTKVTNA | 100 | | | | | | |
| NS5 | 3050 | 0 | 1 | 1 | 0 | Y | WDTKVTNAD | 100 | | | | | | |
| NS5 | 3051 | 0 | 1 | 1 | 0 | Y | DTKVTNADL | 100 | | | | | | |
| NS5 | 3052 | 0 | 1 | 1 | 0 | Y | TKVTNADLE | 100 | | | | | | |
| NS5 | 3053 | 0 | 1 | 1 | 0 | Y | KVTNADLED | 100 | | | | | | |
| NS5 | 3054 | 0 | 1 | 1 | 0 | Y | VTNADLEDE | 100 | | | | | | |
| NS5 | 3055 | 0 | 1 | 1 | 0 | Y | TNADLEDEE | 100 | | | | | | |
| NS5 | 3056 | 0 | 1 | 1 | 0 | Y | NADLEDEEQ | 100 | | | | | | |
| NS5 | 3057 | — | 2 | 2 | 0 | Y | ADLEDEEQL | 53.12 | ADLEDEEQI | 46.88 | | | | |
| NS5 | 3058 | — | 2 | 2 | 0 | Y | DLEDEEQLL | 53.12 | DLEDEEQIL | 46.88 | | | | |
| NS5 | 3059 | — | 2 | 2 | 0 | Y | LEDEEQLLR | 53.12 | LEDEEQILR | 46.88 | | | | |

Fig. 32-113

Species: TBEV (9-mers)

| protein | block starting position | block entropy | total peptides in block | # peptides required to cover 99% of block | 99% of block gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3060 | — | 2 | 2 | 0 | Y | EDEEQLLRY | 53.12 | EDEEQLLRY | 46.88 | | | | |
| NS5 | 3061 | — | 2 | 2 | 0 | Y | DEEQLLRYM | 53.12 | DEEQLLRYM | 46.88 | | | | |
| NS5 | 3062 | — | 2 | 2 | 0 | Y | EEQLLRYME | 53.12 | EEQLLRYME | 46.88 | | | | |
| NS5 | 3063 | — | 2 | 2 | 0 | Y | EQLLRYMEG | 53.12 | EQLLRYMEG | 46.88 | | | | |
| NS5 | 3064 | — | 2 | 2 | 0 | Y | QLLRYMEGE | 53.12 | QLLRYMEGE | 46.88 | | | | |
| NS5 | 3065 | — | 2 | 2 | 0 | Y | LLRYMEGEH | 53.12 | LLRYMEGEH | 46.88 | | | | |
| NS5 | 3066 | 0.76 | 2 | 2 | 0 | Y | LRYMEGEHK | 78.12 | LRYMEGEHR | 21.88 | | | | |
| NS5 | 3067 | 0.76 | 2 | 2 | 0 | Y | RYMEGEHKQ | 78.12 | RYMEGEHRQ | 21.88 | | | | |
| NS5 | 3068 | 0.76 | 2 | 2 | 0 | Y | YMEGEHKQL | 78.12 | YMEGEHRQL | 21.88 | | | | |
| NS5 | 3069 | 0.76 | 2 | 2 | 0 | Y | MEGEHKQLA | 78.12 | MEGEHRQLA | 21.88 | | | | |
| NS5 | 3070 | 1.49 | 3 | 3 | 0 | Y | EGEHKQLAA | 50 | EGEHRQLAA | 21.88 | | | | |
| NS5 | 3071 | 1.49 | 3 | 3 | 0 | Y | GEHKQLAAT | 50 | GEHRQLAAT | 21.88 | | | | |
| NS5 | 3072 | 1.66 | 4 | 4 | 0 | Y | EHKQLAATI | 46.88 | EHKQLAATI | 28.12 | EHRQLAATI | 21.88 | EHKQLAATV | 3.12 |
| NS5 | 3073 | 1.66 | 4 | 4 | 0 | Y | HKQLAATIM | 46.88 | HKQLAATIM | 28.12 | HRQLAATIM | 21.88 | HKQLAATVM | 3.12 |
| NS5 | 3074 | 1.66 | 4 | 4 | 0 | Y | KQLAATIMQ | 46.88 | KQLAATIMQ | 28.12 | RQLAATIMQ | 21.88 | KQLAATVMQ | 3.12 |
| NS5 | 3075 | 1.04 | 3 | 3 | 0 | Y | QLAATIMQK | 68.75 | QLAATIMQK | 28.12 | QLAATVMQK | 3.12 | | |
| NS5 | 3076 | 1.04 | 3 | 3 | 0 | Y | LAATIMQKA | 68.75 | LAATIMQKA | 28.12 | LAATVMQKA | 3.12 | | |
| NS5 | 3077 | 1.04 | 3 | 3 | 0 | Y | AATIMQKAY | 68.75 | AATIMQKAY | 28.12 | AATVMQKAY | 3.12 | | |
| NS5 | 3078 | 1.04 | 3 | 3 | 0 | Y | ATIMQKAYH | 68.75 | ATIMQKAYH | 28.12 | ATVMQKAYH | 3.12 | | |
| NS5 | 3079 | 0.2 | 2 | 2 | 0 | Y | TIMQKAYHA | 96.88 | TIMQKAYHA | 3.12 | | | | |
| NS5 | 3080 | 0.2 | 2 | 2 | 0 | Y | IMQKAYHAK | 96.88 | VMQKAYHAK | 3.12 | | | | |
| NS5 | 3081 | 0 | 1 | 1 | 0 | Y | MQKAYHAKV | 100 | | | | | | |
| NS5 | 3082 | 0 | 1 | 1 | 0 | Y | QKAYHAKVV | 100 | | | | | | |
| NS5 | 3083 | 0 | 1 | 1 | 0 | Y | KAYHAKVVK | 100 | | | | | | |
| NS5 | 3084 | 0 | 1 | 1 | 0 | Y | AYHAKVVKV | 100 | | | | | | |

Fig. 32-114

Species: TBEV (9-mers)

| protein | block starting position | block entropy | total peptides in block | # peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3085 | 0 | 1 | 1 | 0 | Y | YHAKVKVA | 100 | | | | | | |
| NS5 | 3086 | 0 | 1 | 1 | 0 | Y | HAKVKVAR | 100 | | | | | | |
| NS5 | 3087 | 0 | 1 | 1 | 0 | Y | AKVKVARP | 100 | | | | | | |
| NS5 | 3088 | 0 | 1 | 1 | 0 | Y | KVKVARPS | 100 | | | | | | |
| NS5 | 3089 | 0 | 1 | 1 | 0 | Y | VKVARPSR | 100 | | | | | | |
| NS5 | 3090 | 0.2 | 2 | 2 | 0 | Y | VKVARPSRD | 96.88 | | | | | | |
| NS5 | 3091 | 0.2 | 2 | 2 | 0 | Y | KVARPSRDG | 96.88 | | | | | | |
| NS5 | 3092 | 0.2 | 2 | 2 | 0 | Y | VARPSRDGG | 96.88 | | | | | | |
| NS5 | 3093 | 0.2 | 2 | 2 | 0 | Y | ARPSRDGGC | 96.88 | | | | | | |
| NS5 | 3094 | 0.64 | 3 | 3 | 0 | Y | RPSRDGGCI | 87.5 | RPSRDGGCV | 9.38 | RPSREGGCV | 3.12 | | |
| NS5 | 3095 | 0.64 | 3 | 3 | 0 | Y | PSRDGGCIM | 87.5 | PSRDGGCVM | 9.38 | PSREGGCVM | 3.12 | | |
| NS5 | 3096 | 0.64 | 3 | 3 | 0 | Y | SRDGGCIMD | 87.5 | SRDGGCVMD | 9.38 | SREGGCVMD | 3.12 | | |
| NS5 | 3097 | 0.64 | 3 | 3 | 0 | Y | RDGGCIMDV | 87.5 | RDGGCVMDV | 9.38 | REGGCVMDV | 3.12 | | |
| NS5 | 3098 | 0.64 | 3 | 3 | 0 | Y | DGGCIMDVI | 87.5 | DGGCVMDVI | 9.38 | EGGCVMDVI | 3.12 | | |
| NS5 | 3099 | 0.54 | 2 | 2 | 0 | Y | GGCIMDVIT | 87.5 | GGCVMDVIT | 12.5 | | | | |
| NS5 | 3100 | 0.54 | 2 | 2 | 0 | Y | GCIMDVITR | 87.5 | GCVMDVITR | 12.5 | | | | |
| NS5 | 3101 | 0.54 | 2 | 2 | 0 | Y | CIMDVITRR | 87.5 | CVMDVITRR | 12.5 | | | | |
| NS5 | 3102 | 0.54 | 2 | 2 | 0 | Y | IMDVITRRD | 87.5 | VMDVITRRD | 12.5 | | | | |
| NS5 | 3103 | 0 | 1 | 1 | 0 | Y | MDVITRRDQ | 100 | | | | | | |
| NS5 | 3104 | 0 | 1 | 1 | 0 | Y | DVITRRDQR | 100 | | | | | | |
| NS5 | 3105 | 0 | 1 | 1 | 0 | Y | VITRRDQRG | 100 | | | | | | |
| NS5 | 3106 | 0 | 1 | 1 | 0 | Y | ITRRDQRGS | 100 | | | | | | |
| NS5 | 3107 | 0.2 | 2 | 2 | 0 | Y | TRRDQRGSG | 96.88 | TRRDQRGSV | 3.12 | | | | |
| NS5 | 3108 | 0.2 | 2 | 2 | 0 | Y | RRDQRGSGQ | 96.88 | RRDQRGSVQ | 3.12 | | | | |
| NS5 | 3109 | 0.2 | 2 | 2 | 0 | Y | RDQRGSGQV | 96.88 | RDQRGSVQV | 3.12 | | | | |

Fig. 32-115

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block |

Fig. 32-116

Species: TBEV (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 3135 | 0.2 | 2 | 2 | 0 | Y | MMEGEGVIE | 96.88 | MMEGEGVWE | 3.12 | | | | |
| NS5 | 3136 | 0.2 | 2 | 2 | 0 | Y | MEGEGVIEA | 96.88 | MEGEGVWEA | 3.12 | | | | |
| NS5 | 3137 | 1.73 | 4 | 4 | 0 | Y | EGEGVIEAS | 37.5 | EGEGVIEAA | 31.25 | EGEGVIEAT | 28.12 | EGEGVWEAS | 3.12 | |
| NS5 | 3138 | 1.73 | 4 | 4 | 0 | Y | GEGVIEASD | 37.5 | GEGVIEAAD | 31.25 | GEGVIEATD | 28.12 | GEGVWEASD | 3.12 | |
| NS5 | 3139 | 1.73 | 4 | 4 | 0 | Y | EGVIEASDA | 37.5 | EGVIEAADA | 31.25 | EGVIEATDA | 28.12 | EGVWEASDA | 3.12 | |
| NS5 | 3140 | 1.73 | 4 | 4 | 0 | Y | GVIEASDAH | 37.5 | GVIEAADAH | 31.25 | GVIEATDAH | 28.12 | GVWEASDAH | 3.12 | |
| NS5 | 3141 | 1.73 | 4 | 4 | 0 | Y | VIEASDAHN | 37.5 | VIEAADAHN | 31.25 | VIEATDAHN | 28.12 | VWEASDAHN | 3.12 | |
| NS5 | 3142 | 1.73 | 4 | 3 | 0 | Y | IEASDAHNP | 37.5 | IEAADAHNP | 31.25 | IEATDAHNP | 28.12 | VEASDAHNP | 3.12 | |
| NS5 | 3143 | 1.57 | 3 | 3 | 0 | Y | EASDAHNPR | 40.62 | EAADAHNPR | 31.25 | EATDAHNPR | 28.12 | | | |
| NS5 | 3144 | 1.57 | 3 | 3 | 0 | Y | ASDAHNPRL | 40.62 | AADAHNPRL | 31.25 | ATDAHNPRL | 28.12 | | | |
| NS5 | 3145 | 1.71 | 4 | 4 | 0 | Y | SDAHNPRLL | 40.62 | ADAHNPRLL | 31.25 | TDAHNPRLL | 25 | TDAHNPRLF | 3.12 | |
| NS5 | 3146 | 0.2 | 2 | 2 | 0 | Y | DAHNPRLLR | 96.88 | DAHNPRLFR | 3.12 | | | | | |
| NS5 | 3147 | 0.2 | 2 | 2 | 0 | Y | AHNPRLLRV | 96.88 | AHNPRLFRV | 3.12 | | | | | |
| NS5 | 3148 | 0.2 | 2 | 2 | 0 | Y | HNPRLLRVE | 96.88 | HNPRLFRVE | 3.12 | | | | | |
| NS5 | 3149 | 0.2 | 2 | 2 | 0 | Y | NPRLLRVER | 96.88 | NPRLFRVER | 3.12 | | | | | |
| NS5 | 3150 | 0.2 | 2 | 2 | 0 | Y | PRLLRVERW | 96.88 | PRLFRVERW | 3.12 | | | | | |
| NS5 | 3151 | 0.2 | 2 | 2 | 0 | Y | RLLRVERWL | 96.88 | RLFRVERWL | 3.12 | | | | | |
| NS5 | 3152 | 1.16 | 3 | 3 | 0 | Y | LLRVERWLR | 53.12 | LLRVERWLK | 43.75 | LRVERWLR | 3.12 | | | |
| NS5 | 3153 | 1.5 | 5 | 5 | 0 | Y | LRVERWLRD | 46.88 | LRVERWLKE | 43.75 | LRVERWLRE | 3.12 | LRVERWLRN | 3.12 | FRVERWLRD | 3.12 |
| NS5 | 3154 | 1.5 | 5 | 5 | 0 | Y | RVERWLRDH | 46.88 | RVERWLKEH | 43.75 | RVERWLRNH | 3.12 | RVERWLRDY | 3.12 | RVERWLREH | 3.12 |
| NS5 | 3155 | 1.5 | 5 | 5 | 0 | Y | VERWLRDHG | 46.88 | VERWLKEHG | 43.75 | VERWLRDYG | 3.12 | VERWLRNHG | 3.12 | VERWLREHG | 3.12 |
| NS5 | 3161 | 1.5 | 5 | 3 | 0 | Y | DHGEERLGR | 46.88 | EHGEERLGR | 43.75 | EHGGERLGR | 3.12 | NHGEERLGR | 3.12 | DYGEERLGR | 3.12 |
| NS5 | 3162 | 0.4 | 3 | 3 | 0 | Y | HGEERLGRM | 93.75 | YGEERLGRM | 3.12 | HGGERLGRM | 3.12 | | | |
| NS5 | 3163 | 0.2 | 2 | 2 | 0 | Y | GEERLGRML | 96.88 | GGERLGRML | 3.12 | | | | | |
| NS5 | 3164 | 0.2 | 2 | 2 | 0 | Y | EERLGRMLV | 96.88 | GERLGRMLV | 3.12 | | | | | |

Fig. 32-117

Species: TBEV (9-mers)

| protein | block starting position | block entropy | total peptides in block | # peptides required to cover 99% of block | 99% of block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3165 | 0 | 1 | 1 | 0 | Y | ERLGRMLVS | 100 | | | | | | | | |
| NS5 | 3166 | 0 | 1 | 1 | 0 | Y | RLGRMLVSG | 100 | | | | | | | | |
| NS5 | 3167 | 0 | 1 | 1 | 0 | Y | LGRMLVSGD | 100 | | | | | | | | |
| NS5 | 3168 | 0 | 1 | 1 | 0 | Y | GRMLVSGDD | 100 | | | | | | | | |
| NS5 | 3169 | 0 | 1 | 1 | 0 | Y | RMLVSGDDC | 100 | | | | | | | | |
| NS5 | 3170 | 0 | 1 | 1 | 0 | Y | MLVSGDDCV | 100 | | | | | | | | |
| NS5 | 3171 | 0 | 1 | 1 | 0 | Y | LVSGDDCVV | 100 | | | | | | | | |
| NS5 | 3172 | 0 | 1 | 1 | 0 | Y | VSGDDCVVR | 100 | | | | | | | | |
| NS5 | 3173 | 0.2 | 2 | 2 | 0 | Y | SGDDCVVRP | 96.88 | SGDDCVVRG | 3.12 | | | | | | |
| NS5 | 3174 | 1.48 | 4 | 4 | 0 | Y | GDDCVVRPV | 59.38 | GDDCVVRPL | 25 | GDDCVVRPI | 12.5 | GDDCVVRGI | 3.12 | | |
| NS5 | 3175 | 1.48 | 4 | 4 | 0 | Y | DDCVVRPVD | 59.38 | DDCVVRPLD | 25 | DDCVVRPID | 12.5 | DDCVVRGID | 3.12 | | |
| NS5 | 3176 | 1.48 | 4 | 4 | 0 | Y | DCVVRPVDD | 59.38 | DCVVRPLDD | 25 | DCVVRPIDD | 12.5 | DCVVRGIDD | 3.12 | | |
| NS5 | 3177 | 1.48 | 4 | 4 | 0 | Y | CVVRPVDDR | 59.38 | CVVRPLDDR | 25 | CVVRPIDDR | 12.5 | CVVRGIDDR | 3.12 | | |
| NS5 | 3178 | 1.48 | 4 | 4 | 0 | Y | VVRPVDDRF | 59.38 | VVRPLDDRF | 25 | VVRPIDDRF | 12.5 | VVRGIDDRF | 3.12 | | |
| NS5 | 3179 | 1.85 | 5 | 5 | 0 | Y | VRPVDDRFS | 50 | VRPLDDRFG | 25 | VRPIDDRFG | 12.5 | VRPDDDRFG | 9.38 | VRGIDDRFG | 3.12 |
| NS5 | 3183 | 1.91 | 5 | 5 | 0 | Y | DDRFGKALY | 43.75 | DDRFSKALY | 25 | DDRFSRALY | 21.88 | DDRFGRALY | 6.25 | DDRFSGALY | 3.12 |
| NS5 | 3184 | 1.91 | 5 | 5 | 0 | Y | DRFGKALYF | 43.75 | DRFSKALYF | 25 | DRFSRALYF | 21.88 | DRFGRALYF | 6.25 | DRFSGALYF | 3.12 |
| NS5 | 3185 | 1.91 | 5 | 5 | 0 | Y | RFGKALYFL | 43.75 | RFSKALYFL | 25 | RFSRALYFL | 21.88 | RFGRALYFL | 6.25 | RFSGALYFL | 3.12 |
| NS5 | 3186 | 1.91 | 5 | 5 | 0 | Y | FGKALYFLN | 43.75 | FSKALYFLN | 25 | FSRALYFLN | 21.88 | FGRALYFLN | 6.25 | FSGALYFLN | 3.12 |
| NS5 | 3187 | 1.91 | 5 | 5 | 0 | Y | GKALYFLND | 43.75 | SKALYFLND | 25 | SRALYFLND | 21.88 | GRALYFLND | 6.25 | SGALYFLND | 3.12 |
| NS5 | 3188 | 1.04 | 3 | 3 | 0 | Y | KALYFLNDM | 68.75 | RALYFLNDM | 28.12 | GALYFLNDM | 3.12 | | | | |
| NS5 | 3189 | 0 | 1 | 1 | 0 | Y | ALYFLNDMA | 100 | | | | | | | | |
| NS5 | 3190 | 0 | 1 | 1 | 0 | Y | LYFLNDMAK | 100 | | | | | | | | |
| NS5 | 3191 | 0 | 1 | 1 | 0 | Y | YFLNDMAKT | 100 | | | | | | | | |
| NS5 | 3192 | 0 | 1 | 1 | 0 | Y | FLNDMAKTR | 100 | | | | | | | | |

Fig. 32-118

Species: TBEV (9

Fig. 32-119

Species: TBEV (9-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block

Fig. 32-120

Species: TBEV (9-mers)

| protein | block starting position | block entropy | total peptides in block | # peptides required to cover 99% of block | gap/X fraction of block | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3251 | 1 | 3 | 3 | 0 | Y | RVSPGCGWS | 71.88 | RVSPGCGWS | 71.88 | PVSPGCGWS | 3.12 | | |
| NS5 | 3252 | 1 | 3 | 3 | 0 | Y | VSPGCGWSV | 71.88 | VSPGCGWSV | 71.88 | VSPGCGWSI | 3.12 | | |
| NS5 | 3253 | 0.2 | 2 | 2 | 0 | Y | SPGCGWSVR | 96.88 | SPGCGWSIR | 3.12 | | | | |
| NS5 | 3254 | 0.2 | 2 | 2 | 0 | Y | PGCGWSVRE | 96.88 | PGCGWSIRE | 3.12 | | | | |
| NS5 | 3255 | 0.2 | 2 | 2 | 0 | Y | GCGWSVRET | 96.88 | GCGWSIRET | 3.12 | | | | |
| NS5 | 3256 | 0.2 | 2 | 2 | 0 | Y | CGWSVRETA | 96.88 | CGWSIRETA | 3.12 | | | | |
| NS5 | 3257 | 0.2 | 2 | 2 | 0 | Y | GWSVRETAC | 96.88 | GWSIRETAC | 3.12 | | | | |
| NS5 | 3258 | 0.2 | 2 | 2 | 0 | Y | WSVRETACL | 96.88 | WSIRETACL | 3.12 | | | | |
| NS5 | 3259 | 0.2 | 2 | 2 | 0 | Y | SVRETACLS | 96.88 | SIRETACLS | 3.12 | | | | |
| NS5 | 3260 | 0.2 | 2 | 2 | 0 | Y | VRETACLSK | 96.88 | IRETACLSK | 3.12 | | | | |
| NS5 | 3261 | 0 | 1 | 1 | 0 | Y | RETACLSKA | 100 | | | | | | |
| NS5 | 3262 | 0 | 1 | 1 | 0 | Y | ETACLSKAY | 100 | | | | | | |
| NS5 | 3263 | 0 | 1 | 1 | 0 | Y | TACLSKAYG | 100 | | | | | | |
| NS5 | 3264 | 0 | 1 | 1 | 0 | Y | ACLSKAYGQ | 100 | | | | | | |
| NS5 | 3265 | 0 | 1 | 1 | 0 | Y | CLSKAYGQM | 100 | | | | | | |
| NS5 | 3266 | 0 | 1 | 1 | 0 | Y | LSKAYGQMW | 100 | | | | | | |
| NS5 | 3267 | 0 | 1 | 1 | 0 | Y | SKAYGQMWL | 100 | | | | | | |
| NS5 | 3268 | 0 | 1 | 1 | 0 | Y | KAYGQMWLL | 100 | | | | | | |
| NS5 | 3269 | 0 | 1 | 1 | 0 | Y | AYGQMWLLS | 100 | | | | | | |
| NS5 | 3270 | 0 | 1 | 1 | 0 | Y | YGQMWLLSY | 100 | | | | | | |
| NS5 | 3271 | 0 | 1 | 1 | 0 | Y | GQMWLLSYF | 100 | | | | | | |
| NS5 | 3272 | 0 | 1 | 1 | 0 | Y | QMWLLSYFH | 100 | | | | | | |
| NS5 | 3273 | 0 | 1 | 1 | 0 | Y | MWLLSYFHR | 100 | | | | | | |
| NS5 | 3274 | 0 | 1 | 1 | 0 | Y | WLLSYFHRR | 100 | | | | | | |
| NS5 | 3275 | 0 | 1 | 1 | 0 | Y | LLSYFHRRD | 100 | | | | | | |

Fig. 32-121

Species: TBEV (

Fig. 32-122

Species: TBEV (9-mers)

| prot

Fig. 32-123

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3330 | 1.17 | 3 | 3 | 0 | Y | ILDNPFMHS | 50 | ILDNPFMHG | 46.88 | ILDNPFMHG | 3.12 | | |
| NS5 | 3331 | 1.17 | 3 | 3 | 0 | Y | LDNPFMHSK | 50 | LDNPFMQNK | 46.88 | LDNPFMHGK | 3.12 | | |
| NS5 | 3332 | 1.33 | 4 | 4 | 0 | Y | DNPFMHSKE | 50 | DNPFMQNKE | 43.75 | DNPFMQNKG | 3.12 | DNPFMHGKE | 3.12 | |
| NS5 | 3333 | 1.66 | 5 | 5 | 0 | Y | NPFMHSKEK | 50 | NPFMQNKEK | 34.38 | NPFMQNKER | 9.38 | NPFMHGKEK | 3.12 | |
| NS5 | 3344 | 0.95 | 3 | 3 | 0 | Y | EWRDVPYLP | 78.12 | EWRDIPYLP | 15.62 | EWRNVPYLP | 6.25 | | |
| NS5 | 3345 | 0.95 | 3 | 3 | 0 | Y | WRDVPYLPK | 78.12 | WRDIPYLPK | 15.62 | WRNVPYLPK | 6.25 | RNVPYLPKA | 6.25 | |
| NS5 | 3346 | 1.65 | 4 | 4 | 0 | Y | RDVPYLPKS | 53.12 | RDIPYLPKA | 25 | RDIPYLPKA | 15.62 | VPYLPKAHD | 6.25 | |
| NS5 | 3348 | 1.77 | 5 | 5 | 0 | Y | VPYLPKSHD | 53.12 | VPYLPKAQD | 25 | IPYLPKAHD | 12.5 | | | IPYLPKAQD | 3.12 |
| NS5 | 3349 | 1.45 | 3 | 3 | 0 | Y | PYLPKSHDM | 53.12 | PYLPKAQDM | 28.12 | PYLPKAHDM | 18.75 | | |
| NS5 | 3350 | 1.45 | 3 | 3 | 0 | Y | YLPKSHDML | 53.12 | YLPKAQDML | 28.12 | YLPKAHDML | 18.75 | | |
| NS5 | 3351 | 1.45 | 3 | 3 | 0 | Y | LPKSHDMLC | 53.12 | LPKAQDMLC | 28.12 | LPKAHDMLC | 18.75 | | |
| NS5 | 3352 | 1.45 | 3 | 3 | 0 | Y | PKSHDMLCS | 53.12 | PKAQDMLCS | 28.12 | PKAHDMLCS | 18.75 | | |
| NS5 | 3353 | 1.45 | 3 | 3 | 0 | Y | KSHDMLCSS | 53.12 | KAQDMLCSS | 28.12 | KAHDMLCSS | 18.75 | | |
| NS5 | 3354 | 1.45 | 3 | 3 | 0 | Y | SHDMLCSSL | 53.12 | AQDMLCSSL | 28.12 | AHDMLCSSL | 18.75 | | |
| NS5 | 3355 | 0.86 | 2 | 2 | 0 | Y | HDMLCSSLV | 71.88 | QDMLCSSLV | 28.12 | | | |
| NS5 | 3356 | 0 | 1 | 1 | 0 | Y | DMLCSSLVG | 100 | | | | |
| NS5 | 3357 | 0 | 1 | 1 | 0 | Y | MLCSSLVGR | 100 | | | | |
| NS5 | 3358 | 0.64 | 3 | 3 | 0 | Y | LCSSLVGRK | 87.5 | LCSSLVGRR | 9.38 | LCSSLVGRT | 3.12 | | |
| NS5 | 3359 | 0.64 | 3 | 3 | 0 | Y | CSSLVGRKE | 87.5 | CSSLVGRRE | 9.38 | CSSLVGRTE | 3.12 | | |
| NS5 | 3360 | 0.64 | 3 | 3 | 0 | Y | SSLVGRKER | 87.5 | SSLVGRRER | 9.38 | SSLVGRTER | 3.12 | | |
| NS5 | 3361 | 0.64 | 3 | 3 | 0 | Y | SLVGRKERA | 87.5 | SLVGRRERA | 9.38 | SLVGRTERA | 3.12 | | |
| NS5 | 3362 | 0.64 | 3 | 3 | 0 | Y | LVGRKERAE | 87.5 | LVGRRERAE | 9.38 | LVGRTERAE | 3.12 | | |
| NS5 | 3363 | 0.64 | 3 | 3 | 0 | Y | VGRKERAEW | 87.5 | VGRRERAEW | 9.38 | VGRTERAEW | 3.12 | | |
| NS5 | 3364 | 0.64 | 3 | 3 | 0 | Y | GRKERAEWA | 87.5 | GRRERAEWA | 9.38 | GRTERAEWA | 3.12 | | |
| NS5 | 3365 | 0.97 | 4 | 4 | 0 | Y | RKERAEWAK | 81.25 | RRERAEWAK | 9.38 | RKERAEWAK | 6.25 | RTERAEWAK | 3.12 | |

Fig. 32-124

Species: TBEV (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | fr

Fig. 32-125

Species: TBEV (9-mers)

| protein | block starting position | block entropy | total peptides in block | #

Species: TBEV (10-mers)

Fig. 33-1

| protein | block starting position | block entropy | total peptides in block | # peptides required to cover 99% of block | gap/X fraction | 99% of block covered w/ => 5 peptides? | peptide required to cover 99% of block | frequency | peptide required to cover 99% of block | frequency | peptide required to cover 99% of block | frequency | peptide required to cover 99% of block | frequency | peptide required to cover 99% of block | frequency |
|---|---|---|---|---|---|---|

Fig. 33-2

Species: TBEV (10-mers)

| protein | block starting position | block entropy | total peptides in block | # peptides required to cover 99% of block | gap/X fraction | 99% of block covered w/

Fig. 33-3

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

Fig. 33-4

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to c

Fig. 33-5

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 128 | 0.2 | 2 | 2 | 0 | Y | VIRAEGKDAA | 96.88 | VIRAEGKDAA | 3.12 | | | | |
| prM | 129 | 0.2 | 2 | 2 | 0 | Y | IRAEGKDAAT | 96.88 | IRAEGKDAAT | 3.12 | | | | |
| prM | 130 | 0.2 | 2 | 2 | 0 | Y | RAEGKDAATQ | 96.88 | RAEGKDAATQ | 3.12 | | | | |
| prM | 131 | 0.2 | 2 | 2 | 0 | Y | AEGKDAATQV | 96.88 | AEGKDAATQV | 3.12 | | | | |
| prM | 132 | 0.2 | 2 | 2 | 0 | Y | EGKDAATQVR | 96.88 | EGKDAATQVR | 3.12 | | | | |
| prM | 133 | 0.2 | 2 | 2 | 0 | Y | GKDAATQVRV | 96.88 | GRDAATQVRV | 3.12 | | | | |
| prM | 134 | 0.2 | 2 | 2 | 0 | Y | KDAATQVRVE | 96.88 | RDAATQVRVE | 3.12 | | | | |
| prM | 135 | 0 | 1 | 1 | 0 | Y | DAATQVRVEN | 100 | | | | | | |
| prM | 136 | 0 | 1 | 1 | 0 | Y | AATQVRVENG | 100 | | | | | | |
| prM | 137 | 0 | 1 | 1 | 0 | Y | ATQVRVENGT | 100 | | | | | | |
| prM | 138 | 0 | 1 | 1 | 0 | Y | TQVRVENGTC | 100 | | | | | | |
| prM | 139 | 0 | 1 | 1 | 0 | Y | QVRVENGTCV | 100 | | | | | | |
| prM | 140 | 0 | 1 | 1 | 0 | Y | VRVENGTCVI | 100 | | | | | | |
| prM | 141 | 0.2 | 2 | 2 | 0 | Y | RVENGTCVIL | 96.88 | RVENGTCVIM | 3.12 | VENGTCVIMA | 3.12 | | |
| prM | 142 | 0.64 | 3 | 3 | 0 | Y | VENGTCVILA | 87.5 | VENGTCVILV | 9.38 | ENGTCVIMAT | 3.12 | | |
| prM | 143 | 0.64 | 3 | 3 | 0 | Y | ENGTCVILAT | 87.5 | ENGTCVILVT | 9.38 | NGTCVIMATD | 3.12 | | |
| prM | 144 | 0.64 | 3 | 3 | 0 | Y | NGTCVILATD | 87.5 | NGTCVILVTD | 9.38 | GTCVIMATDM | 3.12 | | |
| prM | 145 | 0.64 | 3 | 3 | 0 | Y | GTCVILATDM | 87.5 | GTCVILVTDM | 9.38 | TCVIMATDMG | 3.12 | | |
| prM | 146 | 0.64 | 3 | 3 | 0 | Y | TCVILATDMG | 87.5 | TCVILVTDMG | 9.38 | CVILATDMGA | 3.12 | | |
| prM | 147 | 0.84 | 4 | 4 | 0 | Y | CVILATDMGS | 84.38 | CVILVTDMGS | 9.38 | VILATDMGAW | 3.12 | CVIMATDMGS | 3.12 |
| prM | 148 | 0.84 | 4 | 4 | 0 | Y | VILATDMGSW | 84.38 | VILVTDMGSW | 9.38 | ILATDMGAWC | 3.12 | VIMATDMGSW | 3.12 |
| prM | 149 | 0.84 | 4 | 4 | 0 | Y | ILATDMGSWC | 84.38 | ILVTDMGSWC | 9.38 | IMATDMGSWC | 3.12 | ILATDMGAWC | 3.12 |
| prM | 150 | 0.84 | 4 | 4 | 0 | Y | LATDMGSWCD | 84.38 | LVTDMGSWCD | 9.38 | LATDMGAWCD | 3.12 | MATDMGSWCD | 3.12 |
| prM | 151 | 0.64 | 3 | 3 | 0 | Y | ATDMGSWCDD | 87.5 | VTDMGSWCDD | 9.38 | ATDMGAWCDD | 3.12 | | |

Fig. 33-6

Species: TBEV (10-mers)

| protein | block starting position | block entropy | total peptides in block | # peptides required to cover 99% of block | gap/x fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 152 | 0.2 | 2 | 2 | 0 | Y | TDMGSWCDDS | 96.88 | TDMGAWCDDS | 3.12 | | | | |
| prM | 153 | 0.2 | 2 | 2 | 0 | Y | DMGSWCDDSL | 96.88 | DMGAWCDDSL | 3.12 | | | | |
| prM | 154 | 1.15 | 3 | 3 | 0 | Y | MGSWCDDSLT | 56.25 | MGSWCDDSLS | 40.62 | MGAWCDDSLS | 3.12 | | |
| prM | 155 | 1.15 | 3 | 3 | 0 | Y | GSWCDDSLTY | 56.25 | GSWCDDSLSY | 40.62 | GAWCDDSLSY | 3.12 | | |
| prM | 156 | 1.15 | 3 | 3 | 0 | Y | SWCDDSLTYE | 56.25 | SWCDDSLSYE | 40.62 | AWCDDSLSYE | 3.12 | | |
| prM | 157 | 0.99 | 2 | 2 | 0 | Y | WCDDSLTYEC | 56.25 | WCDDSLSYEC | 43.75 | | | | |
| prM | 158 | 0.99 | 2 | 2 | 0 | Y | CDDSLTYECV | 56.25 | CDDSLSYECV | 43.75 | | | | |
| prM | 159 | 0.99 | 2 | 2 | 0 | Y | DDSLTYECVT | 56.25 | DDSLSYECVT | 43.75 | | | | |
| prM | 160 | 0.99 | 2 | 2 | 0 | Y | DSLTYECVTI | 56.25 | DSLSYECVTI | 43.75 | | | | |
| prM | 161 | 0.99 | 2 | 2 | 0 | Y | SLTYECVTID | 56.25 | SLSYECVTID | 43.75 | | | | |
| prM | 162 | 0.99 | 2 | 2 | 0 | Y | LTYECVTIDQ | 56.25 | LSYECVTIDQ | 43.75 | | | | |
| prM | 163 | 0.99 | 2 | 2 | 0 | Y | TYECVTIDQG | 56.25 | SYECVTIDQG | 43.75 | | | | |
| prM | 164 | 0 | 1 | 1 | 0 | Y | YECVTIDQGE | 100 | | | | | | |
| prM | 165 | 0 | 1 | 1 | 0 | Y | ECVTIDQGEE | 100 | | | | | | |
| prM | 166 | 0 | 1 | 1 | 0 | Y | CVTIDQGEEP | 100 | | | | | | |
| prM | 167 | 0 | 1 | 1 | 0 | Y | VTIDQGEEPV | 100 | | | | | | |
| prM | 168 | 0 | 1 | 1 | 0 | Y | TIDQGEEPVD | 100 | | | | | | |
| prM | 169 | 0 | 1 | 1 | 0 | Y | IDQGEEPVDV | 100 | | | | | | |
| prM | 170 | 0 | 1 | 1 | 0 | Y | DQGEEPVDVD | 100 | | | | | | |
| prM | 171 | 0 | 1 | 1 | 0 | Y | QGEEPVDVDC | 100 | | | | | | |
| prM | 172 | 0 | 1 | 1 | 0 | Y | GEEPVDVDCF | 100 | | | | | | |
| prM | 173 | 0 | 1 | 1 | 0 | Y | EEPVDVDCFC | 100 | | | | | | |
| prM | 174 | 0 | 1 | 1 | 0 | Y | EPVDVDCFCR | 100 | | | | | | |
| prM | 175 | 0 | 1 | 1 | 0 | Y | PVDVDCFCRN | 100 | | | | | | |

Fig. 33-7

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 176 | 0 | 1 | 1 | 0 | Y | VDVDCFCRNV | 100 | | | | | | |
| prM | 177 | 0 | 1 | 1 | 0 | Y | DVDCFCRNVD | 100 | | | | | | |
| prM | 178 | 0.2 | 2 | 2 | 0 | Y | VDCFCRNVDG | 96.88 | VDCFCRNVDR | 3.12 | | | | |
| prM | 179 | 0.2 | 2 | 2 | 0 | Y | DCFCRNVDGV | 96.88 | DCFCRNVDRV | 3.12 | | | | |
| prM | 180 | 0.53 | 3 | 3 | 0 | Y | CFCRNVDGVY | 90.62 | CFCRNVDGVH | 6.25 | CFCRNVDRVY | 3.12 | | |
| prM | 181 | 0.53 | 3 | 3 | 0 | Y | FCRNVDGVYL | 90.62 | FCRNVDGVHL | 6.25 | FCRNVDRVYL | 3.12 | | |
| prM | 182 | 0.53 | 3 | 3 | 0 | Y | CRNVDGVYLE | 90.62 | CRNVDGVHLE | 6.25 | CRNVDRVYLE | 3.12 | | |
| prM | 183 | 0.53 | 3 | 3 | 0 | Y | RNVDGVYLEY | 90.62 | RNVDGVHLEY | 6.25 | RNVDRVYLEY | 3.12 | | |
| prM | 184 | 0.53 | 3 | 3 | 0 | Y | NVDGVYLEYG | 90.62 | NVDGVHLEYG | 6.25 | NVDRVYLEYG | 3.12 | | |
| prM | 185 | 0.53 | 3 | 3 | 0 | Y | VDGVYLEYGR | 90.62 | VDGVHLEYGR | 6.25 | VDRVYLEYGR | 3.12 | | |
| prM | 186 | 0.53 | 3 | 3 | 0 | Y | DGVYLEYGRC | 90.62 | DGVHLEYGRC | 6.25 | DRVYLEYGRC | 3.12 | | |
| prM | 187 | 0.53 | 3 | 3 | 0 | Y | GVYLEYGRCG | 90.62 | GVHLEYGRCG | 6.25 | RVYLEYGRCG | 3.12 | | |
| prM | 188 | 0.34 | 2 | 2 | 0 | Y | VYLEYGRCGK | 93.75 | VHLEYGRCGK | 6.25 | | | | |
| prM | 189 | 0.34 | 2 | 2 | 0 | Y | YLEYGRCGKQ | 93.75 | HLEYGRCGKQ | 6.25 | | | | |
| prM | 190 | 0 | 1 | 1 | 0 | Y | LEYGRCGKQE | 100 | | | | | | |
| prM | 191 | 0 | 1 | 1 | 0 | Y | EYGRCGKQEG | 100 | | | | | | |
| prM | 192 | 0 | 1 | 1 | 0 | Y | YGRCGKQEGS | 100 | | | | | | |
| prM | 193 | 0 | 1 | 1 | 0 | Y | GRCGKQEGSR | 100 | | | | | | |
| prM | 194 | 0 | 1 | 1 | 0 | Y | RCGKQEGSRT | 100 | | | | | | |
| prM | 195 | 0 | 1 | 1 | 0 | Y | CGKQEGSRTR | 100 | | | | | | |
| prM | 196 | 0 | 1 | 1 | 0 | Y | GKQEGSRTRR | 100 | | | | | | |
| prM | 197 | 0 | 1 | 1 | 0 | Y | KQEGSRTRRS | 100 | | | | | | |
| prM | 198 | 0 | 1 | 1 | 0 | Y | QEGSRTRRSV | 100 | | | | | | |
| prM | 199 | 0 | 1 | 1 | 0 | Y | EGSRTRRSVL | 100 | | | | | | |

Fig. 33-8

Species: TBEV (10-mers)

| protein | block starting position | block

Fig. 33-9

Species: TBEV (

Fig. 33-10

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency |
|---|---|---|---|---

Fig. 33-11

Species: TBEV (

Fig. 33-12

Species: TBEV (10-mers)

| protein | block starting position |

Fig. 33-13

Species: TBEV (10-mers)

| protein | block starting position | block

Fig. 33-14

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 33-15

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

Fig. 33-16

Species: TBEV (10-mers)

| protein | block starting position | block

Fig. 33-17

Species: TBEV (10-mers)

| prot

Fig. 33-18

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 469 | 0.2 | 2 | 2 | 0 | Y | ASGVDLAQTV | 96.88 | PSGVDLAQTV | 3.12 | | | | |
| E | 470 | 0 | 1 | 1 | 0 | Y | SGVDLAQTVI | 100 | | | | | | |
| E | 471 | 0 | 1 | 1 | 0 | Y | GVDLAQTVIL | 100 | | | | | | |
| E | 472 | 0 | 1 | 1 | 0 | Y | VDLAQTVILE | 100 | | | | | | |
| E | 473 | 0 | 1 | 1 | 0 | Y | DLAQTVILEL | 100 | | | | | | |
| E | 474 | 0 | 1 | 1 | 0 | Y | LAQTVILELD | 100 | | | | | | |
| E | 475 | 0 | 1 | 1 | 0 | Y | AQTVILELDK | 100 | | | | | | |
| E | 476 | 0 | 1 | 1 | 0 | Y | QTVILELDKT | 100 | | | | | | |
| E | 477 | 1.42 | 3 | 3 | 0 | Y | TVILELDKTS | 56.25 | TVILELDKTV | 25.00 | TVILELDKTL | 18.75 | | |
| E | 478 | 1.42 | 3 | 3 | 0 | Y | VILELDKTSE | 56.25 | VILELDKTVE | 25.00 | VILELDKTLE | 18.75 | | |
| E | 479 | 1.42 | 3 | 3 | 0 | Y | ILELDKTSEH | 56.25 | ILELDKTVEH | 25.00 | ILELDKTLEH | 18.75 | | |
| E | 480 | 1.42 | 3 | 3 | 0 | Y | LELDKTSEHL | 56.25 | LELDKTVEHL | 25.00 | LELDKTLEHL | 18.75 | | |
| E | 481 | 1.42 | 3 | 3 | 0 | Y | ELDKTSEHLP | 56.25 | ELDKTVEHLP | 25.00 | ELDKTLEHLP | 18.75 | | |
| E | 482 | 1.42 | 3 | 3 | 0 | Y | LDKTSEHLPT | 56.25 | LDKTVEHLPT | 25.00 | LDKTLEHLPT | 18.75 | | |
| E | 483 | 1.42 | 3 | 3 | 0 | Y | DKTSEHLPTA | 56.25 | DKTVEHLPTA | 25.00 | DKTLEHLPTA | 18.75 | | |
| E | 484 | 1.42 | 3 | 3 | 0 | Y | KTSEHLPTAW | 56.25 | KTVEHLPTAW | 25.00 | KTLEHLPTAW | 18.75 | | |
| E | 485 | 1.42 | 3 | 3 | 0 | Y | TSEHLPTAWQ | 56.25 | TVEHLPTAWQ | 25.00 | TLEHLPTAWQ | 18.75 | | |
| E | 486 | 1.42 | 3 | 3 | 0 | Y | SEHLPTAWQV | 56.25 | VEHLPTAWQV | 25.00 | LEHLPTAWQV | 18.75 | | |
| E | 487 | 0.2 | 2 | 2 | 0 | Y | EHLPTAWQVH | 96.88 | EHLPTAWQVR | 3.12 | | | | |
| E | 488 | 0.2 | 2 | 2 | 0 | Y | HLPTAWQVHR | 96.88 | HLPTAWQVRR | 3.12 | | | | |
| E | 489 | 0.2 | 2 | 2 | 0 | Y | LPTAWQVHRD | 96.88 | LPTAWQVRRD | 3.12 | | | | |
| E | 490 | 0.2 | 2 | 2 | 0 | Y | PTAWQVHRDW | 96.88 | PTAWQVRRDW | 3.12 | | | | |
| E | 491 | 0.2 | 2 | 2 | 0 | Y | TAWQVHRDWF | 96.88 | TAWQVRRDWF | 3.12 | | | | |
| E | 492 | 0.2 | 2 | 2 | 0 | Y | AWQVHRDWFN | 96.88 | AWQVRRDWFN | 3.12 | | | | |

Fig. 33-19

Species: TBEV (10-mers)

| protein | block starting position | block entropy | total peptides in block | # peptides required to cover 99% of block | gap/X fraction | 99% of block covered w

Fig. 33-20

Species: TBEV (10-mers)

| protein | block starting position | block entropy | total

Fig. 33-21

Species: TBEV (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99%

Fig. 33-22

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 569 | 0 | 1 | 1 | 0 | Y | TCEVGLEKLK | 100 | | | | | | |
| E | 570 | 0 | 1 | 1 | 0 | Y | CEVGLEKLKM | 100 | | | | | | |
| E | 571 | 0.2 | 2 | 2 | 0 | Y | EVGLEKLKMK | 96.88 | EVGLEKLKMN | 3.12 | | | | |
| E | 572 | 0.2 | 2 | 2 | 0 | Y | VGLEKLKMKG | 96.88 | VGLEKLKMNG | 3.12 | | | | |
| E | 573 | 0.2 | 2 | 2 | 0 | Y | GLEKLKMKGL | 96.88 | GLEKLKMNGL | 3.12 | | | | |
| E | 574 | 0.2 | 2 | 2 | 0 | Y | LEKLKMKGLT | 96.88 | LEKLKMNGLT | 3.12 | | | | |
| E | 575 | 0.2 | 2 | 2 | 0 | Y | EKLKMKGLTY | 96.88 | EKLKMNGLTY | 3.12 | | | | |
| E | 576 | 0.2 | 2 | 2 | 0 | Y | KLKMKGLTYT | 96.88 | KLKMNGLTYT | 3.12 | | | | |
| E | 577 | 0.53 | 3 | 3 | 0 | Y | LKMKGLTYTM | 90.62 | LKMNGLTYTM | 3.12 | | | | |
| E | 578 | 0.53 | 3 | 3 | 0 | Y | KMKGLTYTMC | 90.62 | KMNGLTYTMC | 3.12 | | | | |
| E | 579 | 0.53 | 3 | 3 | 0 | Y | MKGLTYTMCD | 90.62 | MNGLTYTMCD | 3.12 | | | | |
| E | 580 | 0.53 | 3 | 3 | 0 | Y | KGLTYTMCDK | 90.62 | NGLTYTMCDK | 3.12 | | | | |
| E | 581 | 0.34 | 2 | 2 | 0 | Y | GLTYTMCDKT | 93.75 | YTVCDKTKFT | 6.25 | | | | |
| E | 582 | 0.34 | 2 | 2 | 0 | Y | LTYTMCDKTK | 93.75 | TVCDKTKFTW | 6.25 | | | | |
| E | 583 | 0.34 | 2 | 2 | 0 | Y | TYTMCDKTKF | 93.75 | VCDKTKFTWK | 6.25 | | | | |
| E | 584 | 0.87 | 3 | 3 | 0 | Y | YTMCDKTKFT | 81.25 | YTMCDKTKFA | 12.50 | CDKTKFTWRR | 3.12 | | | |
| E | 585 | 0.87 | 3 | 3 | 0 | Y | TMCDKTKFTW | 81.25 | TMCDKTKFAW | 12.50 | | | | |
| E | 586 | 1.06 | 4 | 4 | 0 | Y | MCDKTKFTWK | 78.12 | MCDKTKFAWK | 12.50 | MCDKTKFTWR | 3.12 | | | |
| E | 587 | 0.74 | 3 | 3 | 0 | Y | CDKTKFTWKR | 84.38 | CDKTKFAWKR | 12.50 | | | | |
| E | 588 | 1.85 | 5 | 5 | 0 | Y | DKTKFTWKRI | 50 | DKTKFAWKRT | 25.00 | DKTKFTWKRT | 12.50 | DKTKFTWRRT | 3.12 |
| E | 589 | 1.85 | 5 | 5 | 0 | Y | KTKFTWKRIP | 50 | KTKFAWKRTP | 25.00 | KTKFTWKRTP | 12.50 | KTKFTWRRTP | 3.12 |
| E | 590 | 1.85 | 5 | 5 | 0 | Y | TKFTWKRIPT | 50 | TKFAWKRTPT | 25.00 | TKFTWKRTPT | 12.50 | TKFTWRRTPT | 3.12 |
| E | 591 | 1.85 | 5 | 5 | 0 | Y | KFTWKRIPTD | 50 | KFAWKRTPTD | 25.00 | KFTWKRTPTD | 12.50 | KFTWRRTPTD | 3.12 |
| E | 592 | 1.85 | 5 | 5 | 0 | Y | FTWKRIPTDS | 50 | FAWKRTPTDS | 25.00 | FTWKRTPTDS | 12.50 | FTWRRTPTDS | 3.12 |

Fig. 33-23

Species: TBEV (10-mers)

| protein

Fig. 33-24

Species: TBEV (10

Fig. 33-25

Species: TBEV (10-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency |
|---|---|---|---|---|---|---|---|---|---|---|
| E | 641 | 0.45 | 2 | 2 | 0 | Y | NPTIENNGGG | 90.62 | NPTIETNGGG | 9.38 |
| E | 642 | 0.45 | 2 | 2 | 0 | Y | PTIENNGGGF | 90.62 | PTIETNGGGF | 9.38 |
| E | 643 | 0.45 | 2 | 2 | 0 | Y | TIENNGGGFI | 90.62 | TIETNGGGFI | 9.38 |
| E | 644 | 0.45 | 2 | 2 | 0 | Y | IENNGGGFIE | 90.62 | IETNGGGFIE | 9.38 |
| E | 645 | 0.45 | 2 | 2 | 0 | Y | ENNGGGFIEM | 90.62 | ETNGGGFIEM | 9.38 |
| E | 646 | 0.45 | 2 | 2 | 0 | Y | NNGGGFIEMQ | 90.62 | TNGGGFIEMQ | 9.38 |
| E | 647 | 0 | 1 | 1 | 0 | Y | NGGGFIEMQL | 100 | | |
| E | 648 | 0 | 1 | 1 | 0 | Y | GGGFIEMQLP | 100 | | |
| E | 649 | 0 | 1 | 1 | 0 | Y | GGFIEMQLPP | 100 | | |
| E | 650 | 0 | 1 | 1 | 0 | Y | GFIEMQLPPG | 100 | | |
| E | 651 | 0 | 1 | 1 | 0 | Y | FIEMQLPPGD | 100 | | |
| E | 652 | 0 | 1 | 1 | 0 | Y | IEMQLPPGDN | 100 | | |
| E | 653 | 0 | 1 | 1 | 0 | Y | EMQLPPGDNI | 100 | | |
| E | 654 | 0 | 1 | 1 | 0 | Y | MQLPPGDNII | 100 | | |
| E | 655 | 0 | 1 | 1 | 0 | Y | QLPPGDNIIY | 100 | | |
| E | 656 | 0 | 1 | 1 | 0 | Y | LPPGDNIIYV | 100 | | |
| E | 657 | 0 | 1 | 1 | 0 | Y | PPGDNIIYVG | 100 | | |
| E | 658 | 0 | 1 | 1 | 0 | Y | PGDNIIYVGE | 100 | | |
| E | 659 | 0 | 1 | 1 | 0 | Y | GDNIIYVGEL | 100 | | |
| E | 660 | 0 | 1 | 1 | 0 | Y | DNIIYVGELS | 100 | | |
| E | 661 | 0.2 | 2 | 2 | 0 | Y | NIIYVGELSH | 96.88 | NIIYVGELSY | 3.12 |
| E | 662 | 0.2 | 2 | 2 | 0 | Y | IIYVGELSHQ | 96.88 | IIYVGELSYQ | 3.12 |
| E | 663 | 0.2 | 2 | 2 | 0 | Y | IYVGELSHQW | 96.88 | IYVGELSYQW | 3.12 |
| E | 664 | 0.2 | 2 | 2 | 0 | Y | YVGELSHQWF | 96.88 | YVGELSYQWF | 3.12 |

Fig. 33-26

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 665 | 0.2 | 2 | 2 | 0 | Y | VGELSHQWFQ | 96.88 | VGELSYQWFQ | 3.12 | | | | |
| E | 666 | 0.2 | 2 | 2 | 0 | Y | GELSHQWFQK | 96.88 | GELSYQWFQK | 3.12 | | | | |
| E | 667 | 0.2 | 2 | 2 | 0 | Y | ELSHQWFQKG | 96.88 | ELSYQWFQKG | 3.12 | | | | |
| E | 668 | 0.2 | 2 | 2 | 0 | Y | LSHQWFQKGS | 96.88 | LSYQWFQKGS | 3.12 | | | | |
| E | 669 | 0.2 | 2 | 2 | 0 | Y | SHQWFQKGSS | 96.88 | SYQWFQKGSS | 3.12 | | | | |
| E | 670 | 0.2 | 2 | 2 | 0 | Y | HQWFQKGSSI | 96.88 | YQWFQKGSSI | 3.12 | | | | |
| E | 671 | 0 | 1 | 1 | 0 | Y | QWFQKGSSIG | 100 | | | | | | |
| E | 672 | 0 | 1 | 1 | 0 | Y | WFQKGSSIGR | 100 | | | | | | |
| E | 673 | 0 | 1 | 1 | 0 | Y | FQKGSSIGRV | 100 | | | | | | |
| E | 674 | 0 | 1 | 1 | 0 | Y | QKGSSIGRVF | 100 | | | | | | |
| E | 675 | 0 | 1 | 1 | 0 | Y | KGSSIGRVFQ | 100 | | | | | | |
| E | 676 | 0 | 1 | 1 | 0 | Y | GSSIGRVFQK | 100 | | | | | | |
| E | 677 | 0 | 1 | 1 | 0 | Y | SSIGRVFQKT | 100 | | | | | | |
| E | 678 | 0.81 | 2 | 2 | 0 | Y | SIGRVFQKTR | 75 | SIGRVFQKTK | 25.00 | | | | |
| E | 679 | — | 3 | 3 | 0 | Y | IGRVFQKTRK | 71.88 | IGRVFQKTKK | 25.00 | IGRVFQKTRR | 3.12 | | |
| E | 680 | — | 3 | 3 | 0 | Y | GRVFQKTRKG | 71.88 | GRVFQKTKKG | 25.00 | GRVFQKTRRG | 3.12 | | |
| E | 681 | — | 3 | 3 | 0 | Y | RVFQKTRKGI | 71.88 | RVFQKTKKGI | 25.00 | RVFQKTRRGI | 3.12 | | |
| E | 682 | — | 3 | 3 | 0 | Y | VFQKTRKGIE | 71.88 | VFQKTKKGIE | 25.00 | VFQKTRRGIE | 3.12 | | |
| E | 683 | — | 3 | 3 | 0 | Y | FQKTRKGIER | 71.88 | FQKTKKGIER | 25.00 | FQKTRRGIER | 3.12 | | |
| E | 684 | — | 3 | 3 | 0 | Y | QKTRKGIERL | 71.88 | QKTKKGIERL | 25.00 | QKTRRGIERL | 3.12 | | |
| E | 685 | — | 3 | 3 | 0 | Y | KTRKGIERLT | 71.88 | KTKKGIERLT | 25.00 | KTRRGIERLT | 3.12 | | |
| E | 686 | — | 3 | 3 | 0 | Y | TRKGIERLTV | 71.88 | TKKGIERLTV | 25.00 | TRRGIERLTV | 3.12 | | |
| E | 687 | — | 3 | 3 | 0 | Y | RKGIERLTVI | 71.88 | KKGIERLTVI | 25.00 | RRGIERLTVI | 3.12 | | |
| E | 688 | 0.2 | 2 | 2 | 0 | Y | KGIERLTVIG | 96.88 | RGIERLTVIG | 3.12 | | | | |

Fig. 33-27

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 689 | 0 | 1 | 1 | 0 | Y | GIERLT

Fig. 33-28

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

Fig. 33-29

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block

Fig. 33-30

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

Fig. 33-31

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99

Fig. 33-32

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 817 | 0.4 | 3 | 3 | 0 | Y | ALASAIKETF | 93.75 | ALASAIKEAF | 3.12 | ALASAIRETF | 3.12 | | | | |
| NS1 | 818 | 0.4 | 3 | 3 | 0 | Y | LASAIKETFE | 93.75 | LASAIRETFE | 3.12 | LASAIKEAFE | 3.12 | | | | |
| NS1 | 819 | 0.4 | 3 | 3 | 0 | Y | ASAIKETFEE | 93.75 | ASAIRETFEE | 3.12 | ASAIKEAFEE | 3.12 | | | | |
| NS1 | 820 | 0.4 | 3 | 5 | 0 | Y | SAIKETFEEG | 93.75 | SAIRETFEEG | 3.12 | SAIKEAFEEG | 3.12 | | | | |
| NS1 | 821 | 1.77 | 5 | 5 | 0 | Y | AIKETFEEGS | 50 | AIKETFEEGN | 25.00 | AIKEAFEEGN | 18.75 | AIKEAFEEGT | 3.12 | AIRETFEEGT | 3.12 |
| NS1 | 822 | 1.77 | 5 | 5 | 0 | Y | IKETFEEGSC | 50 | IKETFEEGNC | 25.00 | IKEAFEEGNC | 18.75 | IKEAFEEGTC | 3.12 | IRETFEEGTC | 3.12 |
| NS1 | 823 | 1.77 | 5 | 5 | 0 | Y | KETFEEGSCG | 50 | KETFEEGNCG | 25.00 | KEAFEEGNCG | 18.75 | KEAFEEGTCG | 3.12 | RETFEEGTCG | 3.12 |
| NS1 | 824 | 1.59 | 4 | 4 | 0 | Y | ETFEEGSCGV | 53.12 | ETFEEGNCGI | 25.00 | EAFEEGTCGI | 18.75 | EAFEEGTCGI | 3.12 | | |
| NS1 | 825 | 1.77 | 5 | 5 | 0 | Y | TFEEGSCGVV | 50 | TFEEGNCGIV | 25.00 | AFEEGTCGIV | 18.75 | AFEEGTCGIV | 3.12 | TFEEGTCGIL | 3.12 |
| NS1 | 826 | 1.59 | 4 | 4 | 0 | Y | FEEGSCGVVP | 53.12 | FEEGNCGIVP | 25.00 | FEEGTCGILP | 18.75 | FEEGTCGILP | 3.12 | | |
| NS1 | 827 | 1.59 | 4 | 4 | 0 | Y | EEGSCGVPQ | 53.12 | EEGNCGIVPQ | 25.00 | EGTCGILPQ | 18.75 | EGTCGILPQ | 3.12 | | |
| NS1 | 828 | 1.59 | 4 | 4 | 0 | Y | EGSCGVPQN | 53.12 | EGNCGIVPQN | 25.00 | EGTCGILPQN | 18.75 | EGTCGILPQN | 3.12 | | |
| NS1 | 829 | 1.59 | 4 | 4 | 0 | Y | GSCGVPQNR | 53.12 | GNCGIVPQNR | 25.00 | GTCGILPQNR | 18.75 | GTCGILPQNR | 3.12 | | |
| NS1 | 830 | 1.59 | 4 | 4 | 0 | Y | SCGVPQNRL | 53.12 | NCGIVPQNRL | 25.00 | TCGILPQNRL | 18.75 | TCGILPQNRL | 3.12 | | |
| NS1 | 831 | | 3 | 3 | 0 | Y | CGVPQNRLE | 71.88 | CGILPQNRLE | 25.00 | CGILPQNRLE | 3.12 | | | | |
| NS1 | 832 | | 3 | 3 | 0 | Y | GVPQNRLEM | 71.88 | GILPQNRLEM | 25.00 | GILPQNRLEM | 3.12 | | | | |
| NS1 | 833 | | 3 | 3 | 0 | Y | VPQNRLEMA | 71.88 | ILPQNRLEMA | 25.00 | ILPQNRLEMA | 3.12 | | | | |
| NS1 | 834 | 0.2 | 2 | 2 | 0 | Y | VPQNRLEMAM | 96.88 | LPQNRLEMAM | 3.12 | | | | | | |
| NS1 | 835 | 0 | 1 | 1 | 0 | Y | PQNRLEMAMW | 100 | | | | | | | | |
| NS1 | 836 | 0 | 1 | 1 | 0 | Y | QNRLEMAMWR | 100 | | | | | | | | |
| NS1 | 837 | 0 | 1 | 1 | 0 | Y | NRLEMAMWRS | 100 | | | | | | | | |
| NS1 | 838 | 0.63 | 2 | 2 | 0 | Y | RLEMAMWRSS | 84.38 | RLEMAMWRSA | 15.62 | | | | | | |
| NS1 | 839 | 1.69 | 5 | 5 | 0 | Y | LEMAMWRSSA | 53.12 | LEMAMWRSSY | 28.12 | LEMAMWRSAV | 12.50 | LEMAMWRSSS | 3.12 | LEMAMWRSAA | 3.12 |
| NS1 | 840 | 1.69 | 5 | 5 | 0 | Y | EMAMWRSSAT | 53.12 | EMAMWRSSVT | 28.12 | EMAMWRSAVT | 12.50 | EMAMWRSSST | 3.12 | EMAMWRSAAT | 3.12 |

Fig. 33-33

Species: TBEV (10-mers)

| protein | block star

Species: TBEV (10-mers)

| protein | block

Fig. 33-36

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 33-37

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 33-38

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 979 | 1.94 | 5 | 5 | 0 | Y | KSVRNDTGTY | 50 | RSMKNDTGTY | 18.75 | KSVKNDTGTY | 15.62 | KSMKNDTGTY | 9.38 | KSVRNETGTY | 6.25 |
| NS1 | 980 | 1.68 | 4 | 4 | 0 | Y | SVRNDTGTYI | 50 | SMKNDTGTYI | 28.12 | SVKNDTGTYI | 15.62 | SVRNETGTYI | 6.25 | | |
| NS1 | 981 | 1.68 | 4 | 4 | 0 | Y | VRNDTGTYIV | 50 | MKNDTGTYIV | 28.12 | VKNDTGTYIV | 15.62 | VRNETGTYIV | 6.25 | | |
| NS1 | 982 | 1.27 | 3 | 3 | 0 | Y | RNDTGTYIVE | 50 | KNDTGTYIVE | 43.75 | RNETGTYIVE | 6.25 | | | | |
| NS1 | 983 | 0.34 | 2 | 2 | 0 | Y | NDTGTYIVEL | 93.75 | NETGTYIVEL | 6.25 | | | | | | |
| NS1 | 984 | 0.34 | 2 | 2 | 0 | Y | DTGTYIVELL | 93.75 | ETGTYIVELL | 6.25 | | | | | | |
| NS1 | 985 | 0 | 1 | 1 | 0 | Y | TGTYIVELLV | 100 | | | | | | | | |
| NS1 | 986 | 0 | 1 | 1 | 0 | Y | GTYIVELLVT | 100 | | | | | | | | |
| NS1 | 987 | 0 | 1 | 1 | 0 | Y | TYIVELLVTD | 100 | | | | | | | | |
| NS1 | 988 | 0 | 1 | 1 | 0 | Y | YIVELLVTDL | 100 | | | | | | | | |
| NS1 | 989 | 0 | 1 | 1 | 0 | Y | IVELLVTDLR | 100 | | | | | | | | |
| NS1 | 990 | 0 | 1 | 1 | 0 | Y | VELLVTDLRN | 100 | | | | | | | | |
| NS1 | 991 | 0 | 1 | 1 | 0 | Y | ELLVTDLRNC | 100 | | | | | | | | |
| NS1 | 992 | 0 | 1 | 1 | 0 | Y | LLVTDLRNCS | 100 | | | | | | | | |
| NS1 | 993 | 0 | 1 | 1 | 0 | Y | LVTDLRNCSW | 100 | | | | | | | | |
| NS1 | 994 | 0 | 1 | 1 | 0 | Y | VTDLRNCSWP | 100 | | | | | | | | |
| NS1 | 995 | 0 | 1 | 1 | 0 | Y | TDLRNCSWPA | 100 | | | | | | | | |
| NS1 | 996 | 0 | 1 | 1 | 0 | Y | DLRNCSWPAS | 100 | | | | | | | | |
| NS1 | 997 | 0 | 1 | 1 | 0 | Y | LRNCSWPASH | 100 | | | | | | | | |
| NS1 | 998 | 0 | 1 | 1 | 0 | Y | RNCSWPASHT | 100 | | | | | | | | |
| NS1 | 999 | 0 | 1 | 1 | 0 | Y | NCSWPASHTI | 100 | | | | | | | | |
| NS1 | 1000 | 0 | 1 | 1 | 0 | Y | CSWPASHTID | 100 | | | | | | | | |
| NS1 | 1001 | 0 | 1 | 1 | 0 | Y | SWPASHTIDN | 100 | | | | | | | | |
| NS1 | 1002 | 0.2 | 2 | 2 | 0 | Y | WPASHTIDNA | 96.88 | WPASHTIDNP | 3.12 | | | | | | |

Fig. 33-39

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1003 | 1 | 3 | 3 | 0 | Y | PASHTIDNAE | 71.88 | PASHTIDNAD | 25.00 | PASHTIDNPE | 3.12 | | |
| NS1 | 1004 | 1 | 3 | 3 | 0 | Y | ASHTIDNAEV | 71.88 | ASHTIDNADV | 25.00 | ASHTIDNPEV | 3.12 | | |
| NS1 | 1005 | 1 | 3 | 3 | 0 | Y | SHTIDNAEVW | 71.88 | SHTIDNADVV | 25.00 | SHTIDNPEVV | 3.12 | | |
| NS1 | 1006 | 1 | 3 | 3 | 0 | Y | HTIDNAEVVD | 71.88 | HTIDNADVVD | 25.00 | HTIDNPEVVD | 3.12 | | |
| NS1 | 1007 | 1 | 3 | 3 | 0 | Y | TIDNAEVVDS | 71.88 | TIDNADVVDS | 25.00 | TIDNPEVVDS | 3.12 | | |
| NS1 | 1008 | 1 | 3 | 3 | 0 | Y | IDNAEVVDSE | 71.88 | IDNADVVDSE | 25.00 | IDNPEVVDSE | 3.12 | | |
| NS1 | 1009 | 1.2 | 4 | 4 | 0 | Y | DNAEVVDSEL | 71.88 | DNADVVDSEL | 18.75 | DNADVVDSES | 6.25 | DNPEVVDSEL | 3.12 |
| NS1 | 1010 | 1.2 | 4 | 4 | 0 | Y | NAEVVDSELF | 71.88 | NADVVDSELF | 18.75 | NADVVDSESF | 6.25 | NPEVVDSELF | 3.12 |
| NS1 | 1011 | 1.2 | 4 | 4 | 0 | Y | AEVVDSELFL | 71.88 | ADVVDSELFL | 18.75 | ADVVDSESFL | 6.25 | PEVVDSELFL | 3.12 |
| NS1 | 1012 | 1.01 | 3 | 3 | 0 | Y | EWDSELFLP | 75 | DVVDSELFLP | 18.75 | DVVDSESFLP | 6.25 | | |
| NS1 | 1013 | 0.34 | 2 | 2 | 0 | Y | VVDSELFLPA | 93.75 | VVDSESFLPA | 6.25 | | | | |
| NS1 | 1014 | 0.34 | 2 | 2 | 0 | Y | VDSELFLPAS | 93.75 | VDSESFLPAS | 6.25 | | | | |
| NS1 | 1015 | 0.34 | 2 | 2 | 0 | Y | DSELFLPASL | 93.75 | DSESFLPASL | 6.25 | | | | |
| NS1 | 1016 | 0.34 | 2 | 2 | 0 | Y | SELFLPASLA | 93.75 | SESFLPASLA | 6.25 | | | | |
| NS1 | 1017 | 0.34 | 2 | 2 | 0 | Y | ELFLPASLAG | 93.75 | ESFLPASLAG | 6.25 | | | | |
| NS1 | 1018 | 0.34 | 2 | 2 | 0 | Y | LFLPASLAGP | 93.75 | SFLPASLAGP | 6.25 | | | | |
| NS1 | 1019 | 0 | 1 | 1 | 0 | Y | FLPASLAGPR | 100 | | | | | | |
| NS1 | 1020 | 0 | 1 | 1 | 0 | Y | LPASLAGPRS | 100 | | | | | | |
| NS1 | 1021 | 0 | 1 | 1 | 0 | Y | PASLAGPRSW | 100 | | | | | | |
| NS1 | 1022 | 0 | 1 | 1 | 0 | Y |ASLAGPRSWY | 100 | | | | | | |
| NS1 | 1023 | 0 | 1 | 1 | 0 | Y | SLAGPRSWYN | 100 | | | | | | |
| NS1 | 1024 | 0 | 1 | 1 | 0 | Y | LAGPRSWYNR | 100 | | | | | | |
| NS1 | 1025 | 0 | 1 | 1 | 0 | Y | AGPRSWYNRI | 100 | | | | | | |
| NS1 | 1026 | 0 | 1 | 1 | 0 | Y | GPRSWYNRIP | 100 | | | | | | |

Fig. 33-40

Species: TBEV (10-mers)

| protein | block starting position | block entropy | total peptides in block | # peptides required to cover 99% of block | gap/X

Fig. 33-41

Species: TBEV (10-mers)

| protein | block starting position | block entropy | total peptides in block | # peptides required to cover 99% of block | gap/X fraction | 99% of block covered w/ <= 5 peptides?

Fig. 33-42

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1090 | 0.81 | 2 | 2 | 0 | Y | CRTCTLPPYT | 75 | CRACTMPPVT | 25.00 | | | | |
| NS1 | 1091 | 1 | 3 | 3 | 0 | Y | RTCTLPPVTF | 71.88 | RACTMPPVTF | 25.00 | RTCTLPPVTI | 3.12 | | |
| NS1 | 1092 | 1 | 3 | 3 | 0 | Y | TCTLPPVTFR | 71.88 | ACTMPPVTFR | 25.00 | TCTLPPVTIR | 3.12 | | |
| NS1 | 1093 | 1 | 3 | 3 | 0 | Y | CTLPPVTFRT | 71.88 | CTMPPVTFRT | 25.00 | CTLPPVTIRT | 3.12 | | |
| NS1 | 1094 | 1 | 3 | 3 | 0 | Y | TLPPVTFRTG | 71.88 | TMPPVTFRTG | 25.00 | TLPPVTIRTG | 3.12 | | |
| NS1 | 1095 | 1 | 3 | 3 | 0 | Y | LPPVTFRTGT | 71.88 | MPPVTFRTGT | 25.00 | LPPVTIRTGT | 3.12 | | |
| NS1 | 1096 | 0.2 | 2 | 2 | 0 | Y | PPVTFRTGTD | 96.88 | PPVTIRTGTD | 3.12 | | | | |
| NS1 | 1097 | 0.2 | 2 | 2 | 0 | Y | PVTFRTGTDC | 96.88 | PVTIRTGTDC | 3.12 | | | | |
| NS1 | 1098 | 0.2 | 2 | 2 | 0 | Y | VTFRTGTDCW | 96.88 | VTIRTGTDCW | 3.12 | | | | |
| NS1 | 1099 | 0.2 | 2 | 2 | 0 | Y | TFRTGTDCWY | 96.88 | TIRTGTDCWY | 3.12 | | | | |
| NS1 | 1100 | 0.2 | 2 | 2 | 0 | Y | FRTGTDCWYA | 96.88 | IRTGTDCWYA | 3.12 | | | | |
| NS1 | 1101 | 0 | 1 | 1 | 0 | Y | RTGTDCWYAM | 100 | | | | | | |
| NS1 | 1102 | 0 | 1 | 1 | 0 | Y | TGTDCWYAME | 100 | | | | | | |
| NS1 | 1103 | 0 | 1 | 1 | 0 | Y | GTDCWYAMEI | 100 | | | | | | |
| NS1 | 1104 | 0 | 1 | 1 | 0 | Y | TDCWYAMEIR | 100 | | | | | | |
| NS1 | 1105 | 0 | 1 | 1 | 0 | Y | DCWYAMEIRP | 100 | | | | | | |
| NS1 | 1106 | 0 | 1 | 1 | 0 | Y | CWYAMEIRPV | 100 | | | | | | |
| NS1 | 1107 | 0 | 1 | 1 | 0 | Y | WYAMEIRPVH | 100 | | | | | | |
| NS1 | 1108 | 0 | 1 | 1 | 0 | Y | YAMEIRPVHD | 100 | | | | | | |
| NS1 | 1109 | 0 | 1 | 1 | 0 | Y | AMEIRPVHDQ | 100 | | | | | | |
| NS1 | 1110 | 0 | 1 | 1 | 0 | Y | MEIRPVHDQG | 100 | | | | | | |
| NS1 | 1111 | 0 | 1 | 1 | 0 | Y | EIRPVHDQGG | 100 | | | | | | |
| NS1 | 1112 | 0 | 1 | 1 | 0 | Y | IRPVHDQGGL | 100 | | | | | | |
| NS1 | 1113 | 0.2 | 2 | 2 | 0 | Y | RPVHDQGGLV | 96.88 | RPVHDQGGLI | 3.12 | | | | |

Fig. 33-43

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1114 | 0.2 | 2 | 2 | 0 | Y | PVHDQGGLVR | 96.88 | PVHDQGGLIR | 3.12 | | | | | | |
| NS1 | 1115 | 0.2 | 2 | 2 | 0 | Y | VHDQGGLVRS | 96.88 | VHDQGGLIRS | 3.12 | | | | | | |
| NS1 | 1116 | 0.4 | 3 | 3 | 0 | Y | HDQGGLVRSM | 93.75 | HDQGGLVRST | 3.12 | HDQGGLIRSM | 3.12 | | | | |
| NS1 | 1117 | 0.4 | 3 | 3 | 0 | Y | DQGGLVRSMV | 93.75 | DQGGLVRSTV | 3.12 | DQGGLIRSMV | 3.12 | | | | |
| NS1 | 1118 | 0.4 | 3 | 3 | 0 | Y | QGGLVRSMVV | 93.75 | QGGLVRSTV | 3.12 | QGGLIRSMVV | 3.12 | | | | |
| NS1 | 1119 | 0.4 | 3 | 3 | 0 | Y | GGLVRSMVVA | 93.75 | GGLVRSTWA | 3.12 | GGLIRSMVVA | 3.12 | | | | |
| NS1 | 1120 | 0.4 | 3 | 3 | 0 | Y | GLVRSMVVAD | 93.75 | GLVRSTWAD | 3.12 | GLIRSMVVAD | 3.12 | | | | |
| NS1 | 1121 | 0.4 | 3 | 3 | 0 | Y | LVRSMVVADN | 93.75 | LVRSTWADN | 3.12 | LIRSMVVADN | 3.12 | | | | |
| NS1 | 1122 | 0.4 | 3 | 3 | 0 | Y | VRSMVVADNG | 93.75 | VRSTWADNG | 3.12 | VRSTWADNG | 3.12 | | | | |
| NS1 | 1123 | 0.4 | 3 | 3 | 0 | Y | RSMVVADNGE | 96.88 | RSTWADNGE | 3.12 | | | | | | |
| NS1 | 1124 | 0.2 | 2 | 2 | 0 | Y | SMVVADNGEL | 96.88 | STWADNGEL | 3.12 | | | | | | |
| NS1 | 1125 | 0.2 | 2 | 2 | 0 | Y | MVVADNGELL | 96.88 | TVVADNGELL | 3.12 | | | | | | |
| NS1 | 1126 | 0 | 1 | 1 | 0 | Y | VVADNGELLS | 100 | | | | | | | | |
| NS1 | 1127 | 0 | 1 | 1 | 0 | Y | VADNGELLSE | 100 | | | | | | | | |
| NS1 | 1128 | 0 | 1 | 1 | 0 | Y | ADNGELLSEG | 100 | | | | | | | | |
| NS1 | 1129 | 0 | 1 | 1 | 0 | Y | DNGELLSEGG | 100 | | | | | | | | |
| NS1 | 1130 | 1 | 2 | 2 | 0 | Y | NGELLSEGGI | 50 | NGELLSEGGV | 50.00 | | | | | | |
| NS1 | 1131 | 1 | 2 | 2 | 0 | Y | GELLSEGGVP | 50 | GELLSEGGIP | 50.00 | | | | | | |
| NS2A | 1132 | 1 | 2 | 2 | 0 | Y | ELLSEGGVPG | 50 | ELLSEGGIPG | 50.00 | | | | | | |
| NS2A | 1133 | 1 | 2 | 2 | 0 | Y | LLSEGGIPGI | 50 | LLSEGGVPGI | 50.00 | | | | | | |
| NS2A | 1134 | 1 | 2 | 2 | 0 | Y | LSEGGIPGIV | 50 | LSEGGVPGIV | 50.00 | | | | | | |
| NS2A | 1135 | 1 | 2 | 2 | 0 | Y | SEGGIPGIVA | 50 | SEGGVPGIVA | 50.00 | | | | | | |
| NS2A | 1136 | 1 | 2 | 2 | 0 | Y | EGGIPGIVAL | 50 | EGGVPGIVAL | 50.00 | | | | | | |
| NS2A | 1137 | 1 | 2 | 2 | 0 | Y | GGIPGIVALF | 50 | GGVPGIVALF | 50.00 | | | | | | |

Fig. 33-44

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1138 | — | 2 | 2 | 0 | Y | GVPGIVALFV | 50 | GIPGIVALFV | 50.00 | | | | |
| NS2A | 1139 | — | 2 | 2 | 0 | Y | VPGIVALFVW | 50 | IPGIVALFVW | 50.00 | | | | |
| NS2A | 1140 | 0 | 1 | 1 | 0 | Y | PGIVALFVWL | 100 | | | | | | |
| NS2A | 1141 | 0 | 1 | 1 | 0 | Y | GIVALFVWLE | 100 | | | | | | |
| NS2A | 1142 | 0 | 1 | 1 | 0 | Y | IVALFVWLEY | 100 | | | | | | |
| NS2A | 1143 | 0.81 | 2 | 2 | 0 | Y | VALFVWLEYV | 75 | VALFVWLEYI | 25.00 | | | | |
| NS2A | 1144 | 0.81 | 2 | 2 | 0 | Y | ALFVWLEYVI | 75 | ALFVWLEYII | 25.00 | | | | |
| NS2A | 1145 | 0.81 | 2 | 2 | 0 | Y | LFVWLEYIIR | 75 | LFVWLEYIIR | 25.00 | | | | |
| NS2A | 1146 | 0.81 | 2 | 2 | 0 | Y | FVWLEYIIRR | 75 | FVWLEYIIRR | 25.00 | | | | |
| NS2A | 1147 | 0.81 | 2 | 2 | 0 | Y | VWLEYIIRRR | 75 | VWLEYIIRRR | 25.00 | | | | |
| NS2A | 1148 | 0.81 | 2 | 2 | 0 | Y | VLEYIIRRRP | 75 | VLEYIIRRRP | 25.00 | | | | |
| NS2A | 1149 | 0.81 | 2 | 2 | 0 | Y | LEYIIRRRPA | 75 | LEYIIRRRPS | 25.00 | | | | |
| NS2A | 1150 | 0.81 | 2 | 2 | 0 | Y | EYIIRRRPAT | 75 | EYIIRRRPST | 25.00 | | | | |
| NS2A | 1151 | 0.81 | 2 | 2 | 0 | Y | YIIRRRPATG | 75 | YIIRRRPSTG | 25.00 | | | | |
| NS2A | 1152 | 0.95 | 3 | 3 | 0 | Y | VIRRRPATGT | 75 | IIRRRPSTGT | 21.88 | IIRRPSTGS | 3.12 | | |
| NS2A | 1153 | 1.5 | 4 | 4 | 0 | Y | IRRRPATGTT | 59.38 | IRRRPSTGTT | 21.88 | IRRRPSTGTA | 15.62 | IRRRPSTGST | 3.12 |
| NS2A | 1154 | 1.5 | 4 | 4 | 0 | Y | RRRPATGTTA | 59.38 | RRRPSTGTTV | 21.88 | RRRPATGTAV | 15.62 | RRRPSTGSTV | 3.12 |
| NS2A | 1155 | 1.68 | 5 | 5 | 0 | Y | RRPATGTTAM | 56.25 | RRPSTGTTVV | 21.88 | RRPATGTAV | 15.62 | RRPSTGSTVV | 3.12 |
| NS2A | 1156 | 1.68 | 5 | 5 | 0 | Y | RPATGTTAMV | 56.25 | RPSTGTTVVW | 21.88 | RPATGTAVV | 15.62 | RPSTGSTVVW | 3.12 |
| NS2A | 1157 | 1.68 | 5 | 5 | 0 | Y | PATGTTAMWG | 56.25 | PSTGTTVVWG | 21.88 | PATGTAVWG | 15.62 | PSTGSTVVWG | 3.12 |
| NS2A | 1158 | 1.68 | 5 | 5 | 0 | Y | ATGTTAMWGG | 56.25 | STGTTVVWGG | 21.88 | ATGTAVWGG | 15.62 | ATGTTAVWGG | 3.12 |
| NS2A | 1165 | 1.32 | 5 | 5 | 0 | Y | WGGIVVLALL | 71.88 | WGGIVVLALL | 15.62 | WGGIVLALL | 6.25 | WGGIVVFALL | 3.12 |
| NS2A | 1166 | 1.32 | 5 | 5 | 0 | Y | GGIVVLALLV | 71.88 | GGIVLALLV | 15.62 | GGIVLALLV | 6.25 | GGIVVFALLV | 3.12 |
| NS2A | 1167 | 1.32 | 5 | 5 | 0 | Y | GIVVLALLVT | 71.88 | GIVVLALLVT | 15.62 | GIVLALLVT | 6.25 | GIVVFALLVT | 3.12 |

Fig. 33-45

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1168 | 1.32 | 5 | 5 | 0 | Y | IWLALLVTG | 71.88 | IWLALLVTG | 15.62 | FWLALLVTG | 6.25 | IWFALLVTG | 3.12 | LIVLALLVTG | 3.12 |
| NS2A | 1169 | 1.31 | 4 | 4 | 0 | Y | VVLALLVTGL | 56.25 | VVLALLVTGM | 37.50 | VFALLVTGL | 3.12 | IVLALLVTGM | 3.12 | | |
| NS2A | 1170 | 1.15 | 3 | 3 | 0 | Y | VLALLVTGLV | 56.25 | VLALLVTGMV | 40.62 | VFALLVTGLV | 3.12 | | | | |
| NS2A | 1171 | 2.08 | 5 | 5 | 0 | Y | LALLVTGLVR | 34.38 | LALLVTGMVR | 25.00 | LALLVTGLVK | 21.88 | LALLVTGMVK | 15.62 | FALLVTGLVR | 3.12 |
| NS2A | 1179 | 1.29 | 4 | 4 | 0 | Y | VRIESLVRYV | 59.38 | VKIESLVRYV | 34.38 | VRMESLVRYV | 3.12 | VRVESLVRYV | 3.12 | | |
| NS2A | 1180 | 1.29 | 4 | 4 | 0 | Y | RIESLVRYVV | 59.38 | KIESLVRYVV | 34.38 | RMESLVRYVV | 3.12 | KVESLVRYVV | 3.12 | | |
| NS2A | 1181 | 0.4 | 3 | 3 | 0 | Y | IESLVRYVVA | 93.75 | VESLVRYVVA | 3.12 | MESLVRYVVA | 3.12 | | | | |
| NS2A | 1182 | 0 | 1 | 1 | 0 | Y | ESLVRYVVAV | 100 | | | | | | | | |
| NS2A | 1183 | 0 | 1 | 1 | 0 | Y | SLVRYVVAVG | 100 | | | | | | | | |
| NS2A | 1184 | 0 | 1 | 1 | 0 | Y | LVRYVVAVGI | 100 | | | | | | | | |
| NS2A | 1185 | 0.2 | 2 | 2 | 0 | Y | VRYVVAVGIT | 96.88 | VRYVVAVGIA | 3.12 | | | | | | |
| NS2A | 1186 | 0.2 | 2 | 2 | 0 | Y | RYVVAVGITF | 96.88 | RYVVAVGIAF | 3.12 | | | | | | |
| NS2A | 1187 | 0.2 | 2 | 2 | 0 | Y | YVVAVGITFH | 96.88 | YVVAVGIAFH | 3.12 | | | | | | |
| NS2A | 1188 | 0.4 | 3 | 3 | 0 | Y | VVAVGITFHL | 93.75 | VVAVGIAFHL | 3.12 | VVAVGITFHF | 3.12 | | | | |
| NS2A | 1189 | 0.4 | 3 | 3 | 0 | Y | VAVGITFHLE | 93.75 | VAVGIAFHLE | 3.12 | VAVGITFHFE | 3.12 | | | | |
| NS2A | 1190 | 0.4 | 3 | 3 | 0 | Y | AVGITFHLEL | 93.75 | AVGIAFHLEL | 3.12 | AVGITFHFEL | 3.12 | | | | |
| NS2A | 1191 | 0.4 | 3 | 3 | 0 | Y | VGITFHLELG | 93.75 | VGIAFHLELG | 3.12 | VGITFHFELG | 3.12 | | | | |
| NS2A | 1192 | 0.4 | 3 | 3 | 0 | Y | GITFHLELGP | 93.75 | GITFHFELGP | 3.12 | GIAFHLELGP | 3.12 | | | | |
| NS2A | 1193 | 0.4 | 3 | 3 | 0 | Y | ITFHLELGPE | 93.75 | ITFHFELGPE | 3.12 | IAFHLELGPE | 3.12 | | | | |
| NS2A | 1194 | 0.4 | 3 | 3 | 0 | Y | TFHLELGPEI | 93.75 | TFHFELGPEI | 3.12 | AFHLELGPEI | 3.12 | | | | |
| NS2A | 1195 | 0.2 | 2 | 2 | 0 | Y | FHLELGPEIV | 96.88 | FHFELGPEIV | 3.12 | | | | | | |
| NS2A | 1196 | 0.2 | 2 | 2 | 0 | Y | HLELGPEIVA | 96.88 | HFELGPEIVA | 3.12 | | | | | | |
| NS2A | 1197 | 0.2 | 2 | 2 | 0 | Y | LELGPEIVAL | 96.88 | FELGPEIVAL | 3.12 | | | | | | |
| NS2A | 1198 | 0.81 | 2 | 2 | 0 | Y | ELGPEIVALT | 75 | ELGPEIVALM | 25.00 | | | | | | |

Fig. 33-46

Species: TBEV (10-mers)

| protein | block starting position | block entropy | total peptides in block | # peptides required to cover 99% of block | gap/X fraction | 99% of block covered w/ => 5 pept

Fig. 33-47

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1223 | 1.57 | 4 | 4 | 0 | Y | FALRSNLTVR | 53.12 | FALRRSLTVR | 28.12 | FALRRGLTVR | 15.62 | FALRRNLTVR | 3.12 |
| NS2A | 1224 | 1.57 | 4 | 4 | 0 | Y | ALRSNLTVRE | 53.12 | ALRRSLTVRE | 28.12 | ALRRGLTVRE | 15.62 | ALRRNLTVRE | 3.12 |
| NS2A | 1225 | 1.57 | 4 | 4 | 0 | Y | LRSNLTVREM | 53.12 | LRRSLTVREM | 28.12 | LRRGLTVREM | 15.62 | LRRNLTVREM | 3.12 |
| NS2A | 1226 | 1.57 | 4 | 4 | 0 | Y | RSNLTVREMV | 53.12 | RRSLTVREMV | 28.12 | RRGLTVREMV | 15.62 | RRNLTVREMV | 3.12 |
| NS2A | 1227 | 1.72 | 5 | 5 | 0 | Y | SNLTVREMVT | 53.12 | RSLTVREMVT | 25.00 | RGLTVREMVT | 15.62 | RNLTVREMVT | 3.12 | RSLTVREMVI | 3.12 |
| NS2A | 1228 | 1.68 | 5 | 5 | 0 | Y | NLTVREMVTI | 56.25 | SLTVREMVTI | 21.88 | GLTVREMVTI | 15.62 | SLTVREMVTI | 3.12 | SLTVREMVTI | 3.12 |
| NS2A | 1229 | 0.95 | 3 | 3 | 0 | Y | LTVREMVTIY | 75 | LTVREMVTTY | 21.88 | LTVREMVTY | 3.12 |
| NS2A | 1230 | 0.95 | 3 | 3 | 0 | Y | TVREMVTIYF | 75 | TVREMVTTYF | 21.88 | TVREMVTIYF | 3.12 |
| NS2A | 1231 | 0.95 | 3 | 3 | 0 | Y | VREMVTIYFL | 75 | VREMVTTYFL | 21.88 | VREMVITYFL | 3.12 |
| NS2A | 1232 | 0.95 | 3 | 3 | 0 | Y | REMVTIYFLL | 75 | REMVTTYFLL | 21.88 | REMVITYFLL | 3.12 |
| NS2A | 1233 | 0.95 | 3 | 3 | 0 | Y | EMVTIYFLLL | 75 | EMVTTYFLLL | 21.88 | EMVITYFLL | 3.12 |
| NS2A | 1234 | 0.95 | 3 | 3 | 0 | Y | MVTIYFLLLV | 75 | MVTTYFLLLV | 21.88 | MVITYFLLLV | 3.12 |
| NS2A | 1235 | 0.95 | 3 | 3 | 0 | Y | VTIYFLLLVL | 75 | VTTYFLLLVL | 21.88 | VITYFLLLVL | 3.12 |
| NS2A | 1236 | 0.95 | 3 | 3 | 0 | Y | TIYFLLLVLE | 75 | TTYFLLLVLE | 21.88 | ITYFLLLVLE | 3.12 |
| NS2A | 1237 | 0.81 | 2 | 2 | 0 | Y | IYFLLLVLEL | 75 | TYFLLLVLEL | 25.00 |
| NS2A | 1238 | 0 | 1 | 1 | 0 | Y | YFLLLVLELG | 100 |
| NS2A | 1239 | 0 | 1 | 1 | 0 | Y | FLLLVLELGL | 100 |
| NS2A | 1240 | 0 | 1 | 1 | 0 | Y | LLLVLELGLP | 100 |
| NS2A | 1241 | 1.16 | 3 | 3 | 0 | Y | LLVLELGLPS | 53.12 | LLVLELGLPG | 43.75 | LLVLELGLPY | 3.12 |
| NS2A | 1256 | 0.82 | 3 | 3 | 0 | Y | LWKWGDALAM | 81.25 | FWKWGDALAM | 15.62 | LWRWGDALAM | 3.12 |
| NS2A | 1257 | 0.2 | 2 | 2 | 0 | Y | WKWGDALAMG | 96.88 | WRWGDALAMG | 3.12 |
| NS2A | 1258 | 0.2 | 2 | 2 | 0 | Y | KWGDALAMGA | 96.88 | RWGDALAMGA | 3.12 |
| NS2A | 1259 | 0 | 1 | 1 | 0 | Y | WGDALAMGAL | 100 |
| NS2A | 1260 | 0 | 1 | 1 | 0 | Y | GDALAMGALI | 100 |

Fig. 33-48

Species: TBEV (10-mers)

| protein | block starting position | block entropy (10-mers) | total peptides in block | # peptides required to cover 99% of block | gap/X fraction | 99% of block covered w/ <= 5 peptides? | peptides required to cover 99% of block | frequency | peptides required to cover 99% of

Fig. 33-49

Species: TBEV (10-mers)

| protein | block starting position | block entropy | total

Fig. 33-50

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1343 | 1.57 | 4 | 4 | 0 | Y | VRLLAFWELA | 53.12 | IRLLAFWELA | 28.12 | IRLLAFWELA | 15.62 | IRLLSFWELS | 3.12 |
| NS2A | 1354 | 1.44 | 4 | 4 | 0 | Y | HGRRSFSEP | 46.88 | HGRRSFSEP | 43.75 | HGKRRSFSEP | 6.25 | SGRRSFSEP | 3.12 |
| NS2A | 1355 | 1.27 | 3 | 3 | 0 | Y | GRRSFSEPL | 46.88 | RGRRSFSEPL | 46.88 | GKRRSFSEPL | 6.25 | | |
| NS2A | 1356 | 1.27 | 3 | 3 | 0 | Y | RRSFSEPLT | 46.88 | GRRSFSEPLT | 46.88 | KRRSFSEPLT | 6.25 | | |
| NS2A | 1357 | 0 | 1 | 1 | 0 | Y | RSFSEPLTY | 100 | | | | | | |
| NS2A | 1358 | 0 | 1 | 1 | 0 | Y | RSFSEPLTW | 100 | | | | | | |
| NS2B | 1359 | 0 | 1 | 1 | 0 | Y | SFSEPLTWG | 100 | | | | | | |
| NS2B | 1360 | 0 | 1 | 1 | 0 | Y | FSEPLTWGV | 100 | | | | | | |
| NS2B | 1361 | 0 | 1 | 1 | 0 | Y | SEPLTWGVM | 100 | | | | | | |
| NS2B | 1362 | 0 | 1 | 1 | 0 | Y | EPLTWGVML | 100 | | | | | | |
| NS2B | 1363 | 0 | 1 | 1 | 0 | Y | PLTWGVMLT | 100 | | | | | | |
| NS2B | 1364 | 0 | 1 | 1 | 0 | Y | LTWGVMLTL | 100 | | | | | | |
| NS2B | 1365 | 0 | 1 | 1 | 0 | Y | TWGVMLTLA | 100 | | | | | | |
| NS2B | 1366 | 0.63 | 2 | 2 | 0 | Y | VVGVMLTLAS | 84.38 | VVGVMLTLAG | 15.62 | | | | |
| NS2B | 1367 | 0.63 | 2 | 2 | 0 | Y | VGVMLTLASG | 84.38 | VGVMLTLAGG | 15.62 | | | | |
| NS2B | 1368 | 0.63 | 2 | 2 | 0 | Y | GVMLTLASGM | 84.38 | GVMLTLAGGM | 15.62 | | | | |
| NS2B | 1369 | 0.63 | 2 | 2 | 0 | Y | VMLTLASGMM | 84.38 | VMLTLAGGMM | 15.62 | | | | |
| NS2B | 1370 | 0.63 | 2 | 2 | 0 | Y | MLTLASGMMR | 84.38 | MLTLAGGMMR | 15.62 | | | | |
| NS2B | 1371 | 0.63 | 2 | 2 | 0 | Y | LTLASGMMRH | 84.38 | LTLAGGMMRH | 15.62 | | | | |
| NS2B | 1372 | 0.63 | 2 | 2 | 0 | Y | TLASGMMRHT | 84.38 | TLAGGMMRHT | 15.62 | | | | |
| NS2B | 1373 | 0.82 | 3 | 3 | 0 | Y | LASGMMRHTS | 81.25 | LAGGMMRHTS | 15.62 | LASGMMRHTP | 3.12 | | |
| NS2B | 1374 | 0.82 | 3 | 3 | 0 | Y | ASGMMRHTSQ | 81.25 | AGGMMRHTSQ | 15.62 | ASGMMRHTPQ | 3.12 | | |
| NS2B | 1375 | 0.82 | 3 | 3 | 0 | Y | SGMMRHTSQE | 81.25 | GGMMRHTSQE | 15.62 | SGMMRHTPQE | 3.12 | | |
| NS2B | 1376 | 0.2 | 2 | 2 | 0 | Y | GMMRHTSQEA | 96.88 | GMMRHTPQEA | 3.12 | | | | |

Fig. 33-51

Species: TBEV (10-mers)

| protein | block starting position | block entropy | total peptides in block | # peptides required to cover 99% of block | gap/X fraction | 99% of block covered w/ <= 5 peptides?

Fig. 33-52

Species: TBEV (10-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1401 | 0 | 1 | 1 | 0 | Y | LGTRKMQLV

Fig. 33-53

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequ

Fig. 33-54

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block

Fig. 33-55

Species: TBEV (10-mers)

| protein | block starting position | block ent

Fig. 33-56

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1509 | 0.63 | 2 | 2 | 0 | Y | VKDGYRIFS | 84.38 | VRDGYRIFS | 15.62 | | | | | | |
| NS3 | 1510 | 0.63 | 2 | 2 | 0 | Y | KDGYRIFSP | 84.38 | RDGYRIFSP | 15.62 | | | | | | |
| NS3 | 1511 | 0 | 1 | 1 | 0 | Y | DGYRIFSPG | 100 | | | | | | | | |
| NS3 | 1512 | 0 | 1 | 1 | 0 | Y | GVYRIFSPGL | 100 | | | | | | | | |
| NS3 | 1513 | 0.86 | 2 | 2 | 0 | Y | VYRIFSPGLL | 71.88 | VYRIFSPGLF | 28.12 | | | | | | |
| NS3 | 1514 | 0.86 | 2 | 2 | 0 | Y | YRIFSPGLLW | 71.88 | YRIFSPGLFW | 28.12 | | | | | | |
| NS3 | 1515 | 0.86 | 2 | 2 | 0 | Y | RIFSPGLLWG | 71.88 | RIFSPGLFWG | 28.12 | | | | | | |
| NS3 | 1516 | 0.86 | 2 | 2 | 0 | Y | IFSPGLLWGQ | 71.88 | IFSPGLFWGQ | 28.12 | | | | | | |
| NS3 | 1517 | 1.13 | 4 | 4 | 0 | Y | FSPGLLWGQR | 71.88 | FSPGLFWGQN | 21.88 | FSPGLFWGQS | 3.12 | FSPGLFWGQR | 3.12 | | |
| NS3 | 1518 | 1.13 | 4 | 4 | 0 | Y | SPGLLWGQRQ | 71.88 | SPGLFWGQNQ | 21.88 | SPGLFWGQRQ | 3.12 | SPGLFWGQSQ | 3.12 | | |
| NS3 | 1519 | 1.13 | 4 | 4 | 0 | Y | PGLLWGQRQV | 71.88 | PGLFWGQNQV | 21.88 | PGLFWGQSQV | 3.12 | PGLFWGQRQV | 3.12 | | |
| NS3 | 1520 | 1.13 | 4 | 4 | 0 | Y | GLLWGQRQVG | 71.88 | GLFWGQNQVG | 21.88 | GLFWGQRQVG | 3.12 | GLFWGQSQVG | 3.12 | | |
| NS3 | 1521 | 1.13 | 4 | 4 | 0 | Y | LLWGQRQVGV | 71.88 | LFWGQNQVGV | 21.88 | LFWGQRQVGV | 3.12 | LFWGQSQVGV | 3.12 | | |
| NS3 | 1522 | 1.13 | 4 | 4 | 0 | Y | LWGQRQVGVG | 71.88 | FWGQNQVGVG | 21.88 | FWGQRQVGVG | 3.12 | FWGQSQVGVG | 3.12 | | |
| NS3 | 1523 | 0.95 | 3 | 3 | 0 | Y | WGQRQVGVGY | 75 | WGQSQVGVGY | 21.88 | | | | | | |
| NS3 | 1524 | 0.95 | 3 | 3 | 0 | Y | GQRQVGVGYG | 75 | GQSQVGVGYG | 21.88 | | | | | | |
| NS3 | 1525 | 1.68 | 4 | 4 | 0 | Y | QRQVGVGYGF | 43.75 | QNQVGVGYGS | 31.25 | QSQVGVGYGS | 21.88 | QSQVGYGS | 3.12 | RQVGVGYGFR | 3.12 |
| NS3 | 1526 | 1.84 | 5 | 5 | 0 | Y | RQVGVGYGFK | 40.62 | RQVGVGYGSK | 31.25 | SQVGVGYGSK | 21.88 | SQVGVGYGSK | 3.12 | | |
| NS3 | 1527 | 1.15 | 3 | 3 | 0 | Y | QVGVGYGSKG | 56.25 | QVGVGYGFKG | 40.62 | QVGVGYGFRG | 3.12 | | | | |
| NS3 | 1528 | 1.15 | 3 | 3 | 0 | Y | VGVGYGSKGV | 56.25 | VGVGYGFKGV | 40.62 | VGVGYGFRGV | 3.12 | | | | |
| NS3 | 1529 | 1.15 | 3 | 3 | 0 | Y | GVGYGSKGVL | 56.25 | GVGYGFKGVL | 40.62 | GVGYGFRGVL | 3.12 | | | | |
| NS3 | 1530 | 1.15 | 3 | 3 | 0 | Y | VGYGSKGVLH | 56.25 | VGYGFKGVLH | 40.62 | VGYGFRGVLH | 3.12 | | | | |
| NS3 | 1531 | 1.15 | 3 | 3 | 0 | Y | GYGSKGVLHT | 56.25 | GYGFKGVLHT | 40.62 | GYGFRGVLHT | 3.12 | | | | |
| NS3 | 1532 | 1.15 | 3 | 3 | 0 | Y | YGSKGVLHTM | 56.25 | YGFKGVLHTM | 40.62 | YGFRGVLHTM | 3.12 | | | | |

Fig. 33-57

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1533 | 1.15 | 3 | 3

Fig. 33-58

Species: TBEV (10

Fig. 33-59

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | fr

Fig. 33-60

Species: TBEV (10-mers)

| protein | block starting position | block entropy | total peptides in block | #

Fig. 33-61

Species: TBEV (10-mers)

| protein | block starting position | block entropy | total peptides in block | # peptides

Fig. 33-62

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1674 | 1.52 | 5 | 5 | 0 | Y | GTGWTAKGQI | 59.38 | GTGWTSKGQI | 28.12 | GMGWTAKGQI | 6.25 | GIGWTAKGQI | 3.12 | GSGWTAKGQI | 3.12 |
| NS3 | 1675 | 1.52 | 5 | 5 | 0 | Y | TGWTAKGQIT | 59.38 | TGWTSKGQIT | 28.12 | MGWTAKGQIT | 6.25 | IGWTAKGQIT | 3.12 | SGWTAKGQIT | 3.12 |
| NS3 | 1676 | 0.86 | 2 | 2 | 0 | Y | GWTAKGQITV | 71.88 | GWTSKGQITV | 28.12 | | | | | | |
| NS3 | 1677 | 0.86 | 2 | 2 | 0 | Y | WTAKGQITVL | 71.88 | WTSKGQITVL | 28.12 | | | | | | |
| NS3 | 1678 | 0.86 | 2 | 2 | 0 | Y | TAKGQITVLD | 71.88 | TSKGQITVLD | 28.12 | | | | | | |
| NS3 | 1679 | 0.86 | 2 | 2 | 0 | Y | AKGQITVLDM | 71.88 | SKGQITVLDM | 28.12 | | | | | | |
| NS3 | 1680 | 0 | — | 1 | 0 | Y | KGQITVLDMH | 100 | | | | | | | | |
| NS3 | 1681 | 0 | — | 1 | 0 | Y | GQITVLDMHP | 100 | | | | | | | | |
| NS3 | 1682 | 0 | — | 1 | 0 | Y | QITVLDMHPG | 100 | | | | | | | | |
| NS3 | 1683 | 0 | — | 1 | 0 | Y | ITVLDMHPGS | 100 | | | | | | | | |
| NS3 | 1684 | 0 | — | 1 | 0 | Y | TVLDMHPGSG | 100 | | | | | | | | |
| NS3 | 1685 | 0 | — | 1 | 0 | Y | VLDMHPGSGK | 100 | | | | | | | | |
| NS3 | 1686 | 0 | — | 1 | 0 | Y | LDMHPGSGKT | 100 | | | | | | | | |
| NS3 | 1687 | 0 | — | 1 | 0 | Y | DMHPGSGKTH | 100 | | | | | | | | |
| NS3 | 1688 | 0 | — | 1 | 0 | Y | MHPGSGKTHR | 100 | | | | | | | | |
| NS3 | 1689 | 0 | — | 1 | 0 | Y | HPGSGKTHRV | 100 | | | | | | | | |
| NS3 | 1690 | 0 | — | 1 | 0 | Y | PGSGKTHRVL | 100 | | | | | | | | |
| NS3 | 1691 | 0 | — | 1 | 0 | Y | GSGKTHRVLP | 100 | | | | | | | | |
| NS3 | 1692 | 0 | — | 1 | 0 | Y | SGKTHRVLPE | 100 | | | | | | | | |
| NS3 | 1693 | 0 | — | 1 | 0 | Y | GKTHRVLPEL | 100 | | | | | | | | |
| NS3 | 1694 | 0 | — | 1 | 0 | Y | KTHRVLPELI | 100 | | | | | | | | |
| NS3 | 1695 | 0 | — | 1 | 0 | Y | THRVLPELIR | 100 | | | | | | | | |
| NS3 | 1696 | 0 | — | 1 | 0 | Y | HRVLPELIRQ | 100 | | | | | | | | |
| NS3 | 1697 | 0 | — | 1 | 0 | Y | RVLPELIRQC | 100 | | | | | | | | |

Fig. 33-63

Species: TBEV (10-mers)

| protein

Fig. 33-65

Species: TBEV (10-mers)

| protein | block starting position | block

Fig. 33-66

Species: TBEV (10-

Fig. 33-67

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

Fig. 33-68

Species: TBEV (

Fig. 33-69

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 33-70

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1877 | 0 | 1 | 1 | 0 | Y | VICLNSKTFE | 100 | | | | | | |
| NS3 | 1878 | 0 | 1 | 1 | 0 | Y | ICLNSKTFEK | 100 | | | | | | |
| NS3 | 1879 | 0 | 1 | 1 | 0 | Y | CLNSKTFEKD | 100 | | | | | | |
| NS3 | 1880 | 0 | 1 | 1 | 0 | Y | LNSKTFEKDY | 100 | | | | | | |
| NS3 | 1881 | 0.63 | 2 | 2 | 0 | Y | NSKTFEKDYS | 84.38 | NSKTFEKDYT | 15.62 | | | | |
| NS3 | 1882 | 0.63 | 2 | 2 | 0 | Y | SKTFEKDYSR | 84.38 | SKTFEKDYTR | 15.62 | | | | |
| NS3 | 1883 | 0.63 | 2 | 2 | 0 | Y | KTFEKDYSRV | 84.38 | KTFEKDYTRV | 15.62 | | | | |
| NS3 | 1884 | 0.63 | 2 | 2 | 0 | Y | TFEKDYSRVR | 84.38 | TFEKDYTRVR | 15.62 | | | | |
| NS3 | 1885 | 0.63 | 2 | 2 | 0 | Y | FEKDYSRVRD | 84.38 | FEKDYTRVRD | 15.62 | | | | |
| NS3 | 1886 | 0.63 | 2 | 2 | 0 | Y | EKDYSRVRDE | 84.38 | EKDYTRVRDE | 15.62 | | | | |
| NS3 | 1887 | 0.63 | 2 | 2 | 0 | Y | KDYSRVRDEK | 84.38 | KDYTRVRDEK | 15.62 | | | | |
| NS3 | 1888 | 0.63 | 2 | 2 | 0 | Y | DYSRVRDEKP | 84.38 | DYTRVRDEKP | 15.62 | | | | |
| NS3 | 1889 | 0.63 | 2 | 2 | 0 | Y | YSRVRDEKPD | 84.38 | YTRVRDEKPD | 15.62 | | | | |
| NS3 | 1890 | 0.63 | 2 | 2 | 0 | Y | SRVRDEKPDF | 84.38 | TRVRDEKPDF | 15.62 | | | | |
| NS3 | 1891 | 0 | 1 | 1 | 0 | Y | RVRDEKPDFV | 100 | | | | | | |
| NS3 | 1892 | 0 | 1 | 1 | 0 | Y | VRDEKPDFVW | 100 | | | | | | |
| NS3 | 1893 | 0 | 1 | 1 | 0 | Y | RDEKPDFVWT | 100 | | | | | | |
| NS3 | 1894 | 0 | 1 | 1 | 0 | Y | DEKPDFVWT | 100 | | | | | | |
| NS3 | 1895 | 0 | 1 | 1 | 0 | Y | EKPDFVWTD | 100 | | | | | | |
| NS3 | 1896 | 0 | 1 | 1 | 0 | Y | KPDFVWTTDI | 100 | | | | | | |
| NS3 | 1897 | 0 | 1 | 1 | 0 | Y | PDFVWTTDIS | 100 | | | | | | |
| NS3 | 1898 | 0 | 1 | 1 | 0 | Y | DFVWTTDISE | 100 | | | | | | |
| NS3 | 1899 | 0 | 1 | 1 | 0 | Y | FVWTTDISEM | 100 | | | | | | |
| NS3 | 1900 | 0 | 1 | 1 | 0 | Y | VWTTDISEMG | 100 | | | | | | |

Fig. 33-72

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides

Fig. 33-73

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1949 | 1.36 | 3 | 3 | 0 | Y | RRGRVGRQEG | 59.38 | RRGRVGRQDG | 25.00 | RRGRVGRHEG | 15.62 | | |
| NS3 | 1950 | 1.36 | 3 | 3 | 0 | Y | RGRVGRQEGR | 59.38 | RGRVGRQDGR | 25.00 | RGRVGRHEGR | 15.62 | GRVGRQEGRI | 3.12 |
| NS3 | 1951 | 1.54 | 4 | 4 | 0 | Y | GRVGRQEGRT | 56.25 | GRVGRQDGRT | 25.00 | GRVGRHEGRT | 15.62 | RVGRQEGRID | 3.12 |
| NS3 | 1952 | 1.54 | 4 | 4 | 0 | Y | RVGRQEGRTD | 56.25 | RVGRQDGRTD | 25.00 | RVGRHEGRTD | 15.62 | VGRQEGRIDE | 3.12 |
| NS3 | 1953 | 1.54 | 4 | 4 | 0 | Y | VGRQEGRTDE | 56.25 | VGRQDGRTDE | 25.00 | VGRHEGRTDE | 15.62 | GRQEGRIDEY | 3.12 |
| NS3 | 1954 | 1.54 | 4 | 4 | 0 | Y | GRQEGRTDEY | 56.25 | GRQDGRTDEY | 25.00 | GRHEGRTDEY | 15.62 | RQEGRIDEYI | 3.12 |
| NS3 | 1955 | 1.54 | 4 | 4 | 0 | Y | RQEGRTDEYI | 56.25 | RQDGRTDEYI | 25.00 | RHEGRTDEYI | 15.62 | QEGRIDEYIY | 3.12 |
| NS3 | 1956 | 1.54 | 4 | 3 | 0 | Y | QEGRTDEYIY | 56.25 | QDGRTDEYIY | 25.00 | HEGRTDEYIY | 15.62 | | |
| NS3 | 1957 | 1 | 3 | 2 | 0 | Y | EGRTDEYIYS | 71.88 | DGRTDEYIYS | 25.00 | EGRIDEYIYS | 3.12 | | |
| NS3 | 1958 | 0.2 | 2 | 2 | 0 | Y | GRTDEYIYSG | 96.88 | GRIDEYIYSG | 3.12 | | | | |
| NS3 | 1959 | 0.2 | 2 | 2 | 0 | Y | RTDEYIYSGQ | 96.88 | RIDEYIYSGQ | 3.12 | | | | |
| NS3 | 1960 | 0.2 | 2 | 2 | 0 | Y | TDEYIYSGQC | 96.88 | IDEYIYSGQC | 3.12 | | | | |
| NS3 | 1961 | 0 | 1 | 1 | 0 | Y | DEYIYSGQCD | 100 | | | | | | |
| NS3 | 1962 | 0.2 | 2 | 2 | 0 | Y | EYIYSGQCDD | 96.88 | EYIYSGQCDE | 3.12 | | | | |
| NS3 | 1963 | 0.2 | 2 | 2 | 0 | Y | YIYSGQCDDD | 96.88 | YIYSGQCDEY | 3.12 | | | | |
| NS3 | 1964 | 0.2 | 2 | 2 | 0 | Y | IYSGQCDDDD | 96.88 | IYSGQCDEYD | 3.12 | | | | |
| NS3 | 1965 | 0.4 | 3 | 3 | 0 | Y | YSGQCDDDDS | 93.75 | YSGQCDDDDG | 3.12 | YSGQCDEYDS | 3.12 | | |
| NS3 | 1966 | 0.6 | 4 | 4 | 0 | Y | SGQCDDDDSG | 90.62 | SGQCDDDDSV | 3.12 | SGQCDDDDGG | 3.12 | SGQCDEYDSG | 3.12 |
| NS3 | 1967 | 0.6 | 4 | 4 | 0 | Y | GQCDDDDSGL | 90.62 | GQCDDDDSVL | 3.12 | GQCDDDDGGL | 3.12 | GQCDEYDSGL | 3.12 |
| NS3 | 1968 | 0.6 | 4 | 4 | 0 | Y | QCDDDDSGLV | 90.62 | QCDDDDSVLV | 3.12 | QCDDDDGGLV | 3.12 | QCDEYDSGLV | 3.12 |
| NS3 | 1969 | 0.6 | 4 | 4 | 0 | Y | CDDDDSGLVQ | 90.62 | CDDDDSVLVQ | 3.12 | CDDDDGGLVQ | 3.12 | CDEYDSGLVQ | 3.12 |
| NS3 | 1970 | 0.6 | 4 | 4 | 0 | Y | DDDDSGLVQW | 90.62 | DDDDGGLVQW | 3.12 | DDDDSVLVQW | 3.12 | DEYDSGLVQW | 3.12 |
| NS3 | 1971 | 0.6 | 4 | 4 | 0 | Y | DDDSGLVQWK | 90.62 | EYDSGLVQWK | 3.12 | DDDGGLVQWK | 3.12 | DDDSVLVQWK | 3.12 |
| NS3 | 1972 | 0.6 | 4 | 4 | 0 | Y | DDSGLVQWKE | 90.62 | YDSGLVQWKE | 3.12 | DDGGLVQWKE | 3.12 | DDSVLVQWKE | 3.12 |

Fig. 33-74

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 33-75

Species: TBEV (10-mers)

| protein | block starting position | block entropy | total peptides in block | # peptides required to cover 99% of block | g

Fig. 33-76

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99

Fig. 33-77

Species: TBEV (10-mers)

| protein | block starting position | block entropy | total peptides in block | #

Fig. 33-78

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency |
|---|---|---|---|---|---|---|---|---|---|---|---|---|
| Species: TBEV (10-mers) | | | | | | | | | | | | |
| NS3 | 2069 | 0.53 | 3 | 3 | 0 | Y | DLVTFRSPNG | 90.62

Fig. 33-79

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2093 | 0.81 | 2 | 2 | 0 | Y | FREGDIREF | 75 | FKEGRDIKEF | 25.00 | | | | |
| NS3 | 2094 | 1.12 | 3 | 3 | 0 | Y | REGDIREFV | 68.75 | KEGRDIKEFV | 25.00 | REGRDIREFI | 6.25 | | |
| NS3 | 2095 | 1.12 | 3 | 3 | 0 | Y | EGRDIREFVA | 68.75 | EGRDIKEFVA | 25.00 | EGRDIREFIA | 6.25 | | |
| NS3 | 2096 | 1.12 | 3 | 3 | 0 | Y | GRDIREFVAY | 68.75 | GRDIKEFVAY | 25.00 | GRDIREFIAY | 6.25 | | |
| NS3 | 2097 | 1.12 | 3 | 3 | 0 | Y | RDIREFVAYA | 68.75 | RDIKEFVAYA | 25.00 | RDIREFIAYA | 6.25 | | |
| NS3 | 2098 | 1.12 | 3 | 3 | 0 | Y | DIREFVAYAS | 68.75 | DIKEFVAYAS | 25.00 | DIREFIAYAS | 6.25 | | |
| NS3 | 2099 | 1.12 | 3 | 3 | 0 | Y | IREFVAYASG | 68.75 | IKEFVAYASG | 25.00 | IREFIAYASG | 6.25 | | |
| NS3 | 2100 | 1.12 | 3 | 3 | 0 | Y | REFVAYASGR | 68.75 | KEFVAYASGR | 25.00 | REFIAYASGR | 6.25 | | |
| NS3 | 2101 | 0.34 | 2 | 2 | 0 | Y | EFVAYASGRR | 93.75 | EFIAYASGRR | 6.25 | | | | |
| NS3 | 2102 | 0.34 | 2 | 2 | 0 | Y | FVAYASGRRS | 93.75 | FIAYASGRRS | 6.25 | | | | |
| NS3 | 2103 | 0.95 | 3 | 3 | 0 | Y | VAYASGRRSF | 78.12 | VAYASGRRSI | 15.62 | IAYASGRRSF | 6.25 | | |
| NS3 | 2104 | 0.63 | 2 | 2 | 0 | Y | AYASGRRSFG | 84.38 | AYASGRRSIG | 15.62 | | | | |
| NS3 | 2105 | 0.63 | 2 | 2 | 0 | Y | YASGRRSFGD | 84.38 | YASGRRSIGD | 15.62 | | | | |
| NS3 | 2106 | 0.63 | 2 | 2 | 0 | Y | ASGRRSFGDV | 84.38 | ASGRRSIGDV | 15.62 | | | | |
| NS3 | 2107 | 0.63 | 3 | 2 | 0 | Y | SGRRSFGDVL | 84.38 | SGRRSIGDVL | 15.62 | | | | |
| NS3 | 2108 | 1.4 | 3 | 3 | 0 | Y | GRRSFGDVLS | 56.25 | GRRSFGDVLT | 28.12 | GRRSIGDVLT | 15.62 | | |
| NS3 | 2109 | 1.4 | 3 | 3 | 0 | Y | RRSFGDVLSG | 56.25 | RRSFGDVLTG | 28.12 | RRSIGDVLTG | 15.62 | | |
| NS3 | 2110 | 1.4 | 3 | 3 | 0 | Y | RSFGDVLSGM | 56.25 | RSFGDVLTGM | 28.12 | RSIGDVLTGM | 15.62 | | |
| NS3 | 2111 | 1.4 | 3 | 3 | 0 | Y | SFGDVLSGMS | 56.25 | SFGDVLTGMS | 28.12 | SIGDVLTGMS | 15.62 | | |
| NS4A | 2112 | 1.4 | 3 | 3 | 0 | Y | FGDVLSGMSG | 56.25 | FGDVLTGMSG | 28.12 | IGDVLTGMSG | 15.62 | | |
| NS4A | 2113 | 0.99 | 2 | 2 | 0 | Y | GDVLSGMSGV | 56.25 | GDVLTGMSGV | 43.75 | | | | |
| NS4A | 2114 | 0.99 | 2 | 2 | 0 | Y | DVLSGMSGVP | 56.25 | DVLTGMSGVP | 43.75 | | | | |
| NS4A | 2115 | 0.99 | 2 | 2 | 0 | Y | VLSGMSGVPE | 56.25 | VLTGMSGVPE | 43.75 | | | | |
| NS4A | 2116 | 0.99 | 2 | 2 | 0 | Y | LSGMSGVPEL | 56.25 | LTGMSGVPEL | 43.75 | | | | |

Fig. 33-80

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2117 | 0.99 | 2 | 2 | 0 | Y | SGMSGVPELL | 56.25 | TGMSGVPELL | 43.75 | | | | |
| NS4A | 2118 | 0 | 1 | 1 | 0 | Y | GMSGVPELL

Fig. 33-81

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 33-82

Species: TBEV (10-mers)

| protein | block starting position | block

Fig. 33-83

Species: TBEV (10-mers)

| protein | block starting position | block entropy | total peptides in block | # peptides required to cover 99% of block | gap/X fraction | 99% of block covered w/ => 5 peptides? | peptides required to cover 99% of block

Fig. 33-84

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4A | 2220 | 0 | 1 | 1 | 0 | Y | IFYTLLTVLQ | 100 | | |
| NS4A | 2221 | 0 | 1 | 1 | 0 | Y | FYTLLTVLQP | 100 | | |
| NS4A | 2222 | 0 | 1 | 1 | 0 | Y | YTLLTVLQPE | 100 | | |
| NS4A | 2223 | 0.2 | 2 | 2 | 0 | Y | TLLTVLQPEA | 96.88 | TLLTVLQPEV | 3.12 |
| NS4A | 2224 | 0.2 | 2 | 2 | 0 | Y | LLTVLQPEAG | 96.88 | LLTVLQPEVG | 3.12 |
| NS4A | 2225 | 0.2 | 2 | 2 | 0 | Y | LTVLQPEAGK | 96.88 | LTVLQPEVGK | 3.12 |
| NS4A | 2226 | 0.2 | 2 | 2 | 0 | Y | TVLQPEAGKQ | 96.88 | TVLQPEVGKQ | 3.12 |
| NS4A | 2227 | 0.2 | 2 | 2 | 0 | Y | VLQPEAGKQR | 96.88 | VLQPEVGKQR | 3.12 |
| NS4A | 2228 | 0.2 | 2 | 2 | 0 | Y | LQPEAGKQRS | 96.88 | LQPEVGKQRS | 3.12 |
| NS4A | 2229 | 0.2 | 2 | 2 | 0 | Y | QPEAGKQRSS | 96.88 | QPEVGKQRSS | 3.12 |
| NS4A | 2230 | 0.2 | 2 | 2 | 0 | Y | PEAGKQRSSD | 96.88 | PEVGKQRSSD | 3.12 |
| NS4A | 2231 | 0.2 | 2 | 2 | 0 | Y | EAGKQRSSDD | 96.88 | EVGKQRSSDD | 3.12 |
| NS4A | 2232 | 0.2 | 2 | 2 | 0 | Y | AGKQRSSDDN | 96.88 | VGKQRSSDDN | 3.12 |
| NS4A | 2233 | 0 | 1 | 1 | 0 | Y | GKQRSSDDNK | 100 | | |
| NS4A | 2234 | 0 | 1 | 1 | 0 | Y | KQRSSDDNKL | 100 | | |
| NS4A | 2235 | 0 | 1 | 1 | 0 | Y | QRSSDDNKLA | 100 | | |
| NS4A | 2236 | 0 | 1 | 1 | 0 | Y | RSSDDNKLAY | 100 | | |
| 2K | 2237 | 0 | 1 | 1 | 0 | Y | SSDDNKLAYF | 100 | | |
| 2K | 2238 | 0 | 1 | 1 | 0 | Y | SDDNKLAYFL | 100 | | |
| 2K | 2239 | 0 | 1 | 1 | 0 | Y | DDNKLAYFLL | 100 | | |
| 2K | 2240 | 0 | 1 | 1 | 0 | Y | DNKLAYFLLT | 100 | | |
| 2K | 2241 | 0 | 1 | 1 | 0 | Y | NKLAYFLLTL | 100 | | |
| 2K | 2242 | 0 | 1 | 1 | 0 | Y | KLAYFLLTLC | 100 | | |
| 2K | 2243 | 0 | 1 | 1 | 0 | Y | LAYFLLTLCS | 100 | | |

Fig. 33-85

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2244 | 0.2 | 2 | 2 | 0 | Y | AYFLLTLCSL | 96.88 | AYFLLTLCSV | 3.12 | | | | |
| 2K | 2245 | 0.2 | 2 | 2 | 0 | Y | YFLLTLCSLA | 96.88 | YFLLTLCSVA | 3.12 | | | | |
| 2K | 2246 | 0.2 | 2 | 2 | 0 | Y | FLLTLCSLAG | 96.88 | FLLTLCSVAG | 3.12 | | | | |
| 2K | 2247 | 0.2 | 2 | 2 | 0 | Y | LLTLCSLAGL | 96.88 | LLTLCSVAGL | 3.12 | | | | |
| 2K | 2248 | 0.2 | 2 | 2 | 0 | Y | LTLCSLAGLV | 96.88 | LTLCSVAGLV | 3.12 | | | | |
| 2K | 2249 | 0.2 | 2 | 2 | 0 | Y | TLCSLAGLVA | 96.88 | TLCSVAGLVA | 3.12 | | | | |
| 2K | 2250 | 0.2 | 2 | 2 | 0 | Y | LCSLAGLVAA | 96.88 | LCSVAGLVAA | 3.12 | | | | |
| 2K | 2251 | 0.2 | 2 | 2 | 0 | Y | CSLAGLVAAN | 96.88 | CSVAGLVAAN | 3.12 | | | | |
| 2K | 2252 | 0.2 | 2 | 2 | 0 | Y | SLAGLVAANE | 96.88 | SVAGLVAANE | 3.12 | | | | |
| 2K | 2253 | 0.2 | 2 | 2 | 0 | Y | LAGLVAANEM | 96.88 | VAGLVAANEM | 3.12 | | | | |
| 2K | 2254 | 0 | 1 | 1 | 0 | Y | AGLVAANEMG | 100 | | | | | | |
| 2K | 2255 | 0.2 | 2 | 2 | 0 | Y | GLVAANEMGF | 96.88 | GLVAANEMGL | 3.12 | | | | |
| 2K | 2256 | 0.2 | 2 | 2 | 0 | Y | LVAANEMGFL | 96.88 | LVAANEMGLL | 3.12 | | | | |
| 2K | 2257 | 0.2 | 2 | 2 | 0 | Y | VAANEMGFLE | 96.88 | VAANEMGLLE | 3.12 | | | | |
| 2K | 2258 | 0.89 | 3 | 3 | 0 | Y | AANEMGFLEK | 78.12 | AANEMGFLER | 18.75 | AANEMGLLER | 3.12 | | |
| 2K | 2259 | 0.89 | 3 | 3 | 0 | Y | ANEMGFLEKT | 78.12 | ANEMGFLERT | 18.75 | ANEMGLLERT | 3.12 | | |
| NS4B | 2260 | 0.89 | 3 | 3 | 0 | Y | NEMGFLEKTK | 78.12 | NEMGFLERTK | 18.75 | NEMGLLERTK | 3.12 | | |
| NS4B | 2261 | 0.89 | 3 | 3 | 0 | Y | EMGFLEKTKA | 78.12 | EMGFLERTKA | 18.75 | EMGLLERTKA | 3.12 | | |
| NS4B | 2262 | 0.89 | 3 | 3 | 0 | Y | MGFLEKTKAD | 78.12 | MGFLERTKAD | 18.75 | MGLLERTKAD | 3.12 | | |
| NS4B | 2263 | 0.89 | 3 | 3 | 0 | Y | GFLEKTKADL | 78.12 | GFLERTKADL | 18.75 | GLLERTKADL | 3.12 | | |
| NS4B | 2264 | 0.89 | 3 | 3 | 0 | Y | FLEKTKADLS | 78.12 | FLERTKADLS | 18.75 | LLERTKADLS | 3.12 | | |
| NS4B | 2265 | 0.95 | 3 | 3 | 0 | Y | LEKTKADLST | 75 | LERTKADLST | 21.88 | LERTKADLSA | 3.12 | | |
| NS4B | 2266 | 1.26 | 4 | 4 | 0 | Y | EKTKADLSTV | 68.75 | ERTKADLSTV | 21.88 | EKTKADLSTA | 6.25 | EKTKADLSAV | 3.12 |
| NS4B | 2267 | 1.26 | 4 | 4 | 0 | Y | KTKADLSTVL | 68.75 | RTKADLSTVL | 21.88 | KTKADLSTAL | 6.25 | KTKADLSAVL | 3.12 |

Fig. 33-86

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2268 | 0.53 | 3 | 3 | 0 | Y | TKADLSTVLW | 90.62 | TKADLSTALW | 6.25 | TKADLSAVLW | 3.12 | | | | |
| NS4B | 2269 | 0.73 | 4 | 3 | 0 | Y | KADLSTVLWS | 87.5 | KADLSTALWS | 6.25 | KADLSTVLWA | 3.12 | KADLSAVLWS | 3.12 | | |
| NS4B | 2282 | 1.8 | 5 | 4 | 0 | Y | ELRSWEEWTN | 46.88 | EPRPWSEWTN | 25.00 | EPRSWGEWTN | 21.88 | EMRSWEEWTN | 3.12 | EVRSWEEWTN | 3.12 |
| NS4B | 2283 | 1.8 | 5 | 5 | 0 | Y | LRSWEEWTNI | 46.88 | PRPWSEWTNV | 25.00 | PRSWGEWTNI | 21.88 | VRSWEEWTNI | 3.12 | MRSWEEWTNI | 3.12 |
| NS4B | 2284 | 1.46 | 3 | 3 | 0 | Y | RSWEEWTNID | 53.12 | RPWSEWTNVD | 25.00 | RSWGEWTNID | 21.88 | | | | |
| NS4B | 2285 | 1.46 | 3 | 3 | 0 | Y | SWEEWTNIDI | 53.12 | PWSEWTNVDI | 25.00 | SWGEWTNIDI | 21.88 | | | | |
| NS4B | 2286 | 1.46 | 3 | 3 | 0 | Y | WEEWTNIDIQ | 53.12 | WSEWTNVDIQ | 25.00 | WGEWTNIDIQ | 21.88 | | | | |
| NS4B | 2287 | 1.46 | 3 | 3 | 0 | Y | EEWTNIDIQP | 53.12 | SEWTNVDIQP | 25.00 | GEWTNIDIQP | 21.88 | | | | |
| NS4B | 2288 | 0.81 | 2 | 2 | 0 | Y | EWTNIDIQPA | 75 | EWTNVDIQPA | 25.00 | | | | | | |
| NS4B | 2289 | 0.81 | 2 | 2 | 0 | Y | WTNIDIQPAR | 75 | WTNVDIQPAR | 25.00 | | | | | | |
| NS4B | 2290 | 0.81 | 2 | 2 | 0 | Y | TNIDIQPARS | 75 | TNVDIQPARS | 25.00 | | | | | | |
| NS4B | 2291 | 0.81 | 2 | 2 | 0 | Y | NIDIQPARSW | 75 | NVDIQPARSW | 25.00 | | | | | | |
| NS4B | 2292 | 0.81 | 2 | 2 | 0 | Y | IDIQPARSWG | 75 | VDIQPARSWG | 25.00 | | | | | | |
| NS4B | 2293 | 0 | 1 | 1 | 0 | Y | DIQPARSWGT | 100 | | | | | | | | |
| NS4B | 2294 | 0 | 1 | 1 | 0 | Y | IQPARSWGTY | 100 | | | | | | | | |
| NS4B | 2295 | 0 | 1 | 1 | 0 | Y | QPARSWGTYV | 100 | | | | | | | | |
| NS4B | 2296 | 0 | 1 | 1 | 0 | Y | PARSWGTYVL | 100 | | | | | | | | |
| NS4B | 2297 | 0 | 1 | 1 | 0 | Y | ARSWGTYVLV | 100 | | | | | | | | |
| NS4B | 2298 | 0 | 1 | 1 | 0 | Y | RSWGTYVLVW | 100 | | | | | | | | |
| NS4B | 2299 | 0 | 1 | 1 | 0 | Y | SWGTYVLVWS | 100 | | | | | | | | |
| NS4B | 2300 | 0 | 1 | 1 | 0 | Y | WGTYVLVWSL | 100 | | | | | | | | |
| NS4B | 2301 | 0 | 1 | 1 | 0 | Y | GTYVLVWSLF | 100 | | | | | | | | |
| NS4B | 2302 | 0 | 1 | 1 | 0 | Y | TYVLVWSLFT | 100 | | | | | | | | |
| NS4B | 2303 | 0 | 1 | 1 | 0 | Y | YVLVWSLFTP | 100 | | | | | | | | |

Fig. 33-87

Species: TBEV (10

Fig. 33-88

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 33-89

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2354 | 1.93 | 4 | 4 | 0 | Y | MALGWSLVG | 37.5 | MTLGWSLIG | 25.00 | VALGWSLVG | 21.88 | MSLGWSLVG | 15.62 |
| NS4B | 2355 | 1.36 | 3 | 3 | 0 | Y | ALGWSLVGA | 59.38 | TLGWSLIGA | 25.00 | SLGWSLVGA | 15.62 | | |
| NS4B | 2356 | 0.81 | 2 | 2 | 0 | Y | LGWSLVGAT | 75 | LGWSLIGAT | 25.00 | | | | |
| NS4B | 2357 | 0.81 | 2 | 2 | 0 | Y | GWSLVGATP | 75 | GWSLIGATP | 25.00 | | | | |
| NS4B | 2358 | 0.81 | 2 | 2 | 0 | Y | WSLVGATPT | 75 | WSLIGATPT | 25.00 | | | | |
| NS4B | 2359 | 0.81 | 2 | 2 | 0 | Y | SLVGATPTS | 75 | VSLIGATPTS | 25.00 | | | | |
| N

Fig. 33-91

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2402 | 0.2 | 2 | 2 | 0 | Y | AMVRNPMVDG | 96.88 | AMVRNPMLDG | 3.12 | | | | | | |
| NS4B | 2403 | 0.2 | 2 | 2 | 0 | Y | MVRNPMVDGD | 96.88 | MVRNPMLDGD | 3.12 |

Fig. 33-92

Species: TBEV (10-mers)

| protein | block starting position | block entropy | total peptides in block | # peptides required to cover 99% of block | gap/X fraction | 99% of block covered w/ <= 5 peptides? | peptides required

Fig. 33-93

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2458 | 0.64 | 3 | 3 | 0 | Y | AVGLAAAGQL | 87

Fig. 33-94

Species: TBEV (10-mers)

| protein | block starting position | block entropy | total peptides in block | # peptides required to cover 99% of block | gap/X fraction | 99% of block covered w/ <= 5 peptides?

Fig. 33-95

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 33-96

Species: TBEV (10-mers)

| protein | block starting position | block entropy | total peptides in block | # peptides required to cover 99% of block | gap/X fraction | 99% of block covered w/ <= 5 peptides? | peptides required

Fig. 33-98

Species: TBEV (10-mers

Fig. 33-99

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2616 | 1.39 | 5 | 5 | 0 | Y | IGGKGHETPK | 68.75 | IGGRGHEAPK | 18.75 | IGGRGHEAPK | 6.25 | IGGKGHETPK | 3.12 | IGGKGHETPK | 3.12 |
| NS5 | 2617 | 1.39 | 5 | 5 | 0 | Y | GGKGHETPKM | 68.75 | GGRGHEAPKM | 18.75 | GGKGHEAPKM | 6.25 | GGKGHETPKM | 3.12 | GGRGHETPKM | 3.12 |
| NS5 | 2618 | 1.39 | 5 | 5 | 0 | Y | GKGHETPKMV | 68.75 | GRGHEAPKMV | 18.75 | GKGHEAPKMV | 6.25 | GKGHETPRMV | 3.12 | GRGHETPKMV | 3.12 |
| NS5 | 2619 | 1.39 | 5 | 5 | 0 | Y | KGHETPKMVT | 68.75 | RGHEAPKMVT | 18.75 | KGHEAPKMVT | 6.25 | RGHETPKMVT | 3.12 | KGHETPRMVT | 3.12 |
| NS5 | 2620 | — | 3 | 3 | 0 | Y | GHETPKMVTS | 71.88 | GHEAPKMVTS | 25.00 | GHETPRMVTS | 3.12 | | | | |
| NS5 | 2621 | — | 3 | 3 | 0 | Y | HETPKMVTSL | 71.88 | HEAPKMVTSL | 25.00 | HETPRMVTSL | 3.12 | | | | |
| NS5 | 2622 | — | 3 | 3 | 0 | Y | ETPKMVTSLG | 71.88 | EAPKMVTSLG | 25.00 | ETPRMVTSLG | 3.12 | | | | |
| NS5 | 2623 | — | 3 | 3 | 0 | Y | TPKMVTSLGW | 71.88 | APKMVTSLGW | 25.00 | TPRMVTSLGW | 3.12 | | | | |
| NS5 | 2624 | 0.2 | 2 | 2 | 0 | Y | PKMVTSLGWN | 96.88 | PRMVTSLGWN | 3.12 | | | | | | |
| NS5 | 2625 | 0.2 | 2 | 2 | 0 | Y | KMVTSLGWNL | 96.88 | RMVTSLGWNL | 3.12 | | | | | | |
| NS5 | 2626 | 0 | 1 | 1 | 0 | Y | MVTSLGWNLI | 100 | | | | | | | | |
| NS5 | 2627 | 0 | 1 | 1 | 0 | Y | VTSLGWNLIK | 100 | | | | | | | | |
| NS5 | 2628 | 0 | 1 | 1 | 0 | Y | TSLGWNLIKF | 100 | | | | | | | | |
| NS5 | 2629 | 0 | 1 | 1 | 0 | Y | SLGWNLIKFR | 100 | | | | | | | | |
| NS5 | 2630 | 0.81 | 2 | 2 | 0 | Y | LGWNLIKFRA | 75 | LGWNLIKFRS | 25.00 | WNLIKFRAGV | 3.12 | | | | |
| NS5 | 2631 | 0.81 | 2 | 2 | 0 | Y | GWNLIKFRAG | 75 | GWNLIKFRSG | 25.00 | NLIKFRAGVD | 3.12 | | | | |
| NS5 | 2632 | — | 3 | 3 | 0 | Y | WNLIKFRAGM | 71.88 | WNLIKFRSGM | 25.00 | LIKFRAGVDV | 3.12 | | | | |
| NS5 | 2633 | — | 3 | 3 | 0 | Y | NLIKFRAGMD | 71.88 | NLIKFRSGMD | 25.00 | IKFRAGVDVF | 3.12 | | | | |
| NS5 | 2634 | — | 3 | 3 | 0 | Y | LIKFRAGMDV | 71.88 | LIKFRSGMDV | 25.00 | KFRAGVDVFS | 3.12 | | | | |
| NS5 | 2635 | — | 3 | 3 | 0 | Y | IKFRAGMDVF | 71.88 | IKFRSGMDVF | 25.00 | FRAGVDVFSM | 3.12 | | | | |
| NS5 | 2636 | — | 3 | 3 | 0 | Y | KFRAGMDVFS | 71.88 | KFRSGMDVFS | 25.00 | RAGVDVFSMQ | 3.12 | | | | |
| NS5 | 2637 | — | 3 | 3 | 0 | Y | FRAGMDVFSM | 71.88 | FRSGMDVFSM | 25.00 | AGVDVFSMQP | 3.12 | | | | |
| NS5 | 2638 | — | 3 | 3 | 0 | Y | RAGMDVFSMQ | 71.88 | RSGMDVFSMQ | 25.00 | | | | | | |
| NS5 | 2639 | — | 3 | 3 | 0 | Y | AGMDVFSMQP | 71.88 | SGMDVFSMQP | 25.00 | | | | | | |

Fig. 33-100

Species: TBEV (10-mers)

| protein | block starting position | block entropy | total peptides in block | # peptides required to cover 99% of block | gap/x fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2640 | 0.2 | 2 | 2 | 0 | Y | GMDVFSMQPH | 96.88 | GMDVFSMQPH | 3.12 | | | | |
| NS5 | 2641 | 0.2 | 2 | 2 | 0 | Y | MDVFSMQPHR | 96.88 | VDVFSMQPHR | 3.12 | | | | |
| NS5 | 2642 | 0 | 1 | 1 | 0 | Y | DVFSMQPHRA | 100 | | | | | | |
| NS5 | 2643 | 0 | 1 | 1 | 0 | Y | VFSMQPHRAD | 100 | | | | | | |
| NS5 | 2644 | 0 | 1 | 1 | 0 | Y | FSMQPHRADT | 100 | | | | | | |
| NS5 | 2645 | 0.76 | 2 | 2 | 0 | Y | SMQPHRADTI | 78.12 | SMQPHRADTV | 21.88 | | | | |
| NS5 | 2646 | 0.76 | 2 | 2 | 0 | Y | MQPHRADTIM | 78.12 | MQPHRADTVM | 21.88 | | | | |
| NS5 | 2647 | 0.76 | 2 | 2 | 0 | Y | QPHRADTIMC | 78.12 | QPHRADTVMC | 21.88 | | | | |
| NS5 | 2648 | 0.76 | 2 | 2 | 0 | Y | PHRADTIMCD | 78.12 | PHRADTVMCD | 21.88 | | | | |
| NS5 | 2649 | 0.76 | 2 | 2 | 0 | Y | HRADTIMCDI | 78.12 | HRADTVMCDI | 21.88 | | | | |
| NS5 | 2650 | 0.76 | 2 | 2 | 0 | Y | RADTIMCDIG | 78.12 | RADTVMCDIG | 21.88 | | | | |
| NS5 | 2651 | 0.76 | 2 | 2 | 0 | Y | ADTIMCDIGE | 78.12 | ADTVMCDIGE | 21.88 | | | | |
| NS5 | 2652 | 0.76 | 2 | 2 | 0 | Y | DTIMCDIGES | 78.12 | DTVMCDIGES | 21.88 | | | | |
| NS5 | 2653 | 1.45 | 4 | 4 | 0 | Y | TIMCDIGESN | 62.5 | TVMCDIGES | 18.75 | TIMCDIGESS | 15.62 | TVMCDIGESN | 3.12 |
| NS5 | 2654 | 1.45 | 4 | 4 | 0 | Y | IMCDIGESNP | 62.5 | VMCDIGESSP | 18.75 | IMCDIGESSP | 15.62 | VMCDIGESNP | 3.12 |
| NS5 | 2655 | 0.93 | 2 | 2 | 0 | Y | MCDIGESNPD | 65.62 | MCDIGESSPD | 34.38 | | | | |
| NS5 | 2656 | 0.93 | 2 | 2 | 0 | Y | CDIGESNPDA | 65.62 | CDIGESSPDA | 34.38 | | | | |
| NS5 | 2657 | 1.32 | 3 | 3 | 0 | Y | DIGESNPDAV | 56.25 | DIGESSPDAV | 34.38 | DIGESNPDAA | 9.38 | | |
| NS5 | 2658 | 1.32 | 3 | 3 | 0 | Y | IGESNPDAVV | 56.25 | IGESSPDAAV | 34.38 | IGESNPDAAV | 9.38 | | |
| NS5 | 2659 | 1.32 | 3 | 3 | 0 | Y | GESNPDAVVE | 56.25 | GESSPDAAVE | 34.38 | GESNPDAAVE | 9.38 | | |
| NS5 | 2660 | 1.32 | 3 | 3 | 0 | Y | ESNPDAVVEG | 56.25 | ESSPDAAVEG | 34.38 | ESNPDAAVEG | 9.38 | | |
| NS5 | 2661 | 1.32 | 3 | 3 | 0 | Y | SNPDAVVEGE | 56.25 | SSPDAAVEGE | 34.38 | SNPDAAVEGE | 9.38 | | |
| NS5 | 2662 | 1.49 | 4 | 4 | 0 | Y | NPDAVVEGER | 53.12 | SPDAAVEGER | 34.38 | NPDAAVEGER | 9.38 | NPDAVVEGEK | 3.12 |
| NS5 | 2663 | 1.16 | 3 | 3 | 0 | Y | PDAVVEGERT | 53.12 | PDAAVEGERT | 43.75 | PDAVVEGEKT | 3.12 | | |

Fig. 33-101

Species: TBEV (10-mers)

| protein | block starting position |

Fig. 33-102

Species: TBEV (10-mers)

| protein | block starting position | block entropy | total peptides in block | # peptides required to cover 99% of block | gap/X fraction | 99% of block covered w/ => 5 peptides? | peptides required

Fig. 33-103

Species: TBEV (10-mers)

| protein | block starting position | block entropy | total peptides in block | # peptides required to cover 99% of block |

Species: TBEV (10-mers)

Fig. 33-104

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2736 | 0.2 | 2 | 2 | 0 | Y | AVTGNIVNSV | 96.88 | AITGNIVNSV | 3.12 | | | | |
| NS5 | 2737 | 0.2 | 2 | 2 | 0 | Y | VTGNIVNSVN | 96.88 | ITGNIVNSVN | 3.12 | | | | |
| NS5 | 2738 | 0.7 | 2 | 2 | 0 | Y | TGNIVNSVNI | 81.25 | TGNIVNSVNV | 18.75 | | | | |
| NS5 | 2739 | 0.7 | 2 | 2 | 0 | Y | GNIVNSVNIQ | 81.25 | GNIVNSVNVQ | 18.75 | | | | |
| NS5 | 2740 | 0.7 | 2 | 2 | 0 | Y | NIVNSVNIQS | 81.25 | NIVNSVNVQS | 18.75 | | | | |
| NS5 | 2741 | 0.7 | 2 | 2 | 0 | Y | IVNSVNIQSR | 81.25 | IVNSVNVQSR | 18.75 | | | | |
| NS5 | 2742 | 0.7 | 2 | 2 | 0 | Y | VNSVNIQSRK | 81.25 | VNSVNVQSRK | 18.75 | | | | |
| NS5 | 2743 | 0.7 | 2 | 2 | 0 | Y | NSVNIQSRKL | 81.25 | NSVNVQSRKL | 18.75 | | | | |
| NS5 | 2744 | 0.7 | 2 | 2 | 0 | Y | SVNIQSRKLL | 81.25 | SVNVQSRKLL | 18.75 | | | | |
| NS5 | 2745 | 0.7 | 2 | 2 | 0 | Y | VNIQSRKLLA | 81.25 | VNVQSRKLLA | 18.75 | | | | |
| NS5 | 2746 | 0.7 | 2 | 2 | 0 | Y | NIQSRKLLAR | 81.25 | NVQSRKLLAR | 18.75 | | | | |
| NS5 | 2747 | 0.7 | 2 | 2 | 0 | Y | IQSRKLLARF | 81.25 | VQSRKLLARF | 18.75 | | | | |
| NS5 | 2748 | 0.2 | 2 | 2 | 0 | Y | QSRKLLARFG | 96.88 | QSRKLLARFA | 3.12 | | | | |
| NS5 | 2749 | 0.2 | 2 | 2 | 0 | Y | SRKLLARFGD | 96.88 | SRKLLARFAG | 3.12 | | | | |
| NS5 | 2750 | 0.2 | 2 | 2 | 0 | Y | RKLLARFGDQ | 96.88 | RKLLARFAGQ | 3.12 | | | | |
| NS5 | 2751 | 0.2 | 2 | 2 | 0 | Y | KLLARFGDQR | 96.88 | KLLARFAGQR | 3.12 | | | | |
| NS5 | 2752 | 0.2 | 2 | 2 | 0 | Y | LLARFGDQRG | 96.88 | LLARFAGQRG | 3.12 | | | | |
| NS5 | 2753 | 0.2 | 2 | 2 | 0 | Y | LARFGDQRGP | 96.88 | LARFAGQRGP | 3.12 | | | | |
| NS5 | 2754 | 0.2 | 2 | 2 | 0 | Y | ARFGDQRGPT | 96.88 | ARFAGQRGPT | 3.12 | | | | |
| NS5 | 2755 | 0.53 | 3 | 3 | 0 | Y | RFGDQRGPTR | 90.62 | RFGDQRGPTK | 6.25 | RFAGQRGPTR | 3.12 | | |
| NS5 | 2756 | 0.53 | 3 | 3 | 0 | Y | FGDQRGPTRV | 90.62 | FGDQRGPTKV | 6.25 | FAGQRGPTRV | 3.12 | | |
| NS5 | 2757 | 0.53 | 3 | 3 | 0 | Y | GDQRGPTRVP | 90.62 | GDQRGPTKVP | 6.25 | AGQRGPTRVP | 3.12 | | |
| NS5 | 2758 | 0.53 | 3 | 3 | 0 | Y | DQRGPTRVPE | 90.62 | DQRGPTKVPE | 6.25 | GQRGPTRVPE | 3.12 | | |
| NS5 | 2759 | 0.34 | 2 | 2 | 0 | Y | QRGPTRVPEL | 93.75 | QRGPTKVPEL | 6.25 | | | | |

Fig. 33-105

Species: TBEV (10-mers)

| protein | block starting position | block entropy | total peptides in block | # peptides required to cover 99% of block | gap/x fraction | 99% of block covered w/ => 5 peptides? | peptides required to cover 99% of block | frequency | peptides required to cover 99% of

Fig. 33-106

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 33-107

Species: TBEV (10-mers)

| protein | block starting position | block entropy | total peptides in block | #

Fig. 33-108

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides

Fig. 33-109

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block

Fig. 33-110

Species: TBEV (10-mers)

| protein | block starting position | block entropy | total peptides in block | # peptides required to cover 99% of block | gap/X fraction | 99% of block covered w/ >= 5 peptides? | peptides required to cover 99% of block

Fig. 33-111

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of

Fig. 33-112

Species: TBEV (10-mers)

| protein | block starting position | block entropy | total peptides in block | # peptides required to cover 99% of block | cover/gap fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2969 | 0 | 1 | 1 | 0 | Y | KREKKLGEFG | 100 | | |
| NS5 | 2970 | 0 | 1 | 1 | 0 | Y | REKKLGEFGV | 100 | | |
| NS5 | 2971 | 0.2 | 2 | 2 | 0 | Y | EKKLGEFGVA | 96.88 | EKKLGEFGVS | 3.12 |
| NS5 | 2972 | 0.2 | 2 | 2 | 0 | Y | KKLGEFGVAK | 96.88 | KKLGEFGVSK | 3.12 |
| NS5 | 2973 | 0.2 | 2 | 2 | 0 | Y | KLGEFGVAKG | 96.88 | KLGEFGVSKG | 3.12 |
| NS5 | 2974 | 0.2 | 2 | 2 | 0 | Y | LGEFGVAKGS | 96.88 | LGEFGVSKGS | 3.12 |
| NS5 | 2975 | 0.2 | 2 | 2 | 0 | Y | GEFGVAKGSR | 96.88 | GEFGVSKGSR | 3.12 |
| NS5 | 2976 | 0.2 | 2 | 2 | 0 | Y | EFGVAKGSRA | 96.88 | EFGVSKGSRA | 3.12 |
| NS5 | 2977 | 0.2 | 2 | 2 | 0 | Y | FGVAKGSRAI | 96.88 | FGVSKGSRAM | 3.12 |
| NS5 | 2978 | 0.2 | 2 | 2 | 0 | Y | GVAKGSRAIW | 96.88 | GVSKGSRAMW | 3.12 |
| NS5 | 2979 | 0.2 | 2 | 2 | 0 | Y | VAKGSRAIWY | 96.88 | VSKGSRAMWY | 3.12 |
| NS5 | 2980 | 0.2 | 2 | 2 | 0 | Y | AKGSRAIWYM | 96.88 | SKGSRAMWYM | 3.12 |
| NS5 | 2981 | 0.2 | 2 | 2 | 0 | Y | KGSRAIWYMW | 96.88 | KGSRAMWYMW | 3.12 |
| NS5 | 2982 | 0.2 | 2 | 2 | 0 | Y | GSRAIWYMWL | 96.88 | GSRAMWYMWL | 3.12 |
| NS5 | 2983 | 0.2 | 2 | 2 | 0 | Y | SRAIWYMWLG | 96.88 | SRAMWYMWLG | 3.12 |
| NS5 | 2984 | 0.2 | 2 | 2 | 0 | Y | RAIWYMWLGS | 96.88 | RAMWYMWLGS | 3.12 |
| NS5 | 2985 | 0.2 | 2 | 2 | 0 | Y | AIWYMWLGSR | 96.88 | AMWYMWLGSR | 3.12 |
| NS5 | 2986 | 0.2 | 2 | 2 | 0 | Y | IWYMWLGSRF | 96.88 | MWYMWLGSRF | 3.12 |
| NS5 | 2987 | 0.2 | 2 | 2 | 0 | Y | WYMWLGSRFL | 96.88 | WYMWLGSRFQ | 3.12 |
| NS5 | 2988 | 0.2 | 2 | 2 | 0 | Y | YMWLGSRFLE | 96.88 | YMWLGSRFQE | 3.12 |
| NS5 | 2989 | 0.2 | 2 | 2 | 0 | Y | MWLGSRFLEF | 96.88 | MWLGSRFQEF | 3.12 |
| NS5 | 2990 | 0.2 | 2 | 2 | 0 | Y | WLGSRFLEFE | 96.88 | WLGSRFQEFE | 3.12 |
| NS5 | 2991 | 0.2 | 2 | 2 | 0 | Y | LGSRFLEFEA | 96.88 | LGSRFQEFEA | 3.12 |
| NS5 | 2992 | 0.2 | 2 | 2 | 0 | Y | GSRFLEFEAL | 96.88 | GSRFQEFEAL | 3.12 |

Fig. 33-113

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 33-114

Species: TBEV (10-mers)

| protein | block starting position | block

Fig. 33-115

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3048 | 0 | 1

Fig. 33-116

Species: TBEV (10

Fig. 33-117

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3096 | 0.64 | 3 | 3 | 0 | Y | SRDGGCVMDV | 87.5 | SRDGGCVMDV | 9.38 | SREGGCVMDV | 3.12 | | |
| NS5 | 3097 | 0.64 | 3 | 3 | 0 | Y | RDGGCVMDVI | 87.5 | RDGGCVMDVI | 9.38 | REGGCVMDVI | 3.12 | | |
| NS5 | 3098 | 0.64 | 3 | 3 | 0 | Y | DGGCVMDVIT | 87.5 | DGGCVMDVIT | 9.38 | EGGCVMDVIT | 3.12 | | |
| NS5 | 3099 | 0.54 | 2 | 2 | 0 | Y | GGCVMDVITR | 87.5 | GGCVMDVITR | 12.50 | | | | |
| NS5 | 3100 | 0.54 | 2 | 2 | 0 | Y | GCVMDVITRR | 87.5 | GCVMDVITRR | 12.50 | | | | |
| NS5 | 3101 | 0.54 | 2 | 2 | 0 | Y | CVMDVITRRD | 87.5 | CVMDVITRRD | 12.50 | | | | |
| NS5 | 3102 | 0.54 | 2 | 2 | 0 | Y | VMDVITRRDQ | 87.5 | VMDVITRRDQ | 12.50 | | | | |
| NS5 | 3103 | 0 | 1 | 1 | 0 | Y | MDVITRRDQR | 100 | | | | | | |
| NS5 | 3104 | 0 | 1 | 1 | 0 | Y | DVITRRDQRG | 100 | | | | | | |
| NS5 | 3105 | 0 | 1 | 1 | 0 | Y | VITRRDQRGS | 100 | | | | | | |
| NS5 | 3106 | 0.2 | 2 | 2 | 0 | Y | ITRRDQRGSG | 96.88 | ITRRDQRGSV | 3.12 | | | | |
| NS5 | 3107 | 0.2 | 2 | 2 | 0 | Y | TRRDQRGSGQ | 96.88 | TRRDQRGSVQ | 3.12 | | | | |
| NS5 | 3108 | 0.2 | 2 | 2 | 0 | Y | RRDQRGSGQV | 96.88 | RRDQRGSVQV | 3.12 | | | | |
| NS5 | 3109 | 0.2 | 2 | 2 | 0 | Y | RDQRGSGQVW | 96.88 | RDQRGSVQVW | 3.12 | | | | |
| NS5 | 3110 | 0.2 | 2 | 2 | 0 | Y | DQRGSGQVWT | 96.88 | DQRGSVQVWT | 3.12 | | | | |
| NS5 | 3111 | 0.2 | 2 | 2 | 0 | Y | QRGSGQVWTY | 96.88 | QRGSVQVWTY | 3.12 | | | | |
| NS5 | 3112 | 0.2 | 2 | 2 | 0 | Y | RGSGQVWTYA | 96.88 | RGSVQVWTYA | 3.12 | | | | |
| NS5 | 3113 | 0.2 | 2 | 2 | 0 | Y | GSGQVWTYAL | 96.88 | GSVQVWTYAL | 3.12 | | | | |
| NS5 | 3114 | 0.2 | 2 | 2 | 0 | Y | SGQVWTYALN | 96.88 | SVQVWTYALN | 3.12 | | | | |
| NS5 | 3115 | 0.2 | 2 | 2 | 0 | Y | GQVWTYALNT | 96.88 | VQVWTYALNT | 3.12 | | | | |
| NS5 | 3116 | 0.2 | 2 | 2 | 0 | Y | QVWTYALNTL | 96.88 | QVWTYALNTH | 3.12 | | | | |
| NS5 | 3117 | 0.2 | 2 | 2 | 0 | Y | VWTYALNTLT | 96.88 | VWTYALNTHT | 3.12 | | | | |
| NS5 | 3118 | 0.2 | 2 | 2 | 0 | Y | VTYALNTLTN | 96.88 | VTYALNTHTN | 3.12 | | | | |
| NS5 | 3119 | 0.2 | 2 | 2 | 0 | Y | TYALNTLTNI | 96.88 | TYALNTHTNI | 3.12 | | | | |

Fig. 33-118

Species: TBEV (10-mers)

| protein | block starting position | block entropy | total peptides in block | # peptides required to cover

Fig. 33-119

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3144 | 1.71 | 4 | 4 | 0 | Y | ASDAHNPRLL | 40.62 | AADAHNPRLL | 31.25 | ATDAHNPRLL | 25.00 | ATDAHNPRLF | 3.12 | | |
| NS5 | 3145 | 1.71 | 4 | 4 | 0 | Y | SDAHNPRLLR | 40.62 | ADAHNPRLLR | 31.25 | TDAHNPRLLR | 25.00 | TDAHNPRLFR | 3.12 | | |
| NS5 | 3146 | 0.2 | 2 | 2 | 0 | Y | DAHNPRLLRV | 96.88 | DAHNPRLFRV | 3.12 | | | | | | |
| NS5 | 3147 | 0.2 | 2 | 2 | 0 | Y | AHNPRLLRVE | 96.88 | AHNPRLFRVE | 3.12 | | | | | | |
| NS5 | 3148 | 0.2 | 2 | 2 | 0 | Y | HNPRLLRVER | 96.88 | HNPRLFRVER | 3.12 | | | | | | |
| NS5 | 3149 | 0.2 | 2 | 2 | 0 | Y | NPRLLRVERW | 96.88 | NPRLFRVERW | 3.12 | | | | | | |
| NS5 | 3150 | 0.2 | 2 | 2 | 0 | Y | PRLLRVERWL | 96.88 | PRLFRVERWL | 3.12 | | | | | | |
| NS5 | 3151 | 1.16 | 3 | 3 | 0 | Y | RLLRVERWLR | 53.12 | RLFRVERWLR | 43.75 | | | | | | |
| NS5 | 3152 | 1.5 | 5 | 5 | 0 | Y | LLRVERWLRD | 46.88 | LFRVERWLRD | 43.75 | LLRVERWLKE | 3.12 | LLRVERWLKE | 3.12 | LLRVERWLRN | 3.12 |
| NS5 | 3154 | 1.5 | 5 | 5 | 0 | Y | RVERWLRDHG | 46.88 | RVERWLRNHG | 43.75 | RVERWLKEHG | 3.12 | RVERWLRDYG | 3.12 | RVERWLREHG | 3.12 |
| NS5 | 3161 | 1.5 | 5 | 5 | 0 | Y | DHGEERLGRM | 46.88 | NHGEERLGRM | 43.75 | EHGEERLGRM | 3.12 | EHGEERLGRM | 3.12 | DYGEERLGRM | 3.12 |
| NS5 | 3162 | 0.4 | 3 | 3 | 0 | Y | HGEERLGRML | 93.75 | YGEERLGRML | 3.12 | | | | | | |
| NS5 | 3163 | 0.2 | 2 | 2 | 0 | Y | GEERLGRMLV | 96.88 | GGERLGRMLV | 3.12 | | | | | | |
| NS5 | 3164 | 0.2 | 2 | 2 | 0 | Y | EERLGRMLVS | 96.88 | GERLGRMLVS | 3.12 | | | | | | |
| NS5 | 3165 | 0 | 1 | 1 | 0 | Y | ERLGRMLVSG | 100 | | | | | | | | |
| NS5 | 3166 | 0 | 1 | 1 | 0 | Y | RLGRMLVSGD | 100 | | | | | | | | |
| NS5 | 3167 | 0 | 1 | 1 | 0 | Y | LGRMLVSGDD | 100 | | | | | | | | |
| NS5 | 3168 | 0 | 1 | 1 | 0 | Y | GRMLVSGDDC | 100 | | | | | | | | |
| NS5 | 3169 | 0 | 1 | 1 | 0 | Y | RMLVSGDDCV | 100 | | | | | | | | |
| NS5 | 3170 | 0 | 1 | 1 | 0 | Y | MLVSGDDCVV | 100 | | | | | | | | |
| NS5 | 3171 | 0 | 1 | 1 | 0 | Y | LVSGDDCVVR | 100 | | | | | | | | |
| NS5 | 3172 | 0.2 | 2 | 2 | 0 | Y | VSGDDCVVRP | 96.88 | VSGDDCVVRG | 3.12 | | | | | | |
| NS5 | 3173 | 1.48 | 4 | 4 | 0 | Y | SGDDCVVRPV | 59.38 | SGDDCVVRPL | 25.00 | SGDDCVVRPL | 12.50 | SGDDCVVRGI | 3.12 | | |
| NS5 | 3174 | 1.48 | 4 | 4 | 0 | Y | GDDCVVRPVD | 59.38 | GDDCVVRPLD | 25.00 | GDDCVVRPID | 12.50 | GDDCVVRGID | 3.12 | | |

Fig. 33-120

Species: TBEV (10-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3175 | 1.48 | 4 | 4 | 0 | Y | DDCVVRPVDD | 59.38 | DDCVVRPLDD | 25.00 | DDCVVRPIDD | 12.50 | DDCVVRGIDD | 3.12 | | |
| NS5 | 3176 | 1.48 | 4 | 4 | 0 | Y | DCVVRPVDDR | 59.38 | DCVVRPLDDR | 25.00 | DCVVRPIDDR | 12.50 | DCVVRGIDDR | 3.12 | | |
| NS5 | 3177 | 1.48 | 4 | 4 | 0 | Y | CVVRPVDDRF | 59.38 | CVVRPLDDRF | 25.00 | CVVRPIDDRF | 12.50 | CVVRGIDDRF | 3.12 | | |
| NS5 | 3178 | 1.85 | 5 | 5 | 0 | Y | VVRPVDDRFS | 50 | VVRPLDDRFG | 25.00 | VVRPIDDRFG | 12.50 | VVRPDDRFG | 9.38 | VVRGIDDRFG | 3.12 |
| NS5 | 3183 | 1.91 | 5 | 5 | 0 | Y | DDRFGKALYF | 43.75 | DDRFSKALYF | 25.00 | DDRFSRALYF | 21.88 | DDRFGRALYF | 6.25 | DDRFSGALYF | 3.12 |
| NS5 | 3184 | 1.91 | 5 | 5 | 0 | Y | DRFGKALYFL | 43.75 | DRFSKALYFL | 25.00 | DRFSRALYFL | 21.88 | DRFGRALYFL | 6.25 | DRFSGALYFL | 3.12 |
| NS5 | 3185 | 1.91 | 5 | 5 | 0 | Y | RFGKALYFLN | 43.75 | RFSKALYFLN | 25.00 | RFSRALYFLN | 21.88 | RFGRALYFLN | 6.25 | RFSGALYFLN | 3.12 |
| NS5 | 3186 | 1.91 | 5 | 5 | 0 | Y | FGKALYFLND | 43.75 | FSKALYFLND | 25.00 | FSRALYFLND | 21.88 | FGRALYFLND | 6.25 | FSGALYFLND | 3.12 |
| NS5 | 3187 | 1.91 | 5 | 5 | 0 | Y | GKALYFLNDM | 43.75 | SKALYFLNDM | 25.00 | SRALYFLNDM | 21.88 | GRALYFLNDM | 6.25 | SGALYFLNDM | 3.12 |
| NS5 | 3188 | 1.04 | 3 | 3 | 0 | Y | KALYFLNDMA | 68.75 | RALYFLNDMA | 28.12 | GALYFLNDMA | 3.12 | | | | |
| NS5 | 3189 | 0 | 1 | 1 | 0 | Y | ALYFLNDMAK | 100 | | | | | | | | |
| NS5 | 3190 | 0 | 1 | 1 | 0 | Y | LYFLNDMAKT | 100 | | | | | | | | |
| NS5 | 3191 | 0 | 1 | 1 | 0 | Y | YFLNDMAKTR | 100 | | | | | | | | |
| NS5 | 3192 | 0 | 1 | 1 | 0 | Y | FLNDMAKTRK | 100 | | | | | | | | |
| NS5 | 3193 | 0 | 1 | 1 | 0 | Y | LNDMAKTRKD | 100 | | | | | | | | |
| NS5 | 3194 | 0.9 | 2 | 2 | 0 | Y | NDMAKTRKDI | 68.75 | NDMAKTRKDV | 31.25 | | | | | | |
| NS5 | 3195 | 0.9 | 2 | 2 | 0 | Y | DMAKTRKDIG | 68.75 | DMAKTRKDVG | 31.25 | | | | | | |
| NS5 | 3196 | 0.9 | 2 | 2 | 0 | Y | MAKTRKDIGE | 68.75 | MAKTRKDVGE | 31.25 | | | | | | |
| NS5 | 3197 | 0.9 | 2 | 2 | 0 | Y | AKTRKDIGEW | 68.75 | AKTRKDVGEW | 31.25 | | | | | | |
| NS5 | 3198 | 0.9 | 2 | 2 | 0 | Y | KTRKDIGEWE | 68.75 | KTRKDVGEWE | 31.25 | | | | | | |
| NS5 | 3199 | 0.9 | 2 | 2 | 0 | Y | TRKDIGEWEH | 68.75 | TRKDVGEWEH | 31.25 | | | | | | |
| NS5 | 3200 | 0.9 | 2 | 2 | 0 | Y | RKDIGEWEHS | 68.75 | RKDVGEWEHS | 31.25 | | | | | | |
| NS5 | 3201 | 1.57 | 3 | 3 | 0 | Y | KDIGEWEHSV | 40.62 | KDVGEWEHSV | 31.25 | KDIGEWEHSA | 28.12 | | | | |
| NS5 | 3202 | 1.57 | 3 | 3 | 0 | Y | DIGEWEHSVG | 40.62 | DVGEWEHSVG | 31.25 | DIGEWEHSAG | 28.12 | | | | |

Fig. 33-121

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3203 | 1.71 | 4 | 4 | 0 | Y | IGEWEHSVGF | 40.62 | VGEWEHSVGF | 31.25 | IGEWEHSAGF | 25.00 | IGEWEHSAGL | 3.12 |
| NS5 | 3204 | 1.13 | 4 | 4 | 0 | Y | GEWEHSVGFS | 71.88 | GEWEHSAGFS | 21.88 | GEWEHSAGFA | 3.12 | GEWEHSAGLS | 3.12 |
| NS5 | 3214 | 1.48 | 5 | 5 | 0 | Y | NWEEVPFCSH | 53.12 | SWEEVPFCSH | 37.50 | SWEAVPFCSH | 3.12 | GWEEVPFCSH | 3.12 | SWEEVPFCSH | 3.12 |
| NS5 | 3215 | 0.4 | 3 | 3 | 0 | Y | WEEVPFCSHH | 93.75 | WEAVPFCSHH | 3.12 | VEEVPFCSHH | 3.12 | | | | |
| NS5 | 3216 | 0.2 | 2 | 2 | 0 | Y | EEVPFCSHHF | 96.88 | EAVPFCSHHF | 3.12 | | | | | | |
| NS5 | 3217 | 0.2 | 2 | 2 | 0 | Y | EVPFCSHHFH | 96.88 | AVPFCSHHFH | 3.12 | | | | | | |
| NS5 | 3218 | 0 | 1 | 1 | 0 | Y | VPFCSHHFHE | 100 | | | | | | | | |
| NS5 | 3219 | 0 | 1 | 1 | 0 | Y | PFCSHHFHEL | 100 | | | | | | | | |
| NS5 | 3220 | 0 | 1 | 1 | 0 | Y | FCSHHFHELV | 100 | | | | | | | | |
| NS5 | 3221 | 0 | 1 | 1 | 0 | Y | CSHHFHELVM | 100 | | | | | | | | |
| NS5 | 3222 | 0 | 1 | 1 | 0 | Y | SHHFHELVMK | 100 | | | | | | | | |
| NS5 | 3223 | 0 | 1 | 1 | 0 | Y | HHFHELVMKD | 100 | | | | | | | | |
| NS5 | 3224 | 0 | 1 | 1 | 0 | Y | HFHELVMKDG | 100 | | | | | | | | |
| NS5 | 3225 | 0 | 1 | 1 | 0 | Y | FHELVMKDGR | 100 | | | | | | | | |
| NS5 | 3226 | 1.5 | 3 | 3 | 0 | Y | HELVMKDGRA | 50 | HELVMKDGRT | 25.00 | HELVMKDGRS | 25.00 | | |
| NS5 | 3227 | 1.5 | 3 | 3 | 0 | Y | ELVMKDGRAL | 50 | ELVMKDGRSL | 25.00 | ELVMKDGRTL | 25.00 | | |
| NS5 | 3228 | 1.91 | 4 | 4 | 0 | Y | LVMKDGRALI | 37.5 | LVMKDGRSLI | 25.00 | LVMKDGRTLV | 25.00 | LVMKDGRALV | 12.50 |
| NS5 | 3229 | 1.91 | 4 | 4 | 0 | Y | VMKDGRALIV | 37.5 | VMKDGRTLVW | 25.00 | VMKDGRSLIV | 25.00 | VMKDGRALVW | 12.50 |
| NS5 | 3230 | 1.91 | 4 | 4 | 0 | Y | MKDGRALIVP | 37.5 | MKDGRTLVWP | 25.00 | MKDGRSLIVP | 25.00 | MKDGRALVWP | 12.50 |
| NS5 | 3231 | 1.91 | 4 | 4 | 0 | Y | KDGRALIVPC | 37.5 | KDGRTLVWPC | 25.00 | KDGRSLIVPC | 25.00 | KDGRALVWPC | 12.50 |
| NS5 | 3232 | 1.91 | 4 | 4 | 0 | Y | DGRALIVPCR | 37.5 | DGRSLIVPCR | 25.00 | DGRTLVWPCR | 25.00 | DGRALVWPCR | 12.50 |
| NS5 | 3233 | 1.91 | 4 | 4 | 0 | Y | GRALIVPCRD | 37.5 | GRSLIVPCRD | 25.00 | GRTLVPCRD | 25.00 | GRALVWPCRD | 12.50 |
| NS5 | 3234 | 1.91 | 4 | 4 | 0 | Y | RALIVPCRDQ | 37.5 | RSLIVPCRDQ | 25.00 | RTLVWPCRDQ | 25.00 | RALVWPCRDQ | 12.50 |
| NS5 | 3235 | 1.91 | 4 | 4 | 0 | Y | ALIVPCRDQD | 37.5 | SLIVPCRDQD | 25.00 | TLVWPCRDQD | 25.00 | ALVWPCRDQD | 12.50 |

Fig. 33-122

Species: TBEV (10-mers)

| protein | block starting position | block entropy | total peptides in block | # peptides required to cover 99% of block | gap/X fraction | 99% of block covered w/ => 5 peptides?

Fig. 33-123

Species: TBEV (10

Fig. 33-124

Species: TBEV (10-mers)

| protein | block starting position | block entropy | total peptides in block | # peptides required to cover 99% of block | gap/X fraction | 99% of block

Fig. 33-125

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

Fig. 33-126

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3350 | 1.45 | 3 | 3 | 0 | Y | YLPKSHDMLC | 53.12 | YLPKAQDMLC | 28.12 | YLPKAHDMLC | 18.75 | | |
| NS5 | 3351 | 1.45 | 3 | 3 | 0 | Y | LPKSHDMLCS | 53.12 | LPKAQDMLCS | 28.12 | LPKAHDMLCS | 18.75 | | |
| NS5 | 3352 | 1.45 | 3 | 3 | 0 | Y | PKSHDMLCSS | 53.12 | PKAQDMLCSS | 28.12 | PKAHDMLCSS | 18.75 | | |
| NS5 | 3353 | 1.45 | 3 | 3 | 0 | Y | KSHDMLCSSL | 53.12 | KAQDMLCSSL | 28.12 | KAHDMLCSSL | 18.75 | | |
| NS5 | 3354 | 1.45 | 3 | 3 | 0 | Y | SHDMLCSSLV | 53.12 | AQDMLCSSLV | 28.12 | AHDMLCSSLV | 18.75 | | |
| NS5 | 3355 | 0.86 | 2 | 2 | 0 | Y | HDMLCSSLVG | 71.88 | QDMLCSSLVG | 28.12 | | | | |
| NS5 | 3356 | 0 | 1 | 1 | 0 | Y | DMLCSSLVGR | 100 | | | | | | |
| NS5 | 3357 | 0.64 | 3 | 3 | 0 | Y | MLCSSLVGRK | 87.5 | MLCSSLVGRR | 9.38 | MLCSSLVGRT | 3.12 | | |
| NS5 | 3358 | 0.64 | 3 | 3 | 0 | Y | LCSSLVGRKE | 87.5 | LCSSLVGRRE | 9.38 | LCSSLVGRTE | 3.12 | | |
| NS5 | 3359 | 0.64 | 3 | 3 | 0 | Y | CSSLVGRKER | 87.5 | CSSLVGRRER | 9.38 | CSSLVGRTER | 3.12 | | |
| NS5 | 3360 | 0.64 | 3 | 3 | 0 | Y | SSLVGRKERA | 87.5 | SSLVGRRERA | 9.38 | SSLVGRTERA | 3.12 | | |
| NS5 | 3361 | 0.64 | 3 | 3 | 0 | Y | SLVGRKERAE | 87.5 | SLVGRRERAE | 9.38 | SLVGRTERAE | 3.12 | | |
| NS5 | 3362 | 0.64 | 3 | 3 | 0 | Y | LVGRKERAEW | 87.5 | LVGRRERAEW | 9.38 | LVGRTERAEW | 3.12 | | |
| NS5 | 3363 | 0.64 | 3 | 3 | 0 | Y | VGRKERAEWA | 87.5 | VGRRERAEWA | 9.38 | VGRTERAEWA | 3.12 | | |
| NS5 | 3364 | 0.97 | 4 | 4 | 0 | Y | GRKERAEWAK | 81.25 | GRRERAEWAK | 9.38 | GRKERAEWAR | 6.25 | GRTERAEWAK | 3.12 |
| NS5 | 3365 | 0.97 | 4 | 4 | 0 | Y | RKERAEWAKN | 81.25 | RKERAEWAKN | 9.38 | RKERAEWARN | 6.25 | RTERAEWAKN | 3.12 |
| NS5 | 3366 | 0.97 | 4 | 4 | 0 | Y | KERAEWAKNI | 81.25 | KERAEWAKNI | 9.38 | KERAEWARNI | 6.25 | TERAEWAKNI | 3.12 |
| NS5 | 3367 | 0.34 | 2 | 2 | 0 | Y | ERAEWAKNIW | 93.75 | ERAEWARNIW | 6.25 | | | | |
| NS5 | 3368 | 0.34 | 2 | 2 | 0 | Y | RAEWAKNIWG | 93.75 | RAEWARNIWG | 6.25 | | | | |
| NS5 | 3369 | 0.34 | 2 | 2 | 0 | Y | AEWAKNIWGA | 93.75 | AEWARNIWGA | 6.25 | | | | |
| NS5 | 3370 | 0.34 | 2 | 2 | 0 | Y | EWAKNIWGAV | 93.75 | EWARNIWGAV | 6.25 | | | | |
| NS5 | 3371 | 0.34 | 2 | 2 | 0 | Y | WAKNIWGAVE | 93.75 | WARNIWGAVE | 6.25 | | | | |
| NS5 | 3372 | 0.34 | 2 | 2 | 0 | Y | AKNIWGAVEK | 93.75 | ARNIWGAVEK | 6.25 | | | | |
| NS5 | 3373 | 0.34 | 2 | 2 | 0 | Y | KNIWGAVEKV | 93.75 | RNIWGAVEKV | 6.25 | | | | |

Fig. 33-127

Species: TBEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency

Fig. 34-1

Species: TBEV (11-mers)

| protein | block starting position | block entropy | total peptides in block | # peptides required to cover 99% of block | cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| anC | 1 | 1.46 | 3 | 3 | MAGKAILKGKG | 0 | Y | MVKKAILKGKG | 53.12 | MVKKAILKGKG | 25 | MARKA

Fig. 34-2

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 25 | 1.69 | 4 | 4 | 0 | Y | KTRQSRVQMPN | 43.75 | KTRQSRVRMPN | 28.12 | KTRQPRVQMPN | 28.12 | KTRQSRVQMPS | 3.12 |
| anC | 26 | 1.69 | 4 | 4 | 0 | Y | TRQSRVQMPNG | 43.75 | TRQSRVRMPNG | 28.12 | TRQPRVQMPNG | 28.12 | TRQSRVQMPSG | 3.12 |
| anC | 27 | 1.69 | 4 | 4 | 0 | Y | RQSRVQMPNGL | 43.75 | RQSRVRMPNGL | 28.12 | RQPRVQMPNGL | 28.12 | RQSRVQMPSGL | 3.12 |
| anC | 28 | 1.69 | 4 | 4 | 0 | Y | QSRVQMPNGLV | 43.75 | QSRVRMPNGLV | 28.12 | QPRVQMPNGLV | 28.12 | QSRVQMPSGLV | 3.12 |
| anC | 29 | 1.69 | 4 | 4 | 0 | Y | SRVQMPNGLVL | 43.75 | SRVRMPNGLVL | 28.12 | PRVQMPNGLVL | 28.12 | SRVQMPSGLVL | 3.12 |
| anC | 30 | 1.04 | 3 | 3 | 0 | Y | RVQMPNGLVLM | 68.75 | RVRMPNGLVLM | 28.12 | RVQMPSGLVLM | 3.12 | | |
| anC | 31 | 1.04 | 3 | 3 | 0 | Y | VQMPNGLVLMR | 68.75 | VRMPNGLVLMR | 28.12 | VQMPSGLVLMR | 3.12 | | |
| anC | 32 | 1.04 | 3 | 3 | 0 | Y | QMPNGLVLMRM | 68.75 | RMPNGLVLMRM | 28.12 | QMPSGLVLMRM | 3.12 | | |
| anC | 33 | 0.64 | 3 | 3 | 0 | Y | MPNGLVLMRMM | 87.5 | MPNGLVLMRML | 9.38 | MPSGLVLMRMM | 3.12 | | |
| anC | 34 | 0.64 | 3 | 3 | 0 | Y | PNGLVLMRMMG | 87.5 | PNGLVLMRMLG | 9.38 | PSGLVLMRMMG | 3.12 | | |
| anC | 35 | 0.84 | 4 | 3 | 0 | Y | NGLVLMRMMGI | 84.38 | NGLVLMRMLGI | 9.38 | NGLVLMRMMGF | 9.38 | SGLVLMRMMGI | 3.12 |
| anC | 36 | 0.64 | 3 | 3 | 0 | Y | GLVLMRMMGIL | 87.5 | GLVLMRMLGIL | 9.38 | GLVLMRMMGFL | 9.38 | | |
| anC | 37 | 0.64 | 3 | 3 | 0 | Y | LVLMRMMGILW | 87.5 | LVLMRMLGILW | 9.38 | LVLMRMMGFLW | 9.38 | | |
| anC | 38 | 0.64 | 3 | 3 | 0 | Y | VLMRMMGILWH | 87.5 | VLMRMLGILWH | 9.38 | VLMRMMGFLWH | 9.38 | | |
| anC | 39 | 0.64 | 3 | 3 | 0 | Y | LMRMMGILWHA | 87.5 | LMRMLGILWHA | 9.38 | LMRMMGFLWHA | 9.38 | | |
| anC | 40 | 1.3 | 4 | 4 | 0 | Y | MRMMGILWHAV | 68.75 | MRMMGILWHAI | 18.75 | MRMLGILWHAV | 9.38 | MRMMGFLWHAI | 3.12 |
| anC | 41 | 1.3 | 4 | 4 | 0 | Y | RMMGILWHAVA | 68.75 | RMMGILWHAIA | 18.75 | RMLGILWHAVA | 9.38 | RMMGFLWHAIA | 3.12 |
| anC | 42 | 1.3 | 4 | 4 | 0 | Y | MMGILWHAVAG | 68.75 | MMGILWHAIAG | 18.75 | MLGILWHAVAG | 9.38 | MMGFLWHAIAG | 3.12 |
| anC | 43 | 1.3 | 4 | 4 | 0 | Y | MGILWHAVAGT | 68.75 | MGILWHAIAGT | 18.75 | LGILWHAVAGT | 9.38 | MGFLWHAIAGT | 3.12 |
| anC | 44 | 1.08 | 3 | 4 | 0 | Y | GILWHAVAGTA | 75 | GILWHAIAGTA | 18.75 | GFLWHAIAGTA | 3.12 | GILWHAVAGTV | 3.12 |
| anC | 45 | 1.08 | 3 | 3 | 0 | Y | ILWHAVAGTAR | 75 | ILWHAIAGTAR | 18.75 | FLWHAIAGTAR | 3.12 | | |
| anC | 46 | 1.64 | 4 | 4 | 0 | Y | LWHAVAGTARS | 50 | LWHAIAGTARS | 25 | LWHAIAGTARN | 18.75 | LWHAVAGTVRS | 3.12 |
| anC | 47 | 1.64 | 4 | 4 | 0 | Y | WHAVAGTARSP | 50 | WHAIAGTARSP | 25 | WHAVAGTARNP | 18.75 | WHAVAGTVRSP | 3.12 |
| anC | 48 | 1.64 | 4 | 4 | 0 | Y | HAVAGTARSPV | 50 | HAIAGTARSPV | 25 | HAVAGTARNPV | 18.75 | HAVAGTVRSPV | 3.12 |

Fig. 34-3

Species: TBEV (11-mers)

| protein | block starting position | block entropy | total peptides in block | # peptides required to cover 99

Fig. 34-4

Species: TBEV (11-mers)

| protein | block starting position | block entropy | total peptides in block | # peptides required to cover 99% of block |

Fig. 34-5

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 133 | 0.2 | 2 | 2 | 0 | Y | GKDAATQVRVE | 96.88 | GRDAATQVRVE | 3.12 | | | | | | |
| prM | 134 | 0.2 | 2 | 2 | 0 | Y | KDAATQVRVEN | 96.88 | RDAATQVRVEN | 3.12 | | | | | | |
| prM | 135 | 0 | 1 | 1 | 0 | Y | DAATQVRVENG | 100 | | | | | | | | |
| prM | 136 | 0 | 1 | 1 | 0 | Y | AATQVRVENGT | 100 | | | | | | | | |
| prM | 137 | 0 | 1 | 1 | 0 | Y | ATQVRVENGTC | 100 | | | | | | | | |
| prM | 138 | 0 | 1 | 1 | 0 | Y | TQVRVENGTCV | 100 | | | | | | | | |
| prM | 139 | 0 | 1 | 1 | 0 | Y | QVRVENGTCVI | 100 | | | | | | | | |
| prM | 140 | 0.2 | 2 | 2 | 0 | Y | VRVENGTCVIL | 96.88 | VRVENGTCVIM | 3.12 | | | | | | |
| prM | 141 | 0.64 | 3 | 3 | 0 | Y | RVENGTCVILA | 87.5 | RVENGTCVILY | 9.38 | RVENGTCVIMA | 3.12 | | | | |
| prM | 142 | 0.64 | 3 | 3 | 0 | Y | VENGTCVILAT | 87.5 | VENGTCVILVT | 9.38 | VENGTCVIMAT | 3.12 | | | | |
| prM | 143 | 0.64 | 3 | 3 | 0 | Y | ENGTCVILATD | 87.5 | ENGTCVILVTD | 9.38 | ENGTCVIMATD | 3.12 | | | | |
| prM | 144 | 0.64 | 3 | 3 | 0 | Y | NGTCVILATDM | 87.5 | NGTCVILVTDM | 9.38 | NGTCVIMATDM | 3.12 | | | | |
| prM | 145 | 0.64 | 3 | 3 | 0 | Y | GTCVILATDMG | 87.5 | GTCVILVTDMG | 9.38 | GTCVIMATDMG | 3.12 | | | | |
| prM | 146 | 0.84 | 4 | 4 | 0 | Y | TCVILATDMGS | 84.38 | TCVILVTDMGS | 9.38 | TCVIMATDMGS | 3.12 | TCVILATDMGA | 3.12 | | |
| prM | 147 | 0.84 | 4 | 4 | 0 | Y | CVILATDMGSW | 84.38 | CVILVTDMGSW | 9.38 | CVIMATDMGSW | 3.12 | CVILATDMGAW | 3.12 | | |
| prM | 148 | 0.84 | 4 | 4 | 0 | Y | VILATDMGSWC | 84.38 | VILVTDMGSWC | 9.38 | VIMATDMGSWC | 3.12 | VIMATDMGAWC | 3.12 | | |
| prM | 149 | 0.84 | 4 | 4 | 0 | Y | ILATDMGSWCD | 84.38 | ILVTDMGSWCD | 9.38 | ILATDMGAWCD | 3.12 | IMATDMGSWCD | 3.12 | | |
| prM | 150 | 0.84 | 4 | 4 | 0 | Y | LATDMGSWCDD | 84.38 | LVTDMGSWCDD | 9.38 | LATDMGAWCDD | 3.12 | MATDMGSWCDD | 3.12 | | |
| prM | 151 | 0.64 | 3 | 3 | 0 | Y | ATDMGSWCDDS | 87.5 | VTDMGSWCDDS | 9.38 | ATDMGAWCDDS | 3.12 | | | | |
| prM | 152 | 0.2 | 2 | 2 | 0 | Y | TDMGSWCDDSL | 96.88 | TDMGAWCDDSL | 3.12 | | | | | | |
| prM | 153 | 1.15 | 3 | 3 | 0 | Y | DMGSWCDDSLT | 56.25 | DMGSWCDDSLS | 40.62 | DMGAWCDDSLS | 3.12 | | | | |
| prM | 154 | 1.15 | 3 | 3 | 0 | Y | MGSWCDDSLTY | 56.25 | MGSWCDDSLSY | 40.62 | MGAWCDDSLSY | 3.12 | | | | |
| prM | 155 | 1.15 | 3 | 3 | 0 | Y | GSWCDDSLTYE | 56.25 | GSWCDDSLSYE | 40.62 | GAWCDDSLSYE | 3.12 | | | | |
| prM | 156 | 1.15 | 3 | 3 | 0 | Y | SWCDDSLTYEC | 56.25 | SWCDDSLSYEC | 40.62 | AWCDDSLSYEC | 3.12 | | | | |

Fig. 34-6

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 157 | 0.99 | 2 | 2 | 0 | Y | WCDDSLTYECV | 56.25 | WCDDSLSYECV | 43.75 | | | | |
| prM | 158 | 0.99 | 2 | 2 | 0 | Y | CDDSLTYECVT | 56.25 | CDDSLSYECVT | 43.75 | | | | |
| prM | 159 | 0.99 | 2 | 2 | 0 | Y | DDSLTYECVTI | 56.25 | DDSLSYECVTI | 43.75 | | | | |
| prM | 160 | 0.99 | 2 | 2 | 0 | Y | DSLTYECVTID | 56.25 | DSLSYECVTID | 43.75 | | | | |
| prM | 161 | 0.99 | 2 | 2 | 0 | Y | SLTYECVTIDQ | 56.25 | SLSYECVTIDQ | 43.75 | | | | |
| prM | 162 | 0.99 | 2 | 2 | 0 | Y | LTYECVTIDQG | 56.25 | LSYECVTIDQG | 43.75 | | | | |
| prM | 163 | 0.99 | 2 | 2 | 0 | Y | TYECVTIDQGE | 56.25 | SYECVTIDQGE | 43.75 | | | | |
| prM | 164 | 0 | 1 | 1 | 0 | Y | YECVTIDQGEE | 100 | | | | | | |
| prM | 165 | 0 | 1 | 1 | 0 | Y | ECVTIDQGEEP | 100 | | | | | | |
| prM | 166 | 0 | 1 | 1 | 0 | Y | CVTIDQGEEPV | 100 | | | | | | |
| prM | 167 | 0 | 1 | 1 | 0 | Y | VTIDQGEEPVD | 100 | | | | | | |
| prM | 168 | 0 | 1 | 1 | 0 | Y | TIDQGEEPVDV | 100 | | | | | | |
| prM | 169 | 0 | 1 | 1 | 0 | Y | IDQGEEPVDVD | 100 | | | | | | |
| prM | 170 | 0 | 1 | 1 | 0 | Y | DQGEEPVDVDC | 100 | | | | | | |
| prM | 171 | 0 | 1 | 1 | 0 | Y | QGEEPVDVDCF | 100 | | | | | | |
| prM | 172 | 0 | 1 | 1 | 0 | Y | GEEPVDVDCFC | 100 | | | | | | |
| prM | 173 | 0 | 1 | 1 | 0 | Y | EEPVDVDCFCR | 100 | | | | | | |
| prM | 174 | 0 | 1 | 1 | 0 | Y | EPVDVDCFCRN | 100 | | | | | | |
| prM | 175 | 0 | 1 | 1 | 0 | Y | PVDVDCFCRNV | 100 | | | | | | |
| prM | 176 | 0 | 1 | 1 | 0 | Y | VDVDCFCRNVD | 100 | | | | | | |
| prM | 177 | 0.2 | 2 | 2 | 0 | Y | DVDCFCRNVDG | 96.88 | DVDCFCRNVDR | 3.12 | | | | |
| prM | 178 | 0.2 | 2 | 2 | 0 | Y | VDCFCRNVDGV | 96.88 | VDCFCRNVDRV | 3.12 | | | | |
| prM | 179 | 0.53 | 3 | 3 | 0 | Y | DCFCRNVDGVY | 90.62 | DCFCRNVDGVH | 6.25 | DCFCRNVDRVY | 3.12 | | |
| prM | 180 | 0.53 | 3 | 3 | 0 | Y | CFCRNVDGVYL | 90.62 | CFCRNVDGVHL | 6.25 | CFCRNVDRVYL | 3.12 | | |

Fig. 34-7

Species: TBEV (11-mers)

| protein | block starting position | block entropy | # total peptides in block | # peptides required to cover 99% of block | gap/X f

Fig. 34-8

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| prM | 205 | 0.2 | 2 | 2 | 0 | Y | RSVLIPSHAQG | 96.88 | RSVLIRSHAQG | 3.12 | | | | | | |
| prM | 206 | 1.15 | 3 | 3 | 0 | Y | SVLIPSHAQGD | 56.25 | SVLIPSHAQGE | 40.62 | SVLIRSHAQGD | 3.12 | | | | |
| prM | 207 | 1.15 | 3 | 3 | 0 | Y | VLIPSHAQGDL | 56.25 | VLIPSHAQGEL | 40.62 | VLIRSHAQGDL | 3.12 | | | | |
| prM | 208 | 1.15 | 3 | 3 | 0 | Y | LIPSHAQGDLT | 56.25 | LIPSHAQGELT | 40.62 | LIRSHAQGDLT | 3.12 | | | | |
| prM | 209 | 1.15 | 3 | 3 | 0 | Y | IPSHAQGDLTG | 56.25 | IPSHAQGELTG | 40.62 | IRSHAQGDLTG | 3.12 | | | | |
| prM | 210 | 1.15 | 3 | 3 | 0 | Y | PSHAQGDLTGR | 56.25 | PSHAQGELTGR | 40.62 | RSHAQGDLTGR | 3.12 | | | | |
| prM | 211 | 0.97 | 2 | 2 | 0 | Y | SHAQGDLTGRG | 59.38 | SHAQGELTGRG | 40.62 | | | | | | |
| prM | 212 | 1.13 | 3 | 3 | 0 | Y | HAQGDLTGRGH | 59.38 | HAQGELTGRGH | 37.5 | HAQGELTGRGR | 3.12 | | | | |
| prM | 213 | 1.13 | 3 | 3 | 0 | Y | AQGDLTGRGHK | 59.38 | AQGELTGRGHK | 37.5 | AQGELTGRGRK | 3.12 | | | | |
| prM | 214 | 1.13 | 3 | 3 | 0 | Y | QGDLTGRGHKW | 59.38 | QGELTGRGHKW | 37.5 | QGELTGRGRKW | 3.12 | | | | |
| prM | 215 | 1.13 | 3 | 3 | 0 | Y | GDLTGRGHKWL | 59.38 | GELTGRGHKWL | 37.5 | GELTGRGRKWL | 3.12 | | | | |
| prM | 216 | 1.13 | 3 | 3 | 0 | Y | DLTGRGHKWLE | 59.38 | ELTGRGHKWLE | 37.5 | ELTGRGRKWLE | 3.12 | | | | |
| prM | 217 | 0.2 | 2 | 2 | 0 | Y | LTGRGHKWLEG | 96.88 | LTGRGRKWLEG | 3.12 | | | | | | |
| prM | 218 | 0.2 | 2 | 2 | 0 | Y | TGRGHKWLEGD | 96.88 | TGRGRKWLEGD | 3.12 | | | | | | |
| prM | 219 | 0.2 | 2 | 2 | 0 | Y | GRGHKWLEGDS | 96.88 | GRGRKWLEGDS | 3.12 | | | | | | |
| prM | 220 | 0.2 | 2 | 2 | 0 | Y | RGHKWLEGDSL | 96.88 | RGRKWLEGDSL | 3.12 | | | | | | |
| prM | 221 | 0.2 | 2 | 2 | 0 | Y | GHKWLEGDSLR | 96.88 | GRKWLEGDSLR | 3.12 | | | | | | |
| prM | 222 | 0.2 | 2 | 2 | 0 | Y | HKWLEGDSLRT | 96.88 | RKWLEGDSLRT | 3.12 | | | | | | |
| prM | 223 | 0 | 1 | 1 | 0 | Y | KWLEGDSLRTH | 100 | | | | | | | | |
| prM | 224 | 0 | 1 | 1 | 0 | Y | WLEGDSLRTHL | 100 | | | | | | | | |
| prM | 225 | 0 | 1 | 1 | 0 | Y | LEGDSLRTHLT | 100 | | | | | | | | |
| prM | 226 | 0 | 1 | 1 | 0 | Y | EGDSLRTHLTR | 100 | | | | | | | | |
| prM | 227 | 0 | 1 | 1 | 0 | Y | GDSLRTHLTRV | 100 | | | | | | | | |
| prM | 228 | 0 | 1 | 1 | 0 | Y | DSLRTHLTRVE | 100 | | | | | | | | |

Fig. 34-9

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 229 | 0 | — | — | 0 | Y | SLRTHLTRVEG | 100 | | | | | | |
| prM | 230 | 0 | — | — | 0 | Y | LRTHLTRVEGW | 100 | | | | | | |
| prM | 231 | 0 | — | — | 0 | Y | RTHLTRVEGWV | 100 | | | | | | |
| prM | 232 | 0 | — | — | 0 | Y | THLTRVEGWVV | 100 | | | | | | |
| prM | 233 | 0 | — | — | 0 | Y | HLTRVEGWVVK | 100 | | | | | | |
| prM | 234 | 0 | — | — | 0 | Y | LTRVEGWVVKN | 100 | | | | | | |
| prM | 235 | 0.2 | 2 | 2 | 0 | Y | TRVEGWVVKNK | 96.88 | TRVEGWVVKNR | 3.12 | | | | |
| prM | 255 | 1.32 | 4 | 4 | 0 | Y | VWLTVESVVTR | 68.75 | VWLTESVVTR | 18.75 | VWLTLESVVAR | 6.25 | VWMTVESVVTR | 6.25 |
| prM | 269 | 1.37 | 5 | 5 | 0 | Y | VVVLLCLAPVY | 65.62 | LVVLLCLAPVY | 25 | VWLFCLAPVY | 3.12 | VAVLLCLAPVY | 3.12 |
| prM | 270 | 0.6 | 4 | 4 | 0 | Y | VVLLCLAPVYA | 90.62 | VALLCLAPVYA | 3.12 | VVLFCLAPVYA | 3.12 | AVILLCLAPVYA | 3.12 |
| prM | 271 | 0.4 | 3 | 3 | 0 | Y | VLLCLAPVYAS | 93.75 | VLFCLAPVYAS | 3.12 | VVLFCLAPVYAS | 3.12 | | |
| prM | 272 | 0.2 | 2 | 2 | 0 | Y | LLCLAPVYASR | 96.88 | LFCLAPVYASR | 3.12 | | | | |
| prM | 273 | 0.2 | 2 | 2 | 0 | Y | LCLAPVYASRC | 96.88 | FCLAPVYASRC | 3.12 | | | | |
| prM | 274 | 0 | — | — | 0 | Y | CLAPVYASRCT | 100 | | | | | | |
| prM | 275 | 0 | — | — | 0 | Y | LAPVYASRCTH | 100 | | | | | | |
| prM | 276 | 0 | — | — | 0 | Y | APVYASRCTHL | 100 | | | | | | |
| prM | 277 | 0 | — | — | 0 | Y | PVYASRCTHLE | 100 | | | | | | |
| prM | 278 | 0 | — | — | 0 | Y | VYASRCTHLEN | 100 | | | | | | |
| E | 279 | 0 | — | — | 0 | Y | YASRCTHLENR | 100 | | | | | | |
| E | 280 | 0 | — | — | 0 | Y | ASRCTHLENRD | 100 | | | | | | |
| E | 281 | 0 | — | — | 0 | Y | SRCTHLENRDF | 100 | | | | | | |
| E | 282 | 0 | — | — | 0 | Y | RCTHLENRDFV | 100 | | | | | | |
| E | 283 | 0 | — | — | 0 | Y | CTHLENRDFVT | 100 | | | | | | |
| E | 284 | 0 | — | — | 0 | Y | THLENRDFVTG | 100 | | | | | | |

| | peptides required to cover 99% of block | frequency |
|---|---|---|
| pos 255 extra | | |
| pos 269 extra | VVALLCLAPVY | 3.12 |

Fig. 34-10

Species: TBEV (11-mers)

| protein | block starting position | block entropy | total peptides in block | # peptides required to cover 99% of block | cover 99% of block | gap/X fraction | 99% of block covered w/ <= 5 peptides? | peptides required to cover 99% of block | frequency |
|---|---|---|---|---|---|---|---|---|---|
| E | 285 | 0 | 1 | 1 | 1 | 0 | Y | HLENRDFVTGT | 100 |
| E | 286 | 0 | 1 | 1 | 1 | 0 | Y | LENRDFVTGTQ | 100 |
| E | 287 | 0 | 1 | 1 | 1 | 0 | Y | ENRDFVTGTQG | 100 |
| E | 288 | 0 | 1 | 1 | 1 | 0 | Y | NRDFVTGTQGT | 100 |
| E | 289 | 0 | 1 | 1 | 1 | 0 | Y | RDFVTGTQGTT | 100 |
| E | 290 | 0 | 1 | 1 | 1 | 0 | Y | DFVTGTQGTTR | 100 |
| E | 291 | 0 | 1 | 1 | 1 | 0 | Y | FVTGTQGTTRV | 100 |
| E | 292 | 0 | 1 | 1 | 1 | 0 | Y | VTGTQGTTRVT | 100 |
| E | 293 | 0 | 1 | 1 | 1 | 0 | Y | TGTQGTTRVTL | 100 |
| E | 294 | 0 | 1 | 1 | 1 | 0 | Y | GTQGTTRVTLV | 100 |
| E | 295 | 0 | 1 | 1 | 1 | 0 | Y | TQGTTRVTLVL | 100 |
| E | 296 | 0 | 1 | 1 | 1 | 0 | Y | QGTTRVTLVLE | 100 |
| E | 297 | 0 | 1 | 1 | 1 | 0 | Y | GTTRVTLVLEL | 100 |
| E | 298 | 0 | 1 | 1 | 1 | 0 | Y | TTRVTLVLELG | 100 |
| E | 299 | 0 | 1 | 1 | 1 | 0 | Y | TRVTLVLELGG | 100 |
| E | 300 | 0 | 1 | 1 | 1 | 0 | Y | RVTLVLELGGC | 100 |
| E | 301 | 0 | 1 | 1 | 1 | 0 | Y | VTLVLELGGCV | 100 |
| E | 302 | 0 | 1 | 1 | 1 | 0 | Y | TLVLELGGCVT | 100 |
| E | 303 | 0 | 1 | 1 | 1 | 0 | Y | LVLELGGCVTI | 100 |
| E | 304 | 0 | 1 | 1 | 1 | 0 | Y | VLELGGCVTIT | 100 |
| E | 305 | 0 | 1 | 1 | 1 | 0 | Y | LELGGCVTITA | 100 |
| E | 306 | 0 | 1 | 1 | 1 | 0 | Y | ELGGCVTITAE | 100 |
| E | 307 | 0 | 1 | 1 | 1 | 0 | Y | LGGCVTITAEG | 100 |
| E | 308 | 0 | 1 | 1 | 1 | 0 | Y | GGCVTITAEGK | 100 |

Fig. 34-11

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block

Fig. 34-12

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E |

Fig. 34-13

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block

Fig. 34-14

Species: TBEV (11-mers)

| protein | block starting position | block entropy | total peptides in block | # peptides required to cover 99% of block | cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 381 | 0 | 1 | 1 | — | 0 | Y | WGNHCGLFGKG | 100 | | | | | | |
| E | 382 | 0 | 1 | 1 | — | 0 | Y | GNHCGLFGKGS | 100 | | | | | | |
| E | 383 | 0 | 1 | 1 | — | 0 | Y | NHCGLFGKGSI | 100 | | | | | | |
| E | 384 | 0 | 1 | 1 | — | 0 | Y | HCGLFGKGSIV | 100 | | | | | | |
| E | 385 | 0.81 | 2 | 2 | 2 | 0 | Y | CGLFGKGSIVT | 75 | CGLFGKGSIVA | 25 | | | | |
| E | 386 | 0.81 | 2 | 2 | 2 | 0 | Y | GLFGKGSIVTC | 75 | GLFGKGSIVAC | 25 | | | | |
| E | 387 | 0.81 | 2 | 2 | 2 | 0 | Y | LFGKGSIVTCV | 75 | LFGKGSIVACV | 25 | | | | |
| E | 388 | 0.81 | 2 | 2 | 2 | 0 | Y | FGKGSIVTCVK | 75 | FGKGSIVACVK | 25 | | | | |
| E | 389 | 1.3 | 3 | 3 | 3 | 0 | Y | GKGSIVTCVKA | 62.5 | GKGSIVACVKA | 25 | GKGSIVTCVKV | 12.5 | | | |
| E | 390 | 1.69 | 5 | 5 | 5 | 0 | Y | KGSIVTCVKAS | 56.25 | KGSIVACVKAA | 25 | KGSIVTCVKVA | 9.38 | KGSIVTCVKAA | 6.25 | KGSIVTCVKVS | 3.12 |
| E | 391 | 1.69 | 5 | 5 | 5 | 0 | Y | GSIVTCVKASC | 56.25 | GSIVACVKAAC | 25 | GSIVTCVKVAC | 9.38 | GSIVTCVKAAC | 6.25 | GSIVTCVKVSC | 3.12 |
| E | 392 | 1.69 | 5 | 5 | 5 | 0 | Y | SIVTCVKASCE | 56.25 | SIVACVKAACE | 25 | SIVTCVKVACE | 9.38 | SIVTCVKAACE | 6.25 | SIVTCVKVSCE | 3.12 |
| E | 393 | 1.69 | 5 | 5 | 5 | 0 | Y | IVTCVKASCEA | 56.25 | IVACVKAACEA | 25 | IVTCVKVACEA | 9.38 | IVTCVKAACEA | 6.25 | IVTCVKVSCEA | 3.12 |
| E | 394 | 1.69 | 5 | 5 | 5 | 0 | Y | VTCVKASCEAK | 56.25 | VACVKAACEAK | 25 | VTCVKVACEAK | 9.38 | VTCVKAACEAK | 6.25 | VTCVKVSCEAK | 3.12 |
| E | 395 | 1.69 | 5 | 5 | 5 | 0 | Y | TCVKASCEAKK | 56.25 | ACVKAACEAKK | 25 | TCVKVACEAKK | 9.38 | TCVKAACEAKK | 6.25 | TCVKVSCEAKK | 3.12 |
| E | 396 | 1.47 | 4 | 4 | 4 | 0 | Y | CVKASCEAKKK | 56.25 | CVKAACEAKKK | 31.25 | CVKVACEAKKK | 9.38 | CVKVSCEAKKK | 3.12 | | |
| E | 397 | 1.47 | 4 | 4 | 4 | 0 | Y | VKASCEAKKKA | 56.25 | VKAACEAKKKA | 31.25 | VKVACEAKKKA | 9.38 | VKVSCEAKKKA | 3.12 | | |
| E | 398 | 1.47 | 4 | 4 | 4 | 0 | Y | KASCEAKKKAT | 56.25 | KAACEAKKKAT | 31.25 | KVACEAKKKAT | 9.38 | KVSCEAKKKAT | 3.12 | | |
| E | 399 | 1.47 | 4 | 4 | 4 | 0 | Y | ASCEAKKKATG | 56.25 | AACEAKKKATG | 31.25 | VACEAKKKATG | 9.38 | VSCEAKKKATG | 3.12 | | |
| E | 400 | 0.97 | 2 | 2 | 2 | 0 | Y | SCEAKKKATGH | 59.38 | ACEAKKKATGH | 40.62 | | | | | |
| E | 401 | 0 | 1 | 1 | — | 0 | Y | CEAKKKATGHV | 100 | | | | | | |
| E | 402 | 0 | 1 | 1 | — | 0 | Y | EAKKKATGHVY | 100 | | | | | | |
| E | 403 | 0 | 1 | 1 | — | 0 | Y | AKKKATGHYYD | 100 | | | | | | |
| E | 404 | 0.2 | 2 | 2 | 2 | 0 | Y | KKKATGHYYDA | 96.88 | KKKATGHYYDP | 3.12 | | | | |

Species: TBEV (11-mers)

| protein | block starting position | block entropy | total peptides in block | # peptides required to cover 99% of block | cover 99% of block | gap/X fraction | 99% of block covered w/ <= 5 peptides? | peptides required to cover 99% of block

Fig. 34-17

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

Fig. 34-18

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block |

Fig. 34-19

Species: TBEV (11-mers)

| protein | block starting position | block entropy | total

Fig. 34-20

Species: TBEV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 530 | 0 | 1 | 1 | 0 | Y | VKMDVYNLGDQ | 100 | | | | | | |
| E | 531 | 0 | 1 | 1 | 0 | Y | KMDVYNLGDQT | 100 | | | | | | |
| E | 532 | 0 | 1 | 1 | 0 | Y | MDVYNLGDQTG | 100 | | | | | | |
| E | 533 | 0 | 1 | 1 | 0 | Y | DVYNLGDQTGV | 100 | | | | | | |
| E | 534 | 0 | 1 | 1 | 0 | Y | VYNLGDQTGVL | 100 | | | | | | |
| E | 535 | 0 | 1 | 1 | 0 | Y | YNLGDQTGVLL | 100 | | | | | | |
| E | 536 | 0 | 1 | 1 | 0 | Y | NLGDQTGVLLK | 100 | | | | | | |
| E | 537 | 0.81 | 2 | 2 | 0 | Y | LGDQTGVLLKS | 75 | LGDQTGVLLKA | 25 | | | | |
| E | 538 | 0.81 | 2 | 2 | 0 | Y | GDQTGVLLKSL | 75 | GDQTGVLLKAL | 25 | | | | |
| E | 539 | 0.81 | 2 | 2 | 0 | Y | DQTGVLLKSLA | 75 | DQTGVLLKALA | 25 | | | | |
| E | 540 | 0.81 | 2 | 2 | 0 | Y | QTGVLLKSLAG | 75 | QTGVLLKALAG | 25 | | | | |
| E | 541 | 0.81 | 2 | 2 | 0 | Y | TGVLLKSLAGV | 75 | TGVLLKALAGV | 25 | | | | |
| E | 542 | 0.81 | 2 | 2 | 0 | Y | GVLLKSLAGVP | 75 | GVLLKALAGVP | 25 | | | | |
| E | 543 | 0.81 | 2 | 2 | 0 | Y | VLLKSLAGVPV | 75 | VLLKALAGVPV | 25 | | | | |
| E | 544 | 0.81 | 2 | 2 | 0 | Y | LLKSLAGVPVA | 75 | LLKALAGVPVA | 25 | | | | |
| E | 545 | 0.81 | 2 | 2 | 0 | Y | LKSLAGVPVAH | 75 | LKALAGVPVAH | 25 | | | | |
| E | 546 | 0.81 | 2 | 2 | 0 | Y | KSLAGVPVAHI | 75 | KALAGVPVAHI | 25 | | | | |
| E | 547 | 0.81 | 2 | 2 | 0 | Y | SLAGVPVAHID | 75 | ALAGVPVAHIE | 25 | | | | |
| E | 548 | 0.81 | 2 | 2 | 0 | Y | LAGVPVAHIDG | 75 | LAGVPVAHIEG | 25 | | | | |
| E | 549 | 1.12 | 3 | 3 | 0 | Y | AGVPVAHIDGT | 68.75 | AGVPVAHIEGT | 25 | AGVPVAHIDGA | 6.25 | | |
| E | 550 | 1.12 | 3 | 3 | 0 | Y | GVPVAHIDGTK | 68.75 | GVPVAHIEGTK | 25 | GVPVAHIDGAK | 6.25 | | |
| E | 551 | 1.12 | 3 | 3 | 0 | Y | VPVAHIDGTKY | 68.75 | VPVAHIEGTKY | 25 | VPVAHIDGAKY | 6.25 | | |
| E | 552 | 1.12 | 3 | 3 | 0 | Y | PVAHIDGTKYH | 68.75 | PVAHIEGTKYH | 25 | PVAHIDGAKYH | 6.25 | | |
| E | 553 | 1.12 | 3 | 3 | 0 | Y | VAHIDGTKYHL | 68.75 | VAHIEGTKYHL | 25 | VAHIDGAKYHL | 6.25 | | |

Fig. 34-21

Species: TBEV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of

Fig. 34-22

Species: TBEV

| protein | block starting position | block entropy (11-mers) | total peptides in block | # peptides required to cover 99% of block | gap/X fraction | 99% of block covered w/ <=

Fig. 34-23

Species: TBEV (11-mers)

| protein | block starting position | block entropy | total peptides in block | # peptides required to cover 99% of block | gap/X fraction | 99% of block covered w/ <=

Fig. 34-24

Species: TBEV (11-mers)

| protein | block starting position | block entropy | total peptides in block | # peptides required to cover 99% of block | gap/X fraction | 99% of block cov

Fig. 34-25

Species: TBEV (11-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99

Fig. 34-26

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

Fig. 34-27

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block

Fig. 34-28

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 722 | 0.97 | 2 | 2 | 0 | Y | GGAFNSLFGGV | 59.38 | GGAFNSIFGGV | 40.62 | | | | |
| E | 723 | 0.97 | 2 | 2 | 0 | Y | GAFNSLFGGVG | 59.38 | GAFNSIFGGVG | 40.62 | | | | |
| E | 724 | 0.97 | 2 | 2 | 0 | Y | AFNSLFGGVGF | 59.38 | AFNSIFGGVGF | 40.62 | | | | |
| E | 725 | 1.15 | 3 | 3 | 0 | Y | FNSLFGGVGFL | 56.25 | FNSLFGGVGFL | 40.62 | FNSLFGGVGFI | 3.12 | | |
| E | 726 | 1.15 | 3 | 3 | 0 | Y | NSLFGGVGFLP | 56.25 | NSIFGGVGFLP | 40.62 | NSIFGGVGFIP | 3.12 | | |
| E | 727 | 1.15 | 3 | 3 | 0 | Y | SLFGGVGFLPK | 56.25 | SIFGGVGFLPK | 40.62 | SLFGGVGFIPK | 3.12 | | |
| E | 728 | 1.15 | 3 | 3 | 0 | Y | LFGGVGFLPKI | 56.25 | IFGGVGFLPKI | 40.62 | LFGGVGFIPKL | 3.12 | | |
| E | 729 | 1.15 | 3 | 3 | 0 | Y | FGGVGFLPKIL | 56.25 | FGGVGFLPKLL | 40.62 | FGGVGFIPKLL | 3.12 | | |
| E | 730 | 1.6 | 5 | 5 | 0 | Y | GGVGFLPKILV | 46.88 | GGVGFLPKLLL | 40.62 | GGVGFLPKILM | 3.12 | GGVGFLPKILI | 3.12 |
| E | 731 | 1.6 | 5 | 5 | 0 | Y | GVGFLPKILVG | 46.88 | GVGFLPKLLLG | 40.62 | GVGFLPKILMG | 3.12 | GVGFLPKLLLG | 3.12 |
| E | 741 | 1.13 | 4 | 4 | 0 | Y | GVALAWLGLNM | 71.88 | GVLAWLGLNM | 21.88 | GMALAWLGLNM | 3.12 | GAALAWLGLNM | 3.12 |
| E | 742 | 1.13 | 4 | 4 | 0 | Y | VALAWLGLNMR | 71.88 | VVLAWLGLNMR | 21.88 | MALAWLGLNMR | 3.12 | AALAWLGLNMR | 3.12 |
| E | 743 | 0.76 | 2 | 2 | 0 | Y | ALAWLGLNMRN | 78.12 | VLAWLGLNMRN | 21.88 | | | | |
| E | 744 | 0 | 1 | 1 | 0 | Y | LAWLGLNMRNP | 100 | | | | | | |
| E | 745 | 0 | 1 | 1 | 0 | Y | AWLGLNMRNPT | 100 | | | | | | |
| E | 746 | 0 | 1 | 1 | 0 | Y | WLGLNMRNPTM | 100 | | | | | | |
| E | 747 | 0 | 1 | 1 | 0 | Y | LGLNMRNPTMS | 100 | | | | | | |
| E | 748 | 0 | 1 | 1 | 0 | Y | GLNMRNPTMSM | 100 | | | | | | |
| E | 749 | 0.45 | 2 | 2 | 0 | Y | LNMRNPTMSMS | 90.62 | LNMRNPTMSMG | 9.38 | | | | |
| E | 750 | 0.45 | 2 | 2 | 0 | Y | NMRNPTMSMSF | 90.62 | NMRNPTMSMGF | 9.38 | | | | |
| E | 751 | 0.45 | 2 | 2 | 0 | Y | MRNPTMSMSFL | 90.62 | MRNPTMSMGFL | 9.38 | | | | |
| E | 752 | 0.45 | 2 | 2 | 0 | Y | RNPTMSMSFLL | 90.62 | RNPTMSMGFLL | 9.38 | | | | |
| E | 753 | 0.45 | 2 | 2 | 0 | Y | NPTMSMSFLLA | 90.62 | NPTMSMGFLLA | 9.38 | | | | |
| E | 754 | 0.45 | 2 | 2 | 0 | Y | PTMSMSFLLAG | 90.62 | PTMSMGFLLAG | 9.38 | | | | |

Additional 5th peptide column for rows 730 and 731:
- Row 730: GGVGFIPKLLL, 3.12
- Row 731: GVGFLPKILIG, 3.12

Fig. 34-29

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 34-31

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 803 | 0.34 | 2 | 2 | 0 | Y | EWYDNYAYYPE | 93.75 | EWYDNYAFYPE | 6.25 | | | | | | |
| NS1 | 804 | 0.34 | 2 | 2 | 0 | Y | WYDNYAYYPET | 93.75 | WYDNYAFYPET | 6.25 | | | | | | |
| NS1 | 805 | 0.34 | 2 | 2 | 0 | Y | YDNYAYYPETP | 93.75 | YDNYAFYPETP | 6.25 | | | | | | |
| NS1 | 806 | 0.34 | 2 | 2 | 0 | Y | DNYAYYPETPG | 93.75 | DNYAFYPETPG | 6.25 | | | | | | |
| NS1 | 807 | 0.34 | 2 | 2 | 0 | Y | NYAYYPETPGA | 93.75 | NYAFYPETPGA | 6.25 | | | | | | |
| NS1 | 808 | 0.34 | 2 | 2 | 0 | Y | YAYYPETPGAL | 93.75 | YAFYPETPGAL | 6.25 | | | | | | |
| NS1 | 809 | 0.34 | 2 | 2 | 0 | Y | AYYPETPGALA | 93.75 | AFYPETPGALA | 6.25 | | | | | | |
| NS1 | 810 | 0.34 | 2 | 2 | 0 | Y | YYPETPGALAS | 93.75 | FYPETPGALAS | 6.25 | | | | | | |
| NS1 | 811 | 0 | 1 | 1 | 0 | Y | YPETPGALASA | 100 | | | | | | | | |
| NS1 | 812 | 0 | 1 | 1 | 0 | Y | PETPGALASAI | 100 | | | | | | | | |
| NS1 | 813 | 0.2 | 2 | 2 | 0 | Y | ETPGALASAIR | 96.88 | ETPGALASAIR | 3.12 | | | | | | |
| NS1 | 814 | 0.2 | 2 | 2 | 0 | Y | TPGALASAIRE | 96.88 | TPGALASAIRE | 3.12 | | | | | | |
| NS1 | 815 | 0.4 | 3 | 3 | 0 | Y | PGALASAIKET | 93.75 | PGALASAIKEA | 3.12 | PGALASAIRET | 3.12 | | | | |
| NS1 | 816 | 0.4 | 3 | 3 | 0 | Y | GALASAIKETF | 93.75 | GALASAIKEAF | 3.12 | GALASAIRETF | 3.12 | | | | |
| NS1 | 817 | 0.4 | 3 | 3 | 0 | Y | ALASAIKETFE | 93.75 | ALASAIKEAF | 3.12 | ALASAIRETF | 3.12 | | | | |
| NS1 | 818 | 0.4 | 3 | 3 | 0 | Y | LASAIKETFEE | 93.75 | LASAIKEAFE | 3.12 | LASAIRETFEE | 3.12 | | | | |
| NS1 | 819 | 0.4 | 3 | 3 | 0 | Y | ASAIKETFEEG | 93.75 | ASAIKEAFEEG | 3.12 | ASAIRETFEEG | 3.12 | | | | |
| NS1 | 820 | 1.77 | 5 | 5 | 0 | Y | SAIKETFEEGT | 50 | SAIKETFEEGS | 25 | SAIKETFEEGN | 18.75 | SAIRETFEEGT | 3.12 | SAIKEAFEEGT | 3.12 |
| NS1 | 821 | 1.77 | 5 | 5 | 0 | Y | AIKETFEEGTC | 50 | AIKETFEEGSC | 25 | AIKETFEEGNC | 18.75 | AIRETFEEGTC | 3.12 | AIKEAFEEGTC | 3.12 |
| NS1 | 822 | 1.77 | 5 | 5 | 0 | Y | IKETFEEGTCG | 50 | IKETFEEGSCG | 25 | IKETFEEGNCG | 18.75 | IKEAFEEGTCG | 3.12 | IRETFEEGTCG | 3.12 |
| NS1 | 823 | 1.77 | 5 | 5 | 0 | Y | KETFEEGTCGI | 50 | KETFEEGSCGV | 25 | KETFEEGNCGI | 18.75 | RETFEEGTCGI | 3.12 | KEAFEEGTCGI | 3.12 |
| NS1 | 824 | 1.77 | 5 | 5 | 0 | Y | ETFEEGTCGIV | 50 | ETFEEGSCGVV | 25 | ETFEEGNCGIV | 18.75 | ETFEEGTCGIL | 3.12 | EAFEEGTCGIV | 3.12 |
| NS1 | 825 | 1.77 | 5 | 5 | 0 | Y | TFEEGTCGIVP | 50 | TFEEGSCGVVP | 25 | TFEEGNCGIVP | 18.75 | TFEEGTCGILP | 3.12 | AFEEGTCGIVP | 3.12 |
| NS1 | 826 | 1.59 | 4 | 4 | 0 | Y | FEEGTCGIVPQ | 53.12 | FEEGSCGWPQ | 25 | FEEGNCGIVPQ | 18.75 | FEEGTCGILPQ | 3.12 | | |

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 34-34

Species: TBEV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 875 | 1.31 | 4 | 4 | 0 | Y | RGGIPGLLKKG | 56.25 | RGGVPGLLKKG | 37.5 | RGGIPGLLRKG | 3.12 | | |
| NS1 | 876 | 1.31 | 4 | 4 | 0 | Y | GGIPGLLKKGK | 56.25 | GGVPGLLKKGK | 37.5 | GGVSGLLRKGK | 3.12 | | |
| NS1 | 877 | 1.31 | 4 | 4 | 0 | Y | GIPGLLKKGKD | 56.25 | GVPGLLKKGKD | 37.5 | GVSGLLRKGKD | 3.12 | | |
| NS1 | 878 | 1.31 | 4 | 4 | 0 | Y | IPGLLKKGKDI | 56.25 | VPGLLKKGKDI | 37.5 | VSGLLRKGKDI | 3.12 | | |
| NS1 | 879 | 0.6 | 4 | 4 | 0 | Y | PGLLKKGKDIK | 90.62 | PGLLRKGKDI | 3.12 | SGLLRKGKDIK | 3.12 | | |
| NS1 | 880 | 0.53 | 3 | 3 | 0 | Y | GLLKKGKDIKV | 90.62 | GLLRKGKDIKV | 6.25 | | | | |
| NS1 | 881 | 0.53 | 3 | 3 | 0 | Y | LLKKGKDIKYS | 90.62 | LLRKGKDIKYS | 6.25 | | | | |
| NS1 | 882 | 0.53 | 3 | 3 | 0 | Y | LKKGKDIKYSW | 87.5 | LRKGKDIKYSW | 6.25 | | | | |
| NS1 | 883 | 0.73 | 4 | 3 | 0 | Y | KKGKDIKYSWK | 93.75 | RKGKDIKYSWR | 3.12 | KKGKDIRYSWK | 3.12 | | |
| NS1 | 884 | 0.4 | 3 | 3 | 0 | Y | KGKDIKYSWKS | 93.75 | KGKDIKYSWKS | 3.12 | | | | |
| NS1 | 885 | 0.4 | 3 | 3 | 0 | Y | GKDIKYSWKSW | 93.75 | GKDIRYSWKSW | 3.12 | | | | |
| NS1 | 886 | 0.4 | 3 | 3 | 0 | Y | KDIKYSWKSWG | 93.75 | KDIRYSWKSWG | 3.12 | | | | |
| NS1 | 887 | 1.08 | 4 | 4 | 0 | Y | DIKYSWKSWGH | 75 | DIKYSWKSWGQ | 18.75 | DIRYSWKSWGH | 3.12 | | |
| NS1 | 888 | 1.2 | 5 | 5 | 0 | Y | IKYSWKSWGHS | 75 | IKYSWKSWGQS | 15.62 | IKYSWRSWGHS | 3.12 | IRYSWKSWGHS | 3.12 |
| NS1 | 899 | 1.48 | 5 | 5 | 0 | Y | MIWSIPEAPRR | 53.12 | MIWSIPEAPRR | 37.5 | MIWSIPEASRR | 3.12 | IIWSIPEAPRR | 3.12 |
| NS1 | 900 | 1.16 | 3 | 3 | 0 | Y | IWSIPEAPRRF | 53.12 | IWSIPEAPRRF | 43.75 | | | | |
| NS1 | 901 | 1.16 | 3 | 3 | 0 | Y | WSVPEAPRRFM | 53.12 | WSIPEAPRRFM | 43.75 | | | | |
| NS1 | 902 | 1.16 | 3 | 3 | 0 | Y | SIPEAPRRFMV | 53.12 | SIPEASRRFMV | 43.75 | | | | |
| NS1 | 903 | 1.16 | 3 | 3 | 0 | Y | VPEAPRRFMVG | 53.12 | IPEASRRFMVG | 43.75 | | | | |
| NS1 | 904 | 0.4 | 3 | 3 | 0 | Y | PEAPRRFMVGT | 93.75 | PEASRRFMVGT | 3.12 | | | | |
| NS1 | 905 | 0.4 | 3 | 3 | 0 | Y | EAPRRFMVGTE | 93.75 | EASRRFMVGTE | 3.12 | | | | |
| NS1 | 906 | 0.4 | 3 | 3 | 0 | Y | APRRFMVGTEG | 93.75 | ASRRFMVGTEG | 3.12 | APRRFMVGTEG | 3.12 | | |
| NS1 | 907 | 1.87 | 5 | 5 | 0 | Y | PRRFMVGTEGG | 37.5 | PRRFMVGTEGS | 31.25 | SRRFMVGTEGS | 3.12 | PRRFMVGTEGS | 3.12 |
| NS1 | 918 | 0.89 | 3 | 3 | 0 | Y | SECPLERRKTG | 78.12 | NECPLERRKTG | 18.75 | SECPPERRKTG | 3.12 | | |

Fig. 34-35

Species: TBEV (11-mers)

| protein | block starting position | block entropy | total peptides in block | # peptides required to cover 99% of block | gap/X fraction | 99% of block cov

Fig. 34-36

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 34-37

Species: TBEV (11-mers)

| protein | block starting position | block entropy | total

Fig. 34-38

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 991 | 0 | 1 | 1 | 0 | Y | ELLVTDLRNCS | 100 | | | | | | |
| NS1 | 992 | 0 | 1 | 1 | 0 | Y | LLVTDLRNCSW | 100 | | | | | | |
| NS1 | 993 | 0 | 1 | 1 | 0 | Y | LVTDLRNCSWP | 100 | | | | | | |
| NS1 | 994 | 0 | 1 | 1 | 0 | Y | VTDLRNCSWPA | 100 | | | | | | |
| NS1 | 995 | 0 | 1 | 1 | 0 | Y | TDLRNCSWPAS | 100 | | | | | | |
| NS1 | 996 | 0 | 1 | 1 | 0 | Y | DLRNCSWPASH | 100 | | | | | | |
| NS1 | 997 | 0 | 1 | 1 | 0 | Y | LRNCSWPASHT | 100 | | | | | | |
| NS1 | 998 | 0 | 1 | 1 | 0 | Y | RNCSWPASHTI | 100 | | | | | | |
| NS1 | 999 | 0 | 1 | 1 | 0 | Y | NCSWPASHTID | 100 | | | | | | |
| NS1 | 1000 | 0.2 | 2 | 2 | 0 | Y | CSWPASHTIDN | 100 | | | | | | |
| NS1 | 1001 | 1 | 2 | 2 | 0 | Y | SWPASHTIDNA | 96.88 | SWPASHTIDNP | 3.12 | | | | |
| NS1 | 1002 | 1 | 3 | 3 | 0 | Y | WPASHTIDNAE | 71.88 | WPASHTIDNAD | 25 | WPASHTIDNPE | 3.12 | | |
| NS1 | 1003 | 1 | 3 | 3 | 0 | Y | PASHTIDNAEV | 71.88 | PASHTIDNADV | 25 | PASHTIDNPEV | 3.12 | | |
| NS1 | 1004 | 1 | 3 | 3 | 0 | Y | ASHTIDNAEVW | 71.88 | ASHTIDNADVW | 25 | ASHTIDNPEW | 3.12 | | |
| NS1 | 1005 | 1 | 3 | 3 | 0 | Y | SHTIDNAEVWD | 71.88 | SHTIDNADVWD | 25 | SHTIDNPEVWD | 3.12 | | |
| NS1 | 1006 | 1 | 3 | 3 | 0 | Y | HTIDNAEVWDS | 71.88 | HTIDNADVWDS | 25 | HTIDNPEVWDS | 3.12 | | |
| NS1 | 1007 | 1 | 3 | 3 | 0 | Y | TIDNAEVWDSE | 71.88 | TIDNADVWDSE | 25 | TIDNPEVWDSE | 3.12 | | |
| NS1 | 1008 | 1.2 | 4 | 4 | 0 | Y | IDNAEVWDSEL | 71.88 | IDNADVWDSES | 18.75 | IDNPEVWDSES | 6.25 | IDNPEVWDSEL | 3.12 |
| NS1 | 1009 | 1.2 | 4 | 4 | 0 | Y | DNAEVWDSELF | 71.88 | DNADVWDSESF | 18.75 | DNADVWDSESF | 6.25 | DNPEVWDSELF | 3.12 |
| NS1 | 1010 | 1.2 | 4 | 4 | 0 | Y | NAEVWDSELFL | 71.88 | NADVWDSELFL | 18.75 | NADVWDSESFL | 6.25 | NPEVWDSELFL | 3.12 |
| NS1 | 1011 | 1.2 | 4 | 4 | 0 | Y | AEVWDSELFLP | 71.88 | ADVWDSELFLP | 18.75 | ADVWDSESFLP | 6.25 | PEVWDSELFLP | 3.12 |
| NS1 | 1012 | 1.01 | 3 | 3 | 0 | Y | EVWDSELFLPA | 75 | DVWDSELFLPA | 18.75 | DVWDSESFLPA | 6.25 | | |
| NS1 | 1013 | 0.34 | 2 | 2 | 0 | Y | VWDSELFLPAS | 93.75 | VWDSESFLPAS | 6.25 | | | | |
| NS1 | 1014 | 0.34 | 2 | 2 | 0 | Y | VDSELFLPASL | 93.75 | VDSESFLPASL | 6.25 | | | | |

Fig. 34-39

Species: TBEV (11-mers)

| protein | block starting position | block entropy | total peptides in block | # peptides required to cover 99% of block | gap/X fraction | 99% of block covered w/ => 5 peptides? | peptides required to cover 99% of block | fr

Fig. 34-40

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1039 | 1.32 | 4 | 4 | 0 | Y | EQVKGPWKYSP | 68.75 | EQVKGPWKHTP | 15.62 | EQVKGPWKYTP | 12.5 | EQVKGPWKYLP | 3.12 |
| NS1 | 1040 | 1.32 | 4 | 4 | 0 | Y | QVKGPWKYSPI | 68.75 | QVKGPWKHTPI | 15.62 | QVKGPWKYTPI | 12.5 | QVKGPWKYLPI | 3.12 |
| NS1 | 1041 | 1.32 | 4 | 4 | 0 | Y | VKGPWKYSPIR | 68.75 | VKGPWKHTPIR | 15.62 | VKGPWKYTPIR | 12.5 | VKGPWKYLPIR | 3.12 |
| NS1 | 1042 | 1.32 | 4 | 4 | 0 | Y | KGPWKYSPIRV | 68.75 | KGPWKHTPIRV | 15.62 | KGPWKYTPIRV | 12.5 | KGPWKYLPIRV | 3.12 |
| NS1 | 1049 | 1.04 | 3 | 3 | 0 | Y | PIRVTREECPG | 68.75 | PIRVIREECPG | 28.12 | PIRVRGECPG | 3.12 | | |
| NS1 | 1050 | 1.04 | 3 | 3 | 0 | Y | IRVTREECPGT | 68.75 | IRVIREECPGT | 28.12 | IRVWRGECPGT | 3.12 | | |
| NS1 | 1051 | 1.77 | 5 | 5 | 0 | Y | RVTREECPGTR | 50 | RVIREECPGTK | 25 | RVTREECPGTK | 18.75 | RVWRGECPGTK | 3.12 | RVIREECPGTR | 3.12 |
| NS1 | 1052 | 1.77 | 5 | 5 | 0 | Y | VTREECPGTRV | 50 | VIREECPGTTV | 25 | VTREECPGTKV | 18.75 | VIREECPGTRV | 3.12 | VVRGECPGTKV | 3.12 |
| NS1 | 1064 | 1.72 | 5 | 5 | 0 | Y | INADCDKRGAS | 53.12 | INAKCDKRGAS | 25 | ISADCDKRGAS | 15.62 | ISADCDRRGAS | 3.12 | ITADCDKRGAS | 3.12 |
| NS1 | 1065 | 1.72 | 5 | 5 | 0 | Y | NADCDKRGASV | 53.12 | NAKCDKRGASV | 25 | SADCDKRGASV | 15.62 | TADCDKRGASV | 3.12 | SADCDRRGASV | 3.12 |
| NS1 | 1066 | 1 | 3 | 3 | 0 | Y | ADCDKRGASVR | 71.88 | AKCDKRGASVR | 25 | ADCDRRGASVR | 3.12 | | |
| NS1 | 1067 | 1 | 3 | 3 | 0 | Y | DCDKRGASVRS | 71.88 | KCDKRGASVRS | 25 | DCDRRGASVRS | 3.12 | | |
| NS1 | 1068 | 0.2 | 2 | 2 | 0 | Y | CDKRGASVRST | 96.88 | CDRRGASVRST | 3.12 | | | | |
| NS1 | 1069 | 0.2 | 2 | 2 | 0 | Y | DKRGASVRSTT | 96.88 | DRRGASVRSTT | 3.12 | | | | |
| NS1 | 1070 | 0.2 | 2 | 2 | 0 | Y | KRGASVRSTTE | 96.88 | RRGASVRSTTE | 3.12 | | | | |
| NS1 | 1071 | 0 | 1 | 1 | 0 | Y | RGASVRSTTES | 100 | | | | | | |
| NS1 | 1072 | 0 | 1 | 1 | 0 | Y | GASVRSTTESG | 100 | | | | | | |
| NS1 | 1073 | 0 | 1 | 1 | 0 | Y | ASVRSTTESGK | 100 | | | | | | |
| NS1 | 1074 | 0 | 1 | 1 | 0 | Y | SVRSTTESGKV | 100 | | | | | | |
| NS1 | 1075 | 0 | 1 | 1 | 0 | Y | VRSTTESGKVI | 100 | | | | | | |
| NS1 | 1076 | 0 | 1 | 1 | 0 | Y | RSTTESGKVIP | 100 | | | | | | |
| NS1 | 1077 | 0 | 1 | 1 | 0 | Y | STTESGKVIPE | 100 | | | | | | |
| NS1 | 1078 | 0 | 1 | 1 | 0 | Y | TTESGKVIPEW | 100 | | | | | | |
| NS1 | 1079 | 0 | 1 | 1 | 0 | Y | TESGKVIPEWC | 100 | | | | | | |

Fig. 34-41

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1080 | 0 | — | — | 0 | Y | ESGKVIPEWCC | 100 | | | | | | |
| NS1 | 1081 | 0 | — | — | 0 | Y | SGKVIPEWCCR | 100 | | | | | | |
| NS1 | 1082 | 0.81 | — | 2 | 0 | Y | GKVIPEWCCRT | 75 | GKVIPEWCCRA | 25 | | | | |
| NS1 | 1083 | 0.81 | — | 2 | 0 | Y | KVIPEWCCRTC | 75 | KVIPEWCCRAC | 25 | | | | |
| NS1 | 1084 | 0.81 | — | 2 | 0 | Y | VIPEWCCRTCT | 75 | VIPEWCCRACT | 25 | | | | |
| NS1 | 1085 | 0.81 | — | 2 | 0 | Y | IPEWCCRTCTL | 75 | IPEWCCRACTM | 25 | | | | |
| NS1 | 1086 | 0.81 | — | 2 | 0 | Y | PEWCCRTCTLP | 75 | PEWCCRACTMP | 25 | | | | |
| NS1 | 1087 | 0.81 | — | 2 | 0 | Y | EWCCRTCTLPP | 75 | EWCCRACTMPP | 25 | | | | |
| NS1 | 1088 | 0.81 | — | 2 | 0 | Y | WCCRTCTLPPV | 75 | WCCRACTMPPV | 25 | | | | |
| NS1 | 1089 | 0.81 | — | 2 | 0 | Y | CCRTCTLPPVT | 75 | CCRACTMPPVT | 25 | | | | |
| NS1 | 1090 | — | — | 3 | 0 | Y | CRTCTLPPVTF | 71.88 | CRACTMPPVTF | 25 | CRTCTLPPVTI | 3.12 | | |
| NS1 | 1091 | — | — | 3 | 0 | Y | RTCLPPVTFR | 71.88 | RACTMPPVTFR | 25 | RTCLPPVTIR | 3.12 | | |
| NS1 | 1092 | — | — | 3 | 0 | Y | TCTLPPVTFRT | 71.88 | ACTMPPVTFRT | 25 | TCTLPPVTIRT | 3.12 | | |
| NS1 | 1093 | — | — | 3 | 0 | Y | CTLPPVTFRTG | 71.88 | CTMPPVTFRTG | 25 | CTLPPVTIRTG | 3.12 | | |
| NS1 | 1094 | — | — | 3 | 0 | Y | TLPPVTFRTGT | 71.88 | TMPPVTFRTGT | 25 | TLPPVTIRTGT | 3.12 | | |
| NS1 | 1095 | — | — | 3 | 0 | Y | LPPVTFRTGTD | 71.88 | MPPVTFRTGTD | 25 | LPPVTIRTGTD | 3.12 | | |
| NS1 | 1096 | 0.2 | — | 2 | 0 | Y | PPVTFRTGTDC | 96.88 | PPVTIRTGTDC | 3.12 | | | | |
| NS1 | 1097 | 0.2 | — | 2 | 0 | Y | PVTFRTGTDCW | 96.88 | PVTIRTGTDCW | 3.12 | | | | |
| NS1 | 1098 | 0.2 | — | 2 | 0 | Y | VTFRTGTDCWY | 96.88 | VTIRTGTDCWY | 3.12 | | | | |
| NS1 | 1099 | 0.2 | — | 2 | 0 | Y | TFRTGTDCWYA | 96.88 | TIRTGTDCWYA | 3.12 | | | | |
| NS1 | 1100 | 0.2 | — | 2 | 0 | Y | FRTGTDCWYAM | 96.88 | IRTGTDCWYAM | 3.12 | | | | |
| NS1 | 1101 | 0 | — | — | 0 | Y | RTGTDCWYAME | 100 | | | | | | |
| NS1 | 1102 | 0 | — | — | 0 | Y | TGTDCWYAMEI | 100 | | | | | | |
| NS1 | 1103 | 0 | — | — | 0 | Y | GTDCWYAMEIR | 100 | | | | | | |

Fig. 34-42

Species: TBEV (11-mers)

| prot

Fig. 34-43

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1128 | 0 | 1 | 1 | 0 | Y | ADNGELLSEGG | 100 | | | | | | |
| NS1 | 1129 | 1 | 2 | 2 | 0 | Y | DNGELLSEGGV | 50 | DNGELLSEGGI | 50 | | | | |
| NS2A | 1130 | 1 | 2 | 2 | 0 | Y | NGELLSEGGVP | 50 | NGELLSEGGIP | 50 | | | | |
| NS2A | 1131 | 1 | 2 | 2 | 0 | Y | GELLSEGGIPG | 50 | GELLSEGGVPG | 50 | | | | |
| NS2A | 1132 | 1 | 2 | 2 | 0 | Y | ELLSEGGVPGI | 50 | ELLSEGGIPGI | 50 | | | | |
| NS2A | 1133 | 1 | 2 | 2 | 0 | Y | LLSEGGIPGIV | 50 | LLSEGGVPGIV | 50 | | | | |
| NS2A | 1134 | 1 | 2 | 2 | 0 | Y | LSEGGVPGIVA | 50 | LSEGGIPGIVA | 50 | | | | |
| NS2A | 1135 | 1 | 2 | 2 | 0 | Y | SEGGIPGIVAL | 50 | SEGGVPGIVAL | 50 | | | | |
| NS2A | 1136 | 1 | 2 | 2 | 0 | Y | EGGVPGIVALF | 50 | EGGIPGIVALF | 50 | | | | |
| NS2A | 1137 | 1 | 2 | 2 | 0 | Y | GGIPGIVALFV | 50 | GGVPGIVALFV | 50 | | | | |
| NS2A | 1138 | 1 | 2 | 2 | 0 | Y | GIPGIVALFVV | 50 | GVPGIVALFVV | 50 | | | | |
| NS2A | 1139 | 1 | 2 | 2 | 0 | Y | IPGIVALFVVL | 50 | VPGIVALFVVL | 50 | | | | |
| NS2A | 1140 | 0 | 1 | 1 | 0 | Y | PGIVALFVVLE | 100 | | | | | | |
| NS2A | 1141 | 0 | 1 | 1 | 0 | Y | GIVALFVVLEY | 100 | | | | | | |
| NS2A | 1142 | 0.81 | 2 | 2 | 0 | Y | IVALFVVLEYV | 75 | IVALFVVLEYI | 25 | | | | |
| NS2A | 1143 | 0.81 | 2 | 2 | 0 | Y | VALFVVLEYVI | 75 | VALFVVLEYII | 25 | | | | |
| NS2A | 1144 | 0.81 | 2 | 2 | 0 | Y | ALFVVLEYIIR | 75 | ALFVVLEYIIR | 25 | | | | |
| NS2A | 1145 | 0.81 | 2 | 2 | 0 | Y | LFVVLEYIIRR | 75 | LFVVLEYIIRR | 25 | | | | |
| NS2A | 1146 | 0.81 | 2 | 2 | 0 | Y | FVVLEYIIRRR | 75 | FVVLEYIIRRR | 25 | | | | |
| NS2A | 1147 | 0.81 | 2 | 2 | 0 | Y | VVLEYIIRRRP | 75 | VVLEYIIRRRP | 25 | | | | |
| NS2A | 1148 | 0.81 | 2 | 2 | 0 | Y | VLEYIIRRRPA | 75 | VLEYIIRRRPS | 25 | | | | |
| NS2A | 1149 | 0.81 | 2 | 2 | 0 | Y | LEYIIRRRPAT | 75 | LEYIIRRRPST | 25 | | | | |
| NS2A | 1150 | 0.81 | 2 | 2 | 0 | Y | EYIIRRRPATG | 75 | EYIIRRRPSTG | 25 | | | | |
| NS2A | 1151 | 0.95 | 3 | 3 | 0 | Y | YIIRRRPATGT | 75 | YIIRRRPSTGT | 21.88 | YIIRRPSTGS | 3.12 | | |

Fig. 34-44

Species: TBEV (11-mers)

| protein | block starting position | block entropy | total pept

Fig. 34-45

Species: TBEV (11-mers)

| protein | block starting position | block

Species: TBEV (11

Fig. 34-48

Species: TBEV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | pe

Fig. 34-49

Species: TBEV (11-mers)

| protein | block starting position | block entropy | # total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1340 | 1.16 | 3 | 3 | 0 | Y | GGVRLLAFWE | 53.12 | GSGVRLLAFWE | 43.75 | GSGIRLLAFWE | 3.12 | | |
| NS2A | 1341 | 1.16 | 3 | 3 | 0 | Y | SGVRLLAFWEL | 53.12 | SGIRLLAFWEL | 43.75 | SGIRLLSFWEL | 3.12 | GIRLLSFWELS | 3.12 |
| NS2A | 1342 | 1.57 | 4 | 4 | 0 | Y | GVRLLAFWELA | 53.12 | GIRLLAFWELA | 28.12 | GIRLLAFWELA | 15.62 | SGRRSFSEPL | 3.12 |
| NS2A | 1354 | 1.44 | 4 | 4 | 0 | Y | HGRRSFSEPL | 46.88 | HGRRSFSEPL | 43.75 | HGKRRSFSEPL | 6.25 | | |
| NS2A | 1355 | 1.27 | 3 | 3 | 0 | Y | RGRRSFSEPLT | 46.88 | GRRSFSEPLT | 46.88 | GKRRSFSEPLT | 6.25 | | |
| NS2A | 1356 | 1.27 | 3 | 3 | 0 | Y | RRSFSEPLTV | 46.88 | GRRSFSEPLTV | 46.88 | KRRSFSEPLTV | 6.25 | | |
| NS2A | 1357 | 0 | 1 | 1 | 0 | Y | RSFSEPLTVG | 100 | | | | | | |
| NS2A | 1358 | 0 | 1 | 1 | 0 | Y | RSFSEPLTVGV | 100 | | | | | | |
| NS2A | 1359 | 0 | 1 | 1 | 0 | Y | SFSEPLTVGV | 100 | | | | | | |
| NS2A | 1360 | 0 | 1 | 1 | 0 | Y | FSEPLTVGVM | 100 | | | | | | |
| NS2A | 1361 | 0 | 1 | 1 | 0 | Y | SEPLTVGVML | 100 | | | | | | |
| NS2A | 1362 | 0 | 1 | 1 | 0 | Y | EPLTVGVMLT | 100 | | | | | | |
| NS2A | 1363 | 0 | 1 | 1 | 0 | Y | PLTVGVMLTL | 100 | | | | | | |
| NS2A | 1364 | 0 | 1 | 1 | 0 | Y | LTVGVMLTLA | 100 | | | | | | |
| NS2B | 1365 | 0.63 | 2 | 2 | 0 | Y | TVGVMLTLAS | 84.38 | TVGVMLTLAG | 15.62 | | | | |
| NS2B | 1366 | 0.63 | 2 | 2 | 0 | Y | VGVMLTLASG | 84.38 | WGVMLTLAGG | 15.62 | | | | |
| NS2B | 1367 | 0.63 | 2 | 2 | 0 | Y | VGVMLTLASGM | 84.38 | VGVMLTLAGGM | 15.62 | | | | |
| NS2B | 1368 | 0.63 | 2 | 2 | 0 | Y | GVMLTLASGMM | 84.38 | GVMLTLAGGMM | 15.62 | | | | |
| NS2B | 1369 | 0.63 | 2 | 2 | 0 | Y | VMLTLASGMMR | 84.38 | VMLTLAGGMMR | 15.62 | | | | |
| NS2B | 1370 | 0.63 | 2 | 2 | 0 | Y | MLTLASGMMRH | 84.38 | MLTLAGGMMRH | 15.62 | | | | |
| NS2B | 1371 | 0.63 | 2 | 2 | 0 | Y | LTLASGMMRHT | 84.38 | LTLAGGMMRHT | 15.62 | | | | |
| NS2B | 1372 | 0.82 | 3 | 3 | 0 | Y | TLASGMMRHTS | 81.25 | TLAGGMMRHTS | 15.62 | TLASGMMRHTP | 3.12 | | |
| NS2B | 1373 | 0.82 | 3 | 3 | 0 | Y | LASGMMRHTSQ | 81.25 | LAGGMMRHTSQ | 15.62 | LASGMMRHTPQ | 3.12 | | |
| NS2B | 1374 | 0.82 | 3 | 3 | 0 | Y | ASGMMRHTSQE | 81.25 | AGGMMRHTSQE | 15.62 | ASGMMRHTPQE | 3.12 | | |

Fig. 34-50

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1375 | 0.82 | 3 | 3 | 0 | Y | SGMMRHTSQEA | 81.25 | GGMMRHTSQEA | 15.62 | SGMMRHTPQEA | 3.12 | | |
| NS2B | 1376 | 0.2 | 2 | 2 | 0 | Y | GMMRHTSQEAL | 96.88 | GMMRHTPQEAL | 3.12 | | | | |
| NS2B | 1377 | 0.2 | 2 | 2 | 0 | Y | MMRHTSQEALC | 96.88 | MMRHTPQEALC | 3.12 | | | | |
| NS2B | 1378 | 0.2 | 2 | 2 | 0 | Y | MRHTSQEALCA | 96.88 | MRHTPQEALCA | 3.12 | | | | |
| NS2B | 1379 | 0.2 | 2 | 2 | 0 | Y | RHTSQEALCAL | 96.88 | RHTPQEALCAL | 3.12 | | | | |
| NS2B | 1380 | 0.2 | 2 | 2 | 0 | Y | HTSQEALCALA | 96.88 | HTPQEALCALA | 3.12 | | | | |
| NS2B | 1381 | 0.2 | 2 | 2 | 0 | Y | TSQEALCALAV | 96.88 | TPQEALCALAV | 3.12 | | | | |
| NS2B | 1382 | 0.2 | 2 | 2 | 0 | Y | SQEALCALAVA | 96.88 | PQEALCALAVA | 3.12 | | | | |
| NS2B | 1383 | 0 | 1 | 1 | 0 | Y | QEALCALAVAS | 100 | | | | | | |
| NS2B | 1384 | 0 | 1 | 1 | 0 | Y | EALCALAVASF | 100 | | | | | | |
| NS2B | 1385 | 0 | 1 | 1 | 0 | Y | ALCALAVASFL | 100 | | | | | | |
| NS2B | 1386 | 0 | 1 | 1 | 0 | Y | LCALAVASFLL | 100 | | | | | | |
| NS2B | 1387 | 0 | 1 | 1 | 0 | Y | CALAVASFLLL | 100 | | | | | | |
| NS2B | 1388 | 0 | 1 | 1 | 0 | Y | ALAVASFLLLM | 100 | | | | | | |
| NS2B | 1389 | 0 | 1 | 1 | 0 | Y | LAVASFLLLML | 100 | | | | | | |
| NS2B | 1390 | 0 | 1 | 1 | 0 | Y | AVASFLLLMLV | 100 | | | | | | |
| NS2B | 1391 | 0 | 1 | 1 | 0 | Y | VASFLLLMLVL | 100 | | | | | | |
| NS2B | 1392 | 0 | 1 | 1 | 0 | Y | ASFLLLMLVLG | 100 | | | | | | |
| NS2B | 1393 | 0 | 1 | 1 | 0 | Y | SFLLLMLVLGT | 100 | | | | | | |
| NS2B | 1394 | 0 | 1 | 1 | 0 | Y | FLLLMLVLGTR | 100 | | | | | | |
| NS2B | 1395 | 0 | 1 | 1 | 0 | Y | LLLMLVLGTRK | 100 | | | | | | |
| NS2B | 1396 | 0 | 1 | 1 | 0 | Y | LLMLVLGTRKM | 100 | | | | | | |
| NS2B | 1397 | 0 | 1 | 1 | 0 | Y | LMLVLGTRKMQ | 100 | | | | | | |
| NS2B | 1398 | 0 | 1 | 1 | 0 | Y | MLVLGTRKMQL | 100 | | | | | | |

Fig. 34-51

Species: TBEV (11-mers)

| protein | block starting position | block entropy | total peptides in block | # peptides required to cover 99% of block | gap X fraction | 99% of block covered w/ <= 5 peptides? | peptides required to cover 99% of block | frequency | peptides required to cover 99% of block | frequency | peptides required to cover 99% of block | frequency

Fig. 34-53

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 34-54

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to c

Fig. 34-55

Species: TBEV (11

Fig. 34-56

Species: TBEV (11-mers)

| protein | block star

Fig. 34-57

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1558 | 1.23 | 4 | 4 | 0 | Y | GPYWADVKEDV | 65.62 | GPYWADVREDV | 28.12 | GPYWAEVKEDV | 3.12 | GPYWSDVREDV | 3.12 |
| NS3 | 1559 | 1.23 | 4 | 4 | 0 | Y | PYWADVKEDVW | 65.62 | PYWADVREDVW | 28.12 | PYWSDVREDVW | 3.12 | PYWAEVKEDVW | 3.12 |
| NS3 | 1560 | 1.23 | 4 | 4 | 0 | Y | YWADVKEDVWC | 65.62 | YWADVREDVWC | 28.12 | YWSDVREDVWC | 3.12 | YWAEVKEDVWC | 3.12 |
| NS3 | 1561 | 1.23 | 4 | 4 | 0 | Y | WADVKEDVWCY | 65.62 | WADVREDVWCY | 28.12 | WAEVKEDVWCY | 3.12 | WSDVREDVWCY | 3.12 |
| NS3 | 1562 | 1.23 | 4 | 4 | 0 | Y | ADVKEDVWCYG | 65.62 | ADVREDVWCYG | 28.12 | SDVREDVWCYG | 3.12 | AEVKEDVWCYG | 3.12 |
| NS3 | 1563 | 1.08 | 3 | 3 | 0 | Y | DVKEDVWCYGG | 65.62 | DVREDVWCYGG | 31.25 | EVKEDVWCYGG | 3.12 | | |
| NS3 | 1564 | 1.08 | 3 | 3 | 0 | Y | VKEDVWCYGGA | 65.62 | VREDVWCYGGA | 31.25 | VKEDVWCYGGT | 3.12 | | |
| NS3 | 1565 | 1.08 | 3 | 3 | 0 | Y | KEDVWCYGGAW | 65.62 | REDVWCYGGAW | 31.25 | KEDVWCYGGTW | 3.12 | | |
| NS3 | 1566 | 0.2 | 2 | 2 | 0 | Y | EDVCYGGAWS | 96.88 | EDVWCYGGTWS | 3.12 | | | | |
| NS3 | 1567 | 0.2 | 2 | 2 | 0 | Y | DVWCYGGAWSL | 96.88 | DVWCYGGTWSL | 3.12 | | | | |
| NS3 | 1568 | 0.2 | 2 | 2 | 0 | Y | VWCYGGAWSLE | 96.88 | VWCYGGTWSLE | 3.12 | | | | |
| NS3 | 1569 | 0.2 | 2 | 2 | 0 | Y | VCYGGAWSLEE | 96.88 | VCYGGTWSLEE | 3.12 | | | | |
| NS3 | 1570 | 0.2 | 2 | 2 | 0 | Y | CYGGAWSLEEK | 96.88 | CYGGTWSLEEK | 3.12 | | | | |
| NS3 | 1571 | 0.2 | 2 | 2 | 0 | Y | YGGAWSLEEKW | 96.88 | YGGTWSLEEKW | 3.12 | | | | |
| NS3 | 1572 | 0.4 | 3 | 3 | 0 | Y | GGAWSLEEKWK | 93.75 | GGTWSLEEKWK | 3.12 | GGAWSLEEKWR | 3.12 | | |
| NS3 | 1573 | 0.4 | 3 | 3 | 0 | Y | GAWSLEEKWKG | 93.75 | GAWSLEEKWRG | 3.12 | GTWSLEEKWKG | 3.12 | | |
| NS3 | 1574 | 0.4 | 3 | 3 | 0 | Y | AWSLEEKWKGE | 93.75 | TWSLEEKWKGE | 3.12 | AWSLEEKWRGE | 3.12 | | |
| NS3 | 1575 | 0.2 | 2 | 2 | 0 | Y | WSLEEKWKGET | 96.88 | WSLEEKWRGET | 3.12 | | | | |
| NS3 | 1576 | 0.2 | 2 | 2 | 0 | Y | SLEEKWKGETV | 96.88 | SLEEKWRGETV | 3.12 | | | | |
| NS3 | 1577 | 0.2 | 2 | 2 | 0 | Y | LEEKWKGETVQ | 96.88 | LEEKWRGETVQ | 3.12 | | | | |
| NS3 | 1578 | 0.2 | 2 | 2 | 0 | Y | EEKWKGETVQV | 96.88 | EEKWRGETVQV | 3.12 | | | | |
| NS3 | 1579 | 0.2 | 2 | 2 | 0 | Y | EKWKGETVQVH | 96.88 | EKWRGETVQVH | 3.12 | | | | |
| NS3 | 1580 | 0.2 | 2 | 2 | 0 | Y | KWKGETVQVHA | 96.88 | KWRGETVQVHA | 3.12 | | | | |
| NS3 | 1581 | 0.2 | 2 | 2 | 0 | Y | WKGETVQVHAF | 96.88 | WRGETVQVHAF | 3.12 | | | | |

Fig. 34-58

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1582 | 0.2 | 2 | 2 | 0 | Y | KGETVQHAFP | 96.88 | RGETVQHAFP | 3.12 | | | | |
| NS3 | 1583 | 0 | 1 | 1 | 0 | Y | GETVQHAFPP | 100 | | | | | | |
| NS3 | 1584 | 0 | 1 | 1 | 0 | Y | ETVQHAFPPG | 100 | | | | | | |
| NS3 | 1585 | 0.76 | 2 | 2 | 0 | Y | TVQHAFPPGR | 78.12 | TVQHAFPPGK | 21.88 | | | | |
| NS3 | 1586 | 0.76 | 2 | 2 | 0 | Y | VQHAFPPGRA | 78.12 | VQHAFPPGKA | 21.88 | | | | |
| NS3 | 1587 | 0.76 | 2 | 2 | 0 | Y | QHAFPPGRAH | 78.12 | QHAFPPGKAH | 21.88 | | | | |
| NS3 | 1588 | 0.76 | 2 | 2 | 0 | Y | HAFPPGRAHE | 78.12 | VHAFPPGKAHE | 21.88 | | | | |
| NS3 | 1589 | 0.76 | 2 | 2 | 0 | Y | AFPPGRAHEV | 78.12 | HAFPPGKAHEV | 21.88 | | | | |
| NS3 | 1590 | 0.76 | 2 | 2 | 0 | Y | FPPGRAHEVH | 78.12 | AFPPGKAHEV | 21.88 | | | | |
| NS3 | 1591 | 0.76 | 2 | 2 | 0 | Y | PPGRAHEVHQ | 78.12 | FPPGKAHEVHQ | 21.88 | | | | |
| NS3 | 1592 | 0.76 | 2 | 2 | 0 | Y | PGRAHEVHQC | 78.12 | PPGKAHEVHQC | 21.88 | | | | |
| NS3 | 1593 | 0.76 | 2 | 2 | 0 | Y | GRAHEVHQCQ | 78.12 | PGKAHEVHQCQ | 21.88 | | | | |
| NS3 | 1594 | 0.76 | 2 | 2 | 0 | Y | RAHEVHQCQP | 78.12 | GKAHEVHQCQP | 21.88 | | | | |
| NS3 | 1595 | 0.76 | 2 | 2 | 0 | Y | AHEVHQCQPG | 78.12 | KAHEVHQCQPG | 21.88 | | | | |
| NS3 | 1596 | 0 | 1 | 1 | 0 | Y | HEVHQCQPGE | 100 | | | | | | |
| NS3 | 1597 | 0 | 1 | 1 | 0 | Y | EVHQCQPGEL | 100 | | | | | | |
| NS3 | 1598 | 0.81 | 2 | 2 | 0 | Y | VHQCQPGELL | 75 | EVHQCQPGELI | 25 | | | | |
| NS3 | 1599 | 0.81 | 2 | 2 | 0 | Y | HQCQPGELLL | 75 | VHQCQPGELIL | 25 | | | | |
| NS3 | 1600 | 0.81 | 2 | 2 | 0 | Y | QCQPGELLLD | 75 | HQCQPGELILD | 25 | | | | |
| NS3 | 1601 | 0.81 | 2 | 2 | 0 | Y | CQPGELLLDT | 75 | QCQPGELILDT | 25 | | | | |
| NS3 | 1602 | 0.81 | 2 | 2 | 0 | Y | QPGELLLDTG | 75 | CQPGELILDTG | 25 | | | | |
| NS3 | 1603 | 1 | 3 | 3 | 0 | Y | PGELLLDTGR | 71.88 | QPGELILDTGR | 25 | QPGELLLDTGG | 3.12 | | |
| NS3 | 1604 | 1 | 3 | 3 | 0 | Y | GELLLDTGRK | 71.88 | PGELILDTGRK | 25 | PGELLLDTGGR | 3.12 | | |
| NS3 | 1616 | 1.31 | 4 | 4 | 0 | Y | GAVPIDLAKGT | 65.62 | GAIPIDLVKGT | 25 | GAIPIDLAKGT | 6.25 | GAVLIDLSKGT | 3.12 |

Fig. 34-59

Species: TBEV (11-mers)

| protein | block starting position | block entropy | total peptides in block | # peptides required to cover 99% of block | gap/X fraction |

Fig. 34-60

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1643 | 0.2 | 2 | 2 | 0 | Y | GNGLKTNETYV | 96.88 | GNGLKTNGTYV | 3.12 | | | | |
| NS3 | 1644 | 0.2 | 2 | 2 | 0 | Y | NGLKTNETYVS | 96.88 | NGLKTNGTYVS | 3.12 | | | | |
| NS3 | 1645 | 0.2 | 2 | 2 | 0 | Y | GLKTNETYVSS | 96.88 | GLKTNGTYVSS | 3.12 | | | | |
| NS3 | 1646 | 0.2 | 2 | 2 | 0 | Y | LKTNETYVSSI | 96.88 | LKTNGTYVSSI | 3.12 | | | | |
| NS3 | 1647 | 0.2 | 2 | 2 | 0 | Y | KTNETYVSSIA | 96.88 | KTNGTYVSSIA | 3.12 | | | | |
| NS3 | 1648 | 0.2 | 2 | 2 | 0 | Y | TNETYVSSIAQ | 96.88 | TNGTYVSSIAQ | 3.12 | | | | |
| NS3 | 1649 | 0.2 | 2 | 2 | 0 | Y | NETYVSSIAQG | 96.88 | NGTYVSSIAQG | 3.12 | | | | |
| NS3 | 1650 | 0.2 | 2 | 2 | 0 | Y | ETYVSSIAQGE | 96.88 | GTYVSSIAQGE | 3.12 | | | | |
| NS3 | 1651 | 0.45 | 2 | 2 | 0 | Y | TYVSSIAQGEA | 90.62 | TYVSSIAQGEV | 3.12 | | | | |
| NS3 | 1652 | 0.45 | 2 | 2 | 0 | Y | YVSSIAQGEAE | 90.62 | YVSSIAQGEVE | 3.12 | | | | |
| NS3 | 1653 | 0.64 | 3 | 3 | 0 | Y | VSSIAQGEAEK | 87.5 | VSSIAQGEVEK | 9.38 | VSSIAQGEAER | 3.12 | | |
| NS3 | 1654 | 0.64 | 3 | 3 | 0 | Y | SSIAQGEAEKS | 87.5 | SSIAQGEVEKS | 9.38 | SSIAQGEAERS | 3.12 | | |
| NS3 | 1655 | 0.64 | 3 | 3 | 0 | Y | SIAQGEAEKSR | 87.5 | SIAQGEVEKSR | 9.38 | SIAQGEAERSR | 3.12 | | |
| NS3 | 1656 | 0.64 | 3 | 3 | 0 | Y | IAQGEAEKSRP | 87.5 | IAQGEVEKSRP | 9.38 | IAQGEAERSRP | 3.12 | | |
| NS3 | 1657 | 0.84 | 4 | 4 | 0 | Y | AQGEAEKSRPN | 84.38 | AQGEVEKSRPN | 9.38 | AQGEAERSRPN | 3.12 | AQGEAEKSRPS | 3.12 |
| NS3 | 1658 | 0.84 | 4 | 4 | 0 | Y | QGEAEKSRPNL | 84.38 | QGEVEKSRPNL | 9.38 | QGEAERSRPNL | 3.12 | QGEAEKSRPSL | 3.12 |
| NS3 | 1659 | 0.84 | 4 | 4 | 0 | Y | GEAEKSRPNLP | 84.38 | GEVEKSRPNLP | 9.38 | GEAERSRPNLP | 3.12 | GEAEKSRPSLP | 3.12 |
| NS3 | 1660 | 1.66 | 5 | 5 | 0 | Y | EAEKSRPNLPP | 50 | EVEKSRPNLPQ | 34.38 | EAERSRPNLPQ | 3.12 | EAEKSRPSLPP | 3.12 |
| NS3 | 1661 | 1.66 | 5 | 5 | 0 | Y | AEKSRPNLPPA | 50 | VEKSRPNLPQA | 34.38 | AERSRPNLPQA | 3.12 | AEKSRPSLPPA | 3.12 |
| NS3 | 1662 | 1.33 | 4 | 4 | 0 | Y | EKSRPNLPPAV | 50 | EKSRPSLPPAV | 43.75 | ERSRPNLPQAV | 3.12 | | |
| NS3 | 1674 | 1.52 | 5 | 5 | 0 | Y | GTGWTAKGQIT | 59.38 | GTGWTSKGQIT | 28.12 | GMGWTAKGQIT | 3.12 | GIGWTAKGQIT | 3.12 |
| NS3 | 1675 | 1.52 | 5 | 5 | 0 | Y | TGWTAKGQITV | 59.38 | TGWTSKGQITV | 28.12 | MGWTAKGQITV | 6.25 | IGWTAKGQITV | 3.12 |
| NS3 | 1676 | 0.86 | 2 | 2 | 0 | Y | GWTAKGQITVL | 71.88 | GWTSKGQITVL | 28.12 | GSGWTAKGQIT | 6.25 | | |
| NS3 | 1677 | 0.86 | 2 | 2 | 0 | Y | WTAKGQITVLD | 71.88 | WTSKGQITVLD | 28.12 | SGWTAKGQITV | 6.25 | | |

Fig. 34-61

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|

Fig. 34-62

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1702 | 0.2 | 2 | 2 | 0 | Y | LIRQCIDRRLR | 96.88 | LIRQCTDRRLR | 3.12 | | | | |
| NS3 | 1703 | 0.2 | 2 | 2 | 0 | Y | IRQCIDRRLRT | 96.88 | IRQCTDRRLRT | 3.12 | | | | |
| NS3 | 1704 | 0.2 | 2 | 2 | 0 | Y | RQCIDRRLRTL | 96.88 | RQCTDRRLRTL | 3.12 | | | | |
| NS3 | 1705 | 0.2 | 2 | 2 | 0 | Y | QCIDRRLRTLV | 96.88 | QCTDRRLRTLV | 3.12 | | | | |
| NS3 | 1706 | 0.2 | 2 | 2 | 0 | Y | CIDRRLRTLVL | 96.88 | CTDRRLRTLVL | 3.12 | | | | |
| NS3 | 1707 | 0.2 | 2 | 2 | 0 | Y | IDRRLRTLVLA | 96.88 | TDRRLRTLVLA | 3.12 | | | | |
| NS3 | 1708 | 0 | 1 | 1 | 0 | Y | DRRLRTLVLAP | 100 | | | | | | |
| NS3 | 1709 | 0 | 1 | 1 | 0 | Y | RRLRTLVLAPT | 100 | | | | | | |
| NS3 | 1710 | 0 | 1 | 1 | 0 | Y | RLRTLVLAPTR | 100 | | | | | | |
| NS3 | 1711 | 0 | 1 | 1 | 0 | Y | LRTLVLAPTRV | 100 | | | | | | |
| NS3 | 1712 | 0 | 1 | 1 | 0 | Y | RTLVLAPTRVV | 100 | | | | | | |
| NS3 | 1713 | 0 | 1 | 1 | 0 | Y | TLVLAPTRVVL | 100 | | | | | | |
| NS3 | 1714 | 0 | 1 | 1 | 0 | Y | LVLAPTRVVLK | 100 | | | | | | |
| NS3 | 1715 | 0 | 1 | 1 | 0 | Y | VLAPTRVVLKE | 100 | | | | | | |
| NS3 | 1716 | 0 | 1 | 1 | 0 | Y | LAPTRVVLKEM | 100 | | | | | | |
| NS3 | 1717 | 0 | 1 | 1 | 0 | Y | APTRVVLKEME | 100 | | | | | | |
| NS3 | 1718 | 0 | 1 | 1 | 0 | Y | PTRVVLKEMER | 100 | | | | | | |
| NS3 | 1719 | 0 | 1 | 1 | 0 | Y | TRVVLKEMERA | 100 | | | | | | |
| NS3 | 1720 | 0 | 1 | 1 | 0 | Y | RVVLKEMERAL | 100 | | | | | | |
| NS3 | 1721 | 0.74 | 3 | 3 | 0 | Y | VVLKEMERALN | 84.38 | VVLKEMERALS | 12.5 | VVLKEMERALT | 3.12 | | |
| NS3 | 1722 | 0.74 | 3 | 3 | 0 | Y | VLKEMERALNG | 84.38 | VLKEMERALSG | 12.5 | VLKEMERALTG | 3.12 | | |
| NS3 | 1723 | 0.74 | 3 | 3 | 0 | Y | LKEMERALNGK | 84.38 | LKEMERALSGK | 12.5 | LKEMERALTGK | 3.12 | | |
| NS3 | 1724 | 0.74 | 3 | 3 | 0 | Y | KEMERALNGKR | 84.38 | KEMERALSGKR | 12.5 | KEMERALTGKR | 3.12 | | |
| NS3 | 1725 | 0.74 | 3 | 3 | 0 | Y | EMERALNGKRV | 84.38 | EMERALSGKRV | 12.5 | EMERALTGKRV | 3.12 | | |

Fig. 34-63

Species: TBEV (11-mers)

| protein | block starting position | block

Fig. 34-64

Species: TBEV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1761 | 0.2 | 2 | 2 | 0 | Y | VNRRLLPQGRQ | 96.88 | VSRRLLPQGRQ | 3.12 | | | | |
| NS3 | 1762 | 0.2 | 2 | 2 | 0 | Y | NRRLLPQ

Fig. 34-65

Species: TBEV (11-mers)

| protein | block star

Fig. 34-66

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1809 | 0.2 | 2 | 2 | 0 | Y | MTATPPGKSEP | 96.88 | MTATRPGKSEP | 3.12 | | | | | | |
| NS3 | 1810 | 0.2 | 2 | 2 | 0 | Y | TATPPGKSEPF | 96.88 | TATRPGKSEPF | 3.12 | | | | | | |
| NS3 | 1811 | 0.2 | 2 | 2 | 0 | Y | ATPPGKSEPFP | 96.88 | ATRPGKSEPFP | 3.12 | | | | | | |
| NS3 | 1812 | 0.2 | 2 | 2 | 0 | Y | TPPGKSEPFPE | 96.88 | TRPGKSEPFPE | 3.12 | | | | | | |
| NS3 | 1813 | 0.2 | 2 | 2 | 0 | Y | PPGKSEPFPES | 96.88 | RPGKSEPFPES | 3.12 | | | | | | |
| NS3 | 1814 | 0 | 1 | 1 | 0 | Y | PGKSEPFPESN | 100 | | | | | | | | |
| NS3 | 1815 | 0.2 | 2 | 2 | 0 | Y | GKSEPFPESNG | 96.88 | GKSEPFPESNR | 3.12 | | | | | | |
| NS3 | 1816 | 0.2 | 2 | 2 | 0 | Y | KSEPFPESNGA | 96.88 | KSEPFPESNRG | 3.12 | | | | | | |
| NS3 | 1817 | 0.2 | 2 | 2 | 0 | Y | SEPFPESNGAI | 96.88 | SEPFPESNRGI | 3.12 | | | | | | |
| NS3 | 1818 | 1.16 | 3 | 3 | 0 | Y | EPPFPESNGAIS | 53.12 | EPPFPESNRGIT | 43.75 | EPFPESNRGIT | 3.12 | | | | |
| NS3 | 1819 | 1.16 | 3 | 3 | 0 | Y | PFPESNGAISS | 53.12 | PFPESNRGITS | 43.75 | PFPESNRGITS | 3.12 | | | | |
| NS3 | 1820 | 1.16 | 3 | 3 | 0 | Y | FPESNGAISSE | 53.12 | FPESNRGITSE | 43.75 | FPESNRGITSE | 3.12 | | | | |
| NS3 | 1821 | 1.16 | 3 | 3 | 0 | Y | PESNGAISSEE | 53.12 | PESNRGITSEV | 43.75 | PESNRGITSEV | 3.12 | | | | |
| NS3 | 1822 | 1.69 | 4 | 4 | 0 | Y | ESNGAISSEEK | 43.75 | ESNGAITSEEK | 28.12 | ESNGAITSEER | 25 | ESNRGITSEVK | 3.12 | | |
| NS3 | 1823 | 1.69 | 4 | 4 | 0 | Y | SNGAISSEEKQ | 43.75 | SNGAITSEEKQ | 28.12 | SNGAITSEERQ | 25 | SNRGITSEVKQ | 3.12 | | |
| NS3 | 1824 | 1.69 | 4 | 4 | 0 | Y | NGAISSEEKQI | 43.75 | NGAITSEEKQI | 28.12 | NGAITSEERQI | 25 | NRGITSEVKQI | 3.12 | | |
| NS3 | 1825 | 1.69 | 4 | 4 | 0 | Y | GAISSEEKQIP | 43.75 | GAITSEEKQIP | 28.12 | GAITSEERQIP | 25 | RGITSEVKQIP | 3.12 | | |
| NS3 | 1829 | 1.61 | 5 | 5 | 0 | Y | SEEKQIPDGEW | 59.38 | SEEKQIPEGEW | 21.88 | SEEQIPEGEW | 12.5 | SEERQIPNGEW | 3.12 | SEVKQIPEGEW | 3.12 |
| NS3 | 1830 | 1.61 | 5 | 5 | 0 | Y | EEKQIPDGEWR | 59.38 | EEKQIPEGEWR | 21.88 | EERQIPEGEWR | 12.5 | EVKQIPEGEWR | 3.12 | EERQIPNGEWR | 3.12 |
| NS3 | 1831 | 1.61 | 5 | 5 | 0 | Y | EKQIPDGEWRD | 59.38 | EKQIPEGEWRD | 21.88 | ERQIPEGEWRD | 12.5 | VKQIPEGEWRD | 3.12 | ERQIPNGEWRD | 3.12 |
| NS3 | 1832 | 1.5 | 4 | 4 | 0 | Y | KQIPDGEWRDG | 59.38 | KQIPEGEWRDG | 21.88 | RQIPEGEWRDG | 15.62 | RQIPNGEWRDG | 3.12 | | |
| NS3 | 1833 | 0.82 | 3 | 3 | 0 | Y | QIPDGEWRDGF | 81.25 | QIPEGEWRDGF | 15.62 | QIPNGEWRDGF | 3.12 | | | | |
| NS3 | 1834 | 0.82 | 3 | 3 | 0 | Y | IPDGEWRDGFD | 81.25 | IPEGEWRDGFD | 15.62 | IPNGEWRDGFD | 3.12 | | | | |
| NS3 | 1835 | 0.82 | 3 | 3 | 0 | Y | PDGEWRDGFDW | 81.25 | PEGEWRDGFDW | 15.62 | PNGEWRDGFDW | 3.12 | | | | |

Fig. 34-67

Species: TBEV (11-mers)

| protein

Fig. 34-68

Species: TBEV (11-mers)

| protein | block star

Fig. 34-69

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 34-70

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1908 | 0 | 1 | 1 | 0 | Y | MGANLDYSRVI | 100 | | | | | | |
| NS3 | 1909 | 0 | 1 | 1 | 0 | Y | GANLDYSRVID | 100 | | | | | | |
| NS3 | 1910 | 0 | 1 | 1 | 0 | Y | ANLDVSRVIDG | 100 | | | | | | |
| NS3 | 1911 | 0 | 1 | 1 | 0 | Y | NLDVSRVIDGR | 100 | | | | | | |
| NS3 | 1912 | 0 | 1 | 1 | 0 | Y | LDVSRVIDGRT | 100 | | | | | | |
| NS3 | 1913 | 0 | 1 | 1 | 0 | Y | DVSRVIDGRTN | 100 | | | | | | |
| NS3 | 1914 | 0 | 1 | 1 | 0 | Y | VSRVIDGRTNI | 100 | | | | | | |
| NS3 | 1915 | 0 | 1 | 1 | 0 | Y | SRVIDGRTNIK | 100 | | | | | | |
| NS3 | 1916 | 0 | 1 | 1 | 0 | Y | RVIDGRTNIKP | 100 | | | | | | |
| NS3 | 1917 | 0 | 1 | 1 | 0 | Y | VIDGRTNIKPE | 100 | | | | | | |
| NS3 | 1918 | 0 | 1 | 1 | 0 | Y | IDGRTNIKPEE | 100 | | | | | | |
| NS3 | 1919 | 0 | 1 | 1 | 0 | Y | DGRTNIKPEEV | 100 | | | | | | |
| NS3 | 1920 | 0 | 1 | 1 | 0 | Y | GRTNIKPEEVD | 100 | | | | | | |
| NS3 | 1921 | 0 | 1 | 1 | 0 | Y | RTNIKPEEVDG | 100 | | | | | | |
| NS3 | 1922 | 0.81 | 2 | 2 | 0 | Y | TNIKPEEVDGR | 75 | TNIKPEEVDGK | 25 | | | | |
| NS3 | 1923 | 0.81 | 2 | 2 | 0 | Y | NIKPEEVDGRV | 75 | NIKPEEVDGKV | 25 | | | | |
| NS3 | 1924 | 0.81 | 2 | 2 | 0 | Y | IKPEEVDGRVE | 75 | IKPEEVDGKVE | 25 | | | | |
| NS3 | 1925 | 0.81 | 2 | 2 | 0 | Y | KPEEVDGRVEL | 75 | KPEEVDGKVEL | 25 | | | | |
| NS3 | 1926 | 1 | 3 | 2 | 0 | Y | PEEVDGRVELT | 71.88 | PEEVDGKVELT | 25 | PEEVDGRVELI | 3.12 | | |
| NS3 | 1927 | 1 | 3 | 2 | 0 | Y | EEVDGRVELTG | 71.88 | EEVDGKVELTG | 25 | EEVDGRVELIG | 3.12 | | |
| NS3 | 1928 | 1 | 3 | 2 | 0 | Y | EVDGRVELTGT | 71.88 | EVDGKVELTGT | 25 | EVDGRVELIGT | 3.12 | | |
| NS3 | 1929 | 1 | 3 | 3 | 0 | Y | VDGRVELTGTR | 71.88 | VDGKVELTGTR | 25 | VDGRVELIGTR | 3.12 | | |
| NS3 | 1930 | 1 | 3 | 3 | 0 | Y | DGRVELTGTRR | 71.88 | DGKVELTGTRR | 25 | DGRVELIGTRR | 3.12 | | |
| NS3 | 1931 | 1 | 3 | 3 | 0 | Y | GRVELTGTRRV | 71.88 | GKVELTGTRRV | 25 | GRVELIGTRRV | 3.12 | | |

Fig. 34-71

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 34-72

Species: TBEV (11-mers)

| protein | block

Fig. 34-73

Species: TBEV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1980 | 0.6 | 4 | 4 | 0 | Y | KEAQILLDNIT | 90.62 | KEAQILLDNII | 3.12 | KEAQILLDDIT | 3.12 | KEGQILLDNIT | 3.12 |
| NS3 | 1981 | 0.6 | 4 | 4 | 0 | Y | EAQILLDNITT | 90.62 | EAQILLDDITT | 3.12 | EAQILLDNITT | 3.12 | EGQILLDNITT | 3.12 |
| NS3 | 1982 | 0.6 | 4 | 4 | 0 | Y | AQILLDNITTL | 90.62 | AQILLDNIITL | 3.12 | GQILLDNITTL | 3.12 | AQILLDDITTL | 3.12 |
| NS3 | 1983 | 0.4 | 3 | 3 | 0 | Y | QILLDNITTLR | 93.75 | QILLDDITTLR | 3.12 | QILLDNIITLR | 3.12 | | |
| NS3 | 1984 | 0.4 | 3 | 3 | 0 | Y | ILLDNITTLRG | 93.75 | ILLDDITTLRG | 3.12 | ILLDNIITLRG | 3.12 | | |
| NS3 | 1985 | 0.4 | 3 | 3 | 0 | Y | LLDNITTLRGP | 93.75 | LLDDITTLRGP | 3.12 | LLDNIITLRGP | 3.12 | | |
| NS3 | 1986 | 0.4 | 3 | 3 | 0 | Y | LDNITTLRGPV | 93.75 | LDNIITLRGPV | 3.12 | LDDITTLRGPV | 3.12 | | |
| NS3 | 1987 | 0.6 | 4 | 4 | 0 | Y | DNITTLRGPVA | 90.62 | DNIITLRGPVA | 3.12 | DDITTLRGPVA | 3.12 | DNITTLRGPVV | 3.12 |
| NS3 | 1988 | 0.6 | 4 | 4 | 0 | Y | NITTLRGPVAT | 90.62 | NIITLRGPVAT | 3.12 | DITTLRGPVAT | 3.12 | NIITLRGPVAT | 3.12 |
| NS3 | 1989 | 0.4 | 3 | 3 | 0 | Y | ITTLRGPVATF | 93.75 | IITLRGPVATF | 3.12 | ITLRGPVATF | 3.12 | | |
| NS3 | 1990 | 0.4 | 3 | 3 | 0 | Y | TTLRGPVATFY | 93.75 | ITLRGPVATFY | 3.12 | ITLRGPVATFY | 3.12 | | |
| NS3 | 1991 | 0.2 | 2 | 2 | 0 | Y | TLRGPVATFYG | 96.88 | TLRGPVATFYG | 3.12 | | | | |
| NS3 | 1992 | 0.2 | 2 | 2 | 0 | Y | LRGPVATFYGP | 96.88 | LRGPVATFYGP | 3.12 | | | | |
| NS3 | 1993 | 0.2 | 2 | 2 | 0 | Y | RGPVATFYGPE | 96.88 | RGPVATFYGPE | 3.12 | | | | |
| NS3 | 1994 | 0.2 | 2 | 2 | 0 | Y | GPVATFYGPEQ | 96.88 | GPVATFYGPEQ | 3.12 | | | | |
| NS3 | 1995 | 0.2 | 2 | 2 | 0 | Y | PVATFYGPEQD | 96.88 | PVATFYGPEQD | 3.12 | | | | |
| NS3 | 1996 | 0.4 | 3 | 3 | 0 | Y | VATFYGPEQDK | 93.75 | VTFYGPEQDK | 3.12 | VATFYGPEQDR | 3.12 | | |
| NS3 | 1997 | 0.4 | 3 | 3 | 0 | Y | ATFYGPEQDKM | 93.75 | ATFYGPEQDRM | 3.12 | VTFYGPEQDKM | 3.12 | | |
| NS3 | 1998 | 0.2 | 2 | 2 | 0 | Y | TFYGPEQDKMP | 96.88 | TFYGPEQDRMP | 3.12 | | | | |
| NS3 | 1999 | 0.2 | 2 | 2 | 0 | Y | FYGPEQDKMPE | 96.88 | FYGPEQDRMPE | 3.12 | | | | |
| NS3 | 2000 | 0.2 | 2 | 2 | 0 | Y | YGPEQDKMPEV | 96.88 | YGPEQDRMPEV | 3.12 | | | | |
| NS3 | 2001 | 0.2 | 2 | 2 | 0 | Y | GPEQDKMPEVA | 96.88 | GPEQDRMPEVA | 3.12 | | | | |
| NS3 | 2002 | 0.2 | 2 | 2 | 0 | Y | PEQDKMPEVAG | 96.88 | PEQDRMPEVAG | 3.12 | | | | |
| NS3 | 2003 | 0.2 | 2 | 2 | 0 | Y | EQDKMPEVAGH | 96.88 | EQDRMPEVAGH | 3.12 | | | | |

Fig. 34-74

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 2004 | 0.4 | 3 | 3 | 0 | Y | QDKMPEVAGHF | 93.75 | QDRMPEVAGHF | 3.12 | QDKMPEVAGHY | 3.12 |
| NS3 | 2005 | 0.4 | 3 | 3 | 0 | Y | DKMPEVAGHFR | 93.75 | DRMPEVAGHFR | 3.12 | DKMPEVAGHYR | 3.12 |
| NS3 | 2006 | 0.4 | 3 | 3 | 0 | Y | KMPEVAGHFRL | 93.75 | KMPEVAGHYRL | 3.12 | RMPEVAGHFRL | 3.12 |
| NS3 | 2007 | 0.2 | 2 | 2 | 0 | Y | MPEVAGHFRLT | 96.88 | MPEVAGHYRLT | 3.12 | | |
| NS3 | 2008 | 0.2 | 2 | 2 | 0 | Y | PEVAGHFRLTE | 96.88 | PEVAGHYRLTE | 3.12 | | |
| NS3 | 2009 | 0.2 | 2 | 2 | 0 | Y | EVAGHFRLTEE | 96.88 | EVAGHYRLTEE | 3.12 | | |
| NS3 | 2010 | 0.2 | 2 | 2 | 0 | Y | VAGHFRLTEEK | 96.88 | VAGHYRLTEEK | 3.12 | | |
| NS3 | 2011 | 0.2 | 2 | 2 | 0 | Y | AGHFRLTEEKR | 96.88 | AGHYRLTEEKR | 3.12 | | |
| NS3 | 2012 | 0.2 | 2 | 2 | 0 | Y | GHFRLTEEKRK | 96.88 | GHYRLTEEKRK | 3.12 | | |
| NS3 | 2013 | 0.2 | 2 | 2 | 0 | Y | HFRLTEEKRKH | 96.88 | HYRLTEEKRKH | 3.12 | | |
| NS3 | 2014 | 0.2 | 2 | 2 | 0 | Y | FRLTEEKRKHF | 96.88 | YRLTEEKRKHF | 3.12 | | |
| NS3 | 2015 | 0 | 1 | 1 | 0 | Y | RLTEEKRKHFR | 100 | | | | |
| NS3 | 2016 | 0 | 1 | 1 | 0 | Y | LTEEKRKHFRH | 100 | | | | |
| NS3 | 2017 | 0 | 1 | 1 | 0 | Y | TEEKRKHFRHL | 100 | | | | |
| NS3 | 2018 | 0 | 1 | 1 | 0 | Y | EEKRKHFRHLL | 100 | | | | |
| NS3 | 2019 | 0 | 1 | 1 | 0 | Y | EKRKHFRHLLT | 100 | | | | |
| NS3 | 2020 | 0 | 1 | 1 | 0 | Y | KRKHFRHLLTH | 100 | | | | |
| NS3 | 2021 | 0 | 1 | 1 | 0 | Y | RKHFRHLLTHC | 100 | | | | |
| NS3 | 2022 | 0 | 1 | 1 | 0 | Y | KHFRHLLTHCD | 100 | | | | |
| NS3 | 2023 | 0 | 1 | 1 | 0 | Y | HFRHLLTHCDF | 100 | | | | |
| NS3 | 2024 | 0 | 1 | 1 | 0 | Y | FRHLLTHCDFT | 100 | | | | |
| NS3 | 2025 | 0 | 1 | 1 | 0 | Y | RHLLTHCDFTP | 100 | | | | |
| NS3 | 2026 | 0 | 1 | 1 | 0 | Y | HLLTHCDFTPW | 100 | | | | |
| NS3 | 2027 | 0 | 1 | 1 | 0 | Y | LLTHCDFTPWL | 100 | | | | |

Fig. 34-75

Species: TBEV (11-mers)

| protein | block starting position | block entropy | total

Fig. 34-76

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequ

Fig. 34-77

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 2076 | 0.2 | 2 | 2 | 0 | Y | PNGAERTLRPV | 96.88 | PNGAERTLKPV | 3.12 | | |
| NS3 | 2077 | 0.2 | 2 | 2 | 0 | Y | NGAERTLRPVW | 96.88 | NGAERTLKPVW | 3.12 | | |
| NS3 | 2078 | 1 | 3 | 3 | 0 | Y | GAERTLRPVWR | 71.88 | GAERTLRPVWK | 25 | GAERTLKPVWR | 3.12 |
| NS3 | 2079 | 1 | 3 | 3 | 0 | Y | AERTLRPVWRD | 71.88 | AERTLRPVWKD | 25 | AERTLKPVWRD | 3.12 |
| NS3 | 2080 | 1 | 3 | 3 | 0 | Y | ERTLRPVWRDA | 71.88 | ERTLRPVWKDA | 25 | ERTLKPVWRDA | 3.12 |
| NS3 | 2081 | 1 | 3 | 3 | 0 | Y | RTLRPVWRDAR | 71.88 | RTLRPVWKDAR | 25 | RTLKPVWRDAR | 3.12 |
| NS3 | 2082 | 1 | 3 | 3 | 0 | Y | TLRPVWRDARM | 71.88 | TLRPVWKDARM | 25 | TLKPVWRDARM | 3.12 |
| NS3 | 2083 | 1 | 3 | 3 | 0 | Y | LRPVWRDARMF | 71.88 | LRPVWKDARMF | 25 | LKPVWRDARMF | 3.12 |
| NS3 | 2084 | 1 | 3 | 3 | 0 | Y | RPVWRDARMFR | 71.88 | RPVWKDARMFK | 25 | KPVWRDARMFR | 3.12 |
| NS3 | 2085 | 0.81 | 2 | 2 | 0 | Y | PVWRDARMFRE | 75 | PVWKDARMFKE | 25 | | |
| NS3 | 2086 | 0.81 | 2 | 2 | 0 | Y | VWRDARMFREG | 75 | VWKDARMFKEG | 25 | | |
| NS3 | 2087 | 0.81 | 2 | 2 | 0 | Y | WRDARMFREGR | 75 | WKDARMFKEGR | 25 | | |
| NS3 | 2088 | 0.81 | 2 | 2 | 0 | Y | RDARMFREGRD | 75 | KDARMFKEGRD | 25 | | |
| NS3 | 2089 | 0.81 | 2 | 2 | 0 | Y | DARMFREGRDI | 75 | DARMFKEGRDI | 25 | | |
| NS3 | 2090 | 0.81 | 2 | 2 | 0 | Y | ARMFREGRDIR | 75 | ARMFKEGRDIK | 25 | | |
| NS3 | 2091 | 0.81 | 2 | 2 | 0 | Y | RMFREGRDIRE | 75 | RMFKEGRDIKE | 25 | | |
| NS3 | 2092 | 0.81 | 2 | 2 | 0 | Y | MFREGRDIREF | 75 | MFKEGRDIKEF | 25 | | |
| NS3 | 2093 | 1.12 | 3 | 3 | 0 | Y | FREGRDIREFV | 68.75 | FKEGRDIKEFV | 25 | FREGRDIREFI | 6.25 |
| NS3 | 2094 | 1.12 | 3 | 3 | 0 | Y | REGRDIREFVA | 68.75 | KEGRDIKEFVA | 25 | REGRDIREFIA | 6.25 |
| NS3 | 2095 | 1.12 | 3 | 3 | 0 | Y | EGRDIREFVAY | 68.75 | EGRDIKEFVAY | 25 | EGRDIREFIAY | 6.25 |
| NS3 | 2096 | 1.12 | 3 | 3 | 0 | Y | GRDIREFVAYA | 68.75 | GRDIKEFVAYA | 25 | GRDIREFIAYA | 6.25 |
| NS3 | 2097 | 1.12 | 3 | 3 | 0 | Y | RDIREFVAYAS | 68.75 | RDIKEFVAYAS | 25 | RDIREFIAYAS | 6.25 |
| NS3 | 2098 | 1.12 | 3 | 3 | 0 | Y | DIREFVAYASG | 68.75 | DIKEFVAYASG | 25 | DIREFIAYASG | 6.25 |
| NS3 | 2099 | 1.12 | 3 | 3 | 0 | Y | IREFVAYASGR | 68.75 | IKEFVAYASGR | 25 | IREFIAYASGR | 6.25 |

Fig. 34-78

Species: TBEV (11-mers)

| protein

Fig. 34-79

Species: TBEV (

Fig. 34-80

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 34-81

Species: TBEV (11-mers)

|

Fig. 34-82

Species: TBEV (11-mers)

| protein | block starting position | block entropy | total peptides in block | # peptides required to cover 99% of block | gap/X fraction | 99% of block covered w/ <= 5 peptides? | peptide | frequency | peptide (required to cover 99% of block) | frequency |
|---|---|---|---|---|---|---|---|---|---|---|
| NS4A | 2204 | 0.9 | 2 | 2 | 0 | Y | LWAGGVSYGNM | 68.75 | LWAGGVSYGNM | 31.25 |
| NS4A | 2205 | 0.9 | 2 | 2 | 0 | Y | WAGGVSYGNMA | 68.75 | WAGGVSYGNMA | 31.25 |
| NS4A | 2206 | 0.9 | 2 | 2 | 0 | Y | AGGVSYGNMAG | 68.75 | AGGVGYGNMAG | 31.25 |
| NS4A | 2207 | 0.9 | 2 | 2 | 0 | Y | GGVSYGNMAGV | 68.75 | GGVGYGNMAGV | 31.25 |
| NS4A | 2208 | 0.9 | 2 | 2 | 0 | Y | GVSYGNMAGVA | 68.75 | GVGYGNMAGVA | 31.25 |
| NS4A | 2209 | 0.9 | 2 | 2 | 0 | Y | VSYGNMAGVAL | 68.75 | VGYGNMAGVAL | 31.25 |
| NS4A | 2210 | 0.9 | 2 | 2 | 0 | Y | SYGNMAGVALI | 68.75 | GYGNMAGVALI | 31.25 |
| NS4A | 2211 | 0 | 1 | 1 | 0 | Y | YGNMAGVALIF | 100 | | |
| NS4A | 2212 | 0 | 1 | 1 | 0 | Y | GNMAGVALIFY | 100 | | |
| NS4A | 2213 | 0 | 1 | 1 | 0 | Y | NMAGVALIFYT | 100 | | |
| NS4A | 2214 | 0 | 1 | 1 | 0 | Y | MAGVALIFYTL | 100 | | |
| NS4A | 2215 | 0 | 1 | 1 | 0 | Y | AGVALIFYTLL | 100 | | |
| NS4A | 2216 | 0 | 1 | 1 | 0 | Y | GVALIFYTLLT | 100 | | |
| NS4A | 2217 | 0 | 1 | 1 | 0 | Y | VALIFYTLLTV | 100 | | |
| NS4A | 2218 | 0 | 1 | 1 | 0 | Y | ALIFYTLLTVL | 100 | | |
| NS4A | 2219 | 0 | 1 | 1 | 0 | Y | LIFYTLLTVLQ | 100 | | |
| NS4A | 2220 | 0 | 1 | 1 | 0 | Y | IFYTLLTVLQP | 100 | | |
| NS4A | 2221 | 0 | 1 | 1 | 0 | Y | FYTLLTVLQPE | 100 | | |
| NS4A | 2222 | 0.2 | 2 | 2 | 0 | Y | YTLLTVLQPEA | 96.88 | YTLLTVLQPEV | 3.12 |
| NS4A | 2223 | 0.2 | 2 | 2 | 0 | Y | TLLTVLQPEAG | 96.88 | TLLTVLQPEVG | 3.12 |
| NS4A | 2224 | 0.2 | 2 | 2 | 0 | Y | LLTVLQPEAGK | 96.88 | LLTVLQPEVGK | 3.12 |
| NS4A | 2225 | 0.2 | 2 | 2 | 0 | Y | LTVLQPEAGKQ | 96.88 | LTVLQPEVGKQ | 3.12 |
| NS4A | 2226 | 0.2 | 2 | 2 | 0 | Y | TVLQPEAGKQR | 96.88 | TVLQPEVGKQR | 3.12 |
| NS4A | 2227 | 0.2 | 2 | 2 | 0 | Y | VLQPEAGKQRS | 96.88 | VLQPEVGKQRS | 3.12 |

Fig. 34-83

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4A | 2228 | 0.2 | 2 | 2 | 0 | Y | LQPEAGKQRSS | 96.88 | LQPEVGKQRSS | 3.12 |
| NS4A | 2229 | 0.2 | 2 | 2 | 0 | Y | QPEAGKQRSSD | 96.88 | QPEVGKQRSSD | 3.12 |
| NS4A | 2230 | 0.2 | 2 | 2 | 0 | Y | PEAGKQRSSDD | 96.88 | PEVGKQRSSDD | 3.12 |
| NS4A | 2231 | 0.2 | 2 | 2 | 0 | Y | EAGKQRSSDDN | 96.88 | EVGKQRSSDDN | 3.12 |
| NS4A | 2232 | 0.2 | 2 | 2 | 0 | Y | AGKQRSSDDNK | 96.88 | VGKQRSSDDNK | 3.12 |
| NS4A | 2233 | 0 | 1 | 1 | 0 | Y | GKQRSSDDNKL | 100 | | |
| NS4A | 2234 | 0 | 1 | 1 | 0 | Y | KQRSSDDNKLA | 100 | | |
| NS4A | 2235 | 0 | 1 | 1 | 0 | Y | QRSSDDNKLAY | 100 | | |
| NS4A | 2236 | 0 | 1 | 1 | 0 | Y | RSSDDNKLAYF | 100 | | |
| 2K | 2237 | 0 | 1 | 1 | 0 | Y | SSDDNKLAYFL | 100 | | |
| 2K | 2238 | 0 | 1 | 1 | 0 | Y | SDDNKLAYFLL | 100 | | |
| 2K | 2239 | 0 | 1 | 1 | 0 | Y | DDNKLAYFLLT | 100 | | |
| 2K | 2240 | 0 | 1 | 1 | 0 | Y | DNKLAYFLLTL | 100 | | |
| 2K | 2241 | 0 | 1 | 1 | 0 | Y | NKLAYFLLTLC | 100 | | |
| 2K | 2242 | 0 | 1 | 1 | 0 | Y | KLAYFLLTLCS | 100 | | |
| 2K | 2243 | 0.2 | 2 | 2 | 0 | Y | LAYFLLTLCSL | 96.88 | LAYFLLTLCSV | 3.12 |
| 2K | 2244 | 0.2 | 2 | 2 | 0 | Y | AYFLLTLCSLA | 96.88 | AYFLLTLCSVA | 3.12 |
| 2K | 2245 | 0.2 | 2 | 2 | 0 | Y | YFLLTLCSLAG | 96.88 | YFLLTLCSVAG | 3.12 |
| 2K | 2246 | 0.2 | 2 | 2 | 0 | Y | FLLTLCSLAGL | 96.88 | FLLTLCSVAGL | 3.12 |
| 2K | 2247 | 0.2 | 2 | 2 | 0 | Y | LLTLCSLAGLV | 96.88 | LLTLCSVAGLV | 3.12 |
| 2K | 2248 | 0.2 | 2 | 2 | 0 | Y | LTLCSLAGLVA | 96.88 | LTLCSVAGLVA | 3.12 |
| 2K | 2249 | 0.2 | 2 | 2 | 0 | Y | TLCSLAGLVAA | 96.88 | TLCSVAGLVAA | 3.12 |
| 2K | 2250 | 0.2 | 2 | 2 | 0 | Y | LCSLAGLVAAN | 96.88 | LCSVAGLVAAN | 3.12 |
| 2K | 2251 | 0.2 | 2 | 2 | 0 | Y | CSLAGLVAANE | 96.88 | CSVAGLVAANE | 3.12 |

Species: TBEV (11-mers)

Species: TBEV (

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2337 | 1.01 | 4 | 4 | 0 | Y | MRDLGGGAPFF | 78.12 | MRDLGGGTPFF | 15.62 | MRDLGGGAPFL | 3.12 | MRDLGGGAPFI | 3.12 |
| NS4B | 2338 | 1.01 | 4 | 4 | 0 | Y | RDLGGGAPFFG | 78.12 | RDLGGGTPFFG | 15.62 | RDLGGGAPFIG | 3.12 | RDLGGGAPFLG | 3.12 |
| NS4B | 2339 | 1.2 | 5 | 5 | 0 | Y | DLGGGAPFFGV | 75 | DLGGGTPFFGV | 15.62 | DLGGGAPFIGV | 3.12 | DLGGGAPFLGV | 3.12 |
| NS4B | 2340 | 1.2 | 5 | 5 | 0 | Y | LGGGAPFFGVA | 75 | LGGGTPFFGVA | 15.62 | LGGGAPFIGVA | 3.12 | LGGGAPFFGIA | 3.12 |
| NS4B | 2341 | 1.2 | 5 | 5 | 0 | Y | GGGAPFFGVAG | 75 | GGGTPFFGVAG | 15.62 | GGGAPFIGVAG | 3.12 | GGGAPFLGVAG | 3.12 |
| NS4B | 2342 | 1.2 | 5 | 5 | 0 | Y | GGAPFFGVAGH | 75 | GGTPFFGVAGH | 15.62 | GGAPFIGVAGH | 3.12 | GGAPFLGVAGH | 3.12 |
| NS4B | 2343 | 1.2 | 5 | 5 | 0 | Y | GAPFFGVAGHV | 75 | GTPFFGVAGHV | 15.62 | GAPFIGVAGHV | 3.12 | GAPFLGVAGHV | 3.12 |
| NS4B | 2348 | 2.08 | 5 | 4 | 0 | Y | GVAGHVMALGV | 34.38 | GVAGHVMTLGV | 25 | GVAGHVMSLGV | 21.88 | GIAGHYMALGV | 3.12 |
| NS4B | 2349 | 2.08 | 5 | 4 | 0 | Y | VAGHVMALGVW | 34.38 | VAGHVMTLGVW | 25 | VAGHVMSLGVW | 21.88 | IAGHYMALGVW | 3.12 |
| NS4B | 2350 | 1.93 | 4 | 4 | 0 | Y | AGHVMALGVWS | 37.5 | AGHVMTLGVWS | 25 | AGHYMSLGVWS | 15.62 | | |
| NS4B | 2351 | 1.93 | 4 | 4 | 0 | Y | GHVMALGVWSL | 37.5 | GHVMTLGVWSL | 25 | GHVMSLGVWSL | 15.62 | | |
| NS4B | 2352 | 1.93 | 4 | 4 | 0 | Y | HVMALGVWSLV | 37.5 | HVMTLGVWSLI | 25 | HVMSLGVWSLV | 15.62 | | |
| NS4B | 2353 | 1.93 | 4 | 4 | 0 | Y | VMALGVWSLVG | 37.5 | VMTLGVWSLIG | 25 | VMSLGVWSLVG | 15.62 | | |
| NS4B | 2354 | 1.93 | 4 | 4 | 0 | Y | MALGVWSLVGA | 37.5 | MTLGVWSLIGA | 25 | MSLGVWSLVGA | 15.62 | | |
| NS4B | 2355 | 1.36 | 3 | 3 | 0 | Y | ALGVWSLVGAT | 59.38 | TLGVWSLIGAT | 25 | SLGVWSLVGAT | 15.62 | | |
| NS4B | 2356 | 0.81 | 2 | 2 | 0 | Y | LGVWSLVGATP | 75 | LGVWSLIGATP | 25 | | | | |
| NS4B | 2357 | 0.81 | 2 | 2 | 0 | Y | GVWSLVGATPT | 75 | GVWSLIGATPT | 25 | | | | |
| NS4B | 2358 | 0.81 | 2 | 2 | 0 | Y | VWSLVGATPTS | 75 | VWSLIGATPTS | 25 | | | | |
| NS4B | 2359 | 0.81 | 2 | 2 | 0 | Y | VSLVGATPTSL | 75 | VSLIGATPTSL | 25 | | | | |
| NS4B | 2360 | 0.81 | 2 | 2 | 0 | Y | SLVGATPTSLY | 75 | SLIGATPTSLM | 25 | | | | |
| NS4B | 2361 | 0.81 | 2 | 2 | 0 | Y | LVGATPTSLYV | 75 | LIGATPTSLMV | 25 | | | | |
| NS4B | 2362 | 0.81 | 2 | 2 | 0 | Y | VGATPTSLYVG | 75 | IGATPTSLMVG | 25 | | | | |
| NS4B | 2363 | 0.81 | 2 | 2 | 0 | Y | GATPTSLYVGV | 75 | GATPTSLMVGV | 25 | | | | |
| NS4B | 2364 | 0.81 | 2 | 2 | 0 | Y | ATPTSLYVGVG | 75 | ATPTSLMVGVG | 25 | | | | |

Fig. 34-88

Species: TBEV (11-mers)

| protein | block starting position | block ent

Fig. 34-89

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2389 | 0 | 1 | 1 | 0 | Y | AELTQRAHKVF | 100 | | | | | | |
| NS4B | 2390 | 0 | 1 | 1 | 0 | Y | ELTQRAHKVFF | 100 | | | | | | |
| NS4B | 2391 | 0 | 1 | 1 | 0 | Y | LTQRAHKVFFS | 100 | | | | | | |
| NS4B | 2392 | 0 | 1 | 1 | 0 | Y | TQRAHKVFFSA | 100 | | | | | | |
| NS4B | 2393 | 0 | 1 | 1 | 0 | Y | QRAHKVFFSAM | 100 | | | | | | |
| NS4B | 2394 | 0 | 1 | 1 | 0 | Y | RAHKVFFSAMV | 100 | | | | | | |
| NS4B | 2395 | 0 | 1 | 1 | 0 | Y | AHKVFFSAMVR | 100 | | | | | | |
| NS4B | 2396 | 0 | 1 | 1 | 0 | Y | HKVFFSAMVRN | 100 | | | | | | |
| NS4B | 2397 | 0 | 1 | 1 | 0 | Y | KVFFSAMVRNP | 100 | | | | | | |
| NS4B | 2398 | 0 | 1 | 1 | 0 | Y | VFFSAMVRNPM | 100 | | | | | | |
| NS4B | 2399 | 0.2 | 2 | 2 | 0 | Y | FFSAMVRNPMV | 96.88 | FFSAMVRNPML | 3.12 | | | | |
| NS4B | 2400 | 0.2 | 2 | 2 | 0 | Y | FSAMVRNPMVD | 96.88 | FSAMVRNPMLD | 3.12 | | | | |
| NS4B | 2401 | 0.2 | 2 | 2 | 0 | Y | SAMVRNPMVDG | 96.88 | SAMVRNPMLDG | 3.12 | | | | |
| NS4B | 2402 | 0.2 | 2 | 2 | 0 | Y | AMVRNPMVDGD | 96.88 | AMVRNPMLDGD | 3.12 | | | | |
| NS4B | 2403 | 0.2 | 2 | 2 | 0 | Y | MVRNPMVDGDV | 96.88 | MVRNPMLDGDV | 3.12 | | | | |
| NS4B | 2404 | 0.2 | 2 | 2 | 0 | Y | VRNPMVDGDVI | 96.88 | VRNPMLDGDVI | 3.12 | | | | |
| NS4B | 2405 | 0.2 | 2 | 2 | 0 | Y | RNPMVDGDVIN | 96.88 | RNPMLDGDVIY | 3.12 | | | | |
| NS4B | 2406 | 0.2 | 2 | 2 | 0 | Y | NPMVDGDVINP | 96.88 | NPMLDGDVIYP | 3.12 | | | | |
| NS4B | 2407 | 0.2 | 2 | 2 | 0 | Y | PMVDGDVINPF | 96.88 | PMLDGDVIYPF | 3.12 | | | | |
| NS4B | 2408 | 0.2 | 2 | 2 | 0 | Y | MVDGDVINPFG | 96.88 | MLDGDVIYPFG | 3.12 | | | | |
| NS4B | 2409 | 0.2 | 2 | 2 | 0 | Y | VDGDVINPFGE | 96.88 | LDGDVIYPFGE | 3.12 | | | | |
| NS4B | 2410 | 0.2 | 2 | 2 | 0 | Y | DGDVINPFGEG | 96.88 | DGDVIYPFGEG | 3.12 | | | | |
| NS4B | 2411 | 0.2 | 2 | 2 | 0 | Y | GDVINPFGEGE | 96.88 | GDVIYPFGEGE | 3.12 | | | | |
| NS4B | 2412 | 0.64 | 3 | 3 | 0 | Y | DVINPFGEGEA | 87.5 | DVINPFGEGET | 9.38 | DVIYPFGEGET | 3.12 | | |

Fig. 34-90

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 34-91

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 34-92

Species: TBEV (11-mers)

| protein | block starting position | block entropy | total peptides in block | # peptides required to cover 99% of block | gap/X fraction | 99% of block covered w/ =>5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2475 | 0.81 | 2 | 2 | 0 | Y | LWTMPVACGLS | 75 | LWTMPVACGMS | 25 | | | | |
| NS4B | 2476 | 1.12 | 3 | 3 | 0 | Y | WTMPVACGLSG | 68.75 | WTMPVACGMSG | 25 | WTMPVACGLSS | 6.25 | | |
| NS4B | 2477 | 1.12 | 3 | 3 | 0 | Y | TMPVACGLSGV | 68.75 | TMPVACGMSGV | 25 | TMPVACGLSSV | 6.25 | | |
| NS4B | 2478 | 1.12 | 3 | 3 | 0 | Y | MPVACGLSGVV | 68.75 | MPVACGMSGVV | 25 | MPVACGLSSVV | 6.25 | | |
| NS4B | 2479 | 1.31 | 4 | 4 | 0 | Y | PVACGLSGVVR | 65.62 | PVACGMSGVVR | 25 | PVACGLSSVVR | 6.25 | PVACGLSGVVT | 3.12 |
| NS4B | 2480 | 1.31 | 4 | 4 | 0 | Y | VACGLSGVVRG | 65.62 | VACGMSGVVRG | 25 | VACGLSSVVRG | 6.25 | VACGLSGVVTG | 3.12 |
| NS4B | 2481 | 1.31 | 4 | 4 | 0 | Y | ACGLSGVVRGS | 65.62 | ACGMSGVVRGS | 25 | ACGLSSVVRGS | 6.25 | ACGLSGVVTGS | 3.12 |
| NS4B | 2482 | 1.31 | 4 | 4 | 0 | Y | CGLSGVVRGSL | 65.62 | CGMSGVVRGSL | 25 | CGLSSVVRGSL | 6.25 | CGLSGVVTGSL | 3.12 |
| NS4B | 2483 | 1.31 | 4 | 4 | 0 | Y | GLSGVVRGSLW | 65.62 | GMSGVVRGSLW | 25 | GLSSVVRGSLW | 6.25 | GLSGVVTGSLW | 3.12 |
| NS4B | 2484 | 1.31 | 4 | 4 | 0 | Y | LSGVVRGSLWG | 65.62 | MSGVVRGSLWG | 25 | LSSVVRGSLWG | 6.25 | LSGVVTGSLWG | 3.12 |
| NS4B | 2485 | 0.53 | 3 | 3 | 0 | Y | SGVVRGSLWGF | 90.62 | SSVVRGSLWGF | 6.25 | SGVVTGSLWGF | 3.12 | | |
| NS4B | 2486 | 0.53 | 3 | 3 | 0 | Y | GVVRGSLWGFL | 90.62 | SVVRGSLWGFL | 6.25 | GVVTGSLWGFL | 3.12 | | |
| NS4B | 2487 | 0.2 | 2 | 2 | 0 | Y | VVRGSLWGFLP | 96.88 | VVTGSLWGFLP | 3.12 | | | | |
| NS4B | 2488 | 0.2 | 2 | 2 | 0 | Y | VRGSLWGFLPL | 96.88 | VTGSLWGFLPL | 3.12 | | | | |
| NS4B | 2489 | 0.2 | 2 | 2 | 0 | Y | RGSLWGFLPLG | 96.88 | TGSLWGFLPLG | 3.12 | | | | |
| NS4B | 2490 | 0 | 1 | 1 | 0 | Y | GSLWGFLPLGH | 100 | | | | | | |
| NS4B | 2491 | 0 | 1 | 1 | 0 | Y | SLWGFLPLGHR | 100 | | | | | | |
| NS4B | 2492 | 0 | 1 | 1 | 0 | Y | LWGFLPLGHRL | 100 | | | | | | |
| NS4B | 2493 | 0 | 1 | 1 | 0 | Y | WGFLPLGHRLW | 100 | | | | | | |
| NS4B | 2494 | 0 | 1 | 1 | 0 | Y | GFLPLGHRLWL | 100 | | | | | | |
| NS4B | 2495 | 0 | 1 | 1 | 0 | Y | FLPLGHRLWLR | 100 | | | | | | |
| NS4B | 2496 | 0 | 1 | 1 | 0 | Y | LPLGHRLWLRA | 100 | | | | | | |
| NS4B | 2497 | 0 | 1 | 1 | 0 | Y | PLGHRLWLRAS | 100 | | | | | | |
| NS4B | 2498 | 0 | 1 | 1 | 0 | Y | LGHRLWLRASG | 100 | | | | | | |

Fig. 34-93

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block

Fig. 34-94

Species: TBEV (11-mers)

| protein | block

Species: TBEV (11-mers)

| protein | block starting position | block entropy | total peptides in block | # peptides required to cover 99% of block | gap/X fraction | 99% of block covered w

Fig. 34-98

Species: TBEV (11-mers)

| protein

Fig. 34-99

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

Fig. 34-100

Species: TBEV (11-mers)

| protein | block starting position | block entropy | total peptides in block | # peptides required to cover 99% of block | cover 99% of block | gap/X

Fig. 34-101

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2706 | 0.97 | 4 | 4 | 0 | Y | ALHRFQLQWGG | 81.25 | ALHRFQLRWGG | 9.38 | ALHRFQLKWGG | 6.25 | TLHRFQLQWGG | 3.12 |
| NS5 | 2707 | 0.78 | 3 | 3 | 0 | Y | LHRFQLQWGGG | 84.38 | LHRFQLRWGGG | 9.38 | LHRFQLKWGGG | 6.25 | | |
| NS5 | 2708 | 0.78 | 3 | 3 | 0 | Y | HRFQLQWGGGL | 84.38 | HRFQLRWGGGL | 9.38 | HRFQLKWGGGL | 6.25 | | |
| NS5 | 2709 | 0.78 | 3 | 3 | 0 | Y | RFQLQWGGGLV | 84.38 | RFQLRWGGGLV | 9.38 | RFQLKWGGGLV | 6.25 | | |
| NS5 | 2710 | 0.78 | 3 | 3 | 0 | Y | FQLQWGGGLVR | 84.38 | FQLRWGGGLVR | 9.38 | FQLKWGGGLVR | 6.25 | | |
| NS5 | 2711 | 0.78 | 3 | 3 | 0 | Y | QLQWGGGLVRT | 84.38 | QLRWGGGLVRT | 9.38 | QLKWGGGLVRT | 6.25 | | |
| NS5 | 2712 | 0.78 | 3 | 3 | 0 | Y | LQWGGGLVRTP | 84.38 | LRWGGGLVRTP | 9.38 | LKWGGGLVRTP | 6.25 | | |
| NS5 | 2713 | 0.78 | 3 | 3 | 0 | Y | QWGGGLVRTPF | 84.38 | RWGGGLVRTPF | 9.38 | KWGGGLVRTPF | 6.25 | | |
| NS5 | 2714 | 0 | 1 | 1 | 0 | Y | WGGGLVRTPFS | 100 | | | | | | |
| NS5 | 2715 | 0 | 1 | 1 | 0 | Y | GGGLVRTPFSR | 100 | | | | | | |
| NS5 | 2716 | 0 | 1 | 1 | 0 | Y | GGLVRTPFSRN | 100 | | | | | | |
| NS5 | 2717 | 0 | 1 | 1 | 0 | Y | GLVRTPFSRNS | 100 | | | | | | |
| NS5 | 2718 | 0 | 1 | 1 | 0 | Y | LVRTPFSRNST | 100 | | | | | | |
| NS5 | 2719 | 0 | 1 | 1 | 0 | Y | VRTPFSRNSTH | 100 | | | | | | |
| NS5 | 2720 | 0.2 | 2 | 2 | 0 | Y | RTPFSRNSTHE | 96.88 | RTPFSRNSTHK | 3.12 | | | | |
| NS5 | 2721 | 0.2 | 2 | 2 | 0 | Y | TPFSRNSTHEM | 96.88 | TPFSRNSTHKV | 3.12 | | | | |
| NS5 | 2722 | 0.2 | 2 | 2 | 0 | Y | PFSRNSTHEMY | 96.88 | PFSRNSTHKVY | 3.12 | | | | |
| NS5 | 2723 | 0.2 | 2 | 2 | 0 | Y | FSRNSTHEMYY | 96.88 | FSRNSTHKVYY | 3.12 | | | | |
| NS5 | 2724 | 0.2 | 2 | 2 | 0 | Y | SRNSTHEMYYS | 96.88 | SRNSTHKVYYS | 3.12 | | | | |
| NS5 | 2725 | 0.2 | 2 | 2 | 0 | Y | RNSTHEMYYST | 96.88 | RNSTHKVYYST | 3.12 | | | | |
| NS5 | 2726 | 0.2 | 2 | 2 | 0 | Y | NSTHEMYYSTA | 96.88 | NSTHKVYYSTA | 3.12 | | | | |
| NS5 | 2727 | 0.4 | 3 | 3 | 0 | Y | STHEMYYSTAV | 93.75 | STHEMYYSTAI | 3.12 | STHKVYYSTAV | 3.12 | | |
| NS5 | 2728 | 0.4 | 3 | 3 | 0 | Y | THEMYYSTAVT | 93.75 | THEMYYSTAIT | 3.12 | THKVYYSTAVT | 3.12 | | |
| NS5 | 2729 | 0.4 | 3 | 3 | 0 | Y | HEMYYSTAVTG | 93.75 | HEMYYSTAITG | 3.12 | HKVYYSTAVTG | 3.12 | | |

Fig. 34-102

Species: TBEV (11

Fig. 34-103

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

Fig. 34-104

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | fr

Fig. 34-105

Species: TBEV (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2828 | 0.2 | 2 | 2 | 0 | Y | SAASLINGVYK | 96.88 | SAASLINGVYK | 3.12 | | | | |
| NS5 | 2829 | 0.2 | 2 | 2 | 0 | Y | AASLINGVYKL | 96.88 | AASLTNGVYKL | 3.12 | | | | |
| NS5 | 2830 | 0.2 | 2 | 2 | 0 | Y | ASLINGVYKLL | 96.88 | ASLTNGVYKLL | 3.12 | | | | |
| NS5 | 2831 | 0.2 | 2 | 2 | 0 | Y | SLINGVYKLLS | 96.88 | SLTNGVYKLLS | 3.12 | | | | |
| NS5 | 2832 | 0.2 | 2 | 2 | 0 | Y | LINGVYKLLSW | 96.88 | LTNGVYKLLSW | 3.12 | | | | |
| NS5 | 2833 | 0.2 | 2 | 2 | 0 | Y | INGVYKLLSWP | 96.88 | TNGVYKLLSWP | 3.12 | | | | |
| NS5 | 2834 | 0 | 1 | 1 | 0 | Y | NGVYKLLSWPW | 100 | | | | | | |
| NS5 | 2835 | 0 | 1 | 1 | 0 | Y | GVYKLLSWPWN | 100 | | | | | | |
| NS5 | 2836 | 0 | 1 | 1 | 0 | Y | VYKLLSWPWNA | 100 | | | | | | |
| NS5 | 2837 | 0 | 1 | 1 | 0 | Y | YKLLSWPWNAR | 100 | | | | | | |
| NS5 | 2838 | 0 | 1 | 1 | 0 | Y | KLLSWPWNARE | 100 | | | | | | |
| NS5 | 2839 | 0 | 1 | 1 | 0 | Y | LLSWPWNARED | 100 | | | | | | |
| NS5 | 2840 | 0 | 1 | 1 | 0 | Y | LSWPWNAREDV | 100 | | | | | | |
| NS5 | 2841 | 0 | 1 | 1 | 0 | Y | SWPWNAREDVV | 100 | | | | | | |
| NS5 | 2842 | 0 | 1 | 1 | 0 | Y | WPWNAREDVVR | 100 | | | | | | |
| NS5 | 2843 | 0 | 1 | 1 | 0 | Y | PWNAREDVVRM | 100 | | | | | | |
| NS5 | 2844 | 0 | 1 | 1 | 0 | Y | WNAREDVVRMA | 100 | | | | | | |
| NS5 | 2845 | 0 | 1 | 1 | 0 | Y | NAREDVVRMAM | 100 | | | | | | |
| NS5 | 2846 | 0 | 1 | 1 | 0 | Y | AREDVVRMAMT | 100 | | | | | | |
| NS5 | 2847 | 0 | 1 | 1 | 0 | Y | REDVVRMAMTD | 100 | | | | | | |
| NS5 | 2848 | 0.2 | 2 | 2 | 0 | Y | EDVVRMAMTDT | 96.88 | EDVVRMAMTDP | 3.12 | | | | |
| NS5 | 2849 | 0.2 | 2 | 2 | 0 | Y | DVVRMAMTDTT | 96.88 | DVVRMAMTDPT | 3.12 | | | | |
| NS5 | 2850 | 0.2 | 2 | 2 | 0 | Y | VVRMAMTDTTA | 96.88 | VVRMAMTDPTP | 3.12 | | | | |
| NS5 | 2851 | 0.2 | 2 | 2 | 0 | Y | VRMAMTDTTAF | 96.88 | VRMAMTDPTPA | 3.12 | | | | |

Fig. 34-106

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2852 | 0.2 | 2 | 2 | 0 | Y | RMAMTDTTAFG | 96.88 | RMAMTDPTPAW | 3.12 | | | | |
| NS5 | 2853 | 0.2 | 2 | 2 | 0 | Y | MAMTDTTAFGQ | 96.88 | MAMTDPTPAWQ | 3.12 | | | | |
| NS5 | 2854 | 0.2 | 2 | 2 | 0 | Y | AMTDTTAFGQQ | 96.88 | AMTDPTPAWQQ | 3.12 | | | | |
| NS5 | 2855 | 0.2 | 2 | 2 | 0 | Y | MTDTTAFGQQR | 96.88 | MTDPTPAWQQR | 3.12 | | | | |
| NS5 | 2856 | 0.2 | 2 | 2 | 0 | Y | TDTTAFGQQRV | 96.88 | TDPTPAWQQRV | 3.12 | | | | |
| NS5 | 2857 | 0.2 | 2 | 2 | 0 | Y | DTTAFGQQRVF | 96.88 | DPTPAWQQRVF | 3.12 | | | | |
| NS5 | 2858 | 0.2 | 2 | 2 | 0 | Y | TTAFGQQRVFK | 96.88 | PTPAWQQRVFK | 3.12 | | | | |
| NS5 | 2859 | 1.04 | 3 | 3 | 0 | Y | TAFGQQRVFKE | 68.75 | TAFGQQRVFKD | 28.12 | TPAWQQRVFKK | 3.12 | | |
| NS5 | 2860 | 1.04 | 3 | 3 | 0 | Y | AFGQQRVFKEK | 68.75 | AFGQQRVFKDK | 28.12 | PAWQQRVFKKN | 3.12 | | |
| NS5 | 2861 | 1.04 | 3 | 3 | 0 | Y | FGQQRVFKEKV | 68.75 | FGQQRVFKDKV | 28.12 | AWQQRVFKKNA | 3.12 | | |
| NS5 | 2862 | 1.04 | 3 | 3 | 0 | Y | GQQRVFKEKVD | 68.75 | GQQRVFKDKVD | 28.12 | WQQRVFKKNAD | 3.12 | | |
| NS5 | 2863 | 1.04 | 3 | 3 | 0 | Y | QQRVFKEKVDT | 68.75 | QQRVFKDKVDT | 28.12 | QQRVFKKNADT | 3.12 | | |
| NS5 | 2864 | 1.04 | 3 | 3 | 0 | Y | QRVFKEKVDTK | 68.75 | QRVFKDKVDTK | 28.12 | QRVFKKNADTK | 3.12 | | |
| NS5 | 2865 | 1.04 | 3 | 3 | 0 | Y | RVFKEKVDTKA | 68.75 | RVFKDKVDTKA | 28.12 | RVFKKNADTKA | 3.12 | | |
| NS5 | 2866 | 1.04 | 3 | 3 | 0 | Y | VFKEKVDTKAQ | 68.75 | VFKDKVDTKAQ | 28.12 | VFKKNADTKAQ | 3.12 | | |
| NS5 | 2867 | 1.04 | 3 | 3 | 0 | Y | FKEKVDTKAQE | 68.75 | FKDKVDTKAQE | 28.12 | FKKNADTKAQE | 3.12 | | |
| NS5 | 2868 | 1.04 | 3 | 3 | 0 | Y | KEKVDTKAQEP | 68.75 | KDKVDTKAQEP | 28.12 | KKNADTKAQEP | 3.12 | | |
| NS5 | 2869 | 1.04 | 3 | 3 | 0 | Y | EKVDTKAQEPQ | 68.75 | DKVDTKAQEPQ | 28.12 | KNADTKAQEPQ | 3.12 | | |
| NS5 | 2870 | 0.2 | 2 | 2 | 0 | Y | KVDTKAQEPQP | 96.88 | NADTKAQEPQP | 3.12 | | | | |
| NS5 | 2871 | 0.2 | 2 | 2 | 0 | Y | VDTKAQEPQPG | 96.88 | ADTKAQEPQPG | 3.12 | | | | |
| NS5 | 2872 | 0 | 1 | 1 | 0 | Y | DTKAQEPQPGT | 100 | | | | | | |
| NS5 | 2873 | 0.81 | 2 | 2 | 0 | Y | TKAQEPQPGTK | 75 | TKAQEPQPGTR | 25 | | | | |
| NS5 | 2874 | 0.81 | 2 | 2 | 0 | Y | KAQEPQPGTKV | 75 | KAQEPQPGTRV | 25 | | | | |
| NS5 | 2875 | 0.81 | 2 | 2 | 0 | Y | AQEPQPGTKVI | 75 | AQEPQPGTRVI | 25 | | | | |

Fig. 34-107

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block

Fig. 34-108

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

Fig. 34-109

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

Fig. 34-110

Species: TBEV (11-mers)

| protein

Fig. 34-111

Species: TBEV (11

Fig. 34-112

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3020 | 0.99 | 2 | 2 | 0 | Y | EGISLNYLGWH | 56.25 | EGISLNYLGWY | 43.75 | | | | |
| NS5 | 3021 | 0.99 | 2 | 2 | 0 | Y | GISLNYLGWHL | 56.25 | GISLNYLGWYL | 43.75 | | | | |
| NS5 | 3022 | 0.99 | 2 | 2 | 0 | Y | ISLNYLGWHLK | 56.25 | ISLNYLGWYLK | 43.75 | | | | |
| NS5 | 3023 | 1.74 | 5 | 5 | 0 | Y | SLNYLGWYLKG | 40.62 | SLNYLGWHLKK | 40.62 | SLNYLGWHLKG | 12.5 | SLNYLGWHLKR | 3.12 | SLNYLGWYLKE | 3.12 |
| NS5 | 3024 | 1.74 | 5 | 5 | 0 | Y | LNYLGWHLKKL | 40.62 | LNYLGWYLKGL | 40.62 | LNYLGWHLKGL | 12.5 | LNYLGWHLKRL | 3.12 | LNYLGWYLKEL | 3.12 |
| NS5 | 3025 | 1.74 | 5 | 5 | 0 | Y | NYLGWYLKGLS | 40.62 | NYLGWHLKKLS | 40.62 | NYLGWHLKGLS | 12.5 | NYLGWHLKRLS | 3.12 | NYLGWYLKELS | 3.12 |
| NS5 | 3034 | 1.31 | 4 | 4 | 0 | Y | LSTLEGGLFYA | 65.62 | LSTLNGGLFYA | 25 | LSILEGGLFYA | 6.25 | LSTPEGGLFYA | 3.12 | | |
| NS5 | 3035 | 1.31 | 4 | 4 | 0 | Y | STLEGGLFYAD | 65.62 | STLNGGLFYAD | 25 | SILEGGLFYAD | 6.25 | STPEGGLFYAD | 3.12 | | |
| NS5 | 3036 | 1.31 | 4 | 4 | 0 | Y | TLEGGLFYADD | 65.62 | TLNGGLFYADD | 25 | ILEGGLFYADD | 6.25 | TPEGGLFYADD | 3.12 | | |
| NS5 | 3037 | 1 | 3 | 3 | 0 | Y | LEGGLFYADDT | 71.88 | LNGGLFYADDT | 25 | PEGGLFYADDT | 3.12 | | | | |
| NS5 | 3038 | 0.81 | 2 | 2 | 0 | Y | EGGLFYADDTA | 75 | NGGLFYADDTA | 25 | | | | | | |
| NS5 | 3039 | 0 | 1 | 1 | 0 | Y | GGLFYADDTAG | 100 | | | | | | | | |
| NS5 | 3040 | 0 | 1 | 1 | 0 | Y | GLFYADDTAGW | 100 | | | | | | | | |
| NS5 | 3041 | 0 | 1 | 1 | 0 | Y | LFYADDTAGWD | 100 | | | | | | | | |
| NS5 | 3042 | 0 | 1 | 1 | 0 | Y | FYADDTAGWDT | 100 | | | | | | | | |
| NS5 | 3043 | 0 | 1 | 1 | 0 | Y | YADDTAGWDTK | 100 | | | | | | | | |
| NS5 | 3044 | 0 | 1 | 1 | 0 | Y | ADDTAGWDTKV | 100 | | | | | | | | |
| NS5 | 3045 | 0 | 1 | 1 | 0 | Y | DDTAGWDTKVT | 100 | | | | | | | | |
| NS5 | 3046 | 0 | 1 | 1 | 0 | Y | DTAGWDTKVTN | 100 | | | | | | | | |
| NS5 | 3047 | 0 | 1 | 1 | 0 | Y | TAGWDTKVTNA | 100 | | | | | | | | |
| NS5 | 3048 | 0 | 1 | 1 | 0 | Y | AGWDTKVTNAD | 100 | | | | | | | | |
| NS5 | 3049 | 0 | 1 | 1 | 0 | Y | GWDTKVTNADL | 100 | | | | | | | | |
| NS5 | 3050 | 0 | 1 | 1 | 0 | Y | WDTKVTNADLE | 100 | | | | | | | | |
| NS5 | 3051 | 0 | 1 | 1 | 0 | Y | DTKVTNADLED | 100 | | | | | | | | |

Fig. 34-113

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3052 | 0 | 1 | 1 | 0 | Y | TKVTNADLEDE | 100 | | | | | | |
| NS5 | 3053 | 0 | 1 | 1 | 0 | Y | KVTNADLEDEE | 100 | | | | | | |
| NS5 | 3054 | 0 | 1 | 1 | 0 | Y | VTNADLEDEEQ | 100 | | | | | | |
| NS5 | 3055 | 1 | 2 | 2 | 0 | Y | TNADLEDEEQI | 53.12 | TNADLEDEEQL | 46.88 | | | | |
| NS5 | 3056 | 1 | 2 | 2 | 0 | Y | NADLEDEEQLL | 53.12 | NADLEDEEQIL | 46.88 | | | | |
| NS5 | 3057 | 1 | 2 | 2 | 0 | Y | ADLEDEEQLLR | 53.12 | ADLEDEEQILR | 46.88 | | | | |
| NS5 | 3058 | 1 | 2 | 2 | 0 | Y | DLEDEEQLLRY | 53.12 | DLEDEEQILRY | 46.88 | | | | |
| NS5 | 3059 | 1 | 2 | 2 | 0 | Y | LEDEEQLLRYM | 53.12 | LEDEEQILRYM | 46.88 | | | | |
| NS5 | 3060 | 1 | 2 | 2 | 0 | Y | EDEEQLLRYME | 53.12 | EDEEQILRYME | 46.88 | | | | |
| NS5 | 3061 | 1 | 2 | 2 | 0 | Y | DEEQLLRYMEG | 53.12 | DEEQILRYMEG | 46.88 | | | | |
| NS5 | 3062 | 1 | 2 | 2 | 0 | Y | EEQLLRYMEGE | 53.12 | EEQILRYMEGE | 46.88 | | | | |
| NS5 | 3063 | 1 | 2 | 2 | 0 | Y | EQLLRYMEGEH | 53.12 | EQILRYMEGEH | 46.88 | | | | |
| NS5 | 3064 | 1.75 | 4 | 4 | 0 | Y | QLLRYMEGEHK | 43.75 | QILRYMEGEHR | 34.38 | QILRYMEGEHR | 12.5 | QLLRYMEGEHR | 9.38 |
| NS5 | 3065 | 1.75 | 4 | 4 | 0 | Y | LLRYMEGEHKQ | 43.75 | ILRYMEGEHRQ | 34.38 | ILRYMEGEHRQ | 12.5 | LLRYMEGEHRQ | 9.38 |
| NS5 | 3066 | 0.76 | 2 | 2 | 0 | Y | LRYMEGEHKQL | 78.12 | LRYMEGEHRQL | 21.88 | | | | |
| NS5 | 3067 | 0.76 | 2 | 2 | 0 | Y | RYMEGEHKQLA | 78.12 | RYMEGEHRQLA | 21.88 | | | | |
| NS5 | 3068 | 1.49 | 3 | 3 | 0 | Y | YMEGEHKQLAA | 50 | YMEGEHRQLAT | 28.12 | YMEGEHRQLAA | 21.88 | | |
| NS5 | 3069 | 1.49 | 3 | 3 | 0 | Y | MEGEHKQLAAT | 50 | MEGEHRQLATT | 28.12 | MEGEHRQLAAT | 21.88 | | |
| NS5 | 3070 | 1.66 | 4 | 4 | 0 | Y | EGEHKQLAATI | 46.88 | EGEHRQLATTI | 28.12 | EGEHRQLAATI | 21.88 | EGEHKQLAATV | 3.12 |
| NS5 | 3071 | 1.66 | 4 | 4 | 0 | Y | GEHKQLAATIM | 46.88 | GEHRQLATTIM | 28.12 | GEHRQLAATIM | 21.88 | GEHKQLAATVM | 3.12 |
| NS5 | 3072 | 1.66 | 4 | 4 | 0 | Y | EHKQLAATIMQ | 46.88 | EHRQLATTIMQ | 28.12 | EHRQLAATIMQ | 21.88 | EHKQLAATVMQ | 3.12 |
| NS5 | 3073 | 1.66 | 4 | 4 | 0 | Y | HKQLAATIMQK | 46.88 | HRQLATTIMQK | 28.12 | HRQLAATIMQK | 21.88 | HKQLAATVMQK | 3.12 |
| NS5 | 3074 | 1.66 | 4 | 4 | 0 | Y | KQLAATIMQKA | 46.88 | KQLATTIMQKA | 28.12 | RQLAATIMQKA | 21.88 | KQLAATVMQKA | 3.12 |
| NS5 | 3075 | 1.04 | 3 | 3 | 0 | Y | QLAATIMQKAY | 68.75 | QLATTIMQKAY | 28.12 | QLAATVMQKAY | 3.12 | | |

Fig. 34-114

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3076 | 1.04 | 3 | 3 | 0 | Y | LAATIMQKAYH | 68.75 | LATTIMQKAYH | 28.12 | LAATVMQKAYH | 3.12 | | |
| NS5 | 3077 | 1.04 | 3 | 3 | 0 | Y | AATIMQKAYHA | 68.75 | ATTIMQKAYHA | 28.12 | AATVMQKAYHA | 3.12 | | |
| NS5 | 3078 | 1.04 | 3 | 3 | 0 | Y | ATIMQKAYHAK | 68.75 | TTIMQKAYHAK | 28.12 | ATVMQKAYHAK | 3.12 | | |
| NS5 | 3079 | 0.2 | 2 | 2 | 0 | Y | TIMQKAYHAKV | 96.88 | TVMQKAYHAKV | 3.12 | | | | |
| NS5 | 3080 | 0.2 | 2 | 2 | 0 | Y | IMQKAYHAKVV | 96.88 | VMQKAYHAKVV | 3.12 | | | | |
| NS5 | 3081 | 0 | 1 | 1 | 0 | Y | MQKAYHAKVVK | 100 | | | | | | |
| NS5 | 3082 | 0 | 1 | 1 | 0 | Y | QKAYHAKVVKV | 100 | | | | | | |
| NS5 | 3083 | 0 | 1 | 1 | 0 | Y | KAYHAKVVKVA | 100 | | | | | | |
| NS5 | 3084 | 0 | 1 | 1 | 0 | Y | AYHAKVVKVAR | 100 | | | | | | |
| NS5 | 3085 | 0 | 1 | 1 | 0 | Y | YHAKVVKVARP | 100 | | | | | | |
| NS5 | 3086 | 0 | 1 | 1 | 0 | Y | HAKVVKVARPS | 100 | | | | | | |
| NS5 | 3087 | 0 | 1 | 1 | 0 | Y | AKVVKVARPSR | 100 | | | | | | |
| NS5 | 3088 | 0.2 | 2 | 2 | 0 | Y | KVVKVARPSRD | 96.88 | KVVKVARPSRE | 3.12 | | | | |
| NS5 | 3089 | 0.2 | 2 | 2 | 0 | Y | VVKVARPSRDG | 96.88 | VVKVARPSREG | 3.12 | | | | |
| NS5 | 3090 | 0.2 | 2 | 2 | 0 | Y | VKVARPSRDGG | 96.88 | VKVARPSREGG | 3.12 | | | | |
| NS5 | 3091 | 0.2 | 2 | 2 | 0 | Y | KVARPSRDGGC | 96.88 | KVARPSREGGC | 3.12 | | | | |
| NS5 | 3092 | 0.64 | 3 | 3 | 0 | Y | VARPSRDGGCI | 87.5 | VARPSRDGGCV | 9.38 | VARPSREGGCV | 3.12 | | |
| NS5 | 3093 | 0.64 | 3 | 3 | 0 | Y | ARPSRDGGCIM | 87.5 | ARPSRDGGCVM | 9.38 | ARPSREGGCVM | 3.12 | | |
| NS5 | 3094 | 0.64 | 3 | 3 | 0 | Y | RPSRDGGCIMD | 87.5 | RPSRDGGCVMD | 9.38 | RPSREGGCVMD | 3.12 | | |
| NS5 | 3095 | 0.64 | 3 | 3 | 0 | Y | PSRDGGCIMDV | 87.5 | PSRDGGCVMDV | 9.38 | PSREGGCVMDV | 3.12 | | |
| NS5 | 3096 | 0.64 | 3 | 3 | 0 | Y | SRDGGCIMDVI | 87.5 | SRDGGCVMDVI | 9.38 | SREGGCVMDVI | 3.12 | | |
| NS5 | 3097 | 0.64 | 3 | 3 | 0 | Y | RDGGCIMDVIT | 87.5 | RDGGCVMDVIT | 9.38 | REGGCVMDVIT | 3.12 | | |
| NS5 | 3098 | 0.64 | 3 | 3 | 0 | Y | DGGCIMDVITR | 87.5 | DGGCVMDVITR | 9.38 | EGGCVMDVITR | 3.12 | | |
| NS5 | 3099 | 0.54 | 2 | 2 | 0 | Y | GGCIMDVITRR | 87.5 | GGCVMDVITRR | 12.5 | | | | |

Fig. 34-115

Species: TBEV (11-mers)

| protein | block starting position | block entropy | total peptides in block | # peptides required to cover 99% of block | cover 99% of block | gap/X fraction | 99% of

Fig. 34-116

Species: TBEV (11-mers)

|

Fig. 34-117

Species: TBEV (11-mers)

| protein | block starting position | block entropy | total peptides in block | # peptides required to cover 99% of block | gap/X fraction | 99% of block covered w/ <= 5 pe

Fig. 34-118

Species: TBEV (11-mers)

| protein | block starting position | block entropy | total peptides in block | # peptides required to cover 99% of block | gap/X fraction | 99% of block covered w/ => 5 peptides? | peptides required to cover 99% of block

Fig. 34-119

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3220 | 0 | 1 | 1 | 0 | Y | FCSHHFHELVM | 100 | | | | | | |
| NS5 | 3221 | 0 | 1 | 1 | 0 | Y | CSHHFHELVMK | 100 | | | | | | |
| NS5 | 3222 | 0 | 1 | 1 | 0 | Y | SHHFHELVMKD | 100 | | | | | | |
| NS5 | 3223 | 0 | 1 | 1 | 0 | Y | HHFHELVMKDG | 100 | | | | | | |
| NS5 | 3224 | 0 | 1 | 1 | 0 | Y | HFHELVMKDGR | 100 | | | | | | |
| NS5 | 3225 | 1.5 | 3 | 3 | 0 | Y | FHELVMKDGRA | 50 | FHELVMKDGRS | 25 | FHELVMKDGRT | 25 | | |
| NS5 | 3226 | 1.5 | 3 | 3 | 0 | Y | HELVMKDGRAL | 50 | HELVMKDGRSL | 25 | HELVMKDGRTL | 25 | | |
| NS5 | 3227 | 1.91 | 4 | 4 | 0 | Y | ELVMKDGRALI | 37.5 | ELVMKDGRTLV | 25 | ELVMKDGRSLI | 25 | ELVMKDGRALV | 12.5 |
| NS5 | 3228 | 1.91 | 4 | 4 | 0 | Y | LVMKDGRALIV | 37.5 | LVMKDGRSLIV | 25 | LVMKDGRTLVV | 25 | LVMKDGRALVV | 12.5 |
| NS5 | 3229 | 1.91 | 4 | 4 | 0 | Y | VMKDGRALIVP | 37.5 | VMKDGRSLIVP | 25 | VMKDGRTLVVP | 25 | VMKDGRALVVP | 12.5 |
| NS5 | 3230 | 1.91 | 4 | 4 | 0 | Y | MKDGRALIVPC | 37.5 | MKDGRSLIVPC | 25 | MKDGRTLVVPC | 25 | MKDGRALVVPC | 12.5 |
| NS5 | 3231 | 1.91 | 4 | 4 | 0 | Y | KDGRALIVPCR | 37.5 | KDGRSLIVPCR | 25 | KDGRTLVVPCR | 25 | KDGRALVVPCR | 12.5 |
| NS5 | 3232 | 1.91 | 4 | 4 | 0 | Y | DGRALIVPCRD | 37.5 | DGRSLIVPCRD | 25 | DGRTLVVPCRD | 25 | DGRALVVPCRD | 12.5 |
| NS5 | 3233 | 1.91 | 4 | 4 | 0 | Y | GRALIVPCRDQ | 37.5 | GRTLVVPCRDQ | 25 | GRSLIVPCRDQ | 25 | GRALVVPCRDQ | 12.5 |
| NS5 | 3234 | 1.91 | 4 | 4 | 0 | Y | RALIVPCRDQD | 37.5 | RTLVVPCRDQD | 25 | RSLIVPCRDQD | 25 | RALVVPCRDQD | 12.5 |
| NS5 | 3235 | 1.91 | 4 | 4 | 0 | Y | ALIVPCRDQDE | 37.5 | SLIVPCRDQDE | 25 | TLVVPCRDQDE | 25 | ALVVPCRDQDE | 12.5 |
| NS5 | 3236 | 0.95 | 2 | 2 | 0 | Y | LIVPCRDQDEL | 62.5 | LVVPCRDQDEL | 37.5 | | | | |
| NS5 | 3237 | 0.95 | 2 | 2 | 0 | Y | IVPCRDQDELV | 62.5 | VVPCRDQDELV | 37.5 | | | | |
| NS5 | 3238 | 0 | 1 | 1 | 0 | Y | VPCRDQDELVG | 100 | | | | | | |
| NS5 | 3239 | 0 | 1 | 1 | 0 | Y | PCRDQDELVGR | 100 | | | | | | |
| NS5 | 3240 | 0 | 1 | 1 | 0 | Y | CRDQDELVGRA | 100 | | | | | | |
| NS5 | 3241 | 0.2 | 2 | 2 | 0 | Y | RDQDELVGRAR | 96.88 | RDQDELVGRAP | 3.12 | | | | |
| NS5 | 3242 | 1 | 3 | 3 | 0 | Y | DQDELVGRARV | 71.88 | DQDELVGRARI | 25 | DQDELVGRAPV | 3.12 | | |
| NS5 | 3243 | 1 | 3 | 3 | 0 | Y | QDELVGRARVS | 71.88 | QDELVGRARIS | 25 | QDELVGRAPVS | 3.12 | | |

Fig. 34-120

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3244 | 1 | 3 | 3 | 0 | Y | DELVGRARVSP | 71.88 | DELVGRARISP | 71.88 | DELVGRAPVSP | 3.12 | | |
| NS5 | 3245 | 1 | 3 | 3 | 0 | Y | ELVGRARVSPG | 71.88 | ELVGRARISPG | 71.88 | ELVGRAPVSPG | 3.12 | | |
| NS5 | 3246 | 1 | 3 | 3 | 0 | Y | LVGRARVSPGC | 71.88 | LVGRARISPGC | 71.88 | LVGRAPVSPGC | 3.12 | | |
| NS5 | 3247 | 1 | 3 | 3 | 0 | Y | VGRARVSPGCG | 71.88 | VGRARISPGCG | 71.88 | VGRAPVSPGCG | 3.12 | | |
| NS5 | 3248 | 1 | 3 | 3 | 0 | Y | GRARVSPGCGW | 71.88 | GRARISPGCGW | 71.88 | GRAPVSPGCG W | 3.12 | | |
| NS5 | 3249 | 1 | 3 | 3 | 0 | Y | RARVSPGCGWS | 71.88 | RARISPGCGWS | 71.88 | RAPVSPGCGWS | 3.12 | | |
| NS5 | 3250 | 1.18 | 4 | 4 | 0 | Y | ARVSPGCGWSV | 68.75 | ARISPGCGWSV | 25 | APVSPGCGWS V | 3.12 | ARVSPGCGWSI | 3.12 |
| NS5 | 3251 | 1.18 | 4 | 4 | 0 | Y | RVSPGCGWSVR | 68.75 | RISPGCGWSVR | 25 | PVSPGCGWSVR | 3.12 | RVSPGCGWSIR | 3.12 |
| NS5 | 3252 | 1 | 3 | 3 | 0 | Y | VSPGCGWSVRE | 71.88 | ISPGCGWSVRE | 25 | VSPGCGWSIRE | 3.12 | | |
| NS5 | 3253 | 0.2 | 2 | 2 | 0 | Y | SPGCGWSVRET | 96.88 | SPGCGWSIRET | 3.12 | | | | |
| NS5 | 3254 | 0.2 | 2 | 2 | 0 | Y | PGCGWSVRETA | 96.88 | PGCGWSIRETA | 3.12 | | | | |
| NS5 | 3255 | 0.2 | 2 | 2 | 0 | Y | GCGWSVRETAC | 96.88 | GCGWSIRETAC | 3.12 | | | | |
| NS5 | 3256 | 0.2 | 2 | 2 | 0 | Y | CGWSVRETACL | 96.88 | CGWSIRETACL | 3.12 | | | | |
| NS5 | 3257 | 0.2 | 2 | 2 | 0 | Y | GWSVRETACLS | 96.88 | GWSIRETACLS | 3.12 | | | | |
| NS5 | 3258 | 0.2 | 2 | 2 | 0 | Y | WSVRETACLSK | 96.88 | WSIRETACLSK | 3.12 | | | | |
| NS5 | 3259 | 0.2 | 2 | 2 | 0 | Y | SVRETACLSKA | 96.88 | SIRETACLSKA | 3.12 | | | | |
| NS5 | 3260 | 0.2 | 2 | 2 | 0 | Y | VRETACLSKAY | 96.88 | IRETACLSKAY | 3.12 | | | | |
| NS5 | 3261 | 0 | 1 | 1 | 0 | Y | RETACLSKAYG | 100 | | | | | | |
| NS5 | 3262 | 0 | 1 | 1 | 0 | Y | ETACLSKAYGQ | 100 | | | | | | |
| NS5 | 3263 | 0 | 1 | 1 | 0 | Y | TACLSKAYGQM | 100 | | | | | | |
| NS5 | 3264 | 0 | 1 | 1 | 0 | Y | ACLSKAYGQMW | 100 | | | | | | |
| NS5 | 3265 | 0 | 1 | 1 | 0 | Y | CLSKAYGQMWL | 100 | | | | | | |
| NS5 | 3266 | 0 | 1 | 1 | 0 | Y | LSKAYGQMWLL | 100 | | | | | | |
| NS5 | 3267 | 0 | 1 | 1 | 0 | Y | SKAYGQMWLLS | 100 | | | | | | |

Fig. 34-121

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block

Fig. 34-122

Species: TBEV (11-mers)

| protein | block star

Fig. 34-123

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3322 | 0 | 1 | 1 | 0 | Y | LDVWNRVWILD | 100 | | | | | | |
| NS5 | 3323 | 0 | 1 | 1 | 0 | Y | DVWNRVWILDN | 100 | | | | | | |
| NS5 | 3324 | 0 | 1 | 1 | 0 | Y | VWNRVWILDNP | 100 | | | | | | |
| NS5 | 3325 | 0 | 1 | 1 | 0 | Y | WNRVWILDNPF | 100 | | | | | | |
| NS5 | 3326 | 0 | 1 | 1 | 0 | Y | NRVWILDNPFM | 100 | | | | | | |
| NS5 | 3327 | 1 | 2 | 2 | 0 | Y | RVWILDNPFMH | 53.12 | RVWILDNPFMQ | 46.88 | | | | |
| NS5 | 3328 | 1.17 | 3 | 3 | 0 | Y | VWILDNPFMHS | 50 | VWILDNPFMQN | 46.88 | VWILDNPFMHG | 3.12 | | |
| NS5 | 3329 | 1.17 | 3 | 3 | 0 | Y | WILDNPFMHSK | 50 | WILDNPFMQNK | 46.88 | WILDNPFMHGK | 3.12 | | |
| NS5 | 3330 | 1.33 | 4 | 4 | 0 | Y | ILDNPFMHSKE | 50 | ILDNPFMQNKE | 43.75 | ILDNPFMHGKE | 3.12 | ILDNPFMQNKG | 3.12 |
| NS5 | 3331 | 1.66 | 5 | 5 | 0 | Y | LDNPFMHSKEK | 50 | LDNPFMQNKEK | 34.38 | LDNPFMQNKER | 9.38 | LDNPFMQNKGK | 3.12 |
| NS5 | 3344 | 1.65 | 4 | 4 | 0 | Y | EWRDVPYLPKS | 53.12 | EWRDVPYLPKA | 25 | EWRDIPYLPKA | 15.62 | EWRNVPYLPKA | 6.25 |
| NS5 | 3348 | 1.77 | 5 | 5 | 0 | Y | VPYLPKSHDML | 53.12 | VPYLPKAQDML | 25 | IPYLPKAHDML | 12.5 | VPYLPKAHDML | 6.25 |
| NS5 | 3349 | 1.45 | 3 | 3 | 0 | Y | PYLPKSHDMLC | 53.12 | PYLPKAQDMLC | 28.12 | PYLPKAHDMLC | 18.75 | | |
| NS5 | 3350 | 1.45 | 3 | 3 | 0 | Y | YLPKSHDMLCS | 53.12 | YLPKAQDMLCS | 28.12 | YLPKAHDMLCS | 18.75 | | |
| NS5 | 3351 | 1.45 | 3 | 3 | 0 | Y | LPKSHDMLCSS | 53.12 | LPKAQDMLCSS | 28.12 | LPKAHDMLCSS | 18.75 | | |
| NS5 | 3352 | 1.45 | 3 | 3 | 0 | Y | PKSHDMLCSSL | 53.12 | PKAQDMLCSSL | 28.12 | PKAHDMLCSSL | 18.75 | | |
| NS5 | 3353 | 1.45 | 3 | 3 | 0 | Y | KSHDMLCSSLV | 53.12 | KAQDMLCSSLV | 28.12 | KAHDMLCSSLV | 18.75 | | |
| NS5 | 3354 | 1.45 | 3 | 3 | 0 | Y | SHDMLCSSLVG | 53.12 | AQDMLCSSLVG | 28.12 | AHDMLCSSLVG | 18.75 | | |
| NS5 | 3355 | 0.86 | 2 | 2 | 0 | Y | HDMLCSSLVGR | 71.88 | QDMLCSSLVGR | 28.12 | | | | |
| NS5 | 3356 | 0.64 | 3 | 2 | 0 | Y | DMLCSSLVGRK | 87.5 | DMLCSSLVGRR | 9.38 | DMLCSSLVGRT | 3.12 | | |
| NS5 | 3357 | 0.64 | 3 | 3 | 0 | Y | MLCSSLVGRKE | 87.5 | MLCSSLVGRRE | 9.38 | MLCSSLVGRTE | 3.12 | | |
| NS5 | 3358 | 0.64 | 3 | 3 | 0 | Y | LCSSLVGRKER | 87.5 | LCSSLVGRRER | 9.38 | LCSSLVGRTER | 3.12 | | |
| NS5 | 3359 | 0.64 | 3 | 3 | 0 | Y | CSSLVGRKERA | 87.5 | CSSLVGRRERA | 9.38 | CSSLVGRTERA | 3.12 | | |
| NS5 | 3360 | 0.64 | 3 | 3 | 0 | Y | SSLVGRKERAE | 87.5 | SSLVGRRERAE | 9.38 | SSLVGRTERAE | 3.12 | | |

Fig. 34-124

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block

Fig. 34-125

Species: TBEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3397 | 0.2 | 2 | 2 | 0 | Y | CMDRHDLHWEL | 96.88 | CMDRHYLHWNL | 3.12 | | | | |
| NS5 | 3398 | 1.15 | 3 | 3 | 0 | Y | MDRHDLHWELK | 56.25 | MDRHDLHWELR | 40.62 | MDRHYLHWNLK | 3.12 | | |
| NS5 | 3399 | 1.15 | 3 | 3 | 0 | Y | DRHDLHWELKL | 56.25 | DRHDLHWELRL | 40.62 | DRHYLHWNLKL | 3.12 | | |
| NS5 | 3400 | 1.15 | 3 | 3 | 0 | Y | RHDLHWELKLE | 56.25 | RHDLHWELRLE | 40.62 | RHYLHWNLKLE | 3.12 | | |
| NS5 | 3401 | 1.33 | 4 | 4 | 0 | Y | HDLHWELKLES | 53.12 | HDLHWELRLES | 40.62 | HDLHWELKLEG | 3.12 | HYLHWNLKLES | 3.12 |
| NS5 | 3402 | 1.33 | 4 | 4 | 0 | Y | DLHWELKLESS | 53.12 | DLHWELRLESS | 40.62 | YLHWNLKLESS | 3.12 | DLHWELKLEGS | 3.12 |
| NS5 | 3403 | 1.33 | 4 | 4 | 0 | Y | LHWELKLESSI | 53.12 | LHWELRLESSI | 40.62 | LHWELKLEGSI | 3.12 | LHWNLKLESSI | 3.12 |
| NS5 | 3404 | 1.33 | 4 | 4 | 0 | Y | HWELKLESSII | 53.12 | HWELRLESSII | 40.62 | HWNLKLESSIF | 3.12 | HWELKLEGSII | 3.12 |

FIG. 35-1

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 1 | 0.11 | 2 | 2 | 0 | Y | MTKKPGGP | 98.51 | MTKKPRGP | 1.49 | | | | |
| anC | 2 | 0.11 | 2 | 2 | 0 | Y | TKKPGGPG | 98.51 | TKKPRGPG | 1.49 | | | | |
| anC | 3 | 0.44 | 3 | 3 | 0 | Y | KKPGGPGK | 92.54 | KKPGGPGR | 5.97 | KKPRGPGI | 1.49 | | |
| anC | 4 | 0.55 | 4 | 4 | 0 | Y | KPGGPGKN | 91.04 | KPGGPGRN | 5.97 | KPRGPGIN | 1.49 | KPGGPGKS | 1.49 |
| anC | 5 | 0.55 | 4 | 4 | 0 | Y | PGGPGKNR | 91.04 | PGGPGRNR | 5.97 | PRGPGINR |

FIG. 35-2

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 26 | 0.22 | 3 | 3 | 0 | Y | PLVGVKRV | 97.01 | PLVGVKKV | 1.49 | PLVRVKRV | 1.49 | | |
| anC | 27 | 0.22 | 3 | 3 | 0 | Y | LVGVKRV | 97.01 | LVGVKKV | 1.49 | LVRVKRV | 1.49 | | |
| anC | 28 | 0.33 | 4 | 4 | 0 | Y | VGVKRVM | 95.52 | VGVKKVM | 1.49 | VRVKRVM | 1.49 | VGVKRVI | 1.49 |
| anC | 29 | 0.33 | 4 | 4 | 0 | Y | GVKRVMS | 95.52 | GVKKVMS | 1.49 | GVKRVIS | 1.49 | RVKRVMS | 1.49 |
| anC | 30 | 0.22 | 3 | 3 | 0 | Y | VKRVMSL | 97.01 | VKKVMSL | 1.49 | VKRVISL | 1.49 | | |
| anC | 31 | 0.22 | 3 | 3 | 0 | Y | KRVMSL | 97.01 | KKVMSLL | 1.49 | KRVVISLL | 1.49 | | |
| anC | 32 | 0.22 | 3 | 3 | 0 | Y | RVMSLLD | 97.01 | KVVMSLL | 1.49 | RVVISLLD | 1.49 | | |
| anC | 33 | 0.11 | 2 | 2 | 0 | Y | VMSLLDG | 98.51 | WVISLLD | 1.49 | | | | |
| anC | 34 | 0.11 | 2 | 2 | 0 | Y | MSLLDGR | 98.51 | VISLLDG | 1.49 | | | | |
| anC | 35 | 0.11 | 2 | 2 | 0 | Y | SLLDGRG | 98.51 | ISLLDGI | 1.49 | | | | |
| anC | 36 | 0.11 | 2 | 2 | 0 | Y | SLLDGRP | 98.51 | SLLDGIG | 1.49 | | | | |
| anC | 36 | 0.3 | 3 | 3 | 0 | Y | LLDGRGP | 95.52 | LLDGRGPA | 2.99 | LLDGIGPL | 1.49 | | |
| anC | 37 | 0.3 | 3 | 3 | 0 | Y | LDGRGPV | 95.52 | LDGRGPAR | 2.99 | LDGIGPLR | 1.49 | | |
| anC | 38 | 0.3 | 3 | 3 | 0 | Y | DGRGPVR | 95.52 | DGRGPARF | 2.99 | DGIGPLRF | 1.49 | | |
| anC | 39 | 0.3 | 3 | 3 | 0 | Y | GRGPVRF | 95.52 | GRGPARFV | 2.99 | GIGPLRFV | 1.49 | | |
| anC | 40 | 0.3 | 3 | 3 | 0 | Y | RGPVRFV | 95.52 | RGPARFVL | 2.99 | IGPLRFVL | 1.49 | | |
| anC | 41 | 0.3 | 3 | 3 | 0 | Y | GPVRFVL | 95.52 | GPARFVLA | 2.99 | GPLRFVL | 1.49 | | |
| anC | 42 | 0.42 | 4 | 4 | 0 | Y | PVRFVLAL | 94.03 | PARFVLAL | 2.99 | PLRFVLAL | 1.49 | PVRFVLAF | 1.49 |
| anC | 43 | 0.61 | 5 | 5 | 0 | Y | VRFVLALI | 91.04 | ARFVLALI | 2.99 | VRFVLALT | 2.99 | LRFVLALV | 1.49 | VRFVLAFI | 1.49 |
| anC | 44 | 0.42 | 4 | 4 | 0 | Y | RFVLALIT | 94.03 | RFVLALTT | 2.99 | RFVLAFIT | 1.49 | RFVLALVS | 1.49 |
| anC | 45 | 0.42 | 4 | 4 | 0 | Y | FVLALITF | 94.03 | FVLALITF | 2.99 | FVLAFITF | 1.49 | FVLALVSF | 1.49 |
| anC | 46 | 0.42 | 4 | 4 | 0 | Y | VLALITFF | 94.03 | VLALITFF | 2.99 | VLAFITFF | 1.49 | VLALVSFF | 1.49 |
| anC | 47 | 0.42 | 4 | 4 | 0 | Y | LALITFFK | 94.03 | LALITFFK | 2.99 | LAFITFFK | 1.49 | LALVSFFK | 1.49 |
| anC | 48 | 0.42 | 4 | 4 | 0 | Y | ALITFFKF | 94.03 | ALITFFKF | 2.99 | AFITFFKF | 1.49 | ALVSFFKF | 1.49 |
| anC | 49 | 0.42 | 4 | 4 | 0 | Y | LITFFKFT | 94.03 | LITFFKFT | 2.99 | FITFFKFT | 1.49 | LVSFFKFT | 1.49 |

FIG. 35-3

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 51 | 0.3 | 3 | 3 | 0 | Y | ITFFKFTA | 95.52 | TTFFKFTA | 2.99 | VSFFKFTA | 1.49 | | |
| anC | 52 | 0.11 | 2 | 2 | 0 | Y | TFFKFTAL | 98.51 | SFFKFTAL | 1.49 | | | | |
| anC | 53 | 0.11 | 2 | 2 | 0 | Y | FFKFTALA | 98.51 | FFKFTALS | 1.49 | | | | |
| anC | 54 | 0.11 | 2 | 2 | 0 | Y | FKFTALAP | 98.51 | FKFTALSP | 1.49 | | | | |
| anC | 55 | 0.11 | 2 | 2 | 0 | Y | KFTALAPT | 98.51 | KFTALSPT | 1.49 | | | | |
| anC | 56 | 0.11 | 2 | 2 | 0 | Y | FTALAPTK | 98.51 | FTALSPTK | 1.49 | | | | |
| anC | 57 | 0.11 | 2 | 2 | 0 | Y | TALAPTKA | 98.51 | TALSPTKA | 1.49 | | | | |
| anC | 58 | 0.11 | 2 | 2 | 0 | Y | ALAPTKAL | 98.51 | ALSPTKAL | 1.49 | | | | |
| anC | 59 | 0.37 | 3 | 3 | 0 | Y | LAPTKALL | 94.03 | LAPTKALS | 4.48 | LSPTKALL | 1.49 | | |
| anC | 60 | 0.37 | 3 | 3 | 0 | Y | APTKALLG | 94.03 | APTKALSG | 4.48 | SPTKALLG | 1.49 | | |
| anC | 61 | 0.26 | 2 | 2 | 0 | Y | PTKALLGR | 95.52 | PTKALSGR | 4.48 | | | | |
| anC | 62 | 0.26 | 2 | 2 | 0 | Y | TKALLGRW | 95.52 | TKALSGRW | 4.48 | | | | |
| anC | 63 | 0.96 | 3 | 3 | 0 | Y | KALLGRWK | 76.12 | KALLGRWR | 19.4 | KALSGRWK | 4.48 | | |
| anC | 64 | 0.96 | 3 | 3 | 0 | Y | ALLGRWKA | 76.12 | ALLGRWRA | 19.4 | ALSGRWKA | 4.48 | | |
| anC | 65 | 1.04 | 4 | 4 | 0 | Y | LLGRWKAV | 76.12 | LLGRWRAV | 17.91 | LSGRWKAV | 4.48 | LLGRWRAL | 1.49 |
| anC | 66 | 1.04 | 4 | 4 | 0 | Y | LGRWKAVE | 76.12 | LGRWRAVE | 17.91 | SGRWKAVE | 4.48 | LGRWRALE | 1.49 |
| anC | 67 | 0.89 | 4 | 4 | 0 | Y | GRWKAVEK | 79.1 | GRWRAVEK | 17.91 | GRWRALEK | 1.49 | GRWKAVER | 1.49 |
| anC | 68 | 0.89 | 4 | 4 | 0 | Y | RWKAVEKS | 79.1 | RWRAVEKS | 17.91 | RWKAVERS | 1.49 | RWRALEKS | 1.49 |
| anC | 69 | 0.89 | 4 | 4 | 0 | Y | WKAVEKSV | 79.1 | WRAVEKSV | 17.91 | WKAVERSV | 1.49 | WRALEKSV | 1.49 |
| anC | 70 | 0.89 | 4 | 4 | 0 | Y | KAVEKSVA | 79.1 | RAVEKSVA | 17.91 | KAVERSVA | 1.49 | RALEKSVA | 1.49 |
| anC | 71 | 0.22 | 3 | 3 | 0 | Y | AVEKSVAM | 97.01 | ALEKSVAM | 1.49 | AVERSVAM | 1.49 | | |
| anC | 72 | 0.22 | 3 | 3 | 0 | Y | VEKSVAMK | 97.01 | VERSVAMK | 1.49 | LEKSVAMK | 1.49 | | |
| anC | 73 | 0.11 | 2 | 2 | 0 | Y | EKSVAMKH | 98.51 | ERSVAMKH | 1.49 | | | | |
| anC | 74 | 0.11 | 2 | 2 | 0 | Y | KSVAMKHL | 98.51 | RSVAMKHL | 1.49 | | | | |
| anC | 75 | 0 | 1 | 1 | 0 | Y | SVAMKHLT | 100 | | | | | | |

FIG. 35-4

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 76 | 0 | 1 | 1 | 0 | Y | VAMKHLTS | 100 | | | | | | |
| anC | 77 | 0 | 1 | 1 | 0 | Y | AMKHLTSF | 100 | | | | | | |
| anC | 78 | 0 | 1 | 1 | 0 | Y | MKHLTSFK | 100 | | | | | | |
| anC | 79 | 0.11 | 2 | 2 | 0 | Y | KHLTSFKR | 98.51 | KHLTSFKG | 1.49 | | | | |
| anC | 80 | 0.11 | 2 | 2 | 0 | Y | HLTSFKRE | 98.51 | HLTSFKGE | 1.49 | | | | |
| anC | 81 | 0.11 | 2 | 2 | 0 | Y | LTSFKREL | 98.51 | LTSFKGEL | 1.49 | | | | |
| anC | 82 | 0.11 | 2 | 2 | 0 | Y | TSFKRELG | 98.51 | TSFKGELG | 1.49 | | | | |
| anC | 83 | 0.22 | 3 | 3 | 0 | Y | SFKRELGI | 97.01 | SFKRELGT | 1.49 | SFKGELGT | 1.49 | | |
| anC | 84 | 0.22 | 3 | 3 | 0 | Y | FKRELGIL | 97.01 | FKRELGTL | 1.49 | FKGELGTL | 1.49 | | |
| anC | 85 | 0.22 | 3 | 3 | 0 | Y | KRELGILI | 97.01 | KGELGTLI | 1.49 | KRELGTLI | 1.49 | | |
| anC | 86 | 0.22 | 3 | 3 | 0 | Y | RELGILID | 97.01 | GELGTLID | 1.49 | RELGTLID | 1.49 | | |
| anC | 87 | 0.45 | 5 | 5 | 0 | Y | ELGTLIDA | 94.03 | ELGTLIDT | 1.49 | ELGTLIDG | 1.49 | ELGILIDA | 1.49 | ELGTLIDV | 1.49 |
| anC | 88 | 0.45 | 5 | 5 | 0 | Y | LGTLIDAV | 94.03 | LGTLIDTV | 1.49 | LGTLIDGV | 1.49 | LGTLIDVV | 1.49 | LGILIDAV | 1.49 |
| anC | 89 | 0.45 | 5 | 5 | 0 | Y | GTLIDAVN | 94.03 | GILIDAVN | 1.49 | GTLIDGVN | 1.49 | GTLIDVYN | 1.49 | GTLIDTVN | 1.49 |
| anC | 90 | 0.45 | 5 | 5 | 0 | Y | TLIDAVNK | 94.03 | TLIDTVNK | 1.49 | ILIDAVNK | 1.49 | TLIDVYNK | 1.49 | TLIDGVNK | 1.49 |
| anC | 91 | 0.33 | 4 | 4 | 0 | Y | LIDAVNKR | 95.52 | LIDVYNKR | 1.49 | LIDGVNKR | 1.49 | LIDTVNKR | 1.49 | | |
| anC | 92 | 0.33 | 4 | 4 | 0 | Y | IDAVNKRG | 95.52 | IDTVNKRG | 1.49 | IDGVNKRG | 1.49 | IDVYNKRG | 1.49 | | |
| anC | 93 | 0.97 | 5 | 5 | 0 | Y | DAVNKRGR | 79.1 | DTVNKRGK | 16.42 | DGVNKRGR | 1.49 | DTVNKRGR | 1.49 | DVYNKRGK | 1.49 |
| anC | 94 | 0.97 | 5 | 5 | 0 | Y | AVNKRGRK | 79.1 | AVNKRGKK | 16.42 | VVNKRGRK | 1.49 | GVNKRGRK | 1.49 | TVNKRGRK | 1.49 |
| anC | 95 | 0.79 | 3 | 3 | 0 | Y | VNKRGRKQ | 80.6 | VNKRGKKQ | 17.91 | VNKRGRKR | 1.49 | | | | |
| anC | 96 | 0.79 | 3 | 3 | 0 | Y | NKRGRKQN | 80.6 | NKRGKKQN | 17.91 | NKRGRKRN | 1.49 | | | | |
| anC | 97 | 0.79 | 3 | 3 | 0 | Y | KRGRKQNK | 80.6 | KRGKKQNK | 17.91 | KRGRKRNK | 1.49 | | | | |
| anC | 98 | 0.79 | 3 | 3 | 0 | Y | RGRKQNKR | 80.6 | RGKKQNKR | 17.91 | RGRKRNKR | 1.49 | | | | |
| anC | 99 | 0.79 | 3 | 3 | 0 | Y | GRKQNKRG | 80.6 | GKKQNKRG | 17.91 | GRKRNKRG | 1.49 | | | | |
| anC | 100 | 0.79 | 3 | 3 | 0 | Y | RKQNKRGG | 80.6 | KKQNKRGG | 17.91 | RKRNKRGG | 1.49 | | |

FIG. 35-5

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 101 | 0.11 | 2 | 2 | 0 | Y | KQNKRGGN | 98.51 | KRNKRGGN | 1.49 | | | | |
| anC | 102 | 0.22 | 3 | 3 | 0 | Y | QNKRGGNE | 97.01 | RNKRGGNE | 1.49 | QNKRGGNG | 1.49 | | |
| anC | 103 | 0.86 | 4 | 4 | 0 | Y | NKRGGNEG | 80.6 | NKRGGNES | 16.42 | NKRGGNGG | 2.99 | NKRGGNER | 1.49 |
| anC | 112 | 0.74 | 5 | 5 | 0 | Y | IMWLASLA | 88.06 | IMWLTSLA | 5.97 | IMWLACLA | 4.48 | IMWLASVA | 1.49 |
| anC | 125 | 0.86 | 5 | 5 | 0 | Y | AGAMKLSN | 85.07 | VGAMKLSN | 7.46 | AGAMRLSN | 4.48 | VGALKLSN | 1.49 |
| anC | 126 | 0.49 | 4 | 4 | 0 | Y | GAMKLSNF | 92.54 | GAMRLSNF | 4.48 | GALKLSNF | 1.49 | GAIKLSNF | 1.49 |
| anC | 127 | 0.49 | 4 | 4 | 0 | Y | AMKLSNFQ | 92.54 | AMRLSNFQ | 4.48 | AIKLSNFQ | 1.49 | ALKLSNFQ | 1.49 |
| anC | 128 | 0.49 | 4 | 4 | 0 | Y | MKLSNFQG | 92.54 | MRLSNFQG | 4.48 | LKLSNFQG | 1.49 | IKLSNFQG | 1.49 |
| prM | 129 | 0.26 | 2 | 2 | 0 | Y | KLSNFQGK | 95.52 | RLSNFQGK | 4.48 | | | | |
| prM | 130 | 0 | 1 | 1 | 0 | Y | LSNFQGKL | 100 | | | | | | |
| prM | 131 | 0 | 1 | 1 | 0 | Y | SNFQGKLL | 100 | | | | | | |
| prM | 132 | 0 | 1 | 1 | 0 | Y | NFQGKLLM | 100 | | | | | | |
| prM | 133 | 0.11 | 2 | 2 | 0 | Y | FQGKLLMT | 98.51 | FQGKLLMA | 1.49 | QGKLLMAV | 1.49 | | |
| prM | 134 | 0.44 | 3 | 3 | 0 | Y | QGKLLMTI | 92.54 | QGKLLMTV | 5.97 | GKLLMAVN | 1.49 | | |
| prM | 135 | 0.44 | 3 | 3 | 0 | Y | GKLLMTIN | 92.54 | GKLLMTVN | 5.97 | KLLMAVNN | 1.49 | | |
| prM | 136 | 0.44 | 3 | 3 | 0 | Y | KLLMTINN | 92.54 | KLLMTVNN | 5.97 | LLMAVNNT | 1.49 | | |
| prM | 137 | 0.44 | 3 | 3 | 0 | Y | LLMTINNT | 92.54 | LLMTVNNT | 5.97 | LMAVNNTD | 1.49 | | |
| prM | 138 | 0.44 | 3 | 3 | 0 | Y | LMTINNTD | 92.54 | LMTVNNTD | 5.97 | MAVNNTDI | 1.49 | | |
| prM | 139 | 0.44 | 3 | 3 | 0 | Y | MTINNTDI | 92.54 | MTVNNTDI | 5.97 | AVNNTDIA | 1.49 | | |
| prM | 140 | 0.44 | 3 | 3 | 0 | Y | TINNTDIA | 92.54 | TVNNTDIA | 5.97 | | | | |
| prM | 141 | 0.38 | 2 | 2 | 0 | Y | INNTDIAD | 92.54 | VNNTDIAD | 7.46 | | | | |
| prM | 142 | 0 | 1 | 1 | 0 | Y | NNTDIADV | 100 | | | | | | |
| prM | 143 | 0 | 1 | 1 | 0 | Y | NTDIADVI | 100 | | | | | | |
| prM | 144 | 0 | 1 | 1 | 0 | Y | TDIADVIV | 100 | | | | | | |
| prM | 145 | 0 | 1 | 1 | 0 | Y | DIADVIVI | 100 | | | | | | |

FIG. 35-6

Species: JEV (length of peptides: 8)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| pM | 146 | 0 | 1 | 1 | 0 | | Y | IADVVIP | 100 | | | | | | |
| pM | 147 | 0 | 1 | 1 | 0 | | Y | ADVVIPT | 100 | | | | | | |
| pM | 148 | 0 | 1 | 1 | 0 | | Y | DVVIPTS | 100 | | | | | | |
| pM | 149 | 0 | 1 | 1 | 0 | | Y | VVIPTSK | 100 | | | | | | |
| pM | 150 | 0 | 1 | 1 | 0 | | Y | VIPTSKG | 100 | | | | | | |
| pM | 151 | 0 | 1 | 1 | 0 | | Y | IPTSKGE | 100 | | | | | | |
| pM | 152 | 0 | 1 | 1 | 0 | | Y | PTSKGEN | 100 | | | | | | |
| pM | 153 | 0 | 1 | 1 | 0 | | Y | TSKGENR | 100 | | | | | | |
| pM | 154 | 0 | 1 | 1 | 0 | | Y | SKGENRC | 100 | | | | | | |
| pM | 155 | 0 | 1 | 1 | 0 | | Y | KGENRCW | 100 | | | | | | |
| pM | 156 | 0 | 1 | 1 | 0 | | Y | GENRCWV | 100 | | | | | | |
| pM | 157 | 0 | 1 | 1 | 0 | | Y | ENRCWVR | 100 | | | | | | |
| pM | 158 | 0 | 1 | 1 | 0 | | Y | NRCWVRA | 100 | | | | | | |
| pM | 159 | 0 | 1 | 1 | 0 | | Y | RCWVRAI | 100 | | | | | | |
| pM | 160 | 0 | 1 | 1 | 0 | | Y | CWVRAID | 100 | | | | | | |
| pM | 161 | 0 | 1 | 1 | 0 | | Y | WVRAIDV | 100 | | | | | | |
| pM | 162 | 0 | 1 | 1 | 0 | | Y | VRAIDVG | 100 | | | | | | |
| pM | 163 | 0.11 | 2 | 2 | 0 | | Y | VRAIDVGY | 98.51 | VRAIDVGH | 1.49 | | | | |
| pM | 164 | 0.22 | 3 | 3 | 0 | | Y | RAIDVGYM | 97.01 | RAIDVGHM | 1.49 | RAIDVGYL | 1.49 | | |
| pM | 165 | 0.22 | 3 | 3 | 0 | | Y | AIDVGYMC | 97.01 | AIDVGHMC | 1.49 | AIDVGHMC | 1.49 | | |
| pM | 166 | 0.22 | 3 | 3 | 0 | | Y | IDVGYMCE | 97.01 | IDVGYLCE | 1.49 | IDVGHMCE | 1.49 | | |
| pM | 167 | 0.22 | 3 | 3 | 0 | | Y | DVGYMCED | 97.01 | DVGHMCED | 1.49 | DVGYLCED | 1.49 | | |
| pM | 168 | 0.22 | 3 | 3 | 0 | | Y | VGYMCEDT | 97.01 | VGYLCEDT | 1.49 | VGHMCEDT | 1.49 | | |
| pM | 169 | 0.22 | 3 | 3 | 0 | | Y | GYMCEDTI | 97.01 | GYLCEDTI | 1.49 | GHMCEDTI | 1.49 | | |
| pM | 170 | 0.22 | 3 | 3 | 0 | | Y | YMCEDTIT | 97.01 | HMCEDTIT | 1.49 | YLCEDTIT | 1.49 | | |

FIG. 35-7

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block

FIG. 35-8

Species: JEV (length of peptides: 8)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | fr

FIG. 35-9

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| pM | 228 | 0.22 | 3 | 3 | 0 | Y | ESSLVNKK | 97.01 | ESSLENKK | 1.49 | ERSLVNKK | 1.49 | | |
| pM | 229 | 0.33 | 4 | 4 | 0 | Y | SSLVNKKE | 95.52 | SSLVNKKK | 1.49 | SSLENKKE | 1.49 | RSLVNKKE | 1.49 |
| pM | 230 | 0.22 | 3 | 3 | 0 | Y | SLVNKKEA | 97.01 | SLVNKKKA | 1.49 | SLENKKEA | 1.49 | | |
| pM | 231 | 0.22 | 3 | 3 | 0 | Y | LVNKKEAW | 97.01 | LVNKKKAW | 1.49 | LENKKEAW | 1.49 | | |
| pM | 232 | 0.22 | 3 | 3 | 0 | Y | VNKKEAWL | 97.01 | VNKKKAWL | 1.49 | ENKKEAWL | 1.49 | | |
| pM | 233 | 0.22 | 3 | 3 | 0 | Y | NKKEAWLD | 97.01 | NKKKAWLN | 1.49 | NKKKAWLD | 1.49 | | |
| pM | 234 | 0.22 | 3 | 3 | 0 | Y | KKEAWLDS | 97.01 | KKEAWLNS | 1.49 | KKKAWLDS | 1.49 | | |
| pM | 235 | 0.22 | 3 | 3 | 0 | Y | KEAWLDST | 97.01 | KRAWLDST | 1.49 | KEAWLNST | 1.49 | | |
| pM | 236 | 0.33 | 4 | 4 | 0 | Y | EAWLDSTK | 95.52 | EAWLNSTK | 1.49 | KAWLDSTR | 1.49 | EAWLDSTR | 1.49 |
| pM | 237 | 0.3 | 3 | 3 | 0 | Y | AWLDSTRA | 95.52 | AWLDSTKA | 2.99 | AWLNSTKA | 1.49 | | |
| pM | 238 | 0.3 | 3 | 3 | 0 | Y | WLDSTRAT | 95.52 | WLDSTKAT | 2.99 | WLNSTKAT | 1.49 | | |
| pM | 239 | 0.3 | 3 | 3 | 0 | Y | LDSTRATR | 95.52 | LDSTKATR | 2.99 | LNSTKATR | 1.49 | | |
| pM | 240 | 0.3 | 3 | 3 | 0 | Y | DSTRATRY | 95.52 | DSTRATRY | 2.99 | NSTKATRY | 1.49 | | |
| pM | 241 | 0.19 | 2 | 2 | 0 | Y | STKATRYL | 97.01 | STRATRYL | 2.99 | | | | |
| pM | 242 | 0.57 | 4 | 4 | 0 | Y | TKATRYLM | 91.04 | TKATRYLT | 4.48 | TRATRYLM | 2.99 | TKATRYLV | 1.49 |
| pM | 243 | 0.57 | 4 | 4 | 0 | Y | KATRYLMK | 91.04 | KATRYLTK | 4.48 | RATRYLMK | 2.99 | KATRYLVK | 1.49 |
| pM | 244 | 0.37 | 3 | 3 | 0 | Y | ATRYLMKT | 94.03 | ATRYLTKT | 4.48 | ATRYLVKT | 1.49 | | |
| pM | 245 | 0.37 | 3 | 3 | 0 | Y | TRYLMKTE | 94.03 | TRYLTKTE | 4.48 | TRYLVKTE | 1.49 | | |
| pM | 246 | 0.37 | 3 | 3 | 0 | Y | RYLMKTEN | 94.03 | RYLTKTEN | 4.48 | RYLVKTEN | 1.49 | | |
| pM | 247 | 0.37 | 3 | 3 | 0 | Y | YLMKTENW | 94.03 | YLTKTENW | 4.48 | YLVKTENW | 1.49 | | |
| pM | 248 | 0.37 | 3 | 3 | 0 | Y | LMKTENWI | 94.03 | LTKTENWI | 4.48 | LVKTENWI | 1.49 | | |
| pM | 249 | 0.63 | 4 | 4 | 0 | Y | MKTENWII | 89.55 | MKTENWIV | 4.48 | MKTENWIV | 1.49 | VKTENWIV | 1.49 |
| pM | 250 | 0.33 | 2 | 2 | 0 | Y | KTENWIIR | 94.03 | KTENWIVR | 5.97 | | | | |
| pM | 251 | 0.33 | 2 | 2 | 0 | Y | TENWIIRN | 94.03 | TENWIVRN | 5.97 | | | | |
| pM | 252 | 0.33 | 2 | 2 | 0 | Y | ENWIIRNP | 94.03 | ENWIVRNP | 5.97 | | | | |

FIG. 35-10

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 253 | 0.33 | 2 | 2 | 0 | Y | NWIIRNPG | 94.03 | NWIVRNPG | 5.97 | | | | |
| prM | 254 | 0.33 | 2 | 2 | 0 | Y | WIIRNPGY | 94.03 | WIVRNPGY | 5.97 | | | | |
| prM | 255 | 0.33 | 2 | 2 | 0 | Y | IIRNPGYA | 94.03 | IVRNPGYA | 5.97 | | | | |
| prM | 256 | 0.33 | 2 | 2 | 0 | Y | IRNPGYAF | 94.03 | VRNPGYAF | 5.97 | | | | |
| prM | 257 | 0 | 1 | 1 | 0 | Y | RNPGYAFL | 100 | | | | | | |
| prM | 258 | 0 | 1 | 1 | 0 | Y | NPGYAFLA | 100 | | | | | | |
| prM | 259 | 0.22 | 3 | 3 | 0 | Y | PGYAFLAA | 97.01 | PGYAFLAV | 1.49 | PGYAFLAG | 1.49 | | |
| prM | 267 | 1.34 | 4 | 4 | 0 | Y | VLGWMLGS | 64.18 | ALGWMLGS | 25.37 | ILGWMLGS | 7.46 | TLGWMLGS | 2.99 |
| prM | 268 | 0.26 | 2 | 2 | 0 | Y | LGWMLGSN | 95.52 | LGWMLGST | 4.48 | | | | |
| prM | 269 | 0.94 | 4 | 4 | 0 | Y | GWMLGSNN | 79.1 | GWMLGSNS | 16.42 | GWMLGSTT | 2.99 | GWMLGSTN | 1.49 |
| prM | 270 | 0.94 | 4 | 4 | 0 | Y | WMLGSNNG | 79.1 | WMLGSNSG | 16.42 | WMLGSTTG | 2.99 | WMLGSTNG | 1.49 |
| prM | 277 | 0.33 | 3 | 3 | 0 | Y | GQRVFTI | 95.52 | GHRVFTI | 1.49 | GQRLGFTI | 1.49 | GPRVFTI | 1.49 |
| prM | 278 | 0.33 | 3 | 3 | 0 | Y | QRVFTIL | 95.52 | HRVFTIL | 1.49 | QRLGFTIL | 1.49 | PRVFTIL | 1.49 |
| prM | 279 | 0.22 | 2 | 2 | 0 | Y | RVFTILP | 97.01 | RVFTILP | 1.49 | RLGFTIL | 1.49 | | |
| prM | 280 | 0.22 | 2 | 2 | 0 | Y | VVFTILLL | 97.01 | LGFTILLL | 1.49 | VVFTILPL | 1.49 | | |
| prM | 281 | 0.22 | 2 | 2 | 0 | Y | VFTILLLL | 97.01 | GFTILLLL | 1.49 | VFTILPLL | 1.49 | | |
| prM | 282 | 0.11 | 2 | 2 | 0 | Y | FTILLLLV | 98.51 | FTILPLLV | 1.49 | | | | |
| prM | 283 | 0.11 | 2 | 2 | 0 | Y | TILLLLVA | 98.51 | TILPLLVA | 1.49 | | | | |
| prM | 284 | 0.11 | 2 | 2 | 0 | Y | ILLLLVAP | 98.51 | ILPLLVAP | 1.49 | | | | |
| prM | 285 | 0.11 | 2 | 2 | 0 | Y | LLLLVAPA | 98.51 | LPLLVAPA | 1.49 | | | | |
| prM | 286 | 0.11 | 2 | 2 | 0 | Y | LLLVAPAY | 98.51 | PLLVAPAY | 1.49 | | | | |
| prM | 287 | 0 | 1 | 1 | 0 | Y | LLVAPAYS | 100 | | | | | | |
| prM | 288 | 0 | 1 | 1 | 0 | Y | LVAPAYSF | 100 | | | | | | |
| prM | 289 | 0.11 | 2 | 2 | 0 | Y | VAPAYSFN | 98.51 | VAPAYSFT | 1.49 | | | | |
| prM | 290 | 0.11 | 2 | 2 | 0 | Y | APAYSFNC | 98.51 | APAYSFTC | 1.49 | | | | |

FIG. 35-11

Species: JEV (length of peptides: 8)

|

FIG. 35-12

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 316 | 0 | 1 | 1 | 0 | Y | DLVLEGDS | 100 | | | | | | |
| E | 317 | 0 | 1 | 1 | 0 | Y | LVLEGDSC | 100 | | | | | | |
| E | 318 | 0 | 1 | 1 | 0 | Y | VLEGDSCL | 100 | | | | | | |
| E | 319 | 0 | 1 | 1 | 0 | Y | LEGDSCLT | 100 | | | | | | |
| E | 320 | 0 | 1 | 1 | 0 | Y | EGDSCLTI | 100 | | | | | | |
| E | 321 | 0 | 1 | 1 | 0 | Y | GDSCLTIM | 100 | | | | | | |
| E | 322 | 0 | 1 | 1 | 0 | Y | DSCLTIMA | 100 | | | | | | |
| E | 323 | 0.19 | 2 | 2 | 0 | Y | SCLTIMAN | 97.01 | SCLTIMAS | 2.99 | | | | |
| E | 324 | 0.19 | 2 | 2 | 0 | Y | CLTIMAND | 97.01 | CLTIMASD | 2.99 | | | | |
| E | 325 | 0.3 | 3 | 3 | 0 | Y | LTIMANDK | 95.52 | LTIMASDK | 2.99 | LTIMANDR | 1.49 | | |
| E | 326 | 0.3 | 3 | 3 | 0 | Y | TIMANDKP | 95.52 | TIMASDKP | 2.99 | TIMANDRP | 1.49 | | |
| E | 327 | 0.3 | 3 | 3 | 0 | Y | IMANDKPT | 95.52 | IMASDKPT | 2.99 | IMANDRPT | 1.49 | | |
| E | 328 | 0.3 | 3 | 3 | 0 | Y | MANDKPTL | 95.52 | MASDKPTL | 2.99 | MANDRPTL | 1.49 | | |
| E | 329 | 0.3 | 3 | 3 | 0 | Y | ANDKPTLD | 95.52 | ASDKPTLD | 2.99 | ANDRPTLD | 1.49 | | |
| E | 330 | 0.42 | 4 | 4 | 0 | Y | NDKPTLDV | 94.03 | SDKPTLDV | 2.99 | NDRPTLDV | 1.49 | NDKPTLDR | 1.49 |
| E | 331 | 0.22 | 3 | 3 | 0 | Y | DKPTLDVR | 97.01 | DRPTLDVR | 1.49 | DKPTLDRR | 1.49 | | |
| E | 332 | 0.22 | 3 | 3 | 0 | Y | KPTLDVRM | 97.01 | RPTLDVRM | 1.49 | KPTLDRRM | 1.49 | | |
| E | 333 | 0.22 | 3 | 3 | 0 | Y | PTLDVRMI | 97.01 | PTLDVRMT | 1.49 | PTLDRRMI | 1.49 | | |
| E | 334 | 0.22 | 3 | 3 | 0 | Y | TLDVRMIN | 97.01 | TLDVRMTN | 1.49 | TLDRRMIN | 1.49 | | |
| E | 335 | 0.22 | 3 | 3 | 0 | Y | LDVRMINI | 97.01 | LDVRMTNI | 1.49 | LDRRMINI | 1.49 | | |
| E | 336 | 0.22 | 3 | 3 | 0 | Y | DVRMINIE | 97.01 | DRRMINIE | 1.49 | DVRMTNIE | 1.49 | | |
| E | 337 | 0.22 | 3 | 3 | 0 | Y | VRMINIEA | 97.01 | VRMTNIEA | 1.49 | RRMINIEA | 1.49 | | |
| E | 338 | 0.37 | 3 | 3 | 0 | Y | RMINIEAS | 94.03 | RMINIEAV | 4.48 | RMTNIEAS | 1.49 | | |
| E | 339 | 0.37 | 3 | 3 | 0 | Y | MINIEASQ | 94.03 | MINIEAVQ | 4.48 | MTNIEASQ | 1.49 | | |
| E | 340 | 0.37 | 3 | 3 | 0 | Y | INIEASQL | 94.03 | INIEAVQL | 4.48 | TNIEASQL | 1.49 | | |

FIG. 35-13

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 341 | 0.26 | 2 | 2 | 0 | Y | NIEASQLA | 95.52 | NIEAVQLA | 4.48 | | | | |
| E | 342 | 0.26 | 2 | 2 | 0 | Y | IEASQLAE | 95.52 | IEAVQLAE | 4.48 | | | | |
| E | 343 | 0.26 | 2 | 2 | 0 | Y | EASQLAEV | 95.52 | EAQLAEV | 4.48 | | | | |
| E | 344 | 0.26 | 2 | 2 | 0 | Y | ASQLAEVR | 95.52 | AVQLAEVR | 4.48 | | | | |
| E | 345 | 0.26 | 2 | 2 | 0 | Y | SQLAEVRS | 95.52 | VQLAEVRS | 4.48 | | | | |
| E | 346 | 0 | 2 | 1 | 0 | Y | QLAEVRSY | 100 | | | | | | |
| E | 347 | 0.11 | 2 | 2 | 0 | Y | LAEVRSYY | 98.51 | LAEVRSYY | 1.49 | | | | |
| E | 348 | 0.11 | 2 | 2 | 0 | Y | AEVRSYCY | 98.51 | AEVRSYYY | 1.49 | | | | |
| E | 349 | 0.22 | 3 | 3 | 0 | Y | EVRSYCYH | 97.01 | EVRSYYYH | 1.49 | EVRSYCYR | 1.49 | | |
| E | 350 | 0.22 | 3 | 3 | 0 | Y | VRSYCYHA | 97.01 | VRSYCYRA | 1.49 | VRSYYHA | 1.49 | | |
| E | 351 | 0.22 | 3 | 3 | 0 | Y | RSYCYHAS | 97.01 | RSYYYHAS | 1.49 | RSYCYRAS | 1.49 | | |
| E | 352 | 0.22 | 3 | 3 | 0 | Y | SYCYHASV | 97.01 | SYCYRASV | 1.49 | SYYYHASV | 1.49 | | |
| E | 353 | 0.22 | 3 | 3 | 0 | Y | YCYHASVT | 97.01 | YCYRASVT | 1.49 | YYYHASVT | 1.49 | | |
| E | 354 | 0.22 | 3 | 3 | 0 | Y | CYHASVTD | 97.01 | CYRASVTD | 1.49 | YYHASVTD | 1.49 | | |
| E | 355 | 0.11 | 2 | 2 | 0 | Y | YHASVTDI | 98.51 | YRASVTDI | 1.49 | | | | |
| E | 356 | 0.11 | 2 | 2 | 0 | Y | HASVTDIS | 98.51 | RASVTDIS | 1.49 | | | | |
| E | 357 | 0 | 1 | 1 | 0 | Y | ASVTDIST | 100 | | | | | | |
| E | 358 | 0 | 1 | 1 | 0 | Y | SVTDISTV | 100 | | | | | | |
| E | 359 | 0 | 1 | 1 | 0 | Y | VTDISTVA | 100 | | | | | | |
| E | 360 | 0 | 1 | 1 | 0 | Y | TDISTVAR | 100 | | | | | | |
| E | 361 | 0 | 1 | 1 | 0 | Y | DISTVARC | 100 | | | | | | |
| E | 362 | 0 | 1 | 1 | 0 | Y | ISTVARCP | 100 | | | | | | |
| E | 363 | 0.43 | 2 | 2 | 0 | Y | STVARCPT | 91.04 | STVARCPM | 8.96 | | | | |
| E | 364 | 0.43 | 2 | 2 | 0 | Y | TVARCPTT | 91.04 | TVARCPMT | 8.96 | | | | |
| E | 365 | 0.43 | 2 | 2 | 0 | Y | VARCPTTG | 91.04 | VARCPMTG | 8.96 | | | | |

FIG. 35-14

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 366 | 0.43 | 2 | 2 | 0 | Y | ARCPTGE | 91.04 | ARCPMTGE | 8.96 | | | | |
| E | 367 | 0.43 | 2 | 2 | 0 | Y | RCPTGEA | 91.04 | RCPMTGEA | 8.96 | | | | |
| E | 368 | 0.43 | 2 | 2 | 0 | Y | CPTGEAH | 91.04 | CPMTGEAH | 8.96 | | | | |
| E | 369 | 0.43 | 2 | 2 | 0 | Y | PTGEAHN | 91.04 | PMTGEAHN | 8.96 | | | | |
| E | 370 | 0.54 | 3 | 3 | 0 | Y | TTGEAHNE | 89.55 | MTGEAHNE | 8.96 | TTGEAHNK | 1.49 | | |
| E | 371 | 0.11 | 2 | 2 | 0 | Y | TGEAHNEK | 98.51 | TGEAHNKK | 1.49 | | | | |
| E | 372 | 0.33 | 4 | 4 | 0 | Y | GEAHNEKR | 95.52 | GEAHNEKQ | 1.49 | GEAHNKKR | 1.49 | GEAHNEKG | 1.49 |
| E | 373 | 0.33 | 4 | 4 | 0 | Y | EAHNEKRA | 95.52 | EAHNEKGA | 1.49 | EAHNKKRA | 1.49 | EAHNEKQA | 1.49 |
| E | 374 | 0.33 | 4 | 4 | 0 | Y | AHNEKRAD | 95.52 | AHNEKGAD | 1.49 | AHNKKRAD | 1.49 | AHNEKQAD | 1.49 |
| E | 375 | 0.33 | 4 | 4 | 0 | Y | HNEKRADS | 95.52 | HNEKGADS | 1.49 | HNKKRADS | 1.49 | HNEKGADS | 1.49 |
| E | 376 | 0.33 | 4 | 4 | 0 | Y | NEKRADSS | 95.52 | NEKGADSS | 1.49 | NEKGADSS | 1.49 | NKKRADSS | 1.49 |
| E | 377 | 0.33 | 3 | 3 | 0 | Y | EKRADSSY | 95.52 | EKQADSSY | 1.49 | KKRADSSY | 1.49 | EKGADSSY | 1.49 |
| E | 378 | 0.22 | 3 | 3 | 0 | Y | KRADSSYV | 97.01 | KQADSSYV | 1.49 | KGADSSYV | 1.49 | | |
| E | 379 | 0.22 | 3 | 1 | 0 | Y | RADSSYVC | 97.01 | GADSSYVC | 1.49 | QADSSYVC | 1.49 | | |
| E | 380 | 0 | 1 | 1 | 0 | Y | ADSSYVCK | 100 | | | | | | |
| E | 381 | 0 | 1 | 1 | 0 | Y | DSSYVCKQ | 100 | | | | | | |
| E | 382 | 0 | 1 | 1 | 0 | Y | SSYVCKQG | 100 | | | | | | |
| E | 383 | 0 | 1 | 1 | 0 | Y | SYVCKQGF | 100 | | | | | | |
| E | 384 | 0 | 1 | 1 | 0 | Y | YVCKQGFT | 100 | | | | | | |
| E | 385 | 0 | 1 | 1 | 0 | Y | VCKQGFTD | 100 | | | | | | |
| E | 386 | 0 | 1 | 1 | 0 | Y | CKQGFTDR | 100 | | | | | | |
| E | 387 | 0 | 1 | 1 | 0 | Y | KQGFTDRG | 100 | | | | | | |
| E | 388 | 0 | 1 | 1 | 0 | Y | QGFTDRGW | 100 | | | | | | |
| E | 389 | 0.11 | 2 | 2 | 0 | Y | GFTDRGWG | 98.51 | GFTDRGWR | 1.49 | | | | |
| E | 390 | 0.22 | 3 | 3 | 0 | Y | FTDRGWGN | 97.01 | FTDRGWRN | 1.49 | FTDRGWGK | 1.49 | | |

FIG. 35-15

Species: JEV (length of peptides: 8)

| protein | block starting position | block entropy | total peptides in block | # peptides required to cover 99% of block | gap/X fraction | 99% of block | covered w/ <= 5 peptides? | peptides required to cover 99% of block

FIG. 35-16

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 418 | 1.04 | 5 | 5 | 0 | Y | KAIGRTIQ | 77.61 | KATGKTIQ | 2.99 | KAIERTIQ | 1.49 | KAIGRAIQ | 1.49 |
| E | 423 | 0.93 | 5 | 5 | 0 | Y | TIQPENIK | 80.6 | TIQPENSK | 1.49 | AIQPENIK | 1.49 | MIQSENIK | 1.49 |
| E | 424 | 0.22 | 3 | 3 | 0 | Y | IQPENIKY | 97.01 | IQSENIKY | 1.49 | | | | |
| E | 425 | 0.86 | 4 | 4 | 0 | Y | QPENIKYE | 80.6 | QPENSKYE | 1.49 | QSENIKYE | 1.49 | | |
| E | 426 | 0.86 | 4 | 4 | 0 | Y | PENIKYEV | 80.6 | PENSKYEV | 1.49 | SENIKYEV | 1.49 | | |
| E | 427 | 0.75 | 3 | 3 | 0 | Y | ENIKYEVG | 82.09 | ENSKYEVG | 1.49 | | | | |
| E | 428 | 0.75 | 3 | 3 | 0 | Y | NIKYEVGI | 82.09 | NSKYEVGI | 1.49 | | | | |
| E | 429 | 0.75 | 3 | 3 | 0 | Y | IKYEVGIF | 82.09 | SKYEVGIF | 1.49 | | | | |
| E | 430 | 0.64 | 2 | 2 | 0 | Y | KYEVGIFV | 83.58 | | | | | | |
| E | 431 | 0.64 | 2 | 2 | 0 | Y | YEVGIFVH | 83.58 | | | | | | |
| E | 432 | 0.64 | 2 | 2 | 0 | Y | EVGIFVHG | 83.58 | | | | | | |
| E | 433 | 0.33 | 2 | 2 | 0 | Y | VGIFVHGT | 94.03 | | | | | | |
| E | 434 | 0.33 | 2 | 2 | 0 | Y | GIFVHGTT | 94.03 | | | | | | |
| E | 435 | 0.33 | 2 | 2 | 0 | Y | IFVHGTTT | 94.03 | | | | | | |
| E | 436 | 0.33 | 2 | 2 | 0 | Y | FVHGTTTS | 94.03 | | | | | | |
| E | 437 | 0.33 | 2 | 2 | 0 | Y | VHGTTTSE | 94.03 | | | | | | |
| E | 438 | 0.33 | 2 | 2 | 0 | Y | HGTTTSEN | 94.03 | | | | | | |
| E | 439 | 0.33 | 2 | 2 | 0 | Y | GTTTSENH | 94.03 | | | | | | |
| E | 440 | 0.33 | 2 | 2 | 0 | Y | TTTSENHG | 94.03 | | | | | | |
| E | 441 | 0 | 1 | 1 | 0 | Y | TTSENHGN | 100 | | | | | | |
| E | 442 | 0 | 1 | 1 | 0 | Y | TSENHGNY | 100 | | | | | | |
| E | 443 | 0.11 | 2 | 2 | 0 | Y | SENHGNYS | 98.51 | SENHGNYT | 1.49 | | | | |
| E | 444 | 0.11 | 2 | 2 | 0 | Y | ENHGNYSA | 98.51 | ENHGNYTA | 1.49 | | | | |
| E | 445 | 0.11 | 2 | 2 | 0 | Y | NHGNYSAQ | 98.51 | NHGNYTAQ | 1.49 | | | | |
| E | 446 | 0.11 | 2 | 2 | 0 | Y | HGNYSAQV | 98.51 | HGNYTAQI | 1.49 | | | | |

FIG. 35-17

Species: JEV (length of peptides: 8)

| protein | block starting position | block entropy | total peptides in block | # peptides required to cover 99% of block | gap/X fraction | 99% of block covered w/ <= 5 peptides? | peptides required

FIG. 35-18

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover

FIG. 35-19

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 498 | 0.83 | 4 | 4 | 1.49 | Y | MTVGSKSF | 80.6 | MTVGRSF | 14.93 | MTVGPKSF | 1.49 | MTVGSKSL | 1.49 | | |
| E | 499 | 0.83 | 4 | 4 | 1.49 | Y | TVGSKSFL | 80.6 | TVGSRSFL | 14.93 | TVGPKSFL | 1.49 | TVGSKSLL | 1.49 | | |
| E | 500 | 0.83 | 4 | 4 | 1.49 | Y | VGSKSFLV | 80.6 | VGSRSFLV | 14.93 | VGPKSFLV | 1.49 | VGSKSLLV | 1.49 | | |
| E | 501 | 0.83 | 4 | 4 | 1.49 | Y | GSKSFLVH | 80.6 | GSRSFLVH | 14.93 | GPKSFLVH | 1.49 | GSKSLLVH | 1.49 | | |
| E | 502 | 0.83 | 4 | 4 | 1.49 | Y | SKSFLVHR | 80.6 | SRSFLVHR | 14.93 | PKSFLVHR | 1.49 | SKSLLVHR | 1.49 | | |
| E | 503 | 0.72 | 3 | 3 | 1.49 | Y | KSFLVHRE | 82.09 | RSFLVHRE | 14.93 | KSLLVHRE | 1.49 | | | | |
| E | 504 | 0.11 | 2 | 2 | 0 | Y | SFLVHREW | 98.51 | SLLVHREW | 1.49 | | | | | | |
| E | 505 | 0.11 | 2 | 2 | 0 | Y | FLVHREWF | 98.51 | LLVHREWF | 1.49 | | | | | | |
| E | 506 | 0 | 1 | 1 | 0 | Y | LVHREWFH | 100 | | | | | | | | |
| E | 507 | 0 | 1 | 1 | 0 | Y | VHREWFHD | 100 | | | | | | | | |
| E | 508 | 0 | 1 | 1 | 0 | Y | HREWFHDL | 100 | | | | | | | | |
| E | 509 | 0.68 | 2 | 2 | 0 | Y | REWFHDLA | 82.09 | REWFHDLS | 17.91 | | | | | | |
| E | 510 | 0.68 | 2 | 2 | 0 | Y | EWFHDLAL | 82.09 | EWFHDLSL | 17.91 | | | | | | |
| E | 511 | 0.68 | 2 | 2 | 0 | Y | WFHDLALP | 82.09 | WFHDLSLP | 17.91 | | | | | | |
| E | 512 | 0.68 | 2 | 2 | 0 | Y | FHDLALPW | 82.09 | FHDLSLPW | 17.91 | | | | | | |
| E | 513 | 0.79 | 3 | 3 | 0 | Y | HDLALPWT | 80.6 | HDLSLPWT | 17.91 | HDLALPWS | 1.49 | | | | |
| E | 514 | 1.27 | 4 | 4 | 0 | Y | DLALPWTS | 68.66 | DLSLPWTS | 17.91 | DLALPWTP | 11.94 | DLALPWSS | 1.49 | | |
| E | 515 | 1.38 | 5 | 5 | 0 | Y | LALPWTSP | 67.16 | LSLPWTSP | 17.91 | LALPWTPP | 11.94 | LALPWTSS | 1.49 | LALPWSSP | 1.49 |
| E | 516 | 1.38 | 5 | 5 | 0 | Y | ALPWTSPS | 67.16 | SLPWTSPS | 17.91 | ALPWTPPS | 11.94 | ALPWTSSS | 1.49 | ALPWTSSS | 1.49 |
| E | 517 | 0.75 | 4 | 4 | 0 | Y | LPWTSPSS | 85.07 | LPWTPPSS | 17.91 | LPWTSSSN | 11.94 | LPWSSPSS | 1.49 | | |
| E | 518 | 0.75 | 4 | 4 | 0 | Y | PWTSPSST | 85.07 | PWTPPSST | 17.91 | PWSSPSST | 11.94 | PWTSSSNT | 1.49 | | |
| E | 519 | 0.75 | 4 | 4 | 0 | Y | WTSPSSTA | 85.07 | WTPPSSTA | 17.91 | WSSPSSTA | 11.94 | WTSSSNTA | 1.49 | | |
| E | 520 | 0.75 | 4 | 4 | 0 | Y | TSPSSTAW | 85.07 | TPPSSTAW | 17.91 | SSPSSTAW | 11.94 | TSSSNTAW | 1.49 | | |
| E | 521 | 0.64 | 3 | 3 | 0 | Y | SPSSTAWR | 86.57 | PPSSTAWR | 11.94 | SSSNTAWR | 1.49 | | | | |
| E | 522 | 0.11 | 2 | 2 | 0 | Y | PSSTAWRN | 98.51 | SSNTAWRN | 1.49 | | | | | | |

FIG. 35-21

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 548 | 0.33 | 4 | 4 | 0 | Y | ALGQEGG | 95.52 | ALGSQERA | 1.49 | ALGSQEGS | 1.49 | ALGSREGG | 1.49 | | |
| E | 549 | 0.33 | 4 | 4 | 0 | Y | LGSQEGGL | 95.52 | LGSQEGSL | 1.49 | LGSQERAL | 1.49 | LGSREGGL | 1.49 | | |
| E | 550 | 0.33 | 4 | 4 | 0 | Y | GSQEGGLH | 95.52 | GSREGGLH | 1.49 | GSQERALH | 1.49 | GSQEGSLH | 1.49 | | |
| E | 551 | 0.66 | 5 | 5 | 0 | Y | SQEGGLHQ | 89.55 | SQEGGLHH | 5.97 | SQEGSLHQ | 1.49 | SQERALHQ | 1.49 | SREGGLHQ | 1.49 |
| E | 552 | 0.66 | 5 | 5 | 0 | Y | QEGGLHQA | 89.55 | QEGGLHHA | 5.97 | REGGLHQA | 1.49 | QEGSLHQA | 1.49 | QERALHQA | 1.49 |
| E | 553 | 0.55 | 4 | 4 | 0 | Y | EGGLHQAL | 91.04 | EGGLHHAL | 5.97 | ERALHQAL | 1.49 | EGSLHQAL | 1.49 | | |
| E | 554 | 0.55 | 4 | 4 | 0 | Y | GGLHQALA | 91.04 | GGLHHALA | 5.97 | GSLHQALA | 1.49 | RALHQALA | 1.49 | | |
| E | 555 | 0.55 | 4 | 4 | 0 | Y | GLHQALAG | 91.04 | GLHHALAG | 5.97 | ALHQALAG | 1.49 | SLHQALAG | 1.49 | | |
| E | 556 | 0.33 | 2 | 2 | 0 | Y | LHQALAGA | 94.03 | LHHALAGA | 5.97 | | | | | | |
| E | 557 | 0.33 | 2 | 2 | 0 | Y | HQALAGAI | 94.03 | HHALAGAI | 5.97 | | | | | | |
| E | 558 | 0.33 | 2 | 2 | 0 | Y | QALAGAIV | 94.03 | HALAGAIV | 5.97 | | | | | | |
| E | 559 | 0 | 1 | 1 | 0 | Y | ALAGAIVV | 100 | | | | | | | | |
| E | 560 | 0 | 1 | 1 | 0 | Y | LAGAIVVE | 100 | | | | | | | | |
| E | 561 | 0 | 1 | 1 | 0 | Y | AGAIVVEY | 100 | | | | | | | | |
| E | 562 | 0.11 | 2 | 2 | 0 | Y | GAIVVEYS | 98.51 | GAIVVEYP | 1.49 | | | | | | |
| E | 563 | 0.22 | 3 | 3 | 0 | Y | AIVVEYSS | 97.01 | AIVVEYSN | 1.49 | AIVVEYPS | 1.49 | | | | |
| E | 564 | 0.22 | 3 | 3 | 0 | Y | IVVEYSSS | 97.01 | IVVEYSNS | 1.49 | IVVEYPSS | 1.49 | | | | |
| E | 565 | 0.22 | 3 | 3 | 0 | Y | VVEYSSSV | 97.01 | VVEYSNSV | 1.49 | VVEYPSSV | 1.49 | | | | |
| E | 566 | 0.42 | 4 | 4 | 0 | Y | VEYSSSVM | 94.03 | VEYSSSYM | 2.99 | VEYSNSVK | 1.49 | VEYPSSVK | 1.49 | | |
| E | 567 | 0.42 | 4 | 4 | 0 | Y | EYSSSVKL | 94.03 | EYSSSVML | 2.99 | EYPSSVKL | 1.49 | EYSNSVKL | 1.49 | | |
| E | 568 | 0.42 | 4 | 4 | 0 | Y | YSSSVKLT | 94.03 | YSSSVMLT | 2.99 | YSNSVKLT | 1.49 | YPSSVKLT | 1.49 | | |
| E | 569 | 0.42 | 4 | 4 | 0 | Y | SSSVKLTS | 94.03 | SSSVMLTS | 2.99 | PSSVKLTS | 1.49 | SNSVKLTS | 1.49 | | |
| E | 570 | 0.3 | 3 | 3 | 0 | Y | SSVKLTSG | 95.52 | SSVMLTSG | 2.99 | NSVKLTSG | 1.49 | | | | |
| E | 571 | 0.19 | 2 | 2 | 0 | Y | SVKLTSGH | 97.01 | SVMLTSGH | 2.99 | | | | | | |
| E | 572 | 0.3 | 3 | 3 | 0 | Y | VKLTSGHL | 95.52 | VMLTSGHL | 2.99 | VKLTSGHV | 1.49 | | | | |

FIG. 35-22

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of

FIG. 35-23

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

FIG. 35-24

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 623 | 0.22 | 3 | 3 | 0 | Y | SGSDGPCK | 97.01 | SGRDGPCK | 1.49 | SGSDGSCK | 1.49 | | |
| E | 624 | 0.22 | 3 | 3 | 0 | Y | GSDGPCKI | 97.01 | GRDGPCKI | 1.49 | GSDGSCKI | 1.49 | | |
| E | 625 | 0.22 | 3 | 3 | 0 | Y | SDGPCKIP | 97.01 | RDGPCKIP | 1.49 | SDGSCKIP | 1.49 | | |
| E | 626 | 0.11 | 2 | 2 | 0 | Y | DGPCKIPI | 98.51 | DGSCKIPI | 1.49 | | | | |
| E | 627 | 0.11 | 2 | 2 | 0 | Y | GPCKIPIW | 98.51 | GSCKIPIW | 1.49 | | | | |
| E | 628 | 0.11 | 2 | 2 | 0 | Y | PCKIPIWS | 98.51 | SCKIPIWS | 1.49 | | | | |
| E | 629 | 0 | 1 | 1 | 0 | Y | CKIPIWSV | 100 | | | | | | |
| E | 630 | 0.11 | 2 | 2 | 0 | Y | KIPIWSVA | 98.51 | KIPIWSYV | 1.49 | | | | |
| E | 631 | 0.22 | 3 | 3 | 0 | Y | IPIWSVAS | 97.01 | IPIWSVAN | 1.49 | IPIWSVYS | 1.49 | | |
| E | 632 | 0.22 | 3 | 3 | 0 | Y | PIWSVASL | 97.01 | PIWSVANL | 1.49 | PIWSVYSL | 1.49 | | |
| E | 633 | 0.22 | 3 | 3 | 0 | Y | IWSVASLN | 97.01 | IWSVANLN | 1.49 | IWSVYSLN | 1.49 | | |
| E | 634 | 0.22 | 3 | 3 | 0 | Y | VSVASLND | 97.01 | VSVANLND | 1.49 | VSVWSLND | 1.49 | | |
| E | 635 | 0.55 | 3 | 3 | 0 | Y | SVASLNDM | 91.04 | SVASLNDL | 5.97 | SVANLNDM | 1.49 | SVWSLNDM | 1.49 |
| E | 636 | 0.55 | 3 | 3 | 0 | Y | VASLNDMT | 91.04 | VASLNDLT | 5.97 | WSLNDMT | 1.49 | VANLNDMT | 1.49 |
| E | 637 | 0.55 | 3 | 3 | 0 | Y | ASLNDMTP | 91.04 | ASLNDLTP | 5.97 | ANLNDMTP | 1.49 | VSLNDMTP | 1.49 |
| E | 638 | 0.55 | 3 | 3 | 0 | Y | SLNDMTPV | 91.04 | SLNDLTPV | 5.97 | NLNDMTPV | 1.49 | SLNDMTPA | 1.49 |
| E | 639 | 0.44 | 3 | 3 | 0 | Y | LNDMTPVG | 92.54 | LNDLTPVG | 5.97 | NDMTPAG | 1.49 | | |
| E | 640 | 0.44 | 3 | 3 | 0 | Y | NDMTPVGR | 92.54 | NDLTPVGR | 5.97 | NDMTPAGR | 1.49 | | |
| E | 641 | 0.44 | 3 | 3 | 0 | Y | DMTPVGRL | 92.54 | DLTPVGRL | 5.97 | DMTPAGRL | 1.49 | | |
| E | 642 | 0.44 | 3 | 3 | 0 | Y | MTPVGRLV | 92.54 | LTPVGRLV | 5.97 | MTPAGRLV | 1.49 | | |
| E | 643 | 0.11 | 2 | 2 | 0 | Y | TPVGRLVT | 98.51 | TPAGRLVT | 1.49 | | | | |
| E | 644 | 0.11 | 2 | 2 | 0 | Y | PVGRLVTV | 98.51 | PAGRLVTV | 1.49 | | | | |
| E | 645 | 0.11 | 2 | 2 | 0 | Y | VGRLVTVN | 98.51 | AGRLVTVN | 1.49 | | | | |
| E | 646 | 0 | 1 | 1 | 0 | Y | GRLVTVNP | 100 | | | | | | |
| E | 647 | 0 | 1 | 1 | 0 | Y | RLVTVNPF | 100 | | | | | | |

FIG. 35-25

Species: JEV (length of peptides: 8)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 648 | 0 | 1 | 1 | 0 | LVTVNPFV | Y | 100 | | | | | | | |
| E | 649 | 0 | 1 | 1 | 0 | VTVNPFVA | Y | 100 | | | | | | | |
| E | 650 | 0.26 | 2 | 2 | 0 | TVNPFVAT | Y | 95.52 | TVNPFVAA | 4.48 | | | | | |
| E | 651 | 0.26 | 2 | 2 | 0 | VNPFVATS | Y | 95.52 | VNPFVAAS | 4.48 | | | | | |
| E | 652 | 0.26 | 2 | 2 | 0 | NPFVATSS | Y | 95.52 | NPFVAASS | 4.48 | | | | | |
| E | 653 | 0.93 | 3 | 3 | 0 | PFVATSSA | Y | 77.61 | PFVAASSA | 4.48 | | | | | |
| E | 654 | 0.93 | 3 | 3 | 0 | FVATSSSN | Y | 77.61 | FVAASSAN | 4.48 | | | | | |
| E | 655 | 0.93 | 3 | 3 | 0 | VATSSSNS | Y | 77.61 | VAASSANS | 4.48 | | | | | |
| E | 656 | 1 | 4 | 4 | 0 | ATSSSNSK | Y | 77.61 | AASSANSK | 4.48 | ATSSSNSQ | 1.49 | | | |
| E | 657 | 1.11 | 5 | 5 | 0 | TSSSNSKV | Y | 76.12 | ASSANSKV | 4.48 | TSSSNSQV | 1.49 | TSSANSKA | 1.49 | |
| E | 658 | 0.86 | 4 | 4 | 0 | SSSNSKVL | Y | 80.6 | SSSNSQVL | 1.49 | SSANSKAL | 1.49 | SSNSQVLV | 1.49 | |
| E | 659 | 0.93 | 5 | 5 | 0 | SANSKVLV | Y | 80.6 | SSNSKVLL | 1.49 | SANSKALV | 1.49 | SNSQVLVE | 1.49 | |
| E | 660 | 0.93 | 5 | 5 | 0 | ANSKVLVE | Y | 80.6 | ANSKALVE | 1.49 | SNSKVLLE | 1.49 | | | |
| E | 661 | 0.33 | 2 | 4 | 0 | NSKVLVEM | Y | 95.52 | NSKALVEM | 1.49 | NSQVLVEM | 1.49 | | | |
| E | 662 | 0.33 | 2 | 4 | 0 | SKVLVEME | Y | 95.52 | SQVLVEME | 1.49 | SKVLLEIE | 1.49 | | | |
| E | 663 | 0.33 | 2 | 4 | 0 | KVLVEMEP | Y | 95.52 | KALVEMEP | 1.49 | QVLVEMEP | 1.49 | | | |
| E | 664 | 0.22 | 3 | 3 | 0 | VLVEMEPP | Y | 97.01 | ALVEMEPP | 1.49 | | | | | |
| E | 665 | 0.11 | 2 | 2 | 0 | LVEMEPPF | Y | 98.51 | | | | | | | |
| E | 666 | 0.11 | 2 | 2 | 0 | VEMEPPFG | Y | 98.51 | | | | | | | |
| E | 667 | 0.11 | 2 | 2 | 0 | EMEPPFGD | Y | 98.51 | | | | | | | |
| E | 668 | 0.11 | 2 | 2 | 0 | MEPPFGDS | Y | 98.51 | | | | | | | |
| E | 669 | 0 | 1 | 1 | 0 | EPPFGDSY | Y | 100 | | | | | | | |
| E | 670 | 0 | 1 | 1 | 0 | PPFGDSYI | Y | 100 | | | | | | | |
| E | 671 | 0 | 1 | 1 | 0 | PFGDSYIV | Y | 100 | | | | | | | |
| E | 672 | 0.11 | 2 | 2 | 0 | FGDSYIVI | Y | 98.51 | FGDSYIVV | 1.49 | | | | | |

FIG. 35-26

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 673 | 0.11 | 2 | 2 | 0 | Y | GDSYIVVG | 98.51 | | | | | | |
| E | 674 | 0.22 | 3 | 3 | 0 | Y | DSYIVVGR | 97.01 | | | | | | |
| E | 675 | 0.45 | 5 | 5 | 0 | Y | SYIVVGRG | 94.03 | DSYIVVGM | 1.49 | | | | |
| E | 684 | 0.33 | 4 | 4 | 0 | Y | KQINHHWH | 95.52 | SYIVVGRK | 1.49 | | | | |
| E | 685 | 0.6 | 5 | 5 | 0 | Y | QINHHWHK | 91.04 | KQINHHRH | 1.49 | | | | |
| E | 688 | 0.6 | 5 | 5 | 0 | Y | HHWHKAGS | 91.04 | QINHHRHK | 1.49 | | | | |
| E | 689 | 0.6 | 5 | 5 | 0 | Y | HWHKAGST | 91.04 | HHWYKAGS | 4.48 | | | | |
| E | 690 | 0.6 | 5 | 5 | 0 | Y | WHKAGSTL | 91.04 | HWHKPGST | 4.48 | | | | |
| E | 691 | 0.49 | 4 | 4 | 0 | Y | HKAGSTLG | 92.54 | WHRAGSTL | 4.48 | | | | |
| E | 692 | 0.37 | 3 | 3 | 0 | Y | KAGSTLGK | 94.03 | HRAGSTLG | 4.48 | | | | |
| E | 693 | 0.11 | 2 | 2 | 0 | Y | AGSTLGKA | 98.51 | RAGSTLGK | 1.49 | | | | |
| E | 694 | 0 | 1 | 1 | 0 | Y | GSTLGKAF | 100 | | | | | | |
| E | 695 | 0.38 | 2 | 2 | 0 | Y | STLGKAFS | 92.54 | STLGKAFL | 7.46 | | | | |
| E | 696 | 0.38 | 2 | 2 | 0 | Y | TLGKAFST | 92.54 | TLGKAFLT | 7.46 | | | | |
| E | 697 | 0.38 | 2 | 2 | 0 | Y | LGKAFSTT | 92.54 | LGKAFLTT | 7.46 | | | | |
| E | 698 | 0.38 | 2 | 2 | 0 | Y | GKAFSTTL | 92.54 | GKAFLTTL | 7.46 | | | | |
| E | 699 | 0.38 | 2 | 2 | 0 | Y | KAFSTTLK | 92.54 | KAFLTTLK | 7.46 | | | | |
| E | 700 | 0.38 | 2 | 2 | 0 | Y | AFSTTLKG | 92.54 | AFLTTLKG | 7.46 | | | | |
| E | 701 | 0.38 | 2 | 2 | 0 | Y | FSTTLKGA | 92.54 | FLTTLKGA | 7.46 | | | | |
| E | 702 | 0.38 | 2 | 2 | 0 | Y | STTLKGAQ | 92.54 | LTTLKGAQ | 7.46 | | | | |
| E | 703 | 0 | 1 | 1 | 0 | Y | TTLKGAQR | 100 | | | | | | |
| E | 704 | 0 | 1 | 1 | 0 | Y | TLKGAQRL | 100 | | | | | | |
| E | 705 | 0.19 | 2 | 2 | 0 | Y | LKGAQRLA | 97.01 | LKGAQRLV | 2.99 | | | | |
| E | 706 | 0.19 | 2 | 2 | 0 | Y | KGAQRLAA | 97.01 | KGAQRLVA | 2.99 | | | | |
| E | 707 | 0.19 | 2 | 2 | 0 | Y | GAQRLAAL | 97.01 | GAQRLVAL | 2.99 | | | | |

FIG. 35-27

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 708 | 0.19 | 2 | 2 | 0 | Y | AQRLAALG | 97.01 | AQRLVALG | 2.99 | | | | |
| E | 709 | 0.19 | 2 | 2 | 0 | Y | QRLAALGD | 97.01 | QRLVALGD | 2.99 | | | | |
| E | 710 | 0.19 | 2 | 2 | 0 | Y | RLAALGDT | 97.01 | RLVALGDT | 2.99 | | | | |
| E | 711 | 0.19 | 2 | 2 | 0 | Y | LAALGDTA | 97.01 | LVALGDTA | 2.99 | | | | |
| E | 712 | 0.19 | 2 | 2 | 0 | Y | AALGDTAW | 97.01 | VALGDTAW | 2.99 | | | | |
| E | 713 | 0 | 1 | 1 | 0 | Y | ALGDTAWD | 100 | | | | | |

FIG. 35-28

Species: JEV (length of peptides: 8)

| protein | block starting position | block entropy | total peptides in block | # peptides required to cover 99% of block | gap/X fraction | 99% of block | covered w/ <= 5 peptides? | peptides required to cover 99% of block |

FIG. 35-29

Species: JEV (length of peptides: 8)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 758 | 0.11 | 2 | 2 | 0 | | Y | MGALLLWM | 98.51 | MGVLLLWM | 1.49 | | | | |
| E | 759 | 0.11 | 2 | 2 | 0 | | Y | GALLLWMG | 98.51 | GVLLLWMG | 1.49 | | | | |
| E | 760 | 0.44 | 3 | 3 | 0 | | Y | ALLLWMGV | 92.54 | ALLLWMGI | 5.97 | VLLLWMGI | 1.49 | | |
| E | 761 | 0.38 | 2 | 2 | 0 | | Y | LLLWMGVN | 92.54 | LLLWMGIN | 7.46 | | | | |
| E | 762 | 0.38 | 2 | 2 | 0 | | Y | LLWMGVNA | 92.54 | LLWMGINA | 7.46 | | | | |
| E | 763 | 0.38 | 2 | 2 | 0 | | Y | LWMGVNAR | 92.54 | LWMGINAR | 7.46 | | | | |
| E | 764 | 0.49 | 3 | 3 | 0 | | Y | WMGVNARD | 91.04 | WMGINARD | 7.46 | WMGVNARN | 1.49 | | |
| E | 765 | 0.49 | 3 | 3 | 0 | | Y | MGVNARDR | 91.04 | MGINARDR | 7.46 | MGVNARNR | 1.49 | | |
| E | 766 | 0.49 | 3 | 3 | 0 | | Y | GVNARDRS | 91.04 | GINARDRS | 7.46 | GVNARNRS | 1.49 | | |
| E | 767 | 0.49 | 3 | 3 | 0 | | Y | VNARDRSI | 91.04 | INARDRSI | 7.46 | VNARNRSI | 1.49 | | |
| E | 768 | 0.11 | 2 | 2 | 0 | | Y | NARDRSIA | 98.51 | NARNRSIA | 1.49 | | | | |
| E | 769 | 0.22 | 3 | 3 | 0 | | Y | ARDRSIAL | 97.01 | ARNRSIAL | 1.49 | ARDRSIAM | 1.49 | | |
| E | 770 | 0.22 | 3 | 3 | 0 | | Y | RDRSIALA | 97.01 | RDRSIAMA | 1.49 | RNRSIALA | 1.49 | | |
| E | 771 | 0.22 | 3 | 3 | 0 | | Y | DRSIALAF | 97.01 | DRSIAMAF | 1.49 | NRSIALAF | 1.49 | | |
| E | 772 | 0.11 | 2 | 2 | 0 | | Y | RSIALAFL | 98.51 | RSIAMAFL | 1.49 | | | | |
| E | 773 | 0.11 | 2 | 2 | 0 | | Y | SIALAFLA | 98.51 | SIAMAFLV | 1.49 | | | | |
| E | 774 | 0.11 | 2 | 2 | 0 | | Y | IALAFLAT | 98.51 | IAMAFLVT | 1.49 | | | | |
| E | 775 | 0.11 | 2 | 2 | 0 | | Y | ALAFLATG | 98.51 | AMAFLVTG | 1.49 | | | | |
| E | 776 | 0.11 | 2 | 2 | 0 | | Y | LAFLATGG | 98.51 | MAFLVTGG | 1.49 | | | | |
| E | 777 | 0.11 | 2 | 2 | 0 | | Y | AFLATGGV | 98.51 | AFLVTGGT | 1.49 | | | | |
| E | 778 | 0.11 | 2 | 2 | 0 | | Y | FLATGGVL | 98.51 | FLVTGGTL | 1.49 | | | | |
| E | 779 | 0.11 | 2 | 2 | 0 | | Y | LATGGVLV | 98.51 | LVTGGTLL | 1.49 | | | | |
| E | 780 | 0.11 | 2 | 2 | 0 | | Y | ATGGVLVF | 98.51 | VTGGTLLF | 1.49 | | | | |
| E | 781 | 0.11 | 2 | 2 | 0 | | Y | TGGVLVFL | 98.51 | TGGTLLFL | 1.49 | | | | |
| E | 782 | 0.11 | 2 | 2 | 0 | | Y | GGVLVFLA | 98.51 | GGTLLFLA | 1.49 | | | | |

FIG. 35-30

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 783 | 0.11 | 2 | 2 | 0 | Y | GVLVFLAT | 98.51 | GTLLFLAT | 1.49 | | | | |
| E | 784 | 0.11 | 2 | 2 | 0 | Y | VLVFLATN | 98.51 | TLLFLATN | 1.49 | | | | |
| E | 785 | 0.11 | 2 | 2 | 0 | Y | LVFLATNV | 98.51 | LLFLATNV | 1.49 | | | | |
| E | 786 | 0.11 | 2 | 2 | 0 | Y | VFLATNVH | 98.51 | LFLATNVH | 1.49 | | | | |
| E | 787 | 0 | 1 | 1 | 0 | Y | FLATNVHA | 100 | | | | | | |
| E | 788 | 0 | 1 | 1 | 0 | Y | LATNVHAD | 100 | | | | | | |
| E | 789 | 0 | 1 | 1 | 0 | Y | ATNVHADT | 100 | | | | | | |
| E | 790 | 0 | 1 | 1 | 0 | Y | TNVHADTG | 100 | | | | | | |
| E | 791 | 0.11 | 2 | 2 | 0 | Y | NVHADTGC | 98.51 | NVHADTGS | 1.49 | | | | |
| E | 792 | 0.11 | 2 | 2 | 0 | Y | VHADTGCA | 98.51 | VHADTGSA | 1.49 | | | | |
| E | 793 | 0.11 | 2 | 2 | 0 | Y | HADTGCAI | 98.51 | HADTGSAI | 1.49 | | | | |
| E | 794 | 0.11 | 2 | 2 | 0 | Y | ADTGCAID | 98.51 | ADTGSAID | 1.49 | | | | |
| NS1 | 795 | 0.42 | 4 | 4 | 0 | Y | DTGCAIDT | 94.03 | DTGCAIDT | 2.99 | DTGCAIDV | 1.49 | DTGCAIDI | 1.49 | |
| NS1 | 796 | 0.68 | 5 | 5 | 0 | Y | TGCAIDTT | 89.55 | TGCAIDIT | 4.48 | TGCAIDTT | 2.99 | TGSAIDIT | 1.49 | TGCAIDVT | 1.49 |
| NS1 | 797 | 0.68 | 5 | 5 | 0 | Y | GCAIDTTR | 89.55 | GCAIDIAR | 4.48 | GCAIDTTR | 2.99 | GCAIDVTR | 1.49 | GSAIDITR | 1.49 |
| NS1 | 803 | 0.7 | 4 | 4 | 0 | Y | TRKEMRCG | 88.06 | TRREMRCG | 5.97 | ARKEMRCG | 4.48 | TRNQMRCG | | |
| NS1 | 804 | 0.44 | 3 | 3 | 0 | Y | RKEMRCGS | 92.54 | RREMRCGS | 5.97 | RNQMRCG | 1.49 | | | |
| NS1 | 805 | 0.44 | 3 | 3 | 0 | Y | KEMRCGSG | 92.54 | REMRCGSG | 5.97 | NQMRCGSG | 1.49 | | | |
| NS1 | 806 | 0.11 | 2 | 2 | 0 | Y | EMRCGSGI | 98.51 | QMRCGSGI | 1.49 | | | | |
| NS1 | 807 | 0 | 1 | 1 | 0 | Y | MRCGSGIF | 100 | | | | | | |
| NS1 | 808 | 0 | 1 | 1 | 0 | Y | RCGSGIFY | 100 | | | | | | |
| NS1 | 809 | 0 | 1 | 1 | 0 | Y | CGSGIFYH | 100 | | | | | | |
| NS1 | 810 | 0 | 1 | 1 | 0 | Y | GSGIFYHN | 100 | | | | | | |
| NS1 | 811 | 0 | 1 | 1 | 0 | Y | SGIFYHND | 100 | | | | | | |
| NS1 | 812 | 0 | 1 | 1 | 0 | Y | GIFYHNDY | 100 | | | | | | |

FIG. 35-31

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 35-32

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 838 | 0.9 | 4 | 4 | 0 | Y | KIVHKAHK | 80.6 | KIVHKAHQ | 14.93 | KIVHKAHM | 2.99 | | | | |
| NS1 | 839 | 0.9 | 4 | 4 | 0 | Y | IVHKAHKE | 80.6 | IVHKAHQE | 14.93 | IVHKAHME | 2.99 | | | | |
| NS1 | 840 | 0.9 | 4 | 4 | 0 | Y | VHKAHKEG | 80.6 | VHKAHQEG | 14.93 | VHKAHMEG | 2.99 | | | | |
| NS1 | 841 | 0.93 | 5 | 5 | 0 | Y | HKAHKEGV | 80.6 | HKAHQEGV | 14.93 | HKAYKEG | 1.49 | HKAHMEGI | 1.49 | HKAHMEGV | 1.49 |
| NS1 | 842 | 0.93 | 5 | 5 | 0 | Y | KAHKEGVC | 80.6 | KAHQEGVC | 14.93 | KAYKEGVC | 1.49 | KAHMEGIC | 1.49 | KAHMEGIC | 1.49 |
| NS1 | 843 | 0.93 | 5 | 5 | 0 | Y | AHKEGVCG | 80.6 | AHQEGVCG | 14.93 | AHMEGVCG | 1.49 | AHMEGVC | 1.49 | AYKEGVCG | 1.49 |
| NS1 | 844 | 0.93 | 5 | 5 | 0 | Y | HKEGVCGV | 80.6 | HQEGVCGV | 14.93 | HMEGVCGV | 1.49 | HMEGVCG | 1.49 | YKEGVCGI | 1.49 |
| NS1 | 845 | 0.93 | 5 | 5 | 0 | Y | KEGVCGVR | 80.6 | QEGVCGVR | 14.93 | MEGICCGV | 1.49 | KEGVCGIR | 1.49 | MEGVCGVR | 1.49 |
| NS1 | 846 | 0.22 | 3 | 3 | 0 | Y | EGVCGVRS | 97.01 | EGVCGIRS | 1.49 | EGICGVRS | 1.49 | | | | |
| NS1 | 847 | 0.22 | 3 | 3 | 0 | Y | GVCGVRSV | 97.01 | GVCGIRSV | 1.49 | GICGVRSV | 1.49 | | | | |
| NS1 | 848 | 0.22 | 3 | 3 | 0 | Y | VCGVRSVT | 97.01 | ICGVRSVT | 1.49 | VCGIRSVT | 1.49 | | | | |
| NS1 | 849 | 0.11 | 2 | 2 | 0 | Y | CGVRSVTR | 98.51 | CGIRSVTR | 1.49 | | | | | | |
| NS1 | 850 | 0.11 | 2 | 2 | 0 | Y | GVRSVTRL | 98.51 | GIRSVTRL | 1.49 | | | | | | |
| NS1 | 851 | 0.11 | 2 | 2 | 0 | Y | VRSVTRLE | 98.51 | IRSVTRLE | 1.49 | | | | | | |
| NS1 | 852 | 0 | 1 | 1 | 0 | Y | RSVTRLEH | 100 | | | | | | | | |
| NS1 | 853 | 0 | 1 | 1 | 0 | Y | SVTRLEHQ | 100 | | | | | | | | |
| NS1 | 854 | 0 | 1 | 1 | 0 | Y | VTRLEHQM | 100 | | | | | | | | |
| NS1 | 855 | 0 | 1 | 1 | 0 | Y | TRLEHQMW | 100 | | | | | | | | |
| NS1 | 856 | 0 | 1 | 1 | 0 | Y | RLEHQMWE | 100 | | | | | | | | |
| NS1 | 857 | 0.68 | 2 | 2 | 0 | Y | LEHQMWEA | 82.09 | LEHQMWES | 17.91 | | | | | | |
| NS1 | 858 | 0.68 | 2 | 2 | 0 | Y | EHQMWEAV | 82.09 | EHQMWESV | 17.91 | | | | | | |
| NS1 | 859 | 0.68 | 2 | 2 | 0 | Y | HQMWEAVR | 82.09 | HQMWESVR | 17.91 | | | | | | |
| NS1 | 860 | 0.68 | 2 | 2 | 0 | Y | QMWEAVRD | 82.09 | QMWESVRD | 17.91 | | | | | | |
| NS1 | 861 | 0.68 | 2 | 2 | 0 | Y | MWEAVRDE | 82.09 | MWESVRDE | 17.91 | | | | | | |
| NS1 | 862 | 0.68 | 2 | 2 | 0 | Y | WEAVRDEL | 82.09 | WESVRDEL | 17.91 | | | | | | |

FIG. 35-33

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS1 | 863 | 0.68 | 2 | 2 | 0 | Y | EAVRDELN | 82.09 | ESVRDELN | 17.91 |
| NS1 | 864 | 0.68 | 2 | 2 | 0 | Y | AVRDELNV | 82.09 | SVRDELNV | 17.91 |
| NS1 | 865 | 0.11 | 2 | 2 | 0 | Y | VRDELNVL | 98.51 | VRDELNVP | 1.49 |
| NS1 | 866 | 0.11 | 2 | 2 | 0 | Y | RDELNVLL | 98.51 | RDELNVPL | 1.49 |
| NS1 | 867 | 0.11 | 2 | 2 | 0 | Y | DELNVLLK | 98.51 | DELNVPLK | 1.49 |
| NS1 | 868 | 0.11 | 2 | 2 | 0 | Y | ELNVLLKE | 98.51 | ELNVPLKE | 1.49 |
| NS1 | 869 | 0.11 | 2 | 2 | 0 | Y | LNVLLKEN | 98.51 | LNVPLKEN | 1.49 |
| NS1 | 870 | 0.11 | 2 | 2 | 0 | Y | NVLLKENA | 98.51 | NVPLKENA | 1.49 |
| NS1 | 871 | 0.11 | 2 | 2 | 0 | Y | VLLKENAV | 98.51 | VPLKENAV | 1.49 |
| NS1 | 872 | 0.11 | 2 | 2 | 0 | Y | LLKENAVD | 98.51 | PLKENAVD | 1.49 |
| NS1 | 873 | 0 | 1 | 1 | 0 | Y | LKENAVDL | 100 | | |
| NS1 | 874 | 0 | 1 | 1 | 1.49 | Y | KENAVDLS | 98.51 | | |
| NS1 | 875 | 0 | 1 | 1 | 1.49 | Y | ENAVDLSV | 98.51 | | |
| NS1 | 876 | 0 | 1 | 1 | 1.49 | Y | NAVDLSVV | 98.51 | | |
| NS1 | 877 | 0 | 1 | 1 | 1.49 | Y | AVDLSVVV | 98.51 | | |
| NS1 | 878 | 0 | 1 | 1 | 1.49 | Y | VDLSVVVN | 98.51 | | |
| NS1 | 879 | 0 | 1 | 1 | 1.49 | Y | DLSVVVNK | 98.51 | | |
| NS1 | 880 | 0 | 1 | 1 | 0 | Y | LSVVVNKP | 98.51 | | |
| NS1 | 881 | 0 | 1 | 1 | 0 | Y | SVVVNKPV | 98.51 | | |
| NS1 | 882 | 0 | 1 | 1 | 0 | Y | VVVNKPVG | 100 | | |
| NS1 | 883 | 0 | 1 | 1 | 0 | Y | VVNKPVGR | 100 | | |
| NS1 | 884 | 0 | 1 | 1 | 0 | Y | VNKPVGRY | 100 | | |
| NS1 | 885 | 0 | 1 | 1 | 0 | Y | NKPVGRYR | 100 | | |
| NS1 | 886 | 0 | 1 | 1 | 0 | Y | KPVGRYRS | 100 | | |
| NS1 | 887 | 0.11 | 2 | 2 | 0 | Y | PVGRYRSA | 98.51 | PVGRYRST | 1.49 |

FIG. 35-34

Species: JEV (length of peptides: 8)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required

FIG. 35-35

Species: JEV (length of peptides: 8)

| protein | block starting position | block entropy | total peptides in block | # peptides required to cover 99% of block | gap/X fraction | 99% of block covered w/ <=5 peptides? | peptides required to cover 99% of block | frequency |

FIG. 35-36

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 938 | 0.86 | 4 | 4 | 0 | Y | PDEHRAWN | 80.6 | PDERRAWN | 16.42 | PDEQRAWN | 1.49 | PVHRAWN | 1.49 |
| NS1 | 939 | 0.86 | 4 | 4 | 0 | Y | DEHRAWNS | 80.6 | DERRAWNS | 16.42 | VVHRAWNS | 1.49 | DEQRAWNS | 1.49 |
| NS1 | 940 | 0.93 | 5 | 5 | 0 | Y | EHRAWNSM | 80.6 | ERRAWNSM | 14.93 | EQRAWNSM | 1.49 | VHRAWNSM | 1.49 |
| NS1 | 941 | 0.82 | 4 | 4 | 0 | Y | HRAWNSMQ | 82.09 | RRAWNSMQ | 14.93 | QRAWNSMQ | 1.49 | RRAWNSTQ | 1.49 |
| NS1 | 942 | 0.11 | 2 | 2 | 0 | Y | RAWNSMQI | 98.51 | RAWNSTQI | 1.49 | | | | |
| NS1 | 943 | 0.11 | 2 | 2 | 0 | Y | AWNSMQIE | 98.51 | AWNSTQIE | 1.49 | | | | |
| NS1 | 944 | 0.11 | 2 | 2 | 0 | Y | WNSMQIED | 98.51 | WNSTQIED | 1.49 | | | | |
| NS1 | 945 | 0.11 | 2 | 2 | 0 | Y | NSMQIEDF | 98.51 | NSTQIEDF | 1.49 | | | | |
| NS1 | 946 | 0.11 | 2 | 2 | 0 | Y | SMQIEDFG | 98.51 | STQIEDFG | 1.49 | | | | |
| NS1 | 947 | 0.11 | 2 | 2 | 0 | Y | MQIEDFGF | 98.51 | TQIEDFGF | 1.49 | | | | |
| NS1 | 948 | 0 | 1 | 1 | 0 | Y | QIEDFGFG | 100 | | | | | | |
| NS1 | 949 | 0 | 1 | 1 | 0 | Y | IEDFGFGI | 100 | | | | | | |
| NS1 | 950 | 0 | 1 | 1 | 0 | Y | EDFGFGIT | 100 | | | | | | |
| NS1 | 951 | 0 | 1 | 1 | 0 | Y | DFGFGITS | 100 | | | | | | |
| NS1 | 952 | 0 | 1 | 1 | 0 | Y | FGFGITST | 100 | | | | | | |
| NS1 | 953 | 0 | 1 | 1 | 0 | Y | GFGITSTR | 100 | | | | | | |
| NS1 | 954 | 0 | 1 | 1 | 0 | Y | FGITSTRV | 100 | | | | | | |
| NS1 | 955 | 0 | 1 | 1 | 0 | Y | GITSTRVW | 100 | | | | | | |
| NS1 | 956 | 0 | 1 | 1 | 0 | Y | ITSTRVWL | 100 | | | | | | |
| NS1 | 957 | 0 | 1 | 1 | 0 | Y | TSTRVWLK | 100 | | | | | | |
| NS1 | 958 | 0 | 1 | 1 | 0 | Y | STRVWLKI | 100 | | | | | | |
| NS1 | 959 | 0 | 1 | 1 | 0 | Y | TRVWLKIR | 100 | | | | | | |
| NS1 | 960 | 0 | 1 | 1 | 0 | Y | RVWLKIRE | 100 | | | | | | |
| NS1 | 961 | 0 | 1 | 1 | 0 | Y | VWLKIREE | 100 | | | | | | |
| NS1 | 962 | 0.79 | 3 | 3 | 0 | Y | WLKIREES | 80.6 | WLKIREEN | 17.91 | WLKIREET | 1.49 | | |

FIG. 35-37

Species: JEV (length of peptides: 8)

| protein | block starting position | block entropy | total peptides in block | # peptides required to cover 99% of block | gap/X fraction | 99% of block | covered w/ > = 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS1 | 963 | 0.79 | 3 | 3 | 0 | Y | Y | LKIREEST | 80.6 | LKIREENT | 17.91 | LKIREETT | 1.49 | | | | |
| NS1 | 964 | 0.79 | 3 | 3 | 0 | Y | Y | KIREESTD | 80.6 | KIREENTD | 17.91 | KIREETTD | 1.49 | | | | |
| NS1 | 965 | 0.79 | 3 | 3 | 0 | Y | Y | IREESTDE | 80.6 | IREENTDE | 17.91 | IREETTDE | 1.49 | | | | |
| NS1 | 966 | 0.79 | 3 | 3 | 0 | Y | Y | REESTDEC | 80.6 | REENTDEC | 17.91 | REETTDEC | 1.49 | | | | |
| NS1 | 967 | 0.79 | 3 | 3 | 0 | Y | Y | EESTDECD | 80.6 | EENTDECD | 17.91 | EETTDECD | 1.49 | | | | |
| NS1 | 968 | 0.79 | 3 | 3 | 0 | Y | Y | ESTDECDG | 80.6 | ENTDECDG | 17.91 | ETTDECDG | 1.49 | | | | |
| NS1 | 969 | 1.04 | 5 | 5 | 0 | Y | Y | STDECDGA | 77.61 | NTDECDGA | 16.42 | STDECDGP | 2.99 | TTDECDGA | 1.49 | NTDECDGT | 1.49 |
| NS1 | 970 | 0.3 | 3 | 3 | 0 | Y | Y | TDECDGAI | 95.52 | TDECDGPI | 2.99 | TDECDGTI | 1.49 | | | | |
| NS1 | 971 | 0.3 | 3 | 3 | 0 | Y | Y | DECDGAII | 95.52 | DECDGPII | 2.99 | DECDGTII | 1.49 | | | | |
| NS1 | 972 | 0.3 | 3 | 3 | 0 | Y | Y | ECDGAIIG | 95.52 | ECDGPIIG | 2.99 | ECDGTIIG | 1.49 | | | | |
| NS1 | 973 | 0.3 | 3 | 3 | 0 | Y | Y | CDGAIIGT | 95.52 | CDGPIIGT | 2.99 | CDGTIIGT | 1.49 | | | | |
| NS1 | 974 | 0.3 | 3 | 3 | 0 | Y | Y | DGAIIGTA | 95.52 | DGPIIGTA | 2.99 | DGT

FIG. 35-38

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block

FIG. 35-39

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1018 | 0.19 | 2 | 2 | 0 | Y | TWPETHTL | 97.01 | TWPETHSL | 2.99 | | | | |
| NS1 | 1019 | 0.19 | 2 | 2 | 0 | Y | WPETHTLW | 97.01 | WPETHSLW | 2.99 | | | | |
| NS1 | 1020 | 0.19 | 2 | 2 | 0 | Y | PETHTLWG | 97.01 | PETHSLWG | 2.99 | | | | |
| NS1 | 1021 | 0.19 | 2 | 2 | 0 | Y | ETHTLWGD | 97.01 | ETHSLWGD | 2.99 | | | | |
| NS1 | 1022 | 0.72 | 3 | 3 | 0 | Y | THTLWGDG | 85.07 | THTLWGDD | 11.94 | THSLWGDG | 2.99 | | |
| NS1 | 1023 | 0.78 | 4 | 4 | 0 | Y | HTLWGDGV | 85.07 | HTLWGDDV | 10.45 | HSLWGDGV | 2.99 | HTLWGDDA | 1.49 |
| NS1 | 1024 | 0.78 | 4 | 3 | 0 | Y | TLWGDGVE | 85.07 | TLWGDDVE | 10.45 | SLWGDGVE | 2.99 | TLWGDDAE | 1.49 |
| NS1 | 1025 | 0.59 | 3 | 3 | 0 | Y | LWGDGVEE | 88.06 | LWGDDVEE | 10.45 | LWGDDAEE | 1.49 | | |
| NS1 | 1026 | 0.59 | 3 | 3 | 0 | Y | WGDDVEES | 88.06 | WGDDVEES | 10.45 | WGDDAEES | 1.49 | | |
| NS1 | 1027 | 0.7 | 4 | 4 | 0 | Y | GDDVEESE | 86.57 | GDDVEESD | 10.45 | GDDVEESE | 1.49 | GDDAEESE | 1.49 |
| NS1 | 1028 | 0.7 | 4 | 4 | 0 | Y | DGVEESEL | 86.57 | DDVEESEL | 10.45 | DDAEESEL | 1.49 | DGVEESDL | 1.49 |
| NS1 | 1029 | 0.7 | 4 | 4 | 0 | Y | GVEESELI | 86.57 | DVEESELI | 10.45 | DAEESELI | 1.49 | GVEESDLV | 1.49 |
| NS1 | 1030 | 0.22 | 3 | 2 | 0 | Y | VEESELII | 97.01 | VEESDLVI | 1.49 | AEESELII | 1.49 | | |
| NS1 | 1031 | 0.11 | 2 | 2 | 0 | Y | EESELIIP | 98.51 | EESDLVIP | 1.49 | | | | |
| NS1 | 1032 | 0.22 | 3 | 3 | 0 | Y | ESELIIPH | 97.01 | ESDLVIPH | 1.49 | ESELIIPD | 1.49 | DLVIPHTI | 1.49 |
| NS1 | 1033 | 0.22 | 3 | 3 | 0 | Y | SELIIPHT | 97.01 | SDLVIPHT | 1.49 | SELIIPDT | 1.49 | LVIPHTIA | 1.49 |
| NS1 | 1034 | 0.49 | 4 | 4 | 0 | Y | ELIIPHTI | 92.54 | ELIIPHTL | 4.48 | ELIIPDTI | 1.49 | VIPHTIAG | 1.49 |
| NS1 | 1035 | 0.49 | 4 | 4 | 0 | Y | LIIPHTIA | 92.54 | LIIPHTLA | 4.48 | LIIPDTIA | 1.49 | | |
| NS1 | 1036 | 0.49 | 4 | 4 | 0 | Y | IIPHTIAG | 92.54 | IIPHTLAG | 4.48 | IIPDTIAG | 1.49 | | |
| NS1 | 1037 | 0.37 | 3 | 3 | 0 | Y | IPHTIAGP | 94.03 | IPHTLAGP | 4.48 | IPDTIAGP | 1.49 | | |
| NS1 | 1038 | 1.04 | 4 | 4 | 0 | Y | PHTIAGPK | 76.12 | PHTIAGPR | 17.91 | PHTLAGPK | 4.48 | PDTIAGPK | 1.49 |
| NS1 | 1039 | 1.04 | 4 | 4 | 0 | Y | HTIAGPKS | 76.12 | HTIAGPRS | 17.91 | HTLAGPKS | 4.48 | DTIAGPKS | 1.49 |
| NS1 | 1040 | 0.93 | 3 | 3 | 0 | Y | TIAGPKSK | 77.61 | TIAGPRSK | 17.91 | TLAGPKSK | 4.48 | | |
| NS1 | 1041 | 0.93 | 3 | 3 | 0 | Y | IAGPKSKH | 77.61 | IAGPRSKH | 17.91 | LAGPKSKH | 4.48 | | |
| NS1 | 1042 | 0.68 | 2 | 2 | 0 | Y | AGPKSKHN | 82.09 | AGPRSKHN | 17.91 | | | | |

FIG. 35-40

Species: JEV (length of peptides: 8)

| protein | block starting position | block entropy | total peptides in block | # peptides required to cover 99% of block | gap/X fraction 99% of block | covered w/ <= 5

FIG. 35-41

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 35-42

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1093 | 0.11 | 2 | 2 | 0 | Y | RTTDSGK | 98.51 | RTTDIGK | 1.49 | | | | |
| NS1 | 1094 | 0.11 | 2 | 2 | 0 | Y | TTDSGKL | 98.51 | TTDIGKL | 1.49 | | | | |
| NS1 | 1095 | 0.11 | 2 | 2 | 0 | Y | TDSGKLI | 98.51 | TDIGKLI | 1.49 | | | | |
| NS1 | 1096 | 0.11 | 2 | 2 | 0 | Y | DSGKLIT | 98.51 | TDIGKLIT | 1.49 | | | | |
| NS1 | 1097 | 0.11 | 2 | 2 | 0 | Y | SGKLITDW | 98.51 | DIGKLITD | 1.49 | | | | |
| NS1 | 1098 | 0.11 | 2 | 2 | 0 | Y | GKLITDWC | 98.51 | IGKLITDW | 1.49 | | | | |
| NS1 | 1099 | 0 | 1 | 1 | 0 | Y | KLITDWCC | 100 | | | | | | |
| NS1 | 1100 | 0 | 1 | 1 | 0 | Y | LITDWCC | 100 | | | | | | |
| NS1 | 1101 | 0 | 1 | 1 | 0 | Y | ITDWCCR | 100 | | | | | | |
| NS1 | 1102 | 0.11 | 2 | 2 | 0 | Y | TDWCCRS | 98.51 | ITDWCCRN | 1.49 | | | | |
| NS1 | 1103 | 0.11 | 2 | 2 | 0 | Y | DWCCRSC | 98.51 | TDWCCRNC | 1.49 | | | | |
| NS1 | 1104 | 0.22 | 3 | 3 | 0 | Y | DWCCRSCS | 97.01 | DWCCRNCS | 1.49 | DWCCRSCT | 1.49 | | |
| NS1 | 1105 | 0.22 | 3 | 3 | 0 | Y | WCCRSCSL | 97.01 | WCCRSCTL | 1.49 | WCCRNCSL | 1.49 | | |
| NS1 | 1106 | 0.22 | 3 | 3 | 0 | Y | CCRSCSLP | 97.01 | CCRNCSLP | 1.49 | CCRSCTLP | 1.49 | | |
| NS1 | 1107 | 0.22 | 3 | 3 | 0 | Y | CRSCSLPP | 97.01 | CRSCTLPP | 1.49 | CRNCSLPP | 1.49 | | |
| NS1 | 1108 | 0.22 | 3 | 3 | 0 | Y | RSCSLPPL | 97.01 | RNCSLPPL | 1.49 | RSCTLPPL | 1.49 | | |
| NS1 | 1109 | 0.49 | 4 | 4 | 0 | Y | SCSLPPLR | 92.54 | SCSLPPLG | 4.48 | NCSLPPLR | 1.49 | SCTLPPLR | 1.49 |
| NS1 | 1110 | 0.37 | 3 | 3 | 0 | Y | CSLPPLRF | 94.03 | CSLPPLGF | 4.48 | CTLPPLRF | 1.49 | | |
| NS1 | 1111 | 0.37 | 3 | 3 | 0 | Y | SLPPLRFR | 94.03 | SLPPLGFR | 4.48 | TLPPLRFR | 1.49 | | |
| NS1 | 1112 | 0.26 | 2 | 2 | 0 | Y | LPPLRFRT | 95.52 | LPPLGFRT | 4.48 | | | | |
| NS1 | 1113 | 0.49 | 4 | 4 | 0 | Y | PPLRFRTE | 92.54 | PPLGFRTE | 4.48 | PPLRFRTG | 4.48 | PPLRFRTD | 1.49 |
| NS1 | 1114 | 0.49 | 4 | 4 | 0 | Y | PLRFRTEN | 92.54 | PLGFRTEN | 4.48 | PLRFRTGS | 4.48 | PLRFRTDN | 1.49 |
| NS1 | 1115 | 0.49 | 4 | 4 | 0 | Y | LRFRTENG | 92.54 | LGFRTENG | 4.48 | LRFRTGSG | 4.48 | LRFRTDNG | 1.49 |
| NS1 | 1116 | 0.49 | 4 | 4 | 0 | Y | RFRTENGC | 92.54 | GFRTENGC | 4.48 | RFRTGSGC | 4.48 | RFRTDNGC | 1.49 |
| NS1 | 1117 | 0.22 | 3 | 3 | 0 | Y | FRTENGCW | 97.01 | FRTGSGCW | 1.49 | FRTDNGCW | 1.49 | | |

FIG. 35-43

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block

FIG. 35-44

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS2A | 1158 | 0.19 | 2 | 2 | 0 | Y | GLLWMFLA | 97.01 | GLLWFLA | 2.99 | | |
| NS2A | 1159 | 0.19 | 2 | 2 | 0 | Y | LLWMFLAT | 97.01 | LLWFLAT | 2.99 | | |
| NS2A | 1160 | 0.19 | 2 | 2 | 0 | Y | LWMFLATQ | 97.01 | LVWFLATQ | 2.99 | | |
| NS2A | 1161 | 0.19 | 2 | 2 | 0 | Y | WMFLATQE | 97.01 | WFLATQE | 2.99 | | |
| NS2A | 1162 | 0.19 | 2 | 2 | 0 | Y | MFLATQEV | 97.01 | VFLATQEV | 2.99 | | |
| NS2A | 1163 | 0.11 | 2 | 2 | 0 | Y | FLATQEVL | 98.51 | FLATQEVF | 1.49 | | |
| NS2A | 1164 | 0.22 | 3 | 3 | 0 | Y | LATQEVLR | 97.01 | LATQEVLG | 1.49 | LATQEVFR | 1.49 |
| NS2A | 1165 | 0.22 | 3 | 3 | 0 | Y | ATQEVLRK | 97.01 | ATQEVLGK | 1.49 | ATQEVFRK | 1.49 |
| NS2A | 1166 | 0.22 | 3 | 3 | 0 | Y | TQEVLRKR | 97.01 | TQEVLGKR | 1.49 | TQEVFRKR | 1.49 |
| NS2A | 1167 | 0.22 | 3 | 3 | 0 | Y | QEVLRKRW | 97.01 | QEVLGKRW | 1.49 | QEVFRKRW | 1.49 |
| NS2A | 1168 | 0.22 | 3 | 3 | 0 | Y | EVLRKRWT | 97.01 | EVLGKRWT | 1.49 | EVFRKRWT | 1.49 |
| NS2A | 1169 | 0.22 | 3 | 3 | 0 | Y | VLRKRWTA | 97.01 | VFRKRWTA | 1.49 | VLGKRWTA | 1.49 |
| NS2A | 1170 | 0.22 | 3 | 3 | 0 | Y | LRKRWTAR | 97.01 | LGKRWTAR | 1.49 | FRKRWTAR | 1.49 |
| NS2A | 1171 | 0.11 | 2 | 2 | 0 | Y | RKRWTARL | 98.51 | GKRWTARL | 1.49 | | |
| NS2A | 1172 | 0 | 1 | 1 | 0 | Y | KRWTARLT | 100 | | | | |
| NS2A | 1173 | 0.19 | 2 | 2 | 0 | Y | RWTARLTI | 97.01 | RWTARLTV | 2.99 | | |
| NS2A | 1174 | 0.19 | 2 | 2 | 0 | Y | WTARLTIP | 97.01 | WTARLTVP | 2.99 | | |
| NS2A | 1175 | 0.19 | 2 | 2 | 0 | Y | TARLTIPA | 97.01 | TARLTVPA | 2.99 | | |
| NS2A | 1176 | 0.19 | 2 | 2 | 0 | Y | ARLTIPAV | 97.01 | ARLTVPAV | 2.99 | | |
| NS2A | 1177 | 0.19 | 2 | 2 | 0 | Y | RLTIPAVL | 97.01 | RLTVPAVL | 2.99 | | |
| NS2A | 1178 | 0.19 | 2 | 2 | 0 | Y | LTIPAVLG | 97.01 | LTVPAVLG | 2.99 | | |
| NS2A | 1179 | 0.52 | 3 | 3 | 0 | Y | TIPAVLGA | 91.04 | TIPAVLGV | 5.97 | TVPAVLGA | 2.99 |
| NS2A | 1180 | 0.52 | 3 | 3 | 0 | Y | IPAVLGAL | 91.04 | IPAVLGVL | 5.97 | VPAVLGAL | 2.99 |
| NS2A | 1181 | 0.33 | 2 | 2 | 0 | Y | PAVLGALL | 94.03 | PAVLGVLL | 5.97 | | |
| NS2A | 1182 | 0.33 | 2 | 2 | 0 | Y | AVLGALLV | 94.03 | AVLGVLLV | 5.97 | | |

FIG. 35-45

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1183 | 0.33 | 2 | 2 | 0 | Y | VLGALLVL | 94.03 | VLGVLLVL | 5.97 | | | | |
| NS2A | 1184 | 0.33 | 2 | 2 | 0 | Y | LGALLVLM | 94.03 | LGVLLVLM | 5.97 | | | | |
| NS2A | 1185 | 0.44 | 3 | 3 | 0 | Y | GALLVLML | 92.54 | GVLLVLML | 5.97 | GALLVLMF | 1.49 | | |
| NS2A | 1186 | 0.44 | 3 | 3 | 0 | Y | ALLVLMLG | 92.54 | VLLVLMLG | 5.97 | ALLVLMFG | 1.49 | | |
| NS2A | 1187 | 0.11 | 2 | 2 | 0 | Y | LLVLMLGG | 98.51 | LLVLMFGG | 1.49 | | | | |
| NS2A | 1188 | 0.11 | 2 | 2 | 0 | Y | LVLMLGGI | 98.51 | LVLMFGGI | 1.49 | | | | |
| NS2A | 1189 | 0.11 | 2 | 2 | 0 | Y | VLMLGGIT | 98.51 | VLMFGGIT | 1.49 | | | | |
| NS2A | 1190 | 0.11 | 2 | 2 | 0 | Y | LMLGGITY | 98.51 | LMFGGITY | 1.49 | | | | |
| NS2A | 1191 | 0.3 | 3 | 3 | 0 | Y | MLGGITYT | 95.52 | MLGGITYT | 2.99 | MFGGITYT | 1.49 | | |
| NS2A | 1192 | 0.3 | 3 | 3 | 0 | Y | LGGITYTD | 95.52 | LGGITYID | 2.99 | FGGITYTD | 1.49 | | |
| NS2A | 1193 | 0.19 | 2 | 2 | 0 | Y | GGITYTDL | 97.01 | GGITYIDL | 2.99 | | | | |
| NS2A | 1194 | 0.19 | 2 | 2 | 0 | Y | GITYTDLA | 97.01 | GITYIDLA | 2.99 | | | | |
| NS2A | 1195 | 0.19 | 2 | 2 | 0 | Y | ITYTDLAR | 97.01 | ITYIDLAR | 2.99 | | | | |
| NS2A | 1196 | 0.19 | 2 | 2 | 0 | Y | TYTDLARY | 97.01 | TYIDLARY | 2.99 | | | | |
| NS2A | 1197 | 0.19 | 2 | 2 | 0 | Y | YTDLARYV | 97.01 | YIDLARYV | 2.99 | | | | |
| NS2A | 1198 | 0.19 | 2 | 2 | 0 | Y | TDLARYVV | 97.01 | IDLARYVV | 2.99 | | | | |
| NS2A | 1199 | 0 | 1 | 1 | 0 | Y | DLARYVVL | 100 | | | | | | |
| NS2A | 1200 | 0 | 1 | 1 | 0 | Y | LARYVVLV | 100 | | | | | | |
| NS2A | 1201 | 0 | 1 | 1 | 0 | Y | ARYVVLVA | 100 | | | | | | |
| NS2A | 1202 | 0 | 1 | 1 | 0 | Y | RYVVLVAA | 100 | | | | | | |
| NS2A | 1203 | 0.22 | 3 | 3 | 0 | Y | YVVLVAAA | 97.01 | YVVLVAAV | 1.49 | YVVLVAAS | 1.49 | | |
| NS2A | 1204 | 0.22 | 3 | 3 | 0 | Y | VVLVAAAF | 97.01 | VVLVAASF | 1.49 | VVLVAAVF | 1.49 | | |
| NS2A | 1205 | 0.22 | 3 | 3 | 0 | Y | VLVAAAFA | 97.01 | VLVAAVFA | 1.49 | VLVAASFA | 1.49 | | |
| NS2A | 1206 | 0.22 | 3 | 3 | 0 | Y | LVAAAFAE | 97.01 | LVAASFAE | 1.49 | LVAAVFAE | 1.49 | | |
| NS2A | 1207 | 0.22 | 3 | 3 | 0 | Y | VAAAFAEA | 97.01 | VAAVFAEA | 1.49 | VAASFAEA | 1.49 | | |

FIG. 35-46

Species: JEV (length of peptides: 8)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to c

FIG. 35-47

Species: JEV (length of peptides: 8)

FIG. 35-48

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1260 | 0.68 | 3 | 3 | 0 | Y | FQLASVDL | 85.07 | FQLASADL | 13.43 | FQLASMDL | 1.49 | | |
| NS2A | 1261 | 0.68 | 3 | 3 | 0 | Y | QLASVD

FIG. 35-49

Species: JEV (length of peptides: 8)

|

FIG. 35-50

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1315 | 0.11 | 2 | 2 | 0 | Y | TYRIILLV

FIG. 35-51

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1344 | 0.33 | 2 | 2 | 0 | Y | LLGLALTS | 94.03 | LMGLALTS | 5.97 | | | | |
| NS2A | 1345 | 0.33 | 2 | 2 | 0 | Y | LGLALTST | 94.03 | MGLALTST | 5.97 | | | | |
| NS2A | 1346 | 0 | 1 | 1 | 0 | Y | GLALTSTG | 100 | | | | | | |
| NS2A | 1347 | 0 | 1 | 1 | 0 | Y | LALTSTGW | 100 | | | | | | |
| NS2A | 1348 | 0 | 1 | 1 | 0 | Y | ALTSTGWF | 100 | | | | | | |
| NS2A | 1349 | 0 | 1 | 1 | 0 | Y | LTSTGWFS | 100 | | | | | | |
| NS2A | 1350 | 0 | 1 | 1 | 0 | Y | TSTGWFSP | 100 | | | | | | |
| NS2A | 1351 | 0 | 1 | 1 | 0 | Y | STGWFSPT | 100 | | | | | | |
| NS2A | 1352 | 0 | 1 | 1 | 0 | Y | TGWFSPTT | 100 | | | | | | |
| NS2A | 1353 | 0 | 1 | 1 | 0 | Y | GWFSPTTI | 100 | | | | | | |
| NS2A | 1354 | 0.11 | 2 | 2 | 0 | Y | WFSPTTIA | 98.51 | WFSPTTIT | 1.49 | | | | |
| NS2A | 1355 | 0.11 | 2 | 2 | 0 | Y | FSPTTIAA | 98.51 | FSPTTITA | 1.49 | | | | |
| NS2A | 1356 | 0.11 | 2 | 2 | 0 | Y | SPTTIAAG | 98.51 | SPTTITAG | 1.49 | | | | |
| NS2A | 1357 | 0.11 | 2 | 2 | 0 | Y | PTTIAAGL | 98.51 | PTTITAGL | 1.49 | | | | |
| NS2A | 1358 | 0.11 | 2 | 2 | 0 | Y | TTIAAGLM | 98.51 | TTITAGLM | 1.49 | | | | |
| NS2A | 1359 | 0.22 | 3 | 3 | 0 | Y | TIAAGLMV | 97.01 | TIAAGLMA | 1.49 | TITAGLMV | 1.49 | | |
| NS2A | 1360 | 0.22 | 3 | 3 | 0 | Y | IAAGLMVC | 97.01 | IAAGLMAC | 1.49 | ITAGLMVC | 1.49 | | |
| NS2A | 1361 | 0.22 | 3 | 3 | 0 | Y | AAGLMVCN | 97.01 | TAGLMVCN | 1.49 | AAGLMACN | 1.49 | | |
| NS2A | 1362 | 0.11 | 2 | 2 | 0 | Y | AGLMVCNP | 98.51 | AGLMACNP | 1.49 | | | | |
| NS2A | 1363 | 0.11 | 2 | 2 | 0 | Y | GLMVCNPN | 98.51 | GLMACNPN | 1.49 | | | | |
| NS2A | 1364 | 0.11 | 2 | 2 | 0 | Y | LMVCNPNK | 98.51 | LMACNPNK | 1.49 | | | | |
| NS2A | 1365 | 0.11 | 2 | 2 | 0 | Y | MVCNPNKK | 98.51 | MACNPNKK | 1.49 | | | | |
| NS2A | 1366 | 0.11 | 2 | 2 | 0 | Y | VCNPNKKR | 98.51 | ACNPNKKR | 1.49 | | | | |
| NS2A | 1367 | 0 | 1 | 1 | 0 | Y | CNPNKKRG | 100 | | | | | | |
| NS2A | 1368 | 0 | 1 | 1 | 0 | Y | NPNKKRGW | 100 | | | | | | |

FIG. 35-52

Species: JEV (length of peptides: 8)

| protein | block starting position | block entropy | total peptides in block | # peptides required to cover 99% of block | gap/X fraction | 99% of block covered w

FIG. 35-53

Species: JEV (length of peptides: 8)

| protein | block starting position | block entropy | total peptides in block | # peptides required to cover 99% of block | gap/X fraction | 99% of block covered w/ <= 5 peptides? | peptides required

FIG. 35-54

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1419 | 0 | 1 | 1 | 0 | Y | SGKATDMW | 100 | | | | | | |
| NS2B | 1420 | 0 | 1 | 1 | 0 | Y | GKATDMWL | 100 | | | | | | |
| NS2B | 1421 | 0.68 | 2 | 2 | 0 | Y | KATDMWLE | 82.09 | KATDMWLD | 17.91 | | | | |
| NS2B | 1422 | 0.79 | 3 | 3 | 0 | Y | ATDMWLER | 80.6 | ATDMWLDR | 17.91 | ATDMWLEQ | 1.49 | | |
| NS2B | 1423 | 0.79 | 3 | 3 | 0 | Y | TDMWLERA | 80.6 | TDMWLDRA | 17.91 | TDMWLEQA | 1.49 | | |
| NS2B | 1424 | 0.79 | 3 | 3 | 0 | Y | DMWLERAA | 80.6 | DMWLDRAA | 17.91 | DMWLEQAA | 1.49 | | |
| NS2B | 1425 | 0.79 | 3 | 3 | 0 | Y | MWLERAAD | 80.6 | MWLDRAAD | 17.91 | MWLEQAAD | 1.49 | | |
| NS2B | 1426 | 0.89 | 4 | 4 | 0 | Y | WLERAADI | 79.1 | WLDRAADI | 17.91 | WLEQAADI | 1.49 | WLERAADV | 1.49 |
| NS2B | 1427 | 0.89 | 4 | 4 | 0 | Y | LERAADIS | 79.1 | LDRAADIS | 17.91 | LERAADYS | 1.49 | LEQAADIS | 1.49 |
| NS2B | 1428 | 0.89 | 4 | 4 | 0 | Y | ERAADISW | 79.1 | DRAADISW | 17.91 | ERAADYSW | 1.49 | EQAADISW | 1.49 |
| NS2B | 1429 | 0.53 | 4 | 4 | 0 | Y | RAADISWE | 92.54 | RAADISWD | 2.99 | QAADISWE | 1.49 | RAADYSWE | 1.49 |
| NS2B | 1430 | 0.42 | 4 | 5 | 0 | Y | AADISWEM | 94.03 | AADISWDM | 2.99 | AADISWGM | 1.49 | AADYSWEM | 1.49 |
| NS2B | 1434 | 1.08 | 5 | 4 | 0 | Y | SWEMDAAI | 76.12 | SWEMEAAI | 17.91 | SWDMGAAI | 2.99 | SWEMGAAI | 1.49 |
| NS2B | 1435 | 1.08 | 5 | 5 | 0 | Y | WEMDAAIT | 76.12 | WEMEAAIT | 17.91 | WDMGAAIT | 2.99 | WGMDAAIT | 1.49 |
| NS2B | 1436 | 1.08 | 5 | 5 | 0 | Y | EMDAAITG | 76.12 | EMEAAITG | 17.91 | DMGAAITG | 2.99 | EMGAAITG | 1.49 |
| NS2B | 1437 | 0.93 | 3 | 3 | 0 | Y | MDAAITGS | 77.61 | MEAAITGS | 17.91 | MGAAITGS | 4.48 | | |
| NS2B | 1438 | 0.93 | 3 | 3 | 0 | Y | DAAITGSS | 77.61 | EAAITGSS | 17.91 | GAAITGSS | 4.48 | | |
| NS2B | 1439 | 0 | 1 | 1 | 0 | Y | AAITGSSR | 100 | | | | | | |
| NS2B | 1440 | 0 | 1 | 1 | 0 | Y | AITGSSRR | 100 | | | | | | |
| NS2B | 1441 | 0 | 1 | 1 | 0 | Y | ITGSSRRL | 100 | | | | | | |
| NS2B | 1442 | 0 | 1 | 1 | 0 | Y | TGSSRRLD | 100 | | | | | | |
| NS2B | 1443 | 0 | 1 | 1 | 0 | Y | GSSRRLDV | 100 | | | | | | |
| NS2B | 1444 | 0 | 1 | 1 | 0 | Y | SSRRLDVK | 100 | | | | | | |
| NS2B | 1445 | 0 | 1 | 1 | 0 | Y | SRRLDVKL | 100 | | | | | | |
| NS2B | 1446 | 0 | 1 | 1 | 0 | Y | RRLDVKLD | 100 | | | | | | |

FIG. 35-56

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1472 | 1 | 5 | 5 | 0 | Y | VLRMSCIG | 77.61 | LLRMSCIG | 17.91 | VLRMSCIC | 1.49 | VLRMSCSG | 1.49 | VLRTSCIG | 1.49 |
| NS2B | 1473 | 0.33 | 4 | 4 | 0 | Y | LRMSCIGL | 95.52 | LRTSCIGL | 1.49 | LRMSCICL | 1.49 | LRMSCSGL | 1.49 | RTSCIGLA | 1.49 |
| NS2B | 1474 | 0.45 | 5 | 5 | 0 | Y | RMSCIGLA | 94.03 | RMSCICLA | 1.49 | RMSCIGLV | 1.49 | RMSCSGLA | 1.49 | MSCSGLAA | 1.49 |
| NS2B | 1475 | 0.45 | 5 | 5 | 0 | Y | MSCIGLAA | 94.03 | MSCICLAA | 1.49 | TSCIGLAA | 1.49 | MSCIGLVA | 1.49 | | |
| NS2B | 1476 | 0.33 | 4 | 4 | 0 | Y | SCIGLAAL | 95.52 | SCGLAAL | 1.49 | SCIGLVAL | 1.49 | SCICLAAL | 1.49 | | |
| NS2B | 1477 | 0.33 | 4 | 4 | 0 | Y | CIGLAALT | 95.52 | CSGLAALT | 1.49 | CICLAALT | 1.49 | CIGLVALT | 1.49 | | |
| NS2B | 1478 | 0.33 | 4 | 4 | 0 | Y | IGLAALTP | 95.52 | ICLAALTP | 1.49 | IGLVALTP | 1.49 | SGLAALTP | 1.49 | | |
| NS2B | 1479 | 0.22 | 3 | 3 | 0 | Y | GLAALTPW | 97.01 | CLAALTPW | 1.49 | GLVALTPW | 1.49 | | | | |
| NS2B | 1480 | 0.11 | 2 | 2 | 0 | Y | LAALTPWA | 98.51 | LVALTPWA | 1.49 | | | | | | |
| NS2B | 1481 | 0.11 | 2 | 2 | 0 | Y | AALTPWAI | 98.51 | VALTPWAI | 1.49 | | | | | | |
| NS2B | 1482 | 0 | 1 | 1 | 0 | Y | ALTPWAIV | 100 | | | | | | | | |
| NS2B | 1483 | 0 | 1 | 1 | 0 | Y | LTPWAIVP | 100 | | | | | | | | |
| NS2B | 1484 | 0 | 1 | 1 | 0 | Y | TPWAIVPA | 100 | | | | | | | | |
| NS2B | 1485 | 0 | 1 | 1 | 0 | Y | PWAIVPAA | 100 | | | | | | | | |
| NS2B | 1486 | 0 | 1 | 1 | 0 | Y | WAIVPAAF | 100 | | | | | | | | |
| NS2B | 1487 | 0 | 1 | 1 | 0 | Y | AIVPAAFG | 100 | | | | | | | | |
| NS2B | 1488 | 0 | 1 | 1 | 0 | Y | IVPAAFGY | 100 | | | | | | | | |
| NS2B | 1489 | 0 | 1 | 1 | 0 | Y | VPAAFGYW | 100 | | | | | | | | |
| NS2B | 1490 | 0 | 1 | 1 | 0 | Y | PAAFGYWL | 100 | | | | | | | | |
| NS2B | 1491 | 0 | 1 | 1 | 0 | Y | AAFGYWLT | 100 | | | | | | | | |
| NS2B | 1492 | 0 | 1 | 1 | 0 | Y | AFGYWLTL | 100 | | | | | | | | |
| NS2B | 1493 | 0 | 1 | 1 | 0 | Y | FGYWLTLK | 100 | | | | | | | | |
| NS2B | 1494 | 0 | 1 | 1 | 0 | Y | GYWLTLKT | 100 | | | | | | | | |
| NS2B | 1495 | 0 | 1 | 1 | 0 | Y | YWLTLKIT | 100 | | | | | | | | |
| NS2B | 1496 | 0 | 1 | 1 | 0 | Y | WLTLKITK | 100 | | | | | | | | |

FIG. 35-57

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1497 | 0 | 1 | 1 | 0 | Y | LTLKTTKR | 100 | | | | | | |
| NS2B | 1498 | 0 | 1 | 1 | 0 | Y | TLKTTKRG | 100 | | | | | | |
| NS2B | 1499 | 0 | 1 | 1 | 0 | Y | LKTTKRGG | 100 | | | | | | |
| NS2B | 1500 | 0 | 1 | 1 | 0 | Y | KTTKRGGV | 100 | | | | | | |
| NS2B | 1501 | 0 | 1 | 1 | 0 | Y | TTKRGGVF | 100 | | | | | | |
| NS2B | 1502 | 0 | 1 | 1 | 0 | Y | TKRGGVFW | 100 | | | | | | |
| NS2B | 1503 | 0 | 1 | 1 | 0 | Y | KRGGVFWD | 100 | | | | | | |
| NS2B | 1504 | 0 | 1 | 1 | 0 | Y | RGGVFWDT | 100 | | | | | | |
| NS3 | 1505 | 0 | 1 | 1 | 0 | Y | GGVFWDTP | 100 | | | | | | |
| NS3 | 1506 | 0 | 1 | 1 | 0 | Y | GVFWDTPS | 100 | | | | | | |
| NS3 | 1507 | 0 | 1 | 1 | 0 | Y | VFWDTPSP | 100 | | | | | | |
| NS3 | 1508 | 0 | 1 | 1 | 0 | Y | FWDTPSPK | 100 | | | | | | |
| NS3 | 1509 | 0 | 1 | 1 | 0 | Y | WDTPSPKP | 100 | | | | | | |
| NS3 | 1510 | 0 | 1 | 1 | 0 | Y | DTPSPKPC | 100 | | | | | | |
| NS3 | 1511 | 0.85 | 3 | 3 | 0 | Y | TPSPKPCS | 77.61 | TPSPKPCL | 20.9 | TPSPKPCA | 1.49 | | |
| NS3 | 1512 | 0.85 | 3 | 3 | 0 | Y | PSPKPCSK | 77.61 | PSPKPCLK | 20.9 | PSPKPCAK | 1.49 | | |
| NS3 | 1513 | 0.85 | 3 | 3 | 0 | Y | SPKPCSKG | 77.61 | SPKPCLKG | 20.9 | SPKPCAKG | 1.49 | | |
| NS3 | 1514 | 0.85 | 3 | 3 | 0 | Y | PKPCSKGD | 77.61 | PKPCLKGD | 20.9 | PKPCAKGD | 1.49 | | |
| NS3 | 1515 | 0.85 | 3 | 3 | 0 | Y | KPCSKGDT | 77.61 | KPCLKGDT | 20.9 | KPCAKGDT | 1.49 | | |
| NS3 | 1516 | 0.85 | 3 | 3 | 0 | Y | PCSKGDTT | 77.61 | PCLKGDTT | 20.9 | PCAKGDTT | 1.49 | | |
| NS3 | 1517 | 0.85 | 3 | 3 | 0 | Y | CSKGDTTT | 77.61 | CLKGDTTT | 20.9 | CAKGDTTT | 1.49 | | |
| NS3 | 1518 | 0.85 | 3 | 3 | 0 | Y | SKGDTTTG | 77.61 | LKGDTTTG | 20.9 | AKGDTTTG | 1.49 | | |
| NS3 | 1519 | 0 | 1 | 1 | 0 | Y | KGDTTTGV | 100 | | | | | | |
| NS3 | 1520 | 0 | 1 | 1 | 0 | Y | GDTTTGVY | 100 | | | | | | |
| NS3 | 1521 | 0 | 1 | 1 | 0 | Y | DTTTGVYR | 100 | | | | | | |

FIG. 35-58

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block |

FIG. 35-59

Species: JEV (length of peptides: 8)

| protein | block starting position | block entropy | total peptides in block | # peptides required to cover 99% of block | gap/X fraction | 99% of block covered w/ <= 5 pe

FIG. 35-60

Species: JEV (length of peptides: 8)

| protein | block starting position | block entropy | total peptides in block | # peptides required to cover 99% of block | gap/X fraction | 99% of block covered w/ <= 5 pe

FIG. 35-61

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 35-62

Species: JEV

FIG. 35-63

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequ

FIG. 35-64

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1682 | 1 | 5 | 5 | 0 | Y | AYTPNMLR | 77.61 | AYTPSMLK | 17.91 | AYTPTMLR | 1.49 | AYTPNMLK | 1.49 |
| NS3 | 1683 | 1 | 5 | 5 | 0 | Y | YTPNMLRK | 77.61 | YTPSMLKK | 17.91 | YTPTMLRK | 1.49 | YNPSMLKK | 1.49 |
| NS3 | 1685 | 1 | 5 | 5 | 0 | Y | PNMLKRRQ | 77.61 | PSMLKKRQ | 17.91 | PTMLRKRQ | 1.49 | PSMLKKKQ | 1.49 |
| NS3 | 1687 | 1.12 | 4 | 4 | 0 | Y | MLRKRQMT | 73.13 | MLKKRQMT | 19.4 | MLKKKQMT | 1.49 | | |
| NS3 | 1688 | 1.12 | 4 | 4 | 0 | Y | LRKRQMTV | 73.13 | LKKRQMTV | 19.4 | LKKKQMTV | 1.49 | | |
| NS3 | 1689 | 1.12 | 4 | 4 | 0 | Y | RKRQMTVL | 73.13 | RKRQLTVL | 19.4 | KKKQMTVL | 1.49 | | |
| NS3 | 1690 | 0.44 | 3 | 3 | 0 | Y | KRQMTVLD | 92.54 | KKRQMTVL | 5.97 | KKKQMTVL | 1.49 | | |
| NS3 | 1691 | 0.44 | 3 | 3 | 0 | Y | RQMTVLDL | 92.54 | KQMTVLDL | 5.97 | | | | |
| NS3 | 1692 | 0.44 | 3 | 3 | 0 | Y | QMTVLDLH | 92.54 | QMTVLDLP | 5.97 | | | | |
| NS3 | 1693 | 0.44 | 3 | 3 | 0 | Y | MTVLDLHP | 92.54 | MTVLDLPP | 5.97 | | | | |
| NS3 | 1694 | 0.11 | 2 | 2 | 0 | Y | TVLDLHPG | 98.51 | VLDLPPGS | 1.49 | | | | |
| NS3 | 1695 | 0.22 | 3 | 3 | 0 | Y | VLDLHPGS | 97.01 | LDLPPGSG | 1.49 | | | | |
| NS3 | 1696 | 0.22 | 3 | 3 | 0 | Y | LDLHPGSG | 97.01 | DLPPGSGK | 1.49 | | | | |
| NS3 | 1697 | 0.22 | 3 | 3 | 0 | Y | DLHPGSGK | 97.01 | LPPGSGKT | 1.49 | | | | |
| NS3 | 1698 | 0.22 | 3 | 3 | 0 | Y | LHPGSGKT | 97.01 | PGSGKTKR | 1.49 | HPGLGKTR | 1.49 | | |
| NS3 | 1699 | 0.42 | 4 | 4 | 0 | Y | HPGSGKTR | 94.03 | PGLGKTRK | 2.99 | | | | |
| NS3 | 1700 | 0.3 | 3 | 3 | 0 | Y | PGSGKTRK | 95.52 | GSGKTKKI | 2.99 | | | | |
| NS3 | 1701 | 0.3 | 3 | 3 | 0 | Y | GSGKTRKI | 95.52 | SGKTKKIL | 2.99 | | | | |
| NS3 | 1702 | 0.3 | 3 | 3 | 0 | Y | SGKTRKIL | 95.52 | GKTKKILP | 2.99 | | | | |
| NS3 | 1703 | 0.19 | 2 | 2 | 0 | Y | GKTRKILP | 97.01 | KTKILPQ | 2.99 | | | | |
| NS3 | 1704 | 0.19 | 2 | 2 | 0 | Y | KTRKILPQ | 97.01 | TKILPQ | 2.99 | | | | |
| NS3 | 1705 | 0.3 | 3 | 3 | 0 | Y | TRKILPQI | 95.52 | TRKILPQT | 1.49 | | | | |
| NS3 | 1706 | 0.3 | 3 | 3 | 0 | Y | RKILPQII | 95.52 | RKILPQII | 1.49 | | | | |
| NS3 | 1707 | 0.22 | 3 | 3 | 0 | Y | KILPQIIK | 97.01 | KILPQIIR | 1.49 | | | | |
| NS3 | 1708 | 0.22 | 3 | 3 | 0 | Y | ILPQIIKD | 97.01 | ILPQTIKD | 1.49 | | | | |

FIG. 35-65

Species: JEV (length of peptides: 8)

| protein | block starting position | block entropy | total peptides in block | # peptides required to cover 99% of block | gap/x fraction | 99% of block | covered w/ <= 5 peptides? | peptides required to cover 99% of block

FIG. 35-66

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block

FIG. 35-67

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 35-68

Species: JEV (length of peptides: 8)

FIG. 35-69

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|

FIG. 35-70

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1834 | 0.11 | 2 | 2 | 0 | Y | NAPIHDLQ | 98.51 | DAPIHDLQ | 1.49 | | | | |
| NS3 | 1835 | 0 | 1 | 1 | 0 | Y | APIHDLQD | 100 | | | | | | |
| NS3 | 1836 | 0.19 | 2 | 2 | 0 | Y | PIHDLQDE | 97.01 | PIHDLQDG | 2.99 | | | | |
| NS3 | 1837 | 0.23 | 3 | 3 | 2.99 | Y | IHDLQDEI | 94.03 | IHDLQDET | 1.49 | IHDLQDEV | 1.49 | | |
| NS3 | 1838 | 0.23 | 3 | 3 | 2.99 | Y | HDLQDEIP | 94.03 | HDLQDETP | 1.49 | HDLQDEVP | 1.49 | | |
| NS3 | 1839 | 0.23 | 3 | 3 | 2.99 | Y | DLQDEIPD | 94.03 | DLQDEVPD | 1.49 | DLQDEVPD | 1.49 | | |
| NS3 | 1840 | 0.34 | 4 | 4 | 2.99 | Y | LQDEIPDR | 92.54 | LQDEVPDW | 1.49 | LQDEVPDW | 1.49 | LQDETPDR | 1.49 |
| NS3 | 1841 | 0.34 | 4 | 4 | 2.99 | Y | QDEIPDRA | 92.54 | QDEVPDRA | 1.49 | QDEVPDRA | 1.49 | QDETPDRA | 1.49 |
| NS3 | 1842 | 0.34 | 4 | 4 | 2.99 | Y | DEIPDRAW | 92.54 | DEVPDRAW | 1.49 | DEIPDWAW | 1.49 | DETPDRAW | 1.49 |
| NS3 | 1843 | 0.34 | 4 | 4 | 2.99 | Y | EIPDRAWS | 92.54 | EVPDRAWS | 1.49 | EIPDWAWS | 1.49 | ETPDRAWS | 1.49 |
| NS3 | 1844 | 0.34 | 4 | 4 | 2.99 | Y | IPDRAWSS | 92.54 | IPDWAWSS | 1.49 | VPDRAWSS | 1.49 | TPDRAWSS | 1.49 |
| NS3 | 1845 | 0.11 | 2 | 2 | 2.99 | Y | PDRAWSSG | 95.52 | PDWAWSSG | 1.49 | | | | |
| NS3 | 1859 | 0.86 | 4 | 4 | 0 | Y | WITEYAGK | 80.6 | WITDYAGK | 16.42 | WSTEYAGK | 1.49 | WITEYSGK | 1.49 |
| NS3 | 1860 | 0.86 | 4 | 4 | 0 | Y | ITEYAGKT | 80.6 | ITDYAGKT | 16.42 | STEYAGKT | 1.49 | ITEYSGKT | 1.49 |
| NS3 | 1861 | 0.75 | 3 | 3 | 0 | Y | TEYAGKTV | 82.09 | TDYAGKTV | 16.42 | TEYSGKTV | 1.49 | | |
| NS3 | 1862 | 0.75 | 3 | 3 | 0 | Y | EYAGKTVW | 82.09 | DYAGKTVW | 16.42 | EYSGKTVW | 1.49 | | |
| NS3 | 1863 | 0.11 | 2 | 2 | 0 | Y | YAGKTVWF | 98.51 | YSGKTVWF | 1.49 | | | | |
| NS3 | 1864 | 0.11 | 2 | 2 | 0 | Y | AGKTVWFV | 98.51 | SGKTVWFV | 1.49 | | | | |
| NS3 | 1865 | 0 | 1 | 1 | 0 | Y | GKTVWFYA | 100 | | | | | | |
| NS3 | 1866 | 0 | 1 | 1 | 0 | Y | KTVWFYAS | 100 | | | | | | |
| NS3 | 1867 | 0 | 1 | 1 | 0 | Y | TVWFYASV | 100 | | | | | | |
| NS3 | 1868 | 0.19 | 2 | 2 | 0 | Y | VWFVASVK | 97.01 | VWFVASVR | 2.99 | | | | |
| NS3 | 1869 | 0.19 | 2 | 2 | 0 | Y | WFVASVKM | 97.01 | WFVASVRM | 2.99 | | | | |
| NS3 | 1870 | 0.19 | 2 | 2 | 0 | Y | FVASVKMG | 97.01 | FVASVRMG | 2.99 | | | | |
| NS3 | 1871 | 0.19 | 2 | 2 | 0 | Y | VASVKMGN | 97.01 | VASVRMGN | 2.99 | | | | |

FIG. 35-71

Species: JEV (length of peptides: 8)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1872 | 0.19 | 2 | 2 | 0 | Y | ASVKMGNE | 97.01 | ASVRMGNE | 2.99 | | | | |
| NS3 | 1873 | 0.19 | 2 | 2 | 0 | Y | SVKMGNEI | 97.01 | SVRMGNEI | 2.99 | | | | |
| NS3 | 1874 | 0.19 | 2 | 2 | 0 | Y | VKMGNEIA | 97.01 | VRMGNEIA | 2.99 | | | | |
| NS3 | 1875 | 0.3 | 3 | 3 | 0 | Y | KMGNEIAM | 95.52 | RMGNEIAM | 2.99 | KMGNEIAV | 1.49 | | |
| NS3 | 1876 | 0.11 | 2 | 2 | 0 | Y | MGNEIAMC | 98.51 | MGNEIAVC | 1.49 | | | | |
| NS3 | 1877 | 0.11 | 2 | 2 | 0 | Y | GNEIAMCL | 98.51 | GNEIAVCL | 1.49 | | | | |
| NS3 | 1878 | 0.11 | 2 | 2 | 0 | Y | NEIAMCLQ | 98.51 | NEIAVCLQ | 1.49 | | | | |
| NS3 | 1879 | 0.11 | 2 | 2 | 0 | Y | EIAMCLQR | 98.51 | EIAVCLQR | 1.49 | | | | |
| NS3 | 1880 | 0.11 | 2 | 2 | 0 | Y | IAMCLQRA | 98.51 | IAVCLQRA | 1.49 | | | | |
| NS3 | 1881 | 0.11 | 2 | 2 | 0 | Y | AMCLQRAG | 98.51 | AVCLQRAG | 1.49 | | | | |
| NS3 | 1882 | 0.11 | 2 | 2 | 0 | Y | MCLQRAGK | 98.51 | VCLQRAGK | 1.49 | | | | |
| NS3 | 1883 | 0.11 | 2 | 2 | 0 | Y | CLQRAGKK | 98.51 | CLQRAGKR | 1.49 | | | | |
| NS3 | 1884 | 0.11 | 2 | 2 | 0 | Y | LQRAGKKV | 98.51 | LQRAGKRV | 1.49 | | | | |
| NS3 | 1885 | 0.11 | 2 | 2 | 0 | Y | QRAGKKVI | 98.51 | QRAGKRVI | 1.49 | | | | |
| NS3 | 1886 | 0.11 | 2 | 2 | 0 | Y | RAGKKVIQ | 98.51 | RAGKRVIQ | 1.49 | | | | |
| NS3 | 1887 | 0.11 | 2 | 2 | 0 | Y | AGKKVIQL | 98.51 | AGKRVIQL | 1.49 | | | | |
| NS3 | 1888 | 0.22 | 3 | 3 | 0 | Y | GKKVIQLN | 97.01 | GKKVIQLS | 1.49 | GKRVIQLN | 1.49 | | |
| NS3 | 1889 | 0.22 | 3 | 3 | 0 | Y | KKVIQLNR | 97.01 | KRVIQLNR | 1.49 | KVIQLSR | 1.49 | | |
| NS3 | 1890 | 0.22 | 3 | 3 | 0 | Y | KVIQLNRK | 97.01 | KVIQLSRK | 1.49 | RVIQLNRK | 1.49 | | |
| NS3 | 1891 | 0.11 | 2 | 2 | 0 | Y | VIQLNRKS | 98.51 | VIQLSRKS | 1.49 | | | | |
| NS3 | 1892 | 0.11 | 2 | 2 | 0 | Y | IQLNRKSY | 98.51 | IQLSRKSY | 1.49 | | | | |
| NS3 | 1893 | 0.11 | 2 | 2 | 0 | Y | QLNRKSYD | 98.51 | QLSRKSYD | 1.49 | | | | |
| NS3 | 1894 | 0.11 | 2 | 2 | 0 | Y | LNRKSYDT | 98.51 | LSRKSYDT | 1.49 | | | | |
| NS3 | 1895 | 0.11 | 2 | 2 | 0 | Y | NRKSYDTE | 98.51 | SRKSYDTE | 1.49 | | | | |
| NS3 | 1896 | 0 | 1 | 1 | 0 | Y | RKSYDTEY | 100 | | | | | | |

FIG. 35-72

Species: JEV (length of peptides: 8)

|

FIG. 35-73

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1922 | 0.11 | 2 | 2 | 0 | Y | MGANFGAS | 98.51 | VGANFGAS | 1.49 | | | | |
| NS3 | 1923 | 0 | 1 | 1 | 0 | Y | GANFGASR | 100 | | | | | | |
| NS3 | 1924 | 0 | 1 | 1 | 0 | Y | ANFGASRV | 100 | | | | | | |
| NS3 | 1925 | 0 | 1 | 1 | 0 | Y | NFGASRVI | 100 | | | | | | |
| NS3 | 1926 | 0 | 1 | 1 | 0 | Y | FGASRVID | 100 | | | | | | |
| NS3 | 1927 | 0 | 1 | 1 | 0 | Y | GASRVIDC | 100 | | | | | | |
| NS3 | 1928 | 0 | 1 | 1 | 0 | Y | ASRVIDCR | 100 | | | | | | |
| NS3 | 1929 | 0 | 1 | 1 | 0 | Y | SRVIDCRK | 100 | | | | | | |
| NS3 | 1930 | 0 | 1 | 1 | 0 | Y | RVIDCRKS | 100 | | | | | | |
| NS3 | 1931 | 0 | 1 | 1 | 0 | Y | VIDCRKSV | 100 | | | | | | |
| NS3 | 1932 | 0.11 | 2 | 2 | 0 | Y | IDCRKSVK | 98.51 | IDCRKSVE | 1.49 | | | | |
| NS3 | 1933 | 0.11 | 2 | 2 | 0 | Y | DCRKSVKP | 98.51 | DCRKSVEP | 1.49 | | | | |
| NS3 | 1934 | 0.22 | 3 | 3 | 0 | Y | CRKSVKPT | 97.01 | CRKSVKPI | 1.49 | | | CRKSVEPT | 1.49 |
| NS3 | 1935 | 0.22 | 3 | 3 | 0 | Y | RKSVKPTI | 97.01 | RKSVKPII | 1.49 | | | RKSVKPII | 1.49 |
| NS3 | 1936 | 0.22 | 3 | 3 | 0 | Y | KSVKPTIL | 97.01 | KSVEPTIL | 1.49 | | | KSVKPIIL | 1.49 |
| NS3 | 1937 | 0.22 | 3 | 3 | 0 | Y | SVKPTILE | 97.01 | SVKPIILE | 1.49 | | | SVEPTILE | 1.49 |
| NS3 | 1938 | 0.33 | 4 | 4 | 0 | Y | VKPTILEE | 95.52 | VKPTILEK | 1.49 | | | VEPTILEE | 1.49 |
| NS3 | 1939 | 0.33 | 4 | 4 | 0 | Y | KPTILEEG | 95.52 | EPTILEKE | 1.49 | | | KPTILEKE | 1.49 |
| NS3 | 1940 | 0.22 | 3 | 3 | 0 | Y | PTILEEGE | 97.01 | PTILEKEE | 1.49 | | | PIILEEGE | 1.49 |
| NS3 | 1941 | 0.22 | 3 | 3 | 0 | Y | TILEEGEG | 97.01 | TILEKEEG | 1.49 | | | IILEEGEG | 1.49 |
| NS3 | 1942 | 0.11 | 2 | 2 | 0 | Y | ILEEGEGR | 98.51 | ILEKEEGR | 1.49 | | | | |
| NS3 | 1943 | 0.11 | 2 | 2 | 0 | Y | LEEGEGRV | 98.51 | LEKEEGRV | 1.49 | | | | |
| NS3 | 1944 | 0.22 | 3 | 3 | 0 | Y | EEGEGRVI | 97.01 | EEGEGRVF | 1.49 | | | EKEEGRVI | 1.49 |
| NS3 | 1945 | 0.22 | 3 | 3 | 0 | Y | EGEGRVIL | 97.01 | EGEGRVFL | 1.49 | | | KEEGRVIL | 1.49 |
| NS3 | 1946 | 0.22 | 3 | 3 | 0 | Y | GEGRVILG | 97.01 | EEGRVILG | 1.49 | | | GEGRVFLG | 1.49 |

FIG. 35-74

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|

FIG. 35-75

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1972 | 0.11 | 2 | 2 | 0 | Y | RNPNQVGD

FIG. 35-76

Species: JEV (length of peptides: 8)

| protein | block starting position | block entropy | total peptides in block | # peptides required to cover

FIG. 35-77

Species: JEV (length of peptides: 8)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 2022 | 0.49 | 3 | 3 | 0 | | Y | REKAFTMD | 91.04 | REKASTMD | 7.46 | | | | |
| NS3 | 2023 | 0.6 | 4 | 4 | 0 | | Y | EKAFTMDG | 89.55 | EKASTMDG | 7.46 | REKALTMD | 1.49 | | |
| NS3 | 2024 | 0.6 | 4 | 4 | 0 | | Y | KAFTMDGE | 89.55 | KASTMDGE | 7.46 | EKALTMDG | 1.49 | EKAFTMDV | 1.49 |
| NS3 | 2025 | 0.6 | 4 | 4 | 0 | | Y | AFTMDGEY | 89.55 | ASTMDGEY | 7.46 | KAFTMDVE | 1.49 | KALTMDGE | 1.49 |
| NS3 | 2026 | 0.6 | 4 | 4 | 0 | | Y | FTMDGEYR | 89.55 | STMDGEYR | 7.46 | ALTMDGEY | 1.49 | AFTMDVEY | 1.49 |
| NS3 | 2027 | 0.11 | 2 | 2 | 0 | | Y | TMDGEYRL | 98.51 | TMDVEYRL | 1.49 | FTMDVEYR | 1.49 | LTMDGEYR | 1.49 |
| NS3 | 2028 | 0.11 | 2 | 2 | 0 | | Y | MDGEYRLR | 98.51 | MDVEYRLR | 1.49 | | | | |
| NS3 | 2029 | 0.11 | 2 | 2 | 0 | | Y | DGEYRLRG | 98.51 | DVEYRLRG | 1.49 | | | | |
| NS3 | 2030 | 0.11 | 2 | 2 | 0 | | Y | GEYRLRGE | 98.51 | VEYRLRGE | 1.49 | | | | |
| NS3 | 2031 | 0 | 1 | 1 | 0 | | Y | EYRLRGEE | 100 | | | | | | |
| NS3 | 2032 | 0 | 1 | 1 | 0 | | Y | YRLRGEEK | 100 | | | | | | |
| NS3 | 2033 | 0 | 1 | 1 | 0 | | Y | RLRGEEKK | 100 | | | | | | |
| NS3 | 2034 | 0 | 1 | 1 | 0 | | Y | LRGEEKKN | 100 | | | | | | |
| NS3 | 2035 | 0 | 1 | 1 | 0 | | Y | RGEEKKNF | 100 | | | | | | |
| NS3 | 2036 | 0 | 1 | 1 | 0 | | Y | GEEKKNFL | 100 | | | | | | |
| NS3 | 2037 | 0 | 1 | 1 | 0 | | Y | EEKKNFLE | 100 | | | | | | |
| NS3 | 2038 | 0 | 1 | 1 | 0 | | Y | EKKNFLEL | 100 | | | | | | |
| NS3 | 2039 | 0 | 1 | 1 | 0 | | Y | KKNFLELL | 100 | | | | | | |
| NS3 | 2040 | 0 | 1 | 1 | 0 | | Y | KNFLELLR | 100 | | | | | | |
| NS3 | 2041 | 0 | 1 | 1 | 0 | | Y | NFLELLRT | 100 | | | | | | |
| NS3 | 2042 | 0 | 1 | 1 | 0 | | Y | FLELLRTA | 100 | | | | | | |
| NS3 | 2043 | 0 | 1 | 1 | 0 | | Y | LELLRTAD | 100 | | | | | | |
| NS3 | 2044 | 0 | 1 | 1 | 0 | | Y | ELLRTADL | 100 | | | | | | |
| NS3 | 2045 | 0 | 1 | 1 | 0 | | Y | LLRTADLP | 100 | | | | | | |
| NS3 | 2046 | 0 | 1 | 1 | 0 | | Y | LRTADLPV | 100 | | | | | | |

FIG. 35-78

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2047 | 0 | 1 | 1 | 0 | Y | RTADLPVW | 100 | | | | | | |
| NS3 | 2048 | 0 | 1 | 1 | 0 | Y | TADLPVWL | 100 | | | | | | |
| NS3 | 2049 | 0 | 1 | 1 | 0 | Y | ADLPVWLA | 100 | | | | | | |
| NS3 | 2050 | 0 | 1 | 1 | 0 | Y | DLPVWLAY | 100 | | | | | | |
| NS3 | 2051 | 0.11 | 2 | 2 | 0 | Y | LPVWLAYK | 98.51 | LPWWLAYR | 1.49 | | | | |
| NS3 | 2052 | 0.11 | 2 | 2 | 0 | Y | PVWLAYKV | 98.51 | PVWLAYRV | 1.49 | | | | |
| NS3 | 2053 | 0.11 | 2 | 2 | 0 | Y | VWLAYKVA | 98.51 | VWLAYRVA | 1.49 | | | | |
| NS3 | 2054 | 0.22 | 3 | 3 | 0 | Y | WLAYKVAS | 97.01 | WLAYKVAP | 1.49 | WLAYRVAS | 1.49 | | |
| NS3 | 2055 | 0.22 | 3 | 3 | 0 | Y | LAYKVASN | 97.01 | LAYKVASN | 1.49 | LAYKVAPN | 1.49 | | |
| NS3 | 2056 | 0.22 | 3 | 3 | 0 | Y | AYKVASNG | 97.01 | AYKVAPNG | 1.49 | AYVASNG | 1.49 | | |
| NS3 | 2057 | 0.22 | 3 | 3 | 0 | Y | YKVASNGI | 97.01 | YRVASNGI | 1.49 | YKVAPNGI | 1.49 | | |
| NS3 | 2058 | 0.22 | 3 | 3 | 0 | Y | KVASNGIQ | 98.51 | KVAPNGIQ | 1.49 | RVASNGIQ | 1.49 | | |
| NS3 | 2059 | 0.11 | 2 | 2 | 0 | Y | VASNGIQY | 98.51 | VAPNGIQY | 1.49 | | | | |
| NS3 | 2060 | 0.11 | 2 | 2 | 0 | Y | ASNGIQYT | 98.51 | APNGIQYT | 1.49 | | | | |
| NS3 | 2061 | 0.11 | 2 | 2 | 0 | Y | SNGIQYTD | 98.51 | PNGIQYTD | 1.49 | | | | |
| NS3 | 2062 | 0 | 1 | 1 | 0 | Y | NGIQYTDR | 100 | | | | | | |
| NS3 | 2063 | 0.26 | 2 | 2 | 0 | Y | GIQYTDRK | 95.52 | GIQYTDRR | 4.48 | | | | |
| NS3 | 2064 | 0.26 | 2 | 2 | 0 | Y | IQYTDRKW | 95.52 | IQYTDRRW | 4.48 | | | | |
| NS3 | 2065 | 0.26 | 2 | 2 | 0 | Y | QYTDRKWC | 95.52 | QYTDRRWC | 4.48 | | | | |
| NS3 | 2066 | 0.26 | 2 | 2 | 0 | Y | YTDRKWCF | 95.52 | YTDRRWCF | 4.48 | | | | |
| NS3 | 2067 | 0.26 | 2 | 2 | 0 | Y | TDRKWCFD | 95.52 | TDRRWCFD | 4.48 | | | | |
| NS3 | 2068 | 0.26 | 2 | 2 | 0 | Y | DRKWCFDG | 95.52 | DRRWCFDG | 4.48 | | | | |
| NS3 | 2069 | 0.26 | 2 | 2 | 0 | Y | RKWCFDGP | 95.52 | RRWCFDGP | 4.48 | | | | |
| NS3 | 2070 | 0.26 | 2 | 2 | 0 | Y | KWCFDGPR | 95.52 | RWCFDGPR | 4.48 | | | | |
| NS3 | 2071 | 0 | 1 | 1 | 0 | Y | WCFDGPRT | 100 | | | | | | |

FIG. 35-79

Species: JEV (length of peptides: 8)

| protein | block starting position | block entropy | total peptides in block | # peptides required to cover 99% of block | gap/X fraction | 99%

FIG. 35-80

Species: JEV (length of pe

FIG. 35-81

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2122 | 0.11 | 2 | 2 | 0 | Y | FAAGKRSA | 98.51 | FASGKRSA | 1.49 | | | | |
| NS3 | 2123 | 1.03 | 4 | 4 | 0 | Y | AAGKRSAV | 71.64 | AAGKRSAI | 25.37 | AAGKRSAT | 1.49 | | |
| NS3 | 2124 | 1.03 | 4 | 4 | 0 | Y | AGKRSAVS | 71.64 | AGKRSAIS | 25.37 | SGKRSAYS | 1.49 | ASGKRSAV | 1.49 |
| NS3 | 2125 | 0.92 | 3 | 3 | 0 | Y | GKRSAVSF | 73.13 | GKRSAISF | 25.37 | GKRSATSF | 1.49 | AGKRSATS | 1.49 |
| NS3 | 2126 | 0.92 | 3 | 3 | 0 | Y | KRSAVSFI | 73.13 | KRSAISFI | 25.37 | KRSATSFI | 1.49 | | |
| NS3 | 2127 | 0.92 | 3 | 3 | 0 | Y | RSAVSFIE | 73.13 | RSAISFIE | 25.37 | RSATSFIE | 1.49 | | |
| NS3 | 2128 | 1.03 | 4 | 4 | 0 | Y | SAVSFIEV | 71.64 | SAISFIEV | 25.37 | SATSFIEV | 1.49 | SAVSFIEE | 1.49 |
| NS4A | 2129 | 1.11 | 5 | 5 | 0 | Y | AVSFIEVL | 71.64 | AISFIEVL | 25.37 | ATSFIEVL | 1.49 | AISFIEVR | 1.49 | AVSFIEEP | 1.49 |
| NS4A | 2130 | 1.11 | 5 | 5 | 0 | Y | VSFIEVLG | 71.64 | ISFIEVLG | 25.37 | VSFIEEPG | 1.49 | ISFIEVRG | 1.49 | TSFIEVLG | 1.49 |
| NS4A | 2131 | 0.22 | 3 | 3 | 0 | Y | SFIEVLGR | 97.01 | SFIEEPGR | 1.49 | | | | |
| NS4A | 2132 | 0.22 | 3 | 3 | 0 | Y | FIEVLGRM | 97.01 | FIEEPGRM | 1.49 | | | | |
| NS4A | 2133 | 0.22 | 3 | 3 | 0 | Y | IEVLGRMP | 97.01 | IEEPGRMP | 1.49 | | | | |
| NS4A | 2134 | 0.22 | 3 | 3 | 0 | Y | EVLGRMPE | 97.01 | EEPGRMPE | 1.49 | | | | |
| NS4A | 2135 | 0.22 | 3 | 3 | 0 | Y | VLGRMPEH | 97.01 | VRGRMPEH | 1.49 | | | | |
| NS4A | 2136 | 0.22 | 3 | 3 | 0 | Y | LGRMPEHF | 97.01 | PGRMPEHF | 1.49 | | | | |
| NS4A | 2137 | 0.11 | 2 | 2 | 0 | Y | GRMPEHFM | 98.51 | GRMPEHFA | 1.49 | | | | |
| NS4A | 2138 | 0.11 | 2 | 2 | 0 | Y | RMPEHFMG | 98.51 | RMPEHFAG | 1.49 | | | | |
| NS4A | 2139 | 0.11 | 2 | 2 | 0 | Y | MPEHFMGK | 98.51 | MPEHFAGK | 1.49 | | | | |
| NS4A | 2140 | 0.11 | 2 | 2 | 0 | Y | PEHFMGKT | 98.51 | PEHFAGKT | 1.49 | | | | |
| NS4A | 2141 | 0.11 | 2 | 2 | 0 | Y | EHFMGKTR | 98.51 | EHFAGKTR | 1.49 | | | | |
| NS4A | 2142 | 0.11 | 2 | 2 | 0 | Y | HFMGKTRE | 98.51 | HFAGKTRE | 1.49 | | | | |
| NS4A | 2143 | 0.11 | 2 | 2 | 0 | Y | FMGKTREA | 98.51 | FAGKTREA | 1.49 | | | | |
| NS4A | 2144 | 0.11 | 2 | 2 | 0 | Y | MGKTREAL | 98.51 | AGKTREAL | 1.49 | | | | |
| NS4A | 2145 | 0 | 1 | 1 | 0 | Y | GKTREALD | 100 | | | | | | |
| NS4A | 2146 | 0 | 1 | 1 | 0 | Y | KTREALDT | 100 | | | | | | |

FIG. 35-82

Species: JEV (length of peptides: 8)

| protein | position | block entropy | total peptides in block | # peptides required to cover 99% of

FIG. 35-83

Species: JEV (length of peptides: 8)

| protein | position | block entropy | total peptides in block | # peptides required to cover 99% of block | gap/X fraction | 99% of block covered w/ <= 5 peptides?

FIG. 35-84

Species: JEV (length of peptides: 8)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---

FIG. 35-85

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

FIG. 35-86

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | pe

FIG. 35-87

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2277 | 0.11 | 2 | 2 | 1.49 | Y | NEYGMLEK | 97.01 | NEYGML

FIG. 35-88

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2306 | 0.33 | 4 | 4 | 0 | Y | PSMALDLR | 95.52 | PGMALDLR | 1.49 | PSMTLDLR | 1.49 | PSVALDLR | 1.49 | | |
| NS4B | 2307 | 0.33 | 4 | 4 | 0 | Y | SMALDLRP | 95.52 | SMTLDLRP | 1.49 | SVALDLRP | 1.49 | GMALDLRP | 1.49 | | |
| NS4B | 2308 | 0.22 | 3 | 3 | 0 | Y | MALDLRPA | 97.01 | MTLDLRPA | 1.49 | VALDLRPA | 1.49 | | | | |
| NS4B | 2309 | 0.11 | 2 | 2 | 0 | Y | ALDLRPAT | 98.51 | TLDLRPAT | 1.49 | | | | | | |
| NS4B | 2310 | 0 | 1 | 1 | 0 | Y | LDLRPATA | 100 | | | | | | | | |
| NS4B | 2311 | 0 | 1 | 1 | 0 | Y | DLRPATAW | 100 | | | | | | | | |
| NS4B | 2312 | 0 | 1 | 1 | 0 | Y | LRPATAWA | 100 | | | | | | | | |
| NS4B | 2313 | 0.11 | 2 | 2 | 0 | Y | RPATAWAL | 98.51 | RPATAWAW | 1.49 | | | | | | |
| NS4B | 2314 | 0.11 | 2 | 2 | 0 | Y | PATAWALY | 98.51 | PATAWAWY | 1.49 | | | | | | |
| NS4B | 2315 | 0.11 | 2 | 2 | 0 | Y | ATAWALYG | 98.51 | ATAWAWYG | 1.49 | | | | | | |
| NS4B | 2316 | 0.11 | 2 | 2 | 0 | Y | TAWALYGG | 98.51 | TAWAWYGG | 1.49 | | | | | | |
| NS4B | 2317 | 0.11 | 2 | 2 | 0 | Y | AWALYGGS | 98.51 | AWAWYGGS | 1.49 | | | | | | |
| NS4B | 2318 | 0.11 | 2 | 2 | 0 | Y | WALYGGST | 98.51 | WAWYGGST | 1.49 | | | | | | |
| NS4B | 2319 | 0.11 | 2 | 2 | 0 | Y | ALYGGSTV | 98.51 | AWYGGSTV | 1.49 | | | | | | |
| NS4B | 2320 | 0.11 | 2 | 2 | 0 | Y | LYGGSTVW | 98.51 | WYGGSTVW | 1.49 | | | | | | |
| NS4B | 2321 | 0 | 1 | 1 | 0 | Y | YGGSTVWL | 100 | | | | | | | | |
| NS4B | 2322 | 0 | 1 | 1 | 0 | Y | GGSTVWLT | 100 | | | | | | | | |
| NS4B | 2323 | 0 | 1 | 1 | 0 | Y | GSTVWLTP | 100 | | | | | | | | |
| NS4B | 2324 | 0 | 1 | 1 | 0 | Y | STVWLTPL | 100 | | | | | | | | |
| NS4B | 2325 | 0 | 1 | 1 | 0 | Y | TVWLTPLL | 100 | | | | | | | | |
| NS4B | 2326 | 0 | 1 | 1 | 0 | Y | VWLTPLLK | 100 | | | | | | | | |
| NS4B | 2327 | 0 | 1 | 1 | 0 | Y | WLTPLLKH | 100 | | | | | | | | |
| NS4B | 2328 | 0.11 | 2 | 2 | 0 | Y | LTPLLKHL | 98.51 | LTPLLKHI | 1.49 | | | | | | |
| NS4B | 2329 | 0.11 | 2 | 2 | 0 | Y | TPLLKHLI | 98.51 | TPLLKHII | 1.49 | | | | | | |
| NS4B | 2330 | 0.11 | 2 | 2 | 0 | Y | PLLKHLIT | 98.51 | PLLKHIIT | 1.49 | | | | | | |

FIG. 35-89

Species: JEV (length of peptides: 8)

| protein | block starting position | block entropy | total peptides in block | # peptides required to cover 99

FIG. 35-90

Species: JEV (length of peptides: 8)

|

FIG. 35-91

Species: JEV (length of peptides: 8)

| protein | block starting position | block entropy | total peptides in block | # peptides required to cover

FIG. 35-92

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency |
|---|---|---|

FIG. 35-93

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 35-94

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2457 | 0.37 | 3 | 3 | 0 | Y | VSV

FIG. 35-95

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 35-96

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 35-97

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 35-98

Species: JEV (length of peptides: 8)

| protein | block starting position | block entropy | total peptides in block | # peptides required to cover 99% of block | gap/X fraction of 99% of block | covered w/ <= 5 peptides? | peptides required

FIG. 35-99

Species: JEV (length of peptides: 8)

| protein | block starting position | block entropy | total peptides in block | # peptides required to cover 99% of block | block | gap/X fraction | 99% of block

FIG. 35-100

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of

FIG. 35-101

Species: JEV (length of peptides: 8)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency |

FIG. 35-102

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to

FIG. 35-103

Species: JEV (length of peptides: 8)

FIG. 35-104

Species: JEV (length of peptides: 8)

| protein | block starting position | block entropy | total peptides in block | # peptides required to cover 99% of block | gap/X fraction | 99% of block | covered w/ <= 5 peptides? | peptides required

FIG. 35-105

Species: JEV (length of peptides: 8)

| protein | block starting position | block entropy | total

FIG. 35-106

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 35-107

Species: JEV (length of peptides: 8)

| protein | block starting position | block entropy | total peptides in block | # peptides required to cover 99% of block | gap/X fraction | 99% of block covered w/ <= 5 peptides? | peptides required

FIG. 35-108

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2813 | 0.65 | 4 | 4 | 0 | Y | RIQKLEE | 88.06 | RIQKLEE | 8.96 | RIQKQKEE | 1.49 | RIQKLREG | 1.49 |
| NS5 | 2814 | 0.65 | 4 | 4 | 0 | Y | IQKLKEEF | 88.06 | IQKLREEF | 8.96 | IQKQKEEF | 1.49 | IQKLREGF | 1.49 | QKLREGFA | 1.49 |
| NS5 | 2815 | 0.71 | 5 | 5 | 0 | Y | QKLKEEFA | 88.06 | QKLREEFA | 7.46 | QKLREEFG | 1.49 | QKQKEEFA | 1.49 | KLREEFGT | 1.49 |
| NS5 | 2816 | 0.71 | 5 | 5 | 0 | Y | KLKEEFAT | 88.06 | KLREEFAT | 7.46 | KLREGFAT | 1.49 | KQKEEFAT | 1.49 | QKEEFATT | 1.49 |
| NS5 | 2817 | 0.71 | 5 | 5 | 0 | Y | LKEEFATT | 88.06 | LREEFATT | 7.46 | LREGFATT | 1.49 | LREEFGTT | 1.49 |
| NS5 | 2818 | 0.6 | 4 | 4 | 0 | Y | KEEFATTW | 89.55 | REEFATTW | 7.46 | REGFATTW | 1.49 | REEFGTTW | 1.49 |
| NS5 | 2819 | 0.22 | 3 | 3 | 0 | Y | EEFATTWH | 97.01 | EGFATTWH | 1.49 | EEFGTTWH | 1.49 | EFATTWHR | 1.49 |
| NS5 | 2820 | 0.33 | 4 | 4 | 0 | Y | EFATTWHK | 95.52 | EFGTTWHK | 1.49 | GFATTWHK | 1.49 | ATTWHRDP | 1.49 |
| NS5 | 2821 | 0.22 | 3 | 3 | 0 | Y | FATTWHKD | 97.01 | FATTWHRD | 1.49 | FGTTWHKD | 1.49 |
| NS5 | 2822 | 0.33 | 4 | 4 | 0 | Y | ATTWHKDP | 95.52 | ATTWHKDH | 1.49 | GTTWHKDP | 1.49 |
| NS5 | 2823 | 0.22 | 3 | 3 | 0 | Y | TTWHKDPE | 97.01 | TTWHKDHE | 1.49 | TTWHRDPE | 1.49 |
| NS5 | 2824 | 0.22 | 3 | 3 | 0 | Y | TWHKDPEH | 97.01 | TWHKDHEH | 1.49 | TWHRDPEH | 1.49 |
| NS5 | 2825 | 0.22 | 3 | 3 | 0 | Y | WHKDPEHP | 97.01 | WHRDPEHP | 1.49 | WHKDHEHP | 1.49 |
| NS5 | 2826 | 0.22 | 3 | 3 | 0 | Y | HKDPEHPY | 97.01 | HRDPEHPY | 1.49 | HKDHEHPY | 1.49 |
| NS5 | 2827 | 0.22 | 3 | 3 | 0 | Y | KDPEHPYR | 97.01 | RDPEHPYR | 1.49 | KDHEHPYR | 1.49 |
| NS5 | 2828 | 0.22 | 3 | 3 | 0 | Y | DPEHPYRT | 97.01 | DPEHPYRN | 1.49 | DHEHPYRT | 1.49 |
| NS5 | 2829 | 0.22 | 3 | 3 | 0 | Y | PEHPYRTW | 97.01 | PEHPYRNW | 1.49 | HEHPYRTW | 1.49 |
| NS5 | 2830 | 0.11 | 2 | 2 | 0 | Y | EHPYRTWT | 98.51 | EHPYRNWT | 1.49 |
| NS5 | 2831 | 0.11 | 2 | 2 | 0 | Y | HPYRTWTY | 98.51 | HPYRNWTY | 1.49 |
| NS5 | 2832 | 0.11 | 2 | 2 | 0 | Y | PYRTWTYH | 98.51 | PYRNWTYH | 1.49 |
| NS5 | 2833 | 0.11 | 2 | 2 | 0 | Y | YRTWTYHG | 98.51 | YRNWTYHG | 1.49 |
| NS5 | 2834 | 0.11 | 2 | 2 | 0 | Y | RTWTYHGS | 98.51 | RNWTYHGS | 1.49 |
| NS5 | 2835 | 0.11 | 2 | 2 | 0 | Y | TWTYHGSY | 98.51 | NWTYHGSY | 1.49 |
| NS5 | 2836 | 0 | 1 | 1 | 0 | Y | WTYHGSYE | 100 |
| NS5 | 2837 | 0 | 1 | 1 | 0 | Y | TYHGSYEV | 100 |

FIG. 35-109

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2838 | 0.11 | 2 | 2 | 0 | Y | YHGSYEVK | 98.51 | YHGSYEVR | 1.49 | | |
| NS5 | 2839 | 0.11 | 2 | 2 | 0 | Y | HGSYEVKA | 98.51 | HGSYEVRA | 1.49 | | |
| NS5 | 2840 | 0.22 | 3 | 3 | 0 | Y | GSYEVKAT | 97.01 | GSYEVKAN | 1.49 | GSYEVRAT | 1.49 |
| NS5 | 2841 | 0.22 | 3 | 3 | 0 | Y | SYEVKATG | 97.01 | SYEVRATG | 1.49 | SYEVKANG | 1.49 |
| NS5 | 2842 | 0.22 | 3 | 3 | 0 | Y | YEVKATGS | 97.01 | YEVKANGS | 1.49 | YEVRATGS | 1.49 |
| NS5 | 2843 | 0.22 | 3 | 3 | 0 | Y | EVKATGSA | 97.01 | EVRATGSA | 1.49 | EVKANGSA | 1.49 |
| NS5 | 2844 | 0.22 | 3 | 3 | 0 | Y | VKATGSAS | 97.01 | VRATGSAS | 1.49 | VKANGSAS | 1.49 |
| NS5 | 2845 | 0.22 | 3 | 3 | 0 | Y | KATGSASS | 97.01 | KANGSASS | 1.49 | RATGSASS | 1.49 |
| NS5 | 2846 | 0.11 | 2 | 2 | 0 | Y | ATGSASSL | 98.51 | ANGSASSL | 1.49 | | |
| NS5 | 2847 | 0.11 | 2 | 2 | 0 | Y | TGSASSLV | 98.51 | NGSASSLV | 1.49 | | |
| NS5 | 2848 | 0 | 1 | 1 | 0 | Y | GSASSLVN | 100 | | | | |
| NS5 | 2849 | 0 | 1 | 1 | 0 | Y | SASSLVNG | 100 | | | | |
| NS5 | 2850 | 0 | 1 | 1 | 0 | Y | ASSLVNGV | 100 | | | | |
| NS5 | 2851 | 0.11 | 2 | 2 | 1.49 | Y | SSLVNGVV | 97.01 | | | | |
| NS5 | 2852 | 0.11 | 2 | 2 | 1.49 | Y | SLVNGVVK | 97.01 | SLVNGVVE | 1.49 | | |
| NS5 | 2853 | 0.11 | 2 | 2 | 1.49 | Y | LVNGVVKL | 97.01 | LVNGVVEL | 1.49 | | |
| NS5 | 2854 | 0.11 | 2 | 2 | 1.49 | Y | VNGVVKLM | 97.01 | VNGVVELM | 1.49 | | |
| NS5 | 2855 | 0.11 | 2 | 2 | 1.49 | Y | NGVVKLMS | 97.01 | NGVVELMS | 1.49 | | |
| NS5 | 2856 | 0.11 | 2 | 2 | 1.49 | Y | GVVKLMSK | 97.01 | GVVELMSK | 1.49 | | |
| NS5 | 2857 | 0.11 | 2 | 2 | 1.49 | Y | VVKLMSKP | 97.01 | VVELMSKP | 1.49 | | |
| NS5 | 2858 | 0.11 | 2 | 2 | 1.49 | Y | VKLMSKPW | 97.01 | VELMSKPW | 1.49 | | |
| NS5 | 2859 | 0.11 | 2 | 2 | 0 | Y | KLMSKPWD | 97.01 | ELMSKPWD | 1.49 | | |
| NS5 | 2860 | 0.11 | 2 | 2 | 0 | Y | LMSKPWDA | 98.51 | LMSKPWDT | 1.49 | | |
| NS5 | 2861 | 0.11 | 2 | 2 | 0 | Y | MSKPWDAI | 98.51 | MSKPWDTI | 1.49 | | |
| NS5 | 2862 | 0.22 | 3 | 3 | 0 | Y | SKPWDAIA | 97.01 | SKPWDAIS | 1.49 | SKPWDTIA | 1.49 |

FIG. 35-110

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2863 | 0.22 | 3 | 3 | 0 | Y | KPWDAIAN | 97.01 | KPWDTIAN | 1.49 | KPWDAISY | 1.49 | | |
| NS5 | 2864 | 0.22 | 3 | 3 | 0 | Y | PWDAIANV | 97.01 | PWDTIANV | 1.49 | PWDAISYV | 1.49 | | |
| NS5 | 2865 | 0.22 | 3 | 3 | 0 | Y | WDAIANVT | 97.01 | WDTIANVT | 1.49 | WDAISYVT | 1.49 | | |
| NS5 | 2866 | 0.22 | 3 | 3 | 0 | Y | DAIANVTT | 97.01 | DAISYVTT | 1.49 | DTIANVTT | 1.49 | | |
| NS5 | 2867 | 0.22 | 3 | 3 | 0 | Y | AIANVTTM | 97.01 | TIANVTTM | 1.49 | AISYVTTM | 1.49 | | |
| NS5 | 2868 | 0.11 | 2 | 2 | 0 | Y | IANVTTMA | 98.51 | ISYVTTMP | 1.49 | | | | |
| NS5 | 2869 | 0.11 | 2 | 2 | 0 | Y | ANVTTMAM | 98.51 | SYVTTMPM | 1.49 | | | | |
| NS5 | 2870 | 0.11 | 2 | 2 | 0 | Y | NVTTMAMT | 98.51 | YVTTMPMT | 1.49 | | | | |
| NS5 | 2871 | 0.11 | 2 | 2 | 0 | Y | VTTMAMTD | 98.51 | VTTMPMTD | 1.49 | | | | |
| NS5 | 2872 | 0.11 | 2 | 2 | 0 | Y | TTMAMTDT | 98.51 | TTMPMTDT | 1.49 | | | | |
| NS5 | 2873 | 0.11 | 2 | 2 | 0 | Y | TMAMTDTT | 98.51 | TMPMTDTT | 1.49 | | | | |
| NS5 | 2874 | 0.11 | 2 | 2 | 0 | Y | MAMTDTTP | 98.51 | MPMTDTTP | 1.49 | | | | |
| NS5 | 2875 | 0.11 | 2 | 2 | 0 | Y | AMTDTTPF | 98.51 | PMTDTTPF | 1.49 | | | | |
| NS5 | 2876 | 0 | 1 | 1 | 0 | Y | MTDTTPFG | 100 | | | | | | |
| NS5 | 2877 | 0 | 1 | 1 | 0 | Y | TDTTPFGQ | 100 | | | | | | |
| NS5 | 2878 | 0 | 1 | 1 | 0 | Y | DTTPFGQQ | 100 | | | | | | |
| NS5 | 2879 | 0 | 1 | 1 | 0 | Y | TTPFGQQR | 100 | | | | | | |
| NS5 | 2880 | 0 | 1 | 1 | 0 | Y | TPFGQQRV | 100 | | | | | | |
| NS5 | 2881 | 0 | 1 | 1 | 0 | Y | PFGQQRVF | 100 | | | | | | |
| NS5 | 2882 | 0 | 1 | 1 | 0 | Y | FGQQRVFK | 100 | | | | | | |
| NS5 | 2883 | 0 | 1 | 1 | 0 | Y | GQQRVFKE | 100 | | | | | | |
| NS5 | 2884 | 0 | 1 | 1 | 0 | Y | QQRVFKEK | 100 | | | | | | |
| NS5 | 2885 | 0 | 1 | 1 | 0 | Y | QRVFKEKV | 100 | | | | | | |
| NS5 | 2886 | 0.19 | 2 | 2 | 0 | Y | RVFKEKVD | 97.01 | RVFKEKVG | 2.99 | | | | |
| NS5 | 2887 | 0.19 | 2 | 2 | 0 | Y | VFKEKVDT | 97.01 | VFKEKVGT | 2.99 | | | | |

FIG. 35-111

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2888 | 0.22 | 3 | 3 | 0 | Y | FKEKVDTK | 97.01 | FKEKVGTM | 1.49 | FKEKVGTK | 1.49 | | |
| NS5 | 2889 | 0.22 | 3 | 3 | 0 | Y | KEKVDTKA | 97.01 | KEKVGTMA | 1.49 | KEKVGTKA | 1.49 | | |
| NS5 | 2890 | 0.22 | 3 | 3 | 0 | Y | EKVDTKAP | 97.01 | EKVGTKAP | 1.49 | EKVGTMAP | 1.49 | | |
| NS5 | 2891 | 0.22 | 3 | 3 | 0 | Y | KVDTKAPE | 97.01 | KVGTKAPE | 1.49 | KVGTMAPE | 1.49 | | |
| NS5 | 2892 | 0.22 | 3 | 3 | 0 | Y | VDTKAPEP | 97.01 | VGTKAPEP | 1.49 | VGTMAPEP | 1.49 | | |
| NS5 | 2893 | 0.22 | 3 | 3 | 0 | Y | DTKAPEPP | 97.01 | GTMAPEPP | 1.49 | GTKAPEPP | 1.49 | | |
| NS5 | 2894 | 0.45 | 5 | 5 | 0 | Y | TKAPEPPA | 94.03 | TKAPEPPT | 1.49 | TKAPEPPG | 1.49 | TKAPEPPV | 1.49 | TMAPEPPA | 1.49 |
| NS5 | 2895 | 0.45 | 5 | 5 | 0 | Y | KAPEPPAG | 94.03 | MAPEPPAG | 1.49 | KAPEPPTG | 1.49 | KAPEPPPG | 1.49 | KAPEPPVG | 1.49 |
| NS5 | 2896 | 1.11 | 5 | 5 | 0 | Y | APEPPAGA | 71.64 | APEPPAGV | 23.88 | APEPPVGA | 1.49 | APEPPPGV | 1.49 | APEPPTGA | 1.49 |
| NS5 | 2902 | 0.9 | 3 | 3 | 0 | Y | GAKEVLNE | 74.63 | GVKEVLNE | 23.88 | GVREVLNE | 1.49 | | |
| NS5 | 2903 | 0.9 | 3 | 3 | 0 | Y | AKEVLNET | 74.63 | VKEVLNET | 23.88 | VREVLNET | 1.49 | | |
| NS5 | 2904 | 0.11 | 2 | 2 | 0 | Y | KEVLNETT | 98.51 | REVLNETT | 1.49 | | | | |
| NS5 | 2905 | 0 | 1 | 1 | 0 | Y | EVLNETTN | 100 | | | | | | |
| NS5 | 2906 | 0 | 1 | 1 | 0 | Y | VLNETTNW | 100 | | | | | | |
| NS5 | 2907 | 0 | 1 | 1 | 0 | Y | LNETTNWL | 100 | | | | | | |
| NS5 | 2908 | 0 | 1 | 1 | 0 | Y | NETTNWLW | 100 | | | | | | |
| NS5 | 2909 | 0 | 1 | 1 | 0 | Y | ETTNWLWA | 100 | | | | | | |
| NS5 | 2910 | 0.93 | 2 | 2 | 0 | Y | TTNWLWAH | 65.67 | TTNWLWAY | 34.33 | | | | |
| NS5 | 2911 | 0.93 | 2 | 2 | 0 | Y | TNWLWAHL | 65.67 | TNWLWAYL | 34.33 | | | | |
| NS5 | 2912 | 0.93 | 2 | 2 | 0 | Y | NWLWAHLS | 65.67 | NWLWAYLS | 34.33 | | | | |
| NS5 | 2913 | 0.93 | 2 | 2 | 0 | Y | WLWAHLSR | 65.67 | WLWAYLSR | 34.33 | | | | |
| NS5 | 2914 | 1.03 | 3 | 3 | 0 | Y | LWAHLSRE | 64.18 | LWAYLSRE | 34.33 | LWAHLSRK | 1.49 | | |
| NS5 | 2915 | 1.03 | 3 | 3 | 0 | Y | WAHLSREK | 64.18 | WAYLSREK | 34.33 | WAHLSRKK | 1.49 | | |
| NS5 | 2916 | 1.03 | 3 | 3 | 0 | Y | AHLSREKR | 64.18 | AYLSREKR | 34.33 | AHLSRKKR | 1.49 | | |
| NS5 | 2917 | 1.03 | 3 | 3 | 0 | Y | HLSREKRP | 64.18 | YLSREKRP | 34.33 | HLSRKKRP | 1.49 | | |

FIG. 35-112

Species: JEV (length of peptides: 8)

| protein | block starting position | block entropy | total peptides in block | # peptides required to cover 99% of block | block gap/X fraction | 99% of block covered w/ <= 5 pe

FIG. 35-113

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 35-114

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block

FIG. 35-115

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | pept

FIG. 35-116

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block

FIG. 35-117

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3054 | 0.33 | 4 | 4 | 0 | Y | DIAGKQGG | 95.52 | DIARKEGG | 1.49 | DITSRAIG | 1.49 | DIAVKQGG | 1.49 |
| NS5 | 3055 | 0.33 | 4 | 4 | 0 | Y | IAGKQGGK | 95.52 | IARKQGGK | 1.49 | IARKEGGK | 1.49 | ITSRAIGK | 1.49 |
| NS5 | 3056 | 0.33 | 4 | 4 | 0 | Y | AGKQGGKM | 95.52 | AVKQGGKM | 1.49 | TSRAIGKM | 1.49 | ARKEGGKM | 1.49 |
| NS5 | 3057 | 0.33 | 4 | 4 | 0 | Y | GKQGGKMY | 95.52 | SRAIGKMY | 1.49 | RKEGGKMY | 1.49 | VKQGGKMY | 1.49 |
| NS5 | 3058 | 0.22 | 3 | 3 | 0 | Y | KQGGKMYA | 97.01 | KEGGKMYA | 1.49 | RAIGKMYA | 1.49 | | |
| NS5 | 3059 | 0.22 | 3 | 3 | 0 | Y | QGGKMYAD | 97.01 | EGGKMYAD | 1.49 | AIGKMYAD | 1.49 | | |
| NS5 | 3060 | 0.11 | 2 | 2 | 0 | Y | GGKMYADD | 98.51 | IGKMYADD | 1.49 | | | | |
| NS5 | 3061 | 0.11 | 2 | 2 | 0 | Y | GKMYADDT | 98.51 | GKMYADDP | 1.49 | | | | |
| NS5 | 3062 | 0.11 | 2 | 2 | 0 | Y | KMYADDTA | 98.51 | KMYADDPA | 1.49 | | | | |
| NS5 | 3063 | 0.11 | 2 | 2 | 0 | Y | MYADDTAG | 98.51 | MYADDPAG | 1.49 | | | | |
| NS5 | 3064 | 0.11 | 2 | 2 | 0 | Y | YADDTAGW | 98.51 | YADDPAGW | 1.49 | | | | |
| NS5 | 3065 | 0.11 | 2 | 2 | 0 | Y | ADDTAGWD | 98.51 | ADDPAGWD | 1.49 | | | | |
| NS5 | 3066 | 0.11 | 2 | 2 | 0 | Y | DDTAGWDT | 98.51 | DDPAGWDT | 1.49 | | | | |
| NS5 | 3067 | 0.11 | 2 | 2 | 0 | Y | DTAGWDTR | 98.51 | DPAGWDTR | 1.49 | | | | |
| NS5 | 3068 | 0.11 | 2 | 2 | 0 | Y | TAGWDTRI | 98.51 | PAGWDTRI | 1.49 | | | | |
| NS5 | 3069 | 0 | 1 | 1 | 0 | Y | AGWDTRIT | 100 | | | | | | |
| NS5 | 3070 | 0.11 | 2 | 2 | 0 | Y | GWDTRITR | 98.51 | GWDTRITK | 1.49 | | | | |
| NS5 | 3071 | 0.3 | 3 | 3 | 0 | Y | WDTRITRT | 95.52 | WDTRITRA | 2.99 | WDTRITKT | 1.49 | | |
| NS5 | 3072 | 0.3 | 3 | 3 | 0 | Y | DTRITRTD | 95.52 | DTRITRAD | 2.99 | DTRITKTD | 1.49 | | |
| NS5 | 3073 | 0.3 | 3 | 3 | 0 | Y | TRITRTDL | 95.52 | TRITRADL | 2.99 | TRITKTDL | 1.49 | | |
| NS5 | 3074 | 0.3 | 3 | 3 | 0 | Y | RITRTDLE | 95.52 | RITRADLE | 2.99 | RITKTDLE | 1.49 | | |
| NS5 | 3075 | 0.3 | 3 | 3 | 0 | Y | ITRTDLEN | 95.52 | ITRADLEN | 2.99 | ITKTDLEN | 1.49 | | |
| NS5 | 3076 | 0.3 | 3 | 3 | 0 | Y | TRTDLENE | 95.52 | TRADLENE | 2.99 | TKTDLENE | 1.49 | | |
| NS5 | 3077 | 0.3 | 3 | 3 | 0 | Y | RTDLENEA | 95.52 | RADLENEA | 2.99 | KTDLENEA | 1.49 | | |
| NS5 | 3078 | 0.19 | 2 | 2 | 0 | Y | TDLENEAK | 97.01 | ADLENEAK | 2.99 | | | | |

FIG. 35-118

Species: JEV (length of peptides: 8)

| protein | block

FIG. 35-119

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3104 | 0.22 | 3 | 3 | 0 | Y | LTRHKVW | 97.01 | LTYKHKVW | 1.49 | LTYRHQVF | 1.49 | | |
| NS5 | 3105 | 0.22 | 3 | 3 | 0 | Y | TYRHKVWK | 97.01 | TYKHKVWK | 1.49 | TYRHQVFK | 1.49 | | |
| NS5 | 3106 | 0.22 | 3 | 3 | 0 | Y | YRHKVWKV | 97.01 | YRHQVFKV | 1.49 | YKHKVWKV | 1.49 | | |
| NS5 | 3107 | 0.22 | 3 | 3 | 0 | Y | RHKVWKVM | 97.01 | RHQVFKVM | 1.49 | KHKVWKVM | 1.49 | | |
| NS5 | 3108 | 0.11 | 2 | 2 | 0 | Y | HKVWKVYM | 98.51 | HQVFKVMR | 1.49 | | | | |
| NS5 | 3109 | 0.11 | 2 | 2 | 0 | Y | KVWKVMRP | 98.51 | QVFKVMRP | 1.49 | | | | |
| NS5 | 3110 | 0.22 | 3 | 3 | 0 | Y | VWKVMRPA | 97.01 | VFKVMRPA | 1.49 | | | | |
| NS5 | 3111 | 0.33 | 4 | 4 | 0 | Y | VKVMRPAA | 95.52 | VKVMRPAS | 1.49 | FKVMRPAA | 1.49 | | |
| NS5 | 3112 | 0.97 | 5 | 5 | 0 | Y | KVMRPAAE | 79.1 | KVMRPAAG | 16.42 | KVMRPAAK | 1.49 | KVMRPSTD | 1.49 |
| NS5 | 3113 | 0.97 | 5 | 5 | 0 | Y | VMRPAAEG | 79.1 | VMRPAAGG | 16.42 | VMRPAAKG | 1.49 | VMRPSTDG | 1.49 |
| NS5 | 3114 | 0.97 | 5 | 5 | 0 | Y | MRPAAEGK | 79.1 | MRPAAGGK | 16.42 | MRPSTDGK | 1.49 | MRPASGGK | 1.49 |
| NS5 | 3115 | 0.97 | 5 | 5 | 0 | Y | RPAEGKT | 79.1 | RPAAGGKT | 16.42 | RPSTDGKT | 1.49 | RPASGGKT | 1.49 |
| NS5 | 3116 | 0.97 | 5 | 5 | 0 | Y | PAAEGKTV | 79.1 | PAAGGKTV | 16.42 | PSTDGKTV | 1.49 | PASGGKTV | 1.49 |
| NS5 | 3117 | 0.97 | 5 | 5 | 0 | Y | AAEGKTVM | 77.61 | AAGGKTVM | 17.91 | STDGKTVM | 1.49 | AAKGKTGM | 1.49 |
| NS5 | 3119 | 1 | 5 | 5 | 0 | Y | EGKTVMDV | | GGKTVMDV | 1.49 | EGKTVMVV | 1.49 | DGKTVMDV | 1.49 |
| NS5 | 3120 | 0.22 | 3 | 3 | 0 | Y | GKTVMDVI | 97.01 | GKTGMAVI | 1.49 | GKTVMVVY | 1.49 | | |
| NS5 | 3121 | 0.22 | 3 | 3 | 0 | Y | KTVMDVIS | 97.01 | KTVMVVYS | 1.49 | KTGMAVIS | 1.49 | | |
| NS5 | 3122 | 0.22 | 3 | 3 | 0 | Y | TVMDVISR | 97.01 | TVMVVYSR | 1.49 | TGMAVISR | 1.49 | | |
| NS5 | 3123 | 0.22 | 3 | 3 | 0 | Y | VMDVISRE | 97.01 | VMVVYSRE | 1.49 | | | | |
| NS5 | 3124 | 0.22 | 3 | 3 | 0 | Y | MDVISRED | 97.01 | MVVYSRED | 1.49 | MAVISREN | 1.49 | | |
| NS5 | 3125 | 0.22 | 3 | 3 | 0 | Y | DVISREDQ | 97.01 | VVYSREDQ | 1.49 | AVISRENQ | 1.49 | | |
| NS5 | 3126 | 0.22 | 3 | 3 | 0 | Y | VISREDQR | 97.01 | VYSRENQR | 1.49 | VYSREDQR | 1.49 | | |
| NS5 | 3127 | 0.22 | 3 | 3 | 0 | Y | ISREDQRG | 97.01 | YSREDQRG | 1.49 | ISRENQRG | 1.49 | | |
| NS5 | 3128 | 0.11 | 2 | 2 | 0 | Y | SREDQRGS | 98.51 | SRENQRGS | 1.49 | | | | |
| NS5 | 3129 | 0.11 | 2 | 2 | 0 | Y | REDQRGSG | 98.51 | RENQRGSG | 1.49 | | | | |

FIG. 35-120

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3130 | 0.11 | 2 | 2 | 0 | Y | EDQRGSGQ | 98.51 | ENQRGSGQ | 1.49 | | | | |
| NS5 | 3131 | 0.11 | 2 | 2 | 0 | Y | DQRGSGQV | 98.51 | NQRGSGQV |

FIG. 35-121

Species: JEV (length of peptides: 8)

| protein | block

FIG. 35-122

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3181 | 0.11 | 2 | 2 | 0 | Y | TWL

FIG. 35-123

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|

FIG. 35-124

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block

FIG. 35-125

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover

FIG. 35-126

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover

FIG. 35-127

Species: JEV (length of pe

FIG. 35-128

Species: JEV (length of peptides: 8)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3331 | 0.19 | 2 | 2 | 0 | Y | WSIHSKGE | 97.01 | WSKHSKGE | 2.99 | | | | |
| NS5 | 3332 | 0.19 | 2 | 2 | 0 | Y | SIHSKGEW | 97.01 | SKHSKGEW | 2.99 | | | | |
| NS5 | 3333 | 0.3 | 3 | 3 | 0 | Y | IHSKGEWM | 95.52 | KHSKGEWM | 2.99 | IHSKGEWI | 1.49 | | |
| NS5 | 3334 | 0.11 | 2 | 2 | 0 | Y | HSKGEWMT | 98.51 | HSKGEWIP | 1.49 | | | | |
| NS5 | 3335 | 0.11 | 2 | 2 | 0 | Y | SKGEWMTT | 98.51 | SKGEWIPT | 1.49 | | | | |
| NS5 | 3336 | 0.11 | 2 | 2 | 0 | Y | KGEWMTTE | 98.51 | KGEWIPTE | 1.49 | | | | |
| NS5 | 3337 | 0.3 | 3 | 3 | 0 | Y | GEWMTTED | 95.52 | GEWMTTEN | 2.99 | GEWIPTED | 1.49 | | |
| NS5 | 3338 | 0.3 | 3 | 3 | 0 | Y | EWMTTEDM | 95.52 | EWMTTENM | 2.99 | EWIPTEDM | 1.49 | | |
| NS5 | 3339 | 0.3 | 3 | 3 | 0 | Y | WMTTEDML | 95.52 | WMTTENML | 2.99 | WIPTEDML | 1.49 | | |
| NS5 | 3340 | 0.3 | 3 | 3 | 0 | Y | MTTEDMLQ | 95.52 | MTTENMLQ | 2.99 | IPTEDMLQ | 1.49 | | |
| NS5 | 3341 | 0.3 | 3 | 3 | 0 | Y | TTEDMLQV | 95.52 | TTENMLQV | 2.99 | PTEDMLQV | 1.49 | | |
| NS5 | 3342 | 0.19 | 2 | 2 | 0 | Y | TEDMLQVW | 97.01 | TENMLQVW | 2.99 | | | | |
| NS5 | 3343 | 0.19 | 2 | 2 | 0 | Y | EDMLQVWN | 97.01 | ENMLQVWN | 2.99 | | | | |
| NS5 | 3344 | 0.19 | 2 | 2 | 0 | Y | DMLQVWNR | 97.01 | NMLQVWNK | 2.99 | | | | |
| NS5 | 3345 | 0.19 | 2 | 2 | 0 | Y | MLQVWNRV | 97.01 | MLQVWNKV | 2.99 | | | | |
| NS5 | 3346 | 0.19 | 2 | 2 | 0 | Y | LQVWNRVW | 97.01 | LQVWNKVW | 2.99 | | | | |
| NS5 | 3347 | 0.19 | 2 | 2 | 0 | Y | QVWNRVWI | 97.01 | QVWNKVWI | 2.99 | | | | |
| NS5 | 3348 | 0.19 | 2 | 2 | 0 | Y | VWNRVWIE | 97.01 | VWNKVWIE | 2.99 | | | | |
| NS5 | 3349 | 0.19 | 2 | 2 | 0 | Y | WNRVWIEE | 97.01 | WNKVWIEE | 2.99 | | | | |
| NS5 | 3350 | 0.19 | 2 | 2 | 0 | Y | NRVWIEEN | 97.01 | NKVWIEEN | 2.99 | | | | |
| NS5 | 3351 | 0.19 | 2 | 2 | 0 | Y | RVWIEENE | 97.01 | KVWIEENE | 2.99 | | | | |
| NS5 | 3352 | 0 | 1 | 1 | 0 | Y | VWIEENEW | 100 | | | | | | |
| NS5 | 3353 | 0 | 1 | 1 | 0 | Y | WIEENEWM | 100 | | | | | | |
| NS5 | 3354 | 0.42 | 4 | 4 | 0 | Y | IEENEWMM | 94.03 | IEENEWMV | 2.99 | IEENEWMT | 1.49 | IEENEWME | 1.49 |
| NS5 | 3355 | 0.42 | 4 | 4 | 0 | Y | EENEWMMD | 94.03 | EENEWMVD | 2.99 | EENEWMTD | 1.49 | EENEWMED | 1.49 |

FIG. 35-129

Species: JEV (length of peptides: 8)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3356 | 0.53 | 5 | 5 | 0 | Y | ENEWMMDK | 92.54 | ENEWMVDK | 2.99 | ENEWMMDM | 1.49 | ENEWMEDK | 1.49 | ENEWMTDK | 1.49 |
| NS5 | 3357 | 0.53 | 5 | 5 | 0 | Y | NEWMMDKT | 92.54 | NEWMVDKT | 2.99 | NEWMMDMT | 1.49 | NEWMEDKT | 1.49 | NEWMTDKT | 1.49 |
| NS5 | 3358 | 0.53 | 5 | 5 | 0 | Y | EWMMDKTP | 92.54 | EWMVDKTP | 2.99 | EWMMDMT | 1.49 | EWMTDKTP | 1.49 | EWMMDMTP | 1.49 |
| NS5 | 3362 | 0.49 | 4 | 4 | 0 | Y | DKTPITSW | 92.54 | DKTPVTSW | 4.48 | DKTPIASW | 1.49 | DMTPITSW | 1.49 | | |
| NS5 | 3363 | 0.49 | 4 | 4 | 0 | Y | KTPITSWT | 92.54 | KTPVTSWT | 4.48 | MTPITSWT | 1.49 | KTPIASWT | 1.49 | | |
| NS5 | 3364 | 0.37 | 3 | 3 | 0 | Y | TPITSWTD | 94.03 | TPVTSWTD | 4.48 | TPIASWTD | 1.49 | | | | |
| NS5 | 3365 | 0.37 | 3 | 3 | 0 | Y | PITSWTDV | 94.03 | PVTSWTDV | 4.48 | PIASWTDV | 1.49 | | | | |
| NS5 | 3366 | 0.37 | 3 | 3 | 0 | Y | ITSWTDVP | 94.03 | VTSWTDVP | 4.48 | IASWTDVP | 1.49 | | | | |
| NS5 | 3367 | 0.11 | 2 | 2 | 0 | Y | TSWTDVPY | 97.01 | ASWTDVPY | 1.49 | | | | | | |
| NS5 | 3368 | 0 | 1 | 1 | 1.49 | Y | SWTDVPYV | 98.51 | | | | | | | | |
| NS5 | 3369 | 0 | 1 | 1 | 1.49 | Y | WTDVPYVG | 98.51 | | | | | | | | |
| NS5 | 3370 | 0 | 1 | 1 | 1.49 | Y | TDVPYVGK | 98.51 | | | | | | | | |
| NS5 | 3371 | 0 | 1 | 1 | 1.49 | Y | DVPYVGKR | 98.51 | | | | | | | | |
| NS5 | 3372 | 0 | 1 | 1 | 1.49 | Y | VPYVGKRE | 98.51 | | | | | | | | |
| NS5 | 3373 | 0 | 1 | 1 | 1.49 | Y | PYVGKRED | 98.51 | | | | | | | | |
| NS5 | 3374 | 0 | 1 | 1 | 1.49 | Y | YVGKREDI | 98.51 | | | | | | | | |
| NS5 | 3375 | 0 | 1 | 1 | 0 | Y | VGKREDIW | 100 | | | | | | | | |
| NS5 | 3376 | 0 | 1 | 1 | 0 | Y | GKREDIWC | 100 | | | | | | | | |
| NS5 | 3377 | 0 | 1 | 1 | 0 | Y | KREDIWCG | 100 | | | | | | | | |
| NS5 | 3378 | 0.11 | 2 | 2 | 0 | Y | REDIWCGS | 98.51 | REDIWCGN | 1.49 | | | | | | |
| NS5 | 3379 | 0.11 | 2 | 2 | 0 | Y | EDIWCGSL | 98.51 | EDIWCGNL | 1.49 | | | | | | |
| NS5 | 3380 | 0.11 | 2 | 2 | 0 | Y | DIWCGSLI | 98.51 | DIWCGNLI | 1.49 | | | | | | |
| NS5 | 3381 | 0.11 | 2 | 2 | 0 | Y | IWCGSLIG | 98.51 | IWCGNLIG | 1.49 | | | | | | |
| NS5 | 3382 | 0.11 | 2 | 2 | 0 | Y | WCGSLIGT | 98.51 | WCGNLIGT | 1.49 | | | | | | |
| NS5 | 3383 | 0.11 | 2 | 2 | 0 | Y | CGSLIGTR | 98.51 | CGNLIGTR | 1.49 | | | | | | |

FIG. 35-130

Species: JEV (length of peptides: 8)

| protein | block starting position | block entropy | total peptides in block | # peptides required to cover 99% of block | gap/

FIG. 35-131

Species: JEV (length of peptides: 8)

| protein | block starting position | block

Species: JEV (9-mers)

FIG. 36-1

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 1 | 0.11 | 2 | 2 | 0 | Y | MTKKPGGPG | 98.51 | MTKKPRGPG | 1.49 | | | | |
| anC | 2 | 0.44 | 3 | 3 | 0 | Y | TKKPGGPGK | 92.54 | TKKPGGPGR | 5.97 | TKKPRGPGI | 1.49 | | |
| anC | 3 | 0.55 | 4 | 4 | 0 | Y | KKPGGPGKN | 91.04 | KKPGGPGRN | 5.97 | KKPRGPGIN | 1.49 | KKPGGPGKS | 1.49 |
| anC | 4 | 0.55 | 4 | 4 | 0 | Y | KPGGPGKNR | 91.04 | KPGGPGRNR | 5.97 | KPGGPGKSR | 1.49 | KPRGPGINR | 1.49 |
| anC | 5 | 0.55 | 4 | 4 | 0 | Y | PGGPGKNRA | 91.04 | PGGPGRNRA | 5.97 | PRGPGINRA | 1.49 | PGGPGKSRA | 1.49 |
| anC | 6 | 0.55 | 4 | 4 | 0 | Y | GGPGKNRAI | 91.04 | GGPGRNRAI | 5.97 | GGPGKSRAI | 1.49 | RGPGINRAI | 1.49 |
| anC | 7 | 0.55 | 4 | 4 | 0 | Y | GPGKNRAIN | 91.04 | GPGRNRAIN | 5.97 | GPGINRAIY | 1.49 | GPGKSRAIN | 1.49 |
| anC | 8 | 0.55 | 4 | 4 | 0 | Y | PGKNRAINM | 91.04 | PGRNRAINM | 5.97 | PGKSRAINM | 1.49 | PGINRAIYM | 1.49 |
| anC | 9 | 0.55 | 4 | 4 | 0 | Y | GKNRAINML | 91.04 | GRNRAINML | 5.97 | GINRAIYML | 1.49 | GKSRAINML | 1.49 |
| anC | 10 | 0.55 | 4 | 4 | 0 | Y | KNRAINMLK | 91.04 | RNRAINMLK | 5.97 | INRAIYMLK | 1.49 | KSRAINMLK | 1.49 |
| anC | 11 | 0.22 | 3 | 3 | 0 | Y | NRAINMLKR | 97.01 | NRAIYMLKR | 1.49 | SRAINMLKR | 1.49 | | |
| anC | 12 | 0.11 | 2 | 2 | 0 | Y | RAINMLKRG | 98.51 | RAIYMLKRG | 1.49 | | | | |
| anC | 13 | 0.11 | 2 | 2 | 0 | Y | AINMLKRGL | 98.51 | AIYMLKRGL | 1.49 | | | | |
| anC | 14 | 0.11 | 2 | 2 | 0 | Y | INMLKRGLP | 98.51 | IYMLKRGLP | 1.49 | | | | |
| anC | 15 | 0.11 | 2 | 2 | 0 | Y | NMLKRGLPR | 98.51 | YMLKRGLPR | 1.49 | | | | |
| anC | 16 | 0 | 1 | 1 | 0 | Y | MLKRGLPRV | 100 | | | | | | |
| anC | 17 | 0 | 1 | 1 | 0 | Y | LKRGLPRVF | 100 | | | | | | |
| anC | 18 | 0 | 1 | 1 | 0 | Y | KRGLPRVFP | 100 | | | | | | |
| anC | 19 | 0 | 1 | 1 | 0 | Y | RGLPRVFPL | 100 | | | | | | |
| anC | 20 | 0 | 1 | 1 | 0 | Y | GLPRVFPLV | 100 | | | | | | |
| anC | 21 | 0.11 | 2 | 2 | 0 | Y | LPRVFPLYG | 98.51 | LPRVFPLVR | 1.49 | | | | |
| anC | 22 | 0.11 | 2 | 2 | 0 | Y | PRVFPLVGV | 98.51 | PRVFPLVRN | 1.49 | | | | |
| anC | 23 | 0.11 | 2 | 2 | 0 | Y | RVFPLVGVK | 98.51 | RVFPLVRVK | 1.49 | | | | |
| anC | 24 | 0.22 | 3 | 3 | 0 | Y | VFPLVGVKR | 97.01 | VFPLVRVKR | 1.49 | VFPLVGVKK | 1.49 | | |
| anC | 25 | 0.22 | 3 | 3 | 0 | Y | FPLVGVKRV | 97.01 | FPLVRVKRV | 1.49 | FPLVGVKKV | 1.49 | | |

FIG. 36-2

Species: JEV (9-mers)

| protein | block starting position | block entropy | total peptides in block | peptides required to cover 99% of block | gap/X fraction 99% of block | covered w/ >= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 26 | 0.22 | 3 | 3 | 0 | Y | P

FIG. 36-3

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 51 | 0.3 | 3 | 3 | 0 | Y | ITFF

FIG. 36-4

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 76 | 0 | 1 | 1 | 0 | Y | VAMKHLTSF | 100 | | | | | | |
| anC | 77 | 0 | 1 | 1 | 0 | Y | AMKHLTSFK | 100 | | | | | | |
| anC | 78 | 0.11 | 2 | 2 | 0 | Y | MKHLTSFKR | 98.51 | MKHLTSFKG | 1.49 | | | | |
| anC | 79 | 0.11 | 2 | 2 | 0 | Y | KHLTSFKRE | 98.51 | KHLTSFKGE | 1.49 | | | | |
| anC | 80 | 0.11 | 2 | 2 | 0 | Y | HLTSFKREL | 98.51 | HLTSFKGEL | 1.49 | | | | |
| anC | 81 | 0.11 | 2 | 2 | 0 | Y | LTSFKRELG | 98.51 | LTSFKGELG | 1.49 | | | | |
| anC | 82 | 0.22 | 3 | 3 | 0 | Y | TSFKRELGT | 97.01 | TSFKGELGT | 1.49 | TSFKRELGI | 1.49 | | |
| anC | 83 | 0.22 | 3 | 3 | 0 | Y | SFKRELGTL | 97.01 | SFKGELGTL | 1.49 | SFKRELGIL | 1.49 | | |
| anC | 84 | 0.22 | 3 | 3 | 0 | Y | FKRELGTLI | 97.01 | FKGELGTLI | 1.49 | FKGELGTLI | 1.49 | | |
| anC | 85 | 0.22 | 3 | 3 | 0 | Y | KRELGTLID | 97.01 | KGELGTLID | 1.49 | KGELGTLID | 1.49 | | |
| anC | 86 | 0.45 | 5 | 5 | 0 | Y | RELGTLIDA | 94.03 | RELGTLID | 1.49 | GELGTLIDG | 1.49 | RELGTLIDT | 1.49 | RELGTLIDV | 1.49 |
| anC | 87 | 0.45 | 5 | 5 | 0 | Y | ELGTLIDAV | 94.03 | ELGTLIDAV | 1.49 | ELGTLIDTV | 1.49 | ELGILIDAV | 1.49 | ELGTLIDGV | 1.49 |
| anC | 88 | 0.45 | 5 | 5 | 0 | Y | LGTLIDAVN | 94.03 | LGTLIDAVN | 1.49 | LGTLIDTV | 1.49 | LGTLIDGVN | 1.49 | LGTLIDVYN | 1.49 |
| anC | 89 | 0.45 | 5 | 5 | 0 | Y | GTLIDAVNK | 94.03 | GTLIDAVNK | 1.49 | GTLIDTVNK | 1.49 | GTLIDGVNK | 1.49 | GTLIDVYNK | 1.49 |
| anC | 90 | 0.45 | 5 | 5 | 0 | Y | TLIDAVNKR | 94.03 | TLIDGVNKR | 1.49 | TLIDGVNK | 1.49 | ILIDAVNKR | 1.49 | TLIDTVNKR | 1.49 |
| anC | 91 | 0.33 | 4 | 4 | 0 | Y | LIDAVNKRG | 95.52 | LIDGVNKRG | 1.49 | LID

Species: JEV (9-mers)

| protein | block starting position | block entropy | total peptides in block | peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| prM | 149 | 0 | 1 | 1 | 0 | VIVIPTSKG | 100 | Y | | | | | | | |
| prM | 150 | 0 | 1 | 1 | 0 | IVIPTSKGE | 100 | Y | | | | | | | |
| prM | 151 | 0 | 1 | 1 | 0 | VIPTSKGEN | 100 | Y | | | | | | | |
| prM | 152 | 0 | 1 | 1 | 0 | IPTSKGENR | 100 | Y | | | | | | | |
| prM | 153 | 0 | 1 | 1 | 0 | PTSKGENRC | 100 | Y | | | | | | | |
| prM | 154 | 0 | 1 | 1 | 0 | TSKGENRCW | 100 | Y | | | | | | | |
| prM | 155 | 0 | 1 | 1 | 0 | SKGENRCWV | 100 | Y | | | | | | | |
| prM | 156 | 0 | 1 | 1 | 0 | KGENRCWVR | 100 | Y | | | | | | | |
| prM | 157 | 0 | 1 | 1 | 0 | GENRCWVRA | 100 | Y | | | | | | | |
| prM | 158 | 0 | 1 | 1 | 0 | ENRCWVRAI | 100 | Y | | | | | | | |
| prM | 159 | 0 | 1 | 1 | 0 | NRCWVRAID | 100 | Y | | | | | | | |
| prM | 160 | 0 | 1 | 1 | 0 | RCWVRAIDV | 100 | Y | | | | | | | |
| prM | 161 | 0 | 1 | 1 | 0 | CWVRAIDVG | 100 | Y | | | | | | | |
| prM | 162 | 0.11 | 2 | 2 | 0 | WVRAIDVGY | 98.51 | Y | WVRAIDVGH | 1.49 | | | | | |
| prM | 163 | 0.22 | 3 | 3 | 0 | VRAIDVGYM | 97.01 | Y | VRAIDVGYL | 1.49 | VRAIDVGHM | 1.49 | | | | |
| prM | 164 | 0.22 | 3 | 3 | 0 | RAIDVGYMC | 97.01 | Y | RAIDVGYMC | 1.49 | RAIDVGYLC | 1.49 | | | | |
| prM | 165 | 0.22 | 3 | 3 | 0 | AIDVGYMCE | 97.01 | Y | AIDVGHMCE | 1.49 | AIDVGYLCE | 1.49 | | | | |
| prM | 166 | 0.22 | 3 | 3 | 0 | IDVGYMCED | 97.01 | Y | IDVGYLCED | 1.49 | IDVGHMCED | 1.49 | | | | |
| prM | 167 | 0.22 | 3 | 3 | 0 | DVGYMCEDT | 97.01 | Y | DVGHMCEDT | 1.49 | DVGYLCEDT | 1.49 | | | | |
| prM | 168 | 0.22 | 3 | 3 | 0 | VGYMCEDTI | 97.01 | Y | VGYLCEDTI | 1.49 | VGHMCEDTI | 1.49 | | | | |
| prM | 169 | 0.22 | 3 | 3 | 0 | GYMCEDTIT | 97.01 | Y | GYLCEDTIT | 1.49 | GHMCEDTIT | 1.49 | | | | |
| prM | 170 | 0.22 | 3 | 3 | 0 | YMCEDTITY | 97.01 | Y | HMCEDTITY | 1.49 | YLCEDTITY | 1.49 | | | | |
| prM | 171 | 0.11 | 2 | 2 | 0 | MCEDTITYE | 98.51 | Y | LCEDTITYE | 1.49 | | | | | |
| prM | 172 | 0 | 1 | 1 | 0 | CEDTITYEC | 100 | Y | | | | | | | |
| prM | 173 | 0 | 1 | 1 | 0 | EDTITYECP | 100 | Y | | | | | | | |

FIG. 36-7

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 174 | 0 | 1 | 1 | 0 | Y | DTITYECPK | 100 | | | | | | |
| prM | 175 | 0 | 1 | 1 | 0 | Y | TITYECPKL | 100 | | | | | | |
| prM | 176 | 0.77 | 2 | 2 | 0 | Y | ITYECPKLT | 77.61 | ITYECPKLA | 22.39 | | | | |
| prM | 185 | 1.17 | 5 | 5 | 0 | Y | MGNDPEDVD | 74.63 | VGNDPEDVD | 16.42 | AGNDPEDVD | 5.97 | TGNDPEDVD | 1.49 | PGNDPQDVD | 1.49 |
| prM | 186 | 0.11 | 2 | 2 | 0 | Y | GNDPEDVDC | 98.51 | GNDPQDVDC | 1.49 | | | | |
| prM | 187 | 0.11 | 2 | 2 | 0 | Y | NDPEDVDCW | 98.51 | NDPQDVDCW | 1.49 | | | | |
| prM | 188 | 0.11 | 2 | 2 | 0 | Y | DPEDVDCWC | 98.51 | DPQDVDCWC | 1.49 | | | | |
| prM | 189 | 0.11 | 2 | 2 | 0 | Y | PEDVDCWCD | 98.51 | PQDVDCWCD | 1.49 | | | | |
| prM | 190 | 0.11 | 2 | 2 | 0 | Y | EDVDCWCDN | 98.51 | QDVDCWCDH | 1.49 | | | | |
| prM | 191 | 0.11 | 2 | 2 | 0 | Y | DVDCWCDNQ | 98.51 | DVDCWCDHQ | 1.49 | | | | |
| prM | 192 | 0.3 | 3 | 3 | 0 | Y | VDCWCDNQE | 95.52 | VDCWCDNQQ | 2.99 | VDCWCDHQE | 1.49 | | |
| prM | 193 | 0.3 | 3 | 3 | 0 | Y | DCWCDNQEV | 95.52 | DCWCDNQQV | 2.99 | DCWCDHQEV | 1.49 | | |
| prM | 194 | 0.3 | 3 | 3 | 0 | Y | CWCDNQEVY | 95.52 | CWCDNQQVY | 2.99 | CWCDHQEVY | 1.49 | | |
| prM | 195 | 0.42 | 4 | 4 | 0 | Y | WCDNQEVYY | 94.03 | WCDNQQVYV | 2.99 | WCDNQEVYI | 1.49 | WCDHQEVYV | 1.49 |
| prM | 196 | 0.42 | 4 | 4 | 0 | Y | CDNQEVYVQ | 94.03 | CDNQQVYVQ | 2.99 | CDHQEVYVQ | 1.49 | CDNQEVYIQ | 1.49 |
| prM | 197 | 0.42 | 4 | 4 | 0 | Y | DNQEVYVQY | 94.03 | DNQQVYVQY | 2.99 | DNQEVYIQY | 1.49 | DHQEVYVQY | 1.49 |
| prM | 198 | 0.42 | 4 | 4 | 0 | Y | NQEVYVQYG | 94.03 | NQQVYVQYG | 2.99 | NQEVYIQYG | 1.49 | HQEVYVQYG | 1.49 |
| prM | 199 | 0.3 | 3 | 3 | 0 | Y | QEVYVQYGP | 95.52 | QQVYVQYGP | 2.99 | QEVYIQYGP | 1.49 | | |
| prM | 200 | 0.3 | 3 | 3 | 0 | Y | EVYVQYGPC | 95.52 | QVYVQYGPC | 2.99 | EVYIQYGRC | 1.49 | | |
| prM | 201 | 0.3 | 3 | 3 | 0 | Y | VYVQYGRCT | 95.52 | VYVQYGPCT | 2.99 | VYIQYGRCT | 1.49 | | |
| prM | 202 | 0.3 | 3 | 3 | 0 | Y | YVQYGRCTR | 95.52 | YVQYGPCTR | 2.99 | YIQYGRCTR | 1.49 | | |
| prM | 203 | 0.3 | 3 | 3 | 0 | Y | VQYGRCTRT | 95.52 | VQYGPCTRT | 2.99 | IQYGRCTRT | 1.49 | | |
| prM | 204 | 0.3 | 3 | 3 | 0 | Y | QYGRCTRTR | 95.52 | QYGPCTRTR | 2.99 | QYGRCTRTS | 1.49 | | |
| prM | 205 | 0.3 | 3 | 3 | 0 | Y | YGRCTRTRH | 95.52 | YGPCTRTRH | 2.99 | YGRCTRTSH | 1.49 | | |
| prM | 206 | 0.3 | 3 | 3 | 0 | Y | GRCTRTRHS | 95.52 | GPCTRTRHS | 2.99 | GRCTRTSHS | 1.49 | | |

FIG. 36-8

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 207 | 0.3 | 3 | 3 | 0 | Y | RC

FIG. 36-9

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 232 | 0.33 | 4 | 4 | 0 | Y | VNKKEAWLD | 95.52 | VNKKEAWLN | 1.49 | ENKKEAWLD | 1.49 | VNKKKAWLD | 1.49 |
| prM | 233 | 0.22 | 3 | 3 | 0 | Y | NKKEAWLDS | 97.01 | NKKEAWLDS | 1.49 | NKKEAWLNS | 1.49 | | |
| prM | 234 | 0.22 | 3 | 3 | 0 | Y | KKEAWLDST

FIG. 36-10

Species: JEV (9-mers)

| protein | block starting position | block entropy | total peptides in block | peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 257 | 0 | 1 | 1 | 0 | Y | RNPGYAFLA | 100 | | | | | | |
| prM | 258 | 0.22 | 3 | 3 | 0 | Y | NPGYAFLAA | 97.01 | NPGYAFLAV | 1.49 | NPGYAFLAG | 1.49 | | |
| prM | 267 | 1.58 | 5 | 5 | 0 | Y | VLGWMLGSN | 59.7 | ALGWMLGSN | 25.37 | ILGWMLGSN | 7.46 | VLGWMLGST | 4.48 |
| prM | 268 | 0.94 | 4 | 4 | 0 | Y | LGWMLGSNN | 79.1 | LGWMLGSNS | 16.42 | LGWMLGSTT | 2.99 | LGWMLGSTN | 1.49 |
| prM | 269 | 0.94 | 4 | 4 | 0 | Y | GWMLGSNNG | 79.1 | GWMLGSNSG | 16.42 | GWMLGSTTG | 2.99 | GWMLGSTNG | 1.49 |
| prM | 277 | 0.33 | 4 | 4 | 0 | Y | GQRVVFTIL | 95.52 | GPRVVFTIL | 1.49 | GHRVVFTIL | 1.49 | GQRLGFTIL | 1.49 |
| prM | 278 | 0.45 | 5 | 5 | 0 | Y | QRVVFTILL | 94.03 | HRVVFTILL | 1.49 | QRVVFTILP | 1.49 | QRLGFTILL | 1.49 |
| prM | 279 | 0.22 | 3 | 3 | 0 | Y | RVVFTILLL | 97.01 | RVVFTILPL | 1.49 | RLGFTILLL | 1.49 | | |
| prM | 280 | 0.22 | 3 | 3 | 0 | Y | VVFTILLLL | 97.01 | VVFTILPLL | 1.49 | VVFTILPLL | 1.49 | | |
| prM | 281 | 0.22 | 3 | 3 | 0 | Y | VFTILLLLV | 97.01 | VFTILPLLV | 1.49 | GFTILLLLV | 1.49 | | |
| prM | 282 | 0.11 | 2 | 2 | 0 | Y | FTILLLLVA | 98.51 | FTILPLLVA | 1.49 | | | | |
| prM | 283 | 0.11 | 2 | 2 | 0 | Y | TILLLLVAP | 98.51 | TILPLLVAP | 1.49 | | | | |
| prM | 284 | 0.11 | 2 | 2 | 0 | Y | ILLLLVAPA | 98.51 | ILPLLVAPA | 1.49 | | | | |
| prM | 285 | 0.11 | 2 | 2 | 0 | Y | LLLLVAPAY | 98.51 | LPLLVAPAY | 1.49 | | | | |
| prM | 286 | 0.11 | 2 | 2 | 0 | Y | LLLVAPAYS | 98.51 | PLLVAPAYS | 1.49 | | | | |
| prM | 287 | 0 | 1 | 1 | 0 | Y | LLVAPAYSF | 100 | | | | | | |
| prM | 288 | 0.11 | 2 | 2 | 0 | Y | LVAPAYSFN | 98.51 | LVAPAYSFT | 1.49 | | | | |
| prM | 289 | 0.11 | 2 | 2 | 0 | Y | VAPAYSFNC | 98.51 | VAPAYSFTC | 1.49 | | | | |
| prM | 290 | 0.11 | 2 | 2 | 0 | Y | APAYSFNCL | 98.51 | APAYSFTCL | 1.49 | | | | |
| prM | 291 | 0.11 | 2 | 2 | 0 | Y | PAYSFNCLG | 98.51 | PAYSFTCLG | 1.49 | | | | |
| prM | 292 | 0.11 | 2 | 2 | 0 | Y | AYSFNCLGM | 98.51 | AYSFTCLGM | 1.49 | | | | |
| prM | 293 | 0.11 | 2 | 2 | 0 | Y | YSFNCLGMG | 98.51 | YSFTCLGMG | 1.49 | | | | |
| prM | 294 | 0.11 | 2 | 2 | 0 | Y | SFNCLGMGN | 98.51 | SFTCLGMGN | 1.49 | | | | |
| E | 295 | 0.11 | 2 | 2 | 0 | Y | FNCLGMGNR | 98.51 | FTCLGMGNR | 1.49 | | | | |
| E | 296 | 0.11 | 2 | 2 | 0 | Y | NCLGMGNRD | 98.51 | TCLGMGNRD | 1.49 | | | | |

FIG. 36-11

Species: JEV (9-mers)

| protein | block starting position | entropy block | total peptides in block | peptides required to cover 99% of block | gap/X fraction | 99% of block | covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|---|
| E | 297 | 0 | 1 | 1 | 0 | — | Y | CLGMGNRDF | 100 | | | | | | | | |
| E | 298 | 0.11 | 2 | 2 | 0 | — | Y | LGMGNRDFH | 98.51 | LGMGNRDFV | 1.49 | | | | | | |
| E | 299 | 0.22 | 3 | 3 | 0 | — | Y | GMGNRDFIE | 97.01 | GMGNRDFVE | 1.49 | | | | | | |
| E | 300 | 0.33 | 4 | 4 | 0 | — | Y | MGNRDFIEG | 95.52 | MGNRDFVEG | 1.49 | | | | | | |
| E | 301 | 0.45 | 5 | 5 | 0 | — | Y | GNRDFIEGA | 94.03 | GNRDFIQGA | 1.49 | GM

FIG. 36-12

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 322 | 0.19 | 2 | 2 | 0 | Y | DSCLTIMAN | 97.01 | DSCLTIMAS | 2.99 | | | | |
| E | 323 | 0.19 | 2 | 2 | 0 | Y | SCLTIMAND | 97.01 | SCLTIMASD | 2.99 | | | | |
| E | 324 | 0.3 | 3 | 3 | 0 | Y | CLTIMANDK | 95.52 | CLTIMASDK | 2.99 | CLTIMANDR | 1.49 | | |
| E | 325 | 0.3 | 3 | 3 | 0 | Y | LTIMANDKP | 95.52 | LTIMASDKP | 2.99 | LTIMANDRP | 1.49 | | |
| E | 326 | 0.3 | 3 | 3 | 0 | Y | TIMANDKPT | 95.52 | TIMASDKPT | 2.99 | TIMANDRPT | 1.49 | | |
| E | 327 | 0.3 | 3 | 3 | 0 | Y | IMANDKPTL | 95.52 | IMASDKPTL | 2.99 | IMANDRPTL | 1.49 | | |
| E | 328 | 0.3 | 3 | 3 | 0 | Y | MANDKPTLD | 95.52 | MASDKPTLD | 2.99 | MANDRPTLD | 1.49 | | |
| E | 329 | 0.42 | 4 | 4 | 0 | Y | ANDKPTLDV | 94.03 | ASDKPTLDV | 2.99 | ANDRPTLDV | 1.49 | ANDKPTLDR | 1.49 |
| E | 330 | 0.42 | 4 | 4 | 0 | Y | NDKPTLDVR | 94.03 | SDKPTLDVR | 2.99 | NDRPTLDVR | 1.49 | NDKPTLDRR | 1.49 |
| E | 331 | 0.22 | 3 | 3 | 0 | Y | DKPTLDVRM | 97.01 | DKPTLDRRM | 1.49 | DRPTLDVRM | 1.49 | KPTLDVRMT | 1.49 |
| E | 332 | 0.33 | 4 | 4 | 0 | Y | KPTLDVRMI | 95.52 | KPTLDRRMI | 1.49 | RPTLDVRMI | 1.49 | | |
| E | 333 | 0.22 | 3 | 3 | 0 | Y | PTLDVRMIN | 97.01 | PTLDRRMIN | 1.49 | PTLDVRMTN | 1.49 | | |
| E | 334 | 0.22 | 3 | 3 | 0 | Y | TLDVRMINI | 97.01 | TLDRRMINI | 1.49 | TLDVRMTNI | 1.49 | | |
| E | 335 | 0.22 | 3 | 3 | 0 | Y | LDVRMINIE | 97.01 | LDRRMINIE | 1.49 | LDVRMTNIE | 1.49 | | |
| E | 336 | 0.22 | 3 | 3 | 0 | Y | DVRMINIEA | 97.01 | DRRMINIEA | 1.49 | DVRMTNIEA | 1.49 | | |
| E | 337 | 0.49 | 4 | 4 | 0 | Y | VRMINIEAS | 92.54 | VRMINIEAV | 4.48 | RRMINIEAS | 1.49 | VRMTNIEAS | 1.49 |
| E | 338 | 0.37 | 3 | 3 | 0 | Y | RMINIEASQ | 94.03 | RMINIEAVQ | 4.48 | RMTNIEASQ | 1.49 | | |
| E | 339 | 0.37 | 3 | 3 | 0 | Y | MINIEASQL | 94.03 | MINIEAVQL | 4.48 | MTNIEASQL | 1.49 | | |
| E | 340 | 0.37 | 3 | 3 | 0 | Y | INIEASQLA | 94.03 | INIEAVQLA | 4.48 | TNIEASQLA | 1.49 | | |
| E | 341 | 0.26 | 2 | 2 | 0 | Y | NIEASQLAE | 95.52 | NIEAVQLAE | 4.48 | | | | |
| E | 342 | 0.26 | 2 | 2 | 0 | Y | IEASQLAEV | 95.52 | IEAVQLAEV | 4.48 | | | | |
| E | 343 | 0.26 | 2 | 2 | 0 | Y | EASQLAEVR | 95.52 | EAVQLAEVR | 4.48 | | | | |
| E | 344 | 0.26 | 2 | 2 | 0 | Y | ASQLAEVRS | 95.52 | AVQLAEVRS | 4.48 | | | | |
| E | 345 | 0.26 | 2 | 2 | 0 | Y | SQLAEVRSY | 95.52 | VQLAEVRSY | 4.48 | | | | |
| E | 346 | 0.11 | 2 | 2 | 0 | Y | QLAEVRSYC | 98.51 | QLAEVRSY | 1.49 | | | | |

FIG. 36-13

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides

FIG. 36-14

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 372 | 0.33 | 4 | 4 | 0 | Y | GEAHNEKRA | 95.52 | GEAHNEKQA | 1.49 | GEAHNKKRA | 1.49 | GEAHNEKGA | 1.49 | | |
| E | 373 | 0.33 | 4 | 4 | 0 | Y | EAHNEKRAD | 95.52 | EAHNEKGAD | 1.49 | EAHNKKRAD | 1.49 | EAHNEKQAD | 1.49 | | |
| E | 374 | 0.33 | 4 | 4 | 0 | Y | AHNEKRADS | 95.52 | AHNEKGADS | 1.49 | AHNKKRADS | 1.49 | AHNEKQADS | 1.49 | | |
| E | 375 | 0.33 | 4 | 4 | 0 | Y | HNEKRADSS | 95.52 | HNEKQADSS | 1.49 | HNEKGADSS | 1.49 | HNKKRADSS | 1.49 | | |
| E | 376 | 0.33 | 4 | 4 | 0 | Y | NEKRADSSY | 95.52 | NEKQADSSY | 1.49 | NEKGADSSY | 1.49 | NKKRADSSY | 1.49 | | |
| E | 377 | 0.33 | 4 | 4 | 0 | Y | EKRADSSYV | 95.52 | KKRADSSYV | 1.49 | EKGADSSYV | 1.49 | EKQADSSYY | 1.49 | | |
| E | 378 | 0.22 | 3 | 3 | 0 | Y | KRADSSYVC | 97.01 | KGADSSYVC | 1.49 | KQADSSYVC | 1.49 | | | | |
| E | 379 | 0.22 | 3 | 3 | 0 | Y | RADSSYVCK | 97.01 | GADSSYVCK | 1.49 | QADSSYVCK | 1.49 | | | | |
| E | 380 | 0 | 1 | 1 | 0 | Y | ADSSYVCKQ | 100 | | | | | | | | |
| E | 381 | 0 | 1 | 1 | 0 | Y | DSSYVCKQG | 100 | | | | | | | | |
| E | 382 | 0 | 1 | 1 | 0 | Y | SSYVCKQGF | 100 | | | | | | | | |
| E | 383 | 0 | 1 | 1 | 0 | Y | SYVCKQGFT | 100 | | | | | | | | |
| E | 384 | 0 | 1 | 1 | 0 | Y | YVCKQGFTD | 100 | | | | | | | | |
| E | 385 | 0 | 1 | 1 | 0 | Y | VCKQGFTDR | 100 | | | | | | | | |
| E | 386 | 0 | 1 | 1 | 0 | Y | CKQGFTDRG | 100 | | | | | | | | |
| E | 387 | 0 | 1 | 1 | 0 | Y | KQGFTDRGW | 100 | | | | | | | | |
| E | 388 | 0.11 | 2 | 2 | 0 | Y | QGFTDRGWG | 98.51 | QGFTDRGWR | 1.49 | | | | | | |
| E | 389 | 0.22 | 3 | 3 | 0 | Y | GFTDRGWGN | 97.01 | GFTDRGWGK | 1.49 | GFTDRGWRN | 1.49 | | | | |
| E | 390 | 0.22 | 3 | 3 | 0 | Y | FTDRGWGNG | 97.01 | FTDRGWGKG | 1.49 | FTDRGWRNG | 1.49 | | | | |
| E | 391 | 0.22 | 3 | 3 | 0 | Y | TDRGWGNGC | 97.01 | TDRGWGKGC | 1.49 | TDRGWRNGC | 1.49 | | | | |
| E | 392 | 0.22 | 3 | 3 | 0 | Y | DRGWGNGCG | 97.01 | DRGWGKGCG | 1.49 | DRGWGKCCG | 1.49 | | | | |
| E | 393 | 0.49 | 4 | 4 | 0 | Y | RGWGNGCGL | 92.54 | RGWGNGCGF | 4.48 | RGWGKGCGL | 1.49 | RGWRNGCGL | 1.49 | | |
| E | 394 | 0.6 | 5 | 5 | 0 | Y | GWGNGCGLF | 91.04 | GWGNGCGFF | 4.48 | GWGNGCGLS | 1.49 | GWGKGCGLF | 1.49 | GWRNGCGLF | 1.49 |
| E | 395 | 0.6 | 5 | 5 | 0 | Y | WGNGCGLFG | 91.04 | WGNGCGFFG | 4.48 | WGKGCGLFG | 1.49 | WGNGCGLSG | 1.49 | WRNGCGLFG | 1.49 |
| E | 396 | 0.6 | 5 | 5 | 0 | Y | GNGCGLFGK | 91.04 | GNGCGFFGK | 4.48 | RNGCGLFGK | 1.49 | GNGCGLSGK | 1.49 | GKGCGLFGK | 1.49 |

FIG. 36-15

Species: JEV (9-mers)

| protein | block starting position | entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 397 | 0.49 | 4 | 4 | 0 | Y | NG

FIG. 36-16

Species: JEV (9-mers)

| protein | block starting position | entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 430 | 0.64 | 2 | 2 | 0 | Y | KYEVGIFVH | 83.58 | KYKVGIFVH | 16.42 | | | | |
| E | 431 | 0.64 | 2 | 2 | 0 | Y | YEVGIFVHG | 83.58 | YKVGIFVHG | 16.42 | | | | |
| E | 432 | 0.94 | 4 | 4 | 0 | Y | EVGIFVHGT | 80.6 | KVGIFVHGT | 13.43 | EVGIFVHGA | 2.99 | KVGIFVHGA | 2.99 |
| E | 433 | 0.33 | 2 | 2 | 0 | Y | VGIFVHGTT | 94.03 | VGIFVHGAT | 5.97 | | | | |
| E | 434 | 0.33 | 2 | 2 | 0 | Y | GIFVHGTTT | 94.03 | GIFVHGATT | 5.97 | | | | |
| E | 435 | 0.33 | 2 | 2 | 0 | Y | IFVHGTTTS | 94.03 | IFVHGATTS | 5.97 | | | | |
| E | 436 | 0.33 | 2 | 2 | 0 | Y | FVHGTTTSE | 94.03 | FVHGATTSE | 5.97 | | | | |
| E | 437 | 0.33 | 2 | 2 | 0 | Y | VHGTTTSEN | 94.03 | VHGATTSEN | 5.97 | | | | |
| E | 438 | 0.33 | 2 | 2 | 0 | Y | HGTTTSENH | 94.03 | HGATTSENH | 5.97 | | | | |
| E | 439 | 0.33 | 2 | 2 | 0 | Y | GTTTSENHG | 94.03 | GATTSENHG | 5.97 | | | | |
| E | 440 | 0.33 | 2 | 2 | 0 | Y | TTTSENHGN | 94.03 | ATTSENHGN | 5.97 | | | | |
| E | 441 | 0 | 1 | 1 | 0 | Y | TTSENHGNY | 100 | | | | | | |
| E | 442 | 0.11 | 2 | 2 | 0 | Y | TSENHGNYS | 98.51 | TSENHGNYT | 1.49 | | | | |
| E | 443 | 0.11 | 2 | 2 | 0 | Y | SENHGNYSA | 98.51 | SENHGNYTA | 1.49 | | | | |
| E | 444 | 0.11 | 2 | 2 | 0 | Y | ENHGNYSAQ | 98.51 | ENHGNYTAQ | 1.49 | | | | |
| E | 445 | 0.11 | 2 | 2 | 0 | Y | NHGNYSAQV | 98.51 | NHGNYTAQI | 1.49 | | | | |
| E | 446 | 0.11 | 2 | 2 | 0 | Y | HGNYSAQVG | 98.51 | HGNYTAQIG | 1.49 | | | | |
| E | 447 | 0.42 | 4 | 4 | 0 | Y | GNYSAQVGA | 94.03 | GNYSAQVGT | 2.99 | GNYTAQIGA | 1.49 | GNYSAQVGV | 1.49 |
| E | 448 | 0.42 | 4 | 4 | 0 | Y | NYSAQVGAS | 94.03 | NYSAQVGTS | 2.99 | NYSAQVGVS | 1.49 | NYTAQIGAS | 1.49 |
| E | 449 | 0.42 | 4 | 4 | 0 | Y | YSAQVGASQ | 94.03 | YSAQVGTSQ | 2.99 | YSAQVGTSQ | 1.49

FIG. 36-17

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 455 | 0.68 | 5 | 5 | 0 | Y | ASQAAKFTV | 89.55 | ASQAAKFTI | 4.48 | TSQAAKFTV | 2.99 | VSQAAKFTV | 1

FIG. 36-18

Species: JEV (9-mers)

| protein | block starting position | block entropy | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 482 | 0.22 | 3 | 3 | 0 | Y | LDCEPRSGL | 97.01 | LDCEPKSGL | 1

FIG. 36-19

Species: JEV (9

FIG. 36-20

Species: J

FIG. 36-21

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 557 | 0.33 | 2 | 2 | 0 | Y | HQALAGAIV | 94.03 | HHALAGAIV | 5.97 | | | | |
| E | 558 | 0.33 | 2 | 2 | 0 | Y | QALAGAIVW | 94.03 | HALAGAIVW | 5.97 | | | | |
| E | 559 | 0 | 1 | 1 | 0 | Y | ALAGAIVWE | 100 | | | | | | |
| E | 560 | 0 | 1 | 1 | 0 | Y | LAGAIVWEY | 100 | | | | | | |
| E | 561 | 0.11 | 2 | 2 | 0 | Y | AGAIVWEYS | 98.51 | AGAIVWEYP | 1.49 | | | | |
| E | 562 | 0.22 | 3 | 3 | 0 | Y | GAIVWEYSS | 97.01 | GAIVWEYPS | 1.49 | GAIVWEYSN | 1.49 | | |
| E | 563 | 0.22 | 3 | 3 | 0 | Y | AIVWEYSSS | 97.01 | AIVWEYPSS | 1.49 | AIVWEYSNS | 1.49 | | |
| E | 564 | 0.22 | 3 | 3 | 0 | Y | IVWEYSSSV | 97.01 | IVWEYPSSV | 1.49 | IVWEYSNSV | 1.49 | | |
| E | 565 | 0.42 | 4 | 4 | 0 | Y | VWEYSSSVM | 94.03 | VWEYSSSVM | 2.99 | VWEYPSSVK | 1.49 | VWEYSNSVK | 1.49 |
| E | 566 | 0.42 | 4 | 4 | 0 | Y | VEYSSSVKL | 94.03 | VEYSSSVML | 2.99 | VEYPSSVKL | 1.49 | VEYPSSVKL | 1.49 |
| E | 567 | 0.42 | 4 | 4 | 0 | Y | EYSSSVKLT | 94.03 | EYSSSVMLT | 2.99 | EYPSSVKLT | 1.49 | EYSNSVKLT | 1.49 |
| E | 568 | 0.42 | 4 | 4 | 0 | Y | YSSSVKLTS | 94.03 | YSSSVMLTS | 2.99 | YPSSVKLTS | 1.49 | YSNSVKLTS | 1.49 |
| E | 569 | 0.42 | 4 | 4 | 0 | Y | SSSVKLTSG | 94.03 | SSSVMLTSG | 2.99 | SNSVKLTSG | 1.49 | PSSVKLTSG | 1.49 |
| E | 570 | 0.3 | 3 | 3 | 0 | Y | SSVKLTSGH | 95.52 | SSVMLTSGH | 2.99 | NSVKLTSGH | 1.49 | | |
| E | 571 | 0.3 | 3 | 3 | 0 | Y | SVKLTSGHL | 95.52 | SVMLTSGHL | 2.99 | SVKLTSGHV | 1.49 | | |
| E | 572 | 0.3 | 3 | 3 | 0 | Y | VKLTSGHLK | 95.52 | VMLTSGHLK | 2.99 | VKLTSGHVK | 1.49 | | |
| E | 573 | 0.3 | 3 | 3 | 0 | Y | KLTSGHLKC | 95.52 | MLTSGHLKC | 2.99 | KLTSGHVKR | 1.49 | | |
| E | 574 | 0.11 | 2 | 2 | 0 | Y | LTSGHLKCR | 98.51 | LTSGHVKRR | 1.49 | | | | |
| E | 575 | 0.11 | 2 | 2 | 0 | Y | TSGHLKCRL | 98.51 | TSGHVKRRL | 1.49 | | | | |
| E | 576 | 0.22 | 3 | 3 | 0 | Y | SGHLKCRLK | 97.01 | SGHVKRRLK | 1.49 | SGHLKCRLR | 1.49 | | |
| E | 577 | 0.22 | 3 | 3 | 0 | Y | GHLKCRLKM | 97.01 | GHVKRRLKM | 1.49 | GHLKCRLRM | 1.49 | | |
| E | 578 | 0.22 | 3 | 3 | 0 | Y | HLKCRLKMD | 97.01 | HLKCRLRMD | 1.49 | HVKRRLKMD | 1.49 | | |
| E | 579 | 0.22 | 3 | 3 | 0 | Y | LKCRLKMDK | 97.01 | VKRRLKMDK | 1.49 | LKCRLRMDK | 1.49 | | |
| E | 580 | 0.22 | 3 | 3 | 0 | Y | KCRLKMDKL | 97.01 | KCRLRMDKL | 1.49 | KRRLKMDKL | 1.49 | | |
| E | 581 | 0.22 | 3 | 3 | 0 | Y | CRLKMDKLA | 97.01 | CRLKMDKLA | 1.49 | RRLKMDKLA | 1.49 | | |

FIG. 36-22

| Species: JEV (9-mers) protein | block starting position | block entropy | total peptides in block | peptides required to cover 99% of block | gap/X fraction | 99% of block covered w/ <= 5

FIG. 36-23

Species: JEV (9-mers)

| protein | block starting position | entropy block | total peptides in block | peptides required to cover 99% of block | gap/X fraction 99% of block | covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 607 | 0.33 | 2 | 2 | 0 | Y | NPADTGHGT | 94.03 | NPVDTGHGT | 5.97 | | | | |
| E | 608 | 0.33 | 2 | 2 | 0 | Y | PADTGHGTV | 94.03 | PVDTGHGTV | 5.97 | | | | |
| E | 609 | 0.33 | 2 | 2 | 0 | Y | ADTGHGTW | 94.03 | VDTGHGTW | 5.97 | | | | |
| E | 610 | 0 | 1 | 1 | 0 | Y | DTGHGTWI | 100 | | | | | | |
| E | 611 | 0 | 1 | 1 | 0 | Y | TGHGTWIE | 100 | | | | | | |
| E | 612 | 0 | 1 | 1 | 0 | Y | GHGTWIEL | 100 | | | | | | |
| E | 613 | 0.79 | 3 | 3 | 0 | Y | HGTWIELS | 80.6 | HGTWIELT | 17.91 | HGTWIELL | 1.49 | | |
| E | 614 | 0.79 | 3 | 3 | 0 | Y | GTWIELSY | 80.6 | GTWIELTY | 17.91 | GTWIELLY | 1.49 | | |
| E | 615 | 0.79 | 3 | 3 | 0 | Y | TWIELSYS | 80.6 | TWIELTYS | 17.91 | TWIELLYS | 1.49 | | |
| E | 616 | 0.79 | 3 | 3 | 0 | Y | WIELSYSG | 80.6 | WIELTYSG | 17.91 | WIELLYSG | 1.49 | | |
| E | 617 | 0.89 | 4 | 4 | 0 | Y | VIELSYSGS | 79.1 | VIELTYSGS | 17.91 | VIELLYSGS | 1.49 | VIELSYSGR | 1.49 | |
| E | 618 | 0.89 | 4 | 4 | 0 | Y | IELSYSGSD | 79.1 | IELTYSGSD | 17.91 | IELLYSGSD | 1.49 | IELSYSGRD | 1.49 | |
| E | 619 | 0.89 | 4 | 4 | 0 | Y | ELSYSGSDG | 79.1 | ELTYSGSDG | 17.91 | ELLYSGSDG | 1.49 | ELLYSGSDG | 1.49 | |
| E | 620 | — | 4 | 5 | 0 | Y | LSYSGSDGP | 77.61 | LTYSGSDGP | 17.91 | LLYSGSDGP | 1.49 | LSYSGSDGS | 1.49 | LSYSGRDGP | 1.49 |
| E | 621 | — | 4 | 5 | 0 | Y | SYSGSDGPC | 77.61 | TYSGSDGPC | 17.91 | SYSGSDGSC | 1.49 | SYSGRDGPC | 1.49 | LYSGSDGPC | 1.49 |
| E | 622 | 0.22 | 3 | 3 | 0 | Y | YSGSDGPCK | 97.01 | YSGSDGPCK | 1.49 | YSGSDGSCK | 1.49 | | | |
| E | 623 | 0.22 | 3 | 3 | 0 | Y | SGSDGPCKI | 97.01 | SGRDGPCKI | 1.49 | SGSDGSCKI | 1.49 | | | |
| E | 624 | 0.22 | 3 | 3 | 0 | Y | GSDGPCKIP | 97.01 | GRDGPCKIP | 1.49 | GSDGSCKIP | 1.49 | | | |
| E | 625 | 0.22 | 3 | 3 | 0 | Y | SDGPCKIPI | 97.01 | RDGPCKIPI | 1.49 | | | | | |
| E | 626 | 0.11 | 2 | 2 | 0 | Y | DGPCKIPIV | 98.51 | DGSCKIPIV | 1.49 | | | | | |
| E | 627 | 0.11 | 2 | 2 | 0 | Y | GPCKIPIVS | 98.51 | GSCKIPIVS | 1.49 | | | | | |
| E | 628 | 0.11 | 2 | 2 | 0 | Y | PCKIPIVSV | 98.51 | SCKIPIVSV | 1.49 | | | | | |
| E | 629 | 0.11 | 2 | 2 | 0 | Y | CKIPIVSVA | 98.51 | CKIPIVSVA | 1.49 | | | | | |
| E | 630 | 0.22 | 3 | 3 | 0 | Y | KIPIVSVAS | 97.01 | KIPIVSVWS | 1.49 | KIPIVSVAN | 1.49 | | | |
| E | 631 | 0.22 | 3 | 3 | 0 | Y | IPIVSVASL | 97.01 | IPIVSVWSL | 1.49 | IPIVSVANL | 1.49 | | | |

FIG. 36-24

Species: JEV (9-mers)

| protein | block starting position | entropy block | total peptides in block | peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 632 | 0.22 | 3 | 3 | 0 | Y | PIWSVASLN | 97.01 | PIWSVASLN | 1.49 | | | | |
| E | 633 | 0.22 | 3 | 3 | 0 | Y | IWSVASLND | 97.01 | IWSVASLND | 1.49 | | | | |
| E | 634 | 0.55 | 4 | 4 | 0 | Y | VSVASLNDM | 91.04 | VSVASLNDL | 5.97 | VSWSLNDM | 1.49 | | |
| E | 635 | 0.55 | 4 | 4 | 0 | Y | SVASLNDMT | 91.04 | SVASLNDLT | 5.97 | SWSLNDMT | 1.49 | | |
| E | 636 | 0.55 | 4 | 4 | 0 | Y | VASLNDMTP | 91.04 | VASLNDLTP | 5.97 | VANLNDMTP | 1.49 | | |
| E | 637 | 0.66 | 5 | 5 | 0 | Y | ASLNDMTPV | 89.55 | ASLNDLTPV | 5.97 | ANLNDMTPV | 1.49 | ASLNDMTPA | 1.49 |
| E | 638 | 0.55 | 4 | 4 | 0 | Y | SLNDMTPVG | 91.04 | SLNDLTPVG | 5.97 | SLNDMTPAG | 1.49 | NLNDMTPVG | 1.49 |
| E | 639 | 0.44 | 3 | 3 | 0 | Y | LNDMTPVGR | 92.54 | LNDLTPVGR | 5.97 | LNDMTPAGR | 1.49 | | |
| E | 640 | 0.44 | 3 | 3 | 0 | Y | NDMTPVGRL | 92.54 | NDLTPVGRL | 5.97 | NDMTPAGRL | 1.49 | | |
| E | 641 | 0.44 | 3 | 3 | 0 | Y | DMTPVGRLV | 92.54 | DLTPVGRLV | 5.97 | DMTPAGRLV | 1.49 | | |
| E | 642 | 0.44 | 3 | 3 | 0 | Y | MTPVGRLVT | 92.54 | LTPVGRLVT | 5.97 | MTPAGRLVT | 1.49 | | |
| E | 643 | 0.11 | 2 | 2 | 0 | Y | TPVGRLVTV | 98.51 | TPAGRLVTV | 1.49 | | | | |
| E | 644 | 0.11 | 2 | 2 | 0 | Y | PVGRLVTVN | 98.51 | PAGRLVTVN | 1.49 | | | | |
| E | 645 | 0.11 | 2 | 2 | 0 | Y | VGRLVTVNP | 98.51 | AGRLVTVNP | 1.49 | | | | |
| E | 646 | 0 | 1 | 1 | 0 | Y | GRLVTVNPF | 100 | | | | | | |
| E | 647 | 0 | 1 | 1 | 0 | Y | RLVTVNPFV | 100 | | | | | | |
| E | 648 | 0 | 1 | 1 | 0 | Y | LVTVNPFVA | 100 | | | | | | |
| E | 649 | 0.26 | 2 | 2 | 0 | Y | VTVNPFVAT | 95.52 | VTVNPFVAA | 4.48 | | | | |
| E | 650 | 0.26 | 2 | 2 | 0 | Y | TVNPFVATS | 95.52 | TVNPFVAAS | 4.48 | | | | |
| E | 651 | 0.26 | 2 | 2 | 0 | Y | VNPFVATSS | 95.52 | VNPFVAASS | 4.48 | | | | |
| E | 652 | 0.93 | 3 | 3 | 0 | Y | NPFVATSSA | 77.61 | NPFVATSSS | 17.91 | NPFVAASSA | 4.48 | | |
| E | 653 | 0.93 | 3 | 3 | 0 | Y | PFVATSSAN | 77.61 | PFVATSSSN | 17.91 | PFVAASSAN | 4.48 | | |
| E | 654 | 0.93 | 3 | 3 | 0 | Y | FVATSSANS | 77.61 | FVATSSSNS | 17.91 | FVAASSANS | 4.48 | | |
| E | 655 | 1 | 4 | 4 | 0 | Y | VATSSANSK | 76.12 | VATSSSNSK | 16.42 | VAASSANSK | 4.48 | VATSSNSQ | 1.49 | VATSSNSQV | 1.49 |
| E | 656 | 1.11 | 5 | 5 | 0 | Y | ATSSANSKV | 76.12 | ATSSSNSKV | 16.42 | AASSANSKV | 4.48 | ATSSANSKA | 1.49 | ATSSNSQV | 1.49 |

FIG. 36-25

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 657 | 1.11 | 5 | 5 | 0 | Y | TSSAN

FIG. 36-26

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| E | 694 | 0.38 | 2 | 2 | 0 | Y | GSTLGKAFS | 92.54 | GSTLGKAFL

FIG. 36-27

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 719 | 0.33 | 4 | 4 | 0 | Y | WDFGSIGGV | 95.52 | WDFGSIGRV | 1.49 | WDFGSIGGA | 1.49 | WDFGSIGGI | 1.49 |
| E | 720 | 0.33 | 4 | 4 | 0 | Y | DFGSIGGVF | 95.52 | DFGSIGRVF | 1.49 | DFGSIGGAF | 1.49 | DFGSIGGIF | 1.49 |
| E | 721 | 0.33 | 4 | 4 | 0 | Y | FGSIGGVFN | 95.52 | FGSIGRVFN | 1.49 | FGSIGGAFN | 1.49 | FGSIGGIFN | 1.49 |
| E | 722 | 0.33 | 4 | 4 | 0 | Y | GSIGGVFNS | 95.52 | GSIGRVFNS | 1.49 | GSIGGAFNS | 1.49 | GSIGGIFNS | 1.49 |
| E | 723 | 0.33 | 4 | 4 | 0 | Y | SIGGVFNSI | 95.52 | SIGRVFNSI | 1.49 | SIGGAFNSI | 1.49 | SIGGIFNSI | 1.49 |
| E | 724 | 0.33 | 4 | 4 | 0 | Y | IGGVFNSIG | 95.52 | IGRVFNSIG | 1.49 | IGGAFNSIG | 1.49 | IGGIFNSIG | 1.49 |
| E | 725 | 0.71 | 5 | 5 | 0 | Y | GGVFNSIGK | 88.06 | GRVFNSIGK | 1.49 | GGAFNSIGK | 1.49 | GGIFNSIGK | 1.49 |
| E | 726 | 0.71 | 5 | 5 | 0 | Y | GVFNSIGKA | 88.06 | GVFNSIGRA | 1.49 | GAFNSIGKA | 1.49 | GIFNSIGKA | 1.49 |
| E | 727 | 0.6 | 4 | 4 | 0 | Y | VFNSIGKAV | 89.55 | VFNSIGRAV | 1.49 | | | IFNSIGKAV | 1.49 |
| E | 728 | 0.38 | 2 | 2 | 0 | Y | FNSIGKAVH | 92.54 | FNSIGRAVH | 7.46 | | | | |
| E | 729 | 0.38 | 2 | 2 | 0 | Y | NSIGKAVHQ | 92.54 | NSIGRAVHQ | 7.46 | | | | |
| E | 730 | 0.38 | 2 | 2 | 0 | Y | SIGKAVHQV | 92.54 | SIGRAVHQV | 7.46 | | | | |
| E | 731 | 0.38 | 2 | 2 | 0 | Y | IGKAVHQVF | 92.54 | IGRAVHQVF | 7.46 | | | | |
| E | 732 | 0.38 | 2 | 2 | 0 | Y | GKAVHQVFG | 92.54 | GRAVHQVFG | 7.46 | | | | |
| E | 733 | 0.44 | 3 | 3 | 0 | Y | KAVHQVFGG | 92.54 | RAVHQVFGG | 5.97 | RAVHQVFGD | 1.49 | | |
| E | 734 | 0.11 | 2 | 2 | 0 | Y | AVHQVFGGA | 98.51 | AVHQVFGDA | 1.49 | | | | |
| E | 735 | 0.11 | 2 | 2 | 0 | Y | VHQVFGGAF | 98.51 | VHQVFGDAF | 1.49 | | | | |
| E | 736 | 0.11 | 2 | 2 | 0 | Y | HQVFGGAFR | 98.51 | HQVFGDAFR | 1.49 | | | | |
| E | 737 | 0.11 | 2 | 2 | 0 | Y | QVFGGAFRT | 98.51 | QVFGDAFRT | 1.49 | | | | |
| E | 738 | 0.11 | 2 | 2 | 0 | Y | VFGGAFRTL | 98.51 | VFGDAFRTL | 1.49 | | | | |
| E | 739 | 0.11 | 2 | 2 | 0 | Y | FGGAFRTLF | 98.51 | FGDAFRTLF | 1.49 | | | | |
| E | 740 | 0.11 | 2 | 2 | 0 | Y | GGAFRTLFG | 98.51 | GDAFRTLFG | 1.49 | | | | |
| E | 741 | 0.11 | 2 | 2 | 0 | Y | GAFRTLFGG | 98.51 | DAFRTLFGG | 1.49 | | | | |
| E | 742 | 0 | 1 | 1 | 0 | Y | AFRTLFGGM | 100 | | | | | | |
| E | 743 | 0 | 1 | 1 | 0 | Y | FRTLFGGMS | 100 | | | | | | |

FIG. 36-28

Species: JEV (9-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 744 | 0 | 1 | 1 | 0 | Y | RTLFGGMSW

FIG. 36-29

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 769 | 0.22 | 3 | 3 | 0 | Y | ARDRSIALA | 97

FIG. 36-30

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99%

FIG. 36-31

Species: JEV (9-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 825 | 0 | 1 | 1 | 0 | Y | RYKYLPETP | 100 | | |

FIG. 36-32

Species: JEV (9-mers)

| protein | block starting position | block entropy | total peptides in block | peptides required to cover 99% of block | gap/X fraction of 99% of block | covered w/ <= 5 peptides? | peptides required to cover 99% of block | frequency | peptides required to cover 99% of block | frequency | peptides required to cover 99%

FIG. 36-33

Species: JEV (9-mers)

| protein | block starting position | block entropy | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 875 | 0 | 1 | 1 | 1.49 | Y | ENAVDLSVV | 98.51 | | | | | | |
| NS1 | 876 | 0 | 1 | 1 | 1.49 | Y | NAVDLSVVN | 98.51 | | | | | | |
| NS1 | 877 | 0 | 1 | 1 | 1.49 | Y | AVDLSVVNK | 98.51 | | | | | | |
| NS1 | 878 | 0 | 1 | 1 | 1.49 | Y | VDLSVVNKP | 98.51 | | | | | | |
| NS1 | 879 | 0 | 1 | 1 | 1.49 | Y | DLSVVNKPV | 98.51 | | | | | | |
| NS1 | 880 | 0 | 1 | 1 | 1.49 | Y | LSVVNKPVG | 98.51 | | | | | | |
| NS1 | 881 | 0 | 1 | 1 | 1.49 | Y | SVVNKPVGR | 98.51 | | | | | | |
| NS1 | 882 | 0 | 1 | 1 | 0 | Y | VVNKPVGRY | 100 | | | | | | |
| NS1 | 883 | 0 | 1 | 1 | 0 | Y | VNKPVGRYR | 100 | | | | | | |
| NS1 | 884 | 0 | 1 | 1 | 0 | Y | NKPVGRYRS | 100 | | | | | | |
| NS1 | 885 | 0 | 1 | 1 | 0 | Y | KPVGRYRST | 100 | | | | | | |
| NS1 | 886 | 0.11 | 2 | 2 | 0 | Y | PVGRYRSTP | 98.51 | KPVGRYRST | | | | | |
| NS1 | 887 | 0.11 | 2 | 2 | 0 | Y | VGRYRSTPK | 98.51 | PVGRYRSTP | | | | | |
| NS1 | 888 | 0.11 | 2 | 2 | 0 | Y | GRYRSTPKR | 98.51 | VGRYRSTPK | | | | | |
| NS1 | 889 | 0.11 | 2 | 2 | 0 | Y | RYRSTPKRL | 98.51 | GRYRSTPKR | | | | | |
| NS1 | 890 | 0.11 | 2 | 2 | 0 | Y | YRSTPKRLS | 98.51 | RYRSTPKRL | | | | | |
| NS1 | 891 | 0.22 | 3 | 3 | 0 | Y | RSAPKRLS | 97.01 | YRSTPKRLS | 1.49 | YRSAPKRLF | 1.49 | | |
| NS1 | 892 | 0.22 | 3 | 3 | 0 | Y | RSAPKRLSM | 97.01 | RSTPKRLSM | 1.49 | RSAPKRLFM | 1.49 | | |
| NS1 | 893 | 0.22 | 3 | 3 | 0 | Y | SAPKRLSMT | 97.01 | STPKRLSMT | 1.49 | SAPKRLFMT | 1.49 | | |
| NS1 | 894 | 0.33 | 4 | 4 | 0 | Y | APKRLSMTQ | 95.52 | APKRLSMTR | 1.49 | APKRLFMTQ | 1.49 | TPKRLSMTQ | 1.49 |
| NS1 | 895 | 0.22 | 3 | 3 | 0 | Y | PKRLSMTQE | 97.01 | PKRLSMTRE | 1.49 | PKRLFMTQE | 1.49 | | |
| NS1 | 896 | 0.22 | 3 | 3 | 0 | Y | KRLSMTQEK | 97.01 | KRLSMTREK | 1.49 | KRLFMTQEK | 1.49 | | |
| NS1 | 897 | 0.22 | 3 | 3 | 0 | Y | RLSMTQEKF | 97.01 | RLSMTREKF | 1.49 | RLFMTQEKF | 1.49 | | |
| NS1 | 898 | 0.22 | 3 | 3 | 0 | Y | LSMTQEKFE | 97.01 | LSMTREKFE | 1.49 | LFMTQEKFE | 1.49 | | |
| NS1 | 899 | 0.22 | 3 | 3 | 0 | Y | SMTQEKFEM | 97.01 | SMTREKFEM | 1.49 | FMTQEKVEM | 1.49 | | |

FIG. 36-34

Species: JEV (9-mers)

| protein | block starting position | block entropy | total peptides in block | peptides required to cover 99% of block | gap/X fraction | 99% of block covered w/ <= 5 peptides? | peptides required to cover 99% of block | fr

FIG. 36-35

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of

FIG. 36-36

Species: JEV (9-mers)

| protein | block starting position | block entropy | total peptides in block | peptides required to cover 99% of block | gap/X fraction | 99% of block covered w/ <= 5 peptides? | peptides required to cover 99% of block

FIG. 36-37

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 975 | 0.3 | 3 | 3 | 0 | Y | GANIGTAVK | 95.52 | GPIIGTAVK | 2.99 | GTIIGTANK | 1.49 | | |
| NS1 | 976 | 0.3 | 3 | 3 | 0 | Y | ANIGTAVKG | 95.52 | PIIGTAVKG | 2.99 | TIIGTAIKG | 1.49 | | |
| NS1 | 977 | 0.3 | 3 | 3 | 0 | Y | IIGTAVKGH | 95.52 | IIGTAVKGN | 2.99 | IIGTAIKGH | 1.49 | | |
| NS1 | 978 | 0.3 | 3 | 3 | 0 | Y | IGTAVKGHV | 95.52 | IGTAVKGNV | 2.99 | IGTAIKGHV | 1.49 | | |
| NS1 | 979 | 0.42 | 4 | 4 | 0 | Y | GTAVKGHVA | 94.03 | GTAVKGNVA | 2.99 | GTAVKGHVT | 1.49 | GTAIKGHVA | 1.49 |
| NS1 | 980 | 0.53 | 5 | 5 | 0 | Y | TAVKGHVAV | 92.54 | TAVKGNVAV | 2.99 | TAVKGHVAL | 1.49 | TAIKGHVAV | 1.49 | TAVKGHVTV | 1.49 |
| NS1 | 981 | 0.53 | 5 | 5 | 0 | Y | AVKGHVAVH | 92.54 | AVKGNVAVH | 2.99 | AIKGHVAVH | 1.49 | AVKGHVTH | 1.49 | AVKGHVALH | 1.49 |
| NS1 | 982 | 0.53 | 5 | 5 | 0 | Y | VKGHVAVHS | 92.54 | VKGNVAVHS | 2.99 | IKGHVAVHS | 1.49 | VKGHVALHS | 1.49 | VKGHVTVHS | 1.49 |
| NS1 | 983 | 0.42 | 4 | 4 | 0 | Y | KGHVAVHSD | 94.03 | KGNVAVHSD | 2.99 | KGHVTHSD | 1.49 | KGHVALHSD | 1.49 | |
| NS1 | 984 | 0.42 | 4 | 4 | 0 | Y | GHVAVHSDL | 94.03 | GNVAVHSDL | 2.99 | GHVALHSDL | 1.49 | GHVTVHSDV | 1.49 | |
| NS1 | 985 | 0.42 | 4 | 4 | 0 | Y | HVAVHSDLS | 94.03 | NVAVHSDLS | 2.99 | HVTVHSDS | 1.49 | HVALHSDLS | 1.49 | |
| NS1 | 986 | 0.22 | 3 | 3 | 0 | Y | VAVHSDLSY | 97.01 | VTVHSDSY | 1.49 | VALHSDLSY | 1.49 | | |
| NS1 | 987 | 0.22 | 3 | 3 | 0 | Y | AVHSDLSYW | 97.01 | ALHSDLSYW | 1.49 | TVHSDVSYW | 1.49 | | |
| NS1 | 988 | 0.22 | 3 | 3 | 0 | Y | VHSDLSYWI | 97.01 | VHSDVSYWI | 1.49 | LHSDLSYWI | 1.49 | | |
| NS1 | 989 | 0.22 | 3 | 3 | 0 | Y | HSDLSYWIE | 97.01 | HSDLSYWIG | 1.49 | HSDVSYWIE | 1.49 | | |
| NS1 | 990 | 0.22 | 3 | 3 | 0 | Y | SDLSYWIES | 97.01 | SDVSYWIES | 1.49 | SDLSYWIGS | 1.49 | | |
| NS1 | 991 | 0.33 | 4 | 4 | 0 | Y | DLSYWIESR | 95.52 | DLSYWIESH | 1.49 | DLSYWIGSR | 1.49 | DVSYWIESR | 1.49 | |
| NS1 | 993 | 1.01 | 5 | 5 | 0 | Y | SYWIESRYN | 79.1 | SYWIESRLN | 14.93 | SYWIESRFN | 2.99 | SYWIESHLN | 1.49 | SYWIGSRYN | 1.49 |
| NS1 | 994 | 1.01 | 5 | 5 | 0 | Y | YWIESRYND | 79.1 | YWIESRLND | 14.93 | YWIESRFND | 2.99 | YWIESHLND | 1.49 | YWIGSRYND | 1.49 |
| NS1 | 1001 | 0.45 | 5 | 5 | 0 | Y | NDTWKLERA | 94.03 | NDSWKLERA | 1.49 | NDSWKLERA | 1.49 | NDTWKRERA | 1.49 | NDTRKLERA | 1.49 |
| NS1 | 1002 | 0.45 | 5 | 5 | 0 | Y | DTWKLERAV | 94.03 | DTWKRERAV | 1.49 | DTWKLERLV | 1.49 | DTRKLERAV | 1.49 | DSWKLERAV | 1.49 |
| NS1 | 1003 | 0.45 | 5 | 5 | 0 | Y | TWKLERAVF | 94.03 | TWKRERAVF | 1.49 | TRKLERAVF | 1.49 | SWKLERAVF | 1.49 | TWKLERLVF | 1.49 |
| NS1 | 1004 | 0.33 | 4 | 4 | 0 | Y | WKLERAVFG | 95.52 | RKLERAVFG | 1.49 | WKLERLVFG | 1.49 | WKRERAVFE | 1.49 | |
| NS1 | 1005 | 0.22 | 3 | 3 | 0 | Y | KLERAVFGE | 97.01 | KRERAVFEE | 1.49 | KLERLVFGE | 1.49 | | |
| NS1 | 1006 | 0.42 | 4 | 4 | 0 | Y | LERAVFGEV | 94.03 | LERAVFGEI | 2.99 | RERAVFEEV | 1.49 | LERLVFGEV | 1.49 | |

FIG. 36-38

Species: JEV (9-mers)

| protein | block starting position | block entropy | total peptides in block | peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1007 | 0.42 | 4 | 4 | 0 | Y | ERAVFGEVK | 94.03 | ERAVFGEIK | 2.99 | ERL

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99

FIG. 36-41

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1082 | 0.44 | 3 | 3 | 0 | Y | TEDCGKRGP | 92.54 | TEDCGKRGP | 5.97 | TEDCGKRAP | 1.49 | | |
| NS1 | 1083 | 0.44 | 3 | 3 | 0 | Y | EDCGKRGPS | 92.54 | EDCSKRGPS | 5.97 | EDCGKRAPW | 1.49 | | |
| NS1 | 1084 | 1.17 | 5 | 5 | 0 | Y | DCGKRGPSV | 74.63 | DCGKRGPSI | 16.42 | D

FIG. 36-42

Species: JEV (9-mers)

| protein | block starting position | block entropy | total peptides in block | peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1107 | 0.22 | 3 | 3 | 0 | Y | CRSCSLPPL | 97.01 | CRSCTLPPL | 1.49 | CRNCSLPPL | 1.49 | | |
| NS1 | 1108 | 0.49 | 4 | 4 | 0 | Y | RSCSLPPLR | 92.54 | RSCSLPPLG | 4.48 | RSCTLPPLR | 1.49 | RNCSLPPLR | 1.49 |
| NS1 | 1109 | 0.49 | 4 | 4 | 0 | Y | SCSLPPLRF | 92.54 | SCSLPPLGF | 4.48 | NCSLPPLRF | 1.49 | SCTLPPLRF | 1.49 |
| NS1 | 1110 | 0.37 | 3 | 3 | 0 | Y | CSLPPLRFR | 94.03 | CSLPPLGFR | 4.48 | CTLPPLRFR | 1.49 | | |
| NS1 | 1111 | 0.37 | 3 | 3 | 0 | Y | SLPPLRFRT | 94.03 | SLPPLGFRT | 4.48 | TLPPLRFRT | 1.49 | | |
| NS1 | 1112 | 0.49 | 4 | 4 | 0 | Y | LPPLRFRTE | 92.54 | LPPLGFRTE | 4.48 | LPPLRFRTG | 1.49 | LPPLRFRTD | 1.49 |
| NS1 | 1113 | 0.49 | 4 | 4 | 0 | Y | PPLRFRTEN | 92.54 | PPLGFRTEN | 4.48 | PPLRFRTGS | 1.49 | PPLRFRTDN | 1.49 |
| NS1 | 1114 | 0.49 | 4 | 4 | 0 | Y | PLRFRTENG | 92.54 | PLGFRTENG | 4.48 | PLRFRTGSG | 1.49 | PLRFRTDNG | 1.49 |
| NS1 | 1115 | 0.49 | 4 | 4 | 0 | Y | LRFRTENGC | 92.54 | LGFRTENGC | 4.48 | LRFRTGSGC | 1.49 | LRFRTDNGC | 1.49 |
| NS1 | 1116 | 0.49 | 4 | 4 | 0 | Y | RFRTENGCW | 92.54 | GFRTENGCW | 4.48 | RFRTDNGCW | 1.49 | RFRTGSGCW | 1.49 |
| NS1 | 1117 | 0.22 | 3 | 3 | 0 | Y | FRTENGCWY | 97.01 | FRTGSGCWY | 1.49 | FRTDNGCWY | 1.49 | | |
| NS1 | 1118 | 0.22 | 3 | 3 | 0 | Y | RTENGCWYG | 97.01 | RTGSGCWYG | 1.49 | RTDNGCWYG | 1.49 | | |
| NS1 | 1119 | 0.22 | 3 | 2 | 0 | Y | TENGCWYGM | 97.01 | TDNGCWYGM | 1.49 | TGSGCWYGM | 1.49 | | |
| NS1 | 1120 | 0.11 | 2 | 2 | 0 | Y | ENGCWYGME | 98.51 | GSGCWYGME | 1.49 | DNGCWYGME | 1.49 | | |
| NS1 | 1121 | 0.11 | 2 | 2 | 0 | Y | NGCWYGMEI | 98.51 | SGCWYGMEV | 1.49 | | | | |
| NS1 | 1122 | 0.11 | 2 | 2 | 0 | Y | GCWYGMEIR | 98.51 | GCWYGMEVR | 1.49 | | | | |
| NS1 | 1123 | 0.55 | 4 | 4 | 0 | Y | CWYGMEIRP | 91.04 | CWYGMEVRP | 1.49 | | | | |
| NS1 | 1124 | 0.55 | 4 | 4 | 0 | Y | WYGMEIRPV | 91.04 | WYGMEIRPL | 5.97 | WYGMEIRPA | 1.49 | WYGMEVRPV | 1.49 |
| NS1 | 1133 | 1 | 5 | 5 | 0 | Y | RHDETTLVR | 80.6 | RHDEATLVR | 11.94 | MHDETTLVR | 4.48 | KHDEATLVR | 1.49 | GHDETTLVR |  |
| NS1 | 1134 | 0.68 | 3 | 3 | 0 | Y | HDETTLVRS | 85.07 | HDEATLVRS | 13.43 | HDETTLVRW | 1.49 | | |
| NS1 | 1135 | 0.79 | 4 | 4 | 0 | Y | DETTLVRSQ | 83.58 | DEATLVRSQ | 13.43 | DETTLVRSR | 1.49 | DETTLVRWQ | 1.49 | EATLVRSQA |  |
| NS1 | 1136 | 0.85 | 5 | 5 | 0 | Y | ETTLVRSQV | 83.58 | EATLVRSQV | 11.94 | ETTLVRWQV | 1.49 | ETTLVRSRV | 1.49 | TLVRWQVDA |  |
| NS1 | 1138 | 0.53 | 3 | 3 | 0 | Y | TLVRSQVDA | 92.54 | TLVRSQVHA | 2.99 | TLVRSQADA | 1.49 | TLVRSRVDA | 1.49 | |
| NS2A | 1148 | 1.17 | 5 | 5 | 0 | Y | NGEMVDPFQ | 74.63 | NGEMIDPFQ | 16.42 | KGEMIDPFQ | 5.97 | SGEMIDPFQ | 1.49 | NGGMVDPFQ |  |
| NS2A | 1149 | 0.89 | 4 | 4 | 0 | Y | GEMVDPFQL | 79.1 | GEMIDPFQL | 17.91 | GGMVDPFQL | 1.49 | GEMVDPFQM | 1.49 | |

FIG. 36-43

Species: JEV (9-mers)

| protein | block starting position | block entropy | total peptides in block | peptides required to cover 99% of block | gap/X fraction 99% of block | covered w/ <= 5 peptides? | peptide | frequency | peptide | frequency | peptide | frequency | peptide | frequency |
|---|---|---|---|---|---|---|---|---|---|---|---|---|---|---|
| NS2A | 1150 | 0.89 | 4 | 4 | 0 | Y | EMVDPFQLG | 79.1 | EMIDPFQLG | 17.91 | GMVDPFQLG | 1.49 | EMVDPFQMG | 1.49 |
| NS2A | 1151 | 0.79 | 3 | 3 | 0 | Y | MVDPFQLGL | 80.6 | MIDPFQLGL | 17.91 | MVDPFQMGL | 1.49 | | |
| NS2A | 1152 | 0.79 | 3 | 3 | 0 | Y | VDPFQLGLL | 80.6 | IDPFQLGLL | 17.91 | VDPFQMGLL | 1.49 | | |
| NS2A | 1153 | 0.11 | 2 | 2 | 0 | Y | DPFQLGLLV | 98.51 | DPFQMGLLV | 1.49 | | | | |
| NS2A | 1154 | 0.3 | 3 | 3 | 0 | Y | PFQLGLLVM | 95.52 | PFQLGLLVW | 2.99 | PFQMGLLVM | 1.49 | | |
| NS2A | 1155 | 0.3 | 3 | 3 | 0 | Y | FQLGLLVMF | 95.52 | FQLGLLVWF | 2.99 | FQMGLLVMF | 1.49 | | |
| NS2A | 1156 | 0.3 | 3 | 3 | 0 | Y | QLGLLVMFL | 95.52 | QLGLLVWFL | 2.99 | QMGLLVMFL | 1.49 | | |
| NS2A | 1157 | 0.3 | 3 | 3 | 0 | Y | LGLLVMFLA | 95.52 | LGLLVWFLA | 2.99 | MGLLVMFLA | 1.49 | | |
| NS2A | 1158 | 0.19 | 2 | 2 | 0 | Y | GLLVMFLAT | 97.01 | GLLVWFLAT | 2.99 | | | | |
| NS2A | 1159 | 0.19 | 2 | 2 | 0 | Y | LLVMFLATQ | 97.01 | LLVWFLATQ | 2.99 | | | | |
| NS2A | 1160 | 0.19 | 2 | 2 | 0 | Y | LVMFLATQE | 97.01 | LVWFLATQE | 2.99 | | | | |
| NS2A | 1161 | 0.19 | 2 | 2 | 0 | Y | VMFLATQEV | 97.01 | VWFLATQEV | 2.99 | | | | |
| NS2A | 1162 | 0.3 | 3 | 3 | 0 | Y | MFLATQEVL | 95.52 | MFLATQEVF | 2.99 | MFLATQEVF | 1.49 | | |
| NS2A | 1163 | 0.22 | 3 | 3 | 0 | Y | FLATQEVLR | 97.01 | FLATQEVLG | 1.49 | FLATQEVFR | 1.49 | | |
| NS2A | 1164 | 0.22 | 3 | 3 | 0 | Y | LATQEVLRK | 97.01 | LATQEVLGK | 1.49 | LATQEVFRK | 1.49 | | |
| NS2A | 1165 | 0.22 | 3 | 3 | 0 | Y | ATQEVLRKR | 97.01 | ATQEVLRKR | 1.49 | ATQEVFRKR | 1.49 | | |
| NS2A | 1166 | 0.22 | 3 | 3 | 0 | Y | TQEVLRKRW | 97.01 | TQEVLGKRW | 1.49 | TQEVFRKRW | 1.49 | | |
| NS2A | 1167 | 0.22 | 3 | 3 | 0 | Y | QEVLRKRWT | 97.01 | QEVLGKRWT | 1.49 | QEVFRKRWT | 1.49 | | |
| NS2A | 1168 | 0.22 | 3 | 3 | 0 | Y | EVLRKRWTA | 97.01 | EVLGKRWTA | 1.49 | EVFRKRWTA | 1.49 | | |
| NS2A | 1169 | 0.22 | 3 | 3 | 0 | Y | VLRKRWTAR | 97.01 | VLGKRWTAR | 1.49 | VFRKRWTAR | 1.49 | | |
| NS2A | 1170 | 0.22 | 3 | 3 | 0 | Y | LRKRWTARL | 97.01 | LGKRWTARL | 1.49 | FRKRWTARL | 1.49 | | |
| NS2A | 1171 | 0.11 | 2 | 2 | 0 | Y | RKRWTARLT | 98.51 | GKRWTARLT | 1.49 | | | | |
| NS2A | 1172 | 0.19 | 2 | 2 | 0 | Y | KRWTARLTI | 97.01 | KRWTARLTI | 2.99 | | | | |
| NS2A | 1173 | 0.19 | 2 | 2 | 0 | Y | RWTARLTIP | 97.01 | RWTARLTVP | 2.99 | | | | |
| NS2A | 1174 | 0.19 | 2 | 2 | 0 | Y | WTARLTIPA | 97.01 | WTARLTVPA | 2.99 | | | | |

FIG. 36-44

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1175 | 0.19 | 2 | 2 | 0 | Y | TARLTIPAV | 97.01 | TARLTIPAV | 2.99 | | | | |
| NS2A | 1176 | 0.19 | 2 | 2 | 0 | Y | ARLTIPAVL | 97.01 | ARLTVPAVL | 2.99 | | | |

FIG. 36-45

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1200 | 0 | 1 | 1 | 0 | Y | LARYWLVA | 100 | | | | | | |
| NS2A | 1201 | 0 | 1 | 1 | 0 | Y | ARYWLVAA | 100 | | | | | | |
| NS2A | 1202 | 0.22 | 3 | 3 | 0 | Y | RYWLVAAA | 97.01 | RYWLVAAV | 1.49 | RYWLVAAS | 1.49 | | |
| NS2A | 1203 | 0.22 | 3 | 3 | 0 | Y | YWLVAAAF | 97.01 | YWLVAASF | 1.49 | YWLVAAVF | 1.49 | | |
| NS2A | 1204 | 0.22 | 3 | 3 | 0 | Y | WLVAAAFA | 97.01 | WLVAASFA | 1.49 | WLVAAVFA | 1.49 | | |
| NS2A | 1205 | 0.22 | 3 | 3 | 0 | Y | LVAAAFAE | 97.01 | LVAAVFAE | 1.49 | LVAASFAE | 1.49 | | |
| NS2A | 1206 | 0.22 | 3 | 3 | 0 | Y | VAAAFAEA | 97.01 | VAAVFAEA | 1.49 | VAASFAEA | 1.49 | | |
| NS2A | 1207 | 0.22 | 3 | 3 | 0 | Y | AAAFAEAN | 97.01 | AAVFAEAN | 1.49 | AASFAEAN | 1.49 | | |
| NS2A | 1208 | 0.75 | 4 | 4 | 0 | Y | AAFAEANS | 85.07 | AFAEANN | 11.94 | ASFAEANS | 1.49 | AAVFAEANS | 1.49 |
| NS2A | 1209 | 0.75 | 4 | 4 | 0 | Y | AFAEANSG | 85.07 | AFAEANNG | 11.94 | SFAEANSG | 1.49 | AVFAEANSG | 1.49 |
| NS2A | 1210 | 0.75 | 4 | 4 | 0 | Y | FAEANSGG | 85.07 | FAEANNGG | 11.94 | SFAEANSGG | 1.49 | VFAEANSGG | 1.49 |
| NS2A | 1211 | 0.53 | 2 | 2 | 0 | Y | AEANSGGD | 88.06 | AEANNGGD | 11.94 | | | | |
| NS2A | 1212 | 0.53 | 2 | 2 | 0 | Y | EANSGGDV | 88.06 | EANNGGDV | 11.94 | | | | |
| NS2A | 1213 | 0.53 | 2 | 2 | 0 | Y | ANSGGDVL | 88.06 | ANNGGDVL | 11.94 | | | | |
| NS2A | 1214 | 0.53 | 2 | 2 | 0 | Y | NSGGDVLH | 88.06 | NNGGDVLH | 11.94 | | | | |
| NS2A | 1215 | 0.53 | 2 | 2 | 0 | Y | SGGDVLHL | 88.06 | NGGDVLHL | 11.94 | | | | |
| NS2A | 1216 | 0.53 | 2 | 2 | 0 | Y | GGDVLHLA | 88.06 | NGGDVLHLA | 11.94 | | | | |
| NS2A | 1217 | 0 | 1 | 1 | 0 | Y | GDVLHLAL | 100 | | | | | | |
| NS2A | 1218 | 0 | 1 | 1 | 0 | Y | DVLHLALI | 100 | | | | | | |
| NS2A | 1219 | 0 | 1 | 1 | 0 | Y | VLHLALIA | 100 | | | | | | |
| NS2A | 1220 | 0 | 1 | 1 | 0 | Y | LHLALIAV | 100 | | | | | | |
| NS2A | 1221 | 0 | 1 | 1 | 0 | Y | HLALIAVF | 100 | | | | | | |
| NS2A | 1222 | 0 | 1 | 1 | 0 | Y | LALIAVFK | 100 | | | | | | |
| NS2A | 1223 | 0 | 1 | 1 | 0 | Y | ALIAVFKI | 100 | | | | | | |
| NS2A | 1224 | 0 | 1 | 1 | 0 | Y | LIAVFKIQ | 100 | | | | | | |

FIG. 36-46

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1225 | 0 | 1 | 1 | 0 | Y | LIAVFKIQP | 100 | | | | | | |
| NS2A | 1226 | 0 | 1 | 1 | 0 | Y | IAVFKIQPA | 100 | | | | | | |
| NS2A | 1227 | 0 | 1 | 1 | 0 | Y | AVFKIQPAF | 100 | | | | | | |
| NS2A | 1228 | 0 | 1 | 1 | 0 | Y | VFKIQPAFL | 100 | | | | | | |
| NS2A | 1229 | 0.19 | 2 | 2 | 0 | Y | FKIQPAFLV | 97.01 | FKIQPAFLA | 2.99 | | | | |
| NS2A | 1230 | 0.3 | 3 | 2 | 0 | Y | KIQPAFLVM | 95.52 | KIQPAFLAM | 2.99 | | | | |
| NS2A | 1231 | 0.33 | 4 | 3 | 0 | Y | IQPAFLVMN | 95.52 | IQPAFLAMK | 1.49 | IQPAFLAMN | 1.49 | | |
| NS2A | 1232 | 0.33 | 4 | 4 | 0 | Y | QPAFLVMNM | 95.52 | QPAFLAMKM | 1.49 | QPAFLVANM | 1.49 | | |
| NS2A | 1233 | 0.33 | 4 | 4 | 0 | Y | PAFLVMNML | 95.52 | PAFLAMNTL | 1.49 | PAFLVANML | 1.49 | | |
| NS2A | 1234 | 0.33 | 4 | 4 | 0 | Y | AFLVMNMLS | 95.52 | AFLAMKMLS | 1.49 | AFLVANMLS | 1.49 | | |
| NS2A | 1235 | 1 | 5 | 5 | 0 | Y | FLVMNMLST | 77.61 | FLVANMLST | 17.91 | FLAMKMLST | 1.49 | FLAMNTLST | 1.49 |
| NS2A | 1239 | 0.97 | 5 | 5 | 0 | Y | NMLSTRWTN | 79.1 | NMLSARWTN | 16.42 | KMLSTRWTN | 1.49 | NTLSTRWTN | 1.49 |
| NS2A | 1240 | 0.86 | 4 | 4 | 0 | Y | MLSTRWTNQ | 80.6 | MLSARWTNQ | 16.42 | MLSAKWTNQ | 1.49 | | |
| NS2A | 1241 | 0.75 | 3 | 3 | 0 | Y | LSTRWTNQE | 82.09 | LSARWTNQE | 16.42 | | | | |
| NS2A | 1242 | 0.75 | 3 | 3 | 0 | Y | STRWTNQEN | 82.09 | SARWTNQEN | 16.42 | | | | |
| NS2A | 1243 | 0.75 | 3 | 3 | 0 | Y | TRWTNQENV | 82.09 | ARWTNQENM | 16.42 | | | | |
| NS2A | 1244 | 0.55 | 4 | 4 | 0 | Y | RWTNQENVV | 91.04 | RWTNQENVA | 5.97 | RWTNQENVI | 1.49 | KWTNQENMV | 1.49 |
| NS2A | 1245 | 0.55 | 4 | 4 | 0 | Y | WTNQENVVL | 91.04 | WTNQENVAL | 5.97 | WTNQENMYL | 1.49 | WTNQENVIL | 1.49 |
| NS2A | 1246 | 0.55 | 4 | 4 | 0 | Y | TNQENVLV | 91.04 | TNQENVALV | 5.97 | TNQENMVLV | 1.49 | TNQENVILV | 1.49 |
| NS2A | 1247 | 0.55 | 4 | 4 | 0 | Y | NQENVLVL | 91.04 | NQENVALVL | 5.97 | NQENMVLVL | 1.49 | NQENVILV | 1.49 |
| NS2A | 1248 | 0.55 | 4 | 4 | 0 | Y | QENVVLVLG | 91.04 | QENVALVLG | 5.97 | QENMVLVLG | 1.49 | QENVILVLG | 1.49 |
| NS2A | 1249 | 0.55 | 4 | 4 | 0 | Y | ENVVLVLGA | 91.04 | ENVALVLGA | 5.97 | ENMVLVLGA | 1.49 | ENVILVLGA | 1.49 |
| NS2A | 1250 | 0.55 | 4 | 4 | 0 | Y | NVVLVLGAA | 91.04 | NVALVLGAA | 5.97 | NMVLVLGAA | 1.49 | NVILVLGAA | 1.49 |
| NS2A | 1251 | 0.74 | 5 | 5 | 0 | Y | VVLVLGAAF | 88.06 | VALVLGAAL | 5.97 | VLVLGAAL | 2.99 | VILVLGAAF | 1.49 | MVLVLGAAF | 1.49 |
| NS2A | 1252 | 0.63 | 4 | 4 | 0 | Y | VLVLGAAFF | 89.55 | ALVLGAAFF | 5.97 | VLVLGAAFF | 2.99 | ILVLGAAFF | 1.49 | |

FIG. 36-47

Species: JEV (

FIG. 36-48

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1278 | 0.22 | 3 | 3 | 0 | Y | AAIAWMIVR | 97.01 | AAMAWMIVR | 1.49 | | | | |
| NS2A | 1279 | 0.22 | 3 | 3 | 0 | Y | AIAWMIVRA | 97.01 | AIAWMIIKA | 1.49 | AAIAWMIIK | 1.49 | | |
| NS2A | 1280 | 0.22 | 3 | 3 | 0 | Y | IAWMIVRAI | 97.01 | MAWMIVRAI | 1.49 | AMAWMIVRA | 1.49 | | |
| NS2A | 1281 | 0.11 | 2 | 2 | 0 | Y | AWMIVRAIT | 98.51 | AWMIIKAIT | 1.49 | IAWMIIKAI | 1.49 | | |
| NS2A | 1282 | 0.11 | 2 | 2 | 0 | Y | WMIVRAITF | 98.51 | WMIIKAITF | 1.49 | | | | |
| NS2A | 1283 | 0.11 | 2 | 2 | 0 | Y | MIVRAITFP | 98.51 | MIIKAITFP | 1.49 | | | | |
| NS2A | 1284 | 0.11 | 2 | 2 | 0 | Y | IVRAITFPT | 98.51 | IIKAITFPT | 1.49 | IIKAITFPT | 1.49 | | |
| NS2A | 1285 | 0.37 | 3 | 3 | 0 | Y | VRAITFPTT | 94.03 | VRAITFPTA | 1.49 | | | | |
| NS2A | 1286 | 0.37 | 3 | 3 | 0 | Y | RAITFPTTS | 94.03 | RAITFPTAS | 1.49 | IKAITFPTT | 1.49 | | |
| NS2A | 1287 | 0.96 | 3 | 3 | 0 | Y | AITFPTTSS | 76.12 | AITFPTTSS | 19.4 | KAITFPTSS | 1.49 | | |
| NS2A | 1288 | 1.04 | 4 | 4 | 0 | Y | ITFPTTSSV | 76.12 | ITFPTTSTV | 17.91 | AITFPTASS | 4.48 | | |
| NS2A | 1289 | 1.11 | 5 | 5 | 0 | Y | TFPTTSSVT | 76.12 | TFPTTSSVA | 16.42 | ITFPTASSV | 4.48 | ITFPTTSTI | 1.49 | TFPTTSTIT | 1.49 |
| NS2A | 1290 | 1.11 | 5 | 5 | 0 | Y | FPTTSSVTM | 76.12 | FPTTSVAM | 16.42 | TFPTASSVT | 4.48 | TFPTTSVT | 1.49 | FPTTSTITM | 1.49 |
| NS2A | 1291 | 1.11 | 5 | 5 | 0 | Y | PTTSSVTMP | 76.12 | PTTSVAMP | 16.42 | PTASSVTMP | 4.48 | FPTTSVTM | 1.49 | PTTSVTMP | 1.49 |
| NS2A | 1298 | 0.55 | 4 | 4 | 0 | Y | MPVLALLIP | 91.04 | MPILALLIP | 5.97 | MPILALLAP | 1.49 | PTTSVTMP | 1.49 | | |
| NS2A | 1299 | 0.55 | 4 | 4 | 0 | Y | PVLALLIPG | 91.04 | PILALLIPG | 5.97 | PILALLAPG | 1.49 | MPWLLLLTP | 1.49 | | |
| NS2A | 1300 | 0.55 | 4 | 4 | 0 | Y | VLALLTPGM | 91.04 | ILALLTPGM | 5.97 | LLALLAPGM | 1.49 | PVLILLTPG | 1.49 | | |
| NS2A | 1301 | 0.33 | 4 | 4 | 0 | Y | LALLTPGMR | 95.52 | LTLLTPGMR | 1.49 | LALLAPGMR | 1.49 | VLTLLTPGM | 1.49 | | |
| NS2A | 1302 | 0.33 | 4 | 4 | 0 | Y | ALLTPGMRA | 95.52 | ALLTPGMRA | 1.49 | ALLAPGMRA | 1.49 | LALLAPGMR | 1.49 | | |
| NS2A | 1303 | 0.45 | 5 | 5 | 0 | Y | LLTPGMRAL | 94.03 | LTPGMKAL | 1.49 | LLAPGMRAL | 1.49 | TLLTPGMRA | 1.49 | | |
| NS2A | 1304 | 0.45 | 5 | 5 | 0 | Y | LTPGMRALY | 94.03 | LPGMKALY | 1.49 | LAPGMRALY | 1.49 | LLTPGMRAF | 1.49 | LTPGMRAFD | 1.49 |
| NS2A | 1305 | 0.33 | 4 | 4 | 0 | Y | TPGMRALYL | 94.03 | TPGMKALYL | 1.49 | TPGMKALYL | 1.49 | LTPGMRAF | 1.49 | TPGMRAFDL | 1.49 |
| NS2A | 1306 | 0.33 | 4 | 4 | 0 | Y | PGMRALYLD | 95.52 | PGMKALCLD | 1.49 | PGMKALYLD | 1.49 | APGMRALYL | 1.49 | | |
| NS2A | 1307 | 0.33 | 4 | 4 | 0 | Y | GMRALYLDT | 95.52 | GMKALYLDT | 1.49 | GMRALCLDT | 1.49 | PGMRAFDLD | 1.49 | | |
| NS2A | 1308 | 0.33 | 4 | 4 | 0 | Y | MRALYLDTY | 95.52 | MKALYLDTY | 1.49 | MRALCLDTY | 1.49 | GMRAFDLDT | 1.49 | | |

FIG. 36-49

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1309 | 0.33 | 4 | 4 | 0 |

FIG. 36-50

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides

FIG. 36-51

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1365 | 0.11 | 2 | 2 | 0 | Y | MVCNPNKKR | 98.51 | MACNPNKKR | 1.49 | | | | |
| NS2A | 1366 | 0.11 | 2 | 2 | 0 | Y | VCNPNKKRG | 98.51 | ACNPNKKRG

FIG. 36-52

Species: JEV (9-mers)

| protein | block starting position | ent

FIG. 36-53

Species: JEV (9-mers)

| protein | block starting position | entropy block | total

FIG. 36-54

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1445 | 0 | 1 | 1 | 0 | Y | SRRLDVKLD | 100 | | | | | | |
| NS2B | 1446 | 0.68 | 2 | 2 | 0 | Y | RRLDVKLDD | 82.09 | RRLDVKLDE | 17.91 | | | | |
| NS2B | 1447 | 0.68 | 2 | 2 | 0 | Y | RLDVKLDDD | 82.09 | RLDVKLDED | 17.91 | | | | |
| NS2B | 1448 | 0.68 | 2 | 2 | 0 | Y | LDVKLDDDG | 82.09 |

FIG. 36-55

Species: JEV (9-mers)

| protein | block starting position | entropy block | total peptides in block | peptides required to cover 99% of block | gap/X fraction | 99% of block covered w/ => 5 peptides? | peptides required to cover 99% of block | frequency | peptides required to cover 99

FIG. 36-56

Species: JEV (9-mers)

| protein | block starting position | block entropy | total peptides in block | peptides required to cover 99% of block | gap/X fraction 99% of block | covered w/ <=5 peptides? | peptides | frequency | peptides required to cover 99% of block | frequency | peptides required to cover 99% of block | frequency |
|

FIG. 36-57

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1520 | 0 | 1 | 1 | 0 | Y | GDTTTGVYR | 100 | | | | | | |
| NS3 | 1521 | 0 | 1 | 1 | 0 | Y | DTTTGVYRI | 100 | | | | | | |
| NS3 | 1522 | 0 | 1 | 1 | 0 | Y | TTTGVYRIM | 100 | | | | | | |
| NS3 | 1523 | 0 | 1 | 1 | 0 | Y | TTGVYRIMA | 100 | | | | | | |
| NS3 | 1524 | 0.11 | 2 | 2 | 0 | Y | TGVYRIMAR | 98.51 | TGVYRIMAC | 1.49 | | | | |
| NS3 | 1525 | 0.11 | 2 | 2 | 0 | Y | GVYRIMARG | 98.51 | GVYRIMACG | 1.49 | | | | |
| NS3 | 1526 | 0.11 | 2 | 2 | 0 | Y | VYRIMARGI | 98.51 | VYRIMACGI | 1.49 | | | | |
| NS3 | 1527 | 0.22 | 3 | 3 | 0 | Y | YRIMARGIL | 97.01 | YRIMARGIF | 1.49 | YRIMACGIL | 1.49 | | | |
| NS3 | 1528 | 0.22 | 3 | 3 | 0 | Y | RIMARGILG | 97.01 | RIMARGIFG | 1.49 | RIMACGILG | 1.49 | | | |
| NS3 | 1529 | 0.22 | 3 | 3 | 0 | Y | IMARGILGT | 97.01 | IMARGIFGT | 1.49 | IMACGILGT | 1.49 | | | |
| NS3 | 1530 | 0.22 | 3 | 3 | 0 | Y | MARGILGTY | 97.01 | MACGILGTY | 1.49 | MARGIFGTH | 1.49 | | | |
| NS3 | 1531 | 0.22 | 3 | 3 | 0 | Y | ARGILGTYQ | 97.01 | ARGIFGTHQ | 1.49 | ACGILGTYQ | 1.49 | | | |
| NS3 | 1532 | 0.22 | 3 | 3 | 0 | Y | RGILGTYQA | 97.01 | RGIFGTHQA | 1.49 | CGILGTYQS | 1.49 | | | |
| NS3 | 1533 | 0.22 | 3 | 3 | 0 | Y | GILGTYQAG | 97.01 | GILGTYQSG | 1.49 | GIFGTHQAG | 1.49 | | | |
| NS3 | 1534 | 0.22 | 3 | 3 | 0 | Y | ILGTYQAGV | 97.01 | ILGTYQSGV | 1.49 | IFGTHQAGV | 1.49 | | | |
| NS3 | 1535 | 0.22 | 3 | 3 | 0 | Y | LGTYQAGVG | 97.01 | LGTYQSGVG | 1.49 | FGTHQAGVG | 1.49 | | | |
| NS3 | 1536 | 0.22 | 3 | 3 | 0 | Y | GTYQAGVGV | 97.01 | GTYQSGVGV | 1.49 | GTHQAGVGV | 1.49 | | | |

FIG. 36-58

Species: JEV (9-mers)

| protein | block starting position | entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1545 | 0.45 | 5 | 5 | 0 | Y | MYENVFHTL | 94.03 | MYESVFHTL | 1.49 | MYENVLHTL | 1.49 | MYQNVFHTL | 1.49 | IYENVFHTL | 1.49 |
| NS3 | 1546 | 0.33 | 4 | 4 | 0 | Y | YENVFHTLW | 95.52 | YESVFHTLW | 1.49 | YENVLHTLW | 1.49 | YQNVFHTLW | 1.49 | | |
| NS3 | 1547 | 0.33 | 4 | 4 | 0 | Y | ENVFHTLWH | 95.52 | ESVFHTLWH | 1.49 | QNVFHTLWH | 1.49 | ENVLHTLWH | 1.49 | | |
| NS3 | 1548 | 0.33 | 4 | 4 | 0 | Y | NVFHTLWHT | 95.52 | NVLHTLWHT | 1.49 | NVFHTLWHT | 1.49 | SVFHTLWHT | 1.49 | | |
| NS3 | 1549 | 0.22 | 3 | 3 | 0 | Y | VFHTLWHTT | 97.01 | VLHTLWHT | 1.49 | VFHTLWHT | 1.49 | | | | |
| NS3 | 1550 | 0.22 | 3 | 3 | 0 | Y | FHTLWHTTR | 97.01 | LHTLWHTTR | 1.49 | FHTLWHPT | 1.49 | | | | |
| NS3 | 1551 | 0.11 | 2 | 2 | 0 | Y | HTLWHTTRG | 98.51 | HTLWHPTRG | 1.49 | | | | | | |
| NS3 | 1552 | 0.11 | 2 | 2 | 0 | Y | TLWHTTRGA | 98.51 | TLWHPTRGA | 1.49 | | | | | | |
| NS3 | 1553 | 0.11 | 2 | 2 | 0 | Y | LWHTTRGAA | 98.51 | LWHPTRGAA | 1.49 | | | | | | |
| NS3 | 1554 | 0.3 | 4 | 3 | 0 | Y | WHTTRGAAI | 95.52 | WHTTRGAAV | 2.99 | WHPTRGAAI | 1.49 | | | | |
| NS3 | 1555 | 0.57 | 5 | 4 | 0 | Y | HTTRGAAIM | 91.04 | HTTRGAAIV | 4.48 | HTTRGAAVM | 2.99 | HPTRGAAIM | 1.49 | | |
| NS3 | 1556 | 0.57 | 5 | 4 | 0 | Y | TTRGAAIMS | 91.04 | TTRGAAIVS | 4.48 | TTRGAAVMS | 2.99 | PTRGAAIMS | 1.49 | | |
| NS3 | 1557 | 0.46 | 3 | 3 | 0 | Y | TRGAAIMSG | 92.54 | TRGAAIVSG | 4.48 | TRGAAVMSG | 2.99 | | | | |
| NS3 | 1558 | 0.68 | 5 | 5 | 0 | Y | RGAAIMSGE | 89.55 | RGAAIVSGE | 4.48 | RGAAIMSGG | 2.99 | RGAAIMSGG | 1.49 | RGAAIMSGK | 1.49 |
| NS3 | 1559 | 0.68 | 5 | 5 | 0 | Y | GAAIMSGEG | 89.55 | GAAIVSGEG | 4.48 | GAAIMSGGG | 2.99 | GAAIMSGGG | 1.49 | GAAIMSGKG | 1.49 |
| NS3 | 1560 | 0.68 | 5 | 5 | 0 | Y | AAIMSGEGK | 89.55 | AAIVSGEGK | 4.48 | AAIMSGKGK | 2.99 | AAIMSGKGK | 1.49 | AAIMSGGGK | 1.49 |
| NS3 | 1561 | 0.68 | 5 | 5 | 0 | Y | AIMSGEGKL | 89.55 | AIVSGEGKL | 4.48 | AVMSGEGKL | 2.99 | AIMSGKGKL | 1.49 | AIMSGKGKL | 1.49 |
| NS3 | 1562 | 0.49 | 4 | 4 | 0 | Y | IMSGEGKLT | 89.55 | IVSGEGKLT | 4.48 | VMSGEGKLT | 2.99 | IMSGGGKLT | 1.49 | IMSGGGKLT | 1.49 |
| NS3 | 1563 | 0.22 | 3 | 3 | 0 | Y | MSGEGKLTP | 92.54 | VSGEGKLTP | 4.48 | MSGGGKLTP | 1.49 | MSGKGKLTP | 1.49 | | |
| NS3 | 1564 | 0.22 | 3 | 3 | 0 | Y | SGEGKLTPY | 97.01 | SGGGKLTPY | 1.49 | SGKGKLTPY | 1.49 | | | | |
| NS3 | 1565 | 0.22 | 3 | 3 | 0 | Y | GEGKLTPYW | 97.01 | GGGKLTPYW | 1.49 | GKGKLTPYW | 1.49 | | | | |
| NS3 | 1566 | 0.22 | 3 | 3 | 0 | Y | EGKLTPYWG | 97.01 | KGKLTPYWG | 1.49 | GGKLTPYWG | 1.49 | | | | |
| NS3 | 1567 | 0 | 1 | 1 | 0 | Y | GKLTPYWGS | 100 | | | | | | | | |
| NS3 | 1568 | 0 | 1 | 1 | 0 | Y | KLTPYWGSV | 100 | | | | | | | | |
| NS3 | 1569 | 0.43 | 2 | 2 | 0 | Y | LTPYWGSVK | 91.04 | LTPYWGSVR | 8.96 | | | | | | |

FIG. 36-59

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1570 | 0.43 | 2 | 2 | 0 | Y | TPYWGSVKE | 91.04 | TPYWGSVRE | 8.96 |

FIG. 36-60

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1595 | 0.11 | 2 | 2 | 0 | Y | GTDD

FIG. 36-61

Species: JEV (9-mers)

| protein | block starting position | block entropy | total peptides in block | peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1633 | 0 | 1 | 1 | 0 | Y | DYPRGTSGS | 100 | | | | |
| NS3 | 1634 | 0 | 1 | 1 | 0 | Y | YPRGTSGSP | 100 | | | | |
| NS3 | 1635 | 0 | 1 | 1 | 0 | Y | PRGTSGSPI | 100 | | | | |
| NS3 | 1636 | 0 | 1 | 1 | 0 | Y | RGTSGSPIL | 100 | | | | |
| NS3 | 1637 | 0.11 | 2 | 2 | 0 | Y | GTSGSPILD | 98.51 | GTSGSPILN | 1.49 | | |
| NS3 | 1638 | 0.22 | 3 | 3 | 0 | Y | TSGSPILDS | 97.01 | TSGSPILDF | 1.49 | TSGSPILNS | 1.49 |
| NS3 | 1639 | 0.22 | 3 | 3 | 0 | Y | SGSPILDSN | 97.01 | SGSPILNSN | 1.49 | SGSPILDFN | 1.49 |
| NS3 | 1640 | 0.22 | 3 | 3 | 0 | Y | GSPILDSNG | 97.01 | GSPILNSNG | 1.49 | GSPILDFNG | 1.49 |
| NS3 | 1641 | 0.22 | 3 | 3 | 0 | Y | SPILDSNGD | 97.01 | SPILDFNGD | 1.49 | SPILNSNGD | 1.49 |
| NS3 | 1642 | 0.22 | 3 | 3 | 0 | Y | PILDSNGDI | 97.01 | PILNSNGDV | 1.49 | PILDFNGDI | 1.49 |
| NS3 | 1643 | 0.22 | 3 | 3 | 0 | Y | ILDSNGDII | 97.01 | ILDFNGDII | 1.49 | ILNSNGDW | 1.49 |
| NS3 | 1644 | 0.22 | 3 | 3 | 0 | Y | LDSNGDIIG | 97.01 | LNSNGDWG | 1.49 | LDFNGDIIG | 1.49 |
| NS3 | 1645 | 0.22 | 3 | 3 | 0 | Y | DSNGDIIGL | 97.01 | NSNGDWGC | 1.49 | DFNGDIIGL | 1.49 |
| NS3 | 1646 | 0.22 | 3 | 3 | 0 | Y | SNGDIIGLY | 97.01 | FNGDIIGLY | 1.49 | SNGDWGCL | 1.49 |
| NS3 | 1647 | 0.11 | 2 | 2 | 0 | Y | NGDIIGLYG | 98.51 | NGDWGCLG | 1.49 | | |
| NS3 | 1648 | 0.11 | 2 | 2 | 0 | Y | GDIIGLYGN | 98.51 | GDWGCLGN | 1.49 | | |
| NS3 | 1649 | 0.11 | 2 | 2 | 0 | Y | DIIGLYGNG | 98.51 | DWGCLGNG | 1.49 | | |
| NS3 | 1650 | 0.22 | 3 | 3 | 0 | Y | IIGLYGNGV | 97.01 | WGCLGNGV | 1.49 | IIGLYGNGG | 1.49 |
| NS3 | 1651 | 0.22 | 3 | 3 | 0 | Y | IGLYGNGVE | 97.01 | VGCLGNGVE | 1.49 | IGLYGNGGE | 1.49 |
| NS3 | 1652 | 0.22 | 3 | 3 | 0 | Y | GLYGNGVEL | 97.01 | GLYGNGGEL | 1.49 | GCLGNGVEL | 1.49 |
| NS3 | 1653 | 0.22 | 3 | 3 | 0 | Y | LYGNGVELG | 97.01 | CLGNGVELG | 1.49 | LYGNGGELG | 1.49 |
| NS3 | 1654 | 0.22 | 3 | 3 | 0 | Y | YGNGVELGD | 97.01 | LGNGVELGD | 1.49 | YGNGGELGD | 1.49 |
| NS3 | 1655 | 0.22 | 3 | 3 | 0 | Y | GNGVELGDG | 97.01 | GNGGELGDG | 1.49 | GNGVELGDR | 1.49 |
| NS3 | 1656 | 0.22 | 3 | 3 | 0 | Y | NGVELGDGS | 97.01 | NGVELGDRS | 1.49 | NGGELGDGS | 1.49 |
| NS3 | 1657 | 0.22 | 3 | 3 | 0 | Y | GVELGDGSY | 97.01 | GGELGDGSY | 1.49 | GVELGDRSY | 1.49 |

FIG. 36-62

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1658 | 0.22 | 3 | 3 | 0 | Y | VELG

FIG. 36-63

| protein | block starting position | block entropy | total peptides in block | peptides required to cover 99% of block | gap/K fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| Species: JEV (9-mers) | | | | | | | | | | | | | | |
| NS3 | 1688 | 1.12 | 4 | 4 | 0 | Y | LKKRQMTVL | 73.13 | LKKRQMTVL | 19.4 | LRKRQLTVL | 5.97 | LKKKQMTVL | 1.49 |
| NS3 | 1689 | 1.12 | 4 | 4 | 0 | Y | RKKQMTVLD | 73.13 | KKRQMTVLD | 19.4 | RKRQLTVLD | 5.97 | KKKQMTVLD | 1.49 |
| NS3 | 1690 | 0.44 | 3 | 3 | 0 | Y | KRQMTVLDL | 92.54 | KRQLTVLDL | 5.97 | KKQMTVLDL | 1.49 | |
| NS3 | 1691 | 0.44 | 3 | 3 | 0 | Y | RQMTVLDLH | 92.54 | RQLTVLDLH | 5.97 | KQMTVLDLP | 1.49 | |
| NS3 | 1692 | 0.44 | 3 | 3 | 0 | Y | QMTVLDLHP | 92.54 | QLTVLDLHP | 5.97 | QMTVLDLPP | 1.49 | |
| NS3 | 1693 | 0.44 | 3 | 3 | 0 | Y | MTVLDLHPG | 92.54 | LTVLDLHPG | 5.97 | MTVLDLPPG | 1.49 | |
| NS3 | 1694 | 0.22 | 3 | 3 | 0 | Y | TVLDLHPGS | 97.01 | TVLDLPPGS | 1.49 | TVLDLHPGL | 1.49 | |
| NS3 | 1695 | 0.22 | 3 | 3 | 0 | Y | VLDLHPGSG | 97.01 | VLDLPPGSG | 1.49 | VLDLHPGLG | 1.49 | |
| NS3 | 1696 | 0.22 | 3 | 3 | 0 | Y | LDLHPGSGK | 97.01 | LDLPPGSGK | 1.49 | LDLHPGLGK | 1.49 | |
| NS3 | 1697 | 0.22 | 3 | 3 | 0 | Y | DLHPGSGKT | 97.01 | DLHPGLGKT | 1.49 | DLPPGSGKT | 1.49 | |
| NS3 | 1698 | 0.42 | 4 | 4 | 0 | Y | LHPGSGKTR | 94.03 | LHPGSGKTK | 2.99 | LPPGSGKTR | 1.49 | LHPGLGKTR | 1.49 |
| NS3 | 1699 | 0.42 | 4 | 4 | 0 | Y | HPGSGKTRK | 94.03 | HPGSGKTRK | 2.99 | HPGLGKTRK | 1.49 | PPGSGKTRK | 1.49 |
| NS3 | 1700 | 0.3 | 3 | 3 | 0 | Y | PGSGKTRKI | 95.52 | PGSGKTKKI | 2.99 | PGLGKTRKI | 1.49 | |
| NS3 | 1701 | 0.3 | 3 | 3 | 0 | Y | GSGKTRKIL | 95.52 | GSGKTKKIL | 2.99 | GLGKTRKIL | 1.49 | |
| NS3 | 1702 | 0.3 | 3 | 3 | 0 | Y | SGKTRKILP | 95.52 | SGKTKKILP | 2.99 | LGKTRKILP | 1.49 | |
| NS3 | 1703 | 0.19 | 2 | 2 | 0 | Y | GKTRKILPQ | 97.01 | GKTKKILPQ | 2.99 | | |
| NS3 | 1704 | 0.3 | 3 | 3 | 0 | Y | KTRKILPQI | 95.52 | KTKKILPQI | 2.99 | KTRKILPQT | 1.49 | |
| NS3 | 1705 | 0.3 | 3 | 3 | 0 | Y | TRKILPQII | 95.52 | TKILPQII | 2.99 | TRKILPQTI | 1.49 | |
| NS3 | 1706 | 0.42 | 4 | 4 | 0 | Y | RKILPQIIK | 94.03 | KKILPQIIK | 2.99 | RKILPQIIR | 1.49 | RKILPQTIK | 1.49 |
| NS3 | 1707 | 0.22 | 3 | 3 | 0 | Y | KILPQIIKD | 97.01 | KILPQTIKD | 1.49 | KILPQIIRD | 1.49 | |
| NS3 | 1708 | 0.22 | 3 | 3 | 0 | Y | ILPQIIKDA | 97.01 | ILPQTIKDA | 1.49 | ILPQIIRDA | 1.49 | |
| NS3 | 1709 | 0.22 | 3 | 3 | 0 | Y | LPQIIKDAI | 97.01 | LPQTIKDAI | 1.49 | LPQIIRDAI | 1.49 | |
| NS3 | 1710 | 0.22 | 3 | 3 | 0 | Y | PQIIKDAIQ | 97.01 | PQTIKDAIQ | 1.49 | PQIIRDAIQ | 1.49 | |
| NS3 | 1711 | 0.22 | 3 | 3 | 0 | Y | QIIKDAIQQ | 97.01 | QTIKDAIQ | 1.49 | QIIRDAIQQ | 1.49 | |
| NS3 | 1712 | 0.42 | 4 | 4 | 0 | Y | IIKDAIQQR | 94.03 | IIKDAIQQH | 2.99 | IIRDAIQQR | 1.49 | TIKDAIQQR | 1.49 |

FIG. 36-64

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1713 | 0.3 | 3 | 3 | 0 | Y | IKDAIQQRL | 95.52 | IKDAIQQHL | 2.99 | IRDAIQQRL | 1.49 | | |
| NS3 | 1714 | 0.5 | 4 | 4 | 0 | Y | KDAIQQRLR | 92.54 | KDAIQQHLR | 2.99 | KDAIQQRLK | 2.99 | RDAIQQRLR | 1.49 |
| NS3 | 1715 | 0.39 | 3 | 3 | 0 | Y | DAIQQRLRT | 94.03 | DAIQQHLRT | 2.99 | DAIQQRLKT | 2.99 | | |
| NS3 | 1716 | 0.39 | 3 | 3 | 0 | Y | AIQQRLRTA | 94.03 | AIQQHLRTA | 2.99 | AIQQRLK

FIG. 36-65

Species: JEV (9-mers)

| protein | block starting position | block entropy | total peptides in block | peptides required to cover 99% of block | gap/X fraction | covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1738 | 0.59 | 3 | 3 | 0 | Y | EALRGLPVR | 89.55 | EALKGLPVR | 5.97 | EVLRGLPVR | 4.48 |
| NS3 | 1739 | 0.59 | 3 | 3 | 0 | Y | ALRGLPVRY | 89.55 | ALKGLPVRY | 5.97 | VLRGLPVRY | 4.48 |
| NS3 | 1740 | 0.33 | 2 | 2 | 0 | Y | LRGLPVRYQ | 94.03 | LKGLPVRYQ | 5.97 | | |
| NS3 | 1741 | 0.33 | 2 | 2 | 0 | Y | RGLPVRYQT | 94.03 | KGLPVRYQT | 5.97 | | |
| NS3 | 1742 | 0 | 1 | 1 | 0 | Y | GLPVRYQTS | 100 | | | | |
| NS3 | 1743 | 0 | 1 | 1 | 0 | Y | LPVRYQTSA | 100 | | | | |
| NS3 | 1744 | 0 | 1 | 1 | 0 | Y | PVRYQTSAV | 100 | | | | |
| NS3 | 1745 | 0 | 1 | 1 | 0 | Y | VRYQTSAVQ | 100 | | | | |
| NS3 | 1746 | 0 | 1 | 1 | 0 | Y | RYQTSAVQR | 100 | | | | |
| NS3 | 1747 | 0.11 | 2 | 2 | 0 | Y | YQTSAVQRE | 98.51 | YQTSAVQRS | 1.49 | | |
| NS3 | 1748 | 0.11 | 2 | 2 | 0 | Y | QTSAVQREH | 98.51 | QTSAVQRSH | 1.49 | | |
| NS3 | 1749 | 0.11 | 2 | 2 | 0 | Y | TSAVQREHQ | 98.51 | TSAVQRSHQ | 1.49 | | |
| NS3 | 1750 | 0.11 | 2 | 2 | 0 | Y | SAVQREHQG | 98.51 | SAVQRSHQG | 1.49 | | |
| NS3 | 1751 | 0.11 | 2 | 2 | 0 | Y | AVQREHQGN | 98.51 | AVQRSHQGN | 1.49 | | |
| NS3 | 1752 | 0.22 | 3 | 3 | 0 | Y | VQREHQGNE | 97.01 | VQRSHQGN | 1.49 | VQRSHQGNE | 1.49 |
| NS3 | 1753 | 0.22 | 3 | 3 | 0 | Y | QREHQGNEI | 97.01 | QRSHQGNEI | 1.49 | QREHQGNAI | 1.49 |
| NS3 | 1754 | 0.22 | 3 | 3 | 0 | Y | REHQGNEIV | 97.01 | REHQGNAIV | 1.49 | RSHQGNEIV | 1.49 |
| NS3 | 1755 | 0.22 | 3 | 3 | 0 | Y | EHQGNEIVD | 97.01 | SHQGNEIVD | 1.49 | EHQGNAIVD | 1.49 |
| NS3 | 1756 | 0.11 | 2 | 2 | 0 | Y | HQGNEIVDV | 98.51 | HQGNAIVDV | 1.49 | | |
| NS3 | 1757 | 0.11 | 2 | 2 | 0 | Y | QGNEIVDVM | 98.51 | QGNAIVDVM | 1.49 | | |
| NS3 | 1758 | 0.11 | 2 | 2 | 0 | Y | GNEIVDVMC | 98.51 | GNAIVDVMC | 1.49 | | |
| NS3 | 1759 | 0.11 | 2 | 2 | 0 | Y | NEIVDVMCH | 98.51 | NAIVDVMCH | 1.49 | | |
| NS3 | 1760 | 0.11 | 2 | 2 | 0 | Y | EIVDVMCHA | 98.51 | AIVDVMCHA | 1.49 | | |
| NS3 | 1761 | 0 | 1 | 1 | 0 | Y | IVDVMCHAT | 100 | | | | |
| NS3 | 1762 | 0 | 1 | 1 | 0 | Y | VDVMCHATL | 100 | | | | |

FIG. 36-66

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1763 | 0 | 1 | 1 | 0 | Y

FIG. 36-67

Species: JEV (9-mers)

| protein | block starting position | block entropy | total

FIG. 36-68

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1813 | 0 | 1 | 1 | 0 | Y | EAAAIFMTA | 100 | | | | | | |
| NS3 | 1814 | 0 | 1 | 1 | 0 | Y | AAAIFMTAT | 100 | | |

FIG. 36-69

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1838 | 0.23 | 3 | 3 | 2.99 | Y | HDLQDEIPD | 94.03 | HDLQDEVPD | 1.49 | HDLQDETPD | 1.49 | HDLQDEVPD | 1.49 |
| NS3 | 1839 | 0.34 | 4 | 4 | 2.99 | Y | DLQDEIPDR | 92.54 | DLQDEVPDR | 1.49 | DLQDETPDR | 1.49 | DLQDEIPDW | 1.49 |
| NS3 | 1840 | 0.34 | 4 | 4 | 2.99 | Y | LQDEIPDRA | 92.54 | LQDEVPDRA | 1.49 | LQDEIPDWA | 1.49 | LQDETPDRA | 1.49 |
| NS3 | 1841 | 0.34 | 4 | 4 | 2.99 | Y | QDEIPDRAW | 92.54 | QDETPDRAW | 1.49 | QDEIPDWAW | 1.49 | QDEVPDRAW | 1.49 |
| NS3 | 1842 | 0.34 | 4 | 4 | 2.99 | Y | DEIPDRAWS | 92.54 | DETPDRAWS | 1.49 | DEIPDWAWS | 1.49 | DEVPDRAWS | 1.49 |
| NS3 | 1843 | 0.34 | 4 | 4 | 2.99 | Y | EIPDRAWSS | 92.54 | EVPDRAWSS | 1.49 | EIPDWAWSS | 1.49 | ETPDRAWSS | 1.49 |
| NS3 | 1844 | 0.34 | 4 | 4 | 2.99 | Y | IPDRAWSSG | 92.54 | VPDRAWSSG | 1.49 | TPDRAWSSG | 1.49 | IPDWAWSSG | 1.49 |
| NS3 | 1859 | 0.86 | 4 | 4 | 0 | Y | WITEYAGKT | 80.6 | WITDYAGKT | 1.49 | WITEYSGKT | 1.49 | WSTEYAGKT | 1.49 |
| NS3 | 1860 | 0.86 | 4 | 4 | 0 | Y | ITEYAGKTV | 80.6 | ITDYAGKTV | 1.49 | STEYAGKTV | 1.49 | ITEYSGKTV | 1.49 |
| NS3 | 1861 | 0.75 | 3 | 3 | 0 | Y | TEYAGKTVW | 82.09 | TDYAGKTVW | 1.49 | TEYSGKTVW | 1.49 | | |
| NS3 | 1862 | 0.75 | 3 | 3 | 0 | Y | EYAGKTVWF | 82.09 | DYAGKTVWF | 1.49 | EYSGKTVWF | 1.49 | | |
| NS3 | 1863 | 0.11 | 2 | 2 | 0 | Y | YAGKTVWFV | 98.51 | YSGKTVWFV | 1.49 | | | | |
| NS3 | 1864 | 0.11 | 2 | 2 | 0 | Y | AGKTVWFVA | 98.51 | SGKTVWFVA | 1.49 | | | | |
| NS3 | 1865 | 0 | 1 | 1 | 0 | Y | GKTVWFVAS | 100 | | | | | | |
| NS3 | 1866 | 0 | 1 | 1 | 0 | Y | KTVWFVASV | 100 | | | | | | |
| NS3 | 1867 | 0.19 | 2 | 2 | 0 | Y | TVWFVASVK | 97.01 | TVWFVASVR | 2.99 | | | | |
| NS3 | 1868 | 0.19 | 2 | 2 | 0 | Y | VWFVASVKM | 97.01 | VWFVASVRM | 2.99 | | | | |
| NS3 | 1869 | 0.19 | 2 | 2 | 0 | Y | WFVASVKMG | 97.01 | WFVASVRMG | 2.99 | | | | |
| NS3 | 1870 | 0.19 | 2 | 2 | 0 | Y | FVASVKMGN | 97.01 | FVASVRMGN | 2.99 | | | | |
| NS3 | 1871 | 0.19 | 2 | 2 | 0 | Y | VASVKMGNE | 97.01 | VASVRMGNE | 2.99 | | | | |
| NS3 | 1872 | 0.19 | 2 | 2 | 0 | Y | ASVKMGNEI | 97.01 | ASVRMGNEI | 2.99 | | | | |
| NS3 | 1873 | 0.3 | 3 | 3 | 0 | Y | SVKMGNEIA | 95.52 | SVRMGNEIA | 2.99 | | | | |
| NS3 | 1874 | 0.3 | 3 | 3 | 0 | Y | VKMGNEIAM | 95.52 | VRMGNEIAM | 2.99 | VKMGNEIAV | 1.49 | | |
| NS3 | 1875 | 0.3 | 3 | 3 | 0 | Y | KMGNEIAMC | 95.52 | RMGNEIAMC | 2.99 | KMGNEIAVC | 1.49 | | |
| NS3 | 1876 | 0.11 | 2 | 2 | 0 | Y | MGNEIAMCL | 98.51 | MGNEIAVCL | 1.49 | | | | |

FIG. 36-70

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to

FIG. 36-71

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1902 | 0 | 1 | 1 | 0 | Y | EYPICKNGD | 100 | | |
| NS3 | 1903 | 0 | 1 | 1 | 0 | Y | YPICKNGDW | 100 | | |
| NS3 | 1904 | 0 | 1 | 1 | 0 | Y | PICKNGDWD | 100 | | |
| NS3 | 1905 | 0 | 1 | 1 | 0 | Y | ICKNGDWDF | 100 | | |
| NS3 | 1906 | 0 | 1 | 1 | 0 | Y | CKNGDWDFV | 100 | | |
| NS3 | 1907 | 0 | 1 | 1 | 0 | Y | KNGDWDFVI | 100 | | |
| NS3 | 1908 | 0 | 1 | 1 | 0 | Y | NGDWDFVIT | 100 | | |
| NS3 | 1909 | 0 | 1 | 1 | 0 | Y | GDWDFVITT | 100 | | |
| NS3 | 1910 | 0 | 1 | 1 | 0 | Y | DWDFVITTD | 100 | | |
| NS3 | 1911 | 0 | 1 | 1 | 0 | Y | WDFVITTDI | 100 | | |
| NS3 | 1912 | 0 | 1 | 1 | 0 | Y | DFVITTDIS | 100 | | |
| NS3 | 1913 | 0 | 1 | 1 | 0 | Y | FVITTDISE | 100 | | |
| NS3 | 1914 | 0.11 | 2 | 2 | 0 | Y | VITTDISEM | 98.51 | VITTDISEV | 1.49 |
| NS3 | 1915 | 0.11 | 2 | 2 | 0 | Y | ITTDISEMG | 98.51 | ITTDISEVG | 1.49 |
| NS3 | 1916 | 0.11 | 2 | 2 | 0 | Y | TTDISEMGA | 98.51 | TTDISEVGA | 1.49 |
| NS3 | 1917 | 0.11 | 2 | 2 | 0 | Y | TDISEMGAN | 98.51 | TDISEVGAN | 1.49 |
| NS3 | 1918 | 0.11 | 2 | 2 | 0 | Y | DISEMGANF | 98.51 | DISEVGANF | 1.49 |
| NS3 | 1919 | 0.11 | 2 | 2 | 0 | Y | ISEMGANFG | 98.51 | ISEVGANFG | 1.49 |
| NS3 | 1920 | 0.11 | 2 | 2 | 0 | Y | SEMGANFGA | 98.51 | SEVGANFGA | 1.49 |
| NS3 | 1921 | 0.11 | 2 | 2 | 0 | Y | EMGANFGAS | 98.51 | EVGANFGAS | 1.49 |
| NS3 | 1922 | 0.11 | 2 | 2 | 0 | Y | MGANFGASR | 98.51 | VGANFGASR | 1.49 |
| NS3 | 1923 | 0 | 1 | 1 | 0 | Y | GANFGASRV | 100 | | |
| NS3 | 1924 | 0 | 1 | 1 | 0 | Y | ANFGASRVI | 100 | | |
| NS3 | 1925 | 0 | 1 | 1 | 0 | Y | NFGASRVID | 100 | | |
| NS3 | 1926 | 0 | 1 | 1 | 0 | Y | FGASRVIDC | 100 | | |

FIG. 36-72

Species: JEV (9-mers)

| protein | block starting position | entropy | total peptides in block | peptides required to c

FIG. 36-73

Species: JEV (9-mers)

| protein | block starting position | entropy | total peptides in block | peptides required to cover 99% of block | gap/X fraction 99% of block | covered w/ <= 5 peptides? | peptides required to cover 99% of block | frequency | peptides required to cover 99% of block | frequency |

FIG. 36-74

Species: JEV

| protein | block starting position | block entropy (9-mers) | total peptides in block | peptides required to cover 99% of block | gap/X fraction | 99% of block covered w/ <= 5 peptides? | peptides required

FIG. 36-75

Species: JEV (9-mers)

| protein | block starting position | block entropy | total peptides in block | peptides required to cover 99% of block | gap/X fraction | 99% of block covered w/ <= 5 pe

FIG. 36-76

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 36-77

Species: JEV (9-mers)

| protein | block starting position | block entropy | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2052 | 0.11 | 2 | 2

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2102 | 0.11 | 2 | 2 | 0 | Y | PRWLDARV

FIG. 36-80

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of

FIG. 36-81

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2152 | 0 | 1 | 1 | 0 | Y | DTM

FIG. 36-82

Species: JEV (9-mers)

| protein | block starting position | block entropy | total peptides in block | peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2177 | 0.53 | 5 | 5 | 0 | Y | ALETITLIV | 92.54 | ALETITLIA | 2.99 | ALETITLIV | 1.49 | ALETITLIA | 1.49 | ALETV

FIG. 36-83

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4A | 2208 | 0.11 | 2 | 2 | 0 | Y | GLGALVLTL | 98.51 | G

FIG. 36-84

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2233 | 0.61 | 2 | 2 | 0 | Y | GTLLIALLL | 85.07 | GTLLVALLL | 14.93 | | | | | | |
| NS4A | 2234 | 0.61 | 2 | 2

FIG. 36-85

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| 2K | 2258 | 0 | 1 | 1 | 0 | Y | NQLAVFLIC | 100 | | |
| 2K | 2259 | 0 | 1 | 1 | 0 | Y | QLAVFLICV | 100 | | |
| 2K | 2260 | 0 | 1 | 1 | 0 | Y | LAVFLICVL | 100 | | |
| 2K | 2261 | 0 | 1 | 1 | 0 | Y | AVFLICVLT | 100 | | |
| 2K | 2262 | 0 | 1 | 1 | 0 | Y | VFLICVLTV | 100 | | |
| 2K | 2263 | 0 | 1 | 1 | 0 | Y | FLICVLTVW | 100 | | |
| 2K | 2264 | 0 | 1 | 1 | 0 | Y | LICVLTVWG | 100 | | |
| 2K | 2265 | 0.11 | 2 | 2 | 0 | Y | ICVLTVWGV | 98.51 | ICVLTVWGM | 1.49 |
| 2K | 2266 | 0.22 | 3 | 3 | 0 | Y | CVLTVWGV | 97.01 | CVLTVWGVA | 1.49 | CVLTVWGMV | 1.49 |
| 2K | 2267 | 0.22 | 3 | 3 | 0 | Y | VLTVWGVA | 97.01 | VLTVWGVMA | 1.49 | VLTVWGVAA | 1.49 |
| 2K | 2268 | 0.22 | 3 | 3 | 0 | Y | LTVWGVAA | 97.01 | LTVWGVAAA | 1.49 | LTVWGMVAA | 1.49 |
| 2K | 2269 | 0.22 | 3 | 3 | 0 | Y | TVWGVAAN | 97.01 | TVWGVAAAN | 1.49 | TVWGMVAAN | 1.49 |
| 2K | 2270 | 0.22 | 3 | 3 | 0 | Y | VWGVAANE | 97.01 | VGVAAANE | 1.49 | VWGMVAANE | 1.49 |
| 2K | 2271 | 0.22 | 3 | 3 | 0 | Y | VGVAANEY | 97.01 | GVAAANEY | 1.49 | VGMVAANEY | 1.49 |
| 2K | 2272 | 0.22 | 3 | 3 | 0 | Y | GVAANEYG | 97.01 | GVAAANEYG | 1.49 | GMVAANEYG | 1.49 |
| 2K | 2273 | 0.22 | 3 | 3 | 0 | Y | VAANEYGM | 97.01 | VAAANEYGM | 1.49 | MVAANEYGM | 1.49 |
| 2K | 2274 | 0.11 | 2 | 2 | 0 | Y | AANEYGML | 98.51 | AAANEYGML | 1.49 | | |
| 2K | 2275 | 0 | 1 | 1 | 0 | Y | AANEYGMLE | 100 | | | | |
| 2K | 2276 | 0.11 | 2 | 2 | 1.49 | Y | ANEYGMLEK | 97.01 | ANEYGMLER | 1.49 | | |
| 2K | 2277 | 0.11 | 2 | 2 | 1.49 | Y | NEYGMLEKT | 97.01 | NEYGMLERT | 1.49 | | |
| 2K | 2278 | 0.11 | 2 | 2 | 1.49 | Y | EYGMLEKTK | 97.01 | EYGMLERTK | 1.49 | | |
| NS4B | 2279 | 0.11 | 2 | 2 | 1.49 | Y | YGMLEKTKA | 97.01 | YGMLERTKA | 1.49 | | |
| NS4B | 2280 | 0.11 | 2 | 2 | 1.49 | Y | GMLEKTKAD | 97.01 | GMLERTKAD | 1.49 | | |
| NS4B | 2281 | 0.23 | 3 | 3 | 1.49 | Y | MLEKTKADL | 95.52 | MLEKTKADL | 1.49 | M

FIG. 36-86

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2283 | 0.23 | 3 | 3 | 1.49 | Y | EKITKADL

FIG. 36-87

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2314 | 0.11 | 2 | 2 | 0 | Y | PATA

FIG. 36-88

Species: JEV (9-mers)

| protein | block starting position | block entropy | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2339 | 0.11 | 2 | 2 | 0 | Y | EYVTTSLAS | 98.51 | EYVTTSLAS | 1.49 | | | | |
| NS4B | 2340 | 0.11 | 2 | 2 | 0 | Y | YVTTSLASI | 98.51 | YVTTSLASI | 1.49 | | | | |
| NS4B | 2341 | 0.75 | 3 | 3 | 0 | Y | VTTSLASIN | 82.09 | VTTSLASIS | 16.42 | VTPSLASIS | 1.49 | | |
| NS4B | 2342 | 0.75 | 3 | 3 | 0 | Y | TTSLASINS | 82.09 | TTSLASISS | 16.42 | TPSLASISS | 1.49 | | |
| NS4B | 2343 | 0.75 | 3 | 3 | 0 | Y | TSLASINSQ | 82.09 | TSLASISSQ | 16.42 | PSLASISSQ | 1.49 | | |
| NS4B | 2344 | 0.68 | 2 | 2 | 0 | Y | SLASINSQA | 82.09 | SLASISSQA | 17.91 | | | | |
| NS4B | 2345 | 0.68 | 2 | 2 | 0 | Y | LASINSQAG | 82.09 | LASISSQAG | 17.91 | | | | |
| NS4B | 2346 | 0.68 | 2 | 2 | 0 | Y | ASINSQAGS | 82.09 | ASISSQAGS | 17.91 | | | | |
| NS4B | 2347 | 0.68 | 2 | 2 | 0 | Y | SINSQAGSL | 82.09 | SISSQAGSL | 17.91 | | | | |
| NS4B | 2348 | 0.68 | 2 | 2 | 0 | Y | INSQAGSLF | 82.09 | ISSQAGSLF | 17.91 | | | | |
| NS4B | 2349 | 0.68 | 2 | 2 | 0 | Y | NSQAGSLFV | 82.09 | SSQAGSLFV | 17.91 | | | | |
| NS4B | 2350 | 0 | 1 | 1 | 0 | Y | SQAGSLFVL | 100 | | | | | | |
| NS4B | 2351 | 0 | 1 | 1 | 0 | Y | QAGSLFVLP | 100 | | | | | | |
| NS4B | 2352 | 0 | 1 | 1 | 0 | Y | AGSLFVLPR | 100 | | | | | | |
| NS4B | 2353 | 0 | 1 | 1 | 0 | Y | GSLFVLPRG | 100 | | | | | | |
| NS4B | 2354 | 0 | 1 | 1 | 0 | Y | SLFVLPRGV | 100 | | | | | | |
| NS4B | 2355 | 0 | 1 | 1 | 0 | Y | LFVLPRGVP | 100 | | | | | | |
| NS4B | 2356 | 0.19 | 2 | 2 | 0 | Y | FVLPRGVPF | 97.01 | FVLPRGVPS | 2.99 | | | | |
| NS4B | 2357 | 0.19 | 2 | 2 | 0 | Y | VLPRGVPFT | 97.01 | VLPRGVPST | 2.99 | | | | |
| NS4B | 2358 | 0.19 | 2 | 2 | 0 | Y | LPRGVPFTD | 97.01 | LPRGVPSTD | 2.99 | | | | |
| NS4B | 2359 | 0.19 | 2 | 2 | 0 | Y | PRGVPFTDL | 97.01 | PRGVPSTDL | 2.99 | | | | |
| NS4B | 2360 | 0.19 | 2 | 2 | 0 | Y | RGVPFTDLD | 97.01 | RGVPSTDLD | 2.99 | | | | |
| NS4B | 2361 | 0.19 | 2 | 2 | 0 | Y | GVPFTDLDL | 97.01 | GVPSTDLDL | 2.99 | | | | |
| NS4B | 2362 | 0.19 | 2 | 2 | 0 | Y | VPFTDLDLT | 97.01 | VPSTDLDLT | 2.99 | | | | |
| NS4B | 2363 | 0.19 | 2 | 2 | 0 | Y | PFTDLDLTV | 97.01 | PSTDLDLTV | 2.99 | | | | |

FIG. 36-89

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2364 | 0.19 | 2 | 2 | 0 | Y | FTDLDLTVG | 97.01 | STDLDLTVG | 2.99 | | | | |
| NS4B | 2365 | 0 | 1 | 1 | 0 | Y | TDLDLTVGL | 100 | | | | | | |
| NS4B | 2366 | 0 | 1 | 1 | 0 | Y | DLDLTVGLV | 100 | | | | | | |
| NS4B | 2367 | 0.19 | 2 | 2 | 0 | Y | LDLTVGLVF | 97.01 | LDLTVGLVL | 2.99 | | | | |
| NS4B | 2368 | 0.19 | 2 | 2 | 0 | Y | DLTVGLVFL | 97.01 | DLTVGLVLL | 2.99 | | | | |
| NS4B | 2369 | 0.19 | 2 | 2 | 0 | Y | LTVGLVFLG | 97.01 | LTVGLVLLG | 2.99 | | | | |
| NS4B | 2370 | 0.19 | 2 | 2 | 0 | Y | TVGLVFLGC | 97.01 | TVGLVLLGC | 2.99 | | | | |
| NS4B | 2371 | 0.19 | 2 | 2 | 0 | Y | VGLVFLGCW | 97.01 | VGLVLLGCW | 2.99 | | | | |
| NS4B | 2372 | 0.19 | 2 | 2 | 0 | Y | GLVFLGCWG | 97.01 | GLVLLGCWG | 2.99 | | | | |
| NS4B | 2373 | 0.19 | 2 | 2 | 0 | Y | LVFLGCWGQ | 97.01 | LVLLGCWGQ | 2.99 | | | | |
| NS4B | 2374 | 0.52 | 3 | 3 | 0 | Y | VFLGCWGQI | 91.04 | VFLGCWGQV | 2.99 | VLLGCWGQI | 2.99 | | |
| NS4B | 2375 | 0.52 | 3 | 3 | 0 | Y | FLGCWGQIT | 91.04 | FLGCWGQVT | 2.99 | LLGCWGQIT | 2.99 | | |
| NS4B | 2376 | 0.33 | 3 | 2 | 0 | Y | LGCWGQITL | 94.03 | LGCWGQVTL | 2.99 | | | | |
| NS4B | 2377 | 0.33 | 3 | 2 | 0 | Y | GCWGQITLI | 94.03 | GCWGQVTLI | 2.99 | | | | |
| NS4B | 2378 | 0.33 | 2 | 2 | 0 | Y | CWGQITLIT | 94.03 | CWGQVTLIT | 2.99 | | | | |
| NS4B | 2379 | 0.77 | 4 | 4 | 0 | Y | WGQITLITF | 86.57 | WGQVTLITF | 5.97 | WGQITLITS | 4.48 | WGQITLITV | 2.99 |
| NS4B | 2380 | 0.77 | 4 | 4 | 0 | Y | GQITLITFL | 86.57 | GQVTLITFL | 5.97 | GQITLTSL | 4.48 | GQITLTVL | 2.99 |
| NS4B | 2381 | 0.77 | 4 | 4 | 0 | Y | QITLITFLT | 86.57 | QVTLITFLT | 5.97 | QITLTSLI | 4.48 | QITLTVLT | 2.99 |
| NS4B | 2382 | 0.77 | 4 | 4 | 0 | Y | ITLITFLTA | 86.57 | VTLITFLTA | 5.97 | ITLITSLIA | 4.48 | ILITVLTA | 2.99 |
| NS4B | 2383 | 0.83 | 4 | 4 | 0 | Y | TLITFLTAM | 85.07 | TLITFLTAV | 5.97 | TLITSLTAM | 4.48 | TLITVLTAM | 2.99 |
| NS4B | 2384 | 0.83 | 4 | 4 | 0 | Y | LITFLTAMV | 85.07 | LITFLTAVV | 5.97 | LITSLTAMV | 4.48 | LTVLTAMV | 2.99 |
| NS4B | 2385 | 0.83 | 4 | 4 | 0 | Y | ITFLTAMVL | 85.07 | TFLTAMVL | 5.97 | TSLTAMVL | 4.48 | TVLTAMVL | 2.99 |
| NS4B | 2388 | 1.32 | 5 | 5 | 0 | Y | LTAMVLATL | 65.67 | LTAMVLVTL | 25.37 | LTAWLATL | 5.97 | LTAMVLAIL | 2.99 | LTAWLTTL | 1.49 |
| NS4B | 2389 | 1.32 | 5 | 5 | 0 | Y | TAMVLATLH | 65.67 | TAMVLVTLH | 25.37 | TAWLATLH | 5.97 | TAWLTLH | 1.49 | TAMVLAILH | 1.49 |
| NS4B | 2390 | 1.32 | 5 | 5 | 0 | Y | AMVLATLHY | 65.67 | AMVLVTLHY | 25.37 | AWLATLHY | 5.97 | AWLTLTHY | 1.49 | AMVLAILHY | 1.49 |

FIG. 36-90

Species: JEV (9-mers)

| protein

FIG. 36-91

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency |
|

FIG. 36-92

Species: JEV (9-mers)

| protein | block starting position | block entropy | total peptides in block | peptides required to cover 99% of block | gap/X fraction of block | covered w/ <= 5 peptides? | peptides to cover 99% of block | frequency | peptides to cover 99% of block | frequency | peptides to cover 99% of block | frequency | peptides to cover 99% of block | frequency |
|---|---|---|---|---|---|---|---|---|---|---|---|---|---|---|
| NS4B | 2441 | 0.11 | 2 | 2 | 0 | Y | TTPLMQKKV | 98.51 | TTPLMQKKI | 1.49 | | | | |
| NS4B | 2442 | 0.11 | 2 | 2 | 0 | Y | TPLMQKKVG | 98.51 | TPLMQKKIG | 1

FIG. 36-93

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2466 | 0.33 | 4 | 4 | 0 | Y | PNVTTVREA | 95.52 | PNVTTVKKP | 1.49 | PNVSTVRKA | 1.49 | PKITTVREA | 1.49 |
| NS4B | 2467 | 0.33 | 4 | 4 | 0 | Y | NVTTVREAG | 95.52 | NVSTVRKAG | 1.49 | NVTTVKKPG | 1.49 | KITTVREAG | 1.49 |
| NS4B | 2468 | 0.33 | 4 | 4 | 0 | Y | VTTVREAGV | 95.52 | ITTVREAGV | 1.49 | VSTVRKAGV | 1.49 | VTTVKKPGV | 1.49 |
| NS4B | 2469 | 0.22 | 3 | 3 | 0 | Y | TTVREAGVL | 97.01 | STVRKAGVL | 1.49 | TTVKKPGVL | 1.49 | | |
| NS4B | 2470 | 0.22 | 3 | 3 | 0 | Y | TVREAGVLV | 97.01 | TVKKPGVLV | 1.49 | TVRKAGVLV | 1.49 | | |
| NS4B | 2471 | 0.22 | 3 | 3 | 0 | Y | VREAGVLVT | 97.01 | VRKAGVLVT | 1.49 | VKKPGVLVT | 1.49 | | |
| NS4B | 2472 | 0.22 | 3 | 3 | 0 | Y | REAGVLVTA | 97.01 | RKAGVLVTA | 1.49 | KKPGVLVTA | 1.49 | | |
| NS4B | 2473 | 0.42 | 4 | 4 | 0 | Y | EAGVLVTAA | 94.03 | EAGVLVTAR | 2.99 | KAGVLVTAA | 1.49 | KPGVLVTAA | 1.49 |
| NS4B | 2474 | 0.3 | 3 | 3 | 0 | Y | AGVLVTAAT | 95.52 | AGVLVTART | 2.99 | PGVLVTAAT | 1.49 | | |
| NS4B | 2475 | 0.19 | 2 | 2 | 0 | Y | GVLVTAATL | 97.01 | GVLVTARTL | 2.99 | | | | |
| NS4B | 2476 | 0.3 | 3 | 3 | 0 | Y | VLVTAATLI | 95.52 | VLVTARTLI | 2.99 | VLVTAATLS | 1.49 | | |
| NS4B | 2477 | 0.3 | 3 | 3 | 0 | Y | LVTAATLTL | 95.52 | LVTARTLTL | 2.99 | LVTAATLSL | 1.49 | | |
| NS4B | 2478 | 0.3 | 3 | 3 | 0 | Y | VTAATLTLW | 95.52 | VTARTLTLW | 2.99 | VTAATLSLW | 1.49 | | |
| NS4B | 2479 | 0.3 | 3 | 3 | 0 | Y | TAATLTLWD | 95.52 | TARTLTLWD | 2.99 | TAATLSLWD | 1.49 | | |
| NS4B | 2480 | 0.3 | 3 | 3 | 0 | Y | AATLTLWDN | 95.52 | ARTLTLWDN | 2.99 | AATLSLWDN | 1.49 | | |
| NS4B | 2481 | 0.3 | 3 | 3 | 0 | Y | ATLTLWDNG | 95.52 | RTLTLWDNG | 2.99 | ATLSLWDNG | 1.49 | | |
| NS4B | 2482 | 0.11 | 2 | 2 | 0 | Y | TLTLWDNGA | 98.51 | TLSLWDNGA | 1.49 | | | | |
| NS4B | 2483 | 0.11 | 2 | 2 | 0 | Y | LTLWDNGAS | 98.51 | LSLWDNGAS | 1.49 | | | | |
| NS4B | 2484 | 0.11 | 2 | 2 | 0 | Y | TLWDNGASA | 98.51 | SLWDNGASA | 1.49 | | | | |
| NS4B | 2485 | 0.11 | 2 | 2 | 0 | Y | LWDNGASAV | 98.51 | LWDNGASAA | 1.49 | | | | |
| NS4B | 2486 | 0.11 | 2 | 2 | 0 | Y | WDNGASAVW | 98.51 | WDNGASAAW | 1.49 | | | | |
| NS4B | 2487 | 0.11 | 2 | 2 | 0 | Y | DNGASAVWN | 98.51 | DNGASAAWN | 1.49 | | | | |
| NS4B | 2488 | 0.11 | 2 | 2 | 0 | Y | NGASAVWNS | 98.51 | NGASAAWNS | 1.49 | | | | |
| NS4B | 2489 | 0.11 | 2 | 2 | 0 | Y | GASAVWNST | 98.51 | GASAAWNST | 1.49 | | | | |
| NS4B | 2490 | 0.11 | 2 | 2 | 0 | Y | ASAVWNSTT | 98.51 | ASAAWNSTT | 1.49 | | | | |

FIG. 36-94

Species: JEV (9-mers)

| protein | block starting position | entropy block | total peptides in block | pe

FIG. 36-95

Species: JEV (9-mers)

| protein | block starting position | block entropy | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2516 | 0 | 1 | 1 | 0 | Y | IAWT

FIG. 36-96

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2541 | 0.33 | 4 | 4 | 0 | Y | EQWKERLNA | 95.52 | EQWKERLNA | 1.49 | DQWKEKLNA | 1.49 | | |
| NS5 | 2542 | 0.33 | 4 | 4 | 0 | Y | QWKEKLNAM | 95.52 | QWKERLNAM | 1.49 | QWKEKLNAL | 1.49 | | |
| NS5 | 2543 | 0.45 | 5 | 5 | 0 | Y | WKEKLNAMS | 94.03 | WKERLNAMS | 1.49 | WKEK

FIG. 36-97

Species: JEV (9-mers)

| protein | block starting position | entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2567 | 0.19 | 2 | 2 | 0 | Y | DRTEARRAR | 97.01 | DRTEACRAR | 2.99 | | | | | | |
| NS5 | 2568 | 0.3 | 3 | 3 | 0 | Y | RTEARRARR | 95.52 | RTEACRARR | 2.99 | RTEARRARS | 1.49 | | | | |
| NS5 | 2569 | 0.3 | 3 | 3 | 0 | Y | TEARRARRE | 95.52 | TEACRARRE | 2.99 | TEARRARSE | 1.49 | | | | |
| NS5 | 2570 | 0.3 | 3 | 3 | 0 | Y | EARRARREN | 95.52 | EACRARREN | 2.99 | EARRARSEN | 1.49 | | | | |
| NS5 | 2571 | 0.3 | 3 | 3 | 0 | Y | ARRARRENN | 95.52 | ACRARRENN | 2.99 | ARRARSENN | 1.49 | | | | |
| NS5 | 2572 | 0.84 | 5 | 5 | 0 | Y | RRARRENNI | 85.07 | RRARRENNV | 8.96 | CRARRENNI | 2.99 | RRARRENNK | 1.49 | RRARSENNI | 1.49 |
| NS5 | 2573 | 0.65 | 4 | 4 | 0 | Y | RARRENNIV | 88.06 | RARRENNVV | 8.96 | RARRENNIV | 1.49 | RARSENNIV | 1.49 | | |
| NS5 | 2574 | 0.65 | 4 | 4 | 0 | Y | ARRENNIVG | 88.06 | ARRENNVVG | 8.96 | ARSENNIVG | 1.49 | ARRENNKVG | 1.49 | | |
| NS5 | 2575 | 0.65 | 4 | 4 | 0 | Y | RRENNIVGG | 88.06 | RRENNVVGG | 8.96 | RRENNKVGG | 1.49 | RSENNIVGG | 1.49 | | |
| NS5 | 2576 | 0.65 | 4 | 4 | 0 | Y | RENNIVGGH | 88.06 | RENNVVGGH | 8.96 | SENNIVGGH | 1.49 | RENNKVGGH | 1.49 | | |
| NS5 | 2577 | 0.54 | 3 | 3 | 0 | Y | ENNIVGGHP | 89.55 | ENNVVGGHP | 8.96 | ENNKVGGHP | 1.49 | | | | |
| NS5 | 2578 | 0.54 | 3 | 3 | 0 | Y | NNIVGGHPV | 89.55 | NNVVGGHPV | 8.96 | NNKVGGHPV | 1.49 | | | | |
| NS5 | 2579 | 0.54 | 3 | 3 | 0 | Y | NIVGGHPVS | 89.55 | NVVGGHPVS | 8.96 | NKVGGHPVS | 1.49 | | | | |
| NS5 | 2580 | 0.54 | 3 | 3 | 0 | Y | IVGGHPVSR | 89.55 | VVGGHPVSR | 8.96 | KVGGHPVSR | 1.49 | | | | |
| NS5 | 2581 | 0 | 1 | 1 | 0 | Y | VGGHPVSRG | 100 | | | | | | | | |
| NS5 | 2582 | 0 | 1 | 1 | 0 | Y | GGHPVSRGS | 100 | | | | | | | | |
| NS5 | 2583 | 0 | 1 | 1 | 0 | Y | GHPVSRGSA | 100 | | | | | | | | |
| NS5 | 2584 | 0 | 1 | 1 | 0 | Y | HPVSRGSAK | 100 | | | | | | | | |
| NS5 | 2585 | 0 | 1 | 1 | 0 | Y | PVSRGSAKL | 100 | | | | | | | | |
| NS5 | 2586 | 0 | 1 | 1 | 0 | Y | VSRGSAKLR | 100 | | | | | | | | |
| NS5 | 2587 | 0 | 1 | 1 | 0 | Y | SRGSAKLRW | 100 | | | | | | | | |
| NS5 | 2588 | 0 | 1 | 1 | 0 | Y | RGSAKLRWL | 100 | | | | | | | | |
| NS5 | 2589 | 0 | 1 | 1 | 0 | Y | GSAKLRWLV | 100 | | | | | | | | |
| NS5 | 2590 | 0 | 1 | 1 | 0 | Y | SAKLRWLVE | 100 | | | | | | | | |
| NS5 | 2591 | 0 | 1 | 1 | 0 | Y | AKLRWLVEK | 100 | | | | | | | | |

FIG. 36-98

Species: JEV (9-mers)

| protein | block starting position | entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2592 | 0 | 1 | 1 | 0 | Y | KLRWLVEKG | 100 | | | | | | |
| NS5 | 2593 | 0 | 1 | 1 | 0 | Y | LRWLVEKGF | 100 | | | | | | |
| NS5 | 2594 | 0 | 1 | 1 | 0 | Y | RWLVEKGFV | 100 | | | | | | |
| NS5 | 2595 | 0.11 | 2 | 2 | 0 | Y | WLVEKGFVS | 98.51 | WLVEKGFVP | 1.49 | | | | |
| NS5 | 2596 | 0.11 | 2 | 2 | 0 | Y | LVEKGFVSP | 98.51 | LVEKGFVPP | 1.49 | | | | |
| NS5 | 2597 | 0.11 | 2 | 2 | 0 | Y | VEKGFVSPI | 98.51 | VEKGFVPPI | 1.49 | | | | |
| NS5 | 2598 | 0.11 | 2 | 2 | 0 | Y | EKGFVSPIG | 98.51 | EKGFVPPIG | 1.49 | | | | |
| NS5 | 2599 | 0.11 | 2 | 2 | 0 | Y | KGFVSPIGK | 98.51 | KGFVPPIGK | 1.49 | | | | |
| NS5 | 2600 | 0.11 | 2 | 2 | 0 | Y | GFVSPIGKV | 98.51 | GFVPPIGKV | 1.49 | | | | |
| NS5 | 2601 | 0.22 | 3 | 3 | 0 | Y | FVSPIGKVI | 97.01 | FVPPIGKVI | 1.49 | | | | |
| NS5 | 2602 | 0.22 | 3 | 3 | 0 | Y | VSPIGKVID | 97.01 | VPPIGKVID | 1.49 | | | | |
| NS5 | 2603 | 0.22 | 3 | 3 | 0 | Y | SPIGKVIDL | 97.01 | PPIGKVIDL | 1.49 | | | | |
| NS5 | 2604 | 0.11 | 2 | 2 | 0 | Y | PIGKVIDLG | 98.51 | | | | | | |
| NS5 | 2605 | 0.11 | 2 | 2 | 0 | Y | IGKVIDLGC | 98.51 | | | | | | |
| NS5 | 2606 | 0.11 | 2 | 2 | 0 | Y | GKVIDLGCG | 98.51 | KVIDLGCGC | 1.49 | | | | |
| NS5 | 2607 | 0.22 | 3 | 3 | 0 | Y | KVIDLGCGR | 97.01 | WDLGCGRG | 1.49 | | | | |
| NS5 | 2608 | 0.22 | 3 | 3 | 0 | Y | VIDLGCGRG | 97.01 | IDLGCGCGG | 1.49 | | | | |
| NS5 | 2609 | 0.42 | 4 | 4 | 0 | Y | IDLGCGRGG | 94.03 | DLGCCGGW | 2.99 | VDLGCGRGG | 1.49 | | |
| NS5 | 2610 | 0.3 | 3 | 3 | 0 | Y | DLGCGRGGW | 95.52 | LGCCGGWS | 2.99 | | | | |
| NS5 | 2611 | 0.3 | 3 | 3 | 0 | Y | LGCGRGGWS | 95.52 | GCGCGGWS | 2.99 | | | | |
| NS5 | 2612 | 0.3 | 3 | 3 | 0 | Y | GCGRGGWSY | 95.52 | CGGGGWSY | 2.99 | | | | |
| NS5 | 2613 | 0.42 | 4 | 4 | 0 | Y | CGRGGWSYY | 94.03 | CGRGGWSYC | 2.99 | CGCGGWSYY | 1.49 | | |
| NS5 | 2614 | 0.42 | 4 | 4 | 0 | Y | GRGGWSYYA | 94.03 | GCGGWSYYA | 2.99 | RGGWSYCA | 1.49 | | |
| NS5 | 2615 | 0.42 | 4 | 4 | 0 | Y | RGGWSYYAA | 94.03 | RGGWSYCAA | 2.99 | CGGWSYYAA | 1.49 | | |
| NS5 | 2616 | 0.3 | 3 | 3 | 0 | Y | GGWSYYAAT | 95.52 | GGWSYCAAT | 2.99 | | | | |

FIG. 36-99

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2617 | 0.3 | 3 | 3 | 0 | Y | GWSYA

FIG. 36-100

Species: JEV (9-mers)

| protein | block starting position | block entropy | total peptides in block | peptides required to cover 99% of block | gap/X fraction | 99% of block covered w

FIG. 36-101

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block |

FIG. 36-102

Species: JEV (9-mers)

| protein | block starting position | ent

FIG. 36-103

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2717 | 0 | 1 | 1 | 0 | Y | PYMPKVIEK | 100 | | | | |
| NS5 | 2718 | 0.22 | 3 | 3 | 0 | Y | YMPKVIEKM | 97.01 | YMPKVIEKN | 1.49 | YMPKVIEKI | 1.49 |
| NS5 | 2719 | 0.22 | 3 | 3 | 0 | Y | MPKVIEKME | 97.01 | MPKVIEKNE | 1.49 | MPKVIEKIE | 1.49 |
| NS5 | 2720 | 0.22 | 3 |

FIG. 36-104

Species: JEV (

FIG. 36-105

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2767 | 0 | 1 | 1 | 0 | Y | TSQVLLGRM | 100 | | | | | | |
| NS5 | 2768 | 0.11 | 2 | 2 | 0 | Y | SQVLLGRMD | 98.51 | SQVLLGRMN | 1.49 | | | | |
| NS5 | 2769 | 0.11 | 2 | 2 | 0 | Y | QVLLGRMDR | 98.51 | QVLLGRMNR | 1.49 | | | | |
| NS5 | 2770 | 0.22 | 3 | 3 | 0 | Y | VLLGRMDRT | 97.01 | VLLGRMNRT | 1.49 | VLLGRMDRA | 1.49 | | |
| NS5 | 2771 | 0.22 | 3 | 3 | 0 | Y | LLGRMDRTV | 97.01 | LLGRMNRTV | 1.49 | LLGRMDRAV | 1.49 | | |
| NS5 | 2772 | 0.22 | 3 | 3 | 0 | Y | LGRMDRTVW | 97.01 | LGRMNRTVW | 1.49 | LGRMDRAVW | 1.49 | | |
| NS5 | 2773 | 0.22 | 3 | 3 | 0 | Y | GRMDRTVWR | 97.01 | GRMNRTVWR | 1.49 | GRMDRAVWR | 1.49 | | |
| NS5 | 2774 | 0.22 | 3 | 3 | 0 | Y | RMDRTVWRG | 97.01 | RMNRTVWRG | 1.49 | RMDRAVWRG | 1.49 | | |
| NS5 | 2775 | 0.22 | 3 | 4 | 0 | Y | MDRTVWRGP | 97.01 | MNRTVWRGP | 1.49 | MDRAVWRGP | 1.49 | | |
| NS5 | 2776 | 0.33 | 4 | 3 | 0 | Y | DRTVWRGPK | 95.52 | DRAVWRGPK | 1.49 | DRTVWRGPR | 1.49 | NRTVWRGPK | 1.49 |
| NS5 | 2777 | 0.22 | 3 | 4 | 0 | Y | RTVWRGPKY | 97.01 | RTVWRGPRY | 1.49 | RAVWRGPKY | 1.49 | AVWRGPKYE | 1.49 |
| NS5 | 2778 | 0.33 | 4 | 3 | 0 | Y | TVWRGPKYE | 95.52 | TVWRGPRYE | 1.49 | TVWRGPKYE | 1.49 | | |
| NS5 | 2779 | 0.22 | 3 | 3 | 0 | Y | VWRGPKYEE | 97.01 | VWRGPRYEE | 1.49 | VWRGPRYEE | 1.49 | | |
| NS5 | 2780 | 0.22 | 3 | 3 | 0 | Y | WRGPKYEED | 97.01 | WRGPRYEED | 1.49 | WRGPRYEED | 1.49 | | |
| NS5 | 2781 | 0.22 | 3 | 3 | 0 | Y | RGPKYEEDV | 97.01 | RGPRYEEDV | 1.49 | RGPRYEEDV | 1.49 | | |
| NS5 | 2782 | 0.22 | 3 | 3 | 0 | Y | GPKYEEDVN | 97.01 | GPRYEEDVN | 1.49 | GPKYEDVN | 1.49 | | |
| NS5 | 2783 | 0.22 | 3 | 3 | 0 | Y | PKYEEDVNL | 97.01 | PRYEEDVNL | 1.49 | PRYEEDVNL | 1.49 | | |
| NS5 | 2784 | 0.22 | 3 | 3 | 0 | Y | KYEEDVNLG | 97.01 | KYKEDVNLG | 1.49 | RYEEDVNLG | 1.49 | | |
| NS5 | 2785 | 0.11 | 2 | 2 | 0 | Y | YEEDVNLGS | 98.51 | YKEDVNLGS | 1.49 | | | | |
| NS5 | 2786 | 0.11 | 2 | 2 | 0 | Y | EEDVNLGSG | 98.51 | KEDVNLGSG | 1.49 | | | | |
| NS5 | 2787 | 0 | 1 | 1 | 0 | Y | EDVNLGSGT | 100 | | | | | | |
| NS5 | 2788 | 0 | 1 | 1 | 0 | Y | DVNLGSGTR | 100 | | | | | | |
| NS5 | 2789 | 0 | 1 | 1 | 0 | Y | VNLGSGTRA | 100 | | | | | | |
| NS5 | 2790 | 0 | 1 | 1 | 0 | Y | NLGSGTRAV | 100 | | | | | | |
| NS5 | 2791 | 0 | 1 | 1 | 0 | Y | LGSGTRAVG | 100 | | | | | | |

FIG. 36-106

Species: JEV (9-mers)

| protein | block starting position | block entropy | total peptides in block | peptides required to cover 99% of block | gap/X fraction | covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2792 | 0 | 1 | 1 | 0 | Y | GSGTRAVGK | 100 | | | | | | |
| NS5 | 2793 | 0 | 1 | 1 | 0 | Y | SGTRAVGKG | 100 | | | | | | |
| NS5 | 2794 | 0 | 1 | 1 | 0 | Y | GTRAVGKGE | 100 | | | | | | |
| NS5 | 2795 | 0.33 | 2 | 2 | 0 | Y | TRAVGKGEV | 94.03 | TRAVGKGEI | 5.97 | | | | |
| NS5 | 2796 | 0.33 | 2 | 2 | 0 | Y | RAVGKGEVH | 94.03 | RAVGKGEIH | 5.97 | | | | |
| NS5 | 2797 | 0.33 | 2 | 2 | 0 | Y | AVGKGEVHS | 94.03 | AVGKGEIHS | 5.97 | | | | |
| NS5 | 2798 | 0.7 | 4 | 4 | 0 | Y | VGKGEVHSN | 88.06 | VGKGEIHSN | 5.97 | VGKGEVHSD | 4.48 | | |
| NS5 | 2799 | 0.7 | 4 | 4 | 0 | Y | GKGEVHSNQ | 88.06 | GKGEIHSNQ | 5.97 | GKGEVHSDQ | 4.48 | | |
| NS5 | 2807 | 0.89 | 5 | 5 | 0 | Y | QEKIRKRIQ | 82.09 | QEKIRRRIQ | 13.43 | QDKIRRRIQ | 1.49 | QGKIKKRIQ | 1.49 |
| NS5 | 2808 | 0.89 | 5 | 5 | 0 | Y | EKIKKRIQK | 82.09 | EKIRRRIQK | 13.43 | DKIRRRIQK | 1.49 | GKIKKRIQK | 1.49 |
| NS5 | 2809 | 0.82 | 4 | 4 | 0 | Y | KIKKRIQKL | 82.09 | KIRRRIQKL | 14.93 | KIKKRIQKQ | 1.49 | | |
| NS5 | 2810 | 0.97 | 5 | 5 | 0 | Y | IKKRIQKLK | 82.09 | IRRRIQKLR | 8.96 | IRRRIQKLK | 5.97 | IKKRIQKQK | 1.49 |
| NS5 | 2811 | 0.97 | 5 | 5 | 0 | Y | KKRIQKLKE | 82.09 | RRRIQKLRE | 8.96 | KKRIQKLRE | 5.97 | RRRIQKLRE | 1.49 |
| NS5 | 2812 | 0.71 | 4 | 4 | 0 | Y | KRIQKLKEE | 88.06 | KRIQKLREE | 7.46 | KRIQKQKEE | 1.49 | RRIQKLREE | 1.49 |
| NS5 | 2813 | 0.65 | 4 | 4 | 0 | Y | RIQKLREEF | 88.06 | RIQKLREEF | 8.96 | RIQKQKEEF | 1.49 | | |
| NS5 | 2814 | 0.71 | 5 | 5 | 0 | Y | IQKLREEFA | 88.06 | IQKLREEFA | 7.46 | IQKQKEEFA | 1.49 | IQKLREEFG | 1.49 |
| NS5 | 2815 | 0.71 | 5 | 5 | 0 | Y | QKLREEFAT | 88.06 | QKLREEFAT | 7.46 | QKQKEEFAT | 1.49 | QKLREGFAT | 1.49 |
| NS5 | 2816 | 0.71 | 5 | 5 | 0 | Y | KLREEFATT | 88.06 | KLREEFATT | 7.46 | KLREGFATT | 1.49 | KQKEEFATT | 1.49 |
| NS5 | 2817 | 0.71 | 4 | 4 | 0 | Y | LREEFATTW | 88.06 | LREEFATTW | 7.46 | LREGFATTW | 1.49 | LREEFGTTW | 1.49 |
| NS5 | 2818 | 0.6 | 4 | 4 | 0 | Y | KEEFATTWH | 89.55 | REEFATTWH | 7.46 | REGFATTWH | 1.49 | | |
| NS5 | 2819 | 0.33 | 4 | 4 | 0 | Y | EEFATTWHK | 95.52 | EGFATTWHK | 1.49 | EEFATTWHR | 1.49 | | |
| NS5 | 2820 | 0.33 | 4 | 4 | 0 | Y | EFATTWHKD | 95.52 | GFATTWHKD | 1.49 | EFATTWHRD | 1.49 | | |
| NS5 | 2821 | 0.33 | 4 | 4 | 0 | Y | FATTWHKDP | 95.52 | FATTWHKDP | 1.49 | FGTTWHKDP | 1.49 | | |
| NS5 | 2822 | 0.33 | 4 | 4 | 0 | Y | ATTWHKDPE | 95.52 | GTTWHKDPE | 1.49 | ATTWHRDPE | 1.49 | ATTWHKDHE | 1.49 |
| NS5 | 2823 | 0.22 | 3 | 3 | 0 | Y | TTWHKDPEH | 97.01 | TTWHRDPEH | 1.49 | TTWHKDHEH | 1.49 | | |

FIG. 36-107

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2824 | 0.22 | 3 | 3 | 0 | Y | TWHKDPEHP | 97.01 | TWHKDPEH

FIG. 36-108

Species: JEV (9-mers)

| protein | block starting position | entropy block | total peptides in block | peptides required to cover 99% of block | gap/χ fraction | covered w/ <= 5 peptides? | peptides required to cover 99% of block |

FIG. 36-109

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2874 | 0.11 | 2 | 2 | 0 | Y | M

FIG. 36-110

Species: JEV (9-mers)

| protein | block starting position | entropy block | total peptides in block | pe

FIG. 36-111

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2932 | 0.53 | 5 | 5 | 1.49 | Y | FIKKV

FIG. 36-112

Species: JEV (9-mers)

| protein | block starting position | entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2968 | 0.82 | 3 | 3 | 0 | Y | VDEERENHL | 79.1 | VNEERENHL | 19.4 | VDVERENHL | 1.49 | | |
| NS5 | 2969 | 0.82 | 3 | 3 | 0 | Y | DEERENHLR | 79.1 | NEERENHLR | 19.4 | DVERENHLR | 1.49 | | |
| NS5 | 2970 | 0.11 | 2 | 2 | 0 | Y | EERENHLRG | 98.51 | VERENHLRG | 1.49 | | | | |
| NS5 | 2971 | 0 | 1 | 1 | 0 | Y | ERENHLRGE | 100 | | | | | | |
| NS5 | 2972 | 0 | 1 | 1 | 0 | Y | RENHLRGEC | 100 | | | | | | |
| NS5 | 2973 | 0 | 1 | 1 | 0 | Y | ENHLRGECH | 100 | | | | | | |
| NS5 | 2974 | 0 | 1 | 1 | 0 | Y | NHLRGECHT | 100 | | | | | | |
| NS5 | 2975 | 0.11 | 2 | 2 | 0 | Y | HLRGECHTC | 98.51 | HLRGECHTR | 1.49 | | | | |
| NS5 | 2976 | 0.37 | 3 | 2 | 0 | Y | LRGECHTCI | 94.03 | LRGECHTCV | 4.48 | LRGECHTRI | 1.49 | | |
| NS5 | 2977 | 0.37 | 3 | 2 | 0 | Y | RGECHTCIY | 94.03 | RGECHTCVY | 4.48 | RGECHTRIY | 1.49 | | |
| NS5 | 2978 | 0.42 | 4 | 3 | 0 | Y | GECHTCIYN | 94.03 | GECHTCVYN | 2.99 | GECHTRIYN | 1.49 | GECHTCVYH | 1.49 |
| NS5 | 2979 | 0.42 | 4 | 3 | 0 | Y | ECHTCIYNM | 94.03 | ECHTCVYNM | 2.99 | ECHTRIYNM | 1.49 | ECHTCVYHM | 1.49 |
| NS5 | 2980 | 0.42 | 4 | 3 | 0 | Y | CHTCIYNMM | 94.03 | CHTCVYNMM | 2.99 | CHTRIYNMM | 1.49 | CHTRIYNMM | 1.49 |
| NS5 | 2981 | 0.42 | 4 | 3 | 0 | Y | HTCIYNMMG | 94.03 | HTCVYNMMG | 2.99 | HTCVYHMM | 1.49 | HTRIYNMMG | 1.49 |
| NS5 | 2982 | 0.42 | 4 | 3 | 0 | Y | TCIYNMMGK | 94.03 | TCVYNMMGK | 2.99 | TCVYHMMG | 1.49 | TRIYNMMGK | 1.49 |
| NS5 | 2983 | 0.42 | 4 | 3 | 0 | Y | CIYNMMGKR | 94.03 | CVYNMMGKR | 2.99 | RIYNMMGKR | 1.49 | CVYHMMGKR | 1.49 |
| NS5 | 2984 | 0.3 | 3 | 3 | 0 | Y | IYNMMGKRE | 95.52 | VYNMMGKRE | 2.99 | VYHMMGKRE | 1.49 | | |
| NS5 | 2985 | 0.11 | 2 | 2 | 0 | Y | YNMMGKREK | 98.51 | YHMMGKREK | 1.49 | | | | |
| NS5 | 2986 | 0.11 | 2 | 2 | 0 | Y | NMMGKREKK | 98.51 | HMMGKREKK | 1.49 | | | | |
| NS5 | 2987 | 0 | 1 | 1 | 0 | Y | MMGKREKKP | 100 | | | | | | |
| NS5 | 2988 | 0 | 1 | 1 | 0 | Y | MGKREKKPG | 100 | | | | | | |
| NS5 | 2989 | 0 | 1 | 1 | 0 | Y | GKREKKPGE | 100 | | | | | | |
| NS5 | 2990 | 0 | 1 | 1 | 0 | Y | KREKKPGEF | 100 | | | | | | |
| NS5 | 2991 | 0 | 1 | 1 | 0 | Y | REKKPGEFG | 100 | | | | | | |
| NS5 | 2992 | 0 | 1 | 1 | 0 | Y | EKKPGEFGK | 100 | | | | | | |

FIG. 36-114

Species: JEV (9-mers)

| protein | block

FIG. 36-115

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides required to cover 99% of block | fr

Species: JEV (9-mers)

| protein | block starting position | entropy block | total peptides in block | peptides required to cover 99% of block | gap/X fraction 99% of block | covered w/ =>5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3097 | 0 | 1 | 1 | 0 | Y | LARAIIELT | 100 | | | | | | |
| NS5 | 3098 | 0 | 1 | 1 | 0 | Y | ARAIIELTY | 100 | | | | | | |
| NS5 | 3099 | 0.11 | 2 | 2 | 0 | Y | RAI

FIG. 36-118

Species: JEV (9-mers)

| protein | block starting position | entropy block | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3125 | 0.22 | 3 | 3 | 0 | Y | DVISREDQR | 97.01 | VVYSREDQR | 1.49 | | | | |
| NS5 | 3126 | 0.22 | 3 | 3 | 0 | Y | VISREDQRG | 97.01 | VYSREDQRG | 1.49 | | | | |
| NS5 | 3127 | 0.22 | 3 | 3 | 0 | Y | ISREDQRGS | 97.01 | YSREDQRGS | 1.49 | | | | |
| NS5 | 3128 | 0.11 | 2 | 2 | 0 | Y | SREDQRGSG | 98.51 | SRENQRGSG | 1.49 | AVISRENQR | 1.49 | | |
| NS5 | 3129 | 0.11 | 2 | 2 | 0 | Y | REDQRGSGQ | 98.51 | RENQRGSGQ | 1.49 | VISRENQRG | 1.49 | | |
| NS5 | 3130 | 0.11 | 2 | 2 | 0 | Y | EDQRGSGQV | 98.51 | ENQRGSGQV | 1.49 | ISRENQRGS | 1.49 | | |
| NS5 | 3131 | 0.11 | 2 | 2 | 0 | Y | DQRGSGQVV | 98.51 | NQRGSGQVV | 1.49 | | | | |
| NS5 | 3132 | 0 | 1 | 1 | 0 | Y | QRGSGQVVT | 100 | | | | | | |
| NS5 | 3133 | 0 | 1 | 1 | 0 | Y | RGSGQVVTY | 100 | | | | | | |
| NS5 | 3134 | 0 | 1 | 1 | 0 | Y | GSGQVVTYA | 100 | | | | | | |
| NS5 | 3135 | 0 | 1 | 1 | 0 | Y | SGQVVTYAL | 100 | | | | | | |
| NS5 | 3136 | 0 | 1 | 1 | 0 | Y | GQVVTYALN | 100 | | | | | | |
| NS5 | 3137 | 0 | 1 | 1 | 0 | Y | QVVTYALNT | 100 | | | | | | |
| NS5 | 3138 | 0 | 1 | 1 | 0 | Y | VVTYALNTF | 100 | | | | | | |
| NS5 | 3139 | 0 | 1 | 1 | 0 | Y | VTYALNTFT | 100 | | | | | | |
| NS5 | 3140 | 0 | 1 | 1 | 0 | Y | TYALNTFTN | 100 | | | | | | |
| NS5 | 3141 | 0 | 1 | 1 | 0 | Y | YALNTFTNI | 100 | | | | | | |
| NS5 | 3142 | 0 | 1 | 1 | 0 | Y | ALNTFTNIA | 100 | | | | | | |
| NS5 | 3143 | 0 | 1 | 1 | 0 | Y | LNTFTNIAY | 100 | | | | | | |
| NS5 | 3144 | 0 | 1 | 1 | 0 | Y | NTFTNIAVQ | 100 | | | | | | |
| NS5 | 3145 | 0.11 | 2 | 2 | 0 | Y | TFTNIAVQL | 98.51 | TFTNIAVQF | 1.49 | | | | |
| NS5 | 3146 | 0.11 | 2 | 2 | 0 | Y | FTNIAVQLV | 98.51 | FTNIAVQFV | 1.49 | | | | |
| NS5 | 3147 | 0.11 | 2 | 2 | 0 | Y | TNIAVQLVR | 98.51 | TNIAVQFVR | 1.49 | | | | |
| NS5 | 3148 | 0.11 | 2 | 2 | 0 | Y | NIAVQLVRL | 98.51 | NIAVQFVRL | 1.49 | | | | |
| NS5 | 3149 | 0.22 | 3 | 3 | 0 | Y | IAVQLVRLM | 97.01 | IAVQFVRLM | 1.49 | IAVQLVRLV | 1.49 | | |

FIG. 36-119

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequency | peptides

FIG. 36-120

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3177 | 0 | 1 | 1 | 0 | Y | IAVRTWLFE | 100 | | | | | | |
| NS5 | 3178 | 0 | 1 | 1 | 0 | Y | AVRTWLFEN | 100 | | | | | | |
| NS5 | 3179 | 0 | 1 | 1 | 0 | Y | VRTWLFENG | 100 | | | | | | |
| NS5 | 3180 | 0.11 | 2 | 2 | 0 | Y | RTWLFENGE | 98.51 | RTWLFENG

FIG. 36-121

Species: JEV (9-mers)

| protein | block starting position | block entropy | total peptides in block | peptides required to cover 99% of block | gap/X fraction | 99% of block covered w/ <= 5 peptides? | cover 99% of block | frequency | cover 99% of block | frequency | cover 99% of block | frequency | cover

FIG. 36-122

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |

FIG. 36-123

Species: JEV (9-mers)

| protein | block starting position | entropy block | total peptides in block | peptides required to cover 99% of block | gap/X fraction | 99% of block covered w/ <= 5 peptides? | peptides required to cover 99% of block | frequ

FIG. 36-124

Species: JEV (9-mers)

| prot

FIG. 36-125

Species: JEV (9-mers)

| protein | block starting position | block entropy | total peptides in block | peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3302 | 0.42 | 4 | 4 | 0 | Y | YFHRRDLRL | 94.03 | YFHRRYLRL | 2.99 | YFHRRDQRL | 1.49 | YFHRRDLCL | 1.49 |
| NS5 | 3303 | 0.42 | 4 | 4 | 0 | Y | FHRRDLRLM | 94.03 | FHRRYLRLM | 2.99 | FHRRDLCLM | 1.49 | FHRRDQRLM | 1.49 |
| NS5 | 3304 | 0.42 | 4 | 4 | 0 | Y | HRRDLRLMA | 94.03 | HRRYLRLMA | 2.99 | HRRDQRLMA | 1.49 | HRRDLCLMA | 1.49 |
| NS5 | 3305 | 0.42 | 4 | 4 | 0 | Y | RRDLRLMAN | 94.03 | RRYLRLMAN | 2.99 | RRDLCLMAN | 1.49 | RRDQRLMAN | 1.49 |
| NS5 | 3306 | 0.42 | 4 | 4 | 1.49 | Y | RDLRLMANA | 92.54 | RYLRLMANA | 2.99 | RDQRLMANA | 1.49 | RDLCLM

FIG. 36-126

Species: JEV (9

FIG. 36-127

Species: JEV (9-mers)

| protein | block

FIG. 36-128

Species: JEV (9-mers)

| protein | block starting position | block entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block |

FIG. 36-129

Species: JEV (9-mers)

| protein | block starting position | entropy | total peptides in block | peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3406 | 0.89 | 5 | 5 | 0 | Y | VRAVIGKEN | 82.09 | VRAIIGKEN | 13.43 | VRAIIGKET | 1.49 | VRAIIGKED | 1.49 | VRAIIGKEN | 1.49 |
| NS5 | 3407 | 0.89 | 5 | 5 | 0 | Y | RAVIGKENY | 82.09 | RAIIGKENY | 13.43 | RAILGKENY | 1.49 | RAIIGKEDY | 1.49 | RAIIGKETY | 1.49 |
| NS5 | 3408 | 0.89 | 5 | 5 | 0 | Y | AVIGKENYV | 82.09 | AIIGKENYV | 13.43 | AIIGKEDYY | 1.49 | AILGKENYV | 1.49 | AIIGKETYV | 1.49 |
| NS5 | 3409 | 0.89 | 5 | 5 | 0 | Y | VIGKENYVD | 82.09 | IIGKENYVD | 13.43 | ILGKEDYVD | 1.49 | IIGKETYVD | 1.49 | IIGKEDYVD | 1.49 |
| NS5 | 3410 | 0.33 | 4 | 4 | 0 | Y | IGKENYVDY | 95.52 | IGKETYVDY | 1.49 | IGKEDYVDY | 1.49 | LGKENYVDY | 1.49 | | |
| NS5 | 3411 | 0.22 | 3 | 3 | 0 | Y | GKENYVDYM | 97.01 | GKEDYVDYM | 1.49 | GKETYVDYM | 1.49 | | | | |
| NS5 | 3412 | 0.45 | 5 | 5 | 0 | Y | KENYVDYMT | 94.03 | KENYVDYML | 1.49 | KEDYVDYMT | 1.49 | KETYVDYMT | 1.49 | | |
| NS5 | 3413 | 0.45 | 5 | 5 | 0 | Y | ENYVDYMTS | 94.03 | ETYVDYMTS | 1.49 | ENYVDYMDF | 1.49 | ENYVDYMLS | 1.49 | | |
| NS5 | 3414 | 0.45 | 5 | 5 | 0 | Y | NYVDYMTSL | 94.03 | DYVDYMTSL | 1.49 | TYVDYMTSL | 1.49 | NYVDYMDFP | 1.49 | | |
| NS5 | 3415 | 0.22 | 3 | 3 | 0 | Y | YVDYMTSLR | 97.01 | YVDYMLSLR | 1.49 | | | | | | |
| NS5 | 3416 | 0.22 | 3 | 3 | 0 | Y | VDYMTSLRR | 97.01 | VDYMLSLRR | 1.49 | | | | | | |
| NS5 | 3417 | 0.22 | 3 | 3 | 0 | Y | DYMTSLRRY | 97.01 | DYMDFPQRI | 1.49 | | | | | | |
| NS5 | 3418 | 0.22 | 3 | 3 | 0 | Y | YMTSLRRYE | 97.01 | YMDFPQRIE | 1.49 | | | | | | |
| NS5 | 3419 | 0.22 | 3 | 3 | 0 | Y | MTSLRRYED | 97.01 | MDFPQRIED | 1.49 | | | | | | |
| NS5 | 3420 | 0.22 | 3 | 3 | 0 | Y | TSLRRYEDV | 97.01 | DFPQRIEDV | 1.49 | | | | | | |
| NS5 | 3421 | 0.22 | 3 | 3 | 0 | Y | SLRRYEDVL | 97.01 | FPQRIEDVL | 1.49 | | | | | | |
| NS5 | 3422 | 0.53 | 5 | 5 | 0 | Y | LRRYEDVLI | 92.54 | LRRYEDVLT | 1.49 | LRRYEDVSI | 1.49 | PQRIEDVLI | 1.49 | | |
| NS5 | 3423 | 0.53 | 5 | 5 | 0 | Y | RRYEDVLIQ | 92.54 | QRIEDVLIQ | 2.99 | RRYEDVSIQ | 1.49 | RRYEDVLTQ | 1.49 | | |
| NS5 | 3424 | 0.53 | 5 | 5 | 0 | Y | RYEDVLIQE | 92.54 | RIEDVLIQE | 2.99 | RYEDVLTQE | 1.49 | RYEDVSIQE | 1.49 | | |
| NS5 | 3425 | 0.53 | 5 | 5 | 0 | Y | YEDVLIQED | 92.54 | YEDVLTQED | 2.99 | YEDVSIQED | 1.49 | IEDVLIQED | 1.49 | | |
| NS5 | 3426 | 0.42 | 4 | 4 | 0 | Y | EDVLIQEDR | 94.03 | EDVLTQEDR | 2.99 | EDVSIQEDR | 1.49 | | | | |
| NS5 | 3427 | 0.42 | 4 | 4 | 0 | Y | DVLIQEDRV | 94.03 | DVLTQEDRV | 2.99 | DVSIQEDRV | 1.49 | | | | |
| NS5 | 3428 | 0.42 | 4 | 4 | 0 | Y | VLIQEDRVI | 94.03 | VLTQEDRVI | 2.99 | VSIQEDRVI | 1.49 | | | | |

FIG. 37-1

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| anC | 1 | 0.44 | 3 | 3 | 0 | Y | MTKKPGGPGK | 92.54 | MTKKPGGPGR | 5.97 | MTKKPRGPGI | 1.49 | | | | |
| anC | 2 | 0.55 | 4 | 4 | 0 | Y | TKIKPGGPGKN | 91.04 | TKKPGGPGRN | 5.97 | TKKPRGPGIN | 1.49 | TKKPGGPGKS | 1.49 | | |
| anC | 3 | 0.55 | 4 | 4 | 0 | Y | KKPGGPGKNR | 91.04 | KKPGGPGRNR | 5.97 | KKPRGPGINR | 1.49 | KKPGGPGKSR | 1.49 | | |
| anC | 4 | 0.55 | 4 | 4 | 0 | Y | KPGGPGKNRA | 91.04 | KPGGPGRNRA | 5.97 | KPGGPGKSRA | 1.49 | KPRGPGINRA | 1.49 | | |
| anC | 5 | 0.55 | 4 | 4 | 0 | Y | PGGPGKNRAI | 91.04 | PGGPGRNRAI | 5.97 | PRGPGINRAI | 1.49 | PGGPGKSRAI | 1.49 | | |
| anC | 6 | 0.55 | 4 | 4 | 0 | Y | GGPGKNRAIN | 91.04 | GGPGRNRAIN | 5.97 | RGPGINRAIY | 1.49 | GGPGKSRAIN | 1.49 | | |
| anC | 7 | 0.55 | 4 | 4 | 0 | Y | GPGKNRAINM | 91.04 | GPGRNRAINM | 5.97 | GPGINRAIYM | 1.49 | GPGKSRAINM | 1.49 | | |
| anC | 8 | 0.55 | 4 | 4 | 0 | Y | PGKNRAINML | 91.04 | PGRNRAINML | 5.97 | PGKSRAINML | 1.49 | PGINRAIYML | 1.49 | | |
| anC | 9 | 0.55 | 4 | 4 | 0 | Y | GKNRAINMLK | 91.04 | GRNRAINMLK | 5.97 | GKSRAINMLK | 1.49 | GINRAIYMLK | 1.49 | | |
| anC | 10 | 0.55 | 4 | 4 | 0 | Y | KNRAINMLKR | 91.04 | RNRAINMLKR | 5.97 | INRAIYMLKR | 1.49 | KSRAINMLKR | 1.49 | | |
| anC | 11 | 0.22 | 3 | 3 | 0 | Y | NRAINMLKRG | 97.01 | NRAIYMLKRG | 1.49 | SRAINMLKRG | 1.49 | | | | |
| anC | 12 | 0.11 | 2 | 2 | 0 | Y | RAINMLKRGL | 98.51 | RAIYMLKRGL | 1.49 | | | | | | |
| anC | 13 | 0.11 | 2 | 2 | 0 | Y | AINMLKRGLP | 98.51 | AIYMLKRGLP | 1.49 | | | | | | |
| anC | 14 | 0.11 | 2 | 2 | 0 | Y | INMLKRGLPR | 98.51 | IYMLKRGLPR | 1.49 | | | | | | |
| anC | 15 | 0.11 | 2 | 2 | 0 | Y | NMLKRGLPRV | 98.51 | YMLKRGLPRV | 1.49 | | | | | | |
| anC | 16 | 0 | 1 | 1 | 0 | Y | MLKRGLPRVF | 100 | | | | | | | | |
| anC | 17 | 0 | 1 | 1 | 0 | Y | LKRGLPRVFP | 100 | | | | | | | | |
| anC | 18 | 0 | 1 | 1 | 0 | Y | KRGLPRVFPL | 100 | | | | | | | | |
| anC | 19 | 0 | 1 | 1 | 0 | Y | RGLPRVFPLV | 100 | | | | | | | | |
| anC | 20 | 0.11 | 2 | 2 | 0 | Y | GLPRVFPLVG | 98.51 | GLPRVFPLVR | 1.49 | | | | | | |
| anC | 21 | 0.11 | 2 | 2 | 0 | Y | LPRVFPLVGV | 98.51 | LPRVFPLVRV | 1.49 | | | | | | |
| anC | 22 | 0.11 | 2 | 2 | 0 | Y | PRVFPLVGVK | 98.51 | PRVFPLVRVK | 1.49 | | | | | | |
| anC | 23 | 0.22 | 3 | 3 | 0 | Y | RVFPLVGVKK | 97.01 | RVFPLVGVKR | 1.49 | RV

FIG. 37-2

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block |

FIG. 37-3

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 51 | 0.3 | 3 | 3 | 0 | Y | ITFFK

FIG. 37-4

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 76 | 0 | 1 | 1 | 0 | Y | VAMKHLTSFK | 100 | | | | | | |
| anC | 77 | 0.11 | 2 | 2 | 0 | Y | AMKHLTSFKR | 98.51 | AMKHLTSFKG | 1.49 | | | | |
| anC | 78 | 0.11 | 2 | 2 | 0 | Y | MKHLTSFKRE | 98.51 | MKHLTSFKGE | 1.49 | | | | |
| anC | 79 | 0.11 | 2 | 2 | 0 | Y | KHLTSFKREL | 98.51 | KHLTSFKGEL | 1.49 | | | | |
| anC | 80 | 0.11 | 2 | 2 | 0 | Y | HLTSFKRELG | 98.51 | HLTSFKGELG | 1.49 | | | | |
| anC | 81 | 0.22 | 3 | 3 | 0 | Y | LTSFKRELGT | 97.01 | LTSFKGELGI | 1.49 | LTSFKGELGT | 1.49 | | |

FIG. 37-5

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 126 | 0.49 | 4 | 4 | 0 | Y | GAMKLSNFQG | 92.54 | GAMRLSNFQG | 4.48 | GAIKLSNFQG | 1.49 | GALKLSNFQG | 1.49 |
| anC | 127 | 0.49 | 4 | 4 | 0 | Y | AMKLSNFQGK | 92.54 | AMRLSNFQGK | 4.48 | AIKLSNFQGK | 1.49 | ALKLSNFQGK | 1.49 |
| prM | 128 | 0.49 | 4 | 4 | 0 | Y | MKLSNFQGKL | 92.54 | MRLSNFQGKL | 4.48 | LK

FIG. 37-6

Species: JEV (10-mers)

| protein | block starting position | block entropy | total peptides in block | # peptides required to cover 99% of block | gap/X fraction | 99% of block covered w/ <= 5 peptides? | peptides required

FIG. 37-7

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 185 | 1.17 | 5 | 5 | 0 | Y | MGNDPEDVDC | 74.63 | VGNDPEDVDC | 16.42 | AGNDPEDVDC | 5.97 | PGNDPQDVDC | 1.49 | TGNDPEDVDC | 1.49 |
| prM | 186 | 0.11 | 2 | 2 | 0 | Y | GNDPEDV

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 235 | 0.33 | 4 | 4 | 0 | Y | KEAWLDSTRA | 95.52 | KEAWLNSTKA | 1.49 | KEAWLDSTRA | 1.49 | KKAWLDSTRA | 1.49 |
| prM | 236 | 0.33 | 4 | 4 | 0 | Y | EAWLDSTKAT | 95.52 | KAWLDSTRAT | 1.49 | EAWLNSTKAT | 1.49 | EAWLDSTRAT | 1.49 |
| prM | 237 | 0.3 | 3 | 3 | 0 | Y | AWLDSTKATR | 95.52 | AWLDSTKATR | 2.99 | AWLNSTKATR | 2.99 | | |
| prM | 238 | 0.3 | 3 | 3 | 0 | Y | WLDSTKATRY | 95.52 | WLDSTKATRY | 2.99 | WLNSTKATRY | 2.99 | | |
| prM | 239 | 0.3 | 3 | 3 | 0 | Y | LDSTKATRYL | 95.52 | LDSTRATRYL | 2.99 | LNSTKATRYL | 2.99 | | |
| prM | 240 | 0.57 | 4 | 4 | 0 | Y | DSTKATRYLM | 91.04 | DSTKATRYLT | 4.48 | DSTRATRYLM | 4.48 | NSTKATRYLV | 1.49 |
| prM | 241 | 0.57 | 4 | 4 | 0 | Y | STKATRYLMK | 91.04 | STKATRYLTK | 4.48 | STRATRYLMK | 4.48 | STRATRYLVK | 1.49 |
| prM | 242 | 0.57 | 4 | 4 | 0 | Y | TKATRYLMKT | 91.04 | TKATRYLTKT | 4.48 | TRATRYLMKT | 4.48 | TKATRYLVKT | 1.49 |
| prM | 243 | 0.57 | 4 | 3 | 0 | Y | KATRYLMKTE | 91.04 | KATRYLTKTE | 4.48 | RATRYLMKTE | 4.48 | KATRYLVKTE | 1.49 |
| prM | 244 | 0.37 | 3 | 3 | 0 | Y | ATRYLMKTEN | 94.03 | ATRYLTKTEN | 4.48 | ATRYLVKTEN | 1.49 | | |
| prM | 245 | 0.37 | 3 | 3 | 0 | Y | TRYLMKTENW | 94.03 | TRYLTKTENW | 4.48 | TRYLVKTENW | 1.49 | | |
| prM | 246 | 0.37 | 3 | 3 | 0 | Y | RYLMKTENWI | 94.03 | RYLTKTENWI | 4.48 | RYLVKTENWI | 1.49 | | |
| prM | 247 | 0.63 | 4 | 4 | 0 | Y | YLMKTENWIV | 89.55 | YLMKTENWIV | 4.48 | YLTKTENWII | 4.48 | YLVKTENWIV | 1.49 |
| prM | 248 | 0.63 | 4 | 4 | 0 | Y | LMKTENWIIR | 89.55 | LTKTENWIIR | 4.48 | LMKTENWIVR | 4.48 | LVKTENWIVR | 1.49 |
| prM | 249 | 0.63 | 4 | 4 | 0 | Y | MKTENWIIRN | 89.55 | TKTENWIIRN | 4.48 | MKTENWIVRN | 4.48 | VKTENWIVRN | 1.49 |
| prM | 250 | 0.33 | 2 | 2 | 0 | Y | KTENWIIRNP | 94.03 | KTENWIVRNP | 5.97 | | | | |
| prM | 251 | 0.33 | 2 | 2 | 0 | Y | TENWIIRNPG | 94.03 | TENWIVRNPG | 5.97 | | | | |
| prM | 252 | 0.33 | 2 | 2 | 0 | Y | ENWIIRNPGY | 94.03 | ENWIVRNPGY | 5.97 | | | | |
| prM | 253 | 0.33 | 2 | 2 | 0 | Y | NWIIRNPGYA | 94.03 | NWIVRNPGYA | 5.97 | | | | |
| prM | 254 | 0.33 | 2 | 2 | 0 | Y | WIIRNPGYAF | 94.03 | WIVRNPGYAF | 5.97 | | | | |
| prM | 255 | 0.33 | 2 | 2 | 0 | Y | IIRNPGYAFL | 94.03 | IVRNPGYAFL | 5.97 | | | | |
| prM | 256 | 0.33 | 2 | 2 | 0 | Y | IRNPGYAFLA | 94.03 | VRNPGYAFLA | 5.97 | | | | |
| prM | 257 | 0.22 | 3 | 3 | 0 | Y | RNPGYAFLAA | 97.01 | RNPGYAFLAG | 1.49 | RNPGYAFLAV | 1.49 | | |
| prM | 268 | 0.94 | 4 | 4 | 0 | Y | LGWMLGSNNG | 79.1 | LGWMLGSNSG | 16.42 | LGWMLGSTTG | 2.99 | LGWMLGSTNG | 1.49 |
| prM | 277 | 0.45 | 5 | 5 | 0 | Y | GQRWFTILL | 94.03 | GPRWFTILL | 1.49 | GHRWFTILL | 1.49 | GQRWFTILP | 1.49 |

FIG. 37-10

Species: JEV (10-mers)

| protein | block starting position | block entropy | total peptides in block | # peptides required to cover 99% of block | gap/X fraction | 99% of block covered w/ <= 5 peptides? | peptides required to cover 99% of block

FIG. 37-11

Species: JEV (10

FIG. 37-12

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99%

FIG. 37-13

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 353 | 0.22 | 3 | 3 | 0 | Y | YCYHASVTDI | 97.01 | YYHASVTDI | 1.49 | YCYR

FIG. 37-14

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 378 | 0.22 | 3 | 3 | 0 | Y | KRADSSYVCK | 97.01 | KGADSSYVCK | 1.49 | KQADSSYVCK | 1.49 | | |
| E | 379 | 0.22 | 3 | 3 | 0 | Y | RADSSYVCKQ | 97.01 | QADSSYVCKQ | 1.49 | GADSSYVCKQ | 1.49 | | |
| E | 380 | 0 | 1 | 1 | 0 | Y | ADSSYVCKQG | 100 | | | | | | |
| E | 381 | 0 | 1 | 1 | 0 | Y | DSSYVCKQGF | 100 | | | | | | |
| E | 382 | 0 | 1 | 1 | 0 | Y | SSYVCKQGFT | 100 | | | | | | |
| E | 383 | 0 | 1 | 1 | 0 | Y | SYVCKQGFTD | 100 | | | | | | |
| E | 384 | 0 | 1 | 1 | 0 | Y | YVCKQGFTDR | 100 | | | | | | |
| E | 385 | 0 | 1 | 1 | 0 | Y | VCKQGFTDRG | 100 | | | | | | |
| E | 386 | 0 | 1 | 1 | 0 | Y | CKQGFTDRGW | 100 | | | | | | |
| E | 387 | 0.11 | 2 | 2 | 0 | Y | KQGFTDRGWG | 98.51 | KQGFTDRGWR | 1.49 | | | | |
| E | 388 | 0.22 | 3 | 3 | 0 | Y | QGFTDRGWGN | 97.01 | QGFTDRGWRN | 1.49 | QGFTDRGWGK | 1.49 | | |
| E | 389 | 0.22 | 3 | 3 | 0 | Y | GFTDRGWGNG | 97.01 | GFTDRGWRNG | 1.49 | GFTDRGWGKG | 1.49 | | |
| E | 390 | 0.22 | 3 | 3 | 0 | Y | FTDRGWGNGC | 97.01 | FTDRGWRNGC | 1.49 | FTDRGWGKGC | 1.49 | | |
| E | 391 | 0.22 | 3 | 3 | 0 | Y | TDRGWGNGCG | 97.01 | TDRGWRNGCG | 1.49 | TDRGWGKGCG | 1.49 | | |
| E | 392 | 0.49 | 4 | 4 | 0 | Y | DRGWGNGCGL | 92.54 | DRGWGKGCGL | 4.48 | DRGWRNGCGL | 1.49 | DRGWGNGCGF | 1.49 |
| E | 393 | 0.6 | 5 | 5 | 0 | Y | RGWGNGCGLF | 91.04 | RGWGKGCGLF | 4.48 | RGWRNGCGLF | 1.49 | RGWGNGCGLS | 1.49 |
| E | 394 | 0.6 | 5 | 5 | 0 | Y | GWGNGCGLFG | 91.04 | GWGKGCGLFG | 4.48 | GWRNGCGLFG | 1.49 | GWGNGCGLSG | 1.49 |
| E | 395 | 0.6 | 5 | 5 | 0 | Y | WGNGCGLFGK | 91.04 | WGNGCGFFGK | 4.48 | WRNGCGLFGK | 1.49 | WGKGCGLFGK | 1.49 |
| E | 396 | 0.49 | 4 | 4 | 0 | Y | GNGCGLFGKG | 91.04 | GNGCGFFGKG | 4.48 | RNGCGLFGKG | 1.49 | GNGCGLSGKG | 1.49 |
| E | 397 | 0.49 | 4 | 4 | 0 | Y | NGCGLFGKGS | 92.54 | NGCGFFGKGS | 4.48 | NGCGLSGKGS | 1.49 | | |
| E | 398 | 0.37 | 3 | 3 | 0 | Y | GCGLFGKGSI | 94.03 | GCGFFGKGSI | 4.48 | GCGLSGKGSI | 1.49 | | |
| E | 399 | 0.37 | 3 | 3 | 0 | Y | CGLFGKGSID | 94.03 | CGFFGKGSID | 4.48 | CGLSGKGSID | 1.49 | | |
| E | 400 | 0.37 | 3 | 3 | 0 | Y | GLFGKGSIDT | 94.03 | GFFGKGSIDT | 4.48 | GLSGKGSIDT | 1.49 | | |
| E | 401 | 0.37 | 3 | 3 | 0 | Y | LFGKGSIDTC | 94.03 | FFGKGSIDTC | 4.48 | LSGKGSIDTC | 1.49 | | |
| E | 402 | 0.11 | 2 | 2 | 0 | Y | FGKGSIDTCA | 98.51 | SGKGSIDTCA | 1.49 | | | | |

FIG. 37-15

Species: JEV (10-mers)

| protein | block starting position | block entropy | total peptides in block | # peptides required to cover 99% of block | block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 403 | 0 | 1 | 1 | 1 | 0 | Y | GKGSIDTCAK | 100 | | | | | | |
| E | 404 | 0 | 1 | 1 | 1 | 0 | Y | KGSIDTCAKF | 100 | | | | | | |
| E | 405 | 0 | 1 | 1 | 1 | 0 | Y | GSIDTCAKFS | 100 | | | | | | |
| E | 406 | 0 | 1 | 1 | 1 | 0 | Y | SIDTCAKFSC | 100 | | | | | | |
| E | 407 | 0 | 1 | 1 | 1 | 0 | Y | IDTCAKFSCT | 100 | | | | | | |
| E | 408 | 0.57 | 3 | 3 | 3 | 0 | Y | DTCAKFSCTS | 89.55 | DTCAKFSCTR | 7.46 | | | | |
| E | 409 | 0.57 | 3 | 3 | 3 | 0 | Y | TCAKFSCTSK | 89.55 | TCAKFSCTRK | 7.46 | | | | |
| E | 410 | 0.57 | 3 | 3 | 3 | 0 | Y | CAKFSCTSKA | 89.55 | CAKFSCTRKA | 7.46 | | | | |
| E | 411 | 0.76 | 4 | 4 | 4 | 0 | Y | AKFSCTSKAI | 86.57 | AKFSCTRKAI | 7.46 | AKFSCTNKAI | 2.99 | | |
| E | 412 | 0.87 | 5 | 5 | 5 | 0 | Y | KFSCTSKAIG | 85.07 | KFSCTRKAIG | 7.46 | KFSCTNKAIG | 2.99 | KFSCTSKAIE | 1.49 |
| E | 413 | 0.87 | 5 | 5 | 5 | 0 | Y | FSCTSKAIGR | 85.07 | FSCTRKAIGR | 7.46 | F

FIG. 37-16

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 438 | 0.33 | 2 | 2 | 0 | Y | HGTTSENHG | 94.03 | HGTTSENHG | 5.97 | | | | |
| E | 439 | 0.33 | 2 | 2 | 0 | Y | GTTSENHGN | 94.03 | GATTSENHGN | 5.97 | | | | |
| E | 440 | 0.33 | 2 | 2 | 0 | Y | TTSENHGNY | 94.03 | ATTSENHGNY | 5.97 | | | | |
| E | 441 | 0.11 | 2 | 2 | 0 | Y | TSENHGNYS | 98.51 | TTSENHGNYT | 1.49 | | | | |
| E | 442 | 0.11 | 2 | 2 | 0 | Y | SENHGNYSA | 98.51 | TSENHGNYTA | 1.49 | | | | |
| E | 443 | 0.11 | 2 | 2 | 0 | Y | ENHGNYSAQ | 98.51 | SENHGNYTAQ | 1.49 | | | | |
| E | 444 | 0.11 | 2 | 2 | 0 | Y | NHGNYSAQV | 98.51 | ENHGNYTAQI | 1.49 | | | | |
| E | 445 | 0.11 | 2 | 2 | 0 | Y | HGNYSAQVG | 98.51 | NHGNYTAQIG | 1.49 | | | | |
| E | 446 | 0.42 | 4 | 4 | 0 | Y | HGNYSAQVGA | 94.03 | HGNYTAQIGA | 2.99 | HGNYSAQVGV

FIG. 37-17

Species: JEV (10-mers)

| protein | block starting position | block entropy | total peptides in block | # peptides required to cover 99% of block | gap/X f

FIG. 37-18

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 491 | 0 | 1 | 1 | 0 | Y | NTEAFYMTV | 100 | | | | | | | | |
| E | 492 | 0 | 1 | 1 | 0 | Y | TEAFYMTVG | 100 | | | | | | | | |
| E | 493 | 0.11 | 2 | 2 | 0 | Y | EAFYMTVGS | 98.51 | EAFYMT

FIG. 37-19

Species: JEV (10-mers)

| protein | block starting position | block entropy | total peptides in block | # peptides required to cover 99% of block | gap/X fraction | 99% of block covered w/ <= 5 peptides? | peptides required

FIG. 37-20

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 37-21

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 566 | 0.42 | 4 | 4 | 0 | Y | VEYSSVVKLT | 94.03 | VEYSSVVMLT | 2.99 | VEYPSSVVKLT | 1.49 | VEYSNSVVKLT | 1.49 |
| E | 567 | 0.42 | 4 | 4 | 0 | Y | EYSSVVKLTS | 94.03 | EYSSVVMLTS | 2.99 | EYPSSVVKLTS | 1.49 | EYSNSVVKLTS | 1.49 |
| E | 568 | 0.42 | 4 | 4 | 0 | Y | YSSVVKLTSG | 94.03 | YSSVVMLTSG | 2.99 | YPSSVVKLTSG | 1.49 | YSNSVVKLTSG | 1.49 |
| E | 569 | 0.42 | 4 | 4 | 0 | Y | SSVVKLTSGH | 94.03 | SSVVMLTSGH | 2.99 | PSSVVKLTSGH | 1.49 | SNSVVKLTSGH | 1.49 |
| E | 570 | 0.42 | 4 | 4 | 0 | Y | SVVKLTSGHL | 94.03 | SVVMLTSGHL | 2.99 | SSVVKLTSGH | 1.49 | NSVVKLTSGHL | 1.49 |
| E | 571 | 0.3 | 3 | 3 | 0 | Y | VVKLTSGHLK | 95.52 | SVVMLTSGHLK | 2.99 | SVVKLTSGHV | 1.49 | |  |
| E | 572 | 0.3 | 3 | 3 | 0 | Y | VKLTSGHLKC | 95.52 | VMLTSGHLKC | 2.99 | SVVKLTSGHVK | 1.49 | |  |
| E | 573 | 0.3 | 3 | 3 | 0 | Y | KLTSGHLKCR | 95.52 | MLTSGHLKCR | 2.99 | VKLTSGHVKR | 1.49 | |  |
| E | 574 | 0.11 | 2 | 2 | 0 | Y | LTSGHLKCRL | 98.51 | LTSGHVKRRL | 1.49 | KLTSGHVKRR | 1.49 | |  |
| E | 575 | 0.22 | 3 | 3 | 0 | Y | TSGHLKCRLK | 97.01 | TSGHVKRLK | 1.49 | TSGHVKRRLK | 1.49 | |  |
| E | 576 | 0.22 | 3 | 3 | 0 | Y | SGHLKCRLKM | 97.01 | SGHVKCRLRM | 1.49 | SGHVKRRLKM | 1.49 | |  |
| E | 577 | 0.22 | 3 | 3 | 0 | Y | GHLKCRLKMD | 97.01 | GHVKRRLKMD | 1.49 | GHLKCRLRMD | 1.49 | |  |
| E | 578 | 0.22 | 3 | 3 | 0 | Y | HLKCRLKMDK | 97.01 | HVKRRLKMDK | 1.49 | HLKCRLRMDK | 1.49 | |  |
| E | 579 | 0.22 | 3 | 3 | 0 | Y | LKCRLKMDKL | 97.01 | LKCRLRMDKL | 1.49 | VKRRLKMDKL | 1.49 | |  |
| E | 580 | 0.22 | 3 | 3 | 0 | Y | KCRLKMDKLA | 97.01 | KRRLKMDKLA | 1.49 | KCRLRMDKLA | 1.49 | |  |
| E | 581 | 0.22 | 3 | 3 | 0 | Y | CRLKMDKLAL | 97.01 | CRLRMDKLAL | 1.49 | RRLKMDKLAL | 1.49 | |  |
| E | 582 | 0.11 | 2 | 2 | 0 | Y | RLKMDKLALK | 98.51 | RLRMDKLALK | 1.49 | |  | |  |
| E | 583 | 0.11 | 2 | 2 | 0 | Y | LKMDKLALKG | 98.51 | LRMDKLALKG | 1.49 | |  | |  |
| E | 584 | 0.11 | 2 | 2 | 0 | Y | KMDKLALKGT | 98.51 | RMDKLALKGT | 1.49 | |  | |  |
| E | 585 | 0 | 1 | 1 | 0 | Y | MDKLALKGTT | 100 | |  | |  | |  |
| E | 586 | 0 | 1 | 1 | 0 | Y | DKLALKGTTY | 100 | |  | |  | |  |
| E | 587 | 0 | 1 | 1 | 0 | Y | KLALKGTTYG | 100 | |  | |  | |  |
| E | 588 | 0.11 | 2 | 2 | 0 | Y | LALKGTTYGM | 98.51 | LALKGTTYGV | 1.49 | |  | |  |
| E | 589 | 0.11 | 2 | 2 | 0 | Y | ALKGTTYGMC | 98.51 | ALKGTTYGVC | 1.49 | |  | |  |
| E | 590 | 0.11 | 2 | 2 | 0 | Y | LKGTTYGMCT | 98.51 | LKGTTYGVCT | 1.49 | |  | |  |

FIG. 37-22

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 591 | 0.82 | 4 | 4 | 0 | Y | KGTTYGMCTE | 83.58 | KGTTYGMCTG | 11.94 | KGTTYGMCTK | 2.99 | KGTTYGVC

FIG. 37-23

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 616 | 0.89 | 4 | 4 | 0 | Y | WIELYSGS | 79.1 | WIELYSGS | 17.91 | WIELYSGR | 1.49 | | |
| E | 617 | 0.89 | 4 | 4 | 0 | Y | VIELYSGSD | 79.1 | VIELYSGSD | 17.91 | VIELYSGRD | 1.49 | | |
| E | 618 | 0.89 | 4 | 4 | 0 | Y | IELYSGSDG | 79.1 | IELTYSGSDG | 17.91 | IELYSGR

FIG. 37-24

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 641 | 0.44 | 3 | 3 | 0 | Y | DMTPVGRLVT | 92.54 | DLTPVGRLVT | 5.97 | DMTP

FIG. 37-25

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 667 | 0.11 | 2 | 2 | 0 | Y | EMEPPFGDSY | 98.51 | EIEPPFGDSY | 1.49 | | | | |
| E | 668 | 0.11 | 2 | 2 | 0 | Y | MEPPFGDSYI | 98.51 | IEPPFGDSYI | 1.49 | | | | |
| E | 669 | 0 | 1 | 1 | 0 | Y | EPPFGDSYIV | 100 | | | | | | |
| E | 670 | 0.11 | 2 | 2 | 0 | Y | PPFGDSYIVW | 98.51 | PPFGDSYIVI | 1.49 | | | | |
| E | 671 | 0.11 | 2 | 2 | 0 | Y | PFGDSYIVWG | 98.51 | PFGDSYIVIG | 1.49 | | | | |
| E | 672 | 0.22 | 3 | 3 | 0 | Y | FGDSYIVWGR | 97.01 | FGDSYIVWGM | 1.49 | | | | |
| E | 673 | 0.45 | 5 | 5 | 0 | Y | GDSYIVWGRG | 94.03 | GDSYIVWGMG | 1.49 | GDSYIVWGRK | 1.49 | GDSYIVWGRE | 1.49 |
| E | 688 | 0.6 | 5 | 5 | 0 | Y | HHWHKAGSTL | 91.04 | HHWYKAGSTL | 1.49 | HHWHKPGSTL | 1.49 | HHRHKAGSTL | 1.49 |
| E | 689 | 0.6 | 5 | 5 | 0 | Y | HWHKAGSTLG | 91.04 | HRHKAGSTLG | 1.49 | HWHKPGSTLG | 1.49 | HWYKAGSTLG | 1.49 |
| E | 690 | 0.6 | 5 | 5 | 0 | Y | WHKAGSTLGK | 91.04 | WHRAGSTLGK | 4.48 | WYKAGSTLGK | 1.49 | RHKAGSTLGK | 1.49 |
| E | 691 | 0.49 | 4 | 4 | 0 | Y | HKAGSTLGKA | 92.54 | HRAGSTLGKA | 4.48 | YKAGSTLGKA | 1.49 | HKPGSTLGKA | 1.49 |
| E | 692 | 0.37 | 3 | 3 | 0 | Y | KAGSTLGKAF | 94.03 | RAGSTLGKAF | 4.48 | KPGSTLGKAF | 1.49 | | |
| E | 693 | 0.49 | 3 | 3 | 0 | Y | AGSTLGKAFS | 91.04 | AGSTLGKAFL | 7.46 | PGSTLGKAFS | 1.49 | | |
| E | 694 | 0.38 | 2 | 2 | 0 | Y | GSTLGKAFST | 92.54 | GSTLGKAFLT | 7.46 | | | | |
| E | 695 | 0.38 | 2 | 2 | 0 | Y | STLGKAFSTT | 92.54 | STLGKAFLTT | 7.46 | | | | |
| E | 696 | 0.38 | 2 | 2 | 0 | Y | TLGKAFSTTL | 92.54 | TLGKAFLTTL | 7.46 | | | | |
| E | 697 | 0.38 | 2 | 2 | 0 | Y | LGKAFSTTLK | 92.54 | LGKAFLTTLK | 7.46 | | | | |
| E | 698 | 0.38 | 2 | 2 | 0 | Y | GKAFSTTLKG | 92.54 | GKAFLTTLKG | 7.46 | | | | |
| E | 699 | 0.38 | 2 | 2 | 0 | Y | KAFSTTLKGA | 92.54 | KAFLTTLKGA | 7.46 | | | | |
| E | 700 | 0.38 | 2 | 2 | 0 | Y | AFSTTLKGAQ | 92.54 | AFLTTLKGAQ | 7.46 | | | | |
| E | 701 | 0.38 | 2 | 2 | 0 | Y | FSTTLKGAQR | 92.54 | FLTTLKGAQR | 7.46 | | | | |
| E | 702 | 0.38 | 2 | 2 | 0 | Y | STTLKGAQRL | 92.54 | LTTLKGAQRL | 7.46 | | | | |
| E | 703 | 0.19 | 2 | 2 | 0 | Y | TTLKGAQRLA | 97.01 | TTLKGAQRLV | 2.99 | | | | |
| E | 704 | 0.19 | 2 | 2 | 0 | Y | TLKGAQRLAA | 97.01 | TLKGAQRLVA | 2.99 | | | | |
| E | 705 | 0.19 | 2 | 2 | 0 | Y | LKGAQRLAAL | 97.01 | LKGAQRLVAL | 2.99 | | | | |

FIG. 37-26

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 706 | 0.19 | 2 | 2 | 0 | Y | KGAQRLAALG | 97

FIG. 37-27

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| E | 731 | 0.38 | 2 | 2 | 0 | Y | IGKAVHQVFG | 92.54 | IGRAVHQVFG | 7.46 | | |
| E | 732 | 0.44 | 3 | 3 | 0 | Y | GKAVHQVFGG | 92.54 | GRAVHQVFGG | 5.97 | GRAVHQVFGD | 1.49 |
| E | 733 | 0.44 | 3 | 3 | 0 | Y | KAVHQVFGGA | 92.54 | RAVHQVFGGA | 5.97 | RAVHQVFGDA | 1.49 |
| E | 734 | 0.11 | 2 | 2 | 0 | Y | AVHQVFGGAF | 98.51 | AVHQVFGDAF | 1.49 | | |
| E | 735 | 0.11 | 2 | 2 | 0 | Y | VHQVFGGAFR | 98.51 | VHQVFGDAFR | 1.49 | | |
| E | 736 | 0.11 | 2 | 2 | 0 | Y | HQVFGGAFRT | 98.51 | HQVFGDAFRT | 1.49 | | |
| E | 737 | 0.11 | 2 | 2 | 0 | Y | QVFGGAFRTL | 98.51 | QVFGDAFRTL | 1.49 | | |
| E | 738 | 0.11 | 2 | 2 | 0 | Y | VFGGAFRTLF | 98.51 | VFGDAFRTLF | 1.49 | | |
| E | 739 | 0.11 | 2 | 2 | 0 | Y | FGGAFRTLFG | 98.51 | FGDAFRTLFG | 1.49 | | |
| E | 740 | 0.11 | 2 | 2 | 0 | Y | GGAFRTLFGG | 98.51 | GDAFRTLFGG | 1.49 | | |
| E | 741 | 0.11 | 2 | 2 | 0 | Y | GAFRTLFGGM | 98.51 | DAFRTLFGGM | 1.49 | | |
| E | 742 | 0 | 1 | 1 | 0 | Y | AFRTLFGGMS | 100 | | | | |
| E | 743 | 0 | 1 | 1 | 0 | Y | FRTLFGGMSW | 100 | | | | |
| E | 744 | 0 | 1 | 1 | 0 | Y | RTLFGGMSWI | 100 | | | | |
| E | 745 | 0 | 1 | 1 | 0 | Y | TLFGGMSWIT | 100 | | | | |
| E | 746 | 0 | 1 | 1 | 0 | Y | LFGGMSWITQ | 100 | | | | |
| E | 747 | 0 | 1 | 1 | 0 | Y | FGGMSWITQG | 100 | | | | |
| E | 748 | 0 | 1 | 1 | 0 | Y | GGMSWITQGL | 100 | | | | |
| E | 749 | 0 | 1 | 1 | 0 | Y | GMSWITQGLM | 100 | | | | |
| E | 750 | 0 | 1 | 1 | 0 | Y | MSWITQGLMG | 100 | | | | |
| E | 751 | 0.11 | 2 | 2 | 0 | Y | SWITQGLMGA | 98.51 | SWITQGLMGV | 1.49 | | |
| E | 752 | 0.11 | 2 | 2 | 0 | Y | WITQGLMGAL | 98.51 | WITQGLMGVL | 1.49 | | |
| E | 753 | 0.11 | 2 | 2 | 0 | Y | ITQGLMGALL | 98.51 | ITQGLMGVLL | 1.49 | | |
| E | 754 | 0.11 | 2 | 2 | 0 | Y | TQGLMGALLL | 98.51 | TQGLMGVLLL | 1.49 | | |
| E | 755 | 0.11 | 2 | 2 | 0 | Y | QGLMGALLLW | 98.51 | QGLMGVLLLW | 1.49 | | |

FIG. 37-28

Species: JEV (10-mers)

| protein | block starting position | block entropy | total peptides in block | # peptides required to cover 99% of block | gap/X fraction | 99% of block covered w/ <= 5 peptides? | peptides required

FIG. 37-29

Species: JEV (10-mers)

| protein | block starting position | block entropy (10-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 781 | 0.11 | 2 | 2 | 0 | Y | TGGVLVF

FIG. 37-30

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 813 | 0 | 1 | 1 | 0 | Y | IFYHNDVEAW | 100 | | | | | | |
| NS1 | 814 | 0 | 1 | 1 | 0 | Y | FVHNDVEAWV | 100 | | | | | | |
| NS1 | 815 | 0 | 1 | 1 | 0 | Y | VHNDVEAWVD | 100 | | | | | | |
| NS1 | 816 | 0 | 1 | 1 | 0 | Y | HNDVEAWVDR | 100 | | | | | | |
| NS1 | 817 | 0 | 1 | 1 | 0 | Y | NDVEAWVDRY | 100 | | | | | |

FIG. 37-31

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 838 | 0.9 | 4 | 4 | 0 | Y | KIVHK

FIG. 37-32

Species: JEV (10-mers)

| protein | block starting position | block entropy | total peptides in block | # peptides required to cover 99% of block | gap/X

**Species: JEV (10-mers

FIG. 37-34

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 |

FIG. 37-35

Species: JEV

| protein | block starting position | block entropy (10-mers) | total peptides in block | # peptides required to cover 99

FIG. 37-36

Species: JEV (10-mers)

| protein | block starting position | block entropy | total peptides in block | # peptides required to cover 99% of block | gap/X fraction | 99% of block covered w/ <= 5 peptides? | peptides required

FIG. 37-37

Species: JEV (10-mers)

| protein | block starting position | block entropy | total peptides in block | # peptides required to cover 99% of block | gap/X fraction | 99% of block covered w/ <= 5 peptides? | peptides required to cover 99% of block

FIG. 37-38

Species: JEV (10-mers)

| protein | block starting position | block entropy | total peptides in block | # peptides required to cover 99% of block | block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS1 | 1022 | 0.78 | 4 | 4 | 0 | Y | THTLWGDVE | 85.07 | THTLWGDGVE | 10.45 | THTLWGDDAE | 1.49 | | |
| NS1 | 1023 | 0.78 | 4 | 4 | 0 | Y | HTLWGDGVEE | 85.07 | HTLWGDDVEE | 10.45 | HTLWGDDAEE | 1.49 | | |
| NS1 | 1024 | 0.78 | 4 | 4 | 0 | Y | TLWGDVEES | 85.07 | TLWGDDVEES | 10.45 | TLWGDDAEES | 1.49 | | |
| NS1 | 1025 | 0.7 | 4 | 4 | 0 | Y | LWGDVEESE | 86.57 | LWGDDVEESE | 10.45 | LWGDDAEESD | 1.49 | | |
| NS1 | 1026 | 0.7 | 4 | 4 | 0 | Y | WGDGVEESEL | 86.57 | WGDDVEESEL | 10.45 | WGDDAEESEL | 1.49 | WGDGVEESDL | 1.49 | | |
| NS1 | 1027 | 0.7 | 4 | 4 | 0 | Y | GDGVEESELI | 86.57 | GDDVEESELI | 10.45 | GDDAEESELI | 1.49 | GDGVEESDLV | 1.49 | | |
| NS1 | 1028 | 0.7 | 4 | 4 | 0 | Y | DGVEESELII | 86.57 | DDVEESELII | 10.45 | DGVEESDLVI | 1.49 | DDAEESELII | 1.49 | | |
| NS1 | 1029 | 0.7 | 4 | 4 | 0 | Y | GVEESELIIP | 86.57 | DVEESELIIP | 10.45 | DAEESELIIP | 1.49 | GVEESDLVIP | 1.49 | | |
| NS1 | 1030 | 0.33 | 4 | 3 | 0 | Y | VEESELIIPH | 95.52 | AEESELIIPH | 1.49 | VEESELIIP | 1.49 | VEESDLVIPH | 1.49 | | |
| NS1 | 1031 | 0.22 | 4 | 4 | 0 | Y | EESELIIPHT | 97.01 | EESELIIPHT | 1.49 | EESELIIPDT | 1.49 | | |
| NS1 | 1032 | 0.49 | 4 | 4 | 0 | Y | ESELIIPHTI | 92.54 | ESDLVIPHTI | 4.48 | ESELIIPDTI | 1.49 | | |
| NS1 | 1033 | 0.49 | 4 | 4 | 0 | Y | SELIIPHTIA | 92.54 | SDLVIPHTIA | 4.48 | SELIIPDTIA | 1.49 | | |
| NS1 | 1034 | 0.49 | 4 | 4 | 0 | Y | ELIIPHTIAG | 92.54 | DLVIPHTIAG | 4.48 | ELIIPDTIAG | 1.49 | | |
| NS1 | 1035 | 0.49 | 4 | 4 | 0 | Y | LIIPHTIAGP | 92.54 | LIIPDTIAGP | 4.48 | LVIPHTIAGP | 1.49 | | |
| NS1 | 1036 | 1.11 | 5 | 5 | 0 | Y | IIPHTIAGPR | 76.12 | IIPHTIAGPK | 16.42 | IIPDTIAGPK | 4.48 | IPHTIAGPR | 1.49 | VIPHTIAGPR | 1.49 |
| NS1 | 1037 | 1.04 | 4 | 4 | 0 | Y | IPHTIAGPRS | 76.12 | IPHTIAGPKS | 17.91 | IPDTIAGPKS | 4.48 | | |
| NS1 | 1038 | 1.04 | 4 | 4 | 0 | Y | PHTIAGPRSK | 76.12 | PHTIAGPKSK | 17.91 | PDTIAGPKSK | 4.48 | | |
| NS1 | 1039 | 1.04 | 4 | 4 | 0 | Y | HTIAGPRSKH | 76.12 | HTIAGPKSKH | 17.91 | DTIAGPKSKH | 4.48 | | |
| NS1 | 1040 | 0.93 | 3 | 3 | 0 | Y | TIAGPKSKHN | 77.61 | TLAGPKSKHN | 17.91 | | |
| NS1 | 1041 | 1.04 | 4 | 4 | 0 | Y | IAGPKSKHNR | 76.12 | LAGPKSKHNR | 17.91 | IAGPKSKHNQ | 1.49 | | |
| NS1 | 1042 | 0.79 | 3 | 3 | 0 | Y | AGPKSKHNRR | 80.6 | AGPRSKHNRR | 17.91 | AGPKSKHNQR | 1.49 | | |
| NS1 | 1043 | 0.79 | 3 | 3 | 0 | Y | GPKSKHNRRE | 80.6 | GPRSKHNRRE | 17.91 | GPKSKHNQRE | 1.49 | | |
| NS1 | 1044 | 0.79 | 3 | 3 | 0 | Y | PKSKHNRREG | 80.6 | PRSKHNRREG | 17.91 | PKSKHNQREG | 1.49 | | |
| NS1 | 1045 | 0.79 | 3 | 3 | 0 | Y | KSKHNRREGY | 80.6 | RSKHNRREGY | 17.91 | KSKHNQREGY | 1.49 | | |
| NS1 | 1046 | 0.42 | 4 | 4 | 0 | Y | SKHNRREGYK | 94.03 | SKHNRREGYR | 2.99 | SKHNQREGYK | 1.49 | SKHNRREGYM | 1.49 | | |

FIG. 37-39

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1047 | 0.42 | 4 | 4 | 0 | Y | KHNRREGYKT | 94.03 | KHNQREGYKT | 2.99 | KHNRREGYMT | 1.49 | | |
| NS1 | 1048 | 0.42 | 4 | 4 | 0 | Y | HNRREGYKTQ | 94.03 | HNQREGYKTQ | 2.99 | HNRREGYMTQ | 1.49 | | |
| NS1 | 1049 | 0.42 | 4 | 4 | 0 | Y | NRREGYKTQN | 94.03 | NQREGYKTQN | 2.99 | NRREGYMTQN | 1.49 | | |
| NS1 | 1050 | 0.42 | 4 | 4 | 0 | Y | RREGYKTQNQ | 94.03 | RREGYRTQNQ | 2.99 | QREGYKTQNQ | 1.49 | | |
| NS1 | 1051 | 0.3 | 3 | 3 | 0 | Y | REGYKTQNQG | 95.52 | REGYRTQNQG | 2.99 | | | | |
| NS1 | 1052 | 0.3 | 3 | 3 | 0 | Y | EGYKTQNQGP | 95.52 | EGYRTQNQGP | 2.99 | | | | |
| NS1 | 1053 | 0.3 | 3 | 3 | 0 | Y | GYKTQNQGPW | 95.52 | GYRTQNQGPW | 2.99 | | | | |
| NS1 | 1054 | 0.3 | 3 | 3 | 0 | Y | YKTQNQGPWD | 95.52 | YRTQNQGPWD | 2.99 | | | | |
| NS1 | 1055 | 0.3 | 3 | 3 | 0 | Y | KTQNQGPWDE | 95.52 | RTQNQGPWDE | 2.99 | | | | |
| NS1 | 1056 | 0.33 | 4 | 4 | 0 | Y | TQNQGPWDEN | 95.52 | TQNQGPWDES | 1.49 | TQNQGPWDEK | 1.49 | | |
| NS1 | 1057 | 0.33 | 4 | 4 | 0 | Y | QNQGPWDENG | 95.52 | QNQGPWDESG | 1.49 | QNQGPWDEDG | 1.49 | | |
| NS1 | 1058 | 0.45 | 5 | 5 | 0 | Y | NQGPWDENGI | 94.03 | NQGPWDENGL | 1.49 | NQGPWDESGI | 1.49 | NQGPWDEKGI | 1.49 |
| NS1 | 1059 | 0.45 | 5 | 5 | 0 | Y | QGPWDENGIV | 94.03 | QGPWDEDGIV | 1.49 | QGPWDEKGIV | 1.49 | QGPWDENGLV | 1.49 |
| NS1 | 1060 | 0.45 | 5 | 5 | 0 | Y | GPWDENGIVL | 94.03 | GPWDESGIVL | 1.49 | GPWDEDGIVL | 1.49 | GPWDEKGIVL | 1.49 |
| NS1 | 1061 | 0.45 | 5 | 5 | 0 | Y | PWDENGIVLD | 94.03 | PWDEDGIVLD | 1.49 | PWDESGIVLD | 1.49 | PWDENGLVPG | 1.49 |
| NS1 | 1062 | 0.45 | 5 | 5 | 0 | Y | WDENGIVLDF | 94.03 | WDEDGIVLDF | 1.49 | WDEDGIVLDF | 1.49 | WDENGL

FIG. 37-40

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1072 | 0.11 | 2 | 2 | 0 | Y | DYCPGTKVTI | 98.51 | DYCPGTKVTI | 1.49 | | | | | | |
| NS1 | 1073 | 0.11 | 2 | 2 | 0 | Y | YCPGTKVTIT | 98.51 | YCPGTKVTIT | 1.49 | | | | | | |
| NS1 | 1074 | 0.11 | 2 | 2 | 0 | Y | CPGTKVTITE | 98.51 | CPGTKVTITE | 1.49 | | | | | | |
| NS1 | 1075 | 0.11 | 2 | 2 | 0 | Y | PGTKVTITED | 98.51 | PGTKVTITED | 1.49 | | | | | | |
| NS1 | 1076 | 0.11 | 2 | 2 | 0 | Y | GTKVTITEDC | 98.51 | GTKVTITEDC | 1.49 | | | | | | |
| NS1 | 1077 | 0.44 | 3 | 3 | 0 | Y | TKVTITEDCG | 92.54 | TKVTITEDCS | 5.97 | TTVTITEDCG | 1.49 | | | | |
| NS1 | 1078 | 0.44 | 3 | 3 | 0 | Y | KVTITEDCGK | 92.54 | KVTITEDCSK | 5.97 | TVTITEDCGK | 1.49 | | | | |
| NS1 | 1079 | 0.33 | 2 | 2 | 0 | Y | VTITEDCGKR | 94.03 | VTITEDCSKR | 5.97 | | | | | | |
| NS1 | 1080 | 0.44 | 3 | 3 | 0 | Y | TITEDCGKRG | 92.54 | TITEDCSKRG | 5.97 | TITEDCGKRA | 1.49 | | | | |
| NS1 | 1081 | 0.44 | 3 | 3 | 0 | Y | ITEDCGKRGP | 92.54 | ITEDCSKRGP | 5.97 | ITEDCGKRAP | 1.49 | | | | |
| NS1 | 1082 | 0.44 | 3 | 3 | 0 | Y | TEDCGKRGPS | 92.54 | TEDCSKRGPS | 5.97 | TEDCGKRAPW | 1.49 | | | | |
| NS1 | 1083 | 1.17 | 5 | 5 | 0 | Y | EDCGKRGPSV | 74.63 | EDCGKRGPSI | 16.42 | EDCSKRGPSV | 5.97 | EDCGKRAPWV | 1.49 | EDCGKRGPSL | 1.49 |
| NS1 | 1084 | 1.17 | 5 | 5 | 0 | Y | DCGKRGPSVR | 74.63 | DCGKRGPSIR | 16.42 | DCSKRGPSVR | 5.97 | DCGKRGPSLR | 1.49 | DCGKRAPWVR | 1.49 |
| NS1 | 1085 | 1.17 | 5 | 5 | 0 | Y | CGKRGPSVRT | 74.63 | CGKRGPSIRT | 16.42 | CSKRGPSVRT | 5.97 | CGKRGPSLRT | 1.49 | CGKRGPSLRT | 1.49 |
| NS1 | 1086 | 1.17 | 5 | 5 | 0 | Y | GKRGPSVRTT | 74.63 | GKRGPSIRTT | 16.42 | SKRGPSVRTT | 5.97 | GKRGPSLRTT | 1.49 | GKRAPWVRTT | 1.49 |
| NS1 | 1087 | 0.86 | 4 | 4 | 0 | Y | KRGPSVRTTT | 80.6 | KRGPSIRTTT | 16.42 | KRGPSLRTTT | 1.49 | KRAPWVRTTT | 1.49 | | |
| NS1 | 1088 | 0.86 | 4 | 4 | 0 | Y | RGPSVRTTTD | 80.6 | RGPSIRTTTD | 16.42 | RGPSLRTTTD | 1.49 | RAPWVRTTTD | 1.49 | | |
| NS1 | 1089 | 0.86 | 4 | 4 | 0 | Y | GPSVRTTTDS | 80.6 | GPSIRTTTDS | 16.42 | GPSLRTTTDS | 1.49 | GPSLRTTTDS | 1.49 | | |
| NS1 | 1090 | 0.86 | 4 | 4 | 0 | Y | PSVRTTTDSG | 80.6 | PSIRTTTDSG | 16.42 | PSLRTTTDSG | 1.49 | PSLRTTTDSG | 1.49 | | |
| NS1 | 1091 | 0.86 | 4 | 4 | 0 | Y | SVRTTTDSGK | 80.6 | SIRTTTDSGK | 16.42 | SLRTTTDSGK | 1.49 | WVRTTTDIGK | 1.49 | | |
| NS1 | 1092 | 0.86 | 4 | 4 | 0 | Y | VRTTTDSGKL | 80.6 | IRTTTDSGKL | 16.42 | LRTTTDSGKL | 1.49 | VRTTTDIGKL | 1.49 | | |
| NS1 | 1093 | 0.11 | 2 | 2 | 0 | Y | RTTTDSGKLI | 98.51 | RTTTDIGKLI | 1.49 | | | | | | |
| NS1 | 1094 | 0.11 | 2 | 2 | 0 | Y | TTTDSGKLIT | 98.51 | TTTDIGKLIT | 1.49 | | | | | | |
| NS1 | 1095 | 0.11 | 2 | 2 | 0 | Y | TTDSGKLITD | 98.51 | TDIGKLITD | 1.49 | | | | | | |
| NS1 | 1096 | 0.11 | 2 | 2 | 0 | Y | TDSGKLITDW | 98.51 | TDIGKLITDW | 1.49 | | | | | | |

Species: JEV (10-mers)

FIG. 37-41

|

FIG. 37-42

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1122 | 0.11 | 2 | 2 | 0 | Y | GCWYGMEIRP | 98.51 | GCWYGMEVRP | 1.49 | | | | |
| NS1 | 1123 | 0.55 | 4 | 4 | 0 | Y | CWYGMEIRPV | 91.04 | CWYGMEIRPL | 5.97 | CWYGMEIRPA | 1.49 | CWYGMEVRPV | 1.49 |
| NS1 | 1134 | 0.79 | 4 | 4 | 0 | Y | HDETTLVRSQ | 83.58 | HDEATLVRSQ | 13.43 | HDETTLVRWQ | 1.49 | HDETTLVRSR | 1.49 |
| NS1 | 1135 | 0.85 | 5 | 5 | 0 | Y | DETTLVRSQV | 83.58 | DEATLVRSQV | 11.94 | DETTLVRSRV | 1.49 | DEATLVRSQA | 1.49 |
| NS1 | 1149 | 0.89 | 4 | 4 | 0 | Y | GEMVDPFQLG | 79.1 | GEMIDPFQLG | 17.91 | GGMVDPFQLG | 1.49 | GEMVDPFQMG | 1.49 |
| NS1 | 1150 | 0.89 | 4 | 4 | 0 | Y | EMVDPFQLGL | 79.1 | EMIDPFQLGL | 17.91 | EMVDPFQMGL | 1.49 | GMVDPFQLGL | 1.49 |
| NS2A | 1151 | 0.79 | 3 | 3 | 0 | Y | MVDPFQLGLL | 80.6 | MIDPFQLGLL | 17.91 | MVDPFQMGLL | 1.49 | | |
| NS2A | 1152 | 0.79 | 3 | 3 | 0 | Y | VDPFQLGLLV | 80.6 | IDPFQLGLLV | 17.91 | VDPFQMGLLV | 1.49 | | |
| NS2A | 1153 | 0.3 | 3 | 3 | 0 | Y | DPFQLGLLVM | 95.52 | DPFQLGLLVW | 2.99 | DPFQMGLLVM | 1.49 | | |
| NS2A | 1154 | 0.3 | 3 | 3 | 0 | Y | PFQLGLLVMF | 95.52 | PFQLGLLVWF | 2.99 | PFQMGLLVMF | 1.49 | | |
| NS2A | 1155 | 0.3 | 3 | 3 | 0 | Y | FQLGLLVMFL | 95.52 | FQLGLLVWFL | 2.99 | FQMGLLVMFL | 1.49 | | |
| NS2A | 1156 | 0.3 | 3 | 3 | 0 | Y | QLGLLVMFLA | 95.52 | QLGLLVWFLA | 2.99 | QMGLLVMFLA | 1.49 | | |
| NS2A | 1157 | 0.19 | 2 | 2 | 0 | Y | LGLLVMFLAT | 97.01 | LGLLVWFLAT | 2.99 | MGLLVMFLAT | 1.49 | | |
| NS2A | 1158 | 0.19 | 2 | 2 | 0 | Y | GLLVMFLATQ | 97.01 | GLLVWFLATQ | 2.99 | | | | |
| NS2A | 1159 | 0.19 | 2 | 2 | 0 | Y | LLVMFLATQE | 97.01 | LLVWFLATQE | 2.99 | | | | |
| NS2A | 1160 | 0.19 | 2 | 2 | 0 | Y | LVMFLATQEV | 97.01 | LVWFLATQEV | 2.99 | | | | |
| NS2A | 1161 | 0.3 | 3 | 3 | 0 | Y | VMFLATQEVL | 95.52 | VFLATQEVL | 2.99 | VMFLATQEVF | 1.49 | MFLATQEVLG | 1.49 |
| NS2A | 1162 | 0.42 | 4 | 4 | 0 | Y | MFLATQEVLR | 94.03 | VFLATQEVLR | 2.99 | MFLATQEVFR | 1.49 | | |
| NS2A | 1163 | 0.22 | 3 | 3 | 0 | Y | FLATQEVLRK | 97.01 | FLATQEVLRK | 1.49 | FLATQEVLGK | 1.49 | | |
| NS2A | 1164 | 0.22 | 3 | 3 | 0 | Y | LATQEVLRKR | 97.01 | LATQEVLRKR | 1.49 | LATQEVLGKR | 1.49 | | |
| NS2A | 1165 | 0.22 | 3 | 3 | 0 | Y | ATQEVLRKRW | 97.01 | ATQEVLRKRW | 1.49 | ATQEVFRKRW | 1.49 | | |
| NS2A | 1166 | 0.22 | 3 | 3 | 0 | Y | TQEVLRKRWT | 97.01 | TQEVFRKRWT | 1.49 | TQEVLGKRWT | 1.49 | | |
| NS2A | 1167 | 0.22 | 3 | 3 | 0 | Y | QEVLRKRWTA | 97.01 | QEVFRKRWTA | 1.49 | QEVLGKRWTA | 1.49 | | |
| NS2A | 1168 | 0.22 | 3 | 3 | 0 | Y | EVLRKRWTAR | 97.01 | EVFRKRWTAR | 1.49 | EVLGKRWTAR | 1.49 | | |
| NS2A | 1169 | 0.22 | 3 | 3 | 0 | Y | VLRKRWTARL | 97.01 | VLGKRWTARL | 1.49 | VFRKRWTARL | 1.49 | | |

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1195 | 0.19 | 2 | 2 | 0 | Y | ITYTDLARYV | 97.01 | ITYTDLARYV | 2.99 | | | | |
| NS2A | 1196 | 0.19 | 2 | 2 | 0 | Y | TYTDLARYVV

FIG. 37-45

Species: JEV (10-mers)

| protein | block starting position | block entropy | total peptides in block | # peptides required to cover 99% of block | gap/X fraction | 99% of block cov

FIG. 37-46

| protein | block starting position | block entropy (10-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2A | 1249 | 0.55 | 4 | 4 | 0 | Y | ENV

FIG. 37-47

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1274 | 0.22 | 3 | 3 | 0 | Y | ILNAAAIAW

FIG. 37-48

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1306 | 0.33 | 4 | 4 | 0 | Y | PGMRALYLDT | 95.52 | PGMRAFDLDT | 1.49 | PGMRALCLDT | 1.49 | PGMKALYLDT | 1.49 |
| NS2A | 1307 | 0.33 | 4 | 4 | 0 | Y | GMRALYLDTY | 95.52 | GMRAFDLDTY | 1.49 | GMRALCLDTY | 1.49 | GMKALYLDTY | 1.49 |
| NS2A | 1308 | 0.33 | 4 | 4 | 0 | Y | MRALYLDTYR | 95.52 | MRAFDLDTYR | 1.49 | MRAFDLDTYR | 1.49 | MKALYLDTYR | 1.49 |
| NS2A | 1309 | 0.33 | 4 | 4 | 0 | Y | RALYLDTYRI | 95.52 | KALYLDTYRI | 1.49 | RAFDLDTYRI | 1.49 | RALCLDTYRI | 1.49 |
| NS2A | 1310 | 0.22 | 3 | 3 | 0 | Y | ALYLDTYRII | 97.01 | AFDLDTYRII | 1.49 | ALCLDTYRII | 1.49 | | |
| NS2A | 1311 | 0.22 | 3 | 3 | 0 | Y | LYLDTYRIIL | 97.01 | FDLDTYRIIL | 1.49 | LCLDTYRIIL | 1.49 | | |
| NS2A | 1312 | 0.22 | 3 | 3 | 0 | Y | YLDTYRIILL | 97.01 | DLDTYRIILL | 1.49 | CLDTYRIILL | 1.49 | | |
| NS2A | 1313 | 0.11 | 2 | 2 | 0 | Y | LDTYRIILLI | 98.51 | LDTYRIILLI | 1.49 | | | | |
| NS2A | 1314 | 0.11 | 2 | 2 | 0 | Y | DTYRIILLVI | 98.51 | DTYRIILLII | 1.49 | | | | |
| NS2A | 1315 | 0.11 | 2 | 2 | 0 | Y | TYRIILLVIG | 98.51 | TYRIILLIIG | 1.49 | | | | |
| NS2A | 1316 | 0.44 | 3 | 3 | 0 | Y | YRIILLVIGI | 92.54 | YRIILLVIGV | 5.97 | YRIILLIIGV | 1.49 | | |
| NS2A | 1317 | 0.44 | 3 | 3 | 0 | Y | RIILLVIGIC | 92.54 | RIILLVIGVC | 5.97 | RIILLIIGVC | 1.49 | | |
| NS2A | 1318 | 0.44 | 3 | 3 | 0 | Y | IILLVIGICS | 92.54 | IILLVIGVCS | 5.97 | IILLIIGVCS | 1.49 | | |
| NS2A | 1319 | 0.44 | 3 | 3 | 0 | Y | ILLVIGICSL | 92.54 | ILLVIGVCSL | 5.97 | ILLIIGVCSL | 1.49 | | |
| NS2A | 1320 | 0.55 | 4 | 4 | 0 | Y | LLVIGICSLL | 91.04 | LLVIGVCSLL | 5.97 | LLIIGVCSLL | 1.49 | LIIGVCSLL | 1.49 |
| NS2A | 1321 | 1.06 | 5 | 5 | 0 | Y | LVIGICSLLQ | 79.1 | LVIGICSLLH | 11.94 | LVIGVCSLLQ | 5.97 | LIIGVCSLLQ | 1.49 | LVIGICSLQQ | 1.49 |
| NS2A | 1322 | 1.06 | 5 | 5 | 0 | Y | VIGICSLLQE | 79.1 | VIGICSLLHE | 11.94 | VIGVCSLLQE | 5.97 | IIGVCSLLQE | 1.49 | VIGICSLQQE | 1.49 |
| NS2A | 1323 | 1 | 4 | 4 | 0 | Y | IGICSLLQER | 79.1 | IGICSLLHER | 11.94 | IGVCSLLQER | 7.46 | IGICSLQQER | 1.49 | |
| NS2A | 1331 | 1.2 | 5 | 5 | 0 | Y | ERKKTMAKKK | 71.64 | ERRKTMAKKK | 20.9 | ERKKAMAKKK | 4.48 | ERKTMAKKK | 1.49 | ERRTMAKKK | 1.49 |
| NS2A | 1332 | 1.2 | 5 | 5 | 0 | Y | RKKTMAKKKG | 71.64 | RRKTMAKKKG | 20.9 | RKKAMAKKKG | 4.48 | RRTMAKKKG | 1.49 | REKTMAKKKG | 1.49 |
| NS2A | 1333 | 1.2 | 5 | 5 | 0 | Y | KKTMAKKKGA | 71.64 | RKTMAKKKGA | 20.9 | KKAMAKKKGA | 4.48 | EKTMAKKKGA | 1.49 | RRTMAKKKGA | 1.49 |
| NS2A | 1334 | 0.37 | 3 | 3 | 0 | Y | KTMAKKKGAV | 94.03 | KAMAKKKGAV | 4.48 | RTMAKKKGAV | 1.49 | | |
| NS2A | 1335 | 0.26 | 2 | 2 | 0 | Y | TMAKKKGAVL | 95.52 | AMAKKKGAVL | 4.48 | | | | |
| NS2A | 1336 | 0.33 | 2 | 2 | 0 | Y | MAKKKGAVLL | 94.03 | MAKKKGAVLM | 5.97 | | | | |
| NS2A | 1337 | 0.33 | 2 | 2 | 0 | Y | AKKKGAVLLG | 94.03 | AKKKGAVLMG | 5.97 | | | | |

FIG. 37-49

Species: JEV (10-mers)

| protein | block starting position | block entropy (10-mers) | total peptides in block | # peptides required to cover 99% of block | gap/X fraction | 99% of block covered w/ <= 5 peptides? | peptides required

FIG. 37-50

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1363 | 0.11 | 2 | 2 | 0 | Y | GLMYCNPNKK | 98.51 | GLMACNPNKK | 1.49 | | | | |
| NS2A | 1364 | 0.11 | 2 | 2 | 0 | Y | LMYCNPNKKR | 98.51 | LMACNPNKKR | 1.49 | | | | |
| NS2A | 1365 | 0.11 | 2 | 2 | 0 | Y | MYCNPNKKRG | 98.51 | MACNPNKKRG | 1.49 | | | | |
| NS2A | 1366 | 0.11 | 2 | 2 | 0 | Y | VCNPNKKRGW | 98.51 | ACNPNKKRGW | 1.49 | | | | |
| NS2A | 1367 | 0 | 1 | 1 | 0 | Y | CNPNKKRGWP

FIG. 37-51

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS2B | 1388 | 0.11 | 2 | 2 | 0 | Y | FAIVGGLAEL | 98.51 | FAIVGGLAEM | 1.49 |
| NS2B | 1389 | 0.11 | 2 | 2 | 0 | Y | AIVGGLAELD | 98.51 | AIVGGLAEMD | 1.49 |
| NS2B | 1390 | 0.11 | 2 | 2 | 0 | Y | IVGGLAELDI | 98.51 | IVGGLAEMDI | 1.49 |
| NS2B | 1391 | 0.11 | 2 | 2 | 0 | Y | VGGLAELDIE | 98.51 | VGGLAEMDIE | 1.49 |
| NS2B | 1392 | 0.11 | 2 | 2 | 0 | Y | GGLAELDIES | 98.51 | GGLAEMDIES | 1.49 |
| NS2B | 1393 | 0.11 | 2 | 2 | 0 | Y | GLAELDIESM | 98.51 | GLAEMDIESM | 1.49 |
| NS2B | 1394 | 0.11 | 2 | 2 | 0 | Y | LAELDIESMS | 98.51 | LAEMDIESMS | 1.49 |
| NS2B | 1395 | 0.11 | 2 | 2 | 0 | Y | AELDIESMSI | 98.51 | AEMDIESMSI | 1.49 |
| NS2B | 1396 | 0.11 | 2 | 2 | 0 | Y | ELDIESMSIP | 98.51 | EMDIESMSIP | 1.49 |
| NS2B | 1397 | 0.11 | 2 | 2 | 0 | Y | LDIESMSIPF | 98.51 | MDIESMSIPF | 1.49 |
| NS2B | 1398 | 0 | 1 | 1 | 0 | Y | DIESMSIPFM | 100 | | |
| NS2B | 1399 | 0 | 1 | 1 | 0 | Y | IESMSIPFML | 100 | | |
| NS2B | 1400 | 0 | 1 | 1 | 0 | Y | ESMSIPFMLA | 100 | | |
| NS2B | 1401 | 0.11 | 2 | 2 | 0 | Y | SMSIPFMLAG | 98.51 | SMSIPFMLAV | 1.49 |
| NS2B | 1402 | 0.11 | 2 | 2 | 0 | Y | MSIPFMLAGL | 98.51 | MSIPFMLAVL | 1.49 |
|

FIG. 37-52

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 37-53

Species: JEV (10-mers)

| protein |

FIG. 37-54

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency |

FIG. 37-55

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1497 | 0 | 1 | 1 | 0 | Y | LTLKTTKRGG | 100 | |

FIG. 37-56

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1522 | 0 | 1 | 1 | 0 | Y | TTGVYRIMA | 100 | | | | | | |
| NS3 | 1523 | 0.11 | 2 | 2 | 0 | Y | TGVYRIMAR | 98.51 | TGVYRIMAC | 1.49 | | | | |
| NS3 | 1524 | 0.11 | 2 | 2 | 0 | Y | TGVYRIMARG | 98.51 | TGVYRIMACG | 1.49 | | | | |
| NS3 | 1525 | 0.11 | 2 | 2 | 0 | Y | GVYRIMARGI | 98.51 | GVYRIMACGI | 1.49 | | | | |
| NS3 | 1526 | 0.22 | 3 | 3 | 0 | Y | VYRIMARGIL | 97.01 | VYRIMACGIL | 1.49 | VYRIMARGIF | 1.49 | | | |
| NS3 | 1527 | 0.22 | 3 | 3 | 0 | Y | YRIMARGILG | 97.01 | YRIMACGILG | 1.49 | YRIMARGIFG | 1.49 | | | |
| NS3 | 1528 | 0.22 | 3 | 3 | 0 | Y | RIMARGILGT | 97.01 | RIMACGILGT | 1.49 | RIMARGIFGT | 1.49 | | | |
| NS3 | 1529 | 0.22 | 3 | 3 | 0 | Y | IMARGILGTY | 97.01 | IMARGIFGTH | 1.49 |

FIG. 37-57

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1547 | 0.45 | 5 | 5 | 0 | Y | ENVFHTLWHT | 94.03 | QNVFHTLWHT | 1.49 | ENVLHTLWHT | 1.49 | ENVFHTLWHP | 1.49 | ESVFHTLWHT | 1.49 |
| NS3 | 1548 | 0.33 | 4 | 4 | 0 | Y | NVFHTLWHT | 95.52 | NVLHTLWHT | 1.49 | NVFHTLWHPT | 1.49 | SVFHTLWHT | 1.49 | | |
| NS3 | 1549 | 0.22 | 3 | 3 | 0 | Y | VFHTLWHTR | 97.01 | VFHTLWHPTR | 1.49 | VLHTLWHTTR | 1.49 | | | | |
| NS3 | 1550 | 0.22 | 3 | 3 | 0 | Y | FHTLWHTRG | 97.01 | FHTLWHPTRG | 1.49 | LHTLWHTTRG | 1.49 | | | | |
| NS3 | 1551 | 0.11 | 2 | 2 | 0 | Y | HTLWHTRGA | 98.51 | HTLWHPTRGA | 1.49 | | | | | | |
| NS3 | 1552 | 0.11 | 2 | 2 | 0 | Y | TLWHTRGAA | 98.51 | TLWHPTRGA | 1.49 | | | | | | |
| NS3 | 1553 | 0.3 | 3 | 3 | 0 | Y | LWHTRGAAI | 95.52 | LWHPTRGAA | 2.99 | LWHPTRGAAI | 1.49 | | | | |
| NS3 | 1554 | 0.57 | 4 | 4 | 0 | Y | WHTTRGAAIM | 91.04 | WHTTRGAAV | 2.99 | WHTRGAAVM | 1.49 | WHPTRGAAIM | 1.49 | | |
| NS3 | 1555 | 0.57 | 4 | 4 | 0 | Y | HTTRGAAIMS | 91.04 | HTTRGAAVMS | 4.48 | HTRGAAVMS | 2.99 | HPTRGAAIMS | 1.49 | | |
| NS3 | 1556 | 0.57 | 4 | 4 | 0 | Y | TTRGAAIMSG | 91.04 | TTRGAAVMSG | 4.48 | TRGAAVMSG | 2.99 | PTRGAAIMSG | 1.49 | | |
| NS3 | 1557 | 0.68 | 5 | 5 | 0 | Y | TRGAAIMSGE | 89.55 | TRGAAVMSGE | 4.48 | RGAAVMSGE | 2.99 | TRGAAIMSGK | 1.49 | TRGAAIMSGG | 1.49 |
| NS3 | 1558 | 0.68 | 5 | 5 | 0 | Y | RGAAIMSGEG | 89.55 | RGAAVMSGEG | 4.48 | GAAVMSGEG | 2.99 | RGAAIMSGGG | 1.49 | RGAAIMSGKG | 1.49 |
| NS3 | 1559 | 0.68 | 5 | 5 | 0 | Y | GAAIMSGEGK | 89.55 | GAAVMSGEGK | 4.48 | AAVMSGEGK | 2.99 | GAAIMSGGGK | 1.49 | GAAIMSGGGK | 1.49 |
| NS3 | 1560 | 0.68 | 5 | 5 | 0 | Y | AAIMSGEGKL | 89.55 | AAVMSGEGKL | 4.48 | AVMSGEGKL | 2.99 | AAIMSGGGKL | 1.49 | AAIMSGKGKL | 1.49 |
| NS3 | 1561 | 0.68 | 5 | 5 | 0 | Y | AIMSGEGKLT | 89.55 | AVMSGEGKLT | 4.48 | VMSGEGKLT | 2.99 | AIMSGGGKLT | 1.49 | AIMSGKGKLT | 1.49 |
| NS3 | 1562 | 0.68 | 5 | 5 | 0 | Y | IMSGEGKLTP | 89.55 | IVSGEGKLTP | 4.48 | VMSGEGKLTP | 2.99 | IMSGGGKLTP | 1.49 | IMSGGGKLTP | 1.49 |
| NS3 | 1563 | 0.49 | 4 | 4 | 0 | Y | MSGEGKLTPY | 92.54 | VSGEGKLTPY | 4.48 | MSGGGKLTPY | 2.99 | MSGKGKLTPY | 1.49 | | |
| NS3 | 1564 | 0.22 | 3 | 3 | 0 | Y | SGEGKLTPYW | 97.01 | SGKGKLTPYW | 1.49 | SGGGKLTPYW | 1.49 | | | | |
| NS3 | 1565 | 0.22 | 3 | 3 | 0 | Y | GEGKLTPYWG | 97.01 | GGGKLTPYWG | 1.49 | GKGKLTPYWG | 1.49 | | | | |
| NS3 | 1566 | 0.22 | 3 | 3 | 0 | Y | EGKLTPYWGS | 97.01 | KGKLTPYWGS | 1.49 | GGKLTPYWGS | 1.49 | | | | |
| NS3 | 1567 | 0 | 1 | 1 | 0 | Y | GKLTPYWGSV | 100 | | | | | | | | |
| NS3 | 1568 | 0.43 | 2 | 2 | 0 | Y | KLTPYWGSVK | 91.04 | KLTPYWGSVR | 8.96 | | | | | | |
| NS3 | 1569 | 0.43 | 2 | 2 | 0 | Y | LTPYWGSVKE | 91.04 | LTPYWGSVRE | 8.96 | | | | | | |
| NS3 | 1570 | 0.43 | 2 | 2 | 0 | Y | TPYWGSVKED | 91.04 | TPYWGSVRED | 8.96 | | | | | | |
| NS3 | 1571 | 0.43 | 2 | 2 | 0 | Y | PYWGSVKEDR | 91.04 | PYWGSVREDR | 8.96 | | | | | | |

FIG. 37-58

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1572 | 0.43 | 2 | 2 | 0 | Y | YWGSVKEDRI | 91.04 | YWGSVREDRI | 8.96 | | | | |
| NS3 | 1573 | 1.09 | 3 | 3 | 0 | Y | WGSVKEDRIA | 73.13 | WGSVKEDRIS | 17.91 | WGSVREDRIA | 8.96 | | |
| NS3 | 1574 | 1.09 | 3 | 3 | 0 | Y | GSVKEDRIAY | 73.13 | GSVKEDRISY | 17.91 | GSVREDRIAY | 8.96 | | |
| NS3 | 1575 | 1.09 | 3 | 3 | 0 | Y | SVKEDRIAYG | 73.13 | SVKEDRISYG | 17.91 | SVREDRIAYG | 8.96 | | |
| NS3 | 1576 | 1.09 | 3 | 3 | 0 | Y | VKEDRIAYGG | 73.13 | VKEDRISYGG | 17.91 | VREDRIAYGG | 8.96 | | |
| NS3 | 1577 | 1.09 | 3 | 3 | 0 | Y | KEDRIAYGGP | 73.13 | KEDRISYGGP | 17.91 | REDRIAYGGP | 8.96 | | |
| NS3 | 1578 | 0.68 | 2 | 2 | 0 | Y | EDRIAYGGPW | 82.09 | EDRISYGGPW | 17.91 | | | | |
| NS3 | 1579 | 0.68 | 2 | 2 | 0 | Y | DRIAYGGPWR | 82.09 | DRISYGGPWR | 17.91 | | | | |
| NS3 | 1580 | 0.68 | 2 | 2 | 0 | Y | RIAYGGPWRF | 82.09 | RISYGGPWRF | 17.91 | | | | |
| NS3 | 1581 | 0.68 | 2 | 2 | 0 | Y | IAYGGPWRFD | 82.09 | ISYGGPWRFD | 17.91 | | | | |
| NS3 | 1582 | 0.68 | 2 | 2 | 0 | Y | AYGGPWRFDR | 82.09 | SYGGPWRFDR | 17.91 | | | | |
| NS3 | 1583 | 0 | 1 | 1 | 0 | Y | YGGPWRFDRK | 100 | | | | | | |
| NS3 | 1584 | 0 | 1 | 1 | 0 | Y | GGPWRFDRKW | 100 | | | | | | |
| NS3 | 1585 | 0 | 1 | 1 | 0 | Y | GPWRFDRKWN | 100 | | | | | | |
| NS3 | 1586 | 0 | 1 | 1 | 0 | Y | PWRFDRKWNG | 100 | | | | | | |
| NS3 | 1587 | 0 | 1 | 1 | 0 | Y | WRFDRKWNGT | 100 | | | | | | |
| NS3 | 1588 | 0.11 | 2 | 2 | 0 | Y | REDRKWNGTD | 98.51 | REDRKWNGTN | 1.49 | | | | |
| NS3 | 1589 | 0.11 | 2 | 2 | 0 | Y | FDRKWNGTDD | 98.51 | FDRKWNGTND | 1.49 | | | | |
| NS3 | 1590 | 0.11 | 2 | 2 | 0 | Y | DRKWNGTDDV | 98.51 | DRKWNGTNDV | 1.49 | | | | |
| NS3 | 1591 | 0.11 | 2 | 2 | 0 | Y | RKWNGTDDVQ | 98.51 | RKWNGTNDVQ | 1.49 | | | | |
| NS3 | 1592 | 0.11 | 2 | 2 | 0 | Y | KWNGTDDVQV | 98.51 | KWNGTNDVQV | 1.49 | | | | |
| NS3 | 1593 | 0.11 | 2 | 2 | 0 | Y | WNGTDDVQVI | 98.51 | WNGTNDVQVI | 1.49 | | | | |
| NS3 | 1594 | 0.11 | 2 | 2 | 0 | Y | NGTDDVQVIV | 98.51 | NGTNDVQVIV | 1.49 | | | | |
| NS3 | 1595 | 0.11 | 2 | 2 | 0 | Y | GTDDVQVIVV | 98.51 | GTNDVQVIVV | 1.49 | | | | |
| NS3 | 1596 | 0.11 | 2 | 2 | 0 | Y | TDDVQVIVVE | 98.51 | TNDVQVIVVE | 1.49 | | | | |

FIG. 37-59

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1597 | 0.22 | 3 | 3 | 0 | Y | DDVQVIVWEP | 97.01 | DDVQVIVWEQ | 1.49 | NDVQVIVWEP | 1.49 | | |
| NS3 | 1598 | 0.11 | 2 | 2 | 0 | Y | DVQVIVWEPG | 98.51 | DVQVIVWEQG | 1.49 | | | | |
| NS3 | 1599 | 0.11 | 2 | 2 | 0 | Y | VQVIVWEPGK | 98.51 | VQVIVWEQGK | 1.49 | | | | |
| NS3 | 1600 | 1.08 | 5 | 5 | 0 | Y | QVIVWEPGKA | 77.61 | QVIVWEPGKP | 14.93 | QVIVWEPGKG | 4.48 | QVIVWEQGKP | 1.49 | QVIVWEPGKV | 1.49 |
| NS3 | 1601 | 1.08 | 5 | 5 | 0 | Y | VIVWEPGKAA | 77.61 | VIVWEPGKPA | 14.93 | VIVWEPGKGA | 4.48 | VIVWEQGKPA | 1.49 | VIWEPGKVA | 1.49 |
| NS3 | 1612 | 0.53 | 5 | 5 | 0 | Y | NIQTKPGVFR | 92.54 | NIQTKPGVFP | 2.99 | SIQTKPGVFR | 1.49 | NIQTKPGVFC | 1.49 | NFQTKPGVFR | 1.49 |
| NS3 | 1613 | 0.45 | 5 | 4 | 0 | Y | IQTKPGVFRT | 94.03 | FQTKPGVFRT | 1.49 | IQTKPGIFPP | 1.49 | IQTKPGVFCT | 1.49 | IQTKPGIFPT | 1.49 |
| NS3 | 1614 | 0.33 | 4 | 4 | 0 | Y | QTKPGVFRTP | 95.52 | QTKPGVFCTP | 1.49 | QTKPGIFPTP | 1.49 | QTKPGVFCTP | 1.49 | |
| NS3 | 1615 | 0.45 | 5 | 5 | 0 | Y | TKPGVFRTPF | 94.03 | TKPGIFPTPF | 1.49 | TKPGIFPPPF | 1.49 | TKPGVFCTPF | 1.49 | TKPGVFRTPL | 1.49 |
| NS3 | 1616 | 0.45 | 5 | 5 | 0 | Y | KPGVFRTPFG | 94.03 | KPGVFRTPLG | 1.49 | KPGVFCTPFG | 1.49 | KPGIFPPPFG | 1.49 | KPGIFPTPFG | 1.49 |
| NS3 | 1623 | 0.66 | 5 | 5 | 0 | Y | PFGEVGAVSL | 89.55 | PGEIGAVSL | 1.49 | PFGKVGTVSL | 1.49 | PFGKVGAVSL | 1.49 | PLGEVGAVSL | 1.49 |
| NS3 | 1624 | 0.66 | 5 | 5 | 0 | Y | FGEVGAVSLD | 89.55 | FGEIGAVSLD | 1.49 | FGKVGAVSLD | 1.49 | FGKVGTVSLD | 1.49 | LGEVGAVSLD | 1.49 |
| NS3 | 1625 | 0.55 | 5 | 5 | 0 | Y | GEVGAVSLDY | 91.04 | GEIGAVSLDY | 1.49 | GKVGTVSLDY | 1.49 | GKVGAVSLDY | 1.49 | | |
| NS3 | 1626 | 0.55 | 5 | 4 | 0 | Y | EVGAVSLDYP | 91.04 | EIGAVSLDYP | 1.49 | KVGTVSLDYP | 1.49 | KVGAVSLDYP | 1.49 | | |
| NS3 | 1627 | 0.44 | 4 | 4 | 0 | Y | VGAVSLDYPR | 92.54 | IGAVSLDYPR | 1.49 | VGTVSLDYPR | 1.49 | | | | |
| NS3 | 1628 | 0.11 | 3 | 3 | 0 | Y | GAVSLDYPRG | 98.51 | GTVSLDYPRG | 1.49 | | | | | |
| NS3 | 1629 | 0.11 | 2 | 2 | 0 | Y | AVSLDYPRGT | 98.51 | TVSLDYPRGT | 1.49 | | | | | |
| NS3 | 1630 | 0 | 1 | 1 | 0 | Y | VSLDYPRGTS | 100 | | | | | | | |
| NS3 | 1631 | 0 | 1 | 1 | 0 | Y | SLDYPRGTSG | 100 | | | | | | | |
| NS3 | 1632 | 0 | 1 | 1 | 0 | Y | LDYPRGTSGS | 100 | | | | | | | |
| NS3 | 1633 | 0 | 1 | 1 | 0 | Y | DYPRGTSGSP | 100 | | | | | | | |
| NS3 | 1634 | 0 | 1 | 1 | 0 | Y | YPRGTSGSPI | 100 | | | | | | | |
| NS3 | 1635 | 0 | 1 | 1 | 0 | Y | PRGTSGSPIL | 100 | | | | | | | |
| NS3 | 1636 | 0.11 | 2 | 2 | 0 | Y | RGTSGSPILD | 98.51 | RGTSGSPILN | 1.49 | | | | | |
| NS3 | 1637 | 0.22 | 3 | 3 | 0 | Y | GTSGSPILDS | 97.01 | GTSGSPILNS | 1.49 | GTSGSPILDF | 1.49 | | | |

FIG. 37-60

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1638 | 0.22 | 3 | 3 | 0 | Y | TSGSPILDSN | 97.01 | TSGSPILNSN | 1.49 | TSGSPILDFN | 1.49 | | | | |
| NS3 | 1639 | 0.22 | 3 | 3 | 0 | Y | SGSPILDSNG | 97.01 | SGSPILNSNG | 1.49 | SGSPILDFNG | 1.49 | | | | |
| NS3 | 1640 | 0.22 | 3 | 3 | 0 | Y | GSPILDSNGD | 97.01 | GSPILDFNGD | 1.49 | GSPILNSNGD | 1.49 | | | | |
| NS3 | 1641 | 0.22 | 3 | 3 | 0 | Y | SPILDSNGDI | 97.01 | SPILDFNGDI | 1.49 | SPILNSNGDV | 1.49 | | | | |
| NS3 | 1642 | 0.22 | 3 | 3 | 0 | Y | PILDSNGDII | 97.01 | PILDFNGDII | 1.49 | PILNSNGDVV | 1.49 | | | | |
| NS3 | 1643 | 0.22 | 3 | 3 | 0 | Y | ILDSNGDIIG | 97.01 | ILDFNGDIIG | 1.49 | ILNSNGDVVG | 1.49 | | | | |
| NS3 | 1644 | 0.22 | 3 | 3 | 0 | Y | LDSNGDIIGL | 97.01 | LDFNGDIIGL | 1.49 | LNSNGDVVGC | 1.49 | | | | |
|

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1695 | 0.22 | 3 | 3 | 0 | Y | VLDLHPGSGK | 97.01 | VLDLHPGLGK | 1.49 | | | | |
| NS3 | 1696 | 0.22 | 3 | 3 | 0 | Y | LDLHPGSGKT | 97.01 | LDLHPGLGKT | 1.49 | | | | |
| NS3 | 1697 | 0.42 | 4 | 4 | 0 | Y | DLHPGSGKTR | 94.03 | DLHPGLGKTR | 2.99 | DLHPGSGKTR | 1.49 | DLPPGSGKTR | 1.49 | |
| NS3 | 1698 | 0.42 | 4 | 4 | 0 | Y | LHPGSGKTRK | 94.03 | LHPGLGKTRK | 2.99 | LHPGLGKTRK | 1.49 | LPPGSGKTRK | 1.49 | |
| NS3 | 1699 | 0.42 | 4 | 4 | 0 | Y | HPGSGKTRKI | 94.03 | HPGSGKTRKI | 2.99 | PPGSGKTRKI | 1.49 | HPGLGKTRKI | 1.49 | |
| NS3 | 1700 | 0.3 | 3 | 3 | 0 | Y | PGSGKTRKIL | 95.52 | PGSGKTKKIL | 2.99 | PGLGKTRKIL | 1.49 | | | |
| NS3 | 1701 | 0.3 | 3 | 3 | 0 | Y | GSGKTRKILP | 95.52 | GSGKTKKILP | 2.99 | GLGKTRKILP | 1.49 | | | |
| N Species: JEV (10-mers)

FIG. 37-63

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1720 | 0.39 | 3 | 3 | 0 | Y | RLRTAVLAPT | 94.03 | RLKTAVLAPT | 2.99 | HLRTAVLAPT | 2.99 | | |
| NS3 | 1721 | 0.19 | 2 | 2 | 0 | Y | LRTAVLAPTR | 97.01 | LKTAVLAPTR | 2.99 | | | | |
| NS3 | 1722 | 0.19 | 2 | 2 | 0 | Y | RTAVLAPTRV | 97.01 | KTAVLAPTRV | 2.99 | | | | |
| NS3 | 1723 | 0 | 1 | 1 | 0 | Y | TAVLAPTRVV | 100 | | | | | | |
| NS3 | 1724 | 0 | 1 | 1 | 0 | Y | AVLAPTRVVA | 100 | | | | | | |
| NS3 | 1725 | 0 | 1 | 1 | 0 | Y | VLAPTRVVAA | 100 | | | | | | |
| NS3 | 1726 | 0 | 1 | 1 | 0 | Y | LAPTRVVAAE | 100 | | | | | | |
| NS3 | 1727 | 0 | 1 | 1 | 0 | Y | APTRVVAAEM | 100 | | | | | | |
| NS3 | 1728 | 0 | 1 | 1 | 0 | Y | PTRVVAAEMA | 100 | | | | | | |
| NS3 | 1729 | 0 | 1 | 1 | 0 | Y | TRVVAAEMAE | 100 | | | | | | |
| NS3 | 1730 | 0.26 | 2 | 2 | 0 | Y | RVVAAEMAEA | 95.52 | RVVAAEMAEV | 4.48 | | | | |
| NS3 | 1731 | 0.26 | 2 | 2 | 0 | Y | VVAAEMAEAL | 95.52 | VVAAEMAEVL | 4.48 | | | | |
| NS3 | 1732 | 0.59 | 3 | 3 | 0 | Y | VAAEMAEALR | 89.55 | VAAEMAEALK | 5.97 | VAAEMAEVLR | 4.48 | | |
| NS3 | 1733 | 0.59 | 3 | 3 | 0 | Y | AAEMAEALRG | 89.55 | AAEMAEALKG | 5.97 | AAEMAEVLRG | 4.48 | | |
| NS3 | 1734 | 0.59 | 3 | 3 | 0 | Y | AEMAEALRGL | 89.55 | AEMAEALKGL | 5.97 | AEMAEVLRGL | 4.48 | | |
| NS3 | 1735 | 0.59 | 3 | 3 | 0 | Y | EMAEALRGLP | 89.55 | EMAEALKGLP | 5.97 | EMAEVLRGLP | 4.48 | | |
| NS3 | 1736 | 0.59 | 3 | 3 | 0 | Y | MAEALRGLPV | 89.55 | MAEALKGLPV | 5.97 | MAEVLRGLPV | 4.48 | | |
| NS3 | 1737 | 0.59 | 3 | 3 | 0 | Y | AEALRGLPVR | 89.55 | AEALKGLPVR | 5.97 | AEVLRGLPVR | 4.48 | | |
| NS3 | 1738 | 0.59 | 3 | 3 | 0 | Y | EALRGLPVRY | 89.55 | EALKGLPVRY | 5.97 | EVLRGLPVRY | 4.48 | | |
| NS3 | 1739 | 0.59 | 3 | 3 | 0 | Y | ALRGLPVRYQ | 89.55 | ALKGLPVRYQ | 5.97 | VLRGLPVRYQ | 4.48 | | |
| NS3 | 1740 | 0.33 | 2 | 2 | 0 | Y | LRGLPVRYQT | 94.03 | LKGLPVRYQT | 5.97 | | | | |
| NS3 | 1741 | 0.33 | 2 | 2 | 0 | Y | RGLPVRYQTS | 94.03 | KGLPVRYQTS | 5.97 | | | | |
| NS3 | 1742 | 0 | 1 | 1 | 0 | Y | GLPVRYQTSA | 100 | | | | | | |
| NS3 | 1743 | 0 | 1 | 1 | 0 | Y | LPVRYQTSAV | 100 | | | | | | |
| NS3 | 1744 | 0 | 1 | 1 | 0 | Y | PVRYQTSAVQ | 100 | | | | | | |

FIG. 37-64

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1745 | 0 | 1 | 1 | 0 | Y | VRYQTSAVQR | 100 | | | | | | |
| NS3 | 1746 | 0.11 | 2 | 2 | 0 | Y | RYQTSAVQRE | 98.51 | RYQTSAVQRS | 1.49 | | | | |
| NS3 | 1747 | 0.11 | 2 | 2 | 0 | Y | YQTSAVQREH | 98.51 | YQTSAVQRSH | 1.49 | | | | |
| NS3 | 1748 | 0.11 | 2 | 2 | 0 | Y | QTSAVQREHQ | 98.51 | QTSAVQRSHQ | 1.49 | | | | |
| NS3 | 1749 | 0.11 | 2 | 2 | 0 | Y | TSAVQREHQG | 98.51 | TSAVQRSHQG | 1.49 | | | | |
| NS3 | 1750 | 0.11 | 2 | 2 | 0 | Y | SAVQREHQGN | 98.51 | SAVQRSHQGN | 1.49 | | | | |
| NS3 | 1751 | 0.22 | 3 | 3 | 0 | Y | AVQREHQGNE | 97.01 | AVQREHQGNA | 1.49 | AVQRSHQGNE | 1.49 | | |
| NS3 | 1752 | 0.22 | 3 | 3 | 0 | Y | VQREHQGNEI | 97.01 | VQREHQGNAI | 1.49 | VQRSHQGNEI | 1.49 | | |
| NS3 | 1753 | 0.22 | 3 | 3 | 0 | Y | QREHQGNEIV | 97.01 | QREHQGNAIV | 1.49 | QRSHQGNEIV | 1.49 | | |
| NS3 | 1754 | 0.22 | 3 | 3 | 0 | Y | REHQGNEIVD | 97.01 | RSHQGNAIVD | 1.49 | REHQGNAIVD | 1.49 | | |
| NS3 | 1755 | 0.22 | 3 | 3 | 0 | Y | EHQGNEIVDV | 97.01 | EHQGNAIVDV | 1.49 | SHQGNEIVDV | 1.49 | | |
| NS3 | 1756 | 0.11 | 2 | 2 | 0 | Y | HQGNEIVDVM | 98.51 | HQGNAIVDVM | 1.49 | | | | |
| NS3 | 1757 | 0.11 | 2 | 2 | 0 | Y | QGNEIVDVMC | 98.51 | QGNAIVDVMC | 1.49 | | | | |
| NS3 | 1758 | 0.11 | 2 | 2 | 0 | Y | GNEIVDVMCH | 98.51 | GNAIVDVMCH | 1.49 | | | | |
| NS3 | 1759 | 0.11 | 2 | 2 | 0 | Y | NEIVDVMCHA | 98.51 | NAIVDVMCHA | 1.49 | | | | |
| NS3 | 1760 | 0.11 | 2 | 2 | 0 | Y | EIVDVMCHAT | 98.51 | AIVDVMCHAT | 1.49 | | | | |
| NS3 | 1761 | 0 | 1 | 1 | 0 | Y | IVDVMCHATL | 100 | | | | | | |
| NS3 | 1762 | 0 | 1 | 1 | 0 | Y | VDVMCHATLT | 100 | | | | | | |
| NS3 | 1763 | 0 | 1 | 1 | 0 | Y | DVMCHATLTH | 100 | | | | | | |
| NS3 | 1764 | 0 | 1 | 1 | 0 | Y | VMCHATLTHR | 100 | | | | | | |
| NS3 | 1765 | 0 | 1 | 1 | 0 | Y | MCHATLTHRL | 100 | | | | | | |
| NS3 | 1766 | 0.11 | 2 | 2 | 0 | Y | CHATLTHRLM | 98.51 | CHATLTHRLT | 1.49 | | | | |
| NS3 | 1767 | 0.11 | 2 | 2 | 0 | Y | HATLTHRLMS | 98.51 | HATLTHRLTS | 1.49 | | | | |
| NS3 | 1768 | 0.11 | 2 | 2 | 0 | Y | ATLTHRLMSP | 98.51 | AITLTHRLSP | 1.49 | | | | |
| NS3 | 1769 | 0.11 | 2 | 2 | 0 | Y | TLTHRLMSPN | 98.51 | TLTHRLTSPN | 1.49 | | | | |

FIG. 37-65

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 1770 | 0.11 | 2 | 2 | 0 | Y | LTHRLMSPNR | 98.51 | LTHRLTSPNR | 1.49 | | |
| NS3 | 1771 | 0.11 | 2 | 2 | 0 | Y | THRLMSPNRV | 98.51 | THRLTSPNRV | 1.49 | | |
| NS3 | 1772 | 0.11 | 2 | 2 | 0 | Y | HRLMSPNRVP | 98.51 | HRLTSPNRVP | 1.49 | | |
| NS3 | 1773 | 0.11 | 2 | 2 | 0 | Y | RLMSPNRVPN | 98.51 | RLTSPNRVPN | 1.49 | | |
| NS3 | 1774 | 0.11 | 2 | 2 | 0 | Y | LMSPNRVPNY | 98.51 | LTSPNRVPNY | 1.49 | | |
| NS3 | 1775 | 0.11 | 2 | 2 | 0 | Y | MSPNRVPNYN | 98.51 | TSPNRVPNYN | 1.49 | | |
| NS3 | 1776 | 0 | 1 | 1 | 0 | Y | SPNRVPNYNL | 100 | | | | |
| NS3 | 1777 | 0 | 1 | 1 | 0 | Y | PNRVPNYNLF | 100 | | | | |
| NS3 | 1778 | 0 | 1 | 1 | 0 | Y | NRVPNYNLFV | 100 | | | | |
| NS3 | 1779 | 0 | 1 | 1 | 0 | Y | RVPNYNLFVM | 100 | | | | |
| NS3 | 1780 | 0 | 1 | 1 | 0 | Y | VPNYNLFVMD | 100 | | | | |
| NS3 | 1781 | 0 | 1 | 1 | 0 | Y | PNYNLFVMDE | 100 | | | | |
| NS3 | 1782 | 0 | 1 | 1 | 0 | Y | NYNLFVMDEA | 100 | | | | |
| NS3 | 1783 | 0 | 1 | 1 | 0 | Y | YNLFVMDEAH | 100 | | | | |
| NS3 | 1784 | 0 | 1 | 1 | 0 | Y | NLFVMDEAHF | 100 | | | | |
| NS3 | 1785 | 0 | 1 | 1 | 0 | Y | LFVMDEAHFT | 100 | | | | |
| NS3 | 1786 | 0 | 1 | 1 | 0 | Y | FVMDEAHFTD | 100 | | | | |
| NS3 | 1787 | 0 | 1 | 1 | 0 | Y | VMDEAHFTDP | 100 | | | | |
| NS3 | 1788 | 0 | 1 | 1 | 0 | Y | MDEAHFTDPA | 100 | | | | |
| NS3 | 1789 | 0.11 | 2 | 2 | 0 | Y | DEAHFTDPAS | 98.51 | DEAHFTDPAG | 1.49 | | |
| NS3 | 1790 | 0.11 | 2 | 2 | 0 | Y | EAHFTDPASI | 98.51 | EAHFTDPAGI | 1.49 | | |
| NS3 | 1791 | 0.11 | 2 | 2 | 0 | Y | AHFTDPASIA | 98.51 | AHFTDPAGIA | 1.49 | | |
| NS3 | 1792 | 0.11 | 2 | 2 | 0 | Y | HFTDPASIAA | 98.51 | HFTDPAGIAA | 1.49 | | |
| NS3 | 1793 | 0.11 | 2 | 2 | 0 | Y | FTDPASIAAR | 98.51 | FTDPAGIAAR | 1.49 | | |
| NS3 | 1794 | 0.11 | 2 | 2 | 0 | Y | TDPASIAARG | 98.51 | TDPAGIAARG | 1.49 | | |

FIG. 37-66

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1795 | 0.11 |

FIG. 37-67

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1820 | 0.11 | 2 | 2 | 0 | Y | TATPPGTTDP | 98.51 | TATSPGTTDP | 1.49 | | | | |
| NS3 | 1821 | 0.11 | 2 | 2 | 0 | Y | ATPPGTTDPF | 98.51 | ATSPGTTDPF | 1.49 | | | | |
| NS3 | 1822 | 0.11 | 2 | 2 | 0 | Y | TPPGTTDPFP | 98.51 | TSPGTTDPFP | 1.49 | | | | |
| NS3 | 1823 | 0.11 | 2 | 2 | 0 | Y | PPGTTDPFPD | 98.51 | SPGTTDPFPD | 1.49 | | | | |
| NS3 | 1824 | 0 | 1 | 1 | 0 | Y | PGTTDPFPDS | 100 | | | | | | |
| NS3 | 1825 | 0.11 | 2 | 2 | 0 | Y | GTTDPFPDSN | 98.51 | GTTDPFPDSD | 1.49 | | | | |
| NS3 | 1826 | 0.11 | 2 | 2 | 0 | Y | TTDPFPDSNA | 98.51 | TTDPFPDSDA | 1.49 | | | | |
| NS3 | 1827 | 0.11 | 2 | 2 | 0 | Y | TDPFPDSNAP | 98.51 | TDPFPDSDAP | 1.49 | | | | |
| NS3 | 1828 | 0.11 | 2 | 2 | 0 | Y | DPFPDSNAPI | 98.51 | DPFPDSDAPI | 1.49 | | | | |
| NS3 | 1829 | 0.11 | 2 | 2 | 0 | Y | PFPDSNAPIH | 98.51 | PFPDSDAPIH | 1.49 | | | | |
| NS3 | 1830 | 0.11 | 2 | 2 | 0 | Y | FPDSNAPIHD | 98.51 | FPDSDAPIHD | 1.49 | | | | |
| NS3 | 1831 | 0.11 | 2 | 2 | 0 | Y | PDSNAPIHDL | 98.51 | PDSDAPIHDL | 1.49 | | | | |
| NS3 | 1832 | 0.11 | 2 | 2 | 0 | Y | DSNAPIHDLQ | 98.51 | DSDAPIHDLQ | 1.49 | | | | |
| NS3 | 1833 | 0.11 | 2 | 2 | 0 | Y | SNAPIHDLQD | 98.51 | SDAPIHDLQD | 1.49 | | | | |
| NS3 | 1834 | 0.3 | 3 | 3 | 2.99 | Y | NAPIHDLQDE | 95.52 | NAPIHDLQDG | 2.99 | DAPIHDLQDE | 1.49 | | |
| NS3 | 1835 | 0.23 | 3 | 3 | 2.99 | Y | APIHDLQDEI | 94.03 | APIHDLQDEV | 1.49 | APIHDLQDET | 1.49 | | |
| NS3 | 1836 | 0.23 | 3 | 3 | 2.99 | Y | PIHDLQDEIP | 94.03 | PIHDLQDETP | 1.49 | PIHDLQDEVP | 1.49 | | |
| NS3 | 1837 | 0.23 | 3 | 3 | 2.99 | Y | IHDLQDEIPD | 94.03 | IHDLQDETPD | 1.49 | IHDLQDEVPD | 1.49 | | |
| NS3 | 1838 | 0.34 | 4 | 4 | 2.99 | Y | HDLQDEIPDR | 92.54 | HDLQDEIPDW | 1.49 | HDLQDEVPDR | 1.49 | HDLQDEVPDR | 1.49 |
| NS3 | 1839 | 0.34 | 4 | 4 | 2.99 | Y | DLQDEIPDRA | 92.54 | DLQDEIPDRA | 1.49 | DLQDEVPDRA | 1.49 | DLQDEIPDWA | 1.49 |
| NS3 | 1840 | 0.34 | 4 | 4 | 2.99 | Y | LQDEIPDRAW | 92.54 | LQDEIPDWAW | 1.49 | LQDEVPDRAW | 1.49 | LQDETPDRAW | 1.49 |
| NS3 | 1841 | 0.34 | 4 | 4 | 2.99 | Y | QDEIPDRAWS | 92.54 | QDEIPDWAWS | 1.49 | QDEVPDRAWS | 1.49 | QDEIPDWAWS | 1.49 |
| NS3 | 1842 | 0.34 | 4 | 4 | 2.99 | Y | DEIPDRAWSS | 92.54 | DEIPDWAWSS | 1.49 | DETPDRAWSS | 1.49 | DEVPDRAWSS | 1.49 |
| NS3 | 1843 | 0.34 | 4 | 4 | 2.99 | Y | EIPDRAWSSG | 92.54 | EVPDRAWSSG | 1.49 | ETPDRAWSSG | 1.49 | EIPDWAWSSG | 1.49 |
| NS3 | 1859 | 0.86 | 4 | 4 | 0 | Y | WITEYAGKTV | 80.6 | WITDYAGKTV | 16.42 | WSTEYAGKTV | 1.49 | WITEYSGKTV | 1.49 |

FIG. 37-68

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1860 | 0.86 | 4 | 4 | 0 | Y | ITEYAG

FIG. 37-69

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1885 | 0.11 | 2 | 2 | 0 | Y | QRAGKKVIQL | 98.51 | QRAGKRVIQL | 1.49 | | | | |
| NS3 | 1886 | 0.22 | 3 | 3 | 0 | Y | RAGKKVIQLN | 97.01 | RAGKRVIQLN | 1.49 | RAGKKVIQLS | 1.49 | | |
| NS3 | 1887 | 0.22 | 3 | 3 | 0 | Y | AGKKVIQLNR | 97.01 | AGKRVIQLSR | 1.49 | AGKRVIQLNR | 1.49 | | |
| NS3 | 1888 | 0.22 | 3 | 3 | 0 | Y | GKKVIQLNRK | 97.01 | GKRVIQLNRK | 1.49 | GKKVIQLSRK | 1.49 | | |
| NS3 | 1889 | 0.22 | 3 | 3 | 0 | Y | KKVIQLNRKS | 97.01 | KVIQLSRKS | 1.49 | KRVIQLNRKS | 1.49 | | |
| NS3 | 1890 | 0.22 | 3 | 3 | 0 | Y | KVIQLNRKSY | 97.01 | KVIQLSRKSY | 1.49 | RVIQLNRKSY | 1.49 | | |
| NS3 | 1891 | 0.11 | 2 | 2 | 0 | Y | VIQLNRKSYD | 98.51 | VIQLSRKSYD | 1.49 | | | | |
| NS3 | 1892 | 0.11 | 2 | 2 | 0 | Y | IQLNRKSYDT | 98.51 | IQLSRKSYDT | 1.49 | | | | |
| NS3 | 1893 | 0.11 | 2 | 2 | 0 | Y | QLNRKSYDTE | 98.51 | QLSRKSYDTE | 1.49 | | | | |
| NS3 | 1894 | 0.11 | 2 | 2 | 0 | Y | LNRKSYDTEY | 98.51 | LSRKSYDTEY | 1.49 | | | | |
| NS3 | 1895 | 0.11 | 2 | 2 | 0 | Y | NRKSYDTEYP | 98.51 | SRKSYDTEYP | 1.49 | | | | |
| NS3 | 1896 | 0 | 1 | 1 | 0 | Y | RKSYDTEYPK | 100 | | | | | | |
| NS3 | 1897 | 0 | 1 | 1 | 0 | Y | KSYDTEYPKC | 100 | | | | | | |
| NS3 | 1898 | 0 | 1 | 1 | 0 | Y | SYDTEYPKCK | 100 | | | | | | |
| NS3 | 1899 | 0 | 1 | 1 | 0 | Y | YDTEYPKCKN | 100 | | | | | | |
| NS3 | 1900 | 0 | 1 | 1 | 0 | Y | DTEYPKCKNG | 100 | | | | | | |
| NS3 | 1901 | 0 | 1 | 1 | 0 | Y | TEYPKCKNGD | 100 | | | | | | |
| NS3 | 1902 | 0 | 1 | 1 | 0 | Y | EYPKCKNGDW | 100 | | | | | | |
| NS3 | 1903 | 0 | 1 | 1 | 0 | Y | YPKCKNGDWD | 100 | | | | | | |
| NS3 | 1904 | 0 | 1 | 1 | 0 | Y | PKCKNGDWDF | 100 | | | | | | |
| NS3 | 1905 | 0 | 1 | 1 | 0 | Y | KCKNGDWDFV | 100 | | | | | | |
| NS3 | 1906 | 0 | 1 | 1 | 0 | Y | CKNGDWDFVI | 100 | | | | | | |
| NS3 | 1907 | 0 | 1 | 1 | 0 | Y | KNGDWDFVIT | 100 | | | | | | |
| NS3 | 1908 | 0 | 1 | 1 | 0 | Y | NGDWDFVITT | 100 | | | | | | |
| NS3 | 1909 | 0 | 1 | 1 | 0 | Y | GDWDFVITTD | 100 | | | | | | |

FIG. 37-70

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1910 | 0 | — | — | 0 | Y | DWDFVITTDI | 100 | | | | | | |
| NS3 | 1911 | 0 | — | — | 0 | Y | WDFVITTDIS | 100 | | | | | | |
| NS3 | 1912 | 0 | — | — | 0 | Y | DFVITTDISE | 100 | | | | | | |
| NS3 | 1913 | 0.11 | 2 | 2 | 0 | Y | FVITTDISEM | 98.51 | FVITTDISEV | 1.49 | | | | |
| NS3 | 1914 | 0.11 | 2 | 2 | 0 | Y | VITTDISEMG | 98.51 | VITTDISEVG | 1.49 | | | | |
| NS3 | 1915 | 0.11 | 2 | 2 | 0 | Y | ITTDISEMGA | 98.51 | ITTDISEVGA | 1.49 | | | | |
| NS3 | 1916 | 0.11 | 2 | 2 | 0 | Y | TTDISEMGAN | 98.51 | TTDISEVGAN | 1.49 | | | | |
| NS3 | 1917 | 0.11 | 2 | 2 | 0 | Y | TDISEMGANF | 98.51 | TDISEVGANF | 1.49 | | | | |
| NS3 | 1918 | 0.11 | 2 | 2 | 0 | Y | DISEMGANFG | 98.51 | DISEVGANFG | 1.49 | | | | |
| NS3 | 1919 | 0.11 | 2 | 2 | 0 | Y | ISEMGANFGA | 98.51 | ISEVGANFGA | 1.49 | | | | |
| NS3 | 1920 | 0.11 | 2 | 2 | 0 | Y | SEMGANFGAS | 98.51 | SEVGANFGAS | 1.49 | | | | |
| NS3 | 1921 | 0.11 | 2 | 2 | 0 | Y | EMGANFGASR | 98.51 | EVGANFGASR | 1.49 | | | | |
| NS3 | 1922 | 0.11 | 2 | 2 | 0 | Y | MGANFGASRV | 98.51 | VGANFGASRV | 1.49 | | | | |
| NS3 | 1923 | 0 | 1 | 1 | 0 | Y | GANFGASRVI | 100 | | | | | | |
| NS3 | 1924 | 0 | 1 | 1 | 0 | Y | ANFGASRVID | 100 | | | | | | |
| NS3 | 1925 | 0 | 1 | 1 | 0 | Y | NFGASRVIDC | 100 | | | | | | |
| NS3 | 1926 | 0 | 1 | 1 | 0 | Y | FGASRVIDCR | 100 | | | | | | |
| NS3 | 1927 | 0 | 1 | 1 | 0 | Y | GASRVIDCRK | 100 | | | | | | |
| NS3 | 1928 | 0 | 1 | 1 | 0 | Y | ASRVIDCRKS | 100 | | | | | | |
| NS3 | 1929 | 0 | 1 | 1 | 0 | Y | SRVIDCRKSV | 100 | | | | | | |
| NS3 | 1930 | 0.11 | 2 | 2 | 0 | Y | RVIDCRKSVK | 98.51 | RVIDCRKSVE | 1.49 | | | | |
| NS3 | 1931 | 0.11 | 2 | 2 | 0 | Y | VIDCRKSVKP | 98.51 | VIDCRKSVEP | 1.49 | | | | |
| NS3 | 1932 | 0.22 | 3 | 3 | 0 | Y | IDCRKSVKPT | 97.01 | IDCRKSVEPT | 1.49 | IDCRKSVKPI | 1.49 | | |
| NS3 | 1933 | 0.22 | 3 | 3 | 0 | Y | DCRKSVKPTI | 97.01 | DCRKSVEPTI | 1.49 | DCRKSVKPTI | 1.49 | | |
| NS3 | 1934 | 0.22 | 3 | 3 | 0 | Y | CRKSVKPTIL | 97.01 | CRKSVEPTIL | 1.49 | CRKSVKPTIL | 1.49 | | |

FIG. 37-71

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1935 | 0.22 | 3 | 3 | 0 | Y | RKSVKPT

FIG. 37-72

Species: JEV (10-mers)

| protein | block starting position | block entropy (10-mers) | total peptides in block | # peptides required to cover 99% of block | gap/X fraction | 99% of block covered w/ <= 5 peptides? | peptides required to cover

FIG. 37-73

Species: JEV (10

FIG. 37-74

Species: JEV (10-mers)

| protein | block

FIG. 37-75

Species: JEV (10-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS3 | 2035 | 0 | 1 | 1 | 0 | Y | RGEEKKNFLE | 100 | | | | |
| NS3 | 2036 | 0 | 1 | 1 | 0 | Y | GEEKKNFLEL | 100 | | | | |
| NS3 | 2037 | 0 | 1 | 1 | 0 | Y | EEKKNFLELL | 100 | | | | |
| NS3 | 2038 | 0 | 1 | 1 | 0 | Y | EKKNFLELLR | 100 | | | | |
| NS3 | 2039 | 0 | 1 | 1 | 0 | Y | KKNFLELLRT | 100 | | | | |
| NS3 | 2040 | 0 | 1 | 1 | 0 | Y | KNFLELLRTA | 100 | | | | |
| NS3 | 2041 | 0 | 1 | 1 | 0 | Y | NFLELLRTAD | 100 | | | | |
| NS3 | 2042 | 0 | 1 | 1 | 0 | Y | FLELLRTADL | 100 | | | | |
| NS3 | 2043 | 0 | 1 | 1 | 0 | Y | LELLRTADLP | 100 | | | | |
| NS3 | 2044 | 0 | 1 | 1 | 0 | Y | ELLRTADLPV | 100 | | | | |
| NS3 | 2045 | 0 | 1 | 1 | 0 | Y | LLRTADLPVW | 100 | | | | |
| NS3 | 2046 | 0 | 1 | 1 | 0 | Y | LRTADLPVWL | 100 | | | | |
| NS3 | 2047 | 0 | 1 | 1 | 0 | Y | RTADLPVWLA | 100 | | | | |
| NS3 | 2048 | 0 | 1 | 1 | 0 | Y | TADLPVWLAY | 100 | | | | |
| NS3 | 2049 | 0.11 | 2 | 2 | 0 | Y | ADLPVWLAYK | 98.51 | ADLPVWLAYR | 1.49 | | |
| NS3 | 2050 | 0.11 | 2 | 2 | 0 | Y | DLPVWLAYKV | 98.51 | DLPVWLAYRV | 1.49 | | |
| NS3 | 2051 | 0.11 | 2 | 2 | 0 | Y | LPVWLAYKVA | 98.51 | LPVWLAYRVA | 1.49 | | |
| NS3 | 2052 | 0.22 | 3 | 3 | 0 | Y | PVWLAYKVAS | 97.01 | PVWLAYRVAS | 1.49 | PVWLAYKVAP | 1.49 |
| NS3 | 2053 | 0.22 | 3 | 3 | 0 | Y | VWLAYKVASN | 97.01 | VWLAYRVASN | 1.49 | VWLAYKVAPN | 1.49 |
| NS3 | 2054 | 0.22 | 3 | 3 | 0 | Y | WLAYKVASNG | 97.01 | WLAYRVASNG | 1.49 | WLAYKVAPNG | 1.49 |
| NS3 | 2055 | 0.22 | 3 | 3 | 0 | Y | LAYKVASNGI | 97.01 | LAYKVAPNGI | 1.49 | LAYRVASNGI | 1.49 |
| NS3 | 2056 | 0.22 | 3 | 3 | 0 | Y | AYKVASNGIQ | 97.01 | AYKVAPNGIQ | 1.49 | AYRVASNGIQ | 1.49 |
| NS3 | 2057 | 0.22 | 3 | 3 | 0 | Y | YKVASNGIQY | 97.01 | YKVAPNGIQY | 1.49 | YRVASNGIQY | 1.49 |
| NS3 | 2058 | 0.22 | 3 | 3 | 0 | Y | KVASNGIQYT | 97.01 | KVAPNGIQYT | 1.49 | KVAPNGIQYT | 1.49 |
| NS3 | 2059 | 0.11 | 2 | 2 | 0 | Y | VASNGIQYTD | 98.51 | VAPNGIQYTD | 1.49 | | |

FIG. 37-76

Species: JEV (10-mers)

| protein | block starting position | block entropy | total peptides in block | # peptides required to cover 99% of block | gap/X fraction | 99% of block covered w/ <= 5 peptides? | peptides required to cover 99% of block

Species: JEV (10-mers)

| protein | block starting position | block entropy | total peptides in block | # peptides required to cover 99% of block | gap/X fraction | 99% of block covered w

FIG. 37-79

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4A | 2135 | 0.33 | 4 | 4 | 0 | Y | VLGRMPEHFM | 95.52 | VRGRMPEHFM | 1.49 | VLGRMPEHFA | 1.49 | EPGRMPEHFM | 1.49 | | |
| NS4A | 2136 | 0.33 | 4 | 4 | 0 | Y | LGRMPEHFMG | 95.52 | RGRMPEHFMG | 1.49 | PGRMPEHFMG | 1.49 | LGRMPEHFAG | 1.49 | | |
| NS4A | 2137 | 0.11 | 2 | 2 | 0 | Y | GRMPEHFMGK | 98.51 | GRMPEHFAGK | 1.49 | | | | | | |
| NS4A | 2138 | 0.11 | 2 | 2 | 0 | Y | RMPEHFMGKT | 98.51 | RMPEHFAGKT | 1.49 | | | | | | |
| NS4A | 2139 | 0.11 | 2 | 2 | 0 | Y | MPEHFMGKTR | 98.51 | MPEHFAGKTR | 1.49 | | | | | | |
| NS4A | 2140 | 0.11 | 2 | 2 | 0 | Y | PEHFMGKTRE | 98.51 | PEHFAGKTRE | 1.49 | | | | | | |
| NS4A | 2141 | 0.11 | 2 | 2 | 0 | Y | EHFMGKTREA | 98.51 | EHFAGKTREA | 1.49 | | | | | | |
| NS4A | 2142 | 0.11 | 2 | 2 | 0 | Y | HFMGKTREAL | 98.51 | HFAGKTREAL | 1.49 | | | | | | |
| NS4A | 2143 | 0.11 | 2 | 2 | 0 | Y | FMGKTREALD | 98.51 | FAGKTREALD | 1.49 | | | | | | |
| NS4A | 2144 | 0.11 | 2 | 2 | 0 | Y | MGKTREALDT | 98.51 | AGKTREALDT | 1.49 | | | | | | |
| NS4A | 2145 | 0 | 1 | 1 | 0 | Y | GKTREALDTM | 100 | | | | | | | | |
| NS4A | 2146 | 0 | 1 | 1 | 0 | Y | KTREALDTMY | 100 | | | | | | | | |
| NS4A | 2147 | 0 | 1 | 1 | 0 | Y | TREALDTMYL | 100 | | | | | | | | |
| NS4A | 2148 | 0 | 1 | 1 | 0 | Y | REALDTMYLY | 100 | | | | | | | | |
| NS4A | 2149 | 0 | 1 | 1 | 0 | Y | EALDTMYLVA | 100 | | | | | | | | |
| NS4A | 2150 | 0 | 1 | 1 | 0 | Y | ALDTMYLVAT | 100 | | | | | | | | |
| NS4A | 2151 | 0 | 1 | 1 | 0 | Y | LDTMYLVATA | 100 | | | | | | | | |
| NS4A | 2152 | 0 | 1 | 1 | 0 | Y | DTMYLVATAE | 100 | | | | | | | | |
| NS4A | 2153 | 0.19 | 2 | 2 | 0 | Y | TMYLVATAEK | 97.01 | TMYLVATAER | 2.99 | | | | | | |
| NS4A | 2154 | 0.3 | 3 | 3 | 0 | Y | MYLVATAEKG | 95.52 | MYLVATAERG | 2.99 | MYLVATAEKS | 1.49 | | | | |
| NS4A | 2155 | 0.3 | 3 | 3 | 0 | Y | YLVATAEKGG | 95.52 | YLVATAERGG | 2.99 | YLVATAEKSG | 1.49 | | | | |
| NS4A | 2156 | 0.3 | 3 | 3 | 0 | Y | LVATAEKGGK | 95.52 | LVATAERGGK | 2.99 | LVATAEKSGK | 1.49 | | | | |
| NS4A | 2157 | 0.42 | 4 | 4 | 0 | Y | VATAEKGGKA | 94.03 | VATAERGGKA | 2.99 | VATAEKSGKA | 1.49 | VATAEKGGKT | 1.49 | | |
| NS4A | 2158 | 0.42 | 4 | 4 | 0 | Y | ATAEKGGKAH | 94.03 | ATAERGGKAH | 2.99 | ATAEKSGKAH | 1.49 | ATAEKGGKTH | 1.49 | | |
| NS4A | 2159 | 0.42 | 4 | 4 | 0 | Y | TAEKGGKAHR | 94.03 | TAERGGKAHR | 2.99 | TAEKSGKAHR | 1.49 | TAEKGGKTHR | 1.49 | | |

FIG. 37-80

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2160 | 0.42 | 4 | 4 | 0 | Y | AEKGGK

FIG. 37-81

Species: JEV (10-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---

FIG. 37-82

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS4A | 2217 | 0 | 2 | 1 | 0 | Y | ATFFLWA

FIG. 37-83

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

FIG. 37-84

| protein | block starting position | block entropy (10-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2267 | 0.22 | 3 | 3 | 0 | Y | VLTVGVAA | 97.01 | VLTVGVAA | 1.49 | VLTVGVAAA | 1.49 | | |
| 2K | 2268 | 0.22 | 3 | 3 | 0 | Y | LTVGVAAN | 97.01 | LTVGVAAN | 1.49 | LTVGVAAAN | 1.49 | | |
| 2K | 2269 | 0.22 | 3 | 3 | 0 | Y | TVGVAANE | 97.01 | TVGVAANE | 1.49 | TVGMVAANE | 1.49 | | |
| 2K | 2270 | 0.22 | 3 | 3 | 0 | Y | VVGVAANEY | 97.01 | VVGMVAANEY | 1.49 | VVGMVAANEY | 1.49 | | |
| 2K | 2271 | 0.22 | 3 | 3 | 0 | Y | VGVAANEYG | 97.01 | VGVAANEYG | 1.49 | VGMVAANEYG | 1.49 | | |
| 2K | 2272 | 0.22 | 3 | 3 | 0 | Y | GVAANEYGM | 97.01 | GVAANEYGM | 1.49 | GMVAANEYGM | 1.49 | | |
| 2K | 2273 | 0.22 | 3 | 3 | 0 | Y | VAANEYGML | 97.01 | MVAANEYGML | 1.49 | VAAANEYGML | 1.49 | | |
| 2K | 2274 | 0.11 | 2 | 2 | 0 | Y | AANEYGMLE | 98.51 | AAANEYGMLE | 1.49 | | | | |
| 2K | 2275 | 0.11 | 2 | 2 | 1.49 | Y | ANEYGMLEK | 97.01 | AANEYGMLEK | 1.49 | | | | |
| 2K | 2276 | 0.11 | 2 | 2 | 1.49 | Y | NEYGMLEKT | 97.01 | ANEYGMLERT | 1.49 | | | | |
| 2K | 2277 | 0.11 | 2 | 2 | 1.49 | Y | EYGMLEKTK | 97.01 | NEYGMLERTK | 1.49 | | | | |
| 2K | 2278 | 0.11 | 2 | 2 | 1.49 | Y | EYGMLEKTKA | 97.01 | EYGMLERTKA | 1.49 | | | | |
| 2K | 2279 | 0.11 | 2 | 2 | 1.49 | Y | YGMLEKTKAD | 97.01 | YGMLERTKAD | 1.49 | | | | |
| NS4B | 2280 | 0.23 | 3 | 3 | 1.49 | Y | GMLEKTKADI | 95.52 | GMLEKTKADI | 1.49 | GMLERTKADL | 1.49 | | |
| NS4B | 2281 | 0.23 | 3 | 3 | 1.49 | Y | MLEKTKADLK | 95.52 | MLEKTKADIK | 1.49 | MLERTKADLK | 1.49 | | |
| NS4B | 2282 | 0.23 | 3 | 3 | 1.49 | Y | LEKTKADLKS | 95.52 | LEKTKADIKS | 1.49 | LERTKADLKS | 1.49 | | |
| NS4B | 2283 | 0.23 | 3 | 3 | 1.49 | Y | EKTKADLKSM | 95.52 | ERTKADLKSM | 1.49 | EKTKADLKSM | 1.49 | | |
| NS4B | 2284 | 0.23 | 3 | 3 | 1.49 | Y | KTRADLKSMF | 95.52 | KTRADLKSMF | 1.49 | RTKADLKSMF | 1.49 | | |
| NS4B | 2285 | 0.96 | 4 | 4 | 0 | Y | TKADLKSMFG | 80.6 | TKADLKSMFA | 10.45 | TKADLKSMFV | 7.46 | TKADIKSMFA | 1.49 |
| NS4B | 2286 | 0.96 | 4 | 4 | 0 | Y | KADLKSMFGG | 80.6 | KADLKSMFAG | 10.45 | KADLKSMFVG | 7.46 | KADIKSMFAG | 1.49 |
| NS4B | 2287 | 1.49 | 5 | 5 | 0 | Y | ADLKSMFGGK | 67.16 | ADLKSMFAGK | 13.43 | ADLKSMFGGR | 10.45 | ADLKSMFVGK | 7.46 | ADIKSMFAGK | 1.49 |
| NS4B | 2290 | 1.52 | 5 | 5 | 0 | Y | KSMFGGKTQA | 65.67 | KSMFAGKTQA | 13.43 | KSMFGRTQA | 11.94 | KSMFVGKTQA | 7.46 | KSMFGGKAPV | 1.49 |
| NS4B | 2297 | 0.65 | 4 | 4 | 0 | Y | TQASGLTGLP | 88.06 | TQAPGLTGLP | 8.96 | TQALGLTGLP | 1.49 | APVSGMTGLP | 1.49 | |
| NS4B | 2298 | 0.65 | 4 | 4 | 0 | Y | QASGLTGLPS | 88.06 | QAPGLTGLPS | 8.96 | QALGLTGLPS | 1.49 | PVSGMTGLPG | 1.49 | |
| NS4B | 2299 | 0.76 | 5 | 5 | 0 | Y | ASGLTGLPSM | 86.57 | APGLTGLPSM | 8.96 | VSGMTGLPGM | 1.49 | ALGLTGLPSM | 1.49 | ASGLTGLPSV | 1.49 |

Species: JEV

FIG. 37-85

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2301 | 0.33 | 4 | 4 | 0 | Y | GLTGLPSMAL | 95.52 | GMTGLPGMAL | 1.49 | GLTGLPSMTL | 1.49 | GLTGLPSVAL | 1.49 |
| NS4B | 2302 | 0.33 | 4 | 4 | 0 | Y | LTGLPSMALD | 95.52 | MTGLPGMALD | 1.49 | LTGLPSVALD | 1.49 | LTGLPSMTLD | 1.49 |
| NS4B | 2303 | 0.33 | 4 | 4 | 0 | Y | TGLPSMALDL | 95.52 | TGLP

FIG. 37-86

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2326 | 0.11 | 2 | 2 | 0 | Y | WLTPLLKHL | 98.51 | WLTPLLKHI | 1.49 | | | | |
| NS4B | 2327 | 0.11 | 2 | 2 | 0 | Y | VLTPLLKHLI | 98.51 | VLTPLLKHII | 1.49 | | | | |
| NS4B | 2328 | 0.11 | 2 | 2 | 0 | Y | LTPLLKHLIT | 98.51 | LTPLLKHIIT | 1.49 | | | | |
| NS4B | 2329 | 0.11 | 2 | 2 | 0 | Y | TPLLKHLITS | 98.51 | TPLLKHIITS | 1.49 | | | | |
| NS4B | 2330 | 0.11 | 2 | 2 | 0 | Y | PLLKHLITSE | 98.51 | PLLKHIITSE | 1.49 | | | | |
| NS4B | 2331 | 0.11 | 2 | 2 | 0 | Y | LLKHLITSEY | 98.51 | LLKHIITSEY | 1.49 | | | | |
| NS4B | 2332 | 0.11 | 2 | 2 | 0 | Y | LKHLITSEYV | 98.51 | LKHIITSEYV | 1.49 | | | | |
| NS4B | 2333 | 0.11 | 2 | 2 | 0 | Y | KHLITSEYVT | 98.51 | KHIITSEYVT | 1.49 | | | | |
| NS4B | 2334 | 0.22 | 3 | 3 | 0 | Y | HLITSEYVTP | 97.01 | HIITSEYVTP | 1.49 | HIITSEYVT | 1.49 | | |
| NS4B | 2335 | 0.22 | 3 | 3 | 0 | Y | LITSEYVTPS | 97.01 | IITSEYVTPS | 1.49 | LITSEYVTPS | 1.49 | | |
| NS4B | 2336 | 0.11 | 2 | 2 | 0 | Y | ITSEYVTPSL | 98.51 | ITSEYVTPSL | 1.49 | | | | |
| NS4B | 2337 | 0.11 | 2 | 2 | 0 | Y | TSEYVTPSLA | 98.51 | TSEYVTPSLA | 1.49 | | | | |
| NS4B | 2338 | 0.11 | 2 | 2 | 0 | Y | SEYVTPSLAS | 98.51 | SEYVTPSLAS | 1.49 | | | | |
| NS4B | 2339 | 0.11 | 2 | 2 | 0 | Y | EYVTPSLASI | 98.51 | EYVTPSLASI | 1.49 | | | | |
| NS4B | 2340 | 0.75 | 3 | 3 | 0 | Y | YVTTSLASIN | 82.09 | YVTTSLASIS | 16.42 | YVTPSLASIS | 1.49 | | |
| NS4B | 2341 | 0.75 | 3 | 3 | 0 | Y | VTTSLASINS | 82.09 | VTTSLASISS | 16.42 | VTPSLASISS | 1.49 | | |
| NS4B | 2342 | 0.75 | 3 | 3 | 0 | Y | TTSLASINSQ | 82.09 | TTSLASISSQ | 16.42 | TPSLASISSQ | 1.49 | | |
| NS4B | 2343 | 0.75 | 3 | 3 | 0 | Y | TSLASINSQA | 82.09 | TSLASISSQA | 16.42 | PSLASISSQA | 1.49 | | |
| NS4B | 2344 | 0.68 | 2 | 2 | 0 | Y | SLASINSQAG | 82.09 | SLASISSQAG | 17.91 | | | | |
| NS4B | 2345 | 0.68 | 2 | 2 | 0 | Y | LASINSQAGS | 82.09 | LASISSQAGS | 17.91 | | | | |
| NS4B | 2346 | 0.68 | 2 | 2 | 0 | Y | ASINSQAGSL | 82.09 | ASISSQAGSL | 17.91 | | | | |
| NS4B | 2347 | 0.68 | 2 | 2 | 0 | Y | SINSQAGSLF | 82.09 | SISSQAGSLF | 17.91 | | | | |
| NS4B | 2348 | 0.68 | 2 | 2 | 0 | Y | INSQAGSLFV | 82.09 | ISSQAGSLFV | 17.91 | | | | |
| NS4B | 2349 | 0.68 | 2 | 2 | 0 | Y | NSQAGSLFVL | 82.09 | SSQAGSLFVL | 17.91 | | | | |
| NS4B | 2350 | 0 | 1 | 1 | 0 | Y | SQAGSLFVLP | 100 | | | | | | |

FIG. 37-87

Species: JEV (10-mers)

| prot

FIG. 37-88

Species:

FIG. 37-89

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---

FIG. 37-90

| protein | block starting position | block entropy | total peptides in block | # peptides required to cover 99% of block | gap/X fraction | 99% of block covered w/ <= 5 peptides? | cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2430 | 0 | 2 | 1 | 0 | Y | MVAT

Species: JEV (10-mers)

| protein | block starting position | block entropy | total peptides in block | # peptides required to cover 99% of block | gap/X fraction | 99% of block covered w/ <= 5 peptides? | peptides required to cover 99% of block

FIG. 37-93

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2505 | 0.19 | 2 | 2 | 0 | Y | VMR

FIG. 37-94

| protein | block starting position | block entropy (10-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2531 | 0.5 | 4 | 4 | 0 | Y | RGRPGGRTLG | 92.54 | KGRPGGRTLG | 2.99 | RGRSGGRTLG | 2.99 | RGGPGGRTLW | 1.49 | | |
| NS5 | 2532 | 0.42 | 4 | 4 | 0 | Y | GRPGGRTLGE | 94.03 | GRSGGRTLGE | 2.99 | GRPGGRTLGD | 1.49 | GGPGGRTLWE | 1.49 | | |
| NS5 | 2533 | 0.42 | 4 | 4 | 0 | Y | RPGGRTLGEQ | 94.03 | RSGGRTLGEQ | 2.99 | GPGGRTLWEQ | 1.49 | RPGGRTLGDQ | 1.49 | | |
| NS5 | 2534 | 0.42 | 4 | 3 | 0 | Y | PGGRTLGEQW | 94.03 | SGGRTLGEQW | 2.99 | PGGRTLWEQW | 1.49 | PGGRTLGDQW | 1.49 | | |
| NS5 | 2535 | 0.22 | 3 | 4 | 0 | Y | GGRTLGEQWK | 97.01 | GGRTLGDQWK | 1.49 | GGRTLWEQWK | 1.49 | | | | |
| NS5 | 2536 | 0.33 | 4 | 5 | 0 | Y | GRTLGEQWKE | 95.52 | GRTLWEQWKE | 1.49 | GRTLGDQWKE | 1.49 | | | | |
| NS5 | 2537 | 0.45 | 5 | 5 | 0 | Y | RTLGEQWKEK | 94.03 | RTLWEQWKEK | 1.49 | RTLGDQWKEK | 1.49 | RTLGEQ

FIG. 37-95

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2558

FIG. 37-96

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2583 | 0 | 1 | 1 | 0 | Y | GHPVSRGSAK | 100 | | | | | | |
| NS5 | 2584 | 0 | 1 | 1 | 0 | Y | HPVSRGSAKL | 100 | | | | | | |
| NS5 | 2585 | 0 | 1 | 1 | 0 | Y | PVSRGSAKLR | 100 | | | | | | |
| NS5 | 2586 | 0 | 1 | 1 | 0 | Y | VSRGSAKLRW | 100 | | | | | | |
| NS5 | 2587 | 0 | 1 | 1 | 0 | Y | SRGSAKLRWL | 100 | | | | | | |
| NS5 | 2588 | 0 | 1 | 1 | 0 | Y | RGSAKLRWLV | 100 | | | | | | |
| NS5 | 2589 | 0 | 1 | 1 | 0 | Y | GSAKLRWLVE | 100 | | | | | | |
| NS5 | 2590 | 0 | 1 | 1 | 0 | Y | SAKLRWLVEK | 100 | | | | | | |
| NS5 | 2591 | 0 | 1 | 1 | 0 | Y | AKLRWLVEKG | 100 | | | | | | |
| NS5 | 2592 | 0 | 1 | 1 | 0 | Y | KLRWLVEKGF | 100 | | | | | | |
| NS5 | 2593 | 0 | 1 | 1 | 0 | Y | LRWLVEKGFV | 100 | | | | | | |
| NS5 | 2594 | 0.11 | 2 | 2 | 0 | Y | RWLVEKGFVS | 98.51 | RWLVEKGFVP | 1.49 | | | | |
| NS5 | 2595 | 0.11 | 2 | 2 | 0 | Y | WLVEKGFVSP | 98.51 | WLVEKGFVPP | 1.49 | | | | |
| NS5 | 2596 | 0.11 | 2 | 2 | 0 | Y | LVEKGFVSPI | 98.51 | LVEKGFVPPI | 1.49 | | | | |
| NS5 | 2597 | 0.11 | 2 | 2 | 0 | Y | VEKGFVSPIG | 98.51 | VEKGFVPPIG | 1.49 | | | | |
| NS5 | 2598 | 0.11 | 2 | 2 | 0 | Y | EKGFVSPIGK | 98.51 | EKGFVPPIGK | 1.49 | | | | |
| NS5 | 2599 | 0.11 | 2 | 2 | 0 | Y | KGFVSPIGKV | 98.51 | KGFVPPIGKV | 1.49 | | | | |
| NS5 | 2600 | 0.22 | 3 | 3 | 0 | Y | GFVSPIGKVI | 97.01 | GFVPPIGKVI | 1.49 | | | | |
| NS5 | 2601 | 0.22 | 3 | 3 | 0 | Y | FVSPIGKVID | 97.01 | FVPPIGKVID | 1.49 | | | | |
| NS5 | 2602 | 0.22 | 3 | 3 | 0 | Y | VSPIGKVIDL | 97.01 | VPPIGKVIDL | 1.49 | | | | |
| NS5 | 2603 | 0.22 | 3 | 3 | 0 | Y | SPIGKVIDLG | 97.01 | SPIGKVDLG | 1.49 | | | | |
| NS5 | 2604 | 0.11 | 2 | 2 | 0 | Y | PIGKVIDLGC | 98.51 | | | | | | |
| NS5 | 2605 | 0.11 | 2 | 2 | 0 | Y | IGKVIDLGCG | 98.51 | | | | | | |
| NS5 | 2606 | 0.22 | 3 | 3 | 0 | Y | GKVIDLGCGR | 97.01 | GKVIDLGCGC | 1.49 | | | | |
| NS5 | 2607 | 0.22 | 3 | 3 | 0 | Y | KVIDLGCGRG | 97.01 | KVIDLGCGCG | 1.49 | | | | |

FIG. 37-97

Species: JEV (10

FIG. 37-98

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2633 | 0 | 1 | 1 | 0 | Y | GYTKGGA

FIG. 37-99

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2658 | 0.22 | 3 | 3 | 0 | Y | KSGVDVFYKP | 97.01 | KSGVDVFYRP | 1.49 | KSGVHVFYKP | 1.49 | | |
| NS5 | 2659 | 0.22 | 3 | 3 | 0 | Y | SGVDVFYKPS | 97.01 | SGVDVFYRPS | 1.49 | SGVHVFYKPS | 1.49 | | |
| NS5 | 2660 | 0.22 | 3 | 3 | 0 | Y | GVDVFYKPSE | 97.01 | GVDVFYRPSE | 1.49 | GVHVFYKPSE | 1.49 | | |
| NS5 | 2661 | 0.22 | 3 | 3 | 0 | Y | VDVFYKPSEP | 97.01 | VDVFYRPSEP | 1.49 | VDVFYRPSEP | 1.49 | | |
| NS5 | 2662 | 0.22 | 3 | 3 | 0 | Y | DVFYKPSEPS | 97.01 | DVFYRPSEPS | 1.49 | HVFYKPSEPS | 1.49 | | |
| NS5 | 2663 | 0.11 | 2 | 2 | 0 | Y | VFYKPSEPSD | 98.51 | VFYRPSEPSD | 1.49 | | | | |
| NS5 | 2664 | 0.11 | 2 | 2 | 0 | Y | FYKPSEPSDT | 98.51 | FYRPSEPSDT | 1.49 | | | | |
| NS5 | 2665 | 0.11 | 2 | 2 | 0 | Y | YKPSEPSDTL | 98.51 | YRPSEPSDTL | 1.49 | | | | |
| NS5 | 2666 | 0.11 | 2 | 2 | 0 | Y | KPSEPSDTLF | 98.51 | RPSEPSDTLL | 1.49 | | | | |
| NS5 | 2667 | 0.11 | 2 | 2 | 0 | Y | PSEPSDTLFC | 98.51 | PSEPSDTLLC | 1.49 | | | | |
| NS5 | 2668 | 0.11 | 2 | 2 | 0 | Y | SEPSDTLFCD | 98.51 | SEPSDTLLCD | 1.49 | | | | |
| NS5 | 2669 | 0.11 | 2 | 2 | 0 | Y | EPSDTLFCDI | 98.51 | EPSDTLLCDI | 1.49 | | | | |
| NS5 | 2670 | 0.11 | 2 | 2 | 0 | Y | PSDTLFCDIG | 98.51 | PSDTLLCDIG | 1.49 | | | | |
| NS5 | 2671 | 0.11 | 2 | 2 | 0 | Y | SDTLFCDIGE | 98.51 | SDTLLCDIGE | 1.49 | | | | |
| NS5 | 2672 | 0.11 | 2 | 2 | 0 | Y | DTLFCDIGES | 98.51 | DTLLCDIGES | 1.49 | | | | |
| NS5 | 2673 | 0.11 | 2 | 2 | 0 | Y | TLFCDIGESS | 98.51 | TLLCDIGESS | 1.49 | | | | |
| NS5 | 2674 | 0.11 | 2 | 2 | 0 | Y | LFCDIGESSP | 98.51 | LLCDIGESSP | 1.49 | | | | |
| NS5 | 2675 | 0.11 | 2 | 2 | 0 | Y | FCDIGESSPS | 98.51 | LCDIGESSPS | 1.49 | | | | |
| NS5 | 2676 | 0 | 1 | 1 | 0 | Y | CDIGESSPSP | 100 | | | | | | |
| NS5 | 2677 | 0.11 | 2 | 2 | 0 | Y | DIGESSPSPE | 98.51 | DIGESSPSPD | 1.49 | | | | |
| NS5 | 2678 | 0.11 | 2 | 2 | 0 | Y | IGESSPSPEV | 98.51 | IGESSPSPDV | 1.49 | | | | |
| NS5 | 2679 | 0.11 | 2 | 2 | 0 | Y | GESSPSPEVE | 98.51 | GESSPSPDVE | 1.49 | | | | |
| NS5 | 2680 | 0.11 | 2 | 2 | 0 | Y | ESSPSPEVEE | 98.51 | ESSPSPDVEE | 1.49 | | | | |
| NS5 | 2681 | 0.11 | 2 | 2 | 0 | Y | SSPSPEVEEQ | 98.51 | SSPSPDVEEQ | 1.49 | | | | |
| NS5 | 2682 | 0.11 | 2 | 2 | 0 | Y | SPSPEVEEQR | 98.51 | SPSPDVEEQR | 1.49 | | | | |

FIG. 37-100

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS5 | 2683 | 0.11 | 2 | 2 | 0 | Y | PSPEVEEQRT | 98.51 | PSPDVEEQRT | 1.49 |
| NS5 | 2684 | 0.11 | 2 | 2 | 0 | Y | SPEVEEQRTL | 98.51 | SPDVEEQRTL | 1.49 |
| NS5 | 2685 | 0.11 | 2 | 2 | 0 | Y | PEVEEQRTLR | 98.51 | PDVEEQRTLR | 1.49 |
| NS5

FIG. 37-101

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2708 | 0.11 | 2 | 2 | 0 | Y | RE

FIG. 37-102

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 37-103

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2758 | 0 | 1 | 1 | 0 | Y | GNW

FIG. 37-104

Species: JEV (10-mers)

| protein | block starting position | block entropy | total peptides in block | # peptides required to cover 99% of block | gap/X fraction | 99% of block covered w/ <= 5 peptides? | peptides required

FIG. 37-105

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2818 | 0.71 | 5 | 5 | 0 | Y | KE

FIG. 37-106

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required

FIG. 37-107

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2868 | 0.11 | 2 | 2 | 0 | Y | IANVTTMAMT | 98.51 | ISYVTTMPMT | 1.49 | | |
| NS5 | 2869 | 0.11 | 2 | 2 | 0 | Y | ANVTTMAMTD | 98.51 | SYVTTMPMTD | 1.49 | | |
| NS5 | 2870 | 0.11 | 2 | 2 | 0 | Y | NVTTMAMTDT | 98.51 | YVTTMPMTDT | 1.49 | | |
| NS5 | 2871 | 0.11 | 2 | 2 | 0 | Y | VTTMAMTDTT | 98.51 | VTTMPMTDTT | 1.49 | | |
| NS5 | 2872 | 0.11 | 2 | 2 | 0 | Y | TTMAMTDTTP | 98.51 | TTMPMTDTTP | 1.49 | | |
| NS5 | 2873 | 0.11 | 2 | 2 | 0 | Y | TMAMTDTTPF | 98.51 | TMPMTDTTPF | 1.49 | | |
| NS5 | 2874 | 0.11 | 2 | 2 | 0 | Y | MAMTDTTPFG | 98.51 | MPMTDTTPFG | 1.49 | | |
| NS5 | 2875 | 0.11 | 2 | 2 | 0 | Y | AMTDTTPFGQ | 98.51 | PMTDTTPFGQ | 1.49 | | |
| NS5 | 2876 | 0 | 1 | 1 | 0 | Y | MTDTTPFGQQ | 100 | | | | |
| NS5 | 2877 | 0 | 1 | 1 | 0 | Y | TDTTPFGQQR | 100 | | | | |
| NS5 | 2878 | 0 | 1 | 1 | 0 | Y | DTTPFGQQRV | 100 | | | | |
| NS5 | 2879 | 0 | 1 | 1 | 0 | Y | TTPFGQQRVF | 100 | | | | |
| NS5 | 2880 | 0 | 1 | 1 | 0 | Y | TPFGQQRVFK | 100 | | | | |
| NS5 | 2881 | 0 | 1 | 1 | 0 | Y | PFGQQRVFKE | 100 | | | | |
| NS5 | 2882 | 0 | 1 | 1 | 0 | Y | FGQQRVFKEK | 100 | | | | |
| NS5 | 2883 | 0 | 1 | 1 | 0 | Y | GQQRVFKEKV | 100 | | | | |
| NS5 | 2884 | 0.19 | 2 | 2 | 0 | Y | QQRVFKEKVD | 97.01 | QQRVFKEKVG | 2.99 | | |
| NS5 | 2885 | 0.19 | 2 | 2 | 0 | Y | QRVFKEKVDT | 97.01 | QRVFKEKVGT | 2.99 | | |
| NS5 | 2886 | 0.22 | 3 | 3 | 0 | Y | RVFKEKVDTK | 97.01 | RVFKEKVGTK | 1.49 | RVFKEKVGTM | 1.49 |
| NS5 | 2887 | 0.22 | 3 | 3 | 0 | Y | VFKEKVDTKA | 97.01 | VFKEKVGTKA | 1.49 | VFKEKVGTMA | 1.49 |
| NS5 | 2888 | 0.22 | 3 | 3 | 0 | Y | FKEKVDTKAP | 97.01 | FKEKVGTKAP | 1.49 | FKEKVGTMAP | 1.49 |
| NS5 | 2889 | 0.22 | 3 | 3 | 0 | Y | KEKVDTKAPE | 97.01 | KEKVGTKAPE | 1.49 | KEKVGTMAPE | 1.49 |
| NS5 | 2890 | 0.22 | 3 | 3 | 0 | Y | EKVDTKAPEP | 97.01 | EKVGTKAPEP | 1.49 | EKVGTMAPEP | 1.49 |
| NS5 | 2891 | 0.22 | 3 | 3 | 0 | Y | KVDTKAPEPP | 97.01 | KVGTKAPEPP | 1.49 | KVGTMAPEPP | 1.49 |
| NS5 | 2902 | 0.9 | 3 | 3 | 0 | Y | GAKEVLNETT | 74.63 | GVKEVLNETT | 23.88 | GVREVLNETT | 1.49 |

FIG. 37-108

Species: JEV (10-mers)

| protein | block

FIG. 37-109

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |

FIG. 37-110

Species: JEV (10-mers)

| protein | block starting position | block entropy | total peptides in block | # peptides required to cover 99% of block | gap/X fraction | 99% of block covered w/ <= 5 peptides? | peptides required

FIG. 37-112

Species: JEV (10-mers)

| protein | block starting position | block entropy | total peptides in block | # peptides required to cover 99% of block | gap/X fraction | 99% of block covered w/ <= 5 peptides? | peptides required to cover 99% of block

FIG. 37-113

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3041 | 0.3 | 3 | 3 | 0 | Y | EGSGVQKLGY | 95.52 | EGSGVQKLGY | 2.99 | | | | |
| NS5 | 3042 | 0.3 | 3 | 3 | 0 | Y | GSGVQKLGYI | 95.52 | GSGVQKLGYI | 2.99 | | | | |
| NS5 | 3044 | 0.53 | 5 | 5 | 0 | Y | GVQKLGYILR | 92.54 | SVQKLGYILR | 2.99 | EGLGVQKLGY | 1.49 | GV

FIG. 37-114

Species: JEV (10-mers)

| protein | block starting position | block entropy | total peptides in block | # peptides required to cover 99% of block | gap/X fraction | 99% of block covered w/ <= 5 peptides? | peptides required to c

FIG. 37-115

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 37-116

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 3127 | 0.22 | 3 | 3 | 0 | Y | ISREDQRGSG | 97.01 | ISRENQRGSG | 1.49 | YSRE

FIG. 37-117

Species: JEV (10-mers)

| protein | block starting position | block entropy (10-mers) | total peptides in block | # peptides required to cover 99% of block | gap/X fraction | 99% of block covered w/ <= 5 peptides? | peptides required to cover 99% of block | frequency | peptides required to cover 99% of

FIG. 37-118

Species: JEV (10-mers)

| protein | block starting position | block entropy | total peptides in block | # peptides required to cover 99% of block | gap/X fraction | 99% of block covered w/ <= 5 peptides? | peptides required to cover 99% of block

FIG. 37-119

Species: JEV (10-mers)

| protein | block starting position | block entropy | total peptides in block | # peptides required to cover 99% of block | gap/

FIG. 37-120

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 3230 | 0.11 | 2 | 2 | 0 | Y | WKPSH

FIG. 37-121

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3255 | 0.22 | 3 | 3 | 0 | Y | KDGRSI

FIG. 37-122

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3280 | 0.42 | 4 | 4 | 0 | Y | AGWNVKDTAC | 94.03 | AGCNVKDTAC | 2.99 | AGWNVMDTAC | 1.49 | AGWNVRDTAC | 1.49 |
| NS5 | 3281 | 0.42 | 4 | 4 | 0 | Y | GWNVKDTACL | 94.03 | GCNVKDTACL | 2.99 | GWNVMDTACL | 1.49 | GWNVRDTACL | 1.49 |
| NS5 | 3282 | 0.53 | 5 | 5 | 0 | Y | WNVKDTACLA | 92.54 | CNVKDTACLA | 2.99 | WNVMDTACLA | 1.49 | WNVRDTACLA | 1.49 | WNVKDTACLP | 1.49 |
| NS5 | 3283 | 0.33 | 4 | 4 | 0 | Y | NVKDTACLAK | 95.52 | NVKDTACLPK | 1.49 | NVMDTACLAK | 1.49 | NVRDTACLAK | 1.49 |
| NS5 | 3284 | 0.33 | 4 | 4 | 0 | Y | VKDTACLAKA | 95.52 | VRDTACLAKA | 1.49 | VKDTACLPKA | 1.49 | VMDTACLAKA | 1.49 |
| NS5 | 3285 | 0.33 | 4 | 4 | 0 | Y | KDTACLAKAY | 95.52 | RDTACLAKAY | 1.49 | KDTACLPKAY | 1.49 | MDTACLAKAY | 1.49 |
| NS5 | 3286 | 0.11 | 2 | 2 | 0 | Y | DTACLAKAYA | 98.51 | DTACLPKAYA | 1.49 | | | | |
| NS5 | 3287 | 0.11 | 2 | 2 | 0 | Y | TACLAKAYAQ | 98.51 | TACLPKAYAQ | 1.49 | | | | |
| NS5 | 3288 | 0.11 | 2 | 2 | 0 | Y | ACLAKAYAQM | 98.51 | ACLPKAYAQM | 1.49 | | | | |
| NS5 | 3289 | 0.3 | 3 | 3 | 0 | Y | CLAKAYAQMW | 95.52 | CLAKAYAQMR | 2.99 | CLPKAYAQMW | 1.49 | | |
| NS5 | 3290 | 0.3 | 3 | 3 | 0 | Y | LAKAYAQMWL | 95.52 | LAKAYAQMRL | 2.99 | LPKAYAQMWV | 1.49 | | |
| NS5 | 3291 | 0.3 | 3 | 3 | 0 | Y | AKAYAQMWLL | 95.52 | AKAYAQMRLL | 2.99 | PKAYAQMWVL | 1.49 | | |
| NS5 | 3292 | 0.3 | 3 | 3 | 0 | Y | KAYAQMWLLL | 95.52 | KAYAQMRLLL | 2.99 | KAYAQMWVLL | 1.49 | | |
| NS5 | 3293 | 0.3 | 3 | 3 | 0 | Y | AYAQMWLLLY | 95.52 | AYAQMRLLLY | 2.99 | AYAQMWVLLY | 1.49 | | |
| NS5 | 3294 | 0.3 | 3 | 3 | 0 | Y | YAQMWLLLYF | 95.52 | YAQMRLLLYF | 2.99 | YAQMWVLLYF | 1.49 | | |
| NS5 | 3295 | 0.3 | 3 | 3 | 0 | Y | AQMWLLLYFH | 95.52 | AQMRLLLYFH | 2.99 | AQMWVLLYFH | 1.49 | | |
| NS5 | 3296 | 0.3 | 3 | 3 | 0 | Y | QMWLLLYFHR | 95.52 | QMRLLLYFHR | 2.99 | QMWVLLYFHR | 1.49 | | |
| NS5 | 3297 | 0.3 | 3 | 3 | 0 | Y | MWLLLYFHRR | 95.52 | MRLLLYFHRR | 2.99 | MWVLLYFHRR | 1.49 | | |
| NS5 | 3298 | 0.5 | 4 | 4 | 0 | Y | WLLLYFHRRD | 92.54 | RLLLYFHRRD | 2.99 | WLLLYFHRRY | 2.99 | WLLLYFHRRD | 1.49 |
| NS5 | 3299 | 0.42 | 4 | 4 | 0 | Y | LLLYFHRRDL | 94.03 | LLLYFHRRYL | 2.99 | LLLYFHRRDQ | 1.49 | VLLYFHRRDL | 1.49 |
| NS5 | 3300 | 0.42 | 4 | 4 | 0 | Y | LLYFHRRDLR | 94.03 | LLYFHRRYLR | 2.99 | LLYFHRRDQR | 1.49 | LLYFHRRDLC | 1.49 |
| NS5 | 3301 | 0.42 | 4 | 4 | 0 | Y | LYFHRRDLRL | 94.03 | LYFHRRYLRL | 2.99 | LYFHRRDQRL | 1.49 | LYFHRRDLCL | 1.49 |
| NS5 | 3302 | 0.42 | 4 | 4 | 0 | Y | YFHRRDLRLM | 94.03 | YFHRRYLRLM | 2.99 | YFHRRDQRLM | 1.49 | YFHRRDLCLM | 1.49 |
| NS5 | 3303 | 0.42 | 4 | 4 | 0 | Y | FHRRDLRLMA | 94.03 | FHRRYLRLMA | 2.99 | FHRRDQRLMA | 1.49 | FHRRDLCLMA | 1.49 |
| NS5 | 3304 | 0.42 | 4 | 4 | 0 | Y | HRRDLRLMAN | 94.03 | HRRYLRLMAN | 2.99 | HRRDQRLMAN | 1.49 | HRRDLCLMAN | 1.49 |

FIG. 37-123

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3305 | 0.42 | 4 | 4 | 1.49 | Y | RRDLR

FIG. 37-124

Species: JEV (10-mers)

| protein | block starting position | block entropy | total peptides in block | # peptides required to cover 99% of block | gap/X fraction | 99% of block covered w/ <=

FIG. 37-125

Species: JEV (10-mers)

| protein | block starting position | block entropy | total peptides in block | # peptides required to cover 99% of block | gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3355 | 0.53 | 5 | 5 | 0 | Y | EENEWMMDKT | 92.54 | EENEWMVDKT | 2.99 | EENEWMMDMT | 1.49 | EENEWMTDKT | 1.49 | EENEWMEDKT | 1.49 |
| NS5 | 3356 | 0.53 | 5 | 5 | 0 | Y | ENEWMMDKTP | 92.54 | ENEWMVDKTP | 2.99 | ENEWMTDKTP | 1.49 | ENEWMMDMTP | 1.49 | ENEWMEDKTP | 1.49 |
| NS5 | 3362 | 0.49 | 4 | 4 | 0 | Y | DKTPITSWTD | 92.54 | DKTPVTSWTD | 4.48 | DKTPIASWTD | 1.49 | DMTPITSWTD | 1.49 | | |
| NS5 | 3363 | 0.49 | 4 | 4 | 0 | Y | KTPITSWTDV | 92.54 | KTPVTSWTDV | 4.48 | MTPITSWTDV | 1.49 | KTPIASWTDV | 1.49 | | |
| NS5 | 3364 | 0.37 | 3 | 3 | 0 | Y | TPITSWTDVP | 94.03 | TPVTSWTDVP | 4.48 | TPIASWTDVP | 1.49 | | | | |
| NS5 | 3365 | 0.38 | 3 | 3 | 0 | Y | PITSWTDVPY | 92.54 | PVTSWTDVPY | 4.48 |

FIG. 37-126

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3385 | 1.01 | 5 | 5 | 0 | Y

FIG. 37-127

Species: JEV (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3410 | 0.33 | 4 | 4 | 0 | Y | IGKENYVDYM | 95.52 | IGKETYVDYM | 1.49 | IGKEDYVDYM | 1.49 | | |
| NS5 | 3411 | 0.45 | 5 | 5 | 0 | Y | GKENYVDYMT | 94.03 | GKEDYVDYMT | 1.49 | GKENYVDYMD | 1.49 | LGKENYVDYM | 1.49 | GKENYVDYML | 1.49 |
| NS5 | 3412 | 0.45 | 5 | 5 | 0 | Y | KENYVDYMTS | 94.03 | KENYVDYMDF | 1.49 | KENYVDYMLS | 1.49 | GKETYVDYMT | 1.49 | KETYVDYMTS | 1.49 |
| NS5 | 3413 | 0.45 | 5 | 5 | 0 | Y | ENYVDYMTSL | 94.03 | EDYVDYMTSL | 1.49 | ETYVDYMTSL | 1.49 | KEDYVDYMTS | 1.49 | ENYVDYMLSL | 1.49 |
| NS5 | 3414 | 0.45 | 5 | 5 | 0 | Y | NYVDYMTSLR | 94.03 | NYVDYMLSLR | 1.49 | DVYDYMTSLR | 1.49 | ENYVDYMDFP | 1.49 | NYVDYMDFPQ | 1.49 |
| NS5 | 3415 | 0.22 | 3 | 3 | 0 | Y | YVDYMTSLRR | 97.01 | YVDYMLSLRR | 1.49 | YVDYMDFPQR | 1.49 | TYVDYMTSLR | 1.49 | |
| NS5 | 3416 | 0.22 | 3 | 3 | 0 | Y | VDYMTSLRRY | 97.01 | VDYMDFPQRI | 1.49 | VDYMLSLRRY | 1.49 | | | |
| NS5 | 3417 | 0.22 | 3 | 3 | 0 | Y | DYMTSLRRYE | 97.01 | DYMDFPQRIE | 1.49 | DYMLSLRRYE | 1.49 | | | |
| NS5 | 3418 | 0.22 | 3 | 3 | 0 | Y | YMTSLRRYED | 97.01 | YMDFPQRIED | 1.49 | YMDFPQRIED | 1.49 | | | |
| NS5 | 3419 | 0.22 | 3 | 3 | 0 | Y | MTSLRRYEDV | 97.01 | MLSLRRYEDV | 1.49 | MDFPQRIEDV | 1.49 | | | |
| NS5 | 3420 | 0.33 | 4 | 4 | 0 | Y | TSLRRYEDVL | 95.52 | TSLRRYEDVS | 1.49 | LSLRRYEDVL | 1.49 | DFPQRIEDVL | 1.49 | SLRRYEDVLT | 1.49 |
| NS5 | 3421 | 0.53 | 5 | 5 | 0 | Y | SLRRYEDVLI | 92.54 | SLRRYEDVLV | 2.99 | FPQRIEDVLI | 1.49 | SLRRYEDVSI | 1.49 | LRRYEDVSIQ | 1.49 |
| NS5 | 3422 | 0.53 | 5 | 5 | 0 | Y | LRRYEDVLIQ | 92.54 | LRRYEDVLVQ | 2.99 | PQRIEDVLIQ | 1.49 | LRRYEDVLTQ | 1.49 | QRIEDVLIQE | 1.49 |
| NS5 | 3423 | 0.53 | 5 | 5 | 0 | Y | RRYEDVLIQE | 92.54 | RRYEDVLVQE | 2.99 | RRYEDVLIQ | 1.49 | RRYEDVLTQE | 1.49 | RIEDVLIQED | 1.49 |
| NS5 | 3424 | 0.53 | 5 | 5 | 0 | Y | RYEDVLIQED | 92.54 | RYEDVLVQED | 2.99 | RYEDVSIQE | 1.49 | RYEDVSIQED | 1.49 | IEDVLIQEDR | 1.49 |
| NS5 | 3425 | 0.53 | 5 | 5 | 0 | Y | YEDVLIQEDR | 92.54 | YEDVLVQEDR | 2.99 | YEDVSIQEDR | 1.49 | YEDVLTQEDR | 1.49 | |
| NS5 | 3426 | 0.42 | 4 | 4 | 0 | Y | EDVLIQEDRV | 94.03 | EDVLVQEDRV | 2.99 | EDVLTQEDRV | 1.49 | EDVSIQEDRV | 1.49 | |
| NS5 | 3427 | 0.42 | 4 | 4 | 0 | Y | DVLIQEDRVI | 94.03 | DVLVQEDRVI | 2.99 | DVLTQEDRVI | 1.49 | DVSIQEDRVI | 1.49 | |

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 26 | 0.33 | 4 | 4 |

FIG. 38-3

Species: JEV (11-mers)

| prot

FIG. 38-4

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 76 | 0.11 | 2 | 2 | 0 | Y | VAMKHLTSFKR | 98.51 | VAMKHLTSFKG | 1.49 | | | | |
| anC | 77 | 0.11 | 2 | 2 | 0 | Y | AMKHLTSFKRE | 98.51 | AMKHLTSFKGE | 1.49 | | | | |
| anC | 78 | 0.11 | 2 | 2 | 0 | Y | MKHLTSFKREL | 98.51 | MKHLTSFKGEL | 1.49 | | | | |
| anC | 79 | 0.11 | 2 | 2 | 0 | Y | K

FIG. 38-5

Species: JEV (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency |
|---|---|---|---|---|---|---|---|---|---|---|---|---|
| pM | 130 | 0.11 | 2 | 2 | 0 | Y | LSNFQGKLLMT | 98.51 | LSNFQGKLLMA | 1.49 | | |
| pM | 131 | 0.44 | 3 | 3 | 0 | Y | SNFQGKLLMTI | 92.54 | SNFQGKLLMTV | 5.97 | SNFQGKLLMAV | 1.49 |
| pM | 132 | 0.44 | 3 | 3 | 0 | Y | NFQGKLLMTIN | 92.54 | NFQGKLLMTVN | 5.97 | NFQGKLLMAVN | 1.49 |
| pM | 133 | 0.44 | 3 | 3 | 0 | Y | FQGKLLMTINN | 92.54 | FQGKLLMTVNN | 5.97 | FQGKLLMAVNN | 1.49 |
| pM | 134 | 0.44 | 3 | 3 | 0 | Y | QGKLLMTINNT | 92.54 | QGKLLMTVNNT | 5.97 | QGKLLMAVNNT | 1.49 |
| pM | 135 | 0.44 | 3 | 3 | 0 | Y | GKLLMTINNTD | 92.54 | GKLLMTVNNTD | 5.97 | GKLLMAVNNTD | 1.49 |
| pM | 136 | 0.44 | 3 | 3 | 0 | Y | KLLMTINNTDI | 92.54 | KLLMTVNNTDI | 5.97 | KLLMAVNNTDI | 1.49 |
| pM | 137 | 0.44 | 3 | 3 | 0 | Y | LLMTINNTDIA | 92.54 | LLMTVNNTDIA | 5.97 | LLMAVNNTDIA | 1.49 |
| pM | 138 | 0.44 | 3 | 3 | 0 | Y | LMTINNTDIAD | 92.54 | LMTVNNTDIAD | 5.97 | LMAVNNTDIAD | 1.49 |
| pM | 139 | 0.44 | 3 | 3 | 0 | Y | MTINNTDIADV | 92.54 | MTVNNTDIADV | 5.97 | MAVNNTDIADV | 1.49 |
| pM | 140 | 0.44 | 3 | 3 | 0 | Y | TINNTDIADVI | 92.54 | TVNNTDIADVI | 5.97 | AVNNTDIADVI | 1.49 |
| pM | 141 | 0.38 | 2 | 2 | 0 | Y | INNTDIADVIV | 92.54 | VNNTDIADVIV | 7.46 | | |
| pM | 142 | 0 | 1 | 1 | 0 | Y | NNTDIADVIVI | 100 | | | | |
| pM | 143 | 0 | 1 | 1 | 0 | Y | NTDIADVIVIP | 100 | | | | |
| pM | 144 | 0 | 1 | 1 | 0 | Y | TDIADVIVIPT | 100 | | | | |
| pM | 145 | 0 | 1 | 1 | 0 | Y | DIADVIVIPTS | 100 | | | | |
| pM | 146 | 0 | 1 | 1 | 0 | Y | IADVIVIPTSK | 100 | | | | |
| pM | 147 | 0 | 1 | 1 | 0 | Y | ADVIVIPTSKG | 100 | | | | |
| pM | 148 | 0 | 1 | 1 | 0 | Y | DVIVIPTSKGE | 100 | | | | |
| pM | 149 | 0 | 1 | 1 | 0 | Y | VIVIPTSKGEN | 100 | | | | |
| pM | 150 | 0 | 1 | 1 | 0 | Y | IVIPTSKGENR | 100 | | | | |
| pM | 151 | 0 | 1 | 1 | 0 | Y | VIPTSKGENRC | 100 | | | | |
| pM | 152 | 0 | 1 | 1 | 0 | Y | IPTSKGENRCW | 100 | | | | |
| pM | 153 | 0 | 1 | 1 | 0 | Y | PTSKGENRCWV | 100 | | | | |
| pM | 154 | 0 | 1 | 1 | 0 | Y | TSKGENRCWVR | 100 | | | | |

FIG. 38-6

Species: JEV (11-mers)

| protein | block starting position | block entropy | total peptides in block | # peptides required to cover 99% of block | gap/X fraction of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 155 | 0 | 1 | 1 | 0 | Y | SKGENRCWVRA | 100 | | | | | | |
| prM | 156 | 0 | 1 | 1 | 0 | Y | KGENRCWVRAI | 100 | | | | | | |
| prM | 157 | 0 | 1 | 1 | 0 | Y | GENRCWVRAID | 100 | | | | | | |
| prM | 158 | 0 | 1 | 1 | 0 | Y | ENRCWVRAIDV | 100 | | | | | | |
| prM | 159 | 0 | 1 | 1 | 0 | Y | NRCWVRAIDVG | 100 | | | | | | |
| prM | 160 | 0.11 | 2 | 2 | 0 | Y | RCWVRAIDVGY | 98.51 | RCWVRAIDVGH | 1.49 | | | | |
| prM | 161 | 0.22 | 3 | 3 | 0 | Y | CWVRAIDVGYM | 97.01 | CWVRAIDVGHM | 1.49 | CWVRAIDVGYL | 1.49 | | |
| prM | 162 | 0.22 | 3 | 3 | 0 | Y | WVRAIDVGYMC | 97.01 | WVRAIDVGHMC | 1.49 | WVRAIDVGYLC | 1.49 | | |
| prM | 163 | 0.22 | 3 | 3 | 0 | Y | VRAIDVGYMCE | 97.01 | VRAIDVGHMCE | 1.49 | VRAIDVGYLCE | 1.49 | | |
| prM | 164 | 0.22 | 3 | 3 | 0 | Y | RAIDVGYMCED | 97.01 | RAIDVGHMCED | 1.49 | RAIDVGYLCED | 1.49 | | |
| prM | 165 | 0.22 | 3 | 3 | 0 | Y | AIDVGYMCEDT | 97.01 | AIDVGHMCEDT | 1.49 | AIDVGYLCEDT | 1.49 | | |
| prM | 166 | 0.22 | 3 | 3 | 0 | Y | IDVGYMCEDTI | 97.01 | IDVGHMCEDTI | 1.49 | IDVGYLCEDTI | 1.49 | | |
| prM | 167 | 0.22 | 3 | 3 | 0 | Y | DVGYMCEDTIT | 97.01 | DVGHMCEDTIT | 1.49 | DVGYLCEDTIT | 1.49 | | |
| prM | 168 | 0.22 | 3 | 3 | 0 | Y | VGYMCEDTITY | 97.01 | VGHMCEDTITY | 1.49 | VGYLCEDTITY | 1.49 | | |
| prM | 169 | 0.22 | 3 | 3 | 0 | Y | GYMCEDTITYE | 97.01 | GYLCEDTITYE | 1.49 | GHMCEDTITYE | 1.49 | | |
| prM | 170 | 0.22 | 3 | 3 | 0 | Y | YMCEDTITYEC | 97.01 | HMCEDTITYEC | 1.49 | YLCEDTITYEC | 1.49 | | |
| prM | 171 | 0.11 | 2 | 2 | 0 | Y | MCEDTITYECP | 98.51 | LCEDTITYECP | 1.49 | | | | |
| prM | 172 | 0 | 1 | 1 | 0 | Y | CEDTITYECPK | 100 | | | | | | |
| prM | 173 | 0 | 1 | 1 | 0 | Y | EDTITYECPKL | 100 | | | | | | |
| prM | 174 | 0.77 | 5 | 2 | 0 | Y | DTITYECPKLT | 77.61 | DTITYECPKLA | 22.39 | | | | |
| prM | 185 | 1.17 | 5 | 5 | 0 | Y | MGNDPEDVDCW | 74.63 | VGNDPEDVDCW | 16.42 | AGNDPEDVDCW | 5.97 | TGNDPEDVDCW | 1.49 | PGNDPQDVDCW | 1.49 |
| prM | 186 | 0.11 | 2 | 2 | 0 | Y | GNDPEDVDCWC | 98.51 | GNDPQDVDCWC | 1.49 | | | | |
| prM | 187 | 0.11 | 2 | 2 | 0 | Y | NDPEDVDCWCD | 98.51 | NDPQDVDCWCD | 1.49 | | | | |
| prM | 188 | 0.11 | 2 | 2 | 0 | Y | DPEDVDCWCDN | 98.51 | DPQDVDCWCDH | 1.49 | | | | |
| prM | 189 | 0.11 | 2 | 2 | 0 | Y | PEDVDCWCDNQ | 98.51 | PQDVDCWCDHQ | 1.49 | | | | |

FIG. 38-7

Species: JEV (11-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 190 | 0.3 | 3 | 3 | 0 | Y | EDVDCWDNQE | 95.52 | EDVDCWDNQQ | 2.99 | QDVDCWDHQE | 1.49 | | |
| prM | 191 | 0.3 | 3 | 3 | 0 | Y | DVDCWDNQEV | 95.52 | DVDCWDNQQV | 2.99 | DVDCWDHQEV | 1.49 | | |
| prM | 192 | 0.3 | 3 | 3 | 0 | Y | VDCWDNQEVY | 95.52 | V

FIG. 38-8

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 215 | 0.53 | 5 | 5 | 0 | Y | KRSRRSVS

FIG. 38-9

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| prM | 240 | 0.57 | 4 | 4 | 0 | Y | DSTK

FIG. 38-10

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 38-11

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 38-12

Species: JEV (11-mers)

| protein | block starting position | block entropy | total peptides in block | # peptides required to cover 99% of block | gap/X fraction 99% of block | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 335 | 0.49 | 4 | 4 | 0 | Y | LDVRMINIEAS | 92.54 | LDVRMIN

FIG. 38-13

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 360 | 0.43 | 2 | 2 | 0 | Y | TDISTVARCPT | 91.04 | TDISTVARCPM | 8.96 | | | | |
| E | 361 | 0.43 | 2 | 2 | 0 | Y | DISTVARCPTT | 91.04 | DISTVARCPMT | 8.96 | | | | |
| E | 362 | 0.43 | 2 | 2 | 0 | Y | ISTVARCPTTG | 91.04 | ISTVARCPMTG | 8.96 | | | | |
| E | 363 | 0.43 | 2 | 2 | 0 | Y | STVARCPTTGE | 91.04 | STVARCPMTGE | 8.96 | | | | |
| E | 364 | 0.43 | 2 | 2 | 0 | Y | TVARCPTTGEA | 91.04 | TVARCPMTGEA | 8.96 | | | | |
| E | 365 | 0.43 | 2 | 2 | 0 | Y | VARCPTTG

FIG. 38-14

Species: JEV (11-mers)

| protein | block starting position | block entropy | total pe

FIG. 38-15

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 410 | 0.76 | 4 | 4 | 0 | Y | CAKFSCTSKAI | 86.57 | CAKFSCTRKAI | 7.46 | CAKFSCTSKAT | 2.99 | CAKFSCTNKAI | 2.99 | AKFSCT

FIG. 38-16

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 446 | 0.42 | 4 | 4 | 0 | Y | HGNYSAQVGAS | 94.03 | HGNYSAQVGTS | 2.99 | HGNYTAQIGAS | 1.49 | HGNYSAQVGVS | 1.49 | | |
| E | 447 | 0.42 | 4 | 4 | 0 | Y | GNYSAQVGASQ | 94.03 | GNYSAQVGTSQ | 2.99 | GNYTAQIGASQ | 1.49 | GNYSAQVGVSQ | 1.49 | | |
| E | 448 | 0.42 | 4 | 4 | 0 | Y | NYSAQVGASQA | 94.03 | NYSAQVGTSQA | 2.99 | NTAQIGASQA | 1.49 | NYSAQVGVSQA | 1.49 | | |
| E | 449 | 0.42 | 4 | 4 | 0 | Y | YSAQVGASQAA | 94.03 | YSAQVGTSQA | 2.99 | YSAQVGVSQAA | 1.49 | YTAQIGASQAA | 1.49 | | |
| E | 450 | 0.53 | 5 | 5 | 0 | Y | SAQVGASQAAK | 92.54 | SAQVGTSQAAK | 2.99 | SAQVGVSQAAK | 1.49 | TAQIGASQAAK | 1.49 | SAQVGASQAAR | 1.49 |
| E | 451 | 0.53 | 5 | 5 | 0 | Y | AQVGASQAAKF | 92.54 | AQVGTSQAAKF | 2.99 | AQIGASQAAKF | 1.49 | AQVGASQAAKF | 1.49 | AQVGVSQAAKF | 1.49 |
| E | 452 | 0.53 | 5 | 5 | 0 | Y | QVGASQAAKFT | 92.54 | QVGTSQAAKFT | 2.99 | QVGSQAAKFT | 2.99 | QIGASQAAKFT | 1.49 | QVGASQAARFT | 1.49 |
| E | 454 | 0.68 | 5 | 5 | 0 | Y | GASQAAKFTVT | 89.55 | GASQAAKFTIT | 4.48 | GTSQAAKFTVT | 2.99 | GVSQAAKFTVT | 1.49 | GASQAARFTVT | 1.49 |
| E | 455 | 0.68 | 5 | 5 | 0 | Y | ASQAAKFTVTP | 89.55 | ASQAAKFTITP | 4.48 | TSQAAKFTVTP | 2.99 | VSQAAKFTVTP | 1.49 | ASQAARFTVTP | 1.49 |
| E | 456 | 0.37 | 3 | 3 | 0 | Y | SQAAKFTVTPN | 94.03 | SQAAKFTITPN | 4.48 | SQAARFTVTPN | 1.49 | | | | |
| E | 457 | 0.37 | 3 | 3 | 0 | Y | QAAKFTVTPNA | 94.03 | QAAKFTITPNA | 4.48 | QAARFTVTPNA | 1.49 | | | | |
| E | 458 | 0.37 | 3 | 3 | 0 | Y | AAKFTVTPNAP | 94.03 | AAKFTITPNAP | 4.48 | AARFTVTPNAP | 1.49 | | | | |
| E | 459 | 0.37 | 3 | 3 | 0 | Y | AKFTVTPNAPS | 94.03 | AKFTITPNAPS | 4.48 | ARFTVTPNAPS | 1.49 | | | | |
| E | 460 | 0.95 | 5 | 5 | 0 | Y | KFTVTPNAPSI | 83.58 | KFTVTPNAPSV | 5.97 | KFTITPNAPSI | 4.48 | KFTITPNAPSI | 4.48 | RFTVTPNAPSI | 1.49 |
| E | 461 | 0.9 | 5 | 5 | 0 | Y | FTVTPNAPSIT | 85.07 | FTVTPNAPSVA | 4.48 | FTITPNAPSIT | 4.48 | FTVTPNAPSVT | 2.99 | FTVTPNAPSVT | 2.99 |
| E | 462 | 0.9 | 5 | 5 | 0 | Y | TVTPNAPSITL | 85.07 | TITPNAPSTTL | 4.48 | TVTPNAPSTTL | 4.48 | TVTPNAPSYTL | 2.99 | TVTPNAPSVAL | 1.49 |
| E | 464 | 0.68 | 5 | 5 | 0 | Y | TPNAPSITLKL | 89.55 | TPNAPSTTLKL | 4.48 | TPNAPSVALKL | 2.99 | TPNAPSYTL | 1.49 | TPNAPSYTLKL | 1.49 |
| E | 465 | 0.68 | 5 | 5 | 0 | Y | PNAPSITLKLG | 89.55 | PNAPSTTLKLG | 4.48 | PNAPSVALKLG | 2.99 | PNAPSYTLEL | 1.49 | PNAPSYTLKL | 1.49 |
| E | 466 | 0.68 | 5 | 5 | 0 | Y | NAPSITLKLGD | 89.55 | NAPSTTLKLGD | 4.48 | NAPSVALKLGD | 2.99 | NAPSYTLKLGD | 1.49 | NAPSYTLELGD | 1.49 |
| E | 471 | 0.42 | 4 | 4 | 0 | Y | TLKLGDYGEVT | 94.03 | ALKLGDYGEVT | 2.99 | TLKLGDFGEVT | 2.99 | TLELGDYGEVT | 1.49 | | |
| E | 472 | 0.22 | 3 | 3 | 0 | Y | LKLGDYGEVTL | 97.01 | LELGDYGEVTL | 1.49 | LKLGDFGEVTL | 1.49 | | | | |
| E | 473 | 0.22 | 3 | 3 | 0 | Y | KLGDYGEVTLD | 97.01 | KLGDFGEVTLD | 1.49 | ELGDYGEVTLD | 1.49 | | | | |
| E | 474 | 0.11 | 2 | 2 | 0 | Y | LGDYGEVTLDC | 98.51 | LGDFGEVTLDC | 1.49 | | | | | | |
| E | 475 | 0.11 | 2 | 2 | 0 | Y | GDYGEVTLDCE | 98.51 | GDFGEVTLDCE | 1.49 | | | | | | |
| E | 476 | 0.22 | 3 | 3 | 0 | Y | DYGEVTLDCEP | 97.01 | DYGEVTLDCEA | 1.49 | DFGEVTLDCEP | 1.49 | | | | |

FIG. 38-17

Species: JEV (11-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 477 | 0.22 | 3 | 3 | 0 | Y | YGEVTLDCEPR | 97.01 | FGEVTLDCEPK | 1.49 | YGEVTLDCEAR | 1.49 | | |
| E | 478 | 0.22 | 3 | 3 | 0 | Y | GEVTLDCEPRS | 97.01 | GEVTLDCEARS | 1.49 | GEVTLDCEPKS | 1.49 | | |
| E | 479 | 0.22 | 3 | 3 | 0 | Y | EVTLDCEPRSG | 97.01 | EVTLDCEARSG | 1.49 | EVTLDCEPKSG | 1.49 | | |
| E | 480 | 0.22 | 3 | 3 | 0 | Y | VTLDCEPRSGL | 97.01 | VTLDCEARSGL | 1.49 | VTLDCEPKSGL | 1.49 | | |
| E | 481 | 0.22 | 3 | 3 | 0 | Y | TLDCEPRSGLN | 97.01 | TLDCEARSGLN | 1.49 | TLDCEPKSGLN | 1.49 | | |
| E | 482 | 0.22 | 3 | 3 | 0 | Y | LDCEPRSGLNT | 97.01 | LDCEARSGLNT | 1.49 | LDCEPKSGLNT | 1.49 | | |
| E | 483 | 0.22 | 3 | 3 | 0 | Y | DCEPRSGLNTE | 97.01 | DCEARSGLNTE | 1.49 | DCEPKSGLNTE | 1.49 | | |
| E | 484 | 0.22 | 3 | 3 | 0 | Y | CEPRSGLNTEA | 97.01 | CEARSGLNTEA | 1.49 | CEPKSGLNTEA | 1.49 | | |
| E | 485 | 0.22 | 3 | 3 | 0 | Y | EPRSGLNTEAF | 97.01 | EARSGLNTEAF | 1.49 | | | | |
| E | 486 | 0.22 | 3 | 3 | 0 | Y | PRSGLNTEAFY | 97.01 | ARSGLNTEAFY | 1.49 | | | | |
| E | 487 | 0.11 | 2 | 2 | 0 | Y | RSGLNTEAFYV | 98.51 | | | | | | |
| E | 488 | 0 | 1 | 1 | 0 | Y | SGLNTEAFYVM | 100 | | | | | | |
| E | 489 | 0 | 1 | 1 | 0 | Y | GLNTEAFYVMT | 100 | | | | | | |
| E | 490 | 0 | 1 | 1 | 0 | Y | LNTEAFYVMTV | 100 | | | | | | |
| E | 491 | 0 | 1 | 1 | 0 | Y | NTEAFYVMTVG | 100 | | | | | | |
| E | 492 | 0.11 | 2 | 2 | 0 | Y | TEAFYVMTVGS | 98.51 | TEA

FIG. 38-18

Species: JEV (11-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 502 | 0.83 | 4 | 4 | 1.49 | Y | SKSFLVHREWF | 80.6 | SKSFLVHREWF | 14.93 | SKSLLVHREWF | 1

FIG. 38-19

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 527 | 0 | 1 | 1 | 0 | Y | WRNRELLMEFE | 100 | | | | | | |
| E | 528 | 0.54 | 3 | 3 | 0 | Y | RNRELLMEFEE | 89.55 | RNRELLMEFEG | 8.96 | RNRELLMEFEQ | 1.49 | | |
| E | 529 | 0.54 | 3 | 3 | 0 | Y | NRELLMEFEEA | 89.55 | NRELLMEFEGA | 8.96 | NRELLMEFEQA | 1.49 | | |
| E | 530 | 0.54 | 3 | 3 | 0 | Y | RELLMEFEEAH | 89.55 | RELLMEFEGAH | 8.96 | RELLMEFEQAH | 1.49 | | |
|

FIG. 38-20

Species: JEV (11-mers)

| protein | block starting position | block entropy | total peptides in block | # peptides required to cover 99% of block | gap/X f

FIG. 38-21

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 38-22

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 602 | 0.44 | 3 | 3 | 0 | Y | FSFAKNPADTG | 92.54 | FSFAKNPDTG | 5.97 | | | | |
| E | 603 | 0.44 | 3 | 3 | 0 | Y | SFAKNPADTGH | 92.54 | SFAKNPVDTGH | 5.97 | | | | |
| E | 604 | 0.44 | 3 | 3 | 0 | Y | FAKNPADTGHG | 92.54 | FAKNPVDTGHG | 5.97 | | | | |
| E | 605 | 0.44 | 3 | 2 | 0 | Y | AKNPADTGHGT | 92.54 | AKNPVDTGHGT | 5.97 | | | | |
| E | 606 | 0.33 | 2 | 2 | 0 | Y | KNPADTGHGTV | 94.03 | KNPVDTGHGTV | 5.97 | | | | |
| E | 607 | 0.33 | 2 | 2 | 0 | Y | NPADTGHGTV | 94.03 | NPVDTGHGTV | 5.97 | | | | |
| E | 608 | 0.33 | 2 | 2 | 0 | Y | PADTGHGTWI | 94.03 | PVDTGHGTWI | 5.97 | | | | |
| E | 609 | 0.33 | 2 | 2 | 0 | Y | ADTGHGTWIE | 94.03 | VDTGHGTWIE | 5.97 | | | | |
| E | 610 | 0 | 1 | 1 | 0 | Y | DTGHGTWIEL | 100 | | | | | | |
| E | 611 | 0.79 | 3 | 3 | 0 | Y | TGHGTWIELS | 80.6 | TGHGTWIELT | 17.91 | TGHGTWIELL | 1.49 | | |
| E | 612 | 0.79 | 3 | 3 | 0 | Y | GHGTWIELSY | 80.6 | GHGTWIELTY | 17.91 | GHGTWIELLY | 1.49 | | |
| E | 613 | 0.79 | 3 | 3 | 0 | Y | HGTWIELSYS | 80.6 | HGTWIELTYS | 17.91 | HGTWIELLYS | 1.49 | | |
| E | 614 | 0.79 | 3 | 3 | 0 | Y | GTWIELSYSG | 80.6 | GTWIELTYSG | 17.91 | GTWIELLYSG | 1.49 | | |
| E | 615 | 0.89 | 4 | 4 | 0 | Y | TWIELSYSGS | 79.1 | TWIELTYSGS | 17.91 | TWIELLYSGS | 1.49 | | |
| E | 616 | 0.89 | 4 | 4 | 0 | Y | WIELSYSGSD | 79.1 | WIELSYSGRD | 17.91 | WIELLYSGSD | 1.49 | | |
| E | 617 | 0.89 | 4 | 4 | 0 | Y | VIELSYSGSDG | 79.1 | VIELSYSGRDG | 17.91 | VIELLYSGSDG | 1.49 | | |
| E | 618 | 1 | 5 | 5 | 0 | Y | IELSYSGSDGP | 77.61 | IELSYSGRDGP | 17.91 | IELSYSGRDGP | 1.49 | IELLYSGSDGP | 1.49 |
| E | 619 | 1 | 5 | 5 | 0 | Y | ELSYSGSDGPC | 77.61 | ELSYSGRDGPC | 17.91 | ELSYSGRDGPC | 1.49 | ELLYSGSDGPC | 1.49 |
| E | 620 | 1 | 5 | 5 | 0 | Y | LSYSGSDGPCK | 77.61 | LTYSGSDGPCK | 17.91 | LSYSGRDGPCK | 1.49 | LLYSGSDGPCK | 1.49 |
| E | 621 | 1 | 5 | 5 | 0 | Y | SYSGSDGPCKI | 77.61 | TYSGSDGPCKI | 17.91 | SYSGRDGPCKI | 1.49 | SYSGSDGSCKI | 1.49 |
| E | 622 | 0.22 | 3 | 3 | 0 | Y | YSGSDGPCKIP | 97.01 | YSGSDGSCKIP | 1.49 | YSGDGSCKIP | 1.49 | | |
| E | 623 | 0.22 | 3 | 3 | 0 | Y | SGSDGPCKIPI | 97.01 | SGSDGSCKIPI | 1.49 | SGRDGPCKIPI | 1.49 | | |
| E | 624 | 0.22 | 3 | 3 | 0 | Y | GSDGPCKIPIV | 97.01 | GRDGPCKIPIV | 1.49 | GSDGSCKIPIV | 1.49 | | |
| E | 625 | 0.22 | 3 | 3 | 0 | Y | SDGPCKIPIVS | 97.01 | SDGSCKIPIVS | 1.49 | RDGPCKIPIVS | 1.49 | | |
| E | 626 | 0.11 | 2 | 2 | 0 | Y | DGPCKIPIVSV | 98.51 | DGSCKIPIVSV | 1.49 | | | | |

FIG. 38-23

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 38-24

Species: JEV (11-mers)

| protein | block starting position | block entropy | total

FIG. 38-25

Species: JEV (11-mers)

| protein | block starting position | block entropy | total peptides in block | # peptides required to cover 99% of block | block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| E | 694 | 0.38 | 2 | 2 | | 0 | Y | GSTLGKAFSTT | 92.54 | GSTLGKAFLTT | 7.46 | | | | |
| E | 695 | 0.38 | 2 | 2 | | 0 | Y | STLGKAFSTTL | 92.54 | STLGKAFLTTL | 7.46 | | | | |
| E | 696 | 0.38 | 2 | 2 | | 0 | Y | TLGKAFSTTLK | 92.54 | TLGKAFLTTLK | 7.46 | | | | |
| E | 697 | 0.38 | 2 | 2 | | 0 | Y | LGKAFSTTLKG | 92.54 | LGKAFLTTLKG | 7.46 | | | | |
| E | 698 | 0.38 | 2 | 2 | | 0 | Y | GKAFSTTLKGA | 92.54 | GKAFLTTLKGA | 7.46 | | | | |
| E | 699 | 0.38 | 2 | 2 | | 0 | Y | KAFSTTLKGAQ | 92.54 | KAFLTTLKGAQ | 7.46 | | | | |
| E | 700 | 0.38 | 2 | 2 | | 0 | Y | AFSTTLKGAQR | 92.54 | AFLTTLKGAQR | 7.46 | | | | |
| E | 701 | 0.38 | 2 | 2 | | 0 | Y | FSTTLKGAQRL | 92.54 | FLTTLKGAQRL | 7.46 | | | | |
| E | 702 | 0.57 | 3 | 3 | | 0 | Y | STTLKGAQRLA | 89.55 | LTTLKGAQRLA | 7.46 | STTLKGAQRLV | 2.99 | | |
| E | 703 | 0.19 | 2 | 2 | | 0 | Y | TTLKGAQRLAA | 97.01 | TTLKGAQRLVA | 2.99 | | | | |
| E | 704 | 0.19 | 2 | 2 | | 0 | Y | TLKGAQRLAAL | 97.01 | TLKGAQRLVAL | 2.99 | | | | |
| E | 705 | 0.19 | 2 | 2 | | 0 | Y | LKGAQRLAALG | 97.01 | LKGAQRLVALG | 2.99 | | | | |
| E | 706 | 0.19 | 2 | 2 | | 0 | Y | KGAQRLAALGD | 97.01 | KGAQRLVALGD | 2.99 | | | | |
| E | 707 | 0.19 | 2 | 2 | | 0 | Y | GAQRLAALGDT | 97.01 | GAQRLVALGDT | 2.99 | | | | |
| E | 708 | 0.19 | 2 | 2 | | 0 | Y | AQRLAALGDTA | 97.01 | AQRLVALGDTA | 2.99 | | | | |
| E | 709 | 0.19 | 2 | 2 | | 0 | Y | QRLAALGDTAW | 97.01 | QRLVALGDTAW | 2.99 | | | | |
| E | 710 | 0.19 | 2 | 2 | | 0 | Y | RLAALGDTAWD | 97.01 | RLVALGDTAWD | 2.99 | | | | |
| E | 711 | 0.19 | 2 | 2 | | 0 | Y | LAALGDTAWDF | 97.01 | LVALGDTAWDF | 2.99 | | | | |
| E | 712 | 0.19 | 2 | 2 | | 0 | Y | AALGDTAWDFG | 97.01 | VALGDTAWDFG | 2.99 | | | | |
| E | 713 | 0 | 1 | 1 | | 0 | Y | ALGDTAWDFGS | 100 | | | | | | |
| E | 714 | 0 | 1 | 1 | | 0 | Y | LGDTAWDFGSI | 100 | | | | | | |
| E | 715 | 0 | 1 | 1 | | 0 | Y | GDTAWDFGSIG | 100 | | | | | | |
| E | 716 | 0.11 | 2 | 2 | | 0 | Y | DTAWDFGSIGG | 98.51 | DTAWDFGSIGR | 1.49 | | | | |
| E | 717 | 0.33 | 4 | 4 | | 0 | Y | TAWDFGSIGGV | 95.52 | TAWDFGSIGGA | 1.49 | TAWDFGSIGGI | 1.49 | TAWDFGSIGRV | 1.49 |
| E | 718 | 0.33 | 4 | 4 | | 0 | Y | AWDFGSIGGVF | 95.52 | AWDFGSIGGIF | 1.49 | AWDFGSIGGAF | 1.49 | AWDFGSIGRVF | 1.49 |

FIG. 38-26

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 719 | 0.33 | 4 | 4 | 0 | Y | WDFGSIGGVFN | 95.52 | WDFGSIGGIFN | 1.49 | WDFGSIGGIFN | 1.49 | WDFGSIGRVFN | 1.49 | | |
| E | 720 | 0.33 | 4 | 4 | 0 | Y | DFGSIGGVFNS | 95.52 | DFGSIGGAFNS | 1.49 | DFGSIGGRVFNS | 1.49 | DFGSIGGIFNS | 1.49 | | |
| E | 721 | 0.33 | 4 | 4 | 0 | Y | FGSIGGVFNSI | 95.52 | FGSIGGAFNSI | 1.49 | FGSIGRVFNSI | 1.49 | FGSIGGIFNSI | 1.49 | | |
| E | 722 | 0.33 | 4 | 4 | 0 | Y | GSIGGVFNSIG | 95.52 | GSIGGAFNSIG | 1.49 | GSIGGIFNSIG | 1.49 | GSIGRVFNSIG | 1.49 | | |
| E | 723 | 0.71 | 5 | 5 | 0 | Y | SIGGVFNSIGK | 88.06 | SIGGIFNSIGK | 1.49 | SIGGIFNSIGK | 1.49 | SIGGAFNSIGK | 1.49 | SIGRVFNSIGK | 1.49 |
| E | 724 | 0.71 | 5 | 5 | 0 | Y | IGGVFNSIGKA | 88.06 | IGGAFNSIGRA | 1.49 | IGGAFNSIGKA | 1.49 | IGGIFNSIGKA | 1.49 | IGRVFNSIGKA | 1.49 |
| E | 725 | 0.71 | 5 | 5 | 0 | Y | GGVFNSIGKAV | 88.06 | GGVFNSIGRAV | 1.49 | GRVFNSIGKAV | 1.49 | GGIFNSIGKAV | 1.49 | GGAFNSIGKAV | 1.49 |
| E | 726 | 0.71 | 5 | 5 | 0 | Y | GVFNSIGKAVH | 88.06 | GVFNSIGRAVH | 1.49 | GIFNSIGKAVH | 1.49 | GAFNSIGKAVH | 1.49 | RVFNSIGKAVH | 1.49 |
| E | 727 | 0.6 | 4 | 4 | 0 | Y | VFNSIGKAVHQ | 89.55 | VFNSIGRAVHQ | 7.46 | IFNSIGKAVHQ | 1.49 | AFNSIGKAVHQ | 1.49 | | |
| E | 728 | 0.38 | 2 | 2 | 0 | Y | FNSIGKAVHQY | 92.54 | FNSIGRAVHQY | 7.46 | | | | | | |
| E | 729 | 0.38 | 2 | 2 | 0 | Y | NSIGKAVHQYF | 92.54 | NSIGRAVHQYF | 7.46 | | | | | | |
| E | 730 | 0.38 | 2 | 2 | 0 | Y | SIGKAVHQYFG | 92.54 | SIGRAVHQYFG | 7.46 | | | | | | |
| E | 731 | 0.44 | 3 | 3 | 0 | Y | IGKAVHQYFGG | 92.54 | IGRAVHQYFGG | 5.97 | IGRAVHQYFGD | 1.49 | | | | |
| E | 732 | 0.44 | 3 | 3 | 0 | Y | GKAVHQYFGGA | 92.54 | GRAVHQYFGGA | 5.97 | GRAVHQYFGDA | 1.49 | | | | |
| E | 733 | 0.44 | 3 | 3 | 0 | Y | KAVHQYFGGAF | 92.54 | RAVHQYFGGAF | 5.97 | RAVHQYFGDAF | 1.49 | | | | |
| E | 734 | 0.11 | 2 | 2 | 0 | Y | AVHQYFGGAFR | 98.51 | AVHQYFGDAFR | 1.49 | | | | | | |
| E | 735 | 0.11 | 2 | 2 | 0 | Y | VHQYFGGAFRT | 98.51 | VHQYFGDAFRT | 1.49 | | | | | | |
| E | 736 | 0.11 | 2 | 2 | 0 | Y | HQYFGGAFRTL | 98.51 | HQYFGDAFRTL | 1.49 | | | | | | |
| E | 737 | 0.11 | 2 | 2 | 0 | Y | QYFGGAFRTLF | 98.51 | QYFGDAFRTLF | 1.49 | | | | | | |
| E | 738 | 0.11 | 2 | 2 | 0 | Y | VFGGAFRTLFG | 98.51 | VFGDAFRTLFG | 1.49 | | | | | | |
| E | 739 | 0.11 | 2 | 2 | 0 | Y | FGGAFRTLFG | 98.51 | FGDAFRTLFGG | 1.49 | | | | | | |
| E | 740 | 0.11 | 2 | 2 | 0 | Y | GGAFRTLFGGM | 98.51 | GDAFRTLFGGM | 1.49 | | | | | | |
| E | 741 | 0.11 | 2 | 2 | 0 | Y | GAFRTLFGGMS | 98.51 | DAFRTLFGGMS | 1.49 | | | | | | |
| E | 742 | 0 | 1 | 1 | 0 | Y | AFRTLFGGMSW | 100 | | | | | | | | |
| E | 743 | 0 | 1 | 1 | 0 | Y | FRTLFGGMSWI | 100 | | | | | | | | |

FIG. 38-27

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 38-28

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 769 | 0.22 | 3 | 3 | 0 | Y | ARDRSIALAFL | 97.01 | ARDRSIAMAFL | 1.49 | ARNRSIAL Species: JEV (11-mers)

FIG. 38-29

| protein | block starting position | block entropy | total peptides in block | # peptides required to cover 99% of block | gap/X fraction

FIG. 38-30

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

FIG. 38-31

Species: JEV (11-mers)

| protein | block starting position | block entropy | total peptides in block | # peptides required to cover 99% of block | block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS1 |

FIG. 38-32

Species: JEV (11-mers)

| protein | block star

FIG. 38-33

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 902 | 0.22 | 3 | 3 | 0 | Y | QEKFEMG

FIG. 38-34

Species: JEV (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 927 | 0 | 1 | 1 | 0 | Y | FWDGPETKEC | 100 | | | | | | |
| NS1 | 928 | 0 | 1 | 1 | 0 | Y | WDGPETKECP | 100 | | | | | | |
| NS1 | 929 | 0.11 | 2 | 2 | 0 | Y | VDGPETKECPD | 98.51 | VDGPETKECPV | 1.49 | | | | |
| NS1 | 930 | 0.11 | 2 | 2 | 0 | Y | DGPETKECPDE | 98.51 | DGPETKECPVV | 1.49 | | | | |
| NS1 | 931 | 0.86 | 4 | 4 | 0 | Y | GPETKECPDEH | 80.6 | GPETKECPDER | 16.42 | GPETKECPVVH | 1.49 | | |
| NS1 | 932 | 0.86 | 4 | 4 | 0 | Y | PETKECPDEHR | 80.6 | PETKECPDERR | 16.42 | PETKECPVVHR | 1.49 | PETKECPDEQ | 1.49 |
| NS1 | 933 | 0.86 | 4 | 4 | 0 | Y | ETKECPDEHRA | 80.6 | ETKECPDERRA | 16.42 | ETKECPVVHRA | 1.49 | ETKECPDEQR | 1.49 |
| NS1 | 934 | 0.86 | 4 | 4 | 0 | Y | TKECPDEHRAW | 80.6 | TKECPDERRAW | 16.42 | TKECPDEQRAW | 1.49 | TKECPVVHRA | 1.49 |
| NS1 | 935 | 0.86 | 4 | 4 | 0 | Y | KECPDEHRAWN | 80.6 | KECPDERRAWN | 16.42 | KECPVVHRAWN | 1.49 | KECPDEQRAWN | 1.49 |
| NS1 | 936 | 0.86 | 4 | 4 | 0 | Y | ECPDEHRAWNS | 80.6 | ECPDERRAWNS | 16.42 | ECPVVHRAWNS | 1.49 | ECPDEQRAWNS | 1.49 |
| NS1 | 937 | 0.93 | 5 | 5 | 0 | Y | CPDEHRAWNSM | 80.6 | CPDERRAWNSM | 14.93 | CPDEQRAWNST | 1.49 | CPDERRAWNS | 1.49 |
| NS1 | 938 | 0.93 | 5 | 5 | 0 | Y | PDEHRAWNSMQ | 80.6 | PDERRAWNSMQ | 14.93 | PDEQRAWNSTQ | 1.49 | PVVHRAWNSMQ | 1.49 |
| NS1 | 939 | 0.93 | 5 | 5 | 0 | Y | DEHRAWNSMQI | 80.6 | DERRAWNSMQI | 14.93 | DEQRAWNSMQI | 1.49 | VVHRAWNSMQI | 1.49 |
| NS1 | 940 | 0.93 | 5 | 5 | 0 | Y | EHRAWNSMQIE | 80.6 | ERRAWNSMQIE | 14.93 | VHRAWNSMQIE | 1.49 | ERRAWNSTQIE | 1.49 |
| NS1 | 941 | 0.82 | 4 | 4 | 0 | Y | HRAWNSMQIED | 82.09 | RRAWNSMQIED | 14.93 | QRAWNSMQIED | 1.49 | | |
| NS1 | 942 | 0.11 | 2 | 2 | 0 | Y | RAWNSMQIEDF | 98.51 | RAWNSTQIEDF | 1.49 | | | | |
| NS1 | 943 | 0.11 | 2 | 2 | 0 | Y | AWNSMQIEDFG | 98.51 | AWNSTQIEDFG | 1.49 | | | | |
| NS1 | 944 | 0.11 | 2 | 2 | 0 | Y | WNSMQIEDFGF | 98.51 | WNSTQIEDFGF | 1.49 | | | | |
| NS1 | 945 | 0.11 | 2 | 2 | 0 | Y | NSMQIEDFGFG | 98.51 | NSTQIEDFGFG | 1.49 | | | | |
| NS1 | 946 | 0.11 | 2 | 2 | 0 | Y | SMQIEDFGFGI | 98.51 | STQIEDFGFGI | 1.49 | | | | |
| NS1 | 947 | 0.11 | 2 | 2 | 0 | Y | MQIEDFGFGIT | 98.51 | TQIEDFGFGIT | 1.49 | | | | |
| NS1 | 948 | 0 | 1 | 1 | 0 | Y | QIEDFGFGITS | 100 | | | | | | |
| NS1 | 949 | 0 | 1 | 1 | 0 | Y | IEDFGFGITST | 100 | | | | | | |
| NS1 | 950 | 0 | 1 | 1 | 0 | Y | EDFGFGITSTR | 100 | | | | | | |
| NS1 | 951 | 0 | 1 | 1 | 0 | Y | DFGFGITSTRV | 100 | | | | | | |

FIG. 38-35

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 952 | 0 | 1 | 1 | 0 | Y | FGFGITSTRVW | 100 | | | | | | |
| NS1 | 953 | 0 | 1 | 1 | 0 | Y | GFGITSTRVWL | 100 | | | | | | |
| NS1 | 954 | 0 | 1 | 1 | 0 | Y | FGITSTRVWLK | 100 | | | | | | |
| NS1 | 955 | 0 | 1 | 1 | 0 | Y | GITSTRVWLKI | 100 | | | | | | |
| NS1 | 956 | 0 | 1 | 1 | 0 | Y | ITSTRVWLKIR | 100 | | | | | | |
| NS1 | 957 | 0 | 1 | 1 | 0 | Y | TSTRVWLKIRE | 100 | | | | | | |
| NS1 | 958 | 0 | 1 | 1 | 0 | Y | STRVWLKIREE | 100 | | | | | | |
| NS1 | 959 | 0.79 | 3 | 3 | 0 | Y | TRVWLKIREES | 80.6 | TRVWLKIREEN | 17.91 | TRVWLKIREET | 1.49 | | |
| NS1 | 960 | 0.79 | 3 | 3 | 0 | Y | RVWLKIREEST | 80.6 | RVWLKIREENT | 17.91 | RVWLKIREETT | 1.49 | | |
| NS1 | 961 | 0.79 | 3 | 3 | 0 | Y | VWLKIREESTD | 80.6 | VWLKIREENTD | 17.91 | VWLKIREETTD | 1.49 | | |
| NS1 | 962 | 0.79 | 3 | 3 | 0 | Y | WLKIREESTDE | 80.6 | WLKIREENTDE | 17.91 | WLKIREETTDE | 1.49 | | |
| NS1 | 963 | 0.79 | 3 | 3 | 0 | Y | LKIREESTDEC | 80.6 | LKIREENTDEC | 17.91 | LKIREETTDEC | 1.49 | | |
| NS1 | 964 | 0.79 | 3 | 3 | 0 | Y | KIREESTDECD | 80.6 | KIREENTDECD | 17.91 | KIREETTDECD | 1.49 | | |
| NS1 | 965 | 0.79 | 3 | 3 | 0 | Y | IREESTDECDG | 80.6 | IREENTDECDG | 17.91 | IREETTDECDG | 1.49 | | |
| NS1 | 966 | 1.04 | 5 | 5 | 0 | Y | REESTDECDGA | 77.61 | REENTDECDGA | 16.42 | REESTDECDGP | 2.99 | REENTDECDGT | 1.49 | REETTDECDGA | 1.49 |
| NS1 | 967 | 1.04 | 5 | 5 | 0 | Y | EESTDECDGAI | 77.61 | EENTDECDGAI | 16.42 | EESTDECDGPI | 2.99 | EETTDECDGAI | 1.49 | EENTDECDGTI | 1.49 |
| NS1 | 968 | 1.04 | 5 | 5 | 0 | Y | ESTDECDGAII | 77.61 | ENTDECDGAII | 16.42 | ESTDECDGPII | 2.99 | ETTDECDGAII | 1.49 | ENTDECDGTII | 1.49 |
| NS1 | 969 | 1.04 | 5 | 5 | 0 | Y | STDECDGAIIG | 77.61 | NTDECDGAIIG | 16.42 | STDECDGPIIG | 2.99 | NTDECDGTIIG | 1.49 | TTDECDGAIIG | 1.49 |
| NS1 | 970 | 0.3 | 3 | 3 | 0 | Y | TDECDGAIIGT | 95.52 | TDECDGPIIGT | 2.99 | TDECDGTIIGT | 1.49 | | |
| NS1 | 971 | 0.3 | 3 | 3 | 0 | Y | DECDGAIIGTA | 95.52 | DECDGPIIGTA | 2.99 | DECDGTIIGTA | 1.49 | | |
| NS1 | 972 | 0.3 | 3 | 3 | 0 | Y | ECDGAIIGTAV | 95.52 | ECDGPIIGTAV | 2.99 | ECDGTIIGTAI | 1.49 | | |
| NS1 | 973 | 0.3 | 3 | 3 | 0 | Y | CDGAIIGTAVK | 95.52 | CDGPIIGTAVK | 2.99 | CDGTIIGTAIK | 1.49 | | |
| NS1 | 974 | 0.3 | 3 | 3 | 0 | Y | DGAIIGTAVKG | 95.52 | DGPIIGTAVKG | 2.99 | DGTIIGTAIKG | 1.49 | | |
| NS1 | 975 | 0.5 | 4 | 4 | 0 | Y | GAIIGTAVKGH | 92.54 | GAIIGTAVKGN | 2.99 | GPIIGTAVKGH | 2.99 | GTIIGTAIKGH | 1.49 | |
| NS1 | 976 | 0.5 | 4 | 4 | 0 | Y | AIIGTAVKGHV | 92.54 | PIIGTAVKGHV | 2.99 | AIIGTAVKGNV | 2.99 | TIIGTAIKGHV | 1.49 | |

FIG. 38-36

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 977 | 0.42 | 4 | 4 | 0 | Y | IIGTAVKGHVA | 94.03 | IIGTAVKGNVA | 2.99 | IIGTAVKGHVT | 1.49 | IIGTAIKGHVA | 1.49 |
| NS1 | 978 | 0.53 | 5 | 5 | 0 | Y | IGTAVKGHVAV | 92.54 | IGTAVKGNVAV | 2.99 | IGTAVKGHVAL | 1.49 | IGTAVKGHVTV | 1.49 |
| NS1 | 979 | 0.53 | 5 | 5 | 0 | Y | GTAVKGHVAVH | 92.54 | GTAVKGNVAVH | 2.99 | GTAVKGHVALH | 1.49 | GTAVKGHVTVH | 1.49 |
| NS1 | 980 | 0.53 | 5 | 5 | 0 | Y | TAVKGHVAVHS | 92.54 | TAVKGNVAVHS | 2.99 | TAVKGHVALHS | 1.49 | TAVKGHVTVHS | 1.49 |
| NS1 | 981 | 0.53 | 5 | 5 | 0 | Y | AVKGHVAVHSD | 92.54 | AVKGNVAVHSD | 2.99 | AIKGHVAVHSD | 1.49 | AVKGHVTVHSD | 1.49 |
| NS1 | 982 | 0.53 | 5 | 5 | 0 | Y | VKGHVAVHSDL | 92.54 | VKGNVAVHSDL | 2.99 | IKGHVAVHSDL | 1.49 | VKGHVTVHSDV | 1.49 |
| NS1 | 983 | 0.42 | 4 | 4 | 0 | Y | KGHVAVHSDLS | 94.03 | KGNVAVHSDLS | 2.99 | KGHVAVHSDLS | 1.49 | KGHVTVHSDVS | 1.49 |
| NS1 | 984 | 0.42 | 4 | 4 | 0 | Y | GHVAVHSDLSY | 94.03 | GNVAVHSDLSY | 2.99 | GHVALHSDLSY | 1.49 | GHVTVHSDVSY | 1.49 |
| NS1 | 985 | 0.42 | 4 | 4 | 0 | Y | HVAVHSDLSYW | 94.03 | NVAVHSDLSYW | 2.99 | HVALHSDLSYW | 1.49 | HVTVHSDVSYW | 1.49 |
| NS1 | 986 | 0.22 | 3 | 3 | 0 | Y | VAVHSDLSYWI | 97.01 | VALHSDLSYWI | 1.49 | VTVHSDVSYWI | 1.49 | | |
| NS1 | 987 | 0.33 | 4 | 4 | 0 | Y | AVHSDLSYWIE | 95.52 | ALHSDLSYWIE | 1.49 | TVHSDVSYWIE | 1.49 | AVHSDLSYWIG | 1.49 |
| NS1 | 988 | 0.33 | 4 | 4 | 0 | Y | VHSDLSYWIES | 95.52 | VHSDLSYWIES | 1.49 | VHSDVSYWIES | 1.49 | LHSDLSYWIES | 1.49 |
| NS1 | 989 | 0.33 | 4 | 4 | 0 | Y | HSDLSYWIESR | 95.52 | HSDLSYWIESH | 1.49 | HSDVSYWIESR | 1.49 | HSDLSYWIGSR | 1.49 |
| NS1 | 1001 | 0.45 | 5 | 5 | 0 | Y | NDTWKLERAVF | 94.03 | NDTRKLERAVF | 1.49 | NDTRKLERLYF | 1.49 | NDSWKLERAVF | 1.49 | NDTWKLERLYF | 1.49 |
| NS1 | 1002 | 0.45 | 5 | 5 | 0 | Y | DTWKLERAVFG | 94.03 | DTRKLERAVFG | 1.49 | DTRKLERLYFG | 1.49 | DTWKRERAVFE | 1.49 | DSWKLERAVFG | 1.49 |
| NS1 | 1003 | 0.45 | 5 | 5 | 0 | Y | TWKLERAVFGE | 94.03 | TWKLERAVFGE | 1.49 | TRKLERLYFGE | 1.49 | TRKLERAVFGE | 1.49 | TWKRERAVFEE | 1.49 |
| NS1 | 1004 | 0.53 | 5 | 5 | 0 | Y | WKLERAVFGEV | 92.54 | WKLERAVFGEI | 2.99 | SWKLERAVFGE | 1.49 | WKLERLYFGEV | 1.49 | RKLERAVFGEV | 1.49 |
| NS1 | 1005 | 0.42 | 4 | 4 | 0 | Y | KLERAVFGEVK | 94.03 | KLERAVFGEIK | 2.99 | WKLERAVFGEV | 1.49 | KLERLYFGEVK | 1.49 | |
| NS1 | 1006 | 0.42 | 4 | 4 | 0 | Y | LERAVFGEVKS | 94.03 | LERAVFGEIKS | 2.99 | KRERAVFGEIK | 1.49 | LERLYFGEVKS | 1.49 | |
| NS1 | 1007 | 0.42 | 4 | 4 | 0 | Y | ERAVFGEVKSC | 94.03 | ERAVFGEIKSC | 2.99 | RERAVFGEIKS | 1.49 | ERAVFEEVKSC | 1.49 | |
| NS1 | 1008 | 0.42 | 4 | 4 | 0 | Y | RAVFGEVKSCT | 94.03 | RAVFGEIKSCT | 2.99 | ERLVFGEVKSC | 1.49 | RAVFEEVKSCT | 1.49 | |
| NS1 | 1009 | 0.42 | 4 | 4 | 0 | Y | AVFGEVKSCTW | 94.03 | AVFGEIKSCTW | 2.99 | RLVFGEVKSCT | 1.49 | AVFEEVKSCTW | 1.49 | |
| NS1 | 1010 | 0.3 | 3 | 3 | 0 | Y | VFGEVKSCTWP | 95.52 | VFGEIKSCTWP | 2.99 | LVFGEVKSCTW | 1.49 | | | | |
| NS1 | 1011 | 0.3 | 3 | 3 | 0 | Y | FGEVKSCTWPE | 95.52 | FGEIKSCTWPE | 2.99 | VFEEVKSCTWP | 1.49 | | | | |
| NS1 | 1012 | 0.3 | 3 | 3 | 0 | Y | GEVKSCTWPET | 95.52 | GEIKSCTWPET | 2.99 | EEVKSCTWPET | 1.49 | | | | |

FIG. 38-37

Species: JEV (11-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1013 | 0.19 | 2 | 2 | 0 | Y | EVKSCTWPETH | 97.01 | EIKSCTWPETH | 2.99 | | | | |
| NS1 | 1014 | 0.39 | 3 | 3 | 0 | Y | VKSCTWPETHT | 94.03 | VKSCTWPETHS | 2.99 | IKSCTWPETHT | 2.99 | | |
| NS1 | 1015 | 0.19 | 2 | 2 | 0 | Y | KSCTWPETHTL | 97.01 | KSCTWPETHSL | 2.99 | | | | |
| NS1 | 1016 | 0.19 | 2 | 2 | 0 | Y | SCTWPETHTLW | 97.01 | SCTWPETHSLW | 2.99 | | | | |
| NS1 | 1017 | 0.19 | 2 | 2 | 0 | Y | CTWPETHTLWG | 97.01 | CTWPETHSLWG | 2.99 | | | | |
| NS1 | 1018 | 0.19 | 2 | 2 | 0 | Y | TWPETHTLWGD | 97.01 | TWPETHSLWGD | 2.99 | | | | |
| NS1 | 1019 | 0.72 | 3 | 3 | 0 | Y | WPETHTLWGDG | 85.07 | WPETHTLWGDD | 11.94 | WPETHSLWGDG | 2.99 | | |
| NS1 | 1020 | 0.78 | 4 | 4 | 0 | Y | PETHTLWGDGV | 85.07 | PETHTLWGDDV | 10.45 | PETHSLWGDGV | 2.99 | PETHTLWGDDA | 1.49 | |
| NS1 | 1021 | 0.78 | 4 | 4 | 0 | Y | ETHTLWGDGVE | 85.07 | ETHTLWGDDVE | 10.45 | ETHSLWGDGVE | 2.99 | ETHTLWGDDAE | 1.49 | |
| NS1 | 1022 | 0.78 | 4 | 4 | 0 | Y | THTLWGDGVEE | 85.07 | THTLWGDDVEE | 10.45 | THSLWGDGVEE | 2.99 | THTLWGDDAEE | 1.49 | |
| NS1 | 1023 | 0.78 | 4 | 4 | 0 | Y | HTLWGDGVEES | 85.07 | HTLWGDDVEES | 10.45 | HSLWGDGVEES | 2.99 | HTLWGDDAEES | 1.49 | |
| NS1 | 1024 | 0.89 | 5 | 5 | 0 | Y | TLWGDGVEESE | 83.58 | TLWGDDVEESE | 10.45 | SLWGDGVEESE | 2.99 | TLWGDGVEESD | 1.49 | TLWGDDAEESE | 1.49 |
| NS1 | 1025 | 0.7 | 4 | 4 | 0 | Y | LWGDGVEESEL | 86.57 | LWGDDVEESEL | 10.45 | LWGDGVEESDL | 1.49 | LWGDAEESEL | 1.49 | |
| NS1 | 1026 | 0.7 | 4 | 4 | 0 | Y | WGDGVEESELI | 86.57 | WGDDVEESELI | 10.45 | WGDGVEESDLV | 1.49 | WGDAEESELI | 1.49 | |
| NS1 | 1027 | 0.7 | 4 | 4 | 0 | Y | GDGVEESELII | 86.57 | GDDVEESELII | 10.45 | GDVEESELII | 1.49 | GDVEESDLVI | 1.49 | |
| NS1 | 1028 | 0.81 | 5 | 5 | 0 | Y | DGVEESELIIP | 86.57 | DDVEESELIIP | 10.45 | DAEESELIIP | 1.49 | DGVEESDLVIP | 1.49 | GVEESDLVIPH | 1.49 |
| NS1 | 1029 | 0.33 | 2 | 2 | 0 | Y | GVEESELIIPH | 85.07 | DVEESELIIPD | 10.45 | DAEESELIIPH | 1.49 | | |
| NS1 | 1030 | 0.49 | 4 | 4 | 0 | Y | VEESELIIPHT | 95.52 | AEESELIIPHT | 1.49 | VEESELIIPDT | 1.49 | | |
| NS1 | 1031 | 0.49 | 4 | 4 | 0 | Y | EESELIIPHTI | 92.54 | EESELIIPHTL | 4.48 | EESDLIIPHTI | 1.49 | | |
| NS1 | 1032 | 0.49 | 4 | 4 | 0 | Y | ESELIIPHTIA | 92.54 | ESELIIPHTLA | 4.48 | ESDLIIPHTIA | 1.49 | | |
| NS1 | 1033 | 0.49 | 4 | 4 | 0 | Y | SELIIPHTIAG | 92.54 | SELIIPHTLAG | 4.48 | SELIIPDTIAG | 1.49 | | |
| NS1 | 1034 | 0.49 | 4 | 4 | 0 | Y | ELIIPHTIAGP | 92.54 | ELIIPHTLAGP | 4.48 | DLVIPHTIAGP | 1.49 | | |
| NS1 | 1035 | 1.11 | 5 | 5 | 0 | Y | LIIPHTIAGPK | 76.12 | LIIPHTLAGPK | 16.42 | LIIPHTIAGPR | 4.48 | LVIPHTIAGPR | 1.49 | LIIPDTIAGPK | 1.49 |
| NS1 | 1036 | 1.11 | 5 | 5 | 0 | Y | IIPHTIAGPKS | 76.12 | IIPHTLAGPKS | 16.42 | IIPHTIAGPRS | 4.48 | IPDTIAGPKS | 1.49 | VIPHTIAGPRS | 1.49 |
| NS1 | 1037 | 1.04 | 4 | 4 | 0 | Y | IPHTIAGPKSK | 76.12 | IPHTLAGPKSK | 17.91 | IPHTIAGPRSK | 4.48 | IPDTIAGPKSK | 1.49 | |

FIG. 38-38

Species: JEV (11-mers)

| protein | block starting position | block

FIG. 38-39

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to

FIG. 38-40

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1089 | 0.86 | 4 | 4 | 0 | Y | GPSVRTTTDSG | 80.6 | GPSIRTTTDSG | 16.42 | GPSLRTTTDSG | 1.49 | APWVRTTTDIG | 1.49 |
| NS1 | 1090 | 0.86 | 4 | 4 | 0 | Y | PSVRTTTDSGK | 80.6 | PSIRTTTDSGK | 16.42 | PSLRTTTDSGK | 1.49 | PWVRTTTDIGK | 1.49 |
| NS1 | 1091 | 0.86 | 4 | 4 | 0 | Y | SVRTTTDSGKL | 80.6 | SIRTTTDSGKL | 16.42 | SLRTTTDSGKL | 1.49 | WVRTTTDIGKL | 1.49 |
| NS1 | 1092 | 0.86 | 4 | 4 | 0 | Y | VRTTTDSGKLI | 80.6 | IRTTTDSGKLI | 16.42 | VRTTTDIGKLI | 1.49 | LRTTTDSGKLI | 1.49 |
| NS1 | 1093 | 0.11 | 2 | 2 | 0 | Y | RTTTDSGKLIT | 98.51 | RTTTDIGKLIT | 1.49 | | | | |
| NS1 | 1094 | 0.11 | 2 | 2 | 0 | Y | TTTDSGKLITD | 98.51 | TTTDIGKLITD | 1.49 | | | | |
| NS1 | 1095 | 0.11 | 2 | 2 | 0 | Y | TTDSGKLITDW | 98.51 | TTDIGKLITDW | 1.49 | | | | |
| NS

FIG. 38-41

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS1 | 1114 | 0.49 | 4 | 4 | 0 | Y | PLRFRTENGCW | 92.54 | PLGFRTENGCW | 4.48 | PLRFRTDNGCW | 1.49 | PLRFRTGSGCW | 1.49 |
| NS1 | 1115 | 0.49 | 4 | 4 | 0 | Y | LRFRTENGCWY | 92.54 | LGRTENGCWY | 4.48 | LRFRTDNGCWY | 1.49 | LRFRTGSGCWY | 1.49 |
| NS1 | 1116 | 0.49 | 4 | 4 | 0 | Y | RFRTENGCWYG | 92.54 | GFRTENGCWYG | 4.48 | RFRTDNGCWYG | 1.49 | RFRTGSGCWYG | 1.49 |
| NS1 | 1117 | 0.22 | 3 | 3 | 0 | Y | FRTENGCWYGM | 97.01 | FRTGSGCWYGM | 1.49 | FRTDNGCWYGM | 1.49 | | |
| NS1 | 1118 | 0.22 | 3 | 3 | 0 | Y | RTENGCWYGME | 97.01 | RTGSGCWYGME | 1.49 | RTDNGCWYGME | 1.49 | | |
| NS1 | 1119 | 0.22 | 3 | 3 | 0 | Y | TENGCWYGMEI | 97.01 | TDNGCWYGMEI | 1.49 | TGSGCWYGMEV | 1.49 | | |
| NS1 | 1120 | 0.22 | 3 | 3 | 0 | Y | ENGCWYGMEIR | 97.01 | GSGCWYGMEVR | 1.49 | DNGCWYGMEIR | 1.49 | | |
| NS1 | 1121 | 0.11 | 2 | 2 | 0 | Y | NGCWYGMEIRP | 98.51 | SGCWYGMEVRP | 1.49 | | | | |
| NS1 | 1122 | 0.55 | 4 | 4 | 0 | Y | GCWYGMEIRPV | 91.04 | GCWYGMEIRPL | 5.97 | GCWYGMEIRPA | 1.49 | GCWYGMEVRPV | 1.49 |
| NS1 | 1134 | 0.85 | 5 | 5 | 0 | Y | HDETTLVRSQV | 83.58 | HDEATLVRSQV | 11.94 | HDEATLVRSQA | 1.49 | HDETTLVRWQV | 1.49 | HDETTLVRSRV |
| NS1 | 1149 | 0.89 | 4 | 4 | 0 | Y | GEMVDPFQLGL | 79.1 | GEMIDPFQLGL | 17.91 | GGMVDPFQLGL | 1.49 | GEMVDPFQMGL | 1.49 |
| NS1 | 1150 | 0.89 | 4 | 4 | 0 | Y | EMVDPFQLGLL | 79.1 | EMIDPFQLGLL | 17.91 | GMVDPFQLGLL | 1.49 | EMVDPFQMGLL | 1.49 |
| NS1 | 1151 | 0.79 | 3 | 3 | 0 | Y | MVDPFQLGLLV | 80.6 | MIDPFQLGLLV | 17.91 | MVDPFQMGLLV | 1.49 | | |
| NS1 | 1152 | 0.97 | 4 | 4 | 0 | Y | VDPFQLGLLVM | 77.61 | IDPFQLGLLVM | 17.91 | VDPFQLGLLIV | 2.99 | VDPFQMGLLVM | 1.49 |
| NS2A | 1153 | 0.3 | 3 | 3 | 0 | Y | DPFQLGLLVMF | 95.52 | DPFQLGLLVF | 2.99 | DPFQMGLLVMF | 1.49 | | |
| NS2A | 1154 | 0.3 | 3 | 3 | 0 | Y | PFQLGLLVMFL | 95.52 | PFQLGLLVFL | 2.99 | PFQMGLLVMFL | 1.49 | | |
| NS2A | 1155 | 0.3 | 3 | 3 | 0 | Y | FQLGLLVMFLA | 95.52 | FQLGLLVFLA | 2.99 | FQMGLLVMFLA | 1.49 | | |
| NS2A | 1156 | 0.3 | 3 | 3 | 0 | Y | QLGLLVMFLAT | 95.52 | QLGLLVFLAT | 2.99 | QMGLLVMFLAT | 1.49 | | |
| NS2A | 1157 | 0.3 | 3 | 3 | 0 | Y | LGLLVMFLATQ | 95.52 | LGLLVFLATQ | 2.99 | MGLLVMFLATQ | 1.49 | | |
| NS2A | 1158 | 0.19 | 2 | 2 | 0 | Y | GLLVMFLATQE | 97.01 | GLLVFLATQE | 2.99 | | | | |
| NS2A | 1159 | 0.19 | 2 | 2 | 0 | Y | LLVMFLATQEV | 97.01 | LLVFLATQEV | 2.99 | | | | |
| NS2A | 1160 | 0.3 | 3 | 3 | 0 | Y | LVMFLATQEVL | 95.52 | LVFLATQEVL | 2.99 | LVMFLATQEVF | 1.49 | LVMFLATQEVF | 1.49 |
| NS2A | 1161 | 0.42 | 4 | 4 | 0 | Y | VMFLATQEVLR | 94.03 | VVFLATQEVLR | 2.99 | VMFLATQEVLG | 1.49 | VMFLATQEVFR | 1.49 |
| NS2A | 1162 | 0.42 | 4 | 4 | 0 | Y | MFLATQEVLRK | 94.03 | VFLATQEVLRK | 2.99 | MFLATQEVLGK | 1.49 | MFLATQEVFRK | 1.49 |
| NS2A | 1163 | 0.22 | 3 | 3 | 0 | Y | FLATQEVLRKR | 97.01 | FLATQEVLRK | 1.49 | FLATQEVLGKR | 1.49 | | |

FIG. 38-42

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

FIG. 38-43

Species: JEV (11-mers)

| protein | block starting position | block entropy | total peptides in block | # peptides required to cover 99% of block | gap/X fraction | 99% of block covered w/ <= 5 peptides? | peptides required to cover 99% of block

FIG. 38-44

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1214 | 0.53 | 2 | 2 | 0 | Y | ANSGGDVL

FIG. 38-45

Species: JEV (11-mers)

| protein | block starting

FIG. 38-46

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of

FIG. 38-47

| Species: JEV (11-mers) | protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| | NS2A | 1303 | 0.45 | 5 | 5 | 0 | Y | LLTPGMRALYL | 94.03 | LLAPGMRALYL | 1.49 | LLTPGMRALCL | 1.49 | LLTPGMKALYL | 1.49

FIG. 38-48

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1336 | 0.33 | 2 | 2 | 0 | Y | MAKKKGAVLLG | 94.03 | MAKKKGAVLMG | 5.97 | | | | |
| NS2A | 1337 | 0.33 | 2 | 2 | 0 | Y | AKKKGAVLLGL | 94.03 | AKKKGAVLMGL | 5.97 | | | | |
| NS2A | 1338 | 0.33 | 2 | 2 | 0 | Y | KKKGAVLLGLA | 94.03 | KKKGAVLMGLA | 5.97 | | | | |
| NS2A | 1339 | 0.33 | 2 | 2 | 0 | Y | KKGAVLLGLAL | 94.03 | KKGAVLMGLAL | 5.97 | | | | |
| NS2A | 1340 | 0.33 | 2 | 2 | 0 | Y | KGAVLLGLALT | 94.03 | KGAVLMGLALT | 5.97 | | | | |
| NS2A | 1341 | 0.33 | 2 | 2 | 0 | Y | GAVLLGLALTS | 94.03 | GAVLMGLALTS | 5.97 | | | | |
| NS2A | 1342 | 0.33 | 2 | 2 | 0 | Y | AVLLGLALTST | 94.03 | AVLMGLALTST | 5.97 | | | | |
| NS2A | 1343 | 0.33 | 2 | 2 | 0 | Y | VLLGLALTSTG | 94.03 | VLMGLALTSTG | 5.97 | | | | |
| NS2A | 1344 | 0.33 | 2 | 2 | 0 | Y | LLGLALTSTGW | 94.03 | LMGLALTSTGW | 5.97 | | | | |
| NS2A | 1345 | 0.33 | 2 | 2 | 0 | Y | LGLALTSTGWF | 94.03 | MGLALTSTGWF | 5.97 | | | | |
| NS2A | 1346 | 0 | 1 | 1 | 0 | Y | GLALTSTGWFS | 100 | | | | | | |
| NS2A | 1347 | 0 | 1 | 1 | 0 | Y | LALTSTGWFSP | 100 | | | | | | |
| NS2A | 1348 | 0 | 1 | 1 | 0 | Y | ALTSTGWFSPT | 100 | | | | | | |
| NS2A | 1349 | 0 | 1 | 1 | 0 | Y | LTSTGWFSPTT | 100 | | | | | | |
| NS2A | 1350 | 0 | 1 | 1 | 0 | Y | TSTGWFSPTTI | 100 | | | | | | |
| NS2A | 1351 | 0.11 | 2 | 2 | 0 | Y | STGWFSPTTIA | 98.51 | STGWFSPTTIT | 1.49 | | | | |
| NS2A | 1352 | 0.11 | 2 | 2 | 0 | Y | TGWFSPTTIAA | 98.51 | TGWFSPTTITA | 1.49 | | | | |
| NS2A | 1353 | 0.11 | 2 | 2 | 0 | Y | GWFSPTTIAAG | 98.51 | GWFSPTTITAG | 1.49 | | | | |
| NS2A | 1354 | 0.11 | 2 | 2 | 0 | Y | WFSPTTIAAGL | 98.51 | WFSPTTITAGL | 1.49 | | | | |
| NS2A | 1355 | 0.11 | 2 | 2 | 0 | Y | FSPTTIAAGLM | 98.51 | FSPTTITAGLM | 1.49 | | | | |
| NS2A | 1356 | 0.22 | 3 | 3 | 0 | Y | SPTTIAAGLMV | 97.01 | SPTTITAGLMV | 1.49 | SPTTIAAGLMA | 1.49 | | |
| NS2A | 1357 | 0.22 | 3 | 3 | 0 | Y | PTTIAAGLMVC | 97.01 | PTTITAGLMVC | 1.49 | PTTIAAGLMAC | 1.49 | | |
| NS2A | 1358 | 0.22 | 3 | 3 | 0 | Y | TTIAAGLMVCN | 97.01 | TTITAGLMVCN | 1.49 | TTIAGLMVCN | 1.49 | | |
| NS2A | 1359 | 0.22 | 3 | 3 | 0 | Y | TIAAGLMVCNP | 97.01 | TIAAGLMACNP | 1.49 | TITAGLMVCNP | 1.49 | | |
| NS2A | 1360 | 0.22 | 3 | 3 | 0 | Y | IAAGLMVCNPN | 97.01 | IAAGLMACNPN | 1.49 | ITAGLMVCNPN | 1.49 | | |

FIG. 38-49

Species: JEV (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2A | 1361 | 0.22 | 3 | 3 | 0 | Y | AAGLMVCNPNK | 97.01 | AAGLMACNPNK | 1.49 | TAGLMVCNPNK | 1.49 | | |
| NS2A | 1362 | 0.11 | 2 | 2 | 0 | Y | AGLMVCNPNKK | 98.51 | AGLMACNPNKK | 1.49 | | | | |
| NS2A | 1363 | 0.11 | 2 | 2 | 0 | Y | GLMVCNPNKKR | 98.51 | GLMACNPNKKR | 1.49 | | | | |
| NS2A | 1364 | 0.11 | 2 | 2 | 0 | Y | LMVCNPNKKRG | 98.51 | LMACNPNKKRG | 1.49 | | | | |
| NS2A | 1365 | 0.11 | 2 | 2 | 0 | Y | MVCNPNKKRGW | 98.51 | MACNPNKKRGW | 1.49 | | | | |
| NS2A | 1366 | 0.11 | 2 | 2 | 0 | Y | VCNPNKKRGWP | 98.51 | ACNPNKKRGWP | 1.49 | | | | |
| NS2A | 1367 | 0 | 1 | 1 | 0 | Y | CNPNKKRGWPA | 100 | | | | | | |
| NS2A | 1368 | 0 | 1 | 1 | 0 | Y | NPNKKRGWPAT | 100 | | | | | | |
| NS2A | 1369 | 0 | 1 | 1 | 0 | Y | PNKKRGWPATE | 100 | | | | | | |
| NS2A | 1370 | 0.11 | 2 | 2 | 0 | Y | NKKRGWPATEF | 98.51 | NKKRGWPATEV | 1.49 | | | | |
| NS2A | 1371 | 0.11 | 2 | 2 | 0 | Y | KKRGWPATEFL | 98.51 | KKRGWPATEVL | 1.49 | | | | |
| NS2A | 1372 | 0.11 | 2 | 2 | 0 | Y | KRGWPATEFLS | 98.51 | KRGWPATEVLS | 1.49 | | | | |
| NS2A | 1373 | 0.11 | 2 | 2 | 0 | Y | RGWPATEFLSA | 98.51 | RGWPATEVLSA | 1.49 | | | | |
| NS2B | 1374 | 0.44 | 3 | 3 | 0 | Y | GWPATEFLSAV | 92.54 | GWPATEFLSAI | 5.97 | GWPATEVLSAV | 1.49 | | |
| NS2B | 1375 | 0.44 | 3 | 3 | 0 | Y | WPATEFLSAVG | 92.54 | WPATEFLSAIG | 5.97 | WPATEVLSAVG | 1.49 | | |
| NS2B | 1376 | 0.44 | 3 | 3 | 0 | Y | PATEFLSAVGL | 92.54 | PATEFLSAIGL | 5.97 | PATEVLSAVGL | 1.49 | | |
| NS2B | 1377 | 0.44 | 3 | 3 | 0 | Y | ATEFLSAVGLM | 92.54 | ATEFLSAIGLM | 5.97 | ATEVLSAVGLM | 1.49 | | |
| NS2B | 1378 | 0.44 | 3 | 3 | 0 | Y | TEFLSAVGLMF | 92.54 | TEFLSAIGLMF | 5.97 | TEVLSAVGLMF | 1.49 | | |
| NS2B | 1379 | 0.44 | 3 | 3 | 0 | Y | EFLSAVGLMFA | 92.54 | EFLSAIGLMFA | 5.97 | EVLSAVGLMFA | 1.49 | | |
| NS2B | 1380 | 0.44 | 3 | 3 | 0 | Y | FLSAVGLMFAI | 92.54 | FLSAIGLMFAI | 5.97 | VLSAVGLMFAI | 1.49 | | |
| NS2B | 1381 | 0.33 | 2 | 2 | 0 | Y | LSAVGLMFAIV | 94.03 | LSAIGLMFAIV | 5.97 | | | | |
| NS2B | 1382 | 0.33 | 2 | 2 | 0 | Y | SAVGLMFAIVG | 94.03 | SAIGLMFAIVG | 5.97 | | | | |
| NS2B | 1383 | 0.33 | 2 | 2 | 0 | Y | AVGLMFAIVGG | 94.03 | AIGLMFAIVGG | 5.97 | | |

FIG. 38-50

| Species: JEV (11-mers) protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1386 | 0 | 1 | 1 | 0 | Y | LMFAIVGGLAE | 100 | | | | | | | | |
| NS2B | 1387 | 0.11 | 2 | 2 | 0 | Y | MFAIVGGLAEL | 98.51 | MFAIVGGLAEM | 1.49 | | | | | | |
| NS2B | 1388 | 0.11 | 2 | 2 | 0 | Y | FAIVGGLAELD | 98.51 | FAIVGGLAEMD | 1.49 | | | | | | |
| NS2B | 1389 | 0.11 | 2 | 2 | 0 | Y | AIVGGLAELDI | 98.51 | AIVGGLAEMDI | 1.49 | | | | | | |
| NS2B | 1390 | 0.11 | 2 | 2 | 0 | Y | IVGGLAELDIE | 98.51 | IVGGLAEMDIE | 1.49 | | | | | | |
| NS2B | 1391 | 0.11 | 2 | 2 | 0 | Y | VGGLAELDIES | 98.51 | VGGLAEMDIES | 1.49 | | | | | | |
| NS2B | 1392 | 0.11 | 2 | 2 | 0 | Y | GGLAELDIESM | 98.51 | GGLAEMDIESM | 1.49 | | | | | | |
| NS2B | 1393 | 0.11 | 2 | 2 | 0 | Y | GLAELDIESMS | 98.51 | GLAEMDIESMS | 1.49 | | | | | | |
| NS2B | 1394 | 0.11 | 2 | 2 | 0 | Y | LAELDIESMSI | 98.51 | LAEMDIESMSI | 1.49 | | | | | | |
| NS2B | 1395 | 0.11 | 2 | 2 | 0 | Y | AELDIESMSIP | 98.51 | AEMDIESMSIP | 1.49 | | | | | | |
| NS2B | 1396 | 0.11 | 2 | 2 | 0 | Y | ELDIESMSIPF | 98.51 | EMDIESMSIPF | 1.49 | | | | | | |
| NS2B | 1397 | 0.11 | 2 | 2 | 0 | Y | LDIESMSIPFM | 98.51 | MDIESMSIPFM | 1.49 | | | | | | |
| NS2B | 1398 | 0 | 1 | 1 | 0 | Y | DIESMSIPFML | 100 | | | | | | | | |
| NS2B | 1399 | 0 | 1 | 1 | 0 | Y | IESMSIPFMLA | 100 | | | | | | | | |
| NS2B | 1400 | 0.11 | 2 | 2 | 0 | Y | ESMSIPFMLAG | 98.51 | ESMSIPFMLAV | 1.49 | | | | | | |
| NS2B | 1401 | 0.11 | 2 | 2 | 0 | Y | SMSIPFMLAGL | 98.51 | SMSIPFMLAVL | 1.49 | | | | | | |
| NS2B | 1402 | 0.11 | 2 | 2 | 0 | Y | MSIPFMLAGLM | 98.51 | MSIPFMLAVLM | 1.49 | | | | | | |
| NS2B | 1403 | 0.11 | 2 | 2 | 0 | Y | SIPFMLAGLMA | 98.51 | SIPFMLAVLMA | 1.49 | | | | | | |
| NS2B | 1404 | 0.11 | 2 | 2 | 0 | Y | IPFMLAGLMAV | 98.51 | IPFMLAVLMAV | 1.49 | | | | | | |
| NS2B | 1405 | 0.11 | 2 | 2 | 0 | Y | PFMLAGLMAVS | 98.51 | PFMLAVLMAVS | 1.49 | | | | | | |
| NS2B | 1406 | 0.11 | 2 | 2 | 0 | Y | FMLAGLMAVSY | 98.51 | FMLAVLMAVSY | 1.49 | | | | | | |
| NS2B | 1407 | 0.11 | 2 | 2 | 0 | Y | MLAGLMAVSYV | 98.51 | MLAVLMAVSYV | 1.49 | | | | | | |
| NS2B | 1408 | 0.11 | 2 | 2 | 0 | Y | LAGLMAVSYVV | 98.51 | LAVLMAVSYVV | 1.49 | | | | | | |
| NS2B | 1409 | 0.11 | 2 | 2 | 0 | Y | AGLMAVSYVVS | 98.51 | AVLMAVSYVVS | 1.49 | | | | | | |
| NS2B | 1410 | 0.11 | 2 | 2 | 0 | Y | GLMAVSYVVSG | 98.51 | VLMAVSYVVSG | 1.49 | | | | | | |

FIG. 38-51

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS2B | 1411 | 0 | 1 | 1 | 0 | Y | LMA

FIG. 38-52

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1444 | 0.68 | 2 | 2 | 0 | Y | SSRRLDVKLDD | 82.09 | SSRRLDVKLDE | 17.91 | | | | | | |
| NS2B | 1445 | 0.68 | 2 | 2 | 0 | Y | SRRLDVKLDDD | 82.09 | SRRLDVKLDED | 17.91 | | | | | | |
| NS2B | 1446 | 0.68 | 2 | 2 | 0 | Y | RRLDVKLDDDG | 82.09 | RRLDVKLDEDG | 17.91 | | | | | | |
| NS2B | 1447 | 0.68 | 2 | 2 | 0 | Y | RLDVKLDDDGD | 82.09 | RLDVKLDEDGD | 17.91 | | | | | | |
| NS2B | 1448 | 0.68 | 2 | 2 | 0 | Y | LDVKLDDDGDF | 82.09 | LDVKLDEDGDF | 17.91 | | | | | | |
| NS2B | 1449 | 0.68 | 2 | 2 | 0 | Y | DVKLDDDGDFH | 82.09 | DVKLDEDGDFH | 17.91 | | | | | | |
| NS2B | 1450 | 0.79 | 3 | 3 | 0 | Y | VKLDDDGDFHL | 80.6 | VKLDEDGDFHL | 17.91 | VKLDDDGDFHF | 1.49 | | | | |
| NS2B | 1451 | 0.79 | 3 | 3 | 0 | Y | KLDDDGDFHLI | 80.6 | KLDEDGDFHLI | 17.91 | KLDDDGDFHFI | 1.49 | | | | |
| NS2B | 1452 | 0.79 | 3 | 3 | 0 | Y | LDDDGDFHLID | 80.6 | LDEDGDFHLID | 17.91 | LDDDGDFHFID | 1.49 | | | | |
| NS2B | 1453 | 0.86 | 4 | 4 | 0 | Y | DDDGDFHLIDD | 80.6 | DEDGDFHLIDD | 16.42 | DDDGDFHFIDD | 1.49 | DEDGDFHLIDV | 1.49 | | |
| NS2B | 1454 | 0.86 | 4 | 4 | 0 | Y | DDGDFHLIDDP | 80.6 | EDGDFHLIDDP | 16.42 | DDGDFHFIDDP | 1.49 | EDGDFHLIDVP | 1.49 | | |
| NS2B | 1455 | 0.22 | 3 | 3 | 0 | Y | DGDFHLIDDPG | 97.01 | DGDFHFIDDPG | 1.49 | DGDFHLIDVPG | 1.49 | | | | |
| NS2B | 1456 | 0.22 | 3 | 3 | 0 | Y | GDFHLIDDPGV | 97.01 | GDFHFIDDPGV | 1.49 | GDFHLIDVPGV | 1.49 | | | | |
| NS2B | 1457 | 0.22 | 3 | 3 | 0 | Y | DFHLIDDPGVP | 97.01 | DFHFIDDPGVP | 1.49 | DFHLIDVPGVP | 1.49 | | | | |
| NS2B | 1458 | 0.22 | 3 | 3 | 0 | Y | FHLIDDPGVPW | 97.01 | FHFIDDPGVPW | 1.49 | FHLIDVPGVPW | 1.49 | | | | |
| NS2B | 1459 | 0.33 | 4 | 4 | 0 | Y | HLIDDPGVPWK | 95.52 | HFIDDPGVPWK | 1.49 | HLIDVPGVPWK | 1.49 | | | | |
| NS2B | 1460 | 0.22 | 3 | 3 | 0 | Y | LIDDPGVPWKV | 97.01 | FIDDPGVPWKV | 1.49 | LIDVPGVPWKV | 1.49 | LIDDPGVPWKI | 1.49 | | |
| NS2B | 1461 | 0.22 | 3 | 3 | 0 | Y | IDDPGVPWKVW | 97.01 | IDVPGVPWKVW | 1.49 | IDDPGVPWKIW | 1.49 | | | | |
| NS2B | 1462 | 0.86 | 4 | 4 | 0 | Y | DDPGVPWKVWL | 80.6 | DPGVPWKVWL | 16.42 | DDPGVPWKVWL | 1.49 | DVPGVPWKVWV | 1.49 | | |
| NS2B | 1463 | 0.86 | 4 | 4 | 0 | Y | DPGVPWKVWVL | 80.6 | VPGVPWKVWLL | 16.42 | VPGVPWKIWLL | 1.49 | DPGVPWKIWLL | 1.49 | | |
| NS2B | 1464 | 0.75 | 3 | 3 | 0 | Y | PGVPWKVWVLR | 82.09 | PGVPWKIWLLR | 16.42 | PGVPWKVWLLR | 1.49 | | | | |
| NS2B | 1465 | 0.86 | 4 | 4 | 0 | Y | GVPWKVWVLRM | 80.6 | GVPWKIWLLRM | 16.42 | GVPWKVWLLRM | 1.49 | GVPWKVWLRT | 1.49 | | |
| NS2B | 1466 | 0.86 | 4 | 4 | 0 | Y | VPWKVWVLRMS | 80.6 | VPWKIWLLRMS | 16.42 | VPWKVWLLRMS | 1.49 | VPWKVWLRTS | 1.49 | | |
| NS2B | 1467 | 0.86 | 4 | 4 | 0 | Y | PWKVWVLRMSC | 80.6 | PWKIWLLRMSC | 16.42 | PWKVWLLRMSC | 1.49 | PWKIWLLRMSC | 1.49 | | |
| NS2B | 1468 | 0.97 | 5 | 5 | 0 | Y | WKVWVLRMSCI | 79.1 | WKVWLLRMSCI | 16.42 | WKVWLRTSCI | 1.49 | WKVWLLRMSCS | 1.49 | WKIWLLRMSCI | 1.49 |

FIG. 38-53

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS2B | 1473 | 0.45 | 5 | 5 | 0 | Y | LRMSCIGLAAL | 94.03 | LRMSCSGLAAL | 1.49 | LRMSCICLAAL | 1.49 | LRMSCIGLVAL | 1.49 | LRTSCIGLAAL | 1.49 |
| NS2B | 1474 | 0.45 | 5 | 5 | 0 | Y | RMSCIGLAALT | 94.03 | RMSCSCICLAALT | 1.49 | RTSCIGLAALT | 1.49 | RMSCSGLAALT | 1.49 | RMSCIGLVALT | 1.49 |
| NS2B | 1475 | 0.45 | 5 | 5 | 0 | Y | MSCIGLAALTP | 94.03 | MSCSGLAALTP | 1.49 | MSCICLAALTP | 1.49 | TSCIGLAALTP | 1.49 | MSCIGLVALTP | 1.49 |
| NS2B | 1476 | 0.33 | 4 | 4 | 0 | Y | SCIGLAALTPW | 95.52 | SCIGLVALTPW | 1.49 | SCSGLAALTPW | 1.49 | SCICLAALTPW | 1.49 | | |
| NS2B | 1477 | 0.33 | 4 | 4 | 0 | Y | CIGLAALTPWA | 95.52 | CSGLAALTPWA | 1.49 | CIGLVALTPWA | 1.49 | CICLAALTPWA | 1.49 | | |
| NS2B | 1478 | 0.33 | 4 | 4 | 0 | Y | IGLAALTPWAI | 95.52 | SGLAALTPWAI | 1.49 | IGLVALTPWAI | 1.49 | ICLAALTPWAI | 1.49 | | |
| NS2B | 1479 | 0.22 | 3 | 3 | 0 | Y | GLAALTPWAIV | 97.01 | CLAALTPWAIV | 1.49 | GLVALTPWAIV | 1.49 | | | | |
| NS2B | 1480 | 0.11 | 2 | 2 | 0 | Y | LAALTPWAIVP | 98.51 | LVALTPWAIVP | 1.49 | | | | | | |
| NS2B | 1481 | 0.11 | 2 | 2 | 0 | Y | AALTPWAIVPA | 98.51 | VALTPWAIVPA | 1.49 | | | | | | |
| NS2B | 1482 | 0 | 1 | 1 | 0 | Y | ALTPWAIVPAA | 100 | | | | | | | | |
| NS2B | 1483 | 0 | 1 | 1 | 0 | Y | LTPWAIVPAAF | 100 | | | | | | | | |
| NS2B | 1484 | 0 | 1 | 1 | 0 | Y | TPWAIVPAAFG | 100 | | | | | | | | |
| NS2B | 1485 | 0 | 1 | 1 | 0 | Y | PWAIVPAAFGY | 100 | | | | | | | | |
| NS2B | 1486 | 0 | 1 | 1 | 0 | Y | WAIVPAAFGYW | 100 | | | | | | | | |
| NS2B | 1487 | 0 | 1 | 1 | 0 | Y | AIVPAAFGYWL | 100 | | | | | | | | |
| NS2B | 1488 | 0 | 1 | 1 | 0 | Y | IVPAAFGYWLT | 100 | | | | | | | | |
| NS2B | 1489 | 0 | 1 | 1 | 0 | Y | VPAAFGYWLTL | 100 | | | | | | | | |
| NS2B | 1490 | 0 | 1 | 1 | 0 | Y | PAAFGYWLTLK | 100 | | | | | | | | |
| NS2B | 1491 | 0 | 1 | 1 | 0 | Y | AAFGYWLTLKT | 100 | | | | | | | | |
| NS2B | 1492 | 0 | 1 | 1 | 0 | Y | AFGYWLTLKTT | 100 | | | | | | | | |
| NS2B | 1493 | 0 | 1 | 1 | 0 | Y | FGYWLTLKTTK | 100 | | | | | | | | |
| NS2B | 1494 | 0 | 1 | 1 | 0 | Y | GYWLTLKTTKR | 100 | | | | | | | | |
| NS2B | 1495 | 0 | 1 | 1 | 0 | Y | YWLTLKTTKRG | 100 | | | | | | | | |
| NS2B | 1496 | 0 | 1 | 1 | 0 | Y | WLTLKTTKRGG | 100 | | | | | | | | |
| NS2B | 1497 | 0 | 1 | 1 | 0 | Y | LTLKTTKRGGV | 100 | | | | | | | | |

FIG. 38-54

Species: JEV (11-mers)

| protein | block starting position | block entropy | total peptides in block | # peptides required to cover 99% of block | gap/X fraction | 99% of block covered w

FIG. 38-55

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1574 | 1.09 | 3 | 3 | 0 | Y | GSVKEDRIA

FIG. 38-58

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1599 | 1.08 | 5 | 5 | 0 | Y | VQVIVVEPGKA | 77.61 | VQVIVVEPGKP | 14.93 | VQVIVVEPGKG | 4.48 | VQVIVVEPGKV | 1.49 | VQVIVVEQGKP | 1.49 |
| NS3 | 1600 | 1.08 | 5 | 5 | 0 | Y | QVIVVEPGKAA | 77.61 | QVIVVEPGKPA | 14.93 | QVIVVEPGKGA | 4.48 | QVIVVEQGKPA | 1.49 | QVIVVEQGKVA | 1.49 |
| NS3 | 1613 | 0.45 | 5 | 5 | 0 | Y | IQTKPGVFRTP | 94.03 | IQTKPGVFCTP | 1.49 | IQTKPGIFPTP | 1.49 | FQTKPGVFRTP | 1.49 | IQTRPGIFPPP | 1.49 |
| NS3 | 1614 | 0.45 | 5 | 5 | 0 | Y | QTKPGVFRTPF | 94.03 | QTKPGVFCTPF | 1.49 | QTKPGIFPPPF | 1.49 | QTKPGVFRTPL | 1.49 | QTKPGVFCTPF | 1.49 |
| NS3 | 1615 | 0.45 | 5 | 5 | 0 | Y | TKPGVFRTPFG | 94.03 | TKPGIFPPPFG | 1.49 | TKPGVFCTPFG | 1.49 | TKPGVFRTPLG | 1.49 | TKPGIFPTPFG | 1.49 |
| NS3 | 1623 | 0.66 | 5 | 5 | 0 | Y | PFGEVGAVSLD | 89.55 | PFGEIGAVSLD | 5.97 | PFGKVGTVSLD | 1.49 | PFGKVGTVSLD | 1.49 | PLGEVGAVSLD | 1.49 |
| NS3 | 1624 | 0.66 | 5 | 4 | 0 | Y | FGEVGAVSLDY | 89.55 | FGEIGAVSLDY | 5.97 | FGKVGAVSLD | 1.49 | LGEVGAVSLD | 1.49 | FGKVGTVSLDY | 1.49 |
| NS3 | 1625 | 0.55 | 4 | 4 | 0 | Y | GEVGAVSLDYP | 91.04 | GEIGAVSLDYP | 5.97 | GKVGAVSLDYP | 1.49 | GKVGTVSLDYP | 1.49 | | |
| NS3 | 1626 | 0.55 | 4 | 4 | 0 | Y | EVGAVSLDYPR | 91.04 | EIGAVSLDYPR | 5.97 | KVGAVSLDYPR | 1.49 | KVGTVSLDYPR | 1.49 | | |
| NS3 | 1627 | 0.44 | 4 | 3 | 0 | Y | VGAVSLDYPRG | 92.54 | IGAVSLDYPRG | 5.97 | VGTVSLDYPRG | 1.49 | | | | |
| NS3 | 1628 | 0.11 | 3 | 2 | 0 | Y | GAVSLDYPRGT | 98.51 | GTVSLDYPRGT | 1.49 | | | | | | |
| NS3 | 1629 | 0.11 | 2 | 2 | 0 | Y | AVSLDYPRGTS | 98.51 | TVSLDYPRGTS | 1.49 | | | | | | |
| NS3 | 1630 | 0 | 1 | 1 | 0 | Y | VSLDYPRGTSG | 100 | | | | | | | | |
| NS3 | 1631 | 0 | 1 | 1 | 0 | Y | SLDYPRGTSGS | 100 | | | | | | | | |
| NS3 | 1632 | 0 | 1 | 1 | 0 | Y | LDYPRGTSGSP | 100 | | | | | | | | |
| NS3 | 1633 | 0 | 1 | 1 | 0 | Y | DYPRGTSGSPI | 100 | | | | | | | | |
| NS3 | 1634 | 0 | 1 | 1 | 0 | Y | YPRGTSGSPIL | 100 | | | | | | | | |
| NS3 | 1635 | 0.11 | 2 | 2 | 0 | Y | PRGTSGSPILD | 98.51 | PRGTSGSPILN | 1.49 | | | | | | |
| NS3 | 1636 | 0.22 | 3 | 3 | 0 | Y | RGTSGSPILDS | 97.01 | RGTSGSPILDF | 1.49 | RGTSGSPILNS | 1.49 | | | | |
| NS3 | 1637 | 0.22 | 3 | 3 | 0 | Y | GTSGSPILDSN | 97.01 | GTSGSPILDFN | 1.49 | GTSGSPILNSN | 1.49 | | | | |
| NS3 | 1638 | 0.22 | 3 | 3 | 0 | Y | TSGSPILDSNG | 97.01 | TSGSPILDFNG | 1.49 | TSGSPILNSNG | 1.49 | | | | |
| NS3 | 1639 | 0.22 | 3 | 3 | 0 | Y | SGSPILDSNGD | 97.01 | SGSPILDFNGD | 1.49 | SGSPILNSNGD | 1.49 | | | | |
| NS3 | 1640 | 0.22 | 3 | 3 | 0 | Y | GSPILDSNGDI | 97.01 | GSPILDFNGDI | 1.49 | GSPILNSNGDV | 1.49 | | | | |
| NS3 | 1641 | 0.22 | 3 | 3 | 0 | Y | SPILDSNGDII | 97.01 | SPILDFNGDII | 1.49 | SPILNSNGDVW | 1.49 | | | | |
| NS3 | 1642 | 0.22 | 3 | 3 | 0 | Y | PILDSNGDIIG | 97.01 | PILDFNGDIIG | 1.49 | PILNSNGDVVG | 1.49 | | | | |

FIG. 38-59

Species: JEV (11-mers)

| protein | block starting position | block entropy | total peptides in block | # peptides required to cover 99% of block | gap/X fraction | 99% of block covered w/ <= 5 peptides? | peptides required

FIG. 38-60

Species: JEV (11-mers)

| protein | block starting position | block entropy | total peptides in block | # peptides required to cover 99% of block | gap/X fraction | 99% of block covered w / <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1668 | 0.33 | 2 | 2 |

FIG. 38-61

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 38-62

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1726 | 0 | 1 | 1 | 0 | Y | LAPTRVVAAEM | 100 | | | | | | |
| NS3 | 1727 | 0 | 1 | 1 | 0 | Y | APTRVVAAEMA | 100 | | | | | | |
| NS3 | 1728 | 0 | 1 | 1 | 0 | Y | PTRVVAAEMAE | 100 | | | | | | |
| NS3 | 1729 | 0.26 | 2 | 2 | 0 | Y | TRVVAAEMAEA | 95.52 | TRVVAAEMAEV | 4.48 | | | | |
| NS3 | 1730 | 0.26 | 2 | 2 | 0 | Y | RVVAAEMAEAL | 95.52 | RVVAAEMAEVL | 4.48 | | | | |
| NS3 | 1731 | 0.59 | 3 | 3 | 0 | Y | VVAAEMAEALR | 89.55 | VVAAEMAEALK | 5.97 | VVAAEMAEVLR | 4.48 | | |
| NS3 | 1732 | 0.59 | 3 | 3 | 0 | Y | VAAEMAEALRG | 89.55 | VAAEMAEALKG | 5.97 | VAAEMAEVLRG | 4.48 | | |
| NS3 | 1733 | 0.59 | 3 | 3 | 0 | Y | AAEMAEALRGL | 89.55 | AAEMAEALKGL | 5.97 | AAEMAEVLRGL | 4.48 | | |
| NS3 | 1734 | 0.59 | 3 | 3 | 0 | Y | AEMAEALRGLP | 89.55 | AEMAEALKGLP | 5.97 | AEMAEVLRGLP | 4.48 | | |
| NS3 | 1735 | 0.59 | 3 | 3 | 0 | Y | EMAEALRGLPV | 89.55 | EMAEALKGLPV | 5.97 | EMAEVLRGLPV | 4.48 | | |
| NS3 | 1736 | 0.59 | 3 | 3 | 0 | Y | MAEALRGLPVR | 89.55 | MAEALKGLPVR | 5.97 | MAEVLRGLPVR | 4.48 | | |
| NS3 | 1737 | 0.59 | 3 | 3 | 0 | Y | AEALRGLPVRY | 89.55 | AEALKGLPVRY | 5.97 | AEVLRGLPVRY | 4.48 | | |
| NS3 | 1738 | 0.59 | 3 | 3 | 0 | Y | EALRGLPVRYQ | 89.55 | EALKGLPVRYQ | 5.97 | EVLRGLPVRYQ | 4.48 | | |
| NS3 | 1739 | 0.59 | 3 | 3 | 0 | Y | ALRGLPVRYQT | 89.55 | ALKGLPVRYQT | 5.97 | VLRGLPVRYQT | 4.48 | | |
| NS3 | 1740 | 0.33 | 2 | 2 | 0 | Y | LRGLPVRYQTS | 94.03 | LKGLPVRYQTS | 5.97 | | | | |
| NS3 | 1741 | 0.33 | 2 | 2 | 0 | Y | RGLPVRYQTSA | 94.03 | KGLPVRYQTSA | 5.97 | | | | |
| NS3 | 1742 | 0 | 1 | 1 | 0 | Y | GLPVRYQTSAV | 100 | | | | | | |
| NS3 | 1743 | 0 | 1 | 1 | 0 | Y | LPVRYQTSAVQ | 100 | | | | | | |
| NS3 | 1744 | 0 | 1 | 1 | 0 | Y | PVRYQTSAVQR | 100 | | | | | | |
| NS3 | 1745 | 0.11 | 2 | 2 | 0 | Y | VRYQTSAVQRE | 98.51 | VRYQTSAVQRS | 1.49 | | | | |
| NS3 | 1746 | 0.11 | 2 | 2 | 0 | Y | RYQTSAVQREH | 98.51 | RYQTSAVQRSH | 1.49 | | | | |
| NS3 | 1747 | 0.11 | 2 | 2 | 0 | Y | YQTSAVQREHQ | 98.51 | YQTSAVQRSHQ | 1.49 | | | | |
| NS3 | 1748 | 0.11 | 2 | 2 | 0 | Y | QTSAVQREHQG | 98.51 | QTSAVQRSHQG | 1.49 | | | | |
| NS3 | 1749 | 0.11 | 2 | 2 | 0 | Y | TSAVQREHQGN | 98.51 | TSAVQRSHQGN | 1.49 | | | | |
| NS3 | 1750 | 0.22 | 3 | 3 | 0 | Y | SAVQREHQGNE | 97.01 | SAVQRSHQGNE | 1.49 | SAVQREHQGNA | 1.49 | | |

FIG. 38-63

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1751 | 0.22 | 3 | 3 | 0 | Y | AVQRE

FIG. 38-64

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1776 | 0 | 1 | 1 | 0 | Y | SPNRVPNYNLF | 100 | | |
| NS3 | 1777 | 0 | 1 | 1 | 0 | Y | PNRVPNYNLFV | 100 | | |
| NS3 | 1778 | 0 | 1 | 1 | 0 | Y | NRVPNYNLFVM | 100 | | |
| NS3 | 1779 | 0 | 1 | 1 | 0 | Y | RVPNYNLFVMD | 100 | | |
| NS3 | 1780 | 0 | 1 | 1 | 0 | Y | VPNYNLFVMDE | 100 | | |
| NS3 | 1781 | 0 | 1 | 1 | 0 | Y | PNYNLFVMDEA | 100 | | |
| NS3 | 1782 | 0 | 1 | 1 | 0 | Y | NYNLFVMDEAH | 100 | | |
| NS3 | 1783 | 0 | 1 | 1 | 0 | Y | YNLFVMDEAHF | 100 | | |
| NS3 | 1784 | 0 | 1 | 1 | 0 | Y | NLFVMDEAHFT | 100 | | |
| NS3 | 1785 | 0 | 1 | 1 | 0 | Y | LFVMDEAHFTD | 100 | | |
| NS3 | 1786 | 0 | 1 | 1 | 0 | Y | FVMDEAHFTDP | 100 | | |
| NS3 | 1787 | 0 | 1 | 1 | 0 | Y | VMDEAHFTDPA | 100 | | |
| NS3 | 1788 | 0.11 | 2 | 2 | 0 | Y | MDEAHFTDPAS | 98.51 | MDEAHFTDPAG | 1.49 |
| NS3 | 1789 | 0.11 | 2 | 2 | 0 | Y | DEAHFTDPASI | 98.51 | DEAHFTDPAGI | 1.49 |
| NS3 | 1790 | 0.11 | 2 | 2 | 0 | Y | EAHFTDPASIA | 98.51 | EAHFTDPAGIA | 1.49 |
| NS3 | 1791 | 0.11 | 2 | 2 | 0 | Y | AHFTDPASIAA | 98.51 | AHFTDPAGIAA | 1.49 |
| NS3 | 1792 | 0.11 | 2 | 2 | 0 | Y | HFTDPASIAAR | 98.51 | HFTDPAGIAAR | 1.49 |
| NS3 | 1793 | 0.11 | 2 | 2 | 0 | Y | FTDPASIAARG | 98.51 | FTDPAGIAARG | 1.49 |
| NS3 | 1794 | 0.11 | 2 | 2 | 0 | Y | TDPASIAARGY | 98.51 | TDPAGIAARGY | 1.49 |
| NS3 | 1795 | 0.11 | 2 | 2 | 0 | Y | DPASIAARGYI | 98.51 | DPAGIAARGYI | 1.49 |
| NS3 | 1796 | 0.11 | 2 | 2 | 0 | Y | PASIAARGYIA | 98.51 | PAGIAARGYIA | 1.49 |
| NS3 | 1797 | 0.11 | 2 | 2 | 0 | Y | ASIAARGYIAT | 98.51 | AGIAARGYIAT | 1.49 |
| NS3 | 1798 | 0.11 | 2 | 2 | 0 | Y | SIAARGYIATK | 98.51 | GIAARGYIATK | 1.49 |
| NS3 | 1799 | 0 | 1 | 1 | 0 | Y | IAARGYIATKV | 100 | | |
| NS3 | 1800 | 0 | 1 | 1 | 0 | Y | AARGYIATKVE | 100 | | |

FIG. 38-65

Species: JEV (11-mers)

| protein | block starting position | block entropy | total peptides in block | # peptides required to cover 99% of block | gap/X fraction | 99% of block | covered w/ <= 5 peptides? | peptides required to cover 99% of block | frequency | peptides required to cover 99% of block | frequency |
|---|---|---|---|---|---|---|---|---|---|---|---|
| NS3 | 1801 | 0 | 1 | 1 | 0 | | Y | ARGYIATKVEL | 100 | | |
| NS3 | 1802 | 0 | 1 | 1 | 0 | | Y | RGYIATKVELG | 100 | | |
| NS3 | 1803 | 0 | 1 | 1 | 0 | | Y | GYIATKVELGE | 100 | | |
| NS3 | 1804 | 0 | 1 | 1 | 0 | | Y | YIATKVELGEA | 100 | | |
| NS3 | 1805 | 0 | 1 | 1 | 0 | | Y | IATKVELGEAA | 100 | | |
| NS3 | 1806 | 0 | 1 | 1 | 0 | | Y | ATKVELGEAAA | 100 | | |
| NS3 | 1807 | 0 | 1 | 1 | 0 | | Y | TKVELGEAAAI | 100 | | |
| NS3 | 1808 | 0 | 1 | 1 | 0 | | Y | KVELGEAAAIF | 100 | | |
| NS3 | 1809 | 0 | 1 | 1 | 0 | | Y | VELGEAAAIFM | 100 | | |
| NS3 | 1810 | 0 | 1 | 1 | 0 | | Y | ELGEAAAIFMT | 100 | | |
| NS3 | 1811 | 0 | 1 | 1 | 0 | | Y | LGEAAAIFMTA | 100 | | |
| NS3 | 1812 | 0 | 1 | 1 | 0 | | Y | GEAAAIFMTAT | 100 | | |
| NS3 | 1813 | 0.11 | 2 | 2 | 0 | | Y | EAAAIFMTATP | 98.51 | EAAAIFMTATS | 1.49 |
| NS3 | 1814 | 0.11 | 2 | 2 | 0 | | Y | AAAIFMTATPP | 98.51 | AAAIFMTATSP | 1.49 |
| NS3 | 1815 | 0.11 | 2 | 2 | 0 | | Y | AAIFMTATPPG | 98.51 | AAIFMTATSPG | 1.49 |
| NS3 | 1816 | 0.11 | 2 | 2 | 0 | | Y | AIFMTATPPGT | 98.51 | AIFMTATSPGT | 1.49 |
| NS3 | 1817 | 0.11 | 2 | 2 | 0 | | Y | IFMTATPPGT | 98.51 | IFMTATSPGTT | 1.49 |
| NS3 | 1818 | 0.11 | 2 | 2 | 0 | | Y | FMTATPPGTT | 98.51 | FMTATSPGTTD | 1.49 |
| NS3 | 1819 | 0.11 | 2 | 2 | 0 | | Y | MTATPPGTTDP | 98.51 | MTATSPGTTDP | 1.49 |
| NS3 | 1820 | 0.11 | 2 | 2 | 0 | | Y | TATPPGTTDPF | 98.51 | TATSPGTTDPF | 1.49 |
| NS3 | 1821 | 0.11 | 2 | 2 | 0 | | Y | ATPPGTTDPFP | 98.51 | ATSPGTTDPFP | 1.49 |
| NS3 | 1822 | 0.11 | 2 | 2 | 0 | | Y | TPPGTTDPFPD | 98.51 | TSPGTTDPFPD | 1.49 |
| NS3 | 1823 | 0.11 | 2 | 2 | 0 | | Y | PPGTTDPFPDS | 98.51 | SPGTTDPFPDS | 1.49 |
| NS3 | 1824 | 0.11 | 2 | 2 | 0 | | Y | PGTTDPFPDSN | 98.51 | PGTTDPFPDSD | 1.49 |
| NS3 | 1825 | 0.11 | 2 | 2 | 0 | | Y | GTTDPFPDSNA | 98.51 | GTTDPFPDSDA | 1.49 |

FIG. 38-66

Species: JEV (11-mers)

| protein | block starting position | block entropy | total peptides in block | # peptides required to cover 99% of block | gap/x fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1826 | 0.11 | 2 | 2 | 0 | Y | TTDPFPDSNAP | 98.51 | TTDPFPDSDAP | 1.49 | | | | |
| NS3 | 1827 | 0.11 | 2 | 2 | 0 | Y | TDPFPDSNAPI | 98.51 | TDPFPDSDAPI | 1.49 | | | | |
| NS3 | 1828 | 0.11 | 2 | 2 | 0 | Y | DPFPDSNAPIH | 98.51 | DPFPDSDAPIH | 1.49 | | | | |
| NS3 | 1829 | 0.11 | 2 | 2 | 0 | Y | PFPDSNAPIHD | 98.51 | PFPDSDAPIHD | 1.49 | | | | |
| NS3 | 1830 | 0.11 | 2 | 2 | 0 | Y | FPDSNAPIHDL | 98.51 | FPDSDAPIHDL | 1.49 | | | | |
| NS3 | 1831 | 0.11 | 2 | 2 | 0 | Y | PDSNAPIHDLQ | 98.51 | PDSDAPIHDLQ | 1.49 | | | | |
| NS3 | 1832 | 0.11 | 2 | 2 | 0 | Y | DSNAPIHDLQD | 98.51 | DSDAPIHDLQD | 1.49 | | | | |
| NS3 | 1833 | 0.3 | 3 | 2 | 0 | Y | SNAPIHDLQDE | 95.52 | SNAPIHDLQDG | 2.99 | SDAPIHDLQDE | 1.49 | | |
| NS3 | 1834 | 0.34 | 4 | 3 | 2.99 | Y | NAPIHDLQDEI | 92.54 | NAPIHDLQDEV | 1.49 | NAPIHDLQDET | 1.49 | DAPIHDLQDEI | 1.49 |
| NS3 | 1835 | 0.23 | 3 | 3 | 2.99 | Y | APIHDLQDEIP | 94.03 | APIHDLQDETP | 1.49 | APIHDLQDEVP | 1.49 | | |
| NS3 | 1836 | 0.23 | 3 | 3 | 2.99 | Y | PIHDLQDEIPD | 94.03 | PIHDLQDETPD | 1.49 | PIHDLQDEVPD | 1.49 | | |
| NS3 | 1837 | 0.34 | 4 | 4 | 2.99 | Y | IHDLQDEIPDR | 92.54 | IHDLQDETPDR | 1.49 | IHDLQDEVPDW | 1.49 | IHDLQDEVPDR | 1.49 |
| NS3 | 1838 | 0.34 | 4 | 4 | 2.99 | Y | HDLQDEIPDRA | 92.54 | HDLQDETPDRA | 1.49 | HDLQDEVPDWA | 1.49 | HDLQDETPDRA | 1.49 |
| NS3 | 1839 | 0.34 | 4 | 4 | 2.99 | Y | DLQDEIPDRAW | 92.54 | DLQDETPDRAW | 1.49 | DLQDEIPDWAW | 1.49 | DLQDEVPDRAW | 1.49 |
| NS3 | 1840 | 0.34 | 4 | 4 | 2.99 | Y | LQDEIPDRAWS | 92.54 | LQDEVPDRAWS | 1.49 | LQDETPDRAWS | 1.49 | LQDEIPDWAWS | 1.49 |
| NS3 | 1841 | 0.34 | 4 | 4 | 2.99 | Y | QDEIPDRAWSS | 92.54 | QDEVPDRAWSS | 1.49 | QDETPDRAWSS | 1.49 | QDEIPDWAWSS | 1.49 |
| NS3 | 1842 | 0.34 | 4 | 4 | 2.99 | Y | DEIPDRAWSSG | 92.54 | DETPDRAWSSG | 1.49 | DEVPDRAWSSG | 1.49 | DEVPDRAWSSG | 1.49 |
| NS3 | 1859 | 0.86 | 4 | 4 | 0 | Y | WITEYAGKTVW | 80.6 | WITDYAGKTVW | 16.42 | WITEYSGKTVW | 1.49 | WSTEYAGKTVW | 1.49 |
| NS3 | 1860 | 0.86 | 4 | 4 | 0 | Y | ITEYAGKTVWF | 80.6 | ITDYAGKTVWF | 16.42 | ITEYSGKTVWF | 1.49 | STEYAGKTVWF | 1.49 |
| NS3 | 1861 | 0.75 | 3 | 3 | 0 | Y | TEYAGKTVWFV | 82.09 | TDYAGKTVWFV | 16.42 | TEYSGKTVWFV | 1.49 | | |
| NS3 | 1862 | 0.75 | 3 | 3 | 0 | Y | EYAGKTVWFVA | 82.09 | DYAGKTVWFVA | 16.42 | EYSGKTVWFVA | 1.49 | | |
| NS3 | 1863 | 0.11 | 2 | 2 | 0 | Y | YAGKTVWFVAS | 98.51 | YSGKTVWFVAS | 1.49 | | | | |
| NS3 | 1864 | 0.11 | 2 | 2 | 0 | Y | AGKTVWFVASV | 98.51 | SGKTVWFVASV | 1.49 | | | | |
| NS3 | 1865 | 0.19 | 2 | 2 | 0 | Y | GKTVWFVASVK | 97.01 | GKTVWFVASVR | 2.99 | | | | |
| NS3 | 1866 | 0.19 | 2 | 2 | 0 | Y | KTVWFVASVKM | 97.01 | KTVWFVASVRM | 2.99 | | | | |

FIG. 38-67

Species: JEV (11-mers)

| protein | block starting position | block entropy | total peptides in block | # peptides required to cover 99% of block | gap/X fraction | 99% of block covered w/ <= 5 peptides?

FIG. 38-68

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |
|---|---|---|---|---|---|---|---|---|---|---|
| NS3 | 1892 | 0.11 | 2 | 2 | 0 | Y | IQLNRKSYDTE | 98.51 | IQLSRKSYDTE |

FIG. 38-69

Species: JEV (11-mers)

| protein | block starting position | block entropy | total peptides in block | # peptides required to cover 99% of block | block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS3 | 1917 | 0.11 | 2 | 2 | 0 | Y | TDISEMGANFG | 98.51 | TDISEVGANFG | 1.49 | | | | |
| NS3 | 1918 | 0.11 | 2 | 2 | 0 | Y | DISEMGANFGA | 98.51 | DISEVGANFGA | 1.49 | | | | |
| NS3 | 1919 | 0.11 | 2 | 2 | 0 | Y | ISEMGANFGAS | 98.51 | ISEVGANFGAS | 1.49 | | | | |
| NS3 | 1920 | 0.11 | 2 | 2 | 0 | Y | SEMGANFGASR | 98.51 | SEVGANFGASR | 1.49 | | | | |
| NS3 | 1921 | 0.11 | 2 | 2 | 0 | Y | EMGANFGASRV | 98.51 | EVGANFGASRV | 1.49 | | | | |
| NS3 | 1922 | 0.11 | 2 | 2 | 0 | Y | MGANFGASRVI | 98.51 | VGANFGASRVI | 1.49 | | | | |
| NS3 | 1923 | 0 | 1 | 1 | 0 | Y | GANFGASRVID | 100 | | | | | | |
| NS3 | 1924 | 0 | 1 | 1 | 0 | Y | ANFGASRVIDC | 100 | | | | | | |
| NS3 | 1925 | 0 | 1 | 1 | 0 | Y | NFGASRVIDCR | 100 | | | | | | |
| NS3 | 1926 | 0 | 1 | 1 | 0 | Y | FGASRVIDCRK | 100 | | | | | | |
| NS3 | 1927 | 0 | 1 | 1 | 0 | Y | GASRVIDCRKS | 100 | | | | | | |
| NS3 | 1928 | 0 | 1 | 1 | 0 | Y | ASRVIDCRKSV | 100 | | | | | | |
| NS3 | 1929 | 0.11 | 2 | 2 | 0 | Y | SRVIDCRKSVK | 98.51 | SRVIDCRKSVE | 1.49 | | | | |
| NS3 | 1930 | 0.11 | 2 | 2 | 0 | Y | RVIDCRKSVKP | 98.51 | RVIDCRKSVEP | 1.49 | | | | |
| NS3 | 1931 | 0.22 | 3 | 3 | 0 | Y | VIDCRKSVKPT | 97.01 | VIDCRKSVEPT | 1.49 | VIDCRKSVKPI | 1.49 | | |
| NS3 | 1932 | 0.22 | 3 | 3 | 0 | Y | IDCRKSVKPTI | 97.01 | IDCRKSVEPTI | 1.49 | IDCRKSVKPII | 1.49 | | |
| NS3 | 1933 | 0.22 | 3 | 3 | 0 | Y | DCRKSVKPTIL | 97.01 | DCRKSVEPTIL | 1.49 | DCRKSVKPIIL | 1.49 | | |
| NS3 | 1934 | 0.22 | 3 | 3 | 0 | Y | CRKSVKPTILE | 97.01 | CRKSVEPTILE | 1.49 | CRKSVKPIILE | 1.49 | | |
| NS3 | 1935 | 0.33 | 4 | 4 | 0 | Y | RKSVKPTILEE | 95.52 | RKSVEPTILEE | 1.49 | RKSVKPTILEK | 1.49 | RKSVKPIILEE | 1.49 |
| NS3 | 1936 | 0.33 | 4 | 4 | 0 | Y | KSVKPTILEEG | 95.52 | KSVEPTILEEG | 1.49 | KSVKPTILEKE | 1.49 | KSVKPIILEEG | 1.49 |
| NS3 | 1937 | 0.33 | 4 | 4 | 0 | Y | SVKPTILEEGE | 95.52 | SVEPTILEEGE | 1.49 | SVKPTILEKEE | 1.49 | SVKPIILEEGE | 1.49 |
| NS3 | 1938 | 0.33 | 4 | 4 | 0 | Y | VKPTILEEGEG | 95.52 | VEPTILEEGEG | 1.49 | VKPTILEKEEG | 1.49 | VKPIILEEGEG | 1.49 |
| NS3 | 1939 | 0.33 | 4 | 4 | 0 | Y | KPTILEEGEGR | 95.52 | KPIILEEGEGR | 1.49 | KPTILEKEEGR | 1.49 | EPTILEEGEGR | 1.49 |
| NS3 | 1940 | 0.22 | 3 | 3 | 0 | Y | PTILEEGEGRV | 97.01 | PIILEEGEGRV | 1.49 | PTILEKEEGRV | 1.49 | | |
| NS3 | 1941 | 0.33 | 4 | 4 | 0 | Y | TILEEGEGRVI | 95.52 | IILEEGEGRVI | 1.49 | TILEEGEGRVF | 1.49 | TILEKEEGRVI | 1.49 |

FIG. 38-70

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1942 | 0.22 | 3 | 3 | 0 | Y | ILEEGEG

FIG. 38-71

Species: JEV (11-mers)

| protein | block starting position | block entropy (11-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1967 | 0.22 | 3 | 3 | 0 | Y | RGRVGRNPNQV | 97.01 | RGRVSRNPNQV | 1.49 | RGRVGRNPSQV | 1.49 | | |
| NS3 | 1968 | 0.22 | 3 | 3 | 0 | Y | GRVGRNPNQVG | 97.01 | GRVSRNPNQVG | 1.49 | GRVGRNPSQVG | 1.49 | | |
| NS3 | 1969 | 0.22 | 3 | 3 | 0 | Y | RVGRNPNQVGD | 97.01 | RVSRNPNQVGD | 1.49 | RVGRNPSQVGD | 1.49 | | |
| NS3 | 1970 | 0.22 | 3 | 3 | 0 | Y | VGRNPNQVGDE | 97.01 | VGRNPSQVGDE | 1.49 | VSRNPNQVGDE | 1.49 | | |
| NS3 | 1971 | 0.22 | 3 | 3 | 0 | Y | GRNPNQVGDEY | 97.01 | GRNPSQVGDEY | 1.49 | SRNPNQVGDEY | 1.49 | | |
| NS3 | 1972 | 0.22 | 3 | 3 | 0 | Y | RNPNQVGDEYH | 97.01 | RNPSQVGDEYH | 1.49 | RNPNQVGDEYH | 1.49 | | |
| NS3 | 1973 | 0.22 | 3 | 3 | 0 | Y | NPNQVGDEYHY | 97.01 | NPSQVGDEYHY | 1.49 | NPNQVGDEYH | 1.49 | | |
| NS3 | 1974 | 0.22 | 3 | 3 | 0 | Y | PNQVGDEYHYG | 97.01 | PSQVGDEYHYG | 1.49 | PNQVGDEYEYG | 1.49 | | |
| NS3 | 1975 | 0.22 | 3 | 3 | 0 | Y | NQVGDEYHYGG | 97.01 | NQVGDEYEYGG | 1.49 | SQVGDEYHYGG | 1.49 | | |
| NS3 | 1976 | 0.22 | 3 | 3 | 0 | Y | QVGDEYHYGGA | 97.01 | QVGDEYHYGGP | 1.49 | QVGDEYEYGGA | 1.49 | | |
| NS3 | 1977 | 0.22 | 3 | 3 | 0 | Y | VGDEYHYGGAT | 97.01 | VGDEYEYGGAT | 1.49 | VGDEYHYGGPT | 1.49 | | |
| NS3 | 1978 | 0.22 | 3 | 3 | 0 | Y | GDEYHYGGATS | 97.01 | GDEYHYGGPTS | 1.49 | GDEYEYGGATS | 1.49 | | |
| NS3 | 1979 | 0.22 | 3 | 3 | 0 | Y | DEYHYGGATSE | 97.01 | DEYEYGGATSE | 1.49 | DEYHYGGPTSE | 1.49 | | |
| NS3 | 1980 | 0.33 | 4 | 4 | 0 | Y | EYHYGGATSED | 95.52 | EYEYGGATSED | 1.49 | EYHYGGATSEG | 1.49 | EYHYGGATSEG | 1.49 |
| NS3 | 1981 | 0.33 | 4 | 4 | 0 | Y | YHYGGATSEDD | 95.52 | YEYGGATSEDD | 1.49 | YHYGGATSEGD | 1.49 | YHYGGPTSEDD | 1.49 |
| NS3 | 1982 | 0.45 | 5 | 5 | 0 | Y | HYGGATSEDDS | 94.03 | HYGGATSEDDG | 1.49 | HYGGATSEGDS | 1.49 | HYGGPTSEDDS | 1.49 |
| NS3 | 1983 | 0.33 | 4 | 4 | 0 | Y | YGGATSEDDSN | 95.52 | YGGATSEGDSN | 1.49 | YGGATSEDDGN | 1.49 | YGGPTSEDDSN | 1.49 |
| NS3 | 1984 | 0.33 | 4 | 4 | 0 | Y | GGATSEDDSNL | 95.52 | GGPTSEDDSNL | 1.49 | GGATSEDDGNL | 1.49 | GGATSEGDSNL | 1.49 |
| NS3 | 1985 | 0.33 | 4 | 4 | 0 | Y | GATSEDDSNLA | 95.52 | GATSEDDGNLA | 1.49 | GATSEGDSNLA | 1.49 | GPTSEDDSNLA | 1.49 |
| NS3 | 1986 | 0.33 | 4 | 4 | 0 | Y | ATSEDDSNLAH | 95.52 | ATSEGDSNLAH | 1.49 | ATSEDDGNLAH | 1.49 | | |
| NS3 | 1987 | 0.22 | 3 | 3 | 0 | Y | TSEDDSNLAHW | 97.01 | TSEDDGNLAHW | 1.49 | TSEGDSNLAHW | 1.49 | | |
| NS3 | 1988 | 0.22 | 3 | 3 | 0 | Y | SEDDSNLAHWT | 97.01 | SEDDGNLAHWT | 1.49 | SEGDSNLAHWT | 1.49 | | |
| NS3 | 1989 | 0.22 | 3 | 3 | 0 | Y | EDDSNLAHWTE | 97.01 | EDDGNLAHWTE | 1.49 | EGDSNLAHWTE | 1.49 | | |
| NS3 | 1990 | 0.22 | 3 | 3 | 0 | Y | DDSNLAHWTEA | 97.01 | DDGNLAHWTEA | 1.49 | DDGNLAHWTEA | 1.49 | | |
| NS3 | 1991 | 0.11 | 2 | 2 | 0 | Y | DSNLAHWTEAK | 98.51 | DGNLAHWTEAK | 1.49 | | | | |

FIG. 38-72

Species: JEV (11-mers)

| protein | block starting position | block entropy | total peptides in block | # peptides required to cover 99% of block

FIG. 38-73

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2017 | 0.49 | 3 | 3 | 0 | Y

FIG. 38-74

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99

FIG. 38-75

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2067 | 0.26 | 2 | 2 | 0 | Y | TDRKWCFDGPR | 95.52 | TDRKWCFDGPR | 4.48 | | | | |
| NS3 | 2068 | 0.26 | 2 | 2 | 0 | Y | DRKWCFDGPRT | 95.52 | DRKWCFDGPRT | 4.48 | | | | |
| NS3 | 2069 | 0.26 | 2 | 2 | 0 | Y | RKWCFDGPRTN | 95.52 | RWCFDGPRTN | 4.48 | | | | |
| NS3 | 2070 | 0.26 | 2 | 2 | 0 | Y | KWCFDGPRTNA | 95.52 | RWCFDGPRTNA | 4.48 | | | | |
| NS3 | 2071 | 0 | 1 | 1 | 0 | Y | WCFDGPRTNAI | 100 | | | | | | |
| NS3 | 2072 | 0 | 1 | 1 | 0 | Y | CFDGPRTNAIL | 100 | | | | | | |
| NS3 | 2073 | 0 | 1 | 1 | 0 | Y | FDGPRTNAILE | 100 | | | | | | |
| NS3 | 2074 | 0 | 1 | 1 | 0 | Y | DGPRTNAILED | 100 | | | | | | |
| NS3 | 2075 | 0.11 | 2 | 2 | 0 | Y | GPRTNAILEDN | 98.51 | GPRTNAILEDS | 1.49 | | | | |
| NS3 | 2076 | 0.3 | 3 | 3 | 0 | Y | PRTNAILEDNT | 95.52 | PRTNAILEDNI | 2.99 | PRTNAILEDST | 1.49 | | |
| NS3 | 2077 | 0.3 | 3 | 3 | 0 | Y | RTNAILEDNTE | 95.52 | RTNAILEDNIE | 2.99 | RTNAILEDSTE | 1.49 | | |
| NS3 | 2078 | 0.3 | 3 | 3 | 0 | Y | TNAILEDNTEV | 95.52 | TNAILEDNIEV | 2.99 | TNAILEDSTEV | 1.49 | | |
| NS3 | 2079 | 0.3 | 3 | 3 | 0 | Y | NAILEDNTEVE | 95.52 | NAILEDNIEVE | 2.99 | NAILEDSTEVE | 1.49 | | |
| NS3 | 2080 | 0.3 | 3 | 3 | 0 | Y | AILEDNTEVEI | 95.52 | AILEDNIEVEI | 2.99 | AILEDSTEVEI | 1.49 | | |
| NS3 | 2081 | 0.3 | 3 | 3 | 0 | Y | ILEDNTEVEIV | 95.52 | ILEDNIEVEIV | 2.99 | ILEDSTEVEIV | 1.49 | | |
| NS3 | 2082 | 0.3 | 3 | 3 | 0 | Y | LEDNTEVEIVT | 95.52 | LEDNIEVEIVT | 2.99 | LEDSTEVEIVT | 1.49 | | |
| NS3 | 2083 | 0.3 | 3 | 3 | 0 | Y | EDNTEVEIVTR | 95.52 | EDNIEVEIVTR | 2.99 | EDSTEVEIVTR | 1.49 | | |
| NS3 | 2084 | 0.42 | 4 | 4 | 0 | Y | DNTEVEIVTRM | 94.03 | DNIEVEIVTRM | 2.99 | DSTEVEIVTRM | 1.49 | DNTEVEIVTRT | 1.49 |
| NS3 | 2085 | 0.42 | 4 | 4 | 0 | Y | NTEVEIVTRMG | 94.03 | NIEVEIVTRMG | 2.99 | NTEVEIVTRTG | 1.49 | STEVEIVTRMG | 1.49 |
| NS3 | 2086 | 0.3 | 3 | 3 | 0 | Y | TEVEIVTRMGE | 95.52 | IEVEIVTRMGE | 2.99 | TEVEIVTRTGE | 1.49 | | |
| NS3 | 2087 | 0.11 | 2 | 2 | 0 | Y | EVEIVTRMGER | 98.51 | EVEIVTRTGER | 1.49 | | | | |
| NS3 | 2088 | 0.11 | 2 | 2 | 0 | Y | VEIVTRMGERK | 98.51 | VEIVTRTGERK | 1.49 | | | | |
| NS3 | 2089 | 0.11 | 2 | 2 | 0 | Y | EIVTRMGERKI | 98.51 | EIVTRTGERKV | 1.49 | | | | |
| NS3 | 2090 | 0.11 | 2 | 2 | 0 | Y | IVTRMGERKIL | 98.51 | IVTRTGERKVL | 1.49 | | | | |
| NS3 | 2091 | 0.11 | 2 | 2 | 0 | Y | VTRMGERKILK | 98.51 | VTRTGERKVLK | 1.49 | | | | |

FIG. 38-76

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2092 | 0.11 | 2 | 2 | 0 | Y | TRMGERKILKP | 98.51 | TRTGERKILKP | 1.49 | | | | |
| NS3 | 2093 | 0.11 | 2 | 2 | 0 | Y | RMGERKILKPR | 98.51 | RTGERKILKPR | 1.49 | | | | |
| NS3 | 2094 | 0.11 | 2 | 2 | 0 | Y | MGERKILKPRW | 98.51 | TGERKILKPRW | 1.49 | | | | |
| NS3 | 2095 | 0.11 | 2 | 2 | 0 | Y | GERKILKPRWL | 98.51 | GERKVLKPRWL | 1.49 | | | | |
| NS3 | 2096 | 0.22 | 3 | 3 | 0 | Y | ERKILKPRWLD | 97.01 | ERKVLKPRWLD | 1.49 | ERKILKPRWLY | 1.49 | | |
| NS3 | 2097 | 0.22 | 3 | 3 | 0 | Y | RKILKPRWLDA | 97.01 | RKVLKPRWLYA | 1.49 | RKVLKPRWLDA | 1.49 | | |
| NS3 | 2098 | 0.22 | 3 | 3 | 0 | Y | KILKPRWLDAR | 97.01 | KILKPRWLYAR | 1.49 | KVLKPRWLDAR | 1.49 | | |
| NS3 | 2099 | 0.22 | 3 | 3 | 0 | Y | ILKPRWLDARV | 97.01 | ILKPRWLYARV | 1.49 | VLKPRWLDARV | 1.49 | | |
| NS3 | 2100 | 0.11 | 2 | 2 | 0 | Y | LKPRWLDARVY | 98.51 | LKPRWLYARVY | 1.49 | | | | |
| NS3 | 2101 | 0.11 | 2 | 2 | 0 | Y | KPRWLDARVYA | 98.51 | KPRWLYARVYA | 1.49 | | | | |
| NS3 | 2102 | 0.11 | 2 | 2 | 0 | Y | PRWLDARVYAD | 98.51 | PRWLYARVYAD | 1.49 | | | | |
| NS3 | 2103 | 0.11 | 2 | 2 | 0 | Y | RWLDARVYADH | 98.51 | RWLYARVYADH | 1.49 | | | | |
| NS3 | 2104 | 0.11 | 2 | 2 | 0 | Y | WLDARVYADHQ | 98.51 | WLYARVYADHQ | 1.49 | | | | |
| NS3 | 2105 | 0.11 | 2 | 2 | 0 | Y | LDARVYADHQA | 98.51 | LYARVYADHQA | 1.49 | | | | |
| NS3 | 2106 | 0.11 | 2 | 2 | 0 | Y | DARVYADHQAL | 98.51 | YARVYADHQAL | 1.49 | | | | |
| NS3 | 2107 | 0 | 1 | 1 | 0 | Y | ARVYADHQALK | 100 | | | | | | |
| NS3 | 2108 | 0 | 1 | 1 | 0 | Y | RVYADHQALKW | 100 | | | | | | |
| NS3 | 2109 | 0 | 1 | 1 | 0 | Y | VYADHQALKWF | 100 | | | | | | |
| NS3 | 2110 | 0 | 1 | 1 | 0 | Y | YADHQALKWFK | 100 | | | | | | |
| NS3 | 2111 | 0 | 1 | 1 | 0 | Y | ADHQALKWFKD | 100 | | | | | | |
| NS3 | 2112 | 0 | 1 | 1 | 0 | Y | DHQALKWFKDF | 100 | | | | | | |
| NS3 | 2113 | 0 | 1 | 1 | 0 | Y | HQALKWFKDFA | 100 | | | | | | |
| NS3 | 2114 | 0.11 | 2 | 2 | 0 | Y | QALKWFKDFAA | 98.51 | QALKWFKDFAS | 1.49 | | | | |
| NS3 | 2115 | 0.11 | 2 | 2 | 0 | Y | ALKWFKDFAAG | 98.51 | ALKWFKDFASG | 1.49 | | | | |
| NS3 | 2116 | 0.11 | 2 | 2 | 0 | Y | LKWFKDFAAGK | 98.51 | LKWFKDFASGK | 1.49 | | | | |

FIG. 38-77

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2117 | 0.11 | 2 | 2 | 0 | Y | KWFK

FIG. 38-78

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2142 | 0.11 | 2 | 2 | 0 | Y | HFMGKTREALD | 98.51 | HFAGKTREALD | 1.49 | | | | |
| NS4A | 2143 | 0.11 | 2 | 2 | 0 | Y | FMGKTREALDT | 98.51 | FAGKTREALDT | 1.49 | | | | |
| NS4A | 2144 | 0.11 | 2 | 2 | 0 | Y | MGKTREALDTM | 98.51 | AGKTREALDTM | 1.49 | | | | |
| NS4A | 2145 | 0 | 1 | 1 | 0 | Y | GKTREALDTMY | 100 | | | | | | |
| NS4A | 2146 | 0 | 1 | 1 | 0 | Y | KTREALDTMYL | 100 | | | | | | |
| NS4A | 2147 | 0 | 1 | 1 | 0 | Y | TREALDTMYLV | 100 | | | | | | |
| NS4A | 2148 | 0 | 1 | 1 | 0 | Y | REALDTMYLVA | 100 | | | | | | |
| NS4A | 2149 | 0 | 1 | 1 | 0 | Y | EALDTMYLVAT | 100 | | | | | | |
| NS4A | 2150 | 0 | 1 | 1 | 0 | Y | ALDTMYLVATA | 100 | | | | | | |
| NS4A | 2151 | 0 | 1 | 1 | 0 | Y | LDTMYLVATAE | 100 | | | | | | |
| NS4A | 2152 | 0.19 | 2 | 2 | 0 | Y | DTMYLVATAEK | 97.01 | DTMYLVATAER | 2.99 | | | | |
| NS4A | 2153 | 0.3 | 3 | 3 | 0 | Y | TMYLVATAEKG | 95.52 | TMYLVATAERG | 2.99 | TMYLVATAEKS | 1.49 | | |
| NS4A | 2154 | 0.3 | 3 | 3 | 0 | Y | MYLVATAEKGG | 95.52 | MYLVATAERGG | 2.99 | MYLVATAEKSG | 1.49 | | |
| NS4A | 2155 | 0.3 | 3 | 3 | 0 | Y | YLVATAEKGGK | 95.52 | YLVATAERGGK | 2.99 | YLVATAEKSGK | 1.49 | | |
| NS4A | 2156 | 0.42 | 4 | 4 | 0 | Y | LVATAEKGGKA | 94.03 | LVATAERGGKA | 2.99 | LVATAEKGGKT | 1.49 | LVATAEKSGKA | 1.49 |
| NS4A | 2157 | 0.42 | 4 | 4 | 0 | Y | VATAEKGGKAH | 94.03 | VATAERGGKAH | 2.99 | VATAEKSGKAH | 1.49 | VATAEKGGKTH | 1.49 |
| NS4A | 2158 | 0.42 | 4 | 4 | 0 | Y | ATAEKGGKAHR | 94.03 | ATAERGGKAHR | 2.99 | ATAEKSGKAHR | 1.49 | ATAEKGGKTHR | 1.49 |
| NS4A | 2159 | 0.42 | 4 | 4 | 0 | Y | TAEKGGKAHRM | 94.03 | TAERGGKAHRM | 2.99 | TAEKGGKTHRM | 1.49 | TAEKSGKAHRM | 1.49 |
| NS4A | 2160 | 0.42 | 4 | 4 | 0 | Y | AEKGGKAHRMA | 94.03 | AERGGKAHRMA | 2.99 | AEKSGKAHRMA | 1.49 | AEKGGKTHRMA | 1.49 |
| NS4A | 2161 | 0.42 | 4 | 4 | 0 | Y | EKGGKAHRMAL | 94.03 | ERGGKAHRMAL | 2.99 | EKGGKTHRMAL | 1.49 | EKSGKAHRMAL | 1.49 |
| NS4A | 2162 | 0.42 | 4 | 4 | 0 | Y | KGGKAHRMALE | 94.03 | RGGKAHRMALE | 2.99 | KGGKTHRMALE | 1.49 | KSGKAHRMALE | 1.49 |
| NS4A | 2163 | 0.22 | 3 | 3 | 0 | Y | GGKAHRMALEE | 97.01 | GGKTHRMALEE | 1.49 | SGKAHRMALEE | 1.49 | | |
| NS4A | 2164 | 0.11 | 2 | 2 | 0 | Y | GKAHRMALEEL | 98.51 | GKTHRMALEEL | 1.49 | | | | |
| NS4A | 2165 | 0.11 | 2 | 2 | 0 | Y | KAHRMALEELP | 98.51 | KTHRMALEELP | 1.49 | | | | |
| NS4A | 2166 | 0.11 | 2 | 2 | 0 | Y | AHRMALEELPD | 98.51 | THRMALEELPD | 1.49 | | | | |

FIG. 38-79

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | pept

FIG. 38-80

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2200 | 0.3 | 3 | 3 | 0 | Y | QRKGIGKMGLG | 95.52 | QRKGIGKMGLG | 2.99 | QRKGIEKMGLG | 1.49 | | |
| NS4A | 2201 | 0.3 | 3 | 3 | 0 | Y | RKGIGKMGLGA | 95.52 | RKGIGRMGLGA | 2.99 | RKGI

FIG. 38-81

Species: JEV (11-mers)

| protein | block starting position | block entropy | total peptides in block | # peptides required to cover 99% of block | block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|
| NS4A | 2225 | 0.11 | 2

FIG. 38-82

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4A | 2250 | 0.53 | 5 | 5 | 0 | Y | EKQRSQTDNQL | 92.54 | GKQRSQTDNQL | 2.99 | EKQRLQTDNQL | 1.49 | EKQRSQTGNQL | 1.49 | EKQKSQTDNQL | 1.49 |
| NS4A | 2251 | 0.33 | 4 | 4 | 0 | Y | KQRSQTDNQLA | 95.52 | KQKSQTDNQLA | 1.49 | KQRLQTDNQLA | 1.49 | KQRSQTGNQLA | 1.49 | | |
| NS4A | 2252 | 0.33 | 4 | 4 | 0 | Y | QRSQTDNQLAV | 95.52 | QRLQTDNQLAV | 1.49 | QRSQTGNQLAV | 1.49 | QKSQTDNQLAV | 1.49 | | |
| NS4A | 2253 | 0.33 | 4 | 4 | 0 | Y | RSQTDNQLAVF | 95.52 | KSQTDNQLAVF | 1.49 | RLQTDNQLAVF | 1.49 | RSQTGNQLAVF | 1.49 | | |
| NS4A | 2254 | 0.22 | 3 | 3 | 0 | Y | SQTDNQLAVFL | 97.01 | LQTDNQLAVFL | 1.49 | SQTGNQLAVFL | 1.49 | | | | |
| 2K | 2255 | 0.11 | 2 | 2 | 0 | Y | QTDNQLAVFLI | 98.51 | QTGNQLAVFLI | 1.49 | | | | | | |
| 2K | 2256 | 0.11 | 2 | 2 | 0 | Y | TDNQLAVFLIC | 98.51 | TGNQLAVFLIC | 1.49 | | | | | | |
| 2K | 2257 | 0.11 | 2 | 2 | 0 | Y | DNQLAVFLICV | 98.51 | GNQLAVFLICV | 1.49 | | | | | | |
| 2K | 2258 | 0 | 1 | 1 | 0 | Y | NQLAVFLICVL | 100 | | | | | | | | |
| 2K | 2259 | 0 | 1 | 1 | 0 | Y | QLAVFLICVLT | 100 | | | | | | | | |
| 2K | 2260 | 0 | 1 | 1 | 0 | Y | LAVFLICVLTV | 100 | | | | | | | | |
| 2K | 2261 | 0 | 1 | 1 | 0 | Y | AVFLICVLTVW | 100 | | | | | | | | |
| 2K | 2262 | 0 | 1 | 1 | 0 | Y | VFLICVLTVWG | 100 | | | | | | | | |
| 2K | 2263 | 0.11 | 2 | 2 | 0 | Y | FLICVLTVWGV | 98.51 | FLICVLTVWGM | 1.49 | | | | | | |
| 2K | 2264 | 0.22 | 3 | 3 | 0 | Y | LICVLTVWGVV | 97.01 | LICVLTVWGMV | 1.49 | LICVLTVWGVA | 1.49 | | | | |
| 2K | 2265 | 0.22 | 3 | 3 | 0 | Y | ICVLTVWGVVA | 97.01 | ICVLTVWGMVA | 1.49 | ICVLTVWGVAA | 1.49 | | | | |
| 2K | 2266 | 0.22 | 3 | 3 | 0 | Y | CVLTVWGVVAA | 97.01 | CVLTVWGMVAA | 1.49 | CVLTVWGVAAA | 1.49 | | | | |
| 2K | 2267 | 0.22 | 3 | 3 | 0 | Y | VLTVWGVVAAN | 97.01 | VLTVWGMVAAN | 1.49 | VLTVWGVAAAN | 1.49 | | | | |
| 2K | 2268 | 0.22 | 3 | 3 | 0 | Y | LTVWGVVAANE | 97.01 | LTVWGMVAANE | 1.49 | LTVWGVAAANE | 1.49 | | | | |
| 2K | 2269 | 0.22 | 3 | 3 | 0 | Y | TVWGVVAANEY | 97.01 | TVWGMVAANEY | 1.49 | TVWGVAAANEY | 1.49 | | | | |
| 2K | 2270 | 0.22 | 3 | 3 | 0 | Y | VWGVVAANEYG | 97.01 | VWGMVAANEYG | 1.49 | VWGVAAANEYG | 1.49 | | | | |
| 2K | 2271 | 0.22 | 3 | 3 | 0 | Y | VGVVAANEYGM | 97.01 | VGMVAANEYGM | 1.49 | VGVAAANEYGM | 1.49 | | | | |
| 2K | 2272 | 0.22 | 3 | 3 | 0 | Y | GVVAANEYGML | 97.01 | GMVAANEYGML | 1.49 | GVAAANEYGML | 1.49 | | | | |
| 2K | 2273 | 0.22 | 3 | 3 | 0 | Y | VVAANEYGMLE | 97.01 | MVAANEYGMLE | 1.49 | VAAANEYGMLE | 1.49 | | | | |
| 2K | 2274 | 0.23 | 3 | 3 | 1.49 | Y | VAANEYGMLEK | 95.52 | AAANEYGMLEK | 1.49 | VAANEYGMLER | 1.49 | | | | |

FIG. 38-83

Species: JEV (11-mers)

| protein | block starting position | block entropy | total peptides in block | # peptides required to cover 99% of block | block 99% gap/X fraction | covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| 2K | 2275 | 0.11 | 2 | 2 | 1.49 | Y | AANEYGMLEKT | 97.01 | AANEYGMLERT | 1.49 | | | | |
| 2K | 2276 | 0.11 | 2 | 2 | 1.49 | Y | ANEYGMLEKTIK | 97.01 | ANEYGMLERTIK | 1.49 | | | | |
| NS4B | 2277 | 0.11 | 2 | 2 | 1.49 | Y | NEYGMLEKTKA | 97.01 | NEYGMLERTKA | 1.49 | | | | |
| NS4B | 2278 |

FIG. 38-84

Species: JEV (11-mers)

| protein | block starting position | block entropy | total peptides in block | # peptides required to cover 99% of block | gap/X fraction | 99% of block covered w/ <=5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2312 | 0.11 | 2 | 2 | 0 | Y | LRPATAWALYG | 98.51 | LRPATAWAWYG | 1.49 | | | | |
| NS4B | 2313 | 0.11 | 2 | 2 | 0 | Y | RPATAWALYGG | 98.51 | RPATAWAWYGG | 1.49 | | | | |
| NS4B | 2314 | 0.11 | 2 | 2 | 0 | Y | PATAWALYGGS | 98.51 | PATAWAWYGGS | 1.49 | | | | |
| NS4B | 2315 | 0.11 | 2 | 2 | 0 | Y | ATAWALYGGST | 98.51 | ATAWAWYGGST | 1.49 | | | | |
| NS4B | 2316 | 0.11 | 2 | 2 | 0 | Y | TAWALYGGSTV | 98.51 | TAWAWYGGSTV | 1.49 | | | | |
| NS4B | 2317 | 0.11 | 2 | 2 | 0 | Y | AWALYGGSTVW | 98.51 | AWAWYGGSTVW | 1.49 | | | | |
| NS4B | 2318 | 0.11 | 2 | 2 | 0 | Y | WALYGGSTVWL | 98.51 | WAWYGGSTVWL | 1.49 | | | | |
| NS4B | 2319 | 0.11 | 2 | 2 | 0 | Y | ALYGGSTVWLT | 98.51 | AWYGGSTVWLT | 1.49 | | | | |
| NS4B | 2320 | 0.11 | 2 | 2 | 0 | Y | LYGGSTVWLTP | 98.51 | WYGGSTVWLTP | 1.49 | | | | |
| NS4B | 2321 | 0 | 1 | 1 | 0 | Y | YGGSTVWLTPL | 100 | | | | | | |
| NS4B | 2322 | 0 | 1 | 1 | 0 | Y | GGSTVWLTPLL | 100 | | | | | | |
| NS4B | 2323 | 0 | 1 | 1 | 0 | Y | GSTVWLTPLLK | 100 | | | | | | |
| NS4B | 2324 | 0 | 1 | 1 | 0 | Y | STVWLTPLLKH | 100 | | | | | | |
| NS4B | 2325 | 0.11 | 2 | 2 | 0 | Y | TVWLTPLLKHL | 98.51 | TVWLTPLLKHI | 1.49 | | | | |
| NS4B | 2326 | 0.11 | 2 | 2 | 0 | Y | VWLTPLLKHLI | 98.51 | VWLTPLLKHII | 1.49 | | | | |
| NS4B | 2327 | 0.11 | 2 | 2 | 0 | Y | VLTPLLKHLIT | 98.51 | VLTPLLKHIIT | 1.49 | | | | |
| NS4B | 2328 | 0.11 | 2 | 2 | 0 | Y | LTPLLKHLITS | 98.51 | LTPLLKHIITS | 1.49 | | | | |
| NS4B | 2329 | 0.11 | 2 | 2 | 0 | Y | TPLLKHLITSE | 98.51 | TPLLKHIITSE | 1.49 | | | | |
| NS4B | 2330 | 0.11 | 2 | 2 | 0 | Y | PLLKHLITSEY | 98.51 | PLLKHIITSEY | 1.49 | | | | |
| NS4B | 2331 | 0.11 | 2 | 2 | 0 | Y | LLKHLITSEYV | 98.51 | LLKHIITSEYV | 1.49 | | | | |
| NS4B | 2332 | 0.11 | 2 | 2 | 0 | Y | LKHLITSEYVT | 98.51 | LKHIITSEYVT | 1.49 | | | | |
| NS4B | 2333 | 0.22 | 3 | 3 | 0 | Y | KHLITSEYVTT | 97.01 | KHLITSEYVTP | 1.49 | KHIITSEYVTT | 1.49 | | |
| NS4B | 2334 | 0.22 | 3 | 3 | 0 | Y | HLITSEYVTTS | 97.01 | HLITSEYVTPS | 1.49 | HLITSEYVTPS | 1.49 | | |
| NS4B | 2335 | 0.22 | 3 | 3 | 0 | Y | LITSEYVTTSL | 97.01 | LITSEYVTPSL | 1.49 | LITSEYVTPSL | 1.49 | | |
| NS4B | 2336 | 0.11 | 2 | 2 | 0 | Y | ITSEYVTTSLA | 98.51 | ITSEYVTPSLA | 1.49 | | | | |

FIG. 38-85

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2337 | 0.11 | 2 | 2 | 0 | Y | TSEVVTSLA

FIG. 38-86

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2362 | 0.19 | 2 | 2 | 0 | Y | VPFTD

FIG. 38-87

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2393 | 1.13 | 5 | 5 | 0 | Y | LATL

FIG. 38-88

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2418 | 0 | 1 | 1 | 0 | Y | AAGIMKNAVW

FIG. 38-89

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2443 | 0.11 | 2 | 2 | 0 | Y | PLMQKKVGQVL | 98.51 | PLMQKKIGQVL | 1.49 | | | | |
| NS4B | 2444 | 0.11 | 2 | 2 | 0 | Y | LMQKKVGQVL

FIG. 38-90

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2468 | 0.33 | 4 | 4 | 0 | Y | VTTVREAGVLV | 95.52 |

FIG. 38-91

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2493 | 0.11 | 2 | 2 | 0 | Y | VWNSTTATGLC | 98.51 | AWNSTTATGLC | 1.49 | | | | |
| NS4B | 2494 | 0 | 1 | 1 | 0 | Y | WNSTTATGLCH | 100 | | | | | | |
| NS4B | 2495 | 0 | 1 | 1 | 0 | Y | NSTTATGL

FIG. 38-92

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2518 | 0.22 | 3 | 3 | 0 | Y | WTLIKNADKPS | 97.01 | W

FIG. 38-93

Species: JEV (11-mers)

| protein | block starting position | block entropy (11-mers) | total peptides in block | # peptides required to cover 99% of block | gap/X fraction | 99% of block covered w/ <= 5 peptides? | peptides required to cover 99% of block

FIG. 38-94

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2575 | 0.65 | 4 | 4 | 0 | Y | RRENNIVGGHP | 88.06 | RRENNVVGGHP | 8.96 | RSENNIVGGHP | 1.49 | RRENNKVGGHP | 1.49 |
| NS5 | 2576 | 0.65 | 4 | 4 | 0 | Y | RENNIVGGHPV | 88.06 | RENNVVGGHPV | 8.96 | RENNKVGGHPV | 1.49 | SENNIVGGHPV | 1.49 |
| NS5 | 2577 | 0.54 | 3 | 3 | 0 | Y | ENNIVGGHPVS | 89.55 | ENNVVGGHPVS | 8.96 | ENNKVGGHPVS | 1.49 | | |
| NS5 | 2578 | 0.54 | 3 | 3 | 0 | Y | NNIVGGHPVSR | 89.55 | NNVVGGHPVSR | 8.96 | NNKVGGHPVSR | 1.49 | | |
| NS5 | 2579 | 0.54 | 3 | 3 | 0 | Y | NIVGGHPVSRG | 89.55 | NVVGGHPVSRG | 8.96 | NKVGGHPVSRG | 1.49 | | |
| NS5 | 2580 | 0.54 | 3 | 3 | 0 | Y | IVGGHPVSRGS | 89.55 | VVGGHPVSRGS | 8.96 | KVGGHPVSRGS | 1.49 | | |
| NS5 | 2581 | 0 | 1 | 1 | 0 | Y | VGGHPVSRGSA | 100 | | | | | | |
| NS5 | 2582 | 0 | 1 | 1 | 0 | Y | GGHPVSRGSAK | 100 | | | | | | |
| NS5 | 2583 | 0 | 1 | 1 | 0 | Y | GHPVSRGSAKL | 100 | | | | | | |
| NS5 | 2584 | 0 | 1 | 1 | 0 | Y | HPVSRGSAKLR | 100 | | | | | | |
| NS5 | 2585 | 0 | 1 | 1 | 0 | Y | PVSRGSAKLRW | 100 | | | | | | |
| NS5 | 2586 | 0 | 1 | 1 | 0 | Y | VSRGSAKLRWL | 100 | | | | | | |
| NS5 | 2587 | 0 | 1 | 1 | 0 | Y | SRGSAKLRWLV | 100 | | | | | | |
| NS5 | 2588 | 0 | 1 | 1 | 0 | Y | RGSAKLRWLVE | 100 | | | | | | |
| NS5 | 2589 | 0 | 1 | 1 | 0 | Y | GSAKLRWLVEK | 100 | | | | | | |
| NS5 | 2590 | 0 | 1 | 1 | 0 | Y | SAKLRWLVEKG | 100 | | | | | | |
| NS5 | 2591 | 0 | 1 | 1 | 0 | Y | AKLRWLVEKGF | 100 | | | | | | |
| NS5 | 2592 | 0 | 1 | 1 | 0 | Y | KLRWLVEKGFV | 100 | | | | | | |
| NS5 | 2593 | 0.11 | 2 | 2 | 0 | Y | LRWLVEKGFVS | 98.51 | LRWLVEKGFVP | 1.49 | | | | |
| NS5 | 2594 | 0.11 | 2 | 2 | 0 | Y | RWLVEKGFVSP | 98.51 | RWLVEKGFVPP | 1.49 | | | | |
| NS5 | 2595 | 0.11 | 2 | 2 | 0 | Y | WLVEKGFVSPI | 98.51 | WLVEKGFVPPI | 1.49 | | | | |
| NS5 | 2596 | 0.11 | 2 | 2 | 0 | Y | LVEKGFVSPIG | 98.51 | LVEKGFVPPIG | 1.49 | | | | |
| NS5 | 2597 | 0.11 | 2 | 2 | 0 | Y | VEKGFVSPIGK | 98.51 | VEKGFVPPIGK | 1.49 | | | | |
| NS5 | 2598 | 0.11 | 2 | 2 | 0 | Y | EKGFVSPIGKV | 98.51 | EKGFVPPIGKV | 1.49 | | | | |
| NS5 | 2599 | 0.22 | 3 | 3 | 0 | Y | KGFVSPIGKVI | 97.01 | KGFVPPIGKVI | 1.49 | KGFVSPIGKVV | 1.49 | | |

FIG. 38-95

Species: JEV (11-mers)

| protein | block starting position | block entropy | total peptides in block | # peptides required to cover 99% of block | gap/X f

FIG. 38-96

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2625 | 0.86 | 4 | 4 | 0

FIG. 38-97

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2650 | 0.44 | 3 | 3 | 0 | Y | YGWNLVSLKSG | 92.54 | YGRNLVSLKSG | 5.97 | YGWNLVSMKSG | 1.49 | | |
| NS5 | 2651 | 0.44 | 3 | 3 | 0 | Y | GWNLVSLKSGV | 92.54 | GRNLVSLKSGV | 5.97 | GWNLVSMKSGV | 1.49 | | |
| NS5 | 2652 | 0.55 | 4 | 4 | 0 | Y | WNLVSLKSGVD | 91.04 | RNLVSLKSGVD | 5.97 | WNLVSMKSGVD | 1.49 | WNLVSLKSGVH | 1.49 |
| NS5 | 2653 | 0.22 | 3 | 3 | 0 | Y | NLVSLKSGVDV | 97.01 | NLVSMKSGVDV | 1.49 | NLVSLKSGVHV | 1.49 | | |
| NS5 | 2654 | 0.22 | 3 | 3 | 0 | Y | LVSLKSGVDVF | 97.01 | LVSMKSGVDVF | 1.49 | LVSLKSGVHVF | 1.49 | | |
| NS5 | 2655 | 0.22 | 3 | 3 | 0 | Y | VSLKSGVDVFY | 97.01 | VSMKSGVDVFY | 1.49 | VSLKSGVHVFY | 1.49 | | |
| NS5 | 2656 | 0.33 | 4 | 4 | 0 | Y | SLKSGVDVFYR | 95.52 | SMKSGVDVFYR | 1.49 | SLKSGVHVFYK | 1.49 | SLKSGVHVFYK | 1.49 |
| NS5 | 2657 | 0.33 | 4 | 4 | 0 | Y | LKSGVDVFYKP | 95.52 | MKSGVDVFYKP | 1.49 | LKSGVDVFYRP | 1.49 | LKSGVHVFYKP | 1.49 |
| NS5 | 2658 | 0.22 | 3 | 3 | 0 | Y | KSGVDVFYKPS | 97.01 | KSGVDVFYRPS | 1.49 | KSGVHVFYKPS | 1.49 | | |
| NS5 | 2659 | 0.22 | 3 | 3 | 0 | Y | SGVDVFYKPSE | 97.01 | SGVDVFYRPSE | 1.49 | SGVHVFYKPSE | 1.49 | | |
| NS5 | 2660 | 0.22 | 3 | 3 | 0 | Y | GVDVFYKPSEP | 97.01 | GVDVFYRPSEP | 1.49 | GVHVFYKPSEP | 1.49 | | |
| NS5 | 2661 | 0.22 | 3 | 3 | 0 | Y | VDVFYKPSEPS | 97.01 | VDVFYRPSEPS | 1.49 | VHVFYKPSEPS | 1.49 | | |
| NS5 | 2662 | 0.22 | 3 | 3 | 0 | Y | DVFYKPSEPSD | 97.01 | HVFYKPSEPSD | 1.49 | DVFYRPSEPSD | 1.49 | | |
| NS5 | 2663 | 0.11 | 2 | 2 | 0 | Y | VFYKPSEPSDT | 98.51 | VFYRPSEPSDT | 1.49 | | | | |
| NS5 | 2664 | 0.11 | 2 | 2 | 0 | Y | FYKPSEPSDTL | 98.51 | FYRPSEPSDTL | 1.49 | | | | |
| NS5 | 2665 | 0.11 | 2 | 2 | 0 | Y | YKPSEPSDTLF | 98.51 | YRPSEPSDTLL | 1.49 | | | | |
| NS5 | 2666 | 0.11 | 2 | 2 | 0 | Y | KPSEPSDTLFC | 98.51 | RPSEPSDTLLC | 1.49 | | | | |
|

FIG. 38-98

Species: JEV (11-mers)

| protein | block starting position | block entropy | total peptides in block | # peptides required to cover 99% of block | gap/X fraction | 99% of block covered w/ <= 5 pe

FIG. 38-99

Species: JEV (11-mers)

| protein | block starting position | block entropy | total peptides in block | #

FIG. 38-100

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides

FIG. 38-101

Species: JEV (11-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2750 | 0.11 | 2 | 2 | 0 | Y | MYWVSGAAGNV | 98.51 | MYWVSGPAGNV | 1.49 | | | | |
| NS5 | 2751 | 0.11 | 2 | 2 | 0 | Y | YWVSGAAGNVW | 98.51 | YWVSGPAGNVW | 1.49 | | | | |
| NS5 | 2752 | 0.11 | 2 | 2 | 0 | Y | WVSGAAGNVWH | 98.51 | WVSGPAGNVWH | 1.49 | | | | |
| NS5 | 2753 | 0.11 | 2 | 2 | 0 | Y | VSGAAGNVWHA | 98.51 | VSGPAGNVWHA | 1.49 | | | | |
| NS5 | 2754 | 0.11 | 2 | 2 | 0 | Y | SGAAGNVWHAV | 98.51 | SGPAGNVWHAV | 1.49 | | | | |
| NS5 | 2755 | 0.11 | 2 | 2 | 0 | Y | GAAGNVWHAVN | 98.51 | GPAGNVWHAVN | 1.49 | | | | |
| NS5 | 2756 | 0.11 | 2 | 2 | 0 | Y | AAGNVWHAVNM | 98.51 | PAGNVWHAVNM | 1.49 | | | | |
| NS5 | 2757 | 0 | 1 | 1 | 0 | Y | AGNVWHAVNMT | 100 | | | | | | |
| NS5 | 2758 | 0 | 1 | 1 | 0 | Y | GNVWHAVNMTS | 100 | | | | | | |
| NS5 | 2759 | 0 | 1 | 1 | 0 | Y | NVWHAVNMTSQ | 100 | | | | | | |
| NS5 | 2760 | 0 | 1 | 1 | 0 | Y | VWHAVNMTSQV | 100 | | | | | | |
| NS5 | 2761 | 0 | 1 | 1 | 0 | Y | WHAVNMTSQVL | 100 | | | | | | |
| NS5 | 2762 | 0 | 1 | 1 | 0 | Y | HAVNMTSQVLL | 100 | | | | | | |
| NS5 | 2763 | 0 | 1 | 1 | 0 | Y | AVNMTSQVLLG | 100 | | | | | | |
| NS5 | 2764 | 0 | 1 | 1 | 0 | Y | VNMTSQVLLGR | 100 | | | | | | |
| NS5 | 2765 | 0 | 1 | 1 | 0 | Y | NMTSQVLLGRM | 100 | | | | | | |
| NS5 | 2766 | 0.11 | 2 | 2 | 0 | Y | MTSQVLLGRMD | 98.51 | MTSQVLLGRMN | 1.49 | | | | |
| NS5 | 2767 | 0.11 | 2 | 2 | 0 | Y | TSQVLLGRMDR | 98.51 | TSQVLLGRMNR | 1.49 | | | | |
| NS5 | 2768 | 0.22 | 3 | 3 | 0 | Y | SQVLLGRMDRT | 97.01 | SQVLLGRMDRA | 1.49 | SQVLLGRMNRT | 1.49 | | |
| NS5 | 2769 | 0.22 | 3 | 3 | 0 | Y | QVLLGRMDRTV | 97.01 | QVLLGRMNRTV | 1.49 | QVLLGRMDRAV | 1.49 | | |
| NS5 | 2770 | 0.22 | 3 | 3 | 0 | Y | VLLGRMDRTVW | 97.01 | VLLGRMDRAVW | 1.49 | VLLGRMNRTVW | 1.49 | | |
| NS5 | 2771 | 0.22 | 3 | 3 | 0 | Y | LLGRMDRTVWR | 97.01 | LLGRMNRTVWR | 1.49 | LLGRMDRAVWR | 1.49 | | |
| NS5 | 2772 | 0.22 | 3 | 3 | 0 | Y | LGRMDRTVWRG | 97.01 | LGRMNRTVWRG | 1.49 | LGRMDRAVWRG | 1.49 | | |
| NS5 | 2773 | 0.22 | 3 | 3 | 0 | Y | GRMDRTVWRGP | 97.01 | GRMDRAVWRGP | 1.49 | GRMNRTVWRGP | 1.49 | | |
| NS5 | 2774 | 0.33 | 4 | 4 | 0 | Y | RMDRTVWRGPK | 95.52 | RMDRAVWRGPK | 1.49 | RMNRTVWRGPK | 1.49 | RMDRTVWRGPR | 1.49 |

FIG. 38-102

Species: JEV (11-mers)

| protein | block starting position | block entropy | total

FIG. 38-103

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 38-104

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required

FIG. 38-105

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2864 | 0.22 | 3 | 3 | 0 | Y | PWDA

FIG. 38-106

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 2889 | 0.22 | 3 | 3 | 0 | Y | KEKVDTKAPEP | 97.01 | KEKVGTKAPEP | 1.49 | KEKVGTMAPEP | 1.49 |
| NS5 | 2890 | 0.22 | 3 | 3 | 0 | Y | EKVDTKAPEPP | 97.01 | EKVGTKAPEPP | 1.49 | EKVGTMAPEPP | 1.49 |
| NS5 | 2902 | 0.9 | 3 | 3 | 0 | Y | GAKEVLNETTN | 74.63 | GVKEVLNETTN | 23.88 | GVREVLNETTN | 1.49 |
| NS5 | 2903 | 0.9 | 3 | 3 | 0 | Y | AKEVLNETTNW | 74.63 | VKEVLNETTNW | 23.88 | VREVLNETTNW | 1.49 |
| NS5 | 2904 | 0.11 | 2 | 2 | 0 | Y | KEVLNETTNWL | 98.51 | REVLNETTNWL | 1.49 | | |
| NS5 | 2905 | 0 | 1 | 1 | 0 | Y | EVLNETTNWLW | 100 | | | | |
| NS5 | 2906 | 0 | 1 | 1 | 0 | Y | VLNETTNWLWA | 100 | | | | |
| NS5 | 2907 | 0.93 | 2 | 2 | 0 | Y | LNETTNWLWAH | 65.67 | LNETTNWLWAY | 34.33 | | |
| NS5 | 2908 | 0.93 | 2 | 2 | 0 | Y | NETTNWLWAHL | 65.67 | NETTNWLWAYL | 34.33 | | |
| NS5 | 2909 | 0.93 | 2 | 2 | 0 | Y | ETTNWLWAHLS | 65.67 | ETTNWLWAYLS | 34.33 | | |
| NS5 | 2910 | 0.93 | 2 | 2 | 0 | Y | TTNWLWAHLSR | 65.67 | TTNWLWAYLSR | 34.33 | | |
| NS5 | 2911 | 1.03 | 3 | 3 | 0 | Y | TNWLWAHLSRE | 64.18 | TNWLWAYLSRE | 34.33 | TNWLWAHLSRK | 1.49 |
| NS5 | 2912 | 1.03 | 3 | 3 | 0 | Y | NWLWAHLSREK | 64.18 | NWLWAYLSREK | 34.33 | NWLWAHLSRKK | 1.49 |
| NS5 | 2913 | 1.03 | 3 | 3 | 0 | Y | WLWAHLSREKR | 64.18 | WLWAYLSREKR | 34.33 | WLWAHLSRKKR | 1.49 |
| NS5 | 2914 | 1.03 | 3 | 3 | 0 | Y | LWAHLSREKRP | 64.18 | LWAYLSREKRP | 34.33 | LWAHLSRKKRP | 1.49 |
| NS5 | 2915 | 1.03 | 3 | 3 | 0 | Y | WAHLSREKRPR | 64.18 | WAYLSREKRPR | 34.33 | WAHLSRKKRPR | 1.49 |
| NS5 | 2916 | 1.03 | 3 | 3 | 0 | Y | AHLSREKKRPL | 64.18 | AYLSREKKRPL | 34.33 | AHLSRKKRPRL | 1.49 |
| NS5 | 2917 | 1.03 | 3 | 3 | 0 | Y | HLSREKRPRLC | 64.18 | YLSREKRPRLC | 34.33 | HLSRKKRPRLC | 1.49 |
| NS5 | 2918 | 0.11 | 2 | 2 | 0 | Y | LSREKRPRLCT | 98.51 | LSRKKRPRLCT | 1.49 | | |
| NS5 | 2919 | 0.11 | 2 | 2 | 0 | Y | SREKRPRLCTK | 98.51 | SRKKRPRLCTK | 1.49 | | |
| NS5 | 2920 | 0.11 | 2 | 2 | 0 | Y | REKRPRLCTKE | 98.51 | RKKRPRLCTKE | 1.49 | | |
| NS5 | 2921 | 0.11 | 2 | 2 | 0 | Y | EKRPRLCTKEE | 98.51 | KKRPRLCTKEE | 1.49 | | |
| NS5 | 2922 | 0 | 1 | 1 | 0 | Y | KRPRLCTKEEF | 100 | | | | |
| NS5 | 2923 | 0 | 1 | 1 | 0 | Y | RPRLCTKEEFI | 100 | | | | |
| NS5 | 2924 | 0.3 | 3 | 3 | 0 | Y | PRLCTKEEFIK | 95.52 | PRLCTKEEFIR | 2.99 | PRLCTKEEFIN | 1.49 |

FIG. 38-107

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | pe

FIG. 38-108

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2965 | 0.92 | 4 | 4 | 0 | Y | WEMDEERENH | 77.61 | WEMVNEERENH | 19.4 | WEIVDEERENH | 1.49 | WEMVDVERENH | 1.49 | | |
| NS5 | 2966 | 0.92 | 4 | 4 | 0 | Y | EMDEERENHL | 77.61 | EMVNEERENHL | 19.4 | EIVDEERENHL | 1.49 | EMVDVERENHL | 1.49 | | |
| NS5 | 2967 | 0.92 | 4 | 4 | 0 | Y | MVDEERENHLR | 77.61 | MVNEERENHLR | 19.4 | IVDEERENHLR | 1.49 | MVDVERENHLR | 1.49 | | |
| NS5 | 2968 | 0.82 | 3 | 3 | 0 | Y | VDEERENHLRG | 79.1 | VNEERENHLRG | 19.4 | VDVERENHLRG | 1.49 | | | | |
| NS5 | 2969 | 0.82 | 3 | 3 | 0 | Y | DEERENHLRGE | 79.1 | NEERENHLRGE | 19.4 | DVERENHLRGE | 1.49 | | | | |
| NS5 | 2970 | 0.11 | 2 | 2 | 0 | Y | EERENHLRGEC | 98.51 | VERENHLRGEC | 1.49 | | | | | | |
| NS5 | 2971 | 0 | 1 | 1 | 0 | Y | ERENHLRGECH | 100 | | | | | | | | |
| NS5 | 2972 | 0 | 1 | 1 | 0 | Y | RENHLRGECHT | 100 | | | | | | | | |
| NS5 | 2973 | 0.11 | 2 | 2 | 0 | Y | ENHLRGECHTC | 98.51 | ENHLRGECHTR | 1.49 | | | | | | |
| NS5 | 2974 | 0.37 | 3 | 3 | 0 | Y | NHLRGECHTCI | 94.03 | NHLRGECHTCV | 4.48 | NHLRGECHTRI | 1.49 | | | | |
| NS5 | 2975 | 0.37 | 3 | 3 | 0 | Y | HLRGECHTCIY | 94.03 | HLRGECHTCVY | 4.48 | HLRGECHTRIY | 1.49 | | | | |
| NS5 | 2976 | 0.42 | 4 | 4 | 0 | Y | LRGECHTCIYN | 94.03 | LRGECHTCVYN | 2.99 | LRGECHTCVYH | 1.49 | LRGECHTRIYN | 1.49 | | |
| NS5 | 2977 | 0.42 | 4 | 4 | 0 | Y | RGECHTCIYNM | 94.03 | RGECHTCVYNM | 2.99 | RGECHTCVYHM | 1.49 | RGECHTRIYNM | 1.49 | | |
| NS5 | 2978 | 0.42 | 4 | 4 | 0 | Y | GECHTCIYNMM | 94.03 | GECHTCVYNMM | 2.99 | GECHTCVYHMM | 1.49 | GECHTRIYNMM | 1.49 | | |
| NS5 | 2979 | 0.42 | 4 | 4 | 0 | Y | ECHTCIYNMMG | 94.03 | ECHTCVYNMMG | 2.99 | ECHTCVYHMM | 1.49 | ECHTRIYNMMG | 1.49 | | |
| NS5 | 2980 | 0.42 | 4 | 4 | 0 | Y | CHTCIYNMMGK | 94.03 | CHTCVYNMMGK | 2.99 | CHTCVYHMMG | 1.49 | CHTRIYNMMGK | 1.49 | | |
| NS5 | 2981 | 0.42 | 4 | 4 | 0 | Y | HTCIYNMMGKR | 94.03 | HTCVYNMMGKR | 2.99 | HTCVYHMMGKR | 1.49 | HTRIYNMMGKR | 1.49 | | |
| NS5 | 2982 | 0.42 | 4 | 4 | 0 | Y | TCIYNMMGKRE | 94.03 | TCVYNMMGKRE | 2.99 | TCVYHMMGKRE | 1.49 | TRIYNMMGKRE | 1.49 | | |
| NS5 | 2983 | 0.42 | 4 | 4 | 0 | Y | CIYNMMGKREK | 94.03 | CVYNMMGKREK | 2.99 | CVYHMMGKREK | 1.49 | RIYNMMGKREK | 1.49 | | |
| NS5 | 2984 | 0.3 | 3 | 3 | 0 | Y | IYNMMGKREKK | 95.52 | VYNMMGKREKK | 2.99 | VYHMMGKREKK | 1.49 | | | | |
| NS5 | 2985 | 0.11 | 2 | 2 | 0 | Y | YNMMGKREKKP | 98.51 | YHMMGKREKKP | 1.49 | | | | | | |
| NS5 | 2986 | 0.11 | 2 | 2 | 0 | Y | NMMGKREKKPG | 98.51 | HMMGKREKKPG | 1.49 | | | | | | |
| NS5 | 2987 | 0 | 1 | 1 | 0 | Y | MMGKREKKPGE | 100 | | | | | | | | |
| NS5 | 2988 | 0 | 1 | 1 | 0 | Y | MGKREKKPGEF | 100 | | | | | | | | |
| NS5 | 2989 | 0 | 1 | 1 | 0 | Y | GKREKKPGEFG | 100 | | | | | | | | |

FIG. 38-109

Species: JEV (11-mers)

| protein | block starting position | block entropy | total peptides in block | # peptides required to cover 99% of block | gap/

FIG. 38-110

Species: JEV (11-mers)

| protein | block starting position | block entropy | total peptides in block | # peptides required to cover 99% of block | gap/x fraction | 99% of block covered w/ <= 5 peptides? | peptides required to cover 99% of block | frequency | peptides

FIG. 38-111

Species: JEV (11-mers)

| protein | block

FIG. 38-112

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

FIG. 38-113

Species: JEV (11-mers)

| protein | block starting position | block

FIG. 38-114

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3131 | 0.11 | 2 | 2 | 0 | Y | DQR

FIG. 38-115

Species: JEV (11-mers)

| protein | block starting position | block entropy | total peptides in block | # peptides required to cover 99% of block | block gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3156 | 0.22 | 3 | 3 | 0 | Y | LMEAEGVIGPQ | 97.01 | LMKVEGVIGPQ | 1.49 | | | | |
| NS5 | 3157 | 0.22 | 3 | 3 | 0 | Y | MEAEGVIGPQH | 97.01 | MKVEGVIGPQH | 1.49 | VEAEGVIGPQH | 1.49 | | |
| NS5 | 3158 | 0.22 | 3 | 3 | 0 | Y | EAEGVIGPQHL | 97.01 | KVEGVIGPQHL | 1.49 | EAEGVIGPQHV | 1.49 | | |
| NS5 | 3159 | 0.22 | 3 | 3 | 0 | Y | AEGVIGPQHLE | 97.01 | VEGVIGPQHLE | 1.49 | AEGVIGPQHVE | 1.49 | | |
| NS5 | 3160 | 0.22 | 3 | 3 | 0 | Y | EGVIGPQHLEQ | 97.01 | EGVIGPQHLEH | 1.49 | EGVIGPQHVEQ | 1.49 | | |
| NS5 | 3161 | 0.22 | 3 | 3 | 0 | Y | GVIGPQHLEQL | 97.01 | GVIGPQHLEHL | 1.49 | GVIGPQHVEQL | 1.49 | | |
| NS5 | 3162 | 0.22 | 3 | 3 | 0 | Y | VIGPQHLEQLP | 97.01 | VIGPQHLEHLP | 1.49 | VIGPQHVEQLP | 1.49 | | |
| NS5 | 3163 | 0.33 | 4 | 4 | 0 | Y | IGPQHLEQLPR | 95.52 | IGPQHLEQLPK | 1.49 | IGPQHVEQLPK | 1.49 | IGPQHLEHLPR | 1.49 |
| NS5 | 3164 | 0.45 | 5 | 5 | 0 | Y | GPQHLEQLPRK | 94.03 | GPQHLEQLPRE | 1.49 | GPQHLEHLPRK | 1.49 | GPQHVEQLPRK | 1.49 |
| NS5 | 3169 | 1.06 | 5 | 5 | 0 | Y | EQLPRKNKIAV | 74.63 | EHLPRKNKIAV | 1.49 | EQLPRENKIAV | 1.49 | EQLPKKNKIAV | 1.49 |
| NS5 | 3170 | 1.06 | 5 | 5 | 0 | Y | QLPRKNKIAVR | 74.63 | HLPRKNKIAVR | 1.49 | QLPRENKIAVR | 1.49 | QLPKKNKIAVR | 1.49 |
| NS5 | 3171 | 0.95 | 4 | 4 | 0 | Y | LPRKNKIAVRT | 76.12 | LPRENKIAVRT | 1.49 | LPKKNKIAVRT | 1.49 | | |
| NS5 | 3172 | 0.95 | 4 | 4 | 0 | Y | PRKNKIAVRTW | 76.12 | PRKTKIAVRTW | 20.9 | PRENKIAVRTW | 1.49 | PKKNKIAVRTW | 1.49 |
| NS5 | 3173 | 0.95 | 4 | 4 | 0 | Y | RKNKIAVRTWL | 76.12 | RKTKIAVRTWL | 20.9 | RENKIAVRTWL | 1.49 | KKNKIAVRTWL | 1.49 |
| NS5 | 3174 | 0.85 | 3 | 3 | 0 | Y | KNKIAVRTWLF | 77.61 | KTKIAVRTWLF | 20.9 | | | KNKIAVRTWL | 1.49 |
| NS5 | 3175 | 0.74 | 2 | 2 | 0 | Y | NKIAVRTWLFE | 79.1 | TKIAVRTWLFE | 20.9 | | | | |
| NS5 | 3176 | 0 | 1 | 1 | 0 | Y | KIAVRTWLFEN | 100 | | | | | | |
| NS5 | 3177 | 0 | 1 | 1 | 0 | Y | IAVRTWLFENG | 100 | | | | | | |
| NS5 | 3178 | 0.11 | 2 | 2 | 0 | Y | AVRTWLFENGE | 98.51 | AVRTWLFENGG | 1.49 | | | | |
| NS5 | 3179 | 0.11 | 2 | 2 | 0 | Y | VRTWLFENGEE | 98.51 | VRTWLFENGGE | 1.49 | | | | |
| NS5 | 3180 | 0.11 | 2 | 2 | 0 | Y | RTWLFENGEER | 98.51 | RTWLFENGGER | 1.49 | | | | |
| NS5 | 3181 | 0.11 | 2 | 2 | 0 | Y | TWLFENGEERV | 98.51 | TWLFENGGERV | 1.49 | | | | |
| NS5 | 3182 | 0.37 | 3 | 3 | 0 | Y | WLFENGEERVT | 94.03 | WLFENGGERVS | 4.48 | WLFENGGERVT | 1.49 | | |
| NS5 | 3183 | 0.37 | 3 | 3 | 0 | Y | LFENGEERVTR | 94.03 | LFENGGERVSR | 4.48 | LFENGGERVTR | 1.49 | | |
| NS5 | 3184 | 0.37 | 3 | 3 | 0 | Y | FENGEERVTRM | 94.03 | FENGGERVSRM | 4.48 | FENGGERVTRM | 1.49 | | |

FIG. 38-116

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency |
|---|---|---|---|---|---|---|---|---|---|---|---|---|
| NS5 | 3185 | 0.37 | 3 | 3 | 0 | Y | ENGEERVTRMA | 94

FIG. 38-117

Species: JEV (11-mers)

| protein | block starting position | block entropy | total peptides in block

FIG. 38-118

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block |

FIG. 38-119

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3260 | 0.22 | 3 | 3 | 0 | Y | IWPCRGQDEL | 97.01 | LLVPCRGQDEL | 1.49 | IVDPCRGQDEL | 1.49 | | |
| NS5 | 3261 | 0.22 | 3 | 3 | 0 | Y | WPCRGQDELI | 97.01 | VDPCRGQDELI | 1.49 | LVPCRGQDELI | 1.49 | | |
| NS5 | 3262 | 0.22 | 3 | 3 | 0 | Y | VPCRGQDELIG | 97.01 | VPCRGQDELID | 1.49 | DPCRGQDELIG | 1.49 | | |
| NS5 | 3263 | 0.11 | 2 | 2 | 0 | Y | PCRGQDELIGR | 98.51 | PCRGQDELIDR | 1.49 | | | | |
| NS5 | 3264 | 0.11 | 2 | 2 | 0 | Y | CRGQDELIGRA | 98.51 | CRGQDELIDRA | 1.49 | | | | |
| NS5 | 3265 | 0.11 | 2 | 2 | 0 | Y | RGQDELIGRAR | 98.51 | RGQDELIDRAR | 1.49 | | | | |
| NS5 | 3266 | 0.11 | 2 | 2 | 0 | Y | GQDELIGRARI | 98.51 | GQDELIDRARI | 1.49 | | | | |
| NS5 | 3267 | 0.11 | 2 | 2 | 0 | Y | QDELIGRARIS | 98.51 | QDELIDRARIS | 1.49 | | | | |
| NS5 | 3268 | 0.11 | 2 | 2 | 0 | Y | DELIGRARISP | 98.51 | DELIDRARISP | 1.49 | | | | |
| NS5 | 3269 | 0.11 | 2 | 2 | 0 | Y | ELIGRARISPG | 98.51 | ELIDRARISPG | 1.49 | | | | |
| NS5 | 3270 | 0.11 | 2 | 2 | 0 | Y | LIGRARISPGA | 98.51 | LIDRARISPGA | 1.49 | | | | |
| NS5 | 3271 | 0.11 | 2 | 2 | 0 | Y | IGRARISPGAG | 98.51 | IDRARISPGAG | 1.49 | | | | |
| NS5 | 3272 | 0.3 | 3 | 3 | 0 | Y | GRARISPGAGW | 95.52 | DRARISPGAGW | 2.99 | | | | |
| NS5 | 3273 | 0.19 | 2 | 2 | 0 | Y | RARISPGAGWN | 97.01 | RARISPGAGCN | 2.99 | | | | |
| NS5 | 3274 | 0.19 | 2 | 2 | 0 | Y | ARISPGAGWNV | 97.01 | ARISPGAGCNV | 2.99 | | | | |
| NS5 | 3275 | 0.42 | 4 | 4 | 0 | Y | RISPGAGWNVK | 94.03 | RISPGAGCNVK | 2.99 | RISPGAGWNVR | 1.49 | | |
| NS5 | 3276 | 0.42 | 4 | 4 | 0 | Y | ISPGAGWNVKD | 94.03 | ISPGAGCNVKD | 2.99 | ISPGAGWNVRD | 1.49 | | |
| NS5 | 3277 | 0.42 | 4 | 4 | 0 | Y | SPGAGWNVKDT | 94.03 | SPGAGCNVKDT | 2.99 | SPGAGWNVMDT | 1.49 | | |
| NS5 | 3278 | 0.42 | 4 | 4 | 0 | Y | PGAGWNVKDTA | 94.03 | PGAGCNVKDTA | 2.99 | PGAGWNVRDTA | 1.49 | | |
| NS5 | 3279 | 0.42 | 4 | 4 | 0 | Y | GAGWNVKDTAC | 94.03 | GAGCNVKDTAC | 2.99 | GAGWNVMDTAC | 1.49 | | |
| NS5 | 3280 | 0.42 | 4 | 4 | 0 | Y | AGWNVKDTACL | 94.03 | AGCNVKDTACL | 2.99 | AGWNVMDTACL | 1.49 | | |
| NS5 | 3281 | 0.53 | 5 | 5 | 0 | Y | GWNVKDTACLA | 92.54 | GCNVKDTACLA | 2.99 | GWNVMDTACLA | 1.49 | GWNVRDTACLA | 1.49 |
| NS5 | 3282 | 0.53 | 5 | 5 | 0 | Y | WNVKDTACLAK | 92.54 | CNVKDTACLAK | 2.99 | WNVMDTACLAK | 1.49 | WNVKDTACLPK | 1.49 |
| NS5 | 3283 | 0.33 | 4 | 4 | 0 | Y | NVKDTACLAKA | 95.52 | NVKDTACLPKA | 1.49 | NVRDTACLAKA | 1.49 | | |
| NS5 | 3284 | 0.33 | 4 | 4 | 0 | Y | VKDTACLAKAY | 95.52 | VKDTACLPKAY | 1.49 | VMDTACLAKAY | 1.49 | | |

FIG. 38-120

Species: JEV (11-mers)

| prot

FIG. 38-121

Species: JEV (11-mers)

| prot

FIG. 38-122

Species: JEV (11-mers)

| protein | block starting position | block entropy (11-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3335 | 0.3 | 3 | 3 | 0 | Y | SKG

FIG. 38-123

Species: JEV (11-mers)

| prot

FIG. 38-124

Species: JEV (11

FIG. 38-125

Species: JEV (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency |

Fig. 39-1

Species:panFIVE (8-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| anC | 35 | 1.21 | 10 | 4 | 9.15 | Y | SQLAKRFS | 58.49 | QQLTKRFS | 27.75 | QGLVKRFS | 3.42 | SNKIKQKT | 0.86 | NKIKQKTK | 0.86 |
| anC | 36 | 1.54 | 11 | 5 | 9.15 | Y | QLAKRFSK | 51.96 | QLTKRFSL | 27.75 | QLAKRFSR | 6.73 | GLVKRFST | 3.18 | KIKQKTKQ | 0.86 |
| anC | 37 | 1.56 | 13 | 5 | 9.15 | Y | LAKRFSKG | 51.69 | LTKRFSLG | 27.75 | LAKRFSRG | 6.73 | LVKRFSTG | 3.18 | IKQKTKQI | 0.86 |
| anC | 38 | 1.57 | 15 | 5 | 9.15 | Y | AKRFSKGL | 51.66 | TKRFSLGM | 27.72 | AKRFSRGL | 6.73 | VKRFSTGL | 3.18 | DAATQYRV | 1.13 |
| anC | 167 | 0.84 | 17 | 5 | 0.86 | Y | GKSLLFKT | 86.27 | TDVIVIPT | 5.54 | GRPLLFKT | 3.35 | ADVIVIPT | 2.22 | EPVDVDCF | 1.13 |
| pM | 208 | 1.54 | 10 | 4 | 0 | Y | EPEDIDCW | 49.8 | EPDDVDCW | 40.02 | DPEDIDCW | 5.84 | DPEDVDCW | 2.22 | | |
| pM | 209 | 1.27 | 9 | 5 | 0 | Y | PEDIDCWC | 55.64 | PDDVDCWC | 40.02 | PEDVDCWC | 2.22 | PVDVDCFC | 1.13 | | |
| E | 339 | 1.37 | 9 | 5 | 0 | Y | VLEHGSCV | 67.71 | VLEHGGCV | 22.08 | VLEGDSCV | 5.87 | VLEGDSCL | 2.22 | VLELGGCV | 1.13 |
| E | 340 | 1.37 | 8 | 5 | 0 | Y | LEHGSCVT | 67.71 | LEHGGCVT | 22.08 | LEGDSCVT | 5.87 | LEGDSCLT | 2.22 | LELGGCVT | 1.13 |
| E | 412 | 0.32 | 6 | 3 | 0.03 | Y | VDRGWGNG | 95.76 | TDRGWGNG | 2.16 | SDRGWGNH | 1.13 | | | | |
| E | 413 | 0.1 | 4 | 2 | 0.03 | Y | DRGWGNGC | 98.77 | DRGWGNHC | 1.13 | | | | | | |
| E | 414 | 0.1 | 4 | 2 | 0.03 | Y | RGWGNGCG | 98.77 | RGWGNHCG | 1.13 | | | | | | |
| E | 415 | 0.11 | 5 | 2 | 0.03 | Y | GWGNGCGL | 98.67 | GWGNHCGL | 1.13 | | | | | | |
| E | 416 | 0.11 | 6 | 2 | 0.03 | Y | WGNGCGLF | 98.64 | WGNHCGLF | 1.13 | | | | | | |
| E | 417 | 0.11 | 6 | 2 | 0 | Y | GNGCGLFG | 98.67 | GNHCGLFG | 1.13 | | | | | | |
| E | 418 | 0.11 | 5 | 2 | 0 | Y | NGCGLFGK | 98.71 | NHCGLFGK | 1.13 | | | | | | |
| E | 419 | 0.1 | 4 | 2 | 0 | Y | GCGLFGKG | 98.74 | HCGLFGKG | 1.13 | | | | | | |
| E | 420 | 0.92 | 5 | 2 | 0 | Y | CGLFGKGS | 68.73 | CGLFGKGG | 31.07 | | | | | | |
| E | 421 | 1.48 | 7 | 4 | 9.22 | Y | GLFGKGSL | 58.79 | GLFGKGGI | 27.65 | GLFGKGSI | 9.95 | GLFGKGGV | 3.42 | VGAKQENW | 0.83 |
| E | 465 | 1.33 | 18 | 5 | 9.22 | Y | TGDQHQVG | 58.55 | SGEEHAVG | 25.93 | NGDTHAVG | 3.32 | SGEENAVG | 1.62 | GAKQENWN | 0.66 |
| E | 466 | 1.35 | 22 | 5 | 0 | Y | GDQHQVGN | 58.59 | GEEHAVGN | 25.76 | GDTHAVGN | 3.32 | GEENAVGN | 1.62 | CQVQTAVD | 0.83 |
| E | 509 | 0.84 | 19 | 5 | 0 | Y | CSPRTGLD | 85.91 | CEPRSGID | 9.08 | CEPRSGLN | 2.16 | CRVASGVD | 1.09 | ALGNQEGS | 0.8 |
| E | 583 | 0.66 | 12 | 5 | 0 | Y | VLGQEGA | 89.79 | ALGQEGA | 5.87 | ALGQEGG | 2.12 | NLGDQTGV | 1.13 | LGNQEGSL | 0.8 |
| E | 584 | 0.65 | 11 | 5 | 0 | Y | LGQEGAM | 89.85 | LGQEGAL | 5.87 | LGQEGGL | 2.12 | LGDQTGVL | 1.13 | GNQEGSLK | 0.8 |
| E | 585 | 0.65 | 12 | 5 | 0 | Y | GSQEGAMH | 89.85 | GSQEGALH | 5.84 | GSQEGGLH | 2.12 | GDQTGVLL | 1.13 | | |

Fig. 39-2

SpeciespanFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 715 | 1.66 | 9 | 5 | 0 | Y | EPPFGESY | 39.95 | EPPFGDSY | 39.19 | EPPFGESN | 1.13 | NPPFGDSY | 0.86 |
| E | 716 | 1.62 | 11 | 4 | 0 | Y | PPFGDSYI | 39.99 | PPFGESYI | 39.89 | PPFGESNI | 1.13 | | |
| E | 753 | 1.44 | 11 | 5 | 0 | Y | GARRMAIL | 58.72 | GAKRMAIL | 31.07 | GIERLTVI | 1.13 | GVERLAVM | 0.6 |
| E | 754 | 1.44 | 11 | 5 | 0 | Y | ARRMAILG | 58.72 | AKRMAILG | 31.07 | IERLTVIG | 1.13 | VERLAVMG | 0.6 |
| E | 756 | 0.83 | 14 | 5 | 0 | Y | RMAILGDT | 86.34 | RLAALGDT | 7.89 | RLTVIGEH | 1.13 | RLAVMGDT | 0.43 |
| E | 757 | 0.83 | 11 | 5 | 0 | Y | MAILGDTA | 86.27 | LAALGDTA | 7.89 | LTVIGEHA | 1.13 | LAVMGDTA | 0.43 |
| E | 758 | 0.83 | 16 | 5 | 0 | Y | AILGDTAW | 86.31 | AALGDTAW | 7.89 | TVIGEHAW | 1.13 | AVMGDTAW | 0.43 |
| E | 759 | 0.82 | 15 | 5 | 0 | Y | ILGDTAWD | 86.31 | ALGDTAWD | 7.96 | VIGEHAWD | 1.13 | VMGDTAWD | 0.43 |
| E | 760 | 0.41 | 14 | 4 | 0 | Y | LGDTAWDF | 94.46 | LGETAWDF | 3.35 | MGDTAWDF | 0.43 | | |
| E | 761 | 0.41 | 11 | 4 | 0 | Y | GDTAWDFG | 94.46 | GETAWDFG | 3.35 | GDTAWDFS | 1.13 | | |
| E | 762 | 0.41 | 11 | 4 | 0 | Y | DTAWDFGS | 94.46 | ETAWDFGS | 3.35 | DTAWDFSS | 1.13 | | |
| E | 763 | 1.74 | 14 | 5 | 0 | Y | TAWDFGSI | 41.25 | TAWDFGSV | 29.28 | HAWDFGST | 0.86 | TAWDFSSA | 0.43 |
| E | 764 | 1.72 | 10 | 5 | 0 | Y | AWDFGSIG | 41.28 | AWDFGSVG | 29.31 | AWDFGSTG | 0.86 | AWDFSSAG | 0.86 |
| E | 765 | 1.71 | 9 | 5 | 0 | Y | WDFGSIGG | 41.28 | WDFGSVGG | 29.31 | WDFSSAGG | 0.86 | WDFGSTGG | 0.86 |
| NS1 | 852 | 0.71 | 11 | 5 | 0 | Y | ELKCGSGI | 89.19 | ELRCGSGV | 5.84 | ELRCGEGL | 1.06 | ELKCGDGI | 0.86 |
| NS1 | 853 | 0.7 | 9 | 4 | 0 | Y | LKCGSGIF | 89.22 | LRCGSGVF | 5.84 | LRCGEGLV | 1.06 | LKCGDGIF | 0.86 |
| NS1 | 865 | 0.69 | 17 | 5 | 0 | Y | VHTWTEQY | 89.72 | VEAWMDRY | 5.5 | VSEWYDNY | 1.06 | SDDWLNKY | 0.76 |
| NS1 | 866 | 0.7 | 19 | 5 | 0.03 | Y | HTWTEQYK | 89.59 | EAWMDRYK | 5.5 | SEWYDNYA | 1.06 | DDWLNKYS | 0.76 |
| NS1 | 1003 | 0.64 | 9 | 4 | 0 | Y | EVEDGFG | 89.89 | EVEDFGFG | 5.87 | TVAEFGVG | 1.06 | | |
| NS1 | 1042 | 0.67 | 11 | 5 | 0 | Y | AVHADMGY | 89.85 | AIHSDLSY | 5.24 | SAHGSPTF | 0.86 | AVHTDQSL | 0.8 |
| NS1 | 1043 | 0.67 | 11 | 5 | 0 | Y | VHADMGYW | 89.85 | IHSDLSYW | 5.24 | AHGSPTFW | 0.86 | VHTDQSLW | 0.8 |
| NS1 | 1044 | 0.59 | 8 | 4 | 0 | Y | HADMGYWI | 89.69 | HSDLSYWI | 8.06 | HGSPTFWM | 0.86 | | |
| NS1 | 1045 | 0.6 | 10 | 4 | 0 | Y | ADMGYWIE | 89.69 | SDLSYWIE | 8.02 | GSPTFWMG | 0.86 | | |
| NS1 | 1046 | 0.6 | 10 | 4 | 0 | Y | DMGYWIES | 89.69 | DLSYWIES | 8.02 | SPTFWMGS | 0.86 | | |
| NS1 | 1076 | 0.79 | 9 | 5 | 0.86 | Y | WPKISHTLW | 85.58 | WPKITHTLW | 3.48 | WPASHTID | 1.06 | WPRSHTLW | 0.83 |

Fig. 39-3

| SpeciespanFIVE (8-mers) protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1077 | 0.8 | 10 | 5 | 0.9 | Y | PKSHTLWS | 85.51 | PETHTLWG | 7.99 | PKTHTLWS | 3.48 | PASHTIDN | 1.06 | PKSHTLWS | 0.83 |
| NS1 | 1078 | 0.82 | 12 | 5 | 0.9 | Y | KSHTLWSN | 85.51 | ETHTLWGD | 7.69 | KTHTLWSN | 3.48 | ASHTIDNA | 1.03 | RSHTLWSN | 0.83 |
| NS1 | 1079 | 0.8 | 15 | 5 | 0.9 | Y | SHTLWSNG | 86.17 | THTLWGDG | 7.43 | THTLWSNG | 3.48 | SHTIDNAE | 0.76 | THTLWGEG | 0.3 |
| NS1 | 1161 | 0.79 | 9 | 4 | 0 | Y | EWCCRSCT | 87.27 | DWCCRSCT | 5.87 | QWCCRSCT | 3.48 | DWCCRSCS | 2.16 | EWCCRTCT | 0.86 |
| NS1 | 1162 | 0.52 | 8 | 4 | 0 | Y | WCCRSCTL | 92.27 | WCCRSCTM | 4.34 | WCCRSCSL | 2.16 | WCCRTCTL | 0.86 | | |
| NS1 | 1163 | 0.51 | 7 | 4 | 0 | Y | CCRSCTLP | 92.31 | CCRSCTMP | 4.34 | CCRSCSLP | 2.16 | CCRTCTLP | 0.86 | | |
| NS1 | 1164 | 0.51 | 6 | 4 | 0 | Y | CRSCTLPP | 92.34 | CRSCTMPP | 4.34 | CRSCSLPP | 2.16 | CRTCTLPP | 0.86 | RTCTLPPV | 0.8 |
| NS1 | 1165 | 0.54 | 8 | 5 | 0 | Y | RSCTLPPL | 92.34 | RSCTMPPL | 3.48 | RSCSLPPL | 2.16 | RSCTMPPV | 0.86 | TCTLPPVT | 0.8 |
| NS1 | 1166 | 0.55 | 9 | 5 | 0 | Y | SCTLPPLR | 92.34 | SCTMPPLR | 3.48 | SCSLPPLR | 2.06 | SCTMPPYS | 0.86 | GSDGCWYP | 0.83 |
| NS1 | 1176 | 0.69 | 14 | 5 | 0.03 | Y | GEDGCWYG | 89.75 | TDSGCWYG | 5.11 | TENGCWYG | 2.59 | TGTDCWYA | 1.06 | SDGCWYPM | 0.83 |
| NS1 | 1177 | 0.68 | 12 | 5 | 0.03 | Y | EDGCWYGM | 89.79 | DSGCWYGM | 5.11 | ENGCWYGM | 2.62 | GTDCWYAM | 1.06 | | |
| NS1 | 1178 | 0.64 | 6 | 5 | 0.03 | Y | DGCWYGME | 89.92 | SGCWYGME | 5.34 | NGCWYGME | 2.75 | TDCWYAME | 1.06 | | |
| NS1 | 1179 | 0.16 | 4 | 2 | 0 | Y | GCWYGMEI | 98.04 | DCWYAMEI | 1.06 | | | | | | |
| NS1 | 1180 | 0.16 | 5 | 2 | 0 | Y | CWYGMEIR | 98.01 | CWYAMEIR | 1.06 | | | | | | |
| NS1 | 1181 | 0.16 | 5 | 2 | 0 | Y | WYGMEIRP | 98.01 | WYAMEIRP | 1.06 | | | | | | |
| NS3 | 1635 | 1.31 | 8 | 4 | 0 | Y | VFHTMWHV | 63.1 | TFHTMWHV | 27.69 | VFHTLWHT | 7.99 | VLHTMWHV | 1.06 | | |
| NS3 | 1636 | 0.51 | 7 | 3 | 0 | Y | FHTMWHVT | 90.78 | FHTLWHTT | 7.99 | LHTMWHVT | 1.06 | | | | |
| NS3 | 1637 | 0.48 | 6 | 3 | 0 | Y | HTMWHVTR | 91.84 | HTLWHTTK | 5.87 | HTLWHTTR | 2.19 | | | | |
| NS3 | 1638 | 0.48 | 6 | 3 | 0 | Y | TMWHVTRG | 91.84 | TLWHTTKG | 5.87 | TLWHTTRG | 2.19 | | | | |
| NS3 | 1639 | 0.69 | 6 | 4 | 0 | Y | MWHVTRGA | 88.4 | LWHTTKGA | 5.87 | MWHVTRGS | 3.48 | LWHTTRGA | 2.19 | | |
| NS3 | 1640 | 0.84 | 7 | 5 | 0 | Y | WHVTRGAV | 86.51 | WHTTKGAA | 5.87 | WHVTRGSV | 3.48 | WHTTRGAA | 2.19 | WHVTRGAA | 1.06 |
| NS3 | 1641 | 0.85 | 8 | 4 | 0 | Y | HVTRGAVL | 86.51 | HTTKGAAL | 5.87 | HVTRGSVI | 3.48 | HTTRGAAI | 2.12 | HVTRGAAL | 1.06 |
| NS3 | 1723 | 0.64 | 9 | 3 | 0 | Y | PGTSGSPI | 89.92 | TGTSGSPI | 5.87 | RGTSGSPI | 2.22 | KGTSGSPI | 0.99 | | |
| NS3 | 1724 | 1.11 | 8 | 4 | 0 | Y | GTSGSPIL | 64.39 | GTSGSPII | 32.26 | GTSGSPIL | 3.18 | | | | |
| NS3 | 1737 | 1.51 | 7 | 4 | 0 | Y | VGLYGNG | 47.15 | IVGLYGNG | 40.38 | VIGLYGNG | 10.11 | IIGLYGNG | 2.19 | | |

Fig. 39-4

Species: panFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1738 | 0.69 | 8 | 4 | 0 | Y | VGLYGNGV | 86.37 | IGLYGNGV | 11.51 | VGLYGNGL | 1.06 | | |
| NS3 | 1739 | 0.64 | 7 | 4 | 0 | Y | GLYGNGVV | 89.89 | GLYGNGVI | 5.97 | GLYGNGVE | 2.16 | | |
| NS3 | 1740 | 0.64 | 8 | 5 | 0 | Y | LYGNGVT | 89.89 | LYGNGVM | 5.87 | LYGNGVEL | 2.16 | | |
| NS3 | 1786 | 0.66 | 13 | 5 | 0 | Y | LTIMDLHP | 89.89 | ITVLDLHP | 5.84 | MTVLDLHP | 2.06 | | |
| NS3 | 1787 | 0.59 | 11 | 4 | 0 | Y | TIMDLHPG | 89.92 | TVLDLHPG

Fig. 39-5

Species:panFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1853 | 0.58 | 9 | 4 | 0 | Y | EIVDLMCH | 89.92 | EIVDVMCH | 8.06 | | | | | | |
| NS3 | 1854 | 0.53 | 8 | 2 | 0 | Y | IVDLMCHA | 89.89 | IVDVMCHA | 9.12 | AIVDVMCH | 0.96 | EVIDAMCH | 0.83 | | |
| NS3 | 1855 | 0.53 | 9 | 3 | 0 | Y | VDLMCHAT | 89.85 | VDVMCHAT | 9.12 | IDAMCHAT | 0.83 | | | | |
| NS3 | 1856 | 0.58 | 9 | 3 | 0 | Y | DLMCHATF | 89.85 | DVMCHATF | 8.12 | DVMCHATY | 1.03 | | | | |
| NS3 | 1857 | 0.58 | 8 | 3 | 0 | Y | LMCHATFT | 89.85 | VMCHATLI | 8.12 | VMCHATYV | 1.03 | | | | |
| NS3 | 1858 | 0.79 | 10 | 5 | 0 | Y | MCHATFTM | 86.37 | MCHATLTH | 8.09 | MCHATFTT | 3.48 | MCHATYVN | 0.99 | MCHATLTY | 0.86 |
| NS3 | 1859 | 0.8 | 11 | 5 | 0 | Y | CHATFTMR | 86.37 | CHATLTHR | 8.09 | CHATFTTR | 3.42 | CHATYVNR | 0.99 | CHATLTYR | 0.86 |
| NS3 | 1860 | 0.79 | 10 | 5 | 0 | Y | HATFTMRL | 86.41 | HATLTHRL | 8.09 | HATFTTRL | 3.42 | HATYVNRR | 0.99 | HATLTYRM | 0.86 |
| NS3 | 1861 | 0.8 | 11 | 5 | 0 | Y | ATFTMRLL | 86.41 | ATLTHRLM | 8.06 | ATFTTRLL | 3.42 | ATYVNRRL | 0.99 | ATLTYRML | 0.86 |
| NS3 | 1862 | 0.79 | 9 | 5 | 0 | Y | TFTMRLLS | 86.44 | TLTHRLMS | 8.06 | TFTTRLLS | 3.42 | TVNRRLL | 1.03 | TLTYRMLE | 0.86 |
| NS3 | 1863 | 0.79 | 9 | 5 | 0 | Y | FTMRLLSP | 86.44 | LTHRLMSP | 8.06 | FTTRLLSS | 3.42 | YVNRRLLP | 1.03 | LTYRMLEP | 0.86 |
| NS3 | 1872 | 1.56 | 9 | 5 | 0 | Y | RVPNYNLI | 48.41 | RVPNYNMI | 40.05 | RVPNYNLF | 8.09 | RVPNYNLV | 1.49 | GRQNWEVA | 1.06 |
| NS3 | 1879 | 0.87 | 10 | 3 | 0 | Y | IIMDEAHF | 85.38 | FVMDEAHF | 7.59 | IVMDEAHF | 3.95 | VIMDEAHF | 1.46 | AIMDEAHW | 1.03 |
| NS3 | 1880 | 0.68 | 7 | 2 | 0 | Y | IMDEAHFT | 86.44 | VMDEAHFT | 11.57 | IMDEAHWT | 1.03 | | | | |
| NS3 | 1881 | 0.17 | 6 | 2 | 0 | Y | MDEAHFTD | 98.01 | MDEAHWTD | 1.03 | | | | | | |
| NS3 | 1882 | 0.16 | 4 | 2 | 0 | Y | DEAHFTDP | 98.04 | DEAHWTDP | 1.06 | | | | | | |
| NS3 | 1883 | 1.11 | 8 | 4 | 0 | Y | EAHFTDPA | 64.46 | EAHFTDPS | 33.12 | EAHWTDPH | 1.06 | EAHFLDPA | 1.06 | HFLDPASI | 0.86 |
| NS3 | 1884 | 1.12 | 10 | 5 | 0 | Y | AHFTDPAS | 64.39 | AHFTDPSS | 33.12 | AHWTDPHS | 1.06 | AHFLDPAS | 0.86 | FLDPASIA | 0.86 |
| NS3 | 1885 | 1.27 | 10 | 5 | 0 | Y | HFTDPSIA | 64.42 | HFTDPSSV | 29.94 | HFTDPSSI | 3.18 | HWTDPHSI | 1.06 | LDPASIAA | 0.86 |
| NS3 | 1886 | 1.27 | 11 | 5 | 0 | Y | FTDPSIA | 64.39 | FTDPSSV | 29.94 | FTDPSSVA | 3.18 | WTDPHSIA | 1.06 | | |
| NS3 | 1887 | 1.28 | 13 | 4 | 0 | Y | TDPSIAA | 64.32 | TDPSIAA | 29.91 | TDPSSVAA | 3.18 | TDPHSIAA | 1.06 | | |
| NS3 | 1888 | 1.22 | 13 | 4 | 0 | Y | DPSIAAR | 65.15 | DPSIAAR | 29.91 | DPSSVAAR | 3.18 | DPHSIAAR | 1.06 | | |
| NS3 | 1889 | 1.22 | 13 | 5 | 0 | Y | PASIAARG | 65.15 | PSSIAARG | 29.91 | PSSVAARG | 3.18 | PHSIAARG | 1.06 | | |
| NS3 | 1890 | 1.28 | 14 | 4 | 0 | Y | ASIAARGY | 64.29 | SSIAARGY | 29.91 | SSVAARGY | 3.18 | HSIAARGH | 1.06 | ASIAARGW | 0.86 |
| NS3 | 1891 | 0.4 | 10 | 4 | 0 | Y | SIAARGYI | 94.33 | SVAARGYI | 3.51 | SIAARGHL | 1.06 | SIAARGWA | 0.86 | | |

Fig. 39-6

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1892 | 0.57 | 9 | 5 | 0 | Y | IAARGYIS | 91.74 | VAARGYIS | 3.51 | IAARGYIA | 2.65 | IAARGHLY | 1.06 | IAARGWAA | 0.86 |
| NS3 | 1893 | 0.35 | 8 | 4 | 0 | Y | AARGYIST | 95.26 | AARGYIAT | 2.65 | AARGHLYT | 1.06 | AARGWAAH | 0.86 | ARGWAAHR | 0.86 |
| NS3 | 1894 | 0.64 | 10 | 5 | 0 | Y | ARGYISTR | 90.12 | ARGYISTIK | 5.14 | ARGHLYT | 2.62 | ARGHLYTL | 1.06 | | |
| NS3 | 1895 | 0.63 | 8 | 4 | 0 | Y | RGYISTRV | 90.22 | RGYISTIKV | 5.14 | RGYIATIKV | 2.62 | RGHLYTLA | 1.06 | | |
| NS3 | 1896 | 1.47 | 9 | 5 | 0 | Y | GYISTRVG | 58.75 | GYISTRVE | 31.47 | GYISTRVE | 5.14 | GYIATKVE | 2.65 | GHLYTLAK | 1.03 |
| NS3 | 1900 | 1.45 | 10 | 5 | 0 | Y | TRVGMGEA | 58.45 | TRVEMGEA | 31.2 | TKVELGEA | 7.79 | TLAKENKC | 1.03 | HRARANES | 0.86 |
| NS3 | 1901 | 1.46 | 12 | 5 | 0 | Y | RVGMGEAA | 58.39 | RVEMGEAA | 31.2 | KVELGEAA | 7.79 | LAKENKCA | 1.03 | RARANESA | 0.86 |
| NS3 | 1904 | 1.4 | 9 | 4 | 0 | Y | MGEAAAIF | 61.9 | MGEAAGIF | 27.72 | LGEAAAIF | 8.06 | ENKCALVL | 1.06 | ANESATIL | 0.86 |
| NS3 | 1905 | 1.04 | 8 | 4 | 0 | Y | GEAAAIFM | 69.96 | GEAAGIFM | 27.72 | NKCALVLM | 1.06 | NESATILM | 0.86 | | |
| NS3 | 1906 | 1.04 | 8 | 4 | 0 | Y | EAAAIFMT | 69.96 | EAAGIFMT | 27.72 | KCALVLMT | 1.06 | ESATILMT | 0.86 | | |
| NS3 | 1907 | 1.03 | 7 | 4 | 0 | Y | AAAIFMTA | 69.99 | AAGIFMTA | 27.72 | CALVLMTA | 1.06 | SATILMTA | 0.86 | | |
| NS3 | 1908 | 1.01 | 7 | 3 | 0 | Y | AAIFMTAT | 70.26 | AGIFMTAT | 27.72 | ALVLMTAT | 1.06 | | | | |
| NS3 | 1909 | 1.01 | 7 | 3 | 0 | Y | AIFMTATP | 70.29 | GIFMTATP | 27.72 | LVLMTATP | 1.06 | | | | |
| NS3 | 1910 | 0.17 | 6 | 2 | 0 | Y | IFMTATPP | 98.01 | VLMTATPP | 1.03 | | | | | | |
| NS3 | 1911 | 0.15 | 5 | 2 | 0 | Y | FMTATPPG | 98.01 | LMTATPPG | 1.89 | | | | | | |
| NS3 | 1912 | 1.13 | 8 | 4 | 0 | Y | MTATPPGS | 68 | MTATPPGT | 27.82 | MTATPPGA | 2.98 | MTATPPGK | 1.03 | | |
| NS3 | 1958 | 0.33 | 8 | 4 | 0 | Y | GKTYWFVP | 95.66 | GKTYWFVA | 2.22 | GRTAWFVP | 2.22 | RPTAWFLP | 0.86 | | |
| NS3 | 1959 | 0.33 | 8 | 4 | 0 | Y | KTYWFVPS | 95.66 | KTYWFVAS | 2.22 | RTAWFVPS | 2.22 | PTAWFLPS | 0.86 | | |
| NS3 | 1960 | 0.64 | 9 | 4 | 0 | Y | TYWFVPSI | 89.89 | TVWFVPSI | 5.87 | TVWFVASV | 2.22 | TAWFVPSI | 1.03 | | |
| NS3 | 1961 | 0.7 | 11 | 5 | 0 | Y | YWFVPSIK | 89.42 | VWFVASVK | 5.7 | VWFVASYK | 2.16 | AWFVPSIA

Fig. 39-7

SpeciesspanFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2005 | 1.39 | 7 | 3 | 0 | Y | DFWTTDI | 51.06 | DFWTTDI | 40.02 | DFWTTDI | 7.96 | | |
| NS3 | 2006 | 1.39 | 7 | 3 | 0 | Y | FWTTDIS | 51.06 | YWTTDIS | 40.02 | FWTTDIS | 7.96 | | |
| NS3 | 2007 | 0.48 | 6 | 2 | 0 | Y | WTTDISE | 91.08 | VTTDISE | 7.96 | | | | |
| NS3 | 2008 | 0.48 | 6 | 2 | 0 | Y | VTTDISEM | 91.11 | ITTDISEM | 7.92 | | | | |
| NS3 | 2009 | 0.08 | 3 | 1 | 0 | Y | TTDISEMG | 99.1 | | | | | | |
| NS3 | 2010 | 0.08 | 3 | 1 | 0 | Y | TDISEMGA | 99.1 | | | | | | |
| NS3 | 2011 | 0.08 | 3 | 1 | 0 | Y | DISEMGAN | 99.1 | | | | | | |
| NS3 | 2012 | 0.16 | 4 | 2 | 0 | Y | ISEMGANF | 98.04 | ISEMGANL | 1.06 | | | | |
| NS3 | 2013 | 1.27 | 7 | 4 | 0 | Y | SEMGANFK | 48.81 | SEMGANFR | 47.02 | SEMGANFG | 2.19 | SEMGANLD | 1.06 |
| NS3 | 2014 | 1.28 | 9 | 4 | 0 | Y | EMGANFRA | 48.74 | EMGANFRA | 47.02 | EMGANFGA | 2.19 | EMGANLDV | 1.06 |
| NS3 | 2023 | 0.63 | 6 | 4 | 0 | Y | RVIDPRRC | 89.95 | RVIDSRKS | 5.87 | RVIDCRKS | 2.22 | RVIDGRTN | 1.06 |
| NS3 | 2024 | 1.44 | 8 | 5 | 0 | Y | VIDPRRCL | 62.23 | VIDPRRCM | 27.72 | VIDSRKSV | 5.87 | VIDCRKSV | 2.22 |
| NS3 | 2025 | 1.44 | 9 | 5 | 0 | Y | IDPRRCLK | 62.23 | IDPRRCMK | 27.72 | IDSRKSVK | 5.87 | IDCRKSVK | 2.19 |
| NS3 | 2026 | 1.44 | 8 | 5 | 0 | Y | DPRRCLKP | 62.27 | DPRRCMKP | 27.72 | DSRKSVKP | 5.87 | DCRKSVKP | 2.19 |
| NS3 | 2027 | 1.38 | 10 | 4 | 1.06 | Y | PRRCLKPV | 62.23 | PRRCMKPV | 27.72 | SRKSVKPT | 5.84 | CRKSVKPT | 2.16 |
| NS3 | 2028 | 1.31 | 9 | 5 | 1.06 | Y | RRCLKPVI | 62.23 | RRCMKPVI | 27.72 | RKSVKPTI | 7.96 | RTAFKPVL | 0.76 |
| NS3 | 2029 | 1.39 | 12 | 5 | 1.06 | Y | RCLKPVIL | 62.1 | RCMKPVIL | 28.35 | KSVKPTIL | 5.8 | KSVKPTIL | 2.16 |
| NS3 | 2054 | 0.89 | 5 | 2 | 0 | Y | ASAAQRRG | 71.39 | SSAAQRRG | 23.41 | | | | |
| NS3 | 2055 | 0.01 | 3 | 1 | 0 | Y | SAAQRRGR | 99.93 | | | | | | |
| NS3 | 2056 | 0.79 | 4 | 2 | 0 | Y | AAQRRGRI | 76.53 | AAQRRGRV | 23.38 | | | | |
| NS3 | 2057 | 0.8 | 5 | 2 | 0 | Y | AQRRGRIG | 76.53 | AQRRGRVG | 23.38 | | | | |
| NS3 | 2058 | 0.8 | 5 | 2 | 0 | Y | QRRGRIGR | 76.53 | QRRGRVGR | 22.35 | | | | |
| NS3 | 2059 | 0.88 | 8 | 3 | 0 | Y | RRGRIGRN | 76.36 | RRGRVGRN | 27.72 | RRGRVGRQ | 0.9 | | |
| NS3 | 2090 | 1.44 | 9 | 5 | 0 | Y | WTEAKMLL | 62.27 | WTEAKMLL | 27.72 | WTEARIML | 5.84 | WTEAKIML | 2.19 | WKEAQILL | 1.03 |
| NS3 | 2091 | 1.44 | 10 | 5 | 0 | Y | TEAKMLLD | 62.23 | TEAKMLLD | 27.72 | TEARIMLD | 5.84 | TEAKIMLD | 2.19 | KEAQILLD | 1.03 |

Fig. 39-8

Species: panFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 2092 | 0.64 | 10 | 5 | 0 | Y | EAKMLLDN | 89.95 | EARIMLDN | 5.84 | EAKIMLDN | 2.19 | EAQILLDN | 0.99 | EASMLLDN | 0.86 |
| NS3 | 2093 | 0.65 | 13 | 5 | 0 | Y | AKMLLDNI | 89.85 | ARIMLLDN | 5.84 | AKIMLLDN | 2.19 | AQILLDNI | 0.99 | ASMLLDNM | 0.86 |
| NS3 | 2122 | 1.09 | 13 | 5 | 0 | Y | DGEYRLRG | 75.63 | DGEYRLKG | 18.63 | DGEFRLRG | 3.48 | AGHFRLTE | 1.03 | PGEMRLRD | 0.86 |
| NS3 | 2123 | 1.09 | 12 | 5 | 0.03 | Y | GEYRLRGE | 75.66 | GEYRLKGE | 18.63 | GEFRLRGE | 3.48 | GHFRLTEE | 1.03 | GEMRLRDD | 0.86 |
| NS3 | 2138 | 0.66 | 12 | 5 | 0.03 | Y | LMRRGDLP | 89.29 | LLRTADLP | 7.59 | LLTHCDFT | 1.06 | LVRNCDLP | 0.7 | LMKRGDLP | 0.56 |
| NS3 | 2139 | 0.63 | 11 | 4 | 0.03 | Y | MRRGDLPV | 89.29 | LRTADLPV | 8.06 | LTHCDFTP | 1.06 | VRNCDLPV | 0.7 | | |
| NS3 | 2140 | 0.63 | 10 | 3 | 0.03 | Y | RRGDLPVW | 89.32 | RTADLPVW | 8.06 | THCDFTPW | 1.06 | RNCDLPYW | 0.7 | | |
| NS3 | 2141 | 0.58 | 8 | 4 | 0.03 | Y | RGDLPVWL | 89.89 | TADLPVWL | 8.09 | HCDFTPWL | 1.06 | | | | |
| NS3 | 2142 | 1.47 | 9 | 5 | 0.03 | Y | GDLPVWLA | 46.29 | GDLPVWLS | 43.6 | ADLPVWLA | 8.09 | | | | |
| NS3 | 2143 | 1.71 | 11 | 5 | 0.03 | Y | DLPVWLSY | 43.04 | DLPVWLAY | 36.01 | DLPVWLAH | 18.1 | CDFTPWLA | 1.06 | DLPVWLSW | 0.76 |
| NS3 | 2161 | 1.25 | 10 | 5 | 0 | Y | DRWCFDG | 64.39 | DRWCFDG | 30.14 | DREWCFTG | 3.48 | DFTPWLAW | 1.06 | SRNWTWEG | 0.76 |
| NS3 | 2217 | 1.83 | 13 | 5 | 8.95 | Y | FAAGRRSV | 39.69 | FAAGRKSL | 27.65 | FAAGRKSI | 18.73 | DRKWCFEG | 0.83 | YASGRRSF | 0.9 |
| NS3 | 2340 | 1.5 | 12 | 5 | 0.03 | Y | LLIPEPEK | 49.8 | LLIPEPDR | 39.75 | VLIPEPEK | 7.99 | FASGRKSI | 3.45 | VVIPEPCQ | 0.8 |
| NS4A | 2341 | 1.17 | 12 | 4 | 0.03 | Y | LIPEPEKQ | 57.79 | LIPEPDRQ | 39.72 | LQPEAGKQ | 1.03 | VLQPEAGK | 1.03 | | |
| NS4A | 2342 | 1.17 | 12 | 3 | 0.03 | Y | IPEPEKQR | 57.76 | IPEPDRQR | 39.72 | QPEAGKQR | 1.03 | VIPEPGQQ | 0.86 | PEPGQQRS | 0.8 |
| NS4A | 2343 | 1.5 | 13 | 4 | 0.03 | Y | PEPEKQRT | 49.9 | PEPDRQRT | 39.75 | PEPEKQRS | 7.92 | IPEPGQQR | 1.03 | EPGQQRSI | 0.8 |
| NS4A | 2344 | 1.5 | 13 | 5 | 0.03 | Y | EPEKQRTP | 49.9 | EPDRQRTP | 39.75 | EPEKQRSQ | 7.92 | PEAGKQRS | 1.03 | PGQQRSIQ | 0.8 |
| NS4A | 2345 | 1.49 | 13 | 5 | 0.03 | Y | PEKQRTPQ | 49.93 | PDRQRTPQ | 39.75 | PEKQRSQT | 7.92 | EAGKQRSS | 1.03 | GQQRSIQD | 0.8 |
| NS4A | 2346 | 1.5 | 12 | 4 | 0.03 | Y | EKQRTPQD | 49.93 | DRQRTPQD | 39.75 | EKQRSQTD | 7.89 | AGKQRSSD | 1.03 | | |
| NS4A | 2347 | 1.47 | 12 | 3 | 0.03 | Y | KQRTPQDN | 50.2 | RQRTPQDN | 39.75 | KQRSQTDN | 7.96 | GKQRSSDD | 1.06 | | |
| NS4A | 2348 | 0.58 | 10 | 3 | 0 | Y | QRTPQDNQ | 89.95 | QRSQTDNQ | 7.99 | QRSSDDNK | 1.06 | KQRSSDDN | 1.06 | | |
| NS4A | 2349 | 0.57 | 9 | 3 | 0 | Y | RTPQDNQL | 89.99 | RSQTDNQL | 7.99 | RSSDDNKL | 1.06 | | | | |
| 2K | 2350 | 1.56 | 8 | 5 | 0 | Y | TPQDNQLA | 58.79 | TPQDNQLT | 27.72 | SQTDNQLA | 8.02 | TPQDNQLI | 3.48 | SSDDNKLA | 1.06 |
| NS4B | 2408 | 1.46 | 9 | 5 | 0 | Y | DLHPASAW | 51.79 | DLRPASAW | 38.2 | DLRPATAW | 7.92 | DLQPARSW | 1.06 | DLRPGAAW | 0.86 |
| NS4B | 2411 | 0.63 | 6 | 4 | 0 | Y | PASAWTLY | 89.95 | PATAWSLY | 5.87 | PATAWALY | 2.19 | PARSWGTY | 1.06 | | |

Fig. 39-9

Species:panFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2412 | 0.63 | 7 | 4 | 0 | Y | ASAWTLYA | 89

Fig. 39-10

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2517 | 0.59 | 9 | 4 | 0 | Y | AAGIMKNP | 89.89 | AAGIMKNA | 7.96 | FSAMVRNP | 1.06 | FHGVAKNP | 0.8 | | |
| NS4B | 2518 | 0.59 | 10 | 4 | 0 | Y | AGIMKNPT | 89.85 | AGIMKNAV | 7.96 | SAMVRNPM | 1.06 | HGVAKNPV | 0.8 | GVAKNPVW | 0.8 |
| NS4B | 2519 | 0.68 | 12 | 5 | 0 | Y | GIMKNPTV | 88.86 | GIMKNAVV | 7.82 | GI

Fig. 39-11

Species:panFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2712 | 1.65 | 13 | 5 | 0 | Y | KVID

Fig. 39-12

Species: panFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2844 | 0.56 | 11 | 5 | 0 | Y | VRNPLSRN | 92.11 | VRCPLSRN | 3.38 | VRLPLSRN | 2.22 | VRTPFSRN | 1.06 | IRNPLSRN | 0.96 |
| NS5 | 2845 | 0.48 | 9 | 4 | 0 | Y | RNPLSRNS | 93.07 | RCPLSRNS | 3.48 | RLPLSRNS | 2.22 | RTPFSRNS | 1.06 | | |
| NS5 | 2846 | 0.49 | 10 | 4 | 0 | Y | NPLSRNST | 92.94 | CPLSRNST | 3.48 | LPLSRNSN | 2.22 | TPFSRNST | 1.06 | | |
| NS5 | 2847 | 0.27 | 7 | 3 | 0 | Y | PLSRNSTH | 96.49 | PLSRNSNH | 2.22 | PFSRNSTH | 1.06 | | | | |
| NS5 | 2848 | 0.27 | 9 | 3 | 0 | Y | LSRNSTHE | 96.45 | LSRNSNHE | 2.22 | FSRNSTHE | 1.03 | | | | |
| NS5 | 2849 | 0.19 | 8 | 2 | 0 | Y | SRNSTHEM | 97.48 | SRNSNHEM | 2.22 | | | | | | |
| NS5 | 2850 | 0.2 | 9 | 2 | 0 | Y | RNSTHEMY | 97.41 | RNSNHEMY | 2.22 | | | | | | |
| NS5 | 2851 | 0.33 | 10 | 3 | 0 | Y | NSTHEMYW | 95.52 | NSNHEMYW | 2.22 | NSTHEMYY | 1.89 | | | | |
| NS5 | 2852 | 1.04 | 14 | 5 | 0 | Y | STHEMYWV | 76.82 | STHEMYWI | 18.67 | SNHEMYWV | 2.22 | STHEMYYS | 1.03 | STHEMYYV | 0.86 |
| NS5 | 2853 | 1.04 | 14 | 5 | 0 | Y | THEMYWVS | 76.82 | THEMYWIS | 18.67 | NHEMYWVS | 2.22 | THEMYYST | 1.03 | THEMYYS | 0.86 |
| NS5 | 2938 | 0.85 | 7 | 5 | 0 | Y | PYKTWAYH | 86.34 | PYRTWNYH | 5.87 | PYRTWAYH | 3.65 | PYRTWTYH | 2.19 | PYRTWQYW | 1.06 |

Fig. 39-13

Species:panFIVE (8-mers)

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2966 | 0.67 | 14 | 5 | 0 | Y | LLTKPWDV | 89.79 | LLSKPWDT | 5.84 | LMSKPWDA | 2.19 | LLSWPWNA | 1.06 | ILTY

Fig. 39-14

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3094 | 0.43 | 6 | 2 | 0 | Y | MGKREKKL | 91.68 | MGKREKKP | 8.06 | | | | | | |
| NS5 | 3095 | 0.5 | 7 | 2 | 0 | Y | GKREKKLG | 90.82 | GKREKKPG | 8.06 | GKREKKLS | 0.86 | | | | |
| NS5 | 3096 | 0.5 | 7 | 3 | 0 | Y | KREKKLGE | 90.82 | KREKKPGE | 8.06 | KREKKLSE | 0.86 | | | | |
| NS5 | 3097 | 0.5 | 7 | 3 | 0 | Y | REKKLGEF | 90.82 | REKKPGEF | 8.06 | REKKLSEF | 0.86 | | | | |
| NS5 | 3098 | 0.5 | 7 | 3 | 0 | Y | EKKLGEFG | 90.82 | EKKPGEFG | 8.06 | EKKLSEFG | 0.86 | | | | |
| NS5 | 3099 | 0.81 | 9 | 5 | 0 | Y | KKLGEFGK | 86.11 | KKPGEFGK | 8.06 | KKLGEFGR | 3.65 | KKLGEFGV | 1.06 | KKLSEFGK | 0.86 |
| NS5 | 3100 | 0.81 | 11 | 5 | 0 | Y | KLGEFGKA | 86.07 | KPGEFGRA | 8.06 | KLGEFGRA | 3.65 | KLGEFGVA | 1.03 | KLSEFGKA | 0.86 |
| NS5 | 3101 | 0.81 | 11 | 5 | 0 | Y | LGEFGKAK | 86.11 | PGEFGKAK | 8.02 | LGEFGRAK | 3.65 | LGEFGVAK | 1.03 | LSEFGKAK | 0.86 |
| NS5 | 3102 | 0.4 | 9 | 4 | 0 | Y | GEFGKAKG | 94.3 | GEFGRAKG | 3.65 | GEFGVAKG | 1.03 | SEFGKAKG | 0.86 | | |
| NS5 | 3103 | 0.33 | 8 | 3 | 0 | Y | EFGKAKGS | 95.16 | EFGRAKGS | 3.65 | EFGVAKGS | 1.03 | | | | |
| NS5 | 3104 | 0.33 | 7 | 3 | 0 | Y | FGKAKGSR | 95.19 | FGRAKGSR | 3.65 | FGVAKGSR | 1.03 | | | | |
| NS5 | 3105 | 0.33 | 9 | 3 | 0 | Y | GKAKGSRA | 95.13 | GRAKGSRA | 3.65 | GVAKGSRA | 1.03 | | | | |
| NS5 | 3106 | 0.33 | 9 | 3 | 0 | Y | KAKGSRAI | 95.13 | RAKGSRAI | 3.65 | VAKGSRAI | 1.03 | | | | |
| NS5 | 3107 | 0.03 | 7 | 1 | 0 | Y | AKGSRAIW | 99.8 | | | | | | | | |
| NS5 | 3108 | 0.43 | 7 | 2 | 0 | Y | KGSRAIWY | 91.74 | KGSRAIWF | 8.06 | | | | | | |
| NS5 | 3109 | 0.43 | 6 | 2 | 0 | Y | GSRAIWYM | 91.71 | GSRAIWFM | 8.09 | | | | | | |
| NS5 | 3110 | 0.43 | 6 | 2 | 0 | Y | SRAIWYMW | 91.74 | SRAIWFMW | 8.09 | | | | | | |
| NS5 | 3111 | 0.43 | 6 | 2 | 0 | Y | RAIWYMWL | 91.74 | RAIWFMWL | 8.09 | | | | | | |
| NS5 | 3112 | 0.43 | 6 | 2 | 0 | Y | AIWYMWLG | 91.74 | AIWFMWLG | 8.09 | | | | | | |
| NS5 | 3113 | 0.5 | 6 | 3 | 0 | Y | IWYMWLGA | 90.78 | IWFMWLGA | 8.09 | IWYMWLGS | 1.03 | | | | |
| NS5 | 3114 | 0.5 | 8 | 3 | 0 | Y | WYMWLGAR | 90.75 | WFMWLGAR | 8.09 | WYMWLGSR | 1.06 | | | | |
| NS5 | 3115 | 1.24 | 7 | 5 | 0 | Y | YMWLGARF | 71.75 | YMWLGARY | 19 | FMWLGARF | 5.87 | FMWLGARY | 2.22 | YMWLGSRF | 1.06 |
| NS5 | 3116 | 0.84 | 6 | 3 | 0.03 | Y | MWLGARFL | 77.62 | MWLGARYL | 21.22 | MWLGSRFL | 1.03 | | | | |
| NS5 | 3117 | 0.84 | 6 | 3 | 0.03 | Y | WLGARFLE | 77.62 | WLGARYLE | 21.22 | WLGSRFLE | 1.03 | | | | |
| NS5 | 3118 | 0.84 | 6 | 3 | 0.03 | Y | LGARFLEF | 77.62 | LGARYLEF | 21.22 | LGSRFLEF | 1.03 | | | | |

Species:panFIVE (8-mers)

Fig. 39-15

Species:panFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3119 | 0.84 | 6 | 3 | 0.03 | Y | GARLEFEE | 77.62 | GARYLEFE | 21.22 | GRFLEFE | 1.03 | | |
| NS5 | 3120 | 0.84 | 7 | 3 | 0.03 | Y | ARLEFEEA | 77.59 | ARYLEFEA | 21.22 | SRFLEFEA | 1.03 | | |
| NS5 | 3121 | 0.76 | 5 | 2 | 0.03 | Y | RFLEFEAL | 78.61 | RYLEFEAL | 21.25 | | | | |
| NS5 | 3122 | 0.75 | 4 | 2 | 0.03 | Y | FLEFEALG | 78.65 | YLEFEALG | 21.25 | | | | |
| NS5 | 3123 | 0.01 | 4 | 1 | 0.03 | Y | LEFEALGF | 99.87 | | | | | | |
| NS5 | 3124 | 0.99 | 6 | 2 | 0 | Y | EFEALGFL | 59.81 | EFEALGFM | 40.02 | | | | |
| NS5 | 3125 | 0.99 | 6 | 2 | 0 | Y | FEALGFLN | 59.85 | FEALGFMN | 40.02 | | | | |
| NS5 | 3126 | 0.99 | 7 | 2 | 0 | Y | EALGFLNE | 59.81 | EALGFMNE | 40.02 | | | | |
| NS5 | 3127 | 1 | 8 | 2 | 0 | Y | ALGFLNED | 59.78 | ALGFMNED | 40.02 | | | | |
| NS5 | 3128 | 0.99 | 7 | 2 | 0 | Y | LGFLNEDH | 59.81 | LGFMNEDH | 40.02 | | | | |
| NS5 | 3129 | 0.99 | 7 | 2 | 0 | Y | GFLNEDHW | 59.81 | GFMNEDHW | 40.02 | | | | |
| NS5 | 3130 | 1.45 | 10 | 4 | 0 | Y | FLNEDHWF | 49.9 | FMNEDHWF | 39.99 | FLNEDHWL | 7.99 | FLNEDHWA | 1.92 |
| NS5 | 3132 | 0.84 | 11 | 5 | 0 | Y | NEDHWFSR | 86.6 | NEDHWLGR | 5.84 | NEDHWFGR | 3.22 | NEDHWLSR | 2.16 | NEDHWASR | 0.56 |
| NS5 | 3144 | 0.68 | 17 | 5 | 0 | Y | SGVEGEGL | 89.75 | GGVEGLGL | 5.87 | GGVEGSGV | 2.09 | GGVEGIGL | 0.83 | SGVEGISL | 0.83 |
| NS5 | 3145 | 0.69 | 18 | 5 | 0 | Y | GVEGEGLH | 89.52 | GVEGLGLQ | 5.87 | GVEGSGVQ | 2.09 | GVEGISLN | 1.06 | GVEGIGLQ | 0.83 |
| NS5 | 3169 | 0.51 | 9 | 3 | 0 | Y | MYADDTAG | 91.58 | IYADDTAG | 6.17 | FYADDTAG | 1.89 | | |
| NS5 | 3170 | 0.01 | 4 | 1 | 0 | Y | YADDTAGW | 99.9 | | | | | |

Fig. 39-16

| protein | block starting position | block entropy (8-mers) | total peptides in block | # peptides required to cover 99% of block | gap/X fraction | 99% of block covered w/ =>5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3210 | 0.59 | 12 | 4 | 0 | Y | LTYQNKVV | 89.85 | LTYRHKVV | 7.96 | KAYHAKVV | 1.06 | MTYKNKVV | 0.86 |
| NS5 | 3211 | 1.31 | 13 | 5 | 0 | Y | TYQNKVVR | 67.67 | TYQNKVVK | 22.18 | TYRHKVVK | 7.96 | AYHAKVVK | 1.06 | TYKNKVVK | 0.86 |
| NS5 | 3212 | 1.32 | 14 | 5 | 0 | Y | YQNKVVRV | 67.67 | YQNKVVKV | 22.18 | YRHKVVKV | 7.92 | YHAKVVKV | 1.06 | YKNKVVKV | 0.86 |
| NS5 | 3214 | 1.43 | 13 | 5 | 0 | Y | NKVVRVQR | 67.61 | NKVVQVQR | 18.7 | HKVVKVMR | 7.99 | NKVVKVLR | 4.34 | AKVVKVAR | 1.06 |
| NS5 | 3215 | 1.41 | 10 | 5 | 0 | Y | KVVRVQRP | 67.67 | KVVKVQRP | 18.7 | KVVKVMRP | 8.02 | KVVKVLRP | 4.34 | KVVKVARP | 1.06 |
| NS5 | 3228 | 1.35 | 13 | 5 | 0 | Y | TYMDVISR | 47.81 | TYMDIISR | 46.58 | AYMDIISR | 3.48 | CIMDVITR | 0.93 | AYMDVISR | 1.06 |
| NS5 | 3230 | 1.93 | 12 | 5 | 0 | Y | MDVISRRD | 40.68 | MDIISRRD | 26.06 | MDIISRED | 23.97 | MDVISRED | 7.82 | MDVITRRD | 1.06 |
| NS5 | 3231 | 1.92 | 11 | 5 | 0 | Y | DVISRRDQ | 40.68 | DIISRRDQ | 26.06 | DIISRREDQ | 24.01 | DVISREDQ | 7.82 | DVITRRDQ | 1.06 |
| NS5 | 3232 | 1.92 | 11 | 5 | 0 | Y | VISRRDQR | 40.68 | IISRRDQR | 26.06 | IISRREDQR | 24.01 | VISREDQR | 7.82 | VITRRDQR | 1.06 |
| NS5 | 3233 | 1.29 | 8 | 4 | 0 | Y | ISRRDQRG | 64.69 | ISRKDQRG | 26.06 | ISREDQRG | 8.02 | ITRRDQRG | 1.06 | | |
| NS5 | 3234 | 1.29 | 8 | 4 | 0 | Y | SRRDQRGS | 64.69 | SRKDQRGS | 26.06 | SREDQRGS | 8.02 | TRRDQRGS | 1.06 | | |
| NS5 | 3235 | 1.22 | 9 | 3 | 0 | Y | RRDQRGSG | 65.68 | RKDQRGSG | 26.06 | REDQRGSG | 8.02 | | | | |
| NS5 | 3236 | 1.22 | 8 | 3 | 0 | Y | RDQRGSGQ | 65.72 | KDQRGSGQ | 26.06 | EDQRGSGQ | 8.02 | | | | |
| NS5 | 3237 | 0.03 | 7 | 1 | 0 | Y | DQRGSGQV | 99.73 | | | | | | | | |
| NS5 | 3238 | 0.54 | 7 | 2 | 0 | Y | QRGSGQVG | 88.36 | QRGSGQW | 11.44 | | | | | | |
| NS5 | 3239 | 0.54 | 7 | 2 | 0 | Y | RGSGQVGT | 88.36 | RGSGQWT | 11.44 | | | | | | |
| NS5 | 3240 | 0.54 | 7 | 2 | 0 | Y | GSGQVGTY | 88.36 | GSGQWTY | 11.44 | | | | | | |
| NS5 | 3241 | 0.62 | 9 | 3 | 0 | Y | SGQVGTYG | 88.23 | SGQWTYA | 9.91 | SGQWTYG | 1.53 | | | | |
| NS5 | 3242 | 0.61 | 8 | 3 | 0 | Y | GQVGTYGL | 88.23 | GQWTYAL | 9.95 | GQWTYGL | 1.53 | | | | |
| NS5 | 3243 | 0.61 | 6 | 3 | 0 | Y | QVGTYGLN | 88.23 | QWTYALN | 10.01 | QWTYGLN | 1.53 | | | | |
| NS5 | 3244 | 0.61 | 7 | 3 | 0 | Y | VGTYGLNT | 88.23 | WTYALNT | 9.95 | WTYGLNT | 1.53 | | | | |
| NS5 | 3300 | 0.46 | 7 | 3 | 0 | Y | RMAISGDD | 92.04 | RMAVSGDD | 6.7 | RMLVSGDD | 1.06 | | | | |
| NS5 | 3301 | 0.46 | 7 | 3 | 0 | Y | MAISGDDC | 92.04 | MAVSGDDC | 6.7 | MLVSGDDC | 1.06 | | | | |
| NS5 | 3302 | 0.47 | 7 | 3 | 0 | Y | AISGDDCV | 91.98 | AVSGDDCV | 6.73 | LVSGDDCV | 1.06 | | | | |
| NS5 | 3303 | 0.41 | 5 | 2 | 0 | Y | ISGDDCVV | 92.04 | VSGDDCVV | 7.79 | | | | | | |

Fig. 39-17

SpeciesspanFIVE (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3304 | 0.15 | 5 | 2 | 0 | Y | SGDDCVVK | 97.98 | SGDDCV

Fig. 39-18

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3393 | 1.35 | 10 | 5 | 0 | Y | ETACLGKS | 67.67 | ETACLGKA

Fig. 39-19

| SpeciespanFIVE (8-mers) | | | | | | | | | | | | | | | | |
|---|---|---|---|---|---|---|---|---|---|---|---|---|---|---|---|---|
| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
| NS5 | 3486 | 0.81 | 10 | 5 | 0 | Y | EDQWCGSL | 86.31 | EDIWCGSL | 8.06 | EDLWCGSL | 3.48 | QDKLCGSL | 0.86 | HDMLCSSL | 0.76

Fig. 40-1

Species: panFIVE (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 35 | 1.56 | 14 | 5 | 9.15 | Y | SQLAKRFSK | 51.86 | QQLTKRFSL | 27.72 | SQLAKRFSR | 6.63 | QGLVKRFST | 3.18 | SNKIKQKTK | 0.86 |
| anC | 36 | 1.56 | 13 | 5 | 9.15 | Y | QLAKRFSKG | 51.69 | QLTKRFSLG | 27.75 | QLAKRFSRG | 6.73 | GLVKRFSTG | 3.18 | NKIKQKTKQ | 0.86 |
| anC | 37 | 1.57 | 15 | 5 | 9.15 | Y | LAKRFSKGL | 51.66 | LTKRFSLGM | 27.72 | LAKRFSRGL | 6.73 | LVKRFSTGL | 3.18 | KIKQKTKQI | 0.86 |
| anC | 38 | 1.57 | 15 | 5 | 9.15 | Y | AKRFSKGLL | 51.66 | TKRFSLGML | 27.72 | AKRFSRGLL | 6.73 | VKRFSTGLF | 3.18 | IKQKTKQIG | 0.86 |
| pM | 208 | 1.54 | 10 | 5 | 0 | Y | EPEDIDCWC | 49.8 | EPDDVDCWC | 40.02 | DPEDIDCWC | 5.84 | DPEDVDCWC | 2.22 | EPVDVDCFC | 1.13 |
| E | 339 | 1.37 | 9 | 3 | 0 | Y | VLEHGSCVT | 67.71 | VLEHGGCVT | 22.08 | VLEGDSCVT | 5.87 | VLEGDSCLT | 2.22 | VLELGGCVT | 1.13 |
| E | 412 | 0.32 | 6 | 2 | 0.03 | Y | VDRGWGNGC | 95.76 | TDRGWGNGC | 2.16 | SDRGWGNHC | 1.13 | | | | |
| E | 413 | 0.1 | 4 | 2 | 0.03 | Y | DRGWGNGCG | 98.77 | DRGWGNHCG | 1.13 | | | | | | |
| E | 414 | 0.11 | 5 | 2 | 0.03 | Y | RGWGNGCGL | 98.67 | RGWGNHCGL | 1.13 | | | | | | |
| E | 415 | 0.11 | 6 | 2 | 0.03 | Y | GWGNCGCLF | 98.64 | GWGNHCGLF | 1.13 | | | | | | |
| E | 416 | 0.11 | 6 | 2 | 0.03 | Y | WGNGCGLFG | 98.64 | WGNHCGLFG | 1.13 | | | | | | |
| E | 417 | 0.11 | 6 | 2 | 0 | Y | GNGCGLFGK | 98.67 | GNHCGLFGK | 1.13 | | | | | | |
| E | 418 | 0.11 | 5 | 2 | 0 | Y | NGCGLFGKG | 98.71 | NHCGLFGKG | 1.13 | HCGLFGKGS | 1.13 | | | | |
| E | 419 | 1 | 6 | 3 | 0 | Y | GCGLFGKGS | 67.61 | GCGLFGKGG | 31.07 | CGLFGKGSI | 27.65 | CGLFGKGGV | 3.42 | VGAKQENWN | 0.66 |
| E | 420 | 1.48 | 7 | 4 | 9.22 | Y | CGLFGKGSL | 58.79 | CGLFGKGGI | 27.65 | NGDTHAVGN | 25.76 | SGEENAVGN | 1.62 | ALGNQEGSL | 0.8 |
| E | 465 | 1.36 | 24 | 5 | 0 | Y | TGDQHQVGN | 58.52 | SGEEHAVGN | 25.76 | ALGSQEGGL | 5.87 | NLGDQTGVL | 1.13 | LGNQEGSLK | 0.8 |
| E | 583 | 0.66 | 12 | 5 | 0 | Y | VLGSQEGAM | 89.79 | ALGSQEGAL | 5.87 | LGSQEGGLH | 5.84 | LGDQTGVLL | 1.13 | NPPFGDSYI | 0.86 |
| E | 584 | 0.66 | 13 | 5 | 0 | Y | LGSQEGAMH | 89.82 | LGSQEGALH | 5.84 | EPPFGESNI | 39.12 | QLPPGDNII | 1.13 | GVERLAVMG | 0.6 |
| E | 715 | 1.68 | 12 | 5 | 0 | Y | EPPFGESYI | 39.89 | EPPFGDSYI | 18.67 | GAQRLAALG | 31.07 | GIERLTVIG | 1.13 | RLAVMGDTA | 0.43 |
| E | 753 | 1.44 | 11 | 5 | 0 | Y | GARRMAILG | 58.72 | GAKRMAILG | 7.89 | RMAILGETA | 7.89 | RLTVIGEHA | 1.13 | LAVMGDTAW | 0.43 |
| E | 756 | 0.83 | 16 | 5 | 0 | Y | RMAILGDTA | 86.27 | RLAALGDTA | 3.35 | MAILGETAW | 7.89 | LTVIGEHAW | 1.13 | AVMGDTAWD | 0.43 |
| E | 757 | 0.83 | 16 | 5 | 0 | Y | MAILGDTAW | 86.27 | LAALGDTAW | 3.35 | AILGETAWD | 7.89 | TVIGEHAWD | 1.13 | VMGDTAWDF | 0.43 |
| E | 758 | 0.83 | 15 | 5 | 0 | Y | AILGDTAWD | 86.31 | AALGDTAWD | 3.35 | ILGETAWDF | 7.96 | VIGEHAWDF | 1.13 | | |
| E | 759 | 0.82 | 14 | 5 | 0 | Y | ILGDTAWDF | 86.31 | ALGDTAWDF | 3.35 | IGEHAWDFG | 3.35 | MGDTAWDFS | 0.43 | | |
| E | 760 | 0.41 | 11 | 4 | 0 | Y | LGDTAWDFG | 94.46 | LGETAWDFG | 3.35 | IGEHAWDFG | | | | | |

Fig. 40-2

Species: panFIVE (9-mers)

| protein | block starting position | block entropy | total peptides in block | # peptides required to cover 99% of block | gap/X fraction | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 761 | 0.41 | 11 | 4 | 0 | Y | GDTAWDFGS | 94.46 | GETAWDFGS | 3.35 | GEHAWDFGS | 1.13 | GDTAWDFSS | 0.43 |
| E | 763 | 1.74 | 14 | 5 | 0 | Y | TAWDFGSIG | 41.25 | TAWDFGSVG | 29.28 | TAWDFGSLG | 27.25 | HAWDFGSTG | 0.86 |
| E | 764 | 1.72 | 11 | 5 | 0 | Y | AWDFGSIGG | 41.25 | AWDFGSVGG | 29.31 | AWDFGSLGG | 27.25 | AWDFGSTGG | 0.86 |
| E | 852 | 0.71 | 11 | 5 | 0 | Y | ELKCGGIF | 89.19 | ELRCGGIF | 5.84 | EMRCGGIF | 2.19 | ELKCGDGIF | 0.86 |
| E | 865 | 0.71 | 20 | 5 | 0.03 | Y | VHTWFEQYK | 89.52 | VEAWMDRYK | 5.5 | VEAWDRYK | 2.22 | SDDWLNKYS | 1.06 |
| NS1 | 1042 | 0.67 | 11 | 5 | 0 | Y | AVHADMGYW | 89.85 | AIHSDLSYW | 5.24 | AVHSDLSYW | 2.79 | AVHTDQSLW | 0.86 |
| NS1 | 1043 | 0.69 | 13 | 5 | 0 | Y | VHADMGYWI | 89.59 | IHSDLSYWI | 5.24 | VHSDLSYWI | 2.79 | VHTDQSLWM | 0.86 |
| NS1 | 1044 | 0.6 | 10 | 4 | 0 | Y | HADMGYWIE | 89.69 | HSDLSYWIE | 8.02 | HTDQSLWMK | 0.86 | | |
| NS1 | 1045 | 0.6 | 10 | 4 | 0 | Y | ADMGYWIES | 89.69 | SDLSYWIES | 8.02 | GSPTFWMGS | 0.86 | | |
| NS1 | 1076 | 0.8 | 13 | 5 | 0.9 | Y | WPKSHTLWS | 85.51 | WPETHTLWG | 7.99 | WPKTHTLWS | 3.48 | WPRSHTLWS | 0.83 |
| NS1 | 1077 | 0.82 | 8 | 5 | 0.9 | Y | PKSHTLWSN | 85.48 | PETHTLWGD | 7.69 | PKTHTLWSN | 3.48 | PRSHTLWSN | 0.83 |
| NS1 | 1162 | 0.52 | 7 | 4 | 0 | Y | WCCRSCTLP | 92.27 | WCCRSCTMP | 4.34 | WCCRSCLP | 2.16 | | |
| NS1 | 1163 | 0.51 | 8 | 4 | 0 | Y | CCRSCTLPP | 92.31 | CCRSCTMPP | 4.34 | CCRSCLPP | 2.16 | | |
| NS1 | 1164 | 0.54 | 8 | 5 | 0 | Y | CRSCTLPPL | 92.34 | CRSCTMPPL | 3.48 | CRSCTMPPV | 2.16 | CRTCTLPPV | 0.8 |
| NS1 | 1165 | 0.55 | 9 | 5 | 0 | Y | RSCTLPPLR | 92.34 | RSCTMPPLR | 3.48 | RSCLPPLR | 2.06 | RTCTLPPVT | 0.8 |
| NS1 | 1176 | 0.69 | 14 | 4 | 0.03 | Y | GEDGCWYGM | 89.75 | TDSGCWYGM | 5.11 | TENGCWYGM | 2.59 | GSDGCWYPM | 0.83 |
| NS1 | 1177 | 0.68 | 12 | 5 | 0.03 | Y | EDGCWYGME | 89.79 | DSGCWYGME | 5.11 | ENGCWYGME | 2.62 | SDGCWYPME | 0.83 |
| NS1 | 1178 | 0.64 | 7 | 4 | 0.03 | Y | DGCWYGMEI | 89.92 | SGCWYGMEI | 5.31 | NGCWYGMEI | 2.75 | | |
| NS1 | 1179 | 0.16 | 5 | 2 | 0 | Y | GCWYGMEIR | 98.01 | DCWYAMEIR | 1.06 | | | | |
| NS1 | 1180 | 0.16 | 5 | 2 | 0 | Y | CWYGMEIRP | 98.01 | CWYAMEIRP | 1.06 | | | | |
| NS3 | 1635 | 1.31 | 8 | 4 | 0 | Y | VFHTMWHVT | 63.1 | TFHTMWHVT | 27.69 | VFHITLWHTT | 7.99 | | |
| NS3 | 1636 | 0.57 | 9 | 4 | 0 | Y | FHTMWHVTR | 90.78 | FHTLWHTTR | 5.84 | FHTLWHTTR | 2.16 | | |
| NS3 | 1637 | 0.48 | 6 | 3 | 0 | Y | HTMWHVTRG | 91.84 | HTLWHTTKG | 5.87 | HTLWHTTRG | 2.19 | | |
| NS3 | 1638 | 0.7 | 7 | 4 | 0 | Y | TMWHVTRGA | 88.36 | TLWHTTKGA | 5.87 | TMWHVTRGS | 3.48 | TLWHTTRGA | 2.19 |
| NS3 | 1639 | 0.85 | 8 | 5 | 0 | Y | MWHVTRGAV | 86.47 | LWHTTKGAA | 5.87 | MWHVTRGSV | 3.48 | LWHTTRGAA | 2.19 | MWHYTRGAA | 1.06 |

Fig. 40-3

| protein | block starting position | block entropy | total peptides in block | # peptides required to cover 99% of block | gap/X fraction | 99% of block covered w/ =< 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1640 | 0.85 | 8 | 5 | 0 | Y | WH

Fig. 40-4

Species: panFIVE (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1858 | 0.8 | 11 | 5 | 0 | Y | MCHATFTMR | 86.37 | MCHATLTHR | 8.09 | MCHATFTTR | 3.42 | MCHATLTYR | 0.86 |
| NS3 | 1859 | 0.8 | 11 | 5 | 0 | Y | CHATFTMRL | 86.37 | CHATLTHRL | 8.09 | CHATFTTRL | 3.42 | CHATLTYRM | 0.86 |
| NS3 | 1860 | 0.8 | 11 | 5 | 0 | Y | HATFTMRLL | 86.41 | HATLTHRLM | 8.06 | HATFTTRLL | 3.42 | HATLTYRML | 0.86 |
| NS3 | 1861 | 0.8 | 11 | 5 | 0 | Y | ATFTMRLLS | 86.41 | ATLTHRLMS | 8.06 | ATFTTRLLS | 3.42 | ATLTYRMLE | 0.86 |
| NS3 | 1862 | 0.8 | 10 | 5 | 0 | Y | TFTMRLLSP | 86.37 | TLTHRLMSP | 8.06 | TFTTRLLSS | 3.42 | TLTYRMLEP | 0.86 |
| NS3 | 1880 | 0.68 | 7 | 3 | 0 | Y | IMDEAHFTD | 86.44 | VMDEAHFTD | 11.57 | IMDEAHWTD | 1.03 | | |
| NS3 | 1881 | 0.17 | 6 | 2 | 0 | Y | MDEAHFTDP | 98.01 | MDEAHWTDP | 1.03 | | | | |
| NS3 | 1882 | 1.11 | 8 | 4 | 0 | Y | DEAHFTDPA | 64.46 | DEAHFTDPS | 33.12 | DEAHWTDPH | 1.06 | DEAHFLDPA | 0.86 |
| NS3 | 1883 | 1.12 | 10 | 4 | 0 | Y | EAHFTDPAS | 64.39 | EAHFTDPSS | 33.12 | EAHWTDPHS | 1.06 | EAHFLDPAS | 0.86 |
| NS3 | 1884 | 1.27 | 11 | 5 | 0 | Y | AHFTDPASI | 64.39 | AHFTDPSSI | 29.94 | AHWTDPHSI | 3.18 | AHFLDPASI | 1.06 |
| NS3 | 1885 | 1.27 | 11 | 5 | 0 | Y | HFTDPASIA | 64.39 | HFTDPSSIA | 29.94 | HFTDPSSVA | 3.18 | HFLDPASJA | 1.06 |
| NS3 | 1886 | 1.28 | 13 | 5 | 0 | Y | FTDPASIAA | 64.32 | FTDPSSIAA | 29.91 | FTDPSSVAA | 3.18 | FLDPASIAA | 1.06 |
| NS3 | 1887 | 1.28 | 13 | 5 | 0 | Y | TDPASIAAR | 64.29 | TDPSSIAAR | 29.91 | TDPSSVAAR | 3.18 | LDPASIAAR | 1.06 |
| NS3 | 1888 | 1.22 | 13 | 4 | 0 | Y | DPASIAARG | 65.15 | DPSSIAARG | 29.91 | DPSSVAARG | 3.18 | | |
| NS3 | 1889 | 1.28 | 14 | 5 | 0 | Y | PASIAARGY | 64.29 | PSSIAARGY | 29.91 | PSSVAARGY | 3.18 | PASIAARGW | 1.06 |
| NS3 | 1890 | 1.28 | 14 | 5 | 0 | Y | ASIAARGYI | 64.29 | SSIAARGYI | 29.91 | SSYAARGYI | 3.18 | ASIAARGWA | 1.06 |
| NS3 | 1891 | 0.58 | 11 | 5 | 0 | Y | SIAARGYIS | 91.71 | SVAARGYIS | 3.51 | SIAARGYIA | 3.18 | SIAARGWAA | 1.06 |
| NS3 | 1892 | 0.57 | 9 | 5 | 0 | Y | IAARGYIST | 91.74 | VAARGYIST | 3.51 | IAARGYIAT | 2.62 | IAARGWAAH | 1.06 |
| NS3 | 1893 | 0.65 | 11 | 5 | 0 | Y | AARGYISTR | 90.09 | AARGYISTK | 5.14 | AARGYIATK | 2.62 | AARGWAAHR | 1.06 |
| NS3 | 1894 | 0.64 | 10 | 5 | 0 | Y | ARGYISTRV | 90.12 | ARGYISTKV | 5.14 | ARGYIATKV | 2.62 | ARGWAAHRA | 1.06 |
| NS3 | 1895 | 1.48 | 12 | 5 | 0 | Y | RGYISTRVG | 58.75 | RGYISTKVE | 31.47 | RGYIATKVE | 5.14 | RGHLYTLAK | 2.62 |
| NS3 | 1900 | 1.46 | 9 | 5 | 0 | Y | TRVGMGEAA | 58.39 | TRVEMGEAA | 31.2 | TKVELGEAA | 7.79 | TLAKENKCA | 1.03 |
| NS3 | 1904 | 1.4 | 8 | 4 | 0 | Y | MGEAAIFMT | 61.9 | MGEAAGIFM | 27.72 | LGEAAIFM | 8.06 | ENIKCALVLM | 1.06 |
| NS3 | 1905 | 1.04 | 8 | 4 | 0 | Y | GEAAIFMT | 69.96 | GEAAGIFMT | 27.72 | NKCALVLMT | 1.06 | NESATILMT | 0.86 |
| NS3 | 1906 | 1.04 | 8 | 4 | 0 | Y | EAAIFMTA | 69.96 | EAAGIFMTA | 27.72 | KCALVLMTA | 1.06 | ESATILMTA | 0.86 |

Fig. 40-5

Species: panFIVE (9-mers)

| protein | block starting position | block entropy | total peptides in block | # peptides required to cover 99% of block | gap/X fraction | 99% of block covered w/ <=5 peptides? | block to cover 99% of | frequency | block to cover 99% of peptides required | frequency | block to cover 99% of peptides required | frequency | block to cover 99% of peptides required | frequency |
|---|---|---|---|---|---|---|---|---|---|---|---|---|---|---|
| NS3 | 1907 | 1.04 | 8 | 4 | 0 | Y | AAAIFMTAT | 69.96 | AAGIFMTAT | 27.72 | | | | |
| NS3 | 1908 | 1.02 | 9 | 4 | 0 | Y | AAIFMTATP | 70.23 | AGIFMTATP | 27.72 | SATILMTAT | 0.86 | | |
| NS3 | 1909 | 1.01 | 7 | 3 | 0 | Y | AIFMTATPP | 70.29 | GIFMTATPP | 27.72 | ATILMTATP | 0.86 | | |
| NS3 | 1910 | 0.17 | 6 | 2 | 0 | Y | IFMTATPPG | 98.01 | VLMTATPPG | 1.03 | | | | |
| NS3 | 1911 | 1.18 | 9 | 5 | 0 | Y | FMTATPPGS | 68 | FMTATPPGA | 26.96 | LMTATPPGK | 2.98 | LMTATPPGT | 0.86 |
| NS3 | 1958 | 0.33 | 8 | 4 | 0 | Y | GKTYWFVPS | 95.66 | GRTAWFVAS | 2.22 | RPTAWFLPS | 1.03 | PTAWFLPSI | 0.86 |
| NS3 | 1959 | 0.66 | 10 | 5 | 0 | Y | KTYWFVPSI | 89.75 | KTYWFVASV | 5.87 | RTAWFVPSI | 2.22 | TAWFLPSIR | 0.86 |
| NS3 | 1960 | 0.7 | 13 | 5 | 0 | Y | TYWFVPSIK | 89.39 | TYWFVASVK | 5.7 | TAWFVPSIA | 2.16 | VVLNRKTF | 0.86 |
| NS3 | 1984 | 0.71 | 9 | 5 | 0 | Y | VIQLSRKTF | 89.22 | VIQLNRKSY | 5.07 | VICLNSRKTF | 2.95 | | |
| NS3 | 2003 | 1.47 | 10 | 4 | 0 | Y | DWDFVYTTD | 49.97 | DWDYYVTTD | 40.02 | KPDFVVTTD | 7.96 | | |
| NS3 | 2004 | 1.46 | 8 | 4 | 0 | Y | WDFVYTTDI | 50 | WDYYVTTDI | 40.02 | PDFVVTTDI | 7.96 | | |
| NS3 | 2005 | 1.39 | 7 | 3 | 0 | Y | DFVYTTDIS | 51.06 | DYVYTTDIS | 40.02 | DFVITTDIS | 7.96 | | |
| NS3 | 2006 | 1.39 | 7 | 3 | 0 | Y | FVYTTDISE | 51.06 | YVYTTDISE | 40.02 | FVITTDISE | 7.92 | | |
| NS3 | 2007 | 0.49 | 7 | 2 | 0 | Y | VYTTDISEM | 91.08 | VITTDISEM | 7.92 | | | | |
| NS3 | 2008 | 0.48 | 6 | 2 | 0 | Y | YTTDISEMG | 91.11 | ITTDISEMG | 7.92 | | | | |
| NS3 | 2009 | 0.08 | 3 | 1 | 0 | Y | TTDISEMGA | 99.1 | | | | | | |
| NS3 | 2010 | 0.08 | 3 | 1 | 0 | Y | TDISEMGAN | 99.1 | | | | | | |
| NS3 | 2011 | 0.16 | 4 | 2 | 0 | Y | DISEMGANF | 98.04 | DISEMGANL | 1.06 | | | | |
| NS3 | 2012 | 1.27 | 7 | 4 | 0 | Y | ISEMGANFK | 48.81 | ISEMGANFR | 47.02 | ISEMGANFG | 2.19 | ISEMGANLD | 1.06 |
| NS3 | 2013 | 1.28 | 9 | 4 | 0 | Y | SEMGANFKA | 48.74 | SEMGANFRA | 47.02 | SEMGANFGA | 2.19 | SEMGANLDV | 1.06 |
| NS3 | 2023 | 1.44 | 8 | 5 | 0 | Y | RVIDPRRCL | 62.23 | RVIDPRRCM | 27.72 | RVIDSRKSV | 5.87 | RVIDCRKSV | 2.22 | RVIDGRTNI | 1.06 |
| NS3 | 2024 | 1.44 | 9 | 5 | 0 | Y | VIDPRRCLK | 62.23 | VIDPRRCMK | 27.72 | VIDSRKSVK | 5.87 | VIDCRKSVK | 2.19 | VIDGRTNIK | 1.06 |
| NS3 | 2025 | 1.44 | 9 | 5 | 0 | Y | IDPRRCLKP | 62.23 | IDPRRCMKP | 27.72 | IDSRKSVKP | 5.87 | IDCRKSVKP | 2.19 | IDGRTNIKP | 1.06 |
| NS3 | 2026 | 1.38 | 10 | 5 | 1.06 | Y | DPRRCLKPV | 62.23 | DPRRCMKPV | 27.72 | DSRKSVKPT | 5.84 | DCRKSVKPT | 2.16 | DCRTAFKPV | 0.76 |
| NS3 | 2027 | 1.38 | 11 | 5 | 1.06 | Y | PRRCLKPVI | 62.23 | PRRCMKPVI | 27.72 | SRKSVKPTI | 5.8 | CRKSVKPTI | 2.16 | CRTAFKPVL | 0.76 |

Fig. 40-6

| protein | block starting position | block entropy panFIVE (9-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2028 | 1.39 | 12 | 5 | 1.06 | Y | RRCLKPVIL | 62.1 | RRCMKPVIL | 27.72 | RKSVKPTII | 5.8 | RKSVKPTIL | 2.16 | RTAFKP

Fig. 40-7

Species: panFIVE (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2413 | 0.65 | 11 | 5 | 0 | Y | SAWTLYAVA | 89.92 | TAWSLYAVT | 5.67 | TAWALYGGS | 2.19 | RSWGTYVLV | 1.06 | AAWT

Fig. 40-8

Species: panFIVE (9-mers)

| protein | block starting position | block entropy | total peptides in block | # peptides required to cover 99% of block | gap/X fraction | 99% of block covered w/ <= 5 peptides? | block to cover 99% of block | frequency | block | frequency | block | frequency | block | frequency | block | frequency |
|---|---|---|---|---|---|---|---|---|---|---|---|---|---|---|---|---|
| NS4B | 2520 | 0.68 | 12 | 5 | 0 | Y | IMKNPTVDG | 88.86 | IMKNAVDG | 7.82 | MVRNPMVDG | 1.03 | IMKNPTIDG | 1.03 | VAKNPVDG | 0.8 |
| NS4B | 2549 | 1.42 | 9 | 4 | 1.92 | Y | FEKQLGQVM | 50.1 | FEKQLGQIM | 39.79 | MQKKVGQIM | 5.6 | MQKKVGQVL | 2.19 | DTLWTMPVA | 1.06 |
| NS4B | 2595 | 1.47 | 9 | 5 | 0.03 | Y | GKFWNTTIA | 59.35 | GRFWNTTIA | 30.6 | SSVWNATTA | 5.77 | SAVWNSTTA | 2.19 | TLWTMPVAC | 1.06 |
| NS4B | 2596 | 1.47 | 9 | 5 | 0.03 | Y | KFWNTTIAV | 59.35 | RFWNTTIAV | 30.6 | SVWNATTAI | 5.84 | AVWNSTTAT | 2.19 |  |  |
| NS4B | 2597 | 0.63 | 8 | 4 | 0.03 | Y | FWNTTIAVS | 89.95 | VWNATTAIG | 5.84 | VWNSTTATG | 2.19 | LWTMPVACG | 1.06 | TGVMRGNHY | 0.53 |
| NS4B | 2607 | 0.68 | 13 | 5 | 0 | Y | ANIFRGSYL | 89.82 | CHIMRGGWL | 5.64 | CHVMRGSYL | 2.22 | SGVVRGSLW | 0.96 | GVMRGNHYA | 0.53 |
| NS4B | 2608 | 0.68 | 14 | 5 | 0 | Y | NIFRGSYLA | 89.82 | HIMRGGWLS | 5.64 | HVMRGSYLA | 2.16 | GVVRGSLWG | 0.96 | VMRGNHYAF | 0.53 |
| NS4B | 2609 | 0.68 | 13 | 5 | 0 | Y | IFRGSYLAG | 89.82 | IMRGGWLSC | 5.64 | VMRGSYLAG | 2.16 | VVRGSLWGF | 1.03 | MRGNHYAFV | 0.53 |
| NS4B | 2610 | 0.68 | 15 | 5 | 0 | Y | FRGSYLAGA | 89.72 | MRGGWLSCL | 5.8 | MRGSYLAGG | 2.16 | VRGSLWGFL | 1.03 | RGNHYAFVG | 0.53 |
| NS4B | 2611 | 0.69 | 17 | 5 | 0 | Y | RGSYLAGAG | 89.62 | RGGWLSCLS | 5.67 | RGSYLAGGS | 2.16 | RGSLWGFLP | 1.03 | GNHYAFVGV | 0.53 |
| NS4B | 2612 | 0.7 | 16 | 5 | 0 | Y | GSYLAGAGL | 89.66 | GGWLSCLSI | 5.84 | GSYLAGGSI | 2.16 | GSLWGFLPL | 1.06 | GKTLGEVWK | 0.86 |
| NS4B | 2641 | 0.65 | 11 | 5 | 0 | Y | GETLGEKWK | 89.85 | GRTLGEVWK | 5.84 | GRTLGEQWK | 2.16 | GDTLGDLWK | 1.06 | PVSRGSAKL | 2.25 |
| NS5 | 2690 | 1.6 | 10 | 5 | 0 | Y | AVSRGSAKL | 46.02 | AVSRGTAKL | 42.27 | PVSRGTAKL | 5.77 | AVSRGSSKI | 3.38 | VSRGTAKLA | 1.06 |
| NS5 | 2691 | 1.77 | 9 | 5 | 0 | Y | VSRGTAKLR | 46.65 | VSRGAKLR | 29.97 | VSRGSAKLQ | 18.34 | VSRGSSKIR | 3.38 | SRGTAKLAW | 1.06 |
| NS5 | 2692 | 1.77 | 10 | 5 | 0 | Y | SRGTAKLRW | 46.65 | SRGAKLRW | 29.94 | SRGAKLQW | 18.34 | SRGSSKIRW | 3.38 | GKVMDLGCG | 1.06 |
| NS5 | 2711 | 1.65 | 13 | 5 | 0 | Y | GKVIDLGCG | 47.51 | GKVDLGCG | 30.97 | GRVIDLGCG | 19.43 | GEVDLGCG | 1.06 | KVMDLGCGR | 0.63 |
| NS5 | 2712 | 1.66 | 14 | 5 | 0 | Y | KVIDLGCGR | 47.48 | KVDLGCGR | 30.97 | RVIDLGCGR | 19.43 | EVDLGCGR | 1.06 |  |  |
| NS5 | 2713 | 1 | 10 | 3 | 0 | Y | VIDLGCGRG | 66.91 | VDLGCGRG | 32.06 | VMDLGCGRG | 0.7 |  |  |  |  |
| NS5 | 2714 | 1 | 10 | 3 | 0 | Y | IDLGCGRGG | 66.84 | VDLGCGRGG | 32.1 | MDLGCGRGG | 0.7 |  |  |  |  |
| NS5 | 2715 | 0.03 | 6 | 1 | 0 | Y | DLGCGRGGW | 99.8 |  |  |  |  |  |  |  |  |
| NS5 | 2716 | 0.38 | 7 | 2 | 0 | Y | LGCGRGGWS | 93.07 | LGCGRGGWC | 6.73 |  |  |  |  |  |  |
| NS5 | 2717 | 0.38 | 7 | 2 | 0 | Y | GCGRGGWSY | 93.07 | GCGRGGWCY | 6.73 |  |  |  |  |  |  |
| NS5 | 2718 | 0.39 | 9 | 2 | 0 | Y | CGRGGWSYY | 93 | CGRGGWCYY | 6.73 |  |  |  |  |  |  |
| NS5 | 2719 | 0.84 | 12 | 5 | 0 | Y | GRGGWSYYC | 86.41 | GRGGWCYYM | 5.87 | GRGGWSYYM | 3.45 | GRGGWSYYA | 3.15 | GRGGWCYYA | 0.86 |
| NS5 | 2735 | 1.73 | 17 | 5 | 0.1 | Y | EVKGYTIKGG | 44.26 | EVRGYTIKGG | 27.59 | EVKGLTIKGG | 25.73 | GVKGFTLGR | 0.76 | SVKAYTIGG | 0.73 |

Fig. 40-9

Species: panFIVE (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2738 | 1.23 | 18 | 5 | 0.07 | Y | GYTKGGPGH | 67.37 | GLTKGGPGH | 27.62 | GYTKGGAGH | 2.42 | AYTIGGKGH | 0.83 | G

Fig. 40-10

Species: panFIVE (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2956 | 1.26 | 12 | 5 | 0 | Y | ASSMNGVW | 70.99 | ASSMINGVW | 18.77 | ASSLVNGVW | 8.09 | AASLINGVV | 1.03 | AASMVNGVI | 0.76 |
| NS5 | 2961 | 1.52 | 11 | 5 | 0.03 | Y | NGVWKLLTK | 54.08 | NGVWKLLTK | 35.81 | NGVVRLLSK | 5.87 | NGVVKLMSK | 2.16 | NGVVKLLSW | 1.06 |
| NS5 | 2962 | 1.52 | 10 | 5 | 0.03 | Y | GVWKLLTKP | 54.08 | GVWRLLTKP | 35.84 | GVVRLLSKP | 5.87 | GVVKLM

Fig. 40-11

Species: panFIVE (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3092 | 0.03 | 6 | 1 | 0 | Y | NMMGKREKK | 99.77 | | | | | | |
| NS5 | 3093 | 0.45 | 8 | 2 | 0 | Y | MMGKREKKL | 91.55 | MMGKREKKP | 8.06 | | | | |
| NS5 | 3094 | 0.5 | 7 | 3 | 0 | Y | MGKREKKLG | 90.82 | MGKREKKPG | 8.06 | | | | |
| NS5 | 3095 | 0.5 | 7 | 3 | 0 | Y | GKREKKLGE | 90.82 | GKREKKPGE | 8.06 | | | | |
| NS5 | 3096 | 0.5 | 7 | 3 | 0 | Y | KREKKLGEF | 90.82 | KREKKPGEF | 8.06 | | | | |
| NS5 | 3097 | 0.5 | 7 | 3 | 0 | Y | REKKLGEFG | 90.82 | RE

Fig. 40-12

Species: panFIVE (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3117 | 0.84 | 6 | 3 | 0.03 | Y | WLGARFLEF | 77.62 | WLGAR

Fig. 40-13

Species: panFIVE (9

Fig. 40-14

Species: panFIVE (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS5 | 3350 | 1.61 | 13 | 5 | 0 | Y | PFCS

Fig. 40-15

Species: panFIVE (9-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency | block | frequency |
|---|---|---|---|---|---|---|---|---|---|---|---|---|---|---|---|---|
| NS5 | 3445 | 1.12 | 15 | 3 | 0 | Y | QWMTTEDML | 61.8 | EWMTTEDML | 36.24 | AWMTTEDML | 0.96 | | | | |
| NS5 | 3483 | 0.8 | 9 | 5 | 0 | Y | GIKREDQWCG | 86.44 | GIKREDIWCG | 8.09 | GIKREDLWCG | 3.48 | TKRQDKLCG | 0.86 | PKSHDMLCS | 0.56 |
| NS5 | 3484 | 0.8 | 10 | 5 | 0 | Y | KREDQWCGS | 86.44 | KREDIWCGS | 8.06 | KREDLWCGS | 3.48 | KRQDKLCGS | 0.86 | KSHDMLCSS | 0.56 |
| NS5 | 3485 | 0.81 | 11 | 5 | 0 | Y | REDQWCGSL | 86.31 | REDIWCGSL | 8.06 | REDLWCGSL | 3.48 | RQDKLCGSL | 0.86 | SHDMLCSSL | 0.56 |
| NS5 | 3486 | 0.81 | 10 | 5 | 0 | Y | EDQWCGSLI | 86.31 | EDIWCGSLI | 8.06 | EDLWCGSLI | 3.48 | QDKLCGSLI | 0.86 | HDMLCSSLV | 0.76 |
| NS5 | 3487 | 0.8 | 9 | 5 | 0 | Y | DQWCGSLIG | 86.31 | DIWCGSLIG | 8.06 | DLWCGSLIG | 3.48 | DMLCSSLVG | 1.06 | DKLCGSLIG | 0.86 |
| NS5 | 3488 | 0.8 | 10 | 5 | 0 | Y | QWCGSLIGL | 86.27 | IWCGSLIGT | 8.06 | LWCGSLIGL | 3.48 | MLCSSLVGR | 1.06 | KLCGSLIGM | 0.86 |
| NS5 | 3489 | 0.81 | 12 | 5 | 0 | Y | WCGSLIGLT | 86.31 | WCGSLIGTR | 8.06 | WCGSLIGLS | 3.45 | LCSSLVGRK | 0.93 | LCGSLIGMT | 0.86 |

Fig. 41-1

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| anC | 35 | 1.59 | 16 | 5 | 9.15 | Y | SQLAKRFSKG | 51.59 | QQLTKRFSLG | 27.72 | SQLAKRFSRG | 6.63 | QGLVKRFSTG | 3.18 | SNKIKQKTKQ | 0.86 |
| anC | 36 | 1.57 | 15 | 5 | 9.15 | Y | QLAKRFSKGL | 51.66 | QLTKRFSLGM | 27.72 | QLAKRFSRGL | 6.73 | GLVKRFSTGL | 3.18 | NKIKQKTKQI | 0.86 |
| anC | 37 | 1.57 | 15 | 5 | 9.15 | Y | LAKRFSKGLL | 51.66 | LTKRFSLGML | 27.72 | LAKRFSRGLL | 6.73 | LVKRFSTGLF | 3.18 | IKQKTKQIG | 0.86 |
| E | 412 | 0.32 | 6 | 3 | 0.03 | Y | VDRGWGNGCG | 95.76 | TDRGWGNGCG | 2.16 | SDRGWGNHCG | 1.13 | | | | |
| E | 413 | 0.11 | 5 | 2 | 0.03 | Y | DRGWGNGCGL | 98.67 | DRGWGNHCGL | 1.13 | | | | | | |
| E | 414 | 0.11 | 6 | 2 | 0.03 | Y | RGWGNGCGLF | 98.64 | RGWGNHCGLF | 1.13 | | | | | | |
| E | 415 | 0.11 | 6 | 2 | 0.03 | Y | GWGNGCGLFG | 98.64 | GWGNHCGLFG | 1.13 | | | | | | |
| E | 416 | 0.11 | 6 | 2 | 0.03 | Y | WGNGGGLFGK | 98.64 | WGNHCGLFGK | 1.13 | | | | | | |
| E | 417 | 0.11 | 6 | 2 | 0 | Y | GNGCGLFGKG | 98.67 | GNHCGLFGKG | 1.13 | | | | | | |
| E | 418 | — | 7 | 3 | 0 | Y | NGCGLFGKGS | 67.57 | NGCGLFGKGG | 31.07 | NHCGLFGKGS | 1.13 | | | | |
| E | 419 | 1.53 | 8 | 5 | 0 | Y | GCGLFGKGSL | 58.79 | GCGLFGKGGI | 27.65 | GCGLFGKGGI | 8.82 | GCGLFGKGGV | 3.42 | HCGLFGKGSI | 1.13 |
| E | 583 | 0.67 | 14 | 5 | 0 | Y | VLGSQEGAMH | 89.75 | ALGSQEGALH | 5.84 | ALGSQEGGLH | 2.12 | NLGDQTGVLL | 1.13 | ALGNQEGSLK | 0.80 |
| E | 756 | 0.83 | 16 | 5 | 0 | Y | RMAILGDTAW | 86.27 | RLAALGDTAW | 7.89 | RMAILGETAW | 3.35 | RLTVIGEHAW | 1.13 | RLAVMGDTAW | 0.43 |
| E | 757 | 0.83 | 16 | 5 | 0 | Y | MAILGDTAWD | 86.27 | LAALGDTAWD | 7.89 | MAILGETAWD | 3.35 | LTVIGEHAWD | 1.13 | LAVMGDTAWD | 0.43 |
| E | 758 | 0.83 | 15 | 5 | 0 | Y | AILGDTAWDF | 86.31 | AALGDTAWDF | 7.89 | AILGETAWDF | 3.35 | TVIGEHAWDF | 1.13 | AVMGDTAWDF | 0.43 |
| E | 759 | 0.82 | 14 | 5 | 0 | Y | ILGDTAWDFG | 86.31 | ALGDTAWDFG | 7.96 | ILGEHAWDFG | 3.35 | VIGEHAWDFG | 1.13 | VMGDTAWDFS | 0.43 |
| E | 760 | 0.41 | 11 | 4 | 0 | Y | LGDTAWDFGS | 94.46 | LGETAWDFGS | 3.35 | IGEHAWDFGS | 1.13 | MGDTAWDFSS | 0.43 | | |
| E | 763 | 1.74 | 15 | 5 | 0 | Y | TAWDFGSIGG | 41.21 | TAWDFGVGG | 29.28 | TAWDFGSLGG | 27.25 | HAWDFGSTGG | 0.86 | TAWDFSSAGG | 0.43 |
| NS1 | 1042 | 0.69 | 13 | 5 | 0 | Y | AVHADMGYWI | 89.59 | AIHSDLSYWI | 5.24 | AVHSDLSYWI | 2.79 | SAHGSPTFWM | 0.86 | AVHTDQSLWM | 0.80 |
| NS1 | 1043 | 0.7 | 15 | 5 | 0 | Y | VHADMGTYWIE | 89.59 | IHSDLSYWIE | 5.24 | VHSDLSYWIE | 2.75 | AHGSPTFWMG | 0.86 | VHTDQSLWMK | 0.80 |
| NS1 | 1044 | 0.6 | 10 | 4 | 0 | Y | HADMGYWIES | 89.69 | HSDLSYWIES | 8.02 | HTDQSLWMKS | 0.86 | HGSPTFWMGS | 0.86 | | |
| NS1 | 1076 | 0.82 | 13 | 5 | 0.9 | Y | WPKSHTLWSN | 85.48 | WPETHTLWGD | 7.69 | WPKTHTLWSN | 3.48 | WPASHTIDNA | 1.03 | WPRSHTLWSN | 0.83 |
| NS1 | 1162 | 0.52 | 8 | 4 | 0 | Y | WCCRSCTLPP | 92.27 | WCCRSCTLPP | 4.34 | WCCRSCSLPP | 2.16 | WCCRTCTLPP | 0.86 | | |
| NS1 | 1163 | 0.55 | 9 | 5 | 0 | Y | CCRSCTLPPL | 92.31 | CCRSCTMPPL | 3.48 | CCRSCSLPPL | 2.16 | CCRSCTMPPV | 0.86 | CCRTCTLPPV | 0.80 |

Fig. 41-2

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS1 | 1164 | 0.55 | 9 | 5 | 0 | Y | CRSCTLPPLR | 92.34 | CRSCTMPPLR | 3.48 | CRSCSLPPLR | 2.06 | CRSCTMPPVS | 0.86 | CRICTLPPVT | 0.80 |
| NS1 | 1176 | 0.69 | 14 | 5 | 0.03 | Y | GEDGCWYGME | 89.75 | TDSGCWYGME | 5.11 | TENGCWYGME | 2.59 | TGTD

Fig. 41-3

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1852 | 1.44 | 14 | 5 | 0 | Y | REIVDLMCHA | 57.82 | REIVDLMCHA | 32.06 | NEIVDVMCHA | 8.02 | GAI

Fig. 41-4

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1906 | 1.04 | 9 | 4 | 0 | Y | EAAAIFMTAT | 69.93 | EAAGIFMTAT | 27.72 | KCALVLMTAT | 1.06 | ESATILMTAT | 0.86 | | |
| NS3 | 1907 | 1.05 | 10 | 4 | 0 | Y | AAAIFMTATP | 69.93 | AAGIFMTATP | 27.72 | CALVLMTATP | 1.03 | SATILMTATP | 0.86 | | |
| NS3 | 1908 | 1.02 | 9 | 4 | 0 | Y | AAIFMTATPP | 70.23 | AGIFMTATPP | 27.72 | ALVLMTATPP | 1.03 | ATILMTATPP | 0.86 | | |
| NS3 | 1909 | 1.01 | 7 | 3 | 0 | Y | AIFMTATPPG | 70.29 | GIFMTATPPG | 27.72 | LVLMTATPPG | 1.03 | | | | |
| NS3 | 1910 | 1.18 | 9 | 5 | 0 | Y | IFMTATPPGS | 68 | IFMTATPPGA | 26.96 | IFMTATPPGK | 2.98 | VLMTATPPGK | 1.03 | ILMTATPPGT | 0.86 |
| NS3 | 1958 | 0.66 | 10 | 5 | 0 | Y | GKTVWFVPSI | 89.75 | GKTVWFVASV | 5.87 | GKTVWFVPS

Fig. 41-5

| protein | block starting position | block entropy (10-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2057 | 0.88 | 9 | 3 | 0 | Y | AQRGRIGRN | 76.36 | AQRGRVGRN | 22.35 | AQRGRVGRQ | 0.86 | | |
| NS3 | 2138 | 0.66 | 12 | 5 | 0.03 | Y | LMRRGDLPYW | 89.29 | LLRTADLPYW | 7.59 | LLTHCDFTPW | 1.06 | LMKRGDLPYW | 0.56 |
| NS3 | 2139 | 0.63 | 11 | 4 | 0.03 | Y | MRRGDLPYWL | 89.29 | LRTADLPYWL | 8.06 | LTHCDFTPWL | 1.06 | | |
| NS3 | 2140 | 1.53 | 13 | 5 | 0.03 | Y | RRGDLPYWLA | 45.82 | RTADLPYWLS | 43.5 | RTADLPYWLA | 8.06 | RNCDLPYWLS | 0.70 |
| NS4A | 2340 | 1.51 | 14 | 5 | 0.03 | Y | LLIPEPEKQR | 49.8 | LLIPEPDRQR | 39.72 | VLQPEAGKQR | 7.96 | VVIPEPGQQR | 0.80 |
| NS4A | 2341 | 1.52 | 17 | 5 | 0.03 | Y | LIPEPEKQRT | 49.8 | LIPEPDRQRT | 39.72 | LQPEAGKQRS | 7.92 | VIPEPGQQRS | 0.76 |
| NS4A | 2342 | 1.51 | 15 | 5 | 0.03 | Y | IPEPEKQRTP | 49.8 | IPEPDRQRTP | 39.72 | QPEAGKQRSS | 7.92 | IPEPGQQRSI | 0.80 |
| NS4A | 2343 | 1.5 | 13 | 5 | 0.03 | Y | PEPEKQRTPQ | 49.9 | PEPDRQRTPQ | 39.72 | PEAGKQRSSD | 7.92 | PEPGQQRSIQ | 0.80 |
| NS4A | 2344 | 1.5 | 14 | 5 | 0.03 | Y | EPEKQRTPQD | 49.9 | EPDRQRTPQD | 39.75 | EAGKQRSSDD | 7.89 | EPGQQRSIQD | 0.80 |
| NS4A | 2345 | 1.5 | 13 | 5 | 0.03 | Y | PEKQRTPQDN | 49.93 | PDRQRTPQDN | 39.75 | AGKQRSSDDN | 7.89 | PGQQRSIQDN | 0.80 |
| NS4A | 2346 | 1.5 | 12 | 5 | 0.03 | Y | EKQRTPQDNQ | 49.93 | DRQRTPQDNQ | 39.75 | GKQRSSDDNK | 7.89 | GQQRSIQDNQ | 0.80 |
| NS4A | 2347 | 1.47 | 10 | 4 | 0.03 | Y | KQRTPQDNQL | 50.2 | RQRTPQDNQL | 39.75 | KQRSSDDNKL | 7.96 | | |
| NS4A | 2348 | 1.57 | 11 | 5 | 0 | Y | QRTPQDNQLA | 58.75 | QRTPQDNQLT | 27.72 | QRSQTDNQLA | 7.99 | QRSSDDNKLA | 1.06 |
| NS4B | 2411 | 0.64 | 8 | 4 | 0 | Y | PASAWTLYAV | 89.95 | PATAWSLYAV | 5.84 | PATAWLYGG | 2.19 | PARSWGTYYL | 1.06 |
| NS4B | 2412 | 0.65 | 11 | 4 | 0 | Y | ASAWTLYAVA | 89.92 | ATAWSLYAVT | 5.67 | ATAWALYGGS | 2.19 | ARSWGTYVLV | 1.06 | GAAWTYYGI | 0.86 |
| NS4B | 2413 | 0.65 | 11 | 5 | 0 | Y | SAWTLYAVAT | 89.92 | TAWSLYAVTT | 5.67 | TAWALYGGST | 2.19 | RSWGTYVLVV | 1.06 | AAWTYYVGIV | 0.86 |
| NS4B | 2414 | 0.66 | 12 | 5 | 0 | Y | AWTLYAVATT | 89.89 | AWSLYAVTTA | 5.67 | AWALYGGSTV | 2.19 | SWGTYVLVVS | 1.06 | AWTYYVGIVT | 0.86 |
| NS4B | 2496 | 0.67 | 16 | 5 | 0 | Y | HYAIIGPGLQ | 89.72 | HYAYMYPGWQ | 5.8 | HYGYMLPGWQ | 2.19 | HLAIVVSGLE | 1.06 | HWSLILPGIK | 0.73 |
| NS4B | 2497 | 0.67 | 15 | 5 | 0 | Y | YAIIGPGLQA | 89.75 | YAYMYPGWQA | 5.8 | YGYMLPGWQA | 2.19 | LAIVVSGLEA | 1.06 | WSLILPGIKA | 0.73 |
| NS4B | 2498 | 0.67 | 16 | 5 | 0 | Y | AIIGPGLQAK | 89.72 | AYMYPGWQAE | 5.8 | GYMLPGWQAE | 2.19 | AIVVSGLEAE | 1.06 | SLILPGIKAQ | 0.73 |
| NS4B | 2499 | 0.67 | 15 | 5 | 0 | Y | IIGPGLQAKA | 89.72 | YMVPGWQAEA | 5.8 | YMLPGWQAEA | 2.19 | IVVSGLEAEL | 1.06 | LILPGIKAQQ | 0.86 |
| NS4B | 2500 | 0.67 | 16 | 5 | 0 | Y | IGPGLQAKAT | 89.69 | MVPGWQAEAM | 5.8 | MLPGWQAEAL | 2.19 | VVSGLEAELT | 1.06 | ILPGIKAQQS | 0.86 |
| NS4B | 2501 | 0.67 | 16 | 5 | 0 | Y | GPGLQAKATR | 89.69 | VPGWQAEAMR | 5.8 | LPGWQAEALR | 2.19 | VSGLEAELTQ | 1.06 | LPGIKAQQSK | 0.86 |
| NS4B | 2502 | 0.67 | 14 | 5 | 0 | Y | PGLQAKATRE | 89.75 | PGWQAEAMRS | 5.7 | PGWQAEALRA | 2.19 | SGLEAELTQR | 1.06 | PGIKAQQSKL | 0.86 |

Fig. 41-6

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4B | 2503 | 0.67 | 14 | 5 | 0 | Y | GLQAKATREA | 89.79 | GWQAEAMRSA | 5.7 | GWQAEALRAA | 2.19 | GLE

Fig. 41-7

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 2712 | 1.66 | 14 | 5 | 0 | Y | KVIDLGCCGRG | 47.48 | KVVDLGCCGRG | 30.97 | RVIDLGCCGRG | 19.43 | EVDLGCCGRG | 1.06 | KVMDLGCCGRG | 0.63 |
| NS5 | 2713 | 1.01 | 11 | 3 | 0 | Y | VIDLGCCGRGG | 66.84 | VDLGCCGRGG | 32.06 | VMDLGCCGRGG | 0.7 | | | | |
| NS5 | 2714 | 1 | 10 | 3 | 0 | Y | IDLGCCGRGGW | 66.84 | VDLGCCGRGGW | 32.1 | MDLGCCGRGGW | 0.7 | | | | |
| NS5 | 2715 | 0.38 | 7 | 2 | 0 | Y | DLGCCGRGGWS | 93.07 | DLGCCGRGGWC | 6.73 | | | | | | |
| NS5 | 2716 | 0.38 | 7 | 2 | 0 | Y | LGCCGRGGWSY | 93.07 | LGCCGRGGWCY | 6.73 | | | | | | |
| NS5 | 2717 | 0.39 | 9 | 2 | 0 | Y | GCCGRGGWSYY | 93 | GCCGRGGWCYY | 6.73 | | | | | | |
| NS5 | 2718 | 0.84 | 13 | 5 | 0.07 | Y | CGRGGWSYYC | 86.37 | CGRGGWSYYM | 5.87 | CGRGGWSYYM | 3.45 | CGRGGWSYYA | 3.15 | CGRGGWCYYA | 0.86 |
| NS5 | 2738 | 1.24 | 19 | 5 | 0.03 | Y | GYTKGGPGHE | 67.34 | GLTKGGPGHE | 27.62 | GYTKGGAGHE | 2.42 | AYTIGGKGHE | 0.83 | GFTLGRDGHE | 0.73 |
| NS5 | 2740 | 0.41 | 20 | 4 | 0.03 | Y | TKGGPGHEEP | 94.99 | TKGGAGHEEP | 2.42 | TLGRDGHEKP | 0.83 | TIGGKGHETP | 0.76 | | |
| NS5 | 2776 | 0.56 | 11 | 5 | 0.03 | Y | CDTLLCDIGE | 92.24 | VDTLLCDIGE | 3.48 | SDTLFCDIGE | 2.19 | ADTIMCDIGE | 0.83 | SDTLLCDIGE | 0.66 |
| NS5 | 2777 | 0.27 | 7 | 3 | 0.03 | Y | DTLLCDIGES | 96.45 | DTLFCDIGES | 2.19 | DTIMCDIGES | 0.83 | | | | |
| NS5 | 2778 | 0.27 | 8 | 3 | 0.03 | Y | TLLCDIGESS | 96.52 | TLFCDIGES | 2.19 | TIMCDIGESN | 0.66 | | | | |
| NS5 | 2779 | 0.73 | 8 | 4 | 0 | Y | LLCDIGESSP | 86.6 | LLCDIGESSS | 10.01 | LFCDIGESSP | 2.19 | IMCDIGESNP | 0.66 | | |
| NS5 | 2843 | 0.57 | 15 | 5 | 0 | Y | LVRNPLSRNS | 92.08 | LVRCPLSRNS | 3.38 | LVRLPLSRNS | 2.19 | LVRTPFSRNS | 1.06 | VIRNPLSRNS | 0.83 |
| NS5 | 2844 | 0.58 | 13 | 5 | 0 | Y | VRNPLSRNST | 91.94 | VRCPLSRNST | 3.38 | VRLPLSRNSN | 2.19 | VRTPFSRNST | 1.06 | IRNPLSRNST | 0.96 |
| NS5 | 2845 | 0.49 | 11 | 4 | 0 | Y | RNPLSRNSTH | 92.9 | RCPLSRNSTH | 3.48 | RLPLSRNSNH | 2.22 | RTPFSRNSTH | 1.06 | | |
| NS5 | 2846 | 0.5 | 12 | 4 | 0 | Y | NPLSRNSTHE | 92.9 | CPLSRNSTHE | 3.48 | LPLSRNSTHE | 2.22 | TPFSRNSTHE | 1.03 | | |
| NS5 | 2847 | 0.27 | 9 | 3 | 0 | Y | PLSRNSTHEM | 96.45 | PLSRNSNHEM | 2.22 | PFSRNSTHEM | 1.03 | | | | |
| NS5 | 2848 | 0.28 | 11 | 3 | 0 | Y | LSRNSTHEMY | 96.35 | LSRNSNHEMY | 2.22 | FSRNSTHEMY | 1.03 | | | | |
| NS5 | 2849 | 0.34 | 11 | 3 | 0 | Y | SRNSTHEMYW | 95.49 | SRNSNHEMYW | 2.22 | SRNSTHEMYY | 1.89 | | | | |
| NS5 | 2850 | 1.04 | 14 | 5 | 0 | Y | RNSTHEMYWV | 76.82 | RNSNHEMYWI | 18.67 | RNSNHEMYWV | 2.22 | RNSTHEMYYS | 1.03 | RNSTHEMYYV | 0.86 |
| NS5 | 2851 | 1.04 | 14 | 5 | 0 | Y | NSTHEMYWVS | 76.82 | NSTHEMYWIS | 18.67 | NSNHEMYWVS | 2.22 | NSTHEMYST | 1.03 | NSTHEMYVS | 0.86 |
| NS5 | 2938 | 0.85 | 7 | 5 | 0 | Y | PYKTWAYHGS | 86.34 | PYRTWNYHGS | 5.87 | PYRTWAYHGS | 3.65 | PYRTWTHGS | 2.19 | PYRTWQYWGS | 1.06 |
| NS5 | 2939 | 0.85 | 7 | 5 | 0 | Y | YKTWAYHGSY | 86.34 | YRTWNYHGSY | 5.87 | YRTWAYHGSY | 3.65 | YRTWTYHGSY | 2.19 | YRTWQYWGSY | 1.06 |

Fig. 41-8

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2954 | 1.25 | 12 | 5 | 0 | Y | GSASSMYNGV | 71.05 | GSASSMINGV | 18.77 | GSASSLVNGV | 8.06 | GSA

Fig. 41-9

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3092 | 0.45 | 9 | 2 | 0 | Y | NMMGKREKKL | 91.55 | NMMGKREKKP | 8.02 | | | | |
| NS5 | 3093 | 0.52 | 9 | 3 | 0 | Y | MMGKREKKLG | 90.68 | MMGKREKKPG | 8.06 | MMGKREKKLS | 0.86 | | |
| NS5 | 3094 | 0.5 | 7 | 3 | 0 | Y | MGKREKKLGE | 90.82 | MGKREKKPGE | 8.06 | MGKREKKLSE | 0.86 | | |
| NS5 | 3095 | 0.5 | 7 | 3 | 0 | Y | GKREKKLGEF | 90.82 | GKREKKPGEF | 8.06 | GKREKKLSEF | 0.86 | | |
| NS5 | 3096 | 0.5 | 7 | 3 | 0 | Y | KREKKLGEFG | 90.82 | KREKKPGEFG | 8.06 | KREKKLSEFG | 0.86 | | |
| NS5 | 3097 | 0.81 | 9 | 5 | 0 | Y | REKKLGEFGK | 86.11 | REKKPGEFGK | 8.06 | REKKLGEFGR | 3.65 | REKKLGEFGV | 1.06 | REKKLSEFGK | 0.86 |
| NS5 | 3098 | 0.81 | 11 | 5 | 0 | Y | EKKLGEFGKA | 86.07 | EKKPGEFGKA | 8.06 | EKKLGEFGRA | 3.65 | EKKLGEFGVA | 1.03 | EKKLSEFGKA | 0.86 |
| NS5 | 3099 | 0.82 | 12 | 5 | 0 | Y | KKLGEFGKAK | 86.07 | KKPGEFGKAK | 8.06 | KKLGEFGRAK | 3.65 | KKLGEFGVAK | 1.03 | KKLSEFGKAK | 0.86 |
| NS5 | 3100 | 0.82 | 13 | 5 | 0 | Y | KLGEFGKAKG | 86.04 | KPGEFGKAKG | 8.06 | KLGEFGRAKG | 3.65 | KLGEFGVAKG | 1.03 | KLSEFGKAKG | 0.86 |
| NS5 | 3101 | 0.82 | 12 | 5 | 0 | Y | LGEFGKAKGS | 86.07 | PGEFGKAKGS | 8.06 | LGEFGRAKGS | 3.65 | LGEFGVAKGS | 1.03 | LSEFGKAKGS | 0.86 |
| NS5 | 3102 | 0.4 | 9 | 4 | 0 | Y | GEFGKAKGSR | 94.3 | GEFGRAKGSR | 3.65 | GEFGVAKGSR | 1.03 | SEFGKAKGSR | 0.86 | | |
| NS5 | 3103 | 0.34 | 10 | 3 | 0 | Y | EFGKAKGSRA | 95.09 | EFGRAKGSRA | 3.65 | | | | | | |
| NS5 | 3104 | 0.33 | 9 | 3 | 0 | Y | FGKAKGSRAI | 95.13 | FGRAKGSRAI | 3.65 | | | | | | |
| NS5 | 3105 | 0.33 | 9 | 3 | 0 | Y | GKAKGSRAIW | 95.13 | GRAKGSRAIW | 3.65 | | | | | | |
| NS5 | 3106 | 0.73 | 10 | 4 | 0 | Y | KAKGSRAIWY | 87.07 | KAKGSRAIWF | 8.06 | VAKGSRAIWY | 1.03 | | | | |
| NS5 | 3107 | 0.43 | 9 | 2 | 0 | Y | AKGSRAIWYM | 91.71 | AKGSRAIWFM | 8.06 | | | | | | |
| NS5 | 3108 | 0.43 | 8 | 2 | 0 | Y | KGSRAIWYMW | 91.71 | KGSRAIWFMW | 8.06 | | | | | | |
| NS5 | 3109 | 0.43 | 7 | 2 | 0 | Y | GSRAIWYMWL | 91.71 | GSRAIWFMWL | 8.09 | | | | | | |
| NS5 | 3110 | 0.43 | 6 | 2 | 0 | Y | SRAIWYMWLG | 91.74 | SRAIWFMWLG | 8.09 | | | | | | |
| NS5 | 3111 | 0.51 | 8 | 3 | 0 | Y | RAIWYMWLGA | 90.68 | RAIWFMWLGA | 8.09 | RAIWYMWLGS | 1.03 | | | | |
| NS5 | 3112 | 0.52 | 9 | 3 | 0 | Y | AIWYMWLGAR | 90.65 | AIWFMWLGAR | 8.09 | AIWYMWLGSR | 1.03 | | | | |
| NS5 | 3113 | 1.24 | 9 | 5 | 0 | Y | IWYMWLGARF | 71.75 | IWFMWLGARY | 19 | IWFMWLGARF | 5.87 | IWFMWLGARY | 2.22 | IWYMWLGSRF | 1.03 |
| NS5 | 3114 | 1.24 | 9 | 5 | 0 | Y | WYMWLGARFL | 71.75 | WYMWLGARYL | 19 | WFMWLGARFL | 5.87 | WFMWLGARYL | 2.22 | WYMWLGSRFL | 1.03 |
| NS5 | 3115 | 1.24 | 9 | 5 | 0.03 | Y | YMWLGARFLE | 71.75 | YMWLGARYLE | 19 | FMWLGARFLE | 5.84 | FMWLGARYLE | 2.22 | YMWLGSRFLE | 1.03 |

Fig. 41-10

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3116 | 0.84 | 7 | 3 | 0.03 | Y | MWLGARFLEF | 77.59 | MWLGARYLEF | 21.22 | MWLGSRFLEF | 1.03 | | |
| NS5 | 3117 | 0.84 | 6 | 3 | 0.03 | Y | WLGARF

Fig. 41-11

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3232 | 1.93 | 12 | 5 | 0 | Y | VIS

Fig. 41-12

Species: panFIVE (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3381 | 1.51 | 16 | 5 | 0 | Y | ARISQGAGWS | 49.73 | ARVSQGAGWS | 49.89 | ARISPGAGWN | 39.89 | GRYSPGNGWM | 8.02 |

Fig. 42-1

Species: panFIVE (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| anC | 36 | 1.57 | 15 | 5 | 9.15 | Y | QLAKRFSKGLL | 51.66 | QLTKRFSLGML | 27.72 | QLAKRFSRGLL | 6.73 | GLVKRFSTGLF | 3.18 | NKIHQKTKQJG | 0.86 |
| E | 412 | 0.32 | 7 | 4 | 0.03 | Y | VDRGWGNGCGL | 95.76 | TDRGWGNGCGL | 2.06 | SDRGWGNHCGL | 1.13 | SDRGWGNGCGL | 0.86 | | |
| E | 413 | 0.11 | 6 | 2 | 0.03 | Y | DRGWGNGCGLF | 98.64 | DRGWGNHCGLF | 1.13 | | | | | | |
| E | 414 | 0.11 | 6 | 2 | 0.03 | Y | RGWGNGCGLFG | 98.64 | RGWGNHCGLFG | 1.13 | | | | | | |
| E | 415 | 0.11 | 6 | 2 | 0.03 | Y | GWGNGCGLFGK | 98.64 | GWGNHCGLFGK | 1.13 | | | | | | |
| E | 416 | 0.11 | 6 | 2 | 0.03 | Y | WGNGCGLFGKG | 98.64 | WGNHCGLFGKG | 1.13 | | | | | | |
| E | 417 | 1.01 | 8 | 3 | 0 | Y | GNGCGLFGKGS | 67.54 | GNGGGLFGKGG | 31.07 | GNHCGLFGKGS | 1.13 | | | | |
| E | 418 | 1.54 | 9 | 5 | 0 | Y | NGCGLFGKGSL | 58.79 | NGCGLFGKGGI | 27.65 | NGCGLFGKGS | 8.79 | NGCGLFGKGGV | 3.42 | NHCGLFGKGSI | 1.13 |
| E | 756 | 0.83 | 16 | 5 | 0 | Y | RMAILGDTAWD | 86.27 | RLAALGDTAWD | 7.89 | RMAILGETAWD | 3.35 | RLTVIGEHAWD | 1.13 | RLAVMGDTAWD | 0.43 |
| E | 757 | 0.83 | 16 | 5 | 0 | Y | MAILGDTAWDF | 86.27 | LAALGDTAWDF | 7.89 | MAILGETAWDF | 3.35 | LTVIGEHAWDF | 1.13 | LAVMGDTAWDF | 0.43 |
| E | 758 | 0.83 | 15 | 5 | 0 | Y | AILGDTAWDFG | 86.31 | AALGDTAWDFG | 7.89 | AILGETAWDFG | 3.35 | TVIGEHAWDFG | 1.13 | AVMGDTAWDFS | 0.43 |
| E | 759 | 0.82 | 14 | 5 | 0 | Y | ILGDTAWDFGS | 86.31 | ALGDTAWDFGS | 7.96 | ILGETAWDFGS | 3.35 | VIGEHAWDFGS | 1.13 | VMGDTAWDFSS | 0.43 |
| NS1 | 1042 | 0.7 | 15 | 5 | 0 | Y | AVHADMGYWIE | 89.59 | AIHSDLSYWIE | 5.24 | AVHSDLSYWIE | 2.75 | SAHGSPTFWMG | 0.86 | AVHTDQSLWMK | 0.8 |
| NS1 | 1043 | 0.7 | 15 | 5 | 0 | Y | VHADMGYWIES | 89.59 | IHSDLSYWIES | 5.24 | VHSDLSYWIES | 2.75 | AHGSPTFWMGS | 0.86 | VHTDQSLWMKS | 0.8 |
| NS1 | 1162 | 0.55 | 10 | 5 | 0 | Y | WCCRSCTLPPL | 92.27 | WCCRSCTLPPL | 3.48 | WCCRSCTLPPL | 2.16 | WCCRSCTMPPV | 0.86 | WCCRTCTLPPV | 0.8 |
| NS1 | 1163 | 0.55 | 10 | 5 | 0 | Y | CCRSCTLPPLR | 92.31 | CCRSCTMPPLR | 3.48 | CCRSCSLPPLR | 2.06 | CCRSCTMPPVS | 0.86 | CCRTCTLPPVT | 0.8 |
| NS1 | 1176 | 0.69 | 14 | 5 | 0.03 | Y | GEDGCWYGMEI | 89.75 | TDSGCWYGMEI | 5.11 | TENGCWYGMEI | 2.59 | TGTDCWYAMEI | 1.06 | GSDGCWYPMEI | 0.83 |
| NS1 | 1177 | 0.68 | 13 | 5 | 0 | Y | EDGCWYGMEIR | 89.75 | DSGCWYGMEIR | 5.11 | ENGCWYGMEIR | 2.62 | GTDCWYAMEIR | 1.06 | SDGCWYPMEIR | 0.83 |
| NS1 | 1178 | 0.65 | 8 | 4 | 0.03 | Y | DGCWYGMEIRP | 89.89 | SGCWYGMEIRP | 5.31 | NGCWYGMEIRP | 2.75 | TDCWYAMEIRP | 1.06 | | |
| NS3 | 1635 | 1.38 | 10 | 5 | 0 | Y | VFHTMWHVTRG | 63.1 | TFHTMWHVTRG | 27.69 | VFHTLWHTRG | 5.84 | VFHTLWHTTKG | 2.16 | VLHTMWHVTRG | 1.06 |
| NS3 | 1636 | 0.79 | 10 | 5 | 0 | Y | FHTMWHVTRGA | 87.3 | FHTLWHTTKGA | 5.84 | FHTLWHTTRGA | 3.48 | FHTLWHTRGS | 2.16 | LHTMWHVTRGA | 1.06 |
| NS3 | 1637 | 0.85 | 9 | 5 | 0 | Y | HTMWHVTRGAV | 86.44 | HTLWHTTKGAA | 5.87 | HTMWHVTRGSY | 3.48 | HTLWHTTRGAA | 2.19 | HTMWHVTRGAA | 1.06 |
| NS3 | 1814 | 0.65 | 9 | 3 | 0 | Y | LRTLILAPTRV | 88.53 | LRTLVLAPTRV | 7.82 | LRTLVLAPTRV | 3.15 | | | | |
| NS3 | 1815 | 0.63 | 6 | 3 | 0 | Y | RTLILAPTRW | 88.69 | RTAVLAPTRW | 7.82 | RTLVLAPTRW | 3.18 | | | | |

Fig. 42-2

Species: panFIVE (11-mers)

| protein | block starting position | block entropy | total peptides in block | # peptides required to cover 99% of block | gap/X fraction | 99% of block covered w/ => 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS3 | 1816 | 0.66 | 7 | 4 | 0 | Y | TLILAPTRVVA | 88.69 | TAVLAPTRVVA | 7.86 | TLVLAPTRVVL | 1.92 | TLVLAPTRVVA | 1.26 | | 1.06 |
| NS3 | 1818 | 1.53 | 8 | 5 | 0 | Y | ILAPTRVVAAE | 50 | ILAPTRVVASE | 38.89 | VLAPTRVVAAE | 7.82 | VLAPTRVVASE | 1.29 | VLAPTRVVLKE | 0.86 |
| NS

Fig. 42-3

Species: panFIVE (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 1888 | 1.28 | 14 | 5 | 0 | Y | DPASIAARGYI | 64.29 | DPSSIAARGYI | 29.91 | DPSSIAARGYI | 3.18 | DPASIAARGWA | 0.86 |
| NS3 | 1904 | 1.4 | 9 | 5 | 0 | Y | MGEAAAIFMTA | 61.9 | MGEAAGIFMTA | 27.72 | LGEAAAIFMTA | 8.06 | ANESATILMTA | 0.86 |
| NS3 | 1905 | 1.04 | 9 | 4 | 0 | Y | GEAAAIFMTAT | 69.93 | GEAAGIFMTAT | 27.72 | NKCALVLMTAT | 1.06 | | |
| NS3 | 1906 | 1.05 | 11 | 4 | 0 | Y | EAAAIFMTATP | 69.89 | EAAGIFMTATP | 27.72 | KCALVLMTATP | 1.03 | | |
| NS3 | 1907 | 1.05 | 10 | 4 | 0 | Y | AAAIFMTATPP | 69.93 | AAGIFMTATPP | 27.72 | CALVLMTATPP | 1.03 | | |
| NS3 | 1908 | 1.02 | 9 | 4 | 0 | Y | AAIFMTATPPG | 70.23 | AGIFMTATPPG | 27.72 | ALVLMTATPPG | 1.03 | | |
| NS3 | 2003 | 1.47 | 10 | 4 | 0 | Y | DWDFVVTTDIS | 49.97 | DWDFVVTTDIS | 40.02 | DWDFVVTTDIS | 7.96 | | |
| NS3 | 2004 | 1.46 | 8 | 4 | 0 | Y | WDFVVTTDISE | 50 | WDFVVTTDISE | 40.02 | WDFVVTTDISE | 7.96 | | |
| NS3 | 2005 | 1.39 | 8 | 3 | 0 | Y | DFVVTTDISEM | 51.06 | DFVVTTDISEM | 40.02 | DFVVTTDISEM | 7.92 | | |
| NS3 | 2006 | 1.39 | 8 | 3 | 0 | Y | FVVTTDISEMG | 51.06 | FVVTTDISEMG | 40.02 | FVVTTDISEMG | 7.92 | | |
| NS3 | 2007 | 0.49 | 7 | 2 | 0 | Y | VTTDISEMGA | 91.08 | VTTDISEMGA | 7.92 | | | | |
| NS3 | 2008 | 0.48 | 6 | 2 | 0 | Y | VTTDISEMGAN | 91.11 | ITTDISEMGAN | 7.92 | | | | |
| NS3 | 2009 | 0.16 | 2 | 2 | 0 | Y | TTDISEMGANF | 98.04 | TTDISEMGANL | 1.06 | | | | |
| NS3 | 2010 | 1.27 | 7 | 4 | 0 | Y | TDISEMGANFK | 48.81 | TDISEMGANFR | 47.02 | TDISEMGANFG | 2.19 | TDISEMGANLD | 1.06 |
| NS3 | 2011 | 1.28 | 7 | 4 | 0 | Y | DISEMGANFKA | 48.74 | DISEMGANFRA | 47.02 | DISEMGANFGA | 2.19 | DISEMGANLDV | 1.06 |
| NS3 | 2023 | 1.44 | 9 | 5 | 0 | Y | RVIDPRRCLKP | 62.23 | RVIDPRRCMKP | 27.72 | RVIDSRKSVKP | 5.87 | RVIDGRTNIKP | 1.06 |
| NS3 | 2024 | 1.38 | 9 | 5 | 1.06 | Y | VIDPRRCLKPV | 62.2 | VIDPRRCMKPV | 27.72 | VIDSRKSVKPT | 5.84 | VLDCRTAFKPV | 0.76 |
| NS3 | 2025 | 1.38 | 11 | 5 | 1.06 | Y | IDPRRCLKPVI | 62.2 | IDPRRCMKPVI | 27.72 | IDSRKSVKPTI | 5.80 | LDCRTAFKPVL | 0.76 |
| NS3 | 2026 | 1.39 | 12 | 5 | 1.06 | Y | DPRRCLKPVIL | 62.1 | DPRRCMKPVIL | 27.72 | DSRKSVKPTIL | 5.80 | DCRTAFKPVLV | 0.76 |
| NS3 | 2054 | 1.61 | 12 | 5 | 0 | Y | ASAAQRGRIG | 49.3 | SSAAQRGRIG | 27.02 | ASAAQRGRVG | 22.02 | | |
| NS3 | 2055 | 0.8 | 9 | 4 | 0 | Y | SAAQRGRGR | 76.53 | SAAQRGRGR | 23.34 | AAQRGRGRQ | 0.86 | | |
| NS3 | 2056 | 0.88 | 6 | 2 | 0 | Y | AAQRGRGRN | 76.36 | AAQRGRGRN | 22.35 | | | | |
| NS3 | 2138 | 0.66 | 9 | 3 | 0.03 | Y | LMRGDLPVWL | 89.29 | LLRTADLPVWL | 7.59 | LLTHCDFTPWL | 1.06 | LMKRGDLPVWL | 0.56 |
| NS3 | 2139 | 1.53 | 12 | 5 | 0.03 | Y | MRGDLPVWLA | 45.82 | LRTADLPVWLA | 43.47 | LTHCDFTPWLA | 8.06 | VRNCDLPVWLS | 0.7 |

(additional frequency columns) — MRGDLPVWLS | LVRNCDLPVWL 0.70 | LTHCDFTPWLA 8.06 values per row as shown

Fig. 42-4

Species: panFIVE (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS4A | 2340 | 1.52 | 17 | 5 | 0.03 | Y | LLIPEPEKQRT | 49.8 | LLIPEPDRQRT | 39.72 | VLQPEAGKQRS | 1.03 | VVIPEPGQQRS | 0.76 |
| NS4A | 2341 | 1.52 | 17 | 5 | 0.03 | Y | LIPEPEKQRTP | 49.8 | LIPEPDRQRTP | 39.72 | LQPEAGKQRSS | 1.03 | VIPEPGQQRSI | 0.76 |
| NS4A | 2342 | 1.51 | 15 | 5 | 0.03 | Y | IPEPEKQRTPQ | 49.8 | IPEPDRQRTPQ | 39.72 | QPEAGKQRSSD | 1.03 | IPEPGQQRSIQ | 0.8 |
| NS4A | 2343 | 1.5 | 14 | 5 | 0.03 | Y | PEPEKQRTPQD | 49.9 | PEPDRQRTPQD | 39.75 | PEAGKQRSSDD | 1.03 | PEPGQQRSIQD | 0.8 |
| NS4A | 2344 | 1.5 | 14 | 5 | 0.03 | Y | EPEKQRTPQDN | 49.93 | EPDRQRTPQDN | 39.75 | EAGKQRSSDDN | 1.03 | EPGQQRSIQDN | 0.8 |
| NS4A | 2345 | 1.5 | 13 | 5 | 0.03 | Y | PEKQRTPQDNQ | 49.93 | PDRQRTPQDNQ | 39.75 | AGKQRSSDDNK | 1.03 | PGQQRSIQDNQ | 0.8 |
| NS4A | 2346 | 1.5 | 12 | 5 | 0.03 | Y | EKQRTPQDNQL | 49.93 | DRQRTPQDNQL | 39.75 | GKQRSSDDNKL | 1.03 | GQQRSIQDNQV | 0.8 |
| NS4B | 2411 | 0.65 | 11 | 5 | 0 | Y | PASAWTLYAVA | 89.92 | PATAWSLYAVT | 5.67 | PARSWGTYVLV | 1.06 | PGAAWTYVYGI | 0.86 |
| NS4B | 2412 | 0.65 | 12 | 5 | 0 | Y | ASAWTLYAVAT | 89.92 | ATAWSLYAVTT | 5.67 | ARSWGTYVLVW | 1.06 | GAAWTYVYGIV | 0.86 |
| NS4B | 2413 | 0.66 | 13 | 5 | 0 | Y | SAWTLYAVATT | 89.89 | TAWSLYAVTTA | 5.67 | RSWGTYVLVYS | 1.06 | AAWTYVYGIVT | 0.86 |
| NS4B | 2496 | 0.67 | 16 | 5 | 0 | Y | HYAIIGPGLQA | 89.72 | HYGYMLPGWQA | 5.8 | HLAIVVSGLEA | 1.06 | HWSLILPGIKA | 0.73 |
| NS4B | 2497 | 0.67 | 16 | 5 | 0 | Y | YAIIGPGLQAK | 89.72 | YGYMLPGWQAE | 5.8 | LAIVVSGLEAE | 1.06 | WSLILPGIKAQ | 0.73 |
| NS4B | 2498 | 0.67 | 16 | 5 | 0 | Y | AIIGPGLQAKA | 89.72 | GYMLPGWQAEA | 5.8 | AIVVSGLEAEL | 1.06 | SLILPGIKAQQ | 0.73 |
| NS4B | 2499 | 0.67 | 16 | 5 | 0 | Y | IIGPGLQAKAT | 89.69 | YMLPGWQAEAM | 5.8 | IVVSGLEAELT | 1.06 | LILPGIKAQQS | 0.86 |
| NS4B | 2500 | 0.68 | 17 | 5 | 0 | Y | IGPGLQAKATR | 89.66 | MLPGWQAEALR | 5.8 | VVSGLEAELTQ | 1.06 | ILPGIKAQQSK | 0.86 |
| NS4B | 2501 | 0.68 | 17 | 5 | 0 | Y | GPGLQAKATRE | 89.75 | LPGWQAEALRA | 5.67 | VSGLEAELTQR | 1.06 | LPGIKAQQSKL | 0.86 |
| NS4B | 2502 | 0.67 | 15 | 5 | 0 | Y | PGLQAKATREA | 89.72 | PGWQAEALRAA | 5.7 | SGLEAELTQRA | 1.06 | PGIKAQQSKLA | 0.83 |
| NS4B | 2503 | 0.68 | 16 | 5 | 0 | Y | GLQAKATREAQ | 89.75 | GWQAEALRAAQ | 5.7 | GLEAELTQRAH | 1.06 | GIKAQQSKLAQ | 0.83 |
| NS4B | 2504 | 0.68 | 17 | 5 | 0 | Y | LQAKATREAQK | 89.72 | WQAEALRAAQR | 5.7 | LEAELTQRAHK | 1.06 | IKAQQSKLAQR | 0.73 |
| NS4B | 2505 | 0.67 | 15 | 5 | 0 | Y | QAKATREAQKR | 89.75 | QAEALRAAQRR | 5.74 | EAELTQRAHKV | 1.06 | KAQQSKLAQRR | 0.73 |
| NS4B | 2512 | 1.37 | 13 | 5 | 0 | Y | AQKRTAAGIMK | 63.83 | AQRRTAAGIMK | 25.99 | AHKVFFSAMYR | 1.06 | AQRVFHGVAK | 0.66 |
| NS4B | 2513 | 1.37 | 12 | 5 | 0 | Y | QKRTAAGIMKN | 63.83 | QRRTAAGIMKN | 25.99 | HKVFFSAMYRN | 1.06 | QRRVFHGVAKN | 0.7 |
| NS4B | 2514 | 1.37 | 11 | 5 | 0 | Y | KRTAAGIMKNP | 63.86 | RRTAAGIMKNP | 26.03 | KVFFSAMYRNP | 1.06 | RRVFHGVAKNP | 0.7 |
| NS4B | 2515 | 1.37 | 11 | 5 | 0 | Y | RTAAGIMKNPT | 63.86 | RTAAGIMKNPT | 25.99 | VFFSAMYRNPM | 7.96 | RVFHGVAKNPV | 0.8 |

Fig. 42-5

Species: panFIVE (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS4B | 2517 | 0.68 | 13 | 5 | 0 | Y | AAGIMKNPTVD | 88.83 | AAGIMKNAVVD | 7.82 | AAGIMKNPTID | 1.03 | FSAMVRNPMVD | 1.03 | FHGVAKNPVVD | 0.8 |
| NS4B | 2518 | 0.68 | 13 | 5 | 0 | Y | AGIMKNPTVDG | 88.83 | AGIMKNAVVDG | 7.82 | AGIMKNPTIDG | 1.03 | SAMVRNPMVDG | 1.03 | HGVAKNPVVDG | 0.8 |
| NS4B | 2549 | 1.42 | 9 | 4 | 1.92 | Y | FEKQLGQMLL | 50.1 | FEKQLGQIMLL | 39.79 | MQKKVGQIMLI | 5.60 | MQKKVGQVLLI | 2.19 | DTLWTMPVACG | 1.06 |
| NS4B | 2595 | 1.47 | 9 | 5 | 0.03 | Y | GKFWNTTIAVS | 59.35 | GRFWNTTIAVS | 30.6 | SSYWNATTAIG | 5.77 | SAVWNSTTATG | 2.19 | TGVMRGNHYAF | 0.53 |
| NS4B | 2607 | 0.68 | 14 | 5 | 0 | Y | ANIFRGSYLAG | 89.82 | CHIMRGGWLSC | 5.64 | CHVMRGSYLAG | 2.16 | SGVVRGSLWGF | 0.96 | GVMRGNHYAFV | 0.53 |
| NS4B | 2608 | 0.69 | 17 | 5 | 0 | Y | NIFRGSYLAGA | 89.72 | HIMRGGWLSCL | 5.64 | HVMRGSYLAGG | 2.16 | GWRGSLWGFL | 0.96 | MRGNHYAFVGV | 0.53 |
| NS4B | 2610 | 0.7 | 18 | 5 | 0 | Y | FRGSYLAGAGL | 89.62 | MRGGWLSCLSI | 5.67 | MRGSYLAGGSI | 5.67 | VRGSLWGFLPL | 1.03 | GKVMDLGCGRG | 0.63 |
| NS4B | 2711 | 1.66 | 14 | 5 | 0 | Y | GKVIDLGCGRG | 47.48 | GKVIDLGCGRG | 30.97 | GRVIDLGCGRG | 19.43 | GEVVDLGCGRG | 1.06 | KVMDLGCGRGG | 0.63 |
| NS4B | 2712 | 1.66 | 15 | 5 | 0 | Y | KVIDLGCGRGG | 47.41 | KVIDLGCGRGG | 30.97 | RVIDLGCGRGG | 19.43 | EVVDLGCGRGG | 1.06 | | |
| NS4B | 2713 | 1.01 | 11 | 3 | 0 | Y | VIDLGCGRGGW | 66.84 | VVDLGCGRGGW | 32.06 | VMDLGCGRGGW | 0.70 | | | | |
| NS4B | 2714 | 1.34 | 13 | 4 | 0 | Y | IDLGCGRGGWS | 60.88 | VDLGCGRGGWS | 31.53 | IDLGCGRGGWC | 5.97 | MDLGCGRGGWS | 0.63 | | |
| NS4B | 2715 | 0.38 | 7 | 2 | 0 | Y | DLGCGRGGWCY | 93.07 | DLGCGRGGWCY | 6.73 | | | | | | |
| NS4B | 2716 | 0.39 | 9 | 2 | 0 | Y | LGCGRGGWSYY | 93 | LGCGRGGWCYY | 6.73 | | | | | | |
| NS4B | 2717 | 0.84 | 13 | 5 | 0 | Y | GCGRGGWSYYC | 86.37 | GCGRGGWCYYM | 5.87 | GCGRGGWSYYM | 3.45 | GCGRGGWSYYA | 3.15 | GCGRGGWCYYA | 0.86 |
| NS5 | 2776 | 0.56 | 11 | 3 | 0.03 | Y | CDTLLCDIGES | 92.24 | VDTLLCDIGES | 3.48 | SDTLFCDIGES | 2.19 | ADTIMCDIGES | 0.83 | SDTILCDIGES | 0.66 |
| NS5 | 2777 | 0.3 | 10 | 3 | 0.03 | Y | DTLLCDIGESS | 96.32 | DTLFCDIGESS | 2.19 | DTIMCDIGESN | 0.66 | | | | |
| NS5 | 2778 | 0.74 | 9 | 4 | 0.03 | Y | TLLCDIGESSP | 86.54 | TLLCDIGESSP | 9.98 | TLFCDIGESSP | 2.19 | TIMCDIGESNP | 1.06 | | |
| NS5 | 2843 | 0.59 | 17 | 5 | 0 | Y | LVRNPLSRNST | 91.91 | LVRCPLSRNST | 3.38 | LVRLPLSRNSN | 3.38 | LVRTPFSRNST | 2.19 | VIRNPLSRNST | 0.83 |
| NS5 | 2844 | 0.58 | 13 | 5 | 0 | Y | VRNPLSRNSTH | 91.94 | VRCPLSRNSNH | 3.38 | VRLPLSRNSNH | 3.38 | VRTPFSRNSTH | 2.22 | IRNPLSRNSTH | 0.96 |
| NS5 | 2845 | 0.5 | 13 | 4 | 0 | Y | RNPLSRNSTHE | 92.87 | RCPLSRNSTHE | 3.48 | RLPLSRNSNHE | 3.48 | RTPFSRNSTHE | 2.22 | | |
| NS5 | 2846 | 0.5 | 12 | 4 | 0 | Y | NPLSRNSTHEM | 92.9 | CPLSRNSTHEM | 3.48 | LPLSRNSNHEM | 3.48 | TPFSRNSTHEM | 2.22 | | |
| NS5 | 2847 | 0.28 | 11 | 3 | 0 | Y | PLSRNSTHEMY | 96.35 | PLSRNNHEMY | 2.22 | PFSRNSTHEMY | 1.03 | | | | |
| NS5 | 2848 | 0.36 | 12 | 4 | 0 | Y | LSRNSTHEMYW | 95.49 | LSRNSNHEMYW | 2.22 | ESRNSTHEMYY | 1.03 | LSRNSTHEMYY | 0.86 | | |
| NS5 | 2849 | 1.04 | 15 | 5 | 0 | Y | SRNSTHEMYWV | 76.79 | SRNSNHEMYWV | 18.67 | SRNSTHEMYWV | 2.22 | SRNSTHEMYYS | 1.03 | SRNSTHEMYYV | 0.86 |

Fig. 42-6

Species: panFIVE (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 2850 | 1.04 | 14 | 5 | 0 | Y | RNSTHEMYWVS | 76.82 | RNSNHEMYWVS | 2.22 | RNSTHEMYST | 1.03 | RNSTHEMYVVS | 0.86 |
| NS5 | 2938 | 0.85 | 7 | 5 | 0 | Y | PYKTWAYHGSY | 86.34 | PYRTWAYHGSY | 3.65 | PYRTWYHGSY | 2.19 | PYRTWQYWGSY | 1.06 |
| NS5 | 2954 | 1.26 | 13 | 5 | 0.03 | Y | GSASSMVNGVV | 70.99 | GSASSLVNGVV | 8.06 | GSAASLINGVV | 1.03 | GSAASMVNGVI | 0.76 |
| NS5 | 2961 | 1.52 | 11 | 5 | 0.03 | Y | NGVVKLLTKPW | 54.08 | NGVVRLLSKPW | 5.87 | NGVVKLMSKPW | 2.16 | NGVVKLLSWPW | 1.06 |
| NS5 | 2962 | 1.52 | 10 | 5 | 0.03 | Y | GVVKLLTKPWD | 54.08 | GVVRLLSKPWD | 5.87 | GVVKLMSKPWD | 2.16 | GVVKLLSWPWN | 1.06 |
| NS5 | 2980 | 1.27 | 10 | 4 | 0.07 | Y | MAMTDTTPFGQ | 55.37 | LAMTDTTPFGQ | 3.48 | MAMTDTTAFGQ | 1.03 | | |
| NS5 | 2981 | 0.1 | 6 | 2 | 0.07 | Y | AMTDTTPFGQQ | 98.77 | AMTDTTAFGQQ | 1.03 | | | | |
| NS5 | 2982 | 0.09 | 4 | 2 | 0.07 | Y | MTDTTPFGQQR | 98.84 | MTDTTAFGQQR | 1.03 | | | | |
| NS5 | 2983 | 0.09 | 4 | 2 | 0.07 | Y | TDTTPFGQQRV | 98.84 | TDTTAFGQQRV | 1.03 | | | | |
| NS5 | 2984 | 0.1 | 5 | 2 | 0.07 | Y | DTTPFGQQRVF | 98.81 | DTTAFGQQRVF | 1.03 | | | | |
| NS5 | 2985 | 0.1 | 6 | 2 | 0.03 | Y | TTPFGQQRVFK | 98.77 | TTAFGQQRVFK | 1.03 | | | | |
| NS5 | 2986 | 0.13 | 9 | 2 | 0.03 | Y | TPFGQQRVFKE | 98.61 | TAFGQQRVFKE | 0.73 | | | | |
| NS5 | 2987 | 0.13 | 9 | 2 | 0.03 | Y | PFGQQRVFKEK | 98.61 | AFGQQRVFKEK | 0.73 | | | | |
| NS5 | 2988 | 0.07 | 8 | 1 | 0.03 | Y | FGQQRVFKEKV | 99.34 | | | | | | |
| NS5 | 2989 | 0.07 | 8 | 1 | 0 | Y | GQQRVFKEKVD | 99.3 | | | | | | |
| NS5 | 2990 | 0.07 | 8 | 1 | 0 | Y | QQRVFKEKVDT | 99.3 | | | | | | |
| NS5 | 2991 | 0.5 | 9 | 2 | 0 | Y | QRVFKEKVDTR | 90.62 | RVFKEKVDTRA | 8.75 | | | | |
| NS5 | 2992 | 0.57 | 11 | 3 | 0 | Y | RVFKEKVDTRT | 89.69 | VFKEKVDTKAP | 8.75 | RVFKEKVDTRA | 0.90 | | |
| NS5 | 2993 | 1.41 | 14 | 5 | 0 | Y | VFKEKVDTRTP | 62.17 | VFKEKVDTKAP | 27.52 | VFKEKVDTRAK | 8.02 | VFKEKVDTKAQ | 0.73 |
| NS5 | 3088 | 1.27 | 16 | 4 | 0 | Y | TCYNMMGKRE | 68.24 | TCIYNMMGKRE | 22.28 | HCVYNMMGKRE | 8.09 | | |
| NS5 | 3089 | 0.46 | 12 | 2 | 0 | Y | CVYNMMGKREK | 91.48 | CIYNMMGKREK | 8.12 | | | | |
| NS5 | 3090 | 0.46 | 12 | 2 | 0 | Y | VYNMMGKREKK | 91.45 | IYNMMGKREKK | 8.12 | | | | |
| NS5 | 3091 | 0.47 | 12 | 2 | 0 | Y | YNMMGKREKKP | 91.45 | YNMMGKREKKP | 8.02 | | | | |
| NS5 | 3092 | 0.52 | 10 | 3 | 0 | Y | NMMGKREKKLG | 90.68 | NMMGKREKKPG | 8.02 | NMMGKREKKLS | 0.86 | | |

Fig. 42-7

| protein | block starting position | block entropy (11-mers) | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3093 | 0.52 | 9 | 3 | 0 | Y | MMGKREKKLG

Fig. 42-8

Species: panFIVE (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3117 | 0.84 | 7 | 3 | 0.03 | Y | WLGAR

Fig. 42-9

Species: panFIVE (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3236 | 1.42 | 12 | 4 | 0 | Y | RD

Fig. 42-10

Species: panFIVE (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3487 | 0.82 | 14 | 5 | 0 | Y | DQWCGSLIGLT | 86.24 | DIWCGSLIGTR | 8.06 |

Fig. 43-1

Species: panFlavi (8-mers)

| protein | block starting position | block entropy | total peptides in block | # peptides required to cover 99% of block | gap/X fraction of block | 99% of block covered w/ <= 5 peptides? | block to cover 99% of | frequency | block to cover 99% of | frequency | block to cover 99% of | frequency | block to cover 99% of | frequency |
|---|---|---|---|---|---|---|---|---|---|---|---|---|---|---|
| E | 502 | 0.51 | 14 | 4 | 0.03 | Y | VDRGWGNG | 93.08 | TDRGWGNG | 2.44 | SDRGWGNH | 2.15 | SDRGWGNG | 1.7 |
| E | 503 | 0.21 | 10 | 2 | 0.03 | Y | DRGWGNGC | 97.34 | DRGWGNHC | 2.15 | | | | |
| E | 504 | 0.23 | 10 | 2 | 0.03 | Y | RGWGNGCG | 97.15 | RGWGNHCG | 2.15 | | | | |
| E | 505 | 0.25 | 13 | 2 | 0.03 | Y | GWGNGCGL | 97.05 | GWGNHCGL | 1.96 | | | | |
| E | 506 | 0.25 | 14 | 2 | 0.03 | Y | WGNGCGLF | 97.02 | WGNHCGLF | 1.96 | | | | |
| E | 507 | 0.25 | 14 | 2 | 0 | Y | GNGCGLFG | 97.05 | GNHCGLFG | 1.96 | | | | |
| E | 508 | 0.24 | 12 | 2 | 0 | Y | NGCGLFGK | 97.18 | NHCGLFGK | 1.96 | | | | |
| E | 509 | 0.23 | 10 | 2 | 0 | Y | GCGLFGKG | 97.21 | HCGLFGKG | 1.96 | | | | |
| E | 510 | 0.98 | 10 | 2 | 0 | Y | CGLFGKGS | 69.04 | CGLFGKGG | 30.03 | | | | |
| E | 511 | 1.6 | 15 | 5 | 0 | Y | GLFGKGSL | 57.08 | GLFGKGGI | 26.73 | GLFGKGSI | 11.76 | GLFGKGGV | 3.3 | GFFGKGSI | 0.29 |
| NS3 | 2006 | 1.42 | 13 | 4 | 0 | Y | VFHTLWHV | 62.31 | TFHTMWHV | 26.83 | VFHTLWHT | 7.92 | VLHTMWHV | 2.08 | | |
| NS3 | 2007 | 0.63 | 12 | 3 | 0 | Y | FHTMWHVT | 89.26 | FHTLWHT | 7.92 | LHTMWHVT | 2.05 | | | | |
| NS3 | 2008 | 0.59 | 14 | 4 | 0 | Y | HTMWHVTR | 90.87 | HTLWHTTR | 5.77 | HTLWHTTR | 2.34 | HTMWHVTK | 0.19 | | |
| NS3 | 2009 | 0.59 | 14 | 4 | 0 | Y | TMWHVTRG | 90.87 | TLWHTTRG | 5.77 | TLWHTTKG | 2.34 | TMWHVTKG | 0.19 | | |
| NS3 | 2010 | 0.82 | 17 | 5 | 0 | Y | MWHVTRGA | 87.18 | LWHTTKGA | 5.77 | MWHVTRGA | 3.59 | LWHTTRGA | 2.34 | MWHVTQGA | 0.16 |
| NS3 | 2120 | 1.61 | 12 | 4 | 0 | Y | VGLYGNG | 46.79 | IVGLYGNG | 39.23 | VIGLYGNG | 10.45 | IIGLYGNG | 2.56 | | |
| NS3 | 2172 | 1.28 | 16 | 5 | 0 | Y | DLHPGSGK | 59.01 | DLHPGAGK | 36.76 | DMHPGSGK | 1.92 | DFHPGAGK | 1.06 | DAHPGSGK | 0.26 |
| NS3 | 2173 | 1.26 | 15 | 5 | 0 | Y | LHPGSGKT | 59.01 | LHPGAGKT | 36.89 | MHPGSGKT | 1.99 | FHPGAGKT | 1.06 | AHPGSGKT | 0.26 |
| NS3 | 2174 | 1.45 | 13 | 4 | 0 | Y | HPGSGKTR | 58.97 | HPGAGKTR | 30.13 | HPGAGKTR | 8.04 | HPGSGKTH | 2.12 | | |
| NS3 | 2198 | 0.82 | 16 | 5 | 0 | Y | TLILAPTR | 85.87 | TAVLAPTR | 8.11 | TLVLAPTR | 4.52 | TVILAPTR | 0.32 | TAILAPTR | 0.29 |
| NS3 | 2199 | 0.83 | 16 | 5 | 0 | Y | LILAPTRV | 85.87 | AVLAPTRV | 8.11 | LVLAPTRV | 4.49 | VILAPTRV | 0.32 | VVLAPTRV | 0.29 |
| NS3 | 2200 | 0.62 | 10 | 2 | 0 | Y | ILAPTRVV | 86.51 | VLAPTRVV | 12.92 | | | | | | |
| NS3 | 2201 | 0.3 | 11 | 2 | 0 | Y | LAPTRWA | 95.83 | LAPTRWL | 3.4 | | | | | | |
| NS3 | 2203 | 1.3 | 17 | 5 | 0 | Y | PTRVYAAE | 56.73 | PTRVYASE | 38.91 | PTRVLKE | 1.7 | PTRVYLSE | 1.28 | PTRVYLRE | 0.42 |
| NS3 | 2239 | 0.71 | 17 | 4 | 0 | Y | VDLMCHAT | 87.05 | VDMCHAT | 10.67 | IDAMCHAT | 1.03 | IDVMCHAT | 0.45 | | |

Fig. 43-2

Species: panFlavi (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2240 | 0.76 | 15 | 4 | 0 | Y | DLMCHATF | 87.12 | DVMCHATL | 8.62 | DVMCHATY | 2.28 | DAMCHATL | 1.06 | | |
| NS3 | 2266 | 0.87 | 15 | 5 | 0 | Y | IMDEAHFT | 83.88 | VMDEAHFT | 11.83 | IMDEAHWT | 2.08 | IMDEAHFL | 1.19 | IMDEGHWT | 0.22 |
| NS3 | 2267 | 0.35 | 12 | 4 | 0 | Y | MDEAHFTD | 95.71 | MDEAHWTD | 2.08 | MDEAHFLD | 1.19 | MDEGHWTD | 0.26 | | |
| NS3 | 2268 | 0.34 | 10 | 3 | 0 | Y | DEAHFTDP | 95.74 | DEAHWTDP | 2.12 | DEAHFLDP | 1.19 | | | | |
| NS3 | 2277 | 0.57 | 19 | 4 | 0 | Y | SIAARGYI | 92.21 | SVAARGYI | 3.46 | SIAARGHL | 2.05 | SIAARGWA | 1.28 | | |
| NS3 | 2298 | 0.31 | 11 | 3 | 0.1 | Y | IFMTATPP | 95.96 | VLMTATPP | 2.28 | ILMTATPP | 0.93 | | | | |
| NS3 | 2299 | 0.28 | 9 | 2 | 0.1 | Y | FMTATPPG | 96.06 | LMTATPPG | 3.21 | | | | | | |
| NS3 | 2300 | 1.27 | 17 | 5 | 0.1 | Y | MTATPPGS | 65.99 | MTATPPGT | 28.17 | MTATPPGA | 2.88 | MTATPPGK | 1.63 | MSATPPGT | 0.22 |
| NS3 | 2351 | 0.53 | 16 | 5 | 0 | Y | GKTVWFVP | 93.21 | GKTVWFVA | 2.37 | GRTVWFVP | 2.02 | RPTAWFLP | 1.25 | GRTVWFVP | 0.29 |
| NS3 | 2352 | 0.52 | 16 | 5 | 0 | Y | KTVWFVPS | 93.27 | KTVWFVAS | 2.37 | RTAWFVPS | 1.99 | PTAWFLPS | 1.25 | RTVWFVPS | 0.29 |
| NS3 | 2397 | 1.61 | 15 | 5 | 0 | Y | WDFVVTTD | 48.75 | WDYVVTTD | 38.72 | WDFVVITD | 8.37 | PDFVVTTD | 2.02 | PDFILATD | 1.28 |
| NS3 | 2398 | 1.49 | 13 | 4 | 0 | Y | DFVVTTDI | 50.77 | DYVVTTDI | 38.72 | DFVVITDI | 8.37 | DFILATDI | 1.28 | | |
| NS3 | 2399 | 1.49 | 13 | 4 | 0 | Y | FVVTTDIS | 50.77 | YVVTTDIS | 38.72 | FVVITDIS | 8.37 | FILATDIA | 1.28 | | |
| NS3 | 2400 | 0.61 | 12 | 3 | 0 | Y | VVTTDISE | 89.49 | VITTDISE | 8.37 | ILATDIAE | 1.28 | | | | |
| NS3 | 2401 | 0.59 | 11 | 3 | 0 | Y | VTTDISEM | 89.62 | ITTDISEM | 8.37 | LATDIAEM | 1.28 | | | | |
| NS3 | 2402 | 0.15 | 6 | 2 | 0 | Y | TTDISEMG | 98.3 | ATDIAEMG | 1.28 | | | | | | |
| NS3 | 2403 | 0.12 | 4 | 2 | 0 | Y | TDISEMGA | 98.46 | TDIAEMGA | 1.38 | | | | | | |
| NS3 | 2404 | 0.12 | 4 | 2 | 0 | Y | DISEMGAN | 98.46 | DIAEMGAN | 1.38 | | | | | | |
| NS3 | 2405 | 0.28 | 6 | 3 | 0 | Y | ISEMGANF | 96.22 | ISEMGANL | 2.24 | IAEMGANL | 1.38 | | | | |
| NS3 | 2448 | 0.93 | 10 | 2 | 0 | Y | ASAAQRRG | 71.41 | SSAAQRRG | 27.88 | | | | | | |
| NS3 | 2449 | 0.06 | 7 | 1 | 0 | Y | SAAQRRGR | 99.49 | | | | | | | | |
| NS3 | 2450 | 0.85 | 7 | 2 | 0 | Y | AAQRRGRI | 74.94 | AAQRRGRV | 24.71 | | | | | | |
| NS3 | 2451 | 0.85 | 8 | 2 | 0 | Y | AQRRGRIG | 74.94 | AQRGRVG | 24.68 | | | | | | |
| NS3 | 2452 | 0.84 | 5 | 2 | 0 | Y | QRRGRIGR | 74.94 | QRRGRVGR | 24.78 | | | | | | |
| NS5 | 3229 | 1.32 | 15 | 5 | 0 | Y | VSRGTAKL | 47.82 | VSRGSAKL | 47.37 | VSRGSSKI | 3.27 | VSRGTSKL | 0.45 | VSRGCAKL | 0.19 |

Fig. 43-3

Species: panFlavi (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3251 | 1.04 | 11 | 3 | 0 | Y | VIDLGCGR | 65.06 | VMDLGCGR | 33.65 | | | | |
| NS5 | 3252 | 1.04 | 10 | 3 | 0 | Y | IDLGCGRG | 65.06 | MDLGCGRG | 33.69 | | | | |
| NS5 | 3253 | 0.04 | 7 | 1 | 0 | Y | DLGCGRGG | 99.65 | | | | | | |
| NS5 | 3254 | 0.04 | 7 | 1 | 0 | Y | LGCCRGGW | 99.65 | | | | | | |
| NS5 | 3255 | 0.4 | 8 | 2 | 0 | Y | GCGRGGWS | 92.95 | GCCRGGWC | 6.7 | | | | |
| NS5 | 3256 | 0.41 | 9 | 2 | 0.03 | Y | CGRGGWSY | 92.79 | CGRGGWCY | 6.7 | | | | |
| NS5 | 3257 | 0.45 | 13 | 2 | 0 | Y | GRGGWSYY | 92.44 | GRGGWCYY | 6.7 | | | | |
| NS5 | 3322 | 0.43 | 12 | 5 | 0 | Y | TILCDIGE | 94.68 | TLFCDIGE | 2.28 | TIMCDIGE | 1.15 | TILCDIGE | 0.58 |
| NS5 | 3323 | 0.43 | 11 | 5 | 0 | Y | LLCDIGES | 94.68 | LFCDIGES | 2.28 | IMCDIGES | 1.15 | ILCDIGES | 0.71 |
| NS5 | 3324 | 0.41 | 12 | 5 | 0 | Y | LCDIGESS | 94.94 | FCDIGESS | 2.28 | MCDIGESN | 0.77 | MCDIGESS | 0.67 |
| NS5 | 3325 | 0.69 | 11 | 3 | 0 | Y | CDIGESSP | 86.92 | CDIGESNP | 10.87 | CDIGESNP | 1.35 | | |
| NS5 | 3392 | 0.44 | 16 | 3 | 0 | Y | PLSRNSTH | 94.2 | PLSRNSNH | 2.47 | PFSRNSTH | 2.44 | | |
| NS5 | 3393 | 0.44 | 18 | 3 | 0 | Y | LSRNSTHE | 94.17 | LSRNSHE | 2.4 | FSRNSTHE | 2.4 | | |
| NS5 | 3394 | 0.25 | 12 | 2 | 0 | Y | SRNSTHEM | 96.76 | SRNSNHEM | 2.47 | | | | |
| NS5 | 3395 | 0.25 | 12 | 2 | 0 | Y | RNSTHEMY | 96.76 | RNSNHEMY | 2.47 | | | | |
| NS5 | 3396 | 0.5 | 16 | 4 | 0 | Y | NSTHEMYW | 93.21 | NSNHEMYW | 2.92 | NSNHEMYW | 2.47 | NSTHEMYF | 0.64 |
| NS5 | 3532 | 1.39 | 16 | 4 | 0.03 | Y | MAMTDTTP | 54.52 | IAMTDTTP | 38.75 | LAMTDTTP | 3.62 | MAMTDTTA | 2.15 |
| NS5 | 3533 | 0.26 | 11 | 2 | 0.03 | Y | AMTDTTPF | 96.83 | AMTDTTAF | 2.15 | | | | |
| NS5 | 3534 | 0.21 | 7 | 2 | 0.03 | Y | MTDTTPFG | 97.15 | MTDTTAFG | 2.34 | | | | |
| NS5 | 3535 | 0.22 | 8 | 2 | 0.06 | Y | TDTTPFGQ | 97.08 | TDTTAFGQ | 2.34 | | | | |
| NS5 | 3536 | 0.22 | 8 | 2 | 0.06 | Y | DTTPFGQQ | 97.08 | DTTAFGQQ | 2.34 | | | | |
| NS5 | 3537 | 0.22 | 8 | 2 | 0.06 | Y | TTPFGQQR | 97.08 | TTAFGQQR | 2.34 | | | | |
| NS5 | 3538 | 0.22 | 10 | 2 | 0.03 | Y | TPFGQQRV | 97.08 | TAFGQQRV | 2.34 | | | | |
| NS5 | 3539 | 0.23 | 11 | 2 | 0.03 | Y | PFGQQRVF | 97.05 | AFGQQRVF | 2.34 | | | | |
| NS5 | 3540 | 0.07 | 11 | 1 | 0.03 | Y | FGQQRVFK | 99.36 | | | | | | |

Fig. 43-4

Species: panFlavi (8-mers)

| protein | block starting position | block entropy | total peptides in block | # peptides required to cover 99% of block | gap/X fraction | 99% of block covered w/ <=5 peptides? | block | frequency | block | frequency | block | frequency | block | frequency |
|---|---|---|---|---|---|---|---|---|---|---|---|---|---|---|
| NS5 | 3541 | 0.15 | 12 | 2 | 0.03 | Y | GQQRVFKE | 98.4 | GQQRVFKD | 0

Fig. 43-5

Species: panFlavi (8-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3667 | 0.6 | 7 | 3 | 0 | Y | WY

Fig. 43-6

Species: panflavi (8-mers)

| protein | block starting position | block entropy | total peptides in block | # peptides required to cover 99% of block | gap/X fraction | 99% of block covered w/ <= 5 peptides? | block | frequency | block | frequency | block | frequency | block | frequency |
|---|---|---|---|---|---|---|---|---|---|---|---|---|---|---|
| NS5 | 3813 | 0.63 | 9 | 2 | 0 | Y | GSGQVGTY | 85.42 | GSGQVVTY | 14.23 | | | | |
| NS5 | 3814 | 0.73 | 12 | 3 | 0 | Y | SGQVGTYG | 85.29 | SGQVVTYA | 12.53 | | | | |
| NS5 | 3815 | 0.74 | 12 | 3 | 0 | Y | GQVGTYGL | 85.29 | GQVVTYAL | 12.47 | | | | |
| NS5 | 3816 | 0.73 | 10 | 3 | 0 | Y | QVGTYGLN | 85.29 | QVVTYALN | 12.53 | | | | |
| NS5 | 3817 | 0.74 | 11 | 3 | 0 | Y | VGTYGLNT | 85.29 | VVTYALNT | 12.47 | | | | |
| NS5 | 3878 | 0.68 | 21 | 5 | 0 | Y | RMAISGDD | 88.97 | RMAVSGDD | 7.82 | RMLVSGDD | 1.99 | RLLVSGDD | 0.16 | NMVIAGDD | 0.1 |
| NS5 | 3879 | 0.65 | 16 | 3 | 0 | Y | MAISGDDC | 89.17 | MAVSGDDC | 7.92 | MLVSGDDC | 1.99 | | | |
| NS5 | 3930 | 0.52 | 15 | 3 | 0 | Y | VPFCSHHF | 90.9 | VPFCSNHF | 8.04 | VEFCSNHF | 0.19 | | | |
| NS5 | 3931 | 0.63 | 20 | 5 | 0 | Y | PFCSHHFH | 90.54 | PFCSNHFT | 5.67 | PF

Fig. 44-1

Species: panFlavi (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 502 | 0.51 | 14 | 4 | 0.03 | Y | VDRGWGNGC | 93.08 | TDRGWGNGC | 2.44 | SDRGWGNHC | 2.15 | SDRGWGNGC | 1.7 | | |
| E | 503 | 0.23 | 11 | 2 | 0.03 | Y | DRGWGNGCG | 97.15 | DRGWGNHCG | 2.15 | | | | | | |
| E | 504 | 0.25 | 13 | 2 | 0.03 | Y | RGWGNGCGL | 97.05 | RGWGNHCGL | 1.96 | | | | | | |
| E | 505 | 0.25 | 14 | 2 | 0.03 | Y | GWGNGCGLF | 97.02 | GWGNHCGLF | 1.96 | | | | | | |
| E | 506 | 0.25 | 14 | 2 | 0 | Y | WGNGCGLFG | 97.02 | WGNHCGLFG | 1.96 | | | | | | |
| E | 507 | 0.25 | 12 | 2 | 0 | Y | GNGCGLFGK | 97.05 | GNHCGLFGK | 1.96 | | | | | | |
| E | 508 | 0.24 | 12 | 2 | 0 | Y | NGCGLFGKG | 97.18 | NHCGLFGKG | 1.96 | | | | | | |
| E | 509 | 1.11 | 13 | 3 | 0 | Y | GCGLFGKGS | 67.05 | GCCLFGKGG | 30.03 | HCGLFGKGS | 1.96 | | | | |
| E | 510 | 1.6 | 15 | 5 | 0 | Y | CGLFGKGSL | 57.08 | CGLFGKGGI | 26.73 | CGLFGKGS | 1.76 | CGLFGKGGV | 3.3 | CGFFGKGSI | 0.29 |
| NS3 | 2006 | 1.43 | 14 | 4 | 0 | Y | VFHTMWHVT | 62.31 | TFHTMWHVT | 26.83 | VFHTLWHTT | 7.92 | VLHTMWHVT | 2.05 | | |
| NS3 | 2008 | 0.59 | 18 | 4 | 0 | Y | HTMWHVTRG | 90.87 | HTLWHTKG | 5.77 | HTLWHTRG | 2.34 | HTMWHVTKG | 0.19 | | |
| NS3 | 2009 | 0.82 | 17 | 5 | 0 | Y | TMWHVTRGA | 87.15 | TLWHTKGA | 5.77 | TMWHVTRGS | 3.59 | TLWHTRGA | 2.34 | TMWHATEGA | 0.16 |
| NS3 | 2198 | 0.83 | 16 | 5 | 0 | Y | TLILAPTRV | 85.87 | TAVLAPTRV | 8.11 | TLVLAPTRV | 4.46 | TVILAPTRV | 0.32 | TAILAPTRV | 0.29 |
| NS3 | 2199 | 0.83 | 15 | 3 | 0 | Y | LILAPTRVV | 85.87 | AVLAPTRVV | 8.11 | LVLAPTRVV | 4.49 | VILAPTRVV | 0.32 | VVLAPTRV | 0.29 |
| NS3 | 2200 | 0.76 | 15 | 3 | 0 | Y | ILAPTRVVA | 86.35 | VLAPTRVVA | 9.46 | VLAPTRVVL | 3.24 | | | | |
| NS3 | 2266 | 0.87 | 15 | 5 | 0 | Y | IMDEAHFTD | 83.88 | VMDEAHFTD | 11.83 | IMDEAHWTD | 2.08 | IMDEAHFLD | 1.19 | IMDEAHFMD | 0.22 |
| NS3 | 2267 | 0.35 | 12 | 4 | 0 | Y | MDEAHFTDP | 95.71 | MDEAHWTDP | 2.08 | MDEAHFLDP | 1.19 | MDEGHWTDP | 0.26 | | |
| NS3 | 2298 | 0.31 | 11 | 3 | 0.1 | Y | IFMTATPPG | 95.96 | VLMTATPPG | 2.28 | ILMTATPPG | 0.93 | | | | |
| NS3 | 2351 | 0.53 | 17 | 5 | 0 | Y | GKTVWFVPS | 93.21 | GKTVWFYAS | 2.37 | GRTAWFVPS | 1.99 | RPTAWFLPS | 1.25 | GRTVWFVPS | 0.29 |
| NS3 | 2397 | 1.61 | 15 | 5 | 0 | Y | WDFVVTTDI | 48.75 | WDYVVTTDI | 38.72 | WDFVVTTDI | 38.72 | PDFVVTTDI | 2.02 | PDFILATDI | 1.28 |
| NS3 | 2398 | 1.49 | 14 | 4 | 0 | Y | DFVVTTDIS | 50.77 | DYVVTTDIS | 38.72 | DFVVTTDIS | 8.37 | DFILATDIA | 1.28 | | |
| NS3 | 2399 | 1.49 | 13 | 3 | 0 | Y | FVVTTDISE | 50.77 | YVVTTDISE | 38.72 | FVVTTDISE | 8.37 | FILATDIAE | 1.28 | | |
| NS3 | 2400 | 0.61 | 14 | 3 | 0 | Y | VVTTDISEM | 89.46 | VTTDISEM | 8.33 | ILATDIAEM | 1.28 | | | | |
| NS3 | 2401 | 0.59 | 11 | 3 | 0 | Y | VTTDISEMG | 89.62 | ITTDISEMG | 8.37 | LATDIAEMG | 1.28 | | | | |

Fig. 44-2

Species: panFlavi (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS3 | 2402 | 0.15 | 6 | 2 | 0 | Y | TTDISEMGA | 98.3 | ATDIAEMGA | 1.28 | |

Fig. 44-3

Species: panFlavi (9-mers)

| protein | block starting position | block entropy | total peptides in block | # peptides required to cover 99% of block | gap/X fraction w/ 99% of block covered | <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3538 | 0.23 | 11 | 2 | 0.03 | Y | TPFGQQRVF | 97.05 | TAFGQQRVF | 2.34 | | | | |
| NS5 | 3539 | 0.23 | 12 | 2 | 0.03 | Y | PFGQQRVFK | 97.02 | AFGQQRVFK

Fig. 44-4

Species: panFlavi (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3665 | 0.63 | 10 | 3 | 0 | Y | AIWYMWLGA | 88.91 | AIWYMWLGA | 8.21 | AIWYMWLGS | 2.18 | | | | |
| NS5 | 3666 | 0.61 | 8 | 3 | 0 | Y | IWYMWLGAR | 88.97 | IWFMWLGAR | 8.21 | IWYMWLGSR | 2.6 | | | | |
| NS5 | 3667 | 1.33 | 10 | 5 | 0 | Y | WYMWLGARF | 70.58 | WYMWLGARY | 18.4 | WFMWLGARF | 6.06 | WYMWLGSRF | 2.5 | WFMWLGARY | 2.15 |
| NS5 | 3668 | 1.34 | 11 | 5 | 0.03 | Y | YMWLGARFL | 70.58 | YMWLGARYL | 18.4 | FMWLGARFL | 6.06 | YMWLGSRFL | 2.47 | FMWLGARYL | 2.15 |
| NS5 | 3669 | 0.93 | 9 | 3 | 0.03 | Y | MWLGARFLE | 76.6 | MWLGARYLE | 20.54 | MWLGSRFLE | 2.47 | | | | |
| NS5 | 3670 | 0.93 | 8 | 3 | 0.03 | Y | WLGARFLEF | 76.63 | WLGARYLEF | 20.54 | WLGSRFLEF | 2.47 | | | | |
| NS5 | 3671 | 0.93 | 8 | 3 | 0.03 | Y | LGARFLEFE | 76.63 | LGARYLEFE | 20.54 | LGSRFLEFE | 2.47 | | | | |
| NS5 | 3672 | 0.95 | 11 | 3 | 0.03 | Y | GARFLEFEA | 76.6 | GARYLEFEA | 20.54 | GSRFLEFEA | 2.08 | | | | |
| NS5 | 3673 | 0.95 | 11 | 3 | 0.03 | Y | ARFLEFEAL | 76.6 | ARYLEFEAL | 20.54 | SRFLEFEAL | 2.08 | | | | |
| NS5 | 3674 | 0.8 | 8 | 2 | 0.03 | Y | RFLEFEALG | 78.69 | RYLEFEALG | 20.71 | | | | | | |
| NS5 | 3675 | 0.8 | 8 | 2 | 0.03 | Y | FLEFEALGF | 78.72 | YLEFEALGF | 20.67 | | | | | | |
| NS5 | 3676 | 1.03 | 10 | 2 | 0.03 | Y | LEFEALGFL | 60.64 | LEFEALGFM | 38.69 | | | | | | |
| NS5 | 3677 | 1.03 | 12 | 2 | 0.03 | Y | EFEALGFLN | 60.67 | EFEALGFMN | 38.69 | | | | | | |
| NS5 | 3678 | 1.05 | 14 | 2 | 0 | Y | FEALGFLNE | 60.45 | FEALGFMNE | 38.69 | | | | | | |
| NS5 | 3679 | 1.06 | 15 | 2 | 0 | Y | EALGFLNED | 60.35 | EALGFMNED | 38.69 | | | | | | |
| NS5 | 3680 | 1.07 | 14 | 2 | 0 | Y | ALGFLNEDH | 60.32 | ALGFMNEDH | 38.69 | | | | | | |
| NS5 | 3681 | 1.06 | 14 | 2 | 0 | Y | LGFLNEDHW | 60.35 | LGFMNEDHW | 38.69 | | | | | | |
| NS5 | 3728 | 0.66 | 14 | 4 | 0 | Y | MYADDTAGW | 89.62 | IYADDTAGW | 6.25 | FYADDTAGW | 2.6 | LYADDTAGW | 0.61 | | |
| NS5 | 3729 | 0.07 | 8 | 1 | 0 | Y | YADDTAGWD | 99.39 | DDTAGWDTK | 1.54 | DTAGWDTRV | 0.96 | | | | |
| NS5 | 3730 | 0.06 | 7 | 1 | 0 | Y | ADDTAGWDT | 99.52 | | | | | | | | |
| NS5 | 3731 | 0.16 | 8 | 2 | 0 | Y | DDTAGWDTR | 98.08 | DDTAGWDTK | 1.54 | | | | | | |
| NS5 | 3732 | 0.27 | 13 | 3 | 0 | Y | DTAGWDTRI | 97.02 | DTAGWDTKV | 1.12 | DTAGWDTRV | 0.96 | | | | |
| NS5 | 3733 | 0.28 | 14 | 4 | 0 | Y | TAGWDTRIT | 96.86 | TAGWDTKYT | 1.12 | TAGWDTRYT | 0.96 | TAGWDTKIT | 0.35 | | |
| NS5 | 3811 | 0.64 | 10 | 2 | 0 | Y | QRGSGQVGT | 85.42 | QRGSGQVYT | 14.13 | | | | | | |

Fig. 44-5

Species: panFlavi (9-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| NS5 | 3812 | 0.63 | 9 | 2 | 0 | Y | RGSGQVGTY | 85.42 | RGSGQVVTY | 14.23 | | | | | | |
| NS5 | 3813 | 0.73 | 12 | 3 | 0 | Y | GSGQVGTYG | 85.29 | GSGQVVTYA | 12.53 | GSGQVVTYG | 1.47 | | | | |
| NS5 | 3814 | 0.74 | 13 | 3 | 0 | Y | SGQVGTYGL | 85.29 | SGQVVTYAL | 12.44 | SGQVVTYGL | 1.47 | | | | |
| NS5 | 3815 | 0.74 | 12 | 3 | 0 | Y | GQVGTYGLN | 85.29 | GQVVTYALN | 12.47 | GQVVTYGLN | 1.47 | | | | |
| NS5 | 3816 | 0.74 | 11 | 3 | 0 | Y | QVGTYGLNT | 85.29 | QVVTYALNT | 12.47 | QVVTYGLNT | 1.47 | | | | |
| NS5 | 3955 | 1.15 | 19 | 3 | 0 | Y | QDELIGRAR | 52.21 | QDELVGRAR | 46.12 | QDELIGRGR | 0.83 | | | | |
| NS5 | 3956 | 1.46 | 21 | 5 | 0 | Y | DELIGRARI | 51.35 | DELVGRARI | 40.54 | DELVGRARV | 5.61 | DELIGRGRV | 0.83 | DELIGRARV | 0.77 |
| NS5 | 3957 | 1.46 | 20 | 5 | 0 | Y | ELIGRARIS | 51.38 | ELVGRARIS | 40.54 | ELVGRARVS | 5.61 | ELIGRGRVS | 0.83 | ELIGRARVS | 0.67 |
| NS5 | 3988 | 0.74 | 17 | 5 | 0 | Y | LMYFHRRDL | 87.76 | LLYFHRRDL | 8.43 | LSYFHRRDL | 1.83 | LMYFHKRDM | 0.83 | LNYFHRRDL | 0.26 |
| NS5 | 3989 | 0.74 | 16 | 5 | 0 | Y | MYFHRRDLR | 87.76 | LYFHRRDLR | 8.46 | SYFHRRDLR | 1.89 | MYFHKRDMR | 0.83 | NYFHRRDLR | 0.26 |
| NS5 | 3990 | 0.34 | 14 | 4 | 0 | Y | YFHRRDLRL | 95.96 | YFHRRDLRT | 2.12 | YFHKRDMRL | 0.83 | YFHRRDLRV | 0.22 | | |
| NS5 | 3991 | 0.78 | 21 | 5 | 0 | Y | FHRRDLRLA | 86.96 | FHRRDLRLM | 8.91 | FHRRDLRTL | 2.08 | FHKRDMRLL | 0.83 | FHRRDLRVM | 0.22 |

Fig. 45-1

Species: All Flavi (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| E | 502 | 0.52 | 16 | 4 | 0.03 | Y | VDRGWGNGCG | 93.08 | TDRGWGNGCG | 2.4 | SDRGWGNHCG | 2.15 | SDRGWGNGCG | 1.54 |
| E | 503 | 0.25 | 14 | 2 | 0.03 | Y | DRGWGNGCGL | 97.05 | DRGWGNHCGL | 1.96 | | | | |
| E | 504 | 0.25 | 14 | 2 | 0.03 | Y | RGWGNGCGLF | 97.02 | RGWGNHCGLF | 1.96 | | | | |
| E | 505 | 0.25 | 14 | 2 | 0.03 | Y | GWGNGCGLFG | 97.02 | GWGNHCGLFG | 1.96 | | | | |
| E | 506 | 0.25 | 14 | 2 | 0.03 | Y | WGNGCGLFGK | 97.02 | WGNHCGLFGK | 1.96 | | | | |
| E | 507 | 0.25 | 14 | 2 | 0 | Y | GNGCGLFGKG | 97.05 | GNHCGLFGKG | 1.96 | | | | |
| E | 508 | 1.12 | 15 | 3 | 0 | Y | NGCGLFGKGS | 67.02 | NGCGLFGKG | 30.03 | NHCGLFGKGS | 1.96 | | |
| NS3 | 2008 | 0.82 | 18 | 5 | 0 | Y | HTMWHVTRGA | 87.15 | HTLWHTTKGA | 5.77 | HTMWHVTRGS | 3.59 | HTMWHVTQGA | 0.16 |
| NS3 | 2198 | 0.83 | 17 | 5 | 0 | Y | TLILAPTRW | 85.87 | TAVLAPTRW | 8.11 | TLVLAPTRW | 4.46 | TAILAPTRW | 0.29 |
| NS3 | 2266 | 0.87 | 15 | 5 | 0 | Y | IMDEAHFTDP | 83.88 | VMDEAHFTDP | 11.83 | IMDEAHWTDP | 2.08 | IMDEAHFMDP | 0.22 |
| NS3 | 2397 | 1.62 | 16 | 5 | 0 | Y | WDFVVTTDIS | 48.75 | WDYVVTTDIS | 38.72 | WDFVITTDIS | 8.37 | PDFILATDIA | 1.28 |
| NS3 | 2398 | 1.49 | 14 | 4 | 0 | Y | DFVVTTDISE | 50.77 | DYVVTTDISE | 38.72 | DFVITTDISE | 8.37 | | |
| NS3 | 2399 | 1.5 | 15 | 4 | 0 | Y | FVVTTDISEM | 50.74 | YVVTTDISEM | 38.72 | FVITTDISEM | 8.33 | | |
| NS3 | 2400 | 0.61 | 14 | 3 | 0 | Y | VVTTDISEMG | 89.46 | VITTDISEMG | 8.33 | ILATDIAEMG | 1.28 | | |
| NS3 | 2401 | 0.59 | 11 | 3 | 0 | Y | VTTDISEMGA | 89.62 | ITTDISEMGA | 8.37 | LATDIAEMGA | 1.28 | | |
| NS3 | 2402 | 0.15 | 6 | 2 | 0 | Y | TTDISEMGAN | 98.3 | ATDIAEMGAN | 1.28 | | | | |
| NS3 | 2403 | 0.28 | 6 | 3 | 0 | Y | TDISEMGANF | 96.22 | TDISEMGANL | 2.24 | TDIAEMGANL | 1.38 | | |
| NS3 | 2448 | 1.67 | 14 | 4 | 0 | Y | ASAAQRRGRI | 48.27 | SSAAQRRGRI | 26.35 | ASAAQRRGRV | 23.08 | SSAAQRRGRV | 1.54 |
| NS3 | 2449 | 0.87 | 11 | 2 | 0 | Y | SAAQRRGRIG | 74.81 | SAAQRRGRVG | 24.58 | | | | |
| NS3 | 2450 | 0.85 | 8 | 2 | 0 | Y | AAQRRGRVGR | 74.94 | AAQRRGRVGR | 24.68 | | | | |
| NS5 | 3251 | 1.05 | 12 | 3 | 0 | Y | VIDLGCGRGG | 65 | VVDLGCGRGG | 33.65 | VMDLGCGRGG | 0.67 | | |
| NS5 | 3252 | 1.05 | 11 | 3 | 0 | Y | IDLGCGRGGW | 65 | VDLGCGRGGW | 33.69 | MDLGCGRGGW | 0.67 | | |
| NS5 | 3253 | 0.4 | 8 | 2 | 0 | Y | DLGCGRGGWS | 92.95 | DLGCGRGGWC | 6.7 | | | | |
| NS5 | 3254 | 0.41 | 9 | 2 | 0 | Y | LGCGRGGWSY | 92.79 | LGCGRGGWCY | 6.7 | | | | |

Fig. 45-2

Species: All Flavi (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3255 | 0.46 | 14 | 2 | 0 | Y | GCGRGGW

Fig. 45-3

Species: All Flavi (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3657 | 0.46 | 15 | 3 | 0 | Y | FGR

Fig. 45-4

Species: All Flavi (10-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3728 | 0.66 | 14 | 4 | 0 | Y | MYADDTAGWD | 89.62 | IYADDTAGWD | 6.25 | FYADDTAGWD | 2.60 | IYADDTAGWD | 0.61 |
| NS5 | 3729 | 0.07 | 8 | 1 | 0 | Y | YADDTAGWDT | 99.39 | ADDTAGWDTK | 1.54 | | | | |
| NS5 | 3730 | 0.18 | 10 | 2 | 0 | Y | ADDTAGWDTR | 97.92 | DDTAGWDTKV | 1.12 | DDTAGWDTRV | 0.96 | | |
| NS5 | 3731 | 0.27 | 13 | 3 | 0 | Y | DDTAGWDTRI | 97.02 | DTAGWDTKVT | 1.12 | DTAGWDTRVT | 0.96 | DTAGWDTKIT | 0.35 |
| NS5 | 3732 | 0.29 | 15 | 4 | 0 | Y | DTAGWDTRIT | 96.83 | | | | | | |
| NS5 | 3811 | 0.64 | 10 | 2 | 0 | Y | QRGSGQVGTY | 85.42 | QRGSGQVVTY | 14.13 | | | | |
| NS5 | 3812 | 0.73 | 12 | 3 | 0 | Y | RGSGQVGTYG | 85.29 | RGSGQVVTYA | 12.53 | RGSGQVVTYG | 1.47 | | |
| NS5 | 3813 | 0.74 | 13 | 3 | 0 | Y | GSGQVGTYGL | 85.29 | GSGQVVTYAL | 12.44 | GSGQVVTYGL | 1.47 | | |
| NS5 | 3814 | 0.74 | 13 | 3 | 0 | Y | SGQVGTYGLN | 85.29 | SGQVVTYALN | 12.44 | SGQVVTYGLN | 1.47 | | |
| NS5 | 3815 | 0.74 | 13 | 3 | 0 | Y | GQVGTYGLNT | 85.29 | GQVVTYALNT | 12.4 | GQVVTYGLNT | 1.47 | | |
| NS5 | 3955 | 1.47 | 23 | 5 | 0 | Y | QDELIGRARI | 51.31 | QDELVGRARV | 40.51 | QDELVGRARI | 5.61 | QDELIGRGRV | 0.83 |
| NS5 | 3988 | 0.75 | 18 | 5 | 0 | Y | LMYFHRRDLR | 87.76 | LLYFHRRDLR | 8.4 | LSYFHRRDLR | 1.83 | LMYFHKRDMR | 0.83 |
| NS5 | 3990 | 0.78 | 21 | 5 | 0 | Y | YFHRRDLRLA | 86.96 | YFHRRDLRLM | 8.91 | YFHRRDLRTL | 2.08 | YFHRRDMRLL | 0.83 |

Additional columns (peptides required to cover 99% of block / frequency):

| block starting position | peptide | frequency |
|---|---|---|
| NS5 3955 | QDELIGRARV | 0.77 |
| NS5 3988 | LNYFHRRDLR | 0.26 |
| NS5 3990 | YFHRRDLRVM | 0.22 |

Fig. 46-1

Species: panFlavi (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|---|---|
| E | 502 | 0.53 | 18 | 5 | 0.03 | Y | VDRGWGNGCGL | 93.08 | TDRGWGNGCGL | 2.31 | SDRGWGNHCGL | 1.96 | SDRGWGNGCCGL | 1.54 | SDRGWGNHCGF | 0.19 |
| E | 503 | 0.25 | 15 | 2 | 0.03 | Y | DRGWGNGCCGLF | 97.02 | DRGWGNHCGLF | 1.96 | | | | | | |
| E | 504 | 0.25 | 14 | 2 | 0.03 | Y | RGWGNCGLFG | 97.02 | RGWGNHCGLFG | 1.96 | | | | | | |
| E | 505 | 0.25 | 14 | 2 | 0.03 | Y | GWGNGCGLFGK | 97.02 | GWGNHCGLFGK | 1.96 | | | | | | |
| E | 506 | 0.25 | 17 | 2 | 0.03 | Y | WGNGCGLFGKG | 97.02 | WGNHCGLFGKG | 1.96 | | | | | | |
| E | 507 | 1.13 | 17 | 4 | 0 | Y | GNGCGLFGKGS | 66.96 | GNGCGLFGKGG | 30.03 | GNHCGLFGKGS | 1.96 | GNHCGFFGKGS | 0.19 | | |
| NS3 | 2397 | 1.62 | 16 | 5 | 0 | Y | WDFWTTDISE | 48.75 | WDYWTTDISE | 38.72 | WDFWTTDISE | 8.37 | PDFWTTDISE | 2.02 | PDFILATDIAE | 1.28 |
| NS3 | 2398 | 1.5 | 16 | 4 | 0 | Y | DFWTTDISEM | 50.74 | DYWTTDISEM | 38.72 | DFWTTDISEM | 8.33 | DFILATDIAEM | 1.28 | | |
| NS3 | 2399 | 1.5 | 15 | 4 | 0 | Y | FWTTDISEMG | 50.74 | YWTTDISEMG | 38.72 | FWTTDISEMG | 8.33 | FILATDIAEMG | 1.28 | | |
| NS3 | 2400 | 0.61 | 14 | 3 | 0 | Y | WTTDISEMGA | 89.46 | VTTDISEMGA | 8.33 | ILATDIAEMGA | 1.28 | | | | |
| NS3 | 2401 | 0.59 | 11 | 3 | 0 | Y | VTTDISEMGAN | 89.62 | ITTDISEMGAN | 8.37 | LATDIAEMGAN | 1.28 | | | | |
| NS3 | 2402 | 0.29 | 8 | 3 | 0 | Y | TTDISEMGANF | 96.22 | TTDISEMGANL | 2.08 | ATDIAEMGANL | 1.28 | | | | |
| NS3 | 2448 | 1.68 | 15 | 4 | 0 | Y | ASAAQRRGRIG | 48.27 | SSAAQRRGRIG | 26.35 | ASAAQRRGRVG | 23.04 | SSAAQRRGRVG | 1.54 | | |
| NS3 | 2449 | 0.87 | 11 | 2 | 0 | Y | SAAQRRGRIGR | 74.81 | SAAQRRGRVGR | 24.58 | | | | | | |
| NS3 | 3251 | 1.05 | 12 | 3 | 0 | Y | VIDLGCGRGGW | 65 | VDLGCGRGGW | 33.65 | VMDLGCGRGGW | 0.67 | | | | |
| NS3 | 3252 | 1.38 | 14 | 5 | 0 | Y | IDLGCGRGGWS | 59.13 | VDLGCGRGGWS | 33.08 | IDLGCGRGGWC | 5.87 | VDLGCGRGGWC | 0.61 | MDLGCGRGGWS | 0.61 |
| NS3 | 3253 | 0.41 | 9 | 2 | 0 | Y | DLGCGRGGWSY | 92.79 | DLGCGRGWCY | 6.7 | | | | | | |
| NS3 | 3254 | 0.46 | 14 | 2 | 0 | Y | LGCGRGGWSYY | 92.34 | LGCGRGGWCYY | 6.7 | | | | | | |
| NS3 | 3392 | 0.45 | 20 | 4 | 0 | Y | PLSRNSTHEMY | 94.07 | PLSRNSNHEMY | 2.47 | PFSRNSTHEMY | 2.4 | PLSRNSSHEMY | 0.16 | | |
| NS5 | 3532 | 1.42 | 20 | 5 | 0.06 | Y | MAMTDTTPFGQ | 54.46 | IAMTDTTPFGQ | 38.59 | LAMTDTTPFGQ | 3.59 | MAMTDTTAFGQ | 2.15 | FLMTDVSTYSQ | 0.16 |
| NS5 | 3533 | 0.26 | 12 | 3 | 0.06 | Y | AMTDTTPFGQQ | 96.76 | AMTDTTAFGQQ | 2.15 | SMTDTTPFGQQ | 0.26 | | | | |
| NS5 | 3534 | 0.22 | 8 | 2 | 0.06 | Y | MTDTTPFGQQR | 97.08 | MTDTTAFGQQR | 2.34 | | | | | | |
| NS5 | 3535 | 0.22 | 9 | 2 | 0.06 | Y | TDTTPFGQQRV | 97.08 | TDTTAFGQQRV | 2.34 | | | | | | |

Fig. 46-2

Species: panFlavi (11-mers)

| protein | block starting position | block entropy | # peptides required to cover 99% of block | total peptides in block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3536 | 0.22 | 2 | 10 | 0.06 | Y | DTTPFGQQRVF | 97.05 | DTTAFGQQRVF | 2.34 | | | | |
| NS5 | 3537 | 0.23 | 2 | 11 | 0.06 | Y | TTPFGQQRVFK | 97.02 | TTAFGQQRVFK | 2.34 | | | | |
| NS5 | 3538 | 0.28 | 3 | 16 | 0.03 | Y | TPFGQQRVFKE | 96.79 | TAFGQQRVFKE | 1.41 | TAFGQQRVFKD | 0.87 | |

Fig. 46-3

Species: panFlavi (11-mers)

| protein | block starting position | block entropy | total peptides in block | # peptides required to cover 99% of block | gap/X fraction | 99% of block covered w/ <= 5 peptides? | peptides required to cover 99% of block | frequency | peptides required to cover 99% of block | frequency | peptides required to cover 99% of block | frequency | peptides required to cover 99% of block | frequency |
|---|---|---|---|---|---|---|---|---|---|---|---|---|---|---|
| NS5 | 3668 | 1.34 | 11 | 5 | 0.03 | Y | YMWLGARFLEF | 70.58 | YMWLGARYLEF | 18.4 | YMWLGARYLEF | 6.03 | FMWLGARYLEF | 2.15 |
| NS5 | 3669 | 0.93 | 9 | 3 | 0.03 | Y | MWLGARFLEFE | 76.6 | MWLGARYLEFE | 20.54 | MWLGSRFLEFE | 2.47 | | |
| NS5 | 3670 | 0.95 | 11 | 3 | 0.03 | Y | WLGARFLEFEA | 76.6 | WLGARYLEFEA | 20.54 | WLGSRFLEFEA | 2.08 | | |
| NS5 | 3671 | 0.95 | 11 | 3 | 0.03 | Y | LGARFLEFEAL | 76.6 | LGARYLEFEAL | 20.54 | LGSRFLEFEAL | 2.08 | | |
| NS5 | 3672 | 0.95 | 11 | 3 | 0.03 | Y | GARFLEFEALG | 76.6 | GARYLEFEALG | 20.54 | GSRFLEFEALG | 2.08 | | |
| NS5 | 3673 | 0.95 | 12 | 3 | 0.03 | Y | ARFLEFEALGF | 76.6 | ARYLEFEALGF | 20.51 | SRFLEFEALGF | 2.08 | | |
| NS5 | 3674 | 1.6 | 12 | 3 | 0.03 | Y | RFLEFEALGFL | 40 | RFLEFEALGFM | 38.65 | RYLEFEALGFL | 20.64 | | |
| NS5 | 3675 | 1.59 | 11 | 2 | 0.03 | Y | FLEFEALGFLN | 40 | FLEFEALGFMN | 38.69 | YLEFEALGFLN | 20.64 | | |
| NS5 | 3676 | 1.06 | 13 | 2 | 0.03 | Y | LEFEALGFLNE | 60.38 | LEFEALGFMNE | 38.69 | | | | |
| NS5 | 3677 | 1.06 | 14 | 2 | 0.03 | Y | EFEALGFLNED | 60.32 | EFEALGFMNED | 38.69 | | | | |
| NS5 | 3678 | 1.07 | 15 | 2 | 0.03 | Y | FEALGFLNEDH | 60.32 | FEALGFMNEDH | 38.69 | | | | |
| NS5 | 3679 | 1.07 | 15 | 2 | 0.03 | Y | EALGFLNEDHW | 60.32 | EALGFMNEDHW | 38.69 | | | | |
| NS5 | 3728 | 0.66 | 14 | 4 | 0 | Y | MYADDTAGWDT | 89.62 | IYADDTAGWDT | 6.25 | FYADDTAGWDT | 2.6 | LYADDTAGWDT | 0.61 |
| NS5 | 3729 | 0.19 | 11 | 2 | 0 | Y | YADDTAGWDTR | 97.82 | YADDTAGWDTK | 1.54 | | | | |
| NS5 | 3730 | 0.27 | 14 | 3 | 0 | Y | ADDTAGWDTRI | 97.02 | ADDTAGWDTKV | 1.12 | ADDTAGWDTRV | 0.9 | | |
| NS5 | 3731 | 0.29 | 15 | 4 | 0 | Y | DDTAGWDTRIT | 96.83 | DDTAGWDTKVT | 1.12 | DDTAGWDTRVT | 0.96 | DDTAGWDTKIT | 0.35 |
| NS5 | 3811 | 0.74 | 13 | 3 | 0 | Y | QRGSGQVGTYG | 85.29 | QRGSGQVVTYA | 12.44 | QRGSGQVVTYG | 1.47 | | |
| NS5 | 3812 | 0.74 | 13 | 3 | 0 | Y | RGSGQVGTYGL | 85.29 | RGSGQVVTYAL | 12.44 | RGSGQVVTYGL | 1.47 | | |
| NS5 | 3813 | 0.74 | 13 | 3 | 0 | Y | GSGQVGTYGLN | 85.29 | GSGQVVTYALN | 12.44 | GSGQVVTYGLN | 1.47 | | |
| NS5 | 3814 | 0.75 | 14 | 3 | 0 | Y | SGQVGTYGLNT | 85.29 | SGQVVTYALNT | 12.37 | SGQVVTYGLNT | 1.47 | | |

FIG. 48-1

| Peptide | HLA (nM) | HLA (nM) | HLA (nM) | Peptide | HLA (nM) | HLA (nM) | HLA (nM) |
|---|---|---|---|---|---|---|---|
| GTILIRVEY | A1101(377.76) | | | HVLGRLTV | A0201(82.32) | B0801(335.99) | |
| TVNPIVTEK | A0301(163.87) | A1101(8.03) | | LLFKTSTGV | A0201(7.75) | | |
| LILAGVSLL | A0201(126.25) | | | IAVGMVTLY | B1501(125.31) | | |
| KVSCTTLAV | A0201(86.43) | | | FLTFVLLLS | A0201(384.71) | | |
| KMDNFTMGI | A0201(7.72) | | | KYTDRKWCF | A2402(39.35) | | |
| VVQDDGTMK | A1101(295.79) | | | SLIGNEEFL | A0201(208.74) | | |
| ALIFILLAA | A0201(46.69) | | | LATVTGGIF | B1501(310.43) | | |
| FVGKTVWFV | A0201(4.96) | | | TVNPIVTGK | A0301(196.77) | A1101(11.84) | |
| MTTVFSIPR | A1101(26.24) | | | PLAENTNSV | A0201(354.61) | | |
| LAISGVYPM | B1501(37.49) | | | AQEEGICGI | A0201(273.56) | | |
| LPWTSGATA | B0702(59.53) | | | ATLLVALSF | B1501(364.30) | | |
| RSEFQIYKK | A1101(50.40) | | | LVKRFSSGL | B0801(176.72) | | |
| AVASSLLWV | A0201(43.48) | | | LLVWHTWQK | A0301(90.00) | A1101(90.57) | |
| HMIAGVLFM | A0201(53.42) | B1501(25.52) | | IVVGGITLF | B1501(105.01) | | |
| LLMLLPTAL | A0201(65.82) | B0801(373.25) | | AVLTHNGKR | A1101(355.10) | | |
| CWCNATETW | A2402(131.77) | | | YAQMWQLMY | B1501(280.76) | | |
| SLGKAVHQV | A0201(16.02) | | | ATSIFKLTY | A1101(121.94) | | |
| SILLSSLLK | A0301(22.35) | A1101(6.85) | | SALAGATEV | A0201(495.02) | | |
| ITASSLLWY | A0301(127.46) | A1101(21.41) | B1501(177.33) | SMGLLCLTL | A0201(482.89) | | |
| QLWAALLSL | A0201(23.52) | | | WGKAKIFTL | B0801(47.04) | | |
| GTNSRNTPM | B1501(256.87) | | | TLAVFLLLV | A0201(16.85) | | |
| LALSLTFIK | A0301(300.63) | A1101(27.32) | | ALKINWYRK | A0301(161.73) | A1101(212.86) | |
| WATLLSLTF | B1501(145.41) | | | LALKEFKEF | B1501(275.82) | | |
| KAISVLRGF | B1501(74.94) | | | TYGWNIVKL | A2402(100.27) | | |
| KLRIKGMSY | A0301(303.42) | B1501(76.40) | | LMRRGDLPV | A0201(202.72) | B0801(251.95) | B1501(253.27) |
| VSWSGRELK | A0301(492.49) | A1101(21.99) | | AMVLSVVSL | A0201(156.71) | B1501(366.17) | |
| TFIKTTYSL | A2402(68.05) | | | YVLGRLITV | A0201(8.02) | | |
| VTCAMFRCK | A0301(265.11) | A1101(20.84) | | LLNRFTMTY | A0301(151.22) | B1501(47.07) | |
| TLLSFTFIK | A0301(32.16) | A1101(7.87) | | CLNTFVLKK | A0301(31.78) | A1101(21.72) | |

FIG. 48-2

| Peptide | HLA (nM) | HLA (nM) | HLA (nM) | Peptide | HLA (nM) | HLA (nM) | HLA (nM) |
|---|---|---|---|---|---|---|---|
| AIKVLKGFK | A0301(422.74) | A1101(172.10) | | QITNELNYV | A0201(216.40) | | |
| LALLAAFRV | A0201(420.32) | | | TLMAAVLAY | A0301(97.93) | A1101(105.69) | B1501(30.09) |
| GIQRTAFFV | A0201(111.97) | | | CVTTMAQGK | A1101(140.34) | | |
| VIIMMIPTV | A0201(51.40) | | | FMAYMIGQT | A0201(74.48) | | |
| MDLEKRYVL | B0801(113.56) | | | GTLALALTF | B1501(143.08) | | |
| ITNVTTDSR | A1101(449.12) | | | QMSSGNILF | B1501(42.40) | | |
| AVFKMSPGY | A0301(99.14) | | | NGRKRSTVT | B0801(289.53) | | |
| AVQDWLARV | A0201(15.73) | A1101(52.08) | B1501(61.61) | LLLTVGLSL | A0201(88.14) | B1501(435.44) | |
| ILNAHKEGV | A0201(113.80) | | | MTLWYMWQV | A0201(3.82) | | |
| RTATLILAV | A0201(165.61) | | | YIIVGAGEK | A1101(443.34) | | |
| LSRNSTHEM | B1501(33.41) | | | NALKINWYK | A0301(428.37) | A1101(21.49) | |
| WGKAKIVTA | B0801(93.52) | | | WTMKILTGV | A0201(6.90) | | |
| LPVCQSSSM | B0702(10.25) | | | TPRAKRGTT | B0702(70.58) | | |
| FTILALFLA | A0201(33.64) | | | KAKMLSTEL | B1501(404.88) | | |
| LAMGCYSQV | A0201(225.75) | | | SITQKGIIF | B1501(395.90) | | |
| MLIPKSYAG | B0801(457.27) | B0801(50.96) | | WLSYKVASA | A0201(61.49) | B0801(329.38) | |
| TTSIWMKFR | A1101(142.94) | B1501(218.68) | | KPRICTRAE | B0702(178.84) | | |
| IWEVEDYGF | A2402(423.03) | | | IAIGVITLY | B1501(155.92) | | |
| VTEVKGYTK | A1101(160.40) | | | LLLVTHYAI | A0201(40.94) | | |
| MCTNTFVLK | A1101(194.54) | | | VPMVTQMAM | B0702(15.85) | | |
| YSQIGAGVY | B1501(243.85) | | | LMATIGVVL | A0201(92.49) | B1501(174.22) | |
| IPLCRTSCL | B0702(15.41) | | | GLVTLYLGV | A0201(30.48) | | |
| LVAASFVTL | A0201(292.85) | | | LAKRFSKGL | B0801(491.52) | | |
| RTYSDPLAL | B1501(449.83) | | | GSAKLQWFV | A0201(266.90) | | |
| IVQPENLEY | B1501(222.56) | | | TQHGTILIK | A1101(87.93) | | |
| SLIPLCLST | A0201(106.95) | | | TTLTASLAM | B1501(395.65) | | |
| LLVAVSFMT | A0201(188.14) | | | NIYKRSGIM | B0801(83.30) | | |
| QPKPGTRMI | B0702(248.60) | | | ILTPQPMEL | A0201(64.20) | | |
| MQAGRRSLK | A0301(111.70) | A1101(60.82) | | AVLFAVTLI | A0201(439.26) | | |

FIG. 48-3

| Peptide | HLA (nM) | HLA (nM) | HLA (nM) | Peptide | HLA (nM) | HLA (nM) | HLA (nM) |
|---|---|---|---|---|---|---|---|
| AVKNWLVRV | A0201(285.07) | | | NRRRRTVGV | B0801(56.07) | | |
| INRRKKTSL | B0801(232.37) | | | CIAILFEEV | A0201(26.87) | | |
| ITASVLLWY | A0301(129.68) | A1101(21.31) | B1501(431.42) | VSDLKYSWK | A1101(145.25) | | |
| TLTAALLSL | A0201(74.71) | | | MCSNAFVLK | A1101(161.77) | | |
| LTQKVVIFV | A0201(306.37) | | | TTLSRTSKK | A0301(55.67) | A1101(7.63) | |
| HLAHRTRNA | B0801(264.74) | | | MGNEGYTDY | B1501(494.64) | | |
| ASQLATLRK | A0301(236.61) | A1101(22.33) | | ILAKAIFKL | A0201(9.94) | | |
| LLVAHYAII | A0201(171.34) | | | FQPESPARL | A0201(77.58) | | |
| VLLGSLGCK | A0301(86.40) | | | NRRKRSTMT | B0801(470.04) | | |
| NSKNISMSF | B1501(113.27) | A1101(139.16) | | LLLTIGLSL | A0201(95.69) | | |
| HPGFTVMAL | B0702(56.83) | | | VQWDEMADI | A0201(226.60) | | |
| LAAVSVSPL | B1501(284.66) | | | LISGKGVGK | A1101(421.47) | | |
| ALCEALTLA | A0201(23.93) | | | HMIAGALFT | A0201(257.20) | | |
| LLKTALLIV | A0201(236.67) | | | ATLSEGVYR | A1101(46.11) | | |
| TMRHKKATY | B1501(158.38) | | | MQRKHGGML | B0702(81.74) | B0801(61.31) | B1501(57.34) |
| LIQKVVIFI | A0201(388.18) | | | IMKSVGTGK | A0301(104.55) | A1101(237.94) | |
| VTRGAVLMY | A1101(438.40) | B1501(288.20) | | ILKRWGTIK | A0301(137.95) | | |
| KKMVRPQPM | B0801(496.14) | | | NIFRGSYLA | A0201(393.56) | | |
| MLSIINKRK | A0301(101.65) | A1101(136.72) | | GLRRGETTK | A0301(483.40) | | |
| AYQHALNEL | A2402(38.25) | | | AYTHALSEL | A2402(298.40) | | |
| TLLSLTFVK | A0301(29.28) | A1101(9.68) | | RPTFAVGLL | B0702(35.55) | | |
| VVLQNAWKV | A0201(115.30) | | | LYAVATTFI | A2402(271.84) | | |
| TVLIKVEYK | A0301(220.35) | A1101(13.45) | | IIMMIPTVM | B1501(249.35) | | |
| AAFRVRPTF | B1501(471.59) | | | GQLTWSDLI | A0201(266.08) | | |
| FLAHAIGTS | A0201(176.79) | | | VTCAKFTCK | A0301(159.75) | A1101(11.71) | |
| SKSEFNIYK | A1101(115.65) | | | VMAWRTIMA | A0201(89.35) | | |
| QMSGTTTIF | B1501(16.61) | | | KQWFLDLPL | A0201(34.38) | B1501(88.64) | |
| ILLKMVVHF | B1501(37.78) | | | LQRKHGGML | B0702(293.67) | B0801(276.35) | B1501(138.14) |
| TRKVRSNAA | B0801(184.42) | | | GLKRGEITK | A0301(276.96) | | |

FIG. 48-4

| Peptide | HLA (nM) | HLA (nM) | HLA (nM) | Peptide | HLA (nM) | HLA (nM) | HLA (nM) |
|---|---|---|---|---|---|---|---|
| CVTTIAQGK | A1101(134.17) | | | LFVWHFWQK | A1101(215.49) | | |
| GLICVIASS | A0201(216.65) | | | AVASGLLWV | A0201(42.46) | | |
| KVIGRVISA | A0201(176.62) | | | VVVGDITGV | A0201(95.63) | | |
| RAVHADMGY | B1501(93.17) | | | NIHTAITQV | A0201(305.27) | | |
| KWKSRLNAL | B0801(186.00) | | | MLQGRGPLK | A0301(40.89) | A1101(74.58) | |
| VQDDGTMKI | A0201(135.10) | | | LLILCVTQV | A0201(22.04) | | |
| MLLALIAVL | A0201(18.88) | | | RLVTANPIV | A0201(98.32) | | |
| LVISGLFPI | A0201(10.83) | B0801(198.99) | | SPKRLSAAI | B0702(28.55) | B0801(49.29) | |
| TTSKMLLNR | A1101(21.84) | | | SYKVASEGF | A2402(301.89) | | |
| KTFVDLMRR | A0301(147.88) | A1101(12.46) | | NIQAAINQV | A0201(279.40) | | |
| YAQMWALMY | B1501(245.55) | | | YMPTVIEHL | A0201(12.60) | | |
| YIGTSLIQK | A0301(199.89) | A1101(37.11) | | LTYQNKVVR | A1101(491.82) | | |
| TFSLHYAWK | A1101(129.09) | | | TSADLTVEK | A1101(15.47) | | |
| LLVAVSFVT | A0201(279.22) | | | RPGYFTQTA | B0702(105.76) | | |
| SAVNMTSRM | B1501(73.92) | | | KVASEGFQY | A0301(176.67) | A1101(33.00) | B1501(253.76) |
| SGYEWITDF | B1501(274.17) | | | QPKPGTRMV | B0702(333.18) | | |
| SLGCKPLPM | B0801(204.00) | B1501(487.04) | | IMIGVGNSA | A0201(201.75) | | |
| IFRKRKLTI | B0801(60.69) | | | SMAMTCIAV | A0201(20.46) | | |
| KSEFQTYKK | A0301(449.77) | A1101(43.81) | | MCDDTVTYK | A1101(328.68) | | |
| AMVLSIVSL | A0201(101.71) | B1501(394.51) | | VIALFLAHV | A0201(18.09) | | |
| TIGETLGEK | A1101(80.41) | | | IQRTIFFVL | B1501(410.18) | | |
| LSIINRRKK | A1101(358.58) | | | RVITANPIV | A0201(345.06) | | |
| TLKGMSYVM | B0801(345.82) | B1501(218.52) | | TLSEGVYRI | A0201(11.98) | | |
| LAMTDTTPF | B1501(6.56) | | | KQAQRIETW | B1501(302.27) | | |
| LILAGISLL | A0201(77.93) | | | VSTGSQLAK | A0301(322.18) | A1101(35.16) | |
| SLIGLTSRA | A0201(293.20) | | | TLAVLFLLI | A0201(172.95) | | |
| PLNEAIMAV | A0201(48.52) | | | LTGYGTVTM | B1501(330.99) | | |
| LTSRATWAK | A0301(191.98) | A1101(14.96) | | YVFSGDPLK | A0301(264.31) | A1101(22.78) | |
| WMIRILIGI | A0201(18.70) | | | MTDDIGMGI | A0201(137.13) | | |

FIG. 48-5

| Peptide | HLA (nM) | HLA (nM) | HLA (nM) | Peptide | HLA (nM) | HLA (nM) | HLA (nM) |
|---|---|---|---|---|---|---|---|
| CLRRRVTRK | A0301(124.87) | | | AMALSIVSL | A0201(52.50) | B1501(272.11) | |
| TLTPQPMEL | A0201(144.42) | | | ALISNITTA | A0201(19.70) | | |
| YILREVGKK | A1101(263.57) | | | MVLAFITFL | A0201(13.32) | | |
| TMLLMLLPT | A0201(280.92) | | | NMVKSLASA | A0201(109.60) | | |
| EVKTCTWPK | A1101(388.40) | | | GLLCISIMI | A0201(38.81) | | |
| WMIRILIGF | B1501(132.98) | | | RMGMGTTYL | A0201(103.27) | B1501(197.98) | |
| FKKRNLTIM | B0801(468.54) | | | WMADVPLQW | A0201(498.36) | | |
| GGRAYRHAM | B0702(84.10) | B0801(200.55) | | TFSVHYAWK | A1101(146.57) | | |
| LLNGQGPMK | A0301(242.29) | A1101(349.88) | | LSKSEFNTY | B1501(78.94) | | |
| GQLTWNDLI | A0201(416.59) | | | AVLDDGIYR | A1101(48.84) | | |
| FPQSNAPII | B0702(72.18) | | | RTMAMVLSI | A0201(57.76) | A1101(425.41) | B1501(116.53) |
| SYEDREWCF | A2402(59.97) | | | IMMIPTVMA | A0201(186.32) | | |
| LLEEMLRT | A0201(101.08) | | | LTGYGTITM | B1501(399.90) | | |
| MVRILIGFL | B0801(206.34) | | | RLLTKPWDV | A0201(31.30) | | |
| WMTTEDMLK | A1101(161.66) | | | ESRKTFVEL | B0801(190.03) | | |
| YMDYMPVMK | A0301(239.21) | A1101(108.90) | | MWKQITNEL | A2402(303.16) | B0801(139.48) | |
| VTCAMFTCK | A0301(183.20) | A1101(7.43) | | MIAGVFFTF | A0201(329.16) | B1501(86.97) | |
| AVASGLFWV | A0201(9.23) | | | VLFMFVLLL | A0201(80.22) | | |
| KTMAMILSI | A0201(30.36) | A1101(393.43) | B1501(195.12) | ILDVDLRPA | A0201(483.86) | | |
| WMVRILIGL | A0201(21.02) | | | SQHNYRPGY | B1501(26.29) | | |
| LIASLVMLL | A0201(63.41) | | | LQMENKAWL | A0201(144.18) | | |
| SYKVASAGI | A2402(493.50) | | | VMLLVHYAI | A0201(124.75) | | |
| IPMVTQLAM | B0702(8.28) | | | TWAFRHPGF | A2402(357.93) | | |
| SVIEKMEAL | A0201(77.48) | | | LMLLPTALA | A0201(180.64) | | |
| VLTLATGPV | A0201(341.35) | | | IPKIYGGPI | B0702(30.23) | B0801(289.31) | |
| TLITGNMSF | B1501(29.18) | | | TMIALFLAH | B1501(168.34) | | |
| WLKLRDSYT | B0801(302.75) | | | FLDLPLPWT | A0201(44.55) | | |
| GMIIMLTPT | A0201(151.36) | | | KTMAMVLSI | A0201(35.50) | A1101(322.88) | B1501(142.56) |
| KAIKILTGF | B1501(55.05) | | | LLFKTEDGV | A0201(23.28) | | |

FIG. 48-6

| Peptide | HLA (nM) | HLA (nM) | HLA (nM) | Peptide | HLA (nM) | HLA (nM) | HLA (nM) |
|---|---|---|---|---|---|---|---|
| RTIMVVLFV | A0201(203.36) | A1101(487.85) | | TSEVHWNSK | A1101(390.18) | | |
| MIIMLTPTV | A0201(32.53) | | | SLPTYLSSK | A0301(124.69) | A1101(55.22) | |
| IKKVRTNAA | B0801(194.87) | | | MILMEMKKK | A0301(311.05) | A1101(103.33) | |
| KLASAIQKA | A0201(27.29) | | | RIQRTVFFV | A0201(40.63) | | |
| VMLFLISGK | A0301(28.57) | A1101(27.96) | | IMAVGIVSI | A0201(33.50) | | |
| KLALDNIVM | B1501(242.71) | | | SIPETILEL | A0201(99.14) | | |
| ATVLMGLGK | A1101(31.85) | | | TMAMVLSVV | A0201(53.60) | | |
| RFANALFAL | A2402(274.04) | | | TYGWNLVRL | A2402(88.06) | | |
| ASHNILVEV | A0201(493.34) | | | ATFTMRLLS | A1101(381.77) | | |
| TLLYLIPTV | A0201(5.82) | | | RPRWLDARV | B0702(24.82) | | |
| RMLLNRFTM | B0801(236.55) | B1501(190.25) | | LPWTSGAST | B0702(60.35) | | |
| IPRSYAGPF | B0702(6.01) | | | GGRAYQHAL | B0702(461.81) | | |
| IVIEKDSPV | A0201(204.10) | | | TNMITLLVK | A1101(111.59) | | |
| IMAWRTIMV | A0201(14.53) | | | ATFKMRPMF | B1501(320.21) | | |
| SLSVMCIAV | A0201(37.21) | | | MPAMKRYSA | B0702(14.97) | B0801(11.03) | |
| VTTWENVPY | A1101(467.93) | | | HWVEITALI | A2402(455.38) | | |
| WTLMYFHRR | A1101(112.82) | | | GSLIGLSSR | A1101(236.95) | | |
| MGYWIESSK | A0301(134.46) | A1101(140.22) | | LLFRRLTSR | A0301(117.74) | A1101(472.20) | |
| RTIMAVLFA | A1101(421.29) | | | MANIFRGSY | B1501(95.62) | | |
| ITETPTWNR | A1101(332.17) | | | TPRSPSVEI | B0702(26.31) | | |
| SSADLSLEK | A0301(153.23) | A1101(7.79) | | FPQSNAPIM | B0702(21.21) | | |
| FAAGLFLRK | A0301(252.71) | A1101(30.86) | | GLICVIVSS | A0201(326.68) | | |
| VTYECPLLV | A0201(155.80) | | | LMMATIGIT | A0201(186.24) | | |
| FAAGLLLRK | A0301(423.46) | A1101(73.59) | | IIMLGDTMF | B1501(107.70) | | |
| GPMPVTHSS | B0702(216.64) | | | LLLGLLAT | A0201(205.86) | | |
| KQGSNWIQK | A1101(151.46) | | | NQATVLMGL | A0201(67.13) | | |
| FQSHQLWAA | A0201(14.49) | A1101(23.46) | | TVASAAQRR | A1101(404.50) | | |
| ITASILLWY | A0301(165.53) | | | LLLTLLATV | A0201(7.71) | | |
| TIMAVLFAV | A0201(3.41) | | | ISRMLINRF | B1501(135.48) | | |

FIG. 48-7

| Peptide | HLA (nM) | HLA (nM) | Peptide | HLA (nM) | HLA (nM) | HLA (nM) |
|---|---|---|---|---|---|---|
| RPGYHTQTA | B0702(32.52) | | TVWFVPSIK | A0301(71.41) | A1101(10.96) | |
| MILVVVTTL | A0201(132.53) | | SLLGSALLK | A0301(19.57) | A1101(8.98) | |
| LPWTSGATT | B0702(140.09) | | MAWRTIMAV | A0201(73.09) | B0801(329.85) | |
| SNMLSIINK | A0301(438.76) | A1101(30.09) | TTETPTWNR | A1101(287.48) | | |
| LVMLFVHYA | A0201(35.58) | | IASAIVLEF | B1501(144.74) | | |
| RQMESEGIF | B1501(14.49) | | FIDGISLGL | A0201(18.01) | | |
| AMCLNTFVL | A0201(356.71) | | FLNLPLPWT | A0201(68.46) | | |
| MAYMIGQTR | A1101(217.57) | | TLAGEIGAV | A0201(48.02) | | |
| MTATPPGSR | A1101(43.29) | | MTTEDMLSV | A0201(224.07) | | |
| TLTAAVLML | A0201(243.87) | | KMDLGVPLL | A0201(34.36) | | |
| QLWITLLSL | A0201(179.33) | | LPAYLSSKA | B0702(478.42) | | |
| MILLTMKNK | A0301(119.92) | A1101(42.20) | MLDVDLHPA | A0201(10.69) | | |
| VLARWGTFK | A0301(20.43) | A1101(15.69) | SMGLITIAM | B1501(320.80) | | |
| QIANELNYI | A0201(189.40) | | TTFITPMLR | A0301(191.53) | A1101(6.73) | |
| KMLLDNIYT | A0201(486.27) | | QVLAIEPGK | A1101(135.22) | | |
| LLFLNDMGK | A0301(50.84) | A1101(77.99) | GSSPVIEVK | A1101(108.53) | | |
| GMIMLIPT | A0201(220.73) | | TYSLHYAWK | A1101(303.26) | | |
| LGRNKRPRL | B0801(374.13) | | NRRKKSVTM | B0801(32.76) | | |
| SGSPIVDRK | A1101(423.61) | | ILNRRRRSA | B0801(80.17) | | |
| TLTASLAML | A0201(104.29) | | RTTWALCEV | A0201(158.82) | | |
| KTRRYLPAM | B0702(97.47) | B1501(185.35) | TILCVPNAV | A0201(125.13) | | |
| ALWEGGHDL | A0201(12.07) | | SQMLIPRSY | B1501(56.74) | | |
| ALFTFVLLL | A0201(12.32) | | KAIRILIGF | B1501(287.23) | | |
| SLIGLSSRA | A0201(455.24) | | LLFKTTEGI | A0201(15.57) | B1501(409.67) | |
| FIKTTMPLI | A0201(265.44) | | YQGKTVWFV | A0201(4.64) | | |
| RIISSTPFA | A0201(109.42) | | TFIRTTFSL | A2402(105.07) | | |
| LGAMTAGIF | B1501(402.87) | | RLSAAIGKA | A0201(475.87) | | |
| NIHTAIAQV | A0201(212.93) | | KVVQYENLK | A0301(358.13) | A1101(42.07) | |
| GLNSRSTSF | B1501(12.78) | | YIMVGAGEK | A1101(111.80) | | |

FIG. 48-8

| Peptide | HLA (nM) | HLA (nM) | HLA (nM) | Peptide | HLA (nM) | HLA (nM) | HLA (nM) |
|---|---|---|---|---|---|---|---|
| VIVMLIPTV | A0201(129.61) | | | CWPKSHTL | A0201(295.80) | | |
| CIMVGANAF | B1501(78.94) | | | HALLATSIF | B1501(210.84) | | |
| HWFGRENSW | A2402(435.51) | | | LQAKATREA | B1501(370.61) | | |
| MIIMLIPTA | A0201(252.35) | | | TQWLETEGV | A0201(165.02) | | |
| MALWYMWQV | A0201(7.06) | | | ITASTLLWY | A0301(156.14) | A1101(23.50) | B1501(206.75) |
| TTGETLGEK | A1101(56.13) | | | AVILLNAWK | A0301(380.38) | A1101(23.94) | |
| TLGAQALPV | A0201(48.29) | | | MLNILNGRK | A0301(48.92) | A1101(75.25) | |
| YYMATLKNV | A2402(256.80) | | | TQVGVGIHM | B1501(146.46) | | |
| LLFKTEVGV | A0201(13.56) | | | MIVGVFFTF | B1501(104.99) | | |
| LLVAVSFLT | A0201(106.39) | | | SYVMCTGPF | A2402(158.01) | | |
| MILSIVSLF | B1501(66.91) | | | RLITVNPIV | A0201(43.90) | | |
| RMVTFKVPH | B1501(224.61) | | | YVDYMPAMK | A1101(66.40) | | |
| LLATVTGGI | A0201(112.65) | | | CAKFSCLGK | A0301(317.05) | A1101(150.37) | |
| SVIEKMETL | A0201(102.15) | | | VGRERLTRM | B0801(376.28) | | |
| LIIAHYAII | A0201(57.94) | B0801(217.94) | | LALGMMILK | A0301(308.00) | A1101(23.16) | |
| TQHGTTVVK | A1101(138.35) | | | MMATIGITL | A0201(19.18) | B1501(124.43) | |
| MTTEDMLAV | A0201(189.32) | | | FLVDGPDTS | A0201(136.81) | | |
| AMILSIVSL | A0201(48.63) | | | FLLIVGQLT | A0201(374.17) | | |
| RQGYATQTM | B1501(25.89) | B1501(208.72) | | RLPEDEQM | A0201(276.95) | | |
| ALLLVAHY | B1501(346.33) | | | WIVERGMVK | A1101(382.77) | A1101(7.04) | |
| WAYHGSYEV | A0201(48.52) | | | SSMLNIMNR | A0301(327.42) | | |
| NKRRRTAGV | B0801(85.11) | | | TPMAMTCIA | B0702(197.56) | | |
| VGRERLSRM | B0801(268.57) | | | AMGIMILKL | A0201(368.13) | | |
| VSGILAQGK | A1101(168.19) | | | TMKIGIGVL | B0801(419.65) | | |
| NLIGKEEYV | A0201(42.59) | | | ILRHPGFTM | B0702(256.69) | B1501(34.06) | |
| KMKTKTWLV | A0201(60.19) | | | AQRIETWVL | B1501(452.03) | | |
| KIAQYENLK | A0301(82.70) | A1101(28.90) | | LLAKSIFKL | A0201(9.69) | | |
| IMAIGIVSI | A0201(37.86) | B1501(388.37) | | MILMLLPTA | A0201(230.37) | | |
| ALWDVPSPA | A0201(12.48) | | | MILVVVIAL | A0201(241.65) | | |

FIG. 48-9

| Peptide | HLA (nM) | HLA (nM) | HLA (nM) | Peptide | HLA (nM) | HLA (nM) | HLA (nM) |
|---|---|---|---|---|---|---|---|
| QYIFTGQPL | A2402(482.30) | | | CISIMIEEV | A0201(266.05) | | |
| GLAMGIMML | A0201(37.72) | | | TMTYRRPTI | B0801(69.65) | | |
| ILLAAVAPS | A0201(167.78) | | | GGLFTSLGK | A0301(436.85) | A1101(200.21) | |
| LVISGVFPV | A0201(4.85) | | | RLREKQDVF | B1501(73.64) | | |
| KARSTPFNM | B1501(397.82) | | | KQISNELNY | B1501(77.55) | | |
| ITWIGMNSR | A1101(349.39) | | | LLTIGLSLV | A0201(65.45) | | |
| SLTFIRTSL | B0801(195.38) | | | VLDDGIYRI | A0201(5.52) | | |
| HILLENDMK | A1101(159.77) | | | WMKFREGSS | B0801(125.55) | | |
| ARGARRMAI | B0801(430.45) | | | RQWFLDLPL | A0201(52.71) | B1501(87.91) | |
| GLAMGIMIL | A0201(79.53) | | | LMCANTIFT | A0201(499.55) | | |
| WMKLREGSS | B0801(111.69) | | | LLLGVGLAM | A0201(215.80) | B1501(159.65) | |
| AGLAFSLMK | A1101(85.72) | | | AQMWALMYF | A0201(81.22) | A2402(169.20) | B1501(13.98) |
| ILARWSSFK | A0301(11.23) | A1101(11.74) | | QILEENMEV | A0201(55.71) | | |
| GILARWSSF | B0801(147.71) | B1501(51.19) | | HYAWKTMAM | B0801(279.22) | | |
| ALLLIAHY | B1501(352.36) | | | GQLKLDWFK | A1101(125.13) | | |
| LMYADDTAG | B1501(303.71) | | | RIYSDPLAL | A0201(336.25) | B1501(320.40) | |
| SPSELETPI | B0702(174.76) | | | IVAIDLDPV | A0201(128.78) | | |
| KLRDKQDVF | B1501(79.51) | | | MILVVVITL | A0201(244.38) | | |
| LTLAAIVTA | A0201(492.85) | | | WLGARYLEF | B0801(425.90) | B1501(111.53) | |
| TISKMLLNR | A0301(367.82) | A1101(36.65) | | TCAMFTCLK | A1101(208.47) | | |
| SILELTDAL | A0201(70.13) | | | MMKIGIGVL | B0801(53.06) | B1501(178.31) | |
| HALGRLITV | A0201(458.39) | B0801(216.14) | | MLDVDLRPA | A0201(159.58) | | |
| RLLNRFTM | B0801(391.24) | | | HAVSRGSAK | A1101(361.70) | | |
| CTGSFKLEK | A0301(414.15) | A1101(17.00) | | KQIANELNY | B1501(68.41) | | |
| LVLVGVVTL | A0201(478.19) | | | TMFLMLMPT | A0201(67.65) | | |
| CTREEFTRK | A0301(405.38) | A1101(111.77) | | SIGGVFTSV | A0201(54.09) | | |
| FLAHYIGTS | A0201(58.65) | | | LVMAFIAFL | A0201(13.07) | | |
| SYVMCTGSF | A2402(76.78) | | | TFIKTTLSL | A2402(412.12) | | |
| LLFKTENGV | A0201(19.81) | | | YILRDISRK | A0301(228.45) | A1101(76.20) | |

FIG. 48-10

| Peptide | HLA (nM) | HLA (nM) | HLA (nM) | Peptide | HLA (nM) | HLA (nM) | HLA (nM) |
|---|---|---|---|---|---|---|---|
| SLLRNDVPM | B1501(340.72) | | | IIIMMIPTV | A0201(54.41) | | |
| YADYMPVMK | A1101(143.32) | | | LLAAVSFVT | A0201(50.75) | | |
| AVLLLITHY | B1501(412.08) | | | IQPFLALGF | B1501(291.29) | | |
| CVYNMMGKR | A1101(130.45) | | | KLREMYSQL | A0201(264.86) | | B1501(440.27) |
| YTDYMPSMK | A1101(32.80) | | | IVMDEAHFT | A0201(476.66) | | |
| MLAVGLLFR | A0301(260.99) | A1101(192.23) | | LVMLLVHYA | A0201(99.92) | | |
| KMVMAFIAF | B1501(7.99) | | | KLREVYTQM | B1501(161.97) | | |
| NWYRKGSSI | B0801(147.67) | | | KLTDWDFVV | A0201(3.81) | | |
| NWYKKGSSI | B0801(149.45) | | | LQMEDKAWL | A0201(73.77) | | |
| MVAGGLLLA | A0201(76.66) | | | MKMRKKTWL | B0801(103.56) | | |
| HPGFTILAL | B0702(43.65) | | | AMLCIPNVM | A0201(402.68) | | B1501(195.13) |
| KVVIFTLLM | B1501(381.55) | | | VTNPAVLRK | A0301(132.26) | | A1101(14.66) |
| KLGYILRDV | A0201(344.80) | | | RSCTMPPLR | A1101(123.69) | | |
| VASAGISYK | A0301(88.56) | A1101(9.58) | | IILEFFLIV | A0201(61.44) | | |
| ISYDPKFEK | A0301(116.72) | A1101(13.74) | | TIGTTNFQR | A1101(98.72) | | |
| CTKTFVLKK | A0301(127.79) | A1101(16.73) | | STPFNMLKR | A1101(342.47) | | |
| AMGVPSLPL | A0201(444.50) | | | QLKLNWFKK | A0301(250.75) | | A1101(344.98) |
| IQTSGTTTI | B1501(188.34) | | | RTSLDFNEM | B1501(449.99) | | |
| NSLKINWYK | A0301(258.42) | A1101(10.97) | | MYADDTAGW | A2402(361.34) | | |
| WFVERNMVI | B0801(166.71) | | | GFLNEDHWF | A2402(163.46) | | |
| KSAAIDGEY | B1501(233.76) | | | AILAYTVGT | A0201(162.85) | | |
| KLLTDFQPH | B1501(462.68) | | | SYQLWATLL | A2402(61.08) | | |
| LNGRRRSTM | B0801(120.21) | | | RITAEWLWK | A0301(102.45) | | A1101(35.45) |
| GPLKLFMAL | B0702(51.11) | B0801(173.42) | | EPHWIAASI | B0702(247.73) | | |
| SVGKLIHQV | A0201(245.31) | | | GPMPVTVAS | B0702(227.13) | | |
| TPQASTVEA | B0702(484.23) | | | MTDDIGMGV | A0201(30.12) | | |
| LMKRGDLPV | A0201(206.96) | B0801(347.63) | B1501(402.91) | GAVLMYQGK | A1101(314.32) | | |
| INKRKKTSL | B0801(285.88) | | | NSRNTSMAM | B0702(289.29) | | B1501(113.55) |
| ALLSLVAHY | A0301(470.60) | B1501(60.53) | | WTSGATAEV | A0201(120.15) | | |

FIG. 48-11

| Peptide | HLA (nM) | HLA (nM) | HLA (nM) | Peptide | HLA (nM) | HLA (nM) | HLA (nM) |
|---|---|---|---|---|---|---|---|
| KVASEGIKY | A1101(109.21) | B1501(321.48) | | FQKALIFIL | A0201(295.12) | | |
| ILSENEVKL | A0201(360.09) | | | QQVPFCSHH | B1501(230.23) | | |
| GIQRTVFFV | A0201(49.05) | | | ILKRWGTVK | A0301(129.49) | | |
| MVLSIVSLI | A0201(79.81) | | | TFAAGLLLR | A1101(348.20) | | |
| CTRAEFCNK | A0301(386.40) | A1101(67.62) | | TLPAYLSSK | A0301(117.63) | A1101(47.26) | |
| SQLAKRFSK | A0301(86.98) | A1101(20.36) | | MMMLPATLA | A0201(54.94) | | |
| SLSMTCVAV | A0201(60.01) | | | SLGKAIHQV | A0201(11.97) | | |
| MLIPKTYAG | B0801(355.98) | | | SYAMCLNTF | A2402(12.50) | | |
| FLNEDHWFS | A0201(12.84) | | | EIKSCHWPK | A1101(274.60) | | |
| RKMIRPQPM | B0702(362.32) | B0801(124.90) | | TLSLHYAWK | A0301(98.66) | A1101(41.42) | |
| EQGKRTLTL | B0801(400.80) | | | LILCVTQVL | A0201(349.72) | | |
| VMASSVLLW | B1501(464.27) | | | TFIRSTMPL | B0801(467.82) | | |
| GMALLLEEM | A0201(354.66) | B1501(358.95) | | STGEHRREK | A1101(243.15) | | |
| AILLVTVSF | B1501(303.02) | | | TQVGTLALA | A0201(182.46) | | |
| MPVTVASAA | B0702(60.34) | | | KQLGQVMLL | A0201(37.87) | | |
| AAWYLWEVK | A1101(55.84) | | | KQITNELNY | B1501(87.39) | | |
| AQWQKGEEV | A0201(96.64) | | | HAVSRGSSK | A1101(269.68) | | |
| YVVIAILTL | A0201(300.37) | A1101(107.96) | | FMFVLLLSG | A0201(415.03) | B1501(438.58) | |
| IAIGIITLY | B1501(237.97) | | | TMAHRKPTY | B1501(123.74) | | |
| KSYAGPFSH | A0301(149.47) | | | LPTVTQMAM | B0702(16.67) | | |
| SVGKLVHQV | A0201(329.27) | | | LSIVSLLPL | B1501(281.82) | | |
| SPATAQKAT | B0702(340.65) | | | VLNPYMPSV | A0201(4.00) | | |
| TMFGGVSWM | A0201(98.26) | B1501(73.84) | | QVFGAAYGV | A0201(40.83) | | |
| CVTTMAEDK | A1101(319.54) | | | HMIAGVFLT | A0201(40.08) | | |
| ALFSGVSWI | A0201(13.16) | | | VTLFFLSGR | A1101(38.35) | | |
| NRRKRSTIT | B0801(343.00) | A1101(50.84) | | VMKDGRVLV | A0201(264.34) | | |
| MMVLKMVRK | A0301(86.03) | | | VLPENLEYT | A0201(218.96) | | |
| YVLGVFLRR | A1101(148.13) | | | RPGYHTQIA | B0702(45.82) | | |
| TLTAALLLL | A0201(84.42) | | | TPETKNSTF | B0702(398.15) | | |

FIG. 48-12

| Peptide | HLA (nM) | HLA (nM) | Peptide | HLA (nM) | HLA (nM) | HLA (nM) |
|---|---|---|---|---|---|---|
| TMKIGIGAL | B0801(180.70) | | LIAAVLLLV | A0201(16.68) | | |
| RPGYYTQTA | B0702(131.08) | | VENHHHAAM | B1501(492.03) | | |
| MGYWIESEK | A0301(238.48) | A1101(173.69) | STMPLTMAW | B1501(438.66) | | |
| YMPSVIEKM | A0201(99.28) | | TAKEVALLR | A1101(386.90) | | |
| KMVVHFDNA | A0201(273.41) | | ALGKSEFQI | A0201(130.81) | | |
| LAYRTRNAL | B0702(53.09) | B0801(140.23) | MLIALLGAM | A0201(259.83) | B1501(37.70) | |
| ASEMAEALK | A1101(133.28) | | LLMLLPTTL | A0201(65.35) | | |
| LLTKPWDVV | A0201(436.69) | | CLMMILPAT | A0201(73.65) | | |
| AIGTSITQK | A0301(124.16) | A1101(24.74) | RPTFAAGLL | B0702(22.48) | | |
| SGMLWMAEV | A0201(151.43) | | MGYWIESQK | A0301(201.09) | A1101(153.35) | |
| IMMIPTVVA | A0201(296.63) | | DVFFVPPEK | A1101(119.38) | | |
| MVLLTMKKK | A0301(219.10) | A1101(41.88) | LLVTHYAII | A0201(468.75) | | |
| KLTLKGTSY | B1501(127.34) | | IAVGGITLF | B1501(92.57) | | |
| MISYGGGWR | A1101(340.08) | | GPMKMVMAF | B0702(17.59) | | |
| SSMVNGVVK | A0301(351.17) | A1101(20.68) | KTMAMALSI | A0201(78.96) | A1101(387.59) | B1501(218.90) |
| MDLEKRHVL | B0801(126.95) | | HLAYRTRNA | B0801(251.76) | | |
| GTFHTMWHV | A0201(28.38) | | RTLILAPTR | A1101(139.37) | | |
| CWCNLTSTW | A2402(114.53) | | VPMAGPLVA | B0702(85.91) | | |
| FNIYKRSGI | B0801(292.15) | | LMSARGIGK | A0301(44.97) | A1101(48.41) | |
| AAGPWHLGK | A1101(60.78) | | SVIERMETL | A0201(98.01) | | |
| GLSSRATWA | A0201(486.47) | | QMENKAWLV | A0201(140.73) | | |
| NLVSSLVTA | A0201(183.35) | | PMATYGWNL | A0201(438.23) | | |
| SLQPQPTEL | A0201(88.68) | | FQIYKRSGI | B0801(375.82) | B1501(469.22) | |
| VIFTLLMLV | A0201(18.02) | | QLAVTIMTI | A0201(110.65) | | |
| VIIMLIPTV | A0201(55.36) | | LLLLTLLAA | A0201(140.56) | | |
| YMPSVVETL | A0201(12.35) | | FSGVSWIMK | A1101(59.39) | | |
| ILMMLVAPS | A0201(295.99) | | HMIVGRQEK | A0301(268.91) | A1101(119.03) | |
| VSSWGDVPY | B1501(169.00) | | TVWNRVWIL | A0201(337.65) | B0801(325.73) | |
| RPTPKGAVM | B0702(3.43) | | SMTCVAVGL | A0201(63.10) | | |

FIG. 48-13

| Peptide | HLA (nM) | HLA (nM) | HLA (nM) | Peptide | HLA (nM) | HLA (nM) | HLA (nM) |
|---|---|---|---|---|---|---|---|
| VLNPYMPTV | A0201(4.30) | | | LLMRTSWAL | A0201(5.68) | B0801(172.62) | B1501(378.71) |
| INRRKRTSL | B0801(90.06) | | | LMMMFPATL | A0201(16.98) | B0801(129.52) | B1501(71.98) |
| LMLVAHYAI | A0201(33.36) | B0801(489.67) | | YVMCTGPFK | A0301(118.99) | A1101(12.19) | |
| KSYAQMWSL | A0201(367.52) | | | MSSGNILFM | B1501(210.14) | | |
| ALLAGFMAY | A0301(94.19) | A1101(140.01) | B1501(43.45) | MPVMRRYSA | B0702(17.42) | B0801(7.06) | |
| VMAAILAYT | A0201(13.30) | | | GPLRMVLAF | B0702(57.11) | | |
| SLTQKVVIF | B1501(362.05) | | | YLAGAGLAF | A0201(408.06) | B1501(16.75) | |
| TSGSPIIDK | A1101(66.44) | | | FSGVSWVMK | A1101(88.29) | | |
| MLNIMNRRK | A0301(48.91) | A1101(96.17) | | CMAVGGITL | A0201(342.99) | | |
| GVLARWGTF | B1501(305.11) | | | VIAFFLAHA | A0201(70.73) | | |
| AVKNWLARV | A0201(177.99) | | | KLTLKGISY | B1501(268.31) | | |
| ILLVAVSLV | A0201(31.59) | | | VMCTGLFKL | A0201(26.71) | | |
| LVMKDGRVL | B0702(343.73) | | | KITQWLETK | A0301(264.81) | A1101(63.16) | |
| IAFLRFLAI | B0801(20.98) | | | RMGMGMTYL | A0201(90.83) | | |
| LINRFTMRY | A0301(127.49) | A1101(192.63) | B1501(224.75) | RTAGIIIMV | A0201(105.22) | | |
| RIISSIPFA | A0201(32.14) | | | MFGGVSWMI | A2402(220.83) | | |
| RPGYHTQIT | B0702(91.87) | | | WGKARIVTA | B0801(30.10) | | |
| SGSPIINRK | A1101(219.30) | | | TAGPWHLGK | A1101(65.33) | | |
| IVAEKDSPV | A0201(244.44) | | | LSRKDFDLY | B1501(174.95) | | |
| VPNYNLIIM | B0702(77.67) | | | AIDGEYRLK | A1101(201.38) | | |
| SVKKDLISY | A1101(487.31) | | | SYAMCSGTF | A2402(55.13) | | |
| EMILMKMEK | A1101(159.21) | | | SLSMTCIAV | A0201(41.52) | | |
| FIKSTMPLV | A0201(21.66) | | | RVAAEGINY | A0301(446.29) | A1101(100.00) | B1501(140.79) |
| IYSDPLALK | A1101(315.06) | | | VVIGILTLA | A0201(120.05) | | |
| LTTLSRPNK | A0301(497.03) | A1101(63.79) | | LNRRKRSTM | B0801(45.10) | | |
| LPIRYQTPA | B0702(122.75) | B0801(219.80) | | SWFKRGSSI | A2402(360.83) | B0801(44.75) | |
| KVDNFTMGV | A0201(16.44) | | | MALSIVSLF | B1501(71.12) | | |
| KPEGKVIDL | B0702(463.65) | | | WGKAKMLPT | B0801(307.77) | | |
| MVLKMVRNM | B1501(396.33) | | | SAAQRRGRI | B0801(370.70) | | |

FIG. 48-14

| Peptide | HLA (nM) | HLA (nM) | HLA (nM) | Peptide | HLA (nM) | HLA (nM) | HLA (nM) |
|---|---|---|---|---|---|---|---|
| VMILQHAWK | A0301(167.04) | A1101(50.61) | | TQESNWIQK | A1101(143.18) | | |
| FSGVSWTMK | A1101(91.30) | | | ILIAHKDGV | A0201(78.48) | | |
| LPWTSGALT | B0702(444.62) | | | FLSGKGLGK | A0301(305.19) | | |
| RTEAKEGLK | A1101(146.36) | | | RLRDSYTQV | A0201(74.77) | | |
| SMVNGVVKL | A0201(50.35) | | | KSKAINVLR | A1101(139.87) | | |
| YAQMWSLMY | B1501(96.88) | B1501(329.70) | | PTYLSSRAK | A0301(462.53) | A1101(274.04) | |
| WMSSEGAWK | A1101(220.45) | | | YILRDISNI | A0201(63.04) | | |
| SWFKKGSSI | B0801(182.27) | | | LMAIDLGEL | A0201(104.11) | | |
| ILLTGGVML | A0201(169.01) | | | YLRPQPTEL | A0201(61.85) | B0702(241.93) | B0801(205.46) |
| SMCTGKFKV | A0201(138.09) | | | ILLENDMKL | A0201(66.95) | | |
| FTVTALFLA | A0201(38.21) | | | MVRILIGLL | B0801(348.98) | | |
| NRRRRTAGV | B0801(59.14) | | | IAVGLITLY | B1501(192.28) | | |
| RTVGVIIML | A0201(385.51) | | | VTVASAAQR | A1101(95.72) | | |
| RPAKNGTVM | B0702(3.43) | | | VVTYGLNTF | B1501(130.33) | | |
| TVITPMMRH | A1101(464.61) | | | YAMCTNTFV | A0201(8.77) | | |
| GIFTTNIWL | A0201(462.88) | | | LTASLVMLF | B1501(65.18) | | |
| MSSSALLWM | B1501(354.13) | | | GVLGMALFL | A0201(314.91) | | |
| MITPRSPSV | A0201(126.61) | B0801(253.13) | | EVKTCVWPK | A1101(490.95) | | |
| AYVVIGLLF | A2402(87.59) | | | TFRMRPMFA | B0801(33.99) | | |
| KLGKCGSCV | A0201(264.51) | | | AALSEGVYR | A1101(356.02) | | |
| MILSIVSLL | A0201(68.64) | | | MTTTFSIPH | A1101(142.42) | | |
| MILLTGGVM | B1501(216.24) | | | PVMKRYSAL | B0801(54.55) | | |
| WLWALLGRK | A0301(154.34) | A1101(231.87) | | GILGMALFL | A0201(215.92) | | |
| AMHTALTGA | A0201(35.27) | | | AMKRYSAHF | B0801(340.26) | B1501(10.28) | |
| KQVANELNY | B1501(122.21) | | | LGKKKTPRL | B0801(313.82) | | |
| FLDYMPSMK | A0301(401.38) | | | ALTPQPMEL | A0201(79.29) | | |
| TIMAVLFVV | A0201(7.15) | | | IMAVGMVSI | A0201(73.32) | B1501(363.07) | |
| GLFKTNAGT | A0201(423.67) | | | KAVQHENLK | A1101(279.61) | | |
| KLTTQFETY | B1501(198.43) | | | KLSVGLIAI | A0201(26.48) | | |

FIG. 48-15

| Peptide | HLA (nM) | HLA (nM) | HLA (nM) | Peptide | HLA (nM) | HLA (nM) |
|---|---|---|---|---|---|---|
| NWFKKGSSI | B0801(134.09) | | | KTVQYENLK | A0301(362.02) | A1101(23.33) |
| MVEPWLSSK | A0301(126.94) | A1101(14.93) | | MSIPATLFV | A0201(72.94) | |
| KLTLRGMSY | A0301(209.85) | B1501(161.68) | | MAAVLAYTI | A0201(487.66) | |
| KVTQWLETK | A0301(433.46) | A1101(51.79) | | MALKLITQF | B1501(65.62) | |
| VIALFLAHA | A0201(127.77) | | | TPTWNKKEL | B0702(325.87) | |
| MDLEKRHAL | B0801(68.40) | | | ATLLSLTFI | A0201(402.01) | |
| NMGMGTTYL | A0201(157.92) | | | VSWKNKELK | A1101(93.78) | |
| LLAAVAPSM | A0201(56.55) | B1501(88.07) | | IPNHGVTAT | B0702(172.72) | |
| QTTGTTTIF | B1501(431.92) | | | KTSLCLVMI | A0201(476.06) | |
| NFVCRRTLV | B0801(265.25) | | | LTLKGTSYV | A0201(93.92) | |
| HWPKSHTLW | A2402(263.18) | | | LLLVAISFV | A0201(10.32) | |
| SVSLVLVGI | A0201(386.49) | | | TLKNVTEVK | A0301(142.39) | A1101(122.64) |
| YFHRRDLRL | B0801(90.59) | | | SLSMTCIVV | A0201(115.44) | |
| RKKARNTPF | B0801(124.02) | B1501(312.97) | | TVLELTDAL | A0201(379.38) | |
| KLREVYTQL | A0201(95.44) | | | TTILDVDLR | A1101(367.22) | |
| KMKAKTWLV | A0201(45.13) | | | FQENVFHTM | A0201(315.87) | B1501(103.91) |
| SIGKALHQV | A0201(59.44) | | | MIALFLAHA | A0201(33.66) | |
| ITASGLLWY | A0301(249.97) | A1101(37.88) | B1501(277.97) | MILQHAWKV | A0201(11.71) | |
| SQMLIPKSY | B1501(77.67) | | | TFIKTTMPL | B0801(448.43) | |
| AVSTANIFR | A1101(23.01) | | | VSSVNMISR | A1101(266.71) | |
| VSWKSKELK | A1101(50.99) | | | SPPEVGRAV | B0702(217.73) | |
| GPMVAGGLL | B0702(31.36) | | | CLQKQSHWV | A0201(94.51) | |
| ALLTIISLI | A0201(38.32) | | | QVFGAIYGA | A0201(121.70) | |
| AIRRGLRTL | B0702(144.93) | | | FQRALIFIL | A0201(299.46) | B1501(392.91) |
| IPKAYAGPF | B0702(19.23) | | | HRREKRSVA | B0801(287.12) | |
| TFKMRPMLA | B0801(111.99) | B0801(334.52) | | SMAMSCIVV | A0201(59.43) | |
| RVTRKHMIL | B0801(452.94) | | | KNTPFNMLK | A1101(152.48) | |
| ASWSGKELK | A1101(33.76) | | | KTARPSFNM | A1101(395.25) | |
| SQSTIPETV | A0201(160.54) | | | RTAGFLIMV | A0201(36.64) | |

FIG. 48-16

| Peptide | HLA (nM) | HLA (nM) | HLA (nM) | Peptide | HLA (nM) | HLA (nM) | HLA (nM) |
|---|---|---|---|---|---|---|---|
| WTTLLSLTF | B1501(179.90) | | | VSAITQAER | A1101(357.15) | | |
| KATGSASSM | B1501(209.02) | | | LIVSGIFPY | A1101(227.97) | B1501(66.53) | |
| YLDFMTSMK | A0301(206.77) | A1101(149.69) | | GSLIGLTSR | A1101(223.58) | | |
| IALGIMVLK | A0301(219.20) | A1101(19.38) | | KMKGKTWLV | A0201(54.65) | | |
| LVISGLFPV | A0201(3.88) | | | KLMSGKDVF | B1501(63.47) | | |
| WQIERASLI | A0201(95.44) | B1501(105.03) | | LLFKTASGI | A0201(53.58) | B1501(276.75) | |
| CVTTMAKSK | A1101(285.49) | | | ASDLKYSWK | A1101(88.03) | | |
| QLASAIFKL | A0201(14.33) | | | KLLTDFQSY | A0301(295.52) | B1501(42.40) | |
| QLKGMSYSM | B0801(205.56) | B1501(104.97) | | APTWNRKEL | B0702(19.93) | | |
| NVFHTMWHV | A0201(12.91) | | | YAMCTKTFV | A0201(59.60) | | |
| TYLSSKAKL | A2402(244.28) | | | FTDPASIAA | A0201(209.24) | | |
| STGSQLAKR | A1101(212.65) | | | FCSHHFHEL | B0801(482.89) | | |
| ILKRWGQLK | A0301(56.26) | A1101(170.20) | | GLNSRSTSL | A0201(392.78) | B0801(360.01) | B1501(243.97) |
| RQMEGEGVL | A0201(298.66) | B1501(139.93) | | LQRKHGGNL | B0702(432.80) | B0801(379.74) | B1501(162.53) |
| RVPSHLAYR | A1101(133.04) | | | AMFTCLKKM | A0201(407.97) | B1501(231.09) | |
| QLWAALVSL | A0201(23.48) | | | RANDWDFVV | A0201(124.52) | | |
| SYYCAGLKK | A1101(156.28) | | | LNRRKRSTI | B0801(69.55) | | |
| LNGRKRSTM | B0801(446.63) | | | NIVKLMSGK | A1101(374.89) | | |
| IAASIILEF | B1501(103.06) | | | TLEVHWNHK | A1101(267.34) | | |
| LTTLSRTNK | A0301(433.24) | A1101(37.83) | | FGSAYTALF | B1501(222.58) | | |
| KLVHQVFGT | A0201(74.06) | | | VIIAILTVV | A0201(21.78) | | |
| MLMLLPTA | A0201(47.49) | | | RLRIKGMSY | A0301(367.09) | B1501(50.20) | |
| TLTAAVLLL | A0201(128.31) | | | SPATAQKAM | B0702(13.22) | | |
| WITLLSLTF | B1501(239.99) | | | LPLCQSSSM | B0702(13.58) | B0801(375.03) | |
| AVILQNAWK | A1101(25.41) | | | TLIAAVLML | A0201(71.11) | | |
| CIAVGLITL | A0201(428.34) | | | ILRNPGFAL | B0702(68.96) | B1501(142.40) | |
| KLHSGKDVF | B1501(160.44) | | | RQMEGEGVF | B1501(8.92) | | |
| LLILCTSQI | A0201(197.23) | | | ALALGMMAL | A0201(54.80) | | |
| NGRRRSTIT | B0801(397.48) | | | NILFMGHLK | A0301(256.94) | A1101(27.38) | |

FIG. 48-17

| Peptide | HLA (nM) | HLA (nM) | Peptide | HLA (nM) | HLA (nM) |
|---|---|---|---|---|---|
| TQIMEVTAK | A1101(175.55) | | WSLMYFHRR | A1101(247.00) | |
| YQNKVVKVL | B1501(261.85) | | SMAVSCIAV | A0201(23.06) | |
| NYADRKWCF | A2402(138.98) | | SLTFISSTM | B1501(208.20) | |
| NTGETLGEK | A1101(293.50) | | TTNIWLKLK | A0301(354.29) | A1101(15.74) |
| GSSPIVEVK | A1101(106.87) | | RLKMDKLTL | B0801(196.47) | |
| TLMKGASKR | A1101(342.69) | | MVLLTMKEK | A0301(238.34) | A1101(39.24) |
| WPRSHTLWS | B0702(19.38) | | GAVLTYNGK | A1101(265.13) | |
| LTLKGMSYV | A0201(56.48) | | KLVMAFIAF | B1501(18.59) | |
| AVILRNAWK | A0301(428.91) | A1101(29.70) | CTGKFKVVK | A1101(48.52) | |
| NRRRSAGM | B0801(29.99) | | GLFTSVGKL | A0201(399.78) | |
| VMLLVLCAV | A0201(21.39) | | RVISATPLA | A0201(316.41) | |
| TANPIVIDK | A1101(37.56) | | GMGEAAAIF | B1501(149.47) | |
| MLKRARNRV | B0801(42.71) | | TTILTPMLR | A1101(10.16) | |
| ISSWGDVPY | B1501(107.55) | | AMTAGIFLF | A0201(239.97) | B1501(111.40) |
| GVVTTSGTY | B1501(297.57) | | CVSILIEEV | A0201(491.67) | |
| CPTQGEPTL | B0702(213.66) | | PTQGEPFLK | A1101(329.89) | |
| TVNPIVAEK | A0301(214.78) | A1101(9.97) | LPAIVREAI | B0702(40.89) | |
| TWRDMTHTL | A2402(309.31) | | TLIFILLTA | A0201(101.97) | |
| SMSFSCIVI | A0201(245.23) | B1501(463.43) | YLPAIVREA | A0201(81.56) | |
| FMTATPPGT | A0201(78.49) | | MLLNRFTMT | A0201(167.92) | B0801(71.88) |
| PTLDFELIK | A1101(347.86) | | SIGGVFTSI | A0201(308.71) | |
| ITANPVVIK | A0301(157.79) | A1101(12.76) | FTMTHRRPT | B0801(440.75) | |
| VSWNGKELK | A1101(43.10) | | FVKTTFSVH | B1501(303.20) | |
| LLKATLLAV | A0201(43.28) | B0801(169.87) | YILWENNIK | A1101(292.76) | |
| SLTFVKTTF | B1501(490.00) | | LVLCAVQLL | A0201(409.05) | |
| LAAFRVRPT | B0801(444.96) | | WVMKIGIGI | A0201(182.18) | |
| LMCHATFTT | A0201(173.10) | | TQGLNWIQK | A1101(84.36) | B0801(91.59) |
| VLFTFVLLL | A0201(22.21) | | FLMLMPTAL | A0201(9.82) | |
| TWRDMAHTL | A2402(322.47) | | AVVLQNAWK | A1101(54.28) | |

FIG. 48-18

| Peptide | HLA (nM) | HLA (nM) | HLA (nM) | Peptide | HLA (nM) | HLA (nM) | HLA (nM) |
|---|---|---|---|---|---|---|---|
| AILAYTIGT | A0201(221.46) | | | CSNAFVLKK | A0301(112.32) | A1101(8.32) | |
| VILRNAWKV | A0201(133.09) | | | VIDPRRCMK | A1101(182.53) | | |
| AENHHHAAM | B1501(360.90) | | | KTWAYHGSY | A0301(149.72) | A1101(81.98) | B1501(190.24) |
| SGYDWITDF | B1501(200.65) | | | MAMTDTTPF | B1501(4.41) | | |
| HMIAGVFFT | A0201(21.50) | | | RMRPMFAVG | B1501(494.76) | | |
| LWPKTHTLW | A2402(124.19) | | | YLPAIIREA | A0201(59.81) | | |
| ITYKCPLLR | A0301(164.78) | A1101(31.37) | | LTAALLLI | A0201(201.86) | | |
| GLVSLLGSA | A0201(375.70) | | | KPIDDRFAS | B0702(338.54) | | |
| LMALDLGEL | A0201(124.50) | | | GIITLYLGV | A0201(86.48) | | |
| VSTIQQLTK | A1101(57.93) | | | VTDPAVLRK | A1101(60.58) | | |
| SSVNMISRM | B1501(116.53) | | | VIMDEAHFT | A0201(177.75) | | |
| KQPATLRKY | B1501(388.92) | | | TLIAAVLLL | A0201(45.54) | | |
| WLKLREMYT | B0801(148.94) | | | SRWSRRMLM | B0801(123.52) | | |
| LTGGVTLFF | B1501(338.82) | | | QMESKAWLV | A0201(106.59) | | |
| VTAASAAQR | A1101(52.60) | | | TMKHKKATY | B1501(277.54) | | |
| MLLMLVPTA | A0201(83.14) | | | MTTTLSIPH | A1101(266.60) | | |
| TSIFAGHLK | A1101(16.08) | | | IPKNFAGPV | B0702(60.88) | | |
| AFLAGFMAY | B1501(427.95) | | | KTFDSEYIK | A0301(71.55) | A1101(8.59) | |
| VVTNPAVLR | A1101(176.21) | | | LLAAYVMSG | A0201(294.77) | | |
| FWHFWQKK | A0301(232.69) | A1101(41.05) | | MLFVHYAII | A0201(64.61) | B0801(96.22) | |
| QLTYVVIAI | A0201(336.70) | | | WLKLREMYS | B0801(322.96) | | |
| TSGSPIVDK | A1101(82.23) | | | IIFILLMLV | A0201(85.62) | | |
| ASAILNAHK | A0301(416.01) | A1101(19.38) | | TMKKKSWLV | A0201(337.57) | B0801(134.61) | |
| HWFRKGSSI | B0801(97.58) | | | EALKRRLRT | B0801(381.51) | | |
| WIMKIGIGI | A0201(93.48) | | | CTREEFISK | A0301(326.25) | A1101(82.69) | |
| LGRKKNPRL | B0801(476.60) | | | AVIEHLERL | A0201(58.08) | | |
| WTMKIGIGV | A0201(79.11) | | | TTLSRTNKK | A0301(128.30) | A1101(9.91) | |
| KTFDSEYVK | A0301(51.48) | A1101(7.19) | | VPTWNRKEL | B0702(30.04) | | |
| ISLGLILLK | A0301(75.00) | A1101(10.09) | | RPRLCTREE | B0702(117.39) | | |

FIG. 48-19

| Peptide | HLA (nM) | HLA (nM) | HLA (nM) | Peptide | HLA (nM) | HLA (nM) | HLA (nM) |
|---|---|---|---|---|---|---|---|
| LQKTEATQL | B1501(321.14) | | | SQMLIPKTY | B1501(146.13) | | |
| FIFSLKDTL | A0201(192.73) | | | IFLFFMQGK | A0301(450.49) | A1101(241.04) | |
| KADNFTMGV | A0201(74.34) | | | SVGGVFTSV | A0201(103.91) | | |
| QVLALEPGK | A1101(138.40) | | | HPGFTVIAL | B0702(68.36) | | |
| EMILMRMKK | A1101(96.77) | | | KPGTSGSPI | B0702(20.50) | | |
| EMVLLTMKK | A1101(219.66) | | | MGLGKGWPL | B0801(125.60) | | |
| VVIAILTVV | A0201(36.22) | | | LIMAWRTIM | B0801(175.52) | B1501(165.21) | |
| GTAVVKVKY | A1101(423.71) | | | TYQLWTALV | A2402(379.35) | | |
| VTFKNAHAK | A0301(62.13) | A1101(7.80) | | AQMWTLMYF | A0201(77.75) | A2402(143.11) | B1501(11.42) |
| VTASILLWY | A0301(223.64) | A1101(25.41) | | IALGLMTLK | A0301(192.24) | A1101(18.63) | |
| MLIPRSYAG | B0801(94.68) | | | TYGWNLVKL | A2402(87.53) | | |
| LLMLLPTVL | A0201(178.05) | | | MTAGTFLFF | A1101(205.13) | B1501(15.33) | |
| TERLKRMAI | B0801(200.77) | | | KLFMALVAF | A0201(430.68) | B1501(21.11) | |
| CTATGEHRR | A1101(342.24) | | | SLLTCAKFK | A0301(56.38) | A1101(40.21) | |
| LTAALLLLV | A0201(38.73) | | | KSAAVDGEY | A1101(444.61) | B1501(194.60) | |
| MLLVAVSFV | A0201(8.77) | | | IVVQNWLAR | A1101(474.66) | | |
| VSTVQQLTK | A1101(88.67) | | | KQESNWIQK | A1101(213.29) | | |
| RLEPNWASV | A0201(156.86) | | | FQEGVFHTM | A0201(232.44) | B1501(271.89) | |
| KLKEKQDAF | B1501(84.65) | | | VMALFLAHA | A0201(29.03) | | |
| TTNIWLKLR | A1101(208.63) | A1101(53.66) | | TSNHGVTAM | B1501(119.09) | | |
| KLVDREREL | A0201(343.26) | B0801(258.02) | | SVIERMEAL | A0201(78.94) | | |
| VIDPRRCLK | A0301(228.53) | | | ILNAHKDGV | A0201(134.22) | | |
| CLWPKTHTL | A0201(19.43) | | | GINSRSTSL | B1501(471.81) | | |
| NYILWENNI | A2402(272.99) | | | MILMKMKAK | A0301(244.84) | A1101(171.98) | |
| YAMCLNAFV | A0201(10.82) | | | PTLDFELTK | A1101(112.15) | | |
| TTETPTWNK | A1101(24.19) | | | LLTVGLSLV | A0201(46.34) | | |
| NMEKYQLAV | A0201(73.03) | | | GGRAYRHAV | B0801(391.29) | | |
| KWKRQLNSL | A2402(460.34) | | | KPLDERFAT | B0702(293.51) | | |
| TLYAVATTV | A0201(9.98) | | | RPTPKGTVM | B0702(3.12) | | |

FIG. 48-20

| Peptide | HLA (nM) | HLA (nM) | HLA (nM) | Peptide | HLA (nM) | HLA (nM) | HLA (nM) |
|---|---|---|---|---|---|---|---|
| SILASSLLR | A0301(132.56) | A1101(12.76) | | WAFCEALTL | B1501(497.06) | | |
| IPVTPASAA | B0702(81.15) | | | MCLNAFVLK | A1101(153.37) | | |
| AINVLRGFR | A1101(165.46) | | | TTVITPMMR | A1101(51.57) | | |
| SLMCANTIF | B1501(14.05) | | | ITASILLWH | A1101(233.86) | | |
| WLKLREVHT | B0801(144.73) | | | SLITCAKFK | A0301(91.05) | A1101(39.59) | |
| LAHRTRNAL | B0702(32.70) | B0801(174.19) | | LLLIAHYAI | A0201(42.75) | B0801(496.77) | |
| GMGTTYLAL | A0201(304.21) | | | ILLTAVTPS | A0201(407.84) | | |
| KNQTWQIEK | A1101(219.05) | | | LNRRRRSTV | B0801(31.30) | | |
| GLLIACYVI | A0201(151.78) | | | VLIFILLTA | A0201(89.75) | | |
| MMLVVVITL | A0201(47.78) | | | YAWKTMAMI | A0201(323.06) | | |
| SKIPGGAMY | B1501(407.25) | | | VIFVLLMLV | A0201(64.77) | | |
| GLNSRSASL | A0201(321.13) | B0801(258.91) | B1501(346.31) | LGKKKTPRM | B0801(366.28) | | |
| RVYADPMAL | A0201(249.30) | B0702(299.24) | | RLITVNPII | A0201(156.93) | | |
| VSSVNMVSR | A1101(473.63) | | | KLVHQVFGA | A0201(25.45) | | |
| FMAYMVGQT | A0201(102.19) | | | FIFSLKDAL | A0201(216.67) | | |
| LIAAVLMLV | A0201(10.18) | | | LTLNLITEM | B1501(306.09) | | |
| ILGAQALPV | A0201(25.73) | | | SVMCIAVGM | A0201(451.13) | | |
| ITIAEDGSM | B1501(468.39) | | | TMTYRKPTI | B0801(277.72) | | |
| LAIPVTMTL | A0201(469.03) | | | TLKGISYVM | B0801(427.79) | | |
| CAKFSCSEK | A0301(484.28) | A1101(167.97) | | ALGKNEFQI | A0201(346.22) | | |
| TVTEEVAVK | A1101(423.90) | | | RLKMDKLEL | B0801(295.38) | | |
| IVMLHTTEK | A0301(56.53) | A1101(11.30) | | IFTTNIWLK | A1101(229.88) | | |
| PLNEGIMAI | A0201(205.37) | | | VVKPLDERF | B1501(430.41) | | |
| GLKKVTEVK | A0301(197.37) | | | ALTLHWFRK | A0301(88.81) | A1101(60.27) | |
| SQMLIPKAY | B1501(84.10) | | | CTKEEFISK | A0301(402.64) | A1101(56.37) | |
| SQASTAEAI | B1501(258.27) | | | SGSPIINKK | A1101(323.11) | | |
| IPMTGPLVA | B0702(78.57) | | | LIFILLTAI | A0201(237.86) | | |
| MLRTRIGTK | A0301(120.79) | | | VPNYNMIIM | B0702(89.73) | | |
| QLSKSEFNI | A0201(282.90) | | | HPGFTTMAA | B0702(173.07) | | |

FIG. 48-21

| Peptide | HLA (nM) | HLA (nM) | HLA (nM) | Peptide | HLA (nM) | HLA (nM) | HLA (nM) |
|---|---|---|---|---|---|---|---|
| TMFTLTVAW | B1501(273.43) | | | DLMEFIDGI | A0201(233.97) | | |
| EMKKKTWLV | B0801(163.95) | | | EMCDDTVTY | B1501(189.98) | | |
| AYMIGQTRI | A2402(478.90) | | | VIGMAMTTV | A0201(200.69) | | |
| KLYSGKDVF | B1501(53.08) | | | KAAEVSWEK | A0301(158.75) | A1101(18.47) | |
| VLLITHYA | A0201(60.03) | | | SLLPLCLST | A0201(92.39) | | |
| APFESEGVL | B0702(98.31) | | | DVFFIPPEK | A1101(120.22) | | |
| MVLSIVSLL | A0201(100.41) | | | IPKAYAGPI | B0702(31.27) | B0801(194.05) | |
| SPGVVLGIF | B0702(243.82) | | | LLITHYAII | A0201(134.38) | B0801(263.48) | |
| LLIACYVIT | A0201(383.83) | | | GTVMDVISR | A1101(172.09) | | |
| MALFLAHAI | B0801(429.37) | | | SSMINGVVK | A0301(282.98) | A1101(19.10) | |
| KLTSRETAL | A0201(467.73) | | | YTPEGIIPT | A0201(471.77) | | |
| KMLMTGILA | A0201(289.90) | | | GLFSGKGPL | A0201(263.44) | | |
| IQTTGTTTI | B1501(188.37) | | | RLAEAIFKL | A0201(3.58) | | |
| MTLKLITQF | B1501(66.20) | | | RVIDPRRCM | B0702(182.48) | B1501(314.20) | |
| KAVHADMGY | B1501(114.20) | | | AVFFVVTLI | A0201(277.80) | | |
| SYLAGAGLL | A2402(240.84) | | | AMASGLLWI | A0201(16.77) | | |
| ALMATFRMR | A0301(311.52) | A1101(224.33) | | APLESEGVL | B0702(135.95) | | |
| FSIGLFSGK | A0301(357.04) | A1101(20.14) | | ATLKNVTEV | A0201(186.55) | | |
| ALSEGVYRI | A0201(8.47) | | | WAKNIQAAI | B0801(209.70) | | |
| YVFSGDPLR | A1101(260.14) | | | MATFKMRPM | B0801(118.69) | | |
| YVLGIFLRR | A1101(169.15) | | | WHYDDENPY | B1501(458.90) | | |
| YVDYMPVMK | A1101(47.66) | A1101(97.44) | | KSGAIKVLR | A1101(177.35) | | |
| PVYLMTLMK | A0301(311.65) | | | LTNTTTESR | A1101(417.10) | | |
| KMFESTYRG | A0201(306.56) | B0801(414.44) | B1501(26.45) | MTQKARNAL | B0702(42.54) | B0801(167.60) | |
| LQRQYGGAL | B0702(244.45) | A1101(22.91) | | GTILVQIKY | A1101(301.96) | | |
| MVLLQMESK | A0301(230.03) | | | FPYSIPATL | B0702(44.82) | | |
| VYADPMALK | A1101(220.01) | | | VPHAKRQDV | B0702(192.67) | | |
| FIRSTMSLV | A0201(93.55) | | | LMLVPTALA | A0201(186.64) | | |
| GGKAYRHAV | B0801(433.78) | | | LMMLVAPSY | B1501(50.32) | | |

FIG. 48-22

| Peptide | HLA (nM) | HLA (nM) | HLA (nM) | Peptide | HLA (nM) | HLA (nM) | HLA (nM) |
|---|---|---|---|---|---|---|---|
| QLIYVILTI | A0201(78.05) | | | ITYNCPLLK | A0301(12.60) | A1101(4.84) | |
| TMAAILAYT | A0201(15.24) | | | GLGVLLTWL | A0201(325.27) | | |
| IQKEMLVTF | B1501(18.33) | | | MLLMLMPTA | A0201(75.56) | | |
| NQAVVLMGL | A0201(171.31) | | | LALGMMALK | A0301(394.46) | A1101(27.29) | |
| KRKLRTLVL | B0801(463.61) | | | ILLTAIAPS | A0201(211.19) | | |
| SLTFVRTTF | B1501(169.98) | | | SSMVNGVVR | A1101(144.34) | | |
| AVEPGKNPK | A1101(201.58) | | | VVVGDTIGV | A0201(213.38) | | |
| LTASLVMLL | A0201(287.41) | | | AYTIGTTYF | A2402(385.48) | B0801(255.21) | |
| MRGAKRMAI | B0801(42.62) | | | TPRAKRGTA | B0702(31.90) | | |
| HMIVGIQEK | A0301(192.27) | A1101(72.72) | | LAVVSVSPL | B1501(332.30) | | |
| MIGQTGIQR | A1101(347.67) | | | SMTFIRTTF | B1501(48.99) | | |
| VIGLYGNGV | A0201(489.77) | | | ISKMLLNRF | B1501(209.49) | | |
| ILLKIVTQF | B1501(213.17) | | | WIMKIGIGV | A0201(22.80) | | |
| SYAMCTNTF | A2402(18.50) | | | SMTCIAVGM | A0201(444.51) | | |
| TPIWNRKEL | B0702(46.83) | | | LVLCAGQLF | B1501(132.31) | | |
| NLVRLQSGV | A0201(478.72) | | | DLRLAANAI | B0801(305.90) | | |
| LLTAVAPSM | A0201(290.56) | B1501(333.79) | | LTNTTTASR | A1101(132.83) | | |
| YQLAVTIMT | A0201(229.77) | | | WTMKILIGA | A0201(81.42) | | |
| IVIGIITLY | A1101(192.55) | B1501(432.12) | | LMMTTIGIV | A0201(20.08) | | |
| GLLFMILTV | A0201(14.45) | | | SLTFIRTTF | B1501(209.25) | | |
| TVMDIISRK | A0301(64.83) | A1101(5.26) | | MAAILAYTV | A0201(136.58) | | |
| VARPPFNML | B0702(236.04) | | | SVTMLLMLV | A0201(231.90) | | |
| RMGMGVTYL | A0201(69.21) | B1501(341.47) | | TSGSPIVNR | A1101(326.48) | | |
| TIAVASGLF | B1501(386.93) | | | LMSGKDVFY | B1501(98.17) | | |
| TTVITPMLR | A1101(23.56) | | | VLMHRGKRI | B0801(467.26) | | |
| LLMLLPTAM | A0201(448.90) | B1501(115.49) | | MILMKMKTK | A0301(152.92) | A1101(113.58) | |
| KLMRITAEW | A0201(395.92) | | | SMGKLVHQV | A0201(20.67) | | |
| WTMKIGIGI | A0201(433.16) | | | GILTLAAIV | A0201(315.53) | | |
| KLHSGVDVF | B1501(29.85) | | | TMAHRKPTF | B0801(200.79) | B1501(83.29) | |

FIG. 48-23

| Peptide | HLA (nM) | HLA (nM) | HLA (nM) | Peptide | HLA (nM) | HLA (nM) | HLA (nM) |
|---|---|---|---|---|---|---|---|
| MTQKTRDAL | B0702(300.47) | | | LTPPVNDLK | A1101(261.69) | | |
| TVNPIITEK | A0301(185.71) | A1101(8.78) | | AKMLSTESY | B1501(217.17) | | |
| MIAGVFLTF | B1501(27.61) | | | TIGVLEQGK | A1101(286.43) | | |
| LLVAASFVT | A0201(287.43) | | | LPDYGELSL | B0702(105.52) | | |
| LNGRRRSTI | B0801(177.91) | | | GIVTCAMFR | A1101(96.71) | | |
| GLNSKNISM | B1501(193.31) | | | QMEGEGLFK | A1101(188.65) | | |
| MTGTLAVFF | B1501(282.37) | | | MALKDFKEF | B1501(124.45) | | |
| LVMILPAAL | A0201(342.54) | | | LALFLAHYV | A0201(183.11) | | |
| KMVRDMEKY | B1501(252.73) | | | FISSTMPLV | A0201(3.86) | | |
| STIQQLTKR | A1101(83.30) | | | VLAFITFLR | A0301(270.62) | A1101(70.45) | |
| AVLAYTIGT | A0201(461.48) | | | KLREGSSEV | A0201(54.27) | | |
| CLQKQSHWI | A0201(480.21) | | | ATHLATLRK | A0301(78.21) | A1101(11.77) | |
| EVKSCHWPK | A1101(358.42) | | | YMPAVIEHL | A0201(6.98) | | |
| TANPVVIKK | A1101(19.88) | | | SMAMSCIAV | A0201(21.29) | | |
| LLFMILTVA | A0201(90.52) | | | TLTGEIGAV | A0201(308.42) | B1501(496.80) | |
| WGKAKMLST | B0801(402.35) | | | KPMPGTRKV | B0702(38.22) | | |
| TLLAISGVY | B1501(226.97) | | | KVVIFILLI | A0201(384.47) | | |
| NRRRRTVGM | B0801(23.70) | | | ALPVVLMTL | A0201(54.73) | | |
| ISKVRSNAA | B0801(188.06) | | | ILGYSQIGA | A0201(408.82) | | |
| TLKLSWFKK | A0301(47.68) | A1101(35.66) | | GLYPLAIPI | A0201(11.17) | | |
| TTWEDVPYL | A0201(56.98) | | | TPRTPSVEV | B0702(33.46) | | |
| CYWPRSHTL | A2402(4.69) | | | IPKSLAGPI | B0702(45.38) | | |
| VPTVTQMAM | B0702(35.49) | A1101(300.16) | | TVGPWHLGK | A0301(285.98) | A1101(17.47) | |
| FLSGRGLGK | A0301(161.67) | A1101(99.70) | B1501(17.38) | IAGPWHLGK | A1101(114.86) | | |
| VMRSRWSRK | A0301(64.08) | | | KTSLCLMMV | A0201(127.96) | | |
| TMFKMSPGY | A0301(71.06) | | | TFAAGLFLR | A1101(288.34) | | |
| YVVIAILTV | A0201(82.53) | | | KTRANDWDF | B1501(363.92) | B1501(68.49) | |
| KTFVELMRR | A0301(181.49) | A1101(18.29) | | KQWFLNLPL | A0201(27.65) | | |
| TILIKVEYK | A0301(119.80) | A1101(14.84) | | GLLCVTASS | A0201(383.76) | | |

FIG. 48-24

| Peptide | HLA (nM) | HLA (nM) | HLA (nM) | Peptide | HLA (nM) | HLA (nM) |
|---|---|---|---|---|---|---|
| VTFKTAHAK | A0301(39.95) | A1101(5.64) | | IILGGLTWM | A0201(319.59) | |
| ILTDGPERV | A0201(33.07) | | | TTNIWMKFR | A1101(148.88) | |
| EVKTCLWPK | A1101(294.66) | | | LPDYGELTL | B0702(190.31) | |
| KMRDSYTQV | A0201(55.18) | | | MLLMLIPTA | A0201(56.91) | |
| ILNRRRRTV | B0801(92.34) | | | QMEGEGVFK | A1101(464.03) | |
| RPMPGTRRV | B0702(15.08) | | | MLSVHYAII | A0201(117.31) | B0801(148.54) |
| SLRPQPTEL | B0702(487.45) | | | SNMLNTMNR | A1101(325.37) | |
| ILCTSQILL | A0201(336.38) | | | VVQNWLARV | A0201(57.53) | |
| MAMTTVFSI | A0201(34.57) | B0801(380.37) | B1501(231.93) | STVQQLTKR | A1101(158.39) | |
| CLMMMLPAT | A0201(85.66) | | | VVVMVGATM | B1501(376.80) | |
| LALGMMVLK | A0301(327.69) | A1101(23.98) | | NIWLRLREK | A0301(487.69) | A1101(417.77) |
| FQSHQLWAT | A0201(77.03) | | | FMKDGRSLV | A0201(61.32) | |
| MIIMLIPTV | A0201(23.10) | | | TMCSGKFSI | A0201(381.86) | |
| MILMEMRKK | A0301(148.58) | A1101(61.86) | | VTRGAVLTY | B1501(145.13) | |
| MILMKMKGK | A0301(220.37) | A1101(146.30) | | TMFLITENK | A0301(30.26) | A1101(7.79) |
| KLLTEFQPH | B1501(486.70) | | | LPEYGTLGL | B0702(114.16) | |
| TPQAPSTEI | B0702(112.95) | | | SYSMCTGKF | A2402(180.59) | |
| GAVLTHNGK | A1101(361.00) | A1101(5.43) | | GLLCLTLFM | A0201(71.62) | B1501(378.88) |
| PLNEAVMAV | A0201(76.50) | | | TYFQRVLIF | A2402(35.93) | |
| VTLFFLSGK | A0301(36.48) | | | YAWKTTAMV | A0201(46.51) | |
| MADDIGMGV | A0201(68.24) | | | HILLENGMK | A1101(165.67) | |
| ITYKCPFLR | A0301(325.49) | A1101(31.51) | | NRRRRTAGM | B0801(24.22) | |
| LMSGKGVGK | A0301(166.16) | A1101(350.33) | | IAVGLVTLY | B1501(172.34) | |
| TANPVVTKK | A1101(23.94) | | | KSYAQMWTL | A0201(333.12) | |
| RTAGVIIML | A0201(470.60) | | | FIRSTIPLV | A0201(18.93) | |
| WMIRILIGL | A0201(12.73) | | | PLNEGIMAV | A0201(45.66) | |
| LFMALVAFL | A0201(414.40) | | | ILPDGPERV | A0201(36.43) | |
| TLWEGSPGK | A0301(157.30) | A1101(124.81) | | RQLANAIFK | A0301(42.91) | A1101(17.40) |
| KLMKITAEW | A0201(325.79) | | | GIQRAVFFV | A0201(39.15) | |

FIG. 48-25

| Peptide | HLA (nM) | HLA (nM) | HLA (nM) | Peptide | HLA (nM) | HLA (nM) | HLA (nM) |
|---|---|---|---|---|---|---|---|
| TMAMVLSIV | A0201(72.72) | | | RQGYATQTV | A0201(214.13) | | |
| MVKPKGKVV | B0801(175.93) | | | SYVMCTGLF | A2402(57.11) | | |
| MAMTTVLSI | A0201(248.53) | B0801(166.16) | | AQWKKGEEV | A0201(113.50) | | |
| ILARWGTFK | A0301(20.09) | A1101(20.26) | | IFLFLMSGK | A0301(279.71) | A1101(262.94) | |
| RIKGMSYTM | B1501(95.10) | | B1501(87.27) | IQMSGTTTI | A0201(13.84) | B1501(21.08) | |
| KLIHQIFGT | A0201(21.93) | | | SMFEPEREK | A0301(67.31) | A1101(42.82) | |
| AILAGFMAY | A0301(118.37) | A1101(42.29) | | ALGMMILKI | A0201(279.57) | | |
| QLADYGALT | A0201(194.92) | | | MVGANASDK | A0301(292.09) | | |
| TYLSSRAKL | A2402(191.90) | | | NFVCRRTFV | B0801(153.10) | A1101(49.16) | |
| GLGKTSIGL | A0201(341.97) | | | TIPESILEL | A0201(399.80) | | |
| GSCVTTMAK | A0301(194.20) | A1101(13.90) | | LMMMLPATL | A0201(27.20) | B0801(243.43) | B1501(110.28) |
| VLVGVVTLY | B1501(259.13) | | | TILIKIEYK | A0301(125.79) | A1101(15.27) | |
| LVLVGIVTL | A0201(336.13) | | | LAIPPTAGV | A0201(185.34) | | |
| VMLSVHYAI | A0201(18.48) | | | TLTASLVML | A0201(201.93) | | |
| MWKQITPEL | A2402(402.87) | B0801(170.19) | | ILRHPGFTL | B0702(239.17) | B0801(396.27) | B1501(253.23) |
| TKKVRTNAA | B0801(163.27) | | | QPMEHRYSW | B0702(166.79) | | |
| LSRKEFDLY | B1501(225.52) | | | SMEKYQLAV | A0201(30.23) | | |
| VLSLVENWL | A0201(321.09) | | | CVMSSSALL | A0201(264.46) | | |
| LTDAIALGI | A0201(243.60) | | | AAFKVRPTF | B1501(199.54) | | |
| FIKKVRTNA | B0801(140.01) | | | VLNLVENWL | A0201(500.02) | | |
| SPGTSGSPI | B0702(20.23) | | | TLSLDYAWK | A0301(293.15) | A1101(84.76) | |
| TQDDMQNPK | A1101(172.92) | | | ALWYMWQVK | A0301(48.96) | A1101(70.13) | |
| LMAAVLAYT | A0201(10.58) | | | HQWMTTEDM | B1501(133.11) | | |
| ASAIFKLTY | A1101(237.81) | | | RMVLAFITF | B1501(26.86) | | |
| RMLINRFTM | B0801(463.87) | B1501(223.82) | | TTNIWLRLR | A1101(100.74) | | |
| SLSLDYAWK | A0301(227.53) | A1101(67.79) | | LIVSGVFPY | A1101(246.43) | B1501(65.38) | |
| MLLNRFTMA | A0201(43.98) | B0801(28.62) | | WAKNIHTAI | B0801(88.91) | | |
| LLFKTGDGV | A0201(24.62) | | | SLKDTPKRK | A0301(411.54) | | |
| LQRKYGGML | B1501(142.29) | | | TQHGTILVK | A1101(81.30) | | |

FIG. 48-26

| Peptide | HLA (nM) | HLA (nM) | HLA (nM) | Peptide | HLA (nM) | HLA (nM) | HLA (nM) |
|---|---|---|---|---|---|---|---|
| TVVEHLERL | A0201(498.99) | | | RAVFFVLMM | B1501(217.34) | | |
| MLWMAEVPL | A0201(25.94) | B0801(217.38) | B1501(481.97) | VVLPENLEY | A1101(314.21) | B1501(292.12) | |
| KMGMGTTYL | A0201(49.55) | B1501(231.47) | | TTLDILTEI | A0201(73.72) | | |
| FSSGLFSGK | A0301(273.70) | A1101(24.60) | | FMNEDHWFS | A0201(15.43) | | |
| MVLKIVRSM | B0801(220.88) | B1501(217.39) | | MLWMAEIPL | A0201(20.76) | B0801(273.98) | |
| KLQLKGMSY | B1501(254.58) | | | RVLDWLKKY | A1101(316.71) | | |
| LTLRGMSYV | A0201(101.74) | | | LIFILLAAV | A0201(39.99) | | |
| LARWGTFKK | A0301(241.83) | A1101(79.63) | | ITLFLGFTV | A0201(125.96) | B1501(339.91) | |
| KPKGKVVDL | B0702(342.99) | | | LMMATIGIA | A0201(41.69) | | |
| LTALNDMGK | A0301(369.06) | A1101(25.96) | | TVIEHLERL | A0201(144.45) | | |
| LMLVALLGA | A0201(51.19) | | | NPITLTAAL | B0702(37.95) | | |
| MMTTIGIVL | A0201(121.62) | B1501(358.54) | | FLIMVIPTV | A0201(3.84) | | |
| KTMAMVLSV | A0201(13.66) | A1101(314.18) | | SLLKNDVPL | A0201(121.79) | | |
| ELKGMSYAM | B0801(175.13) | | | VIYDSKFEK | A0301(27.26) | A1101(7.73) | |
| PMFAVGLLF | B1501(242.64) | | | TILELTDAL | A0201(210.56) | | |
| KSEFQIYKK | A1101(47.84) | | | LQSGVDVFF | B1501(93.17) | | |
| ASAWTLYAV | A0201(35.38) | | | ILLVAVSFL | A0201(55.18) | | |
| LLGRSQVGV | A0201(56.16) | | | IMAAILAHT | A0201(27.25) | | |
| VENHHHASM | B1501(459.62) | | | VVVGDIIGV | A0201(115.31) | | |
| LLGKTQVGV | A0201(35.24) | | | HSWEDIPYL | A0201(155.04) | | |
| TMPETILEL | A0201(31.00) | | | KLPDYGELT | A0201(339.39) | | |
| SLGILCASI | A0201(303.55) | | | TPQAPTSEI | B0702(59.71) | | |
| IQGSNWIQK | A1101(233.22) | | | GTVMDIISR | A1101(218.97) | | |
| YVILAILTI | A0201(113.18) | | | WLGARFLEF | B0801(121.98) | B1501(54.33) | |
| LMTGILAVF | B1501(79.89) | | | WLVHKQWFL | A0201(8.86) | | |
| KQSATLRKY | B1501(115.25) | | | RQIQKVETW | B1501(413.47) | | |
| TFKMRPMFA | B0801(59.89) | | | LMMILPATL | A0201(32.49) | B1501(362.00) | |
| GIFPYSIPA | A0201(15.70) | | | IVVGDVIGV | A0201(171.45) | | |
| RLASAILNA | A0201(25.70) | | | TQGSNWIQK | A1101(75.19) | | |

FIG. 48-27

| Peptide | HLA (nM) | HLA (nM) | HLA (nM) | Peptide | HLA (nM) | HLA (nM) |
|---|---|---|---|---|---|---|
| VIIMVGAAM | B1501(184.47) | | | AIKRRLRTL | B0801(38.56) | |
| ILNRRRRSV | B0801(45.48) | | | KLREMYTQL | A0201(127.99) | B1501(496.32) |
| SPAATKKAA | B0702(81.46) | | | TLAVFLLLI | A0201(76.80) | |
| LTNTTTDSR | A1101(443.89) | | | MLMTGTLAV | A0201(3.02) | B0801(366.28) | B1501(147.66) |
| TVLELTDAI | A0201(393.63) | | | KMDIGVPLL | A0201(29.50) | |
| QLGQVMLLV | A0201(169.59) | | | MIAGVLFMF | B1501(485.87) | |
| AAAWYLWEV | A0201(6.66) | | | LLGVGLAMA | A0201(150.73) | |
| LQRKYGGAL | B0702(266.87) | B0801(165.70) | | VLNPYMPAV | A0201(4.22) | |
| FLIDGPDTS | A0201(43.16) | | | TYSDPLALK | A1101(102.63) | |
| KPTEQVDTL | B0702(477.63) | | | RLQSGVDVF | B1501(67.32) | |
| IPKSFAGPV | B0702(62.00) | | | CTGPFKLEK | A1101(25.88) | |
| TVIAFFLAH | A1101(150.02) | | | KLFMAFVAF | A2402(467.26) | B1501(16.19) |
| TMLLMLMPT | A0201(192.55) | | | GMFTTNIWM | A0201(189.91) | B1501(112.05) |
| TLRGMSYVM | B0702(455.17) | B0801(229.42) | | WTMKILIGV | A0201(12.28) | |
| IWPKSHTLW | A2402(146.80) | | B1501(99.34) | IINRRKRSV | B0801(150.72) | |
| NGRKRSTMT | B0801(469.15) | | | LLSLVAHYA | A0201(47.16) | |
| TLALALTFI | A0201(30.02) | | | LTLKGISYV | A0201(37.48) | |
| RFATALSAL | B0702(376.88) | | | LLRKLTSK | A0301(65.94) | A1101(233.06) |
| MSAAVKDNR | A1101(129.50) | | | TIIGRRLQR | A1101(221.75) | |
| FMGHLKCRL | A0201(447.68) | B0801(339.73) | | SMSFSCIAI | A0201(82.05) | B1501(254.95) |
| ATFTTRLLS | A1101(412.33) | | | SSVNTISKM | B1501(133.20) | |
| IQISGGTSI | A0201(342.98) | B1501(29.26) | | MIRILIGIL | B0801(76.48) | |
| LTLSLITEM | B1501(375.99) | | | FIDGLSLGL | A0201(25.87) | |
| HPGFTVTAL | B0702(38.55) | | | LTWIGLNSK | A0301(236.89) | A1101(28.71) |
| LLLNRFTMT | A0201(297.73) | B0801(339.73) | | LGKCGSCVY | B1501(181.46) | |
| ALFSGVSWV | A0201(5.34) | | | LNRRRRSTM | B0801(24.14) | |
| TLALSLTFI | A0201(37.78) | | | LQRTEATQL | B1501(147.58) | |
| MAMLCIPNV | A0201(45.46) | | | MILMKMEKK | A0301(126.97) | A1101(31.59) |
| GTIVVRVQY | A1101(220.94) | | | SQVNPLTLI | A0201(106.97) | B1501(305.07) |

FIG. 48-28

| Peptide | HLA (nM) | HLA (nM) | HLA (nM) | Peptide | HLA (nM) | HLA (nM) | HLA (nM) |
|---|---|---|---|---|---|---|---|
| KSKAISVLR | A1101(114.24) | | | LVAGGLLTV | A0201(39.80) | | |
| IAGVFLTFV | A0201(404.08) | | | RTVFFILMM | B1501(376.57) | | |
| GLVSILASS | A0201(415.09) | | | CIAVGLVTL | A0201(473.80) | | |
| QLAVTIMAI | A0201(126.29) | | | SPKRLATAI | B0702(38.74) | B0801(124.57) | |
| ALLATSIFK | A0301(22.63) | A1101(11.33) | | VILLNAWKV | A0201(137.59) | | |
| IPMVTQIAM | B0702(14.35) | | | IVFKMSPGY | A0301(137.51) | A1101(122.34) | B1501(71.58) |
| TWPKSHTLW | A2402(325.10) | | | SQGETLGEK | A1101(253.70) | | |
| WFLNLPLPW | A2402(183.12) | | | IVTAETQNF | B1501(293.29) | | |
| ITANPVVTK | A0301(75.19) | A1101(7.38) | | EMILMEMKK | A1101(279.60) | | |
| YVMCTGSFK | A0301(75.15) | A1101(9.64) | | LLAKAIFKL | A0201(8.52) | | |
| KLAEAIFKL | A0201(2.95) | | | AVMDIISRK | A0301(55.49) | A1101(5.82) | |
| GQLKLSWFK | A0301(95.69) | A1101(32.26) | | RLLGNENYL | A0201(120.04) | | |
| WLVHRQWFL | A0201(8.34) | B0801(120.87) | | VMCTGPFKL | A0201(82.01) | | |
| YWPRSHTLW | A2402(64.39) | | | AGLAFSLIK | A1101(194.74) | | |
| SNMLNIMNR | A1101(284.67) | | | PTLDIELQK | A1101(220.59) | | |
| VVVGDVIGV | A0201(193.03) | | | RARNRVSTV | B0702(55.74) | B0801(42.31) | |
| RLGYILEEI | A0201(45.02) | | | FMQGKGIGK | A0301(448.17) | | |
| AVVSVSPLL | A0201(305.15) | | | RLKEKQDAF | B0801(429.28) | B1501(70.92) | |
| GLFPISIPI | A0201(6.94) | | | YAWKTMAMV | A0201(38.60) | | |
| MIAGVLFTF | A0201(262.65) | B1501(178.41) | | NVKKDLISY | B1501(284.90) | | |
| YMTSMKRFK | A0301(343.55) | A1101(222.98) | | LLLLGLMIL | A0201(218.82) | | |
| TQVRNLIGK | A1101(37.99) | | | SVGKALHQV | A0201(169.84) | | |
| RDMARTLIM | B0801(467.45) | | | RSTPFNMLK | A0301(78.15) | A1101(8.33) | |
| TSEVHWNCK | A1101(440.02) | | | NRRKRSVTM | B0801(13.70) | | |
| ALLIVSGVF | B1501(400.53) | | | GGVFTSIGK | A1101(365.99) | | |
| MCTKTFVLK | A1101(395.82) | | | RPTPTGTVM | B0702(4.06) | | |
| DLMEFIDGL | A0201(176.57) | | | SPGYVLGVF | B0702(118.19) | | |
| LARASFIEV | B0801(366.93) | | | IVLEFFMMV | A0201(23.17) | | |
| SALTLHWFR | A1101(55.37) | | | LTMAWRTIM | B1501(283.49) | | |

FIG. 48-29

| Peptide | HLA (nM) | HLA (nM) | HLA (nM) | Peptide | HLA (nM) | HLA (nM) | HLA (nM) |
|---|---|---|---|---|---|---|---|
| TLFGPEREK | A0301(146.68) | A1101(187.58) | | VVYDAKFEK | A0301(110.03) | A1101(10.69) | |
| KLIHQVFGT | A0201(28.23) | | | QPHWIAASI | B0702(180.47) | | |
| ALTLATGPV | A0201(303.08) | | | TFLFFMQGK | A1101(68.63) | | |
| LIAMDLGEF | B1501(125.84) | | | MIRILIGFL | B0801(111.17) | | |
| NQRKKARST | B0801(308.17) | | | LPIRYQTTA | B0702(346.31) | | |
| IVGVLFTFV | A0201(267.48) | | | WIIRILIGL | A0201(72.43) | | |
| ALKINWYKK | A0301(225.86) | A1101(295.44) | | ILAGFMAYM | A0201(17.14) | B1501(294.57) | |
| TVMALFLAH | A1101(118.32) | | | KVAAEGINY | A0301(356.41) | A1101(82.55) | B1501(193.13) |
| CLRRKVTRK | A0301(166.04) | | | MCLNTFVLK | A1101(81.76) | | |
| ILGKTQVGV | A0201(61.63) | | | MLLNRFTTR | A0301(314.60) | A1101(461.03) | |
| AVLMLVAHY | A1101(327.96) | B1501(138.69) | | GVTATITPR | A1101(122.26) | | |
| ALCEVLTLA | A0201(20.91) | | | TLLCLIPTV | A0201(5.33) | | |
| TLILAPTRV | A0201(108.46) | | | LPWLPGADI | B0702(112.81) | | |
| AISVLRGFR | A1101(148.83) | | | TIMDLHPGA | A0201(96.65) | | |
| KPWDVLPTV | B0702(497.58) | | | KTFDTEYPK | A0301(26.17) | A1101(3.35) | |
| MILMRMKKK | A0301(137.39) | A1101(83.46) | | WMTTEDMLA | A0201(263.48) | | |
| GLNPTAIFL | A0201(28.61) | | | GLLCLTLFI | A0201(16.23) | | |
| HAVSRGTAK | A1101(294.25) | | | ILLKATLLA | A0201(83.86) | | |
| AVRNWLARV | A0201(154.54) | | | LMSGRGVGK | A0301(100.65) | A1101(200.04) | |
| CWCNSTSTW | A2402(160.64) | | | IGMAMTTVF | B1501(30.95) | | |
| LPSIVREAL | B0702(16.77) | | | LATLRKLCI | B0801(312.86) | | |
| NSRSTSLSM | B0702(427.75) | B1501(73.75) | | LPAIIREAI | B0702(39.82) | | |
| YILEDIDRK | A1101(385.88) | | | SSKPEFCIK | A1101(218.85) | | |
| LLFKTENGI | A0201(69.65) | | | RILAKAIFK | A0301(18.86) | A1101(10.89) | |
| IAVSTANIF | B1501(60.49) | | | NTYKRSGIM | B0801(288.36) | | |
| ITFLRVLSI | B0801(184.87) | | | MVISCVPNA | A0201(142.08) | | |
| CTLPPLRFR | A1101(135.47) | | | IMQAGRRSL | B0702(297.37) | B0801(315.50) | B1501(474.46) |
| FWYFWQKK | A0301(132.48) | A1101(26.21) | | MFTTNIWMK | A1101(150.17) | | |
| KIVQYENLK | A0301(216.69) | A1101(62.58) | | KILAKAIFK | A0301(17.67) | A1101(9.87) | |

FIG. 48-30

| Peptide | HLA (nM) | HLA (nM) | HLA (nM) | Peptide | HLA (nM) | HLA (nM) | HLA (nM) |
|---|---|---|---|---|---|---|---|
| ITLLSLTFI | A0201(440.69) | | | NRRRRSVGM | B0801(29.79) | | |
| LLVLCVTQV | A0201(49.77) | | | IMKDGRILV | A0201(249.04) | | |
| AVKSEHTGK | A1101(224.25) | | | QLKLSWFKK | A0301(108.31) | A1101(190.16) | |
| IIMMIPTVV | A0201(88.74) | | | LLFKTATGI | A0201(22.67) | B1501(305.81) | |
| IQTSGGTSI | B1501(154.52) | | | RLGYILREV | A0201(113.99) | | |
| HWFSRGNSL | B0801(66.06) | | | TTKTPTWNR | A1101(201.30) | | |
| VMRGKFGKK | A0301(163.58) | | | LMTGTLVVF | B1501(26.47) | | |
| GPMKLVMAF | B0702(35.43) | | | ALALGMMIL | A0201(329.15) | | |
| RSADLELEK | A0301(238.85) | A1101(19.89) | | NPLTLTAAV | B0702(340.47) | | |
| YMWLGARYL | A0201(16.36) | | | LVVAITFCA | A0201(201.17) | | |
| ILLVAVSFV | A0201(16.04) | | | SLPLFIFSL | A0201(73.10) | | |
| RSQVGVGVF | B1501(171.38) | | | MFKKRNLTI | B0801(6.93) | | |
| SLMCSNTIF | B1501(9.63) | | | VMAVGMVSI | A0201(90.34) | | |
| ALKRRLRTL | B0801(25.05) | | | MISRMLINR | A0301(153.97) | A1101(23.11) | |
| MMAAILAYT | A0201(6.22) | | | HTWQKQTQR | A1101(123.72) | | |
| SLAAIANQA | A0201(68.01) | | | TLAKAIFKL | A0201(13.19) | | |
| IGMAMTTTF | B1501(31.43) | B0801(76.38) | | TPKAKRGTV | B0702(107.54) | B0801(153.59) | |
| TVFFILMML | A0201(249.03) | | | GLFTSLGKA | A0201(304.90) | | |
| LLLLTLLAT | A0201(370.70) | | | AMLLVAVSF | B1501(144.84) | | |
| MLLVHYAII | A0201(101.70) | A1101(320.05) | | RITQWLETK | A0301(223.04) | A1101(52.30) | |
| SIILEFFLI | A0201(119.20) | | | FLDLPLPWL | A0201(10.39) | | |
| CPTQGEAAL | B0702(38.78) | | | KLTLKGMSY | A0301(485.35) | B1501(243.34) | |
| YQLAVTIMA | A0201(43.03) | | | LARWSSFKK | A0301(162.63) | A1101(72.17) | |
| VILAILTII | A0201(205.35) | | | SQKNGSWKL | B1501(363.05) | | |
| RMLNILNRR | A0301(391.00) | A1101(80.91) | | FQPESPSKL | A0201(289.63) | | |
| TYQLWTALI | A2402(24.78) | | | YQLAVTVMA | A0201(43.28) | | |
| ITVSGLYPL | A0201(106.61) | | | IYGAAFSGV | A2402(398.03) | | |
| ILALFLAHY | B1501(251.93) | | | LLLITHYAI | A0201(56.02) | B0801(405.03) | |
| ALKLSWFKK | A0301(54.57) | | | VSTVSQLAK | A0301(386.68) | A1101(39.75) | |

FIG. 48-31

| Peptide | HLA (nM) | HLA (nM) | Peptide | HLA (nM) | HLA (nM) |
|---|---|---|---|---|---|
| LTAALLSLV | A0201(32.74) | | RLGYILEDI | A0201(342.05) | |
| TPQASTTEA | B0702(295.96) | | FMTATPPGS | A0201(331.42) | |
| ISSTPFAEY | B1501(139.94) | | VLCAGQLFL | A0201(70.12) | |
| KMVHQIFGS | A0201(220.87) | | LISGKGIGK | A0301(428.23) | A1101(226.38) |
| LLVAISFVT | A0201(224.49) | | SLTCSNTMF | B1501(54.48) | |
| ALKGLPIRY | A0301(262.43) | | MMLKLLTDF | B1501(20.64) | |
| QLIYVILAI | A0201(77.46) | | FLAHYVGTS | A0201(97.09) | |
| KLNDWDFVV | A0201(3.26) | | NQAAILMGL | A0201(29.86) | |
| RNTPFNMLK | A1101(154.75) | | PTLDIELLK | A1101(117.45) | |
| VTFKNPHAK | A0301(73.47) | A1101(8.50) | LAYTIGTTY | B1501(38.06) | |
| YAMCLNTFV | A0201(10.73) | | QLANAIFKL | A0201(15.52) | |
| NQAAVLMGL | A0201(34.71) | | SLIGLTARA | A0201(85.26) | |
| YILRDISKI | A0201(125.03) | | TFIKSTMPL | B0801(460.29) | |
| YAMCSNAFV | A0201(12.37) | | GPLIAGGML | B0702(80.54) | |
| VILAGPIPV | A0201(23.90) | | LLLTSSRQK | A0301(62.10) | A1101(216.81) |
| HMIVSKNEK | A0301(287.20) | A1101(113.87) | VMCTGSFKL | A0201(71.97) | |
| TLLVAVSFV | A0201(21.10) | | FTVIALFLA | A0201(107.38) | |
| AVTLIPLCR | A1101(273.00) | | SLSVSLVLV | A0201(30.13) | |
| TVWNRVWIR | A1101(164.94) | | AVVSVSPLI | A0201(474.83) | |
| HTWQKQTRR | A1101(139.20) | | KLRDSYTQM | B1501(39.87) | |
| GIQRTVFFI | A0201(293.10) | | IQRVETWVL | B1501(408.29) | |
| KPIDDRFAT | B0702(170.11) | | AVLTYNGKR | A1101(194.02) | |
| SALLWMANV | A0201(116.03) | | KMEKKTWLV | A0201(41.10) | |
| TLRKYCVEA | B0801(378.43) | | MSAAIKDER | A1101(159.66) | |
| AMCSGTFVL | A0201(29.71) | | GVLESQMLI | A0201(335.87) | |
| KMVRKMEKY | B1501(207.68) | | FQPHQLWTT | A0201(240.67) | |
| SYKDREWCF | A2402(43.44) | | KVSCTILAA | A0201(432.83) | |
| KSRLNALGK | A0301(207.82) | A1101(143.50) | CVTTMARNK | A1101(144.65) | |
| IMKDGRTLV | A0201(267.97) | | TTANWLWAL | A0201(48.16) | |

FIG. 48-32

| Peptide | HLA (nM) | HLA (nM) | HLA (nM) | Peptide | HLA (nM) | HLA (nM) | HLA (nM) |
|---|---|---|---|---|---|---|---|
| MLLMLLPTT | A0201(142.52) | | | LTWNDLTRL | A0201(460.11) | | |
| FQADSPKRL | A0201(408.01) | | | IPKMYGGPI | B0702(13.45) | B0801(137.58) | |
| GILKRWGQL | B0801(476.61) | | | IMLTPTVMA | A0201(335.07) | | |
| MDLERRYVL | B0801(38.21) | | | FLIDGPETT | A0201(9.83) | | |
| MVGQTGIQR | A1101(265.05) | | | LVMLSVHYA | A0201(74.08) | | |
| LMLLALIAV | A0201(15.71) | | | LTAALFLLV | A0201(76.33) | | |
| LTIMTGDIK | A1101(138.68) | | | KFWNTTIAV | A0201(400.10) | A1101(34.60) | |
| ITLDILTEI | A0201(35.67) | | | HMIVSIQEK | A0301(80.62) | | |
| MASSALLWM | B1501(415.70) | | | MPVTAASAA | B0702(41.32) | | |
| IIMDEAHFT | A0201(151.86) | | | WTMKIGLGV | A0201(103.79) | | |
| MLRTRVGTK | A0301(133.45) | | | VMVMVGATM | B1501(56.79) | | |
| MSYTMCSGK | A0301(16.86) | A1101(6.81) | | LLATSIFKL | A0201(8.17) | | |
| FTMGILCLA | A0201(8.35) | | | GVQRTVFFV | A0201(71.14) | | |
| EMCEDTVTY | B1501(290.72) | | | SSWEDVPYL | A0201(141.20) | | |
| SLSVTLVLV | A0201(26.10) | | | RPMFAVGLL | B0702(20.75) | | |
| QPKPGTQMI | B0702(452.38) | | | NLLFTGHLK | A0301(153.84) | A1101(60.81) | |
| FAVGLLLRK | A1101(226.82) | | | HMIAGVFFM | A0201(12.65) | | |
| ILARWGSFK | A0301(14.59) | A1101(17.88) | | TSIGLLCVM | B1501(491.37) | B1501(62.62) | |
| LAIPITMTL | A0201(466.10) | | | RFVCRHSMV | B0801(326.00) | | |
| GTLALSLTF | B1501(66.08) | | | GLLCLTLFV | A0201(7.36) | | |
| RKKARSTPF | B0801(128.91) | B1501(121.15) | | ILLKMVTHF | B1501(20.92) | | |
| YILRDVSKK | A0301(335.27) | A1101(139.33) | | VLVGVITLY | B1501(280.73) | | |
| VVVSFVTLI | A0201(270.93) | | | LAAVTGGIF | B1501(86.40) | | |
| NYTDRKWCF | A2402(249.09) | | | VTYGTCTTM | B1501(274.32) | | |
| VILALLTII | A0201(316.72) | | | GGVFTSMGK | A1101(249.47) | | |
| MGLDKGWPI | B0801(312.26) | | | LMLIALLGA | A0201(68.08) | | |
| MTQKARDAL | B0702(224.31) | | | TQVPFCSHH | B1501(362.18) | | |
| SLTAIANQA | A0201(395.48) | | | RTLAKEGIK | A0301(403.09) | A1101(100.50) | |
| MSAAIKDSK | A1101(18.55) | | | ATWATNIQV | A0201(152.83) | | |

FIG. 48-33

| Peptide | HLA (nM) | HLA (nM) | HLA (nM) | Peptide | HLA (nM) | HLA (nM) | HLA (nM) |
|---|---|---|---|---|---|---|---|
| SQIGAGVYK | A0301(308.32) | A1101(11.56) | | KPVDDRFAT | B0702(184.83) | | |
| NRRRRTAGI | B0801(45.61) | | | KLSMGLIAI | A0201(23.48) | | |
| FSTGLFSGK | A1101(56.04) | | | IAGALFTFV | A0201(330.03) | | |
| GLLFIILTV | A0201(19.42) | | | FMMVLLIPE | A0201(138.94) | | |
| SLLKNDIPM | A0201(413.80) | B1501(181.37) | | RLIGNENYL | A0201(144.06) | | |
| KARNTPFNM | B1501(403.92) | | | MVMAFIAFL | A0201(4.94) | B0801(265.02) | B1501(358.49) |
| LALGFFLRK | A0301(158.03) | A1101(18.00) | | LLMLVPTAL | A0201(49.91) | B0801(378.22) | |
| KLITQFETY | B1501(46.29) | | | YLAGAGLLF | B1501(38.67) | | |
| RTVGVIVML | A0201(496.35) | | | LVQIENLEY | B1501(453.76) | | |
| TFIRSTMSL | A2402(441.39) | | | LTAAVLLLV | A0201(37.65) | | |
| EVKNCHWPK | A1101(453.43) | | | KSGAIKVLK | A0301(286.65) | A1101(29.04) | |
| TIMAVFFVV | A0201(9.21) | | | HILSENEAK | A1101(152.14) | | |
| VPNYNLIVM | B0702(45.74) | | | RLEPSWASV | A0201(91.74) | | |
| LNRRRRTAG | B0801(439.96) | | | ATYGWNLVK | A0301(13.46) | A1101(3.61) | |
| TVFFVLMML | A0201(306.37) | | | MPGIFQTTM | B0702(73.03) | | |
| IQRVETWAL | B1501(257.75) | B1501(104.39) | | RLTSRETAL | B0702(336.96) | B0801(306.50) | |
| QLWATLLSL | A0201(36.40) | | | KLRDSHTQM | B0702(254.44) | B1501(33.02) | |
| VMILPAALA | A0201(349.94) | | | GVVTRSGTY | B1501(496.57) | | |
| LILAVISLL | A0201(132.52) | | | ILLENGMKF | B1501(178.18) | | |
| GVFPYSIPA | A0201(20.48) | | | NYKERMVTF | A2402(229.56) | | |
| MMATIGIAL | A0201(19.35) | | | ALGRSEFQI | A0201(223.07) | | |
| ALIFILLTA | A0201(60.27) | | | KLKEKQDVF | B1501(141.84) | | |
| IATFKIQPF | B1501(312.40) | | | KPSGSASSM | B0702(8.39) | | |
| WMDLLRALI | A0201(171.13) | | | VMAFIAFLR | A0301(280.80) | A1101(54.74) | |
| LNRRRRSAG | B0801(398.47) | | | LQRKHGGSL | B0702(86.16) | B0801(89.25) | B1501(46.65) |
| RPARNGTVM | B0702(3.54) | | | LLFKTSAGV | A0201(7.43) | | |
| LMMRTTWAL | A0201(4.23) | B0801(88.43) | | LAKRFSRGL | B0801(280.77) | | |
| YSMCTGKFK | A0301(362.63) | A1101(33.23) | | GIALGLMTL | A0201(350.34) | | |
| KSKAINILR | A1101(103.01) | | | GLLVISGVF | B1501(461.98) | | |

FIG. 48-34

| Peptide | HLA (nM) | HLA (nM) | HLA (nM) | Peptide | HLA (nM) | HLA (nM) | HLA (nM) |
|---|---|---|---|---|---|---|---|
| LFVWYFWQK | A1101(186.53) | | | MVLLQMEEK | A0301(357.87) | A1101(23.86) | |
| KQDAFCDSK | A1101(284.21) | | | SFGKMVHQI | A2402(132.69) | | |
| STYGWNIVK | A0301(13.74) | A1101(3.20) | | MIAGALFTF | A0201(404.58) | B1501(74.19) | |
| AQMWSLMYF | A0201(88.83) | A2402(168.86) | B1501(8.96) | LTIMTGEIK | A1101(130.54) | | |
| SMTCIAVGL | A0201(50.32) | | | ILLVTVSFV | A0201(21.45) | | |
| RIEAKEGLK | A0301(476.91) | A1101(389.19) | | GLLTVCYVL | A0201(38.59) | | |
| GMLIACYVI | A0201(147.44) | | | STYGWNLVR | A0301(109.87) | A1101(9.10) | |
| VFKKRNLTI | B0801(75.20) | | | PMFLITENK | A0301(391.09) | A1101(164.79) | |
| IAIAVASSL | B1501(410.11) | | | TTFVTPMLR | A0301(218.38) | A1101(7.52) | |
| LPVYLMTLM | B0702(203.56) | | | IPKNLAGPV | B0702(80.72) | | |
| TFVKTTFSL | A2402(254.77) | | | AMLLVHYAI | A0201(67.97) | | |
| IALGLMALK | A0301(291.95) | A1101(24.53) | | TPRGAVMDI | B0702(246.83) | | |
| KWKNRLNAL | B0801(146.35) | | | HWFSRENSF | A2402(183.48) | | |
| TMMAAILAY | A0301(62.32) | A1101(34.21) | B1501(10.68) | FTMGVLCLA | A0201(11.90) | | |
| SLAMLLVHY | B1501(59.83) | | | IPRDLMEFI | B0702(414.55) | | |
| MFKMSPGYV | B0801(415.60) | | | VFTTNIWLK | A1101(189.97) | | |
| YVGTSLTQK | A0301(382.17) | A1101(41.67) | | AVLMYQGKR | A1101(253.22) | | |
| TSRMLLNRF | B1501(300.70) | | | CAKFLCSGK | A1101(333.02) | | |
| ALFLLVAHY | B1501(121.77) | | | VFSTNIWLK | A1101(74.84) | | |
| MILLTGGAM | B1501(195.26) | | | GILKRWGTI | B0801(398.91) | | |
| QIFGTAYGV | A0201(36.95) | | | LITGNMSFK | A0301(167.87) | A1101(29.64) | |
| TVMAAILAY | A0301(250.79) | A1101(26.84) | B1501(49.90) | LAVSGVYPL | B1501(413.45) | | |
| FTVMALFLA | A0201(71.96) | | | VATTFITPM | B1501(330.59) | | |
| SYAMCLNAF | A2402(53.87) | | | CPTQGEATL | B0702(148.92) | | |
| MGMGVTYLA | A0201(482.47) | | | QPKPGTRVV | B0702(174.16) | | |
| WATLLSMTF | B1501(242.40) | | | ALLAKSIFK | A0301(27.88) | A1101(20.39) | |
| MTFIRTTFS | A1101(373.95) | | | IQNSGGTSI | B1501(44.36) | | |
| RLNDWDFVV | A0201(4.41) | | | LLMRTTWAL | A0201(4.46) | B0801(132.64) | B1501(280.13) |
| LLMATIGVV | A0201(15.34) | | | LLLIAHYA | A0201(73.48) | | |

FIG. 48-35

| Peptide | HLA (nM) | HLA (nM) | HLA (nM) | Peptide | HLA (nM) | HLA (nM) | HLA (nM) |
|---|---|---|---|---|---|---|---|
| QLWVTLLSL | A0201(135.26) | | | KPEFCIKVL | B0702(223.59) | | |
| LLYLIPTVM | B1501(343.07) | | | LAVFLLLTM | B1501(365.60) | | |
| TPQAPTTEI | B0702(92.68) | | | LIMVIPTVM | B1501(431.04) | | |
| GLLCVSIMI | A0201(37.54) | | | RTIMAVFFV | A0201(26.33) | A1101(284.52) | |
| LTIPPTAGI | A0201(439.82) | | | VLTGGVTLF | B1501(212.70) | | |
| FRKRRLTIM | B0801(15.67) | | | YFQRVLIFI | A2402(102.01) | | |
| LLLMRTSWA | B0801(261.60) | | | AQMWQLMYF | A0201(169.20) | A2402(322.91) | B1501(26.98) |
| MGVPSLPLF | B1501(302.78) | | | FLLLTLGQL | A0201(85.14) | | |
| WFVERNMVA | B0801(207.12) | | | SMGLIAIAV | A0201(81.45) | | |
| KTFDTEYTK | A0301(37.45) | A1101(4.65) | | WLPMTVAAM | B1501(430.69) | | |
| FTDPSSIAA | A0201(342.48) | | | SLIQKVVIF | B1501(65.55) | | |
| MLMTGILAV | A0201(2.70) | B0801(388.80) | B1501(317.65) | KITQWLENK | A0301(234.99) | A1101(49.70) | |
| TVGTTHFQR | A1101(55.72) | | | NPTTLTASL | B0702(46.02) | | |
| TLWYMWQVK | A0301(37.22) | A1101(32.10) | | TLLVALSFV | A0201(13.93) | | |
| SLGKAVHQI | A0201(56.07) | | | VSSWEEVPY | B1501(455.19) | | |
| FLLIMGQLT | A0201(463.08) | | | LQRRHGGSL | B0702(124.05) | B0801(97.12) | B1501(94.93) |
| KSALKDGSK | A1101(203.61) | A1101(11.34) | | HMIAGVLFT | A0201(82.46) | | |
| TLLSLTFIK | A0301(41.13) | | | GLLSGQGPM | B1501(164.78) | | |
| MGKLVHQVF | B0801(485.89) | | | VLLKTALLI | A0201(126.39) | | |
| ALAPPASDL | A0201(404.24) | | | VIFILLMLV | A0201(94.45) | | |
| SKIPGGNMY | B1501(472.38) | | | MIVGVLFTF | B1501(241.17) | | |
| RLPTFMTQK | A0301(84.66) | A1101(60.02) | | FTVTAFFLA | A0201(71.94) | | |
| GILCVSIMI | A0201(481.25) | | | RKKAKTTPF | B0801(286.00) | B1501(134.54) | |
| MMILPATLA | A0201(176.61) | | | AVLLLVTHY | B1501(391.31) | | |
| RSRWSRRML | B1501(472.38) | | | QVMLLILCV | A0201(413.81) | | |
| KLRDSHTQV | A0201(109.19) | | | RKKAKNTPF | B0801(429.45) | B1501(494.26) | |
| KAIKILIGF | B1501(142.98) | | | LQRRYGGSL | B0801(161.35) | B1501(91.93) | |
| LVRVGRERL | B0702(271.19) | | | LSIPATLFV | A0201(183.33) | | |
| | | | | GIVTLYLGV | A0201(216.25) | | |

FIG. 48-36

| Peptide | HLA (nM) | HLA (nM) | HLA (nM) | Peptide | HLA (nM) | HLA (nM) | HLA (nM) |
|---|---|---|---|---|---|---|---|
| AGLAFSIMK | A1101(99.65) | | | ISYGGGWRF | B1501(148.72) | | |
| TLYAVATTF | B1501(42.24) | | | TPEVRNSTF | B0702(187.48) | | |
| YAWRTMAMV | A0201(68.20) | | | MAMTTTFSI | A0201(46.58) | B0801(293.38) | B1501(128.72) |
| LVIMDEAHF | B1501(82.63) | | | KLRDSYTQA | A0201(347.50) | | |
| WGKAKILST | B0801(145.32) | | | MLVRNPLSR | A0301(348.80) | A1101(435.83) | |
| YGMEIRPLK | A1101(207.55) | | | MLKRERNRV | B0801(70.36) | | |
| TLAVFFLLI | A0201(153.37) | | | TMAWRTIMA | A0201(204.62) | | |
| TMSLVMAWR | A1101(291.85) | | | VSSVNTISK | A0301(217.89) | A1101(21.16) | |
| AQVRNLIGK | A1101(63.56) | | | LAHYVGTSL | B0702(169.74) | B1501(245.15) | |
| NSRSASLSM | B0702(276.17) | B1501(88.97) | | GIVTLYLGV | A0201(216.25) | | |
| TPQASTAEA | B0702(313.42) | | | ISYGGGWRF | B1501(148.72) | | |
| MPVTHSSAA | B0702(8.88) | B0801(437.31) | | TPEVRNSTF | B0702(187.48) | | |
| MLNTMNRRK | A0301(44.83) | A1101(72.07) | | MAMTTTFSI | A0201(46.58) | B0801(293.38) | B1501(128.72) |
| AVSMANIFR | A1101(26.40) | | | KLRDSYTQA | A0201(347.50) | | |
| AMCSNAFVL | A0201(199.69) | | | MLVRNPLSR | A0301(348.80) | A1101(435.83) | |
| AMTAGTFLF | A0201(338.14) | B1501(46.99) | | MLKRERNRV | B0801(70.36) | | |
| TMILMLLPT | A0201(232.07) | | | TMAWRTIMA | A0201(204.62) | | |
| ISEMGANFK | A1101(96.89) | | | VSSVNTISK | A0301(217.89) | A1101(21.16) | |
| RMDLGVPLL | A0201(48.65) | | | LAHYVGTSL | B0702(169.74) | B1501(245.15) | |

FIG. 48-37

| Peptide | HLA (nM) | HLA (nM) | HLA (nM) | Peptide | HLA (nM) | HLA (nM) | HLA (nM) |
|---|---|---|---|---|---|---|---|
| TTMAAILAY | A0301(250.45) | A1101(14.83) | B1501(57.83) | | | | |
| RVRPTFAVG | B0702(486.54) | | | | | | |
| FAGKTVWFV | A0201(14.46) | | | | | | |
| MKMEKKTWL | B0801(322.85) | | | | | | |
| VERLRRMAI | B0801(213.14) | | | | | | |
| GLLCTSIMI | A0201(45.45) | | | | | | |
| STIGKMFEA | A0201(184.08) | | | | | | |
| IGAVTLDFK | A1101(241.59) | | | | | | |
| VTEVRGYTK | A1101(117.41) | | | | | | |
| KQIQKVETW | B1501(474.41) | | | | | | |
| TMKGKSWLV | A0201(146.85) | | | | | | |
| LTYQNKVVK | A0301(232.83) | A1101(57.78) | | | | | |
| KQIQRVETW | B1501(156.24) | | | | | | |
| QTSGTTTIF | B1501(191.52) | | | | | | |
| HWFSRENSL | B0801(92.51) | | | | | | |
| TTLLSLTFV | A0201(99.35) | | | | | | |
| YMGEDGCWY | B1501(261.50) | | | | | | |
| MNRRKRSVT | B0801(201.55) | | | | | | |
| APSTGSASS | B0702(343.35) | | | | | | |
| GGRAYNHAL | B0702(439.50) | | | | | | |
| SNMLSIINR | A1101(242.53) | | | | | | |
| QISGGTSIF | B1501(129.87) | | | | | | |
| QLAYVVIGI | A0201(64.17) | | | | | | |
| GLNSRNTSL | B0801(444.95) | | | | | | |
| MVGANAFDR | A1101(172.49) | | | | | | |
| WGKAKVVTA | B0801(134.94) | | | | | | |
| IMTIDLDPV | A0201(29.05) | | | | | | |
| AVQNWLVRV | A0201(49.09) | | | | | | |
| MKMKKKTWL | B0801(100.47) | | | | | | |

FIG. 48-38

| Peptide | HLA (nM) | HLA (nM) | Peptide | HLA (nM) | HLA (nM) | HLA (nM) |
|---|---|---|---|---|---|---|
| VSSIAQTEK | A1101(57.80) | | | | | |
| MTAGIFLFF | A1101(278.11) | B1501(50.62) | | | | |
| TYLALLAAF | A2402(40.51) | | | | | |
| LWKQVANEL | A2402(374.33) | | | | | |
| GVFSTNIWL | A0201(497.48) | | | | | |
| GVTAMITPR | A1101(119.12) | | | | | |
| TQIAGPWHL | A0201(59.05) | | | | | |
| WSYYCAGLK | A0301(64.46) | A1101(19.37) | | | | |
| YMPSVIERM | A0201(62.32) | | | | | |
| VLCAGQLLL | A0201(193.56) | | | | | |
| VTHSSAAQR | A1101(117.67) | | | | | |
| VAVGLVTLY | B1501(235.33) | | | | | |
| ILWENNIKL | A0201(25.32) | | | | | |
| VSWTGKELK | A1101(49.05) | | | | | |
| KALKLSWFK | A0301(25.82) | A1101(8.04) | | | | |
| ILMLLPTAL | A0201(77.87) | | | | | |
| SVLLWYAQI | A0201(236.19) | | | | | |
| QIDNFSLGV | A0201(148.19) | | | | | |
| KLGEFGKAK | A0301(145.33) | | | | | |
| IFRKKRLTI | B0801(50.61) | | | | | |
| LLVALSFVT | A0201(360.35) | | | | | |
| YILLENDMK | A1101(409.29) | | | | | |
| GLFKLEKEV | A0201(186.37) | | | | | |
| QLWTALVSL | A0201(33.43) | | | | | |
| FLLIMGQL | A0201(266.43) | | | | | |
| ILAENEVKL | A0201(226.18) | | | | | |
| GVFHTMWHV | A0201(12.38) | | | | | |
| ILVALSFV | A0201(12.33) | | | | | |
| WVMKIGIGV | A0201(36.39) | | | | | |

FIG. 48-39

| Peptide | HLA (nM) | HLA (nM) | Peptide | HLA (nM) | HLA (nM) | HLA (nM) |
|---|---|---|---|---|---|---|
| LLALNDMGK | A0301(184.97) | A1101(221.54) | | | | |
| QPHQLWTTL | B0702(83.95) | | | | | |
| TSEVHWNYK | A1101(63.76) | | | | | |
| AIEPGKNPK | A1101(243.91) | | | | | |
| TIPETILEL | A0201(383.23) | | | | | |
| MVLLQMKNK | A0301(333.70) | A1101(51.60) | | | | |
| TKKVRSNAA | B0801(279.40) | | | | | |
| NILTAIQQV | A0201(138.88) | | | | | |
| ALGKSEFQV | A0201(35.05) | | | | | |
| AIKRKLRTL | B0801(85.55) | | | | | |
| MTATPPGSM | B1501(228.85) | | | | | |
| IVMLHTTER | A1101(100.51) | | | | | |
| FTDPSSVAA | A0201(373.00) | | | | | |
| ILNRRRRST | B0801(318.66) | | | | | |
| RQWFFDLPL | A0201(25.45) | B1501(55.68) | | | | |
| VQWDEMAAI | A0201(26.36) | | | | | |
| SVGLIAIAV | A0201(406.82) | | | | | |
| GTAKLRWFV | A0201(416.80) | | | | | |
| QGKCATCVY | B1501(493.58) | | | | | |
| CTGKFKIVK | A1101(47.70) | | | | | |
| VALLRTYCI | B0801(291.65) | | | | | |
| HPGFTLMAA | B0702(434.46) | | | | | |
| KSALRDGSK | A0301(322.43) | A1101(116.53) | | | | |
| ITVGGITLF | B1501(119.89) | | | | | |
| EMILMKMKK | A1101(152.89) | | | | | |
| DLRLASNAI | B0801(151.44) | | | | | |
| SYTMCSGKF | A2402(260.37) | | | | | |
| KPRWLDARI | B0702(80.20) | | | | | |
| ILNKRRRTA | B0801(116.00) | | | | | |

FIG. 48-40

| Peptide | HLA (nM) | HLA (nM) | Peptide | HLA (nM) | HLA (nM) | HLA (nM) |
|---|---|---|---|---|---|---|
| WYMWLGARF | A2402(22.01) | | | | | |
| LIGAIITWI | A0201(93.81) | | | | | |
| HILSENEVK | A1101(184.23) | | | | | |
| MIGQTRIQR | A1101(249.25) | | | | | |
| KTFVELMKR | A0301(319.67) | A1101(24.53) | | | | |
| SSADLSLER | A1101(46.97) | | | | | |
| CWCNLTSAW | A2402(439.92) | | | | | |
| VSTGTQLAK | A0301(462.48) | A1101(41.17) | | | | |
| CWCNTTDTW | A2402(198.41) | | | | | |
| VISCVPNAV | A0201(148.62) | | | | | |
| MTGTLAVLF | B1501(382.35) | | | | | |
| TLCLIPTI | A0201(10.77) | | | | | |
| FLLLVMGQL | A0201(249.51) | | | | | |
| TLPETILEL | A0201(26.32) | | | | | |
| MWHVTRGSV | B0801(391.93) | | | | | |
| FLAHVIGTS | A0201(183.50) | | | | | |
| TLMKGASRR | A0301(416.33) | A1101(219.17) | | | | |
| IVVGLVTLY | B1501(281.20) | | | | | |
| QMEEKAWLV | A0201(33.22) | | | | | |
| AYRHAMEEL | A2402(303.31) | | | | | |
| TLYAVATTI | A0201(30.94) | | | | | |
| MTDDIGIGV | A0201(40.70) | | | | | |
| KMFEATARG | A0201(443.22) | | | | | |
| KQLATLRKY | B1501(226.09) | | | | | |
| NRRRRTAGF | B0801(75.08) | | | | | |
| GGKAYRHAM | B0801(249.93) | | | | | |
| AMEELPDTI | A0201(463.67) | | | | | |
| RMEALQRKF | B1501(439.56) | | | | | |
| RPKWLDARV | B0702(205.55) | | | | | |

FIG. 48-41

| Peptide | HLA (nM) | HLA (nM) | HLA (nM) | Peptide | HLA (nM) | HLA (nM) | HLA (nM) |
|---|---|---|---|---|---|---|---|
| KTLAKAIFK | A0301(14.09) | A1101(4.47) | | | | | |
| TTETPIWNR | A1101(397.26) | | | | | | |
| HSWEDVPYL | A0201(293.75) | | | | | | |
| RPMPGTRKA | B0702(17.97) | | | | | | |
| CPTQGEAIL | B0702(185.15) | | | | | | |
| YAWKTMAMA | A0201(496.50) | | | | | | |
| YMWLGARFL | A0201(23.81) | | | | | | |
| LLFKTSVGV | A0201(7.98) | | | | | | |
| AILCVPNAV | A0201(56.43) | | | | | | |
| LIALNDMGK | A0301(267.53) | A1101(63.81) | | | | | |
| IFGSVYTTM | A2402(374.93) | | | | | | |
| SMINGVVKL | A0201(18.28) | B1501(184.37) | | | | | |
| WSYYMATLK | A0301(39.14) | A1101(9.72) | | | | | |
| MILVVVATL | A0201(116.37) | | | | | | |
| AMLLVVVSF | B1501(111.76) | | | | | | |
| MWKQISNEL | A2402(308.67) | B0801(161.28) | | | | | |
| ALIMLGDTM | B1501(236.50) | | | | | | |
| MLWMADVPL | A0201(17.72) | B0801(424.54) | B1501(353.21) | | | | |
| ISVLRGFRK | A0301(288.62) | A1101(31.06) | | | | | |
| AAILMGLDK | A1101(306.73) | | | | | | |
| NSRNTPMAM | B1501(394.59) | | | | | | |
| ILNGRKRSK | A0301(281.71) | | | | | | |
| LLTGGAMLF | B1501(325.65) | | | | | | |
| YAQMWTLMY | B1501(101.89) | | | | | | |
| RMIMTTTAN | B1501(200.74) | | | | | | |
| MVLLQMEDK | A1101(68.77) | | | | | | |
| STYGWNLVK | A0301(10.19) | A1101(2.90) | | | | | |
| SPARLASAI | B0702(17.47) | | | | | | |
| LQKTEATHL | B1501(143.94) | | | | | | |

FIG. 48-42

| Peptide | HLA (nM) | Peptide | HLA (nM) | Peptide | HLA (nM) | Peptide | HLA (nM) |
|---|---|---|---|---|---|---|---|
| WGKAKIVIA | B0801(154.78) | | | | | | |
| TSEDHWNYK | A1101(55.55) | | | | | | |
| RPTPRGAVM | B0702(2.88) | | | | | | |
| LMAMDLGEL | A0201(97.37) | | | | | | |
| IERLKRMAI | B0801(374.33) | | | | | | |
| VLFSGVSWT | A0201(72.21) | | | | | | |
| GLMALKLTT | A0201(419.29) | | | | | | |
| ASMAICSAV | A0201(136.72) | | | | | | |
| MTDEMGMGV | A0201(53.34) | | | | | | |
| VVVMVGAAM | B1501(222.73) | | | | | | |
| SRWSRKMLM | B0801(379.40) | | | | | | |
| VIFILLILV | A0201(183.56) | | | | | | |
| VTQLATLRK | A0301(139.36) | A1101(18.07) | | | | | |
| SMVNGVVRL | A0201(42.07) | B1501(260.95) | | | | | |
| AQWLETKGV | A0201(443.51) | | | | | | |
| LTKRFSLGM | B1501(277.85) | | | | | | |
| WLKMRDSYT | B0801(138.79) | | | | | | |
| FQSHQLWTT | A0201(68.27) | | | | | | |
| SNAALGAVF | B1501(278.84) | | | | | | |
| IAVSMANIF | B1501(80.67) | | | | | | |
| LVMAWRTIM | B0801(340.62) | B1501(215.15) | | | | | |
| MLLVVVSFV | A0201(14.69) | | | | | | |
| ISLTCSNTM | B1501(393.35) | | | | | | |
| ITISEDGSM | B1501(489.94) | | | | | | |
| GTNSRNTSM | B1501(407.36) | | | | | | |
| GIQRTIFFV | A0201(37.54) | | | | | | |
| TVCYVLTGR | A1101(98.93) | | | | | | |
| GVVTRSGAY | B1501(225.87) | | | | | | |
| RLATAIAGA | A0201(22.03) | | | | | | |

FIG. 48-43

| Peptide | HLA (nM) | HLA (nM) | HLA (nM) | HLA (nM) | HLA (nM) | HLA (nM) |
|---|---|---|---|---|---|---|
| AIWYMWLGA | A0201(147.07) | | | | | |
| FRKKRLTIM | B0801(17.88) | | | | | |
| KVSCTILAV | A0201(35.89) | | | | | |
| FGKMVHQIF | B0801(408.83) | | | | | |
| RTEAKSALK | A0301(137.85) | A1101(22.24) | | | | |
| KAKTWLVHK | A0301(129.90) | A1101(40.93) | | | | |
| TVNPIVTER | A1101(42.44) | | | | | |
| LWKQIANEL | A2402(453.86) | | | | | |
| SILASSLLK | A0301(14.96) | A1101(4.26) | | | | |
| KIPGGAMYA | A0201(292.07) | | | | | |
| ILLKTVTQF | B1501(43.10) | | | | | |
| VMSGSSADL | A0201(316.65) | | | | | |
| ALSELPETL | A0201(28.11) | | | | | |
| ITYNCPLLR | A0301(205.53) | A1101(21.72) | | | | |
| AIIREAIKR | A1101(423.88) | | | | | |
| GFMNEDHWF | A2402(87.51) | | | | | |
| STITLLCLI | A0201(419.48) | | | | | |
| KLREKQDVF | B1501(102.10) | | | | | |
| IMNRRKRSV | B0801(79.41) | | | | | |
| LAHYIGTSL | B0702(238.85) | B1501(295.29) | | | | |
| FIFNLKDTL | A0201(208.19) | | | | | |
| GILARWGTF | B1501(300.15) | | | | | |
| QLWTALISL | A0201(26.25) | | | | | |
| TVEEIAVK | A1101(360.07) | | | | | |
| TVIALFLAH | A1101(308.84) | | | | | |
| LLLGLLATV | A0201(6.28) | | | | | |
| LLAGFMAYM | A0201(12.24) | B1501(232.83) | | | | |
| TQWQKGEEV | A0201(394.65) | | | | | |
| ALITVSGLY | A0301(207.52) | A1101(443.31) | B1501(187.98) | | | |

FIG. 48-44

| Peptide | HLA (nM) | HLA (nM) | HLA (nM) | Peptide | HLA (nM) | HLA (nM) | HLA (nM) |
|---|---|---|---|---|---|---|---|
| SGFWELVDK | A1101(148.31) | | | | | | |
| MAMTTTLSI | A0201(315.42) | B0702(316.94) | B0801(120.39) | B1501(45.86) | | | |
| TPQASTAEV | B0702(173.98) | | | | | | |
| SIPHDLMEL | A0201(374.41) | | | | | | |
| GLFGKGSLI | A0201(439.36) | | | | | | |
| TTIITPMMR | A1101(28.21) | | | | | | |
| ITYKCPFLK | A0301(15.75) | A1101(5.07) | | | | | |
| MAFIAFLRF | B1501(34.55) | | | | | | |
| GLLNGQGPM | B1501(174.68) | | | | | | |
| LARWGSFKK | A0301(329.51) | A1101(115.29) | | | | | |
| WAALLSLTF | B1501(55.48) | | | | | | |
| MVLSVVSLF | B1501(54.30) | | | | | | |
| FIFGLKDTL | A0201(194.11) | | | | | | |
| FCIKVLNPY | B1501(485.31) | | | | | | |
| RLITANPIV | A0201(31.23) | | | | | | |
| FLTSSQQKA | A0201(151.73) | | | | | | |
| WMVRILIGF | B1501(228.72) | | | | | | |
| TFIKTTFSL | A2402(107.30) | | | | | | |
| KMKKKTWLV | A0201(124.18) | B0801(331.34) | | | | | |
| FLTQDEKGV | A0201(169.44) | | | | | | |
| MLSIINRRK | A0301(58.62) | A1101(89.54) | | | | | |
| SPATTQKAA | B0702(151.94) | | | | | | |
| TTSQETWNR | A1101(386.59) | | | | | | |
| QMEDKAWLV | A0201(30.73) | | | | | | |
| RLREKQDAF | B0702(396.93) | B0801(340.13) | B1501(47.15) | | | | |
| LLLVAHYA | A0201(72.42) | | | | | | |
| TIMAAILAY | A0301(225.36) | A1101(46.70) | B1501(57.08) | | | | |
| VAFLRFLTI | B0801(70.65) | | | | | | |
| RTIMAVLFV | A0201(213.15) | | | | | | |

FIG. 48-45

| Peptide | HLA (nM) | HLA (nM) | HLA (nM) | Peptide | HLA (nM) | HLA (nM) | HLA (nM) |
|---|---|---|---|---|---|---|---|
| MMLKLLTEF | A0201(495.78) | B1501(10.31) | | | | | |
| RSRWSRKML | B0702(105.85) | | | | | | |
| LISYGGGWK | A1101(250.24) | | | | | | |
| CSGTFVLKK | A0301(428.46) | A1101(27.70) | | | | | |
| GSNTQFCVK | A1101(41.47) | | | | | | |
| YLALIATFK | A0301(94.17) | A1101(81.24) | | | | | |
| TVEAGRTLR | A1101(153.29) | | | | | | |
| KMRKKTWLV | A0201(134.56) | B0801(284.28) | | | | | |
| KIAQWLETK | A0301(85.10) | A1101(21.75) | | | | | |
| VLMLVAHYA | A0201(21.89) | | | | | | |
| AVQNWLARV | A0201(32.17) | | | | | | |
| ILRHPGFAI | B0702(300.81) | B0801(488.38) | B1501(315.90) | | | | |
| VQTAPGTFK | A0301(431.04) | A1101(65.86) | | | | | |
| VSSWEDVPY | B1501(414.48) | | | | | | |
| MLMAGTLAV | A0201(2.96) | B0801(370.38) | B1501(122.81) | | | | |
| LLTAIAPSM | A0201(246.80) | B1501(452.54) | | | | | |
| IIGPGLQAK | A0301(418.97) | A1101(159.42) | | | | | |
| YIIGAGEK | A1101(427.93) | | | | | | |
| CWCNATDTW | A2402(189.93) | | | | | | |
| WAKNIQVAI | B0801(252.82) | | | | | | |
| VVGILAQGK | A1101(135.91) | | | | | | |
| APSENEGVL | B0702(90.69) | | | | | | |
| MTLMKGASK | A0301(87.76) | A1101(14.12) | | | | | |
| KMVRNMEKY | B1501(177.55) | | | | | | |
| TPEAKNSTF | B0702(212.37) | | | | | | |
| GIMQAGKRY | B1501(428.12) | | | | | | |
| ATLLAISGV | A0201(318.91) | | | | | | |
| VLLGSFGCK | A0301(47.70) | A1101(55.80) | | | | | |
| ISKIPGGAM | B1501(350.85) | | | | | | |

FIG. 48-46

| Peptide | HLA (nM) | HLA (nM) | HLA (nM) | Peptide | HLA (nM) | HLA (nM) | HLA (nM) |
|---|---|---|---|---|---|---|---|
| MLLDNIYTP | A0201(80.05) | | | | | | |
| LLMRTTWAF | A0201(115.88) | B0801(394.43) | B1501(16.29) | | | | |
| NYADRRWCF | A2402(151.07) | | | | | | |
| FGRAKGSRA | B0801(403.95) | | | | | | |
| TILIKVEYR | A1101(406.40) | | | | | | |
| TQVGVGVQK | A1101(140.16) | | | | | | |
| TTWENVPYL | A0201(37.54) | | | | | | |
| GIGALLTWI | A0201(424.00) | | | | | | |
| VQTKPGIFK | A0301(448.29) | A1101(69.36) | | | | | |
| MTSRMLLNR | A0301(176.96) | A1101(9.48) | | | | | |
| GLLCISII | A0201(76.10) | | | | | | |
| VLWEGGHDL | A0201(16.53) | | | | | | |
| TSQETWNRK | A1101(114.93) | | | | | | |
| SLVMLSVHY | B1501(42.07) | | | | | | |
| QLAVTVMAM | B1501(364.56) | | | | | | |
| TMFLIAENK | A0301(46.15) | A1101(10.71) | | | | | |
| LIVMDEAHF | B1501(106.12) | | | | | | |
| CLMMMFPAT | A0201(181.12) | | | | | | |
| NMVKSLVSA | A0201(153.73) | | | | | | |
| FIRSTMPLV | A0201(26.09) | | | | | | |
| TTIFAGHLK | A1101(10.72) | | | | | | |
| ATVLMGLGR | A1101(142.70) | | | | | | |
| GMALFLEEM | A0201(165.38) | B1501(226.62) | | | | | |
| LTIMTGDTK | A1101(69.53) | | | | | | |
| IMQRGLFGK | A0301(69.03) | A1101(37.26) | | | | | |
| KAINVLRGF | B1501(63.65) | | | | | | |
| KQTGSASSM | B1501(18.23) | | | | | | |
| AGLLFSIMK | A1101(308.96) | | | | | | |
| RPMPGTRKV | B0702(15.44) | | | | | | |

FIG. 48-47

| Peptide | HLA (nM) | HLA (nM) | Peptide | HLA (nM) | HLA (nM) | HLA (nM) |
|---|---|---|---|---|---|---|
| YVVIGILTL | A0201(215.96) | | | | | |
| MALWYIWQV | A0201(5.99) | | | | | |
| GTGNIVASV | A0201(471.72) | | | | | |
| ATMLDVDLR | A1101(72.70) | | | | | |
| QMSLGNILF | B1501(228.17) | | | | | |
| LQKTEVTQL | B1501(209.03) | | | | | |
| YPMSIPATL | B0702(18.44) | | | | | |
| APSESEGVL | B0702(67.90) | | | | | |
| HPGFTVIAF | B0702(148.68) | | | | | |
| IVGVFFTFV | A0201(136.08) | | | | | |
| TMKILIGAI | B0801(362.17) | | | | | |
| ILLKIVTHF | B1501(56.93) | | | | | |
| RTNDWDFVV | A0201(58.67) | | | | | |
| AVHNMLARV | A0201(21.88) | | | | | |
| ALMATFKMR | A1101(424.19) | | | | | |
| AQNALDNLV | A0201(200.17) | | | | | |
| VTLLSLTFV | A0201(130.82) | | | | | |
| WPKSHTLWS | B0702(225.83) | | | | | |
| SPSKLASAI | B0702(14.75) | | | | | |
| TVAWRTATL | B0801(380.26) | | | | | |
| IGAIALDFK | A1101(366.86) | | | | | |
| SALLWMASV | A0201(83.03) | | | | | |
| CGRGGWSYY | B1501(392.73) | | | | | |
| IILEFFLMV | A0201(27.72) | | | | | |
| TLIASLVML | A0201(61.97) | | | | | |
| VLMMLVAPS | A0201(291.26) | | | | | |
| KTFDTEYQK | A0301(59.69) | A1101(5.41) | | | | |
| GQGTSETFF | B1501(178.57) | | | | | |
| ATGEHRREK | A1101(333.49) | | | | | |

FIG. 48-48

| Peptide | HLA (nM) | HLA (nM) | Peptide | HLA (nM) | HLA (nM) | HLA (nM) |
|---|---|---|---|---|---|---|
| EARKTFVDL | B0801(147.46) | | | | | |
| MMILPAALA | A0201(109.01) | | | | | |
| VPMVTQLAM | B0702(11.70) | | | | | |
| YVILTILTI | A0201(87.82) | | | | | |
| DLMELIDGI | A0201(437.33) | | | | | |
| MILMKMKKK | A0301(189.13) | A1101(122.27) | | | | |
| LMTGTLAVF | B1501(23.50) | | | | | |
| GLNSKNTSM | B1501(107.94) | | | | | |
| FMTATPPGA | A0201(19.18) | | | | | |
| ILLVAASFV | A0201(23.84) | | | | | |
| LAMATTLQL | B1501(246.82) | | | | | |
| MDLLRALIM | B0801(454.82) | | | | | |
| CPTQGEAVL | B0702(89.48) | | | | | |
| IVMLIPTAI | A0201(211.86) | | | | | |
| RTLRVLNLV | A0201(192.45) | | | | | |
| LALNLITEM | B1501(250.98) | | | | | |
| CTILAVVSV | A0201(498.22) | | | | | |
| SLLPVCQSS | A0201(499.48) | | | | | |
| VVVDEHCGY | B1501(353.15) | | | | | |
| STSQEIWNR | A1101(219.44) | | | | | |
| IQNLGGTSI | B1501(88.00) | | | | | |
| VMKRYSAPF | B0801(50.32) | B1501(5.53) | | | | |
| CVTQVLMMR | A1101(287.83) | | | | | |
| VSWSGKELK | A1101(49.99) | | | | | |
| TPKAKRGTA | B0702(327.19) | B0801(228.77) | | | | |
| YPLAIPITM | B0702(93.41) | | | | | |
| RQYGGALVR | A0301(413.35) | | | | | |
| IQMSSGNIL | B1501(57.58) | | | | | |
| FQSHQLWVT | A0201(204.80) | | | | | |

FIG. 48-49

| Peptide | HLA (nM) | HLA (nM) | HLA (nM) | HLA (nM) | Peptide | HLA (nM) | HLA (nM) | HLA (nM) |
|---|---|---|---|---|---|---|---|---|
| VTMLDVDLR | A1101(161.25) | | | | | | | |
| MTLMKGASR | A1101(152.58) | | | | | | | |
| YPLAIPVTM | B0702(83.63) | | | | | | | |
| LMAAILAYT | A0201(9.48) | | | | | | | |
| LALALTFIK | A0301(243.00) | A1101(29.47) | | | | | | |
| TPETRNSTF | B0702(165.32) | | | | | | | |
| CTREEFTKK | A1101(136.24) | | | | | | | |
| CTNTFVLKK | A0301(91.65) | A1101(6.35) | | | | | | |
| GLICVVASS | A0201(334.42) | | | | | | | |
| LPWASGATT | B0702(93.17) | | | | | | | |
| KSYAQMWQL | A0201(493.27) | | | | | | | |
| LMCHATFTM | A0201(78.34) | B1501(16.53) | | | | | | |
| WQIEKASLI | A0201(103.82) | B1501(226.64) | | | | | | |
| HGIERLKRM | B0801(440.29) | | | | | | | |
| HFQRTLIFI | A2402(352.00) | | | | | | | |
| ALLAKAIFK | A0301(33.21) | A1101(22.07) | | | | | | |
| ILLVAVSFM | A0201(451.38) | B1501(426.38) | | | | | | |
| MLINRFTMR | A0301(370.13) | A1101(221.66) | | | | | | |
| ATLTEGVYR | A1101(42.21) | | | | | | | |
| AMHSALAGA | A0201(19.22) | | | | | | | |
| AQIMEVTAK | A1101(241.38) | | | | | | | |
| RPGYFTQAA | B0702(31.12) | | | | | | | |
| SLGLLCISI | A0201(493.79) | | | | | | | |
| KVIDLGCGR | A1101(383.87) | | | | | | | |
| MLVAHYAII | A0201(58.63) | B0801(95.92) | | | | | | |
| HMIVGVFFT | A0201(133.74) | | | | | | | |
| GPLVAGGLL | B0702(131.63) | | | | | | | |
| VILTILTII | A0201(437.70) | | | | | | | |
| ELVHREREL | B0801(387.58) | | | | | | | |

FIG. 48-50

| Peptide | HLA (nM) | HLA (nM) | Peptide | HLA (nM) | HLA (nM) | HLA (nM) |
|---|---|---|---|---|---|---|
| ALGMMVLKI | A0201(384.38) | | | | | |
| MIAGVFFMF | B1501(247.72) | | | | | |
| LLGLMILL | A0201(40.11) | | | | | |
| TSGSPIINR | A1101(268.19) | | | | | |
| MLNILNRRK | A0301(56.95) | A1101(140.84) | | | | |
| RVLDWLEKY | A1101(119.82) | | | | | |
| YVIIAILTV | A0201(35.20) | | | | | |
| TLILAVISL | A0201(199.76) | | | | | |
| FLLLTMGQL | A0201(165.74) | | | | | |
| KMEALQRQY | B1501(439.94) | | | | | |
| TMFGGVSWI | A0201(24.76) | | | | | |
| CLMMVLPAA | A0201(28.30) | | | | | |
| ITANPIVTK | A0301(79.69) | A1101(7.47) | | | | |
| MFGGVSWII | A2402(129.17) | | | | | |
| KALKINWYK | A0301(45.94) | A1101(8.50) | | | | |
| NIWLKLREV | A0201(390.68) | | | | | |
| WYAQIQPHW | A2402(107.90) | | | | | |
| SLGKMVHQI | A0201(70.95) | | | | | |
| TIGTTHFQR | A1101(58.80) | | | | | |
| MAVGGITLF | B1501(38.59) | | | | | |
| WPKTHTLWS | B0702(373.55) | | | | | |
| GLLCVMASS | A0201(348.61) | | | | | |
| GTIVIRIQY | A1101(151.30) | | | | | |
| CTSQILLMR | A1101(84.29) | | | | | |
| FTVIAFFLA | A0201(191.87) | | | | | |
| VTYKCPFLK | A0301(19.65) | A1101(5.42) | | | | |
| LLCVMASSV | A0201(220.58) | | | | | |
| NIWLKLREM | B0801(450.62) | | | | | |
| IMQRGLLGK | A0301(51.50) | A1101(62.86) | | | | |

FIG. 48-51

| Peptide | HLA (nM) | HLA (nM) | Peptide | HLA (nM) | HLA (nM) | HLA (nM) | HLA (nM) |
|---|---|---|---|---|---|---|---|
| MSAAVKDER | A1101(185.53) | | | | | | |
| IMAVGLVSL | A0201(36.53) | B1501(295.20) | | | | | |
| KITAKWLWK | A0301(65.96) | A1101(36.53) | | | | | |
| ALVAFLRFL | A0201(82.71) | | | | | | |
| CSGKFSIDK | A1101(68.66) | | | | | | |
| MIRPQPMEY | A0301(349.16) | B1501(104.55) | | | | | |
| SPAATQKAA | B0702(94.87) | | | | | | |
| TMAMVLSIA | A0201(468.34) | | | | | | |
| TANPIVTDK | A1101(51.29) | | | | | | |
| QIFGTAYGI | A0201(197.66) | | | | | | |
| WIMKILIGV | A0201(7.52) | | | | | | |
| LLRTYCIEA | A0201(250.42) | | | | | | |
| VIGVLEQGK | A1101(495.18) | | | | | | |
| ILKDGPERV | A0201(133.10) | | | | | | |
| WGKAKVLST | B0801(228.62) | | | | | | |
| AIVREAIRR | A1101(466.64) | | | | | | |
| LLLTSSQQK | A0301(58.63) | A1101(104.83) | | | | | |
| IAMTDTTPF | B1501(7.10) | | | | | | |
| QISNELNYI | A0201(398.27) | | | | | | |
| ALRINWYKK | A0301(145.00) | A1101(292.17) | | | | | |
| VLLLVTHYA | A0201(59.04) | | | | | | |
| FIAFLRFLA | A0201(100.94) | | | | | | |
| LAIGIMMLK | A0301(190.68) | A1101(12.56) | | | | | |
| NLCEGTTVV | A0201(41.25) | | | | | | |
| GVVTLYLGV | A0201(393.29) | | | | | | |
| QQLTKRFSL | B0801(109.28) | | | | | | |
| TTEVHWNYK | A1101(25.93) | | | | | | |
| ISRKAGGAM | B0702(65.46) | B1501(70.03) | | | | | |
| YVLGIFLRK | A0301(113.59) | A1101(13.21) | | | | | |

FIG. 48-52

| Peptide | HLA (nM) | HLA (nM) | HLA (nM) | Peptide | HLA (nM) | HLA (nM) | HLA (nM) |
|---|---|---|---|---|---|---|---|
| TVNPIATEK | A0301(216.95) | A1101(10.91) | | | | | |
| LMMILPAAL | A0201(31.65) | B0801(332.00) | B1501(258.74) | | | | |
| LTAAVLMLV | A0201(20.74) | | | | | | |
| VQTKPGLFK | A0301(306.34) | A1101(75.42) | | | | | |
| GSSPIIEVK | A1101(106.41) | | | | | | |
| VWPKSHTLW | A2402(296.89) | | | | | | |
| TIMVVLFVV | A0201(26.70) | | | | | | |
| FTMRLLSPI | A0201(21.27) | B1501(425.27) | | | | | |
| IMAWRTIMA | A0201(84.49) | | | | | | |
| TVMDVISRR | A1101(16.58) | | | | | | |
| MALKLTTQF | B1501(28.50) | | | | | | |
| AMKRYSAPF | B0801(34.02) | B1501(5.62) | | | | | |
| AIMAAILAY | A0301(89.89) | A1101(38.59) | B1501(31.34) | | | | |
| MIMTTTANW | B1501(382.25) | | | | | | |
| GILARWGSF | B0801(364.50) | B1501(175.34) | | | | | |
| GPSLRTTTV | B0702(53.49) | B0801(369.78) | | | | | |
| PTYLSSKAK | A1101(454.12) | | | | | | |
| TLTEGVYRI | A0201(26.50) | | | | | | |
| YMPSVVEAL | A0201(13.00) | | | | | | |
| VMTTTANWL | A0201(349.94) | | | | | | |
| FQSYQLWAT | A0201(39.76) | | | | | | |
| ALALGMMVL | A0201(216.26) | | | | | | |
| LLTGGVMLF | A0201(224.70) | | | | | | |
| YQFQPESPA | A0201(295.76) | B1501(64.20) | | | | | |
| LILTSSQQK | A0301(94.44) | A1101(42.47) | | | | | |
| IQMSLGNIL | B1501(98.81) | | | | | | |
| LLMRTSWAF | A0201(171.85) | B1501(17.81) | | | | | |
| HILAENEVK | A1101(188.80) | | | | | | |
| RVIDPRRCL | B0702(137.16) | | | | | | |

FIG. 48-53

| Peptide | HLA (nM) | Peptide | HLA (nM) | Peptide | HLA (nM) | Peptide | HLA (nM) | Peptide | HLA (nM) | Peptide | HLA (nM) |
|---|---|---|---|---|---|---|---|---|---|---|---|
| ILNRRRRTA | B0801(164.87) | | | | | | | | | | |
| TVMDIISRR | A1101(17.83) | | | | | | | | | | |
| LIIMDEAHF | B1501(65.38) | | | | | | | | | | |
| GQLKLNWFK | A0301(141.20) | A1101(37.61) | | | | | | | | | |
| ALAPPVNDL | A0201(114.47) | | | | | | | | | | |
| LQMEEKAWL | A0201(93.08) | | | | | | | | | | |
| CTREEFIKK | A0301(482.37) | A1101(114.42) | | | | | | | | | |
| HLAIMAVFK | A0301(31.97) | A1101(27.99) | | | | | | | | | |
| SMGLITIAV | A0201(47.73) | | | | | | | | | | |
| TMRYKKATY | B1501(125.22) | | | | | | | | | | |
| SSVNTTSKM | B1501(79.03) | | | | | | | | | | |
| MILVVVITF | B1501(442.26) | | | | | | | | | | |
| YLMTLMKGA | A0201(25.00) | | | | | | | | | | |
| LMLMPTALA | A0201(183.98) | | | | | | | | | | |
| VSAVNMTSR | A1101(316.98) | | | | | | | | | | |
| KMLMTGTLA | A0201(295.21) | | | | | | | | | | |
| MTIMTGDIK | A1101(30.74) | | | | | | | | | | |
| ISSWEDVPY | B1501(264.10) | | | | | | | | | | |
| TLKGVSYVM | B1501(443.31) | | | | | | | | | | |
| ILAVFFLLI | A0201(102.78) | | | | | | | | | | |
| LLFKTSAGI | A0201(18.24) | B1501(304.83) | | | | | | | | | |
| KMGMGVTYL | A0201(33.70) | B1501(429.38) | | | | | | | | | |
| FLIDGPETA | A0201(4.00) | | | | | | | | | | |
| SSMLNIINR | A1101(11.79) | | | | | | | | | | |
| VVTLIPLCR | A1101(431.97) | | | | | | | | | | |
| LQRKYGGNL | B1501(154.69) | | | | | | | | | | |
| GQMFATTMR | A1101(359.13) | | | | | | | | | | |
| VPNYNLVIM | B0702(86.10) | | | | | | | | | | |
| WLWALLGKK | A0301(199.62) | A1101(260.90) | | | | | | | | | |

FIG. 48-54

| Peptide | HLA (nM) | HLA (nM) | HLA (nM) | Peptide | HLA (nM) | HLA (nM) | HLA (nM) |
|---|---|---|---|---|---|---|---|
| ALLARSIFK | A0301(21.01) | A1101(14.80) | | | | | |
| TANIFRGSY | B1501(390.92) | | | | | | |
| FQPESPARV | A0201(19.14) | | | | | | |
| ILLMRTTWA | A0201(310.60) | | | | | | |
| STGTQLAKR | A1101(205.77) | | | | | | |
| DVFYLPPEK | A1101(198.57) | | | | | | |
| RQDLLVTFK | A0301(213.45) | A1101(81.13) | | | | | |
| AMLFLISGK | A0301(30.83) | A1101(23.65) | | | | | |
| SLVRCPLSR | A1101(324.56) | | | | | | |
| QMEGEGIFK | A1101(212.72) | | | | | | |
| TQDDMHNPK | A1101(157.23) | | | | | | |
| LLGAMTAGI | A0201(25.06) | | | | | | |
| AYRHAVEEL | A2402(335.32) | | | | | | |
| MVMTTTANW | B1501(446.96) | | | | | | |
| RPTEQVDTL | B0702(153.09) | | | | | | |
| SMLNIMNRR | A1101(135.84) | | | | | | |
| MLWMADIPL | A0201(14.74) | B0801(499.19) | B1501(376.25) | | | | |
| LLMLVTPSM | A0201(92.27) | B1501(93.68) | | | | | |
| KLSMGLITI | A0201(29.60) | | | | | | |
| GTCAQSGER | A1101(372.39) | | | | | | |
| LLMLMPTAL | A0201(60.10) | B0801(139.79) | | | | | |
| FGAIYGAAF | B1501(295.19) | | | | | | |
| QMSSGNLLF | B1501(20.84) | | | | | | |
| MMGKREKKL | B0801(160.14) | | | | | | |
| FLMVLLIPE | A0201(206.99) | | | | | | |
| GLFGKGSLL | A0201(239.68) | | | | | | |
| VDRLKRMAI | B0801(218.70) | | | | | | |
| CPTQGEPSL | B0702(89.54) | | | | | | |
| MATFRMRPM | B0702(395.05) | B0801(36.17) | | | | | |

FIG. 48-55

| Peptide | HLA (nM) | HLA (nM) | Peptide | HLA (nM) | HLA (nM) | HLA (nM) | HLA (nM) |
|---|---|---|---|---|---|---|---|
| ATLLAVSGV | A0201(461.30) | | | | | | |
| STITLLYLI | A0201(88.74) | | | | | | |
| VTNPAILRK | A0301(153.43) | A1101(16.14) | | | | | |
| RSADLELER | A1101(147.23) | | | | | | |
| LMILLTGGV | A0201(124.71) | | | | | | |
| VSSVNTTSK | A0301(319.60) | A1101(38.04) | | | | | |
| MALVAFLRF | B1501(101.25) | | | | | | |
| TMKNKAWMV | A0201(436.28) | B0801(246.63) | | | | | |
| KWKKRLNQL | A2402(257.09) | B0801(475.62) | | | | | |
| ILSENEAKL | A0201(264.12) | | | | | | |
| KITGNLVQV | A0201(161.27) | | | | | | |
| FLNEDHWFG | A0201(59.94) | | | | | | |
| YSDYMTSMK | A1101(48.56) | | | | | | |
| SILLWYAQI | A0201(178.20) | | | | | | |
| WLKLRDSHT | B0801(270.16) | | | | | | |
| VMAVGLVSI | A0201(38.74) | | | | | | |
| TLEVHWNYK | A0301(165.68) | A1101(44.65) | | | | | |
| WMVHRQWFF | A2402(401.31) | B0801(443.13) | B1501(55.70) | | | | |
| KAYAQMWAL | A0201(135.72) | | | | | | |
| QLWTLLSL | A0201(53.38) | | | | | | |
| TVTAFFLAH | A1101(367.95) | | | | | | |
| EMILMEMRK | A1101(189.71) | | | | | | |
| LVQVENLEY | B1501(359.03) | | | | | | |
| STSQETWNR | A1101(173.04) | | | | | | |
| LTMKKKSWL | B0801(255.08) | | | | | | |
| LTTLSRTSK | A0301(386.81) | A1101(46.73) | | | | | |
| MPVMKRYSA | B0702(22.67) | B0801(11.71) | | | | | |
| LIAVLTGGV | A0201(321.12) | | | | | | |
| YLALLAAFK | A0301(127.58) | A1101(116.61) | | | | | |

FIG. 48-56

| Peptide | HLA (nM) | HLA (nM) | Peptide | HLA (nM) | HLA (nM) | HLA (nM) |
|---|---|---|---|---|---|---|
| TQMIMTTTA | B1501(276.09) | | | | | |
| FIRSTTPLV | A0201(53.26) | | | | | |
| SQGAGWSLK | A0301(301.69) | A1101(34.17) | | | | |
| NFQTMPGTF | A2402(485.66) | | | | | |
| YVMCTGLFK | A0301(80.08) | A1101(8.75) | | | | |
| APEARNSTF | B0702(27.93) | | | | | |
| VSWNGRELK | A0301(356.12) | A1101(20.61) | | | | |
| MILAVVITL | A0201(62.49) | | | | | |
| KAALSEGVY | B1501(191.74) | | | | | |
| RQLASAIFK | A0301(31.03) | A1101(12.25) | | | | |
| MIKPKGKVV | B0801(101.21) | | | | | |
| TLLVKLALI | A0201(209.84) | | | | | |
| FGAAYGVLF | B1501(277.46) | | | | | |
| RLITANPVV | A0201(24.94) | | | | | |
| LLLMRTTWA | A0201(242.92) | B0801(420.95) | | | | |
| MILVVVTTF | B1501(133.49) | | | | | |
| FMQGKGMGK | A0301(263.78) | | | | | |
| LSIASLFPL | A0201(125.12) | B1501(303.32) | | | | |
| TQHGTAVVK | A1101(209.53) | | | | | |
| TLLAVSGVY | A0301(451.32) | B1501(163.50) | | | | |
| FTMMAAILA | A0201(306.07) | | | | | |
| KITAEWLWK | A0301(121.06) | A1101(39.80) | | | | |
| LLVAHYAI | A0201(31.19) | | | | | |
| LATLRKYCI | B0801(305.99) | | | | | |
| TMNRRKRSV | B0801(46.74) | | | | | |
| VVASEMAEA | A0201(497.48) | | | | | |
| VSKKEGGAM | B1501(335.12) | | | | | |
| IALLSQSTM | B1501(365.31) | | | | | |
| ALILGAQAL | A0201(142.53) | | | | | |

FIG. 48-57

| Peptide | HLA (nM) | HLA (nM) | Peptide | HLA (nM) | HLA (nM) | HLA (nM) |
|---|---|---|---|---|---|---|
| QVFGTAYGV | A0201(48.04) | | | | | |
| LMSGRGIGK | A0301(73.91) | A1101(103.33) | | | | |
| VMVMVGAAM | B1501(36.78) | | | | | |
| LQMESKAWL | A0201(46.83) | B1501(498.69) | | | | |
| MLNIINRRK | A0301(56.64) | A1101(112.82) | | | | |
| FRKRNLTIM | B0801(278.95) | | | | | |
| VTFKVPHAK | A0301(42.31) | A1101(5.39) | | | | |
| QLKLDWFKK | A0301(405.27) | | | | | |
| TILGGLTWM | A0201(464.93) | | | | | |
| LMTGTLAVL | A0201(61.05) | | | | | |
| AVQDWLVRV | A0201(21.41) | | | | | |
| VVIAILTLV | A0201(13.61) | | | | | |
| SIVREALKR | A1101(489.14) | | | | | |
| RTEAKSALR | A1101(154.26) | | | | | |
| VVQPENLEY | B1501(331.67) | | | | | |
| ALRGLPIRY | A0301(230.10) | B1501(275.79) | | | | |
| SYAQMWQLM | A2402(386.47) | | | | | |
| GAIKVLRGF | B1501(285.89) | | | | | |
| HWFSRENSW | A2402(235.14) | | | | | |
| FIRSTTPLI | A0201(230.44) | B1501(492.17) | | | | |
| IQMSSGNLL | A0201(453.28) | B1501(62.86) | | | | |
| EARKTFVEL | B0801(57.08) | | | | | |
| SLGGVFTSI | A0201(35.69) | | | | | |
| YILREVSKK | A0301(292.00) | A1101(122.11) | | | | |
| KVLNPYMPA | A0201(228.03) | A1101(330.27) | | | | |
| MILKLLTDF | B1501(96.91) | | | | | |
| TVKEEIAVK | A1101(422.70) | | | | | |
| RPRWLDART | B0702(75.25) | | | | | |
| LLSGQGPMK | A0301(314.98) | A1101(388.62) | | | | |

FIG. 48-58

| Peptide | HLA (nM) | Peptide | HLA (nM) | Peptide | HLA (nM) | Peptide | HLA (nM) | Peptide | HLA (nM) |
|---|---|---|---|---|---|---|---|---|---|
| MLVALLGAM | B1501(59.92) | | | | | | | | |
| KLVHQIFGT | A0201(50.57) | | | | | | | | |
| TLKGTSYVM | B1501(158.88) | | | | | | | | |
| AYNHALSEL | A2402(152.19) | | | | | | | | |
| KTSLCLMMI | A0201(428.27) | | | | | | | | |
| LQWIASAIV | A0201(75.70) | | | | | | | | |
| ILTDGEERV | A0201(53.56) | | | | | | | | |
| AMHSALTGA | A0201(21.93) | | | | | | | | |
| ATKSEHTGK | A1101(151.12) | | | | | | | | |
| IALDLVTEI | A0201(407.55) | | | | | | | | |
| SMAMTCMAV | A0201(16.23) | | | | | | | | |
| AAQNWLARV | A0201(242.23) | | | | | | | | |
| AILLAAVSF | B1501(321.54) | | | | | | | | |
| LIGAVITWI | A0201(150.44) | | | | | | | | |
| AVASGLLWI | A0201(238.83) | | | | | | | | |
| KPTDDRFAT | B0702(245.17) | | | | | | | | |
| SLFPLCLST | A0201(65.42) | | | | | | | | |
| GVYPMSIPA | A0201(219.78) | | | | | | | | |
| DYMPSMKRF | A2402(287.77) | | | | | | | | |
| HSGVDVFYK | A0301(303.05) | A1101(14.01) | | | | | | | |
| YPLSIPATL | B0702(61.59) | | | | | | | | |
| RPTPRGTVM | B0702(2.63) | | | | | | | | |
| TSELHWNYK | A1101(38.80) | | | | | | | | |
| ATQLATLRK | A0301(133.83) | A1101(12.08) | | | | | | | |
| AIIMLGDTM | B1501(384.12) | | | | | | | | |
| KTKTWLVHK | A0301(39.72) | A1101(10.54) | | | | | | | |
| ILNPYMPSV | A0201(3.98) | | | | | | | | |
| TPQASTTEV | B0702(134.06) | | | | | | | | |
| RTTWAFCEV | A0201(332.71) | | | | | | | | |

FIG. 48-59

| Peptide | HLA (nM) | HLA (nM) | HLA (nM) | Peptide | HLA (nM) | HLA (nM) | HLA (nM) |
|---|---|---|---|---|---|---|---|
| GILAVFFLL | A0201(60.09) | | | | | | |
| KLGYILREV | A0201(49.97) | | | | | | |
| GVYPLSIPA | A0201(194.98) | | | | | | |
| TVNPIVIEK | A0301(191.51) | A1101(8.14) | | | | | |
| GLFPVSIPI | A0201(6.96) | B1501(486.38) | | | | | |
| TMAQGKPTL | A0201(312.75) | | | | | | |
| SYAMCSNAF | A2402(75.45) | | | | | | |
| IQKETLVTF | B1501(14.36) | | | | | | |
| NLVNSLVTA | A0201(208.50) | | | | | | |
| LAMGIMILK | A0301(143.75) | A1101(10.13) | | | | | |
| VSAITQAEK | A0301(411.96) | A1101(23.90) | | | | | |
| WAFCEVLTL | B1501(440.19) | | | | | | |
| ITGVLEQGK | A1101(399.32) | | | | | | |
| DVFFMPPEK | A1101(116.65) | | | | | | |
| KMEKYQLAV | A0201(19.02) | | | | | | |
| SLHYAWKTM | B1501(136.17) | | | | | | |
| IMKDGRVLV | A0201(273.30) | | | | | | |
| VILQNAWKV | A0201(67.83) | | | | | | |
| LGAQALPVY | B1501(458.28) | | | | | | |
| MNRRKKSVT | B0801(496.77) | | | | | | |
| RQMEAEGVI | B1501(292.39) | | | | | | |
| AQALPVYLM | B1501(221.16) | | | | | | |
| TMKEKAWLV | A0201(48.84) | | | | | | |
| TMAMALSIV | A0201(64.61) | | | | | | |
| MSAAIKDNR | A1101(112.72) | | | | | | |
| GMNSRSTSL | A0201(327.71) | B0801(237.81) | B1501(51.18) | | | | |
| MRMKKKTWL | B0801(78.42) | | | | | | |
| TRKHMILAV | B0801(340.00) | | | | | | |
| MAWRTIMVV | A0201(252.02) | | | | | | |

FIG. 48-60

| Peptide | HLA (nM) | HLA (nM) | Peptide | HLA (nM) | HLA (nM) | HLA (nM) |
|---|---|---|---|---|---|---|
| LAVSGVYPM | B1501(67.59) | | | | | |
| LTPPVSDLK | A1101(155.38) | | | | | |
| HMIVSRQEK | A0301(120.84) | A1101(60.18) | | | | |
| AERLKRMAI | B0801(387.72) | | | | | |
| RTTWSIHAK | A0301(103.80) | A1101(10.31) | | | | |
| KLLTKPWDV | A0201(13.07) | | | | | |
| HLAIMIVFK | A0301(40.76) | A1101(29.04) | | | | |
| MLINRFTMK | A0301(25.22) | A1101(14.65) | | | | |
| HSGVDVFYR | A1101(208.93) | | | | | |
| QTSGGTSIF | B1501(199.82) | | | | | |
| GILCVSILI | A0201(416.41) | | | | | |
| MIIMDEAHF | B1501(32.27) | | | | | |
| MVLLTMKGK | A0301(251.50) | A1101(49.89) | | | | |
| LVREGRERL | B0702(250.38) | | | | | |
| WSYYCGGLK | A0301(74.56) | A1101(23.56) | | | | |
| TIGTTHFQK | A0301(120.32) | A1101(7.69) | | | | |
| ALFEPEREK | A0301(148.73) | A1101(241.61) | | | | |
| NMITLLVKL | A0201(87.77) | | | | | |
| TIEAGRTLR | A1101(182.67) | | | | | |
| AQGKPTLDF | B1501(146.76) | | | | | |
| IPKIHGGPI | B0702(13.32) | B0801(199.60) | | | | |
| GTLAVFFLL | A0201(108.66) | | | | | |
| IMNRRKKSV | B0801(142.16) | | | | | |
| IPKSYAGPF | B0702(26.86) | | | | | |
| VQTTPGTFK | A1101(112.22) | | | | | |
| TPFGQQRVF | B0702(286.72) | | | | | |
| VAGILVQGK | A1101(419.78) | | | | | |
| GIALGLMAL | A0201(264.37) | | | | | |
| TPEARNSTF | B0702(88.71) | | | | | |

FIG. 48-61

| Peptide | HLA (nM) | HLA (nM) | HLA (nM) | Peptide | HLA (nM) | HLA (nM) | HLA (nM) | HLA (nM) |
|---|---|---|---|---|---|---|---|---|
| HILLENDIK | A1101(309.46) | | | | | | | |
| MLGDTMLSR | A0301(480.51) | A1101(344.77) | | | | | | |
| AQEDDQYVF | B1501(362.30) | | | | | | | |
| KVVQHENLK | A0301(482.79) | A1101(75.90) | | | | | | |
| ALFGGVSWI | A0201(14.26) | | | | | | | |
| KLGEFGRAK | A0301(93.15) | | | | | | | |
| NLVKLHSGV | A0201(421.83) | | | | | | | |
| YMPTVIEEL | A0201(11.30) | | | | | | | |
| IYADDTAGW | A2402(301.32) | | | | | | | |
| YRGAKRMAI | B0801(132.01) | | | | | | | |
| CLMMILPAA | A0201(27.97) | | | | | | | |
| RPAKSGTVM | B0702(2.99) | | | | | | | |
| EMILMKMRK | A1101(100.67) | | | | | | | |
| EQRKTFVEL | B0801(113.22) | | | | | | | |
| CVMASSALL | A0201(165.42) | | | | | | | |
| EGRERLARM | B0801(130.13) | | | | | | | |
| MSPGYVLGV | A0201(176.88) | | | | | | | |
| IVLEHGSCV | A0201(405.52) | | | | | | | |
| HWFRRGSSI | B0801(32.91) | | | | | | | |
| FTMRLLSPV | A0201(5.31) | | | | | | | |
| GMMALKIVK | A0301(64.51) | A1101(35.13) | | | | | | |
| RYMGEDGCW | A2402(385.75) | | | | | | | |
| RPTFAAGLF | B0702(64.85) | | | | | | | |
| YSIPATLLV | A0201(76.81) | | | | | | | |
| AAWYLWETK | A0301(403.97) | A1101(32.25) | | | | | | |
| MVLSIASLF | B1501(107.04) | | | | | | | |
| ALWYIWQVK | A0301(57.57) | A1101(82.26) | | | | | | |
| LIFILLTAV | A0201(46.34) | | | | | | | |
| NGRKRSTIT | B0801(278.35) | | | | | | | |

FIG. 48-62

| Peptide | HLA (nM) | HLA (nM) | Peptide | HLA (nM) | HLA (nM) | HLA (nM) |
|---|---|---|---|---|---|---|
| GPMPVTAAS | B0702(116.09) | | | | | |
| KLRDVYTQL | A0201(61.05) | | | | | |
| MCSGTFVLK | A1101(120.57) | | | | | |
| CTLPPLRFK | A0301(129.01) | A1101(14.73) | | | | |
| LSKSEFNIY | B1501(164.92) | | | | | |
| LYSGKDVFF | A2402(127.08) | | | | | |
| QLAYVVIGL | A0201(54.75) | | | | | |
| LAMGIMMLK | A0301(59.94) | A1101(6.15) | | | | |
| YLDYMTSMK | A0301(279.89) | A1101(322.14) | | | | |
| ATFKIQPFL | A0201(473.94) | | | | | |
| SILLWHAQI | A0201(294.24) | | | | | |
| MLLMLLPTV | A0201(7.54) | | | | | |
| STVSQLAKR | A1101(81.04) | | | | | |
| AIKVLRGFK | A0301(339.32) | A1101(126.14) | | | | |
| VFRKRNLTI | B0801(49.50) | | | | | |
| MNNQRKKTA | B0801(372.24) | | | | | |
| PLNEGVMAV | A0201(78.51) | | | | | |
| KTLKLSWFK | A0301(10.78) | A1101(3.15) | | | | |
| IMIEEVMRS | A0201(452.07) | | | | | |
| YYTQTAGPW | A2402(143.31) | | | | | |
| HTWLVREGR | A1101(245.59) | | | | | |
| VLMMRTTWA | A0201(60.25) | | | | | |
| GGCVTTMAK | A1101(350.76) | | | | | |
| WVTLLSLTF | B1501(202.24) | | | | | |
| VLLIPEPEK | A0301(255.72) | A1101(295.85) | | | | |
| ATLLSLTFV | A0201(62.82) | | | | | |
| ALKGMPIRY | A0301(339.52) | B1501(475.97) | | | | |
| TWRDMAHTF | A2402(100.70) | | | | | |
| TAEVHWNYK | A1101(97.54) | | | | | |

FIG. 48-63

| Peptide | HLA (nM) | HLA (nM) | HLA (nM) | HLA (nM) | HLA (nM) |
|---|---|---|---|---|---|
| QPHQLWITL | B0702(159.07) | | | | |
| HFQRVLIFI | A2402(285.66) | | | | |
| ITAEWLWRT | A0201(490.20) | | | | |
| MTTEDMLTV | A0201(196.53) | | | | |
| ALNELPESL | A0201(40.97) | | | | |
| GMVSILASS | A0201(299.09) | | | | |
| RVISSTPFA | A0201(178.66) | | | | |
| SVLLWMASV | A0201(13.74) | | | | |
| LARVGRERL | B0702(358.52) | | | | |
| MLKRVRNRV | B0801(53.89) | | | | |
| AAAWYLWET | A0201(300.02) | | | | |
| QPKLGTRVV | B0702(367.91) | | | | |
| YVSAIAQAK | A0301(436.17) | A1101(52.59) | | | |
| FTDPCSVAA | A0201(142.86) | | | | |
| KIVQHENLK | A0301(294.00) | A1101(118.37) | | | |
| LMLLPTVLA | A0201(260.44) | | | | |
| VAGILAQGK | A1101(432.71) | | | | |
| LLGAMTAGT | A0201(198.16) | | | | |
| VMLFVHYAI | A0201(43.20) | A2402(499.07) | | | |
| EAIKRRLRT | B0801(479.19) | | | | |
| CSGKFSIGK | A0301(313.77) | A1101(31.06) | | | |
| KALRINWYK | A0301(46.60) | A1101(7.80) | | | |
| SQLCDHRLM | B1501(365.77) | | | | |
| MGLGRGWPL | B0801(28.34) | | | | |
| SSWEEVPYL | A0201(203.54) | | | | |
| MSAAIKDQK | A1101(17.58) | | | | |
| NSRSTSFSM | B1501(188.93) | | | | |
| TMKEKSWLV | A0201(41.64) | | | | |
| TQAAGPWHL | A0201(142.96) | | | | |

FIG. 48-64

| Peptide | HLA (nM) | HLA (nM) | Peptide | HLA (nM) | HLA (nM) | HLA (nM) |
|---|---|---|---|---|---|---|
| TMTHRRPTI | B0801(59.69) | | | | | |
| QYSDRRWCF | A2402(119.40) | | | | | |
| RLITVNPIA | A0201(394.03) | | | | | |
| CAMFTCLKK | A0301(130.84) | A1101(17.29) | | | | |
| VVVATLCAI | A0201(366.08) | | | | | |
| GVTTITPR | A1101(159.99) | | | | | |
| GSLIGLTAR | A1101(236.05) | | | | | |
| LMYFHRRDL | B0801(52.67) | | | | | |
| HPGFTVTAF | B0702(98.97) | | | | | |
| ATWASNIQV | A0201(197.38) | | | | | |
| MVSRLLLNR | A0301(213.16) | A1101(25.04) | | | | |
| GLITLYLGV | A0201(13.29) | | | | | |
| RSEAKEGLK | A1101(464.18) | | | | | |
| CLVMILPAA | A0201(209.54) | | | | | |
| RVIDLGCGR | A1101(445.11) | | | | | |
| CAKFSCSGK | A0301(483.90) | A1101(265.90) | | | | |
| TARPSFNML | B0702(280.18) | | | | | |
| LLTAVTPSM | A0201(116.43) | B1501(114.98) | | | | |
| ISNITTATR | A1101(428.88) | | | | | |
| LAVFLLLVM | B1501(381.59) | | | | | |
| GMGKLSMGL | A0201(237.21) | | | | | |
| MVLSIVSLF | B1501(74.38) | | | | | |
| RTVFFVLMM | B1501(267.18) | | | | | |
| MSYSMCTGK | A0301(19.45) | A1101(5.38) | | | | |
| LAMAATLRL | B1501(348.44) | | | | | |
| YLALMATFK | A0301(99.53) | A1101(93.61) | | | | |
| GTIVIRVQY | A1101(245.90) | | | | | |
| KKMIRPQPM | B0801(373.57) | | | | | |
| MILMKMRKK | A0301(100.38) | A1101(81.13) | | | | |

FIG. 48-65

| Peptide | HLA (nM) | HLA (nM) | Peptide | HLA (nM) | HLA (nM) | HLA (nM) |
|---|---|---|---|---|---|---|
| VGAIALDFK | A1101(324.73) | | | | | |
| QLAVTVMAI | A0201(191.64) | | | | | |
| YVILTILAI | A0201(83.84) | | | | | |
| VATTFVTPM | B1501(234.88) | | | | | |
| LGAMTAGTF | B1501(169.36) | | | | | |
| KLRDSYTQV | A0201(45.01) | | | | | |
| GQMEGRHKK | A1101(89.84) | | | | | |
| RMVMTTTAN | B1501(335.35) | | | | | |
| AMCTNTFVL | A0201(163.02) | | | | | |
| KIPGGNMYA | A0201(406.05) | | | | | |
| STNIWLKLR | A1101(117.24) | | | | | |
| GGITLFLGF | B1501(410.38) | | | | | |
| TLLSLTFIR | A1101(279.67) | | | | | |
| WKLARASFI | B0801(374.23) | | | | | |
| TPRSPSVEV | B0702(28.79) | | | | | |
| MLMTGTLVV | A0201(4.60) | B1501(249.75) | | | | |
| FLAGFMAYM | A0201(3.52) | B1501(310.79) | | | | |
| GGLFTSVGK | A1101(290.08) | | | | | |
| SMTCIVVGM | A0201(187.49) | | | | | |
| VPSLPLFIF | B0702(411.39) | | | | | |
| TLMAAILAY | A0301(108.47) | A1101(101.32) | B1501(31.34) | | | |
| DVFFTPPEK | A1101(151.60) | | | | | |
| RGRIGRNPA | B0702(286.40) | | | | | |
| LMLLPTTLA | A0201(255.17) | | | | | |
| MIRILIGLL | B0801(205.40) | | | | | |
| WFLDLPLPW | A2402(327.15) | | | | | |
| KAYAQMWSL | A0201(184.21) | | | | | |
| SPAATQKAT | B0702(233.48) | | | | | |
| TLTAALFLL | A0201(18.32) | | | | | |

FIG. 48-66

| Peptide | HLA (nM) | HLA (nM) | HLA (nM) | Peptide | HLA (nM) | HLA (nM) | HLA (nM) |
|---|---|---|---|---|---|---|---|
| KLTLKGVSY | B1501(232.10) | | | | | | |
| TPQAPMTEI | B0702(330.34) | | | | | | |
| AVEDEDFWK | A1101(215.38) | | | | | | |
| GPSLRTTTA | B0702(137.13) | B0801(487.83) | | | | | |
| NIQTAITQV | A0201(282.57) | | | | | | |
| YIGTSLTQK | A0301(202.21) | A1101(53.21) | | | | | |
| AMVLSIASL | A0201(63.59) | B1501(257.22) | | | | | |
| VLLVAVSFM | A0201(469.74) | | | | | | |
| RQMEGEGIF | B1501(17.52) | | | | | | |
| TMTHRKPTY | B1501(432.17) | | | | | | |
| KVASAGISY | A0301(187.98) | A1101(56.26) | B1501(41.54) | | | | |
| IFRKRRLTI | B0801(31.20) | | | | | | |
| TYLALMATF | A2402(16.33) | | | | | | |
| LTAAVLMLL | A0201(93.48) | | | | | | |
| CIWPKSHTL | A0201(170.58) | | | | | | |
| ALLSLTFIK | A0301(43.05) | A1101(19.08) | | | | | |
| RIISSTPLA | A0201(410.53) | | | | | | |
| FQDGVFHTM | A0201(14.96) | | | | | | |
| TMFLITETK | A0301(36.18) | A1101(10.39) | | | | | |
| IPKIYGGPT | B0702(188.57) | | | | | | |
| AVVLMGLDK | A1101(254.37) | | | | | | |
| SLVMLLVHY | B1501(96.78) | | | | | | |
| VIGTSITQK | A0301(106.05) | A1101(30.66) | | | | | |
| FTNMEAQLV | A0201(417.98) | | | | | | |
| LIDGISLGL | A0201(91.30) | | | | | | |
| VERLKRMAI | B0801(479.14) | | | | | | |
| LMSGKGIGK | A0301(115.22) | A1101(163.61) | | | | | |
| CNKVRSNAA | B0801(84.80) | | | | | | |
| NPTTLIASL | B0702(189.36) | | | | | | |

FIG. 48-67

| Peptide | HLA (nM) | HLA (nM) | HLA (nM) | Peptide | HLA (nM) | HLA (nM) | HLA (nM) |
|---|---|---|---|---|---|---|---|
| SLVMLFVHY | B1501(58.43) | | | | | | |
| LVKRFSTGL | B0801(250.60) | | | | | | |
| LQRKFGGAL | B0702(255.24) | B0801(308.63) | B1501(34.72) | | | | |
| QILEENVEV | A0201(75.75) | | | | | | |
| TILVKVEYK | A0301(119.91) | A1101(12.52) | | | | | |
| TQMCDHRLM | B1501(204.38) | | | | | | |
| RQLNSLDRK | A0301(477.76) | A1101(85.75) | | | | | |
| QVIAVEPGK | A1101(147.53) | | | | | | |
| TILIRTGLL | B0801(460.61) | | | | | | |
| SQHNHRPGY | B1501(27.65) | | | | | | |
| MSLGNILFM | B1501(189.40) | | | | | | |
| AAVLMGLGK | A1101(232.87) | | | | | | |
| ILLTAVAPS | A0201(321.67) | | | | | | |
| ALFLEEMLR | A1101(358.66) | | | | | | |
| YILRDVGKK | A1101(299.74) | | | | | | |
| SPAAAQKAT | B0702(179.29) | | | | | | |
| SQLAKRFSR | A1101(347.85) | | | | | | |
| RMKKKTWLV | A0201(267.14) | B0801(128.15) | | | | | |
| ALMVIGMAM | A0201(211.15) | B1501(249.17) | | | | | |
| GILTLAATI | A0201(357.95) | | | | | | |
| MWHVTRGAV | B0801(365.98) | | | | | | |
| RSCTLPPLR | A1101(190.38) | | | | | | |
| SQHNNRPGY | B1501(60.68) | | | | | | |
| VILAGPMPV | A0201(17.41) | | | | | | |
| GLFKTSTGT | A0201(435.25) | | | | | | |
| MVLLQMENK | A0301(252.98) | A1101(18.33) | | | | | |
| VMKRYSAHF | B1501(9.48) | | | | | | |
| TSGSPIINK | A1101(28.18) | | | | | | |
| TPEARNNTF | B0702(138.27) | | | | | | |

FIG. 48-68

| Peptide | HLA (nM) | HLA (nM) | Peptide | HLA (nM) | HLA (nM) | HLA (nM) |
|---|---|---|---|---|---|---|
| AILTIIGLV | A0201(123.49) | | | | | |
| VSAIAQTEK | A1101(38.51) | | | | | |
| ILIRTGLLV | A0201(100.61) | | | | | |
| AVQNWLTRV | A0201(40.80) | | | | | |
| KQPATLRKF | B1501(478.21) | | | | | |
| VVRPPFNML | B0702(219.44) | | | | | |
| KLKERQDVF | B1501(86.00) | | | | | |
| TPQSSTTEA | B0702(444.60) | | | | | |
| VLCAVQLLL | A0201(146.43) | | | | | |
| IMAVGVVSI | A0201(45.15) | B1501(216.35) | | | | |
| QVDNFSLGV | A0201(218.02) | | | | | |
| CLNAFVLKK | A0301(27.62) | A1101(18.96) | | | | |
| MWRQISNEL | B0801(111.73) | | | | | |
| IANQATVLM | B1501(242.68) | | | | | |
| IPKIYGGPM | B0702(8.11) | B0801(329.97) | | | | |
| TLPTYLSSK | A0301(179.07) | A1101(69.97) | | | | |
| EVMRGKFGK | A1101(94.15) | | | | | |
| RQMEGEGLF | B1501(17.43) | | | | | |
| WTMKIEIGV | A0201(65.93) | | | | | |
| TIGTTYFQR | A1101(48.85) | | | | | |
| GMVTLYLGV | A0201(18.98) | | | | | |
| WLKLREVYT | B0801(192.92) | | | | | |
| KLREKQDAF | B1501(61.08) | | | | | |
| AVKNWLIRV | A0201(431.21) | | | | | |
| MPIRYQTTA | B0702(141.79) | B0801(138.48) | | | | |
| GILCASIMI | A0201(376.35) | | | | | |
| MTTVFSIPH | A1101(323.20) | | | | | |
| LMMVLPAAL | A0201(22.95) | B0801(461.95) | B1501(210.06) | | | |
| SQHNYRQGY | B1501(25.46) | | | | | |

FIG. 48-69

| Peptide | HLA (nM) | HLA (nM) | HLA (nM) | Peptide | HLA (nM) | HLA (nM) | HLA (nM) |
|---|---|---|---|---|---|---|---|
| ILLTGGAML | A0201(125.59) | | | | | | |
| AISCVPNAV | A0201(103.66) | | | | | | |
| SKSEFNTYK | A1101(232.24) | | | | | | |
| ITNITTDSR | A1101(399.81) | | | | | | |
| GAIFTDENK | A1101(408.46) | | | | | | |
| RTWAYHGSY | A0301(193.56) | A1101(112.10) | B1501(138.60) | | | | |
| TILTIALV | A0201(19.82) | | | | | | |
| TLEARNSTF | B1501(429.91) | | | | | | |
| SLIGDEEFL | A0201(78.10) | | | | | | |
| GQPSFNMLK | A1101(83.63) | | | | | | |
| IIMLTPTVM | B1501(179.68) | | | | | | |
| RLRMDKLQL | B0702(208.98) | B0801(324.79) | | | | | |
| IQNSGGTNI | B1501(198.25) | | | | | | |
| TMLLMLVPT | A0201(312.68) | | | | | | |
| LTAAVLLLI | A0201(185.76) | | | | | | |
| SIGGLFTSV | A0201(68.97) | | | | | | |
| KMLMTGTLV | A0201(29.18) | | | | | | |
| VLVGIVTLY | B1501(394.51) | | | | | | |
| IQRTVFFVL | B1501(281.55) | | | | | | |
| RTLRVLSLV | A0201(213.71) | | | | | | |
| CTGLFKLEK | A0301(404.17) | A1101(22.17) | | | | | |
| VVIGLLFMI | A0201(98.42) | | | | | | |
| RKRSVTMIL | B0702(474.77) | | | | | | |
| KIIQWLETK | A0301(114.37) | A1101(20.90) | | | | | |
| CTLPPLRYR | A1101(83.73) | | | | | | |
| IPMVTQMAM | B0702(10.78) | | | | | | |
| FLLVAHYAI | A0201(5.48) | B0801(346.56) | | | | | |
| GAIKVLKGF | B1501(484.05) | | | | | | |
| PVMRRYSAL | B0801(49.51) | | | | | | |

FIG. 48-70

| Peptide | HLA (nM) | HLA (nM) | HLA (nM) | Peptide | HLA (nM) | HLA (nM) | HLA (nM) |
|---|---|---|---|---|---|---|---|
| SLTCSNTIF | B1501(50.09) | | | | | | |
| LSSRATWAK | A0301(253.03) | A1101(24.39) | | | | | |
| VVLEHGSCV | A0201(384.19) | | | | | | |
| MIGSNASDK | A0301(278.37) | A1101(85.55) | | | | | |
| CVTTMAKNK | A1101(235.34) | | | | | | |
| WAKNIQTAI | B0801(260.03) | | | | | | |
| SQSAIPETV | A0201(83.61) | | | | | | |
| KQLGQIMLL | A0201(19.93) | | | | | | |
| AVEDEEFWK | A1101(172.21) | | | | | | |
| LLKATLLAI | A0201(146.06) | B0801(77.91) | B1501(170.66) | | | | |
| SLTQKAVIF | B1501(456.52) | | | | | | |
| LTAVVLLLV | A0201(220.42) | | | | | | |
| TLLCLIPTA | A0201(33.41) | | | | | | |
| SLGILCVSI | A0201(391.46) | | | | | | |
| TMAMILSIV | A0201(47.73) | | | | | | |
| LTLKGVSYV | A0201(58.24) | | | | | | |
| TPTWNRKEL | B0702(45.57) | | | | | | |
| IMTTTANWL | A0201(266.00) | | | | | | |
| KTVWFVPSI | A0201(50.66) | | | | | | |
| GLFGKGSLV | A0201(57.53) | | | | | | |
| SMAMTCITV | A0201(21.74) | | | | | | |
| TLAVFLLLT | A0201(275.35) | | | | | | |
| IVVGMVTLY | B1501(219.27) | | | | | | |
| TMLLMLIPT | A0201(375.66) | | | | | | |
| TTANWLWTL | A0201(55.30) | | | | | | |
| MWKQITSEL | A2402(390.51) | B0801(111.40) | | | | | |
| WLWTLLGKK | A0301(224.14) | A1101(326.79) | | | | | |
| TPRGTVMDI | B0702(234.80) | | | | | | |
| ILLAAVSFV | A0201(6.69) | | | | | | |

FIG. 48-71

| Peptide | HLA (nM) | HLA (nM) | Peptide | HLA (nM) | HLA (nM) | HLA (nM) |
|---|---|---|---|---|---|---|
| GVFPVSIPI | A0201(99.08) | | | | | |
| ATWAKNIQV | A0201(289.45) | | | | | |
| ITYKCPLLK | A0301(12.24) | A1101(5.99) | | | | |
| STMTLLCLI | A0201(129.23) | | | | | |
| IMAAILAYT | A0201(10.50) | | | | | |
| IVFFVLMML | A0201(289.55) | | | | | |
| SLIEVKTCL | A0201(75.94) | | | | | |
| RSVSTETEK | A1101(54.45) | | | | | |
| LLARSIFKL | A0201(13.12) | | | | | |
| MTLGMCCIV | A0201(420.04) | | | | | |
| CVMASSVLL | A0201(267.81) | | | | | |
| ALCESITLA | A0201(40.74) | | | | | |
| QPQWIAASI | B0702(264.02) | | | | | |
| AVVSVSPLF | B1501(149.16) | | | | | |
| SVSLVLVGV | A0201(83.83) | | | | | |
| TANPIVTKK | A1101(22.11) | | | | | |
| FLDLPLPWA | A0201(15.16) | | | | | |
| TTNIWLRLK | A0301(182.61) | A1101(11.18) | | | | |
| WFFDLPLPW | A2402(180.76) | | | | | |
| YVLGVFLRK | A0301(100.18) | A1101(11.60) | | | | |
| GLYPLAIPV | A0201(4.48) | | | | | |
| ALLKNDVPL | A0201(123.37) | | | | | |
| SLGGVFTSV | A0201(10.47) | | | | | |
| TMGPWHLGK | A0301(53.14) | A1101(13.37) | | | | |
| TYLALIATF | A2402(12.43) | | | | | |
| VSTPQGLVK | A1101(232.44) | | | | | |
| DLRLASMAI | B0801(70.65) | | | | | |
| AIFLTTLSR | A0301(84.73) | A1101(30.36) | | | | |
| KALKINWYR | A1101(68.48) | | | | | |

FIG. 48-72

| Peptide | HLA (nM) | HLA (nM) | HLA (nM) | Peptide | HLA (nM) | HLA (nM) | HLA (nM) |
|---|---|---|---|---|---|---|---|
| NSKNTSMSF | B1501(64.07) | | | | | | |

FIG. 49-1

| Peptide | HLA(nM) | HLA(nM) | HLA(nM) | Peptide | HLA(nM) | HLA(nM) | HLA(nM) |
|---|---|---|---|---|---|---|---|
| MLKRERNRV | B0801(70.36) | | | RVYADPMAL | A0201(249.30) | B0702(299.24) | |
| LAKRFSKGL | B0801(491.52) | | | AYNHALSEL | A2402(152.19) | | |
| GPMKLVMAF | B0702(35.43) | | | IASAIVLEF | B1501(144.74) | | |
| KLVMAFIAF | B1501(18.59) | | | IILEFFLIV | A0201(61.44) | | |
| LVMAFIAFL | A0201(13.07) | | | QLAYVIGL | A0201(54.75) | | |
| IAFLRFLAI | B0801(20.98) | | | TLYAVATTV | A0201(9.98) | | |
| PTLDFELIK | A1101(347.86) | | | SLAAIANQA | A0201(68.01) | | |
| WLVHKQWFL | A0201(8.86) | | | NQAAVLMGL | A0201(34.71) | | |
| KQWFLDLPL | A0201(34.38) | B1501(88.64) | | AAILMGLDK | A1101(306.73) | | |
| WFLDLPLPW | A2402(327.15) | | | MGLDKGWPI | B0801(312.26) | | |
| VTFKTAHAK | A0301(39.95) | A1101(5.64) | | KQLGQIMLL | A0201(19.93) | | |
| AMHTALTGA | A0201(35.27) | | | LLLMRTTWA | A0201(242.92) | B0801(420.95) | |
| ARGARRMAI | B0801(430.45) | | | LMMRTTWAL | A0201(4.23) | B0801(88.43) | B1501(60.20) |
| FQADSPKRL | A0201(408.01) | | | IAVSTANIF | B1501(60.49) | | |
| SPKRLSAAI | B0702(28.55) | B0801(49.29) | | AVSTANIFR | A1101(23.01) | | |
| KAVHADMGY | B1501(114.20) | | | TANIFRGSY | B1501(390.92) | | |
| WPKSHTLWS | B0702(225.83) | | | YLAGAGLLF | B1501(38.67) | | |
| SQHNYRPGY | B1501(26.29) | | | AGLLFSIMK | A1101(308.96) | | |
| GPSLRTTTA | B0702(137.13) | B0801(487.83) | | HAVSRGTAK | A1101(294.25) | | |
| RSCTLPPLR | A1101(190.38) | | | WSYYCGGLK | A0301(74.56) | A1101(23.56) | |
| CLQKQSHWV | A0201(94.51) | | | STYGWNLVR | A0301(109.87) | A1101(9.10) | |
| PLNEGIMAV | A0201(45.66) | | | TYGWNLVRL | A2402(88.06) | | |
| SILASSLLK | A0301(14.96) | A1101(4.26) | | RLQSGVDVF | B1501(67.32) | | |
| ALLKNDVPL | A0201(123.37) | | | VLNPYMPSV | A0201(4.00) | | |
| GPLVAGGLL | B0702(131.63) | | | MTSRMLLNR | A0301(176.96) | A1101(9.48) | |
| SSADLSLEK | A0301(153.23) | A1101(7.79) | | RTWAYHGSY | A0301(193.56) | A1101(112.10) | B1501(138.60) |
| GVFHTMWHV | A0201(12.38) | | | SSMVNGVVR | A1101(144.34) | | |
| MWHVTRGAV | B0801(365.98) | | | SMVNGVVRL | A0201(42.07) | B1501(260.95) | |
| QVIAVEPGK | A1101(147.53) | | | RLLTKPWDV | A0201(31.30) | | |
| KPGTSGSPI | B0702(20.50) | | | LAMTDTTPF | B1501(6.56) | | |

FIG. 49-2

| Peptide | HLA(nM) | HLA(nM) | HLA(nM) | Peptide | HLA(nM) | HLA(nM) | HLA(nM) |
|---|---|---|---|---|---|---|---|
| FRKKRLTIM | B0801(17.88) | | | KLGEFGRAK | A0301(93.15) | | |
| LPAIVREAI | B0702(40.89) | | | YMWLGARYL | A0201(16.36) | | |
| RTLILAPTR | A1101(139.37) | | | WLGARYLEF | B0801(425.90) | B1501(111.53) | |
| TLILAPTRV | A0201(108.46) | | | GFMNEDHWF | A2402(87.51) | | |
| ALRGLPIRY | A0301(230.10) | B1501(275.79) | | FMNEDHWFS | A0201(15.43) | | |
| LPIRYQTPA | B0702(122.75) | B0801(219.80) | | IYADDTAGW | A2402(301.32) | | |
| LMCHATFTM | A0201(78.34) | B1501(16.53) | | LTYQNKVVK | A0301(232.83) | A1101(57.78) | |
| ATFTMRLLS | A1101(381.77) | | | AVMDIISRK | A0301(55.49) | A1101(5.82) | |
| VPNYNLIIM | B0702(77.67) | | | KSYAQMWQL | A0201(493.27) | | |
| LIIMDEAHF | B1501(65.38) | | | YAQMWQLMY | B1501(280.76) | | |
| IIMDEAHFT | A0201(151.86) | | | AQMWQLMYF | A0201(169.20) | A2402(322.91) | B1501(26.98) |
| FTDPASIAA | A0201(209.24) | | | DLRLASMAI | B0801(70.65) | | |
| FMTATPPGS | A0201(331.42) | | | GSLIGLSSR | A1101(236.95) | | |
| KTVWFVPSI | A0201(50.66) | | | SLIGLSSRA | A0201(455.24) | | |
| TVWFVPSIK | A0301(71.41) | A1101(10.96) | | MLKRVRNRV | B0801(53.89) | | |
| KTFDTEYQK | A0301(59.69) | A1101(5.41) | | LTKRFSLGM | B1501(277.85) | | |
| RVIDPRRCL | B0702(137.16) | | | GPLKLFMAL | B0702(51.11) | B0801(173.42) | |
| VIDPRRCLK | A0301(228.53) | A1101(53.66) | | KLFMALVAF | A0201(430.68) | B1501(21.11) | |
| VILAGMPV | A0201(17.41) | | | LFMALVAFL | A0201(414.40) | | |
| MPVTVASAA | B0702(60.34) | | | VAFLRFLTI | B0801(70.65) | | |
| ALFEPEREK | A0301(148.73) | A1101(241.61) | | PTLDIELQK | A1101(220.59) | | |
| EARKTFVDL | B0801(147.46) | | | WLVHRQWFL | A0201(8.34) | B0801(120.87) | |
| KTFVELMRR | A0301(181.49) | A1101(18.29) | | RQWFLDLPL | A0201(52.71) | B1501(87.91) | |
| LMRRGDLPV | A0201(202.72) | B0801(251.95) | B1501(253.27) | WFLNLPLPW | A2402(183.12) | | |
| KVASAGISY | A0301(187.98) | A1101(56.26) | B1501(41.54) | VTFKVPHAK | A0301(42.31) | A1101(5.39) | |
| RPRWLDART | B0702(75.25) | | | AMHSALTGA | A0201(21.93) | | |
| RTYSDPLAL | B1501(449.83) | | | MRGAKRMAI | B0801(42.62) | | |
| AYQHALNEL | A2402(38.25) | | | FQPESPSKL | A0201(289.63) | | |
| IAASIILEF | B1501(103.06) | | | SPARLASAI | B0702(17.47) | | |
| IILEFFLMV | A0201(27.72) | | | WPRSHTLWS | B0702(19.38) | | |

FIG. 49-3

| Peptide | HLA(nM) | HLA(nM) | HLA(nM) | Peptide | HLA(nM) | HLA(nM) | HLA(nM) |
|---|---|---|---|---|---|---|---|
| QLTYVVIAI | A0201(336.70) | | | SQHNHRPGY | B1501(27.65) | | |
| ASAWTLYAV | A0201(35.38) | | | PLNEAIMAV | A0201(48.52) | A1101(6.85) | |
| TLYAVATTI | A0201(30.94) | | | SILLSSLLK | A0301(22.35) | | |
| SLTAIANQA | A0201(395.48) | | | SLLKNDVPL | A0201(121.79) | | |
| NQATVLMGL | A0201(67.13) | | | GPLIAGGML | B0702(80.54) | | |
| AAVLMGLGK | A1101(232.87) | | | TSADLTVEK | A1101(15.47) | | |
| MGLGKGWPL | B0801(125.60) | | | NVFHTMWHV | A0201(12.91) | | |
| IIGPGLQAK | A0301(418.97) | A1101(159.42) | | QVLAIEPGK | A1101(135.22) | | |
| LQAKATREA | B1501(370.61) | | | FRKRNLTIM | B0801(278.95) | | |
| KQLGQVMLL | A0201(37.87) | | | LPAIIREAI | B0702(39.82) | | |
| VLMMRTTWA | A0201(60.25) | | | ALKGLPIRY | A0301(262.43) | | |
| LLMRTTWAL | A0201(4.46) | B0801(132.64) | B1501(280.13) | MPIRYQTTA | B0702(141.79) | B0801(138.48) | |
| IAVSMANIF | B1501(80.67) | | | VPNYNMIIM | B0702(89.73) | | |
| AVSMANIFR | A1101(26.40) | | | MIIMDEAHF | B1501(32.27) | | |
| MANIFRGSY | B1501(95.62) | | | VIMDEAHFT | A0201(177.75) | | |
| NIFRGSYLA | A0201(393.56) | | | FTDPSSIAA | A0201(342.48) | | |
| YLAGAGLAF | A0201(408.06) | B1501(16.75) | | FMTATPPGA | A0201(19.18) | | |
| AGLAFSLIK | A1101(194.74) | | | KTFDSEYVK | A0301(51.48) | A1101(7.19) | |
| HAVSRGSAK | A1101(361.70) | | | MPVTHSSAA | B0702(8.88) | B0801(437.31) | |
| CGRGGWSYY | B1501(392.73) | | | SMFEPEREK | A0301(67.31) | A1101(42.82) | |
| WSYYCAGLK | A0301(64.46) | A1101(19.37) | | EARKTFVEL | B0801(57.08) | | |
| ATYGWNLVK | A0301(13.46) | A1101(3.61) | | KTFVELMKR | A0301(319.67) | A1101(24.53) | |
| TYGWNLVKL | A2402(87.53) | | | KVASEGIKY | A1101(109.21) | B1501(321.48) | |
| KLHSGVDVF | B1501(29.85) | | | RPRWLDARV | B0702(24.82) | | |
| VLNPYMPTV | A0201(4.30) | | | RIYSDPLAL | A0201(336.25) | B1501(320.40) | |
| LSRNSTHEM | B1501(33.41) | | | AYRHAMEEL | A2402(303.31) | | |
| MISRMLINR | A0301(153.97) | A1101(23.11) | | IVLEFFMMV | A0201(23.17) | | |
| KTWAYHGSY | A0301(149.72) | A1101(81.98) | B1501(190.24) | QLIYVILTI | A0201(78.05) | | |
| SSMVNGVVK | A0301(351.17) | A1101(20.68) | | TLYAVATTF | B1501(42.24) | | |
| SMVNGVVKL | A0201(50.35) | B1501(329.70) | | NQAAILMGL | A0201(29.86) | | |

FIG. 49-4

| Peptide | HLA(nM) | HLA(nM) | HLA(nM) | Peptide | HLA(nM) | HLA(nM) | HLA(nM) |
|---|---|---|---|---|---|---|---|
| KLLTKPWDV | A0201(13.07) | | | ATVLMGLGK | A1101(31.85) | | |
| MAMTDTTPF | B1501(4.41) | | | MGLGRGWPL | B0801(28.34) | | |
| TPFGQQRVF | B0702(286.72) | | | ILLMRTTWA | A0201(310.60) | | |
| CVYNMMGKR | A1101(130.45) | | | LLMRTTWAF | A0201(115.88) | B0801(394.43) | B1501(16.29) |
| MMGKREKKL | B0801(160.14) | | | AGLAFSLMK | A1101(85.72) | | |
| KLGEFGKAK | A0301(145.33) | | | HAVSRGSSK | A1101(269.68) | | |
| AIWYMWLGA | A0201(147.07) | | | WSYYMATLK | A0301(39.14) | A1101(9.72) | |
| YMWLGARFL | A0201(23.81) | | | STYGWNIVK | A0301(13.74) | A1101(3.20) | |
| WLGARFLEF | B0801(121.98) | B1501(54.33) | | TYGWNIVKL | A2402(100.27) | | |
| GFLNEDHWF | A2402(163.46) | | | KLMSGKDVF | B1501(63.47) | | |
| FLNEDHWFS | A0201(12.84) | | | ILNPYMPSV | A0201(3.98) | | |
| MYADDTAGW | A2402(361.34) | | | MVSRLLLNR | A0301(213.16) | A1101(25.04) | |
| LTYQNKVVR | A1101(491.82) | | | SSMINGVVK | A0301(282.98) | A1101(19.10) | |
| TVMDIISRK | A0301(64.83) | A1101(5.26) | | SMINGVVKL | A0201(18.28) | B1501(184.37) | |
| KAYAQMWSL | A0201(184.21) | | | IAMTDTTPF | B1501(7.10) | | |
| YAQMWSLMY | B1501(96.88) | | | FLNEDHWFG | A0201(59.94) | | |
| AQMWSLMYF | A0201(88.83) | A2402(168.86) | B1501(8.96) | TVMDVISRR | A1101(16.58) | | |
| LMYFHRRDL | B0801(52.67) | | | KSYAQMWSL | A0201(367.52) | | |
| YFHRRDLRL | B0801(90.59) | | | YAQMWTLMY | B1501(101.89) | | |
| DLRLAANAI | B0801(305.90) | | | AQMWTLMYF | A0201(77.75) | A2402(143.11) | B1501(11.42) |
| GSLIGLTSR | A1101(223.58) | | | DLRLASNAI | B0801(151.44) | | |
| SLIGLTSRA | A0201(293.20) | | | GSLIGLTAR | A1101(236.05) | | |
| MLKRARNRV | B0801(42.71) | | | SLIGLTARA | A0201(85.26) | | |
| LVKRFSTGL | B0801(250.60) | | | LAKRFSRGL | B0801(280.77) | | |
| GPLRMVLAF | B0702(57.11) | | | GPMKMVMAF | B0702(17.59) | | |
| RMVLAFITF | B1501(26.86) | | | KMVMAFIAF | B1501(7.99) | | |
| MVLAFITFL | A0201(13.32) | | | MVMAFIAFL | A0201(4.94) | B0801(265.02) | B1501(358.49) |
| ITFLRVLSI | B0801(184.87) | | | PTLDFELTK | A1101(112.15) | B1501(68.49) | |
| PTLDIELLK | A1101(117.45) | | | KQWFLNLPL | A0201(27.65) | | |
| WMVHRQWFF | A2402(401.31) | B0801(443.13) | B1501(55.70) | VTFKNPHAK | A0301(73.47) | A1101(8.50) | |

FIG. 49-5

| Peptide | HLA(nM) | HLA(nM) | HLA(nM) | Peptide | HLA(nM) | HLA(nM) | HLA(nM) |
|---|---|---|---|---|---|---|---|
| RQWFFDLPL | A0201(25.45) | B1501(55.68) | | FQPESPARV | A0201(19.14) | | |
| WFFDLPLPW | A2402(180.76) | | | SPKRLATAI | B0702(38.74) | B0801(124.57) | |
| VTFKNAHAK | A0301(62.13) | A1101(7.80) | | SQHNNRPGY | B1501(60.68) | | |
| AMHSALAGA | A0201(19.22) | | | PLNEGIMAI | A0201(205.37) | | |
| YRGAKRMAI | B0801(132.01) | | | SILASSLLR | A0301(132.56) | A1101(12.76) | |
| FQPESPARL | A0201(77.58) | | | SLLRNDVPM | B1501(340.72) | | |
| SPSKLASAI | B0702(14.75) | | | RSADLELEK | A0301(238.85) | A1101(19.89) | |
| RAVHADMGY | B1501(93.17) | | | FRKRRLTIM | B0801(15.67) | | |
| WPKTHTLWS | B0702(373.55) | | | VPNYNLVIM | B0702(86.10) | | |
| SQHNYRQGY | B1501(25.46) | | | LVIMDEAHF | B1501(82.63) | | |
| GPSLRTTTV | B0702(53.49) | B0801(369.78) | | FTDPCSVAA | A0201(142.86) | | |
| RSCTMPPLR | A1101(123.69) | | | KTFDSEYIK | A0301(71.55) | A1101(8.59) | |
| CLQKQSHWI | A0201(480.21) | | | MPVTAASAA | B0702(41.32) | | |
| PLNEGVMAV | A0201(78.51) | | | ESRKTFVEL | B0801(190.03) | | |
| SLLGSALLK | A0301(19.57) | A1101(8.98) | | KVAAEGINY | A0301(356.41) | A1101(82.55) | B1501(193.13) |
| SLLKNDIPM | A0201(413.80) | B1501(181.37) | | RPKWLDARV | B0702(205.55) | | |
| GPMVAGGLL | B0702(31.36) | | | AYRHAVEEL | A2402(335.32) | | |
| RSADLELER | A1101(147.23) | | | QLAYVVIGI | A0201(64.17) | | |
| GTFHTMWHV | A0201(28.38) | | | NQAVVLMGL | A0201(171.31) | | |
| MWHVTRGSV | B0801(391.93) | | | AVVLMGLDK | A1101(254.37) | | |
| QVLALEPGK | A1101(138.40) | | | LLLMRTSWA | B0801(261.60) | | |
| SPGTSGSPI | B0702(20.23) | | | LLMRTSWAL | A0201(5.68) | B0801(172.62) | B1501(378.71) |
| FKKRNLTIM | B0801(468.54) | | | AGLAFSIMK | A1101(99.65) | | |
| LPSIVREAL | B0702(16.77) | | | STYGWNLVK | A0301(10.19) | A1101(2.90) | |
| ALKGMPIRY | A0301(339.52) | B1501(475.97) | | KLHSGKDVF | B1501(160.44) | | |
| LPIRYQTTA | B0702(346.31) | | | VLNPYMPAV | A0201(4.22) | | |
| LMCHATFTT | A0201(173.10) | | | TTSKMLLNR | A1101(21.84) | | |
| ATFTTRLLS | A1101(412.33) | | | TVMDIISRR | A1101(17.83) | | |
| VPNYNLIVM | B0702(45.74) | | | KSYAQMWTL | A0201(333.12) | | |
| LIVMDEAHF | B1501(106.12) | | | YAQMWALMY | B1501(245.55) | | |

FIG. 49-6

| Peptide | HLA(nM) | HLA(nM) | HLA(nM) |
|---|---|---|---|
| IVMDEAHFT | A0201(476.66) | | |
| FTDPSSVAA | A0201(373.00) | | |
| FMTATPPGT | A0201(78.49) | | |
| KTFDTEYPK | A0301(26.17) | A1101(3.35) | |
| RVIDPRRCM | B0702(182.48) | B1501(314.20) | |
| VIDPRRCMK | A1101(182.53) | | |
| VILAGPIPV | A0201(23.90) | | |
| IPVTPASAA | B0702(81.15) | | |
| TLFGPEREK | A0301(146.68) | A1101(187.58) | |
| EQRKTFVEL | B0801(113.22) | | |
| KTFVDLMRR | A0301(147.88) | A1101(12.46) | |
| LMKRGDLPV | A0201(206.96) | B0801(347.63) | B1501(402.91) |
| KVASEGFQY | A0301(176.67) | A1101(33.00) | B1501(253.76) |
| KPRWLDARI | B0702(80.20) | | |

| Peptide | HLA(nM) | HLA(nM) | HLA(nM) |
|---|---|---|---|
| AQMWALMYF | A0201(81.22) | A2402(169.20) | B1501(13.98) |
| LVKRFSSGL | B0801(176.72) | | |
| KLFMAFVAF | A2402(467.26) | B1501(16.19) | |
| PLNEAVMAV | A0201(76.50) | | |
| SSADLSLER | A1101(46.97) | | |
| KTFDTEYTK | A0301(37.45) | A1101(4.65) | |
| RVAAEGINY | A0301(446.29) | A1101(100.00) | B1501(140.79) |
| AYTHALSEL | A2402(298.40) | | |
| QLIVILAI | A0201(77.46) | | |
| ATVLMGLGR | A1101(142.70) | | |
| LLMRTSWAF | A0201(171.85) | B1501(17.81) | |
| KLYSGKDVF | B1501(53.08) | | |
| TISKMLLNR | A0301(367.82) | A1101(36.65) | |
| KAYAQMWAL | A0201(135.72) | | |

FIG. 50-1

| peptide | core/HLA(affinity(nM)) | core/HLA(affinity(nM)) | core/HLA(affinity(nM)) | core/HLA(affinity(nM)) |
|---|---|---|---|---|
| LMGLDKGWPLHRMDI | LDKGWPLHR/DRB1*0101 (187.11) | LDKGWPLHR/DRB1*0701 (344.75) | | |
| FGKAKGSRAIWYMWL | AKGSRAIWY/DRB1*0701 (256.91) | FGKAKGSRA/DRB1*0101 (46.93) | FGKAKGSRA/DRB1*1101 (402.09) | |
| PGRFWNTTIAVSMAN | FWNTTIAVS/DRB1*0401 (153.12) | FWNTTIAVS/DRB1*1101 (405.55) | WNTTIAVSM/DRB1*0101 (36.40) | WNTTIAVSM/DRB1*0701 (45.20) |
| HGSYEVKPTGSASSM | YEVKPTGSA/DRB1*0101 (316.47) | | | |
| WTLYAVATTFHTPML | LYAVATTFI/DRB1*0701 (29.06) | YAVATTFIT/DRB1*0101 (32.34) | YAVATTFIT/DRB1*0401 (126.08) | YAVATTFIT/DRB1*1101 (316.85) |
| PMPVTASSAAQRRGR | VTASSAAQR/DRB1*0101 (453.88) | | | |
| DFVEGLSGATWVDWV | FVEGLSGAT/DRB1*0101 (107.14) | | | |
| GAMHSALAGATEIQM | MHSALAGAT/DRB1*0101 (57.78) | | | |
| EATAKGARRMAILGD | TAKGARRMA/DRB1*1101 (316.85) | | | |
| SGSASSMVNGVVKLL | ASSMVNGVV/DRB1*0101 (375.75) | | | |
| GPERVILAGPIPVTP | VILAGPIPV/DRB1*0101 (96.97) | VILAGPIPV/DRB1*0701 (484.38) | | |
| RRDKRSVALVPHVGM | RSVALVPHV/DRB1*0701 (287.42) | SVALVPHVG/DRB1*0101 (201.62) | | |
| CGRGGWSYYMATLKN | WSYYMATLK/DRB1*0101 (191.17) | WSYYMATLK/DRB1*1101 (332.90) | | |
| GDLPVWLAHKVASEG | VWLAHKVAS/DRB1*1101 (256.69) | WLAHKVASE/DRB1*0101 (424.72) | | |
| TPMLRHTIENTSANL | LRHTIENTS/DRB1*0701 (476.40) | | | |
| FQPESPARVASAILN | FQPESPARV/DRB1*0101 (228.49) | | | |
| LDIDLRPASAWTLYA | LRPASAWTL/DRB1*0101 (19.04) | LRPASAWTL/DRB1*0701 (64.12) | | |
| NGTGNIVASVNTSR | IVASVNTTS/DRB1*0101 (289.73) | IVASVNTTS/DRB1*0401 (128.83) | IVASVNTTS/DRB1*0701 (240.42) | |
| PHVGMGLETRAQTWM | VGMGLETRA/DRB1*0101 (358.14) | | | |
| RGDLPVWLAYKVASE | VWLAYKVAS/DRB1*1101 (259.31) | WLAYKVASE/DRB1*0101 (268.42) | | |
| EMGANFRADRVIDPR | FRADRVIDP/DRB1*0401 (247.86) | | | |

FIG. 50-2

| peptide | core/HLA(affinity(nM)) | core/HLA(affinity(nM)) | core/HLA(affinity(nM)) | core/HLA(affinity(nM)) |
|---|---|---|---|---|
| CHATFTTRLLSSTRV | FTTRLLSST/DRB1*1101 (27.12) | TRLLSSTRV/DRB1*0101 (8.50) | TRLLSSTRV/DRB1*0401 (225.25) | TRLLSSTRV/DRB1*0701 (18.30) |
| WPLNEAVMAVGV | NEAVMAVGV/DRB1*0101 (229.57) | | | |
| GSRDFVEGVSGGTWV | FVEGVSGGT/DRB1*0101 (380.33) | | | |
| NQATVLMGLGRGWPL | MGLGRGWPL/DRB1*0101 (116.13) | | | |
| KKLKPRWLDARIYAD | PRWLDARIY/DRB1*0101 (319.60) | | | |
| VLMGLDKGWPLSKMD | MGLDKGWPL/DRB1*0101 (195.23) | MGLDKGWPL/DRB1*0701 (466.03) | | |
| AGPMPVTHSSAAQRR | VTHSSAAQR/DRB1*0701 (440.09) | | | |
| LPIRYQTPAVKSEHT | IRYQTPAVK/DRB1*0101 (29.71) | IRYQTPAVK/DRB1*0401 (256.20) | IRYQTPAVK/DRB1*0401 (365.46) | IRYQTPAVK/DRB1*1101 (184.90) |
| DIRIETWMSSEGAWK | ETWMSSEGA/DRB1*0101 (479.55) | | | |
| GKFWNTTIAVSTANI | FWNTTIAVS/DRB1*0401 (183.65) | FWNTTIAVS/DRB1*1101 (455.54) | WNTTIAVST/DRB1*0101 (23.43) | WNTTIAVST/DRB1*0701 (38.47) |
| SILASALLKNDIPMT | SILASALLK/DRB1*0101 (270.56) | | | |
| VSQLAKRFSRGMLQG | AKRFSRGML/DRB1*0701 (286.18) | AKRFSRGML/DRB1*1101 (52.67) | KRFSRGMLQ/DRB1*0101 (269.24) | |
| FTMRLLSPVRVPNYN | MRLLSPVRV/DRB1*0101 (7.05) | MRLLSPVRV/DRB1*0701 (120.70) | TMRLLSPVR/DRB1*1101 (60.09) | |
| PLVAGGLLITVCYILS | PLVAGGLLT/DRB1*0101 (437.94) | | | |
| AAIANQAVVLMGLGK | IANQAVVLM/DRB1*0101 (116.15) | | | |
| LMKRGDLPWWLAYKV | KRGDLPWWL/DRB1*0101 (376.32) | | | |
| GYWIESQKNGSWKLA | IESQKNGSW/DRB1*0101 (424.75) | WIESQKNGS/DRB1*1101 (460.30) | | |
| DLRPASAWTLYAVAT | LRPASAWTL/DRB1*0101 (62.12) | LRPASAWTL/DRB1*0701 (176.77) | | |
| GEFGKAKGSRAIWYM | FGKAKGSRA/DRB1*0101 (17.48) | FGKAKGSRA/DRB1*0701 (210.12) | FGKAKGSRA/DRB1*1101 (208.73) | |
| GQGPMKMVMAFIAFL | MKMVMAFIA/DRB1*0701 (309.11) | PMKMVMAFI/DRB1*0101 (50.34) | | |
| PTVEAGRTLRVLNLV | AGRTLRVLN/DRB1*1101 (443.08) | VEAGRTLRV/DRB1*0101 (76.82) | VEAGRTLRV/DRB1*0701 (166.39) | |

FIG. 50-3

| peptide | core/HLA(affinity(nM)) | core/HLA(affinity(nM)) | core/HLA(affinity(nM)) | core/HLA(affinity(nM)) |
|---|---|---|---|---|
| SIAARGYISTRVGMG | ARGYISTRV/DRB1*0101(212.84) | YISTRVGMG/DRB1*0701(169.55) | YISTRVGMG/DRB1*1101(244.60) | |
| ASSMVNGVVKLLTKP | MVNGVVKLL/DRB1*0101(229.48) | VNGVVKLLT/DRB1*1101(277.93) | | |
| LGQVMLLVLCAVQLL | LLVLCAVQL/DRB1*0101(360.55) | | | |
| DGEERVILAGPMPVT | VILAGPMPV/DRB1*0101(193.65) | | | |
| HAKHQWMTTEDMLKV | HQWMTTEDM/DRB1*0101(142.65) | HQWMTTEDM/DRB1*0401(140.88) | QWMTTEDML/DRB1*0701(446.15) | |
| VLMGLGRGWPIHRVD | LGRGWPIHR/DRB1*1101(356.35) | MGLGRGWPI/DRB1*0101(63.91) | MGLGRGWPI/DRB1*0701(221.54) | |
| VQVLALEPGKNPKHV | VLALEPGKN/DRB1*0101(129.25) | | | |
| VGNRDFVEGLSGATW | FVEGLSGAT/DRB1*0101(126.33) | | | |
| GAWVDLVLEHGGCVT | LVLEHGGCV/DRB1*0101(276.69) | | | |
| MYHRQWFFDLPLPWT | FFDLPLPWT/DRB1*0101(438.82) | | | |
| VREAIRRGLRTLILA | IRRGLRTLI/DRB1*0101(24.68) | IRRGLRTLI/DRB1*0401(466.57) | IRRGLRTLI/DRB1*0701(29.75) | IRRGLRTLI/DRB1*1101(11.15) |
| MGEAAGIFMTATPPG | IFMTATPPG/DRB1*0101(301.62) | IFMTATPPG/DRB1*0401(87.31) | | |
| DHWFSRENSYSGVEG | FSRENSYSG/DRB1*0401(372.42) | | | |
| GKELKCGSGIFVIDN | LKCGSGIFV/DRB1*0101(177.97) | | | |
| QPESPARLASAILNA | PARLASAIL/DRB1*0101(70.55) | | | |
| CASQILLMRTSWAFC | ILLMRTSWA/DRB1*0101(15.21) | ILLMRTSWA/DRB1*0401(91.82) | LLMRTSWAF/DRB1*0701(208.77) | SQILLMRTS/DRB1*1101(91.27) |
| MLKRARNRVSTPQGL | LKRARNRVS/DRB1*0101(286.28) | LKRARNRVS/DRB1*1101(47.49) | MLKRARNRV/DRB1*0701(425.26) | |
| GCYSQVNPLTLTAAV | CYSQVNPLT/DRB1*0401(145.04) | YSQVNPLTL/DRB1*0101(15.44) | YSQVNPLTL/DRB1*0701(46.18) | YSQVNPLTL/DRB1*1101(389.99) |
| CRSCTMPPLRFRGED | SCTMPPLRF/DRB1*0101(319.81) | | | |
| LMSAAIKDSKAVHAD | IKDSKAVHA/DRB1*0101(279.09) | IKDSKAVHA/DRB1*0701(184.99) | | |
| MCTLMAMDLGEFCED | MCTLMAMDL/DRB1*0101(474.21) | | | |

FIG. 50-4

| peptide | core/HLA(affinity(nM)) | core/HLA(affinity(nM)) | core/HLA(affinity(nM)) | core/HLA(affinity(nM)) |
|---|---|---|---|---|
| SPIRVPNYNLVIMDE | PIRVPNYNL/DRB1*0101(236.75) | PIRVPNYNL/DRB1*0701(338.31) | | |
| RFSTGLLNGKGPLRM | LLNGKGPLR/DRB1*0101(111.25) | | | |
| GWSLRETACLGKSYA | WSLRETACL/DRB1*0101(362.51) | | | |
| MGCYSQVNPTTLIAS | CYSQVNPTT/DRB1*0401(97.51) | YSQVNPTTL/DRB1*0101(11.00) | YSQVNPTTL/DRB1*0701(39.49) | |
| TTIAYSMANIFRGSY | AVSMANIFR/DRB1*0101(41.93) | AVSMANIFR/DRB1*0401(288.27) | AVSMANIFR/DRB1*1101(269.21) | IAVSMANIF/DRB1*0701(143.61) |
| TGHLKCKVRMEKLRI | KCKVRMEKL/DRB1*0701(395.34) | KVRMEKLRI/DRB1*0101(433.84) | LKCKVRMEK/DRB1*1101(79.40) | |
| SKLMSAAIKDQRAVH | KLMSAAIKD/DRB1*0701(467.82) | MSAAIKDQR/DRB1*1101(430.70) | SKLMSAAIK/DRB1*0101(168.90) | |
| GKTVWFVPSIKSGND | VWFVPSIKS/DRB1*0101(33.46) | VWFVPSIKS/DRB1*0401(130.60) | VWFVPSIKS/DRB1*0701(120.26) | VWFVPSIKS/DRB1*1101(33.13) |
| IAGGMLIACYVITGT | GGMLIACYV/DRB1*0101(258.92) | | | |
| CVTTMAKNKPTLDIE | TMAKNKPTL/DRB1*0101(279.81) | TMAKNKPTL/DRB1*0701(447.42) | | |
| MLLILCTGQLLMMRT | LILCTGQLL/DRB1*0101(74.73) | | | |
| VLMGLGKGWPISKMD | MGLGKGWPI/DRB1*0101(107.90) | MGLGKGWPI/DRB1*0701(479.01) | | |
| NVSLAAIANQAVVLM | LAAIANQAV/DRB1*0101(8.40) | LAAIANQAV/DRB1*0401(147.17) | LAAIANQAV/DRB1*0701(79.08) | |
| RTETWMSSEGAWKHA | ETWMSSEGA/DRB1*0101(140.95) | | | |
| MGLGKGWPLHRMDIG | MGLGKGWPL/DRB1*0101(250.03) | | | |
| TVLGSQEGAMHSALT | LGSQEGAMH/DRB1*0101(248.81) | | | |
| IQPQWIAASIILEFF | PQWIAASII/DRB1*0101(53.31) | PQWIAASII/DRB1*0701(68.02) | | |
| KELKCGSGIFITDNV | LKCGSGIFI/DRB1*010l(434.53) | | | |
| MGANFRADRVIDPRR | FRADRVIDP/DRB1*0401(103.94) | | | |
| IFWDNVHTRTEQYK | FVDNVHTR/DRB1*0401(403.67) | IFWDNVHT/DRB1*0101(484.98) | | |
| HAHWTEAKMLLDNIY | WTEAKMLLD/DRB1*0701(385.61) | | | |

FIG. 50-5

| peptide | core/HLA(affinity(nM)) | core/HLA(affinity(nM)) | core/HLA(affinity(nM)) |
|---|---|---|---|
| EKKKLKPRWLDARIY | KKKLKPRWL/DRB1*1101(470.18) | | |
| QEGAMHSALAGATEV | MHSALAGAT/DRB1*0101(109.53) | | |
| EPIPMSTYGWNLVRL | PMSTYGWNL/DRB1*0101(356.68) | PMSTYGWNL/DRB1*0701(244.03) | |
| CLGKAYAQMWSLMYF | YAQMWSLMY/DRB1*0101(22.25) | YAQMWSLMY/DRB1*0401(292.46) | YAQMWSLMY/DRB1*1101(269.00) |
| TIVTPMLRHTIENST | VTPMLRHTI/DRB1*1101(250.38) | | |
| GPSLRTTVSGKLIH | LRTTVSGK/DRB1*0401(359.97) | LRTTVSGK/DRB1*1101(469.14) | TTTVSGKLI/DRB1*0101(263.86) | TTTVSGKLI/DRB1*0701(49.26) |
| YEVKATGSASSMING | VKATGSASS/DRB1*0101(168.73) | VKATGSASS/DRB1*0401(416.42) | VKATGSASS/DRB1*0701(218.53) | |
| DCWCNATSTWVMYGT | WCNATSTWV/DRB1*0101(327.51) | WCNATSTWV/DRB1*0701(165.84) | | |
| RMDLGVPLLALGCYS | MDLGVPLLA/DRB1*0101(147.03) | | | |
| ALCEVLTLATGPVMT | VLTLATGPV/DRB1*0101(17.26) | VLTLATGPV/DRB1*0401(370.58) | VLTLATGPV/DRB1*0701(190.51) | |
| VASVNTSRLLNRF | SVNTSRLL/DRB1*0101(142.54) | VNTSRLLL/DRB1*0701(48.62) | VNTSRLL/DRB1*1101(81.40) | |
| EEFTRKVRSNAAIGA | FTRKVRSNA/DRB1*0701(229.82) | FTRKVRSNA/DRB1*1101(44.25) | TRKVRSNAA/DRB1*0101(64.26) | VRSNAAIGA/DRB1*0401(317.25) |
| TTIAKNKPTLDIELQ | IAKNKPTLD/DRB1*0101(167.73) | IAKNKPTLD/DRB1*0701(304.74) | | |
| ALLALNDMGKVRKDI | LLALNDMGK/DRB1*0101(126.54) | | | |
| PPTAGILKRWGTIKK | LKRWGTIKK/DRB1*1101(111.83) | | | |
| FKKKNLTIMDLHPGA | LTIMDLHPG/DRB1*0101(113.59) | LTIMDLHPG/DRB1*0401(362.33) | LTIMDLHPG/DRB1*1101(373.10) | |
| SSPNPTVEAGRTLRV | VEAGRTLRV/DRB1*0701(493.57) | | | |
| PNPTVEAGRTLRVLS | VEAGRTLRV/DRB1*0101(109.13) | VEAGRTLRV/DRB1*0701(155.18) | | |
| LSSLLRNDVPLAGPL | LLRNDVPLA/DRB1*0101(23.66) | LLRNDVPLA/DRB1*0401(32.96) | LLRNDVPLA/DRB1*0701(473.46) | LLRNDVPLA/DRB1*1101(268.01) |
| GGSWDIVLEHGSCV | IVLEHGSCV/DRB1*0101(254.24) | | | |
| DLMCHATFTMRLLSP | ATFTMRLLS/DRB1*1101(226.84) | CHATFTMRL/DRB1*0101(96.02) | CHATFTMRL/DRB1*0401(410.22) | CHATFTMRL/DRB1*0701(32.82) |

FIG. 50-6

| peptide | core/HLA(affinity(nM)) | core/HLA(affinity(nM)) | core/HLA(affinity(nM)) |
|---|---|---|---|
| NQTWQIEKASLIEVK | WQIEKASLI/DRB1*0101(16.94) | WQIEKASLI/DRB1*0401(461.56) | WQIEKASLI/DRB1*0701(102.49) | |
| KSYAQMWALMYFHRR | WALMYFHRR/DRB1*1101(29.04) | YAQMWALMY/DRB1*0101(10.25) | YAQMWALMY/DRB1*0401(216.61) | YAQMWALMY/DRB1*0701(168.56) |
| IVREAIKRKLRTLVL | IKRKLRTLV/DRB1*0701(115.19) | IKRKLRTLV/DRB1*1101(9.04) | KRKLRTLVL/DRB1*0101(146.41) | |
| LASSLLRNDVPMAGP | LLRNDVPMA/DRB1*0101(116.89) | LLRNDVPMA/DRB1*0401(58.76) | | |
| ASIAARGYISTRVGM | ARGYISTRV/DRB1*0101(212.32) | ARGYISTRV/DRB1*0701(334.61) | ARGYISTRV/DRB1*1101(490.37) | |
| GAMHTALTGATEIQT | HTALTGATE/DRB1*0101(131.65) | | | |
| YKEGVFHTMWHYTRG | FHTMWHYTR/DRB1*0101(23.02) | FHTMWHYTR/DRB1*1101(29.36) | VFHTMWHVT/DRB1*0701(128.17) | |
| LSSLLKNDVPLAGPL | LLKNDVPLA/DRB1*0101(36.18) | LLKNDVPLA/DRB1*0401(56.69) | LLKNDVPLA/DRB1*1101(416.12) | |
| EVPFCSHHFHQLIMK | FCSHHFHQL/DRB1*0101(114.34) | FCSHHFHQL/DRB1*0701(43.80) | FCSHHFHQL/DRB1*1101(384.77) | |
| RGDLPWLAHKVASE | LPWLAHKV/DRB1*0101(451.54) | VWLAHKVAS/DRB1*1101(254.68) | | |
| TYGLNTFTNMEAQLI | FTNMEAQLI/DRB1*0101(10.82) | FTNMEAQLI/DRB1*0101(45.59) | LNTFTNMEA/DRB1*0401(30.00) | |
| AYGVLFSGVSWTMKI | FSGVSWTMK/DRB1*0701(33.80) | LFSGVSWTM/DRB1*0401(373.17) | YGVLFSGVS/DRB1*0101(32.26) | YGVLFSGVS/DRB1*1101(187.20) |
| PLQWIASAIVLEFFM | LQWIASAIV/DRB1*0101(11.67) | LQWIASAIV/DRB1*0401(370.39) | LQWIASAIV/DRB1*0701(21.68) | |
| ALVPHVGMGLETRAQ | LVPHVGMGL/DRB1*0101(272.27) | | | |
| HQWMTTEDMLSVWNR | WMTTEDMLS/DRB1*0101(165.44) | WMTTEDMLS/DRB1*0401(123.84) | | |
| DSKFEKQLGQVMLLI | FEKQLGQVM/DRB1*0101(12.96) | FEKQLGQVM/DRB1*0701(261.86) | | |
| IYRIKQKGIFGKTQV | IYRIKQKGI/DRB1*0701(468.72) | IYRIKQKGI/DRB1*1101(59.54) | RIKQKGIFG/DRB1*0101(182.14) | |
| NMCTLMAMDLGEMCE | MCTLMAMDL/DRB1*0101(199.51) | | | |
| GVRSTTRLENLLWKQ | VRSTTRLEN/DRB1*1101(414.00) | | | |
| ALRGLPIRYQTPAVK | IRYQTPAVK/DRB1*0101(35.30) | IRYQTPAVK/DRB1*0401(297.76) | IRYQTPAVK/DRB1*0701(342.59) | LRGLPIRYQ/DRB1*1101(93.52) |
| ERLRRMAISGDDCVV | LRRMAISGD/DRB1*0101(419.30) | | | |

FIG. 50-7

| peptide | core/HLA(affinity(nM)) | core/HLA(affinity(nM)) | core/HLA(affinity(nM)) | core/HLA(affinity(nM)) |
|---|---|---|---|---|
| HAKHEWMTEDMLKV | HEWMTTEDM/DRB1*0101(332.71) | HEWMTTEDM/DRB1*0401(418.38) | | |
| KCGSGIFVVDNVHTR | FVVDNVHTR/DRB1*0401(437.10) | | | |
| GQLLLMRTSWAFCEA | GQLLLMRTS/DRB1*1101(167.60) | LLLMRTSWA/DRB1*0101(23.53) | LLLMRTSWA/DRB1*0401(238.02) | LMRTSWAFC/DRB1*0701(262.34) |
| AIIREAIKRKLRTLI | IKRKLRTLI/DRB1*0701(208.76) | IKRKLRTLI/DRB1*1101(13.18) | IREAIKRKL/DRB1*0101(240.88) | |
| LQWIASAIILEFFMM | LQWIASAII/DRB1*0101(70.58) | LQWIASAII/DRB1*0101(61.32) | | |
| NDIAACLRKSGKRVI | IAACLRKSG/DRB1*1101(36.81) | LRKSGKRVI/DRB1*0701(414.24) | | |
| REKRSVALAPHVGMG | RSVALAPHV/DRB1*0701(333.72) | SVALAPHVG/DRB1*0101(82.75) | | |
| YVLSGSSADLSLEKA | VLSGSSADL/DRB1*0101(135.81) | YVLSGSSAD/DRB1*0701(448.77) | | |
| ACLRKSGKRVIQLSR | CLRKSGKRV/DRB1*0101(429.40) | LRKSGKRVI/DRB1*0701(318.03) | LRKSGKRVI/DRB1*1101(82.89) | |
| EARKITFVELMRRGDL | FVELMRRGD/DRB1*1101(91.70) | | | |
| VLLMRTTWALCEALT | LMRTTWALC/DRB1*0101(111.79) | MRTTWALCE/DRB1*0701(268.19) | | |
| DDVDCWCNATSAWWM | WCNATSAWV/DRB1*0101(375.23) | WCNATSAWV/DRB1*0701(281.65) | | |
| AAEMEEALKGLPIRY | EEALKGLPI/DRB1*0101(153.57) | | | |
| ISLAAIANQATVLMG | AIANQATVL/DRB1*0701(288.85) | IANQATVLM/DRB1*0401(78.93) | LAAIANQAT/DRB1*0101(12.29) | |
| VDVVLEHGSCVTTMA | VVLEHGSCV/DRB1*0101(194.55) | | | |
| LLALGCYSQVNPLTIL | GCYSQVNPL/DRB1*0401(129.08) | YSQVNPLTL/DRB1*0101(31.09) | YSQVNPLTL/DRB1*0701(30.65) | |
| KMFEATARGARRMAI | FEATARGAR/DRB1*0701(449.16) | FEATARGAR/DRB1*0101(65.36) | MFEATARGA/DRB1*0101(132.32) | |
| NGKRVIQLSRKTFDT | RVIQLSRKT/DRB1*0101(490.09) | RVIQLSRKT/DRB1*1101(26.12) | | |
| TEQYKFQPESPARVA | FQPESPARV/DRB1*0701(200.47) | YKFQPESPA/DRB1*0101(11.14) | YKFQPESPA/DRB1*0401(76.31) | YKFQPESPA/DRB1*1101(473.57) |
| YAGHLKCKVRMERLR | HLKCKVRME/DRB1*1101(105.69) | | | |
| APTRVVASEMAEALK | TRVVASEMA/DRB1*0101(134.15) | | | |

FIG. 50-8

| peptide | core/HLA(affinity(nM)) | core/HLA(affinity(nM)) | core/HLA(affinity(nM)) |
|---|---|---|---|
| WTEQYQFQADSPKRL | FQADSPKRL/DRB1*0101(89.50) | FQADSPKRL/DRB1*0401(302.61) | FQADSPKRL/DRB1*0701(93.69) | |
| TLILAPTRVVASEMA | LILAPTRVV/DRB1*0101(9.39) | LILAPTRVV/DRB1*0401(319.07) | LILAPTRVV/DRB1*0701(81.50) | LILAPTRVV/DRB1*1101(81.29) |
| CEALTLATGPVSTLW | LTLATGPVS/DRB1*0101(14.65) | LTLATGPVS/DRB1*0401(203.51) | LTLATGPVS/DRB1*0701(243.53) |
| KLGEFGRAKGSRAIW | FGRAKGSRA/DRB1*0101(11.06) | FGRAKGSRA/DRB1*0401(240.72) | FGRAKGSRA/DRB1*0701(112.04) | FGRAKGSRA/DRB1*1101(75.22) |
| GVGIHMENVFHTMWH | IHMENVFHT/DRB1*0101(75.00) | IHMENVFHT/DRB1*0401(143.47) | IHMENVFHT/DRB1*0701(475.76) |
| IPLQWIASAIVLEFF | LQWIASAIV/DRB1*0101(7.00) | LQWIASAIV/DRB1*0401(198.25) | LQWIASAIV/DRB1*0701(14.64) |
| KKVRTNAAIGAVFVD | VRTNAAIGA/DRB1*0101(15.12) | VRTNAAIGA/DRB1*0401(161.82) | VRTNAAIGA/DRB1*0701(161.67) |
| NFRADRVIDPRRCLK | FRADRVIDP/DRB1*0401(318.47) |
| TRAQTWMSSEGAWKH | QTWMSSEGA/DRB1*0101(85.75) | QTWMSSEGA/DRB1*0401(482.07) |
| PYWLAYKVAAEGINY | AYKVAAEGI/DRB1*0101(86.77) | AYKVAAEGI/DRB1*0401(301.38) | VWLAYKVAA/DRB1*1101(277.97) |
| MGLGKGWPIHRMDLG | LGKGWPIHR/DRB1*0101(328.27) |
| CGIRSTRLENVMWK | IRSTRLEN/DRB1*1101(234.87) |
| VTYSLNTFTNMEVQL | LNTFTNMEV/DRB1*0101(110.77) | LNTFTNMEV/DRB1*0401(124.25) | LNTFTNMEV/DRB1*0701(117.62) |
| DGEFRLRGEQRKTFV | FRLRGEQRK/DRB1*1101(281.02) |
| MGLGRGWPIHRVDLG | LGRGWPIHR/DRB1*0101(200.71) |
| EFINKVRSNAALGAV | FINKVRSNA/DRB1*1101(62.28) | INKVRSNAA/DRB1*0101(14.82) | INKVRSNAA/DRB1*0701(71.31) | VRSNAALGA/DRB1*0401(88.62) |
| QQLTKRFSLGLLSGR | KRFSLGLLS/DRB1*0101(52.09) | KRFSLGLLS/DRB1*0101(71.57) | LTKRFSLGL/DRB1*0701(109.15) |
| RSNAALGAIFQEEQG | NAALGAIFQ/DRB1*0101(348.67) |
| WSLRETACLGKAYAQ | WSLRETACL/DRB1*0101(440.45) |
| GRFWNTTIAVSTANI | FWNTTIAVS/DRB1*0401(201.64) | WNTTIAVST/DRB1*0101(23.13) | WNTTIAVST/DRB1*0701(38.44) |
| SLTAIANQAVVLMGL | LTAIANQAV/DRB1*0101(13.49) | LTAIANQAV/DRB1*0401(235.53) | LTAIANQAV/DRB1*0701(105.06) |

FIG. 50-9

| peptide | core/HLA(affinity(nM)) | core/HLA(affinity(nM)) | core/HLA(affinity(nM)) |
|---|---|---|---|
| GAMHSALTGATEVDS | MHSALTGAT/DRB1*0101(262.82) | | |
| RLCTKAEFCKKVRSN | AEFCKKVRS/DRB1*1101(360.28) | | |
| ATTIITPMLRHTIEN | ITPMLRHTI/DRB1*0101(241.05) | ITPMLRHTI/DRB1*1101(78.50) | TTIITPMLR/DRB1*0701(409.24) |
| NMCTLIAMDLGELCE | MCTLIAMDL/DRB1*0101(187.78) | | |
| VAGGLLAAYVMTGR | GGLLAAYV/DRB1*0101(41.15) | | |
| NQAAVLMGLGKGWPL | MGLGKGWPL/DRB1*0101(163.55) | | |
| WLMGLGKGWPIHRM | LGKGWPIHR/DRB1*1101(410.67) | MGLGKGWPI/DRB1*0101(38.29) | MGLGKGWPI/DRB1*0701(177.10) |
| PASAWTLYAVATTFI | LYAVATTFI/DRB1*0701(41.99) | WTLYAVATT/DRB1*0101(42.79) | |
| RDFVEGVSGGSWVDL | FVEGVSGGS/DRB1*0101(468.20) | | |
| EPVPMSTYGWNIVKL | PMSTYGWNI/DRB1*0701(367.13) | | |
| TWLVHRQWFLNLPLP | LVHRQWFLN/DRB1*1101(384.96) | WLVHRQWFL/DRB1*0101(163.32) | WLVHRQWFL/DRB1*0701(101.11) |
| SAAIKDSKAVHADMG | IKDSKAVHA/DRB1*0101(94.09) | IKDSKAVHA/DRB1*0701(120.82) | |
| GLVKRFSSELLSGRG | FSSELLSGR/DRB1*0401(341.27) | VKRFSSELL/DRB1*0101(91.26) | VKRFSSELL/DRB1*0701(146.99) | VKRFSSELL/DRB1*1101(453.90) |
| TAYGVLFSGVSWTMK | FSGVSWTMK/DRB1*0701(75.52) | LFSGVSWTM/DRB1*0401(482.17) | YGVLFSGVS/DRB1*0101(26.38) | YGVLFSGVS/DRB1*1101(182.08) |
| EMEEALKGLPIRYQT | EEALKGLPI/DRB1*0101(83.86) | LKGLPIRYQ/DRB1*1101(375.08) | |
| KPVILPDGPERVILA | ILPDGPERV/DRB1*0101(355.70) | | |
| NWQEVPFCSHHFHQL | FCSHHFHQL/DRB1*0701(174.89) | | |
| RHTIENSTANVSLAA | IENSTANVS/DRB1*0101(160.79) | IENSTANVS/DRB1*0401(316.05) | IENSTANVS/DRB1*0701(244.93) |
| VSSVNMISRMLLNRF | ISRMLLNRF/DRB1*0401(468.03) | ISRMLLNRF/DRB1*0701(97.52) | SVNMISRML/DRB1*0101(21.51) | SVNMISRML/DRB1*1101(42.79) |
| SYAQMWTLMYFHRRD | WTLMYFHRR/DRB1*1101(38.11) | YAQMWTLMY/DRB1*0101(35.79) | YAQMWTLMY/DRB1*0401(245.85) | YAQMWTLMY/DRB1*0701(383.84) |
| QWTYGLNTFNMEV | LNTFNMEV/DRB1*0401(260.36) | LNTFNMEV/DRB1*0701(299.06) | VTYGLNTFT/DRB1*0101(128.05) | |

FIG. 50-10

| peptide | core/HLA(affinity(nM)) | core/HLA(affinity(nM)) | core/HLA(affinity(nM)) | core/HLA(affinity(nM)) |
|---|---|---|---|---|
| EGNPGKFWNTTIAVS | FWNTTIAVS/DRB1*0401(434.09) | KFWNTTIAV/DRB1*0701(247.03) | | |
| GEYRLRGEARKTFVE | YRLRGEARK/DRB1*0101(204.80) | YRLRGEARK/DRB1*1101(99.16) | | |
| LKNDIPMTGPLVAGG | DIPMTGPLV/DRB1*0101(18.43) | | | |
| GLYGNGWTTSGTYV | WTTSGTYV/DRB1*0101(371.20) | WTTSGTYV/DRB1*0701(243.55) | | |
| NFRAERVIDPRRCMK | FRAERVIDP/DRB1*0101(393.51) | FRAERVIDP/DRB1*0401(402.33) | | |
| GWSLKETACLGKSYA | WSLKETACL/DRB1*0101(278.32) | | | |
| LRVLSIPPTAGVLAR | RVLSIPPTA/DRB1*0701(181.02) | VLSIPPTAG/DRB1*0101(11.40) | VLSIPPTAG/DRB1*0401(208.40) | VLSIPPTAG/DRB1*1101(386.52) |
| DGEYRLKGEARKTFV | YRLKGEARK/DRB1*0101(243.27) | YRLKGEARK/DRB1*1101(143.76) | | |
| SEMAEALKGMPIRYQ | AEALKGMPI/DRB1*0101(48.51) | | | |
| TGSASSMINGVWLL | ASSMINGVW/DRB1*0101(253.11) | | | |
| GSGIFVTNEVHTWTE | FVTNEVHTW/DRB1*0101(432.48) | | | |
| TIENTSANLSLTAIA | ENTSANLS/DRB1*0101(301.44) | IENTSANLS/DRB1*0101(182.43) | | |
| AKRMAILGETAWDFG | RMAILGETA/DRB1*0101(84.07) | | | |
| FNMLKRERNRVSTGS | FNMLKRERN/DRB1*1101(39.82) | LKRERNRVS/DRB1*0101(141.85) | | |
| RMAILGDTAWDFGSV | ILGDTAWDF/DRB1*0401(422.49) | RMAILGDTA/DRB1*0101(253.94) | | |
| ESTYRGAKRMAILGE | YRGAKRMAI/DRB1*0101(62.77) | YRGAKRMAI/DRB1*0701(193.40) | YRGAKRMAI/DRB1*1101(25.44) | |
| FKLTYQNKVRVQRP | FKLTYQNKV/DRB1*0101(69.50) | FKLTYQNKV/DRB1*0701(45.77) | FKLTYQNKV/DRB1*1101(69.94) | |
| QRGLLGKTQVGVGIH | LLGKTQVGV/DRB1*0101(340.84) | | | |
| MKRGDLPVWLAYRVA | DLPVWLAYR/DRB1*0101(266.56) | DLPVWLAYR/DRB1*1101(493.14) | | |
| HGSYETKQTGSASSM | YETKQTGSA/DRB1*0101(284.71) | | | |
| GCYSQVNPLTLIAAV | CYSQVNPLT/DRB1*0401(148.62) | YSQVNPLIT/DRB1*0101(12.69) | YSQVNPLIT/DRB1*0701(28.75) | YSQVNPLIT/DRB1*1101(343.69) |

FIG. 50-11

| peptide | core/HLA(affinity(nM)) | core/HLA(affinity(nM)) | core/HLA(affinity(nM)) |
|---|---|---|---|
| ANVSLAAIANQATVL | LAAIANQAT/DRB1*0401(130.92) | LAAIANQAT/DRB1*0701(251.12) | SLAAIANQA/DRB1*0101(11.56) |
| LCASQILLMRTSWAF | ILLMRTSWA/DRB1*0101(14.31) | ILLMRTSWA/DRB1*0401(67.55) | LLMRTSWAF/DRB1*0701(179.25) SQILLMRTS/DRB1*1101(80.14) |
| DELIGRARISQGAGW | LIGRARISQ/DRB1*1101(363.10) | | |
| VYNMMGKREKKLGEF | VYNMMGKRE/DRB1*0101(265.93) | YNMMGKREK/DRB1*1101(110.76) | |
| GAAYTALFGGVSWMV | LFGGVSWMV/DRB1*0701(144.81) | YTALFGGVS/DRB1*0101(10.79) | YTALFGGVS/DRB1*1101(164.33) |
| VREAIKRGLRTLILA | IKRGLRTLI/DRB1*0101(31.73) | IKRGLRTLI/DRB1*0701(26.64) | IKRGLRTLI/DRB1*1101(13.02) |
| TWVDVVLEHGGCVTT | VVLEHGGCV/DRB1*0101(430.86) | | |
| WSYTCGGLKNVKEVR | YCGGLKNVK/DRB1*0101(112.86) | YCGGLKNVK/DRB1*1101(161.37) | |
| RHTIENTTANISLAA | IENTTANIS/DRB1*0101(250.05) | IENTTANIS/DRB1*0401(231.60) | IENTTANIS/DRB1*0701(172.25) |
| MGYWIESRLNDTWKI | SRLNDTWKI/DRB1*0701(438.74) | YWIESRLND/DRB1*1101(367.10) | |
| VRSTTRMENLLWKQY | TTRMENLLW/DRB1*0101(330.15) | | |
| AGHLKCRLKMDKLEL | GHLKCRLKM/DRB1*1101(91.11) | | |
| GAKRMAILGDTAWDF | RMAILGDTA/DRB1*0101(190.93) | | |
| LLIACYVITGRSADL | CYVITGRSA/DRB1*0101(47.89) | CYVITGRSA/DRB1*0701(153.84) | CYVITGRSA/DRB1*1101(66.00) |
| RDKRSVALVPHVGMG | RSVALVPHV/DRB1*0701(439.79) | SVALVPHVG/DRB1*0101(154.32) | |
| WLVHKQWFLNLPLPW | KQWFLNLPL/DRB1*0101(212.85) | KQWFLNLPL/DRB1*0701(167.39) | LVHKQWFLN/DRB1*1101(305.61) |
| FCVKVLNPYMPAVIE | CVKVLNPYM/DRB1*0101(44.28) | CVKVLNPYM/DRB1*0401(436.35) | CVKVLNPYM/DRB1*0701(237.38) CVKVLNPYM/DRB1*1101(191.43) |
| RGSAKLRWFVERNMV | LRWFVERNM/DRB1*0701(348.76) | LRWFVERNM/DRB1*1101(403.15) | |
| SLTAIANQAAILMGL | LTAIANQAA/DRB1*0101(6.95) | LTAIANQAA/DRB1*0401(71.02) | LTAIANQAA/DRB1*0701(136.80) |
| RPASAWTLYAVATTF | WTLYAVATT/DRB1*0101(79.09) | WTLYAVATT/DRB1*0701(321.73) | |
| RELKCGSGIFITNNV | LKCGSGIFI/DRB1*0101(365.12) | | |

FIG. 50-12

| peptide | core/HLA(affinity(nM)) | core/HLA(affinity(nM)) | core/HLA(affinity(nM)) | core/HLA(affinity(nM)) |
|---|---|---|---|---|
| VELMKRGDLPVWLAY | MKRGDLPVW/DRB1*0101(431.91) | | | |
| LCVGQLLLMRTSWAF | GQLLLMRTS/DRB1*1101(82.44) | LLLMRTSWA/DRB1*0101(12.91) | LLLMRTSWA/DRB1*0401(110.40) | LLMRTSWAF/DRB1*0701(224.59) |
| IYRILQRGLLGKTQV | YRILQRGLL/DRB1*0101(18.11) | YRILQRGLL/DRB1*0701(199.64) | YRILQRGLL/DRB1*1101(14.20) | |
| QDWVLGSQEGAMHS | VVVLGSQEG/DRB1*0101(92.88) | | | |
| GGLLLAAYVMTGRSA | AYVMTGRSA/DRB1*0101(27.14) | AYVMTGRSA/DRB1*1101(166.21) | LLAAYVMTG/DRB1*0401(420.81) | |
| LGSQEGAMRTALTGA | EGAMRTALT/DRB1*0101(358.73) | | | |
| KFEKQLGQVMLLLC | FEKQLGQVM/DRB1*0101(25.86) | FEKQLGQVM/DRB1*0701(414.74) | | |
| TTWALCEALTLATGP | WALCEALTL/DRB1*0101(78.82) | | | |
| VHADMGYWIESSKNQ | YWIESSKNQ/DRB1*0401(484.04) | | | |
| GNIVSSVNMISRMLI | IVSSVNMIS/DRB1*0401(90.05) | IVSSVNMIS/DRB1*1101(100.14) | NIVSSVNMI/DRB1*0701(44.05) | SVNMISRML/DRB1*0101(30.05) |
| YQGKTVWFVPSIKAG | VWFVPSIKA/DRB1*0101(21.06) | VWFVPSIKA/DRB1*0401(108.92) | VWFVPSIKA/DRB1*0701(50.55) | VWFVPSIKA/DRB1*1101(30.97) |
| SVNITSRLLINRFTM | SRLLINRF/DRB1*0101(53.09) | TSRLLINRF/DRB1*1101(62.77) | VNITSRLLI/DRB1*0701(129.76) | |
| SGKTRKYLPAIVREA | TRKYLPAIV/DRB1*0101(39.10) | TRKYLPAIV/DRB1*0701(377.25) | TRKYLPAIV/DRB1*1101(146.09) | |
| SRDFVEGVSGGSWVD | FVEGVSGGS/DRB1*0101(284.91) | | | |
| DMGYWIESQKNGSWK | YWIESQKNG/DRB1*1101(422.11) | | | |
| FLAIPPTAGILKRWG | FLAIPPTAG/DRB1*0101(17.76) | FLAIPPTAG/DRB1*0401(346.65) | FLAIPPTAG/DRB1*0701(355.67) | FLAIPPTAG/DRB1*1101(268.24) |
| EDGIYRIKQKGIFGK | IYRIKQKGI/DRB1*0101(228.50) | IYRIKQKGI/DRB1*0701(405.28) | IYRIKQKGI/DRB1*1101(46.13) | |
| EALKGLPIRYQTPAI | LKGLPIRYQ/DRB1*0101(98.17) | LKGLPIRYQ/DRB1*1101(182.96) | | |
| HFHKIFMKDGREIW | FHKIFMKDG/DRB1*1101(182.61) | IFMKDGREI/DRB1*0101(324.70) | | |
| LPSIVREAIKRGLRT | IVREAIKRG/DRB1*0101(350.60) | IVREAIKRG/DRB1*1101(108.68) | | |
| GCGLFGKGSLLTCAK | FGKGSLLTC/DRB1*0401(303.22) | FGKGSLLTC/DRB1*0701(288.45) | LFGKGSLLT/DRB1*0101(34.65) | LFGKGSLLT/DRB1*1101(112.03) |

FIG. 50-13

| peptide | core/HLA(affinity(nM)) | core/HLA(affinity(nM)) | core/HLA(affinity(nM)) | core/HLA(affinity(nM)) |
|---|---|---|---|---|
| RTTWSIHATHQWMTT | WSIHATHQW/DRB1*0101(211.77) | WSIHATHQW/DRB1*0701(71.77) | | |
| VMLLVLCAVQLLLMR | LLVLCAVQL/DRB1*0101(292.37) | | | |
| MGANFKAGRVIDPRR | FKAGRVIDP/DRB1*0101(174.86) | FKAGRVIDP/DRB1*0701(258.04) | | |
| RMVLAFITFLRVLSI | FITFLRVLS/DRB1*0101(43.73) | FITFLRVLS/DRB1*0401(423.75) | FITFLRVLS/DRB1*1101(36.12) | ITFLRVLSI/DRB1*0701(49.12) |
| QTTAIKAEHTGREIV | TTAIKAEHT/DRB1*0101(383.40) | | | |
| GKELKCGSGIFVTDE | LKCGSGIFV/DRB1*0101(228.96) | | | |
| DVRKDLISYGGGWKL | ISYGGGWKL/DRB1*0101(416.46) | ISYGGGWKL/DRB1*0701(232.92) | | |
| YRTWAYHGSYEAPSS | WAYHGSYEA/DRB1*0101(319.78) | | | |
| NGVVTRSGTYYSSIA | RSGTYYSSI/DRB1*0701(287.12) | | | |
| LEDGAYRIMQRGLFG | YRIMQRGLF/DRB1*0101(122.06) | YRIMQRGLF/DRB1*0701(36.11) | | |
| QWIASAIILEFFMMV | WIASAIILE/DRB1*0101(425.79) | | | |
| QWCGSLIGLISRATW | LIGLTSRAT/DRB1*0101(4.23) | LIGLTSRAT/DRB1*0401(64.73) | LIGLTSRAT/DRB1*0701(238.35) | LIGLTSRAT/DRB1*1101(40.87) |
| GSWVDIVLEHGSCVT | IVLEHGSCV/DRB1*0101(132.00) | | | |
| TWTEQYKFQADSPSK | YKFQADSPS/DRB1*0101(313.89) | YKFQADSPS/DRB1*0401(168.35) | | |
| AMHTALTGATEIQTS | HTALTGATE/DRB1*0101(177.77) | | | |
| IENTSANLSLTAIAN | NLSLTAIAN/DRB1*0101(151.90) | | | |
| QYQFQADSPKRLASA | FQADSPKRL/DRB1*0101(16.95) | FQADSPKRL/DRB1*0401(108.21) | FQADSPKRL/DRB1*0701(56.78) | FQADSPKRL/DRB1*1101(284.50) |
| GKMFEATARGARRMA | FEATARGAR/DRB1*1101(57.09) | MFEATARGA/DRB1*0401(443.02) | MFEATARGA/DRB1*0701(80.99) | |
| TSRTTWSIHAKHEWM | TTWSIHAKH/DRB1*1101(223.81) | | | |
| ASAWTLYAVATTIIT | TLYAVATTI/DRB1*0101(20.45) | TLYAVATTI/DRB1*0701(18.73) | YAVATTIIT/DRB1*0401(205.27) | |
| PLNEGVMAVGLVSLL | NEGVMAVGL/DRB1*0101(160.52) | | | |

FIG. 50-14

| peptide | core/HLA(affinity(nM)) | core/HLA(affinity(nM)) | core/HLA(affinity(nM)) |
|---|---|---|---|
| KTVWFVPSIKSGNDI | VWFVPSIKS/DRB1*0101(52.01) | VWFVPSIKS/DRB1*0401(196.34) | VWFVPSIKS/DRB1*0701(148.91) | VWFVPSIKS/DRB1*1101(40.62) |
| QVMLLVLCVTQVLLM | LLVLCVTQV/DRB1*0101(451.81) | | | |
| SALNDTWKMERASFI | WKMERASFI/DRB1*0101(61.85) | WKMERASFI/DRB1*0701(158.18) | | |
| QFCVKILNPYMPSVV | CVKILNPYM/DRB1*0101(22.32) | CVKILNPYM/DRB1*0401(84.03) | CVKILNPYM/DRB1*0701(168.52) | CVKILNPYM/DRB1*1101(100.59) |
| PLAGPLIAGGMLIAC | PLIAGGMLI/DRB1*0101(204.41) | | | |
| FCESLTLATGPVLTL | FCESLTLAT/DRB1*0401(327.27) | LTLATGPVL/DRB1*0101(9.89) | LTLATGPVL/DRB1*0701(50.18) | |
| IVASVNTTSRLLLNR | IVASVNTTS/DRB1*0401(370.59) | SVNTSRLL/DRB1*0101(109.38) | SVNTSRLL/DRB1*0701(35.97) | VNTTSRLLL/DRB1*1101(27.09) |
| FHRRDLRLAANAICS | DLRLAANAI/DRB1*0101(9.67) | DLRLAANAI/DRB1*0701(118.23) | FHRRDLRLA/DRB1*0701(72.42) | LRLAANAIC/DRB1*0401(112.39) |
| ARNRVSTPQGLVKRF | NRVSTPQGL/DRB1*0101(499.47) | | | |
| KGSRAIWYMWLGARY | IWYMWLGAR/DRB1*0101(65.91) | IWYMWLGAR/DRB1*1101(100.21) | | |
| PMKMVMAFIAFLRFL | VMAFIAFLR/DRB1*0101(34.61) | VMAFIAFLR/DRB1*0701(133.64) | VMAFIAFLR/DRB1*1101(150.52) | |
| KGLFSGQGPMKLVMA | FSGQGPMKL/DRB1*0101(7.96) | FSGQGPMKL/DRB1*0401(291.87) | FSGQGPMKL/DRB1*0701(45.66) | FSGQGPMKL/DRB1*1101(385.30) |
| SYLAGAGLLFSIMKN | YLAGAGLLF/DRB1*0101(77.61) | | | |
| RMAILGDTAWDFGSI | ILGDTAWDF/DRB1*0401(428.32) | RMAILGDTA/DRB1*0101(254.61) | | |
| MSTYGWNLVRLQSGV | WNLVRLQSG/DRB1*0701(482.71) | YGWNLVRLQ/DRB1*0101(90.67) | YGWNLVRLQ/DRB1*0401(310.60) | YGWNLVRLQ/DRB1*1101(111.49) |
| RTTWALCEVITLATG | WALCEVITL/DRB1*0101(339.28) | | | |
| ETCVYNMMGKREKKL | VYNMMGKRE/DRB1*0101(75.68) | YNMMGKREK/DRB1*1101(42.80) | | |
| ELIGRARISQGAGWS | LIGRARISQ/DRB1*1101(368.12) | | | |
| SCVTTIAKSKPTLDI | CVTTIAKSK/DRB1*1101(152.47) | IAKSKPTLD/DRB1*0701(40.99) | TIAKSKPTL/DRB1*0101(96.35) | |
| GPLVAGGLLIACYVI | GGLLIACYV/DRB1*0101(176.23) | | | |
| CGNGIFVADNVHTRT | FVADNVHTR/DRB1*0401(125.19) | IFVADNVHT/DRB1*0101(195.12) | | |

FIG. 50-15

| peptide | core/HLA(affinity(nM)) | core/HLA(affinity(nM)) | core/HLA(affinity(nM)) | core/HLA(affinity(nM)) |
|---|---|---|---|---|
| ESCVYNMMGKREKKL | VYNMMGKRE/DRB1*0101(79.35) | YNMMGKREK/DRB1*1101(46.46) | | |
| FRGSYLAGAGLLFSI | SYLAGAGLL/DRB1*0101(12.61) | YLAGAGLLF/DRB1*0701(193.87) | | |
| DMGYWIESSKNQTWQ | YWIESSKNQ/DRB1*0101(248.90) | YWIESSKNQ/DRB1*0401(171.24) | | |
| RILQRGLLGKTQVGV | ILQRGLLGK/DRB1*1101(118.04) | LQRGLLGKT/DRB1*0101(60.18) | | |
| GKFWNTTIAVSMANI | FWNTTIAVS/DRB1*0401(81.30) | FWNTTIAVS/DRB1*1101(456.78) | WNTTIAVSM/DRB1*0101(26.57) | WNTTIAVSM/DRB1*0701(39.90) |
| PIRYQTTAIKAEHTG | IRYQTTAIK/DRB1*0101(85.91) | IRYQTTAIK/DRB1*0401(114.74) | IRYQTTAIK/DRB1*1101(234.70) | RYQTTAIKA/DRB1*0701(239.96) |
| LMGLGKGWPISKVDI | MGLGKGWPI/DRB1*0101(223.40) | | | |
| NTTIAVSTANIFRGS | IAVSTANIF/DRB1*0101(80.67) | IAVSTANIF/DRB1*0401(363.29) | IAVSTANIF/DRB1*0701(41.75) | |
| LMSAAVKDQRAVHAD | VKDQRAVHA/DRB1*0101(382.65) | | | |
| SAAVKDQRAVHADMG | VKDQRAVHA/DRB1*0101(155.37) | | | |
| WKLLTKPWDVIPMV | KLLTKPWDV/DRB1*0701(392.41) | | | |
| LMGLGKGWPISKMDI | MGLGKGWPI/DRB1*0101(218.31) | | | |
| SLIGLSSRATWAQNI | LIGLSSRAT/DRB1*0101(4.06) | LIGLSSRAT/DRB1*0401(337.76) | LIGLSSRAT/DRB1*0701(333.72) | LIGLSSRAT/DRB1*1101(56.05) |
| CWCNLTSTWVTYGTC | WCNLTSTWV/DRB1*0101(259.72) | WCNLTSTWV/DRB1*0701(316.85) | | |
| NYNLVYMDEAHFTDP | YNLVYMDEA/DRB1*0101(361.82) | | | |
| WLGARFLEFEALGFM | FLEFEALGF/DRB1*0101(87.23) | FLEFEALGF/DRB1*0701(140.87) | | |
| TDGEERVILAGPIPV | VILAGPIPV/DRB1*0101(430.72) | | | |
| SYAQMWALMYFHRRD | MWALMYFHR/DRB1*1101(35.95) | YAQMWALMY/DRB1*0101(17.59) | YAQMWALMY/DRB1*0401(360.32) | YAQMWALMY/DRB1*0701(341.03) |
| VITLATGPLSTLWEG | ITLATGPLS/DRB1*0101(13.27) | ITLATGPLS/DRB1*0401(153.72) | ITLATGPLS/DRB1*0701(197.74) | |
| RFSSELLSGRGPLKL | SELLSGRGP/DRB1*0101(77.34) | | | |
| IRSATRMENLLWKQI | ATRMENLLW/DRB1*0101(434.06) | | | |

FIG. 50-16

| peptide | core/HLA(affinity(nM)) | core/HLA(affinity(nM)) | core/HLA(affinity(nM)) | core/HLA(affinity(nM)) |
|---|---|---|---|---|
| GEDGCWYGMEIRPIN | WYGMEIRPI/DRB1*0101(124.84) | | | |
| LNEGIMAIGIVSILA | GIMAIGIVS/DRB1*0101(147.36) | | | |
| CGGGIFITNEVHTWT | FITNEVHTW/DRB1*0101(422.78) | | | |
| LMCHATFTMRLLSPV | CHATFTMRL/DRB1*0401(289.42) | CHATFTMRL/DRB1*0701(22.77) | FTMRLLSPV/DRB1*0101(37.95) | FTMRLLSPV/DRB1*1101(77.71) |
| NMCTLMAIDLGEMCE | MCTLMAIDL/DRB1*0101(440.54) | | | |
| LSPIRVPNYNLVVMD | PIRVPNYNL/DRB1*0101(116.29) | PIRVPNYNL/DRB1*0701(176.41) | | |
| RVPNYNMYIMDEAHF | YNMVIMDEA/DRB1*0101(289.05) | | | |
| QWMTTEDMLTVWNRV | WMTTEDMLT/DRB1*0101(376.61) | | | |
| SLETLMLVALLATVT | LVALLATVT/DRB1*0101(110.42) | | | |
| TTANISLTAIANQAT | ISLTAIANQ/DRB1*0401(117.83) | LTAIANQAT/DRB1*0701(311.60) | NISLTAIAN/DRB1*0101(24.49) | |
| AGIMKNPTVDGIVAI | IMKNPTVDG/DRB1*0101(182.21) | IMKNPTVDG/DRB1*0401(326.40) | | |
| KCESCVYNMMGKREK | VYNMMGKRE/DRB1*0101(252.42) | YNMMGKREK/DRB1*1101(105.57) | | |
| RVIQLSRKTFDTEYP | RVIQLSRKT/DRB1*1101(84.27) | | | |
| NEGVMAVGLVSLLGS | MAVGLVSLL/DRB1*0101(158.67) | | | |
| LQGQGPMKMYMAFIA | LQGQGPMKM/DRB1*0101(53.54) | | | |
| QLLMMRTTWALCEVI | LLMMRTTWA/DRB1*0101(50.79) | MMRTTWALC/DRB1*0401(375.65) | MMRTTWALC/DRB1*0701(116.78) | MMRTTWALC/DRB1*1101(354.24) |
| AWLVHKQWFFDLPLP | WLVHKQWFF/DRB1*0701(364.99) | | | |
| QLGQVMLLVLCAVQL | LLVLCAVQL/DRB1*0101(460.98) | | | |
| EYRLRGEARKTFVEL | YRLRGEARK/DRB1*0101(263.28) | YRLRGEARK/DRB1*1101(111.85) | | |
| VVKLLTKPWDVVPMV | KLLTKPWDV/DRB1*0701(441.13) | | | |
| RDFVEGYSGGTWVDV | FVEGYSGGT/DRB1*0101(461.27) | | | |

FIG. 50-17

| peptide | core/HLA(affinity(nM)) | core/HLA(affinity(nM)) | core/HLA(affinity(nM)) |
|---|---|---|---|
| SRTTWSIHAKHEWMT | TTWSIHAKH/DRB1*1101(283.48) | | |
| DYGFGVFTTNIWLKL | FGVFTTNIW/DRB1*0401(349.42) | FTTNIWLKL/DRB1*0101(111.51) | FTTNIWLKL/DRB1*0701(44.23) | VFTTNIWLK/DRB1*1101(232.54) |
| REAIRRGLRTLILAP | IRRGLRTLI/DRB1*0101(27.00) | IRRGLRTLI/DRB1*0401(445.84) | IRRGLRTLI/DRB1*0701(36.70) | IRRGLRTLI/DRB1*1101(11.07) |
| VASVNTSRLLINRF | SVNTSRLL/DRB1*0101(147.08) | VNTSRLLI/DRB1*0701(36.47) | VNTSRLLI/DRB1*1101(78.01) | |
| PNYNLIVMDEAHFTD | IVMDEAHFT/DRB1*0401(470.06) | YNLIVMDEA/DRB1*0101(160.90) | | |
| QDVIVLGSQEGAMRT | VIVLGSQEG/DRB1*0101(50.43) | | | |
| HQWMTTEDMLTYWNR | WMTTEDMLT/DRB1*0101(218.93) | WMTTEDMLT/DRB1*0401(242.93) | | |
| QQGILGKTQVGVGVF | ILGKTQVGV/DRB1*0101(432.02) | | | |
| HWFSRENSLSGVEGE | FSRENSLSG/DRB1*0401(213.20) | WFSRENSLS/DRB1*0101(448.27) | | |
| GVCGVRSTTRLENLL | CGVRSTTRL/DRB1*0701(235.93) | VRSTTRLEN/DRB1*1101(352.92) | | |
| YMATLKNVREVKGLT | MATLKNVRE/DRB1*0101(126.00) | YMATLKNVR/DRB1*0401(472.43) | YMATLKNVR/DRB1*1101(47.37) | |
| LEPSWASVKKDLISY | WASVKKDLI/DRB1*0701(485.18) | WASVKKDLI/DRB1*1101(351.33) | | |
| TFTMRLLSPVRVPNY | MRLLSPVRV/DRB1*0101(5.13) | MRLLSPVRV/DRB1*0701(79.21) | TMRLLSPVR/DRB1*1101(42.82) | |
| CGSGIFVTDNVHTWT | IFVTDNVHT/DRB1*0101(483.05) | IFVTDNVHT/DRB1*0401(254.88) | | |
| WNTTIAVSTANIFRG | IAVSTANIF/DRB1*0401(367.08) | IAVSTANIF/DRB1*0701(29.73) | TIAVSTANI/DRB1*0101(63.72) | |
| LRFLTIPPTAGILAR | FLTIPPTAG/DRB1*0101(2.91) | FLTIPPTAG/DRB1*0401(24.31) | FLTIPPTAG/DRB1*0701(34.76) | FLTIPPTAG/DRB1*1101(42.31) |
| EEALKGMPIRYQTPA | LKGMPIRYQ/DRB1*0101(87.51) | LKGMPIRYQ/DRB1*1101(291.73) | | |
| GSGIFVDNVHTRTE | FVDNVHTR/DRB1*0401(166.64) | FVDNVHTR/DRB1*1101(406.67) | IFVDNVHT/DRB1*0101(189.83) | |
| QYIYMGQPLNNDEDH | YIYMGQPLN/DRB1*0701(59.03) | | | |
| TTRLLSSTRVPNYNL | LLSSTRVPN/DRB1*0401(237.75) | LLSSTRVPN/DRB1*0701(30.03) | LLSSTRVPN/DRB1*1101(73.40) | TRLLSSTRV/DRB1*0101(15.56) |
| VNGVWKLLTKPWDVI | KLLTKPWDV/DRB1*0701(291.96) | WKLLTKPW/DRB1*0101(213.68) | WKLLTKPW/DRB1*1101(91.21) | |

FIG. 50-18

| peptide | core/HLA(affinity(nM)) | core/HLA(affinity(nM)) | core/HLA(affinity(nM)) |
|---|---|---|---|
| NGCGLFGKGSLVTCA | FGKGSLVTC/DRB1*0701(418.87) | GLFGKGSLV/DRB1*0101(68.21) | LFGKGSLVT/DRB1*1101(476.85) |
| KELKCGSGIFVTDEV | LKCGSGIFV/DRB1*0101(414.00) | | |
| DTWKMERASFIEVKN | WKMERASFI/DRB1*0701(29.01) | WKMERASFI/DRB1*0701(233.84) | |
| MLLVLCVTQVLLMRT | LLVLCVTQV/DRB1*0101(377.62) | | |
| VQVIALEPGKNPRAV | IALEPGKNP/DRB1*0101(93.26) | IALEPGKNP/DRB1*0401(287.85) | |
| RAIWYMWLGARYLEF | IWYMWLGAR/DRB1*1101(51.13) | YMWLGARYL/DRB1*0101(6.78) | YMWLGARYL/DRB1*0701(175.05) |
| ASQILLMRTTWAFCE | ILLMRTTWA/DRB1*0101(37.71) | ILLMRTTWA/DRB1*0401(332.30) | LLMRTTWAF/DRB1*0701(427.62) | SQILLMRTT/DRB1*1101(176.45) |
| DWDYWTTDISEMGA | WDYWTTDI/DRB1*0701(332.03) | | |
| VGVVSILASSFLRND | VSILASSFL/DRB1*0701(48.15) | VVSILASSF/DRB1*0101(9.98) | VVSILASSF/DRB1*0401(290.18) | VVSILASSF/DRB1*1101(271.67) |
| ELPESLETLMLVALL | PESLETLML/DRB1*0101(361.12) | | |
| DHRLMSAAIKDSKAV | HRLMSAAIK/DRB1*0101(58.81) | HRLMSAAIK/DRB1*1101(368.04) | RLMSAAIKD/DRB1*0701(407.92) |
| LLILCASQILLMRT | LIILCASQI/DRB1*0701(310.65) | LLILCASQI/DRB1*0101(54.45) | SQILLMRTT/DRB1*1101(483.59) |
| GITVIDLEPVIYDSK | VIDLEPVIY/DRB1*0101(229.41) | | |
| EEALKGLPIRYQTPA | LKGLPIRYQ/DRB1*0101(108.05) | LKGLPIRYQ/DRB1*1101(199.28) | |
| KRRLTIMDLHPGAGK | LTIMDLHPG/DRB1*0101(25.57) | LTIMDLHPG/DRB1*0401(128.41) | LTIMDLHPG/DRB1*1101(120.73) |
| NGKKVIQLSRKTFDT | KVIQLSRKT/DRB1*1101(30.78) | | |
| ESLETLMLVALIAVL | ETLMLVALI/DRB1*0101(461.99) | | |
| WLVHRQWFLDLPLPW | WLVHRQWFL/DRB1*0101(477.14) | WLVHRQWFL/DRB1*0701(330.37) | |
| REKRSVALVPHVGMG | RSVALVPHV/DRB1*0701(382.33) | SVALVPHVG/DRB1*0101(139.20) | |
| HRRDLRLAANAICSA | DLRLAANAI/DRB1*0101(5.48) | HRRDLRLAA/DRB1*1101(188.44) | LRLAANAIC/DRB1*0401(45.99) | LRLAANAIC/DRB1*0701(94.97) |
| INGVVRLLTKPWDVL | RLLTKPWDV/DRB1*0701(256.20) | VVRLLTKPW/DRB1*0101(113.21) | VVRLLTKPW/DRB1*1101(31.77) |

FIG. 50-19

| peptide | core/HLA(affinity(nM)) | core/HLA(affinity(nM)) | core/HLA(affinity(nM)) |
|---|---|---|---|
| SLAAIANQATVLMGL | AIANQATVL/DRB1*0701(250.04) | IANQATVLM/DRB1*0401(84.43) | LAAIANQAT/DRB1*0101(12.57) |
| CVTQYLLMRTTWALC | LLMRTTWAL/DRB1*0701(429.28) | TQYLLMRTT/DRB1*1101(126.80) | VLLMRTTWA/DRB1*0101(45.27) |
| GSGIFVTDNVHTWTE | IFVTDNVHT/DRB1*0101(357.97) | IFVTDNVHT/DRB1*0401(186.23) | |
| LEDGIYRIKQKGIFG | IYRIKQKGI/DRB1*0101(440.06) | IYRIKQKGI/DRB1*0701(458.24) | IYRIKQKGI/DRB1*1101(70.39) |
| VTTSGTYVSAIAQTE | YVSAIAQTE/DRB1*0101(149.58) | YVSAIAQTE/DRB1*0701(454.83) | |
| TIITPMLRHTIENTS | ITPMLRHTI/DRB1*0101(464.70) | ITPMLRHTI/DRB1*1101(155.08) | |
| ERNRVSTGQLAKRF | NRVSTGSQL/DRB1*0101(212.63) | NRVSTGSQL/DRB1*0701(273.96) | |
| MGANFKAERVIDPRR | FKAERVIDP/DRB1*0101(198.13) | FKAERVIDP/DRB1*0401(180.86) | FKAERVIDP/DRB1*0701(498.79) |
| RVILAGPMPVTAASA | RVILAGPMP/DRB1*0101(42.98) | | |
| ATTVLTPMLRHSIEN | LTPMLRHSI/DRB1*0101(180.43) | LTPMLRHSI/DRB1*1101(69.44) | TVLTPMLRH/DRB1*0701(298.93) |
| KTFVELMRRGDLPYW | FVELMRRGD/DRB1*1101(99.23) | | |
| SSPNPTIEAGRTLRV | IEAGRTLRV/DRB1*0101(282.58) | IEAGRTLRV/DRB1*0701(208.20) | |
| RVVILAGPMPVTHSSA | VVLAGPMPV/DRB1*0101(104.54) | VILAGPMPV/DRB1*0101(24.26) | |
| MTEDMLKVVNRVWI | DMLKVVNRV/DRB1*0101(455.92) | | |
| RDFVEGVSGGTWVDI | FVEGVSGGT/DRB1*0101(460.35) | | |
| AVSMANIFRGSYLAG | ANIFRGSYL/DRB1*0701(304.55) | AVSMANIFR/DRB1*0101(112.49) | MANIFRGSY/DRB1*1101(176.51) |
| PERVILAGPMPVTVA | VILAGPMPV/DRB1*0101(24.26) | VILAGPMPV/DRB1*0701(353.52) | |
| PMKLYMAFIAFLRFL | VMAFIAFLR/DRB1*0101(59.64) | VMAFIAFLR/DRB1*0701(203.72) | VMAFIAFLR/DRB1*1101(194.25) |
| GVSGNIVSSVNTISK | IVSSVNTIS/DRB1*0101(181.64) | IVSSVNTIS/DRB1*0401(99.72) | NIVSSVNTI/DRB1*0701(62.72) |
| GNGVTRSGAYVSAI | VTRSGAYVS/DRB1*0701(217.49) | VTRSGAYV/DRB1*0101(135.17) | |
| VWFVPSIKAGNDIAA | VWFVPSIKA/DRB1*0101(48.53) | VWFVPSIKA/DRB1*1101(135.41) | |

FIG. 50-20

| peptide | core/HLA(affinity(nM)) | core/HLA(affinity(nM)) | core/HLA(affinity(nM)) |
|---|---|---|---|
| AEMEEALRGLPIRYQ | EEALRGLPI/DRB1*0101(61.73) | LRGLPIRYQ/DRB1*1101(492.36) | |
| LKGLPIRYQTPAIRA | IRYQTPAIR/DRB1*0101(17.57) | IRYQTPAIR/DRB1*0401(105.03) | IRYQTPAIR/DRB1*0701(114.86) | IRYQTPAIR/DRB1*1101(88.87) |
| PRWLDARIYADPMAL | DARIYADPM/DRB1*0101(341.01) | | |
| PRWLDARVYSDPLAL | WLDARVYSD/DRB1*0701(400.45) | | |
| WTLYAVATTIITPML | LYAVATTII/DRB1*0701(24.72) | YAVATTIIT/DRB1*0101(25.37) | YAVATTIIT/DRB1*0401(119.39) | YAVATTIIT/DRB1*1101(288.85) |
| IRSTTRLENLMWKQI | TTRLENLMW/DRB1*1101(399.40) | | |
| QGILGKTQVGVGVFQ | GKTQVGVGV/DRB1*0101(473.98) | | |
| VDLMCHATFTMRLLS | ATFTMRLLS/DRB1*1101(296.57) | CHATFTMRL/DRB1*0101(125.82) | CHATFTMRL/DRB1*0701(32.81) |
| CTLMAMDLGEMCEDT | LMAMDLGEM/DRB1*0101(432.08) | | |
| LVTFKNAHAKRQDVI | FKNAHAKRQ/DRB1*0701(105.77) | LVTFKNAHA/DRB1*0101(16.97) | LVTFKNAHA/DRB1*0401(46.93) | LVTFKNAHA/DRB1*1101(40.28) |
| QLMYFHRRDLRLASM | YFHRRDLRL/DRB1*0101(18.50) | YFHRRDLRL/DRB1*0401(493.66) | YFHRRDLRL/DRB1*0701(31.53) | YFHRRDLRL/DRB1*1101(9.27) |
| SINMLKRVRNRVSTV | LKRVRNRVS/DRB1*0101(30.10) | LKRVRNRVS/DRB1*0401(276.81) | LKRVRNRVS/DRB1*0701(39.18) | LKRVRNRVS/DRB1*1101(4.94) |
| GNGCGLFGKGSLITC | GLFGKGSLI/DRB1*0101(228.88) | | |
| NDVPMAGPLVAGGLL | DVPMAGPLV/DRB1*0101(125.34) | | |
| DEGVYRIKQQGILGK | VYRIKQQGI/DRB1*0701(301.45) | YRIKQQGIL/DRB1*0101(68.52) | YRIKQQGIL/DRB1*1101(152.31) |
| PKFEKQLGQVMLLVL | FEKQLGQVM/DRB1*0101(14.32) | FEKQLGQVM/DRB1*0701(276.76) | |
| GGLLIACYVITGTSA | CYVITGTSA/DRB1*0101(183.42) | | |
| VTRSGTYVSSIAQTE | YVSSIAQTE/DRB1*0101(260.63) | YVSSIAQTE/DRB1*0701(272.30) | |
| TYSLNTFTNMEAQLI | FTNMEAQLI/DRB1*0101(10.57) | FTNMEAQLI/DRB1*0701(41.89) | LNTFTNMEA/DRB1*0401(30.25) |
| VDLVLEHGGCVTTIA | LVLEHGGCV/DRB1*0101(151.13) | | |
| LFSGQGPMKLVMAFI | FSGQGPMKL/DRB1*0101(37.43) | FSGQGPMKL/DRB1*0701(263.85) | |

FIG. 50-21

| peptide | core/HLA(affinity(nM)) | core/HLA(affinity(nM)) | core/HLA(affinity(nM)) |
|---|---|---|---|
| NIVSSVNMVSRMLLN | IVSSVNMVS/DRB1*0401(314.68) | SVNMVSRML/DRB1*0101(27.02) | SVNMVSRML/DRB1*0701(90.60) | VNMVSRMLL/DRB1*1101(151.52) |
| WVDLVLEHGGCVTTM | LVLEHGGCV/DRB1*0101(92.67) | | | |
| IITPMLRHTIENTSA | IITPMLRHT/DRB1*1101(435.49) | | | |
| NMEAQLIRQMEGEGV | IRQMEGEGV/DRB1*0101(155.22) | | | |
| VPMSTYGWNIVKLHS | PMSTYGWNI/DRB1*0701(415.37) | YGWNIVKLH/DRB1*0101(439.45) | YGWNIVKLH/DRB1*1101(392.66) | |
| IVSSVNMVSRMLLNR | SVNMVSRML/DRB1*0101(20.13) | SVNMVSRML/DRB1*0701(114.22) | VNMVSRMLL/DRB1*1101(75.25) | |
| IGVPLLAIGCYSQVN | PLLAIGCYS/DRB1*0101(194.40) | | | |
| VSTPQGLVKRFSTGL | PQGLVKRFS/DRB1*1101(407.69) | | | |
| AWLVHKQWFLNLPLP | LVHKQWFLN/DRB1*1101(426.27) | WLVHKQWFL/DRB1*0101(222.01) | WLVHKQWFL/DRB1*0701(110.96) | |
| ETLMLVALLATVTGG | LVALLATVT/DRB1*0101(55.61) | | | |
| CGIRSVTRLENIMWK | IRSVTRLEN/DRB1*1101(86.32) | RSVTRLENI/DRB1*0701(378.21) | VTRLENIMW/DRB1*0101(397.99) | |
| AVMAVGVWSILASSF | WSILASSF/DRB1*0101(81.74) | WSILASSF/DRB1*0701(157.75) | | |
| PLNEGIMAIGVSIL | GIMAIGVS/DRB1*0101(196.83) | | | |
| KGWPIHKMDLGVPLL | HKMDLGVPL/DRB1*0101(132.46) | HKMDLGVPL/DRB1*0701(407.04) | | |
| IFITNNVHTWTEQYK | IFITNNVHT/DRB1*0101(395.53) | | | |
| QADSPKRLATAIAGA | PKRLATAIA/DRB1*0101(315.65) | | | |
| EVITLATGPLSTLWE | ITLATGPLS/DRB1*0101(7.74) | ITLATGPLS/DRB1*0401(63.48) | ITLATGPLS/DRB1*0701(104.12) | ITLATGPLS/DRB1*1101(304.61) |
| LEFFLIVLLIPEPDR | IVLLIPEPD/DRB1*0101(231.93) | | | |
| DVKKDLISYGGGWRF | ISYGGGWRF/DRB1*0701(288.77) | LISYGGGWR/DRB1*0101(479.32) | | |
| CEVLTLATGPVMTLW | LTLATGPVM/DRB1*0401(312.08) | VLTLATGPV/DRB1*0101(10.24) | VLTLATGPV/DRB1*0701(134.89) | |
| EKKKLKPRWLDARVY | KKKLKPRWL/DRB1*1101(498.69) | | | |

FIG. 50-22

| peptide | core/HLA(affinity(nM)) | core/HLA(affinity(nM)) | core/HLA(affinity(nM)) |
|---|---|---|---|
| DWLEHGSCVYTTMAK | WLEHGSCV/DRB1*0101(390.88) | | |
| MRLLSPVRPNYNLI | LSPVRPNY/DRB1*0701(93.57) | MRLLSPVRV/DRB1*0101(39.35) | MRLLSPVRV/DRB1*1101(440.83) |
| EQRKTFVDLMRRGDL | FVDLMRRGD/DRB1*1101(169.61) | | |
| VPFCSHHFHELVMKD | FCSHHFHEL/DRB1*0101(417.71) | FCSHHFHEL/DRB1*0701(219.55) | |
| CYVITGTSADLELEK | CYVITGTSA/DRB1*0101(69.67) | YVITGTSAD/DRB1*0401(307.24) | YVITGTSAD/DRB1*0701(232.21) |
| RGGWSYYCAGLKKVT | YYCAGLKKV/DRB1*0101(44.73) | YYCAGLKKV/DRB1*0701(116.20) | YYCAGLKKV/DRB1*1101(26.43) |
| FRKRRLTIMDLHPGA | FRKRRLTIM/DRB1*1101(139.64) | LTIMDLHPG/DRB1*0101(71.25) | LTIMDLHPG/DRB1*0401(234.47) | LTIMDLHPG/DRB1*0701(398.63) |
| FEKQLGQVMLLVLCA | FEKQLGQVM/DRB1*0101(78.90) | | |
| TVLMGLGKGWPISKM | MGLGKGWPI/DRB1*0101(50.57) | MGLGKGWPI/DRB1*0701(286.47) | |
| HQWMTTEDMLKVWNR | WMTTEDMLK/DRB1*0101(309.58) | WMTTEDMLK/DRB1*0401(330.43) | |
| GMLIACYVITGTSAD | CYVITGTSA/DRB1*0101(191.53) | | |
| DAKFEKQLGQIMLLI | FEKQLGQIM/DRB1*0101(10.92) | FEKQLGQIM/DRB1*0701(186.05) | FEKQLGQIM/DRB1*1101(490.73) |
| VQLLMRTSWALCEV | LLLMRTSWA/DRB1*0101(19.93) | LLLMRTSWA/DRB1*0401(252.38) | LMRTSWALC/DRB1*0701(175.35) | VQLLLMRTS/DRB1*1101(135.21) |
| CGRGGWSYYCAGLKK | SYYCAGLKK/DRB1*1101(297.67) | | |
| DIDLRPASAWTLYAV | LRPASAWTL/DRB1*0101(16.25) | LRPASAWTL/DRB1*0701(64.76) | |
| LGEFGRAKGSRAIWY | FGRAKGSRA/DRB1*0101(6.94) | FGRAKGSRA/DRB1*0401(165.96) | FGRAKGSRA/DRB1*0701(86.67) | FGRAKGSRA/DRB1*1101(54.16) |
| MLRHTIENTSANLSL | IENTSANLS/DRB1*0401(183.34) | TIENTSANL/DRB1*0101(131.02) | TIENTSANL/DRB1*0701(115.87) | |
| CGVRSTRLENLLWK | CGVRSTRL/DRB1*0701(471.68) | VRSTRLEN/DRB1*1101(387.11) | | |
| DLPWLAYKVAAEGI | AYKVAAEGI/DRB1*0701(430.36) | VWLAYKVAA/DRB1*1101(177.05) | WLAYKVAAE/DRB1*0101(104.63) | |
| VSLAAIANQATVLMG | AIANQATVL/DRB1*0701(298.96) | IANQATVLM/DRB1*0401(84.85) | LAAIANQAT/DRB1*0101(12.90) | |
| GLPIRYQTTAVKSEH | IRYQTTAVK/DRB1*0101(24.35) | IRYQTTAVK/DRB1*0401(37.20) | IRYQTTAVK/DRB1*1101(116.42) | RYQTTAVKS/DRB1*0701(88.97) |

FIG. 50-23

| peptide | core/HLA(affinity(nM)) | core/HLA(affinity(nM)) | core/HLA(affinity(nM)) | core/HLA(affinity(nM)) |
|---|---|---|---|---|
| LIAGGMLIACYVITG | GGMLIACYV/DRB1*0101(173.15) | | | |
| HRGPSLRTTASGKL | LRTTASGK/DRB1*0701(264.81) | | | |
| KGESRKTFVELMKRG | TFVELMKRG/DRB1*1101(376.99) | | | |
| IETLMLTILLATVTG | LTILLATVT/DRB1*0101(101.16) | | | |
| MAVGLVSILLSSLR | LVSILLSSLR/DRB1*1101(244.21) | VSILLSSLL/DRB1*0101(16.44) | VSILLSSLL/DRB1*0701(97.34) | |
| LTLATGPITTLWEGN | LTLATGPIT/DRB1*0101(144.94) | | | |
| QKNGSWKLARASFIE | WKLARASFI/DRB1*0101(7.52) | WKLARASFI/DRB1*0401(370.52) | WKLARASFI/DRB1*0701(14.03) | WKLARASFI/DRB1*1101(104.99) |
| GSASSMVNGVRLLT | MVNGVRLL/DRB1*0101(190.61) | MVNGVRLL/DRB1*0701(407.59) | | |
| SGNIVSSVNTISKML | IVSSVNTIS/DRB1*0101(46.06) | IVSSVNTIS/DRB1*0401(45.60) | IVSSVNTIS/DRB1*0701(29.77) | IVSSVNTIS/DRB1*1101(281.63) |
| AVVLMGLGKGWPIHR | MGLGKGWPI/DRB1*0101(58.45) | MGLGKGWPI/DRB1*0701(246.51) | VVLMGLGKG/DRB1*1101(420.80) | |
| GIFITNNVHTWTEQY | IFITNNVHT/DRB1*0101(207.32) | IFITNNVHT/DRB1*0401(424.86) | IFITNNVHT/DRB1*0701(449.46) | IFITNNVHT/DRB1*1101(448.41) |
| VTTMAKNKPTLDFEL | MAKNKPTLD/DRB1*0101(289.24) | | | |
| AVATTVLTPMLRHSI | ATTVLTPML/DRB1*0101(134.19) | ATTVLTPML/DRB1*0701(125.47) | LTPMLRHSI/DRB1*1101(66.45) | |
| KKLRPRWLDARVYSD | PRWLDARVY/DRB1*0101(348.68) | | | |
| TFTNMEVQLIRQMEA | FTNMEVQLI/DRB1*0101(51.26) | FTNMEVQLI/DRB1*0701(437.57) | MEVQLIRQM/DRB1*1101(395.19) | |
| GLPIRYQTTAIKAEH | IRYQTTAIK/DRB1*0101(23.18) | IRYQTTAIK/DRB1*0401(27.79) | IRYQTTAIK/DRB1*0701(107.39) | IRYQTTAIK/DRB1*1101(99.00) |
| GVYKEGVFHTMWHVT | VFHTMWHVT/DRB1*0101(136.08) | VFHTMWHVT/DRB1*0701(209.95) | VFHTMWHVT/DRB1*1101(287.85) | |
| CDSKLMSAAVKDQRA | KLMSAAVKD/DRB1*0101(103.50) | KLMSAAVKD/DRB1*0701(466.13) | | |
| LMVLLVPEPEKQRTP | LMVLLVPEP/DRB1*0101(255.83) | | | |
| NLIRCPLSRNSTHEM | LIRCPLSRN/DRB1*0101(482.94) | LIRCPLSRN/DRB1*1101(217.42) | | |
| VATTIVTPMLRHTIE | ATTIVTPML/DRB1*0101(298.39) | ATTIVTPML/DRB1*0701(225.03) | VTPMLRHTI/DRB1*1101(103.91) | |

FIG. 50-24

| peptide | core/HLA(affinity(nM)) | core/HLA(affinity(nM)) | core/HLA(affinity(nM)) | core/HLA(affinity(nM)) |
|---|---|---|---|---|
| KRGSIGKMLEATAK | IGKMLEATA/DRB1*0101(146.95) | | | |
| HAIFTRLLSSTRVP | FTRLLSST/DRB1*1101(29.31) | TRLLSSTRV/DRB1*0101(7.96) | TRLLSSTRV/DRB1*0401(285.70) | TRLLSSTRV/DRB1*0701(31.27) |
| LLNGKGPLRMVLAFI | LNGKGPLRM/DRB1*0101(49.26) | LNGKGPLRM/DRB1*0701(349.48) | LNGKGPLRM/DRB1*1101(471.26) | |
| PMVTQLAMTDTTPFG | LAMTDTTPF/DRB1*0401(348.41) | LAMTDTTPF/DRB1*0701(256.88) | MVTQLAMTD/DRB1*0101(205.43) | |
| WVTYSLNTFTNMEAQ | LNTFTNMEA/DRB1*0401(66.66) | TYSLNTFTN/DRB1*0101(122.70) | YSLNTFTNM/DRB1*0701(206.91) | |
| PMPVTHASAAQRRGR | VTHASAAQR/DRB1*0101(205.02) | VTHASAAQR/DRB1*0701(436.53) | | |
| SNRDFVEGVSGGAWW | FVEGVSGGA/DRB1*0101(150.15) | | | |
| VLAFITFLRVLSIPP | FITFLRVLS/DRB1*1101(20.26) | FLRVLSIPP/DRB1*0101(16.06) | FLRVLSIPP/DRB1*0401(80.73) | FLRVLSIPP/DRB1*0701(22.02) |
| EMEEALRGLPIRYQT | EEALRGLPI/DRB1*0101(56.55) | LRGLPIRYQ/DRB1*1101(275.07) | | |
| GNRDFVEGVSGGAWV | FVEGVSGGA/DRB1*0101(151.66) | | | |
| LCASQILLMRTTWAF | ILLMRTTWA/DRB1*0101(29.87) | ILLMRTTWA/DRB1*0401(206.04) | ILLMRTTWA/DRB1*0701(400.95) | SQILLMRTT/DRB1*1101(148.23) |
| TSWAFCEVLTLATGP | FCEVLTLAT/DRB1*0101(90.90) | FCEVLTLAT/DRB1*0401(207.24) | FCEVLTLAT/DRB1*0701(247.29) | FCEVLTLAT/DRB1*1101(348.74) |
| VWNRVWIQDNPNMID | VWIQDNPNM/DRB1*0101(318.96) | VWIQDNPNM/DRB1*0401(240.25) | | |
| TACLGKAYAQMWSLM | KAYAQMWSL/DRB1*0701(285.58) | LGKAYAQMW/DRB1*0101(69.94) | | |
| CWCNATSTWVMYGTC | WCNATSTWV/DRB1*0101(478.74) | WCNATSTWV/DRB1*0701(246.61) | | |
| RGLLGKTQVGVGIHI | GKTQVGVG/DRB1*0101(324.98) | TQVGVGIHI/DRB1*0701(395.83) | | |
| WPIHRVDLGVPLLAL | HRVDLGVPL/DRB1*0101(36.72) | HRVDLGVPL/DRB1*0701(197.26) | | |
| AKKQEWVLGSQEGA | VWLGSQEG/DRB1*0101(378.80) | | | |
| EDQWCGSLIGLTSRA | CGSLIGLTS/DRB1*0101(77.73) | | | |
| EDGCWYGMEIRPINE | WYGMEIRPI/DRB1*0101(95.90) | | | |
| PFCSHHFHELVMKDG | FCSHHFHEL/DRB1*0701(361.35) | | | |

FIG. 50-25

| peptide | core/HLA(affinity(nM)) | core/HLA(affinity(nM)) | core/HLA(affinity(nM)) |
|---|---|---|---|
| SLRTTVTGKIITEW | TTTVTGKII/DRB1*0701(114.00) | | |
| GVCGIRSVTRLENIM | IRSVTRLEN/DRB1*1101(87.08) | VCGIRSVTR/DRB1*0701(422.95) | VCGIRSVTR/DRB1*0701(255.15) |
| MCTLIAMDLGELCED | LIAMDLGEL/DRB1*0101(260.95) | | |
| LLMRTSWALCEVLTL | LMRTSWALC/DRB1*0101(117.15) | LMRTSWALC/DRB1*0701(205.64) | |
| APHVGMGLETRAQTW | VGMGLETRA/DRB1*0101(368.91) | | |
| PERVILAGPMPVTAA | VILAGPMPV/DRB1*0101(24.61) | | |
| MINGVVKLLTKPWDV | INGVVKLLT/DRB1*1101(65.94) | KLLTKPWDV/DRB1*0701(440.41) | VVKLLTKPW/DRB1*0701(263.26) |
| EQRKTFVDLMKRGDL | FVDLMKRGD/DRB1*1101(253.47) | | |
| GSWKLARASFIEVKS | WKLARASFI/DRB1*0101(5.16) | WKLARASFI/DRB1*0401(300.65) | WKLARASFI/DRB1*0701(3.12) | WKLARASFI/DRB1*1101(91.65) |
| LKNDVPLAGPMVAGG | DVPLAGPMV/DRB1*0101(35.15) | | |
| CCRSCTLPPLRYLGE | SCTLPPLRY/DRB1*0101(391.20) | | |
| EFIKKVRTNAAIGAV | FIKKVRTNA/DRB1*1101(36.03) | IKKVRTNAA/DRB1*0401(66.11) | IKKVRTNAA/DRB1*0701(95.98) | VRTNAAIGA/DRB1*0101(19.54) |
| DTRAQTWMSSEGAWK | QTWMSSEGA/DRB1*0101(210.82) | | |
| GIFVVDNVHTWTEQY | IFVVDNVHT/DRB1*0101(324.07) | IFVVDNVHT/DRB1*0401(354.78) | |
| STYGWNIVKLHSGKD | WNIVKLHSG/DRB1*0101(298.34) | WNIVKLHSG/DRB1*1101(90.16) | |
| QYKFQPESPARVASA | FQPESPARV/DRB1*0101(8.11) | FQPESPARV/DRB1*0401(89.65) | FQPESPARV/DRB1*0701(223.16) |
| RELKCGSGIFITDNV | LKCGSGIFI/DRB1*0101(471.01) | | |
| KIVGLYGNGVVTRSG | IVGLYGNGV/DRB1*0101(27.18) | | |
| SIGKMFEATARGARR | FEATARGAR/DRB1*1101(150.50) | MFEATARGA/DRB1*0101(82.12) | |
| SKFEKQLGQVMLLVL | FEKQLGQVM/DRB1*0101(14.29) | FEKQLGQVM/DRB1*0701(294.64) | |
| QGQGPMKMVMAFIAF | PMKMVMAFI/DRB1*0101(81.97) | | |

FIG. 50-26

| peptide | core/HLA(affinity(nM)) | core/HLA(affinity(nM)) | core/HLA(affinity(nM)) | core/HLA(affinity(nM)) |
|---|---|---|---|---|
| EHRRDKRSVALYPHV | RSVALYPHV/DRB1*0701(384.65) | | | |
| SLRTTTVSGKLIHEW | TTTVSGKLI/DRB1*0101(250.82) | TTTVSGKLI/DRB1*0701(91.75) | | |
| LSEGVYRIKQRGILG | VYRIKQRGI/DRB1*0101(193.85) | VYRIKQRGI/DRB1*0701(203.71) | YRIKQRGIL/DRB1*1101(29.65) | |
| SRTTWSIHAHHQWMT | TWSIHAHHQ/DRB1*0101(246.22) | TWSIHAHHQ/DRB1*0701(129.41) | WSIHAHHQW/DRB1*1101(225.19) | |
| LNEGYMAVGLVSLLG | MAVGLVSLL/DRB1*0101(162.60) | | | |
| TWSIHATHEWMTED | WSIHATHEW/DRB1*0701(454.82) | | | |
| RETACLGKSYAQMWQ | TACLGKSYA/DRB1*0101(398.55) | | | |
| RGAKRMAILGETAWD | RMAILGETA/DRB1*0101(231.41) | | | |
| KGEARKTFVELMKRG | TFVELMKRG/DRB1*1101(351.34) | | | |
| SLLKNDVPLAGPLIA | DVPLAGPLI/DRB1*0101(26.27) | LLKNDVPLA/DRB1*0401(126.46) | | |
| KAEFCKKVRSNAAMG | CKKVRSNAA/DRB1*0101(56.15) | FCKKVRSNA/DRB1*0401(297.67) | FCKKVRSNA/DRB1*0701(138.12) | FCKKVRSNA/DRB1*1101(30.91) |
| YAVATTIITPMLRHT | ATTIITPML/DRB1*0101(92.53) | ATTIITPML/DRB1*0401(450.71) | ATTIITPML/DRB1*0701(127.03) | TIITPMLRH/DRB1*1101(243.50) |
| RGSAKIRWIVERGMV | IRWIVERGM/DRB1*0101(413.67) | IRWIVERGM/DRB1*1101(395.42) | | |
| RLLSSTRVPNYNLIV | LSSTRVPN/DRB1*1101(429.36) | LSSTRVPNY/DRB1*0401(471.01) | LSSTRVPNY/DRB1*0701(51.34) | STRVPNYNL/DRB1*0101(295.32) |
| CWYGMEIRPVSEKEE | WYGMEIRPV/DRB1*0101(76.57) | YGMEIRPVS/DRB1*1101(373.71) | | |
| SLRETACLGKAYAQM | TACLGKAYA/DRB1*0101(455.13) | TACLGKAYA/DRB1*1101(487.90) | | |
| FSGQGPMKLYMAFIA | FSGQGPMKL/DRB1*0101(85.87) | | | |
| LNGKGPLRMVLAFIT | LRMVLAFIT/DRB1*0701(199.49) | PLRMVLAFI/DRB1*0101(42.63) | PLRMVLAFI/DRB1*1101(378.58) | |
| RVRNRVSTVQQLTKR | NRVSTVQQL/DRB1*0101(309.95) | NRVSTVQQL/DRB1*0701(209.95) | VSTVQQLTK/DRB1*1101(413.00) | |
| TDGPERVILAGPMPV | VILAGPMPV/DRB1*0101(422.35) | | | |
| RKSGKKVIQLSRKTF | KVIQLSRKT/DRB1*1101(30.87) | | | |

FIG. 50-27

| peptide | core/HLA(affinity(nM)) | core/HLA(affinity(nM)) | core/HLA(affinity(nM)) | core/HLA(affinity(nM)) |
|---|---|---|---|---|
| GSLIGLTSRATWAKN | LIGLTSRAT/DRB1*0101(3.00) | LIGLTSRAT/DRB1*0401(114.28) | LIGLTSRAT/DRB1*0701(246.98) | LIGLTSRAT/DRB1*1101(18.87) |
| EKKKLRPKWLDARTY | KKKLRPKWL/DRB1*1101(491.77) | | | |
| IVSSVNTISKMLLNR | SVNTISKML/DRB1*0101(135.67) | SVNTISKML/DRB1*0701(76.36) | VNTISKML/DRB1*1101(187.29) | |
| GRGPLKLFMAFVAFL | PLKLFMAFV/DRB1*0101(62.07) | | | |
| NKCTLMAIDLGEMCD | CTLMAIDLG/DRB1*0101(422.39) | | | |
| GNRDFVEGLSGATWV | FVEGLSGAT/DRB1*0101(32.35) | | | |
| TTVLTPMLRHSIENS | LTPMLRHSI/DRB1*0101(194.07) | LTPMLRHSI/DRB1*0701(382.69) | LTPMLRHSI/DRB1*1101(74.67) | |
| ENSWSGVEGEGLHRL | WSGVEGEGL/DRB1*0101(406.98) | | | |
| VMLLVLCVTQVLLMR | LLVLCVTQV/DRB1*0101(477.35) | | | |
| AVNMTSRMLLNRFTM | SRMLLNRFT/DRB1*0101(24.89) | SRMLLNRFT/DRB1*1101(45.06) | VNMTSRMLL/DRB1*0701(156.65) | |
| VCYVLSGSSADLSLE | CYVLSGSSA/DRB1*0101(8.65) | YVLSGSSAD/DRB1*0401(76.74) | YVLSGSSAD/DRB1*0701(71.37) | |
| RGSYLAGAGLAFSLI | YLAGAGLAF/DRB1*0101(9.77) | YLAGAGLAF/DRB1*0701(257.07) | | |
| ILTLWEGNPGRFWNT | LWEGNPGRF/DRB1*0101(344.47) | | | |
| HSIENSSVNVSLTAI | ENSSVNVSL/DRB1*0101(393.58) | ENSSVNVSL/DRB1*0701(252.44) | | |
| GRGGWSYYCAGLKKV | YYCAGLKKV/DRB1*0101(76.31) | YYCAGLKKV/DRB1*0701(133.37) | YYCAGLKKV/DRB1*1101(39.71) | |
| CLGKSYAQMWQLMYF | KSYAQMWQL/DRB1*0701(202.20) | SYAQMWQLM/DRB1*0101(43.74) | YAQMWQLMY/DRB1*1101(318.03) | |
| AGIMKNPTVDGITVI | IMKNPTVDG/DRB1*0101(242.91) | IMKNPTVDG/DRB1*0401(410.79) | | |
| KKNLTIMDLHPGAGK | LTIMDLHPG/DRB1*0101(37.10) | LTIMDLHPG/DRB1*0401(193.61) | LTIMDLHPG/DRB1*1101(176.86) | |
| TSRTTWSIHATHQWM | TTWSIHATH/DRB1*0101(486.31) | TWSIHATHQ/DRB1*0101(351.53) | WSIHATHQW/DRB1*0701(128.32) | |
| SRTTWSIHAKHQWMT | TWSIHAKHQ/DRB1*0101(456.23) | TWSIHAKHQ/DRB1*0701(285.27) | TWSIHAKHQ/DRB1*1101(116.02) | |
| LAKRFSKGLFSGQGP | KRFSKGLFS/DRB1*0101(274.60) | KRFSKGLFS/DRB1*1101(200.66) | | |

FIG. 50-28

| peptide | core/HLA(affinity(nM)) | core/HLA(affinity(nM)) | core/HLA(affinity(nM)) |
|---|---|---|---|
| DGIYRIKQKGIFGKT | IYRIKQKGI/DRB1*0101(170.66) | IYRIKQKGI/DRB1*0701(396.90) | IYRIKQKGI/DRB1*1101(39.87) |
| CVTTMAKNKPTLDFE | TMAKNKPTL/DRB1*0101(312.04) | | |
| VRSNAAIGAVFTDEN | VRSNAAIGA/DRB1*0101(200.77) | | |
| RTTWAFCEVLTLATG | FCEVLTLAT/DRB1*0101(95.93) | FCEVLTLAT/DRB1*0401(281.79) | FCEVLTLAT/DRB1*1101(391.78) |
| HKIFMKDGREIWPC | FMKDGREIW/DRB1*1101(415.82) | | |
| LSPVRVPNYNMVIMD | PVRVPNYNM/DRB1*0101(327.71) | PVRVPNYNM/DRB1*0701(381.48) | |
| LRGLPIRYQTPAVKS | IRYQTPAVK/DRB1*0101(23.91) | IRYQTPAVK/DRB1*0401(192.66) | IRYQTPAVK/DRB1*0701(252.60) | IRYQTPAVK/DRB1*1101(100.68) |
| CESTLTATGPVLTLW | LTLATGPVL/DRB1*0101(8.87) | LTLATGPVL/DRB1*0701(69.76) | |
| LMMRTTWALCEVITL | MMRTTWALC/DRB1*0101(216.67) | MMRTTWALC/DRB1*0701(188.48) | |
| VMAFIAFLRFLTIPP | FIAFLRFLT/DRB1*1101(36.69) | FLRFLTIPP/DRB1*0101(47.42) | FLRFLTIPP/DRB1*0401(112.80) | FLRFLTIPP/DRB1*0701(79.23) |
| KETACLGKSYAQMWQ | TACLGKSYA/DRB1*0101(395.73) | | |
| KRRLTIMDLHPGSGK | LTIMDLHPG/DRB1*0101(33.21) | LTIMDLHPG/DRB1*0401(158.57) | LTIMDLHPG/DRB1*1101(138.05) |
| LTAIANQAAVLMGLD | AIANQAAVL/DRB1*0401(153.91) | AIANQAAVL/DRB1*0701(257.84) | IANQAAVLM/DRB1*0101(7.15) |
| ILPSIVREAIKRGLR | IVREAIKRG/DRB1*0101(491.45) | IVREAIKRG/DRB1*1101(137.33) | |
| QTWQIEKASLIEVKT | WQIEKASLI/DRB1*0101(30.97) | WQIEKASLI/DRB1*0701(169.71) | |
| LNEGIMAVGMVSILA | GIMAVGMVS/DRB1*0101(99.88) | | |
| LGARFLEFEALGFMN | FLEFEALGF/DRB1*0101(69.65) | FLEFEALGF/DRB1*0701(156.61) | |
| LLKNDIPMTGPLVAG | DIPMTGPLV/DRB1*0101(16.90) | LLKNDIPMT/DRB1*0401(269.10) | |
| LLVLCAVQLLLMRTS | VQLLLMRTS/DRB1*0101(157.06) | VQLLLMRTS/DRB1*1101(272.42) | |
| VSGVSGNIVSVNTI | NIVSVNTI/DRB1*0701(273.84) | | |
| SVALVPHVGMGLETR | LVPHVGMGL/DRB1*0101(72.45) | | |

FIG. 50-29

| peptide | core/HLA(affinity(nM)) | core/HLA(affinity(nM)) | core/HLA(affinity(nM)) |
|---|---|---|---|
| EGVCGIRSVTRLENI | CGIRSVTRL/DRB1*0701(288.77) | IRSVTRLEN/DRB1*1101(162.44) | VCGIRSVTR/DRB1*0101(412.05) |
| WLGSQEGAMHSALA | LGSQEGAMH/DRB1*0101(213.54) | | |
| QPQWIASAIILEFFL | WIASAIILE/DRB1*0101(131.80) | WIASAIILE/DRB1*0701(93.80) | |
| WTEQYKFQPESPARL | FQPESPARL/DRB1*0701(197.45) | YKFQPESPA/DRB1*0101(18.65) | YKFQPESPA/DRB1*0401(114.00) |
| GCYSQVNPTLTIASL | CYSQVNPTL/DRB1*0401(162.04) | YSQVNPTL/DRB1*0101(18.99) | YSQVNPTTL/DRB1*0701(61.51) |
| KELKCGSGIFVIDNV | LKCGSGIFV/DRB1*0101(328.21) | | |
| AIVREAIKRKLRTLV | IKRKLRTLV/DRB1*0101(378.85) | IKRKLRTLV/DRB1*0701(332.05) | IKRKLRTLV/DRB1*1101(13.19) |
| GSASSMINGWKLLT | MINGWKLL/DRB1*0101(204.14) | | |
| RTPQDNQLAYVVIGL | QDNQLAYVV/DRB1*0101(212.41) | | |
| LMVLLIPEPEKQRTP | MYLLIPEPE/DRB1*0101(234.29) | | |
| LTIMDLHPGAGKTKR | LTIMDLHPG/DRB1*0101(294.56) | LTIMDLHPG/DRB1*1101(150.37) | LTIMDLHPG/DRB1*0401(86.65) |
| CGGLKNVKEVRGFTK | VKEVRGFTK/DRB1*1101(468.06) | | |
| FRKRRLTIMDLHPGS | FRKRRLTIM/DRB1*0701(438.35) | FRKRRLTIM/DRB1*1101(150.37) | LTIMDLHPG/DRB1*0401(286.32) |
| QGAGWSLRETACLGK | WSLRETACL/DRB1*0101(380.82) | | |
| MRHTIENTTANISLA | IENTTANIS/DRB1*0401(237.07) | TIENTTANI/DRB1*0101(305.34) | TIENTTANI/DRB1*0701(145.78) |
| DGEERWLAGPMPYT | WLAGPMPY/DRB1*0101(157.76) | | |
| NGVVTRSGAYYSAIA | VTRSGAYYS/DRB1*0701(240.33) | VTRSGAYY/DRB1*0101(144.66) | |
| MLRHSIENSSVNYSL | LRHSIENSS/DRB1*0101(351.69) | SIENSSVNV/DRB1*0701(221.36) | |
| LDNIYTPEGIIPTLF | YTPEGIIPT/DRB1*0101(204.03) | | |
| VDIGVPLLAMGCYSQ | PLLAMGCYS/DRB1*0101(170.93) | | |
| YAQMWALMYFHRRDL | WALMYFHRR/DRB1*0101(32.21) | WALMYFHRR/DRB1*0701(237.47) | WALMYFHRR/DRB1*1101(29.38) |

FIG. 50-30

| peptide | core/HLA(affinity(nM)) | core/HLA(affinity(nM)) | core/HLA(affinity(nM)) | core/HLA(affinity(nM)) |
|---|---|---|---|---|
| PMLRHTIENTSANLS | LRHTIENTS/DRB1*0101(388.84) | LRHTIENTS/DRB1*0401(299.73) | TIENTSANL/DRB1*0701(334.29) | |
| SVNTSRLLLNRFTM | SRLLLNRFT/DRB1*0101(46.85) | TSRLLLNRF/DRB1*1101(60.62) | VNTTSRLLL/DRB1*0701(187.74) | |
| WALCEALTLATGPIT | ALTLATGPI/DRB1*0101(77.92) | ALTLATGPI/DRB1*0701(258.47) | | |
| MLQGQGPMKMVMAFI | LQGQGPMKM/DRB1*0101(27.20) | LQGQGPMKM/DRB1*0701(458.73) | | |
| AQMWQLMYFHRRDLR | WQLMYFHRR/DRB1*0101(50.62) | WQLMYFHRR/DRB1*0701(268.40) | WQLMYFHRR/DRB1*1101(25.36) | |
| HGSCVTTIAKSKPTL | CVTTIAKSK/DRB1*0101(380.03) | CVTTIAKSK/DRB1*0701(197.61) | CVTTIAKSK/DRB1*1101(191.23) | |
| CGTGNIVSAVNMTSK | IVSAVNMTS/DRB1*0101(85.82) | IVSAVNMTS/DRB1*0401(39.01) | IVSAVNMTS/DRB1*0701(227.07) | IVSAVNMTS/DRB1*1101(347.43) |
| LAFITFLRVLSIPPT | FITFLRVLS/DRB1*1101(17.83) | FLRVLSIPP/DRB1*0101(8.07) | FLRVLSIPP/DRB1*0401(45.79) | FLRVLSIPP/DRB1*0701(19.10) |
| AIPPTAGILKRWGQL | TAGILKRWG/DRB1*1101(456.04) | | | |
| GLFSGQGPMKLVMAF | FSGQGPMKL/DRB1*0101(17.27) | FSGQGPMKL/DRB1*0701(121.02) | | |
| MVTFKVPHAKKQDW | MVTFKVPHA/DRB1*0101(110.59) | MVTFKVPHA/DRB1*0701(461.91) | MVTFKVPHA/DRB1*1101(56.17) | |
| SWPLNEGIMAVGMYS | NEGIMAVGM/DRB1*0101(183.47) | | | |
| LRKSGKRVIQLSRKT | RVIQLSRKT/DRB1*1101(65.07) | | | |
| RGWPIHRVDLGVPLL | HRVDLGVPL/DRB1*0101(428.67) | HRVDLGVPL/DRB1*0701(426.25) | | |
| HGSYEVKATGSASSM | VKATGSASS/DRB1*0401(438.08) | VKATGSASS/DRB1*0701(428.72) | YEVKATGSA/DRB1*0101(125.09) | |
| QILLMRTSWAFCESL | ILLMRTSWA/DRB1*0101(40.21) | ILLMRTSWA/DRB1*0401(255.36) | ILLMRTSWA/DRB1*1101(296.19) | LMRTSWAFC/DRB1*0701(200.96) |
| GSPGRFWNTTIAVST | FWNTTIAVS/DRB1*0101(205.35) | FWNTTIAVS/DRB1*0401(270.83) | WNTTIAVST/DRB1*0701(119.32) | |
| GEARKTFVELMKRGD | FVELMKRGD/DRB1*1101(255.61) | | | |
| VTTIAKNKPTLDIEL | IAKNKPTLD/DRB1*0101(97.48) | IAKNKPTLD/DRB1*0701(205.55) | | |
| LSSTRVPNYNLIVMD | STRVPNYNL/DRB1*0101(343.47) | STRVPNYNL/DRB1*0701(160.96) | | |
| RTTWALCEALTLATG | WALCEALTL/DRB1*0101(43.68) | WALCEALTL/DRB1*0701(344.83) | | |

FIG. 50-31

| peptide | core/HLA(affinity(nM)) | core/HLA(affinity(nM)) | core/HLA(affinity(nM)) |
|---|---|---|---|
| LHRMDIGVPLLAIGC | HRMDIGVPL/DRB1*0101(50.91) | HRMDIGVPL/DRB1*0701(433.07) | |
| VYRIKQRGILGRSQV | RIKQRGILG/DRB1*0101(84.06) | YRIKQRGIL/DRB1*0701(309.91) | YRIKQRGIL/DRB1*1101(25.79) |
| KETACLGKSYAQMWA | ACLGKSYAQ/DRB1*0101(330.55) | | |
| CLGKAYAQMWALMYF | YAQMWALMY/DRB1*0101(21.79) | YAQMWALMY/DRB1*0701(215.64) | YAQMWALMY/DRB1*1101(332.82) |
| QLAKRFSKGLFSGQG | KRFSKGLFS/DRB1*0101(218.62) | KRFSKGLFS/DRB1*0701(469.19) | KRFSKGLFS/DRB1*1101(135.72) |
| NTFTNMEAQLIRQME | FTNMEAQLI/DRB1*0101(8.12) | FTNMEAQLI/DRB1*0401(131.13) | FTNMEAQLI/DRB1*0701(121.02) | FTNMEAQLI/DRB1*1101(414.56) |
| TTMAKNKPTLDIELQ | MAKNKPTLD/DRB1*0101(418.56) | | |
| PTRVVASEMAEALKG | VASEMAEAL/DRB1*0101(108.19) | | |
| VRSNAALGAVFTDEN | VRSNAALGA/DRB1*0101(155.80) | | |
| GEYRLKGEARKTFVE | YRLKGEARK/DRB1*0101(201.89) | YRLKGEARK/DRB1*0701(121.02) | |
| SKNQTWQIEKASLIE | WQIEKASLI/DRB1*0101(43.95) | WQIEKASLI/DRB1*0701(115.92) | |
| ENSSVNVSLTAIANQ | VNVSLTAIA/DRB1*0101(72.15) | VNVSLTAIA/DRB1*0401(348.23) | VNVSLTAIA/DRB1*0701(383.07) |
| SYLAGAGLAFSLIKN | YLAGAGLAF/DRB1*0101(39.03) | | |
| VREALKRRLRTILA | KRRLRTLIL/DRB1*0101(80.83) | LKRRLRTLI/DRB1*0701(82.10) | LKRRLRTLI/DRB1*1101(9.84) |
| RGLRTLILAPTRVVA | LILAPTRVV/DRB1*0401(66.45) | LILAPTRVV/DRB1*0701(15.44) | TLILAPTRV/DRB1*0101(3.49) | TLILAPTRV/DRB1*1101(20.85) |
| ASSLLRNDVPMAGPL | LLRNDVPMA/DRB1*0101(37.73) | LLRNDVPMA/DRB1*0401(29.04) | LLRNDVPMA/DRB1*1101(462.68) |
| TTANISLAAIANQAT | ISLAAIANQ/DRB1*0401(127.11) | LAAIANQAT/DRB1*0701(392.00) | NISLAAIAN/DRB1*0101(20.53) |
| SRLNDTWKIEKASFI | WKIEKASFI/DRB1*0101(207.77) | WKIEKASFI/DRB1*0701(231.41) | |
| ADMGYWIESALNDTW | YWIESALND/DRB1*0101(166.25) | YWIESALND/DRB1*0401(313.91) | |
| KRKLRTLILAPTRVV | LRTLILAPT/DRB1*0701(13.66) | LRTLILAPT/DRB1*0101(3.03) | LRTLILAPT/DRB1*0401(62.78) | LRTLILAPT/DRB1*1101(16.66) |
| GGLLIACYVITGRSA | CYVITGRSA/DRB1*0101(105.52) | CYVITGRSA/DRB1*0701(320.83) | CYVITGRSA/DRB1*1101(135.09) |

FIG. 50-32

| peptide | core/HLA(affinity(nM)) | core/HLA(affinity(nM)) | core/HLA(affinity(nM)) | core/HLA(affinity(nM)) |
|---|---|---|---|---|
| RHTIENTSANLSLAA | IENTSANLS/DRB1*0101(42.94) | IENTSANLS/DRB1*0401(112.51) | IENTSANLS/DRB1*0701(100.02) | |
| RIYADPMALKDFKEF | IYADPMALK/DRB1*0101(394.29) | | | |
| IDGEYRLRGEARKTF | EYRLRGEAR/DRB1*0101(413.23) | YRLRGEARK/DRB1*1101(214.31) | | |
| YYCAGLKKVTEVKGY | YCAGLKKVT/DRB1*1101(61.85) | YYCAGLKKV/DRB1*0101(172.06) | | |
| VTKSGTYYSAITQAE | TYYSAITQA/DRB1*0101(277.42) | YYSAITQAE/DRB1*0401(199.12) | | |
| DTRAQTWMSSEGAWR | QTWMSSEGA/DRB1*0101(138.12) | | | |
| EERVILAGPMPVTHA | VILAGPMPV/DRB1*0101(41.54) | | | |
| TFVELMRRGDLPVWL | FVELMRRGD/DRB1*1101(199.16) | | | |
| LTLATGPVLTLWEGN | LTLATGPVL/DRB1*0101(130.14) | | | |
| MGLGRGWPLHRVDLG | LGRGWPLHR/DRB1*0101(168.94) | LGRGWPLHR/DRB1*1101(451.01) | | |
| GCGLFGKGGIVTCAM | FGKGGIVTC/DRB1*0101(193.13) | | | |
| VSTVSQLAKRFSRGM | TVSQLAKRF/DRB1*0101(265.41) | VSQLAKRFS/DRB1*1101(46.84) | | |
| LAAIANQAAILMGLG | AIANQAAIL/DRB1*0701(341.34) | IANQAAILM/DRB1*0101(9.81) | IANQAAILM/DRB1*0401(233.24) | |
| GTAYGVLFSGVSWTM | LFSGVSWTM/DRB1*0701(211.44) | YGVLFSGVS/DRB1*0101(22.80) | YGVLFSGVS/DRB1*1101(197.75) | |
| ANYSLAAIANQAYVL | LAAIANQAV/DRB1*0101(8.97) | LAAIANQAV/DRB1*0401(154.37) | LAAIANQAV/DRB1*0701(71.94) | |
| IGAIALDFKPGTSGS | IALDFKPGT/DRB1*1101(442.72) | | | |
| ENVFHTMWHVTRGAV | FHTMWHVTR/DRB1*0101(16.08) | FHTMWHVTR/DRB1*0401(435.02) | FHTMWHVTR/DRB1*0701(81.33) | FHTMWHVTR/DRB1*1101(19.74) |
| FVELMRRGDLPVWLA | FVELMRRGD/DRB1*1101(418.91) | | | |
| STGSQLAKRFSKGLF | GSQLAKRFS/DRB1*1101(175.82) | | | |
| YQFQADSPKRLASAI | FQADSPKRL/DRB1*0101(30.57) | FQADSPKRL/DRB1*0401(225.14) | FQADSPKRL/DRB1*0701(94.59) | FQADSPKRL/DRB1*1101(372.79) |
| IMTIDLDPVYDSKF | IDLDPVYYD/DRB1*0401(339.27) | | | |

FIG. 50-33

| peptide | core/HLA(affinity(nM)) | core/HLA(affinity(nM)) | core/HLA(affinity(nM)) |
|---|---|---|---|
| RVPNYNLVIMDEAHF | YNLVIMDEA/DRB1*0101(276.41) | | |
| NEAIMAVGLYSILLS | NEAIMAVGL/DRB1*0101(224.62) | | |
| GVVKLLTKPWDVLPM | KLLTKPWDV/DRB1*0701(310.17) | VKLLTKPWD/DRB1*1101(148.71) | VVKLLTKPW/DRB1*0101(271.68) |
| ELPDTIETLMLLTLI | PDTIETLML/DRB1*0101(492.99) | | |
| WNRVWIQDNPNMIDK | VWIQDNPNM/DRB1*0101(144.98) | VWIQDNPNM/DRB1*0401(125.53) | WIQDNPNMI/DRB1*0701(493.98) |
| ETWKLEKASFIEVKT | WKLEKASFI/DRB1*0101(48.58) | WKLEKASFI/DRB1*0701(233.33) | |
| GWPISKVDIGVPLLA | SKVDIGVPL/DRB1*0101(199.97) | SKVDIGVPL/DRB1*0701(307.38) | |
| RNDVPLAGPLIAGGM | DVPLAGPLI/DRB1*0101(55.60) | | |
| KGSRAIWYMWLGARF | IWYMWLGAR/DRB1*0101(78.69) | IWYMWLGAR/DRB1*1101(118.47) | |
| PLAGPMVAGGLLLAA | PMVAGGLLL/DRB1*0101(146.70) | | |
| GSYEVKATGSASSMI | EVKATGSAS/DRB1*0101(74.12) | VKATGSASS/DRB1*0401(236.63) | VKATGSASS/DRB1*0701(145.69) |
| TLVTFKNPHAKRQDV | LVTFKNPHA/DRB1*0101(12.13) | LVTFKNPHA/DRB1*0401(10.36) | LVTFKNPHA/DRB1*0701(96.24) | LVTFKNPHA/DRB1*1101(25.52) |
| EALKRLRTLILAPT | LKRRLRTLI/DRB1*0701(96.00) | LKRRLRTLI/DRB1*1101(15.00) | LRTLILAPT/DRB1*0101(17.56) | LRTLILAPT/DRB1*0401(301.02) |
| EKRSVALTPHSGTGL | LTPHSGTGL/DRB1*0701(353.63) | SVALTPHSG/DRB1*0101(122.85) | |
| ANFKAGRVIDPRRCL | FKAGRVIDP/DRB1*0101(229.66) | FKAGRVIDP/DRB1*0701(404.29) | |
| EFRLRGEQRKTFVDL | FRLRGEQRK/DRB1*1101(259.49) | | |
| GSSLLKNDVPLAGPM | LLKNDVPLA/DRB1*0101(44.38) | LLKNDVPLA/DRB1*0401(63.15) | |
| FLRFLTIPPTAGILA | FLTIPPTAG/DRB1*0101(2.43) | FLTIPPTAG/DRB1*0401(12.75) | FLTIPPTAG/DRB1*0701(21.97) | FLTIPPTAG/DRB1*1101(18.00) |
| VVLGSQEGAMHTAL | LGSQEGAMH/DRB1*0101(77.78) | LGSQEGAMH/DRB1*0401(415.05) | |
| PNYNLIIMDEAHFTD | YNLIIMDEA/DRB1*0101(101.27) | YNLIIMDEA/DRB1*0401(485.10) | |
| TEDMLSVWNRVWIRD | DMLSVWNRV/DRB1*0101(479.13) | | |

FIG. 50-34

| peptide | core/HLA(affinity(nM)) | core/HLA(affinity(nM)) | core/HLA(affinity(nM)) |
|---|---|---|---|
| ANDWDFVTTDISEM | WDFVTTDI/DRB1*0701(215.42) | | |
| EKKLGEFGRAKGSRA | FGRAKGSRA/DRB1*0101(107.50) | FGRAKGSRA/DRB1*1101(323.01) | |
| GKAKGSRAIWYMWLG | AKGSRAIWY/DRB1*0101(462.22) | | |
| KVIQLSRKTFDTEYQ | KVIQLSRKT/DRB1*1101(98.61) | | |
| GWSYYMATLKNVREV | YMATLKNVR/DRB1*1101(16.11) | YYMATLKNV/DRB1*0401(90.95) | YYMATLKNV/DRB1*0701(48.90) |
| KGLPIRYQTPAIRAE | IRYQTPAIR/DRB1*0101(14.10) | IRYQTPAIR/DRB1*0401(74.62) | IRYQTPAIR/DRB1*0701(113.01) |
| AAIANQATVLMGLGK | IANQATVLM/DRB1*0101(53.82) | IANQATVLM/DRB1*0401(264.47) | |
| WLDARIYSDPLALRE | DARIYSDPL/DRB1*0101(327.70) | IYSDPLALR/DRB1*0401(332.00) | |
| VVYDSKFEKQLGQVM | FEKQLGQVM/DRB1*0101(88.90) | | |
| VGLVSILLSSLLKND | LVSILLSSL/DRB1*1101(227.07) | VSILLSSL/DRB1*0701(14.42) | |
| AIMAVGLVSILLSSL | LVSILLSSL/DRB1*0101(163.27) | VSILLSSL/DRB1*0701(168.97) | |
| MGEDGCWYGMEIRPI | WYGMEIRPI/DRB1*0101(228.67) | | |
| KKLGEFGRAKGSRAI | FGRAKGSRA/DRB1*0101(26.92) | FGRAKGSRA/DRB1*0401(469.25) | FGRAKGSRA/DRB1*1101(158.33) |
| STLWEGSPGRFWNIT | LWEGSPGRF/DRB1*0101(386.31) | | |
| AIANQAVVLMGLGRG | AIANQAVVL/DRB1*0101(170.97) | | |
| YKFQADSPSKLASAI | FQADSPSKL/DRB1*0101(19.10) | FQADSPSKL/DRB1*0401(50.16) | FQADSPSKL/DRB1*0701(58.21) |
| TVIDLEPWYDSKFE | VIDLEPWY/DRB1*0101(498.85) | | |
| TEQYKFQPESPKRLS | FQPESPKRL/DRB1*0101(41.67) | FQPESPKRL/DRB1*0701(219.56) | YKFQPESPK/DRB1*0401(420.48) | YKFQPESPK/DRB1*1101(374.18) |
| TREEFIKKVRTNAAI | FIKKVRTNA/DRB1*1101(26.23) | IKKVRTNAA/DRB1*0401(89.22) | IKKVRTNAA/DRB1*0401(176.58) | IKKVRTNAA/DRB1*0701(92.83) |
| DDVDCWCNATSTWVM | WCNATSTWV/DRB1*0701(212.17) | | |
| SSVNMVSRMLLNRFT | MVSRMLLNR/DRB1*1101(49.69) | SVNMVSRML/DRB1*0101(26.18) | VSRMLLNRF/DRB1*0701(147.23) |

FIG. 50-35

| peptide | core/HLA(affinity(nM)) | core/HLA(affinity(nM)) | core/HLA(affinity(nM)) |
|---|---|---|---|
| IFVIDNVHTWTEQYK | IFVIDNVHT/DRB1*0101(356.53) | | |
| IANQATVLMGLGKGW | IANQATVLM/DRB1*0101(428.52) | | |
| NTFTNMEVQLIRQME | FTNMEVQLI/DRB1*0101(33.17) | FTNMEVQLI/DRB1*0401(288.15) | FTNMEVQLI/DRB1*0701(267.45) |
| SQLAKRFSKGLFSGQ | KRFSKGLFS/DRB1*0701(277.26) | KRFSKGLFS/DRB1*0701(383.07) | KRFSKGLFS/DRB1*1101(126.65) |
| RELKCGSGIFITNEV | LKCGSGIFI/DRB1*0101(407.87) | | |
| AYTALFGGVSWMVRI | LFGGVSWMV/DRB1*0701(73.99) | YTALFGGVS/DRB1*0101(15.34) | YTALFGGVS/DRB1*1101(215.81) |
| WVDWVLEHGGCVTTM | VVLEHGGCV/DRB1*0101(228.47) | | |
| PTSRTTWSIHAHHQW | TTWSIHAHH/DRB1*1101(313.98) | WSIHAHHQW/DRB1*0701(220.79) | |
| TVSQLAKRFSRGMLQ | AKRFSRGML/DRB1*0701(207.09) | KRFSRGMLQ/DRB1*0101(251.22) | VSQLAKRFS/DRB1*1101(43.96) |
| AVGLVSILLSLLRN | LVSILLSSL/DRB1*0401(367.23) | LVSILLSSL/DRB1*1101(161.23) | VSILLSSL/DRB1*0101(12.36) VSILLSSL/DRB1*0701(92.59) |
| TKPWDWPTVTQMAM | WDWPTVTQ/DRB1*0101(152.89) | WDWPTVTQ/DRB1*0401(293.71) | WDWPTVTQ/DRB1*0701(378.86) |
| RTSWAFCESLTLATG | FCESLTLAT/DRB1*0401(96.33) | FCESLTLAT/DRB1*0701(54.77) | WAFCESLTL/DRB1*0101(35.70) WAFCESLTL/DRB1*1101(256.87) |
| SSTRVPNYNLIVMDE | STRVPNYNL/DRB1*0701(464.53) | | |
| DGIVAIDLDPISYDA | VAIDLDPIS/DRB1*0401(340.97) | | |
| HFHQLIMKDGRVLVV | IMKDGRVL/DRB1*1101(121.60) | LIMKDGRVL/DRB1*0701(213.11) | QLIMKDGRV/DRB1*0101(27.38) |
| EIGAIALDFSPGTSG | IALDFSPGT/DRB1*0101(358.43) | IALDFSPGT/DRB1*0401(81.76) | |
| DIAACLRKNGKRVIQ | IAACLRKNG/DRB1*1101(74.17) | | |
| IFKLTYQNKVVKVLR | FKLTYQNKV/DRB1*0101(32.64) | FKLTYQNKV/DRB1*0401(488.43) | FKLTYQNKV/DRB1*0701(21.87) FKLTYQNKV/DRB1*1101(46.93) |
| SWAFCEVLTLATGPI | FCEVLTLAT/DRB1*0101(50.83) | FCEVLTLAT/DRB1*0401(177.41) | FCEVLTLAT/DRB1*1101(285.06) VLTLATGPI/DRB1*0701(116.33) |
| CDSKLMSAAVKDNRA | KLMSAAVKD/DRB1*0701(476.54) | SKLMSAAVK/DRB1*0101(116.31) | |
| VDLHPASAWTLYAVA | LHPASAWTL/DRB1*0101(39.07) | LHPASAWTL/DRB1*0701(87.50) | |

FIG. 50-36

| peptide | core/HLA(affinity(nM)) | core/HLA(affinity(nM)) | core/HLA(affinity(nM)) |
|---|---|---|---|
| VTYSLNTFTNMEAQL | LNTFTNMEA/DRB1*0101(70.57) | LNTFTNMEA/DRB1*0401(45.79) | LNTFTNMEA/DRB1*0701(197.15) |
| NGGGLFGKGSLITCA | FGKGSLITC/DRB1*0701(489.47) | GLFGKGSLI/DRB1*0101(101.80) | |
| GNLIRCPLSRNSTHE | LIRCPLSRN/DRB1*0101(327.21) | LIRCPLSRN/DRB1*1101(166.94) | |
| GEDGCWYGMEIRPLK | WYGMEIRPL/DRB1*0101(59.01) | YGMEIRPLK/DRB1*1101(270.87) | |
| SELPETLETLLLAL | PETLETLLL/DRB1*0101(285.76) | | |
| KVRTNAAIGAVFVDE | VRTNAAIGA/DRB1*0101(36.50) | VRTNAAIGA/DRB1*0401(418.14) | VRTNAAIGA/DRB1*0701(375.36) |
| ELQWIASAIVLEFFL | LQWIASAIV/DRB1*0101(15.92) | LQWIASAIV/DRB1*0701(30.09) | |
| VAGGLLIACYVITGR | GGLLIACYV/DRB1*0101(307.92) | | |
| PHWIAASIILEFFLM | HWIAASIIL/DRB1*0101(176.63) | HWIAASIIL/DRB1*0701(188.83) | |
| ETRAQTWMSAEGAWR | QTWMSAEGA/DRB1*0101(59.07) | | |
| AEALKGLPIRYQTTA | LKGLPIRYQ/DRB1*0101(51.57) | LKGLPIRYQ/DRB1*1101(141.96) | |
| IRYQTPAVKSEHTGR | IRYQTPAVK/DRB1*0101(281.73) | | |
| CESCVYNMMGKREKK | VYNMMGKRE/DRB1*0101(155.16) | YNMMGKREK/DRB1*1101(64.79) | |
| GEYRLRGEQRKTFVE | YRLRGEQRK/DRB1*1101(275.81) | | |
| SRTTWSIHASHEWMT | TWSIHASHE/DRB1*0101(486.18) | WSIHASHEW/DRB1*0701(186.48) | |
| RVLSIPPTAGVLARW | VLSIPPTAG/DRB1*0101(28.40) | VLSIPPTAG/DRB1*0701(440.38) | |
| CETCVYNMMGKREKK | VYNMMGKRE/DRB1*0101(148.00) | YNMMGKREK/DRB1*1101(58.48) | |
| FINKVRSNAALGAVF | FINKVRSNA/DRB1*1101(94.60) | VRSNAALGA/DRB1*0101(11.34) | VRSNAALGA/DRB1*0401(70.65) VRSNAALGA/DRB1*0701(57.74) |
| DYGFVFTTNIWLRL | FGVFTTNIW/DRB1*0401(355.05) | FTTNIWLRL/DRB1*0101(97.63) | FTTNIWLRL/DRB1*0701(39.23) FTTNIWLRL/DRB1*1101(255.71) |
| IPPTAGILARWGSFK | ILARWGSFK/DRB1*1101(358.89) | | |
| INKVRSNAALGAVFT | VRSNAALGA/DRB1*0101(10.51) | VRSNAALGA/DRB1*0401(86.17) | VRSNAALGA/DRB1*0701(91.09) VRSNAALGA/DRB1*1101(327.70) |

FIG. 50-37

| peptide | core/HLA(affinity(nM)) | core/HLA(affinity(nM)) | core/HLA(affinity(nM)) | core/HLA(affinity(nM)) |
|---|---|---|---|---|
| QPESPARLATAIAGA | PARLATAIA/DRB1*0101(327.01) | | | |
| TGQLLMMRTTWALCE | LLMMRTTWA/DRB1*0101(29.95) | LLMMRTTWA/DRB1*0401(313.80) | LLMMRTTWA/DRB1*1101(237.12) | MMRTTWALC/DRB1*0701(317.06) |
| AKGARRMAILGDTAW | RMAILGDTA/DRB1*0101(465.66) | | | |
| FPTSRTTWSJHAKHE | TTWSJHAKH/DRB1*1101(421.83) | | | |
| YSGVEGEGLHRLGYI | YSGVEGEGL/DRB1*0101(278.98) | | | |
| GEIGAIALDFSPGTS | IALDFSPGT/DRB1*0401(165.96) | | | |
| GNDIAACLRKNGKRV | IAACLRKNG/DRB1*1101(82.63) | | | |
| GKSYAQMWQLMYFHR | MWQLMYFHR/DRB1*1101(91.48) | YAQMWQLMY/DRB1*0101(29.56) | YAQMWQLMY/DRB1*0701(245.98) | |
| SSVNMISRMLLNRFT | ISRMLLNRF/DRB1*0101(20.32) | ISRMLLNRF/DRB1*0401(329.27) | ISRMLLNRF/DRB1*0701(113.49) | ISRMLLNRF/DRB1*1101(37.58) |
| KLFMALVAFLRFLAI | FMALVAFLR/DRB1*0101(19.47) | FMALVAFLR/DRB1*0701(167.01) | LVAFLRFLA/DRB1*1101(59.87) | |
| GIRSTRLENLMWKQ | IRSTRLEN/DRB1*1101(300.31) | | | |
| GANFKAGRVIDPRRC | FKAGRVIDP/DRB1*0101(144.03) | FKAGRVIDP/DRB1*0701(320.65) | | |
| MVNGVVRLLTKPWDV | GVVRLLTKP/DRB1*1101(45.81) | RLLTKPWDV/DRB1*0701(484.95) | VVRLLTKPW/DRB1*0101(204.59) | |
| SEMAEALKGLPIRYQ | AEALKGLPI/DRB1*0101(46.90) | LKGLPIRYQ/DRB1*1101(467.88) | | |
| RDKRSVALAPHYGMG | RSVALAPHY/DRB1*0701(365.83) | SVALAPHVG/DRB1*0101(91.67) | | |
| NIVSSVNMISRMLIN | IVSSVNMIS/DRB1*0401(192.96) | NIVSSVNMI/DRB1*0701(70.16) | SVNMISRML/DRB1*0101(25.47) | VNMISRMLI/DRB1*1101(102.49) |
| NRVWIQDNPNMIDKT | WIQDNPNMI/DRB1*0101(145.15) | WIQDNPNMI/DRB1*0401(135.48) | | |
| RKVRSNAAIGAVFTD | VRSNAAIGA/DRB1*0101(14.01) | VRSNAAIGA/DRB1*0401(135.21) | VRSNAAIGA/DRB1*0701(156.45) | |
| ENDQYIYMGQPLNND | YIYMGQPLN/DRB1*0101(51.59) | | | |
| SGIFVTDEVHTWTEQ | FVTDEVHTW/DRB1*0401(456.68) | | | |
| EGAMRTALTGATEIQ | MRTALTGAT/DRB1*0101(76.67) | MRTALTGAT/DRB1*0401(383.90) | | |

FIG. 50-38

| peptide | core/HLA(affinity(nM)) | core/HLA(affinity(nM)) | core/HLA(affinity(nM)) | core/HLA(affinity(nM)) |
|---|---|---|---|---|
| YDAKFEKQLGQIMLL | FEKQLGQIM/DRB1*0101(14.56) | FEKQLGQIM/DRB1*0701(178.72) | FEKQLGQIM/DRB1*1101(472.97) | |
| GKTKRYLPAIVREAL | TKRYLPAIV/DRB1*0101(30.86) | TKRYLPAIV/DRB1*0701(248.47) | TKRYLPAIV/DRB1*1101(87.90) | YLPAIVREA/DRB1*0401(449.69) |
| IANQAAVLMGLDKGW | IANQAAVLM/DRB1*0101(312.27) | | | |
| KRFSTGLLNGKGPLR | STGLLNGKG/DRB1*0101(140.93) | | | |
| NSTHEMYWVSGATGN | MYWVSGATG/DRB1*0101(277.55) | | | |
| DISEMGANFRAERVI | ISEMGANFR/DRB1*0101(410.77) | | | |
| NGCGLFGKGGWTCA | FGKGGWTC/DRB1*0101(258.72) | | | |
| YNMMGKREKKLGEFG | YNMMGKREK/DRB1*1101(240.45) | | | |
| GSYEVKPTGSASSMI | YEVKPTGSA/DRB1*0101(266.08) | | | |
| RNDVPMAGPLVAGGL | DVPMAGPLV/DRB1*0101(55.44) | | | |
| VILAGPIPVTPSSAA | VILAGPIPV/DRB1*0101(461.68) | | | |
| EGRTLRVLKMVEPWL | TLRVLKMVE/DRB1*1101(214.12) | VLKMVEPWL/DRB1*0101(154.73) | | |
| SAWTLYAVATTFITP | LYAVATTF/DRB1*0701(34.99) | TLYAVATTF/DRB1*0101(31.41) | YAVATTFIT/DRB1*0401(63.28) | YAVATTFIT/DRB1*1101(436.13) |
| GVFQEGTFHTMWHVT | FQEGTFHTM/DRB1*0101(174.12) | FQEGTFHTM/DRB1*0701(307.34) | | |
| VYRIKQQGILGKTQV | RIKQQGILG/DRB1*0101(51.75) | YRIKQQGIL/DRB1*0701(388.82) | YRIKQQGIL/DRB1*1101(145.19) | |
| YMWLGARFLEFFALG | YMWLGARFL/DRB1*0101(79.50) | | | |
| AIANQAAVLMGLDKG | IANQAAVLM/DRB1*0101(41.25) | | | |
| CVYNMMGKREKKLGE | VYNMMGKRE/DRB1*0101(128.73) | YNMMGKREK/DRB1*1101(57.80) | | |
| FESTYRGAKRMAILG | YRGAKRMAI/DRB1*0101(50.61) | YRGAKRMAI/DRB1*0701(120.95) | YRGAKRMAI/DRB1*1101(20.10) | |
| ALGCYSQVNPLTLTA | CYSQVNPLT/DRB1*0101(11.30) | CYSQVNPLT/DRB1*0401(72.80) | YSQVNPLTL/DRB1*0701(24.65) | YSQVNPLTL/DRB1*1101(349.87) |
| PVPMSTYGWNIVKLH | MSTYGWNIV/DRB1*0101(478.90) | PMSTYGWNI/DRB1*0701(322.20) | | |

FIG. 50-39

| peptide | core/HLA(affinity(nM)) | core/HLA(affinity(nM)) | core/HLA(affinity(nM)) | core/HLA(affinity(nM)) |
|---|---|---|---|---|
| LGQVMLLILCASQIL | LLILCASQI/DRB1*0101(45.40) | LLILCASQI/DRB1*0701(233.48) | | |
| VPSIKAGNDIAACLR | IKAGNDIAA/DRB1*0101(296.23) | | | |
| AFCEALTLATGPVST | FCEALTLAT/DRB1*0401(131.90) | FCEALTLAT/DRB1*0701(236.17) | LTLATGPVS/DRB1*0101(35.36) | |
| VNMISRMLLNRFTTR | ISRMLLNRF/DRB1*0101(14.52) | ISRMLLNRF/DRB1*0401(244.49) | ISRMLLNRF/DRB1*0701(181.33) | ISRMLLNRF/DRB1*1101(23.69) |
| DGAYRIMQRGLFGYS | YRIMQRGLF/DRB1*0101(39.75) | YRIMQRGLF/DRB1*1101(25.25) | | |
| VPMSTYGWNIVKLMS | PMSTYGWNI/DRB1*0701(322.86) | YGWNIVKLM/DRB1*0101(202.64) | | |
| TVLTPMLRHSIENSS | LTPMLRHSI/DRB1*0101(372.53) | LTPMLRHSI/DRB1*1101(144.47) | | |
| EAIKRKLRTLILAPT | IKRKLRTLI/DRB1*0701(112.34) | IKRKLRTLI/DRB1*1101(12.88) | LRTLILAPT/DRB1*0101(19.32) | LRTLILAPT/DRB1*0401(341.83) |
| LCEALTLATGPITTL | LTLATGPIT/DRB1*0101(15.15) | LTLATGPIT/DRB1*0401(314.91) | LTLATGPIT/DRB1*0701(105.59) | |
| NRDFVEGVSGGTWVD | FVEGVSGGT/DRB1*0101(315.92) | | | |
| HHFHQLIMKDGRVLV | FHQLIMKDG/DRB1*1101(112.83) | LIMKDGRVL/DRB1*0701(363.08) | QLIMKDGRV/DRB1*0101(37.79) | |
| AGKTKRYLPAIVREA | TKRYLPAIV/DRB1*0101(41.41) | TKRYLPAIV/DRB1*0701(348.51) | TKRYLPAIV/DRB1*1101(103.43) | |
| RRDLRLAANAICSAV | DLRLAANAI/DRB1*0101(5.67) | LRLAANAIC/DRB1*0401(36.45) | LRLAANAIC/DRB1*0701(87.40) | LRLAANAIC/DRB1*1101(368.16) |
| RYQTTAIKAEHTGRE | TTAIKAEHT/DRB1*0101(184.92) | | | |
| AAYTALFGGVSWMYR | LFGGVSWMV/DRB1*0701(106.16) | YTALFGGVS/DRB1*0101(12.66) | YTALFGGVS/DRB1*1101(173.81) | |
| GRARVSQGAGWSLKE | VSQGAGWSL/DRB1*0101(296.62) | | | |
| RKNGKRVIQLSRKTF | RVIQLSRKT/DRB1*1101(27.88) | | | |
| ARVYADPMALKDFKE | VYADPMALK/DRB1*0101(360.46) | | | |
| SMINGVRLLTKPWD | INGVVRLLT/DRB1*1101(38.34) | SMINGVVRL/DRB1*0101(210.08) | | |
| ETACLGKSYAQMWTL | CLGKSYAQM/DRB1*0101(259.70) | CLGKSYAQM/DRB1*0701(337.56) | | |
| TPQDNQLIYVILTIL | NQLIYVILT/DRB1*0101(397.51) | | | |

FIG. 50-40

| peptide | core/HLA(affinity(nM)) | core/HLA(affinity(nM)) | core/HLA(affinity(nM)) |
|---|---|---|---|
| ALVAFLRFLAIPPTA | FLRFLAIPP/DRB1*0101(4.88) | FLRFLAIPP/DRB1*0401(51.37) | FLRFLAIPP/DRB1*0701(40.64) | LVAFLRFLA/DRB1*1101(27.81) |
| LLKNDVPLAGPMVAG | DVPLAGPMV/DRB1*0101(28.95) | LLKNDVPLA/DRB1*0401(260.58) | | |
| AGGMLIACYVITGTS | GGMLIACYV/DRB1*0101(345.11) | | | |
| SKLMSAAVKDNRAVH | KLMSAAVKD/DRB1*0101(176.18) | KLMSAAVKD/DRB1*0701(419.67) | | |
| ASQILLMRTSWAFCE | ILLMRTSWA/DRB1*0101(18.14) | ILLMRTSWA/DRB1*0401(116.86) | LLMRTSWAF/DRB1*0701(243.91) | SQILLMRTS/DRB1*1101(108.10) |
| DMGYWIESALNDTWK | YWIESALND/DRB1*0101(116.84) | YWIESALND/DRB1*0401(260.13) | | |
| QVPFCSHHFHELVMK | FCSHHFHEL/DRB1*0101(288.12) | FCSHHFHEL/DRB1*0701(132.02) | | |
| LMYADDTAGWDTRIT | MYADDTAGW/DRB1*0401(420.96) | | | |
| TSRTTWSIHAHHQWM | TTWSIHAHH/DRB1*1101(225.82) | TWSIHAHHQ/DRB1*0101(382.53) | WSIHAHHQW/DRB1*0701(165.01) | |
| DGCWYGMEIRPVSEK | WYGMEIRPV/DRB1*0101(41.04) | YGMEIRPVS/DRB1*1101(225.46) | | |
| CCRSCTLPPLRFKGE | SCTLPPLRF/DRB1*0101(441.08) | | | |
| GSSIGKMLEATAKGA | IGKMLEATA/DRB1*0101(42.49) | | | |
| QATYLMGLGRGWPLH | MGLGRGWPL/DRB1*0101(73.36) | MGLGRGWPL/DRB1*0701(397.21) | | |
| PYKTWAYHGSYETKQ | WAYHGSYET/DRB1*0101(390.82) | | | |
| YRLRGESRKTFVELM | YRLRGESRK/DRB1*1101(261.66) | | | |
| TFTTRLLSSTRVPNY | FTTRLLSST/DRB1*1101(36.29) | TRLLSSTRV/DRB1*0101(5.92) | TRLLSSTRV/DRB1*0401(238.59) | TRLLSSTRV/DRB1*0701(31.97) |
| SIENSSVNVSLTAIA | ENSSVNVSL/DRB1*0701(268.92) | VNVSLTAIA/DRB1*0101(271.83) | | |
| AVGLVSLLGSSLLKN | LVSLLGSSL/DRB1*0101(2.52) | LVSLLGSSL/DRB1*0401(157.99) | LVSLLGSSL/DRB1*0701(53.27) | LVSLLGSSL/DRB1*1101(89.95) |
| IGAVSLDFSPGTSGS | VSLDFSPGT/DRB1*0401(427.61) | | | |
| RSHTLWSNGVLESQM | TLWSNGVLE/DRB1*0101(464.90) | | | |
| LLSGRGPLKLFMAFV | LLSGRGPLK/DRB1*0101(78.02) | LSGRGPLKL/DRB1*0701(424.01) | LSGRGPLKL/DRB1*1101(478.02) | |

FIG. 50-41

| peptide | core/HLA(affinity(nM)) | core/HLA(affinity(nM)) | core/HLA(affinity(nM)) | core/HLA(affinity(nM)) |
|---|---|---|---|---|
| SHTLWSNGVLESQML | NGVLESQML/DRB1*0101(322.08) | | | |
| MEEALKGMPIRYQTP | ALKGMPIRY/DRB1*0101(69.52) | LKGMPIRYQ/DRB1*1101(357.45) | | |
| LTIMDLHPGSGKTRK | LTIMDLHPG/DRB1*0101(416.65) | | | |
| WSGVEGEGLHRLGYI | VEGEGLHRL/DRB1*0101(443.71) | | | |
| EQRKTFVELMKRGDL | FVELMKRGD/DRB1*1101(145.86) | | | |
| QKGIFGKTQVGVGVQ | IFGKTQVGV/DRB1*0101(343.71) | | | |
| DFVEGVSGGAWVDLV | FVEGVSGGA/DRB1*0101(441.87) | | | |
| AIALDFSPGTSGSPI | IALDFSPGT/DRB1*0101(319.96) | IALDFSPGT/DRB1*0401(164.32) | | |
| ASVNTSRLLLNRFT | SRLLLNRFT/DRB1*0101(95.96) | VNTSRLLL/DRB1*0701(96.12) | VNTTSRLLL/DRB1*1101(79.33) | |
| DQWCGSLIGLTSRAT | LIGLTSRAT/DRB1*0101(7.69) | LIGLTSRAT/DRB1*0401(297.72) | LIGLTSRAT/DRB1*0701(345.32) | LIGLTSRAT/DRB1*1101(106.89) |
| LILAPTRVVASEMAE | LILAPTRVV/DRB1*0101(101.30) | LILAPTRVV/DRB1*0701(298.14) | | |
| KTWLVHRQWFLDLPL | WLVHRQWFL/DRB1*0101(134.00) | WLVHRQWFL/DRB1*0701(81.73) | WLVHRQWFL/DRB1*1101(395.72) | |
| AWTLYAVATTVLTPM | LYAVATTVL/DRB1*0701(30.35) | YAVATTVL/DRB1*0101(13.21) | YAVATTVLT/DRB1*0401(68.13) | YAVATTVLT/DRB1*1101(298.66) |
| RSVALTPHSGTGLET | LTPHSGTGL/DRB1*0101(190.53) | | | |
| VVTRSGTYVSAIAQT | TYVSAIAQT/DRB1*0101(367.30) | | | |
| CCRSCTLPPLRYMGE | SCTLPPLRY/DRB1*0101(473.61) | | | |
| WTEQYKFQADSPKKL | FQADSPKKL/DRB1*0101(74.97) | FQADSPKKL/DRB1*0701(67.38) | YKFQADSPK/DRB1*0401(228.66) | YKFQADSPK/DRB1*1101(381.30) |
| VPFCSHHFHKIFMKD | FCSHHFHKI/DRB1*0101(214.21) | FCSHHFHKI/DRB1*0701(43.87) | FCSHHFHKI/DRB1*1101(92.81) | |
| SSELLSGRGPLKLFM | LLSGRGPLK/DRB1*0101(35.30) | LLSGRGPLK/DRB1*1101(495.23) | LSGRGPLK/DRB1*0701(201.10) | |
| GNGWTKSGTYVSAI | WTKSGTYV/DRB1*0101(324.80) | WTKSGTYV/DRB1*0701(291.11) | | |
| KRFSLGLLSGRGPLK | FSLGLLSGR/DRB1*0401(424.77) | KRFSLGLLS/DRB1*0701(396.92) | KRFSLGLLS/DRB1*1101(114.11) | SLGLLSGRG/DRB1*0101(11.32) |

FIG. 50-42

| peptide | core/HLA(affinity(nM)) | core/HLA(affinity(nM)) | core/HLA(affinity(nM)) |
|---|---|---|---|
| GDLPVWLSYKVASAG | VWLSYKVAS/DRB1*1101(76.59) | WLSYKVASA/DRB1*0101(51.23) | WLSYKVASA/DRB1*0401(193.07) | WLSYKVASA/DRB1*0701(362.19) |
| ANCLRKNGKKVIQLS | CLRKNGKKV/DRB1*1101(121.31) | | | |
| VRSNAALGAIFQEEQ | VRSNAALGA/DRB1*0101(122.99) | | | |
| MVNGVWKLLTKPWDV | GVWKLLTKP/DRB1*1101(96.96) | VWKLLTKPW/DRB1*0101(312.65) | | |
| EEFINKVRSNAALGA | FINKVRSNA/DRB1*1101(52.44) | INKVRSNAA/DRB1*0101(17.72) | INKVRSNAA/DRB1*0401(113.45) | INKVRSNAA/DRB1*0701(82.02) |
| IVSVNMISRMLLNR | IVSVNMIS/DRB1*0401(409.94) | SVNMISRML/DRB1*0101(17.65) | SVNMISRML/DRB1*0701(120.63) | VNMISRMLL/DRB1*1101(61.25) |
| GLYGNGVWTRSGAYV | YGNGVWTRS/DRB1*0101(331.14) | | | |
| PSINMLKRVRNRVST | INMLKRVRN/DRB1*0101(40.82) | INMLKRVRN/DRB1*1101(4.90) | LKRVRNRVS/DRB1*0401(377.12) | LKRVRNRVS/DRB1*0701(66.16) |
| GIYRIKQKGIFGKTQ | IYRIKQKGI/DRB1*0101(134.70) | IYRIKQKGI/DRB1*0701(386.13) | IYRIKQKGI/DRB1*1101(39.14) | |
| LSELPETLETLLLLA | PETLETLL/DRB1*0101(407.44) | | | |
| PLHRVDLGVPLLAMG | HRVDLGVPL/DRB1*0101(37.23) | HRVDLGVPL/DRB1*0701(344.38) | | |
| ELPETLETLLLLALL | PETLETLLL/DRB1*0101(356.35) | | | |
| IGLYGNGVWTTSGTY | YGNGVWTTS/DRB1*0101(293.88) | | | |
| PASIAARGYISTRVG | ARGYISTRV/DRB1*0701(461.60) | SIAARGYIS/DRB1*0101(184.96) | | |
| THEMYWVSGVSGNIV | MYWVSGVSG/DRB1*0701(59.83) | WVSGVSGNI/DRB1*0701(72.91) | YWVSGVSGN/DRB1*0401(495.66) | |
| VCGIRSATRMENLLW | CGIRSATRM/DRB1*0701(482.83) | IRSATRMEN/DRB1*1101(133.85) | VCGIRSATR/DRB1*0101(471.10) | |
| YAVSRGTSKIRWIVE | YAVSRGTSK/DRB1*0701(305.07) | YAVSRGTSK/DRB1*1101(264.52) | | |
| RGPSLRTTASGKLV | LRTTASGK/DRB1*0701(80.85) | SLRTTASG/DRB1*0101(166.45) | SLRTTASG/DRB1*0401(226.25) | |
| PLKLFMALVAFLRFL | FMALVAFLR/DRB1*0101(15.11) | FMALVAFLR/DRB1*0701(186.46) | FMALVAFLR/DRB1*1101(113.20) | |
| RGSSKIRWFVERNLV | IRWFVERNL/DRB1*0101(460.86) | IRWFVERNL/DRB1*0701(192.99) | | |
| EFFLMVLLVPEPEKQ | LMVLLVPEP/DRB1*0101(163.69) | | | |

FIG. 50-43

| peptide | core/HLA(affinity(nM)) | core/HLA(affinity(nM)) | core/HLA(affinity(nM)) | core/HLA(affinity(nM)) |
|---|---|---|---|---|
| TWDWLEHGSCVTT | WLEHGSCV/DRB1*0101(189.92) | | | |
| DARVYADPMALKDFK | VYADPMALK/DRB1*0101(369.57) | | | |
| WLGARFLEFEALGFL | FLEFEALGF/DRB1*0101(80.15) | FLEFEALGF/DRB1*0701(122.23) | | |
| SWHYDQENPYKTWAY | YDQENPYKT/DRB1*0101(435.19) | | | |
| YGWNLVRLQSGVDVF | LVRLQSGVD/DRB1*0401(453.84) | LVRLQSGVD/DRB1*0701(134.97) | NLVRLQSGV/DRB1*1101(166.50) | VRLQSGVDV/DRB1*0101(18.78) |
| LNEAVMAVGVVSILA | AVMAVGVVS/DRB1*0101(280.23) | | | |
| GSSLRTTVSGKLIH | LRTTVSGKL/DRB1*0401(331.31) | TITVSGKLI/DRB1*0101(237.91) | TITVSGKLI/DRB1*0701(48.01) | |
| SWPLNEAIMAVGLVS | NEAIMAVGL/DRB1*0101(102.85) | | | |
| LWCGSLIGLSSRATW | LIGLSSRAT/DRB1*0101(3.70) | LIGLSSRAT/DRB1*0401(202.35) | LIGLSSRAT/DRB1*0701(203.77) | LIGLSSRAT/DRB1*1101(48.00) |
| RVEMGEAAGIFMTAT | VEMGEAAGI/DRB1*0101(175.28) | | | |
| EDHWFSRGNSFSGVE | HWFSRGNSF/DRB1*0701(464.07) | WFSRGNSFS/DRB1*0101(457.98) | | |
| EQYKFQPESPARLAT | FQPESPARL/DRB1*0101(7.34) | FQPESPARL/DRB1*0701(142.06) | YKFQPESPA/DRB1*0401(71.11) | YKFQPESPA/DRB1*1101(487.73) |
| WTEQYKFQPESPKRL | FQPESPKRL/DRB1*0101(74.33) | FQPESPKRL/DRB1*0701(242.66) | | |
| NGVWKLLTKPWDVVP | KLLTKPWDV/DRB1*0701(392.80) | VVKLLTKPW/DRB1*0101(284.89) | VVKLLTKPW/DRB1*1101(110.37) | |
| RNRVSTVSQLAKRFS | RVSTVSQLA/DRB1*0101(159.84) | RVSTVSQLA/DRB1*0701(184.37) | VSQLAKRFS/DRB1*1101(85.19) | |
| KEAKMLLDNIYTPEG | MLLDNIYTP/DRB1*0401(414.75) | | | |
| QRKTFVDLMRRGDLP | FVDLMRRGD/DRB1*1101(157.20) | | | |
| IMAVGMVSILASALL | MVSILASAL/DRB1*0101(8.80) | MVSILASAL/DRB1*0401(482.51) | VSILASALL/DRB1*0701(82.54) | |
| ELQWIASAIVLEFFM | LQWIASAIV/DRB1*0101(16.02) | LQWIASAIV/DRB1*0401(493.04) | LQWIASAIV/DRB1*0701(30.73) | |
| LDVDLHPASAWTLYA | LHPASAWTL/DRB1*0101(32.78) | LHPASAWTL/DRB1*0701(71.75) | | |
| TFVDLMRRGDLPVWL | FVDLMRRGD/DRB1*1101(400.87) | | | |

FIG. 50-44

| peptide | core/HLA(affinity(nM)) | core/HLA(affinity(nM)) | core/HLA(affinity(nM)) |
|---|---|---|---|
| LMMRTTWALCESITL | WALCESITL/DRB1*0101(129.86) | WALCESITL/DRB1*0101(97.21) | |
| VPMAGPLVAGGLLIA | PLVAGGLLI/DRB1*0101(174.95) | | |
| NEDHWFSRGNSLSGV | HWFSRGNSL/DRB1*0101(81.72) | HWFSRGNSL/DRB1*0701(89.49) | WFSRGNSLS/DRB1*0401(311.81) | WFSRGNSLS/DRB1*1101(395.21) |
| KPRWLDARIYADPMA | WLDARIYAD/DRB1*0101(419.66) | | |
| MGLGKGWPIHKMDLG | LGKGWPIHK/DRB1*0101(409.31) | | |
| LLIACYVITGTSADL | CYVITGTSA/DRB1*0101(77.12) | YVITGTSAD/DRB1*0401(262.65) | YVITGTSAD/DRB1*0701(181.07) |
| LKGMPIRYQTPAIRA | IRYQTPAIR/DRB1*0101(18.69) | IRYQTPAIR/DRB1*0401(109.04) | IRYQTPAIR/DRB1*0701(125.90) | IRYQTPAIR/DRB1*1101(99.19) |
| VNVSLTAIANQAAVL | LTAIANQAA/DRB1*0401(43.65) | LTAIANQAA/DRB1*0701(135.91) | SLTAIANQA/DRB1*0101(8.37) |
| PERVILAGPMPVTAS | VILAGPMPV/DRB1*0101(27.88) | | |
| WAFCEVLTLATGPIL | FCEVLTLAT/DRB1*0401(197.34) | FCEVLTLAT/DRB1*1101(366.73) | VLTLATGPI/DRB1*0101(24.67) | VLTLATGPI/DRB1*0701(47.44) |
| MKMVMAFIAFLRFLT | FIAFLRFLT/DRB1*1101(58.46) | VMAFIAFLR/DRB1*0101(55.03) | VMAFIAFLR/DRB1*0701(175.90) |
| LVLEHGGCVTTMAKN | LVLEHGGCV/DRB1*0101(451.86) | | |
| MDIGVPILLAMGCYSQ | PILLAMGCYS/DRB1*0101(160.20) | | |
| CVGQLLLMRTSWAFC | GQLLLMRTS/DRB1*1101(102.29) | LLLMRTSWA/DRB1*0101(14.55) | LLLMRTSWA/DRB1*0401(148.25) | LLMRTSWAF/DRB1*0701(231.43) |
| PSPTVEAGRTLRVLN | VEAGRTLRV/DRB1*0101(116.30) | VEAGRTLRV/DRB1*0701(178.61) | |
| DVIVLGSQEGAMRTA | IVLGSQEGA/DRB1*0101(49.42) | | |
| CGSGIFVIDNVHTRT | FVIDNVHTR/DRB1*0401(130.46) | FVIDNVHTR/DRB1*1101(317.51) | IFVIDNVHT/DRB1*0101(139.31) | IFVIDNVHT/DRB1*0701(414.61) |
| DARIYADPMALKDFK | IYADPMALK/DRB1*0101(223.10) | IYADPMALK/DRB1*0401(385.11) | |
| IVSILASSLLRNDVP | ILASSLLRN/DRB1*1101(305.54) | IVSILASSL/DRB1*0101(11.27) | IVSILASSL/DRB1*0401(297.96) | IVSILASSL/DRB1*0701(64.65) |
| IPTSRTTWSIHATHQ | SRTTWSIHA/DRB1*0701(477.86) | | |
| HRRDKRSVALAPHVG | RSVALAPHV/DRB1*0101(363.66) | RSVALAPHV/DRB1*0701(454.71) | |

FIG. 50-45

| peptide | core/HLA(affinity(nM)) | core/HLA(affinity(nM)) | core/HLA(affinity(nM)) | core/HLA(affinity(nM)) |
|---|---|---|---|---|
| ILCASQILLMRTTWA | ILLMRTTWA/DRB1*0101(46.43) | ILLMRTTWA/DRB1*0401(249.47) | SQILLMRTT/DRB1*1101(195.92) | |
| YISTRVEMGEAAAIF | VEMGEAAAI/DRB1*0101(75.31) | | | |
| GALVRCPLSRNSTHE | LVRCPLSRN/DRB1*0101(452.40) | LVRCPLSRN/DRB1*1101(215.62) | | |
| EGVFHTMWHVTRGSV | FHTMWHVTR/DRB1*0101(18.30) | FHTMWHVTR/DRB1*1101(21.75) | MWHVTRGSV/DRB1*0701(92.97) | |
| AIANQATVLMGLGKG | IANQATVLM/DRB1*0101(127.69) | | | |
| SYAQMWQLMYFHRRD | MWQLMYFHR/DRB1*0101(40.69) | MWQLMYFHR/DRB1*0701(498.48) | WQLMYFHRR/DRB1*1101(49.98) | |
| HEMYWWSGVSGNIVS | MYWWSGVSG/DRB1*0101(54.43) | WVSGVSGNI/DRB1*0701(68.40) | YWVSGVSGN/DRB1*0401(387.22) | |
| TNDWDFVVTDISEM | WDFVVTDI/DRB1*0701(208.87) | | | |
| KGIFGKTQVGVGVQK | FGKTQVGVG/DRB1*0101(304.79) | | | |
| LTKRFSLGLLSGRGP | FSLGLLSGR/DRB1*0401(429.00) | KRFSLGLLS/DRB1*0101(30.91) | KRFSLGLLS/DRB1*0701(277.76) | KRFSLGLLS/DRB1*1101(81.13) |
| AACLRKSGKRVIQLS | CLRKSGKRV/DRB1*0101(297.93) | LRKSGKRVI/DRB1*0701(226.77) | LRKSGKRVI/DRB1*1101(61.26) | |
| IRYQTTATKIEHTGR | IRYQTTATK/DRB1*0101(369.56) | IRYQTTATK/DRB1*0401(264.34) | RYQTTATKI/DRB1*0701(423.63) | |
| AAVKDQRAVHADMGY | VKDQRAVHA/DRB1*0101(259.41) | | | |
| SCVTTMAQGKPTLDI | TTMAQGKPT/DRB1*0101(147.01) | | | |
| ERKKLRPRWLDARIY | RKKLRPRWL/DRB1*1101(400.51) | | | |
| GNRDFVEGVSGGTWV | FVEGVSGGT/DRB1*0101(422.51) | | | |
| HPASAWTLYAVATI | AWTLYAVAT/DRB1*0101(60.29) | TLYAVATTI/DRB1*0701(124.54) | | |
| SRDFVEGVSGGAWVD | FVEGVSGGA/DRB1*0101(95.37) | | | |
| VGRARVSQGAGWSLK | VSQGAGWSL/DRB1*0101(331.00) | VSQGAGWSL/DRB1*0701(444.00) | | |
| AYVMTGRSADLELER | VMTGRSADL/DRB1*0101(78.84) | YVMTGRSAD/DRB1*0701(384.28) | YVMTGRSAD/DRB1*1101(362.15) | |
| MFESTYRGAKRMAIL | YRGAKRMAI/DRB1*0101(70.69) | YRGAKRMAI/DRB1*0701(88.25) | YRGAKRMAI/DRB1*1101(22.55) | |

FIG. 50-46

| peptide | core/HLA(affinity(nM)) | core/HLA(affinity(nM)) | core/HLA(affinity(nM)) |
|---|---|---|---|
| TKPWDVLPMYTQIAM | WDVLPMYTQ/DRB1*0101(54.33) | | |
| QYKFQADSPKKLASA | FQADSPKKL/DRB1*0101(13.42) | FQADSPKKL/DRB1*0401(83.49) | FQADSPKKL/DRB1*1101(146.28) |
| QMAMDTTPFGQQRV | MAMIDTTPF/DRB1*0401(490.52) | | |
| GCVTTMAKNKPTLDF | CVTTMAKNK/DRB1*0101(324.73) | CVTTMAKNK/DRB1*0701(415.91) | CVTTMAKNK/DRB1*1101(397.58) |
| ETTMRGAKRMAILGE | MRGAKRMAI/DRB1*1101(44.17) | TMRGAKRMA/DRB1*0101(239.28) | |
| SASSMINGWRLLTK | INGWRLLT/DRB1*1101(143.86) | MINGWRLL/DRB1*0101(83.91) | MINGWRLL/DRB1*0701(354.03) |
| LLMMRTTWALCESIT | MMRTTWALC/DRB1*0101(106.89) | MMRTTWALC/DRB1*0701(180.89) | |
| ACLGKSYAQMWTLMY | SYAQMWTLM/DRB1*0101(47.26) | YAQMWTLMY/DRB1*0401(285.07) | YAQMWTLMY/DRB1*0701(137.10) |
| IEEGRTLRVLKMVEP | GRTLRVLKM/DRB1*0101(239.10) | GRTLRVLKM/DRB1*1101(241.64) | |
| PIHRVDLGVPLLALG | HRVDLGVPL/DRB1*0101(35.47) | HRVDLGVPL/DRB1*0701(290.63) | |
| VREAIKRKLRTLVLA | IKRKLRTLV/DRB1*0101(69.38) | IKRKLRTLV/DRB1*0701(91.54) | IKRKLRTLV/DRB1*1101(6.91) |
| IHAKHQWMTTEDMLK | HQWMTTEDM/DRB1*0101(373.91) | HQWMTTEDM/DRB1*0401(298.16) | |
| VEGEGLHKLGYILRD | GLHKLGYIL/DRB1*0101(156.77) | LHKLGYILR/DRB1*1101(328.98) | |
| RTEQYKFQPESPARL | FQPESPARL/DRB1*0701(191.28) | YKFQPESPA/DRB1*0101(18.12) | YKFQPESPA/DRB1*0401(109.81) |
| IPYDPKFEKQLGQVM | FEKQLGQVM/DRB1*0101(96.96) | | |
| HGSCVTTMAQGKPTL | CVTTMAQGK/DRB1*0101(265.91) | | |
| TSWAFCESLTLATGP | FCESLTLAT/DRB1*0401(83.71) | FCESLTLAT/DRB1*0701(80.22) | FCESLTLAT/DRB1*1101(324.90) | WAFCESLTL/DRB1*0101(47.79) |
| PNYNMVIMDEAHFTD | YNMVIMDEA/DRB1*0101(187.60) | | |
| KFQADSPKKLASAIL | FQADSPKKL/DRB1*0101(54.11) | FQADSPKKL/DRB1*0401(431.45) | FQADSPKKL/DRB1*0701(108.86) | FQADSPKKL/DRB1*1101(499.22) |
| LILAPTRVVAAEMEE | LILAPTRVV/DRB1*0101(112.11) | LILAPTRVV/DRB1*0701(437.07) | |
| AAEMEEALKGMPIRY | EEALKGMPI/DRB1*0101(130.53) | | |

FIG. 50-47

| peptide | core/HLA(affinity(nM)) | core/HLA(affinity(nM)) | core/HLA(affinity(nM)) | core/HLA(affinity(nM)) |
|---|---|---|---|---|
| HTIENTANISLTAI | ENTTANISL/DRB1*0701(242.06) | IENTTANISL/DRB1*0101(469.73) | | |
| PFCSHHFHQLIMKDG | FCSHHFHQL/DRB1*0101(155.57) | FCSHHFHQL/DRB1*0701(90.35) | HHFHQLIMK/DRB1*1101(334.10) | |
| VCGIRSVTRLENIMW | CGIRSVTRL/DRB1*0701(291.49) | IRSVTRLEN/DRB1*1101(63.49) | VCGIRSVTR/DRB1*0101(497.12) | |
| SGVEGEGLHRLGYIL | GLHRLGYIL/DRB1*0101(487.39) | | | |
| SCVTTMAKNKPTLDF | CVTTMAKNK/DRB1*0101(301.53) | CVTTMAKNK/DRB1*0701(373.96) | CVTTMAKNK/DRB1*1101(407.63) | |
| ATFTMRLLSPVRVPN | MRLLSPVRV/DRB1*0101(5.50) | MRLLSPVRV/DRB1*0401(491.93) | MRLLSPVRV/DRB1*0701(84.48) | TMRLLSPVR/DRB1*1101(35.49) |
| MTTEDMLAVWNRVWI | DMLAVWNRV/DRB1*0101(348.68) | | | |
| LCTGQLLMMRTTWAL | LLMMRTTWA/DRB1*0101(23.58) | LLMMRTTWA/DRB1*0401(254.31) | LLMMRTTWA/DRB1*0701(206.67) | LMMRTTWAL/DRB1*0701(320.31) |
| PAIVREAIKRKLRTL | VREAIKRKL/DRB1*0101(358.82) | VREAIKRKL/DRB1*1101(34.87) | | |
| GSLIGLTSRATWAQN | LIGLTSRAT/DRB1*0101(3.13) | LIGLTSRAT/DRB1*0401(128.14) | LIGLTSRAT/DRB1*0701(306.33) | LIGLTSRAT/DRB1*1101(23.20) |
| FETTMRGAKRMAILG | MRGAKRMAI/DRB1*0701(402.08) | MRGAKRMAI/DRB1*1101(30.87) | TMRGAKRMA/DRB1*0101(120.36) | |
| SSLLRNDVPLAGPLI | LLRNDVPLA/DRB1*0101(25.86) | LLRNDVPLA/DRB1*0401(41.92) | | |
| WPKTHTLWSNGVLES | THTLWSNGV/DRB1*0101(293.94) | | | |
| RTSWALCEVLTLATG | WALCEVLTL/DRB1*0101(227.20) | | | |
| ESRTIRVLKMVEPWL | IRVLKMVEP/DRB1*0101(129.39) | TIRVLKMVE/DRB1*1101(224.86) | | |
| SGGASSMVNGVVRLL | MVNGVVRLL/DRB1*0101(265.62) | MVNGVVRLL/DRB1*0701(421.42) | | |
| LLSPVRVPNYNLIIM | PVRVPNYNL/DRB1*0101(99.52) | PVRVPNYNL/DRB1*0701(92.84) | | |
| TIAVSMANIFRGSYL | ANIFRGSYL/DRB1*0701(114.87) | AVSMANIFR/DRB1*0101(51.77) | AVSMANIFR/DRB1*0401(368.38) | AVSMANIFR/DRB1*1101(201.22) |
| VCGIRSTRLENWMW | CGIRSTRL/DRB1*0701(309.08) | IRSTRLEN/DRB1*1101(133.63) | | |
| LPAIVREALKRRLRT | IVREALKRR/DRB1*0101(243.12) | IVREALKRR/DRB1*1101(27.20) | | |
| WSLMYFHRRDLRLAA | YFHRRDLRL/DRB1*0701(24.36) | YFHRRDLRL/DRB1*0701(32.67) | YFHRRDLRL/DRB1*1101(8.59) | |

FIG. 50-48

| peptide | core/HLA(affinity(nM)) | core/HLA(affinity(nM)) | core/HLA(affinity(nM)) | core/HLA(affinity(nM)) |
|---|---|---|---|---|
| ARYLEFEALGFMNED | YLEFEALGF/DRB1*0101(142.59) | | | |
| DSKLMSAAVKDQRAV | KLMSAAVKD/DRB1*0701(459.64) | LMSAAVKDQ/DRB1*0101(128.51) | | |
| VSLLGSSLLKNDVPL | VSLLGSSLL/DRB1*0701(158.21) | | | |
| NLSLAAIANQAAILM | LAAIANQAA/DRB1*0101(6.79) | LAAIANQAA/DRB1*0401(55.29) | LAAIANQAA/DRB1*0701(144.74) | |
| VGVGIHMENVFHTMW | IHMENVFHT/DRB1*0101(85.95) | IHMENVFHT/DRB1*0401(145.41) | IHMENVFHT/DRB1*0701(467.57) | |
| TWALCESITLATGPL | LCESITLAT/DRB1*0401(435.07) | LCESITLAT/DRB1*0701(280.72) | WALCESITL/DRB1*0101(144.19) | |
| HAVSRGSSKLRWFVE | AVSRGSSKL/DRB1*0701(469.73) | VSRGSSKLR/DRB1*1101(256.03) | | |
| SAWTLYAVATTVLTP | LYAVATTVL/DRB1*0701(32.37) | TLYAVATTV/DRB1*0101(15.74) | YAVATTVLT/DRB1*0401(84.89) | YAVATTVLT/DRB1*1101(389.23) |
| AMGCYSQVNPTTLTA | CYSQVNPTT/DRB1*0401(84.84) | YSQVNPTTL/DRB1*0101(13.79) | YSQVNPTTL/DRB1*0701(36.01) | |
| LGCYSQVNPLTLTAA | CYSQVNPLT/DRB1*0401(83.85) | YSQVNPLTL/DRB1*0101(9.73) | YSQVNPLTL/DRB1*0701(28.41) | YSQVNPLTL/DRB1*1101(273.06) |
| LLILCASQILLMRTS | LILCASQIL/DRB1*0701(312.73) | LLILCASQI/DRB1*0101(53.82) | SQILLMRTS/DRB1*1101(351.68) | |
| LVAFLRFLAIPPTAG | FLRFLAIPP/DRB1*0101(3.51) | FLRFLAIPP/DRB1*0401(24.80) | FLRFLAIPP/DRB1*0701(36.77) | FLRFLAIPP/DRB1*1101(22.47) |
| AWTLYAVATTIITPM | LYAVATTII/DRB1*0701(21.20) | TLYAVATTI/DRB1*0101(21.52) | YAVATTIIT/DRB1*0401(123.90) | YAVATTIIT/DRB1*1101(329.89) |
| GQLLMMRTTWALCEV | LLMMRTTWA/DRB1*0401(38.00) | LLMMRTTWA/DRB1*0401(331.23) | MMRTTWALC/DRB1*0701(196.05) | MMRTTWALC/DRB1*1101(270.74) |
| ILMGLGKGWPLHRMD | LGKGWPLHR/DRB1*1101(344.27) | MGLGKGWPL/DRB1*0101(48.14) | MGLGKGWPL/DRB1*0701(326.91) | |
| NDIAACLRKNGKRVI | IAACLRKNG/DRB1*1101(73.84) | | | |
| NLSLTAIANQAVVLM | LTAIANQAV/DRB1*0101(6.74) | LTAIANQAV/DRB1*0401(80.83) | LTAIANQAV/DRB1*0701(44.87) | |
| SGKRVIQLSRKTFDS | RVIQLSRKT/DRB1*0101(441.41) | RVIQLSRKT/DRB1*1101(24.30) | | |
| RIKQQGILGKTQVGV | IKQQGILGK/DRB1*0101(261.30) | | | |
| RLTIMDLHPGSGKTR | LTIMDLHPG/DRB1*0101(133.77) | LTIMDLHPG/DRB1*1101(499.24) | | |
| RIYSDPLALREFKEF | IYSDPLALR/DRB1*0101(301.30) | IYSDPLALR/DRB1*0401(389.29) | | |

FIG. 50-49

| peptide | core/HLA(affinity(nM)) | core/HLA(affinity(nM)) | core/HLA(affinity(nM)) | core/HLA(affinity(nM)) |
|---|---|---|---|---|
| GVPLLALGCYSQVNP | PLLALGCYS/DRB1*0101(140.13) | | | |
| RGTSKIRWIVERGMI | IRWIVERGM/DRB1*0101(397.71) | IRWIVERGM/DRB1*0701(480.32) | IRWIVERGM/DRB1*1101(401.33) | |
| KTWAYHGSYEVKPTG | WAYHGSYEV/DRB1*0101(263.65) | WAYHGSYEV/DRB1*0701(335.28) | | |
| AGGLLAAYYMTGRS | GLLLAAYYM/DRB1*0101(38.36) | LAAYYMTGR/DRB1*1101(442.41) | | |
| AEMEEALKGLPIRYQ | EEALKGLPI/DRB1*0101(85.29) | | | |
| DVRNDLISYGGGWKL | ISYGGGWKL/DRB1*0701(322.10) | | | |
| TSANLSLTAIANQAA | LTAIANQAA/DRB1*0401(81.81) | LTAIANQAA/DRB1*0701(328.51) | NLSLTAIAN/DRB1*0101(20.43) | |
| LMGLDKGWPLSKMDL | LDKGWPLSK/DRB1*0101(285.88) | | | |
| ELPESLETLMLVALI | PESLETLML/DRB1*0101(347.82) | | | |
| DLRLASMAICSAVPT | LASMAICSA/DRB1*0101(34.70) | | | |
| RRDKRSVALAPHVGM | RSVALAPHV/DRB1*0701(247.66) | SVALAPHVG/DRB1*0101(135.94) | | |
| AIWYMWLGARYLEFE | IWYMWLGAR/DRB1*1101(72.07) | YMWLGARYL/DRB1*0101(7.97) | YMWLGARYL/DRB1*0701(242.99) | |
| WYMWLGARYLEFEAL | YMWLGARYL/DRB1*0101(21.22) | YMWLGARYL/DRB1*0701(397.10) | YMWLGARYL/DRB1*1101(249.04) | |
| MLLVLCAVQLLLMRT | LLVLCAVQL/DRB1*0101(229.52) | | | |
| KVRSNAAMGAYFTEE | VRSNAAMGA/DRB1*0101(37.49) | VRSNAAMGA/DRB1*0401(300.67) | | |
| LPETMETLLLLGLMI | PETMETLLL/DRB1*0101(430.16) | | | |
| IAFLRFLAIPPTAGI | FLAIPPTAG/DRB1*0101(2.67) | FLAIPPTAG/DRB1*0401(17.38) | FLRFLAIPP/DRB1*1101(24.07) | RFLAIPPTA/DRB1*0701(25.86) |
| CGIRSTRLENLMWK | CGIRSTRLE/DRB1*0701(450.97) | IRSTRLEN/DRB1*1101(200.80) | | |
| EAIKRKLRTLVLAPT | IKRKLRTLV/DRB1*0701(108.32) | IKRKLRTLV/DRB1*1101(9.42) | LRTLVLAPT/DRB1*0101(22.41) | LRTLVLAPT/DRB1*0401(321.68) |
| TRAQTWMSAEGAWRQ | QTWMSAEGA/DRB1*0101(24.85) | WMSAEGAWR/DRB1*0401(366.07) | | |
| TRTQTWMSSEGAWKQ | QTWMSSEGA/DRB1*0101(95.08) | | | |

FIG. 50-50

| peptide | core/HLA(affinity(nM)) | core/HLA(affinity(nM)) | core/HLA(affinity(nM)) |
|---|---|---|---|
| SRKITFVELMKRGDLP | FVELMKRGD/DRB1*1101(144.83) | | |
| YSLNTFTNMEAQLIR | FTNMEAQLI/DRB1*0101(6.95) | FTNMEAQLI/DRB1*0701(42.10) | FTNMEAQLI/DRB1*1101(392.04) | LNTFTNMEA/DRB1*0401(35.09) |
| KFQPESPARLATAIA | FQPESPARL/DRB1*0101(33.62) | | |
| VMAVGVSILASSFL | VSILASSF/DRB1*0101(20.31) | VSILASSF/DRB1*0701(40.86) | |
| EEGRTLRVLKMVEPW | GRTLRVLKM/DRB1*0101(423.96) | TLRVLKMVE/DRB1*1101(249.52) | |
| STPQGLVKRFSTGLL | VKRFSTGLL/DRB1*0101(104.82) | VKRFSTGLL/DRB1*0701(43.90) | VKRFSTGLL/DRB1*1101(209.94) |
| AMHSALTGATEVDSG | AMHSALTGA/DRB1*0101(353.30) | | |
| LPIRYQTTAVKSEHT | IRYQTTAVK/DRB1*0101(40.69) | IRYQTTAVK/DRB1*0401(59.49) | IRYQTTAVK/DRB1*1101(165.24) | RYQTTAVKS/DRB1*0701(86.47) |
| MGHLKCRLRMDKLQL | KCRLRMDKL/DRB1*0101(264.67) | LKCRLRMDK/DRB1*1101(37.15) | |
| WPLHRVDLGVPLLAM | HRVDLGVPL/DRB1*0101(40.48) | HRVDLGVPL/DRB1*0701(245.63) | |
| AVSTANIFRGSYLAG | ANIFRGSYL/DRB1*0101(230.05) | ANIFRGSYL/DRB1*0701(372.93) | |
| SGIFVVDNVHTWTEQ | IFVVDNVHT/DRB1*0101(223.12) | IFVVDNVHT/DRB1*0401(237.63) | |
| RRYLPAMVREAIRRG | YLPAMVREA/DRB1*0101(73.92) | YLPAMVREA/DRB1*1101(176.25) | |
| EQYQFQADSPKRLAS | FQADSPKRL/DRB1*0101(27.28) | FQADSPKRL/DRB1*0401(143.86) | FQADSPKRL/DRB1*0701(61.15) | FQADSPKRL/DRB1*1101(354.25) |
| YNLIVMDEAHFTDPS | IVMDEAHFT/DRB1*0101(212.61) | IVMDEAHFT/DRB1*0401(328.03) | |
| AIANQAAVLMGLGKG | IANQAAVLM/DRB1*0101(37.12) | | |
| GAMYADDTAGWDTRI | MYADDTAGW/DRB1*0401(280.64) | | |
| YQFQPESPARVASAI | FQPESPARV/DRB1*0101(16.01) | FQPESPARV/DRB1*0401(237.30) | |
| TMRLLSPVRVPNYNL | MRLLSPVRV/DRB1*0101(12.27) | MRLLSPVRV/DRB1*0701(98.81) | TMRLLSPVR/DRB1*1101(129.21) |
| MFETTMRGAKRMAIL | ETTMRGAKR/DRB1*0101(88.74) | MRGAKRMAI/DRB1*0701(272.86) | MRGAKRMAI/DRB1*1101(33.54) |
| IMAVGLVSILLSSLL | VSILLSSLL/DRB1*0101(34.46) | VSILLSSLL/DRB1*0701(121.25) | |

FIG. 50-51

| peptide | core/HLA(affinity(nM)) | core/HLA(affinity(nM)) | core/HLA(affinity(nM)) |
|---|---|---|---|
| RDLRLAANAICSAVP | LRLAANAIC/DRB1*0101(10.69) | LRLAANAIC/DRB1*0401(79.86) | |
| VEGEGLHRLGYILRD | LHRLGYILR/DRB1*0101(133.83) | LHRLGYILR/DRB1*0701(173.78) | |
| KVRSNAAIGAVFTDE | VRSNAAIGA/DRB1*0101(36.94) | VRSNAAIGA/DRB1*0401(376.04) | VRSNAAIGA/DRB1*0701(390.46) |
| FQADSPKRLASAIQK | FQADSPKRL/DRB1*0101(270.17) | FQADSPKRL/DRB1*0701(435.68) | |
| YFHRRDLRLASNAIC | DLRLASNAI/DRB1*0101(18.56) | DLRLASNAI/DRB1*0701(64.63) | YFHRRDLRL/DRB1*1101(24.90) |
| IGMFEATARGARRM | FEATARGA/DRB1*1101(76.63) | MFEATARGA/DRB1*0101(47.39) | |
| ANCLRKSGKKVIQLS | CLRKSGKKV/DRB1*0101(405.50) | LRKSGKKVI/DRB1*0701(305.03) | LRKSGKKVI/DRB1*1101(58.40) |
| ALVRCPLSRNSTHEM | LVRCPLSRN/DRB1*1101(297.86) | | |
| QAAVLMGLGKGWPLS | MGLGKGWPL/DRB1*0101(102.83) | | |
| KGARRMAILGDTAWD | RMAILGDTA/DRB1*0101(382.17) | | |
| ESTYRGAKRMAILGD | YRGAKRMAI/DRB1*0101(68.85) | YRGAKRMAI/DRB1*0701(202.46) | YRGAKRMAI/DRB1*1101(26.36) |
| VQVLAIEPGKNPKNV | LAIEPGKNP/DRB1*0101(361.28) | | |
| QLLLMRTSWAFCEAL | LLLMRTSWA/DRB1*0101(35.47) | LLLMRTSWA/DRB1*0401(354.51) | LLLMRTSWA/DRB1*1101(342.82) | LMRTSWAFC/DRB1*0701(191.61) |
| VPHVGMGLETRAQTW | HVGMGLETR/DRB1*0101(347.56) | | |
| PPTAGILKRWGQLKK | ILKRWGQLK/DRB1*1101(93.49) | | |
| KNDIPMTGPLVAGGL | DIPMTGPLV/DRB1*0101(32.96) | | |
| DVKKDMISYGGGWRL | ISYGGGWRL/DRB1*0101(253.67) | ISYGGGWRL/DRB1*0701(177.41) | |
| THEMYWVSCGTGNIV | YWVSCGTGN/DRB1*0101(207.01) | YWVSCGTGN/DRB1*0701(164.49) | |
| LNTFTNMEVQLIRQM | FTNMEVQLI/DRB1*0101(18.34) | FTNMEVQLI/DRB1*0401(143.87) | FTNMEVQLI/DRB1*0701(132.62) |
| PSSYAARGYISTRVE | ARGYISTRV/DRB1*0701(482.89) | SVAARGYIS/DRB1*0101(209.57) | |
| NQDELIGRARISQGA | ELIGRARIS/DRB1*0101(497.66) | LIGRARISQ/DRB1*1101(369.62) | |

FIG. 50-52

| peptide | core/HLA(affinity(nM)) | core/HLA(affinity(nM)) | core/HLA(affinity(nM)) | core/HLA(affinity(nM)) |
|---|---|---|---|---|
| GKSYAQMWTLMYFHR | MWTLMYFHR/DRB1*1101(80.17) | YAQMWTLMY/DRB1*0101(22.32) | YAQMWTLMY/DRB1*0401(120.93) | YAQMWTLMY/DRB1*0701(179.06) |
| IGAGVKEGVFHTMW | VYKEGVFHT/DRB1*0101(344.37) | | | |
| TAIANQAAVLMGLDK | IANQAAVLM/DRB1*0101(15.67) | | | |
| GARFLEFEALGFLNE | FLEFEALGF/DRB1*0101(69.03) | FLEFEALGF/DRB1*0701(210.29) | | |
| LIACYVITGRSADLE | CYVITGRSA/DRB1*0101(39.16) | CYVITGRSA/DRB1*0701(184.95) | | CYVITGRSA/DRB1*1101(64.41) |
| MDLGVPLLALGCYSQ | PLLALGCYS/DRB1*0101(202.73) | | | |
| DLVLEHGGCVTTMAK | LVLEHGGCV/DRB1*0101(284.86) | | | |
| GWPIHKMDLGVPLLA | HKMDLGVPL/DRB1*0101(45.20) | HKMDLGVPL/DRB1*0701(279.95) | | |
| CCRSCTMPPLRFRGE | SCTMPPLRF/DRB1*0101(212.11) | | | |
| MYFHRRDLRLASNAI | DLRLASNAI/DRB1*0101(20.87) | DLRLASNAI/DRB1*0401(365.07) | YFHRRDLRL/DRB1*0701(62.17) | YFHRRDLRL/DRB1*1101(14.69) |
| LTLATGPILTILWEGN | LTLATGPIL/DRB1*0101(122.44) | LTLATGPIL/DRB1*0701(489.32) | | |
| VPLLALGCYSQVNPL | GCYSQVNPL/DRB1*0701(405.25) | LALGCYSQV/DRB1*0101(37.22) | | |
| RTSWAFCEALTLATG | FCEALTLAT/DRB1*0401(89.64) | FCEALTLAT/DRB1*0701(85.84) | FCEALTLAT/DRB1*1101(285.50) | WAFCEALTL/DRB1*0101(23.46) |
| PLSKMDLGVPLLALG | SKMDLGVPL/DRB1*0101(30.54) | SKMDLGVPL/DRB1*0701(338.19) | | |
| SIVREAIKRGLRTLI | IKRGLRTLI/DRB1*0101(175.61) | IKRGLRTLI/DRB1*0701(90.97) | IKRGLRTLI/DRB1*1101(32.30) | |
| WPLNEGIMAVGMVSI | NEGIMAVGM/DRB1*0101(147.52) | | | |
| GGNLIRCPLSRNSTH | LIRCPLSRN/DRB1*0101(282.35) | LIRCPLSRN/DRB1*1101(139.18) | | |
| LTYQNKVKVLRPTP | TYQNKVKV/DRB1*0101(340.38) | TYQNKVKV/DRB1*0701(433.05) | VVKVLRPTP/DRB1*1101(131.09) | |
| EQYQFQPESPARVAS | FQPESPARV/DRB1*0101(9.55) | FQPESPARV/DRB1*0701(242.52) | YQFQPESPA/DRB1*0401(94.96) | |
| KGWPISKMDIGVPLL | SKMDIGVPL/DRB1*0101(241.15) | SKMDIGVPL/DRB1*0701(438.52) | | |
| SRGMLQGQGPMKMVM | LQGQGPMK/DRB1*0701(144.17) | MLQGQGPMK/DRB1*0101(6.20) | MLQGQGPMK/DRB1*0401(324.74) | |

FIG. 50-53

| peptide | core/HLA(affinity(nM)) | core/HLA(affinity(nM)) | core/HLA(affinity(nM)) |
|---|---|---|---|
| PETLETLLLLALLGA | LETLLLLAL/DRB1*0101(422.74) | | |
| PLNEAIMAVGLVSIL | NEAIMAVGL/DRB1*0101(115.48) | | |
| ARGYISTRVEMGEAA | YISTRVEMG/DRB1*0101(69.09) | YISTRVEMG/DRB1*0401(72.75) | YISTRVEMG/DRB1*0701(96.25) | YISTRVEMG/DRB1*1101(275.89) |
| NEDHWFSRGNSFSGV | HWFSRGNSF/DRB1*0101(479.30) | HWFSRGNSF/DRB1*0701(333.28) | | |
| SGIFVDNVHTRTEQ | FVDNVHTR/DRB1*0401(148.47) | FVDNVHTR/DRB1*1101(369.08) | IFVDNVHT/DRB1*0101(184.39) | |
| RGSSLRTTVSGKLI | SLRTTVSG/DRB1*0101(213.99) | SLRTTVSG/DRB1*0401(226.81) | TTTVSGKLI/DRB1*0701(45.42) | |
| VALAPHVGLGLDTRT | LAPHVGLGL/DRB1*0101(423.66) | | | |
| DHWFSRENSLSGVEG | FSRENSLSG/DRB1*0401(152.42) | WFSRENSLS/DRB1*0101(373.60) | | |
| YAQMWSLMYFHRRDL | WSLMYFHRR/DRB1*0101(37.25) | WSLMYFHRR/DRB1*0701(187.50) | WSLMYFHRR/DRB1*1101(28.93) | YAQMWSLMY/DRB1*0401(441.62) |
| ALKGLPIRYQTPAIR | IRYQTPAIR/DRB1*0101(34.51) | IRYQTPAIR/DRB1*0401(230.36) | IRYQTPAIR/DRB1*0701(213.37) | LKGLPIRYQ/DRB1*1101(104.61) |
| GRFWNTTIAVSMANI | FWNTTIAVS/DRB1*0401(200.32) | WNTTIAVSM/DRB1*0101(26.39) | WNTTIAVSM/DRB1*0701(40.27) | |
| KFWNTTIAVSMANIF | NTTIAVSMA/DRB1*0401(271.44) | WNTTIAVSM/DRB1*0101(32.57) | WNTTIAVSM/DRB1*0701(33.33) | |
| GERKKLRPRWLDARI | RKKLRPRWL/DRB1*1101(433.52) | | | |
| SYYCGGLKNVTEVRG | YCGGLKNVT/DRB1*0101(152.75) | YCGGLKNVT/DRB1*1101(484.39) | | |
| PMSTYGWNIWKLMSG | WNIVKLMSG/DRB1*0701(326.52) | YGWNIVKLM/DRB1*0101(139.19) | YGWNIVKLM/DRB1*0401(380.81) | YGWNIVKLM/DRB1*1101(230.67) |
| KFWNTTIAVSTANIF | IAVSTANIF/DRB1*0701(23.35) | NTTIAVSTA/DRB1*0401(263.95) | WNTTIAVST/DRB1*0101(28.34) | |
| VSILASSFLRNDVPM | SILASSFLR/DRB1*0701(194.52) | VSILASSFL/DRB1*0101(148.47) | | |
| ETLMLTLIAVLTGG | LLTLIAVLT/DRB1*0101(203.76) | | | |
| KPWDVLPMVTQIAMT | VLPMVTQIA/DRB1*0101(42.16) | VLPMVTQIA/DRB1*0401(405.08) | | |
| ENTTANISLAAIANQ | NISLAAIAN/DRB1*0101(82.38) | | | |
| PTIEESRTIRVLKMY | IEESRTIRV/DRB1*0101(151.49) | IEESRTIRV/DRB1*0701(47.51) | SRTIRVLKM/DRB1*1101(255.19) | |

FIG. 50-54

| peptide | core/HLA(affinity(nM)) | core/HLA(affinity(nM)) | core/HLA(affinity(nM)) |
|---|---|---|---|
| TSANLSLAAIANQAA | LAAIANQAA/DRB1*0401(110.49) | LSLAAIANQ/DRB1*0701(422.55) | NLSLAAIAN/DRB1*0101(17.95) |
| MMRTTWALCEVITLA | MMRTTWALC/DRB1*0101(267.73) | MRTTWALCE/DRB1*0701(321.87) | |
| KCGNGIFVADNVHTR | FVADNVHTR/DRB1*0401(247.90) | IFVADNVHT/DRB1*0101(413.38) | |
| NMEVQLIRQMEAEGV | IRQMEAEGV/DRB1*0101(55.53) | VQLIRQMEA/DRB1*1101(413.53) | |
| YGNGWTRSGAYVSA | WTRSGAYV/DRB1*0101(375.96) | WTRSGAYV/DRB1*0701(439.11) | |
| LTLATGPVSTLWEGN | LTLATGPVS/DRB1*0101(139.73) | | |
| GVCGIRSATRMENLL | CGIRSATRM/DRB1*0701(427.87) | IRSATRMEN/DRB1*1101(151.15) | VCGIRSATR/DRB1*0101(382.37) |
| RGPLKLFMALVAFLR | FMALVAFLR/DRB1*0101(15.54) | FMALVAFLR/DRB1*0701(254.62) | FMALVAFLR/DRB1*1101(111.30) |
| AVLMGLDKGWPLSKM | MGLDKGWPL/DRB1*0101(107.62) | MGLDKGWPL/DRB1*0701(291.15) | |
| KHAVSRGSSKIRWFV | AVSRGSSKI/DRB1*0701(293.39) | VSRGSSKIR/DRB1*1101(285.99) | |
| QPQWIASSIIEFFL | PQWIASSII/DRB1*0101(172.98) | WIASSIIE/DRB1*0701(73.07) | |
| NPTVEAGRTLRVLSL | AGRTLRVLS/DRB1*1101(385.76) | VEAGRTLRV/DRB1*0101(43.97) | VEAGRTLRV/DRB1*0701(94.49) |
| LLKNDVPLAGPLIAG | DVPLAGPLI/DRB1*0101(22.72) | LLKNDVPLA/DRB1*0401(258.86) | |
| WDWPMVTQLAMTDT | VVPMVTQLA/DRB1*0101(52.95) | WPMVTQLA/DRB1*0401(468.61) | |
| KRGDLPVWLAYKVAA | LPVWLAYKV/DRB1*0101(270.78) | VWLAYKVAA/DRB1*1101(240.94) | |
| LAKRFSRGMLQGQGP | AKRFSRGML/DRB1*1101(129.01) | KRFSRGMLQ/DRB1*0101(249.27) | |
| KKKLKPRWLDARIYA | LKPRWLDAR/DRB1*1101(310.33) | PRWLDARIY/DRB1*0101(344.75) | |
| TTWSIHAHHQWMTTE | IHAHHQWMT/DRB1*0701(245.14) | TWSIHAHHQ/DRB1*0101(375.74) | |
| DVIPMVTQMAMTDTT | VIPMVTQMA/DRB1*0101(62.40) | | |
| MRTSWALCEVLTLAT | WALCEVLTL/DRB1*0101(211.75) | WALCEVLTL/DRB1*0701(423.55) | |
| SSLLKNDVPLAGPLI | LLKNDVPLA/DRB1*0101(34.83) | LLKNDVPLA/DRB1*0401(71.85) | |

FIG. 50-55

| peptide | core/HLA(affinity(nM)) | core/HLA(affinity(nM)) | core/HLA(affinity(nM)) | core/HLA(affinity(nM)) |
|---|---|---|---|---|
| AMVREAIRRGLRTLI | IRRGLRTLI/DRB1*0101(140.38) | IRRGLRTLI/DRB1*0701(105.35) | IRRGLRTLI/DRB1*1101(24.62) | |
| IGIVSILASSLLRND | IVSILASSL/DRB1*0101(3.35) | IVSILASSL/DRB1*0401(94.26) | IVSILASSL/DRB1*0701(17.07) | IVSILASSL/DRB1*1101(35.72) |
| AAAGIMKNPTVDGIV | AGIMKNPTV/DRB1*0101(169.97) | IMKNPTVDG/DRB1*0401(397.45) | | |
| GARRMAILGDTAWDF | RMAILGDTA/DRB1*0101(182.20) | | | |
| GIVSILASSLLRNDV | IVSILASSL/DRB1*0101(5.12) | IVSILASSL/DRB1*0401(156.55) | IVSILASSL/DRB1*0701(26.13) | IVSILASSL/DRB1*1101(183.88) |
| MRLLSPVRVPNYNMV | LSPVRVPNY/DRB1*0701(135.03) | MRLLSPVRV/DRB1*0101(40.89) | MRLLSPVRV/DRB1*1101(417.60) | |
| YWVSCGTGNIVSAVN | WVSCGTGNI/DRB1*0101(399.52) | WVSCGTGNI/DRB1*0701(380.94) | | |
| IANQAAILMGLGKGW | IANQAAILM/DRB1*0101(203.58) | | | |
| VWFVPSIKTGNDIAA | FVPSIKTGN/DRB1*0101(193.30) | VWFVPSIKT/DRB1*0101(286.89) | | |
| ISTRVEMGEAAAIFM | VEMGEAAAI/DRB1*0101(31.91) | | | |
| VPNYNLIVMDEAHFT | YNLIVMDEA/DRB1*0101(124.66) | YNLIVMDEA/DRB1*0401(452.48) | | |
| GWSYTYCGGLKNVKEV | YCGGLKNVK/DRB1*1101(191.71) | YYCGGLKNV/DRB1*0101(118.65) | | |
| EAGRTLRVLSLVENW | GRTLRVLSL/DRB1*0101(160.19) | TLRVLSLVE/DRB1*1101(399.44) | | |
| AGWSLRETACLGKSY | WSLRETACL/DRB1*0101(219.53) | | | |
| QEGAMHSALTGATEI | MHSALTGAT/DRB1*0101(283.26) | | | |
| RAAAGIMKNPTVDGI | AGIMKNPTV/DRB1*0101(162.98) | | | |
| MYAGHLKCKVRMERL | GHILKCKVRM/DRB1*1101(117.37) | YAGHLKCKV/DRB1*0101(447.65) | | |
| QFQADSPKRLATAIA | FQADSPKRL/DRB1*0101(79.43) | FQADSPKRL/DRB1*0701(195.94) | | |
| RRDLRLASMAICSAV | DLRLASMAI/DRB1*0101(12.41) | DLRLASMAI/DRB1*0701(168.72) | DLRLASMAI/DRB1*1101(382.47) | LRLASMAIC/DRB1*0401(269.45) |
| NASGNIVSSVNMISR | IVSSVNMIS/DRB1*0401(101.35) | NIVSSVNMI/DRB1*0101(155.82) | NIVSSVNMI/DRB1*0701(69.38) | |
| MDIGVPLLAIGCYSQ | PLLAIGCYS/DRB1*0101(288.06) | | | |

FIG. 50-56

| peptide | core/HLA(affinity(nM)) | core/HLA(affinity(nM)) | core/HLA(affinity(nM)) |
|---|---|---|---|
| QPESPKRLSAAIGKA | PKRLSAAIG/DRB1*0101(215.06) | | |
| IVREAIKRGLRTLIL | IKRGLRTLI/DRB1*0101(66.04) | IKRGLRTLI/DRB1*0701(34.77) | IKRGLRTLI/DRB1*1101(19.59) |
| DGEYRLRGEQRKTFV | YRLRGEQRK/DRB1*1101(345.38) | | |
| GICGIRSTTRLENLM | CGIRSTTRL/DRB1*0101(381.26) | CGIRSTTRL/DRB1*0701(141.33) | IRSTRLEN/DRB1*1101(114.63) |
| AGRTLRVLNLVENWL | LRVLNLVEN/DRB1*0101(168.50) | | |
| LLVLCVTQVLLMRIT | VTQVLLMRT/DRB1*0101(275.99) | VTQVLLMRT/DRB1*1101(468.52) | |
| VSTGSQLAKRFSKGL | GSQLAKRFS/DRB1*1101(238.10) | | |
| QILLMRTTWAFCEVL | ILLMRTTWA/DRB1*0101(83.90) | ILLMRTTWA/DRB1*1101(437.92) | LMRTTWAFC/DRB1*0701(186.64) |
| TGNIVSSVNMVSRML | IVSSVNMVS/DRB1*0401(99.71) | IVSSVNMVS/DRB1*0701(77.60) | SVNMVSRML/DRB1*0101(45.29) |
| FSSELLSGRGPLKLF | LSGRGPLK/DRB1*0101(50.57) | LSGRGPLKL/DRB1*0701(280.68) | |
| VAAEMEEALKGLPIR | EEALKGLPI/DRB1*0101(490.25) | | |
| DQYVFMGEPLENDED | YVFMGEPLE/DRB1*0101(391.43) | | |
| CGSLIGLTSRATWAK | LIGLTSRAT/DRB1*0101(2.39) | LIGLTSRAT/DRB1*0401(72.40) | LIGLTSRAT/DRB1*0701(198.92) | LIGLTSRAT/DRB1*1101(15.02) |
| SRGSSKIRWFVERNL | IRWFVERNL/DRB1*0701(496.84) | | |
| QLGQVMLLILCASQI | LLILCASQI/DRB1*0101(96.44) | LLILCASQI/DRB1*0701(436.48) | |
| LLVTFKNPHAKRQDV | LVTFKNPHA/DRB1*0101(12.77) | LVTFKNPHA/DRB1*0401(11.67) | LVTFKNPHA/DRB1*0701(117.06) | LVTFKNPHA/DRB1*1101(26.54) |
| GRARVSQGAGWSLRE | VSQGAGWSL/DRB1*0101(270.85) | VSQGAGWSL/DRB1*0701(480.68) | |
| TGNIVSAVNMTSKML | IVSAVNMTS/DRB1*0101(20.79) | IVSAVNMTS/DRB1*0401(24.83) | IVSAVNMTS/DRB1*0701(80.62) | IVSAVNMTS/DRB1*1101(98.93) |
| KELKCGSGIFVTDNV | LKCGSGIFV/DRB1*0101(373.40) | | |
| ALIALNDMGKIRKDI | LIALNDMGK/DRB1*0101(72.20) | LIALNDMGK/DRB1*1101(358.99) | |
| RKTFVDLMKRGDLPV | FVDLMKRGD/DRB1*1101(210.12) | | |

FIG. 50-57

| peptide | core/HLA(affinity(nM)) | core/HLA(affinity(nM)) | core/HLA(affinity(nM)) | core/HLA(affinity(nM)) |
|---|---|---|---|---|
| VRVPNYNLIIMDEAH | YNLIIMDEA/DRB1*0101(386.15) | | | |
| FVELMKRGDLPVWLA | LMKRGDLPV/DRB1*0101(478.12) | | | |
| AAIKDSKAVHADMGY | IKDSKAVHA/DRB1*0101(167.72) | IKDSKAVHA/DRB1*0701(197.75) | | |
| EESRTIRVLKMVEPW | SRTIRVLKM/DRB1*0101(461.03) | TIRVLKMVE/DRB1*1101(301.92) | | |
| IPMSTYGWNLVRLQS | PMSTYGWNL/DRB1*0701(338.32) | YGWNLVRLQ/DRB1*0101(206.59) | YGWNLVRLQ/DRB1*0401(444.93) | YGWNLVRLQ/DRB1*1101(320.01) |
| SLVRCPLSRNSTHEM | LVRCPLSRN/DRB1*1101(311.33) | | | |
| MRTTWAFCEVLTLAT | FCEVLTLAT/DRB1*0101(134.64) | FCEVLTLAT/DRB1*0401(371.05) | FCEVLTLAT/DRB1*0701(136.76) | |
| NPTVDGIVAIDLDPI | VDGIVAIDL/DRB1*0101(421.91) | | | |
| LKPVILTDGPERVIL | ILTDGPERV/DRB1*0101(499.86) | | | |
| EERVVLAGPMPVTHS | VVLAGPMPV/DRB1*0101(41.78) | | | |
| LASALLKNDIPMTGP | LLKNDIPMT/DRB1*0101(370.80) | LLKNDIPMT/DRB1*0401(365.14) | | |
| EKRSVALAPHVGLGL | SVALAPHVG/DRB1*0101(29.49) | VALAPHVGL/DRB1*0701(134.42) | | |
| RDFVEGVSGGSWVDI | FVEGVSGGS/DRB1*0101(474.45) | | | |
| NQAAILMGLDKGWPL | AILMGLDKG/DRB1*0101(354.18) | | | |
| RGSGQWTYSLNTFT | VTYSLNTFT/DRB1*0701(263.39) | | | |
| NLIIMDEAHFTDPAS | IIMDEAHFT/DRB1*0101(340.55) | IIMDEAHFT/DRB1*0401(478.82) | | |
| NDTWKIEKASFIEIK | WKIEKASFI/DRB1*0101(46.61) | WKIEKASFI/DRB1*0701(161.57) | | |
| PMYAGGLLLAAYYMT | GGLLLAAYY/DRB1*0101(40.29) | | | |
| DIPMTGPLVAGGLLT | DIPMTGPLV/DRB1*0101(128.05) | | | |
| MATLKNVREVKGLTK | VREVKGLTK/DRB1*1101(411.26) | | | |
| LGCYSQVNPLTLIAA | CYSQVNPLT/DRB1*0401(83.20) | YSQVNPLTL/DRB1*0101(8.73) | YSQVNPLTL/DRB1*0701(18.32) | YSQVNPLTL/DRB1*1101(264.43) |

FIG. 50-58

| peptide | core/HLA(affinity(nM)) | core/HLA(affinity(nM)) | core/HLA(affinity(nM)) |
|---|---|---|---|
| STYRGAKRMAILGET | YRGAKRMAI/DRB1*0101(91.38) | YRGAKRMAI/DRB1*0701(265.24) | YRGAKRMAI/DRB1*1101(34.54) |
| GWNLVKLHSGVDVFY | VKLHSGVDV/DRB1*0101(42.85) | VKLHSGVDV/DRB1*0701(95.35) | WNLVKLHSG/DRB1*1101(275.27) |
| GGWSYYMATLKNVRE | YMATLKNVR/DRB1*1101(21.36) | YYMATLKNV/DRB1*0101(15.38) | YYMATLKNV/DRB1*0401(119.34) | YYMATLKNV/DRB1*0701(68.34) |
| QFCIKVLNPYMPTVI | CIKVLNPYM/DRB1*0101(30.82) | CIKVLNPYM/DRB1*0401(303.96) | CIKVLNPYM/DRB1*0701(121.62) | CIKVLNPYM/DRB1*1101(63.42) |
| AAILMGLGKGWPLHR | LMGLGKGWP/DRB1*1101(381.83) | MGLGKGWPL/DRB1*0101(37.35) | MGLGKGWPL/DRB1*0701(290.24) |
| SSMVNGVVKLLTKPW | SMVNGVVKL/DRB1*0101(278.75) | VNGVVKLLT/DRB1*1101(110.09) |
| KVWNRVWIQDNPNMI | VWIQDNPNM/DRB1*0101(400.70) | VWIQDNPNM/DRB1*0401(301.22) |
| MRTSWAFCESLTLAT | FCESLTLAT/DRB1*0401(146.22) | FCESLTLAT/DRB1*0701(47.48) | WAFCESLTL/DRB1*0101(54.24) | WAFCESLTL/DRB1*1101(407.54) |
| FHTMWHVTRGSVICH | MWHVTRGSV/DRB1*1101(31.61) | WHVTRGSVI/DRB1*0101(13.07) | WHVTRGSVI/DRB1*0701(9.14) |
| VTTDISEMGANFRAE | ISEMGANFR/DRB1*0101(477.87) |
| MRRGDLPVWLAYKVA | LPVWLAYKV/DRB1*0101(386.34) |
| GNDIANCLRKNGKKV | IANCLRKNG/DRB1*1101(316.99) |
| TFLRVLSIPPTAGVL | FLRVLSIPP/DRB1*0101(4.40) | FLRVLSIPP/DRB1*0401(37.51) | FLRVLSIPP/DRB1*0701(34.41) | FLRVLSIPP/DRB1*1101(30.94) |
| TRRYLPAMVREAIRR | TRRYLPAMV/DRB1*1101(81.01) | YLPAMVREA/DRB1*0101(27.83) |
| LMGLGKGWPLHRMDI | LGKGWPLHR/DRB1*0701(404.86) | LGKGWPLHR/DRB1*1101(363.83) | MGLGKGWPL/DRB1*0101(87.24) |
| EKRSVALAPHVGMGL | SVALAPHVG/DRB1*0101(38.97) | VALAPHVGM/DRB1*0701(252.72) |
| SVKKDLISYGGGWRL | ISYGGGWRL/DRB1*0101(215.17) | ISYGGGWRL/DRB1*0701(143.26) |
| KEGVFHTMWHVTRGS | FHTMWHVTR/DRB1*0101(17.17) | FHTMWHVTR/DRB1*0401(457.18) | FHTMWHVTR/DRB1*1101(22.41) | VFHTMWHVT/DRB1*0701(151.62) |
| LKPRWLDARIYADPM | PRWLDARIY/DRB1*0101(384.26) |
| RKTFVELMKRGDLPV | FVELMKRGD/DRB1*1101(115.56) |
| LAGPLIAGGMLIACY | PLIAGGMLI/DRB1*0101(173.22) |

FIG. 50-59

| peptide | core/HLA(affinity(nM)) | core/HLA(affinity(nM)) | core/HLA(affinity(nM)) |
|---|---|---|---|
| SLLFLNDMGKVRKDI | FLNDMGKVR/DRB1*0101(80.76) | FLNDMGKVR/DRB1*0401(367.56) | FLNDMGKVR/DRB1*1101(235.24) |
| SLTAIANQAAVLMGL | AIANQAAVL/DRB1*0701(150.45) | IANQAAVLM/DRB1*0101(6.04) | LTAIANQAA/DRB1*0401(64.27) |
| IMLLILCTGQLLMMR | LLILCTGQL/DRB1*0101(76.37) | | |
| TANVSLAAIANQATV | LAAIANQAT/DRB1*0701(348.32) | SLAAIANQA/DRB1*0101(17.92) | VSLAAIANQ/DRB1*0401(153.88) |
| HWIAASIILEFFLMY | HWIAASIIL/DRB1*0101(452.70) | | |
| HEMYWVSNASGNIVS | MYWVSNASG/DRB1*0101(31.31) | MYWVSNASG/DRB1*0401(92.93) | WVSNASGNI/DRB1*0701(44.14) |
| AGPMPVTAASAAQRR | VTAASAAQR/DRB1*0101(436.36) | | |
| GLVKRFSTGLLNGKG | VKRFSTGLL/DRB1*0101(69.28) | VKRFSTGLL/DRB1*0401(405.99) | VKRFSTGLL/DRB1*0701(98.07) | VKRFSTGLL/DRB1*1101(175.92) |
| YLPAMVREAIRRGLR | MVREAIRRG/DRB1*0101(273.68) | MVREAIRRG/DRB1*1101(100.83) | | |
| RAQTWMSSEGAWKHV | QTWMSSEGA/DRB1*0101(61.58) | QTWMSSEGA/DRB1*0401(413.29) | | |
| RWLDARYADPMALK | DARYADPM/DRB1*0101(370.17) | | | |
| CWYGMEIRPLKEKEE | WYGMEIRPL/DRB1*0101(51.34) | YGMEIRPLK/DRB1*1101(190.20) | | |
| SYEVKPTGSASSMIN | VKPTGSASS/DRB1*0101(298.27) | | | |
| EGIMAVGMVSILASA | AVGMVSILA/DRB1*0101(111.22) | | | |
| REKRSVALTPHSGMG | SVALTPHSG/DRB1*0101(210.93) | | | |
| IAACLRKSGKRVIQL | CLRKSGKRV/DRB1*0101(230.63) | LRKSGKRVI/DRB1*0101(187.03) | LRKSGKRVI/DRB1*1101(46.16) | |
| ESLETLMLVALLATV | TLMLVALLA/DRB1*0101(352.44) | | | |
| LDARIYADPMALKDF | IYADPMALK/DRB1*0401(437.17) | RIYADPMAL/DRB1*0101(210.13) | | |
| WGNGCGLFGKGSLIT | GLFGKGSLI/DRB1*0101(371.65) | | | |
| SRAIWYMWLGARFLE | IWYMWLGAR/DRB1*1101(86.99) | YMWLGARFL/DRB1*0101(13.27) | YMWLGARFL/DRB1*0701(410.54) | |
| LLALNDMGKVRKDIQ | LLALNDMGK/DRB1*0101(374.84) | | | |

FIG. 50-60

| peptide | core/HLA(affinity(nM)) | core/HLA(affinity(nM)) | core/HLA(affinity(nM)) |
|---|---|---|---|
| ATYGWNLVKLHSGVD | WNLVKLHSG/DRB1*0701(475.80) | YGWNLVKLH/DRB1*0101(157.90) | YGWNLVKLH/DRB1*0401(432.43) | YGWNLVKLH/DRB1*1101(100.58) |
| EGNPGRFWNTTIAVS | FWNTTIAVS/DRB1*0401(420.69) | FWNTTIAVS/DRB1*0701(323.36) | | |
| KTKRILPSIVREAIK | TKRILPSIV/DRB1*0101(31.93) | TKRILPSIV/DRB1*0701(179.68) | TKRILPSIV/DRB1*1101(83.37) | |
| PWDVIPMVTQMAMTD | VIPMVTQMA/DRB1*0101(41.74) | VIPMVTQMA/DRB1*0401(270.01) | | |
| GWSYYCGGLKNVTEV | YCGGLKNVT/DRB1*1101(315.95) | YYCGGLKNV/DRB1*0101(110.28) | | |
| TIEESRTIRVLKMVE | IEESRTIRV/DRB1*0701(84.16) | SRTIRVLKM/DRB1*0101(229.14) | SRTIRVLKM/DRB1*1101(252.79) | |
| RHTIENTTANISLTA | IENTANIS/DRB1*0101(312.98) | IENTTANIS/DRB1*0401(286.17) | IENTTANIS/DRB1*0701(199.78) | |
| QYKFQPESPKRLSAA | FQPESPKRL/DRB1*0101(16.82) | FQPESPKRL/DRB1*0401(342.95) | FQPESPKRL/DRB1*0701(207.00) | FQPESPKRL/DRB1*1101(321.65) |
| GGSLVRCPLSRNSTH | LVRCPLSRN/DRB1*0101(363.39) | LVRCPLSRN/DRB1*1101(169.77) | | |
| AEFCKKVRSNAAMGA | CKKVRSNAA/DRB1*0101(29.35) | FCKKVRSNA/DRB1*0701(137.15) | FCKKVRSNA/DRB1*1101(45.61) | VRSNAAMGA/DRB1*0401(121.07) |
| FEKQLGQVMLLILCA | FEKQLGQVM/DRB1*0101(85.20) | | | |
| VTKNGGYVSGIAQTN | YVSGIAQTN/DRB1*0101(201.97) | | | |
| SGKKVIQLSRKTFDS | KVIQLSRKT/DRB1*1101(28.49) | | | |
| DVDCWCNATSAWWMY | WCNATSAWW/DRB1*0101(148.38) | WCNATSAWW/DRB1*0401(453.22) | WCNATSAWW/DRB1*0701(146.68) | |
| WALCEVLTLATGPVM | VLTLATGPV/DRB1*0101(37.00) | VLTLATGPV/DRB1*0701(207.54) | | |
| EDGAYRIMQRGLFGY | YRIMQRGLF/DRB1*0101(60.22) | YRIMQRGLF/DRB1*1101(28.14) | | |
| VEDYGFGVFTTNIWL | GFGVFTTNI/DRB1*0701(241.92) | | | |
| AVKDQRAVHADMGYW | VKDQRAVHA/DRB1*0101(475.74) | | | |
| NQAVLMGLDKGWPI | VVLMGLDKG/DRB1*0101(300.03) | | | |
| ATHQWMTTEDMLSVW | HQWMTTEDM/DRB1*0101(123.70) | WMTTEDMLS/DRB1*0401(79.62) | WMTTEDMLS/DRB1*0701(409.33) | WMTTEDMLS/DRB1*0701(409.33) |
| HADMGYWIESSKNQT | YWIESSKNQ/DRB1*0401(272.84) | | | |

FIG. 50-61

| peptide | core/HLA(affinity(nM)) | core/HLA(affinity(nM)) | core/HLA(affinity(nM)) |
|---|---|---|---|
| KTFVELMKRGDLPYW | FVELMKRGD/DRB1*1101(157.95) | | |
| TKYAVSRGTSKIRWI | YAVSRGTSK/DRB1*0101(96.51) | YAVSRGTSK/DRB1*0701(61.21) | YAVSRGTSK/DRB1*1101(63.21) |
| GEAAGIFMTATPPGS | FMTATPPGS/DRB1*0101(31.19) | IFMTATPPG/DRB1*0401(14.71) | IFMTATPPG/DRB1*1101(321.31) |
| VTVLGSQEGAMHSAL | LGSQEGAMH/DRB1*0101(99.06) | LGSQEGAMH/DRB1*0401(412.29) | |
| EQYKFQADSPSKLAS | FQADSPSKL/DRB1*0101(13.91) | FQADSPSKL/DRB1*0701(34.75) | YKFQADSPS/DRB1*1101(425.44) |
| MSAAVKDNRAVHADM | VKDNRAVHA/DRB1*0101(423.72) | | |
| QEVPFCSHHFHQLIM | FCSHHFHQL/DRB1*0101(171.92) | FCSHHFHQL/DRB1*0701(43.51) | |
| CGLFGKGSLITCAKF | FGKGSLITC/DRB1*0101(63.91) | FGKGSLITC/DRB1*0401(497.67) | FGKGSLITC/DRB1*1101(196.21) |
| GSGIFITNEVHTWTE | FITNEVHTW/DRB1*0101(345.88) | | |
| PTSRTTWSIHATHQW | WSIHATHQW/DRB1*0701(232.38) | | |
| TTWALCESITLATGP | WALCESITL/DRB1*0101(125.13) | WALCESITL/DRB1*0701(382.92) | |
| GVEGEGLHRLGYILR | GLHRLGYIL/DRB1*0101(144.83) | LHRLGYILR/DRB1*1101(207.49) | |
| KTRKYLPAIVREAIK | KYLPAIVRE/DRB1*0701(268.75) | RKYLPAIVR/DRB1*1101(106.62) | YLPAIVREA/DRB1*0401(238.77) |
| AAEMEEALRGLPIRY | EEALRGLPI/DRB1*0101(124.90) | | |
| AVATTFITPMLRHSI | FITPMLRHS/DRB1*0101(109.24) | ITPMLRHSI/DRB1*1101(41.08) | TFITPMLRH/DRB1*0701(101.05) |
| GLVSILLSLLRNDV | ILLSLLRN/DRB1*0401(456.80) | LVSILLSLL/DRB1*1101(170.59) | VSILLSLL/DRB1*0101(18.21) | VSILLSLL/DRB1*0701(151.23) |
| YHGSYEVKATGSASS | YEVKATGSA/DRB1*0101(345.91) | | |
| LTYQNKVVRVQRPTP | TYQNKVVRV/DRB1*0101(442.85) | YQNKVVRVQ/DRB1*1101(169.03) | |
| CYVITGRSADLELEK | CYVITGRSA/DRB1*1101(214.90) | VITGRSADL/DRB1*0101(51.83) | VITGRSADL/DRB1*0701(323.62) |
| DLHPASAWTLYAVAT | LHPASAWTL/DRB1*0101(78.42) | LHPASAWTL/DRB1*0701(177.10) | |
| AEMEEALKGMPIRYQ | EEALKGMPI/DRB1*0101(70.06) | | |

FIG. 50-62

| peptide | core/HLA(affinity(nM)) | core/HLA(affinity(nM)) | core/HLA(affinity(nM)) |
|---|---|---|---|
| QRKTFVELMKRGDLP | FVELMKRGD/DRB1*1101(142.98) | | |
| IACYVITGRSADLEL | CYVITGRSA/DRB1*0101(25.92) | YVITGRSAD/DRB1*0701(121.83) | YVITGRSAD/DRB1*1101(59.20) |
| YGWNIVKLHSGKDVF | VKLHSGKDV/DRB1*0701(137.40) | WNIVKLHSG/DRB1*0101(112.31) | WNIVKLHSG/DRB1*1101(82.54) |
| IYGAAFSGVSWIMKI | FSGVSWIMK/DRB1*0101(104.80) | FSGVSWIMK/DRB1*0701(57.94) | FSGVSWIMK/DRB1*1101(275.99) |
| MFAGHLKCRLKMDKL | FAGHLKCRL/DRB1*0101(249.39) | GHLKCRLKM/DRB1*1101(56.89) | |
| LLDNIYTPEGIIPTL | YTPEGIIPT/DRB1*0101(448.67) | | |
| MWLGARFLEFEALGF | FLEFEALGF/DRB1*0101(176.89) | FLEFEALGF/DRB1*0701(221.79) | |
| TITLLVKLALITVSG | LVKLALITV/DRB1*0101(106.60) | TITLLVKLA/DRB1*1101(350.97) | |
| CESITLATGPLSTLW | ITLATGPLS/DRB1*0101(4.61) | ITLATGPLS/DRB1*0401(28.43) | ITLATGPLS/DRB1*0701(60.10) | ITLATGPLS/DRB1*1101(190.83) |
| EVQYLAIEPGKNPKH | VLAIEPGKN/DRB1*0101(423.43) | | |
| KGLPIRYQTTAVKSE | IRYQTTAVK/DRB1*0101(26.33) | IRYQTTAVK/DRB1*0401(39.28) | IRYQTTAVK/DRB1*1101(139.08) | PIRYQTTAV/DRB1*0701(99.99) |
| ACLGKSYAQMWALMY | SYAQMWALM/DRB1*0101(27.38) | YAQMWALMY/DRB1*0701(161.56) | YAQMWALMY/DRB1*1101(451.88) |
| MLKRERNRVSTGSQL | LKRERNRVS/DRB1*0101(465.23) | LKRERNRVS/DRB1*1101(246.66) | |
| YIYMGQPLNNDEDHA | YIYMGQPLN/DRB1*0101(181.63) | | |
| GIMKNPTVDGIVAID | IMKNPTVDG/DRB1*0101(422.39) | | |
| AILMGLGKGWPLHRM | LGKGWPLHR/DRB1*1101(282.30) | MGLGKGWPL/DRB1*0101(25.24) | MGLGKGWPL/DRB1*0701(198.80) |
| LAPHVGMGLETRAQT | HVGMGLETR/DRB1*0101(410.90) | | |
| ISTRVEMGEAAGIFM | VEMGEAAGI/DRB1*0101(77.72) | | |
| VPNYNLIIMDEAHFT | YNLIIMDEA/DRB1*0101(79.34) | YNLIIMDEA/DRB1*0401(430.79) | |
| LETLMLVALLATVTG | LVALLATVT/DRB1*0101(78.38) | | |
| IGAIALDFSPGTSGS | IALDFSPGT/DRB1*0101(170.80) | IALDFSPGT/DRB1*0401(50.19) | |

FIG. 50-63

| peptide | core/HLA(affinity(nM)) | core/HLA(affinity(nM)) | core/HLA(affinity(nM)) |
|---|---|---|---|
| VEDYGFGVFSTNIWL | GFGVFSTNI/DRB1*0101(357.98) | GFGVFSTNI/DRB1*0701(144.90) | |
| QLLMMRTTWALCESI | LLMMRTTWA/DRB1*0101(55.43) | MMRTTWALC/DRB1*0701(158.42) | MMRTTWALC/DRB1*1101(339.62) |
| STANVSLAAIANQAV | LAAIANQAV/DRB1*0701(152.31) | NVSLAAIANQ/DRB1*0401(240.81) | |
| YLPAIVREAIKRKLR | IVREAIKRK/DRB1*0101(268.17) | IVREAIKRK/DRB1*1101(44.11) | |
| GPMPVTHASAAQRRG | VTHASAAQR/DRB1*0101(378.23) | | |
| ATTIVTPMLRHTIEN | TTIVTPMLR/DRB1*0701(443.48) | VTPMLRHTI/DRB1*0101(382.63) | VTPMLRHTI/DRB1*1101(112.07) |
| VLMGLGKGWPIHKMD | MGLGKGWPI/DRB1*0101(85.97) | MGLGKGWPI/DRB1*0701(360.02) | |
| GKMFETTMRGAKRMA | ETTMRGAKR/DRB1*0101(124.65) | FETTMRGAK/DRB1*1101(42.95) | |
| YNLIIMDEAHFTDPA | IIMDEAHFT/DRB1*0101(136.39) | IIMDEAHFT/DRB1*0401(332.57) | |
| AGKTKRILPSIVREA | TKRILPSIV/DRB1*0101(18.40) | TKRILPSIV/DRB1*0701(131.12) | TKRILPSIV/DRB1*1101(50.61) |
| RREKRSVALVPHVGM | RSVALVPHV/DRB1*0701(250.47) | SVALVPHVG/DRB1*0101(183.76) | |
| MANIFRGSYLAGAGL | ANIFRGSYL/DRB1*0701(465.49) | FRGSYLAGA/DRB1*0401(335.92) | IFRGSYLAG/DRB1*0101(49.10) |
| PSLRTTVTGKIITE | LRTTVTGK/DRB1*0701(79.45) | | |
| SGIFITDNVHTWTEQ | IFITDNVHT/DRB1*0101(265.96) | IFITDNVHT/DRB1*0401(199.02) | IFITDNVHT/DRB1*0701(497.74) |
| KWGLYGNGWTKSG | WGLYGNGV/DRB1*0101(92.32) | | |
| PMLRHTIENSTANYS | RHTIENSTA/DRB1*0401(492.59) | | |
| DNIYTPEGIIPTLFG | YTPEGIIPT/DRB1*0101(210.32) | | |
| WFPTSRTTWSIHAKH | SRTTWSIHA/DRB1*0701(396.45) | TTWSIHAKH/DRB1*1101(307.84) | |
| ASSMINGVKLLTKP | INGVKLLT/DRB1*1101(132.37) | MINGVKLL/DRB1*0101(169.14) | |
| FTNMEVQLIRQMEAE | FTNMEVQLI/DRB1*0101(107.55) | VQLIRQMEA/DRB1*1101(409.05) | |
| LGKSYAQMWTLMYFH | YAQMWTLMY/DRB1*0101(24.56) | YAQMWTLMY/DRB1*0401(145.35) | YAQMWTLMY/DRB1*0701(147.10) | YAQMWTLMY/DRB1*1101(210.51) |

FIG. 50-64

| peptide | core/HLA(affinity(nM)) | core/HLA(affinity(nM)) | core/HLA(affinity(nM)) |
|---|---|---|---|
| RQDVIVLGSQEGAMR | VIVLGSQEG/DRB1*0101(50.00) | | |
| PLSTLWEGSPGRFWN | LWEGSPGRF/DRB1*0101(489.69) | | |
| TCVYNMMGKREKKLG | VYNMMGKRE/DRB1*0101(72.79) | YNMMGKREK/DRB1*1101(41.51) | |
| FIAFLRFLTIPPTAG | FLRFLTIPP/DRB1*0101(4.26) | FLRFLTIPP/DRB1*0701(29.81) | FLRFLTIPP/DRB1*1101(15.83) |
| YWVSGVSGNIVSSYN | WVSGVSGNI/DRB1*0101(226.40) | WVSGVSGNI/DRB1*0701(257.74) | |
| NGVVTRSGTYYSAIA | VTRSGTYYS/DRB1*0701(293.11) | VVTRSGTYV/DRB1*0101(427.50) | |
| LCEVITLATGPLSTL | ITLATGPLS/DRB1*0401(34.49) | ITLATGPLS/DRB1*1101(285.42) | VITLATGPL/DRB1*0101(5.11) | VITLATGPL/DRB1*0701(52.85) |
| LKNDVPLAGPLIAGG | DVPLAGPLI/DRB1*0101(27.92) | | |
| EQYQFQADSPKRLAT | FQADSPKRL/DRB1*0101(27.56) | FQADSPKRL/DRB1*0401(148.62) | FQADSPKRL/DRB1*0701(60.03) | FQADSPKRL/DRB1*1101(374.77) |
| DGITVIDLEPVIYDS | VIDLEPVIY/DRB1*0101(396.35) | | |
| ALKGMPIRYQTPAIR | IRYQTPAIR/DRB1*0101(36.11) | IRYQTPAIR/DRB1*0401(224.43) | | LKGMPIRYQ/DRB1*1101(139.05) |
| LMYFHRRDLRLAANA | FHRRDLRLA/DRB1*1101(9.85) | YFHRRDLRL/DRB1*0101(22.36) | YFHRRDLRL/DRB1*0401(430.98) | YFHRRDLRL/DRB1*0701(53.39) |
| ALKGLPIRYQTTAVK | IRYQTTAVK/DRB1*0401(94.29) | IRYQTTAVK/DRB1*0701(278.82) | LKGLPIRYQ/DRB1*0101(39.56) | LKGLPIRYQ/DRB1*1101(104.70) |
| WTLYAVATTIVTPML | LYAVATTIV/DRB1*0701(26.91) | YAVATTIVT/DRB1*0101(25.83) | YAVATTIVT/DRB1*0401(158.39) | YAVATTIVT/DRB1*1101(332.32) |
| YGWNLVKLMSGKDVF | LVKLMSGKD/DRB1*0401(454.26) | LVKLMSGKD/DRB1*0701(157.86) | LVKLMSGKD/DRB1*1101(71.98) | VKLMSGKDV/DRB1*0101(13.93) |
| GRELKCGSGIFITNN | LKCGSGIFI/DRB1*0101(197.09) | | |
| AQTWMSSEGAWKHYQ | WMSSEGAWK/DRB1*0101(74.17) | | |
| DLLVTFKTAHAKKQE | LVTFKTAHA/DRB1*0101(11.52) | LVTFKTAHA/DRB1*0401(10.55) | LVTFKTAHA/DRB1*0701(60.19) | TFKTAHAKK/DRB1*1101(17.95) |
| VPLLAMGCYSQVNPT | LLAMGCYSQ/DRB1*0101(148.76) | | |
| RTTWSIHAKHEWMTT | TTWSIHAKH/DRB1*1101(375.01) | | |
| NIYTPEGIIPTLFGP | YTPEGIIPT/DRB1*0101(289.22) | | |

FIG. 50-65

| peptide | core/HLA(affinity(nM)) | core/HLA(affinity(nM)) | core/HLA(affinity(nM)) |
|---|---|---|---|
| ASGNIVSSVNMISRM | IVSSVNMIS/DRB1*0401(60.35) | IVSSVNMIS/DRB1*1101(301.61) | NIVSSVNMI/DRB1*0101(76.95) | NIVSSVNMI/DRB1*0701(49.93) |
| LRPRWLDARTYSDPL | WLDARTYSD/DRB1*0701(427.57) | | | |
| IEPSWADVRNDLISY | WADVRNDLI/DRB1*0701(343.60) | | | |
| LDEGYRIKQQGILG | YRIKQQGI/DRB1*0701(324.36) | YRIKQQGIL/DRB1*0101(158.24) | YRIKQQGIL/DRB1*1101(289.11) | |
| ERMVTFKVPHAKKQD | MVTFKVPHA/DRB1*0101(44.75) | MVTFKVPHA/DRB1*0401(113.47) | MVTFKVPHA/DRB1*0701(231.16) | MVTFKVPHA/DRB1*1101(30.60) |
| GNPGRFWNTTIAVSM | FWNTTIAVS/DRB1*0401(256.81) | WNTTIAVSM/DRB1*0101(158.29) | WNTTIAVSM/DRB1*0701(77.87) | |
| ELLVTFKNPHAKRQD | LVTFKNPHA/DRB1*0101(10.04) | LVTFKNPHA/DRB1*0401(8.41) | LVTFKNPHA/DRB1*0701(90.30) | LVTFKNPHA/DRB1*1101(24.99) |
| IETLMLLTLIAVLTG | LLTLIAVLT/DRB1*0101(293.81) | | | |
| TYRGAKRMAILGETA | YRGAKRMAI/DRB1*0101(184.88) | YRGAKRMAI/DRB1*1101(83.84) | | |
| NPGKFWNTTIAVSMA | FWNTTIAVS/DRB1*1101(338.65) | KFWNTTIAV/DRB1*0401(137.54) | WNTTIAVSM/DRB1*0101(51.63) | WNTTIAVSM/DRB1*0701(40.65) |
| GVFHTMWHVTRGAVL | FHTMWHVTR/DRB1*0101(10.38) | FHTMWHVTR/DRB1*1101(16.05) | WHVTRGAVL/DRB1*0701(13.57) | |
| REDLWCGSLIGLSSR | CGSLIGLSS/DRB1*0101(230.10) | | | |
| EVVVLGSQEGAMHTA | VVVLGSQEG/DRB1*0101(83.77) | | | |
| PIPMSTYGWNLVRLQ | MSTYGWNLV/DRB1*0101(267.30) | PMSTYGWNL/DRB1*0701(244.15) | | |
| DLGVPLLALGCYSQV | PLLALGCYS/DRB1*0101(153.63) | | | |
| TRTETWMSSEGAWKH | ETWMSSEGA/DRB1*0101(184.87) | | | |
| FKNAHAKRQDVIVLG | FKNAHAKRQ/DRB1*0101(390.11) | | | |
| NIVSSVNTISKMLLN | IVSSVNTIS/DRB1*0101(139.74) | IVSSVNTIS/DRB1*0401(224.98) | SVNTISKML/DRB1*0701(47.49) | VNTISKMLL/DRB1*1101(274.74) |
| ELMKRGDLPVWLAYK | KRGDLPVWL/DRB1*0101(402.79) | | | |
| FKLTYQNKVVKVLRP | FKLTYQNKV/DRB1*0101(56.56) | FKLTYQNKV/DRB1*0701(39.93) | FKLTYQNKV/DRB1*1101(67.71) | |
| WPLNEGIMAIGIVSI | NEGIMAIGI/DRB1*0101(178.98) | | | |

FIG. 50-66

| peptide | core/HLA(affinity(nM)) | core/HLA(affinity(nM)) | core/HLA(affinity(nM)) |
|---|---|---|---|
| CVTTIAKSKPTLDIE | CVTTIAKSK/DRB1*1101(177.61) | IAKSKPTLD/DRB1*0101(81.48) | IAKSKPTLD/DRB1*0701(45.03) |
| STYSQLAKRFSRGML | AKRFSRGML/DRB1*0701(272.09) | TVSQLAKRF/DRB1*0101(282.49) | VSQLAKRFS/DRB1*1101(42.31) |
| AIYGAAFSGVSWIMK | FSGVSWIMK/DRB1*0701(109.94) | FSGVSWIMK/DRB1*1101(338.75) | YGAAFSGVS/DRB1*0101(101.53) |
| GQVMLLILCASQILL | LLILCASQI/DRB1*0101(27.82) | LLILCASQI/DRB1*0701(169.30) | |
| HWFSRENSYSGYEGE | FSRENSYSG/DRB1*0401(461.36) | | |
| KVRSNAAIGAVFVDE | VRSNAAIGA/DRB1*0101(31.34) | VRSNAAIGA/DRB1*0401(359.51) | VRSNAAIGA/DRB1*0701(277.67) |
| LVSLLGSSLLKNDVP | LVSLLGSSL/DRB1*0101(10.59) | LVSLLGSSL/DRB1*0701(294.31) | |
| TRKYLPAIVREAIKR | YLPAIVREA/DRB1*0101(22.82) | YLPAIVREA/DRB1*0401(267.87) | YLPAIVREA/DRB1*0701(380.60) | YLPAIVREA/DRB1*1101(111.49) |
| FMGHLKCRLRMDKLQ | FMGHLKCRL/DRB1*0101(201.69) | LKCRLRMDK/DRB1*1101(34.82) | |
| DPKFEKQLGQVMLLV | FEKQLGQVM/DRB1*0101(12.99) | FEKQLGQVM/DRB1*0701(269.76) | |
| CGLFGKGSLVTCAKF | FGKGSLVTC/DRB1*0101(36.61) | FGKGSLVTC/DRB1*0401(332.38) | FGKGSLVTC/DRB1*0401(242.60) | LFGKGSLVT/DRB1*1101(188.14) |
| GEAAAIFMTATPPGA | FMTATPPGA/DRB1*0101(16.82) | IFMTATPPG/DRB1*0401(11.32) | IFMTATPPG/DRB1*0401(103.59) | IFMTATPPG/DRB1*1101(404.71) |
| SPSPTVEAGRTLRVL | VEAGRTLRV/DRB1*0101(175.28) | VEAGRTLRV/DRB1*0701(179.53) | VEAGRTLRV/DRB1*0101(121.00) | |
| MGEAAAIFMTATPPG | IFMTATPPG/DRB1*0101(274.45) | IFMTATPPG/DRB1*0401(71.28) | | |
| EAIMAVGLYSILLSS | MAVGLVSIL/DRB1*0101(261.74) | | | |
| NIVSSVNMISRMLLN | IVSSVNMIS/DRB1*0401(191.44) | IVSSVNMIS/DRB1*0701(77.60) | SVNMISRML/DRB1*0101(23.68) | SVNMISRML/DRB1*1101(116.17) |
| SSMINGVWRLLTKPW | INGVWRLLT/DRB1*1101(33.13) | MINGVWRLL/DRB1*0101(122.71) | MINGVWRLL/DRB1*0701(467.57) | |
| PTVEAGRTLRVLSLV | AGRTLRVLS/DRB1*1101(266.93) | VEAGRTLRV/DRB1*0101(53.23) | VEAGRTLRV/DRB1*0701(121.00) | |
| GSLIGLTARATWATN | LIGLTARAT/DRB1*0101(3.01) | LIGLTARAT/DRB1*0401(373.96) | LIGLTARAT/DRB1*0701(41.55) | |
| YWVSGATGNIVSSVN | WVSGATGNI/DRB1*0101(344.23) | | | |
| LPAIIREAIKRKLRT | IREAIKRK/DRB1*0101(192.23) | IIREAIKRK/DRB1*1101(25.10) | IREAIKRKL/DRB1*0701(398.35) | |

FIG. 50-67

| peptide | core/HLA(affinity(nM)) | core/HLA(affinity(nM)) | core/HLA(affinity(nM)) |
|---|---|---|---|
| VGLVSLLGSSLLKND | LVSLLGSSL/DRB1*0101(3.09) | LVSLLGSSL/DRB1*0401(245.69) | LVSLLGSSL/DRB1*0701(88.49) | LVSLLGSSL/DRB1*1101(266.58) |
| EQYKFQPESPARLAS | FQPESPARL/DRB1*0101(7.32) | FQPESPARL/DRB1*0701(146.89) | YKFQPESPA/DRB1*0401(69.39) | YKFQPESPA/DRB1*1101(477.36) |
| GCWYGMEIRPINEKE | WYGMEIRPI/DRB1*0101(65.43) | WYGMEIRPI/DRB1*1101(275.55) | | |
| SILLSSLLKNDVPLA | LLKNDVPLA/DRB1*0401(237.95) | LSSLLKNDV/DRB1*0101(84.54) | LSSLLKNDV/DRB1*0701(325.39) | LSSLLKNDV/DRB1*1101(229.95) |
| WALCESITLATGPLS | ITLATGPLS/DRB1*0101(35.25) | ITLATGPLS/DRB1*0401(107.70) | ITLATGPLS/DRB1*0701(127.37) | |
| VYDSKFEKQLGQVML | FEKQLGQVM/DRB1*0101(36.66) | | | |
| RDFVEGVSGGAWVDL | FVEGVSGGA/DRB1*0101(175.84) | | | |
| SRTTWSIHATHQWMT | TWSIHATHQ/DRB1*0101(231.27) | WSIHATHQW/DRB1*0101(80.25) | WSIHATHQW/DRB1*1101(440.67) | |
| GLPIRYQTPAIRAEH | IRYQTPAIR/DRB1*0101(12.35) | IRYQTPAIR/DRB1*0401(63.96) | IRYQTPAIR/DRB1*0701(140.07) | IRYQTPAIR/DRB1*1101(89.26) |
| GKTRKYLPAIIREAI | TRKYLPAII/DRB1*0101(34.44) | TRKYLPAII/DRB1*0701(283.97) | TRKYLPAII/DRB1*1101(118.72) | YLPAIIREA/DRB1*0401(464.61) |
| DVDCWCNATSAWWTY | WCNATSAWV/DRB1*0101(226.45) | WCNATSAWV/DRB1*0701(314.65) | | |
| TEQYKFQADSPKKLA | FQADSPKKL/DRB1*0101(30.71) | FQADSPKKL/DRB1*0701(45.21) | YKFQADSPK/DRB1*0401(129.46) | YKFQADSPK/DRB1*1101(231.29) |
| TKPWDVIPMYTQMAM | VIPMYTQMA/DRB1*0101(58.77) | VIPMYTQMA/DRB1*0401(320.02) | | |
| VLALEPGKNPKHQT | LALEPGKNP/DRB1*0101(483.62) | | | |
| LTPMLRHSIENSSVN | MLRHSIENS/DRB1*0101(323.83) | MLRHSIENS/DRB1*0701(448.19) | | |
| AIGWSILASSLLRN | IVSILASSL/DRB1*0101(2.79) | IVSILASSL/DRB1*0401(57.94) | IVSILASSL/DRB1*0701(11.31) | IVSILASSL/DRB1*1101(98.07) |
| WALCEVITLATGPLS | ITLATGPLS/DRB1*0401(124.97) | VITLATGPL/DRB1*0101(28.33) | VITLATGPL/DRB1*0701(136.13) | |
| PIRYQTTAVKSEHTG | IRYQTTAVK/DRB1*0101(100.39) | IRYQTTAVK/DRB1*0401(144.94) | IRYQTTAVK/DRB1*0701(305.34) | RYQTTAVKS/DRB1*0701(135.48) |
| QGLVKRFSTGLLNGK | VKRFSTGLL/DRB1*0101(43.32) | VKRFSTGLL/DRB1*0401(285.03) | VKRFSTGLL/DRB1*0701(58.51) | VKRFSTGLL/DRB1*1101(133.69) |
| GSRAIWYMWLGARYL | IWYMWLGAR/DRB1*1101(53.97) | YMWLGARYL/DRB1*0101(9.77) | YMWLGARYL/DRB1*0701(233.27) | |
| GNIVSAVNMTSKMLL | IVSAVNMTS/DRB1*0101(20.87) | IVSAVNMTS/DRB1*0401(42.32) | IVSAVNMTS/DRB1*1101(85.47) | VNMTSKMLL/DRB1*0701(46.59) |

FIG. 50-68

| peptide | core/HLA(affinity(nM)) | core/HLA(affinity(nM)) | core/HLA(affinity(nM)) |
|---|---|---|---|
| GGAMYADDTAGWDTR | MYADDTAGW/DRB1*0401(228.68) | | |
| KGMPIRYQTTAVKSE | IRYQTTAVK/DRB1*0101(30.15) | IRYQTTAVK/DRB1*0401(43.51) | PIRYQTTAV/DRB1*0701(106.75) |
| LRFLAIPPTAGILKR | FLAIPPTAG/DRB1*0101(2.53) | FLAIPPTAG/DRB1*0401(22.92) | FLAIPPTAG/DRB1*1101(35.59) |
| PMSTYGWNLVRLQSG | PMSTYGWNL/DRB1*0701(482.05) | YGWNLVRLQ/DRB1*0101(144.17) | YGWNLVRLQ/DRB1*0401(336.43) |
| TYRGAKRMAILGDTA | YRGAKRMAI/DRB1*0101(236.76) | YRGAKRMAI/DRB1*1101(87.86) | |
| VSSVNMISRMLINRF | ISRMLINRF/DRB1*0401(238.37) | ISRMLINRF/DRB1*0701(50.87) | SVNMISRML/DRB1*0101(18.04) |
| TRHAVSRGSAKLQWI | AVSRGSAKL/DRB1*0101(71.31) | AVSRGSAKL/DRB1*0701(203.79) | |
| SYETKQTGSASMYN | YETKQTGSA/DRB1*0101(434.51) | | |
| NGCGLFGKGSLLTCA | FGKGSLLTC/DRB1*0701(336.04) | GLFGKGSLL/DRB1*0101(49.22) | LFGKGSLLT/DRB1*1101(253.44) |
| VTFKTAHAKKQEVW | FKTAHAKKQ/DRB1*0101(44.65) | FKTAHAKKQ/DRB1*0401(283.42) | FKTAHAKKQ/DRB1*0701(130.74) | FKTAHAKKQ/DRB1*1101(46.37) |
| SIAARGYISTRVEMG | ARGYISTRV/DRB1*0101(200.37) | YISTRVEMG/DRB1*0401(488.12) | YISTRVEMG/DRB1*0701(183.39) |
| TNMEAQLIRQMESEG | MEAQLIRQM/DRB1*0101(422.99) | | |
| CDHRLMSAAVKDERA | HRLMSAAVK/DRB1*0101(68.91) | | |
| AYRHAMEELPDTIET | YRHAMEELP/DRB1*0101(304.24) | | |
| GRGGWSYYCGGLKNV | YYCGGLKNV/DRB1*0101(455.30) | | |
| GKRVIQLSRKTFDSE | RVIQLSRKT/DRB1*1101(27.89) | | |
| SSLLRNDVPMAGPLV | LLRNDVPMA/DRB1*0101(29.28) | LLRNDVPMA/DRB1*0401(33.03) | |
| LMGLGKGWPIHKMDL | LGKGWPIHK/DRB1*0701(484.62) | MGLGKGWPI/DRB1*0101(139.50) | |
| KNGSWKLARASFIEV | WKLARASFI/DRB1*0101(4.20) | WKLARASFI/DRB1*0401(207.99) | WKLARASFI/DRB1*0701(8.58) | WKLARASFI/DRB1*1101(68.09) |
| TDISEMGANFRAERV | ISEMGANFR/DRB1*0101(326.89) | | |
| ATFTRLLSSTRVPN | FTRLLSST/DRB1*1101(33.72) | TRLLSSTRV/DRB1*0101(6.82) | TRLLSSTRV/DRB1*0401(275.64) | TRLLSSTRV/DRB1*0701(40.87) |

FIG. 50-69

| peptide | core/HLA(affinity(nM)) | core/HLA(affinity(nM)) | core/HLA(affinity(nM)) |
|---|---|---|---|
| LRETACLGKSYAQMW | TACLGKSYA/DRB1*0101(399.62) | TACLGKSYA/DRB1*1101(376.06) | |
| MYWISNGTGNIVASV | WISNGTGNI/DRB1*0101(77.52) | WISNGTGNI/DRB1*0401(376.95) | WISNGTGNI/DRB1*0701(117.06) |
| EDHWFSRENSYSGVE | FSRENSYSG/DRB1*0401(404.85) | | |
| RVILAGPMPVTVASA | VILAGPMPV/DRB1*0101(51.93) | | |
| CVTTIAKNKPTLDIE | CVTTIAKNK/DRB1*1101(373.42) | IAKNKPTLD/DRB1*0101(151.11) | IAKNKPTLD/DRB1*0701(201.17) |
| YKFQADSPKRLATAI | FQADSPKRL/DRB1*0101(28.24) | FQADSPKRL/DRB1*0401(262.37) | FQADSPKRL/DRB1*0701(78.36) | FQADSPKRL/DRB1*1101(320.40) |
| GPMVAGGLLLAAYM | GGLLLAAYV/DRB1*0101(44.75) | | |
| SYNTISKMLLNRFT | ISKMLLNRF/DRB1*0401(478.30) | ISKMLLNRF/DRB1*0701(193.54) | ISKMLLNRF/DRB1*1101(69.95) | SKMLLNRFT/DRB1*0101(43.33) |
| IGRARISQGAGWSLR | ISQGAGWSL/DRB1*0101(147.52) | ISQGAGWSL/DRB1*0701(183.87) | |
| MYWVSCGTGNIVSAV | WVSCGTGNI/DRB1*0101(161.69) | WVSCGTGNI/DRB1*0701(203.82) | |
| ENTTANISLTAIANQ | NISLTAIAN/DRB1*0101(110.21) | | |
| NVNMVIMDEAHFTDP | YNMVIMDEA/DRB1*0101(260.99) | | |
| ATVLMGLGKGWPIHK | LMGLGKGWP/DRB1*1101(477.22) | MGLGKGWPI/DRB1*0101(69.10) | MGLGKGWPI/DRB1*0701(300.03) |
| FCVKILNPYMPSVVE | CVKILNPYM/DRB1*0101(28.75) | CVKILNPYM/DRB1*0401(274.09) | CVKILNPYM/DRB1*0701(245.70) | CVKILNPYM/DRB1*1101(126.32) |
| HASHEWMTTEDMLAV | HEWMTTEDM/DRB1*0101(243.89) | WMTTEDMLA/DRB1*0401(199.51) | |
| NEGIMAIGVSILAS | IMAIGVSI/DRB1*0101(142.14) | | |
| GSQEGAMRTALTGAT | EGAMRTALT/DRB1*0101(298.20) | | |
| RVSTVQQLTKRFSLG | QQLTKRFSL/DRB1*0701(388.06) | TVQQLTKRF/DRB1*0101(301.45) | VQQLTKRFS/DRB1*1101(32.51) |
| GSQEGAMHSALAGAT | EGAMHSALA/DRB1*0101(323.76) | | |
| ARKTFVELMRRGDLP | FVELMRRGD/DRB1*1101(87.41) | | |
| EFFLMVLLIPEPEKQ | MVLLIPEPE/DRB1*0101(231.44) | | |

FIG. 50-70

| peptide | core/HLA(affinity(nM)) | core/HLA(affinity(nM)) | core/HLA(affinity(nM)) |
|---|---|---|---|
| FINMEAQLIRQMESE | FINMEAQLI/DRB1*0101(29.75) | | |
| RDLRLASNAICSAVP | LRLASNAIC/DRB1*0101(15.46) | LRLASNAIC/DRB1*0401(66.92) | LRLASNAIC/DRB1*0701(167.08) |
| EGVYRIKQQGILGKT | VYRIKQQGI/DRB1*0701(285.46) | YRIKQQGIL/DRB1*0101(40.70) | YRIKQQGIL/DRB1*1101(116.39) |
| AKMLLDNIYTPEGII | MLLDNIYTP/DRB1*0401(292.56) | | |
| VATIITPMLRHTIE | ITPMLRHTI/DRB1*0101(203.61) | ITPMLRHTI/DRB1*1101(77.50) | TIITPMLRH/DRB1*0701(230.14) |
| LVLCVTQVLLMRTTW | VTQVLLMRT/DRB1*0101(187.04) | VTQVLLMRT/DRB1*1101(223.71) | |
| YKTWAYHGSYEVKAT | WAYHGSYEV/DRB1*0101(63.35) | WAYHGSYEV/DRB1*0701(111.03) | |
| VMAFIAFLRFLAIPP | FIAFLRFLA/DRB1*1101(30.84) | FLRFLAIPP/DRB1*0101(32.70) | FLRFLAIPP/DRB1*0701(110.99) |
| SWPLNEGIMAIGVS | NEGIMAIGI/DRB1*0101(179.55) | | |
| FHTMWHVTRGAVLTY | MWHVTRGAV/DRB1*1101(17.01) | WHVTRGAVL/DRB1*0101(4.67) | WHVTRGAVL/DRB1*0701(8.42) |
| TIGKMFETTMRGAKR | FETTMRGAK/DRB1*1101(119.90) | IGKMFETTM/DRB1*0101(310.46) | KMFETTMRG/DRB1*0401(491.83) |
| GKVIGLYGNGWTTS | VIGLYGNGV/DRB1*0101(66.67) | | |
| GIFWDNVHTRTEQY | FVDNVHTR/DRB1*0401(219.37) | FVDNVHTR/DRB1*1101(419.41) | IFWDNVHT/DRB1*0101(271.14) |
| RTEQYQFQPESPARV | FQPESPARV/DRB1*0701(295.21) | YQFQPESPA/DRB1*0101(25.05) | YQFQPESPA/DRB1*0401(146.39) |
| VSGATGNIVSSVNMV | NIVSSVNMV/DRB1*0701(374.28) | | |
| AQTWMSAEGAWRQVE | WMSAEGAWR/DRB1*0101(22.49) | WMSAEGAWR/DRB1*0401(306.42) | |
| LSTLWEGSPGKFWNT | LWEGSPGKF/DRB1*0101(371.59) | | |
| PIRVPNYNLVMDEA | PIRVPNYNL/DRB1*0101(429.35) | | |
| TANVSLAAIANQAVV | LAAIANQAV/DRB1*0101(13.16) | LAAIANQAV/DRB1*0701(97.23) | VSLAAIANQ/DRB1*0401(164.99) |
| AFLRFLAIPPTAGIL | FLAIPPTAG/DRB1*0101(2.29) | FLAIPPTAG/DRB1*0401(14.59) | FLAIPPTAG/DRB1*0701(18.08) |
| GLPIRYQTTATKTEH | IRYQTTATK/DRB1*0101(43.58) | IRYQTTATK/DRB1*0401(37.02) | IRYQTTATK/DRB1*1101(61.38) | RYQTTATKT/DRB1*0701(194.25) |

FIG. 50-71

| peptide | core/HLA(affinity(nM)) | core/HLA(affinity(nM)) | core/HLA(affinity(nM)) |
|---|---|---|---|
| IVLLIPEPDRQRTPQ | IVLLIPEPD/DRB1*0101(226.55) | | |
| YRIMQRGLFGYSQIG | YRIMQRGLF/DRB1*0101(52.24) | YRIMQRGLF/DRB1*1101(79.92) | |
| EGKVVGLYGNGVTK | WGLYGNGV/DRB1*0101(37.60) | | |
| KCGGIFITNNVHTW | IFITNNVHT/DRB1*0101(352.22) | IFITNNVHT/DRB1*0401(353.54) | IFITNNVHT/DRB1*0701(265.56) |
| MVIQLAMTDTTPFGQ | LAMTDTTPF/DRB1*0101(379.10) | LAMTDTTPF/DRB1*0401(220.36) | LAMTDTTPF/DRB1*0701(191.59) |
| AWTLYAVATTFITPM | LYAVATTFI/DRB1*0101(29.92) | LYAVATTFI/DRB1*0701(28.65) | YAVATTFIT/DRB1*0401(125.00) |
| RGWPLHRVDLGVPLL | HRVDLGVPL/DRB1*0101(447.82) | HRVDLGVPL/DRB1*0701(454.47) | YAVATTFIT/DRB1*1101(348.92) |
| LGAIFQEEQGWTSAS | FQEEQGWTS/DRB1*0101(421.80) | | |
| AGRTLRVLSLVENWL | LRVLSLVEN/DRB1*0101(93.52) | TLRVLSLVE/DRB1*1101(358.64) | |
| RKKLRPRWLDARVYS | PRWLDARVY/DRB1*0101(321.25) | RKKLRPRWL/DRB1*1101(408.16) | |
| GSGIFVIDNVHTWTE | IFVIDNVHT/DRB1*0101(122.90) | IFVIDNVHT/DRB1*0401(148.68) | |
| TYGWNIVKLHSGKDV | WNIVKLHSG/DRB1*0101(160.98) | WNIVKLHSG/DRB1*0701(217.14) | WNIVKLHSG/DRB1*1101(74.10) |
| AVSRGSAKLRWIVER | AVSRGSAKL/DRB1*0101(425.45) | VSRGSAKLR/DRB1*1101(338.78) | |
| ILTILLKATLLAISG | LLKATLLAI/DRB1*0701(292.33) | LTILLKATL/DRB1*1101(96.16) | TILLKATLL/DRB1*0101(29.76) |
| RKNGKKVIQLSRKTF | KVIQLSRKT/DRB1*1101(31.61) | | |
| YAVATTVLTPMLRHS | ATTVLTPML/DRB1*0101(83.94) | ATTVLTPML/DRB1*0701(121.44) | TVLTPMLRH/DRB1*1101(193.29) YAVATTVLT/DRB1*0401(436.33) |
| PERVILAGPIPVTPS | VILAGPIPV/DRB1*0101(59.17) | VILAGPIPV/DRB1*0701(499.51) | |
| GCVTTMAQGKPTLDI | TTMAQGKPT/DRB1*0101(159.93) | | |
| IKRKLRTLILAPTRV | IKRKLRTLI/DRB1*1101(14.93) | LRTLILAPT/DRB1*0101(4.13) | LRTLILAPT/DRB1*0401(110.73) TLILAPTRV/DRB1*0701(40.01) |
| CASQILLMRTTWAFC | ILLMRTTWA/DRB1*0101(31.75) | ILLMRTTWA/DRB1*0401(287.33) | LLMRTTWAF/DRB1*0701(447.50) SQILLMRTT/DRB1*1101(154.71) |
| DHRLMSAAVKDERAV | HRLMSAAVK/DRB1*0101(130.66) | | |

FIG. 50-72

| peptide | core/HLA(affinity(nM)) | core/HLA(affinity(nM)) | core/HLA(affinity(nM)) |
|---|---|---|---|
| GNDIANCLRKSGKKV | IANCLRKSG/DRB1*1101(125.35) | | |
| VCGVRSTRMENLLW | VRSTRMEN/DRB1*1101(413.93) | | |
| CSHHFHQLIMKDGRV | CSHHFHQLI/DRB1*0701(421.48) | FHQLIMKDG/DRB1*0101(97.74) | FHQLIMKDG/DRB1*1101(151.29) |
| AYAQMWSLMYFHRRD | MWSLMYFHR/DRB1*1101(36.83) | YAQMWSLMY/DRB1*0101(24.99) | YAQMWSLMY/DRB1*0401(234.37) | YAQMWSLMY/DRB1*0701(238.67) |
| GIRSTRLENYMWKQ | IRSTRLEN/DRB1*1101(368.89) | | |
| LGQIMLLILCTGQLL | LLILCTGQL/DRB1*0101(171.31) | | |
| SRDFVEGVSGGTWVD | FVEGVSGGT/DRB1*0101(282.08) | | |
| EGEGLHRLGYILRDV | GLHRLGYIL/DRB1*0101(55.42) | LHRLGYILR/DRB1*0701(373.48) | LHRLGYILR/DRB1*1101(96.94) |
| VQVLAIEPGKNPKHV | LAIEPGKNP/DRB1*0101(321.38) | | |
| VDCWCNATSAWVTYG | WCNATSAWV/DRB1*0101(167.63) | WCNATSAWV/DRB1*0701(346.01) | |
| DGVFHTMWHVTRGAV | FHTMWHVTR/DRB1*0101(17.34) | FHTMWHVTR/DRB1*1101(20.92) | MWHVTRGAV/DRB1*0701(100.05) |
| YGLNTFTNMEVQLIR | FTNMEVQLI/DRB1*0101(24.03) | FTNMEVQLI/DRB1*0401(86.61) | FTNMEVQLI/DRB1*0701(69.77) |
| GEKKLRPKWLDART | KKKLRPKWL/DRB1*1101(489.93) | | |
| MTGPLVAGGLLTVCY | PLVAGGLLT/DRB1*0101(310.11) | | |
| SYEVKATGSASSMIN | VKATGSASS/DRB1*0101(75.64) | VKATGSASS/DRB1*0401(207.24) | VKATGSASS/DRB1*0701(149.32) |
| WCGSLIGLSSRATWA | LIGLSSRAT/DRB1*0101(2.49) | LIGLSSRAT/DRB1*0401(123.17) | LIGLSSRAT/DRB1*0701(170.75) | LIGLSSRAT/DRB1*1101(25.31) |
| LCAVQLLLMRTSWAL | LLLMRTSWA/DRB1*0101(11.21) | LLMRTSWA/DRB1*0401(118.61) | LLMRTSWAL/DRB1*0701(158.56) | VQLLLMRTS/DRB1*1101(67.26) |
| GYISTRVEMGEAAAI | YISTRVEMG/DRB1*0101(123.95) | YISTRVEMG/DRB1*0401(308.32) | YISTRVEMG/DRB1*0701(316.62) |
| LRNDVPMAGPLVAGG | DVPMAGPLV/DRB1*0101(27.94) | | |
| WPISKVDIGVPLLAM | SKVDIGVPL/DRB1*0101(83.11) | SKVDIGVPL/DRB1*0701(205.49) | |
| ERELHKLGKCGSCVY | LHKLGKCGS/DRB1*0101(428.82) | LHKLGKCGS/DRB1*1101(206.02) | |

FIG. 50-73

| peptide | core/HLA(affinity(nM)) | core/HLA(affinity(nM)) | core/HLA(affinity(nM)) |
|---|---|---|---|
| MYWSGYSGNIVSSY | WVSGYSGNI/DRB1*0101(75.80) | WVSGYSGNI/DRB1*0701(109.05) | |
| HTIENTTANISLAAI | ENTTANISL/DRB1*0701(235.48) | IENTTANISL/DRB1*0101(333.26) | |
| MWLGARYLEFEALGF | YLEFEALGF/DRB1*0701(284.35) | YLEFEALGF/DRB1*0701(463.75) | |
| WTEQYKFQADSPSKL | FQADSPSKL/DRB1*0701(65.54) | YKFQADSPS/DRB1*0101(40.65) | YKFQADSPS/DRB1*0401(50.29) |
| TYSLNTFTNMEVQLI | FTNMEVQLI/DRB1*0101(32.86) | FTNMEVQLI/DRB1*0401(80.51) | FTNMEVQLI/DRB1*0701(49.79) |
| GVPLLAMGCYSQVNP | LLAMGCYSQ/DRB1*0101(113.03) | | |
| TIENTTANISLAAIA | ENTTANISL/DRB1*0701(379.69) | NTTANISLA/DRB1*0101(222.55) | |
| PLNEAVMAVGVVSIL | NEAVMAVGV/DRB1*0101(270.57) | | |
| GWSYYCAGLKKVTEV | YYCAGLKKV/DRB1*0101(31.63) | YYCAGLKKV/DRB1*0701(174.76) | YYCAGLKKV/DRB1*1101(21.84) |
| KGPLRMVLAFITFLR | LRMVLAFIT/DRB1*0101(17.09) | LRMVLAFIT/DRB1*0701(71.63) | LRMVLAFIT/DRB1*1101(131.19) |
| YQTTAIKAEHTGREI | TTAIKAEHT/DRB1*0101(395.39) | | |
| FCEVLTLATGPILTL | VLTLATGPI/DRB1*0101(6.96) | VLTLATGPI/DRB1*0401(203.02) | VLTLATGPI/DRB1*0701(27.41) |
| KRMAILGETAWDFGS | RMAILGETA/DRB1*0101(75.57) | | |
| CLRKNGKKVIQLSRK | CLRKNGKKV/DRB1*1101(157.89) | | |
| SGQVVTYSLNTFTNM | VTYSLNTFT/DRB1*0101(98.34) | VTYSLNTFT/DRB1*0401(213.06) | VTYSLNTFT/DRB1*0701(114.29) |
| AILMGLDKGWPLHRM | LMGLDKGWP/DRB1*1101(426.41) | MGLDKGWPL/DRB1*0101(72.05) | MGLDKGWPL/DRB1*0701(170.54) |
| QWMTTEDMLSVWNRV | WMTTEDMLS/DRB1*0101(295.86) | WMTTEDMLS/DRB1*0401(312.57) | |
| SSIAARGYISTRVEM | ARGYISTRV/DRB1*0101(210.42) | ARGYISTRV/DRB1*0701(348.77) | |
| SLTLATGPVLTLWEG | LTLATGPVL/DRB1*0101(20.29) | LTLATGPVL/DRB1*0701(179.67) | |
| TYGWNLVRLQSGVDV | LVRLQSGVD/DRB1*0701(192.35) | VRLQSGVDV/DRB1*0101(35.72) | WNLVRLQSG/DRB1*1101(146.17) | YGWNLVRLQ/DRB1*0401(388.28) |
| IKRGLRTLILAPTRV | LRTLILAPT/DRB1*0101(5.50) | LRTLILAPT/DRB1*0401(223.98) | LRTLILAPT/DRB1*1101(34.36) | TLILAPTRV/DRB1*0701(59.83) |

FIG. 50-74

| peptide | core/HLA(affinity(nM)) | core/HLA(affinity(nM)) | core/HLA(affinity(nM)) |
|---|---|---|---|
| WQQVPFCSHHFHQLI | FCSHHFHQL/DRB1*0101(249.37) | FCSHHFHQL/DRB1*0701(52.43) | |
| VASEMAEALKGMPIR | AEALKGMPI/DRB1*0101(196.20) | | |
| IVLGSQEGAMRIALT | LGSQEGAMR/DRB1*0101(109.18) | | |
| NGWTKSGTYYSAIT | VTKSGTYYS/DRB1*0701(330.37) | WTKSGTYY/DRB1*0101(434.56) | |
| MPVTVASAAQRRGRI | TVASAAQRR/DRB1*1101(443.93) | VTVASAAQR/DRB1*0101(248.06) | |
| RGLFGYSQIGAGVYK | GYSQIGAGV/DRB1*0101(53.73) | YSQIGAGVY/DRB1*0701(446.28) | |
| LMGLDKGWPISKMDI | LDKGWPISK/DRB1*0101(370.21) | | |
| NWQQVPFCSHHFHQL | FCSHHFHQL/DRB1*0701(122.60) | | |
| ESRKTFVELMKRGDL | FVELMKRGD/DRB1*1101(147.13) | | |
| QWTYSLNTFTNMEV | TYSLNTFTN/DRB1*0101(91.74) | VTYSLNTFT/DRB1*0401(151.55) | YSLNTFTNM/DRB1*0701(102.72) |
| KMLLDNIYTPEGIIP | MLLDNIYTP/DRB1*0401(416.10) | | |
| RIKQRGILGRSQVGV | IKQRGILGR/DRB1*1101(264.95) | QRGILGRSQ/DRB1*0101(222.07) | |
| NENDQYIYMGQPLNN | YIYMGQPLN/DRB1*0101(61.53) | | |
| VRTNAAIGAVFVDEN | VRTNAAIGA/DRB1*0101(142.60) | | |
| MLKRVRNRVSTVQQL | LKRVRNRVS/DRB1*0101(76.13) | LKRVRNRVS/DRB1*1101(16.14) | NRVSTVQQL/DRB1*0701(75.87) |
| RSVALVPHVGMGLET | LVPHVGMGL/DRB1*0101(75.51) | | |
| MMRHTIENTANISL | HTIENTAN/DRB1*0401(330.60) | TIENTANI/DRB1*0701(229.25) | |
| TLWSNGVLESQMLIP | NGVLESQML/DRB1*0101(209.70) | | |
| WPMVTQLAMTDTTP | MVTQLAMTD/DRB1*0101(62.29) | | |
| GERKKLRPRWLDART | RKKLRPRWL/DRB1*1101(478.85) | | |
| EIVDLMCHATFTMRL | CHATFTMRL/DRB1*0701(100.70) | LMCHATFTM/DRB1*0101(243.34) | |

FIG. 50-75

| peptide | core/HLA(affinity(nM)) | core/HLA(affinity(nM)) | core/HLA(affinity(nM)) |
|---|---|---|---|
| KLVMAFIAFLRFLAI | FIAFLRFLA/DRB1*1101(40.23) | VMAFIAFLR/DRB1*0101(50.79) | VMAFIAFLR/DRB1*0701(142.65) |
| SGIFVIDNVHTWTEQ | IFVIDNVHT/DRB1*0101(129.53) | IFVIDNVHT/DRB1*0401(157.62) | |
| NTTIAYSMANIFRGS | AYSMANIFR/DRB1*0401(329.73) | AYSMANIFR/DRB1*1101(426.84) | IAYSMANIF/DRB1*0101(39.82) | IAYSMANIF/DRB1*0701(106.76) |
| GSRAIWYMWLGARFL | IWYMWLGAR/DRB1*1101(79.35) | YMWLGARFL/DRB1*0101(15.54) | YMWLGARFL/DRB1*0701(333.18) |
| GQWTYGLNTFTNME | VTYGLNTFT/DRB1*0101(111.14) | VTYGLNTFT/DRB1*0401(389.43) | |
| ERRREKRSVALAPHV | RSVALAPHV/DRB1*0701(358.05) | | |
| LRTTTASGKLIHEWC | TTTASGKLI/DRB1*0701(290.29) | | |
| VGIHMENVFHTMWHV | IHMENVFHT/DRB1*0101(92.44) | IHMENVFHT/DRB1*0401(208.00) | NVFHTMWHV/DRB1*0701(229.13) |
| LTLWEGNPGRFWNIT | WEGNPGRFW/DRB1*0101(476.31) | | |
| REKVQAIDGEFRLRG | VQAIDGEFR/DRB1*0101(455.22) | | |
| AVQLLLMRTSWALCE | LLMRTSWA/DRB1*0101(15.38) | LLMRTSWA/DRB1*0401(192.01) | LLMRTSWAL/DRB1*0701(215.96) | VQLLLMRTS/DRB1*1101(94.25) |
| NMCTLMAMDLGEFCE | MCTLMAMDL/DRB1*0101(257.25) | | |
| KRGDLPVWLAHKVAS | VWLAHKVAS/DRB1*1101(225.52) | | |
| DIANCLRKSGKKVIQ | CLRKSGKKV/DRB1*1101(64.52) | | |
| MRCVGIGSRDFVEGV | CVGIGSRDF/DRB1*0101(343.86) | | |
| VEAGRTLRVLNLVEN | GRTLRVLNL/DRB1*0101(200.42) | | |
| VALAPHVGMGLETRT | LAPHVGMGL/DRB1*0101(412.36) | | |
| PLALREFKEFAAGRR | FKEFAAGRR/DRB1*0101(274.64) | FKEFAAGRR/DRB1*0101(380.51) | FKEFAAGRR/DRB1*0701(342.19) |
| SGIFITNEVHTWTEQ | FITNEVHTW/DRB1*0101(278.53) | | |
| SFNMLKRARNRVSTP | FNMLKRARN/DRB1*0101(14.89) | FNMLKRARN/DRB1*0401(233.30) | FNMLKRARN/DRB1*0701(73.48) | FNMLKRARN/DRB1*1101(4.53) |
| WKLLTKPWDVLPMV | KLLTKPWDV/DRB1*0701(365.77) | WKLLTKPW/DRB1*0101(465.90) | WKLLTKPW/DRB1*1101(463.06) | |

FIG. 50-76

| peptide | core/HLA(affinity(nM)) | core/HLA(affinity(nM)) | core/HLA(affinity(nM)) | core/HLA(affinity(nM)) |
|---|---|---|---|---|
| TDWDYVTTDISEMG | WDYVVTTDI/DRB1*0701(205.94) | | | |
| GIVAIDLDPISYDAK | VAIDLDPIS/DRB1*0401(268.84) | | | |
| HPYKTWAYHGSYEVK | WAYHGSYEV/DRB1*0101(185.82) | WAYHGSYEV/DRB1*0701(149.60) | | |
| EDIDCWCNLTSTWVT | WCNLTSTWV/DRB1*0101(302.93) | WCNLTSTWV/DRB1*0701(441.73) | | |
| GCGLFGKGGVTCAK | FGKGGVTC/DRB1*0101(134.69) | | | |
| QPESPARVASAILNA | PARVASAIL/DRB1*0101(339.70) | | | |
| GEFGRAKGSRAIWYM | FGRAKGSRA/DRB1*0101(12.76) | FGRAKGSRA/DRB1*0401(394.08) | FGRAKGSRA/DRB1*0701(152.38) | FGRAKGSRA/DRB1*1101(100.85) |
| VLGSQEGAMHSALAG | LGSQEGAMH/DRB1*0101(403.54) | | | |
| TDGIYRILQRGLLGK | YRILQRGLL/DRB1*0101(15.19) | YRILQRGLL/DRB1*0701(139.79) | YRILQRGLL/DRB1*1101(8.65) | |
| GYISTRVGMGEAAAI | YISTRVGMG/DRB1*0101(155.50) | YISTRVGMG/DRB1*0701(336.56) | YISTRVGMG/DRB1*1101(324.08) | |
| DARYYSDPLALKEFK | VYSDPLALK/DRB1*0101(456.05) | | | |
| IENTTANISLTAIAN | NISLTAIAN/DRB1*0101(157.33) | TANISLTAI/DRB1*0701(474.74) | | |
| KLRPRWLDARVYSDP | PRWLDARVY/DRB1*0101(400.33) | | | |
| GILGRSQVGVGIHME | GRSQVGVGI/DRB1*0101(211.49) | | | |
| DLMYADDTAGWDTRI | MYADDTAGW/DRB1*0401(352.53) | | | |
| EALKGMPIRYQTPAI | LKGMPIRYQ/DRB1*0101(88.67) | LKGMPIRYQ/DRB1*0401(475.95) | LKGMPIRYQ/DRB1*1101(278.37) | |
| SELLSGRGPLKLFMA | LLSGRGPLK/DRB1*0101(39.91) | LSGRGPLKL/DRB1*0701(229.34) | LSGRGPLKL/DRB1*1101(418.42) | |
| FQADSPKRLATAIAG | FQADSPKRL/DRB1*0101(256.67) | | | |
| IANCLRKNGKKVIQL | CLRKNGKK/DRB1*1101(89.02) | | | |
| QGPMKLVMAFIAFLR | PMKLVMAFI/DRB1*0101(58.65) | VMAFIAFLR/DRB1*0701(261.91) | VMAFIAFLR/DRB1*1101(319.70) | |
| SIFKLTYQNKVVRVQ | FKLTYQNKV/DRB1*0101(26.05) | FKLTYQNKV/DRB1*0401(315.22) | FKLTYQNKV/DRB1*0701(17.35) | FKLTYQNKV/DRB1*1101(49.09) |

FIG. 50-77

| peptide | core/HLA(affinity(nM)) | core/HLA(affinity(nM)) | core/HLA(affinity(nM)) |
|---|---|---|---|
| ILLSSLLKNDVPLAG | LLKNDVPLA/DRB1*0101(69.80) | LLKNDVPLA/DRB1*0401(138.18) | LSSLLKNDV/DRB1*0701(411.51) | LSSLLKNDV/DRB1*1101(295.46) |
| AMHSALAGATEIQMS | SALAGATEI/DRB1*0101(68.76) | | |
| RVVASEMAEALKGMP | VASEMAEAL/DRB1*0101(245.91) | | |
| TYGWNLVKLMSGKDV | VKLMSGKDV/DRB1*0101(27.91) | VKLMSGKDV/DRB1*0701(244.19) | WNLVKLMSG/DRB1*1101(79.45) | YGWNLVKLM/DRB1*0401(373.87) |
| CGLFGKGGIVTCAMF | FGKGGIVTC/DRB1*0101(149.50) | | |
| HRRDLRLASNAICSA | DLRLASNAI/DRB1*0101(7.09) | DLRLASNAI/DRB1*1101(198.00) | LRLASNAIC/DRB1*0401(32.01) | LRLASNAIC/DRB1*0701(75.03) |
| QEGAMHTALTGATEI | MHTALTGAT/DRB1*0101(316.42) | | |
| LLAMGCYSQVNPTTL | CYSQVNPTT/DRB1*0401(200.02) | YSQVNPTTL/DRB1*0101(58.59) | YSQVNPTTL/DRB1*0701(64.30) |
| EALTLATGPVSTLWE | LTLATGPVS/DRB1*0101(22.32) | LTLATGPVS/DRB1*0401(329.14) | LTLATGPVS/DRB1*0701(366.56) |
| VSRGTAKLRWIVERG | GTAKLRWIV/DRB1*1101(428.55) | | |
| GKELKCGSGIFVTDN | LKCGSGIFV/DRB1*0101(206.00) | | |
| GVCGIRSTRLENVM | CGIRSTRL/DRB1*0701(220.11) | IRSTRLEN/DRB1*1101(171.80) | |
| SASSMVNGVVRLLTK | SMVNGVVRL/DRB1*0101(112.17) | SMVNGVVRL/DRB1*0701(401.61) | VNGVVRLLT/DRB1*1101(287.79) |
| PSLRTTTASGKLIHE | LRTTTASGK/DRB1*0701(90.36) | TTTASGKLI/DRB1*0101(172.65) | |
| DLPVWLAHKVASEGF | VWLAHKVAS/DRB1*1101(249.89) | WLAHKVASE/DRB1*0101(244.54) | WLAHKVASE/DRB1*0701(443.95) |
| LVHKQWFLDLPLPWT | QWFLDLPLP/DRB1*0101(278.59) | | |
| WQQVPFCSHHFHELV | FCSHHFHEL/DRB1*0701(196.44) | | |
| HPGSGKTRKYLPAIV | TRKYLPAIV/DRB1*0101(427.01) | | |
| LMYFHRRDLRLASNA | FHRRDLRLA/DRB1*1101(10.73) | YFHRRDLRL/DRB1*0101(27.65) | YFHRRDLRL/DRB1*0701(61.02) |
| HAVSRGTAKLRWIVE | AVSRGTAKL/DRB1*0101(287.76) | AVSRGTAKL/DRB1*0701(333.32) | VSRGTAKLR/DRB1*1101(156.03) |
| TFKVPHAKKQDVVYL | TFKVPHAKK/DRB1*1101(292.55) | | |

FIG. 50-78

| peptide | core/HLA(affinity(nM)) | core/HLA(affinity(nM)) | core/HLA(affinity(nM)) |
|---|---|---|---|
| YGWNLVKLHSGVDVF | VKLHSGVDV/DRB1*0101(57.65) | VKLHSGVDV/DRB1*0701(112.06) | WNLVKLHSG/DRB1*1101(146.56) |
| WQEVPFCSHHFHQLI | FCSHHFHQL/DRB1*0101(300.82) | FCSHHFHQL/DRB1*0701(65.53) | |
| TFVELMKRGDLPVWL | FVELMKRGD/DRB1*1101(321.55) | | |
| HAVSRGTAKLQWFVE | AVSRGTAKL/DRB1*1101(412.48) | VSRGTAKLQ/DRB1*0101(319.88) | |
| QMWQLMYFHRRDLRL | WQLMYFHRR/DRB1*0101(44.77) | YFHRRDLRL/DRB1*0701(47.32) | YFHRRDLRL/DRB1*1101(14.19) |
| NIYTPEGIIPTLFEP | YTPEGIIPT/DRB1*0101(324.65) | | |
| LAGPMVAGGLLLAAY | PMVAGGLLL/DRB1*0101(94.97) | | |
| GLVSLLGSSLLKNDV | LVSLLGSSL/DRB1*0101(4.59) | LVSLLGSSL/DRB1*0401(398.04) | LVSLLGSSL/DRB1*0701(127.31) | LVSLLGSSL/DRB1*1101(368.24) |
| RKKLRPRWLDARIYS | PRWLDARIY/DRB1*0101(348.22) | RKKLRPRWL/DRB1*1101(343.74) | |
| PNPTIEAGRTLRVLS | IEAGRTLRV/DRB1*0101(42.41) | IEAGRTLRV/DRB1*0101(64.13) | IEAGRTLRV/DRB1*1101(472.67) |
| ATTFITPMLRHSIEN | FITPMLRHS/DRB1*0101(111.53) | FITPMLRHS/DRB1*1101(44.15) | TFITPMLRH/DRB1*0701(284.96) |
| AIGCYSQVNPITLTA | CYSQVNPIT/DRB1*0101(17.55) | CYSQVNPIT/DRB1*0401(123.96) | YSQVNPITL/DRB1*0701(34.75) |
| GLLIACYVITGRSAD | CYVITGRSA/DRB1*0101(108.65) | CYVITGRSA/DRB1*0701(340.74) | CYVITGRSA/DRB1*1101(116.87) |
| ILLSSLLRNDVPLAG | LLRNDVPLA/DRB1*0101(65.51) | LLRNDVPLA/DRB1*0401(87.71) | LSSLLRNDV/DRB1*0701(372.47) | LSSLLRNDV/DRB1*1101(204.49) |
| WIPTSRTTWSIHATH | SRTTWSIHA/DRB1*0701(436.67) | | |
| SVNMVSRLLLNRFTM | MVSRLLLNR/DRB1*1101(31.18) | SRLLLNRFT/DRB1*0101(26.42) | VSRLLLNRF/DRB1*0701(145.23) |
| LVTFKTAHAKKQEVV | FKTAHAKKQ/DRB1*0101(12.43) | FKTAHAKKQ/DRB1*0701(52.80) | FKTAHAKKQ/DRB1*1101(19.62) | LVTFKTAHA/DRB1*0401(45.88) |
| GTGNIVSAVNMTSKM | IVSAVNMTS/DRB1*0101(35.62) | IVSAVNMTS/DRB1*0401(24.86) | IVSAVNMTS/DRB1*0701(136.22) | IVSAVNMTS/DRB1*1101(168.97) |
| VEDYGFGIFTNIWM | FGIFTNIW/DRB1*0401(450.49) | FGIFTNIW/DRB1*0701(248.33) | GFGIFTNI/DRB1*0101(466.18) | |
| YFHRRDLRLAANAIC | DLRLAANAI/DRB1*0101(15.30) | LRLAANAIC/DRB1*0401(208.11) | YFHRRDLRL/DRB1*0701(68.74) | YFHRRDLRL/DRB1*1101(21.73) |
| MVLAFITFLRVLSIP | FITFLRVLS/DRB1*0101(34.10) | FITFLRVLS/DRB1*0401(255.97) | FITFLRVLS/DRB1*0701(27.56) | ITFLRVLSI/DRB1*0701(31.46) |

FIG. 50-79

| peptide | core/HLA(affinity(nM)) | core/HLA(affinity(nM)) | core/HLA(affinity(nM)) |
|---|---|---|---|
| TRGPSLRTTTASGKL | LRTTTASGKL/DRB1*0701(264.08) | | |
| NDWDFWTTDISEMG | WDFWTTDI/DRB1*0701(306.76) | | |
| PMSTYGWNLVKLMSG | PMSTYGWNL/DRB1*0701(361.35) | YGWNLVKLM/DRB1*0101(75.91) | YGWNLVKLM/DRB1*0401(290.82) | YGWNLVKLM/DRB1*1101(150.19) |
| KVRSNAALGAVFTDE | VRSNAALGA/DRB1*0101(38.75) | VRSNAALGA/DRB1*0401(429.95) | VRSNAALGA/DRB1*0701(485.07) | |
| LLLAAYMTGRSADL | AYYMTGRSA/DRB1*0101(30.51) | AYYMTGRSA/DRB1*1101(113.01) | VMTGRSADL/DRB1*0701(246.12) | |
| GLNTFTNMEAQLIRQ | FTNMEAQLI/DRB1*0101(5.51) | FTNMEAQLI/DRB1*0401(38.15) | FTNMEAQLI/DRB1*0701(53.50) | FTNMEAQLI/DRB1*1101(286.87) |
| SKELKCGNGIFVADN | LKCGNGIFV/DRB1*0101(217.85) | | | |
| LGEDGCWYGMEIRPV | WYGMEIRPV/DRB1*0101(217.74) | | | |
| AQKRAAGIMKNPTV | AGIMKNPTV/DRB1*0101(477.62) | | | |
| EQYKFQADSPKRLAT | FQADSPKRL/DRB1*0101(24.39) | FQADSPKRL/DRB1*0401(149.28) | FQADSPKRL/DRB1*0701(54.26) | YKFQADSPK/DRB1*1101(278.50) |
| HATFTMRLLSPVRVP | FTMRLLSPV/DRB1*1101(28.00) | MRLLSPVRV/DRB1*0101(5.69) | MRLLSPVRV/DRB1*0401(441.22) | MRLLSPVRV/DRB1*0701(57.40) |
| LTDGIYRILQRGLLG | YRILQRGLL/DRB1*0101(24.26) | YRILQRGLL/DRB1*0701(129.63) | YRILQRGLL/DRB1*1101(11.20) | |
| CLRKNGKRVIQLSRK | LRKNGKRVI/DRB1*1101(135.29) | | | |
| VNGVWKLLTKPWDVW | KLLTKPWDV/DRB1*0701(304.96) | VWKLLTKPW/DRB1*0101(213.41) | VWKLLTKPW/DRB1*1101(89.31) | |
| SRITWSIHATHEWMT | WSIHATHEW/DRB1*0701(232.51) | | | |
| LPDTIETLMLLTLIA | TIETLMLLT/DRB1*0101(369.61) | | | |
| RETACLGKAYAQMWS | ACLGKAYAQ/DRB1*0101(177.17) | TACLGKAYA/DRB1*1101(487.56) | | |
| RELKCGSGIFVNEV | LKCGSGIFV/DRB1*0101(350.10) | | | |
| AVATTFITPMMRHTI | FITPMMRHT/DRB1*0101(129.24) | TFITPMMRH/DRB1*0701(152.96) | TFITPMMRH/DRB1*1101(72.89) | |
| VIPMVTQMAMTDTTP | VIPMVTQMA/DRB1*0101(72.97) | | | |
| SAWTLYAVATTIIIP | TLYAVATTI/DRB1*0101(20.42) | TLYAVATTI/DRB1*0701(21.15) | YAVATTIIT/DRB1*0401(148.24) | YAVATTIIT/DRB1*1101(429.88) |

FIG. 50-80

| peptide | core/HLA(affinity(nM)) | core/HLA(affinity(nM)) | core/HLA(affinity(nM)) | core/HLA(affinity(nM)) |
|---|---|---|---|---|
| PMLRHSIENSSVNVS | LRHSIENSS/DRB1*0101(423.85) | LRHSIENSS/DRB1*0701(364.77) | | |
| GIMAVGMVSILASAL | MVSILASAL/DRB1*0101(25.55) | MVSILASAL/DRB1*0701(291.42) | | |
| NRGPSLRTTIASGKL | LRTTIASGK/DRB1*0701(265.81) | | | |
| DTIETLMLTILLATV | TLMLTILLA/DRB1*0101(350.47) | | | |
| LVHRQWFLDLPLPWL | QWFLDLPLP/DRB1*0101(248.54) | | | |
| AGPLVAGGLLIACYV | PLVAGGLLI/DRB1*0101(173.76) | | | |
| YKFQPESPARLATAI | FQPESPARL/DRB1*0101(12.06) | FQPESPARL/DRB1*0401(201.71) | FQPESPARL/DRB1*0701(330.91) | |
| QQVPFCSHHFHELVM | FCSHHFHEL/DRB1*0101(445.33) | FCSHHFHEL/DRB1*0701(125.16) | | |
| TANISLTAIANQATV | ISLTAIANQ/DRB1*0401(80.16) | LTAIANQAT/DRB1*0701(215.45) | SLTAIANQA/DRB1*0101(18.25) | |
| SLNTFTNMEAQLIRQ | FTNMEAQLI/DRB1*0101(5.44) | FTNMEAQLI/DRB1*0401(38.22) | FTNMEAQLI/DRB1*0701(51.23) | FTNMEAQLI/DRB1*1101(297.63) |
| LRPRWLDARVYSDPL | WLDARVYSD/DRB1*0101(357.96) | WLDARVYSD/DRB1*0101(288.39) | | |
| TTEDMLSVWNRYWIR | DMLSVWNRV/DRB1*0101(354.92) | | | |
| DMGYWIESRLNDTWK | YWIESRLND/DRB1*1101(343.46) | | | |
| MINGVVRLLTKPWDV | INGVVRLLT/DRB1*1101(31.56) | RLLTKPWDV/DRB1*0701(419.67) | VVRLLTKPW/DRB1*0101(176.42) | |
| KRSVALTPHSGMGLD | SVALTPHSG/DRB1*0101(114.34) | VALTPHSGM/DRB1*0701(318.35) | | |
| KFQADSPKRLATAIA | FQADSPKRL/DRB1*0101(70.77) | FQADSPKRL/DRB1*0701(163.93) | | |
| ANISLAAIANQATVL | ISLAAIANQ/DRB1*0401(86.91) | LAAIANQAT/DRB1*0701(219.25) | SLAAIANQA/DRB1*0101(10.65) | |
| AIDGEYRLKGEARKT | YRLKGEARK/DRB1*1101(498.43) | | | |
| MFKKNLTIMDLHPG | LTIMDLHPG/DRB1*0101(241.42) | MFKKNLTI/DRB1*0701(381.50) | MFKKNLTI/DRB1*1101(285.75) | |
| VNMTSKMLLNRFTMA | SKMLLNRFT/DRB1*0101(31.96) | SKMLLNRFT/DRB1*1101(67.37) | TSKMLLNRF/DRB1*0701(308.19) | |
| VTTMAQGKPTLDIEL | MAQGKPTLD/DRB1*0101(149.59) | | | |

FIG. 50-81

| peptide | core/HLA(affinity(nM)) | core/HLA(affinity(nM)) | core/HLA(affinity(nM)) | core/HLA(affinity(nM)) |
|---|---|---|---|---|
| LMRTSWAFCEALTLA | WAFCEALTL/DRB1*0101(71.54) | WAFCEALTL/DRB1*0701(151.42) | | |
| MGYWIESALNDTWKM | YWIESALND/DRB1*0101(125.35) | YWIESALND/DRB1*0401(271.21) | | |
| VLCVTQVLLMRTTWA | VLLMRTTWA/DRB1*0101(72.03) | VTQVLLMRT/DRB1*1101(148.65) | | |
| VAAEMEEALRGLPIR | EEALRGLPI/DRB1*0101(423.52) | | | |
| RHAVSRGSAKLQWIV | AVSRGSAKL/DRB1*0701(242.68) | AVSRGSAKL/DRB1*1101(271.53) | VSRGSAKLQ/DRB1*0101(73.81) | |
| DVDLRPASAWTLYAV | LRPASAWTL/DRB1*0101(17.80) | LRPASAWTL/DRB1*0701(68.36) | | |
| HEMYWVSCGTGNIVS | WVSCGTGNI/DRB1*0701(149.97) | YWVSCGTGN/DRB1*0101(131.95) | | |
| GWPIHRVDLGVPLLA | HRVDLGVPL/DRB1*0101(97.63) | HRVDLGVPL/DRB1*0701(280.34) | | |
| FTRKVRSNAAIGAVF | FTRKVRSNA/DRB1*1101(87.60) | VRSNAAIGA/DRB1*0101(10.94) | VRSNAAIGA/DRB1*0401(86.40) | VRSNAAIGA/DRB1*0701(81.16) |
| EAHFTDPSSIAARGY | FTDPSSIAA/DRB1*0101(491.21) | | | |
| VCGVRSTTRLENLLW | CGVRSTTRL/DRB1*0701(302.19) | VRSTTRLEN/DRB1*1101(271.13) | | |
| NGSWKLARASFIEVK | WKLARASFI/DRB1*0101(3.95) | WKLARASFI/DRB1*0401(192.16) | WKLARASFI/DRB1*0701(10.01) | WKLARASFI/DRB1*1101(62.22) |
| VLMGLGRGWPLHRVD | LGRGWPLHR/DRB1*1101(291.41) | MGLGRGWPL/DRB1*0101(49.90) | MGLGRGWPL/DRB1*0701(248.73) | |
| HYAIIGPGLQAKATR | YAIIGPGLQ/DRB1*0101(16.57) | YAIIGPGLQ/DRB1*1101(141.04) | | |
| NYNLIIMDEAHFTDP | IIMDEAHFT/DRB1*0401(483.07) | YNLIIMDEA/DRB1*0101(136.42) | | |
| WWPTSRTTWSIHAHH | SRTTWSIHA/DRB1*0701(424.65) | | | |
| RTEQYQFQADSPKRL | FQADSPKRL/DRB1*0101(86.42) | FQADSPKRL/DRB1*0401(290.87) | FQADSPKRL/DRB1*0701(91.17) | |
| LVSILLSLLRNDVYP | ILLSLLRN/DRB1*0701(254.29) | LSSLLRNDV/DRB1*1101(216.01) | VSILLSLL/DRB1*0101(35.26) | |
| WTEVPFCSHHFHKIF | FCSHHFHKI/DRB1*0101(324.91) | FCSHHFHKI/DRB1*0701(46.94) | PFCSHHFHK/DRB1*1101(234.75) | |
| RHSIENSSVNVSLTA | ENSSVNVSL/DRB1*0701(272.80) | SIENSSVNV/DRB1*0101(324.71) | | |
| CGSGIFVDNVHTRT | FVDNVHTR/DRB1*0401(228.95) | FVDNVHTR/DRB1*1101(481.69) | IFVDNVHT/DRB1*0101(270.89) | |

FIG. 50-82

| peptide | core/HLA(affinity(nM)) | core/HLA(affinity(nM)) | core/HLA(affinity(nM)) | core/HLA(affinity(nM)) |
|---|---|---|---|---|
| LALGCYSQVNPLTLT | CYSQVNPLT/DRB1*0101(17.93) | CYSQVNPLT/DRB1*0401(90.23) | YSQVNPLTL/DRB1*0701(25.01) | |
| RGEARKTFVELMKRG | TFVELMKRG/DRB1*1101(355.42) | | | |
| WSIHATHQWMTTEDM | IHATHQWMT/DRB1*0701(343.77) | | | |
| EPSWASVKKDLISYG | WASVKKDLI/DRB1*1101(349.47) | | | |
| SRGSAKLRWFVERNL | LRWFVERNL/DRB1*0701(445.90) | | | |
| KKVIQLSRKTFDTEY | KVIQLSRKT/DRB1*1101(45.10) | | | |
| IVASVNTSRLLINR | IVASVNTS/DRB1*0401(398.84) | SVNTTSRLL/DRB1*0101(126.98) | SVNTTSRLL/DRB1*0701(33.48) | VNTTSRLLI/DRB1*1101(128.44) |
| FHKIFMKDGREIVVP | IFMKDGREI/DRB1*0101(353.14) | IFMKDGREI/DRB1*1101(274.40) | | |
| TTMAQGKPTLDIELL | MAQGKPTLD/DRB1*0101(272.42) | | | |
| MLIACYVITGTSADL | CYVITGTSA/DRB1*0101(78.06) | YVITGTSAD/DRB1*0401(262.58) | YVITGTSAD/DRB1*0701(182.17) | |
| SGIFVTDNVHTWTEQ | IFVTDNVHT/DRB1*0101(328.80) | IFVTDNVHT/DRB1*0401(185.57) | | |
| VGLYGNGVVTKSGTY | YGNGVVTKS/DRB1*0101(293.22) | | | |
| LVKRFSTGLLNGKGP | VKRFSTGLL/DRB1*0101(144.91) | VKRFSTGLL/DRB1*0701(183.51) | VKRFSTGLL/DRB1*1101(284.76) | |
| HEMYWISNGTGNIVA | MYWISNGTG/DRB1*0401(200.49) | WISNGTGNI/DRB1*0701(94.41) | YWISNGTGN/DRB1*0101(58.43) | |
| WASEMAFEALKGLPI | AEFALKGLPI/DRB1*0101(237.61) | | | |
| LTKPWDVIPMVTQMA | VIPMVTQMA/DRB1*0101(130.50) | | | |
| MEEALRGLPIRYQTP | ALRGLPIRY/DRB1*0101(57.13) | LRGLPIRYQ/DRB1*1101(196.66) | | |
| DGIYRILQRGLLGKT | YRILQRGLL/DRB1*0101(12.79) | YRILQRGLL/DRB1*0701(163.45) | YRILQRGLL/DRB1*1101(9.43) | |
| KKLRPRWLDARIYSD | PRWLDARIY/DRB1*0101(386.00) | | | |
| RIKQKGIFGKTQVGV | IKQKGIFGK/DRB1*1101(343.94) | | | |
| RGTAKLRWIVERGMV | LRWIVERGM/DRB1*0101(325.30) | LRWIVERGM/DRB1*1101(352.55) | | |

FIG. 50-83

| peptide | core/HLA(affinity(nM)) | core/HLA(affinity(nM)) | core/HLA(affinity(nM)) | core/HLA(affinity(nM)) |
|---|---|---|---|---|
| ILLMRTSWAFCEVLT | ILLMRTSWA/DRB1*0101(69.19) | LMRTSWAFC/DRB1*0701(194.64) | | |
| SGNDIANCLRKSGKK | IANCLRKSG/DRB1*1101(286.70) | | | |
| ELPDTIETLMLLTIL | DTIETLMLL/DRB1*0101(488.68) | | | |
| EARKTFVELMKRGDL | FVELMKRGD/DRB1*1101(145.04) | | | |
| GVPLLAIGCYSQVNP | PLLAIGCYS/DRB1*0101(241.38) | | | |
| QVGVGIHMENVFHTM | IHMENVFHT/DRB1*0101(168.23) | IHMENVFHT/DRB1*0401(234.24) | | |
| TEQYQFQPESPARVA | FQPESPARV/DRB1*0701(230.42) | YQFQPESPA/DRB1*0101(11.57) | YQFQPESPA/DRB1*0401(85.66) | |
| LMYFHRRDLRLASMA | FHRRDLRLA/DRB1*0401(417.46) | FHRRDLRLA/DRB1*1101(9.23) | YFHRRDLRL/DRB1*0101(17.92) | YFHRRDLRL/DRB1*0701(40.32) |
| YYMATLKNVREVKGL | MATLKNVRE/DRB1*0101(36.42) | YMATLKNVR/DRB1*0401(212.84) | YMATLKNVR/DRB1*0101(162.50) | YMATLKNVR/DRB1*1101(23.21) |
| YCAGLKKVTEVKGYT | YCAGLKKVT/DRB1*0101(300.33) | | | |
| MVAGGLLLAAYVMTG | GGLLLAAYV/DRB1*0101(48.64) | | | |
| EMAEALKGMPIRYQT | AEALKGMPI/DRB1*0101(47.11) | LKGMPIRYQ/DRB1*1101(341.25) | | |
| KQDVVLGSQEGAMH | VVLGSQEG/DRB1*0101(74.00) | | | |
| SIFKLTYQNKVVKVL | FKLTYQNKV/DRB1*0101(24.60) | FKLTYQNKV/DRB1*0401(311.86) | FKLTYQNKV/DRB1*0701(15.99) | FKLTYQNKV/DRB1*1101(51.87) |
| TVWFVPSIKTGNDIA | FVPSIKTGN/DRB1*1101(72.14) | VWFVPSIKT/DRB1*0101(104.79) | VWFVPSIKT/DRB1*0701(274.45) | |
| KFQPESPSRLSAAIG | FQPESPSRL/DRB1*0101(62.87) | | | |
| KSYAQMWTLMYFHRR | WTLMYFHRR/DRB1*1101(32.00) | YAQMWTLMY/DRB1*0101(20.41) | YAQMWTLMY/DRB1*0401(126.28) | YAQMWTLMY/DRB1*0701(171.96) |
| SHHFHELIMKDGRSL | FHELIMKDG/DRB1*0101(232.38) | FHELIMKDG/DRB1*1101(424.69) | | |
| SWVDLVLEHGGCVTT | LVLEHGGCV/DRB1*0101(161.17) | | | |
| DWQQVPFCSHHFHEL | FCSHHFHEL/DRB1*0701(433.07) | | | |
| HADMGYWIESALNDT | YWIESALND/DRB1*0101(318.71) | YWIESALND/DRB1*0401(464.56) | | |

FIG. 50-84

| peptide | core/HLA(affinity(nM)) | core/HLA(affinity(nM)) | core/HLA(affinity(nM)) |
|---|---|---|---|
| GANFKAERVIDPRRC | FKAERVIDP/DRB1*0101(176.10) | FKAERVIDP/DRB1*0401(185.01) | |
| FGAAYTALFGGVSWM | YTALFGGVS/DRB1*0101(15.16) | YTALFGGVS/DRB1*0701(457.74) | YTALFGGVS/DRB1*1101(243.42) |
| ANQAWLMGLGRGWP | WLMGLGRG/DRB1*0101(182.46) | | |
| VPNYNMYIMDEAHFT | YNMYIMDEA/DRB1*0101(143.36) | | |
| TLTILLKATLLAVSG | LLKATLLAV/DRB1*0701(305.62) | LTILLKATL/DRB1*1101(85.05) | TILLKATLL/DRB1*0101(23.05) |
| SSMVNGVVRLLTKPW | SMVNGVVRL/DRB1*0101(176.30) | VNGVVRLLT/DRB1*1101(55.87) | |
| ARFLEFEALGFLNED | FLEFEALGF/DRB1*0101(99.38) | FLEFEALGF/DRB1*0701(327.23) | |
| RRLTIMDLHPGSGKT | LTIMDLHPG/DRB1*0101(63.55) | LTIMDLHPG/DRB1*0401(368.76) | LTIMDLHPG/DRB1*1101(228.07) |
| TTEDMLKVWNRVWIQ | DMLKVWNRV/DRB1*0101(495.98) | MLKVWNRVW/DRB1*1101(429.81) | |
| CGSLIGLTSRATWAQ | LIGLTSRAT/DRB1*0101(2.49) | LIGLTSRAT/DRB1*0401(80.84) | LIGLTSRAT/DRB1*0701(236.24) | LIGLTSRAT/DRB1*1101(17.95) |
| DGEYRLKGESRKTFV | YRLKGESRK/DRB1*1101(301.33) | | |
| HTIENSTANVSLAAI | ENSTANVSL/DRB1*0701(265.79) | IENSTANVS/DRB1*0101(284.46) | |
| VIGLYGNGVVTSGT | LYGNGVVT/DRB1*0101(187.14) | | |
| SSVNMISRMLINRFT | ISRMLINRF/DRB1*0101(15.01) | ISRMLINRF/DRB1*0401(150.93) | ISRMLINRF/DRB1*0701(55.52) | ISRMLINRF/DRB1*1101(34.58) |
| REKRSVALTPHSGTG | SVALTPHSG/DRB1*0101(298.11) | | |
| LRFLAIPPTAGILAR | FLAIPPTAG/DRB1*0101(2.50) | FLAIPPTAG/DRB1*0401(21.90) | FLAIPPTAG/DRB1*0701(28.83) | FLAIPPTAG/DRB1*1101(38.56) |
| LPVWLAHKVAAEGIN | VWLAHKVAA/DRB1*1101(322.36) | WLAHKVAAE/DRB1*0101(136.25) | |
| RREKRSVALAPHVGM | RSVALAPHV/DRB1*0701(227.50) | SVALAPHVG/DRB1*0101(122.07) | |
| NIVSAVNMTSKMLLN | AVNMTSKML/DRB1*0101(21.43) | IVSAVNMTS/DRB1*0401(81.11) | IVSAVNMTS/DRB1*1101(105.35) | VNMTSKMLL/DRB1*0701(62.53) |
| RYQTTAVKSEHTGKE | RYQTTAVKS/DRB1*0701(443.66) | | |
| PKTHTLWSNGVLESD | THTLWSNGV/DRB1*0101(391.40) | | |

FIG. 50-85

| peptide | core/HLA(affinity(nM)) | core/HLA(affinity(nM)) | core/HLA(affinity(nM)) |
|---|---|---|---|
| NTDWDYWTTDISEM | WDYWTTDI/DRB1*0701(137.12) | | |
| EEPIPMSTYGWNLYR | PMSTYGWNL/DRB1*0701(487.89) | | |
| GRELKCGSGIFITDN | LKCGSGIFI/DRB1*0101(254.45) | | |
| PLLAMGCYSQYNPTT | LLAMGCYSQ/DRB1*0101(191.91) | LLAMGCYSQ/DRB1*0401(439.81) | |
| IHRMDLGVPLLALGC | HRMDLGVPL/DRB1*0101(28.74) | | |
| RYLPAIVREALKRRL | IVREALKRR/DRB1*1101(64.17) | YLPAIVREA/DRB1*0101(177.70) | |
| CTLIAMDLGELCEDT | IAMDLGELC/DRB1*0101(341.06) | | |
| TEDMLKVWNRYWIQD | MLKVWNRYW/DRB1*1101(478.75) | | |
| MRTSWAFCEVLTLAT | FCEVLTLAT/DRB1*0101(127.89) | FCEVLTLAT/DRB1*0401(358.28) | FCEVLTLAT/DRB1*0701(154.37) |
| VALVPHVGMGLETRT | LVPHVGMGL/DRB1*0101(188.71) | | |
| WTTSGTYYSAIAQA | TYYSAIAQA/DRB1*0101(241.57) | WTTSGTYY/DRB1*0701(372.84) | |
| GEARKTFVELMRRGD | FVELMRRGD/DRB1*1101(181.81) | | |
| YNLVWMDEAHFTDPC | LVWMDEAHF/DRB1*0101(450.75) | | |
| NVFHTMWHVTRGAVL | FHTMWHVTR/DRB1*0101(10.64) | FHTMWHVTR/DRB1*1101(16.60) | WHVTRGAVL/DRB1*0701(13.20) |
| SNPTIEEGRTLRVLK | IEEGRTLRV/DRB1*0101(226.60) | IEEGRTLRV/DRB1*0701(201.46) | |
| YRGAKRMAILGDTAW | RMAILGDTA/DRB1*0101(357.94) | YRGAKRMAI/DRB1*1101(352.42) | |
| TKRFSLGLLSGRGPL | FSLGLLSGR/DRB1*0401(377.93) | KRFSLGLLS/DRB1*0701(379.25) | KRFSLGLLS/DRB1*1101(94.12) SLGLLSGRG/DRB1*0101(16.17) |
| VKRFSTGLLNGKGPL | FSTGLLNGK/DRB1*0101(172.23) | FSTGLLNGK/DRB1*0701(397.86) | FSTGLLNGK/DRB1*1101(402.79) |
| GNGIFVADNVHTRTE | FVADNVHTR/DRB1*0401(88.11) | IFVADNVHT/DRB1*0101(128.64) | |
| LRHSIENSSVNVSLT | SIENSSVNV/DRB1*0101(279.27) | SIENSSVNV/DRB1*0701(225.68) | |
| VVGLYGNGVWTKSGD | VVGLYGNGV/DRB1*0101(242.29) | | |

FIG. 50-86

| peptide | core/HLA(affinity(nM)) | core/HLA(affinity(nM)) | core/HLA(affinity(nM)) |
|---|---|---|---|
| REALKRRLRTLILAP | KRRLRTLIL/DRB1*0101(70.88) | LKRRLRTLI/DRB1*0701(93.97) | LKRRLRTLI/DRB1*1101(10.31) |
| PSWASVKKDLISYGG | WASVKKDLI/DRB1*1101(365.85) | | |
| AGNDIAACLRKNGKR | IAACLRKNG/DRB1*1101(140.60) | | |
| TRKYLPAIIREAIKR | YLPAIIREA/DRB1*0101(36.64) | YLPAIIREA/DRB1*0401(390.78) | YLPAIIREA/DRB1*0701(421.47) |
| ACYVITGTSADLELE | VITGTSADL/DRB1*0101(37.50) | YVITGTSAD/DRB1*0401(180.29) | YVITGTSAD/DRB1*0701(149.31) |
| DCWCNATSAWWYMGT | WCNATSAWV/DRB1*0101(177.08) | WCNATSAWV/DRB1*0701(232.70) | |
| RVPNYNLIVMDEAHF | YNLIVMDEA/DRB1*0101(229.64) | | |
| QVPFCSHHFHELIMK | FCSHHFHEL/DRB1*0101(275.26) | FCSHHFHEL/DRB1*0701(102.05) | |
| LMSAAIKDQRAVHAD | IKDQRAVHA/DRB1*0101(176.02) | | |
| LHPASAWTLYAVAIT | LHPASAWTL/DRB1*0101(114.44) | LHPASAWTL/DRB1*0701(276.40) | |
| LDARYYADPMALKDF | RYYADPMAL/DRB1*0101(387.77) | | |
| NCLRKSGKKVIQLSR | CLRKSGKKV/DRB1*1101(79.02) | LRKSGKKVI/DRB1*0701(430.36) | |
| WMTTEDMLAVWNRVW | WMTTEDMLA/DRB1*0101(319.08) | | |
| KRMAILGDTAWDFGS | ILGDTAWDF/DRB1*0401(395.84) | RMAILGDTA/DRB1*0101(180.67) | |
| GEQRKTFVDLMKRGD | FVDLMKRGD/DRB1*1101(448.98) | | |
| NQAAILMGLGKGWPL | MGLGKGWPL/DRB1*0101(126.47) | | |
| KCTLMAMDLGEMCDD | LMAMDLGEM/DRB1*0101(312.75) | | |
| SYYCAGLKKVTEVKG | YCAGLKKVT/DRB1*1101(31.12) | YYCAGLKKV/DRB1*0101(67.79) | YYCAGLKKV/DRB1*0701(376.02) |
| TAAGIMKNPTVDGIT | AGIMKNPTV/DRB1*0101(201.29) | IMKNPTVDG/DRB1*0401(481.68) | |
| DFVEGVSGGAWVDW | FVEGVSGGA/DRB1*0101(454.70) | | |
| RHAVSRGSAKLRWIV | AVSRGSAKL/DRB1*0101(76.71) | AVSRGSAKL/DRB1*0701(155.56) | VSRGSAKLR/DRB1*1101(124.79) |

FIG. 50-87

| peptide | core/HLA(affinity(nM)) | core/HLA(affinity(nM)) | core/HLA(affinity(nM)) |
|---|---|---|---|
| DPSSVAARGYISTRV | ARGYISTRV/DRB1*0701(431.42) | SVAARGYIS/DRB1*0101(202.34) | |
| WPLHRMDIGVPLLAI | HRMDIGVPL/DRB1*0101(25.88) | HRMDIGVPL/DRB1*0401(285.64) | HRMDIGVPL/DRB1*0701(140.48) |
| GGMLVRNPLSRNSTH | GMLVRNPLS/DRB1*0101(202.09) | MLVRNPLSR/DRB1*1101(135.63) | |
| STANIFRGSYLAGAG | FRGSYLAGA/DRB1*0401(445.26) | IFRGSYLAG/DRB1*0101(91.67) | NIFRGSYLA/DRB1*1101(302.21) |
| VSAVNMTSKMLNRF | AVNMTSKML/DRB1*0101(30.27) | VNMTSKMLL/DRB1*0701(88.90) | VNMTSKMLL/DRB1*1101(82.79) |
| PSIKAGNDIAACLRK | IKAGNDIAA/DRB1*0101(492.15) | | |
| GKCESCVYNMMGKRE | CVYNMMGKR/DRB1*1101(387.69) | VYNMMGKRE/DRB1*0101(480.31) | |
| TVLMGLGKGWPISKV | MGLGKGWPI/DRB1*0101(52.46) | MGLGKGWPI/DRB1*0701(284.35) | |
| DPSSIAARGYISTRV | ARGYISTRV/DRB1*0701(448.08) | SIAARGYIS/DRB1*0101(194.28) | |
| GWTRSGTYVSSIAQ | RSGTYVSSI/DRB1*0701(395.93) | | |
| EKKKLRPKVWLDARVY | LRPKWLDAR/DRB1*1101(406.41) | | |
| GRELKCGSGIFVTNE | LKCGSGIFV/DRB1*0101(177.98) | | |
| GVGNRDFVEGLSGAT | FVEGLSGAT/DRB1*0101(486.31) | | |
| VLGSQEGAMRTALTG | LGSQEGAMR/DRB1*0101(271.87) | | |
| REAIKRKLRTLVLAP | IKRKLRTLV/DRB1*0701(106.86) | IKRKLRTLV/DRB1*1101(6.92) | KRKLRTLVL/DRB1*0101(66.68) |
| ERVILAGPMPVTVAS | VILAGPMPV/DRB1*0101(36.46) | | |
| CWCNATSAWVTYGTC | WCNATSAWV/DRB1*0101(449.39) | | |
| TDISEMGANFRADRV | ISEMGANFR/DRB1*0101(422.58) | | |
| TEVPFCSHHFHKIFM | FCSHHFHKI/DRB1*0101(209.30) | FCSHHFHKI/DRB1*0701(33.08) | FCSHHFHKI/DRB1*1101(68.86) |
| NLIVMDEAHFTDPSS | IVMDEAHFT/DRB1*0101(462.45) | | |
| RGMLQGQGPMKMYMA | LQGQGPMKM/DRB1*0101(5.90) | LQGQGPMKM/DRB1*0401(306.36) | LQGQGPMKM/DRB1*0701(167.84) | LQGQGPMKM/DRB1*1101(490.27) |

FIG. 50-88

| peptide | core/HLA(affinity(nM)) | core/HLA(affinity(nM)) | core/HLA(affinity(nM)) |
|---|---|---|---|
| IVSAVNMTSKMLLNR | AVNMTSKML/DRB1*0101(18.14) | AVNMTSKML/DRB1*1101(87.32) | IVSAVNMTS/DRB1*0401(164.67) | VNMTSKMLL/DRB1*0701(73.82) |
| VTTSGDVYSAIAQTE | YVSAIAQTE/DRB1*0101(300.21) | | | |
| MRTTWALCESITLAT | WALCESITL/DRB1*0101(61.94) | WALCESITL/DRB1*0701(118.76) | | |
| RWLDARVYSDPLALK | DARVYSDPL/DRB1*0101(458.74) | RVYSDPLAL/DRB1*0701(413.71) | | |
| KTFVDLMRRGDLPVW | FVDLMRRGD/DRB1*1101(180.84) | | | |
| TEQYKFQPESPSRLS | FQPESPSRL/DRB1*0701(181.99) | YKFQPESPS/DRB1*0101(21.83) | YKFQPESPS/DRB1*0401(108.34) | |
| EGVYRIKQRGILGRS | YRIKQRGIL/DRB1*0101(62.16) | YRIKQRGIL/DRB1*0701(208.26) | YRIKQRGIL/DRB1*1101(17.38) | |
| NMLKVRNRVSTVQQ | LKVRNRVS/DRB1*1101(64.23) | LKVRNRVS/DRB1*1101(10.45) | MLKVRNRV/DRB1*0701(95.35) | |
| TANISLTAIANQAVV | ISLTAIANQ/DRB1*0401(83.05) | LTAIANQAV/DRB1*0701(61.76) | SLTAIANQA/DRB1*0101(13.39) | |
| INGVVKLLTKPWDVL | GVVKLLTKP/DRB1*1101(68.57) | KLLTKPWDV/DRB1*0701(260.11) | VVKLLTKPW/DRB1*0101(180.76) | |
| IPPTAGILKRWGQLK | TAGILKRWG/DRB1*1101(185.80) | | | |
| MALVAFLRFLAIPPT | FLRFLAIPP/DRB1*0101(12.77) | FLRFLAIPP/DRB1*0401(166.15) | FLRFLAIPP/DRB1*0701(85.66) | LVAFLRFLA/DRB1*1101(40.92) |
| GAYRIMQRGLFGYSQ | YRIMQRGLF/DRB1*0101(35.52) | YRIMQRGLF/DRB1*1101(25.54) | | |
| HHFHKIFMKDGREIV | FHKIFMKDG/DRB1*0101(409.66) | FHKIFMKDG/DRB1*1101(107.54) | | |
| RTTWSIHAKHQWMTT | TWSIHAKHQ/DRB1*0101(489.39) | TWSIHAKHQ/DRB1*0701(321.46) | TWSIHAKHQ/DRB1*1101(141.85) | |
| SGIFITNNVHTWTEQ | IFITNNVHT/DRB1*0101(141.80) | IFITNNVHT/DRB1*0401(245.62) | IFITNNVHT/DRB1*0701(331.05) | IFITNNVHT/DRB1*1101(420.95) |
| TLILAPTRVVAAEME | LILAPTRVV/DRB1*0401(296.08) | LILAPTRVV/DRB1*0701(88.26) | LILAPTRVV/DRB1*1101(77.95) | TLILAPTRV/DRB1*0101(8.35) |
| YKTWAYHGSYETKQT | WAYHGSYET/DRB1*0101(324.85) | | | |
| VPNYNLVVMDEAHFT | YNLVVMDEA/DRB1*0101(236.09) | | | |
| EYRLKGESRKTFVEL | YRLKGESRK/DRB1*1101(266.86) | | | |
| IAVSTANIFRGSYLA | ANIFRGSYL/DRB1*0101(237.43) | ANIFRGSYL/DRB1*0701(155.54) | | |

FIG. 50-89

| peptide | core/HLA(affinity(nM)) | core/HLA(affinity(nM)) | core/HLA(affinity(nM)) |
|---|---|---|---|
| WLVHKQWFLDLPLPW | WLVHKQWFL/DRB1*0701(409.83) | | |
| KVIQLSRKTFDSEYV | VIQLSRKTF/DRB1*1101(91.96) | | |
| GWPIHRMDLGVPLLA | HRMDLGVPL/DRB1*0101(35.66) | HRMDLGVPL/DRB1*0701(236.31) | IHRMDLGVP/DRB1*0401(439.59) |
| HEMYWYSGATGNIVS | MYWYSGATG/DRB1*0101(42.86) | WYSGATGNI/DRB1*0701(109.81) | YWYSGATGN/DRB1*0401(398.22) |
| EFGKAKGSRAIWYMW | FGKAKGSRA/DRB1*0101(28.32) | FGKAKGSRA/DRB1*0701(230.55) | FGKAKGSRA/DRB1*1101(306.44) |
| DIAACLRKSGKRVIQ | IAACLRKSG/DRB1*1101(43.13) | LRKSGKRVI/DRB1*0701(381.45) | |
| RERNRVSTGSQLAKR | NRVSTGSQL/DRB1*0101(159.55) | NRVSTGSQL/DRB1*0701(194.59) | |
| PMPVTHSAAQRRGR | VTHSAAQR/DRB1*0101(476.28) | VTHSSAAQR/DRB1*0701(368.53) | |
| RGSAKLQWIVERGMI | LQWIVERGM/DRB1*0101(372.82) | LQWIVERGM/DRB1*0701(442.96) | |
| ATLKNVREVKGLTKG | VREVKGLTK/DRB1*1101(493.65) | | |
| LDARYYSDPLALKEF | RYYSDPLAL/DRB1*0101(427.30) | | |
| PMSTYGWNIVKLHSG | WNIVKLHSG/DRB1*0701(424.30) | YGWNIVKLH/DRB1*0101(292.32) | YGWNIVKLH/DRB1*0401(443.23) | YGWNIVKLH/DRB1*1101(166.56) |
| FCSHHFHELIMKDGR | FCSHHFHEL/DRB1*0701(447.15) | | |
| PNPTIEESRTIRVLS | IEESRTIRV/DRB1*0101(338.57) | IEESRTIRV/DRB1*0701(56.45) | |
| EEFTSKVRSNAALGA | FTSKVRSNA/DRB1*0701(217.81) | FTSKVRSNA/DRB1*1101(64.86) | VRSNAALGA/DRB1*0101(114.90) | VRSNAALGA/DRB1*0401(375.05) |
| NSTHEMYWISNGTGN | MYWISNGTG/DRB1*0101(459.40) | | |
| FPTSRTTWSIHAKHQ | SRTTWSIHA/DRB1*0701(484.13) | TTWSIHAKH/DRB1*1101(281.76) | |
| STGLLNGKPLRMYL | LLNGKPLR/DRB1*0101(23.73) | LLNGKPLR/DRB1*1101(384.80) | LNGKPLRM/DRB1*0701(281.58) |
| WTEQYKFQPESPSRL | FQPESPSRL/DRB1*0701(213.09) | YKFQPESPS/DRB1*0101(40.02) | YKFQPESPS/DRB1*0401(165.91) |
| EDYGFGIFTNIWMK | FGIFTNIW/DRB1*0401(248.23) | GFGIFTNI/DRB1*0101(278.26) | GFGIFTNI/DRB1*0701(138.95) | IFTNIWMK/DRB1*1101(399.59) |
| AFCEVLTLATGPILT | FCEVLTLAT/DRB1*1101(492.26) | VLTLATGPI/DRB1*0101(13.67) | VLTLATGPI/DRB1*0401(212.85) | VLTLATGPI/DRB1*0701(45.19) |

FIG. 50-90

| peptide | core/HLA(affinity(nM)) | core/HLA(affinity(nM)) | core/HLA(affinity(nM)) |
|---|---|---|---|
| MAEALKGMPIRYQTT | ALKGMPIRY/DRB1*0101(36.94) | LKGMPIRYQ/DRB1*1101(239.42) | |
| TRTEQYQFQPESPAR | YQFQPESPA/DRB1*0101(207.15) | | |
| KGKTVWFVPSIKAGN | VWFVPSIKA/DRB1*0101(11.91) | VWFVPSIKA/DRB1*0401(60.79) | VWFVPSIKA/DRB1*0701(46.96) | VWFVPSIKA/DRB1*1101(19.62) |
| IANQAVVLMGLGRGW | VVLMGLGRG/DRB1*0101(203.98) | | |
| SLNTFTNMEVQLIRQ | FTNMEVQLI/DRB1*0101(19.30) | FTNMEVQLI/DRB1*0401(97.51) | FTNMEVQLI/DRB1*0701(90.26) |
| VWFVPSIKSGNDIAN | FVPSIKSGN/DRB1*1101(217.36) | VWFVPSIKS/DRB1*0101(431.85) | |
| SAYTALFSGVSWMIR | LFSGVSWMI/DRB1*0701(16.04) | YTALFSGVS/DRB1*0101(8.27) | YTALFSGVS/DRB1*0401(298.30) | YTALFSGVS/DRB1*1101(59.79) |
| AQMWALMYFHRRDLR | LMYFHRRDL/DRB1*0701(236.67) | WALMYFHRR/DRB1*0101(45.28) | WALMYFHRR/DRB1*1101(21.25) |
| SLLRNDVPLAGPLIA | DVPLAGPLI/DRB1*0101(22.57) | LLRNDVPLA/DRB1*0401(79.34) | |
| LSLTAIANQAAILMG | LTAIANQAA/DRB1*0101(6.71) | LTAIANQAA/DRB1*0401(45.91) | LTAIANQAA/DRB1*0701(120.05) |
| PIPMATYGWNLVKLH | MATYGWNLV/DRB1*0101(222.60) | PMATYGWNL/DRB1*0701(322.74) | YGWNLVKLH/DRB1*1101(471.99) |
| TGEIGAIALDFSPGT | IALDFSPGT/DRB1*0401(440.84) | | |
| LNDTWKIEKASFIEI | WKIEKASFI/DRB1*0101(56.81) | WKIEKASFI/DRB1*0701(139.94) | |
| KRYLPAIVREALKRR | IVREALKRR/DRB1*1101(92.91) | YLPAIVREA/DRB1*0101(68.90) | |
| VILAGPMPTASSAA | VILAGPMPV/DRB1*0101(310.60) | | |
| KFQPESPKRLSAAIG | FQPESPKRL/DRB1*0101(70.40) | | |
| CDSKLMSAAIKDQRA | KLMSAAIKD/DRB1*0701(470.93) | SKLMSAAIK/DRB1*0101(128.49) | |
| SHHFHELVMKDGRKL | LVMKDGRKL/DRB1*0101(303.01) | LVMKDGRKL/DRB1*1101(249.98) | |
| RVEMGEAAAIFMTAT | VEMGEAAAI/DRB1*0101(93.63) | | |
| ANIFRGSYLAGAGLA | FRGSYLAGA/DRB1*0101(33.98) | FRGSYLAGA/DRB1*0401(323.87) | IFRGSYLAG/DRB1*1101(337.08) |
| QEGAMRTALTGATEI | MRTALTGAT/DRB1*0101(120.46) | | |

FIG. 50-91

| peptide | core/HLA(affinity(nM)) | core/HLA(affinity(nM)) | core/HLA(affinity(nM)) |
|---|---|---|---|
| CGLFGKGGVTCAKF | FGKGGVTC/DRB1*0101(107.21) | | |
| ARVYSDPLALKEFKE | VYSDPLALK/DRB1*0101(473.74) | | |
| WNRVWIRDNPNMTDK | VWIRDNPNM/DRB1*0401(412.69) | | |
| RVGMGEAAAIFMTAT | MGEAAAIFM/DRB1*0101(199.99) | | |
| WVDIVLEHGGCVTTM | IVLEHGGCV/DRB1*0101(85.32) | | |
| VPMVTQLAMTDTTPF | LAMTDTTPF/DRB1*0701(341.51) | MVTQLAMTD/DRB1*0101(129.87) | |
| ACLGKAYAQMWSLMY | YAQMWSLMY/DRB1*0101(31.50) | YAQMWSLMY/DRB1*0401(360.88) | YAQMWSLMY/DRB1*1101(378.43) |
| GSSIGKMFEATARGA | IGKMFEATA/DRB1*0101(110.92) | | |
| KETACLGKSYAQMWT | ACLGKSYAQ/DRB1*0101(375.62) | | |
| GGNIYADDTAGWDTR | IYADDTAGW/DRB1*0401(327.09) | | |
| GMPIRYQTPAIRAEH | IRYQTPAIR/DRB1*0101(13.69) | IRYQTPAIR/DRB1*0401(71.53) | IRYQTPAIR/DRB1*1101(95.36) |
| DARIYSDPLALREFK | IYSDPLALR/DRB1*0101(176.91) | IYSDPLALR/DRB1*0401(174.08) | |
| RGEDGCWYGMEIRPL | WYGMEIRPL/DRB1*0101(154.32) | | |
| TWKLEKASFIEVKTC | WKLEKASFI/DRB1*0101(92.18) | WKLEKASFI/DRB1*0701(342.90) | |
| KFEKQLGQIMLLILC | FEKQLGQIM/DRB1*0101(23.12) | FEKQLGQIM/DRB1*0701(343.25) | |
| EDYGFGMFTTNIWMK | FGMFTTNIW/DRB1*0401(135.49) | FGMFTTNIW/DRB1*0701(133.10) | GFGMFTTNI/DRB1*0101(126.99) |
| GSRDFVEGVSGGSWV | FVEGVSGGS/DRB1*0101(378.12) | | |
| KTHTLWSNGVLESDM | THTLWSNGV/DRB1*0101(419.33) | | |
| GWPLHRMDIGVPLLA | HRMDIGVPL/DRB1*0101(38.45) | HRMDIGVPL/DRB1*0701(186.09) | LHRMDIGVP/DRB1*0401(318.95) |
| STRVGMGEAAAIFMT | VGMGEAAAI/DRB1*0101(52.90) | | |
| EDHWFSRGNSLSGVE | HWFSRGNSL/DRB1*0101(89.85) | HWFSRGNSL/DRB1*0701(139.53) | WFSRGNSLS/DRB1*0401(285.94) WFSRGNSLS/DRB1*1101(427.57) |

FIG. 50-92

| peptide | core/HLA(affinity(nM)) | core/HLA(affinity(nM)) | core/HLA(affinity(nM)) |
|---|---|---|---|
| DGICGIRSTRLENL | CGIRSTRL/DRB1*0701(179.88) | ICGIRSTTR/DRB1*0101(394.20) | ICGIRSTTR/DRB1*1101(207.12) |
| KNDVPLAGPLIAGGM | DVPLAGPLI/DRB1*0101(54.38) | | |
| PQDELIGRARISQGA | LIGRARISQ/DRB1*1101(358.61) | | |
| EALRGLPIRYQTPAV | LRGLPIRYQ/DRB1*0101(65.59) | LRGLPIRYQ/DRB1*0401(480.79) | LRGLPIRYQ/DRB1*1101(132.42) |
| GANFRAERVIDPRRC | FRAERVIDP/DRB1*0101(92.80) | FRAERVIDP/DRB1*0401(104.10) | |
| RREKRSVALTPHSGT | SVALTPHSG/DRB1*0101(462.69) | | |
| GYWIESSKNQTWQIE | YWIESSKNQ/DRB1*0101(481.56) | YWIESSKNQ/DRB1*0401(385.50) | |
| EEVQVLALEPGKNPK | VLALEPGKN/DRB1*0101(375.17) | | |
| KPRWLDARVYADPMA | WLDARVYAD/DRB1*0101(324.53) | | |
| GGWSYCCGLKNVTE | WSYYCCGLK/DRB1*1101(404.23) | YYCCGLKNV/DRB1*0101(193.05) | |
| KTKRYLPAIVREALK | TKRYLPAIV/DRB1*1101(91.35) | YLPAIVREA/DRB1*0101(26.57) | YLPAIVREA/DRB1*0701(255.68) |
| YRLRGEARKTFVELM | YRLRGEARK/DRB1*0101(357.01) | YRLRGEARK/DRB1*1101(129.16) | |
| MWQLMYFHRRDLRLA | YFHRRDLRL/DRB1*0101(35.94) | YFHRRDLRL/DRB1*0701(37.80) | YFHRRDLRL/DRB1*1101(10.22) |
| TLYAVATTIVTPMLR | LYAVATTIV/DRB1*0701(36.65) | YAVATTIVT/DRB1*0101(47.62) | YAVATTIVT/DRB1*1101(450.62) |
| REAIKRGLRTLILAP | IKRGLRTLI/DRB1*0101(34.72) | IKRGLRTLI/DRB1*0701(32.62) | IKRGLRTLI/DRB1*1101(13.39) |
| GAIALDFSPGTSGSP | IALDFSPGT/DRB1*0101(253.02) | IALDFSPGT/DRB1*0701(84.19) | |
| QFQADSPKRLASAIQ | FQADSPKRL/DRB1*0101(82.30) | FQADSPKRL/DRB1*0701(203.02) | |
| LKCCSGIFITNNVHT | IFITNNVHT/DRB1*0701(398.22) | | |
| AIANQAVVLMGLGKG | AIANQAVVL/DRB1*0101(183.41) | | |
| KAGNDIAACLRKNGK | IAACLRKNG/DRB1*1101(316.34) | | |
| NYNLIVMDEAHFTDP | IVMDEAHFT/DRB1*0401(428.72) | YNLIVMDEA/DRB1*0101(204.05) | |

FIG. 50-93

| peptide | core/HLA(affinity(nM)) | core/HLA(affinity(nM)) | core/HLA(affinity(nM)) |
|---|---|---|---|
| VPLLAIGCYSQVNPI | GCYSQVNPI/DRB1*0701(267.33) | LAIGCYSQV/DRB1*0101(203.25) | |
| PAIIREAIKRKLRTL | IREAIKRKL/DRB1*0101(203.77) | IREAIKRKL/DRB1*0701(322.69) | IREAIKRKL/DRB1*1101(22.72) |
| NGVWTTSGTYVSAIA | WTTSGTYV/DRB1*0101(172.34) | WTTSGTYV/DRB1*0701(118.43) | |
| SPNPTIEAGRTLRVL | IEAGRTLRV/DRB1*0101(79.22) | IEAGRTLRV/DRB1*0701(74.08) | |
| NTANISLTAIANQA | ISLTAIANQ/DRB1*0701(407.91) | NISLTAIAN/DRB1*0101(44.30) | NISLTAIAN/DRB1*0401(242.04) |
| SASSMVNGVVKLLTK | MVNGVVKLL/DRB1*0101(198.84) | | |
| KHAYSRGSSKLRWFV | AVSRGSSKL/DRB1*0101(246.64) | AVSRGSSKL/DRB1*0701(225.41) | VSRGSSKLR/DRB1*1101(147.48) |
| CGSLIGLSSRATWAQ | LIGLSSRAT/DRB1*0101(2.32) | LIGLSSRAT/DRB1*0401(115.87) | LIGLSSRAT/DRB1*0701(205.65) | LIGLSSRAT/DRB1*1101(21.40) |
| IAACLRKNGKRVIQL | LRKNGKRVI/DRB1*1101(69.43) | | |
| LAIGCYSQVNPITLT | CYSQVNPIT/DRB1*0401(150.31) | YSQVNPITL/DRB1*0101(30.84) | YSQVNPITL/DRB1*0701(32.33) |
| LQWIASAIVLEFFMM | LQWIASAIV/DRB1*0101(42.09) | LQWIASAIV/DRB1*0701(64.47) | |
| WTLMYFHRRDLRLAS | YFHRRDLRL/DRB1*0101(26.05) | YFHRRDLRL/DRB1*0701(36.50) | YFHRRDLRL/DRB1*1101(9.00) |
| NPGRFWNTTIAVSMA | FWNTTIAVS/DRB1*0401(159.39) | FWNTTIAVS/DRB1*1101(437.93) | WNTTIAVSM/DRB1*0101(57.37) | WNTTIAVSM/DRB1*0701(44.74) |
| QWIASAIVLEFFLMV | WIASAIVLE/DRB1*0101(398.51) | WIASAIVLE/DRB1*0701(404.48) | |
| LRHTIENSTANVSLA | IENSTANVS/DRB1*0101(199.05) | IENSTANVS/DRB1*0401(300.88) | TIENSTANV/DRB1*0701(202.15) |
| YVMTGRSADLELERA | VMTGRSADL/DRB1*0101(312.10) | | |
| NGVVKLLTKPWDVLP | KLLTKPWDV/DRB1*0701(346.08) | VVKLLTKPW/DRB1*0101(255.56) | VVKLLTKPW/DRB1*1101(108.39) |
| LSGRGPLKLFMAFVA | PLKLFMAFV/DRB1*0101(77.63) | PLKLFMAFV/DRB1*1101(480.97) | |
| NSSVNVSLTAIANQA | VNVSLTAIA/DRB1*0101(29.55) | VNVSLTAIA/DRB1*0701(161.20) | VNVSLTAIA/DRB1*0701(302.64) |
| GPLRMVLAFITFLRV | LRMVLAFIT/DRB1*0101(29.85) | VLAFITFLR/DRB1*1101(142.28) | |
| LNDWDYWTDISEM | WDYWTDI/DRB1*0701(136.45) | | |

FIG. 50-94

| peptide | core/HLA(affinity(nM)) | core/HLA(affinity(nM)) | core/HLA(affinity(nM)) |
|---|---|---|---|
| DWLEHGSCVTTMAQ | WLEHGSCV/DRB1*0101(416.33) | | |
| TKAEFCKKVRSNAAM | CKKVRSNAA/DRB1*0101(107.16) | FCKKVRSNA/DRB1*0401(428.35) | FCKKVRSNA/DRB1*0701(129.03) | FCKKVRSNA/DRB1*1101(34.09) |
| SSMINGVVKLLTKPW | INGVVKLLT/DRB1*1101(63.53) | MINGVVKLL/DRB1*0101(190.78) | | |
| CEVILTATGPILTLW | LTLATGPIL/DRB1*0101(7.60) | LTLATGPIL/DRB1*0701(35.22) | VLTLATGPI/DRB1*0401(324.42) | |
| PLRMVLAFITFLRVL | LAFITFLR/DRB1*0701(72.54) | LRMVLAFIT/DRB1*0101(41.78) | VLAFITFLR/DRB1*0101(143.75) | |
| HRMDLGVPLLALGCY | HRMDLGVPL/DRB1*0101(56.08) | | | |
| TTANISLTAIANQAV | ISLTAIANQ/DRB1*0401(111.80) | LTAIANQAV/DRB1*0701(89.86) | NISLTAIAN/DRB1*0101(18.73) | |
| RARYSQGAGWSLKET | VSQGAGWSL/DRB1*0101(241.81) | | | |
| EAIKRGLRTLILAPT | IKRGLRTLI/DRB1*0701(61.14) | IKRGLRTLI/DRB1*1101(23.50) | LRTLILAPT/DRB1*0101(25.51) | |
| AARGYISTRVEMGEA | YISTRVEMG/DRB1*0101(116.58) | YISTRVEMG/DRB1*0401(112.67) | YISTRVEMG/DRB1*0701(105.68) | YISTRVEMG/DRB1*1101(372.54) |
| LGLLSGRGPLKLFMA | LLSGRGPLK/DRB1*0101(21.84) | LSGRGPLKL/DRB1*0701(142.49) | LSGRGPLKL/DRB1*1101(244.55) | |
| TTFITPMMRHTIENT | FITPMMRHT/DRB1*0101(180.51) | FITPMMRHT/DRB1*1101(102.44) | | |
| LTAIANQAAILMGLG | AIANQAAIL/DRB1*0701(252.05) | IANQAAILM/DRB1*0101(8.59) | IANQAAILM/DRB1*0401(170.13) | |
| IFRGSYLAGAGLLFS | GSYLAGAGL/DRB1*0101(13.79) | YLAGAGLLF/DRB1*0701(241.97) | | |
| SYYCGGLKNVKEVRG | YCGGLKNVK/DRB1*0101(174.33) | YCGGLKNVK/DRB1*1101(277.59) | | |
| VNMYSRMLLNRFTMT | MYSRMLLNR/DRB1*0101(45.17) | SRMLLNRFT/DRB1*0101(19.39) | VSRMLLNRF/DRB1*0401(438.20) | VSRMLLNRF/DRB1*0701(209.43) |
| NVSLTAIANQAAVLM | LTAIANQAA/DRB1*0101(6.29) | LTAIANQAA/DRB1*0401(33.30) | LTAIANQAA/DRB1*0701(103.67) | |
| HGSCVTTMAKNKPTL | CVTTMAKNK/DRB1*0101(407.52) | CVTTMAKNK/DRB1*1101(347.32) | | |
| GPILTLWEGNPGRFW | LTLWEGNPG/DRB1*0101(456.18) | | | |
| ASHEWMTTEDMLAVW | WMTTEDMLA/DRB1*0101(177.80) | WMTTEDMLA/DRB1*0401(144.01) | | |
| RKYLPAIVREAIKRK | IVREAIKRK/DRB1*1101(97.37) | YLPAIVREA/DRB1*0101(58.72) | | |

FIG. 50-95

| peptide | core/HLA(affinity(nM)) | core/HLA(affinity(nM)) | core/HLA(affinity(nM)) |
|---|---|---|---|
| RWLDARIYSDPLALR | DARIYSDPL/DRB1*0101(267.56) | IYSDPLALR/DRB1*0401(398.15) | RIYSDPLAL/DRB1*0701(363.00) | |
| PLLALGCYSQVNPLT | GCYSQVNPL/DRB1*0101(118.12) | GCYSQVNPL/DRB1*0401(259.79) | GCYSQVNPL/DRB1*0701(284.28) | |
| LNTFTNMEAQLIRQM | FTNMEAQLI/DRB1*0101(5.06) | FTNMEAQLI/DRB1*0401(54.32) | FTNMEAQLI/DRB1*0701(64.20) | FTNMEAQLI/DRB1*1101(257.86) |
| ALKRRLRTLILAPTR | KRRLRTLIL/DRB1*0701(82.09) | LKRRLRTLI/DRB1*1101(4.17) | LRTLILAPT/DRB1*0101(8.49) | LRTLILAPT/DRB1*0401(171.45) |
| RLEFEALGFMNEDH | FLEFEALGF/DRB1*0101(177.21) | | | |
| SANLSLAAIANQAAI | LAAIANQAA/DRB1*0401(71.07) | LSLAAIANQ/DRB1*0701(281.25) | SLAAIANQA/DRB1*0101(13.30) | |
| SLAAIANQAVVLMGL | IANQAVVLM/DRB1*0401(335.21) | LAAIANQAV/DRB1*0101(16.23) | LAAIANQAV/DRB1*0701(194.66) | |
| GYSQIGAGVYKEGVF | YSQIGAGVY/DRB1*0101(297.93) | | | |
| TEQYKFQPESPARLA | FQPESPARL/DRB1*0701(144.34) | YKFQPESPA/DRB1*0101(9.06) | YKFQPESPA/DRB1*0401(65.31) | YKFQPESPA/DRB1*1101(421.66) |
| TIEEGRTLRVLKMYE | GRTLRVLKM/DRB1*1101(197.64) | IEEGRTLRV/DRB1*0101(124.02) | IEEGRTLRV/DRB1*0701(290.84) | |
| AYRIMQRGLFGYSQI | YRIMQRGLF/DRB1*0101(40.90) | YRIMQRGLF/DRB1*0701(494.97) | YRIMQRGLF/DRB1*1101(38.27) | |
| TANIFRGSYLAGAGL | ANIFRGSYL/DRB1*0701(463.09) | FRGSYLAGA/DRB1*0401(346.11) | IFRGSYLAG/DRB1*0101(53.17) | IFRGSYLAG/DRB1*1101(271.81) |
| AIKRKLRTLILAPTR | IKRKLRTLI/DRB1*1101(12.74) | KRKLRTLIL/DRB1*0701(94.51) | LRTLILAPT/DRB1*0101(8.77) | LRTLILAPT/DRB1*0401(180.47) |
| DWTEVPFCSHHFHKI | FCSHHFHKI/DRB1*0701(74.57) | PFCSHHFHK/DRB1*1101(392.41) | | |
| KRSVALAPHVGLGLD | SVALAPHVG/DRB1*0101(29.56) | VALAPHVGL/DRB1*0701(171.41) | | |
| IANQAAILMGLDKGW | IANQAAILM/DRB1*0101(317.81) | | | |
| ARISQGAGWSLKETA | ISQGAGWSL/DRB1*0101(308.65) | | | |
| GLPIRYQTPAVKSEH | IRYQTPAVK/DRB1*0101(19.42) | IRYQTPAVK/DRB1*0401(166.06) | IRYQTPAVK/DRB1*0701(310.99) | IRYQTPAVK/DRB1*1101(128.37) |
| MSAAVKDQRAVHADM | VKDQRAVHA/DRB1*0101(187.55) | | | |
| LVKRFSSELLSGRGP | FSSELLSGR/DRB1*0401(372.31) | VKRFSSELL/DRB1*0101(189.48) | VKRFSSELL/DRB1*0701(297.82) | |
| SSPNPTIEESRTIRV | IEESRTIRV/DRB1*0701(227.69) | | | |

FIG. 50-96

| peptide | core/HLA(affinity(nM)) | core/HLA(affinity(nM)) | core/HLA(affinity(nM)) |
|---|---|---|---|
| MAFIAFLRFLTIPPT | FIAFLRFLT/DRB1*1101(27.62) | FLRFLTIPP/DRB1*0101(15.44) | FLRFLTIPP/DRB1*0401(42.22) | FLRFLTIPP/DRB1*0701(49.49) |
| LMGLGRGWPLHRVDL | LGRGWPLHR/DRB1*0701(281.64) | LGRGWPLHR/DRB1*0101(263.94) | MGLGRGWPL/DRB1*0101(67.95) | |
| EAYMAVGWSILASS | MAVGWSIL/DRB1*0101(274.73) | | | |
| MPVTAASAAQRRGRI | VTAASAAQR/DRB1*010 1(487.65) | | | |
| GAKRMAILGETAWDF | RMAILGETA/DRB1*0101(87.33) | | | |
| KETLVTFKNPHAKRQ | LVTFKNPHA/DRB1*0101(5.64) | LVTFKNPHA/DRB1*0401(4.75) | LVTFKNPHA/DRB1*0701(35.84) | LVTFKNPHA/DRB1*1101(13.25) |
| LVAGGLLIACYVITG | GGLLIACYV/DRB1*0101(274.35) | | | |
| VDLMCHATFTTRLLS | CHATFTTRL/DRB1*0101(122.53) | CHATFTTRL/DRB1*0401(471.88) | CHATFTTRL/DRB1*0701(24.04) | HATFTTRLL/DRB1*1101(420.07) |
| NDWDYWTTDISEMG | WDYWTTDI/DRB1*0701(206.11) | | | |
| CTKAEFCKKVRSNAA | CKKVRSNAA/DRB1*0101(413.81) | FCKKVRSNA/DRB1*0701(319.93) | FCKKVRSNA/DRB1*1101(54.84) | |
| VWFVPSIKAGNDIAN | VWFVPSIKA/DRB1*0101(160.69) | VWFVPSIKA/DRB1*1101(135.92) | | |
| LMKRGDLPVWLAYRV | KRGDLPVWL/DRB1*0101(310.07) | | | |
| DHHAVSRGAKLRWF | AVSRGSAKL/DRB1*0101(124.97) | AVSRGSAKL/DRB1*0701(254.61) | AVSRGSAKL/DRB1*1101(59.93) | |
| NDIPMTGPLVAGGLL | DIPMTGPLV/DRB1*0101(79.37) | | | |
| SQLAKRFSRGMLQGQ | AKRFSRGML/DRB1*0701(339.99) | AKRFSRGML/DRB1*1101(68.88) | KRFSRGMLQ/DRB1*0101(206.84) | |
| GNIVASVNTTSRLLL | IVASVNTTS/DRB1*0101(67.40) | IVASVNTTS/DRB1*0401(80.83) | SVNTTSRLL/DRB1*0701(26.19) | VNTTSRLLL/DRB1*1101(182.55) |
| RGYISTRVGMGEAAA | YISTRVGMG/DRB1*0101(108.45) | YISTRVGMG/DRB1*0401(174.79) | YISTRVGMG/DRB1*0701(142.72) | YISTRVGMG/DRB1*1101(122.88) |
| PIRYQTPAVKSEHTG | IRYQTPAVK/DRB1*0101(82.22) | IRYQTPAVK/DRB1*1101(359.26) | | |
| QGKCATCYNMMGKR | CVYNMMGKR/DRB1*1101(432.44) | | | |
| KRGLRTLILAPTRVV | LILAPTRVV/DRB1*0401(98.77) | LILAPTRVV/DRB1*0701(18.01) | LRTLILAPT/DRB1*0101(3.73) | TLILAPTRV/DRB1*1101(26.95) |
| RLNDTWKIEKASFIE | WKIEKASFI/DRB1*0101(144.53) | WKIEKASFI/DRB1*0701(269.45) | | |

FIG. 50-97

| peptide | core/HLA(affinity(nM)) | core/HLA(affinity(nM)) | core/HLA(affinity(nM)) |
|---|---|---|---|
| NKCTLMAMDLGEMCD | KCTLMAMDL/DRB1*0101(293.34) | | |
| LAPTRVVASEMAEAL | TRVVASEMA/DRB1*0101(154.71) | | |
| SNASGNIVSSVNMIS | IVSSVNMIS/DRB1*0401(222.49) | NIVSSVNMI/DRB1*0101(351.14) | NIVSSVNMI/DRB1*0701(102.32) |
| TRTEQYKFQPESPAR | YKFQPESPA/DRB1*0101(167.27) | YKFQPESPA/DRB1*0401(446.55) | |
| KTFVDLMKRGDLPVW | FVDLMKRGD/DRB1*1101(299.40) | | |
| IAARGYISTRVGMGE | ARGYISTRV/DRB1*0101(241.55) | YISTRVGMG/DRB1*0401(411.75) | YISTRVGMG/DRB1*0701(161.05) | YISTRVGMG/DRB1*1101(203.01) |
| AYTALFSGVSWMIRI | LFSGVSWMI/DRB1*0401(334.07) | LFSGVSWMI/DRB1*0701(12.51) | YTALFSGVS/DRB1*0101(11.70) | YTALFSGVS/DRB1*1101(91.69) |
| GCGLFGKGSLITCAK | FGKGSLITC/DRB1*0101(68.05) | FGKGSLITC/DRB1*0701(428.25) | LFGKGSLIT/DRB1*0701(242.65) | |
| GPERVILAGPMPVTA | RVILAGPMP/DRB1*0101(44.30) | | | |
| KPVILTDGPERVILA | ILTDGPERV/DRB1*0101(301.42) | | | |
| VLMGLGKGWPLSKMD | MGLGKGWPL/DRB1*0101(71.11) | | | |
| ALCEALTLATGPITT | LTLATGPIT/DRB1*0101(47.69) | LTLATGPIT/DRB1*0401(457.45) | LTLATGPIT/DRB1*0701(256.04) | |
| HHAYSRGSAKLRWFV | AVSRGSAKL/DRB1*0101(97.09) | AVSRGSAKL/DRB1*0701(217.66) | AVSRGSAKL/DRB1*1101(111.05) | |
| EFCKKVRSNAAMGAV | CKKVRSNAA/DRB1*0101(18.89) | FCKKVRSNA/DRB1*1101(61.92) | VRSNAAMGA/DRB1*0401(83.27) | VRSNAAMGA/DRB1*0701(107.97) |
| IANCLRKSGKKVIQL | CLRKSGKKV/DRB1*0101(279.62) | CLRKSGKKV/DRB1*0101(45.62) | LRKSGKKVI/DRB1*0701(236.30) | |
| TWAYHGSYEVKPTGS | WAYHGSYEV/DRB1*0101(480.75) | | | |
| YAIIGPGLQAKATRE | YAIIGPGLQ/DRB1*0101(58.68) | YAIIGPGLQ/DRB1*1101(382.05) | | |
| DVPLAGPMVAGGLLL | DVPLAGPMV/DRB1*0101(206.37) | | | |
| AGHLKCRLKMDKLTL | GHLKCRLKM/DRB1*1101(68.82) | KCRLKMDKL/DRB1*0101(280.17) | | |
| EDHWFSRENSLSGVE | WFSRENSLS/DRB1*0101(361.78) | WFSRENSLS/DRB1*0401(151.60) | | |
| KVWGLYGNGVVTKNG | VWGLYGNGV/DRB1*0101(97.43) | | | |

FIG. 50-98

| peptide | core/HLA(affinity(nM)) | core/HLA(affinity(nM)) | core/HLA(affinity(nM)) |
|---|---|---|---|
| LKRERNRVSTGSQLA | NRVSTGSQL/DRB1*0701(306.39) | | |
| VEAGRTLRVLSLVEN | AGRTLRVLS/DRB1*1101(377.41) | GRTLRVLSL/DRB1*0101(131.47) | VEAGRTLRV/DRB1*0701(451.73) |
| GWNLVKLMSGKDVFY | LVKLMSGKD/DRB1*0401(404.20) | LVKLMSGKD/DRB1*0701(136.49) | LVKLMSGKD/DRB1*1101(73.00) | VKLMSGKDV/DRB1*0101(8.80) |
| LRTLILAPTRVVASE | LILAPTRVV/DRB1*0101(3.14) | LILAPTRVV/DRB1*0401(44.49) | LILAPTRVV/DRB1*0701(20.86) | LILAPTRVV/DRB1*1101(16.60) |
| PESPSRLSAAIGKAW | PSRLSAAIG/DRB1*0101(170.24) | | |
| CGSGIFVVDNVHTWT | IFVVDNVHT/DRB1*0101(301.98) | IFVVDNVHT/DRB1*0401(313.68) | |
| EAGRTLRVLNLVENW | GRTLRVLNL/DRB1*0101(276.47) | | |
| CDHRLMSAAIKDSKA | HRLMSAAIK/DRB1*0101(40.48) | HRLMSAAIK/DRB1*1101(461.01) | RLMSAAIKD/DRB1*0701(449.83) |
| ATVLMGLGRGWPLHR | LMGLGRGWP/DRB1*1101(264.54) | MGLGRGWPL/DRB1*0101(38.70) | MGLGRGWPL/DRB1*0701(219.99) |
| KCGSGIFVTDNVHTW | IFVTDNVHT/DRB1*0401(461.86) | | |
| ETILMLLTLLATVTGG | LLTLLATVT/DRB1*0101(73.30) | | |
| SGVSGNIVSSVNTIS | IVSSVNTIS/DRB1*0101(385.61) | IVSSVNTIS/DRB1*0401(217.38) | NIVSSVNTI/DRB1*0701(99.01) |
| WLVHRQWFLNLPLPW | LVHRQWFLN/DRB1*1101(334.54) | RQWFLNLPL/DRB1*0101(203.88) | WLVHRQWFL/DRB1*0701(170.36) |
| FAGHLKCRLKMDKLT | FAGHLKCRL/DRB1*0101(464.41) | GHLKCRLKM/DRB1*1101(68.89) | |
| HVGMGLETRAQTWMS | GMGLETRAQ/DRB1*0101(444.89) | | |
| RSVALTPHSGMGLDT | SVALTPHSG/DRB1*0101(185.88) | | |
| CLRKSGKRVIQLSRK | LRKSGKRVI/DRB1*0701(491.77) | LRKSGKRVI/DRB1*1101(103.46) | |
| NGVVKLLTKPWDVIP | KLLTKPWDV/DRB1*0701(371.74) | VVKLLTKPW/DRB1*0101(284.65) | VVKLLTKPW/DRB1*1101(112.85) |
| GGALVRCPLSRNSTH | LVRCPLSRN/DRB1*1101(359.42) | LVRCPLSRN/DRB1*1101(166.77) | |
| LAAIANQAVVLMGLG | LAAIANQAV/DRB1*0101(33.83) | LAAIANQAV/DRB1*0701(392.32) | |
| RLTIMDLHPGAGKTK | LTIMDLHPG/DRB1*0101(102.13) | LTIMDLHPG/DRB1*1101(414.99) | |

FIG. 50-99

| peptide | core/HLA(affinity(nM)) | core/HLA(affinity(nM)) | core/HLA(affinity(nM)) |
|---|---|---|---|
| NVKKDLISYGGGWRF | ISYGGGWRF/DRB1*0701(283.55) | LISYGGGWR/DRB1*0101(440.45) | |
| QFCIKILNPYMPSVV | CIKILNPYM/DRB1*0101(17.45) | CIKILNPYM/DRB1*0401(156.30) | CIKILNPYM/DRB1*0701(137.34) | CIKILNPYM/DRB1*1101(89.20) |
| FHTMWHVTRGAVLMH | MWHVTRGAV/DRB1*1101(15.70) | WHVTRGAVL/DRB1*0101(4.46) | WHVTRGAVL/DRB1*0701(7.38) |
| LRETACLGKAYAQMW | TACLGKAYA/DRB1*0101(216.34) | TACLGKAYA/DRB1*1101(387.20) | |
| RTTWSIHASHEWMTT | WSIHASHEW/DRB1*0101(389.50) | WSIHASHEW/DRB1*0701(184.50) | |
| YWVSNASGNIVSSVN | WVSNASGNI/DRB1*0101(151.81) | WVSNASGNI/DRB1*0701(138.11) | |
| HHQWMTTEDMLTVWN | WMTTEDMLT/DRB1*0101(146.43) | WMTTEDMLT/DRB1*0401(142.26) | |
| NGVWRLLTKPWDVVP | RLLTKPWDV/DRB1*0701(347.27) | WRLLTKPW/DRB1*0101(168.12) | WRLLTKPW/DRB1*1101(50.93) |
| PMAGPLVAGGLLIAC | PLVAGGLLI/DRB1*0101(220.25) | | |
| VLTLATGPVMTLWEG | VLTLATGPV/DRB1*0101(34.55) | VLTLATGPV/DRB1*0701(365.50) | |
| ANLSLTAIANQAAIL | LTAIANQAA/DRB1*0401(40.04) | LTAIANQAA/DRB1*0701(120.75) | SLTAIANQA/DRB1*0101(7.85) |
| LAMGCYSQVNPTTLT | CYSQVNPTT/DRB1*0401(133.42) | YSQVNPTTL/DRB1*0101(30.12) | YSQVNPTTL/DRB1*0701(46.79) |
| AFCESLTLATGPVLT | FCESLTLAT/DRB1*0401(173.46) | LTLATGPVL/DRB1*0101(20.25) | LTLATGPVL/DRB1*0701(76.65) |
| LPAIVREAIKRKLRT | IVREAIKRK/DRB1*0101(290.49) | IVREAIKRK/DRB1*1101(39.39) | |
| GCYSQVNPITLTAAL | CYSQVNPIT/DRB1*0401(215.65) | YSQVNPITL/DRB1*0101(24.19) | YSQVNPITL/DRB1*0701(67.85) |
| GQMFESTYRGAKRMA | FESTYRGAK/DRB1*1101(73.82) | | |
| STRVEMGEAAAIFMT | VEMGEAAAI/DRB1*0101(23.68) | | |
| PMALKDFKEFASGRK | FKEFASGRK/DRB1*0701(433.74) | FKEFASGRK/DRB1*1101(487.90) | |
| SLIGLTSRATWAQNI | LIGLTSRAT/DRB1*0101(4.76) | LIGLTSRAT/DRB1*0401(247.79) | LIGLTSRAT/DRB1*0701(298.02) | LIGLTSRAT/DRB1*1101(46.67) |
| SMVNGVVKLLTKPWD | SMVNGVVKL/DRB1*0101(451.99) | VNGVVKLLT/DRB1*1101(129.43) | |
| TSRITWSIHATHEWM | WSIHATHEW/DRB1*0701(323.80) | | |

FIG. 50-100

| peptide | core/HLA(affinity(nM)) | core/HLA(affinity(nM)) | core/HLA(affinity(nM)) |
|---|---|---|---|
| SWPLNEAVMAVGVVS | WPLNEAVMA/DRB1*0101(186.64) | | |
| CEALTLATGPITTLW | LTLATGPIT/DRB1*0101(11.19) | LTLATGPIT/DRB1*0401(285.08) | LTLATGPIT/DRB1*0701(117.13) |
| TFKTAHAKKQEVVVL | FKTAHAKKQ/DRB1*0101(91.90) | FKTAHAKKQ/DRB1*0701(226.12) | FKTAHAKKQ/DRB1*1101(88.90) |
| IHKMDLGVPLLALGC | MDLGVPLLA/DRB1*0101(31.88) | | |
| TLETLLLALLGAMT | LLALLGAMT/DRB1*0101(26.23) | | |
| LIVLIPEPDRQRTP | IVLLIPEPD/DRB1*0101(82.89) | | |
| KVDIGVPLLAMGCYS | VDIGVPLLA/DRB1*0101(139.71) | | |
| SVNTISKMLINRFTM | ISKMLINRF/DRB1*0101(25.80) | ISKMLINRF/DRB1*0401(221.41) | ISKMLINRF/DRB1*0701(85.99) | ISKMLINRF/DRB1*1101(63.08) |
| GVMAYGLVSLLGSSL | LVSLLGSSL/DRB1*0101(8.81) | LVSLLGSSL/DRB1*0701(172.41) | |
| ANQAAILMGLGKGWP | AILMGLGKG/DRB1*0101(419.84) | | |
| DVLPMVTQIAMTDTT | VLPMVTQIA/DRB1*0101(100.89) | | |
| FQEGTFHITMWHVTRG | FHITMWHVTR/DRB1*0101(31.82) | FHITMWHVTR/DRB1*0701(229.12) | FHITMWHVTR/DRB1*1101(40.06) |
| ANLSLAAIANQAAIL | LAAIANQAA/DRB1*0101(8.40) | LAAIANQAA/DRB1*0401(57.37) | LAAIANQAA/DRB1*0701(188.10) |
| SVALTPHSGTGLETR | LTPHSGTGL/DRB1*0101(208.49) | | |
| RVPNYNLVWMDEAHF | YNLVWMDEA/DRB1*0101(391.04) | | |
| TIAVSTANIFRGSYL | ANIFRGSYL/DRB1*0101(211.92) | IAVSTANIF/DRB1*0701(96.39) | |
| RKSGKRVIQLSRKTF | RVIQLSRKT/DRB1*1101(27.27) | | |
| EKRSVALVPHVGMGL | LVPHVGMGL/DRB1*0701(262.88) | SVALVPHVG/DRB1*0101(69.62) | |
| VLCAVQLLLMRTSWA | LLMRTSWA/DRB1*0701(18.92) | LLLMRTSWA/DRB1*0401(156.39) | VQLLLMRTS/DRB1*1101(87.37) |
| SGKTRKYLPAIIREA | TRKYLPAII/DRB1*0101(46.15) | TRKYLPAII/DRB1*0701(342.06) | TRKYLPAII/DRB1*1101(157.63) |
| IVGLYGNGVTRSGA | IVGLYGNGV/DRB1*0101(82.72) | LYGNGVTR/DRB1*0401(462.21) | |

FIG. 50-101

| peptide | core/HLA(affinity(nM)) | core/HLA(affinity(nM)) | core/HLA(affinity(nM)) |
|---|---|---|---|
| PQWIASAIILEFFLI | WIASAIILE/DRB1*0101(211.56) | WIASAIILE/DRB1*0701(156.64) | |
| LGEFGKAKGSRAIWY | FGKAKGSRA/DRB1*0101(9.25) | FGKAKGSRA/DRB1*0701(274.71) | FGKAKGSRA/DRB1*1101(116.53) |
| CTREEFIKKVRTNAA | FIKKVRTNA/DRB1*1101(44.09) | IKKVRTNAA/DRB1*0101(306.64) | IKKVRTNAA/DRB1*0701(261.81) |
| ACVVITGRSADLELE | VITGRSADL/DRB1*0101(27.68) | YVITGRSAD/DRB1*1101(101.98) | |
| TFKNAHAKRQDVVL | FKNAHAKRQ/DRB1*0101(172.56) | FKNAHAKRQ/DRB1*0701(372.74) | FKNAHAKRQ/DRB1*1101(219.09) |
| GWPLHRVDLGVPLLA | HRVDLGVPL/DRB1*0101(104.62) | HRVDLGVPL/DRB1*0701(312.91) | |
| IRYQTPAIRAEHTGR | IRYQTPAIR/DRB1*0101(136.12) | IRYQTPAIR/DRB1*1101(392.54) | |
| GLLSGRGPLKLFMAL | LLSGRGPLK/DRB1*0101(51.15) | LSGRGPLKL/DRB1*0701(279.06) | LSGRGPLKL/DRB1*1101(356.09) |
| ANISLTAIANQAVVL | LTAIANQAV/DRB1*0101(7.88) | LTAIANQAV/DRB1*0401(79.05) | LTAIANQAV/DRB1*0701(44.24) |
| FLMVLVPEPEKQRT | MVLLVPEPE/DRB1*0101(155.18) | | |
| EMYWVSGVSGNIVSS | WVSGVSGNI/DRB1*0101(54.26) | WVSGVSGNI/DRB1*0401(456.59) | WVSGVSGNI/DRB1*0701(80.25) |
| MKLVMAFIAFLRFLA | FIAFLRFLA/DRB1*1101(47.02) | VMAFIAFLR/DRB1*0101(61.20) | VMAFIAFLR/DRB1*0701(191.62) |
| SLLGSSLLKNDVPLA | LLKNDVPLA/DRB1*0101(165.52) | LLKNDVPLA/DRB1*0401(285.73) | |
| VGVGVFQEGTFHTMW | VFQEGTFHT/DRB1*0101(250.58) | | |
| GARYLEFEALGFMNE | YLEFEALGF/DRB1*0101(99.64) | YLEFEALGF/DRB1*0701(491.55) | |
| CGSLIGLSSRATWAK | LIGLSSRAT/DRB1*0101(2.25) | LIGLSSRAT/DRB1*0401(104.84) | LIGLSSRAT/DRB1*0701(174.64) | LIGLSSRAT/DRB1*1101(17.85) |
| RGPSLRTTTVSGKLI | SLRTTTVSG/DRB1*0101(272.82) | SLRTTTVSG/DRB1*0401(255.10) | TTTVSGKLI/DRB1*0701(48.06) |
| GSGKTRKYLPAIVRE | TRKYLPAIV/DRB1*0101(102.64) | TRKYLPAIV/DRB1*1101(275.98) | |
| YRIKQKGIFGKTQVG | IKQKGIFGK/DRB1*1101(142.70) | RIKQKGIFG/DRB1*0101(458.25) | |
| EKKLGEFGKAKGSRA | FGKAKGSRA/DRB1*0101(149.39) | | |
| TWTEQYKFQPESPSR | YKFQPESPS/DRB1*0101(440.92) | | |

FIG. 50-102

| peptide | core/HLA(affinity(nM)) | core/HLA(affinity(nM)) | core/HLA(affinity(nM)) |
|---|---|---|---|
| ANQAVVLMGLGKGWP | WLMGLGKG/DRB1*0101(281.19) | | |
| VLMGLGKGWPISKVD | MGLGKGWPI/DRB1*0101(111.96) | MGLGKGWPI/DRB1*0701(474.70) | |
| SWSGVEGEGLHRLGY | WSGVEGEGL/DRB1*0101(465.56) | | |
| TPQDNQLAYVVIGLL | LAYVVIGLL/DRB1*0701(353.91) | QDNQLAYVV/DRB1*0101(166.29) | |
| SPNPTVEAGRTLRVL | VEAGRTLRV/DRB1*0101(194.11) | VEAGRTLRV/DRB1*0701(178.91) | |
| SMANIFRGSYLAGAG | FRGSYLAGA/DRB1*0401(426.02) | IFRGSYLAG/DRB1*0101(81.36) | NIFRGSYLA/DRB1*0101(224.03) |
| SGIFVIDNVHTRTEQ | FVIDNVHTR/DRB1*0401(92.14) | FVIDNVHTR/DRB1*1101(239.28) | IFVIDNVHT/DRB1*0101(95.21) |
| GIMAIGIVSILASSL | IVSILASSL/DRB1*0101(13.39) | IVSILASSL/DRB1*0401(232.34) | IVSILASSL/DRB1*0701(33.94) | IVSILASSL/DRB1*1101(484.42) |
| TKHAVSRGSSKIRWF | AVSRGSSKI/DRB1*0701(240.19) | AVSRGSSKI/DRB1*1101(277.70) | |
| EMYWISNGTGNIVAS | WISNGTGNI/DRB1*0101(66.33) | WISNGTGNI/DRB1*0401(240.61) | WISNGTGNI/DRB1*0701(104.24) |
| GVGVFQEGTFHTMWH | VFQEGTFHT/DRB1*0101(187.59) | | |
| IFRGSYLAGAGLAFS | FRGSYLAGA/DRB1*0401(437.22) | GSYLAGAGL/DRB1*0101(13.71) | YLAGAGLAF/DRB1*0701(414.80) |
| RFLAIPPTAGILKRW | FLAIPPTAG/DRB1*0101(3.72) | FLAIPPTAG/DRB1*0401(49.66) | FLAIPPTAG/DRB1*0701(58.71) | FLAIPPTAG/DRB1*1101(72.32) |
| LRTTASGKLVTQWC | TTTASGKLV/DRB1*0101(437.89) | TTTASGKLV/DRB1*0701(407.76) | |
| TNMEVQLIRQMEAEG | VQLIRQMEA/DRB1*0101(258.83) | VQLIRQMEA/DRB1*1101(413.08) | |
| TVQQLTKRFSLGLLS | KRFSLGLLS/DRB1*0101(112.74) | LTKRFSLGL/DRB1*0701(67.85) | VQQLTKRFS/DRB1*1101(49.86) |
| EMEEALKGMPIRYQT | EEALKGMPI/DRB1*0101(66.91) | LKGMPIRYQ/DRB1*1101(444.66) | |
| WYGMEIRPINEKEEN | WYGMEIRPI/DRB1*0101(320.56) | | |
| KRFSSELLSGRGPLK | SSELLSGRG/DRB1*0101(144.24) | | |
| IYDSKFEKQLGQVML | FEKQLGQVM/DRB1*0101(36.62) | | |
| AVATTIVTPMLRHTI | ATTIVTPML/DRB1*0101(204.73) | ATTIVTPML/DRB1*0701(139.81) | VTPMLRHTI/DRB1*1101(105.81) |

FIG. 50-103

| peptide | core/HLA(affinity(nM)) | core/HLA(affinity(nM)) | core/HLA(affinity(nM)) |
|---|---|---|---|
| VATTVLTPMLRHSIE | LTPMLRHSI/DRB1*0101(163.19) | LTPMLRHSI/DRB1*1101(69.33) | TVLTPMLRH/DRB1*0701(196.61) |
| IPMVTQMAMTDTTPF | MVTQMAMTD/DRB1*0101(166.00) | | |
| PWDVVPMVTQLAMTD | VVPMVTQLA/DRB1*0101(37.12) | VVPMVTQLA/DRB1*0401(352.83) | |
| ATGNIVSSVNMVSRM | IVSSVNMYS/DRB1*0401(114.86) | IVSSVNMVS/DRB1*1101(430.70) | NIVSSVNMV/DRB1*0701(104.84) |
| QVMLLVLCAVQLLLM | LLVLCAVQL/DRB1*0101(225.45) | | |
| LKRRLRTLILAPTRV | LKRRLRTLI/DRB1*1101(14.64) | LRTLILAPT/DRB1*0401(120.64) | TLILAPTRV/DRB1*0701(38.17) |
| GTFHTMWHVTRGAVL | FHTMWHVTR/DRB1*0101(10.49) | FHTMWHVTR/DRB1*1101(18.17) | WHVTRGAVL/DRB1*0701(14.52) |
| QPESPSRLSAAIGKA | PSRLSAAIG/DRB1*0101(327.19) | | |
| LQWIASAIVLEFFLM | LQWIASAIV/DRB1*0101(41.84) | LQWIASAIV/DRB1*0701(62.24) | |
| GWVRLLTKPWDVVPM | RLLTKPWDV/DRB1*0701(325.87) | VVRLLTKPW/DRB1*0101(208.80) | VVRLLTKPW/DRB1*1101(74.21) |
| TTWAFCEVLTLATGP | FCEVLTLAT/DRB1*0101(91.96) | FCEVLTLAT/DRB1*0401(210.34) | FCEVLTLAT/DRB1*0701(242.36) |
| TRVGMGEAAAIFMTA | VGMGEAAAI/DRB1*0101(103.17) | | |
| LRPRWLDARIYSDPL | PRWLDARIY/DRB1*0101(495.11) | | |
| GWNIVKLHSGKDVFF | IVKLHSGKD/DRB1*0101(76.77) | IVKLHSGKD/DRB1*0701(105.42) | WNIVKLHSG/DRB1*1101(115.45) |
| PTSRTTWSIHAKHQW | SRTTWSIHA/DRB1*0701(489.03) | TTWSIHAKH/DRB1*1101(160.81) | |
| GGAWDLVLEHGGCV | WVDLVLEHG/DRB1*0101(417.52) | | |
| SQEGAMHSALAGATE | EGAMHSALA/DRB1*0101(294.50) | | |
| EALKGLPIRYQTTAV | LKGLPIRYQ/DRB1*0101(57.75) | LKGLPIRYQ/DRB1*0401(293.65) | LKGLPIRYQ/DRB1*1101(153.21) |
| THEMYWISNGTGNIV | MYWISNGTG/DRB1*0101(67.70) | MYWISNGTG/DRB1*0401(202.65) | WISNGTGNI/DRB1*0701(116.22) |
| ERNETWKLEKASFIE | WKLEKASFI/DRB1*0101(76.61) | WKLEKASFI/DRB1*0701(231.37) | |
| IHMENVFHTMWHVTR | FHTMWHVTR/DRB1*0101(32.01) | FHTMWHVTR/DRB1*0401(442.81) | FHTMWHVTR/DRB1*1101(44.19) | VFHTMWHVT/DRB1*0701(83.52) |

FIG. 50-104

| peptide | core/HLA(affinity(nM)) | core/HLA(affinity(nM)) | core/HLA(affinity(nM)) |
|---|---|---|---|
| DLWCGSLIGLSSRAT | LIGLSSRAT/DRB1*0101(6.02) | LIGLSSRAT/DRB1*0401(316.73) | LIGLSSRAT/DRB1*0701(303.88) | LIGLSSRAT/DRB1*1101(122.04) |
| EGAMHTALTGATEIQ | MHTALTGAT/DRB1*0101(175.73) | | | |
| IACYVITGTSADLTV | CYVITGTSA/DRB1*0101(26.22) | YVITGTSAD/DRB1*0401(98.30) | YVITGTSAD/DRB1*0701(84.98) | |
| STHEMYWISNGTGNI | MYWISNGTG/DRB1*0101(157.79) | MYWISNGTG/DRB1*0401(314.72) | YWISNGTGN/DRB1*0701(276.31) | |
| MMRTTWALCESITLA | WALCESITL/DRB1*0101(87.97) | WALCESITL/DRB1*0701(106.71) | | |
| FQPESPKRLSAAIGK | FQPESPKRL/DRB1*0101(205.42) | | | |
| LLMRTSWAFCEALTL | WAFCEALTL/DRB1*0101(127.96) | WAFCEALTL/DRB1*0701(176.00) | | |
| GKAYAQMWSLMYFHR | YAQMWSLMY/DRB1*0101(13.34) | YAQMWSLMY/DRB1*0401(147.00) | YAQMWSLMY/DRB1*0701(122.19) | YAQMWSLMY/DRB1*1101(63.53) |
| LFMGHLKCRLRMDKL | FMGHLKCRL/DRB1*0101(102.95) | FMGHLKCRL/DRB1*0701(352.59) | GHLKCRLRM/DRB1*1101(29.41) | |
| ARIYADPMALKDFKE | IYADPMALK/DRB1*0101(216.29) | IYADPMALK/DRB1*0401(422.07) | | |
| WQQVPFCSHHFHELI | FCSHHFHEL/DRB1*0701(165.88) | | | |
| ENPYKTWAYHGSYEV | WAYHGSYEV/DRB1*0101(377.54) | WAYHGSYEV/DRB1*0701(225.13) | | |
| INMLKRVRNRVSTVQ | LKRVRNRVS/DRB1*0101(36.09) | LKRVRNRVS/DRB1*0401(310.86) | LKRVRNRVS/DRB1*1101(6.60) | MLKRVRNRV/DRB1*0701(54.90) |
| AACLRKNGKRVIQLS | LRKNGKRVI/DRB1*1101(103.54) | | | |
| LLFLNDMGKVRKDIP | FLNDMGKVR/DRB1*0101(156.60) | FLNDMGKVR/DRB1*1101(322.09) | | |
| IFVADNVHTRTEQYQ | FVADNVHTR/DRB1*0401(248.47) | IFVADNVHT/DRB1*0101(422.18) | | |
| TGSASSMYNGVVKLL | ASSMYNGVV/DRB1*0101(372.73) | | | |
| RTTWSIHATHEWMTT | WSIHATHEW/DRB1*0701(206.65) | | | |
| MSTYGWNIVKLHSGK | WNIVKLHSG/DRB1*0701(426.11) | YGWNIVKLH/DRB1*0101(229.62) | YGWNIVKLH/DRB1*0401(393.87) | YGWNIVKLH/DRB1*1101(79.00) |
| KRFSKGLFSGQGPMK | FSKGLFSGQ/DRB1*0101(155.89) | | | |
| SLMYFHRRDLRLAAN | YFHRRDLRL/DRB1*0101(22.79) | YFHRRDLRL/DRB1*0401(493.07) | YFHRRDLRL/DRB1*0701(42.07) | YFHRRDLRL/DRB1*1101(10.06) |

FIG. 50-105

| peptide | core/HLA(affinity(nM)) | core/HLA(affinity(nM)) | core/HLA(affinity(nM)) |
|---|---|---|---|
| LIMKDGRSLVVPCRN | LIMKDGRSL/DRB1*0101(247.70) | | |
| IFKRRLTIMDLHPG | FRKRRLTIM/DRB1*0701(303.05) | LTIMDLHPG/DRB1*0101(146.81) | |
| WPLSKMDLGVPLLAL | SKMDLGVPL/DRB1*0101(31.72) | | |
| SQILLMRTTWAFCEV | ILLMRTTWA/DRB1*0101(52.91) | LMRTTWAFC/DRB1*0701(285.22) | SQILLMRTT/DRB1*1101(219.58) |
| LYAVATTFITPMLRH | LYAVATTFI/DRB1*0701(57.67) | YAVATTFI/DRB1*0101(119.13) | YAVATTFIT/DRB1*0401(352.59) |
| KNETWKLEKASFIEV | WKLEKASFI/DRB1*0401(31.44) | WKLEKASFI/DRB1*0701(134.83) | |
| HPGAGKTKRILPSIV | TKRILPSIV/DRB1*0101(161.28) | TKRILPSIV/DRB1*0701(238.19) | TKRILPSIV/DRB1*1101(340.70) |
| SLRTTASGKLIHEW | TTTASGKLI/DRB1*0101(188.09) | | |
| QEGTFHTMWHVTRGA | FHTMWHVTR/DRB1*0401(485.31) | FHTMWHVTR/DRB1*0701(255.83) | FHTMWHVTR/DRB1*1101(25.99) |
| VGLVSILLSSLLRND | ILLSSLLRN/DRB1*0401(449.78) | LVSILLSSL/DRB1*1101(194.18) | VSILLSSL/DRB1*0701(14.12) | VSILLSSL/DRB1*0701(150.53) |
| ESLTLATGPVLTLWE | LTLATGPVL/DRB1*0101(13.61) | LTLATGPVL/DRB1*0701(109.81) | |
| SSLLKNDVPLAGPMV | LLKNDVPLA/DRB1*0101(39.43) | LLKNDVPLA/DRB1*0401(71.99) | |
| STHEMYWVSCGTGNI | YWVSCGTGN/DRB1*0701(418.76) | | |
| TRVEMGEAAAIFMTA | VEMGEAAAI/DRB1*0101(40.75) | | |
| LGRSQVGVGIHMENV | SQVGVGIHM/DRB1*0101(302.39) | | |
| WNTTIAVSMANIFRG | AVSMANIFR/DRB1*0401(408.38) | IAVSMANIF/DRB1*0101(47.77) | |
| FLTIPPTAGILARWS | FLTIPPTAG/DRB1*0101(15.61) | FLTIPPTAG/DRB1*0401(300.12) | FLTIPPTAG/DRB1*0701(342.37) | FLTIPPTAG/DRB1*1101(337.04) |
| HGGCVTTIAKNKPTL | CVTTIAKNK/DRB1*1101(371.59) | | |
| PQGLVKRFSTGLLNG | LVKRFSTGL/DRB1*0101(46.78) | VKRFSTGLL/DRB1*0401(325.47) | VKRFSTGLL/DRB1*0701(46.06) | VKRFSTGLL/DRB1*1101(161.34) |
| KRSVALAPHVGMGLE | LAPHVGMGL/DRB1*0701(312.75) | SVALAPHVG/DRB1*0101(39.10) | |
| TVWFVPSIKAGNDIA | FVPSIKAGN/DRB1*1101(47.46) | VWFVPSIKA/DRB1*0101(48.89) | VWFVPSIKA/DRB1*0401(297.83) | VWFVPSIKA/DRB1*0701(266.96) |

FIG. 50-106

| peptide | core/HLA(affinity(nM)) | core/HLA(affinity(nM)) | core/HLA(affinity(nM)) |
|---|---|---|---|
| FCSHHFHKIFMKDGR | FCSHHFHKI/DRB1*0701(132.82) | HHFHKIFMK/DRB1*0101(342.27) | HHFHKIFMK/DRB1*1101(75.80) |
| FEATARGARRMAILG | TARGARRMA/DRB1*1101(112.43) | | |
| WTLYAVATTVLTPML | YAVATTVLI/DRB1*0101(12.49) | YAVATTVLI/DRB1*0401(70.02) | YAVATTVLI/DRB1*0701(27.89) | YAVATTVLI/DRB1*1101(246.91) |
| VDWLEHGGCVTTMA | WLEHGGCV/DRB1*0101(370.20) | | |
| CYVITGTSADLIVEK | CYVITGTSA/DRB1*0101(41.64) | YVITGTSAD/DRB1*0401(204.18) | YVITGTSAD/DRB1*0701(170.54) |
| LMRITWAFCEVLTLA | WAFCEVLTL/DRB1*0101(226.23) | WAFCEVLTL/DRB1*0701(199.17) | |
| PMTGPLVAGGLLTVC | TGPLVAGGL/DRB1*0101(271.07) | | |
| GSAYTALFSGVSWMI | LFSGVSWMI/DRB1*0701(22.49) | YTALFSGVS/DRB1*0101(6.70) | YTALFSGVS/DRB1*0401(284.01) | YTALFSGVS/DRB1*1101(49.45) |
| PAMVREAIRRGLRTL | MVREAIRRG/DRB1*0101(366.73) | MVREAIRRG/DRB1*1101(60.20) | |
| ISEMGANFRAERVID | ISEMGANFR/DRB1*0101(412.19) | | |
| SSLRTITVSGKLIHE | TITVSGKLI/DRB1*0101(271.40) | TITVSGKLI/DRB1*0701(66.32) | |
| KLMSAAIKDQRAVHA | IKDQRAVHA/DRB1*0101(151.12) | | |
| PGSGKTRKYLPAIIR | TRKYLPAII/DRB1*0101(164.21) | TRKYLPAII/DRB1*0701(444.26) | TRKYLPAII/DRB1*1101(328.53) |
| RGPSLRTITVTGKII | LRTITVTGK/DRB1*0701(58.05) | SLRTITVTG/DRB1*0101(494.90) | SLRTITVTG/DRB1*0401(344.56) |
| EFGRAKGSRAIWYMW | FGRAKGSRA/DRB1*0101(21.25) | FGRAKGSRA/DRB1*0701(196.10) | FGRAKGSRA/DRB1*1101(159.63) |
| RILPSWREAIKRGL | WREAIKRG/DRB1*1101(321.97) | | |
| PIRVPNYNLVIMDEA | PIRVPNYNL/DRB1*0101(458.22) | | |
| HAVSRGSAKLRWIVE | AVSRGSAKL/DRB1*0101(198.25) | AVSRGSAKL/DRB1*0701(322.54) | VSRGSAKLR/DRB1*1101(232.55) |
| ETTMRGAKRMAILGD | MRGAKRMAI/DRB1*1101(45.36) | TMRGAKRMA/DRB1*0101(249.76) | |
| RPASAWTLYAVATTV | AWTLYAVAT/DRB1*0101(59.15) | TLYAVATTV/DRB1*0701(223.77) | |
| LYGNGVTTSGTYVS | WTTSGTYV/DRB1*0101(377.18) | WTTSGTYV/DRB1*0701(169.27) | |

FIG. 50-107

| peptide | core/HLA(affinity(nM)) | core/HLA(affinity(nM)) | core/HLA(affinity(nM)) |
|---|---|---|---|
| VTQVLLMRTTWALCE | LLMRTTWAL/DRB1*0701(425.01) | TQVLLMRTT/DRB1*1101(145.95) | VLLMRTTWA/DRB1*0101(51.92) |
| RMVTFKVPHAKKQDV | MVTFKVPHA/DRB1*0101(53.18) | MVTFKVPHA/DRB1*0401(184.41) | MVTFKVPHA/DRB1*0701(250.34) | MVTFKVPHA/DRB1*1101(31.61) |
| PVWLAHKVAAEGINY | AHKVAAEGI/DRB1*0701(449.09) | WLAHKVAAE/DRB1*0101(200.38) | | |
| EGSPGRFWNTTIAYS | FWNTTIAYS/DRB1*0401(411.76) | FWNTTIAYS/DRB1*0701(328.68) | | |
| HWFSRGNSLSGVEGE | FSRGNSLSG/DRB1*0401(411.11) | HWFSRGNSL/DRB1*0101(138.40) | HWFSRGNSL/DRB1*0701(298.26) | |
| ICGIRSTRLENLMW | CGIRSTRL/DRB1*0701(212.77) | IRSTRLEN/DRB1*1101(105.47) | | |
| GIFVIDNVHTRFEQY | FVIDNVHTR/DRB1*0401(142.02) | FVIDNVHTR/DRB1*1101(289.02) | IFVIDNVHT/DRB1*0101(148.60) | |
| GKELKCGSGIFITDN | LKCGSGIFI/DRB1*0101(248.95) | | | |
| TIIVTPMLRHTIENS | VTPMLRHTI/DRB1*0101(443.19) | VTPMLRHTI/DRB1*1101(126.32) | | |
| EALTLATGPITTLWE | LTLATGPIT/DRB1*0101(18.59) | LTLATGPIT/DRB1*0401(423.07) | LTLATGPIT/DRB1*0701(171.87) | |
| FHELIMKDGRSLVVP | LIMKDGRSL/DRB1*0101(51.59) | LIMKDGRSL/DRB1*0701(252.80) | LIMKDGRSL/DRB1*1101(315.18) | |
| TWLVHRQWFLDLPLP | WLVHRQWFL/DRB1*0101(306.39) | WLVHRQWFL/DRB1*0701(164.93) | | |
| QATVLMGLGKGWPIS | MGLGKGWPI/DRB1*0101(129.10) | | | |
| GNIYADDTAGWDTRI | IYADDTAGW/DRB1*0401(425.94) | | | |
| LKRVRNRVSTVQQLT | LKRVRNRVS/DRB1*0101(188.59) | LKRVRNRVS/DRB1*1101(72.53) | NRVSTVQQL/DRB1*0701(116.97) | |
| WPIHRMDLGVPLLAL | HRMDLGVPL/DRB1*0101(19.24) | HRMDLGVPL/DRB1*0401(382.58) | HRMDLGVPL/DRB1*0701(176.43) | |
| RTLILAPTRVVAAEM | LILAPTRV/DRB1*0101(4.02) | LILAPTRV/DRB1*0401(81.24) | LILAPTRV/DRB1*0701(29.90) | LILAPTRVV/DRB1*1101(22.83) |
| RARISQGAGWSLKET | ISQGAGWSL/DRB1*0101(114.21) | ISQGAGWSL/DRB1*0701(282.08) | | |
| IAARGYISTRVEMGE | ARGYISTRV/DRB1*0101(232.18) | YISTRVEMG/DRB1*0401(293.16) | YISTRVEMG/DRB1*0701(168.86) | |
| RYLEFEALGFMNEDH | YLEFEALGF/DRB1*0101(227.05) | | | |
| PDGPERVILAGPMPV | VILAGPMPV/DRB1*0101(422.79) | | | |

FIG. 50-108

| peptide | core/HLA(affinity(nM)) | core/HLA(affinity(nM)) | core/HLA(affinity(nM)) | core/HLA(affinity(nM)) |
|---|---|---|---|---|
| GSGIFITNNVHTWTE | IFITNNVHT/DRB1*0101(143.27) | IFITNNVHT/DRB1*0401(202.02) | IFITNNVHT/DRB1*0701(279.16) | IFITNNVHT/DRB1*1101(456.28) |
| DKRSVALVPHVGMGL | LVPHVGMGL/DRB1*0701(275.98) | SVALVPHVG/DRB1*0101(74.83) | | |
| EKQLGQYMLLVLCAV | KQLGQYMLL/DRB1*0101(493.14) | | | |
| YKFQPESPSRLSAAI | FQPESPSRL/DRB1*0101(21.29) | FQPESPSRL/DRB1*0401(256.36) | FQPESPSRL/DRB1*0701(331.71) | |
| KGWPLSKMDLGVPLL | SKMDLGVPL/DRB1*0101(210.34) | | | |
| FRGSYLAGAGLAFSL | YLAGAGLAF/DRB1*0101(10.55) | YLAGAGLAF/DRB1*0401(489.92) | YLAGAGLAF/DRB1*0701(299.86) | |
| GPMKMVMAFIAFLRF | VMAFIAFLR/DRB1*0101(29.21) | VMAFIAFLR/DRB1*0701(143.53) | VMAFIAFLR/DRB1*1101(166.13) | |
| TYGLNTFTNMEVQLI | FTNMEVQLI/DRB1*0101(34.69) | FTNMEVQLI/DRB1*0401(81.35) | FTNMEVQLI/DRB1*0701(56.71) | |
| LLMRTSWAFCEVLTL | LMRTSWAFC/DRB1*0101(223.16) | LMRTSWAFC/DRB1*0701(213.15) | | |
| LMGLGRGWPIHRVDL | LGRGWPIHR/DRB1*0701(277.27) | LGRGWPIHR/DRB1*1101(360.76) | MGLGRGWPI/DRB1*0101(76.50) | |
| KLRTLILAPTRVVAA | LILAPTRVV/DRB1*0401(33.28) | LILAPTRVV/DRB1*0701(11.16) | LILAPTRVV/DRB1*1101(12.12) | TLILAPTRV/DRB1*0101(2.62) |
| TEQYQFQADSPKRLA | FQADSPKRL/DRB1*0101(39.53) | FQADSPKRL/DRB1*0401(164.84) | FQADSPKRL/DRB1*0701(67.14) | YQFQADSPK/DRB1*1101(457.02) |
| TTDISEMGANFRADR | ISEMGANFR/DRB1*0101(366.23) | | | |
| NTANISLAAIANQA | ANISLAAIA/DRB1*0701(497.27) | ISLAAIANQ/DRB1*0401(286.55) | NISLAAIAN/DRB1*0101(35.51) | |
| ILMGLDKGWPLHRMD | MGLDKGWPL/DRB1*0101(126.35) | MGLDKGWPL/DRB1*0701(263.24) | | |
| VTRSGAYYSAIAQAK | YVSAIAQAK/DRB1*0101(32.09) | YVSAIAQAK/DRB1*0401(298.96) | YVSAIAQAK/DRB1*0701(266.84) | YVSAIAQAK/DRB1*1101(257.78) |
| DVRNDMSYGGGWKL | ISYGGGWKL/DRB1*0701(400.98) | | | |
| YSLNTFTNMEVQLIR | FTNMEVQLI/DRB1*0101(23.37) | FTNMEVQLI/DRB1*0401(86.91) | FTNMEVQLI/DRB1*0701(62.92) | |
| GKWVGLYGNGVWTKS | VVGLYGNGV/DRB1*0101(49.06) | | | |
| IGVPLLAMGCYSQVN | PLLAMGCYS/DRB1*0101(94.43) | | | |
| ETLVTFKNPHAKRQD | LVTFKNPHA/DRB1*0101(9.42) | LVTFKNPHA/DRB1*0401(7.30) | LVTFKNPHA/DRB1*0701(73.34) | LVTFKNPHA/DRB1*1101(22.91) |

FIG. 50-109

| peptide | core/HLA(affinity(nM)) | core/HLA(affinity(nM)) | core/HLA(affinity(nM)) |
|---|---|---|---|
| VLPMVTQIAMTDTTP | MVTQIAMTD/DRB1*0101(101.71) | | |
| AAIANQAVVLMGLGR | IANQAVVLM/DRB1*0101(113.02) | | |
| SKVRSNAALGAIFQE | VRSNAALGA/DRB1*0101(18.45) | VRSNAALGA/DRB1*0401(187.82) | VRSNAALGA/DRB1*0701(210.74) |
| VAGGLLIACYVITGT | GGLLIACYV/DRB1*0101(355.17) | | |
| QVGTYGLNTFTNMEA | LNTFTNMEA/DRB1*0401(169.04) | TYGLNTFTN/DRB1*0101(285.44) | |
| TMRGAKRMAILGDTA | MRGAKRMAI/DRB1*1101(206.50) | | |
| FHQLIMKDGRVLVVP | IMKDGRVLV/DRB1*1101(180.08) | LIMKDGRVL/DRB1*0701(257.81) | QLIMKDGRV/DRB1*0101(36.50) |
| RVILAGPMPVTHASA | VILAGPMPV/DRB1*0101(70.16) | | |
| WYGMEIRPLKEKEEN | WYGMEIRPL/DRB1*0101(125.12) | YGMEIRPLK/DRB1*1101(322.17) | |
| MPVTHSAAQRRGRI | VTHSAAQR/DRB1*0701(432.61) | | |
| ETACLGKSYAQMWQL | CLGKSYAQM/DRB1*0101(293.89) | LGKSYAQMW/DRB1*0701(355.78) | |
| LCEVLTLATGPVMTL | VLTLATGPV/DRB1*0101(8.08) | VLTLATGPV/DRB1*0401(262.01) | VLTLATGPV/DRB1*0701(103.19) |
| FSRGMLQGQGPMKMV | LQGQGPMKM/DRB1*0101(12.56) | LQGQGPMKM/DRB1*0701(237.47) | |
| AYNHALNELPESLET | YNHALNELP/DRB1*0101(50.14) | YNHALNELP/DRB1*0401(97.47) | YNHALNELP/DRB1*0701(288.07) |
| SYYTMFGGVSWVMK | FGGVSWVMK/DRB1*0701(246.21) | YTTMFGGVS/DRB1*0101(14.90) | YTTMFGGVS/DRB1*1101(318.39) |
| TWSIHAKHQWMTTED | TWSIHAKHQ/DRB1*1101(388.57) | | |
| AHYAIIGPGLQAKAT | YAIIGPGLQ/DRB1*0101(11.52) | YAIIGPGLQ/DRB1*0401(385.25) | YAIIGPGLQ/DRB1*0701(358.08) | YAIIGPGLQ/DRB1*1101(101.82) |
| QVVTYSLNTFTNMEA | LNTFTNMEA/DRB1*0401(89.20) | VTYSLNTFT/DRB1*0101(91.15) | VTYSLNTFT/DRB1*0701(162.11) |
| ERKKLRPRWLDARTY | RKKLRPRWL/DRB1*1101(454.06) | | |
| MGANFRAERVIDPRR | FRAERVIDP/DRB1*0101(103.49) | FRAERVIDP/DRB1*0401(98.56) | FRAERVIDP/DRB1*0701(430.45) |
| SKLMSAAVKDQRAVH | KLMSAAVKD/DRB1*0701(465.01) | LMSAAVKDQ/DRB1*0101(147.30) | LMSAAVKDQ/DRB1*1101(460.20) |

FIG. 50-110

| peptide | core/HLA(affinity(nM)) | core/HLA(affinity(nM)) | core/HLA(affinity(nM)) | core/HLA(affinity(nM)) |
|---|---|---|---|---|
| IVSSVNMISRMLINR | IVSSVNMIS/DRB1*0401(364.24) | SVNMISRML/DRB1*0101(18.29) | VNMISRMLI/DRB1*0701(98.66) | VNMISRMLI/DRB1*1101(55.91) |
| FSKGLFSGQGPMKLV | FSGQGPMKL/DRB1*0101(15.84) | FSGQGPMKL/DRB1*0701(54.45) | LFSGQGPMK/DRB1*0401(418.48) | |
| NDVPLAGPLIAGGML | DVPLAGPLI/DRB1*0101(132.35) | | | |
| WLGSQEGAMHSALT | LGSQEGAMH/DRB1*0101(223.74) | | | |
| KYAVSRGTSKIRWIV | YAVSRGTSK/DRB1*0101(187.85) | YAVSRGTSK/DRB1*0701(91.45) | YAVSRGTSK/DRB1*1101(87.22) | |
| ASSMVNGVVRLLTKP | MVNGVVRLL/DRB1*0101(133.87) | VNGVVRLLT/DRB1*1101(133.32) | | |
| AIIGPGLQAKATREA | AIIGPGLQA/DRB1*0101(388.30) | | | |
| QYVFMGEPLENDEDC | YVFMGEPLE/DRB1*0101(431.09) | | | |
| EVEDYGFGMFTNIW | FGMFTNIW/DRB1*0401(452.47) | FGMFTNIW/DRB1*0701(468.56) | | |
| TSRTTWSIHAKHQWM | TTWSIHAKH/DRB1*1101(113.24) | TWSIHAKHQ/DRB1*0701(328.61) | | |
| SPGKFWNTTIAVSTA | FWNTTIAVS/DRB1*1101(356.64) | KFWNTTIAV/DRB1*0401(146.23) | WNTTIAVST/DRB1*0101(57.72) | WNTTIAVST/DRB1*0701(55.74) |
| STYGWNLVKLMSGKD | YGWNLVKLM/DRB1*0101(81.36) | YGWNLVKLM/DRB1*0401(338.88) | YGWNLVKLM/DRB1*1101(88.51) | |
| IACYVITGTSADLEL | CVVITGTSA/DRB1*0101(35.76) | VVITGTSAD/DRB1*0401(126.25) | VVITGTSAD/DRB1*0701(116.44) | |
| VGLYGNGVVTKSGDY | YGNGVVTKS/DRB1*0101(418.26) | | | |
| TEQYKFQADSPSKLA | FQADSPSKL/DRB1*0701(40.68) | YKFQADSPS/DRB1*0101(17.68) | YKFQADSPS/DRB1*0401(29.05) | YKFQADSPS/DRB1*1101(464.71) |
| SYNITSKMLNRFTT | SKMLLNRFT/DRB1*0101(89.78) | SKMLLNRFT/DRB1*1101(123.79) | SYNITSKML/DRB1*0701(366.44) | |
| AYHGSYEVKATGSAS | YHGSYEVKA/DRB1*0101(432.55) | | | |
| LPETLETLLLLALLG | PETLETLLL/DRB1*0101(393.05) | | | |
| FQPESPSRLSAAIGK | FQPESPSRL/DRB1*0101(251.02) | | | |
| NRVSTVQQLTKRFSL | TVQQLTKRF/DRB1*0101(329.86) | VQQLTKRFS/DRB1*0701(272.44) | VQQLTKRFS/DRB1*1101(35.56) | |
| PIRYQTPAIRAEHTG | IRYQTPAIR/DRB1*0101(44.88) | IRYQTPAIR/DRB1*0401(275.67) | IRYQTPAIR/DRB1*0701(328.05) | IRYQTPAIR/DRB1*1101(226.69) |

FIG. 50-111

| peptide | core/HLA(affinity(nM)) | core/HLA(affinity(nM)) | core/HLA(affinity(nM)) | core/HLA(affinity(nM)) |
|---|---|---|---|---|
| LYAVATTFITPMMRH | LYAVATTFI/DRB1*0701(71.49) | TFITPMMRH/DRB1*1101(298.09) | YAVATTFIT/DRB1*0101(134.36) | YAVATTFIT/DRB1*0401(296.88) |
| NGIFVADNVHTRTEQ | FVADNVHTR/DRB1*0401(81.13) | FVADNVHTR/DRB1*1101(492.17) | IFVADNVHT/DRB1*0101(123.71) | |
| ERVVLAGPMPVTHSS | VVLAGPMPV/DRB1*0101(60.53) | | | |
| KHAVSRGTAKLQWFV | AVSRGTAKL/DRB1*1101(175.49) | VSRGTAKLQ/DRB1*0101(125.46) | VSRGTAKLQ/DRB1*0701(271.66) | |
| GIVYRILQRGLLGKTQ | YRILQRGLL/DRB1*0101(13.33) | YRILQRGLL/DRB1*0701(186.65) | YRILQRGLL/DRB1*1101(9.85) | |
| NLSLTAIANQAAILM | LTAIANQAA/DRB1*0101(5.94) | LTAIANQAA/DRB1*0401(33.64) | LTAIANQAA/DRB1*0701(84.24) | LTAIANQAA/DRB1*1101(483.82) |
| FIAFLRFLAIPPTAG | FIAFLRFLA/DRB1*1101(18.86) | FLRFLAIPP/DRB1*0101(3.50) | FLRFLAIPP/DRB1*0401(25.27) | FLRFLAIPP/DRB1*0701(36.44) |
| YISTRVEMGEAAGIF | VEMGEAAGI/DRB1*0101(162.15) | | | |
| GSGIFVIDNVHTRTE | FVIDNVHTR/DRB1*0401(96.54) | FVIDNVHTR/DRB1*1101(269.19) | IFVIDNVHT/DRB1*0101(98.08) | IFVIDNVHT/DRB1*0701(479.35) |
| RARNRVSTPQGLVKR | NRVSTPQGL/DRB1*0101(344.94) | NRVSTPQGL/DRB1*0701(385.54) | | |
| NPTIEESRTIRVLSL | IEESRTIRV/DRB1*0101(126.95) | IEESRTIRV/DRB1*0701(33.88) | | |
| TTWSIHATHQWMTTE | IHATHQWMT/DRB1*0701(106.44) | WSIHATHQW/DRB1*0101(330.10) | | |
| RKTFVELMRRGDLPV | FVELMRRGD/DRB1*1101(70.85) | | | |
| LRKSGKKVIQLSRKT | KVIQLSRKT/DRB1*1101(77.80) | | | |
| VSLTAIANQAAVLMG | LTAIANQAA/DRB1*0101(6.55) | LTAIANQAA/DRB1*0401(46.01) | LTAIANQAA/DRB1*0701(147.11) | |
| LVLEHGGCVTTIAKN | LVLEHGGCV/DRB1*0101(433.05) | | | |
| FTSKVRSNAALGAIF | FTSKVRSNA/DRB1*1101(135.94) | VRSNAALGA/DRB1*0101(14.82) | VRSNAALGA/DRB1*0401(115.54) | VRSNAALGA/DRB1*0701(97.56) |
| KAYAQMWSLMYFHRR | MWSLMYFHR/DRB1*1101(27.43) | YAQMWSLMY/DRB1*0101(13.97) | YAQMWSLMY/DRB1*0401(138.27) | YAQMWSLMY/DRB1*0701(117.69) |
| KGSSIGKMFEATARG | IGKMFEATA/DRB1*0101(222.83) | | | |
| MCHATFTMRLLSPVR | CHATFTMRL/DRB1*0401(304.13) | CHATFTMRL/DRB1*0701(28.33) | FTMRLLSPV/DRB1*0101(18.74) | FTMRLLSPV/DRB1*1101(35.24) |
| SQILLMRTSWAFCES | ILLMRTSWA/DRB1*0101(24.26) | ILLMRTSWA/DRB1*0401(164.28) | LMRTSWAFC/DRB1*0701(260.55) | SQILLMRTS/DRB1*1101(131.19) |

FIG. 50-112

| peptide | core/HLA(affinity(nM)) | core/HLA(affinity(nM)) | core/HLA(affinity(nM)) |
|---|---|---|---|
| HTWTEQYKFQADSPS | YKFQADSPS/DRB1*0401(407.02) | | |
| TREEFTSKVRSNAAL | FTSKVRSNA/DRB1*0101(400.57) | FTSKVRSNA/DRB1*0701(185.85) | FTSKVRSNA/DRB1*1101(42.85) |
| REEFTSKVRSNAALG | FTSKVRSNA/DRB1*0101(241.07) | FTSKVRSNA/DRB1*0701(199.57) | FTSKVRSNA/DRB1*1101(35.40) |
| PESPARLATAIAGAW | PARLATAIA/DRB1*0101(144.57) | | |
| SILLSSLLRNDVPLA | LLRNDVPLA/DRB1*0101(81.34) | LLRNDVPLA/DRB1*0401(157.27) | LSSLLRNDV/DRB1*1101(158.09) |
| KRGDLPVWLAHKVAA | LPVWLAHKV/DRB1*0101(471.43) | VWLAHKVAA/DRB1*1101(204.80) | |
| PASAWTLYAVATTII | TLYAVATTI/DRB1*0101(31.26) | TLYAVATTI/DRB1*0701(22.24) | |
| GVISTRVEMGEAAGI | YISTRVEMG/DRB1*0101(169.07) | YISTRVEMG/DRB1*0401(321.34) | YISTRVEMG/DRB1*0701(307.42) |
| MPIRYQTTAVKSEHT | IRYQTTAVK/DRB1*0101(45.08) | IRYQTTAVK/DRB1*0401(66.85) | RYQTTAVKS/DRB1*0701(92.49) |
| PGKFWNTTIAVSTAN | FWNTTIAVS/DRB1*0401(142.07) | FWNTTIAVS/DRB1*1101(337.44) | WNTTIAVST/DRB1*0701(50.88) |
| GEAAIFMTATPPGS | FMTATPPGS/DRB1*0101(28.55) | FMTATPPGS/DRB1*1101(348.40) | IFMTATPPG/DRB1*0701(114.86) |
| GVYRIKQRGILGRSQ | YRIKQRGIL/DRB1*0101(58.65) | YRIKQRGIL/DRB1*0701(246.15) | YRIKQRGIL/DRB1*1101(18.65) |
| EYRLRGEQRKTFVEL | YRLRGEQRK/DRB1*1101(302.94) | | |
| FMALVAFLRFLAIPP | FLRFLAIPP/DRB1*0101(25.20) | FLRFLAIPP/DRB1*0401(398.46) | FLRFLAIPP/DRB1*0701(119.39) LVAFLRFLA/DRB1*1101(43.01) |
| PMPVTVASAAQRRGR | VTVASAAQR/DRB1*0101(247.96) | | |
| AWMWHRQWFFDLPLP | WMWHRQWFF/DRB1*0701(301.25) | | |
| QYQFQADSPKRLATA | FQADSPKRL/DRB1*0101(17.04) | FQADSPKRL/DRB1*0401(112.22) | FQADSPKRL/DRB1*0701(55.37) FQADSPKRL/DRB1*1101(302.37) |
| KVRSNAALGAIFQEE | VRSNAALGA/DRB1*0101(33.84) | VRSNAALGA/DRB1*0401(414.16) | VRSNAALGA/DRB1*0701(397.00) |
| IFVIDNVHTREQYQ | FVIDNVHTR/DRB1*1101(485.71) | IFVIDNVHT/DRB1*0101(279.15) | IFVIDNVHT/DRB1*0401(287.13) |
| QGAGWSLKETACLGK | WSLKETACL/DRB1*0101(282.45) | | |
| DVPLAGPLIAGGMLI | DVPLAGPLI/DRB1*0101(166.54) | | |

FIG. 50-113

| peptide | core/HLA(affinity(nM)) | core/HLA(affinity(nM)) | core/HLA(affinity(nM)) |
|---|---|---|---|
| AVNMTSKMLLNRFTM | MTSKMLLNR/DRB1*1101(65.98) | SKMLLNRFT/DRB1*0101(41.21) | VNMTSKMLL/DRB1*0701(198.83) |
| TACLGKSYAQMWALM | LGKSYAQMW/DRB1*0701(246.72) | SYAQMWALM/DRB1*0101(80.18) | |
| KQEVVVLGSQEGAMH | VVVLGSQEG/DRB1*0101(56.40) | | |
| VEDYGFGMFSTNIWL | FGMFSTNIW/DRB1*0401(292.09) | FGMFSTNIW/DRB1*0701(164.15) | GFGMFSTNI/DRB1*0101(126.44) |
| VDIVLEHGGCVTTMA | IVLEHGGCV/DRB1*0101(148.04) | | |
| RTQTWMSSEGAWKQI | QTWMSSEGA/DRB1*0101(67.53) | QTWMSSEGA/DRB1*0401(426.94) | |
| EDYGFGIFTNIWLK | FGIFTNIW/DRB1*0401(284.02) | GFIFTNIW/DRB1*0101(259.73) | GFGIFTTNI/DRB1*0701(131.50) | IFTNIWLK/DRB1*1101(459.74) |
| GWVRLLTKPWDVLPM | RLLTKPWDV/DRB1*0701(277.38) | WRLLTKPW/DRB1*0101(178.75) | WRLLTKPW/DRB1*1101(71.46) |
| RENSYSGVEGEGLHR | YSGVEGEGL/DRB1*0101(304.85) | | |
| ALCESIILATGPLST | ITLATGPLS/DRB1*0101(14.03) | ITLATGPLS/DRB1*0401(55.75) | ITLATGPLS/DRB1*0701(112.50) |
| ISYDAKFEKQLGQIM | FEKQLGQIM/DRB1*0101(72.10) | | |
| LGVPLLALGCYSQVN | PLLALGCYS/DRB1*0101(116.00) | | |
| SMINGVVKLLTKPWD | INGVVKLLT/DRB1*1101(76.60) | MINGVVKLL/DRB1*0101(321.47) | |
| SCVYNMMGKREKKLG | VYNMMGKRE/DRB1*0101(75.94) | YNMMGKREK/DRB1*1101(44.61) | |
| KCETCVYNMMGKREK | VYNMMGKRE/DRB1*0101(259.02) | YNMMGKREK/DRB1*1101(95.75) | |
| GDLPVWLAYKVASEG | VWLAYKVAS/DRB1*1101(221.45) | WLAYKVASE/DRB1*0101(239.09) | |
| GLVSILLSSLLKNDV | LVSILLSSLL/DRB1*1101(214.55) | VSILLSSLL/DRB1*0101(19.12) | VSILLSSLL/DRB1*0701(170.16) |
| DIGVPLLAMGCYSQV | PLLAMGCYS/DRB1*0101(122.14) | | |
| LIALNDMGKIRKDIQ | LIALNDMGK/DRB1*0101(271.55) | | |
| LRMVLAFITFLRVLS | FITFLRVLS/DRB1*1101(46.81) | LAFITFLRV/DRB1*0701(128.83) | VLAFITFLR/DRB1*0101(64.14) |
| IDLRPASAWTLYAVA | LRPASAWTL/DRB1*0101(24.22) | LRPASAWTL/DRB1*0701(88.22) | |

FIG. 50-114

| peptide | core/HLA(affinity(nM)) | core/HLA(affinity(nM)) | core/HLA(affinity(nM)) | core/HLA(affinity(nM)) |
|---|---|---|---|---|
| EMGANFRAERVIDPR | FRAERVIDP/DRB1*0101(273.00) | FRAERVIDP/DRB1*0401(214.89) | | |
| LIMKDGRVLVWPCRP | LIMKDGRVL/DRB1*0101(416.83) | | | |
| SSIGKMLEATAKGAR | IGKMLEATA/DRB1*0101(44.78) | | | |
| EVEDYGFGIFTNIW | FGIFTNIW/DRB1*0701(477.66) | | | |
| ATAKGARRMAILGDT | TAKGARRMA/DRB1*1101(400.44) | | | |
| ASAWTLYAVATTFIT | LYAVATTF/DRB1*0701(32.85) | WTLYAVATT/DRB1*0101(29.74) | YAVATTFIT/DRB1*0401(226.39) | |
| LMRTSWAFCEVLTLA | WAFCEVLTL/DRB1*0101(215.19) | WAFCEVLTL/DRB1*0701(247.51) | | |
| SEKNETWKLEKASFI | WKLEKASFI/DRB1*0101(110.84) | WKLEKASFI/DRB1*0701(212.96) | | |
| RYLEFEALGFLNEDH | YLEFEALGF/DRB1*0101(218.83) | | | |
| WPLNEAIMAVGLVSI | NEAIMAVGL/DRB1*0101(91.99) | | | |
| ETLMLVALIAVLTGG | LVALIAVLT/DRB1*0101(162.03) | | | |
| TDGPERVILAGPIPV | VILAGPIPV/DRB1*0101(354.72) | | | |
| AAVLMGLGKGWPLSK | MGLGKGWPL/DRB1*0101(48.38) | MGLGKGWPL/DRB1*0701(482.47) | | |
| VDGEYRLRGESRKTF | YRLRGESRK/DRB1*1101(429.38) | | | |
| FLIVLLIPEPDRQRT | IVLLIPEPD/DRB1*0101(52.78) | | | |
| VSILLSSLLRNDVPL | LSSLLRNDV/DRB1*0701(277.82) | LSSLLRNDV/DRB1*1101(211.93) | VSILLSSLL/DRB1*0101(80.57) | |
| LEPSWADVKNDMISY | WADVKNDMI/DRB1*0701(490.30) | | | |
| PYDPKFEKQLGQVML | FEKQLGQVM/DRB1*0101(38.83) | | | |
| ARIYSDPLALREFKE | IYSDPLALR/DRB1*0101(175.13) | IYSDPLALR/DRB1*0401(199.48) | | |
| AIKDQRAVHADMGYW | IKDQRAVHA/DRB1*0101(183.37) | | | |
| FTGHLKCKVRMEKLR | HLKCKVRME/DRB1*1101(107.08) | | | |

FIG. 50-115

| peptide | core/HLA(affinity(nM)) | core/HLA(affinity(nM)) | core/HLA(affinity(nM)) |
|---|---|---|---|
| WPISKMDIGVPLLAM | SKMDIGVPL/DRB1*0101(42.13) | SKMDIGVPL/DRB1*0701(181.43) | |
| DLPVWLAYKVASEGI | AYKVASEGI/DRB1*0701(246.12) | VWLAYKVAS/DRB1*1101(198.60) | WLAYKVASE/DRB1*0101(138.97) |
| YAVATTFITPMLRHS | ATTFITPML/DRB1*0101(140.51) | ATTFITPML/DRB1*0401(494.52) | ATTFITPML/DRB1*0701(118.48) | TFITPMLRH/DRB1*1101(107.33) |
| TKPWDVVPMVTQLAM | VVPMVTQLA/DRB1*0101(58.40) | VVPMVTQLA/DRB1*0401(420.18) | |
| TAIANQATVLMGLGK | IANQATVLM/DRB1*0101(52.18) | IANQATVLM/DRB1*0401(263.97) | |
| DDQVFMGEPLENDE | YVFMGEPLE/DRB1*0101(402.29) | | |
| LVSILLSSLLKNDVP | ILLSSLLKN/DRB1*1101(268.47) | VSILLSSLL/DRB1*0101(38.99) | VSILLSSLL/DRB1*0701(282.16) |
| TIENSTANVSLAAIA | ENSTANVSL/DRB1*0701(434.12) | NSTANVSLA/DRB1*0101(276.72) | |
| IVDLMCHATFTFTRLL | CHATFTTRL/DRB1*0701(36.97) | LMCHATFTFT/DRB1*0101(145.90) | |
| NEDHWFSRENSLSGV | HWFSRENSL/DRB1*0701(473.11) | WFSRENSLS/DRB1*0101(421.08) | WFSRENSLS/DRB1*0401(170.07) |
| QLLMRTSWALCEVL | LLLMRTSWA/DRB1*0101(27.90) | LLLMRTSWA/DRB1*0401(295.78) | LMRTSWALC/DRB1*0701(124.45) | LMRTSWALC/DRB1*1101(328.43) |
| YNLVIMDEAHFTDPC | VIMDEAHFT/DRB1*0101(325.03) | | |
| TFHTMWHVTRGAVLM | MWHVTRGAV/DRB1*1101(16.26) | WHVTRGAVL/DRB1*0101(6.74) | WHVTRGAVL/DRB1*0701(8.70) |
| IENTSANLSLAAIAN | NLSLAAIAN/DRB1*0101(112.32) | | |
| VGVFQEGTFHTMWHV | FQEGTFHTM/DRB1*0101(170.28) | FQEGTFHTM/DRB1*0701(326.47) | |
| TGNIVASVNTTSRLL | IVASVNTTS/DRB1*0101(46.25) | IVASVNTTS/DRB1*0401(48.71) | IVASVNTTS/DRB1*0701(43.53) | IVASVNTTS/DRB1*1101(292.77) |
| QDELIGRARISQGAG | LIGRARISQ/DRB1*1101(304.46) | | |
| FHRRDLRLASNAICS | DLRLASNAI/DRB1*0101(11.66) | DLRLASNAI/DRB1*0701(90.20) | FHRRDLRLA/DRB1*1101(81.42) | LRLASNAIC/DRB1*0401(69.87) |
| TYGWNLVKLYSGKDV | WNLVKLYSG/DRB1*0101(131.02) | WNLVKLYSG/DRB1*0701(356.91) | WNLVKLYSG/DRB1*1101(118.56) |
| KRVIQLSRKTFDSEY | RVIQLSRKT/DRB1*1101(33.28) | | |
| GWTTSGTYVSAIAQ | WTTSGTYV/DRB1*0101(316.15) | WTTSGTYV/DRB1*0701(228.03) | |

FIG. 50-116

| peptide | core/HLA(affinity(nM)) | core/HLA(affinity(nM)) | core/HLA(affinity(nM)) |
|---|---|---|---|
| WGNGCGLFGKGSLVT | GLFGKGSLV/DRB1*0101(348.01) | | |
| LAAYVMTGRSADLEL | AYVMTGRSA/DRB1*0101(30.72) | YVMTGRSAD/DRB1*0701(172.69) | YVMTGRSAD/DRB1*1101(99.21) |
| GAGWSLKETACLGKS | WSLKETACL/DRB1*0101(150.98) | | |
| GSWVDLVLEHGGCVT | LVLEHGGCV/DRB1*0101(277.21) | | |
| AFITFLRVLSIPPTA | FITFLRVLS/DRB1*1101(14.76) | FLRVLSIPP/DRB1*0101(4.76) | FLRVLSIPP/DRB1*0401(29.42) | FLRVLSIPP/DRB1*0701(16.67) |
| TWKIEKASFIEIKSC | WKIEKASFI/DRB1*0101(135.51) | WKIEKASFI/DRB1*0701(289.09) | | |
| GRGPLKLFMALVAFL | PLKLFMALV/DRB1*0101(39.98) | PLKLFMALV/DRB1*1101(401.22) | | |
| MVTQIAMTDITPFGQ | IAMTDITPF/DRB1*0101(455.00) | IAMTDITPF/DRB1*0401(85.07) | IAMTDITPF/DRB1*0701(198.52) | |
| GSYLAGAGLLFSIMK | YLAGAGLLF/DRB1*0101(29.71) | | |
| EHRREKRSVALAPHV | RSVALAPHV/DRB1*0701(394.62) | | |
| GLFGYSQIGAGVYKE | GYSQIGAGV/DRB1*0101(53.03) | | |
| TSWAFCEALTLATGP | FCEALTLAT/DRB1*0101(27.70) | FCEALTLAT/DRB1*0401(67.10) | FCEALTLAT/DRB1*0701(114.74) | FCEALTLAT/DRB1*1101(287.47) |
| TRKVRSNAAIGAVFT | VRSNAAIGA/DRB1*0101(8.21) | VRSNAAIGA/DRB1*0401(70.16) | VRSNAAIGA/DRB1*0701(94.75) | VRSNAAIGA/DRB1*1101(445.57) |
| EVGAVTLDFSPGTSG | VTLDFSPGT/DRB1*0401(308.42) | | |
| VLMGLGKGWPIHRMD | MGLGKGWPI/DRB1*0101(75.79) | MGLGKGWPI/DRB1*0701(303.85) | | |
| PLAIKEFKEFAAGRK | FKEFAAGRK/DRB1*0101(377.85) | FKEFAAGRK/DRB1*0701(483.24) | FKEFAAGRK/DRB1*1101(406.50) | |
| AQMWSLMYFHRRDLR | WSLMYFHRR/DRB1*0101(59.34) | WSLMYFHRR/DRB1*0701(203.62) | WSLMYFHRR/DRB1*1101(22.43) | |
| TWSIHAHHQWMTTED | IHAHHQWMT/DRB1*0701(387.02) | | |
| PFCSHHFHELIMKDG | FCSHHFHEL/DRB1*0701(248.62) | | |
| GKRVIQLSRKTFDTE | RVIQLSRKT/DRB1*1101(29.59) | | |
| IANQAVLMGLGKGW | VLMGLGKG/DRB1*0101(276.32) | | |

FIG. 50-117

| peptide | core/HLA(affinity(nM)) | core/HLA(affinity(nM)) | core/HLA(affinity(nM)) | core/HLA(affinity(nM)) |
|---|---|---|---|---|
| HAVSRGSAKLRWFVE | AVSRGSAKL/DRB1*0101(206.44) | AVSRGSAKL/DRB1*0701(372.41) | VSRGSAKLR/DRB1*1101(181.06) | |
| FFLMVLLVPEPEKQR | MVLLVPEPE/DRB1*0101(123.60) | | | |
| DSKFEKQLGQVMLLV | FEKQLGQVM/DRB1*0101(12.89) | FEKQLGQVM/DRB1*0701(283.42) | | |
| VGRARVSQGAGWSLR | VSQGAGWSL/DRB1*0101(307.76) | VSQGAGWSL/DRB1*0701(394.85) | | |
| NPYKTWAYHGSYEVK | WAYHGSYEV/DRB1*0101(193.24) | WAYHGSYEV/DRB1*0701(159.86) | | |
| LILCTGQLLMMRTT | LILCTGQLL/DRB1*0101(80.50) | | | |
| RGSYLAGAGLLFSIM | YLAGAGLLF/DRB1*0101(13.20) | YLAGAGLLF/DRB1*0701(212.03) | | |
| LTKPWDVPTVTQMA | WDVPTVTQ/DRB1*0101(317.89) | WDVPTVTQ/DRB1*0401(498.43) | | |
| TVWFVPSIKSGNDIA | VWFVPSIKS/DRB1*0101(148.20) | VWFVPSIKS/DRB1*0701(383.17) | VWFVPSIKS/DRB1*1101(71.28) | |
| DHWFSRGNSLSGVEG | FSRGNSLSG/DRB1*0401(306.16) | HWFSRGNSL/DRB1*0101(104.80) | HWFSRGNSL/DRB1*0701(205.70) | WFSRGNSLS/DRB1*1101(457.31) |
| IVDLMCHATFTMRLL | CHATFTMRL/DRB1*0701(43.63) | LMCHATFTM/DRB1*0101(148.97) | | |
| PVWLAYKVASEGIKY | AYKVASEGI/DRB1*0101(87.97) | AYKVASEGI/DRB1*0701(105.79) | VWLAYKVAS/DRB1*1101(193.72) | WLAYKVASE/DRB1*0401(415.85) |
| DLRLASNAICSAYPS | LRLASNAIC/DRB1*0101(33.09) | LRLASNAIC/DRB1*0401(171.80) | LRLASNAIC/DRB1*0701(324.36) | |
| FVELMRRGDLPWLS | FVELMRRGD/DRB1*1101(426.37) | | | |
| GCWYGMEIRPLKEKE | WYGMEIRPL/DRB1*0101(29.20) | YGMEIRPLK/DRB1*1101(122.89) | | |
| RTPQDNQLIYVILTI | QDNQLIYVI/DRB1*0101(447.48) | | | |
| VSRGSAKLRWFVERN | GSAKLRWFV/DRB1*1101(402.35) | | | |
| NSTANVSLAAIANQA | NVSLAAIAN/DRB1*0101(43.46) | | | |
| KKKNLTIMDLHPGAG | LTIMDLHPG/DRB1*0101(62.81) | LTIMDLHPG/DRB1*0401(247.56) | LTIMDLHPG/DRB1*1101(275.74) | |
| RGSAKLRWIVERGMV | LRWIVERGM/DRB1*0101(334.02) | LRWIVERGM/DRB1*1101(391.45) | | |
| REAIKRKLRTLILAP | IKRKLRTLI/DRB1*0701(101.56) | IKRKLRTLI/DRB1*1101(9.45) | KRKLRTLIL/DRB1*0101(90.44) | |

FIG. 50-118

| peptide | core/HLA(affinity(nM)) | core/HLA(affinity(nM)) | core/HLA(affinity(nM)) |
|---|---|---|---|
| TRVVASEMAEALKGL | VASEMAEAL/DRB1*0101(85.51) | | |
| MGLGKGWPLSKMDLG | MGLGKGWPL/DRB1*0101(404.13) | | |
| PVWLSYKVASAGISY | VWLSYKVAS/DRB1*1101(94.21) | WLSYKVASA/DRB1*0101(16.96) | WLSYKVASA/DRB1*0401(145.33) | YKVASAGIS/DRB1*0701(66.99) |
| LLVTFKTAHAKKQEV | FKTAHAKKQ/DRB1*0701(43.20) | LVTFKTAHA/DRB1*0101(10.38) | LVTFKTAHA/DRB1*0401(12.54) | TFKTAHAKK/DRB1*1101(14.46) |
| KTWAYHGSYEVKATG | WAYHGSYEV/DRB1*0101(96.56) | WAYHGSYEV/DRB1*0701(202.72) | | |
| ALKGMPIRYQTTAVK | IRYQTTAVK/DRB1*0401(91.13) | IRYQTTAVK/DRB1*0701(297.08) | IRYQTTAVK/DRB1*1101(132.82) | LKGMPIRYQ/DRB1*0101(42.87) |
| GWNLVRLQSGVDVFF | LVRLQSGVD/DRB1*0101(10.73) | LVRLQSGVD/DRB1*0401(464.96) | LVRLQSGVD/DRB1*0701(97.94) | NLVRLQSGV/DRB1*1101(236.81) |
| MLTILIRTGLLVISG | MLTILIRTG/DRB1*1101(197.29) | TILIRTGLL/DRB1*0101(68.52) | TILIRTGLL/DRB1*0701(244.18) | |
| YMWLGARYLEFEALG | YMWLGARYL/DRB1*0101(47.39) | | | |
| ESRTIRVLSLVENWL | IRVLSLVEN/DRB1*0101(95.99) | SRTIRVLSL/DRB1*0701(367.58) | TIRVLSLVE/DRB1*1101(425.07) | |
| NKELKCGSGIFWDN | LKCGSGIFV/DRB1*0101(163.87) | | | |
| TWSIHATHQWMTTED | IHATHQWMT/DRB1*0101(478.99) | IHATHQWMT/DRB1*0701(155.79) | | |
| IRSYTRLENIMWKQI | IRSYTRLEN/DRB1*1101(224.12) | VTRLENIMW/DRB1*0101(161.10) | VTRLENIMW/DRB1*0401(417.13) | VTRLENIMW/DRB1*0701(487.13) |
| WAYHGSYEVKATGSA | YHGSYEVKA/DRB1*0101(224.54) | | | |
| SLAAIANQAAILMGL | AIANQAAIL/DRB1*0701(216.53) | IANQAAILM/DRB1*0101(8.12) | LAAIANQAA/DRB1*0401(121.92) | |
| IKQRGILGRSQVGVG | IKQRGILGR/DRB1*1101(462.17) | QRGILGRSQ/DRB1*0101(311.08) | | |
| VLGSQEGAMHSALTG | LGSQEGAMH/DRB1*0101(496.52) | | | |
| GRSQVGVGIHMENVF | SQVGVGIHM/DRB1*0101(451.95) | | | |
| AKHQWMTTEDMLKVW | HQWMTTEDM/DRB1*0101(142.93) | HQWMTTEDM/DRB1*0401(143.43) | WMTTEDMLK/DRB1*0701(401.15) | |
| QPQWIAASIILEFFL | PQWIAASII/DRB1*0101(103.22) | PQWIAASII/DRB1*0701(99.29) | | |
| GMLVRNPLSRNSTHE | GMLVRNPLS/DRB1*0101(321.67) | MLVRNPLSR/DRB1*1101(229.07) | | |

FIG. 50-119

| peptide | core/HLA(affinity(nM)) | core/HLA(affinity(nM)) | core/HLA(affinity(nM)) |
|---|---|---|---|
| ERVILAGPMPVTAAS | VILAGPMPV/DRB1*0101(34.93) | | |
| VILAGPMPVTHASAA | VILAGPMPV/DRB1*0101(385.98) | | |
| RVPNYNLIMDEAHF | YNLIIMDEA/DRB1*0101(154.34) | | |
| PSIVREAIKRGLRTL | IVREAIKRG/DRB1*0101(463.24) | IVREAIKRG/DRB1*1101(92.37) | |
| NGVCGIRSATRMENL | VCGIRSATR/DRB1*0101(310.43) | VCGIRSATR/DRB1*1101(225.88) | |
| ALTLATGPITILWEG | LTLATGPIT/DRB1*0101(28.59) | LTLATGPIT/DRB1*0701(260.38) | |
| VEDYGFGMFTINIWM | FGMFTINIW/DRB1*0401(242.52) | FGMFTINIW/DRB1*0701(231.74) | GFGMFTINI/DRB1*0101(243.10) |
| AAIKDQRAVHADMGY | IKDQRAVHA/DRB1*0101(103.40) | | |
| RLLSPVRVPNYNLII | PVRVPNYNL/DRB1*0101(157.43) | PVRVPNYNL/DRB1*0701(86.91) | |
| SQEGAMRTALTGATE | MRTALTGAT/DRB1*0101(266.04) | | |
| ACLGKSYAQMWQLMY | KSYAQMWQL/DRB1*0701(196.16) | SYAQMWQLM/DRB1*0101(60.58) | YAQMWQLMY/DRB1*1101(437.62) |
| ANFKAERVIDPRRCL | FKAERVIDP/DRB1*0101(295.83) | FKAERVIDP/DRB1*0401(288.58) | |
| LLRNDVPLAGPLIAG | DVPLAGPLI/DRB1*0101(21.26) | LLRNDVPLA/DRB1*0401(180.55) | |
| RTEQYKFQPESPARV | FQPESPARV/DRB1*0701(267.04) | YKFQPESPA/DRB1*0101(23.24) | YKFQPESPA/DRB1*0401(125.14) |
| DLVLEHGGCVTTIAK | LVLEHGGCV/DRB1*0101(285.43) | | |
| TDPSSIAARGYISTR | SIAARGYIS/DRB1*0101(441.16) | | |
| NIVASVNTTSRLLLN | IVASVNTTS/DRB1*0101(97.99) | IVASVNTTS/DRB1*0401(170.38) | SVNTTSRLL/DRB1*0701(31.10) | VNTTSRLLL/DRB1*1101(199.60) |
| SLIGLSSRATWAKNI | LIGLSSRAT/DRB1*0101(3.86) | LIGLSSRAT/DRB1*0401(316.36) | LIGLSSRAT/DRB1*0701(240.85) | LIGLSSRAT/DRB1*1101(43.29) |
| LQRGLLGKTQVGVGI | QRGLLGKTQ/DRB1*0101(207.98) | | |
| ILLMRTTWAFCEVLT | ILLMRTTWA/DRB1*0101(137.37) | MRTTWAFCE/DRB1*0701(191.65) | |
| GPSLRTTASGKLIH | LRTTASGK/DRB1*0101(130.84) | LRTTASGK/DRB1*0401(329.56) | LRTTASGK/DRB1*0701(64.51) | |

FIG. 50-120

| peptide | core/HLA(affinity(nM)) | core/HLA(affinity(nM)) | core/HLA(affinity(nM)) | core/HLA(affinity(nM)) |
|---|---|---|---|---|
| WCCRSCTLPPLRYLG | SCTLPPLRY/DRB1*0101(336.58) | | | |
| AITFITPMMRHTIEN | FITPMMRHT/DRB1*0101(136.08) | TFITPMMRH/DRB1*0701(414.67) | TFITPMMRH/DRB1*1101(81.98) | |
| EVEDYGFGVFSTNIW | GFGVFSTNI/DRB1*0701(359.08) | | | |
| PTSRTTWSIHAKHEW | TTWSIHAKH/DRB1*1101(284.61) | | | |
| MAGPLVAGGLLIACY | PLVAGGLLI/DRB1*0101(196.78) | | | |
| EFTRKVRSNAAIGAV | FTRKVRSNA/DRB1*1101(55.81) | VRSNAAIGA/DRB1*0101(27.30) | VRSNAAIGA/DRB1*0401(169.88) | VRSNAAIGA/DRB1*0701(136.94) |
| YWIESQKNGSWKLAR | SQKNGSWKL/DRB1*0701(490.75) | | | |
| GARFLEFEALGFMNE | FLEFEALGF/DRB1*0101(74.97) | FLEFEALGF/DRB1*0701(239.20) | | |
| TWTEQYKFQPESPAR | YKFQPESPA/DRB1*0101(170.84) | YKFQPESPA/DRB1*0401(456.14) | | |
| EFFMMVLLVPEPEKQ | MMVLLVPEP/DRB1*0101(163.03) | | | |
| GSGQWTYSLNTFTN | VTYSLNTFT/DRB1*0101(285.51) | VTYSLNTFT/DRB1*0701(249.76) | | |
| HRLMSAAVKDERAVH | HRLMSAAVK/DRB1*0101(173.49) | | | |
| ILGRSQVGVGIHMEN | GRSQVGVG/DRB1*0101(302.64) | | | |
| VRSTRLENLLWKQV | TRLENLLWK/DRB1*1101(381.70) | TTRLENLLW/DRB1*0101(409.95) | | |
| SKMDIGVPLLAMGCY | MDIGVPLLA/DRB1*0101(87.74) | | | |
| EQYKFQADSPKKLAS | FQADSPKKL/DRB1*0101(20.69) | FQADSPKKL/DRB1*0401(107.11) | FQADSPKKL/DRB1*0701(38.33) | FQADSPKKL/DRB1*1101(185.14) |
| GKKVIQLSRKTFDTE | KVIQLSRKT/DRB1*1101(35.31) | | | |
| FLRFLAIPPTAGILA | FLAIPPTAG/DRB1*0101(2.13) | FLAIPPTAG/DRB1*0401(14.06) | FLAIPPTAG/DRB1*0701(19.67) | FLAIPPTAG/DRB1*1101(18.53) |
| TFTNMEAQLIRQMEG | FTNMEAQLI/DRB1*0101(13.18) | FTNMEAQLI/DRB1*0401(276.48) | FTNMEAQLI/DRB1*0701(226.20) | |
| THEWMTTEDMLSVWN | WMTTEDMLS/DRB1*0101(210.06) | WMTTEDMLS/DRB1*0401(142.03) | | |
| SLIGLTSRATWAKNI | LIGLTSRAT/DRB1*0101(4.49) | LIGLTSRAT/DRB1*0401(231.13) | LIGLTSRAT/DRB1*0701(206.39) | LIGLTSRAT/DRB1*1101(35.39) |

FIG. 50-121

| peptide | core/HLA(affinity(nM)) | core/HLA(affinity(nM)) | core/HLA(affinity(nM)) |
|---|---|---|---|
| VLSIPPTAGVLARWG | VLSIPPTAG/DRB1*0101(114.17) | | |
| RFWNTTIAVSTANIF | IAVSTANIF/DRB1*0701(23.38) | NTTIAVSTA/DRB1*0401(277.35) | WNTTIAVST/DRB1*0101(27.52) |
| TVLMGLGRGWPLHRV | LGRGWPLHR/DRB1*1101(218.45) | MGLGRGWPL/DRB1*0101(26.06) | MGLGRGWPL/DRB1*0701(153.56) |
| GQGPMKLYMAFIAFL | PMKLVMAFI/DRB1*0101(104.45) | | |
| FTTRLLSSTRVPNYN | LLSSTRVPN/DRB1*0401(267.21) | LLSSTRVPN/DRB1*1101(45.34) | TRLLSSTRV/DRB1*0101(7.99) |
| EDLWCGSLIGLSSRA | CGSLIGLSS/DRB1*0101(55.87) | | |
| GGMLIACYVITGTSA | CYVITGTSA/DRB1*0101(188.08) | | |
| KPWDVIPMVTQMAMT | VIPMVTQMA/DRB1*0101(37.16) | VIPMVTQMA/DRB1*0401(223.41) | |
| HGGCVTTMAQGKPTL | CVTTMAQGK/DRB1*0101(312.51) | | |
| AWVDWLEHGGCVTT | WLEHGGCV/DRB1*0101(439.66) | | |
| PVTVASAAQRRGRIG | TVASAAQRR/DRB1*0101(442.47) | | |
| LEFFLMVLLVPEPEK | LMVLLVPEP/DRB1*0101(291.45) | | |
| KFQADSPSKLASAIQ | FQADSPSKL/DRB1*0101(65.43) | FQADSPSKL/DRB1*0401(187.48) | FQADSPSKL/DRB1*0701(133.11) |
| VEMGEAAAIFMTATP | VEMGEAAAI/DRB1*0101(415.96) | | |
| EGSPGKFWNTTIAVS | FWNTTIAVS/DRB1*0401(427.87) | KFWNTTIAV/DRB1*0701(255.43) | |
| AVIMGLGKGWPLSKM | MGLGKGWPL/DRB1*0101(33.50) | MGLGKGWPL/DRB1*0701(353.00) | |
| ELLSGRGPLKLFMAF | LLSGRGPLK/DRB1*0101(81.21) | LSGRGPLKL/DRB1*0701(387.98) | |
| GKGPLRMVLAFITFL | LRMVLAFIT/DRB1*0101(20.96) | LRMVLAFIT/DRB1*0701(113.74) | LRMVLAFIT/DRB1*1101(247.82) |
| HRRDLRLASMAICSA | DLRLASMAI/DRB1*0101(9.67) | DLRLASMAI/DRB1*0401(281.32) | DLRLASMAI/DRB1*0701(170.74) | HRRDLRLAS/DRB1*1101(197.99) |
| NDTWKMERASFIEVK | WKMERASFI/DRB1*0101(17.59) | WKMERASFI/DRB1*0401(328.66) | WKMERASFI/DRB1*0701(151.74) |
| EVQVIALEPGKNPRA | VIALEPGKN/DRB1*0101(166.91) | | |

FIG. 50-122

| peptide | core/HLA(affinity(nM)) | core/HLA(affinity(nM)) | core/HLA(affinity(nM)) | core/HLA(affinity(nM)) |
|---|---|---|---|---|
| REDQWCGSLIGLTSR | CGSLIGLTS/DRB1*0101(331.62) | | | |
| GWSLRETACLGKAYA | WSLRETACL/DRB1*0101(294.93) | | | |
| ALGCYSQVNPLTLIA | CYSQVNPLT/DRB1*0101(9.95) | CYSQVNPLT/DRB1*0401(71.21) | YSQVNPLTL/DRB1*0701(16.14) | YSQVNPLTL/DRB1*1101(335.22) |
| TDPSSYAARGYISTR | SYAARGYIS/DRB1*0101(437.94) | | | |
| LILCTGQLLMMRTTW | GQLLMMRTT/DRB1*0101(467.53) | LILCTGQLL/DRB1*0101(81.11) | | |
| RRLTIMDLHPGAGKT | LTIMDLHPG/DRB1*0101(45.84) | LTIMDLHPG/DRB1*0401(296.64) | LTIMDLHPG/DRB1*1101(193.05) | |
| SSIGKMFEATARGAR | IGKMFEATA/DRB1*0101(106.71) | MFEATARGA/DRB1*1101(377.85) | | |
| KRVIQLSRKITFDTEY | RVIQLSRKT/DRB1*1101(35.40) | | | |
| ELMKRGDLPVWLAYR | KRGDLPVWL/DRB1*0101(388.04) | | | |
| LYAVATTVLIPMLRH | ATTVLIPML/DRB1*0701(63.94) | TVLIPMLRH/DRB1*1101(280.51) | YAVATTVLT/DRB1*0101(48.53) | YAVATTVLT/DRB1*0401(261.24) |
| WYMWLGARFLEFEAL | YMWLGARFL/DRB1*0101(40.37) | YMWLGARFL/DRB1*1101(492.32) | | |
| LKLFMALVAFLRFLA | FMALVAFLR/DRB1*0101(17.25) | FMALVAFLR/DRB1*0701(211.46) | FMALVAFLR/DRB1*1101(68.91) | |
| EGEGLHKLGYILRDI | GLHKLGYIL/DRB1*0101(70.86) | LHKLGYILR/DRB1*0701(391.94) | LHKLGYILR/DRB1*1101(85.28) | |
| PVWLAHKVASEGFQY | WLAHKVASE/DRB1*0101(345.12) | | | |
| GNGWTTSGTYVSAI | WTTSGTYV/DRB1*0101(115.06) | WTTSGTYV/DRB1*0701(85.61) | | |
| QRTPQDNQLAYVVIG | QDNQLAYVV/DRB1*0101(393.51) | | | |
| GWTRSGTYVSAIAQ | VTRSGTYVS/DRB1*0701(493.04) | | | |
| AVGWSILASSFLRN | VSILASSFL/DRB1*0701(30.04) | VSILASSF/DRB1*0101(7.60) | VSILASSF/DRB1*0401(216.59) | VSILASSF/DRB1*1101(214.14) |
| AAYYMTGRSADLELE | VMTGRSADL/DRB1*0101(42.84) | YVMTGRSAD/DRB1*0701(258.60) | YVMTGRSAD/DRB1*1101(184.95) | |
| PASAWTLYAVATTVL | LYAVATTVL/DRB1*0701(46.12) | TLYAVATTV/DRB1*0101(29.70) | | |
| DGPERVILAGPMPVT | VILAGPMPV/DRB1*0101(150.99) | | | |

FIG. 50-123

| peptide | core/HLA(affinity(nM)) | core/HLA(affinity(nM)) | core/HLA(affinity(nM)) |
|---|---|---|---|
| peptide | core/HLA(affinity(nM))/() | | |
| AGGLLIACYVITGTS | GGLLIACYV/DRB1*0101(364.36) | | |
| VQQLTKRFSLGLLSG | KRFSLGLLS/DRB1*0101(94.00) | LTKRFSLGL/DRB1*0701(91.78) | VQQLTKRFS/DRB1*1101(67.42) |
| RFLAIPPTAGILARW | FLAIPPTAG/DRB1*0101(3.60) | FLAIPPTAG/DRB1*0401(45.23) | FLAIPPTAG/DRB1*1101(80.47) |
| MRCVGISSRDFVEGV | CVGISSRDF/DRB1*0101(179.89) | CVGISSRDF/DRB1*0701(322.53) | |
| LPIRYQTATKTEHT | IRYQTATK/DRB1*0101(66.89) | IRYQTATK/DRB1*0401(57.66) | IRYQTATK/DRB1*1101(224.31) | RYQTATKT/DRB1*0701(180.30) |
| RREKRSVALAPHVGL | RSVALAPHV/DRB1*0701(141.74) | SVALAPHVG/DRB1*0101(94.81) | |
| AIKDSKAVHADMGYW | IKDSKAVHA/DRB1*0101(343.88) | IKDSKAVHA/DRB1*0701(347.23) | |
| NVSLAAIANQATVLM | LAAIANQAT/DRB1*0101(10.12) | LAAIANQAT/DRB1*0401(80.44) | LAAIANQAT/DRB1*0701(218.60) |
| ITLATGPLSTLWEGS | ITLATGPLS/DRB1*0101(72.38) | | |
| PQWIAASIILEFFLI | PQWIAASII/DRB1*0701(199.74) | WIAASIILE/DRB1*0101(205.26) | |
| RGSAKLRWFVERNLV | LRWFVERNL/DRB1*0101(407.57) | LRWFVERNL/DRB1*0701(178.80) | RWFVERNLV/DRB1*1101(381.77) |
| KLMSAAVKDNRAYHA | KLMSAAVKD/DRB1*0101(316.30) | | |
| HMENVFHTMWHVTRG | FHTMWHVTR/DRB1*0101(25.03) | FHTMWHVTR/DRB1*1101(34.27) | VFHTMWHVT/DRB1*0701(119.07) |
| SSIGQMFESTYRGAK | MFESTYRGA/DRB1*1101(476.52) | | |
| TAIANQAAVLMGLGK | IANQAAVLM/DRB1*0101(14.72) | | |
| DQYIYMGQPLNNDED | YIYMGQPLN/DRB1*0101(50.21) | | |
| IGCYSQVNPITLTAA | CYSQVNPIT/DRB1*0401(140.26) | YSQVNPITL/DRB1*0101(15.05) | YSQVNPITL/DRB1*0701(40.89) |
| REIVDLMCHATFTMR | LMCHATFTM/DRB1*0101(412.24) | LMCHATFTM/DRB1*0701(392.71) | |
| RGGWSYYMATLKNVR | YMATLKNVR/DRB1*1101(22.51) | YYMATLKNV/DRB1*0101(17.68) | YYMATLKNV/DRB1*0401(143.43) | YYMATLKNV/DRB1*0701(50.89) |
| ETRTETWMSSEGAWK | ETWMSSEGA/DRB1*0101(479.41) | | |

FIG. 50-124

| peptide | core/HLA(affinity(nM)) | core/HLA(affinity(nM)) | core/HLA(affinity(nM)) |
|---|---|---|---|
| AVATTIITPMLRHTI | ATTIITPML/DRB1*0101(146.04) | ATTIITPML/DRB1*0701(136.17) | ITPMLRHTI/DRB1*0701(76.84) |
| GEYRLKGESRKTFVE | YRLKGESRK/DRB1*1101(259.53) | | |
| GGCVTTMAQGKPTLD | CVTTMAQGK/DRB1*0101(298.52) | | |
| DSKLMSAAVKDNRAV | KLMSAAVKD/DRB1*0701(441.77) | SKLMSAAVK/DRB1*0101(159.22) | |
| VVSILASSFLRNDVP | SILASSFLR/DRB1*1101(463.18) | VVSILASSF/DRB1*0101(42.99) | VVSILASSF/DRB1*0701(112.79) |
| RTTWALCESITLATG | WALCESITL/DRB1*0101(56.43) | WALCESITL/DRB1*0401(459.25) | WALCESITL/DRB1*0701(184.77) |
| PGAGKTKRILPSIVR | TKRILPSIV/DRB1*0101(49.24) | TKRILPSIV/DRB1*0701(141.52) | TKRILPSIV/DRB1*1101(92.79) |
| KRSVALVPHVGMGLE | LVPHVGMGL/DRB1*0701(305.02) | SVALVPHVG/DRB1*0101(65.43) | |
| RLLSPVRPYPNYNMYI | LSPVRPNY/DRB1*0701(158.49) | PVRPNYNM/DRB1*0101(229.39) | |
| WSYYMATLKNVREVK | YMATLKNVR/DRB1*0401(91.36) | YMATLKNVR/DRB1*1101(13.36) | YYMATLKNV/DRB1*0101(13.18) YYMATLKNV/DRB1*0701(54.81) |
| GRARISQGAGWSLKE | ISQGAGWSL/DRB1*0101(144.93) | ISQGAGWSL/DRB1*0701(251.38) | |
| TVLGSQEGAMHSALA | LGSQEGAMH/DRB1*0101(230.37) | | |
| SIGKMLEATAKGARR | IGKMLEATA/DRB1*0101(49.17) | KMLEATAKG/DRB1*1101(450.92) | |
| AGGLLIACVVITGRS | GGLLIACVV/DRB1*0101(283.97) | IACVVITGR/DRB1*1101(401.44) | |
| WTTSGTYVSAIAQT | TYVSAIAQT/DRB1*0101(312.23) | WTTSGTYV/DRB1*0701(338.16) | |
| RDFVEGVSGGAWVDV | FVEGVSGGA/DRB1*0101(176.86) | | |
| ALTALNDMGKVRKDI | LTALNDMGK/DRB1*1101(344.46) | | |
| EMAEALKGLPIRYQT | AEALKGLPI/DRB1*0101(52.28) | LKGLPIRYQ/DRB1*1101(290.29) | |
| LRPKWLDARTYSDPL | WLDARTYSD/DRB1*0701(324.66) | | |
| QLTKRFSLGLLSGRG | FSLGLLSGR/DRB1*0401(470.07) | KRFSLGLLS/DRB1*0101(30.54) | KRFSLGLLS/DRB1*1101(62.70) LTKRFSLGL/DRB1*0701(161.93) |
| HTLWSNGVLESQMLI | NGVLESQML/DRB1*0101(210.38) | | |

FIG. 50-125

| peptide | core/HLA(affinity(nM)) | core/HLA(affinity(nM)) | core/HLA(affinity(nM)) |
|---|---|---|---|
| LETLLLALLGAMTA | LLALLGAMT/DRB1*0101(10.91) | | |
| CKKVRSNAAMGAVFT | VRSNAAMGA/DRB1*0101(8.63) | VRSNAAMGA/DRB1*0401(49.09) | VRSNAAMGA/DRB1*1101(302.84) |
| VRNRVSTVQQLTKRF | NRVSTVQQL/DRB1*0101(413.75) | NRVSTVQQL/DRB1*0701(289.85) | |
| AKHEWMTTEDMLKVW | HEWMTTEDM/DRB1*0101(322.21) | WMTTEDMLK/DRB1*0401(364.89) | |
| STVQQLTKRFSLGLL | LTKRFSLGL/DRB1*0101(214.78) | LTKRFSLGL/DRB1*0701(71.96) | VQQLTKRFS/DRB1*1101(36.84) |
| VEDYGFGIFTNIWL | FGIFTNIW/DRB1*0401(474.48) | FGIFTNIW/DRB1*0701(206.00) | GFGIFTNI/DRB1*0101(433.08) |
| GAIFQEEQGWTSASE | FQEEQGWTS/DRB1*0101(438.05) | | |
| DYGFGMFSTNIWLKL | FGMFSTNIW/DRB1*0401(168.35) | FSTNIWLKL/DRB1*0701(35.43) | GFGMFSTNI/DRB1*0101(52.07) | MFSTNIWLK/DRB1*1101(248.93) |
| VDLVLEHGGCVTTMA | LVLEHGGCV/DRB1*0101(48.41) | | |
| FHTMWHVTRGAVLMY | MWHVTRGAV/DRB1*1101(14.74) | WHVTRGAVL/DRB1*0101(4.13) | WHVTRGAVL/DRB1*0701(6.58) |
| KCGSGIFVIDNVHTR | FVIDNVHTR/DRB1*0401(245.39) | IFVIDNVHT/DRB1*0101(301.41) | |
| ELRFLAIPPTAGILK | FLAIPPTAG/DRB1*0101(2.15) | FLAIPPTAG/DRB1*0401(14.24) | FLAIPPTAG/DRB1*0701(20.54) | FLAIPPTAG/DRB1*1101(17.75) |
| PRWLDARVYADPMAL | WLDARVYAD/DRB1*0101(438.37) | | |
| RLMSAAIKDSKAVHA | IKDSKAVHA/DRB1*0701(137.63) | SAAIKDSKA/DRB1*0101(193.24) | |
| WLMGLGRGWPIHRV | LMGLGRGWP/DRB1*1101(265.12) | MGLGRGWPI/DRB1*0101(33.88) | MGLGRGWPI/DRB1*0701(130.38) |
| LLTKPWDVLPMVTQI | WDVLPMVTQ/DRB1*0101(365.19) | | |
| GPLVAGGLLTVCVYL | PLVAGGLLT/DRB1*0101(404.09) | | |
| DTWKIEKASFIEIKS | WKIEKASFI/DRB1*0101(81.88) | WKIEKASFI/DRB1*0701(221.16) | |
| GIRSVTRLENIMWKQ | IRSVTRLEN/DRB1*1101(128.19) | VTRLENIMW/DRB1*0101(247.44) | VTRLENIMW/DRB1*0701(498.43) |
| AKRMAILGDTAWDFG | RMAILGDTA/DRB1*0101(191.00) | | |
| SPGRFWNTTIAVSTA | FWNTTIAVS/DRB1*0401(169.14) | FWNTTIAVS/DRB1*1101(452.17) | WNTTIAVST/DRB1*0101(64.60) | WNTTIAVST/DRB1*0701(60.04) |

FIG. 50-126

| peptide | core/HLA(affinity(nM)) | core/HLA(affinity(nM)) | core/HLA(affinity(nM)) |
|---|---|---|---|
| VSSVNTISKMLLNRF | ISKMLLNRF/DRB1*0101(99.85) | SVNTISKML/DRB1*0701(84.74) | VNTISKMLL/DRB1*1101(131.65) |
| VTQMAMTDTTPFGQQ | MAMTDTTPF/DRB1*0401(241.69) | MAMTDTTPF/DRB1*0701(316.70) | |
| THEMYWVSGATGNIV | MYWVSGATG/DRB1*0101(41.35) | MYWVSGATG/DRB1*0401(481.59) | WVSGATGNI/DRB1*0701(125.54) |
| LETRAQTWMSAEGAW | QTWMSAEGA/DRB1*0101(307.44) | | |
| SSVNVSLTAIANQAA | LTAIANQAA/DRB1*0401(86.40) | NVSLTAIAN/DRB1*0101(19.12) | VNVSLTAIA/DRB1*0701(263.04) |
| NKVRSNAALGAVFTD | VRSNAALGA/DRB1*0101(20.69) | VRSNAALGA/DRB1*0401(201.03) | VRSNAALGA/DRB1*0701(220.35) |
| KRFSRGMLQGQGPMK | MLQGQGPMK/DRB1*0101(143.14) | | |
| IHASHEWMTTEDMLA | WMTTEDMLA/DRB1*0401(410.19) | | |
| EGIMAIGIVSILASS | GIVSILASS/DRB1*0101(115.98) | | |
| HTIENTSANLSLTAI | ENTSANLSL/DRB1*0701(171.64) | ENTSANLS/DRB1*0101(107.77) | IENTSANLS/DRB1*0401(340.20) |
| HRGPSLRTTTVSGKL | LRTTTVSGK/DRB1*0701(182.70) | | |
| TTWSIHAKHQWMTTE | TWSIHAKHQ/DRB1*1101(257.18) | | |
| KFQPESPARLASAIL | FQPESPARL/DRB1*0101(28.72) | | |
| SSNPTIEEGRTLRVL | IEEGRTLRV/DRB1*0101(417.53) | IEEGRTLRV/DRB1*0701(246.03) | |
| VFQEGTFHTMWHVTR | FHTMWHVTR/DRB1*0101(42.96) | FHTMWHVTR/DRB1*0701(165.17) | FHTMWHVTR/DRB1*1101(54.08) |
| AHHQWMTTEDMLTVW | HQWMTTEDM/DRB1*0101(144.44) | WMTTEDMLT/DRB1*0401(132.69) | WMTTEDMLT/DRB1*0701(415.77) |
| WTYGLNTFNMEVQ | LNTFNMEV/DRB1*0401(204.52) | LNTFNMEV/DRB1*0701(283.34) | VTYGLNTFT/DRB1*0101(172.96) |
| PNPTIEESRTIRVLK | IEESRTIRV/DRB1*0101(333.90) | IEESRTIRV/DRB1*0701(54.78) | |
| GSVYTMFGGVSWWM | YTTMFGGVS/DRB1*0101(13.04) | YTTMFGGVS/DRB1*1101(445.68) | |
| IANQAAVLMGLGKGW | IANQAAVLM/DRB1*0101(197.68) | | |
| ACLRKNGKRVIQLSR | LRKNGKRVI/DRB1*1101(138.75) | | |

FIG. 50-127

| peptide | core/HLA(affinity(nM)) | core/HLA(affinity(nM)) | core/HLA(affinity(nM)) |
|---|---|---|---|
| GSLVRCPLSRNSTHE | LVRCPLSRN/DRB1*0101(434.12) | LVRCPLSRN/DRB1*1101(225.49) | |
| HRREKRSVALVPHVG | RSVALVPHV/DRB1*0701(332.57) | SVALVPHVG/DRB1*0701(383.55) | |
| MYWVSGATGNIVSSV | VSGATGNIV/DRB1*0101(74.36) | WVSGATGNI/DRB1*0701(176.56) | |
| VVRLLTKPWDVLPMV | RLLTKPWDV/DRB1*0701(352.52) | VVRLLTKPW/DRB1*0101(345.87) | VVRLLTKPW/DRB1*1101(303.47) |
| FLAIPPTAGILARWG | FLAIPPTAG/DRB1*0101(15.74) | FLAIPPTAG/DRB1*0401(293.32) | FLAIPPTAG/DRB1*0701(327.19) | FLAIPPTAG/DRB1*1101(366.10) |
| EEALRGLPIRYQTPA | LRGLPIRYQ/DRB1*0101(70.89) | LRGLPIRYQ/DRB1*1101(141.83) | |
| HRGPSLRTTVTGKI | LRTTVTGK/DRB1*0701(210.06) | | |
| LPVWLAYKVAAEGIN | AYKVAAEGI/DRB1*0701(413.82) | VWLAYKVAA/DRB1*1101(180.87) | WLAYKVAAE/DRB1*0101(88.13) | WLAYKVAAE/DRB1*0401(464.18) |
| EVEDYGFGMFSTNIW | FGMFSTNIW/DRB1*0701(391.82) | GFGMFSTNI/DRB1*0101(358.78) | |
| TLYAVATTFITPMLR | LYAVATTFI/DRB1*0701(39.50) | YAVATTFI/DRB1*0101(54.59) | YAVATTFIT/DRB1*0401(177.17) | YAVATTFIT/DRB1*1101(400.89) |
| RGEARKTFVELMRRG | TFVELMRRG/DRB1*1101(290.22) | | |
| FKGKTVWFVPSIKAG | VWFVPSIKA/DRB1*0101(19.69) | VWFVPSIKA/DRB1*0401(100.63) | VWFVPSIKA/DRB1*0701(46.38) | VWFVPSIKA/DRB1*1101(27.69) |
| ASALLKNDIPMTGPL | LLKNDIPMT/DRB1*0101(178.60) | LLKNDIPMT/DRB1*0401(178.68) | |
| TTIAVSTANIFRGSY | IAVSTANIF/DRB1*0101(136.55) | IAVSTANIF/DRB1*0701(74.02) | |
| KMVMAFIAFLRFLTI | FIAFLRFLT/DRB1*1101(52.29) | VMAFIAFLR/DRB1*0101(56.81) | VMAFIAFLR/DRB1*0701(144.36) |
| CWCNATSAWVMYGTC | CNATSAWVM/DRB1*0701(354.71) | WCNATSAWV/DRB1*0101(274.65) | |
| LDARIYSDPLALREF | IYSDPLALR/DRB1*0101(195.49) | IYSDPLALR/DRB1*0401(191.23) | |
| EAVMAVGWSILLSS | MAVGWSIL/DRB1*0101(391.96) | | |
| GAGKTKRYLPAIVRE | TKRYLPAIV/DRB1*0101(107.14) | TKRYLPAIV/DRB1*1101(183.31) | |
| PPFNMLKRERNRVST | FNMLKRERN/DRB1*0101(77.08) | FNMLKRERN/DRB1*0401(435.75) | FNMLKRERN/DRB1*0701(311.83) | FNMLKRERN/DRB1*1101(15.33) |
| FQPESPARLATAIAG | FQPESPARL/DRB1*0101(185.93) | | |

FIG. 50-128

| peptide | core/HLA(affinity(nM)) | core/HLA(affinity(nM)) | core/HLA(affinity(nM)) | core/HLA(affinity(nM)) |
|---|---|---|---|---|
| QYKFQADSPSKLASA | FQADSPSKL/DRB1*0101(10.45) | FQADSPSKL/DRB1*0401(23.30) | FQADSPSKL/DRB1*0701(32.50) | FQADSPSKL/DRB1*1101(383.15) |
| GNDIAACLRKSGKRV | IAACLRKSG/DRB1*1101(42.75) | | | |
| LNDTWKMERASFIEV | WKMERASFI/DRB1*0101(18.62) | WKMERASFI/DRB1*0401(325.24) | WKMERASFI/DRB1*0701(114.42) | |
| QADSPKKLASAILNA | PKKLASAIL/DRB1*0101(126.98) | | | |
| FPGKTVWFVPSIKSG | VWFVPSIKS/DRB1*0101(54.19) | VWFVPSIKS/DRB1*0401(197.22) | VWFVPSIKS/DRB1*0701(81.00) | VWFVPSIKS/DRB1*1101(38.43) |
| SASSMINGVVKLLTK | INGVVKLLT/DRB1*1101(258.04) | MINGVVKLL/DRB1*0101(149.76) | | |
| SVNMISRMLINRFTM | ISRMLINRF/DRB1*0101(10.93) | ISRMLINRF/DRB1*0401(107.03) | ISRMLINRF/DRB1*0701(50.71) | ISRMLINRF/DRB1*1101(27.78) |
| IDGEYRLKGEARKTF | EYRLKGEAR/DRB1*0101(368.49) | YRLKGEARK/DRB1*1101(236.52) | | |
| PRLCTKAEFCKKVRS | LCTKAEFCK/DRB1*1101(436.06) | | | |
| IMAIGIVSILASSL | IVSILASSL/DRB1*0101(5.24) | IVSILASSL/DRB1*0401(117.92) | IVSILASSL/DRB1*0701(12.26) | IVSILASSL/DRB1*1101(283.86) |
| LPMVTQIAMTDTTPF | IAMTDTTPF/DRB1*0401(489.64) | IAMTDTTPF/DRB1*0701(294.33) | MVTQIAMTD/DRB1*0101(198.77) | |
| NSTHEMYWVSNASGN | MYWVSNASG/DRB1*0101(241.56) | MYWVSNASG/DRB1*0401(220.02) | | |
| STHEMYWVSGATGNI | MYWVSGATG/DRB1*0101(97.45) | WVSGATGNI/DRB1*0701(294.85) | | |
| KELKCGSGIFVTNEV | LKCGSGIFV/DRB1*0101(321.36) | | | |
| ERVILAGPMPVTHAS | VILAGPMPV/DRB1*0101(48.68) | | | |
| ANFRAERVIDPRRCM | FRAERVIDP/DRB1*0101(163.53) | FRAERVIDP/DRB1*0401(175.24) | | |
| KLKPRWLDARVYADP | PRWLDARVY/DRB1*0101(299.57) | | | |
| KTVWFVPSIKAGNDI | VWFVPSIKA/DRB1*0101(17.54) | VWFVPSIKA/DRB1*0401(102.83) | VWFVPSIKA/DRB1*0701(98.93) | VWFVPSIKA/DRB1*1101(27.55) |
| SSRDFVEGVSGGSWV | FVEGVSGGS/DRB1*0101(373.46) | | | |
| MAVGLVSLLGSSLLK | LVSLLGSSL/DRB1*0101(2.87) | LVSLLGSSL/DRB1*0401(197.45) | LVSLLGSSL/DRB1*0701(43.21) | LVSLLGSSL/DRB1*1101(220.46) |
| GIRSATRMENLLWKQ | IRSATRMEN/DRB1*1101(375.76) | | | |

FIG. 50-129

| peptide | core/HLA(affinity(nM)) | core/HLA(affinity(nM)) | core/HLA(affinity(nM)) |
|---|---|---|---|
| MCTLMAMDLGEMCED | LMAMDLGEM/DRB1*0101(286.26) | | |
| NIFRGSYLAGAGLAF | FRGSYLAGA/DRB1*0401(400.65) | GSYLAGAGL/DRB1*0101(21.52) | YLAGAGLAF/DRB1*0701(436.79) |
| CGSGIFVIDNVHTWT | IFVIDNVHT/DRB1*0101(69.85) | IFVIDNVHT/DRB1*0401(199.96) | IFVIDNVHT/DRB1*0701(494.47) |
| RGSSKIRWFVERNMV | RWFVERNMV/DRB1*0701(345.08) | | |
| SVALAPHVGMGLETR | LAPHVGMGL/DRB1*0101(126.40) | | |
| KKQEVVLGSQEGAM | VVLGSQEG/DRB1*0101(102.34) | | |
| NDIANCLRKNGKKVI | CLRKNGKKV/DRB1*1101(188.39) | | |
| DCWCNLTSTWVTYGT | WCNLTSTWV/DRB1*0101(182.60) | WCNLTSTWV/DRB1*0701(272.79) | |
| PLNEGIMAVGMYSIL | NEGIMAVGM/DRB1*0101(131.45) | | |
| IQPHWIAASIILEFF | PHWIAASII/DRB1*0101(49.33) | PHWIAASII/DRB1*0701(59.19) | |
| VATTFITPMMRHTIE | FITPMMRH/DRB1*0101(145.57) | TFITPMMRH/DRB1*0701(246.66) | TFITPMMRH/DRB1*1101(78.08) |
| SHEWMTTEDMLAVWN | WMTTEDMLA/DRB1*0101(140.35) | WMTTEDMLA/DRB1*0401(119.70) | |
| VSTVQQLTKRFSLGL | LTKRFSLGL/DRB1*0701(125.59) | VQQLTKRFS/DRB1*0101(297.71) | VQQLTKRFS/DRB1*1101(28.93) |
| VDCWCNATSTWVMYG | WCNATSTWV/DRB1*0101(180.40) | WCNATSTWV/DRB1*0401(450.52) | WCNATSTWV/DRB1*0701(110.33) |
| SHHFHKIFMKDGREI | FHKIFMKDG/DRB1*0101(492.82) | FHKIFMKDG/DRB1*1101(101.27) | |
| LLSGRGPLKLFMALV | LSGRGPLKL/DRB1*0701(464.55) | LSGRGPLKL/DRB1*1101(426.83) | PLKLFMALV/DRB1*0101(60.11) |
| GEERVVLAGPMPVTH | VVLAGPMPV/DRB1*0101(62.23) | | |
| GCGRGGWSYYMATLK | WSYYMATLK/DRB1*0101(468.02) | | |
| YAQMWQLMYFHRRDL | WQLMYFHRR/DRB1*0101(46.95) | WQLMYFHRR/DRB1*0701(322.14) | WQLMYFHRR/DRB1*1101(34.99) |
| TAIANQAVVLMGLDK | AIANQAVVL/DRB1*0101(120.24) | | |
| DKRSVALAPHVGMGL | SVALAPHVG/DRB1*0101(42.02) | VALAPHVGM/DRB1*0701(265.14) | |

FIG. 50-130

| peptide | core/HLA(affinity(nM)) | core/HLA(affinity(nM)) | core/HLA(affinity(nM)) | core/HLA(affinity(nM)) |
|---|---|---|---|---|
| GAGVYKEGVFHTMWH | VYKEGVFHT/DRB1*0101(289.19) | | | |
| WLDARIYADPMALKD | DARIYADPM/DRB1*0101(290.25) | | | |
| SPIRVPNYNLVVMDE | PIRVPNYNL/DRB1*0101(236.36) | PIRVPNYNL/DRB1*0701(340.32) | | |
| AAGIMKNPTVDGITV | IMKNPTVDG/DRB1*0101(160.75) | IMKNPTVDG/DRB1*0401(277.77) | | |
| LIGRARISQGAGWSL | ISQGAGWSL/DRB1*0101(253.84) | ISQGAGWSL/DRB1*0701(277.70) | | |
| RGYISTRVEMGEAAA | YISTRVEMG/DRB1*0101(100.69) | YISTRVEMG/DRB1*0401(120.94) | YISTRVEMG/DRB1*0701(159.97) | YISTRVEMG/DRB1*1101(419.55) |
| SITLATGPLSTLWEG | ITLATGPLS/DRB1*0101(10.16) | ITLATGPLS/DRB1*0401(110.54) | ITLATGPLS/DRB1*0701(166.54) | ITLATGPLS/DRB1*1101(469.08) |
| FGRAKGSRAIWYMWL | AKGSRAIWY/DRB1*0701(250.19) | FGRAKGSRA/DRB1*0101(36.70) | FGRAKGSRA/DRB1*0701(263.23) | |
| GQLLMMRTTWALCES | LLMMRTTWA/DRB1*0101(39.86) | LLMMRTTWA/DRB1*0401(331.52) | MMRTTWALC/DRB1*0401(280.20) | MMRTTWALC/DRB1*1101(267.44) |
| GEAAGIFMTATPPGT | FMTATPPGT/DRB1*0101(34.54) | IFMTATPPG/DRB1*0401(18.34) | IFMTATPPG/DRB1*0701(131.53) | |
| ATWVDWLEHGSCVT | VVLEHGSCV/DRB1*0101(363.05) | | | |
| HAVSRGSAKIRWIVE | AVSRGSAKI/DRB1*0101(394.55) | VSRGSAKIR/DRB1*0101(485.48) | VSRGSAKIR/DRB1*1101(436.59) | |
| LPVWLSYKVASAGIS | SYKVASAGI/DRB1*0701(103.70) | VWLSYKVAS/DRB1*1101(65.38) | WLSYKVASA/DRB1*0101(20.41) | WLSYKVASA/DRB1*0401(122.81) |
| ARISQGAGWSLRETA | ISQGAGWSL/DRB1*0101(280.70) | | | |
| KRGDLPVWLAYKVAS | LPVWLAYKV/DRB1*0101(342.79) | VWLAYKVAS/DRB1*1101(253.64) | | |
| KKLKPRWLDARYAD | PRWLDARVY/DRB1*0101(274.60) | | | |
| IREAIKRKLRTLILA | IKRKLRTLI/DRB1*0701(80.22) | IKRKLRTLI/DRB1*1101(9.22) | KRKLRTLIL/DRB1*0101(94.16) | |
| MAEALKGLPIRYQTT | ALKGLPIRY/DRB1*0101(44.68) | LKGLPIRYQ/DRB1*1101(179.97) | | |
| SSVNTISKMLLNRFT | ISKMLLNRF/DRB1*0101(64.12) | ISKMLLNRF/DRB1*0701(125.04) | TISKMLLNR/DRB1*1101(101.68) | |
| NTSANLSLAAIANQA | LSLAAIANQ/DRB1*0401(400.89) | NLSLAAIAN/DRB1*0101(38.36) | | |
| VSILASALLKNDIPM | SILASALLK/DRB1*0701(300.66) | VSILASALL/DRB1*0101(101.63) | | |

FIG. 50-131

| peptide | core/HLA(affinity(nM)) | core/HLA(affinity(nM)) | core/HLA(affinity(nM)) |
|---|---|---|---|
| YFHRRDLRLASMAIC | DLRLASMAI/DRB1*0101(14.49) | FHRRDLRLA/DRB1*0401(457.27) | YFHRRDLRL/DRB1*0701(64.63) |
| GWVTRSGAYVSAIAQ | VTRSGAYVS/DRB1*0701(404.79) | VVTRSGAYV/DRB1*0101(221.63) | |
| TRVPNYNLIVMDEAH | YNLIVMDEA/DRB1*0101(490.39) | | |
| IDGEFRLRGEQRKTF | FRLRGEQRK/DRB1*1101(408.42) | | |
| AIFKLTYQNKVKVL | FKLTYQNKV/DRB1*0101(25.40) | FKLTYQNKV/DRB1*0401(315.61) | FKLTYQNKV/DRB1*0701(52.21) |
| ANFRADRVIDPRRCL | FRADRVIDP/DRB1*0401(149.06) | | |
| RMCTREEFIKVRTN | EFIKVRTN/DRB1*1101(411.07) | | |
| FGYSQIGAGVYKEGV | YSQIGAGVV/DRB1*0101(130.28) | | |
| YDSKFEKQLGQVMLL | FEKQLGQVM/DRB1*0101(17.62) | FEKQLGQVM/DRB1*0701(289.22) | |
| RFLTIPPTAGILARW | FLTIPPTAG/DRB1*0101(4.33) | FLTIPPTAG/DRB1*0401(50.88) | FLTIPPTAG/DRB1*1101(96.52) |
| QDVTVLGSQEGAMHS | VTVLGSQEG/DRB1*0101(230.36) | | |
| LPESLETLMLVALLA | LETLMLVAL/DRB1*0101(312.33) | | |
| RVILAGPMPVTASSA | RVILAGPMP/DRB1*0101(51.26) | | |
| TACLGKSYAQMWQLM | KSYAQMWQL/DRB1*0701(235.10) | SYAQMWQLM/DRB1*0101(104.61) | |
| MTTEDMLSVWNRVWI | DMLSVWNRV/DRB1*0101(441.28) | | |
| YYCGGLKNVKEVRGF | YCGGLKNVK/DRB1*0101(348.04) | YCGGLKNVK/DRB1*1101(408.67) | |
| WCGSLIGLTSRATWA | LIGLTSRAT/DRB1*0101(2.69) | LIGLTSRAT/DRB1*0401(87.19) | LIGLTSRAT/DRB1*1101(201.24) | LIGLTSRAT/DRB1*1101(21.00) |
| LMCHATFTTRLLSST | ATFTTRLLS/DRB1*1101(98.33) | CHATFTTRL/DRB1*0101(49.74) | CHATFTTRL/DRB1*0401(296.33) | CHATFTTRL/DRB1*0701(18.00) |
| RAIWYMWLGARFLEF | IWYMWLGAR/DRB1*1101(81.44) | YMWLGARFL/DRB1*0101(11.01) | YMWLGARFL/DRB1*0701(278.08) | |
| ILAPTRVVASEMAEA | TRVVASEMA/DRB1*0101(402.50) | | |
| RARISQGAGWSLRET | ISQGAGWSL/DRB1*0101(104.46) | ISQGAGWSL/DRB1*0701(250.42) | |

FIG. 50-132

| peptide | core/HLA(affinity(nM)) | core/HLA(affinity(nM)) | core/HLA(affinity(nM)) |
|---|---|---|---|
| LVHKQWFFDLPLPWA | FFDLPLPWA/DRB1*0101(298.60) | | |
| QERMVTFKVPHAKKQ | MVTFKVPHA/DRB1*0101(28.19) | MVTFKVPHA/DRB1*0701(65.11) | MVTFKVPHA/DRB1*1101(21.63) |
| DVKNDMISYGGGWRL | ISYGGGWRL/DRB1*0101(382.70) | ISYGGGWRL/DRB1*0701(243.67) | |
| ENTSANLSLAAIANQ | NLSLAAIAN/DRB1*0101(82.80) | | |
| CEVITLATGPLSTLW | ITLATGPLS/DRB1*0101(4.93) | ITLATGPLS/DRB1*0401(34.31) | ITLATGPLS/DRB1*1101(207.85) |
| RKYLPAIIREAIKRK | IIREAIKRK/DRB1*1101(88.94) | YLPAIIREA/DRB1*0101(85.71) | |
| VNGVVRLLTKPWDVV | RLLTKPWDV/DRB1*0701(299.17) | VVRLLTKPW/DRB1*0101(131.24) | VVRLLTKPW/DRB1*1101(40.50) |
| QATVLMGLGKGWPIH | MGLGKGWPI/DRB1*0101(127.85) | MGLGKGWPI/DRB1*0701(440.58) | |
| LLMRTTWAFCEVLTL | LMRTTWAFC/DRB1*0101(295.49) | MRTTWAFCE/DRB1*0701(170.92) | |
| RKRRLTIMDLHPGSG | LTIMDLHPG/DRB1*0101(54.09) | LTIMDLHPG/DRB1*0401(190.59) | LTIMDLHPG/DRB1*1101(189.17) |
| FLNEDHWFSRGNSLS | HWFSRGNSL/DRB1*0101(451.88) | HWFSRGNSL/DRB1*0701(187.60) | |
| LRPASAWTLYAVATT | LRPASAWTL/DRB1*0101(88.51) | LRPASAWTL/DRB1*0701(213.32) | |
| PESLETLMLVALIAV | LETLMLVAL/DRB1*0101(336.77) | | |
| GNPGKFWNTTIAVSM | FWNTTIAVS/DRB1*0401(243.67) | WNTTIAVSM/DRB1*0101(149.70) | WNTTIAVSM/DRB1*0701(66.86) |
| FQADSPSKLASAIQK | FQADSPSKL/DRB1*0101(430.16) | | |
| MWSLMYFHRRDLRLA | YFHRRDLRL/DRB1*0101(38.80) | YFHRRDLRL/DRB1*0701(37.13) | YFHRRDLRL/DRB1*1101(10.25) |
| QQVPFCSHHFHQLIM | FCSHHFHQL/DRB1*0101(143.32) | FCSHHFHQL/DRB1*0701(37.47) | |
| IPMTGPLVAGGLLTV | TGPLVAGGL/DRB1*0101(175.97) | | |
| GPSLRTTASGKLVT | LRTTASGK/DRB1*0101(144.77) | LRTTASGK/DRB1*0401(316.27) | LRTTASGK/DRB1*0701(89.84) |
| VVTRSGTYVSSIAQT | RSGTYVSSI/DRB1*0701(316.21) | | |
| IRSTRLENVMWKQI | TTRLENVMW/DRB1*0101(462.88) | | |

FIG. 50-133

| peptide | core/HLA(affinity(nM)) | core/HLA(affinity(nM)) | core/HLA(affinity(nM)) |
|---|---|---|---|
| LKGLPIRYQTAVKS | IRYQTAVK/DRB1*0101(29.72) | IRYQTAVK/DRB1*0401(50.07) | IRYQTAVK/DRB1*0701(144.13) | IRYQTAVK/DRB1*1101(95.83) |
| LKNVKEVRGFTKGGP | VKEVRGFTK/DRB1*1101(482.01) | | | |
| QQVPFCSHHFHELIM | FCSHHFHEL/DRB1*0101(440.56) | FCSHHFHEL/DRB1*0701(102.93) | | |
| SAVNMTSKMLLNRFT | AVNMTSKML/DRB1*0101(43.85) | VNMTSKMLL/DRB1*0701(131.75) | VNMTSKMLL/DRB1*1101(79.40) | |
| YRILQRGLLGKTQVG | YRILQRGLL/DRB1*0101(25.71) | YRILQRGLL/DRB1*0701(385.94) | YRILQRGLL/DRB1*1101(28.68) | |
| GLLTVCVYLSGSSAD | CYVLSGSSA/DRB1*0101(19.82) | CYVLSGSSA/DRB1*0401(160.09) | VCYVLSGSS/DRB1*0701(133.44) | VCYVLSGSS/DRB1*1101(280.75) |
| SWALCEVLTLATGPV | VLTLATGPV/DRB1*0101(117.84) | VLTLATGPV/DRB1*0701(429.95) | | |
| QILLMRTSWAFCEVL | ILLMRTSWA/DRB1*0101(37.58) | ILLMRTSWA/DRB1*0401(254.35) | ILLMRTSWA/DRB1*0701(301.15) | LMRTSWAFC/DRB1*0701(146.74) |
| ILCTGQLMMRTTWA | LLMMRTTWA/DRB1*0101(41.94) | LLMMRTTWA/DRB1*0401(327.19) | LLMMRTTWA/DRB1*0701(270.16) | |
| SHHFHQLIMKDGRVL | FHQLIMKDG/DRB1*0101(54.95) | FHQLIMKDG/DRB1*1101(123.17) | | |
| SVALAPHVGLGLDTR | LAPHVGLGL/DRB1*0101(109.38) | | | |
| AVSRGSAKLRWFVER | AVSRGSAKL/DRB1*0101(425.07) | VSRGSAKLR/DRB1*1101(232.13) | | |
| TMRLLSPVRVPNYNM | MRLLSPVRV/DRB1*0101(12.32) | MRLLSPVRV/DRB1*0701(122.93) | TMRLLSPVR/DRB1*1101(128.59) | |
| CLRKSGKKVIQLSRK | CLRKSGKKV/DRB1*1101(114.06) | | | |
| KVRTNAAMGAVFTEE | VRTNAAMGA/DRB1*0101(45.25) | VRTNAAMGA/DRB1*0401(374.65) | | |
| DYGFGIFTNIWMKF | FTNIWMKF/DRB1*0701(71.41) | GFGIFTNI/DRB1*0101(174.99) | GFGIFTNI/DRB1*0401(250.02) | IFTNIWMK/DRB1*1101(187.67) |
| PAIVREALKRRLRTL | VREALKRRL/DRB1*0101(221.27) | VREALKRRL/DRB1*0701(473.30) | VREALKRRL/DRB1*1101(24.87) | |
| AVSRGTAKLRWIVER | VSRGTAKLR/DRB1*1101(232.30) | | | |
| AVSRGSSKLRWFVER | VSRGSSKLR/DRB1*1101(363.64) | | | |
| SYDAKFEKQLGQIML | FEKQLGQIM/DRB1*0101(29.89) | FEKQLGQIM/DRB1*0701(341.51) | | |
| QRGLFGYSQIGAGVY | GYSQIGAGV/DRB1*0101(78.79) | YSQIGAGVY/DRB1*0701(474.55) | | |

FIG. 50-134

| peptide | core/HLA(affinity(nM)) | core/HLA(affinity(nM)) | core/HLA(affinity(nM)) |
|---|---|---|---|
| LGKSYAQMWQLMYFH | KSYAQMWQL/DRB1*0701(247.36) | SYAQMWQLM/DRB1*0101(35.40) | YAQMWQLMY/DRB1*1101(250.27) |
| RVVASEMAEALKGLP | VASEMAEAL/DRB1*0101(220.29) | | |
| RPRWLDARTYSDPLA | WLDARTYSD/DRB1*0701(469.32) | | |
| RRMAILGDTAWDFGS | ILGDTAWDF/DRB1*0401(393.97) | RMAILGDTA/DRB1*0101(176.83) | |
| SLRTTTASGKLVTQW | LRTTTASGK/DRB1*0701(173.73) | TTTASGKLV/DRB1*0101(157.40) | |
| SQKNGSWKLARASFI | WKLARASFI/DRB1*0101(9.85) | WKLARASFI/DRB1*0701(13.73) | WKLARASFI/DRB1*1101(116.44) |
| KLTYQNKVVRVQRPT | TYQNKVVRV/DRB1*0101(215.08) | TYQNKVVRV/DRB1*0701(414.32) | YQNKVVRVQ/DRB1*1101(108.82) |
| VTYGLNTFTNMEVQL | LNTFTNMEV/DRB1*0101(132.41) | LNTFTNMEV/DRB1*0401(152.58) | LNTFTNMEV/DRB1*0701(162.11) |
| LKRARNRVSTPQGLV | LKRARNRVS/DRB1*1101(296.40) | NRVSTPQGL/DRB1*0701(470.17) | |
| LVLCAVQLLLMRTSW | VQLLLMRTS/DRB1*0101(93.13) | VQLLLMRTS/DRB1*1101(151.64) | |
| LNEDHWFSRENSLSG | FSRENSLSG/DRB1*0401(427.08) | | |
| ATARGARRMAILGDT | TARGARRMA/DRB1*1101(322.97) | | |
| EDYGFGVFSTNIWLK | FGVFSTNIW/DRB1*0401(415.85) | FGVFSTNIW/DRB1*0701(93.16) | GFGVFSTNI/DRB1*0101(95.40) |
| KMLLDNINTPEGIIP | MLLDNINTP/DRB1*0401(350.83) | | |
| IRYQTTAIKAEHTGR | IRYQTTAIK/DRB1*0101(121.28) | IRYQTTAIK/DRB1*0401(390.87) | IRYQTTAIK/DRB1*1101(317.88) | RYQTTAIKA/DRB1*0701(393.21) |
| KLTYQNKVVKVLRPT | TYQNKVVKV/DRB1*0101(152.75) | TYQNKVVKV/DRB1*0701(235.81) | YQNKVVKVL/DRB1*1101(107.81) |
| EYRLKGEARKTFVEL | YRLKGEARK/DRB1*0101(256.49) | YRLKGEARK/DRB1*0701(137.95) | |
| GRARISQGAGWSLRE | ISQGAGWSL/DRB1*0101(132.49) | ISQGAGWSL/DRB1*0701(223.30) | |
| VDCWCNATSAWVMYG | WCNATSAWV/DRB1*0101(108.82) | WCNATSAWV/DRB1*0401(442.23) | WCNATSAWV/DRB1*0701(163.41) |
| QYKFQADSPKRLATA | FQADSPKRL/DRB1*0101(15.78) | FQADSPKRL/DRB1*0401(115.31) | FQADSPKRL/DRB1*0701(49.01) | FQADSPKRL/DRB1*1101(232.27) |
| GPMPVTAASAAQRRG | PVTAASAAQ/DRB1*0101(361.68) | | |

FIG. 50-135

| peptide | core/HLA(affinity(nM)) | core/HLA(affinity(nM)) | core/HLA(affinity(nM)) | core/HLA(affinity(nM)) |
|---|---|---|---|---|
| KVIGLYGNGVVTTSG | VIGLYGNGV/DRB1*0101(104.50) | | | |
| DLMCHATFTTRLLSS | ATFTTRLLS/DRB1*1101(208.36) | CHATFTTRL/DRB1*0101(78.03) | CHATFTTRL/DRB1*0401(350.73) | CHATFTTRL/DRB1*0701(19.94) |
| TPQGLWVKRFSTGLLN | VKRFSTGLL/DRB1*0101(62.58) | VKRFSTGLL/DRB1*0401(407.47) | VKRFSTGLL/DRB1*0701(37.38) | VKRFSTGLL/DRB1*1101(184.55) |
| QRGILGRSQVGVGIH | ILGRSQVGV/DRB1*0101(214.13) | | | |
| ARFLEFEALGFMNED | FLEFEALGF/DRB1*0101(109.49) | FLEFEALGF/DRB1*0701(364.91) | | |
| NGKGPLRMVLAFITF | LRMVLAFIT/DRB1*0101(33.42) | LRMVLAFIT/DRB1*0701(178.02) | LRMVLAFIT/DRB1*1101(328.61) | |
| PSLRTTASGKLVTQ | LRTTASGK/DRB1*0701(114.43) | TTTASGKLV/DRB1*0101(160.76) | | |
| GVVKLLTKPWDWPM | KLLTKPWDV/DRB1*0701(363.88) | VKLLTKPWD/DRB1*1101(154.95) | VVKLLTKPW/DRB1*0101(319.19) | |
| GCWYGMEIRPVSEKE | WYGMEIRPV/DRB1*0101(43.84) | YGMEIRPVS/DRB1*1101(214.62) | | |
| EGAMHSALAGATEVD | MHSALAGAT/DRB1*0101(97.95) | | | |
| MGLDKGWPLHRMDIG | LDKGWPLHR/DRB1*0101(448.22) | | | |
| GKTKRILPSIVREAI | TKRILPSIV/DRB1*0101(22.14) | TKRILPSIV/DRB1*0701(135.11) | TKRILPSIV/DRB1*1101(55.48) | |
| MLRHTIENSTANVSL | IENSTANVS/DRB1*0401(349.09) | TIENSTANV/DRB1*0101(351.09) | TIENSTANV/DRB1*0701(279.89) | |
| TIEESRTIRVSLYE | IEESRTIRV/DRB1*0701(71.09) | SRTIRVLSL/DRB1*0101(208.96) | | |
| GEQRKTFVDLMRRGD | FVDLMRRGD/DRB1*1101(331.18) | | | |
| GEFRLRGEQRKTFVD | FRLRGEQRK/DRB1*1101(236.07) | | | |
| YGLNTFTNMEAQLIR | FTNMEAQLI/DRB1*0101(7.05) | FTNMEAQLI/DRB1*0701(45.40) | FTNMEAQLI/DRB1*1101(381.47) | LNTFTNMEA/DRB1*0401(34.92) |
| EAKMLLDNINTPEGI | MLLDNINTP/DRB1*0401(311.79) | | | |
| NFRAERVIDPRRCLK | FRAERVIDP/DRB1*0101(389.10) | FRAERVIDP/DRB1*0401(402.33) | | |
| LGARFLEFEALGFLN | FLEFEALGF/DRB1*0101(63.24) | FLEFEALGF/DRB1*0701(135.85) | | |
| MPIRYQTPAIRAEHT | IRYQTPAIR/DRB1*0101(19.97) | IRYQTPAIR/DRB1*0401(114.52) | IRYQTPAIR/DRB1*0701(190.98) | IRYQTPAIR/DRB1*1101(133.95) |

FIG. 50-136

| peptide | core/HLA(affinity(nM)) | core/HLA(affinity(nM)) | core/HLA(affinity(nM)) |
|---|---|---|---|
| ALNDTWKMERASFIE | WKMERASFI/DRB1*0101(43.74) | WKMERASFI/DRB1*0701(181.34) | |
| SKVDIGVPLLAMGCY | VDIGVPLLA/DRB1*0101(100.51) | | |
| IFAGHLKCRLKMDKL | FAGHLKCRL/DRB1*0101(295.72) | GHLKCRLKM/DRB1*1101(60.18) | |
| TREEFTRKVRSNAAI | FTRKVRSNA/DRB1*0101(325.77) | FTRKVRSNA/DRB1*0701(263.98) | FTRKVRSNA/DRB1*1101(31.71) |
| AMYADDTAGWDTRIT | MYADDTAGW/DRB1*0401(463.58) | | |
| KAWMVHRQWFFDLPL | WMVHRQWFF/DRB1*0101(384.13) | WMVHRQWFF/DRB1*0701(157.13) | WMVHRQWFF/DRB1*1101(463.75) |
| SAAVKDNRAVHADMG | VKDNRAVHA/DRB1*0101(367.09) | | |
| KLMSAAVKDQRAVHA | VKDQRAVHA/DRB1*0101(222.46) | | |
| RGSSKLRWFVERNMV | LRWFVERNM/DRB1*0101(340.30) | LRWFVERNM/DRB1*0701(473.47) | |
| RTTWSIHAHHQWMTT | TWSIHAHHQ/DRB1*0101(248.75) | WSIHAHHQW/DRB1*0701(138.93) | WSIHAHHQW/DRB1*1101(286.91) |
| MRCIGIGNRDFVEGL | CIGIGNRDF/DRB1*0101(454.40) | | |
| GTWDVWLEHGSCVT | WLEHGSCV/DRB1*0101(367.84) | | |
| LTLATGPVMTLWEGN | LTLATGPVM/DRB1*0101(161.60) | | |
| FKTAHAKKQEVVVLG | FKTAHAKKQ/DRB1*0101(250.52) | FKTAHAKKQ/DRB1*1101(337.34) | |
| RVILAGPIPVTPSA | VILAGPIPV/DRB1*0101(117.08) | | |
| RMAILGDTAWDFGSL | ILGDTAWDF/DRB1*0401(414.83) | RMAILGDTA/DRB1*0101(243.80) | |
| AIANQAVVLMGLDKG | AIANQAVVL/DRB1*0101(223.74) | | |
| GKTRRYLPAMVREAI | TRRYLPAMV/DRB1*0101(20.09) | TRRYLPAMV/DRB1*0701(321.12) | TRRYLPAMV/DRB1*1101(54.59) | YLPAMVREA/DRB1*0401(486.77) |
| PMPVTAASAAQRRGR | VTAASAAQR/DRB1*0101(281.88) | | |
| GNIVSSVNTISKMLL | IVSSVNTIS/DRB1*0101(82.08) | IVSSVNTIS/DRB1*0401(94.52) | NIVSSVNTI/DRB1*0701(32.27) | VSSVNTISK/DRB1*1101(234.03) |
| LYAVATTIITPMLRH | ATTIITPML/DRB1*0101(77.15) | ATTIITPML/DRB1*0701(66.88) | TIITPMLRH/DRB1*1101(331.29) | YAVATTIIT/DRB1*0401(322.93) |

FIG. 50-137

| peptide | core/HLA(affinity(nM)) | core/HLA(affinity(nM)) | core/HLA(affinity(nM)) | core/HLA(affinity(nM)) |
|---|---|---|---|---|
| LLMRTSWAFCESLTL | WAFCESLTL/DRB1*0101(162.52) | WAFCESLTL/DRB1*0701(118.91) | | |
| SLRETACLGKSYAQM | TACLGKSYA/DRB1*1101(497.69) | | | |
| IPPTAGILKRWGTIK | TAGILKRWG/DRB1*1101(237.38) | | | |
| EALKGMPIRYQTTAV | LKGMPIRYQ/DRB1*0101(57.58) | LKGMPIRYQ/DRB1*0401(243.29) | LKGMPIRYQ/DRB1*1101(242.46) | |
| ITFLRVLSIPPTAGV | FLRVLSIPP/DRB1*0101(4.17) | FLRVLSIPP/DRB1*0401(32.58) | FLRVLSIPP/DRB1*0701(27.72) | FLRVLSIPP/DRB1*1101(22.54) |
| GKCETCVYNMMGKRE | CVYNMMGKR/DRB1*1101(354.27) | | | |
| EKRSVALTPHSGMGL | SVALTPHSG/DRB1*0101(96.86) | VALTPHSGM/DRB1*0701(260.35) | | |
| LNEDHWFSRGNSLSG | HWFSRGNSL/DRB1*0101(264.67) | HWFSRGNSL/DRB1*0701(183.58) | | |
| PIHKMDLGVPLLALG | HKMDLGVPL/DRB1*0101(24.71) | HKMDLGVPL/DRB1*0701(298.81) | | |
| KRILPSIVREAIKRG | KRILPSIVR/DRB1*0101(421.58) | KRILPSIVR/DRB1*1101(360.06) | | |
| EGAMHSALTGATEIQ | MHSALTGAT/DRB1*0101(174.69) | | | |
| LFLNDMGKVRKDIPQ | FLNDMGKVR/DRB1*0101(440.89) | | | |
| TGPLVAGGLLTVCYV | PLVAGGLLT/DRB1*0101(332.66) | | | |
| DVVVLGSQEGAMHSA | VVVLGSQEG/DRB1*0101(93.55) | | | |
| SWKLARASFIEVKSC | WKLARASFI/DRB1*0101(8.21) | WKLARASFI/DRB1*0701(19.77) | WKLARASFI/DRB1*1101(175.54) | |
| RLRTLILAPTRVVAA | LILAPTRVV/DRB1*0401(32.79) | LILAPTRVV/DRB1*0701(10.81) | LILAPTRVV/DRB1*1101(11.97) | TLILAPTRV/DRB1*0101(2.60) |
| SWLVHKQWFLDLPLP | WLVHKQWFL/DRB1*0101(403.74) | WLVHKQWFL/DRB1*0701(209.52) | | |
| TTMAKNKPTLDFELI | MAKNKPTLD/DRB1*0101(433.70) | | | |
| PGKTVWFVPSIKSGN | VWFVPSIKS/DRB1*0101(31.90) | VWFVPSIKS/DRB1*0401(121.60) | VWFVPSIKS/DRB1*0701(80.02) | VWFVPSIKS/DRB1*1101(28.37) |
| IPMATYGWNLVKLHS | PMATYGWNL/DRB1*0701(405.57) | YGWNLVKLH/DRB1*0101(209.52) | YGWNLVKLH/DRB1*0401(445.27) | YGWNLVKLH/DRB1*1101(202.91) |
| FLEFEALGFMNEDHW | FLEFEALGF/DRB1*0101(469.20) | | | |

FIG. 50-138

| peptide | core/HLA(affinity(nM)) | core/HLA(affinity(nM)) | core/HLA(affinity(nM)) |
|---|---|---|---|
| MYFHRRDLRLASMAI | DLRLASMAI/DRB1*0101(13.61) | DLRLASMAI/DRB1*0401(375.09) | YFHRRDLRL/DRB1*1101(11.93) |
| GDLMYADDTAGWDTR | MYADDTAGW/DRB1*0401(276.22) | | |
| HPGSGKTRKYLPAII | TRKYLPAII/DRB1*0101(461.85) | | |
| GLLLAAYYMTGRSAD | AYYMTGRSA/DRB1*0101(38.47) | AYYMTGRSA/DRB1*1101(171.86) | |
| RGLPIRYQTPAVKSE | IRYQTPAVK/DRB1*0101(21.36) | IRYQTPAVK/DRB1*0401(170.87) | IRYQTPAVK/DRB1*1101(144.34) |
| SPVRVPNYNLIIMDE | PVRVPNYNL/DRB1*0101(335.14) | PVRVPNYNL/DRB1*0701(325.32) | |
| HRLMSAAIKDSKAVH | HRLMSAAIK/DRB1*0101(71.65) | HRLMSAAIK/DRB1*1101(279.17) | RLMSAAIKD/DRB1*0701(328.63) |
| DVTVLGSQEGAMHSA | LGSQEGAMH/DRB1*0101(149.73) | | |
| YKFQADSPKKLASAI | FQADSPKKL/DRB1*0101(23.35) | FQADSPKKL/DRB1*0401(166.45) | FQADSPKKL/DRB1*1101(209.24) |
| GVEGEGLHKLGYILR | GLHKLGYIL/DRB1*0101(170.30) | LHKLGYILR/DRB1*1101(353.67) | |
| MRTSWAFCEALTLAT | FCEALTLAT/DRB1*0401(143.47) | FCEALTLAT/DRB1*0701(79.36) | WAFCEALTL/DRB1*0101(33.82) |
| GPERVILAGPMPVTV | VILAGPMPV/DRB1*0101(43.33) | VILAGPMPV/DRB1*0701(361.80) | |
| KRVRNRVSTVQQLTK | NRVSTVQQL/DRB1*0101(333.91) | NRVSTVQQL/DRB1*0701(171.30) | VRNRVSTVQ/DRB1*1101(376.04) |
| IEPSWADVRNDMISY | WADVRNDMI/DRB1*0701(459.59) | | |
| LGKSYAQMWALMYFH | YAQMWALMY/DRB1*0101(12.49) | YAQMWALMY/DRB1*0401(341.91) | YAQMWALMY/DRB1*1101(203.05) |
| IQPQWIASSIILEFF | PQWIASSII/DRB1*0101(94.81) | PQWIASSII/DRB1*0701(53.46) | |
| GWPLSKMDLGVPLLA | SKMDLGVPL/DRB1*0101(68.11) | SKMDLGVPL/DRB1*0701(358.92) | |
| FCSHHFHQLIMKDGR | FCSHHFHQL/DRB1*0701(170.79) | HHFHQLIMK/DRB1*0101(149.83) | HHFHQLIMK/DRB1*1101(201.00) |
| TGSASSMINGVVRLL | MINGVVRLL/DRB1*0101(174.15) | MINGVVRLL/DRB1*0701(399.00) | |
| CYVLSGSSADLSLEK | CYVLSGSSA/DRB1*0101(16.36) | YVLSGSSAD/DRB1*0401(142.22) | YVLSGSSAD/DRB1*0701(144.61) |
| ASEMAEALKGMPIRY | AEALKGMPI/DRB1*0101(81.78) | | |

FIG. 50-139

| peptide | core/HLA(affinity(nM)) | core/HLA(affinity(nM)) | core/HLA(affinity(nM)) |
|---|---|---|---|
| GNGWVTRSGTYYSAI | WVTRSGTYY/DRB1*0101(402.95) | WVTRSGTYY/DRB1*0701(270.02) | |
| RSVALAPHVGLGLDT | LAPHVGLGL/DRB1*0701(378.66) | SVALAPHVG/DRB1*0101(59.63) | |
| VSILLSLLKNDVPL | LSSLLKNDV/DRB1*0701(308.56) | LSSLLKNDV/DRB1*1101(291.39) | VSILLSSLL/DRB1*0101(83.02) |
| SVNMISRMLLNRFT | ISRMLLNRF/DRB1*0101(16.68) | ISRMLLNRF/DRB1*0401(257.32) | ISRMLLNRF/DRB1*0701(139.39) | MISRMLLNR/DRB1*1101(30.55) |
| ENTSANLSLTAIANQ | NLSLTAIAN/DRB1*0101(103.81) | | |
| YLPAIIREAIKRKLR | IIREAIKRK/DRB1*0101(205.42) | IIREAIKRK/DRB1*1101(29.52) | IREAIKRKL/DRB1*0701(401.04) |
| KGWPIHRMDLGVPLL | HRMDLGVPL/DRB1*0101(112.72) | HRMDLGVPL/DRB1*0701(353.25) | |
| YQHALSELPETLETL | YQHALSELP/DRB1*0101(64.68) | YQHALSELP/DRB1*0401(350.08) | YQHALSELP/DRB1*0701(310.69) |
| HKMDLGVPLLALGCY | MDLGVPLLA/DRB1*0101(54.35) | | |
| EFCIKVLNPYMPSVI | CIKVLNPYM/DRB1*0101(36.08) | CIKVLNPYM/DRB1*0401(330.39) | CIKVLNPYM/DRB1*0701(151.14) | CIKVLNPYM/DRB1*1101(175.35) |
| PVWLAYKVASEGFQY | AYKVASEGF/DRB1*0701(262.82) | VWLAYKVAS/DRB1*1101(252.55) | WLAYKVASE/DRB1*0101(126.83) | WLAYKVASE/DRB1*0401(386.82) |
| KTRRYLPAMVREAIR | TRRYLPAMV/DRB1*0101(20.50) | TRRYLPAMV/DRB1*0701(351.20) | TRRYLPAMV/DRB1*1101(59.91) | YLPAMVREA/DRB1*0401(417.42) |
| EGVMAVGLVSLLGSS | MAVGLVSLL/DRB1*0101(110.23) | | |
| FCIKVLNPYMPSVIE | CIKVLNPYM/DRB1*0101(35.56) | CIKVLNPYM/DRB1*0401(386.69) | CIKVLNPYM/DRB1*0701(186.95) | CIKVLNPYM/DRB1*1101(171.95) |
| AQMWTLMYFHRRDLR | WTLMYFHRR/DRB1*0101(56.77) | WTLMYFHRR/DRB1*0701(261.50) | WTLMYFHRR/DRB1*1101(21.43) |
| GAMHSALTGATEIQM | MHSALTGAT/DRB1*0101(141.16) | SALTGATEI/DRB1*0701(452.10) | |
| VPLAGPMYAGGLLLA | PMYAGGLLL/DRB1*0101(216.86) | | |
| GQVMLLVLCAVQLLL | LLVLCAVQL/DRB1*0101(283.17) | | |
| NFKAGRVIDPRRCLK | FKAGRVIDP/DRB1*0101(472.17) | | |
| RPQDELIGRARISQG | LIGRARISQ/DRB1*1101(489.56) | | |
| WYGMEIRPVSEKEEN | WYGMEIRPV/DRB1*0101(195.30) | | |

FIG. 50-140

| peptide | core/HLA(affinity(nM)) | core/HLA(affinity(nM)) | core/HLA(affinity(nM)) | core/HLA(affinity(nM)) |
|---|---|---|---|---|
| AVGLVSILLSSLLKN | LVSILLSSL/DRB1*0401(422.72) | LVSILLSSL/DRB1*1101(189.22) | VSILLSSL/DRB1*0101(12.39) | VSILLSSLL/DRB1*0701(101.56) |
| TEQYKFQADSPKRLA | FQADSPKRL/DRB1*0101(35.05) | FQADSPKRL/DRB1*0401(163.48) | FQADSPKRL/DRB1*0701(60.09) | YKFQADSPK/DRB1*1101(315.38) |
| HRMDIGVPLLAIGCY | MDIGVPLLA/DRB1*0101(101.79) | | | |
| DVPMAGPLVAGGLLI | DVPMAGPLV/DRB1*0101(156.87) | | | |
| GAGWSLRETACLGKS | WSLRETACL/DRB1*0101(212.27) | | | |
| TWALCEVITLATGPL | VITLATGPL/DRB1*0101(128.60) | VITLATGPL/DRB1*0701(330.28) | | |
| RWLDARIYADPMALK | DARIYADPM/DRB1*0101(216.36) | | | |
| WCNLTSTWTYGTCS | LTSTWTYG/DRB1*0701(467.42) | | | |
| GNIVSSVNMVSRMLL | IVSSVNMVS/DRB1*0401(169.48) | IVSSVNMVS/DRB1*1101(158.96) | SVNMVSRML/DRB1*0101(31.13) | SVNMVSRML/DRB1*0701(63.91) |
| WPIHKMDLGVPLLAL | HKMDLGVPL/DRB1*0101(23.54) | HKMDLGVPL/DRB1*0701(197.15) | | |
| KGKVVGLYGNGVTK | VVGLYGNGV/DRB1*0101(20.10) | | | |
| NQAVVLMGLGKGWPI | VVLMGLGKG/DRB1*0101(113.58) | | | |
| SCGTGNIVSAVNMTS | IVSAVNMTS/DRB1*0101(216.77) | IVSAVNMTS/DRB1*0401(83.22) | IVSAVNMTS/DRB1*0701(328.14) | |
| AGPMPVTVASAAQRR | MPVTVASAA/DRB1*0101(421.47) | | | |
| QLIMKDGRVLVVPCR | IMKDGRVLV/DRB1*1101(320.06) | MKDGRVLVV/DRB1*0701(449.12) | QLIMKDGRV/DRB1*0101(94.30) | |
| IEESRTIRVLKMVEP | IEESRTIRV/DRB1*0701(197.83) | SRTIRVLKM/DRB1*0101(381.01) | SRTIRVLKM/DRB1*1101(303.04) | |
| QADSPKRLASAIQKA | PKRLASAIQ/DRB1*0101(345.79) | | | |
| SVAARGYISTRVEMG | ARGYISTRV/DRB1*0101(224.80) | YISTRVEMG/DRB1*0401(492.46) | YISTRVEMG/DRB1*0701(188.06) | |
| WDVIPMVTQMAMTDT | VIPMVTQMA/DRB1*0101(53.12) | VIPMVTQMA/DRB1*0401(363.74) | | |
| RIMQRGLFGYSQIGA | QRGLFGYSQ/DRB1*0101(91.06) | | | |
| PLQWIASAIILEFFM | LQWIASAII/DRB1*0101(17.85) | LQWIASAII/DRB1*0701(18.90) | | |

FIG. 50-141

| peptide | core/HLA(affinity(nM)) | core/HLA(affinity(nM)) | core/HLA(affinity(nM)) |
|---|---|---|---|
| ESITLATGPLSTLWE | ITLATGPLS/DRB1*0101(6.80) | ITLATGPLS/DRB1*0401(51.26) | ITLATGPLS/DRB1*1101(96.15) | ITLATGPLS/DRB1*1101(286.32) |
| YYCGGLKNVTEVRGF | YCGGLKNVT/DRB1*0101(310.50) | | |
| DLPVWLSYKYASAGI | VWLSYKVAS/DRB1*1101(66.08) | WLSYKVASA/DRB1*0101(31.10) | WLSYKVASA/DRB1*0401(155.92) | WLSYKVASA/DRB1*0701(143.91) |
| FVEGLSGATWVDWVL | FVEGLSGAT/DRB1*0101(178.50) | | |
| DLPVWLAHKVAAEGI | VWLAHKVAAE/DRB1*1101(258.92) | WLAHKVAAE/DRB1*0101(159.24) | | |
| NDIANCLRKSGKKVI | CLRKSGKKV/DRB1*1101(76.17) | | |
| GSLIGLSSRATWAQN | LIGLSSRAT/DRB1*0101(2.83) | LIGLSSRAT/DRB1*0401(182.07) | LIGLSSRAT/DRB1*0701(287.08) | LIGLSSRAT/DRB1*1101(28.49) |
| CGSGIFITDNVHTWT | IFITDNVHT/DRB1*0101(371.63) | IFITDNVHT/DRB1*0401(243.13) | IFITDNVHT/DRB1*0701(386.59) | |
| MRCIGISNRDFVEGV | CIGISNRDF/DRB1*0101(260.84) | CIGISNRDF/DRB1*0701(414.14) | | |
| GESRKTFVELMKRGD | FVELMKRGD/DRB1*1101(262.58) | | |
| VSGNIVSSVNTISKM | IVSSVNTIS/DRB1*0101(72.99) | IVSSVNTIS/DRB1*0401(53.78) | IVSSVNTIS/DRB1*1101(448.02) | NIVSSVNTI/DRB1*0701(37.25) |
| MRGAKRMAILGETAW | RMAILGETA/DRB1*0101(301.53) | | |
| RGDLPVWLAHKVAAE | VWLAHKVAAE/DRB1*1101(232.82) | WLAHKVAAE/DRB1*0101(383.16) | | |
| GKGWPLHRMDIGVPL | HRMDIGVPL/DRB1*0101(447.46) | | |
| GNGCGLFGKGSLLTC | FGKGSLLTC/DRB1*0701(489.43) | GLFGKGSLL/DRB1*0101(112.71) | | |
| GSCVTTIAKSKPTLD | CVTTIAKSK/DRB1*0101(304.33) | CVTTIAKSK/DRB1*1101(202.00) | IAKSKPTLD/DRB1*0701(106.36) | |
| PLVAGGLLIACYVIT | GGLLIACYV/DRB1*0101(192.89) | | |
| RTSWAFCEVLTLATG | FCEVLTLAT/DRB1*0101(93.53) | FCEVLTLAT/DRB1*0401(277.11) | FCEVLTLAT/DRB1*0701(198.71) | FCEVLTLAT/DRB1*1101(396.33) |
| KTRKYLPAIIREAIK | RKYLPAIIR/DRB1*0101(32.23) | TRKYLPAII/DRB1*0701(291.29) | TRKYLPAII/DRB1*1101(106.25) | YLPAIIREA/DRB1*0401(344.53) |
| WTEQYKFQADSPKRL | FQADSPKRL/DRB1*0101(84.05) | FQADSPKRL/DRB1*0401(268.49) | FQADSPKRL/DRB1*0701(84.04) | |
| FFLIVLLIPEPDRQR | IVLLIPEPD/DRB1*0101(46.08) | | |

FIG. 50-142

| peptide | core/HLA(affinity(nM)) | core/HLA(affinity(nM)) | core/HLA(affinity(nM)) | core/HLA(affinity(nM)) |
|---|---|---|---|---|
| SGNIVSSVNMISRML | IVSSVNMIS/DRB1*0101(31.59) | IVSSVNMIS/DRB1*0401(49.85) | IVSSVNMIS/DRB1*0701(42.83) | IVSSVNMIS/DRB1*1101(146.67) |
| ERKKLRPRWLDARVY | RKKLRPRWL/DRB1*1101(414.34) | | | |
| EDYGFGMFSTNIWLK | FGMFSTNIW/DRB1*0401(169.68) | FGMFSTNIW/DRB1*0401(94.65) | GFGMFSTNI/DRB1*0101(68.49) | |
| WSYYCAGLKKVTEVK | YCAGLKKVT/DRB1*1101(20.72) | YYCAGLKKV/DRB1*0101(35.45) | YYCAGLKKV/DRB1*0701(226.56) | |
| IKKVRTNAAIGAVFV | VRTNAAIGA/DRB1*0101(8.03) | VRTNAAIGA/DRB1*0401(75.13) | VRTNAAIGA/DRB1*0401(83.51) | VRTNAAIGA/DRB1*1101(268.32) |
| EHRREKRSVALVPHV | KRSVALVPH/DRB1*0701(321.19) | | | |
| IVREALKRRLRTLIL | KRRLRTLIL/DRB1*0101(131.55) | LKRRLRTLI/DRB1*0101(96.45) | LKRRLRTLI/DRB1*1101(11.51) | |
| EVILTATGPVMTLWE | LTLATGPVM/DRB1*0401(484.85) | VLTLATGPV/DRB1*0101(19.20) | VLTLATGPV/DRB1*0701(213.58) | |
| WGLYGNGWTKSGT | LYGNGWTK/DRB1*0101(185.70) | | | |
| EFTSKVRSNAALGAI | FTSKVRSNA/DRB1*1101(85.92) | VRSNAALGA/DRB1*0101(39.49) | VRSNAALGA/DRB1*0401(210.21) | VRSNAALGA/DRB1*0701(147.34) |
| PISKVDIGVPLLAMG | SKVDIGVPL/DRB1*0701(302.93) | VDIGVPLLA/DRB1*0101(69.29) | | |
| KGWPLHRMDIGVPLL | HRMDIGVPL/DRB1*0101(98.50) | HRMDIGVPL/DRB1*0701(275.09) | | |
| EVPFCSHHFHKIFMK | FCSHHFHKI/DRB1*0101(170.40) | FCSHHFHKI/DRB1*0701(34.41) | FCSHHFHKI/DRB1*1101(96.85) | |
| TQTWMSSEGAWKQIQ | WMSSEGAWK/DRB1*0101(81.52) | | | |
| RGEQRKTFVELMKRG | TFVELMKRG/DRB1*1101(365.93) | | | |
| CSHHFHKIFMKDGRE | HHFHKIFMK/DRB1*1101(104.56) | | | |
| KQRGILGRSQVGVGI | ILGRSQVGV/DRB1*0101(247.61) | | | |
| AGPLIAGGMLIACVV | PLIAGGMLI/DRB1*0101(125.56) | | | |
| WGNGCGLFGKGSLLT | GLFGKGSLL/DRB1*0101(218.86) | | | |
| KKVRSNAAMGAVFTE | VRSNAAMGA/DRB1*0101(16.37) | VRSNAAMGA/DRB1*0401(97.84) | VRSNAAMGA/DRB1*0701(229.39) | |
| LWSNGVLESQMLIPK | NGVLESQML/DRB1*0101(123.53) | | | |

FIG. 50-143

| peptide | core/HLA(affinity(nM)) | core/HLA(affinity(nM)) | core/HLA(affinity(nM)) |
|---|---|---|---|
| RELHKLGKCGSCYYN | LHKLGKCGS/DRB1*0101(350.20) | | |
| PYRTWAYHGSYEAPS | WAYHGSYEA/DRB1*0101(391.64) | | |
| ILCASQILLMRTSWA | ILLMRTSWA/DRB1*0101(23.22) | ILLMRTSWA/DRB1*0401(88.53) | ILLMRTSWA/DRB1*0701(494.20) | SQILLMRTS/DRB1*1101(110.68) |
| RVIQLSRKTFDSEYI | RVIQLSRKT/DRB1*1101(77.86) | | |
| GCVTTMAKNKPTLDI | CVTTMAKNK/DRB1*0701(377.16) | CVTTMAKNK/DRB1*1101(415.46) | TMAKNKPTL/DRB1*0101(297.31) |
| KRRLRTLILAPTRVV | LILAPTRVV/DRB1*0701(13.44) | LRTLILAPT/DRB1*0101(3.11) | LRTLILAPT/DRB1*0401(70.38) | LRTLILAPT/DRB1*1101(16.83) |
| KELLVTFKNPHAKRQ | LVTFKNPHA/DRB1*0101(6.19) | LVTFKNPHA/DRB1*0401(5.50) | LVTFKNPHA/DRB1*0701(44.41) | LVTFKNPHA/DRB1*1101(14.33) |
| EGKIVGLYGNGVTR | IVGLYGNGV/DRB1*0101(12.05) | | |
| LGSQEGAMHSALAGA | EGAMHSALA/DRB1*0101(436.88) | | |
| LPVWLAYKVASEGFQ | VWLAYKVAS/DRB1*1101(178.34) | WLAYKVASE/DRB1*0101(119.28) | WLAYKVASE/DRB1*0401(370.38) | WLAYKVASE/DRB1*0701(370.76) |
| KRARNRVSTPQGLVK | NRVSTPQGL/DRB1*0101(487.05) | NRVSTPQGL/DRB1*0701(407.26) | | |
| KHEWMTTEDMLKVWN | WMTTEDMLK/DRB1*0101(347.75) | WMTTEDMLK/DRB1*0401(361.58) | | |
| RPKWLDARTYSDPLA | WLDARTYSD/DRB1*0701(370.43) | | |
| MGYWIESQKNGSWKL | WIESQKNGS/DRB1*0101(356.88) | WIESQKNGS/DRB1*1101(302.95) | |
| LEFFLMVLLIPEPEK | MVLLIPEPE/DRB1*0101(421.29) | | |
| HRREKRSVALAPHVG | RSVALAPHV/DRB1*0101(332.00) | RSVALAPHV/DRB1*0701(406.68) | |
| DHPYKTWAYHGSYEV | WAYHGSYEV/DRB1*0101(370.25) | WAYHGSYEV/DRB1*0701(215.65) | |
| NEAVMAVGWSILAS | MAVGWSIL/DRB1*0101(324.19) | | |
| KNDVPLAGPMVAGGL | DVPLAGPMV/DRB1*0101(69.48) | | |
| TWALCEALTLATGPI | ALTLATGPI/DRB1*0701(340.34) | | |
| LTKPWDVLPMVTQIA | WDVLPMVTQ/DRB1*0101(104.15) | | |

FIG. 50-144

| peptide | core/HLA(affinity(nM)) | core/HLA(affinity(nM)) | core/HLA(affinity(nM)) |
|---|---|---|---|
| GSASSMVNGVVKLLT | MVNGVVKLL/DRB1*0101(304.94) | | |
| GSTIGKMFETTMRGA | IGKMFETTM/DRB1*0101(340.17) | | |
| LTAIANQAVVLMGLD | LTAIANQAV/DRB1*0101(27.63) | LTAIANQAV/DRB1*0701(245.90) | |
| YQFQADSPKRLATAI | FQADSPKRL/DRB1*0101(30.80) | FQADSPKRL/DRB1*0401(236.26) | FQADSPKRL/DRB1*0701(92.09) | FQADSPKRL/DRB1*1101(401.55) |
| TPQDNQLTYVVIAL | DNQLTYVVI/DRB1*0101(307.70) | QLTYVVIAI/DRB1*0701(342.27) | | |
| RKRRLTIMDLHPGAG | LTIMDLHPG/DRB1*0101(42.84) | LTIMDLHPG/DRB1*0401(155.60) | LTIMDLHPG/DRB1*1101(167.15) | |
| GSPGKFWNTTIAYST | FWNTTIAYS/DRB1*0101(187.97) | FWNTTIAVS/DRB1*0401(262.46) | KFWNTTIAV/DRB1*0701(105.34) | |
| LWSNGVLESEMIIPK | NGVLESEMI/DRB1*0101(365.08) | | | |
| ATVLMGLGKGWPISK | MGLGKGWPI/DRB1*0101(70.99) | MGLGKGWPI/DRB1*0701(378.25) | | |
| TTDISEMGANFKAGR | ISEMGANFK/DRB1*0101(420.75) | | | |
| AKRFSKGLFSGQGPM | FSKGLFSGQ/DRB1*0101(222.61) | KRFSKGLFS/DRB1*1101(378.56) | | |
| GTWVDIVLEHGGCVT | IVLEHGGCV/DRB1*0101(295.88) | | | |
| RRGDLPVWLAYKVAA | LPVWLAYKV/DRB1*0101(275.02) | VVWLAYKVAA/DRB1*1101(240.78) | | |
| VIQLSRKTFDSEYIK | VIQLSRKTF/DRB1*1101(493.75) | | | |
| GCGLFGKGSLVTCAK | FGKGSLVTC/DRB1*0101(42.21) | FGKGSLVTC/DRB1*0401(376.95) | FGKGSLVTC/DRB1*0701(337.92) | LFGKGSLVT/DRB1*1101(207.81) |
| VMLLILCASQILLMR | LLILCASQI/DRB1*0101(29.64) | LLILCASQI/DRB1*0701(164.37) | | |
| GYWIESALNDTWKME | YWIESALND/DRB1*0101(252.79) | YWIESALND/DRB1*0401(429.95) | | |
| AKFEKQLGQIMLLIL | FEKQLGQIM/DRB1*0101(13.45) | FEKQLGQIM/DRB1*0401(210.46) | FEKQLGQIM/DRB1*0701(210.46) | |
| GIFVIDNVHTWTEQY | IFVIDNVHT/DRB1*0101(194.08) | IFVIDNVHT/DRB1*0401(246.09) | | |
| LRTLILAPTRVVAAE | LILAPTRVV/DRB1*0101(2.93) | LILAPTRVV/DRB1*0401(40.24) | LILAPTRVV/DRB1*0701(18.73) | LILAPTRVV/DRB1*1101(15.43) |
| TRAQTWMSSEGAWRQ | QTWMSSEGA/DRB1*0101(59.30) | QTWMSSEGA/DRB1*0401(385.42) | | |

FIG. 50-145

| peptide | core/HLA(affinity(nM)) | core/HLA(affinity(nM)) | core/HLA(affinity(nM)) |
|---|---|---|---|
| KKLGEFGKAKGSRAI | FGKAKGSRA/DRB1*0101(38.36) | FGKAKGSRA/DRB1*0701(282.44) | FGKAKGSRA/DRB1*1101(338.98) |
| VDLRPASAWTLYAVA | LRPASAWTL/DRB1*0101(25.79) | LRPASAWTL/DRB1*0701(92.10) | |
| KHAVSRGTAKLRWIV | AVSRGTAKL/DRB1*0101(119.59) | AVSRGTAKL/DRB1*0701(67.20) | AVSRGTAKL/DRB1*1101(81.20) |
| EAHFTDPSSVAARGY | FTDPSVAA/DRB1*0101(323.19) | | |
| ARKTFVELMKRGDLP | FVELMKRGD/DRB1*1101(142.53) | | |
| RGAKRMAILGDTAWD | RMAILGDTA/DRB1*0101(417.40) | | |
| QVMLLILCASQILLM | LLILCASQI/DRB1*0101(22.71) | LLILCASQI/DRB1*0701(143.49) | |
| LYAVATTIVTPMLRH | ATTIVTPML/DRB1*0401(403.88) | ATTIVTPML/DRB1*0701(61.58) | TIVTPMLRH/DRB1*1101(385.31) | YAVATTIVT/DRB1*0101(101.27) |
| NQAWLMGLGRGWPI | MGLGRGWPI/DRB1*0701(419.59) | WLMGLGRG/DRB1*0101(64.90) | WLMGLGRG/DRB1*1101(496.20) |
| WLGARYLEFEALGFM | YLEFEALGF/DRB1*0101(136.54) | YLEFEALGF/DRB1*0701(312.96) | |
| KRGDLPVWLAYRVAA | LPVWLAYRV/DRB1*0101(212.46) | VWLAYRVAA/DRB1*1101(148.63) | |
| LCESITLATGPLSTL | ITLATGPLS/DRB1*0101(5.62) | ITLATGPLS/DRB1*0401(31.10) | ITLATGPLS/DRB1*0701(54.61) | ITLATGPLS/DRB1*1101(278.03) |
| NMLKRERNRVSTGSQ | LKRERNRVS/DRB1*0101(436.98) | LKRERNRVS/DRB1*1101(40.43) | |
| ATTFITPMMRHT | ATTFITPMM/DRB1*0101(153.56) | ATTFITPMM/DRB1*0401(405.00) | TFITPMMRH/DRB1*1101(153.71) | VATTFITPM/DRB1*0701(187.27) |
| PTSRTTWSIHATHEW | WSIHATHEW/DRB1*0701(490.28) | | |
| FAGHLIKCRLKMDKLE | GHLIKCRLKM/DRB1*1101(83.84) | | |
| KQKGIFGKTQVGVGV | IFGKTQVGV/DRB1*0101(491.03) | | |
| ISTRVGMGEAAAIFM | VGMGEAAAI/DRB1*0101(55.18) | | |
| GLLNGKGPLRMVLAF | LNGKGPLRM/DRB1*0101(37.31) | LNGKGPLRM/DRB1*0701(456.35) | LNGKGPLRM/DRB1*1101(442.50) |
| SKGLFSGQGPMKLVM | FSGQGPMKL/DRB1*0701(38.96) | LFSGQGPMK/DRB1*0101(8.37) | LFSGQGPMK/DRB1*0401(268.65) | LFSGQGPMK/DRB1*1101(421.69) |
| GAMHSALAGATEVDS | MHSALAGAT/DRB1*0101(106.81) | | |

FIG. 50-146

| peptide | core/HLA(affinity(nM)) | core/HLA(affinity(nM)) | core/HLA(affinity(nM)) | core/HLA(affinity(nM)) |
|---|---|---|---|---|
| LFMALVAFLRFLAIP | FMALVAFLR/DRB1*0101(35.99) | FMALVAFLR/DRB1*0701(256.72) | LVAFLRFLA/DRB1*1101(57.78) | |
| HAHHQWMTTEDMLTV | HQWMTTEDM/DRB1*0101(156.01) | HQWMTTEDM/DRB1*0401(151.18) | WMTTEDMLT/DRB1*0701(467.67) | |
| IKHAYSRGTAKLRWI | AVSRGTAKL/DRB1*0101(47.37) | AVSRGTAKL/DRB1*0701(80.53) | AVSRGTAKL/DRB1*1101(55.33) | |
| DIDCWCNLTSTWVTY | WCNLTSTWV/DRB1*0101(137.36) | WCNLTSTWV/DRB1*0701(249.11) | | |
| RRDLRLASNAICSAV | LRLASNAIC/DRB1*0101(7.62) | LRLASNAIC/DRB1*0401(29.03) | LRLASNAIC/DRB1*0701(76.45) | LRLASNAIC/DRB1*1101(327.98) |
| DGEYRLRGEARKTFV | YRLRGEARK/DRB1*0101(264.85) | YRLRGEARK/DRB1*1101(133.60) | | |
| PSLRTTTVSGKLIHE | TTTVSGKLI/DRB1*0101(288.36) | TTTVSGKLI/DRB1*0701(68.49) | | |
| PGRFWNTTIAVSTAN | FWNTTIAVS/DRB1*0401(159.45) | FWNTTIAVS/DRB1*1101(409.53) | WNTTIAVST/DRB1*0101(37.76) | WNTTIAVST/DRB1*0701(53.50) |
| LPVWLAHKVASEGFQ | VWLAHKVAS/DRB1*1101(289.14) | WLAHKVASE/DRB1*0101(193.79) | WLAHKVASE/DRB1*0701(491.14) | |
| PLHRMDIGVPLLAIG | HRMDIGVPL/DRB1*0101(32.77) | HRMDIGVPL/DRB1*0401(401.14) | HRMDIGVPL/DRB1*0701(218.67) | |
| TSRTWSIHASHEWM | WSIHASHEW/DRB1*0701(250.87) | | | |
| LFTGHLKCKVRMEKL | FTGHLKCKV/DRB1*1101(99.12) | | | |
| IWYMWLGARYLEFEA | YMWLGARYL/DRB1*0101(10.64) | YMWLGARYL/DRB1*0701(276.55) | YMWLGARYL/DRB1*1101(96.86) | |
| QGKTVWFVPSIKAGN | VWFVPSIKA/DRB1*0101(12.53) | VWFVPSIKA/DRB1*0401(65.28) | VWFVPSIKA/DRB1*0701(50.63) | VWFVPSIKA/DRB1*1101(20.88) |
| TRGPSLRTTTVTGKI | LRTTTVTGK/DRB1*0701(209.66) | | | |
| TQMAMIDTTPFGQQR | MAMIDTTPF/DRB1*0401(272.95) | MAMIDTTPF/DRB1*0701(458.26) | | |
| SILASSLLRNDVPMA | ILASSLLRN/DRB1*0701(409.64) | LLRNDVPMA/DRB1*0101(211.88) | LLRNDVPMA/DRB1*0401(189.74) | |
| LRTTVSGKLIHEWC | TTTVSGKLI/DRB1*0101(465.59) | TTTVSGKLI/DRB1*0701(173.96) | | |
| EWCCRSCTMPPLRFR | CRSCTMPPL/DRB1*0101(252.01) | | | |
| IENSSVNVSLTAIAN | VNVSLTAIA/DRB1*0101(132.63) | VNVSLTAIA/DRB1*0701(361.86) | | |
| IDCWCNLTSTWVTYG | WCNLTSTWV/DRB1*0101(103.32) | WCNLTSTWV/DRB1*0701(253.35) | | |

FIG. 50-147

| peptide | core/HLA(affinity(nM)) | core/HLA(affinity(nM)) | core/HLA(affinity(nM)) |
|---|---|---|---|
| AAVLMGLDKGWPLSK | MGLDKGWPL/DRB1*0101(182.09) | MGLDKGWPL/DRB1*0701(425.48) | |
| IIREAIKRKLRTLIL | IKRKLRTLI/DRB1*0701(91.29) | IKRKLRTLI/DRB1*1101(10.51) | KRKLRTLIL/DRB1*0101(164.31) |
| NEAVMAVGVVSILLS | MAVGVVSIL/DRB1*0101(328.76) | | |
| FQADSPKKLASAILN | FQADSPKKL/DRB1*0101(187.04) | FQADSPKKL/DRB1*0701(345.81) | |
| DHAHWTEAKMLLDNI | AHWTEAKML/DRB1*0701(438.55) | | |
| CGSLIGLTARATWAT | LIGLTARAT/DRB1*0101(2.48) | LIGLTARAT/DRB1*0401(248.16) | LIGLTARAT/DRB1*0701(452.93) | LIGLTARAT/DRB1*1101(35.09) |
| TRTETWMSEGAWKQ | ETWMSEGA/DRB1*0101(203.78) | | |
| TSWALCEVTLATGP | WALCEVTL/DRB1*0101(364.03) | | |
| DPASIAARGYISTRV | ARGYISTRV/DRB1*0701(437.53) | SIAARGYIS/DRB1*0101(197.49) | |
| ALCEVTLATGPLST | ITLATGPLS/DRB1*0401(61.08) | VITLATGPL/DRB1*0101(11.48) | VITLATGPL/DRB1*0701(101.90) |
| RGGWSYYCGGLKNVT | WSYYCGGLK/DRB1*1101(366.60) | YYCGGLKNV/DRB1*0101(212.67) | |
| EQYKFQPESPARVAS | FQPESPARV/DRB1*0101(9.12) | FQPESPARV/DRB1*0701(208.39) | YKFQPESPA/DRB1*0401(83.83) |
| KFQPESPARVASAIL | FQPESPARV/DRB1*0101(50.77) | | |
| YRIKQQGILGKTQVG | IKQQGILGK/DRB1*0101(108.70) | IKQQGILGK/DRB1*1101(248.80) | |
| EGTFHTMWHVTRGAV | FHTMWHVTR/DRB1*0101(17.00) | FHTMWHVTR/DRB1*1101(20.95) | MWHVTRGAV/DRB1*0701(120.25) |
| WVDWVLEHGSCVTTM | VLEHGSCV/DRB1*0101(107.81) | | |
| GNGCCGLFGKGSLVTC | GLFGKGSLV/DRB1*0101(178.60) | | |
| TACLGKSYAQMWTLM | KSYAQMWTL/DRB1*0701(224.36) | SYAQMWTLM/DRB1*0101(107.37) | |
| KLGEFGKAKGSRAIW | FGKAKGSRA/DRB1*0101(15.89) | FGKAKGSRA/DRB1*0401(400.27) | FGKAKGSRA/DRB1*0701(186.47) | FGKAKGSRA/DRB1*1101(167.92) |
| SRAIWYMWLGARYLE | IWYMWLGAR/DRB1*1101(57.57) | YMWLGARYL/DRB1*0101(8.34) | YMWLGARYL/DRB1*0701(269.62) |
| GVYRIKQQGILGKTQ | YRIKQQGIL/DRB1*0101(38.86) | YRIKQQGIL/DRB1*0701(336.18) | YRIKQQGIL/DRB1*1101(118.82) |

FIG. 50-148

| peptide | core/HLA(affinity(nM)) | core/HLA(affinity(nM)) | core/HLA(affinity(nM)) |
|---|---|---|---|
| AGPMVAGGLLLAAYV | PMVAGGLLL/DRB1*0101(60.20) | | |
| GPLIAGGMLIACYVI | GGMLIACYV/DRB1*0101(121.81) | | |
| VGMYSILASALLKND | MVSILASAL/DRB1*0101(5.02) | MVSILASAL/DRB1*0401(321.39) | MVSILASAL/DRB1*0701(76.47) | MVSILASAL/DRB1*1101(227.55) |
| YWISNGTGNIVASYN | ISNGTGNIV/DRB1*0101(223.31) | WISNGTGNI/DRB1*0701(275.95) | | |
| LTAIANQAAVLMGLG | AIANQAAVL/DRB1*0701(259.89) | IANQAAVLM/DRB1*0101(6.93) | IANQAAVLM/DRB1*0401(157.01) | |
| MSTYGWNLVKLMSGK | YGWNLVKLM/DRB1*0101(63.14) | YGWNLVKLM/DRB1*0401(261.48) | YGWNLVKLM/DRB1*1101(77.53) | |
| KSGKRVIQLSRKTFD | RVIQLSRKT/DRB1*1101(31.54) | | | |
| GKTWFVPSIKAGND | VWFVPSIKA/DRB1*0101(12.73) | VWFVPSIKA/DRB1*0401(67.33) | VWFVPSIKA/DRB1*0701(76.92) | VWFVPSIKA/DRB1*1101(22.75) |
| ILASALLKNDIPMTG | LLKNDIPMT/DRB1*0101(334.32) | LLKNDIPMT/DRB1*0401(480.50) | | |
| VTKSGDYVSAITQAE | YVSAITQAE/DRB1*0401(484.56) | | | |
| VIQLSRKTFDSEYVK | VIQLSRKTF/DRB1*1101(494.27) | | | |
| STANVSLAAIANQAT | NVSLAAIAN/DRB1*0101(23.54) | VSLAAIANQ/DRB1*0401(245.30) | | |
| MWTLMYFHRRDLRLA | YFHRRDLRL/DRB1*0101(35.35) | YFHRRDLRL/DRB1*0701(36.71) | YFHRRDLRL/DRB1*1101(9.90) | |
| AWWDLVLEHGGCVTT | LVLEHGGCV/DRB1*0101(165.21) | | | |
| CTREEFTRKVRSNAA | FTRKVRSNA/DRB1*1101(64.99) | | | |
| TWAYHGSYEVKATGS | WAYHGSYEV/DRB1*0701(408.35) | YHGSYEVKA/DRB1*0101(121.14) | | |
| NGCGLFGKGGIVTCA | FGKGGIVTC/DRB1*0101(346.70) | | | |
| YRIKQRGILGRSQYG | YRIKQRGIL/DRB1*0101(146.87) | YRIKQRGIL/DRB1*1101(54.42) | | |
| GVSILASSFLRNDV | VSILASSFL/DRB1*0101(17.52) | VSILASSF/DRB1*0401(377.88) | VSILASSF/DRB1*0701(59.90) | VSILASSF/DRB1*1101(307.62) |
| TTWSIHASHEWMTTE | WSIHASHEW/DRB1*0701(323.35) | | | |
| YDPKFEKQLGQYMLL | FEKQLGQYM/DRB1*0101(17.97) | FEKQLGQYM/DRB1*0701(284.93) | | |

FIG. 50-149

| peptide | core/HLA(affinity(nM)) | core/HLA(affinity(nM)) | core/HLA(affinity(nM)) |
|---|---|---|---|
| SYYMATLKNVREVKG | MATLKNVRE/DRB1*0101(17.59) | MATLKNVRE/DRB1*0401(121.28) | YYMATLKNV/DRB1*0701(94.83) |
| FHRRDLRLASMAICS | DLRLASMAI/DRB1*0101(12.82) | DLRLASMAI/DRB1*0401(432.73) | FHRRDLRLA/DRB1*1101(58.60) |
| NLTIMDLHPGAGKTK | LTIMDLHPG/DRB1*0101(150.86) | | |
| QYQFQPESPARVASA | FQPESPARV/DRB1*0101(8.20) | FQPESPARV/DRB1*0401(101.85) | FQPESPARV/DRB1*0701(260.67) |
| LGSSLLKNDVPLAGP | LLKNDVPLA/DRB1*0101(83.07) | LLKNDVPLA/DRB1*0401(109.53) | |
| EMYWVSNASGNIYSS | WVSNASGNI/DRB1*0101(32.53) | WVSNASGNI/DRB1*0401(131.78) | WVSNASGNI/DRB1*0701(46.29) |
| SKFEKQLGQVMLLIL | FEKQLGQVM/DRB1*0101(14.37) | FEKQLGQVM/DRB1*0701(260.87) | |
| KKVIQLSRKTFDSEY | KVIQLSRKT/DRB1*1101(42.28) | | |
| VRSNAAMGAVFTEEN | NAAMGAVFT/DRB1*0101(158.87) | | |
| NYNLVIMDEAHFTDP | YNLVIMDEA/DRB1*0101(252.32) | | |
| ELIMKDGRSLVWPCR | LIMKDGRSL/DRB1*0101(119.84) | LIMKDGRSL/DRB1*0701(388.41) | |
| GKIWGLYGNGVTRS | IVGLYGNGV/DRB1*0101(14.90) | | |
| HATHEWMTTEDMLSV | HEWMTTEDM/DRB1*0101(327.33) | WMTTEDMLS/DRB1*0401(236.08) | |
| VSNASGNIVSSVNMI | NIVSSVNMI/DRB1*0701(193.16) | | |
| GQVMLLVLCVTQVLL | LLVLCVTQV/DRB1*0101(472.25) | | |
| NTSANLSLTAIANQA | NLSLTAIAN/DRB1*0101(46.14) | NLSLTAIAN/DRB1*0401(297.35) | |
| EWMTTEDMLSVWNRV | WMTTEDMLS/DRB1*0101(410.14) | WMTTEDMLS/DRB1*0401(483.74) | |
| VPMSTYGWNLVKLMS | PMSTYGWNL/DRB1*0701(265.16) | YGWNLVKLM/DRB1*0101(107.68) | YGWNLVKLM/DRB1*0401(396.17) | YGWNLVKLM/DRB1*1101(264.50) |
| MRCIGIGNRDFVEGV | CIGIGNRDF/DRB1*0101(454.87) | | |
| KSYAQMWQLMYFHRR | MWQLMYFHR/DRB1*1101(39.55) | YAQMWQLMY/DRB1*0101(24.49) | YAQMWQLMY/DRB1*0401(467.06) | YAQMWQLMY/DRB1*0701(222.75) |
| GTYGLNIFTNMEAQL | LNTFTNMEA/DRB1*0101(91.13) | LNTFTNMEA/DRB1*0401(50.77) | LNTFTNMEA/DRB1*0701(329.40) |

FIG. 50-150

| peptide | core/HLA(affinity(nM)) | core/HLA(affinity(nM)) | core/HLA(affinity(nM)) |
|---|---|---|---|
| PMATYGWNLVKLHSG | MATYGWNLV/DRB1*0701(471.91) | YGWNLVKLH/DRB1*0101(162.03) | YGWNLVKLH/DRB1*0401(336.94) | YGWNLVKLH/DRB1*1101(110.09) |
| GWPISKMDIGVPLLA | SKMDIGVPL/DRB1*0101(79.89) | SKMDIGVPL/DRB1*0701(251.18) | | |
| GEERVILAGPIPVTP | VILAGPIPV/DRB1*0101(125.08) | | | |
| EESRTIRVLSLVENW | IRVLSLVEN/DRB1*0101(207.21) | | | |
| NRVSTGSQLAKRFSK | GSQLAKRFS/DRB1*1101(472.37) | NRVSTGSQL/DRB1*0101(462.68) | | |
| DITRTQTWMSEGAWK | QTWMSEGA/DRB1*0101(225.01) | | | |
| GGWSYYCAGLKKVTE | YYCAGLKKV/DRB1*0101(44.04) | YYCAGLKKV/DRB1*0701(179.13) | YYCAGLKKV/DRB1*1101(26.43) | |
| FVPSIKAGNDIAACL | IKAGNDIAA/DRB1*0101(453.90) | | | |
| TLYAVATTIITPMLR | LYAVATTII/DRB1*0701(36.28) | YAVATTIIT/DRB1*0101(44.10) | YAVATTIIT/DRB1*0401(191.46) | YAVATTIIT/DRB1*1101(403.08) |
| PDTIETLMLLTLIAV | IETLMLLTL/DRB1*0101(406.87) | | | |
| DIGVPLLAIGCYSQV | PLLAIGCYS/DRB1*0101(240.89) | | | |
| ASEMAEALKGLPIRY | AEALKGLPI/DRB1*0101(78.49) | | | |
| GSGIFITDNVHTWTE | IFITDNVHT/DRB1*0101(265.36) | IFITDNVHT/DRB1*0101(187.34) | IFITDNVHT/DRB1*0701(442.09) | |
| KTWLVHRQWFLNPL | WLVHRQWFL/DRB1*0101(78.36) | WLVHRQWFL/DRB1*0701(52.95) | WLVHRQWFL/DRB1*1101(196.80) | |
| ADSPKKLASAILNAH | KLASAILNA/DRB1*0701(408.75) | PKKLASAIL/DRB1*0101(82.62) | | |
| EELPETMETLLLLGL | PETMETLLL/DRB1*0101(480.50) | | | |
| EIVDLMCHATFTTRL | CHATFTTRL/DRB1*0701(136.92) | LMCHATFTT/DRB1*0101(280.61) | | |
| IENTTANISLAAIAN | NISLAAIAN/DRB1*0101(118.49) | | | |
| RREKRSVALAPHVG | RSVALAPHV/DRB1*0101(323.48) | RSVALAPHV/DRB1*0701(376.67) | | |
| VHYAIIGPGLQAKAT | YAIIGPGLQ/DRB1*0101(11.47) | YAIIGPGLQ/DRB1*0401(374.18) | YAIIGPGLQ/DRB1*0701(345.78) | YAIIGPGLQ/DRB1*1101(93.67) |
| AIANQAAILMGLDKG | IANQAAILM/DRB1*0101(55.83) | | | |

FIG. 50-151

| peptide | core/HLA(affinity(nM)) | core/HLA(affinity(nM)) | core/HLA(affinity(nM)) |
|---|---|---|---|
| TWVDIVLEHGGCVT | IVLEHGGCV/DRB1*0101(153.99) | | |
| NRDFVEGVSGGAWWD | FVEGVSGGA/DRB1*0101(106.80) | | |
| LCVTQVLLMRTTWAL | LLMRTTWAL/DRB1*0701(340.25) | TQVLLMRTT/DRB1*1101(124.71) | VLLMRTTWA/DRB1*0401(499.57) |
| DCWCNATSAWVTYGT | WCNATSAWV/DRB1*0101(296.16) | WCNATSAWV/DRB1*0701(485.60) | |
| NSYSGVEGEGLHRLG | YSGVEGEGL/DRB1*0101(153.71) | | |
| SWPLNEGVMAYGLVS | WPLNEGVMA/DRB1*0101(225.94) | | |
| KNLTIMDLHPGAGKT | LTIMDLHPG/DRB1*0101(67.79) | LTIMDLHPG/DRB1*0401(427.01) | |
| LRKNGKRVIQLSRKT | RVIQLSRKT/DRB1*1101(66.26) | | |
| RMAILGETAWDFGSV | ILGETAWDF/DRB1*0101(103.54) | | |
| IGQMFESTYRGAKRM | FESTYRGAK/DRB1*1101(108.57) | MFESTYRGA/DRB1*0101(487.02) | |
| LTVCYVLSGSSADLS | CYVLSGSSA/DRB1*0101(7.48) | CYVLSGSSA/DRB1*0701(51.33) | YVLSGSSAD/DRB1*0401(52.65) |
| GTGNIVASVNTTSRL | IVASVNTTS/DRB1*0101(87.93) | IVASVNTTS/DRB1*0401(63.91) | |
| RNRVSTGSQLAKRFS | NRVSTGSQL/DRB1*0101(252.38) | NRVSTGSQL/DRB1*0701(346.13) | |
| TDPASIAARGYISTR | SIAARGYIS/DRB1*0101(408.60) | | |
| MLLILCASQILLMRT | LLILCASQI/DRB1*0101(37.80) | LLILCASQI/DRB1*0701(205.16) | |
| GLKNVKEVRGFTKGG | VKEVRGFTK/DRB1*1101(377.23) | | |
| ICTREEFTSKVRSNA | FTSKVRSNA/DRB1*1101(243.44) | | |
| VPSIKITGNDIAACLR | IKTGNDIAA/DRB1*0101(450.56) | | |
| GRELKCGSGIFITNE | LKCGSGIFI/DRB1*0101(214.96) | | |
| YAQMWTLMYFHRRDL | WTLMYFHRR/DRB1*0101(49.43) | WTLMYFHRR/DRB1*0701(276.29) | WTLMYFHRR/DRB1*1101(29.53) |
| DKGWPLHRMDIGVPL | HRMDIGVPL/DRB1*0101(434.36) | | |

FIG. 50-152

| peptide | core/HLA(affinity(nM)) | core/HLA(affinity(nM)) | core/HLA(affinity(nM)) |
|---|---|---|---|
| AVSRGSAKLQWIVER | AVSRGSAKL/DRB1*0101(407.99) | | |
| EMYWVSGATGNIVSS | MYWVSGATG/DRB1*0101(53.23) | WVSGATGNI/DRB1*0701(134.17) | |
| LIACYVITGTSADLE | CYVITGTSA/DRB1*0101(55.87) | YVITGTSAD/DRB1*0701(179.80) | |
| FGSAYTALFSGVSWM | YTALFSGVS/DRB1*0101(9.68) | YTALFSGVS/DRB1*0401(250.32) | YTALFSGVS/DRB1*1101(77.89) |
| LNEAIMAVGLVSILL | NEAIMAVGL/DRB1*0101(167.03) | | |
| TEAKMLLDNIYTPEG | MLLDNIYTP/DRB1*0401(447.95) | | |
| AAILMGLDKGWPLHR | LMGLDKGWP/DRB1*1101(497.89) | MGLDKGWPL/DRB1*0101(130.02) | MGLDKGWPL/DRB1*0701(274.56) |
| PIRYQTTATKTEHTG | IRYQTTATK/DRB1*0101(169.17) | IRYQTTATK/DRB1*0401(121.59) | IRYQTTATK/DRB1*0701(289.23) |
| QGPMKMYMAFIAFLR | MKMYMAFIA/DRB1*0101(29.00) | VMAFIAFLR/DRB1*0701(169.18) | |
| DGCWYGMEIRPINEK | WYGMEIRPI/DRB1*0101(59.10) | WYGMEIRPI/DRB1*1101(296.95) | |
| VRTNAAMGAVFTEEN | VRTNAAMGA/DRB1*0101(176.11) | | |
| GSGQVTYGLNTFTN | VTYGLNTFT/DRB1*0101(409.61) | | |
| SGATGNIVSSVNMVS | IVSSVNMVS/DRB1*0401(336.01) | NIVSSVNMV/DRB1*0101(406.39) | NIVSSVNMV/DRB1*0701(220.73) |
| LMGLGKGWPLSKMDL | MGLGKGWPL/DRB1*0101(133.93) | | |
| ENSTANVSLAAIANQ | NVSLAAIAN/DRB1*0101(110.49) | | |
| QEGAMHSALTGATEV | MHSALTGAT/DRB1*0101(284.84) | | |
| VPLAGPLIAGGMLIA | PLIAGGMLI/DRB1*0101(173.52) | | |
| PMVTQMAMTDTTPFG | MAMTDTTPF/DRB1*0701(465.31) | MVTQMAMTD/DRB1*0101(298.82) | |
| IGKMFETTMRGAKRM | FETTMRGAK/DRB1*0101(192.14) | FETTMRGAK/DRB1*1101(63.68) | |
| REEFTRKVRSNAAIG | FTRKVRSNA/DRB1*0101(170.62) | FTRKVRSNA/DRB1*0701(281.77) | FTRKVRSNA/DRB1*1101(27.45) |
| GSYLAGAGLAFSLIK | YLAGAGLAF/DRB1*0101(18.68) | | |

FIG. 50-153

| peptide | core/HLA(affinity(nM)) | core/HLA(affinity(nM)) | core/HLA(affinity(nM)) |
|---|---|---|---|
| ASVNTSRLLINRFT | SRLLINRFT/DRB1*0101(109.07) | TSRLLINRF/DRB1*1101(80.89) | VNTTSRLLI/DRB1*0701(68.97) |
| SVNVSLTAIANQAAV | LTAIANQAA/DRB1*0401(61.20) | LTAIANQAA/DRB1*0701(214.33) | SLTAIANQA/DRB1*0101(14.93) |
| SQVGVGIHMENVFHT | IHMENVFHT/DRB1*0101(329.30) | IHMENVFHT/DRB1*0401(483.31) | |
| TANISLAAIANQATV | ISLAAIANQ/DRB1*0401(87.61) | ISLAAIANQ/DRB1*0701(273.91) | NISLAAIAN/DRB1*0101(15.03) |
| LAAIANQAAILMGLD | AIANQAAIL/DRB1*0701(340.71) | IANQAAILM/DRB1*0101(10.24) | IANQAAILM/DRB1*0401(229.05) |
| SPTVEAGRTLRVLNL | VEAGRTLRV/DRB1*0101(55.74) | VEAGRTLRV/DRB1*0701(122.18) | |
| IRYQTAVKSEHTGK | IRYQTAVK/DRB1*0101(219.71) | IRYQTAVK/DRB1*0401(411.32) | RYQTAVKS/DRB1*0701(204.29) |
| WTLYAVATTFITPMM | LYAVATTFI/DRB1*0701(31.42) | YAVATTFI/DRB1*0101(32.50) | YAVATTFI/DRB1*0401(114.93) | YAVATTFIT/DRB1*1101(315.08) |
| GVFHTMWHVTRGSVI | FHTMWHVTR/DRB1*0101(14.20) | FHTMWHVTR/DRB1*1101(19.13) | WHVTRGSVI/DRB1*0701(10.48) |
| ALTLATGPVSTLWEG | LTLATGPVS/DRB1*0101(32.31) | | |
| QPHWIAASIILEFFL | HWIAASIIL/DRB1*0701(84.55) | PHWIAASIIL/DRB1*0101(84.41) | |
| LTAIANQATVLMGLG | AIANQATVL/DRB1*0701(320.06) | IANQATVLM/DRB1*0101(16.46) | IANQATVLM/DRB1*0401(103.37) |
| LTKPWDWVPMVTQLA | WPMVTQLA/DRB1*0101(116.47) | | |
| RGDLPVWLSYKVASA | VWLSYKVAS/DRB1*1101(97.11) | WLSYKVASA/DRB1*0101(68.06) | WLSYKVASA/DRB1*0401(251.01) | WLSYKVASA/DRB1*0701(308.53) |
| ITVIDLEPVIYDSKF | VIDLEPVIY/DRB1*0101(266.32) | | |
| LGKAYAQMWSLMYFH | YAQMWSLMY/DRB1*0101(15.47) | YAQMWSLMY/DRB1*0401(194.50) | YAQMWSLMY/DRB1*0701(127.89) | YAQMWSLMY/DRB1*1101(181.79) |
| SEGVYRIKQRGILGR | VYRIKQRGI/DRB1*0101(86.12) | YRIKQRGIL/DRB1*0701(181.15) | YRIKQRGIL/DRB1*1101(18.78) |
| AYQHALSELPETLET | YQHALSELP/DRB1*0101(18.35) | YQHALSELP/DRB1*0401(86.11) | YQHALSELP/DRB1*0701(83.97) |
| LLSSTRVPNYNLIVM | STRVPNYNL/DRB1*0101(186.32) | STRVPNYNL/DRB1*0701(80.46) | |
| HPGAGKTKRYLPAIV | TKRYLPAIV/DRB1*0101(447.84) | | |
| WAFCEALTLATGPVS | FCEALTLAT/DRB1*0101(32.64) | FCEALTLAT/DRB1*0401(85.53) | FCEALTLAT/DRB1*0701(136.89) | FCEALTLAT/DRB1*1101(368.43) |

FIG. 50-154

| peptide | core/HLA(affinity(nM)) | core/HLA(affinity(nM)) | core/HLA(affinity(nM)) | core/HLA(affinity(nM)) |
|---|---|---|---|---|
| KRQDVIVLGSQEGAM | VIVLGSQEG/DRB1*0101(121.66) | | | |
| YKFQPESPARLASAI | FQPESPARL/DRB1*0101(12.02) | FQPESPARL/DRB1*0401(192.94) | FQPESPARL/DRB1*0701(341.98) | |
| TPMLRHSIENSSVNV | LRHSIENSS/DRB1*0101(356.72) | LRHSIENSS/DRB1*0701(352.51) | | |
| RAQTWMSAEGAWRQV | WMSAEGAWR/DRB1*0101(17.45) | WMSAEGAWR/DRB1*0401(251.26) | WMSAEGAWR/DRB1*0701(411.89) | |
| EWMITEDMLAVWNRV | WMITEDMLA/DRB1*0101(289.98) | WMITEDMLA/DRB1*0401(429.94) | | |
| PNYNLVYMDEAHFTD | YNLVYMDEA/DRB1*0101(294.01) | | | |
| HQLIMKDGRVLVVPC | IMKDGRVLV/DRB1*1101(199.48) | LIMKDGRVL/DRB1*0701(305.10) | QLIMKDGRV/DRB1*0101(56.87) | |
| DGVCGVRSTTRLENL | CGVRSTTRL/DRB1*0701(356.35) | | | |
| IVAIDLDPISYDAKF | VAIDLDPIS/DRB1*0401(335.13) | | | |
| MRITWALCEVITLAT | MRITWALCE/DRB1*0701(494.56) | WALCEVITL/DRB1*0101(306.17) | | |
| GEERVILAGPMPVTH | RVILAGPMP/DRB1*0101(78.85) | | | |
| EMGANFKAERVIDPR | FKAERVIDP/DRB1*0101(475.35) | FKAERVIDP/DRB1*0401(371.87) | | |
| FAGKTVWFVPSIKTG | VWFVPSIKT/DRB1*0101(41.74) | VWFVPSIKT/DRB1*0401(307.95) | VWFVPSIKT/DRB1*0701(58.35) | VWFVPSIKT/DRB1*1101(53.16) |
| WAFCESLTLATGPVL | FCESLTLAT/DRB1*0401(104.40) | LTLATGPVL/DRB1*0101(32.95) | LTLATGPVL/DRB1*0701(59.80) | |
| KELKCGNGIFVADNV | LKCGNGIFV/DRB1*0101(381.36) | | | |
| LNDWDFVVTDISEM | WDFVVTDI/DRB1*0701(211.95) | | | |
| QAAILMGLGKGWPLH | MGLGKGWPL/DRB1*0101(76.15) | | | |
| PYKTWAYHGSYEVKP | WAYHGSYEV/DRB1*0101(192.61) | WAYHGSYEV/DRB1*0701(178.30) | | |
| VLMGLDKGWPISKMD | MGLDKGWPI/DRB1*0101(279.16) | MGLDKGWPI/DRB1*0701(411.20) | | |
| TGLLNGKGPLRMVLA | LLNGKGPLR/DRB1*1101(346.30) | LNGKGPLRM/DRB1*0101(22.18) | LNGKGPLRM/DRB1*0701(307.65) | |
| IMQRGLFGYSQIGAG | QRGLFGYSQ/DRB1*0101(167.69) | | | |

FIG. 50-155

| peptide | core/HLA(affinity(nM)) | core/HLA(affinity(nM)) | core/HLA(affinity(nM)) |
|---|---|---|---|
| TIETLMLTILLATVT | LLTLLATVT/DRB1*0101(151.95) | | |
| TIENTSANLSLAAIA | ENTSANLSL/DRB1*0701(295.12) | IENTSANLS/DRB1*0101(135.47) | |
| AKRFSRGMLQGQGPM | AKRFSRGML/DRB1*1101(304.11) | FSRGMLQGQ/DRB1*0101(218.40) | |
| ASSMINGVVRLLTKP | INGVVRLLT/DRB1*1101(69.28) | MINGVVRLL/DRB1*0101(98.15) | MINGVVRLL/DRB1*0701(438.63) |
| QVLLMRTTWALCEAL | LMRTTWALC/DRB1*0101(91.44) | LMRTTWALC/DRB1*0401(488.76) | LMRTTWALC/DRB1*0701(230.16) | LMRTTWALC/DRB1*1101(437.29) |
| EWCCRSCTLPPLRYM | CRSCTLPPL/DRB1*0101(446.81) | | |
| VSMANIFRGSYLAGA | ANIFRGSYL/DRB1*0101(90.91) | ANIFRGSYL/DRB1*0701(380.96) | MANIFRGSY/DRB1*1101(218.81) |
| PILTLWEGNPGRFWN | LWEGNPGRF/DRB1*0101(425.48) | | |
| VAFLRFLAIPPTAGI | FLAIPPTAG/DRB1*0101(2.68) | FLAIPPTAG/DRB1*0401(17.41) | FLRFLAIPP/DRB1*1101(24.51) | RFLAIPPTA/DRB1*0701(26.13) |
| ETACLGKAYAQMWSL | CLGKAYAQM/DRB1*0101(129.02) | KAYAQMWSL/DRB1*0701(421.39) | |
| AGWSLKETACLGKSY | WSLKETACL/DRB1*0101(161.02) | | |
| IFVIDNVHTWTEQYQ | IFVIDNVHT/DRB1*0101(357.16) | | |
| LLALNDMGKIRKDIQ | LLALNDMGK/DRB1*0101(362.60) | | |
| MAVGLVSILLSSLLK | LVSILLSSL/DRB1*0101(268.35) | VSILLSSLL/DRB1*0101(16.42) | VSILLSSLL/DRB1*0701(96.88) |
| SSVAARGYISTRVEM | ARGYISTRV/DRB1*0701(364.86) | SVAARGYIS/DRB1*0101(244.66) | |
| RDLRLASMAICAVP | DLRLASMAI/DRB1*0101(21.19) | DLRLASMAI/DRB1*0701(296.26) | LASMAICSA/DRB1*0401(396.86) |
| ADMGYWIESRLNDTW | YWIESRLND/DRB1*1101(429.38) | | |
| IHAHHQWMTTEDMLT | HQWMTTEDM/DRB1*0101(379.08) | HQWMTTEDM/DRB1*0401(314.52) | |
| VGAVTLDFSPGTSGS | VTLDFSPGT/DRB1*0401(163.54) | | |
| TTDISEMGANFKAER | ISEMGANFK/DRB1*0101(468.04) | | |
| QFCVKVLNPYMPAVI | CVKVLNPYM/DRB1*0101(35.81) | CVKVLNPYM/DRB1*0401(312.31) | CVKVLNPYM/DRB1*0701(160.02) | CVKVLNPYM/DRB1*1101(53.75) |

FIG. 50-156

| peptide | core/HLA(affinity(nM)) | core/HLA(affinity(nM)) | core/HLA(affinity(nM)) | core/HLA(affinity(nM)) |
|---|---|---|---|---|
| KMFETTMRGAKRMAI | ETTMRGAKR/DRB1*0101(83.76) | FETTMRGAK/DRB1*1101(37.93) | MRGAKRMAI/DRB1*0701(461.30) | |
| LRNDVPLAGPLIAGG | DVPLAGPLI/DRB1*0101(28.15) | | | |
| ADSPKRLASAIQKAH | LASAIQKAH/DRB1*1101(397.82) | PKRLASAIQ/DRB1*0101(224.30) | | |
| PESLETLMLVALLAT | LETLMLVAL/DRB1*0101(322.31) | | | |
| YGNGWTTSGTYVSA | WTTSGTYV/DRB1*0101(206.31) | WTTSGTYV/DRB1*0701(120.40) | | |
| MQRGLFGYSQIGAGV | QRGLFGYSQ/DRB1*0101(138.63) | | | |
| GATGNIVSSVNMVSR | IVSSVNMVS/DRB1*0401(175.62) | | | |
| GIMTIDLDPWYDSK | IDLDPWYD/DRB1*0401(325.99) | | | |
| PSFNMLKRARNRVST | FNMLKRARN/DRB1*0101(11.42) | FNMLKRARN/DRB1*0401(157.46) | NIVSSVNMV/DRB1*0701(150.11) | |
| LMGLGKGWPIHRMDL | LGKGWPIHR/DRB1*0101(110.52) | FNMLKRARN/DRB1*0401(157.46) | FNMLKRARN/DRB1*0701(53.18) | FNMLKRARN/DRB1*1101(3.69) |
| TFTNMEAQLIRQMES | FTNMEAQLI/DRB1*0101(12.58) | LGKGWPIHR/DRB1*0701(391.09) | LGKGWPIHR/DRB1*1101(498.95) | |
| VTTIAKSKPTLDIEL | IAKSKPTLD/DRB1*0101(56.87) | FTNMEAQLI/DRB1*0401(267.06) | FTNMEAQLI/DRB1*0701(219.21) | FTNMEAQLI/DRB1*1101(495.18) |
| ISLTAIANQATVLMG | IANQATVLM/DRB1*0401(60.31) | IAKSKPTLD/DRB1*0701(37.25) | TIAKSKPTL/DRB1*1101(304.18) | |
| GERKKLRPRWLDARV | RKKLRPRWL/DRB1*1101(437.18) | LTAIANQAT/DRB1*0101(11.32) | LTAIANQAT/DRB1*0701(179.09) | |
| PDTIETLMLLTLLAT | IETLMLLTL/DRB1*0101(342.51) | | | |
| VGTYGLNTFTNMEAQ | LNTFTNMEA/DRB1*0401(99.22) | YGLNTFTNM/DRB1*0101(240.51) | | |
| GPMKLVMAFIAFLRF | VMAFIAFLR/DRB1*0101(56.68) | VMAFIAFLR/DRB1*0701(206.74) | VMAFIAFLR/DRB1*1101(229.78) | |
| FGSVYTTMFGGVSWV | FGSVYTTMF/DRB1*0701(256.09) | YTTMFGGVS/DRB1*0101(20.52) | | |
| AGYYKEGVFHTMWHV | GVFHTMWHV/DRB1*0701(431.96) | YKEGVFHTM/DRB1*0101(207.45) | | |
| WCCRSCTLPPLRFKG | SCTLPPLRF/DRB1*0101(398.09) | | | |
| SGRGPLKLFMALVAF | PLKLFMALV/DRB1*0101(49.09) | PLKLFMALV/DRB1*1101(440.01) | | |

FIG. 50-157

| peptide | core/HLA(affinity(nM)) | core/HLA(affinity(nM)) | core/HLA(affinity(nM)) | core/HLA(affinity(nM)) |
|---|---|---|---|---|
| LLMRTTWALCEALTL | WALCEALTL/DRB1*0101(86.09) | WALCEALTL/DRB1*0701(163.64) | | |
| VALAPHVGMGLETRA | LAPHVGMGL/DRB1*0101(378.46) | | | |
| RENSFSGVEGEGLHK | FSGVEGEGL/DRB1*0101(311.38) | FSGVEGEGL/DRB1*0701(489.45) | | |
| VKRFSSELLSGRGPL | FSSELLSGR/DRB1*0101(183.48) | FSSELLSGR/DRB1*0401(479.07) | | |
| RVIDPRRCLKPVILK | PRRCLKPVI/DRB1*1101(492.78) | | | |
| IANQAVVLMGLDKGW | AVVLMGLDK/DRB1*0101(441.75) | | | |
| GSCVTTMAKNKPTLD | CVTTMAKNK/DRB1*0101(439.37) | CVTTMAKNK/DRB1*0701(494.50) | CVTTMAKNK/DRB1*1101(404.63) | |
| LGARYLEFEALGFMN | YLEFEALGF/DRB1*0101(101.26) | YLEFEALGF/DRB1*0701(343.27) | | |
| FEKQLGQIMLLILCT | FEKQLGQIM/DRB1*0101(74.03) | | | |
| GIFVADNVHTRTEQY | FVADNVHTR/DRB1*0401(118.01) | IFVADNVHT/DRB1*0101(192.98) | | |
| QAAILMGLDKGWPLH | MGLDKGWPL/DRB1*0101(241.78) | | | |
| TGNDIAACLRKSGKR | IAACLRKSG/DRB1*1101(67.03) | | | |
| RYLPAMVREAIRRGL | MVREAIRRG/DRB1*1101(218.43) | YLPAMVREA/DRB1*0101(234.87) | | |
| SALLKNDIPMTGPLV | DIPMTGPLV/DRB1*0101(42.64) | LLKNDIPMT/DRB1*0401(135.71) | | |
| QAVVLMGLGKGWPIH | MGLGKGWPI/DRB1*0701(393.97) | WLMGLGKG/DRB1*0101(95.39) | | |
| VSLAAIANQAVVLMG | LAAIANQAV/DRB1*0101(12.35) | LAAIANQAV/DRB1*0401(221.80) | LAAIANQAV/DRB1*0701(139.86) | |
| NETWKLEKASFIEVK | WKLEKASFI/DRB1*0101(26.63) | WKLEKASFI/DRB1*0401(325.56) | WKLEKASFI/DRB1*0701(160.44) | |
| DVDLHPASAWTLYAV | LHPASAWTL/DRB1*0101(28.32) | LHPASAWTL/DRB1*0701(71.09) | | |
| GIFVTDNVHTWTEQY | IFVTDNVHT/DRB1*0401(297.43) | | | |
| MEEALKGLPIRYQTP | ALKGLPIRY/DRB1*0101(90.32) | LKGLPIRYQ/DRB1*1101(268.42) | | |
| ADMGYWIESSKNQTW | YWIESSKNQ/DRB1*0101(313.62) | YWIESSKNQ/DRB1*0401(186.73) | | |

FIG. 50-158

| peptide | core/HLA(affinity(nM)) | core/HLA(affinity(nM)) | core/HLA(affinity(nM)) |
|---|---|---|---|
| QAVVLMGLGRGWPIH | MGLGRGWPI/DRB1*0701(290.14) | WLMGLGRG/DRB1*0101(56.39) | WLMGLGRG/DRB1*1101(409.79) |
| YVITGTSADLTVEKA | VITGTSADL/DRB1*0101(189.19) | VITGTSADL/DRB1*0701(426.24) | |
| HAHWTEAKMLLDNIN | AHWTEAKML/DRB1*0701(454.98) | | |
| YLPAIVREALKRRLR | AIVREALKR/DRB1*0101(231.82) | IVREALKRR/DRB1*1101(33.55) | |
| WQLMYFHRRDLRLAS | YFHRRDLRL/DRB1*0101(27.60) | YFHRRDLRL/DRB1*0701(37.39) | YFHRRDLRL/DRB1*1101(9.27) |
| QMWTLMYFHRRDLRL | WTLMYFHRR/DRB1*0101(46.42) | YFHRRDLRL/DRB1*0701(47.68) | YFHRRDLRL/DRB1*1101(12.73) |
| SPNPTIEESRTIRVL | IEESRTIRV/DRB1*0701(67.76) | | |
| FNMLKRARNRVSTPQ | FNMLKRARN/DRB1*0101(26.14) | FNMLKRARN/DRB1*0701(121.10) | FNMLKRARN/DRB1*1101(7.26) | LKRARNRVS/DRB1*0401(373.48) |
| TRVEMGEAAGIFMTA | VEMGEAAGI/DRB1*0101(87.67) | | |
| GPMPVTVASAAQRRG | PVTVASAAQ/DRB1*0101(369.18) | | |
| SKMDLGVPLLALGCY | MDLGVPLLA/DRB1*0101(60.86) | | |
| ETACLGKSYAQMWAL | CLGKSYAQM/DRB1*0101(215.45) | LGKSYAQMW/DRB1*0701(338.43) | |
| GPLKLFMALVAFLRF | FMALVAFLR/DRB1*0101(14.87) | FMALVAFLR/DRB1*0701(212.81) | FMALVAFLR/DRB1*1101(111.53) |
| YNMVIMDEAHFTDPS | VIMDEAHFT/DRB1*0101(302.05) | | |
| CGLFGKGSLLTCAKF | FGKGSLLTC/DRB1*0101(34.67) | FGKGSLLTC/DRB1*0401(286.94) | FGKGSLLTC/DRB1*0701(215.49) | LFGKGSLLT/DRB1*1101(100.43) |
| ILLMRTSWAFCESLT | ILLMRTSWA/DRB1*0101(73.52) | MRTSWAFCE/DRB1*0701(254.35) | |
| MLVRNPLSRNSTHEM | MLVRNPLSR/DRB1*1101(471.98) | | |
| WGLYGNGVTKNGG | WGLYGNGV/DRB1*0101(257.03) | | |
| VALVPHVGMGLETRA | LVPHVGMGL/DRB1*0101(175.81) | | |
| SIGQMFESTYRGAKR | FESTYRGAK/DRB1*1101(202.64) | | |
| CAVQLLMRTSWALC | LLLMRTSWA/DRB1*0101(12.50) | LLLMRTSWA/DRB1*0401(157.63) | LLMRTSWAL/DRB1*0701(173.56) | VQLLLMRTS/DRB1*1101(79.00) |

FIG. 50-159

| peptide | core/HLA(affinity(nM)) | core/HLA(affinity(nM)) | core/HLA(affinity(nM)) | core/HLA(affinity(nM)) |
|---|---|---|---|---|
| VPNYNLVIMDEAHFT | YNLVIMDEA/DRB1*0101(151.65) | | | |
| KLRPRWLDARIYSDP | PRWLDARIY/DRB1*0101(449.39) | | | |
| LMRTTWALCEALTLA | WALCEALTL/DRB1*0101(60.45) | WALCEALTL/DRB1*0701(191.85) | | |
| TVCYVLSGSSADLSL | CYVLSGSSA/DRB1*0101(6.96) | VCYVLSGSS/DRB1*1101(306.04) | YVLSGSSAD/DRB1*0401(48.76) | YVLSGSSAD/DRB1*0701(46.00) |
| MENVFHTMWHVTRGA | FHTMWHVTR/DRB1*0101(16.54) | FHTMWHVTR/DRB1*0401(385.74) | FHTMWHVTR/DRB1*1101(22.94) | VFHTMWHVT/DRB1*0701(132.87) |
| GSGKTRKYLPAIIRE | TRKYLPAII/DRB1*0101(112.84) | TRKYLPAII/DRB1*0701(455.18) | TRKYLPAII/DRB1*1101(282.80) | |
| PIHRMDLGVPLLALG | HRMDLGVPL/DRB1*0101(21.24) | HRMDLGVPL/DRB1*0401(471.60) | HRMDLGVPL/DRB1*0701(275.82) | |
| VRSNAAIGAVFVDEN | VRSNAAIGA/DRB1*0101(135.83) | | | |
| LPAMVREAIRRGLRT | MVREAIRRG/DRB1*0101(277.95) | MVREAIRRG/DRB1*1101(80.18) | | |
| TAIANQAAILMGLGK | IANQAAILM/DRB1*0101(19.97) | | | |
| KNGKRVIQLSRKTFD | RVIQLSRKT/DRB1*1101(32.24) | | | |
| GSLIGLSSRATWAKN | LIGLSSRAT/DRB1*0101(2.73) | LIGLSSRAT/DRB1*0401(64.86) | LIGLSSRAT/DRB1*0401(235.36) | LIGLSSRAT/DRB1*1101(23.49) |
| SWAFCEALTLATGPV | FCEALTLAT/DRB1*0101(24.17) | FCEALTLAT/DRB1*0401(56.53) | FCEALTLAT/DRB1*0701(101.00) | FCEALTLAT/DRB1*1101(243.99) |
| KYLPAIVREAIKRKL | IVREAIKRK/DRB1*1101(75.66) | YLPAIVREA/DRB1*0101(176.00) | | |
| CGSGIFITNNVHTWT | IFITNNVHT/DRB1*0101(191.83) | IFITNNVHT/DRB1*0401(218.52) | IFITNNVHT/DRB1*0701(221.91) | |
| PTIEESRTIRVLSLV | ESRTIRVLS/DRB1*1101(495.45) | IEESRTIRV/DRB1*0101(141.57) | IEESRTIRV/DRB1*0701(40.35) | |
| LEFFMMVLLYPEPEK | MMVLLYPEP/DRB1*0101(276.69) | | | |
| TRLLSSTRVPNVNLI | LLSSTRVPN/DRB1*0401(296.64) | LLSSTRVPN/DRB1*1101(135.83) | LSSTRVPNV/DRB1*0701(33.27) | TRLLSSTRV/DRB1*0101(32.19) |
| QWCCRSCTLPPLRYL | CRSCTLPPL/DRB1*0101(335.37) | CRSCTLPPL/DRB1*0701(405.22) | | |
| MGYWIESSKNQTWQI | YWIESSKNQ/DRB1*0101(247.13) | YWIESSKNQ/DRB1*0401(188.57) | YWIESSKNQ/DRB1*0701(447.61) | YWIESSKNQ/DRB1*1101(423.75) |
| EMYWVSCGTGNIVSA | WVSCGTGNI/DRB1*0101(125.83) | WVSCGTGNI/DRB1*0701(168.40) | | |

FIG. 50-160

| peptide | core/HLA(affinity(nM)) | core/HLA(affinity(nM)) | core/HLA(affinity(nM)) | core/HLA(affinity(nM)) |
|---|---|---|---|---|
| LDVDLRPASAWTLYA | LRPASAWTL/DRB1*0101(21.09) | LRPASAWTL/DRB1*0701(68.42) | | |
| SYSGVEGEGLHRLGY | YSGVEGEGL/DRB1*0101(214.87) | | | |
| LNEAVMAVGVVSILL | AVMAVGVVS/DRB1*0101(276.11) | | | |
| RRGDLPVWLSYKVAS | LPVWLSYKV/DRB1*0101(442.75) | VWLSYKVAS/DRB1*1101(223.85) | | |
| RLEFEALGFLNEDH | FLEFEALGF/DRB1*0101(165.97) | | | |
| NDQYIYMGQPLNNDE | YIYMGQPLN/DRB1*0101(41.20) | | | |
| THEMYWVSNASGNIV | MYWVSNASG/DRB1*0101(32.31) | MYWVSNASG/DRB1*0401(77.28) | WVSNASGNI/DRB1*0701(50.59) | |
| RGARRMAILGDTAWD | RMAILGDTA/DRB1*0101(386.90) | | | |
| EDYGFGVFTNIWLK | FGVFTNIW/DRB1*0401(457.24) | GFGVFTNI/DRB1*0101(348.01) | GFGVFTNI/DRB1*0701(154.71) | |
| LKETACLGKSYAQMW | TACLGKSYA/DRB1*0101(399.08) | TACLGKSYA/DRB1*1101(386.11) | | |
| ETLLLLALLGAMTAG | LLALLGAMT/DRB1*0101(7.77) | LLALLGAMT/DRB1*1101(421.72) | | |
| RFWNTTIAVSMANIF | NTTIAVSMA/DRB1*0401(298.55) | WNTTIAVSM/DRB1*0101(32.42) | WNTTIAVSM/DRB1*0701(32.59) | |
| PFNMLKRERNRVSTG | FNMLKRERN/DRB1*0101(93.03) | FNMLKRERN/DRB1*0701(431.57) | FNMLKRERN/DRB1*1101(19.25) | LKRERNRVS/DRB1*0401(435.54) |
| VVTRSGAYVSAIAQA | AYVSAIAQA/DRB1*0101(165.26) | | | |
| SLIGLTARATWATNI | ARATWATNI/DRB1*0701(326.64) | LIGLTARAT/DRB1*0101(4.33) | LIGLTARAT/DRB1*1101(77.16) | |
| CLGKSYAQMWTLMYF | SYAQMWTLM/DRB1*0101(33.74) | YAQMWTLMY/DRB1*0401(220.37) | YAQMWTLMY/DRB1*0701(126.49) | YAQMWTLMY/DRB1*1101(319.86) |
| AYRHAVEELPETMET | YRHAVEELP/DRB1*0101(239.62) | | | |
| CVTTMAQGKPTLDIE | TMAQGKPTL/DRB1*0101(160.86) | | | |
| AIVREALKRRLRTLI | LKRRLRTLI/DRB1*0701(251.47) | LKRRLRTLI/DRB1*1101(15.87) | VREALKRRL/DRB1*0101(238.71) | |
| LHKLGKCGSCVYNMM | KLGKCGSCV/DRB1*0101(241.36) | | | |
| ANFRAERVIDPRRCL | FRAERVIDP/DRB1*0101(163.16) | FRAERVIDP/DRB1*0401(175.24) | | |

FIG. 50-161

| peptide | core/HLA(affinity(nM)) | core/HLA(affinity(nM)) | core/HLA(affinity(nM)) | core/HLA(affinity(nM)) |
|---|---|---|---|---|
| WVSNASGNIVSSVNM | WVSNASGNI/DRB1*0101(494.98) | WVSNASGNI/DRB1*0701(407.45) | | |
| WCCRSCTLPPLRYMG | SCTLPPLRY/DRB1*0101(398.11) | | | |
| DGEYRLRGESRKTFV | YRLRGESRK/DRB1*1101(264.88) | | | |
| EWCCRSCTLPPLRFK | CRSCTLPPL/DRB1*0101(457.25) | | | |
| ILTVLLKTALLIVSG | LLKTALLIV/DRB1*0701(301.20) | LTVLLKTAL/DRB1*1101(190.39) | TVLLKTALL/DRB1*0101(54.89) | |
| SLLKNDVPLAGPMVA | DVPLAGPMV/DRB1*0101(35.42) | LLKNDVPLA/DRB1*0401(125.54) | | |
| KFEKQLGQVMLLVLC | FEKQLGQVM/DRB1*0101(25.64) | FEKQLGQVM/DRB1*0701(470.21) | | |
| DLRLAANAICSAVPV | LRLAANAIC/DRB1*0101(25.01) | LRLAANAIC/DRB1*0401(212.72) | LRLAANAIC/DRB1*0701(290.06) | |
| VIALEPGKNPRAVQT | LEPGKNPRA/DRB1*0101(119.19) | LEPGKNPRA/DRB1*0401(263.94) | | |
| TIAKNKPTLDIELQK | IAKNKPTLD/DRB1*0101(343.68) | | | |
| LLLMRTSWALCEVLT | LMRTSWALC/DRB1*0101(56.35) | LMRTSWALC/DRB1*0701(182.13) | | |
| ASAWTLYAVATTVLT | LYAVATTVL/DRB1*0701(30.29) | TLYAVATTV/DRB1*0101(17.33) | YAVATTVLT/DRB1*0401(125.85) | |
| FIKKVRTNAAIGAVF | FIKKVRTNA/DRB1*1101(56.15) | VRTNAAIGA/DRB1*0101(10.47) | VRTNAAIGA/DRB1*0401(59.83) | VRTNAAIGA/DRB1*0701(81.92) |
| GSCVTTMAQGKPTLD | VTTMAQGKP/DRB1*0101(260.67) | | | |
| CGIRSATRMENLLWK | IRSATRMEN/DRB1*1101(261.33) | | | |
| ISLTAIANQAVVLMG | LTAIANQAV/DRB1*0101(9.37) | LTAIANQAV/DRB1*0401(130.46) | LTAIANQAV/DRB1*0701(71.16) | |
| GAGKTKRILPSIVRE | TKRILPSIV/DRB1*0101(36.86) | TKRILPSIV/DRB1*0701(154.45) | TKRILPSIV/DRB1*1101(83.52) | |
| KRAAAGIMKNPTVDG | AGIMKNPTV/DRB1*0101(369.54) | | | |
| GAVTLDFSPGTSGSP | VTLDFSPGT/DRB1*0401(259.38) | | | |
| IKTGNDIAACLRKSG | IAACLRKSG/DRB1*1101(335.53) | | | |
| TWQIEKASLIEVKTC | WQIEKASLI/DRB1*0101(76.56) | WQIEKASLI/DRB1*0701(319.34) | | |

FIG. 50-162

| peptide | core/HLA(affinity(nM)) | core/HLA(affinity(nM)) | core/HLA(affinity(nM)) |
|---|---|---|---|
| RNRVSTVQQLTKRFS | NRVSTVQQL/DRB1*0701(417.04) | VQQLTKRFS/DRB1*0701(66.39) | |
| SLTAIANQATVLMGL | AIANQATVL/DRB1*0701(182.44) | IANQATVLM/DRB1*0401(66.54) | LTAIANQAT/DRB1*1101(11.75) |
| SWAFCESLTLATGPV | FCESLTLAT/DRB1*0101(44.35) | FCESLTLAT/DRB1*0401(67.76) | FCESLTLAT/DRB1*0701(82.77) | FCESLTLAT/DRB1*1101(334.69) |
| VTFKNAHAKRQDVIV | FKNAHAKRQ/DRB1*0101(86.99) | FKNAHAKRQ/DRB1*0401(437.55) | FKNAHAKRQ/DRB1*0701(263.31) | FKNAHAKRQ/DRB1*1101(113.97) |
| AIWYMWLGARFLEFE | IWYMWLGAR/DRB1*1101(123.66) | YMWLGARFL/DRB1*0101(13.12) | YMWLGARFL/DRB1*0701(382.44) |
| RFSLGLLSGRGPLKL | FSLGLLSGR/DRB1*1101(190.90) | LSGRGPLKL/DRB1*0701(276.29) | SLGLLSGRG/DRB1*0101(11.85) |
| HGGCVTTMAKNKPTL | CVTTMAKNK/DRB1*0101(490.83) | CVTTMAKNK/DRB1*1101(346.44) | |
| SSRDFVEGVSGGAWV | FVEGVSGGA/DRB1*0101(135.06) | | |
| VIGLYGNGVWTSGD | LYGNGVWT/DRB1*0101(235.55) | | |
| AGGLLTVCYVLSGSS | VCYVLSGSS/DRB1*0101(176.04) | VCYVLSGSS/DRB1*0701(440.93) | |
| RGTAKLQWFVERNMV | LQWFVERNM/DRB1*0701(377.27) | | |
| MVMAFIAFLRFLTIP | FIAFLRFLT/DRB1*0101(92.69) | FIAFLRFLT/DRB1*0701(230.10) | FIAFLRFLT/DRB1*1101(51.11) |
| LLSPVRPVNYNMVIM | PVRVPNYNM/DRB1*0101(181.00) | PVRVPNYNM/DRB1*0701(209.67) | |
| MLVTFKNAHAKRQDV | FKNAHAKRQ/DRB1*0701(90.85) | LVTFKNAHA/DRB1*0101(10.14) | LVTFKNAHA/DRB1*0401(11.07) | LVTFKNAHA/DRB1*1101(24.29) |
| EFFLIVLLIPEPDRQ | IVLLIPEPD/DRB1*0101(99.83) | | |
| ANIFRGSYLAGAGLL | FRGSYLAGA/DRB1*0101(30.59) | FRGSYLAGA/DRB1*0401(362.27) | GSYLAGAGL/DRB1*0401(399.32) | IFRGSYLAG/DRB1*1101(331.38) |
| TVEAGRTLRVLNLVE | VEAGRTLRV/DRB1*0101(124.75) | VEAGRTLRV/DRB1*0701(314.02) | |
| NRDFVEGLSGATWVD | FVEGLSGAT/DRB1*0101(26.84) | | |
| NIFRGSYLAGAGLLF | FRGSYLAGA/DRB1*0401(498.52) | GSYLAGAGL/DRB1*0101(20.75) | YLAGAGLLF/DRB1*0701(246.55) |
| RGPSLRTTASGKLI | LRTTASGK/DRB1*0701(62.99) | SLRTTASG/DRB1*0101(153.07) | SLRTTASG/DRB1*0401(233.56) |
| EAHFTDPASIAARGY | FTDPASIAA/DRB1*0101(433.39) | | |

FIG. 50-163

| peptide | core/HLA(affinity(nM)) | core/HLA(affinity(nM)) | core/HLA(affinity(nM)) | core/HLA(affinity(nM)) |
|---|---|---|---|---|
| PWDVWPTVTQMAMTD | WPTVTQMA/DRB1*0401(430.56) | WDWPTVTQ/DRB1*0101(271.34) | | |
| TSKVRSNAALGAIFQ | VRSNAALGA/DRB1*0101(11.15) | VRSNAALGA/DRB1*0401(99.97) | VRSNAALGA/DRB1*0701(128.22) | VRSNAALGA/DRB1*1101(431.88) |
| VGLYGNGVVTRSGAY | YGNGVVTRS/DRB1*0101(184.45) | | | |
| MPVTHASAAQRRGRI | VTHASAAQR/DRB1*0101(297.66) | | | |
| DGCWYGMEIRPLKEK | WYGMEIRPL/DRB1*0101(26.87) | YGMEIRPLK/DRB1*1101(131.96) | | |
| LETLMLVALIAVLTG | LVALIAVLT/DRB1*0101(229.74) | | | |
| RGSSIGKMLEATAKG | IGKMLEATA/DRB1*0101(89.35) | | | |
| RVSTVSQLAKRFSRG | TVSQLAKRF/DRB1*0101(162.28) | VSQLAKRFS/DRB1*1101(51.08) | | |
| TFITPMMRHTIENTT | FITPMMRHT/DRB1*0101(355.91) | TFITPMMRH/DRB1*1101(199.74) | | |
| RKTFVDLMRRGDLPV | FVDLMRRGD/DRB1*1101(121.08) | | | |
| QYKFQPESPARLASA | FQPESPARL/DRB1*0101(6.48) | FQPESPARL/DRB1*0401(73.91) | FQPESPARL/DRB1*0701(155.43) | YKFQPESPA/DRB1*1101(490.07) |
| STRVEMGEAAGIFMT | VEMGEAAGI/DRB1*0101(57.78) | | | |
| DIVLEHGGVTTMAK | IVLEHGGCV/DRB1*0101(313.44) | | | |
| SLLRNDVPMAGPLVA | DVPMAGPLV/DRB1*0101(24.79) | LLRNDVPMA/DRB1*0401(60.37) | | |
| RTPQDNQLTYWWAI | QDNQLTYW/DRB1*0101(406.27) | | | |
| QVPFCSHHFHQLIMK | FCSHHFHQL/DRB1*0101(98.16) | FCSHHFHQL/DRB1*0701(39.10) | FCSHHFHQL/DRB1*1101(339.99) | |
| LLMMRTWALCEVIT | MMRTWALC/DRB1*0101(99.85) | MMRTWALC/DRB1*0701(150.14) | | |
| WDYVTDISEMGAN | WDYVVTTDI/DRB1*0701(468.74) | | | |
| SVNMYSRMLLNRFTM | MYSRMLLNR/DRB1*1101(37.92) | SRMLLNRFT/DRB1*0101(20.09) | VSRMLLNRF/DRB1*0401(463.09) | VSRMLLNRF/DRB1*0701(159.15) |
| GVVKLLTKPWDVIPM | KLLTKPWDV/DRB1*0701(339.81) | VKLLTKPWD/DRB1*1101(157.77) | VVKLLTKPW/DRB1*0101(317.75) | |
| MFEATARGARRMAIL | ATARGARRM/DRB1*0701(491.79) | FEATARGAR/DRB1*1101(82.44) | MFEATARGA/DRB1*0101(240.13) | |

FIG. 50-164

| peptide | core/HLA(affinity(nM)) | core/HLA(affinity(nM)) | core/HLA(affinity(nM)) |
|---|---|---|---|
| MRTTWALCEALTLAT | WALCEALTL/DRB1*0101(46.12) | WALCEALTL/DRB1*0701(221.56) | |
| TQVLLMRTTWALCEA | LMRTTWALC/DRB1*0701(369.66) | TQVLLMRTT/DRB1*1101(222.39) | VLLMRTTWA/DRB1*0101(71.34) |
| ALLKNDIPMTGPLVA | DIPMTGPLV/DRB1*0101(22.37) | LLKNDIPMT/DRB1*0401(171.45) | |
| KGSTIGKMFETTMRG | IGKMFETTM/DRB1*0101(485.18) | | |
| AKRQDVIVLGSQEGA | VIVLGSQEG/DRB1*0101(417.29) | | |
| HATHQWMTTEDMLSV | HQWMTTEDM/DRB1*0101(145.38) | WMTTEDMLS/DRB1*0401(103.77) | WMTTEDMLS/DRB1*0701(450.98) |
| YRGAKRMAILGETAW | RMAILGETA/DRB1*0101(241.96) | | |
| RFSKGLFSGQGPMKL | FSGQGPMKL/DRB1*0101(41.06) | FSGQGPMKL/DRB1*0701(111.46) | |
| LRKNGKKVIQLSRKT | KVIQLSRKT/DRB1*1101(77.28) | | |
| QFQPESPARVASAIL | FQPESPARV/DRB1*0101(54.52) | | |
| FCIKILNPYMPSWE | CIKILNPYM/DRB1*0101(21.79) | CIKILNPYM/DRB1*0401(227.84) | IKILNPYMP/DRB1*0701(197.23) |
| RFSRGMLQGQGPMKM | LQGQGPMKM/DRB1*0101(34.94) | | |
| GSGIFVDNVHTWTE | IFVDNVHT/DRB1*0101(219.52) | IFVDNVHT/DRB1*0401(232.79) | |
| AVTLDFSPGTSGSPI | VTLDFSPGT/DRB1*0401(416.59) | | |
| IGRARISQGAGWSLK | ISQGAGWSL/DRB1*0101(159.70) | ISQGAGWSL/DRB1*0701(207.07) | |
| LLGSSLLKNDVPLAG | LLKNDVPLA/DRB1*0101(101.65) | LLKNDVPLA/DRB1*0401(154.23) | |
| RGLPIRYQTTATKTE | IRYQTTATK/DRB1*0101(48.51) | IRYQTTATK/DRB1*0401(37.40) | IRYQTTATK/DRB1*1101(206.73) |
| AAIANQAAILMGLGK | IANQAAILM/DRB1*0101(21.28) | | |
| GDLPYWLAHKYAAEG | VWLAHKVAA/DRB1*1101(236.43) | WLAHKVAAE/DRB1*0101(323.15) | |
| VVVLGSQEGAMHSAL | LGSQEGAMH/DRB1*0101(75.75) | LGSQEGAMH/DRB1*0401(391.11) | |
| EEFIKKVRTNAAIGA | FIKKVRTNA/DRB1*1101(29.68) | IKKVRTNAA/DRB1*0101(28.26) | IKKVRTNAA/DRB1*0401(72.88) | IKKVRTNAA/DRB1*0701(114.39) |

FIG. 50-165

| peptide | core/HLA(affinity(nM)) | core/HLA(affinity(nM)) | core/HLA(affinity(nM)) |
|---|---|---|---|
| LLSSLLKNDVPLAGP | LLKNDVPLA/DRB1*0101(64.57) | LLKNDVPLA/DRB1*0401(97.76) | LSSLLKNDV/DRB1*1101(417.43) |
| KRSVALTPHSGTGLE | LTPHSGTGL/DRB1*0701(393.50) | SVALTPHSG/DRB1*0101(140.70) | |
| GVEGEGLHRLGVILE | GLHRLGVIL/DRB1*0101(283.84) | | |
| RPRWLDARYYSDPLA | WLDARYYSD/DRB1*0101(407.90) | WLDARYYSD/DRB1*0701(329.43) | |
| GLLIACYVITGTSAD | CYVITGTSA/DRB1*0101(180.83) | | |
| KNGKKVIQLSRKTFD | KVIQLSRKT/DRB1*1101(38.50) | | |
| MVTQMAMTDITPFGQ | MAMTDITPF/DRB1*0401(357.66) | MAMTDITPF/DRB1*0701(338.28) | |
| NMCTLMALDLGEFCE | MCTLMALDL/DRB1*0101(469.82) | | |
| KNQTWQIEKASLIEV | WQIEKASLI/DRB1*0101(18.35) | WQIEKASLI/DRB1*0401(438.95) | WQIEKASLI/DRB1*0701(76.59) |
| QAVVLMGLDKGWPIS | MGLDKGWPI/DRB1*0701(489.93) | VVLMGLDKG/DRB1*0101(273.60) | |
| MYFHRRDLRLAANAI | DLRLAANAI/DRB1*0101(16.85) | DLRLAANAI/DRB1*0401(343.67) | FHRRDLRLA/DRB1*1101(13.10) | YFHRRDLRL/DRB1*0701(63.02) |
| NCLRKNGKKVIQLSR | LRKNGKKVI/DRB1*1101(149.40) | | |
| VSILASSLLRNDVPM | ILASSLLRN/DRB1*0701(210.20) | VSILASSLL/DRB1*0101(100.60) | |
| EDDQYVFMGEPLEND | QYVFMGEPL/DRB1*0101(467.69) | | |
| YKFQPESPKRLSAAI | FQPESPKRL/DRB1*0101(28.61) | FQPESPKRL/DRB1*0701(398.62) | |
| MAFIAFLRFLAIPPT | FIAFLRFLA/DRB1*1101(28.26) | FLRFLAIPP/DRB1*0101(11.49) | FLRFLAIPP/DRB1*0401(144.17) | FLRFLAIPP/DRB1*0701(77.79) |
| PNVNLVIMDEAHFTD | YNLVIMDEA/DRB1*0101(194.01) | | |
| EPSWADVRNDLISYG | WADVRNDLI/DRB1*0701(484.28) | | |
| IENSTANVSLAAIAN | NVSLAAIAN/DRB1*0101(167.80) | | |
| FRLRGEQRKTFVDLM | FRLRGEQRK/DRB1*1101(318.39) | | |
| PGGKTRKYLPAIVR | TRKYLPAIV/DRB1*0101(141.83) | TRKYLPAIV/DRB1*1101(320.54) | |

FIG. 50-166

| peptide | core/HLA(affinity(nM)) | core/HLA(affinity(nM)) | core/HLA(affinity(nM)) |
|---|---|---|---|
| VSSVNMVSRMLLNRF | SVNMVSRML/DRB1*0101(26.00) | VNMVSRMLL/DRB1*1101(56.32) | VSRMLLNRF/DRB1*0701(111.63) |
| GWNLVKLYSGKDVFF | LVKLYSGKD/DRB1*0101(80.79) | LVKLYSGKD/DRB1*0701(218.74) | LVKLYSGKD/DRB1*1101(151.23) |
| LVPHVGMGLETRAQT | HVGMGLETR/DRB1*0101(310.70) | | |
| KHQWMTEDMLKWVN | HQWMTEDM/DRB1*0101(176.27) | WMTTEDMLK/DRB1*0401(166.75) | WMTTEDMLK/DRB1*0701(488.96) |
| YGWNLVKLYSGKDVF | LVKLYSGKD/DRB1*0101(108.57) | LVKLYSGKD/DRB1*0701(281.64) | NLVKLYSGK/DRB1*1101(131.82) |
| NDVPLAGPMVAGGLL | DVPLAGPMV/DRB1*0101(167.60) | | |
| FWNTIAVSMANIFR | IAVSMANIF/DRB1*0101(46.99) | IAVSMANIF/DRB1*0701(43.92) | TTIAVSMAN/DRB1*0401(385.05) |
| KPWDVWPTVTQMAMT | WDVWPTVTQ/DRB1*0101(167.63) | WDWPTVTQ/DRB1*0401(287.29) | WDWPTVTQ/DRB1*0701(383.00) |
| RVSTGSQLAKRFSKG | GSQLAKRFS/DRB1*1101(413.42) | | |
| YISTRVGMGEAAAIF | TRVGMGEAA/DRB1*0101(103.41) | | |
| RMDIGVPLLAIGCYS | MDIGVPLLA/DRB1*0101(209.11) | | |
| GIHMENVFHTMWHVT | IHMENVFHT/DRB1*0101(99.03) | IHMENVFHT/DRB1*0401(322.40) | VFHTMWHVT/DRB1*0701(143.51) | VFHTMWHVT/DRB1*1101(283.48) |
| ILQRGLLGKTQVGVG | ILQRGLLGK/DRB1*1101(342.18) | QRGLLGKTQ/DRB1*0101(163.25) | | |
| CHATFTMRLLSPVRV | FTMRLLSPV/DRB1*0401(322.50) | FTMRLLSPV/DRB1*1101(27.04) | MRLLSPVRV/DRB1*0101(5.57) | MRLLSPVRV/DRB1*0701(26.45) |
| RLRRMAISGDDCVIK | LRRMAISGD/DRB1*0101(484.82) | | |
| EDGCWYGMEIRPLKE | WYGMEIRPL/DRB1*0101(44.25) | YGMEIRPLK/DRB1*1101(225.79) | |
| TTWSIHATHEWMTTE | WSIHATHEW/DRB1*0701(313.68) | | |
| WTRSGAYYSAIAQT | GAYYSAIAQ/DRB1*0101(207.48) | VTRSGAYYS/DRB1*0701(492.31) | |
| KKQDVWLGSQEGAM | WVLGSQEG/DRB1*0101(142.35) | | |
| MSAAIKDQRAVHADM | IKDQRAVHA/DRB1*0101(79.79) | | |
| ALLALNDMGKIRKDI | LLALNDMGK/DRB1*0101(118.23) | | |

FIG. 50-167

| peptide | core/HLA(affinity(nM)) | core/HLA(affinity(nM)) | core/HLA(affinity(nM)) |
|---|---|---|---|
| NMLKRARNRVSTPQG | LKRARNRVS/DRB1*0701(183.50) | LKRARNRVS/DRB1*0701(428.51) | LKRARNRVS/DRB1*1101(26.40) |
| MVSILASALLKNDIP | ILASALLKN/DRB1*1101(361.28) | MVSILASAL/DRB1*0101(17.32) | SILASALLK/DRB1*0701(145.34) |
| FFLMVLLIPEPEKQR | MVLLIPEPE/DRB1*0101(127.03) | | |
| KVLPAIIREAIKRKL | IREAIKRK/DRB1*1101(52.89) | IREAIKRKL/DRB1*0701(416.12) | YLPAIIREA/DRB1*0101(191.38) |
| AGKTVWFVPSIKTGN | VWFVPSIKT/DRB1*0101(24.48) | VWFVPSIKT/DRB1*0401(186.46) | VWFVPSIKT/DRB1*1101(57.16) | VWFVPSIKT/DRB1*1101(37.87) |
| VYTTMFGGVSWVMKI | FGGVSWVMK/DRB1*0701(123.03) | FGGVSWVMK/DRB1*1101(295.38) | YTTMFGGVS/DRB1*0101(18.05) |
| NGWRLLTKPWDVLP | RLLTKPWDV/DRB1*0701(309.12) | WRLLTKPW/DRB1*0101(153.64) | WRLLTKPW/DRB1*1101(49.98) |
| SGIFVTNEVHTWTEQ | FVTNEVHTW/DRB1*0101(337.22) | | |
| LALGCYSQVNPLTLI | CYSQVNPLT/DRB1*0101(15.42) | CYSQVNPLT/DRB1*0401(86.26) | YSQVNPLTL/DRB1*0701(16.88) |
| GGCVTTMAKNKPTLD | CVTTMAKNK/DRB1*1101(398.66) | | |
| SLGLLSGRGPLKLFM | LLSGRGPLK/DRB1*0101(16.04) | LLSGRGPLK/DRB1*0701(245.44) | LSGRGPLKL/DRB1*1101(125.46) |
| WSYYCGGLKNVTEVR | YCGGLKNVT/DRB1*0701(95.74) | YCGGLKNVT/DRB1*1101(260.70) | |
| MAVGVVSILASSFLR | VSILASSFL/DRB1*0701(26.99) | VVSILASSF/DRB1*0101(9.18) | VVSILASSF/DRB1*0401(307.75) | VVSILASSF/DRB1*1101(260.36) |
| NRVWIRDNPNMTDKT | WIRDNPNMT/DRB1*0401(347.32) | | |
| HHFELIMKDGRSLVV | LIMKDGRSL/DRB1*0101(51.42) | LIMKDGRSL/DRB1*0701(214.22) | LIMKDGRSL/DRB1*1101(280.67) |
| FITFLRVLSIPPTAG | FLRVLSIPP/DRB1*0101(4.08) | FLRVLSIPP/DRB1*0401(29.85) | FLRVLSIPP/DRB1*0701(22.07) | FLRVLSIPP/DRB1*1101(15.31) |
| LCTKAEFCKKVRSNA | FCKKVRSNA/DRB1*1101(97.11) | | |
| FTNMEAQLIRQMEGE | FTNMEAQLI/DRB1*0101(33.10) | | |
| KKGSSIGKMFEATAR | IGKMFEATA/DRB1*0101(361.65) | | |
| RGYISTRVEMGEAAG | YISTRVEMG/DRB1*0101(106.70) | YISTRVEMG/DRB1*0401(121.38) | YISTRVEMG/DRB1*0701(159.97) | YISTRVEMG/DRB1*1101(420.62) |
| GQWTYSLNTFTNME | VTYSLNTFT/DRB1*0101(89.22) | VTYSLNTFT/DRB1*0401(172.27) | VTYSLNTFT/DRB1*0701(144.64) |

FIG. 50-168

| peptide | core/HLA(affinity(nM)) | core/HLA(affinity(nM)) | core/HLA(affinity(nM)) |
|---|---|---|---|
| TVEAGRTLRVLSLVE | AGRTLRVLS/DRB1*1101(299.72) | VEAGRTLRV/DRB1*0101(83.42) | |
| VPTSRITWSIHAHHQ | SRITWSIHA/DRB1*0701(354.40) | | |
| GNIVASVNTTSRLLI | IVASVNTTS/DRB1*0101(69.34) | IVASVNTTS/DRB1*0401(81.34) | VNTTSRLLI/DRB1*0701(173.05) |
| EATARGARRMAILGD | TARGARRMA/DRB1*1101(251.24) | | |
| FGTAYGVLFSGVSWT | YGVLFSGVS/DRB1*0101(39.42) | YGVLFSGVS/DRB1*1101(329.53) | |
| ARRMAILGDTAWDFG | RMAILGDTA/DRB1*0101(183.16) | | |
| QYKFQPESPARLATA | FQPESPARL/DRB1*0101(6.50) | FQPESPARL/DRB1*0401(76.11) | |
| GKSYAQMWALMYFHR | MWALMYFHR/DRB1*1101(70.00) | YAQMWALMY/DRB1*0101(10.25) | YAQMWALMY/DRB1*0701(170.97) |
| LILCASQILMRTSW | LILCASQIL/DRB1*0101(75.85) | LILCASQIL/DRB1*0701(454.07) | |
| KSWLVHKQWFLDLPL | WLVHKQWFL/DRB1*0101(195.66) | WLVHKQWFL/DRB1*0701(107.23) | |
| ERVILAGPMPVTASS | VILAGPMPV/DRB1*0101(40.72) | | |
| PYKTWAYHGSYEVKA | WAYHGSYEV/DRB1*0101(90.41) | WAYHGSYEV/DRB1*0701(109.72) | |
| HELIMKDGRSLVVPC | LIMKDGRSL/DRB1*0101(82.78) | LIMKDGRSL/DRB1*0701(306.10) | LIMKDGRSL/DRB1*1101(358.70) |
| NPTIEEGRTLRVLKM | GRTLRVLKM/DRB1*1101(383.75) | IEEGRTLRV/DRB1*0101(81.53) | IEEGRTLRV/DRB1*0701(128.24) |
| PLIAGGMLIACYVIT | GGMLIACYV/DRB1*0101(123.52) | | |
| MAVGMVSILASALLK | MVSILASAL/DRB1*0101(4.89) | MVSILASAL/DRB1*0401(280.17) | MVSILASAL/DRB1*1101(286.33) |
| YKTWAYHGSYEVKPT | WAYHGSYEV/DRB1*0101(148.99) | WAYHGSYEV/DRB1*0701(177.22) | VSILASALL/DRB1*0701(51.57) |
| IAVSMANIFRGSYLA | ANIFRGSYL/DRB1*0701(164.05) | AVSMANIFR/DRB1*0101(73.28) | |
| GEDGCWYGMEIRPYS | WYGMEIRPV/DRB1*0101(87.94) | YGMEIRPYS/DRB1*1101(454.70) | |
| IHATHQWMTTEDMLS | HQWMTTEDM/DRB1*0101(362.49) | WMTTEDMLS/DRB1*0401(220.34) | MANIFRGSY/DRB1*1101(169.87) |
| EMGANFKAGRVIDPR | FKAGRVIDP/DRB1*0101(461.01) | FKAGRVIDP/DRB1*0701(382.38) | |

FIG. 50-169

| peptide | core/HLA(affinity(nM)) | core/HLA(affinity(nM)) | core/HLA(affinity(nM)) |
|---|---|---|---|
| VPFCSHHFHELIMKD | FCSHHFHELIM/DRB1*0101(385.90) | FCSHHFHEL/DRB1*0701(160.95) | |
| RSVALAPHVGMGLET | SVALAPHVG/DRB1*0101(74.26) | | |
| LLSSLLRNDVPLAGP | LLRNDVPLA/DRB1*0101(53.27) | LLRNDVPLA/DRB1*0401(58.33) | LSSLLRNDV/DRB1*1101(287.02) |
| ANISLTAIANQATVL | LTAIANQAT/DRB1*0401(68.21) | LTAIANQAT/DRB1*0701(151.87) | SLTAIANQA/DRB1*0101(10.35) |
| STYRGAKRMAILGDT | YRGAKRMAI/DRB1*0101(99.61) | YRGAKRMAI/DRB1*0701(278.70) | YRGAKRMAI/DRB1*1101(35.95) |
| QYKFQPESPSRLSAA | FQPESPSRL/DRB1*0101(11.36) | FQPESPSRL/DRB1*0401(106.66) | FQPESPSRL/DRB1*0701(161.20) |
| FCKKVRSNAAMGAVF | FCKKVRSNA/DRB1*1101(71.91) | VRSNAAMGA/DRB1*0101(9.75) | VRSNAAMGA/DRB1*0401(50.92) | VRSNAAMGA/DRB1*0701(77.18) |
| AJANQAAILMGLGKG | IANQAAILM/DRB1*0101(49.28) | | |
| TWSIHASHEWMTED | WSIHASHEW/DRB1*0701(488.76) | | |
| DIANCLRKNGKKVIQ | CLRKNGKKV/DRB1*1101(140.60) | | |
| GRGGWSYYMATLKNV | YYMATLKNV/DRB1*0101(36.49) | YYMATLKNV/DRB1*0401(278.21) | YYMATLKNV/DRB1*0701(71.49) | YYMATLKNV/DRB1*1101(92.88) |
| DIPVWLAYKVASEGF | VWLAYKVAS/DRB1*1101(182.27) | WLAYKVASE/DRB1*0101(153.37) | WLAYKVASE/DRB1*0701(456.29) | |
| LRTTVTGKIITEWC | TTTVTGKII/DRB1*0701(228.88) | | |
| SGQWTYGLNTFTNM | VTYGLNTFT/DRB1*0101(138.73) | VTYGLNTFT/DRB1*0401(464.16) | |
| EHRRDKRSVALAPHV | RSVALAPHV/DRB1*0701(430.97) | | |
| RDFVEGLSGATWVDV | FVEGLSGAT/DRB1*0101(36.69) | | |
| NEGIMAVGMYSILAS | GIMAVGMYS/DRB1*0101(116.46) | | |
| PSSIAARGYISTRVE | ARGYISTRV/DRB1*0701(486.82) | SIAARGYIS/DRB1*0101(188.69) | |
| VMAVGLVSLLGSSLL | LVSLLGSSL/DRB1*0101(4.44) | LVSLLGSSL/DRB1*0401(343.60) | LVSLLGSSL/DRB1*0701(55.88) | LVSLLGSSL/DRB1*1101(446.31) |
| GCVTTIAKNKPTLDI | CVTTIAKNK/DRB1*1101(325.88) | IAKNKPTLD/DRB1*0701(184.41) | TIAKNKPTL/DRB1*0101(206.36) | |
| SGQGPMKLVMAFIAF | PMKLVMAFI/DRB1*0101(144.06) | | |

FIG. 50-170

| peptide | core/HLA(affinity(nM)) | core/HLA(affinity(nM)) | core/HLA(affinity(nM)) | core/HLA(affinity(nM)) |
|---|---|---|---|---|
| AARGYISTRVGMGEA | YISTRVGMG/DRB1*0101(113.25) | YISTRVGMG/DRB1*0401(164.28) | YISTRVGMG/DRB1*0701(100.82) | YISTRVGMG/DRB1*1101(109.29) |
| AGWSLRETACLGKAY | WSLRETACL/DRB1*0101(182.72) | | | |
| KAWLVHKQWFFDLPL | WLVHKQWFF/DRB1*0101(484.21) | WLVHKQWFF/DRB1*0701(199.99) | | |
| QVLALEPGKNPKHVQ | LALEPGKNP/DRB1*0101(229.80) | | | |
| QVIALEPGKNPRAVQ | LEPGKNPRA/DRB1*0101(110.71) | LEPGKNPRA/DRB1*0401(263.90) | | |
| KLKPRWLDARIYADP | PRWLDARIY/DRB1*0101(348.17) | | | |
| NQATVLMGLGKGWPI | MGLGKGWPI/DRB1*0101(203.88) | | | |
| REKRSVALAPHVGLG | SVALAPHVG/DRB1*0101(62.45) | VALAPHVGL/DRB1*0701(195.26) | | |
| TIETLMLLTLIAVLT | LLTLIAVLT/DRB1*0101(321.42) | | | |
| YKFQPESPARVASAI | FQPESPARV/DRB1*0101(15.87) | FQPESPARV/DRB1*0401(225.68) | FQPESPARV/DRB1*0701(487.79) | |
| EDGCWYGMEIRPVSE | WYGMEIRPV/DRB1*0101(67.79) | YGMEIRPVS/DRB1*1101(369.64) | | |
| GEQRKTFVELMKRGD | FVELMKRGD/DRB1*1101(257.04) | | | |
| SNGTGNIVASVNTTS | IVASVNTTS/DRB1*0401(318.98) | IVASVNTTS/DRB1*0701(436.84) | | |
| FSTGLLNGKGPLRMV | LLNGKGPLR/DRB1*0101(51.11) | LLNGKGPLR/DRB1*1101(466.12) | LNGKGPLRM/DRB1*0701(450.22) | |
| PISKMDIGVPLLAMG | MDIGVPLLA/DRB1*0101(43.66) | SKMDIGVPL/DRB1*0701(277.09) | | |
| LVTFKNPHAKRQDVT | LVTFKNPHA/DRB1*0101(51.78) | LVTFKNPHA/DRB1*0401(111.37) | LVTFKNPHA/DRB1*1101(83.39) | |
| VVRLLTKPWDVVPNV | RLLTKPWDV/DRB1*0701(439.34) | VVRLLTKPW/DRB1*0101(451.03) | VVRLLTKPW/DRB1*1101(325.22) | |
| TTMRGAKRMAILGET | MRGAKRMAI/DRB1*0101(364.58) | MRGAKRMAI/DRB1*1101(61.20) | | |
| AEALKGMPIRYQTTA | LKGMPIRYQ/DRB1*0101(41.97) | LKGMPIRYQ/DRB1*0401(464.83) | LKGMPIRYQ/DRB1*1101(210.69) | |
| KRTAAGIMKNPTVDG | AGIMKNPTV/DRB1*0101(353.11) | | | |
| VFHTMWHVTRGAVLT | MWHVTRGAV/DRB1*1101(17.32) | WHVTRGAVL/DRB1*0101(7.70) | WHVTRGAVL/DRB1*0701(10.59) | |

FIG. 50-171

| peptide | core/HLA(affinity(nM)) | core/HLA(affinity(nM)) | core/HLA(affinity(nM)) | core/HLA(affinity(nM)) |
|---|---|---|---|---|
| FLRVLSIPPTAGVLA | FLRVLSIPP/DRB1*0401(69.12) | FLRVLSIPP/DRB1*0701(67.12) | FLRVLSIPP/DRB1*1101(61.77) | VLSIPPTAG/DRB1*0101(5.45) |
| KREDLWCGSLIGLSS | CGSLIGLSS/DRB1*0101(477.14) | | | |
| VTTMAKNKPTLDIEL | MAKNKPTLD/DRB1*0101(261.82) | MAKNKPTLD/DRB1*0701(482.83) | | |
| LMRTSWALCEVLTLA | LMRTSWALC/DRB1*0101(173.21) | MRTSWALCE/DRB1*0701(319.95) | | |
| RREKRSVALTPHSGM | SVALTPHSG/DRB1*0101(327.65) | VALTPHSGM/DRB1*0701(403.79) | | |
| MKRGDLPVWLAYKVA | DLPVWLAYK/DRB1*0101(384.29) | | | |
| PMVTQIAMTDTTPFG | IAMTDTTPF/DRB1*0401(349.22) | IAMTDTTPF/DRB1*0701(255.32) | MVTQIAMTD/DRB1*0101(311.74) | |
| KCGSGIFVIDNVHTW | IFVIDNVHT/DRB1*0101(351.46) | IFVIDNVHT/DRB1*0401(351.67) | | |
| GPSLRTTVTGKIIT | LRTTVTGK/DRB1*0101(492.34) | LRTTVTGK/DRB1*0401(493.76) | RTTVTGKI/DRB1*0701(58.39) | |
| KCGNGIFVADNVHTW | FVADNVHTW/DRB1*0401(345.28) | IFVADNVHT/DRB1*0101(413.37) | | |
| EGAMHSALTGATEVD | MHSALTGAT/DRB1*0401(266.34) | | | |
| ERVILAGPIPVTPSS | VILAGPIPV/DRB1*0101(81.96) | | | |
| DNIYTPEGIIPTLFE | YTPEGIIPT/DRB1*0101(229.04) | | | |
| WLMGLDKGWPISKM | MGLDKGWPI/DRB1*0101(146.24) | MGLDKGWPI/DRB1*0701(243.96) | | |
| LPIRYQTPAIRAEHT | IRYQTPAIR/DRB1*0101(17.85) | IRYQTPAIR/DRB1*0401(102.87) | IRYQTPAIR/DRB1*0701(174.59) | IRYQTPAIR/DRB1*1101(124.79) |
| LLAIGCYSQVNPITL | CYSQVNPIT/DRB1*0401(208.62) | YSQVNPITL/DRB1*0101(57.59) | YSQVNPITL/DRB1*0701(35.58) | |
| EAKMLLDNIYTPEGI | MLLDNIYTP/DRB1*0401(297.53) | | | |
| HEWMTTEDMLAVWNR | WMTTEDMLA/DRB1*0101(183.90) | WMTTEDMLA/DRB1*0401(195.86) | | |
| RKLRTLILAPTRVA | LILAPTRV/DRB1*0401(50.80) | LILAPTRV/DRB1*0401(12.35) | TLILAPTRV/DRB1*0701(2.97) | TLILAPTRV/DRB1*1101(15.79) |
| VNTISKMLINRFTMR | ISKMLINRF/DRB1*0101(18.60) | ISKMLINRF/DRB1*0401(199.93) | ISKMLINRF/DRB1*0701(102.44) | ISKMLINRF/DRB1*1101(40.26) |
| GKKVIQLSRKTFDSE | KVIQLSRKT/DRB1*1101(33.28) | | | |

FIG. 50-172

| peptide | core/HLA(affinity(nM)) | core/HLA(affinity(nM)) | core/HLA(affinity(nM)) |
|---|---|---|---|
| AWLMGLGRGWPIHR | LMGLGRGWP/DRB1*1101(280.44) | MGLGRGWPI/DRB1*0101(43.31) | MGLGRGWPI/DRB1*0701(182.09) |
| GGSWVDLVLEHGGCV | WVDLVLEHG/DRB1*0101(421.79) | | |
| SVALTPHSGMGLDTR | LTPHSGMGL/DRB1*0101(228.52) | | |
| EQYKFQPESPSRLSA | FQPESPSRL/DRB1*0101(13.97) | FQPESPSRL/DRB1*0701(150.74) | YKFQPESPS/DRB1*0401(102.74) |
| TETWMSSEGAWKHAQ | WMSSEGAWK/DRB1*0101(156.47) | | |
| LSKMDLGVPLLALGC | MDLGVPLLA/DRB1*0101(37.79) | | |
| PPTAGVLARWGTFKK | VLARWGTFK/DRB1*1101(318.45) | | |
| AFIAFLRFLAIPPTA | FIAFLRFLA/DRB1*1101(21.86) | FLRFLAIPP/DRB1*0101(4.85) | FLRFLAIPP/DRB1*0401(50.86) |
| LVTFKNPHAKRQDW | LVTFKNPHA/DRB1*0101(50.06) | LVTFKNPHA/DRB1*0401(111.07) | LVTFKNPHA/DRB1*0701(442.64) | LVTFKNPHA/DRB1*1101(81.86) |
| AIKRGLRTLILAPTR | IKRGLRTLI/DRB1*0701(78.61) | LRTLILAPT/DRB1*1101(25.82) | LRTLILAPT/DRB1*0101(13.62) | LRTLILAPT/DRB1*0401(366.59) |
| TRWVASEMAEALKGM | VASEMAEAL/DRB1*0101(93.94) | | |
| DWDFWTTDISEMGA | WDFWTTDI/DRB1*0701(492.13) | | |
| TWAFCEVLTLATGPI | FCEVLTLAT/DRB1*0101(50.79) | FCEVLTLAT/DRB1*0401(180.16) | FCEVLTLAT/DRB1*1101(285.26) | VLTLATGPI/DRB1*0701(117.73) |
| PVPMSTYGWNIVKLM | PMSTYGWNI/DRB1*0701(232.50) | YGWNIVKLM/DRB1*0101(257.80) | | |
| RARVSQGAGWSLRET | VSQGAGWSL/DRB1*0101(217.54) | | |
| QIMLLILCTGQLLMM | LLILCTGQL/DRB1*0101(72.23) | | |
| TVLMGLGKGWPIHKM | LGKGWPIHK/DRB1*1101(432.31) | MGLGKGWPI/DRB1*0101(43.20) | MGLGKGWPI/DRB1*0701(214.14) |
| LLAAYYMTGRSADLE | AYYMTGRSA/DRB1*0101(32.97) | YYMTGRSAD/DRB1*0701(288.34) | YYMTGRSAD/DRB1*1101(111.71) |
| WCCRSCTMPPLRFRG | SCTMPPLRF/DRB1*0101(206.01) | | |
| LRGLPIRYQTTATKT | IRYQTTATK/DRB1*0101(49.47) | IRYQTTATK/DRB1*0401(46.85) | IRYQTTATK/DRB1*0701(273.50) | LRGLPIRYQ/DRB1*1101(130.86) |
| MSAAIKDSKAVHADM | IKDSKAVHA/DRB1*0101(126.92) | IKDSKAVHA/DRB1*0701(95.34) | | |

FIG. 50-173

| peptide | core/HLA(affinity(nM)) | core/HLA(affinity(nM)) | core/HLA(affinity(nM)) |
|---|---|---|---|
| GSYETKQTGSASSMV | YETKQTGSA/DRB1*0101(340.44) | | |
| LSGRGPLKLFMALVA | PLKLFMALV/DRB1*0101(55.72) | PLKLFMALV/DRB1*1101(421.14) | |
| QMFESTYRGAKRMAI | YRGAKRMAI/DRB1*0101(209.16) | YRGAKRMAI/DRB1*0701(195.30) | YRGAKRMAI/DRB1*1101(33.80) |
| VLTPMLRHSIENSSV | LTPMLRHSI/DRB1*1101(420.11) | MLRHSIENS/DRB1*0701(361.90) | MLRHSIENS/DRB1*0701(407.21) |
| EQYKFQPESPKRLSA | FQPESPKRL/DRB1*0101(23.27) | FQPESPKRL/DRB1*0401(393.79) | FQPESPKRL/DRB1*0701(195.13) YKFQPESPK/DRB1*1101(355.67) |
| IQPQWIASAIILEFF | PQWIASAII/DRB1*0101(83.27) | PQWIASAII/DRB1*0701(76.68) | |
| WMTTEDMLSVWNRYW | WMTTEDMLS/DRB1*0101(413.61) | | |
| VAARGYISTRVEMGE | ARGYISTRV/DRB1*0101(241.59) | YISTRVEMG/DRB1*0401(294.76) | YISTRVEMG/DRB1*0701(170.74) |
| WLGSQEGAMHTALT | LGSQEGAMH/DRB1*0101(236.08) | | |
| AAGIMKNPTVDGIVA | IMKNPTVDG/DRB1*0101(126.63) | IMKNPTVDG/DRB1*0401(218.82) | |
| SWVDIVLEHGSCVTT | IVLEHGSCV/DRB1*0101(68.22) | IVLEHGSCV/DRB1*0401(483.02) | |
| SSKNQTWQIEKASLI | WQIEKASLI/DRB1*0101(62.30) | WQIEKASLI/DRB1*0701(97.56) | |
| YRLKGESRKTFVELM | YRLKGESRK/DRB1*1101(310.08) | | |
| FCEALTLATGPVSTL | LTLATGPVS/DRB1*0101(17.50) | LTLATGPVS/DRB1*0401(177.66) | LTLATGPVS/DRB1*0701(188.43) |
| PGAGKTKRYLPAIVR | TKRYLPAIV/DRB1*0101(155.02) | TKRYLPAIV/DRB1*1101(208.14) | |
| KMDIGVPLLAMGCYS | MDIGVPLLA/DRB1*0101(127.67) | | |
| GNGIFVADNVHTWTE | IFVADNVHT/DRB1*0101(146.96) | IFVADNVHT/DRB1*0401(129.12) | |
| GAIYGAAFSGVSWIM | YGAAFSGVS/DRB1*0101(79.33) | YGAAFSGVS/DRB1*0701(303.28) | |
| VTFKVPHAKKQDVVV | FKVPHAKKQ/DRB1*0101(487.53) | TFKVPHAKK/DRB1*1101(48.52) | |
| VGQLLLMRTSWAFCE | GQLLLMRTS/DRB1*1101(126.84) | LLLMRTSWA/DRB1*0101(17.80) | LLLMRTSWA/DRB1*0401(190.12) LLMRTSWAF/DRB1*0701(288.30) |
| ILASSLLRNDVPMAG | LLRNDVPMA/DRB1*0101(152.16) | LLRNDVPMA/DRB1*0401(92.11) | |

FIG. 50-174

| peptide | core/HLA(affinity(nM)) | core/HLA(affinity(nM)) | core/HLA(affinity(nM)) |
|---|---|---|---|
| SGRGPLKLFMAFVAF | PLKLFMAFV/DRB1*0101(74.77) | | |
| TYGWNLVKLHSGYDV | VKLHSGVDV/DRB1*0701(155.19) | WNLVKLHSG/DRB1*0101(81.16) | WNLVKLHSG/DRB1*1101(105.22) |
| RRLRTLILAPTRVVA | LILAPTRVV/DRB1*0401(54.44) | LILAPTRVV/DRB1*0701(12.05) | TLILAPTRV/DRB1*1101(15.65) |
| KMDLGVPLLALGCYS | MDLGVPLLA/DRB1*0101(120.21) | | |
| RHTIENTSANLSLTA | IENTSANLS/DRB1*0101(51.93) | IENTSANLS/DRB1*0401(136.65) | IENTSANLS/DRB1*0701(112.29) |
| DGEERVILAGPIPVT | VILAGPIPV/DRB1*0101(170.30) | | |
| TTIITPMLRHTIENT | ITPMLRHTI/DRB1*0101(259.60) | ITPMLRHTI/DRB1*1101(85.87) | |
| GKWVGLYGNGVVTKN | VVGLYGNGV/DRB1*0101(49.56) | | |
| VVITGTSADLELEKA | VITGTSADL/DRB1*0101(369.46) | | |
| LKPRWLDARYADPM | PRWLDARYV/DRB1*0101(293.85) | | |
| AVNMTSKMLLNRFTT | SKMLLNRFT/DRB1*0101(50.25) | TSKMLLNRF/DRB1*1101(73.07) | VNMTSKMLL/DRB1*0701(243.12) |
| TWKMERASFIEVKNC | WKMERASFI/DRB1*0101(47.23) | WKMERASFI/DRB1*0701(314.65) | |
| STHEMYWVSNASGNI | MYWVSNASG/DRB1*0101(83.02) | MYWVSNASG/DRB1*0401(109.05) | WVSNASGNI/DRB1*0701(122.62) |
| RNSTHEMYWVSNASG | MYWVSNASG/DRB1*0101(461.08) | MYWVSNASG/DRB1*0401(489.30) | |
| AFLRFLTIPPTAGIL | FLRFLTIPP/DRB1*0401(10.84) | FLRFLTIPP/DRB1*1101(17.07) | FLTIPPTAG/DRB1*0101(2.70) | RFLTIPPTA/DRB1*0701(19.40) |
| RTAAGIMKNPTVDGI | AGIMKNPTV/DRB1*0101(155.47) | | |
| ELHKLGKCGSCYYNM | KLGKCGSCV/DRB1*0101(269.06) | LHKLGKCGS/DRB1*1101(372.32) | |
| LVMAFIAFLRFLAIP | FIAFLRFLA/DRB1*0101(70.47) | FIAFLRFLA/DRB1*0701(208.97) | FIAFLRFLA/DRB1*1101(37.45) |
| GEYRLRGESRKTFVE | YRLRGESRK/DRB1*1101(206.37) | | |
| GIFITNEVHTWTEQY | FITNEVHTW/DRB1*0101(362.81) | | |
| VELQWIASAIVLEFF | LQWIASAIV/DRB1*0101(9.78) | LQWIASAIV/DRB1*0401(288.85) | LQWIASAIV/DRB1*0701(21.41) |

FIG. 50-175

| peptide | core/HLA(affinity(nM)) | core/HLA(affinity(nM)) | core/HLA(affinity(nM)) |
|---|---|---|---|
| VSTANIFRGSYLAGA | ANIFRGSYL/DRB1*0101(101.76) | ANIFRGSYL/DRB1*0701(413.62) | NIFRGSYLA/DRB1*1101(364.47) |
| EDYGFGVFTTNIWLR | FGVFTTNIW/DRB1*0401(454.56) | GFGVFTTNI/DRB1*0101(330.11) | GFGVFTTNI/DRB1*0701(144.65) |
| AVGMVSILASALLKN | MVSILASAL/DRB1*0101(4.10) | MVSILASAL/DRB1*0401(224.53) | MVSILASAL/DRB1*0701(51.47) | MVSILASAL/DRB1*1101(187.69) |
| LSTLWEGSPGRFWNT | LWEGSPGRF/DRB1*0101(273.03) | | |
| KRERNRVSTGSQLAK | NRVSTGSQL/DRB1*0101(343.78) | NRVSTGSQL/DRB1*0701(228.39) | |
| LILCASQILLMRTTW | LILCASQIL/DRB1*0101(93.18) | SQILLMRTT/DRB1*1101(321.76) | |
| AAIANQAAILMGLDK | IANQAAILM/DRB1*0101(22.94) | | |
| QEVVLGSQEGAMHT | VVLGSQEG/DRB1*0101(79.39) | | |
| NISLAAIANQATVLM | LAAIANQAT/DRB1*0101(9.44) | LAAIANQAT/DRB1*0401(70.11) | LAAIANQAT/DRB1*0701(202.94) |
| RRGDLPVWLAHKVAS | VWLAHKVAS/DRB1*1101(226.35) | | |
| REEFIKKVRTNAAIG | FIKKVRTNA/DRB1*1101(20.93) | IKKVRTNAA/DRB1*0401(50.60) | IKKVRTNAA/DRB1*0401(116.35) | IKKVRTNAA/DRB1*0701(100.20) |
| VPMATYGWNLVKLYS | MATYGWNLV/DRB1*0701(317.58) | YGWNLVKLY/DRB1*0101(154.80) | YGWNLVKLY/DRB1*1101(285.81) |
| GNIVSSVNMISRMLL | IVSSVNMIS/DRB1*0401(90.17) | IVSSVNMIS/DRB1*0701(48.33) | IVSSVNMIS/DRB1*1101(115.37) | SVNMISRML/DRB1*0101(28.06) |
| VNTTSRLLINRFTMK | SRLLINRF/DRB1*0101(33.40) | TSRLLINRF/DRB1*0701(216.01) | TSRLLINRF/DRB1*1101(46.30) |
| KKKLKPRWLDARYYA | LKPRWLDAR/DRB1*1101(367.69) | PRWLDARVY/DRB1*0101(290.34) | |
| HTIENTSANLSLAAI | ENTSANLSL/DRB1*0701(158.01) | IENTSANLS/DRB1*0101(87.08) | IENTSANLS/DRB1*0401(285.62) |
| RQDVTVLGSQEGAMH | VTVLGSQEG/DRB1*0101(204.67) | | |
| TKRYLPAIVREALKR | YLPAIVREA/DRB1*0101(30.50) | YLPAIVREA/DRB1*0401(380.06) | YLPAIVREA/DRB1*0701(406.04) | YLPAIVREA/DRB1*1101(106.20) |
| QRKTFVDLMKRGDLP | FVDLMKRGD/DRB1*1101(241.65) | | |
| AHFTDPSSVAARGYI | FTDPSSVAA/DRB1*0101(434.56) | | |
| LVTFKNPHAKRQDVI | LVTFKNPHA/DRB1*0101(49.86) | LVTFKNPHA/DRB1*0401(110.66) | LVTFKNPHA/DRB1*0701(422.70) | LVTFKNPHA/DRB1*1101(81.70) |

FIG. 50-176

| peptide | core/HLA(affinity(nM)) | core/HLA(affinity(nM)) | core/HLA(affinity(nM)) | core/HLA(affinity(nM)) |
|---|---|---|---|---|
| AFIAFLRFLTIPPTA | FLRFLTIPP/DRB1*0101(6.30) | FLRFLTIPP/DRB1*0401(18.53) | FLRFLTIPP/DRB1*0701(27.44) | FLRFLTIPP/DRB1*1101(18.87) |
| AKMLLDNINTPEGII | MLLDNINTP/DRB1*0401(250.47) | | | |
| GKTRKYLPAIVREAI | TRKYLPAIV/DRB1*0101(29.33) | TRKYLPAIV/DRB1*0701(271.05) | TRKYLPAIV/DRB1*1101(118.40) | YLPAIVREA/DRB1*0401(342.38) |
| KELKCGSGIFVDNV | LKCGSGIFV/DRB1*0101(327.37) | | | |
| KTGNDIAACLRKSGK | IAACLRKSG/DRB1*1101(136.54) | | | |
| EVQVLALEPGKNPKH | VLALEPGKN/DRB1*0101(190.03) | | | |
| LAAIANQATVLMGLG | AIANQATVL/DRB1*0701(399.24) | IANQATVLM/DRB1*0101(17.94) | IANQATVLM/DRB1*0401(114.82) | |
| LMRRGDLPVWLAYKV | MRRGDLPVW/DRB1*0101(449.04) | | | |
| TLYAVATTFITPMMR | LYAVATTFI/DRB1*0701(42.91) | YAVATTFIT/DRB1*0101(57.92) | YAVATTFIT/DRB1*0401(159.84) | YAVATTFIT/DRB1*1101(402.04) |
| NRVSTVSQLAKRFSR | RVSTVSQLA/DRB1*0701(315.05) | TVSQLAKRF/DRB1*0101(159.25) | VSQLAKRFS/DRB1*1101(54.08) | |
| WPLNEGVMAVGLVSL | NEGVMAVGL/DRB1*0101(210.87) | | | |
| DGPERVILAGPIPVT | VILAGPIPV/DRB1*0101(133.22) | VILAGPIPV/DRB1*0701(436.85) | | |
| HEWMTTEDMLSVWNR | WMTTEDMLS/DRB1*0101(275.70) | WMTTEDMLS/DRB1*0401(229.68) | | |
| QWIASSILEFFLIV | WIASSILE/DRB1*0701(367.74) | | | |
| SQILLMRTSWAFCEV | ILLMRTSWA/DRB1*0101(23.53) | ILLMRTSWA/DRB1*0401(162.03) | LMRTSWAFC/DRB1*0701(190.83) | SQILLMRTS/DRB1*1101(130.24) |
| EPIPMATYGWNLVKL | PMATYGWNL/DRB1*0101(332.34) | PMATYGWNL/DRB1*0701(393.39) | | |
| LMKRGDLPVWLAHKV | KRGDLPVWL/DRB1*0101(491.46) | | | |
| FSLGLLSGRGPLKLF | LGLLSGRGP/DRB1*0101(16.30) | LLSGRGPLK/DRB1*1101(238.06) | LSGRGPLKL/DRB1*0701(167.69) | |
| LKGMPIRYQTTAVKS | IRYQTTAVK/DRB1*0101(32.19) | IRYQTTAVK/DRB1*0401(51.79) | IRYQTTAVK/DRB1*0701(54.19) | IRYQTTAVK/DRB1*1101(105.52) |
| TTDISEMGANFRAER | ISEMGANFR/DRB1*0101(298.47) | | | |
| CLGKSYAQMWALMYF | SYAQMWALM/DRB1*0101(18.56) | YAQMWALMY/DRB1*0701(144.88) | YAQMWALMY/DRB1*1101(309.10) | |

FIG. 50-177

| peptide | core/HLA(affinity(nM)) | core/HLA(affinity(nM)) | core/HLA(affinity(nM)) |
|---|---|---|---|
| LMRTSWAFCESLTLA | WAFCESLTL/DRB1*0101(99.56) | WAFCESLTL/DRB1*0401(495.70) | WAFCESLTL/DRB1*0701(93.87) |
| HAVSRGSAKLQWIVE | AVSRGSAKL/DRB1*0101(195.23) | | |
| RCVGISSRDFVEGVS | CVGISSRDF/DRB1*0101(407.45) | | |
| VFHTMWHVTRGAVLM | MWHVTRGAV/DRB1*1101(15.31) | WHVTRGAVL/DRB1*0101(6.62) | WHVTRGAVL/DRB1*0701(8.37) |
| TMRGAKRMAILGETA | MRGAKRMAI/DRB1*1101(197.03) | RMAILGETA/DRB1*0101(451.08) | |
| WVDLVLEHGGCVTTI | LVLEHGGCV/DRB1*0101(95.27) | | |
| FQPESPARLASAILN | FQPESPARL/DRB1*0101(94.11) | | |
| LRHTIENTSANLSLA | IENTSANLS/DRB1*0401(115.57) | TIENTSANL/DRB1*0101(46.30) | TIENTSANL/DRB1*0701(77.87) |
| THQWMTTEDMLSVWN | WMTTEDMLS/DRB1*0101(119.48) | WMTTEDMLS/DRB1*0401(75.99) | WMTTEDMLS/DRB1*0701(487.21) |
| SLETLMLVALIAVLT | LVALIAVLT/DRB1*0101(255.12) | | |
| GGCVTTIAKNKPTLD | CVTTIAKNK/DRB1*0701(372.53) | CVTTIAKNK/DRB1*1101(398.67) | |
| SANLSLTAIANQAAI | LTAIANQAA/DRB1*0401(55.08) | LTAIANQAA/DRB1*0701(217.82) | SLTAIANQA/DRB1*0101(14.64) |
| MVREAIRRGLRTLIL | IRRGLRTLI/DRB1*0101(49.20) | IRRGLRTLI/DRB1*0701(40.64) | IRRGLRTLI/DRB1*1101(17.05) |
| LPIRYQTTAIKAEHT | IRYQTTAIK/DRB1*0101(37.17) | IRYQTTAIK/DRB1*0401(44.61) | IRYQTTAIK/DRB1*1101(138.02) | RYQTTAIKA/DRB1*0701(128.63) |
| EERVILAGPIPVTPS | VILAGPIPV/DRB1*0101(75.60) | | |
| LIACYVITGTSADLT | CYVITGTSA/DRB1*0101(40.06) | YVITGTSAD/DRB1*0401(135.86) | YVITGTSAD/DRB1*0701(120.85) |
| IEESRTIRVLSLVEN | IEESRTIRV/DRB1*0701(154.08) | SRTIRVLSL/DRB1*0101(243.81) | |
| FGAIYGAAFSGVSWI | AAFSGVSWI/DRB1*0701(431.86) | IYGAAFSGV/DRB1*0101(64.61) | |
| GSQLAKRFSKGLFSG | KRFSKGLFS/DRB1*0701(413.83) | LAKRFSKGL/DRB1*0101(387.57) | LAKRFSKGL/DRB1*1101(122.52) |
| ISKMDIGVPLLAMGC | MDIGVPLLA/DRB1*0101(50.69) | SKMDIGVPL/DRB1*0701(491.38) | |
| GKTVWFVPSIKTGND | VWFVPSIKT/DRB1*0101(25.71) | VWFVPSIKT/DRB1*0401(196.59) | VWFVPSIKT/DRB1*0701(86.81) | VWFVPSIKT/DRB1*1101(41.89) |

FIG. 50-178

| peptide | core/HLA(affinity(nM)) | core/HLA(affinity(nM)) | core/HLA(affinity(nM)) | core/HLA(affinity(nM)) |
|---|---|---|---|---|
| GEAAAIFMTATPPGT | FMTATPPGT/DRB1*0101(31.89) | IFMTATPPG/DRB1*0401(15.64) | IFMTATPPG/DRB1*0701(121.33) | |
| FEKQLGQVMLLYLCV | FEKQLGQVM/DRB1*0101(79.89) | | | |
| RMAILGETAWDFGSI | ILGETAWDF/DRB1*0101(104.67) | | | |
| TIENTTANISLTAIA | ENTTANISL/DRB1*0701(340.03) | NTTANISLT/DRB1*0101(394.18) | | |
| PTIEEGRTLRVLKMV | EGRTLRVLK/DRB1*0101(215.90) | IEEGRTLRV/DRB1*0101(83.64) | IEEGRTLRV/DRB1*0701(164.69) | |
| PGKFWNTTIAYSMAN | FWNTTIAYS/DRB1*0401(136.80) | FWNTTIAYS/DRB1*1101(328.31) | WNTTIAVSM/DRB1*0101(34.16) | WNTTIAVSM/DRB1*0701(42.75) |
| ATHEWMTTEDMLSYW | WMTTEDMLS/DRB1*0101(249.51) | WMTTEDMLS/DRB1*0401(164.93) | | |
| GANFRADRVIDPRRC | FRADRVIDP/DRB1*0101(468.57) | FRADRVIDP/DRB1*0401(91.61) | | |
| GIFITDNVHTWTEQY | IFITDNVHT/DRB1*0101(381.21) | IFITDNVHT/DRB1*0401(308.83) | | |
| HRGSSLRTTVSGKL | LRTTTVSGK/DRB1*0701(153.50) | SLRTTTVSG/DRB1*0401(451.09) | | |
| FCIKVLNPYMPTVIE | CIKVLNPYM/DRB1*0101(38.72) | CIKVLNPYM/DRB1*0401(441.89) | CIKVLNPYM/DRB1*0701(175.59) | CIKVLNPYM/DRB1*1101(215.74) |
| PQWIASSIILEFFLI | WIASSIILE/DRB1*0101(298.02) | WIASSIILE/DRB1*0701(130.43) | | |
| MCHATFTTRLLSSTR | CHATFTTRL/DRB1*0101(45.82) | CHATFTTRL/DRB1*0401(344.35) | CHATFTTRL/DRB1*0701(23.47) | FTTRLLSST/DRB1*1101(44.75) |
| GPMPYTHSSAAQRRG | VTHSSAAQR/DRB1*0701(469.45) | | | |
| KGKVIGLYGNGVVT | VIGLYGNGV/DRB1*0101(28.77) | | | |
| DVKKDMSYGGGWRF | ISYGGGWRF/DRB1*0701(365.45) | | | |
| NISLTAIANQATVLM | LTAIANQAT/DRB1*0101(8.81) | LTAIANQAT/DRB1*0401(49.52) | LTAIANQAT/DRB1*0701(124.51) | |
| NELPESLETLMLVAL | PESLETLML/DRB1*0101(379.54) | | | |
| DGIMTIDLDPVVYDS | IDLDPVVYD/DRB1*0401(433.35) | | | |
| VIYDSKFEKQLGQVM | FEKQLGQVM/DRB1*0101(88.68) | | | |
| SAAIKDQRAVHADMG | IKDQRAVHA/DRB1*0101(64.23) | | | |

FIG. 50-179

| peptide | core/HLA(affinity(nM)) | core/HLA(affinity(nM)) | core/HLA(affinity(nM)) |
|---|---|---|---|
| IAFLRFLTIPPTAGI | FLRFLTIPP/DRB1*0401(10.81) | FLRFLTIPP/DRB1*0701(23.92) | FLRFLTIPP/DRB1*1101(17.73) | LRFLTIPPT/DRB1*0101(3.23) |
| MAIGIVSILASSLLR | IVSILASSL/DRB1*0101(3.21) | IVSILASSL/DRB1*0401(65.96) | IVSILASSL/DRB1*0701(9.75) | IVSILASSL/DRB1*1101(129.66) |
| RTWAYHGSYEAPSSG | WAYHGSYEA/DRB1*0101(453.96) | | | |
| HHFHELIMKDGRSLV | LIMKDGRSL/DRB1*0101(120.05) | LIMKDGRSL/DRB1*1101(351.05) | | |
| EVLTLATGPLILWE | LTLATGPIL/DRB1*0101(13.29) | LTLATGPIL/DRB1*0701(53.59) | | |
| LPWVLAYKVASEGIK | AYKVASEGI/DRB1*0701(160.16) | VWLAYKVAS/DRB1*1101(158.35) | WLAYKVASE/DRB1*0101(95.31) | WLAYKVASE/DRB1*0401(374.22) |
| GMPIRYQTTAVKSEH | IRYQTTAVK/DRB1*0101(26.85) | IRYQTTAVK/DRB1*0401(41.48) | IRYQTTAVK/DRB1*1101(121.60) | RYQTTAVKS/DRB1*0701(94.72) |
| RSNAALGAVFTEENQ | NAALGAVFT/DRB1*0101(455.72) | | | |
| GLRTLILAPTRVVAS | LILAPTRVV/DRB1*0401(43.36) | LILAPTRVV/DRB1*0701(15.16) | LILAPTRVV/DRB1*1101(15.22) | TLILAPTRVV/DRB1*0101(3.11) |
| STIGKMFETTMRGAK | FETTMRGAK/DRB1*1101(304.09) | IGKMFETTM/DRB1*0101(369.98) | | |
| GQIMLILCTGQLLM | LLILCTGQL/DRB1*0101(100.24) | | | |
| PFCSHHFHKIFMKDG | FCSHHFHKI/DRB1*0101(282.85) | FCSHHFHKI/DRB1*0701(71.32) | HHFHKIFMK/DRB1*1101(90.95) | |
| YRLRGEQRKTFVELM | YRLRGEQRK/DRB1*1101(355.84) | | | |
| LTYQNKVRVYQRPAK | TYQNKVRVY/DRB1*0101(358.99) | VRVQRPAK/DRB1*1101(49.24) | | |
| TLYAVATTVLTPMLR | YAVATTVLT/DRB1*0101(22.21) | YAVATTVLT/DRB1*0401(120.68) | YAVATTVLT/DRB1*0701(38.40) | YAVATTVLT/DRB1*1101(362.97) |
| PVPMATYGWNLVKLY | MATYGWNLV/DRB1*0101(177.17) | PMATYGWNL/DRB1*0701(253.17) | | |
| VATTFITPMLRHSIE | FITPMLRHS/DRB1*0101(125.51) | ITPMLRHSI/DRB1*1101(43.62) | TFITPMLRH/DRB1*0701(175.49) | |
| LLLMRTSWAFCEALT | LLLMRTSWA/DRB1*0101(68.31) | MRTSWAFCE/DRB1*0701(254.36) | | |
| ARGARRMAILGDTAW | RMAILGDTA/DRB1*0101(480.05) | | | |
| TLMYFHRRDLRLASN | YFHRRDLRL/DRB1*0101(26.58) | YFHRRDLRL/DRB1*0701(46.57) | YFHRRDLRL/DRB1*1101(10.79) | |
| LFGYSQIGAGVYKEG | GYSQIGAGV/DRB1*0101(61.87) | | | |

FIG. 50-180

| peptide | core/HLA(affinity(nM)) | core/HLA(affinity(nM)) | core/HLA(affinity(nM)) | core/HLA(affinity(nM)) |
|---|---|---|---|---|
| GSASSMINGVWRLLT | INGVWRLLT/DRB1*1101(359.19) | MINGVWRLL/DRB1*0101(131.11) | MINGVWRLL/DRB1*0701(378.45) | |
| LLTVCYVLSGSSADL | CYVLSGSSA/DRB1*0101(9.68) | CYVLSGSSA/DRB1*0701(53.38) | VCYVLSGSS/DRB1*1101(199.71) | YVLSGSSAD/DRB1*0401(72.08) |
| VASEMAEALKGLPIR | AEALKGLPI/DRB1*0101(184.48) | | | |
| GGLLTVCYVLSGSSA | CYVLSGSSA/DRB1*0101(23.39) | VCYVLSGSS/DRB1*0401(256.52) | VCYVLSGSS/DRB1*0701(147.06) | VCYVLSGSS/DRB1*1101(276.07) |
| FLMVLLIPEPEKQRT | MVLLIPEPE/DRB1*0101(146.62) | | | |
| KGMPIRYQTPAIRAE | IRYQTPAIR/DRB1*0101(15.60) | IRYQTPAIR/DRB1*0401(83.52) | IRYQTPAIR/DRB1*0701(143.41) | IRYQTPAIR/DRB1*1101(118.72) |
| DVDCWCNATSTWVMV | WCNATSTWV/DRB1*0101(245.84) | WCNATSTWV/DRB1*0701(105.38) | | |
| KPWDVVPMVTQLAMT | VVPMVTQLA/DRB1*0101(33.45) | VVPMVTQLA/DRB1*0401(302.66) | | |
| KSGKKVIQLSRKTFD | KVIQLSRKT/DRB1*1101(37.60) | | | |
| QMWSLMYFHRRDLRL | WSLMYFHRR/DRB1*0101(49.76) | YFHRRDLRL/DRB1*0101(48.25) | YFHRRDLRL/DRB1*0701(13.50) | |
| EYRLRGESRKTFVEL | YRLRGESRK/DRB1*1101(228.46) | | | |
| SGKTRRYLPAMVREA | TRRYLPAMV/DRB1*0101(21.01) | TRRYLPAMV/DRB1*0701(347.82) | TRRYLPAMV/DRB1*1101(58.09) | |
| ILTLWEGNPGKFWNT | LWEGNPGKF/DRB1*0101(472.88) | | | |
| GMLQGQGPMKMVMAF | LQGQGPMKM/DRB1*0101(12.33) | LQGQGPMKM/DRB1*0701(408.19) | | |
| NIVASVNTTSRLLIN | IVASVNTTS/DRB1*0101(106.97) | IVASVNTTS/DRB1*0401(176.59) | SVNTTSRLL/DRB1*0701(29.62) | VNTTSRLLI/DRB1*1101(184.57) |
| LPESLETLMLVALIA | LETLMLVAL/DRB1*0101(300.53) | | | |
| LPDTIETLMLLTLA | TIETLMLLT/DRB1*0101(336.59) | | | |
| RHAVSRGSAKIRWIV | AVSRGSAKI/DRB1*0101(214.88) | AVSRGSAKI/DRB1*0701(192.77) | VSRGSAKIR/DRB1*1101(237.43) | |
| VVASEMAEALKGMPI | AEALKGMPI/DRB1*0101(252.65) | | | |
| WTYSLNTFTNMEVQ | LNTFTNMEV/DRB1*0701(124.16) | TYSLNTFTN/DRB1*0101(128.75) | YSLNTFTNM/DRB1*0401(147.26) | |
| TGSQLAKRFSKGLFS | KRFSKGLFS/DRB1*0701(376.00) | LAKRFSKGL/DRB1*1101(134.76) | | |

FIG. 50-181

| peptide | core/HLA(affinity(nM)) | core/HLA(affinity(nM)) | core/HLA(affinity(nM)) |
|---|---|---|---|
| AIFKLTYQNKVVRVQ | FKLTYQNKV/DRB1*0101(26.89) | FKLTYQNKV/DRB1*0401(320.26) | FKLTYQNKV/DRB1*0701(18.11) | FKLTYQNKV/DRB1*1101(49.93) |
| MATYGWNLVKLHSGV | WNLVKLHSG/DRB1*0701(355.12) | YGWNLVKLH/DRB1*0101(108.05) | YGWNLVKLH/DRB1*0401(303.60) | YGWNLVKLH/DRB1*1101(77.31) |
| CWYGMEIRPINEKEE | WYGMEIRPI/DRB1*0101(121.11) | WYGMEIRPI/DRB1*1101(480.70) | | |
| VIVLGSQEGAMRTAL | LGSQEGAMR/DRB1*0101(41.77) | LGSQEGAMR/DRB1*0401(486.12) | | |
| VFHTMWHVTRGSVIC | FHTMWHVTR/DRB1*1101(25.41) | WHVTRGSVI/DRB1*0101(15.21) | WHVTRGSVI/DRB1*0701(10.16) | |
| PWDVLPMVTQIAMTD | VLPMVTQIA/DRB1*0101(57.07) | VLPMVTQIA/DRB1*0401(492.92) | | |
| PPTAGILARWGSFKK | ILARWGSFK/DRB1*0101(440.29) | ILARWGSFK/DRB1*1101(161.09) | | |
| MCTREEFIKKVRTNA | FIKKVRTNA/DRB1*1101(87.95) | | | |
| GMVSILASALLKNDI | ILASALLKN/DRB1*0401(432.85) | MVSILASAL/DRB1*0101(7.13) | MVSILASAL/DRB1*1101(251.69) | SILASALLK/DRB1*0701(82.60) |
| VLTLATGPILTLWEG | LTLATGPIL/DRB1*0101(24.21) | LTLATGPIL/DRB1*0701(99.25) | | |
| IGLYGNGVVTTSGDY | YGNGVVTTS/DRB1*0101(415.22) | | | |
| ALVPHVGMGLETRTE | LVPHVGMGL/DRB1*0101(362.02) | | | |
| CGNGIFVADNVHTWT | IFVADNVHT/DRB1*0101(209.96) | IFVADNVHT/DRB1*0401(179.07) | IFVADNVHT/DRB1*0701(485.92) | |
| CTGQLLMMRTTWALC | LLMMRTTWA/DRB1*0101(25.32) | LLMMRTTWA/DRB1*0401(292.92) | LLMMRTTWA/DRB1*1101(207.12) | MMRTTWALC/DRB1*0701(299.45) |
| ISKVDIGVPLLAMGC | VDIGVPLLA/DRB1*0101(69.39) | | | |
| NMEAQLIRQMESEGI | IRQMESEGI/DRB1*0101(127.97) | | | |
| VPFCSHHFHQLIMKD | FCSHHFHQL/DRB1*0101(126.62) | FCSHHFHQL/DRB1*0701(55.93) | FCSHHFHQL/DRB1*1101(370.61) | |
| GAGWSLRETACLGKA | WSLRETACL/DRB1*0101(177.97) | | | |
| GKELKCGSGIFVTNE | LKCGSGIFV/DRB1*0101(174.85) | | | |
| YAVATTIVTPMLRHT | ATTIVTPML/DRB1*0101(127.73) | ATTIVTPML/DRB1*0701(116.41) | TTIVTPMLR/DRB1*1101(296.09) | |
| PMATYGWNLVKLYSG | MATYGWNLV/DRB1*0701(354.88) | YGWNLVKLY/DRB1*0101(118.78) | YGWNLVKLY/DRB1*0401(479.28) | YGWNLVKLY/DRB1*1101(167.86) |

FIG. 50-182

| peptide | core/HLA(affinity(nM)) | core/HLA(affinity(nM)) | core/HLA(affinity(nM)) | core/HLA(affinity(nM)) |
|---|---|---|---|---|
| DWPMVTQLAMTDTT | WPMVTQLA/DRB1*0101(61.30) | | | |
| NSWSGVEGEGLHRLG | WSGVEGEGL/DRB1*0101(420.83) | | | |
| QWIASAIVLEFFMMV | WIASAIVLE/DRB1*0101(370.99) | WIASAIVLE/DRB1*0701(411.68) | | |
| DSKLMSAAIKDQRAV | KLMSAAIKD/DRB1*0701(463.85) | SKLMSAAIK/DRB1*0101(155.01) | | |
| RSGILEVDRTLAKEG | ILEVDRTLA/DRB1*1101(460.04) | | | |
| KTVWFVPSIKTGNDI | VWFVPSIKT/DRB1*0101(36.94) | VWFVPSIKT/DRB1*0401(276.77) | VWFVPSIKT/DRB1*0701(103.44) | VWFVPSIKT/DRB1*1101(47.38) |
| VILAGPMPVTVASAA | VILAGPMPV/DRB1*0101(282.94) | | | |
| YNHALNELPESLETL | YNHALNELP/DRB1*0101(115.08) | YNHALNELP/DRB1*0401(448.31) | | |
| QLAKRFSRGMLQGQG | AKRFSRGML/DRB1*0701(433.12) | AKRFSRGML/DRB1*0401(88.01) | KRFSRGMLQ/DRB1*0101(184.52) | |
| KRQDVTVLGSQEGAM | VTVLGSQEG/DRB1*0101(402.58) | | | |
| TKRILPSIVREAIKR | TKRILPSIV/DRB1*0101(74.01) | TKRILPSIV/DRB1*0701(409.34) | TKRILPSIV/DRB1*1101(159.15) | |
| AKGSRAIWYMWLGAR | IWYMWLGAR/DRB1*0101(186.51) | IWYMWLGAR/DRB1*1101(213.46) | | |
| AVVLMGLDKGWPISK | MGLDKGWPI/DRB1*0101(200.34) | MGLDKGWPI/DRB1*0701(343.89) | | |
| LSLAAIANQAAILMG | LAAIANQAA/DRB1*0101(8.17) | LAAIANQAA/DRB1*0401(80.59) | LAAIANQAA/DRB1*0701(213.36) | |
| STYGWNLVRLQSGVD | YGWNLVRLQ/DRB1*0101(109.12) | YGWNLVRLQ/DRB1*0401(375.97) | YGWNLVRLQ/DRB1*1101(141.90) | |
| YRLKGEARKTFVELM | YRLKGEARK/DRB1*0101(373.53) | YRLKGEARK/DRB1*1101(167.23) | | |
| PRWLDARIYSDPLAL | DARIYSDPL/DRB1*0101(462.05) | DARIYSDPL/DRB1*0701(489.42) | | |
| GGLKNVKEVRGFTKG | VKEVRGFTK/DRB1*1101(402.17) | | | |
| ENSYSGVEGEGLHRL | YSGVEGEGL/DRB1*0101(133.86) | | | |
| WTIKSGTYVSAITQA | TYVSAITQA/DRB1*0101(440.17) | | | |
| LLRNDVPMAGPLVAG | DVPMAGPLV/DRB1*0101(21.09) | LLRNDVPMA/DRB1*0401(134.35) | | |

FIG. 50-183

| peptide | core/HLA(affinity(nM)) | core/HLA(affinity(nM)) | core/HLA(affinity(nM)) | core/HLA(affinity(nM)) |
|---|---|---|---|---|
| HHFHELVMKDGRKLV | LVMKDGRKL/DRB1*0101(150.06) | LVMKDGRKL/DRB1*0701(419.11) | LVMKDGRKL/DRB1*1101(172.50) | |
| IFKLTYQNKVWRVQR | FKLTYQNKV/DRB1*0101(36.65) | FKLTYQNKV/DRB1*0401(469.47) | FKLTYQNKV/DRB1*0701(23.15) | FKLTYQNKV/DRB1*1101(46.56) |
| FWNTTIAVSTANIFR | IAVSTANIF/DRB1*0401(356.98) | IAVSTANIF/DRB1*0701(23.74) | WNTTIAVST/DRB1*0101(43.79) | |
| PLLAIGCYSQVNPIT | GCYSQVNPI/DRB1*0101(202.76) | GCYSQVNPI/DRB1*0401(409.14) | GCYSQVNPI/DRB1*0701(211.03) | |
| KDLLVTFKTAHAKKQ | LVTFKTAHA/DRB1*0101(7.13) | LVTFKTAHA/DRB1*0401(6.77) | LVTFKTAHA/DRB1*0701(35.30) | LVTFKTAHA/DRB1*1101(12.50) |
| LRHTIENTSANLSLT | IENTSANLS/DRB1*0401(139.04) | TIENTSANL/DRB1*0101(56.42) | TIENTSANL/DRB1*0701(89.99) | |
| ARGYISTRVGMGEAA | YISTRVGMG/DRB1*0101(63.40) | YISTRVGMG/DRB1*0401(100.74) | YISTRVGMG/DRB1*0701(88.43) | YISTRVGMG/DRB1*1101(77.39) |
| LSPVRPNYNLLIMD | PVRPNYNL/DRB1*0101(164.56) | PVRVPNYNL/DRB1*0701(158.33) | | |
| ACYVITGTSADLTVE | VITGTSADL/DRB1*0101(26.45) | YVITGTSAD/DRB1*0401(134.05) | YVITGTSAD/DRB1*0701(113.41) | |
| LCTREEFTRKVRSNA | FTRKVRSNA/DRB1*0101(157.20) | | | |
| NPTIEESRTIRVLKM | IEESRTIRV/DRB1*0101(140.53) | IEESRTIRV/DRB1*0701(38.58) | SRTIRVLKM/DRB1*1101(393.45) | |
| VYKEGVFHTMWHVTR | FHTMWHVTR/DRB1*0101(30.84) | FHTMWHVTR/DRB1*1101(37.33) | VFHTMWHVT/DRB1*0701(94.76) | |
| GLNTFTNMEVQLIRQ | FTNMEVQLI/DRB1*0101(19.78) | FTNMEVQLI/DRB1*0401(97.05) | FTNMEVQLI/DRB1*0701(94.60) | |
| MRHTIENTTANISLT | IENTTANIS/DRB1*0401(283.12) | TIENTTANI/DRB1*0101(368.18) | TIENTTANI/DRB1*0701(168.38) | |
| VILAGPMPVTAASAA | VILAGPMPV/DRB1*0101(246.31) | | | |
| HRRDKRSVALVPHVG | RSVALVPHV/DRB1*0101(460.83) | RSVALVPHV/DRB1*0701(409.18) | | |
| WDVLPMVTQIAMTDT | VLPMVTQIA/DRB1*0101(79.66) | | | |
| SMVNGVVRLLTKPWD | SMVNGVVRL/DRB1*0101(289.42) | VNGVVRLLT/DRB1*1101(62.12) | | |
| KDGEERVVLAGPMPV | VVLAGPMPV/DRB1*0101(425.52) | | | |
| EGVCGIRSTTRLENV | CGIRSTRLL/DRB1*0701(262.19) | IRSTTRLEN/DRB1*1101(321.04) | | |
| QLGQIMLLILCTGQL | LLILCTGQL/DRB1*0101(369.63) | | | |

FIG. 50-184

| peptide | core/HLA(affinity(nM)) | core/HLA(affinity(nM)) | core/HLA(affinity(nM)) | core/HLA(affinity(nM)) |
|---|---|---|---|---|
| QAAVLMGLDKGWPLS | MGLDKGWPL/DRB1*0101(352.33) | | | |
| AIDGEYRLRGEARKT | YRLRGEARK/DRB1*1101(450.14) | | | |
| IWYMWLGARFLEFEA | IWYMWLGAR/DRB1*1101(165.58) | YMWLGARFL/DRB1*0101(18.72) | YMWLGARFL/DRB1*0701(455.98) | |
| TTMRGAKRMAILGDT | MRGAKRMA/DRB1*1101(63.07) | TMRGAKRMA/DRB1*0101(393.15) | | |
| CTREEFTSKVRSNAA | FTSKVRSNA/DRB1*1101(95.18) | | | |
| MYWVSNASGNIVSSV | WVSNASGNI/DRB1*0101(45.04) | WVSNASGNI/DRB1*0401(224.79) | WVSNASGNI/DRB1*0701(57.66) | |
| KCGSGIFITDNVHTW | IFITDNVHT/DRB1*0401(421.96) | | | |
| KAWLVHKQWFLNLPL | LVHKQWFLN/DRB1*1101(268.20) | WLVHKQWFL/DRB1*0101(124.52) | WLVHKQWFL/DRB1*0701(66.24) | |
| RTLILAPTRVVASEM | LILAPTRVV/DRB1*0101(4.38) | LILAPTRVV/DRB1*0401(91.37) | LILAPTRVV/DRB1*0701(32.21) | LILAPTRVV/DRB1*1101(24.82) |
| RGILGRSQVGVGIHM | GRSQVGVGI/DRB1*0101(179.60) | | | |

FIG. 53 - 1

>panNV|peptide_length:8|string1

MKMASNDASAAAVxxxxxxxxxxxxxxxxSSMAVTFKRALGARPxxxxxxxxxxRPPRPPTPELVKxI
PPPPPNGEDExxxxxxxKDGVSGLPELSTVxxxxxxNTAFSVPPLNQRENRDAKEPLTGTILEMWDGE
IYHYGLYVERGLVLGVHKPPAAISLAKVELTPLSLFWRPVYTPQYLISPDTLxKLHGETFPYTAFDNN
CYAFCCWVLDLNDSWLSRRMIQRTTGFFRPYQDWNRKPLPTMDDSKLKKVANIFLCTLSSLFTRPIKD
IIGKLRPLNIINILASCDWTFAGIVESLILLAELFGVFWTPPDVSAMIAPLLGDFELQxxxxxxxxxx
xxxxGGIGLVLGFTKEKxGKMLSSAASTLRACKDLGAYGLExxxxxMKWFFPKKEExxxxxMVRSIED
AVxxxxxxxxxxxMTTLLKDKDSLxxxxxxxxxEEEKARKLSxxxxxxxxxxxxxxxxxxRIAAARSLVH
RAKxxxxxxxxxxxxMISGRPGIGKTHLARxxxxxxxxxxTGDQRVGLIPRNGVDHWDAYKGERVVLW
DDYGMSxxxxxxLRLQELADTCPLTLNCDRIENKGKxxxSDVIIITTNLANPAPLDYVNFEACSRRID
FLVYAExxxxxxxxxxxFPGQPDMWKxxxxxxxxxxxxxLAPQGGFDKNGNxxxxxxxxxxxxxxxxx
xxxGLLHERLDExxxxxxxxxxxxxxxxNKVLAFRQLAAENKYGLxxxxxxxxxxxxxxxxxxxxxxx
xxxxxxxxxxxxxxxxxxxxxxxxxxxxxxxxxxxxxxxxxxxxxxxxARIRYYVKCxxxxxxxxx
xQIAGAAFVTTRIxxxxxxxxxxxxxxxxxxxxxxxxxxxxxxxxxxxxxxxxxxxEGKKGKNKT
GRGKKHTAFSSKGLSDEEYDEYKRIREERNGKYSIEEYLQDRDKYYEEVAIARATEEDFCEEEEAKIR
QRIFRPTRKQRKEERAxxxxxxxxxxRKRNPEDFKPKGKLWADDDRSVDYNEKxxxxAPPSIWSRxxx
FGSGWGFWVSPSLFITSTHVIPxxxxxxxxxxxxxxxxxxGEFCRLRFxxxxxxxxxxGMILEEGAPE
GTVVxxxxxxxTGELMPLAARMGTHATMKIQGRTVGGQMGMLLTGSNAKSMDLGTTPGDCGCPYIYKR
xxxxxVIGVHTAAARGGNTVICATQGxEGEATLEGGGGQNKGTYCGAPILGxxxAPKLSTKTKFWRSS
TxPLPPGTYEPAYLGGKDPRVxxGPSLQQVMRDQLKPFTEPxxxxxxxxxxxxxxxxxxxxxxxxxxx
xxxxxxxQACASLDKTTSSGHPHxxxxxxxxxxxxxxLADQASKANLMFExxxxxxPVYTGALKDE
LVKTDK

FIG. 53 - 2

```
IYHYGLYVERGLILGVHKPPAAISLARVELTPLSLYWRPVYASQYLISPDALxRLHGESFPYTAFDxx
xxxxxxxxxDLNDSWLCRRMISRTTDFFKPYQDWNRKPLPTTDDSKLKKAANIFLCALSSLFTRPIKD
IIGKLRPLNILNILATCDWTFAGIVESLILMAALFGVFWTxxxxxxxxIAPLLGDYELQxxxxxxxxxx
xxxxGGIGMVLGFTAEKxGRVMKSAVDGLRACKDLGNYALDxxxxxKKYFFGGDQTxxxxxxILRAIED
AVxxxxxxxxxxxMTALVRDKQSAxxxxxxxxxEEEKARRLSxxxxxxxxxxxxxxxxxxRIAAARSLLH
KAKxxxxxxxxxxxxxMISGKPGIGKTHMARxxxxxxxxxSGDQRVGLVPREAVDHWDAYRGEEVMLW
DDYGMGxxxxxxLTLQELADTCPVSLNCDRIENKGMxxxSDAIIITTNLVGPAPVDFVNLGPVCRRID
FLVYADxxxxxxxxxxxSPGDTTALKxxxxxxxxxxxxxxxAPQGGFDNQGNxxxxxxxxxxxxxxxxxx
xxxALTMERQDExxxxxxxxxxxxxxxNRVSAFRKLAADNKYGIxxxxxxxxxxxxxxxxxxxxxxxx
xxxxxxxxxxxxxxxxxxxxxxxxxxxxxxxxxxxxxxxxxxxxxxxxxxARIRYYVRCxxxxxxxx
xQVAGASFVVNRIxxxxxxxxxxxxxxxxxxxxxxxxxxxxxxxxxxxxxxxxxxxxxEDKKGKNKA
GRGRKHTAFSSxGLSDEEYDEFKRIREERQGRYTIEEYLQDRDRYYEEVAVAKATEENFCEEEEIKIR
QRIFRPTKKQRKEERVxxxxxxxxxxxRKRNPDDFQPKGNLWADDTRSVDYNERxxxxAPPSVWSRxxx
LGTGWGFWVSSNLLITTTHVLPxxxxxxxxxxxxxxxxxxGEFCRFRFxxxxxxxxxGLVLEEGAPE
GTVAxxxxxxxxSGELLPLAVRMGTHATMRIQGRLVHGQMGMLLTGANAKNMDLGTIPGDCGAPYVHKR
xxxxxVAGVHAAATKSGNTVVCAVQAxxxxxxxxxxxxxLGHYAGHEIVRxxxGPALSTKTKFWRSS
PxALPPGVYEPAYLGGRDPRVxxGPSLQQVMRDQLRPFTEPxxxxxxxxxxxxxxxxxxxxxxxxxxx
xxxxxxxDACQSLDKTTSSGSPHxxxxxxxxxxxxxxxxxLGEQASKANLMYExxxxxxPVYTAALKDE
LVKPEKxxxKVKKRLLWGSDLGTMxRAARAFGGLMExxxxxxxxLPVRVGMNSIEDGPxxxxxxxxxx
xHFDADYSAWDSTQNRxxxxxxxxxxxxxxxxxxxxxxxxxxxxxxxxxxxxxxxxxxEGLPSGFPC
TSQVNSIxxxxxxxxxxxxxxxxxxxxxxxxxxxFSFDGDDEIVSTDVxxxxxxxxxxxxxYGLVPTRP
DKSEGPIxxxxxxxxxxxxxxxxxxxxxxxxxxxxxxxxxxxxxxxxxxxxxxxxxxxxxxxxxQL
ISLLGEASLHGxxxxxxxxxxxxxxxxxxxxxxxxxxxxxxxxxRWMRFHDLxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxLAGNAFTAGKLxxxxxxxxxx
xxxxxxxxxxxxxxxxxDVRTLEPVxxxxxxxxxxxxxxxxxxxxxRLVAMLYTPLRSNGSGxVFTV
SCRVLTRPAPDFEFxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxGYFRFESWxxxxxxxxxxxNGAGRRRALMAQAVLGAIAASAAGSALGAGxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxx
```

FIG. 53 - 3

\>panNV|peptide_length:8|string3 xxNGSNDAFAAAVxxxxxxxxxxxxxxxxxSNMAVTFKRALGARSxxxxxxxxxxKPPRPPTPELAKxT
PPPPPNGEEExxxxxxxKDGVSGLPELTTVxxxxxxNTVLSVPPLYQRENRDAKEPLTGTNLEMWDGE
xxxxxLYVDRGLVLGVxxxPAAISFAKVELATLSLFWRPVYTPQYLISPDSLxRLHGEAFPYTAFDxx
xxxxxxxxxxxxxxWLNRRMIQRTTGFFKxxxxxNRKPLPTVDDSKLKKVANLVLCALSSLxxxxIKD
IIGKLKPLNILNILATCDWTFAGVAESLILLAELSGVFWTxxxxxxxxxxxxxxxxxxxxxxxxxxx
xxxxGGIGLAIGFTRDKxTKMMKNAVDTLRAATQLGQYGLExxxxxMKWFFPKKDExxxxxTVRAIED
AVxxxxxxxxxxLTTLLKDKNSLxxxxxxxxxEEEKARTLSxxxxxxxxxxxxxxxxxxRISMARSALA
KAQxxxxxxxxxxxxMMCGPPGIGKTKAAExxxxxxxxxxRPGGKVGLVPRNGVDHWDGYHGERILLW
DDYGMTxxxxxx

FIG. 53 - 4

```
xxxxxxxxxxxxxxxxxxxxxxxxxxSLARVELAPLSLYWRxxxxxQHLISPDTLxKLHGEAFPxxxxxxxx
xxxxxxxxxxxxxxxxxxxxxxxxxxxxxxxxxxxxxxxxPTMDDPKVKKVANVFLCALSSxxxxxxIKD
LIGKVRPLNVINILASCxxxxxxxKAESLILLAELSGVFxxxxxxxxxxxxxxxxxxxxxxxxxxxxxxx
xxxxGGVGMVLGFTKERxSKLLSSAASSLKACREIGNYGIExxxxxxVKWFFPTKDExxxxxxMVRAIED
AxxxxxxxxxxxxxVTQLVRDKQAAxxxxxxxxxEEERARKLSxxxxxxxxxxxxxxxxxxxRISAARSLVH
KAKxxxxxxxxxxxxxMLSGRPGIGKTPLARxxxxxxxxxxxSGDQRIGLTPRNGIDYSHAYKREEAVLR
LDYVLSxxxxxxxLRLQAIADTSPLSLNCDRIENEGKxxxxSDTIIITTNLxxxxxxxxxxxxxxxxxxVD
FLVYCSxxxxxxxxxxxxSPGDTGALKxxxxxxxxxxxxxxxQGGFDQNGNxxxxxxxxxxxxxxxxxxx
xxxGLVHERKDExxxxxxxxxxxxxxxNKIAAFRQLAADNNYGFxxxxxxxxxxxxxxxxxxxxxxxxx
xxxxxxxxxxxxxxxxxxxxxxxxxxxxxxxxxxxxxxxxxxxxxxxxARARYYVSCxxxxxxxxx
xQIAGAAFITTRIxxxxxxxxxxxxxxxxxxxxxxxxxxxxxxxxxxxxxxxxxxxxxxxEGKKGKNKK
GRGxxxxxxxxxxxxxxxEYDEYKRIREERQGRYTIEExxxxRDRYYEELAIARATEENFCEEEIAEIR
QWVFRPTKKQRKEERTxxxxxxxxxxRRRKPDDFQPKGKLCLDDTRSVAYIKRxxxxAPPSLWSRxxx
xxxxWGFWVSSTLFITTTHVIPxxxxxxxxxxxxxxxxxxxxxGEFCKMRFxxxxxxxxxxGLILEEGCPE
GTVCxxxxxxxxxxxxxxLAVRMGAIASMRVQGKVIGGQMGMLLTGSNAKNMDLGTLPGDCGCPYVYKR
xxxxxAIGVHTAATRGGNTVICAIxxxxxxxxxxxxxxxxxHGTYAGHEIVKxxxGPTLSTKTKFWKSS
PxPLPPGVYExxxxxxxxxxxxxGLSLQQVLRDQLKPFTAPxxxxxxxxxxxxxxxxxxxxxxxxxxx
xxxxxxxDACMSLDKTTSSGHPYxxxxxxxxxxxxxxxxxxLANQASRANLMYExxxxxxxPMYTAALKDE
LVKTDRxxxTIKKRLLWGADLGTVxRSARAFGGLLDxxxxxxxxxLPIKVGMNAIEDGPxxxxxxxxxxx
xHYDADYSAWDSTQQRxxxxxxxxxxxxxxxxxxxxxxxxxxxxxxxxxxxxxxxxxxxxxxxxGVPC
TSQWNSFxxxxxxxxxxxxxxxxxxxxxxxxxxFSFYGDDYxxxxxxxxxxxxxxxxxxxxxYGLIPTRP
DKTDGPIxxxxxxxxxxxxxxxxxxxxxxxxxxxxxxxxxxxxxxxxxxxxxxxxxxxxxxxxxxQL
LCLLGESSLHGxxxxxxxxxxxxxxxxxxxxxxxxxxxxxxxxAWMRFHDLxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxNAFAAGKIxxxxxxxxxxxxx
xxxxxxxxxxxxxxxxxDVRQLEPIxxxxxxxxxxxxxxxxxxxxxxxxRLLAYLYTPLRANSGExDVFT
DSCRVLTRPSPDFExxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxGHFRFDSWxxxxxxxxxxxxxxxxxxxxxxxMAQAVIGAIAASTACSAVGAGxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxx
```

FIG. 53 - 5

>panNV|peptide_length:8|string5

```
xxxxxNDASVAAVxxxxxxxxxxxxxxxxxxxxxxxxxKRALGTRPxxxxxxxxxxxxxxxxxxxxxx
xxPPPNGEGExxxxxxxKEGVSGLPExxxxxxxxxxxxxFSVPPFNQRENRDxxxxxxxxxxxxxxxx
xxxxxxxxxxxxxxxxxxxxxxxxxxSLAKVELTTLSLFWRxxxxxxxxxxxxxxxxKLHGESFPxxxxxxxx
xxxxxxxxxxxxxxxxxxxxxxxxxxxxxxxxxxxxxxxxxxxxxLKKVANVILCALSSxxxxxxKD
IIGKLRPLNVINxxxxxxxxxxxxxxxxxxxxxxxxxxxxxxxxxxxxxxxxxxxxxxxxxxxxxx
xxxxGGIGLAIGFTKDKxGRLLKSAADGLRACRDLGAYxxxxxxxxxxxxxxxxxxxxxxxLVRAIED
AxxxxxxxxxxxxITQVVRDRQSTxxxxxxxxxxxxxxxxxxxxxxxxxxxxxxxxxxxRNAMARAALA
KAQxxxxxxxxxxxxxMISGRPGVGKTHMARxxxxxxxxxxNGDKRVGLTPRNGVGHWDAYKEERVVLW
DDYG

FIG. 53 - 6

```
IYHYGLYVERGLVLGVHKPPAAISLAKVELTPLSLFWRPVYTPQYLISPDTLxKLHGETFPYTAFDNN
CYAFCCWVLDLNDSWLSRRMIQRTTGFFRPYQDWNRKPLPTMDDSKLKKVANIFLCTLSSLFTRPIKD
IIGKLRPLNIINILASCDWTFAGIVESLILLAELFGVFWTPPDVSAMIAPLLGDFELQxxxxxxxxxx
xxxxGGIGLVLGFTKEKxxxMLSSAASTLRACKDLGAYGLExxxxxMKWFFPKKEExxxxxMVRSIED
AVLxxxxxxxxxxxxxxxxxxxxxxxxxxxxxxEEEKARKLSxxxxxxxxxxxxxxxxxxxxAARSLVH
RAKxxxxxxxxxxxxxMISGRPGIGKTHxxxxxxxxxxxxxGDQRVGLIPRNGVDHWDAYKGERVVLW
DDYGMxxxxxxxxxxLQELADTCPLTLNCDRIENKGKxxxSDVIIITTNLANPAPLDYVNFEACSRRID
FLVYAExxxxxxxxxxxxxxxxxxxxxxxxxxxxxxxxLAPQGGFDKNGNxxxxxxxxxxxxxxxxx
xxxGLLHERLDExxxxxxxxxxxxxxxxxxNKVLAFRQLAAENKYGLxxxxxxxxxxxxxxxxxxxx
xxxxxxxxxxxxxxxxxxxxxxxxxxxxxxxxxxxxxxxxxxxxxxARIRYYVKCxxxxxxxx
xxxxxxxxxxxxxxxxxxxxxxxxxxxxxxxxxxxxxxxxxxxxxxxxxxxxxxxxxxxxxxxx
GRGKKHTAFSSKGLSDEEYDEYKRIREERNGKYSIEEYLQDRDKYYEEVAIARATEEDFCEEEEAKIR
QRIFRPTRKQRKEERxxxxxxxxxxxRKRNPEDFKPKGKLWADDDRSVxxxxxxxxxxxxxxxxxx
FGSGWGFWVSPSLxxxxxxxxxxxxxxxxxxxxxxxxxxxxxxxxxxxxxxxxxxGMILEEGAPE
GTVVxxxxxxxTGELMPLAARMGTHATMKIQGRTVGGQMGMLLTGSNAKSMDLGTTPGDCGCPYIYKR
xxxxxVIGVHTAAARGGNTVICATQGGEGEATLEGGGGQNKGTYCGAPILxxxxAPKLSTKTKFWRSS
TxPLPPGTYEPAYLGGKDPRVxxGPSLQQVMRDQLKPFTxxxxxxxxxxxxxxxxxxxxxxxxxxx
xxxxxxxQACASLDKTTSSGHPHxxxxxxxxxxxxxxxxxLADQASKANLMFExxxxxxPVYTGALKDE
LVKTDKxxxKIKKRLLWGSDLATMxRCARAFGGLMxxxxxxxxxxxxxxxGMNMNEDGPxxxxxxxxx
xHYDADYSRWDSTQQxxxxxxxxxxxxxxxxxxxxxxxxxxxxxxxxxxxxxxxxEGLPSGVPC
TSQWNSxxxxxxxxxxxxxxxxxxxxxxxxxFSFYGDDEIVSTDIxxxxxxxxxxxxxYGLKPTRP
DKTEGPLxxxxxxxxxxxxxxxxxxxxxxxxxxxxxxxxxxxxxxxxxxxxxxxxxxxxxxxxxx
xxLLGEAALHGxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxLAGNAFTAGKxxxxxxxxxxxxxxxxx
xxxxxxxxxxxxxxxxxxxxxxxxxxxxxxxxxxxxxxxxxxKLIAMLYTPLRANNAGxxVFT
VSCRVLTRPSPDFDFxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxGNGTGRRRALMAQAIIGAIAATAAGSAVGAGIxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxx
```

FIG. 53 - 7

>panNV|peptide_length:9|string2

MKMGSNDASAAAAxxxxxxxxxxxxxxxxxSNMAVTLKRALGARxxxxxxxxxxxxGPPRPPTPELIKxV
PPPPPNGEDDxxxxxxxxDGVSGLPDLSTVxxxxxxSTAFSVPPLNQRENRDAKEPLTGTIIEMWDGE
IYHYGLYVERGLILGVHKPPAAISLARVELTPLSLYWRPVYAPQYLISPDALxRLHGESFPYTAFDNx
xxxxxxxxLDLNDSWLCRRMIQRTTDFFKPYQDWNRKPLPTTDDSKLKKAANIFLCALSSLFTRPIKD
IIGKLRPLNILNILATCDWTFAGIVESLILMAELSGVFWTPPDxxxMIAPLLGDYELQxxxxxxxxxx
xxxxGGIGMVLGFTAEKxxxVMKSAVDGLRACKDLGNYALDxxxxxKKYFFGGDQTxxxxxILRAIED
AVLxxxxxxxxxxxxxxxxxxxxxxxxxxxxxxxxxEEEKARRLSxxxxxxxxxxxxxxxxxxxxAARSLLH
KAKxxxxxxxxxxxxxxMISGKPGIGKTHxxxxxxxxxxxxxxGDQRVGLVPREGVDHWDAYRGEEVMLW
DDYGMxxxxxxxxxxLQAIADTCPVSLNCDRIENKGMxxxSDAIIITTNLVGPAPVDFVNLGPVCRRID
FLVYADxxxxxxxxxxxxxxxxxxxxxxxxxxxxxxxxLAPQGGFDNQGNxxxxxxxxxxxxxxxxxxxx
xxxALTMERQDExxxxxxxxxxxxxxxxxxNRVSAFRKLAADNKYGIxxxxxxxxxxxxxxxxxxxxxx
xxxxxxxxxxxxxxxxxxxxxxxxxxxxxxxxxxxxxxxxxxxxxxxxxxxARIRYYVRCxxxxxxxx
xxxxxxxxxxxxxxxxxxxxxxxxxxxxxxxxxxxxxxxxxxxxxxxxxxxxxxxxxxxxxxxxxxxx
GRGRKHTAFSSKGLSDEEYDEFKRIREERQGRYTIEEYLQDRDRYYEEVAVAKATEENFCEEEEIKIR
QRIFRPTKKQRKEERxxxxxxxxxxxxRKRNPDDFQPKGNLWADDTRSVxxxxxxxxxxxxxxxxxxxx
LGTGWGFWVSSNLxxxxxxxxxxxxxxxxxxxxxxxxxxxxxxxxxxxxxxxxxxxxxxGLVLEEGAPE
GTVAxxxxxxxxSGELLPLAVRMGTHATMRIQGRLVHGQMGMLLTGANAKNMDLGTIPGDCGAPYVHKR
xxxxxVAGVHAAATKSGNTVVCAVQAxxxxxxxxxxxxxxxLGHYAGHEIVxxxxGPALSTKTKFWRSS
PxALPPGVYEPAYLGGRDPRVxxGPSLQQVMRDQLRPFTxxxxxxxxxxxxxxxxxxxxxxxxxxxxxx
xxxxxxxDACQSLDKTTSSGSPHxxxxxxxxxxxxxxxxxLGEQASKANLMYExxxxxxPVYTAALKDE
LVKPEKxxxKVKKRLLWGSDLGTMxRAARAFGPFCxxxxxxxxxxxxxxxxxGMNSIEDGPxxxxxxxxx
xHFDADYSKWDSTQQxxxxxxxxxxxxxxxxxxxxxxxxxxxxxxxxxxxxxxxxxxxxEGLPSGFPC
TSQVNSxxxxxxxxxxxxxxxxxxxxxxxxxxxxxFSFDGDDEIVSTDVxxxxxxxxxxxxxYGLVPTRP
DKSEGPIxxxxxxxxxxxxxxxxxxxxxxxx

FIG. 53 - 8

```
IxxxGLYVDRGLVLGVHxPPAAISFAKVELATLSLFWRPVYTPQYPISPDTLxRLHGEAFPYTAFDNx
xxxxxxxxxxxxxSWLSRRMIQRTTGFFKPxxxWNRKPLPTVDDPKLKKVANIVLCALSSLFxxPIKD
IIGKLKPLNILNILASCDWTFAGVAESLILLAELSGVFWTPxxxxxxxxxxxxxxxxxxxxxxxxxx
xxxxGGIGLAIGFTRDKxxxMMKNAVDSLRAATQLGQYGLExxxxxMKWFFPKKDExxxxxTVRAIED
AVLxxxxxxxxxxxxxxxxxxxxxxxxxxxxxEEERVRELSxxxxxxxxxxxxxxxxxxxMARSALA
KAQxxxxxxxxxxxxMMCGPPGIGKTKxxxxxxxxxxxxxPGGKVGLVPRNAVDHWDGYHGERIVLW
DDYGMxxxxxxxxxLQAIADSAPLTLNCDRIEKKGLxxxSDAIVITTNAPGPAPVDHVNFEACSRRVD
FLVYAExxxxxxxxxxxxxxxxxxxxxxxxxxxxxxLAPQGGFDKNGKxxxxxxxxxxxxxxxxxx
xxxGLVHERRDExxxxxxxxxxxxxxxNKIAAFRKLAAENKYGMxxxxxxxxxxxxxxxxxxxxxxx
xxxxxxxxxxxxxxxxxxxxxxxxxxxxxxxxxxxxxxxxxxxxxxxxxxARARYYISCxxxxxxxx
xxxxxxxxxxxxxxxxxxxxxxxxxxxxxxxxxxxxxxxxxxxxxxxxxxxxxxxxxxxxxxxxxxx
GRGKKHAAFSxxxLRDEEYDEYKRIREERQGKYSIEEYLRDRDRYYEELAIARATEEDFCEEEIARLR
QWNFQPTRKQRKExxxxxxxxxxxxxRKRRPDDFQPKGKLWADDNRSVxxxxxxxxxxxxxxxxxxx
FGSGWGFWVSPTVxxxxxxxxxxxxxxxxxxxxxxxxxxxxxxxxxxxxxxxxxxxxxGMVLEEGAPE
GTVCxxxxxxxxTGEMIPLAVRMGTHASMKIQGKMLGGQSGMLLTGANAKGMDLGTGPGDCGAPYVYKR
xxxxxVCGVHTAAARGENTVVCATQGxxxxxxxxxxxxKGHYAGHEIIxxxxAPALSSKTKFWRSS
NxSLPPGTYEPxxxxxxxxxxxxxxxGPSLQQVMREQLKPFTxxxxxxxxxxxxxxxxxxxxxxxxxx
xxxxxxxDACMSLDKTTSSGYPHxxxxxxxxxxxxxxxxLADQAAHANNMYExxxxxxPIYTAALKDE
LVKTEKxxxRIKKRLLWGSDLSTMxRCARSFGGLMxxxxxxxxxxxxxxGMNTIEDGPxxxxxxxxxx
xHFDADYTAWDSTQNxxxxxxxxxxxxxxxxxxxxxxxxxxxxxxxxxxxxxxxxxxxDGPPSGVPC
TSQLNSxxxxxxxxxxxxxxxxxxxxxxxxxxxxYSFYGDDEIVSTDLxxxxxxxxxxxxxxYGLRPTRP
DKTEGPIxxxxxxxxxxxxxxxxxxxxxxxxxxxxxxxxxxxxxxxxxxxxxxxxxxxxxxxxxxxx
xxLLGEAALHExxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxLAGNALTAGKxxxxxxxxxxxx
xxxxxxxxxxxxxxxxxxxxxxxxxxxxxxxxxxxxxxxxxxxxRILAYLYTPLRANNSGxxVFT
DSCRVLTRPTPDFEFxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxGNGTGRRRVLMAQAIFGAIAASAAGSILGAGIxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxx
```

FIG. 53 - 9

>panNV|peptide_length:9|string4 xxNASNDASATAVxxxxxxxxxxxxxxxxxSSMAVTLKRAxxxxxxxxxxxxxxxxxSPSRPPTPELVRxI
PPPPPNGEGExxxxxxxxxNGISGLPELSTxxxxxxxxNTVFSIPPLNQGKSRDAREPLTGTILxxxxxx
xxxxxxxxxxxxxxxxxxxxxxxxISLARVELAPLSLYWRPxxTPQYLISPDSLxKLHGESFPYxxxxxx
xxxxxxxxxxxxxxxxxxxxxxxxxxxxxxxxxxxLPTMDDSKVKKVANLFLCALSSLxxxPIKD
LIGKVRPLNVINILASCDxTFAGKVESLILLADLFGVFWxxxxxxxxxxxxxxxxxxxxxxxxxxxxxx
xxxxGGVGLAIGFTKDKxxxLLSSAASTLKACREIGNYGIExxxxxMKWFFPTKDExxxxxMVRAIED
AVxxxxxxxxxxxxxxxxxxxxxxxxxxxxEEEKARTLSxxxxxxxxxxxxxxxxxxxxxxAARSLVH
KAKxxxxxxxxxxxxMISGRPGIGKTPxxxxxxxxxxxxxxGDQRIGLVPRNGVDHWDGYKGQRAVLR
LDYVLxxxxxxxxxxIQELADTAPVSLNCDRIEKKGMxxxSDTIIITTNxTSPAPLDYVxxxxxxxRVD
FLVYCSxxxxxxxxxxxxxxxxxxxxxxxxxxxxxxPQGG

FIG. 53 - 10

```
xxxxxxxxxxxxxxxxxxxxxxISLAKVELTTLSLFWRPxxxPQYLISPDSxxKLHGEAFPYxxxxxx
xxxxxxxxxxxxxxxxxxxxxxxxxxxxxxxxxxxxxxxxxMDDSKLKKVANVFLCALSSLxxxxIKD
IIGKLRPLNVINIxxxxxxxxxxxxxxxxLILLADLFGxxxxxxxxxxxxxxxxxxxxxxxxxxxxx
xxxxGEIGMVLGFTKERxxxLLKSAADTLRAAKDLGAYGLDxxxxxVKWFFPKKExxxxxxLVRAIED
AVxxxxxxxxxxxxxxxxxxxxxxxxxxxxxxxxxxxxxxxxxxxxxxxxxxxxxxxxxxxMARAALA
KAQxxxxxxxxxxxxIISRRPGIGKTHxxxxxxxxxxxxxxGDQRVGLVPREGVGHWDAYKEEEVLLW
DDYxxxxxxxxxxxLQELGDTAPLSLNCDRSANKGKxxxSEAIVITTNxxxxxxxxxxxxxxxxxxRVD
FLVYCTxxxxxxxxxxxxxxxxxxxxxxxxxxxxxxxxxxQGGFDKSGNxxxxxxxxxxxxxxxxxx
xxxGLLHERMDExxxxxxxxxxxxxxxxDKVSAFRKLAADNKYSLxxxxxxxxxxxxxxxxxxxxxx
xxxxxxxxxxxxxxxxxxxxxxxxxxxxxxxxxxxxxxxxxxxxxxxxxxxxxARVRYYVKCxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxEEYDEFKKIREERNGRYSIExxxxxxxDKYYEEVAVARATEEDFAEEEEVKIR
QRxxxxxxxxxxxxxxxxxxxxxxxxxxEKRKPDDFKPRGKLWADDSREVxxxxxxxxxxxxxxxxxx
xxxGWAFWVSPSLxxxxxxxxxxxxxxxxxxxxxxxxxxxxxxxxxxxxxxxxxxxGMILEEGCPE
GVVCxxxxxxxxxxxxxxxxxxxRMGAVASMKIQGRLMHGQSGMLxxxxxxxxxxxxxxxxxxxxxxx
xxxxxVIGVHTAAARAGNTVICATxxxxxxxxxxxxxxxxRGTYCGAPIxxxxxAPKFSTKTKxxxxx
xxxxxxxxxxxxxxxxxxxxxxxxLSLQQIMRDQLKPFxxxxxxxxxxxxxxxxxxxxxxxxxxxxxx
xxxxxxxxxxxxxxKTTSSGDPHxxxxxxxxxxxxxxxxxxxxxxxxxxxxxxxxxPLYTAALKDE
LVKTSKxxxTIKKRLLWGADLSTxxxCVRAFGGLMxxxxxxxxxxxxxxGLNMNEDGPxxxxxxxxxx
xSFDADYSRWDSIQQxxxxxxxxxxxxxxxxxxxxxxxxxxxxxxxxxxxxxxxxxxxxxxxPGVPC
TSQWDSxxxxxxxxxxxxxxxxxxxxxxxxxxxxxYSFYGDDYIxxxxxxxxxxxxxxxxxxIGLVPTRP
Dxxxxxxxxxxxxxxxxxxxxxxxxxxxxxxxxxxxxxxxxxxxxxxxxxxxxxxxxxxxxxxxxxx
xxLLGESALHGxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxRLLAYLYTPLRANSPTxxxxx
xxxxxxTRPSQDFEFxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxMAQAIIGAIAATAACSAVGAGIxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxx
```

FIG. 53 – 11

>panNV|peptide_length:10|string1

MKMASNDASAAAxxxxxxxxxxxxxxxxxSSMAVTFKRALGARxxxxxxxxxxxxRPPRPPTPELVKxx
PPPPPNGEDExxxxxxxxxGVSGLPELSTVxxxxxxxxxxxxxPPLNQRENRDAKEPLTGTILEMWDGE
IYHYGLYVERGLVLGVHKPPAAISLAKVELTPLSLFWRPVYTPQYLISPDTLxKLHGETFPYTAFDNN
CYAFCCWVLDLNDSWLSRRMIQRTTGFFRPYQDWNRKPLPTMDDSKLKKVANIFLCTLSSLFTRPIKD
IIGKLRPLNIINILASCDWTFAGIVESLILLAELFGVFWTPPDVSAMIAPLLGDFELQxxxxxxxxxx
xxxxGGIGLVLGFTKEKxxxxxxxxxxxxxACKDLGAYGLExxxxxMKWFFPKKEExxxxxMVRSIED
AVLDxxxxxxxxxxxxxxxxxxxxxxxxxxxxxxxxxxxxxxxxxxxxxxxxxxxxxxxxxxxxxxx
xxxxxxxxxxxxxxxxMISGRPGIGKTxxxxxxxxxxxxxxxGDQRVGLIPRNGVDHWDAYKxERVVLW
DDYGMxxxxxxxxxxxxxxxxxPLTLNCDRIENKGKxxxxxxxIIITTNLANPAPLDYVNFEACSRRID
FLVYAExxxxxxxxxxxxxxxxxxxxxxxxxxxxLAPQGGFDKNGNxxxxxxxxxxxxxxxxxxx
xxxxxxxxxxxxxxxxxxxxxxxxxxxNKVLAFRQLAAENKYGLxxxxxxxxxxxxxxxxxxxxxxx
xxxxxxxxxxxxxxxxxxxxxxxxxxxxxxxxxxxxxxxxxxxxxx

FIG. 53 - 12

```
IYHYGLYVERGLILGVHKPPAAISLARVELTPLSYWRPVYAPQYLISPDALxRLHGESFPYTAFDNN
xxxxxxxVLDLNDSWLCRRMIQRTTGFFRPYQDWNRKPLPTTDDSKLKKAANIFLCALSSLFTRPIKD
IIGKLRPLNILNILATCDWTFAGIVESLILMADLFGVFWTPPVVSAMIAPLLGDYELQxxxxxxxxxx
xxxxGGIGMVLGFTAEKxxxxxxxxxxxxxACKDLGNYALDxxxxxKKYFFGGDQTxxxxxILRAIED
AVLDxxxxxxxxxxxxxxxxxxxxxxxxxxxxxxxxxxxxxxxxxxxxxxxxxxxxxxxxxxxxxxx
xxxxxxxxxxxxxxMISGKPGIGKTxxxxxxxxxxxxxxGDQRVGLVPRNGVDHWDAYRxEEVMLW
DDYGMxxxxxxxxxxxxxxxxxxPVSLNCDRIENKGMxxxxxxIIITTNLVGPAPVDFVNLGPVCRRID
FLVYADxxxxxxxxxxxxxxxxxxxxxxxxxxxxxxxxLAPQGGFDNQGNxxxxxxxxxxxxxxxxx
xxxxxxxxxxxxxxxxxxxxxxxxxxxxxNRVSAFRKLAADNKYGIxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
GRGRKHTAFSSKGLSDEEYDEFKRIREERQGKYTIEEYLQDRDRYYEEVAVAKATEENFCEEEEIKIR
QRIFRPTKKQRKEERxxxxxxxxxxxRKRNPDDFQPKGNLWADDTRSVxxxxxxxxxxxxxxxxxxx
LGTGWGFWVSSNLxxxxxxxxxxxxxxxxxxxxxxxxxxxxxxxxxxxxxxxxxxxxGLVLEEGAPE
GTVAxxxxxxxxSGELIPLAVRMGTHATMRIQGRLVHGQMGMLLTGANAKNMDLGTIPGDCGAPYVHKR
xxxxxVAGVHAAATKSGNTVVCAVQAxxxxxxxxxxxxxxxxxxxxxxxxxxxGPALSTKTKFWRSS
PxALPPGTYEPAYLGGRDPRVxxGPSLQQVMRDQLRPFTxxxxxxxxxxxxxxxxxxxxxxxxxxxxx
xxxxxxxDACQSLDKTTSSGSPHxxxxxxxxxxxxxxxLGDQASKANLMYExxxxxxPVYTAALKDE
LVKPEKxxxxVKKRLLWGSDLGTMxRAARAFGPFCxxxxxxxxxxxxxxxxxxxxxxxxxxxxxxxxx
xHFDADYTAWDSTQxxxxxxxxxxxxxxxxxxxxxxxxxxxxxxxxxxxxxxxxxxxxEGLPSGFPC
TSQVxxxxxxxxxxxxxxxxxxxxxxxxxxxxxxxxGDDEIVSTDVxxxxxxxxxxxxxYGLVPTRP
DKSEGPIxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxLAGNAFAAGKxxxxxxxxxxx
xxxxxxxxxxxxxxxxxxxxxxxxxxxxxxxxxxxxxxxxxxxxxxxRLVAMLYTPLRSNGSGxVFTV
SCRVLTRPAPDFEFTxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxMGNGAGRRRALMAQAIFGAIAASAAGSILxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxx
```

FIG. 53 - 13

```
>panNV|peptide_length:10|string3

MKMASNDASAVAxxxxxxxxxxxxxxxxxSNMAVTLKRALxxxxxxxxxxxxxxKPPRPPTPELAKxx
PPPPPPNGEEExxxxxxxxxxGVSGLPELTTVxxxxxxxxxxxxxPPLNQRESRDAKEPLTGTNLEMWDGE
IYxYGLYVDRGLVLGVHKPPAAISFAKVELATLSLFWRPVYTPQYLISPDSLxRLHGEAFPYTAFDNN
xxxxxxxxxxxxDSWLSRRMIQRTTGFFRPYQDWNRKPLPTVDDSKVKKVANIVLCALSSLFTRPIKD
IIGKLKPLNILNILASCDWSFAGVAESLILLAALFGVFWTPPxxxxxxxxxxxxxxxxxxxxxxxxx
xxxxGGIGLAIGFTRDKxxxxxxxxxxxxxAATQLGQYGLExxxxxMKWFFPKKDExxxxxTVRAIED
AVLDxxxxxxxxxxxxxxxxxxxxxxxxxxxxxxxxxxxxxxxxxxxxxxxxxxxxxxxxxxxxxx
xxxxxxxxxxxxxxxMMCGPPGIGKTxxxxxxxxxxxxxxPGGKVGLVPREAVDHWDGYHxERIVLW
DDYGMxxxxxxxxxxxxxxxxxxPLTLNCDRIEKKGLxxxxxxIVITTNAPSPAPLDFVNFEACSRRVD
FLVYAExxxxxxxxxxxxxxxxxxxxxxxxxxxxxxxxxxxLAPQGGFDKNGKxxxxxxxxxxxxxxxx
xxxxxxxxxxxxxxxxxxxxxxxxxxxxxxNKIAAFRQLAAENKYGMxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
GCGKKHTAFSSxGLRDEEYDEYKRIREERGGKYSIEEYLQDRDRYYEELAIARATEEDFCEEDEARIR
QRIFRPTSKLRKEDxxxxxxxxxxxxxRKRRPDDFQPKGKLWADDNRSVxxxxxxxxxxxxxxxxxxx
FGSGWGFWVSPTVxxxxxxxxxxxxxxxxxxxxxxxxxxxxxxxxxxxxxxxxxxxGMVLEEGAPE
GTVCxxxxxxxxTGEMLPLAVRMGTHASMKIQGKMLGGQSGMLLTGANAKGMDLGTGPGDCGAPYVYKR
xxxxxVCGVHTAATRGENTVICATQGxxxxxxxxxxxxxxxxxxxxxxxxxxxxxAPALSTKTKFWRSS
NxSLPPGVYEPAYLGGKDPRIxxGPSLQQVMREQLKPFTxxxxxxxxxxxxxxxx

FIG. 53 - 14

```
xxxxxxxxxxxxxxxxxxxxxxAISLARVELAPLSLYWRPVYTPQHLISPDTLxKLHGESFPYTxxxxx
xxxxxxxxxxxxxxxxxxSRRMIQRTTDxxxxxxxxxxxPLPTMDDSKLKKVANVVLCALSSLxxRPIKD
LIGKVRPLNVINILASCDWTFAGIVESLILLAELSGVFWTxxxxxxxxxxxxxxxxxxxxxxxxxxxx
xxxxGGVGMVLGFTKERxxxxxxxxxxxxxACREIGNYGIExxxxxMKWFFPTKDExxxxxMVRAIED
AVLxxxxxxxxxxxxxxxxxxxxxxxxxxxxxxxxxxxxxxxxxxxxxxxxxxxxxxxxxxxxxxxx
xxxxxxxxxxxxxxxILSGPPGIGKTxxxxxxxxxxxxxxxGDQRIGLVPRESIDHWDGYHxERVVLW
YEYGMxxxxxxxxxxxxxxxxxPLTLNCDRIEKKGMxxxxxxxxxxxLTSPAPLDYVNFEACSRRVD
FLVYCSxxxxxxxxxxxxxxxxxxxxxxxxxxxxxxxLAPQGGFDKNANxxxxxxxxxxxxxxxxxx
xxxxxxxxxxxxxxxxxxxxxxxxxxxNKIAAFRKMAADNRYGFxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxSDEEYDEFKRIREEKQGRYTIEEYLQDRDRYYEELAIARATEEDFCEEEIAKIR
QRIFRPTSKLRKxxxxxxxxxxxxxxxRRRKLDDFQPKVKLWADDSRSVxxxxxxxxxxxxxxxxxx
xGTGWGFWVSSSLxxxxxxxxxxxxxxxxxxxxxxxxxxxxxxxxxxxxxxxxxxxxGLVLEEGCPE
GTVCxxxxxxxxxxxxLPLAVRMGAIASMRIQGKTIGGQMGMLLTGSNAKNMDLGTFPGDCGCPYVYKR
xxxxxGIGVHAAAARSGNTVVCATQGxxxxxxxxxxxxxxxxxxxxxxxxxxxxxxGPALSTKTKFWKSS
PxPLPPGVYEPAYLGGRxxxxxxGPSLQQVLRDQLKPFAxxxxxxxxxxxxxxxxxxxxxxxxxxxx
xxxxxxxDACMSLDKTTSSGHPYxxxxxxxxxxxxxxxxLADQASRANLMYExxxxxxxPIYTAALKDE
LVKTSKxxxxxxxKRLLWGADLGTVxRCARSFGGLMxxxxxxxxxxxxxxxxxxxxxxxxxxxxxxx
xHYDADYTAWDSxxxxxxxxxxxxxxxxxxxxxxxxxxxxxxxxxxxxxxxxxxxxxxxEGLPSGVPC
TSQRxxxxxxxxxxxxxxxxxxxxxxxxxxxxxxxxxxxxxxxxxxxxxxxxxxxxxYGLIPTRP
DKTDGPIxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxMAGNAFTAGKxxxxxxxxxxxxxxx
xxxxxxxxxxxxxxxxxxxxxxxxxxxxxxxxxxxxxxxxxxxRLIAYLYTPLRANSGExDVFT
DSCRVLTRPSPDFEFxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxMAQAVLGAIAASTAGSALxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxx
```

FIG. 53 - 15

>panNV|peptide_length:10|string5 xKMASNDASATAxxxxxxxxxxxxxxxxxSGMAVTFKRALxxxxxxxxxxxxxxxxxSRPPTPELVKxx
PPPPPNGEGExxxxxxxxxxxxxxxxxxxxxxxxxxxxxxxxPPLNQGKSRDAKExxxxxxxxxxxxx
xxxxxxxxxxxxxxxxxxxxxxxAISLAKVELTTLSLFWRPVxxSQYLISPDTLxKLHGEAFPYTxxxxx
xxxxxxxxxxxxxxxxxxxxxxxxxxxxxxxxxxxxTMDDPKVKKVANLFLCALSSLxxxPIKD
LIGRLRPLNVINILxxxxxxxxxxxxxSLILLAELFDVxxxxxxxxxxxxxxxxxxxxxxxxxxxx
xxxxGGLGLAIGFTKDKxxxxxxxxxxxxxACKDLGAYGLDxxxxxVKWFFPKKEExxxxxLVRAIED
AVLxxxxxxxxxxxxxxxxxxxxxxxxxxxxxxxxxxxxxxxxxxxxxxxxxxxxxxxxxxxxxxxxx
xxxxxxxxxxxxxxxxMLSGPPGIGKxxxxxxxxxxxxxxxxxGDKRVGLTPRNGVHYSHAYKxEEVLLW
DDYGxxxxxxxxxxxxxxxxxxxLTLNCGRIENKGKxxxxxxxxxxxxxxxxxxxxMNLGPVCRRVD
FLVYCTxxxxxxxxxxxxxxxxxxxxxxxxxxxxxxxxxxxPQGGFDQNGNxxxxxxxxxxxxxxxxxx
xxxxxxxxxxxxxxxxxxxxxxxxxxxxxxNKVFAFRKLAADNNYGFxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxDEEYEEYKKLREDRNGKYSIEExxxxRDKYYEEVAIARATEDDFCEDDEMRIR
QRVFRPTRKQRKxxxxxxxxxxxxxxxxRKRKPDDFKPRGKLWADDSREVxxxxxxxxxxxxxxxxxx
xxxGWGCWVSPTLxxxxxxxxxxxxxxxxxxxxxxxxxxxxxxxxxxxxxxxxxxxGMILEEGCPE
GVVCxxxxxxxxxxxxxxxxxxxRMGAVASMKIQGRAVGGQMGMLLxxxxxxxxxxxxxxxxxxxxx
xxxxxVIGVHTAAARSGNTVICAIPxxxxxxxxxxxxxxxxxxxxxxxxxxxxxxxAPTLSTKTKFWRxx
xxxxxxxxxxxxxxxxxxxxxxxxxxCLSLQQIMRDQLKPFTxxxxxxxxxxxxxxxxxxxxxxxxxx
xxxxxxxxxxxxxDKTTSSGFPYxxxxxxxxxxxxxxxxxxxNQASKANLMFxxxxxxxPLYTAALKDE
LVKTDRxxxxxxKRLLWGADLSTVxRAAMAFGPFCxxxxxxxxxxxxxxxxxxxxxxxxxxxxxxx
xHYDADCSRWDxxxxxxxxxxxxxxxxxxxxxxxxxxxxxxxxxxxxxxxxxxxxxxxxxEGPPPGVPC
TSQWxxxxxxxxxxxxxxxxxxxxxxxxxxxxxxxxxxxxxxxxxxxxxxxxxxxxxIGLVPTRP
DKxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxLAGNAFTAGExxxxxxxxxxxxxx
xxxxxxxxxxxxxxxxxxxxxxxxxxxxxxxxxxxxxxxxRLLAYLYTPLRANSPTxxxxx
VSCRILTRPSQDFEFxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxMAQAILGAIAATAACSAVxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxx >panNV|peptide_length:11|string1

MKMASNDASAAAxxxxxxxxxxxxxxxxxSSMAVTFKRALGARxxxxxxxxxxxxPPRPPTPELVKxx
xxxxxxxxxxxxxxxxxxxxxxGVSGLPELSTVxxxxxxxxxxxxPPLNQRENRDAKEPLTGTILEMWDGE

FIG. 53 - 16

```
IYHYGLYVERGLVLGVHKPPAAISLAKVELTPLSLFWRPVYTPQYLISPDxxxKLHGETFPYTAFDNN
CYAFCCWVLDLNDSWLSRRMIQRTTGFFRPYQDWNRKPLPTMDDSKLKKVANIFLCTLSSLFTRPIKD
IIGKLRPLNIINILASCDWTFAGIVESLILLAELFGVFWTPPDVSAMIAPLLGDFELQxxxxxxxxxx
xxxxxxxxxxxxxxxxxxxxxxxxxxxxxxxxxxxxxxxxxxxxxxxxxxxxxxxxxxxxxMVRSIED
AVLDLxxxxxxxxxxxxxxxxxxxxxxxxxxxxxxxxxxxxxxxxxxxxxxxxxxxxxxxxxxxxxxx
xxxxxxxxxxxxxxxxxxxMISGRPGIGKTxxxxxxxxxxxxxxxxxGDQRVGLIPRNGVDHWDAYKxERVVLW
DDYGMxxxxxxxxxxxxxxxxxxPLTLNCDRIENKGKxxxxxxxIIITTNLANPAPLDYVNFEACSRRID
FLVYAxxxxxxxxxxxxxxxxxxxxxxxxxxxxxxxxxxxLAPQGGFDKNGNxxxxxxxxxxxxxxxxx
xxxxxxxxxxxxxxxxxxxxxxxxxxxxNKVLAFRQLAAENKYGLxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
GRGKKHTAFSSKGLSDEEYDEYKRIREERNGKYSIEEYLQDRDKYYEEVAIARATEEDFCEEEEAKIR
QRIFRPTRKQRKEERxxxxxxxxxxxxxxxxPEDFKPKGKLWADDDRSVxxxxxxxxxxxxxxxxxxxx
FGSGWGFWVSPxxxxxxxxxxxxxxxxxxxxxxxxxxxxxxxxxxxxxxxxxxxxxxxxxGMILEEGAPE
GTVVxxxxxxxxTGELMPLAARMGTHATMKIQGRTVGGQMGMLLTGSNAKSMDLGTTPGDCGCPYIYKR
xxxxxxxGVHTAAARGGNTVICATQGGEGEATLEGGGGQNKGHYAGxxxxxxxxAPKLSTKTKFWRSS
TxPLPPGTYEPAYLGGKDPRVxxGPSLQQVMRDQLKPFTxxxxxxxxxxxxxxxxxxxxxxxxxxxxxx
xxxxxxxxQACASLDKTTSSGHPHxxxxxxxxxxxxxxxxxLADQASKANLMFExxxxxxPVYTGALKDE
LVKTDKxxxxIKKRLLWGSDLATMxxxxxxxxxxxxxxxxxxxxxxxxxxxxxxxxxxxxxxxxxxxxx
xHYDADYSRWDSTQQxxxxxxxxxxxxxxxxxxxxxxxxxxxxxxxxxxxxxxxxxxxxGLPSGVPC
TSQxxxxxxxxxxxxxxxxxxxxxxxxxxxxxxxFSFYGDDEIVSTDIxxxxxxxxxxxxxxxxxPTRP
DKTEGPLxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxKLIAMLYTPLRANNAGEDVFT
VSCRVLTRPSPDFDFxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxPMGNGTGRRRALMAQAIIGAIAATAAGSAVxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxx
```

FIG. 53 - 17

>panNV|peptide_length:11|string2

MKMASNDAFAAAxxxxxxxxxxxxxxxxxSNMAVTLKRALGARxxxxxxxxxxxxxPPRPPTPELIKxx
xxxxxxxxxxxxxxxxxxxxxGVSGLPDLSTVxxxxxxxxxxxxxPPLSQRENRDAKEPLTGTIIEMWDGE
IYHYGLYVERGLILGVHKPPAAISLARVELTPLSLYWRPVYAPQYLISPDxxxRLHGESFPYTAFDNN
CxxxxxxWVLDLNDSWLCRRMIQRTTGFFRPYQDWNRKPLPTTDDSKLKKAANIFLCALSSLFTRPIKD
IIGKLRPLNILNILATCDWTFAGIVESLILMAELFDVFWTPPDVSAMIAPLLGDYELQxxxxxxxxxx
xxxxxxxxxxxxxxxxxxxxxxxxxxxxxxxxxxxxxxxxxxxxxxxxxxxxxxxxxxxxxxILRAIED
AVLDMxxxxxxxxxxxxxxxxxxxxxxxxxxxxxxxxxxxxxxxxxxxxxxxxxxxxxxxxxxxxxxx
xxxxxxxxxxxxxxxxMISGKPGIGKTxxxxxxxxxxxxxxxxGDQRVGLVPRNGVDHWDAYRxEEVMLW
DDYGMxxxxxxxxxxxxxxxxxxxxxPVTLNCDRIENKGMxxxxxxxIIITTNLVGPAPVDYVNLGPVCRRVD
FLVYCxxxxxxxxxxxxxxxxxxxxxxxxxxxxxxxxxxxxLAPQGGFDNQGNxxxxxxxxxxxxxxxxx
xxxxxxxxxxxxxxxxxxxxxxxxxxxxxxxxxNRVSAFRKLAADNKYGIxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
GRGRKHTAFSSKGLSDEEYDEFKRIREERQGRYSIEEYLQDRDRYYEEVAVAKATEENFCEEEEIKIR
QRIFRPTKKQRKEERxxxxxxxxxxxxxxxxxxPDDFQPKGNLWADDTRSVxxxxxxxxxxxxxxxxxxxxx
LGTGWGFWVSSxxxxxxxxxxxxxxxxxxxxxxxxxxxxxxxxxxxxxxxxxxxxxxxGLVLEEGAPE
GTVAxxxxxxxxSGEMIPLAVRMGTHATMRIQGRLVGGQMGMLLTGANAKNMDLGTIPGDCGAPYVHKR
xxxxxxxxGVHAAATKSGNTVVCAVQAxxxxxxxxxxxxxxxxxxxxxxxxxxxxxxxxGPALSTKTKFWRSS
PxALPPGTYEPAYLGGRDPRVxxGPSLQQVMRDQLRPFTxxxxxxxxxxxxxxxxxxxxxxxxxxxxxx
xxxxxxxxDACQSLDKTTSSGSPHxxxxxxxxxxxxxxxxxxxLADQASKANLMYExxxxxxPVYTAALKDE
LVK

FIG. 53 - 18

```
IYHYGLYVDRGLVLGVHKPPAAISFAKVELAPLSLFWRPVYTPQYPISPDxxxRLHGEAFPYTAFDNN
CxxxxxxxxxxNDSWLNRRMIQRTTGFFKPYQDWNRKPLPTVDDSKVKKVANIVLCALSSLFTRPIKD
IIGKLKPLNILNILASCDWSFAGVAESLILLADLFGVFWTPPDxxxxxxxxxxxxxxxxxxxxxxxxx
xxxxxxxxxxxxxxxxxxxxxxxxxxxxxxxxxxxxxxxxxxxxxxxxxxxxxxxxxxxxTVRAIED
AVLDLxxxxxxxxxxxxxxxxxxxxxxxxxxxxxxxxxxxxxxxxxxxxxxxxxxxxxxxxxxxxxx
xxxxxxxxxxxxxxxMMCGPPGIGKTxxxxxxxxxxxxxxxPGGKVGLVPREAVDHWDGYHxERIVLW
DDYGMxxxxxxxxxxxxxxxxxPLSLNCDRIENEGKxxxxxxIVITTNAPGPAPVDFVNFEACSRRVD
FLVYAxxxxxxxxxxxxxxxxxxxxxxxxxxxxxxxLAPQGGFDKNGKxxxxxxxxxxxxxxxxxxx
xxxxxxxxxxxxxxxxxxxxxxxxxNKIAAFRQLAAENKYGMxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
GRGKKHAAFSSKGLSDEEYEEYKRIREDKEGRYTIEEYLQDRDRYYEELAIARATEEDFCEEEIAKIR
RRVFRPTKKQRREERxxxxxxxxxxxxxxPDDFQPKGKLWADDNRSVxxxxxxxxxxxxxxxxxxxx
FGSGWGFWVSSxxxxxxxxxxxxxxxxxxxxxxxxxxxxxxxxxxxxxxxxxxxxGMVLEEGAPE
GTVCxxxxxxxTGELLPLAVRMGTHASMKIQGKMLHGQSGMLLTGANAKGMDLGTGPGDCGAPYVYKR
xxxxxxxGVHTAATRGENTVICATQGxxxxxxxxxxxxxxxxxxxxxxxxxGPALSTKTKFWRSS
NxSLPPGVYEPAYLGGKDPRIxxGPSLQQVMREQLKPFTxxxxxxxxxxxxxxxxxxxxxxxxxxx
xxxxxxxQACMSLDKTTSSGYPHxxxxxxxxxxxxxxxxxLGEQAAHANNMYExxxxxxPMYTAALKDE
LVKTEKxxxxIKKRLLWGSDLSTMxxxxxxxxxxxxxxxxxxxxxxxxxxxxxxxxxxxxxxxxxx
xHFDADYSAWDSTQNxxxxxxxxxxxxxxxxxxxxxxxxxxxxxxxxxxxxxxxxxxxGLPPGVPC
TSQxxxxxxxxxxxxxxxxxxxxxxxxxxxxxxxxxYGDDEIVSTDLxxxxxxxxxxxxxxxxxPTRP
DKTEGPIxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxRLVAMLYTPLRANNSGDDVFT
VSCRVLTRPTPDFEFxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxPMGNGTGRRRVLMAQAVIGAIAASAAGSALxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxx
```

FIG. 53 - 19

\>panNV|peptide_length:11|string4

MKRGSNDASAAAxxxxxxxxxxxxxxxxxxxSSMAVTLKRALGxxxxxxxxxxxxxxxPSRPPTPELVKxx
xxxxxxxxxxxxxxxxxxxGISGLPELSTVxxxxxxxxxxxxxPPLYQRENRDAREPLTGTILEMxxxx
xxxxxxxxxxxxxxxxxxAAISLAKVELATLSLFWRPVYTSQYLISPDxxxKLHGEAFPYTAxxxxx
xxxxxxxxxxxxxxxLSRRMISRTTGFxxxxxxxNRKPLPTMDDSKVKKVANLFLCALSSLxTRPIKD
LIGKVKPLNVINILASCDWTFAGKVESMILLAELFDVFWTPPDxxxxxxxxxxxxxxxxxxxxxxxx
xxxxxxxxxxxxxxxxxxxxxxxxxxxxxxxxxxxxxxxxxxxxxxxxxxxxxxxxxxxxMVRAIED
AVLDFxxxxxxxxxxxxxxxxxxxxxxxxxxxxxxxxxxxxxxxxxxxxxxxxxxxxxxxxxxxxx
xxxxxxxxxxxxxxxMISRRPGIGKTxxxxxxxxxxxxxxxxGDQRIGLVPRNGVHYSHAYKxESAVLR
LDYVLxxxxxxxxxxxxxxxxxxxPVTLNCDRIEKKGLxxxxxxxxxxxNATSPAPLDYVNFEACSRRTD
xxxxxxxxxxxxxxxxxxxxxxxxxxxxxxxxxxxxxxxLAPQGGFDKSGNxxxxxxxxxxxxxxxxx
xxxxxxxxxxxxxxxxxxxxxxxxxxxxxNKINSFRQLAAENKHGLxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxLRDEEDDEYKRLREERGGKYTIEEYLQDRDRYYEELAVAQATEEDFAEDDEMRIR
QRVFRPTRKQRKExxxxxxxxxxxxxxxxxxPDDFKPKGKLWADDSRSVxxxxxxxxxxxxxxxxxxx
FGTGWGFWVSPxxxxxxxxxxxxxxxxxxxxxxxxxxxxxxxxxxxxxxxxxxxxxxxGLVLEEGCPE
GTVCxxxxxxxxxxxLLPLAVRMGAIASMRVQGRVIGGQMGMLLTGSNAKNMDLGTSPGDCGCPYVYKR
xxxxxxxGVHTVAARSGNTVICAIPNxxxxxxxxxxxxxxxxxxxxxxxxxxxxAPALSTKTKFWKSS
PxPLPPGVYEPAYLGGRDxxxxxGPSLQQVLRDQLKPFAxxxxxxxxxxxxxxxxxxxxxxxxxxxxx
xxxxxxxDACMSLDKTTSSGHPYxxxxxxxxxxxxxxxxxLADQASRANLMYExxxxxxPIYTAALKDE
LVKTSKxxxxxKKRLLWGADLGTVxxxxxxxxxxxxxxxxxxxxxxxxxxxxxxxxxxxxxxxxxxx
xHYDADYTAWDSTxxxxxxxxxxxxxxxxxxxxxxxxxxxxxxxxxxxxxxxxxxxxxxGLPSGVPC
TPQxxxxxxxxxxxxxxxxxxxxxxxxxxxxxxxxxxxxxxxxxxxxxxxxxxxxxxxxxxxPTRP
DKTDGPIxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxRIIAYLYTPLRANSGEEVVFT
DSCRVLTRPSPDFEFxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxMAQAVLGAIAASTAGSALxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxx \>panNV|peptide_length:11|string5

MKNGSNDASAAAxxxxxxxxxxxxxxxxxxxSNVAVTLKRALGxxxxxxxxxxxxxxxPPRPPTPELVRxx
xxxxxxxxxxxxxxxxxxxxxxxxxxxxxxxxxxxxPPLGQRENRDAKEPxxxxxxxxxxxxxxxxxx

FIG. 53 - 20

```
xxxxxxxxxxxxxxxxxxxxxAAISLARVELTTLSLFWRPVYxxxxxxxxxxxxxKLHGESFPYTAxxxx
xxxxxxxxxxxxxxxxxxxxxxxxxxxxxxxxxxxxxxxxxPTMDDPKLKKVANVFLCALSSLxxRPIKD
IIGKLRPLNVINILASxxxxxxxxxVESLILLAELFDVFxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxLVRAIED
AVLDxxxxxxxxxxxxxxxxxxxxxxxxxxxxxxxxxxxxxxxxxxxxxxxxxxxxxxxxxxxxxxxxx
xxxxxxxxxxxxxxxxxMISGRPGVGKTxxxxxxxxxxxxxxxGDQRVGLTPRESIDHWDGYHxERVVLW
YEYGMxxxxxxxxxxxxxxxxxxPLSLNCGRIENKGKxxxxxxxxxxxxxxxxxxxxxxYVNFEACCRRID
xxxxxxxxxxxxxxxxxxxxxxxxxxxxxxxxxxxxxLAPQGGFDQNGNxxxxxxxxxxxxxxxxxxx
xxxxxxxxxxxxxxxxxxxxxxxxxxxxxxNKVSAFRKLAADNNYGFxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxDEEYDEYKRVREEREGKYSIEEYxxDRDKYYEELAIARATEEDFCEEEEAELR
QWIFRPTSKLRKExxxxxxxxxxxxxxxxxxLFAFLPKGKLWADDDRNVxxxxxxxxxxxxxxxxxxxx
xxxxxxxxxxxxxxxxxxxxxxxxxxxxxxxxxxxxxxxxxxxxxxxxxxxxxxxxxGMILEEGCPE
GVVCxxxxxxxxxxxxxxxxxxxRMGAVASMKIQGKTIGGQMGMLLTxxxxxxxxxxxxxxxxxxxxxx
xxxxxxxGVHTAAAHGGNTVVCATQGxxxxxxxxxxxxxxxxxxxxxxxxGPTLSTKTKFWRSx
xxxxxxxxxxxxxxxxxxxxGLSLQQIMRDQLKPFTxxxxxxxxxxxxxxxxxxxxxxxxxxxxxxxx
xxxxxxxxxxxxxLDKTTSSGFPYxxxxxxxxxxxxxxxxxxANQASKANLMFExxxxxxPLYTAALKDE
LVKTDRxxxxxKKRLLWGADLSTVxxxxxxxxxxxxxxxxxxxxxxxxxxxxxxxxxxxxxxxxxxxx
xLFDADYSRWDSTxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxRLLAYLYTPLRANSPTDDVFT
VSCRVLTRPSQDFEFxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxMAQAILGAIAATAACSAVxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxx
```

FIG. 54-1

\>DENV1|peptide_length:8|string1

```
NNQRKKTGKPSINMLKRVRNRVSTGSQLAKRFSKGLLNGQGPMKLVMAFIAFLRFLAIPPTAGVLARW
GTFKKSGAIKVLKGFKKEISNMLSIINKRKKTSLCLMMILPAALAFHLTSRDGEPRMIVGKNERGKSL
LFKTASGINMCTLIAMDLGEMCDDTVTYKCPHITEVEPEDIDCWCNLTSTWVTYGTCNQAGEHRRDKR
SVALAPHVGMGLDTRTQTWMSAEGAWRQVEKVETWALRHPGFTILALFLAHYIGTSLTQKVVIFILLM
LVTPSMTMRCVGVGNRDFVEGLSGATWVDVVLEHGGCVTTMAKNKPTLDIELQKTEATQLATLRKLCI
EGKITNITTDSRCPTQGEAVLPEEQDQNYVCKHTYVDRGWGNGCGLFGKGSLVTCAKFQCLEPIEGKV
VQYENLKYTVIITVHTGDQHQVGNETQGVTAEITPQASTTEAILPEYGTLGLECSPRTGLDFNEMILL
TMKNKAWMVHRQWFFDLPLPWTSGATTETPTWNRKELLVTFKNAHAKKQEVVVLGSQEGAMHTALTGA
TEIQNSGGTSIFAGHLKCRLKMDKLELKGMSYAMCTNTFVLKKEVSETQHGTILIKVEYKGEDAPCKI
PFSTEDGQGKAHNGRLITANPVVTKKEEPVNIEAEPPFGESNIVIGIGDNALKINWYKKGSSIGKMFE
ATARGARRMAILGDTAWDFGSVGGVLNSLGKMVHQIFGSAYTALFSGVSWVMKIGIGVLLTWIGLNSK
NTSMSFSCIAIGIITLYLGAVVQADMGCVINWKGKELKCGSGIFVTNEVHTWTEQYKFQADSPKRLAT
AIAGAWENGVCGIRSTTRMENLLWKQIANELNYILWENNIKLTVVVGDIIGVLEQGKRTLTPQPMELK
YSWKTWGKAKIVTAETQNSSFIID

FIG. 54-2

ASNAICSAVPVHWVPTSRTTWSIHAHHQWMTTEDMLTVWNRVWIEDNPWMEDKTPVTTWENVPYLGKR
EDQWCGSLIGLTSRATWAQNIPTAIQQVRSLIGNEEFLDYMPSMKRFRKEEESEGAIW

>DENV1|peptide_length:8|string2

NNQRKKAGKPSINMxxxVRNRVSTGSQLAKRFSRELLNGQGPxxxxxxxxxxxxxLAIPPTAGILARW
GTFKKSGAIKVLRGFKREISNMLSIINRRKKTSFCLMMMLPATLAFHLTSxDGEPRMIVAKNERGKSL
LFKTATGINMCTLxxxxLGEMCDDTVTYKCPLIAEVEPEDIxxxxxxxxxxxxxGTCNQAGERRRDKR
SVxxxxxVGMGLDTRAQTWMSAExxWRQVEKVETWAFRHPGFTILALFLAHYIGTSLTQKVVIFVLLM
LVTPSMAMRCVGVGxxxxxxxxxxxxxxxxxxxxxxGCVTTMAKSKPTLDIExxxxxxxxxxxxxxxCI
EGKITNVTTDSRCPTQGEAILPEEQDQxxxxxxxxxxxxxxxxxxxxxxxxxxxxxCAKFQCLESIEGKV
VQHENLKYTVTITVHTGDQHQVGNDTQGVTVEITPQASTVEAVLPEYGTLxxxxxxxxxxxxxxxxxxx
xxxxxxxxxxxxxxFFDLPLPWASGATTETPTWNKKELLVTFxxxxxxxxxxxxxxxxxxxxxxxxLTGA
TEIQTSGGTNIFAGHLKxxxxxxxxxxxKGMSYAMCLNAFVLKKEVxxxxHGTILIKVEYKGEDVPCKV
PFSTEDGQGKAHSGRLITANPIVTKKDEPINIEAEPPFGESNIIIGIGDKSLKINWYRKGxxxxxxxxx
xxxxxxxxxxxxxxxxxxxxxxxxxxxxxxxxxxxxxGSAYTALFSGVSWIMKIGIGILLTWIGLxxx
xTSMSFSCIVIGVITLYLGAVVQADTGCAVNWKGKELKCGNGIFVTNExxxxxxxxxxxxxxxxxxxx
xxxxxxxxxxxxxxxxxxxxxMENLLWKQVANELNYILWENNIKLTVVVGDTIGILEQGKRALTQPMELK
YSWKTWGKARIVTAEIQNSSFIIDGPNTPECPNVSRAWNVWxxxxxxxxxxxNIWLKLREMYTQSCD
HRLMSAAIKDERAVHxxxxxxxxxxxxxSWKLEKASFIEVKTCTxxxxxxxxxxxxxxxxxxxxxxxA
GPISQHNHRPGYYTQTAGPWxxxxxxxxxxxxCEGTTVVITESCGTRGSSLRTTxxxxxxxxxxxxxxx
xxxxxxxxxxxxxxxxWYGMEIRPINEKEENMVKSLVSAGSGEMDNFTMGILCLAILFEEVLRGKFGKKHM
IVGxxFMFVLLLSGQITWRDMARTFIMIGSNASDKMGMGVTHLALIATFKIQPLLALGFFLxxxxxxx
xxxLGVGLAMAATLRLPEDIEQxxNGIALGLMTLKLTTQFETYQLWTALVSLTCSNTMFTLTVAWRTA
TLILAGVSLLPLCQSSSMRKTDWLPMAVAAMGVPSLPLFIFNLKDTPKRKSWPLNEGxxxxxLVSILA
SSFLRNDVPMxxxxxxxxxxxxxxxxxITGTSADLIVEKAADITWEEEAExTGVSHNLMVTVDDDGTMKI
KDDETExxxxxxxxxTALLIVSGVFPYSIPAxxLVWHTWQKQTRRSGVLWDxxxxxxxxxxxxxxEGVYR
IKQQGILGKTQVGVGIQKEGVFHxxxxVTRGAVLTHNGKRLEPNWANVKKDLISYGGGWRLNTQWKKG
EEVQVxxxxxxKNPKNFQTMPGIFQTTMGEIGAIAxxxxxxxxxxxPIINREGKIVGLYGNGVVTKSGG
YVxxxxxTNAEPDGPAPELEEEMFRKRNLTIMxxxxxxxxxTRKYLPAIIREAIKRRxxxxxxxxxxxx
xxxxxxxxxxxxPIRYQTTATKSEHTGKEIVDLMCxxxxxxxxxxxxVRVPNYNLVVMDEAHFTxxxxxx
xxxxxSTRVGMGETAAIFMTATPPGTAEAFPQSNAPIQDEEKDIPERSWNSGNEWITDFVGKTVWFVx
xxxxxxxxxxxxxxxxxxxxxxxxxxxxxFDTEYQKTRLNDWDFVxxxxxxSEMGANFRADRVIDPxxxxxx
xxxxxxxxxxxLAGPMPVTVASAAQRRGRVGRNPPKENDQYIFMGQPLNNDxxxxxxxxxxxxxxxxx
xxxxxxxxxxxxxxxxxxxxxxxxxxxxxxxxxGDLPVWLAYKVASEGIxxxDRKWCFDGE
RNNQILExxxxxxEIWTKEGERKKLRPRWxxxxxxxxxPLALKEFKEFAAGRKSIAFDLVTEIGRVPTHL
AYRTRNALDxxxxLHTSEHGGKAYRHAVExxxxxxxxxxxxxLMILLTGGVMLFLISGKGVGKTSIGL
ICVIVSSGMLWMADVPLQWIASAIILEFFMMVxxxxxxxxxxxxxxxxxxxxIGILTLAAIVTANEM
GMLETTKRDLGMSKEPGVASSNSYLDVDLxxxxxxxxxxxxxxxxxxxxxxxxxxxxxxxxxxxxxxx
xxxxxxxxxxxxxxxxxxxxxxxxxxxSQVNPLTLTAAVLLLVTHYAIIGxxxxxxxxxxxxxxxxxx
xxxxxxxxxxxxxxxxxxxxxxxxxxxxxxQVMLLVLCAAQLLLMRTSWAFCEVLTLATGPxxxxxxx
xxxxxxxxxxxxxxxxxxxxxFRGSYIAGAGLAFSIMKSVGTGRRGTGSQGETLGEKWKKKLNQLSRKDFDL
YKKSGITEVDRIEAKEGLKRGETTHHAVSRGTAKLQWFVERNMVVPEGRVIDxxxxxxxxxxxxxxxx
xxxxxxxxxxxxxxxxxxxPMSTYGWNLVKLMTGKDVFYxxxxxxxxxxxxxxxxxxxxSPSPTVEEGRTIR
VLKMVEPWLRNNQFCIKVLNPYMPAVVEHLERLQRKYGGMLVRNxxxxxxxxxxxxxxxSNGTGNIVSSV
NMVSRxLLNRFTMTYRKPTIERDVDLGAGxRHVNAEPEIPNMDVIGERIRRIKEEHSSTWHYDEExxx
xxxxxxxxxxxxxxxxxxxxxxxxxxxxxxxxxxxTKPWDVVPTVIQMAMTDTxxxxxxxxxxxEKVDTRTPRPMP
GTRRVMGITAGWLWRTLGRNKRPRLCTREEFIKKVRTNAxxxxxxxEENQWDSARAAVEDEEFWKLVD
KERELHKQGKCGSCVxxxxxxxxxxxxxxxxxxxxxxxxxxxxxxxWYMWLGARFLEFEALGxxxxxxxxxxxxxxx
xxxxxxxxxxxxxxxxxxxxxxxxxxxxxxxxxxxxxxxxxDLHNEEKIIQQMDPEHRQLASAIFKLT

FIG. 54-3

```
YxxxxVKVQRPTPKGTVMDIIxxxxxxxxxxxxxxxxxxxFTNMEAQLVRQMEGEGVLTKxxxxxxxx
xEKKVTQWLETKGVERLRRMAISGDxxxxxxxDDRFANALFALNDMGKxxxxxxQWQPSKGWQDWQQV
PFxxxxxxxxxxxxxxxxxxxxx

FIG. 54-4

```
GTRRAMEITAGWLWxxxxxxxxxxxxxxxxTRKVRTNAxxxxxxxxxxxxxxAKAAVEDEEFWILVD
RERELHKQxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxDLHNEEKIMQQMDPEHRLLANAIFKxx
xxxxxxxxxxxxxxxxxxxxxxxxxxxxxxxxxxxxxxxxxFTNMEVQLIRQMEGEGVLSKxxxxxxxx
xEKKITQWLETEGVERLKRxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxGKAYAQMWTLMYFHRRxxxx
xxxxxCSAVPAHWVPTSRxxxxxxxxxxxxWMTTEDMLSVWNRVWIxxxxWMENKTPITTWENVPxxxxx
xxxxxxxxxxxxxxxATWAQNILIAIQQVRxxxxxxxxxxxxxxxxxKRFRKEEETEGAIW >DENV1|peptide_length:8|string4 xxxxxxxxxxxxxxxxxxxxxxxxxxxxxxxxxxxxxxxxxxxxxxxxxxxxxxxxxxxxxxxxxx
xxxxxxxxIKVLKSFKKEISxxxxxxxNRRKRTSLCLMMVLPAALAFxxxxxxxxxxxxxxxxxxxx
xxxxxxxxxxxxxxxxxxxxxxxxxxxDTITYKCPHIAxxxxxxxxxxxxxxxxxxxxxxxxxxxxx
xxxxxxxxxxxxxxxxxxxxxxxxxxxxxxxxxxxxxxxxxxAHYVGTSLIQKVVIFTLLM
xxxxxxxxxxxxxxxxxxxxxxxxxxxxxxxxxxxxxxxxxxxxxxxxxxxxxxxxxxxxxxxxxx
xxxxxxxxxxxRCPTQGEAALPEEQDQxxxxxxxxxxxxxxxxxxxxxxxxxxxxxxAKFQCLEPVEGxx
xxxxxxxxxxxxxxxxxxxxxxxxxxxxxxxEITPQASTAEAILPEYxxxxxxxxxxxxxxxxxxxxx
xxxxxxxxxxxxxxxxxPLPWTSGVTTETPIWNRxxxxxxxxxxxxxxxxxxxxxxxxxxxxxxxxx
xxIQNSGGTTIFxxxxxxxxxxxxxxxxxMSYAMCLNTFVLRKExxxxxxxxxxLVKVEYKGKDAPCKI
PxxxEDGQGKVHNGxxxxANPVVIKKEEPVNxxxxxxxGESNIIIGTGDKALKINWYxxxxxxxxxxx
xxxxxxxxxxxxxxxxxxxxxxxxxxxxxxxxxxxxxxxxALFGGVSWMMKIGIGVxxxxxxxxxxx
xxxxxFSCITIGIITLYLGVVVQADMGCVVNWKxxxxxxxxxxxxxxxxxxxxxxxxxxxxxxxxxx
xxxxxxxxxxxxxxxxxxxxxxxxxxxxxxxxxxxxxxWENSIKLTIVVGDVIxxxxxxxKRILTPQPMExx
xxWKTWGKAKVVTAEIQNFSFIxxxPNTPECPNTSRAWNVxxxxxxxxxxxxxxxxxIWLKLREMYSQLCD
HRLxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxGTTVVITEDCGTRGPALRTxxxxxxxxxxxxx
xxxxxxxxxxxxxxYGMEIRPVSEKEENMxxxLASAGSGKMDNFTMGVxxxxxxxxxxxxxxxGKKHM
IAGxxFIFVLLLSxxxxxxxxxAHTLIMIGSNTSDRxxxxxxxxxxxxxxxxxxxxxxxxxxxxxxx
xxxxxxxxxxxxxxxxxxxxxxxxxxxxxxxxxxxxxxxxTYQLWTALASLTCSNTILTxxxxxxxxx
xLILAGVSLLPMCQxxxxRKTDWLPMTVAAMGVSPLPLFIFGLKDALKRRSWPxxxxxxxxxxxxxxx
xxxxxxxxxxxxxxxxxxxxxxxxxxxxxxxDLTVEKAANVTWEEEAxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxYGGGWRLSAQWKKG
ExxxxxxxxxxxxxxKNFQTTPGIFQTxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxIRYQTTVTKSEHTGxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxGNEWITDFTGxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxSHL
AYRTRxxxxxxxxxxxxxxxxxxxxxxxxxxxxxxxxxxxxxxxxxxxxxxxxLFLISGRGIGKATIGL
ICVTVSSGMLWMADIPLQWIAxxxxxxxxxxxxxxxxxxxxxxxxxxxxxILTLAATIAANEM
GxxxxxxxxxxxSREPGVVSPNSYLDxxxxxxxxxxxxxxxxxxxxxxxxxxxxxxxxxxxxxxxx
xxxxxxxxxxxxxxxxxxxxxxxxxxxxxxxxxxxLIAAVLLLVxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxKKKLNQLSWKEFDL
YxxxxxxxxxxxTEAKEGLKRRETTHHAVxxxxxxxxxxxxxxxxxxxxxxxxxxxxxxxxxxxxxx
xxxxxxxxxxxxxxxxxxxxxxxxxxxxxxGWNIIKLMSGKxxxxxxxxxxxxxxxxxxxxxxxxxx
```

FIG. 54-5

```
xxxxxxxxxxxxxxxxxKVLNPYMPNVIEHLERxxxxxxxxxxxxxxxxxxxxxxxxxxxxxxxxx
xxxxxxxxxxxxxTHRRPTIERxxxxxxxxxxxxxxxxxxxxxxGERIERIKDEHSSTWHYDExxxx
xxxxxxxxxxxxxxxxxxxxxxxxxxxxxxxxxxxxxxxxxxxxxxxxxxxxxxxxxxDTRTPRPMA
GTRKAMEITAEWxxxxxxxxxxxxxxxxxxxxxxxxxxxxxxxxxxxxxxxxxxAVEDEDFWILVD
Rxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxKITQQMDPEHKRLANAIFKxxx
xxxxxxxxxxxxxxxxxxxxxxxxxxxxxxxxxxxxxxxxxxxxxxxxxxxEGEGVLSKxxxxxxxx
xEKKIAQWLENKGVERLKxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxRMTTEDMLxxxxxxxxxxxxxxxxKTPITTWEDVPxxxxx
xxxxxxxxxxxxxxxxxxxxxxxxxxxxxxxxxxxxxxxxxxxxxxxxxxx >DENV1|peptide_length:8|string5 xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxNRRKRTSLxxxMMFPATLAFxxxxxxxxxxxxxxxxx
xxxxxxxxxxxxxxxxxxxxxxxxxxxxxxxTYKCPFIAxxxxxxxxxxxxxxxxxxxxxxxxxxxx
xxxxxxxxxxxxxxxxxxxxxxxxxxxxxxxxxxxxxxxxxxxxxxxxxxxxLTQKVVIFTxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxTSQASITEVILPEYxxxxxxxxxxxxxxxx
xxxxxxxxxxxxxxxxxxxLPWTSGTTTKTPTWNRxxxxxxxxxxxxxxxxxxxxxxxxxxxxxxx
xxxxxxxxxxxxxxxxxxxxxxxxxxMSYAMCLGSFVxxxxxxxxxxxxxxxxxxKGKDAPCKx
xxxxxxxxxxxxxxxxxxxxxVVIKKEEPxxxxxxxxxxxxSNIVIGVGxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxLTVVVGDVIxxxxxxxxxxxxxxx
xxWKTWGKAKMVTAxxxxxxxxxxxxPSTPECPSAARAWNVxxxxxxxxxxxxxxxxWLKLREAYTxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxGTTVVISENCGMRGPSLRTxxxxxxxxxxxxxxxx
xxxxxxxxxxxxxxxxxxxxxxxxTSEKEENMxxxLVSAGSGKVDNFTMGAxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxLWAALVSLMxxxxxxxxxxxxxxx
xxxxxxISLLPLCQxxxxxxxxxxxxxxVAAMGVQPLPLFIxxLKDAPKRRSWPxxxxxxxxxxxxxx
xxxxxxxxxxxxxxxxxxxxxxxxxxxxxxxxDLTVEKAPDVTWEEExxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxGWRLSAQWKKx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxSHL
AHRTKxxxxxxxxxxxxxxxxxxxxxxxxxxxxxxxxxxxxxxxxxxxxxxxxxxxxxxxxxxxxx
xxxIASSGMLWIAEIPxxxxxxxxxxxxxxxxxxxxxxxxxxxxxxxxxxxxxxIIAANEM
GxxxxxxxxxxxxxEPGVVPPTSYLxxxxxxxxxxxxxxxxxxxxxxxxxxxxxxxxxxxxxxxxx
xxxxxxxxxxxxxxxxxxxxxxxxxxxxxxLAAAVLLLVxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
```

FIG. 54-6

```
xxxxxxxxxxxxxxxxxxxxxxxxxxxxxxxxxxxxxxxxxxxxxxxxxKKLNQLSWKxxxx
xxxxxxxxxxxxxxxxxxxRGEITRHAxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxERIKRIKEEHRSxxxxxxxxx
xxxxxxxxxxxxxxxxxxxxxxxxxxxxxxxxxxxxxxxxxxxxxxxxxxxxxxxxxxxxxx
GTRKVMGIxxxxxxxxxxxxxxxxxxxxxxxxxxxxxxxxxxxxxxxxxxxxxxxENFWKLVD
Rxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxTHQMDPEHRRLANAIFxxx
xxxxxxxxxxxxxxxxxxxxxxxxxxxxxxxxxxxxxxxxxxxxxEGEGVLSExxxxxxxxx
xEKRIIQWLETKGxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxx >DENV1|peptide_length:9|string1

MNNQRKKTARPSFNMLKRARNRVSTVSQLAKRFSKGLLSGQGPMKLVMAFIAFLRFLAIPPTAGILAR
WGSFKKNGAIKVLRGFKKEISNMLNIMNRRKRSVTMLLMLxPTALAFHLTTRGGEPHMIVSKQERGKS
LLFKTSAGVNMCTLIAMDLGELCEDTMTYKCPRITEAEPDDVDCWCNATDTWVTYGTCSQTGEHRRDK
RSVALAPHVGLGLETRTETWMSSEGAWKQIQRVETWALRHPGFTVIALFLAHAIGTSITQKGIIFILL
MLVTPSMAMRCVGIGSRDFVEGLSGATWVDVVLEHGSCVTTMAKDKPTLDIELLKTEVTNPAVLRKLC
IEAKISNTTTDSRCPTQGEATLVEEQDANFVCRRTFVDRGWGNGCGLFGKGSLITCAKFKCVTKLEGK
IVQYENLKYSVIVTVHTGDQHQVGNESTEHGTTATITPQAPTTEIQLTDYGALTLDCSPRTGLDFNEM
VLLTMKEKSWLVHKQWFLDLPLPWTSGASTSQETWNRQDLLVTFKTAHAKKQEVVVLGSQEGAMHTAL
TGATEIQTSGTTTIFAGHLKCRLKMDKLTLKGMSYVMCTGSFKLEKEVAETQHGTVLVQIKYEGTDAP
CKIPFSTQDEKGVTQNGRLITANPIVTDKEKPVNIEAEPPFGESYIVIGAGEKALKLSWFKKGSSIGK
MFEATARGARRMAILGDTAWDFGSIGGVFTSVGKLVHQIFGTAYGVLFSGVSWTMKIGIGVLLTWLGL
NSRSTSLSMTCIAVGLVTLYLGVMVQADSGCVINWKGRELKCGSGIFVTNEVHTWTEQYKFQADSPKR
LSAAIGKAWEEGVCGIRSATRLENIMWKQISNELNHILLENDMKFTVVVGDVxxxxxQGKKMIRPQPM
EYKYSWKSWGKAKIIGADVQNTTFIIDGPNTPECPDDQRAWNIWEVEDYGFGIFTTNIWLKLRDSYTQ
VCDHRLMSAAIKDSKAVHADMGYWIESEKNETWKLARASFIEVKTCIWPKSHTLWSNGVLESEMIIPK
IYGGPISQHNYRPGYFTQTAGPWHLGKLELDFDLCEGTTVVVDEHCGNRGPSLRTTTVTGKIIHEWCC
RSCTLPPLRFRGEDGCWYGMEIRPVKEKEENLVKSMVSAGSGEVDSFSLGLLCISIMIEEVMRSRWSR
KMLMTGTLAVFFLLxxGQLTWNDLIRLCIMVGANASDRMGMGTTYLALMATFKMRPMFAVGLLFRRLT
SREVLLLTIGLSLVASVELPNSLEELGDGLAMGIMILKLLTDFQSHQLWxxLLSLTFIKTxxxxHYAW
KTMAMVLSIVSLFPLCLSTTSQKTTWLPVLLGSLGCKPLTMFLIAENKIWGRKSWPLNEGIMAVGIVS
ILLSSLLKNDVPLAGPLIAGGMLIACYVISGSSADLSLEKAAEVSWEEEAEHSGASHNILVEVQDDGT
MKIKDEERDDTLTILLKATLLAVSGVYPLSIPATLFVWYFWQxKKKQRSGVLWDTPSPPEVERAVLDD
GIYRIMQRGLLGRSQVGVGVFQENVFHTMWHVTRGAVLMYQGKRLEPSWASVKKDLISYGGGWRLQGS
WNTGEEVQVIAVEPGKNPKNVQTAPGTFKTPEGEVGAIALDFKPGTSGSPIVNREGKIVGLYGNGVVT
TSGTYVSAIAQAKASQEGPLPEIEDEVFRKRNLTIMDLHPGSGKTRRYLPAIVREAIKRKLRTLILAP
TRVVASEMAEALKGMPIRYQTTAVKSEHTGKEIVDLMCHATFTMRLLSPVRVPNYNMIIMDEAHFTDP
SSIAARGYISTRVGMGEAAAIFMTATPPGSVEAFPQSNAVIQDEERDIPERSWNSGYEWITDFPGKTV
WFVPSIKSGNDIANCLRKNGKRVIQLSRKTFDTEYQKTKNNDWDYVVTTDISEMGANFRADRVIDPRR
CLKPVILKDGPERVILAGPMPVTVASAAQRRGRIGRNHNKEGDQYIYMGQPLNNDEDHAHWTEAKMLL
DNINTPEGIIPALFEPEREKSAAIDGEYRLRGEARKTFVELMRRGDLPVWLSYKVASEGFQYSDRRWC
FDGERNNQVLEENMDVEIWTKEGxERKKLRPRWLDARTYSDPLALREFKEFAAGRRSVSGDLILEIGK
LPQHLTQRAQNALDNLVMLHNSEQGGRAYRHAMEELPDTIETLMLLALIAVLTGGVTLFFLSGRGLGK
TSIGLLCVMASSVLLWMASVEPHWIAASIILEFFLMVLLIPEPDRQRTPQDNQLAYVVIGLLFMILTV
```

FIG. 54-7

AANEMGLLETTKKDLGIGHVAxxxxxHAAMLDVDLHPASAWTLYAVATTIITPMMRHTIENTTANISL
TAIANQAAILMGLDKGWPISKMDIGVPLLALGCYSQVNPLTLTAAVLMLVAHYAIIGPGLQAKATREA
QKRTAAGIMKNPTVDGIVAIDLDPVVYDAKFEKQLGQIMLLILCTSQILLMRTTWALCESITLATGPL
TTLWEGSPGKFWNTTIAVSMANIFRGSYLAGAGLAFSLMKSLGGGRRGTGAQGETLGEKWKRQLNQLS
KSEFNTYKRSGIMEVDRSEAKEGLKRGETTKHAVSRGTAKLRWFVERNLVKPEGKVIDLGCGRGGWSY
YCAGLKKVTEVKGYTKGGPGHEEPIPMATYGWNLVKLHSGKDVFFIPPEKCDTLLCDIGESSPNPTIE
EGRTLRVLKMVEPWLRGNxQFCIKILNPYMPSVVETLEQMQRKHGGMLVRNPLSRNSTHEMYWVSCGT
GNIVSAVNMTSRMLLNRFTMAHRKPTYERDVDLGAGTRHVAVEPEVANLDIIGQRIENIKHEHKSTWH
YDEDNPYKTWAYHGSYEVKPSGSASSMVNGVVKLLTKPWDVIPMVTQIAMTDTTPFGQQRVFKEKVDT
RTPKAKRGTAQIMEVTAKWLWGFLSRNKKPRICTREEFTRKVRSNAAIGAVFVDENQWNSAKEAVEDE
RFWDLVHRERELHKQGKCATCVYNMMGKREKKLGEFGKAKGSRAIWYMWLGARFLEFEALGFMNEDHW
FSRENSLSGVEGEGLHKLGYILRDISKIPGGNMYADDTAGWDTRITEDDLQNEAKITDIMEPEHALLA
KSIFKLTYQNKVVRVQRPAKNGTVMDVISRRDQRGSGQVGTYGLNTFTNMEAQLIRQMESEGIFSPxx
xxxxxxxxxxxxxxxxxxERLKRMAISGDDCVVKPIDDRFATALTALNDMGKVRKDIPQWEPSKGWN
DWQQVPFCSHHFHQLIMKDGREIVVPCRNQDELVGRARVSQGAGWSLRETACLGKSYAQMWQLMYFHR
RDLRLAANAICSAVPVDWVPTSRTTWSIHAHHQWMTTEDMLSVWNRVWIEENPWMEDKTHISSWGDVP
YLGKREDQWCGSLIGLTARATWATNIQVAINQVRRLIGNENYLDYMTSMKRFKNESxxxxxxxxxxxx
xxxxx >DENV1|peptide_length:9|string2

MNNQRKKTGQPSFNMLKRARNRVSTGSQLAKRFSxxxLSGQGPMKMVMAFIAFLxxxxxxxTAGILAR
WGSFKKSGAIKVLRGFKKEISSMLNTMNRRKKSVTMLLMLxPTVLTFHLTTRGGEPHMIVTKQERGKS
LLFKTSVGINMCTLIAMDLGEFCDDTMTYKCPRITETEPDDVDCWCNATETWVTYGTCSQTGEHRREK
RSVALAPxVGLGLETRAETWMSSEGAWKQIQKVETWVLRHPGFTVIAFFLAHVIGTSITQKxIIFILL
MLATPSMAMRCVGIGNRDFVEGLSxxxxxxxxxxxxSCVTTMAKNKPTLDIELLKTEVTNPAILRKLC
IEAxxxxxxxxxxxxPTQGEATLMEEQDTNFVCRRTLVDRGWGNGxGLFGKGSLLTCAKFKCVTKLEGK
TVQHENLKYSVIxxxxxxDQHQVGNETTEHGTIATITPQAPTSEIQLTDYGTLTLDCSPRxxxxxNEM
VLLTMKKKAWLVHKQWxxxxPLPWTSGATTSQETWNRKDLLVTFKTxxxxxxxxxxxxxxxxxxxxxx
xxATEIQTTGTTTIFAGxxxxxLKMDKLTLKGTSYVMCTGSFKLEKELAETQHGTVLVQVRYEGTDAP
CKIPFLTQDEKGVIQNGRLVTANPIVTDKEKPVNIETEPPFGESYIVVGVGEKALKLSWFKRGSTIGK
MFVATARGxxxxxxxxDTAWDFGSVGGVFTSVGKLVHQVFGAAYGVLFSGVSWTMKIGIGILLTWLGL
NSRSTSFSMTCIAVGMITLYLGAMVQADSGCVVNWKGRELxxxxxxxxxxxxxxxxxxxxxxxxxxKR
LSAAIGRAWEEGVCGIRSTTRLENIMWRQISNELNHILLENDMKFTVVVGDAxxxxxQGKKMIRPQPM
EHRYSWRIWGKAKIIGADIQNSTFIIDGPDTPECPDNQRAWNIWEVEDYGFGVFTTNIWLKLRDSYTQ
MCDHRLMSAxxxxxxxxxxxMGYWIESERNETWKLAKASFIEVKTCTWPKSHTLWxNGVLESEMIIPK
IHGGPTSQHNYRPGYFTQAAGPWHLGKLELDFNFCEGTTVVVDEHCGSRGPSLRTTTVTGKTIHEWCC
RSCTLPPLRFKGEDGCWYGMEIRPVKEKEENLVRSMVSAGLGEVDSFSLGILCVSILTEEVMRSRWSR
RMLMTGTLAVFLLLxxGQLTWNDLIRSCIMVGANASDKMGMGMTYLALMATFRMRPMLAVGLLIRRLT
SREVLLLTVGLSLVASVELPSSLEELGDGLAMGIMMLKLLTEFQPHQLWxxLLSLTFVKTxxxxDYAW
KTTAMALSIVSLLPLCMSTTSQKxxWLPVLLGSFGCKPLTMFLITENKIWGRRSWPLNEGIMAIGVVS
ILLSALLKNDVPLxxxxxxxxxxxxxxxxxxxSSADLSLEKAAEVSWEQEAEHSGTSHNILVEIQDDGT
MKIKDEERDDTITILLKATLLAVSGVYPMSIPATLFVWHFWQxxxxxxxxxxLWDTPSPPEVGKAVLDD
GIYRILQRGLLGRSQVGVGVFQDGVFHTMWHVxxxxxxxxxxxxxxxxxxxxxxxxxxISYGGGWRFRGS
WNAGEEVQVIAxxxxKNPKNVQTTPGTFKTSEGEVGAIAxxxxxxxxxxxxIVNRERKIVGLxxxxxxxx
xxxxYVSAIAQAKTSQEGPLPEIEDEVFKKRNLTIMDxxxxxxKTRRYLPAIVREAIKRRLRTLVLAP
TRVVAxEMAEALKGVPIRYQTTAVKSEHTGREIVDLMCHxxxxxxxxxxxxxxxxxxxxxxDEAHFTDP
ASIAARGYIxxxxxxxxxxxxxxMTATPPGSMEAFPQSNAVIQDEEKDIPERSWNSGYDWITDFPGKxV
WFVPSIKAGNDIANCLRKNGKRVVQLSRKTFDTEYQKTRNNDWDYVVxxxxxxxxxxxxxxxxxxxxx
xxxxxxxxxxxxxxxxxxxxxxxxxxxxxxxxRRGRIGRNQNKEGDQYVYMGQPLKNDEDHAHxxxxxxx

FIG. 54-8

```
xxxxxxxxxxxxxxxxPEREKSAAVDGEYRLRGxxxxxxxxxxxxxGDLPVWLSHKVASEGFQxxxxxxxx
xxxxxxxxxxxxxxxxxxxxxxxxxxxxxxxxxxxxxxxxxxxxxxxxxxxFAAGRRSVSGDLISEIGK
LPQHLTLKAQNALDNLxxLHNSEQGGKAYRHALEELPDTIETIMLLALIAVLTGGVTLFFLSGKGLGK
TSIGLLCVTASSALLWMANVEPHWIAAxxxxxxxxxxxxxxxxxxxxxxxxxxxxxYVVIGLLFIILTV
AANExxxxxxTKKDLGIGYVAxxxxxHATMLDVDLRPASAWTLYAVATTVITPMMRHTxxxxxxxxxx
xxxxxxxxxxxxxxxxGWPISKMDLGVPxxxxxxxSQVNPLTLIAAVLMLLAHYAIxxxxxxxxxxxx
xxxxxAGIMKNPTIDGIVTIDLDPVVYDTKFEKQLGQVMLLILCTSxxxxxxxxxxxxxxxxxxxxxx
xxxxxxxxxxxxxxxxxxxxxxxxxxxxxxxxxxxxxxxxxxxxxxxxxxxxxxxxxxxxxxxxQLS
KSEFNIYKRSGIIEVDRSEAKEGLKRGETTRHAVSRGTAxxxxxxxxxxxxxxxxxxxxxxxxxxxx
xxxxxxxxxxVKGYTKGGPGHEEPVPMATYGWNLVKLYSGKDVFFTPPEKCDTLxxxxxxxxxxxxx
xxxxxxxLKMVEPWLKGNxxxxxxxxxPYMPSVVEALEQMQRKYGGMLVRNxxxxxxxxxxxxxxxx
xxxxxxxxxxxMLLNRFTMAHRKPTYERDVDLGTGTRHVAVEPEIANIDIIGQRIENIKNEHKSTWH
YxxxxxxxxxxxxxxxxxxxxxxxxxSSMVNGVVRLLTKPWDVxxxxxxxxxxxxxxxxxxxxxEKVDT
RTPRAKRGTTQIMEVTARWLWSFLSRNKKPxxxxxxxxxxxxxNAAIGAVFIDENQWNSAKEAVEDD
RFWDLVQKERELHKQGxxxxxxxxxxxxxxxxxxxxxxxxxxxxxxxxxxxxxxxxxxxxxxxxxHW
FSRENSFSGVEGEGLHRLGYILRDISNISGGSMYADDTAGxxTRVTEDDLQNEARITEIMEPEHALLA
TAIFKLTYQNKVVRVQRPAKSGTVMDVISxxxxxxxxxxxxGLNTFTNMEVQLIRQMESEGIFLPxx
xxxxxxxxxxxxxxxxxxERLRRMAISGDDCVVKPTDDRFATALIALNDMGKVRKDVPQWEPSKGxx
xxxxxxxxxxxxxxxxxxxxxxxxxxxxxxxxxxxxxxxxxxGWSLKETACLGxxxxxxxxxxxxxx
xxxxxAANAICSAVPVDWIPTSRTTWSxxxxxxxxxxxxxxxxxxxxxxxNPWMEDKTHVSSWEEVP
YLGKRExxxxxxxxxxLTARATWASNIQVAINQVRRLLGNENYSDYMISMKRFKNEGxxxxxxxxxxxx
xxxxx >DENV1|peptide_length:9|string3

MNNQRKKTGQPSFNMLKxxxxxxxxxxxxxxxxxxxLSGQGPMKFVMAFIAFLxxxxxxxxxxxxAR
WSSFKKNGAIRVLRGFKKEVSNMLNIINRRKRSVTMFLMLxPTVLAFHLTTRGGEPHMVVGKQERGKS
LLFKTSAGINMCTLIAMDLGELCEDTMTYKCPQITEVEPDDVDCWCNTTDTWVTYGTCTQIGEHRRDK
RxxxxxxxxxxxxxxxxxxxxxxxxEGAWRQIQRVETWVLRHPGFTVTALFLAHVIGTxxxxxxxxxx
xxxxxxxxxxxxxxxxxxxxxxxxxxxxxxxxxxxxxxxxxxxxxxxxxELLKTEVTDPAVLRKLC
xxxxxxxxxxxxxxxxxxxxATLVEEQDSNFVCRRTFxxxxxxxxxxxxGKGSLMTCAKFKCVTKLEGK
IAQYENLKYSxxxxxxxxxxHQVGNETTDHGTTATITPQAPSTEIQLTDYGVLTLDxxxxxxxxxxEM
VLLTMKEKAWLVHKQxxxxxPLPWTSGALTLQETWNRQDxxxxxxxxxxxxxxxxxxxxxxxxxxxx
xxxxxxxMSGTTTIFAxxxxxxxxxMDKLTLRGISYVMCTGLFKLEKEVAxxxHGTVLVQIRYEGTDAP
CKIPFSSQDEKGATQNGRVITANPIVTDKDKPVNIEAEPPFGESYIIIGAGEKTLKLSWFKKGSSIGK
MFVATxxxxxxxxxxxxxxxWDFGSIGGLFTSIGKLIHQVFGAAYGVLxxxxxWTMKIGLGVLLTWLGL
NSRSASLSMTCIAVGLITLYLGVMxxxxxxxxxxxxxxxxxxxxxxxxxxxxxxxxxxxxxxxxxxx
xxxxxxxxxEGVCGIRSVTRLENIMWKQISNELNYILLENGIKLTVVVGDVxxxxxQGKKTIRPQPM
EHKYSWKSWGKAKIIGADAQNATFIIDGPNTPECPDGQRAWNIWExxxxxxxxIFTTNIWLKMRDSHTQ
ACDHRLMSAxxxxxxxxxxxxxxxxxEKNETWKLAGASFIEVKTCVWPKSHTLWxxxxxxESEMVIPK
IYGGPISQHNHRPGYFTQTxxxxxxGKLELDFDFCEGTTVVVDEHCGYRGPSLRTTxxxxxxxxxxxx
xxxxxxxxxxxxxxxxxxxxxxxKDKEENLVKSMVSAGSGEVDNFSLGILCASIIIEEVMRSRWSK
KMLMTGTLVVFLLLxxGQLTWSDLTRLCIMVGANAFDNMGMGTTHLALMATFKIRPMFAVGLLFRKLT
SREVxxxTIGLSLVASVELPNSLDELGDGLAIGIMMLKLLTDFQSYQLWxxLLSLTFIRTxxxxDYAW
KTMAMILSIASLIPLCLSTTSxxxxxxxxxxGSLGCKPLPMFLITETEIWGRKSWPINEGIMAVGIVS
ILLSALxxxxxxxxxxxxxxxxxxxxxxxSADLSLEKAAVVSWEEEAEHSGASHNILVVVQDDGT
MKxKDEEKDDTLTILLxATLLAISGVYPLSIPATLFLWYFWQxxxxxxxxxxxxDTPSPPEVEKAVLDD
GIxxxxxxxxxxxxxxVGVGVFQEGVFHTMWHxxxxxxxxxxxxxxxxxxxxxxSYGGGWRLQGL
WNTGEEVQxxxxxxxxKNPKNVQTAPGTFKTSExxxxxxxxxxxxxxxxxxxxxxxxxxxxxxxxxx
xxxxxVSAIAQARASQEGPLPEIEEEVFKKRNLxxxxxxxxxxxxxxxxxxxPAMVREAIKRKLRTLVLAP
```

FIG. 54-9

```
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxNAIIQDEERDIxERSWNSGHEWITDFPGxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxRRGRIGRNQNKEGDQYIYMGQPLKNxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxRSISGDLILEIxK
LPQHLTQKAQNALDNxxxxxxxxxGGRAYRHALEExxxxxxxxxxxxxxxxxVMLFFLSGKGxxx
TSIGLLCVTSSSALLWMANVExxxxxxxxxxxxxxxxxxxxxxxxxxxxxxxYVVIGLLFVILTV
AANExxxxxxxKKDLGIGHAAxxxxxHVTMLDVDLRPxxxxxxxxxxxxxxxxxxxxxxxxxxxx
xxxxxxxxxxxxxxxxxxxxxxxxxxxxxxxxxxxxxPLTLTATVLMLVAHYxxxxxxxxxxxxx
xxxxxxxxxxNPTVDGIVTIDLxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxS
KSEFNTYKKSGIVEVDRSEAKEGLRRGEIIKHAVSRGTxxxxxxxxxxxxxxxxxxxxxxxxxxx
xxxxxxxxxxxxxxxxKGGAGHEEPIPMxxYGWNLVRLHSGKDVFFMPPEKCDTLxxxxxxxxxxx
xxxxxxxxxxxxxxxxxxxxxxxxxxxxxxPSVVETLEQMQRRHGGMxxxxxxxxxxxxxxxxxxx
xxxxxxxxxxxxxxxxxxxxTMTHRKPTYEKDVDLGAGTRHVAVEPEEANLDIIGQxxxxxxxxxx
xxxxxxxxxxxxxxxxxxxxxxxxxxxxxxxxxxxxxxxxxxxxxxxxxxxxxxxxxxxxxxxxDT
RTPRAKRGTVQIMEMTARWLWSFLSRxxxxxxxxxxxxxxxxxxxxxxxxxxxxxxxxxAVEDE
RFWELVRRERELHKQxxxxxxxxxxxxxxxxxxxxxxxxxxxxxxxxxxxxxxxxxxxxxxxxxx
xxxxxxxxxxxxxxxxxxxGYILRDISRIPGGSMYADDxxxxxxxxxxxxxLQNEAKITDIMEPEHALLA
KAIFKLTYQxxVVRVQRPARNGTVMDVIxxxxxxxxxxxxxLNTFTNMGAQLIRQMESEGIFFPxx
xxxxxxxxxxxxxxxxxxxxxxxxxxxxGDDCVVKPVDDRFATALSALNDMGKVxxxxxxxxxxxx
xxxxxxxxxxxxxxxxxxxxxxxxxxxxxxxxxxxxxxxxxxxxxxxxxxxxxxxxxxxxxxxxxx
xxxxxxxNAICSADPVEWVPTSRTTxxxxxxxxxxxxxxxxxxxxxxxxxPWMEDKTHISSWEEVP
YLGKRxxxxxxxxxxxxxxxxxxxATNVQVAINxxxRLIGNENYLDFMTSMKRFKNEIxxxxxxxxxxxxx
xxxxx >DENV1|peptide_length:9|string4 xINQRKKTGRxxxxxxxxxxxxxxxxxxxxxxxxxxxxxxxxxxxxxxxxxxxxxxxxxxxxxxxx
xxxxxxxxxxxxxRGFKREISNMLSIMNRRKRSVTMILMLxPTALTFHLTTRGGEPHMIVGKQERGKx
LLFKTSTGVNMCTLIxxxLGELCEDTITYKCPRISEAEPDDVDxxxxxxxxxxxxxSRTGEHRRDK
xxxxxxxxxxxxxxxxxxxxxxxxxxxxxxxxxxxxxxHPGFTVMALFLAxxxxxxxxxxxxxxxx
xxxxxxxxxxxxxxxxxxxxxxxxxxxxxxxxxxxxxxxxxxxxxxxxxxxxxxVTSPAILRKLx
xxxxxxxxxxxxxxxxxxxxxxATLVEEQDANFVCRRTLxxxxxxxxxxxxxxxxxxxxxxVTKLEGK
IVQHENLKYxxxxxxxxxxxxxxxxxxxNESTEHGTIATxxxxxxxxxxxxxxxxxxxxxxxxxxxxxxxM
VLLTMEKKSWLVHKxxxxxxxxxxxxxxxxxTTQETWNRQxxxxxxxxxxxxxxxxxxxxxxxxxxx
xxxxxxxxxxxxxxxxxxxxxxxxxxxxMDKLTLKGVSYVMCTGPFKLEKEVxxxxxxxxxxxxxxxAP
CKIPFSAQDGKGVTQNGRVITAxxIVTDREKPVNIEAxxPFGESYIIIGAGEKTLKLSWFKKGSNIGK
MFEATxxxxxxxxxxxxxxxxxxxxxGGVFTSAGKLVHQVFGAAYxxxxxxxxxxxxxxxxxxxxxGL
NSRNTSLSVMCIVVGLVTLYLGAMxxxxxxxxxxxxxxxxxxxxxxxxxxxxxxxxxxxxxxxxxx
xxxxxxxxxxxxxxxxxxxxxxxxxxxxxxxxxxxxNHILLENDIKFTVVVGNAxxxxxQGRKMVRPQPM
EYKYSWKIWGKAKIIGADTQNxxxxxxGPDTPECPDEQRAWNIWExxxxxxxxxxxxxxxRDSYTQ
ACDHRLxxxxxxxxxxxxxxxxxxxxxxETWKLTRASxxxxxxxxxxxxxxxxxxxxxSEMIIPK
MYGGPISQHxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxFSLGLLCTSIMTEEVMRSRWSR
KMLMTGILAVFFLLxxxxLTWNDLTRLCIMVGANASDRMGMGMTYLxxxATFKIRPMFAVGLLLRRLT
xxxxxxxxIGLSLVAFVELPNSLExxxxxxxxxxxxxxxKLLTDFQPHQLWxxLLSLTFVRTxxxxDYAW
RTMAMVLSVVSLFPLCMSTTSxxxxxxxxxxxxLGCKPLTMFLITENEIWGRKSWxxxxxxxxxxxxx
xxxxxxxxxxxxxxxxxxxxxxxxxxxxxxxxxDLLLDKAAKVSWEQEAEHSGASHNILVEVQDDGP
```

FIG. 54-10

```
xxxxxxxxxxxxxxxxxxxxxxLAISGVYPLSIxxxxxxxxxxxxxxxxxxxxxxxxxxTPSPPKVERAVLDN
GIxxxxxxxxxxxxxxxxxxxxxxxxxxxxxxxxxxxxxxxxxxxxxxxxxxxxxxxxxxxxxxxxxxxxQGL
WNTGEExxxxxxxxxxxxxxxxxTMPGTFKTPExxxxxxxxxxxxxxxxxxxxxxxxxxxxxxxxxxxxxxxx
xxxxxxSAIAQTKASQEGPLPEIENEVFRKRNLxxxxxxxxxxxxxxxxxxxIVREAIKRRLRTLVLAP
xxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxHNKEGDQYVxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxKSVSGDLILxxxK
LPQHLTLKAQNALDNxxxxxxxxxxxxxxxxxxxxxxxxxxxxxxxxxxxxxxxxxxxxxxxxxxxxxxxx
xSIGLLCVITSSALLWIASVExxxxxxxxxxxxxxxxxxxxxxxxxxxxxxxxxxxxxxxxxxxxxxxxxxx
xxxxxxxxxxxxKDLGIGHAVxxxxxHATMLDIDLHPxxxxxxxxxxxxxxxxxxxxxxxxxxxxxxxxxx
xxxxxxxxxxxxxxxxxxxxxxxxxxxxxxxxxxxxxxxxxxxLTATVLMLVAxxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
xxxxNTYKKSGIMExxxxxxxxxGLKRGEITKHAxxxxxxxxxxxxxxxxxxxxxxxxxxxxxxxxxxxx
xxxxxxxxxxxxxxxxGGLGHEEPIPMxxxxxxxxVKLHSGKDVFFVPPEKCDTLxxxxxxxxxxxxxxx
xxxxxxxxxxxxxxxxxxxxxxxxxxxxxxxxxxxxETLEQMQRRHxxxxxxxxxxxxxxxxxxxxxxxx
xxxxxxxxxxxxxxxxxxxxxxxxAHRKPTFERDVDLGAxxRHVTVEPEVPNLDIIGQxxxxxxxxxxxxxx
xxxxxxxxxxxxxxxxxxxxxxxxxxxxxxxxxxxxxxxxxxxxxxxxxxxxxxxxxxxxxxxxxxxxxxxx
xTPKAKQGTAQIMEVTARWLWSFxxxxxxxxxxxxxxxxxxxxxxxxxxxxxxxxxxxxxxxxxAVEDE
RFWNLVKKERELHKQxxxxxxxxxxxxxxxxxxxxxxxxxxxxxxxxxxxxxxxxxxxxxxxxxxxxxxxx
xxxxxxxxxxxxxxxxxxxxxxxxxxxxxxDISKIPGGSMYAxxxxxxxxxxxxxxxRNEARITDIMEPEHALLA
RSIFKLTYQxxxVRVQRPTKNGTVMDVxxxxxxxxxxxxxxxxxxxxxxxxxxxxxxxQMESEEIFSPxx
xxxxxxxxxxxxxxxxxxxxxxxxxxxxxxxxxxxxxxxxKPIDDRFAAALTALNDMxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
xxxxxxxNANCSAVPIDWVPTSRTxxxxxxxxxxxxxxxxxxxxxxxxxxxxxxxxxxxDKTHVSSWGDVP
YxxxxxxxxxxxxxxxxxxxxxxxxxxxxxxxxxxxxxxxxxxIGNENYLDYMISMKRFKNDSxxxxxxxxxxxx
xxxxx >DENV1|peptide_length:9|string5 xxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxMLNVMNRRKRSATMLLMLxxTTLAFHLTTxxxxxxxxxxxxxxxxx
xxxxxxxxxxxxxxxxxxxxxxxxxxxxxxYKCPRISEAEPDDxxxxxxxxxxxxxxxxxxxxxxxxxxxxx
xxxxxxxxxxxxxxxxxxxxxxxxxxxxxxxxxxxxxHPGFTMIALFLAxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxKLEGK
TVQHExxxxxxxxxxxxxxxxxxxxxNETTDHGTTATxxxxxxxxxxxxxxxxxxxxxxxxxxxxxxxx
xxxxxxxxxxxxxxxxxxxxxxxxxxxxxASQETWNRKxxxxxxxxxxxxxxxxxxxxxxxxxxxxxxxx
xxxxxxxxxxxxxxxxxxxxxxxxxxxxxxMDKLTLKGVSYVMxxxxxxxxxxxxxxxxxxxxxxxxxxxx
xKIPFSTQDERGVTQNGRVITxxxxxxxxxxxxxxxxPFGESYITIGxxxxxxxxxxxxxxxxxxxxxxxx
xxxxxxxxxxxxxxxxxxxxxxxxxGGVFTSMGKLIHQVFGTAYxxxxxxxxxxxxxxxxxxxxxxxx
xxxxTSLSMTCIVVGMVTxxxxxxxxxxxxxxxxxxxxxxxxxxxxxxxxxxxxxxxxxxxxxxxxxxxxM
EYKYSWKIWGxxxxxxxxxxxxxxGPNTPECSDDQRAWNIxxxxxxxxxxxxxxxxxxxxRDSHTQ
MCDHRLxxxxxxxxxxxxxxxxxxxxxxxxxxxxxxxxxxxxxxxxxxxxxxxxxxxxxxxxxxxxPK
IYGGPMSQHxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxFSLGLLCVSIxxxxxxxxxxxSR
```

FIG. 54-11

```
KMLMAGTLAVLFLLxxxxLTWKDLIRLxxMVGANVSDRMGMGTTHLxxxxxxxxxxxFAVGLLLRRxx
xxxxxxxxxxxxxxASAELPNSLExxxxxxxxxxxxxxxxxxxxxxxxxLLSFTFIKTxxxxHCAW
KTMAMVLSIVSLFPLCMSxxxxxxxxxxxxxxxxxxxKPLAMFLIVENKIWGRxxxxxxxxxxxxxxxx
xxxxxxxxxxxxxxxxxxxxxxxxxxxxxxxxxxLSLDKAAEVSWEKEAEHSGASHNIFVEVxxxxx
xxxxxxxxxxxxxxxxxxxxxxLAISGVYPLSxxxxxxxxxxxxxxxxxxxxxxxxTPSPPVVERAVLDx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxIVREAIKRKMRTLIxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xSIGLLCVMASSALLWIAxxxxxxxxxxxxxxxxxxxxxxxxxxxxxxxxxxxxxxxxxxxxxxxxx
xxxxxxxxxxxxKDLGIGHVVxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxNIYKRSGIVExxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxVFFTPPERCxxxxxxxxxxxxxxxx
xxxxxxxxxxxxxxxxxxxxxxxxxxxxxxxxxxxxxxxxxTLERMQRKHxxxxxxxxxxxxxxxxxxx
xxxxxxxxxxxxxxxxxxxxxxxxxxxxxxxxxxxxxxxxxHVAVEPEVPNxxxxxxxxxxxxxxxxx
xxxxxxxxxxxxxxxxxxxxxxxxxxxxxxxxxxxxxxxxxxxxxxxxxxxxxxxxxxxxxxxxxxxx
xTPKAKRGTAQIMEMxxxxxxxxxxxxxxxxxxxxxxxxxxxxxxxxxxxxxxxxxxxxxxxxxxxxx
xxxxLVHKERELHKxxxxxxxxxxxxxxxxxxxxxxxxxxxxxxxxxxxxxxxxxxxxxxxxxxxxxx
xxxxxxxxxxxxxxxxxxxxxxxxxxISKISGGNMYAxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxPVNWVPTSRTxxxxxxxxxxxxxxxxxxxxxxxxxxxxxxxxxxxDKTRVSSWEDVP
Yxxxxxxxxxxxxxxxxxxxxxxxxxxxxxxxxxxxxxxxxxxxxxxxxxxxxxxxxxxxxxxxxxxx
xxxxx
```

FIG. 54-12

\>DENV1|peptide_length:10|string1

MNNQRKKTARPSFNMLKRARNRVSTVSQLAKRFSKGLLSGQGPMKLVMAFIAFLRFLAIPPTAGILAR
WGSFKKNGAIKVLRGFKKEISNMLNxMNRRKRSVTMLxxxxPTALAFHLTTRGGEPHMIVSKQERGKS
LLFKTSAGVNMCTLIAMDLGELCEDTMTYKCPRITEAEPDDVDCWCNATDTWVTYGTCSQTGEHRRDK
RSVALAPHVGLGLETRTETWMSSEGAWKQIQRVETWALRHPGFTVIALFLAHAIGTSITQKGIIFILL
MLVTPSMAMRCVGIGSRDFVEGLSGATWVDVVLEHGSCVTTMAKDKPTLDIELLKTEVTNPAVLRKLC
IEAKISNTTTDSRCPTQGEATLVEEQDANFVCRRTFVDRGWGNGCGLFGKGSLITCAKFKCVTKLEGK
IVQYENLKYSVIVTVHTGDQHQVGNESTEHGTTATITPQAPTTEIQLTDYGALTLDCSPRTGLDFNEM
VLLTMKEKSWLVHKQWFLDLPLPWTSGASTSQETWNRQDLLVTFKTAHAKKQEVVVLGSQEGAMHTAL
TGATEIQTSGTTTIFAGHLKCRLKMDKLTLKGMSYVMCTGSFKLEKEVAETQHGTVLVQIKYEGTDAP
CKIPFSTQDEKGVTQNGRLITANPIVTDKEKPVNIEAEPPFGESYIVIGAGEKALKLSWFKKGSSIGK
MFEATARGARRMAILGDTAWDFGSIGGVFTSVGKLVHQIFGTAYGVLFSGVSWTMKIGIGVLLTWLGL
NSRSTSLSMTCIAVGLVTLYLGVMVQADSGCVINWKGRELKCGSGIFVTNEVHTWTEQYKFQADSPKR
LSAAIGKAWEEGVCGIRSATRLENIMWKQISNELNHILLENDMKFTVVVGDVxxxxxQGKKMIRPQPM
EYKYSWKSWGKAKIIGADVQNTTFIIDGPNTPECPDDQRAWNIWEVEDYGFGIFTTNIWLKLRDSYTQ
VCDHRLMSAAIKDSKAVHADMGYWIESEKNETWKLARASFIEVKTCIWPKSHTLWSNGVLESEMIIPK
IYGGPISQHNYRPGYFTQTAGPWHLGKLELDFDLCEGTTVVVDEHCGNRGPSLRTTTVTGKIIHEWCC
RSCTLPPLRFRGEDGCWYGMEIRPVKEKEENLVKSMVSAGSGEVDSFSLGLLCISIMIEEVMRSRWSR
KMLMTGTLAVFxxxxxGQLTWNDLIRLCIMVGANASDRMGMGTTYLALMATFKMRPMFAVGLLFRRLT
SREVLLLTIGLSLVASVELPNSLEELGDGLAMGIMILKLLTDFQSHQLWxxxxxxxxxxxxxxxxxxx
xxxxxxLSIVSLFPLCLSTTSQKTTWLPVLLGSLGCKPLTMFLIAENKIWGRKSWPLNEGIMAVGIVS
ILLSSLLKNDVPLAGPLIAGGMLIACYVISGSSADLSLEKAAEVSWEEEAEHSGASHNILVEVQDDGT
MKIKDEERDDTLTILLKATLLAVSGVYPLSIPATLFVWYFWQxKKKQRSGVLWDTPSPPEVERAVLDD
GIYRIMQRGLLGRSQVGVGVFQENVFHTMWHVTRGAVLMYQGKRLEPSWASVKKDLISYGGGWRLQGS
WNTGEEVQVIAVEPGKNPKNVQTAPGTFKTPEGEVGAIALDFKPGTSGSPIVNREGKIVGLYGNGVVT
TSGTYVSAIAQAKASQEGPLPEIEDEVFRKRNLTIMDLHPGSGKTRRYLPAIVREAIKRKLRTLILAP
TRVVASEMAEALKGMPIRYQTTAVKSEHTGKEIVDLMCHATFTMRLLSPVRVPNYNMIIMDEAHFTDP
SSIAARGYISTRVGMGEAAAIFMTATPPGSVEAFPQSNAVIQDEERDIPERSWNSGYEWITDFPGKTV
WFVPSIKSGNDIANCLRKNGKRVIQLSRKTFDTEYQKTKNNDWDYVVTTDISEMGANFRADRVIDPRR
CLKPVILKDGPERVILAGPMPVTVASAAQRRGRIGRNHNKEGDQYIYMGQPLNNDEDHAHWTEAKMLL
DNINTPEGIIPALFEPEREKSAAIDGEYRLRGEARKTFVELMRRGDLPVWLSYKVASEGFQYSDRRWC
FDGERNNQVLEENMDVEIWTKEGxERKKLRPRWLDARTYSDPLALREFKEFAAGRRSVSGDLILEIGK
LPQHLTQRAQNALDNLVMLHNSEQGGRAYRHAMEELPDTIETLMLLALIAVLTGGVTLFFLSGRGLGK
TSIGLLCVMASSVLLWMASVEPHWIAASIILEFFLMVLLIPEPDRQRTPQDNQLAYVVIGLLFMILTV
AANEMGLLETTKKDLGIGHVAxxxxxxxAMLDVDLHPASAWTLYAVATTIITPMMRHTIENTTANISL
TAIANQAAILMGLDKGWPISKMDIGVPLLALGCYSQVNPLTLTAAVLMLVAHYAIIGPGLQAKATREA
QKRTAAGIMKNPTVDGIVAIDLDPVVYDAKFEKQLGQIMLLILCTSQILLMRTTWALCESITLATGPL
TTLWEGSPGKFWNTTIAVSMANIFRGSYLAGAGLAFSLMKSLGGGRRGTGAQGETLGEKWKRQLNQLS
KSEFNTYKRSGIMEVDRSEAKEGLKRGETTKHAVSRGTAKLRWFVERNLVKPEGKVIDLGCGRGGWSY
YCAGLKKVTEVKGYTKGGPGHEEPIPMATYGWNLVKLHSGKDVFFIPPEKCDTLLCDIGESSPNPTIE
EGRTLRVLKMVEPWLRGNxQFCIKILNPYMPSVVETLEQMQRKHGGMLVRNPLSRNSTHEMYWVSCGT
GNIVSAVNMTSRMLLNRFTMAHRKPTYERDVDLGAGTRHVAVEPEVANLDIIGQRIENIKHEHKSTWH
YDEDNPYKTWAYHGSYEVKPSGSASSMVNGVVKLLTKPWDVIPMVTQIAMTDTTPFGQQRVFKEKVDT
RTPKAKRGTAQIMEVTAKWLWGFLSRNKKPRICTREEFTRKVRSNAAIGAVFVDENQWNSAKEAVEDE
RFWDLVHRERELHKQGKCATCVYNMMGKREKKLGEFGKAKGSRAIWYMWLGARFLEFEALGFMNEDHW
FSRENSLSGVEGEGLHKLGYILRDISKIPGGNMYADDTAGWDTRITEDDLQNEAKITDIMEPEHALLA
KSIFKLTYQNKVVRVQRPAKNGTVMDVISRRDQRGSGQVGTYGLNTFTNMEAQLIRQMESEGIFSPxx
xxxxxxxxxxxxxxxxxxERLKRMAISGDDCVVKPIDDRFATALTALNDMGKVRKDIPQWEPSKGWN
DWQQVPFCSHHFHQLIMKDGREIVVPCRNQDELVGRARVSQGAGWSLRETACLGKSYAQMWQLMYFHR

FIG. 54-13

```
RDLRLAANAICSAVPVDWVPTSRTTWSIHAHHQWMTTEDMLSVWNRVWIEENPWMEDKTHISSWGDVP
YLGKREDQWCGSLIGLTARATWATNIQVAINQVRRLIGNENYLDYMTSMKRFKNExxxxxxxxxxxxx
xxxxx >DENV1|peptide_length:10|string2

MNNQRKKTGQPSFNMLKRARNRVSTGSQLAKRFSKxLLSGQGPMKMVMAFIAFLRxxxxxPTAGILAR
WGSFKKSGAIKVLRGFKKEISSMLNxMNRRKKSVTMLxxxxPTVLTFHLTTRGGEPHMIVTKQERGKS
LLFKTSVGINMCTLIAMDLGEFCEDTMTYKCPRITETEPDDVDCWCNATETWVTYGTCSQTGEHRREK
RSVAL

FIG. 54-14

FSRENSFSGVEGEGLHRLGYILRDISNIPGGSMYADDTAGWDTRVTEDDLQNEARITEIMEPEHALLA
TAIFKLTYQNKVVRVQRPAKSGTVMDVISRxxxxxxxxxxxYGLNTFTNMEVQLIRQMESEGIFLPxx
xxxxxxxxxxxxxxxxxxxERLRRMAISGDDCVVKPTDDRFATALIALNDMGKVRKDVPQWEPSKGWx
xxxxxxxxxxxxxxxxxxxxxxxxxxxxxxxxxxxxxxxxxxAGWSLKETACLGKxxxxxxxxxxxxx
xxxxLAANAICSAVPVDWIPTSRTTWSIxxxxxxxxxxxxxxxxxxxxxxENPWMEDKTHVSSWEEVP
YLGKREDxxxxxxxGLTARATWASNIQVAINQVRRLLGNENYSDYMISMKRFKNExxxxxxxxxxxxx
xxxxx >DENV1|peptide_length:10|string3

MNNQRKKTGQPSFNMLKRxxxxxxxxxxxxxxxxxxLLSGQGPMKFVMAFIAFLRxxxxxxxxxxLAR
WSSFKKNGAIKVLRGFKKEVSNMLNxINRRKRSVTMFxxxxPTVLAFHLTTRGGEPHMVVGKQERGKS
LLFKTSAGINMCTLIAMDLGELCDDTMTYKCPQITEVEPDDVDCWCNTTDTWVTYGTCTQIGEHRRDK
RSxxxxxxxxxxxxxxxxxxxxSEGAWRQIQRVETWVLRHPGFTVTALFLAHVIGTSxxxxxxxxxxx
xxxxxxxxxxxxxxxxxxxxxxxxxxxxxxxxxxxxxxxxxxxxxxxxxxIELLKTEVTDPAVLRKLC
IxxxxxxxxxxxxxxxxxEATLVEEQDSNFVCRRTFVxxxxxxxxxxFGKGSLMTCAKFKCVTKLEGK
IAQYENLKYSVxxxxxxxxQHQVGNETTDHGTTATITPQAPSSEIQLTDYGVLTLDCxxxxxxxxNEM
VLLTMKEKAWLVHKQWxxxLPLPWTSGALTLQETWNRQDLxxxxxxxxxxxxxxxxxxxxxxxxxxxx
xxxxxxQMSGTTTIFAGxxxxxxKMDKLTLRGMSYVMCTGLFKLEKEVAExQHGTVLVQIRYEGTDAP
CKIPFSSQDEKGATQNGRVITANPIVTDKDKPVNIEAEPPFGESYIIIGAGEKTLKLSWFKKGSSIGK
MFVATAxxxxxxxxxxxxAWDFGSIGGLFTSIGKLIHQVFGAAYGVLFxxxSWTMKIGLGVLLTWLGL
NSRSASFSMTCIAVGLVTLYLGAMVQxxxxxxxxxxxxxxxxxxxxxxxxxxxxxxxxxxxxxxxxxx
xxxxxxxxxEEGVCGIRSTTRLENIMWKQISNELNHILLENGMKLTVVVGDVxxxxxQGRKMIRPQPM
EHKYSWRSWGKAKIIGADAQNATFIIDGPNTPECPDGQRAWNIWEVxxxxxGIFTTNIWLKMRDSHTQ
ACDHRLMSAAxxxxxxxxxxxxxxxxSEKNETWKLAGASFIEVKTCVWPKSHTLWSxxxLESEMVIPK
IYGGPISQHNHRPGYFTQTAxxxxLGKLELDFDFCEGTTVVVDEHCGSRGPSLRTTTxxxxxxxxxxx
xxxxxxxxxxxxxxxxxxxxxxxxVKDKEENLVKSMVSAGSGEVDNFSLGILCASIIIEEVMRSRWSK
KMLMTGILAVFxxxxxGQLTWSDLTRLCIMVGANAFDNMGMGTTYLALMATFKIRPMFAVGLLFRKLT
SREVLxLTIGLSLVASVELPNSLDELGDGLAIGIMMLKLLTDFQSYQLWxxxxxxxxxxxxxxxxxxx
xxxxxxLSIASLIPLCLSTTSQxxxxxxxxLGSLGCKPLPMFLITETKIWGRKSWPLNEGIMAVGIVS
ILLSALLxxxxxxxxxxxxxxxxxxxxxxxxSSADLSLEKAAVVSWEEEAEHSGASHNILVVVQDDGT
MKIKDEEKDDTLTILLKATLLAISGVYPLSIPATLFLWYFWQxxxxxxxxxxWDTPSPPEVEKAVLDD
GIYxxxxxxxxxxxQVGVGVFQEGVFHTMWHVxxxxxxxxxxxxxxxxxxxxxxxxISYGGGWRLQGL
WNTGEEVQVxxxxxGKNPKNVQTAPGTFKTSEGxxxxxxxxxxxxxxxxxxxxxxxxxxxxxxxxxxx
xxxxYVSAIAQARASQEGPLPEIEEKVFRKRNLTIxxxxxxxxxxxxxLPAMVREAIKRKLRTLVLAP
Txxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxVEAFPQSNAIIQDEERDIPERSWNSGHEWITDFPGKxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxQRRGRIGRNQNKEGDQYIYMGQPLKNDxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxRRSISGDLILEIGK
LPQHLTQKAQNALDNLxxxxxxxQGGRAYRHALEELxxxxxxxxxxxxxxxxxxGVMLFFLSGKGLxK
TSIGLLCVTSSSALLWMANVEPxxxxxxxxxxxxxxxxxxxxxxxxxxxxxxxxAYVVIGLLFVILTV
AANEMxxxxxTKKDLGIGHAAxxxxxxxTMLDVDLRPAxxxxxxxxxxxxxxxxxxxxxxxxxxxxxx
xxxxxxxxxxxxxxxxxxxxxxxxxxxxxxxxxxxxxNPLTLTATVLMLVAHYAxxxxxxxxxxxxxx
xxxxxxxxxKNPTVDGIVTIDLDxxxxxAKFEKQLGQVxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxLS
KSEFNTYKKSGIVEVDRSEAKEGLRRGEIIKHAVSRGTAxxxxxxxxxxxxxxxxxxxxxxxxxxxxx
xxxxxxxxxxxxxYTKGGAGHEEPIPMATYGWNLVRLHSGKDVFFMPPEKCDTLLxxxxxxxxxxxxx
xxxxxxxxxxxxxxxxxxxxxxxxxxxxxMPSVVETLEQMQRRHGGMLxxxxxxxxxxxxxxxxxxxx

FIG. 54-15

```
xxxxxxxxxxxxxxxxxxFTMAHRKPTYEKDVDLGAGTRHVAVEPEEANLDIIGQRxxxxxxxxxxxxx
xxxxxxxxxxxxxxxxxxxxxxxxxxxxxxxxxxxxxxxxxxxxxxxxxxxxxxxxxxxxxxxxxVDT
RTPRAKRGTVQIMEMTARWLWSFLSRNxxxxxxxxxxxxxxxxxxxxxxxxxxxxxxxxxEAVEDE
RFWELVRRERELHKQGxxxxxxxxxxxxxxxxxxxxxxxxxxxxxxxxxxxxxxxxxxxxxxxxx
xxxxxxxxxxxxxxxxxxLGYILRDISRISGGNMYADDTxxxxxxxxEDDLQNEAKITDIMEPEHALLA
KAIFKLTYQNKVVRVQRPARNGTVMDVISxxxxxxxxxxxxxGLNTFTNMGAQLIRQMESEGIFFPxx
xxxxxxxxxxxxxxxxxxxxxxxxxxxxxxSGDDCVVKPVDDRFATALSALNDMGKVRxxxxxxxxxxxx
xxxxxxxxxxxxxxxxxxxxxxxxxxxxxxxxxxxxxxxxxxxxxxxxxxxxxxxxxxxxxxxxx
xxxxxxANAICSADPVEWVPTSRTTWxxxxxxxxxxxxxxxxxxxxxxxxxNPWMEDKTHISSWEEVP
YLGKRExxxxxxxxxxxxxxxxxxxWATNVQVAINQxRRLIGNENYLDFMTSMKRFKNDxxxxxxxxxxxxx
xxxxx >DENV1|peptide_length:10|string4

MINQRKKTGRPxxxxxxxxxxxxxxxxxxxxxxxxxxxxxxxxxxxxxxxxxxxxxxxxxxxxxx
xxxxxxxxxxxxLRGFKREISNMLNxMNRRKRSVTMIxxxxPTALTFHLTTRGGEPHMIVGKQERGKS
LLFKTSTGVNMCTLIAxDLGELCEDTITYKC

FIG. 54-16

```
xxxxxxxxxxxxxxxxxxxxxxxxxxxxxxxxxxxxxxxxxTLTATVLMLVAHxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxS
KPEFNTYKRSGIVEVDRSxxxEGLKRGETIKHAVSRGTxxxxxxxxxxxxxxxxxxxxxxxxxxxxxxxx
xxxxxxxxxxxxxxxKGGLGHEEPIPMAxxxxxLVKLHSGKDVFFVPPEKCDTLLxxxxxxxxxxxxxxx
xxxxxxxxxxxxxxxxxxxxxxxxxxxxxxxVETLEHMQRKHGGMLxxxxxxxxxxxxxxxxxxxxxxxx
xxxxxxxxxxxxxxxxxxxxMAHRKPTFERDVDLGAGTRHVTVEPEVANIDIIGQRxxxxxxxxxxxxxx
xxxxxxxxxxxxxxxxxxxxxxxxxxxxxxxxxxxxxxxxxxxxxxxxxxxxxxxxxxxxxxxxxxxxxx
RTPKAKQGTAQIMEVTARWLWSFLxxxxxxxxxxxxxxxxxxxxxxxxxxxxxxxxxxxxxxxxEAVEDE
RFWNLVKKERELHKQGxxxxxxxxxxxxxxxxxxxxxxxxxxxxxxxxxxxxxxxxxxxxxxxxxxxxx
xxxxxxxxxxxxxxxxxxxxxxxxxxxRDISKISGGNMYADxxxxxxxxxxxxLRNEARITDTMEPEHALLA
RSIFKLTYQNxVVRVQRPTKNGTVMDVIxxxxxxxxxxxxxxxxxxxxxxxxxxxxxxxxRQMESEEIFSPxx
xxxxxxxxxxxxxxxxxxxxxxxxxxxxxxxxxVKPIDDRFAAALTALNDMGxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxANANCSAVPVNWVPTSRTTxxxxxxxxxxxxxxxxxxxxxxxxxxxxxxxxxEDKTHVSSWGDVP
YLxxxxxxxxxxxxxxxxxxxxxxxxxxxxxxxxxLIGNENYLDYMISMKRFxxxxxxxxxxxxxxxxx
xxxxx >DENV1|peptide_length:10|string5 xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxMNRRKRSVTTLxxxxPTTLAFHLTTRxxxxxxxxxxxxxxxxxx
xxxxxSAGVNMCTLVxxxxxxxxxxxxxTYKCPRISEAEPDDVxxxxxxxxxxxxxxxxxSQTGGHRREK
xxxxxxxxxxxxxxxxxxxxxxxxxxxxxxxxxxxxxxRHPGFTMIALFLAxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxTKLEGK
IVQHENLKYSxxxxxxxxxxxxxxGNETTDHGTTATIxxxxxxxxxxxxxxxxxxxxxxxxxxxxxxxM
VLLTMKGKSxxxxxxxxxxxxxxxxxxxxxASQETWNRKDxxxxxxxxxxxxxxxxxxxxxxxxxxxxx
xxxxxxxxxxxxxxxxxxxxxxxxxxxxxKMDKLTLKGVSYVMCTGxxxxxxxxxxxxxxxxxxxxxxxx
CKIPFSTQDERGVTQNGRVITAxxTVTDKEKPVNxxxxPPFGESYITIGAGEEALKLxxxxxxxxxxxx
xxxxxxxxxxxxxxxxxxxxxxxxxxxxxGGVFTSMGKLIHQVFGTAYGxxxxxxxxxxxxxxxxxxxx
xxxSTSLSMTCIVVGMVTLxxxxxxxxxxxxxxxxxxxxxxxxxxxxxxxxxxxxxxxxxxxxxxxxxx
xxxxxxxxxxxxxxxxxxxxxxxxxxxxxxxxxxxxxHILLENDMKLTVVVGDAxxxxxxxxxxMVRPQPM
EYKYSWKIWGKxxxxxxxxxxxxxxxxxDGPNTSECSDDQRAWNIWxxxxxxxxxxxxxxxxxxRDSHTQ
MCDHRLMxxxxxxxxxxxxxxxxxxxxxxxxxxxxxxxxxxxxxxxxxxxxxxxxxxxxxxxxxxxxxPK
IYGGPMSQHNxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxFSLGLLCVSIxxxxxxxxxxWSR
KMLMAGTLAVFxxxxxxQLTWKDLIRLCIMVGANVSDRMGMGTTHLAxxxxxxxxxMFAVGLLLRRLx
xxxxxxxxxxxxxSAELPNSLEExxxxxxxxxxxILKLLTDFQPxxxxxxxxxxxxxxxxxxxxxxxxx
xxxxxxLSIVSLFPLCMSTxxxxxxxxxxxxxxxLGCKPLTMFLIVExxxxxxxxxxxxxxxxxxxxxx
xxxxxxxxxxxxxxxxxxxxxxxxxxxxxxxxxADLSLEKTAEVSWEKEAEHSGASHNIFVEVQxxxx
xxxxxxxxxxxxxxxxxxLLAISGVYPLSIxxxxxxxxxxxxxxxxxxxxxxxDTPSPPVVERAVLDx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxAIIREAIKRKMRTLILxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxNYNKEGDQYIxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
```

FIG. 54-17

```
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
TSIGLLCVMSSSxxxxxxxxxxxxxxxxxxxxxxxxxxxxxxxxxxxxxxxxxxxxxxxx
xxxxxxxxxxKKDLGIGHVVxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxFNIYKRSGIVEVxxxxxxxxxxxxxxxxxxxxxxxxxxxxxxxxxxxxxxxxxxxxx
xxxxxxxxxxxxxxxxxxxxxxxxxxxxxxxxxxxxxxxDVFFTPPERCDxxxxxxxxxxxx
xxxxxxxxxxxxxxxxxxxxxxxxxxxxxxxxxETLEHMQRKHGxxxxxxxxxxxxxxxxx
xxxxxxxxxxxxxxxxxxxxxxxxxxxxxxxxxxRHVAVEPEVPNLDIxxxxxxxxxxxxx
xxxxxxxxxxxxxxxxxxxxxxxxxxxxxxxxxxxxxxxxxxxxxxxxxxxxxxxxxxxx
RTPKPKRGTAQIMEMTxxxxxxxxxxxxxxxxxxxxxxxxxxxxxxxxxxxxxxxxxxxx
xxxxLVHKERELHKQxxxxxxxxxxxxxxxxxxxxxxxxxxxxxxxxxxxxxxxxxxxxx
xxxxxxxxxxxxxxxxxxxxxxxxDISKIPGGSMYADxxxxxxxxxxxxxxxxAKITDIMKPExxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxPIDWVPTSRTTxxxxxxxxxxxxxxxxxxxxxxxxxxxxxEDKTRVSSWEDVP
YLxxxxxxxxxxxxxxxxxxxxxxxxxxxxxxxxxxxxxxxxxxxxxxxxxxxxxxxxxx
xxxxx
```

>DENV1|peptide_length:11|string1

```
MNNQRKKTARPSFNMLKRARNRVSTVSQLAKRFSKGLLSGQGPMKLVMAFIAFLRFLAIPPTAGILAR
WGSFKKNGAIKVLRGFKKEISNMLNxxxxxxxxxxxxxxxxPTALAFHLTTRGGEPHMIVSKQERGKS
LLFKTSAGVNMCTLIAMDLGELCEDTMTYKCPRITEAEPDDVDCWCNATDTWVTYGTCSQTGEHRRDK
RSVALAPHVGLGLETRTETWMSSEGAWKQIQRVETWALRHPGFTVIALFLAHAIGTSITQKGIIFILL
MLVTPSMAMRCVGIGSRDFVEGLSGATWVDVVLEHGSCVTTMAKDKPTLDIELLKTEVTNPAVLRKLC
IEAKISNTTTDSRCPTQGEATLVEEQDANFVCRRTFVDRGWGNGCGLFGKGSLITCAKFKCVTKLEGK
IVQYENLKYSVIVTVHTGDQHQVGNESTEHGTTATITPQAPTTEIQLTDYGALTDCSPRTGLDFNEM
VLLTMKEKSWLVHKQWFLDLPLPWTSGASTSQETWNRQDLLVTFKTAHAKKQEVVVLGSQEGAMHTAL
TGATEIQTSGTTTIFAGHLKCRLKMDKLTLKGMSYVMCTGSFKLEKEVAETQHGTVLVQIKYEGTDAP
CKIPFSTQDEKGVTQNGRLITANPIVTDKEKPVNIEAEPPFGESYIVIGAGEKALKLSWFKKGSSIGK
MFEATARGARRMAILGDTAWDFGSIGGVFTSxGKLVHQIFGTAYGVLFSGVSWTMKIGIGVLLTWLGL
NSRSTSLSMTCIAVGLVTLYLGVMVQADSGCVINWKGRELKCGSGIFVTNEVHTWTEQYKFQADSPKR
LSAAIGKAWEEGVCGIRSATRLENIMWKQISNELNHILLENDMKFTVVVGDxxxxxxQGKKMIRPQPM
EYKYSWKSWGKAKIIGADVQNxTFIIDGPNTPECPDDQRAWNIWEVEDYGFGIFTTNIWLKLRDSYTQ
VCDHRLMSAAIKDSKAVHADMGYWIESEKNETWKLARASFIEVKTCIWPKSHTLWSNGVLESEMIIPK
IYGGPISQHNYRPGYFTQTAGPWHLGKLELDFDLCEGTTVVVDEHCGNRGPSLRTTTVTGKIIHEWCC
RSCTLPPLRFRGEDGCWYGMEIRPVKEKEENLVKSMVSAGSGEVDSFSLGLLCxSIMIEEVMRSRWSR
KMLMTGTLxxxxxxxxGQLTWNDLIRLCIMVGANASDRMGMGTTYLALMATFKMRPMFAVGLLFRRLT
SREVLLLTIGLSLVASVELPNSLEELGDGLAMGIMILKLLTDFQSHQLWxxxxxxxxxxxxxxxxxxx
xxxxxxxxxVSLFPLCLSTTSQKTTWLPVLLGSLGCKPLTMFLIAENKIWGRKSWPLNEGIMAVGIVS
ILLSSLLKNDVPLAGPLIAGGMLIACYVISGSSADLSLEKAAEVSWEEEAEHSGASHNILVEVQDDGT
MKIKDEERDDTLTILLKATLLAVSGVYPLSIPATLFVWYFWQxKKKQRSGVLWDTPSPPEVERAVLDD
GIYRIMQRGLLGRSQVGVGVFQENVFHTMWHVTRGAVLMYQGKRLEPSWASVKKDLISYGGGWRLQGS
WNTGEEVQVIAVEPGKNPKNVQTAPGTFKTPEGEVGAIALDFKPGTSGSPIVNREGKIVGLYGNGVVT
TSGTYVSAIAQAKASQEGPLPEIEDEVFRKRNLTIMDLHPGSGKTRRYLPAIVREAIKRKLRTLILAP
```

FIG. 54-18

```
TRVVASEMAEALKGMPIRYQTTAVKSEHTGKEIVDLMCHATFTMRLLSPVRVPNYNMIIMDEAHFTDP
SSIAARGYISTRVGMGEAAAIFMTATPPGSVEAFPQSNAVIQDEERDIPERSWNSGYEWITDFPGKTV
WFVPSIKSGNDIANCLRKNGKRVIQLSRKTFDTEYQKTKNNDWDYVVTTDISEMGANFRADRVIDPRR
CLKPVILKDGPERVILAGPMPVTVASAAQRRGRIGRNHNKEGDQYIYMGQPLNNDEDHAHWTEAKMLL
DNINTPEGIIPALFEPEREKSAAIDGEYRLRGEARKTFVELMRRGDLPVWLSYKVASEGFQYSDRRWC
FDGERNNQVLEENMDVEIWTKEGxERKKLRPRWLDARTYSDPLALREFKEFAAGRRSVSGDLILEIGK
LPQHLTQRAQNALDNLVMLHNSEQGGRAYRHAMEELPDTIETLMLLALIAVLTGGVTLFFLSGRGLGK
TSIGLLCVMASSVLLWMASVEPHWIAASIILEFFLMVLLIPEPDRQRTPQDNQLAYVVIGLLFMILTV
AANEMGLLETTKKDLGIGHVAxxxxxxxAMLDVDLHPASAWTLYAVATTIITPMMRHTIENTTANISL
TAIANQAAILMGLDKGWPISKMDIGVPLLALGCYSQVNPLTLTAAVLMLVAHYAIIGPGLQAKATREA
QKRTAAGIMKNPTVDGIVAIDLDPVVYDAKFEKQLGQIMLLILCTSQILLMRTTWALCESITLATGPL
TTLWEGSPGKFWNTTIAVSMANIFRGSYLAGAGLAFSLMKSLGGGRRGTGAQGETLGEKWKRQLNQLS
KSEFNTYKRSGIMEVDRSEAKEGLKRGETTKHAVSRGTAKLRWFVERNLVKPEGKVIDLGCGRGGWSY
YCAGLKKVTEVKGYTKGGPGHEEPIPMATYGWNLVKLHSGKDVFFIPPEKCDTLLCDIGESSPNPTIE
EGRTLRVLKMVEPWLRGNxQFCIKILNPYMPSVVETLEQMQRKHGGMLVRNPLSRNSTHEMYWVSCGT
GNIVSAVNMTSRMLLNRFTMAHRKPTYERDVDLGAGTRHVAVEPEVANLDIIGQRIENIKHEHKSTWH
YDEDNPYKTWAYHGSYEVKPSGSASSMVNGVVKLLTKPWDVIPMVTQIAMTDTTPFGQQRVFKEKVDT
RTPKAKRGTAQIMEVTAKWLWGFLSRNKKPRICTREEFTRKVRSNAAIGAVFVDENQWNSAKEAVEDE
RFWDLVHRERELHKQGKCATCVYNMMGKREKKLGEFGKAKGSRAIWYMWLGARFLEFEALGFMNEDHW
FSRENSLSGVEGEGLHKLGYILRDISKIPGGNMYADDTAGWDTRITEDDLQNEAKITDIMEPEHALLA
KSIFKLTYQNKVVRVQRPAKNGTVMDVISRRDQRGSGQVGTYGLNTFTNMEAQLIRQMESEGIFSPxx
xxxxxxxxxxxxxxxxxxxERLKRMAISGDDCVVKPIDDRFATALTALNDMGKVRKDIPQWEPSKGWN
DWQQVPFCSHHFHQLIMKDGREIVVPCRNQDELVGRARVSQGAGWSLRETACLGKSYAQMWQLMYFHR
RDLRLAANAICSAVPVDWVPTSRTTWSIHAHHQWMTTEDMLSVWNRVWIEENPWMEDKTHISSWGDVP
YLGKREDQWCGSLIGLTARATWATNIQVAINQVRRLIGNENYLDYMTSMKRFKNExxxxxxxxxxxxx
xxxxx >DENV1|peptide_length:11|string2

MNNQRKKTGQPSFNMLKRARNRVSTGSQLAKRFSKGLLSGQGPMKMVMAFIAFLRFxxxPPTAGILAR
WGSF

FIG. 54-19 xxxxxxxxxVSLLPLCMSTTSQKTTWLPVLLGSFGCKPLTMFLITENKIWGRRSWPLNEGIMAIGVVS
ILLSALLKNDVPLAGxxxxxxxxxxxxxISGSSADLSLEKAAEVSWEQEAEHSGTSHNILVEIQDDGT
MKIKDEERDDTITITILLKATLLAVSGVYPMSIPATLFVWHFWQxxxxxxxGVLWDTPSPPEVGKAVLDD
GIYRILQRGLLGRSQVGVGVFQDGVFHTMWHVTRxxxxxxxxxxxxxxxxxDLISYGGGWRFRGS
WNAGEEVQVIAVEPGKNPKNVQTTPGTFKTSEGEVGAIALDxxxxxxxSPIVNREGKVVGLYGxxxxx
xSGTYVSAIAQAKTSQEGPLPEIEDEVFKKRNLTIMDLHxxSGKTRRYLPAIVREAIKRRLRTLVLAP
TRVVASEMAEALKGVPIRYQTTAVKSEHTGREIVDLMCHATxxxxxxxxxxxxxxxxxIMDEAHFTDP
ASIAARGYISTxxxxxxxxxIFMTATPPGSMEAFPQSNAVIQDEEKDIPERSWNSGYDWITDFPGKTV
WFVPSIKAGNDIANCLRKNGKRVVQLSRKTFDTEYQKTRNNDWDYVVTTxxxxxxxxxxxxxxxxxx
xxxxxxxxxxxxxxxxxxxxxxxxxxAQRRGRIGRNQNKEGDQYVYMGQPLKNDEDHAHWTxxxxxx
xxxxxxxxxxxxxFEPEREKSAAVDGEYRLRGEAxxxxxxxxRRGDLPVWLSHKVASEGFQYSxxxxx
xxxxxxxxxxxxxxxxxxxxxxxxxxxxxxxxxxxxxxxxxxFKEFAAGRRSVSGDLISEIGK
LPQHLTLKAQNALDNLVMLHNSEQGGKAYRHAMEELPDTIETIMLLALIAVLTGGVTLFFLSGKGLGK
TSIGLLCVTASSALLWMANVEPHWIAASIxxxxxxxxxxxxxxxxxxxxxxxxxLAYVVIGLLFIILTV
AANEMGxxETTKKDLGIGYVAxxxxxxxTMLDVDLRPASAWTLYAVATTVITPMMRHTIExxxxxxx
xxxxxxxxxxxxDKGWPISKMDLGVPLLALxCYSQVNPLTLIAAVLMLLAHYAIIGxxxxxxxxxx
xxxTAAGIMKNPTIDGIVAIDLDPVVYDTKFEKQLGQVMLLILCTSQIxxxxxxxxxxxxxxxxxx
xxxxxxxxxxxxxxxxxxxxxxxxxxxxxxxxxxxxxxxxxxxxxxxxxxxxxxxxxxxxLNQLS
KSE

FIG. 54-20

```
IYGGPISQHNHRPGYFTQTAGxxHLGKLELDFDFCEGTTVVVDEHCGYRGPSLRTTTVxxxxxxxxxx
xxxxxxxxxxxxxxxxxxxxxxxxPVKDKEENLVKSMVSAGLGEVDNFSLGILCxSIITEEVMRSRWSK
KMLMTGTLxxxxxxxxGQLTWSDLTRLCIMVGANAFDNMGMGMTYLALMATFKMRPMFAVGLLFRKLT
SREVLLLTIGLSLVASVELPNSLDELGDGLAMGIMMLKLLTDFQSYQLWxxxxxxxxxxxxxxxxxxx
xxxxxxxxxASLIPLCLSTTSQKxxxxxxLLGSLGCKPLPMFLITETKIWGRKSWPLNEGIMAVGIVS
ILLSALLKxxxxxxxxxxxxxxxxxxxxxxGSSADLSLEKAAVVSWEEEAEHSGASHNILVVVQDDGT
MKIKDEEKDDTLTILLKATLLAISGVYPLSIPATLFLWYFWQxxxxxxxxxLWDTPSPPEVEKAVLDD
GIYRxxxxxxxxxxSQVGVGVFQEGVFHTMWHVTxxxxxxxxxxxxxxxxxxxxxxLISYGGGWRLQGL
WNTGEEVQVIxxxPGKNPKNVQTAPGTFKTSEGExxxxxxxxxxxxxxxxxxxxxxxxxxxxxxxxxx
xxxTYVSAIAQARASQEGPLPEIEEKVFRKRNLTIMxxxxxxxxxxxYLPAMVREAIKRKLRTLVLAP
TRxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxSVEAFPQSNAIIQDEERDIPERSWNSGHEWITDFPGKTx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxAQRRGRIGRNQNKEGDQYIYMGQPLKNDExxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxGRRSISGDLILEIGK
LPQHLTQKAQNALDNLVxxxxxxEQGGRAYRHALEELPDTIETLxxxxxxxxxxGGVMLFFLSGKGLGK
TSIGLLCVTSSSALLWMANVEPHxxxxxxxxxxxxxxxxxxxxxxxxxLAYVVIGLLFVILTV
AANEMGxxxTTKKDLGIGHAAxxxxxxxTMLDVDLRPASxxxxxxxxxxxxxxxxxxxxxxxxxxxxx
xxxxxxxxxxxxxxxxxxxxxxxxxxxxxxxxxxxxxVNPLTLTATVLMLVAHYAIxxxxxxxxxxxx
xxxxxxxxMKNPTVDGIVTIDLDPVVYDAKFEKQLGQVMxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxQLS
KSEFNTYKKSGIVEVDRSEAKEGLRRGEIIKHAVSRGTAKxxxxxxxxxxxxxxxxxxxxxxxxxxxx
xxxxxxxxxxxGYTKGGAGHEEPIPMATYGWNLVRLHSGKDVFFMPPEKCDTLLCxxxxxxxxxxxxx
xxxxxxxxxxxxxxxxxxxxxxxxxxxxYMPSVVETLEQMQRRHGGMLVxxxxxxxxxxxxxxxxxxx
xxxxxxxxxxxxxxRFTMAHRKPTYEKDVDLGAGTRHVAVEPEEANLDIIGQRIxxxxxxxxxxxxxx
xxxxxxxxxxxxxxxxxxxxxxxxxxxxxxxxxxxxxxxxxxxxxxxxxxxxxxxxxxxxxxxKVDT
RTPRAKRGTVQIMEMTARWLWSFLSRNKxxxxxxxxxxxxxxxxxxxxxxxxxxxxxxxxKEAVEDE
RFWELVRRERELHKQGKxxxxxxxxxxxxxxxxxxxxxxxxxxxxxxxxxxxxxxxxxxxxxxxxx
xxxxxxLSGVEGEGLHKLGYILRDISRISGGNMYADDTAxxxxxxVTEDDLQNEAKITDIMEPEHALLA
KAIFKLTYQNKVVRVQRPARNGTVMDVISRxxxxxxxxxxxYGLNTFTNMGAQLIRQMESEGIFFPxx
xxxxxxxxxxxxxxxxxxxxxxxxxxISGDDCVVKPVDDRFATALSALNDMGKVRKxxxxxxxxxxxx
xxxxxxxxxxxxxxxxxxxxxxxxxxxxxxxxxxxxxxxxxxxxxxxxxxxxxxxxxxxxxxxxxxx
xxxxxAANAICSADPVEWVPTSRTTWSxxxxxxxxxxxxxxxxxxxxxENPWMEDKTHISSWEEVP
YLGKREDxxxxxxxxxxxxxxTWATNVQVAINQVRRLIGNENYLDYMTSMKRFKNDxxxxxxxxxxxx
xxxxx >DENV1|peptide_length:11|string4

MINQRKKTGRPSxxxxxxxxxxxxxxxxxxxxxxxxxxxxxxxxxxxxxxxxxxxxxxxxxxxxxxx
xxxxxxxxxxxVLRGFKREISNMLNxxxxxxxxxxxxxxxxPTALTFHLTTRGGEPHMIVGKQERGKS
LLFKTSTGVNMCTLIAMDLGELCEDTITYKCPRISEAEPDDVDCWxxxxxxxxxxxxTCSRTGEHRRDK
RSxxxxxxxxxxxxxxxxxxxxxxxxxWKQIQRVETWALRHPGFTVMALFLAxxxxxxxxxxxxxxxx
xxxxxxxxxxxxxxxxxxxxxxxxxxxxxxxxxxxxxxxxxxxxxxxxxxxxxxxxKTEVTSPAILRKLC
IxxxxxxxxxxxxxxxxxxxxxxxxxxxxxxxxxxxGEATLVEEQDANFVCRRTLVDxxxxxxxxxxxxxxxxxxKCVTKLEGK
TVQHENLKYSVxxxxxxxxxxxxxVGNESTEHGTTATITPQAPTTEIQLTDYGVLxxxxxxxxxxxxFNEM
VLLTMEKKSWLVHKQWxxxxxxxxxxxxxxTTQETWNRQDLLxxxxxxxxxxxxxxxxxxxxxxxxxx
xxxxxxxxxxxxxxxxxxxxxxLKMDKLTLKGISYVMCTGPFKLEKEVAExxxxTVLVQVRYEGTDAP
CKIPFSAQDGKGVTQNGRLITANPIVTDREKPVNIETEPPFGESYIIVGAGEKALKLSWFKKGSNIGK
MFEATARxxxxxxxxxxxxxxxxxxxxxxGKLVHQVFGAAYGVxxxxxxxxxxxxxxxxxxxxxWLGL
```

FIG. 54-21

```
NSRSTSLSVMCIVVGLVTLYLGAMVQxxxxxxxxxxxxxxxxxxxxxxxxxxxxxxxxxxxxxxxx
xxxxxxxxxxxxxGIRSVTRLENIMWKQxxxELNYILLENDIKFTVVVGNxxxxxxQGKKTIRPQPM
EYKYSWKNWGKAKIIGADTQNxxxxxIDGPDTPECPDEQRAWNIWEVExxxxGIFTTNIWLRLRDSYTQ
ACDHRLMSxxxxxxxxxxxxxxxxxxxxxNETWKLEKASFIEVKTCIxxxxxxxxxxxxLESEMIIPK
MYGGPMSQHNYRPGYFxxxxxxxxxxxxxxxxxxxxxxxxIVDEHCGNRGPxxxxxxxxxxxxxxxx
xxxxxxxxxxxxxxxxxxxxxxxxxxxxxxxxxxxxxSGEVDNFSLGIxxxSIMTEEVMRSRWSR
KMLMTGILxxxxxxxxxGQLTWNDLIRLCIMVGANASDRMGMGTTHLALMATFKIRPMFAVGLLLRRLT
SREVxxLTIGLSLVAFVELPNSLEELxxxxxIGIMMLKLLTDFQPHQLWxxxxxxxxxxxxxxxxxx
xxxxxxxxxVSLFPLCMSTTSQKxxxxxxLLGSLGCKPLTMFLIVENEIWGRKSWPINEGIMAVGIVS
ILLSALxxxxxxxxxxxxxxxxxxxxxxxxxxSADLLLEKAAKVSWEQEAEHSGASHNILVEVQDDGP
MKxKDEERDDMLTIxxxxxLLAISGVYPLSIPAxxxxxxxxxxxxxxxxxxxxxWDTPSPPKVERAVLDN
GIYRxxxxxxxxxxxxxxxxxxxxxxxxxxxxxxxxxxxxxxxxxxxxxxxxxxxxxxxxxxxQGL
WNTGEEVQxxxxxxxxxxxxxVQTMPGTFKTPEGExxxxxxxxxxxxxxxxxxxxxxxxxxxxxx
xxxxYVSAIAQTKASQEGPLPEIENEVFRKRNLTIxxxxxxxxxxxxxxxPAIVREAIKRRLRTLVLAP
TRxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxSAEAFPQSNAVIxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxRNHNKEGDQYVYMxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxGRKSVSGDLILEIGK
LPQHLTLKAQNALDNLVxxxxxxxxxxxxxxxxxxxxxxxxxxxxxxxxxxxxxxxxxxxxxxxxK
TSIGLLCVMSSSVLLWIASVEPHxxxxxxxxxxxxxxxxxxxxxxxxxxxxxxxxxxxxxxxxxxx
xxxxxxxxxxTKKDLGIGHAVxxxxxxxTMLDIDLHPASxxxxxxxxxxxxxxxxxxxxxxxxxxxx
xxxxxxxxxxxxxxxxxxxxxxxxxxxxxxxxxxxxxLTLTATVLMLVAHYxxxxxxxxxxxxxxx
xxxxxxxxxxxxxxxxxxxxxxxxxxxxxxxxxxxxxxxxxxxxxxxxxxxxxxxxxxxxxxxLS
KPEFNTYKRSGIVEVDRSExKEGLKRGETIKHAVSRGTAxxxxxxxxxxxxxxxxxxxxxxxxxxx
xxxxxxxxxxxxxTKGGLGHEEPIPMATYGWNLVKLHSGKDVFFVPPEKCDTLLCxxxxxxxxxxxx
xxxxxxxxxxxxxxxxxxxxxxxxxxxxxVVETLERMQRKHGGMLVxxxxxxxxxxxxxxxxxxxx
xxxxxxxxxxxxxxxxxxxTMAHRKPTFERDVDLGAGTRHVTVEPEVPNLDIIGQRIxxxxxxxxxxx
xxxxxxxxxxxxxxxxxxxxxxxxxxxxxxxxxxxxxxxxxxxxxxxxxxxxxxxxxxxxxxxxT
RTPKAKQGTAQIMEVTAKWLWDFLSRNxxxxxxxxxxxxxxxxxxxxxxxxxxxxxKEAVEDE
RFWNLVKKERELHKQGKxxxxxxxxxxxxxxxxxxxxxxxxxxxxxxxxxxxxxxxxxxxxxxxx
xxxxxxxxxxxxxRLGYILRDISKISGGNMYADDxxxxxxxxxDDLRNEARITDIMEPEHALLA
RSIFKLTYQNKVVRVQRPTKNGTVMDVISxxxxxxxxxxxxxxxxxxxxxIRQMESEEIFSPxx
xxxxxxxxxxxxxxxxxxxxxxxxxxxxVVKPIDDRFAAALTALNDMGKxxxxxxxxxxxxxxxx
xxxxxxxxxxxxxxxxxxxxxxxxxxxxxxxxxxxxxxxxxxxxxxxxxxxxxxxxxxxxxxxxx
xxxxxAANANCSAVPIDWVPTSRTTWxxxxxxxxxxxxxxxxxxxxxxxxxxxMEDKTHVSSWGDVP
YLGxxxxxxxxxxxxxxxxxxxxxxxxxxxxxxxRLIGNENYLDFMTSMKRFKNExxxxxxxxxxxx
xxxxx >DENV1|peptide_length:11|string5 xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxPTTLAFHLTTRGxxxxxxxxxxxxxxxx
xxxxTSAGVNMCTLVAxxxxxxxxxxxxxTYKCPRISEAEPDDVDxxxxxxxxxxxxxxxCSQIGEHRRDK
RxxxxxxxxxxxxxxxxxxxxxxxxxxxxxxxLRHPGFTMIALFLAxxxxxxxxxxxxxxxxxxxx
xxxxxxxxxxxxxxxxxxxxxxxxxxxxxxxxxxxxxxxxxxxxxxxxxxxxxxxxANPAVLRKLC
IxxxxxxxxxxxxxxxxxxxxxxxxxxxxxxxxxxxxxxxxxxxxxxxxxxxxxxxxxxTKLEGK
IVQHENLKYSVxxxxxxxxxxxxxVGNETTDHGTIATITPQAPTTEIQLTDYGVxxxxxxxxxxxxxEM
```

FIG. 54-22

```
VLLTMEKKSWxxxxxxxxxxxxxxxxxxxASQETWNRKDLxxxxxxxxxxxxxxxxxxxxxxxxxxxxx
xxxxxxxxxxxxxxxxxxxxxxxxLKMDKLTLKGVSYVMCTGxxxxxxxxxxxxxxxxxxxxxxxxADAP
CKIPFSTQDERGVTQNGRVITANPIVTDKEKPINIEAEPPFGESYITIGxxEEALKLSWFKKGSSIGK
MFVxxxxxxxxxxxxxxxxxxxxxxxxxxxxxGKLIHQVFGTAYGVxxxxxxxxxxxxxxxxxxxxxxx
xxRNTSLSMTCIVVGMVTLYxxxxxxxxxxxxxxxxxxxxxxxxxxxxxxxxxxxxxxxxxxxxxxxx
xxxxxxxxxxxxxxxxxxxxxxxxxxxxxxxxxxxxNHILLENDIKFTxxxxxxxxxxxxxKKMVRPQPM
EYKYSWRSWGKAxxxxxxxxxxxxxIDGPNTSECSDDQRAWNIWExxxxxxxxxxxxxxxxxRDSHTQ
MCDHRLMSxxxxxxxxxxxxxxxxxxxxxxxxxxxxxxxxxxxxxxxxxxxxxxxxxxxxxxxxxxPK
IYGGPMSQHNxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxRWSR
KMLMAGTLxxxxxxxxxGQLTWKDLIRLCIMVGANVSDRMGMGTTHLALxxxxxMRPMFAVGLLLRRLT
xxxxxxxxxIGLSLVACVELPNSLEELxxxxxxxxxMILKLLTDFQPxxxxxxxxxxxxxxxxxxxxxx
xxxxxxxxxVSLFPLCMSTTxxxxxxxxxxxxxSLGCKPLAMFLIAENEIWGRKSWPLxxxxxxxxxxxx
xxxxxxxxxxxxxxxxxxxxxxxxxxxxxxxxxxxxSADLSLDKAAEVSWEKEAEHSGASHNIFVEVQDDGT
xxxxxxxxxxxxxxxxxxxxLLAISGVYPLSIPxxxxxxxxxxxxxxxxxxxxWDTPSPPVVERAVLDx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxDKVFRKRNLTIxxxxxxxxxxxxxPAIVREAIKRKMRTLILAx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxRNYNKEGDQYIYxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxK
TSIGLLCVIASSxxxxxxxxxxxxxxxxxxxxxxxxxxxxxxxxxxxxxxxxxxxxxxxxxxxxxxxx
xxxxxxxxxxxTKKDLGIGHVVxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxEFNIYKRSGIVEVDxxxxKEGLKRGETIKxxxxxxxxxxxxxxxxxxxxxxxxxxxxxxxxxxxxxx
xxxxxxxxxxxxxxxxxxxxxxxxxxxxxxxxxxxxxxxxKDAFFIPPEKCDTxxxxxxxxxxxxxxxx
xxxxxxxxxxxxxxxxxxxxxxxxxxxxxxxxxxxxVETLEHMQRKHGGxxxxxxxxxxxxxxxxxxxx
xxxxxxxxxxxxxxxxxxxxxxxxxxxxxxxxxxxxTRHVAVEPEVPNLDIIxxxxxxxxxxxxxxxxx
xxxxxxxxxxxxxxxxxxxxxxxxxxxxxxxxxxxxxxxxxxxxxxxxxxxxxxxxxxxxxxxxxxxxT
RTPKAKRGTAQVMEVTARWLWGxxxxxxxxxxxxxxxxxxxxxxxxxxxxxxxxxxxxxxxxxxxxxxx
xxxxLVHKERELHKQGxxxxxxxxxxxxxxxxxxxxxxxxxxxxxxxxxxxxxxxxxxxxxxxxxxxx
xxxxxxxxxxxxxxxxxxxxxxxxRDISKIPGGSMYADDxxxxxxxxxxxxxxxxxEARITDIMEAEHALLA
TSIxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxPVNWVPTSRTTWxxxxxxxxxxxxxxxxxxxxxxxxxxxxxxMEDKTRVSSWEDVP
YLGxxxxxxxxxxxxxxxxxxxxxxxxxxxxxxxxxxxxxxIGNENYLDYMIxxxxxxxxxxxxxxxxx
xxxxx
```

FIG. 55-1

>DENV2|peptide_length:8|string1

```
MNNQRKKARSTPFNMLKRERNRVSTVQQLTKRFSLGMLQGRGPLKLFMALVAFLRFLTIPPTAGILKR
WGTIKKSKAINVLRGFRKEIGRMLNILNRRRRTAGxxxxxIPTA

FIG. 55-2

LAANAICSAVPSHWVPTSRTTWSIHAKHEWMTTEDMLAVWNRVWIQENPWMEDKTPVESWEEVPYLGK
REDQWCGSLIGLTSRATWAKNIQTAINQVRSLIGNEEYTDYMPSMKRFRREEEEAGVLW

>DENV2|peptide_length:8|string2 xNNQRKKAKNTPFNMLKxERNRVSTIQQLTKRFxxxxxxGRGPLKLFMAFVAFLRFLTIPPTVGILKR
WGTVKKSKAISVLRGFRREIGRMLNILNRRRRSAGxxxxxIPTVVAFHLTTRxGEPHMIVGINEKGKS
LLFKTENGTNMCTLMAMDLGELCEDTITYNCPFLKQNEPEDIxxxCNSTSTWVTYGTCSAMGEHRREK
xxVALVPHVRMGLxxxxxxxxxSSEGAWKHAQRIETWVLRHPGFTMMAAILAYTIGTTHFQRVLIFILL
AAITPSMTMRCIGMSNRDFVExxxxxxxxxxxxxxxxxxxxxxxxxxxPTLDFELIKTEAKHPATLRKFC
VEAKLTNTTTASRCPTQGEPSLKEEQDKRFICRHSMVDRGxxxxxxxxxxGGIVTCAMFRCKKNMEGK
VVLPENLEYTIVVTPHSGEENAVGNDTGKHGKEIKVTPQSSxAEAELTDYGTITMECSPRTSLDFNEM
VLLQMENKAWLVHRxxxxxxxxPWLPGADKQESNWIQKEMLVTFKNPHAKRQDVVVLGxxxxxxxxxx
xxATEIQMSLGNILFMGHLKCRLxxxxxxxxxxxxxxMCTGKFKVVKEIAETQHGTIVIRVQYEGDDSP
CKIPFEIMDLEKRYILGRLITVNPIVIEKDSPINIEAEPPFGDSYIIVGVEPGQLKLSWFKKGSSIGQ
MIETTMRGAxxxxxxxxTAWDFGSIGGVFTSVGKALHQVxxAIYGVAFSGVSWTMKILIGVVITWIGM
NxRSTSLSVSLVLVGIVTLYLGAVVQADTGCVVSWKSKELKCGSGIFVTDNVHTWxEQYKFQPDSPSK
LASAIQKAQEEDICGIRSVxxxENLMWKQITPELNHILAENEAKLTIMTGDIRGIMQVGRRSLRPQPT
ELKYSWKAWGKAKVLSTExYNHTFLIDGPETTECPNSNRAWNSLxVEDYGFGVFSTNIWLKLKEKQDx
ICDSKLMSAAVKDDRAVHADMGYWIESALNDTWKIEKASFIEVKNCYWPRSHTLWSNGVLESEMIIPK
NLAGPVSQHNYRPGYHTQIAGPWHLGKLEMDFDFCDGTTVIVTEECGNRGPSxxxxxxxxxxxxxxxx
xxxxxxxxxxxxxxxxxxxxxxxxxEIRPLKEKEENLVSSLVTAGHGQVDNFSLGILGMALLLEEMLRTRIGT
KHAxxxxxxxSFMTLITGNMSFKDLGRVVVMVGAxMADEMGMGITYLALLAAFRVRPTFAVGLFLRKLT
SKELMMTTIGIVLLSQSxxPETVLELTDALALGMMALKxVRDLEKYQLAVTVMAILCVPNAVILRHAW
KVSCTILAVVSVSPLFLTSSQQKTDWIPLVLTIKGLSPTxxFLTTLSRTNKTRSWPLNEAVMAVGMVS
xxxxxxxxxxxxxxxxxxxxxxxxxxxxxxSADLELERATDVRWEEQAEISGSSPILSITIAEDGS
MSIKNEEEEHILTILIRTGLLVISGLFPISMPITAAAWYLWETKKQRAGVxxDVPSPPPMERAELEDG
AYRIKQRGIFGYSQIGAxxxxxxxxxxxxxxVTRGAVLMHKGKRIEPSWADVRKDLVSYGGGWKxxxxx
xxxxxxxxxxxxxAVQTKPGIFKTNAGTIGAVSxxxxxGTSGSPIIDKKGKVVGLxxxGVVTR
SGTYVSSIAQTEKSIEDNPDIEDDIFRKRKLTIMDLHPGAGKTKKYLPAIVREAIRRGLRTLIxxxxx
xxxxxxxxxxxLPIRYQTPAIKTEHTGREIxxxxxxxxxxTMRLLSPIRVPNYNLxxxxxxxxxxxxx
xxxxxxxxxxxxxxxxxxxxxxxxxxxxxxxxPQSNAPIIDEEREIPERSWNSGHEWITNFKGKTVWF
VPSIKTGNDIAACLRKNGKRVIQLSRKTFDSEYIKTRANDWDFVVxxxxSEMGANFRAERVIDPxxxx
KPVILTDGEERVVLAGPMPVTHFSAAQRRGRVGRNPRNENDQYIxxxxxxxxxxxxxxxxxxxxxxxx
xxxxxxxxxxxxxEREKVDAVDGEYRLRxxxxKTFVDLMKRGDLPVWLAYRVASEGINYADRKWCFD
GVRNNQILEENMEVEVWTKEGERxxxxPRWLDARTYSDPLALxxxxxxAAGRKSLALSLITEMGRxPT
FMTQKTRNALDNLAVLHTAEVGGKAYTHALSELPxxLETLLLLGLLAAVTGGIFLFLMSGRGVGKMTL
GMCCIVTASVLLWHAQIQPHWxxxxxIILVFFLIVLLxxxxxxxxxxxDNQLTYVIIAILTLVAATMAN
xxxxLEKTKKDFGLGxxxxxQSEINILDIDLxxxxxxxxxYAVATTFITPMLRHSxxxxxxxxxxxxxx
xxxTVLMGLGRGWPLSKMDIGAPLLAIGCxxxxNPITLTAALFLLIAHYAIIGxxxxxxxTREAQKRT
AAGIMKNPTVDGITVIDLDPIPYDPKxxxxLGQVMLLVLCVTQVLxxxxxxxxxxxLTLATGPVSTLW
EGNPGKFWNTTIAxxxxxxxxxxxxxxxxGLLFSIMKNTTSxRRGTGNMGETLGEKWKNRLNALGKSEF
QIYKRSGIQEVDxxxxxxxxxxxxxxxxxxxxxxxxRWFVERNLVTPEGKVMDLGCGRGxxxYYCGG
LKNVKEVKGLTKxxxPGHEEPVPMSTYGWxxVRLQSGVDVFFIPPERCDTLLCDxxESSPNPTVEAGRT
LRVLSLVENWLNNNTQFCVKVLNPYMPSVIEKMETLQRQFGGALVRNxxxxxxxxxMYWVSNASGNIV
SSVxxxxxxLINRFTMRYKKTTYEPDVxxxSGTRNIGIENETPNMDIIGKRIEKIKQEHEISWHYDQD
xxxxxxxxxxxxxxxxxxxxxxxxSMVNGVVKLLTKPWDVLPTVTQMAMTxxxxxxxxxxxxxxxxxxx
xxEGTKKLMRITAEWLWKELGKEKKPRICTREEFTKKVRSNAALGAVFTDENKWxxAREAVEDGRFWE
LVDRERNLHLDGKCETCVxxxxxxxxxxxxxxxxxxxxxxxxxxxxxxxxxxxxxxxxxxEDHWFSRG
NSLSGVEGEGLHRLGYILRDVGRKAGGAMYADxxxGWDTRITIEDLKNEEMITNHMxGEHKRLAEAIF

FIG. 55-3

RLTYQNKVxxxQRPTSRGTVMDIISRKDQRGSGQVVTYGLNTFTNMGAQLIRQMEGEGVFKxxxxxxx
xxxxxxxxxxxREGRERLARMAISGDDCVVKPIDDRFANALTALNDMGKIRKDIQQWEPSKGWSDWTQ
VPFxSHHFHELVMKDGRTLVVPCRSQDELIGRxxxxQGAGWSLRETACLGKSYAQMWTLMYFHRRxxx
xxxxAICSAVPPHWVPTSRTTWSIHATHEWMTTEDMLTVWNRVWIRDNPWIEDKTPVESWEEIPYLGK
RExxxxxxxxxxxxxxTWAKNIQAAINQVRALIGEEGYIDYMPSMKRFRKEEEESGVLW >DENV2|peptide_length:8|string3 xNNQRKKARTTPFNMLKxxxxxxxxxxxxxxxxxxxxxxxxxxxxxxRLFMALVAxxxxxxxxxxxxxx
WGAIKKSRAINVLRGFRRxxxxxxxILNKRRRTAGxxxxxIPTVIAFHLTTRxxEPHMIVSKNEKGKS
LLFKTKDGINMCTLMAxxxxxxCEDTITYKCPLLKQNEPExxxxxxxxxxxWVTYGTCATMGEHRREx
xxxxxxxxxxxxxxxxxxxxxxxSEGAWKQAQRIETWILRHPGFTLMAAVLAYTVGTTYFQRALIFILL
TAVTPSMAMRCIGISxxxxxxxxxxxxxxxxxxxxxxxxxxxxxxxxxxxxxxxxLTKTEAKQPATLRKYC
VEAKLTNTTTDSRCPTQGEPTLSEEQDKRFVCRHSMVDxxxxxxxxxxxxxxIVTCAMFTCKKNMEGK
VVLPENLEYTVVITPHSGEEHAVGNDTGKHGQEVKITPQSSxSEAELTGYGTITMExxxxxxxxxxxx
xxxxMEEKAWLVHRxxxxxxxxPWLPGADKQGSNWIQxxxxxxxxxxxxxxxxxxxxxxxxxxxxxxx
xxxxxIQMSSGNILFxxxxxxxxxxxxxxxxxxxxxxxxxxxxxxxxxxHGTIVVRIQYEGDGSP
CRVPFEITDLEKKYILGRLITVNPIVAGKDNPINIEAExxFGDSYIVIGVEPGQLKLDWFKKGSSxGQ
MFATTMRxxxxxxxxxxxxxxDFGSLGGAFTSIGKAxxxxxxxxxxxxxxxxxSWIMKILIGAIITWIGM
xxxxxxxxVSLVLVGVVTLYLGAMVQADSGCIVSWKNKExxxxxxxxxxxxxxxxxxxxxxxxxxxxxx
xxxAIQKAHEEDICGIxxxxxxxxxLMWRQITSELNHILSENEVKLTIMTGDTKGIMQAGKRSLKPQPT
ELRYSWKTWGKAKMLPTExHNRTFLIDGPETTECPNSNRxxxxxxxxxDYGFGIFTTNIWLKLKERQDx
VCDSKLMSAAVKNNRAVHADMGYWMESRLNDTWKMxxASFIEIKSCHWPRSHTLxxxxxxxSEMVIPK
SFAGPVSQHNNRPGYYTQITGPWHLGRLEMDFDLCDGTTVVVTENCGNRGPxxxxxxxxxxxxxxxxx
xxxxxxxxxxxxxxxxxxxxxxxxxEREENLVNSLVTAGQGQIDNFSLGILGMALLLxxMLKTRMGT
KHAxxxxxxSLVTLITGNLxFKDLGRVIIMVGAxMTDDIGIGVTYLALxxxYRVRPTFAAGLFLRKLT
SKELLMATIGITLLSQSxxPGSVLELTDAIALGIMVLKxVRKMEKYQLAVTIMAMLCIPNVMILLNAW
KVGCTTLATVSVSPLILTSSRQKTDWIPLALTVKGLNxxxxFLTTLSRPNKTRSWPLxxxxxxxxxxx
xxxxxxxxxxxxxxxxxxxxxxxxxxxxxxxxxxxDLELEKAAEVKWDDQAEISGxxPILSVTISEDGS
xxxKNEEEEQILTILIRxxxxVISGLFPVSMPITAAxxxxxxxxxxxxxxxxDVPSPPPVGRAELEDG
xxRIKQRRILGYSQIxxxxxxxxxxxxxxxVTRGAVLVHKGKRIExxxADVKKDLVSYGxxxxxxxxx
xxxxxxxxxxxxxxxxxxxQTKPGLFRTSTGTIGAVxxxxxxxxSGSPIVDKKGKVVxxxxxxxxxxR
SGTYVSAIAQTEKNVENNPEIEDDIFRKRKLTIMDLxxxxxxxxxxxxxxxxxxxxxxxxxxxxxxxx
xxxxxxxxxxxxxxxxxxxxxxxxxRYQTPAIKAEHTGRExxxxxxxxxxxxxxxxxxxxxxxxxxxxxxx
xxxxxxxxxxxxxxxxxxxxxxxxxxxxxxxxPQSNAPIVDEEREIPERSWSTGYEWITNFEGKTxWF
VPSIRAGNDIAAxxxxxxxxxxxxxxKTFDSEYAKTRSNDWDFVVxxxxxxxxxxxxxxxxxxxxxxx
xxxxxADGEERVIxxxxxxxxxxxxGRIGRNPRNExxxxxxxxxxxxxxxxxxxxxxxxxxxxxxxxx
xxxxxxxxxxxxxxxxxxxxxxxxxxxxxxxxxxxxLPVWLAYKVAAEGINYTDRRWCFD
GIRNNQILEENMEVEVWTKxxxxxxxxxxxxxxxxxxxxxxxxxxxxxxxxxGRKSLTLSLITEMxxxxx
FMTQKARDALDNLAVLHTAEAGGKAYTHALSxxxxxxxxxLLLTLLAAVTGxxFLFLMSGKGVGKMTL
xxxxxxTASGLLWYAxxxxxxxxxxxxxxxxxxxxxxxxxxxxxxxxxVVIAILTLVxxxxxxx
xxxxxxKTKKDLGFGxxxxxEPEINILDIxxxxxxxxxxxxxxxxxxxxxxxxxxxxxxxxxxxxxxx
xxxxxxxxxxxxxxxxxxxxxxxxxxxxxxxxxxxxVTLTAALLSLMAHYAIIGxxxxxxxxxxxxxx
xxxxxxxxxxxGVTVIDLDPxxxxxxxxxxxxxxxxxxxxxxxxxxxxxxxxxxxxxxxxxxxxxxxx
xxxxxxxxxxxxxxxxxxxxxxxxxxxxxxxxxxFSIMKNTANxRRGTGNTGETLGEKWKSRLNALGRSEF
QTYKKSGIQxxxxxxxxxxxxxxxxxxxxxxxxxxxxxxFVERNMVAPEGKVVDxxxxxxxxxYYCGG
LKDVREVKLxxxxxxxxxxxxxxxxxxxxxxxSGVDVFFVPPEKCDTxxxxxxxxxxxxxxxxxxxx
xxxxNLVENWLNNDTQFCIKVxxxxxxSVIERMETLQRKFGGALVRxxxxxxxxxxxxxxxxxxxxxxx
xxxxxxxxxxxxxxxxxxxINRFTMRHKRATYEPxxxxxxxTRNIGIECEVPNLDIIGxxxxKIKEEHEASWHYDQD
xxxxxxxxxxxxxxxxxxxxxxxxxxxxLTKPWDVIPMVTQMAxxxxxxxxxxxxxxxxxxxxxxxxxx

FIG. 55-4

```
xxxxxxKLMKITAKWLWGELGRRKTPRICTRAEFCNKVRSNAAxxxxxxxxxxxxxAREAVEDSGFWE
LIEKERNLHLDxxxxxxxxxxxxxxxxxxxxxxxxxxxxxxxxxxxxxxxxxxxxxxxxxxxxxxxx
xxxxxVEGEGLYRLGYILREISKKAGGAMYxxxxxGWDTRITSEDLKNEEMITDQMxGRHKKLAEAIF
RxxxxxxxxxxxxxxxxxxxxxxxxxxxxxxxxxxxxxxxxxxxxxxxxxxxRQMEGEGLFKxxxxxxx
xxxxxxxxxxxRVGRERLTRMAISGDxxxxxxxDDRFARALTALNDxxxxxxxxxxWEPSKGWSDWTQ
xxxxxxxxxxxxMKDGRILVVPCRxxxxxxxxxxxxxxxxxxxxxxxxxxxxxxxxxxxxxxxxxxx
xxxxxxxxxxxxxxxxxxxTTWSIHASHEWMTTEDMLTVWNRVWILENPWIEDKTPVESWEDIPYLGK
RxxxxxxxxxxxxxxxTWAKNIQVAINQVRSLMGNEEYIDYMPSMKRFRSEEEESGVxx >DENV2|peptide_length:8|string4 xxNQRKKAKTxxxxxxxxxxxxxxxxxxxxxxxxxxxxxxxxxxxxxxxxxxxxxxxxxxxxxxxx
xxxxxxxxxxxxxxxxxxxxxxxxxxxxxLNRRRRSVGxxxxxxIPTAIAFHLTTxxxEPHMIVSIQEKGKS
LLFKTENGINMCTLxxxxxxxxxxxxTVTYKCPLLKQNxxxxxxxxxxxxxxWITYGTCTSTGEHRRE

FIG. 55-5

```
xxxxxxVENWLGSNTQFCVKxxxxxxxxSVIERMEAMQRKYGGAxxxxxxxxxxxxxxxxxxxxxxxxx
xxxxxxxxxxxxxxxxxxxxxxxxxxxxxxxxxxTRNIGTESETPNMDIIGxxxxKIKQEHEASWHxxxx
xxxxxxxxxxxxxxxxxxxxxxxxxxxxxxxxxxxKPWDVLPMVTQMAxxxxxxxxxxxxxxxxxxxxx
xxxxxxKLMRITAKWLWKELGRKKIPRMCTREEFARxxxxxxxxxxxxxxxxxxxAREAVEDERFWE
LVERERNLHLDxxxxxxxxxxxxxxxxxxxxxxxxxxxxxxxxxxxxxxxxxxxxxxxxxxxxxxxxx
xxxxxxxxxxxxKLGYILREISKKAGGAMxxxxxxxxxxxxxxxxxxKNEEMITGQMxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxREGRERLSRxxxxxxxxxxxxxxDDRFAKALTALNDxxxxxxxxxxxxxxxxxxxxx
xxxxxxxxxxxxMKDGRKLVVPCRxxxxxxxxxxxxxxxxxxxxxxxxxxxxxxxxxxxxxxxxxxxxx
xxxxxxxxxxxxxxxxxxxxxxxxTTWSIHARHEWMTTExxxxVWNRVWIQENPWIEDxxPVETWEEIxxxxx
xxxxxxxxxxxxxxxxxxxxxxxxRNIQTAINQVRSLIGSEEYxxxxxxxxxxxxxxxxxxxxxxx >DENV2|peptide_length:8|string5 xxDQRKKARNxxxxxxxxxxxxxxxxxxxxxxxxxxxxxxxxxxxxxxxxxxxxxxxxxxxxxxxxx
xxxxxxxxxxxxxxxxxxxxxxxxxxLNRRRRTVGxxxxxxxxxxxxxxxxxxEPHMIVSKNEKGKS
xxxxxxVGVNMCTLxxxxxxxxxxxxxxxTYNCPLLKQNxxxxxxxxxxxxxxxxxxxxxxxxxxxx
xxxxxxxxxxxxxxxxxxxxxxxxxxxxxxxxxLRHPGFTTMAAxxxxxxGTTHFQKALIFxxx
TAIAPSMAxxxxxxxxxxxxxxxxxxxxxxxxxxxxxxxxxxxxxxxxxxxxxxxxxxxxxxxxxx
xxxxxxxxxxxxxxxTQGEPSLVEEQDKxxxxxxxxxxxxxxxxxxxxxxxxxxxxxxxxxKMEGK
VVQxxxxxxxxxxxxxxxxxxxxxxxxxKHGMEIKVTPQxxxxxxxxxxxxxxxxxxxxxxxxxxxx
xxxxMGNKAWLVHxxxxxxxxxxxxLPGADIQGSNWIQxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxGEDSP
CKIPxxIMDLEKRYILGRLITVNPIATxxxxxxxxxxxxxxxxxxxxxxxxxxxxxxxxxxxxxxx
xxxxxxxxxxxxxxxxxxxxxxxxxxxxLGGVFTSMxxxxxxxxxxxxxxxxxxxxxxxxxxxxxxx
xxxxxxxxxTLVIVGVVILYLGAxxxxxxxxxxxxxxxxxxxxxxxxxxxxxxxxxxxxxxxxxxxx
xxxxxQKAYEEGIxxxxxxxxxxxxxxxxxxxxxxxxxxLTENEVKLTxxxGDIKGIMHAGRRSLRPQPT
QxxxxxxxxxxKAKMLSTGxHNRTFLIDxxKTTECPSSNRxxxxxxxxxxxxxxxxxxxIWLRLKEKQDx
xxxxxxxxxxxxxxxxxxxxxxxxxxxxxxxxxxxxxxxxxxxxxxxVKSCHWPRxxxxxxxxxxxxxxxx
NIAGPVSQHNYRLGYHTQxxxxxxxxxKLEMDFNFCEGTTVxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxFKDLGRVMxxxxxxMTDDIGIGVxxxxxxxxxxxxxxxxxxxxx
xxxxxxxTIGVALLSQSxxPENILELTDxxxxxxxxxxxxVKNLEKYQLAxxxMVISCVPNAVVLQNAW
KVGCxILAAVSVFxxxxxxxxxxxxxxxxxxxxxxxxxxxTLTRTSKKRSxxxxxxxxxxxxxxxxx
xxxxxxxxxxxxxxxxxxxxxxxxxxxxxxLELERAAEVKWEEQAEIxxxxxxxxxxxxxxxxxxxx
xxxxxxxxxxxxxxxxxxxxxxxxxVFPVSIPVxxxxxxxxxxxxxxxxxxxxVPSPPPMExxxxxxx
xxxxKQKRILGYSQxxxxxxxxxxxxxxxxxxxxxxxxxxxxxxxxxxxxxxxxxxxxxxxxxxxxx
xxxxxxxxxxxxxxxxxxxxxxxxxxKPGFFRTNAGTIGxxxxxxxxxxxxxxxxxxxxxxxxxxxx
xxxxxxxIAQTETSVExxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxHEWITDFKxxxxxxx
xxxxxxxxxxxxxxxxxxxxxxxKTFDTEYIKTRxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxKWCFD
GIRxxxxxxxxxxxxxxxxxxxxxxxxxxxxxxxxxxxxxxxxxxxxxxxxxxxxxxxxxxxxxxxx
xxxxxxxxxxxxxxxxxxxxxHSAEMGGRAYxxxxxxxxxxxxxxxxxxxxxxxxxxxFLMSARGIGKMTx
xxxxxxTASSLLWYAxxxxxxxxxxxxxxxxxxxxxxxxxxxxxxxxxxxxxxxxxxxxxxxxxxxx
xxxxxxxxxxxxxxxxxxxxxxQHESNILDxxxxxxxxxxxxxxxxxxxxxxxxxxxxxxxxxxxxx
xxxxxxxxxxxxxxxxxxxxxxxxxxxxxxxxxTAALLMLVAHxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
```

FIG. 55-6

```
xxxxxxxxxxxxxxxxxxxxxxxxxxxxxxxxxSIMKNTINxRRGTGTIGETLGExWKSRLNTLGKSEF
Qxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxNWLKNNTQFCIxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxEKPNLDIIGxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxKELGKKKTPRVCTREEFTxxxxxxxxxxxxxxxxxxxxxREAVEDNRFWE
LVERERNLHxxxxxxxxxxxxxxxxxxxxxxxxxxxxxxxxxxxxxxxxxxxxxxxxxxxxxxxxxxx
xxxxxxxxxxxxxxGYILRDISKKEGGTMxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxMKDGRMLVVPCRxxxxxxxxxxxxxxxxxxxxxxxxxxxxxxxxxxxxxxxxxxxx
xxxxxxxxxxxxxxxxxxxxxxxxxxxxxxxxxxxxxxxxxxWNKVWIQDNPWMEDxxxxxxxxxxxxxx
xxxxxxxxxxxxxxxxxxxxxxxxxxxxxxxRSLIGNEGxxxxxxxxxxxxxxxxxxxx >DENV2|peptide_length:9|string1

MNNQRKKARSTPFNMLKRERNRVSTVQQLTKRFSLGMLQGRG

FIG. 55-7

EMGFLEKTKKDLGLGxxxxxEPESNILDIDLRPASAWTLYAVATTFVTPMLRHSIENSSVNVSLTAIA
NQATVLMGLGKGWPLSKMDIGVPLLAIGCYSQVNPITLTAALLLLVAHYAIIGPGLQAKATREAQKRA
AAGIMKNPTVDGITVIDLDPIPYDPKFEKQLGQVMLLILCVTQVLMMRTTWALCEALTLATGPISTLW
EGNPGRFWNTTIAVSMANIFRGSYLAGAGLLFSIMKNTTNxRRGTGNIGETLGEKWKSRLNALGKSEF
QIYKKSGIQEVDRTLAKEGIKRGETDHHAVSRGSAKLRWFVERNMVTPEGKVVDLGCGRGGWSYYCGG
LKNVREVKGLTKGGPGHEEPIPMSTYGWNLVRLQSGVDVFFTPPEKCDTLLCDIGESSPNPTIEAGRT
LRVLNLVENWLNNNTQFCIKVLNPYMPSVIEKMEALQRKYGGALVRNPLSRNSTHEMYWVSNATGNIV
SSVNMISRMLINRFTMKHKKATYEPDVDLGSGTRNIGIESEIPNLDIIGKRIEKIKQEHETSWHYDQD
HPYKTWAYHGSYETKQTGSASSMVNGVVRLLTKPWDVVPMVTQMAMTDTTPFGQQRVFKEKVDTRTQE
PKEGTKKLMKITAEWLWKELGKKKTPRMCTREEFTRKVRSNAALGAIFTDENKWKSAREAVEDSRFWE
LVDKERNLHLEGKCETCVYNMMGKREKKLGEFGKAKGSRAIWYMWLGARFLEFEALGFLNEDHWFSRE
NSLSGVEGEGLHKLGYILRDVSKKEGGAMYADDTAGWDTRITLEDLKNEEMVTNHMxGEHKKLAEAIF
KLTYQNKVVRVQRPTPRGTVMDIISRRDQRGSGQVGTYGLNTFTNMEAQLIRQMEGEGIFKxxxxxxx
xxxxxxxxxxxRVGRERLSRMAISGDDCVVKPLDDRFASALTALNDMGKVRKDIQQWEPSRGWNDWTQ
VPFCSHHFHELIMKDGRVLVVPCRNQDELIGRARISQGAGWSLKETACLGKSYAQMWSLMYFHRRDLR
LAANAICSAVPSHWVPTSRTTWSIHAKHEWMTTEDMLAVWNRVWIQENPWMEDKTPVESWEEVPYLGK
REDQWCGSLIGLTSRATWAKNIQTAINQVRSLIGNEEYTDYMPSMKRFRREEEEAGVLW >DENV2|peptide_length:9|string2

MNNQRKKAKNTPFNMLKRERNRVSTIQQLTKRFSxxMLQGRGPLKLFMAFVAFLRFLTIPPTVGILKR
WGTVKKSKAISVLRGFRREIGRMLNILNRRRRSAGxxxxxIPTVVAFHLTTRNGEPHMIVGINEKGKS
LLFKTENGVNMCTLMAMDLGELCEDTITYNCPFLKQNEPEDIDxWCNSTSTWVTYGTCSAMGEHRREK
RSVALVPHVRMGLExxxxxxMSSEGAWKHAQRIETWVLRHPGFTMMAAILAYTIGTTHFQRVLIFILL
AAVTPSMTMRCIGMSNRDFVEGxxxxxxxxxxxxxxxxxxxxxxKPTLDFELIKTEAKHPATLRKFC
VEAKLTNTTTASRCPTQGEPSLKEEQDKRFICRHSMVDRGWxxxxxxxxKGGIVTCAMFRCKKNMEGK
VVLPENLEYTIVVTPHSGEENAVGNDTGKHGKEIKVTPQSSxAEAELTDYGTITMECSPRTSLDFNEM
VLLQMENKAWLVHRQxxxxxxLPWLPGADKQESNWIQKEMLVTFKNPHAKRQDVVVLGSxxxxxxxxx
xGATEIQMSLGNILFMGHLKCRLRxxxxxxxxxxxSMCTGKFKVVKEIAETQHGTIVIRVQYEGDDSP
CKIPFEIMDLEKRYILGRLITVNPIVIEKDSPINIEAEPPFGDSYIIVGVEPGQLKLSWFKKGSSIGQ
MIETTMRGAKxxxxxxDTAWDFGSIGGVFTSVGKALHQVFGAIYGAAFSGVSWTMKILIGVVITWIGM
NSRSTSLSVSLVLVGIVTLYLGAVVQADTGCIVSWKSKELKCGSGIFVTDNVHTWTEQYKFQPDSPSK
LASAIQKAQEEDICGIRSVTxLENLMWKQITPELNHILAENEVKLTIMTGDIRGIMQVGRRSLRPQPT
ELKYSWKAWGKAKVLSTExYNHTFLIDGPETTECPNSNRAWNSLEVEDYGFGVFTTNIWLKLKEKQDx
ICDSKLMSAAVKDDRAVHADMGYWIESALNDTWKIEKASFIEVKNCYWPRSHTLWSNGVLESEMIIPK
NLAGPVSQHNYRPGYHTQIAGPWHLGKLEMDFDFCDGTTVIVTEECGNRGPSLxxxxxxxxxxxxxxx
xxxxxxxxxxxxxxxxxxxMEIRPLKEKEENLVSSLVTAGHGQVDNFSLGILGMALLLEEMLRTRIGT
KHAxxxxxxSFMTLITGNMSFKDLGRVVVMVGAxxADEMGMGITYLALLAAFRVRPTFAVGLFLRKLT
SKELMMTTIGIVLLSQSxxPETVLELTDALALGMMALKxVRDLEKYQLAVTVMAILCVPNAVILRNAW
KVSCTILAVVSVSPLFLTSSQQKTDWIPLVLTIKGLSPTAIFLTTLSRTNKTRSWPLNEAVMAVGMVS
IxxxxxxxxxxxxxxxxxxxxxxxxxxxxxxxxxRSADLELERATDVRWEEQAEISGSSPILSITIAEDGS
MSIKNEEEEHILTILIRTGLLVISGLFPISMPITAAAWYLWETKKQRAGVLWDVPSPPPMERAELEDG
AYRIKQRGIFGYSQIGAGxxxxxxxxxxxxHVTRGAVLMHKGKRIEPSWADVRKDLVSYGGGWKLxxxx
xxxxxxxxxxxxxxxxRAVQTKPGIFKTNAGTIGAVSLxxxPGTSGSPIIDKKGKVVGLYxNGVVTR
SGTYVSSIAQTEKSIEDNPDIEDDIFRKRKLTIMDLHPGAGKTKKYLPAIVREAIRRGLRTLILxxxx
xxxxxxxxxxGLPIRYQTPAIKTEHTGREIVxxxxxxxFTMRLLSPIRVPNYNLIxxxxxxxxxxxxx
xxxxxxxxxxxxxxxxxxxxxxxxxxxxxxFPQSNAPIIDEEREIPERSWNSGHEWITNFKGKTVWF
VPSIKTGNDIAACLRKNGKRVIQLSRKTFDSEYIKTRANDWDFVVTxxISEMGANFRAERVIDPRxxM
KPVILTDGEERVVLAGPMPVTHFSAAQRRGRVGRNPRNENDQYIYxxxxxxxxxxxxxxxxxxxxxxx
xxxxxxxxxxxPEREKVDAVDGEYRLRGxxRKTFVDLMKRGDLPVWLAYRVASEGINYADRKWCFD

FIG. 55-8

```
GVRNNQILEENMEVEVWTKEGERKxxKPRWLDARTYSDPLALKxxxxFAAGRKSLALSLITEMGRLPT
FMTQKTRNALDNLAVLHTAEVGGKAYTHALSELPETLETLLLLGLLAAVTGGIFLFLMSGRGVGKMTL
GMCCIVTASVLLWHAQIQPHWIxxSIILVFFLIVLLIxxxxxxxxxQDNQLTYVIIAILTLVAATMAN
ExxFLEKTKKDFGLGxxxxxQSEINILDIDLRxxxxxxLYAVATTFITPMLRHSIxxxxxxxxxxxxx
xxATVLMGLGRGWPLSKMDIGAPLLAIGCYxxVNPITLTAALFLLIAHYAIIGPxxxxxATREAQKRT
AAGIMKNPTVDGITVIDLEPIPYDPKFxxQLGQVMLLVLCVTQVLMxxxxxxxxxALTLATGPVSTLW
EGNPGKFWNTTIAVxxxxxxxxxxxxxAGLLFSIMKNTTSxRRGTGNMGETLGEKWKNRLNALGKSEF
QIYKRSGIQEVDRxxxxxxxxxxxxxxxxxxxxLRWFVERNLVTPEGKVMDLGCGRGGxSYYCGG
LKNVKEVKGLTKGGPGHEEPVPMSTYGWNLVRLQSGVDVFFIPPERCDTLLCDIGESSPNPTVEAGRT
LRVLSLVENWLNNNTQFCVKVLNPYMPSVIEKMETLQRQFGGALVRNPxxxxxxxEMYWVSNASGNIV
SSVNxxxxMLINRFTMRYKKTTYEPDVDxGSGTRNIGIENETPNMDIIGKRIEKIKQEHEISWHYDQD
HPYRxxxxxxxxxxxxxxxxxxSSMVNGVVKLLTKPWDVLPTVTQMAMTDxxxxxxxxxxxxxxxxxx
xKEGTKKLMRITAKWLWKELGKEKKPRICTREEFTKKVRSNAALGAVFTDENKWKSAREAVEDGRFWE
LVDRERNLHLDGKCETCVYxxxxxxxxxxIGEFGKAKGxxxxxxxxxxxxxxxxxxxxxxxNEDHWFSRG
NSLSGVEGEGLHRLGYILRDVGRKAGGAMYADDxAGWDTRITIEDLKNEEMITNHMxGEHKRLAEAIF
RLTYQNKVVxVQRPTPKGTVMDIISRKDQRGSGQVVTYGLNTFTNMGAQLIRQMEGEGVFKxxxxxxx
xxxxxxxxxxxREGRERLARMAISGDDCVVKPIDDRFANALTALNDMGKIRKDIQQWEPSKGWSDWTQ
VPFCSHHFHELVMKDGRTLVVPCRSQDELIGRAxxSQGAGWSLRETACLGKSYAQMWTLMYFHRRDxx
xxxNAICSAVPPHWVPTSRTTWSIHATHEWMTTEDMLTVWNRVWIRDNPWIEDKTPVESWEEIPYLGK
REDxxxxxxxxxxxxATWAKNIQAAINQVRALIGEEGYIDYMPSMKRFRKEEEESGVLW >DENV2|peptide_length:9|string3

MNNQRKKARTTPFNMLKRxxxxxxxxxxxxxxxxxxxxxxxxxxxLRLFMALVAFxxxxxxxxxxTGILKR
WGTIKKSKAINVLRGFRRExxxxxNILNKRRRTAGxxxxxIPTVIAFHLTTRNGEPHMIVSKNEKGKS
LLFKTKDGTNMCTLMAMxxxxxLCEDTITYKCPLLKQNEPEDxxxxxxxxxxTWVTYGTCATMGEHRREK
xxxxxxxxxxxxxxxxxxxxxxxSSEGAWKHAQRIETWILRHPGFTLMAAVLAYTVGTTYFQRALIFILL
TAIAPSMAMRCIGISNxxxxxxxxxxxxxxxxxxxxxxxxxxxxxELIKTEAKQPATLRKYC
IEAKLTNTTTDSRCPTQGEPTLSEEQDKRFVCRHSMVDRxxxxxxxxxxxxGIVTCAMFTCLKNMEGK
VVQPENLEYTVVITPHSGEEHAVGNDTGKHGQEVKITPQSSxAEAELTGYGTITMECxxxxxxxxxx
xxxxMEEKAWLVHRQxxxxxxLPWLPGADKQGSNWIQKEMxxxxxxxxxxxxxxxxxxxxxxxxxxx
xxxxEIQMSSGNILFMxxxxxxxxxxxxxxxxxxxxxxxxxxxxxxxQHGTIVIRIQYEGDGSP
CRVPFEITDLEKKYILGRLITVNPIVAGKDNPINIEAEPPFGDSYIVIGVEPGQLKLDWFKKGSSIGQ
MFATTMRGxxxxxxxxxxxxxWDFGSLGGAFTSIGKALxxxxxxxxxxVAFNGVSWTMKILIGAIITWIGM
NxxxxxxSVSLVLVGVVTLYLGAMVQADSGCVVSWKSKELxxxxxxxxxxxxxxxxxxxxxxxxxxx
xxSAIQKAHEEDICGIRxxxxxxNLMWRQITSELNHILSENEAKLTIMTGDTKGIMQAGKRSLKPQPT
ELRYSWKTWGKAKMLPTExHNRTFLIDGPETTECPNSNRAxxxxxxEDYGFGVFSTNIWLKLKERQDx
SCDSKLMSAAVKNNRAVHADMGYWMESRLNDTWKMEKASFIEIKSCHWPRSHTLWxxxxxESEMVIPK
SFAGPVSQHNNRPGYYTQTTGPWHLGRLEMDFDLCDGTTVVVTENCGNRGPSxxxxxxxxxxxxxxxx
xxxxxxxxxxxxxxxxxxxxxxxxxKEREENLVNSLVTAGQGQIDNFSLGILGMALLLEEMLKTRVGT
KHAxxxxxxxSLVTLITGNLSFKDLGRVIIMVGAxxTDDIGIGVTYLALLxAFRVRPTFAAGLLLKKLT
SKELLMATIGITLLSQSxxPGTVLELTDAIALGIMVLKxVRKMEKYQLAVTIMTMLCIPNVMILQHAW
KVGCTTLATVSVSPLILTSSRQKTDWIPLALTIKGLSPxxIFLTTLSRPNKTRSWPLNxxxxxxxxxx
xxxxxxxxxxxxxxxxxxxxxxxxxxxxxxxADLELEKAAEVKWDDQAEISGSSPILSVTISEDGS
MxIKNEEEEQILTILIRTxxLVISGLFPVSMPITAAAxxxxxxxxxxxxxxxxWDVPSPPPVGRAELEDG
AYRIKQRRILGYSQIGxxxxxxxxxxxxxxxHVTRGAVLHKGKRIEPxWADVKKDLVSYGGxxxxxxxx
xxxxxxxxxxxxxxxxxxxxxxxxxxxxxVQTKPGLFRTSTGTIGAVSxxxxxxxTSGSPIVDKKGKVVGxxxxxxxTR
SGTYVSAIAQTEKNVENNPEIEDDIFRKRKLTIMDLHxxxxxxxxxxxxxxxxxxxxxxxxxxxxxxx
xxxxxxxxxxxxxxxIRYQTPAIKAEHTGREIxxxxxxxxxxxxxxxxxxxxxxxxxxxxxxxxxxxx
xxxxxxxxxxxxxxxxxxxxxxxxxxxxxxxxFPQSNAPIVDEEREIPERSWSTGHEWITNFEGKTVWF
```

FIG. 55-9

```
VPSIRAGNDIAACxxxxxxxxxxxxxRKTFDTEYTKTRSNDWDFVVTxxxxxxxxxxxxxxxxxxxxxx
xxxxLTEGEERVILxxxxxxxxxxxxxxRGRIGRNPRNENxxxxxxxxxxxxxxxxxxxxxxxxxxxx
xxxxxxxxxxxxxxxxxxxxxxxxxxxxxxxxxxxxxxxxxxDLPVWLAYKVAAEGINYTDRRWCFD
GIRNNQILEENMEVEVWTKExxxxxxxxxxxxxxxxxxxxxxxxxxxxxAGRKSLTLSLITEMGxxxT
FMTQKARDALDNLAVLHTAEAGGKAYTHALSExxxxxxxLLLLTLLAAVTGGIFLFLMSGKGVGKMTL
GxxxxxTASGLLWYAxxxxxxxxxxxxxxxxxxxxxxxxxxxxxxxxxYVVIAILTLVAxxxxx
xxxxxEKTKKDLGFGxxxxxEPEINILDIDxxxxxxxxxxxxxxxxxxxxxxxxxxxxxxxxxxxxx
xxxxxxxxxxxxxxxxxxxxxxxxxxxxxxxxxxxPITLTAALLSLMAHYAIIGPxxxxxxxxxxxxx
xxxxxxxxxxDGVTVIDLDPIxxxxxxxxxxxxxxxxxxxxxxxxxxxxxxxxxxxxxxxxxxxxxx
xxxxxxxxxxxxxxxxxxxxxxxxxxxxxxxLFSIMKNTANxRRGTGNTGETLGEKWKSRLNALGRSEF
QTYKKSGIQExxxxxxxxxxxxxxxxxxxxxxxxxxxWFVERNLVAPEGKVVDLxxxxxxxxSYYCGG
LKDVREVKGLTxxxxxxxxxxxxxxxxxxxxxQSGVDVFFVPPEKCDTLxxxxxxxxxxxxxxxxxx
xxxLNLVENWLNNDTQFCIKVLxxxxPSVIERMETLQRKFGGALVRNxxxxxxxxxxxxxxxxxxxxx
xxxxxxxxxLINRFTMRHKKTTYEPDxxxxxGTRNIGIECEVPNLDIIGKxxEKIKEEHEASWHYDQD
HxxxxxxxxxxxxxxxxxxxxxxxxxxxxxxLLTKPWDVIPMVTQMAMxxxxxxxxxxxxxxxxxxx
xxxxxKKLMRITAEWLWGELGRRKTPRICTRAEFCNKVRSNAALxxxxxxxxxxxSAREAVEDSGFWE
LIEKERNLHLDGxxxxxxxxxxxxxxxxxxxxxxxxxxxxxxxxxxxxxxxxxxxxxxxxxxxxxx
xxxxGVEGEGLHRLGYILREISKKAGGAMYAxxxAGWDTRITSEDLKNEEMITDQMxGRHKKLAEAIF
RLxxxxxxxxxxxxxxxxxxxxxxxxxxxxxxxxxxxxxxxxxxxxxxxxxIRQMEGEGLFKxxxxxxx
xxxxxxxxxxRVGRERLTRMAISGDDxxxxxxDDRFARALTALNDMxxxxxxxxQWEPSKGWSDWTQ
VxxxxxxxxxxxMKDGRILVVPCRxxxxxxxxxxxxxxxxxxxxxxxxxxxxxxxxxxxxxxxxxxx
xxxxxxxxxxxxxxxxxxxxRTTWSIHASHEWMTTEDMLTVWNRVWILENPWMEEKTPVESWEDIPYLGK
RExxxxxxxxxxxxxATWAKNIQVAINQVRSLMGNEEYIDYMPSMKRFSEEEESGVLxx >DENV2|peptide_length:9|string4 xNNQRKKAKTxxxxxxxxxxxxxxxxxxxxxxxxxxxxxxxxxxxxxxxxxxxxxxxxxxxxxxxx
xxAIKKSKAINILRxxxxxxxxxxxxILNRRRRSVGxxxxxIPTAIAFHLTTRxGEPHMIVSIQEKGKS
LLFKTENGINMCTLMAMxxxxxxxDTVTYKCPLLKQNExxxxxxxxxxxxxTWITYGTCTSTGEHRREK
xxxxxxxxxxxxxxxxxxxxxxxxxxQAQRIETWILRHPGFAIMAAxxxxTIGTTHFQRTLIFILL
TTVAPSMTMRxxxxxxxxxxxxxxxxxxxxxxxxxxxxxxxxxxxxxELTKTEAKESATLRKYC
Ixxxxxxxxxxxxxxxxxxxx PTQGEPSLVEEQDKRFLCKHSMVDRxxxxxxxxxxxxxGIVTCAMFTCKKKMKGK
VVQPENxxxxxxVTPHSGEEHSVGDDTGKHGKEIKITPQSPxSEAELTDYGxxxxxxxxxxxxxxxxxx
xxxxMESKAWLVHRQxxxxxxxxxWLPGADTQESNWIQKEMxxxxxxxxxxxxxxxxxxxxxxxxxxxx
xxxxxxxxxxxxxxxxxxxxxxxxxxxxxxxxxxxxxxxxxxxxxxxxxxxxxxVVRLQYEGDGSP
CKVPFEIMDLERRYILGRLITVNPIITEKDNPINIExxxxxxxxxxxxxxxxxxxxxxxxxxxxxxx
xxxxxxxxxxxxxxxxxxxxxxxxxxxSLGGAFTSIGxxxxxxxxxxxxxxxxxxxWIMKIFIGVIIxxxxx
xxxxxxxxVTLVLVGVITLYLGVMVQADSGCIVSWKNxxxxxxxxxxxxxxxxxxxxxxxxxxxxxxx
xxxAIQKAYEEGICGIRxxxxxxxxxxxxxxxxxxxILSENEVKLTIMTGEIKGIMQAGKRYLQPQPT
QLKYSWKTWGKAKILSTExQNQTFLIDGxxTVECPNTNRAxxxxxxxxxxxxIFTTNIWLRLREKQDx
VCDSKLMSAAIKNNRAVHAxxxxxxxxxxxxxxxxxxxSFIEVKSCHWPRSHTxxxxxxxxxxxxxIPK
GFAGPVSQHNYRPGYHTQITGPWHLGKLEMDFEFCDGTTVVVTENCGNRxxxxxxxxxxxxxxxxxxx
xxxxxxxxxxxxxxxxxxxxxxxxxxxxxxxxxxxxxxxxxxxxLGVLGMALLExxxRTRMGT
KHAxxxxxxxxFVTLITGNLSFRDLGRVVVMVGTxxTDDIGIGVTYLAxxxAYKVRPTFAAGLLLKKLx
xxELMMATIGVVLLSQSxxPESILELTDALALGMMILKxVRSMEKYQLAVTIMVILCVPNAVILLNAW
KVSCTILATVSVSPLLLTSSRQKADxxxxxxxxxxxxxxxFLTTLSRPNKIRSWPLxxxxxxxxxxx
xxxxxxxxxxxxxxxxxxxxxxxxxxxxxxxxxxxxxxxxxDLELEKAADVRWEDQAEISxxxxxxxxxxx
xxxxxxxxxxxxxxxxxxxxxxxxxxxISGLFPVSMPITxxxxxxxxxxxxxxxxxxxxDVPSPPPIGxxxxxxx
xYRIKQKGIFGYSQIxxxxxxxxxxxxxxxxxxxxTRGAVLTHKGKRIEPxxxxxxxxxxxxxxxxxx
xxxxxxxxxxxxxxxxxxxxVQTKPGLFKTSTGTIGAxxxxxxxxxxxxxxxxxxxxxxxxxxxxxxx
```

FIG. 55-10

```
xxxxxSAIAQTEKGIEDNPEIEDHIFRKRRLxxxxxxxxxxxxxxxxxxxxxxxxxxxxxxxxxxx
xxxxxxxxxxxxxxRYQTTAIKTEHTGxxxxxxxxxxxxxxxxxxxxxxxxxxxxxxxxxxxxxx
xxxxxxxxxxxxxxxxxxxxxxxxxxxxxxxxxxxxxxxxSWNSGYEWITDFKGKTVxx
xxxxxxxxxxxxxxxxxxxxxxxxxxRKTFDSEYAKTRxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxVWLAFKVASEGISYADRRWCFD
GTRNNQILEENIEVEIWTKExxxxxxxxxxxxxxxxxxxxxxxxxxxxxxxxxxxxxxxxxxxxx
xxxxxxxxxxxxxxxLHTAEVGGRAHNHALSExxxxxxxxxxxxxxxxxxxxxLFLMSGRGVGKMTL
GxxxxxTASILLWHAxxxxxxxxxxxxxxxxxxxxxxxxxxxxxxxxxxxxxxxxxxxxxxxxxx
xxxxxxxxxxxxxxxxxxxQHESNILDIDxxxxxxxxxxxxxxxxxxxxxxxxxxxxxxxxxxxx
xxxxxxxxxxxxxxxxxxxxxxxxxxxxVTLTAALLLLMAHYAIIxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxFSIMRNTTSxRRGTGNVGETLGEKWKNRLNSLGKNEF
QIYKKSxxxxxxxxxxxxxxxxxxxxxxxxxxxxxxxxxxxMVAPEGKVVxxxxxxxxxxxxYCGG
LKSVREVKGLxxxxxxxxxxxxxxxxxxxxxxxxxQSGIDVFFTPPERCDTLxxxxxxxxxxxxxx
xxxxxLVENWLGSNTQFCVKVxxxxxPSVIERMEALQRRYGGALxxxxxxxxxxxxxxxxxxxxxx
xxxxxxxxxxxxxxxxxxxRHKRATYEPxxxxxxGTRNIGTESETPNMDIIGKxxEKIKQEHEASWHYxxx
xxxxxxxxxxxxxxxxxxxxxxxxxxxxxxxxxxxTKPWDVLPMVTQMAMxxxxxxxxxxxxxxxx
xxxxxKKLMKITAKWLWKELGRKKIPRVCTREEFARKVRSxxxxxxxxxxxxxxSAREAVEDERFWE
LVERERNLHLDGxxxxxxxxxxxxxxxxxxxxxxxxxxxxxxxxxxxxxxxxxxxxxxxxxxxxx
xxxxxxxxxxxHKLGYILREISKKAGGAMYxxxxxxxxxxxxxxLKNEEMITGQMxxxxxxxxxxx
xxxxxxxxxxxxxxxxxxxxxxxxxxxxxxxxxxxxxxxxxxxxxxxxxxxxxxxxxxxxxxxxx
xxxxxxxxxxxREGRERLSRMxxxxxxxxxxxxxDDRFAKALTALNDMxxxxxxxxxxxxxxxxx
xxxxxxxxxxxMKDGRKLVVPCRxxxxxxxxxxxxxxxxxxxxxxxxxxxxxxxxxxxxxxxxxx
xxxxxxxxxxxxxxxxxRTTWSIHARHEWMTTEDxxTVWNRVWIQENPWIEDKTPVETWEEIPxxxx
xxxxxxxxxxxxxxxxxxxxxxARNIQTAINQVRSLIGSEEYxxxxxxxxxxxxxxxxxxxxxxx
```

>DENV2|peptide_length:9|string5

```
xNDQRKKARNxxxxxxxxxxxxxxxxxxxxxxxxxxxxxxxxxxxxxxxxxxxxxxxxxxxxxxx
xxxxxxxxxxxxxxxxxxxxxxxxILNRRRRTVGxxxxxxxxxxxxxxxxxxxxxGEPHMIVSKNEKGKS
LxxxxxVGTNMCTLMALxxxxxxxxxxxTYNCPLLKQNExxxxxxxxxxxxxxxxxxxxxxxxxx
xxxxxxxxxxxxxxxxxxxxxxxxxxxxxxxxxLRHPGFTTMAAxxxxxxGTTHFQKVLIFILL
TAIAPSMAMxxxxxxxxxxxxxxxxxxxxxxxxxxxxxxxxxxxxxxxxxxxxxxxKQSATLRKYx
xxxxxxxxxxxxxxPTQGEPSLSEEQDKRxxxxxxxxxxxxxxxxxxxxxxxxxCAKFSCKKNMKGK
VVQPxxxxxxxxxxxxxxxxxxGKHGMEIKVTPQSxxxxxxxxxxxxxxxxxxxxxxxxxxxxxx
xxxxMGNKAWLVHRxxxxxxxxxxWLPGADIQGSNWIQKxxxxxxxxxxxxxxxxxxxxxxxxxx
xxxxxxxxxxxxxxxxxxxxxxxxxxxxxxxxxxxxxxxxxxxxxxxxxxxxxxxxIRLQYEGDGSP
CKTPFEIMDLEKRYILGRLITVNPIATxxxxxxxxxxxxxxxxxxxxxxxxxxxxxxxxxxxxxx
xxxxxxxxxxxxxxxxxxxxxSLGGMFTSIGxxxxxxxxxxxxxxxxxxxxxTMKIFIGVIxxxxxx
xxxxxxxxVSLILVGVVILYLGAxxxxxxxxxxxxxxxxxxxxxxxxxxxxxxxxxxxxxxxxxx
xxxxIQKAHEDGICxxxxxxxxxxxxxxxxxxxxILTENEVKMTIMTGDIKGIMHAGRRSLRPQPT
QLxxxxxxxGKAKMLSTGxHNRTFLIDGxxTTECPSSNRAxxxxxxxxxxxxxxTTNIWLRLKEKQDx
xxxxxxxxxxxxxxxxxxxxxxxxxxxxxxxxxxxxxEVKSCHWPRSxxxxxxxxxxxxxxxxxK
NIAGPVSQHNNRPGYYTQxxxxxxxGKLEMDFNFCEGTTVxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxSFKDLGRVMVMxxxxxTDDIGIGVTxxxxxxxFKVRPTFVAGLLLRKxx
xxxxxxxxTIGVALLSQSxxPENILELTDALxxxxxxxxxxVKNLEKYQLAVxxxxxISCVPNAVVLQNAW
xxxxxILAAVSVFPLLLTSSQxxxxxxxxxxxxxxxxxxxxxFLTTLTRTSKKRSWxxxxxxxxxxxx
xxxxxxxxxxxxxxxxxxxxxxxxxxxxxxxDLELERAAEVKWEEQAEISxxxxxxxxxxxxxxx
```

FIG. 55-11

```
xxxxxxxxxxxxxxxxxxxxxxxxxxGVFPVSIPVTxxxxxxxxxxxxxxxxxxxDVPSPPPMExxxxxxx
xxxIKQKRILGYSQIxxxxxxxxxxxxxxxxxxxxxxxxxxxxxxxxxxxxxxxxxxxxxxxxxxxxxxxx
xxxxxxxxxxxxxxxxxxxxxxxTKPGFFRTNAGTIGAxxxxxxxxxxxxxxxxxxxxxxxxxxxxxxxxx
xxxxxxSIAQTETSIEDNPEIEExxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxGHEWITNFEGxxxxx
xxxxxxxxxxxxxxxxxxxxxxxxxxxxRKTFDTEYIKTRxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxYKVASEGISxxxRKWCFD
GIRNxxxxxxxxxxxxxxxxxxxxxxxxxxxxxxxxxxxxxxxxxxxxxxxxxxxxxxxxxxxxxxxxxxx
xxxxxxxxxxxxxxxLHSAEMGGRAYxxxxxxxxxxxxxxxxxxxxxxxxxxLFLMSARGIGKMTL
xxxxxxxTASSLLWYAxxxxxxxxxxxxxxxxxxxxxxxxxxxxxxxxxxxxxxxxxxxxxxxxxxxxxxx
xxxxxxxxxxxxxxxxxxxxxxxxxQHESNILDIxxxxxxxxxxxxxxxxxxxxxxxxxxxxxxxxxxxxx
xxxxxxxxxxxxxxxxxxxxxxxxxxxxxxxxxxxxTTLTAALLSLIAHYAIIxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxFSIMKNTINxRRGTGTIGETLGEKWKSRLNTLGKNEF
QIYKKxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxFIPPERCDTxxxxxxxxxxxxxxxxxxxx
xxxxxxxVENWLNNNTKFCIKxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxEKPNLDIIGKxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxRITAKWLWKELGKKKTPRMCTREEFAxxxxxxxxxxxxxxxxxxxxxAREAVEDNRFWE
LVERERNLHLxxxxxxxxxxxxxxxxxxxxxxxxxxxxxxxxxxxxxxxxxxxxxxxxxxxxxxxxxxxxx
xxxxxxxxxxxKLGYILRDVSRKAGGAIYxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxMKDGRMLVVPCRxxxxxxxxxxxxxxxxxxxxxxxxxxxxxxxxxxxxxxxxxxxxxxxx
xxxxxxxxxxxxxxxxxxxxxxxxxxxxxxxxxxxxxxxxTVWNKVWIQDNPWMEDKxxxxxxxxxxxxxx
xxxxxxxxxxxxxxxxxxxxxxxxxxxxxxVRSLIGNEGYxxxxxxxxxxxxxxxxxxxx >DENV2|peptide_length:10|string1

MNNQRKKARSTPFN

FIG. 55-12

SKELMMATIGIALLSQSxxPETILELTDALALGMMVLKxxxNMEKYQLAVTIMAISCVPNAVILQNAW
KVSCTILAAVSVSPLLLTSSQQKADWIPLALTIKGLNPTAIFLTTLSRTSKKRSWPLNEAIMAVGMVS
ILASSLLKNDIPMTGPLVAGGLLTVCYVLTGRSADLELERAADVKWEDQAEISGSSPILSITISEDGS
MSIKNEEEEQTLTILIRTGLLVISGVFPVSIPITAAAWYLWEVKKQRAGVLWDVPSPPPVGKAELEDG
AYRIKQKGILGYSQIGAGVYKEGTFHTMWHVTRGAVLMHRGKRIEPSWADVKKDLISYGGGWKLEGEW
KEGEEVQVLALEPGKNPRAVQTKPGLFKTNTGTIGAVSLDFSPGTSGSPIVDRKGKVVGLYGNGVVTR
SGAYVSAIAQTEKSIEDNPEIEDDIFRKKRLTIMDLHPGAGKTKRYLPAIVREAIKRGLRTLILAPTR
VVAAEMEEALRGLPIRYQTPAIRAEHTGREIVDLMCHATFTMRLLSPVRVPNYNLIIMDEAHFTDPAS
IAARGYISTRVEMGEAAGIFMTATPPGSRDPFPQSNAPIMDEEREIPERSWNSGHEWVTDFKGKTVWF
VPSIKAGNDIAACLRKNGKKVIQLSRKTFDSEYVKTRTNDWDFVVTTDISEMGANFKAERVIDPRRCM
KPVILTDGEERVILAGPMPVTHSSAAQRRGRIGRNPKNENDQYIYMGEPLENDEDCAHWKEAKMLLDN
INTPEGIIPSMFEPEREKVDAIDGEYRLRGEARKTFVDLMRRGDLPVWLAYKVAAEGINYADRRWCFD
GIKNNQILEENVEVEIWTKEGERKKLKPRWLDARIYSDPLALKEFKEFAAGRKSLTLNLITEMGRLPT
FMTQKARDALDNLAVLHTAEAGGRAYNHALSELPETLETLLLLTLLATVTGGIFLFLMSGKGIGKMTL
GMCCIITASxLLWYAQIQPHWIAASIILEFFLIVLLIPEPEKQRTPQDNQLTYVVIAILTVVAATMAN
EMGFLEKTKKDLGLGxxxxxEPESNILDIDLRPASAWTLYAVATTFVTPMLRHSIENSSVNVSLTAIA
NQATVLMGLGKGWPLSKMDIGVPLLAIGCYSQVNPITLTAALLLLVAHYAIIGPGLQAKATREAQKRA
AAGIMKNPTVDGITVIDLDPIPYDPKFEKQLGQVMLLILCVTQVLMMRTTWALCEALTLATGPISTLW
EGNPGRFWNTTIAVSMANIFRGSYLAGAGLLFSIMKNTTNxRRGTGNIGETLGEKWKSRLNALGKSEF
QIYKKSGIQEVDRTLAKEGIKRGETDHHAVSRGSAKLRWFVERNMVTPEGKVVDLGCGRGGWSYYCGG
LKNVREVKGLTKGGPGHEEPIPMSTYGWNLVRLQSGVDVFFTPPEKCDTLLCDIGESSPNPTIEAGRT
LRVLNLVENWLNNNTQFCIKVLNPYMPSVIEKMEALQRKYGGALVRNPLSRNSTHEMYWVSNATGNIV
SSVNMISRMLINRFTMKHKKATYEPDVDLGSGTRNIGIESEIPNLDIIGKRIEKIKQEHETSWHYDQD
HPYKTWAYHGSYETKQTGSASSMVNGVVRLLTKPWDVVPMVTQMAMTDTTPFGQQRVFKEKVDTRTQE
PKEGTKKLMKITAEWLWKELGKKKTPRMCTREEFTRKVRSNAALGAIFTDENKWKSAREAVEDSRFWE
LVDKERNLHLEGKCETCVYNMMGKREKKLGEFGKAKGSRAIWYMWLGARFLEFEALGFLNEDHWFSRE
NSLSGVEGEGLHKLGYILRDVSKKEGGAMYADDTAGWDTRITLEDLKNEEMVTNHMxGEHKKLAEAIF
KLTYQNKVVRVQRPTPRGTVMDIISRRDQRGSGQVGTYGLNTFTNMEAQLIRQMEGEGIFKxxxxxxx
xxxxxxxxxxxRVGRERLSRMAISGDDCVVKPLDDRFASALTALNDMGKVRKDIQQWEPSRGWNDWTQ
VPFCSHHFHELIMKDGRVLVVPCRNQDELIGRARISQGAGWSLKETACLGKSYAQMWSLMYFHRRDLR
LAANAICSAVPSHWVPTSRTTWSIHAKHEWMTTEDMLAVWNRVWIQENPWMEDKTPVESWEEVPYLGK
REDQWCGSLIGLTSRATWAKNIQTAINQVRSLIGNEEYTDYMPSMKRFRREEEEAGVLW >DENV2|peptide_length:10|string2

MNNQRKKAKNTPFNMLKRERNRVSTIQQLTKRFSLGMLQGRGPLKLFMAFVAFLRFLTIPPTAGILKR
WGTVKKSKAISVLRGFRREIGRMLNILNRRRRSAGxxxxxIPTVVAFHLTTRNGEPHMIVGINEKGKS
LLFKTENGVNMCTLMAMDLGELCEDTITYNCPFLKQNEPEDIDCWCNSTSTWVTYGTCSAMGEHRREK
RSVALVPHVRMGLETxxxxWMSSEGAWKHAQRIETWVLRHPGFTMMAAILAYTIGTTHFQRVLIFILL
AAVTPSMTMRCIGMSNRDFVEGVxxxxxxxxxxxxxxxxxxxNKPTLDFELIKTEAKHPATLRKFC
VEAKLTNTTTASRCPTQGEPSLKEEQDKRFICRHSMVDRGWGxxxxxxGKGGIVTCAMFRCKKNMEGK
VVLPENLEYTIVVTPHSGEENAVGNDTGKHGKEIKVTPQSxxAEAELTDYGTIITMECSPRTSFDFNEM
VLLQMENKAWLVHRQWxxxxPLPWLPGADKQESNWIQKEMLVTFKNPHAKRQDVVVLGSQxxxxxxxx
TGATEIQMSLGNILFMGHLKCRLRMxxxxxxxxxYSMCTGKFKVVKEIAETQHGTIVIRVQYEGDDSP
CKIPFEIMDLEKRYILGRLITVNPIVIEKDSPINIEAEPPFGDSYIIVGVEPGQLKLSWFKKGSSIGQ
MIETTMRGAKRxxxxGDTAWDFGSIGGVFTSVGKALHQVFGAIYGAAFSGVSWTMKILIGVVITWIGM
NSRSTSLSVSLVLVGIVTLYLGAVVQADTGCIVSWKSKELKCGSGIFVTDNVHTWTEQYKFQPDSPSK
LASAIQKAQEEDICGIRSVTRLENLMWKQITPELNHILAENEVKLTIMTGDIRGIMQVGRRSLRPQPT

FIG. 55-13

ELKYSWKAWGKAKVLSTExYNHTFLIDGPETTECPNSNRAWNSLEVEDYGFGVFTTNIWLKLKEKQDx
ICDSKLMSAAVKDDRAVHADMGYWIESALNDTWKIEKASFIEVKNCYWPRSHTLWSNGVLESEMIIPK
NLAGPVSQHNYRPGYHTQIAGPWHLGKLEMDFDFCDGTTVIVTEECGNRGPSLRxxxxxxxxxxxxxx
xxxxxxxxxxxxxxxxxxGMEIRPLKEKEENLVSSLVTAGHGQVDNFSLGILGMALFLEEMLRTRIGT
KHAxxxxxxSFMTLITGNMSFKDLGRVVVMVGAxxADEMGMGITYLALLAAFRVRPTFAVGLFLRKLT
SKELMMTTIGIVLLSQSxxPETVLELTDALALGMMALKxxxDMEKYQLAVTVMAILCVPNAVILRNAW
KVSCTILAVVSVSPLFLTSSQQKTDWIPLVLIIKGLNPTAIFLTTLSRTNKKRSWPLNEAVMAVGMVS
ILxxxxxxxxxxxxxxxxxxxxxxxxxxGRSADLELERATDVRWEEHAEISGSSPILSITIAEDGS
MSIKNEEEEHILTILIRTGLLVISGLFPISMPITAAAWYLWETKKQRAGVLWDVPSPPPMERAELEDG
AYRIKQRGIFGYSQIGAGVxxxxxxxxxWHVTRGAVLMHKGKRIEPSWADVRKDLVSYGGGWKLExxx
xxxxxxxxxxxxxxxxxPRAVQTKPGIFKTNAGTIGAVSLDxSPGTSGSPIIDKKGKVVGLYGNGVVTR
SGTYVSSIAQTEKSVEDNPEIEDDIFRKRKLTIMDLHPGAGKTKKYLPAIVREAIRRGLRTLILAxxx
xxxxxxxxxxRGLPIRYQTPAIKTEHTGREIVDxxxxxTFTMRLLSPIRVPNYNLIIxxxxxxxxxx
xxxxxxxxxxxxxxxxxxxxxxxxxxxxxxxxPFPQSNAPIIDEEREIPERSWSSGHEWITNFKGKTVWF
VPSIKTGNDIAACLRKNGKRVIQLSRKTFDSEYIKTRANDWDFVVTTDISEMGANFRAERVIDPRRCM
KPVILTDGEERVVLAGPMPVTHSSAAQRRGRVGRNPRNENDQYIYMxxxxxxxxxxxxxxxxxxxxxx
xxxxxxxxxxxEPEREKVDAVDGEYRLRGEARKTFVDLMKRGDLPVWLAYRVASEGINYADRKWCFD
GVKNNQILEENMEVEVWTKEGERKKLKPRWLDARTYSDPLALKExxEFAAGRKSLALSLITEMGRLPT
FMTQKTRNALDNLAVLHTAEVGGKAYTHALSELPETLETLLLLGLLAAVTGGIFLFLMSGRGVGKMTL
GMCCIVTASxLLWHAQIQPHWIAASIILVFFLIVLLIPxxxxxxxxPQDNQLTYVIIAILTLVAATMAN
EMGFLEKTKKDFGLGxxxxxQSEINILDIDLRPxxxxTLYAVATTFITPMLRHSIExxxxxxxxxxxx
xQATVLMGLGRGWPLSKMDIGAPLLAIGCYSQVNPITLTAALFLLIAHYAIIGPGxxxKATREAQKRT
AAGIMKNPTVDGITVIDLEPIPYDPKFEKQLGQVMLLVLCVTQVLMMxxxxxxxEALTLATGPVSTLW
EGNPGKFWNTTIAVSxxxxxxxxxxxxGAGLLFSIMKNTTSxRRGTGNMGETLGEKWKNRLNALGKSEF
Q

FIG. 55-14

MFATTMRGAxxxxxxxxxxAWDFGSLGGAFTSIGKALHxxxxxxxxGVAFSGVSWTMKILIGAIITWIGM
NSxSTSLSVSLVLVGVVTLYLGAMVQADSGCVVSWKSKELKxxxxxxxxxxxxxxxxxxxxxxxxxxxx
xASAIQKAHEEDICGIRSxxxxENLMWRQITSELNHILSENEVKLTIMTGDTKGIMQAGKRSLKPQPT
ELRYSWKTWGKAKMLPTExHNRTFLIDGPETTECPNSNRAWxxxxVEDYGFGVFSTNIWLKLKERQDx
VCDSKLMSAAVKNNRAVHADMGYWMESRLNDTWKMEKASFIEIKSCHWPRSHTLWSxxxLESEMVIPK
SFAGPVSQHNNRPGYYTQTTGPWHLGRLEMDFDLCDGTTVVVTENCGNRGPSLxxxxxxxxxxxxxxx
xxxxxxxxxxxxxxxxxxxxxxxxxLKEREENLVNSLVTAGQGQIDNFSLGILGMALLLEEMLKTRVGT
KHAxxxxxxSLLTLITGNLSFKDLGRVIIMVGAxxTDDIGIGVTYLALLAAFRVRPTFAAGLLLKKLT
SKELLMATIGITLLSQSxxPGTVLELTDAIALGIMVLKxxxKLEKYQLAVTIMTMLCIPNVMILQHAW
KVGCTTLAVVSVSPLILTSSRQKTDWIPLALTIKGLSPTAIFLTTLSRPNKTRSWPLNEAIxxxxxxx
xxxxxxxxxxxxxxxxxxxxxxxxxxxxxxxSADLELEKAAEVKWDDHAEISGSSPILSVTISEDGS
MSIKNEEEEQILTILIRTGLLVISGLFPVSMPITAAAWxxxxxxxxxxxxLWDVPSPPPVGRAELEDG
AYRIKQRRILGYSQIGAxxxxxxxxxxxxWHVTRGAVLVHKGKRIEPSWADVKKDLVSYGGGxxxxxxx
xxxxxxxxxxxxxxxxxAVQTKPGLFRTSTGTIGAVSLxxxxGTSGSPIVDKKGKVVGLxxxxxVTR
SGTYVSAIAQTEKNIEDNPDIEDDIFRKRKLTIMDLHPxxxxxxxxxxxxxxxxxxxxxxxxxxxxxx
xxxxxxxxxxxPIRYQTPAIKAEHTGREIVxxxxxxxxxxxxxxxxxxxxxxxxxxxxxxxxxxxxxx
xxxxxxxxxxxxxxxxxxxxxxxxxxxPFPQSNAPIVDEEREIPERSWNSGYEWITDFKGKTVWF
VPSIRAGNDIAACLxxxxxxxxxxxxSRKTFDSEYAKTRSNDWDFVVTTxxxxxxxxxxxxxxxxxx
xxxILADGEERVILAxxxxxxxxxxxRRGRIGRNPRNENDxxxxxxxxxxxxxxxxxxxxxxxxxxx
xxxxxxxxxxxxxxxxxxxxxxxxxxxxxxxxxxGDLPVWLAYKVAAEGINYADRRWCFD
GIRNNQILEENMEVEVWTKEGxxxxxxxxxxxxxxxxxxxxxAAGRKSLTLSLITEMGRxPT
FMTQKARDALDNLAVLHTAEAGGKAYTHALSELxxxxxTLLLLTLLAAVTGGIFLFLMSGKGMGKMTL
GMCxxxxxxxxxxxxxxxxxxxxxxxxxxxxxxxxxxxxxxxxxxxxxxTYVVIAILTLVAAxxxx
xxxxLEKTKKDLGFGxxxxxEPEINILDIDLxxxxxxxxxxxxxxxxxxxxxxxxxxxxxxxxxxxx
xxxxxxxxxxxxxxxxxxxxxxxxxxxxxxxxxNPITLTAALLLLMAHYAIIGPGxxxxxxxxxxxx
xxxxxxxxVDGVTVIDLDPIPxxxxxxxxxxxxxxxxxxxxxxxxxxxxxxxxxxxxxxxxxxxxxx
xxxxxxxxxxxxxxxxxxxxxxxxxxxxxxxxLLFSIMKNTANxRRGTGNTGETLGEKWKSRLNALGRSEF
QTYKKSGIQEVxxxxxxxxxxxxxxxxxxxxxxxxxxxxxRWFVERNLVAPEGKVVDLGxxxxxxWSYYCGG
LKDVREVKGLTKxxxxxxxxxxxxxxxxxxxxxxLQSGVDVFFVPPEKCDTLLxxxxxxxxxxxxxxxxx
xxVLNLVENWLNNDTQFCIKVLNxxMPSVIERMETLQRKFGGALVRNPxxxxxxxxxxxxxxxxxxxx
xxxxxxxxxMLINRFTMRHKRATYEPDVxxxSGTRNIGIECEVPNLDIIGKRIEKIKEEHEASWHYDQD
HPxxxxxxxxxxxxxxxxxxxxxxxxRLLTKPWDVIPMVTQMAMTxxxxxxxxxxxxxxxxxxxxxx
xxxxTKKLMRITAKWLWGELGRRKTPRICTRAEFCNKVRSNAALGxxxxxxxxxxxKSAREAVEDSGFWE
LIEKERNLHLDGKxxxxxxxxxxxxxxxxxxxxxxxxxxxxxxxxxxxxxxxxxxxxxxxxxxxxxx
xxxSGVEGEGLHRLGYILREISKKAGGAMYADxTAGWDTRITSEDLKNEEMITDQMxGRHKKLAEAIF
RLTxxxxxxxxxxxxxxxxxxxxxxxRDQRGSGQVVxxxxxxxxxxxxxLIRQMEGEGLFKxxxxxxxx
xxxxxxxxxxRVGRERLTRMAISGDDCxxxxxDDRFARALTALNDMGxxxxxxQQWEPSKGWSDWTQ
VPxxxxxxxxxxMKDGRILVVPCRxxxxxxxxxxxxxxxxxxxxxxxxxxxxxxxxxxxxxxxxxxx
xxxxxxxxxxxxxxxxxSRTTWSIHASHEWMTTEDMLTVWNRVWILDNPWMEDKTPVESWEDIPYLGK
REDxxxxxxxxxxxRATWAKNIQVAINQVRSLMGNEEYIDYMPSMKRFRSEEEESGVLW >DENV2|peptide_length:10|string4

MNNQRKKAKTxxxxxxxxxxxxxxxxxxxxxxxxxxxxxxxxxxxxxxxxxxxxxxxxxxxTGILKR
WGTIKKSRAINVLRGxxxxxxxxxNILNRRRRSVGxxxxxIPTAIAFHLTTRNGEPHMIVSIQEKGKS
LLFKTENGINMCTLMAMDxxxxxEDTVTYKCPLLKQNEPxxxxxxxxxxSTWITYGTCTSTGEHRREK
RxxxxxxxxxxxxxxxxxxxxxxxxxxxxxxKQAQRIETWILRHPGFAIMAAVLAYTIGTTHFQRTLIFILL
TAIAPSMAMRCxxxxxxxxxxxxxxxxxxxxxxxxxxxxxxFELIKTEAKESATLRKYC
IEARxxxxxxxxxxCPTQGEPSLVEEQDKRFLCKHSMVDRGxxxxxxxxxxGGIVTCAMFTCKKKMKGK
VVQPENLxxxxVVTPHSGEEYAVGNDTGKHGKEVKITPQSxxSEAELTDYGTxxxxxxxxxxxxxxxx

FIG. 55-15

```
xxxxMESKAWLVHRQWxxxxxxxPWLPGADTQESNWIQKEMLxxxxxxxxxxxxxxxxxxxxxxxxx
xxxxxxxxxxxxxxxxxxxxxxxxxxxxxxxxxxxxxxxxxxxxxxxxxxxIVVRLQYEGDGSP
CKIPFEIMDLERRYILGRLITVNPIITEKDNPINIEAxxxxxxxxxxxxxxxxxxxxxxxxxxxx
xxxxxxxxxxxxxxxxxxxxxxGSLGGAFTSIGKxxxxxxxxxxxAAFNGVSWIMKIFIGVIITxxxx
xxxxxxLSVTLVLVGVITLYLGVMVQADSGCIVSWKNKxxxxxxxxxxxxxxxxxxxxxxxxxxxx
xxSAIQKAHEDGICGIRSxxxxxxxxxxxxITPELNHILSENEAKLTIMTGEIKGIMQAGKRYLQPQPT
QLKYSWKTWGKAKILSTExQNQTFLIDGPxTVECPNTNRAWxxxxxxxxxxxGIFTTNIWLRLREKQDx
SCDSKLMSAAIKNNRAVHADxxxxxxxALNDTWKMERASFIEVKSCHWPRSHTLxxxxxxxxxxxxIPK
NFAGPVSQHNYRPGYHTQITGPWHLGKLEMDFEFCEGTTVVVTENCGNRGxxxxxxxxxxxxxxxx
xxxxxxxxxxxxxxxxxxxxxxxxxxxxxxxxxxxxxxxxxxxxxxxxxSLGVLGMALFLEEMLRTRVGT
KHVxxxxxxSFVTLITGNLSFRDLGRVVVMVGTxxTDDIGIGVTYLALxAAFKVRPTFAAGLLLKKLT
xKELMMATIGVVLLSQSxxPESILELTDALALGMMILKxxxSMEKYQLAVTIMVILCVPNAVILLNAW
KVSCAILATVSVSPLLLTSSQQKTDWIPLVxxxxxxxxxxxIFLTTLSRPNKIRSWPLNxxxxxxxxxx
xxxxxxxxxxxxxxxxxxxxxxxxxxxxxxxxADLELEKAADVRWEDQAEISGxxxxxxxxxxxxx
xxxxxxxxxxxxxxxxxxxxxxxxVISGLFPVSMPITAxxxxxxxxxxxxWDVPSPPPIGxxxxxxx
AYRIKQKGIFGYSQIGxxxxxxxxxxxxVTRGAVLTHKGKRIEPSxxxxxxxxxxxxxxxxxxxxx
xxxxxxxxxxxxxxxxxAVQTKPGLFKTSTGTIGAVxxxxxxxxxxxxxxxxxxxxxxxxxxxxxx
xxxxVSAIAQTEKGIENNPEIEDHIFRKRRLTxxxxxxxxxxxxxxxxxxxxxxxxxxxxxxxxx
xxxxxxxxxxxxxxxIRYQTTAIKTEHTGRxxxxxxxxxxxxxxxxxxxxxxxxxxxxxxxxxxxx
xxxxxxxxxxxxxxxxxxxxxxxxxxxxxxxxxxxxxxxxxxxxRSWNTGHEWITNFEGKTVWx
xxxxxxxxxxxxxxxxxxxxxxxxxSRKTFDTEYTKTRxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxPVWLAFKVASEGISYADRRWCFD
GTRNNQILEENIEVEIWTKEGxxxxxxxxxxxxxxxxxxxxxxxxxxxxxxxxxxxxxxxxxxxx
xxxxxxxxxxxxxxxVLHTAEVGGRAYNHALNELxxxxxxxxxxxxxxxxxxxxxFLFLMSGRGVGKMTL
GMxxxxxxxxxxxxxxxxxxxxxxxxxxxxxxxxxxxxxxxxxxxxxxxxxxxxxxxxxxxxxxx
xxxxxxxxxxxxxxxxxxxxQHESNILDIDLxxxxxxxxxxxxxxxxxxxxxxxxxxxxxxxxxx
xxxxxxxxxxxxxxxxxxxxxxxxxxxxxxPVTLTAALLSLVAHYAIIGPAxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxLFSIMRNTTSxRRGTGNVGETLGEKWKNRLNSLGKNEF
QIYKKSGxxxxxxxxxxxxxxxxxxxxxxxxxxxxxxxxxxxNMVAPEGKVVDxxxxxxxxxxYYCGG
LKSVREVKGLTxxxxxxxxxxxxxxxxxxxxxxLQSGVDVFFTPPERCDTLLxxxxxxxxxxxxxxx
xxxxNLVENWLGSNTQFCVKVLxxxMPSVIERMEALQRRYGGALVRxxxxxxxxxxxxxxxxxxxxx
xxxxxxxxxxxxxxxxMRHKRATYEPDxxxxSGTRNIGTESETPNMDIIGKRIEKIKQEHEASWHYDxx
xxxxxxxxxxxxxxxxxxxxxxxxxxxxKLLTKPWDVLPMVTQMAMTxxxxxxxxxxxxxxxxxxx
xxxxTKKLMKITAKWLWKELGKKKIPRVCTREEFARKVRSNxxxxxxxxxxxxKSAREAVEDNRFWE
LVERERNLHLDGKxxxxxxxxxxxxxxxxxxxxxxxxxxxxxxxxxxxxxxxxxxxxxxxxxxxx
xxxxxxxxxxLHKLGYILREISKKAGGAMYAxxxxxxxxxxxxDLKNEEMITGQMxxxxxxxxxxx
xxxxxxxxxxxxxxxxxxxxxxxxxxxxxxxxxxxxxxxxxxxxxxxxxxxxxxxxxxxxxxxxx
xxxxxxxxxREGRERLSRMAxxxxxxxxxxxxDDRFAKALTALNDMGxxxxxxxxxxxxxxxxxxx
xxxxxxxxxxxMKDGRKLVVPCRxxxxxxxxxxxxxxxxxxxxxxxxxxxxxxxxxxxxxxxxxxx
xxxxxxxxxxxxxxxxxSRTTWSIHARHEWMTTEDMLTVWNRVWIQENPWMEDKTPVETWEEIPYxxx
xxxxxxxxxxxxxxxxxWARNIQTAINQVRSLIGSEEYxxxxxxxxxxxxxxxxxxxxx >DENV2|peptide_length:10|string5

MNDQRKKARNxxxxxxxxxxxxxxxxxxxxxxxxxxxxxxxxxxxxxxxxxxxxxxxxxxxxxx
xxAIKKSKAINVxxxxxxxxxxxxxxxNILNRRRRTVGxxxxxxxxxxxxxxxxxNGEPHMIVSKNEKGKS
LLxxxxVGTNMCTLMALDxxxxxxxxxxTYNCPLLKQNEPxxxxxxxxxxxxxxxxxxxxxxxxx
xxxxxxxxxxxxxxxxxxxxxxxxxxxxxxxxxxxxxxLRHPGFTTMAAxxxxxxxGTTHFQKALIFILL
```

FIG. 55-16

```
TTVAPSMTMRxxxxxxxxxxxxxxxxxxxxxxxxxxxxxxxxxxxxxxxxxxxxAKQSATLRKYC
xxxxxxxxxxxxxCPTQGEPSLSEEQDKRFxxxxxxxxxxxxxxxxxxxxxxIVTCAMFSCLKNMKGK
VVQPExxxxxxxxxxxxxxxxxxxxNDTGKHGMEIKVTPQSxxTDAELTGYGTxxxxxxxxxxxxxxxx
xxxxMGNKAWLVHRQxxxxxxxxPWLPGADIQGSNWIQKExxxxxxxxxxxxxxxxxxxxxxxxxxxx
xxxxxxxxxxxxxxxxxxxxxxxxxxxxxxxxxxxxxxxxxxxxxxxxxxxxxxxxxVIRVQYEGEGAP
CKIPFEIMDLEKRYILGRLITVNPIATxxxxxxxxxxxxxxxxxxxxxxxxxxxxxxxxxxxxxxxx
xxxxxxxxxxxxxxxxxxxxxxxxxxGSLGGVFTSMGKxxxxxxxxxxxxxxxxxxWTMKIFIGVIIxxxxx
xxxxxxxSVSLILVGVVILYLGAMVQADSGCIxxxxxxxxxxxxxxxxxxxxxxxxxxxxxxxxxx
xxxAIQKAHEDGICGxxxxxxxxxxxxxxxxxxxxxHILTENEVKMTIMTGDIKGIMHAGRRSLRPQPT
QLxxxxxxxWGKAKMLSTGxHNRTFLIDGPxTAECPNANRAWxxxxxxxxxxxxFTTNIWLRLKEKQDx
LCDSKLMSAAxxxxxxxxxxxxxxxxxxxxxxxxxxxxIEVKSCHWPRSHxxxxxxxxxxxxxxxxPK
GIAGPVSQHNNRPGYYTQxxxxxxLGKLEMDFNFCEGTTVVVTENxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxRDLGRVIIMVxxxxTDDIGIGVTYxxxxxAYKVRPTFVAGLLLRKLx
xxxxxxxxTIGVALLSQSxxPENILELTDALAxxxxxxxxxxxNLEKYQLAVTxxxTLCVPNAVVLQNAW
xxxxxILAAVSVFPLLLTSSRQKADWIPLAxxxxxxxxxxxIFLTTLTRTSKKRSWPxxxxxxxxxxxxx
xxxxxxxxxxxxxxxxxxxxxxxxxxxxxxxxxxxxxxADLELERAAEVKWEEQAEISGxxxxxxxxxxxxx
xxxxxxxxxxxxxxxxxxxxxxxxxxxSGVFPVSIPVTAxxxxxxxxxxxxxxxxWDVPSPPPMExxxxxxx
xxRIKQRGFLGYSQIGxxxxxxxxxxxxxxxxxxxxxxxxxxxxxxxxxxxxxxxxxxxxxxxxxx
xxxxxxxxxxxxxxxxxxxxxxQTKPGFFRTNAGTIGAVxxxxxxxxxxxxxxxxxxxxxxxxxxxx
xxxxxSSIAQTETSVExxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxNSGHEWITDFKGKxxxxx
xxxxxxxxxxxxxxxxxxxxxxxxxSRKTFDTEYIKTRxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxAYKVASEGISYTDRKWCFD
GIRNNxxxxxxxxxxxxxxxxxxxxxxxxxxxxxxxxxxxxxxxxxxxxxxxxxxxxxxxxxxxxx
xxxxxxxxxxxxxVLHSAEMGGRAxxxxxxxxxxxxxxxxxxxxxxxxxxxFLFLMSARGIGKMTL
Gxxxxxxxxxxxxxxxxxxxxxxxxxxxxxxxxxxxxxxxxxxxxxxxxxxxxxxxxxxxxxxxxx
xxxxxxxxxxxxxxxxxxxxxQHESNILDIDxxxxxxxxxxxxxxxxxxxxxxxxxxxxxxxxxxx
xxxxxxxxxxxxxxxxxxxxxxxxxxxxxxxxxPTTLTAALLLLMAHxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxLFSIMKNTINxRRGTGTIGETLGEKWKSQLNTLGKNEF
QIYKKSxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxIDVFFIPPERCDTLxxxxxxxxxxxxxxxxxx
xxxxNLVENWLNNNTKFCIKVxxxxxxxxxxxxxxxxxxxxxxxxxxxxxxxxxxxxxxxxxxxxx
xxxxxxxxxxxxxxxxxxxxxxxxxxxxxxxxxxxxEKPNLDIIGKRxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxMRITAKWLWKELGRKKTPRMCTREEFAxxxxxxxxxxxxxxxxxxSAREAVEDERFWE
LVERERNLHLxxxxxxxxxxxxxxxxxxxxxxxxxxxxxxxxxxxxxxxxxxxxxxxxxxxxxxxx
xxxxxxxxxxxxHKLGYILRDVSKKEGGTMYAxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxVGRERLSRMVxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxMKDGRMLVVPCRxxxxxxxxxxxxxxxxxxxxxxxxxxxxxxxxxxxxxxxxx
xxxxxxxxxxxxxxxxxxxxxxxxxxxxxxxxLTVWNKVWIQDNPWMEDKTxxxxxxxxxxxxxxx
xxxxxxxxxxxxxxxxxxxxxxxxxxxTAINQVRSLIGNEGYxxxxxxxxxxxxxxxxxxxxxxxx
```

FIG. 55-17

>DENV2|peptide_length:11|string1 xxxxxxxxxSTPFNMLKRERNRVSTVQ

FIG. 55-18

LAANAICSAVPSHWVPTSRTTWSIHAKHEWMTTEDMLAVWNRVWIQENPWMEDKTPVESWEEVPYLGK
REDQWCGSLIGLTSRATWAKNIQTAINQVRSLIGNEEYTDYMPSMKRFRREEEEAGVLW

>DENV2|peptide_length:11|string2 xxxxxxxxxNTPFNMLKRERNRVSTIQQLTKRFSLGMLQGRGPLKLFMAFVAFLRFLTIPPTAGILKR
WGTVKKSKAISVLRGFRREIGRMLNILNRRRRSAGxxxxxIPTVVAFHLTTRNGEPHMIVGINEKGKS
LLFKTENGVNMCTLMAMDLGELCEDTITYNCPFLKQNEPEDIDCWCNSTSTWVTYGTCSAMGEHRREK
RSVALVPHVRMGLETRxxTWMSSEGAWKHAQRIETWVLRHPGFTMMAAILAYTIGTTHFQRVLIFILL
AAVTPSMTMRCIGMSNRDFVEGVSxxxxxxxxxxxxxxxxxxKNKPTLDFELIKTEAKHPATLRKFC
IEAKLTNTTTASRCPTQGEPSLKEEQDKRFICRHSMVDRGWGNxxxxFGKGGIVTCAMFRCKKNMEGK
VVQPENLEYTIVVTPHSGEENAVGNDTGKHGKEIKVTPQSxxxEAELTDYGTITMECSPRTSFDFNEM
VLLQMENKAWLVHRQWFxxLPLPWLPGADKQESNWIQKEMLVTFKNPHAKRQDVVVLGSQExxxxxxL
TGATEIQMSLGNILFMGHLKCRLRMDxxxxxxxSYSMCTGKFKVVKEIAETQHGTIVIRVQYEGDDSP
CKIPFEIMDLEKRYILGRLITVNPIVIEKDSPINIEAEPPFGDSYIIIGVEPGQLKLSWFKKGSSIGQ
MIETTMRGAKRMxxLGDTAWDFGSIGGVFTSVGKALHQVFGAIYGAAFSGVSWTMKILIGVVITWIGM
NSRSTSLSVSLVLVGIVTLYLGAVVQADTGCVVSWKSKELKCGSGIFVTDNVHTWTEQYKFQPDSPSK
LASAIQKAQEEDICGIRSVTRLENLMWKQITPELNHILAENEVKLTIMTGDIRGIMQxxxxxLRPQPT
ELKYSWKAWGKAKMLxxxxYNHTFLIDGPETTECPNSNRAWNSLEVEDYGFGVFTTNIWLKLKEKQDx
xCDSKLMSAAVKDDRAVHADMGYWIESALNDTWKIEKASFIEVKNCYWPRSHTLWSNGVLESEMIIPK
NLAGPVSQHNYRPGYHTQIAGPWHLGKLEMDFDFCDGTTVIVTEECGNRGPSLRTxxxxxxxxxxxx
xxxxxxxxxxxxxxxxYGMEIRPLKEKEENLVNSLVTAGHGQVDNFSLGILGMALFLEEMLRTRIGT
KHAxxxxxxSFMTLITGNMSFKDLGRVVVMVGAxxADEMGMGVTYLALLAAFRVRPTFAVGLLLRKLT
SKELMMTTIGIxxxxxxxxxxTVLELTDALALGMMALKxxxxMEKYQLAVTVMAxxCVPNAVILRNAW
xxxxxxxxxVSVSPLFLTSSQQKTDWIPLVLIIKGLNPTAIFLTTLSRTNKKRSWPLNEAVMAVGMVS
ILAxxxxxxxxxxxxxxxxxxxxxxxxxTGRSADLELERATDVRWEEHAEISGSSPILSITIAEDGS
MSIKNEEEEHILTILIRTGLLVISGLFPISMPITAAAWYLWETKKQRAGVLWDVPSPPPMERAELEDG
AYRIKQRGIFGYSQIGAGVYxxxxxxxMWHVTRGAVLMHKGKRIEPSWADVRKDLVSYGGGWKLEGxx
xxxxxxxxxxxxxxNPRAVQTKPGIFKTNAGTIGAVSLDFSPGTSGSPIIDKKGKVVGLYGNGVVTR
SGTYVSSIAQTEKSVEDNPEIEDDIFRKRKLTIMDLHPGAGKTKKYLPAIVREAIRRGLRTLILAPxx
xxxxxxxxxLRGLPIRYQTPAIKTEHTGREIVDLxxxATFTMRLLSPIRVPNYNLIIMxxxxxxxxxx
xxxxxxxxxxxxxxxxxxxxxxxxxxxxDPFPQSNAPIIDEEREIPERSWSSGHEWITNFKGKTVWF
VPSIKTGNDIAACLRKNGKRVIQLSRKTFDSEYIKTRANDWDFVVTTDISEMGANFRAERVIDPRRCM
KPVILTDGEERVVLAGPMPVTHSSAAQRRGRVGRNPRNENDQYIYMGxxxxxxxxxxxxxxxxxxxx
xxxxxxxxxxxFEPEREKVDAVDGEYRLRGEARKTFVDLMKRGDLPVWLAYRVASEGINYADRKWCFD
GVKNNQILEENMEVEVWTKEGERKKLKPRWLDARTYSDPLALKEFKEFAAGRKSLALSLITEMGRLPT
FMTQKTRNALDNLAVLHTAEVGGKAYTHALSELPETLETLLLLGLLAAVTGGIFLFLMSGRGVGKMTL
GMCCIVTASxLLWHAQIQPHWIAASIILVFFLIVLLIPExxxxxTPQDNQLTYVIIAILTLVAATMAN
EMGFLEKTKKDFGLGxxxxxQSEINILDIDLRPAxxWTLYAVATTFITPMLRHSIENxxxxxxxxxxx
NQATVLMGLGRGWPLSKMDIGAPLLAIGCYSQVNPITLTAALFLLIAHYAIIGPGLxAKATREAQKRT
AAGIMKNPTVDGITVIDLEPIPYDPKFEKQLGQVMLLVLCVTQVLMMRxxxxxCEALTLATGPVSTLW
EGNPGKFWNTTIAVSMxxxxxxxxxAGAGLLFSIMKNTTSxRRGTGNMGETLGEKWKNRLNALGKSEF
QIYKRSGIQEVDRTLxxxxxxxxxxxxxxxxxxAKLRWFVERNLVTPEGKVMDLGCGRGGWSYYCGG
LKNVKEVKGLTKGGPGHEEPVPMSTYGWNLVRLQSGVDVFFIPPERCDTLLCDIGESSPNPTVEAGRT
LRVLSLVENWLNNNTQFCVKVLNPYMPSVIEKMETLQRQFGGALVRNPLSxxxTHEMYWVSNASGNIV
SSVNMISRMLINRFTMRYKKTTYEPDVDLGSGTRNIGIENETPNMDIIGKRIEKIKQEHEISWHYDQD
HPYRTWxxxxxxxxxxxxSASSMVNGVVRLLTKPWDVLPTVTQMAMTDTTxxxxxxxxxxxxxxxxxE
PKEGTKKLMRITAKWLWKELGKEKKPRICTREEFTKKVRSNAALGAVFTDENKWKSAREAVEDGRFWE
LVDRERNLHLDGKCETCVYNMxxxxxKKIGEFGKAKGSRxxxxxxxxxxxxxxxxxFLNEDHWFSRG
NSLSGVEGEGLHRLGYILRDVGRKAGGAMYADDTAGWDTRITIEDLKNEEMITNHMxGEHKRLAEAIF

FIG. 55-19

RLTYQNKVVRVQRPTPRGTVMDIISRKDQRGSGQVVTYGLNTFTNMGAQLIRQMEGEGVFKxxxxxxx
xxxxxxxxxxxxxGRERLARMAISGDDCVVKPIDDRFANALTALNDMGKIRKDIQQWEPSKGWSDWTQ
VPFCSHHFHELVMKDGRTLVVPCRSQDELIGRARISQGAGWSLRETACLGKSYAQMWTLMYFHRRDLR
xAANAICSAVPPHWVPTSRTTWSIHATHEWMTTEDMLTVWNRVWIRENPWIEDKTPVESWEEIPYLGK
REDQWxxxxxxxxSRATWAKNIQAAINQVRALIGEEGYIDYMPSMKRFRKEEEEAGVLW >DENV2|peptide_length:11|string3 xxxxxxxxxTTPFNMLKRERxxxxxxxxxxxxxxxxxxGRGPLRLFMALVAFLRxxxxxPTVGILKR
WGTIKKSKAINVLRGFRREIGxMLNILNKRRRTAGxxxxxIPTVIAFHLTTRNGEPHMIVSKNEKGKS
LLFKTKDGTNMCTLMAMDLGELCEDTITYKCPLLKQNEPEDIDxxxxxTSTWVTYGTCATMGEHRREK
RSxxxxxxxxxxxxxxxxxWMSSEGAWKHAQRIETWILRHPGFTLMAAILAYTVGTTYFQRALIFILL
TAIAPSMAMRCIGISNRDxxxxxxxxxxxxxxxxxxxxxxxxxxxxDFELIKTEAKQPATLRKYC
IEAKLTNTTTDSRCPTQGEPTLNEEQDKRFVCRHSMVDRGWxxxxxxxxKGGIVTCAMFTCKKNMEGK
VVLPENLEYTIVITPHSGEEHAVGNDTGKHGQEIKVTPQSxxxEAELTGYGTVTMECSPRTGFDFNEM
VLLQMEEKAWLVHRQWFxxLPLPWLPGADKQGSNWIQKEMLVxxxxxxxxxxxxxxxxxxxxxxxxx
xxATEIQMSSGNILFMGHxxxxxxxxxxxxxxxxxxxxxxxETQHGTIVIRVQYEGDGSP
CRIPFEITDLEKKYILGRLITVNPIVAGKDNPINIEAEPPFGDSYIVVGVEPGQLKLDWFRKGSSIGQ
MFATTMRGAKxxxxxxxxTAWDFGSLGGAFTSIGKALHQVFGAIYGVAFSGVSWTMKILIGAIITWIGM
NSRSTSLSVSLVLVGVVTLYLGAMVQADSGCIVSWKNKELKCxxxxxxxxxxxxxxxxxxxxxxxx
LASAIQKAHEEDICGIRSVxxLENLMWRQITSELNHILSENEVKLTIMTGDTKGIMQxxxxxLKPQPT
ELRYSWKTWGKAKVLxxxxHNQTFLIDGPETTECPNSNRAWNxxEVEDYGFGVFSTNIWLKLKERQDx
xxDSKLMSAAVKNNRAVHADMGYWIESRLNDTWKIEKASFIEIKSCHWPRSHTLWSNxVLESEMVIPK
SFAGPVSQHNNRPGYYTQTTGPWHLGRLEMDFDLCDGTTVVVTENCGNRGPSLRxxxxxxxxxxxxxx
xxxxxxxxxxxxxxxxxxxxxxxPLKEREENLVSSLVTAGHGQIDNFSLGILGMALLLEEMLKTRVGT
KHAxxxxxxSLVTLITGNLSFKDLGRVIIMVGAxxTDDIGIGITYLALLAAFKVRPTFAAGLFLRKLT
SKELLMATIGVxxxxxxxxxxxTVLELTDAIALGIMVLKxxxxLEKYQLAVTIMTxxCIPNVMILQHAW
xxxxxxxxxVSVSPLILTSSRQKTDWIPLALTVKGLNPTAIFLTTLSRPNKTRSWPLNEAIMxxxxxx
xxxxxxxxxxxxxxxxxxxxxxxxxxxxxxRSADLELEKAAEVKWDDHAEISGSSPILSVTISEDGS
MSIKNEEEEQILTILIRTGLLVISGLFPVSMPITAAAWYxxxxxxxxxxVLWDVPSPPPVGRAELEDG
AYRIKQRRILGYSQIGAGxxxxxxxxxxMWHVTRGAVLVHKGKRIEPSWADVKKDLVSYGGGWxxxxxx
xxxxxxxxxxxxxxxxRAVQTKPGLFRTSTGTIGAVSLDxxPGTSGSPIVDKKGKVVGLYxxxVVTR
SGTYVSAIAQTEKNIEDNPDIEDDIFRKRKLTIMDLHPGxxxxxxxxxxxxxxxxxxxxxxxxxxxx
xxxxxxxxxxxxLPIRYQTPAIKAEHTGREIVDxxxxxxxxxxxxxxxxxxxxxxxxxxxxxxxxxx
xxxxxxxxxxxxxxxxxxxxxxxxxxxxxDPFPQSNAPIVDEEREIPERSWNSGYEWITNFEGKTVWF
VPSIRAGNDIAACLRxxxxxxxxLSRKTFDTEYTKTRSNDWDFVVTTDxxxxxxxxxxxxxxxxxxx
xxVILTEGEERVILAGxxxxxxxxxxQRRGRIGRNPRNENDQxxxxxxxxxxxxxxxxxxxxxxxxx
xxxxxxxxxxxxxxxxxxxxxxxxxxxxxxxxRGDLPVWLAYKVAAEGINYADRRWCFD
GIRNNQILEENMEVEVWTKEGExxxxxxxxxxxxxxxxxxxxxxxxFAAGRKSLTLSLITEMGKLPT
FMTQKARDALDNLAVLHTAEAGGKAYTHALSELPxxxETLLLLTLLAAVTGGIFLFLMSGKGMGKMTL
GMCCxxxxxxxxxxxxxxxxxxxxxxxxxxxxxxxxxxxxxxxxxxLTYVVIAILTLVAATxxx
xxxFLEKTKKDLGFGxxxxxEPEINILDIDLRxxxxxxxxxxxxxxxxxxxxxxxxxxxxxxxxxxx
xxxxxxxxxxxxxxxxxxxxxxxxxxxxxxVNPITLTAALLSLMAHYAIIGPGLxxxxxxxxxxxxx
xxxxxxxxTVDGVTVIDLDPIPYxxxxxxxxxxxxxxxxxxxxxxxxxxxxxxxxxxxxxISTLW
EGNPGKxxxxxxxxxxxxxxxxxxxxxGLLFSIMKNTANxRRGTGNTGETLGEKWKSRLNTLGRSEF
QTYKKSGIQEVDxxxxxxxxxxxxxxxxxxxxxxxLRWFVERNLVAPEGKVVDLGCxxxGWSYYCGG
LKDVREVKGLTKGxxxxxxxxxxxxxxxxRLQSGVDVFFVPPEKCDTLLCxxxxxxxxxxIEAGRT
LRVLNLVENWLNNDTQFCIKVLNPYMPSVIERMETLQRKFGGALVRNPLxxxxxxxxxxxxxxxxxx
xxxxxxRMLINRFTMRHKKTTYEPDVDxGSGTRNIGIECEVPNLDIIGKRIEKIKEEHEASWHYDQD
HPYxxxxxxxxxxxxxxxxxxxxxxxxxVRLLTKPWDVIPMVTQMAMTDxxxxxxxxxxxxxxxxxxx

FIG. 55-20 xxxGTKKLMRITAEWLWGELGRRKTPRICTRAEFCNKVRSNAALGAxxxxxxxWKSAREAVEDSGFWE
LIEKERNLHLDGKCxxxxxxxxxxxxxxxxxxxxxxxxxxxxxxxxxxxxxxxxxxxxxxxxxxxx
xxLSGVEGEGLHRLGYILREISKKAGGAMYADDTAGWDTRITSEDLKNEEMITDQMxGRHKKLAEAIF
RLTYxxxxxxxxxxxxxxxxxxxxxxRRDQRGSGQVVTxxxxxxxxxxxQLIRQMEGEGLFKxxxxxxx
xxxxxxxxxxxxxxGRERLTRMAISGDDCVxxxxDDRFARALTALNDMGKxxxxIQQWEPSKGWSDWTQ
VPFxxxxxxxxxxMKDGRILVVPCRxxxxxxxxxxxxxxxxxxxxxxxxxxxxxxxxxxxxxxxxxx
xxxxxxxxxxxxxxxxxxTSRTTWSIHASHEWMTTEDMLTVWNRVWILDNPWMEDKTPVESWEDIPYLGK
REDQxxxxxxxxxxSRATWAKNIQVAINQVRSLMGNEEYIDY

FIG. 55-21

```
xxVLNLVESWLGSNTQFCVKVLNxYMPSVIERMEAMQRRYGGALVRNxxxxxxxxxxxxxxxxxxxx
xxxxxxxxxxINRFTMRHKRATYEPDVxxGSGTRNIGTESETPNMDIIGKRIEKIKQEHEASWHYDQx
xxxxxxxxxxxxxxxxxxxxxxxxxxxxxVKLLTKPWDVLPMVTQMAMTDxxxxxxxxxxxxxxxxx
xxxGTKKLMKITAKWLWKELGKKKIPRMCTREEFARKVRSNAxxxxxxxxxxxWKSAREAVEDNRFWE
LVERERNLHLDGKCxxxxxxxxxxxxxxxxxxxxxxxxxxxxxxxxxxxxxxxxxxxxxxxxxxxx
xxxxxxxxxGLHKLGYILREISKKAGGAMYADxxxxxxxxxxxxEDLKNEEMITGQMxxEHKKLAEAIF
Rxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxDDRFAKALTALNDMGKxxxxxxxxxxxxxx
xxxxxxxxxxxxMKDGRKLVVPCRxxxxxxxxxxxxxxxxxxxxxxxxxxxxxxxxxxxxxxxxxx
xxxxxxxxxxxxxxxxxTSRTTWSIHARHEWMTTEDMLTVWNRVWIQDNPWMEDKTPVETWEEIPYLxx
xxxxxxxxxxxxxxxxxTWARNIQTAINQVRSLIGSEEYxxxxxxxxxxxxxxxxxxxxx >DENV2|peptide_length:11|string5 xxxxxxxxxxxxxxxxxxxxxxxxxxxxxxxxxxxxxxxxxxxxxxxxxxxxxxxxxxxxxxxxxx
xGAIKKSRAINVLRxxxxxxxxxxLNILNRRRRTVGxxxxxxxxxxxxxxxxxxRNGEPHMIVSKNEKGKS
LLFxxxxGINMCTLMAIDLxxxxxxxxxxTYNCPLLKQNEPExxxxxxxxxxxxxxxxxxxxxxxx
xxxxxxxxxxxxxxxxxxxxxxxxxxxxxxxLRHPGFTTMAAxxxxxxGTTHFQKALIFILL
TTVAPSMTMRCxxxxxxxxxxxxxxxxxxxxxxxxxxxxxxxxxxxxxxxxxxxEAKQSATLRKYC
IEARLTNTTTExRCPTQGEPSLSEEQDKRFxxxxxxxxxxxxxxxxxxxGIVTCAMFSCLKKMEGK
VVQPENxxxxIMITPHSGEEHAVGNDTGKHGMEIKVTPQSxxxxxxxxxxxxxxxxxxxxxxxxxx
xxxxMGNKAWLVHRQWxxxxxxLPWLPGADIQGSNWIQKExxxxxxxxxxxxxxxxxxxxxxxxxx
xxxxxxxxxxxxxxxxxxxxxxxxxxxxxxxxxxxxxxxxxxxxxxxxxxVIRLQYEGEGAP
CKIPFEIMDLEKRYILGRLITVNPIATxxxxxxxxxxxxxxxxxxxxxxxxxxxxxxxxxxxxxx
xxxxxxxxxxxxxxxxxxxxxxxxxFGSLGGVFTSMGKAxxxxxxxxxxxxxxxxxSWTMKIFIGVIITxxxx
xxxxxxLSVTLVLVGVVILYLGAMVQADSGCIVxxxxxxxxxxxxxxxxxxxxxxxxxxxxxxxx
xxSAIQKAYEEGICGIRSVxxxxxxxxxxxxxxxNHILTENEVKMTIMTGDIKGIMHxxxxxxxxxxx
xxxxxxxxxxxxxxxxxxxxxxHNRTFLIDGPETAECPNANRAWNxxxxxxxxxxxFTTNIWLRLKEKQDx
xxxSKLMSAAIKDSxxxxxxxxxxxxxxxxxxxxxxxxxFIEVKSCHWPRSHTxxxxxxxxxxxxxxIPK
GIAGPVSQHNYRLGYHTQxxxxxHLGKLEMDFNFCEGTTVVVTENCxxxxxxxxxxxxxxxxxxxx
xxxxxxxxxxxxxxxxxxxxxxxxxxxxxxxNSLVTAGYGQIDNFSLGVxxxxxxxxxxxxxxxxx
xxxxxxxxxxFVTLITGNLSFKDLGRVIVMVGxxxTDDIGIGVTYLxxxAAFKVRPTFAAGLLLRRLT
xxxxxxxxxxxxxxxxxxxxxxxNILELTDALALxxxxxxxxxxxxxxxxxxxxxCVPNAVVLQNAW
xxxxxxxxxxxSVFPLLLTSSRQKADWIPLALxxxxxxxxxAIFLTTLTRTSKKRSWPxxxxxxxxxx
xxxxxxxxxxxxxxxxxxxxxxxxxxxxxxSADLELERAAEVKWEEQAEISGSxxxxxxxxxxxxx
xxxxxxxxxxxxxxxxxxxxxxxxxxxSGVFPVSIPVTAAxxxxxxxxxxxxxLWDVPSPPPMExxxxxxx
xYRIKQRGFLGYSQIGAxxxxxxxxxxxxxxxxxxxxxxxxxxxxxxxxxxxxxxxxxxxxxxxxx
xxxxxxxxxxxxxxxxxxxxxVQTKPGIFKTNTGIIGAVSxxxxxxxxxxxxxxxxxxxxxxxxxx
xxxxVSSIAQTETSVExxxEIEDHIFRKRRxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxWNSGHEWITNFEGKTxxx
xxxxxxxxxxxxxxxxxxxxxxxxLSRKTFDTEYIKTRxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxLAYKVASEGISYTDRKWCFD
GIRNNQxxxxxxxxxxxxxxxxxxxxxxxxxxxxxxxxxxxxxxxxxxxxxxxxxxxxxxxxxxx
xxxxxxxxxxxxAVLHSAEMGGRAxxxxxxxxxxxxxxxxxxxxxxxxxxxFLFLMSARGMGKMTL
GMCxxxxxxxxxxxxxxxxxxxxxxxxxxxxxxxxxxxxxxxxxxxxxxxxxxxxxxxxxxxxxx
xxxxxxxxxxxxxxxxxxxxQHESNILDIDLxxxxxxxxxxxxxxxxxxxxxxxxxxxxxxxxxx
xxxxxxxxxxxxxxxxxxxxxxxxxxxxxxxxxNPITLTAALLMLxxxxxxxxxxxxxxxxxxxxx
xxxxxxxxxxxxxxxxxxxxxxxxxxxxxxxxxxxxxxxxxxxxxxxxxxxxxxxxxxxxxxxxxx
```

FIG. 55-22

```
xxxxxxxxxxxxxxxxxxxxxxxxxxxxxLLFSIMKNTINxRRGTGTIGETLGEKWKSQLNALGKNEF
QIYKKSGxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxGIDVFFIPPERCDTLLxxxxxxxxxxxxxxxxx
xxxLNLVENWLNNNIQFCIKVLxxxxxxxxxxxxxLQRKHGGALVRxxxxxxxxxxxxxxxxxxxxx
xxxxxxxxxxxxxxxxxxxxxxxxxxxxxxxxxxxxxxxxxxxEKPNLDIIGKRIxKIKQEHETSWHHxxx
xxxxxxxxxxxxxxxxxxxxxxxxxxxxxxxxxxxxxxxxxxxxxxxxxxxxxxxxxxxxxxxxxxx
xxxxxxxLMRITAKWLWKELGRKKTPRVCTREEFxxxxxxxxxxxxxxxxxxxxxKSAREAVEDERFWE
LVERERNLHLxxxxxxxxxxxxxxxxxxxxxxxxxxxxxxxxxxxxxxxxxxxxxxxxxxxxxxxxx
xxxxxxxxxxLHKLGYILRDISKKEGGTMYADxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxMKDGRMLVVPCRxxxxxxxxxxxxxxxxxxxxxxxxxxxxxxxxxxxxxxxxxxxx
xxxxxxxxxxxxxxxxxxxxxxxxxxxxxxxxxxxxxMLTVWNKVWIQDNPWMEDKTLVESWEEVxxxxx
xxxxxxxxxxxxxxxxxxxxxxxxQTAINQVRSLIGNEGYxxxxxxxxxxxxxxxxxxxxx
```

FIG. 56-1

>DENV3|peptide_length:8|string1

MNNQRKKTGKPSINMLKRVRNRVSTGSQLAKRFSKGLLNGQGPMKLVMAFIAFLRFLAIPPTAGVLAR
WGTFKKSGAIKVLKGFKKEISNMLSIINKRKKTSLCLMMILPAALAFHLTSRDGEPRMIVGKNERGKS
LLFKTASGINMCTLIAMDLGEMCDDTVTYKCPHITEVEPEDIDCWCNLTSTWVTYGTCNQAGEHRRDK
RSVALAPHVGMGLDTRTQTWMSAEGAWRQVEKVETWALRHPGFTILALFLAHYIGTSLTQKVVIFILL
MLVTPSMTMRCVGVGNRDFVEGLSGATWVDVVLEHGGCVTTMAKNKPTLDIELQKTEATQLATLRKLC
IEGKITNITTDSRCPTQGEAVLPEEQDQNYVCKHTYVDRGWGNGCGLFGKGSLVTCAKFQCLEPIEGK
VVQYENLKYTVIITVHTGDQHQVGNETQGVTAEITPQASTTEAILPEYGTLGLECSPRTGLDFNEMIL
LTMKNKAWMVHRQWFFDLPLPWTSGATTETPTWNRKELLVTFKNAHAKKQEVVVLGSQEGAMHTALTG
ATEIQNSGGTSIFAGHLKCRLKMDKLELKGMSYAMCTNTFVLKKEVSETQHGTILIKVEYKGEDAPCK
IPFSTEDGQGKAHNGRLITANPVVTKKEEPVNIEAEPPFGESNIVIGIGDNALKINWYKKGSSIGKMF
EATARGARRMAILGDTAWDFGSVGGVLNSLGKMVHQIFGSAYTALFSGVSWVMKIGIGVLLTWIGLNS
KNTSMSFSCIAIGIITLYLGAVVQADMGCVINWKGKELKCGSGIFVTNEVHTWTEQYKFQADSPKRLA
TAIAGAWENGVCGIRSTTRMENLLWKQIANELNYILWENNIKLTVVVGDIIGVLEQGKRTLTPQPMEL
KYSWKTWGKAKIVTAETQNSSFIIDGPNTPECPSASRAWNVWEVEDYGFGVFTTNIWLKLREVYTQLC
DHRLMSAAVKDERAVHADMGYWIESQKNGSWKLEKASLIEVKTCTWPKSHTLWSNGVLESDMIIPKSL
AGPISQHNYRPGYHTQTAGPWHLGKLELDFNYCEGTTVVITENCGTRGPSLRTTTVSGKLIHEWCCRS
CTLPPLRYMGEDGCWYGMEIRPISEKEENMVKSLVSAGSGKVDNFTMGVLCLAILFEEVMRGKFGKKH
MIAGVxFTFVLLLSGQITWRDMAHTLIMIGSNASDRMGMGVTYLALIATFKIQPFLALGFFLRKLTSR
ENLLLGVGLAMATTLQLPEDIEQMANGIALGLMALKLITQFETYQLWTALISLTCSNTIFTLTVAWRT
ATLILAGVSLLPVCQSSSMRKTDWLPMTVAAMGVPPLPLFIFSLKDTLKRRSWPLNEGVMAVGLVSIL
ASSLLRNDVPMAGPLVAGGLLIACYVITGTSADLTVEKAADVTWEEEAEQTGVSHNLMITVDDDGTMR
IKDDETENILTVLLKTALLIVSGIFPYSIPATLLVWHTWQKQTQRSGVLWDVPSPPETQKAELEEGVY
RIKQQGIFGKTQVGVGVQKEGVFHTMWHVTRGAVLTYNGKRLEPNWASVKKDLISYGGGWRLSAQWQK
GEEVQVIAVEPGKNPKNFQTMPGTFQTTTGEIGAIALDFKPGTSGSPIINREGKVVGLYGNGVVTKNG
GYVSGIAQTNAEPDGPTPELEEEMFKKRNLTIMDLHPGSGKTRKYLPAIVREAIKRRLRTLILAPTRV
VAAEMEEALKGLPIRYQTTATKSEHTGREIVDLMCHATFTMRLLSPVRVPNYNLIIMDEAHFTDPASI
AARGYISTRVGMGEAAAIFMTATPPGTADAFPQSNAPIQDEERDIPERSWNSGNEWITDFAGKTVWFV
PSIKAGNDIANCLRKNGKKVIQLSRKTFDTEYQKTKLNDWDFVVTTDISEMGANFKADRVIDPRRCLK
PVILTDGPERVILAGPMPVTAASAAQRRGRVGRNPQKENDQYIFTGQPLNNDEDHAHWTEAKMLLDNI
NTPEGIIPALFEPEREKSAAIDGEYRLKGESRKTFVELMRRGDLPVWLAHKVASEGIKYTDRKWCFDG
QRNNQILEENMDVEIWTKEGEKKKLRPRWLDARTYSDPLALKEFKDFAAGRKSIALDLVTEIGRVPSH
LAHRTRNALDNLVMLHTSEHGGRAYRHAVEELPETMETLLLLGLMILLTGGAMLFLISGKGIGKTSIG
LICVIASSGMLWMAEIPLQWIASAIVLEFFMMVLLIPEPEKQRTPQDNQLAYVVIGILTLAAIIAANE
MGLLETTKRDLGMSKEPGVVSPTSYLDVDLHPASAWTLYAVATTVITPMLRHTIENSTANVSLAAIAN
QAVVLMGLDKGWPISKMDLGVPLLALGCYSQVNPLTLTAAVLLLITHYAIIGPGLQAKATREAQKRTA
AGIMKNPTVDGIMTIDLDPVIYDSKFEKQLGQVMLLVLCAVQLLLMRTSWALCEALTLATGPITTLWE
GSPGKFWNTTIAVSMANIFRGSYLAGAGLAFSIMKSVGTGKRGTGSQGETLGEKWKKKLNQLSRKEFD
LYKKSGITEVDRTEAKEGLKRGEITHHAVSRGSAKLQWFVERNMVIPEGRVIDLGCGRGGWSYYCAGL
KKVTEVRGYTKGGPGHEEPVPMSTYGWNIVKLMSGKDVFYLPPEKCDTLLCDIGESSPSPTVEESRTI
RVLKMVEPWLKNNQFCIKVLNPYMPTVIEHLERLQRKHGGMLVRNPLSRNSTHEMYWISNGTGNIVAS
VNMVSRLLLNRFTMTHRRPTIEKDVDLGAGTRHVNAEPETPNMDVIGERIKRIKEEHNSTWHYDDENP
YKTWAYHGSYEVKATGSASSMINGVVKLLTKPWDVVPMVTQMAMTDTTPFGQQRVFKEKVDTRTPRSM
PGTRKVMEITAEWLWRTLGRNKKPRLCTREEFTKKVRTNAAMGAVFTEENQWDSAKAAVEDEDFWKLV
DRERELHKLGKCGSCVYNMMGKREKKLGEFGKAKGSRAIWYMWLGARYLEFEALGFLNEDHWFSRENS
YSGVEGEGLHKLGYILRDISKIPGGAMYADDTAGWDTRITEDDLHNEEKITQQMDPEHRQLANAIFKL
TYQNKVVKVQRPTPTGTVMDIISRKDQRGSGQVGTYGLNTxFTNMEAQLIRQMEGEGVLSKADLExxx
xxEKKITQWLETKGVERLKRMAISGDDCVVKPIDDRFANALLALNDMGKVRKDIPQWQPSKGWHDWQQ
VPFCSHHFHELIMKDGRKLVVPCRPQDELIGRARISQGAGWSLRETACLGKAYAQMWSLMYFHRRDLR

FIG. 56-2

LASNAICSAVPVHWVPTSRTTWSIHAHHQWMTTEDMLTVWNRVWIEDNPWMEDKTPVTTWENVPYLGK
REDQWCGSLIGLTSRATWAQNIPTAIQQVRSLIGNEEFLDYMPSMKRFRKEEESEGAIW

>DENV3|peptide_length:8|string2

MNNQRKKAGKPSINMxxxxxxxxxxxxxQLAKRFSRELLNGQGPxxxxxxxxxxxxxxxAIPPTAGILAR
WGTFKKSGAIKVLRGFKREISNMLSIINRRKKTSFCLMMMLPATLAFHLTSxxGEPRMIVAKNERGKS
LLFKTATGINMCTLxxxxxGEMCDDTVTYKCPLIAEVEPEDIxxxxxxxxxxxxxxxxTCNQAGERRRDK
RSVxxxxxxGMGLDTRAQTWMSAExxxRQVEKVETWAFRHPGFTIxALFLAHYIGTSLTQKVVIFVLL
MLVTPSMAMRCVGVGxxxxxxxxxxxxxxxxxxxxxxxCVTTMAKSKPTLDIExxxxxxxxxxxxxxxxx
IEGKITNVTTDSRCPTQGEAILPEEQDQxxxxxxxxxxxxxxxxxxxxxxxxxxxxxxAKFQCLESIEGK
VVQHENLKYTVTITVHTGDQHQVGNDTQGVTVEITPQASTVEAVLPEYGTLxxxxxxxxxxxxxxxxxxx
xxxxxxxxxxxxxxxxFDLPLPWASGATTETPTWNKKELLVTFxxxxxxxxxxxxxxxxxxxxxxxxxTG
ATEIQTSGGTNIFAGHLKxxxxxxxxxxxxGMSYAMCLNAFVLKKEVxxxxxxGTILIKVEYKGEDVPCK
VPFSTEDGQGKAHSGRLITANPIVTKKDEPINIEAEPPFGESNIIIGIGDKSLKINWYRKGxxxxxxx
xxxxxxxxxxxxxxxxxxxxxxxxxxxxxxxxxxxxxxxxxSAYTALFSGVSWIMKIGIGILLTWIGLxx
xxxSMSFSCIVIGVITLYLGAVVQADTGCAVNWKGKELKCGNGIFVTNExxxxxxxxxxxxxxxxxxxx
xxxxxxxxxxxxxxxxxxxxxENLLWKQVANELNYILWENNIKLTVVVGDTIGILEQGKRALTLQPMEL
KYSWKTWGKARIVTAEIQNSSFIIDGPNTPECPNVSRAWNVWxxxxxxxxxxxxxxxIWLKLREMYTQSC
DHRLMSAAIKDERAVHxxxxxxxxxxxxxxxWKLEKASFIEVKTCTxxxxxxxxxxxxxxxxxxxxxxxx
xGPISQHNHRPGYYTQTAGPWxxxxxxxxxxxxxEGTTVVITESCGTSGPSLTTTxxxxxxxxxxxxxxx
xxxxxxxxxxxxxxxxYGMEIRPINEKEENMVKSLVSAGSGEMDNFTMGILCLAILFEEVLRGKFGKKH
MIVGVxFMFVLLLSGQITWRDMARTFIMIGSNASDKMGMGVTYxxxxATFKIQPLLALGFFLxxxxxx
xxxxxGVGLAMAATLRLPEDIEQxxxGIALGLMTLKLTTQFETYQLWTALVSLTCSNTMFTLTVAWxT
ATLILAGVSLLPLCQSSSMRKTDWLPMAVAAMGVPSLPLFIFNLKDTPKRKSWPLNEGxxxxxxVSIL
ASSFLRNDVPMxxxxxxxxxxxxxxxxxTGTSADLIVEKAADITWEEEAExxGVSHNLMVTVDDDGTMK
IKDDETExxxxxxxxxALLIVSGVFPYSIPAxxxVWHTWQKQTRRSGVLWDxxxxxxxxxxxxxxxxx
RIKQQGILGKTQVGVGIQKEGVFHxxxxxTRGAVLTHNGKRLEPNWANVKKDLISYGGGWRLNTQWKK
GEEVQVxxxxxxxNPKNFQTMPGIFQTTMGEIGAIAxxxxxxxxxxxxIINREGKIVGLYGNGVVTKSG
GYVxxxxxxNAEPDGPAxELEEEMFRKRNLTIMxxxxxxxxxxRKYLPAIIREAIKRRxxxxxxxxxxxx
xxxxxxxxxxxxxIRYQTTATKSEHTGKEIVDLMCxxxxxxxxxxxxxRVPNYNLVVMDEAHFTxxxxx
xxxxxxxTRVGMGETAAIFMTATPPGTAEAFPQSNAPIQDEEKDIPERSWNSGNEWITDFVGKTVWFV
xxxxxxxxxxxxxxxxxxxxxxxxxxxxxDTEYQKTRLNDWDFVxxxxxxEMGANFRADRVIDPxxxxx
xxxxxxxxxxxxxAGPMPVTVASAAQRRGRVGRNPPKENDQYIFMGQPLNNDxxxxxxxxxxxxxxxx
xxxxxxxxxxxxxxxxxxxxxxxxxxxxxxxxxxxxxxxxxxxDLPVWLAYKVASEGIxxxxRKWCFDG
ERNNQILExxxxxxIWTKEGERKKLRPRWxxxxxxxxxLALKEFKEFAAGRKSIAFDLVTEIGRVPTH
LAYRTRNALDxxxxxHTSEHGGKAYRHAVExxxxxxxxxxxxxxxMILLTGGVMLFLISGKGVGKTSIG
LICVIVSSGMLWMADVPLQWIASAIILEFFMMVxxxxxxxxxxxxxxxxxxxxxxxxGILTLAAIVTANE
MGMLETTKRDLGMSKEPGVASSNSYLDVDLxxxxxxxxxxxxxxxxxxxxxxxxxxxxxxxxxxxxxxxx
xxxxxxxxxxxxxxxxxxxxxxxxxxxxxxxQVNPLTLTAAVLLLVTHYAIIGxxxxxxxxxxxxxxxxx
xxxxxxxxxxxxxxxxxxxxxxxxxxxxxxxxxVMLLVLCAAQLLLMRTSWAFCEVLTLATGPxxxxxx
xxxxxxxxxxxxxxxxxxxxRGSYIAGAGLAFSVMKSVGTGRRGTGSQGxTLGEKWKKRLNQLSRKDFD
LYKKSGITEVDRIEAKEGLKRGETTHHAVSRGTAKLQWFVERNMVVPEGRVIDxxxxxxxxxxxxxxx
xxxxxxxxxxxxxxxxxxxxxMSTYGWNLVKLMTGKDVFYxxxxxxxxxxxxxxxxxxxPSPIVEEGRTI
RVLKMVEPWLRNNQFCIKVLNPYMPAVVEHLERLQRKYGGMLVRNxxxxxxxxxxxxxxxNGTGNIVSS
VNMVSRxxLNRFTMTYRKPTIERDVDLGAGxxHVNAEPEIPNMDVIGERIRRIKEEHSKTWHYDDExx
xxxxxxxxxxxxxxxxxxxxxxxxxxxxxxxKPWDVVPTVIQMAMTDTxxxxxxxxxxxxKVDTRTPRPM
PGTRRVMGITAGWLWRTLGRNKRPRLCTREEFIKKVRTNAxxxxxxxxENQWDSARAAVEDEEFWKLV
DKERELHKQGKCGSCVxxxxxxxxxxxxxxxxxxxxxxxxxYMWLGARFLEFEALGxxxxxxxxxxxxx
xxxxxxxxxxxxxxxxxxxxxxxxxxxxxxxxxxxxxxxxxxxxLHNEEKIIHQMDPEHRQLASAIFKL

FIG. 56-3

```
TYxxxxxxKVQRPTPKGTVMDIIxxxxxxxxxxxxxxxxxxxxFTNMEAQLVRQMEGEGVLTKADLExxx
xxEKKVTQWLETKGVERLRRMAISGDxxxxxxxxxDRFANALFALNDMGKxxxxxxxxWQPSKGWQDWQQ
VPFxxxxxxxxxxxxxxxxxxxxxxxxxxxxxxxQGAGWSLKETACLGKAYAQMWALMYFHRRxxx
xxxxAICSAVPVHWIPTSRTTWxxxxxxxxxMTTEDMLAVWNRVWIEEENPWMEDKTPVTTWEDVPYLGK
RxxxxxxxxxxxxxxATWAQNILIAIQQVRSLIGDEEFLDYMxxxxRFRKEEELEGAIW >DENV3|peptide_length:8|string3 xxxxxxxxxxxxxxxxxxxxxxxxxxxxLAKRFSKELLNGQGxxxxxxxxxxxxxxxxxxxxxxxxxxxx
xxxxxxxGAIKVLKSFKKEISNMLSIINKR

FIG. 56-4

```
PGTRRAMGITAEWxxxxxxxxxxxxxxxxxxxxxxxxxxxxxxxxxxxxxxxxKAAVEDEEFWILV
DRERELHKQxxxxxxxxxxxxxxxxxxxxxxxxxxxxxxxxxxxxxxxxxxxxxxxxxxxxxxxx
xxxxxxxxxxxxxxxxxxxxxx

FIG. 56-5

```
xxxxxxxxxxxxxxxxxxVLNPYMPNVIEHLERxxxxxxxxxxxxxxxxxxxxxxxxxxxxxxx
xxxxxxxxxxxxxxxxHRRPTIERxxxxxxxxxxxxxxxxxxxxxxxxxERLRRIKEEHSSTWHYDExxx
xxxxxxxxxxxxxxxxxxxxxxxxxxxxxxxxxxxxxxxxxxxxxxxxxxxxxxxxxxxxTRTPRPM
PGTRKAMEITAEWxxxxxxxxxxxxxxxxxxxxxxxxxxxxxxxxxxxxxxxxxxxxxxxEDFWILV
DRxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxITQQMDPEHRRLANAIFKx
xxxxxxxxxxxxxxxxxxxxxxxxxxxxxxxxxxxxxxxxxxxxxxxxxGEGVLSKVDLExxx
xxEKKITQWLENKGVERLKxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxTPITTWEDVPxxxx
xxxxxxxxxxxxxxxxxxxxxxxxxxxxxxxxxxxxxxxxxxxxxxxxxx >DENV3|peptide_length:8|string5 xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxNRRKRTSLCLMMVLPAALAFxxxxxxxxxxxxxxxxxx
xxxxxxxxxxxxxxxxxxxxxxxxxxTYKCPFIAExxxxxxxxxxxxxxxxxxxxxxxxxxxxx
xxxxxxxxxxxxxxxxxxxxxxxxxxxxxxxxxxxxxxxxxxxxxxxxxIQKVVIFIxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxPQASITEVILPEYxxxxxxxxxxxxxxxxx
xxxxxxxxxxxxxxxxxxxxxxxxxxxxPWTSGVITKTPTWNRxxxxxxxxxxxxxxxxxxxxx
xxxxxxxxxxxxxxxxxxxxxxxxxxxxxxxxSYAMCLGSFVLxxxxxxxxxxxxxxxxxxxxx
xxxxxxxxxxxxxxxxxxxxxxxxxxxxxxxxxxxxNIVIGVGDxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxTVVVGDVIGxxxxxxxxxxxxxxxxxx
xxxxKTWGKAKMVTAExxxxxxxxxxxxxSTPECPSALRAWNVxxxxxxxxxxxxxxxxLKLRDVYTQxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxTTVVISENCGIRGPSLRTxxxxxxxxxxxx
xxxxxxxxxxxxxxxxxxxxxxxxxxxxxxxxxVSAGSGKVDNFTMGAxxxxxxxxxxxxxxxx
xxxxxxxxxxxxxxxxxxxxxxDLAHTLIMxxxxxxxxxxxxxxxxxxxxxxxxxxxxxxxxxx
xxxxxxxxxxxxxxxxxxxxxxxxxxxxxxxxxxxxxxxxxxxxWAALVSLMCxxxxxxxxxxx
xxxxxxxISLLPLCQxxxxxxxxxxxxxTVAAMGVQPLPLFIxxLKDAPKRRSWPxxxxxxxxxxxxx
xxxxxxxxxxxxxxxxxxxxxxxxxxxxLTVEKAANVTWEEExxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxWRLSAQWKK
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxGMLWIAEIPxxxxxxxxxxxxxxxxxxxxxxxxxxxxxxxxxxxxxxxxxxxxxxx
xxxxxxxxxxxxxxEPGVVSPISYLxxxxxxxxxxxxxxxxxxxxxxxxxxxxxxxxxxxxxxx
xxxxxxxxxxxxxxxxxxxxxxxxxxxxxxAAAVLLLVxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 56-6

```
xxxxxxxxxxxxxxxxxxxxxxxxxxxxxxxxxxxxxxxxxxxxxxxxxxxxxxxxxxxxxxxx
xxxxxxxxxxxxxxxxxxxxxRRETTHHAxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxRIKRIKEEHDSxxxxxxxxx
xxxxxxxxxxxxxxxxxxxxxxxxxxxxxxxxxxxxxxxxxxxxxxxxxxxxxxxxxxxxxxxx
xGTRKAMEITxxxxxxxxxxxxxxxxxxxxxxxxxxxxxxxxxxxxxxxxxxxxxxxxNFWKLV
DRxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxQMDPEHKQLANAIFxx
xxxxxxxxxxxxxxxxxxxxxxxxxxxxxxxxxxxxxxxxxxxxxxxxxxGEGVLSEADLExxx
xxEKRIAQWLETKGxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxx
```

>DENV3|peptide_length:9|string

FIG. 56-7

LICVIASSGMLWMAEIPLQWIASAIVLEFFMMVLLIPEPEKQRTPQDNQLAYVVIGILTLAAIIAANE
MGLLETTKRDLGMSKEPGVVSPTSYLDVDLHPASAWTLYAVATTVITPMLRHTIENSTANVSLAAIAN
QAVVLMGLDKGWPISKMDLGVPLLALGCYSQVNPLTLTAAVLLLITHYAIIGPGLQAKATREAQKRTA
AGIMKNPTVDGIMTIDLDPVIYDSKFEKQLGQVMLLVLCAVQLLLMRTSWALCEALTLATGPITTLWE
GSPGKFWNTTIAVSMANIFRGSYLAGAGLAFSIMKSVGTGKRGTGSQGETLGEKWKKKLNQLSRKEFD
LYKKSGITEVDRTEAKEGLKRGEITHHAVSRGSAKLQWFVERNMVIPEGRVIDLGCGRGGWSYYCAGL
KKVTEVRGYTKGGPGHEEPVPMSTYGWNIVKLMSGKDVFYLPPEKCDTLLCDIGESSPSPTVEESRTI
RVLKMVEPWLKNNQFCIKVLNPYMPTVIEHLERLQRKHGGMLVRNPLSRNSTHEMYWISNGTGNIVAS
VNMVSRLLLNRFTMTHRRPTIEKDVDLGAGTRHVNAEPETPNMDVIGERIKRIKEEHNSTWHYDDENP
YKTWAYHGSYEVKATGSASSMINGVVKLLTKPWDVVPMVTQMAMTDTTPFGQQRVFKEKVDTRTPRSM
PGTRKVMEITAEWLWRTLGRNKKPRLCTREEFTKKVRTNAAMGAVFTEENQWDSAKAAVEDEDFWKLV
DRERELHKLGKCGSCVYNMMGKREKKLGEFGKAKGSRAIWYMWLGARYLEFEALGFLNEDHWFSRENS
YSGVEGEGLHKLGYILRDISKIPGGAMYADDTAGWDTRITEDDLHNEEKITQQMDPEHRQLANAIFKL
TYQNKVVKVQRPTPTGTVMDIISRKDQRGSGQVGTYGLNTxFTNMEAQLIRQMEGEGVLSKAxxxxxx
xxEKKITQWLETKGVERLKRMAISGDDCVVKPIDDRFANALLALNDMGKVRKDIPQWQPSKGWHDWQQ
VPFCSHHFHELIMKDGRKLVVPCRPQDELIGRARISQGAGWSLRETACLGKAYAQMWSLMYFHRRDLR
LASNAICSAVPVHWVPTSRTTWSIHAHHQWMTTEDMLTVWNRVWIEDNPWMEDKTPVTTWENVPYLGK
REDQWCGSLIGLTSRATWAQNIPTAIQQVRSLIGNEEFLDYMPSMKRFRKEEESEGAIW >DENV3|peptide_length:9|string2

MNNQRKKAGKPSINMLxxVRNRVSTGSQLAKRFSRELLNGQGPMxxxxxxxxxxxxLAIPPTAGILAR
WGTFKKSGAIKVLRGFKREISNMLSIINRRKKTSFCLMMMLPATLAFHLTSRDGEPRMIVAKNERGKS
LLFKTATGINMCTLIxxxLGEMCDDTVTYKCPLIAEVEPEDIDxxxxxxxxxxxxGTCNQAGERRRDK
RSVAxxxxVGMGLDTRAQTWMSAEGxWRQVEKVETWAFRHPGFTILALFLAHYIGTSLTQKVVIFVLL
MLVTPSMAMRCVGVGNxxxxxxxxxxxxxxxxxxxGCVTTMAKSKPTLDIELxxxxxxxxxxxxxxC
IEGKITNVTTDSRCPTQGEAILPEEQDQNxxxxxxxxxxxxxxxxxxxxxxxxxCAKFQCLESIEGK
VVQHENLKYTVTITVHTGDQHQVGNDTQGVTVEITPQASTVEAVLPEYGTLGxxxxxxxxxxxxxxx
xxxxxxxxxxxxxxxxFFDLPLPWASGATTETPTWNKKELLVTFKxxxxxxxxxxxxxxxxxxxxLTG
ATEIQTSGGTNIFAGHLKCxxxxxxxxxKGMSYAMCLNAFVLKKEVSxxxHGTILIKVEYKGEDVPCK
VPFSTEDGQGKAHSGRLITANPIVTKKDEPINIEAEPPFGESNIIGIGDKSLKINWYRKGSxxxxxx
xxxxxxxxxxxxxxxxxxxxxxxxxxxxxxxxxxGSAYTALFSGVSWIMKIGIGILLTWIGLNx
xxTSMSFSCIVIGVITLYLGAVVQADTGCAVNWKGKELKCGNGIFVTNEVxxxxxxxxxxxxxxxxx
xxxxxxxxxxxxxxxxxxxMENLLWKQVANELNYILWENNIKLTVVVGDTIGILEQGKRALTLQPMEL
KYSWKTWGKARIVTAEIQNSSFIIDGPNTPECPNVSRAWNVWExxxxxxxxxxxNIWLKLREMYTQSC
DHRLMSAAIKDERAVHAxxxxxxxxxxxSWKLEKASFIEVKTCTWxxxxxxxxxxxxxxxxxxxxx
AGPISQHNHRPGYYTQTAGPWHxxxxxxxxxxCEGTTVVITESCGTRGSSLRTTTxxxxxxxxxxxx
xxxxxxxxxxxxxxxWYGMEIRPINEKEENMVKSLVSAGSGEMDNFTMGILCLAILFEEVLRGKFGKKH
MIVGVxFMFVLLLSGQITWRDMARTFIMIGSNASDKMGMGVTHLALIATFKIQPLLALGFFLRxxxxx
xxxxLGVGLAMAATLRLPEDIEQMxNGIALGLMTLKLTTQFETYQLWTALVSLTCSNTMFTLTVAWRT
ATLILAGVSLLPLCQSSSMRKTDWLPMAVAAMGVPSLPLFIFNLKDTPKRKSWPLNEGVxxxxLVSIL
ASSFLRNDVPMAxxxxxxxxxxxxxITGTSADLIVEKAADITWEEEAEQTGVSHNLMVTVDDDGTMK
IKDDETENxxxxxxxTALLIVSGVFPYSIPATxLVWHTWQKQTRRSGVLWDVxxxxxxxxxxxxEGVY
RIKQQGILGKTQVGVGIQKEGVFHTxxxVTRGAVLTHNGKRLEPNWANVKKDLISYGGGWRLNTQWKK
GEEVQVIxxxxxKNPKNFQTMPGIFQTTMGEIGAIALxxxxxxxxxxPIINREGKIVGLYGNGVVTKSG
GYVSxxxxTNAEPDGPAPELEEEMFRKRNLTIMDxxxxxxxTRKYLPAIIREAIKRRLxxxxxxxxxx
xxxxxxxxxxxPIRYQTTATKSEHTGKEIVDLMCHxxxxxxxxxxVRVPNYNLVVMDEAHFTDxxxx
xxxxxxSTRVGMGETAAIFMTATPPGTAEAFPQSNAPIQDEEKDIPERSWNSGNEWITDFVGKTVWFV
PxxxxxxxxxxxxxxxxxxxxxxxxxxxxFDTEYQKTRLNDWDFVVxxxxSEMGANFRADRVIDPRxxxx
xxxxxxxxxxxxLAGPMPVTVASAAQRRGRVGRNPPKENDQYIFMGQPLNNDExxxxxxxxxxxxxxx

FIG. 56-8 xxxxxxxxxxxxxxxxxxxxxxxxxxxxxxxxxxxxxxxxxGDLPVWLAYKVASEGIKxxDRKWCFDG
ERNNQILEExxxxEIWTKEGERKKLRPRWLxxxxxxxxPLALKEFKEFAAGRKSIAFDLVTEIGRVPTH
LAYRTRNALDNxxxLHTSEHGGKAYRHAVEExxxxxxxxxxxxLMILLTGGVMLFLISGKGVGKTSIG
LICVIVSSGMLWMADVPLQWIASAIILEFFMMVLxxxxxxxxxxxxxxxxxxxIGILTLAAIVTANE
MGMLETTKRDLGMSKEPGVASSNSYLDVDLHxxxxxxxxxxxxxxxxxxxxxxxxxxxxxxxxxxxxx
xxxxxxxxxxxxxxxxxxxxxxxxxxxxxxxxSQVNPLTLTAAVLLLVTHYAIIGPxxxxxxxxxxxxx
xxxxxxxxxxxxxxxxxxxxxxxxxxxxxxxxxQVMLLVLCAAQLLLMRTSWAFCEVLTLATGPIxxxxx
xxxxxxxxxxxxxxxxxFRGSYIAGAGLAFSIMKSVGTGRRGTGSQGETLGEKWKKKLNQLSRKDFD
LYKKSGITEVDRIEAKEGLKRGETTHHAVSRGTAKLQWFVERNMVVPEGRVIDLxxxxxxxxxxxxx
xxxxxxxxxxxxxxxxxxxxxxxPMSTYGWNLVKLMTGKDVFYLxxxxxxxxxxxxxxxxxSPSPTVEEGRTI
RVLKMVEPWLRNNQFCIKVLNPYMPAVVEHLERLQRKYGGMLVRNPxxxxxxxxxxxxxSNGTGNIVSS
VNMVSRLLLNRFTMTYRKPTIERDVDLGAGTRHVNAEPEIPNMDVIGERIRRIKEEHSSTWHYDEENx
xxxxxxxxxxxxxxxxxxxxxxxxxxxxxxxxxxxxxTKPWDVVPTVIQMAMTDTTxxxxxxxxxEKVDTRTPRPM
PGTRRVMGITAGWLWRTLGRNKRPRLCTREEFIKKVRTNAAxxxxxxEENQWDSARAAVEDEEFWKLV
DKERELHKQGKCGSCVYxxxxxxxxxxxxxxxxxxxxxxxxxxxxWYMWLGARFLEFEALGFxxxxxxxxxxxxx
xxxxxxxxxxxxxxxxxxxxxxxxxxxxxxxxxxxxxxxxDLHNEEKIIQQMDPEHRQLASAIFKL
TYQxxxVKVQRPTPKGTVMDIISxxxxxxxxxxxxxxxxxxxFTNMEAQLVRQMEGEGVLTKAxxxxxx
xxEKKVTQWLETKGVERLRRMAISGDDxxxxxxDDRFANALFALNDMGKVxxxxxQWQPSKGWQDWQQ
VPFCxxxxxxxxxxxxxxxxxxxxxxxxxxxxxxSQGAGWSLKETACLGKAYAQMWALMYFHRRDxx
xxxNAICSAVPVHWIPTSRTTWSxxxxxxxWMTTEDMLAVWNRVWIEENPWMEDKTPVTTWEDVPYLGK
RExxxxxxxxxxxxxRATWAQNILIAIQQVRSLIGDEEFLDYMPxxKRFRKEEELEGAIW >DENV3|peptide_length:9|string3 xxxxxxxxxxxxxxxxxxxxxxxxxxxQLAKRFSKELLNGQGPxxxxxxxxxxxxxxxxxxxxxxxxxx
xxxxxxSGAIKVLKGFKKEISNMLSIINKRKKTSLCLVMILPATLAFHxxxxxxxxxxxxxxxxxxxxxx
xxxxxxxxxxxxxxxxxxxxxxxDTVTYKCPLVAEVEPEDIxxxxxxxxxxxxxxxxxxxxxxxxxxxxx
xxxxxxxxxxxxxxxxxxxxxxxxxxxxxxxxxxxxxxxxxxxLAHYIGTSLTQKAVIFTLL
MLVTPSxxxxxxxxxxxxxxxxxxxxxxxxxxxxxxxxxxxxxxxxxxxxxxxxxxxxxxxxxxxxxx
xxxxxxxxxxxxRCPTQGEATLPEEQDQNxxxxxxxxxxxxxxxxxxxxxxxxxxxCAKFQCLELIEGK
AVQHENLKYTVTxxxxxxxxxxxGNDTQGVTAEITPQASTVEVILPEYGTLxxxxxxxxxxxxxxxxx
xxxxxxxxxxxxxxxxLPLPWTSGATAETPIWNRKExxxxxxxxxxxxxxxxxxxxxxxxxxxxxxxx
xxEIQNLGGTSIFAGxxxxxxxxxxxxKGMSYAMCSGSFVLKKEVSxxxxxTILIKVEYRGEDVPCK
IPFSTEDEQGKVHNGRLxTANPVVTKKEEPINIEAExxxGESNIVIGTGDNALKINWYRKxxxxxxxx
xxxxxxxxxxxxxxxxxxxxxxxxxxxxxxxxxxxxxxxxxxxALFGGVSWVMKIGIGILxxxxxxxxx
xxxxxSFSCIAIGIITLYLGTVVQADMGCVVNWKGKELxxxxxxxxxxxxxxxxxxxxxxxxxxxxxxx
xxxxxxxxxxxxxxxxxxxxxxxxxxxxxxxxxxxxNHILWENNVKLTVVVGDITGVLEQGKRTLPPQPMEL
KYSWKAWGKAKIVIAETQNFSFIIDGPNTPECPSTSRAWNVWExxxxxxxxxxxxNIWLKLREVHTQTC
DHRLMSAxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxCEGTTVVIAENCGTKGPSLRTTTxxxxxxxxxxxxx
xxxxxxxxxxxxxxxxYGMEIRPVNEKEENMVxSLVSAGSGKADNFTMGALCLAILFExxxxxxxGKKH
MIAGAxLIFVLLLSGQITWRDLTHTLIMIGSNATDRMGMGVTxxxxxxxxxxxxxxxxxxxxxxxxxxx
xxxxxxxxxxMTTTLQLPADIExxxxxxxLGLMALKLTTQFETYQLWTALVSLMCANTIFTLTVxxxT
ATLILAVISLLPMCQSSSMRKSDWLPVAVAAMGAQPLPLFIFSLKDTPKRKSWPLNxxxxxxxxxxxx
xxxxxxxxxxxxxxxxxxxxxxxxxxxxxxSADLTVEKVAEVTWEEEAExxxxxxxxxxxxxxxxxxxxx
xxxxxxxxxxxxxxxxxxxxxxxxxxxWHTWQKRTQRSxxxxxxxxxxxxxxxxxxxxxxxxxxxxxxx
xxxxxxxxxxxxxxxxxxxxxxxxxxxxxxxxxxxxxxxxxxxxxxxxxxxSYGGGWKLSAQWKK
GEEVxxxxxxxxxxxxKNFQTTPGIFQTTTGEIGAVAxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxPIRYQTSAIKSEHTGRExxxxxxxxxxxxxxxxxxxxRVPNYNLIVMDEAHFTxxxxx

FIG. 56-9

```
xxxxxxxxxxxxxxxxxxxxxxxxxxxxxxxxxxxxxxxxxxxxxGNDWITDFTGKTVWFV
Pxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxGRNSQKENDQYIxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxGRVPSH
LAHKTRNALDxxxxxxxxxxxxxxxxxxxxxxxxxxxxxxxxxxxTGGAMLFLVSGKGIGKTSIG
LICVVASSGMLWMAEVPLQWIASxxxxxxxxxxxxxxxxxxxxxxxxxxxxxGILTLAAIVTANE
MGLLxxxxxxxxGMSKEPGVVSPNSYLDVDLxxxxxxxxxxxxxxxxxxxxxxxxxxxxxxxx
xxxxxxxxxxxxxxxxxxxxxxxxxxxxxxxxVNPLTLTAVVLLLVTHYxxxxxxxxxxxxxxxxx
xxxxxxxxxxxxxxxxxxxxxxxxxxxxxxxxVMLLILCAVQLLLxRTSWALCEVLTLATxxxxxxxx
xxxxxxxxxxxxxxxxxxxxxxxxxxxxxxxxVMKSVGTGKRGTGLQxxTLGEKWKRRLNQLSWKEFD
LYKKSGITEVDRSEAKEGLKKGEVTHHAVSRGxxxxxxxxxxxxxxxxxxxxxxxxxxxxxxxx
xxxxxxxxxxxxxxxxxxxxxxxxxxMSTYGWNIIKLMSGKDVxxxxxxxxxxxxxxxxxxxxx
xxxKMVEPWLKNNQFCIKILNPYMPTVVEHLERLxxxxxxxxxxxxxxxxxxxxxxxxxxxxxxx
xxxxxxxxxNRFTMTYRRPTIERDVDxxxxxxxxxxxxxxxDVIGERIKRIKGEHSKTWHYDDExx
xxxxxxxxxxxxxxxxxxxxxxxxxxxxxxxPWDVVPMVIQMAMTDxxxxxxxxxxxxxKVDTRTPKPM
PGTRRAMEITAGWLWRxxxxxxxxxxxxxxxxTRKVRTNAAxxxxxxxxxxxxAKAAVEDEEFWILV
DRERELHKQGxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxDLHNEEKIMQQMDPEHRLLANAIFKL
xxxxxxxxxxxxxxxxxxxxxxxxxxxxxxxxxxxxxxxxxxxxxFTNMEVQLIRQMEGEGVLSKTxxxxxx
xxEKKITQWLETEGVERLKRMxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxGKAYAQMWTLMYFHRRDxx
xxxxxxCSAVPAHWVPTSRTxxxxxxxxxxWMTTEDMLSVWNRVWIExxxWMENKTPITTWENVPYxxx
xxxxxxxxxxxxxxxATWAQNILIAIQQVRSxxxxxxxxxxxxxxKRFRKEEETEGAIW >DENV3|peptide_length:9|string4 xxxxxxxxxxxxxxxxxxxxxxxxxxxxxxxxxxxxxxxxxxxxxxxxxxxxxxxxxxxxxx
xxxxxxxxxIKVLKSFKKEISNxxxxxN

FIG. 56-10

```
GEExxxxxxxxxxxxxKNFQTTPGIFQTTxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxIRYQTTVTKSEHTGRxxxxxxxxxxxxxxxxxxxxxxxxxxxxxxxxx
xxxxxxxxxxxxxxxxxxxxxxxxxxxxxxxxxxxxxxxxxxxxxxxxGNEWITDFTGKxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxSH
LAYRTRSxxxxxxxxxxxxxxxxxxxxxxxxxxxxxxxxxxxxxxxxxLFLISGRGIGKATIG
LICVTVSSGMLWMADIPLQWIASxxxxxxxxxxxxxxxxxxxxxxxxxxILTLAATIAANE
MGLxxxxxxxxxxSREPGVVSPNSYLDVxxxxxxxxxxxxxxxxxxxxxxxxxxxxxxxxxx
xxxxxxxxxxxxxxxxxxxxxxxxxxxxxxxxxxLIAAVLLLVTxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxKKKLNQLSWKEFD
LYKxxxxxxxxxTEAKEGLKRRETTHHAVSxxxxxxxxxxxxxxxxxxxxxxxxxxxxxxxx
xxxxxxxxxxxxxxxxxxxxxxxxxGWNIIKLMSGKDxxxxxxxxxxxxxxxxxxxxxxxxx
xxxxxxxxxxxxxxxxxxxKVLNPYMPNVIEHLERLxxxxxxxxxxxxxxxxxxxxxxxxxx
xxxxxxxxxxxxxxxxTHRRPTIERDxxxxxxxxxxxxxxxxxxxGERIERIKDEHSSTWHYDEExx
xxxxxxxxxxxxxxxxxxxxxxxxxxxxxxxxxxxxxxxxxxxxxxxxxxDTRTPRPM
AGTRKAMEITAEWLxxxxxxxxxxxxxxxxxxxxxxxxxxxxxxxxxxxAVEDEDFWILV
DRExxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxKITQQMDPEHKRLANAIFKL
xxxxxxxxxxxxxxxxxxxxxxxxxxxxxxxxxxxxxxxxxxxxxxEGEGVLSKVxxxxxx
xxEKKIAQWLENKGVERLKRxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxRMTTEDMLTxxxxxxxxxxxxxxKTPITTWEDVPYxxx
xxxxxxxxxxxxxxxxxxxxxxxxxxxxxxxxxxxxxxxxxxxxxxxxxxx >DENV3|peptide_length:9|string5 xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxNRRKRTSLCxxMMFPATLAFHxxxxxxxxxxxxxxxx
xxxxxxxxxxxxxxxxxxxxxxxxxxxxTYKCPFIAExxxxxxxxxxxxxxxxxxxxxxxxx
xxxxxxxxxxxxxxxxxxxxxxxxxxxxxxxxxxxxxxxxxxxxxxLTQKVVIFTLx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxTSQASITEVILPEYGxxxxxxxxxxxxxxxxx
xxxxxxxxxxxxxxxxxxxxxxxxLPWTSGTTTKTPTWNRKxxxxxxxxxxxxxxxxxxxxx
xxxxxxxxxxxxxxxxxxxxxxxxxxMSYAMCLGSFVLxxxxxxxxxxxxxxxxxxKGKDAPCK
IxxxxxxxxxxxxxxxxxxxxxxxxxVVIKKEEPVxxxxxxxxxxSNIVIGVGDxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxLTVVVGDVIGxxxxxxxxxxxxx
xxxWKTWGKAKMVTAExxxxxxxxxxxPSTPECPSAARAWNVWxxxxxxxxxxxxxxWLKLREAYTQxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxGTTVVISENCGMRGPSLRTTxxxxxxxxxxxxxxxxx
xxxxxxxxxxxxxxxxxxxxxxxxxxTSEKEENMVxxLVSAGSGKVDNFTMGALxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxLWAALVSLMCxxxxxxxxxxxxxx
xxxxxxxISLLPLCQSxxxxxxxxxxxxxxVAAMGVQPLPLFIFxLKDAPKRRSWPLxxxxxxxxxxxxxxxxx
```

FIG. 56-11

```
xxxxxxxxxxxxxxxxxxxxxxxxxxxxxxxDLTVEKAPDVTWEEEAxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxGWRLSAQWKK
Gxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxSH
LAHRTKNxxxxxxxxxxxxxxxxxxxxxxxxxxxxxxxxxxxxxxxxxxxxxxxxxxxxxxxxxx
xxxxIASSGMLWIAEIPLxxxxxxxxxxxxxxxxxxxxxxxxxxxxxxxxxxxxxxxxxIIAANE
MGMxxxxxxxxxxxxEPGVVPPTSYLDxxxxxxxxxxxxxxxxxxxxxxxxxxxxxxxxxxxxxx
xxxxxxxxxxxxxxxxxxxxxxxxxxxxxxxxxxxLAAAVLLLVTxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxKKLNQLSWKExx
xxxxxxxxxxxxxxxxxxxRGEITRHAVxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxERIKRIKEEHRSTxxxxxxxxx
xxxxxxxxxxxxxxxxxxxxxxxxxxxxxxxxxxxxxxxxxxxxxxxxxxxxxxxxxxxxxxxxxx
xGTRKVMGITxxxxxxxxxxxxxxxxxxxxxxxxxxxxxxxxxxxxxxxxxxxxxxxxxENFWKLV
DRExxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxTHQMDPEHRRLANAIFKx
xxxxxxxxxxxxxxxxxxxxxxxxxxxxxxxxxxxxxxxxxxxxxxxxxxxxEGEGVLSEAxxxxxx
xxEKRIIQWLETKGVxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
```

FIG. 56-12

>DENV3|peptide_length:10|string1

MNNQRKKTGKPSINMLKR

FIG. 56-13

LASNAICSAVPVHWVPTSRTTWSIHAHHQWMTTEDMLTVWNRVWIEDNPWMEDKTPVTTWENVPYLGK
REDQWCGSLIGLTSRATWAQNIPTAIQQVRSLIGNEEFLDYMPSMKRFRKEEESEGAIW

>DENV3|peptide_length:10|string2

MNNQRKKAGKPSINMLKRVR

FIG. 56-14

TYQNxVVKVQRPTPKGTVMDIISRxxxxxxxxxxxxxxxxxxFTNMEAQLVRQMEGEGVLTKAxxxxxx
xxxxxxTQWLETKGVERLRRMAISGDDCxxxxIDDRFANALFALNDMGKVRxxxPQWQPSKGWQDWQQ
VPFCSxxxxxxxxxxxxxxxxxxxxxxxxxxISQGAGWSLKETACLGKAYAQMWALMYFHRRDLx
xxSNAICSAVPVHWIPTSRTTWSIxxxxQWMTTEDMLTVWNRVWIEENPWMEDKTPVTTWEDVPYLGK
REDxxxxxxxxxxSRATWAQNILIAIQQVRSLI

FIG. 56-15

PGTRxAMEITAGWLWRTxxxxxxxxxxxxxxxFTRKVRTNAAMxxxxxxxxxxxxSAKAAVEDEEFWILV
DRERELHKQGKxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxDDLHNEEKIMQQMDPEHRLLANAIFKL
TxxxxxxxxxxxxxxxxxxxxxxxxxxxxxxxxxxxxxxxxFTNMEVQLIRQMEGEGVLSKTxxxxxx
xxxxxxAQWLETEGVERLKRMAxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxLGKAYAQMWTLMYFHRRDLx
xxxxxICSAVPAHWVPTSRTTxxxxxxxQWMTTEDMLAVWNRVWIEDxPWMEDKTPITTWENVPYLxx
xxxxxxxxxxxxxRATWAQNILIAIQQVRSLxxxxxxxxxxxxxMKRFRKEEETEGAIW >DENV3|peptide_length:10|string4 xxxxxxxxxxxxxxxxxxxxxxxxxxxxxxxxxxxxxxxxxxxxxxxxxxxxxxxxxxxxxxxxxxxx
xxxxxxxxAIKVLKSFKKEISSMLSIINRRKRTSLCLMMMFPATLAFHLxxxxxxxxxxxxxxxxxxx
xxxxxxxxxxxxxxxxxxxxxxxxDDTITYKCPLIxxxxxxxxxxxxxxxxxxxxxxxxxxxxxxxxx
xxxxxxxxxxxxxxxxxxxxxxxxxxxxxxxxxxxxxxxxxxxLAHYVGTSLIQKVVIFTLL
MLVxxxxxxxxxxxxxxxxxxxxxxxxxxxxxxxxxxxxxxxxxxxxxxxxxxxxxxxxxxxxxxxxx
xxxxxxxxxxxSRCPTQGEAALPEEQDQNYxxxxxxxxxxxxxxxxxxxxxxxxxxCAKFQCLEPVEGK
xxxxxxxxxxxxxxxxxxxxxxxxxxxxxxxEITPQASIAEAILPEYGTxxxxxxxxxxxxxxxxxxx
xxxxxxxxxxxxxxxxxxLPLPWTSGTTTETPIWNRKExxxxxxxxxxxxxxxxxxxxxxxxxxxxxx
xxEIQNSGGTSIFSGxxxxxxxxxxxxxxGMSYAMCLGSFVLKKEVSxxxxxxILIKVEYKGKDAPCK
IPFSTEDGQGKVHNGRLxTANPVVIKKEEPVNIExxxxFGESNIIIGTGDKALKINWYRKxxxxxxxx
xxxxxxxxxxxxxxxxxxxxxxxxxxxxxxxxxxxxxxxxxTALFGGVSWMMKIGIGVLLxxxxxxx
xxxxxSFSCITIGIITLYLGTVVQADMGCVVNWKGKxxxxxxxxxxxxxxxxxxxxxxxxxxxxxxxx
xxxxxxxxxxxxxxxxxxxxxxxxxxxxxxLWENSIKLTIVVGDVIGVLEQGKRTLTLQPMEL
KxSWKAWGKAKVVTAENQNSSFIIDGPNTPECPNTSRAWNVWExxxxxxxxxxxxNIWLKLREMYSQLC
DHRLMSxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxEGTTVVITEDCGTSGPSLTTTTxxxxxxxxxxxxxxxx
xxxxxxxxxxxxxxxWYGMEIRPVSEKEENMVKSLASAGSGKMDNFTMGVLCxxxxxxxxxxxxFGKKH
MIAGIxFIFVLLLSGQITWRGMAHTLIMIGSNTSDRMGMGVxxxxxxxxxxxxxxxxxxxxxxxxxxx
xxxxxxxxxxxTTTLQLPEDIxxxxxxxxxxxxxxxxxxxxxETYQLWTALASLMCANTIFTLTxxxxx
xTLILAGISLLPLCQSSxMRKTDWLPMTVAAMGVSPLPLFIFGLKDALKRRSWPLNxxxxxxxxxxxx
xxxxxxxxxxxxxxxxxxxxxxxxxxxxxxADLTVEKAPNVTWEEEAEQxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxSYGGGWRLSAQWKK
GEEVxxxxxxxxxxPKNFQTTPGIFQTTxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxPIRYQTTVTKSEHTGRExxxxxxxxxxxxxxxxxxxxxxxxxxxxxxxxxxxxxxxx
xxxxxxxxxxxxxxxxxxxxxxxxxxxxxxxxxxxxxxxxxxxxxxxxxSGNEWITDFTGKTxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxPSH
LAYRTRSAxxxxxxxxxxxxxxxxxxxxxxxxxxxxxxxxxxxxxxxxxxxxMLFLVSGRGIGKTTIG
LICVTVSSGMLWMADIPLQWIASAxxxxxxxxxxxxxxxxxxxxxxxxxxxxxxxGILTLAATIAANE
MGLLxxxxxxxxMSREPGVVSPNSYLDVDxxxxxxxxxxxxxxxxxxxxxxxxxxxxxxxxxxxxxxx
xxxxxxxxxxxxxxxxxxxxxxxxxxxxxxTLIAAVLLLVTHxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxWKKKLNQLSWKEFD
LYKKxxxxxxxxRTEAKEGLKRGEITRHAVSRGSxxxxxxxxxxxxxxxxxxxxxxxxxxxxxxxxx
xxxxxxxxxxxxxxxxxxxxxxxxxxxxYGWNIVKLMTGKDVxxxxxxxxxxxxxxxxxxxxxxxxxx

FIG. 56-16

```
xxxxxxxxxxxxxxxxxIKILNPYMPNVIEHLERLQxxxxxxxxxxxxxxxxxxxxxxxxxxxxxx
xxxxxxxxxxxxxMTHRRPTIERDVxxxxxxxxxxxxxxxxxDVIGERIKRIKEEHSSTWHYDEENx
xxxxxxxxxxxxxxxxxxxxxxxxxxxxxxxxxxxxxxxxxxxxxxxxxxxxxxxxxVDTRTPRPM
AGTRxAMGITAEWLWxxxxxxxxxxxxxxxxxxxxxxxxxxxxxxxxxxxSAKAAVEDEDFWILV
DRERKLHKLxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxNEEKITHQMDPEHKRLANAIFKL
TxxxxxxxxxxxxxxxxxxxxxxxxxxxxxxxxxxxxxxxxxxxxxxxxMEGEGVLSKVxxxxxx
xxxxxxTQWLENKGVERLKRMxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxQRMTTEDMLSVWNRVWIEDxxxxxDKTPITTWEDVPYLxx
xxxxxxxxxxxxxxxxxxxxxxxxxxxxxxxxxxxxxxxxxxxxxxxxxxxxxxxxxxx >DENV3|peptide_length:10|string5 xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxMVLPAALAFHLxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxSLTQKVVIFTLL
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxITSQASTTEVILPEYGTxxxxxxxxxxxxxxxxx
xxxxxxxxxxxxxxxxxxxPLPWTSGVTTKTPTWNRKExxxxxxxxxxxxxxxxxxxxxxxxxxx
xxxxxxxxxxxxxxxxxxxxxxxxxGMSYAMCLGSFVLxxxxxxxxxxxxxVKVEYKGKDAPCK
IPxxxxxxxxxxxxxxxxxxxPVVIKKEEPVNxxxxxxxxESNIVIGVGDKALRINWYKxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxVVVQADIGCVINWKGKxxxxxxxxxxxxxxxxxxxxxxxx
xxxxxxxxxxxxxxxxxxxxxxxxxxxxxxxxxxxxxxxxLTVVVGDVLGVLEQGKRTLTPQPTEL
KxSWKTWGKAKMVTAExxxxxxxxxGPSTPECPSALRAWNVWExxxxxxxxxxxxIWLKLRDVYTQxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxEGTTVVISENCGTRGSSLRTTTxxxxxxxxxxxx
xxxxxxxxxxxxxxxxxxxxxxxxxxPTSEKEENMVKSLVSAGSGKVDNFTMGALCxxxxxxxxxxxxxxxx
xxxxxxxxxxxxxxxxxxxxxxxxxxAHTLIMVGSNAxxxxxxxxxxxxxxxxxxxxxxxxxxxx
xxxxxxxxxxxxxxxxxxxxxxxxxxxxxxxxxxxxxxxxxxQLWAALVSLTCxxxxxxxxxxxxx
xxxxxxxVSLLPMCQSSxxxxxxxxxxxxVAAMGVQPLPLFIFxLKDAPKRRSWPLNxxxxxxxxxx
xxxxxxxxxxxxxxxxxxxxxxxxxxxxxADLTVEKAANVTWEEEAExxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxGGWRLSAQWKK
GExxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxTVTKSEHTGRxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxPSH
LAHRTKNAxxxxxxxxxxxxxxxxxxxxxxxxxxxxxxxxxxxxxxxxxxxISGKGIGKASIG
LICVIASSGMLWIAEIPLQxxxxxxxxxxxxxxxxxxxxxxxxxxxxxxxxxxxxxAIIAANE
MGMLxxxxxxxxxxxEPGVVSPISYLDVxxxxxxxxxxxxxxxxxxxxxxxxxxxxxxxxxxxx
xxxxxxxxxxxxxxxxxxxxxxxxxxxxxxTLAAAVLLLVTHxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
```

FIG. 56-17

```
xxxxxxxxxxxxxxxxxxxxxxxxxxxxxxxxxxxxxxxxxxxxxxxxxxxKKKLNQLSRREFx
xxxxxxxxxxxxTEAKEGLRRGEVTHHAVSRGSxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxVLNPYMPNVIxxxxxxxxxxxxxxxxxxxxxxxxxxxxxxxxxxxxx
xxxxxxxxxxxxxxxxxxxxxxxxxxxxxxxxxxxxxxxxxxxxGERVKRVKEEHNSTWxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxDENFWKLV
DRERxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxITQQMDPEHRRLANAIFKL
xxxxxxxxxxxxxxxxxxxxxxxxxxxxxxxxxxxxxxxxxxxxxMEGEGVLSEAxxxxxxx
xxxxxxIQWLETKGVExxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
```

>DENV3|peptide_length:11|string1

```
MNNQRKKTGKPSINMLKRVRNRVSTGSQLAKRFSKGLLNGQGPMKLVMAFIAFLRFLAIPPTAGVLAR
WGTFKKSGAIKVLKGFKKEISNMLSIINKRKKTSxxxxMILPAALAFHLTSRDGEPRMIVGKNERGKS
LLFKTASGINMCTLIAMDLGEMCDDTVTYKCPHITEVEPEDIDCWCNLTSTWVTYGTCNQAGEHRRDK
RSVALAPHVGMGLDTRTQTWMSAEGAWRQVEKVETWALRHPGFTILALFLAHYIGTSLTQKVVIFILL
MLVTPSMTMRCVGVGNRDFVEGLSGATWVDVVLEHGGCVTTMAKNKPTLDIELQKTEATQLATLRKLC
IEGKITNITTDSRCPTQGEAVLPEEQDQNYVCKHTYVDRGWGNGCGLFGKGSLVTCAKFQCLEPIEGK
VVQYENLKYTVIITVHTGDQHQVGNETQGVTAEITPQASTTEAILPEYGTLGLECSPRTGLDFNEMIL
LTMKNKAWMVHRQWFFDLPLPWTSGATTETPTWNRKELLVTFKNAHAKKQEVVVLGSQEGAMHTALTG
ATEIQNSGGTSIFAGHLKCRLKMDKLELKGMSYAMCTNTFVLKKEVSETQHGTILIKVEYKGEDAPCK
IPFSTEDGQGKAHNGRLITANPVVTKKEEPVNIEAEPPFGESNIVIGIGDNALKINWYKKGSSIGKMF
EATARGARRMAILGDTAWDFGSVGGVLNSLGKMVHQIFGSAYTALFSGVSWVMKIGIGVLLTWIGLNS
KNTSMSFSCIAIGIITLYLGAVVQADMGCVINWKGKELKCGSGIFVTNEVHTWTEQYKFQADSPKRLA
TAIAGAWENGVCGIRSTTRMENLLWKQIANELNYILWENNIKLTVVVGDIIGVLEQGKRTLTPQPMEL
KYSWKTWGKAKIVxAETQNSSFIIDGPNTPECPSASRAWNVWEVEDYGFGVFTTNIWLKLREVYTQLC
DHRLMSAAVKDERAVHADMGYWIESQKNGSWKLEKASLIEVKTCTWPKSHTLWSNGVLESDMIIPKSL
AGPISQHNYRPGYHTQTAGPWHLGKLELDFNYCEGTTVVITENCGTRGPSLRTTTVSGKLIHEWCCRS
CTLPPLRYMGEDGCWYGMEIRPISEKEENMVKSLVSAGSGKVDNFTMGVLCLAILFEEVMRGKFGKKH
MIAGVxFTFVLLLSGQITWRDMAxTLIMIGSNASDRMGMGVTYLALIATFKIQPFLALGFFLRKLTSR
ENLLGVGLAMATTLQLPEDIEQMANGIALGLMALKLITQFETYQLWTALISLTCSNTIFTLTVAWRT
ATLILAGVSLLPVCQSSSMRKTDWLPMTVAAMGVPPLPLFIFSLKDTLKRRSWPLNEGVMAVGLVSIL
ASSLLRNDVPMAGPLVAGGLLIACYVITGTSADLTVEKAADVTWEEEAEQTGVSHNLMITVDDDGTMR
IKDDETENILTVLLKTALLIVSGIFPYSIPATLLVWHTWQKQTQRSGVLWDVPSPPETQKAELEEGVY
RIKQQGIFGKTQVGVGVQKEGVFHTMWHVTRGAVLTYNGKRLEPNWASVKKDLISYGGGWRLSAQWQK
GEEVQVIAVEPGKNPKNFQTMPGTFQTTTGEIGAIALDFKPGTSGSPIINREGKVVGLYGNGVVTKNG
GYVSGIAQTNAEPDGPTPELEEEMFKKRNLTIMDLHPGSGKTRKYLPAIVREAIKRRLRTLILAPTRV
VAAEMEEALKGLPIRYQTTATKSEHTGREIVDLMCHATFTMRLLSPVRVPNYNLIIMDEAHFTDPASI
AARGYISTRVGMGEAAAIFMTATPPGTADAFPQSNAPIQDEERDIPERSWNSGNEWITDFAGKTVWFV
PSIKAGNDIANCLRKNGKKVIQLSRKTFDTEYQKTKLNDWDFVVTTDISEMGANFKADRVIDPRRCLK
PVILTDGPERVILAGPMPVTAASAAQRRGRVGRNPQKENDQYIFTGQPLNNDEDHAHWTEAKMLLDNI
NTPEGIIPALFEPEREKSAAIDGEYRLKGESRKTFVELMRRGDLPVWLAHKVASEGIKYTDRKWCFDG
QRNNQILEENMDVEIWTKEGEKKKLRPRWLDARTYSDPLALKEFKDFAAGRKSIALDLVTEIGRVPSH
LAHRTRNALDNVLMLHTSEHGGRAYRHAVEELPETMETLLLLGLMILLTGGAMLFLISGKGIGKTSIG
LICVIASSGMLWMAEIPLQWIASAIVLEFFMMVLLIPEPEKQRTPQDNQLAYVVIGILTLAAIIAANE
```

FIG. 56-18

MGLLETTKRDLGMSKEPGVVSPTSYLDVDLHPASAWTLYAVATTVITPMLRHTIENSTANVSLAAIAN
QAVVLMGLDKGWPISKMDLGVPLLALGCYSQVNPLTLTAAVLLLITHYAIIGPGLQAKATREAQKRTA
AGIMKNPTVDGIMTIDLDPVIYDSKFEKQLGQVMLLVLCAVQLLLMRTSWALCEALTLATGPITTLWE
GSPGKFWNTTIAVSMANIFRGSYLAGAGLAFSIMKSVGTGKRGTGSQGETLGEKWKKKLNQLSRKEFD
LYKKSGITEVDRTEAKEGLKRGEITHHAVSRGSAKLQWFVERNMVIPEGRVIDLGCGRGGWSYYCAGL
KKVTEVRGYTKGGPGHEEPVPMSTYGWNIVKLMSGKDVFYLPPEKCDTLLCDIGESSPSPTVEESRTI
RVLKMVEPWLKNNQFCIKVLNPYMPTVIEHLERLQRKHGGMLVRNPLSRNSTHEMYWISNGTGNIVAS
VNMVSRLLLNRFTMTHRRPTIEKDVDLGAGTRHVNAEPETPNMDVIGERIKRIKEEHNSTWHYDDENP
YKTWAYHGSYEVKATGSASSMINGVVKLLTKPWDVVPMVTQMAMTDTTPFGQQRVFKEKVDTRTPRSM
PGTRxVMEITAEWLWRTLGRNKKPRLCTREEFTKKVRTNAAMGAVFTEENQWDSAKAAVEDEDFWKLV
DRERELHKLGKCGSCVYNMMGKREKKLGEFGKAKGSRAIWYMWLGARYLEFEALGFLNEDHWFSRENS
YSGVEGEGLHKLGYILRDISKIPGGAMYADDTAGWDTRITEDDLHNEEKITQQMDPEHRQLANAIFKL
TYQNKVVKVQRPTPTGTVMDIISRKDQRGSGQVGTYGLNTxFTNMEAQLIRQMEGEGVLSKAxxxxxx
xxxxxxTQWLETKGVERLKRMAISGDDCVVKPIDDRFANALLALNDMGKVRKDIPQWQPSKGWHDWQQ
VPFCSHHFHELIMKDGRKLVVPCRPQDELIGRARISQGAGWSLRETACLGKAYAQMWSLMYFHRRDLR
LASNAICSAVPVHWVPTSRTTWSIHAHHQWMTTEDMLTVWNRVWIEDNPWMEDKTPVTTWENVPYLGK
REDQWCGSLIGLTSRATWAQNIPTAIQQVRSLIGNEEFLDYMPSMKRFRKEEESEGAIW >DENV3|peptide_length:11|string2

MNNQRKKAGKPSINMLKRVRNRVSTGSQLAKRFSRELLNGQGPMKLxxxxxxxxRFLAIPPTAGILAR
WGTFKKSGAIKVLRGFKREISNMLSIINRRKKTSxxxxMMLPATLAFHLTSRDGEPRMIVAKNERGKS
LLFKTATGINMCTLIAMDLGEMCDDTVTYKCPLIAEVEPEDIDCWxxxxxTWVTYGTCNQAGERRRDK
RSVALAPHVGMGLDTRAQTWMSAEGAWRQVEKVETWAFRHPGFTILALFLAHYIGTSLTQKVVIFVLL
MLVTPSMAMRCVGVGNRDxxxxxxxxxxxxxxxHGGCVTTMAKSKPTLDIELQKxxxxxxxxxxKLC
IEGKITNVTTDSRCPTQGEAILPEEQDQNYVxxxxxxxxxxxxxxxxxxxxxVTCAKFQCLESIEGK
VVQHENLKYTVTITVHTGDQHQVGNDTQGVTVEITPQASTVEAVLPEYGTLGLExxxxxxxxxxxxx
xxxxxxxxxxxxQWFFDLPLPWASGATTETPTWNKKELLVTFKNAxxxxxxxxxxxxxxxxxTALTG
ATEIQTSGGTNIFAGHLKCRLxxxxxELKGMSYAMCLNAFVLKKEVSETQHGTILIKVEYKGEDVPCK
VPFSTEDGQGKAHNGRLITANPIVTKKDEPINIEAEPPFGESNIIIGIGDKSLKINWYRKGSSIxxxx
xxxxxxxxxxxxxxxxxxxxxxxxxxxxxxxxxIFGSAYTALFSGVSWIMKIGIGILLTWIGLNS
KNTSMSFSCIVIGVITLYLGAVVQADTGCAVNWKGKELKCGNGIFVTNEVHTxxxxxxxxxxxxxxx
xxxxxxxxxxxxxxxxTRMENLLWKQVANELNYILWENNIKLTVVVGDTIGILEQGKRALTLQPMEL
KYSWKTWGKARIVxAEIQNSSFIIDGPNTPECPNVLRAWNVWEVEDxxxxxxTTNIWLKLREMYTQSC
DHRLMSAAIKDERAVHADMxxxxxxxxNGSWKLEKASFIEVKTCTWPKxxxxxTNGVLESDMIIxxSL
AGPISQHNHRPGYYTQTAGPWHLGKLDLxxNYCEGTTVVITESCGTRGPALRTTTVSxxxxxxxxxxx
xxxxxxxxxxxxGCWYGMEIRPINEKEENMVKSLVSAGSGEMDNFTMGILCLAILFEEVLRGKFGKKH
MIVGVxFMFALLLSGQITWRDMTxTFIMIGSNATDKMGMGVTHLALIATFKIQPLLALGFFLRKLxxx
xxLLLGVGLAMAATLRLPEDIEQMANGIALGLMTLKLTTQFETYQLWTALVSLTCSNTMFTLTVAWRT
ATLILAGVSLLPLCQSSSMRKTDWLPMAVAAMGVPSLPLFIFNLKDTPKRKSWPLNEGVMAVGLVSIL
ASSFLRNDVPMAGPxxxxxxxxxxYVITGTSADLIVEKAADITWEEEAEQTGVSHNLMVTVDDDGTMK
IKDDETENILxxxLKTALLIVSGVFPYSIPATLLVWHTWQKQTRRSGVLWDVPSxxxxxxxxLEEGVY
RIKQQGILGKTQVGVGIQKEGVFHTMWHVTRGAVLTHNGKRLEPNWANVKKDLISYGGGWRLNTQWKK
GEEVQVIAVxPGKNPKNFQTMPGIFQTTMGEIGAIALDFxxxxxGSPIINREGKIVGLYGNGVVTKSG
GYVSGIAQTNAEPDGPTPELEEEMFRKRNLTIMDLHxxxGKTRKYLPAIIREAIKRRLRTxxxxxxxx
xxxxxxxxLKGLPIRYQTTATKSEHTGKEIVDLMCHATxxxxxxSPVRVPNYNLVVMDEAHFTDPAxx
xxxxYISTRVGMGETAAIFMTATPPGTAEAFPQSNAPIQDEEKDIPERSWNSGNEWITDFVGKTVWFV
PSIxxxxxxxxxxxxxxxxxxxxxxKTFDTEYQKTRLNDWDFVVTTDISEMGANFRADRVIDPRRCxx
xxxxxxxxxxVILAGPMPVTVASAAQRRGRVGRNPQKENDQYIFMGQPLNNDEDHxxxxxxxxxxxxx
xxxxxxxxxxxxxxxxxxxxxxxxxxxxxxxxxxxxxRRGDLPVWLAYKVASEGIKYTDRKWCFDG

FIG. 56-19

ERNNQILEENMDVEIWTKEGERKKLRPRWLDAxxxSDPLALKEFKEFAAGRKSIAFDLVTEIGRVPTH
LAYRTRNALDNLVMLHTSEHGGKAYRHAVEELPxxxxxxxxxLGLMILLTGGVMLFLISGKGVGKTSIG
LICVIVSSGMLWMADVPLQWIASAIILEFFMMVLLIxxxxxxxxxxxxxxxxxVVIGILTLAAIVTANE
MGMLETTKRDLGMSKEPGVASSNSYLDVDLHPAxxxxxxxxxxxxxxxxxxxxxxxxxxxxxxxxxxx
xxxxxxxxxxxxxxxxxxxxxxxxxxxxxCYSQVNPLTLTAAVLLLVTHYAIIGPGLxxxxxxxxxxxx
xxxxxxxxxxxxxxxxxxxxxxxxxxxxxxxLGQVMLLVLCAAQLLLMRTSWAFCEVLTLATGPITTxxx
xxxxxxxxxxxxxxxxxNIFRGNYLAGAGLAFSIMKSVGTGRRGTGSQGETLGEKWKKKLNQLSRKDFD
LYKKSGITEVDRIEAKEGLKRGETTHHAVSRGTAKLQWFVERNMVVPEGRVIDLGCxxxxxxxxxxxxx
xxxxxxxxxxxxxxxxxxxxxPVPMSTYGWNLVKLMTGKDVFYLPPxxxxxxxxxxxxESSPSPIVEEGRTI
RVLKMVEPWLRNNQFCIKVLNPYMPAVIEHLERLQRKYGGMLVRNPLSxxxxxxxxxWISNGTGNIVSS
VNMVSRLLLNRFTMTYRKPTIERDVDLGAGTRHVNAEPEIPNMDVIGERIRRIKEEHSSTWHYDEENP
YxxxxxxxxxxxxxxxxxxxxxxxxxxLLTKPWDVVPTVIQMAMTDTTPFxxxxxFKEKVDTRTPRPM
PGTRxVMGITAGWLWRTLGRNKRPRLCTREEFIKKVRTNAAMGxxFTEENQWDSARAAVEDEEFWKLV
DKERELHKQGKCGSCVYNMxxxxxxxxxxxxxxxxxxxAIWYMWLGARFLEFEALGFLNxxxxxxxxxx
xxxxxxxxxxxxxxxxxxxxxxxxxxxxxxxxxxxxxxxxxEDDLHNEEKIIQQMDPEHRQLASAIFKL
TYQNKVVKVQRPTPKGTVMDIISRKxxxxxxxxxxxxxxxxxFTNMEAQLVRQMEGEGVLTKAxxxxxx
xxxxxxTQWLETKGVERLRRMAISGDDCVxxPIDDRFANALFALNDMGKVRKxIPQWQPSKGWQDWQQ
VPFCSHxxxxxxxxxxxxxxxxxxxxxxxxxRISQGAGWSLKETACLGKAYAQMWALMYFHRRDLR
xASNAICSAVPVHWIPTSRTTWSIHxxHQWMTTEDMLTVWNRVWIEENPWMEDKTPVTTWEDVPYLGK
REDQxxxxxxxxxTSRATWAQNILIAIQQVRSLIGDEEFLDYMPSMKRFRKEEELEGAIW >DENV3|peptide_length:11|string3 xxxxxxxxxxxxxxxxxxxxxxxxxxxxGSQLAKRFSKELLNGQGPMKxxxxxxxxxxxxxxxxxxxxx
xxxFKKSGAIKVLKSFKKEISNMLSIINRRKRTSxxxxMILPATLAFHLTxxxxxxxxxxxxxxxxxxKS
IFFKTASGIxxxxxxxxxxxxxCDDTVTYKCPFVAEVEPEDIDCxxxxxxxxxxxxxxxxxxxxxxxxx
xxxxxxxxxxxxxxxxxxxxxxxxxxxxRQVERVETWALRxxxxxILALFLAHYIGTSLTQKAVIFVLL
MLVTPSMAxxxxxxxxxxxxxxxxxxxxxxxxxxxxxxxxxxxxxxxxxxxxxxxxxxxxxxxxxxxx
xxxxxxxxxxDSRCPTQGEATLPEEQDQNYVxxxxxxxxxxxxxxxxxxxxxxxxVTCAKFQCLELIEGK
AVQHENLKYTVTITxxxxxQPQVGNETQGVTAEITPQASTVEVILPEYGTLGLxxxxxxxxxxxxxxxx
xxxxxxxxxxxxxFDLPLPWTSGATAETPIWNRKELLVxxxxxxxxxxxxxxxxxxxxxxxxxxxxxxx
ATEIQNLGGTSIFAGHLxxxxxxxxxELKGMSYAMCSGTFVLRKEVSETxHGTILIKVEYRGEDVPCK
IPFSTEDEQGKVHSGRLITANPVVTKKEEPINIEAEPPFGESNIVIGTGDNALKINWYRKGSxxxxxx
xxxxxxxxxxxxxxxxxxxxxxxxxxxxxxxxxxxxxYTALFGGVSWVMKIGIGILLTxxxxxx
KNTSMSFSCIAIGIITLYLGAVVQADMGCVVNWKGKELKCxxxxxxxxxxxxxxxxxxxxxxxxxxxxx
xxxxxxxxxxxxxxxxxxxxxxxxxxxELNYILWENNIKLTIVVGDVTGVLEQGKRILTPQPMDL
KYSWKTWGKAKVVxAETQNFSFIIDGPNTPECPSTSRAWNVWEVExxxxxxxSTNIWLKLREVHTQTC
DHRLMSAAIxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxNYCEGTTVVIAENCGTGGPSLRTTTVSxxxxxxxxx
xxxxxxxxxxxxxCWYGMEIRPVNEKEENMVKSLVSAGSGKADNFTMGALCLAILFEEVxxxKFGKKH
MIAGAxLIFMLLLSGQITWRDLAxTLIMIGSNASDKMGMGVTYLALIATFKVQPFLAxxxxxxxxxxx
xxxxxxxxLAMATTLQLPADIEQMxxxIALGLMALKLITQFETYQLWTALVSLMCANTIFTLTVAWRT
ATLILAVISLLPVCQSSSMRKSDWLPVAVAAMGAQPLPLFIFSLKDTPKRKSWPLNEGxxxxxxxxxx
xxxxxxxxxxxxxxxxxxxxxxxxxxxxxxGTSADLTVEKVAEVTWEEEAEQTxxxxxxMITVDDDGTMK
IxxxxxxxxxxxxxxxxxxxxxxxxxxxxLVWHTWQKRTQRSGVxxxxxxxxxxxxxxxxxxxxxxx
RINQQGIFGKTQVGVGIQxxxxxxxxxxxxxxxxLAYNGKRLEPNWxxxxxxLISYGGGWKLSAQWQR
GEEVQVIxxxxxxNPKNFQTTPGIFQTITGEIGAIALDxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxGLPIRYQTTAIKSEHTGREIVxxxxxxxxxxxxxPVRVPNYNLIVMDEAHFTDPxxx
xxxxxxxxxxxxxxxxxxxxxxxxxxxxxxxxxxxxxxxxxxxxxxxNSGNDWITDFTGKTVWFV

FIG. 56-20

```
PSIxxxxxxxxxxxxxxxxxxxxxxxxxxxNTEYQKTKLNDxxxxxxxxxxxxxxxxxxxxxxxxxxxxx
xxxxxxxxxxxxxxxxxxxxxxxxxxxxxxRVGRNPPKENDQYIFTGxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxDFAAGRKSIAFxxxxEIGRVPSH
LPHRTRNALDNLxxxxTSEDGGRAYRHxxxxxxxxxxxxxxxxxxxLLTGGAMLFLISGKGIGKTSIG
LICVVASSGMLWMAEVPLQWIASAIIxxxxxxxxxxxxxxxxxxxxxxxxxxVIGILTLAAIVTANE
MGLLETxKKDLGMSKEPGVVSPNSYLDVDLHPxxxxxxxxxxxxxxxxxxxxxxxxxxxxxxxxxxxxx
xxxxxxxxxxxxxxxxxxxxxxxxxxxxxSQVNPLTLTAVVLLLVTHYAIxxxxxxxxxxxxxxxxxxx
xxxxxxxxxxxxxxxxxxxxxxxxxxxxxxGQVMLLILCAVQLLLMRTSWALCEVLTLATGPxxxxxxx
xxxxxxxxxxxxxxxxxxxxxxxxxxxxxxFSVMKSVGTGKRGTGTQGET

FIG. 56-21

```
xxxxxxxxxxxxxxxxxxxxxxxxxxxxxxxxxxxxxxxxxxxxxxxxxxxxxxxxxxxxxxxx
xxxxxxxxxxxLPIRYQTTATRSEHTGREIxxxxxxxxxxxxxxxxxxxxxxxxxxxxxxxxxx
xxxxxxxxxxxxxxxxxxxxxxxxxxxxxxxxxxxxxxxxxxxxNSGNEWITDFTGKTVxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxSQKENDQYIFTxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxVPSH
LAHRTKNALxxxxxxxxxxxxxxxxxxxxxxxxxxxxxxxxxxxxxGGAMLFLVSGRGIGKTTIG
LICVTVSSGMLWMADIPLQWIASAIxxxxxxxxxxxxxxxxxxxxxxxIGILTLAATIAANE
MGLLExxxxxxGMSREPGVVSPNSYLDVDLxxxxxxxxxxxxxxxxxxxxxxxxxxxxxxxxxx
xxxxxxxxxxxxxxxxxxxxxxxxxxxxxxxxxxxxxLTLIAAVLLLVTHYxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxKWKKKLNQLSRREFD
LYKKSxxxxxDRTEAKEGLKRREVTHHAVSRGSAxxxxxxxxxxxxxxxxxxxxxxxxxxxxxx
xxxxxxxxxxxxxxxxxxxxxxxxxxTYGWNIIKLMSGKDVFxxxxxxxxxxxxxxxxxxxxxx
xxxxxxxxxxxxxxxxxCIKILNPYMPNVIEHLERLQRxxxxxxxxxxxxxxxxxxxxxxxxxx
xxxxxxxxxxxxxTMTHRRPTIERDVDxxxxxxxxxxxxxMDVIGERLRRIKEEHSSTWHYDEENP
xxxxxxxxxxxxxxxxxxxxxxxxxxxxxxxxxxxxxxxxxxxxxxxxxxxKVDTRTPRPM
AGTRxAMEITAEWLWRxxxxxxxxxxxxxxxxxxxxxxxxxxxxxxxxxxxxDNAKAAVEDEDFWKLV
ERERELHKLGKxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxHNEEKITHQMDPEHRRLANAIFKL
TYxxxxxxxxxxxxxxxxxxxxxxxxxxxxxxxxxxxxxxxxxAQLIRQMEGEGVLSKVxxxxxxx
xxxxxxAQWLENKGVERLKRMAxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxHQRMTTEDMLSVWNRVWIEDNxxxEDKTPITTWEDVPYLGx
xxxxxxxxxxxxxxxxxxxxxxxxxxSTAIQQVRSLIxxxxxxxxxxxxxxxxxxxxxxxxxxx >DENV3|peptide_length:11|string5 xxxxxxxxxxxxxxxxxxxxxxxxxxxxxxxxxxxxxxxxxxxxxxxxxxxxxxxxxxxxxxxx
xxxxxxxxxxxVLRGFKKEISSMLSIINRRKKxxxxxxMVLPAALAFHLTxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxHYISTSLIQKVVIFILL
Mxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxEITSQASTTEVILPEYGTLxxxxxxxxxxxxxxx
xxxxxxxxxxxxxxxxxxxxxxxLPLPWTSGTTTKTPTWNRKELxxxxxxxxxxxxxxxxxxxxx
xxxIQNSGGTSIFSxxxxxxxxxxxxxxxKGMSYAMCLGSFVLxxxxxxxxxxxxxLVKVEYKGKDAPCK
IPFxxxxxxxxxxxxxxxxxxNPVVIKKEEPVNIxxxxxxGESNIVIGVGEKALKINWYKxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxGVVVQADIGCVINWKGKExxxxxxxxxxxxxxxxxxxxxxxxxxx
xxxxxxxxxxxxxxxxxxxxxxxxxxxxxxxxxxNVKLTVVVGDILGVLEQGKRTLPPQPMEL
KYSWKTWGKAKMVxxxxxxxxxxxxDGPSTPECPSAARAWNVWEVxxxxxxxxxxxNIWLKLREAYTQxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxCEGTTVVISENCGTRGSSLRTTTVxxxxxxxxxxxxxx
xxxxxxxxxxxxxxxxxxxxxxxxxxxxRPTSEKEENMVKSLVSAGSGKVDNFTMGALCLxxxxxxxxxxxxxxx
xxxxxxxxxxxxxxxxxxxxxxxxxxxLIMIGSNTSDRxxxxxxxxxxxxxxxxxxxxxxxxxxx
xxxxxxxxxxxxxxxxxxxxxxxxxxxxxxxxxxxxxxYQLWAALVSLMCxxxxxxxxxxxxxxxxx
xxxxxxxVSLLPMCQSSSxxxxxxxxxxxxVAAMGVSPLPLFIFxLKDAPKRRSWPLNExxxxxxxxxxx
xxxxxxxxxxxxxxxxxxxxxxxxxxxxxxxxxSADLTVEKAPDVTWEEEAEQxxxxxxxxxxxxxxxxxx
```

FIG. 56-22

```
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxGGGWRLSAQWKK
GEExxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxTSATKSEHTGRExxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxVPSH
LAYRTRSALxxxxxxxxxxxxxxxxxxxxxxxxxxxxxxxxxxxxxxxxxLISGKGIGKASIG
LICVIASSGMLWIAEIPLQWxxxxxxxxxxxxxxxxxxxxxxxxxxxxxxxxxAAIIAANE
MGMLExxxxxxxxxxxEPGVVSPISYLDVDxxxxxxxxxxxxxxxxxxxxxxxxxxxxxx
xxxxxxxxxxxxxxxxxxxxxxxxxxxxxxxxxxxxLTLAAAVLLLVTHYxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxWKKKLNQLSRREFD
xxxxxxxxxxxRTEAKEGLKRGEITRHAVSRGSAxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxKVLNPYMPNVIExxxxxxxxxxxxxxxxxxxxxxxxxxx
xxxxxxxxxxxxxxxxxxxxxxxxxxxxxxxxxxxxxxxxxxVIGERVKKIKDEHNSTWHYDDxxx
xxxxxxxxxxxxxxxxxxxxxxxxxxxxxxxxxxxxxxxxxxxxxxxxxxxxxxxxxxxx
xxxxxVMGITAEWLWKxxxxxxxxxxxxxxxxxxxxxxxxxxxxxxxxxDNAKAAVEDENFWKLV
DRERxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxKITQQMNPEHKQLANAIFKL
TxxxxxxxxxxxxxxxxxxxxxxxxxxxxxxxxxxxxxxxxxxxxxxxQMEGEGVLSEAxxxxxx
xxxxxxTQWLENKGVERxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxGNKTPVTTWENVxxxxx
xxxxxxxxxxxxxxxxxxxxxxxxxxxxxxxxxxxxxxxxxxxxxxxxxxxxxxxx
```

FIG. 57-1

\>DENV4|peptide_length:8|string1 xMNQRKKVVRPP

FIG. 57-2

SMAICSAVPTEWFPTSRTTWSIHAHHQWMTTEDMLKVWNRVWIEDNPNMIDKTPVHSWEDIPYLGKRE
DLWCGSLIGLSSRATWAKNIHTAITQVRNLIGKEEYVDYMPVMKRYSAPSESEGVL

>DENV4|peptide_length:8|string2 xMNQRKKVANTPFNMLKRERNRVSTVQGLVKRFSSGMLQGRGPLKLFMALVAFLRFLTIPPTAGILKR
WGQLKKNKAIKILTGFRKEIGRMLNILNRRKRSTMMLLCLIPTAMAFSLTTRNGEPHMIVSRQEKGKS
LLFKTEDGVNMCTLMAMDLGELCEDTITYKCPLLIQNEPEDIDCWCNLTSAWVMYGTCTQNGEHRREK
RSVALVPHVGMGLETRTETWMSSExAWKHAQRIETWILRHPGFTIMAAFMAYTIGTTHIQRTVFFILL
TAVAPSYTMRCIGISNRDFVEGVSGGSWVDIVLEHGSCVTTMAKNKPTLDFELIKTEAKQPATLRTYC
IEALLTNTTTESRCPTQGEPSLNEEQDKRYVCKRSMVDRGWGNxxGLFGKGGVVTCAKFLCKKNMEGK
VVQPENLEYTIVITPHSGEEHAVGNDTSNHGVTAMITPRTPIVEAELTGYGTLTMECSPRTGLDFNEM
ILMKMETKAWLVHRQWFLDLPLPWTTGADTSEVHWNHKETLVTFKNPHAKKQDVVVLGSQEGAMHSAL
TGATEIQMSSGNLLFTGHLKCRLRMDKLQLKGMSYSMCSGKFKVVKEIAETQHGTIVVKVKYEGTGAP
CKIPFEIRDVNKKKVVGRIISATPFAESTNSAVNIEAEPPFGDSYIVIGVGDGQLKLNWFKKGSSIGK
MFETTMRGAKRMAILGDTAWDFGSVGGLLTSIGKALHQVFGAIYGAAFGGVSWMVRILIGLIITWIGM
NSRNTSMAMSCIAVGGIxLFLGFTVHADMGCVVSWSGKELKCGSGIFVIDNVHTWTEQYQFQPESPAR
VASAILNAHKDGVCGVRSTTRLENIMWKQITNxxxxxxxxxGHDLTVVAGDVKGVLSKGKRALTPPAN
DLKYSWKxWGKAKIFTPETKNSTFLVDGPDTSExxNERRAWNSFEVEDYGFGMFTTSIWMKFREGSSE
LxxxxxxxxxxxxxxxxxxxxxxxxNQTWQIERASLIEVKxxxxxxxxxxxxxxxxESQMLIPR
AYAGPFSHHNYRQGYATQTAGPWHLGKLEMDFGECPGTTVTIQENCGHRGSSLRTTTAxxxxxxxxxx
xxxxxxxxxxxxxxxxGMEIRPLNEREENMVKSQVAAGQSSSETFFMGLLCLTLFMEECLRRKVTR
KHMILVVVITFCAIILGGxxWMDLLRAIIMLGDTMSGRIGGQIHLAIMIVFKMSPGYVLGIFLRRLTS
RETAxxxIGMAMTTVFSIPHDLMEFIDGIALGLILLKIVTHFDDTQLGTLALSLTFIRSTTPLIMAWR
TIMAVFFAVTLIPLCxxxxLQKQSHWVEITAITLGAQALPxxxxTLMKGASKRSWPLNExxxxxxxxx
xxxxxxxxxxxxxxxxxxxxxxxxxxxxxxxxxxxxxSADLSLEKAASVQWDEMADITGSSPIVEVKQDEDGS
FSIRDIEETNMITxxxxxxxxxxxxLYPLAIPITMALWYIWQVRTQRSGALWDVPSPAATKKATLTEG
VYRIMQRGLLGKTQVGVGIHIEGVFHTMxxxxxGSVICHESGRLEPSWxxxxxxxxxxxxxxRLGDKW
DREEDVQVLAVEPGKNPKxxxxxKPGLFKTITGEIGAVxxxxxxGSSGSPIINKKGKVIGLxxxxxxxx
xxxxxxAITQAERTGEPDYEVxxxxxxxxxxxxxxxxxxxxxxxxxxxxxxxxxxxxxxxxxxxxxxx
xxxxxxxxxxxxxxxQTPAVKSDHTGREIxxxxCHATFTTKLLSSTRVxxxxxxxxxxEAHFTDPCS
VAARGYxxxxxxxxxxxxxxxxMTATPPGSIDPFPQSNxxxxxxxxxxxxxxxxxxxxxxxxxxxxxxx
xxxxxxxxxxxxCLRKSGKRVIQLSRKxxxxxxxxxxxxxxxxxxxxxxxxxxxxxxxxxxxxxRCL
KPVILPDGPERVIxxxxxxxxxxxxxxRGRIGRNLTQEDDQYVFSGDPLRNDEDHAHxxxxxxxxxxx
xxxxxxxxxxxFGPEREKNQAIDGEFxxxxxxxxKTFVELMKRGDLPVWxxxxxASAGISYEDREWCFT
xxxxxxxxxxxxxxxxxxxxxxEKKKLRPKWLDARVYxxxxxxxxxxxxxxxxxxxxxxDILTEIATLPT
YLSSKAKLALDNxVMLHTTEKGGKAYQHALNxxxxSLETLMLIALLGAMTAGTFLFFMQGKGMGKLSM
GLIAIAMASGLLWIAELQPQWIAAxxxxxFFLMVLLVPEPEKQRxxxxxQLIYVILAILTIIGLVAAN
EMGLIEKTKTDFGFYQAKAETTILDVxxxxxxxxxLYAVVTTILTPMxxxxxxxxxxxxxSLTAIANQA
AxxxxxxKGWPLHRVDLGVPLLxxxxxxQVNPTTLTASLVMLSVHYAIIGxxxxxxxxxxxxxxxxxxx
xxxxxxxxxxxxxxxxxxxxxxxxxxxxVMLLVLCVGQLFLMRTTWALCEVLTLATGPIMTLWEGN
PxxxxxxxxxxxxxxxxxxxxxxxAFSLIKNVQTPRRGTGITGETLGExxxxQLNSLDRREFEEY
KRSGIIEVDRTEAKSALRDGSKTKYAVSRGTSKIRWIVERGMIKPKGKIVDLGCGRxxxxxxxxxxLKN
VTEVRGFTKGGPGHxxxxxxxxxxxxxxxxxxxxSGVDVFYRPTEQVDTxxxxxxxxxxxxxxxxxxx
xxxxxxxxxxxxxxxxxxxxxxxxxxxxELEKLQRRHGGSLIRCPLSRNxxxEMYWVSGVSGNIVSSV
NTISKMLLNRFTTRHRKPTYEKDADLGAGTRxxxxxPEKPDMTVIGRRLQRLREEHKETWHYDHENPY
RTWxxxxxxEASSTGSASSMINGVxxLLTKPWDVVPMVTQLAxxxxxxxxxxxxxxxxxxxxxTRTPQPKP
GTRMIMTTTANWLWALLGKKKSPRLCTKEEFISKVxxxxxxxxxxxxxxxxxxTSASEAVSDSRFWELVD
KERALHQEGRCxxxxxxxxxxxxxxxxxxxxxxxxxxxxxxxxxxxxxxxxLNEDHWFSRENSW
SGxxxxxxxxRLGYILEDIDKKDGDLIYADDTAGxxxRITEDDLLNEELVTEQMAPHHKTLAKAIFKxx

FIG. 57-3 xxxxxxKVLRPTPKGAVMDIIxxxxxxxxSGQVGTYSLNTFTNMxxxxxxxxxEAEGVITRDDMHNPKGL
KERVEKWLKECGVDRLxxxxxxxxxxxxxKPLDERFSTSLLFLNxxxxxxxxxxxxxxxxxxxxxxxxx
xxSHHFHKILMKDGRxxxxxxxxxxxxxxxxxxxQGAGWSLKETACLGKxxxxxxxxxxxxxxxxxxxx
xxxxxSAVPVEWVPTSRTTWxxxxxxxxxxxxxxxxxxxxxxxIEDNPNMTDKTPIHSWEDVPYLGKRE
xxxxxxxxxxxxxATWAKNIQTAIAQVRNLIGKEEYVDYMPAMKRYSAPFESEGVL >DENV4|peptide_length:8|string3 xNNQRKKARNTPFNMLxxxxxxxxxxxxQLVKRFSLGMLQGRGxxxxxxxxxxxxxxxxxxxxxxxxxR
WGTLKKNKAIRVLRGFRKEIGxxLNILNRRRRSTVTLLCLIPTVMAFHLTTRNGEPLMIVGKHERGRP
xxxKTTEGTNKCTLIAxxxxxxCEDTVTYKCPLLRQNEPEDIxCWCNSTSTWVTYGTCTTTGEHRREK
xxxxxxxxxxxxxxxxxxxxxxxxxxxxxxxxxxxxxxxxxxxxxxxAGILAYMVGQTRFQRALIFILL
TAVAPSMGMRCIGVGNRDFVEGVSGGTWVDLVLExxxxxxxxxxxxxxDFELIKTEAKQPxxxRKYC
IEAKLTNTTTExxxxxxxxxxxxxxxxxRQFICRHDMVDRGWGxxxxxxxxxxxIVTCAMFTCKKNMEGx
xxxxxxxxxxxxxxxxxxxxxTHAVGNDISNHGVTTTITPQSSSTEVELPDYGEVSLDCEPRSxxxFNEM
ILMEMKNKAWLVHRxxxLDLPLPWAAGADTLGSNWIQKETLVTFxxxxxxxxxxxxxxxxxxGAMHTAL
TGATEIQMxxxxxxxxxxxxKCKIRMERLRIKGMSxxxxTGKFSIDREMAETQHGTTVIRVQYEGAGSP
CKIPFEIMDLNKEHVVGRVISSTPFAENKDSPVNIEAEPPFGDSYIIIGVEPGQLKLNWxxxGSSIGQ
MLESTYRGAxxxxxxxxxxxxxFGSLGGVFTSLGKAVHQIFGSVYTTxFSGVSWTVKILIGVIITWIGT
NSRNTPMAMTCIAxxxxxxxxxGFTVHADTGCVASWNGKELKCGSGIFVADNVHTWTEQHKFQPxxxxx
xxxAILIAHKDGVCGVRxxxxxxxxxxxxxxxxxxxxxxxxxxLTVVAGDVKGVLVKGKRALTPPVN
DLKYSWxxxxxxAKIFTPEARNSTFLVDxxxxxxxxxxERRAWNFLEVEDYGxxxxxxxxxxxxxxxxx
xxxxxxxxxxxxxxxxxxxxxxxxxxxxxxxxxxxxxxxxxxxxxxxxxxxxxxxxxxxxxSQMLIPK
SYAGPISQHNYRQGYATQTMGPWHLGKxxxxxxxCPGTTVAIQDDCGHRGSSxxxxxxxxxxxxxxxx
xxxxxxxxxxxxxxxxxxxxxxxxxxEIRPLSEKEENMVKSQVSAGPGPSETFSMGLLCLTLFIEECLRRKxxx
KHMILVVVTTLCAIILxxxxxxxxxxxxxMLGDTMLSRMGGQVHLAIMAVxxxxxxxVLGVFLRRLTS
xxxxxxxxGMAMTTVFSIPHDLMEFIDGLSLGLILLKMVTHFDNAQLGTLALSLTFIKSTMPLTMAWR
TIMAVLFAVTLIPxxxxxxxxxxxxWVEITALTLGAQALxxxxxxxxxxxxxxxxxxxxxxxxxxxxx
xxxxxxxxxxxxxxxxxxxxxxxxxxxxxxxLSLERAANVQWDxxxxxxxxxxIIEVKQDDxxx
xxxxxxxxxxxxxxxxxxxxxxxxxxxxxLAIPVTMALWYMWQVRTQRxxxxxDVPSPAATQKATLTEG
VYRxxxxxxxxxxxQVGVGIHVEGVFHTMxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxMTATPPGTTDPFPQSxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxCL
KPVISTDGPERVxxxxxxxxxxxxxxxGRIGRNPTQEDDQYxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxTEIATLPA
YLSSKAKxxxxxxxxxHTTERGGKAYQHxxxxxxxxxxxxxxxxxxxxxxxxxxxxxxKGIGKLSM
GLITIAVASGLFWVAELQPQWxxxxxxxxxxxxxxxxxxxxxxxxxxxxxxxxYVILTILTIIALVAAN
EMxxxxxxxTDFGFYQEKPETTILDVxxxxxxxxxxxxxxxxxxxxxxxxxxxxxxxxxxxxxxxxxx
xxxxxxxxxxxxxxxxxxxxxxxxxxxxxxxxxIASLVMLFVHYAxxxxxxxxxxxxxxxxxxxxxxx
xxxxxxxxxxxxxxxxxxxxxxxxxxxxxxxxVLCAGQLFLMRxxxxxxxxLTLATGPVLTLWEGN
xxxxxxxxxxxxxxxxxxxxxxxxxxxxxAFSLIKNAQAPRRGTxxxxxxxxxxxxxxxxxxxxxxxx
xxxxxxxxxxxxxxxxxxxxxALKDGSKIKYAVSRGxxxxxxxxxxxxxVKPKGKVIxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxLEKLQRKHGGSLIRCPLSxxxxxxxxxxxxxxxxxxxxx
xxVSKMLLNRFTTKHRKxxxxxxxxxxxxxxxxxxxxxxxxxxxxxxxxxxxxxxxxxxxxxxxxxxx
xxxxxxxxxxxxxxxxxxxxxxxxxxxxxLTKPWDMIPMVTQLxxxxxxxxxxxxxxxxxxxxxxPQPKP

FIG. 57-4

```
GTRVVMTTTANWLWTLLGRKKSPRLCTKExxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxYILEDIDRKDGDLMYxxxxxxxxxxxxxxxxxxxxxxQMAPHHRILAKAIFxxx
xxxxxxxxxxxxxxxxxxxxxxxxxxxxxxxxxxxxxxxxxxxxxxxxxxVITQDDMHNPKGL
KERVENWLRECGVxxxxxxxxxxxxxxxxKPLDERFATSLLFLNxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxNMTDKTPVHSWEDVPxxxxxx
xxxxxxxxxxxxxxxxxxxKNIHTAIAQVRxxxxxxEYVDYMPVMKRYSALSESEGVL >DENV4|peptide_length:8|string4 xxxxxKKVVRPSFNxxxxxxxxxxxxxxGLTKRFSIGLFSGKGxxxxxxxxxxxxxxxxxxxxx
xxxIKKTKAINVL

FIG. 57-5

```
xxxxxxxxxxxxxxxxxxxxxxxxxxxxxxxLQRKYGGSLVRCxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxQPKL
GTQMIMTTTAxxxxxxLLGKKKTPRLCTRExxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxMDYMPAMRRYSAHFESEGVL >DENV4|peptide_length:8|string5 xxxxxxxxxxxxxxxxxxxxxxxxxxxxxxxxxxxxxxxxxxxxxxxxxxxxxxxxxxxxxxxx
xxxxxxSKAINVLRxxxxxxxxxxxILNGRRRTAGMIIxxxxTVMAFHLTTxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxGKHGKTIKITPRSPSAEVKLxxxxxxxxxxxxxxxxxEM
ILMRMKxxxxxxxxxxxxxxxxxxxxWTAGADTLExxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxDMNKEKVIGRIISSIPIATEKDSPVNIxxxxxxxxxxYIIIGVGDSAxxxxxxxxxxxxxxx
xxxxxxxxxxxxxxxxxxxxxxxxxxxxxxxxxxxxxxxxxxxxxxxxxxxxMKILIGVIxxxxxx
xxxxxxxxxxxxxxxxxxxxxxxxxGFTVQADVGCVVSWTGKELKCGxxxxxxxxxxxxxxxxxxxxxx
xxxxxxxxxxxxxxxxxxxxxxxxxxxxxxxxxxxxxxxxxxxxxxxxxxxxxxTKGKRTLAPPAS
DLKxxxxxxxxxxxIFAPEARNNTFLxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxTTVTVREDCDHRGxxxxxxxxxxxxxxxx
xxxxxxxxxxxxxxxxxxxxxxxxxxxxxxxxxxxxNMVRSQVTAGQGTPETFSMxxxxxxxxxxxxxxx
xHMILVVVTTFCAIILxxxxxxxxxxxxxxxxxxxxxxxxxRVGGQTHLAxxxxxxxxxxxxxxxxxxx
xxxxxxxxxxxxxxxxxxxxxxxxxxxxxxxxxxxxxxxxVVHFDNAQLGxxxxxLTFIKTTMxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxFYQVKTEITILxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 57-6

```
xxxxxxxxxxxxxxxxxxxxxxxxxxxxxxxxxxxxxxxxxxxxxxxxxxxxxxxxxxxxxxxx
xxxxxxxxxxxxxxxxxRDGSKTKHxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxRKYGGSLVRxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxPKP
GTQMIMTxxxxxxxxxxxxxKNPRLCTKExxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxVMKRYSAPSENEGVL
```

\>DENV4|peptide_length:9|string1

```
xMNQRKKVVRPPFNMLKRERNRVSTPQGLVKRFSTGLFSGKGPLRMVLAFITFLRVLSIPPTAGILKR
WGQLKKNKAIKILIGFRKEIGRMLNILNGRKRSTITLLCLIPTVMAFHLSTRDGEPLMIVAKHERGRP
LLFKTTEGINKCTLIAMDLGEMCEDTVTYKCPLLVNTEPEDIDCWCNLTSTWVMYGTCTQSGERRREK
RSVALTPHSGMGLETRAETWMSSEGAWKHAQRVESWILRNPGFALLAGFMAYMIGQTGIQRTVFFVLM
MLVAPSYGMRCVGVGNRDFVEGVSGGAWVDLVLEHGGCVTTMAQGKPTLDFELTKTTAKEVALLRTYC
IEASISNITTATRCPTQGEPYLKEEQDQQYICRRDVVDRGWGNGCGLFGKGGVVTCAKFSCSGKITGN
LVQIENLEYTVVVTVHNGDTHAVGNDTSNHGVTATITPRSPSVEVKLPDYGELTLDCEPRSGIDFNEM
ILMKMKKKTWLVHKQWFLDLPLPWTAGADTSEVHWNYKERMVTFKVPHAKRQDVTVLGSQEGAMHSAL
AGATEVDSGDGNHMFAGHLKCKVRMEKLRIKGMSYTMCSGKFSIDKEMAETQHGTTVVKVKYEGAGAP
CKVPIEIRDVNKEKVVGRxxxxxxxAENTNSVTNIELEPPFGDSYIVIGVGNSALTLHWFRKGSSIGK
MFESTYRGAKRMAILGETAWDFGSVGGLFTSLGKAVHQVFGSVYTTMFGGVSWMIRILIGFLVLWIGT
NSRNTSMAMTCIAVGGITLFLGFTVQADMGCVVSWSGRELKCGSGIFVVDNVHTWTEQYKFQPESPAR
LASAILNAHKDGVCGIRSTTRLENVMWKQITNELNYVLWEGGHDLTVVAGDVKGVLTKGKRALTPPVS
DLKYSWKTWGKAKIFTPEARNSTFLIDGPDTSECPNERRAWNSLEVEDYGFGMFTTNIWMKFREGSSE
VCDHRLMSAAIKDQKAVHADMGYWIESSKNQTWQIEKASLIEVKTCLWPKTHTLWSNGVLESQMLIPK
SYAGPFSQHNYRQGYATQTVGPWHLGKLEIDFGECPGTTVTIQEDCDHRGPSLRTTTASGKLVTQWCC
RSCTMPPLRFLGEDGCWYGMEIRPLSEKEENMVKSQVTAGQGTSETFSMGLLCLTLFVEECLRRRVTR
KHMILAVVITLCAIILGGLTWMDLLRALIMLGDTMSGRIGGQTHLAIMAVFKMSPGYVLGVFLRKLTS
RETALMVIGMAMTTTLSIPHDLMELIDGISLGLILLKIVTQFDNTQVGTLALSLTFIRSTxSLVMAWR
TIMAVLFVVTLIPLCRTSCLQKQSHWVEITALILGAQALPVYLMTLMKGASRRSWPLNEGIMAVGLVS
LLGSALLKNDVPLAGPMVAGGLLLAAYVMSGSSADLSLEKAANVQWDEMADITGSSPIIEVKQDEDGS
FSIRDVEETNMITLLVKLALITVSGLYPLAIPVTMTLWYMWQVKTQRSGALWDVPSPAATQKAALSEG
VYRIMQRGLFGKTQVGVGIHMEGVFHTMWHVTRGSVICHETGRLEPSWADVRNDMISYGGGWRLGDKW
DKEEDVQVLAIEPGKNPKHVQTKPGLFKTLTGEIGAVTLDFKPGTSGSPIINRKGKVIGLYGNGVVTK
SGDYVSAITQAERIGEPDYEVDEDIFRKKRLTIMDLHPGAGKTKRILPSIVREALKRRLRTLILAPTR
VVAAEMEEALRGLPIRYQTPAVKSEHTGREIVDLMCHATFTTRLLSSTRVPNYNLIVMDEAHFTDPSS
VAARGYISTRVEMGEAAAIFMTATPPGATDPFPQSNSPIEDIEREIPERSWNTGFDWITDYQGKTVWF
VPSIKAGNDIANCLRKSGKKVIQLSRKTFDTEYPKTKLTDWDFVVTTDISEMGANFRAGRVIDPRRCL
KPVILTDGPERVILAGPIPVTPASAAQRRGRIGRNPAQEDDQYVFSGDPLKNDEDHAHWTEAKMLLDN
IYTPEGIIPTLFGPEREKTQAIDGEFRLRGEQRKTFVELMRRGDLPVWLSYKVASAGISYKDREWCFT
GERNNQILEENMEVEIWTREGEKKKLRPRWLDARVYADPMALKDFKEFASGRKSITLDILTEIASLPT
YLSSRAKLALDNIVMLHTTERGGRAYQHALNELPESLETLMLVALLGAMTAGIFLFFMQGKGIGKLSM
GLITIAVASGLLWVAEIQPQWIAASIILEFFLMVLLIPEPEKQRTPQDNQLIYVILTILTIIGLIAAN
```

FIG. 57-7

EMGLIEKTKTDFGFYQVKTETTILDVDLRPASAWTLYAVATTILTPMLRHTIENTSANLSLAAIANQA
AVLMGLGKGWPLHRMDLGVPLLAMGCYSQVNPTTLTASLVMLLVHYAIIGPGLQAKATREAQKRTAAG
IMKNPTVDGITVIDLEPISYDPKFEKQLGQVMLLVLCAGQLLLMRTTWAFCEVLTLATGPILTLWEGN
PGRFWNTTIAVSTANIFRGSYLAGAGLAFSLIKNAQTPRRGTGTTGETLGEKWKRQLNSLDRKEFEEY
KRSGILEVDRTEAKSALKDGSKIKHAVSRGSSKIRWIVERGMVKPKGKVVDLGCGRGGWSYYMATLKN
VTEVKGYTKGGPGHEEPIPMATYGWNLVKLHSGVDVFYKPTEQVDTLLCDIGESSSNPTIEEGRTLRV
LKMVEPWLSSKPEFCIKVLNPYMPTVIEELEKLQRKHGGNLVRCPLSRNSTHEMYWVSGASGNIVSSV
NTTSKMLLNRFTTRHRKPTYEKDVDLGAGTRSVSTETEKPDMTIIGRRLQRLQEEHKETWHYDQENPY
RTWAYHGSYEAPSTGSASSMVNGVVKLLTKPWDVIPMVTQLAMTDTTPFGQQRVFKEKVDTRTPQPKP
GTRMVMTTTANWLWALLGKKKNPRLCTREEFISKVRSNAAIGAVFQEEQGWTSASEAVNDSRFWELVD
KERALHQEGKCESCVYNMMGKREKKLGEFGRAKGSRAIWYMWLGARFLEFEALGFLNEDHWFGRENSW
SGVEGEGLHRLGYILEEIDKKDGDLMYADDTAGWDTRITEDDLQNEELITEQMAPHHKILAKAIFKLT
YQNKVVKVLRPTPRGAVMDIISRKDQRGSGQVGTYGLNTFTNMEVQLIRQMEAEGVITQDDMQNPKGL
KERVEKWLRECGVDRLKRMAISGDDCVVKPLDERFGTSLLFLNDMGKVRKDIPQWEPSKGWKNWQEVP
FCSHHFHKIFMKDGRSLVVPCRNQDELIGRARISQGAGWSLRETACLGKAYAQMWSLMYFHRRDLRLA
SMAICSAVPTEWFPTSRTTWSIHAHHQWMTTEDMLKVWNRVWIEDNPNMIDKTPVHSWEDIPYLGKRE
DLWCGSLIGLSSRATWAKNIHTAITQVRNLIGKEEYVDYMPVMKRYSAPSESEGVL

>DENV4|peptide_length:9|string2 xMNQRKKVANTPFNMLKRERNRVSTVQGLVKRFSSGMLQGRGPLKLFMALVAFLRFLTIPPTAGILKR
WGQLKKNKAIKILTGFRKEIGRMLNILNRRKRSTMTLLCLIPTAMAFSLTTRNGEPHMIVSRQEKGKS
LLFKTEDGVNMCTLMAMDLGELCEDTVTYKCPLLIQNEPEDIDCWCNLTSAWVMYGTCTQNGEHRREK
RSVALVPHVGMGLETRTETWMSSEGAWKHAQRIETWILRHPGFTIMAGIMAYTVGTTGIQRTVFFILL
TAVAPSYGMRCIGISNRDFVEGVSGGSWVDIVLEHGSCVTTMAKNKPTLDFELIKTEAKQPATLRTYC
IEALLTNTTTESRCPTQGEPSLNEEQDKQFICKHSMVDRGWGNGCGLFGKGGVVTCAKFLCKKNMEGK
VVQPENLEYTIVITPHSGETHAVGNDTSNHGVTAMITPRTPSVEVELTDYGTLSMECSPRTGLDFNEM
ILMRMKTKAWLVHRQWFLDLPLPWTTGADTSEVHWNHKETLVTFKNPHAKKQDVVVLGSQEGAMHSAL
TGATEIQMSSGNLLFTGHLKCRLRMDKLQLKGMSYSMCSGKFSIDREIAETQHGTIVVKVKYEGTGAP
CKIPIEIRDVNKKKVVGRxxxxxxxAESTNSAVNIEAEPPFGDSYIVIGVGDGQLKLNWFKKGSSIGQ
MFETTMRGAKRMAILGDTAWDFGSVGGLLTSLGKAVHQIFGAIYGAMFGGVSWMVRILIGLIITWIGM
NSRNTSMAMSCIAVGGITLFLGFTVHADMGCVASWSGKELKCGSGIFVIDNVHTWTEQYQFQPESPAR
VASAILNAHKEGVCGIRSTTRLENIMWKQITNExxxxxxxGGHDLTVVAGDVKGVLSKGKRALTPPAN
DLKYSWKTWGKAKIFTPETKNSTFLVDGPDTSECPNERRAWNSFEVEDYGFGMFTTSIWMKFREGSSE
LCxxxxxxxxxxxxxxxxxxxxxxxxxKNQTWQIERASLIEVKTxxxxxxxxxxxxxxLESQMLIPR
AYAGPFSHHNYRQGYATQTAGPWHLGKLEMDFGECPGTTVTIQENCGHRGSSLRTTTASxxxxxxxxx
xxxxxxxxxxxxxxxxxYGMEIRPLNEREENMVKSQVAAGQSSSETFFMGLLCLTLFMEECLRRKVTR
KHMILVVVITFCAIILGGLTWMDLLRAIIMLGDTMSGRIGGQIHLAIMIVFKMSPGYVLGIFLRRLTS
RETALxVIGMAMTTVFSIPHDLMEFIDGLSLGLILLKIVTHFDDAQVGTLALSLTFIKSTxPLIMAWR
TIMAVFFAVTLIPLCRxxCLQKQSHWVEITAITLGAQALPVxxMTLMKGASKRSWPLNEGxxxxxxxx
xxxxxxxxxxxxxxxxxxxxxxxxxxxxxxxSSADLSLEKAASVQWDEMADITGSSPIVEVKQDEDGS
FSIRDIEETNMITLxxxxxxxxxxGLYPLAIPITMALWYIWQVRTQRSGALWDVPSPAATKKATLTEG
VYRIMQRGLLGRTQVGVGIHIEGVFHTMWxxxRGSVICHESGRLEPSWAxxxxxxxxxxxxWRLGDKW
DREEDVQVLAVEPGKNPKHxxTKPGLFKTITGEIGAVTxxxxPGTSGSPIINKKGKVIGLYxxxxxxx
xxxxxSAITQAERTGEPDYEVDxxxxxxxxxxxxxxxxxxxxxxxxxxxxxxxxxxxxxxxxxxxxxx
xxxxxxxxxxxxxxxxYQTPAVKSDHTGREIVxxMCHATFTTKLLSSTRVPxxxxxxxDEAHFTDPCS
VAARGYIxxxxxxxxxxxxFMTATPPGSIDPFPQSNSxxxxxxxxxxxxxxxxxxxxxxxxxxxxxxx
xxxxxxxxxxxNCLRKSGKRVIQLSRKTxxxxxxxxxxxxxxxxxxxxxxxxxxxxxxxxxxxxRRCL
KPVILPDGPERVILxxxxxxxxxxxxxRRGRIGRNLTQEDDQYVFSGDPLRNDEDHAHWxxxxxxxxx
xxxxxxxxxxLFGPEREKNQAIDGEFRxxxxxRKTFVELMKRGDLPVWLxxxVASAGISYEDREWCFT

FIG. 57-8

```
Gxxxxxxxxxxxxxxxxxxxxxxxxxxxxx GEKKKLRPKWLDARVYAxxxxxxxxxxxxxxxxxxxxxx LDILTEIATLPT
YLSSKAKLALDNIVMLHTTEKGGKAYQHALNExxESLETLMLIALLGAMTAGTFLFFMQGKGMGKLSM
GLIAIAMASGLLWIAELQPQWIAASxxxEFFLMVLLVPEPEKQRTxxxNQLIYVILAILTIIGLVAAN
EMGLIEKTKTDFGFYQAKAETTILDVDxxxxxxxxTLYAVVTTILTPMLxxxxxxxxxxxLSLTAIANQA
AVxxxxGKGWPLHRVDLGVPLLAxxxxSQVNPTTLTASLVMLSVHYAIIGPxxxxxxxxxxxxxxxxx
xxxxxxxxxxxxxxxxxxxxxxxxxQVMLLVLCVGQLLLMRTTWALCEVLTLATGPIMTL

FIG. 57-9

```
xxxxxxxxxxxxxxxxxxxxxxxxxxxxxxxxxxxxxxxxxxxxxxxxxxxxxxxxxxxxxxxxRCL
KPVISTDGPERVIxxxxxxxxxxxxxxxRGRIGRNPTQEDDQYVxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxLTEIATLPA
YLSSKAKLxxxxxxxxLHTTERGGKAYQHAxxxxxxxxxxxxxxxxxxxxxxxxxxxxxxGKGIGKLSM
GLITIAVASGLFWVAELQPQWIxxxxxxxxxxxxxxxxxxxxxxxxxxxxxxxxxIYVILTILTIIALVAAN
EMGxxxxxKTDFGFYQEKPETTILDVDxxxxxxxxxxxxxxxxxxxxxxxxxxxxxxxxxxxx
xxxxxxxxxxxxxxxxxxxxxxxxxxxxxxxxxxxxxxLIASLAMLLVHYAIxxxxxxxxxxxxxxxxx
xxxxxxxxxxxxxxxxxxxxxxxxxxxxxxxxxxxxxxLVLCAGQLFLMRTTWAFxxVLTLATGPVLTLWEGN
PxxxxxxxxxxxxxxxxxxxxxxxxxxxxxxLAFSLIKNAQTPRRGTGITxxxxxxxxxxxxxxxxxxx
xxxxxxxxxxxxxxSALKDGSKIKYAVSRGTxxxxxxxxxxxMVKPKGKVIDxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxELEKLQRKHGGSLIRCPLSRxxxxxxxxxxxxxxxxxxx
xTVSKMLLNRFTTKHRKPxxxxxxxxxxxxxxxxxxxxxxxxxxxxxxxxxxxxxxxxxxxxxxx
xxxxxxxxxxxxxxxxxxxxxxxxxxxxxxxLLTKPWDMIPMVTQLAxxxxxxxxxxxxxxxxxxxxTPQPKP
GTRVVMTTTANWLWTLLGRKKTPRLCTREExxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxGYILEDIDRKDGDLMYAxxxxxxxxxxxxxxxxxxxxxxxxxxxEQMAPHHRILAKAIFKxx
xxxxxxxxxxxxxxxxxxxxxxxxxxxxxxxxxxxxxxxxxxxxxxxxxxxxxxxxxGVITQDDMQNPKGL
KERVENWLRECGVDxxxxxxxxxxxxxxVKPLDERFATSLLFLNDxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxPNMTDKTPVHSWEDVPYxxxxx
xxxxxxxxxxxxxxxxxxAKNIHTAIAQVRNxxxxEEYVDYMPVMRRYSALSESEGVL >DENV4|peptide_length:9|string4 xxxxxNRVVRPPFNMxxxxxxxxxxxxQGLTKRFSLGMLQGRGPxxxxxxxxxxxxxxxxxxxxxx
xxQIKKSKAINVLRGFRKExxxMLNILNRRKRTAGMIIMLIPTIMAFHLSTRxxxxxxxxxxxxxxxx
xxxxxxxxxxxxxxxxxxxxxxxxxxxxxxxxVTYECPLLVNTExxxxxxxxxxxxxxxxxxxxxxx
xxxxxxxxxxxxxxxxxxxxxxxxxxxxxxxxxxxxxxxxxxxxxxxxxIGQTRIQRTIFFVLM
MLxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxQQYICRRNVxxxxxxxxxxxxxxxxxxxxxxxxx
xxxxxxxxxxxxxxxxxxxxxxxxxxxxDIPKHGVEITITPRSPSAEVKLPDYGxxxxxxxxxxxxDFNEM
VLLQMEKKTWLVHKxxxLDLPLPWLAGADTLEVHWNHKExxxxxxxxxxxxxxxxxxxxxxxxxx
xxxxxxxxxxxxxxxxxxxxxxxxxxxxxxxxxxxxxxxxxxxxxxxxxxxxxxxxxxEGAGAP
CKIPIEIRDVNKEKVIGRxxxxxxxxVTEKDSPVNIExxxxxxxDSYIIIGVEPGQLxxxxxxxxxxx
xxxxxxxxxxxxxxxxxxxxxxxxxxxxxxxxxxxxxxxxxxxxxxxxxxxxxVRILIGLLVxxxxx
xxxxxxxxxxxxxxxxxxxxxxLGFTVQADMGCAVSWNGRELKCGSGIFVADNVHTWExxxxxxxxxxx
xxxxxxxxxxxxxxxxxxxxxxxxxxxxxxxxxxxxxxxxxLTIVAGDAKGVLVKGKRALAPPVN
DLKYxxxxxxKAKIFTPETKNSTFLxxxxxxxxxNERRAWNFFEVEDYGFxxxxxxxxxxxxxxxxx
xxxxxxxxxxxxxxxxxxxxxxxxxxxxxxxxxxxxxxxxxxxxxxxxxxxxxxxxxxxxIPK
AYAGPISQHxxRQGYATQIAGPWHLGKxxxxxxxxxPGTTVTIQDDCDHRGPSxxxxxxxxxxxxx
xxxxxxxxxxxxxxxxxxxxxxxxxxxxxxNEKEENMVKSQATAGQGTPETFSMGLxxxxxxxxxxxx
KHMILVVATTFCAIILGxxxxxxxxxxxxLGDTMSSRVGGQTHLAIMIVFxxxxxxxxxxxxxxxx
xxxxxxxIGMAMTTTFSIPHDLMxxxxxxxxxLILLKMVTQFDDTQVGTxALSLTFIKTTxPLTMAWR
TIxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxPVTMALWYMWQVKxxxxxxxxDVPSPATAQKATLTEG
Vxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 57-10

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxMTATPPGSTDPFPQSNxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxSLPT
YLSSKxxxxxxxxxxxxxxxxxxxxxxxxxxxxxxxxxxxxxxxxxxxxxxxxxxxxxxxxxSV
GLITIAVASGLLWVAELQPQxxxxxxxxxxxxxxxxxxxxxxxxxxxxxxxxxxxILALLAIIGLIAAN
xxxxxxxxKADFGFYQVKAETTILDxxxxxxxxxxxxxxxxxxxxxxxxxxxxxxxxxxxxxxx
xxxxxxxxxxxxxxxxxxxxxxxxxxxxxxxxxxxxxxxxLTASLVMLFVxxxxxxxxxxxxxxxxxxxxxx
xxxxxxxxxxxxxxxxxxxxxxxxxxxxxxxxxxxxxxxxxxxxxxxxxxxLTLSTGPTLTLWEGN
PxxxxxxxxxxxxxxxxxxxxxxxxxxxxxxxxFSLIKNTQTPRRGTGxxxxxxxxxxxxxxxxxxxxxxx
xxxxxxxxxxxxxxxSALKDGSKIKYAxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxKLQRKYGGNLIRCPxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxPQPKP
GTQMIMTTTANxxxxLLGKKKSPRLCTKEExxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
RERVEKWLKxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxYADYMPVMKRYSAHFESEGVL >DENV4|peptide_length:9|string5 xxxxxxxxxxxxxxxxxxxxxxxxxxxxxxxxxxxxxxxxxxxxxxxxxxxxxxxxxxxxxxxx
xxxxxKTKAIKILTGxxxxxxxxxNILNRRRRTAGMIIMxxPTVMAFHLTTRxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxGIQRAVFFVxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxTGKHGKTATITPRSPSAEVKLPxxxxxxxxxxxxxxxxxNEM
ILMKMExxxxxxxxxxxxxxxxxPWTAGADTLEVxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxRDVNKERVVGRxxxxxxxxAEYTNSVTNIExxxxxxxxSYIIIGVGDSALxxxxxxxxxxxxxxx
xxxxxxxxxxxxxxxxxxxxxxxxxxxxxxxxxxxxxxxxxxxxxxxxxMKILIGVIIxxxxx
xxxxxxxxxxxxxxxxxxxxxxxLGFTVRADMGCxxSWTGKELKCGSxxxxxxxxxxxxxxxxxx
xxxxxxxxxxxxxxxxxxxxxxxxxxxxxxxxxxxxxxxxxxxxTGDVKGVLTKGKRTLAPPAS
DLKYxxxxxxxxxxxxxxPEARNNTFLxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxK
AYAGPISQxxxxxxxxxxxxxxxxxxxxxxxxxxxxxxxGTTVTVREDCDHRGPxxxxxxxxxxxxxxxxx
xxxxxxxxxxxxxxxxxxxxxxxxxxxxxxxENMVRSQVTAGQGTSETFFMGxxxxxxxxxxxxx
KHMILVVVATLCAIILGxxxxxxxxxxxxxxxxxxxxxxxxxxRIGGQVHLAIxxxxxxxxxxxx
xxxxxxxxxxxxxxxxxxxxxxxxxxxxxxxxxVVHFDNAQLGTxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 57-11

```
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxGFYQEKPETTILDxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxLRDGSKTKHAxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxQRKYGGNLIRCxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxQPKL
GTRVVMTTxxxxxxxxxxxKKKPRLCTREExxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxx

FIG. 57-12

RETALMVIGMAMTTTLSIPHDLMELIDGISLGLILLKIVTQFDNTQVGTLALSLTFIRSTxSLVMAWR
TIMAVLFVVTLIPLCRTSCLQKQSHWVEITALILGAQALPVYLMTLMKGASRRSWPLNEGIMAVGLVS
LLGSALLKNDVPLAGPMVAGGLLLAAYVMSGSSADLSLEKAANVQWDEMADITGSSPIIEVKQDEDGS
FSIRDVEETNMITLLVKLALITVSGLYPLAIPVTMTLWYMWQVKTQRSGALWDVPSPAATQKAALSEG
VYRIMQRGLFGKTQVGVGIHMEGVFHTMWHVTRGSVICHETGRLEPSWADVRNDMISYGGGWRLGDKW
DKEEDVQVLAIEPGKNPKHVQTKPGLFKTLTGEIGAVTLDFKPGTSGSPIINRKGKVIGLYGNGVVTK
SGDYVSAITQAERIGEPDYEVDEDIFRKKRLTIMDLHPGAGKTKRILPSIVREALKRRLRTLILAPTR
VVAAEMEEALRGLPIRYQTPAVKSEHTGREIVDLMCHATFTTRLLSSTRVPNYNLIVMDEAHFTDPSS
VAARGYISTRVEMGEAAAIFMTATPPGATDPFPQSNSPIEDIEREIPERSWNTGFDWITDYQGKTVWF
VPSIKAGNDIANCLRKSGKKVIQLSRKTFDTEYPKTKLTDWDFVVTTDISEMGANFRAGRVIDPRRCL
KPVILTDGPERVILAGPIPVTPASAAQRRGRIGRNPAQEDDQYVFSGDPLKNDEDHAHWTEAKMLLDN
IYTPEGIIPTLFGPEREKTQAIDGEFRLRGEQRKTFVELMRRGDLPVWLSYKVASAGISYKDREWCFT
GERNNQILEENMEVEIWTREGEKKKLRPRWLDARVYADPMALKDFKEFASGRKSITLDILTEIASLPT
YLSSRAKLALDNIVMLHTTERGGRAYQHALNELPESLETLMLVALLGAMTAGIFLFFMQGKGIGKLSM
GLITIAVASGLLWVAEIQPQWIAASIILEFFLMVLLIPEPEKQRTPQDNQLIYVILTILTIIGLIAAN
EMGLIEKTKTDFGFYQVKTETTILDVDLRPASAWTLYAVATTILTPMLRHTIENTSANLSLAAIANQA
AVLMGLGKGWPLHRMDLGVPLLAMGCYSQVNPTTLTASLVMLLVHYAIIGPGLQAKATREAQKRTAAG
IMKNPTVDGITVIDLEPISYDPKFEKQLGQVMLLVLCAGQLLLMRTTWAFCEVLTLATGPILTLWEGN
PGRFWNTTIAVSTANIFRGSYLAGAGLAFSLIKNAQTPRRGTGTTGETLGEKWKRQLNSLDRKEFEEY
KRSGILEVDRTEAKSALKDGSKIKHAVSRGSSKIRWIVERGMVKPKGKVVDLGCGRGGWSYYMATLKN
VTEVKGYTKGGPGHEEPIPMATYGWNLVKLHSGVDVFYKPTEQVDTLLCDIGESSSNPTIEEGRTLRV
LKMVEPWLSSKPEFCIKVLNPYMPTVIEELEKLQRKHGGNLVRCPLSRNSTHEMYWVSGASGNIVSSV
NTTSKMLLNRFTTRHRKPTYEKDVDLGAGTRSVSTETEKPDMTIIGRRLQRLQEEHKETWHYDQENPY
RTWAYHGSYEAPSTGSASSMVNGVVKLLTKPWDVIPMVTQLAMTDTTPFGQQRVFKEKVDTRTPQPKP
GTRMVMTTTANWLWALLGKKKNPRLCTREEFISKVRSNAAIGAVFQEEQGWTSASEAVNDSRFWELVD
KERALHQEGKCESCVYNMMGKREKKLGEFGRAKGSRAIWYMWLGARFLEFEALGFLNEDHWFGRENSW
SGVEGEGLHRLGYILEEIDKKDGDLMYADDTAGWDTRITEDDLQNEELITEQMAPHHKILAKAIFKLT
YQNKVVKVLRPTPRGAVMDIISRKDQRGSGQVGTYGLNTFTNMEVQLIRQMEAEGVITQDDMQNPKGL
KERVEKWLRECGVDRLKRMAISGDDCVVKPLDERFGTSLLFLNDMGKVRKDIPQWEPSKGWKNWQEVP
FCSHHFHKIFMKDGRSLVVPCRNQDELIGRARISQGAGWSLRETACLGKAYAQMWSLMYFHRRDLRLA
SMAICSAVPTEWFPTSRTTWSIHAHHQWMTTEDMLKVWNRVWIEDNPNMIDKTPVHSWEDIPYLGKRE
DLWCGSLIGLSSRATWAKNIHTAITQVRNLIGKEEYVDYMPVMKRYSAPSESEGVL

>DENV4|peptide_length:10|string2 xMNQRKKVANTPFNMLKRERNRVSTPQGLVKRFSSGMLQGRGPLKLFMALVAFLRFLTIPPTAGILKR
WGQLKKNKAIKILTGFRKEIGRMLNILNRRKRSTMTLLCLIPTAMAFSLTTRNGEPHMIVSRQEKGKS
LLFKTEDGVNMCTLMAMDLGELCEDTVTYKCPLLIQNEPEDIDCWCNLTSAWVMYGTCTQNGEHRREK
RSVALVPHVGMGLETRTETWMSSEGAWKHAQRIETWILRHPGFTILAGIMAYTIGTTGIQRTVFFILL
TAVAPSMGMRCIGISNRDFVEGVSGGSWVDIVLEHGSCVTTMAKGKPTLDFELIKTEAKQPALLRTYC
IEALLTNTTTESRCPTQGEPSLNEEQDQRYICKHSMVDRGWGNGCGLFGKGGVVTCAKFLCKKNMEGK
VVQPENLEYTIVITPHSGEEHAVGNDTSNHGVTAMITPRTPIVEAELTDYGELSMECSPRTGIDFNEM
ILMEMENKAWLVHRQWFLDLPLPWTTGADTSEVHWNHKETLVTFKNPHAKKQDVVVLGSQEGAMHSAL
TGATEIQMSSGNLLFTGHLKCRLRMDKLQLKGMSYSMCTGKFKIDKEIAETQHGTTVVKVKYEGTGSP
CKIPIEIRDVNKKKVVGRxxxxxxxAENTNSAVNIEAEPPFGDSYIVIGVGDGQLKLNWFKKGSSIGQ
MFETTMRGAKRMAILGDTAWDFGSVGGLLTSLGKAVHQVFGAIYGTMFGGVSWMVRILIGLIITWIGT
NSRNTSMAMSCIAVGGITLFLGFTVHADMGCxxSWSGKELKCGSGIFVIDNVHTWTEQYKFQPESPAR
VASAILIAHKDGVCGIRSTTRLENIMWKQITNELxxxxxEGGHDLTVVAGDVKGVLSKGKRALTPPAN
DLKYSWKTWGKAKIFTPETKNSTFLVDGPDTSECPNERRAWNSFEVEDYGFGMFTTSIWMKFREGSSE
LCDxxxxxxxxxxxxxxxxxxxxxxxSKNQTWQIERASLIEVKTCxxxxxxxxxxxxVLESQMLIPR

FIG. 57-13

```
AYAGPFSHHNYRQGYATQTAGPWHLGKLEMDFGECPGTTVTIQENCGHRGSSLRTTTASGxxxxxxxx
xxxxxxxxxxxxxxxxxWYGMEIRPLNEREENMVKSQVAAGxSSPETFSMGLLCLTLFMEECLRRRVTR
KHMILVVVITFCAIILGGLTWMDLLRAIIMLGDTMSGRIGGQIHLAIMIVFKMSPGYVLGIFLRRLTS
RETALMVIGMAMTTVFSIPHDLMEFIDGISLGLILLKIVTHFDDAQVGTLALSLTFIKSTxPLIMAWR
TIMAVFFAVTLIPLCRTSCLQKQSHWVEITAITLGAQALPVYLMTLMKGASKRSWPLNEGIxxxxxxx
xxxxxxxxxxxxxxxxxxxxxxxxxxxxGSSADLSLEKAASVQWDEMADITGSSPIVEVKQDEDGS
FSIRDIEETNMITLLxxxxxxxxSGLYPLAIPITMALWYIWQVRTQRSGALWDVPSPAATKKATLTEG
VYRIMQRGLLGKTQVGVGIHIEGVFHTMWHxTRGSVICHESGRLEPSWADxxxxxxxxxxxGWRLGDKW
DREEDVQVLAVEPGKNPKHVQTKPGLFKTITGEIGAVTLxxKPGTSGSPIINKKGKVIGLYGxxxxxx
xxxxVSAITQAERTGEPDYEVDExxxxxxxxxxxxxxxxxxxxxxxxxxxxxxxxxxxxxxxxxxxx
xxxxxxxxxxxxxxIRYQTPAVKAEHTGREIVDLMCHATFTTKLLSSTRVPNxxxxxMDEAHFTDPCS
VAARGYISxxxxxxxxxxxIFMTATPPGSIDPFPQSNSPxxxxxxxxxxxxxxxxxxxxxxxxxxxx
xxxxxxxxxxANCLRKSGKRVIQLSRKTFxxxxxxxxxxxxxxxxxxxxxxxxxxxxxxxxxPRRCL
KPVILPDGPERVILAxxxxxxxxxxxQRRGRIGRNLTQEDDQYVFSGDPLRNDEDHAHWTxxxxxxxx
xxxxxxxxxTLFGPEREKNQAIDGEFRLxxxQRKTFVELMKRGDLPVWLSxKVASAGISYEDREWCFT
GExxxxxxxxxxxxxxxxEGEKKKLRPKWLDARVYADxxxxxxxxxxxxxxxxxxTLDILTEIATLPT
YLSSKAKLALDNIVMLHTTEKGGKAYQHALNELPESLETLMLIALLGAMTAGTFLFFMQGKGIGKLSM
GLIAIAMASGLLWIAELQPQWIAASIxLEFFLMVLLVPEPEKQRTPxDNQLIYVILAILTIIGLVAAN
EMGLIEKTKTDFGFYQAKPETTILDVDLxxxxxWTLYAVVTTILTPMLRxxxxxxxxxNLSLAAIANHA
AVLxxLGKGWPLHRVDLGVPLLAMxxYSQVNPTTLTASLVMLSVHYAIIGPGxxxxxxxxxxxxxxxx
xxxxxxxxxxxxxxxxxxxxxxGQVMLLVLCVGQLLLMRTTWALCEVLTLATGPIMTLWEGN
PGRxxxxxxxxxxxxxxxxxxxxxGLAFSLIKNVQTPRRGTGITGETLGEKWKRQLNSLDRREFEEY
KRSGIIEVDRTEAKSALRDGSKTKYAVSRGTSKIRWIVERGMIKPKGKIVDLGCGRGGxxxxxATLKN
VTEVRGFTKGGPGHEExxxxxxxxxxxxxLHSGVDVFYRPTEQVDTLLxxxxxxxxxxxxxxxxxxx
xxxxxxxxxxxxxxxxxxxxxxIEELEKLQRRHGGSLIRCPLSRNSTHEMYWVSGVSGNIVSSV
NTISKMLLNRFTTRHRKPTYEKDADLGAGTRSVxTEPEKPDMTIIGRRLQRLREEHKETWHYDHENPY
RTWAYxxSYEAPSTGSASSMINGVVKLLTKPWDVVPMVTQLAMTxxxxxxxxxxxxxxVDTRTPQPKP
GTRMIMTTTANWLWALLGKKKSPRLCTKEEFISKVRSxxxxxxxxxxxxGWTSASEAVSDSRFWKLVD
KERTLHQEGKCESxxxxxxxxxxxxxxxxxxxxxxxxxxxxxxxxxxxxxGFLNEDHWFSRENSW
SGVExxxLHRLGYILEDIDKKDGDLIYADDTAGWDTRITEDDLLNEELITEQMAPHHKTLAKAIFKLT
xxxxVVKVLRPTPKGAVMDIISRxxxRGSGQVGTYSLNTFTNMEVxxxxQMEAEGVITQDDMHNPKGL
KERVEKWLKECGVDRLKRxxxxxxxxVVKPLDERFSTSLLFLNDMxxxxxxxxxxxxxxxxxxxxxxx
FCSHHFHRIFMKDGRSLxxxxxxxxxxxxxxxISQGAGWSLKETACLGKAYxxxxxxxxxxxxxxxxx
xxxICSAVPTEWLPTSRTTWSIxxxxxxxxxxxxxxxxxxxxxVWIEDNPNMTDKTPIHSWEDVPYLGKRE
DLxxxxxxxxxSRATWAKNIQTAIAQVRNLIGKEEYVDYMPAMKRYSAPFESEGVL >DENV4|peptide_length:10|string3 xNNQRKKARNTPFNMLKRxxxxxxxVQQLVKRFSLGMLQGRGPLxxxxxxxxxxxxxxxxxxxxxLKR
WGQIKKNKAIRVLRGFRKEIGRMLNILNGRRRSTVTLLCLIPTVMAFHLTTRDGEPLMIVGKHERGRP
LLFKTTEGINRCTLIAMDxxEMCEDTVTYECPLLRQNEPEDIDCWCNSTSTWVTYGTCTTTGEHRREK
RSxxxxxxxxxxxxxxxxxxxxxxxxxxxxxxxxxxxxLMAAFLAYMVGQTHFQRALIFILL
TAVAPSYTMRCIGISNRDFVEGVSGGVWVDLVLEHGxxxxxxxxNKPTLDFELIKTEAKQPATLRKYC
IEAKLTNTTTESRxxxxxxxxxxxxxQDKQFVCRRDMVDRGWGNGxxxxxxGGIVTCAMFTCKKNMEGK
VxxxxxxxxxxxxxxxxxxxxxxxxxxxxxxxxxxGDTHAVGNDTSNHGVTTKITPRSSSTEVELPGYGTVTMECSPRTGIDFNEM
ILMKMKTKTWLVHKQWFLDLPLPWAPGADTQGSNWIQKETLVTFKNxxxxxxxxxxxxxxxQEGAMHTAL
TGATEIQMSSxxxxxxxHLKCKIRMERLRIKGMSYTMCSGKFSVVREMAETQHGTIVIRVQYEGDGAP
CKIPFEIRDVNKEKVIGRxxxxxxxAESKDSPVNIEAEPPFGDSYIMIGVEPGQLKLNWFRKGSSIGK
MLESTYRGAKRxxxxxxxxWDFGSLGGVFTSIGKALHQIFGSVYTAAFSGVSWTIKILIGVIITWIGM
NSRNTPMAMTCIAVGxxxxFLGFTVHADTGCxxSWNGKELKCGSGIFVTDNVHTWTEQHQFQPESPAR
```

FIG. 57-14

```
LASAILNAHKDGVCGVRSTxxxxxxxxxxxxxxxxxxxxxxHDLTVVAGDAKGVLVKGKRALTPPVN
DLKYSWKTxGKARIFTPEARNSTFLVDGPxxxxxPNERRAWNFLEVEDYGFGxxxxxxxxxxxxxxx
xxxxxxxxxxxxxxxxxxxxxxxxxxxxxxxxxxxxxxxxxxxxxxxxxxxxxxxxxLESQMLIPK
SYAGPISQHNYRQGYATQTMGPWHLGKLExxxGECPGTTVAIQDDCGHRGSSLRxxxxxxxxxxxxx
xxxxxxxxxxxxxxxxxGMEIRPLSEKEENMVKSQVSAGxGPSETFSMGLLCLTLFIEECLRRKVTR
KHMILVVVTTLCAIILGGxxxxxxxxxxIIMLGDTMLSRMGGQVHLAIMAVFKxxxGYVLGVFLRRLTS
RExxxxVIGMAMTTVLSIPHDLMEFIDGISLGLILLKMVTHFDNTQVGTLALSLTFIKTTxPLTMAWR
TIMAVLFAVTLIPLCxxxxxxxxSHWVEITALTLGAQALPVxxxxxxxxxxxxxxxxxxxxxxxxx
xxxxxxxxxxxxxxxxxxxxxxxxxxxxxxADLSLERAANVQWDEMAAITGSSPIIEVKQDDDGx
xxxxxxxxxxxxxxxxxxxxxxxxxxxxxxxYPLAIPVTMTLWYMWQVRTQRSGxLWDVPSPAATQKATLTEG
VYRIMxxxxLGKTQVGVGVHTEGVFHTMWHxxxxxxxxxxxxxxxxxxxxxxxxxxxxxxxxxxxx
xKEEDVQVLAVxxxxxxxxxxxxxxxxxxxxxxxxxxxxxxxxxGSSGSPIINRKxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxIFMTATPPGTTDPFPQSNSxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxRRCL
KPVISTDGPERVILxxxxxxxxxxxxxRRGRIGRNPTQEDDQYVFxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxILTEIATLPA
YLSSKAKLAxxxxxMLHTTERGGKAYQHALxxxxxxxxxxxxxxxxxxxxxxxxxxxxQGKGIGKLSM
GLITIAVASGLFWVAELQPQWIAxxxxxxxxxxxxxxxxxxxxxxxxxxLIYVILTILTIIALVAAN
EMGLxxxTKADFGFYQEKTEITILDVDLxxxxxxxxxxxxxxxxxxxxxxxxxxxxxxxxxxxxxx
xxxxxxxxxxxxxxxxxxxxxxxxxxxxxxTLIASLVMLFVHYAIIxxxxxxxxxxxxxxxxxxxx
xxxxxxxxxxxxxxxxxxxxxxxxxxxxxLLVLCAGQLFLMRTTWAFCEVLTLATGPVLTLWEGN
PGxxxxxxxxxxxxxxxxxxxxxxxGLAFSLIKNTQTPRRGTGITGxxxxxxxxxxxxxxxxxxxx
xxxxxxxxxxxKSALKDGSKIKYAVSRGTSxxxxxxxxGMVKPKGKVIDLxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxEELEKLQRKHGGSLIRCPLSRNxxxxxxxxxxxxxxxxx
NTVSKMLLNRFTTKHRKPTxxxxxxxxxxxxxxxxxxxxxxxxxxxxxxxxxxxxxxxxxxxxxxx
xxxxxxxxxxxSSTGSASSMVxxxxKLLTKPWDMIPMVTQLAMxxxxxxxxxxxxxxxxxxxRTPQPKP
GTRVVMTTTANWLWTLLGRKKSPRLCTKEEFxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxLGYILEDIDRKDGDLMYADxxxxxxxxxxxxxxxxxxxxITEQMAPHHRILAKAIFKLx
xxxxxxxxxxxxxxxxxxxxxxxxxxxxxxxxxxxxxxxxxxxxxxxxxxxxxxxxEGVITRDDMQNPKGL
KERVENWLRECGVDRxxxxxxxxxxxxxVVKPLDERFATSLLFLNDMxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxNPNMTDKTPVHSWEDVPYLxxxx
xxxxxxxxxxxxxxWAKNIHTAIAQVRNLxxKEEYVDYMPVMRRYSALSESEGVL >DENV4|peptide_length:10|string4 xxxxxNRVVRPPFNMLxxxxxxxxxPQGLTKRFSIGLFSGKGPLxxxxxxxxxxxxxxxxxxxxxx
xGTLKKSKAINVLRGFRKEIxRMLNILNRRRRTAGMIICLIPTIMAFHLSTRDxxxxxxxxxxxxx
xxxxxxxxxxxxxxxxxxxxxxxxxxxxTITYKCPLLRQNEPxxxxxxxxxxxxxxxxxxxxxxxx
xxxxxxxxxxxxxxxxxxxxxxxxxxxxxxxxxxxxxxxxxxxxxxxxxMIGQTGIQRTIFFVLM
MLVxxxxxxxxxxxxxxxxxxxxxxxxxxxxxxxxxxxxxxxxxxxxxxxxxxxxxxxxxxxxxx
xxxxxxxxxxxxxxxxxxxxxxxxDQQYICRRNVVxxxxxxxxxxxxxxxxxxxxxxxxxxxxxxx
xxxxxxxxxxxxxxxxxxxxxxxxxxxNDIGKHGKTATITPQSPSVEVQLPDYGExxxxxxxxxxxLDFNEM
ILMRMENKAWLVHRQxFLDLPLPWLAGADTLEVHWNHKERxxxxxxxxxxxxxxxxxxxxxxxxxx
xxxxxxxxxxxxxxxxxxxxxxxxxxxxxxxxxxxxxxxxxxxxxxxxxxxxTVIKVKYEGAGAP
```

FIG. 57-15

```
CKIPIEIMDLEKRHVLGRxxxxxxxVTYTNSVTNIELxxxxGDSYIIIGVEPGQLKxxxxxxxxxxxxx
xxxxxxxxxxxxxxxxxxxxxxxxxxxxxxxxxxxxxxxxxxxxxxxxxxxxxVRILIGLLVLxxxx
xxxxxxxxxxxxxxxxxxxxxFLGFTVQADTGCxxSWNGRELKCGSGIFVADNVHTWTEQxxxxxxxxx
xxxxxxNAHKDGVCGVxxxxxxxxxxxxxxxxxxxxxxxxxxxxxDLTIVAGDVRGVLTKGKRALAPPVN
DLKYSxxxxGKAKIFTPEVxxxxxxxxxxxxxxxxPNERRAWNFFEVEDYGFGxxxxxxxxxxxxxxxx
xxxxxxxxxxxxxxxxxxxxxxxxxxxxxxxxxxxxxxxxxxxxxxxxxxxxxxxxxxxxxxxxLIPK
AYAGPISQHNYRQGYATQIAGPWHLGKLxxxxxxCPGTTVTIQEDCGHRGSSLxxxxxxxxxxxxxxxx
xxxxxxxxxxxxxxxxxxxxxxxxxxxxxxLNEKEENMVKSQATAGxGTPETFSMGLLxxxxxxxxxxxxxxxR
KHMILVVATTFCAIILGGxxxxxxxxxxxxMLGDTMFGRVGGQTHLAIMIVFKxxxxxxxxxxxxxxxxx
xxxxxxVIGMAMTTTFSIPHDLMExxxxIALGLILLKTVVHFDNAQLGTLALALTFIKSTxPLTMAWR
TIMxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxIPVTMALWYMWQVKTxxxxxxWDVPSPATAQKATLTEG
VYxxxxxxxxxKTQVGVGIHTxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxFMTATPPGSTDPFPQSNSxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxASLPA
YLSSRAxxxxxxxxxxxxxxxxxxxxxxxxxxxxxxxxxxxxxxxxxxxxxxxxxxxxxxxMGKLSV
GLITIAVASGLLWVAELQPQWxxxxxxxxxxxxxxxxxxxxxxxxxxxxxxxxxxxVILAILAIIGLIAAN
ExxxxxxTKTDFGFYQEKPETTILDVxxxxxxxxxxxxxxxxxxxxxxxxxxxxxxxxxxxxxxxxxx
xxxxxxxxxxxxxxxxxxxxxxxxxxxxxxxxxxxxTLTASLVMLFVHxxxxxxxxxxxxxxxxxxxx
xxxxxxxxxxxxxxxxxxxxxxxxxxxxxxxxxxxxxxxxxxxxxxxxVLTLSTGPALTLWEGG
PGxxxxxxxxxxxxxxxxxxxxxxxxxxxxxxAFSLIKNAQAPRRGTGTxxxxxxxxxxxxxxxxxxx
xxxxxxxxxxxxxKSALKDGSKIKYAVxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxEKLQRKYGGNLIRCPLxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxTPQPKP
GTQMIMTTTANWxxxLLGKKKTPRLCTREEFxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxDIDKKDGDLMxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxL
KEKVEKWLKExxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxEYADYMPVMKRYSAHFESEGVL >DENV4|peptide_length:10|string5 xxxxxxxxxxxxxxxxxxxxxxxxxxxxxxxxxxxxxxxxxxxxxxxxxxxxxxxxxxxxxxxxxxxx
xxxxKKTKAIKILTGFxxxxxxxLNILNRRKRSTVTLLMLIPTVMAFHLTTRNxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxIGQTGIQRAVFFVLx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
```

FIG. 57-16

```
xxxxxxxxxxxxxxxxxxxxxxxxxDTPNHGVEIKITPRSPSAEVKLPDxxxxxxxxxxxxxxxxFNEM
VLLQMExxxxxxxxxxxxxxxxxLPWTAGADTLEVHxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxIKDVNKERVVGRxxxxxxxAEEKDSPVNIEAxxxxxDSYIIIGVGDSALTxxxxxxxxxxx
xxxxxxxxxxxxxxxxxxxxxxxxxxxxxxxxxxxxxxxxxxxxxxxxxxxxMKILIGVIITxxxx
xxxxxxxxxxxxxxxxxxxxFLGFTVRADMGCxxSWTGKELKCGSGxxxxxxxxxxxxxxxxxxxx
xxxxxxxxxxxxxxxxxxxxxxxxxxxxxxxxxxxxxxxxxxxxxVTGDVKGVLTKGKRTLAPPAS
DLKYSxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxPK
AYAGPISQHxxxxxxxxxxxxxxxxxxxxxxxxxxPGTTVTVREDCDHRGPSxxxxxxxxxxxxxx
xxxxxxxxxxxxxxxxxxxxxxxxxxxxEENMVRSQVTAGxGPSETFSMGLxxxxxxxxxxxxxxxR
KHMILVVVATLCAIILGGxxxxxxxxxxxxxxxxxxxxxRIGGQVHLAIMxxxxxxxxxxxxxxxx
xxxxxxxxxxxxxxxxxxxxxxxxxxxxxxxxxxxxxVTHFDSTQVGTLxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxTDFGFYQVKAETTILDVxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxALRDGSKTKHAVxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxLQRKYGGNLIRCPxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxPQPKL
GTRVVMTTTxxxxxxxxxxKKNPRLCTKEEFxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxMPAMKRYSAPSENEGVL
```

FIG. 57-17

>DENV4|peptide_length:11|string1 xMNQRKKVVRPPFNMLKRERNRVSTPQGLVKRFSTGLFSGKGPLRMVLAFITFLRVLSIPPTAGILKR
WGQLKKNKAIKILIGFRKEIGRMLNILNGRKRSTITLLCLIPTVMAFHLSTRDGEPLMIVAKHERGRP
LLFKTTEGINKCTLIAMDLGEMCEDTVTYKCPLLVNTEPEDIDCWCNLTSTWVMYGTCTQSGERRREK
RSVALTPHSGMGLETRAETWMSSEGAWKHAQRVESWILRNPGFALLAGFMAYMIGQTGIQRTVFFVLM
MLVAPSYGMRCVGVGNRDFVEGVSGGAWVDLVLEHGGCVTTMAQGKPTLDFELTKTTAKEVALLRTYC
IEASISNITTATRCPTQGEPYLKEEQDQQYICRRDVVDRGWGNGCGLFGKGGVVTCAKFSCSGKITGN
LVQIENLEYTVVVTVHNGDTHAVGNDTSNHGVTATITPRSPSVEVKLPDYGELTLDCEPRSGIDFNEM
ILMKMKKKTWLVHKQWFLDLPLPWTAGADTSEVHWNYKERMVTFKVPHAKRQDVTVLGSQEGAMHSAL
AGATEVDSGDGNHMFAGHLKCKVRMEKLRIKGMSYTMCSGKFSIDKEMAETQHGTTVVKVKYEGAGAP
CKVPIEIRDVNKEKVVGRxxxxxxxAENTNSVTNIELEPPFGDSYIVIGVGNSALTLHWFRKGSSIGK
MFESTYRGAKRMAILGETAWDFGSVGGLFTSLGKAVHQVFGSVYTTMFGGVSWMIRILIGFLVLWIGT
NSRNTSMAMTCIAVGGITLFLGFTVQADMGCxxSWSGRELKCGSGIFVVDNVHTWTEQYKFQPESPAR
LASAILNAHKDGVCGIRSTTRLENVMWKQITNELNYVLWEGGHDLTVVAGDVKGVLTKGKRALTPPVS
DLKYSWKTWGKAKIFTPEARNSTFLIDGPDTSECPNERRAWNSLEVEDYGFGMFTTNIWMKFREGSSE
VCDHRLMSAAIKDQKAVHADMGYWIESSKNQTWQIEKASLIEVKTCLWPKTHTLWSNGVLESQMLIPK
SYAGPFSQHNYRQGYATQTVGPWHLGKLEIDFGECPGTTVTIQEDCDHRGPSLRTTTASGKLVTQWCC
RSCTMPPLRFLGEDGCWYGMEIRPLSEKEENMVKSQVTAGxGTSETFSMGLLCLTLFVEECLRRRVTR
KHMILAVVITLCAIILGGLTWMDLLRALIMLGDTMSGRIGGQTHLAIMAVFKMSPGYVLGVFLRKLTS
RETALMVIGMAMTTTLSIPHDLMELIDGISLGLILLKIVTQFDNTQVGTLALSLTFIRSTxSLVMAWR
TIMAVLFVVTLIPLCRTSCLQKQSHWVEITALILGAQALPVYLMTLMKGASRRSWPLNEGIMAVGLVS
LLGSALLKNDVPLAGPMVAGGLLLAAYVMSGSSADLSLEKAANVQWDEMADITGSSPIIEVKQDEDGS
FSIRDVEETNMITLLVKLALITVSGLYPLAIPVTMTLWYMWQVKTQRSGALWDVPSPAATQKAALSEG
VYRIMQRGLFGKTQVGVGIHMEGVFHTMWHVTRGSVICHETGRLEPSWADVRNDMISYGGGWRLGDKW
DKEEDVQVLAIEPGKNPKHVQTKPGLFKTLTGEIGAVTLDFKPGTSGSPIINRKGKVIGLYGNGVVTK
SGDYVSAITQAERIGEPDYEVDEDIFRKKRLTIMDLHPGAGKTKRILPSIVREALKRRLRTLILAPTR
VVAAEMEEALRGLPIRYQTPAVKSEHTGREIVDLMCHATFTTRLLSSTRVPNYNLIVMDEAHFTDPSS
VAARGYISTRVEMGEAAAIFMTATPPGATDPFPQSNSPIEDIEREIPERSWNTGFDWITDYQGKTVWF
VPSIKAGNDIANCLRKSGKKVIQLSRKTFDTEYPKTKLTDWDFVVTTDISEMGANFRAGRVIDPRRCL
KPVILTDGPERVILAGPIPVTPASAAQRRGRIGRNPAQEDDQYVFSGDPLKNDEDHAHWTEAKMLLDN
IYTPEGIIPTLFGPEREKTQAIDGEFRLRGEQRKTFVELMRRGDLPVWLSYKVASAGISYKDREWCFT
GERNNQILEENMEVEIWTREGEKKKLRPRWLDARVYADPMALKDFKEFASGRKSITLDILTEIASLPT
YLSSRAKLALDNIVMLHTTERGGRAYQHALNELPESLETLMLVALLGAMTAGIFLFFMQGKGIGKLSM
GLITIAVASGLLWVAEIQPQWIAASIILEFFLMVLLIPEPEKQRTPQDNQLIYVILTILTIIGLIAAN
EMGLIEKTKTDFGFYQVKTETTILDVDLRPASAWTLYAVATTILTPMLRHTIENTSANLSLAAIANQA
AVLMGLGKGWPLHRMDLGVPLLAMGCYSQVNPTTLTASLVMLLVHYAIIGPGLQAKATREAQKRTAAG
IMKNPTVDGITVIDLEPISYDPKFEKQLGQVMLLVLCAGQLLLMRTTWAFCEVLTLATGPILTLWEGN
PGRFWNTTIAVSTANIFRGSYLAGAGLAFSLIKNAQTPRRGTGTTGETLGEKWKRQLNSLDRKEFEEY
KRSGILEVDRTEAKSALKDGSKIKHAVSRGSSKIRWIVERGMVKPKGKVVDLGCGRGGWSYYMATLKN
VTEVKGYTKGGPGHEEPIPMATYGWNLVKLHSGVDVFYKPTEQVDTLLCDIGESSSNPTIEEGRTLRV
LKMVEPWLSSKPEFCIKVLNPYMPTVIEELEKLQRKHGGNLVRCPLSRNSTHEMYWVSGASGNIVSSV
NTTSKMLLNRFTTRHRKPTYEKDVDLGAGTRSVSTETEKPDMTIIGRRLQRLQEEHKETWHYDQENPY
RTWAYHGSYEAPSTGSASSMVNGVVKLLTKPWDVIPMVTQLAMTDTTPFGQQRVFKEKVDTRTPQPKP
GTRMVMTTTANWLWALLGKKKNPRLCTREEFISKVRSNAAIGAVFQEEQGWTSASEAVNDSRFWELVD
KERALHQEGKCESCVYNMMGKREKKLGEFGRAKGSRAIWYMWLGARFLEFEALGFLNEDHWFGRENSW
SGVEGEGLHRLGYILEEIDKKDGDLMYADDTAGWDTRITEDDLQNEELITEQMAPHHKILAKAIFKLT
YQNKVVKVLRPTPRGAVMDIISRKDQRGSGQVGTYGLNTFTNMEVQLIRQMEAEGVITQDDMQNPKGL
KERVEKWLRECGVDRLKRMAISGDDCVVKPLDERFGTSLLFLNDMGKVRKDIPQWEPSKGWKNWQEVP
FCSHHFHKIFMKDGRSLVVPCRNQDELIGRARISQGAGWSLRETACLGKAYAQMWSLMYFHRRDLRLA

FIG. 57-18

SMAICSAVPTEWFPTSRTTWSIHAHHQWMTTEDMLKVWNRVWIEDNPNMIDKTPVHSWEDIPYLGKRE
DLWCGSLIGLSSRATWAKNIHTAITQVRNLIGKEEYVDYMPVMKRYSAPSESEGVL

>DENV4|peptide_length:11|string2 xMNQRKKVANTPFNMLKRERNRVSTPQGLVKRFSSGMLQGRGPLKLFMALVAFLRFLTIPPTAGILKR
WGQLKKNKAIKILTGFRKEIGRMLNILNRRKRSTMTLLCLIPTAMAFSLTTRNGEPHMIVSRQEKGKS
LLFKTEDGVNMCTLMAMDLGELCEDTVTYKCPLLIQNEPEDIDCWCNLTSAWVMYGTCTQNGEHRREK
RSVALVPHVGMGLETRTETWMSSEGAWKHAQRIETWILRHPGFTILAGFLAYMIGQTGIQRTVFFILL
TLVAPSYGMRCIGISNRDFVEGVSGGSWVDIVLEHGSCVTTMAQGKPTLDFELIKTEAKQPALLRTYC
IEALLTNTTTESRCPTQGEPSLNEEQDKRYVCKHSMVDRGWGNGCGLFGKGGVVTCAKFLCKKNMEGK
VVQPENLEYTIVITPHNGDEHAVGNDTSNHGVTAMITPRTSSTEVELPGYGEVSMECSPRTGLDFNEM
ILMEMKNKAWLVHRQWFLDLPLPWTTGADTSEVHWNHKETLVTFKNPHAKKQDVVVLGSQEGAMHSAL
TGATEIQMSSGNLLFTGHLKCRLRMDKLQLKGMSYTMCTGKFKIVKEIAETQHGTTVVKVKYEGTGAP
CKVPIEIRDVNKKKVVGRxxxxxxxAENTNSAVNIEAEPPFGDSYIVIGVGDGQLKLNWFRKGSSIGQ
MFETTMRGAKRMAILGDTAWDFGSVGGLLTSIGKAVHQVFGAIYTTMFGGVSWMVRILIGLIITWIGT
NSRNTSMAMSCIAVGGITLFLGFTVHADMGCxxSWSGKELKCGSGIFVIDNVHTWTEQYQFQPESPAR
VASAILNAHKEGVCGIRSTTRLENIMWKQITNELNxALWEGGHDLTVVAGDVKGVLSKGKRALTPPAN
DLKYSWKTWGKAKIFTPETKNSTFLVDGPDTSECPNERRAWNSFEVEDYGFGMFTTSIWMKLREGSSE
LCDHRLMSAAIxxxKAVHADMGYWLxSSKNQTWQIERASLIEVKTCLxxxxxxxxxGVLESQMLIPR
AYAGPFSHHNYRQGYATQTAGPWHLGKLEMDFGECPGTTVTIQENCGHRGSSLRTTTASGKxxxxxxx
xxxxxxxxxxxxxxCWYGMEIRPLNEREENMVKSQVAAGxSSPETFSMGLLCLTLFMEECLRRRVTR
KHMILVVVITFCAIILGGLTWMDLLRAIIMLGDTMSGRIGGQIHLAIMIVFKMSPGYVLGIFLRRLTS
RETALMVIGMAMTTVFSIPHDLMEFIDGISLGLILLKIVTHFDDTQLGTLALSLTFIKSTxPLVMAWR
TIMAVFFAVTLIPLCRTSCLQKQSHWVEITAITLGAQALPVYLMTLMKGASKRSWPLNEGIMxxxxxx
xxxxxxxxxxxxxxxxxxxxxxxxxxxSGSSADLSLEKAASVQWDEMADITGSSPIVEVKQDEDGS
FSIRDIEETNMITLLVxxxxxxVSGLYPLAIPITMALWYIWQVRTQRSGALWDVPSPAATKKATLTEG
VYRIMQRGLLGKTQVGVGIHIEGVFHTMWHVTRGSVICHESGRLEPSWADVxxxxxxxxGGWRLGDKW
DREEDVQVLAVEPGKNPKHVQTKPGLFKTITGEIGAVTLDFKPGTSGSPIINKKGKVIGLYGNxxxxx
xxxYVSAITQAERTGEPDYEVDEDxxxxxxxxxxxxxxxxxxxxxxxxxxxxxxxxxxxxxxxxxxxx
xxxxxxxxxxxxPIRYQTPAVKSDHTGREIVDLMCHATFTTKLLSSTRVPNYxxxVMDEAHFTDPCS
VAARGYISTxxxxxxxxAIFMTATPPGSIDPFPQSNSPIxxxxxxxxxxxxxxxxxxxxxxxxxxxx
xxxxxxxxxIANCLRKSGKRVIQLSRKTFDxxxxxxxxxxxxxxxxxxxxxxxxxxxxxxxDPRRCL
KPVILPDGPERVILAGxxxxxxxxxAQRRGRIGRNLTQEDDQYVFSGDPLRNDEDHAHWTExxxxxxx
xxxxxxxxPTLFGPEREKNQAIDGEFRLRxEQRKTFVELMKRGDLPVWLSYKVASAGISYEDREWCFT
GERxxxxxxxxxxxxxxxREGEKKKLRPKWLDARVYADPxxxxxxxxxxxxxxITLDILTEIATLPT
YLSSKAKLALDNIVMLHTTEKGGKAYQHALNELPESLETLMLVALLGAMTAGTFLFFMQGKGIGKLSM
GLIAIAMASGLLWIAELQPQWIAASIILEFFLMVLLVPEPEKQRTPQDNQLIYVILAILTIIGLVAAN
EMGLIEKTKTDFGFYQAKTEITILDVDLRxxxAWTLYAVVTTILTPMLRHxxxxxxANLSLTAIANQA
AVLMGLGKGWPLHRVDLGVPLLAMGCYSQVNPTTLTASLVMLSVHYAIIGPGLxxxxxxxxxxxxxx
xxxxxxxxxxxxxxxxxxxxxxxxxLGQVMLLVLCVGQLLLMRTTWALCEVLTLATGPIMTLWEGN
PGRFxxxxxxxxxxxxxxxxxxxAGLAFSLIKNVQTPRRGTGITGETLGEKWKRQLNSLDRREFEEY
KRSGIIEVDRTEAKSALRDGSKTKYAVSRGTSKIRWIVERGMIKPKGKVIDLGCGRGGWxxxMATLKN
VTEVRGFTKGGPGHEEPxxxxxxxxxxKLHSGVDVFYRPTEQVDTLLCxxxxxxxxxxxxxxxxxx
xxxxxxxxxxxxxxxxxxxxxxxxVIEELEKLQRRHGGSLIRCPLSRNSTHEMYWVSGVSGNIVSSV
NTISKMLLNRFTTRHRKPTYEKDADLGAGTRSVSTEPEKPDMTIIGRRLQRLREEHKETWHYDHENPY
RTWAYHGSYEASSTGSTSSMVNGVVKLLTKPWDVVPMVTQLAMTDxxxxxxxxxxxxKVDTRTPQPKP
GTRMIMTTTANWLWALLGKKKSPRLCTKEEFISKVRSNxxxxxxxxxxQGWTSASEAVSDSRFWELVD
KERALHQEGRCESCxxxxxxxxxxxxxxxxxxxxxxxxxxxxxxxxxxxxxxLGFLNEDHWFSRENSW
SGVEGxGLHRLGYILEDIDKKDGDLIYADDTAGWDTRITEDDLLNEELITEQMAPHHKTLAKAIFKLT

FIG. 57-19

YxxKVVKVLRPTPKGAVMDIISRKxQRGSGQVGTYSLNTFTNMEVQxxRQMEAEGVITQDDMHNPKGL
KERVEKWLKECGVDRLKRMxxxxxxxCVVKPLDERFSTSLLFLNDMGxxxxxxxxxxxxxxxxxxxxP
FCSHHFHRIFMKDGRSLVxxxxxxxxxxxxxRISQGAGWSLKETACLGKAYAxxxxxxxxxxxxxxxx
xxAICSAVPTEWLPTSRTTWSIHxxxxxxxxxxxxxxxxxRVWIEDNPNMTDKTPIHSWEDVPYLGKRE
DLWxxxxxxxxTSRATWAKNIQTAIAQVRNLIGKEEYVDYMPAMKRYSAPFESEGVL >DENV4|peptide_length:11|string3 xNN

FIG. 57-20

```
GTRVVMTTTANWLWTLLGRKKTPRLCTREEFIxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxRLGYILEDIDRKDGDLMYADDxxxxxxxxxxxxxxxxLITEQMAPHHRILAKAIFKLT
xxxxxxxxxxxxxxxxxxxxxxxxxxxxxxxxxxxxxxxxxxxxxxxxxxxxAEGVITRDDMQNPKGL
KERVENWLRECGVDRLxxxxxxxxxxCVVKPLDERFATSLLFLNDMGxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxDNPNMTDKTPVHSWEDVPYLGxxx
xxxxxxxxxxxxxxTWAKNIHTAIAQVRNLIGKEEYVDYMPVMRRYSALSESEGVL >DENV4|peptide_length:11|string4 xxxxxNKVVRPSFNMLKxxxxxxxxTVQGLVKRFSIGLFSGKGPLRxxxxxxxxxxxxxxxxxxxx
WGQLKKTKAINVLRGFRKEIGRMLNILNRRRRTAGMILCLIPTIMAFHLSTRDGxxxxxxxxxxxxx
xxxxxxxxxxxxxxxxxxxxxxxxxDTVTYECPLLVNTEPExxxxxxxxxSTWVTYGTCTTTxxxxxxx
xxxxxxxxxxxxxxxxxxxxxxxxxxxxxxxxxxxxxxxxxxxxxxxxxYMIGQTGIQRTIFFVLM
MLVAxxxxxxxxxxxxxxxxxxxxxxxxxxxxxxxxxxxxxxxxxxxxxxxxxxxxxxxxxxxxx
xxxxxxxxxxxxxxxxxxxxxxxxxxQDRQYICRRDVVDxxxxxxxxxxxxxxxxxxxxxxxxxxxxx
xxxxxxxxxxxxxxxxxxxxxxxxxGNDTGKHGVTIKITPRSPSVEVQLPDYGELxxxxxxxxGIDFNEM
ILMRMENKAWLVHRQWFLDLPLPWLAGADTQGSNWIQKETLxxxxxxxxxxxxxxxxxxxxxxxx
xxxxxxxxxxxxxxxxxxxxxxxxxxIRMEKLRIKGMxxxxxxxxxxxxxxxxxTAVVKVQYEGDGSP
CKIPIEIRDVNKEKVIGRxxxxxxxVTYTNSVTNIELExxFGDSYIMIGVGNSALTLxxxxxxxxxxx
xxxxxxxxxxxxxxxxxxxxxxxxxxxxxxxFTSLGKAVHQIxxxxxxxxxxxxxxxxIRILIGLLVLWxxM
NSRNTSMAMTxxxxxxxxxLFLGFTVQADVGCxxSWNGRELKCGSGIFVADNVHTWTEQYxxxxxxxxx
LASAILNAHKDGVCGVRxxxxxxxxxxxxxxxxxxxxxxxxxxxHDLTVVAGDVKGVLTKGKRALAPPVN
DLKYSWxxWGKAKIFTPEVxxxxxxxxxxxxxxCPNERRAWNFFEVEDYGFGMxxxxxxxxxxxxxx
xxxxxxxxxxxxxxxxxxxxxxxxxxxxxxxxxxxxxxxxxxxxxxxxxxxxxxxxxxxxMLIPK
AYAGPISQHNYRQGYATQIAGPWHLGKLExxxxECPGTTVTIQEDCGHRGSSLRxxxxxxxxxxxxxx
xxxxxxxxxxxxxxxxxxxxxxxxPLNEKEENMVRSQVTAGxGPSETFSMGLLCxxxxxxxxxxxxxTR
KHMILVVVTTFCAIILGGLxxxxxxxxxIMLGDTMFGRIGGQTHLAIMIVFKMxxxxxxxxxxxxxxx
xxxxxMVIGMAMTTVLSIPHDLMEFxxGIALGLILLKTVVQFDSTQVGTLALSLTFISSTxPLIMAWR
TIMAVFxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxAIPVTMTLWYMWQVRTQxxxxLWDVPSPATAQKATLTEG
VYRxxxxxxxGKTQVGVGIHTExxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxIFMTATPPGSTDPFPQSNSPxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxIASLPT
YLSSKAKxxxxxxxxxxxxxxxxxxxxxxxxxxxxxxxxxxxxxxxxxxxxxxxxxxGMGKLSV
GLITIAVASGLLWVAELQPQWIxxxxxxxxxxxxxxxxxxxxxxxxxxxxxxxxYVILAILAIIGLIAAN
EMxxxxKTKTDFGFYQEKPETTILDVDxxxxxxxxxxxxxxxxxxxxxxxxxxxxxxxxxxxxxx
xxxxxxxxxxxxxxxxxxxxxxxxxxxxxxTTLTASLAMLLVHYxxxxxxxxxxxxxxxxxxxxxx
xxxxxxxxxxxxxxxxxxxxxxxxxxxxxxxxxxxxxxxxxxxxxEVLTLSTGPALTLWEGG
PGRxxxxxxxxxxxxxxxxxxxxLAFSLIKNTQTPRRGTGITxxxxxxxxxxxxxxxxxxxxxxx
xxxxxxxxxxxAKSALKDGSKIKYAVSxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 57-21

```
xxxxxxxxxxxxxxxxxxxxxxxxxxxxxLEKLQRKYGGSLVRCPLSxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxRTPQPKP
GTQMIMTTTANWLxxLLGKKKSPRLCTKEEFIxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxEDIDKKDGDLMYxxxxxxxxxxxxxxxxxxxxxxITEQMAPGHKIxxxxxxxxx
xxxxxxxxxxxxxxxxxxxxxxxxxxxxxxxxxxxxxxxxxxxxxxxxxxxxxxxxxxxxxxxxxxGL
KEKVEKWLKECxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxEEYADYMPVMKRYSAHFESEGVL >DENV4|peptide_length:11|string5 xxxxxxxxxxxxxxxxxxxxxxxxxxxxxxxxxxxxxxxxxxxxxxxxxxxxxxxxxxxxxxxxxxxx
xxxIKKSKAINVLRGFRxxxxxMLNILNRRKRSTVTLIMLIPTVMAFHLTTRNGxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxMIGQTRIQRTVFFVLM
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxNDIPNHGKEATITPRSPSAEVKLPDYxxxxxxxxxxxxxxDFNEM
VLLQMExxxxxxxxxxxxxPLPWTAGADTLEVHWxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxEIKDMNKEKVVGRxxxxxxxAEEKDSPVNIEAExxxGDSYIVIGAGDSALTLxxxxxxxxxxxx
xxxxxxxxxxxxxxxxxxxxxxxxxxxxxxxxxxxxxxxxxxxxxxxxxxxxxxMKILIGVIITWxxx
xxxxxxxxxxxxxxxxxxxxxLFLGFTVRADMGCxxSWTGKELKCGSGIxxIDNVHTWTEQHxxxxxxxxxx
xxxxxxxxxxxxxxxxxxxxxxxxxxxxxxxxxxxxxxxxxxxxxVAGDVKGVLTKGKRTLAPPAS
DLKYSWxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxIPK
AYAGPISQHNxxxxxxxxxxxxxxxxxxxxxxxxxCPGTTVTVREDCDHRGPSLxxxxxxxxxxxxxxxx
xxxxxxxxxxxxxxxxxxxxxxxxxxxxxxxxxEENMVKSQATAGxGTPETFSMGLLxxxxxxxxxxxxxTR
KHMILVVAATLCAIILGGLxxxxxxxxxxxxxxxxxxxRVGGQTHLAIMxxxxxxxxxxxxxxxxxxxx
xxxxxxxxxxxxxxxxTFSIPHDLMELxxxxxxxxxxxxxxxxVTHFDSTQVGTLAxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxAIAVASGLLWIAEIxxxxxxxxxxxxxxxxxxxxxxxxxxxxxxxxxxxxxxxxxxxxxxxxxx
xxxxxxxxKTDFGFYQVKTEITILDVDxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
```

FIG. 57-22

```
xxxxxxxxxxxxxxxxxxxxxxxxxxxxxxxxAQTPRRGTGTIxxxxxxxxxxxxxxxxxxxxxx
xxxxxxxxxxxxxxSALRDGSKTKHAVSxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxKLQRKYGGSLVRCPLxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxTPQPKL
GTRVVMTTTAxxxxxxxxxxKKKPRLCTREEFIxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxYMPAMKRYSAPSENEGVL
```

FIG. 58-1

>WNV|peptide_length:8|string1

MSKKPGGPGKSRAVNMLKRGMPRVLSLIGLKRAMLSLIDGKGPIRFVLALLAFFRFTAIAPTRAVLDR
WRGVNKQTAMKHLLSFKKELGTLTSAINRRSSKQKKRGGKTGxxxxxxxxxxxGAVTLSNFQGKVMMT
VNATDVTxVITIPTAAGKNLCIVRAMDVGYMCDDTITYECPVLSAGNDPEDIDCWCTKSAVYVRYGRC
TKTRHSRRSRRSLTVQTHGESTLANKKGAWMDSTKATRYLVKTESWILRNPGYALVAAVIGWMLGSNT
MQRVVFVVLLLLVAPAYSFNCLGMSNRDFLEGVSGATWVDLVLEGDSCVTIMSKDKPTIDVKMMNMEA
xxLAEVRSYCYLAxVSDLSTKAACPTMGEAHNDKRADPxFVCRQGVVDRGWGNGCGLFGKGSIDTCAK
FACSTKAIGRTILKENIKYEVAIFVHGPTTVESHGxxxxxxGATQAGRFSITPAAPSYTxKLGEYGEV
TVDCEPRSGIDTNAYYVMTVGTKTFLVHREWFMDLNLPWSSAGSTVWRNRETLMEFEEPHATKQSVIA
LGSQEGALHQALAGAIPVEFSSNTVKLTSGHLKCRVKMEKLQLKGTTYGVCSKAFKFxGTPADTGHGT
VVLELQYTGTDGPCKVPISSVASLNDLTPVGRLVTVNPFVSVATANAKVLIELEPPFGDSYIVVGRGE
QQINHHWHKSGSSIGKAFTTTLKGAQRLAALGDTAWDFGSVGGVFTSVGKAVHQVFGGAFRSLFGGMS
WITQGLLGALLLWMGINARDRSIALTFLAVGGVLLFLSVNVHADTGCAIDISRQELRCGSGVFIHNDV
EAWMDRYKYYPETPQGLAKIIQKAHKEGVCGLRSVSRLEHQMWEAVKDELNTLLKENGVDLSVVVEKQ
EGMxxxAPKRLTATTEKLEIGWKAWGKSILFAPELANNTFVVDGPETKECPTxNRAWNSLEVEDFGFG
LTSTRMFLKVRESNTTECDSKIIGTAVKNNLAIHSDLSYWIESRLNDTWKLERAVLGEVKSCTWPETH
TLWGDGILESDLIIPVTLAGPRSNHNRRPGYKTQNQGPWDEGRVEIDFDYCPGTTVTLSxSCGHRGPA
TRTTTESGKLITDWCCRSCTLPPLRYQTDSGCWYGMEIRPQRHDEKTLVQSQVNAYNADMIDPFQLGL
LVVFLATQEVLRKRWTAKISMPAILIALLVLVFGGITYTDVLRYVILVGAAFAESNSGGDVVHLALMA
TFKIQPVFMVASFLKARWTNQENILLMLAAVFFQMAYHDARxxxxWEIPDVLNSLAVAWMILRAITFT
TTSNVVVPLLALLTPGLRCLNLDVYRILLLMVGIGSLIREKRSAAAKKKGASLLCLALASTGxFNPMI
LAAGLIACDPNRKRGWPATEVMTAVGLMFAIVGGLAELDIDSMAIPMTIAGLMFAAFVISGKSTDMWI
ERTADISWESDAEITGSSERVDVRLDDDGNFQLMNDPGAPWKIWMLRMVCLAISAYTPWAILPSVVGF
WITLQYTKRGGVLWDTPSPKEYKKGDTTTGVYRIMTRGLLGSYQAGAGVMVEGVFHTLWHTTKGAALM
SGEGRLDPYWGSVKEDRLCYGGPWKLQHKWNGQDEVQMIVVEPGKNVKNVQTKPGVFKTPEGEIGAVT
LDFPTGTSGSPIVDKNGDVIGLYGNGVIMPNGSYISAIVQGERMDEPIPAGFEPEMLRKKQITVLDLH
PGAGKTRRILPQIIKEAINRRLRTAVLAPTRVVAAEMAEALRGLPIRYQTSAVPREHNGNEIVDVMCH
ATLTHRLMSPHRVPNYNLFVMDEAHFTDPASIAARGYISTKVELGEAAAIFMTATPPGTSDPFPESNS
PIxDLQTEIPDRAWNSGYEWITEYTGKTVWFVPSVKMGNEIALCLQRAGKKVVQLNRKSYETEYPKCK
NDDWDFVITTDISEMGANFKASRVIDSRKSVKPTIITEGEGRVILGEPSAVTAASAAQRRGRIGRNPS
QVGDEYCYGGHTNEDDSNFAHWTEARIMLDNINMPNGLIAQFYQPEREKVYTMDGEYRLRGEERKNFL
ELLRTADLPVWLAYKVAAAGVSYHDRRWCFDGPRTNTILEDNNEVEVITKLGERKILRPRWIDARVYS
DHQALKAFKDFASGKRSQIGLIEVLGKMPEHFMGKTWEALDTMYVVATAEKGGRAHRMALEELPDALQ
TIALIALLSVMTMGVFFLLMQRKGIGKIGLGGAxLGVATFFCWMAEVPGTKIAGMLLLSLLLMIVLIP
EPEKQRSQTDNQLAVFLICVMTLVSAVAANEMGWLDKTKSDIxxxxxxxxxxxxxxxxxxxGEFLLDLRP
ATAWSLYAVTTAVLTPLLKHLITSDYINTSLTSINVQASALFTLARGFPFVDVGVSALLLAAGCWGQV
TLTVTVTAATLLFCHYAYMVPGWQAEAMRSAQRRTAAGIMKNAVVDGIVATDVPELERTTPIMQKKVG
QIMLILVSLAAVVVNPSVKTVREAGILITAAAVTLWENGASSVWNATTAIGLCHIMRGGWLSCLSITW
TLIKNMEKPGLKRGGAKGRTLGEVWKERLNQMTKEEFTRYRKEAIIEVDRSAAKxARKEGNVTGGHPV
SRGTAKLRWLVERRFLEPVGKVIDLGCGRGGWCYYMATQKRVQEVRGYTKGGPGHEEPQLVQSYGWNI
VTMKSGVDVFYRPSECCDTLLCDIGESSSSAEVEEHRTIRVLEMVEDWLHRGPREFCVKVLCPYMPKV
IEKMELLQRRYGGGLVRNPLSRNSTHEMYWVSRASGNVVHSVNMTSQVLLGRMEKRTWKGPQYEEDVN
LGSGTRAVGKPLLNSDTSKIKNRIERLRREYSSTWHxDENHPYRTWNYHGSYDVKPTGSASSLVNGVV
RLLSKPWDTITNVTTMAMTDTTPFGQQRVFKEKVDTKAPEPPEGVKxVLNETTNWLWAFLAREKRPRM
CSREEFIRKVNSNAALGAMFEEQNQWRSAREAVEDPKFWEMVDEEREAHLRGECHTCIYNMMGKREKK
PGEFGKAKGSRAIWFMWLGARFLEFEALGFLNEDHWLGRKNSGGGVEGLGLQKLGYILREVGxxxGGK
IYADDTAGWDTRITRADLENEAKVLELLDGEHRRLARAIIELTYRHKVVKVMRPAADGRTVMDVISRE
DQRGSGQVVTYALNTFTNLAVQLVRMMEGEGVIGPDDVEKLTKGKGPKVRTWLFENGEERLSRMAVSG
DDCVVKPLDDRFATSLHFLNAMSKVRKDIQEWKPSTGWYDWQQVPFCSNHFTELIMKDGRTLVVPCRG

FIG. 58-2

QDELVGRARISPGAGWNVRDTACLAKSYAQMWLLLYFHRRDLRLMANAICSAVPVNWVPTGRTTWSIH
AGGEWMTTEDMLEVWNRVWIEENEWMEDKTPVEKWSDVPYSGKREDIWCGSLIGTRARATWAENIQVA
INQVRAIIGDEKYVDYMSSLKRYEDTxxxxxxxx >WNV|peptide_length:8|string2 xxxKPGGPGKNRAVNMQKRGMPRGLSLTGLKRAMLSLIDGRGPTRFVLALLTFFKFTAIAPTRALLDR
WRGVRKQTAMKHLTSFKKELGALTNAMNRRSTKQKKRGGTAGxxxxxxxxxxSALTLSNFQGKLMMT
VNATDITxIITIPPAAGKNLCTIRAMDVGYLCEDTITYECPVLAEGNDPEDIDCWCTKSSVFVRYGRC
TRTRNSRRSRRSLNVQVHGESSLANKKGAWLDSTKASRYLMKAESWILRNxxYALVAAVTGWMLGSNT
MQRVVFAILLLLVAPxxxFNCLGMSNRDFIEGASGATWMDLVLEGDSCVTIMAKDRPTIDVKMVTMGA
xxLADVRSYCYAAxVSDLSTRAACPTMGEAHNEKRADPxFVCKQGVVDRGxxxxxxxxxxxIDTCAK
FACSTKATGWIIQRENVKYEVAAFVHGPTTVDTHSxxxxxxAAVQAGRFSITPSAPSYTxTLGDYGEV
TFDCEPRSGIDTSAYYVMSVGAKSFLVHREWFTDLNLPWSSPGNTTWRNREALVEFEEAHATKQSVVA
LGSQEGxLQQALAGAIPVDYKNSVVKLSSGHLKCRVRMEKLKLKGTTYGVCAKAFRFxRTPADTGHGT
VVMELQYTGTDGPCKIPITSVASLNDxxxxxRLVTVNPYVSVATANSKILVELEPPFGDSYIVIGKGD
QQVTHHWYKSGSSIGKAFTTTLRGAQRLVSLGDTAWDFGSIGGVFTSVGKAIHQLFGGAFRLLFGGMS
WxxxxxxxALLLWMGINARDRSIAMTFLAVGGILLFLSANVHADTGCAIDIGRQELRCGSGVFIYNDV
EAWVDRYKFHPETPQGLAKIIQKAHAEGVCGVRSVSRLEHQMWESIKDELNTLLKENGVDLSIVVEKQ
NGMxxxAPKRLAATTEKLEMGWKAWGKSIIFAPELANNTFVIDGPETEECPTxNRAWNSMEVEDFGFG
LTSTRMFLRIRETNTTECDTKTIGTAVKNNMAVHSDLSYWIESGFNETWKLERAxxxxxxxxxxxETH
TLWGDGVQESDLIIPITLAGLRSNYNKRPGYKTQSQGPWDEGRVELDFDYCPGTTVTISxSCGHRGPA
ARTTTESGKLISDWCCRSCTLPPLRFQTENGCWYGMEIRPTRHDEKTLVQSRVTAYKAEMIDPFQLGL
MVVFLATQEVLRRRWTAKISIPAIMLALLTLVFGGVTYTDLIRYINLVGAAFAEANSGGDVVxLALMA
TFKIQPVFLVASFLKARWTNQESILLMLAAAFFQMAYYDAKxxxxWEVPDVLNSLSIAWMILRAISFT
NTSNVATPLMALLTPGLKCLHLDIYRILLLMVGVGSLIKEKRSSAAKKKGACLICLALASTxxFNPMI
LAAGLITCDPNRKRxxxxxxxxxxxxxxxxxGGLAELDIDTMAIPMTIAGLMFVAYVITGRSTDMWI
ERTADITWESDAEITGTSDRVDVKLDDDGNFQLINDPGAPWKIWMLRMACLAVSAYTPWAILPSVIGF
WITLQxxxxxxxLWDTPSPREYKRGDTTTGVYRIMTRGILGSYQAGVGVMVEGVxxxxxxxxxGAALM
SGTGRLDPYWGSVREDRLCYGGPWKLQHKWNGHDEVQMIVAEPGRNTRNVQTKPGVFKTPDGEIGAVT
LDYPTGTSGSPIVDRSGDVIGLYGNGVIMPNGAYISAIVQGERMEEPAPAGFEPDTLRKKQISVLDLH
PGAGKTRKILPQIIKEAINKRLRTAILAPTRVVAAEMSEALRGLPxRYQTSAVTREHSGNEIVDVxxx
xxxxxxxxxxxVPNYNLFIMDEAHFTxxxxIAARGYIATRVELGEAAxxxxTATPPGSSDPFPESNA
PIxDMQTEIPDRAWNTGYEWITEYIGKTVWFVPSVRMGNEMAQCLQRAGKKVIQLNRKSYxxxxxxxx
NDDWDFVVTTDISEMGANFKANRVIDSRKSVKPTIIEEGDNRVILGEPSAITAASAAQRRGRIGRNSS
QAGDEYCxxxxTNEDDSNCAHWTEARxxLDNINMPNGLVAQLYQPEREKVYTMDGEYKLRGEERKNFL
EFLRTADLPVWLAYKVAAAGISYHDRKWCFDGPRTNTVLEENTEVEIVTKMGERKILRPRWADARVYS
DHQALKSFKDFAAGKRSQIGLVEVLGRMPEHFVVKTWEALDxxYVVATAEKGGRAHRTALEELPDALQ
TIALITLLSVMSLGVFCLLMQRKGVGKIGLGGTxLGAATLFCWMAEVSGTKIAGMLLLSLLMMIVLIP
ExxxxxxQTDNQLAVFLICVLTLVGTVAANEMGWLDKTKNDIxxxxxxxxxxxxxxxxESFLLDLKP
ATAWSLYAVSTAVMTPLLKHVITSDYINxxxxSINVQASALFTLSRGFPFVDVGVSALLLAVGCWEQV
TLTVTVTATALLLCHYAYMIPGWQAEAMRAAQRRTAAGIMKNVVIDGMVATDVPELERTTPVMQKKVG
QVMLILVSMAAVVVNPSVRTVREAGILTSAASVTLWENGAGSVWNATTAIGLCHVMREGWLSCLSITW
TLVKNMDKPVLKRGGAKxxTLGEVWKERLNHLTKEEFIRYRKEAITEVDRSAARxARREGNITGGHSV
SRGTAKxxxLVERRFLEPVGKVVDLGCGRGxxxxxxxxQKRVQEVKGYTKGGPxxxxxxxVQSYGWNT
VTMKSGVDVFYRPSEASDTLLCDIGESASSAEVEEHRTVRVLEMVEDWLHRGPKEFCIKVLCPYMPKV
IEKMETLQRRYGGGLIRNPLSRNxxHEMYWVSHASGNIVNSVSMTSQVLLGRMEKKTWKGPQFEEDAN
LGSGTRAVGRPLLNSDTGKIRNRIERLKKEYSSTWHxDANHPYRTWNYHGSYDVRPTGSASSxxxxxx
xxxSKPWDTIMNVTTMAMxxxxxxxxxxxxxxxDTKAPEPAEGVKxALNETTNWLWTFLARDKKPRM
CSREEFIGKVNSNAAxxxxFEEQNQWKNARAAVEDLKFWEMVDDEREAHLRGECNTCIYNMMxxxxxx

FIG. 58-3

```
PGEFGKARGSxxxxxxxxxxxxxxxxxxxxxEDHWLGRENSGGGVExxGLQKLGYILKEVGxxxGGK
MYADDTAGWDTRITKADLENEAKVLEFLEGEHRRLARSVIELTYRYKVVKVMRPAADGKTVMDIISRE
DQRxxxxVVTYALNTFTNLSFQLVRMMEGEGVVTPDDVEKLGKGKGVKVRVWLSENGKERLGRMAVSG
DxxxxxPLDDRFATALHFLNDMPKVRKDIQxxxxxVGWYDWQQVQFCSNHFTxxxxKDGRTLVTPCRG
QDELIGRARISPxxxxxxxxxxxxxxKSYAQMWQLLYFHRRxxxxxxxAICSAVPVSWVPTGRTTWSIH
AKGEWMTTEDMLAVWNKVWIEENExxEDKTPVERWSDIPYSGKRExxxxGSLIGTRTRATWAENIHVA
INQVRSVIGEEKYVDYMSSLRRYEDTxxxxxxxx >WNV|peptide_length:8|string3 xxxxxxxxxKNRAVNMQKRGTPRVGSLIGLKRAVLSLIDGRGPTRFVLALLAFFKFTAIAPTRAVLDR
WRSVNKQTAMxxxxSFKRELGILTNAMNRRSLKQKKRGGSIGxxxxxxxxxxxGAVTLSNFQGKVMMT
INATETTxIITIPTASGKNLCTVRAMDVGFMCDDTIAYECPALMEGNDPEDIDCWCTKLAVFVRYGRC
TRTRQSRRSRRSLTVQTHGESTLSNRKGAWLDSTKASRxxxxxxxxxxxxxxxxxxxxxxxxxxxxT
TQRVVFMILLLLVAxxxxxxxxGMSSRDFLEGVSGATWMDxxxxxDSCVTIMSKNKPTIDVKMTNMEA
xxMGEVRSYCHLAxATEISSSAACPAMGEAHNEKRTDSxYVCRQGVVxxxxxxxxxxxxxxxxxxTCAK
FACTTKATGLTIQREBIKYEVAIxxxxPTTVESHRxxxxxxGATQAGRFSVSPAAPTHTxNLGEYGEV
TIDCEPRSGVDVDAFYVMSVGEKxxxxxxxxxxxNLPWSSAESNNWRNRETLVEFEEPHAxxxxxxx
xxxxxxxxxxxLAGAIPLSFTSNTVKLTxxxxxxRVKMEKLKLKxxxxGVCSKAFRFxNTPADTGHxx
xxLELQYTGKDGPCKIPITSVASxxxxxxxxxxxTVNPFVSVATANAKILVELExxxxxxxxxxxGRGE
QQISHHWHKSGxSIGKAFATTLQGAQRLVSxxxxxxxFGSVGGIFNSIGKAVHQVFGGAFRLxxxxxx
xxxxxxxxxLLVWMGISSRDKSIALTFLAIGGVLLFLSINVHADTGCAIDLKRQELRCGxxxFIHNDV
EAWIDRYRYHPETPQGLARVIHNAHQEGTCGLRSASRLEHQMWEAIKDELNTPFKENGIDLTVVVEKQ
SGLxxxAPRRLAATTENLEIGWKAxxxSIIFAPELANHTFVIDGPETKECPSxDRAWNSLExxxxxxx
LTSTRMFMKVRESNTTECDSKTIGTAIKNNLAIHxxxSYWIESRLNHTWKLERAxxxxxxxxxxxxH
TLWGEGVLESDLIIPITLAGPKSNHNKRxxxxxxxxxxWDEGRIEIDFDYCPGTTVTLRxRCGHRGPA
IRTTTESGxxxxxxxxxxxxTLPPLRYRTESGCWYGMEIRPLKHDEKTLVQSKVNAYKSDMIDPxQLGL
LVVFLATQEVLRRRWTAKISVPAIIIALLVLVLGGITYTDVLRYVILVGAAFMEAxxxxxxxxxxALMA
TFKIQPAFMVASFLKTKWTNHENILLMLxxVFFQMAYYDARxxxxWNMPDVLNSLAVAWMILRAIGFT
TTSNVVVPLLAFLTPGLKCLNLDVSKILLLMVGVGSLVKERRSAVAKKKGASLICLALAxxxxFSPLI
LAAGLMACDPNRKxxxxxxxxxxxxxxxxxxxxxxxLAELDMDSMAIPMxxAGLMFAAYVITGRxxxxxxI
ERTADISWEGDVEITGSSDRVDVRLDDDEDFQLMNDPxxPWKIWMLRMTCLAVSAYxxWAILPSIVGF
WITLxxxxxxxxxxxxTPSPREYRKGDTTTGxxxxxxxxxxxxxxxxxxxxxxxxxxxxxxxxxxxx
xxxxxxxxxxxxxxxxxxxxGGPWKLQRKWNGLDEVQMIVVEPGKNAKNVQTKPxxxxxxxxxxxxxx
xxxxxxxxxSPIVDKNSDVIGLxxxGVIMPSGSYISAIxxGERMDEPVPAGFDSEMLKKKQITVLxxx
xxxxxxxxKILPQIIREAINKRLRTAILxxxRVVASEMAEALRxxxxRYQTSAVHREHTGNEIVDVxxx
xxxxxxxxxxxxxxxxxxxxxxxxxxxxxxxxxARGYISTRVELGExxxxxxxxxxxxxGTSDPFPESNA
PVxDIQTEIPDRxxxxxYEWITEYVGKTVWFVxxxxxxxxxxxxxxxxxxQRAGKRVIQLNRKxxxxxxxxxx
xxxxxxxxxxxxxxxMGANFRASRVIDSxxSVKPTIITDGEARVVLGEPSAIxxxxxxxxRGRIGRNPT
QVGDEYxxxxxTNEDDSNLAHWTEARxxxxxxxxPNGLIAQLYQPEREKVYTMEGEYRxxxxxxxxxx
xxxxxxxxPVWLAYQVAAAGVPYHDRRWCxxxxRTNMILEDNNExxxxxxxxxxxKILRPRWVDARVYS
DHQALKLFKDFAAGRRSQIGLVEVIGRMPEHFMVKTWEALxxxxxVATADRGGRAHRSALEELPDALQ
TIVLIALLSVMTLGIFFLLMQRxxxGKIGLGGVxLGLATFFCWMADVPGTKIAxxxxxxxxxxxxxxxx
xxxxxxxxxxxxAMFLICVLTLVGTVAANEMGWLDRTKSDIxxxxxxxxxxxxxxxxxxESLLLDLKP
AxAWSLYAVATAFLTPLLKHVxxxxxxxxxxxxNVQASALYSLARGFPFxxxxISSLLLAVxxxxxxx
xLTVTVTSATLLLCHYAxxxxxxxxxxxxxxxxGIMKNAVIDGMVAxxxxELERATPMMQKKVG
QIMLILVSTAALVVNPSVKxVREAGILVTAAAVTLxxxxxxxxxxxxxxxxxxxxxWLSCLSMTW
TLIKNMGKPGLKRGxxxxxxLGEVWKDRLNRMTKEEFTRYRREAITEVDRSAAQxARKERNVTGGYPV
SRGTAxxxxxxERRFLDPIGKVVDLGxxxxxxxxxxxxxxxxxxxxxxxxxxxxxxxxxxxxxxxxxx
xxxxxxxxVYYRASESCDTLLCDxxxxxxxxEVEEHRTLRVLEMVExxxxRGPKEFCVKVLxxxxxKV
```

FIG. 58-4

```
IEKMEVLQRRYGGxxxxxxxxxxxxxxxxYWVSRASGNIVHAVNMTSQVxxxxxxEKKTWKGPHYEEDAN
LGxxxxxxxxxPLLNSDTRKIKSRVERLKKEYGSTWHxDDNHPYRTWxYHGSYEVNPLVSASSxxxxxx
xxxxKPWDTITSVTTMxxxxxxxxxxxxxxxxxxxxAPEPPEGAKxxxxxTTNWLWAFLSRNKRPRM
CSREEFIKKVNSNAAxxxxFEEQNQWKSAREAVEDPKFWEIVDEEREAHLRGECYTCIYNMMxxxxxx
xxxxxxxxxxxxxxxxxxxxxxxxxxxxxxxxxxxxxxxxxxxxxxxxxxxxxQKLGYVLREVGxxxGGR
VYADDTAGWDTPITKADLExxxKVLELLEGEHRRLARSIIELTYCHKVVKVMRPAVGGKTVMDIISxx
xxxxxxxxxxxxLNPFSNLAVQLVRRREGEGVIGPYDVEKLEKRKGPKVRTWLSENGEERLGRMAxxx
xxxxxxxLDDRFASSLHFLNAMSQVRKDxxxxxxxxxxxxxxxxxxxxxxxxxxxxxxxxxxxxxxx
xxxxxxxxxxxxxxxxxxxxxxxxxxxxxxxxxxxxxxxxxxxxICSAVPADWVPTGRTTWSIH
ARGEWMTTADMLGVWNRVWIxxxxxxxxxxPVERWSDIPYSxxxxxxxxGSLIGTRSRATWAENxQVA
IGQVRSIIGEEKYVDYMGSLKRYEEPxxxxxxxx >WNV|peptide_length:8|string4 xxxxxxxxxxxxxVNMLKRGKPRGGSLMGLKxxxxxLIDGKGPVRFVLxxxVFFRFTAIxxxxAVLNR
WRGVNKxxxxxxxxxxxxKELGTLTNAMSRRSAKQKKRGGVVGxxxxxxxxxxxxGAVTLSDFQGKVIMT
INATDTTxAITIPTAAGKNLCTVRAMDVGHMCDDTITYECSVLSAGNDxxxxDCWCTKLPVYVRYGRx
xxxxxxxxxxxxxxxxxTHGKSTLSNKKGAWMxxxxxxxxxxxxxxxxxxxxxxxxxxxxxxxxxxT
MQRVVFAVLLLLVAxxxxxxxxxxxxxxxxxxxxxxxxxxxxxCVTIMSKNKPTIDVKMMNVEA
xxLAGVRDYCYLAxVSELSTKAACPAMxxxHNDKRADSxYFCKQGVVxxxxxxxxxxxxxxxxCAR
FTCSNKATGLTIQRExxxxxxxxxxxxxxxxxxxxxxxxxxxxGAAQAGRLTITPAAPSHTxKLGDYGEV
TIDxxxxxxxxTSAYYVMTVGAKxxxxxxxxxxxxxxxxLPWSSAAGTVWRNRETFMEFEExxxxxxxxx
xxxxxxxxxxLAGTIPVEFSSxxxxxxxxxxxxxxxxxxxxxxxxxxxxxxxxxxxxxxxxxxxx
xxxxxxxxxxxxxxxxxxxxxxxxxxxxxxxxxxxxxxxxVNPFVSMSTADAKVLIELxxxxxxxxxxxxxx
HQINHHWHxxxxxxxKAFTATLKGAQRxxxxxxxxxxxxGSVGGVFTSVGQAIHQVxxxxxxxxxxxx
xxxxxxxxLLWMGVNSRDRSIALxxxxxxxVLLFLSINxxxxTGCAIDVGRQELRCxxxxxxxNDV
EAWTDRYKFHPETPQGLAKVIQKAHAEGVCGLRSASxxEHQMWESIKDELNTxxKENGVDLSMVVEKQ
GGMxxxAPRRLTATTEKFEIGWKxxxxSILFAPEIANNTFVVDGSETRECPTxSRAWNSMExxxxxxx
xMTTRMFLKIREGNTTECDSKIIGTAIxxxxxxxxxxSYWIESGLNHTWKLExxxxxxxxxxxxxxxH
TLWGEGVVESELIIPVTLAGPKSxxxxxxxxxxxxxxxxxxxxxxxxxxxxxxxxxxxxxxNCEHRGPS
ARTTTESxxxxxxxxxxxxxTLPPLRFQTDNGCWYGMEIRPLKHDERTLVQSRVNAYNAEMIxxxxxxGL
LIVFLATQExxxxRWTAKISLPAILIALLVLVFGGVTYADVLRYIILVGxxxxxxxxxxxxxxxxxxA
TFRVQPVFMVASFLKARWTNHENIxxxxxxAFFQMAYIDSQxxxxWEMPDVLNSLAIAWMILRAITFT
STSNVVVxxxxxxxxxxxxxxxxNLDVYRILLLMIGIGSLIKERRNAAAKKKGxxxxxxxxxxxxxxxMI
LVAGLLACDPNRKxxxxxxxxxxxxxxxxxxxxxLDIDTMAIPMxxxxxxxxxxxxxxxxxxxxx
xxVADISWENDAEITGSxxxxxxxxxxxGGNFQLMSDxxxxxxxxWILRMACLAVSAYxxxxxxxxxxx
xxxxxxxxxxxxxxxxxxxTPSPKEYEKGDTTTGxxxxxxxxxxxxxxxxxxxxxxxxxxxxxxxx
xxxxxxxxxxxxxxxxxxxxxGPWKLQHRWNGQDEVxxxVAKPGRKTRNVQTKxxxxxxxxxxxxxxx
xxxxxxxxxxxxxxxxxxxxxxxxxxxxxxxxxxxGERMDEPIPVGFEPETLKKKQxxxxxxxxx
xxxxxxxxxQIIKEAMSKRLRTAIxxxxxVVAAEMADALxxxxxRYQTSAVAREHxxxxxxxxxxxx
xxxxxxxxxxxxxxxxxxxxxxxxxxxxxxxAGGYISTRVELGDxxxxxxxxxxxxxxxxxxxxx
xxxxxxxxxxxxxxxxxxxxxxxxYEWITEFVGKTVWFxxxxxxxxxxxxxxxxxxxxxxxxxxxx
xxxxxxxxxxxxxxxxxxxxxxxxxxxxxxVKPTSITEGESRVVLGEPxxxxxxxxxxxxxGRVGRNPS
QVxxxxxxxxxxTNEDDSNYAHWTEARxxxxxxxxxxxxxxxxxxxxxxxxCTMDGEYRxxxxxxxxx
xxxxxxxxxWLAYKVASAGISYHDRRWxxxxxxxxxxxxxxxxxxxxxxxxxxxxxxxxxWIDARVYL
DxxxxxxxxxxASGKRSQIGFIEVLGRMPEHFMVxxxxxxxxxxxxxxxxxxEKGGRAHRSALxxxxxxLQ
TIALIALLSVMSMGIFFLLMxxxxxxGKIGLGGIxLGVATLFCWMxxxxxxxxxxxxxxxxxxxxx
xxxxxxxxxxxxxxFMICVLTFISAVAANxxxxLDKTKSDVxxxxxxxxxxxxxxxxxxxxxEDLLLDLKP
xxxxxLYAVSTAVLTPLIKHLxxxxxxxxxxASTLFTLARGxxxxxxxxxxxxxxxxxxxxxxxxx
xxxxxxxxxVLLFCHYAxxxxxxxxxxxxxxxxxxxxxxxxxxxxxxxxxxxxxxxxxxxxxIG
```

FIG. 58-5

```
QIILILVSLAALVVNPxxxxxxEAGILTSAAAVTLxxxxxxxxxxxxxxxxxxxxxxxxxWLSCLSIMW
TLIKSLEKPVLKRGxxxxxxxxxVWKERLNYMSKEEFSRYRKEAIxEVDRSTAKxARREGNVTGGHSx
xxxxxxxxxxxxxxVEPIGKVIDLGxxxxxxxxxxxxxxxxxxxxxxxxxxxxxxxxxxxxxxxxxx
xxxxxxxxVFYRPSESCDTLxxxxxxxxxxxxxxxRTMRVLEMVExxxxxxxxxxxxxxxxxxxxxKV
IEKMEILQRRYGGxxxxxxxxxxxxxxxYWVSQASGNIVHAVNMTxxxxxxxxxxKTWKGAQYEEDAN
LxxxxxxxxxxLLNSDTSKIKNRIEKLKREYSLTWHxDGNHPYRTWxYHGSYDVNPTGSAxxxxxxxx
xxxxxxxxxxxxxxxxxxxxxxxxxxxxxxxxxxxxPEPPEGVRxxxxxxxNWLWAYLARGKRPRM
CTREEFISKVNSNAAxxxxxEEQNQWSNAREAVEDSTFWEMVDxxxxxxxxxxxxxxxxxxxxxxxx
xxxxxxxxxxxxxxxxxxxxxxxxxxxxxxxxxxxxxxxxxxxxxxxxxxxxxxxxxxxxxxxxGGK
IFADDTAGxxxxxxxxxxxxxxxxxxxxxxxxxxxxxxxxAIIQLTYRHxxxxxxxxxxADRKTVMDVIxxx
xxxxxxxxxxxxxxxxxxxxxxxxxxxxxxGEGVIGPDDVERLGRGKGPKVRxxxxxxxxxxxxxxx
xxxxxxxxxxxxxxTSLHFLNDxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxICSAVPVDWVPTGRTTWSIH
VRGEWMTTEDMLSVWNRVWIxxxxxxxxxxxxxxxxxxxxxxxxxxxxxxxxxxxxxxxxxxxxxxx
xxxxxxxxxxxxxxxxxGSLRRYEDAxxxxxxxx >WNV|peptide_length:8|string5 xxxxxxxxxxxxxVNMLKRGKPRGGSLxxxxxxxxxxxxxxxxxxxxxxxxxxxxxxxxxxxxxxxx
xxxxxxxxxxxxxxxxxxxKELGTLTNxxNRRSEKKKKRGGSIxxxxxxxxxxxxxRAVTLSNFxxxxxxxT
VNATDVAxIITIPPAAxxxxxxxxxxxxxxFMCDDTITxxxxxxxxxxxxxxxxxCWCTKAAVxxxxxxx
xxxxxxxxxxxxxxxxTHGKSTLAxxxxxxxxxxxxxxxxxxxxxxxxxxxxxxxxxxxxxxxxxxx
MQRVVFIVLLLLVAxxxxxxxxxxxxxxxxxxxxxxxxxxxxxxxxxxxxxxxxxxxxxxxxxxxxx
xxLAEVRSYCHLxxVNELSTRAACxxxxxxxxxxxxxxxxxxxxxxxxxxxxxxxxxxxxxxxxxxx
xxxxxxxxxxxxxxxxxxxxxxxxxxxxxxxxxxxxxxxxxxxTQAGRFSVTPAAPSYxxxxxxxxxxx
xxxxxxxxxxxxTGAYYVMSVGSKxxxxxxxxxxxxxxPWSSAGGTAWRNRETLxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxNPFVAAATADAKVLIxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxTGCAIDVSRQELRCxxxxxxxxNDV
EVWMDRYKYHPETPQxxxxxxIQKAHESGTCGxxxxxxxEHQMWDSVKDELNxxxxxENGVDLTVVVEKQ
DGLxxxAPKRLKATTDKLEIGWxxxxxxxxxxxxLANSTFVVDGPETEECPSxxxxxxxxxxxxxxxx
xxxxxxxxxVRKVNTTECDAxxxxxxxxxxxxxxxxxxxxxxxxxFNETWKLExxxxxxxxxxxxxxx
TLWGDGVIESELIIxxxxxxxxxxxxxxxxxxxxxxxxxxxxxxxxxxxxxxxxxxxxxCGHRGPS
ARxxxxxxxxxxxxxxxxxxxxxxxPPLRFKTExxxxxxxxxIRPQKHDERTLxxxRVSAYKSDxxxxxxxxx
LVVVLATQxxxxxxxxxxxxxxxPAILLALLVLVxxxxxxTDVLRYVNxxxxxxxxxxxxxxxxxxx
xxxxxxxxVVATFVKARWTNQENTxxxxxxAFFQMAYHxxxxxxxxWGIPDVLNSxxxxxxxxxxxxxxx
xxxxxxxxxxxxxxxxxxxxxxxxxxxxxxxxxVGIGSLIKEKKNSAAKKxxxxxxxxxxxxxxxxIT
LAAGLVACDPNRKxxxxxxxxxxxxxxxxxxxxxxxxxxxxxxxxxxxxxxxxxxxxxxxxxxxxxx
xxTADISWESDVEITGSxxxxxxxxxxxxxxxxxxxxxxxxxxWMLRMFCLAISAYxxxxxxxxxxxx
xxxxxxxxxxxxxxxxTPSPKEYEKGDTTxxxxxxxxxxxxxxxxxxxxxxxxxxxxxxxxxxxxxxx
xxxxxxxxxxxxxxxxxxxxxxxxxLGCKWNGQDExxxxxxxxxxxxxxxxxxxxxxxxxxxxxxxxx
xxxxxxxxxxxxxxxxxxxxxxxxxxxxxxxxxxxxxxxxxxxxxRMEEPVPSGFxxxxxxxxxxxxxx
xxxxxxxxxxxxIIKEAIDRRLRTAVxxxxxxxxxxxxxxxxxRYQTSAVNRExxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxITDGESRVVLGExxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxHKVASAGISxxxxxxxxxxxxxxxxxxxxxxxxxxxxxxxxxxxxxxxxx
xxxxxxxxxxxxxxxxxxxKRSQMGLIEVLGxxxxxxxxxxxxxxxxxxxxxxxxxxxxxxxxxxxxx
```

FIG. 58-6

```
xxxxxxxLSVMTMGVFLLLxxxxxxxSKIGLAGVxLAVATFFCxxxxxxxxxxxxxxxxxxxxxxxxx
xxxxxxxxxxxxxxxxxICVMTLVGxxxxxxxxxxxxxxxxxxxxxxxxxxxxxxxxxANFLLDLRP
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxMLIWVSLAAVVxxxxxxxxxxxxxxxxxxxxxxxxxxxxxxxxxxxxxxxxxxxxxxxxxxSIAW
TLIKNMEKPVLKRxxxxxxxxxxxAWKEKLNQMTKEEFARxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxVFYRTSEASDTLxxxxxxxxxxxxxxxxxxxxxxxxxxxxxxxxxxxxxxxxxxxxRV
IEKMETxxxxxxxxxxxxxxxxxxxxxxxxxVSRASSNVVHSxxxxxxxxxxxxxxKTWKGPQYEEDVS
xxxxxxxxxxxxxSSDTSKINNRIERLKREYGSTWHxDSNHPYRTWxxxxxxxxxxxxxxxxxxxxx
xxxxxxxxxxxxxxxxxxxxxxxxxxxxxxxxxxxxxxxxxxxxxxxxxxxxxxxxxxxxxRDKRPRL
CSREEFISKxxxxxxxxxxxxxxxxNQWRSARAAVExxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxGGK
IFADDTAxxxxxxxxxxxxxxxxxxxxxxxxxxxxxxxxxxxxxxxxxxxxxxxDGKTVMSLxxxx
xxxxxxxxxxxxxxxxxxxxxxxxxxxxxxxxxGVIGPEDVEKLTxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxDMLGVWNKxxxxxxxxxxxxxxxxxxxxxxxxxxxxxxxxxxxxxxxxxxxxxxxxxx
xxxxxxxxxxxxxxxxxSLKRYEDVxxxxxxxx
```

FIG. 58-7

\>WNV|peptide_length:9|string1

```
MSKKPGGPGKSRAVNM

FIG. 58-8

QDELVGRARISPGAGWNVRDTACLAKSYAQMWLLLYFHRRDLRLMANAICSAVPVNWVPTGRTTWSIH
AGGEWMTTEDMLEVWNRVWIEENEWMEDKTPVEKWSDVPYSGKREDIWCGSLIGTRARATWAENIQVA
INQVRAIIGDEKYVDYMSSLKRYEDxxxxxxxxx >WNV|peptide_length:9|string2 xxKKPGGPGKNRAVNMQKRGMPRGLSLTGLKRAMLSLIDGRGPTRFVLALLTFFKFTAIAPTRALLDR
WRGVRKQTAMKHLLSFKKELGALTNAMNRRSTKQKKRGGTAGFxxxxxxxxxxSALTLSNFQGKVMMT
VNATDITxIITIPTAAGKNLCTVRAMDVGYLCEDTITYECPVLAEGNDPEDIDCWCTKSSVFVRYGRC
TRTRNSRRSRRSLNVQVHGESSLANKKGAWLDSTKASRYLMKAESWILRNPGYALVAVVTGWMLGSNT
MQRVVFAILLLLVAPAxSFNCLGMSNRDFIEGASGATWMDLVLEGDSCVTIMAKDRPTIDVKMVTMGA
xxxxDVRSYCYLAxVSDLSTRAACPTMGEAHNEKRADPxFVCKQGVVDRGWxxxxxxxxxxxSIDTCAK
FACSTKATGWIIQRENVKYEVAAFVHGPTTVDTHSxxxxxxAAVQAGRFSITPSAPSYTxTLGDYGEV
TFDCEPRSGIDTSAYYVMSVGxKSFLVHREWFTDLNLPWSSPGNTxWRNREALVEFEEPHATKQSVVA
LGSQEGALHQALAGAIPVDYKNSVVKLSSGHLKCRVRMEKLKLKGTTYGVCAKAFRFxRTPADTGHGT
VVMELQYTGTDGPCKIPITSVASLNDLxxxGRLVTVNPYVSVATANSKILVELEPPFGDSYIVIGKGD
QQVTHHWYKSGSSIGKAFTTTLRGAQRLVSLGDTAWDFGSIGGVFTSVGKAIHQLFGGAFRLLFGGMS
WIxxxxxGALLLWMGINARDRSIAMTFLAIGGILLFLSANVHADTGCAIDIGRQELRCGNGVFIHNDV
EAWVDRYKFHPETPQGLAKIIHNAHxEGVCGVRSVSRLEHQMWESIKDELNTLLKENGVDLSIVVEKQ
xxxxxxxxxxxxATTEKLEMGWKAWGKSIIFAPELANNTFVIDGPETEECPTxNRAWNSMEVEDFGFG
LTSTRMFLRIRETNTTECDTKTIGTAVKNNMAVHSDLSYWIESGFNETWKLERAVxxxxxxxxxxPETH
TLWGDGVLESDLIIPITLAGLRSNHNRRPGYKTQSQGPWDEGRVELDFDYCPGTTVTISxxCGHRGPA
ARTTTESGKLISDWCCRSCTLPPLRFQTENGCWYGMEIRPTKHDEKTLVQSRVTAYNAEMIDPFQLGL
MVVFLVTKEVLRKRWTAKISIPAIMLALLTLVFGGVTYTDLIRYIILVGAAFAEANSGGDVVHLALMA
TFKIQPVFLVASFLKTRWTNQESILLMLAAAFFQMAYYDAKxxxxWEVPDVLNSLSIAWMILRAISFT
NTSNVATPLLALLTPGLKCLHLDIYRILLLMVGVGSLIKEKRSSAAKKKGACLICLALASTGxFNPMI
LAAGLITCDPNRKRGxxxxxxxxxxxxxxxxxVGGLAELDIDSMAVPMTIAGLMFVAYVITGRSTDMWI
ERTADITWESDAEITGTSDRVDVKLDDDGNFQLISDPGAPWKIWMLRMACLAVSAYTPWAILPSVIGF
WITLQYxxxxxVLWDTPSPREYKRGDTTTGVYRIMTRGILGSYQAGVGVMVEGVFxxxxxxxxKGAALM
SGTGRLDPYWGSVREDRLCYGGPWKLQHKWNGHDEVQMIVAEPGRNTRNVQTKPGVFKTPDGEIGAVT
LDYPTGTSGSPIVDRSGDVIGLYGNGVIMPNGAYISAIVQGERMEEPAPAGFEPDTLKKKKISVLDLH
PGAGKTRKILPQIIKEAINKRLRTAILAPTRVVAAEMSEALRGLPIRYQTSAVHREHSGNEIVDVMxx
xxxxxxxxxxxRVPNYNLFIMDEAHFTDxxSIAARGYIATRVELGEAAAxxMTATPPGTSDPFPESNA
PIxDMQTEIPDRAWNTGYEWITEYIGKTVWFVPSVRMGNEMAQCLQRAGKKVIQLNRKSYExxxxxxK
NDDWDFVVTTDISEMGANFKANRVIDSRKSVKPTIIEEGDNRVILGEPSAITAASAAQRRGRIGRNSS
QAGDEYCYxxHTNEDDSNYAHWTEARIMPDNINMPNGLVAQLYQPEREKVYTMDGEYKLRGEERKNFL
EFLRTADLPVWLAYKVAAAGISYHDRKWCFDGPRTNTVLEENTEVEIVTKMGERKILRPRWADARVYS
DHQALKSFKDFAAGKRSQIGLVEVLGRMPEHFVVKTWEALDTMYVVATAEKGGRAHRTALEELPDALQ
TIALITLLSVMSLGVFCLLMQRKGIGKIGLGGTxLGAATFFCWMAEVSGTKIAGMLLLSLLMMIVLIP
EPxxxxSQTDNQLAVFLICVLTLVGTVAANEMGWLDKTKNDIxxxxxxxxxxxxxxxxxxESFLLDLKP
ATAWSLYAVSTAVMTPLLKHVITSDYINTxxTSINVQASALFTLSRGFPFVDVGVSALLLAVGCWGQV
TLTVTVTSAALLLCHYAYMIPGWQAEAMRAAQRRTAAGIMKNAVIDGMVATDVPELERTTPVMQKKVG
QVMLILVSMAAVVVNPSVRTVREAGILTSSAAVTLWENGAGSVWNATTAIGLCHVMRGGWLSCLSMTW
TLxKNMDKPVLKRGGAKGRTLGEVWKERLNHLTKEEFTRYRKEAITEVDRSAAKxARREGNITGGHSV
SRGTAKLxWLVERRFLEPVGKVVDLGCGRGGxxxxxxTQKRVQEVKGYTKGGPGxxxxxLVQSYGWNT
VTMKSGVDVFYRPSEASDTLLCDIGESASSAEVEEHRTVRVLEMVEDWLHRGPKEFCIKVLCPYMPKV
IEKMETLQRRYGGGLIRNPLSRNSTHEMYWVSHASGNIVNSVSMTSQVLLGRMEKKTWKGPQFEEDAN
LGSGTRAVGKPLLNSDTGKIRNRIERLKKEYSxxxxxDANHPYRTWNYHGSYDVRPTGSASSLxxxxxx
xxLSKPWDTITSVTTMAMTxxxxxxxxxxxxxxxVDTKAPEPAEGVKxVLNETTNWLWTFLARDKKPRM
CSREEFIGKVNSNAALxxMFEEQNQWKNARAAVEDPKFWEMVDDEREAHLRGECNTCIYNMMGxxxxK

FIG. 58-9

PGEFGKARGSRxxxxxxxxxxxxxxxxxxxxNEDHWLGRENSGGGVEGLGLQKLGYILKEVGxxxGGK
MYADDTAGWDTRITKADLENEAKVLEFLEGEHRRLARSVIELTYCHKVVKVMRPAADGKTVMDIISRE
DQRGxxQVVTYALNTFTNLSFQLGRMMEGEGVVGPDDVExxxKGKGVKVRVWLSENGKERLGRMAVSG
DDxxxKPLDDRFATALHFLNDMSQVRKDIQExxxSVGWYDWQQVQFCSNHFTExxMKDGRTLVTPCRG
QDELIGRARISPGxxxxxxxxxxxAKSYAQMWQLLYFHRRDxxxxxNAICSAVPVSWVPTGRTTWSIH
AKGEWMTTEDMLAVWNKVWIEENEWMEDKTPVERWSDIPYSGKREDxxCGSLIGTRTRATWAENIHVA
INQVRSVIGEEKYVDYMSSLRRYEDxxxxxxxxx >WNV|peptide_length:9|string3 xxxxxxxxGKNRAVNMQKRGTPRVMSLIGLKRAVLSLIDGRGPIRFVLALLAFFKFTAIAPTRAVLDR
WRSVNKQTAMKxxTSFKKELGALTNAMNRRSLKQKKRGGNTGIxxxxxxxxxxGAVVLSNFQGKLIMT
INATDTTxIITIPTASGKNLCIIRAMDVGFMCDDTIAYECPALMEGNDPEDIDCWCTKLAVFVRYGRC
TKTRHSRRSKRSLTVQTHGESTLSNRKGAWLDSTKASRYxxxxxxxxxxxxxxxxxxxxxxxxxxNT
TQRVVFMILLLLVAPxxxxxxLGMSSRDFLEGVSGATWMDLxxxGDSCVTITAKDRPTIDVKMTNMEA
xxxxEVRSYCYAAxATEISSSAACPAMGEAHNEKRTDSxYVCRQGVVDxxxxxxxxxxxxxxxDTCAK
FACTTKATGLTIQREBIKYEVAIFxxGPTTVESHRxxxxxxGAAQAGRFSVSPAAPTHTxNLGDYGEV
TIDCEPRSGVDVDAFYVMTVGxxxxxxxxxxxxxLNLPWSSAESNxWRNRETLVEFEEAHATKQSVVx
xxxxxxxxxALAGAIPLSFSSNTVTLTSxxxxCRVKMEKLKLKGxxYGVCSKAFRFxNTPADTGHGx
xVLELQYTGKDGPCKIPISSVASLxxxxxxxxxxVTVNPFVSVSTANAKILVELEPxxxxxxxxxVGRGE
QQINHHWYKSGSSIGKAFATTLQGAQRLVSLxxxxxDFGSVGGVFNSIGKAVHQVFGGAFRLLxxxxx
xxxxxxxxALLLWMGINSRDRSIALTFLAVGGVLLFLSVSVHADTGCAIDLKRQELRCGSxVFIHNDV
EAWIDRYRYHPETPQGLARIIQKAHxEGICGIRSVSRLEHQMWEAVKDELNTLLKENGIDLTVVVEKQ
xxxxxxxxxxxATTENLEIGWKAWxKSIIFAPELANHTFVIDGPETKECPSxDRAWNSLEVxxxxxxG
LTSTRMFMKIRESNTTECDSKTIGTAIKNNLAIHSxLSYWIESRLNHTWKLERAVxxxxxxxxxxxxTH
TLWGEGVQESDLIIPITLAGPRSNHNKRPGYKTQNxxPWDEGRIEIDFDYCPGTTVTVSxxCGHRGPA
IRTTTESGKxxxxxxxxxxCTLPPLRYRTESGCWYGMEIRPLRHDEKTLVQSKVSAHNADMIDPFQLGL
LVVFLATKEVLRKRWTAKISVPAIIIALAVLVLGGITYIDVLRYVILVGAAFMEANxxxxxxxLALMA
TFKIQPAFMVASFLKAKWTNHENILLMLAAVFFQMAYYDARxxxxWNIPDVLNSLAAAWMILRAIGFT
TTSNVVVPAMAFLTPGLKCLNLDVYKIVLLMVGVGSLVKERRSAVAKKKGASLICLALASxxxFSPLI
LAAGLMACDPNRKRxxxxxxxxxxxxxxxxxxxxGLAELDVDSMAIPMTIAGLMFAAYVITGRSxxxWI
ERTADISWEGDVEITGSSERVDVRLDDGGNFQLMSDPGAPWKLWMLRMTCLAVSAYTPWAVLPSVVGF
WISLQxxxxxxxxxxDTPSPREYRKGDTTTGVxxxxxxxxLLGNYQAGVxxxxxxxxxxxxxxxxxxxx
xxxxxxxxxxxxxxxxxxxxxYGGPWKLQRKWNGLDEVQMIVVEPGKNAKNVQTKPGxxxxxxxxxxx
xxxxxxxxGSPIVDKNSDVIGLYxNGVIMPSGSYISAIVQGERMDEPVPAGFDSEMLRKKQISVLDxx
xxxxxxRKILPQIIREAINKRLRTAILAxTRVVASEMAEALRGxxIRYQTSAVTREHTGNEIVDVMxx
xxxxxxxxxxxxxxxxxxxxxxxxxxxxxxAARGYISTRVELGEAxxxxxxxxxxPGTHDPFPESNA
PVxDIQTEIPDRAxxxGYEWITEYVGKTVWFVPxxxxxxxxxLCLQRAGKRVIQLNRKSxxxxxxxxx
xxxxxxxxxxxEMGANFRASRVIDSRKSVKPTIITDGEGKVVLGEPSAITxxxxxxRRGRTGRNPS
QAGDEYCxxxHTNEDDSNCAHWTEARIxxxxxxMPNGLIAQLYQPEREKVYTMEGEYRLxxxxxxxxx
xxxxxxLPVWLAYQVAAAGIPYHDRRWCFxxPRTNMILEDNNEVxxxxxxxxRKILRPRWVDARVYS
DHQALKLFKDFASGRRSQIGLVEVIGRMPEHFMVKTWEALDxxxVVATAEKGGRAHRSALEELPDALQ
TIVLIALLSVMTLGVFLLLMQRKxIGKIGLGGVxLGLATFFCWMADVPGTKIAGxxxxxxxxxxxxxx
xxxxxxxxxxxLAMFLICVMTLVGTVAANEMGWLDRTKSDIxxxxxxxxxxxxxxxxxxESLLLDLKP
ATAWSLYAIATAFLTPLIKHLIxxxxxxxxxxxINVQASALYSLARGPFVxxGISALLLAAGxxxxx
TLTVTVTATTLLLCHYAYxxxxxxxxxxxxxxxxAGIMKNVVVDGIVATxxPELERATPIMQKKVG
QIMLILVSTAALVVNPSVKTVREAGILVTAAVTLWxxxxxxxxxxxxxxxxxxxxxxxGGWLSCLSIMW
TLxKNMGKPGLKRGGxxxxTLGEVWKDRLNRMTKEEFIRYRKEAIIEVDRSAARxARKERNVTGGYPV
SRGTAKxxxxVERKFLDPIGKVVDLGCxxxxxxxxxxxxxxxxxxxxxxxxxxxxxxxxxxxxxxxx
xxxxxxxDVYYRASEVSDTLLCDIxxxxxxxAEVEEHRTLRVLEMVEDxxHRGPKEFCVKVLCxxxPKV

FIG. 58-10

```
IEKMEVLQRRYGGGxxxxxxxxxxxxxMYWVSRASGNIVHAVNMTSQVLxxxMEKKTWKGPQYEEDAN
LGSxxxxxxKPLLNSDTSRIKSRIEKLKKEYGxxxxxDDNHPYRTWNYHGSYEVNPLVSASSLxxxxx
xxxSKPWDVITNVTTMAxxxxxxxxxxxxxxxxxxxKAPEPPEGVRxxxKETTNWLWSHLERNKRPRM
CSREEFISKVNSNAALxxMFEEQNQWKSAREAVEDLKFWEIVDEEREAHLRGECYTCIYNMMGxxxxx
xxxxxxxxxxxxxxxxxxxxxxxxxxxxxxxxxxxxxxxxxxxxxxxxxLQKLGYVLREVGxxxGGK
VYADDTAGWDTPITKADLENxAKVLELLDREHRRLARSIIQLTYRYKVVKVMRPAVGGKTVMDIISRx
xxxxxxxxxxALNPFSNLAVQLVRRREGEGVIGPYDVExxxKRKGPKVRTWLFENGEERLGRMAVxx
xxxxxxPLDDRFATSLHFLNAMSQVRKDIxxxxxxxxxxxxxxxxxxxxxxxxxxxxxxxxxxxxxx
xxxxxxxxxxxxxxxxxxxxxxxxxxxxxxxxxxxxxxxxxxxxxxxxxAICSAVPADWVPTGRTTWSIH
ARGEWMTTADMLGVWNRVWIExxxxxxxxTPVERWSDIPYSGxxxxxxCGSLIGTRSRATWAENIQVA
INQVRSIIGEEKYVDYMGSLKRYEExxxxxxxxx >WNV|peptide_length:9|string4 xxxxxxxxxxxxAVNMLKRGKPRGGSLMGLKRxxxSLIDGKGPVRFVLALLVFFRFTAVAPTRALLNR
WRGVNKQxxxxxxxxxxKRELGILTNAINRRSSKEKKRGGSIGVxxxxxxxxxxRAVTLSDFQGKLMMT
INATETTxVITIPPAAGKNLCTVRAMDVGHMCDDTITYECSVLSAGNDPxxVDCWCTKSAMYVRYGRC
xKTRQSRRSRxxxxxQTHGKSTLSNKKGAWMDxxxxxxxxxxxxxxxxxxxxxxxxxxxxxxxxxxNT
MQRVVFAVLLLLVAPxxxxxxxxxxxxxxxxxxxxxxxxxxxxxSCVTLMSKDKPTIDVKMMKMEA
xxxxEVRSYCHLAxVSELSPKAACPTMGDAHNDKRADSxYFCKQGVVDxxxxxxxxxxxxxxxxTCAK
FTCSNKATGLTIQRENxxxxxxxxxxxxxxxxxxxxxxxxxGATQAGRLSITPAAPSHTxKLGGYGEV
TVDCxxxxxxDTSAYYVMTVGxxxxxxxxxxxxxxNLPWSSAGGTxWRNRGTLMEFEEPxxxxxxxxxx
xxxxxxxxxxALAGAIPVSFTSNTVKxxxxxxxxxxxxxxxxxxxxxxxxxxxxxxxxxxxxxxxxx
xxxxxxxxxxxxxxxxxxxxxxxxxxxxxxxxxxxxxxxxTVNPFVSMAAADAKVLIELExxxxxxxxxxxxxxxE
HQINHHWHKSGIxxGKAFTATLKGAQRLxxxxxxxxxFGSVGGVLTSFGKAVHQVFxxxxxxxxxxx
xxxxxxxxxLLVWMGINSRDRSIALTFLAVGGVLLFLSINVxxDTGCAINVTRQELRCGSxxxxxNDV
EAWTDRYKFHPETPQGLARVIQKAHxSGVCGLRSASRLEHQMWESIKDELNTPFRENGVDLSMVVEKQ
xxxxxxxxxxxxATTEKFEIGWKAxxKSIMFAPEIANNTFVVDGSETRECPTxSRAWNSMEVxxxxxx
LMTTRMFLKVREGNTTECDSKIIGTAIKxxxxxxxxLSYWIESGFNETWKLERxxxxxxxxxxxxTH
TLWGEGVIESELIIPATLAGPRSNxxxxxxxxxxxxxxxxxxxxxxxxxxxxxxxxCEHRGAS
TRTTTDSGxxxxxxxxxxxCTLPPLRFQTDNGCWYGMEIRPLKHDGRTLVQSRVNAHNADMIDxxxLGL
LIVFLATQEVxxKRWTAKISLPAIMIALLVLVFGGVTYADVLRYVNLVGAxxxxxxxxxxxxxxMA
TFRVQPVFMVASFLRARWTNHENILxxxxAAFFQMAYIDSQxxxxWEMSDVLNSLAVAWMILRAITFT
STSNVVVPxLALLTPRLRCLNLDVYRILLLMIGIGSLIKERRNSAAKKKGAxxxxxxxxxxxxxxPMI
LVAGLLACDPNRKRxxxxxxxxxxxxxxxxxxxxxxxELDIDSMAVPMTxxxxxxxxxxxxxxxxxx
xRTADISWENDAEITGSSxxxxxxxxxDDGNFQLMSDPxxxxxxWILRMVCLAVSAYTxxxxxxxxxxx
xxxxxxxxxxxxxxxxDTPSPKVYRKGDTATGVxxxxxxxxxxxxxxxxxxxxxxxxxxxxxxxxxx
xxxxxxxxxxxxxxxxxxxxxxxxxxGGPWKLGHRWNGMDEVQxIVAKPGEKTRNVQTKPxxxxxxxxxx
xxxxxxxxxxxxxxxxxxxxxxxxxxxxxxxxxxxxxxxxxxQGERMDEPIPVGFEPETLKKKQITxxxxx
xxxxxxxxxxPQIIKEAMNRRLRTAILxxxRVVAAEMADALRxxxIRYQTSAVAREHxxxxxxxxxxx
xxxxxxxxxxxxxxxxxxxxxxxxxxxxxxxxxxxxAARGYISTRVELGDAxxxxxxxxxxxxxxxx
xxxxxxxxxxxxxGYEWITEFVGKTVWFVxxxxxxxxxxxxxxxxxxxxxxxxxxxxxxxxxxxxxx
xxxxxxxxxxxxxxxxxxxxxxxxxxxSVKPTSITDGEARVILGEPSxxxxxxxxxxRGRIGRNPT
QVGxxxxxxxHTNEDDSNLAHWTEARIxxxxxxxxxxxxxxxxxxxxxxxxVCTMDGEYRLxxxxxxxxx
xxxxxxxxVWLAYKAAAAGVPYHDRRWCxxxxxxxxxxxxxxxxxxxxxxxxxxRWIDARVYL
DHxxxxxxxxFASGKRSQIGFIEVLGRMPEHFMVKxxxxxxxxxxxxxxxxAERGRRAHRMALExxxxALQ
TVALITLLSVMTMGIFFLLMQxxxIGKIGLGGIxLGVATLFCWMAEVPxxxxxxxxxxxxxxxxxxx
xxxxxxxxxxxxxxxxxxVFMICVMTPVSAVAANExxWLDKTKSDVxxxxxxxxxxxxxxxxxxxxxxENFLLDLRP
AxxxSLYAVSTAVLTPLLKHVIxxxxxxxxxxxxxxxQASTLFTLARGFxxxxxxxxxxxxxxxxxxxx
xxxxxxxxxVLLFCHYAYxxxxxxxxxxxxxxxxxxxxxxxxxxxxxxxxxxxxxxxTTPMMQKKIG
```

FIG. 58-11

```
QIILILVSLAALVVNPSxxxVREAGILTSAAAVTLWxxxxxxxxxxxxxxxxxxxxxxGWLSCLSIAW
TLxKNMEKPVLKRGGxxxxxxxEVWKERLNYMTKEEFARYRKEAITEVDRAPAKxARKEGNVTGGHSV
xxxxxxxxxxxxxxxFVEPVGRVIDLGCxxxxxxxxxxxxxxxxxxxxxxxxxxxxxxxxxxxxxxx
xxxxxxxDVFYRTSEASDTLLxxxxxxxxxxxxxxHRTIRVLEIVEDxxxxxxxxxxxxxxxxxxPKV
IEKMEILQRRYGGGxxxxxxxxxxxxxxMYWVSQASGNIVHAVNMTSxxxxxxxxKKTWKGAHYEEDVN
LGxxxxxxxxRPLLNSDTSKINNRIERLKREYSxxxxxDGNHPYRTWNYHGSYEVNPLVSASxxxxxxx
xxxxxxxxxxxxxxxxxxxxxxxxxxxxxxxxAPEPPAGVKxxxxxxTNWLWAYLARGKRPRM
CTREEFIKKVNSNAALxxxFEEQNQWSSAREAVEDPKFWEIVDExxxxxxxxxxxxxxxxxxxxxxx
xxxxxxxxxxxxxxxxxxxxxxxxxxxxxxxxxxxxxxxxxxxxxxxxxxxxxxxxxxxxxxxxGGR
IFADDTAGWxxxxxxxxxxxxxxxxxxxxxxxxxxxxxxxxRAIIELTYRYKxxxxxxxxAADGKTVMSLISxx
xxxxxxxxxxxxxxxxxxxxxxxxxxxxxxxEGEGVIGPEDVExxxRGKGPKVRTxxxxxxxxxxxxxxx
xxxxxxxxxxxxASSLHFLNAMxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxAICSAVPVDWVPTGRTTWSIH
ARGEWMTTEDMLSVWNRVWIExxxxxxxxxxxxxxxxxxxxxxxxxxxxxxxxxxxxxxxxxQVA
IGQVRSxxxxxxxxxxxMSSLRRYEExxxxxxxxx >WNV|peptide_length:9|string5 xxxxxxxxxxxxAVNMQKRGKPRGGSLxxxxxxxxxxxxxxxxxxxxxxxxxxxxxxxxxxxVLER
WRGVNxxxxxxxxxxxxxKKELGILTNAxNRRSAKQKKRGGKTGSxxxxxxxxxxxGAVTLSDFQxxLMMT
VNATDVAxAITIPTAAGxxxxTVRAIDVGFMCDDTITYxxxxxxxxxxxxxxIDCWCTKLAMxxxxxxx
xxxxxxxxxxxxxxxxQTHGESTLVNKKGAWLDxxxxxxxxxxxxxxxxxxxxxxxxxxxxxxxxxx
MQRVVFIVLLLLVAPxxxxxxxxxxxxxxxxxxxxxxxxxxxxxxxxxxxxxxxxxxxxxxxxxxxx
xxxxGVRDYCYLAxVSDLSPRAACPxxxxxxxxxxxxxxxxxxxxxxxxxxxxxxxxxxxxxxxxxK
FACTSKATxxxxxxxxxxxxxxxxxxxxxxxxxxxxxxxxxATQAGRFSVSPSAPTYTxxxxxxxxx
xxxxxxxxxDTNAYYVMSVGxxxxxxxxxxxxxxxxLPWSSAGGNxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxVNPFVAAATADAKVLIExxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxSARDKSIAMTFLAVGGIxxxxxxxxxxxDTGCAIDITRQELRCGxxxxxxNDV
EVWMDRYKYHPETPQGxxxxxxxxxxxxxxxxxxxxxxxxxLEHQMWDSVKDELNTxxKENGIDLSMVVEKx
xxxxxxxxxxxATSEKLEIGWKxxxxxxxxxxxELANHTFVVDGPETEECPSxxxxxxxxxxxxxxxx
xxxxxxxxxVRKVNTTECDSKxxxxxxxxxxxxxxxxxxxxxxxLNHTWKLERxxxxxxxxxxxxxxxH
TLWGDGVVESDLIIPxxxxxxxxxxxxxxxxxxxxxxxxxxxxxxxxxxxxxxxxxxxxCGHRGPS
ARTxxxxxxxxxxxxxxxxxxLPPLRYTTExxxxxxxEIRPQRHDGKTLVxSRVNAHNADMxxxxxxxxL
LVVFLVTQExxxRRWTAKISMPAILLALLVLVFGGVTYTDVLRYIILxxxxxxxxxxxxxxxxxxxxx
xxxIQPVFVVASFLKARWTNQENTLxxxxAAFFQMAYHDxxxxxxWGISDVLNSLAxxxxxxxxxxxx
xxxxxxxxxxxxxxxxxxxxxxxxxxxVSRILLLMIGIGSLIKEKKNSAAKKKxxxxxxxxxxxxxxxPIT
LAAGLVACDPNRKRxxxxxxxxxxxxxxxxxxxxxxxxxxxxxxxxxxxxxxxxxxxxxxxxxxxxxx
xRVADISWESDVEITGSSxxxxxxxxxxxxxxxxxxxxxxxxxxxxWMLKMACLAVSAYTxxxxxxxxx
xxxxxxxxxxxxDTPSPKEYRKGDTATxxxxxxxxxxxxxxxxxxxxxxxxxxxxxxxxxxxxxxxxx
xxxxxxxxxxxxxxxxxxxxxxxxxxKLQHRWNGMDEVxxxxxxxxxxxxxxxxxxxxxxxxxxxxxxx
xxxxxxxxxxxxxxxxxxxxxxxxxxxxxxxxxERMEEPVPSGFEPEMLRKKKxxxxxxxx
xxxxxxxxxxxQIIKEAMSKRLRTAILxxxxxxxxxxxxxxxxxxIRYQTSAVNREHxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxITEGEGKVVLSEPxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxAYKVASAGISYxxxxxxxxxxxxxxxxxxxxxxxxxxxxxxxxxxxxxxxxxxxxx
xxxxxxxxxxxAGKRSQMGLIEVLGKxxxxxxxxxxxxxxxxxxxxxxxDKGGRAHRMxxxxxxxxx
```

FIG. 58-12 xxxxxxLLGVMTMGVFLLLMxxxxVSKIGLAGVxLAVATFFCWxxxxxxxxxxxxxxxxxxxxxxxxx
xxxxxxxxxxxxxxVFMICVMTLxxxxxxxxxxxxxxxxxxxxxxxxxxxxxxxxxxxxxGEFFLDLRP
AxxxxxxxxTTAFLTPLLKHLxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxMLILVSVAAVVVxxxxxxxxxxxxxxxxxxxxxxxxxxxxxxxxxxxxxxxxxxxxxxxxxxxxxxx
xxxKNLEKPGLKRGxxxxxxxxEVWKEKLNQMTKEEFTRYRREAIIEVDRSTAKxxxREGNVTGGHxx
xxxxxxxxxxxxxxxxxxxxxxxxxxxxxxxxxxxxxxxxxxxxxxxxxxxxxxxxxxxxxxxxxxxxx
xxxxxxxDVFYRPSEVSDTLLxxxxxxxxxxxxxxxxxxxxxxxxxxxxxxxxxxxxxxxxxxxxxPRV
VEKMEVLQRxxxxxxxxxxxxxxxxxxxWVSRASRNVVHxxxxxxxxxxxxxxKKTWKGPHYEEDVN
LxxxxxxxxxxxLNSDTRKIKNRIERLKKEYNxxxxxDSNHPYRTWNxxxxxxxxxxxxxxxxxxxxx
xxxxxxxxxxxxxxxxxxxxxxxxxxxxxxxxxxxxxxxxxxxxxxxxxxxxxxxxxxxxxxREKKPRL
CSREEFISKVxxxxxxxxxxxxQNQWRSAREAVEDSTFWEMVDExxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxGGK
TYADDTAGxxxxxxxxxxxxxxxxxxxxxxxxxxxxSIIQLTYRHxxxxxxxxxADRKTVMDVIxxx
xxxxxxxxxxxxxxxxxxxxxxxxxxxxxEGVITPDDVExxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
VGGEWMTTEDMLGVWNKVxxxxxxxxxxxxxxxxxxxxxxxxxxxxxxxxxxxxxxxxxxxxxxxxxxx
xxxxxxxxxxxxxxxxxxxxxxxxxxxxxxxxxx

FIG. 58-13

```
>WNV|peptide_length:10|string1

MSKKPGGPGKSRAVNMLKRGMPRVLSLIGLKRAMLSLIDGKGPIRFVLALLAFFRFTAIAPTRAVLDR
WRGVNKQTAMKHLLSFKKELGTLTSAINRRSSKQKKRGGKTGxxxxxxxxxxxGAVTLSNFQGKVMMT
VNATDxxxVITIPTAAGKNLCIVRAMDVGYMCDDTITYECPVLSAGNDPEDIDCWCTKSAVYVRYGRC
TKTRHSRRSRRSLTVQTHGESTLANKKGAWMDSTKATRYLVKTESWILRNPGYALVAAVIGWMLGSNT
MQRVVFVVLLLLVAPAYSFNCLGMSNRDFLEGVSGATWVDLVLEGDSCVTIMSKDKPTIDVKMMNMEA
xxxxxxxxxxxxxVSDLSTKAACPTMGEAHNDKRADPxFVCRQGVVDRGWGNGCGLFGKGSIDTCAK
FACSTKAIGRTILKENIKYEVAIFVHGPTTVESHGxxxxxxGATQAGRFSITPAAPSYTxKLGEYGEV
TVDCEPRSGIDTNAYYVMTVGxKTFLVHREWFMDLNLPWSSAGSTxWRNRETLMEFEEPHATKQSVIA
LGSQEGALHQALAGAIPVEFSSNTVKLTSGHLKCRVKMEKLQLKGTTYGVCSKAFKFxGTPADTGHGT
VVLELQYTGTDGPCKVPISSVASLNDLTPVGRLVTVNPFVSVATANAKVLIELEPPFGDSYIVVGRGE
QQINHHWHKSGSSIGKAFTTTLKGAQRLAALGDTAWDFGSVGGVFTSVGKAVHQVFGGAFRSLFGGMS
WITQGLLGALLLWMGINARDRSIALTFLAVGGVLLFLSVNVHADTGCAIDISRQELRCGSGVFIHNDV
EAWMDRYKYYPETPQGLAKIIQKAHxEGVCGLRSVSRLEHQMWEAVKDELNTLLKENGVDLSVVVEKQ
xxxxxxxxxxxxATTEKLEIGWKAWGKSILFAPELANNTFVVDGPETKECPTxNRAWNSLEVEDFGFG
LTSTRMFLKVRESNTTECDSKIIGTAVKNNLAIHSDLSYWIESRLNDTWKLERAVLGEVKSCTWPETH
TLWGDGILESDLIIPVTLAGPRSNHNRRPGYKTQNQGPWDEGRVEIDFDYCPGTTVTLSxxCGHRGPA
TRTTTESGKLITDWCCRSCTLPPLRYQTDSGCWYGMEIRPQRHDEKTLVQSQVNAYNADMIDPFQLGL
LVVFLATQEVLRKRWTAKISMPAILIALLVLVFGGITYTDVLRYVILVGAAFAESNSGGDVVHLALMA
TFKIQPVFMVASFLKARWTNQENILLMLAAVFFQMAYHDARxxxxWEIPDVLNSLAVAWMILRAITFT
TTSNVVVPLLALLTPGLRCLNLDVYRILLLMVGIGSLIREKRSAAAKKKGASLLCLALASTGxFNPMI
LAAGLIACDPNRKRGWPATEVMTAVGLMFAIVGGLAELDIDSMAIPMTIAGLMFAAFVISGKSTDMWI
ERTADISWESDAEITGSSERVDVRLDDDGNFQLMNDPGAPWKIWMLRMVCLAISAYTPWAILPSVVGF
WITLQYTKRGGVLWDTPSPKEYKKGDTTTGVYRIMTRGLLGSYQAGAGVMVEGVFHTLWHTTKGAALM
SGEGRLDPYWGSVKEDRLCYGGPWKLQHKWNGQDEVQMIVVEPGKNVKNVQTKPGVFKTPEGEIGAVT
LDFPTGTSGSPIVDKNGDVIGLYGNGVIMPNGSYISAIVQGERMDEPIPAGFEPEMLRKKQITVLDLH
PGAGKTRRILPQIIKEAINRRLRTAVLAPTRVVAAEMAEALRGLPIRYQTSAVPREHNGNEIVDVMCH
ATLTHRLMSPHRVPNYNLFVMDEAHFTDPASIAARGYISTKVELGEAAAIFMTATPPGTSDPFPESNS
PIxDLQTEIPDRAWNSGYEWITEYTGKTVWFVPSVKMGNEIALCLQRAGKKVVQLNRKSYETEYPKCK
NDDWDFVITTDISEMGANFKASRVIDSRKSVKPTIITEGEGRVILGEPSAVTAASAAQRRGRIGRNPS
QVGDEYCYGGHTNEDDSNFAHWTEARIMLDNINMPNGLIAQFYQPEREKVYTMDGEYRLRGEERKNFL
ELLRTADLPVWLAYKVAAAGVSYHDRRWCFDGPRTNTILEDNNEVEVITKLGERKILRPRWIDARVYS
DHQALKAFKDFASGKRSQIGLIEVLGKMPEHFMGKTWEALDTMYVVATAEKGGRAHRMALEELPDALQ
TIALIALLSVMTMGVFFLLMQRKGIKIGLGGAxLGVATFFCWMAEVPGTKIAGMLLLSLLLMIVLIP
EPEKQRSQTDNQLAVFLICVMTLVSAVAANEMGWLDKTKSDIxxxxxxxxxxxxxxxxxGEFLLDLRP
ATAWSLYAVTTAVLTPLLKHLITSDYINTSLTSINVQASALFTLARGFPFVDVGVSALLLAAGCWGQV
TLTVTVTAATLLFCHYAYMVPGWQAEAMRSAQRRTAAGIMKNAVVDGIVATDVPELERTTPIMQKKVG
QIMLILVSLAAVVVNPSVKTVREAGILITAAAVTLWENGASSVWNATTAIGLCHIMRGGWLSCLSITW
TLxKNMEKPGLKRGGAKGRTLGEVWKERLNQMTKEEFTRYRKEAIIEVDRSAAKxARKEGNVTGGHPV
SRGTAKLRWLVERRFLEPVGKVIDLGCGRGGWCYYMATQKRVQEVRGYTKGGPGHEEPQLVQSYGWNI
VTMKSGVDVFYRPSECCDTLLCDIGESSSSAEVEEHRTIRVLEMVEDWLHRGPREFCVKVLCPYMPKV
IEKMELLQRRYGGGLVRNPLSRNSTHEMYWVSRASGNVVHSVNMTSQVLLGRMEKRTWKGPQYEEDVN
LGSGTRAVGKPLLNSDTSKIKNRIERLRREYSxxxxxDENHPYRTWNYHGSYDVKPTGSASSLVNGVV
RLLSKPWDTITNVTTMAMTDTTPFGQQRVFKEKVDTKAPEPPEGVKxVLNETTNWLWAFLAREKRPRM
CSREEFIRKVNSNAALGAMFEEQNQWRSAREAVEDPKFWEMVDEEREAHLRGECHTCIYNMMGKREKK
PGEFGKAKGSRAIWFMWLGARFLEFEALGFLNEDHWLGRKNSGGGVEGLGLQKLGYILREVGxxxGGK
IYADDTAGWDTRITRADLENEAKVLELLDGEHRRLARAIIELTYRHKVVKVMRPAADGRTVMDVISRE
DQRGSGQVVTYALNTFTNLAVQLVRMMEGEGVIGPDDVExxxKGKGPKVRTWLFENGEERLSRMAVSG
DDCVVKPLDDRFATSLHFLNAMSKVRKDIQEWKPSTGWYDWQQVPFCSNHFTELIMKDGRTLVVPCRG
```

FIG. 58-14

QDELVGRARISPGAGWNVRDTACLAKSYAQMWLLLYFHRRDLRLMANAICSAVPVNWVPTGRTTWSIH
AGGEWMTTEDMLEVWNRVWIEENEWMEDKTPVEKWSDVPYSGKREDIWCGSLIGTRARATWAENIQVA
INQVRAIIGDEKYVDYMSSLKRYEDxx

>WNV|peptide_length:10|string2 xSKKPGGPGKNRAVNMQKRGMPRGLSLTGLKRAMLSLIDGRGPTRFVLALLTFFKFTAIAPTRALLDR
WRGVRKQTAMKHLLSFKKELGALTNAMNRRSTKQKKRGGTAGxxxxxxxxxxxSALTLSNFQGKVIMT
VNATDxxxIITIPTAAGKNLCTVRAMDVGYLCEDTITYECPVLAEGNDPEDIDCWCTKSSVFVRYGRC
TRTRNSRRSRRSLNVQVHGESTLANKKGAWLDSTKASRYLMKAESWILRNPGYALVAVVIGWMLGSNT
MQRVVFAILLLLVAPAYSFNCLGMSNRDFIEGASGATWMDLVLEGDSCVTIMAKDRPTIDVKMVTMGA
xxxxxxxxxxxxxxVSDLSTRAACPTMGEAHNEKRADPxFVCKQGVVDRGWGxxxxxxxxGSIDTCAK
FACSTKATGWIIQRENVKYEVAAFVHGPTTVDTHSxxxxxxAAVQAGRFSITPSAPSYTxTLGDYGEV
TFDCEPRSGIDTSAYYVMSVGxKSFLVHREWFMDLNLPWSSPGNTxWRNREALVEFEEPHATKQSVVA
LGSQEGALHQALAGAIPVDYKNSVVKLTSGHLKCRVRMEKLKLKGTTYGVCAKAFRFxRTPADTGHGT
VVMELQYTGTDGPCKIPITSVASLNDLTxVGRLVTVNPYVSVATANSKILVELEPPFGDSYIVIGKGD
QQVTHHWHKSGSSIGKAFTTTLRGAQRLVSLGDTAWDFGSIGGVFTSVGKAIHQLFGGAFRLLFGGMS
WITxxxLGALLLWMGINARDRSIAMTFLAVGGVLLFLSVSVHADTGCAIDIGRQELRCGNGVFIYNDV
EAWVDRYKFHPETPQGLAKIIHNAHxEGVCGVRSVSRLEHQMWESIKDELNTLLKENGVDLSIVVEKQ
xxxxxxxxxxxxATTEKLEMGWKAWGKSIIFAPELANNTFVIDGPETEECPTxNRAWNSMEVEDFGFG
LTSTRMFLRIRETNTTECDTKIIGTAVKNNMAVHSDLSYWIESGFNETWKLERAVLxxxxxxxWPETH
TLWGDGVLESDLIIPITLAGLKSNHNRRPGYKTQSQGPWDEGRVELDFDYCPGTTVTISxxCGHRGPA
ARTTTESGKLISDWCCRSCTLPPLRFQTENGCWYGMEIRPTKHDEKTLVQSRVTAYKSDMIDPFQLGL
MVVFLATQEVLRKRWTAKISIPAIMLALLTLVFGGVTYTDLIRYVILVGAAFAEANSGGDVVHLALMA
TFKIQPVFLVASFLKTRWTNQESILLMLAAAFFQMAYYDAKxxxxWEVPDVLNSLSVAWMILRAISFT
NTSNVATPLLALLTPGLKCLHLDIYRILLLMVGVGSLIKEKRSSAAKKKGACLICLALASTGxFNPMI
LAAGLITCDPNRKRGWxxxxxxxxxxxxxxIVGGLAELDIDSMAVPMTIAGLMFVAYVITGRSTDMWI
ERTADITWESDAEITGTSDRVDVKLDDDGNFQLISDPGAPWKIWILRMACLAVSAYTPWAILPSVIGF
WITLQYTxxxGVLWDTPSPREYKRGDTTTGVYRIMTRGILGSYQAGVGVMVEGVFHxxxxxTKGAALM
SGTGRLDPYWGSVREDRLCYGGPWKLQHKWNGHDEVQMIVAEPGRNTRNVQTKPGVFKTPDGEIGAVT
LDYPTGTSGSPIVDRSGDVIGLYGNGVIMPNGAYISAIVQGERMEEPAPAGFEPDTLRKKQISVLDLH
PGAGKTRKILPQIIKEAINKRLRTAILAPTRVVAAEMSEALRGLPIRYQTSAVHREHSGNEIVDVMCx
xxxxxxxxxxHRVPNYNLFIMDEAHFTDPASIAARGYIATRVELGEAAAIFMTATPPGTSDPFPESNA
PIxDMQTEIPDRAWNSGYEWITEYIGKTVWFVPSVRMGNEMAQCLQRAGKKVIQLNRKSYETxxxxCK
NDDWDFVVTTDISEMGANFRANRVIDSRKSVKPTIIEEGDNRVILGEPSAITAASAAQRRGRIGRNSS
QAGDEYCYGGHTNEDDSNLAHWTEARIMPDNINMPNGLVAQLYQPEREKVYTMDGEYKLRGEERKNFL
EFLRTADLPVWLAYKVAAAGISYHDRKWCFDGPRTNTVLEENTEVEIVTKMGERKILRPRWADARVYS
DHQALKSFKDFAAGKRSQIGLVEVLGRMPEHFVVKTWEALDTMYVVATAEKGGRAHRTALEELPDALQ
TIALITLLSVMSLGVFCLLMQRKGIGKIGLGGTxLGAATFFCWMAEVSGTKIAGMLLLSLLMMIVLIP
EPExxRSQTDNQLAVFLICVLTLVGTVAANEMGWLDKTKNDIxxxxxxxxxxxxxxxxxxESFLLDLKP
ATAWSLYAVSTAVMTPLLKHVITSDYINTSLTSINVQASALFTLSRGFPFVDVGVSALLLAVGCWGQV
TLTVTVTSAALLLCHYAYMIPGWQAEAMRAAQRRTAAGIMKNVVIDGMVATDVPELERTTPVMQKKVG
QVMLILVSMAAVVVNPSVRTVREAGILTTAAAVTLWENGAGSVWNATTAIGLCHVMRGGWLSCLSMTW
TLxKNMDKPVLKRGGAKGRTLGEVWKERLNHLTKEEFTRYRKEAITEVDRSAAKxARREGNITGGHSV
SRGTAKLRWLVERRFLEPVGKVVDLGCGRGGWxxxxATQKRVQEVKGYTKGGPGHxxxQLVQSYGWNT
VTMKSGVDVFYRPSEASDTLLCDIGESASSAEVEEHRTVRVLEMVEDWLHRGPKEFCIKVLCPYMPKV
IEKMETLQRRYGGGLIRNPLSRNSTHEMYWVSHASGNIVNSVSMTSQVLLGRMEKKTWKGPQFEEDAN
LGSGTRAVGKPLLNSDTGKIRNRIERLKKEYSxxxxxDANHPYRTWNYHGSYDVRPTGSASSLVxxxx
xLLSKPWDTITSVTTMAMTDxxxxxxxxxxxxKVDTKAPEPAEGVKxVLNETTNWLWTFLARDKKPRM
CSREEFIGKVNSNAALGAMFEEQNQWKNAREAVEDPKFWEMVDDEREAHLRGECNTCIYNMMGKxxKK

FIG. 58-15

PGDFGKAKGSRAxxxxxxxxxxxxxxxxxxLNEDHWLGRENSGGGVEGLGLQKLGYILKEVGxxxGGK
MYADDTAGWDTRITKADLENEAKVLEFLDGEHRRLARSVIQLTYCYKVVKVMRPAADGKTVMDIISRE
DQRGSGQVVTYALNTFTNLSFQLVRMMEGEGVVGPDDVExxxKGKGVKVRVWLSENGKERLGRMAVSG
DDCxVKPLDDRFATALHFLNAMPKVRKDIQEWxPSTGWYDWQQVQFCSNHFTELIMKDGRTLVVPCRG
QDELIGRARISPGAxxxxxxxxxxLAKSYAQMWQLLYFHRRDLxxxANAICSAVPVSWVPTGRTTWSIH
AKGEWMTTEDMLAVWNKVWIEENEWMEDKTPVERWSDIPYSGKREDIWCGSLIGTRTRATWAENIHVA
INQVRSVIGEEKYVDYMSSLRRYEDxx >WNV|peptide_length:10|string3 xxxxxxxPGKNRAVNMQKRGTPRVLSLIGLKRAVLSLIDGRGPIRFVLALLAFFKFTAIAPTRAVLDR
WRSVNKQTAMKHLLSFKRELGILTNAINRRSLKQKKRGGNTGxxxxxxxxxxxGAVTLSNFQGKLMMT
INATDxxxAITIPTASGKNLCIIRAMDVGFMCDDTIAYECPALMEGNDPEDIDCWCTKLAMYVRYGRC
TKTRQSRRSKRSLTVQTHGESSLSNRKGAWLDSTKASRYLxxxxxxxxxxxxxxxxxxxTGWMLGSNT
MQRVVFAVLLLLVAPAxxxxCLGMSSRDFLEGVSGATWMDLVxEGDSCVTIMSKDKPTIDVKMTNMEA
xxxxxxxxxxxxxxATEISSSAACPTMGEAHNEKRTDSxYVCRQGVVDRxxxxxxxxxxxxxxxIDTCAK
FACTTKATGLTIQKEBIKYEVAVFVHGPTTVESHRxxxxxxGAAQAGRFSVSPAAPTHTxNLGDYGEV
TIDCEPRSGVDVDAFYVMTVGxxxxxxxxxxxxTDLNLPWSSAESNxWRNRETLVEFEEAHATKQSVVA
xxxxxxxxQQALAGTIPVEFTSNTVKLSSGHLKCRVKMEKLKLKGTTYGVCSKAFRFxNTPADTGHGT
VVLELQYTGTDGPCKIPISSVASLNxxxxxxxLVTVNPFVSVSTANAKILVELEPPxxxxxxVVGRGE
HQINHHWYKSGSSIGKAFATTLQGAQRLVSLGxxxWDFGSVGGVFNSIGKAVHQVFGGAFRLLFxxxx
xxxxxxxGALLLWMGISSRDRSIALTFLAIGGILLFLSANVHADTGCAIDLKRQELRCGSGVFIHNDV
EAWIDRYRYYPETPQGLARIIQKAHxSGTCGIRSVSRLEHQMWEAVKDELNTLLKENGIDLSIVVEKQ
xxxxxxxxxxxATTENLEIGWKAWGKSILFAPELANHTFVIDGPETKECPSxDRAWNSLEVExxxFG
LTSTRMFMKVREGNTTECDSKTIGTAVKNNLAVHSDLSYWIESRLNHTWKLERAVLxxxxxxxxxETH
TLWGEGVQESELIIPITLAGPRSNYNRRPGYKMQNQGPWDEGRIEIDFDYCPGTTVTVSxxCGHRGPA
IRTTTESGKLITDWWxxSCTLPPLRYRTESGCWYGMEIRPLRHDEKTLVQSKVNAYKSDMIDPFQLGL
LVVFLVTQEVLRKRWTAKISVPAIIIALLVLVLGGITYADVLRYINLVGAAFMEANSxxxxxHLALMA
TFKIQPAFMVASFLKAKWTNHENILLMLAAVFFQMAYYDARxxxxWEMSDVLNSLAVAWMILRAIGFT
TTSNVVVPLMALLTPGLKCLNLDVSRILLLMVGVGSLVKERRSAVAKKKGASLICLALASTxxFNPLI
LAAGLMACDPNRKRGxxxxxxxxxxxxxxxxxxxGGLAELDMDSMAIPMTIAGLMFAAYVITGRSTxMWI
ERTADISWEGDVEITGSSERVDVRLDDDEDFQLMSDPGAPWKLWMLRMTCLAVSAYTPWAVLPSVVGF
WISLQYxxxxxxxxWDTPSPREYRKGDTTTGVYxxxxxGLLGNYQAGVGxxxxxxxxxxxxxxxxxxxx
xxxxxxxxxxxxxxxxxxCYGGPWKLQRKWNGLDEVQMIVVEPGKNAKNVQTKPGVxxxxxxxxxxxx
xxxxxxxSGSPIVDKSGDVIGLYGNGVIMPSGSYISAIVQGERMDEPVPAGFEPDMLRKKKITVLDLH
PGxxxTRKILPQIIREAINKRLRTAILAPTRVVASEMAEALRGLPIRYQTSAVTREHTGNEIVDVMCx
xxxxxxxxxxxxxxxxxxxxxxxxxxxxxxxIAARGYISTRVELGEAAxxxxxxxxPPGTHDPFPESNA
PVxDIQTEIPDRAWxTGYEWITEYVGKTVWFVPSxxxxxxxALCLQRAGKRVIQLNRKSYxxxxxxxx
xxxxxxxxxxxSEMGANFKANRVIDSRKSVKPTIITDGESRVVLGEPSAITAxxxxQRRGRIGRNPS
QAGDEYCYxGHTNEDDSNCAHWTEARIMxxxxNMPNGLIAQFYQPEREKVCTMDGEYRLRxxxxxxxx
xxxxxxDLPVWLAYQVAAAGVPYHDRRWCFDGPRTNTVLEDNNEVExxxxVGERKILRPRWVDARVYS
DHQALKLFKDFASGRRSQIGLVEVIGRMPEHFMVKTWEALDTxYVVATAEKGRRAHRSALEELPDALQ
TIVLIALLSVMTLGIFFLLMQRKGIGKIGLGGVxLGLATLFCWMADVPGTKIAGMxxxxxxxxxxxx
xxxxxxxxxxxQLAMFLICVMTLVGTVAANEMGWLDRTKSDIxxxxxxxxxxxxxxxxxxxxxxxESFFLDLRP
ATAWSLYAITTAVLTPLLKHVITxxxxxxxxxSINVQASALYSLARGFPFVDVGISALLLAAGCWExV
TLTVTVTATTLLLCHYAYMxxxxxxxxxxxxxxxxxAAGIMKNAVIDGMVATDVPELERATPIMQKKVG
QIILILVSTAALVVNPSVKTVREAGILVSAASVTLWENGASxxxxxxxxxxxxxxxVMRGGWLSCLSIMW
TLxKNMGKPGLKRGGAxxRTLGEVWKDRLNRMTKEEFIRYRKEAIIEVDRSAARxARKERNVTGGHPV
SRGSAKLxxLVERRFLDPIGKVVDLGCGxxxxxxxxxxxxxxxxxxxxxxxxxxxxxxxxxxxxxxxx
xxxxxxVDVYYRASESCDTLLCDIGxxxxSAEVEEHRTLRVLEMVEDWLHRGPKEFCVKVLCPxMPKV

FIG. 58-16

```
IEKMEVLQRRYGGGLxxxxxxxxxxxxEMYWVSRASGNIVHAVNMTSQVLLxRMEKKTWKGPHYEEDAN
LGSGxxxxGKPLLNSDTSKINSRIERLKREYSxxxxxDDNHPYRTWNYHGSYEVNPTGSASSLVxxxx
xxLSKPWDTIMNVTTMAMxxxxxxxxxxxxxxxxTKAPEPPEGAKxxLNETTNWLWAYLARNKRPRM
CSREEFISKVNSNAALGAMFEEQNQWKSARAAVEDPKFWEIVDEEREAHLRGECYTCIYNMMGKxxxx
xxxxxxxxxxxxxxxxxxxxxxxxxxxxxxxxxxxxxxxxxxxxGLQKLGYVLREVGxxxGGK
VYADDTAGWDTRITMTDLENEAKVLELLEGEHRRLARSIIELTYRHKVVKVMRPAVGGKTVMDVISRE
DQRGRxxxxxxYALNPFTNLAVQLVRRREGEGVIGPYDVExxxKRKGPKVRTWLFENGEERLSRTAVSx
xxxxxKPLDDRFATSLHFLNDMSKVRKDIQxxxxxVGWYDWQQVPxxxxxxxxxxIMKDGRTLVTPCRG
QDELVxxxxxxxxxxxxxxxxxxxxxxxxxxxxxxxxxxxxxxxNAICSAVPADWVPTGRTTWSIH
ARGEWMTTADMLGVWNRVWIEExxxxxxxKTPVERWSDIPYSGKxxxxWCGSLIGTRTRATWAENIQVA
INQVRSIIGEEKYVDYMGSLKRYEExx >WNV|peptide_length:10|string4 xxxxxxxxxxxRAVNMLKRGKPRGGSLMGLKRAILSLIDGKGPIRFVLALLAFFRFTAIAPTRAVLER
WRGVNKQTxxxxxxxxFKKELGALTSAISRRSAKKKKRGGSIGxxxxxxxxxxxxRAVVLSNFQGKLMMT
INATExxxIITIPTAAGKNLCTVRAMDVGHMCDDTITYECPALAAGNDPEDIDCWCTKAAMYVRYGRC
TKTRHSRRSKRxxxVQAHGESTLSNKKGAWMDSxxxxxxxxxxxxxxxxxxxxxxxxxxxxxxxSNT
TQRVVFMILLLLVAPAxxxxxxxxxxxxxxxxxxxxxxxxxDSCVTLMSKDKPTIDVKMMKMEA
xxxxxxxxxxxxxVSELSPKAACPTMGEAHNDKRADSxYFCKQGVVDRxxxxxxxxxxxxxxDTCAK
FTCSNKATGLTIQRENVxxxxxxxxxxxxxxxxxxxxxxxxxxGATQAGRLSITPAAPSHTxKLGEYGEV
TMDCExxxxIDTSAYYVMTVGxxxxxxxxxxxxxxLNLPWSSAGGTxWRNRETFMEFEEPHxxxxxxxxx
xxxxxxxxxQALAGAIPVSFTSNTVKLxxxxxxxxxxxxxxxxxxxxxxxxxxxxxxxxxxx
xxxxxxxxKDGPCKVPISxxxxxxxxxxxxxxxVTVNPFVAAATADAKVLIELEPxxxxxxxxxxxGE
QQINHHWHKSGISIGKAFTATLKGAQRLAxxxxxxxDFGSVGGVLTSFGKAVHQVFGxxxxxxxxxxx
xxxxxxxxxALLLWMGINSRDRSIALTFLAVGGVLLFLSINVHADTGCAIDVTRQELRCGSGxxxxNDV
EAWTDRYKFYLETPQGLAKVIQKAHxEGVCGLRSASRLEHQMWESIKDELNTLLKENGVDFSVVVEKQ
xxxxxxxxxxxxATTEKFEIGWKAWGKSIIFAPEIANNTFVVDGSETRECPTxSRAWNSMEVExxxxG
LTSTRIFLKIREVNTTECDSKIIGTAIKNxxxxxxDLSYWIESGLNHTWKLERAxxxxxxxxxxxxETH
TLWGEGVIESELIIPVTLAGPRSNYxxxxxxxxxxxxxxxxxxxxxxxxxxxxxxxxxxxxxxCEHRGAS
ARTTTESGKxxxxxxxxxSCTLPPLRFQTDNGCWYGMEIRPLKHDEKTLVQSRVNAYNAEMIDPxQLGL
LVVFLATKEVLRKRWTAKISLPAIMVALLVLFGGVTYTDVLRYVILAGAAFAESxxxxxxxxxxxLMA
TFRVQPVFVVATFVKARWTNHENILLxxAAAFFQMAYIDSQxxxxWNIPDVLNSLAVAWMVLRAISFT
TTSNVVVPLLALLTPGLRCLNLDVYRILLLMIGIGSLIKEKRNAAAKKKGASLIxxxxxxxxxxxNPMI
LVAGLLACDPNRKRGxxxxxxxxxxxxxxxxxxAELDVDSMAIPMTIxxxxxxxxxxxxxxxxxxxxxxx
ERTADISWESDVEITGSSExxxxxxxDDGGDFQLMNDPGxxxxxxxxxxMFCLAISAYTPxxxxxxxxxx
xxxxxxxxxxxWDTPSPKEYEKGDTTTGVYxxxxxxxxxxxxxxxxxxxxxxxxxxxxxxxxxxxx
xxxxxxxxxxxxxxxxxxxxxxxYGGPWKLQHRWNGMDEVQMIVVEPGESVKNVQTKPGxxxxxxxxxxx
xxxxxxxxxxxxxxxxxxxxxxxxxxxxxxxxxxxxVQGERMDEPIPVGFESEMLRKKKITVxxxx
xxxxxxxxxLPQIIKEAMDRRLRTAVLAPTRVVAAEMADALRGxPIRYQTSAVAREHxxxxxxxxxxxxx
xxxxxxxxxxxxxxxxxxxxxxxxxxxxxxxIAARGYISTRVELGDAAxxxxxxxxxxxSSDPFPESNA
xxxxxxxxxxxxxxxxxxxxxxxSGYEWITEYAGKTVWFVPxxxxxxxxxxLCLQRAGKKIxxxxxxxxxxxxxx
xxxxxxxxxxxxxxxxxxxxxxxxxxxxxxxKSVKPTSITEGEARVILGEPSAxxxxxxxxxRRGRTGRNPS
QAGDxxxxxGHTNEDDSNYAHWTEARIMxxxxxxxxxxxxxxxxxxxxxKVYTMEGEYRLRxxxxxxxxx
xxxxxxxxPVWLAYKVAAAGISYHDRRWCFxxxxxxxxxxxxxxxxxxxxxxxxxxxxPRWTDARVYS
DHQxxxxxxDFASGKRSQIGFIEVLGRMPEHFMVKTxxxxxxxxxxxxTAEKGGRAHSMALEExxDALQ
TVALIALLSVMTMGIFFLLMQRxGIGKIGLGGIxLGAATFFCWMADVPGxxxxxxxxxxxxxxxxxxxxx
xxxxxxxxxxxxxAVFMICVMTFISAVAANEMGWLDKTKNDMxxxxxxxxxxxxxxxxxxxxxANFLLDLRP
ATxWSLYAVSTAVLTPLIKHLITxxxxxxxxxxxxxxVQASTLFTLARGFPxxxxxxxxxxxxxxxxxxxxx
xxxxxxxxxILLFCHYAYMxxxxxxxxxxxxxxxxxxxxxxxxxxxxxxRATPVMQKKIG
```

FIG. 58-17

QIMLILVSLAALVVNPSVxTVREAGILITSASVTLWExxxxxxxxxxxxxxxxxxxxxGGWLSCLSIAW
TLxKSMEKPVLKRGGAxxxxxxGEVWKERLNYMTKEEFSRYRKEAIIEVDRSAAQxARKEGNVTGGHSV
SxxxxxxxxxxxxxRFLEPIGKVIDLGCGxxxxxxxxxxxxxxxxxxxxxxxxxxxxxxxxxxxxxxx
xxxxxxVDVFYRPSEVSDTLLCxxxxxxxxxxxxxEHRTIRVLEIVEDWxxxxxxxxxxxxxxxxMPKV
IEKMEILQRRYGGGLxxxxxxxxxxxxxEMYWVSRASRNIVHAVNMTSQxxxxxxEKKTWKGAQYEEDAN
LGSxxxxxGKPLLSSDTSKIKNRIERLKKEYNxxxxxDGNHPYRTWNYHGSYDVNPTGSASSxxxxxx
xxxxxxxxxxxxxxxxxxxxxxxxxxxxxxxxxxxKAPEPPEGVRxxxKETTNWLWAFLSRGKRPRM
CTREEFIKKVNSNAALGxMFEEQNQWSSAREAVEDLKFWEMVDEExxxxxxxxxxxxxxxxxxxxxxxx
xxxxxxxxxxxxxxxxxxxxxxxxxxxxxxxxxxxxxxxxxxxxxxxxxxxxxxxxxxxxxxxxxGGR
IFADDTAGWDxxxxxxxxxxxxxxxxxxxxxxxxxARSIIELTYRYKVxxxxxPAADRKTVMDVISRx
xxxxxxxxxxxxxxxxxxxxxxxxxxxxMEGEGVIGPEDVExxxRGKGPKVRTWxxxxxxxxxxxxxx
xxxxxxxxxxxFATSLHFLNAMPKxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxNAICSAVPVDWVPTGRTTWSIH
ARGEWMTTEDMLSVWNRVWIEExxxxxxxxxxxxxxxxxxxxxxxxxxxxxxxxxxSRATWAENIQVA
INQVKAxxxxxxxxxxYMSSLRRYEExx >WNV|peptide_length:10|string5 xxxxxxxxxxxxRAVNMLKRGMPRVMSLxxxxxxxxxxxxxxxxxxxxxxxxxxxxxxxxxAVLER
WRGVNKxxxxxxxxxxFKKELGALTSAINRRSEKQKKRGGVVGxxxxxxxxxxxGSVTLSNFQGKLMMT
VNATDxxxIITIPIASGKNLCTVRAIDVGFMCDDTITYExxxxxxxxxxDIDCWCTKSPxxxxxxxx
xxxxxxxxxxxxxxxxVQTHGESTLANKKGAWMBSxxxxxxxxxxxxxxxxxxxxxxxxxxxxxxxx
MQRVVFIVLLLLVAPAxxxxxxxxxxxxxxxxxxxxxxxxxxxxxxxxxxxxxxxxxxxxxxxxxxx
xxxxxxxxxxxxxxVNDLSTKAACPTMGDAHNDKRADPxxxxxxxxxxxxxxxxxxxxxxxxxxxAR
FACSTKATGxxxxxxxxxxxxxxxxxxxxxxxxxxxxxGATQAGRFTVSPSAPTYTxKLGGYGEV
TVxxxxxxxIDTGAYYVMSVGxxxxxxxxxxxxxxxxNLPWSSAGGNxxxxxxxxxxxxxxxxxxxx
xxxxxxxxxxxxxxxxxxxxxxxxxxxxxxxxxxxxTVNPFVSVAAANAKVLIELxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxARDRSIAMTFLAVGGILxxxxxxxxADTGCAIDVSRQELRCGxxxxxxNDV
KAWMDRYKFHPETPQGLxxxxxxxxxxxxxxxxxxxxxRLEHQMWDSVKDELNTLFKENGIDLSMVVEKQ
xxxxxxxxxxATTEKFEIGWKAxxxxxxxxxPELANHTFVVDGPETKECSTxxxxxxxxxxxxxxxx
xxxxxxxxxARESNTTECDxxxxxxxxxxxxxxxxxxxxFNETWKLERAxxxxxxxxxxxxxxxTH
TLWGDGVLESELIIPATLAGPRSNHxxxxxxxxxxxxxxxxxxxxxxxxxxxxxxxxxxxCGHRGPS
ARTTxxxxxxxxxxxxxxxxxTLPPLRFKTExxxxxxMEIRPQKHDERTLVQSQVNAYNAEMIxxxxxGL
LVVFLATKEVxRRRWTAKISMPAILVALAVLVFGGITYIDVLRYVILxxxxxxxxxxxxxxxxxxxx
xxxIQPVFMVASFLRAGWTNQENILLxxAAAFFQMAYHDAxxxxxxWGIPDVLNSLxIAWMILRAITxx
xxxxxxxxxxxxxxxxxxxxxxxxxxxDVYKILLLMVGVGSLIKEKKNSAAKKKGxxxxxxxxxxxxSPLV
LAAGLVACDPNRKRGxxxxxxxxxxxxxxxxxxxxxxxxxxxxxxxxxxxxxxxxxxxxxxxxxxxx
ERVADISWENDAEITGSSExxxxxxxxxxxxxxxxxxxxxxxxxxxxxxMVCLAVSAYTPxxxxxxxxx
xxxxxxxxxxxxWDTPSPKEYEKGDTTTGxxxxxxxxxxxxxxxxxxxxxxxxxxxxxxxxxxxxxx
xxxxxxxxxxxxxxxxxxxxxxxxxWKLGHRWNGQDEVQxxxxxxxxxxxxxxxxxxxxxxxxxxxx
xxxxxxxxxxxxxxxxxxxxxxxxxxxxxxxxxxxGERMEEPVPSGFDPETLKKKQITxxxxxx
xxxxxxxxxxPQIIKEAISKRLRTAILAxxxxxxxxxxxxxxxPIRYQTSAVNREHxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxSGYEWITEYAxxxxxxxxxxxxxxxxxxxxxxxxxxxxxxxxxxxxxx
xxxxxxxxxxxxxxxxxxxxxxxxxxxxxxxxxxxxxITDGEARVILGEPSxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxLAHKAAAAGVSYHDRKxxxxxxxxxxxxxxxxxxxxxxxxxxxxxxxxxxxxxxx
xxxxxxxxxxxASGKRSQMGLIEVLGKMxxxxxxxxxxxxxxxxxxxxAEKGRRAHRMAxxxxxxxx

FIG. 58-18

```
xxxxxxLLGVMTMGIFFLLMQxxGVSKIGLAGVxLAVATLFCWMAExxxxxxxxxxxxxxxxxxxxx
xxxxxxxxxxxxAVFLICVLTFIxxxxxxxxxxxxxxxxxxxxxxxxxxxxxxxxxxEDLLLDLKP
ATxxxxxxVATAFLTPLLKHLIxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxMMQKKVG
QVMLILVSVAAVVVNxxxxxxxxxxxxxxxxxxxxxxxxxxxxxxxxxxxxxxxEGWLSCLSITx
xxxKNLEKPGLKRGGxxxxxxGEVWKEKLNQMTREEFARYRKEAIIEVDRSTAKxxRKEGNVTGGYxx
xxxxxxxxxxxxxxxxxxxxxxxxxxxxxxxxxxxxxxxxxxxxxxxxxxxxxxxxxxxxxxxxxx
xxxxxxVDVFYRPSESCDTLLCxxxxxxxxxxxxxxxxxxxxxxxxxxxxxxxxxxxxxxxMPKV
VEKMEVLQRRxxxxxxxxxxxxxxxxxxxxYWVSQASGNIVHxxxxxxxxxxxxxxEKKTWKGPQYEEDVS
LGxxxxxxxKPLLNSDTRKIKNRVERLKREYGxxxxxDVNHPYRTWNYxxxxxxxxxxxxxxxxxxx
xxxxxxxxxxxxxxxxxxxxxxxxxxxxxxxxxxxxxxxxxxxxxxxxxxxxxxxxxxxREKKPRL
CSREEFKRKVNxxxxxxxxxxEQNQWRSAREAVEDSTFWEMVDEExxxxxxxxxxxxxxxxxxxxx
xxxxxxxxxxxxxxxxxxxxxxxxxxxxxxxxxxxxxxxxxxxxxxxxxxxxxxxxxxxxxxxGGK
TYADDTAGWxxxxxxxxxxxxxxxxxxxxxxxxxxxxxRAIIELTYCHKxxxxxxxAADGKTVMDIISxx
xxxxxxxxxxxxxxxxxxxxxxxxxxxMEGEGVITPDDVExxxxxxxxxxxxxxxxxxxxxxxxxx
xxxxxxxxxxxxISLHFLNAMSxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxH
VGGEWMTTEDMLGVWNKVWxxxxxxxxxxxxxxxxxxxxxxxxxxxxxxxxxxxxxxxxxxxxxxx
xxxxxxxxxxxxxxxxxxxxxxxxxxxxxx
```

FIG. 58-19

>WNV|peptide_length:11|string1

```
MSKKPGGPGKSRAVNMLKRGMPRVLSLIGLKRAMLSLIDGKGPIRFVLALLAFFRFTAIAPTRAVLDR
WRGVNKQTAMKHLLSFKKELGTLTSAINRRSSKQKKRGGxxxxxxxxxxxxxxGAVTLSNFQGKVMMT
VNATDxxxVITIPTAAGKNLCIVRAMDVGYMCDDTITYECPVLSAGNDPEDIDCWCTKSAVYVRYGRC
TKTRHSRRSRRSLTVQTHGESTLANKKGAWMDSTKATRYLVKTESWILRNPGYALVAAVIGWMLGSNT
MQRVVFVVLLLLVAPAYSFNCLGMSNRDFLEGVSGATWVDLVLEGDSCVTIMSKDKPTIDVKMMNMEA
xxxxxxxxxxxxxxVSDLSTKAACPTMGEAHNDKRADPxFVCRQGVVDRGWGNGCGLFGKGSIDTCAK
FACSTKAIGRTILKENIKYEVAIFVHGPTTVESHGxxxxxxGATQAGRFSITPAAPSxxxKLGEYGEV
TVDCEPRSGIDTNAYYVMTVGxKTFLVHREWFMDLNLPWSSAGSTxWRNRETLMEFEEPHATKQSVIA
LGSQEGALHQALAGAIPVEFSSNTVKLTSGHLKCRVKMEKLQLKGTTYGVCSKAFKFxGTPADTGHGT
VVLELQYTGTDGPCKVPISSVASLNDLTPVGRLVTVNPFVSVATANAKVLIELEPPFGDSYIVVGRGE
QQINHHWHKSGSSIGKAFTTTLKGAQRLAALGDTAWDFGSVGGVFTSVGKAVHQVFGGAFRSLFGGMS
WITQGLLGALLLWMGINARDRSIALTFLAVGGVLLFLSVNVHADTGCAIDISRQELRCGSGVFIHNDV
EAWMDRYKYYPETPQGLAKIIQKAHxEGVCGLRSVSRLEHQMWEAVKDELNTLLKENGVDLSVVVEKQ
xxxxxxxxxxxxATTEKLEIGWKAWGKSILFAPELANNTFVVDGPETKECPxxNRAWNSLEVEDFGFG
LTSTRMFLKxxxxNTTECDSKIIGTAVKNNLAIHSDLSYWIESRLNDTWKLERAVLGEVKSCTWPETH
TLWGDGILESDLIIPVTLAGPRSNHNRRPGYKTQNQGPWDEGRVEIDFDYCPGTTVTLSxxCGHRGPA
TRTTTESGKLITDWCCRSCTLPPLRYQTDSGCWYGMEIRPQRHDEKTLVQSQVNAYNADMIDPFQLGL
LVVFLATQEVLRKRWTAKISMPAILIALLVLFGGITYTDVLRYVILVGAAFAESNSGGDVVHLALMA
TFKIQPVFMVASFLKARWTNQENILLMLAAVFFQMAYHDAxxxxxxxxPDVLNSLAVAWMILRAITFT
TTSNVVVPLLALLTPGLRCLNLDVYRILLLMVGIGSLIREKRSAAAKKKGASLLCLALASTGxFNPMI
LAAGLIACDPNRKRGWPATEVMTAVGLMFAIVGGLAELDIDSMAIPMTIAGLMFAAFVISGKSTDMWI
ERTADISWESDAEITGSSERVDVRLDDDGNFQLMNDPGAPWKIWMLRMVCLAISAYTPWAILPSVVGF
WITLQYTKRGGVLWDTPSPKEYKKGDTTTGVYRIMTRGLLGSYQAGAGVMVEGVFHTLWHTTKGAALM
SGEGRLDPYWGSVKEDRLCYGGPWKLQHKWNGQDEVQMIVVEPGKNVKNVQTKPGVFKTPEGEIGAVT
LDFPTGTSGSPIVDKNGDVIGLYGNGVIMPNGSYISAIVQGERMDEPIPAGFEPEMLRKKQITVLDLH
PGAGKTRRILPQIIKEAINRRLRTAVLAPTRVVAAEMAEALRGLPIRYQTSAVPREHNGNEIVDVMCH
ATLTHRLMSPHRVPNYNLFVMDEAHFTDPASIAARGYISTKVELGEAAAIFMTATPPGTSDPFPESNS
PIxDLQTEIPDRAWNSGYEWITEYTGKTVWFVPSVKMGNEIALCLQRAGKKVVQLNRKSYETEYPKCK
NDDWDFVITTDISEMGANFKASRVIDSRKSVKPTIITEGEGRVILGEPSAVTAASAAQRRGRIGRNPS
QVGDEYCYGGHTNEDDSNFAHWTEARIMLDNINMPNGLIAQFYQPEREKVYTMDGEYRLRGEERKNFL
ELLRTADLPVWLAYKVAAAGVSYHDRRWCFDGPRTNTILEDNNEVEVITKLGERKILRPRWIDARVYS
DHQALKAFKDFASGKRSQIGLIEVLGKMPEHFMGKTWEALDTMYVVATAEKGGRAHRMALEELPDALQ
TIALIALLSVMTMGVFFLLMQRKGIGKIGLGGAxLGVATFFCWMAEVPGTKIAGMLLLSLLLMIVLIP
EPEKQRSQTDNQLAVFLICVMTLVSAVAANEMGWLDKTKSDIxxxxxxxxxxxxxxxxxxGEFLLDLRP
ATAWSLYAVTTAVLTPLLKHLITSDYINTSLTSINVQASALFTLARGFPFVDVGVSALLLAAGCWGQV
TLTVTVTAATLLFCHYAYMVPGWQAEAMRSAQRRTAAGIMKNAVVDGIVATDVPELERTTPIMQKKVG
QIMLILVSLAAVVVNPSVKTVREAGILITAAAVTLWENGASSVWNATTAIGLCHIMRGGWLSCLSITW
TLxKNMEKPGLKRGGAKGRTLGEVWKERLNQMTKEEFTRYRKEAIIEVDRSAAKxARKEGNVTGGHPV
SRGTAKLRWLVERRFLEPVGKVIDLGCGRGGWCYYMATQKRVQEVRGYTKGGPGHEEPQLVQSYGWNI
VTMKSGVDVFYRPSECCDTLLCDIGESSSSAEVEEHRTIRVLEMVEDWLHRGPREFCVKVLCPYMPKV
IEKMELLQRRYGGGLVRNPLSRNSTHEMYWVSRASGNVVHSVNMTSQVLLGRMEKRTWKGPQYEEDVN
LGSGTRAVGKPLLNSDTSKIKxxxxxxxxxxxxxxxxxDENHPYRTWNYHGSYDVKPTGSASSLVNGVV
RLLSKPWDTITNVTTMAMTDTTPFGQQRVFKEKVDTKAPEPPEGVKxVLNETTNWLWAFLAREKRPRM
CSREEFIRKVNSNAALGAMFEEQNQWRSAREAVEDPKFWEMVDEEREAHLRGECHTCIYNMMGKREKK
PGEFGKAKGSRAIWFMWLGARFLEFEALGFLNEDHWLGRKNSGGGVEGLGLQKLGYILREVGxxxGGK
IYADDTAGWDTRITRADLENEAKVLELLDGEHRRLARAIIELTYRHKVVKVMRPAADGRTVMDVISRE
DQRGSGQVVTYALNTFTNLAVQLVRMMEGEGVIGPDDVExxxKGKGPKVRTWLFENGEERLSRMAVSG
DDCVVKPLDDRFATSLHFLNAMSKVRKDIQEWKPSTGWYDWQQVPFCSNHFTELIMKDGRTLVVPCRG
```

FIG. 58-20

QDELVGRARISPGAGWNVRDTACLAKSYAQMWLLLYFHRRDLRLMANAICSAVPVNWVPTGRTTWSIH
AGGEWMTTEDMLEVWNRVWIEENEWMEDKTPVEKWSDVPYSGKREDIWCGSLIGTRARATWAENIQVA
INQVRAIIGDEKYVDYMSSLKRYEDxx

>WNV|peptide_length:11|string2

MSKKPGGPGKNRAVNMQKRGMPRGLSLTGLKRAMLSLIDGRGPIRFVLALLTFFRFTAIAPTRALLDR
WRGVRKQTAMKHLLSFKKELGALTNAMNRRSTKQKKRGGxxxxxxxxxxxxxSALTLSNFQGKVIMT
VNATDxxxIITIPTAAGKNLCTVRAMDVGYLCEDTITYECPVLAEGNDPEDIDCWCTKSSVFVRYGRC
TRTRNSRRSRRSLNVQVHGESTLANKKGAWLDSTKASRYLMKAESWILRNPGYALVAVVIGWMLGSNT
MQRVVFAILLLLVAPAYSFNCLGMSNRDFIEGASGATWMDLVLEGDSCVTIMAKDRPTIDVKMVTMGA
xxxxxxxxxxxxxVSDLSTRAACPTMGEAHNEKRADPxFVCKQGVVDRGWGNxxxxxxKGSIDTCAK
FACSTKATGWIIQRENVKYEVAAFVHGPTTVDTHSxxxxxxAAVQAGRFSITPSAPSxxxTLGDYGEV
TFDCEPRSGIDTSAYYVMSVGxKSFLVHREWFMDLNLPWSSPGNTxWRNREALVEFEEPHATKQSVVA
LGSQEGALHQALAGAIPVDYKNSVVKLTSGHLKCRVRMEKLKLKGTTYGVCAKAFRFxRTPADTGHGT
VVMELQYTGTDGPCKIPITSVASLNDLTPVGRLVTVNPYVSVATANSKILVELEPPFGDSYIVIGKGD
QQVTHHWHKSGSSIGKAFTTTLRGAQRLVSLGDTAWDFGSIGGVFTSVGKAIHQLFGGAFRLLFGGMS
WITQxLMGALLLWMGINARDRSIAMTFLAVGGVLLFLSINVHADTGCAIDIGRQELRCGNGVFIHNDV
EAWVDRYKFHPETPQGLAKIIHNAHxEGVCGVRSVSRLEHQMWESIKDELNTLLKENGVDLSIVVEKQ
xxxxxxxxxxxATTEKLEMGWKAWGKSIIFAPELANNTFVIDGPETEECPxxNRAWNSMEVEDFGFG
LTSTRMFLRxxxxNTTECDTKIIGTAVKNNMAVHSDLSYWIESGFNETWKLERAVLGxxxxxTWPETH
TLWGDGVLESDLIIPITLAGLKSNHNRRPGYKTQSQGPWDEGRVELDFDYCPGTTVTISxxCGHRGPA
ARTTTESGKLISDWCCRSCTLPPLRFQTENGCWYGMEIRPTRHDEKTLVQSRVTAHNADMIDPFQLGL
MVVFLATKEVLRKRWTAKISIPAIMLALLTLVFGGVTYTDLIRYVILVGAAFAEANSGGDVVHLALMA
TFKIQPVFLVASFLKTRWTNQESILLMLAAAFFQMAYYDAxxxxxxxxPDVLNSLSVAWMILRAISFT
NTSNVATPLLALLTPGLKCLHLDIYRILLLMVGVGSLIKEKRSSAAKKKGACLICLALASTGxFNPMI
LAAGLITCDPNRKRGWPxxxxxxxxxxxxAIVGGLAELDIDSMAIPMTIAGLMFVAYVITGRSTDMWI
ERTADITWESDAEITGTSDRVDVKLDDDGNFQLINDPGAPWKIWILRMACLAVSAYTPWAILPSVIGF
WITLQYTKxGGVLWDTPSPREYKRGDTTTGVYRIMTRGILGSYQAGVGVMVEGVFHTxxxTTKGAALM
SGTGRLDPYWGSVREDRLCYGGPWKLQHKWNGHDEVQMIVAEPGRNTRNVQTKPGVFKTPEGEIGAVT
LDYPTGTSGSPIVDRSGDVIGLYGNGVIMPNGAYISAIVQGERMEEPAPAGFEPDMLKKKQITVLDLH
PGAGKTRKILPQIIKEAINKRLRTAILAPTRVVAAEMSDALRGLPIRYQTSAVHREHSGNEIVDVMCH
xxxxxxxxxPHRVPNYNLFIMDEAHFTDPASIAARGYIATRVELGEAAAIFMTATPPGTSDPFPESNA
PIxDMQTEIPDRAWNSGYEWITEYIGKTVWFVPSVRMGNEMALCLQRAGKKVIQLNRKSYETExxKCK
NDDWDFVVTTDISEMGANFKANRVIDSRKSVKPTIIEEGDGRVILGEPSAITAASAAQRRGRIGRNSS
QAGDEYCYGGHTNEDDSNCAHWTEARIMLDNINMPNGLVAQLYQPEREKVYTMDGEYKLRGEERKNFL
EFLKTADLPVWLAYKVAAAGISYHDRKWCFDGPRTNTVLEENTEVEIVTKMGERKILRPRWADARVYS
DHQALKSFKDFAAGKRSQIGLVEVLGRMPEHFVVKTWEALDTMYVVATAEKGGRAHRTALEELPDALQ
TIALITLLSVMSLGVFCLLMQRKGIGKIGLGGTxLGAATFFCWMAEVSGTKIAGMLLLSLLMMIVLIP
EPEKQRSQTDNQLAVFLICVLTLVGTVAANEMGWLDKTKNDIxxxxxxxxxxxxxxxxESFLLDLKP
ATAWSLYAVSTAVMTPLLKHVITSDYINTSLTSINVQASALFTLSRGFPFVDVGVSALLLAVGCWGQV
TLTVTVTATALLLCHYAYMVPGWQAEAMRAAQRRTAAGIMKNVVIDGMVATDVPELERTTPVMQKKVG
QVMLILVSMAAVVVNPSVRTVREAGILTTAAAVTLWENGAGSVWNATTAIGLCHVMRGGWLSCLSMTW
TLxKNMDKPVLKRGGAKGRTLGEVWKERLNHMTKEEFTRYRKEAITEVDRSAAKxARREGNITGGHSV
SRGTAKLRWLVERRFLEPVGKVVDLGCGRGGWCxxMATQKRVQEVKGYTKGGPGHExPQLVQSYGWNT
VTMKSGVDVFYRPSEASDTLLCDIGESASSAEVEEHRTVRVLEMVEDWLHRGPKEFCIKVLCPYMPKV
IEKMETLQRRYGGGLIRNPLSRNSTHEMYWVSHASGNIVNSVSMTSQVLLGRMEKKTWKGPQFEEDAS
LGSGTRAVGKPLLNSDTGKIRxxxxxxxxxxxxxxxxDANHPYRTWNYHGSYDVRPTGSASSLVNxxx
RLLSKPWDTITSVTTMAMTDTxxxxxxxxxxEKVDTKAPEPAEGVKxVLNETTNWLWTFLARDKKPRM
CSREEFIGKVNSNAALGAMFEEQNQWKNARAAVEDPKFWEMVDDEREAHLRGECNTCIYNMMGKREKK

FIG. 58-21

PGEFGKARGSRAIxxxxxxxxxxxxxxxxxFLNEDHWLGRENSGGGVEGLGLQKLGYILKEVGxxxGGK
MYADDTAGWDTRITKADLENEAKVLEFLDGEHRRLARSVIELTYCHKVVKVMRPAADGKTVMDIISRE
DQRGSGQVVTYALNTFTNLSFQLVRMMEGEGVVGPDDVExxxKGKGVKVRVWLSENGEERLGRMAVSG
DDCVVKPLDDRFATALHFLNDMPKVRKDIQEWKPSTGWYDWQQVQFCSNHFTELIMKDGRTLVVPCRG
QDELIGRARISPGAGxxxxxxxCLAKSYAQMWQLLYFHRRDLRxMANAICSAVPVSWVPTGRTTWSIH
AKGEWMTTEDMLAVWNRVWIEENEWMEDKTPVER

FIG. 58-22

```
IEKMEVLQRRYGGGLxxxxxxxxxxHEMYWVSRASGNIVHAVNMTSQVLLGRMEKKTWKGPHYEEDAN
LGSGTxxVGKPLLNSDTSKINxxxxxxxxxxxxxxxxDDNHPYRTWNYHGSYEVNPTGSASSLVNxxx
xLLSKPWDVITNVTTMAMTxxxxxxxxxxxxxxxxDTKAPEPPEGVRxVLNETTNWLWAYLARNKRPRM
CSREEFIKKVNSNAALGAMFEEQNQWKSAREAVEDPKFWEIVDEEREAHLRGECYTCIYNMMGKRxxx
xxxxxxxxxxxxxxxxxxxxxxxxxxxxxxxxxxxxxxxxxxxxxxxLGLQKLGYVLREVGxxxGGK
VYADDTAGWDTPITKADLENEAKVLELLDGEHRRLARSIIQLTYRYKVVKVMRPAVGGKTVMDVISRE
DQRGRGxxxTYALNPFTNLAFQLVRRMEGEGVIGPYDVExxxKGKGPKVRTWLFENGKERLGRMAVSG
xxxxVKPLDDRFAISLHFLNAMPKVRKDIQExxxSTGWYDWQKVQFxxxxxxxLVMKDGRTLVTPCRG
QDELVGxxxxxxxxxxxxxxxxxxxxxxxxxxxxxxxxxxxxxxxxANAICSAVPADWVPTGRTTWSIH
ARGEWMTTADMLGVWNRVWIEENxxxxDKTPVERWSDIPYSGKRxxIWCGSLIGTRTRATWAENIQVA
INQVRSIIGEEKYVDYMGSLKRYEExx >WNV|peptide_length:11|string4 xxxxxxxxxxxRAVNMQKRGKPRVMSLIGLKRAMLSLIDGKGPIRFVLALLVFFKFTAVAPTRALLER
WRGVNKQTAxxxxxSFKKELGALTSAINRRSAKQKKRGGxxxxxxxxxxxxxxxRAVTLSNFQGKLMMT
INATDxxxIITIPIASGKNLCTVRAMDVGHLCDDTITYECSALAAGNDPEDVDCWCTKSAVYVRYGRC
TKTRQSRRSRRSLTVQTHGKSTLSNKKGAWMDSTxxxxxxxxxxxxxxxxxxxxxxxxxxxxxxGSNT
TQRVVFMILLLLVAPAYxxxxxxxxxxxxxxxxxxxxxxxxxxxxxGDSCVTIMSKNKPTIDVKMMNVEA
xxxxxxxxxxxxxVSELSPKAACPTMGEAHNDKRADSxYFCKQGVVDRGxxxxxxxxxxxxIDTCAK
FTCSNKATGLTILKEBIKYEVAIxxxxxxxxxxxxxxxxxGAAQAGRLSITPAAPSxxxNLGEYGEV
TMDCEPxxGIDTSAYYVMTVGxxxxxxxxxxxMDLNLPWSSAGGNxWRNRGTLMEFEEPHAxxxxxxx
xxxxxxxxQQALAGTIPVSFTSNTVKLTxxxxxxxxxxxxxxxxxxxxxxxxxxxxxxxxxxxxxx
xxxxxxxxGKDGPCKVPISSxxxxxxxxxxxxLVTVNPFVSMAAANAKVLVELEPPxxxxxxxxxRGE
QQINHHWYKSGSSIGKAFTATLKGAQRLAAxxxxxWDFGSVGGILTSVGQAVHQVFGGAFRLxxxxxx
xxxxxxxGALLLWMGINSRDRSIALMFLAIGGILLFLSVNVHADTGCAIDVSRQELRCGSGVFIHNDV
EAWTDRYKFYPETPQGLARIIQKAHxEGTCGIRSASRLEHQMWESIKDELNTLLKENGIDLSMVVEKQ
xxxxxxxxxxxATSDKLEIGWKAWGKSIIFAPEIANNTFVVDGSETRECPxxSRAWNSMEVEDxxFG
LTSTRIFLKxxxxxxxxECDSKIIGTAIKNNxxxxSDLSYWIESGFNETWKLERAVxxxxxxxxxPETH
TLWGEGVQESELIIPATLAGPRSNHNRRPGYKMQNxxxxxxxxxxxxxxxxxxxxxxxxxCEHRGPS
ARTTTESGKLxxxxxxRSCTLPPLRFKTDNGCWYGMEIRPQKHDEKTLVQSRVNAHNADMIDPFQLGL
LIVFLATKEVLRKRWTAKISLPAILIALLVLVFGGITYADVLRYVNLVGAAFAESNxxxxxxxxxALMA
TFRVQPVFMVATFVKARWTNHENILLMLAAAFFQMAYIDSxxxxxxxxPDVLNSLAVAWMVLRAISFT
TTSNVVVPALALLTPGLRCLNLDVYKILLLMIGIGSLIKERKNAAAKKKGASLICxxxxxxxxFNPMI
LVAGLLACDPNRKRGWxxxxxxxxxxxxxxxxxxLAELDVDSMAIPMTIAxxxxxxxxxxxxxxxxI
ERTADISWESDVEITGSSERxxxRLDDGGNFQLMSDPGAxxxxxxxxxMACLAVSAYTPWxVLPSVVGF
WITxxxxxxxxxxLWDTPSPKVYRKGDTATGVYRxxxxxxxxxxxxxxxxxxxxxxxxxxxxxxxxx
xxxxxxxxxxxxxxxxxxxCYGGPWKLQHRWNGHDEVQMIVVEPGEKTRNVQTKPGVxxxxxxxxxxx
xxxxxxxxxxxxxxxxxxxxxxxxxxxxxxxxxxxxxxxIVQGERMEEPVPSGFEPETLKKKQITVLxxx
xxxxxxxxILPQIIKEAMDRRLRTAVLAPTRVVTAEMAEALRGLPIRYQTSAVAREHxxxxxxxxxxx
xxxxxxxxxxxxxxxxxxxxxxxxxxxxxxxSIAARGYIATRVELGEAAAxxxxxxxxGSSDPFPKSNS
PIxxxxxxxxxxxxNSGYEWITEFVGKTVWFVPSxxxxxxxALCLQRAGKKIVxxxxxxxxxxxxxx
xxxxxxxxxxxxxxxxxxxxxxxxxxxxxxRKSVKPTSITEGESRVVLGEPSAIxxxxxxQRRGRIGRNPT
QVGDExxxGGHTNEDDSNYAHWTEARIMLxxxxxxxxxxxxxxxxxxxEKVHTMDGEYRLRGxxxxxxx
xxxxxxxLPVWLAYKAAAAGISYHDRRWCFDxxxxxxxxxxxxxxxxxxxxxxxxxxxxRPWWTDARVYS
DHQAxxxxKDFAAGKRSQIGFIEVLGRMPEHFMVKTWxxxxxxxxxATAEKGRRAHRMALEELPDALQ
TVALIALLGVMTMGVFLLLMQRKGIGKIGLGGIxLGAATLFCWMAEVPGTxxxxxxxxxxxxxxxxxx
xxxxxxxxxxxxxLAVFLICVMTPVSAVAANEMGWLDKTKNDMxxxxxxxxxxxxxxAEFFLDLRP
ATAWSLYAVTTAVLTPLIKHLITSxxxxxxxxxxNVQASTLFTLARGFPFxxxxxxxxxxxxxxxxxx
xxxxxxxxVLLFCHYAYMVxxxxxxxxxxxxxxxxxxxxxxxxxxxxxxxERATPVMQKKIG
```

FIG. 58-23

```
QIMLILVSLAALVVNPSVxTVREAGILITSASVTLWENxxxxxxxxxxxxxxxxxxRGGWLSCLSIAW
TLxKNLEKPVLKRGGAKxxxLGEAWKERLNQLTREEFTRYRKEAIIEVDRSAAQxARREGNITGGHPV
SRGSxxxxxxxxxRKFVEPIGKVIDLGCGRxxxxxxxxxxxxxxxxxxxxxxxxxxxxxxxxxxxxx
xxxxxKVDVFYRPSEVSDTLLCDxxxxxxxxxxEEHRTIRVLEIVEDWLxxxxxxxxxxxxxxxYMPKV
IEKMEILQRRYGGGLxxxxxxxxxxxHEMYWVSRASRNIVHAVNMTSQVxxxxMEKKTWKGAQYEEDAN
LGSGxxxVGRPLLSSDTSKIKxxxxxxxxxxxxxxxDGNHPYRTWNYHGSYEVNPLVSASSLxxxxx
xxxxxxxxxxxxxxxxxxxxxxxxxxxxxxxxxxxxTKAPEPPAGVKxVLKETTNWLWSHLERGKRPRM
CTREEFISKVNSNAALGAMFEEQNQWSSAREAVEDLKFWEMVDEERxxxxxxxxxxxxxxxxxxxx
xxxxxxxxxxxxxxxxxxxxxxxxxxxxxxxxxxxxxxxxxxxxxxxxxxxxxxxxxxxxxxGGR
TYADDTAGWDTxxxxxxxxxxxxxxxxxxEGEHRRLARAIIELTYRHKVVKGxRPAADGKTVMSLISRE
xxxxxxxxxxxxxxxxxxxxxxxxxVRMREGEGVIGPEDVExxxKRKGPKVRTWLFENGEERLGRMxxxx
xxxxxxxxxxRFASSLHFLNAMPKVxxxxxxxxxxxxxxxxxxxxxxxxxxxxxxxxxxxxxxxxx
xxxxxxxxxxxxxxxxxxxxxxxxxxxxxxxxxxxxxxxxxxxxxANAICSAVPVDWVPTGRTTWSIH
VRGEWMTTEDMLSVWNRVWIEENxxxxxxxxxxxxxxxxxxxxxxxxxxxxxxxxxRSRATWAENIQVA
INQVKAxxxxGKYVDYMSSLRRYEExx >WNV|peptide_length:11|string5 xxxxxxxxxxxRAVNMLKRGTPRVMSLIGLKRAMxxxxxxxxxxxxxxxxxxxxxxxxxxxxxRAVLER
WRGVNKQxxxxxxxxSFKKELGILTNAINRRSSKEKKRGGxxxxxxxxxxxxxxxGSVTLSNFQGKLMMT
VNATDxxxVITIPPAAGKNLCTVRAMDVGFLCDDTITYECxxxxxxxxxEDIDCWCTKSPVYVRYGRC
TKxxxxxxxxxxxxTVQTHGKSTLVNKKGAWLDSTxxxxxxxxxxxxxxxxxxxxxxxxxxxxxxxx
MQRVVFIVLLLLVAPAYxxxxxxxxxxxxxxxxxxxxxxxxxxxxxxxxxxxxxxxxxxxxxxxxx
xxxxxxxxxxxxxxxxVSELSTKAACPTMGDAHNDKRADPxxxxxxxxxxxxxxxxxxxxxxxxCAK
FACTSKATGWxxxxxxxxxxxxxxxxxxxxxxxxxxxxxGATQAGRFTVSPSAPTxxxKLGGYGEV
TVDxxxxxGIDTNAYYVMSVGxxxxxxxxxxxxxxxLNMPWSSAAGTxxxxxxxxxxxxxxxxxxx
xxxxxxxxHQALAGAIPLExxxxxxxxxxxxxxxxxxxxxxxxxxxxxxxxxxxxxxxxxxxxxx
xxxxxxxxxxxxxxxxxxxxxxxxxxxxxxxxxxxxxxVTVNPFVSVATADAKVLIELExxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxARDKSIAMTFLAVGGILLFLSANxHADTGCAIDVSRQELRCGxxxxxxNDV
KAWMDRYKYYPETPQGLARIxxxxxxxxxxxxxxSRLEHQMWDSVKDELNTLLKENGVDLTVVVEKQ
xxxxxxxxxxxATTEKFEIGWKAWxxxxxxASELANHTFVVDGPETEECPxxxxxxxxxxxxxxxx
xxxxxxxxxxxxxxxxxxxxxxxxxxxxxxxxxxxxxxxxxLNHTWKLERAVxxxxxxxxxxxxxETH
TLWGDGVIESDLIIPVTLAGPRSNYNxxxxxxxxxxxxxxxxxxxxxxxxxxxxxxxxxxCGHRGPS
ARTTTxxxxxxxxxxxxxxxCTLPPLRYTTExxxxxGMEIRPLRHDGKTLVQSRVSAYKSDMIDxxxLGL
LVVFLVTQEVLRRRWTAKISMPAILLALLVLVFGGITYTDVLRYIILxxxxxxxxxxxxxxxxxxxx
xxxIQPVFVVASFLKARWTNQENTLLMLAAAFFQMAYHDAxxxxxxxxxxxxxxxAIAWMILRAITFP
TTSNVVVPLLxxxxxRLRCLNLDVSRILLLMIGIGSLIREKKNSAAKKKGAxxxxxxxxxxxFSPLV
LAAGLVACDPNRKRGWxxxxxxxxxxxxxxxxxxxxxxxxxxxxxxxxxxxxxxxxxxxxxxxxI
ERTADISWENDAEITGSSERxxxRLDDDGDFQLMxxxxxxxxxxxxxMFCLAISAYTPWxxxxxxxxx
xxxxxxxxxxxLWDTPSPKEYRKGDTATGVxxxxxxxxxxxxxxxxxxxxxxxxxxxxxxxxxxxx
xxxxxxxxxxxxxxxxxxxxxxxxxxxPWKLQCKWNGQDEVQMxxxxxxxxxxxxxxxxxxxxxxx
xxxxxxxxxxxxxxxxxxxxxxxxxxxxxxxQGERMEEPPPVGFESEMLRKKQITVxxxxx
xxxxxxxxxLPQIIKEAINRRLRTAILAPxxxxxxxxxxxxxxLPIRYQTSAVNREHxxxxxxxxx
xxxxxxxxxxxxxxxxxxxxxxxxxxxxxxxxxxxxxxxxxxxxxxxxxxxxxxxxxxxxxxxxx
xxxxxxxxxxxNAGYEWITEFVGxxxxxxxxxxxxxxxLCLQRAGKRVIxxxxxxxxxxxxxxxxx
xxxxxxxxxxxxxxxxxxxxxxxxxxITDGEGKVVLSEPSAIxxxxxxxxxxxxxxxxxxxxxxxx
xxxxxxxxxxxxFAHWTEARIMPxxxxxxxxxxxxxxxxxxxxxxxxxxxxxxxxxxxxxxxxxx
xxxxxxxxxxWLAYKAAAAGVSYHDRKWxxxxxxxxxxxxxxxxxxxxxxxxxxxxxxxxxxxxxx
xxxxxxxxxxFASGKRSQMGLIEVLGKMPxxxxxxxxxxxxxxxxxTAEKGRRAHRMALxxxxxxxx
```

FIG. 58-24

```
xxxxxxxxxxVMSMGVFFLLMQRKGVSKIGLAGVxIGVATLFCWMAEVxxxxxxxxxxxxxxxxxxxxxx
xxxxxxxxxxxxLAVFMICVMTLVxxxxxxxxxxxxxxxxxxxxxxxxxxxxxxxxxGDLLLDLKP
ATAxxxxAVTTAFLTPLLKHLITxxxxxxxxxxxxxxxxxxxxxxxxxxxxxxxxxxxxxxxxxx
xxxxxxxxxILLFCHYAYMVxxxxxxxxxxxxxxxxxxxxxxxxxxxxxxxxxxxxPIMQKKIG
QIMLIWVSLAAVVVNPxxxxxxxxxxxxITAAAVTLWEKxxxxxxxxxxxxxxxxxxRGGWLSCFSITW
xxxKNMEKPVLKRGGAxxxxLGEVWKEKLNQMTKEEFARYRKEAIIEVDRSTAKxARKEGNVTGGYxx
xxxxxxxxxxxxxxxxxxxxxxxxxxxxxxxxxxxxxxxxxxxxxxxxxxxxxxxxxxxxxxxxxx
xxxxxGVDVFYRPSESCDTLLCDxxxxxxxxxxxxxxxxxxxxxxxxxxxxxxxxxxxxYMPRV
IEKMELLQLRYxxxxxxxxxxxxxxxMYWVSQASGNIVHxxxxxxxxxxxxMEKKTWKGPHYEEDVN
LGSxxxxxGKPLLNSDTSRIKxxxxxxxxxxxxxxxxxDVNHPYRTWNYHxxxxxxxxxxxxxxxxxx
xxxxxxxxxxxxxxxxxxxxxxxxxxxxxxxxxxxxxxxxxxxxxxxxxxxxxxxxxxxxxREKKPRL
CSREEFKRKVNSxxxxxxx

FIG. 59-1

>YFV|peptide_length:8|string1

MSGRKAQGKTLGVNMVRRGVRSLSNKIKQKTKQIGNRPGPSRGVQGFIFFFLFNILTGKKITAHLKRL
WKMLDPRQGLAVLRKVKRVVASLMRGLSSRKRRSHDVLTVQFLILGMLLMTGGVTLVRKNRWLLLNVT
SEDLGKTFSVGTGNCTTNILEAKYWCPDSMEYNCPNLSPREEPDDIDCWCYGVENVRVAYGKCDSAGR
SRRSRRAIDLPTHENHGLKTRQEKWMTGRMGERQLQKIERWFVRNPFFAVTALTIAYLVGSNMTQRVV
IALLVLAVGPAYSAHCIGITDRDFIEGVHGGTWVSATLEQDKCVTVMAPDKPSLDISLETVAIDRPAE
VRKVCYNAVLTHVKINDKCPSTGEAHLAEENEGDNACKRTYSDRGWGNGCGLFGKGSIVACAKFTCAK
SMSLFEVDQTKIQYVIRAQLHVGAKQENWNTDIKTLKFDALSGSQEVEFIGYGKATLECQVQTAVDFG
NSYIAEMETESWIVDRQWAQDLTLPWQSGSGGVWREMHHLVEFEPPHAATIRVLALGNQEGSLKTALT
GAMRVTKDTNDNNLYKLHGGHVSCRVKLSALTLKGTSYKICTDKMFFVKNPTDTGHGTVVMQVKVSKG
APCRIPVIVADDLTAAINKGILVTVNPIASTNDDEVLIEVNPPFGDSYIIVGRGDSRLTYQWHKEGSS
IGKLFTQTMKGVERLAVMGDTAWDFSSAGGFFTSVGKGIHTVFGSAFQGLFGGLNWITKVIMGAVLIW
VGINTRNMTMSMSMILVGVIMMFLSLGVADQGCAINFGKRELKCGDGIFIFRDSDDWLNKYSYYPED
PVKLASIVKASFEEGKCGLNSVDSLEHEMWRSRADEINAIFEENEVDISVVVQDPKNVYQRGTHPFSR
IRDGLQYGWKTWGKNLVFSPGRKNGSFIIDGKSRKECPFSNRVWNSFQIEEFGTGVFTTRVYMDAVFE
YTIDCDGSILGAAVNGKKSAHGSPTFWMGSHEVNGTWMIHTLEALDYKECEWPLTHTIGTSVEESEMF
MPRSIGGPVSSHNHIPGYKVQTNGPWMQVPLEVKREACPGTSVIIDGNCDGRGKSTRSTTDSGKVIPE
WCCRSCTMPPVSFHGSDGCWYPMEIRPRKTHESHLVRSWVTAGEIHAVPFGLVSMMIAMEVVLRKRQG
PKQMLVGGVVLLGAMLVGQVTLLDLLKLTVAVGLHFHEMNNGGDAMYMALIAAFSIRPGLLIGFGLRT
LWSPRERLVLTLGAAMVEIALGGVMGGLWKYLNAVSLCILTINAVASRKASNTILPLMALLTPVTMAE
VRLAAMFFCAVVIIGVLHQNFKDTSMQKTIPLVALTLTSYLGLTQPFLGLCAFLATRIFGRRSIPVNE
ALAAAGLVGVLAGLAFQEMENFLGPIAVGGLLMMLVSVAGRVDGLELKKLGEVSWEEEAEISGSSARY
DVALSEQGEFKLLSEEKVPWDQVVMTSLALVGAALHPFALLLVLAGWLFHVRGARRSGDVLWDIPTPK
IIEECEHLEDGIYGIFQSTFLGASQRGVGVAQGGVFHTMWHVTRGAFLVRNGKKLIPSWASVKEDLVA
YGGSWKLEGRWDGEEEVQLIAAVPGKNVVNVQTKPSLFKVRNGGEIGAVALDYPSGTSGSPIVNRNGE
VIGLYGNGILVGDNSFVSAISQTEVKEEGKEELQEIPTMLKKGMTTILDFHPGAGKTRRFLPQILAEC
ARRRLRTLVLAPTRVVLSEMKEAFHGLDVKFHTQAFSAHGSGREVIDAMCHATLTYRMLEPTRVVNWE
VIIMDEAHFLDPASIAARGWAAHRARANESATILMTATPPGTSDEFPHSNGEIEDVQTDIPSEPWNTG
HDWILADKRPTAWFLPSIRAANVMAASLRKAGKSVVVLNRKTFEREYPTIKQKKPDFILATDIAEMGA
NLCVERVLDCRTAFKPVLVDEGRKVAIKGPLRISASSAAQRRGRIGRNPNRDGDSYYYSEPTSENNAH
HVCWLEASMLLDNMEVRGGMVAPLYGVEGTKTPVSPGEMRLRDDQRKVFRELVRNCDLPVWLSWQVAK
AGLKTNDRKWCFEGPEEHEILNDSGETVKCRAPGGAKKPLRPRWCDERVSSDQSALSEFIKFAEGRRG
AAEVLVVLSELPDFLAKKGGEAMDTISVFLHSEEGSRAYRNALSMMPEAMTIVMLFILAGLLTSGMVI
FFMSPKGISRMSMAMGTMAGCGYLMFLGGVKPTHISYIMLIFFVLMVVVIPEPGQQRSIQDNQVAYLI
IGILTLVSAVAANELGMLEKTKEDLFGKKNxxIPSSASPWSWPDLDLKPGAAWTVYVGIVTMLSPMLH
HWIKVEYGNLSLSGIAQSASVLSFMDKGIPFMKMNISVIMLLVSGWNSITVMPLLCGIGCAMLHWSLI
LPGIKAQQSKLAQRRVFHGVAKNPVVDGNPTVDIEEAPEMPALYEKKLALYLLLALSLASVAMCRTPF
SLAEGIVLASAALGPLIEGNTSLLWNGPMAVSMTGVMRGNHYAFVGVMYNLWKMKTGRRGSANGKTLG
EVWKRELNLLDKQQFELYKRTDIVEVDRDTARRHLAEGKVDTGVAVSRGTAKLRWFHERGYVKLEGRV
IDLGCGRGGWCYYAAAQKEVSGVKGFTLGRDGHEKPMNVQSLGWNIITFKDKTDIHRLEPVKCDTLLC
DIGESSSSSVTEGERTVRVLDTVEKWLACGVDNFCVKVLAPYMPDVLEKLELLQRRFGGTVIRNPLSR
NSTHEMYYVSGARSNVTFTVNQTSRLLMRRMRRPTGKVTLEADVILPIGTRSVETDKGPLDKEAIEER
VERIKSEYMTSWFYDNDNPYRTWHYCGSYVTKTSGSAASMVNGVIKILTYPWDRIEEVTRMAMTDTTP
FGQQRVFKEKVDTRAKDPPAGTRKIMKVVNRWLFRHLAREKNPRLCTKEEFIAKVRSHAAIGAYLEEQ
EQWKTANEAVQDPKFWELVDEERKLHQQGRCRTCVYNMMGKREKKLSEFGKAKGSRAIWYMWLGARYL
EFEALGFLNEDHWASRENSGGGVEGIGLQYLGYVIRDLAAMDGGGFYADDTAGWDTRITEADLDDEQE
ILNYMSPHHKKLAQAVMEMTYKNKVVKVLRPAPGGKAYMDVISRRDQRGSGQVVTYALNTITNLKVQL
IRMAEAEMVIHHQHVQDCDESVLTRLEAWLTEHGCNRLKRMAVSGDDCVVRPIDDRFGLALSHLNAMS
KVRKDISEWQPSKGWNDWENVPFCSHHFHELQLKDGRRIVVPCREQDELIGRGRVSPGNGWMIKETAC

FIG. 59-2

LSKAYANMWSLMYFHKRDMRLLSLAVSSAVPTSWVPQGRTTWSIHGKGEWMTTEDMLEVWNRVWITNN
PHMQDKTMVKKWRDVPYLTKRQDKLCGSLIGMTNRATWASHIHLVIHRIRTLIGQEKYTDYLTVMDRY
SVDADLQLGELI

>YFV|peptide_length:8|string2 xxxxxxxxxxxxVNMVRRGARSLSNKIxxxxxxQIGNRPGLSRGVQGFISFFSFNILTGKKLTTHLKRL
WRMLDPRQGLAALRKVKRVVAGLMIGLSSRKRRSNEMAMMPLLILSMVLMAGGVTLMRKNRWLLLNVT
AEDLGKTFSVGAGNCTTNIxxxxxxxxxxxxxxxxxxxxxxxxxxxxxxxGVENVRVAYGRCDAVGR
SKRSRRAIDxxxxxxxxxxxTRQEKWMAGRMGERQLQKIERWLVRNPFFAVTALAIAYLVGNNTTQRVV
IAxxxxxxxxxYSAHCIGVADRDFIEGxxGGTWVSASLEQGKCVTVMAxxxPSLDISLETVAIDGPAE
ARKVCYSAVLTHVKIDDKCPSTGxAHLAEENDGDNACKRxxxxxxxxxxxxxxxxxxxxxxxxxxxxx
xxxxxxxxxTKIQYVIRARLHVGAKQENWTTSIKTLKFDALSGSQEAEFTGYGKATLECRVQTAVDFx
xSYIAEMEKDSWIVDRQxxxxxxxxxWQSGSGGIWRGMHHLVEFEPPHAVTIRVLALGDQEGSLKTxxx
xAMRVTKDENDNNLYKxxxxxxxxxxxxxxxxxLKGTSYKMCTDKMSFVKNPTDTDHGTVVMQVKVPKG
APCKIPVIVADDLTAAVNKGILVTxxxxxxxxxxxxxxxxxxxxxxxFGDSYIIVGTGDSRLTYxxxxxxxxx
xxxxFTQTMKGAERLAVMGDAAWDFSSAGGLLTSIGKGSHTVFGSAxQGLFGGLSWITKVIIGVVLIW
VGFNTRNMTMSMSMIMVGVIMMFxxxxxGADQGCAVNFAKRELKCGDGIFVFRDSDDWLTKYSYYPEx
PVKLASIIKASHEEGKCGLNSVDSLDHEMWRSRADEINAILEENEVDISIVVQDPKNIYQRGTHPxxx
xxxxxxxxGWKTWGKNLIFSPGRKNxxxxxxxxxxxxxxxxxxxxxxFQIEEFGMGVFTTRVFMDAVFD
YSVDCDGAILGAAVNxxxxxxxxxxxxxxxxxxEVNGTWMIHTLETLDYKECEWPPTHTIGTSVEESDMF
MPRSIxGPVSSHNRIPGYKVQxxxxxMQVPLEVRREPCPGTSVVVDTGCDGRGKSARSTTDSGKIIPE
WCCRxxxxPPVSFHGNDGCWYPMEIRPMKASDSHLVRSWVTAGEVHAVPFGLVSMMIAMEVVLRKRQG
PKQMLVGGIILLGAMLVGQVTVLDLVKLIMAVGLHFHEINNGGDAMYMALIASFSVRPGLLMGFGLRT
LxSPRERLVMAFGAAMVEIALGGMMGGLWQYLNAVSLCVLTINAISSRKASNAVLPLMALLTPVTMAE
VRLATMLFCTVVIIGVLHQNSKDTSMQKTIPIVALTLTSYMGLTQPFLGLCAYMSTQVFGRRSIPVNE
ALAATGLVGVLAGLAFQDMENFLGPIAVGGILMMLVSVAGKVDGLELRKLGEIAWEEEAEISGSSSRY
DVALNEQGEFKLLSEDKVPWDQIVMTSLALVGAAIHPFALLLVLAGWLLHIKRARRSGDVxWDIPTPK
VIEECEHLEDGISGIFQSTFxxxxxxxxxxxxxxxxxxxxxxxxVTRGAFLLRNGKKLVPSWASVKxxxxx
YGGSWKLDGKWDGEEEVQLIAAVPGKAVVNVQTKPSVFRVKNGGEIGAxxxxxxxxxxxGSPIVNRSGE
VVGLYGNGIxxxxxxxxxSAISQTEVKEEGKEELREIPTMLKKGMTTVLDYHPGAGKTxxxxxxxxxxx
xxxxxxxxxxxxxxxSEMKEAFQGLDVKFHxxxFSAHGSGKEVIDVMCHATLTxRMLEPTRIVNWE
VIIxxxxxxxxxxxxxxxxxxxxxxxxxxxxxxxxxxxxxxxxDIPSEPWTSG
HEWILADKRxxxxxxxxxxxxxxxxxxxxSLRKAGKNVVVLNRKTFEKEYPTIKQKRPDFILATxxxxMGA
NLCVDRVLDCRTAYKPVLVDEGKKVAIKGPxxxxxxxxxxxxxxxxxxxxxxYSEPTSEDNAH
HVCWxxxxxxxxxxxxxMVAPLYGIEGIKTPVSPGxxRLRDDQRRVFRELVRGCDLPVWLSWQVAK
PGLKTNDRKWCFDGPKEHEILNDNGETVKCRSPGGAKKALRPRWCDxxxSSDQSALADFIKFAEGRRG
AAEMLVVLTELPDFLAxxxxxAMDTISVLLHSEEGSxxxxxxxxxMPEAMTIVMLFLLAGLLTSGAVI
FFMSPKGMSRMSMAMGTMAGSGYLMFLGGVKPTHISYVMLIFFVLMVVIIPEPGQQRTIQDNQVAFLI
IGILTLVSVVAANELGMLEKTKEDLFGKKDxxTSGGTIPWSWPDLxxxxxxxxxxVYVGIVTILSPMLH
HxxxxxxxxxxxxxxxxxxxxLSFMDKGVPFMKMNISVIILLISGWNSITVIPLLCGVGGAMLHWTLI
LPGIKAQQSKLAQKRVFHGVAENPVVDGNPTADIEEAPEMPVLYEKKLAxxLLLALSLMSVAMCRTPF
SLAEGIVLASAASGPLIEGNxxxxxxxxxxxxxxTGVMRGNYYAFVGVMYNLWKMETGRRGRASGKTLG
EVxxRELNLLDKRQFELYKRTDITEVDRDMARRHLAExxxxxxxxxxxxxxxxxxxxxxxVKLEGRV
TDLGCGRGxxxxxxxxxxEVSGVKGYTLGREGHEKPMNVQSLGWNIVTFKDKTDVHRLEPAKCETLLC
DIGESSPSSVTEGERTMRVLETIEKWLACGVDNFCIKVLAPYMPDVIEKLELLQRRFGGTIIRNPLSR
xxxxxxxxVSGARSNITFTVNQTxxxxxxxxxxxxTGKVTLEPDVTLPIGTRSxETDKGPLDRDAIKER
VERIKSEYMTTWFHDNDNPYRxWHYCGSYITKTSGSAASMINGVIKILTFPWDKIEEVTRMxxxxxxx
xxxxxxxxxxxxxxxxxAGTRKIMRVVNRWLFRHLAREKSPRLCTKExxxxKVRSHAAVGAFLEEQ
DQWKTANExxQDPKFWEMVDAERRLHQQGRCQSCVYNMMGxxxxxxxxxxxxxxxxxxxxxYMWLGARFL

FIG. 59-3

```
EFEALGxxxxxxxxxxxxxSGGGVEGTGLQYLGYVIKDLSTKEGGGLYADDTAGxxxxxxxxxxLDDEQE
IMSYMNAEQRKLAWAIMEMTYKNxVVKVLRPAPGGKAFMDIISRRDQRGSRQVVTYALxxxxxxxxxx
IRMAEAEMVINHQHVQECDESALARLDAWLTEHGCDRLARMAVSGDDCVVRPVDDRFGMALSHLNAxx
xxxxxxSEWQPSKEWTDWESVPFCSHHFHELVLKDGRKVVVPCRDQDELIGRxxxxxxxxxxxxxxxx
xxxxxxxxxxxxxxxxRDMRLLSFAVSSAVPTAWVPSGRTTWSVHGKGEWMTTEDMLDVWNRVWVLNN
PHMQDKTMVKEWRDVPYLxxxxxxxxxxxxxxxNRATWASNIHLVIHRIRTLVGQEKFTDYLTVMxxx
SVDADLQPGELI >YFV|peptide_length:8|string3 xxxxxx

FIG. 59-4

```
xxxxxxxxxxxxxxxxxxxxxxxxxxxxxxxxxxxxxxxxVTLEADVTLPIGxxxxxTDKGPLNREAIKER
VERIKTEYAATWFHDNDNxxxxxxxxxxxxxxxxxxxxxxxMVNGVIKILTYPWDKIEExxxxxxxxxxx
xxxxxxxxxxxxxxxxxxxxxxxxxxxxxxxxxxxxxxxxRHLAREKKPRLCTKExxxxxxxxSHAAIGAYLEEQ
DQWxxxxxxxxxxxxxxELVDEERRLHQQxxxxxxxxxxxxxxxxxxxxxxxxxxxxxxxxxxxxxxx
xxxxxxxxxxxxxxxxxxxxxxxxxxxxxxxxxxGYVIRDLSAMDGGGLYADxxxxxxxxxxxxxxxxxxxQE
IMSYMSPEQRKLAWAIMEMTYxxxxxxxxxxPTPGGKAYMxxxxxxxxxxxxxxxxxxxxxxxxxxxxx
xxxAEAENVINHQHVQDCDDSTLARLEAWLAENGCDRLRRMAVNGDDCVVKPIDDRFGMAxxxxxxxxx
xxxxxxxxWQPSKGWTDWENVPFCSHHFHELHLKDGRKIVVPCRDQxxxxxxxxxxxxxxxxxxxxxxx
xxxxxxxxxxxxxxxxxxxxxxxxxxxxVSSAVPMAWVPSGRTTWSVHGRGEWMTTEDMLGVWNRVWVLNN
PHMQDKTVIKEWRDVPxxxxxxxxxxxxxxxxxxxxxxxxxxxxxIHRIRTLIGQEKFTDxxxxxxxxx
xxxxxxxxxxxx >YFV|peptide_length:8|string4 xxxxxxxxxxxxxxxxxxxxxxxxxxxxxxxxxxxxxxxxxxxxxxxxxxxxxxTGKKLTAQLKRL
WKMxxxxxxxxxxxxxxxxxxxxxxxxxxxxRKRRSSEMTTVPLLLLGLLILGGGVTLVRxxxxxxxxxx
xxDLGKTFSIGTGNCTTxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxAYLVGNNMTQRVV
xxxxxxxxxxxxxxxxxxxxxxxxxxxxxxxxxxxxxxxxxxxxxxxxxxxxxxxxxxxAIDGPVE
ARKVxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxGAKQENWKTDIKTLKxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxWMVHTLETLDxxxxxxxxxxxxxxxxxxxxxx
xxxxxxxxxxxxxxxxxxxxxxxxxxxxxxPLEVKREVCPGTSVVVDTGCDGRGKxxxxxxxxxxxxxx
xxxxxxxxxxxxxxxxxxxxxxxxxxxxEIRPRKAHESHLxxxxxxxxxxxxxxxxxxxxxxxxxxxxx
xKQMLVGGMVLxxxxxxxxVTLLDLLEFTMAVGLHFxxxxxxxxxxxxxxxxxxxSIRPGLLVGxxxxx
xxxxxxxxxxxxxxxxxxxxxxxxxxxxxxxxxxxxxxxxxxxxSSRKASNAVLPLMALMTPMTMYE
VRMAAMLLCAVVIVGVLYQNSKDTSxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxLKKLGEVAWxxxxxxxxxxxx
xxxxxxxxxxxxxxxxxxxxxxxxxxxxxxxxxxxxxxxxxxxxGGWLFHVRRARRSGxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxIAAVPGKSVVNxxxxxxxxxxxxxxxxxxxxxxxxxxxxxxxxxxxxx
xxxxxxxxxxxxxxxxxxxxxxxxxxxxxxxxxxxxxxxxxxxxGMTTILDYHxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxRAPGGAKRPLRPRWCxxxxxxxxxxxxxxxxxxxxxGRRG
AADILVVLSELxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xGILTLLSIVAANExxxxxxxxEDFFGRRNxxISSGASPWSWPxxxxxxxxxxxxxxxxxxxxxxxxxx
xxxxxxxxxxxxxxxxxxxxxxxxxxxxxxxxxxxxISVIMLLISGWxxxxxxxxLCGIGCATLHWSLx
xxxxxxxxxxxxxxxxxxxxxxxxxxxxxxxxxxxxxxxxxxxxxxxxxxxxxxxxxxxxxxxxxxxx
```

FIG. 59-5

```
xxxxxxxxxxxxxxxxxxxxxxxxxxxxxxxxxxxxxxxxxxxxxxNLWKMKTARRGSASGKTLG
xxxxxxxxxLDKQQFEMYKxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxKDKTDIHHLEPMKCDTLLC
xxGESSSSSATEGERTLRVLDTVExxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxGAIEER
VExIKNEYAATWFHDNDxxxxxxxxxxxxxxxxxxxxxxxxxxxxxLLTYPWDKxxxxxxxxxxxx
xxxxxxxxxxxxxxxxxxxxxxxxxxxxxxxxxxxxxxRHLSREKNPRLxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxAAMDGGGLYxxxxxxxxxxxxxxxxxE
ILNYMSSHHKKLAQxxxxxxxxxxxxxxxxxxxxxxxxxxxxxxxxxxxxxxxxxxxxxxxxxxxx
xxxxxAEMVIHHHHVNECGENVLERLETWLIEHGCDRLNRMAVNGDxxxxxxxxxxxxxxxxxxxx
xxxxxxxxxxxxKGWTDWESVxxxSHRFHELVLKDGRKIxxxxxxxxxxxxxxxxxxxxxxxxxxx
xxxxxxxxxxxxxxxxxxxxxxxxxxxxxxxxxxxxxxxxxxxxxxMTTQDRLEVWNRVxxxxx
PHMKDKTTVKEWRDVxxxxxxxxxxxxxxxxxxxxxxxxxxxxxxxxxxxxNLIGQEKYxxxxxxxxxx
xxxxxxxxxxx >YFV|peptide_length:8|string5 xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxLFPLLLLGxxALTGGVTLMRxxxxxxxxxx
xxxxGKTFSMGTGNCTTxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxKQEDWKTDIKTxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxLTMAVGLHxxxxxxxxxxxxxxxxxxxxxxxxxxxxx
xxxxxxxxxxxxxxxxxxxxxxxxxxxxxxxxxxxxxxxxxxSSRKASNAxxxxxxxxxxxxxxxx
VRLATMLLCAVVIVGVLHQNAxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxGWILHIKGARxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxRSPGGAKRAxxxxxxxxxxxxxxxxxxxxxxxxG
AAEMLVILTExxxxxxxxxxxxxxxxxxxxxxxxxxxxxxxxxxxxxxxxxxxxxxxxxxxxxxx
```

FIG. 59-6

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxEDFFGKRNxxIPSGAIPWSxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxTDVHPLESVKCDTLLx
xxxxxxxxxITEGERTLRVLETVExxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxEYAATWFHDNxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxHVNECDEGVLVRLEAWLIxxxxxRLSRMAVSGDxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxMTTEDRLEVWNxxxxxxx
xxxTDKTTIKEWRDVxxxxxxxxxxxxxxxxxxxxxxxxxxxxxxxxxxxxxxxxxxxxxxxxx
xxxxxxxxxxxx >YFV|peptide_length:9|string1

MSGRKAQGKTLGVNMVRRGVRSLSNKIKQKTKQIGNRPGPSRGVQGFIFFFLFNILTGKKITAHLKRL
WKMLDPRQGLAVLRKVKRVVASLMRGLSSRKRRSHDVLTVQFLILGMLLMTGGVTLVRKNRWLLLNVT
SEDLGKTFSVGTGNCTTNILEAKYWCPDSMEYNCPNLSPREEPDDIDCWCYGVENVRVAYGKCDSAGR
SRRSRRAIDLPTHENHGLKTRQEKWMTGRMGERQLQKIERWFVRNPFFAVTALTIAYLVGSNMTQRVV
IALLVLAVGPAYSAHCIGITDRDFIEGVHGGTWVSATLEQDKCVTVMAPDKPSLDISLETVAIDRPAE
VRKVCYNAVLTHVKINDKCPSTGEAHLAEENEGDNACKRTYSDRGWGNGCGLFGKGSIVACAKFTCAK
SMSLFEVDQTKIQYVIRAQLHVGAKQENWNTDIKTLKFDALSGSQEVEFIGYGKATLECQVQTAVDFG
NSYIAEMETESWIVDRQWAQDLTLPWQSGSGGVWREMHHLVEFEPPHAATIRVLALGNQEGSLKTALT
GAMRVTKDTNDNNLYKLHGGHVSCRVKLSALTLKGTSYKICTDKMFFVKNPTDTGHGTVVMQVKVSKG
APCRIPVIVADDLTAAINKGILVTVNPIASTNDDEVLIEVNPPFGDSYIIVGRGDSRLTYQWHKEGSS
IGKLFTQTMKGVERLAVMGDTAWDFSSAGGFFTSVGKGIHTVFGSAFQGLFGGLNWITKVIMGAVLIW
VGINTRNMTMSMSMILVGVIMMFLSLGVGADQGCAINFGKRELKCGDGIFIFRDSDDWLNKYSYYPED
PVKLASIVKASFEEGKCGLNSVDSLEHEMWRSRADEINAIFEENEVDISVVVQDPKNVYQRGTHPFSR
IRDGLQYGWKTWGKNLVFSPGRKNGSFIIDGKSRKECPFSNRVWNSFQIEEFGTGVFTTRVYMDAVFE
YTIDCDGSILGAAVNGKKSAHGSPTFWMGSHEVNGTWMIHTLEALDYKECEWPLTHTIGTSVEESEMF
MPRSIGGPVSSHNHIPGYKVQTNGPWMQVPLEVKREACPGTSVIIDGNCDGRGKSTRSTTDSGKVIPE
WCCRSCTMPPVSFHGSDGCWYPMEIRPRKTHESHLVRSWVTAGEIHAVPFGLVSMMIAMEVVLRKRQG
PKQMLVGGVVLLGAMLVGQVTLLDLLKLTVAVGLHFHEMNNGGDAMYMALIAAFSIRPGLLIGFGLRT
LWSPRERLVLTLGAAMVEIALGGVMGGLWKYLNAVSLCILTINAVASRKASNTILPLMALLTPVTMAE
VRLAAMFFCAVVIIGVLHQNFKDTSMQKTIPLVALTLTSYLGLTQPFLGLCAFLATRIFGRRSIPVNE
ALAAAGLVGVLAGLAFQEMENFLGPIAVGGLLMMLVSVAGRVDGLELKKLGEVSWEEEAEISGSSARY
DVALSEQGEFKLLSEEKVPWDQVVMTSLALVGAALHPFALLLVLAGWLFHVRGARRSGDVLWDIPTPK
IIEECEHLEDGIYGIFQSTFLGASQRGVGVAQGGVFHTMWHVTRGAFLVRNGKKLIPSWASVKEDLVA
YGGSWKLEGRWDGEEEVQLIAAVPGKNVVNVQTKPSLFKVRNGGEIGAVALDYPSGTSGSPIVNRNGE
VIGLYGNGILVGDNSFVSAISQTEVKEEGKEELQEIPTMLKKGMTTILDFHPGAGKTRRFLPQILAEC
ARRRLRTLVLAPTRVVLSEMKEAFHGLDVKFHTQAFSAHGSGREVIDAMCHATLTYRMLEPTRVVNWE
VIIMDEAHFLDPASIAARGWAAHRARANESATILMTATPPGTSDEFPHSNGEIEDVQTDIPSEPWNTG
HDWILADKRPTAWFLPSIRAANVMAASLRKAGKSVVVLNRKTFEREYPTIKQKKPDFILATDIAEMGA
```

FIG. 59-7

NLCVERVLDCRTAFKPVLVDEGRKVAIKGPLRISASSAAQRRGRIGRNPNRDGDSYYYSEPTSENNAH
HVCWLEASMLLDNMEVRGGMVAPLYGVEGTKTPVSPGEMRLRDDQRKVFRELVRNCDLPVWLSWQVAK
AGLKTNDRKWCFEGPEEHEILNDSGETVKCRAPGGAKKPLRPRWCDERVSSDQSALSEFIKFAEGRRG
AAEVLVVLSELPDFLAKKGGEAMDTISVFLHSEEGSRAYRNALSMMPEAMTIVMLFILAGLLTSGMVI
FFMSPKGISRMSMAMGTMAGCGYLMFLGGVKPTHISYIMLIFFVLMVVVIPEPGQQRSIQDNQVAYLI
IGILTLVSAVAANELGMLEKTKEDLFGKKNxxIPSSASPWSWPDLDLKPGAAWTVYVGIVTMLSPMLH
HWIKVEYGNLSLSGIAQSASVLSFMDKGIPFMKMNISVIMLLVSGWNSITVMPLLCGIGCAMLHWSLI
LPGIKAQQSKLAQRRVFHGVAKNPVVDGNPTVDIEEAPEMPALYEKKLALYLLLALSLASVAMCRTPF
SLAEGIVLASAALGPLIEGNTSLLWNGPMAVSMTGVMRGNHYAFVGVMYNLWKMKTGRRGSANGKTLG
EVWKRELNLLDKQQFELYKRTDIVEVDRDTARRHLAEGKVDTGVAVSRGTAKLRWFHERGYVKLEGRV
IDLGCGRGGWCYYAAAQKEVSGVKGFTLGRDGHEKPMNVQSLGWNIITFKDKTDIHRLEPVKCDTLLC
DIGESSSSSVTEGERTVRVLDTVEKWLACGVDNFCVKVLAPYMPDVLEKLELLQRRFGGTVIRNPLSR
NSTHEMYYVSGARSNVTFTVNQTSRLLMRRMRRPTGKVTLEADVILPIGTRSVETDKGPLDKEAIEER
VERIKSEYMTSWFYDNDNPYRTWHYCGSYVTKTSGSAASMVNGVIKILTYPWDRIEEVTRMAMTDTTP
FGQQRVFKEKVDTRAKDPPAGTRKIMKVVNRWLFRHLAREKNPRLCTKEEFIAKVRSHAAIGAYLEEQ
EQWKTANEAVQDPKFWELVDEERKLHQQGRCRTCVYNMMGKREKKLSEFGKAKGSRAIWYMWLGARYL
EFEALGFLNEDHWASRENSGGGVEGIGLQYLGYVIRDLAAMDGGGFYADDTAGWDTRITEADLDDEQE
ILNYMSPHHKKLAQAVMEMTYKNKVVKVLRPAPGGKAYMDVISRRDQRGSGQVVTYALNTITNLKVQL
IRMAEAEMVIHHQHVQDCDESVLTRLEAWLTEHGCNRLKRMAVSGDDCVVRPIDDRFGLALSHLNAMS
KVRKDISEWQPSKGWNDWENVPFCSHHFELQLKDGRRIVVPCREQDELIGRGRVSPGNGWMIKETAC
LSKAYANMWSLMYFHKRDMRLLSLAVSSAVPTSWVPQGRTTWSIHGKGEWMTTEDMLEVWNRVWITNN
PHMQDKTMVKKWRDVPYLTKRQDKLCGSLIGMTNRATWASHIHLVIHRIRTLIGQEKYTDYLTVMDRY
SVDADLQLGELI

>YFV|peptide_length:9|string2 xxxxxxxxxxGVNMVRRGARSLSNKIKxxxKQIGNRPGLSRGVQGFISFFSFNILTGKKLTTHLKRL
WRMLDPRQGLAALRKVKRVVAGLMIGLSSRKRRSNEMAMMPLLILSMVILAGGVTLMRKNRWLLLNVT
AEDLGKTFSVGAGNCTTNILxxxxxxxxxxxxxxxxxxxxxxxxxxxxxxxYGVENVRVAYGRCDAVGR
SKRSRRAIDLxxxxxxxxxKTRQEKWMAGRMGERQLQKIERWLVRNPFFAVTALAIAYLVGNNTTQRVV
IALxxxxxxxAYSAHCIGVADRDFIEGVHGGTWVSASLEQGKCVTVMAPxKPSLDISLETVAIDGPAE
ARKVCYSAVLTHVKIDDKCPSTGEAHLAEENDGDNACKRTxxxxxxxxxxxxxxxxxxxxxxxxxxxx
xxxxxxxxQTKIQYVIRARLHVGAKQENWTTSIKTLKFDALSGSQEAEFTGYGKATLECRVQTAVDFG
NSYIAEMEKDSWIVDRQWxxxxxxPWQSGSGGIWRGMHHLVEFEPPHAVTIRVLALGDQEGSLKTAxx
GAMRVTKDENDNNLYKLxxxxxxxxxxxxxxTLKGTSYKMCTDKMSFVKNPTDTDHGTVVMQVKVPKG
APCKIPVIVADDLTAAVNKGILVTVxxxxxxxxxxxxxxxxxxPFGDSYIIVGTGDSRLTYQxxxxxxx
xxxLFTQTMKGAERLAVMGDAAWDFSSAGGLFTSIGKGSHTVFGSAFQGLFGGLSWITKVIMGAVLIW
VGFNTRNMTMSMSMIMVGVIMMFLxxxVGADQGCAVNFAKRELKCGDGIFVFRDSDDWLTKYSYYPED
PVKLASIIKASHEEGKCGLNSVDSLDHEMWRSRADEINAILEENEVDISVVVQDPKNIYQRGTHPFxx
xxxxxxYGWKTWGKNLIFSPGRKNGxxxxxxxxxxxxxxxxxxxxxxxxxSFQIEEFGMGVFTTRVFMDAVFD
YSVDCDGAILGAAVNGxxxxxxxxxxxxxxxxHEVNGTWMIHTLETLDYKECEWPPTHTIGTSVEESDMF
MPRSIGGPVSSHNRIPGYKVQTxxxWMQVPLEVRREVCPGTSVVLDTSCDGRGKSARSTTDSGKIIPE
WCCRSxxMPPVSFHGNDGCWYPMEIRPMKTSDSHLVRSWVTAGEVHAVPFGLVSMMIALEVVLRKRQG
PKQMLVGGIILLGAMLVGQVTVLDLVKLIMAVGLHFHEINNGGDAMYMALIASFSVRPGLLMGFGLRT
LWSPRERLVMAFGAAMVEIALGGMMGGLWQYLNAVSLCVLTINAVSSRKASNAILPLMALLTPVTMAE
VRLATMLFCTVVIIGVLHQNSKDTSMQKTIPIVALTLTSYMGLTQPFLGLCAYMSTQVFGRRSIPVNE
ALAATGLVGVLAGLAFQDMENFLGPIAVGGILMMLVSVAGRVDGLELRKLGEIAWEEEAEISGSSRY
DVALNEQGEFKLLSEDKVPWDQIVMTSLALVGAAIHPFALLLVLAGWLFHIKRARRSGDVLWDIPTPK
VIEECEHLEDGISGIFQSTFLxxxxxxxxxxxxxxxxxxxxxHVTRGAFLLRNGKKLVPSWASVKExxxA
YGGSWKLDGKWDGEEEVQLIAAVPGKAVVNVQTKPSVFRVKNGGEIGAVxxxxxxxxSGSPIVNRSGE

FIG. 59-8

VVGLYGNGILxxxxxxVSAISQTEVKEEGKEELREIPTMLKKGMTTVLDYHPGAGKTRxxxxxxxxxx
xxxxxxxxxxxxxxxxLSEMKEAFQGLDVKFHTxAFSAHGSGKEVIDVMCHATLTYRMLEPTRIVNWE
VIIMxxxxxxxxxxxxxxxxxxxxxxxxxxxxxxxxxxxxxxxxxxxxxxxxxxxxTDIPSEPWTSG
HEWILADKRPxxxxxxxxxxxxxxxxxxASLRKAGKNVVVLNRKTFEKEYPTIKQKRPDFILATDxxEMGA
NLCVDRVLDCRTAYKPVLVDEGKKVAIKGPLxxxxxxxxxxxxxxxxxxxxxxxxxxxYYSEPTSEDNAH
HVCWLxxxxxxxxxxxxxxGMVAPLYGIEGIKTPVSPGEMRLRDDQRRVFRELVRGCDQPVWLSWQVAK
PGLKTNDRKWCFEGPEEHEILNDNGETVKCRSPGGAKKALRPRWCDExVSSDQSALADFIKFAEGRRG
AAEMLVVLTELPDFLAKxxxEAMDTISVLLHSEEGSRxxxxxxxMMPEAMTIVMLFLLAGLLTSGAVI
FFMSPKGMSRMSMAMGTMAGSGYLMFLGGVKPTHISYVMLIFFVLMVVIIPEPGQQRTIQDNQVAFLI
IGILTLVSVVAANELGMLEKTKEDLFGKKDxxTSGGTIPWSWPDLDxxxxxxxTVYVGIVTILSPMLH
HWxxxxxxxxxxxxxxxxxVLSFMDKGVPFMKMNISVIILLISGWNSITVIPLLCGVGGAMLHWTLI
LPGIKAQQSKLAQKRVFHGVAENPVVDGNPTADIEEAPEMPVLYEKKLALYLLLALSLMSVAMCRTPF
SLAEGIVLASAASGPLIEGNTxxxxxxxxxxxxMTGVMRGNYYAFVGVMYNLWKMETGRRGRASGKTLG
EVWKRELNLLDKRQFELYKRTDITEVDRDMARRHLAEGxxxxxxxxxxxxxxxxxxxxxxxxYVKLEGRV
TDLGCGRGGxxxxxxxxKEVSGVKGYTLGREGHEKPMNVQSLGWNIVTFKDKTDVHPLEPAKCETLLC
DIGESSPSSVTEGERTMRVLETIEKWLACGVDNFCVKVLAPYMPDVIEKLELLQRRFGGTIIRNPLSR
NxxxxxxxYVSGARSNITFTVNQTSxxxxxxxxxxPTGKVTLEADVTLPIGTRSVETDKGPLDRDAIEER
VERIKSEYMTTWFHDNDNPYRTWHYCGSYITKTSGSAASMINGVIKILTFPWDKIEEVTRMAxxxxxx
xxxxxxxxxxxxxxxxxPAGTRKIMRVVNRWLFRHLAREKSPRLCTKEExxAKVRSHAAVGAFLEEQ
DQWKTANEAVQDPKFWEMVDAERKLHQQGRCQSCVYNMMGKxxxxxxxxxxxxxxxxxWYMWLGARFL
EFEALGFxxxxxxxxxNSGGGVEGTGLQYLGYVIKDLSTKEGGGLYADDTAGWxxxxxxxxDLDDEQE
IMSYMNAEQRKLAWAIMEMTYKNKVVKVLRPAPGGKAFMDIISRRDQRGSRQVVTYALNxxxxxxxxxL
IRMAEAEMVINHQHVNECDESALARLDAWLTEHGCDRLRRMAVSGDDCVVRPVDDRFGMALSHLNAMx
xxxxxISEWQPSKEWTDWESVPFCSHHFHELHLKDGRKVVVPCRDQDELIGRGxxxxxxxxxxxxxx
xxxxxxxxxxxxxxxxxxKRDMRLLSFAVSSAVPTAWVPSGRTTWSVHGRGEWMTTEDMLDVWNRVWVLNN
PHMQDKTMVKEWRDVPYLTxxxxxxxxxxxxxTNRATWASNIHLVIHRIRTLVGQEKFTDYLTVMDxY
SVDADLQPGELI >YFV|peptide_length:9|string3 xxxxxxxxxxxxxxxxxxxxxxxxxxxxxxxxxxxxxxxxxxxxxxxxILTGKKLTAQLKKL
WRMLDPRQGLTVLRKVKRVVASLMIGLSSRKRRSHDALLVPLLLLGLLALSGGVTLVRKxxxxxxxx
xEDLGKTFSLGTGNCTTNxxxxxxxxxxxxxxxxxxxxxxxxxxxxxxxENVRVTYGKCDSAGx
xxxxxxxxxxxxxxxxxxxxxxxxxxxxxxxxxxxxxxxLVRNPFFAITALAIAYLVGNNKTQRVV
IALxxxxxxxxxxxxxxxxxxxxxxxxxxxxxxxWVSATLEQGKCVTxxxxxxxxxxxxSLQTVAIDRPAE
ARKVCYSAVxxxxxxxxxxxxxxxxxxxxxxxxxxxxxxxxxxxxxxxxxxxxxxxxxxxxxxxx
xxxxxxxxxxKIQYVIKAQLHVGAKQENWNTDIKTLKFDVLSGSQEAEFTGYGKVTLECQVQTxxxxx
xSYIAEMEKDSWIVDRQxxxxxxxxxxxSGSGGVWRGMHHLVxxxxxxxxxxxxxxxxxxxxxxxx
xxxxxxxxxxxxxxxxxxxxxxxxxxxxxxxxxxxxxxxxxxxxxxxxxxxxxxxxxxxxKVPKG
APCRIPxxxxxxxxxxxxxxxxxxxxxxxxxxxxxxxxGDSYIIIGTGDSRLTxxxxxxxxxx
xxxxxxxxxxxERLAVMGDVAWDFSSAGGFLTSVGKGIHxxxxxxxxxxxxxLNWITKVIIGVVLIW
VGINxxxxxxxxxxxxxxxxxxxxxxxxxxxDQGCAINFAKRELKxxxxxxxxxxxxxxxxxxxx
xxxLASIIKASYEEGKCGLNxxxxxxxxxxxxxxxxxxxxxxxxxxIVVQDPKNIxxxxxxxxx
xxxxxxxxxWKTWGKSLVFSPGRKxxxxxxxxxxxxxxxxxxxxxxxxxxxxxTTRVFMDATFD
YSVDCDxxxxxxxxxxxxxxxxxxxxxxxxxxxHEVNGTWMVHTLETLDYxxxxxxxxxxxxxxxx
xxxxxxxxxxxxxxxxxxxxxxxxxxxxVPLEVRREPCPGTSVVVDSNCDGRGKSAxxxxxxxxx
xxxxxxxxxxxxxxxxxxxxxxxxxxxxPMEIRPMKAHESHLVRSxxxxxxxxxxxxxxxxIAMEVVLRRRQG
PKQMLVGGMVLLGAMLVGQVTMLDLVKLVVAVGLHFHxxxxxxxxxxxMALIAAFSIRPGLLVGFGLRT
LWSPRERLVLAFGAAMVEVALGGMMGGLWQYLxxxxxxxxxxxxxIASRKASNAVLPLMALMTPVTMAE
VRLAAMLFCTVVIIGVLHQNAKDTSMQKTxxxxxxxxxxxxxxxxxxxLCAFLATRLFGRRSIPVxx

FIG. 59-9

```
xxxxxxxxxxxxxxxxxxxxxxxxxxxxxxxxxxxxxxxxxGKVDGLELKKLGEVAWEEEAEIxxxSARY
DVALNExxxxxxxxxxxxxxxxxxxxxxxxxLVGAAIHPSALLLVLAGWVLHVRRARRSGDVxxxxxxPK
VIEECEYLEDGIYGIxxxxxxxxxxxxxxxxxxxxxxxxxxVTRGAFLVWNGKKLIPSxxxxxxxxxx
xGGSWKLDGRWDGEEExxLIAAVPGKSVVNVQTKPSLFRVKNGGExxxxxxxxxxxxxxxxIVNRNGE
VVGLYGxxxxxxxxxxxxxSQTELKEESKEELQEISTMLKKGKTTILDYHPGAGxxxxxxxxxxxxx
xxxxxxxxxxxxxxxxxxxxxxxxxxxxxxxxxxxxxxxxxxxGSGREVIDVMCHxxxxYRMLEPTRAVNWE
VIIMxxxxxxxxxxxxxxxxxxxxxxxxxxxxxxxxxxxxxxxxxxxxxxxxxxxxxDIPSEPWTAG
HEWILADxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxAPLYGVEGIKTPVSxxxxxLRDDQRRVSRELVRGCDLPVWLAWQVAK
AGLxxxxRKWCFDGPKEHEILNDSGETVKCRAPGGAKRALRPRWCDxxxxxxxxxxxxxxxxxEGRRG
AAEMLVILTELPDFLxxxxxxxxxxxxxxxxxxxxxxxxxxxxxxxxAMTIAMLFILAGLxxxxxxxx
xxxxxxGISRMSMAKGTMAGCGYLMFLGGVEPTHISYIMxxxxxxxxxxxxxxxxxxxSIQDNQVAFxx
IGILTLLSIVAANELGMLEKTKEDFFGRRNxxTPSGAIPWSWPDLxxxxxxxxxxxxxxxxxxxxxx
xxxxxxxxxxxxxxxxxxxxxxxxxxxxxxxMKMNISVVMLLISGWNSxTVIPLLCGIGCATLHWSLI
LPxxxAQQSKLPQRRVFHGVAExxxxxxxxxxxxxxxxxxxxxxxxxxYLLLALSLSSVAMCRTPx
SLDEGIVLSSAALGPLIxxxxxxxxxxxxxxxxxxxxxxxxxNYYAFVGVAYNLWKMKTARRGSASGKTLG
ExxxRELNLLDRQQFEMYKRTDIIEVDRDMARxxxxxxxxxxxxxxxxxxxxxxxxxYVKLEGRV
MDLGCGRGGxxxxxxxxxxxxxVKGFTLGREGHExxxxVRSLGWNIITFKDKTDVHRLESMKCDTLLC
DIGESSPSSVTEGERTLRVLETVEKWLACxxxxxxIKVLAPYMRDVLEKLELxxxxxxxxxxxxxx
xxxxxxxxxxxxxxxxxxxxxxxxxxxxxxxKVTLEPDVILPIGTxxxETDKGPLNREAIKER
VERIKTEYAATWFHDNDNPxxxxxxxxxxxxxxxxxxSMVNGVIKILTYPWDKIEEVxxxxxxxxxx
xxxxxxxxxxxxxxxxxxxxxxxxxxxxxxxFRHLSREKKPRLCTKEExxxxxRSHAAIGAYLEEQ
DQWKxxxxxxxxxxxxWELVDEERRLHQQGRCRxxxxxxxxxxxxxxxxxxxxxxxxxxxxxxxxx
xxxxxxxxxxxxxxxxxxxxxxxxxxxxxxxLGYVIRDLSAMDGGGLYADDxxxxxxxxxxxxxxEQE
IMSYMSSEQRKLAWAIMEMTYKxxxxxxxxRPTPGGKAYMDxxxxxxxxxxxxxxxxxxxxxxxxx
xxMAEAEMVIHHQHVQECDDSTLARLEAWLAENGCDRLARMAVNGDDCVVRPIDDRFGMALxxxxxxx
xxxxxxxEWQPSKGWTDWENVPFCSHHFHELVLKDGRKIVVPCRDQDxxxxxxxxxxxxxxxxxxx
xxxxxxxxxxxxxxxxxxxxxxxxFAVSSAVPMAWVPSGRTTWSVHGKGEWMTTEDMLGVWNRVWVLNN
PHMQDKTVIKEWRDVPYxxxxxxxxxxxxxxxxxxxxxxxxxxxxVIHRIRTLIGQEKFTDYxxxxxxx
xxxxxxxxxxx >YFV|peptide_length:9|string4 xxxxxxxxxxxxxxxxxxxxxxxxxxxxxxxxxxxxxxxxxxxxLTGKKITAHLKKL
WRMLxxxxxxxxxxxxxxxxxxxxxxSRKRRSSEMTAFQLLILGMILMGGGVTLVRKxxxxxxxxxx
xEDLGKTFSIGTGNCTTNxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxIAYLVGNNKTQRVV
IxxxxxxxxxxxxxxxxxxxxxxxxxxxxxxxxxxxxxxxxxxxxxxxxxxxxxxxETVAIDGPVE
ARKVCYNxxxxxxxxxxxxxxxxxxxxxxxxxxxxxxxxxxxxxxxxxxxxxxxxxxxxxxxxxx
xxxxxxxxxxxxxxxxxxxxxVGAKQEDWKTDIKTLKFxxxxxxxxVEFTGYGKAxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxTWMMHTLETLDYxxxxxxxxxxxxx
xxxxxxxxxxxxxxxxxxxxxxxxxxxxxxxxxVPLEVKREPCPGTSVVVDTGCDGRGKSTxxxxxxxxx
```

FIG. 59-10

```
xxxxxxxxxxxxxxxxxxxxxxxxMEIRPRKAHESHLVxxxxxxxxxxxxxxxxxxxxxxxxxxxxx
PKQVLVGGVVLLxxxxxxQVTLLDLLEFTMAVGLHFHxxxxxxxxxxxxxxxFSIRPGLLVGFxxxx
xxxxxxxxxxAFGAAMVEIxxxxxxxxxxxxxxxxxxxxxxxxxISSRKASNMILPLMALLTPMTMHE
VRMAAMLLCTVVIVGVLYQNSKDTSMxxxxxxxxxxxxxxxxxxxxxxxxxxxxxxxxxxxxxxxx
xxxxxxxxxxxxxxxxxxxxxxxxxxxxxxxxxxxxxxxxxxxxxELKKLGEVAWExxxxxxxxxxxx
xxxxxxxxxxxxxxxxxxxxxxxxxxxxxxxxxxxxxxxxxxLGGWLFHVRRARRSGDxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxLIAAAPGKNVVNVxxxxxxxxxxxxxxxxxxxxxxxxxxxxxx
xxxxxxxxxxxxxxxxxxxxxxxxxxxGKEELQEISxxxxKGMTTILDYHPxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxNCDQPVWLSxxxxx
xxxxxxxxxxxxxxxxxxDEHEILNDSxxxxxCRTPGGAKRPLRPRWCDxxxxxxxxxxxxxxxxxEGRRG
AADILVVLSELPxxxxxxxxxxxxxxxxxxxxxxxxxxxxxxxxxxxxxxxxxxxxxxxxxxxxxx
xxxxxxxxxxxxxxxxxxxxxxxxxxxxxxAKPTHISYIxxxxxxxxxxxxxxxxxxxxxxxxxxxx
IGILTLLSIVAANELxxxxRTKEDFFGKRNxxISSGASPWSWPDxxxxxxxxxxxxxxxxxxxxxx
xxxxxxxxxxxxxxxxxxxxxxxxxxxxNISVIMLLISGWNxxxxxxLLCGIGCAMLHWTLI
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxYNLWKMKTERRGTANGKTLG
ExxxxxxxLLDKQQFEMYKRxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxVTFKDKTDIHRLEPLKCETLLC
DIGESSSSSITEGERTLRVLETVEKxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxGAIEER
VERIKTEYAATWFHDNDNxxxxxxxxxxxxxxxxxxxxxxxxxxxKLLTYPWDKIxxxxxxxxxxxx
xxxxxxxxxxxxxxxxxxxxxxxxxxxxxxxxFRHLAREKKPRLCxxxxxxxxxxxxxxxIGAYLEEQ
Dxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxLAAMDGGGLYAxxxxxxxxxxxxxxxxxxxQE
ILNYMSPEQRKLAWAxxxxxxxxxxxxxxxxxxxxxxxxxxxxxxxxxxxxxxxxxxxxxxxxxxx
xxxxEAEMVINHQHVNECGENVLVRLEAWLIEHGCDRLSRMAVSGDDxxxKPVDDRFGLxxxxxxxxx
xxxxxxxxxxxxSKGWTDWENVPxCSHRFHELVLKDGRKIVxxxxxxxxxxxxxxxxxxxxxxxxxx
xxxxxxxxxxxxxxxxxxxxxxxxxxxxxxxxxxxxxxxxxxxWMTTEDRLEVWNRVWxxxN
PHMKDKTTVKEWRDVPxxxxxxxxxxxxxxxxxxxxxxxxxxxxxxxxxxxxxRNLIGQEKYTxxxxxxxxx
xxxxxxxxxxxx
```

>YFV|peptide_length:9|string5

```
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxTVQLLILGMxxxTGGVTLMRKxxxxxxxxx
xxxLGKTFSMGTGNCTTNxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxAKQENWKTDIKTLxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
```

FIG. 59-11

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxFTVAVGLHFxxxxxxxxxxxxxxxxxxxxxxxxxxx
xxxxxxxxxxxxxxxxxxxxxxxxxxxxxxxxxxxxxxxxxxISSRKASNTIxxxxxxxxxxxxYE
VRLATMLLCAVVIVGVLHQNAKxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxGGWILHIKGARRxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxCRSPGGAKRALxxxxxxxxxxxxxxxxxxxxxxxxxRG
AAEMLVILTELxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxKEDFFGKRDxxIPSGASPWSWxxxxxxxxxxxxxxxxxxxxx
xxxxxxxxxxxxxxxxxxxxxxxxxxxxxxxxxxxxxxxxxxxxxxxxxxxxxxIGCAMLHWTxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxKTDIHHLEPMKCDTLLC
xxxxxxxxSATEGERTLRVLETIEKxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxNEYATTWFYDNDxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxNVIHHHHVQDCDEGVLERLETWLAENGCDRLNRMAVNGDDxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxWMTTQDMLDVWNRxxxxxx
xxMTDKTTIKEWRDVPxxxxxxxxxxxxxxxxxxxxxxxxxxxxxxxxxxxxxxxxxxxxxxxx
xxxxxxxxxxxx
```

FIG. 59-12

\>YFV|peptide_length:10|string1

MSGRKAQGKTLGVNMVRRGVRSLSNKIKQKTKQIGNRPGPSRGVQGFIFFFLFNILTGKKITAHLKRL
WKMLDPRQGLAVLRKVKRVVASLMRGLSSRKRRSHDVLTVQFLILGMLLMTGGVTLVRKNRWLLLNVT
SEDLGKTFSVGTGNCTTNILEAKYWCPDSMEYNCPNLSPREEPDDIDCWCYGVENVRVAYGKCDSAGR
SRRSRRAIDLPTHENHGLKTRQEKWMTGRMGERQLQKIERWFVRNPFFAVTALTIAYLVGSNMTQRVV
IALLVLAVGPAYSAHCIGITDRDFIEGVHGGTWVSATLEQDKCVTVMAPDKPSLDISLETVAIDRPAE
VRKVCYNAVLTHVKINDKCPSTGEAHLAEENEGDNACKRTYSDRGWGNGCGLFGKGSIVACAKFTCAK
SMSLFEVDQTKIQYVIRAQLHVGAKQENWNTDIKTLKFDALSGSQEVEFIGYGKATLECQVQTAVDFG
NSYIAEMETESWIVDRQWAQDLTLPWQSGSGGVWREMHHLVEFEPPHAATIRVLALGNQEGSLKTALT
GAMRVTKDTNDNNLYKLHGGHVSCRVKLSALTLKGTSYKICTDKMFFVKNPTDTGHGTVVMQVKVSKG
APCRIPVIVADDLTAAINKGILVTVNPIASTNDDEVLIEVNPPFGDSYIIVGRGDSRLTYQWHKEGSS
IGKLFTQTMKGVERLAVMGDTAWDFSSAGGFFTSVGKGIHTVFGSAFQGLFGGLNWITKVIMGAVLIW
VGINTRNMTMSMSMILVGVIMMFLSLGVGADQGCAINFGKRELKCGDGIFIFRDSDDWLNKYSYYPED
PVKLASIVKASFEEGKCGLNSVDSLEHEMWRSRADEINAIFEENEVDISVVVQDPKNVYQRGTHPFSR
IRDGLQYGWKTWGKNLVFSPGRKNGSFIIDGKSRKECPFSNRVWNSFQIEEFGTGVFTTRVYMDAVFE
YTIDCDGSILGAAVNGKKSAHGSPTFWMGSHEVNGTWMIHTLEALDYKECEWPLTHTIGTSVEESEMF
MPRSIGGPVSSHNHIPGYKVQTNGPWMQVPLEVKREACPGTSVIIDGNCDGRGKSTRSTTDSGKVIPE
WCCRSCTMPPVSFHGSDGCWYPMEIRPRKTHESHLVRSWVTAGEIHAVPFGLVSMMIAMEVVLRKRQG
PKQMLVGGVVLLGAMLVGQVTLLDLLKLTVAVGLHFHEMNNGGDAMYMALIAAFSIRPGLLIGFGLRT
LWSPRERLVLTLGAAMVEIALGGVMGGLWKYLNAVSLCILTINAVASRKASNTILPLMALLTPVTMAE
VRLAAMFFCAVVIIGVLHQNFKDTSMQKTIPLVALTLTSYLGLTQPFLGLCAFLATRIFGRRSIPVNE
ALAAAGLVGVLAGLAFQEMENFLGPIAVGGLLMMLVSVAGRVDGLELKKLGEVSWEEEAEISGSSARY
DVALSEQGEFKLLSEEKVPWDQVVMTSLALVGAALHPFALLLVLAGWLFHVRGARRSGDVLWDIPTPK
IIEECEHLEDGIYGIFQSTFLGASQRGVGVAQGGVFHTMWHVTRGAFLVRNGKKLIPSWASVKEDLVA
YGGSWKLEGRWDGEEEVQLIAAVPGKNVVNVQTKPSLFKVRNGGEIGAVALDYPSGTSGSPIVNRNGE
VIGLYGNGILVGDNSFVSAISQTEVKEEGKEELQEIPTMLKKGMTTILDFHPGAGKTRRFLPQILAEC
ARRRLRTLVLAPTRVVLSEMKEAFHGLDVKFHTQAFSAHGSGREVIDAMCHATLTYRMLEPTRVVNWE
VIIMDEAHFLDPASIAARGWAAHRARANESATILMTATPPGTSDEFPHSNGEIEDVQTDIPSEPWNTG
HDWILADKRPTAWFLPSIRAANVMAASLRKAGKSVVVLNRKTFEREYPTIKQKKPDFILATDIAEMGA
NLCVERVLDCRTAFKPVLVDEGRKVAIKGPLRISASSAAQRRGRIGRNPNRDGDSYYYSEPTSENNAH
HVCWLEASMLLDNMEVRGGMVAPLYGVEGTKTPVSPGEMRLRDDQRKVFRELVRNCDLPVWLSWQVAK
AGLKTNDRKWCFEGPEEHEILNDSGETVKCRAPGGAKKPLRPRWCDERVSSDQSALSEFIKFAEGRRG
AAEVLVVLSELPDFLAKKGGEAMDTISVFLHSEEGSRAYRNALSMMPEAMTIVMLFILAGLLTSGMVI
FFMSPKGISRMSMAMGTMAGCGYLMFLGGVKPTHISYIMLIFFVLMVVVIPEPGQQRSIQDNQVAYLI
IGILTLVSAVAANELGMLEKTKEDLFGKKNxxIPSSASPWSWPDLDLKPGAAWTVYVGIVTMLSPMLH
HWIKVEYGNLSLSGIAQSASVLSFMDKGIPFMKMNISVIMLLVSGWNSITVMPLLCGIGCAMLHWSLI
LPGIKAQQSKLAQRRVFHGVAKNPVVDGNPTVDIEEAPEMPALYEKKLALYLLLALSLASVAMCRTPF
SLAEGIVLASAALGPLIEGNTSLLWNGPMAVSMTGVMRGNHYAFVGVMYNLWKMKTGRRGSANGKTLG
EVWKRELNLLDKQQFELYKRTDIVEVDRDTARRHLAEGKVDTGVAVSRGTAKLRWFHERGYVKLEGRV
IDLGCGRGGWCYYAAAQKEVSGVKGFTLGRDGHEKPMNVQSLGWNIITFKDKTDIHRLEPVKCDTLLC
DIGESSSSSVTEGERTVRVLDTVEKWLACGVDNFCVKVLAPYMPDVLEKLELLQRRFGGTVIRNPLSR
NSTHEMYYVSGARSNVTFTVNQTSRLLMRRMRRPTGKVTLEADVILPIGTRSVETDKGPLDKEAIEER
VERIKSEYMTSWFYDNDNPYRTWHYCGSYVTKTSGSAASMVNGVIKILTYPWDRIEEVTRMAMTDTTP
FGQQRVFKEKVDTRAKDPPAGTRKIMKVVNRWLFRHLAREKNPRLCTKEEFIAKVRSHAAIGAYLEEQ
EQWKTANEAVQDPKFWELVDEERKLHQQGRCRTCVYNMMGKREKKLSEFGKAKGSRAIWYMWLGARYL
EFEALGFLNEDHWASRENSGGGVEGIGLQYLGYVIRDLAAMDGGGFYADDTAGWDTRITEADLDDEQE
ILNYMSPHHKKLAQAVMEMTYKNKVVKVLRPAPGGKAYMDVISRRDQRGSGQVVTYALNTITNLKVQL
IRMAEAEMVIHHQHVQDCDESxLTRLEAWLTEHGCNRLKRMAVSGDDCVVRPIDDRFGLALSHLNAMS
KVRKDISEWQPSKGWNDWENVPFCSHHFHELQLKDGRRIVVPCREQDELIGRGRVSPGNGWMIKETAC

FIG. 59-13

LSKAYANMWSLMYFHKRDMRLLSLAVSSAVPTSWVPQGRTTWSIHGKGEWMTTEDMLEVWNRVWITNN
PHMQDKTMVKKWRDVPYLTKRQDKLCGSLIGMTNRATWASHIHLVIHRIRTLIGQEKYTDYLTVMDRY
SVDADLQLGELI

>YFV|peptide_length:10|string2 xxxxxxxxxxLGVNMVRRGARSLSNKIKQxTKQIGNRPGLSRGVQGFISFFLFNILTGKKLTTHLKRL
WRMLDPRQGLAALRKVKRVVAGLMIGLSSRKRRSNEMAMMPLLILSMVILAGGVTLMRKNRWLLLNVT
AEDLGKTFSLGAGNCTTNILExxxxxxxxxxxxxxxxxxxxxxxCYGVENVRVAYGRCDAVGR
SKRSRRAIDLPxxxxxxLKTRQEKWMAGRMGERQLQKIERWLVRNPFFAVTALAIAYLVGNNTTQRVV
IALLxxxxxPAYSAHCIGVADRDFIEGVHGGTWVSASLEQGKCVTVMAPDKPSLDISLETVAIDGPAE
ARKVCYSAVLTHVKIDDKCPSTGEAHLAEENDGDNACKRTYxxxxxxxxxxxxxxxxxxxxxxxxxxx
xxxxxxxDQTKIQYVIKARLHVGAKQENWTTSIKTLKFDALSGSQEAEFTGYGKVTLECRVQTAVDFG
NSYIAEMEKDSWIVDRQWAxxxxLPWQSGSGGIWRGMHHLVEFEPPHAATIRVLALGDQEGSLKTALT
GAMRVTKDENDNNLYKLHxxxxxxxxxxxLTLKGTSYKMCTDKMSFVKNPTDTDHGTVVMQVKVPKG
APCKIPVIVADDLTAAVNKGILVTVNxxxxxxxxxxxxxxxPPFGDSYIIVGTGDSRLTYQWxxxxxx
xxKLFTQTMKGAERLAVMGDAAWDFSSAGGLFTSIGKGSHTVFGSAFQGLFGGLSWITKVIMGAVLIW
VGFNTRNMTMSMSMIMVGVIMMFLSxGVGADQGCAVNFAKRELKCGDGIFVFRDSDDWLTKYSYYPED
PVKLASIIKASHEEGKCGLNSVDSLDHEMWRSRADEINAILEENEVDISVVVQDPKNIYQRGTHPFSx
xxxxxQYGWKTWGKNLIFSPGRKNGSxxxxxxxxxxxxxxxxxNSFQIEEFGMGVFTTRVFMDAVFD
YSVDCDGAILGAAVNGKxxxxxxxxxxxxxSHEVNGTWMIHTLETLDYKECEWPPTHTIGTSVEESDMF
MPRSIGGPVSSHNRIPGYKVQTNxPWMQVPLEVRREPCPGTSVVLDSGCDGRGKSTRSTTDSGKIIPE
WCCRSCTMPPVSFHGNDGCWYPMEIRPMKASDSHLVRSWVTAGEVHAVPFGLVSMMIALEVVLRKRQG
PKQMLVGGIILLGAMLVGQVTVLDLVKLIVAVGLHFHEINNGGDAMYMALIAAFSVRPGLLVGFGLRT
LWSPRERLVLAFGAAMVEIALGGMMGGLWQYLNAVSLCVLTINAVASRKASNAILPLMALMTPVTMAE
VRLATMLFCTVVIIGVLHQNSKDTSMQKTIPIVALTLTSYMGLTQPFLGLCAYMSTQVFGRRSIPVNE
ALAATGLVGVLAGLAFQDMENFLGPIAVGGILMMLVSVAGRVDGLELRKLGEIAWEEEAEISGSSSRY
DVALNEQGEFKLLSEDKVPWDQIVMTSLALVGAAIHPFALLLVLAGWLLHVKRARRSGDVLWDIPTPK
VIEECEHLEDGISGIFQSTFLGxxxxxxxxxxxxxxxxxxxxWHVTRGAFLLRNGKKLVPSWASVKEDxVA
YGGSWKLDGKWDGEEEVQLIAAVPGKAVVNVQTKPSVFRVKNGGEIGAVAxxxxxxTSGSPIVNRSGE
VVGLYGNGILVxxxxFVSAISQTEVKEEGKEELREIPTMLKKGMTTVLDYHPGAGKTRRxxxxxxxxx
xxxxxxxxxxxxxxxVLSEMKEAFQGLDVKFHTQAFSAHGSGKEVIDVMCHATLTYRMLEPTRIVNWE
VIIMDxxxxxxxxxxxxxxxxxxxxxxxxxxxxxxxxxxxxxxxxxxxxxxxxQTDIPSEPWTSG
HEWILADKRPTxxxxxxxxxxxxxxAASLRKAGKNVVVLNRKTFEKEYPTIKQKRPDFILATDIAEMGA
NLCVERVLDCRTAYKPVLVDEGKKVAIKGPLRxxxxxxxxxxxxxxxxxxxxxxxYYYSEPTSEDNAH
HVCWLExxxxxxxxxxxxGGMVAPLYGIEGIKTPVSPGEMRLRDDQRRVFRELVRGCDQPVWLAWQVAK
PGLKTNDRKWCFDGPEEHEILNDNGETVKCRSPGGAKKALRPRWCDERVSSDQSALADFIKFAEGRRG
AAEMLVVLTELPDFLAKKxGEAMDTISVLLHSEEGSRAxxxxxSMMPEAMTIVMLFLLAGLLTSGAVI
FFMSPKGMSRMSMAMGTMAGSGYLMFLGGVKPTHISYVMLIFFVLMVVVIPEPGQQRTIQDNQVAYLI
IGILTLVSVVAANELGMLEKTKEDLFGKKDxxTSGGTIPWSWPDLDLxxxxxWTVYVGIVTILSPMLH
HWIxxxxxxxxxxxxxxxxxxSVLSFMDKGVPFMKMNISVIILLVSGWNSITVIPLLCGVGGAMLHWTLI
LPGIKAQQSKLAQKRVFHGVAENPVVDGNPTADIEEAPEMPVLYEKKLALYLLLALSLMSVAMCRTPF
SLAEGIVLASAASGPLIEGNTSxxxxxxxxxSMTGVMRGNYYAFVGVMYNLWKMETGRRGRASGKTLG
EVWKRELNLLDKRQFELYKRTDITEVDRDMARRHLAEGKxxxxxxxxxxxxxxxxxxxxxxxGYVKLEGRV
TDLGCGRGGWxxxxxxxQKEVSGVKGYTLGREGHEKPMNVQSLGWNIVTFKDKTDIHHLEPAKCETLLC
DIGESSPSSVTEGERTMRVLETIEKWLACGVDNFCVKVLAPYMPDVIEKLELLQRRFGGTIIRNPLSR
NSxxxxYYVSGARSNITFTVNQTSRxxxxxxRPTGKVTLEADVTLPIGTRSVETDKGPLDRDAIEER
VERIKSEYMTTWFHDNDNPYRTWHYCGSYITKTSGSAASMINGVIKILTFPWDKIEEVTRMAMxxxxx
xxxxxxxxxxxxxxxPPAGTRKIMRVVNRWLFRHLAREKSPRLCTKEEFIAKVRSHAAVGAFLEEQ
DQWKTANEAVQDPKFWEMVDAERKLHQQGRCQSCVYNMMGKRxxxxxxxxxxxxxxxxxIWYMWLGARFL

FIG. 59-14

```
EFEALGFLxxxxxxxxENSGGGVEGTGLQYLGYVIKDLSTKEGGGLYADDTAGWDxxxxxADLDDEQE
IMSYMNAEQRKLAWAIMEMTYKNKVVKVLRPAPGGKAFMDIISRRDQRGSRQVVTYALNTxxxxxxQL
IRMAEAEMVINHQHVNECDEGxLARLEAWLTEHGCDRLARMAVSGDDCVVRPVDDRFGMALSHLNAMS
xxxxDISEWQPSKGWTDWENVPFCSHHFHELHLKDGRKVVVPCRDQDELIGRGRxxxxxxxxxxxxxx
xxxxxxxxxxxxxHKRDMRLLSFAVSSAVPTAWVPSGRTTWSVHGKGEWMTTEDMLDVWNRVWVLNN
PHMQDKTMVKEWRDVPYLTKxxxxxxxxxxxMTNRATWASNIHLVIHRIRTLVGQEKFTDYLTVMDRY
SVDADLQPGELI >YFV|peptide_length:10|string3 xxxxxxxxxxxxxxxxxxxxxxxxxxxxxxxxxxxxxxxxPSRGVQGFISxxSFNILTGKKLTAHLKKL
WRMLDPRQGLTVLRKVKRVVASLMIGLSSRKRRSHDALTFPLLLLGLLALSGGVTLVRKNxxxxxxxx
SEDLGKTFSMGTGNCTTNIxxxxxxxxxxxxxxxxxxxxxxxxxxxxxxxxVENVRVTYGKCDSAGR
xxxxxxxxxxxxxxxxxxxxxxxxxxxxxxxxxxxxxxxxxxxxWLVRNPFFAITALAIAYLVGNNKTQRVV
IALLxxxxxxxxxxxxxxxxxxxxxxxxxxxxxTWVSATLEQGKCVTVxxxxxxxxxxISLQTVAIDRPAE
ARKVCYNAVLTHVKIDxxxxxxxxxxxxxxxxxxxxxxxxxxxxxxxxxxxxxxxxxxxxxxxxxxxxx
xxxxxxxxxTKIQYVIRAQLHVGAKQENWNTDIKTLKFDVLSGSQEAEFTGYGKATLECRVQTAxxxxx
NSYIAEMEKDSWIVDRQWxxxxxxxxxQSGSGGVWRGMHHLVExxxxxxVTIRVLALGNxxxxxxxxx
xxxxxxxxxxxxxxxxxxxxxxxxxxxxxxxxxxxxxxxxSFVKNPTDTDxxxxxxxVKVPKG
APCRIPVxxxxxxxxxxxxxxxxxxxxxxxxxxxxxxxxxxFGDSYIIIGTGDSRLTYxxxxxxxxx
xxxxxxxxxxVERLAVMGDVAWDFSSAGGFLTSVGKGIHTxxxxxxxxxxxGLNWITKVIMGVVLIW
VGINTxxxxxxxxxxxxxxxxxxxxxADQGCAINFAKRELKCxxxxxxxxxxxxxxxxxxxxxxx
xxKLASIIKASYEEGKCGLNSxxxxxxxxxxxxxxxxxxxxFEENEVDISIVVQDPKNIYxxxxxxxxx
xxxxxxxGWKTWGKSLVFSPGRKNxxxxxxxxxxxxxxxxxxxxxxxxxxxxxFTTRVFMDATFD
YSVDCDGxxxxxxxxxxxxxxxxxxxxxxxxSHEVNGTWMMHTLETLDYKxxxxxxxxxxxxxxxx
xxxxxxxxxxxxxxxxxxxxxxxxxxxxxxQVPLEVRREVCPGTSVVVDTNCDGRGKSARSTTDSGKIxxx
xxxxxxxxxxxxxxxxxxxxxxxxYPMEIRPRKTSDSHLVRSWxxxxxxxxxxxxxxxxxxMIAMEVVLRRRQG
PKQVLVGGMVLLGAMLVGQVTMLDLVKFTMAVGLHFHEMxxxxxxxYMALIASFSIRPGLLMGFGLRT
LWSPRERLVMAFGAAMVEVALGGMMGGLWQYLNxxxxxxxxxxAISSRKASNAVLPLMALLTPVTMAE
VRLAAMLFCTVVIVGVLHQNAKDTSMQKTIxxxxxxxxxxxxxxxxxxxGLCAFLATRLFGRRSIPVNx
xxxxxxxxxxxxxxxxxxxxxxxxxxxxxxAGKVDGLELKKLGEVAWEEEAEISxSSARY
DVALNEQxxxxxxxxxxxxxxxxxxxxxxxALVGAAIHPSALLLVLAGWVFHIRRARRSGDVLxxxxTPK
VIEECEYLEDGIYGIFxxxxxxxxxxxxxxxxxxxxxxxxHVTRGAFLVWNGKKLIPSWxxxxxxxxxx
YGGSWKLDGRWDGEEEVQLIAAVPGKSVVNVQTKPSLFRVKNGGEIxxxxxxxxxxxxxxxPIVNRNGE
VVGLYGNxxxxxxxxxxxxxISQTEVKEESKEELQEISTMLKKGKTTILDYHPGAGKxxxxxxxxxx
xxxxxxxxxxxxxxxxxxxxxxxxxxxxxxHGSGREVIDVMCHAxxTYRMLEPTRAVNWE
VIIMDxxxxxxxxxxxxxxxxxxxxxxxxxxxxxxxxxxxxxxxxxxxxTDIPSEPWTAG
HEWILADKxxxxxxxxxxxxxxxxxxxxxxxxxxxxKEYPTIKQKKxxxxxxxxxxxxxxxx
xxxxDRVLDCRTAYKPVLVDEGKxxxxxxxxxxxxxxxxxxxxxxxxxxxxxxxxxxxxxxxxx
xxxxxxxxxxxxxxxxxxxxxxxxxVAPLYGVEGIKTPVSPxxxRLRDDQRRVFRELVRNCDLPVWLSWQVAK
PGLKxxDRKWCFEGPKEHEILNDSGETVKCRAPGGAKRPLRPRWCDExxxxxxxxxxxxxxxxxAEGRRG
AAEMLVILTELPDFLAxxxxxxxxxxxxxxxxxxxxxxxxxxxxEAMTIAMLFLLAGLLTSGAxx
xxxxxKGISRMSMAKGTMAGCGYLMFLGGVEPTHISYIMLxxxxxxxxxxIIPEPGQQRSIQDNQVAFLI
IGILTLLSIVAANELGMLERTKEDFFGKRNxxIPSGAIPWSWPDLDxxxxxxxxxxxxxxxxxxx
xxxxxxxxxxxxxxxxxxxxxxxxxxFMKMNISVVMLLISGWNSITVIPLLCGIGCATLHWSLI
LPGxKAQQSKLPQRRVFHGVAENxxxxxxxxxxxxxxxxxxxxxxxxxxxxLYLLLALSLSSVAMCRTPF
SLDEGIVLSSAALGPLIExxxxxxxxxxxxxxxxxxxxxxGNYYAFVGVAYNLWKMTARRGSASGKTLG
EVxKRELNLLDRQQFEMYKRTDIIEVDRDMARRxxxxxxxxxxxxxxxxxxxxxxxxxxxxxxGYVKLEGRV
MDLGCGRGGWxxxxxxxxxxxGVKGFTLGREGHEKxxNVRSLGWNIITFKDKTDVHPLEPMKCDTLLC
DIGESSSSSVTEGERTLRVLETVEKWLACGxxxxCIKVLAPYMRDVLEKLELLxxxxxxxxxxxxxxxxx
```

FIG. 59-15

```
xxxxxxxxxxxxxxxxxxxxxxxxxxxxxxxxxxxxxxxxGKVTLEPDVILPIGTRxVETDKGPLNREAIKER
VERIKTEYAATWFHDNDNPYxxxxxxxxxxxxxxxxxxxASMVNGVIKILTYPWDKIEEVTxxxxxxxxx
xxxxxxxxxxxxxxxxxxxxxxxxxxxxxxxxxxLFRHLSREKKPRLCTKEEFxxxVRSHAAIGAYLEEQ
DQWKTxxxxxxxxxxFWELVDEERRLHQQGRCRTxxxxxxxxxxxxxxxxxxxxxxxxxxxxxxxxxxx
xxxxxxxxxxxxxxxxxxxxxxxxxxxxxxxxYLGYVIRDLAAMDGGGLYADDTxxxxxxxxxxxxxDEQE
IMNYMSPEQRKLAWAIMEMTYKNxxxxxLRPTPGGKAYMDVxxxxxxxxxxxxxxxxxxxxxxxxxxx
xRMAEAEMVINHQHVNECDESxLARLDAWLAENGCDRLRRMAVSGDDCVVRPIDDRFGMALSxxxxxx
xxxxxxSEWQPSKGWTDWESVPFCSHHFHELVLKDGRKIVVPCRDQDExxxxxxxxxxxxxxxxxxxx
xxxxxxxxxxxxxxxxxxxxxxxxxSFAVSSAVPMAWVPSGRTTWSVHGKGEWMTTEDMLGVWNRVWVLNN
PHMQDKTVIKEWRDVPYLxxxxxxxxxxxxxxxxxxxxxxxxxxxLVIHRIRTLIGQEKFTDYLxxxxxx
xxxxxxxxxxxx >YFV|peptide_length:10|string4 xxxxxxxxxxxxxxxxxxxxxxxxxxxxxxxxxxxxxxxxxxxxxILTGKKITAQLKRL
WKMLDxxxxxxxxxxxxxxxxxxxxxxxSSRKRRSSEMTLVQLLILGMILGGGVTLVRKNxxxxxxxx
SEDLGKTFSVGAGNCTTNIxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxAIAYLVGNNKTQRVV
IAxxxxxxxxxxxxxxxxxxxxxxxxxxxxxxxxxxxxxxxxxxxxxxxxxxxxLETVAIDGPVE
ARKVCYNAxxxxxxxxxxxxxxxxxxxxxxxxxxxxxxxxxxxxxxxxxxxxxxxxxxxxxxxxxx
xxxxxxxxxxxxxxxxxxxxxxxHVGAKQEDWKTDIKTLKFDxxxxxxEVEFTGYGKATxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxVERLAVMGDAxxxxxxxxxxxxxxxxxxxxxxxxxxxxxNWITKVIIGAVLIW
VGIxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxGTWMVHTLETLDYKxxxxxxxxxxxxxxxxx
xxxxxxxxxxxxxxxxxxxxxxxxxxxxxQVPLEVKREPCPGTSVVVDTSCDGRGKSTRxxxxxxxxxxx
xxxxxxxxxxxxxxxxxxxxxxxxxPMEIRPMKTSDSHLVRxxxxxxxxxxxxxxxxxxxxxxxxxxxG
PKQMLVGGMVLLGxxxxGQVTLLDLLELVVAVGLHFHExxxxxxxxxxxxxxSFSIRPGLLMGFGxxx
xxxxxxxxxMAFGAAMVEIAxxxxxxxxxxxxxxxxxxxxxxxxxAISSRKASNMILPLMALLTPVTMHE
VRMATMLLCTVVIVGVLYQNSKDTSMQxxxxxxxxxxxxxxxxxxxxxxxxxxxxxxxxxxxxxxxx
xxxxxxxxxxxxxxxxxxxxxxxxxxxxxxxxxxxxxxxxxxxLELKKLGEISWEExxxxxxxxxxxx
xxxxxxxxxxxxxxxxxxxxxxxxxxxxxxxxxxxxxxxVLGGWLFHVRRARRSGDVxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxQLIAAAPGKNVVNVQxxxxxxxxxxxxxxxxxxxxxxxxxxxxxxxx
xxxxxxxxxxxxxxxxxxxxxxxxxLKEEGKEELQEISTxxKKGMTTILDYHPGxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxSRELVRGCDLPVWLAWxxxx
xxxxxxxxxxxxxxxPDEHEILNDSGxxxKCRTPGGAKRALRPRWCDExxxxxxxxxxxxxxxxAEGRRG
AAEILVVLSELPDxxxxxxxxxxxxxxxxxxxxxxxxxxxxxxxxxxxxxxxxxxxxxxxxxxxxx
xxxxxxxxxxxxxxxxxxxxxxxxxxGAKPTHISYIMxxxxxxxxxxIIPEPGQQRSxxxxxxxxxI
IGILTLLSIVAANELGxxEKTKEDFFGRRNxxIPSGASPWSWPDLxxxxxxxxxxxxxxxxxxxxxxx
xxxxxxxxxxxxxxxxxxxxxxxxxxxxxxxxxxxxMNISVIMLLISGWNSxxxxPLLCGIGCAMLHWTLI
Lxxxxxxxxxxxxxxxxxxxxxxxxxxxxxxxxxxxxxxxxxxxxxxxxxxxxxxxxxxxxxxxxxx
```

FIG. 59-16

```
xxxxxxxxxxxxxxxxxxxxxxxxxxxxxxxxxxxxxxxxxxxxMYNLWKMKTERRGTANGKTLG
EVxxxxxxNLLDKQQFEMYKRTxxxxxxxxxxxxxxxxxxxxxxxxxxxxxxxxxxxxxxxxxxx
xxxxxxxxxxxxxxxxxxxxxxxxxxxxxxxxxxxxxxxxxxxIVTFKDKTDIHRLEPLKCETLLC
DIGESSPSSITEGERTLRVLETIEKWxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxGAIEER
VERIKNEYAATWFYDNDNPxxxxxxxxxxxxxxxxxxxxxxxxxIKLLTYPWDKIExxxxxxxxxxxx
xxxxxxxxxxxxxxxxxxxxxxxxxxxxxxxxxxLFRHLAREKKPRLCTxxxxxxxxxxxxAIGAFLEEQ
EQxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxDLSAKEGGGFYADxxxxxxxxxxxxxxxxxxEQE
ILSYMSSHHKKLAQAVxxxxxxxxxxxxxxxxxxxxxxxxxxxxxxxxxxxxxxxxxxxxxxxxx
xxxAEAENVIHHQHVQECGENxLVRLETWLIEHGCDRLSRMAVNGDDCVVKPVDDRFGLAxxxxxxxxx
xxxxxxxxxxPSKEWTDWENVPFCSHRFHELVLKDGRKIVVxxxxxxxxxxxxxxxxxxxxxxxx
xxxxxxxxxxxxxxxxxxxxxxxxxxxxxxxxxxxxxxxxxxxRGEWMTTEDRLEVWNRVWIxNN
PHMKDKTTVKEWRDVPYxxxxxxxxxxxxxxxxxxxxxxxxxxxxxxxxIRNLIGQEKYTDxxxxxxxxx
xxxxxxxxxxxx >YFV|peptide_length:10|string5 xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxAVQFLILGMLxxTGGVTLMRKNxxxxxxxx
AEDLGKTFSIGTGNCTTNIxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxAIAYLVGNNTxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxGAKQENWKTDIKTLKxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxGNCDGRGKSAxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxFTVAVGLHFHxxxxxxxxxxxxxxxxxSFSIRPGLLIxxxxxx
xxxxxxxxxxxxxxxxxxxxxxxxxxxxxxxxxxAISSRKASNAVLxxxxxxxxxMTMYE
VRLAAMLLCAVVIIGVLYQNSKDxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxLGGWILHIKGARRSxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxKCRSPGGAKRALRxxxxxxxxxxxxxxxxxxxxxRRG
AADVLVVLSELPxxxxxxxxxxxxxxxxxxxxxxxxxxxxxxxxxxxxxxxxxxxxxxxxxxxx
```

FIG. 59-17

```
xxxxxxxxxxxxxxxxxxxxxxxxxxxxxxxxxxxxxxxxxxxxxxxxxxxxxxxxxxxx
xxxxxxxxxxxxxxxxxxxxxxTKEDFFGKRDxxTSSSASPWSWPxxxxxxxxxxxxxxxxxxxxx
xxxxxxxxxxxxxxxxxxxxxxxxxxxxxxxxxxxxxxxxxxxxxxxxxxGIGCATLHWSLx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxDKTDVHRLESVKCDTLLC
DxxxxxxSSATEGERTLRVLETVEKWxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxKTEYAATWFYDNDNxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxEMVINHHHVQDCDDSxLERLEAWLIEHGCDRLNRMAVNGDDCxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxEWMTTQDMLDVWNRVxxxxx
xHMTDKTTIKEWRDVPYxxxxxxxxxxxxxxxxxxxxxxxxxxxxxxxxxxxxxxxxxxxx
xxxxxxxxxxx >YFV|peptide_length:11|string1

MSGRKAQGKTLGVNMVRRGVRSLSNKIKQKTKQIGNRPGPSRGVQGFIFFFLFNILTGKKITAHLKRL
WKMLDPRQGLAVLRKVKRVVASLMRGLSSRKRRSHDVLTVQFLILGMLLMTGGVTLVRKNRWLLLNVT
SEDLGKTFSVGTGNCTTNILEAKYWCPDSMEYNCPNLSPREEPDDIDCWCYGVENVRVAYGKCDSAGR
SRRSRRAIDLPTHENHGLKTRQEKWMTGRMGERQLQKIERWFVRNPFFAVTALTIAYLVGSNMTQRVV
IALLVLAVGPAYSAHCIGITDRDFIEGVHGGTWVSATLEQDKCVTVMAPDKPSLDISLETVAIDRPAE
VRKVCYNAVLTHVKINDKCPSTGEAHLAEENEGDNACKRTYSDRGWGNGCGLFGKGSIVACAKFTCAK
SMSLFEVDQTKIQYVIRAQLHVGAKQENWNTDIKTLKFDALSGSQEVEFIGYGKATLECQVQTAVDFG
NSYIAEMETESWIVDRQWAQDLTLPWQSGSGGVWREMHHLVEFEPPHAATIRVLALGNQEGSLKTALT
GAMRVTKDTNDNNLYKLHGGHVSCRVKLSALTLKGTSYKICTDKMFFVKNPTDTGHGTVVMQVKVSKG
APCRIPVIVADDLTAAINKGILVTVNPIASTNDDEVLIEVNPPFGDSYIIVGRGDSRLTYQWHKEGSS
IGKLFTQTMKGVERLAVMGDTAWDFSSAGGFFTSVGKGIHTVFGSAFQGLFGGLNWITKVIMGAVLIW
VGINTRNMTMSMSMILVGVIMMFLSLGVGADQGCAINFGKRELKCGDGIFIFRDSDDWLNKYSYYPED
PVKLASIVKASFEEGKCGLNSVDSLEHEMWRSRADEINAIFEENEVDISVVVQDPKNVYQRGTHPFSR
IRDGLQYGWKTWGKNLVFSPGRKNGSFIIDGKSRKECPFSNRVWNSFQIEEFGTGVFTTRVYMDAVFE
YTIDCDGSILGAAVNGKKSAHGSPTFWMGSHEVNGTWMIHTLEALDYKECEWPLTHTIGTSVEESEMF
MPRSIGGPVSSHNHIPGYKVQTNGPWMQVPLEVKREACPGTSVIIDGNCDGRGKSTRSTTDSGKVIPE
WCCRSCTMPPVSFHGSDGCWYPMEIRPRKTHESHLVRSWVTAGEIHAVPFGLVSMMIAMEVVLRKRQG
PKQMLVGGVVLLGAMLVGQVTLLDLLKLTVAVGLHFHEMNNGGDAMYMALIAAFSIRPGLLIGFGLRT
LWSPRERLVLTLGAAMVEIALGGVMGGLWKYLNAVSLCILTINAVASRKASNTILPLMALLTPVTMAE
VRLAAMFFCAVVIIGVLHQNFKDTSMQKTIPLVALTLTSYLGLTQPFLGLCAFLATRIFGRRSIPVNE
ALAAAGLVGVLAGLAFQEMENFLGPIAVGGLLMMLVSVAGRVDGLELKKLGEVSWEEEAEISGSSARY
DVALSEQGEFKLLSEEKVPWDQVVMTSLALVGAALHPFALLLVLAGWLFHVRGARRSGDVLWDIPTPK
IIEECEHLEDGIYGIFQSTFLGASQRGVGVAQGGVFHTMWHVTRGAFLVRNGKKLIPSWASVKEDLVA
YGGSWKLEGRWDGEEEVQLIAAVPGKNVVNVQTKPSLFKVRNGGEIGAVALDYPSGTSGSPIVNRNGE
VIGLYGNGILVGDNSFVSAISQTEVKEEGKEELQEIPTMLKKGMTTILDFHPGAGKTRRFLPQILAEC
ARRRLRTLVLAPTRVVLSEMKEAFHGLDVKFHTQAFSAHGSGREVIDAMCHATLTYRMLEPTRVVNWE
VIIMDEAHFLDPASIAARGWAAHRARANESATILMTATPPGTSDEFPHSNGEIEDVQTDIPSEPWNTG
HDWILADKRPTAWFLPSIRAANVMAASLRKAGKSVVVLNRKTFEREYPTIKQKKPDFILATDIAEMGA
```

FIG. 59-18

NLCVERVLDCRTAFKPVLVDEGRKVAIKGPLRISASSAAQRRGRIGRNPNRDGDSYYYSEPTSENNAH
HVCWLEASMLLDNMEVRGGMVAPLYGVEGTKTPVSPGEMRLRDDQRKVFRELVRNCDLPVWLSWQVAK
AGLKTNDRKWCFEGPEEHEILNDSGETVKCRAPGGAKKPLRPRWCDERVSSDQSALSEFIKFAEGRRG
AAEVLVVLSELPDFLAKKGGEAMDTISVFLHSEEGSRAYRNALSMMPEAMTIVMLFILAGLLTSGMVI
FFMSPKGISRMSMAMGTMAGCGYLMFLGGVKPTHISYIMLIFFVLMVVVIPEPGQQRSIQDNQVAYLI
IGILTLVSAVAANELGMLEKTKEDLFGKKxxxIPSSASPWSWPDLDLKPGAAWTVYVGIVTMLSPMLH
HWIKVEYGNLSLSGIAQSAS

FIG. 59-19

```
VVGLYGNGILVGxxSFVSAISQTEVKEESKEELREIPTMLKKGMTTVLDYHPGAGKTRRFxxxxxxxx
xxxxxxxxxxxxxVVLSEMKEAFQGLDVKFHTQAFSAHGSGKEVIDVMCHATLTYRMLEPTRIVNWE
VIIMDExxxxxxxxxxxxxxxxxxxxxxxxxxxxxxxxxxxxxxxxxxxxxxxxxxxxVQTDIPSEPWTSG
HEWILADKRPTAxxxxxxxxxxxxMAASLRKAGKNVVVLNRKTFEKEYPTIKQKRPDFILATDIAEMGA
NLCVERVLDCRTAYKPVLVDEGKKVAIKGPLRIxxxxxxxxxxxxxxxxxxxxxxxxxSYYYSEPTSEDNAH
HVCWLEAxxxxxxxxxxRGGMVAPLYGIEGIKTPVSPGEMRLRDDQRRVFRELVRGCDQPVWLSWQVAK
PGLKTNDRKWCFDGPEEHEILNDNGETVKCRSPGGAKKALRPRWCDERVSSDQSALADFIKFAEGRRG
AAEMLVVLTELPDFLAKKGGEAMDTISVLLHSEEGSRAYxxxLSMMPEAMTIVMLFLLAGLLTSGMVI
FFMSPKGMSRMSMAMGTMAGSGYLMFLGGVKPTHISYVMLIFFVLMVVIIPEPGQQRSIQDNQVAYLI
IGILTLVSVVAANELGMLEKTKEDFFGKRxxxTSGGTIPWSWPDLDLKxxxAWTVYVGIVTILSPMLH
HWIKxxxxxxxxxxxxxxxASVLSFMDKGIPFMKMNISVIILLVSGWNSITVIPLLCGVGGAMLHWTLI
LPGIKAQQSKLAQKRVFHGVAKNPVVDGNPTADIEEAPEMPVLYEKKLALYLLLALSLMSVAMCRTPF
SLAEGIVLASAASGPLIEGNTSLxxxxxxxVSMTGVMRGNYYAFVGVMYNLWKMETGRRGRASGKTLG
EVWKRELNLLDKRQFELYKRTDITEVDRDMARRHLAEGKVxxxxxxxxxxxxxxxxxxxRGYVKLEGRV
TDLGCGRGGWCxxxxAQKEVSGVKGYTLGREGHEKPMNVQSLGWNIVTFKDKTDIHHLEPAKCETLLC
DIGESSSSSVTEGERTMRVLETIEKWLACGVDNFCIKVLAPYMPDVIEKLELLQRRFGGTIIRNPLSR
NSTxxMYYVSGARSNITFTVNQTSRLxxxxxRRPTGKVTLEPDVTLPIGTRSVETDKGPLDRDAIEER
VERIKSEYMTTWFHDNDNPYRTWHYCGSYITKTSGSAASMINGVIKILTFPWDKIEEVTRMAMTxxxx
xxxxxxxxxxxxxxxDPPAGTRKIMRVVNRWLFRHLAREKSPRLCTKEEFIAKVRSHAAVGAFLEEQ
DQWKTANEAVQDPKFWEMVDAERKLHQQGRCQSCVYNMMGKRExxxxxxxxxxxxxAIWYMWLGARFL
EFEALGFLNxxxxxxRENSGGGVEGIGLQYLGYVIKDLSTKEGGGLYADDTAGWDTxxxEADLDDEQE
IMSYMNAEQRKLAWAIMEMTYKNKVVKVLRPAPGGKAFMDIISRRDQRGSRQVVTYALNTIxxxxVQL
IRMAEAEMVINHQHVNECDESxLARLEAWLTEHGCDRLRRMAVSGDDCVVRPVDDRFGMALSHLNAMS
KxxKDISEWQPSKGWTDWESVPFCSHHFELHLKDGRKVVVPCRDQDELIGRGRVxxxxxxxxxxxxx
xxxxxxxxxxxxxFHKRDMRLLSFAVSSAVPTAWVPSGRTTWSVHGKGEWMTTEDMLDVWNRVWVTNN
PHMQDKTMVKEWRDVPYLTKRxxxxxxxxxGMTNRATWASHIHLVIHRIRTLVGQEKFTDYLTVMDRY
SVDADLQPGELI >YFV|peptide_length:11|string3 xxxxxxxxxxxxxxxxxxxxxxxxxxxxxxxxxxxxxxGPSRGVQGFISFFSFNILTGKKLTAQLKKL
WKMLDPRQGLTVLRKVKRVVASLMRGLSSRKRRSHDALAVQLLILGMILMTGGVTLMRKNRxxxxxxT
SEDLGKTFSLGTGNCTTNILxxxxxxxxxxxxxxxxxxxxxxxxxxxxxxGVENVRVTYGKCDSAGR
SxxxxxxxxxxxxxxxxxxxxxxxxxxxxxxxxxxxxxxxRWLVRNPFFAITALAIAYLVGNNTTQRVV
IALLVxxxxxxxxxxxxxxxxxxxxxxxxGTWVSATLEQGKCVTVMxxxxxxxxDISLETVAIDRPAE
ARKVCYNAVLTHVKIDDxxxxxxxxxxxxxxxxxxxxxxxxxxxxxxxxxxxxxxxxxxxxxxxxxx
xxxxxxxxQTKIQYVIKAQLHVGAKQENWNTDIKTLKFDALSGSQEAEFTGYGKATLECRVQTAVxxG
NSYIAEMEKDSWIVDRQWAxxxxxxWQSGSGGVWRGMHHLVEFxxxxAVTIRVLALGNQxxxxxxxxx
xxxxxxxxxxxxxxxxxxxxxxxxxxxxxxxxxxxxxxMSFVKNPTDTDHxxxxxQVKVPKG
APCRIPVIxxxxxxxxxxxxxxxxxxxxxxxxxxxxxxPFGDSYIIIGTGDSRLTYQxxxxxxx
xxxxxxxxxGVERLAVMGDVAWDFSSAGGFLTSVGKGIHTVxxxxxxxxxxGGLNWITKVIMGVVLIW
VGINTRxxxxxxxxxxxxxxxxxxxxxxxGADQGCAINFAKRELKCGxxxxxxxxxxxxxxxxxxxxx
xVKLASIIKASYEEGKCGLNSVxxxxxxxxxxxxxxxIFEENEVDISIVVQDPKNIYQxxxxxxx
xxxxxxYGWKTWGKSLVFSPGRKNGxxxxxxxxxxxxxxxxxxxxxxxxVFTTRVFMDATFD
YSVDCDGAxxxxxxxxxxxxxxxxxxxxGSHEVNGTWMMHTLEALDYKECEWPPxxxxxxxxxxxxxx
xxxxxxxxxxxxxxxxxxxxxMQVPLEVRREVCPGTSVVLDTGCDGRGKSARSTTDSGKIIxx
xxxxxxxxxxxxxxxxxWYPMEIRPRKAHESHLVRSWVxxxxxxxxxxxxMMIAMEVVLRRRQG
PKQMLVGGMVLLGAMLVGQVTMLDLVKLVMAVGLHFEMNxxxxxMYMALIASFSIRPGLLVGFGLRT
LWSPRERLVMAFGAAMVEVALGGMMGGLWQYLNAxxxxxxxxNAISSRKASNAILPLMALLTPVTMAE
VRLAAMLFCTVVIIGVLHQNAKDTSMQKTIPxxxxxxxxxxxxxxxLGLCAFLATRLFGRRSIPVNE
```

FIG. 59-20

```
xxxxxxxxxxxxxxxxxxxxxxxxxxxxxxILMMLVSVAGRVDGLELKKLGEISWEEEAEISGSSARY
DVALNEQGxxxxxxxxxxxxxxxxxxxxxLALVGAAIHPSALLLVLGGWLFHVRRARRSGDVLWxxPTPK
VIEECEHLEDGISGIFQxxxxxxxxxxxxxxxxxxxxxxxWHVTRGAFLVWNGKKLIPSWAxxxxxxxxA
YGGSWKLDGRWDGEEEVQLIAAAPGKAVVNVQTKPSVFKVRNGGEIGxxxxxxxxxxxxxSPIVNRNGE
VVGLYGNGxxxxxxxxxxxAISQTEVKEEGKEELQEIPTMLKKGKTTILDYHPGAGKTxxxxxxxxxxx
xxxxxxxxxxxxxxxxxxxxxxxxxxxxxxxxxxxxxxxxAHGSGREVIDVMCHATLTYRMLEPTRAVNWE
VIIMDExxxxxxxxxxxxxxxxxxxxxxxxxxxxxxxxxxxxxxxxxxxxxxxxQTDIPSEPWTAG
HEWILADKRxxxxxxxxxxxxxxxxxxxxxxxxxxxxxxxxxxxxxxEKEYPTIKQKKPxxxxxxxxxxx
xxxVDRVLDCRTAYKPVLVDEGKKxxxxxxxxxxxxxxxxxxxxxxxxxxxxxxxxxxxxxxxxxxxx
xxxxxxxxxxxxxxxxxxxxxMVAPLYGVEGIKTPVSPGxMRLRDDQRRVSRELVRNCDLPVWLAWQVAK
AGLKTNDRKWCFEGPKEHEILNDSGETVKCRSPGGAKRPLRPRWCDERxxxxxxxxxxxxxxFAEGRRG
AAEMLVILTELPDFLAKxxxxxxxxxxxxxxxxxxxxxxxxxxxxxPEAMTIAMLFLLAGLLTSGAVI
FFMSPKGISRMSMAKGTMAGCGYLMFLGGVEPTHISYIMLIxxxxxxVVIPEPGQQRTIQDNQVAFLI
IGILTLLSIVAANELGMLEKTKEDFFGRRxxxIPSGAIPWSWPDLDLxxxxxxxxxxxxxxxxxxxxx
xxxxxxxxxxxxxxxxxxxxxxxxxxxxxxVPFMKMNISVVMLLISGWNSITVMPLLCGIGCATLHWSLI
LPGIKAQQSKLAQRRVFHGVAENPVVDGNPTVDIEEAPEMPVxxxxxxALYLLLALSLSSVAMCRTPF
SLAEGIVLSSAALGPLIEGxxxxxxxxxxxxxxxxxxxxxRGNYYAFVGVMYNLWKMKTARRGSASGKTLG
EVWKRELNLLDRQQFEMYKRTDIIEVDRDMARRHxxxxxxxxxxxxxxxxxxxxxxRGYVKLEGRV
MDLGCGRGGWCxxxxxxxxxxSGVKGFTLGREGHEKPMNVRSLGWNIITFKDKTDIHRLEPLKCETLLC
DIGESSPSSVTEGERTLRVLETVEKWLACGVxxFCVKVLAPYMRDVLEKLELLQxxxxxxxxxxxxxx
xxxxxxxxxxxxxxxxxxxxxxxxxxxxxxxxxxTGKVTLEADVTLPIGTRSVETDKGPLNREAIKER
VERIKTEYAATWFHDNDNPYRxxxxxxxxxxxxxxxxxAASMVNGVIKLLTYPWDKIEEVTRxxxxxxxx
xxxxxxxxxxxxxxxxxxxxxxxxxxxxxxxxxxWLFRHLSREKKPRLCTKEEFIxKVRSHAAIGAYLEEQ
DQWKTAxxxxxxxKFWELVDEERRLHQQGRCRTCxxxxxxxxxxxxxxxxxxxxxxxxxxxxxxxxx
xxxxxxxxxxxxxxxxxxxxxxxxxxxxxTGLQYLGYVIRDLSAMDGGGLYADDTAxxxxxxxxxxxDDEQE
IMSYMSSEQRKLAWAIMEMTYKNKxxxVLRPTPGGKAYMDVISRRDQRGSRxxxxxxxxxxxxxxxxx
IRMAEAENVINHQHVNECDEGxLARLDAWLAENGCDRLARMAVNGDDCVVRPIDDRFGMALSHxxxxxx
xxxxxISEWQPSKGWTDWENVPFCSHHFELVLKDGRKIVVPCRDQDELxxxxxxxxxxxxxxxxxxx
xxxxxxxxxxxxxxxxxxxxxLSFAVSSAVPMAWVPSGRTTWSVHGRGEWMTTEDMLGVWNRVWVLNN
PHMQDKTVIKEWRDVPYLTxxxxxxxxxxxxxxxxxxxxxxxxNIHLVIHRIRTLIGQEKFTDYLTxxxxx
xxxxxxxxxxx
```

>YFV|peptide_length:11|string4

```
xxxxxxxxxxxxxxxxxxxxxxxxxxxxxxxxxxxxxxxxxxxxxxxxxxNILTGKKITAHLKKL
WRMLDPRQGLTVxxxxxxxxxxxxxxIGLSSRKRRSSEMTLFPLLLLGLLALSGGVTLVRKNRxxxxxxxT
SEDLGKTFSVGAGNCTTNILxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxLAIAYLVGNNTTQRVV
IALxxxxxxxxxxxxxxxxxxxxxxxxxxxxxxxxxxxxxxxxxxxxxSLQTVAIDGPVE
ARKVCYNAVxxxxxxxxxxxxxxxxxxxxxxxxxxxxxxxxxxxxxxxxxxxxxxxxxxxxxxxxx
xxxxxxxxxxxxxxxxxxxxxxxLHVGAKQENWKTDIKTLKFDVLSGSQEVEFTGYGKVTLECQxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxGVERLAVMGDAAWDFSSAGGLxxxxxxxxxxxxxxxxxxxxxLNWITKVIMGAVLIW
VGFNxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxNGTWMVHTLETLDYKExxxxxxxxxxxxxxxxxx
xxxxxxxxxxxxxxxxxxxxxxxxxxxxxxxMQVPLEVKREPCPGTSVVVDGSCDGRGKSTRSxxxxxxxxx
```

FIG. 59-21

```
xxxxxxxxxxxxxxxxxxxxxxxxYPMEIRPMKTSDSHLVRSxxxxxxxxxxxxxxxxxxxxxxxxxxxxQG
PKQVLVGGVVLLGAxxVGQVTLLDLLEFIVAVGLHFHEMxxxxxxxxxxxxxASFSIRPGLLVGFGLxx
xxxxxxxxVMAFGAAMVEIALxxxxxxxxxxxxxxxxxxxxxxxNAISSRKASNMILPLMALMTPMTMHE
VRMATMLFCTVVIVGVLYQNSKDTSMQKxxxxxxxxxxxxxxxxxxxxxxxxxxxxxxxxxxxxxxxxx
xxxxxxxxxxxxxxxxxxxxxxxxxxxxxxxxxxxxxxxxxxxxxGLELKKLGEVAWEEExxxxxxxxx
xxxxxxxxxxxxxxxxxxxxxxxxxxxxxxxxxxxxIHPFALLLVLAGWVFHVRRARRSGDVLxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxVQLIAAVPGKAVVNVQTKPSVxxxxxxxxxxxxxxxxxxxxxxxxxxxxxxx
xxxxxxxxxxxxxxxxxxxxxxxxxELKEEGKEELQEISTMLKKGMTTILDYHPGAxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxVFRELVRGCDLPVWLAWQxxx
xxxxxxxxxxxxxGPDEHEILNDSGExVKCRTPGGAKRALRPRWCDERxxxxxxxxxxxxxFAEGRRG
AAEILVVLSELPDFxxxxxxxxxxxxxxxxxxxxxxxxxxxxxxxxxxxxxxxxxxxxxxxxxxxxxxx
xxxxxxxxxxxxxxxxxxxxxxCGYLMFLGGAKPTHISYIMLxxxxxxxxVIIPEPGQQRSIxxxxxxxLI
IGILTLLSIVAANELGMLERTKEDLFGKKxxxIPSGAIPWSWPDLDxxxxxxxxxxxxxxxxxxxxxxxx
xxxxxxxxxxxxxxxxxxxxxxxxxxxxxxxKMNISVIMLLISGWNSIxxIPLLCGIGCAMLHWTLI
LPxxxxxxxxxPQRRVFHGVAKxxxxxxxxxxxxxxxxxxxxxxxxxxxxxxxxxxxxxxxxxxxxxxx
xxDEGIVLASAALxxxxxxxxxxxxxxxxxxxxxxxxxxxxxxxxxVAYNLWKMKTERRGTANGKTLG
EVWxxxLNLLDKQQFEMYKRTDxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxNIVTFKDKTDVHRLESMKCDTLLC
DIGESSSSSITEGERTLRVLETVEKWLxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxGAIEER
VERIKTEYAATWFHDNDNPYxxxxxxxxxxxxxxxxxxxxxxxVIKILTYPWDKIEExxxxxxxxxxx
xxxxxxxxxxxxxxxxxxxxxxxxxxxxxxxxWLFRHLAREKKPRLCTKxxxxxxxxxxxAAIGAFLEEQ
EQWxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxRDLAAMDGGGLYADDxxxxxxxxxxxxxDEQE
ILNYMSPEQRKLAWAIMxxxxxxxxxxxxxxxxxxxxxxxxxxxxxxxxxxxxxxxxxxxxxxxxxxxx
xxMAEAEMVIHHHHVQDCDDSxLVRLEAWLIEHGCDRLNRMAVSGDDCVVKPVDDRFGLALxxxxxxx
xxxxxxxxQPSKEWTDWENVPFCSHRFHELVLKDGRKIVVPxxxxxxxxxxxxxxxxxxxxxxxxxxxx
xxxxxxxxxxxxxxxxxxxxxxxxxxxxxxxxxxxxxxxxxxxxxVHGKGEWMTTQDRLEVWNRVWILNN
PHMKDKTTVKEWRDVPYLxxxxxxxxxxxxxxxxxxxxxxxxxxxxxxxRIRNLIGQEKYTDYxxxxxxx
xxxxxxxxxxxx >YFV|peptide_length:11|string5 xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxTVQLLILGMILxGGGVTLVRKNRxxxxxxT
AEDLGKTFSMGTGNCTTNILxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxLAIAYLVGNNKTxxxx
xxxxxxxxxxxxxxxxxxxxxxxxxxxxxxxxxxxxxxxxxxxxxxxxxxxxxxxxxxETVAIDGPVE
ARKVCYNxxxxxxxxxxxxxxxxxxxxxxxxxxxxxxxxxxxxxxxxxxxxxxxxxxxxxxxxxxxxxxx
xxxxxxxxxxxxxxxxxxxxxxxxxVGAKQEDWKTDIKTLKFDAxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
```

FIG. 59-22

```
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxDTGCDGRGKSTRxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxFTMAVGLHFHEMxxxxxxxxxxxxASFSIRPGLLMGxxxxx
xxxxxxxxxxxxxxxxxxxxxxxxxxxxxxxxxxxxxNAIASRKASNAILPxxxxxxxPVTMYE
VRMATMLLCAVVIVGVLHQNSKDTxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxVLGGWILHIKGARRSGxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxVKCRAPGGAKRPLRPxxxxxxxxxxxxxxxxxxxxxxGRRG
AADVLVVLSELPDxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxTSSSASPWSWPDxxxxxxxxxxxxxxxxxxxx
xxxxxxxxxxxxxxxxxxxxxxxxxxxxxxxxxxxxxxxxxxxxxxxxxxxxxCGIGCAMLHWTLI
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxITFKDKTDVHPLEPLKCETLLC
DIxxxxPSSATEGERTLRVLDTVEKWLxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxIKNEYAATWFYDNDNPxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxAEMVINHQHVQECGENxLERLETWLAENGCDRLSRMAVSGDDCVxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxGEWMTTEDRLEVWNRVWxxxx
PHMTDKTTIKEWRDVPYLxxxxxxxxxxxxxxxxxxxxxxxxxxxxxxxxxxxxxxxxxxxx
xxxxxxxxxxx
```

FIG. 60-1

\>TBEV|peptide_length:8|string1

MAGKAILKGKGGGPPRRVSKETAKKTRQSRVQMPNGLVLMRMMGILWHAVAGTARSPVLKSFWNSVPL
KQATAALRKIKKAVSTLMVGLQRRGKRRSAxDWTGWLLVxxxxxxxTLAATVRKERDGTTVIRAEGKDA
ATQVRVENGTCVILATDMGSWCDDSLTYECVTIDQGEEPVDVDCFCRNVDGVYLEYGRCGKQEGSRTR
RSVLIPSHAQGDLTGRGHKWLEGDSLRTHLTRVEGWVWKNKxxxxxxxxxVVWLTVESVVTRVxxVVVL
LCLAPVYASRCTHLENRDFVTGTQGTTRVTLVLELGGCVTITAEGKPSMDVWLDSIYQENPAKTREYC
LHAKLSDTKVAARCPTMGPATLAEEHQSGTVCKRDQSDRGWGNHCGLFGKGSIVTCVKASCEAKKKAT
GHVYDANKIVYTVKVEPHTGDYVAANETHSGRKTASFTVSSEKTILTMGDYGDVSLLCRVASGVDLAQ
TVILELDKTSEHLPTAWQVHRDWFNDLALPWKHEGAQNWNNAERLVEFGAPHAVKMDVYNLGDQTGVL
LKSLAGVPVAHIDGTKYHLKSGHVTCEVGLEKLKMKGLTYTMCDKTKFTWKRIPTDSGHDTVVMEVAF
SGTKPCRIPVRAVAHGSPDVNVAMLITPNPTIENNGGGFIEMQLPPGDNIIYVGELSHQWFQKGSSIG
RVFQKTRKGIERLTVIGEHAWDFGSTGGFLTSVGKALHTVLGGAFNSLFGGVGFLPKILVGVALAWLG
LNMRNPTMSMSFLLAGGLVLAMTLGVGADVGCAVDTERMELRCGEGLVVWREVSEWYDNYAYYPETPG
ALASAIKETFEEGTCGIVPQNRLEMAMWRSSATELNLALAEGDANLTVVVDKLDPTDYRGGIPGLLKK
GKDIKVSWKSWGHSMIWSVPEAPRRFMVGTEGGSECPLERRKTGVFTVAEFGVGLRTKVFLDFRQEST
HECDTGVMGAAVKNGMAVHTDQSLWMKSVRNDTGTYIVELLVTDLRNCSWPASHTIDNAEVVDSELFL
PASLAGPRSWYNRIPGYSEQVKGPWKYSPIRVTREECPGTRVTINADCDKRGASVRSTTESGKVIPEW
CCRTCTLPPVTFRTGTDCWYAMEIRPVHDQGGLVRSMVVADNGELLSEGGIPGIVALFVVLEYVIRRR
PATGTTAMWGGIVVLALLVTGLVRIESLVRYVVAVGITFHLELGPEIVALTLLQAVFELRVGLLSAFA
LRSNLTVREMVTIYFLLLVLELGLPSxxxxxLWKWGDALAMGALIFRACTAEEKTGVGLLLMALMTQQ
DxxxAHYGLMLFLGxxxxxxxxWKLIRGHREQKGLTWIVPLAGLLGGEGSGVRLLAFWELAxHGGRRSF
SEPLTVVGVMLTLASGMMRHTSQEALCALAVASFLLLMLVLGTRKMQLVAEWSGCVEWHPELMNEGGE
VSLRVRQDSMGNFHLTELEKEERVMAFWLLAGLAASAFHWSGILGVMGLWTLSEMLRTARRSDLVFSG
QGGRERGDRPFEVKDGVYRIFSPGLLWGQRQVGVGYGSKGVLHTMWHVTRGAALSIDDAVAGPYWADV
KEDVVCYGGAWSLEEKWKGETVQVHAFPPGRAHEVHQCQPGELLLDTGRRxGAVPIDLAKGTSGSPIL
NSQGVVVGLYGNGLKTNETYVSSIAQGEAEKSRPNLPPAVxGTGWTAKGQITVLDMHPGSGKTHRVLP
ELIRQCIDRRLRTLVLAPTRVVLKEMERALNGKRVRFHSPAVGDQQVGGAIVDVMCHATYVNRRLLPQ
GRQNWEVAIMDEAHWTDPHSIAARGHLYTLAKENKCALVLMTATPPGKSEPFPESNGAISSEEKQIPD
GEWRDGFDWITEYEGRTAWFVPSIAKGGIIARTLRQKGKSVICLNSKTFEKDYSRVRDEKPDFVVTTD
ISEMGANLDVSRVIDGRTNIKPEEVDGRVELTGTRRVTTASAAQRRGRVGRQEGRTDEYIYSGQCDDD
DSGLVQWKEAQILLDNITTLRGPVATFYGPEQDKMPEVAGHFRLTEEKRKHFRHLLTHCDFTPWLAWH
VAANVSSVTSRNWTWEGPEENTVDEANGDLVTFRSPNGAERTLRPVWRDARMFREGRDIREFVAYASG
RRSFGDVLSGMSGVPELLRHRCVSAMDVFYTLMHEEPGSRAMRMAERDAPEAFLTVVEMMVLGLATLG
VVWCFVVRTSISRMMLGTLVLLASLALLWAGGVSYGNMAGVALIFYTLLTVLQPEAGKQRSSDDNKLA
YFLLTLCSLAGLVAANEMGFLEKTKADLSTVLWSxxxELRSWEEWTNIDIQPARSWGTYVLVVSLFTP
YIIHQLQTKIQQLVNSAVATGAQAMRDLGGGAPFFGVAGHVMALGVVSLVGATPTSLVVGVGLAAFHL
AIVVSGLEAELTQRAHKVFFSAMVRNPMVDGDVINPFGEGEAKPALYERKMSLVLAIVLCLMSVVMNR
TVPSITEASAVGLAAAGQLLRPEADTLWTMPVACGLSGVVRGSLWGFLPLGHRLWLRASGSRRGGSEG
DTLGDLWKRKLNGCTKEEFFAYRRTGILETERDKARELLRRGETNMGLAVSRGTAKLAWLEERGYATL
KGEVVDLGCGRGGWSYYAASRPAVMSVKAYTIGGKGHETPKMVTSLGWNLIKFRAGMDVFSMQPHRAD
TIMCDIGESNPDAVVEGERTRKVILLMEQWKNRNPTATCVFKVLAPYRPEVIEALHRFQLQWGGGLVR
TPFSRNSTHEMYYSTAVTGNIVNSVNIQSRKLLARFGDQRGPTRVPELDLGVGTRCVVLAEDKVKEKD
VQERISALREQYGETWHxDREHPYRTWQYWGSYRTAPTGSAASLINGVVKLLSWPWNAREDVVRMAMT
DTTAFGQQRVFKEKVDTKAQEPQPGTKVIMRAVNDWILERLARKSKPRMCSREEFIAKVKSNAALGAW
SDEQNRWSSAKEAVEDPAFWQLVDEERERHLAGRCAHCVYNMMGKREKKLGEFGVAKGSRAIWYMWLG
SRFLEFEALGFLNEDHWASRGSSGSGVEGISLNYLGWYLKGLSTLEGGLFYADDTAGWDTKVTNADLE
DEEQLLRYMEGEHKQLAATIMQKAYHAKVVKVARPSRDGGCIMDVITRRDQRGSGQVVTYALNTLTNI
KVQLIRMMEGEGVIEASDAHNPRLLRVERWLRDHGEERLGRMLVSGDDCVVRPVDDRFGKALYFLNDM
AKTRKDIGEWEHSVGFSNWEEVPFCSHHFHELVMKDGRALIVPCRDQDELVGRARVSPGCGWSVRETA

FIG. 60-2

```
CLSKAYGQMWLLSYFHRRDLRTLGLAICSAVPVDWVPTGRTTWSIHASGAWMTTEDMLDVWNRVWILD
NPFMHSKEKxxEWRDVPYLPKSHDMLCSSLVGRKERAEWAKNIWGAVEKVRKMIGxxKFKDYLSCMDR
HDLHWELKLESSII

>TBEV|peptide_length:8|string2

MVKKAILKGKGGGPPRRVSKETATKTRQSRVRMPSGLVLMRMMGILWHAVAGTARNPVLKAFWNSVPL
RQAMAALRKIKRTVSALMVGLQKRGKRRSAxDWMSWLLVxxxxxxAFAATVRKERDGSTVIRAEGRDA
ATQVRxENGTCVILVTDMGSWCDDSLSYECVTIDxxxxxxxxxCFCRNVDGVHLEYGRCGxxxxxxxTR
RSVLIPSHAQGELTGRGRKWLEGDSxxxxxxxxEGWVWKNRxxxxxxxxVVWLTLESVVTRVxxLVAL
FCLAPVYAxxxxxxxxxxxxxxxxxxxxxxxxxxxxxxxxxSMDVWLDAIYQESPAQTREYC
LHVKLSDTKVAARCPTMGPATLAEEHQGGTVCKRDxxxxxxxxxxxFGKGSIVACVKAACEAKKKAT
GHVYDANKIVYTIKVEPHTGDYVAPHETHSGRKTASFTISSEKTILTMGEYGDVSLLCKVPSGVDLAQ
xxILELDKTVEHLPTAWQVRRDWFNDLALPWRHEGAQQWNNAERLVEFGVPHAVKMDxxxxxxQTGVL
LKALAGVPVAHIEGAKYHLKSGxxxxxxGLEKLKMKGLTYTMCDKTKFTWKRAPTDSGHDTVVMEVTF
SGTKPCxxxVRAVAHGFPDVNVAMxxTPNPTIETNGGGFIExxxxxxxxxxIYVGELSYQWFQKGSxxG
RVFQKTKRGIERLTVxxxHAWDFGSAGGFLSSIGKAVHTVLGGAFNSIFGGVGFLPKLLLGVVLAWLG
LNxRNPTMSMGFLLAGVLVLAMTLGVGADVGGAVDTERMxxxxxxxxxxxxxxEWYDNYAFYPETPG
ALASAIKETFEEGSCGVLPQNRLEMAMWRSSVTELNLALAEGEANLTVVVDKFDPTDYRGGVPGLLRK
GKDIKVSWKSWGQSMIWSIPEASRRFMVGTEGSNECPLERRKTGIFTVAEFGxGLRTKVFLDFRQEPT
HECDTGxxxxAVKNGMAIHTDQSLWMRSMKNETGTYIVExxxxxxxxxxASHTIDNADVVDSESFL
PASLAxxxxxYNRIPGYAEQVKGPWKHTPIRVIREECPGTKVTINAKCDRRGASVRSxxxxxxxIPEW
CCRACTMPPVTIRTGTDCWxxxxxxxVHDQGGLIRSTVVADNGELLSEGGVPGIVALFVVLEYIIRRR
PSTGTTVVWGGVIVLALLVTGMVKVESLVRYVVAVGITFHFELGPEIVALMLLQAVFExxxxxLSAFA
LRRSLTVREMVTTYFLLLVLELGLPGxxxxxFWRWGDALAMGALIFRACTAEGKTGAGLLLMALMTQR
DxxxVHHGLVCFLSxxxxxxxWRLLKGHREQKGLTWIVPLARLLGGEGSGIRLLAFWELSxHRRRRSF
SEPxxxxGVMLTLAGGMMRHTPQEALCALxxxxxxxxxxxxxxxxxxxxxxxxWSGCVEWHPELVNEGGE
VSLRVRQDAMGNFHLTELEKEERMMAFWLIAGLAASAIHWSGIIGVMGLWTLTEMLRSSRRSGLVFSG
QGGRERGDKPFEVRDGVYRIFSPGLFWGQNQVGVGYGFRGVLHTMWxVTRGAALSINDAVVGPYWADV
REDVVCYGGTWSLEEKWRGETVQVHAFPPGKAHEVHQCQPGELILDTGRKxGAIPIDLVKGTSGSPIL
NAQGAVVGLYGNGLKTNGTYVSSIAQGEVEKSRPNLPQAVxGTGWTSKGQITVLxxxxxxxxxxxxxxP
ELIRQCTDRRLRTLxxxxxxxxxKEMERALSGKRVRFHSPAVSDQQAGGSIVDLMCHTTYVSRRLLPQ
GRQNWEVATIDEAHWTDxxxxxxxGHLYTLAQENKCALVLMTATRPGKSEPFPESNGAITSEERQIPE
GEWRDGFxxITEYEGRSAWFVPSIAKGGAIARALRQKGKSxxxxxxxKTFEKDYTRVRDEKPxxxxxxx
xxxxxxxxxxxxxxxxxxxxxxKPEEVDGKVELIGTRRVTTASAAPRRGRVGRQDGRIDEYIYSGQCDDY
DGVLVQWKEGQILLDNITTLRGPVVTFYGPEQDRMPEVAGHYRLTEEKRxxxxxxxxxxxxxxxxxxxxH
VAANVSSVTDRSWTWEGPEENAVDEASGDLVTFKSPNGAERTLRPVWKDARMFKEGRDIKEFIAYASG
RRSFGDVLTGMSGVPExxRHRCVSALDVFYTLMHEEPGSRAMKMAERDAPEAFLTMAEVLVLGLATLG
VIWCFVVRASISRMMLxxLVLLASLLLLWAGGVGYGNMAGVxxxxxxxLTVLQPEVGKQRSSDxxxxx
xFLLTLCSVAGLVAANEMGFLERTKADLSTALWSxxxEPRPWSEWTNVDIQPARSxxxxxxxVSLFTP
YMIHQLQTKxxQLVNSAVASGAQAMRDLGGGTPFFGVAGHVMTLGVVSLIGATPTSLMVGVGLAALHL
AIVVSxxxxxxxxxxxxxxxxxxAMVRNPMLDGDVINPFGEGETKPALYERKMSLVLAIALCLMAVVMNR
TVASITEASAVGLAAVGQLLRPEVDTLWTMPVACGMSSVVTGSLWGFLxxxxxLWLRASGGRRGGADG
DTLGDLWKRRLNNCTREEFFVYRRAGIMETERDKARELLRKGETNTGLAVSRGxxxxxxxxxxxxxxx
xxxxxxxxxxxxxxxYYAASRPAVMSVRAYTIGGRGHEAPRMVTSLGWNLIKFRSGVDVFSMQPHRAD
TVMCDIGESSPDAAVEGERTRRVILLMEQWKNRNPTAACVFKVLAPYRPEVIEALHRFQLRWGGGLVR
xxFSRNSTHEMYYSTAITGNIVNSVNVQSRKLLARFGDQRGPTKVPELDLGIGTRCVVLAEDKVKEQD
VQERIRALREQYSETWHxDEEHPYRTWxxxxxxxxxxTGSAASLTNGVVKLLxxxxxxxxxxxVRMAMT
DPTPAGQQRVFKDNADTKAQEPQPGTRVIMRAVNDWILERLAQKSKPRMCSKEEFIAKVKSSAALGAW
SDEQNRWASAREAVEDPAFWHLVDEERERHLMGRCAHCVHNIMGKREKKLGEFGVSKGSRAMWYMWLG
```

FIG. 60-3

SRFQEFEALGFxxEDHWASRESSGAGVEGISLNYLGWHLKKLSTLNGGLFYADxxxxxxxxxxxxDLE
DEEQILRYMEGEHKQLATTVMQKAYHAxxxKVARPSRDGGCVMDVITRRDQRGSVQVVTYALNTHTNI
KVQLxxMMEGEGVIEAADAHNPRLLRVERWLKEYGGERLGRMLxxGDDCVVRPLDDRFSRALYFLNDM
AKTRKDVGEWEHSAGFSSVEAVPFCSHHxxxLVMKDGRTLVVPCRDQDELVGRARISPGCGWSIRETA
CLSxxxxxxxxxxxxxxxRDLRTLGLAINSAVPADWVPTGRxxWSIHASGAWITTENMLDVWNRxxILD
NPFMQNKEKxxEWRDVPYLPKAQDMLCSSLVGRRERAEWARNIWGAVEKVRRMIGxxKFRDYLSCMDR
HDLHWELRLESSII >TBEV|peptide_length:8|string3

MARKAILKGKxxxxPRRVSKETARKTRQPRVQMPSGLVLMRMLGFLWHAIAGTVRSPVLKSFWKSVPL
KQATTALRKIKMAVSTLMIGLQRRGKKRSTxNWTGWLLVxxxxxxTFAATVRKEGDDTTVIRAExxxx
xxxxxxxNGTCVIMATDMGAWCDDSLSxxxxxxxxxxxxxxxxxxxCRNVDRVYLEYGRxxxxxxxxxx
xxxxIRSHAQGELTGRGRKxxxxxxxxxxxxxxxxxxxxxxxxxxxxIVWMTVESVVTRIxxVAVL
FCLAPVxxxxxxxxxxxxxxxxxxxxxxxxxxxxxxxxxxxxxxxxxxxLDAIYQEKPAKTREYx
xxxxxxxxxxxxxxxxTTGPATLTEQHQSGTVCxxxxxxxxxxxxxxxxxxxxxSIVTCVKVACEAKKKxx
GHVYDANKIVYPVKVEPHTGDYVAVNETHSGRKTPSFTVSSEKTILNMGDYGDVxxxxxxxxxxxxxxx
xxILELDKTLEHLPTAWxxxxxxxxxxxxLPWKHEGAQHWNNAERLxxxxxxxxxxxxxxxxxxxxxx
xxxxxxxPVAHIDGAKYHLKxxxxxxxxxxxxxxMNGLTYTVCDKTKFAWKRTPTDSGHDTVVMEVSF
SGTKPCxxxxxxxxxxxxxxxxxxxxxxxxxxxxxxxxxxxxxxxxxxxxxxxxxxxxxxxxxxxxxx
RVFQKTRRGIERLTxxxxxxxDFGSTGGFLASIGKALHTVxxxxxxxLFGGVGFLPKILMGAALAWLG
LxxxxxxxxxMSFLLAGVLxxxxxxxxxxxxxxxxxxxxxxxxxxxxxxxxxxxxxxxxxxxxxxxxx
xLASAIKETFEEGNCGILPQNRLEMAMWRSASTELNLALxxGEANLTVMVDKFDPTDYRGGISGLLKK
GKDIRVSWRSWGQSIIWSIPEAPRRFMVGTEGQSECPPERRKTGVxxxxxxxxxxxxxxFLDFRQEAT
HECDTGxxxxxxxxxxxxxxxQSLWMKSVRNETGTYIxxxxxxxxxxxxxSHTIDNADVVDSESFx
xxxxxxxxxxxxxxxxxxVKGPWKYTPIRVVREECPGTTVTISADCDRRGASxxxxxxxxxxxxxxx
xxxxCTLPPVTIRTxxxxxxxxxxxxxxxQGGLVRSTVVADxxxxxxxxxxxxxxxxxxxxxxxxRRR
PATGTAVVWGGFVVFALLVTGLVKMESLVRYVxAVGIAFHLELGPxxxxxxxxxxxxxxxxxxxSAFA
LRRGLTVREMVITYFLLLVLELGLPYxxxxxLWRWGDALxxxxxxLRACTAEGKAGVGLLLMALMTQQ
NxxxVHYGLIIFLGxxxxxxxWRLLEGHREQKGLSWVVPLAGLMGGEGSGIRLLSFWELSxHGKRRSF
SEPxxxxxxxxxxxSGMMRHTPxxxxxxxxxxxxxxxxxxxxxxxxxxxxxxxxxxVEWYPELVNEGxx
xxxxxxxxxxxxxxxxxxxxxxxxxxxxxRMMAFWLLAGLAASAVHWSGILGxMGLWTLSEMMRSARRSDLAFSG
QGRGERGDRPFEVRDGxxxxxxPGLFWGQSQVGVGYGFRGVLHTMxxxTRGAALSIDDAVAGPYWAEV
KEDVVCxxxxxxxxxxxxxxxxxxxxxxxxxxxxxxxxxxxELLLDTGGRxGAILIDLSKGTSGSPIL
NAQGAVVGLxxxxxxxxxxxxxxxxxIAQGEAEKSRPSLPPAVxGMGWTAKGQxxxxxxxxxxxxxxxx
xxxxxxxxxxxxxxxxxxxxxxxxxxxKEMERALTGKRVRFHSPAVSDQQMGGAIVDLMCHATYVSRRLxxx
xxxxxxxxxxxxxxxxxxxxxxxxxxxxxxxxxxxxxxxxxxPESNGAITSEEKQIPN
GEWRDGFxxxxxxxxxxxxxxPSIAKGGVIARTLRQxxxxxxxxxxxxxxxxxxxxxxxxxxxxxxxx
xxxxxxxxxxxxxxxxxxxxxxxxxVDGRVELIGTRxxxxxxxxxxRGRVGRHEGRIDEYIxxGQCDDD
DSGLVQWKEAQILLDDIITLRGPVAxxxxxxxxxxxxxxxxxxxxxxxxxxxxxxxxxxxxxxxxxx
xxANVSGVTSRSWTWEGPEANAVDEANGGLVTFRSPxxxxxRTLKPVWRDARxxxxGRDIREFIAYASx
xRSIGDVLTGMxxxxxxxxxxxxxxxxxFYTLMHEKPGSSAMRMAERxAPEAFLTLVEMMVLGLGTLG
VVWCFVARTSISRMxxxxLVLLASLVLLWAGGVxxxxxxxxxxxxxxxxxxxxxxxxxxxxxxxxxxx
xxxxxxxxxxxxxxxxxxxNEMGLLEKTKADLSTVLWAxxxEPRSWGEWTNIDIxxxxxxxxxxxxxxx
xxxxxxxxxxxLVNSAVVTGAQAMRxLGGGAPFIGVAGHVVSLGVVSLVxxxxxxxxxxxxxxxxxxx
xxxxxxxxxxxxxxxxxxxxxxxxxxxxxxxxxYPFGEGETxxxxxxxKMSLVLAVVLCLISVVMNR
TVLSITEASAVGLAAAGQLLSPEEDTLWTMPVACGLSGVVTGSLWxxxxxxxxxxxxxxSGSRRGGSDG
DTLGDLWKQRLNSCTKEEFFVYRRTGILETERDKARELLKRGETNVGLAVSRGxxxxxxxxxxxxxxx
xxxxxxxxxxxxxxxxxxxxxxxASRPSVMNRAYTIGGKGHETPRMVTSLxxxLIKFRAGVDVFSMxxxxxx
xxxxxxGESNPDAVVEGEKTRKVILLxxQWKNRNPAAACVFKVxxxYRPKVIEALHRFQLKWGGGLVR

FIG. 60-4

```
xxxxxxxxxKVYYSTAVTxxxxxxxxxxxxxxxxxxAGQRGPTRVxxxxxGVGTRCVVLAEDRVREQD
VQERIKALKEQYGETWxxDGEHPYRTWxxxxxxxxxxxxxxxxxxxxxxxxxxxxxxxxxxxxxxxx
xxxxxWQQRVFKKNADTKAQxxxxxxxxxxxxxxxWILDRLAQRSRSRIHSKEEFIAKVRSNAALGAW
SNEQNRWSNAKEAVEDPVFWRLVDEERERDLTGRCAHCAFNIMGKRExxxxxxxxxxxxxxxxxxxx
xxxxxxxxxxxxxDHWASRGFSGSGVEGxxxxYLGWHLKGLSIPEGGLFYAxxxxxxxxxxxxxxxx
xxxxxxxxxxGEHRQLAATVMQKAYxxxxxxxxxPSREGGCVMDVxxxxxxxxxxxxxxxxxxxxxx
xxxxxxxxxGEGVIEATDAHNPRLFRVERWLREHGGERLGRxxxxxDDCVVRPIDDRFSGALYFLNDx
xxxxxxIGEWEHSAGLSSWEAVPFCSxxxxxLVMKDGRSLIVPCRDxxELVGRAPVSPGCGWxxxxxx
xxxxxxxxxxxxxxxxxDLRTLGLAISSAVPIDWVPTGRxxxxIHASGSWMTTENMLDxxxxxxxLD
NPFMQNKERxxEWRDIPYLPKAHDMLCSSLVGRKERAEWARxxxxAVEKVRKMMGxxRCKDYPSCMDR
HYLHWNLKLEGSII >TBEV|peptide_length:8|string4 xxxxxxxxxxxxxxxxxRVSKEAAKKTRQSRVQMPSGxxxxxxMGFLWHAVAGTVRSPVLKSFWKPVPL
KQATTALRKIKKAVSALMVGLQRREKKRSTxDWMGWLLVxxxxxxxTIAATVRRERDDTTVIRxxxxxx
xxxxxxxxxxxxILATDMGAWxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxIVWLTLESVVARVxxVVVL
FCLAPxxxxxxxxxxxxxxxxxxxxxxxxxxxxxxxxxxxxxxxxxxxxxLDAIYQENPAQTREYx
xxxxxxxxxxxxxxxxxxxxxxxxxTLAEQHQSGTxxxxxxxxxxxxxxxxxxxIVTCVKVSCEAKKKxx
xxxxxPNRIVYTVKVxxxxxxxxxxxxxxxxxxxxxxxxxxxxxxxxxxxxxxxxxxxxxxxxxx
xxxxxxxxxxxxxxxxxxxxxxxxxxxxxxxPWRHEGVRNWNNAERxxxxxxxxxxxxxxxxxxxx
xxxxxxxxxxxxxxxxxxxxxxxxxxxxxxxxxxxxxxxxxxTKFTWRRTPTDSGxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxGSTGGLLSSIGKALHxxxxxxxxxxxxxxxxGFLPKILIGMALAWLG
Lxxxxxxxxxxxxxxxxxxxxxxxxxxxxxxxxxxxxxxxxxxxxxxxxxxxxxxxxxxxxxxxx
xxxxxxKEAFEEGTCGILPQNxxxMAMWRSAATELNLAxxxxxxxxxxxxxxxxxxxxxxGGVSGLLRK
GxxxxxSWKSWGHSVIWSIPEAxxxFMVGIEGSxxxxxxxxxxxxxxxxxxxxxxxxxFVDFRQEST
xxxxxxxxxxxxxxxxxxxxxxxxxxSLWMKSVRNETGTYxxxxxxxxxxxxxxxxxxxxxPEVVDSELxx
xxxxxxxxxxxxxxxxxxxxxxxxxVKGPWKYLPIRVxRGECPGTTVVITADCDKRGxxxxxxxxxxxxxx
xxxxxxxxxxxxxxxxxxxxxxxxxxxxxxxxxxxxxxxxxxxxxxxxxxxxxxxxxxxxxxxxRR
PSTGSTVVWGGIVVFALLVTGMVRMESLVRYxxxxxxxxxxxxxxxxxxxxxxxxxxxxxxxxSAFA
LRRNLTVREMxxxxxxxxxxxxxxxxxxxxxxxxxxxxxxxxxxxxxxxxxxTAEGKAGVGLLLMPLLTKR
GxxxVHYGLIFFLSxxxxxxxxWRLLEGHREQKGLSWTVPMAGLVGGEGSGIxxxxxxxxxxxSGRRRSF
Sxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxAGLSASAIHWSGIIGxxxLWTLSEMLKTARRSDLVFSG
QGNRERGDKPFEVRDGxxxxxxPGLFWGQSQVGxxxxxxxxxxxxxxxxRGAALYVDDAVAGPYWSDV
REDVVxxxxxxxxxxxxxxxxxxxxxxxxxxxxxxxxxxxxxxxxxxxxxxGAVLIDLSKGTSRSPTI
NSQGVVVxxxxxxxxxxxxxxxxxxxxxEAERSRPNLPQxxxGIGWTAKGQxxxxxxxxxxxxxxxx
xxxxxxxxxxxxxxxxxxxxxxxxxxxxxxxxxxxxxxxxxxRFLSPVVGDQQVGGSIVDxxxxxxxxxxxxxxx
xxxxxxxxxxxxxxxxxxxxxxxxxxxxxxxxxxxxxxxxxxxxxxxxxxxxxRGITSEERQIPN
GEWxxxxxxxxxxxxxxxxxxxxxPSIVKGGIIARALRQxxxxxxxxxxxxxxxxxxxxxxxxxxx
xxxxxxxxxxxxxxxxxxxxxxxxxxxxxxxxxxxxVGRQEGRIDEYxxxxQCDED
DGGLVQWxxxxxxxxxxxxxxxxxxxxxxxxxxxxxxxxxxxxxxxxxxxxxxxxxxxxxxxxxx
xxxxVSSVTSRSWTxxxxxxxxAVDEASGGLVTFRxxxxxxxxxxxxxxxxxxxxxxxxxxxxxxx
xxxxxxxxxxxxxxxxxxxxxxxxxxxxxxxMHDEPDSRAMRMAxxxxPEAFLTVAEMMVLGLGTxx
xVWCFVARTxxxxxxxxxxxxxxxxxxxxxxxxxxxxxxxxxxxxxxxxxxxxxxxxxxxxxxxxx
xxxxxxxxxxxxxxxxxxxxxxxxxxxxxDLSAVLWSxxxEMRSWEEWTxxxxxxxxxxxxxxxxx
xxxxxxxxxxxxxxxxxxxxxxxxxxxxxxLGGGAPFLGVAGHVMSLGVVSLxxxxxxxxxxxxxxxxx
xxxxxxxxxxxxxxxxxxxxxxxxxxxxxxxxxxxxxxxxxxxxRMSLVLATVLCLISVVMNR
```

FIG. 60-5
TMPSITEAAAVGLAALGQLLKPEADTLWxxxxxCGLSGVVTGSxxxxxxxxxxxxxxxxxGSRRGGSDG
xxxxxxxxxxLNSCTREEFFIYRRTGILxxxxxKARELLKKGETNMGLxxxxxxxxxxxxxxxxxxxx
xxxxxxxxxxxxxxxxxxxxRPAVMNVKAYTIGGKGHETPRMxxxxxxxxxxxxxxxxxxxxxxxxxx
xxxxxxxxxxxxxxxxxxxxxxxxxKIRNPTATCxxxxxxxxxxxxxxxTLHRFQLQxxxxxxx
xxxxxxxxxxxxxxxxxxxxxxxxxxxxxxxxxxxxxxxxxxxxxxxxxxxxxxCVVLAEDKVKEQD
VRERIRALKEQYxxxxxxDAEHPYRTWxxxxxxxxxxxxxxxxxxxxxxxxxxxxxxxxxxxxxxxx
xxxxxxxxxxxxxxxxxxxxxxxxxxxxxxxxMLERLAQKSNSRIHSKExxxxxxxxxxxxxxx
SEEQNRWAGAREAVEDPAFWKLVDEERERHLAGRSAHGVFNIMGKRxxxxxxxxxxxxxxxxxxxxx
xxxxxxxxxxxxxxxxxASRGFSGSGVExxxxxxYLGWYLKELSTPEGGLFYxxxxxxxxxxxxxxxx
xxxxxxxxxxxxHKQLAATVMxxxxxxxxxxxxxxxxxxxxxxxxxxxxxxxxxxxxxxxxxxxxxx
xxxxxxxxxGEGVVEASDAHNxxxxRVERWLRNHGEERLGxxxxxxDDCVVRPVDDRFGRALYFLNxx
xxxxxxxxxxWEHSAGFAGWEEVPFCxxxxxxxxMKDGRALVVPCRDxxxxxxxxxxxxxxxxxxxx
xxxxxxxxxxxxxxxxxxxxxxRTLGLTICSAVPTDWVPTGRxxxxxxxxGAWMTTENMxxxxxxxxxxx
NPFMHGKEKxxxxxNVPYLPKAHxxxxxxxxxxTERAEWAKxxxxxVEKVRKIVGxxKCKDYPSCxxx
xxxHWELKLESSIF >TBEV|peptide_length:8|string5 xxxxxxxxxxxxxxxxRASKETAKKxxxxxxxxxxxxxxxxxxxxxxxxxxxxxxxxxxxxxxxxx
xxxxxxxxKIKRAVSTLMIGxxKRGKRRSVxDWTSWLLVxxxxxxxxxxxxVRKERDDTTVxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxVVWMTVESVVTRTxxVVVL
FCLAxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxIVTCVKVSCExxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxHEGARNWNNAExxxxxxxxxxxxxxxxxxxxx
xxxxxxxxxxxxxxxxxxxxxxxxxxxxxxxxxxxxxxTKFTWRRTPTDxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxGFIPKLLLGxxxxxxx
xxxxxxxxxxxxxxxxxxxxxxxxxxxxxxxxxxxxxxxxxxxxxxxxxxxxxxxxxxxxxxxxxx
xxxxxxRETFEEGTxxxxxxxxxxxMAMWRSSSTELNLAxxxxxxxxxxxxxxxxxxxxxxxxxxx
xxxxxxxxxSWGQAMIWSIPExxxxxxxxxxxxxxxxxxxxxxxxxxxxxxxxxxxxxxxxxxxxxx
xxxxxxxxxxxxxxxxxxxxxWMKSVRNETGxxxxxxxxxxxxxxxxxxxxxxxxxxxxxxxxxx
xxxxxxxxxxxxxxxxxxxxxxxxxxxxxECPGTRVIISADCDRRGxxxxxxxxxxxxxxxxxx
xxxxxxxxxxxxxxxxxxxxxxxxxxxxxxxxxxxxxxxxxxxxxxxxxxxxxxxxxxxxxxxxxx
PATGTTAVWGGLIVLALLVxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxMALITQQ
DxxxVHYGLIFFLGxxxxxxxWRLLEGHRExxGLSWIVPLAGLVGGExxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxAGLAASALHWSGILGxxxxWTLTKMLRPSRRSxxxxxx
xxxxxxxxxxxxxxxxxxxxxxxxxxxxxxxxxxxxxxxxxxxxxxxxxxxxLSVDDAVVGxxxxxx
xxxxxxxxxxxxxxxxxxxxxxxxxxxxxxxxxxxxxxxxxxxxxxxxxxxxxxxxxxxSGSPII
NSQGVVxxxxxxxxxxxxxxxxxxxxxxxxxxxxxxxxxxxGSGWTAKGQxxxxxxxxxxxxxxxxx
xxxxxxxxxxxxxxxxxxxxxxxxxxxxxxxxxxxxHSPVVSDHQGGGAIVDxxxxxxxxxxxxxxx
xxxxxxxxxxxxxxxxxxxxxxxxxxxxxxxxxxxxxxxxxxxxxxxxxxxxxxxxxSEVKQIPE
GExxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxPEAFLTMAExxxxxxxxxx

FIG. 60-6

```
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxEVRSWEEWTxxxxxxxxxxxxx
xxxxxxxxxxxxxxxxxxxxxxxxxxxxxxxxxxGGAPFFGIAGHVMALxxxxxxxxxxxx
xxxxxxxxxxxxxxxxxxxxxxxxxxxxxxxxxxxxxxxxxxxxMSLVLAVALCLxxxxxx
xVPSITEAAxxxxAAAGQLLRPEEDTLWxxxxxxxxxxxxxxxxxxxxxxxxxxxxxxxxx
xxxxxxxxxxxxxCTREEFFVYRRTGIMxxxxxRARELLRRxxxxxxxxxxxxxxxxxxxx
xxxxxxxxxxxxxxxxxxxxxxxxxxxxxxxxxGRGHETPKMxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxFLADDKVKEQD
VQERINALREQYxxxxxxNGEHPYRTxxxxxxxxxxxxxxxxxxxxxxxxxxxxxxxxxxx
xxxxxxxxxxxxxxxxxxxxxxxxxxxxxxxxxLERLARKNRPRMCSRExxxxxxxxxxxx
xxxxxxxxxxxxxVEDPAFWKLVDExxxxxxAGRCAHCAxxxxxxxxxxxxxxxxxxxxxx
xxxxxxxxxxxxxxxxxxxxASRESSGSGVExxxxxYLGWHLKRLSxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxVERWLRDYGEERLGxxxxxxxxxxxRGIDDRFSGALYFLNxx
xxxxxxxxxxxxxxxxxxxSVEEVPFCxxxxxxxxxxxxxxxxxxxxxxxxxxxxxxxxxx
xxxxxxxxxxxxxxxxxxxxxxxRTLGFAICSAVPxxxxxxxxxxxxxxxxxxxxxxxxxx
xPFMQNKGKxxxxxxxIPYLPKAQxxxxxxxxxxxxxxxxxxxxxxVEKVRKMVGxxxxxxxxxxxxx
xxxxxxxxxxxxxx
```

FIG. 60-7

>TBEV|peptide_length:9|string1

MAGKAILKGKGGGPPRRVSKETAKKTRQSRVQMPNGLVLMRMMGILWHAVAGTARSPVLKSFWNSVPL
KQATAALRKIKKAVSTLMVGLQRRGKRRSAxxxxxxxxxxxxxxxTLAATVRKERDGTTVIRAEGKDA
ATQVRVENGTCVILATDMGSWCDDSLTYECVTIDQGEEPVDVDCFCRNVDGVYLEYGRCGKQEGSRTR
RSVLIPSHAQGDLTGRGHKWLEGDSLRTHLTRVEGWVWKNKxxxxxxxxVVWLTVESVVTRVxxVVVL
LCLAPVYASRCTHLENRDFVTGTQGTTRVTLVLELGGCVTITAEGKPSMDVWLDSIYQENPAKTREYC
LHAKLSDTKVAARCPTMGPATLAEEHQSGTVCKRDQSDRGWGNHCGLFGKGSIVTCVKASCEAKKKAT
GHVYDANKIVYTVKVEPHTGDYVAANETHSGRKTASFTVSSEKTILTMGDYGDVSLLCRVASGVDLAQ
TVILELDKTSEHLPTAWQVHRDWFNDLALPWKHEGAQNWNNAERLVEFGAPHAVKMDVYNLGDQTGVL
LKSLAGVPVAHIDGTKYHLKSGHVTCEVGLEKLKMKGLTYTMCDKTKFTWKRIPTDSGHDTVVMEVAF
SGTKPCRIPVRAVAHGSPDVNVAMLITPNPTIENNGGGFIEMQLPPGDNIIYVGELSHQWFQKGSSIG
RVFQKTRKGIERLTVIGEHAWDFGSTGGFLTSVGKALHTVLGGAFNSLFGGVGFLPKILVGVALAWLG
LNMRNPTMSMSFLLAGGLVLAMTLGVGADVGCAVDTERMELRCGEGLVVWREVSEWYDNYAYYPETPG
ALASAIKETFEEGTCGIVPQNRLEMAMWRSSATELNLALAEGDANLTVVVDKLDPTDYRGGIPGLLKK
GKDIKVSWKSWGHSMIWSVPEAPRRFMVGTEGGSECPLERRKTGVFTVAEFGVGLRTKVFLDFRQEST
HECDTGVMGAAVKNGMAVHTDQSLWMKSVRNDTGTYIVELLVTDLRNCSWPASHTIDNAEVVDSELFL
PASLAGPRSWYNRIPGYSEQVKGPWKYSPIRVTREECPGTRVTINADCDKRGASVRSTTESGKVIPEW
CCRTCTLPPVTFRTGTDCWYAMEIRPVHDQGGLVRSMVVADNGELLSEGGIPGIVALFVVLEYVIRRR
PATGTTAMWGGIVVLALLVTGLVRIESLVRYVVAVGITFHLELGPEIVALTLLQAVFELRVGLLSAFA
LRSNLTVREMVTIYFLLLVLELGLPSxxxxxLWKWGDALAMGALIFRACTAEEKTGVGLLLMALMTQQ
DxxxAHYGLMLFLGxxxxxxxWKLIRGHREQKGLTWIVPLAGLLGGEGSGVRLLAFWELAxHRGRRSF
SEPLTVVGVMLTLASGMMRHTSQEALCALAVASFLLLMLVLGTRKMQLVAEWSGCVEWHPELMNEGGE
VSLRVRQDSMGNFHLTELEKEERVMAFWLLAGLAASAFHWSGILGVMGLWTLSEMLRxARRSDLVFSG
QGGRERGDRPFEVKDGVYRIFSPGLLWGQRQVGVGYGSKGVLHTMWHVTRGAALSIDDAVAGPYWADV
KEDVVCYGGAWSLEEKWKGETVQVHAFPPGRAHEVHQCQPGELLLDTGRRxGAVPIDLAKGTSGSPIL
NSQGVVVGLYGNGLKTNETYVSSIAQGEAEKSRPNLPPAVxGTGWTAKGQITVLDMHPGSGKTHRVLP
ELIRQCIDRRLRTLVLAPTRVVLKEMERALNGKRVRFHSPAVGDQQVGGAIVDVMCHATYVNRRLLPQ
GRQNWEVAIMDEAHWTDPHSIAARGHLYTLAKENKCALVLMTATPPGKSEPFPESNGAISSEEKQIPD
GEWRDGFDWITEYEGRTAWFVPSIAKGGIIARTLRQKGKSVICLNSKTFEKDYSRVRDEKPDFVVTTD
ISEMGANLDVSRVIDGRTNIKPEEVDGRVELTGTRRVTTASAAQRRGRVGRQEGRTDEYIYSGQCDDD
DSGLVQWKEAQILLDNITTLRGPVATFYGPEQDKMPEVAGHFRLTEEKRKHFRHLLTHCDFTPWLAWH
VAANVSSVTSRNWTWEGPEENTVDEANGDLVTFRSPNGAERTLRPVWRDARMFREGRDIREFVAYASG
RRSFGDVLSGMSGVPELLRHRCVSAMDVFYTLMHEEPGSRAMRMAERDAPEAFLTVVEMMVLGLATLG
VVWCFVVRTSISRMMLGTLVLLASLALLWAGGVSYGNMAGVALIFYTLLTVLQPEAGKQRSSDDNKLA
YFLLTLCSLAGLVAANEMGFLEKTKADLSTVLWSxxxELRSWEEWTNIDIQPARSWGTYVLVVSLFTP
YIIHQLQTKIQQLVNSAVATGAQAMRDLGGGAPFFGVAGHVMALGVVSLVGATPTSLVVGVGLAAFHL
AIVVSGLEAELTQRAHKVFFSAMVRNPMVDGDVINPFGEGEAKPALYERKMSLVLAIVLCLMSVVMNR
TVPSITEASAVGLAAAGQLLRPEADTLWTMPVACGLSGVVRGSLWGFLPLGHRLWLRASGSRRGGSEG
DTLGDLWKRKLNGCTKEEFFAYRRTGILETERDKARELLRRGETNMGLAVSRGTAKLAWLEERGYATL
KGEVVDLGCGRGGWSYYAASRPAVMSVKAYTIGGKGHETPKMVTSLGWNLIKFRAGMDVFSMQPHRAD
TIMCDIGESNPDAVVEGERTRKVILLMEQWKNRNPTATCVFKVLAPYRPEVIEALHRFQLQWGGGLVR
TPFSRNSTHEMYYSTAVTGNIVNSVNIQSRKLLARFGDQRGPTRVPELDLGVGTRCVVLAEDKVKEKD
VQERISALREQYGETWHxDREHPYRTWQYWGSYRTAPTGSAASLINGVVKLLSWPWNAREDVVRMAMT
DTTAFGQQRVFKEKVDTKAQEPQPGTKVIMRAVNDWILERLARKSKPRMCSREEFIAKVKSNAALGAW
SDEQNRWSSAKEAVEDPAFWQLVDEERERHLAGRCAHCVYNMMGKREKKLGEFGVAKGSRAIWYMWLG
SRFLEFEALGFLNEDHWASRGSSGSGVEGISLNYLGWHLKKLSTLEGGLFYADDTAGWDTKVTNADLE
DEEQLLRYMEGEHKQLAATIMQKAYHAKVVKVARPSRDGGCIMDVITRRDQRGSGQVVTYALNTLTNI
KVQLIRMMEGEGVIEASDAHNPRLLRVERWLRDHGEERLGRMLVSGDDCVVRPVDDRFGKALYFLNDM
AKTRKDIGEWEHSVGFSNWEEVPFCSHHFHELVMKDGRALIVPCRDQDELVGRARVSPGCGWSVRETA

FIG. 60-8

CLSKAYGQMWLLSYFHRRDLRTLGLAICSAVPVDWVPTGRTTWSIHASGAWMTTEDMLDVWNRVWILD
NPFMHSKEKxxEWRDVPYLPKSHDMLCSSLVGRKERAEWAKNIWGAVEKVRKMIGxxKFKDYLSCMDR
HDLHWELKLESSII

>TBEV|peptide_length:9|string2

MVKKAILKGKGGGPPRRVSKETAKKTRQSRVRMPNGLVLMRMMGILWHAVAGTARNPVLKSFWNSVPL
RQATAALRKIKRTVSALMVGLQKRGKRRSAxxxxxxxxxxxxxxALAATVRKERDGSTVIRAEGRDA
ATQVRVENGTCVILVTDMGSWCDDSLSYECVTIDQxxxxxxxDCFCRNVDGVHLEYGRCGKxxxxRTR
RSVLIPSHAQGELTGRGRKWLEGDSLxxxxxxVEGWVVWKNRxxxxxxxxVVWLTLESVVTRVxxLVAL
FCLAPVYASxxxxxxxxxxxxxxxxxxxxxxxxxxxxxxxxxxxPSMDVWLDAIYQESPAKTREYC
LHVKLSDTKVAARCPTTGPATLAEEHQGGTVCKRDQxxxxxxxxxxLFGKGSIVACVKAACEAKKKAT
GHVYDANKIVYPIKVEPHTGDYVAPHETHSGRKTASFTISSEKTILTMGEYGDVSLLCKVPSGVDLAQ
TVILELDKTVEHLPTAWQVRRDWFNDLALPWRHEGAQQWNNAERLVEFGVPHAVKMDVxxxxDQTGVL
LKALAGVPVAHIEGAKYHLKSGHxxxxVGLEKLKMKGLTYTMCDKTKFTWKRTPTDSGHDTVVMEVTF
SGTKPCRxPVRAVAHGFPDVNVAMLITPNPTIETNGGGFIEMxxxxxxxxIIYVGELSYQWFQKGSSIG
RVFQKTKRGIERLTVIxEHAWDFGSAGGFLSSIGKAVHTVLGGAFNSIFGGVGFLPKLLLGVVLAWLG
LNMRNPTMSMGFLLAGVLVLAMTLGVGADVGGAVDTERMExxxxxxxxxxxxSEWYDNYAFYPETPG
ALASAIKETFEEGSCGVLPQNRLEMAMWRSSVTELNLALAEGEANLTVVVDKFDPTDYRGGVSGLLRK
GKDIKVSWKSWGQSMIWSIPEAPRRFMVGTEGSNECPLERRKTGIFTVAEFGVGLRTKVFLDFRQEPT
HECDTGVxxAAVKNGMAIHTDQSLWMRSMKNETGTYIVELxxxxxxxxxxPASHTIDNADVVDSESFL
PASLAGxxxWYNRIPGYAEQVKGPWKHTPIRVIREECPGTKVTINAKCDRRGASVRSTxxxxxVIPEW
CCRACTMPPVTIRTGTDCWYxxxxxPVHDQGGLIRSTVVADNGELLSEGGVPGIVALFVVLEYIIRRR
PSTGTTVVWGGVVVLALLVTGMVKVESLVRYVVAVGIAFHFELGPEIVALMLLQAVFELxxxLLSAFA
LRRSLTVREMVTTYFLLLVLELGLPGxxxxxFWRWGDALAMGALIFRACTAEGKTGAGLLLMALMTQR
DxxxVHHGLVCFLSxxxxxxxWRLLKGHREQKGLTWVVPLARLLGGEGSGIRLLAFWELSxHGRRRSF
SEPLxxVGVMLTLAGGMMRHTPQEALCALAxxxxxxxxxxxxxxxxxxxxEWSGCVEWHPELVNEGGE
VSLRVRQDAMGNFHLTELEKEERMMAFWLIAGLAASAVHWSGIIGVMGLWTLTEMLRxSRRSDLVFSG
QGGRERGDKPFEVRDGVYRIFSPGLFWGQRQVGVGYFRGVLHTMWHVTRGAALSINDAVAGPYWADV
REDVVCYGGAWSLEEKWRGETVQVHAFPPGKAHEVHQCQPGELILDTGRKxGAIPIDLVKGTSGSPIL
NAQGAVVGLYGNGLKTNGTYVSSIAQGEVEKSRPNLPQAVxGTGWTSKGQITVLDxxxxxxxxxxxLP
ELIRQCTDRRLRTLVxxxxxxxLKEMERALSGKRVRFHSPAVSDQQAGGSIVDLMCHTTYVSRRLLPQ
GRQNWEVATIDEAHWTDPxxxxxRGHLYTLAQENKCALVLMTATRPGKSEPFPESNGAITSEERQIPE
GEWRDGFDWITEYEGRTAWFVPSIAKGGAIARALRQKGKSVxxxxSKTFEKDYTRVRDEKPDxxxxxx
xxxxxxxxxxxxxxxxxxxxxIKPEEVDGKVELIGTRRVTTASAAQRRGRVGRQDGRIDEYIYSGQCDDD
DGGLVQWKEAQILLDDIITLRGPVVTFYGPEQDRMPEVAGHYRLTEEKRKxxxxxxxxxxxxxxxxWH
VAANVSSVTDRSWTWEGPEANAVDEASGDLVTFKSPNGAERTLRPVWKDARMFKEGRDIKEFIAYASG
RRSFGDVLTGMSGVPELLRHRCVSALDVFYTLMHEEPGSRAMKMAERDAPEAFLTMAEVMVLGLATLG
VIWCFVARASISRMMLGTLVLLASLLLLWAGGVGYGNMAGVAxxxxxLLTVLQPEVGKQRSSDDxxxx
YFLLTLCSVAGLVAANEMGFLERTKADLSTALWSxxxEPRPWSEWTNVDIQPARSWxxxxxVVSLFTP
YMIHQLQTKIQQLVNSAVASGAQAMRDLGGGTPFFGVAGHVMTLGVVSLIGATPTSLMVGVGLAALHL
AIVVSGxxxxxxxxxxxxxxxSAMVRNPMLDGDVINPFGEGETKPALYERKMSLVLAIALCLMSVVMNR
TVASITEASAVGLAAVGQLLRPEVDTLWTMPVACGMSSVVTGSLWGFLPxxxRLWLRASGGRRGGADG
DTLGDLWKRRLNNCTREEFFVYRRTGILETERDKARELLRKGETNTGLAVSRGTxxxxxxxxxxxxxx
xxxxxxxxxxxxxSYYAASRPAVMSVRAYTIGGRGHEAPRMVTSLGWNLIKFRSGVDVFSMQPHRAD
TVMCDIGESSPDAAVEGERTRRVILLMEQWKNRNPTAACVFKVLAPYRPEVIEALHRFQLRWGGGLVR
TPFSRNSTHEMYYSTAITGNIVNSVNVQSRKLLARFGDQRGPTRVPELDLGIGTRCVVLAEDKVKEQD
VQERIRALREQYSETWHxDEEHPYRTWQxxxxxxxxPTGSAASLTNGVVKLLSxxxxxxxxxVVRMAMT
DPTPFGQQRVFKDNADTKAQEPQPGTRVIMRAVNDWILERLAQKSKPRMCSKEEFIAKVRSSAALGAW
SDEQNRWASAREAVEDPAFWHLVDEERERHLMGRCAHCVHNIMGKREKKLGEFGVSKGSRAMWYMWLG

FIG. 60-9

SRFQEFEALGFLNEDHWASRESSGAGVEGISLNYLGWYLKGLSTLNGGLFYADDxxxxxxxxxxADLE
DEEQILRYMEGEHKQLATTVMQKAYHAKxVKVARPSRDGGCVMDVITRRDQRGSVQVVTYALNTHTNI
KVQLIRMMEGEGVIEAADAHNPRLLRVERWLKEYGGERLGRMLVSGDDCVVRPLDDRFSRALYFLNDM
AKTRKDVGEWEHSAGFSSVEAVPFCSHHFxELVMKDGRSLVVPCRDQDELVGRARISPGCGWSIRETA
CLSKxxxxxxxxxxxxRRDLRTLGLAINSAVPADWVPTGRTTWSIHASGAWMTTENMLDVWNRVWILD
NPFMQNKEKxxEWRDVPYLPKAQDMLCSSLVGRRERAEWARNIWGAVEKVRRMIGxxKFRDYPSCMDR
HDLHWELRLESSII >TBEV|peptide_length:9|string3

MARKAILKGKGxxPPRRVSKETATKTRQPRVQMPSGLVLMRMLGFLWHAIAGTVRSPVLKAFWKSVPL
KQAMTALRKIKMAVSALMVGLQRRGKKRSTxxxxxxxxxxxxxxxTFAATVRKEGDDTTVIRAEGRxx
xxxxxxENGTCVILATDMGAWCDDSLSYxxxxxxxxxxxxxxxxxFCRNVDRVYLEYGRCxxxxxxxxx
xxxLIRSHAQGELTGRGRKWxxxxxxxxxxxxxxxxxxxxxxxxxxIVWLTVESVVTRIxxVAVL
FCLAPVYxxxxxxxxxxxxxxxxxxxxxxxxxxxxxxxxxxxxxxxxxxxxWLDAIYQENPAQTREYC
LHAxxxxxxxxxxxxPTMGPATLAEQHQSGTVCKxxxxxxxxxxxxxxxxxxGSIVTCVKVACEAKKKAT
GHVYDANRIVYTIKVEPHTGDYVAVNETHSGRKTPSFTVSSEKTILNMGDYGDVSxxxxxxxxxxxx
xVILELDKTLEHLPTAWQxxxxxxxxxALPWKHEGAQHWNNAERLVxxxxxxxxxxxxxxxxxxxx
xxxxxxVPVAHIDGAKYHLKSxxxxxxxxxxxKMNGLTYTVCDKTKFAWKRAPTDSGHDTVVMEVSF
SGTKPCRxxxxxxxxxxxxxxxxxxxxxxxxxxxxxxxxxxxxxxxxxxxxxxxxxxxxxxxxxG
RVFQKTRRGIERLTVxxxxxWDFGSTGGFLASIGKALHTVLxxxxxSLFGGVGFLPKILMGAALAWLG
LNxxxxxxSMSFLLAGVLVxxxxxxxxxxxxxxxxxxxxxxxxxxxxxxxxxxxxxxxxxxxxxxxx
ALASAIKETFEEGNCGILPQNRLEMAMWRSASTELNLALAEGEANLTVMVDKFDPTDYRGGVPGLLKK
GKDIKVSWKSWGQAMIWSIPEASRRFMVGTEGQSECPPERRKTGVFxxxxxxxxxxxxxVFVDFRQEAT
HECDTGVxxxxxxxxxxxxxxDQSLWMKSVRNETGTYIVxxxxxxxxxxxxxxxASHTIDNADVVDSESFL
xxxxxxxxxxxxxxxxxxxxxxxQVKGPWKYTPIRVTREECPGTTVTISADCDRRGASVxxxxxxxxxxxx
xxxTCTLPPVTIRTGxxxxxxxxxxxxxxDQGGLVRSTVVADNxxxxxxxxxxxxxxxxxxxxxxIRRR
PATGTAVVWGGFIVFALLVTGLVRMESLVRYVVAVGITFHFELGPExxxxxxxxxxxxxxxxxxxxLSAFA
LRRGLTVREMVITYFLLLVLELGLPYxxxxxLWRWGDALAxxxxILRACTAEGKAGVGLLLMALITQQ
DxxxVHYGLIIFLGxxxxxxxxWRLLEGHREQKGLSWIVPLAGLMGGEGSGIRLLSFWELSxHGKRRSF
SEPLxxxxxxxxxxASGMMRHTPQxxxxxxxxxxxxxxxxxxxxxxxxxxxxxxxCVEWYPELVNEGGx
xxxxxxxxxxxxxxxxxxxxxxxERMMAFWLLAGLAASAIHWSGILGVMGLWTLSEMMRxARRSGLVFSG
QGRGERGDRPFEVRDGVxxxxSPGLFWGQNQVGVGYGFRGVLHTMWxVTRGAALYVDDAVVGPYWSEV
KEDVVCYxxTWSLEEKWKxxxxxxxxxxxxxxxxxxxxxxGELLLDTGGRxGAILIDLSKGTSGSPIL
NAQGAVVGLYxxxxxxxxxxxxxxSIAQGEAERSRPSLPPAVxGMGWTAKGQIxxxxxxxxxxxxxxx
xxxxxxxxxxxxxxxxxxxxxxxxxLKEMERALTGKRVRFHSPAVGDQQVGGAIVDVMCHATYVSRRLLxx
xxxxxxxxxxxxxxxxxxxxxxxxxxxxxxxxxxxxxxxxxxxxxxxxxxxxxxxxFPESNGAITSEEKQIPN
GEWRDGFDxxxxxxxxxxxSAWFVPSIAKGGVIARTLRQKxxxxxxxxxxxxxxxxxxxxxxxxxx
xxxxxxxxxxxxxxxxxxxxxxxxEVDGRVELIGTRRxxxxxxxPRRGRVGRHEGRIDEYIYSGQCDED
DSVLVQWKEAQILLDNITTLRGPVVTxxxxxxxKMPEVAGHYxxxxxxxxxxxxxxxxxxxxxxxxx
xAANVSGVTSRSWTWEGPEENAVDEANGGLVTFRSPNxxERTLKPVWRDARMxxEGRDIREFIAYASG
RRSIGDVLTGMSxxxxxxxxxxxxxxxxVFYTLMHDKPDSSAMRMAERDAPEAFLTMVEMLVLGLGTLG
VVWCFVVRASISRMMxxTLVLLASLALLWAGGVGxxxxxxxxxxxxxxxxxxxxxxxxxxxxxxxxx
xxxxxxxxxxxxxxANEMGLLEKTKADLSTVLWAxxxEPRSWGEWTNIDIQxxxxxxxxxxxxxxxxx
xxxxxxxxxxxQLVNSAVVTGAQAMRDLGGGAPFFGVAGHVVSLGVVSLVGxxxxxxMVGVGLAAFxx
xxxxxxxxxxxxxxxxxxxxxxxxxxxxxxxxxxxIYPFGEGEAKPALYERKMSLVLAVVLCLIAVVMNR
TVPSITEAAAVGLAAAGQLLSPEEDTLWTMPVACGLSGVVTGSLWGxxxxxxxxxxxxASGSRRGGSDG
DTLGDLWKQRLNSCTKEEFFIYRRAGIMETERDKARELLKKGETNVGLAVSRGTxxxxxxxxxxxxxx
xxxxxxxxxxxxxxxxxxxxxxxxxAASRPSVMNVRAYTIGGKGHETPRMVTSLGxNLIKFRAGVDVFSMQxxxxx
xIMCDIGESNPDAAVEGEKTRKVILLMEQWKNRNPAAACVFKVLxPYRPKVIEALHRFQLKWGGGLVR

FIG. 60-10

```
TxxxxxxxHKVYYSTAVTGxxxxxxxxxxxxxxxxxFAGQRGPTKVPELDLGVGTRCVVLAEDRVREKD
VQERIKALKEQYGETWHxDGEHPYRTWQxxxxxxxxxxxxxxxxxxxxxxxxxxxxxxxxxxxxxxxx
xxxxAWQQRVFKKNADTKAQExxxxxxxxxxxxDWILERLAQRSNSRIHSKEEFIAKVKSNAALGAW
SNEQNRWSNAKEAVEDPVFWRLVDEERERDLAGRSAHGVFNIMGKREKxxxxxxxxxxxxxxxxxxx
xxxxxxxxxxxEDHWASREFSGSGVEGIxxNYLGWHLKGLSIPEGGLFYADxxxxxxxxxxxxxxxx
xxxxxxxxxEGEHRQLAATVMQKAYHxxxxxxxRPSREGGCVMDVIxxxxxxxxxxxxxxxxxxxxx
xxxxxxxxEGEGVIEATDAHNPRLLRVERWLREHGGERLGRMxxxGDDCVVRPIDDRFSGALYFLNDM
xxxxxDIGEWEHSAGLSGWEAVPFCSHxxxELVMKDGRTLVVPCRDQDELVGRAPVSPGCGWSIxxxx
xxxxxxxxxxxxxxxxxRDLRTLGFAICSAVPIDWVPTGRTxxSIHASGAWITTEDMLDVxxxxxILD
NPFMQNKERxxEWRDIPYLPKAHDMLCSSLVGRKERAEWARNxxGAVEKVRKIVGxxRCKDYLSCMDR
HYLHWELKLEGSII >TBEV|peptide_length:9|string4 xxxxxxxxxxxxxxxRRASKEAARKTRQSRVQMPSGLxxxxMMGFLWHAVAGTVRSPVLKSFWNSVPL
KQATAALRKIKRAVSTLMIGLQKRGKRRSVxxxxxxxxxxxxxxxTIAATVRRERDDTTVIRAxxxxx
xxxxxxxxxxxVIMATDMGSWCxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxIVWMTLESVVARVxxVVAL
LCLAPVxxxxxxxxxxxxxxxxxxxxxxxxxxxxxxxxxxxxxxxxxWLDAIYQEKPAKTREYC
xxxxxxxxxxxxxxxxxxxxxATLTEEHQGGTVxxxxxxxxxxxxxxxxxxxSIVTCVKVSCEAKKKAx
xxxxDPNKIVYPVKVExxxxxxxxxxxxxxxxxxxxxxxxxxxxxxxxxxxxxxxxxxxxxxxxxx
xxxxxxxxxxxxxxxxxxxxxxxxxxxxxxxxxLPWRHEGARNWNNAERLxxxxxxxxxxxxxxxxx
xxxxxxxxxxxxxxxxxxxxxxxxxxxxxxxxxxxxxxxxxxxKTKFTWRRTPTDSGHxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxFGSTGGLLSSIGKALHTxxxxxxxxxxxxxVGFIPKLLLGMALAWLG
LNxxxxxxxxxxxxxxxxxxxxxxxxxxxxxxxxxxxxxxxxxxxxxxxxxxxxxxxxxxxxxxxx
xxxxxIKEAFEEGTCGILPQNRxEMAMWRSSSTELNLALxxxxxxxxxxxxxxxxxxxxRGGIPGLLRK
GKxxRVSWRSWGQSIIWSIPEAPxRFMVGIEGSxxxxxxxxxxxxxxxxxxxxxxVFLDFRQEAT
HxxxxxxxxxxxxxxxxxxxxxxxxQSLWMKSVRNETGTYIxxxxxxxxxxxxxxxxxxxxxNPEVVDSELFx
xxxxxxxxxxxxxxxxxxxxxxxxQVKGPWKYLPIRVIRGECPGTRVIITADCDKRGAxxxxxxxxxxxxxxx
xxxxxxxxxxxxxxxxxxxxxxxxxxxxxxxxxxxxxxxxxxxxxxxxxxxxxxxxxxxxxxxxRRR
PSTGTTAVWGGLIVLALLVTGMVKVESLVRYVxxxxxxxxxxxxxxxxxxxxxxxxxxxxxxxLSAFA
LRRSLTVREMVIxxxxxxxxxxxxxxxxxxxxxxxxxxxxxxxxxxxxxxxCTAEGKAGVGLLLMPLLTKR
GxxxVHYGLIFFLSxxxxxxxxWRLLEGHREQKGLSWTVPMAGLVGGEGSGIRxxxxxxxxxxSGRRRSF
SExxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxAGLSASAIHWSGIIGVxGLWTLTKMLRxARRSDLAFSG
QGNRERGDKPFEVRDGVxxxxxSPGLFWGQSQVGVGYGSxxxxxxxxxxxTRGAALSIDDAVAGPYWAEV
KEDVVCxxxxxxxxxxxxxxxxxxxxxxxxxxxxxxxxxxxxxxxxxxxxxGAVLIDLAKGTSRSPII
NSQGVVVGxxxxxxxxxxxxxxxxxxxxxGEAEKSRPSLPPAxxGIGWTAKGQIxxxxxxxxxxxxxxxx
xxxxxxxxxxxxxxxxxxxxxxxxxxxxxxxxxxxxxxxxVRFHSPVVGDQQMGGAIVDxxxxxxxxxxxxx
xxxxxxxxxxxxxxxxxxxxxxxxxxxxxxxxxxxxxxxxxxxxxxxxNRGITSEVRQIPN
GEWRxxxxxxxxxxxxxxxxxxxxVPSIVKGGIIARALRQKxxxxxxxxxxxxxxxxxxxxxxxxxx
xxxxxxxxxxxxxxxxxxxxxxxxxxxxxxxxxxxxxxxxxxRVGRQEGRIDEYIxxGQCDDY
DSGLVQWKEGQILLDNITxxxxxxxxxxxxxxxxxxxxxxxxxxxxxxxxxxxxxxxxxxxxxxxx
xxxNVSSVTSRSWTWxxxxxNAVDEASGGLVTFRSxxxxxxxxxxxxxxxxxxxxxxxxxxxxxxxx
xxxxxxxxxxxxxxxxxxxxxxxxxxxxxxLMHEEPGSSAMRMAExxAPEAFLTLVEMMVLGLGTLx
VVWCFVARTSxxxxxxxxxxxxxxxxxVLLWAGGVSxxxxxxxxxxxxxxxxxxxxxxxxxxxxxxx
xxxxxxxxxxxxxxxxxxxxxxxxxxxxxxKTKADLSAVLWSxxxEMRSWEEWTNxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxDLGGGAPFLGVAGHVMSLGVVSLVxxxxxxxxxxxxxx
xxxxxxxxxxxxxxxxxxxxxxxxxxxxxxxxxxxxxxxxxxxxRRMSLVLATVLCLMSVVMNR
```

FIG. 60-11

```
TMLSITEASAVGLAAAGQLLRPEEDTLWTxxxACGLSGVVTGSLxxxxxxxxxxxxxxxSGSRRGGSDG
DxxxxxxxxxLNSCTREEFFVYRRTGIMExxxDKARELLKRGETNVGLAxxxxxxxxxxxxxxxxxxx
xxxxxxxxxxxxxxxxxxxxSRPAVMNVKAYTIGGRGHETPKMVxxxxxxxxxxxxxxxxxxxxxxxx
xVMCDIGESNxxxVVEGEKTRKxxxxxxxWKIRNPTATCVxxxxxxxxxxxxxETLHRFQLQWxxxxxx
xxxxxxxxxxxxxxxxxxxxxxxxxxxxxxxxxxxxxxxxxxxxxxxxxxxxxRCVFLAEDKVKEQD
VRERINALREQYxxxxxxNAEHPYRTWQxxxxxxxxxxxxxxxxxxxxxxxxxxxxxxxxxxxxxxxx
xxxxxxxxxxxxxxxxxxxxxxxxxxxxxxxxxxxxxWILERLARKNRPRMCSREExxxxxxxNAALGAW
SEEQNRWSGAREAVEDPAFWKLVDEERERHLAGRCAHCAYNMMGKRExxxxxxxxxxxxxxxxxxxxx
xxxxxxxxxxxxxxxxxWASRGFSGSGVEGxxxNYLGWYLKELSTPEGGLFYAxxxxxxxxxxxxxxx
xxxxxxxxxxxEHKQLAATVMQxxxxxxxxxxxxxxxxxxxxxxxxxxxxxxxxxxxxxxxxxxxxx
xxxxxxxxEGEGVVEATDAHNPRLLRVERWLRNHGEERLGRxxxxGDDCVVRPVDDRFGRALYFLNDx
xxxxxxxxEWEHSAGFASWEAVPFCSxxxxxxxVMKDGRALVVPCRDQxxxxxxxxxxxxxxxxxxxx
xxxxxxxxxxxxxxxxxxxxxxxLRTLGLTICSAVPTDWVPTGRTxxxxxxSGSWMTTEDMLxxxxxxxxxD
NPFMHGKEKxxxxRNVPYLPKAHDxxxxxxxxxRTERAEWAKNxxxAVEKVRKMMGxxKCKDYPSCMxx
xxLHWNLKLESSIF >TBEV|peptide_length:9|string5 xxxxxxxxxxxxxxxxxxRRVSKEAAKKTxxxxxxxxxxxxxxxxxxxxxxxxxxxxxxxxSFWKPVPL
KQATAxxRKIKKAVSTLMVGLQRREKKRSTxxxxxxxxxxxxxxxxFAATVRKERDDTTVIxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxVVWMTVESVVTRTxxVVAL
LCLAPxxxxxxxxxxxxxxxxxxxxxxxxxxxxxxxxxxxxxxxxxxxxxxxxxAIYQENPAQxxxxx
xxxxxxxxxxxxxxxxxxxxxxxxxxxxxxxxxxxxxxxxxxxxxxxxxxxxxSIVTCVKVSCEAxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxHEGVQNWNNAERxxxxxxxxxxxxxxxxxxxx
xxxxxxxxxxxxxxxxxxxxxxxxxxxxxxxxxxxxxxxKTKFTWRRTPTDSxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxFLSSIGKALxxxxxxxxxxxxxxxVGFLPKILIGxxxxxxx
xxxxxxxxxxxxxxxxxxxxxxxxxxxxxxxxxxxxxxxxxxxxxxxxxxxxxxxxxxxxxxxxxxx
xxxxxIRETFEEGTCxxxxxxxxxEMAMWRSAATELNLALxxxxxxxxxxxxxxxxxxxxxxxxxxxx
xxxxxxxxxSWGHSVIWSIPEAPxxxxxxxxxxxxxxxxxxxxxxxxxxxxxxxxxxxxxxxxxxxx
xxxxxxxxxxxxxxxxxxxxxxxxxxxxxLWMKSVRNETGTxxxxxxxxxxxxxxxxxxxxxxxxxxx
xxxxxxxxxxxxxxxxxxxxxxxxxxxxxVRGECPGTTVVISADCDRRGAxxxxxxxxxxxxxxxxxx
xxxxxxxxxxxxxxxxxxxxxxxxxxxxxxxxxxxxxxxxxxxxxxxxxxxxxxxxxxxxxxxxxxR
PATGSTVVWGGIVVFALLVTxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxLMALMTQQ
NxxxVHYGLIFFLGxxxxxxxWRLLEGHREQKGLSWIVPLAGLVGGEGxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxAGLAASALHWSGILGVxxLWTLSEMLKxxxxxDLAFSG
QGGxxxxxxxxxxxxxxxxxxxxxxxxxxxxxxxxxxxxxxxxxxxxxxxxxxxALSVDDAVAGPYWAEV
KxxxxxxxxxxxxxxxxxxxxxxxxxxxxxxxxxxxxxxxxxxxxxxxxxxxxxxxxxxxxTSGSPTL
NSQGVVVxxxxxxxxxxxxxxxxxxxxxxxxxxxxxxxxxxxxxxxxGSGWTAKGQIxxxxxxxxxxxxxxxxx
xxxxxxxxxxxxxxxxxxxxxxxxxxxxxxxxxxxxxxxxFLSPAVSDHQGGGAIVDxxxxxxxxxxxxxxxx
xxxxxxxxxxxxxxxxxxxxxxxxxxxxxxxxxxxxxxxxxxxxxxxxxxxxxxxxxxxxSEERQIPN
GEWxxxxxxxxxxxxxxxxxxxxxxxxxAKGGIIARAxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxEEPGSSAMRxxxxxAPEAFLTVAEMLVLGLAxxx
```

FIG. 60-12

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxEVRSWEEWTNxxxxxxxxxxxxxxxxxxxxx
xxxxxxxxxxxxxxxxxxxxxxxxxxxxxxxGGGAPFIGIAGHVMALGxxxxxxxxxxxxxxxxxxxxxx
xxxxxxxxxxxxxxxxxxxxxxxxxxxxxxxxxxxxxxxxxxxxxxxxxMSLVLAVALCLxSVVMNR
TVLSITEASAxxLAALGQLLKPEADTLWTxxxxxxxxxxxxxxxxxxxxxxxxxxxxxxxxxxxxx
xxxxxxxxxxxxxSCTREEFFVYRRAGILExxxDRARELLRRGxxxxxxxxxxxxxxxxxxxxxxxx
xxxxxxxxxxxxxxxxxxxxxxxxxxxxxxxxxxxGGKGHETPRMVxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxVVLADDKVKEQD
VQERIRALKEQYxxxxxxDAEHPYRTWxxxxxxxxxxxxxxxxxxxxxxxxxxxxxxxxxxxxxxx
xxxxxxxxxxxxxxxxxxxxxxxxxxxxxxxxxMLDRLAQKSRPRMCSKEExxxxxxxxxxxxxxx
xxxxxxxxxxxxxAVEDPAFWKLVDEExxxxLTGRCAHCVxxxxxxxxxxxxxxxxxxxxxxxxxx
xxxxxxxxxxxxxxxxWASRGSSGAGVEGxxxNYLGWHLKRLSxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxFRVERWLRDYGEERLGRxxxxxxxxxVRGIDDRFSGALYFLNDx
xxxxxxxxxxxxxxxxxSVEEVPFCSxxxxxxxxxxxxxxxxxxxxxxxxxxxxxxxxxxxxxxx
xxxxxxxxxxxxxxxxxxxxLRTLGLAISSAVPxxxxxxxxxxxxxxxxxxxxxxxxxxxxxxxx
NPFMQNKGKxxxxxxIPYLPKAQDxxxxxxxxxxxxxxxxxxxxAVEKVRKMVGxxxxxxxxxxxxx
xxxxxxxxxxxxxx
```

FIG. 60-13

>TBEV|peptide_length:10|string1

MAGKAILKGKGGGPPRRVSKETAKKTRQSRVQMPNGLVLMRMMGILWHAVAGTARSPVLKSFWNSVPL
KQATAALRKIKKAVSTLMVGLQRRGKRRSAxxxxxxxxxxxxxxxxTLAATVRKERDGTTVIRAEGKDA
ATQVRVENGTCVILATDMGSWCDDSLTYECVTIDQGEEPVDVDCFCRNVDGVYLEYGRCGKQEGSRTR
RSVLIPSHAQGDLTGRGHKWLEGDSLRTHLTRVEGWVWKNKxxxxxxxxxVVWLTVESVVTRxxxVVVL
LCLAPVYASRCTHLENRDFVTGTQGTTRVTLVLELGGCVTITAEGKPSMDVWLDSIYQENPAKTREYC
LHAKLSDTKVAARCPTMGPATLAEEHQSGTVCKRDQSDRGWGNHCGLFGKGSIVTCVKASCEAKKKAT
GHVYDANKIVYTVKVEPHTGDYVAANETHSGRKTASFTVSSEKTILTMGDYGDVSLLCRVASGVDLAQ
TVILELDKTSEHLPTAWQVHRDWFNDLALPWKHEGAQNWNNAERLVEFGAPHAVKMDVYNLGDQTGVL
LKSLAGVPVAHIDGTKYHLKSGHVTCEVGLEKLKMKGLTYTMCDKTKFTWKRIPTDSGHDTVVMEVAF
SGTKPCRIPVRAVAHGSPDVNVAMLITPNPTIENNGGGFIEMQLPPGDNIIYVGELSHQWFQKGSSIG
RVFQKTRKGIERLTVIGEHAWDFGSTGGFLTSVGKALHTVLGGAFNSLFGGVGFLPKILVGVALAWLG
LNMRNPTMSMSFLLAGGLVLAMTLGVGADVGCAVDTERMELRCGEGLVVWREVSEWYDNYAYYPETPG
ALASAIKETFEEGTCGIVPQNRLEMAMWRSSATELNLALAEGDANLTVVVDKLDPTDYRGGIPGLLKK
GKDIKVSWKSWGHSMIWSVPEAPRRFMVGTEGGSECPLERRKTGVFTVAEFGVGLRTKVFLDFRQEST
HECDTGVMGAAVKNGMAVHTDQSLWMKSVRNDTGTYIVELLVTDLRNCSWPASHTIDNAEVVDSELFL
PASLAGPRSWYNRIPGYSEQVKGPWKYSPIRVTREECPGTRVxINADCDKRGASVRSTTESGKVIPEW
CCRTCTLPPVTFRTGTDCWYAMEIRPVHDQGGLVRSMVVADNGELLSEGGVPGIVALFVVLEYVIRRR
PATGTTAMWGGIVVLALLVTGLVRIESLVRYVVAVGITFHLELGPEIVALTLLQAVFELRVGLLSAFA
LRSNLTVREMVTIYFLLLVLELGLPSxxxxxLWKWGDALAMGALIFRACTAEEKTGVGLLLMALMTQQ
DxxxxxxxxxxxxxxxxxxxxWKLIRGHREQKGLTWIVPLAGLLGGEGSGVRLLAFWELAxHGRRRSF
SEPLTVVGVMLTLASGMMRHTSQEALCALAVASFLLLMLVLGTRKMQLVAEWSGCVEWHPELMNEGGE
VSLRVRQDSMGNFHLTELEKEERVMAFWLLAGLAASAFHWSGILGVMGLWTLSEMLRxARRSDLVFSG
QGGRERGDRPFEVKDGVYRIFSPGLLWGQRQVGVGYGSKGVLHTMWHVTRGAALSIDDAVAGPYWADV
KEDVVCYGGAWSLEEKWKGETVQVHAFPPGRAHEVHQCQPGELLLDTGRRxGAVPIDLAKGTSGSPIL
NSQGVVVGLYGNGLKTNETYVSSIAQGEAEKSRPNLPPAVxGTGWTAKGQITVLDMHPGSGKTHRVLP
ELIRQCIDRRLRTLVLAPTRVVLKEMERALNGKRVRFHSPAVGDQQVGGAIVDVMCHATYVNRRLLPQ
GRQNWEVAIMDEAHWTDPHSIAARGHLYTLAKENKCALVLMTATPPGKSEPFPESNGAISSEEKQIPD
GEWRDGFDWITEYEGRTAWFVPSIAKGGIIARTLRQKGKSVICLNSKTFEKDYSRVRDEKPDFVVTTD
ISEMGANLDVSRVIDGRTNIKPEEVDGRVELTGTRRVTTASAAQRRGRVGRQEGRTDEYIYSGQCDDD
DSGLVQWKEAQILLDNITTLRGPVATFYGPEQDKMPEVAGHFRLTEEKRKHFRHLLTHCDFTPWLAWH
VAANVSSVTSRNWTWEGPEENTVDEANGDLVTFRSPNGAERTLRPVWRDARMFREGRDIREFVAYASG
RRSFGDVLSGMSGVPELLRHRCVSAMDVFYTLMHEEPGSRAMRMAERDAPEAFLTVVEMMVLGLATLG
VVWCFVVRTSISRMMLGTLVLLASLALLWAGGVSYGNMAGVALIFYTLLTVLQPEAGKQRSSDDNKLA
YFLLTLCSLAGLVAANEMGFLEKTKADLSTVLWSxxxELRSWEEWTNIDIQPARSWGTYVLVVSLFTP
YIIHQLQTKIQQLVNSAVATGAQAMRDLGGGAPFFGVAGHVMALGVVSLVGATPTSLVVGVGLAAFHL
AIVVSGLEAELTQRAHKVFFSAMVRNPMVDGDVINPFGEGEAKPALYERKMSLVLAIVLCLMSVVMNR
TVPSITEASAVGLAAAGQLLRPEADTLWTMPVACGLSGVVRGSLWGFLPLGHRLWLRASGSRRGGSEG
DTLGDLWKRKLNGCTKEEFFAYRRTGILETERDKARELLRRGETNMGLAVSRGTAKLAWLEERGYATL
KGEVVDLGCGRGGWSYYAASRPAVMSVKAYTIGGKGHETPKMVTSLGWNLIKFRAGMDVFSMQPHRAD
TIMCDIGESNPDAVVEGERTRKVILLMEQWKNRNPTATCVFKVLAPYRPEVIEALHRFQLQWGGGLVR
TPFSRNSTHEMYYSTAVTGNIVNSVNIQSRKLLARFGDQRGPTRVPELDLGVGTRCVVLAEDKVKEKD
VQERISALREQYGETWHxDREHPYRTWQYWGSYRTAPTGSAASLINGVVKLLSWPWNAREDVVRMAMT
DTTAFGQQRVFKEKVDTKAQEPQPGTKVIMRAVNDWILERLARKSKPRMCSREEFIAKVKSNAALGAW
SDEQNRWSSAKEAVEDPAFWQLVDEERERHLAGRCAHCVYNMMGKREKKLGEFGVAKGSRAIWYMWLG
SRFLEFEALGFLNEDHWASRGSSGSGVEGISLNYLGWYLKGLSTLEGGLFYADDTAGWDTKVTNADLE
DEEQLLRYMEGEHKQLAATIMQKAYHAKVVKVARPSRDGGCIMDVITRRDQRGSGQVVTYALNTLTNI
KVQLIRMMEGEGVIEASDAHNPRLLRVERWLRDHGEERLGRMLVSGDDCVVRPVDDRFGKALYFLNDM
AKTRKDIGEWEHSVGFSNWEEVPFCSHHFHELVMKDGRALIVPCRDQDELVGRARVSPGCGWSVRETA

FIG. 60-14

CLSKAYGQMWLLSYFHRRDLRTLGLAICSAVPVDWVPTGRTTWSIHASGAWMTTEDMLDVWNRVWILD
NPFMHSKEKxxEWRDVPYLPKSHDMLCSSLVGRKERAEWAKNIWGAVEKVRKMIGxxKFKDYLSCMDR
HDLHWELKLESSII

>TBEV|peptide_length:10|string2

MVKKAILKGKGGGPPRRVSKETAKKTRQSRVRMPNGLVLMRMMGILWHAVAGTARNPVLKAFWNSVPL
RQATAALRKIKRTVSALMVGLQKRGKRRSAxxxxxxxxxxxxxxxTLAATVRKERDGSTVIRAEGRDA
ATQVRVENGTCVILVTDMGSWCDDSLSYECVTIDQGxxxxxVDCFCRNVDGVHLEYGRCGKQxxSRTR
RSVLIPSHAQGELTGRGRKWLEGDSLRxxxxRVEGWVWKNRxxxxxxxxVVWLTLESVVTRxxxLAAL
FCLAPVYASRxxxxxxxxxxxxxxxxxxxxxxxxxxxxxxxxxKPSMDVWLDAIYQESPAKTREYC
LHVKLSDTKVAARCPTTGPATLAEEHQGGTVCKRDQSxxxxxxxxGLFGKGSIVACVKAACEAKKKAT
GHVYDANKIVYPIKVEPHTGDYVAPHETHSGRKTASFTISSEKTILTMGEYGDVSLLCKVPSGVDLAQ
TVILELDKTVEHLPTAWQVRRDWFNDLALPWRHEGAQQWNNAERLVEFGVPHAVKMDVYxxGDQTGVL
LKALAGVPVAHIEGAKYHLKSGHVxxEVGLEKLKMKGLTYTMCDKTKFTWKRTPTDSGHDTVVMEVTF
SGTKPCRIPVRAVAHGFPDVNVAMLITPNPTIETNGGGFIEMQxxxxxNIIYVGELSYQWFQKGSSIG
RVFQKTKRGIERLTVIGEHAWDFGSAGGFLSSIGKAVHTVLGGAFNSIFGGVGFLPKLLLGVVLAWLG
LNMRNPTMSMGFLLAGVLVLAMTLGVGADVGGAVDTERMELxxxxxxxxxxxVSEWYDNYAFYPETPG
ALASAIKETFEEGSCGVLPQNRLEMAMWRSSVTELNLALAEGEANLTVVVDKFDPTDYRGGVPGLLRK
GKDIKVSWKSWGQSMIWSIPEAPRRFMVGTEGSNECPLERRKTGIFTVAEFGVGLRTKVFLDFRQEPT
HECDTGVMGAAVKNGMAIHTDQSLWMRSMKNETGTYIVELLxxxxxxxxWPASHTIDNADVVDSESFL
PASLAGPxSWYNRIPGYAEQVKGPWKHTPIRVIREECPGTTVxINAKCDRRGASVRSTTxxxKVIPEW
CCRACTMPPVTIRTGTDCWYAxxxRPVHDQGGLIRSTVVADNGELLSEGGIPGIVALFVVLEYIIRRR
PSTGTTVVWGGVVVLALLVTGMVKVESLVRYVVAVGITFHFELGPEIVALMLLQAVFELRxGLLSAFA
LRRSLTVREMVTTYFLLLVLELGLPGxxxxxFWRWGDALAMGALIFRACTAEGKTGAGLLLMALMTQR
DxxxxxxxxxxxxxxxxxxxWRLLKGHREQKGLTWVVPLARLLGGEGSGIRLLAFWELSxHRGRRSF
SEPLTVVGVMLTLAGGMMRHTPQEALCALAVxxxxxxxxxxxxxxxxxxxxxAEWSGCVEWHPELVNEGGE
VSLRVRQDAMGNFHLTELEKEERMMAFWLIAGLAASAIHWSGILGVMGLWTLTEMLRxSRRSDLAFSG
QGGRERGDKPFEVRDGVYRIFSPGLFWGQRQVGVGYGFRGVLHTMWHVTRGAALSINDAVAGPYWADV
REDVVCYGGAWSLEEKWRGETVQVHAFPPGKAHEVHQCQPGELILDTGRKxGAIPIDLVKGTSGSPIL
NAQGAVVGLYGNGLKTNGTYVSSIAQGEAEKSRPNLPQAVxGTGWTSKGQITVLDMxxxxxxxxxVLP
ELIRQCTDRRLRTLVLxxxxxxVLKEMERALSGKRVRFHSPAVSDQQAGGSIVDVMCHTTYVSRRLLPQ
GRQNWEVATIDEAHWTDPHxxxARGHLYTLAQENKCALVLMTATRPGKSEPFPESNGAITSEERQIPE
GEWRDGFDWITEYEGRTAWFVPSIAKGGAIARALRQKGKSVIxxNSKTFEKDYTRVRDEKPDFxxxxx
xxxxxxxxxxxxxxxxxxNIKPEEVDGKVELIGTRRVTTASAAQRRGRVGRQDGRIDEYIYSGQCDEY
DSVLVQWKEGQILLDDIITLRGPVATFYGPEQDKMPEVAGHYRLTEEKRKHxxxxxxxxxxxxxxxxAWH
VAANVSSVTDRSWTWEGPEENAVDEASGDLVTFKSPNGAERTLRPVWKDARMFKEGRDIKEFVAYASG
RRSFGDVLTGMSGVPELLRHRCVSALDVFYTLMHEEPGSRAMKMAERDAPEAFLTMAEVLVLGLATLG
VIWCFVVRASISRMMLGTLVLLASLLLLWAGGVGYGNMAGVALxxxTLLTVLQPEVGKQRSSDDNxxA
YFLLTLCSVAGLVAANEMGFLERTKADLSTALWSxxxEPRPWSEWTNVDIQPARSWGxxxLVVSLFTP
YMIHQLQTKIQQLVNSAVASGAQAMRDLGGGTPFFGVAGHVMTLGVVSLIGATPTSLMVGVGLAALHL
AIVVSGLxxxxxxxxxxxxFSAMVRNPMLDGDVINPFGEGETKPALYERKMSLVLAIALCLMSVVMNR
TVASITEASAVGLAAVGQLLRPEVDTLWTMPVACGMSSVVTGSLWGFLPLxHRLWLRASGGRRGGADG
DTLGDLWKRRLNNCTREEFFVYRRAGIMETERDKARELLRKGETNTGLAVSRGTAxxxxxxxxxxxxx
xxxxxxxxxxWSYYAASRPAVMSVRAYTIGGRGHEAPRMVTSLGWNLIKFRSGVDVFSMQPHRAD
TVMCDIGESSPDAAVEGERTRRVILLMEQWKNRNPTAACVFKVLAPYRPEVIEALHRFQLRWGGGLVR
TPFSRNSTHEVYYSTAITGNIVNSVNVQSRKLLARFGDQRGPTRVPELDLGIGTRCVVLAEDKVKEQD
VQERIRALREQYSETWHxDEEHPYRTWQYxxxxxxAPTGSAASLTNGVVKLLSWxxxxxxDVVRMAMT
DPTAFGQQRVFKDNADTKAQEPQPGTRVIMRAVNDWILERLAQKSKPRMCSKEEFIAKVRSNAALGAW
SDEQNRWASAREAVEDPAFWHLVDEERERHLMGRCAHCVHNIMGKREKKLGEFGVSKGSRAMWYMWLG

FIG. 60-15

SRFQEFEALGFLNEDHWASRESSGAGVEGISLNYLGWHLKKLSTLNGGLFYADDTxxxxxxxxNADLE
DEEQILRYMEGEHKQLATTVMQKAYHAKVVKVARPSRDGGCVMDVITRRDQRGSVQVVTYALNTHTNI
KVQLIRMMEGEGVIEAADAHNPRLLRVERWLKEHGGERLGRMLVSGDDCVVRPLDDRFSRALYFLNDM
AKTRKDVGEWEHSAGFSSWEAVPFCSHHFHELVMKDGRSLVVPCRDQDELVGRARISPGCGWSIRETA
CLSKAxxxxxxxxxxxHRRDLRTLGLAINSAVPIDWVPTGRTTWSIHASGSWITTENMLDVWNRVWILD
NPFMQNKEKxxEWRDVPYLPKAQDMLCSSLVGRRERAEWARNIWGAVEKVRRMIGxxKFRDYPSCMDR
HDLHWELRLESSII >TBEV|peptide_length:10|string3

MARKAILKGKGGGPPRRVSKETATKTRQPRVQMPSGLVLMRMLGILWHAIAGTVRSPVLKSFWKSVPL
KQAMAALRKIKKAVSALMIGLQRRGKKRSTxxxxxxxxxxxxxxxTFAATVRKEGDDTTVIRAEGRDx
xxxxxVENGTCVILATDMGAWCDDSLSYExxxxxxxxxxxxxxxxCFCRNVDRVYLEYGRCGxxxxxxxx
xxVLIRSHAQGELTGRGRKWLxxxxxxxxxxxxxxxxxxxxxxxxxxxxxIVWLTLESVVARxxxVVVL
FCLAPVYAxxxxxxxxxxxxxxxxxxxxxxxxxxxxxxxxxxxxxxxxxxVWLDAIYQENPAQTREYC
LHAKxxxxxxxxxxCPTMGPATLAEQHQSGTVCKRxxxxxxxxxxxxxxxxKGSIVTCVKVACEAKKKAT
GHVYDPNRIVYTIKVEPHTGDYVAVNETHSGRKTPSFTVSSEKTILNMGDYGDVSLLCKxxxxxxxxxx
TVILELDKTLEHLPTAWQVxxxxxxxLALPWRHEGAQHWNNAERLVExxxxxxxxxxxxxxxxxxxxx
xxxxxGVPVAHIDGAKYHLKSGxxxxxxxxxxxLKMNGLTYTVCDKTKFAWKRAPTDSGHDTVVMEVSF
SGTKPCRIxxxxxxxxxxxxxxxxxxxxxxxxxxxxxxxxxxxxxxxxxxxxxxxxxxxxxxxxxxIG
RVFQKTRRGIERLTVIxxxAWDFGSTGGFLASIGKALHTVLGxxxNSLFGGVGFLPKILMGAALAWLG
LNMxxxxMSMSFLLAGVLVLxxxxxxxxxxxxxxxxxxxxxxxxxxxxxxxxxxxxxxxxxxxxxxxG
ALASAIKETFEEGNCGILPQNRLEMAMWRSASTELNLALAEGEANLTVMVDKLDPTDYRGGVSGLLKK
GKDIKVSWKSWGQAIIWSIPEASRRFMVGTEGQSECPPERRKTGVFTxxxxxxxxxxxKVFVDFRQEAT
HECDTGVMxxxxxxxxxxIHTDQSLWMKSVRNETGTYIVExxxxxxxxxxxPASHTIDNADVVDSESFL
PxxxxxxxxxxxxxxxxxSEQVKGPWKYTPIRVTREECPGTKVxISADCDRRGASVRxxxxxxxxxxxxx
xxRTCTLPPVTIRTGTxxxxxxxxxxxHDQGGLVRSTVVADNGxxxxxxxxxxxxxxxxxxxxxxIIRRR
PATGTAVVWGGFVVLALLVTGLVRMESLVRYVVAVGIAFHLELGPEIxxxxxxxxxxxxxxxxxLLSAFA
LRRGLTVREMVITYFLLLVLELGLPYxxxxxLWRWGDALAMxxLIFRACTAEGKAGVGLLLMPLLTKR
GxxxxxxxxxxxxxxxxxxxxxWRLLRGHREQKGLSWIVPLAGLMGGEGSGIRLLAFWELAxHGKRRSF
SEPLTxxxxxxxxLASGMMRHTPQExxxxxxxxxxxxxxxxxxxxxxxxxxxxGCVEWYPELVNEGGE
xxxxxxxxxxxxxxxxxxxxxEERMMAFWLLAGLAASAVHWSGIIGVMGLWTLSEMMRxARRSDLVFSG
QGRGERGDRPFEVRDGVYxxFSPGLFWGQNQVGVGYGFRGVLHTMWHVTRGAALSIDDAVVGPYWAEV
KEDVVCYGGTWSLEEKWKGxxxxxxxxxxxxxxxxxxxPGELLLDTGGRxGAILIDLSKGTSRSPIL
NAQGAVVGLYGxxxxxxxxxxxSSIAQGEVEKSRPSLPPAVxGMGWTAKGQITxxxxxxxxxxxxxxxxx
xxxxxxxxxxxxxxxxxxxxxxxxVLKEMERALTGKRVRFHSPAVGDQQMGGAIVDLMCHATYVSRRLLPx
xxxxxxxxxxxxxxxxxxxxxxxxxxxxxxxxxxxxxxxxxPFPESNGAITSEEKQIPN
GEWRDGFDWxxxxxxxRSAWFVPSIAKGGVIARTLRQKGxxxxxxxxxxxxxxxxxxxxxxxxxxxxxx
xxxxxxxxxxxxxxxxxxxxxxxxxxEEVDGRVELIGTRRVxxxxxAQRRGRVGRHEGRIDEYIYSGQCDDD
DGGLVQWKEAQILLDNITTLRGPVVTFYGPEQDRMPEVAGHFRxxxxxxxxxxxxxxxxxxxxxxxxxx
VAANVSGVTSRSWTWEGPEANAVDEANGGLVTFRSPNGAERTLKPVWRDARMFREGRDIREFIAYASG
RRSIGDVLTGMSGxxxxxxxxxxxxMDVFYTLMHEEPDSSAMRMAERDAPEAFLTVVEMMVLGLGTLG
VVWCFVARTSISRMMLGTLVLLASLALLWAGGVGYxxxxxxxxxxxxxxxxxxxxxxxxxxxxxxxxx
xxxxxxxxxxxxAANEMGLLEKTKADLSTVLWAxxxEPRSWGEWTNIDIQPxxxxxxxxxxxxxxxxxx
xxxxxxxxxxQQLVNSAVVTGAQAMRDLGGGAPFLGVAGHVVSLGVVSLVGAxxxxLMVGVGLAAFHx
xxxxxxxxxxxxxxxxxxxxxxxxxxxxxxxVIYPFGEGEAKPALYERKMSLVLAVVLCLIAVVMNR
TVPSITEASAVGLAAAGQLLSPEEDTLWTMPVACGLSGVVTGSLWGFxxxxxxxxxxRASGSRRGGSDG
DTLGDLWKQRLNSCTKEEFFVYRRTGILETERDRARELLKKGETNVGLAVSRGTAxxxxxxxxxxxxxx
xxxxxxxxxxxxxxxxxYAASRPSVMSVRAYTIGGKGHETPRMVTSLGWNLIKFRAGVDVFSMQPxxxx
TIMCDIGESNPDAAVEGEKTRKVILLMEQWKIRNPAAACVFKVLAPYRPKVIEALHRFQLKWGGGLVR

FIG. 60-16

TPxxxxxTHKMYYSTAITGNxxxxxxxxxxxxxxRFAGQRGPTKVPELDLGVGTRCVVLAEDRVREKD
VQERIRALKEQYGETWHxDGEHPYRTWQYxxxxxxxxxxxxxxxxxxxxxxxxxxxxxxxxxxxxxx
xxxPAWQQRVFKKNADTKAQEPxxxxxxxxxxxNDWILERLARKNRSRIHSKEEFIAKVKSSAALGAW
SEEQNRWSNAKEAVEDPVFWRLVDEERERDLAGRSAHCAFNIMGKREKKxxxxxxxxxxxxxxxxxx
xxxxxxxxxxxxNEDHWASREFSGSGVEGISLNYLGWHLKGLSIPEGGLFYADDxxxxxxxxxxxxx
xxxxILRYMEGEHRQLAATVMQKAYHAxxxxxARPSREGGCVMDVITxxxxxxxxxxxxxxxxxxxx
xxxxxxxMEGEGVIEATDAHNPRLFRVERWLRNYGEERLGRMLxSGDDCVVRPIDDRFSGALYFLNDM
AxxxKDIGEWEHSAGFASVEEVPFCSHHxHELVMKDGRTLVVPCRDQDELVGRAPVSPGCGWSIRxxx
xxxxxxxxxxxxxxxxRRDLRTLGLAISSAVPADWVPTGRTTWSIHASGAWMTTENMLDVWxxxWILD
NPFMQNKERxxEWRDIPYLPKAHDMLCSSLVGRKERAEWARNIWGAVEKVRKIVGxxKCKDYLSCMDR
HDLHWELKLEGSII >TBEV|peptide_length:10|string4 xxxxxxxxxxxxxxxPRRVSKEAARKTRQSRVQMPSGLVxxRMMGFLWHAVAGTVRSPVLKSFWNSVPL
KQATTALRKIKMAVSTLMVGLQRREKKRSTxxxxxxxxxxxxxxxxAFAATVRRERDGTTVIRAEGRxx
xxxxxxxxxxCVIMATDMGSWCDxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxVVWMTVESVVTRxxxVVVL
FCLAPVYxxxxxxxxxxxxxxxxxxxxxxxxxxxxxxxxxxxxxxxxxVWLDAIYQEKPAKTREYC
LxxxxxxxxxxxxxxxxxPATLTEEHQGGTVCxxxxxxxxxxxxxxxxxxxGSIVTCVKVSCEAKKKAT
xxxYDANKIVYPVKVEPxxxxxxxxxxxxxxxxxxxxxxxxxxxxxxxxxxxxxxxxxxxxxxxxx
xxxxxxxxxxxxxxxxxxxxxxxxxxALPWKHEGVRNWNNAERLVxxxxxxxxxxxxxxxxxxxxxx
xxxxxxxxxxxxxxxxxxxxxxxxxxxxxxxxxxxxxxxxxMCDKTKFTWRRTPTDSGHDxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxDFGSTGGLLSSIGKALHTVxxxxxxxxxxGVGFIPKLLLGMALAWLG
LNMxxxxxxxxxxxxxxxxxxxxxxxxxxxxxxxxxxxxxxxxxxxxxxxxxxxxxxxxxxxxxxx
xxxxAIKEAFEEGTCGILPQNRLEMAMWRSSSTELNLALAxxxxxxxxxxxxFDPTDYRGGIPGLLRK
GKDIKVSWRSWGHSMIWSIPEASRRFMVGIEGSxxxxxxxxxxxxxxxxxxxxxxxKVFLDFRQEAT
HExxxxxxxxxxxxxxxxxxDQSLWMKSVRNETGTYIVxxxxxxxxxxxxxxxxxxxDNPEVVDSELFL
xxxxxxxxxxxxxxxxxxxEQVKGPWKYLPIRVIREECPGTRVxISADCDRRGASxxxxxxxxxxxxx
xxxxxxxxxxxxxxxxxxxxxxxxxxxxxxxxxxxxxxxxxxxxxxxxxxxxxxxxxxxxxxxIRRR
PSTGSTVVWGGIIVLALLVTGMVKVESLVRYVVxxxxxxxxxxxxxxxxxxxxxxxxxxxxxLLSAFA
LRRSLTVREMVITxxxxxxxxxxxxxxxxxxxxxxxxxxxxxxxxLRACTAEGKAGVGLLLMALMTQQ
NxxxxxxxxxxxxxxxxxxxxxxWRLLEGHREQKGLSWTVPMAGLVGGEGSGIRLLSFWELSxSGRRRSF
SEPxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxAGLAASAIHWSGIIGVMGLWTLSEMLKxARRSDLVFSG
QGNRERGDKPFEVRDGVYxxFSPGLFWGQSQVGVGYGSKxxxxxxxxVTRGAALYVDDAVAGPYWSDV
REDVVCYxxxxxxxxxxxxxxxxxxxxxxxxxxxxxxxxxxxxxxxxxxxxxGAVLIDLAKGTSGSPII
NSQGVVVGLxxxxxxxxxxxxxxxxxxQGEAERSRPNLPQAVxGIGWTAKGQITxxxxxxxxxxxxxx
xxxxxxxxxxxxxxxxxxxxxxxxxxxxRVRFLSPAVSDQQVGGSIVDxxxxxxxxxxxxxxxxxxxx
xxxxxxxxxxxxxxxxxxxxxxxxxxxxxxxxxxxxxxxxxxxxxxxxxxxxxSNRGITSEVRQIPN
GEWRDxxxxxxxxxxxxxxxxxFVPSIVKGGIIARALRQKGxxxxxxxxxxxxxxxxxxxxxxxxxx
xxxxxxxxxxxxxxxxxxxxxxxxxxxxxxxxxxxxxPRRGRVGRQEGRIDEYIYSGQCDDD
DSVLVQWKEAQILLDNITTLRGPVVxxxxxxxxxxxxxxxxxxxxxxxxxxxxxxxxxxxxxxxxxxx
xxANVSSVTSRSWTWExxxANAVDEASGGLVTFRSPxxxxxxxxxxxxxxxxxxxxxxxxxxxxxxx
xxxxxxxxxxxxxxxxxxxxxxxxxxxxxxTLMHDKPGSSAMRMAERDAPEAFLTLAEMMVLGLGTLG
VVWCFVVRASIxxxxxxxxxxxxxxxLVLLWAGGVSYxxxxxxxxxxxxxxxxxxxxxxxxxxxxxx
xxxxxxxxxxxxxxxxxxxEKTKADLSAVLWSxxxEVRSWEEWTNIxxxxxxxxxxxxxxxxxxxxx
xxxxxxxxxxxxxxxxxxxxxxxxxxxxRDLGGGAPFFGVAGHVMSLGVVSLVGxxxxxxxxxxxxxx
xxxxxxxxxxxxxxxxxxxxxxxxxxxxxxxxxxxxxxERRMSLVLATVLCLMSVVMNR

FIG. 60-17

```
TMLSITEAAAVGLAAAGQLLRPEEDTLWTMxVACGLSGVVTGSLWxxxxxxxxxxxxxASGSRRGGSDG
DTxxxxxxxxxLNSCTREEFFIYRRTGIMETERDKARELLKRGETNVGLAVxxxxxxxxxxxxxxxxxx
xxxxxxxxxxxxxxxxxxASRPAVMNVKAYTIGGRGHETPKMVTxxxxxxxxxxxxxxxxxxxxxxxxx
TVMCDIGESNPDAVVEGEKTRKVxxxxxQWKNRNPAAACVFxxxxxxxxxxIETLHRFQLQWGxxxxx
xxxxxxxxxxxxxxxxxxxxxxxxxxxxxxxxxxxxxxxxxxxxxxxxxxxxxxxVGTRCVFLAEDKVKEQD
VRERINALREQYxxxxxxDAEHPYRTWQYxxxxxxxxxxxxxxxxxxxxxxxxxxxxxxxxxxxxxxx
xxxxxxxxxxxxxxxxxxxxxxxxxxxxxxxxxxxDWMLDRLAQKSRPRMCSREEFxxxxxSNAALGAW
SNEQNRWSSAKEAVEDPAFWQLVDEERERHLTGRCAHGVFNIMGKREKxxxxxxxxxxxxxxxxxxxx
xxxxxxxxxxxxxxxxHWASRGSSGAGVEGIxLNYLGWYLKELSTPEGGLFYADxxxxxxxxxxxxxx
xxxxLLRYMEGEHKQLAATVMQKxxxxxxxxxxxxxxxxxxxxxxxxxxxxxxxxxxxxxxxxxxxx
xxxxxxxMEGEGVVEATDAHNPRLLRVERWLREHGGERLGRMxxSGDDCVVRPVDDRFGRALYFLNDM
xxxxxxIGEWEHSAGLSGWEEVPFCSHxxxxLVMKDGRALVVPCRDQDxxxxxxRVSPGCGWSIxxxx
xxxxxxxxxxxxxxxxxxDLRTLGFAICSAVPTDWVPTGRTTxxxxASGAWMTTENMLDxxxxxxxLD
NPFMQNKGKxxxWRNVPYLPKAHDMxxxxxxGRTERAEWAKNIxGAVEKVRKMMGxxRFKDYLSCMDx
xYLHWNLKLESSIF >TBEV|peptide_length:10|string5 xxxxxxxxxxxxxxPRRASKETAKKTRxxxxxxxxxxxxxxxxxxxxxxxxxxxxxxxKSFWKPVPL
KQATAALRKIKRAVSALMVGLQKRGKRRSVxxxxxxxxxxxxxxxxTIAATVRKERDDTTVIRxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxIVWMTVESVVxxxxxVVVL
FCLAPVxxxxxxxxxxxxxxxxxxxxxxxxxxxxxxxxxxxxxxxxxxxxxxDAIYQEKPAKTxxxx
xxxxxxxxxxxxxxxxxxxxxxxxxxxxxxxxxxxxxxxxxxxxxxxxxxxxGSIVTCVKVSCEAKxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxHEGARNWNNAERLxxxxxxxxxxxxxxxxxx
xxxxxxxxxxxxxxxxxxxxxxxxxxxxxxxxxxxxxxxDKTKFTWRRTPTDSGxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxGFLSSIGKALHxxxxxxxxxxxxxGVGFLPKILIGxxxxxxx
xxxxxxxxxxxxxxxxxxxxxxxxxxxxxxxxxxxxxxxxxxxxxxxxxxxxxxxxxxxxxxxxxxx
xxxxAIRETFEEGTCGILxxxxLEMAMWRSAATELNLALAxxxxxxxxxxxxxxxxxxxxxxxxxxx
xxxxRVSWKSWGHSVIWSIPEAPRxxxxxxxxxxxxxxxxxxxxxxxxxxxxxxxxxxxxxxxxxxx
xxxxxxxxxxxxxxxxxxxxxxxxxxxxSLWMKSVRNETGTYxxxxxxxxxxxxxxxxxxxxxxxxx
xxxxxxxxxxxxxxxxxxxxxxxxxxxxxxxxVVRGECPGTKVxITADCDKRGASxxxxxxxxxxxx
xxxxxxxxxxxxxxxxxxxxxxxxxxxxxxxxxxxxxxxxxxxxxxxxxxxxxxxxxxxxxxxxxRR
PATGTTAVWGGLIVFALLVTGLVRxxxxxxxxxxxxxxxxxxxxxxxxxxxxxxxxxxxxxxxxxxxx
xxRSLTVREMVTIxxxxxxxxxxxxxxxxxxxxxxxxxxxxxxxxxxxxxxxxxxxxxxxLLMALITQQ
DxxxxxxxxxxxxxxxxxxxxxxxxxxxxxxxxWRLLEGHREQKGLSWIVPLAGLVGGEGSGIxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxAGLSASALHWSGILGVMGLWTLTKMLRxxxxSGLVFSG
QGGRxxxxxxxxxxxxxxxxxxxxxxxxxxxxRQVGVGYGFRxxxxxxxxxxxxxAALSIDDAVAGPYWSDV
RExxxxxxxxxxxxxxxxxxxxxxxxxxxxxxxxxxxxxxxxxxxxxxxxxxxxxxxAKGTSGSPTL
NSQGVVVGxxxxxxxxxxxxxxxxxxxxAEKSRPSLPPxxxGSGWTAKGQITxxxxxxxxxxxxxxx
xxxxxxxxxxxxxxxxxxxxxxxxxxxxxxxxxxxxxxxRFHSPVVGDHQGGGAIVDxxxxxxxxxxx
xxxxxxxxxxxxxxxxxxxxxxxxxxxxxxxxxxxxxxxxxxxxxxxxxxxxxxxxxxSEERQIPN
GEWRxxxxxxxxxxxxxxxxxxIAKGGIIARALxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxHEEPGSSAMRMxxxDAPEAFLTMVEMMVLGLGTxx
```

FIG. 60-18

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxEMRSWEEWTNIxxxxxxxxxxxxxxx
xxxxxxxxxxxxxxxxxxxxxxxxxxxxxLGGGAPFIGIAGHVMALGVxxxxxxxxxxxxxxxxx
xxxxxxxxxxxxxxxxxxxxxxxxxxxxxxxxxxxxxxxxxxxxxxxMSLVLAVALCLxSVVMNR
TVLSITEASAVGLAALGQLLKPEADTLWTMxxxxxxxxxxxxxxxxxxxxxxxxxxxxxxxxxxx
xxxxxxxxxxxNSCTREEFFVYRRTGIMETxRDKARELLKRGExxxxxxxxxxxxxxxxxxxxxx
xxxxxxxxxxxxxxxxxxxxxxxxxxSVKAYTIGGKGHETPRMVTxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxCVVLADDKVKEQD
VRERIKALREQYxxxxxxNGEHPYRTWQxxxxxxxxxxxxxxxxxxxxxxxxxxxxxxxxxxxx
xxxxxxxxxxxxxxxxxxxxxxxxxxxxxxxxxWILERLAQRSNSRIHSKEEFxxxxxxxxxxxx
xxxxxxxxGAREAVEDPAFWKLVDEERERHLAGRCAHCAxxxxxxxxxxxxxxxxxxxxxxxxxx
xxxxxxxxxxxxxxHWASRGFSGSGVEGIxLNYLGWHLKRLSxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxLLRVERWLRDYGEERLGRMxxxxxxxVVRGIDD

FIG. 60-19

>TBEV|peptide_length:11|string1

```
MAGKAILKGKGGGPPRRVSKETAKKTRQSRVQMPNGLVLMRMMGILWHAVAGTARSPVLKSFWNSVPL
KQATAALRKIKKAVSTLMVGLQRRGKRRSAxxxxxxxxxxxxxxxxTLAATVRKERDGTTVIRAEGKDA
ATQVRVENGTCVILATDMGSWCDDSLTYECVTIDQGEEPVDVDCFCRNVDGVYLEYGRCGKQEGSRTR
RSVLIPSHAQGDLTGRGHKWLEGDSLRTHLTRVEGWVWKNKxxxxxxxxxVWLTVESVVTRxxxVVVL
LCLAPVYASRCTHLENRDFVTGTQGTTRVTLVLELGGCVTITAEGKPSMDVWLDSIYQENPAKTREYC
LHAKLSDTKVAARCPTMGPATLAEEHQSGTVCKRDQSDRGWGNHCGLFGKGSIVTCVKASCEAKKKAT
GHVYDANKIVYTVKVEPHTGDYVAANETHSGRKTASFTVSSEKTILTMGDYGDVSLLCRVASGVDLAQ
TVILELDKTSEHLPTAWQVHRDWFNDLALPWKHEGAQNWNNAERLVEFGAPHAVKMDVYNLGDQTGVL
LKSLAGVPVAHIDGTKYHLKSGHVTCEVGLEKLKMKGLTYTMCDKTKFTWKRIPTDSGHDTVVMEVAF
SGTKPCRIPVRAVAHGSPDVNVAMLITPNPTIENNGGGFIEMQLPPGDNIIYVGELSHQWFQKGSSIG
RVFQKTRKGIERLTVIGEHAWDFGSTGGFLTSVGKALHTVLGGAFNSLFGGVGFLPKILVGVALAWLG
LNMRNPTMSMSFLLAGGLVLAMTLGVGADVGCAVDTERMELRCGEGLVVWREVSEWYDNYAYYPETPG
ALASAIKETFEEGTCGIVPQNRLEMAMWRSSATELNLALAEGDANLTVVVDKLDPTDYRGGIPGLLKK
GKDIKVSWKSWGHSMIWSVPEAPRRFMVGTEGGSECPLERRKTGVFTVAEFGVGLRTKVFLDFRQEST
HECDTGVMGAAVKNGMAVHTDQSLWMKSVRNDTGTYIVELLVTDLRNCSWPASHTIDNAEVVDSELFL
PASLAGPRSWYNRIPGYSEQVKGPWKYSPIRVTREECPGTRVxINADCDKRGASVRSTTESGKVIPEW
CCRTCTLPPVTFRTGTDCWYAMEIRPVHDQGGLVRSMVVADNGELLSEGGIPGIVALFVVLEYVIRRR
PATGTTAMWGGIVVLALLVTGLVRIESLVRYVVAVGITFHLELGPEIVALTLLQAVFELRVGLLSAFA
LRSNLTVREMVTIYFLLLVLELGLPSxxxxxLWKWGDALAMGALIFRACTAEEKTGVGLLLMALMTQQ
DxxxxxxxxxxxxxxxxxxxxWKLIRGHREQKGLTWIVPLAGLLGGEGSGVRLLAFWELAxHRRRRSF
SEPLTVVGVMLTLASGMMRHTSQEALCALAVASFLLLMLVLGTRKMQLVAEWSGCVEWHPELMNEGGE
VSLRVRQDSMGNFHLTELEKEERVMAFWLLAGLAASAFHWSGILGVMGLWTLSEMLRxARRSDLVFSG
QGGRERGDRPFEVKDGVYRIFSPGLLWGQRQVGVGYGSKGVLHTMWHVTRGAALSIDDAVAGPYWADV
KEDVVCYGGAWSLEEKWKGETVQVHAFPPGRAHEVHQCQPGELLLDTGRRxGAVPIDLAKGTSGSPIL
NSQGVVVGLYGNGLKTNETYVSSIAQGEAEKSRPNLPPAVxGTGWTAKGQITVLDMHPGSGKTHRVLP
ELIRQCIDRRLRTLVLAPTRVVLKEMERALNGKRVRFHSPAVGDQQxGGAIVDVMCHATYVNRRLLPQ
GRQNWEVAIMDEAHWTDPHSIAARGHLYTLAKENKCALVLMTATPPGKSEPFPESNGAISSEEKQIPD
GEWRDGFDWITEYEGRTAWFVPSIAKGGIIARTLRQKGKSVICLNSKTFEKDYSRVRDEKPDFVVTTD
ISEMGANLDVSRVIDGRTNIKPEEVDGRVELTGTRRVTTASAAQRRGRVGRQEGRTDEYIYSGQCDDD
DSGLVQWKEAQILLDNITTLRGPVATFYGPEQDKMPEVAGHFRLTEEKRKHFRHLLTHCDFTPWLAWH
VAANVSSVTSRNWTWEGPEENTVDEANGDLVTFRSPNGAERTLRPVWRDARMFREGRDIREFVAYASG
RRSFGDVLSGMSGVPELLRHRCVSAMDVFYTLMHEEPGSRAMRMAERDAPEAFLTVVEMMVLGLATLG
VVWCFVVRTSISRMMLGTLVLLASLALLWAGGVSYGNMAGVALIFYTLLTVLQPEAGKQRSSDDNKLA
YFLLTLCSLAGLVAANEMGFLEKTKADLSTVLWSxxxELRSWEEWTNIDIQPARSWGTYVLVVSLFTP
YIIHQLQTKIQQLVNSAVATGAQAMRDLGGGAPFFGVAGHVMALGVVSLVGATPTSLVVGVGLAAFHL
AIVVSGLEAELTQRAHKVFFSAMVRNPMVDGDVINPFGEGEAKPALYERKMSLVLAIVLCLMSVVMNR
TVPSITEASAVGLAAAGQLLRPEADTLWTMPVACGLSGVVRGSLWGFLPLGHRLWLRASGSRRGGSEG
DTLGDLWKRKLNGCTKEEFFAYRRTGILETERDKARELLRRGETNMGLAVSRGTAKLAWLEERGYATL
KGEVVDLGCGRGGWSYYAASRPAVMSVKAYTIGGKGHETPKMVTSLGWNLIKFRAGMDVFSMQPHRAD
TIMCDIGESNPDAVVEGERTRKVILLMEQWKNRNPTATCVFKVLAPYRPEVIEALHRFQLQWGGGLVR
TPFSRNSTHEMYYSTAVTGNIVNSVNIQSRKLLARFGDQRGPTRVPELDLGVGTRCVVLAEDKVKEKD
VQERIxALREQYGETWHxDREHPYRTWQYWGSYRTAPTGSAASLINGVVKLLSWPWNAREDVVRMAMT
DTTAFGQQRVFKEKVDTKAQEPQPGTKVIMRAVNDWILERLARKSKPRMCSREEFIAKVKSNAALGAW
SDEQNRWSSAKEAVEDPAFWQLVDEERERHLAGRCAHCVYNMMGKREKKLGEFGVAKGSRAIWYMWLG
SRFLEFEALGFLNEDHWASRGSSGSGVEGISLNYLGWYLKGLSTLEGGLFYADDTAGWDTKVTNADLE
DEEQLLRYMEGEHKQLAATIMQKAYHAKVVKVARPSRDGGCIMDVITRRDQRGSGQVVTYALNTLTNI
KVQLIRMMEGEGVIEASDAHNPRLLRVERWLRDHGEERLGRMLVSGDDCVVRPVDDRFGKALYFLNDM
AKTRKDIGEWEHSVGFSNWEEVPFCSHHFHELVMKDGRALIVPCRDQDELVGRARVSPGCGWSVRETA
```

FIG. 60-20

CLSKAYGQMWLLSYFHRRDLRTLGLAICSAVPVDWVPTGRTTWSIHASGAWMTTEDMLDVWNRVWILD
NPFMHSKEKxxEWRDVPYLPKSHDMLCSSLVGRKERAEWAKNIWGAVEKVRKMIGxxKFKDYLSCMDR
HDLHWELKLESSII

>TBEV|peptide_length:11|string2

MVKKAILKGKGGGPPRRVSKETAKKTRQSRVRMPNGLVLMRMMGILWHAVAGTARNPVLKAFWNSVPL
RQATAALRKIKRTVSALMVGLQKRGKRRSAxxxxxxxxxxxxxxxTLAATVRKERDGSTVIRAEGRDA
ATQVRVENGTCVILVTDMGSWCDDSLSYECVTIDQGExxxDVDCFCRNVDGVHLEYGRCGKQEGSRTR
RSVLIPSHAQGELTGRGRKWLEGDSLRTxxTRVEGWVWKNRxxxxxxxxxxVWLTLESVVTRxxxLVVL
FCLAPVYASRCxxxxxxxxxxxxxxxxxxxxxxxxxxxxxxxGKPSMDVWLDAIYQESPAKTREYC
LHVKLSDTKVAARCPTMGPATLAEEHQGGTVCKRDQSDxxxxxxCGLFGKGSIVACVKAACEAKKKAT
GHVYDPNRIVYPIKVEPHTGDYVAPHETHSGRKTASFTISSEKTILTMGEYGDVSLLCKVPSGVDLAQ
TVILELDKTVEHLPTAWQVRRDWFNDLALPWRHEGAQQWNNAERLVEFGVPHAVKMDVYNLGDQTGVL
LKALAGVPVAHIEGAKYHLKSGHVTCEVGLEKLKMKGLTYTMCDKTKFTWKRTPTDSGHDTVVMEVTF
SGTKPCRIPVRAVAHGFPDVNVAMLITPNPTIETNGGGFIEMQLxxxDNIIYVGELSYQWFQKGSSIG
RVFQKTKRGIERLTVIGEHAWDFGSAGGFLSSIGKAVHTVLGGAFNSIFGGVGFLPKLLLGVVLAWLG
LNMRNPTMSMGFLLAGVLVLAMTLGVGADVGGAVDTERMELRxxxxxxxxxxEVSEWYDNYAFYPETPG
ALASAIKETFEEGSCGVLPQNRLEMAMWRSSVTELNLALAEGEANLTVVVDKFDPTDYRGGVPGLLRK
GKDIKVSWKSWGQSMIWSIPEAPRRFMVGTEGSNECPPERRKTGIFTVAEFGVGLRTKVFLDFRQEPT
HECDTGVMGAAVKNGMAIHTDQSLWMRSMKNETGTYIVELLVxxxxxxSWPASHTIDNADVVDSESFL
PASLAGPRSWYNRIPGYSEQVKGPWKHTPIRVIREECPGTTVxINAKCDRRGASVRSTTExGKVIPEW
CCRACTMPPVTIRTGTDCWYAMxIRPVHDQGGLIRSTVVADNGELLSEGGVPGIVALFVVLEYIIRRR
PSTGTTVVWGGVVVLALLVTGMVKMESLVRYVVAVGITFHLELGPEIVALMLLQAVFELRVGLLSAFA
LRRSLTVREMVTTYFLLLVLELGLPGxxxxxFWRWGDALAMGALIFRACTAEGKTGAGLLLMALMTQR
DxxxxxxxxxxxxxxxxxxxxxWRLIRGHREQKGLTWVVPLARLLGGEGSGIRLLAFWELSxHGGRRSF
SEPLTVVGVMLTLAGGMMRHTPQEALCALAVAxxxxxxxxxxxxxxxVAEWSGCVEWHPELVNEGGE
VSLRVRQDAMGNFHLTELEKEERMMAFWLIAGLAASAVHWSGILGVMGLWTLTEMLRxSRRSDLVFSG
QGGRERGDKPFEVRDGVYRIFSPGLFWGQRQVGVGYGFRGVLHTMWHVTRGAALSINDAVAGPYWADV
REDVVCYGGTWSLEEKWRGETVQVHAFPPGKAHEVHQCQPGELILDTGRKxGAIPIDLVKGTSGSPIL
NAQGAVVGLYGNGLKTNGTYVSSIAQGEAEKSRPNLPQAVxGTGWTSKGQITVLDMHxxxxxxxRVLP
ELIRQCTDRRLRTLVLAxxxVVLKEMERALSGKRVRFHSPAVSDQQxGGSIVDVMCHATYVSRRLLPQ
GRQNWEVATIDEAHWTDPHSxAARGHLYTLAQENKCALVLMTATRPGKSEPFPESNGAITSEERQIPE
GEWRDGFDWITEYEGRTAWFVPSIAKGGAIARALRQKGKSVICLNSKTFEKDYTRVRDEKPDFVxxxx
xxxxxxxxxxxxxxxxxTNIKPEEVDGKVELIGTRRVTTASAAQRRGRVGRQDGRIDEYIYSGQCDEY
DGGLVQWKEAQILLDNITTLRGPVATFYGPEQDKMPEVAGHYRLTEEKRKHFxxxxxxxxxxxxLAWH
VAANVSSVTDRSWTWEGPEENAVDEASGDLVTFKSPNGAERTLRPVWKDARMFKEGRDIKEFVAYASG
RRSFGDVLTGMSGVPELLRHCVSALDVFYTLMHEEPGSRAMKMAERDAPEAFLTMAEVMVLGLATLG
VIWCFVVRASISRMMLGTLVLLASLLLLWAGGVGYGNMAGVALIxYTLLTVLQPEVGKQRSSDDNKLA
YFLLTLCSVAGLVAANEMGFLERTKADLSTALWSxxxEPRPWSEWTNVDIQPARSWGTxVLVVSLFTP
YMIHQLQTKIQQLVNSAVASGAQAMRDLGGGTPFFGVAGHVMTLGVVSLIGATPTSLMVGVGLAALHL
AIVVSGLExxxxxxxxxxFFSAMVRNPMLDGDVINPFGEGETKPALYERKMSLVLAIALCLMSVVMNR
TVASITEASAVGLAAVGQLLRPEVDTLWTMPVACGMSSVVTGSLWGFLPLGHRLWLRASGGRRGGAEG
DTLGDLWKRRLNNCTREEFFVYRRTGILETERDKARELLRKGETNTGLAVSRGTAKxxxxxxxxxxxx
xxxxxxxxxxxxGWSYYAASRPAVMSVRAYTIGGRGHEAPRMVTSLGWNLIKFRSGVDVFSMQPHRAD
TVMCDIGESSPDAAVEGERTRRVILLMEQWKNRNPTAACVFKVLAPYRPEVIEALHRFQLRWGGGLVR
TPFSRNSTHKVYYSTAVTGNIVNSVNVQSRKLLARFGDQRGPTRVPELDLGIGTRCVVLAEDKVKEQD
VQERIxALREQYSETWHxDEEHPYRTWQYWxxxxTAPTGSAASLTNGVVKLLSWPxxxxEDVVRMAMT
DPTAFGQQRVFKDNADTKAQEPQPGTRVIMRAVNDWILERLAQKSKPRMCSKEEFIAKVKSNAALGAW
SDEQNRWASAREAVEDPAFWHLVDEERERHLMGRCAHCVHNIMGKREKKLGEFGVSKGSRAMWYMWLG

FIG. 60-21

SRFQEFEALGFLNEDHWASRESSGAGVEGISLNYLGWHLKKLSTLNGGLFYADDTAxxxxxxxTNADLE
DEEQILRYMEGEHKQLATTVMQKAYHAKVVKVARPSRDGGCVMDVITRRDQRGSVQVVTYALNTHTNI
KVQLIRMMEGEGVIEAADAHNPRLLRVERWLKEYGGERLGRMLVSGDDCVVRPLDDRFSRALYFLNDM
AKTRKDVGEWEHSVGFSSVEAVPFCSHHFHELVMKDGRSLVVPCRDQDELVGRARISPGCGWSIRETA
CLSKAYxxxxxxxxxFHRRDLRTLGLAINSAVPIDWVPTGRTTWSIHASGAWMTTENMLDVWNRVWILD
NPFMQNKEKxxEWRDVPYLPKAQDMLCSSLVGRRERAEWARNIWGAVEKVRRMIGxxKFRDYPSCMDR
HDLHWELRLESSII >TBEV|peptide_length:11|string3

MARKAILKGKGGGPPRRVSKETATKTRQPRVQMPNGLVLMRMLGILWHAIAGTARSPVLKSFWKSVPL
KQAMTALRKIKRAVSTLMIGLQRRGKKRSTxxxxxxxxxxxxxxxxAFAATVRKEGDDTTVIRAEGRDA
xxxxRVENGTCVILATDMGAWCDDSLSYECxxxxxxxxxxxxxDCFCRNVDRVYLEYGRCGKxxxxxxx
xSVLIRSHAQGELTGRGRKWLExxxxxxxxxxxxxxxxxxxxxxxxxxxVWLTLESVVARxxxVVAL
LCLAPVYASxxxxxxxxxxxxxxxxxxxxxxxxxxxxxxxxxxxxxxxxxDVWLDAIYQEKPAQTREYC
LHAKLxxxxxxxRCPTTGPATLAEQHQSGTVCKRDxxxxxxxxxxxxxGKGSIVTCVKVACEAKKKAT
GHVYDANKIVYTIKVEPHTGDYVAVNETHSGRKTPSFTVSSEKTILNMGDYGDVSLLCKVxxxxxxxQ
TVILELDKTLEHLPTAWQVHxxxxxDLALPWRHEGAQHWNNAERLVEFxxxxxxxxxxxxxxxxxxxx
xxxxAGVPVAHIDGAKYHLKSGHxxxxxxxxKLKMNGLTYTVCDKTKFAWKRAPTDSGHDTVVMEVSF
SGTKPCRIPxxxxxxxxxxxxxxxxxxxxxxxxxxxxxxxxxxxxxxxxxxxxxxxxxxxxxxxSIG
RVFQKTRRGIERLTVIGxHAWDFGSTGGFLASIGKALHTVLGGxFNSLFGGVGFLPKILMGMALAWLG
LNMRxxTMSMSFLLAGVLVLAxxxxxxxxxxxxxxxxxxxxxxxxxxxxxxxxxxxxxxxxxxxxxPG
ALASAIKETFEEGNCGILPQNRLEMAMWRSASTELNLALAEGDANLTVMVDKLDPTDYRGGIPGLLKK
GKDIKVSWKSWGQAVIWSIPEAPRRFMVGTEGQSECPLERRKTGIFTVxxxxxxxxxTKVFVDFRQEAT
HECDTGVMGxxxxxxxAIHTDQSLWMKSVRNETGTYIVELxxxxxxxxxxWPASHTIDNADVVDSESFL
PAxxxxxxxxxxxxYAEQVKGPWKYTPIRVTREECPGTKVxISADCDRRGASVRSxxxxxxxxxxxxx
xCRTCTLPPVTIRTGTDxxxxxxxxxVHDQGGLVRSTVVADNGExxxxxxxxxxxxxxxxxxxYVIRRR
PATGTAVVWGGFVVLALLVTGLVRVESLVRYVVAVGIAFHFELGPEIVALTxxxxxxxxxxGLLSAFA
LRRGLTVREMVITYFLLLVLELGLPYxxxxxLWRWGDALAMGALIFRACTAEGKAGVGLLLMALITQQ
DxxxxxxxxxxxxxxxxxxxxxxxxxWRLLKGHREQKGLSWIVPLAGLMGGEGSGIRLLAFWELAxHGKRRSF
SEPLTVxxxxxTLASGMMRHTPQEAxxxxxxxxxxxxxxxxxxxxxxxxxxxxxxSGCVEWYPELVNEGGE
VxxxxxxxxxxxxxxxxxxKEERMMAFWLLAGLAASAIHWSGIIGVMGLWTLSEMMRxARRSDLAFSG
QGRRERGDRPFEVRDGVYRIFSPGLFWGQNQVGVGYGFRGVLHTMWHVTRGAALSVDDAVVGPYWSEV
KEDVVCYGGAWSLEEKWRGExxxxxxxxxxxxxxxxxQPGELLLDTGGRxGAILIDLSKGTSGSPIL
NAQGAVVGLYGNxxxxxxxxxVSSIAQGEVEKSRPSLPPAVxGMGWTAKGQITVxxxxxxxxxxxxxxx
xxxxxxxxxxxxxxxxxxxxxxxVVLKEMERALTGKRVRFHSPVVGDQQxGGAIVDLMCHTTYVNRRLLPQ
xxxxxxxxxxxxxxxxxxxxxxxxxxxxxxxxxxxxxxxxxxxxxxEPFPESNGAITSEEKQIPN
GEWRDGFDWIxxxxGRSAWFVPSIAKGGVIARTLRQKGKxxxxxxxxxxxxxxxxxxxxxxxxxxxx
xxxxxxxxxxxxxxxxxxxxxxxxPEEVDGRVELIGTRRVTxxxAAQRRGRVGRHEGRIDEYIYSGQCDDD
DSVLVQWKEGQILLDDIITLRGPVVTFYGPEQDRMPEVAGHFRLxxxxxxxxxxxxxxxxxxxxxxxxH
VAANVSSVTSRNWTWEGPEANAVDEANGGLVTFRSPNGAERTLKPVWRDARMFREGRDIREFIAYASG
RRSIGDVLTGMSGVxxxxxxxxxxxxALDVFYTLMHEKPGSSAMRMAERDAPEAFLTLVEMMVLGLATLG
VVWCFVARTSISRMMLGTLVLLASLALLWAGGVGYGxxxxxxxxxxxxxxxxxxxxxxxxxxxxxxxx
xxxxxxxxxxxVAANEMGFLEKTKADLSAVLWSxxxEPRSWGEWTNIDIQPAxxxxxxxxxxxxxxxx
xxxxxxxxxIQQLVNSAVVTGAQAMRDLGGGAPFIGVAGHVVSLGVVSLVGATxxSLMVGVGLAAFHL
xxxxxxxxxxxxxxxxxxxxxxxxxxxxxxDVIYPFGEGEAKPALYERKMSLVLAVVLCLIAVVMNR
TVPSITEASAVGLAAAGQLLSPEEDTLWTMPVACGLSGVVTGSLWGFLxxxxxxxLRASGSRRGGSDG
DTLGDLWKQRLNSCTKEEFFVYRRAGIMETERDKARELLKKGETNVGLAVSRGTAKxxxxxxxxxxxx
xxxxxxxxxxxxxxxxxxxYYAASRPSVMSVRAYTIGGKGHETPRMVTSLGWNLIKFRAGVDVFSMQPHxxD
TIMCDIGESNPDAAVEGEKTRRVILLMEQWKIRNPAAACVFKVLAPYRPKVIEALHRFQLKWGGGLVR

FIG. 60-22

```
TPFxxxSTHEMYYSTAITGNIVNSVNIQSRKLLARFAGQRGPTKVPELDLGVGTRCVVLAEDRVREKD
VQERIxALKEQYGETWHxDGEHPYRTWQYWxxxxxxxxxxxxxxxxxxxxxxxxxxxxxxxxxxxx
xxTPAWQQRVFKKNADTKAQEPQxxxKVIMRAVNDWILERLARKNNSRIHSKEEFIAKVKSSAALGAW
SNEQNRWSNAKEAVEDPVFWRLVDEERERDLAGRCAHGVFNIMGKREKKLxxxxxxxxxxxxxxxxx
xxxxxxxxxxxLNEDHWASRGFSGSGVEGISLNYLGWHLKGLSIPEGGLFYADDTxxxxxxxxxxxx
xxxQILRYMEGEHRQLAATVMQKAYHAKxxxVARPSREGGCVMDVITRxxxxxxxxxxxxxxxxxxx
xxxxxxMMEGEGVIEATDAHNPRLLRVERWLRNHGGERLGRMLVSGDDCVVRPIDDRFSGALYFLNDM
AKxRKDIGEWEHSAGFSSWEAVPFCSHHFHELVMKDGRTLVVPCRDQDELVGRAPVSPGCGWSIRExx
xxxxxxxxxxxxxxHRRDLRTLGLTICSAVPADWVPTGRTTWSIHASGSWITTEDMLDVWNxVWILD
NPFMQNKERxxEWRDIPYLPKAHDMLCSSLVGRKERAEWARNIWGAVEKVRKIVGxxRCKDYLSCMDR
HYLHWNLKLESSIF >TBEV|peptide_length:11|string4 xxxxxxxxxxxxxPPRRVSKETARKTRQSRVQMPSGLVLMRMMGFLWHAVAGTVRSPVLKSFWNPVPL
KQATAALRKIKKAVSALMVGLQKRGKRRSVxxxxxxxxxxxxxxxxxTFAATVRKERDGTTVIRAEGRDx
xxxxxxxxxTCVIMATDMGSWCDDxxxxxxxxxxxxxxxxxxxxxxxxxxxxxxxxxxxxxxxxxx
xxxxxxxxxxxxxxxxxxxxxxxxxxxxxxxxxxxxxxxxxxxxVWMTVESVVTRxxxVAVL
LCLAPVYAxxxxxxxxxxxxxxxxxxxxxxxxxxxxxxxxxxxxDVWLDAIYQENPAQTREYC
LHxxxxxxxxxxxxxxxGPATLTEEHQGGTVCKxxxxxxxxxxxxxxxxxKGSIVTCVKVSCEAKKKAT
GxVYDANKIVYTIKVEPHxxxxxxANETHSGRKTPxxxxxxxxxxxxxxxxxxxxxxxxxxxxxxx
xxxxxxxxLEHLPTAWQVRxxxxxxLALPWKHEGVRNWNNAERLVExxxxxxxxxxxxxxxxxxxxx
xxxxxxxxxxxxxxxxxxxxxxxxxxxxxxxxxxTMCDKTKFTWRRTPTDSGHDTxxxxxxx
xxxxxxxxxxxxxxxxxxxxxxxxxxxxxxxxxxxxxxxxxxxxxxxxxxxxxxxxxxxxxxxx
xxxxxxxxxxxxxxxWDFGSTGGLLSSIGKALHTVLxxxxxxxxGGVGFIPKLLLGAALAWLG
LNMRxxxxxxxxxxxxxxxxxxxxxxxxxxxxxxxxxxxxxxxxxxxxxxxxxxxxxxxxxxxx
xxxSAIRETFEEGTCGILPQNRLEMAMWRSAATELNLALAExEANLTVMVDKFDPTDYRGGVSGLLKK
GKDIKVSWRSWGHSMIWSIPEASRRFMVGTEGSxxxxxxxxxxxxxxxxxxxxxxxxxTKVFLDFRQEAT
HECxxxxxxxxxxxxxxxxxxxTDQSLWMKSVRNETGTYIVExxxxxxxxxxxxxxxxxIDNPEVVDSELFL
PxxxxxxxxxxxxxxxxxSEQVKGPWKYLPIRVIREECPGTRVxITADCDKRGASVxxxxxxxxxxxx
xxxxxxxxxxxxxxxxxxxxxxxxxxxxxxxxxxxxxxxxxxxxxxxxxxxxxxxxxxxxIIRRR
PSTGSTVVWGGIIVLALLVTGMVKVESLVRYVVAxxxxxxxxxxxxxxxxxxxxxxxxxxGLLSAFA
LRRSLTVREMVITYxxxxxxxxxxxxxxxxxxxxxxxxxxxxILRACTAEGKTGVGLLLMALMTQQ
NxxxxxxxxxxxxxxxxxxxxWRLLEGHREQKGLSWTVPMAGLVGGEGSGIRLLSFWELSxSGRRRSF
SEPLxxxxxxxxxxxxxxxxxxxxxxxxxxxxxxxxxxxxxxxxxxxxxxxxxxxxxxxxxxxx
xxxxxxxxxxxxxxxxxxxxxxxxxxxxVMAFWLLAGLSASAIHWSGIIGVMGLWTLSEMLKxARRSGLVFSG
QGNRERGDKPFEVRDGVYRIFSPGLFWGQRQVGVGYGFRGxxxxxxHVTRGAALSIDDAVAGPYWAEV
KEDVVCYGxxxxxxxxxxxxxxxxxxxxxxxxxxxxxxxxxxxxxxGAVLIDLAKGTSGSPTI
NSQGVVVGLYxxxxxxxxxxxxxxAQGEAERSRPNLPQAVxGSGWTAKGQITVxxxxxxxxxxxxx
xxxxxxxxxxxxxxxxxxxxxxxxNGKRVRFLSPAVSDQQxxxxxxxxxxxxxxxxxxxxxxxxx
xxxxxxxxxxxxxxxxxxxxxxxxxxxxxxxxxxxxxxxxxxxxxxxxxxxxESNRGITSEVRQIPN
GEWRDGxxxxxxxxxxxxxWFVPSIVKGGIIARALRQKGKxxxxxxxxxxxxxxxxxxxxxxxxx
xxxxxxxxxxxxxxxxxxxxxxxxxxxxxxxxxxxAPRRGRVGRQEGRIDEYIYSGQCDDD
DSGLVQWKEAQILLDNIITLRGPVATxxxxxxxxxxxxxxxxxxxxxxxxxxxxxxxxxxxxxxx
xAANVSGVTSRSWTWEGPEANAVDEASGGLVTFRSPNxxxxxxxxxxxxxxxxxxxxxxxxxxxxx
xxxxxxxxxxxxxxxxxxxxxxMDVFYTLMHEEPDSRAMRMAERDAPEAFLTVVEMLVLGLGTLG
VVWCFVVRASISxxxxxxxxxxSLVLLWAGGVSYGxxxEVRSWEEWTNIDxxxxxxxxxxxxxxxxx
xxxxxxxxxxxxxxxxxxxxxxLLEKTKADLSTVLWAxxxEVRSWEEWTNIDxxxxxxxxxxxxxxx
xxxxxxxxxxxxxxxxxxxxxxxxxxxxMRDLGGGAPFLGVAGHVMSLGVVSLVGAxxxxxxxxxxx
xxxxxxxxxxxxxxxxxxxxxxxxxxxxxxxxxxxxxxxxxxYERRMSLVLATVLCLMSVVMNR
```

FIG. 60-23

```
TMLSITEAAAVGLAALGQLLRPEEDTLWTMPVACGLSGVVTGSLWGxxxxxxxxxxxRASGSRRGGSDG
DTLxxxxxxxxLNSCTREEFFIYRRTGILETERDKARELLKRGETNVGLAVSxxxxxxxxxxxxxxxx
xxxxxxxxxxxxxxxxxAASRPAVMNVKAYTIGGRGHETPKMVTSxxxxxxxxxxxxxxxxxxxxxxD
TVMCDIGESNPDAVVEGEKTRKVIxxxEQWKNRNPAAACVFKxxxxxxxxxVIETLHRFQLQWGGxxxx
xxxxxxxxxxxxxxxxxxxxxxxxxxxxxxxxxxxxxxxxxxxxxxxxxxGVGTRCVVLAEDKVREKD
VQERIxxxxxxxxxxxxxDAEHPYRTWQYWxxxxxxxxxxxxxxxxxxxxxxxxxxxxxxxxxxxxxx
xxxxxxxxxxxxxxxxxxxxxxxxxxxxxxxxxNDWILERLAQRSRPRMCSKEEFIAKVKSNAALGAW
SEEQNRWSGAREAVEDPAFWKLVDEERERHLAGRSAHCAYNMMGKREKKxxxxxxxxxxxxxxxxxxx
xxxxxxxxxxxxxDHWASRESSGSGVEGISLNYLGWHLKRLSTPEGGLFYADDxxxxxxxxxxxxxxx
xxxQLLRYMEGEHKQLAATVMQKAxxxxxxxxxxxxxxxxxxxxxxxxxxxxxxxxxxxxxxxxxxxx
xxxxxxMMEGEGVVEATDAHNPRLLRVERWLREHGGERLGRMLVSGDDCVVRPVDDRFGRALYFLNDM
AxxxxDIGEWEHSAGLSSVEEVPFCSHHxxELVMKDGRALVVPCRDQDExxxxARVSPGCGWSIRxxx
xxxxxxxxxxxxxxxxxxxRDLRTLGFAICSAVPTDWVPTGRTTWxxHASGAWITTEDMLDVxxxxxILD
NPFMQNKGKxxEWRNVPYLPKAHDMLxxxxVGRTERAEWAKNIWGAVEKVRKMVGxxKCKDYPSCMDR
HDLHWELKLEGSII >TBEV|peptide_length:11|string5 xxxxxxxxxxxxxPPRRASKEAAKKTRQSRVQxxxxxxxxxxxxxxxxxxxxxxxxxxxLKSFWKSVPL
KQATAALRKIKMAVSALMVGLQRREKKRSTxxxxxxxxxxxxxxxTIAATVRREGDGTTVIRAxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxVVAL
LCLAPVYxxxxxxxxxxxxxxxxxxxxxxxxxxxxxxxxxxxxxxxxLDAIYQEKPAKTRxxx
xxxxxxxxxxxxxxxxxxxxxxxxxxxxxxxxxxxxxxxxxxxxxxxxxKGSIVTCVKVSCEAKKxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxHEGARNWNNAERLVxxxxxxxxxxxxxxxxxxxx
xxxxxxxxxxxxxxxxxxxxxxxxxxxxxxxxxxxxxxxxCDKTKFTWRRTPTDSGHxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxGGFLSSIGKALHTxxxxxxxxxxxGGVGFLPKILIGxxxxxxx
xxxxxxxxxxxxxxxxxxxxxxxxxxxxxxxxxxxxxxxxxxxxxxxxxxxxxxxxxxxxxxxxxxxx
xxxSAIKEAFEEGTCGIVPxxRLEMAMWRSSSTELNLALAExxxxxxxxxxxxFDPTDYRGGIPxxxxx
xxxIRVSWKSWGHSIIWSIPEAPRRFMVGIEGSxxxxxxxxxxxxxxxxxxxxxxxxxxxxxxxxxxx
xxxxxxxxxxxxxxxxxxxxxxxxQSLWMKSVRNETGTYIxxxxxxxxxxxxxxxxxxxxxxxxxxxxx
xxxxxxxxxxxxxxxxxxxxSEQVKGPWKYLxxRVVRGECPGTKVxISADCDRRGASVxxxxxxxxxxx
xxxxxxxxxxxxxxxxxxxxxxxxxxxxxxxxxxxxxxxxxxxxxxxxxxxxxxxxxxxxxxxxRRR
PATGTTAVWGGLIVFALLVTGLVRxxxxxxxxxxxxxxxxxxxxxxxxxxxxxxxxxxxxxxxxxxxx
xRRSLTVREMVTIYxxxxxxxxxxxxxxxxxxxxxxxxxxxxxxxxxxxxxxGKAGVGLLLMPLLTKR
GxxxxxxxxxxxxxxxxxxxWRLLEGHREQKGLSWIVPLAGLVGGEGSGIRxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxAGLAASALHWSGILGVMGLWTLTKMLRxxxRSDLAFSG
QGGGERGDKPFEVKxxxxxxxxxxxxxxxxQSQVGVGYGSKGxxxxxxxxxxGAALYIDDAVAGPYWSDV
REDxxxxxxxxxxxxxxxxxxxxxxxxxxxxxxxxxxxxxxxxxxxxxxxLAKGTSRSPII
NSQGVVVGLxxxxxxxxxxxxxxxxxxxxEAEKSRPSLPPAxxGIGWTAKGQITVxxxxxxxxxxxxx
xxxxxxxxxxxxxxxxxxxxxxxxxxxxxxxxxxxxxVRFHSPAVGDHQxxxxxxxxxxxxxxxxxxx
xxxxxxxxxxxxxxxxxxxxxxxxxxxxxxxxxxxxxxxxxxxxxxxxxxxxxxxxxxSEERQIPN
GEWRDxxxxxxxxxxxxxxxxxxxSIAKGGIIARALRxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxD
DGGLVQWKEAxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxMHDEPGSRAMKMAxRDAPEAFLTMAEMLVLGLATLx
```

FIG. 60-24

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxEMRSWEEWTNIDxxxxxxxxxxxxxxxxxxx
xxxxxxxxxxxxxxxxxxxxxxxxxxxDLGGGAPFFGIAGHVMALGVVxxxxxxxxxxxxxxxxxxxxxx
xxxxxxxxxxxxxxxxxxxxxxxxxxxxxxxxxxxxxxxxxxxxxxxxxxMSLVLAVALCLxSVVMNR
TVLSITEASAVGLAAAGQLLKPEADTLWTMPxxxxxxxxxxxxxxxxxxxxxxxxxxxxxxxxxxxx
xxxxxxxxxxLNSCTREEFFVYRRAGILETERDRARELLRRGETxxxxxxxxxxxxxxxxxxxxxxx
xxxxxxxxxxxxxxxxxxxxxxxxxxMSVKAYTIGGKGHETPRMVTSxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxRCVFLADDKVKEQD
VRERIxxxxxxxxxxxxxxNGEHPYRTWQYxxxxxxxxxxxxxxxxxxxxxxxxxxxxxxxxxxxx
xxxxxxxxxxxxxxxxxxxxxxxxxxxxxxxDWMLDRLAQKSRPRMCSREEFIxxxRSNAALGAW
SDxxxxxxxSAKEAVEDPAFWQLVDEERERHLTGRCAHCVxxxxxxxxxxxxxxxxxxxxxxxxxxx
xxxxxxxxxxxxxDHWASRGFSGSGVEGISLNYLGWYLKELSxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxRLFRVERWLRDYGEERLGRMLxxxxxCVVRGIDDRFSGALYFLNDM
AxxxxxIGEWEHSAGFAGWEEVPFCSHHxxxxxxxxxxxxxxxxxxxxxxxxxxxxxxxxxxxxx
xxxxxxxxxxxxxxxxxxRDLRTLGLAISSAVPxxxxxxxxxxxxxxxxxxxxxxxxxxxxxxxxxLD
NPFMHGKEKxxxxxxxIPYLPKAQDMLxxxxxxxxxxxxxxxxxWGAVEKVRKM

FIG. 61-1

>JEV|peptide_length:8|string1

MTKKPGGPGKNRAINML

FIG. 61-2

RGQDELIGRARISPGAGWNVKDTACLAKAYAQMWLLLYFHRRDLRLMANAICSAVPVDWVPTGRTSWS
IHSKGEWMTTEDMLQVWNRVWIEENEWMMDKTPITSWTDVPYVGKREDIWCGSLIGTRSRATWAENIY
AAINQVRAVIGKENYVDYMTSLRRYEDVLIQEDRVI

>JEV|peptide_length:8|string2

MTKKPGGPGRSRAIYMLKRGLPRVFPLVGVKRVVISLLDGRGPARFVLALTSFFKFTALAPTKALLGR
WRAVERSVAMKHLTSFKGELGTLIDAVNKRGKKRNKRGGNESxIMWLTSLAxxxxxxVGAMRLSNFQGK
LLMTVNNTDIADxxxxxxxxxxxxxVRAIDVGHLCEDTTITYECPKLAVGNDPQDVDCWCDNQQVYVQ
YGPCTRTRHSKRTRRSVSVHPHGESSLVNKKEAWLDSTKATRYLTKTENWIVRNPGYAFLAVALGWML
GSNSGHRLGFTILPLLVAPAYSFTCLGMGNRDFVQGVSGATWVDxxxxxxSCLTIMASDRPTLDVRMI
NIEAVQLAEVRSYCYRASVTDISTVARCPMTGEAHNEKGADSSYVCxxG

FIG. 61-3

Kxxxxxxxxxxxxxxxxxxxxxxxxxxxxxxx LEFEALGSLNEDHWLSRRNSGGGVEGSSVQKLGYISGDIASKEI
GKMYADDPAGWDTRITRADLENEAKxxxLLDGEHRKLARAIIELTYKHQVVKVMRPAAGGKTGMVVYS
RENQRGSGQVxxxxxxxxFTNIAVQFVRLMKVEGVIGPQHLEQLPRKTKIAVRTWLFENGEERVSRMAI
SGDDCAVKPLDDRFATSLYFLNAMSKVRKDILQWKPSHGWHDWLHVPFCSNHFHEIVMKDGRSLVDPC
RGQDELIDRARISPGAGCNVKDTACLAKAYAQMRVLLYFHRRYLCLMANAICSAVPVNWVPTGRTSWS
KHSKGEWMTTENMLQVWNKVWIEENEWMVDKTPVASWTDVPYxxxREDIWCGSLIGTRTKATWAENVY
AAINQVRAIIGKETYVDYMDFLRRYEDVLVQEDRVI >JEV|peptide_length:8|string3 xxKKPRGPGINRAIYMLKxxxxxxxFPLVGVKKVVMSLLDGIGPVRFVLAFVSFFKFTALSPTKALSGR
WKALEKSVAMKxxxSFKRELGILIDVVNKRGRKQNKRGGNGGxIMWLACLAxxxxxAGALKLSNFQGK
LLMAVNNTDIAxxxxxxxxxxxxxxxRAIDVGYLCEDTITxxxxxxxAGNDPEDVDCWCDHQEVYIQ
YGRCTRTSHSQRSKRSVSVQTNGESSLENKKKAWLNSTRATRYLMKTENWIVxxPGYAFLAGILGWML
GSTTGQRVVFTILPLLxxxxxxxxxxxxMGNRDFIERASGATWVxxxxxxxxxLTIMANDKPTLDRRMT
NIEASQLxEVRSYYYHASVTDxxxxxxxxTTGEAHNKKQADSSYVCxxxFTDRGWGNGCGLSGKGSID
xCAKFSCTNKATGKTIQPENSKYEVGIFxxxxxxxxxxxNYSAQIGVSQAARFTITPNAPSVTLELGD
YGEVTLDCEARSGLNTExxYVMTVGPKSLLVHRExxHDLALPWSSSSNTAWRxxELLMEFEQAHATKQ
SxVALGSREGALHQALAGAIVVEYPNSVKLTSGHLKCRLRMDKLxxxxTTYGMCTKKSSFRKNPADTG
xGTVVIELSYSGSDGSCKIPIVSVANLNDMTPAGRLVxxxPFVAASSANSKALVEMEPPxxDSYIVVG
RKxKQINHHWYKPGSTLGKxxxxxxxxxxxxxxxxxxxxDFGSIGGAFNSIGKAxxxxxxxxxxxxx
xxxxxxxxxxxVLLLWMGVNARNRSIALAFxxxxxxxxxxxxxxxxxxxDTGCAIDTARNQMRCGSGxxxx
xxxxxxxxxxxxYLPETPKSLAKIVHKAHMEGVCGIRSVTxxxxxxxxxxxxxxxxxxxxxxxxxxx
xxxxxxxRSTPKRLSMTREKFEMGWKAWGKSILFAPELANSSFVVxxxxTKECPVEQRAWNSMQxxxx
xxxxxxxxxWLKIREESTDECDGTIIGTAVKGHVTVHSDVSYWIESRFNDTRKLERAVFEEVKSCTWx
xTHSLWGDDAEESELIIPHTLAGPKSKHNQREGYMTQNQGPWDESGIVLDFDYCPGTTxxxTEDCSKR
APWVRTTTDIGxxxxDWCCRNCTLPPLRFRTDNGCWYGMEIRPAMHDEATLVRSRVDAxKGEMVDPFQ
MGLLVMFLATQEVFRKRWTARxTVPAVLGALLVLMFGGITYTDxxxYVVLVAASFAEANSGxxxxxxx
xxxxxxIQPAFLVANMLSAKWTNQENMVLVLGAALFQLASMDLQIGVHGILNAAAMAWMIVKAITFPT
ASSVTMPVLALLTPGMRALDLDTYRIILLIIGVCSLLHERKRTMAKKKGxxxxxxxxxxxxxxxxxTI
AAGLMACNxxxxxxxxATEVLSAVGLMxxxxxxxxxxxxxxxxxxxxxxxxxxxxxxxxxATDMWLE
QAADISWDMGAAITGSSxxxxxxxDDDGDFHFIDVPGVPWKIWVLRTSCIGLVALTPWxxxxxxxxx
xxxxxxxxxxxxxTPSPKPCAKGDTTTGxxRIMACGIFGTYQAGVGVIYQNVLHTLWHTTRGAAVMS
GKGKLTPYWxSVREDRIAYGxxxxxxxxxxxxxxxxxxIVVEPGKGAANFQTKPGVFCTPFGKVGTVSL
DYxxxxSGSPILDFNGDIVGLLGNGVELGDRSYxxxxxxGDRQEEPVPEAYTPNMLRKKQMTVLDLPP
GLGKTRKILPQTIRDAIQQHLRTAVLAxxxxxxAEMAEVLRGLPVRxxxxxxQREHQGNAIVxxxxxx
xxxxxxxxxxxxxxxxxxxxxxxxxxxxxxxxxxxxxxxxxxxxxxxxxxxxxxxxxxxxxxxxxxx
IHDLQDEVPDRAWSSxxxxxxxWSTEYSGKTVWxxxxxKMGNEIAVxxxxxGKRVIQLNRKxxxxxxx
xxxxxxxxxxxxxxxxxxxxxxxxxxxxxCRKSVKPIILEKGEGRVFLGxxxxxxxxxxxxxxGRVGR
NPNQVGDEYHYGGATSEDDGNLAHWxxxxxxxxxxxxxxxxxxxxxxxGPEREKAFTMDVEYRxxxxxxx
xxxxxxxxxxxxWLAYRVASNGIQxxxxxxxxxxxxxxNAILEDSTEVEIVTxxxxxxVLKPRWLDxx
xxxxxxxxxxxASGKRSAVSFIEVPGRMPEHFxxxxxxxxxxxxxLVATAEKSGKAHRMAxxxxxx
ALETVTLIVAIAVMTRGFFLLMKQRKGIEKMGLGALxxxxxxxxxxxxxxxxxxxxxxxxxxxxxxx
xIPEPEKQKLQTDNQLAxxxxxxVLTVVGMVAANEYGxLEKTKADLKSMFAGKAQALGMTGLPSVALDL
RPAxxxxxxxxxxxxxxxxxxxxxTPSLASISSxxxxxxxxxxxxxxxxxxxxxxxxxxxxxLLGCWG
QITLTTSLTAVVLTTLHYGFMLxxxxxxxxxxxxxxxxxxxxxxxxxxxxxxxxxxxxxxxxxxxxx
xxxxxxIGGSVAAFLVNPKISTVKKPGVLVTAATLSLWDNxxxxxxxxxxxxxxxxxxxxxxxxxxxx
xxTLIKNANKPSLKKGGPGGRTLWEQWKEKLNAMGREEFFKYRREGIIxxxxTEARRARSENNKVGGH
PVSxxxxxxxxxxxxxxVPPIGKVVDLGCGCGGWSYYAATLKRVQEFRGYTKGGxxxxxxMPMQSYGW
NLVSMKSGVDVFYRPSExxxxxxxxxxxxxxxxxxxxxxxxxxxxxxxxxxxxxxxxxxxxxxxxMP

FIG. 61-4

```
KVIEKIEVLQRRFxxxxxxxxxxxxxxxxxxxxxxxxxxxxxxxxxLLGRMDRAVWRGPKYKED
VNLxxxxxxxGKGEVHSDQGKIRRRIQKLREGFGTTWHKDHEHPYRTWxxxGSYEVRATGSASSxxxx
xxxxxSKPWDAISYVTTMxxxxxxxxxxxxFKEKVGTKAPEPPVGVREVLNETxxxLWAHLSRKKRP
xxCTKEEFIKKVNSSASLGTVFAExxxxSTAREAVNDPRFWEMVDVERENHLRGECHTCVYHMMGKRx
xxxxxxxxxxxxxxxxxxxxxxxxxxxxxEALGFLNLNHWLSRENSGGGEEGLGVQKLGYIFRDITRRAI
GKMYADxxxxWDTRITKTDLENEAxxxxxxxxxxxxxxxxxxIELTYRHQVVKVMRPSTEGKTVMAVIS
RENQRGxxxxxxxxxxxxxxxAVQLVRLVEAEGVIGPQHLEQLPKENKIAVRTxxxENGGERVTRMAx
xxxxxxxxxxxDRFATALYFLNAMSKVTKDIQQWKPSHGWLDWQQVPFxxxxxxxxxxKDGRSILVPC
RGQDxxxxxxxxxPGAGWNVRDTACLPKAYAQMWVLLYFHRRDQRLMANAICSTVPLDWVPTGRxxxx
IHSKGEWIPTEDMLQVxxxxxIEENEWMEDMTPIASWTDVPxxxxxxxxxxxGSLIGTRSRATWAENVx
xxINQVRAILGKEDYVDYMLSPQRIEDVSIQEDRVI >JEV|peptide_length:8|string4 xxxKPGGPGKSRAINMLxxxxxxxxxxxVRVKRVVMSxxxxxxxPLRFVLALVSFFKFTxxxxxxxLLGR
WRALEKSVAxxxxxxxxxELGTLIDGVNKRGRKxNKRGGNERxIMWLASVAxxxxxVGAIKLSNFQGx
xxxxxxxxxxxxxxxxxxxxxxxxxxxxxxxxxxxxxxxxxTGNDPEDVxxxCDNQEVYIQ
YxxxxxTRHSKTSRRSVSVQPxxxRSLVNKKEAWLDSTKATRYLVKTENWIVxxxxxxxxxxTLGWML
GSTNGPRVVFTILxxxxxxxxxxxxGNRDFIERASGATWxxxxxxxxxxxxxxxNDKPTLDRxxx
xxxxxxxxxxxxxxxxxxxxxxxxxxxxGEAHNEKGADSSYxxxxxxxxxxGWGKGCGLFGKxxxx
xxxxFSCTSKAIERAIQSENIKYEVxxxxxxxxxxxxxxxNYTAQVGASQAARFTVTPNAPSVTLELGD
YGxxxxxxxxxxxxxxxxxMTVGSKSLLVHRxxxxDLALPWTSSSNTAWxxxxxxxxxxxxxxxx
xxxALGSQERSLHQALAGxxxVEYSNSVKLTSxxxxxxxxxxxxxxxxxTTYGVCTENSSFRKNxxxxx
xxxxxIELLYSGSDGPxxxxxxSVVSLNDMTPAxxxxxxxxxxxATSSSNSQVLVEMEPxxxxSYIVVG
MGxKQISHHRHKPGSTLGxxxxxxxxxxxxxxxxxxxxxxxDFGSIGGIFNSIGKAxxxxxxxxxxxxx
xxxxxxxxxxxxxxxxxxxxxxxxxxxxxxxxxxxxxxxxxxDTGCAIDVTRNQMRCGxxxxxx
xxxxxxxxxxxxxxxxxxxxxxxKIVHKAHKEGVCGIRxxxxxxxxxxxxxxxxxxxxxxxxxxx
xxxxxxxxxxxxxxxxxxxxxxxxxxSLLFAPELAxxxxxxxxxxTKECPDVRRAWNSTQxxxx
xxxxxxxxxxxxxxxxxTTDECDGAxxxTAVKGHVTVHSDLSYWIGSRYNDTWKRERLVFGEVKSxxxx
xxHTLWGDGVEESDLVIPDTIAGPKSxHNRREGYMTQNQGPWDENGLVPGLDxxxxxxxxxxxxxCGKR
GPSLRTTTDSGxxxxxxxxxxSCTLPPLRFRTGSGCxYGMEVRPVGHDETTLVRSQADAxSGGMVDPFQ
LxxxxxxxxxxxxxxxxxxxxxxxxxxxxxxxxxxxxxxxxxxxxxxxxAVFAEANSGxxxxxxx
xxxxxxxQPAFLAMNTLSTRWTNQENVILVLGAAFFQLASMDxxxxxxxxxxxxxxxxxxxxxxTFPT
TSTVTMPLLTLLTPGMKALYLDTYxxxxxVIGICSLQQERRRTMAKKKxxxxxxxxxxxxxxxxxxx
xxxxxxxxxxxxxxxxxxxxxxxxxxxxxxxxxxxxxxxxxxxxxxxxxxxxxxxxxxxxxxxWLE
RAADVSWEMGAAITGxxxxxxxxxxxxxxxxxxxxxxxxxWKVWVLRMSCSGLAALTPxxxxxxxxxxx
xxxxxxxxxxxxxxxxxxxxxxxxxxxxxxxxxxxxxxxxGVGVMYESVFHTLWxPTRGAAIMS
GKGKLTxxxxxxxxxxxxxxxxxxxxxxxxxxxIVVEQGKPATSIQTKPGVFRTPFGKVGAVSL
DxxxxxxxxxxxxxxxxxxxxxxxxxxxxxxxxxxxxxxxxIPEAYTPTMLKKKQMTVLxxHP
GLGKTRxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxLQDETPDRAWSSxxxxxxxWITEYSGKTxxxxxxxxxxxxxxxxxxxxxxxxxxxxxxxxx
xxxxxxxxxxxxxxxxxxxxxxxxxxxxxxxxxxxVKPIILEEGxxxxxxxxxxxxxxxxxxxxx
xxxxxxxxxxxGPTSEDDSNxxxxxxxxxxxxxxxxxxxxxxxxxxEKALTMDGEYRxxxxxxx
xxxxxxxxxxxxxxxxxxxxxxxxxxxxxxxxxxxxxxxxxxxxxxxxxxxxxxxxxxxxxxxx
xxxxxxxxxxxxxxAAGKRSAISFIEVRGxxxxxxxxxxxxxxxxxxxxxTAEKSGKAHRMxxxxxxx
xLETITLTVAITVMTRGFFxxxMQRKGIEKxxxxxxxxxxxxxxxxxxxxxxxxxxxxxxxxxx
xxPEPEKQRSQTGNQLxxxxxxxxxxxxxxxxxxxxxxxADLKSMFVGKTPVSGLTGLPGMALDL
RPxxxxxxxxxxxxxxxxxxxxxxxxxxxxxxxxxxxxxxxxxxxxxxxxxxxxxxxxxxxxxG
QITLTTVLTAMVLAILHYGYMxxxxxxxxxxxxxxxxxxxxxxxxxxxxxxxxxxxxxxxxxxx
```

FIG. 61-5

```
xxxxxxxxxxxxxFLVNPNVSTVRKAGxxxxxxxxxxxxxxxxxxxxxxxxxxxxxxxxxxxxx
xxxxxKNADNPSFKRGGPGGRTLGEQWKERLNAMSREEFFQYxxxxxxxxxxxxxRARRENNKVGGx
xxxxxxxxxxxxxxxxxxxxxxxxxxxxxxxxGRGGWSYCAxxLKKVQEFRGYxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxGKGEVHSTQDKIRKRIQKLREEFATTWHRDPxxxxxxxxxxxxxxxxxxxxxxxx
xxxxxxxxxxxxxxxxxxxxxxxxxxxxxxxxxxxxxxTKAPEPPPGVxxxxxxxxxxxxxxxxxx
xxxxxxxFIKKVNSNASLGTVFxxxxxxSTAREAVSDSLLWEIVDEERENxxxxECHTRIYNMMGKxx
xxxxxxxxxxxxxxxxxxxxxxxxxxxxxxxxxALGFLNEDHWLSRENSGGGVEGLGVQKLGYIIRDIAVKQG
GKMYxxxxxxxxxxxxxxxxxxxxxxxxxxxxxxxxxxxxxxxxxxxxxFKVMRPASKGKTGMAVxx
xxxxxxxxxxxxxxxxxxxxxxxxxxxxxxxxxxxxxQHVEQLPRENKIAVRxxxxxxxxxxxxxxx
xxxxxxxxxxxxxxxxxxxxxxxxxxxxxxxSKVRRDIQEWKPxxxxxxxxxxxxxxxxxxxxxxx
xxxxxxxxxxxxxxPGAGWNVMDTACLAKxxxxxxxxxxYFHRRDQRLMANAICSAVPLDWVPxxxxxxxx
xxxxxxxxxxxxxxxxxxxxxxxxxxxIEENEWMTDKTPIASWTxxxxxxxxxxxxxGSLIGTRARATWAENxx
xxxxxxxRAIIGKENYVDYMDFxRRYEDVLTQEDRVI >JEV|peptide_length:8|string5 xxxxxxxxxxxxxxxxxxxxxxxxxxxxxxxxxxxxxxxxVRFVLAFIxxxxxxxxxxxxxxxxx
xxxxxxxxxxxxxxxxxxxxxELGTLIDTVNKRGRKxxxxxxxxxxxTLWFMSLTxxxxxAGAIKLSNxxxx
xxxxxxxxxxxxxxxxxxxxxxxxxxxxxxxxxxxxxxxxxxxxxxxPGNDPQDVxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxNRDFIQGASGATxxxxxxxxxxxxxxxxxxxxxx
xxxxxxxxxxxxxxxxxxxxxxxxxxxxxxxxxxxxxxxxxxxxxxWRNGCGLFGxxxxx
xxxxxSCTSKAIGRMIQSENIKxxxxxxxxxxxxxxxxxxxxxVGASQAARxxxxxNAPSVTLKLGD
xxxxxxxxxxxxxxxxxxxxxxxxxxxxxxxxxxxxxxxLALPWTSSSxxxxxxxxxxxxxxxxxx
xxxxxxSQERALHQAxxxxxxxxxxxxxxxxxxxxxxxxxxxxxxxTYGMCTENSSFxxxxxxxxx
xxxxxxxxSYSGRDGPxxxxxxxxxxxxxxxxxxxxxxxxxxxxTSSSNSQVLVExxxxxxxxSYIVIG
RGxxQINHHWHKPGSTLxxxxxxxxxxxxxxxxxxxxxxxxxxxRVFNSIGKxxxxxxxxxxxxxxxx
xxxxxxxxxxxxxxxxxxxxxxxxxxxxxxxxxxxxxxxxxxxxxTGSAIDITRxxxxxxxxxxxxx
xxxxxxxxxxxxxxxxxxxxxxxxxxxHKAYMEGVCGVRxxxxxxxxxxxxxxxxxxxxxxxxxxx
xxxxxxxxxxxxxxxxxxxxxxxxxxxxxxxxxxxxxxxxxxxxxERRAWNSTxxxxx
xxxxxxxxxxxxxxxxNTDECDGTxxxxAIKGHVAVHxxxSYWIESHLNDSWKLERAVxxxxxxxxx
xxxxxxxxxxxxxxxxxxxxxxxxxxxxxxxxxGPWDEDGIVLDFDxxxxxxxxxxxxxCGKR
GPSLRxxxxxxxxxxxxxxxxxxxxxxxxxxxxxxxxxxxKHDETTLVRWQVDAxNGGMVDPFx
xxxxxxxxxxxxxxxxxxxxxxxxxxxxxxxxxxxxxxxxxxxxxxxxxxxxxxxxxxxxxxxxx
xxxxxxxxxxxLAMKMLSTRWTxxxxxxxxxxxxxxxxxxxxxxxxxxxxxxxxxxxxxxxxFPT
TSTITMPxxxxxTPGMRAFDxxxxxxxxxxxxxxCSLLQEREKTMAKKKxxxxxxxxxxxxxxxxxx
xxxxxxxxxxxxxxxxxxxxxxxxxxxxxxxxxxxxxxxxxxxxxxxxxxxxxxxxxxxxxxxxx
RAADISWGMDAAITGxxxxxxxxxxxxxxxxxxxxxxxxxxxVLRMSCSGLAAxxxxxxxxxxxxx
xxxxxxxxxxxxxxxxxxxxxxxxxxxxxxxxxxxxxxxxxxxxxxxGVMYESVFHTxxxxxxGAAIMS
GGGKLxxxxxxxxxxxxxxxxxxxxxxxxxxxxxxxxxIVVEPGKVAVNFQTKPGIFPTPLGEVGAVSx
xxxxxxxxxxxxxxxxxxxxxxxxxxxxxxxxxxxxxxxxxxxxxVPEAYNPSMLKKKQxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxATSFIEVLGxxxxxxxxxxxxxxxxxxxxxxxxxxxxxxx
```

FIG. 61-6

```
xLETITLIIAIxxxxxxxxxxxxxxxxxxxxxxxxxxxxxxxxxxxxxxxxxxxxxxxxxx
xxxxxEKQKSQTDxxxxxxxxxxxxxxxxxxxxxxxxxxxxxIKSMFGGKAPVxxxxxxxxxxxxxx
xxxxxxxxxxxxxxxxxxxxxxxxxxxxxxxxxxxxxxxxxxxxxxxxxxxxxxxxxxxxxx
xxxxxxxLTAVVLATLHYGFMxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxADNPSLKRGGPGGxxLGDQWKRKLNALSREEFFKxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxQKKIKKRIQKQKEEFATTxxxxxxxxxxxxxxxxxxxxxxxxxx
xxxxxxxxxxxxxxxxxxxxxxxxxxxxxxxxxTKAPEPPTGAxxxxxxxxxxxxxxxxxxxx
xxxxxxxFINKVNSDAALGAVFxxxxxxxxxAREAVGDPRFWEIVDEExxxxxxxxxxxxxxxxxx
xxxxxxxxxxxxxxxxxxxxxxxxxxxxxxxxxxxxxxxxxxxRGGVEGSSxxxxxxxxxxxxxxx
xxxxxxxxxxxxxxxxxxxxxxxxxxxxxxxxxxxxxxxxxxxxxxKVMRPAADGKTVMDVxx
xxxxxxxxxxxxxxxxxxxxxxxxxxxxxxxxxxxxHLEHLPRKNKIxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxENEWMMDMTPxxxxxxxxxxxxxxxxxxxNLIGTRSRxxxxxxxx
xxxxxxRAIIGKENYVDYMLSxRRYEDVLTQExx
```

FIG. 61-7

>JEV|peptide_length:9|string1

MTKKPGGPGKNRAINMLKRGLPRVFPLVGVKRVVMSLLDGRGPVRFVLALITFFKFTALAPTKALLGR
WKAVEKSVAMKHLTSFKRELGTLIDAVNKRGRKQNKRGGNEGxxxxxxxxxxxxxxAGAMKLSNFQGK
LLMTINNTDIADVIVIPTSKGENRCWVRAIDVGYMCEDTITYECPKLTMGNDPEDVDCWCDNQEVYVQ
YGRCTRTRHSKRSRRSVSVQTHGESSLVNKKEAWLDSTKATRYLMKTENWIIRNPGYAFLAAVLGWML
GSNNGQRVVFTILLLLVAPAYSFNCLGMGNRDFIEGASGATWVDLVLEGDSCLTIMANDKPTLDVRMI
NIEASQLAEVRSYCYHASVTDISTVARCPTTGEAHNEKRADSSYVCKQGFTDRGWGNGCGLFGKGSID
TCAKFSCTSKAIGRTIQPENIKYEVGIFVHGTTTSENHGNYSAQVGASQAAKFTVTPNAPSITLKLGD
YGEVTLDCEPRSGLNTEAFYVMTVGSKSFLVHREWFHDLALPWTSPSSTAWRNRELLMEFEEAHATKQ
SVVALGSQEGGLHQALAGAIVVEYSSSVKLTSGHLKCRLKMDKLALKGTTYGMCTEKFSFAKNPADTG
HGTVVIELSYSGSDGPCKIPIVSVASLNDMTPVGRLVTVNPFVATSSANSKVLVEMEPPFGDSYIVVG
RGxKQINHHWHKAGSTLGKAFSTTLKGAQRLAALGDTAWDFGSIGGVFNSIGKAVHQVFGGAFRTLFG
GMSWITQGLMGALLLWMGVNARDRSIALAFLATGGVLVFLATNVHADTGCAIDITRKEMRCGSGIFVH
NDVEAWVDRYKYLPETPRSLAKIVHKAHKEGVCGVRSVTRLEHQMWEAVRDELNVLLKENAVDLSVVV
NKPVGRYRSAPKRLSMTQEKFEMGWKAWGKSILFAPELANSTFVVDGPETKECPDEHRAWNSMQIEDF
GFGITSTRVWLKIREESTDECDGAIIGTAVKGHVAVHSDLSYWIESRYNDTWKLERAVFGEVKSCTWP
ETHTLWGDGVEESELIIPHTIAGPKSKHNRREGYKTQNQGPWDENGIVLDFDYCPGTKVTITEDCGKR
GPSVRTTTDSGKLITDWCCRSCSLPPLRFRTENGCWYGMEIRPVRHDETTLVRSQVDAxNGEMVDPFQ
LGLLVMFLATQEVLRKRWTARLTIPAVLGALLVLMLGGITYTDLARYVVLVAAAFAEANSGGDVLHLA
LIAVFKIQPAFLVMNMLSTRWTNQENVVLVLGAAFFQLASVDLQIGVHGILNAAAIAWMIVRAITFPT
TSSVTMPVLALLTPGMRALYLDTYRIILLVIGICSLLQERKKTMAKKKGAVLLGLALTSTGWFSPTTI
AAGLMVCNPNKKRGWPATEFLSAVGLMFAIVGGLAELDIESMSIPFMLAGLMAVSYVVSGKATDMWLE
RAADISWEMDAAITGSSRRLDVKLDDDGDFHLIDDPGVPWKVWVLRMSCIGLAALTPWAIVPAAFGYW
LTLKTTKRGGVFWDTPSPKPCSKGDTTTGVYRIMARGILGTYQAGVGVMYENVFHTLWHTTRGAAIMS
GEGKLTPYWGSVKEDRIAYGGPWRFDRKWNGTDDVQVIVVEPGKAAVNIQTKPGVFRTPFGEVGAVSL
DYPRGTSGSPILDSNGDIIGLYGNGVELGDGSYVSAIVQGDRQEEPVPEAYTPNMLRKRQMTVLDLHP
GSGKTRKILPQIIKDAIQQRLRTAVLAPTRVVAAEMAEALRGLPVRYQTSAVQREHQGNEIVDVMCHA
TLTHRLMSPNRVPNYNLFVMDEAHFTDPASIAARGYIATKVELGEAAAIFMTATPPGTTDPFPDSNAP
IHDLQDEIPDRAWSSGxxxxxxWITEYAGKTVWFVASVKMGNEIAMCLQRAGKKVIQLNRKSYDTEYP
KCKNGDWDFVITTDISEMGANFGASRVIDCRKSVKPTILEEGEGRVILGNPSPITSASAAQRRGRVGR
NPNQVGDEYHYGGATSEDDSNLAHWTEAKIMLDNIHMPNGLVAQLYGPEREKAFTMDGEYRLRGEEKK
NFLELLRTADLPVWLAYKVASNGIQYTDRKWCFDGPRTNAILEDNTEVEIVTRMGERKILKPRWLDAR
VYADHQALKWFKDFAAGKRSAVSFIEVLGRMPEHFMGKTREALDTMYLVATAEKGGKAHRMALEELPD
ALETITLIVAITVMTGGFFLLMMQRKGIGKMGLGALVLTLATFFLWAAEVPGTKIAGTLLIALLLMVV
LIPEPEKQRSQTDNQLAVFLICVLTVVGVVAANEYGMLEKTKADLKSMFGGKTQASGLTGLPSMALDL
RPATAWALYGGSTVVLTPLLKHLITSEYVTTSLASINSQAGSLFVLPRGVPFTDLDLTVGLVFLGCWG
QITLTTFLTAMVLATLHYGYMLPGWQAEALRAAQRRTAAGIMKNAVVDGMVATDVPELERTTPLMQKK
VGQVLLIGVSVAAFLVNPNVTTVREAGVLVTAATLTLWDNGASAVWNSTTATGLCHVMRGSYLAGGSI
AWTLIKNADKPSLKRGRPGGRTLGEQWKEKLNAMSREEFFKYRREAIIEVDRTEARRARRENNIVGGH
PVSRGSAKLRWLVEKGFVSPIGKVIDLGCGRGGWSYYAATLKKVQEVRGYTKGGAGHEEPMLQSYGW
NLVSLKSGVDVFYKPSEPSDTLFCDIGESSPSPEVEEQRTLRVLEMTSDWLHRGPREFCIKVLCPYMP
KVIEKMEVLQRRFGGGLVRLPLSRNSNHEMYWVSGAAGNVVHAVNMTSQVLLGRMDRTVWRGPKYEED
VNLGSGTRAVGKGEVHSNQEKIKKRIQKLKEEFATTWHKDPEHPYRTWTYHGSYEVKATGSASSLVNG
VVKLMSKPWDAIANVTTMAMTDTTPFGQQRVFKEKVDTKAPEPPAGAKEVLNETTNWLWAHLSREKRP
RLCTKEEFIKKVNSNAALGAVFAEQNQWSTAREAVDDPxFWEMVDEERENHLRGECHTCIYNMMGKRE
KKPGEFGKAKGSRAIWFMWLGARYLEFEALGFLNEDHWLSRENSGGGVEGSGVQKLGYILRDIAGKQG
GKMYADDTAGWDTRITRTDLENEAKVLELLDGEHRMLARAIIELTYRHKVVKVMRPAAEGKTVMDVIS
REDQRGSGQVVTYALNTFTNIAVQLVRLMEAEGVIGPQHLEQLPRKNKIAVRTWLFENGEERVTRMAI
SGDDCVVKPLDDRFATALHFLNAMSKVRKDIQEWKPSHGWHDWQQVPFCSNHFQEIVMKDGRSIVVPC

FIG. 61-8

RGQDELIGRARISPGAGWNVKDTACLAKAYAQMWLLLYFHRRDLRLMANAICSAVPVDWVPTGRTSWS
IHSKGEWMTTEDMLQVWNRVWIEENEWMMDKTPITSWTDVPYVGKREDIWCGSLIGTRSRATWAENIY
AAINQVRAVIGKENYVDYMTSLRRYEDVLIQEDRVI

>JEV|peptide_length:9|string2

MTKKPGGPGRNRAIYMLKRGLPRVFPLVGVKKVVISLLDGRGPARFVLALTSFFKFTALAPTKALLGR
WRAVERSVAMKHLTSFKRELGTLIDAVNKRGKKQNKRGGNESxxxxxxxxxxxxxxVGAMRLSNFQGK
LLMTVNNTDIADVxxxxxxxxxxxxWVRAIDVGHLCEDTITYECPKLAVGNDPQDVDCWCDNQQVYVQ
YGPCTRTRHSKRTRRSVSVHPHGERSLVNKKKAWLDSTKATRYLMKTENWIVRNPGYAFLAVALGWML
GSNSGHRLVFTILPLLVAPAYSFTCLGMGNRDFVEGVSGATWVDLxxxxDSCLTIMASDKPTLDVRMI
NIEAVQLAEVRSYYYRASVTDISTVARCPMTGEAHNKKGADSSYVCKQGFTDRGWGNGCGFSGKGSID
TCAKFSCTRKAIGRMIQPENIKYKVGIFVHGATTSENHGNYSAQVGASQAAKFTVTPNAPSTALELGD
FGEVTLDCEPKSGLNTEAFYVMTVGSRSLLVHREWFHDLSLPWTPSSNTAWRNRELLMEFEGAHATKQ
SVVALGSQEGGLHHALAGAIVVEYSSSVMLTSGHVKCRLRMDKLALKGTTYGMCTGKFSFAKNPVDTG
HGTVVIELTYSGSDGSCKIPIVSVASLNDLTPAGRLVTVNPFVATSSSNSQVLLEIEPPFGDSYIVVG
RKxKQINHHWHRPGSTLGKAFLTTLKGAQRLVALGDTAWDFGSIGGVFNSIGRAVHQVFGDAFRTLFG
GxxWITQGLMGALLLWMGINARNRSIAMAFLVTGGTLLFLATNVHADTGCAIDITRRQMRCGSGIFxx
xxxxxxxxxYKYLPETPRALAKIVHKAHQEGICGIRSVTRLEHQMWESVRDELNVPLKENAVDLxxxx
xKPVGRYRSAPKRLFMTREKVEMGWKAWGKSILFAPEMANSSFVVDGPETKECPDERRAWNSTQIEDF
GFGxxxxxVWLKIREENTDECDGPIIGTAVKGNVAVHSDLSYWIESRLNDTRKLERAVFGEIKSCTWP
ETHTLWGDDVEESELIIPHTIAGPRSKHNRREGYRTQNQGPWDENGLVPDLDYCPGTKVTITEDCGKR
GPSIRTTTDIGKLITDWCCRSCSLPPLGFRTGSGCWYGMEIRPLRHDEATLVRSQVHAxNGEMIDPFQ
LGLLVVFLATQEVFGKRWTARLTIPAVLGVLLVLMLGGITYIDLARYVVLVAAAFAEANNGGDVLHLA
xxxxFKIQPAFLVMNMLSARWTNQENVALVLGAAFFQLASADLQIGVHGILNAAAMAWMIVRAITFPT
TSTVAMPILALLTPGMRALCLDTYRIILLVIGICSLLHERRKAMAKKKGAVLMGLALTSTGWFSPTTI
TAGLMACNPNKKRGWPATEFLSAIGLMFAIVGGLAEMDIESMSIPFMLAVLMAVSYVVxGKATDMWLD
RAADISWEMEAAITGSSRRLDVKLDEDGDFHLIDVPGVPWKVWLLRMSCICLVALTPWAIVxxxxxxx
xxxxxxxxxxxxDTPSPKPCLKGDTTTGVYRIMARGILGTYQSGVGVMYENVLHTLWHTTRGAAIVS
GKGKLTPYWGSVKEDRISYGGPWRFDRKWNGTNDVQVIVVEPGKPAVNIQTKPGVFRTPFGEIGTVSL
DYPRGTSGSPILNFNGDVVGCLGNGVELGDRSYVSAIVQGDRQEEPVPDAYTPSMLKKRQLTVLDLHP
GSGKTKKILPQIIKDAIQQHLKTAVLAPTRVVAAEMAEALKGLPVRYQTSAVQRSHQGNAIVDVMCHA
TLTHRLTSPNRVPNYxxxxxxEAHFTDPAGIAARGYIAxxxxxxxxxAAIFMTATSPGTTDPFPDSDAP
IHDLQDEVPDRAWSSGxxxxxxWITDYSGKTVWFVASVRMGNEIAMCLQRAGKKVIQLSRKSYDTEYx
xxxxxxxxxVITTDISEVGANFGASRVIDCRKSVKPIILEEGEGRVFLGNPSPITNASAAQRRGRVSR
NPSQVGDEYHYGGATSEGDGNLAHWTEAKILLDNIHMPNGLVVQLYGPEREKASTMDVEYRLRGEExx
xxxxxxxxxDLPVWLAYKVAPNGIQYTDRRWCFDGPRTNAILEDNIEVEIVTRTGERKILKPRWLYAR
VYADHQxLKWFKDFAAGKRSAISFIEERGRMPEHFAGKTREALDxMYLVATAERSGKTHRMALEELPD
ALETITLIAAITAMTGGFFLLMMQRKGIGRMGLGALVLVLATFFLWAAEVSGTKIAGTLLVALLLMVV
LIPEPGKQRSQTGNQLAVFLICVLTVVGVAAANEYGMLERTKADLKSMFGGRTQAPGLTGLPSVTLDL
RPATAWAWYGGSTVVLTPLLKHIITSEYVTTSLASISSQAGSLFVLPRGVPSTDLDLTVGLVFLGCWG
QVTLTTFLTAMVLVTLHYGFMLPGWQAQALRAAQRRxxxxxxxxxxxxxxxATDVPELEKTTPLMQKK
IGQVLLIGVSVAALLVNPNISTVKEAGVLVTARTLSLWDNGASAAWNSTTATGxxHVMRGSYLRGGSI
AWTLIKNADKPSLKKGRSGGRTLGEQWKEKLNAMSRDEFFKYRREGIIEVDRTEARRARRENNVVGGH
PVSRxxxxxxWLVEKGFVSPIGKVIDLGCGRGSWNYCAATLKKVQEVKGYTKGGAGHEEPMLMQSYGR
NLVSLKSGVHVFYRPSEPSDTLLCDIGESSPSPDVEEQRTLRxxxxxSDWLHRGPIEFCIKVLCxYMP
KVIEKIEVLQRRFGGGVVRLPLSRNxxHEMYWVSGPAGNVVHAVxxxSQVLLGRMDRTVWRGPKYKED
VNLGSGTRAVGKGEIHSNQEKIRKRIQKLREGFGTTWHKDHEHPYRNWTYHGSYEVKANGSASSLVNG
VVKLMSKPWDTISYVTTMPMTDTTPFGxQRVFKEKVGTKAPEPPTGVREVLNETTNWLWAYLSRKKRP

FIG. 61-9

```
RLCTKEEFIRKVNSNASLGTVFAEQNQWSTAREAVGDPxFWEMVNVERENHLRGECHTCVYHMMGKRE
KKxxxxxxxxxxxxxxxxxxxxxxxYLEFEALGFLNENHWLSRENSGGGVEGSSVQKLGYIFRDITVKAI
GKMYADDPAGWDTRITRADLENEAKVxELLDGEHRKLARAIIELTYKHQVFKVMRPAAGGKTVMVVYS
RENQRGSGQVVxxxxxTFTNIAVQLVRLMKVEGVIGPQHLEQLPRKTKIAVRTWLFENGEERVSRMAI
SGDDCAVKPLDDRFATSLYFLNAMSKVTRDIQQWKPSHGWLDWLHVPFCSNHFHEIVMKDGRSLVDPC
RGQDELIDRARISPGAGCNVMDTACLAKAYAQMRLLLYFHRRYLCLMANAICSAVPLNWVPTGRTSWS
KHSKGEWMTTENMLQVWNKVWIEENEWMVDKTPVASWTDVPYVxKREDIWCGSLIGTRTKATWAENVY
AAINQVRAIIGKENYVDYMLSLRRYEDVLVQEDRVI >JEV|peptide_length:9|string3 xTKKPGGPGISRAINMLKRxxxxVFPLVGVKRVVISLLDGIGPVRFVLALVSFFKFTALSPTKALSGR
WKALEKSVAMKHxTSFKGELGTLIDVVNKRGRKQNKRGGNGGxxxxxxxxxxxxxAGALKLSNFQGK
LLMAVNNTDIADxxxxxxxxxxxxxxVRAIDVGY

FIG. 61-10

```
NLVSMKSGVDVFYRPSEPxxxxxxxxxxxxxxxxxxxxxxxxxxxxxxxxxxxxxxxxxxxxxYMP
KVIEKNEVLQRRFGxxxxxxxxxxxxxxxxxxxxxxxxxxxxxxxxxxxxVLLGRMDRTVWRGPRYEED
VNLGxxxxxVGKGEVHSDQKKIRKRIQKQREEFATTWHKDPEHPYRNWTxHGSYEVRATGSASSLxxx
xxELMSKPWDAISYVTTMPxxxxxxxxxxxxVFKEKVGTKAPEPPVGVREVLNETTxWLWAHLSRKKRP
RLCTKEEFIKKVNSNASLGTVFAEQxxWSTAREAVNDPxLWEMVDVERENHLRGECHTRVYHMMGKRE
xxxxxxxxxxxxxxxxxxxxxxxxxFEALGSLNEDHWLSRENSGGGEEGLGVQKLGYISRDIASREG
GKMYADDPxGWDTRITKTDLENEAKxxxxxxxxxxxxxxIIELTYRHKVVKVMRPASDGKTGMAVIS
RENQRGSxxxxxxxxxxxxxxIAVQFVRLVEAEGVIGPQHLEQLPRENKIAVRTWxFENGGERVTRMAI
xxxxxxxxxxDDRFATALYFLNAMSKVRKDILEWKPSHGWHDWLHVPFCxxxxxxxxMKDGRSILVPC
RGQDExxxxxxxSPGAGWNVKDTACLPKAYAQMWVLLYFHRRDQRLMANAICSTVPVNWVPTGRTxxS
IHSKGEWIPTEDMLQVWxxxWIEENEWMMDKTPIASWTDVPYxxxxxxxxCGSLIGTRSRATWAENVY
xAINQVRAIIGKEDYVDYMDFLQRYEDVLTQEDRVI >JEV|peptide_length:9|string4 xxKKPRGPGKSRAINMLKxxxxxxxxLVRVKRVVMSLxxxxGPLRFVLAFITFFKFTAxxxxxALLGR
WRALEKSVAMxxxxxxxRELGILIDTVNKRGRKQNKRGGNERxxxxxxxxxxxxxxVGAIKLSNFQGK
xxxxxxxxxxxxxxxxxxxxxxxxxxxxxxxxxxxxxxxxxxTGNDPEDVDxWCDHQEVYVQ
YGxxxRTSHSKTSKRSVSVQTHGESSLVNKKEAWLDSTKATRYLVKTENWIVRxxxxxxxxxxVLGWML
GSTNGQRLGFTILLxxxxxxxxxxxxxMGNRDFIERASGATWVxxxxxxxxxxxxxANDKPTLDVRMT
NIEASxxxxxxxxxxxxxxxxxxxxxxTGEAHNEKQADSSYVxxxxxxxxRGWGNGCGLSGKGxxx
xxxKFSCTSKATGKTIQPENSKYKVGIFVHGAxxxxxxGNYSAQIGVSQAAKFTVTPNAPSVTLKLGD
FGExxxxxxxxxxxxxxxxxxxVMTVGPKSFLVHRExxHDLALPWSSPSSTAWRxxxxxxxxxxxxxxxx
xxVALGSQERSLHQALAGAxVVEYPSSVKLTSGxxxxxxxxxxxxxxxGTTYGMCTENSSFRKNPxxxx
xxxxVIELSYSGRDGPCxxxxVSVANLNDMTPVGxxxxxxxxVATSSSNSKALVEMEPPxxDSYIVVG
MGxKQINHHWHKPGSTLGKxxxxxxxxxxxxxxxxxxxxxWDFGSIGGAFNSIGKAVxxxxxxxxxxxx
xxxxxxxxxxxxxxxxxxxxxxxxxxxxxxxxxxxxxxxxxADTGCAIDVTRNQMRCGSxxxxx
xxxxxxxxxxxxxxxxxxxxxxxxxxAKIVHKAYMEGICGVRSxxxxxxxxxxxxxxxxxxxxxxxxx
xxxxxxxxxTPKRLSMTQxxxxxxxxxxxxKSLLFAPELANxxxxxxxxETKECPDEQRAWNSMQIxxx
xxxxxxxxxxxxxxxxxENTDECDGTIxGTAVKGHVALHSDVSYWIESHLNDSWKLERAVFEEVKSCxxx
xTHTLWGDDAEESELIIPDTIAGPKSKHNRREGYMTQNQGPWDESGIVLDFDYxxxxxxxxxxDCGKR
APWVRTTTDIGKxxxxxxxRSCTLPPLRFRTGSGCWYGMEVRPVKHDETTLVRSRVDAxSGEMVDPFQ
MGxxxxxxxxxxxxxxxxxxxxxxxxxxxxxxxxxxxxxxxxxxxxxxxxxxAAVFAEANSGGxxxxx
xxxxxxIQPAFLAMKMLSAKWTNQENVILVLGAAFFQLASMDLxxxxxxxxxxxxxxxxxxxxxxITFPT
TSTITMPVLTLLAPGMRALCLDTYRxxxLIIGICSLQQEREKTMAKKKGxxxxxxxxxxxxxxxxxxxx
xxxxxxxxxxxxxxxxxxxxxxxxxxxxxxxxxxxxxxxxxxxxxxxxxxxxxxxxxxxxxxMWLE
RAADVSWEMGAAITGSxxxxxxxxxxxxxxxxxxxxxxPWKVWVLRMSCSGLAALTPWxxxxxxxxxx
xxxxxxxxxxxxxxxxxxxxxxxxxxxxxxxxxxxxxxxxxxxxxAGVGVMYESVFHTLWHPTRGAAIMS
GKGKLTPxxxxxxxxxxxxxxxxxxxxxxxxxxxxxxVIVVEPGKVAVSFQTKPGIFPTPLGKVGTVSL
DYxxxxxxxxxxxxxxxxxxxxxxxxxxxxxxxxxxxDRQEEPVPEAYTPTMLKKKQMTVLDLPP
GSGKTRKILPQTIRDAIQQRLRxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxDLQDEIPDWAWSSGxxxxxxWITEYSGKTVxxxxxxxxxxxxxxxxxxxxxxxxxxxxxxxxxxxx
xxxxxxxxxxxxxxxxxxxxxxxxxxxxxxxSVKPIILEEGExxxxxxxxxxxxxxxxxxxxxxxxx
xxxxxxxxxHYGGPTSEDDSNLxxxxxxxxxxxxxxxxxxxxxxREKAFTMDVEYRLxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxFASGKRSAVSFIEELGRMPEHFAxxxxxxxxxxxxATAEKGGKTHRMAxxxxxxx
ALETVTLIVAITAMTGGFFLxMKQRKGIGKMxxxxxxxxxxxxxxxxxxxxxxxxxxxxxxxxxxxxx
xIPEPEKQRSQTGNQLAxxxxxxxxxxxxxxxxxxxxxxxxxKADLKSMFVGKTQVSGLTGLPGMALDL
RPAxxxxxxxxxxxxxxxxxxxxxxxxxxxxxxxxxxxxxxxxxxxxxxxxxxxxxxxxxxxxxWG
```

FIG. 61-11

```
QITLTTVLTAVVLATLHYGFMLxxxxxxxxxxxxxxxxxxxxxxxxxxxxxxxxxxxxxxxxxxxx
xxxxxxxxxxxxxAFLVNPKVTTVKKPGVLVTAAxxxxxxxxxxxxxxxxxxxxxxxxxxxxxxxx
xxxxIKNANNPSFKRGGPGGRTLGDQWKRKLNALSREEFFQYRxxxxxxxxxxxxRRARRENNKVGGH
xxxxxxxxxxxxxxxxxxxxxxxxxxVDLGCGCGGWSYCAATLKRVQEVRGYTxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxNRAVWRGPKYExx
xxxxxxxxxVGKGEVHSTQDKIKKRIQKLREEFATTWHRDPEHPYRTxxxxxxxxxxxxxxxxxxx
xxxxxxxxxxxxxxxxxxxxxxxxxxxxxxxxxxxxxTKAPEPPPGxxxxxxxxxxxxxxxxxxxx
xxxxxxEFIKKVNSDAALGAVFAxxxxWSTAREAVSDPxFWEIVDEERENHxxGECHTCVYHMMGKRx
xxxxxxxxxxxxxxxxxxxxxxxxxxEALGFLNLDHWLSRRNSRGGVEGLGVQKLGYIIGDIARKEG
GKMYAxxxxxxxxxxxxxxxxxxxxxxxxxxxxxxxxxxxxxxxxxxxVVKVMRPSTKGKTGMAVIx
xxxxxxxxxxxxxxxxxxxxxxxxxxxxxxPQHLEHLPKKNKIAVRTxxxxxxxxxxxxxxxxxx
xxxxxxxxxxxxxxxxxxxxxxxxxxMSKVRKDILEWKPSxxxxxxxxxxxxxxxxxxxxxxxxx
xxxxxxxxxxxxSPGAGWNVRDTACLAKAxxxxxxxxLYFHRRDQRLMANAICSAVPLDWVPTxxxxxx
xxxxxxxxxxxxxxxxxxxxxxWIEENEWMTDMTPITSWTDxxxxxxxxxxxxCGNLIGTRSRATWAENVx
xxxxxVRAILGKETYVDYMTSLRRYEDVSIQEDRVI >JEV|peptide_length:9|string5 xxxxxxxxxxxxxxxxxxxxxxxxxxxxxxxxxxxxxxxxPVRFVLAFITxxxxxxxxxxxxxxxSGR
WKAVERxxxxxxxxxxxxRELGTLIDGVNKRGRKRNKRGGNEGxxxxxxxxxxxxxxAGAIKLSNFxxx
xxxxxxxxxxxxxxxxxxxxxxxxxxxxxxxxxxxxxxxxxxxxxxxxPGNDPQDVDxxxxxxxxxxx
xxxxxxxxxxxxSKRSVSVQTxxxxxxxxxxxxxxxxxxxxxxxxxxxxxxxxxxxxxxxxTLGWML
GSNxxPRVVFTILLxxxxxxxxxxxxxxxGNRDFIEGVSGATWxxxxxxxxxxxxxxxxxxxxxxxx
xxxxxxxxxxxxxxxxxxxxxxxxxxxxxxxxxxxxxxxxxxxxxxxxxxxxxGWGKGCGLFGKxxxx
xxxxFSCTSKAIERAIQPENIKYxxxxxxxxxxxxxxxxxxxxxQVGASQAARFTVTPNAPSVTLKLGD
xxxxxxxxxxxxxxxxxxxxxxxxxxxxxxxxxxxxxxxDLALPWTSSSNxxxxxxxxxxxxxxxxxxx
xxxxxGSQEGSLHQALxxxxxxxxxxxxxxxxxxxxxxxxxxxxxxxxxTTYGVCTEKFSFAxxxxxxxx
xxxxxxxxLLYSGSDGPCxxxxxxxxVSLNDMTPVxxxxxxxxxxxATSSSNSQVLVEMxxxxxDSYIVIG
RGxKQINHHRHKAGSTLGxxxxxxxxxxxxxxxxxxxxxxxxxxxxxGRVFNSIGKAxxxxxxxxxxxxx
xxxxxxxxxxxxxxxxxxxxxxxxxxxxxxxxxxxxxxxxxxxxxxxxxDTGSAIDITRxxxxxxxxxxxx
xxxxxxxxxxxxxxxxxxxxxxxxxxxxxVHKAHMEGVCGVRSxxxxxxxxxxxxxxxxxxxxxxxxxx
xxxxxxxxxxxxxxxxxxxxxxxxxxxxxxxxxxxxxxxxxxxxxxxxxxxxDEQRAWNSMQxxxxx
xxxxxxxxxxxxxxxETTDECDGAIxxTAVKGHVTVHSxxSYWIGSRYNDTWKLERLVFxxxxxxxxx
xxxxxxxxxxxxxxxxxxxxxxxxxxxxxxxxxxxxxxxQGPWDEDGIVLDFDYxxxxxxxxxxxDCGKR
APWVRTxxxxxxxxxxxxxxxxxxxxxxxxxxxxxxxxxGHDEATLVRWQVDAxNGGMVDPFQ
xxxxxxxxxxxxxxxxxxxxxxxxxxxxxxxxxxxxxxxxxxxxxxxxxxxxxxxxxxxxxxxxx
xxxxxxxxxxFLAMNTLSTRWTNxxxMVLVLGAAFxxxxxxxxxxxxxxxxxxxxxxxxxxxTFPT
TSTVTMPxxxxLTPGMRAFDLxxxxxxxxVIGICSLQQERRRTMAKKKGxxxxxxxxxxxxxxxx
xxxxxxxxxxxxxxxxxxxxxxxxxxxxxxxxxxxxxxxxxxxxxxxxxxxxxxxxxxxxxxxxx
RAADISWGMDAAITGSxxxxxxxxxxxxxxxxxxxxxxxVWVLRMSCIGLVALxxxxxxxxxxxx
xxxxxxxxxxxxxxxxxxxxxxxxxxxxxxxxxxxxxxxxxVGVIYENVFHTLxxxxRGAAIMS
GGGKLTxxxxxxxxxxxxxxxxxxxxxxxxxxxxxxVIVVEQGKPATNIQTKPGIFPPPFGKVGTVSL
xxxxxxxxxxxxxxxxxxxxxxxxxxxxxxxxxxxxxPIPEAYTPNMLKKxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
```

FIG. 61-12

```
xxxxxxxxxxxxxxxxxxxxSATSFIEVLGRxxxxxxxxxxxxxxxxxxxxxxxxxxxxxxxxxxxx
ALETITLIIAIxxxxxxxxxxxxxxxxxxxxxxxxxxxxxxxxxxxxxxxxxxxxxxxxxxxxxxxx
xxxxPEKQRLQTDNxxxxxxxxxxxxxxxxxxxxxxxxxxxxxDIKSMFGGKAPVLGLTGLPSMxxxx
xxxxxxxxxxxxxxxxxxxxxxxxxxxxxxxxxxxxxxxxxxxxxxxxxxxxxxxxxxxxxxxxxxxx
xxxxxxxLTAMVLTTLHYGYMLxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxNADKPSLKRGGPGGRTLGEQWKERLNAMSREEFFQYxxxxxxxxxxxxxRRARSENNIxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxQGKIRRRIQKLREEFGTTWxxxxxxxxxxxxxxxxxxxxxxxxxxxxx
xxxxxxxxxxxxxxxxxxxxxxxxxxxxxxxxxxxxxTMAPEPPAGxxxxxxxxxxxxxxxxxxxxxx
xxxxxxEFINKVNSSAALGAVFAxxxxxxxTAREAVGDSxFWEMVDVERxxxxxxxxxxxxxxxxxxx
xxxxxxxxxxxxxxxxxxxxxxxxxxxxxxxxxxxxxxxxxxxSGGGVEGLGVQKLGYISxxxxxxxx
xxxxxxxxxxxxxxxxxxxxxxxxxxxxxxxxxxxxxxxxxxxxxxxxxKVMRPAAEGKTVMVVYx
xxxxxxxxxxxxxxxxxxxxxxxxxxxxxxxxxxxxxxxxQHVEQLPRENKIAxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxEENEWMEDKTPxxxxxxxxxxxxxxxxxGSLIGTRARATWAENIx
xxxxxVRAIIGKENYVDYMDFPRRIEDVLIQEDxx
```

FIG. 61-13

```
>JEV|peptide_length:10|string1

MTKKPGGPGKNRAINMLKRGLPRVFPLVGVKRVVMSLLDGRGPVRFVLALITFFKFTALAPTKALLGR
WKAVEKSVAMKHLTSFKRELGTLIDAVNKRGRKQNKRGGNEGxxxxxxxxxxxxxxAGAMKLSNFQGK
LLMTINNTDIADVIVIPTSKGENRCWVRAIDVGYMCEDTITYECPKLTMGNDPEDVDCWCDNQEVYVQ
YGRCTRTRHSKRSRRSVSVQTHGESSLVNKKEAWLDSTKATRYLMKTENWIIRNPGYAFLAAxLGWML
GSNNGQRVVFTILLLLVAPAYSFNCLGMGNRDFIEGASGATWVDLVLEGDSCLTIMANDKPTLDVRMI
NIEASQLAEVRSYCYHASVTDISTVARCPTTGEAHNEKRADSSYVCKQGFTDRGWGNGCGLFGKGSID
TCAKFSCTSKAIGRxIQPENIKYEVGIFVHGTTTSENHGNYSAQVGASQAAKFTVTPNAPSITLKLGD
YGEVTLDCEPRSGLNTEAFYVMTVGSKSFLVHREWFHDLALPWTSPSSTAWRNRELLMEFEEAHATKQ
SVVALGSQEGGLHQALAGAIVVEYSSSVKLTSGHLKCRLKMDKLALKGTTYGMCTEKFSFAKNPADTG
HGTVVIELSYSGSDGPCKIPIVSVASLNDMTPVGRLVTVNPFVATSSANSKVLVEMEPPFGDSYIVVG
RGxxxxxHHWHKAGSTLGKAFSTTLKGAQRLAALGDTAWDFGSIGGVFNSIGKAVHQVFGGAFRTLFG
GMSWITQGLMGALLLWMGVNARDRSIALAFLATGGVLVFLATNVHADTGCAIDITRKEMRCGSGIFVH
NDVEAWVDRYKYLPETPRSLAKIVHKAHKEGVCGVRSVTRLEHQMWEAVRDELNVLLKENAVDLSVVV
NKPVGRYRSAPKRLSMTQEKFEMGWKAWGKSILFAPELANSTFVVDGPETKECPDEHRAWNSMQIEDF
GFGITSTRVWLKIREESTDECDGAIIGTAVKGHVAVHSDLSYWIESRYNDTWKLERAVFGEVKSCTWP
ETHTLWGDGVEESELIIPHTIAGPKSKHNRREGYKTQNQGPWDENGIVLDFDYCPGTKVTITEDCGKR
GPSVRTTTDSGKLITDWCCRSCSLPPLRFRTENGCWYGMEIRPVxHDETTLVRSQVxxxxGEMVDPFQ
LGLLVMFLATQEVLRKRWTARLTIPAVLGALLVLMLGGITYTDLARYVVLVAAAFAEANSGGDVLHLA
LIAVFKIQPAFLVMNMLSTRWTNQENVVLVLGAAFFQLASVDLQIGVHGILNAAAIAWMIVRAITFPT
TSSVTMPVLALLTPGMRALYLDTYRIILLVIGICSLLQERKKTMAKKKGAVLLGLALTSTGWFSPTTI
AAGLMVCNPNKKRGWPATEFLSAVGLMFAIVGGLAELDIESMSIPFMLAGLMAVSYVVSGKATDMWLE
RAADISWEMDAAITGSSRRLDVKLDDDGDFHLIDDPGVPWKVWVLRMSCIGLAALTPWAIVPAAFGYW
LTLKTTKRGGVFWDTPSPKPCSKGDTTTGVYRIMARGILGTYQAGVGVMYENVFHTLWHTTRGAAIMS
GEGKLTPYWGSVKEDRIAYGGPWRFDRKWNGTDDVQVIVVEPGKAAxNIQTKPGVFRTPFGEVGAVSL
DYPRGTSGSPILDSNGDIIGLYGNGVELGDGSYVSAIVQGDRQEEPVPEAYTPNMLRKRQMTVLDLHP
GSGKTRKILPQIIKDAIQQRLRTAVLAPTRVVAAEMAEALRGLPVRYQTSAVQREHQGNEIVDVMCHA
TLTHRLMSPNRVPNYNLFVMDEAHFTDPASIAARGYIATKVELGEAAAIFMTATPPGTTDPFPDSNAP
IHDLQDEIPDRAWSSGxxxxxxWITEYAGKTVWFVASVKMGNEIAMCLQRAGKKVIQLNRKSYDTEYP
KCKNGDWDFVITTDISEMGANFGASRVIDCRKSVKPTILEEGEGRVILGNPSPITSASAAQRRGRVGR
NPNQVGDEYHYGGATSEDDSNLAHWTEAKIMLDNIHMPNGLVAQLYGPEREKAFTMDGEYRLRGEEKK
NFLELLRTADLPVWLAYKVASNGIQYTDRKWCFDGPRTNAILEDNTEVEIVTRMGERKILKPRWLDAR
VYADHQALKWFKDFAAGKRSAVSFIEVLGRMPEHFMGKTREALDTMYLVATAEKGGKAHRMALEELPD
ALETITLIVAITVMTGGFFLLMMQRKGIGKMGLGALVLTLATFFLWAAEVPGTKIAGTLLIALLLMVV
LIPEPEKQRSQTDNQLAVFLICVLTVVGVVAANEYGMLEKTKADLKSMFGGKTQASGLTGLPSMALDL
RPATAWALYGGSTVVLTPLLKHLITSEYVTTSLASINSQAGSLFVLPRGVPFTDLDLTVGLVFLGCWG
QITLTTFLTAMVLATLHYGYMLPGWQAEALRAAQRRTAAGIMKNAVVDGMVATDVPELERTTPLMQKK
VGQVLLIGVSVAAFLVNPNVTTVREAGVLVTAATLTLWDNGASAVWNSTTATGLCHVMRGSYLAGGSI
AWTLIKNADKPSLKRGRPGGRTLGEQWKEKLNAMSREEFFKYRREAIIEVDRTEARRARRENNIVGGH
PVSRGSAKLRWLVEKGFVSPIGKVIDLGCGRGGWSYYAATLKKVQEVRGYTKGGAGHEEPMLQSYGW
NLVSLKSGVDVFYKPSEPSDTLFCDIGESSPSPEVEEQRTLRVLEMTSDWLHRGPREFCIKVLCPYMP
KVIEKMEVLQRRFGGGLVRLPLSRNSNHEMYWVSGAAGNVVHAVNMTSQVLLGRMDRTVWRGPKYEED
VNLGSGTRAVGKGEVHSNQEKIKKRIQKLKEEFATTWHKDPEHPYRTWTYHGSYEVKATGSASSLVNG
VVKLMSKPWDAIANVTTMAMTDTTPFGQQRVFKEKVDTKAPEPPxGAKEVLNETTNWLWAHLSREKRP
RLCTKEEFIKKVNSNAALGAVFAEQNQWSTAREAVDDPxFWEMVDEERENHLRGECHTCIYNMMGKRE
KKPGEFGKAKGSRAIWFMWLGARYLEFEALGFLNEDHWLSRENSGGGVEGSGVQKLGYILRDIAGKQG
GKMYADDTAGWDTRITRTDLENEAKVLELLDGEHRMLARAIIELTYRHKVVKVMRPAAEGKTVMDVIS
REDQRGSGQVVTYALNTFTNIAVQLVRLMEAEGVIGPQHLEQLPRKNKIAVRTWLFENGEERVTRMAI
SGDDCVVKPLDDRFATALHFLNAMSKVRKDIQEWKPSHGWHDWQQVPFCSNHFQEIVMKDGRSIVVPC
```

FIG. 61-14

RGQDELIGRARISPGAGWNVKDTACLAKAYAQMWLLLYFHRRDLRLMANAICSAVPVDWVPTGRTSWS
IHSKGEWMTTEDMLQVWNRVWIEENEWMMDKTPITSWTDVPYVGKREDIWCGSLIGTRSRATWAENIY
AAINQVRAVIGKENYVDYMTSLRRYEDVLIQEDRVI

>JEV|peptide_length:10|string2

MTKKPGGPGRNRAIYMLKRGLPRVFPLVGVKRVVMSLLDGRGPVRFVLALTSFFKFTALAPTKALLGR
WRALERSVAMKHLTSFKRELGTLIDAVNKRGKKQNKRGGNESxxxxxxxxxxxxxVGAMRLSNFQGK
LLMTVNNTDIADVIxxxxxxxxxCWVRAIDVGYLCEDTITYECPKLAVGNDPQDVDCWCDNQQVYVQ
YGPCTRTRHSKRTRRSVSVHTNGESSLENKKKAWLDSTKATRYLTKTENWIVRNPGYAFLAGxLGWML
GSNSGQRVVFTILPLLVAPAYSFTCLGMGNRDFIERVSGATWVDLVxxGDSCLTIMASDRPTLDVRMI
NIEAVQLAEVRSYYYRASVTDISTVARCPMTGEAHNEKQADSSYVCKQGFTDRGWGNGCGFSGKGSID
TCAKFSCTRKAIGRxIQPENIKYKVGIFVHGATTSENHGNYSAQVGASQAAKFTVTPNAPSTALELGD
YGEVTLDCEPKSGLNTEAFYVMTVGSRSLLVHREWFHDLSLPWTPSSNTAWRNRELLMEFEGAHATKQ
SVVALGSQEGGLHHALAGAIVVEYSSSVMLTSGHLKCRLRMDKLALKGTTYGMCTGKFSFAKNPVDTG
HGTVVIELTYSGRDGSCKIPIVSVASLNDLTPAGRLVTVNPFVATSSSNSQVLLEIEPPFGDSYIVIG
RGxxxxxHHWHRAGSTLGKAFLTTLKGAQRLVALGDTAWDFGSIGGVFNSIGRAVHQVFGDAFRTLFG
GMSWITQGLMGALLLWMGINARDRSIAMAFLVTGGTLLFLATNVHADTGCAIDITRRQMRCGSGIFVx
xxxxxxxxRYKYLPETPRSLAKIVHKAHQEGVCGIRSVTRLEHQMWESVRDELNVPLKENAVDLSxxx
NKPVGRYRSAPKRLFMTQEKVEMGWKAWGKSMLFAPELANSSFVVDGPETKECPDERRAWNSTQIEDF
GFGIxxxRVWLKIREENTDECDGPIIGTAVKGNVAVHSDLSYWIESRLNDSWKLERAVFGEIKSCTWP
ETHTLWGDDAEESELIIPHTIAGPRSKHNRREGYRTQNQGPWDEKGLVLGFDYCPGTKVTITEDCGKR
GPSIRTTTDIGKLITDWCCRSCSLPPLGFRTDSGCWYGMEIRPLxHDEATLVRSQVxxxxGEMIDPFQ
LGLLVVFLATQEVLRKRWTARLTIPAVLGVLLVLMLGGITYIDLARYVVLVAAAFAEANNGGDVLHLA
LxxVFKIQPAFLVMNMLSARWTNQENVALVLGAAFFQLASADLQIGVHGMLNAAAMAWMIVRAITFPT
TSTVAMPILALLTPGMKAFDLDTYRIILLVIGICSLLHERRKAMAKKKGAVLMGLALTSTGWFSPTTI
TAGLMACNPNKKRGWPATEFLSAIGLMFAIVGGLAEMDIESMSIPFMLAVLMAVSYVVSGKATDMWLD
RAADISWEMEAAITGSSRRLDVKLDEDGDFHLIDDPGVPWKVWLLRMSCSCLVALTPWAIVPxxxxxx
xxxxxxxxxxxWDTPSPKPCLKGDTTTGVYRIMARGIFGTHQSGVGVMYQNVFHTLWHTTRGAAIVS
GKGKLTPYWGSVKEDRISYGGPWRFDRKWNGTDDVQVIVVEPGKPAxNFQTKPGVFRTPFGEIGTVSL
DYPRGTSGSPILNSNGDIIGCLGNGGELGDRSYVSAIVQGDRQEEPVPDAYTPSMLKKRQLTVLDLHP
GSGKTKKILPQIIKDAIQQRLKTAVLAPTRVVAAEMAEALKGLPVRYQTSAVQREHQGNAIVDVMCHA
TLTHRLTSPNRVPNYNxxxxDEAHFTDPAGIAARGYIATxxxxxxAAAIFMTATSPGTTDPFPDSNAP
IHDLQDEVPDRAWSSGxxxxxxWITDYSGKTVWFVASVRMGNEIAVCLQRAGKKVIQLSRKSYDTEYP
xxxxxxxxFVITTDISEVGANFGASRVIDCRKSVEPIILEKGEGRVFLGNPSPITNASAAQRRGRVGR
NPNQVGDEYHYGGPTSEGDGNLAHWTEAKILLDNIHMPNGLVVQLYGPEREKASTMDVEYRLRGEEKx
xxxxxxxxADLPVWLAYRVASNGIQYTDRRWCFDGPRTNAILEDNIEVEIVTRTGERKILKPRWLYAR
VYADHQALKWFKDFAAGKRSAISFIEVRGRMPEHFAGKTREALDTMYLVATAERSGKTHRMALEELPD
ALETITLIAAITVMTGGFFLLMMQRKGIGRMGLGALVLVLATFFLWAAEVSGTKIAGTLLVALLLMVV
LIPEPGKQRSQTGNQLAVFLICVLTVVGMAAANEYGMLEKTKADLKSMFGGRTQAPGMTGLPGMTLDL
RPATAWAWYGGSTVVLTPLLKHIITSEYVTTSLASISSQAGSLFVLPRGVPSTDLDLTVGLVFLGCWG
QITLTTFLTAMVLVTLHYGFMLPGWQAQALRAAQRRTxxxxxxxxxxxxVATDVPELEKTTPLMQKK
IGQVLLIGVSVAALLVNPKVSTVREAGVLVTARTLTLWDNGASAAWNSTTATGLCHVMRGSYLRGGSI
AWTLIKNADKPSLKKGRSGGRTLGEQWKEKLNAMSRDEFFQYRREGIIEVDRTEARRARRENNVVGGH
PVSRGxxxxRWLVEKGFVPPIGKVIDLGCGRGSWNYYAATLKKVQEVKGYTKGGAGHEEPMLMQSYGR
NLVSLKSGVDVFYRPSEPSDTLLCDIGESSPSPDVEEQRTLRVxxxTSDWLHRGPIEFCIKVLCPYMP
KVIEKIEVLQRRFGGGVVRLPLSRNSNHEMYWVSGPAGNVVHAVNxTSQVLLGRMDRTVWRGPKYKED
VNLGSGTRAVGKGEIHSNQEKIRKRIQKLREGFATTWHRDHEHPYRNWTYHGSYEVKANGSASSLVNG
VVELMSKPWDAISYVTTMPMTDTTPFGQQRVFKEKVGTMAPEPPxGVREVLNETTNWLWAYLSRKKRP
RLCTKEEFIRKVNSDASLGTVFAEQNQWSTAREAVGDPxFWEMVNVERENHLRGECHTCVYHMMGKRE

FIG. 61-15

KKPxxxxxxxxxxxxxxxxxxxxxRYLEFEALGFLNENHWLSRRNSGGGVEGSSVQKLGYIFRDIARREI
GKMYADDTAGWDTRITRADLENEAKVLELLDGEHRKLARAIIELTYKHKVVKVMRPAAGGKTGMVVIS
RENQRGSGQVVTxxxNTFTNIAVQFVRLMKAEGVIGPQHLEQLPRKTKIAVRTWLFENGEERVSRMAI
SGDDCAVKPLDDRFATALYFLNAMSKVTKDIQEWKPSHGWHDWLHVPFCSNHFHEIVMKDGRSILDPC
RGQDELIDRARISPGAGCNVRDTACLAKAYAQMRLLLYFHRRYLCLMANAICSTVPLNWVPTGRTSWS
KHSKGEWMTTENMLQVWNKVWIEENEWMVDKTPVASWTDVPYVGKREDIWCGSLIGTRTKATWAENVY
AAINQVRAIIGKENYVDYMTSLRRYEDVLVQEDRVI >JEV|peptide_length:10|string3

MTKKPRGPGISRAINMLKRGxxRVFPLVRVKKVVISLLDGRGPARFVLALVSFFKFTALSPTKALSGR
WKAVERSVAMKHLTSFKRELGTLIDTVNKRGRKQNKRGGNGGxxxxxxxxxxxxxAGALKLSNFQGK
LLMAVNNTDIADVxxxxxxxxxxxxxWVRAIDVGHMCEDTITYExxxxxAGNDPEDVDCWCDHQEVYVQ
YGRCTRTSHSKRSRRSVSVQPHGESSLVNKKEAWLDSTRATRYLMKTENWIVRNPGYAFLAVxLGWML
GSTTGPRLGFTILLLLVAxxxxxxxLGMGNRDFIEGVSGATWVDLxxxxxSCLTIMANDKPTLDVRMT
NIEASQLAEVRSYCYRASVTDISxxxxCPTTGEAHNKKGADSSYVCKQGFTDRGWRNGCGLSGKGSID
TCAKFSCTSKATGKxIQPENSKYEVGIFVHGATxxxxHGNYSAQVGTSQAARFTITPNAPSVTLKLGD
FGEVTLDCEARSGLNTEAFYVMTVGSKSLLVHREWFHDLALPWSSSSNTAWRNRELLMEFEQAHATKQ
SVVALGSQERSLHQALAGAIVVEYPSSVKLTSGHVKRRLKMDKLALKGTTYGMCTENSSFRKNPADTG
HGTVVIELLYSGSDGPCKIPIVSVVSLNDMTPAGRLVTVNPFVAASSANSKALVEMEPPFGDSYIVVG
MGxxxxxHHWYKPGSTLGKAFSxxxxxxxxxxxxxxAWDFGSIGGIFNSIGRAVHQVFGDAxxxxxx
xxxxxxxxxMGVLLLWMGVNARNRSIALAFLAxxxxxxxxxxxxHADTGCAIDTARNQMRCGSGIFxx
xxxxxxxxxYKYLPETPKALAKIVHKAHMEGICGVRSVTRLxxxxxEAVRDELNVPLxxxxxxxxxxx
xxxxxRYRSTPKRLSMTREKFEMGWKAWGKSLLFAPEMANSTFVVDGPETKECPDVRRAWNSTQIExx
xxxxxxxRVWLKIREESTDECDGAIIGTAVKGHVTLHSDVSYWIESRFNDTWKLERLVFEEVKSCTWP
ETHSLWGDDVEESDLIIPHTLAGPKSKHNRREGYMTQNQGPWDENGLVPDLDYCPGTTVTITEDCSKR
APSLRTTTDSGKLITDWCCRNCSLPPLRFRTGSGCWYGMEIRPAxHDETTLVRSRVxxxxGEMVDPFQ
MGLLVMFLATQEVFGKRWTARLTVPAVLGALLVLMFGGITYTDLARYVVLVAAVFAEANSGGDxxxxx
xxxxFKIQPAFLAMNMLSTRWTNQENVVLVLGAALFQLASADLQIGVHGILNAAAIAWMIIRAITFPT
ASSVTMPVLALLTPGMRALCLDTYRIILLVIGVCSLLQERKRTMAKKKGAVxxxxxxxxxxxxxPTTI
AAGLMACNPNxxxxWPATEVLSAVGLMFAxxxxxxxxxxxxxxxxxxxxxxxxxxxxxGKATDMWLE
QAADISWDMGAAITGSSRRxxxKLDDDGDFHFIDVPGVPWKIWVLRMSCIGLVALTPWAIxxxxxxxx
xxxxxxxxxxxxWDTPSPKPCAKGDTTTGVYRIMACGILGTYQAGVGVMYENVLHTLWHTTRGAAVMS
GGGKLTPYWGSVREDRIAYGGPxxxxxxxxxxNDVQVIVVEPGKGAxSIQTKPGVFCTPFGKVGTVSL
DYPRGTSGSPILDFNGDVVGLYGNGVELGDRSYVSxxVQGERQEEPVPEAYTPSMLRKKQMTVLDLPP
GLGKTRKILPQTIKDAIQQHLRTAVLAPTxxVAAEMAEVLRGLPVRYQxxAVQRSHQGNEIVDVxxxx
xxxxxxxxxxxxxxxxxxxxxxxxxxxxxxxxxxxxxxxxxxxxxxxxxxxxxxxxxxxxxxxxxDAP
IHDLQDETPDRAWSSGxxxxxxWSTEYSGKTVWFVxSVKMGNEIAMCLQRAGKRVIQLNRKSYxxxxx
xxxxxxxxxxxxxxxxxxxxxxxxxxxxxIDCRKSVKPTILEEEEGRVILGNPSPITNxxxxxRRGRVSR
NPSQVGDEYEYGGATSEDDGNLAHWTExxxxxxxxxxxxxxxxxLYGPEREKAFTMDVEYRLRxxxxx
xxxxxxxxxxxPVWLAYKVAPNGIQYTDRKxxxxxxRTNAILEDNTEVEIVTRTGxRKVLKPRWLDAR
xxxxxxxxxxxxDFASGKRSATSFIEVPGRMPEHFMGxxxxxxxxMYLVATAEKGGKTHRMALExxPD
ALETVTLIVAIAAMTRGFFLLMMQRKGIEKMGLGALVLVxxxxxxxxxxxxxxxxxxxxxxxxxxxxxV
LIPEPEKQKLQTDNQLAVFxICVLTVVGVAAANEYGMLERTKADLKSMFAGKTQVSGLTGLPSVALDL
RPATAxxxxxxxxxxxxxxxxxHLITSEYVTPSLASISSQAxxxxxxxxxxxxxxxxxxxxxxLVLLGCWG
QVTLTTSLTAVVLAILHYGYMLPGxxxxxxxxxxxxxxxxxxxxxxxxxxxxxxxxxxxxxxxxxxxx
xxxxLLIGGSVAAFLVNPNVTTVRKPGVLVTAATLSLWDNGASAVxxxxxxxxxxxxxxxxxxxxxxxxx
AWTLIKNADNPSLKRGGPGGRTLGDQWKRKLNAMGREEFFKYRREGIIEVDRTEACRARSENNKVGGH
PVSRGxxxxxxxxxxGFVSPIGKVVDLGCGRGGWSYCAATLKKVQEFRGYTKGGAGxxEPMPMQSYGW
NLVSMKSGVHVFYKPSEPSxxxxxxxxxxxxxxxxxxxxxxxxxxxxxxxxxxxxxxxxxxxxxxPYMP

FIG. 61-16

```
KVIEKNEVLQRRFGGxxxxxxxxxxxxxxxxxxxxxxxxxxxxxxQVLLGRMDRAVWRGPRYEED
VNLGSxxxAVGKGEVHSDQDKIRRRIQKLREEFGTTWHKDPEHPYRNWTYHGSYEVRATGSASSLVxx
xVKLMSKPWDTIANVTTMAMxxxxxxxxxRVFKEKVGTKAPEPPxGVREVLNETTNWLWAHLSRKKRP
RLCTKEEFIKKVNSNASLGAVFAEQNQWSTAREAVSDPxLWEIVDVERENHLRGECHTCVYHMMGKRE
KxxxxxxxxxxxxxxxxxxxxxxxxxxxEFEALGFLNEDHWLSRENSGGGEEGLGVQKLGYIIRDIAVQG
GKMYADDPAGWDTRITKTDLENEAKVxxxxxxxxxxxxxAIIELTYRHQVFKVMRPASKGKTVMAVYS
REDQRGSGxxxxxxxxxxxxNIAVQLVRLVEVEGVIGPQHLEHLPRENKIAVRTWLFENGGERVTRMAI
SxxxxxxxxLDDRFATSLHFLNAMSKVRRDILQWKPSHGWLDWQQVPFCSxxxxxxVMKDGRSLVDPC
RGQDELxxxxxISPGAGWNVKDTACLPKAYAQMWLLLYFHRRDQRLMANAICSAVPVNWVPTGRTSWS
IHSKGEWIPTEDMLQVWNxVWIEENEWMTDMTPIASWTDVPYVxxxxxxWCGSLIGTRSRATWAENVY
AAINQVRAIIGKEDYVDYMLFPRRYEDVLTQEDRVI >JEV|peptide_length:10|string4 xTKKPGGPGKSRAINMLKRxxxxxxPLVGVKRVVISLLxxIGPVRFVLAFITFFKFTALxxxKALSGR
WRALEKSVAMKxxxxxKRELGILIDGVNKRGRKRNKRGGNEGxxxxxxxxxxxxxAGAIKLSNFQGK
LxxxxxxxxxxxxxxxxxxxxxxxxxxxxxxxxPGNDPQDVDCWCDNQEVYIQ
YGRCTRTRHSQTSKRSVSVQPNGERSLVNKKEAWLNSTKATRYLVKTENWIVRNxxxxxxxxxLGWML
GSTNGQRVVFTILPLxxxxxxxxxxGMGNRDFVQGASGATWVDxxxxxxxxxxMANDKPTLDRRMI
NIEASQxxxxxxxxxxxxxxxxxxxxxxTTGEAHNEKQADSSYVCxxxxxDRGWGKGCGLFGKGSxx
xxAKFSCTNKAIGRxIQSENIKYKVGIFVHGATxxxxHGNYTAQIGASQAARFTVTPNAPSVTLELGD
YGEVxxxxxxxxxxxxxxxxYVMTVGPKSFLVHREWFHDLALPWTSSSNTAWRNxxxxxxxxxxxxx
xVVALGSREGALHQALAGAIVVEYSNSVKLTSGHLxxxxxxxxxxxxKGTTYGVCTKKFSFAKNPAxxx
xxxVVIELSYSGRDGPCKxxIVSVANLNDMTPVGRxxxxxxFVATSSSNSKALVEMEPPFGDSYIVVG
RKxxxxxHHRHKPGSTLGKAxxxxxxxxxxxxxxxxxxxxAWDFGSIGRAFNSIGKAVHxxxxxxxxxxxx
xxxxxxxxxxxxxxxINARDRSIAMxxxxxxxxxxxxxxxxHADTGSAIDITRNQMRCGSGxxxx
xxxxxxxxxxxxxxxxxxxxLAKIVHKAHMEGVCGVRSVxxxxxxxxxxxxxxxxxxxxxxxxxxxx
xxxxxxxxSAPKRLFMTQExxxxxxxxxxGKSILFAPEMANSxxxxxxPETKECPVEQRAWNSMQIExx
xxxxxxxxxxxxxxEENTDECDGTIIGTAIKGHVTVHSDLSYWIESHLNDTRKRERAVFEEVKSCTxx
ETHTLWGDGVEESELIIPDTIAGPKSKHNQREGYKTQNQGPWDEDGIVLDFDYCxxxxxxxxxEDCGKR
GPWVRTTTDIGKLxxxxxCRSCTLPPLRFRTDNGCWYGMEVRPVxHDEATLVRSQAxxxxxGGMVDPFQ
LGLxxMFLATQEVLGxxxxxxxxxxxxxxxxxxxxxxxxxxxxxxVAASFAEANSGGDxxxxx
xxxxxKIQPAFLAMKTLSTKWTNQENMILVLGAAFFQLASMDLQIGVHGIxxxxxxxxxxxxKAITFPT
TSTVTMPLLTLLAPGMRALCLDTYRIxLLIIGICSLQQEREKTMAKKKGAxxxxxxxxxxxxxxxxxx
xxxxxxxxxxxxxxxxxxxxxxxxxxxxxxxxxxxxxxxxxxxxxxxxxxxxxxxxxxxxxxDMWLE
RAADVSWGMDAAITGSSxxxxxxxxEDGDFHLIDDPGVPWKVWVLRMSCICLAALTPWAxxxxxxxxx
xxxxxxxxxxxxxxxxxxxxxxxxxxxxxxxxxxxYQAGVGVIYESVFHTLWHPTRGAAIMS
GKGKLTPYxxxxxxxxxxxxxxxxxxxxxxxxxQVIVVEQGKPAxNIQTKPGIFPPPFGKVGAVSL
DYPxxxxxxxxxxxxxxxxxxxYGNGGELGDGxxxxxxxxGDRQEEPVPEAYTPTMLKKKQLTVLDLHP
GLGKTRKILPQIIRDAIQQRLRTxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xHDLQDEIPDWAWSSGxxxxxxWITEYSGKTVWxxxxxxxxxxxxxxxxxxxxxxxxxxxxxxxx
xxxxxxxxxxxxxxxxxxxxxxxxxxxxxxxKSVKPIILEEGEGxxxxxxxxxxxxxxxxxxxxx
xxxxxxxxYHYGGATSEGDSNLAxxxxxxxxxxxxxxxxxxxxxEREKALTMDGEYRLRxxxxx
xxxxxxxxxxxxxxxxxxxxxxxxxxxxxxSTEVEIVTRMxxxxxxxxxxxxxxxxxxxxxxx
xxxxxxxxxDFAAGKRSAVSFIEELGRMPEHFAGxxxxxxxxxVATAEKGGKTHRMALxxxxD
ALETITLIIAITAMTGGFFLLMKQRKGIGKMGxxxxxxxxxxxxxxxxxxxxxxxxxxxxxxxxxx
LIPEPEKQRLQTDNQLAVxxxxxxxxxxxxxxxxxxxxTKADLKSMFVGKAPALGLTGLPSMTLDL
RPATxxxxxxxxxxxxxxxxxxxxxxxxxxxxxxxxxxxxxxxxxxxxxxxxxxxxxxxxxCWG
QITLTTVLTAMVLTTLHYGYMLPxxxxxxxxxxxxxxxxxxxxxxxxxxxxxxxxxxxxxxxxxxx
```

FIG. 61-17 xxxxxxxxxxxAAFLVNPNITTVKKPGVLVTAATxxxxxxxxxxxxxxxxxxxxxxxxxxxxxxxx
xxxLIKNANKPSFKRGRPGGRTLGEQWKEKLNAMSREEFFKYRREGxxxxxxxxARRARRENNKVGGH
PxxxxxxxxxxxxxxxxxxxVIDLGCGCGGWSYYAATLKRVQEVRGYTKxxxxxxxxxxxxxxxxx
xxxxLKSGVDVFYRxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxMNRTVWRGPRYEEx
xxxxxxxxAVGKGEVHSTQGKIKKRIQKQREEFATTWHKDHEHPYRTWxxxxxxxxxxxxxxxxx
xxxxxxxxxxxxxxxxxxxxxxxxxxxxxxxxxxxxxxxxxxxxxxxxxxxxxxxxxxxxxxxx
xxxxxEEFINKVNSNASLGAVFAExxQWSTAREAVNDPxFWEMVDVERENHLRGECHTRIYNMMGKRE
xxxxxxxxxxxxxxxxxxxxxxxxxxxFEALGSLNLDHWLSRENSGGGVEGLGVQKLGYISGDITSRAI
GKMYADDTxxxxxxxxxxxxxxxxxxxxxxxxxxxxxxxxxxxxxxxKVVKVMRPAAEGKTVMVVYS
xxxxxxxxxxxxxxxxxxxxxxxxxxxGPQHLEQLPKKNKIAVRTWxxxxxxxxxxxxxxx
xxxxxxxxxxxxxxxxxxxxxxxxxAMSKVRKDIQQWKPSHGWHxxxxxxxxxxxxxxxxxxxxx
xxxxxxxxxxxISPGAGWNVMDTACLAKAYxxxWVLLYFHRRDQRLMANAICSAVPVNWVPTGxxxxx
xxxxxxxxxxxxxxxxxxxxxxxxVWIEENEWMMDKTPIASWTDVxxxxxxxxxxWCGNLIGTRARATWAENIY
xxxxQVRAILGKETYVDYMDSLRRYEDVSIQEDRVI >JEV|peptide_length:10|string5 xxxxxxxxxxxxxxxxxxxxxxxxxxxxxxxxxxxxxxxxGPLRFVLALVSFxxxxxxxxxxxxLLGR
WRALEKSxxxxxxxxxxKGELGTLIDVVNKRGKKQNKRGGNERxxxxxxxxxxxxxxVGALKLSNFQxx
xxxxxxxxxxxxxxxxxxxxxxxxxxxxxxxxxxxxxxxxxxxxxTGNDPEDVDCxxxxxxxxxxx
xxxxxxxxxxxxRSRRSVSVHTHxxxxxxxxxxxxxxxxxxxxxxxxxxxxxxxxxxxxxxxxxxx
xxxxGHRVVFTILLLxxxxxxxxxxxxxMGNRDFIQGASGATWVxxxxxxxxxxxxxxxxxxxxxx
xxxxxxxxxxxxxxxxxxxxxxxxxxxxTTGEAHNEKQxxxxxxxxxxxxxxxRGWGNGCGLSGKGxxx
xxxKFSCTSKAIERxxxxxxxxxxxxxxxxxxxxxxxxxAQVGVSQAAKFTVTPNAPSVTLELGD
xxxxxxxxxxxxxxxxxxxxxxxxxxxxxxxxxxxHDLALPWTSSSNTxxxxxxxxxxxxxxxxxx
xxxxLGSQERALHQALAxxxxxxxxxxxxxxxxxxxxxxxxxxxGTTYGMCTENSSFRKNPAxxx
xxxxxxxELSYSGSDGSCKxxxxxVASLNDMTPAGxxxxxxxxVATSSSNSKVLLEIExxxGDSYIVVG
RExxxxxxHHWHKPGSTLGKxxxxxxxxxxxxxxxxxxxxxxxxxIGGAFNSIGKAVxxxxxxxxxxxxxx
xxxxxxxxxxxxxxxxxxxxxxxxxxxxxxxxxxxxxxxxxADTGCAIDVTRxxxxxxxxxxxxx
xxxxxxxxxxxxxxxxxxxxxxxxxxxxIVHKAYKEGVCGIRSVxxxxxxxxxxxxxxxxxxxxxx
xxxxxxxxxxxxxxxxxxxxxxxxxxxxxxxxxxxxxxxxxxxxxxxPDERRAWNSTQIxxx
xxxxxxxxxxxxxxEETTDECDGAIIGTAVKGHVTVHSDxSYWIGSRYNDTRKLERAVFGxxxxxxxx
xxxxxxxxxxxxxxxxxVIPHTIAGPRxxxxxxxxxxxxNQGPWDESGIVLDFDYCxxxxxxxxEDCGKR
APWVRTTxxxxxxxxxxxxxxxxxxxxxxxxxxxxxDETTLVRWQVxxxxxxxxxxxxxx
xxxxxxxxxxxxxxxxxxxxxxxxxxxxxxxxxxxxxxxxxxxxxxxxxxxxxxxxxxxxxxxx
xxxxxxxxxAFLVANTLSAKWTNQENVILVLGAAFFxxxxxxxxxxxxxxxxxxxxxxxxxITFPT
TSTITMPVLALLTPGMRAFDLDxxxxxxxLVIGICSLQQERRRTMAKKKGAxxxxxxxxxxxxxxx
xxxxxxxxxxxxxxxxxxxxxxxxxxxxxxxxxxxxxxxxxxxxxxxxxxxxxxxxxxxxxxxx
xxxxxSWEMGAAITGSSxxxxxxxxxxxxxxxxxxxxxxxxxKVWVLRTSCIGLAALTxxxxxxxxxxxx
xxxxxxxxxxxxxxxxxxxxxxxxxxxxxxxxxxxxxxxxxxGVGVMYESVFHTLWHTTRGAAIMS
GGGKLTPxxxxxxxxxxxxxxxxxxxxxxxxxxxxxQVIVVEPGKVAxNIQTKPGIFPTPLGEVGAVSL
DxxxxxxxxxxxxxxxxxxxxxxxxxxxxxxxxxxxxxxxxxxxEPIPEAYNPSMLxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxRSAISFIEVRGRMxxxxxxxxxxxxxxxxxxxxxxxxxxxxxxxxD

FIG. 61-18

```
ALETITLTVAIxxxxxxxxxxxxxxxxxxxxxxxxxxxxxxxxxxxxxxxxxxxxxxxxxxxx
xxxEPEKQRSQTGNQxxxxxxxxxxxxxxxxxxxxxxxxxADIKSMFGGKAPASGLTGLPSVxxxx
xxxxxxxxxxxxxxxxxxxxxxxxxxxxxxxxxxxxxxxxxxxxxxxxxxxxxxxxxxxxxxxx
xITLTTVLTAVVLATLHYGFMLPxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxKNADKPSLKKGRPGGRTLWEQWKERLNALSREEFFKYRxxxxxxxxxxxARRARRENNKVxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxQKKIRKRIQKLKEEFGTTWHKDPxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxEEFIKKVNSSAALGAVFAExxxxSTAREAVGDSxFWEMVDVERExxxxxxxxxxxxxxxx
xxxxxxxxxxxxxxxxxxxxxxxxxxxxxxxxxxxxxxxxENSRGGVEGSGVQKLGYIIRxxxxxxx
xxxxxxxxxxxxxxxxxxxxxxxxxxxxxxxxxxxxxxxxxxxxxxxxxKVMRPSTDGKTVMDVIS
xxxxxxxxxxxxxxxxxxxxxxxxxxxxxxxxxxxxxPQHVEQLPKKNKIAVxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxWNVKDTACLPxxxxxxxxxxxxxxxxxxxxxxxxxxxxxxxxxx
xxxxxxxxxxxxxxxxxxxxxxxIEENEWMEDKTPxxxxxxxxxxxxxxxxxxCGSLIGTRSRATWAENVY
xxxxQVRAIIGKENYVDYMDSLQRIEDVLIQEDRxx
```

FIG. 61-19

```
>JEV|peptide_length:11|string1
MTKKPGGPGKNRAINMLKRGLPRVFPLVGVKRVVMSLLDGRGPVRFVLALITFFKFTALAPTKALLGR
WKAVEKSVAMKHLTSFKRELGTLIDAVNKRGRKQNKRGGNExxxxxxxxxxxxxxAGAMKLSNFQGK
LLMTINNTDIADVIVIPTSKGENRCWVRAIDVGYMCEDTITYECPKLTMGNDPEDVDCWCDNQEVYVQ
YGRCTRTRHSKRSRRSVSVQTHGESSLVNKKEAWLDSTKATRYLMKTENWIIRNPGYAFLAAxxxxxx
xxxxGQRVVFTILLLLVAPAYSFNCLGMGNRDFIEGASGATWVDLVLEGDSCLTIMANDKPTLDVRMI
NIEASQLAEVRSYCYHASVTDISTVARCPTTGEAHNEKRADSSYVCKQGFTDRGWGNGCGLFGKGSID
TCAKFSCTSKAIGRxIQPENIKYEVGIFVHGTTTSENHGNYSAQVGASQAAKFTVTPNAPSITLKLGD
YGEVTLDCEPRSGLNTEAFYVMTVGSKSFLVHREWFHDLALPWTSPSSTAWRNRELLMEFEEAHATKQ
SVVALGSQEGGLHQALAGAIVVEYSSSVKLTSGHLKCRLKMDKLALKGTTYGMCTEKFSFAKNPADTG
HGTVVIELSYSGSDGPCKIPIVSVASLNDMTPVGRLVTVNPFVATSSANSKVLVEMEPPFGDSYIVVG
RGxxxxxHHWHKAGSTLGKAFSTTLKGAQRLAALGDTAWDFGSIGGVFNSIGKAVHQVFGGAFRTLFG
GMSWITQGLMGALLLWMGVNARDRSIALAFLATGGVLVFLATNVHADTGCAIDITRKEMRCGSGIFVH
NDVEAWVDRYKYLPETPRSLAKIVHKAHKEGVCGVRSVTRLEHQMWEAVRDELNVLLKENAVDLSVVV
NKPVGRYRSAPKRLSMTQEKFEMGWKAWGKSILFAPELANSTFVVDGPETKECPDEHRAWNSMQIEDF
GFGITSTRVWLKIREESTDECDGAIIGTAVKGHVAVHSDLSYWIESRxNDTWKLERAVFGEVKSCTWP
ETHTLWGDGVEESELIIPHTIAGPKSKHNRREGYKTQNQGPWDENGIVLDFDYCPGTKVTITEDCGKR
GPSVRTTTDSGKLITDWCCRSCSLPPLRFRTENGCWYGMEIRPVxHDETTLVRSQVxxxxxGEMVDPFQ
LGLLVMFLATQEVLRKRWTARLTIPAVLGALLVLMLGGITYTDLARYVVLVAAAFAEANSGGDVLHLA
LIAVFKIQPAFLVMNMLSTRWTNQENVVLVLGAAFFQLASVDLQIGVHGILNAAAIAWMIVRAITFPT
TSSVTMPVLALLTPGMRALYLDTYRIILLVIGICSLLQERKKTMAKKKGAVLLGLALTSTGWFSPTTI
AAGLMVCNPNKKRGWPATEFLSAVGLMFAIVGGLAELDIESMSIPFMLAGLMAVSYVVSGKATDMWLE
RAADISWEMDAAITGSSRRLDVKLDDDGDFHLIDDPGVPWKVWVLRMSCIGLAALTPWAIVPAAFGYW
LTLKTTKRGGVFWDTPSPKPCSKGDTTTGVYRIMARGILGTYQAGVGVMYENVFHTLWHTTRGAAIMS
GEGKLTPYWGSVKEDRIAYGGPWRFDRKWNGTDDVQVIVVEPGKAAxxIQTKPGVFRTPFGEVGAVSL
DYPRGTSGSPILDSNGDIIGLYGNGVELGDGSYVSAIVQGDRQEEPVPEAYTPNMLRKRQMTVLDLHP
GSGKTRKILPQIIKDAIQQRLRTAVLAPTRVVAAEMAEALRGLPVRYQTSAVQREHQGNEIVDVMCHA
TLTHRLMSPNRVPNYNLFVMDEAHFTDPASIAARGYIATKVELGEAAAIFMTATPPGTTDPFPDSNAP
IHDLQDEIPDRAWSSGxxxxxxWITEYAGKTVWFVASVKMGNEIAMCLQRAGKKVIQLNRKSYDTEYP
KCKNGDWDFVITTDISEMGANFGASRVIDCRKSVKPTILEEGEGRVILGNPSPITSASAAQRRGRVGR
NPNQVGDEYHYGGATSEDDSNLAHWTEAKIMLDNIHMPNGLVAQLYGPEREKAFTMDGEYRLRGEEKK
NFLELLRTADLPVWLAYKVASNGIQYTDRKWCFDGPRTNAILEDNTEVEIVTRMGERKILKPRWLDAR
VYADHQALKWFKDFAAGKRSAVSFIEVLGRMPEHFMGKTREALDTMYLVATAEKGGKAHRMALEELPD
ALETITLIVAITVMTGGFFLLMMQRKGIGKMGLGALVLTLATFFLWAAEVPGTKIAGTLLIALLLMVV
LIPEPEKQRSQTDNQLAVFLICVLTVVGVVAANEYGMLEKTKADLKSMFGGKTQASGLTGLPSMALDL
RPATAWALYGGSTVVLTPLLKHLITSEYVTTSLASINSQAGSLFVLPRGVPFTDLDLTVGLVFLGCWG
QITLTTFLTAMVLATLHYGYMLPGWQAEALRAAQRRTAAGIMKNAVVDGMVATDVPELERTTPLMQKK
VGQVLLIGVSVAAFLVNPNVTTVREAGVLVTAATLTLWDNGASAVWNSTTATGLCHVMRGSYLAGGSI
AWTLIKNADKPSLKRGRPGGRTLGEQWKEKLNAMSREEFFKYRREAIIEVDRTEARRARRENNIVGGH
PVSRGSAKLRWLVEKGFVSPIGKVIDLGCGRGGWSYYAATLKKVQEVRGYTKGGAGHEEPMLMQSYGW
NLVSLKSGVDVFYKPSEPSDTLFCDIGESSPSPEVEEQRTLRVLEMTSDWLHRGPREFCIKVLCPYMP
KVIEKMEVLQRRFGGGLVRLPLSRNSNHEMYWVSGAAGNVVHAVNMTSQVLLGRMDRTVWRGPKYEED
VNLGSGTRAVGKGEVHSNQxKIKKRIQKLKEEFATTWHKDPEHPYRTWTYHGSYEVKATGSASSLVNG
VVKLMSKPWDAIANVTTMAMTDTTPFGQQRVFKEKVDTKAPEPPxGAKEVLNETTNWLWAHLSREKRP
RLCTKEEFIKKVNSNAALGAVFAEQNQWSTAREAVDDPxFWEMVDEERENHLRGECHTCIYNMMGKRE
KKPGEFGKAKGSRAIWFMWLGARYLEFEALGFLNEDHWLSRENSGGGVEGSGVQKLGYILRDIAGKQG
GKMYADDTAGWDTRITRTDLENEAKVLELLDGEHRMLARAIIELTYRHKVVKVMRPAAEGKTVMDVIS
REDQRGSGQVVTYALNTFTNIAVQLVRLMEAEGVIGPQHLEQLPRKNKIAVRTWLFENGEERVTRMAI
SGDDCVVKPLDDRFATALHFLNAMSKVRKDIQEWKPSHGWHDWQQVPFCSNHFQEIVMKDGRSIVVPC
```

FIG. 61-20

RGQDELIGRARISPGAGWNVKDTACLAKAYAQMWLLLYFHRRDLRLMANAICSAVPVDWVPTGRTSWS
IHSKGEWMTTEDMLQVWNRVWIEENEWMMDKTPITSWTDVPYVGKREDIWCGSLIGTRSRATWAENIY
AAINQVRAVIGKENYVDYMTSLRRYEDVLIQEDRVI

>JEV|peptide_length:11|string2

MTKKPGGPGRNRAIYMLKRGLPRVFPLVGVKKVVMSLLDGRGPVRFVLALTSFFKFTALAPTKALLGR
WRALERSVAMKHLTSFKRELGTLIDAVNKRGKKQNKRGGNExxxxxxxxxxxxxxxVGAMRLSNFQGK
LLMTVNNTDIADVIVxxxxxxxxRCWVRAIDVGHLCEDTITIYECPKLAVGNDPEDVDCWCDNQQVYVQ
YGRCTRTRHSKRTRRSVSVQPNGESSLVNKKEAWLDSTKATRYLTKTENWIVRNPGYAFLAAxxxxxx
xxxxGQRLGFTILLLLVAPAYSFTCLGMGNRDFIQGVSGATWVDLVLEGDSCLTIMASDKPTLDVRMI
NIEAVQLAEVRSYYYRASVTDISTVARCPMTGEAHNKKGADSSYVCKQGFTDRGWGNGCGFSGKGSID
TCAKFSCTRKAIGRxIQPENIKYKVGIFVHGATTSENHGNYSAQVGASQAAKFTITPNAPSTALKLGD
FGEVTLDCEPKSGLNTEAFYVMTVGSRSLLVHREWFHDLSPWTPSSNTAWRNRELLMEFEGAHATKQ
SVVALGSQEGGLHHALAGAIVVEYSSSVMLTSGHVKCRLRMDKLALKGTTYGMCTGKFSFAKNPVDTG
HGTVVIELTYSGSDGSCKIPIVSVASLNDLTPAGRLVTVNPFVATSSSNSKALLEIEPPFGDSYIVVG
RKxxxxxxHHWHKAGSTLGKAFLTTLKGAQRLVALGDTAWDFGSIGGVFNSIGRAVHQVFGDAFRTLFG
GMSWITQGLMGALLLWMGINARDRSIAMAFLVTGGTLLFLATNVHADTGCAIDITRRQMRCGSGIFVH
xxxxxxxDRYKYLPETPRSLAKIVHKAHQEGICGIRSVTRLEHQMWESVRDELNVPLKENAVDLSVxV
NKPVGRYRSAPKRLSMTREKVEMGWKAWGKSILFAPEMANSSFVVDGPETKECPDERRAWNSTQIEDF
GFGITxTRVWLKIREENTDECDGPIIGTAVKGNVAVHSDLSYWIESHxNDTWKLERAVFGEVKSCTWP
ETHTLWGDDAEESELIIPHTIAGPRSKHNRREGYRTQNQGPWDEDGLVPGFDYCPGTKVTITEDCGKR
GPSIRTTTDIGKLITDWCCRSCSLPPLGFRTGSGCWYGMEIRPLxHDEATLVRSQVxxxxGEMIDPFQ
LGLLVVFLATQEVLRKRWTARLTIPAVLGVLLVLMLGGITYIDLARYVVLVAAAFAEANNGGDVLHLA
LIAVFKIQPAFLVMNMLSARWTNQENVALVLGAAFFQLASADLQIGVHGILNAAAMAWMIVRAITFPT
TSTVAMPILALLAPGMRAFYLDTYRIILLVIGICSLLHERRKTMAKKKGAVLMGLALTSTGWFSPTTI
AAGLMACNPNKKRGWPATEFLSAIGLMFAIVGGLAEMDIESMSIPFMLAVLMAVSYVVSGKATDMWLD
RAADISWEMEAAITGSSRRLDVKLDEDGDFHFIDDPGVPWKVWLLRMSCSCLVALTPWAIVPAxxxxx
xxxxxxxxxxFWDTPSPKPCLKGDTTTGVYRIMARGILGTYQSGVGVMYESVLHTLWHTTRGAAIVS
GGGKLTPYWGSVKEDRISYGGPWRFDRKWNGTDDVQVIVVEPGKPAxxIQTKPGIFPPPFGEIGTVSL
DYPRGTSGSPILDSNGDVVGCLGNGGELGDGSYVSAIVQGDRQEEPVPDAYTPSMLKKRQLTVLDLHP
GSGKTKKILPQIIKDAIQQRLKTAVLAPTRVVAAEMAEALKGLPVRYQTSAVQRSHQGNAIVDVMCHA
TLTHRLTSPNRVPNYNLxxMDEAHFTDPAGIAARGYIATKxxxxEAAAIFMTATSPGTTDPFPDSNAP
IHDLQDETPDRAWSSGxxxxxxWITDYSGKTVWFVASVRMGNEIAVCLQRAGKRVIQLSRKSYDTEYP
KxxxxxxDFVITTDISEVGANFGASRVIDCRKSVKPIILEKEEGRVILGNPSPITNASAAQRRGRVGR
NPNQVGDEYHYGGPTSEGDGNLAHWTEAKILLDNIHMPNGLVVQLYGPEREKASTMDVEYRLRGEEKK
xxxxxxxTADLPVWLAYRVASNGIQYTDRRWCFDGPRTNAILEDNIEVEIVTRTGERKILKPRWLYAR
VYADHQALKWFKDFAAGKRSAISFIEVPGRMPEHFAGKTREALDTMYLVATAERGGKTHRMALEELPD
ALETITLIAAITVMTGGFFLLMMQRKGIGRMGLGALVLVLATFFLWAAEVPGTKIAGTLLVALLLMVV
LIPEPGKQKLQTGNQLAVFLICVLTVVGMAAANEYGMLEKTKADLKSMFGGRTQAPGLTGLPSVTLDL
RPATAWAWYGGSTVVLTPLLKHIITSEYVTTSLASISSQAGSLFVLPRGVPSTDLDLTVGLVFLGCWG
QITLTTFLTAMVLVTLHYGFMLPGWQAQALRAAQRRTAxxxxxxxxxxxMVATDVPELEKTTPLMQKK
IGQVLLIGVSVAALLVPNIITTVREAGVLVTARTLTLWDNGASAAWNSTTATGLCHVMRGSYLRGGSI
AWTLIKNADKPSLKKGRSGGRTLGEQWKEKLNAMSRDEFFKYRREAIIEVDRTEARRARRENNVGGH
PVSRGSxxLRWLVEKGFVPPIGKVIDLGCGRGSWNYYAATLKKVQEVKGYTKGGAGHEEPMLMQSYGR
NLVSMKSGVHVFYRPSEPSDTLLCDIGESSPSPDVEEQRTLRVLxMTSDWLHRGPIEFCIKVLCPYMP
KVIEKNEVLQRRFGGGVVRLPLSRNSNHEMYWVSGPAGNVVHAVNMTSQVLLGRMDRAVWRGPKYKED
VNLGSGTRAVGKGEIHSNQxKIRKRIQKLREEFGTTWHKDHEHPYRNWTYHGSYEVRANGSASSLVNG
VVELMSKPWDTISYVTTMPMTDTTPFGQQRVFKEKVGTKAPEPPxGVREVLNETTNWLWAYLSRKKRP
RLCTKEEFIRKVNSNASLGTVFAEQNQWSTAREAVGDPxFWEMVNVERENHLRGECHTCVYHMMGKRE

FIG. 61-21

KKPGxxxxxxxxxxxxxxxxARYLEFEALGFLNLDHWLSRRNSRGGVEGSSVQKLGYISRDIAVKQG
GKMYADDTAGWDTRITRADLENEAKVLELLDGEHRKLARAIIELTYKHQVFKVMRPAAGGKTGMAVYS
RENQRGSGQVVTYxLNTFTNIAVQLVRLMKVEGVIGPQHLEQLPRKTKIAVRTWLFENGEERVSRMAI
SGDDCAVKPLDDRFATSLHFLNAMSKVTRDIQEWKPSHGWHDWLHVPFCSNHFHEIVMKDGRSLVVPC
RGQDELIGRARISPGAGCNVMDTACLAKAYAQMWLLLYFHRRYQCLMANAICSAVPVNWVPTGRTSWS
KHSKGEWMTTENMLQVWNKVWIEENEWMVDKTPVASWTDVPYVGKREDIWCGSLIGTRTKATWAENIY
AAINQVRAIIGKETYVDYMLSLRRYEDVLVQEDRVI >JEV|peptide_length:11|string3

MTKKPRGPGKSRAINMLKRGLPRVFPLVRVKRVVISLLDGRGPARFVLALVSFFKFTALAPTKALSGR
WKAVERSVAMKHLTSFKRELGTLIDTVNKRGRKRNKRGGNExxxxxxxxxxxxxxxxAGAIKLSNFQGK
LLMAVNNTDIADVIxxxxxxxxxxxCWVRAIDVGYLCEDTITYECxxxxAGNDPQDVDCWCDHQEVYVQ
YGPCTRTSHSKRSRRSVSVHTHGERSLVNKKKAWLDSTRATRYLMKTENWIIRNPGYAFLAVxxxxxx
xxxxGPRVVFTILPLLVAPAYSFNCLGMGNRDFVERASGATWVDLVxxxDSCLTIMANDKPTLDVRMT
NIEASQLAEVRSYCYRASVTDISTxxRCPTTGEAHNEKQADSSYVCKQGFTDRGWGKGCGLSGKGSID
TCAKFSCTNKAIGRxIQPENSKYKVGIFVHGTTTSENHGNYSAQVGTSQAAKFTVTPNAPSVTLELGD
YGEVTLDCEARSGLNTEAFYVMTVGSKSLLVHREWFHDLALPWSSSSNTAWRNRELLMEFEQAHATKQ
SVVALGSQERALHQALAGAIVVEYSSSVKLTSGHLKRRLKMDKLALKGTTYGMCTENSSFRKNPADTG
HGTVVIELSYSGRDGPCKIPIVSVVNLNDMTPAGRLVTVNPFVAASSSNSQVLLEIEPPFGDSYIVVG
RExxxxxHHWYRPGSTLGKAFSTTLKGAQRLVxxxxTAWDFGSIGGIFNSIGRAVHQVFGDAFxxxxx
xxxxxxxxLMGVLLLWMGINARNRSIALAFLATxxxxxxxxxxVHADTGCAIDTARNQMRCGSGIFVx
xxxxxxxxRYKYLPETPKSLAKIVHKAYKEGVCGIRSVTRLExxxWEAVRDELNVPLKxxxxxxxxxx
xxxxGRYRSAPKRLFMTQEKVEMGWKAWGKSLLFAPELANSSFVVDGPETKECPDERRAWNSTQIEDx
xxxxxxTRVWLKIREESTDECDGAIIGTAIKGHVTVHSDVSYWIESRxNDSWKRERLVFEEIKSCTWP
ETHSLWGDGVEESDLIIPHTLAGPKSKHNRREGYMTQNQGPWDEKGIVLDLDYCPGTTVTITEDCSKR
GPSVRTTTDIGKLITDWCCRSCTLPPLRFRTDNGCWYGMEIRPAxHDEATLVRSQAxxxxGGMVDPFQ
MGLLVMFLATQEVLGKRWTARLTVPAVLGALLVLMFGGITYTDLARYVVLVAASFAEANSGGDVxxxx
xxxVFKIQPAFLAMNTLSTKWTNQENVVLVLGAALFQLASADLQIGVHGMLNAAAIAWMIVRAITFPT
ASSVTMPVLALLTPGMKALCLDTYRIILLVIGVCSLLQERKRAMAKKKGAVLLxxxxxxxxxxSPTTI
TAGLMVCNPNKxxGWPATEVLSAVGLMFAIxxxxxxxxxxxxxxxxxxxxxxxxxxxxxSGKATDMWLE
RAADVSWDMGAAITGSSRRLxVKLDDDGDFHLIDVPGVPWKVWVLRMSCIGLVALTPWAIVxxxxxxx
xxxxxxxxxxxFWDTPSPKPCAKGDTTTGVYRIMACGIFGTYQAGVGVMYENVFHTLWHTTRGAAVMS
GKGKLTPYWGSVREDRIAYGGPWxxxxxxxxxTNDVQVIVVEPGKGAxxIQTKPGVFCTPFGKVGTVSL
DYPRGTSGSPILNFNGDIIGLYGNGVELGDRSYVSAIVQGERQEEPVPEAYTPTMLRKKQLTVLDLHP
GSGKTRKILPQIIKDAIQQHLRTAVLAPTRVVAAEMAEVLRGLPVRYQTSAVQREHQGNAIVDVMxxx
xxxxxxxxxxxxxxxxxxxxxxxxxxxxxxxxxxxxxxxxxxxxxxxxxxxxxxxxxxxxxxSNAP
IHDLQDEIPDWAWSSGxxxxxxWITEYSGKTVWFVASVKMGNEIAMCLQRAGKKVIQLSRKSYDxxxx
xxxxxxxxxxxxxxxxxxxxxxxxxxVIDCRKSVKPTILEEGEGRVFLGNPSPITSAxxxQRRGRVSR
NPSQVGDEYHYGGATSEDDGNLAHWTEAxxxxxxxxxxxxxxQLYGPEREKALTMDGEYRLRGxxxx
xxxxxxxxxLPVWLAYKVAPNGIQYTDRKWxxxxPRTNAILEDNTEVEIVTRTGERKVLKPRWLDAR
VxxxxxxxxxxKDFAAGKRSAISFIEVLGRMPEHFAGKxxxxxxTMYLVATAEKSGKAHRMALEELPD
ALETITLTVAITVMTRGFFLLMMQRKGIGKMGLGALVLVLxxxxxxxxxxSGTKIAGTLLIxxxxxVV
LIPEPEKQRSQTGNQLAVFLICVLTVVGVVAANEYGMLEKTKADLKSMFAGKAPVSGMTGLPSMTLDL
RPATAWxxxxxxxxxxxxxxxxxxKHLITSEYVTPSLASISSQAGxxxxxxxxxxxxxxxxxxxxxGLVLLGCWG
QVTLTTSLTAVVLTILHYGYMLPGWxxxxxxxxxxxxxxxxxxxxxxxxxxxxxxxxxxxxxxxxxxxx
xxxVLLIGVSVAAFLVNPNVSTVKKPGVLVTAATLSLWDNGASAVWxxxxxxxxxxxxxxxxxxxxxxxI
AWTLIKNANKPSLKRGRPGGRTLGEQWKEKLNAMGREEFFQYRREGIIEVDRTEACRARRENNKVGGH
PVSRGSxxxxxxxxKGFVSPIGKVIDLGCGRGGWSYCAATLKRVQEFRGYTKGGAGHEEPMPMQSYGW

FIG. 61-22

```
NLVSLKSGVDVFYRPSEPSDxxxxxxxxxxxxxxxxxxxxxxxxxxxxxxxxxxxxxxxxxCPYMP
KVIEKIEVLQRRFGGGxxxxxxxxxxxxxxxxxxxxxxxxxxxxxxxSQVLLGRMNRTVWRGPRYEED
VNLGSGxRAVGKGEVHSDQxKIRKRIQKQKEEFATTWHRDPEHPYRTWTYHGSYEVKANGSASSLVNx
VVKLMSKPWDAISYVTTMPMTxxxxxxxQRVFKEKVGTMAPEPPxGVREVLNETTNWLWAHLSRKKRP
RLCTKEEFIKKVNSSASLGAVFAEQNQWSTAREAVSDPxLWEIVDVERENHLRGECHTCVYHMMGKRE
KKxxxxxxxxxxxxxxxxxxxxxLEFEALGFLNEDHWLSRENSGGGVEGLGVQKLGYIIGDITRKAI
GKMYADDPAGWDTRITKTDLENEAKVLxxxxxxxxxxxRAIIELTYRHKVVVKVMRPAAKGKTVMVVIS
RENQRGSGQxxxxxxxxxTNIAVQFVRLVEAEGVIGPQHLEHLPKENKIAVRTWLFENGGERVTRMAI
SGDDCAxxPLDDRFATALHFLNAMSKVRKDIQQWKPSHGWLDWQQVPFCSNxxxxIVMKDGRSILDPC
RGQDELIDRARISPGAGWNVRDTACLPKAYAQMRLLLYFHRRDLRLMANAICSTVPLDWVPTGRTSWS
IHSKGEWIPTEDMLQVWNRVWIEENEWMTDKTPIASWTDVPYVGxxxxIWCGSLIGTRSRATWAENVY
AAINQVRAIIGKENYVDYMTSLRRIEDVSIQEDRVI >JEV|peptide_length:11|string4

MTKKPGGPGINRAIYMLKRGxxxxFPLVGVKRVVISLLDGIGPLRFVLAFITFFKFTALSPTKALSGR
WRALEKSVAMKHxxxFKGELGTLIDVVNKRGRKQNKRGGNGxxxxxxxxxxxxxxxxAGALKLSNFQGK
LLxxxxxxxxxxxxxxxxxxxxxxxxxxxxxxxxxxxxxxxxxxxxxTGNDPEDVDCWCDNQEVYIQ
YGRCTRTRHSKRSKRSVSVQTHGESSLENKKEAWLNSTKATRYLVKTENWIIRNPGYAFLAGxxxxxx
xxxxGQRVVFTILPLLxxxxxxxxxLGMGNRDFIERASGATWVDLxxxxxxxxxxIMANDRPTLDRRMI
NIEASQLxxxxxxxxxxxxxxxxxxxxxxPTTGEAHNEKQADSSYVCKxxxTDRGWRNGCGLSGKGSIx
xCAKFSCTSKATGKxIQSENIKYEVGIFVHGATTxxNHGNYTAQIGVSQAAKFTVTPNAPSVTLELGD
YGEVTxxxxxxxxxxxxxFYVMTVGPKSFLVHREWFHDLALPWTSSSNTAWRNRxxxxxxxxxxxxxx
SVVALGSREGSLHQALAGAIVVEYPNSVKLTSGHLKxxxxxxxxxLKGTTYGMCTKKFSFAKNPADxx
xxTVVIELLYSGSDGPCKIPIVSVASLNDMTPAGRLxxxxPFVATSSANSKVLLEIEPPFGDSYIVVG
MGxxxxxHHWHKPGSTLGKAFSxxxxxxxxxxxxxTAWDFGSIGGAFNSIGKAVHQxxxxxxxxxxxx
xxxxxxxxxxxxxxxxxxxxxxxGVNARNRSIALAxxxxxxxxxxxxxxxVHADTGSAIDITRNQMRCGSGIxxx
xxxxxxxxxxxxxxxxxxxxxxALAKIVHKAHMEGVCGVRSVTxxxxxxxxxxxxxxxxxxxxxxxxx
xxxxxxxRSTPKRLSMTQEKxxxxxxxWGKSMLFAPELANSTxxxxGPETKECPDVQRAWNSMQIEDx
xxxxxxxxxxxxxxREENTDECDGTIIGTAVKGHVALHSDLSYWIGSRxNDTWKLERAVFEEVKSCTWP
ETHTLWGDDVEESELIIPDTIAGPKSKHNQREGYKTQNQGPWDESGIVLDFDYCPxxxxxxxTEDCGKR
APWLRTTTDSGKLIxxxCCRNCSLPPLRFRTGSGCWYGMEVRPVxHDETTLVRWQVxxxxGEMVDPFQ
MGLLVMFLATQEVFRKRWTARLTIxxxxxxxxxxxxxxxxxxxxxxxxxLVAAVFAEANSGGDVxxxx
xxxxFKIQPAFLVAKMLSTRWTNQENVILVLGAAFFQLASMDLQIGVHGILxxxxxxxxxxIKAITFPT
TSTITMPLLALLTPGMRALDLDTYRIILLVIGICSLQQEREKTMAKKKGAVxxxxxxxxxxxxxxxxx
xxxxxxxxxxxxxxxxxxxxxxxxxxxxxxxxxxxxxxxxxxxxxxxxxxxxxxxxxxxTDMWLE
QAADISWEMGAAITGSSRxxxxxxxDEDGDFHLIDDPGVPWKVWVLRTSCICLAALTPWAIxxxxxxxx
xxxxxxxxxxxxxxxxxxxxxxxxxxxxxxxxxxxxxxxxTHQAGVGVMYENVLHTLWHPTRGAAIMS
GKGKLTPYWxxxxxxxxxxxxxxxxxxxxxVQVIVVEQGKPAxxFQTKPGVFRTPLGKVGAVSL
DYPRxxxxxxxxxxxxxxxxxLYGNGVELGDRSxxxxxxQGDRQEEPVPEAYTPSMLKKKQMTVLDLPP
GLGKTRKILPQTIRDAIQQRLRTAxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxDAP
IHDLQDEVPDRAWSSGxxxxxxxWSTEYAGKTVWFxxxxxxxxxxxxxxxxxxxxxxxxxxxxxxxx
xxxxxxxxxxxxxxxxxxxxxxxxxxRKSVEPTILEKEEGRVIxxxxxxxxxxxxxxxxxxxx
xxxxxxxEYHYGGATSEDDGNLAHxxxxxxxxxxxxxxxxxPEREKAFTMDVEYRLRGxxxxx
xxxxxxxxxxxxxxxxxxxxxxxxxxxxxxxxxxDSTEVEIVTRMGxxxxxxxxxxxxxxxxx
xxxxxxxxxxKDFASGKRSATSFIEERGRMPEHFMGKxxxxxxxxxxLVATAEKSGKAHRMALExxPD
ALETVTLIVAIAAMTGGFFLLMKQRKGIEKMGLGALVLTxxxxxxxxxxxxxxxxxxxxxxxxxxxxV
LIPEPEKQRSQTGNQLAVFxxxxxxxxxxxxxxxxxxxxKTKADLKSMFVGKTQALGLTGLPGMALDL
RPATAxxxxxxxxxxxxxxxxxxxxxxxxxxxxxxxxxxxxxxxxxxxxxxxxxxxxxxGCWG
```

FIG. 61-23

```
QITLTTVLTAMVLATLHYGFMLPGxxxxxxxxxxxxxxxxxxxxxxxxxxxxxxxxxxxxxxxxx
xxxxxxxxGSVAAFLVNPKVSTVRKAGVLVTAATLSxxxxxxxxxxxxxxxxxxxxxxxxxxxxx
xxTLIKNADNPSLKRGGPGGRTLWEQWKERLNALSREEFFQYRREAIxxxxxxEARRARSENNIVGGH
PVxxxxxxxxxxxxxxxxxxxxxKVVDLGCGCGGWSYYAATLKKVQEFRGYTKGxxxxxxxxxxxxxxW
NLVSLKSGVHVFYKPxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxRMDRTVWRGPKYKED
xxxxxxxRAVGKGEVHSTQxKIKRRIQKLREEFATTWHKDHEHPYRTWTxxxxxxxxxxxxxxxxx
xxKLMSKPWDAISxxxxxxxxxxxxxxxxxxxxxxxxxxxxxxxxxxxxxxxxxxxxxxxxxxxx
xxxxKEEFIKKVNSDAALGAVFAEQNQWSTAREAVNDPxFWEMVDVERENHLRGECHTRIYNMMGKRE
KxxxxxxxxxxxxxxxxxxxxxxxxxEFEALGSLNENHWLSRENSGGGEEGSGVQKLGYIFRDIASREG
GKMYADDTAGWDTRITKTxxxxxxxxxxxxxxxxxxxxxxxxxxxxxxxHKVVKVMRPASDGKTVMDVIS
RxxxxxxxxxxxxxxxxxxxxxxxxxxxxxxxxIGPQHVEQLPRENKIAVRTWLxxxxxxxxxxxxx
xxxxxxxxxxxxxxxxxxxxxxxxxYFLNAMSKVRKDILEWKPSHGWHDxxxxxxxxxxxxxxxxx
xxxxxxxxxxRISPGAGWNVKDTACLPKAYAxMWVLLYFHRRDLRLMANAICSAVPVNWVPTGRxxxx
xxxxxxxxxxxxxxxxxxxxxxxxRVWIEENEWMEDMTPITSWTDVPxxxxxxxxIWCGNLIGTRARATWAENIY
AxxNQVRAILGKEDYVDYMDFLQRYEDVLTQEDRVI >JEV|peptide_length:11|string5 xxxxxxxxxxxxxxxxxxxxxxxxxxxxxxxxxRGPVRFVLAFITFFxxxxxxxxxxALLGR
WRALEKSVxxxxxxxxFKRELGILIDGVNKRGRKxxxxxxxxxxxxxxxxxxxxxxVGALKLSNFQGx
xxxxxxxxxxxxxxxxxxxxxxxxxxxxxxxxxxxxxxxxxxxxxxxxxxxxxPGNDPQDVDCWxxxxxxxxxx
xxxxxxxxxxQTSRRSVSVQPNGxxxxxxxxxxxxxxxxxxxxxxxxxxxxxxxxxxxxxxxxxxx
xxxxGHRVVFTILLLLxxxxxxxxxxxGMGNRDFIERASGATWVDxxxxxxxxxxxxxNDKPTLDVRMT
xxxxxxxxxxxxxxxxxxxxxxxxxxxxxxxxxPTTGEAHNEKQAxxxxxxxxxxxxDRGWGNGCGLSGKGSxx
xxAKFSCTSKAIERxxxxxxxxxxxxxxxxxxxxxxxxxxxSAQVGASQAARFTVTPNAPSVTLELGD
xxxxxxxxxxxxxxxxxxxxxxxxxxxxxxxxxxxFHDLALPWSSPSSTAxxxxxxxxxxxxxxxx
xxxALGSQERALHQALAGxxxxxxxSNSVKLTSGHLxxxxxxxxxxxKGTTYGVCTENSSFRKNPADxx
xxxxxIELSYSGSDGSCKIxxxSVANLNDMTPVGRxxxxxxFVATSSSNSQVLVEMEPxFGDSYIVIG
RGxxxxxHHRHKAGSTLGKAxxxxxxxxxxxxxxxxxxxxxxxxxSIGRVFNSIGKAVHxxxxxxxxxx
xxxxxxxxxxxxxxxxxxxxxxxxxxxxxxxxxxxxxxxxxxxxxxxxxHADTGCAIDVTRxxxxxxxxxxx
xxxxxxxxxxxxxxxxxxxxxxxxSLAKIVHKAHMEGICGVRSVTxxxxxxxxxxxxxxxxxxxxx
xxxxxxxxxxxxxxxxxxxxxxxxxxxxxxxxxxxxxxxxxxxxxCPVERRAWNSTQIExx
xxxxxxxxxxxxxREETTDECDGAIIGTAVKGHVALHSDLxxxxxxxxNDTRKLERAVFGEVxxxxxx
xxxTLWGDGVEESDLVIPHTIAGPKSKHNRREGYMxQNQGPWDENGLVPGLDYCPxxxxxxxTEDCGKR
GPSLRTTTxxxxxxxxxxxxxxxxxxxxxxxxxxxxxxxxxxxHDETTLVRSRVxxxxxxxxxxxx
xxxxxxxxxxxxxxxxxxxxxxxxxxxxxxxxxxxxxxxxxxxxxxxxxxxxxxxxxxxxxxxxx
xxxxxxxxPAFLAMNTLSAKWTNQENMVLVLGAAFFQxxxxxxxxxxxxxxxxxxxxxxxxAITFPT
TSTVTMPVLTLLTPGMRALCLDTxxxxLLIIGVCSLLQERRRTMAKKKGAVxxxxxxxxxxxxxxx
xxxxxxxxxxxxxxxxxxxxxxxxxxxxxxxxxxxxxxxxxxxxxxxxxxxxxxxxxxxxxxxxx
xxxxxSWGMDAAITGSSRxxxxxxxxxxxxxxxxxxxxxWKIWLLRMSCIGLVALTPxxxxxxxxxx
xxxxxxxxxxxxxxxxxxxxxxxxxxxxxxxxxxxxxxxxYQAGVGVIYQNVFHTLWHTTRGAAIMS
GGGKLTPYxxxxxxxxxxxxxxxxxxxxxxxxxxxVQVIVVEPGKVAxxIQTKPGIFPTPFGKVGTVSL
DYxxxxxxxxxxxxxxxxxxxxxxxxxxxxxxxxxxxxxxxxxEEPIPEAYNPSMLxxxxxxxxxxx
xxxxxxxxxxxIIRDAIQQRLRxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxEYGGATSEDDSxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
```

FIG. 61-24

```
xxxxxxxxxxxxxxxxxxKRSAVSFIEEPGRMPxxxxxxxxxxxxxxxxxxxxxxxxxxxxxxxxPD
ALETITLIIAIxxxxxxxxxxxxxxxxxxxxxxxxxxxxxxxxxxxxxxxxxxxxxxxxxxxxxxx
xxPEPEKQKSQTDNQLxxxxxxxxxxxxxxxxxxxxxxxxxRTKADIKSMFAGKxQASGLTGLPSVxxxx
xxxxxxxxxxxxxxxxxxxxxxxxxxxxxxxxxxxxxxxxxxxxxxxxxxxxxxxxxxxxxxxxxx
QITLTTVLTAVVLAILHYGYMLPGxxxxxxxxxxxxxxxxxxxxxxxxxxxxxxxxxxxxxxxxxx
xxxxxxxxxxxxxxFLVNPNVTTVKxxxxxxxxxxxxxxxxxxxxxxxxxxxxxxxxxxxxxxxxx
xxxxIKNADKPSFKRGGPGGRTLGDQWKRKLNAMSREEFFQYRRxxxxxxxxxxEARRARRENNKVGxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxDRAVWRGPKYExxx
xxxxxxxxxxxxxxxxxxxxxxxKIRKRIQKLREGFATTWHKDPExxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
xxxxKEEFINKVNSNASLGTVFAEQxxWSTAREAVGDSxFWEMVDVERENxxxxxxxxxxxxxxxxxx
xxxxxxxxxxxxxxxxxxxxxxxxxxxxxxxxxxFLNLDHWLSRENSGGGVEGLGVQKLGYIFRDxxxxxx
xxxxxxxxxxxxxxxxxxxxxxxxxxxxxxxxxxxxxxxxxxxxxxKVMRPSTEGKTVMVVYS
RxxxxxxxxxxxxxxxxxxxxxxxxxxxxxxxxxxxxxGPQHLEQLPKKNKIAVRxxxxxxxxxxxxxxx
xxxxxxxxxxxxxxxxxxxxxxxxxxxxxxxxxxxxxxxxxxxxxxxxxxxxxxxxxxxxxxxxxx
xxxxxxxxxxxxxxxxxGWNVKDTACLPKxxxxxxWLLLYFHRRDQRxxxxxxxxxxxxxxxxxxxxxx
xxxxxxxxxxxxxxxxxxxxRVWIEENEWMMDMTPxxxxxxxxxxxxxxxxxWCGSLIGTRSRATWAENVY
AxxNQVRAIIGKENYVDYMLSPRRYEDVSIQEDRVxx
```

FIG. 62-1

>DENVall|peptide_length:8|string1

```
xxxxxxxxxxPPFNML

FIG. 62-2

SLMYFHRRDLRLAANAICSAVPVxWVPTSRTTWSIHAHHQWMTTEDMLTVWNRVWIEENPWMEDKTxx
xxxxDVPYLGKREDQWCGSLIGLTSRATWAKNIxxAITQVRNLxxxxxxxDYMPSMKRFRxxxxxxxx
xx >DENVall|peptide_length:8|string2 xxxxxxxxxxPSFNMLKRARNRVSTPQGLVKRFSTGLLNGKGPLRMVLAFITFLRVLSIPPTAGVLAR
WGTFKKxxxxxxxxxGFKKEISNMLSIINxxxxxxxxxxxxxxxxxFHLTSRDGEPRMIVxxNEKGKS
LLFKTSxxxNKCTLMAMDLGEMCDDTMTYKCPxxxxxEPDDIDCWCNSTDTWVTYGTCNxxGEHRREK
RSVALVPHVGMGLETRAQTWMSAEGAWRQVExVESWILRNPGFxxxxxxxxxxxxxxxxxxxxxxxx
xxxxxxxxMRCIGISNRDFVEGVSGGAWVDVVLEHGGCVTTMAQGKPTLDIELLKTxxxxxxxLRKLC
IEGxxxxxTTATRCPTQGEPxxxxxxxxxxxxxxxxxYVDRGWGNxCGLFGKGGVVTCAKFxxxxxxxx
xxxxENLEYTVVxTVHNGDTHxxxxxxxxxxxxxxxxxxxxxxxxxxxxxxxxxGLDCEPRSGLDFNEM
ILLxxxxKAWMVHRQWFFDLPLPWTxxxxxxxxxxxxKELLVTFKNPHAKRQDVTVLGSQEGAMHSAL
TGATEVDSGxxxxMFAGHLKCRLKMDKLELxxxxxxxxxxxxxxxxxEVSETQHGTILxxxxxxxxxx
xxxxxxxxxxxxxxxxxxxxxxxxxxxxxxTNIELEPPFGESNIxxxxxxxxxxxxxxxxRKGSSIGQ
MFESTYRGAKRMAILGETAWDFGSIGGVxxxxxxxxxxxFGSAYTALFSGVSWMIRIxxxxLLTWIGL
NSKNxxxxxxxxxxxxxxxxxxxxxxxxxxxxxxxGRELKCGSGIFITNEVHTWTEQYKFQPESPSR
LSAAIGKAWxDGICGIRSTTRLENLMWKQIxxxxxxxxxxxxxxxxxxxxxxxxxxxxxxxxxxxx
xxKYSWKSWGKAKxxxxxxxxxxxFLIDGPETxxxxxxxxxxxxLEVEDYGFGIFTTNIWMKFxxxxxx
xCDSKLMSAAVKDQRAVHADMGYWIESEKNETWKLEKASFIEVKTCxWPKTHTLWSNGVLESDMIIPK
xxAGPISQHNYRQGYxTQTVGPWHLGKLEIDFxxxxxxxxxxxxxCGHRGPSLRTTTASGKLVTQWCC
RSCTLPPLRYLGEDGCWYGMEIRPVSEKEENMVxxxxxxxxxxxxxxxxxxxxxxxxxxxxxxxxxx
xxxxxxxxxxxxxxxxxxxxxxxxxxxxxxxxxxxxxxYLALMATFxxxxxxxxxxxLLRRLT
SREVLLLTxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxSWPLNEGVMAVGLV
SLLGSSLLKNDVPLAGPMVAGGLLLAAYVMTGRSADLELERAxxxxxxxMADITGSSPIxxxxVDDDG
TMKIKDEERDxTITLLVKLALITVSGxxxxxxxxxxxxxxxxxxxxxSGALWDVPSPAAxxxxxLDE
GVYRIKQQGILGKTQVGVGVFQEGTFHTMWHVTRGAVLMHxGKRIEPSWADVRNDMISYGGGWKLxxx
WDKGEEVQVLALEPGKNPKHVQTxxxxxxxxxEGEIGAVSLDFSPGTSGSPIVNxKGKVIGLYGNGVVT
TSGDYVSAIAQTExxxxxxxxxxxxxMFKKKNLTIMDLHPGAGKTKRILPSIVREAIKRGLRTLILAP
TRVVASEMAEALKGLPIRYQTTAVKSEHTGKEIVDLMCHATFTTRLLSSTRVPNYNLIVMDEAHFTDP
SSVAARGYISTRVEMGEAAGIFMTATPPGTxDPFPQSNAVIEDEERDIPERSWNSGHxxxxxxYQGKTV
WFVPSIKAGNDIAACLRKNGKRVIQLSRKTFDTEYPKTxNTDWDYVVTTDISEMGANFRAERVIDPRR
CMKPVILTDGEERVILAGPIPVTPSSAAQRRGRVGRNPxQEDDQYVFMGEPLENDEDCAHWKEAKMLL
DNIYTPEGIIPTLFEPEREKVQAIDGEFRLRGEQRKTFVDLMKRGDLPVWLAHKVAAEGINYxDRKWC
FDGxRNNQVLEENMEVEIWTREGEKKKLKPRWLDARVYADPMALKDFKEFASGRKxxxLDLILEIGKL
PxxxxxxxQLALDNLAVLHTAExxxxAYNHALNELPESLETLMLVALLATVTGGxxxxxxxxxxxGKL
SMGLIxxxxxxxxxxxxxxIQPQWIASAIILEFFLIVLLIPEPDRQRTPQDNQLAYVVIGLLxxxxxxx
xNEMGLIEKTKTDFGxxxxxxxxxxxxxxxxxxxxLDVDLHPASAWTLYAVATTIITPMLRHTIENTSAN
LSLTAIANQAAILMGLGKGWPLHRMDIGVPLLAIGCYSQVNPITLTAALxxxxVHYAIIGPxxxxxxT
REAQKRAAAGIMKNPTVDGIVAIDLDPISYDAKFEKQLGQIMLLILCTGQLLMMRTTWALCEVITLAT
GPLSTLWEGSPGKFWNTTIAVSTANIFRGSYLAGAGLLFSIMKNxxxxxxxxxxTGETLGEKWKSRLN
xxxxxxxxYKRSGILEVDRTLAKEGIKRGExTKHAVSRGSSKIRWFVERNLVxPEGKVIDLGCGRGG
WSYYMATLKNVREVKGLTKGGPGHEEPIPMSTYGWNLVRLQSGVDVFFxPTEQVDTLLCDIGESSPSP
TVEAGRTLRVLNLVENWLxxxxEFCIKVLNPYMPSVIExxxxxxxxxGGALVRCPLSRNSTHEMYWVS
CGTGNIVSAVNMTSKMLLNRFTMAxxxPTYEPDVDLGSGTRNIGIExxxPNLTIIGKRIEKIxxxxxx
TWHYDQDNPYRTWAYHGSYEAPSSGSASSMVNGVVRLLTKPWDVVPMVTQLAMTDTTPxxxxxxxxxEK
VDTRTQExxxxxxxxxxxxxxxxxxxxxxxxxxxPRICTREEFTSKVRSNAALGAIFQEEQGWTSASEAV
xxxxxxxxxxxERNLHLEGKCESCVYNMMGxxxKKLGEFGRAKGSRAIxYMWLGARYLEFEALGFMNE

FIG. 62-3

DHWFGRENSWSGVEGEGLHRLGYILRDVxxxxGGNIYADDTAGWDTRITLEDLKNExxxxxxxxxxx
xxxxSIFKLTYQNKVVKVLRPTxGAVMDVISRRDQRGSGQVVTYGLNTFTNMEVQLIRQMEAEGVxx
xxxxxxxxxxxxxxxxxxxxxxxxxDRLSRMAISGDDCVVKPLDERFxxSLLFLNDMGKVRKDIPQW
EPSKGWNDWTEVPFCSHHFHKIFMKDGREIVVPCRNQDELVGRARVSQGAGWSLKETACLGKSYAQMW
QLMYFHRRDLRLASMAICSAVPTxWFPTSRTTWSIHAKHEWMTTEDMLKVWNRVWIQDNPNMIDKTxx
xxxxDIPYLGKREDLWCGSLIGLSSRATWAQNIxxAINQVRSLxxxxxxxDYMTSMKRFKxxxxxxxxx
xx >DENVall|peptide_length:8|string3 xxxxxxxxxxPSINMLKRVRNRVSTVQQLTKRFSLGLLSGRGPLKLFMALVAFLRFLAIPPTAGILKR
WGTIKKxxxxxxxxGFKKEISNMLNIMNxxxxxxxxxxxxxxxxxFHLTTRGGEPHMIVxxQERGKS
LLFKTExxxNMCTLMAIDLGEMCEDTITYKCPxxxxxxxxDVDCWCNATSAWVTYGTCTxxGERRREK
RSVALAPHVGLGLDTRTQTWMSSEGAWKQIQxIETWILRHPGFxxxxxxxxxxxxxxxxxxxxxxxxx
xxxxxxxxMRCVGIGSRDFVEGVSGGSWVDLVLEHGGCVTTMAKNKPTLDIELQKTxxxxxxxLRTYC
IEAxxxxxTTESRCPTQGxxxxxxxxxxxxxxxxxMVDRGWGNxxGLFGKGGIVTCAMFxxxxxxxxx
xxxxENLKYTVIxTPHSGEEHxxxxxxxxxxxxxxxxxxxxxxxxxxxxxTLDCSPRTGIDFNEM
ILMxxxxKTWLVHRQWFLDLPLPWLxxxxxxxxxxxxQERMVTFKVPHAKKQDVVVLGSQxGAMHSAL
AGATEIQMSxxxxLFTGHLKCKVRMEKLRIxxxxxxxxxxxxxxxxEMAETQHGTTVxxxxxxxxxxx
xxxxxxxxxxxxxxxxxxxxxxxxxxxxxxxxVNIEAEPPFGESYIxxxxxxxxxxxxxxxKKGSTIGK
MFETTMRGAKRMAILGDTAWDFGSVGGLxxxxxxxxxxxFGSVYTTMFGGVSWVMKIxxxxLVLWIGT
NSRNxxxxxxxxxxxxxxxxxxxxxxxxxxxxxxxxNKELKCGSGIFVVDNVHTRTEQYKFQPESPAR
LATAIAGAWxEGVCGIRSTTRLENVMWKQIxxxxxxxxxxxxxxxxxxxxxxxxxxxxxxxxxxxxx
xxRYSWKAWGKAKxxxxxxxxxxFLIDGPDTxxxxxxxxxxxFEVEDYGFGMFSTNIWLKLxxxxxx
xxxHRLMSAAVKDERAVHADMGYWIESQKNGSWKLARASFIEVKSCxxPRSHTLWSNGVLESQMLIPK
xxGGPISQHNHRPGYxTQIMGPWHLGKLEMDFxxxxxxxxxxxxxCDTRGPSLRTTTVTGKIITEWCC
RSCTLPPLRYMGEDGCWYGMEIRPINEKEENMVxxxxxxxxxxxxxxxxxxxxxxxxxxxxxxxxxx
xxxxxxxxxxxxxxxxxxxxxxxxxxxxxxxxxxxxxxxxxxHLAIMAVFxxxxxxxxxxLFRKLT
SRENLLLGxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxSWPLNEAIMAVGLV
SILLSSLLRNDVPLAGPLIAGGMLIACYVITGTSADLTVEKAxxxxxxxEAEQTGVSHNxxxxISEDG
SFSIRDVEETxTLTILLKATLLAVSGxxxxxxxxxxxxxxxxxxxxxxSGVLWDTPSPPExxxxxxLSE
GVYRIKQRGILGRSQVGVGIHMENVFHTMWHVTRGAVLMYxTKRLEPSWADVKKDLISYGGGWRFxxx
WNTEEDVQVLAIEPGKNPKNVQTxxxxxxxxxTGEVGAVTLDFKPGTSGSPIVDxEGKIVGLYGNGVVT
RSGAYVSAIAQAKxxxxxxxxxxxxVFRKRRLTIMDLxPGSGKTRKYLPAIIREAIKRKLRTLILAx
xxxxxAEMEEALKGMPIRYQTPAIRAEHTGREIxxxxxxxxTMRLLSPVRVPNYNMVIMDEAHFTDP
SSIAARGYxxxxVEMGEAAAIxMTATPPGAxDAFPQSNAPIMDIEREIPERSWNSGYxxxxxFPGKTV
WFVPSIKSGNDIANCLRKSGKKVIQLxxKTFDSEYVKTxLNDWDYVVTxxxxxMGANFKAGRVIDPRR
CLKPVILKDGEERVVLAGPMPVTHSSAAQRRGRIGRNHxKENDQYIYSGDPLKNDEDHAHxxxxxxxx
xxxxTPEGIIPSMFGPEREKTDAIDGEYRLKGEARKTFVELMKRGDLPVWLAYKVASEGFQYxDREWC
FTGxKNNQILEENVEVEIWTKEGERKKLRPRWLDARIYSDPLALREFKEFAAGRRxxxGDLVTEIGRV
PxxxxxxxRDALDNLVMLHNSExxxxAYRHAMEELPDTIETLMLLTLIAVLTGGxxxxxxxxxxxxGKT
SIGLLxxxxxxxxxxxxxxxVELQWIASAIVLEFFMMVLLIPExxxxxTPQDNQLIYVILTILxxxxxxx
xNEMGLLEKTKKDLGxxxxxxxxxxxxxxxxLDIDLRPASAxxLYAVATTFITPMMRHTIENTTAN
ISLAAIANQATVLMGLGKGWPISKVDIGVPLLAMGCYSQVNPTTLTASLxxxxTHYAIIGPxxxxxxxx
xxxxxxxxxxxxNPTVDGIMTIDLDPVVYDSKFEKQLGQVMLLILCASQILLMRTSWAFCESLTLAT
GPVLTLWEGNPGKFWNTxxxxxxxxxxxxxGAGLAFSLMKSxxxxxxxxxxIGETLGEKWKKKLN
xxxxxxxxYKRSGIMEVDRSEAKSALKDGSxIKHAVSRGTAKLRWIVERGMVxPEGRVIDLGCGxGG
WSYYCGGLKNVTEVRGFTKGGPGHEEPVPMSTYGWNIVKLHSGKDVFFxPPERCDTLLxDIGESSPNP
TIEESRTIRVLSLVENWLxxxxQFCVKILNPYMPSVVExxxxxxxxxxGGNLVRCPLSxxxxHEMYWVS

FIG. 62-4

GATGNIVSSVNMVSRMLLNRFTMTxxxPTYERDVDLGAGTRHVAVExxxANLDIIGQRIENIxxxxxx
TWHYDEDHPYKTWAYHGSYEVKPTGSASSMINGVVKLLTKPWDVLPMVTQIAMTDTTPxxxxxxxxxK
VDTRTPQxxxxxxxxxxxxxxxxxxxxxxxxxPRMCTREEFIKKVRTNAAIGAVFVDENQWNSAKEAV
xxxxxxxxxxxERELHKQGKCATCVYNMMxxxxxxxxxxxxxxxxxxxxxxxxxxxxxxxxxxxxLNE
DHWFSRENSYSGVEGEGxHRLGYILEEIxxxxGDLMYADDTAGWDTRITEDDLHNExxxxxxxxxxxx
xxxxxxxxxxxQNKVVRVQRPAKxGTVMDIISRRDQRxxxxxxxxxxxxxTNMEAQLIRQMESEGIxx
xxxxxxxxxxxxxxxxxxxxxxxxxxERLRRMAISGDDCVVKPLDDRFxxALLALNDMGKIRKDIQQW
QPSKGWNNWQEVPFCSHHFHQLIMKDGRVLVVPCRPQDELIGRxxxxxxxxxxxxxxxxxxKSYAQMW
TLMYFHRRDLRLASNAICSAVPSxWIPTSRTTWSIHATHEWMTTEDMLSVWNRVWIRDNPNMTDKTxx
xxxxEVPYLGKRxxxxxGSLIGLTARATWATNIxxAINQVRRLxxxxxxxDYMPVMKRYSxxxxxxxx
xx >DENVall|peptide_length:8|string4 xxxxxxxxxxTPFNMLKRxRNRVSTVSQLAKRFSRGMLQGQGPMKMVMAFIAFxxxxTIPPTAGILAR
WGSFKKxxxxxxxxGFKKEVSSMLNIMNxxxxxxxxxxxxxxxxxxFHLSTRDGEPLMIVxxHERGRP
LLFKTTxxxNMCTLMAMDLGEFCEDTITYNCPxxxxxxxxDVDCWCNATSAWVMYGTCTxxGERRREK
RSVALTPHSGMGLDTRAQTWMSSEGAWKHVQxVETWAFRHPGFxxxxxxxxxxxxxxxxxxxxxxxxx
xxxxxxxxMRCVGIGNRDFVExxxxxxxxDIVLEHGGCVTTMAKDKPTLDFELTKTxxxxxxxLRKYC
IEAxxxxxTTASRCPTQGxxxxxxxxxxxxxxxxxVVDRGWGNxxxLFGKGSLITCAKFxxxxxxxxx
xxxxENLEYTIVxTPHSGEENxxxxxxxxxxxxxxxxxxxxxxxxxxxxxxxxTMECSPRTSLDFNEM
VxxxxxxKAWLVHKQWFFDLPLPWAxxxxxxxxxxxxKETLVTFKNPHAKRQDVVVLGxxxxxxxxxx
TGATEIQNSxxxxLFMGHLKCRLRMDKLQLxxxxxxxxxxxxxxxxEIAETQHGTIVxxxxxxxxxxx
xxxxxxxxxxxxxxxxxxxxxxxxxxxxxxxxINIETEPPSGESYIxxxxxxxxxxxxxxKRGSSIGK
MLEATAKGARxxxxxxxxxxDFGSLGGVxxxxxxxxxxxFGAIYGAAFSGVSWIMKIxxxxIITWIGM
NSRSxxxxxxxxxxxxxxxxxxxxxxxxxxxxxxxxGKELKCGSGIFVIDNVHTWTEQYQFQADSPKR
LASAIQKAHxNGVCGIRSATRMENLLWKQIxxxxxxxxxxxxxxxxxxxxxxxxxxxxxxxxxxxxxx
xxKYSWKTWGKARxxxxxxxxxxFIIDGPDTxxxxxxxxxxxxxxxxDYGFGVFTTNIWLRLxxxxxx
xxxSKLMSAAVKDNRAVHADMGYWIESALNDTWKMERASFIEVKNCxxxxxxxxxxxGVLESQMLIPR
xxAGPFSQHNNRPGYxTQTAGPWHLGRLEMDFxxxxxxxxxxxxxCGHRGSSLRTTTVSGKLIHEWCC
RxxTLPPLRFKGEDGCWYxxxxxxxSEREENMVxxxxxxxxxxxxxxxxxxxxxxxxxxxxxxxxxxx
xxxxxxxxxxxxxxxxxxxxxxxxxxxxxxxxxxxxxxxxxxxxYLALIATFxxxxxxxxxxFLRKLT
SKELMMATxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxSWPLNEGIMAIGIV
SILASSLLRNDVPMAGPLVAGGLLIACYVITGTSADLELEKAxxxxxxxEAEHSGASHNxxxxVDDDG
TMRIKDDETExILTVLLKTALLIVSGxxxxxxxxxxxxxxxxxxxxxxSGVLWDVPSPPExxxxxLED
GIYRIKQKGIFGKTQVGVGVQKDGVFHTMWxxTRGAVLTYxGKRLEPNWANVKKDLISxxxxxxxxxx
WQKGEEVQVIxxxPGKNPKNFQTxxxxxxxxTGEIGAIALDFxxxTSGSPIIDxEGKVVGLYGNGVVT
KNGGYVSGIAQTNxxxxxxxxxxxxxIFRKRRLTIMxxxxGSGKTRKYLPAIVREAIKRKLRTLVLxx
xxxxxxxxxxxxxxxxIRYQTTATKTEHTGREIxxxxxxxxxxxxxxxxIRVPNYNLVIMDEAHFTDP
CSVAARGYxxxxxxxxxxxxxxxxxxxxxxxDAFPQSNAPIIDEEREIPERSWNSGNxxxxxFAGKTV
WFVxxxKTGNDIAACLRKSGKRVIQLxxKTFDSEYIKTxTNDWDFVVxxxxxxMGANFKAERVIDPxx
CLKPVILPDGPERVIxAGPMPVTAASAAQRRGRIGRNQxKEGDQYIFTGDPLRNDEDHAHxxxxxxxx
xxxxxxxxxxxxxxxxEREKSAAVDGEYRLRxESRKTFVELxxxxxLPVWLAYKVASEGIKYxxxxxx
xxxxxxxQILEENMEVEIWTKxxEKKKLRPKWLDARVYxxxLALKEFKDFAAGRKxxxLDILTEIASL
PxxxxxxxRNALDNLVMLHTSExxxxAYRHAVEELPETMETLLLLGLMILLTGGxxxxxxxxxxxGKT
SIGLIxxxxxxxxxxxxxIPLQWIASAxxxxxxxxxxxxxxxxxxxxxxxxQLAYVVIGILxxxxxxx
xxxxGLLETTKRDLGxxxxxxxxxxxxxxxxxxxxxxxxxxxxxxxYAVATTIVTPMLRHTIENSTAN
VSLAAIANQAVVLMGLGRGWPIHRVDLGVPLLALxxxxQVNPLTLIAAVxxxxxxxxxxxxxxxxxxx
xxxxxxxxxxxxxNPTIDGITVIDLEPVIYDSKFEKxxxxVMLLVLCAVQLLLMRTSWALCEVLTLAx

FIG. 62-5

```
xxxMTLWEGNPxxxxxxxxxxxxxxxxxxxxxxxxxAGLAFSIMKSxxxxxxxxxxxMGETLGEKWKNRLN
xxxxxxxxxxYKKSGITEVDRTEAKSALRDGSxTRHAVSRGSAKLQWIVERGMIxPEGRVIDLGxxxxxx
xxYYCGGLKNVKEVRGFTKGGPxxxxxxxxxxxxGWNLVKLMSGKDVFYxxxxxxxxxxxxxxxESSPNP
TVEAGRTLRVLSLVExxxxxxxQFCVKVLNPYMPAVIExxxxxxxxxxGGSLVRCPLSxxxxHEMYWIS
NGTGNIVASVNTTSRLLINRFTMKxxxPTIERDVDLGAGTRHVNAExxxPNMDVIGERIKRIxxxxxx
TWHYDDENPYKTWAxHGSYEVKATGSASSMxxxxxxxxxxKPWDVVPTVTQMAMTxxxxxxxxxxxxxK
VDTRTPKxxxxxxxxxxxxxxxxxxxxxxxxxPRLCTKAEFCKKVRSNAAMGAVFTEENQWDSAKAAV
xxxxxxxxxxxERELHKLGKCGSCVYNMMxxxxxxxxxxxxxxxxxxxxxxxxxxxxxxxxxxxxxx
xxxxxRGNSLSGVExxxxxRLGYILEDIxxxxGDLIYADDTAxxxxxITEDDLLNExxxxxxxxxxxx
xxxxxxxxxxxxxxxxVVKVQRPTPxxxxxxxxxxxxxxxxxxxxxxxxxxxxxxQLVRQMEGEGIxx
xxxxxxxxxxxxxxxxxxxxxxxxxxERLRRMAIxxxxCVVKPTDDRFxxALIALNDMGKxxxxIQQW
EPSRGWHDWQQVPFxSHHFHELVMKDGRKLVxxxxxxxxxxxxxxxxxxxxxxxxxxxxxKSYAQMW
ALMYFHRRxxxxxxxAICSAVPPxxxxxxxTTWSIHASHEWMTTEDMLAVWNRVWIxDNPNMTDKxxx
xxxxNVPYLGKRxxxxxxxxxxxxTARATWASNIxxAIQQVRSLxxxxxxxDYMPAMKRYSxxxxxxxx
xx
```

>DENVall|peptide_length:8|string5

```
xxxxxxxxxxxxxxxxxxxxRNRVSTIQGLVKRFSSGLFSGQGPLKLFMAFVxxxxxxxxxxxxxxxAR
WSSFKKxxxxxxxxxGFKREISNMLNTMNxxxxxxxxxxxxxxxxxxxxFSLSTRDGExxxxxxxxxxxxKS
LLFKTKxxxxxxxxxxxxxxxxxxxxxxxxxxxxxxxxxDCWCNTTETWVTYGTxxxxxxxxxxxx
xxxALTPHSGTGLETRxxxxxxSEGAWRQIQxIETWVLRHPGFxxxxxxxxxxxxxxxxxxxxxxxxxx
xxxxxxxxMRCIGVGNRDFxxxxxxxxxxxxxxxxxxxSCVTTIAKSKPTLDIExxxxxxxxxxxxLRKFC
IEAxxxxxxxxxxxxxxxxxxxxxxxxxxxxxLVDRGWGNxxxLFGKGSLLTCAKFxxxxxxxxxx
xxxxENLKYTVTxTVHNGDAHxxxxxxxxxxxxxxxxxxxxxxxxxxxxxxxxSLDCEPRSxxxxxxx
xxxxxxxxxxxxxxxLDLPLPWAxxxxxxxxxxxxKDLLVTFKxxxxxxxxxxxxxxxxxxxxxxxx
TGATEIQISxxxxxxxxxxxxxKVRMERLRIxxxxxxxxxxxxxxxxxxELAETQHGTxxxxxxxxxxxx
xxxxxxxxxxxxxxxxxxxxxxxxxxxxxxxxxxxxxxEAEPPFGDSYVxxxxxxxxxxxxxxxRRGSSIGK
xxxxxxxxxxxxxxxxxxxxxxxxxxxxxxxxxxxxxxFGAAYTALFGGVSWMVRIxxxxVITWLGL
NSRNxxxxxxxxxxxxxxxxxxxxxxxxxxxxxxxSKELKCGNGIFVADNVHTWTxxxxxxPESPAR
VASAIQKAQxDGVCGVRSTTRLENLLWKQVxxxxxxxxxxxxxxxxxxxxxxxxxxxxxxxxxxxxx
xxRYSWKIWGKAKxxxxxxxxxxxFIIDGPSTxxxxxxxxxxxxxxxxxxxxxxxxxxxxTTSIWMKFxxxxxx
xxxxxxxxxxxKDDRAVHADMGYWIESRLNDTWKIEKASFIEIKSCxxxxxxxxxxxxxxxxxESEMVIPK
xxAGPFSHHNxxxxxxxTQAAGPWHLGxxxxxxxxxxxxxxxxxxxxxxCGHRGSSLRxxxxxxxxxxxxx
xxxTLPPLRFKGEDGCWxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxHLAIMIVFxxxxxxxxxxxFLRRLT
SKELMMTTxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxLNEAVMAVGVV
SILLSSxxxxxxxxxxxxxxxxxxxxxxxxSADLSLERAxxxxxxxEAEHSGTSHNxxxxIAEDG
SFSIRDIEETxILTILLKATLLAISGxxxxxxxxxxxxxxxxxxxxxxxxxWDVPSPATxxxxxLTD
GIYRILQRGLLGKTQVGVGIHIxxxxxxxxxxTRGAVLTHxxxxxxxPNWANVKKDxxxxxxxxxxxx
WDREEDVQVLxxxxxxxxxxxxxxxxxxxxxxxxxAGTIGAVSxxxxxxxxxxxxxxxxxxxxxxGVVT
RSGTYVSSIAQTExxxxxxxxxxxxxxxVFKKRNLTxxxxxxxxxxxTRRYLPAMVREAIRRGLRTLIxxx
xxxxxxxxxxxxxxxxIRYQTTAIKAEHTGRExxxxxxxxxxxxxxxxxxxxxxxxxxxxxxxxxxx
xxxxxxxxxxxxxxxxxxxxxxxxxxxxxxxxxxxxxxxPQSNAPIQDEEKDIPxxxxxxxxxxxxxxxFVGKTV
WFVxxxxxxxxxxxxxxxxxxxxxxxxxxxxKTFDTEYTKTxANDWDFVVxxxxxxMGANFRAERVIDPxx
xxxPVISTDGEERVVxxxxxxxxxxxxxxxxxRGRIGRNLxKEGDQYVFSGDPLRNDxxxxxxxxxxxx
xxxxxxxxxxxxxxxxxxxxxxEREKNQAIDGEFxxxxxxxxxxxxxxxxxxxxxxxWLAYRVAAEGINxxxxxxx
xxxxxxxxxxxxxxxxxxxxxxxxxxxxxxxxxxxxxxxxxxxxxxxxxxxxxxxxxLDILTEIATL
PxxxxxxxRNALDNLAxxxxxxxxxxxxAYTHALSELxxxxETLMLIGLLATVTGxxxxxxxxxxxxxGKL
```

FIG. 62-6

```
SVGLIxxxxxxxxxxxxxxxVPLQWIASxxxxxxxxxxxxxxxxxxxxxxxxxxxxxxLIYVILAILxxxxxxx
xxxxGLLEKTKKDFGxxxxxxxxxxxxxxxxxxxxxxxxxxxxxxxYAVATTFITPMLRHSxxxxxxx
xxxxxxxxxxTVLMGLGRxxxLHRVDLGVxxxxxxxxxxxNPTTLIASLxxxxxxxxxxxxxxxxxx
xxxxxxxxxxxxxxPTVDGVTVIDLDPIPYDPKxxxxxxxxxxxxLCVGQLLLMRTSWAFCEALTLAx
xxxxxxxxxxxxxxxxxxxxxxxxxxxxxxxxxxxxxxxxxxxxxxxxxxxxxxxxxxxxxxxxxxx
xxxxxxxxxYKRSGIIEVDRxEAKEGLRRGExTKYAVSRGTSKIRWIVxxxxxxxPEGKVMDLGxxxxx
xxxxCGGLKDVREVxxxxxxxxxxxxxxxxxxxGWNLVKLYSGKDVFFxxxxxxxxxxxxxxxxxSPNP
TVEAGxxxxxxxxxxxxxxxxxxxxxxxxxxxxxxxxxxxxxxxxxxxxxxxxxxxxxxxxxEMYWVS
GVxxxxxxxSVNTISKMLINRFTMRxxxPTYEKDADLGTGTRHVAVxxxxPNMDVIGERIRRIxxxxxx
xxxxxxxxxxxxxxxxxxxxxxxxxxxxxxxxxxxxxxxxxxxxxxWDMIPMVTQxxxxxxxxxxxxxxxxx
xxxxxxxxxxxxxxxxxxxxxxxxxxxxxxxxxxxxxxxxxxEEFINKVRSNAALGAVFTDENQWDSARAAV
xxxxxxxxxxxxERNLHLDGKCETCVxxxxxxxxxxxxxxxxxxxxxxxxxxxxxxxxxxxxxxxxxx
xxxxxRENSFSGVExxxxxxRLGYILREVxxxxxxxxxxxxxxxxxxxxITIEDLKNExxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxVKPVDDRFxxALFALNDMGKxxxxxxxxW
EPSKGWSDWTQVPxxxxxxxxxxxMKDGRTLVxxxxxxxxxxxxxxxxxxxxxxxxxxxxxxxxKAYAQMW
ALxxxxxxxxxxxxxAICSAVPAxxxxxxxxxxxxxxxxxxxxxxxxxxxxxxxxxxxxxxxxxxxxx
xxxxEIPYLGKRxxxxxxxxxxxxxTARATWASxxxxAIAQVRNLxxxxxxxxYMPVMRRYxxxxxxxxxx
xx
```

FIG. 62-7
>DENVall|peptide_length:9|string1

```
xxxxxxxxxxPPF

FIG. 62-8

SLMYFHRRDLRLAANAICSAVPVxWVPTSRTTWSIHAHHQWMTTEDMLTVWNRVWIxENPWMEDKTxx
xxxxDVPYLGKREDQWCGSLIGLTSRATWAKNIxxxxxxxxxxxxxxxxxDYMPSMKRFRxxxxxxxx
xx >DENVall|peptide_length:9|string2 xxxxxxxxxxPSFNMLKRARNRVSTPQGLVKRFSTGLLNGKGPLRMVLAFITFLRVLSIPPTAGVLAR
WGxxxxxxxxxxxxGFKKEISNMLxxxxxxxxxxxxxxxxxxxxxxFHLTSRDGEPRMIVxxNEKGKS
LLFKTSxxxNKCTLMAIDLGEMCDDTxxxxxxxxxxxEPEDIDCWCNSTDTWVTYGTCxxxGEHRREK
RSVALAPHVGMGLETRAQTWMSAEGAWRQVExVESWILRNPGFxxxxxxxxxxxxxxxxxxxxxxxxx
xxxxxxxxMRCIGIGNRDFVEGVSGGAWVDVVLEHGGCVTTMAQGKPTLDIELLKTxxxxxxxxxxxx
xxxxxxxxTTATRCPTQGEPxxxxxxxxxxxxxxxxYVDRGWGNGCGLFGKGGVVTCAKFxxxxxxxx
xxxxxxxxxxxxxxxxxxxxxxxxxxxxxxxxxxxxxxxxxxxxxxxxxxxxxxxxLDCEPRTGLDFNEM
ILLxxxxKAWMVHRQWFFDLPLPWxxxxxxxxxxxxxxELLVTFKNPHAKRQDVTVLGSQEGAMHSAL
TGATEIQMxxxxxMFAGHLKCRLKMDKLExxxxxxxxxxxxxxxxxxEVSETQHGTILxxxxxxxxxxx
xxxxxxxxxxxxxxxxxxxxxxxxxxxxxxxxxTNIELEPPFGESNIxxxxxxxxxxxxxxxxxxKGSSIGQ
MFESTYRGAKRMAILGDTAWDFGSIGGVxxxxxxxxxxxFGSAYTALFSGVSWxxxxxxxxxLLTWIGL
NSKNxxxxxxxxxxxxxxxxxxxxxxxxxxxxxxxxxxGRELKCGSGIFITNNVHTWTEQYKFQPESPKR
LSAAIGKAxxxGICGIRSTTRLENLMWQIxxxxxxxxxxxxxxxxxxxxxxxxxxxxxxxxxxxxxxx
xxxYSWKSWGKAKxxxxxxxxxxxxxxxxxxxxxxxxxxxxLEVEDYGFGIFTTNIWMKFxxxxxx
xCDSKLMSAAIKDQRAVHADMGYWIESEKNETWKxEKASFIEVKTCxWPKTHTLWSNGVLESDMIIPK
xxxxxxSQHNYRQGYxTQTVGPWHLGKLEIDFxxxxxxxxxxxxCGHRGPSLRTTTASGKLVTQWCC
RSCTLPPLRYLGEDGCWYGMEIRPVxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxLFRRLT
SREVLLLTxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxSWPLNEGVMAVGLV
SLLGSSLLKNDVPLAGPMVAGGLLLAAYVMTGRSADLELERxxxxxxxxxMADITGSSPIxxxxVDDDG
TMKIKDEERDxTITLLVKLALITVSGxxxxxxxxxxxxxxxxxxxxxxSGALWDVPSPAAxxxxxxxx
xxxxxxxxxxLGKTQVGVGIHxEGTFHTMWHVTRGAVLMHxGKRIEPSWADVRNDLISYGGGWKLxxx
WDKGEEVQVLALEPGKNPKHVQTxxxxxxxxxEGEIGAVSLDFSPGTSGSPIVNxKGKVIGLYGNGVVT
TSGTYVSAIAQTExxxxxxxxxxxxxxxxxFKKKNLTIMDLHPGAGKTKRILPSIVREAIKRGLRTLILAP
TRVVASEMAEALKGLPIRYQTTAVKSEHTGKEIVDLMCHATFTTRLLSSTRVPNYNLIVMDEAHFTDP
SSVAARGYISTRVEMGEAAGIFMTATPPGTxDPFPQSNAVIEDEEREIPERSWNSGHxxxxxYQGKTV
WFVPSIKAGNDIAACLRKNGKRVIQLSRKTFDTEYPKTxNTDWDYVVTTDISEMGANFRAERVIDPRR
CMKPVILTDGEERVILAGPIPVTPSSAAQRRGRVGRNPxQEDDQYVFMGEPLENDEDCAHWKEAKMLL
DNINTPEGIIPTMFEPEREKVQAIDGEFRLRGEQRKTFVDLMKRGDLPVWLAHKVASEGFQYxxxxxx
xxxxRNNQVLEENMEVEIWTKEGEKKKLKPRWLDARIYADPMALKDFKEFASGRKxxxxDLILEIGKL
PxxxxxxxQLALDNLAVLHTAExxxxAYNHALNELPESLETLMLVALIAVLTGGxxxxxxxxxxxxxx
xxxxxxxxxxxxxxxxxIQPQWIASSIILEFFLIVLLIPEPDRQRTPQDNQLAYVVIGLLxxxxxxxx
xNEMGLIEKTKTDFGxxxxxxxxxxxxxxxxxxLDVDLHPASAWTLYAVATTIITPMLRHTIENTSAN
LSLAAIANQAAILMGLGKGWPLHRMDIGVPLLAIGCYSQVNPITLTAALxxxxVHYAIIGPGxxxxAT
REAQKRAAAGIMKNPTVDGIVAIDLDPISYDAKFEKQLGQIMLLILCTGQLLMMRTTWALCESITLAT
GPLSTLWEGSPGKFWNTTIAVSTANIFRGSYLAGAGLLFSIMKNxxxxxxxxxxTGETLGEKWKSRLN
xxxxxxxxxYKRSGILEVDRTLAKEGIKRGExxKHAVSRGSSKIRWFVERNMVxPEGKVIDLGCGRGG
WSYYMATLKNVREVKGLTKGGPGHEEPIPMSTYGWNLVRLQSGVDVFFxPTEQVDTLLCDIGESSPSP
TVEAGRTLRVLNLVENWLxxxxEFCIKVLNPYMPSVIExxxxxxxxxGGALVRCPLSRNSTHEMYWVS
CGTGNIVSAVNMTSKMLLNRFTTxxxxPTYEPDVDLGSGTRNIGIExxxPNLTIIGRRLQRLxxxxxx
TWHYDQDNPYRTWAYHGSYEAPSSGSASSMVNGVVRLLTKPWDVVPMVTQLAMTDTTPFxxxxxxKEK
VDTRTPQxxxxxxxxxxxxxxxxxxxxxxxxxPRICTREEFxxKVRSNAALGAIFQEEQGWTSASEAV
xxxxxxxxxxxERNLHLEGKCESCVYNMMGKxEKKLGEFGRAKGSRAIWYMWLGARYLEFEALGFMNE

FIG. 62-9

```
DHWFGRENSWSGVEGEGLHRLGYILExxxxxxGGNIYADDTAGWDTRITLEDLKNExxxxxxxxxxxx
xxxxSIFKLTYQNKVVRVQRPTPxGAVMDVISRRDQRGSGQVVTYSLNTFTNMEVQLIRQMEAEGVxx
xxxxxxxxxxxxxxxxxxxxxxxxxDRLSRMAISGDDCVVKPLDERFxxSLLFLNDMGKVRKDIPQW
EPSKGWNDWTEVPFCSHHFHKIFMKDGRxIVVPCRNQDELVGRARVSQGAGWSLRETACLGKSYAQMW
QLMYFHRRDLRLASMAICSAVPTxWFPTSRTTWSIHAKHEWMTTEDMLKVWNRVWIxDNPWMEDKTxx
xxxxDIPYLGK

FIG. 62-10

```
GATGNIVSSVNMVSRMLLNRFTMxxxxPTYERDVDLGAGTRHVAVExxxANLDIIGQRIENIxxxxxx
TWHYDEDHPYKTWAYHGSYEVKPTGSASSMINGVVKLLTKPWDVLPMVTQIAMTDTTPFxxxxxxxxEK
VDTRTQExxxxxxxxxxxxxxxxxxxxxxxxxPRMCTREEFxxKVRTNAAIGAVFVDENQWNSAKEAV
xxxxxxxxxxxERELHKQGKCATCVYNMMGxxxxxxxxxxxxxxxxxxxxxxxxxxxxxxxxFLNE
DHWFSRENSYSGVEGEGLHRLGYILRxxxxxxGDLMYADDTAGWDTRITEDDLHNExxxxxxxxxxxx
xxxxxxxxxxYQNKVVRVQRPAKxGTVMDIISRRDQRGxxxxxxxxxxxFTNMEAQLIRQMESEGIxx
xxxxxxxxxxxxxxxxxxxxxxxxxxxERLRRMAISGDDCVVKPLDDRFxxALLALNDMGKVRKDIQQW
QPSKGWNNWQEVPFCSHHFHQLIMKDGRxLVVPCRPQDELIGRAxxxxxxxxxxxKETACLGKSYAQMW
TLMYFHRRDLRLASNAICSAVPSxWIPTSRTTWSIHATHEWMTTEDMLSVWNRVWIxDNPNMIDKTxx
xxxxEVPYLGKRExxxCGSLIGLTARATWATNIxxxxxxxxxxxxxxxxxxxDYMPVMKRYSxxxxxxxxx
xx >DENVall|peptide_length:9|string4 xxxxxxxxxxTPFNMLKRERNRVSTVSQLAKRFSRGMLQGQGPMKMVMAFIAFLxxLTIPPTAGILAR
WSxxxxxxxxxxxxGFKKEVSNMLxxxxxxxxxxxxxxxxxxxxxxxFHLSTRDGEPLMIVxxHERGRP
LLFKTTxxxNMCTLMALDLGEFCEDTxxxxxxxxxxxxxDDVDCWCNATSAWVMYGTCxxxGERRREK
RSVALTPHSGMGLDTRAQTWMSSEGAWKHVQxVETWAFRHPGFxxxxxxxxxxxxxxxxxxxxxxxxx
xxxxxxxxMRCVGIGSRDFVEGVSGGTWVDIVLEHGGCVTTMAKDKPTLDFELTKTxxxxxxxxxxxx
xxxxxxxxTTASRCPTQGExxxxxxxxxxxxxxxxxVVDRGWGNGxGLFGKGSLITCAKFxxxxxxxxx
xxxxxxxxxxxxxxxxxxxxxxxxxxxxxxxxxxxxxxxxxxxxxxxxxxxxMECSPRTSLDFNEM
VLxxxxxKAWLVHKQWFLNLPLxxxxxxxxxxxxxxxxxETLVTFKNPHAKRQDVVVLGSxxxxxxxxL
TGATEIQNxxxxxLFMGHLKCRLRMDKLQxxxxxxxxxxxxxxxxxEIAETQHGTIVxxxxxxxxxxx
xxxxxxxxxxxxxxxxxxxxxxxxxxxxxINIETEPPSGESYIxxxxxxxxxxxxxxxxxRGSSIGK
MLEATAKGARRxxxxxDTAWDFGSLGGVxxxxxxxxxxxFGAIYGAAFSGVSWxxxxxxxxxIITWIGM
NSRSxxxxxxxxxxxxxxxxxxxxxxxxxxxxxxGKELKCGSGIFVIDNVHTRTEQYQFQADSPKR
LATAIAGAxxxGVCGIRSATRMENLLWKQIxxxxxxxxxxxxxxxxxxxxxxxxxxxxxxxxxxxxx
xxxYSWKTWGKARxxxxxxxxxxxxxxxxxxxxxxxxxxxxxxxxxxEDYGFGVFTTNIWLRLxxxxxx
xxDSKLMSAAVKDNRAVHADMGYWIESALNDTWKxERASFIEVKNCxxxxxxxxxxNGVLESQMLIPR
xxxxxxSQHNNRPGYxTQTAGPWHLGRLEMDFxxxxxxxxxxxxCGHRGSSLRTTTVSGKLIHEWCC
RSCTLPPLRFKGEDGCWYGxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxFLRKLT
SKELMMATxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxSWPLNEGIMAIGIV
SILASSLLRNDVPMAGPLVAGGLLIACYVITGRSADLELEKxxxxxxxxEAEHSGASHNxxxxVDDDG
TMRIKDDETExILTVLLKTALLIVSGxxxxxxxxxxxxxxxxxxxxxxxxxxSGVLWDVPSPPExxxxxxxxx
xxxxxxxxxxFGKTQVGVGVQxDGVFHTMWHVTRGAVLTYxGKRLEPNWANVKKDLISYxxxxxxxxx
WQKGEEVQVIAxEPGKNPKNFQTxxxxxxxxxTGEIGAIALDFKxGTSGSPIIDxEGKVVGLYGNGVVT
KNGGYVSGIAQTNxxxxxxxxxxxxxxxFRKRRLTIMDxxPGSGKTRKYLPAIVREAIKRKLRTLVLAx
xxxxxxxxxxxxxxxxxPIRYQTTATKTEHTGREIVxxxxxxxxxxxxxxxPIRVPNYNLVIMDEAHFTDP
CSVAARGYIxxxxxxxxxxxxxxxxxxxxxxDAFPQSNAPIIDEEREIPERSWNSGNxxxxxFAGKTV
WFVPxIKTGNDIAACLRKSGKRVIQLSRKTFDSEYIKTxTNDWDFVVTxxxxEMGANFKAERVIDPRR
CLKPVILPDGPERVILAGPMPVTAASAAQRRGRIGRNQxKEGDQYIFTGDPLRNDEDHAHWxxxxxxxx
xxxxxxxxxxxLFGPEREKSAAVDGEYRLRGESRKTFVELMxxxDLPVWLAYKVAAEGINYxxxxxx
xxxxxxNQILEENMEVEIWTKEGEKKKLRPKWLDARTYSDPLALKEFKDFAAGRKxxxxDILTEIASL
PxxxxxxxRNALDNLVMLHTSExxxxAYRHAVEELPETMETLLLLGLMILLTGGxxxxxxxxxxxxxxx
xxxxxxxxxxxxxxxxxIPLQWIASAIxxEFFLMVLLVxxxxxxxxxxxxxxNQLAYVVIGILxxxxxxxxx
xxxMGLLETTKRDLGxxxxxxxxxxxxxxxxxxxxxxxxxxxxxxxxxLYAVATTIVTPMLRHTIENSTAN
```

FIG. 62-11

VSLAAIANQAVVLMGLGRGWPIHRVDLGVPLLALGxxSQVNPLTLIAAVxxxxxxxxxxxxxxxxxx
xxxxxxxxxxxxKNPTIDGITVIDLEPVIYDSKFEKQxxQVMLLVLCAVQLLLMRTSWALCEVLTLAT
GPVMTLWEGNPGxxxxxxxxxxxxxxxxxxxxxGAGLAFSIMKSxxxxxxxxxxMGETLGEKWKNRLN
xxxxxxxxxxYKKSGITEVDRTEAKSALRDGSxxRHAVSRGSAKLRWIVERGMVxPEGRVIDLGCxxxx
xSYYCGGLKNVKEVRGFTKGGPGxxxxxxxSTYGWNLVKLMSGKDVFYxxxxxxxxxxxxxGESSPNP
TVEAGRTLRVLSLVENxxxxxxxQFCVKVLNPYMPAVIExxxxxxxxxxGGSLVRCPLSRxxTHEMYWIS
NGTGNIVASVNTTSRLLLNRFTMxxxxPTIERDVDLGAGTRHVNAExxxPNMDVIGERIKRIxxxxxx
TWHYDDENPYKTWAYHGSYEVKATGSASSMIxxxxxxxTKPWDVVPTVTQMAMTDxxxxxxxxxxxEK
VDTRTPKxxxxxxxxxxxxxxxxxxxxxxxxxxPRLCTKEEFxxxxRSNAAMGAVFTEENQWDSAKAAV
xxxxxxxxxxxERELHKLGKCGSCVYNMMGxxxxxxxxxxxxxxxxxxxxxxxxxxxxxxxxxxxxx
xxxxxRGNSLSGVEGxxxxxxxxxxxxxxxxxxxxxxGDLIYADDTAGxxxxxITEDDLLNExxxxxxxxxxx
xxxxxxxxxxxxxxxxKVVKVQRPTPxxTVMDIISRRxxxxxxxxxxxxxxxxxxxxxxAQLIRQMEGEGIxx
xxxxxxxxxxxxxxxxxxxxxxxxxxxxxxERLRRMAISxxDCVVKPTDDRFxxALIALNDMGKIRKDIQQW
EPSRGWHDWQQVPFCSHHFHELVMKDGRxxxxxxxxxxxxxxxxxxxxxxxxxxxxxKETACLGKSYAQMW
ALMYFHRRDxxxxxNAICSAVPPxxxxxxRTTWSIHASHEWMTTEDMLAVWNRVWIxDNPNMTDKTxx
xxxxNVPYLGKRExxxxxxxxxLTARATWASNIxxxxxxxxxxxxxxxxxxDYMPAMKRYSxxxxxxxx
xx >DENVall|peptide_length:9|string5 xxxxxxxxxxxxxxxxxxxxxRNRVSTIQGLVKRFSSGLLSGQGPLKLFMAFVAFxxxxxxxxxxxxxxx
xxxxxxxxxxxxxxxGFKREISNMLxxxxxxxxxxxxxxxxxxxxxxFSLSTRDGEPxxxxxxxxxxGKS
LLFKTKxxxxMCTLMALDLxxxxxxxxxxxxxxxxxxxxxxxVDCWCNTTETWVTYGTCxxxxxxxxxx
xxVALTPHSGTGLETRxxxxxxSSEGAWRQIQxIETWVLRHPGFxxxxxxxxxxxxxxxxxxxxxxxxx
xxxxxxxxMRCIGVGNRDFVxxxxxxxxxxxxxxxxxGSCVTTIAKSKPTLDIELxxxxxxxxxxxxxxx
xxxxxxxxxxxxxxxxxxxxxxxxxxxxxxxxxxxxxxxLVDRGWGNGxGLFGKGSLLTCAKFxxxxxxxxx
xxxxxxxxxxxxxxxxxxxxxxxxxxxxxxxxxxxxxxxxxxxxxxxMECSPRTSLxxxxx
xxxxxxxxxxMVHRQWFLDxxxxxxxxxxxxxxxxxxxxxxFKNPHAKKQEVAVLxxxxxxxxxxxxL
TGATEVDSxxxxxMYAGHLKCKVRMERLRxxxxxxxxxxxxxxxxxxxELAETQHGTILxxxxxxxxxx
xxxxxxxxxxxxxxxxxxxxxxxxxxxxxxxxxVNIEAEPPFGDSYVxxxxxxxxxxxxxxxxKGSSIGQ
MIExxxxxxxxxxxxxxxxxxxxxxxxxxxxxxxxxxFGAAYTALFGGVSWxxxxxxxxxVITWLGL
NSRNxxxxxxxxxxxxxxxxxxxxxxxxxxxxxxxxSKELKCGNGIFVADNVHTWTExYKFQPESPAR
VASAILNAxxxxxxxxxRSTTRMENLLWKQVxxxxxxxxxxxxxxxxxxxxxxxxxxxxxxxxxxxx
xxxxSWKIWGKAKxxxxxxxxxxxxxxxxxxxxxxxxxxxxxxxxxxxxxxVFTTSIWMKFxxxxxx
xxxxxxxxxxxKDDRAVHADMGYWIESRLNDTWKxEKASFIEIKSCxxxxxxxxxxxxLESEMVIPK
xxxxxxxxxxxxxxTQAAGPWHLGxxxxxxxxxxxxxxxxxxxxCGHRGSSLRTxxxxxxxxxxxxx
xxCTLPPLRFKGEDGCWYxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxFLRRLT
SKELMMTTxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxPLNEAVMAVGVV
SILASSFLRNDVxxxxxxxxxxxxxxxxxxxxxxxxSSADLSLERxxxxxxxxxEAEHSGTSHNxxxxIAEDG
SFSIRDIEETxILTILLKATLLAISGxxxxxxxxxxxxxxxxxxxxxxxxxxxxxLWDVPSPATxxxxxxxx
xxxxxxxxxxLGKTQVGVGVHxxxxxxxxxxxVTRGAVLTHxxxxLEPNWANVKKDLxxxxxxxxxxx
WDREEDVQVLAxxxxxxxxxxxxxxxxxxxxAGTIGAVSLxxxxxxxxxxxxxxxxxxxxxxxxNGVVT
RSGTYVSSIAQTExxxxxxxxxxxxxxxxxxxxxxxxxxxxxxxxKTRRYLPAMVREAIRRGLRTLILxx
xxxxxxxxxxxxxxxPIRYQTTAIKAEHTGREIxxxxxxxxxxxxxxxxxxxVRVPNYNLVxxxxxxxxxx
xxxxxxxxxxxxxxxxxxxxxxxxxxxxEAFPQSNAPIQDEEKDIPExxxxxxxxxxxxxFVGKTV
WFVPxxxxxxxxxxxxxxxxxxxxxxxxxxxRKTFDSEYAKTxANDWDFVVTxxxxEMGANFRAERVIDPRx

FIG. 62-12 xxKPVISTDGEERVVLxxxxxxxxxxxxxRRGRIGRNLxKEGDQYVFSGDPLRNDExxxxxxxxxxxxx
xxxxxxxxxxxxxxxPEREKNQAIDGEFRxxxxxxxxxxxxxxxxxxxVWLAYRVAAEGINYxxxxxx
xxxxxxxxxxxxxxxxxxxxxxxxxxxxxxxxxxxxxxxxxxxxxxxxxxxxxxxxxxxDILTEIATL
PxxxxxxxxRNALDNLAVxxxxxxxxxxAYTHALSELPxxxxxxxxxxGLLATVTGGxxxxxxxxxxxxx
xxxxxxxxxxxxxxxxxxVPLQWIASAxxxxxxxxxxxxxxxxxxxxxxxxxxQLIYVILAILxxxxxxx
xxxMGLLEKTKKDFGxxxxxxxxxxxxxxxxxxxxxxxxxxxxxxxLYAVATTFITPMLRHSIxxxxxxx
xxxxxxxxxATVLMGLGRGxPLHRVDLGVPxxxxxxxxxxVNPTTLIASLxxxxxxxxxxxxxxxxxxx
xxxxxxxxxxxxxNPTVDGVTVIDLDPIPYDPKFxxxxxxxxxxxxLCVGQLLLMRTSWAFCEALTLAT
GPVxxxxxxxxxxxxxxxxxxxxxxxxxxxxxxxxxxxxxxxxxxxxxxxxxxxxxxxxxxxxxxxxxx
xxxxxxxxxxYKRSGIIEVDRxEAKEGLRRGExxKYAVSRGTSKIRWIVERGMIxPEGKVMDLGCxxxx
xxxYCGGLKDVREVxxxxxxxxxxxxxxxxxYGWNLVKLYSGKDVFFxxxxxxxxxxxxxxxxSSPNP
TVEAGRxxxxxxxxxxxxxxxxxxxxxxxxxxxxxxxxxxxxxxxxxxxxxxxxxxxxxxxHEMYWVS
GVxxxxxxSVNTISKMLLNRFxxxxxxP

FIG. 62-13

>DENVall|peptide_length:10|string1 xxxxxxxxxxPPFNMLKRERNRV

FIG. 62-14

SLMYFHRRDLRLAANAICSAVPxxWVPTSRTTWSIHAHHQWMTTEDMLTVWNRVWIxxxxxxxxxxxx
xxxxDVPYLGKREDQWCGSLIGLTSRATWAKNIxxxxxxxxxxxxxxxxxDYMPSMKRFRxxxxxxxx
xx >DENVall|peptide_length:10|string2 xxxxxxxxxxPSFNMLKRARNRVSTxxGLVKRFSTGLLNGKGPLRMVLAFITFLRVLSIPPTAGVLAR
WGxxxxxxxxxxxxGFKKEISNMLxxxxxxxxxxxxxxxxxxxxxxFHLTSRDGEPRMIVxxQERGKS
LLFKTSxxxNKCTLMAIDLGExxxxxxxxxxxxxxxxEPEDIDCWCNSTDTWVTYGTCxxxGEHRREK
RSVALAPHVGMGLETRAQTWMSAEGAWRQVExVESWILRNPGFxxxxxxxxxxxxxxxxxxxxxxxxx
xxxxxxxxMRCIGVGNRDFVEGVSGGAWVDVVLEHGGCVTTMAQGKPTLDIELLKTxxxxxxxxxxxx
xxxxxxxxTTATRCPTQGEPxxxxxxxxxxxxxxxYVDRGWGNGCGLFGKGGVVTCAKFxxxxxxxxx
xxxxxxxxxxxxxxxxxxxxxxxxxxxxxxxxxxxxxxxxxxxxxxxxxxxxxxxxxxLDCEPRTGLDFNEM
ILLxxxxKAWMVHRQWFFDLPLPWxxxxxxxxxxxxxxELLVTFKNPHAKRQDVTVLGSQEGAMHSAL
AGATEVDxxxxxxxFAGHLKCKVRMEKLxxxxxxxxxxxxxxxxxxxxxxxxxxxxxxxxxxxxxxxx
xxxxxxxxxxxxxxxxxxxxxxxxxxxxxxxxTNIELEPPFGDSxxxxxxxxxxxxxxxxxxxxxxxx
xxESTYRGAKRMAILGDTAWDFGSIGGVxxxxxxxxxxxxxxAYTALFSGVSWxxxxxxxxLLTWIGL
NSKNxxxxxxxxxxxxxxxxxxxxxxxxxxxxxxxxGRELKCGSGIFITDNVHTWTEQYKFQPESPKR
LSAAIGKxxxxGICGIRSTTRLENLMWKQIxxxxxxxxxxxxxxxxxxxxxxxxxxxxxxxxxxxxxx
xxxYSWKSWGKAKxxxxxxxxxxxxxxxxxxxxxxxxxxxxxxWEVEDYGFGIFTTNIWLKxxxxxxx
xCDSKLMSAAIKDQRAVHADMGYWIESEKNxxxxxxxxxxxxxxxxxWPKTHTLWSNGVLESDMIIPK
xxxxxxxxxxxxxxxxTQTVGPWHLGKLEIDFxxxxxxxxxxxxxxGHRGPSLRTTTASGKLVTQWCC
RSCTLPPLRYLGEDGCWYGMEIRPVxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxLT
SREVLLLTxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxSWPLNEGVMAVGLV
SLLGSSLLKNDVPLAGPMVAGGLLLAAYVMTGRSADLELERxxxxxxxxMADITGSSPIxxxxxDDDG
TMKIKDEERDxTITLLVKLALITVSGxxxxxxxxxxxxxxxxxxxxxxSGALWDVPSPAAxxxxxxxx
xxxxxxxxxxxGKTQVGVGIHxEGTFHTMWHVTRGAVLMHxGKRIEPSWADVRNDLISYGGGWKLxxx
WDKGEEVQVLAIEPGKNPKHVQTxxxxxxxxEGEIGAVSLDFKPGTSGSPIVNxKGKVIGLYGNGVVT
TSGTYVSAIAQAxxxxxxxxxxxxxxxFKKKNLTIMDLHPGAGKTKRILPSIVREAIKRGLRTLILAP
TRVVASEMAEALKGMPIRYQTTAVKSEHTGKEIVDLMCHATFTTRLLSSTRVPNYNLIVMDEAHFTDP
SSVAARGYISTRVEMGEAAGIFMTATPPGTxDPFPQSNAVIEDEEREIPERSWNSGHxxxxxYQGKTV
WFVPSIKAGNDIAACLRKNGKRVIQLSRKTFDTEYPKTxNTDWDYVVTTDISEMGANFRAERVIDPRR
CMKPVILTDGPERVILAGPIPVTPSSAAQRRGRVGRNPxQEDDQYVFMGEPLENDEDCAHWKEAKMLL
DNINTPEGIIPSMFEPEREKVDAIDGEFRLRGEQRKTFVDLMRRGDLPVWLAHKVASxxxxxxxxxxx
xxxxRNNQVLEENMEVEIWTKEGEKKKLKPRWLDARIYADPMALKDFKEFASGRKxxxxDLILEIGKL
PxxxxxxxQLALDNLAVLHTAExxxxAYNHALNELPESLETLMLVxxxxxxxxxxxxxxxxxxxxxxx
xxxxxxxxxxxxxxxxxxIQPQWIAASIILEFFLIVLLIPEPDRQRTPQDNQLAYVVIGLLxxxxxxx
xNEMGLLETTKKDxxxxxxxxxxxxxxxxxxxxLDVDLHPASAWTLYAVATTIITPMLRHTIENTSAN
LSLAAIANQAAILMGLGKGWPLHRMDIGVPLLAIGCYSQVNPITLTAALxxxxVHYAIIGPGLxxKAT
REAQKRAAAGIMKNPTVDGIVAIDLDPISYDAKFEKQLGQIMLLILCTGQLLMMRTTWALCESITLAT
GPLSTLWEGSPGKFWNTTIAVSTANIFRGSYLAGAGLLFSIMKNxxxxxxxxxxTGETLGEKWKSRLN
xxxxxxxxxYKRSGILEVDRTLAKEGIKRGExxKHAVSRGSSKLRWFVERNMVxPEGKVIDLGCGRGG
WSYYMATLKNVREVKGLTKGGPGHEEPIPMSTYGWNLVRLQSGVDVFFxPTEQVDTLLCDIGESSPSP
TVEAGRTLRVLNLVENWLxxxxEFCIKVLNPYMPSVIExxxxxxxxxGGALVRCPLSRNSTHEMYWVS
CGTGNIVSAVNMTSKMLLNRFTTxxxxPTYEPDVDLGSGTRNIGIExxxPNLTIIGRRLQRLxxxxxx
TWHYDQDNPYRTWAYHGSYEAPSSGSASSMVNGVVKLLTKPWDVVPMVTQLAMTDTTPFGxxxxFKEK

FIG. 62-15

```
VDTRTPQxxxxxxxxxxxxxxxxxxxxxxxxxxxxxxxxxxKVRSNAALGAIFQEEQGWTSASEAV
xxxxxxxxxxxERNLHLEGKCESCVYNMMGKREKKLGEFGRAKGSRAIWYMWLGARFLEFEALGFMNE
DHWFGRENSWSGVEGEGLHRLGYILExxxxxxGGNIYADDTAGWDTRITLEDLxxxxxxxxxxxxxxx
xxxxSIFKLTYQNKVVRVQRPTPxGAVMDVISRRDQRGSGQVVTYGLNTFTNMEVQLIRQMEAEGVxx
xxxxxxxxxxxxxxxxxxxxxxxxxxDRLSRMAISGDDCVVKPLDERFxxSLLFLNDMGKVRKDIPQW
EPSKGWNDWTEVPFCSHHFHKIFMKDGRxIVVPCRNQDELVGRARVSQGAGWSLRETACLGKSYAQMW
QLMYFHRRDLRLASMAICSAVPxxWFPTSRTTWSIHAKHQWMTTEDMLKVWNRVWIxxxxxxxxxxxx
xxxxDIPYLGKREDLWCGSLIGLSSRATWAKNIxxxxxxxxxxxxxxxxxDYMTSMKRFKxxxxxxxx
xx >DENVall|peptide_length:10|string3 xxxxxxxxxxPSINMLKRVRNRVSTxxQLTKRFSLGLLSGRGPLKLFMALVAFLRFLAIPPTAGILAR
WGxxxxxxxxxxxxxGFKKEISSMLxxxxxxxxxxxxxxxxxxxxxxxFHLTTRGGEPHMIVxxNEKGKS
LLFKTExxxNMCTLMAMDLGExxxxxxxxxxxxxxxxxxPDDVDCWCNATSTWVMYGTCxxxGERRREK
RSVALAPHVGLGLDTRTQTWMSSEGAWKQIQxIETWILRHPGFxxxxxxxxxxxxxxxxxxxxxxxxx
xxxxxxxMRCVGISSRDFVEGVSGGSWVDLVLEHGGCVTTMAKNKPTLDIELQKTxxxxxxxxxxxxx
xxxxxxxxTTESRCPTQGEPxxxxxxxxxxxxxxMVDRGWGNGCGLFGKGGIVTCAMFxxxxxxxxx
xxxxxxxxxxxxxxxxxxxxxxxxxxxxxxxxxxxxxxxxxxxxxxxxxxxxxLDCSPRSGIDFNEM
ILMxxxxKTWLVHRQWFLNLPLPWxxxxxxxxxxxxxxxERMVTFKVPHAKKQDVVVLGSQEGAMHSAL
TGATEVDxxxxxxxFTGHLKCRLRMDKLxxxxxxxxxxxxxxxxxxxxxxxxxxxxxxxxxxxxxxx
xxxxxxxxxxxxxxxxxxxxxxxxxxxxxxxxVNIEAEPPFGDSxxxxxxxxxxxxxxxxxxxxxxx
xxETTMRGAKRMAILGETAWDFGSVGGLxxxxxxxxxxxxxVYTTMFGGVSWxxxxxxxxxLVLWIGT
NSRNxxxxxxxxxxxxxxxxxxxxxxxxxxxxxxxNKELKCGSGIFVVDNVHTWTEQYKFQPESPAR
LASAILNxxxxGVCGIRSTTRLENVMWKQIxxxxxxxxxxxxxxxxxxxxxxxxxxxxxxxxxxxxx
xxxYSWKAWGKAKxxxxxxxxxxxxxxxxxxxxxxxxxxxLEVEDYGFGMFTTNIWMKxxxxxxxx
xCDHRLMSAAVKDERAVHADMGYWIESQKNxxxxxxxxxxxxxxxxxxWPRSHTLWSNGVLESQMLIPK
xxxxxxxxxxxxxxTQIMGPWHLGKLEMDFxxxxxxxxxxxxxDTRGPSLRTTTVTGKIITEWCC
RSCTLPPLRYMGEDGCWYGMEIRPIxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxLT
SRENLLLGxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxSWPLNEAIMAVGLV
SILLSSLLKNDVPLAGPLIAGGMLIACYVITGTSADLTVEKxxxxxxxxEAEQTGVSHNxxxxxSEDG
SFSIRDVEETxTLTILLKATLLAVSGxxxxxxxxxxxxxxxxxxxxxxSGVLWDTPSPPExxxxxxxx
xxxxxxxxxxGRSQVGVGVFxENVFHTMWHVTRGAVLMYxTKRLEPSWADVKKDMISYGGGWRLxxx
WNTEEDVQVLAVEPGKNPKNVQTxxxxxxxxTGEVGAVTLDFSPGTSGSPIVDxEGKIVGLYGNGVVT
RSGAYVSAIAQTxxxxxxxxxxxxxxxxxFRKRRLTIMDLHPGSGKTRKYLPAIIREAIKRKLRTLILAP
TxxVAAEMEEALKGLPIRYQTPAIRAEHTGREIVDxxxxxTFTMRLLSPVRVPNYNMVIMDEAHFTDP
SSIAARGYISTRVEMGEAAAIFMTATPPGAxEAFPQSNAPIMDIEREIPERSWNSGYxxxxxFPGKTV
WFVPSIKSGNDIANCLRKSGKKVIQLSRKTFDSEYVKTxLNDWDYVVTTDxSEMGANFKAGRVIDPRR
CLKPVILKDGEERVILAGPMPVTHASAAQRRGRIGRNHxKENDQYIYSGDPLKNDEDHAHWTxxxxxx
xxIYTPEGIIPTLFGPEREKTAAIDGEYRLRGEARKTFVELMKRGDLPVWLAYKVAAxxxxxxxxxx
xxxxKNNQILEENVEVEIWTREGERKKLRPRWLDARTYSDPLALREFKEFAAGRRxxxxDLVTEIGRV
PxxxxxxxRDALDNLVMLHNSExxxxAYRHAMEELPDTIETLMLLxxxxxxxxxxxxxxxxxxxxxx
xxxxxxxxxxxxxxxxxxxxxxxVELQWIASAIVLEFFLMVLLVPEPEKQxTPQDNQLIYVILTILxxxxxxx
xNEMGLIEKTKTDxxxxxxxxxxxxxxxxxxxxLDIDLRPASAWTLYAVATTFITPMMRHTIENTTAN
ISLTAIANQATVLMGLGKGWPISKMDIGVPLLAMGCYSQVNPTTLTASLxxxxTHYAIIGPGLxxxxx
xxxxxxxxxxxMKNPTVDGIMTIDLDPVVYDSKFEKQLGQVMLLILCASQILLMRTTWAFCEVLTLAT
```

FIG. 62-16

```
GPILTLWEGNPGKFWNTTIxxxxxxxxxxxxLAGAGLAFSLMKSxxxxxxxxxxxIGETLGEKWKKKLN
xxxxxxxxxxYKRSGIMEVDRSEAKSALKDGSxxKHAVSRGTAKLQWFVERNMVxPEGRVIDLGCGRGG
WSYYCGGLKNVTEVRGFTKGGPGHEEPVPMSTYGWNIVKLHSGKDVFFxPPERCDTLLCDIGESSPNP
TIEESRTIRVLSLVENWLxxxxQFCIKILNPYMPSVVExxxxxxxxxxGGNLIRCPLSRNSTHEMYWVS
GATGNIVSSVNMVSRMLLNRFTMxxxxPTYERDVDLGAGTRHVAVExxxANLDIIGQRIENIxxxxxx
TWHYDEDHPYKTWAYHGSYEVKPTGSASSMINGVVRLLTKPWDVLPMVTQIAMTDTTPFGxxxxxKEK
VDTRTQExxxxxxxxxxxxxxxxxxxxxxxxxxxxxxxxxxxxxKVRSNAAIGAVFVDENQWNSAKEAV
xxxxxxxxxxxERELHKQGKCATCVYNMMGKxxxxxxxxxxxxxxxxxxxxxxxxxYLEFEALGFLNE
DHWFSRENSYSGVEGEGLHRLGYILRxxxxxxGDLMYADDTAGWDTRITIEDLxxxxxxxxxxxxxxx
xxxxxxxxTYQNKVVRVQRPAKxGTVMDIISRRDQRGSGQVVxxSLNTFTNMEAQLIRQMESEGIxx
xxxxxxxxxxxxxxxxxxxxxxxxxERLRRMAISGDDCVVKPLDDRFxxALLALNDMGKVRKDIQQW
QPSKGWNNWQEVPFCSHHFHQLIMKDGRxLVVPCRPQDELIGRARISQGAGWSLKETACLGKSYAQMW
TLMYFHRRDLRLASNAICSAVPxxWIPTSRTTWSIHATHQWMTTEDMLSVWNRVWIxxxxxxxxxxx
xxxxEIPYLGKREDQWCGSLIGLTSRATWAQNIxxxxxxxxxxxxxxxxxDYMPVMKRYSxxxxxxxx
xx >DENVa11|peptide_length:10|string4 xxxxxxxxxxTPFNMLKRERxxxxxxxQLAKRFSRGMLQGQGPMKMVMAFIAFLRFLTIPPTAGILAR
WSxxxxxxxxxxxxGFKKEVSNMLxxxxxxxxxxxxxxxxxxxxFHLSTRDGEPLMIVxxHERGRP
LLFKTTxxxNMCTLMALDLGExxxxxxxxxxxxxxxxxxPDDVDCWCNATSAWVMYGTCxxxGERRREK
RSVALTPHSGMGLDTRAQTWMSSEGAWKHVQxVETWAFRHPGFxxxxxxxxxxxxxxxxxxxxxxxx
xxxxxxxMRCVGIGSRDFVEGVSGGTWVDIVLEHGGCVTTMAKDKPTLDFELTKTxxxxxxxxxxxx
xxxxxxxxTTASRCPTQGEPxxxxxxxxxxxxxxxxxVVDRGWGNGCGLFGKGSLITCAKFxxxxxxxxx
xxxxxxxxxxxxxxxxxxxxxxxxxxxxxxxxxxxxxxxxxxxxxxxxxMECSPRTSLDFNEM
VLLxxxxKAWLVHKQWFLNLPLPxxxxxxxxxxxxxxxETLVTFKNPHAKRQDVVVLGSQxxxMRTVL
TGATEIQxxxxxxxxFMGHLKCKVRMERLxxxxxxxxxxxxxxxxxxxxxxxxxxxxxxxxxxxx
xxxxxxxxxxxxxxxxxxxxxxxxxxxxxxxxxxxxINIETEPPFGESxxxxxxxxxxxxxxxxxx
xxEATAKGARRMxxxGDTAWDFGSLGGVxxxxxxxxxxxxxIYGAAFSGVSWxxxxxxxxxIITWIGM
NSRSxxxxxxxxxxxxxxxxxxxxxxxxxxxGKELKCGSGIFVIDNVHTWTEQYKFQADSPKR
LATAIAGxxxxGVCGIRSATRMENLLWKQIxxxxxxxxxxxxxxxxxxxxxxxxxxxxxxxxxxx
xxxYSWKTWGKARxxxxxxxxxxxxxxxxxxxxxxxxxxLEVEDYGFGVFSTNIWLKxxxxxxxx
xCDSKLMSAAVKDNRAVHADMGYWIESALNxxxxxxxxxxxxxxxxxxxxxxxxSNGVLESQMLIPR
xxxxxxxxxxxxxxxTQTAGPWHLGRLEMDFxxxxxxxxxxxxxxxxGHRGSSLRTTTVSGKLIHEWCC
RSCTLPPLRFKGEDGCWYGMxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxLT
SKELMMATxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxSWPLNEGIMAIGIV
SILASSLLRNDVPMAGPLVAGGLLIACYVITGRSADLELEKxxxxxxxxEAEHSGASHNxxxxxDDDG
TMRIKDDETExILTVLLKTALLIVSGxxxxxxxxxxxxxxxxxxxxxxSGVLWDVPSPPExxxxxxx
xxxxxxxxxxGKTQVGVGVQxDGVFHTMWHVTRGAVLTYxGKRLEPNWANVKKDLISYGGGWRFxxx
WQKGEEVQVIAVEPGKNPKNFQTxxxxxxxxTGEIGAIALDFSPGTSGSPIIDxEGKVVGLYGNGVVT
KNGGYVSGIAQTxxxxxxxxxxxxxxxxxFRKRRLTIMDLHPGSGKTRKYLPAIVREAIKRKLRTLVLAP
xxxxxxxxxxRGLPIRYQTTATKTEHTGREIVDxxxxxxxxxxxSPIRVPNYNLVIMDEAHFTDP
CSVAARGYISxxxxxxxxxxxxxxxxxDAFPQSNAPIIDEEKDIPERSWNSGNxxxxxFAGKTV
WFVPSIKTGNDIAACLRKSGKRVIQLSRKTFDSEYIKTxTNDWDFVVTTxxSEMGANFKAERVIDPRR
CLKPVILPDGPERVILAGPMPVTASSAAQRRGRIGRNQxKEGDQYIFTGDPLRNDEDHAHWTxxxxxx
xxxxxxxxxxxTLFEPEREKSAAVDGEYRLKGESRKTFVELMRxGDLPVWLAYRVAAxxxxxxxxxxx
```

FIG. 62-17 xxxxKNNQILEENMEVEIWTKEGEKKKLRPKWLDARTYSDPLALKEFKDFAAGRKxxxxDILTEIASL
PxxxxxxxRNALDNLVMLHTSExxxxAYRHAVEELPETMETLLLLxxxxxxxxxxxxxxxxxxxxxx
xxxxxxxxxxxxxxxxxxxIPLQWIASAIVLEFFMMVLLVPEPEKxxxxxDNQLAYVVIGILxxxxxxx
xxEMGLLETTKRDxxxxxxxxxxxxxxxxxxxxxxxxxxxxxxTLYAVATTIVTPMLRHTIENSTAN
VSLAAIANQAVVLMGLGKGWPIHRMDLGVPLLALGCYSQVNPLTLIAAVxxxxxxxxxxxxxxxxxx
xxxxxxxxxxxMKNPTIDGITVIDLEPVIYDSKFEKQLGQVMLLVLCAVQLLLMRTSWALCEVLTLAT
GPVMTLWEGNPGRxxxxxxxxxxxxxxxxxxxxAGAGLAFSIMKSxxxxxxxxxxMGETLGEKWKNRLN
xxxxxxxxxYKKSGITEVDRTEAKSALRDGSxxRHAVSRGSAKIRWIVERGMVxPEGRVIDLGCGxxx
WSYYCGGLKNVKEVRGFTKGGPGHxxxVPMSTYGWNLVKLMSGKDVFYxxxxxxxxxxxxxIGESSPNP
TVEAGRTLRVLSLVENWxxxxxQFCVKVLNPYMPAVIExxxxxxxxxxGGSLVRCPLSRNSTHEMYWIS
NGTGNIVASVNTTSRLLLNRFTMxxxxPTIERDVDLGAGTRHVNAExxxPNMDVIGERIKRIxxxxxx
TWHYDDENPYKTWAYHGSYEVKATGSASSMINxxxRLLTKPWDVVPTVTQMAMTDTxxxxxxxxxKEK
VDTRTPKxxxxxxxxxxxxxxxxxxxxxxxxxxxxxxxxxxxxxxxVRTNAAMGAVFTEENQWDSAKAAV
xxxxxxxxxxxERELHKLGKCGSCVYNMMGKxxxxxxxxxxxxxxxxxxxxxxxxxxxxxxxxxLNE
DHWFSRGNSFSGVEGEGLHxxxxxxxxxxxxxGDLIYADDTAGWxxxxxxxxxxxxxxxxxxxxxx
xxxxxxxxxxxNKVVKVQRPTPxGTVMDIISRRDxxxxxxxxxxxxxxxxxxxEAQLIRQMEGEGIxx
xxxxxxxxxxxxxxxxxxxxxxxxxxxERLRRMAISGDDCVVKPTDDRFxxALIALNDMGKIRKDIQQW
EPSRGWHDWQQVPFCSHHFHELVMKDGRxxxxxxxxxxxxxxxxxxxxxxxLKETACLGKSYAQMW
ALMYFHRRDLxxxxxxxxxxxxxxxxxxxSRTTWSIHASHEWMTTEDMLAVWNRVWIxxxxxxxxxxx
xxxxNVPYLGKREDxxxxxxxGLTARATWATNIxxxxxxxxxxxxxxxxxxDYMPAMKRYSxxxxxxxx
xx >DENVall|peptide_length:10|string5 xxxxxxxxxxxxxxxxxxxxxxxxxxxxGLVKRFSSELLSGRGPLKLFMAFVAFLxxxxxxxxxxxxxx
xxxxxxxxxxxxxxGFKREISNMLxxxxxxxxxxxxxxxxxxxxxxxxFSLTTRGGEPHMVVxxxxKGKS
LLFKTKxxxNMCTLMALDLGxxxxxxxxxxxxxxxxxxxxxDVDCWCNTTETWVTYGTCxxxxxxxxxxx
xSVALTPHSGTGLETRxxxxxSSEGAWRQIQxIETWVLRHPGFxxxxxxxxxxxxxxxxxxxxxxxxxx
xxxxxxxxMRCIGIGNRDFVEGLxxxxxxxxxxxxHGSCVTTIAKSKPTLDIELxxxxxxxxxxxxxxx
xxxxxxxxxxDSRCPTQGEPxxxxxxxxxxxxxxLVDRGWGNGCGLFGKGSLLTCAKFxxxxxxxxxx
xxxxxxxxxxxxxxxxxxxxxxxxxxxxxxxxxxxxxxxxxxxxxxxxxMECSPRTSLDxxxx
xxxxxxxxAWMVHRQWFLDLxxxxxxxxxxxxxxxxxVTFKNPHAKKQEVAVLGSxxxxxxxxxx
xxxxxxxxxxxxxxxxxxxYAGHLKCKVRxxxxxxxxxxxxxxxxxxxxxxxxxxxxxxxxxxxxxxx
xxxxxxxxxxxxxxxxxxxxxxxxxxxxxxxVNIEAEPPSGESxxxxxxxxxxxxxxxxxxxxxxxxx
xxxxxxxxxxxxxxxxxxxxxxxxxxxxxxxxxAYTALFGGVSWxxxxxxxxxVLTWLGL
NSRNxxxxxxxxxxxxxxxxxxxxxxxxxxxxxxxSKELKCGNGIFVADNVHTRTEQYQFQPESPAR
VASAILNxxxxxxxxxRSTTRMENLLWKQVxxxxxxxxxxxxxxxxxxxxxxxxxxxxxxxxxxxxx
xxxYSWKIWGKAKxxxxxxxxxxxxxxxxxxxxxxxxxxxxxFEVEDYGFGVFTTNIWLRxxxxxxx
xxxxxxxxxxKDDRAVHADMGYWIESRLNxxxxxxxxxxxxxxxxxxxxxxxxxxxxVLESEMVIPK
xxxxxxxxxxxxxTQAAGPWHLGxxxxxxxxxxxxxxxxxxxxGHRGSSLRTTxxxxxxxxxxxxxxx
xSCTLPPLRFKGEDGCWYGxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxLT
SKELMMTTxxxxxxxxxxxxxxxxxxxxxxxxxxxxxxxxxxxxxxxxxxxxxxxxxWPLNEAVMAVGVV
SILASSFLRNDVPxxxxxxxxxxxxxxxxxxxxxGSSADLSLERxxxxxxxxxEAEHSGTSHNxxxxxAEDG
SFSIRDIEETxILTILLKATLLAISGxxxxxxxxxxxxxxxxxxxxxxxxxxxxxALWDVPSPATxxxxxxxx
xxxxxxxxxxGKTQVGVGVHxxxxxxxxxHVTRGAVLTHxSGRLEPNWANVKKDLxxxxxxxxxxxx
WDREEDVQVLAxxxxxxxxxxxxxxxxxxxxxxxAGTIGAVSLDxxxxxxxxxxxxxxxxxxxxxGNGVVT

FIG. 62-18

```
RSGTYVSAIAQTxxxxxxxxxxxxxxxxxxxxxxxxxxxxxxGKTRRYLPAMVREAIRRGLRTLILAx
xxxxxxxxxxxxxxLPIRYQTTAIKAEHTGREIVxxxxxxxxxxxxxxPVRVPNYNLVIxxxxxxxxx
xxxxxxxxxxxxxxxxxxxxxxxxxxxxxxEAFPQSNAPIQDEEKDIPERxxxxxxxxxxxxFVGKTV
WFVPSxxxxxxxxxxxxxxxxxxxxxxxxSRKTFDSEYAKTxANDWDFVVTTxxSEMGANFRAERVIDPRR
xLKPVISTDGEERVVLAxxxxxxxxxxxxQRRGRIGRNLxKEGDQYVFSGDPLRNDEDxxxxxxxxxx
xxxxxxxxxxxxxxxGPEREKNAAVDGEYRLRxxQRKTFVELMKxxxxPVWLAYKVASxxxxxxxxxx
xxxxRNNQILEENVxxxxxxxxxxxxxxxxxxxxxxxxxxxxxxxxxxxxxxxxxxxxDILTEIATL
PxxxxxxxRNALDNLAVLxxxxxxxxxAYTHALSELPExxxxxxxxxxxxxxxxxxxxxxxxxxxxx
xxxxxxxxxxxxxxxxxxVPLQWIASAIxxxxxxxxxxxxxxxxxxxxxNQLIYVILAILxxxxxxx
xxEMGLIEKTKADxxxxxxxxxxxxxxxxxxxxxxxxxxxxxxxxxxTLYAVATTFITPMLRHSIExxxxx
xxxxxxxxQATVLMGLGRGWPLHRVDLGVPLLAMxxxxQVNPTTLIASLxxxxxxxxxxxxxxxxxxx
xxxxxxxxxxxxKNPTVDGVTVIDLDPIPYDPKFExxxxxxxxxxLCVGQLLLMRTSWAFCEALTLAT
GPVxxxxxxxxxxxxxxxxxxxxxxxxxxxxxxxxAGLLFSIMRNxxxxxxxxxxxxxxxxxxxxxx
xxxxxxxxxYKRSGIIEVDRxEAKEGLRRGExxKYAVSRGTSKIRWIVERGMIxPEGKVMDLGCGxxx
xxYYCGGLKDVREVxxxxxxxxxxxxxxxxxxTYGWNLVKLYSGKDVFFxxxxxxxxxxxxxxESSPNP
TVEAGRTxxxxxxxxxxxxxxxxxxxIKVLNPYMPTVVxxxxxxxxxxxxxxxxxxxxxxTHEMYWVS
GVSGNIVSSVNTISKMLLNRFTxxxxxPTYEKDADLGTGTRHVAVExxxPNMDVIGERIRRIxxxxxx
xWHYDHENPYRTxxxxxxxxxxxxxxxxxxxxxxRLLTKPWDMIPMVTQxxxxxxxxxxxxxxxxxx
xxxxxxxxxxxxxxxxxxxxxxxxxxxxxxxxxxxxxxxxxxxxxxxxSNAALGAVFTEENQWDSARAAV
xxxxxxxxxxxERNLHLDGKCETCVYNxxxxxxxxxxxxxxxxxxxxxxxxxxxxxxxxxxxxxxxx
xxxxxRENSFSGVEGExxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxEVQLVRQMEGEGVxx
xxxxxxxxxxxxxxxxxxxxxxxxxxxxxxxxxxxxxxxxxxxxCVVKPVDDRFxxALFALNDMGKxxxxxxxQW
EPSKGWSDWTQVPFCSxxxxxxxxxxxxxxxxxxxxxxxxxxxxxxxxxxxxxxxxxxxLGKAYAQMW
ALMYxxxxxxxxxxxxxxxxxxxxxxxxxxxxxxxxEWMTTEDMLTxxxxxxxxxxxxxxxxxxxxx
xxxxEIPYLGKREDxxxxxxxGLTARATWASNIxxxxxxxxxxxxxxxxxDYMPVMRRYSxxxxxxxxx
xx >DENVall|peptide_length:11|string1 xxxxxxxxxxPPFNMLKRERNRVSTxxQLAKRFSKGLLxGQGPMKLVMAFIAFLRFLAIPPTAGILKR
WGxxxxxxxxxxxxxxxxxxxxxxxxxxxxxxxxxxxxxxxFHLTTRNGEPHMIVxxQERGKS
LLFKTAxxxNMCTLIAMDLGExxxxxxxxxxxxxxxxEPEDIDCWCNLTSxxxxxxxxxxxxGEHRRDK
RSVALAPHVGMGLETRTETWMSSEGAWKHxxxVETWALRHPGFxxxxxxxxxxxxxxxxxxxxxxxx
xxxxxxxxMRCVGVGNRDFVEGLSGATWVDVVLEHGGCVTTMAKNKPTLDFELIKTxxxxxxxxxxx
xxxxxxxxTTDSRCPTQGEAxxxxxxxxxxxxxxxFVDRGWGNGCGLFGKGSLVTCAKFxxxxxxxx
xxxxxxxxxxxxxxxxxxxxxxxxxxxxxxxxxxxxxxxxxxxxxxxxxxxxxxLECSPRTGLDFNEM
VLLxxxxKSWLVHKQWFLDLPLPWxxxxxxxxxxxxxxxDLLVTFKTAHAKKQEVVVLGSQEGAMHTAL
TGATEIQxxxxxxxxFAGHLKCRLKMDKLxxxxxxxxxxxxxxxxxxxxxxxxxxxxxxxxxxxxxx
xxxxxxxxxxxxxxxxxxxxxxxxxxxxxxxxxxNIEAEPPFGESxxxxxxxxxxxxxxxxxxxxxx
xxEATARGARRMAILGDTAWDFGSVGGVxxxxxxxxxxxxxAYGVLFSGVSWxxxxxxxxxxxxxxx
xxxxxxxxxxxxxxxxxxxxxxxxxxxxxxxxxxxxxxxGRELKCGSGIFVTNEVHTWTEQYKFQADSPSK
LASAIQKxxxxGVCGIRSVTRLENIMWKQIxxxxxxxxxxxxxxxxxxxxxxxxxxxxxxxxxxxxx
xxxxxxxxxxxxxxxxxxxxxxxxxxxxxxxxxxxxxxxxxxWEVEDYGFGVFTTNIWLKxxxxxxx
xCDHRLMSAAIKDSKAVHADMGYWIESSKNxxxxxxxxxxxxxxxxxWPKSHTLWSNGVLESEMIIPK
xxxxxxxxxxxxGPWHLGKLELDFxxxxxxxxxxxxxxxxGNRGPSLRTTTASGKLIHEWCC
RSCTMPPLRFRGEDGCWYGMEIRPLxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
```

FIG. 62-19

```
xxxxxxxxxxxxxxxxxxxxxxxxxxxxxxxxxxxxxxxxxxxxxSWPLNEGIMAVGMV
SILASALLKNDIPMTGPLVAGGLLTVCYVLSGSSADLSLEKxxxxxxxxxxxxxxxxxxxxxxxEDG
SMSIKNEEEExMLTILIRTGLLVISGxxxxxxxxxxxxxxxxxxxxxxxxAGVLWDVPSPPPxxxxxxxx
xxxxxxxxxxxxxxxxxxxxxxxxxEGVFHTMWHVTRGSVICHxGGRLEPSWASVKKDLISYGGGWRLxxx
WKEGEEVQVIALEPGKNPRAVQTxxxxxxxxxTGTIGAIALDFKPGTSGSPIINxKGKVVGLYGNGVVT
KSGDYVSAITQAxxxxxxxxxxxxxxxxFRKRRLTIMDLHPGAGKTKRYLPAIVREALKRRLRTLILAP
TRVVAAEMEEALRGLPIRYQTPAVKSEHTGREIVDLMCHATFTMRLLSPVRVPNYNLIIMDEAHFTDP
ASIAARGYISTRVGMGEAAAIFMTATPPGSxxxxxxxxxxxIQDEEREIPERSWNTGFxxxxxFKGKTV
WFVPSIKAGNDIANCLRKNGKKVIQLSRKTFDTEYQKTxLNDWDFVVTTDISEMGANFRADRVIDPRR
CLKPVILTDGPERVILAGPMPVTVASAAQRRGRIGRNPxNENDQYIYMGQPLNNDEDHAHWTEAKMLL
DNINTPEGIIPALFEPEREKSQAIDGEYRLRGEARKTFVELMRRGDLPVWLSYKVASxxxxxxxxxxx
xxxxxNNQILEENMDVEIWTKEGERKKLRPRWLDARVYSDPLALKEFKEFAAGRKxxxxxxxxxxxxx
xxxxxxxxKLALDNIVMLHTTExxxxAYQHALSELPETLETLLLLxxxxxxxxxxxxxxxxxxxxxxx
xxxxxxxxxxxxxxxxxxxxxQPHWIAASIILEFFLMVLLIPEPEKQRTPQDNQLTYVVIAILxxxxxxx
xNEMGFLEKTKKDxxxxxxxxxxxxxxxxxxxxxLDVDLRPASAWTLYAVATTVLTPMLRHSIENSSVN
VSLTAIANQAAVLMGLGKGWPLSKMDLGVPLLALGCYSQVNPLTLTAAVxxxxAHYAIIGPGLQAKAT
REAQKRTAAGIMKNPTVDGITVIDLEPIPYDPKFEKQLGQVMLLVLCVTQVLLMRTTWALCEALTLAT
GPITTLWEGNPGKFWNTTIAVSMANIFRGSYLAGAGLAFSLIKNx

FIG. 62-20 xxxxxxxxxxxxxxxxxxxxxxxxxxxxxxxxxxxxxxxxxxWEVEDYGFGIFTTNIWLKxxxxxxx
xCDSKLMSAAIKDQRAVHADMGYWIESEKNxxxxxxxxxxxxxxxxxWPKTHTLWSNGVLESDMIIPK
xxxxxxxxxxxxxxxxxGPWHLGKLEIDFxxxxxxxxxxxxxGTRGPSLRTTTASGKLVTQWCC
RSCTLPPLRYLGEDGCWYGMEIRPVxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxSWPLNEGVMAVGLV
SLLGSSLLKNDVPLAGPMVAGGLLLAAYVMTGRSADLELERxxxxxxxxxxxxxxxxxxxxxxDDG
TMKIKDEERDxTITLLVKLALITVSGxxxxxxxxxxxxxxxxxxxxxSGALWDVPSPAAxxxxxxxx
xxxxxxxxxxxxxxxxxxxxxEGTFHTMWHVTRGAVLMHxTKRIEPSWADVRKDLISYGGGWKLxxx
WDKGEEVQVLAIEPGKNPKHVQTxxxxxxxxxEGEIGAVSLDFKPGTSGSPIVNxKGKVIGLYGNGVVT
TSGTYVSAIAQAxxxxxxxxxxxxxxxFKKKNLTIMDLHPGAGKTKRILPSIVREAIKRGLRTLILAP
TRVVASEMAEALKGMPIRYQTTAVKSEHTGKEIVDLMCHATFTTRLLSSTRVPNYNLIVMDEAHFTDP
SSVAARGYISTRVEMGEAAGIFMTATPPGSxxxxxxxxxxxIEDIEREIPERSWNSGHxxxxxxYQGKTV
WFVPSIKAGNDIAACLRKNGKRVIQLSRKTFDTEYPKTxNTDWDYVVTTDISEMGANFRAERVIDPRR
CMKPVILTDGPERVILAGPIPVTPSSAAQRRGRVGRNPxQEDDQYVFMGEPLENDEDCAHWKEAKMLL
DNINTPEGIIPSMFEPEREKVDAIDGEFRLRGEQRKTFVDLMRRGDLPVWLAHKVASxxxxxxxxxxx
xxxxxNNQVLEENMEVEIWTKEGEKKKLKPRWLDARIYADPMALKDFKEFASGRKxxxxxxxxxxxx
xxxxxxxxQNALDNLAVLHTAExxxxAYNHALNELPESLETLMLVxxxxxxxxxxxxxxxxxxxxxx
xxxxxxxxxxxxxxxxxQPQWIAASIILEFFLIVLLIPEPDRQRTPQDNQLAYVVIGLLxxxxxxx
xNEMGLLETTKKDxxxxxxxxxxxxxxxxxxxLDVDLHPASAWTLYAVATTIITPMLRHTIENTSAN
LSLAAIANQAAILMGLDKGWPLHRMDIGVPLLAIGCYSQVNPITLTAALxxxxVHYAIIGPGLQAKAT
REAQKRAAAGIMKNPTVDGIVAIDLDPISYDAKFEKQLGQIMLLILCTGQLLMMRTTWALCESITLAT
GPLSTLWEGSPGRFWNTTIAVSTANIFRGSYLAGAGLLFSIMKNxxxxxxxxxxGETLGEKWKSRLN
xxxxxxxxxYKRSGILEVDRTEAKSALxxxxxxKHAVSRGSSKLRWFVERNMVxPEGKVIDLGCGRGG
WSYYMATLKNVREVKGLTKGGPGHEEPIPMSTYGWNLVRLQSGxxxxxxPTEQVDTLLCDIGESSPSP
TVEAGRTLRVLNLVENWLxxxxxEFCIKVLNPYMPSVIExxxxxxxxxGGALVRCPLSRNSTHEMYWVS
CGxxxxxxAVNMTSRMLLNRFTMxxxxxxxxEKDVDLGSGTRNIGIExxxxxxxxxxxxxxxxxxxxxx
TWHYDQDNPYRTWAYHGSYEAPSSGSASSMVNGVVKLLTKPWDVVPMVTQLAMTDTTPFGQxxVFKEK
VDTRTPQxxxxxxxxxxxxxxxxxxxxxxxxxxxxxxxxxxxxxKVRSNAALGAIFQEEQGWTSASEAV
xxxxxxxxxxxxxxLHLEGKCESCVYNMMGKREKKLGEFGRAKGSRAIWYMWLGARFLEFEALGFMNE
DHWFGRENSWSGVEGEGLHRLGYILExxxxxxGGNIYADDTAGWDTRITLEDLxxxxxxxxxxxxxxx
xxxxSIFKLTYQNKVVRVQRPTPxGAVMDVISRRDQRGSGQVVTYGLNTFTNMEVQLIRQMEAEGVxx
xxxxxxxxxxxxxxxxxxxxxxxxxDRLSRMAISGDDCVVKPLDERFxxxxxFLNDMGKVRKDIPQW
EPSKGWNDWTEVPFCSHHFHKIFMKDGRxIVVPCRNQDELVGRARVSQGAGWSLRETACLGKSYAQMW
QLMYFHRRDLRLASMAICSAVPxxWFPTSRTTWSIHAKHQWMTTEDMLKVWNRVWIxxxxxxxxxxxx
xxxxxIPYLGKREDLWCGSLIGLSSRATWAKNIxxxxxxxxxxxxxxxxxxxxxxxxxxxxxxxxx
xx >DENVall|peptide_length:11|string3 xxxxxxxxxxPSINMLKRVRNRVSTxxQLTKRFSLGMLxGRGPLKLFMALVAFLRFLAIPPTAGILAR
WGxxxxxxxxxxxxxxxxxxxxxxxxxxxxxxxxxxxxxxxFHLTTRGGEPHMIVxxNEKGKS
LLFKTExxxNMCTLMAIDLGExxxxxxxxxxxxxxxxxEPDDVDCWCNATDxxxxxxxxxxxGERRREK
RSVALAPHVGLGLDTRTETWMSSEGAWKQxxxIETWILRHPGFxxxxxxxxxxxxxxxxxxxxxxxx
xxxxxxxxMRCVGISSRDFVEGVSGGAWVDLVLEHGGCVTTIAKNKPTLDIELQKTxxxxxxxxxxx
xxxxxxxxTTESRCPTQGEPxxxxxxxxxxxxxxMVDRGWGNGCGLFGKGGIVTCAMFxxxxxxxxx
xxxxxxxxxxxxxxxxxxxxxxxxxxxxxxxxxxxxxxxxxxxxxxxxxxxxxxxLDCSPRSGIDFNEM

FIG. 62-21

```
ILMxxxxKTWLVHRQWFLDLPLPWxxxxxxxxxxxxxxxERMVTFKVPHAKKQDVVVLGSQEGAMHSAL
TGATEVDxxxxxxxFTGHLKCRLRMDKLxxxxxxxxxxxxxxxxxxxxxxxxxxxxxxxxxxxxxxxx
xxxxxxxxxxxxxxxxxxxxxxxxxxxxxxxxxxxxxNIEAEPPFGDSxxxxxxxxxxxxxxxxxxxx
xxETTMRGAKRMAILGETAWDFGSVGGLxxxxxxxxxxxxxVYTTMFGGVSWxxxxxxxxxxxxxxxx
xxxxxxxxxxxxxxxxxxxxxxxxxxxxxxxxxxxxxxNKELKCGSGIFVVDNVHTWTEQYKFQPESPAR
LASAILNxxxxGVCGIRSTTRLENVMWKQIxxxxxxxxxxxxxxxxxxxxxxxxxxxxxxxxxxxxxx
xxxxxxxxxxxxxxxxxxxxxxxxxxxxxxxxxxxxxxxxxxLEVEDYGFGMFTTNIWMKxxxxxxxx
xCDHRLMSAAVKDERAVHADMGYWIESQKNxxxxxxxxxxxxxxxxxWPRSHTLWSNGVLESQMLIPK
xxxxxxxxxxxxxxxxxxGPWHLGKLEMDFxxxxxxxxxxxxxxDHRGPSLRTTTVTGKIITEWCC
RSCTLPPLRYMGEDGCWYGMEIRPIxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxSWPLNEAIMAVGLV
SILLSSLLKNDVPLAGPLIAGGMLIACYVITGTSADLTVEKxxxxxxxxxxxxxxxxxxxxxxxxEDG
SFSIRDVEETxTLTILLKATLLAVSGxxxxxxxxxxxxxxxxxxxxxxxSGVLWDTPSPPExxxxxxxxx
xxxxxxxxxxxxxxxxxxxxxxxxxxxENVFHTMWHVTRGAVLMYxGKRLEPSWADVKNDMISYGGGWRLxxx
WNTEEDVQVLAVEPGKNPKNVQTxxxxxxxxxTGEVGAVTLDFSPGTSGSPIVDxEGKIVGLYGNGVVT
RSGAYVSAIAQTxxxxxxxxxxxxxxxFRKRRLTIMDLHPGSGKTRKYLPAIIREAIKRKLRTLILAP
TRVVAAEMEEALKGLPIRYQTPAIRAEHTGREIVDLxxxATFTMRLLSPVRVPNYNMVIMDEAHFTDP
SSIAARGYISTRVEMGEAAAIFMTATPPGTxxxxxxxxxxIMDEERDIPERSWNSGYxxxxxFPGKTV
WFVPSIKSGNDIANCLRKSGKKVIQLSRKTFDSEYVKTxLNDWDYVVTTDISEMGANFKAGRVIDPRR
CLKPVILKDGEERVILAGPMPVTHASAAQRRGRIGRNHxKENDQYIYSGDPLKNDEDHAHWTEAKMLL
DNIYTPEGIIPTLFGPEREKTAAIDGEYRLRGEARKTFVELMRRGDLPVWLAYKVAAxxxxxxxxxxx
xxxxxNNQILEENVEVEIWTKEGERKKLRPRWLDARTYSDPLALREFKEFAAGRRxxxxxxxxxxxxx
xxxxxxxRNALDNLVMLHNSExxxxAYRHAMEELPDTIETLMLLxxxxxxxxxxxxxxxxxxxxxxxx
xxxxxxxxxxxxxxxxxxxxELQWIASAIVLEFFLMVLLVPEPEKQRTPQDNQLIYVILTILxxxxxxx
xNEMGLIEKTKTDxxxxxxxxxxxxxxxxxxxxLDIDLRPASAWTLYAVATTFITPMMRHTIENTTAN
ISLTAIANQAVVLMGLDKGWPISKMDIGVPLLAMGCYSQVNPTTLTASLxxxxTHYAIIGPGLQxxxx
xxxxxxxxxxIMKNPTVDGIMTIDLDPVVYDSKFEKQLGQVMLLILCASQILLMRTTWAFCEVLTLAT
GPILTLWEGNPGRFWNTTIAVSMxxxxxxxxYLAGAGLAFSLMKSxxxxxxxxxxxGETLGEKWKKKLN
xxxxxxxxxYKRSGIMEVDRSEAKEGLxxxxxxKHAVSRGTAKLQWFVERNMVxPEGRVIDLGCGRGG
WSYYCGGLKNVTEVRGFTKGGPGHEEPVPMSTYGWNIVKLMSGxxxxxxPPERCDTLLCDIGESSPNP
TIEESRTIRVLKMVEPWLxxxxQFCIKILNPYMPSVVExxxxxxxxxGGNLIRCPLSRNSTHEMYWVS
GAxxxxxxSVNMVSRLLLNRFTMxxxxxxxEKDVDLGAGTRHVAVExxxxxxxxxxxxxxxxxxxxxx
TWHYDEDHPYKTWAYHGSYEVKPTGSASSMINGVVRLLTKPWDVLPMVTQIAMTDTTPFGQxxxFKEK
VDTRTQExxxxxxxxxxxxxxxxxxxxxxxxxxxxxxxxxxxxxxxxKVRSNAAIGAVFVDENQWNSAKEAV
xxxxxxxxxxxxxLHKQGKCATCVYNMMGKRxxxxxxxxxxxxxxxxxxxxxxxxRYLEFEALGFLNE
DHWFSRENSYSGVEGEGLHRLGYILRxxxxxxxGDLMYADDTAGWDTRITIEDLxxxxxxxxxxxxxx
xxxxxxxxLTYQNKVVRVQRPAKxGTVMDIISRRDQRGSGQVVTYSLNTFTNMEAQLIRQMESEGIxx
xxxxxxxxxxxxxxxxxxxxxxxxxxxxxxxERLRRMAISGDDCVVKPLDDRFxxxxxALNDMGKVRKDIQQW
QPSKGWNNWQQVPFCSHHFHQLIMKDGRxLVVPCRPQDELIGRARISQGAGWSLKETACLGKSYAQMW
TLMYFHRRDLRLASNAICSAVPxxWIPTSRTTWSIHATHQWMTTEDMLSVWNRVWIxxxxxxxxxxxx
xxxxxIPYLGKREDQWCGSLIGLTSRATWAQNIxxxxxxxxxxxxxxxxxxxxxxxxxxxxxxxxxxx
xx >DENVall|peptide_length:11|string4 xxxxxxxxxxTPFNMLKRERNxxxxxxQLAKRFSRGLLxGQGPMKMVMAFIAFLRFLTIPPTAGILAR
```

FIG. 62-22

```
WSxxxxxxxxxxxxxxxxxxxxxxxxxxxxxxxxxxxxxxxxxFHLSTRDGEPLMIVxxHERGRP
LLFKTTxxxNMCTLMAMDLGExxxxxxxxxxxxxxxxxEPDDVDCWCNATExxxxxxxxxxxxGERRREK
RSVALTPHSGMGLDTRAQTWMSSEGAWRQxxxVETWAFRHPGFxxxxxxxxxxxxxxxxxxxxxxxx
xxxxxxxxMRCVGIGSRDFVEGVSGGSWVDIVLEHGSCVTTxAKDKPTLDFELTKTxxxxxxxxxxxx
xxxxxxxxTTASRCPTQGEPxxxxxxxxxxxxxxxxVVDRGWGNGCGLFGKGSLITCAKFxxxxxxxxx
xxxxxxxxxxxxxxxxxxxxxxxxxxxxxxxxxxxxxxxxxxxxxxxxxxxxxxMECSPRTSLDFNEM
VLLxxxxKAWLVHKQWFLNLPLPWxxxxxxxxxxxxxxETLVTFKNPHAKRQDVIVLGSQEGAMRTAL
TGATEIQxxxxxxxFMGHLKCKVRMERLxxxxxxxxxxxxxxxxxxxxxxxxxxxxxxxxxxxxxxx
xxxxxxxxxxxxxxxxxxxxxxxxxxxxxxxxxxNIETEPPFGESxxxxxxxxxxxxxxxxxxxxxxx
xxEATAKGARRMAILGDTAWDFGSLGGVxxxxxxxxxxxxxxIYGAAFSGVSWxxxxxxxxxxxxxxx
xxxxxxxxxxxxxxxxxxxxxxxxxxxxxxxxxxxxxGKELKCGSGIFVIDNVHTWTEQYQFQADSPKR
LATAIAGxxxxGVCGIRSATRMENLLWKQIxxxxxxxxxxxxxxxxxxxxxxxxxxxxxxxxxxxxxx
xxxxxxxxxxxxxxxxxxxxxxxxxxxxxxxxxxxxxxxxxLEVEDYGFGVFSTNIWLKxxxxxxxxx
xCDSKLMSAAVKDNRAVHADMGYWIESALNxxxxxxxxxxxxxxxxxxxxxxxxxxWSNGVLESQMLIPR
xxxxxxxxxxxxxxxxxxxxGPWHLGRLEMDFxxxxxxxxxxxxxGHRGPSLRTTTVSGKLIHEWCC
RSCTLPPLRFKGEDGCWYGMExxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxSWPLNEGIMAIGIV
SILASSLLRNDVPMAGPLVAGGLLIACYVITGRSADLELEKxxxxxxxxxxxxxxxxxxxxxxxxDDG
TMRIKDDETExILTVLLKTALLIVSGxxxxxxxxxxxxxxxxxxxxxSGVLWDVPSPPExxxxxxxxx
xxxxxxxxxxxxxxxxxxxxxxxxDGVFHTMWHVTRGAVLTYxGKRLEPNWANVKKDLISYGGGWRFxxx
WQKGEEVQVIAVEPGKNPKNFQTxxxxxxxxxTGEIGAIALDFSPGTSGSPIIDxEGKVVGLYGNGVVT
KNGGYVSGIAQTxxxxxxxxxxxxxxxxFRKRRLTIMDLHPGSGKTRKYLPAIVREAIKRKLRTLVLAP
TxxxxxxxxxxLRGLPIRYQTTATKTEHTGREIVDLxxxxxxxxxxLSPIRVPNYNLVVMDEAHFTDP
CSVAARGYISTxxxxxxxxxAIFMTATPPGAxxxxxxxxxxxxIIDEEKDIPERSWNSGNxxxxxFAGKTV
WFVPSIKTGNDIAACLRKSGKRVIQLSRKTFDSEYIKTxTNDWDFVVTTDISEMGANFKAERVIDPRR
CLKPVILPDGPERVILAGPMPVTASSAAQRRGRIGRNQxKEGDQYIFTGDPLRNDEDHAHWTExxxxx
xxxxxxxxxxPTLFEPEREKSAAVDGEYRLKGESRKTFVELMKRGDLPVWLAYRVAAxxxxxxxxxxx
xxxxxNNQILEENMDVEIWTREGEKKKLRPKWLDARTYSDPLALKEFKDFAAGRKxxxxxxxxxxxxx
xxxxxxxxRDALDNLVMLHTSExxxxAYRHAVEELPETMETLLLLxxxxxxxxxxxxxxxxxxxxxx
xxxxxxxxxxxxxxxxxxxxPLQWIASAIILEFFMMVLLVPEPEKQxxxQDNQLAYVVIGILxxxxxxx
xNEMGLLETTKRDxxxxxxxxxxxxxxxxxxxxxxxxxWTLYAVATTIVTPMLRHTIENSTAN
VSLAAIANQATVLMGLGKGWPIHKMDLGVPLLALGCYSQVNPLTLIAAVxxxxxxxxxxxxxxxxxxx
xxxxxxxxxxIMKNPTIDGITVIDLEPVIYDSKFEKQLGQVMLLVLCAVQLLLMRTSWALCEVLTLAT
GPVMTLWEGNPGRFxxxxxxxxxxxxxxLAGAGLAFSIMKSxxxxxxxxxxxxGETLGEKWKNRLN
xxxxxxxxxYKKSGITEVDRTEAKEGLxxxxxxRHAVSRGSAKIRWIVERGMVxPEGRVIDLGCGRxG
WSYYCGGLKNVKEVRGFTKGGPGHExPVPMATYGWNLVKLYSGxxxxxxxxxxxxxxxxxxDIGESSPNP
TVEAGRTLRVLSLVENWLxxxxQFCVKVLNPYMPAVIExxxxxxxxxxGGSLVRCPLSRNSTHEMYWIS
NGxxxxxxSVNTTSKMLLNRFTTxxxxxxxERDVDLGAGTRHVNAExxxxxxxxxxxxxxxxxxxxxx
TWHYDDENPYKTWAYHGSYEVKATGSASSMINGxVRLLTKPWDVVPTVTQMAMTDTTxxxxxxxFKEK
VDTRTPKxxxxxxxxxxxxxxxxxxxxxxxxxxxxxxxxxxxKVRTNAAMGAVFTEENQWDSAKAAV
xxxxxxxxxxxxxxxxLHKLGKCGSCVYNMMGKRxxxxxxxxxxxxxxxxxxxxxxxxxxxxxFLNE
DHWFSRGNSLSGVEGEGLHRxxxxxxxxxxxGDLIYADDTAGWDxxxxxxxxxxxxxxxxxxxxxxx
xxxxxxxxxxxQN

FIG. 62-23

```
>DENVall|peptide_length:11|string5 xxxxxxxxxxxxxxxxxxxxxxxxxxxGLVKRFSSGLFxGRGPLKLFMAFVAxxxxxxxxxxxxxxx
xxxxxxxxxxxxxxxxxxxxxxxxxxxxxxxxxxxxxxxxxxxxxxFSLTTRGGEPHMVVxxxEKGKS
LLFKTKxxxNMCTLMALDLGExxxxxxxxxxxxxxxxxDDVDCWCNTTDxxxxxxxxxxxxxxxHRREK
RSVALTPHSGTGLETRxxxxxxxxxxxxxxxxIETWVLRHPGFxxxxxxxxxxxxxxxxxxxxxxxxx
xxxxxxxxMRCIGIGNRDFVEGLSxxTWVDLVLEHGGxxxxxAKSKPTLDIELxxxxxxxxxxxxxxx
xxxxxxxxxTDSRCPTQGEPxxxxxxxxxxxxxxLVDRGWGNGCGLFGKGSLLTCAKFxxxxxxxxx
xxxxxxxxxxxxxxxxxxxxxxxxxxxxxxxxxxxxxxxxxxxxxxxxxxxxxMECSPRTSLDFxxx
xxxxxxxKAWMVHRQWFLDLPxxxxxxxxxxxxxxxxxxxxMLVTFKNAHAKRQDVIVLGSQExxxHTVL
TGATEIQxxxxxxxYAGHLKCKVRMxxxxxxxxxxxxxxxxxxxxxxxxxxxxxxxxxxxxxxxxxx
xxxxxxxxxxxxxxxxxxxxxxxxxxxxxxxxNIEAEPPSGESxxxxxxxxxxxxxxxxxxxxxxxx
xxATTMRGAKRMAxxxxTAWDFGSIGGLxxxxxxxxxxxxxxxAYTALFGGVSWxxxxxxxxxxxxx
xxxxxxxxxxxxxxxxxxxxxxxxxxxxxxxxxxxxSKELKCGNGIFVTxxxxTRTEQYKFQPESPAR
VASAILNxxxxGVCGVRSTTRMENLLWKQVxxxxxxxxxxxxxxxxxxxxxxxxxxxxxxxxxxxxxx
xxxxxxxxxxxxxxxxxxxxxxxxxxxxxxxxxxxxxxFEVEDYGFGVFTTNIWLRxxxxxxxx
xxxxxxxxxxxKDDRAVHADMGYWIESRLNxxxxxxxxxxxxxxxxxxxxxxxxGVLESEMVIPK
xxxxxxxxxxxxxxxxxxxxxxxxxxxxxxxxxxxxxxxxxxxxxxGHRGSSLRTTTxxxxxxxxxx
RSCTLPPLRFKGEDGCWYGMxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxSWPLNEAVMAVGVV
SILASSFLRNDVPMxxxxxxxxxxxxxxxxxSGSSADLSLERxxxxxxxxxxxxxxxxxxxxxxxEDG
SFSIRDIEETxILTILLKATLLAISGxxxxxxxxxxxxxxxxxxxxxxxxGALWDVPSPATxxxxxxxx
xxxxxxxxxxxxxxxxxxxxxxxxxxxxxxWHVTRGAVLTHxSKRLEPNWANVKKDLxxxxxxxxxxx
WDREEDVQVLAxxxxxxxxxxxxxxxxxxxxxxAGTIGAVSLDFxxxxxxxxxxxxxxxxxxxxYGNGVVT
RSGTYVSAIAQTxxxxxxxxxxxxxxxxxxxxxxxxxxxxxSGKTRRYLPAMVREAIRRGLRTLILAP
xxxxxxxxxxxxGLPIRYQTTAIKAEHTGREIVDxxxxxxxxxxxxSPVRVPNYNLVIMxxxxxxxx
xxxxxxxxxxxxxxxxxxxxxxxxxxxxxxxxxxxxIQDEEKEIPERSWSSGHxxxxxFVGKTV
WFVPSIxxxxxxxxxxxxxxxxxxxxxLSRKTFDTEYTKTxANDWDFVVTTDISEMGANFRAERVIDPRR
CLKPVISTDGEERVVLAGxxxxxxxxxAQRRGRIGRNLxKEGDQYVFSGDPLRNDEDHxxxxxxxxxx
xxxxxxxxxxxxxxFGPEREKNAAVDGEYRLRGEQRKTFVELMKRGDLPVWLAYKVASxxxxxxxxxx
xxxxxxxxxxxxxxxxxxxxxxREGEKKKLRPKxxxxxxxxxxxxxxxxxxxxxxxxxxxxxxxxxx
xxxxxxxxRNALDNLAVLHTxxxxxxAYTHALSELPETxxxxxxxxxxxxxxxxxxxxxxxxxxxxxx
xxxxxxxxxxxxxxxxxxxxxxxxxxxxxxxLMVLLVPEPEKxxxxxDNQLIYVILAILxxxxxxxx
xNEMGLIEKTKADxxxxxxxxxxxxxxxxxxxxxxxxxxxxxxxxWTLYAVATTFITPMLRHSIENxxxx
xxxxxxxNQATVLMGLGRGWPLHRVDLGVPLLAMGxxSQVNPTTLIASLxxxxxxxxxxxxxxxxxxx
xxxxxxxxxxxMKNPTVDGVTVIDLDPIPYDPKFEKxxxxxxxxxxLCVGQLLLMRTSWAFCEALTLAT
GPVSTLWEGNPGKFxxxxxxxxxxxxxxxxxxGAGLLFSIMRNxxxxxxxxxxxxxxxxxxxxxxxx
xxxxxxxxxYKRSGIIEVDRxxxxxxxxxxxxKYAVSRGTSKIRWIVERGMIxPEGKVMDLGCGRxx
xSYYCGGLKDVTEVRGFTKGGPxxxxxxxxSTYGWNLVKLMSGxxxxxxxxxxxxxxxxxxGESSPNP
TIEAGRTLRVLSxxxxxxxxxxxxxCIKVLNPYMPTVVExxxxxxxxxxxxxxxxxxxxxSTHEMYWVS
GVxxxxxxxSVNTISKMLLNRFTTxxxxxxxxRDVDLGTGTRHVAVExxxxxxxxxxxxxxxxxxxxx
TWHYDHENPYRTWxxxxxxxASSTGSASSMVNxxVRLLTKPWDMIPMVTQxxxxxxxxxxxxxxxxxx
xxxxxxxxxxxxxxxxxxxxxxxxxxxxxxxxxxxxxxxRSNAALGAVFTEENQWDSARAAV
xxxxxxxxxxxxLHLDGKCETCVYNMxxxxxxxxxxxxxxxxxxxxxxxxxxxxxxxxxxxxxxxxx
xxxxxRENSFSGVEGEGLHKxxxxxxxxxxxxxxxxxxxxxxxxxxxxxxxxxxxxxxxxxxxxxxx
```

FIG. 62-24
xxxxxxxxxxxxxxxxxxxxxxxxxxxxxxxxxxxxxxxxxxxxxxxxxxEVQLVRQMEGEGVxx
xxxxxxxxxxxxxxxxxxxxxxxxxxxxxxxxxxxxxxxxxDCVVKPVDDRFxxxxxxxxxxxxxxxxxxxxQW
EPSKGWSDWTQVPFCSHxxxxxxxxxxxxxxxxxxxxxxxxxxxxxxxxxxxxxxxxxxCLGKAYAQMW
ALMYFxxxxxxxxxxxxxxxxxxxxxxxxxxxxxxxxxHEWMTTEDMLTVxxxxxxxxxxxxxxxxxx
xxxxxxxxxxxxxxxxxxxIGLTARATWASNIxxxxxxxxxxxxxxxxxxxxxxxxxxxxxxxxxxx
xx

FIG. 63-1

\>panFIVE|peptide_length:8|string1

```
xxxxxxxxxxxxxxxxxxxxxxxxxxxxxxxxxxxSQLAKRFSKGLxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxGKSLLFKTxxxxxxxxxxxxxxxxxxxxxxxxxx
xxxEPEDIDCWCxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxVL
EHGSCVTxxxxxxxxxxxxxxxxxxxxxxxxxxxxxxxxxxxxxxxxxxxxxxxxxxxxxxxxxxxx
xxxVDRGWGNGCGLFGKGSLxxxxxxxxxxxxxxxxxxxxxxxxxxxxxxxxxxxxTGDQHQVGNxxx
xxxxxxxxxxxxxxxxxxxxxxxxxxxxxxxxCSPRTGLDxxxxxxxxxxxxxxxxxxxxxxxxxxx
xxxxxxxxxxxxxxxxxxxxxxxxxxxxxxxxxVLGSQEGAMHxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxEPPFGDSYIxxxxxxxxxxxxxxxxxxxxxxx
xxxxGARRMAILGDTAWDFGSIGGxxxxxxxxxxxxxxxxxxxxxxxxxxxxxxxxxxxxxxxxxxx
xxxxxxxxxxxxxxxxxxxxxxxxxxxxxxxxxxxxELKCGSGIFxxxxVHTWTEQYKxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxEVEDYGFGxxxxxxxxx
xxxxxxxxxxxxxxxxxxxxxxAVHADMGYWIESxxxxxxxxxxxxxxxxxxxxxxxxWPKSHTLWSNGxx
xxxxxxxxxxxxxxxxxxxxxxxxxxxxxxxxxxxxxxxxxxxxxxxxxxxxxxxxxxxxxxxxxxx
xxxxEWCCRSCTLPPLRxxGEDGCWYGMEIRPxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxVFHTMWHVTRGAVLxxxxxxxxxxxxxxxxxxxxxxxxxxxxxxxxxxxxxxxxxxxxxxxxxxx
xxxxxxxxxxxxxxxxxxxxxxxxPGTSGSPIVxxxxxVVGLYGNGVVTxxxxxxxxxxxxxxxxxx
xxxxxxxxxxxxxxxxxxLTIMDLHPGSGKTRxxxxxxxxxxxxxxLRTLILAPTRVVAAEMEEALxGL
PIRYQTxxxxxxxxxGREIVDLMCHATFTMRLLSPxRVPNYNLIIMDEAHFTDPASIAARGYISTRVGM
GEAAAIFMTATPPGSxxxxxxxxxxxxxxxxxxxxxxxxxxxxxxxxxxxxxGKTVWFVPSIKxxxx
xxxxxxxxxxxVIQLSRKTFDxxxxxxxxxxDWDFVVTTDISEMGANFKAxRVIDPRRCLKPVILxxxx
xxxxxxxxxxxxxASAAQRRGRIGRNxxxxxxxxxxxxxxxxxxxxxxxxxWTEAKMLLDNIxxxxxxxx
xxxxxxxxxxxxxDGEYRLRGExxxxxxxxLMRRGDLPWLSYxxxxxxxxxxxDRRWCFDGxxxxxxxxx
xxxxxxxxxxxxxxxxxxxxxxxxxxxxxxxxxxxxxxFAAGRRSVxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxLLIPEPEKQRTPQDNQLAxxxxxxxxxxxxxxxxx
xxxxxxxxxxxxxxxxxxxxxxxxxxxxxxxxDLHPASAWTLYAVATTxxxxxxxxxxxxxxxxxxx
xxxxxxxxxxxxxxxxxxxxxxxxxxxxxxxxxxxxxxxxxxxxHYAIIGPGLQAKATREAQKRT
AAGIMKNPTVDGxxxxxxxxxxxxxxxxxxxxFEKQLGQVxxxxxxxxxxxxxxxxxxxxxxxxxx
xxxxxxxxxGKFWNTTIAVSxANIFRGSYLAGAGLxxxxxxxxxxxxxxxxxxxxxxGETLGEKWKxxx
xxxxxxxxxxxxxxxxxxxxxxxxxxxxxxxxxxxxxxxxxAVSRGTAKLRWFVExxxxxxxxGKVIDLGCGR
GGWSYYCxxxxxxxxEVKGYTKGGPGHEEPxxxxxxxxxxxxxxxxxxxxxxxxxCDTLLCDIGESSP
NxxxxxxxxxxxxxxxxxxxxxxxxxxxxxxKVLNPYMPxxxxxxxxxxxxxxxxLVRNPLSRNSTHEM
YWVSxxxxxxxxxxxxxxxxxxxxxxxxxxxxxxxxxxxxxxxxxxxxxxxxxxxxxxxxxxxxxxx
xxxxxxxxxxxxxPYKTWAYHGSYExxxxGSASSMVNGVVKLLTKPWDVxxxxxQMAMTDTTPFGQQR
VFKEKVDTRTPxxxxxxxxxxxxxxxxxxxxxxxxxxxxxxxxxxxxxxxxxxxxxxxxxxxxxxxx
xxxxxxxxxxxxxxxxxxxxxxxxxxxxxxxxTCVYNMMGKREKKLGEFGKAKGSRAIWYMWLGARFLEFEAL
GFLNEDHWFSRxxxxxSGVEGEGLHxxxxxxxxxxxxxMYADDTAGWDTRITxxxxxxxxxxxxxxx
xxxxxxxxxxxIFKLTYQNKVVRVQRPxxxxxTVMDVISRRDQRGSGQVGTYGLNTxxxxxxxxxxx
```

FIG. 63-2

```
xxxxxxxxxxxxxxxxxxxxxxxxxxxxxxxxxxxxxxRMAISGDDCVVKPxxxxxxxxxxxxLNDMGKVRK
DIxxxxxxxxxxDWQQVPFCSHHFHELxxxxxxxxxxVPCRNQDELIGRARISQGAGWSLxETACLGKS
YAQMxxLMYFHRRDLRLAANAICSAVPxxxxPTSRTTWSIHAxHQWMTTEDMLxVWNRVWIExxxxxx
xxxxxxxxxxxPYLGKREDQWCGSLIGLTxxxxxxxxxxxxxxxxxxxxxxxxxxxxxxxxxxxxx
xxxxxxxxxxxxxxxxxxxx >panFIVE|peptide_length:8|string2 xxxxxxxxxxxxxxxxxxxxxxxxxxxxxxxxxQQLTKRFSLGMxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxTDVITIPTxxxxxxxxxxxxxxxxxxxxxxxx
xxxEPDDVDCWCxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxVL
EHGGCVTxxxxxxxxxxxxxxxxxxxxxxxxxxxxxxxxxxxxxxxxxxxxxxxxxxxxxxxxxx
xxxTDRGWGNHCGLFGKGGIxxxxxxxxxxxxxxxxxxxxxxxxxxxxxxxSGEEHAVGNxxx
xxxxxxxxxxxxxxxxxxxxxxxxxxxxxxxxxCEPRSGIDxxxxxxxxxxxxxxxxxxxxxxxx
xxxxxxxxxxxxxxxxxxxxxxxxxxxxxxxxALGSQEGALHxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxEPPFGESYIxxxxxxxxxxxxxxxxxxxxxxx
xxxxGAKRLAALGETAWDFGSVGGxxxxxxxxxxxxxxxxxxxxxxxxxxxxxxxxxxxxxxxxx
xxxxxxxxxxxxxxxxxxxxxxxxxxxxxxxxxELRCGSGVFxxxxVEAWMDRYKxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxEVEDFGFGxxxxxxxxxx
xxxxxxxxxxxxxxxxxxxAIHSDLSYWIESxxxxxxxxxxxxxxxxxxxxxWPETHTLWGDGxx
xxxxxxxxxxxxxxxxxxxxxxxxxxxxxxxxxxxxxxxxxxxxxxxxxxxxxxxxxxxxxxxxx
xxxxDWCCRSCTMPPLRxxTDSDCWYAMEIRPxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxTFHTLWHTTKGAALxxxxxxxxxxxxxxxxxxxxxxxxxxxxxxxxxxxxxxxxxxxxxxxxx
xxxxxxxxxxxxxxxxxxxxxxxxxTGTSGSPIIxxxxxIIGLYGNGVIMxxxxxxxxxxxxxxxxx
xxxxxxxxxxxxxxxxxxxxITVMDLHPGAGKTKxxxxxxxxxxxxLRTAVLAPTRVVASEMAEALxGM
PIRYQTxxxxxxxxGKEIVDVMCHATLTHRLMSPxRVPNYNMFVMDEAHFTDPSSVAARGYISTRVEM
GEAAGVLMTATPPGTxxxxxxxxxxxxxxxxxxxxxxxxxxxxxxxxxxxxxxGKTVWFVPSVKxxxx
xxxxxxxxxxxxVVQLNRKSYExxxxxxxxxDWDYVITTDISEMGANFRAxRVIDPRRCMKPVILxxxx
xxxxxxxxxxxxxSSAAQRRGRVGRNxxxxxxxxxxxxxxxxxxxxxxWKEARIMLDNIxxxxxxxx
xxxxxxxxxxxxDGEYRLKGExxxxxxxxLLRTGDLPVWLAYxxxxxxxxxxxDRKWCFDGxxxxxxxx
xxxxxxxxxxxxxxxxxxxxxxxxxxxxxxxxxxxxxxxxFAAGRKSLxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxLLIPEPDRQRTPQDNQLTxxxxxxxxxxxxxxxxx
xxxxxxxxxxxxxxxxxxxxxxxxxxxxxxDLRPATAWSLYAVTTAxxxxxxxxxxxxxxxxxxxx
xxxxxxxxxxxxxxxxxxxxxxxxxxxxxxxxxxxxxxxxxxxxHYAYMVPGWQAEAMREAQKRA
AAGIMKNAVVDGxxxxxxxxxxxxxxxxxxxxxFEKQLGQIxxxxxxxxxxxxxxxxxxxxxxxx
xxxxxxxxxxGRVWNATTAIGxCHIMRGGWLSCLSIxxxxxxxxxxxxxxxxxxxxxGRTLGEVWKxxx
xxxxxxxxxxxxxxxxxxxxxxxxxxxxxxxxxxxxAVSRGSAKLQWFVExxxxxxxGKVVDLGCGR
```

FIG. 63-3

```
GGWCYYMxxxxxxxxEVKGLTKGGAGHEEPxxxxxxxxxxxxxxxxxxxxxxxxxxxxVDTLFCDIGESSP
SxxxxxxxxxxxxxxxxxxxxxxxxxxxxxxxKILNPYMPxxxxxxxxxxxxxxxxxLVRCPLSRNSTHEM
YWISxxxxxxxxxxxxxxxxxxxxxxxxxxxxxxxxxxxxxxxxxxxxxxxxxxxxxxxxxxxxxxxxxxx
xxxxxxxxxxxxxxPYRTWNYHGSYDxxxxGSASSMVNGVVRLLSKPWDTxxxxxQIAMTDTTAFGQQR
VFKEKVDTRTQxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxSCIYNMMGKREKKPGEFGRAKGSRAIWYMWLGARYLEFEAL
GFMNEDHWLGRxxxxGGVEGLGLQxxxxxxxxxxxxxxxxxIYADDTAGWDTKVTxxxxxxxxxxxxxxx
xxxxxxxxxxxxIIELTYQNKVVKVQRPxxxxxTVMDIISRKDQRGSGQVVTYALNTxxxxxxxxxxxxx
xxxxxxxxxxxxxxxxxxxxxxxxxxxxxxxxRMAVSGDDCVVRPxxxxxxxxxxxxL

FIG. 63-4

```
xxxxxxxxxxxxxxxxxxxxxxxxxxxxxxxxxxxxxxxFAAGRKSIxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxVLQPEPEKQRSQTDNQLAxxxxxxxxxxxxxxxxxx
xxxxxxxxxxxxxxxxxxxxxxxxxxxxxxxxxDLRPATAWALYGGSTVxxxxxxxxxxxxxxxxxxxx
xxxxxxxxxxxxxxxxxxxxxxxxxxxxxxxxxxxxxxxxxxxxxxxHYGYMLPGWQAEALRSAQRVF
FSGMVRNPMVDGxxxxxxxxxxxxxxxxxxxxMQKKVGQIxxxxxxxxxxxxxxxxxxxxxxxxxxxx
xxxxxxxxxxSSVWNSTTATGxCHVMRGSYLAGGSIxxxxxxxxxxxxxxxxxxxxGRTLGEQWKxxx
xxxxxxxxxxxxxxxxxxxxxxxxxxxxxxxxxxxxxxxPVSRGSAKLRWLVExxxxxxxGRVMDLGCGR
GGWSYYMxxxxxxxxEVRGYTLGRDGHEKPxxxxxxxxxxxxxxxxxxxxxxxxxxxSDTIMCDIGESSS
SxxxxxxxxxxxxxxxxxxxxxxxxxxxxxxxKVLCPYMPxxxxxxxxxxxxxxxxxLVRLPFSRNSNHEM
YWVSxxxxxxxxxxxxxxxxxxxxxxxxxxxxxxxxxxxxxxxxxxxxxxxxxxxxxxxxxxxxxxxx
xxxxxxxxxxxxxPYRTWTYHGSYExxxxGSASSLINGVVRLMSKPW

FIG. 63-5

```
xxVLHTLWHTTRGAAIxxxxxxxxxxxxxxxxxxxxxxxxxxxxxxxxxxxxxxxxxxxxxxxx
xxxxxxxxxxxxxxxxxxxxxKGTSGSPIxxxxxxIIGLYGNGLKTxxxxxxxxxxxxxxxxxx
xxxxxxxxxxxxxxxxITILDLHPGSGKTHxxxxxxxxxxxxxxxxxxxxxxRVVLKEMERALxGK
RVRFHSxxxxxxxxxGGEVIDAMCHATYVNRRLLPxRVPNYNLVIMDEAHWTDPHSIAARGYIATLAKE
NESATILMTATPPGKxxxxxxxxxxxxxxxxxxxxxxxxxxxxxxxxxxxxxxxRPTAWFVPSIAxxxx
xxxxxxxxxxxxVICLNSKTFExxxxxxxxxxKPDFVVTTDxSEMGANLDVxRVIDCRKSVKPTILxxxx
xxxxxxxxxxxxxxxxxxxxxxxxxxxxxxxxxxxxxxxxxxxxxxxxWTEAQILLDNIxxxxxxxx
xxxxxxxxxxxxxxAGHFRLTEExxxxxxxLVRNCDFTPWLAWxxxxxxxxxxxDRKWCFEGxxxxxxxx
xxxxxxxxxxxxxxxxxxxxxxxxxxxxxxxxxxxxxxxFASGRKSIxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxVVIPEAGKQRTPQDNQLIxxxxxxxxxxxxxx
xxxxxxxxxxxxxxxxxxxxxxxxxxxxxxxxDIQPARSWGTYVLVVSxxxxxxxxxxxxxxxx
xxxxxxxxxxxxxxxxxxxxxxxxxxxxxxxxxxxxxxxxxHLAIVVSGLEAELTRAAHKVF
FHAIMKNPTIDGxxxxxxxxxxxxxxxxxxxxMQKKVGQVxxxxxxxxxxxxxxxxxxxxxxxxx
xxxxxxxxxxSALWTMPVACGxSGVVRGSLWGFLPLxxxxxxxxxxxxxxxxxxxxxGDTLGDLWKxxx
xxxxxxxxxxxxxxxxxxxxxxxxxxxxxxxAVSRGSSKIRWIVExxxxxxxxGEVVDLGCGR
GGWSYYAxxxxxxxxGVKAYTIGGKGHETPxxxxxxxxxxxxxxxxxxxxxxxxxxxADTIMCDIGESSS
NxxxxxxxxxxxxxxxxxxxxxxxxxxxxxxxxxKVLAPYRPxxxxxxxxxxxxxxxLVRTPFSRNSTHEM
YYSTxxxxxxxxxxxxxxxxxxxxxxxxxxxxxxxxxxxxxxxxxxxxxxxxxxxxxxxxxxxxx
xxxxxxxxxxxxPYRTWQYWGSYRxxxxGSAASLVNGVVKLLSWPWNAxxxxxQMAMTDTTAxxxxxx
xxxEKVDTRAKxxxxxxxxxxxxxxxxxxxxxxxxxxxxxxxxxxxxxxxxxxxxxxxxxxxxxx
xxxxxxxxxxxxxxxxxxxxxxxxxxxxxxHCVYNMMGxxxKKLSEFGKAKGxxxxxFMWLGARYxxxxxx
xFLNEDHWLSRxxxxGGVEGISLNxxxxxxxxxxxxxxxxxxxxxxxxxxxxxxxxxxxxxxxx
xxxxxxxxxxVMEMAYHNKVVKVLRPxxxxxCIMDVITRRDQRGSxxxxxxxxxxxxxxxxxxxx
xxxxxxxxxxxxxxxxxxxxxxxxxxxxxxxxxxxxxxxxxxxxxxxxxxxxLNDMAKTRK
DIxxxxxxxxxxDWENVPFCSHHFHKIxxxxxxxxxxVPCRDQDELIGRGRVSPGNGWMIxDTACLAKA
YAQMxxLMYFHRRDLRTLSLAICSAVPxxxxPQGRTTWSIxxxGAWMTTEDxxxVWNRVWILxxxxxx
xxxxxxxxxxxPYLTKRQDMLCSSLVGRKxxxxxxxxxxxxxxxxxxxxxxxxxxxxxxxxxxxx
xxxxxxxxxxxxxxxxxxxx
```

>panFIVE|peptide_length:8|string5

```
xxxxxxxxxxxxxxxxxxxxxxxxxxxxxxxxxNKIKQKTKQIxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxDAATQVRVxxxxxxxxxxxxxxxxxxxxxxxxx
xxxEPVDVDCFxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxVL
ELGGCVTxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxVGAKQENWNxxx
xxxxxxxxxxxxxxxxxxxxxxxxxxxxxxxxxxxxxxCQVQTAVDxxxxxxxxxxxxxxxxxxx
xxxxxxxxxxxxxxxxxxxxxxxxxxxxxxxxxxxALGNQEGSLKxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxNPPFGDSYxxxxxxxxxxxxxxxxx
xxxxGVERLAVMGDTAWDFGSTGGxxxxxxxxxxxxxxxxxxxxxxxxxxxxxxxxxxxxxxxxx
xxxxxxxxxxxxxxxxxxxxxxxxxxxxxxxxxxELKCGDGIFxxxxSDDWLNKYSxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxAVHTDQSLWxxxxxxxxxxxxxxxxxxxxxxxxxxxxWPRTHTLWGEGxx
```

FIG. 63-6

```
xxxxxxxxxxxxxxxxxxxxxxxxxxxxxxxxxxxxxxxxxxxxxxxxxxxxxxxxxxxxxxxx
xxxxEWCCRTCTLPPVTxxGSDGCWYPMxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxWHVTRGAALxxxxxxxxxxxxxxxxxxxxxxxxxxxxxxxxxxxxxxxxxxxxxxxx
xxxxxxxxxxxxxxxxxxxxxxxxxxxxxxxxxxxxxxLYGNGILVxxxxxxxxxxxxxxxxxx
xxxxxxxxxxxxxxxxxTTILDMHPGSGxxxxxxxxxxxxxxxxxxxxxxRVVLSEMKEAFxGL
DVKFHTxxxxxxxxxxGREVIDAMCHATLTYRMLEPxGRQNWEVAIMDEAHFLDPASIAARGHLYHRARA
NESATILxxxxxxxxxxxxxxxxxxxxxxxxxxxxxxxxxxxxxxxxxxxxxxxxxAWFLPSIRxxxx
xxxxxxxxxxxVVVLNRKTFExxxxxxxxxxxxxxxxxxxxxxxxxxxxxxVIDCRTAFKPVLVxxxx
xxxxxxxxxxxxxxxxxxxxxxxxxxxxxxxxxxxxxxxxxxxxxxxxxxWKEASMLLDNMxxxxxxxx
xxxxxxxxxxxxxxPGEMRLRDDxxxxxxxLMKRGDLPVWLSWxxxxxxxxxxxSRNWTWEGxxxxxxxx
xxxxxxxxxxxxxxxxxxxxxxxxxxxxxxxxxxxxxxxYASGRRSFxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxVVIPEPGQQRSSDDNKLAxxxxxxxxxxxxxxxxxxxx
xxxxxxxxxxxxxxxxxxxxxxxxxxxxxDLKPGAAWTVYVGIVTxxxxxxxxxxxxxxxxxxxxx
xxxxxxxxxxxxxxxxxxxxxxxxxxxxxxxxxxHWSLILPGIKAQQSQRAHKVF
FSGVAKNPVVDGxxxxxxxxxxxxxxxxxxxxxxxxxxxxxxxxxxxxxxxxxxxxxxxxxxxx
xxxxxxxxxxxDTLWTMPVAxxxTGVMRGNHYAFVGVxxxxxxxxxxxxxxxxxxxxGKTLGEVWKxxx
xxxxxxxxxxxxxxxxxxxxxxxxxxxxxxxxxPVSRGTAKLAWLEExxxxxxxxxKVMDLGCGR
GGWCYYAxxxxxxxxSVKGFTLGRDGHxxxxxxxxxxxxxxxxxxxxxxxxxxxSDTLLCDIGESNP
DxxxxxxxxxxxxxxxxxxxxxxxxxxxxxxxxxxxxxxxxxxxxxxxxxxVIRNPLSRNSTHEM
YYVSxxxxxxxxxxxxxxxxxxxxxxxxxxxxxxxxxxxxxxxxxxxxxxxxxxxxxxxxxxxx
xxxxxxxxxxxxxPYRTWHYCGSYVxxxxGSAASMVNGVVKILTYP

FIG. 63-7

```
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxEPPFGESYIxxxxxxxxxxxxxxxxxxxxx
xxxxGARRMAILGDTAWDFGSIGGxxxxxxxxxxxxxxxxxxxxxxxxxxxxxxxxxxxxxxxxxxxx
xxxxxxxxxxxxxxxxxxxxxxxxxxxxxxxxxxxxELKCGSGIFxxxxVHTWTEQYKxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxAVHADMGYWIESxxxxxxxxxxxxxxxxxxxxxxWPKSHTLWSNxxx
xxxxxxxxxxxxxxxxxxxxxxxxxxxxxxxxxxxxxxxxxxxxxxxxxxxxxxxxxxxxxxxxxxxx
xxxxxWCCRSCTLPPLRxxGEDGCWYGMEIRPxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxVFHTMWHVTRGAVLxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxGLYGNGVVTxxxxxxxxxxxxxxxxxx
xxxxxxxxxxxxxxxLTIMDLHPGSGKTRxxxxxxxxxxxxxxLRTLILAPTRVVAAEMEEALxxx
xxxxxxxxxxxxxxGREIVDLMCHATFTMRLLSPxxxxxxxxxIMDEAHFTDPASIAARGYISTRVGM
GEAAAIFMTATPPGSxxxxxxxxxxxxxxxxxxxxxxxxxxxxxxxxxxxxxxGKTVWFVPSIKxxxx
xxxxxxxxxVIQLSRKTFxxxxxxxxxxxDWDFVVTTDISEMGANFKAxRVIDPRRCLKPVILxxxx
xxxxxxxxxxxxxASAAQRRGRIGRNxxxxxxxxxxxxxxxxxxxxxxxWTEAKMLLDNIxxxxxxxx
xxxxxxxxxxxxxDGEYRLRGExxxxxxxxLMRRGDLPVWLAxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxLLIPEPEKQRTPQDNQLAxxxxxxxxxxxxxxxxxx
xxxxxxxxxxxxxxxxxxxxxxxxxxxxxxxxxPASAWTLYAVATTxxxxxxxxxxxxxxxxxxxxxx
xxxxxxxxxxxxxxxxxxxxxxxxxxxxxxxxxxxxxxxxHYAIIGPGLQAKATREAQKRT
AAGIMKNPTVDGxxxxxxxxxxxxxxxxxxxxxxxxxFEKQLGQVMxxxxxxxxxxxxxxxxxxxxx
xxxxxxxxxGKFWNTTIAVSxANIFRGSYLAGAGLxxxxxxxxxxxxxxxxxxxxGETLGEKWKxxx
xxxxxxxxxxxxxxxxxxxxxxxxxxxxxxxxxxxxAVSRGTAKLRWxxxxxxxxxxxGKVIDLGCGR
GGWSYYCxxxxxxxxEVKGYTKGGPGHEEPxxxxxxxxxxxxxxxxxxxxxxxxxxCDTLLCDIGESSP
NxxxxxxxxxxxxxxxxxxxxxxxxxxxxxxxxxxxxxxxxxxxxxxxxxxxxLVRNPLSRNSTHEM
YWVSxxxxxxxxxxxxxxxxxxxxxxxxxxxxxxxxxxxxxxxxxxxxxxxxxxxxxxxxxxxxxxxx
xxxxxxxxxxxPYKTWAYHGSYExxxxGSASSMVNGVVKLLTKPWDxxxxxxxMAMTDTTPFGQQR
VFKEKVDTRTPxxxxxxxxxxxxxxxxxxxxxxxxxxxxxxxxxxxxxxxxxxxxxxxxxxxxxxxxx
xxxxxxxxxxxxxxxxxxxxxxxxxxxxxxTCVYNMMGKREKKLGEFGKAKGSRAIWYMWLGARFLEFEAL
GFLNEDHWFxxxxxxxxxxxxxxxxxxxxxxxxxxxxxxxxxxMYADDTAGWDTRITxxxxxxxxxxxx
xxxxxxxxxIFKLTYQNKVVRVQRPxxxxxxxMDVISRRDQRGSGQVGTYGLNTxxxxxxxxxxxx
xxxxxxxxxxxxxxxxxxxxxxxxxxxxxxxxxxxxxxRMAISGDDCVVKPxxxxxxxxxxxLNDMGKVRK
DIxxxxxxxxxxxDWQQVPFCSHHFHELxxxxxxxxxxVPCRNQDELIGRARISQGAGWSLxETACLGKS
YAQMxxLMYFHRRDLRLAANAICSAVPxxxxPTSRTTWSIHAxHQWMTTEDMLxxxxxxxxxxxxxx
xxxxxxxxxxxxxGKREDQWCGSLIGLTxxxxxxxxxxxxxxxxxxxxxxxxxxxxxxxxxxxxxxx
xxxxxxxxxxxxxxxxxxxx >panFIVE|peptide_length:9|string2 xxxxxxxxxxxxxxxxxxxxxxxxxxxxxxxQQLTKRFSLGMLxxxxxxxxxxxxxxxxxxxxxxxx
```

FIG. 63-8

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxEPDDVDCWCxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxVL
EHGGCVTxxxxxxxxxxxxxxxxxxxxxxxxxxxxxxxxxxxxxxxxxxxxxxxxxxxxxxxxx
xxxTDRGWGNGCGLFGKGGIxxxxxxxxxxxxxxxxxxxxxxxxxxxxxxxxxxSGEEHAVGNxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxALGSQEGALHxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxEPPFGDSYIxxxxxxxxxxxxxxxxxxxxxx
xxxxGAKRLAALGETAWDFGSVGGxxxxxxxxxxxxxxxxxxxxxxxxxxxxxxxxxxxxxxxx
xxxxxxxxxxxxxxxxxxxxxxxxxxxxxxxxxELRCGSGVFxxxxVEAWMDRYKxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxAIHSDLSYWIESxxxxxxxxxxxxxxxxxxxxxWPETHTLWGDxxx
xxxxxxxxxxxxxxxxxxxxxxxxxxxxxxxxxxxxxxxxxxxxxxxxxxxxxxxxxxxxxxxx
xxxxxWCCRSCTMPPLRxxTDSDCWYAMEIRPxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxTFHTLWHTTKGAALxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxGLYGNGVIMxxxxxxxxxxxxx
xxxxxxxxxxxxxxxxxITVMDLHPGAGKTKxxxxxxxxxxxxxLRTAVLAPTRVVASEMAEALxxx
xxxxxxxxxxxxxGKEIVDVMCHATLTHRLMSPxxxxxxxxxVMDEAHFTDPSSVAARGYISTRVEM
GEAAGVFMTATPPGTxxxxxxxxxxxxxxxxxxxxxxxxxxxxxxxxxxxGKTVWFVPSVKxxxx
xxxxxxxxxxxVVQLNRKSYxxxxxxxxxxxDWDYVITTDISEMGANFRAxRVIDPRRCMKPVILxxxx
xxxxxxxxxxxxxSSAAQRRGRVGRNxxxxxxxxxxxxxxxxxxxxxWKEARIMLDNIxxxxxxxx
xxxxxxxxxxxxxDGEYRLKGExxxxxxxxLLRRGDLPVWLSxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxLLIPEPDRQRTPQDNQLTxxxxxxxxxxxxxx
xxxxxxxxxxxxxxxxxxxxxxxxxxxxxxxxxxPATAWSLYAVTTAxxxxxxxxxxxxxxxxx
xxxxxxxxxxxxxxxxxxxxxxxxxxxxxxxxxxxxxxxxxxHYAYMVPGWQAEAMREAQKRA
AAGIMKNAVVDGxxxxxxxxxxxxxxxxxxxxxxxxFEKQLGQIMxxxxxxxxxxxxxxxxxxxxx
xxxxxxxxxxGRVWNATTAIGxCHIMRGGWLSCLSIxxxxxxxxxxxxxxxxxxxxGRTLGEVWKxxx
xxxxxxxxxxxxxxxxxxxxxxxxxxxxxxxxxxAVSRGSAKLRWxxxxxxxxxxGKVVDLGCGR
GGWCYYMxxxxxxxxEVKGLTKGGAGHEEPxxxxxxxxxxxxxxxxxxxxxxxxxxxVDTLLCDIGESSP
SxxxxxxxxxxxxxxxxxxxxxxxxxxxxxxxxxxxxxxxxxxxxxxxxxxxxxLVRCPLSRNSTHEM
YWISxxxxxxxxxxxxxxxxxxxxxxxxxxxxxxxxxxxxxxxxxxxxxxxxxxxxxxxxxxxx
xxxxxxxxxxxxxPYRTWNYHGSYDxxxxGSASSMINGVVRLLTKPWDxxxxxxxxIAMTDTTAFGQQR
VFKEKVDTRTQxxxxxxxxxxxxxxxxxxxxxxxxxxxxxxxxxxxxxxxxxxxxxxxxxxxxx
xxxxxxxxxxxxxxxxxxxxxxxxxxxxxxSCIYNMMGKREKKPGEFGRAKGSRAIWYMWLGARYLEFEAL
GFMNEDHWFxxxxxxxxxxxxxxxxxxxxxxxxxxxxxIYADDTAGWDTKVTxxxxxxxxxxxx
xxxxxxxxxxxIIELTYQNKVVKVQRPxxxxxxxMDIISRKDQRGSGQVVTYALNTxxxxxxxxxx
xxxxxxxxxxxxxxxxxxxxxxxxxxxxxxxRMAVSGDDCVVRPxxxxxxxxxxLNDMGKIRK
DIxxxxxxxxxxxDWTQVPFCSHHFHQLxxxxxxxxxxVPCRPQDELVGRARVSQGAGWSLxETACLGKA
YAQMxxLLYFHRRDLRLASNAICSAVPxxxxPTGRTTWSIHAxHEWMTTEDMLxxxxxxxxxxxxxx
```

FIG. 63-9 xxxxxxxxxxxxxGKREDIWCGSLIGTRxxxxxxxxxxxxxxxxxxxxxxxxxxxxxxxxxx
xxxxxxxxxxxxxxxxxxx >panFIVE|peptide_length:9|string3 xxxxxxxxxxxxxxxxxxxxxxxxxxxxxxxxSQLAKRFSRGLLxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxDPEDIDCWCxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxVL
EGDSCVTxxxxxxxxxxxxxxxxxxxxxxxxxxxxxxxxxxxxxxxxxxxxxxxxxxxxxxxx
xxxSDRGWGNHCGLFGKGSIxxxxxxxxxxxxxxxxxxxxxxxxxxxxxxxxxxNGDTHAVGNxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxALGSQEGGLHxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxEPPFGESNIxxxxxxxxxxxxxxxxxx
xxxxGAQRMAIIGETAWDFGSLGGxxxxxxxxxxxxxxxxxxxxxxxxxxxxxxxxxxxxxxx
xxxxxxxxxxxxxxxxxxxxxxxxxxxxxxxxEMRCGSGIFxxxxVEAWVDRYKxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxAVHGSPTFWMGSxxxxxxxxxxxxxxxxxxxxxxWPKTHTLWSNxxx
xxxxxxxxxxxxxxxxxxxxxxxxxxxxxxxxxxxxxxxxxxxxxxxxxxxxxxxxxxxxxxx
xxxxxWCCRSCSLPPLRxxTENGCWYGMEIxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxVFHTMWHVTRGSVIxxxxxxxxxxxxxxxxxxxxxxxxxxxxxxxxxxxxxxxxxxxxxxx
xxxxxxxxxxxxxxxxxxxxxxxxxxxxxxxxxxxxxxxGLYGNGVELxxxxxxxxxxxxxxx
xxxxxxxxxxxxxxxxMTVLDLHPGAGKTRxxxxxxxxxxxxxxLRTLVLAPTRVVAAEMAEALxxx
xxxxxxxxxxxxxGNAVVDLMCHATFTTRLLSSxxxxxxxxxIMDEAHFTDPSSIAARGYISTKVEL
NKCALVFMTATPPGAxxxxxxxxxxxxxxxxxxxxxxxxxxxxxxxxGKTVWFVASVKxxxx
xxxxxxxxxxxxVIQLNRKSYxxxxxxxxxxxDWDFVITTDISEMGANFGAxRVIDSRKSVKPTIIxxxx
xxxxxxxxxxxxxxxxxQRRGRVGRQxxxxxxxxxxxxxxxxxxxxxxxWTEAKIMLDNIxxxxxxxx
xxxxxxxxxxxxDGEFRLRGExxxxxxxLLTTADLPVWLAxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxVLIPEPEKQRSQTDNQLAxxxxxxxxxxxxxxxxx
xxxxxxxxxxxxxxxxxxxxxxxxxxxxxxPATAWALYGGSTVxxxxxxxxxxxxxxxxxxxx
xxxxxxxxxxxxxxxxxxxxxxxxxxxxxxxxxxxxxxxxHYGYMLPGWQAEALRSAQRVT
FSAMVRNPMVDGxxxxxxxxxxxxxxxxxxxMQKKVGQIMxxxxxxxxxxxxxxxxxxxxxxx
xxxxxxxxxxSSVWNSTTATGxCHVMRGSYLAGGSIxxxxxxxxxxxxxxxxxxxxxGRTLGEQWKxxx
xxxxxxxxxxxxxxxxxxxxxxxxxxxxxxxxPVSRGSAKLQWxxxxxxxxxxGRVMDLGCGR
GGWSYYMxxxxxxxxEVRGYTLGRDGHEKPxxxxxxxxxxxxxxxxxxxxxxxxxSDTIFCDIGESSS
SxxxxxxxxxxxxxxxxxxxxxxxxxxxxxxxxxxxxxxxxxxxxLVRLPFSRNSHEM
YWVSxxxxxxxxxxxxxxxxxxxxxxxxxxxxxxxxxxxxxxxxxxxxxxxxxxxxxxxxxxx

FIG. 63-10

```
xxxxxxxxxxxxxxPYRTWTYHGSYExxxxGSASSLVNGVVRLLSKPWDxxxxxxxxLAMTDTTPFxxxx
xFKEKVDTKAPxxxxxxxxxxxxxxxxxxxxxxxxxxxxxxxxxxxxxxxxxxxxxxxxxxxxxxxxxx
xxxxxxxxxxxxxxxxxxxxxxxxxxxxTCIYNMMGKREKKLGEFGVAKGSRAIWFMWLGSRFLEFEAL
GFLNEDHWLxxxxxxxxxxxxxxxxxxxxxxxxxxxxxxxxxFYADDTAGWxxxxxxxxxxxxxxxxxx
xxxxxxxxxxIMQLTYRHKVVKVMRPxxxxxxxMDIISREDQRGSGQVVTYGLNTxxxxxxxxxxxxxx
xxxxxxxxxxxxxxxxxxxxxxxxxxxxxxxxxxxRMLVSGDDCVVRxxxxxxxxxxxxxLNAMSKVRK
DIxxxxxxxxxxNWQEVPFCSNHFTELxxxxxxxxxxVPCRGQDELVGRARISPGAGWNVxDTACLAKS
YAQMxxLSYFHRRDLRLMSMAICSAVPxxxxPTGRTSWSIHSxGAWMTTEDMLxxxxxxxxxxxxxxxx
xxxxxxxxxxxxxxGKREDLWCGSLIGLSxxxxxxxxxxxxxxxxxxxxxxxxxxxxxxxxxxxxxxxx
xxxxxxxxxxxxxxxxxxx >panFIVE|peptide_length:9|string4 xxxxxxxxxxxxxxxxxxxxxxxxxxxxxxxxxQGLVKRFSTGLFxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxDPEDVDCWCxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxVL
EGDSCLTxxxxxxxxxxxxxxxxxxxxxxxxxxxxxxxxxxxxxxxxxxxxxxxxxxxxxxxxxxxxxx
xxxxxxxxxxCGLFGKGGVxxxxxxxxxxxxxxxxxxxxxxxxxxxxxxxxxxxxSGEENAVGNxxx
xxxxxxxxxxxxxxxxxxxxxxxxxxxxxxxxxxxxxxxxxxxxxxxxxxxxxxxxxxxxxxxxxxxxx
xxxxxx

FIG. 63-11

```
xxxxxxxxxxxxxxxxxxxxxxxxxxxxxPARSWGTYVLVVSxxxxxxxxxxxxxxxxxxxxxxxx
xxxxxxxxxxxxxxxxxxxxxxxxxxxxxxxxxxxxxxxxxxxHLAIVVSGLEAELTRAAHKVF
FAGIMKNPTIDGxxxxxxxxxxxxxxxxxxxxMQKKVGQVLxxxxxxxxxxxxxxxxxxxxxxxx
xxxxxxxxxxSALWTMPVACGxSGVVRGSLWGFLPLxxxxxxxxxxxxxxxxxxxGDTLGDLWKxxx
xxxxxxxxxxxxxxxxxxxxxxxxxxxxxxxxxxxxxxAVSRGSSKIRWxxxxxxxxxxxGEVVDLGCGR
GGWSYYAxxxxxxxGVKAYTIGGKGHETPxxxxxxxxxxxxxxxxxxxxxxxxxxADTIMCDIGESSS
NxxxxxxxxxxxxxxxxxxxxxxxxxxxxxxxxxxxxxxxxxxxxxxxLVRTPFSRNSTHEM
YYSTxxxxxxxxxxxxxxxxxxxxxxxxxxxxxxxxxxxxxxxxxxxxxxxxxxxxxxxxxxx
xxxxxxxxxxxxxxPYRTWQYWGSYRxxxxGSAASLINGVVKLMSKPWDxxxxxxxMAMTDTTAFxxxx
xxKEKVDTRAKxxxxxxxxxxxxxxxxxxxxxxxxxxxxxxxxxxxxxxxxxxxxxxxxxxxx
xxxxxxxxxxxxxxxxxxxxxxxxxxxxxHCVYNMMGKxEKKLSEFGKAKGSxxxWFMWLGARYLxxxxx
GFLNEDHWAxxxxxxxxxxxxxxxxxxxxxxxxxxxxxxxxxxxxxxxxxxxxxxxxxxxxxx
xxxxxxxxxxVMEKAYHNKVVKVLRPxxxxxxxMDVITRRDQRGSGxxxxxxxxxxxxxxxxxx
xxxxxxxxxxxxxxxxxxxxxxxxxxxxxxxxxxxxxxxxxxxxxxxxxxxxxxxxLNDMAKTRK
DIxxxxxxxxxxxDWENVPFCSHHFHKIxxxxxxxxxxVPCRDQDELIGRGRVSPGNGWMIxDTACLAKA
YAQMxxLMYFHRRDLRTLSLAVSSAVPxxxxPQGRTTWSIHGxGAWMTTEDMxxxxxxxxxxxxxx
xxxxxxxxxxxxxTKRQDMLCSSLVGRKxxxxxxxxxxxxxxxxxxxxxxxxxxxxxxxxxxxx
xxxxxxxxxxxxxxxxxx >panFIVE|peptide_length:9|string5 xxxxxxxxxxxxxxxxxxxxxxxxxxxxxxxSNKIKQKTKQIGxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxEPVDVDCFCxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxVL
ELGGCVTxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxVGAKQENWNxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxALGNQEGSLKxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxNPPFGDSYIxxxxxxxxxxxxxxxxx
xxxxGVERLAVMGDTAWDFSSAGGxxxxxxxxxxxxxxxxxxxxxxxxxxxxxxxxxxxxxxx
xxxxxxxxxxxxxxxxxxxxxxxxxxxxxxxxxxxxxxELKCGDGIFxxxxSDDWLNKYSxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxAVHTDQSLWMxxxxxxxxxxxxxxxxxxxxxxWPRSHTLWSNxxx
xxxxxxxxxxxxxxxxxxxxxxxxxxxxxxxxxxxxxxxxxxxxxxxxxxxxxxxxxxxxxxx
xxxxxxxCRTCTLPPVTxxGSDGCWYPMExxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxMWHVTRGAALxxxxxxxxxxxxxxxxxxxxxxxxxxxxxxxxxxxxxxxxxxxxxxx
xxxxxxxxxxxxxxxxxxxxxxxxxxxxxxxxxxxxxxxxxGLYGNGILVxxxxxxxxxxxxxxxx
xxxxxxxxxxxxxxxxxxxxTTILDFHPGAGKTRxxxxxxxxxxxxxxxxxxxxxxTRVVLSEMKEAFxxx
```

FIG. 63-12

```
xxxxxxxxxxxxxxxGREVIDAMCHATLTYRMLEPxxxxxxxxxxxxxxxAHFLDPASIAARGHLYHRARA
NESATILMTATPPGTxxxxxxxxxxxxxxxxxxxxxxxxxxxxxxxxxxxxxPTAWFLPSIRxxxx
xxxxxxxxxxxxVVVLNRKTFxxxxxxxxxxxxxxxxxxxxxxxxxxxxxxxxxRVIDCRTAFKPVLVxxxx
xxxxxxxxxxxxxxxxxxxxxxxxxxxxxxxxxxxxxxxxxxxxxxxxxxWKEASMLLDNMxxxxxxxx
xxxxxxxxxxxxxPGEMRLRDDxxxxxxxLMKRGDLPVxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxVVIPEPGQQRSSDDNKLAxxxxxxxxxxxxxxxx
xxxxxxxxxxxxxxxxxxxxxxxxxxxxxxxxxxAAWTVYVGIVTxxxxxxxxxxxxxxxxxxxxxxx
xxxxxxxxxxxxxxxxxxxxxxxxxxxxxxxxxxxxxxxxxxxxHWSLILPGIKAQQSQRAQRRV
FHGVAKNPVVDGxxxxxxxxxxxxxxxxxxxxxxxxxxxxxxxxxxxxxxxxxxxxxxxxxxxxxxx
xxxxxxxxxxDTLWTMPVACxxTGVMRGNHYAFVGVxxxxxxxxxxxxxxxxxxxxGKTLGEVWKxxx
xxxxxxxxxxxxxxxxxxxxxxxxxxxxxxxxxxxxxxxxPVSRGTAKLAWxxxxxxxxxxGKVMDLGCGR
GGWCYYAxxxxxxxxSVKGFTLGRDGHxxxxxxxxxxxxxxxxxxxxxxxxxxxxxxxSDTLLCDIGESNP
DxxxxxxxxxxxxxxxxxxxxxxxxxxxxxxxxxxxxxxxxxxxxxxxxxxxxxxxxxVIRNPLSRNSTHEM
YYVSxxxxxxxxxxxxxxxxxxxxxxxxxxxxxxxxxxxxxxxxxxxxxxxxxxxxxxxxxxxxxxxx
xxxxxxxxxxxxxPYRTWHYCGSYVxxxxGSAASMVNGVVKLLSWPWNxxxxxxxxxxxxxxxxxxxx
xxKEKVDTKAQxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxEKKLSEFGKAKGxxxxWYMWLGSRFLxxxxx
xxxxxxxxxxxxxxxxxxxxxxxxxxxxxxxxxxxxxxxxxxxxxxxxxxxxxxxxxxxxxxxxxxxx
xxxxxxxxxxxxxMTYKAKVVKVARPxxxxxxxMDVITRRDQRGxxxxxxxxxxxxxxxxxxxxxxxx
xxxxxxxxxxxxxxxxxxxxxxxxxxxxxxxxxxxxxxxxxxxxxxxxxxxxxxxxxxxxDMGKVRK
DVxxxxxxxxxxxxNWEEVPFCSNHFQEIxxxxxxxxxxxVPCREQDELxGRARVSPGCGWSVxETACLSKA
YGQMxxxxxxxHKRDMRLLGLAICSAVPxxxxxxxxxxxxxxxxxxxxxxxxxxxxxxxxxxxxxxx
xxxxxxxxxxxxxxPKSHDKLCGSLIGMTxxxxxxxxxxxxxxxxxxxxxxxxxxxxxxxxxxxxxx
xxxxxxxxxxxxxxxxxxx >panFIVE|peptide_length:10|string1 xxxxxxxxxxxxxxxxxxxxxxxxxxxxxxxxxxxxSQLAKRFSKGLLxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxVDRGWGNGCGLFGKGSLxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxVLGSQEGAMHxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxRMAILGDTAWDFGSIGGxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxAVHADMGYWIESxxxxxxxxxxxxxxxxxxxxxWPKSHTLWSNxxx
xxxxxxxxxxxxxxxxxxxxxxxxxxxxxxxxxxxxxxxxxxxxxxxxxxxxxxxxxxxxxxxxxxxx
xxxxxWCCRSCTLPPLRxxGEDGCWYGMEIRPxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
```

FIG. 63-13

```
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxVFHTMWHVTRGAVLxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxMDLHPGSGKTRxxxxxxxxxxxxxxLRTLILAPTRVVAAEMEEALxxx
xxxxxxxxxxxxxxGREIVDLMCHATFTMRLLSPxxxxxxxxxIMDEAHFTDPASIAARGYISTRVxM
GEAAAIFMTATPPGSxxxxxxxxxxxxxxxxxxxxxxxxxxxxxxxxxxxxxxGKTVWFVPSIxxxxx
xxxxxxxxxxxxxxxxxxxxxxxxxxxxxxxxDWDFVVTTDISEMGANFKAxRVIDPRRCLKPVILxxxx
xxxxxxxxxxxxxASAAQRRGRIGRNxxxxxxxxxxxxxxxxxxxxxxxxxxxxxxxxxxxxx
xxxxxxxxxxxxxxxxxxxxxxxxxxxxxxLMRRGDLPVWLAxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxLLIPEPEKQRTPQDNQLAxxxxxxxxxxxxxxx
xxxxxxxxxxxxxxxxxxxxxxxxxxxxxxPASAWTLYAVATTxxxxxxxxxxxxxxxxxxxx
xxxxxxxxxxxxxxxxxxxxxxxxxxxxxxxxxxxxxxxxxxHYAIIGPGLQAKATREAQKRT
AAGIMKNPTVDGxxxxxxxxxxxxxxxxxxxxxFEKQLGQVMLxxxxxxxxxxxxxxxxxxxx
xxxxxxxxxGKFWNTTIAVSxANIFRGSYLAGAGLxxxxxxxxxxxxxxxxxxxxxxxxxxxxx
xxxxxxxxxxxxxxxxxxxxxxxxxxxxxxVSRGTAKLRWxxxxxxxxxxGKVIDLGCGR
GGWSYYCxxxxxxxxxxxGYTKGGPGHEEPxxxxxxxxxxxxxxxxxxxxxxxxxxxCDTLLCDIGESSP
xxxxxxxxxxxxxxxxxxxxxxxxxxxxxxxxxxxxxxxxxxxxxxxxxxLVRNPLSRNSTHEM
YWVSxxxxxxxxxxxxxxxxxxxxxxxxxxxxxxxxxxxxxxxxxxxxxxxxxxxxxxxxxxx
xxxxxxxxxxxxxPYKTWAYHGSYxxxxxGSASSMVNGVVKLLTKPWDxxxxxxxMAMTDTTPFGQQR
VFKEKVDTRTPxxxxxxxxxxxxxxxxxxxxxxxxxxxxxxxxxxxxxxxxxxxxxxxxxxxx
xxxxxxxxxxxxxxxxxxxxxxxxxxxxxxTCVYNMMGKREKKLGEFGKAKGSRAIWYMWLGARFLEFEAL
GFLNEDHWFxxxxxxxxxxxxxxxxxxxxxxxxxxxxxMYADDTAGWDTRITxxxxxxxxxxxxxxx
xxxxxxxxxxIFKLTYQNKVVR

FIG. 63-14

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxAIHSDLSYWIESxxxxxxxxxxxxxxxxxxxxxWPETHTLWGDxxx
xxxxxxxxxxxxxxxxxxxxxxxxxxxxxxxxxxxxxxxxxxxxxxxxxxxxxxxxxxxxxxxx
xxxxxWCCRSCTMPPLRxxTDSDCWYAMEIRPxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxTFHTLWHTTKGAALxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxMDLHPGAGKTKxxxxxxxxxxxxxxLRTAILAPTRVVASEMAEALxxx
xxxxxxxxxxxxxxxxGKEIVDVMCHATLTHRLMSPxxxxxxxxxxVMDEAHFTDPSSVAARGYISTKVxM
GEAAGIFMTATPPGTxxxxxxxxxxxxxxxxxxxxxxxxxxxxxxxxxxxxxxxxxGKTVWFVPSVxxxxx
xxxxxxxxxxxxxxxxxxxxxxxxxxxxxxxDWDYVITTDISEMGANFRAxRVIDPRRCMKPVILxxxx
xxxxxxxxxxxxxxSSAAQRRGRVGRNxxxxxxxxxxxxxxxxxxxxxxxxxxxxxxxxxxxxx
xxxxxxxxxxxxxxxxxxxxxxxxxxxxxxxLLRRGDLPVWLSxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxLLIPEPDRQRTPQDNQLTxxxxxxxxxxxxxxxxxx
xxxxxxxxxxxxxxxxxxxxxxxxxxxxxxPATAWSLYAVTTAxxxxxxxxxxxxxxxxxxxxxx
xxxxxxxxxxxxxxxxxxxxxxxxxxxxxxxxxxxxxxxxHYAYMVPGWQAEAMREAQKRA
AAGIMKNAVVDGxxxxxxxxxxxxxxxxxxxxxFEKQLGQIMLxxxxxxxxxxxxxxxxxxxxx
xxxxxxxxxxGRFWNTTIAVSxCHIMRGGWLSCLSIxxxxxxxxxxxxxxxxxxxxxxxxxxxx
xxxxxxxxxxxxxxxxxxxxxxxxxxxxxxxxVSRGSAKLRWxxxxxxxxxxxGKVVDLGCGR
GGWCYYMxxxxxxxxxxxxGLTKGGAGHEEPxxxxxxxxxxxxxxxxxxxxxxxxxxVDTLLCDIGESSS
xxxxxxxxxxxxxxxxxxxxxxxxxxxxxxxxxxxxxxxxxxxxxxxxxxxxLVRCPLSRNSTHEM
YWISxxxxxxxxxxxxxxxxxxxxxxxxxxxxxxxxxxxxxxxxxxxxxxxxxxxxxxxxxxxx
xxxxxxxxxxxxxP

FIG. 63-15

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxSDRGWGNGCGLFGKGSIxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxALGSQEGGLHxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxRMAIIGETAWDFGSLGGxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxAVHTDQSLWMKSxxxxxxxxxxxxxxxxxxxxxxxWPKTHTLWSNxxx
xxxxxxxxxxxxxxxxxxxxxxxxxxxxxxxxxxxxxxxxxxxxxxxxxxxxxxxxxxxxxxxx
xxxxxWCCRSCSLPPLRxxTENGCWYGMEIRxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxVFHTMWHVTRGSVIxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxLDLHPGAGKTRxxxxxxxxxxxxxLRTLVLAPTRVVAAEMAEALxxx
xxxxxxxxxxxxxxxGNAIVDLMCHATFTTRLLSSxxxxxxxxxIMDEAHFTDPSSIAARGYIATKVxL
NKCALIFMTATPPGAxxxxxxxxxxxxxxxxxxxxxxxxxxxxxxxxxxxxxxxxxGKTVWFVASVxxxxx
xxxxxxxxxxxxxxxxxxxxxxxxxxxxxxDWDFVITTDISEMGANFGAxRVIDSRKSVKPTIIxxxx
xxxxxxxxxxxxASAAQRRGRVGRQxxxxxxxxxxxxxxxxxxxxxxxxxxxxxxxxxxxxxxx
xxxxxxxxxxxxxxxxxxxxxxxxxxxxLLRTADLPVWLAxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxVLIPEPEKQRSQTDNQLAxxxxxxxxxxxxxxxxx
xxxxxxxxxxxxxxxxxxxxxxxxxxxxxxPATAWALYGGSTVxxxxxxxxxxxxxxxxxxxxx
xxxxxxxxxxxxxxxxxxxxxxxxxxxxxxxxxxxxxxxHYGYMLPGWQAEALRSAQRRT
ASAMVRNPMVDGxxxxxxxxxxxxxxxxxxxxMQKKVGQIMLxxxxxxxxxxxxxxxxxxxxxx
xxxxxxxxxxSSVWNATTAIGxCHVMRGSYLAGGSIxxxxxxxxxxxxxxxxxxxxxxxxxxxx
xxxxxxxxxxxxxxxxxxxxxxxxxxxxxxxxxxxxxxxVSRGSAKLQWxxxxxxxxxxGRVMDLGCGR
GGWSYYMxxxxxxxxxxxxGYTLGRDGHEKPxxxxxxxxxxxxxxxxxxxxxxxxxSDTLFCDIGESSP
xxxxxxxxxxxxxxxxxxxxxxxxxxxxxxxxxxxxxxxxxxxxxxxxxxxxxxxxLVRLPFSRNSHEM
YWVSxxxxxxxxxxxxxxxxxxxxxxxxxxxxxxxxxxxxxxxxxxxxxxxxxxxxxxxxxxxx
xxxxxxxxxxxxxPYRTWAYHGSYxxxxxGSASSLVNGVVRLLSKPWDxxxxxxxLAMTDTTPFGxxx
VFKEKVDTKAPxxxxxxxxxxxxxxxxxxxxxxxxxxxxxxxxxxxxxxxxxxxxxxxxxxxxx
xxxxxxxxxxxxxxxxxxxxxxxxxxxxxxxxxTCIYNMMGKREKKLGEFGRAKGSRAIWFMWLGSRYLEFEAL
GFLNEDHWLxxxxxxxxxxxxxxxxxxxxxxxxxxxxxxxxxFYADDTAGWDxxxxxxxxxxxx
xxxxxxxxxxxIMELTYRHKVVKVxxxxxxxxxxMDIISREDQRGSGQVVTYGLNTxxxxxxxxxx
xxxxxxxxxxxxxxxxxxxxxxxxxxxxxxxxxxxRMLVSGDDCVVRPxxxxxxxxxxxxLNAMSKVRK
DIxxxxxxxxxxxxxxEVPFCSNHFTELxxxxxxxxxxxxxxxxQDELVGRARISPGAGWNVxxTACLAKS
YAQMxxLSYFHRRDLRLMAxxxxxxxxxxxxxPTGRTSWSIHSxGEWMTTEDMLxxxxxxxxxxxxxx
xxxxxxxxxxxxGKREDLWCGSLIGLSxxxxxxxxxxxxxxxxxxxxxxxxxxxxxxxxxxxxx
xxxxxxxxxxxxxxxxxxx
```

FIG. 63-16

>panFIVE|peptide_length:10|string4 xxxxxxxxxxxxxxxxxxxxxxxxxxxxxxxxxxxxQGLVKRFSTGLFxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxGCGLFGKGGVxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxNLGDQTGVLLxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxRLTVMGDHAWDFGSTGGxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxSAHGSPTFWMGSxxxxxxxxxxxxxxxxxxxxxWPASHTIDNAxxx
xxxxxxxxxxxxxxxxxxxxxxxxxxxxxxxxxxxxxxxxxxxxxxxxxxxxxxxxxxxxxxxxxxxxxxx
xxxxxWCCRSCTMPPVSxxTGTDCWYAMEIRxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxVLHTLWHTTRGAAIxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxLDMHPGSGKTHxxxxxxxxxxxxxxxxxLVLAPTRVVLKEMERALxxx
xxxxxxxxxxxxxGGEVIDVMCHATYVNRRLLPxxxxxxxxxxMDEAHWTDPHSIAARGHLYTLAxE
NESATVLMTATPPGKxxxxxxxxxxxxxxxxxxxxxxxxxxxxxxxxxxxxxxxxGRTAWFVPSIxxxxx
xxxxxxxxxxxxxxxxxxxxxxxxxxxxxxxxKPDFVVTTDISEMGANLDVxRVIDCRKSVKPTILxxxx
xxxxxxxxxxxxxxSSAAQRRGRVxxxxxxxxxxxxxxxxxxxxxxxxxxxxxxxxxxxxxxxxxxxxxx
xxxxxxxxxxxxxxxxxxxxxxxxxxxxxxxxLVTHCDFTPWLAxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxVLQPEAGKQRTPQDNQLIxxxxxxxxxxxxxxxxxx
xxxxxxxxxxxxxxxxxxxxxxxxxxxxxxxxxxxxPARSWGTYVLVVSxxxxxxxxxxxxxxxxxxxxxx
xxxxxxxxxxxxxxxxxxxxxxxxxxxxxxxxxxxxxxxxxxHLAIVVSGLEAELTRAAHKVF
FAGIMKNPTIDGxxxxxxxxxxxxxxxxxxxxxxxxMQKKVGQVLLxxxxxxxxxxxxxxxxxxxxxxx
xxxxxxxxxxSAVWNSTTATGxSGVVRGSLWGFLPLxxxxxxxxxxxxxxxxxxxxxxxxxxxxxxxxxxx
xxxxxxxxxxxxxxxxxxxxxxxxxxxxxxxxxxxxxxxxxVSRGSSKIRWxxxxxxxxxxxGEVVDLGCGR
GGWSYYAxxxxxxxxxxxxxAYTIGGKGHETPxxxxxxxxxxxxxxxxxxxxxxxxxxxxxADTIMCDIGESNP
xxxxxxxxxxxxxxxxxxxxxxxxxxxxxxxxxxxxxxxxxxxxxxxxxxxxxxxxxxxxxLVRTPFSRNSTHEM
YYSTxxxxxxxxxxxxxxxxxxxxxxxxxxxxxxxxxxxxxxxxxxxxxxxxxxxxxxxxxxxxxxxxxxx
xxxxxxxxxxxxxxPYRTWTYHGSYxxxxxGSAASLINGVVKLMSKPWDxxxxxxxMAMTDTTAFGxxx
xFKEKVDTRAKxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxHCVYNMMGKREKKLSEFGVAKGSRAIWFMWLGARYLExxxL

FIG. 63-17

```
GFLNEDHWAxxxxxxxxxxxxxxxxxxxxxxxxxxxxxxxxxxxxxxxxxxxxxxxxxxxxxxx
xxxxxxxxxxVMQKAYHAKVVKVxxxxxxxxxxMDVITRRDQRGSGQVVxxxxxxxxxxxxxxx
xxxxxxxxxxxxxxxxxxxxxxxxxxxxxxxxAVSGDDCVVRxxxxxxxxxxxxLNDMAKTRK
DIxxxxxxxxxxxxxQVPFCSHHFHKIxxxxxxxxxxxxxxQDELIGRGRVSPGNGWMIxxTACLAKA
YAQMxxLMYFHRRDLRTLGxxxxxxxxxxxxPQGRTTWSIHGxGAWMTTEDMLxxxxxxxxxxxxxx
xxxxxxxxxxxxxxTKRQDMLCSSLVGRKxxxxxxxxxxxxxxxxxxxxxxxxxxxxxxxxxxx
xxxxxxxxxxxxxxxxxxx
```

>panFIVE|peptide_length:10|string5

```
xxxxxxxxxxxxxxxxxxxxxxxxxxxxxxSNKIKQKTKQIGxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxHCGLFGKGSIxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxALGNQEGSLKxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxRLAVMGDTAWDFSSAGGxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxAVHTDQSLWMKxxxxxxxxxxxxxxxxxxxxxWPRSHTLWSNxxx
xxxxxxxxxxxxxxxxxxxxxxxxxxxxxxxxxxxxxxxxxxxxxxxxxxxxxxxxxxxxxxx
xxxxxxCCRTCTLPPVTxxGSDGCWYPMEIxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxVLHTMWHVTRGAALxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxLDFHPGAGKTRxxxxxxxxxxxxxxxxxxVLAPTRVVLSEMKEAFxxx
xxxxxxxxxxxxxxGREVIDAMCHATLTYRMLEPxxxxxxxxxxxEAHFLDPASIAARGWAAHRAxA
NESATILMTATPPGTxxxxxxxxxxxxxxxxxxxxxxxxxxxxxxxxxxxxxRPTAWFLPSIxxxxx
xxxxxxxxxxxxxxxxxxxxxxxxxxxxxxxxxxxxxxxxxxxxxxxxRVLDCRT

FIG. 63-18

```
xxxxxxxxxxDTLWTMPVACGxTGVMRGNHYAFVGVxxxxxxxxxxxxxxxxxxxxxxxxxxxxx
xxxxxxxxxxxxxxxxxxxxxxxxxxxxxxxxxxxxxxxVSRGTAKLAWxxxxxxxxxxGKVMDLGCGR
GGWCYYAxxxxxxxxxxxGFTLGRDGHExxxxxxxxxxxxxxxxxxxxxxxxxxxxxxSDTLLCDIGExxx
xxxxxxxxxxxxxxxxxxxxxxxxxxxxxxxxxxxxxxxxxxxxxxxxxxxxxxxxVIRNPLSRNSTHEM
YYVSxxxxxxxxxxxxxxxxxxxxxxxxxxxxxxxxxxxxxxxxxxxxxxxxxxxxxxxxxxxxxxxxxx
xxxxxxxxxxxxxPYRTWQYWGSYxxxxxGSAASMVNGVVKLLSWPWNxxxxxxxxxxxxxxxxxxxxx
xFKEKVDTKAQxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxREKKLSEFGKAKGSxxIWYMWLGSRFLExxxx
xxxxxxxxxxxxxxxxxxxxxxxxxxxxxxxxxxxxxxxxxxxxxxxxxxxxxxxxxxxxxxxxxxxxxx
xxxxxxxxxxxxEMTYKNKVVKVxxxxxxxxxxMDVITRRDQRGSxxxxxxxxxxxxxxxxxxxx
xxxxxxxxxxxxxxxxxxxxxxxxxxxxxxxxxxxxxxxxxxxxxxxxxxxxxxxxxxNDMGKVRK
DVxxxxxxxxxxxxxxNVPFCSNHFQEIxxxxxxxxxxxxxxxxxxxxGRARVSPGCGWSVxxTACLSKA
YGQMxxxxxFHKRDMRLLSxxxxxxxxxxxxxxxxxxxxxxxxxxxxxxxxxxxxxxxxxxxxxxxxxx
xxxxxxxxxxxxPKSHDKLCGSLIGMTxxxxxxxxxxxxxxxxxxxxxxxxxxxxxxxxxxxxxxxx
xxxxxxxxxxxxxxxxxxxx >panFIVE|peptide_length:11|string1 xxx

FIG. 63-19

```
xxxxxxxxxxxxxxxxxxxxxxxxxxxxxLMRRGDLPVWLAxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxLLIPEPEKQRTPQDNQLxxxxxxxxxxxxxxxxxxx
xxxxxxxxxxxxxxxxxxxxxxxxxxxxxPASAWTLYAVATTxxxxxxxxxxxxxxxxxxxxxxx
xxxxxxxxxxxxxxxxxxxxxxxxxxxxxxxxxxxxxxxxxxxxxHYAIIGPGLQAKATREAQKRT
AAGIMKNPTVDGxxxxxxxxxxxxxxxxxxxFEKQLGQVMLLxxxxxxxxxxxxxxxxxxxxxxx
xxxxxxxxxxGKFWNTTIAVSxANIFRGSYLAGAGLxxxxxxxxxxxxxxxxxxxxxxxxxxxxx
xxxxxxxxxxxxxxxxxxxxxxxxxxxxxxxxxxxxxxxxxxxxxxxxxxxxxxxxxxGKVIDLGCGR
GGWSYYCxxxxxxxxxxxxxxxxxxxxxxxxxxxxxxxxxxxxxxxxxxxCDTLLCDIGESSP
xxxxxxxxxxxxxxxxxxxxxxxxxxxxxxxxxxxxxxxxxxxxxxxxxLVRNPLSRNSTHEM
YWVSxxxxxxxxxxxxxxxxxxxxxxxxxxxxxxxxxxxxxxxxxxxxxxxxxxxxxxxxxxxx
xxxxxxxxxxxxxxPYKTWAYHGSYxxxxxGSASSMVNGVVKLLTKPWDxxxxxxxMAMTDTTPFGQQR
VFKEKVDTRTPxxxxxxxxxxxxxxxxxxxxxxxxxxxxxxxxxxxxxxxxxxxxxxxxxxxxx
xxxxxxxxxxxxxxxxxxxxxxxxxxxxxxxTCVYNMMGKREKKLGEFGKAKGSRAIWYMWLGARFLEFEAL
GFLNEDHWFxxxxxxxxxxxxxxxxxxxxxxxxxxxxxxxxMYADDTAGWDTRITxxxxxxxxxxxxxxx
xxxxxxxxxxIFKLTYQNKVVRVxxxxxxxxxxxMDVISRRDQRGSGQVGTYGLNTxxxxxxxxxxxxx
xxxxxxxxxxxxxxxxxxxxxxxxxxxxxxxxxxxxRMAISGDDCVVKPxxxxxxxxxxxxLNDMGKVRK
DIxxxxxxxxxxxxxxxVPFCSHHFHELxxxxxxxxxxxxxxQDELIGRARISQGAGWSLxxTACLGKS
YAQMxxLMYFHRRDLRLAAxxxxxxxxxxxxPTSRTTWSIHAxxxxxxxxxxxxxxxxxxxxxxx
xxxxxxxxxxxxxGKREDQWCGSLIGLTxxxxxxxxxxxxxxxxxxxxxxxxxxxxxxxxxxxx
xxxxxxxxxxxxxxxxxxxx >panFIVE|peptide_length:11|string2 xxxxxxxxxxxxxxxxxxxxxxxxxxxxxxxxxxxxxxxxxQLTKRFSLGMLxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxTDRGWGNGCGLFGKGGIxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxRLAALGDTAWDFGSxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxAIHSDLSYWIESxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxWCCRSCTMPPLRxxTDSGCWYGMEIRPxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 63-20

```
xxxxxxxxxxxxxxxxxxxxxxxxxxxxxxxxxxxxxxxxxxxxxxxxxxxxxxxxxxxxxxx
xxTFHTLWHTTKGAAxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxLRTAILAPTRVVASEMAEALxxx
xxxxxxxxxxxxxxGKEIVDVMCHATLTHRLMSPxxxxxxxxxxMDEAHFTDPSSIAARGYIxxxxxM
GEAAGIFMTATPPGxxxxxxxxxxxxxxxxxxxxxxxxxxxxxxxxxxxxxxxxxxxxxxxxx
xxxxxxxxxxxxxxxxxxxxxxxxxxxxxxxxxDWDYVITTDISEMGANFRAxRVIDPRRCMKPVILxxxx
xxxxxxxxxxxxxSSAAQRRGRVGRNxxxxxxxxxxxxxxxxxxxxxxxxxxxxxxxxxxxx
xxxxxxxxxxxxxxxxxxxxxxxxxxxxxxLMRRGDLPVWLSxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxLLIPEPDRQRTPQDNQLxxxxxxxxxxxxxxx
xxxxxxxxxxxxxxxxxxxxxxxxxxxxxPATAWSLYAVTTAxxxxxxxxxxxxxxxxxxxx
xxxxxxxxxxxxxxxxxxxxxxxxxxxxxxxxxxxxxxxxxxxxxHYAYMVPGWQAEAMRSAQKRA
AAGIMKNAVVDGxxxxxxxxxxxxxxxxxxxxxxxFEKQLGQIMLLxxxxxxxxxxxxxxxxxxxxxxx
xxxxxxxxxxxGRFWNTTIAVSxCHIMRGGWLSCLSIxxxxxxxxxxxxxxxxxxxxxxxxx
xxxxxxxxxxxxxxxxxxxxxxxxxxxxxxxxxxxxxxxxxxxxxxxxxxxxxxGKVVDLGCGR
GGWCYYMxxxxxxxxxxxxxxxxxxxxxxxxxxxxxxxxxxxxxxxxxxxxxxxVDTLLCDIGESSS
xxxxxxxxxxxxxxxxxxxxxxxxxxxxxxxxxxxxxxxxxxxxxxxxxxxLVRCPLSRNSTHEM
YWISxxxxxxxxxxxxxxxxxxxxxxxxxxxxxxxxxxxxxxxxxxxxxxxxxxxxxxxxxxx
xxxxxxxxxxxxxPYRTWNYHGSYxxxxxGSASSMINGVVRLLTK

FIG. 63-21

```
xxxxxxxxxxxxxxxxxxxxxAVHSDLSYWIESxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxWCCRSCSLPPLRxxTENGCWYGMEIRPxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxVFHTMWHVTRGSVxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxLRTLVLAPTRVVAAEMAEALxxx
xxxxxxxxxxxxxxGNAIVDLMCHATFTTRLLSSxxxxxxxxxxMDEAHFTDPSSVAARGYIxxxxxxL
NKCALVLMTATPPGxxxxxxxxxxxxxxxxxxxxxxxxxxxxxxxxxxxxxxxxxxxxxxxxxx
xxxxxxxxxxxxxxxxxxxxxxxxxxxxxxxDWDFVITTDISEMGANFGAxRVIDSRKSVKPTIIxxxx
xxxxxxxxxxxxxxASAAQRRGRVGRQxxxxxxxxxxxxxxxxxxxxxxxxxxxxxxxxxxxxx
xxxxxxxxxxxxxxxxxxxxxxxxxxxxxxLLRTADLPVWLAxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxVLIPEPEKQRSQTDNQLxxxxxxxxxxxxxxxxxx
xxxxxxxxxxxxxxxxxxxxxxxxxxxxxPATAWALYGGSTVxxxxxxxxxxxxxxxxxxxxxx
xxxxxxxxxxxxxxxxxxxxxxxxxxxxxxxxxxxxxHYGYMLPGWQAEALRAAQRRT
ASAMVRNPMVDGxxxxxxxxxxxxxxxxxxxxxMQKKVGQIMLIxxxxxxxxxxxxxxxxxxxx
xxxxxxxxxxSSVWNATTAIGxCHVMRGSYLAGGSIxxxxxxxxxxxxxxxxxxxxxxxxxxxx
xxxxxxxxxxxxxxxxxxxxxxxxxxxxxxxxxxxxxxxxxxxxxxxxxxxxGRVIDLGCGR
GGWSYYMxxxxxxxxxxxxxxxxxxxxxxxxxxxxxxxxxxxxxxxxxxxxxSDTLFCDIGESSP
xxxxxxxxxxxxxxxxxxxxxxxxxxxxxxxxxxxxxxxxxxxxxxxxxxxxLVRLPFSRNSNHEM
YWVSxxxxxxxxxxxxxxxxxxxxxxxxxxxxxxxxxxxxxxxxxxxxxxxxxxxxxxxxxxxx
xxxxxxxxxxxxxPYRTWAYHGSYxxxxxGSASSLVNGVVRLLSKPWDxxxxxxxLAMTDTTPFGQxR
VFKEKVDTKAPxxxxxxxxxxxxxxxxxxxxxxxxxxxxxxxxxxxxxxxxxxxxxxxxxxxxx
xxxxxxxxxxxxxxxxxxxxxxxxxxxxxxxTCIYNMMGKREKKLGEFGRAKGSRAIWFMWLGSRYLEFEAL
GFLNEDHWLxxxxxxxxxxxxxxxxxxxxxxxxxxxxxxxxxFYADDTAGWDTxxxxxxxxxxxxxxx
xxxxxxxxxxIIELTYRHKVVKVxxxxxxxxxxMDIISREDQRGSGQVVTYGLNTxxxxxxxxxxxx
xxxxxxxxxxxxxxxxxxxxxxxxxxxxxxxxRMLVSGDDCVVRPxxxxxxxxxxLNAMSKVRK
DIxxxxxxxxxxxxxxxxxVPFCSNHFTELxxxxxxxxxxxxxxxQDELVGRARISPGAGWNVxxTACLAKS
YAQMxxLSYFHRRDLRLMAxxxxxxxxxxxxPTGRTSWSIHSxxxxxxxxxxxxxxxxxxxxxx
xxxxxxxxxxxxxGKREDLWCGSLIGLSxxxxxxxxxxxxxxxxxxxxxxxxxxxxxxxxxxxx
xxxxxxxxxxxxxxxxxxxx >panFIVE|peptide_length:11|string4 xxxxxxxxxxxxxxxxxxxxxxxxxxxxxxxxxGLVKRFSTGLFxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxSDRGWGNGCGLFGKGGVxxxxxxxxxxxxxxxxxxxxxxxxxxxxxxxxxxxxxxxxxxxx
```

FIG. 63-22

```
xxxxxxxxxxxxxxxxxxxxxxxxxxxxxxxxxxxxxxxxxxxxxxxxxxxxxxxxxxxxxxxx
xxxxxxxxxxxxxxx

FIG. 63-23

```
xxxxxxxxxxxxxxxxxxxxxxxxxxxxxxxxxxxxNKIKQKTKQIGxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxNHCGLFGKGSIxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxRLAVMGDTAWDFSSxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxAVHTDQSLWMKSxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxWCCRTCTLPPVTxxGSDGCWYPMEIRxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxVLHTMWHVTRGAAxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxVLAPTRVVLSEMKEAFxxx
xxxxxxxxxxxxxxGREVIDAMCHATLTYRMLEPxxxxxxxxxxxDEAHFLDPASIAARGWAxxxxxA
NESATILMTAxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxRVLDCRTAFKPVLVxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxLVRNCDLPVWLSxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxVVIPEPGQQRSIQDNQVxxxxxxxxxxxxx
xxxxxxxxxxxxxxxxxxxxxxxxxxxxxxxxxxxxxxxxxPGAAWTVYVGIVTxxxxxxxxxxxxxx
xxxxxxxxxxxxxxxxxxxxxxxxxxxxxxxxxxxxxxxxxxxxxxxHWSLILPGIKAQQSKLAQRRV
FHGVAKNPVVDGxxxxxxxxxxxxxxxxxxxxxxxxxxxxxxxxxxxxxxxxxxxxxxxxxxxxxxxx
xxxxxxxxxxDTLWTMPVACGxTGVMRGNHYAFVGVxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxGKVMDLGCGR
GGWCYYAxxxxxxxxxxxxxxxxxxxxxxxxxxxxxxxxxxxxxxxxxxxxxxxxxxxSDTLLCDIGESxxx
xxxxxxxxxxxxxxxxxxxxxxxxxxxxxxxxxxxxxxxxxxxxxxxxxxxxxxxxVIRNPLSRNSTHEM
YYVSxxxxxxxxxxxxxxxxxxxxxxxxxxxxxxxxxxxxxxxxxxxxxxxxxxxxxxxxxxxxxxxx
xxxxxxxxxxxxPYRTWQYWGSYxxxxxGSAASMVNGVVKLLSWPWNxxxxxxxxxxxxxxxxxxxxx
VFKEKVDTKAQxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxKREKKLSEFG

FIG. 63-24

```
DVxxxxxxxxxxxxxxVPFCSNHFQEIxxxxxxxxxxxxxxxxxxxGRARVSPGCGWSVxxTACLSKA
YGQMxxxxYFHKRDMRLLSxxxxxxxxxxxxxxxxxxxxxxxxxxxxxxxxxxxxxxxxxxxxxxxx
xxxxxxxxxxxxxPKSHDKLCGSLIGMTxxxxxxxxxxxxxxxxxxxxxxxxxxxxxxxxxxxxxxx
xxxxxxxxxxxxxxxxxxx
```

FIG. 64-1

>panFLAVI|peptide_length:8|string1

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxVDRGWGNGCGLFGKGSLxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxVFHTMWHVTRGAxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxVVGLYGNGxxxxxxxxxxxxxxxxxxxxxxxxxxxxxxxxxxxxxxxxDLHPG
SGKTRxxxxxxxxxxxxxxxxxTLILAPTRVVAAExxxxxxxxxxxxxxxxxxxxxxxxxVDLMCH
ATFxxxxxxxxxxxxxxxxxxxIMDEAHFTDPxSIAARGYIxxxxxxxxxxxxxIFMTATPPGSxxxxx
xxxxxxxxxxxxxxxxxxxxxxxxxxxxxxxxxxxxxGKTVWFVPSxxxxxxxxxxxxxxxxxxxx
xxxxxxxxxxxxxxxxxxWDFVVTTDISEMGANFxxxxxxxxxxxxxxxxxxxxxxxxxxxxxA
SAAQRRGRIGRxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxVSRGTAKLxxxxxxxxxxxxxxxxxVIDLGCGRGGWSYY
```

FIG. 64-2

```
xxxxxxxxxxxxxxxxxxxxxxxxxxxxxxxxxxxxxxxxxxxxxxxxxxxxxTLLCDIGESSP
xxxxxxxxxxxxxxxxxxxxxxxxxxxxxxxxxxxxxxxxxxxxxxxxxxxxxPLSRNSTHE
MYWxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxMAMTD
TTPFGQQRVFKEKVDTRTxxxxxxxxxxxxxxxxxxxxxxxxxxxxxxxxxxxxxxxxxxxx
xxxxxxxxxxxxxxxxxxxxxxxxxxxxxxxxxxxxxCVYNMMGKREKKLGEFGKAKGSRAIWYMWLG
ARFLEFEALGFLNEDHWxxxxxxxxxxxxxxxxxxxxxxxxxxxxxxxxxxxxxMYADDTAGWDTRI
Txxxxxxxxxxxxxxxxxxxxxxxxxxxxxxxxxxxxxxxxxxxxxxxxxxxxxxxxxxxx
xxQRGSGQVGTYGL

FIG. 64-3

```
AGKTKxxxxxxxxxxxxxxxxxTAVLAPTRVVASExxxxxxxxxxxxxxxxxxxxxxxxxxxxxVDVMCH
ATLxxxxxxxxxxxxxxxxxxxxVMDEAHWTDPxSVAARGYIxxxxxxxxxxxxxVLMTATPPGTxxxxx
xxxxxxxxxxxxxxxxxxxxxxxxxxxxxxxxxxxxxxxxxxGKTVWFVASxxxxxxxxxxxxxxxxxx
xxxxxxxxxxxxxxxxxxxWDYVIATDISEMGANLxxxxxxxxxxxxxxxxxxxxxxxxxxxxxxxxxS
SAAQRRGRVGRxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxVSRGSAKLxxxxxxxxxxxxxxxVVDLGCGRGGWCYY
xxxxxxxxxxxxxxxxxxxxxxxxxxxxxxxxxxxxxxxxxxxxxxxxxxxxxxxxxxxxxTLFCDIGESSS
xxxxxxxxxxxxxxxxxxxxxxxxxxxxxxxxxxxxxxxxxxxxxxxxxxxxxxxxxxxxxPLSRNSTHE
MYYxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxIAMTD
TTAFGQQRVFKEKVDTKAxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxCIYNMMGKREKKPGEFGRAKGSRAIWYMWLG
ARYLEFEALGFMNEDHWxxxxxxxxxxxxxxxxxxxxxxxxxxxxxxxxxxxxxxxxxIYADDTAGWDTKV
Txxxxxxxxxxxxxxxxxxxxxxxxxxxxxxxxxxxxxxxxxxxxxxxxxxxxxxxxxxxxxxxxxxxx
xxQRGSGQVVTYALNTxxxxxxxxxxxxxxxxxxxxxxxxxxxxxxxxxxxxxxxxxxxxxxxxxxxxx
xRMAVSGDDCxxxxxxxxxxxxxxxxxxxxxxxxxxxxxxxxxxxxxxxxxxxxxxxxVPFCSNHFTxxxxxx
xxxxxxxxxxQDELVGRARVSQGxxxxxxxxxxxxxxxxxxxxxxxLLYFHRRDLRLMxxxxxxxxxxxxx
PTGRTTWSIHxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
```

>panFLAVI|peptide_length:8|string3

```
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxSDRGWGNHxGLFGKGSIxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxx
```

FIG. 64-4

```
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxVLHTMWHVTRGSxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxVIGLYGNGxxxxxxxxxxxxxxxxxxxxxxxxxxxxxxxxxxxxxDMHPG
AGKTRxxxxxxxxxxxxxxxxxTLVLAPTRVVLKExxxxxxxxxxxxxxxxxxxxxIDVMCH
ATYxxxxxxxxxxxxxxxxxxxIMDEAHFLDPxSIAARGHLxxxxxxxxxxxxxILMTATPPGAxxxxx
xxxxxxxxxxxxxxxxxxxxxxxxxxxxxxxxxGRTAWFVPSxxxxxxxxxxxxxxxxxxx
xxxxxxxxxxxxxxxxxxxxWDFILATDIAEMGANLxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxVSRGSSKIxxxxxxxxxxxxxxxVMDLGCGRGxxxxx
xxxxxxxxxxxxxxxxxxxxxxxxxxxxxxxxxxxxxxxxxxxxxxxxTIMCDIGESNP
xxxxxxxxxxxxxxxxxxxxxxxxxxxxxxxxxxxxxxxxxxxxxxxxxxxxPFSRNSNHE
MYWxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxLAMTD
TTPxxxxxxxFKEKVDTRAxxxxxxxxxxxxxxxxxxxxxxxxxxxxxxxxxxxxxxxxx
xxxxxxxxxxxxxxxxxxxxxxxxxxxxxxxxxxxxxxxMGKREKKTGEFGVAKGSRAIWFMWLG
SRFLEFEAxxxxxxxxxxxxxxxxxxxxxxxxxxxxxxxxxxxxxxxxxxxFYADDTAGWDTRV
Txxxxxxxxxxxxxxxxxxxxxxxxxxxxxxxxxxxxxxxxxxxxxxxxxxxxxxxxxxx
xxxxxSGQVVTYGLNTxxxxxxxxxxxxxxxxxxxxxxxxxxxxxxxxxxxxxxxxxxxx
xRMLVSGDDCxxxxxxxxxxxxxxxxxxxxxxxxxxxxxxxxxxxxxxxVPFCSNHFQxxxxxx
xxxxxxxxxQDELVGRARISPGxxxxxxxxxxxxxxxxxxxxxLSYFHRRDLRTLxxxxxxxxxxxxx
PTGRTSWSIHxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
```

>panFLAVI|peptide_length:8|string4

FIG. 64-6

```
MYFxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxMAMTD
TTAxxxxxxxxKDKVDTKAxxxxxxxxxxxxxxxxxxxxxxxxxxxxxxxxxxxxxxxxxxx
xxxxxxxxxxxxxxxxxxxxxxxxxxxxxxxxxxxxxxxxxxxxSEFGKAKGxxxxxYMWLG
SRFxxxxxxxxxxxxxxxxxxxxxxxxxxxxxxxxxxxxxxxxxxxxxxxxLYADDTAGxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xRLLVSGDDxxxxxxxxxxxxxxxxxxxxxxxxxxxxxxxxxxxxxxxxPFCSHHFNxxxxxx
xxxxxxxxxxxxxELIGRARVSPGxxxxxxxxxxxxxxxxxxxxxLMYFHKRDMRLLxxxxxxxxxxxxx
PQGRTTWSVHxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
```

FIG. 64-7

>panFLAVI|peptide_length:8|string5

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxGFFGKGSIxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxMWHVTQGAxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxDAHPG
SGKTxxxxxxxxxxxxxxxxxxxTVVLAPTRVVLRExxxxxxxxxxxxxxxxxxxxxxxxxxxx
xxxxxxxxxxxxxxxxxxxxxxxxIMDEGHWTxxxxxxxxxxxxxxxxxxxxxxxxMSATPPGTxxxxx
xxxxxxxxxxxxxxxxxxxxxxxxxxxxxxGRTVWFVPSxxxxxxxxxxxxxxxxxxx
xxxxxxxxxxxxxxxxxxxxPDFILATDxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxVSRGCAKLxxxxxxxxxxxxxxxxxxxxx
```

FIG. 64-8

```
xxxxxxxxxxxxxxxxxxxxxxxxxxxxxxxxxxxxxxxxxxxxxxxxxxTVLCDIGESNx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxAEFGKAKGxxxxxFMWLG
ARYxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xNMVIAGDDxxxxxxxxxxxxxxxxxxxxxxxxxxxxxxxxxxxxxxEFCSNHFHxxxxxx
xxxxxxxxxxxxELIGRGRVSPGxxxxxxxxxxxxxxxxxxxxNYFHRRDLRVMxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx >panFLAVI|peptide_length:9|string1 xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxVDRGWGNGCGLFGKGSLxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxVFHTMWHVTRGAxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
xxxxxxxxxxxxxxxxxxxxxxxxxTLILAPTRVVAxxxxxxxxxxxxxxxxxxxxxxxxx
```

FIG. 64-9

```
xxxxxxxxxxxxxxxxxxxxxIMDEAHFTDPxxxxxxxxxxxxxxxxxxxxxxIFMTATPPGxxxxxx
xxxxxxxxxxxxxxxxxxxxxxxxxxxxxxxxxxxxxxGKTVWFVPSxxxxxxxxxxxxxxxxxxxx
xxxxxxxxxxxxxxxxWDFVVTTDISEMGANFxxxxxxxxxxxxxxxxxxxxxxxxxxxxxxxxxxxA
SAAQRRGRIGRxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxVIDLGCGRGGWSYY
xxxxxxxxxxxxxxxxxxxxxxxxxxxxxxxxxxxxxxxxxxxxxxxxxxxxxxxxTLLCDIGESxx
xxxxxxxxxxxxxxxxxxxxxxxxxxxxxxxxxxxxxxxxxxxxxxxxxxxxxxxxxxPLSRNSTHE
MYWxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxMAMTD
TTPFGQQRVFKEKVDTRTxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxCVYNMMGKREKKLGEFGKAKGSRAIWYMWLG
ARFLEFEALGFLNEDHWxxxxxxxxxxxxxxxxxxxxxxxxxxxxxxxxxxxxxxxxxMYADDTAGWDTRI
Txxxxxxxxxxxxxxxxxxxxxxxxxxxxxxxxxxxxxxxxxxxxxxxxxxxxxxxxxxxxxxxxxxx
xxQRGSGQVGTYGLNTxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxQDELIGRARISxxxxxxxxxxxxxxxxxxxxxxxLMYFHRRDLRLAxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx >panFLAVI|peptide_length:9|string2 xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxTDRGWGNGCGLFGKGGIxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxx
```

FIG. 64-10

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxTFHTLWHTTKGAxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxTAVLAPTRVVAxxxxxxxxxxxxxxxxxxxxxxxxxxxx
xxxxxxxxxxxxxxxxxxxxxxxxxVMDEAHWTDPxxxxxxxxxxxxxxxxxxxxVLMTATPPGxxxxxx
xxxxxxxxxxxxxxxxxxxxxxxxxxxxxxxxxxxxxxxxxGKTVWFVASxxxxxxxxxxxxxxxxxxx
xxxxxxxxxxxxxxxxxWDYVIATDISEMGANLxxxxxxxxxxxxxxxxxxxxxxxxxxxxxxxS
SAAQRRGRVGRxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxVVDLGCGRGGWCYY
xxxxxxxxxxxxxxxxxxxxxxxxxxxxxxxxxxxxxxxxxxxxxxxxxxxxxxTLFCDIGESxx
xxxxxxxxxxxxxxxxxxxxxxxxxxxxxxxxxxxxxxxxxxxxxxxxxxxxxxxPLSRNSTHE
MYYxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxIAMTD
TTAFGQQRVFKEKVDTKAxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxCIYNMMGKREKKPGEFGRAKGSRAIWYMWLG
ARYLEFEALGFMNEDHWxxxxxxxxxxxxxxxxxxxxxxxxxxxxxxxxxxxxxIYADDTAGWDTKV
Txxxxxxxxxxxxxxxxxxxxxxxxxxxxxxxxxxxxxxxxxxxxxxxxxxxxxxxxxxxxxxx
xxQRGSGQVVTYALNTxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxQDELVGRARVSxxxxxxxxxxxxxxxxxxxxxLLYFHRRDLRLMxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx >panFLAVI|peptide_length:9|string3 xxxxxxxxxxxxxxxxxxxxxxxxxxxxxxxxxxxxxxxxxxxxxxxxxxxxxxxxxxxxxxxx
```

FIG. 64-11

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxSDRGWGNHCGLFGKGSIxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxVFHTMWHVTRGSxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxTLVLAPTRVVLxxxxxxxxxxxxxxxxxxxxxxxxxxxxxx
xxxxxxxxxxxxxxxxxxxxxxxxxxIMDEAHFLDPxxxxxxxxxxxxxxxxxxxxxxxILMTATPPGxxxxxx
xxxxxxxxxxxxxxxxxxxxxxxxxxxxxxxxxxxxxxxxxxxGRTAWFVPSxxxxxxxxxxxxxxxxxxxx
xxxxxxxxxxxxxxxxxxxxxxxxxWDFILATDIAEMGANLxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxVMDLGCGRGGxxxx
xxxxxxxxxxxxxxxxxxxxxxxxxxxxxxxxxxxxxxxxxxxxxxxxxxxxxxxTIMCDIGESxx
xxxxxxxxxxxxxxxxxxxxxxxxxxxxxxxxxxxxxxxxxxxxxxxxxxxxxxxxPFSRNSNHE
MYWxxxxxxxxxxxxxxxxxxxxxxxxxxxxxxxxxxxxxxxxxxxxxxxxxxxxxxxxxxxxx
```

FIG. 64-12

```
xxxxxxxxxxxxxxxxxxxxxxxxxxxxxxxxxxxxxxxxxxxxxxxxxxxxxxxxxxxxLAMTD
TTPFxxxxVFKEKVDTRAxxxxxxxxxxxxxxxxxxxxxxxxxxxxxxxxxxxxxxxxxxxxxx
xxxxxxxxxxxxxxxxxxxxxxxxxxxxxxxxxxxxxxxxxMMGKREKKTGEFGVAKGSRAIWFMWLG
SRFLEFEALxxxxxxxxxxxxxxxxxxxxxxxxxxxxxxxxxxxxxxxxxxxxFYADDTAGWDTRV
Txxxxxxxxxxxxxxxxxxxxxxxxxxxxxxxxxxxxxxxxxxxxxxxxxxxxxxxxxxxxxxx
xxxxGSGQVVTYGLNTxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxQDELVGRARISxxxxxxxxxxxxxxxxxxxxxxxLSYFHRRDLRTLxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
```

FIG. 64-13
>panFLAVI|peptide_length:9|string4

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxSDRGWGNGCGLFGKGGVxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxVLHTLWHTTRGAxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxTVILAPTRVVxxxxxxxxxxxxxxxxxxxxxxxxxxxxxxxx
xxxxxxxxxxxxxxxxxxxxxxIMDEGHWTDPxxxxxxxxxxxxxxxxxxxxxxxxxxxxxxxx
xxxxxxxxxxxxxxxxxxxxxxxxxxxxxxxxxxxxxxxRPTAWFLPSxxxxxxxxxxxxxxxxx
xxxxxxxxxxxxxxxxxxxxPDFILATDIAExxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 64-14

```
xxxxxxxxxxxxxxxxxxxxxxxxxxxxxxxxxxxxxxxxxxxxxxxxxxTILCDIGESxx
xxxxxxxxxxxxxxxxxxxxxxxxxxxxxxxxxxxxxxxxxxxxxxxxxxxxxxxRNSTHE
MYFxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxMAMTD
TTAFxxxxxxFKDKVDTKAxxxxxxxxxxxxxxxxxxxxxxxxxxxxxxxxxxxxxxxxxx
xxxxxxxxxxxxxxxxxxxxxxxxxxxxxxxxxxxxxxMMGKREKKISEFGKAKGSxxxWYMWLG
SRFLxxxxxxxxxxxxxxxxxxxxxxxxxxxxxxxxxxxxxxxxxxxxxxLYADDTAGWDTKI
Txxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxDELIGRGRVSxxxxxxxxxxxxxxxxxxxLMYFHKRDMRLLxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx >panFLAVI|peptide_length:9|string5 xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxCGFFGKGSIxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxTMWHATEGAxxxxxxxxxxx
xxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx
```

FIG. 64-15

```
xxxxxxxxxxxxxxxxxxxxxxTVVLAPTRVVxxxxxxxxxxxxxxxxxxxxxxxxxxxxxxxxxxx
xxxxxxxxxxxxxxxxxxxxxxIMDEAHFMDxxxxxxxxxxxxxxxxxxxxxxxxxxxxxxxxxxxx
xxxxxxxxxxxxxxxxxxxxxxxxxxxxxxxxxxGRTVWFVPSxxxxxxxxxxxxxxxxxxxxxxxx
xxxxxxxxxxxxxxxPDFILATDIxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxTVMCDIGESxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxFLMTD
VSTYxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxTMGKKEKKPAEFGKAKGSxxxWFMWLG
ARYLxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxDELIGRARVSxxxxxxxxxxxxxxxxxxxxxxxLNYFHRRDLRVMxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx >panFLAVI|peptide_length:10|string1 xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxVDRGWGNGCGLFGKGSxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
```

FIG. 64-16

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxHTMWHVTRGAxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxTLILAPTRVVxxxxxxxxxxxxxxxxxxxxxxxxxxxxxxx
xxxxxxxxxxxxxxxxxxxxxxxIMDEAHFTDPxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxWDFVVTTDISEMGANFxxxxxxxxxxxxxxxxxxxxxxxxxxxxA
SAAQRRGRIGRxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxVIDLGCGRGGWSYY
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxPLSRNSTHE
MYWxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxMAMTD
TTPFGQQRVFKEKVDTRTxxxxxxxxxxxxxxxxxxxxxxxxxxxxxxxxxxxxxxxxxxxxxx
xxxxxxxxxxxxxxxxxxxxxxxxxxxxxxxxxxxxxxxxxCVYNMMGKREKKLGEFGKAKGSRAIWYMWLG
ARFLEFEALGFLNEDHWxxxxxxxxxxxxxxxxxxxxxxxxxxxxxxxxxxxxxxxMYADDTAGWDTRI
Txxxxxxxxxxxxxxxxxxxxxxxxxxxxxxxxxxxxxxxxxxxxxxxxxxxxxxxxxxxxxxx
xxQRGSGQVGTYGLNTxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxQDELIGRARIxxxxxxxxxxxxxxxxxxxxxxxxxLMYFHRRDLRLAxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx >panFLAVI|peptide_length:10|string2 xxxxxxxxxxxxxxxxxxxxxxxxxxxxxxxxxxxxxxxxxxxxxxxxxxxxxxxxxxxxxxxx
```

FIG. 64-17

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxTDRGWGNGCGLFGKGGxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxHTLWHTTKGAxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxTAVLAPTRVVxxxxxxxxxxxxxxxxxxxxxxxxxxxxx
xxxxxxxxxxxxxxxxxxxxxxxxxxxVMDEAHFTDPxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxWDYVIATDISEMGANLxxxxxxxxxxxxxxxxxxxxxxxxxxxxxS
SAAQRRGRVGRxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxVVDLGCGRGGWCYY
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxPLSRNSTHE
MYYxxxxxxxxxxxxxxxxxxxxxxxxxxxxxxxxxxxxxxxxxxxxxxxxxxxxxxxxxxxxx
```

FIG. 64-18

```
xxxxxxxxxxxxxxxxxxxxxxxxxxxxxxxxxxxxxxxxxxxxxxxxxxxxxxxxxxIAMTD
TTAFGQQRVFKEKVDTKAxxxxxxxxxxxxxxxxxxxxxxxxxxxxxxxxxxxxxxxxxxxx
xxxxxxxxxxxxxxxxxxxxxxxxxxxxxxxxxxxCIYNMMGKREKKPGEFGKAKGSRAIWYMWLG
ARFLEFEALGFMNEDHWxxxxxxxxxxxxxxxxxxxxxxxxxxxxxxxxxxxxxIYADDTAGWDTKV
Txxxxxxxxxxxxxxxxxxxxxxxxxxxxxxxxxxxxxxxxxxxxxxxxxxxxxxxxxxxxx
xxQRGSGQVVTYALNTxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxQDELVGRARVxxxxxxxxxxxxxxxxxxxxxxxLLYFHRRDLRLMxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxx
```

FIG. 64-19

>panFLAVI|peptide_length:10|string3

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxSDRGWGNHCGLFGKGSxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxHTMWHVTRGSxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxTLVLAPTRVVxxxxxxxxxxxxxxxxxxxxxxxxxxxxxx
xxxxxxxxxxxxxxxxxxxxxxxxIMDEAHWTDPxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxWDFILATDIAEMGANLxxxxxxxxxxxxxxxxxxxxxxxxxxxxxA
SAAQRRGRVxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxVMDLGCGRGGWxxx
```

FIG. 64-20

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxPFSRNSNHE
MYWxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxLSMTD
TTAFGQQRVFKEKVDTRAxxxxxxxxxxxxxxxxxxxxxxxxxxxxxxxxxxxxxxxxxxxxx
xxxxxxxxxxxxxxxxxxxxxxxxxxxxxxxxxxxxxxxxxxNMMGKREKKTGEFGRAKGSRAIWFMWLG
SRYLEFEALGFLxxxxxxxxxxxxxxxxxxxxxxxxxxxxxxxxxxxxxxxxxxFYADDTAGWDTRV
Txxxxxxxxxxxxxxxxxxxxxxxxxxxxxxxxxxxxxxxxxxxxxxxxxxxxxxxxxxxxxx
xxxRGSGQVVTYGLNTxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxQDELVGRARIxxxxxxxxxxxxxxxxxxxxxxxxxxLSYFHRRDLRTLxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx >panFLAVI|peptide_length:10|string4 xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxSDRGWGNGCGxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxHTLWHTTRGAxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 64-21

```
xxxxxxxxxxxxxxxxxxxxxxxxTVILAPTRVVxxxxxxxxxxxxxxxxxxxxxxxxxxxxxxxxxxxx
xxxxxxxxxxxxxxxxxxxxxxxxIMDEAHFLDPxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxPDFILATDIAEMxxxxxxxxxxxxxxxxxxxxxxxxxxxxxxxxxxxxxxxxxS
SAAQRRGRVxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxLSRNSTHE
MYFxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxMAMTD
TTAFGxxxVFKDKVDTKAxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxNMMGKREKKISEFGVAKGSRAIWYMWLG
SRFLExxxxxxxxxxxxxxxxxxxxxxxxxxxxxxxxxxxxxxxxxxxxxxxxxxxxxxLYADDTAGWDTKI
Txxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxQDELIGRGRVxxxxxxxxxxxxxxxxxxxxxxxxLMYFHKRDMRLLxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxx
```

>panFLAVI|peptide_length:10|string5

```
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxx
```

FIG. 64-22

```
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxHTMWHVTQGAxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxTAILAPTRVVxxxxxxxxxxxxxxxxxxxxxxxxxxx
xxxxxxxxxxxxxxxxxxxxxxxxxIMDEAHFMDPxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxPDFILATDIAxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxFLMTD
VSTYSxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxNTMGKKEKKPAEFGKAKGSRxIWFMWLG
ARYLExxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
xxxxxxxxxxQDELIGRARVxxxxxxxxxxxxxxxxxxxxxxxxLNYFHRRDLRVMxxxxxxxxxxxxxx
xxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
```

>panFLAVI|peptide_length:11|string1

```
xxxxxxxxxxxxxxxxxxxxxxxxxxxxxxxxxxxxxxxxxxxxxxxxxxxxxxxxxxxxxx
```

FIG. 64-23

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxVDRGWGNGCGLFGKGSxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxWDFVVTTDISEMGANFxxxxxxxxxxxxxxxxxxxxxxxxxxxxxxA
SAAQRRGRIGRxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxVIDLGCGRGGWSYY
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxPLSRNSTHE
MYxxxxxxxxxxxxxxxxxxxxxxxxxxxxxxxxxxxxxxxxxxxxxxxxxxxxxxxxxxxxxx
```

FIG. 64-24
```
xxxxxxxxxxxxxxxxxxxxxxxxxxxxxxxxxxxxxxxxxxxxxxxxxxxxxxxxxxxxMAMTD
TTPFGQQRVFKEKVDTRTxxxxxxxxxxxxxxxxxxxxxxxxxxxxxxxxxxxxxxxxxxxxxx
xxxxxxxxxxxxxxxxxxxxxxxxxxxxxxxxxxxxxCVYNMMGKREKKxxEFGKAKGSRAIWYMWLG
ARFLEFEALGFLNEDHWxxxxxxxxxxxxxxxxxxxxxxxxxxxxxxxxxxxxxxMYADDTAGWDTRI
Txxxxxxxxxxxxxxxxxxxxxxxxxxxxxxxxxxxxxxxxxxxxxxxxxxxxxxxxxxxxxxx
xxQRGSGQVGTYGLNTxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxx
```

FIG. 64-25

\>panFLAVI|peptide_length:11|string2

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxTDRGWGNGCGLFGKGGxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxWDYVITTDISEMGANLxxxxxxxxxxxxxxxxxxxxxxxxxxxxS
SAAQRRGRVGRxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxVVDLGCGRGGWCYY
```

FIG. 64-26

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxPLSRNSNHE
MYxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxIAMTD
TTAFGQQRVFKEKVDTKAxxxxxxxxxxxxxxxxxxxxxxxxxxxxxxxxxxxxxxxxxxxxxx
xxxxxxxxxxxxxxxxxxxxxxxxxxxxxxxxxxxxxCIYNMMGKREKKxxEFGKAKGSRAIWYMWLG
ARFLEFEALGFMNEDHWxxxxxxxxxxxxxxxxxxxxxxxxxxxxxxxxxxxxxIYADDTAGWDTKV
Txxxxxxxxxxxxxxxxxxxxxxxxxxxxxxxxxxxxxxxxxxxxxxxxxxxxxxxxxxxxxxx
xxQRGSGQVVTYALNTxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx >panFLAVI|peptide_length:11|string3 xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxSDRGWGNHCGLFGKGSxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 64-27

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxWDFILATDIAEMGANLxxxxxxxxxxxxxxxxxxxxxxxxxxxxxxxA
SAAQRRGRVGxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxVIDLGCGRGGWCxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxPFSRNSTHE
MYxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxLSMTD
TTAFGQQRVFKEKVDTRAxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxEFGRAKGSRAIWFMWLG
SRYLEFEALGFLNxxxxxxxxxxxxxxxxxxxxxxxxxxxxxxxxxxxxxxxxxFYADDTAGWDTRV
Txxxxxxxxxxxxxxxxxxxxxxxxxxxxxxxxxxxxxxxxxxxxxxxxxxxxxxxxxxxxxxx
xxQRGSGQVVTYGLNTxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxx >panFLAVI|peptide_length:11|string4 xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxSDRGWGNHCGFFGKGSxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 64-28

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxPDFILATDIAEMGxxxxxxxxxxxxxxxxxxxxxxxxxxxxxxxxS
SAAQRRGRVGxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxVDLGCGRGGWCxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxPLSRNSSHE
MYxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxMAMTD
TTAFGQxRVFKDKVDTKAxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxEFGVAKGSRAIWYMWLG
SRFLEFxxxxxxxxxxxxxxxxxxxxxxxxxxxxxxxxxxxxxxxxxxxxxxxLYADDTAGWDTKI
Txxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx >panFLAVI|peptide_length:11|string5
```

FIG. 64-29

```
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxSDRGWGNHCGFxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxPDFILATDIAExxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
xxxxx

FIG. 64-30

```
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxFLMTD
VSTYSQxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxAIWFMWLG
ARYLEFxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxx
```

FIG. 65-1

| Epitope | HLA(nM) | | HLA(nM) | | Epitope | HLA(nM) | | HLA(nM) |
|---|---|---|---|---|---|---|---|---|
| KMASNDASV | A0201(30.65) | | | | KTTSSGHPY | A1101(124.72) | | B1501(137.59) |
| RPVYTPQHL | B0702(33.49) | | | | LVAMLYTPL | B1501(328.09) | | |
| RQLAAENKY | B1501(293.78) | | | | TLNCDRIEK | A0301(235.86) | | A1101(43.14) |
| MPLAARMGT | B0702(237.19) | | | | FSFYGDDYI | A0201(140.34) | | |
| NGAGRRRAL | B0801(97.37) | | | | RMGTHATMK | A0301(45.98) | | A1101(72.57) |
| IVLCALSSL | A0201(225.83) | | | | MMKNAVDGL | A0201(252.50) | | B1501(155.12) |
| MIAPLLGDY | B1501(174.86) | | | | QASKANLMY | B1501(260.92) | | |
| LAADNNYGF | B1501(203.20) | | | | LLAALFGVF | B1501(14.34) | | |
| YSFYGDDYI | A0201(344.09) | | | | ESRRLFAFL | B0801(128.63) | | |
| CVRAFGGLM | B1501(304.32) | | | | VARATEENF | B1501(274.19) | | |
| CARAFGGLM | B0702(455.77) | B1501(276.19) | | | RPLNILNIL | B0702(50.55) | | |
| LTTLSLFWR | A1101(141.16) | | | | WGFWVSPTV | A0201(179.46) | | |
| IAKATEENF | B1501(427.28) | | | | RPVYTPQYL | B0702(44.33) | | |
| MVLGFTKER | A1101(265.76) | | | | ILLAELFDV | A0201(8.32) | | |
| RLHGETFPY | A0301(59.98) | A1101(247.68) | B1501(19.55) | | RPVYAPQYL | B0702(36.06) | | |
| RMGTHATMR | A0301(390.95) | | | | MAVTFKRAL | B0702(276.00) | | B0801(212.91) |
| MLLTGSNAK | A0301(79.07) | A1101(93.50) | | | KLKKVANVF | B1501(35.01) | | |
| LLAELFGVF | B1501(17.47) | | | | LVLGFTKEK | A0301(418.21) | | A1101(75.16) |
| VMRDQLKPF | B1501(18.44) | | | | KLHGESFPY | A0301(45.70) | | A1101(200.77) | B1501(32.71) |
| LAIGFTRDK | A1101(364.86) | | | | KLHGEAFPY | A0301(69.54) | | A1101(271.68) | B1501(63.60) |
| RSARAFGPF | B1501(26.19) | | | | RMGAVASMK | A0301(27.40) | | A1101(47.75) |
| KPLNILNIL | B0702(139.81) | | | | AARGGNTVI | B0702(312.48) | | |
| KLKKVANIF | B1501(106.25) | | | | LLAYLYTPL | A0201(13.08) | | B1501(98.31) |
| AASAAGSIL | B0702(301.65) | | | | ISGRPGIGK | A1101(112.28) | | |
| SSMAVTLKR | A0301(227.64) | A1101(7.23) | | | RTTGFFRPY | A0301(304.27) | | A1101(72.11) | B1501(129.19) |
| RLHGESFPY | A0301(64.77) | A1101(280.30) | B1501(27.13) | | AALKDELVK | A1101(479.36) | | |
| VMRDQLRPF | B1501(13.54) | | | | AGNALTAGK | A1101(161.44) | | |
| CYAFCCWVL | A2402(40.78) | | | | SLFWRPVYT | A0201(44.95) | | |
| RPDKTDGPI | B0702(63.02) | | | | LIAMLYTPL | A0201(345.81) | | B0801(357.14) | B1501(328.28) |

FIG. 65-2

| Epitope | HLA(nM) | HLA(nM) | Epitope | HLA(nM) | HLA(nM) |
|---|---|---|---|---|---|
| GIVESLILL | A0201(92.90) | | RMGTHASMK | A0301(31.65) | A1101(70.14) |
| ISGKPGIGK | A1101(105.04) | A1101(5.93) | WAFWVSPSL | A0201(210.92) | |
| MVLGFTAEK | A0301(47.62) | | KLKKAANIF | B1501(44.22) | |
| FSFDGDDEI | A0201(148.40) | | ILAFRQLAA | A0201(296.98) | |
| IMRDQLKPF | B1501(13.58) | | DLIGKLRPL | B0801(434.62) | |
| MAVTLKRAL | B0702(427.99) | | YLGGKDPRV | A0201(27.81) | |
| LLWGSDLST | A0201(231.85) | | IAMLYTPLR | A1101(172.90) | |
| APLLGDYEL | B0702(333.11) | | CALSSLFTR | A1101(110.44) | |
| TVDDSKLKK | A1101(88.22) | | FGSGWGFWV | A0201(61.69) | |
| AASAAGSAL | B0702(45.76) | B1501(473.78) | LSSKTKFWR | A1101(112.85) | |
| AMLYTPLRA | A0201(238.22) | | AGNAFAAGK | A1101(117.67) | |
| AARMGTHAT | B0702(98.35) | | CARAFGGLL | B0702(414.73) | |
| SSLFTRPIK | A0301(181.62) | A1101(20.17) | GVDHWDAYK | A0301(475.10) | A1101(28.30) |
| LLWGADLST | A0201(152.66) | | SNMAVTLKR | A1101(193.78) | |
| CTLSSLFTR | A1101(18.97) | | KLIAMLYTP | A0201(200.37) | |
| TLSLFWRPV | A0201(267.98) | | ILLAELFGV | A0201(4.36) | |
| RLLAYLYTP | A0201(108.51) | | MIAPLLGDF | B1501(98.32) | |
| AVRMGTHAS | B0702(165.11) | | FLCTLSSLF | B1501(27.74) | |
| VMLWDDYGM | A0201(65.09) | | | | |
| AASTAGSAL | B0702(61.44) | | | | |
| IFLCTLSSL | A2402(322.34) | | | | |
| MIQRTTGFF | B1501(64.30) | | | | |
| QYLISPDTL | A2402(177.75) | | | | |
| RLLWGSDLA | A0201(147.90) | | | | |
| TPLRANSPT | B0702(385.55) | | | | |
| TMDDTKVKK | A1101(117.88) | | | | |
| MLLTGANAK | A0301(96.90) | A1101(99.03) | | | |
| KLMHGQSGM | A0201(33.76) | B1501(23.56) | | | |
| QASKANLMF | B1501(316.26) | | | | |

FIG. 65-3

| Epitope | HLA(nM) | HLA(nM) | Epitope | HLA(nM) | HLA(nM) | HLA(nM) |
|---|---|---|---|---|---|---|
| VLCALSSLF | B1501(34.78) | | | | | |
| SLILLAALF | B1501(251.24) | | | | | |
| RMIQRTTGF | B0801(373.07) | B1501(4.90) | | | | |
| IVAMLYTPL | B1501(441.14) | | | | | |
| ILATCDWTF | B1501(283.55) | | | | | |
| LPTMDDSKL | B0702(240.09) | | | | | |
| NGTGRRRVL | B0801(369.45) | | | | | |
| RPDKTEGPL | B0702(21.89) | | | | | |
| GPVCRRVDF | B0702(147.71) | | | | | |
| YLQDRDKYY | B1501(268.94) | | | | | |
| RWIFRPTSK | A0301(340.59) | A1101(383.55) | | | | |
| LLSSAASSL | A0201(59.60) | B1501(109.02) | | | | |
| LLWGADLGT | A0201(137.23) | | | | | |
| LVNPAPLDY | B1501(205.75) | | | | | |
| RLVHGQSGM | B1501(45.23) | | | | | |
| RPLNIINIL | B0702(64.91) | | | | | |
| KPPAAISFA | B0702(443.28) | | | | | |
| LAYLYTPLR | A1101(237.64) | | | | | |
| AGNAFTAGK | A1101(59.32) | | | | | |
| RPDKTEGPI | B0702(65.75) | | | | | |
| QAAHANNMY | B1501(319.61) | | | | | |
| RPLNVINIL | B0702(52.07) | | | | | |
| TVSCRVLTR | A1101(124.35) | A1101(124.35) | | | | |
| LLWGSDLAT | A0201(199.09) | | | | | |
| KLHGETFPY | A0301(43.28) | A1101(176.86) | B1501(23.08) | | | |
| NGTGRRRAL | B0801(135.63) | | | | | |
| VAMLYTPLR | A1101(144.61) | | | | | |
| IARATEEDF | B1501(363.88) | | | | | |
| GVVESLILL | A0201(152.77) | | | | | |

FIG. 65-4

| Epitope | HLA(nM) | Epitope | HLA(nM) | HLA(nM) | HLA(nM) | HLA(nM) | HLA(nM) |
|---|---|---|---|---|---|---|---|
| MAQAIFGAI | B0801(193.36) | | | | | | |
| RMGAIASMR | A0301(362.26) | | | | | | |
| SLYWRPVYT | A0201(84.72) | | | | | | |
| SMILLAELF | B1501(88.97) | | | | | | |
| VLAFRQLAA | A0201(272.01) | | | | | | |
| GVHYSHAYK | A0301(33.89) | A1101(6.88) | | | | | |
| GVGHWDAYK | A0301(197.12) | A1101(14.65) | | | | | |
| MKMASNDAF | B1501(136.55) | | | | | | |
| VMREQLKPF | B0801(457.64) | B1501(24.63) | | | | | |
| SSMAVTFKR | A0301(398.63) | A1101(5.56) | | | | | |
| LANPAPLDY | B1501(213.92) | | | | | | |
| MIHRTTGFF | B1501(28.44) | | | | | | |
| TMDDSKLKK | A0301(240.62) | A1101(60.60) | | | | | |
| SLILLAELF | B1501(399.17) | | | | | | |
| KMLGGQMGM | A0201(14.44) | B1501(188.04) | | | | | |
| ISGRPGVGK | A1101(143.52) | | | | | | |
| LLADLFGVF | B1501(13.28) | | | | | | |
| QGRYTIEEY | B1501(299.84) | | | | | | |
| SNMAVTFKR | A1101(138.67) | | | | | | |
| LMAELFGVF | B1501(6.93) | | | | | | |
| LSTKTKFWR | A1101(317.44) | | | | | | |
| APLLGDFEL | B0702(411.35) | | | | | | |
| KLKKVANLF | B1501(90.33) | | | | | | |
| RMIQRTTDF | B1501(7.70) | | | | | | |
| YLGGRDPRV | A0201(22.72) | | | | | | |
| QYLISPDSL | A2402(308.76) | | | | | | |
| LSLYWRPVY | B1501(441.10) | | | | | | |
| ILASCDWTF | B1501(293.10) | | | | | | |
| RAARAFGPF | B0702(161.19) | B1501(26.65) | | | | | |

FIG. 65-5

| Epitope | HLA(nM) | Epitope | HLA(nM) | Epitope | HLA(nM) | Epitope | HLA(nM) |
|---|---|---|---|---|---|---|---|
| ILLAELSGV | A0201(8.76) | | | | | | |
| KMASNDAFA | A0201(67.04) | | | | | | |
| SLILMAELF | B1501(328.31) | | | | | | |
| SLFWRPVYA | A0201(13.65) | | | | | | |
| YLQDRDRYY | B1501(170.91) | | | | | | |
| AARAGNTVI | B0702(216.37) | | | | | | |
| VLRDQLKPF | B1501(65.65) | | | | | | |
| ILMAELFGV | A0201(2.66) | | | | | | |
| CARSFGGLM | B1501(335.42) | | | | | | |
| LLWGSDLGT | A0201(194.79) | | | | | | |
| TTDDSKLKK | A1101(128.96) | | | | | | |
| AFDNNCYAF | A2402(293.59) | | | | | | |
| PPRPTPEL | B0702(58.78) | | | | | | |
| RPDKSEGPI | B0702(54.28) | | | | | | |
| FGTGWGFWV | A0201(145.63) | | | | | | |
| MLSSAASTL | A0201(31.81) | B1501(119.49) | | | | | |
| KTTSSGYPH | A1101(300.41) | | | | | | |
| GLIPTRPDK | A0301(283.90) | A1101(312.28) | | | | | |
| FLCALSSLF | B1501(24.53) | | | | | | |
| LSTKTKFWK | A0301(366.78) | A1101(30.54) | | | | | |
| KMASNDASA | A0201(203.27) | B1501(392.27) | | | | | |
| GVFWTPPDV | A0201(368.80) | | | | | | |
| IFLCALSSL | A2402(352.60) | | | | | | |

FIG. 66-1

| Virus Protein | Accession No. | Virus Protein | Accession No. | Virus Protein | Accession No. | Virus Protein | Accession No. |
|---|---|---|---|---|---|---|---|
| DENV1 2K | FJ639670 | DENV1 2K | GQ868501 | DENV1 2K | FJ461303 | DENV1 2K | GU131919 |
| DENV1 2K | FJ024446 | DENV1 2K | FJ432734 | DENV1 2K | FJ639679 | DENV1 2K | GU131682 |
| DENV1 2K | GU131759 | DENV1 2K | FJ410253 | DENV1 2K | FJ469909 | DENV1 2K | EU482714 |
| DENV1 2K | FJ882560 | DENV1 2K | FJ410281 | DENV1 2K | EU081227 | DENV1 2K | FJ410197 |
| DENV1 2K | GU131838 | DENV1 2K | EU482708 | DENV1 2K | EU482534 | DENV1 2K | GU131744 |
| DENV1 2K | FJ024437 | DENV1 2K | GQ199784 | DENV1 2K | FJ410261 | DENV1 2K | FJ410183 |
| DENV1 2K | GQ868639 | DENV1 2K | GQ868567 | DENV1 2K | FJ687428 | DENV1 2K | GQ199875 |
| DENV1 2K | FJ639806 | DENV1 2K | EU280167 | DENV1 2K | EU660392 | DENV1 2K | GQ199845 |
| DENV1 2K | GQ199837 | DENV1 2K | FJ850084 | DENV1 2K | GQ199815 | DENV1 2K | GU131689 |
| DENV1 2K | AB189120 | DENV1 2K | EU482514 | DENV1 2K | EU482611 | DENV1 2K | FJ461323 |
| DENV1 2K | EU081235 | DENV1 2K | AY722802 | DENV1 2K | FJ639821 | DENV1 2K | FJ432740 |
| DENV1 2K | FJ410263 | DENV1 2K | FJ639808 | DENV1 2K | FJ410174 | DENV1 2K | AY713474 |
| DENV1 2K | AY713476 | DENV1 2K | EU482526 | DENV1 2K | GU131706 | DENV1 2K | GQ199789 |
| DENV1 2K | GQ199806 | DENV1 2K | AY732476 | DENV1 2K | AY373427 | DENV1 2K | GU131977 |
| DENV1 2K | GU131693 | DENV1 2K | GU131772 | DENV1 2K | EU249495 | DENV1 2K | FJ850069 |
| DENV1 2K | GU131753 | DENV1 2K | FJ882530 | DENV1 2K | EU482477 | DENV1 2K | EF457905 |
| DENV1 2K | GU131711 | DENV1 2K | GU131978 | DENV1 2K | EU482826 | DENV1 2K | FJ898421 |
| DENV1 2K | FJ639812 | DENV1 2K | FJ547088 | DENV1 2K | GQ199843 | DENV1 2K | FJ744701 |
| DENV1 2K | GU131765 | DENV1 2K | FJ898374 | DENV1 2K | GQ199821 | DENV1 2K | GQ199788 |
| DENV1 2K | FJ432744 | DENV1 2K | GQ868504 | DENV1 2K | GU131777 | DENV1 2K | EU726778 |
| DENV1 2K | GM059691 | DENV1 2K | FJ882550 | DENV1 2K | FJ898378 | DENV1 2K | EU081263 |
| DENV1 2K | FJ410278 | DENV1 2K | FJ850113 | DENV1 2K | FJ461306 | DENV1 2K | FJ205874 |
| DENV1 2K | EU081261 | DENV1 2K | GU131980 | DENV1 2K | GU131707 | DENV1 2K | GU131826 |
| DENV1 2K | EU482801 | DENV1 2K | GU131783 | DENV1 2K | AF226686 | DENV1 2K | FJ898407 |
| DENV1 2K | FJ882526 | DENV1 2K | AY732474 | DENV1 2K | EU677152 | DENV1 2K | GQ199804 |
| DENV1 2K | FJ639823 | DENV1 2K | GU131958 | DENV1 2K | GU131828 | DENV1 2K | FJ024478 |
| DENV1 2K | EU081260 | DENV1 2K | FJ898393 | DENV1 2K | GU131971 | DENV1 2K | FJ850102 |
| DENV1 2K | GQ199786 | DENV1 2K | EU677176 | DENV1 2K | GQ199826 | DENV1 2K | FJ432721 |
| DENV1 2K | AY726550 | DENV1 2K | FJ850104 | DENV1 2K | EU677168 | DENV1 2K | EU660418 |
| DENV1 2K | FJ882558 | DENV1 2K | EU249492 | DENV1 2K | FJ461313 | DENV1 2K | EF032590 |
| DENV1 2K | GU131809 | DENV1 2K | EU482712 | DENV1 2K | EU081267 | DENV1 2K | AY713473 |
| DENV1 2K | FJ182030 | DENV1 2K | FJ410236 | DENV1 2K | FJ410175 | DENV1 2K | GU131700 |
| DENV1 2K | EU482816 | DENV1 2K | FJ410192 | DENV1 2K | FJ182028 | DENV1 2K | GQ868523 |
| DENV1 2K | GU131813 | DENV1 2K | EU081281 | DENV1 2K | FJ882516 | DENV1 2K | GQ868522 |
| DENV1 2K | EU482808 | DENV1 2K | FJ432729 | DENV1 2K | FJ024456 | DENV1 2K | EU660402 |
| DENV1 2K | EU482498 | DENV1 2K | GQ868525 | DENV1 2K | AF311956 | DENV1 2K | FJ639676 |
| DENV1 2K | FJ882525 | DENV1 2K | FN429883 | DENV1 2K | GU131770 | DENV1 2K | FJ410272 |
| DENV1 2K | GU131731 | DENV1 2K | GQ199828 | DENV1 2K | GU131824 | DENV1 2K | AY277665 |
| DENV1 2K | GQ199794 | DENV1 2K | FJ182021 | DENV1 2K | GQ199854 | DENV1 2K | GQ199802 |
| DENV1 2K | GU131832 | DENV1 2K | EU482824 | DENV1 2K | FJ898410 | DENV1 2K | FJ882549 |
| DENV1 2K | EU848545 | DENV1 2K | GU131956 | DENV1 2K | FJ024472 | DENV1 2K | FJ898391 |
| DENV1 2K | GU131760 | DENV1 2K | EU482797 | DENV1 2K | EU081236 | DENV1 2K | GQ199830 |
| DENV1 2K | GU131965 | DENV1 2K | FJ410213 | DENV1 2K | EU482480 | DENV1 2K | DQ672562 |
| DENV1 2K | FJ898415 | DENV1 2K | FJ898384 | DENV1 2K | GU131795 | DENV1 2K | GU131757 |
| DENV1 2K | GU131782 | DENV1 2K | FJ410186 | DENV1 2K | FJ432736 | DENV1 2K | GQ199839 |
| DENV1 2K | GQ868535 | DENV1 2K | GQ868538 | DENV1 2K | FJ024480 | DENV1 2K | FJ898437 |
| DENV1 2K | EU482524 | DENV1 2K | EU677163 | DENV1 2K | EU081278 | DENV1 2K | EU081250 |
| DENV1 2K | GU131726 | DENV1 2K | FJ432742 | DENV1 2K | FJ182019 | DENV1 2K | GU131963 |

FIG. 66-2

| Virus | Protein | Accession No. | Virus | Protein | Accession No. | Virus | Protein | Accession No. | Virus | Protein | Accession No. |
|---|---|---|---|---|---|---|---|---|---|---|---|
| DENV1 | 2K | FJ410257 | DENV1 | 2K | GU131752 | DENV1 | 2K | GQ199799 | DENV1 | 2K | FJ410285 |
| DENV1 | 2K | GU131798 | DENV1 | 2K | GQ199811 | DENV1 | 2K | GU056029 | DENV1 | 2K | FJ898388 |
| DENV1 | 2K | GQ868508 | DENV1 | 2K | GQ868518 | DENV1 | 2K | AY145122 | DENV1 | 2K | GQ868529 |
| DENV1 | 2K | EU482789 | DENV1 | 2K | FJ850075 | DENV1 | 2K | GU131811 | DENV1 | 2K | FJ882579 |
| DENV1 | 2K | U88536 | DENV1 | 2K | FJ850100 | DENV1 | 2K | EU482495 | DENV1 | 2K | FJ024442 |
| DENV1 | 2K | GU131807 | DENV1 | 2K | GU131709 | DENV1 | 2K | GQ868506 | DENV1 | 2K | GQ868563 |
| DENV1 | 2K | GQ868533 | DENV1 | 2K | GQ199848 | DENV1 | 2K | GU131961 | DENV1 | 2K | FJ639743 |
| DENV1 | 2K | FJ898390 | DENV1 | 2K | FJ024429 | DENV1 | 2K | FJ410269 | DENV1 | 2K | FJ390378 |
| DENV1 | 2K | EU081259 | DENV1 | 2K | FJ461315 | DENV1 | 2K | GQ199833 | DENV1 | 2K | GU131837 |
| DENV1 | 2K | EU482806 | DENV1 | 2K | EU677154 | DENV1 | 2K | EU081238 | DENV1 | 2K | FJ432732 |
| DENV1 | 2K | FJ373298 | DENV1 | 2K | GU056033 | DENV1 | 2K | GU131748 | DENV1 | 2K | GU131840 |
| DENV1 | 2K | FJ898382 | DENV1 | 2K | FN429890 | DENV1 | 2K | FJ410248 | DENV1 | 2K | EU677174 |
| DENV1 | 2K | FJ410250 | DENV1 | 2K | EU482822 | DENV1 | 2K | GU131733 | DENV1 | 2K | FJ639680 |
| DENV1 | 2K | FJ410226 | DENV1 | 2K | GU131746 | DENV1 | 2K | FJ461325 | DENV1 | 2K | GQ199849 |
| DENV1 | 2K | GU131785 | DENV1 | 2K | FJ390382 | DENV1 | 2K | GQ199817 | DENV1 | 2K | FJ882566 |
| DENV1 | 2K | GU131842 | DENV1 | 2K | GU131724 | DENV1 | 2K | GU131691 | DENV1 | 2K | FJ882541 |
| DENV1 | 2K | GU131836 | DENV1 | 2K | EU677161 | DENV1 | 2K | GU131804 | DENV1 | 2K | FJ639802 |
| DENV1 | 2K | GQ199824 | DENV1 | 2K | EU482536 | DENV1 | 2K | FJ562106 | DENV1 | 2K | FJ432725 |
| DENV1 | 2K | EU482790 | DENV1 | 2K | GU131713 | DENV1 | 2K | FJ639682 | DENV1 | 2K | FN429888 |
| DENV1 | 2K | EU081257 | DENV1 | 2K | GU131721 | DENV1 | 2K | GU131792 | DENV1 | 2K | EU482492 |
| DENV1 | 2K | FJ024449 | DENV1 | 2K | EU660397 | DENV1 | 2K | FJ882522 | DENV1 | 2K | FJ882557 |
| DENV1 | 2K | FJ024430 | DENV1 | 2K | FJ906965 | DENV1 | 2K | GU131742 | DENV1 | 2K | FJ639669 |
| DENV1 | 2K | EU482815 | DENV1 | 2K | EU081280 | DENV1 | 2K | GU131761 | DENV1 | 2K | EU482792 |
| DENV1 | 2K | FJ898398 | DENV1 | 2K | FJ639692 | DENV1 | 2K | GQ868561 | DENV1 | 2K | FJ461340 |
| DENV1 | 2K | EU482530 | DENV1 | 2K | EU249494 | DENV1 | 2K | FJ410245 | DENV1 | 2K | GU131805 |
| DENV1 | 2K | GQ868636 | DENV1 | 2K | FJ639819 | DENV1 | 2K | GQ868520 | DENV1 | 2K | FJ410264 |
| DENV1 | 2K | FJ024459 | DENV1 | 2K | EU482529 | DENV1 | 2K | EU482707 | DENV1 | 2K | EU482516 |
| DENV1 | 2K | GQ868610 | DENV1 | 2K | EU482616 | DENV1 | 2K | EU482520 | DENV1 | 2K | FJ469907 |
| DENV1 | 2K | EU081233 | DENV1 | 2K | FJ410284 | DENV1 | 2K | FJ882536 | DENV1 | 2K | FJ898396 |
| DENV1 | 2K | FJ687426 | DENV1 | 2K | FJ410181 | DENV1 | 2K | EU081248 | DENV1 | 2K | EU677157 |
| DENV1 | 2K | FJ898404 | DENV1 | 2K | FJ461332 | DENV1 | 2K | GQ868531 | DENV1 | 2K | EU482510 |
| DENV1 | 2K | EU081244 | DENV1 | 2K | GQ199777 | DENV1 | 2K | EU482533 | DENV1 | 2K | FJ182034 |
| DENV1 | 2K | EU482522 | DENV1 | 2K | EU081229 | DENV1 | 2K | FJ898411 | DENV1 | 2K | FJ898377 |
| DENV1 | 2K | FJ205882 | DENV1 | 2K | FJ410270 | DENV1 | 2K | GQ199796 | DENV1 | 2K | EU660390 |
| DENV1 | 2K | GU131788 | DENV1 | 2K | GQ199873 | DENV1 | 2K | GU131818 | DENV1 | 2K | GU131718 |
| DENV1 | 2K | GU131762 | DENV1 | 2K | FJ024451 | DENV1 | 2K | EU081239 | DENV1 | 2K | GQ868513 |
| DENV1 | 2K | FJ410238 | DENV1 | 2K | GU131739 | DENV1 | 2K | EU081255 | DENV1 | 2K | FJ639740 |
| DENV1 | 2K | DQ285558 | DENV1 | 2K | EU482482 | DENV1 | 2K | EU359008 | DENV1 | 2K | FJ882533 |
| DENV1 | 2K | FJ898371 | DENV1 | 2K | FJ024482 | DENV1 | 2K | FJ906964 | DENV1 | 2K | GU131926 |
| DENV1 | 2K | FJ461308 | DENV1 | 2K | GU131698 | DENV1 | 2K | EU482618 | DENV1 | 2K | GU131734 |
| DENV1 | 2K | EU482711 | DENV1 | 2K | FJ024432 | DENV1 | 2K | FJ410246 | DENV1 | 2K | EU482519 |
| DENV1 | 2K | GQ868605 | DENV1 | 2K | FJ882556 | DENV1 | 2K | GQ868534 | DENV1 | 2K | AY206457 |
| DENV1 | 2K | GQ868565 | DENV1 | 2K | GU131831 | DENV1 | 2K | GQ199835 | DENV1 | 2K | GQ199818 |
| DENV1 | 2K | GQ868608 | DENV1 | 2K | AY835999 | DENV1 | 2K | GU131716 | DENV1 | 2K | FJ850077 |
| DENV1 | 2K | FJ898417 | DENV1 | 2K | GU131922 | DENV1 | 2K | FJ410256 | DENV1 | 2K | AY726553 |
| DENV1 | 2K | FJ024426 | DENV1 | 2K | FJ898376 | DENV1 | 2K | FJ898424 | DENV1 | 2K | EU482718 |
| DENV1 | 2K | GQ868511 | DENV1 | 2K | FJ898425 | DENV1 | 2K | GU131687 | DENV1 | 2K | EU081274 |
| DENV1 | 2K | FJ882562 | DENV1 | 2K | FJ898419 | DENV1 | 2K | EU482615 | DENV1 | 2K | FJ182025 |

FIG. 66-3

| Virus | Protein | Accession No. | Virus | Protein | Accession No. | Virus | Protein | Accession No. | Virus | Protein | Accession No. |
|---|---|---|---|---|---|---|---|---|---|---|---|
| DENV1 | 2K | GU131973 | DENV1 | 2K | FJ390380 | DENV1 | 2K | FJ850093 | DENV1 | 2K | FJ410262 |
| DENV1 | 2K | EU482811 | DENV1 | 2K | FJ882547 | DENV1 | 2K | GU131728 | DENV1 | 2K | EU081243 |
| DENV1 | 2K | FJ410210 | DENV1 | 2K | GQ868611 | DENV1 | 2K | FJ898372 | DENV1 | 2K | CS477264 |
| DENV1 | 2K | GU131925 | DENV1 | 2K | FJ410231 | DENV1 | 2K | EU677172 | DENV1 | 2K | FJ562104 |
| DENV1 | 2K | FJ373297 | DENV1 | 2K | GU131680 | DENV1 | 2K | FJ639794 | DENV1 | 2K | GQ199823 |
| DENV1 | 2K | FJ205875 | DENV1 | 2K | M87512 | DENV1 | 2K | GQ868527 | DENV1 | 2K | FJ639741 |
| DENV1 | 2K | DQ193572 | DENV1 | 2K | FJ024440 | DENV1 | 2K | FJ687430 | DENV1 | 2K | GU131690 |
| DENV1 | 2K | U88535 | DENV1 | 2K | GU131774 | DENV1 | 2K | FJ639672 | DENV1 | 2K | EU482497 |
| DENV1 | 2K | FJ882564 | DENV1 | 2K | DQ672560 | DENV1 | 2K | FJ410189 | DENV1 | 2K | GU370049 |
| DENV1 | 2K | GQ199774 | DENV1 | 2K | GQ868512 | DENV1 | 2K | FJ182023 | DENV1 | 2K | GQ868632 |
| DENV1 | 2K | GQ199787 | DENV1 | 2K | FJ024463 | DENV1 | 2K | FJ410260 | DENV1 | 2K | GQ868613 |
| DENV1 | 2K | FJ850099 | DENV1 | 2K | EF122231 | DENV1 | 2K | EU081266 | DENV1 | 2K | GU131893 |
| DENV1 | 2K | FJ410267 | DENV1 | 2K | GQ199810 | DENV1 | 2K | GU131895 | DENV1 | 2K | EU687247 |
| DENV1 | 2K | EU726777 | DENV1 | 2K | FJ850081 | DENV1 | 2K | GU131829 | DENV1 | 2K | EU482813 |
| DENV1 | 2K | EU081241 | DENV1 | 2K | FJ024427 | DENV1 | 2K | FJ410204 | DENV1 | 2K | AY713475 |
| DENV1 | 2K | FJ898381 | DENV1 | 2K | GQ868637 | DENV1 | 2K | FJ410194 | DENV1 | 2K | FJ024438 |
| DENV1 | 2K | CS477265 | DENV1 | 2K | FJ639796 | DENV1 | 2K | FJ882528 | DENV1 | 2K | FJ882542 |
| DENV1 | 2K | GQ199780 | DENV1 | 2K | EU677159 | DENV1 | 2K | FJ432730 | DENV1 | 2K | GU131982 |
| DENV1 | 2K | FN429889 | DENV1 | 2K | FJ882519 | DENV1 | 2K | EU081230 | DENV1 | 2K | FJ461328 |
| DENV1 | 2K | FJ024434 | DENV1 | 2K | GQ199825 | DENV1 | 2K | FJ410206 | DENV1 | 2K | FJ687432 |
| DENV1 | 2K | FJ024483 | DENV1 | 2K | EU482525 | DENV1 | 2K | GU131969 | DENV1 | 2K | FJ410188 |
| DENV1 | 2K | EU482502 | DENV1 | 2K | EU482798 | DENV1 | 2K | AY732478 | DENV1 | 2K | GQ199813 |
| DENV1 | 2K | GU131962 | DENV1 | 2K | FJ182032 | DENV1 | 2K | FJ461330 | DENV1 | 2K | GQ199847 |
| DENV1 | 2K | FJ461339 | DENV1 | 2K | GU131769 | DENV1 | 2K | DQ672556 | DENV1 | 2K | FJ410212 |
| DENV1 | 2K | EU482821 | DENV1 | 2K | GQ199792 | DENV1 | 2K | GU131976 | DENV1 | 2K | FJ410232 |
| DENV1 | 2K | GU131891 | DENV1 | 2K | GU131888 | DENV1 | 2K | FJ410216 | DENV1 | 2K | EU482481 |
| DENV1 | 2K | EU660403 | DENV1 | 2K | GU131704 | DENV1 | 2K | GQ199801 | DENV1 | 2K | AY726551 |
| DENV1 | 2K | FJ410275 | DENV1 | 2K | GQ199850 | DENV1 | 2K | FJ906728 | DENV1 | 2K | FJ639811 |
| DENV1 | 2K | GQ868559 | DENV1 | 2K | GQ868526 | DENV1 | 2K | GU131803 | DENV1 | 2K | GU131800 |
| DENV1 | 2K | AF298808 | DENV1 | 2K | GU131695 | DENV1 | 2K | AY726555 | DENV1 | 2K | FJ024425 |
| DENV1 | 2K | FJ410218 | DENV1 | 2K | FJ410243 | DENV1 | 2K | GQ199798 | DENV1 | 2K | EU482527 |
| DENV1 | 2K | GQ199775 | DENV1 | 2K | AF309641 | DENV1 | 2K | GU056030 | DENV1 | 2K | EU482500 |
| DENV1 | 2K | FJ882552 | DENV1 | 2K | FJ639686 | DENV1 | 2K | GU131816 | DENV1 | 2K | EU482828 |
| DENV1 | 2K | FJ898402 | DENV1 | 2K | FJ410255 | DENV1 | 2K | EU482512 | DENV1 | 2K | FJ205873 |
| DENV1 | 2K | GQ199859 | DENV1 | 2K | EU482818 | DENV1 | 2K | FJ882568 | DENV1 | 2K | AY732481 |
| DENV1 | 2K | FJ410196 | DENV1 | 2K | GU131685 | DENV1 | 2K | FJ898413 | DENV1 | 2K | GQ199782 |
| DENV1 | 2K | FJ639690 | DENV1 | 2K | GU131793 | DENV1 | 2K | EU596504 | DENV1 | 2K | EU677150 |
| DENV1 | 2K | FJ898383 | DENV1 | 2K | FN429882 | DENV1 | 2K | FJ410276 | DENV1 | 2K | EU482591 |
| DENV1 | 2K | GU131984 | DENV1 | 2K | EU482509 | DENV1 | 2K | FJ898386 | DENV1 | 2K | GU131738 |
| DENV1 | 2K | GQ868498 | DENV1 | 2K | FJ547086 | DENV1 | 2K | EU482506 | DENV1 | 2K | FJ024485 |
| DENV1 | 2K | EU482487 | DENV1 | 2K | FJ639694 | DENV1 | 2K | GU131736 | DENV1 | 2K | EU677177 |
| DENV1 | 2K | FJ639818 | DENV1 | 2K | EU482491 | DENV1 | 2K | GU131948 | DENV1 | 2K | GU131967 |
| DENV1 | 2K | EU677166 | DENV1 | 2K | GU131755 | DENV1 | 2K | GU131834 | DENV1 | 2K | GU131814 |
| DENV1 | 2K | GU131758 | DENV1 | 2K | FJ898430 | DENV1 | 2K | EU482715 | DENV1 | 2K | AJ968413 |
| DENV1 | 2K | GU131697 | DENV1 | 2K | FJ898428 | DENV1 | 2K | EU482716 | DENV1 | 2K | FJ024436 |
| DENV1 | 2K | EU081247 | DENV1 | 2K | FJ639814 | DENV1 | 2K | FJ850087 | DENV1 | 2K | FJ432746 |
| DENV1 | 2K | AY376738 | DENV1 | 2K | GU131763 | DENV1 | 2K | AF514883 | DENV1 | 2K | FJ850071 |
| DENV1 | 2K | GU131776 | DENV1 | 2K | FJ873814 | DENV1 | 2K | EU660395 | DENV1 | 2K | EU081271 |

FIG. 66-4

| Virus Protein | Accession No. | Virus Protein | Accession No. | Virus Protein | Accession No. | Virus Protein | Accession No. |
|---|---|---|---|---|---|---|---|
| DENV1 2K | AY708047 | DENV1 2K | EU179861 | DENV1 2K | FJ639685 | DENV1 2K | FJ410258 |
| DENV1 2K | EU677169 | DENV1 2K | AB074761 | DENV1 2K | EU482535 | DENV1 2K | EU482802 |
| DENV1 2K | FJ882535 | DENV1 2K | GQ199829 | DENV1 2K | FJ024433 | DENV1 2K | GQ868633 |
| DENV1 2K | FJ547087 | DENV1 2K | GU131863 | DENV1 2K | FJ176780 | DENV1 2K | AB074760 |
| DENV1 2K | EU677164 | DENV1 2K | GU131892 | DENV1 2K | FJ373305 | DENV1 2K | EU081256 |
| DENV1 2K | GU131725 | DENV1 2K | GQ868530 | DENV1 2K | FJ410279 | DENV1 2K | FJ432735 |
| DENV1 2K | DQ285561 | DENV1 2K | FJ410173 | DENV1 2K | EU081279 | DENV1 2K | GQ199781 |
| DENV1 2K | GU131678 | DENV1 2K | EU482814 | DENV1 2K | GU131756 | DENV1 2K | DQ285559 |
| DENV1 2K | GU131822 | DENV1 2K | EU660393 | DENV1 2K | FJ478457 | DENV1 2K | FJ182036 |
| DENV1 2K | EU482479 | DENV1 2K | FJ639815 | DENV1 2K | FJ024457 | DENV1 2K | FJ547089 |
| DENV1 2K | FJ882518 | DENV1 2K | GU131979 | DENV1 2K | AB189121 | DENV1 2K | FJ898416 |
| DENV1 2K | FJ639696 | DENV1 2K | EU482827 | DENV1 2K | DQ285562 | DENV1 2K | GU131960 |
| DENV1 2K | GQ199857 | DENV1 2K | FJ461316 | DENV1 2K | FJ850103 | DENV1 2K | GU131820 |
| DENV1 2K | GQ199808 | DENV1 2K | FJ882544 | DENV1 2K | EU482499 | DENV1 2K | EU677170 |
| DENV1 2K | FJ432749 | DENV1 2K | GU131768 | DENV1 2K | GQ199805 | DENV1 2K | FJ882531 |
| DENV1 2K | GU131771 | DENV1 2K | EU482567 | DENV1 2K | GQ868568 | DENV1 2K | AF514889 |
| DENV1 2K | GQ199772 | DENV1 2K | GU131957 | DENV1 2K | FJ547068 | DENV1 2K | EU863650 |
| DENV1 2K | FJ882538 | DENV1 2K | DQ672559 | DENV1 2K | EU081234 | DENV1 2K | FB667403 |
| DENV1 2K | FJ410283 | DENV1 2K | EU677153 | DENV1 2K | FJ432739 | DENV1 2K | GU131714 |
| DENV1 2K | FJ882521 | DENV1 2K | AF226687 | DENV1 2K | GQ199816 | DENV1 2K | FJ882569 |
| DENV1 2K | EU726779 | DENV1 2K | EU482825 | DENV1 2K | FJ898401 | DENV1 2K | FJ410280 |
| DENV1 2K | EU081253 | DENV1 2K | FJ182022 | DENV1 2K | GU131812 | DENV1 2K | FJ882548 |
| DENV1 2K | FN429886 | DENV1 2K | EU482592 | DENV1 2K | EU660419 | DENV1 2K | FJ859029 |
| DENV1 2K | GQ868601 | DENV1 2K | EU482800 | DENV1 2K | GQ199831 | DENV1 2K | GU131781 |
| DENV1 2K | FJ182003 | DENV1 2K | GU131745 | DENV1 2K | AY732475 | DENV1 2K | FJ410252 |
| DENV1 2K | FJ410286 | DENV1 2K | FJ410184 | DENV1 2K | EU249491 | DENV1 2K | EU081262 |
| DENV1 2K | FJ639684 | DENV1 2K | GQ199778 | DENV1 2K | GU131833 | DENV1 2K | GQ199842 |
| DENV1 2K | EU482794 | DENV1 2K | FJ390383 | DENV1 2K | GQ199836 | DENV1 2K | EU726782 |
| DENV1 2K | AY722801 | DENV1 2K | FJ410203 | DENV1 2K | FJ410240 | DENV1 2K | GQ868537 |
| DENV1 2K | FJ410199 | DENV1 2K | EU482476 | DENV1 2K | FJ410225 | DENV1 2K | GQ199797 |
| DENV1 2K | EU482485 | DENV1 2K | AY145123 | DENV1 2K | GU131732 | DENV1 2K | FJ882515 |
| DENV1 2K | EU482803 | DENV1 2K | EU081270 | DENV1 2K | FJ639677 | DENV1 2K | FJ024450 |
| DENV1 2K | GU131767 | DENV1 2K | GQ199872 | DENV1 2K | FJ810419 | DENV1 2K | GU131723 |
| DENV1 2K | AY726549 | DENV1 2K | GQ199856 | DENV1 2K | GU056032 | DENV1 2K | GQ868503 |
| DENV1 2K | FJ176779 | DENV1 2K | EU482709 | DENV1 2K | FJ390374 | DENV1 2K | FJ882551 |
| DENV1 2K | FJ461335 | DENV1 2K | GQ868618 | DENV1 2K | FJ882527 | DENV1 2K | FJ461318 |
| DENV1 2K | FJ898408 | DENV1 2K | GU131699 | DENV1 2K | GU131830 | DENV1 2K | FJ898418 |
| DENV1 2K | GQ199844 | DENV1 2K | FJ182029 | DENV1 2K | EU482791 | DENV1 2K | GQ199820 |
| DENV1 2K | GU131970 | DENV1 2K | GQ199855 | DENV1 2K | FJ898427 | DENV1 2K | AF513110 |
| DENV1 2K | EU482796 | DENV1 2K | FJ882539 | DENV1 2K | FJ410234 | DENV1 2K | FJ410191 |
| DENV1 2K | EU596502 | DENV1 2K | FJ410180 | DENV1 2K | EU482494 | DENV1 2K | FJ024431 |
| DENV1 2K | GQ868607 | DENV1 2K | GU131806 | DENV1 2K | FJ432720 | DENV1 2K | FJ898394 |
| DENV1 2K | GQ868524 | DENV1 2K | DQ672564 | DENV1 2K | FJ639735 | DENV1 2K | FJ024445 |
| DENV1 2K | GQ868517 | DENV1 2K | FJ410268 | DENV1 2K | FJ898406 | DENV1 2K | EU081242 |
| DENV1 2K | EU081268 | DENV1 2K | GU131825 | DENV1 2K | DQ672563 | DENV1 2K | FJ461333 |
| DENV1 2K | GQ199827 | DENV1 2K | FJ850101 | DENV1 2K | GQ199793 | DENV1 2K | GQ868509 |
| DENV1 2K | EU660394 | DENV1 2K | FJ182002 | DENV1 2K | EU482807 | DENV1 2K | FJ410209 |
| DENV1 2K | EU482610 | DENV1 2K | GU131683 | DENV1 2K | GU131797 | DENV1 2K | GU131839 |

FIG. 66-5

| Virus | Protein | Accession No. | Virus | Protein | Accession No. | Virus | Protein | Accession No. | Virus | Protein | Accession No. |
|---|---|---|---|---|---|---|---|---|---|---|---|
| DENV1 | 2K | FJ410251 | DENV1 | 2K | FJ850090 | DENV1 | 2K | EU081264 | DENV1 | 2K | EU482538 |
| DENV1 | 2K | EU677175 | DENV1 | 2K | EU482528 | DENV1 | 2K | GU131688 | DENV1 | 2K | EU081245 |
| DENV1 | 2K | FJ639820 | DENV1 | 2K | FJ898448 | DENV1 | 2K | A75711 | DENV1 | 2K | GQ868619 |
| DENV1 | 2K | GQ199867 | DENV1 | 2K | FJ898420 | DENV1 | 2K | EU081254 | DENV1 | 2K | GU131789 |
| DENV1 | 2K | FJ024428 | DENV1 | 2K | GQ868519 | DENV1 | 2K | FJ898429 | DENV1 | 2K | AB178040 |
| DENV1 | 2K | EU482537 | DENV1 | 2K | FJ432727 | DENV1 | 2K | FJ469908 | DENV1 | 2K | AY732480 |
| DENV1 | 2K | GU131778 | DENV1 | 2K | EU677155 | DENV1 | 2K | GU131799 | DENV1 | 2K | FJ898385 |
| DENV1 | 2K | FJ024464 | DENV1 | 2K | EU677162 | DENV1 | 2K | FJ182027 | DENV1 | 2K | FJ639688 |
| DENV1 | 2K | GU131972 | DENV1 | 2K | GU131692 | DENV1 | 2K | FJ432737 | DENV1 | 2K | FJ205884 |
| DENV1 | 2K | GQ868606 | DENV1 | 2K | EU596501 | DENV1 | 2K | FJ410201 | DENV1 | 2K | FJ898380 |
| DENV1 | 2K | GU131679 | DENV1 | 2K | FJ410273 | DENV1 | 2K | GU131701 | DENV1 | 2K | FJ182026 |
| DENV1 | 2K | GU131708 | DENV1 | 2K | FJ410182 | DENV1 | 2K | EU081269 | DENV1 | 2K | AF311957 |
| DENV1 | 2K | EU687251 | DENV1 | 2K | GQ199791 | DENV1 | 2K | GQ199783 | DENV1 | 2K | FJ639693 |
| DENV1 | 2K | AF226685 | DENV1 | 2K | GQ868630 | DENV1 | 2K | GU131754 | DENV1 | 2K | GU131735 |
| DENV1 | 2K | FJ882561 | DENV1 | 2K | EU482503 | DENV1 | 2K | EU081251 | DENV1 | 2K | FJ850114 |
| DENV1 | 2K | EU482488 | DENV1 | 2K | FB730116 | DENV1 | 2K | FJ432733 | DENV1 | 2K | FJ882563 |
| DENV1 | 2K | FJ410214 | DENV1 | 2K | FJ410198 | DENV1 | 2K | FJ024447 | DENV1 | 2K | GQ199812 |
| DENV1 | 2K | FJ687429 | DENV1 | 2K | EU081276 | DENV1 | 2K | FJ547063 | DENV1 | 2K | GU131737 |
| DENV1 | 2K | FJ898379 | DENV1 | 2K | FJ461324 | DENV1 | 2K | EU482523 | DENV1 | 2K | FJ547060 |
| DENV1 | 2K | GU131790 | DENV1 | 2K | AF311958 | DENV1 | 2K | EU482793 | DENV1 | 2K | GQ199819 |
| DENV1 | 2K | EU482540 | DENV1 | 2K | FJ639813 | DENV1 | 2K | U88537 | DENV1 | 2K | FJ024484 |
| DENV1 | 2K | GU131681 | DENV1 | 2K | AF180817 | DENV1 | 2K | FJ898399 | DENV1 | 2K | GQ868500 |
| DENV1 | 2K | EU081226 | DENV1 | 2K | EU081277 | DENV1 | 2K | GQ868609 | DENV1 | 2K | EU249493 |
| DENV1 | 2K | FJ182020 | DENV1 | 2K | FJ898426 | DENV1 | 2K | EU726780 | DENV1 | 2K | EU081275 |
| DENV1 | 2K | FJ882524 | DENV1 | 2K | GU131729 | DENV1 | 2K | EU482805 | DENV1 | 2K | FJ432748 |
| DENV1 | 2K | EU677139 | DENV1 | 2K | GQ868539 | DENV1 | 2K | GU131784 | DENV1 | 2K | EU081228 |
| DENV1 | 2K | GU131920 | DENV1 | 2K | AY145121 | DENV1 | 2K | GU131827 | DENV1 | 2K | EU482810 |
| DENV1 | 2K | GQ868536 | DENV1 | 2K | EU677167 | DENV1 | 2K | FJ410227 | DENV1 | 2K | GQ199852 |
| DENV1 | 2K | GQ199776 | DENV1 | 2K | FJ898422 | DENV1 | 2K | GQ868505 | DENV1 | 2K | GU131923 |
| DENV1 | 2K | FJ390381 | DENV1 | 2K | FJ744702 | DENV1 | 2K | FN429884 | DENV1 | 2K | GQ199790 |
| DENV1 | 2K | GU131751 | DENV1 | 2K | GQ199838 | DENV1 | 2K | FJ873809 | DENV1 | 2K | FJ024423 |
| DENV1 | 2K | FJ390388 | DENV1 | 2K | GQ199779 | DENV1 | 2K | EU081258 | DENV1 | 2K | FJ882555 |
| DENV1 | 2K | EU482823 | DENV1 | 2K | FJ205883 | DENV1 | 2K | EU677173 | DENV1 | 2K | FJ898405 |
| DENV1 | 2K | FJ850073 | DENV1 | 2K | GQ868635 | DENV1 | 2K | FJ898392 | DENV1 | 2K | GU131889 |
| DENV1 | 2K | EU081237 | DENV1 | 2K | DQ285560 | DENV1 | 2K | FJ024448 | DENV1 | 2K | GQ868499 |
| DENV1 | 2K | EU482483 | DENV1 | 2K | FJ410239 | DENV1 | 2K | GQ868507 | DENV1 | 2K | EU482501 |
| DENV1 | 2K | GQ199853 | DENV1 | 2K | FJ882554 | DENV1 | 2K | EU482531 | DENV1 | 2K | GU131775 |
| DENV1 | 2K | GU131921 | DENV1 | 2K | GU131747 | DENV1 | 2K | GQ868510 | DENV1 | 2K | EU081246 |
| DENV1 | 2K | FJ182031 | DENV1 | 2K | FJ024481 | DENV1 | 2K | FJ410290 | DENV1 | 2K | GQ199773 |
| DENV1 | 2K | FJ639683 | DENV1 | 2K | FJ639675 | DENV1 | 2K | GU131981 | DENV1 | 2K | FJ898431 |
| DENV1 | 2K | GU131740 | DENV1 | 2K | GU131810 | DENV1 | 2K | EU660391 | DENV1 | 2K | EU081231 |
| DENV1 | 2K | FJ562105 | DENV1 | 2K | FJ410249 | DENV1 | 2K | EU482515 | DENV1 | 2K | EU482486 |
| DENV1 | 2K | FJ432745 | DENV1 | 2K | DQ672561 | DENV1 | 2K | EU081232 | DENV1 | 2K | FJ410187 |
| DENV1 | 2K | AY277664 | DENV1 | 2K | FJ810415 | DENV1 | 2K | GQ199840 | DENV1 | 2K | FN429881 |
| DENV1 | 2K | FJ882559 | DENV1 | 2K | GQ199785 | DENV1 | 2K | EU482710 | DENV1 | 2K | GU131764 |
| DENV1 | 2K | FJ024435 | DENV1 | 2K | FJ410220 | DENV1 | 2K | GQ868566 | DENV1 | 2K | GQ868569 |
| DENV1 | 2K | GQ199803 | DENV1 | 2K | EU482504 | DENV1 | 2K | GU131964 | DENV1 | 2K | GQ868612 |
| DENV1 | 2K | FJ461320 | DENV1 | 2K | FJ205881 | DENV1 | 2K | EU482713 | DENV1 | 2K | FJ461331 |

FIG. 66-6

| Virus Protein | Accession No. | Virus Protein | Accession No. | Virus Protein | Accession No. | Virus Protein | Accession No. |
|---|---|---|---|---|---|---|---|
| DENV1 2K | FJ410282 | DENV1 2K | FJ461319 | DENV1 2K | GU131717 | DENV1 2K | GU131743 |
| DENV1 2K | FJ205872 | DENV1 2K | FJ898412 | DENV1 2K | EU081273 | DENV1 2K | GQ868614 |
| DENV1 2K | GQ199809 | DENV1 2K | GQ868521 | DENV1 2K | GQ199846 | DENV1 2K | EU482706 |
| DENV1 2K | GU131722 | DENV1 2K | GU131686 | DENV1 2K | AY732483 | DENV1 2K | AY376737 |
| DENV1 2K | FJ873810 | DENV1 2K | AY732479 | DENV1 2K | CS477263 | DENV1 2K | FJ562101 |
| DENV1 2K | FJ882546 | DENV1 2K | FJ384655 | DENV1 2K | EU482496 | DENV1 2K | FB667398 |
| DENV1 2K | FJ639797 | DENV1 2K | FJ882537 | DENV1 2K | FJ410265 | DENV1 2K | GU131808 |
| DENV1 2K | EU677160 | DENV1 2K | FJ898373 | DENV1 2K | GU131720 | DENV1 2K | GU131780 |
| DENV1 2K | FJ461312 | DENV1 2K | GU131710 | DENV1 2K | FJ461327 | DENV1 2K | FJ639671 |
| DENV1 2K | NC_001477 | DENV1 2K | EU677171 | DENV1 2K | GU370048 | DENV1 2K | FJ390379 |
| DENV1 2K | GQ199841 | DENV1 2K | FJ024479 | DENV1 2K | FJ898409 | DENV1 2K | FJ024439 |
| DENV1 2K | FJ882534 | DENV1 2K | FJ687431 | DENV1 2K | FJ182024 | DENV1 2K | AF350498 |
| DENV1 2K | FJ410289 | DENV1 2K | FJ882523 | DENV1 2K | FJ882565 | DENV1 2K | FJ432747 |
| DENV1 2K | FJ410179 | DENV1 2K | FJ547065 | DENV1 2K | GU131966 | DENV1 2K | EU482795 |
| DENV1 2K | FJ432719 | DENV1 2K | GU131791 | DENV1 2K | EU249490 | DENV1 2K | FJ639678 |
| DENV1 2K | AY277666 | DENV1 2K | GU131894 | DENV1 2K | AF514876 | DENV1 2K | EU482617 |
| DENV1 2K | GU131727 | DENV1 2K | EU482490 | DENV1 2K | FN429885 | DENV1 2K | FJ410287 |
| DENV1 2K | FJ024462 | DENV1 2K | EU482521 | DENV1 2K | EU081272 | DENV1 2K | FJ024444 |
| DENV1 2K | FJ024441 | DENV1 2K | FJ898423 | DENV1 2K | GU131841 | DENV1 2K | EU482799 |
| DENV1 2K | GQ199822 | DENV1 2K | EU660396 | DENV1 2K | GQ868570 | DENV1 2K | GU131750 |
| DENV1 2K | FN429887 | DENV1 2K | AF180818 | DENV1 2K | GU131890 | DENV1 2K | FJ906963 |
| DENV1 2K | EU482539 | DENV1 2K | AY726554 | DENV1 2K | FJ882553 | DENV1 2K | FJ410185 |
| DENV1 2K | EU482804 | DENV1 2K | FJ898403 | DENV1 2K | GU131821 | DENV1 2K | EU660412 |
| DENV1 2K | FJ882520 | DENV1 2K | CS479203 | DENV1 2K | GQ199771 | DENV1 2K | GU131779 |
| DENV1 2K | FJ639689 | DENV1 2K | EU482517 | DENV1 2K | AB195673 | DENV1 2K | FJ639691 |
| DENV1 2K | EU677140 | DENV1 2K | EU482609 | DENV1 2K | EU482812 | DENV1 2K | EU677165 |
| DENV1 2K | GQ199832 | DENV1 2K | FJ410266 | DENV1 2K | AF298807 | DENV1 2K | GU131773 |
| DENV1 2K | FJ639695 | DENV1 2K | EU482493 | DENV1 2K | GU131801 | DENV1 2K | FJ882517 |
| DENV1 2K | FJ410244 | DENV1 2K | FJ639674 | DENV1 2K | GU131983 | DENV1 2K | FJ410230 |
| DENV1 2K | FJ898397 | DENV1 2K | FJ639673 | DENV1 2K | EF122232 | DENV1 2K | FJ410211 |
| DENV1 2K | GU131819 | DENV1 2K | AY732482 | DENV1 2K | AB519681 | DENV1 2K | FJ850070 |
| DENV1 2K | GU131823 | DENV1 2K | CS479204 | DENV1 2K | GQ199814 | DENV1 2K | FJ024460 |
| DENV1 2K | FJ882543 | DENV1 2K | EU482819 | DENV1 2K | AY726552 | DENV1 2K | GQ868562 |
| DENV1 2K | GU131715 | DENV1 2K | FJ882570 | DENV1 2K | EU482484 | DENV1 2K | FJ882529 |
| DENV1 2K | EU677156 | DENV1 2K | AF514885 | DENV1 2K | AY722803 | DENV1 2K | FJ639687 |
| DENV1 2K | FJ461317 | DENV1 2K | GU131802 | DENV1 2K | GU131787 | DENV1 2K | GU131684 |
| DENV1 2K | GU131794 | DENV1 2K | FJ687427 | DENV1 2K | FJ373296 | DENV1 2K | FJ205876 |
| DENV1 2K | FJ461341 | DENV1 2K | FJ182033 | DENV1 2K | GU131887 | DENV1 2K | FJ410205 |
| DENV1 2K | EU482511 | DENV1 2K | GQ199800 | DENV1 2K | GU131741 | DENV1 2K | FJ478458 |
| DENV1 2K | FJ024453 | DENV1 2K | GU131702 | DENV1 2K | EU677178 | DENV1 2K | EU677158 |
| DENV1 2K | GU131749 | DENV1 2K | FJ432723 | DENV1 2K | FJ898433 | DENV1 2K | EU482532 |
| DENV1 2K | FJ898389 | DENV1 2K | EU482505 | DENV1 2K | FJ024443 | DENV1 2K | FJ410242 |
| DENV1 2K | GU131696 | DENV1 2K | FJ882532 | DENV1 2K | FJ461336 | DENV1 2K | EU482619 |
| DENV1 2K | EU482508 | DENV1 2K | AF514878 | DENV1 2K | GQ199858 | DENV1 2K | FJ410235 |
| DENV1 2K | EU081265 | DENV1 2K | FJ882540 | DENV1 2K | EU482820 | DENV1 2K | FJ898395 |
| DENV1 2K | FJ410247 | DENV1 2K | GU131703 | DENV1 2K | EU482478 | DENV1 2K | GU131949 |
| DENV1 2K | FJ461307 | DENV1 2K | FJ410190 | DENV1 2K | GU131815 | DENV1 2K | AY732477 |
| DENV1 2K | GQ868560 | DENV1 2K | GQ868564 | DENV1 2K | GQ199834 | DENV1 2K | EU596503 |

FIG. 66-7

| Virus Protein | Accession No. | Virus Protein | Accession No. | Virus Protein | Accession No. | Virus Protein | Accession No. |
|---|---|---|---|---|---|---|---|
| DENV1 2K | GQ199851 | DENV1 2K | DQ672557 | DENV1 anC | GU131813 | DENV1 anC | FJ410192 |
| DENV1 2K | GU131796 | DENV1 2K | GQ199877 | DENV1 anC | EU482808 | DENV1 anC | EU081281 |
| DENV1 2K | EU081252 | DENV1 2K | GU131719 | DENV1 anC | EU482498 | DENV1 anC | FJ432729 |
| DENV1 2K | GU131712 | DENV1 2K | EU482817 | DENV1 anC | FJ882525 | DENV1 anC | GQ868525 |
| DENV1 2K | EU081249 | DENV1 2K | FJ410254 | DENV1 anC | GU131731 | DENV1 anC | FN429883 |
| DENV1 2K | GU131730 | DENV1 2K | EU482507 | DENV1 anC | GQ199794 | DENV1 anC | GQ199828 |
| DENV1 2K | GQ199795 | DENV1 2K | FJ410274 | DENV1 anC | GU131832 | DENV1 anC | FJ182021 |
| DENV1 2K | GQ199807 | DENV1 2K | FJ898387 | DENV1 anC | EU848545 | DENV1 anC | EU482824 |
| DENV1 2K | GU131817 | DENV1 2K | GQ868514 | DENV1 anC | GU131760 | DENV1 anC | GU131956 |
| DENV1 2K | FJ024455 | DENV1 2K | GU131705 | DENV1 anC | GU131965 | DENV1 anC | EU482797 |
| DENV1 2K | GU131766 | DENV1 2K | FJ432738 | DENV1 anC | FJ898415 | DENV1 anC | FJ410213 |
| DENV1 2K | GU056031 | DENV1 2K | FJ639681 | DENV1 anC | GU131782 | DENV1 anC | FJ898384 |
| DENV1 2K | GU131786 | DENV1 2K | EU482513 | DENV1 anC | GQ868535 | DENV1 anC | FJ410186 |
| DENV1 2K | FJ410207 | DENV1 2K | EU081240 | DENV1 anC | EU482524 | DENV1 anC | GQ868538 |
| DENV1 2K | EU726781 | DENV1 2K | FJ639670 | DENV1 anC | GU131726 | DENV1 anC | EU677163 |
| DENV1 2K | FJ182035 | DENV1 anC | FJ639670 | DENV1 anC | GQ868501 | DENV1 anC | FJ432742 |
| DENV1 2K | FJ882545 | DENV1 anC | FJ024446 | DENV1 anC | FJ432734 | DENV1 anC | FJ461303 |
| DENV1 2K | FJ410222 | DENV1 anC | GU131759 | DENV1 anC | FJ410253 | DENV1 anC | FJ639679 |
| DENV1 2K | EU660401 | DENV1 anC | FJ882560 | DENV1 anC | FJ410281 | DENV1 anC | FJ469909 |
| DENV1 2K | FJ639824 | DENV1 anC | GU131838 | DENV1 anC | EU482708 | DENV1 anC | EU081227 |
| DENV1 2K | AY762084 | DENV1 anC | FJ024437 | DENV1 anC | GQ199784 | DENV1 anC | EU482534 |
| DENV1 2K | GQ868602 | DENV1 anC | GQ868639 | DENV1 anC | GQ868567 | DENV1 anC | FJ410261 |
| DENV1 2K | GQ868532 | DENV1 anC | FJ639806 | DENV1 anC | EU280167 | DENV1 anC | FJ687428 |
| DENV1 2K | EF025110 | DENV1 anC | GQ199837 | DENV1 anC | FJ850084 | DENV1 anC | EU660392 |
| DENV1 2K | GQ868528 | DENV1 anC | AB189120 | DENV1 anC | EU482514 | DENV1 anC | GQ199815 |
| DENV1 2K | GU131694 | DENV1 anC | EU081235 | DENV1 anC | AY722802 | DENV1 anC | EU482611 |
| DENV1 2K | EU482489 | DENV1 anC | FJ410263 | DENV1 anC | FJ639808 | DENV1 anC | FJ639821 |
| DENV1 2K | FJ850068 | DENV1 anC | AY713476 | DENV1 anC | EU482526 | DENV1 anC | FJ410174 |
| DENV1 2K | FJ898400 | DENV1 anC | GQ199806 | DENV1 anC | AY732476 | DENV1 anC | GU131706 |
| DENV1 2K | GU131968 | DENV1 anC | GU131693 | DENV1 anC | GU131772 | DENV1 anC | AY373427 |
| DENV1 2K | GQ868615 | DENV1 anC | GU131753 | DENV1 anC | FJ882530 | DENV1 anC | EU249495 |
| DENV1 2K | FJ882567 | DENV1 anC | GU131711 | DENV1 anC | GU131978 | DENV1 anC | EU482477 |
| DENV1 2K | DQ672558 | DENV1 anC | FJ639812 | DENV1 anC | AY277659 | DENV1 anC | EU482826 |
| DENV1 2K | EU677151 | DENV1 anC | GU131765 | DENV1 anC | FJ547088 | DENV1 anC | GQ199843 |
| DENV1 2K | AB204803 | DENV1 anC | FJ432744 | DENV1 anC | FJ898374 | DENV1 anC | GQ199821 |
| DENV1 2K | FJ182018 | DENV1 anC | GM059691 | DENV1 anC | GQ868504 | DENV1 anC | GU131777 |
| DENV1 2K | EU482809 | DENV1 anC | FJ410278 | DENV1 anC | FJ882550 | DENV1 anC | FJ898378 |
| DENV1 2K | FJ687433 | DENV1 anC | EU081261 | DENV1 anC | FJ850113 | DENV1 anC | FJ461306 |
| DENV1 2K | FJ410277 | DENV1 anC | EU482801 | DENV1 anC | GU131980 | DENV1 anC | GU131707 |
| DENV1 2K | GQ868502 | DENV1 anC | FJ882526 | DENV1 anC | GU131783 | DENV1 anC | AF226686 |
| DENV1 2K | FJ461310 | DENV1 anC | FJ639823 | DENV1 anC | AY732474 | DENV1 anC | EU677152 |
| DENV1 2K | FJ898375 | DENV1 anC | EU081260 | DENV1 anC | GU131958 | DENV1 anC | GU131828 |
| DENV1 2K | AY858983 | DENV1 anC | GQ199786 | DENV1 anC | FJ898393 | DENV1 anC | GU131971 |
| DENV1 2K | GU131835 | DENV1 anC | AY726550 | DENV1 anC | EU677176 | DENV1 anC | GQ199826 |
| DENV1 2K | FJ390386 | DENV1 anC | FJ882558 | DENV1 anC | FJ850104 | DENV1 anC | EU677168 |
| DENV1 2K | EU482518 | DENV1 anC | GU131809 | DENV1 anC | EU249492 | DENV1 anC | FJ461313 |
| DENV1 2K | FJ898414 | DENV1 anC | FJ182030 | DENV1 anC | EU482712 | DENV1 anC | EU081267 |
| DENV1 2K | EU482717 | DENV1 anC | EU482816 | DENV1 anC | FJ410236 | DENV1 anC | FJ410175 |

FIG. 66-8

| Virus Protein Accession No. | Virus Protein Accession No. | Virus Protein Accession No. | Virus Protein Accession No. |
|---|---|---|---|
| DENV1 anC FJ182028 | DENV1 anC GU131700 | DENV1 anC FJ898404 | DENV1 anC FJ410181 |
| DENV1 anC FJ882516 | DENV1 anC GQ868523 | DENV1 anC EU081244 | DENV1 anC FJ461332 |
| DENV1 anC FJ024456 | DENV1 anC GQ868522 | DENV1 anC EU482522 | DENV1 anC GQ199777 |
| DENV1 anC AF311956 | DENV1 anC EU660402 | DENV1 anC FJ205882 | DENV1 anC EU081229 |
| DENV1 anC GU131770 | DENV1 anC FJ639676 | DENV1 anC GU131788 | DENV1 anC FJ410270 |
| DENV1 anC AY277663 | DENV1 anC FJ410272 | DENV1 anC GU131762 | DENV1 anC GQ199873 |
| DENV1 anC GU131824 | DENV1 anC AY277665 | DENV1 anC FJ410238 | DENV1 anC M23027 |
| DENV1 anC GQ199854 | DENV1 anC GQ199802 | DENV1 anC DQ285558 | DENV1 anC FJ024451 |
| DENV1 anC FJ898410 | DENV1 anC FJ882549 | DENV1 anC FJ898371 | DENV1 anC GU131739 |
| DENV1 anC FJ024472 | DENV1 anC FJ898391 | DENV1 anC FJ461308 | DENV1 anC EU482482 |
| DENV1 anC EU081236 | DENV1 anC GQ199830 | DENV1 anC EU482711 | DENV1 anC FJ024482 |
| DENV1 anC EU482480 | DENV1 anC DQ672562 | DENV1 anC GQ868605 | DENV1 anC GU131698 |
| DENV1 anC GU131795 | DENV1 anC GU131757 | DENV1 anC GQ868565 | DENV1 anC FJ024432 |
| DENV1 anC FJ432736 | DENV1 anC GQ199839 | DENV1 anC GQ868608 | DENV1 anC FJ882556 |
| DENV1 anC FJ024480 | DENV1 anC FJ898437 | DENV1 anC FJ898417 | DENV1 anC GU131831 |
| DENV1 anC EU081278 | DENV1 anC EU081250 | DENV1 anC FJ024426 | DENV1 anC AY835999 |
| DENV1 anC FJ182019 | DENV1 anC GU131963 | DENV1 anC GQ868511 | DENV1 anC GU131922 |
| DENV1 anC GU131919 | DENV1 anC FJ410257 | DENV1 anC FJ882562 | DENV1 anC FJ898376 |
| DENV1 anC GU131682 | DENV1 anC GU131798 | DENV1 anC GU131752 | DENV1 anC FJ898425 |
| DENV1 anC EU482714 | DENV1 anC GQ868508 | DENV1 anC S64849 | DENV1 anC FJ898419 |
| DENV1 anC FJ410197 | DENV1 anC EU482789 | DENV1 anC GQ199811 | DENV1 anC GQ199799 |
| DENV1 anC GU131744 | DENV1 anC U88536 | DENV1 anC GQ868518 | DENV1 anC GU056029 |
| DENV1 anC FJ410183 | DENV1 anC GU131807 | DENV1 anC FJ850075 | DENV1 anC AY145122 |
| DENV1 anC GQ199875 | DENV1 anC GQ868533 | DENV1 anC FJ850100 | DENV1 anC GU131811 |
| DENV1 anC GQ199845 | DENV1 anC FJ898390 | DENV1 anC GU131709 | DENV1 anC EU482495 |
| DENV1 anC GU131689 | DENV1 anC EU081259 | DENV1 anC GQ199848 | DENV1 anC GQ868506 |
| DENV1 anC FJ461323 | DENV1 anC EU482806 | DENV1 anC FJ024429 | DENV1 anC GU131961 |
| DENV1 anC FJ432740 | DENV1 anC FJ373298 | DENV1 anC FJ461315 | DENV1 anC FJ410269 |
| DENV1 anC AY713474 | DENV1 anC FJ898382 | DENV1 anC EU677154 | DENV1 anC GQ199833 |
| DENV1 anC GQ199789 | DENV1 anC FJ410250 | DENV1 anC GU056033 | DENV1 anC EU081238 |
| DENV1 anC GU131977 | DENV1 anC FJ410226 | DENV1 anC FN429890 | DENV1 anC GU131748 |
| DENV1 anC FJ850069 | DENV1 anC GU131785 | DENV1 anC EU482822 | DENV1 anC FJ410248 |
| DENV1 anC EF457905 | DENV1 anC GU131842 | DENV1 anC GU131746 | DENV1 anC GU131733 |
| DENV1 anC FJ898421 | DENV1 anC GU131836 | DENV1 anC FJ390382 | DENV1 anC FJ461325 |
| DENV1 anC FJ744701 | DENV1 anC GQ199824 | DENV1 anC GU131724 | DENV1 anC GQ199817 |
| DENV1 anC GQ199788 | DENV1 anC AY277657 | DENV1 anC EU677161 | DENV1 anC GU131691 |
| DENV1 anC EU726778 | DENV1 anC EU482790 | DENV1 anC EU482536 | DENV1 anC GU131804 |
| DENV1 anC EU081263 | DENV1 anC EU081257 | DENV1 anC GU131713 | DENV1 anC FJ562106 |
| DENV1 anC FJ205874 | DENV1 anC FJ024449 | DENV1 anC GU131721 | DENV1 anC FJ639682 |
| DENV1 anC GU131826 | DENV1 anC FJ024430 | DENV1 anC EU660397 | DENV1 anC GU131792 |
| DENV1 anC FJ898407 | DENV1 anC EU482815 | DENV1 anC FJ906965 | DENV1 anC FJ882522 |
| DENV1 anC GQ199804 | DENV1 anC FJ898398 | DENV1 anC EU081280 | DENV1 anC GU131742 |
| DENV1 anC FJ024478 | DENV1 anC EU482530 | DENV1 anC FJ639692 | DENV1 anC GU131761 |
| DENV1 anC FJ850102 | DENV1 anC GQ868636 | DENV1 anC EU249494 | DENV1 anC GQ868561 |
| DENV1 anC FJ432721 | DENV1 anC FJ024459 | DENV1 anC FJ639819 | DENV1 anC FJ410245 |
| DENV1 anC EU660418 | DENV1 anC GQ868610 | DENV1 anC EU482529 | DENV1 anC GQ868520 |
| DENV1 anC EF032590 | DENV1 anC EU081233 | DENV1 anC EU482616 | DENV1 anC EU482707 |
| DENV1 anC AY713473 | DENV1 anC FJ687426 | DENV1 anC FJ410284 | DENV1 anC EU482520 |

FIG. 66-9

| Virus Protein Accession No. | Virus Protein Accession No. | Virus Protein Accession No. | Virus Protein Accession No. |
|---|---|---|---|
| DENV1 anC FJ882536 | DENV1 anC FJ410264 | DENV1 anC GU131891 | DENV1 anC GQ199792 |
| DENV1 anC EU081248 | DENV1 anC EU482516 | DENV1 anC EU660403 | DENV1 anC GU131888 |
| DENV1 anC GQ868531 | DENV1 anC FJ469907 | DENV1 anC FJ410275 | DENV1 anC GU131704 |
| DENV1 anC EU482533 | DENV1 anC FJ898396 | DENV1 anC GQ868559 | DENV1 anC GQ199850 |
| DENV1 anC FJ898411 | DENV1 anC EU677157 | DENV1 anC AF298808 | DENV1 anC GQ868526 |
| DENV1 anC GQ199796 | DENV1 anC EU482510 | DENV1 anC FJ410218 | DENV1 anC GU131695 |
| DENV1 anC GU131818 | DENV1 anC FJ182034 | DENV1 anC GQ199775 | DENV1 anC FJ410243 |
| DENV1 anC EU081239 | DENV1 anC FJ898377 | DENV1 anC FJ882552 | DENV1 anC AF309641 |
| DENV1 anC EU081255 | DENV1 anC EU660390 | DENV1 anC FJ898402 | DENV1 anC FJ639686 |
| DENV1 anC EU359008 | DENV1 anC GU131718 | DENV1 anC GQ199859 | DENV1 anC FJ410255 |
| DENV1 anC FJ906964 | DENV1 anC GQ868513 | DENV1 anC FJ410196 | DENV1 anC EU482818 |
| DENV1 anC EU482618 | DENV1 anC FJ639740 | DENV1 anC FJ639690 | DENV1 anC GU131685 |
| DENV1 anC FJ410246 | DENV1 anC FJ882533 | DENV1 anC FJ898383 | DENV1 anC GU131793 |
| DENV1 anC GQ868534 | DENV1 anC GU131926 | DENV1 anC GU131984 | DENV1 anC FN429882 |
| DENV1 anC GQ199835 | DENV1 anC GU131734 | DENV1 anC GQ868498 | DENV1 anC EU482509 |
| DENV1 anC GU131716 | DENV1 anC EU482519 | DENV1 anC EU482487 | DENV1 anC FJ547086 |
| DENV1 anC FJ410256 | DENV1 anC AY206457 | DENV1 anC FJ639818 | DENV1 anC FJ639694 |
| DENV1 anC FJ898424 | DENV1 anC GQ199818 | DENV1 anC EU677166 | DENV1 anC EU482491 |
| DENV1 anC GU131687 | DENV1 anC FJ850077 | DENV1 anC GU131758 | DENV1 anC GU131755 |
| DENV1 anC EU482615 | DENV1 anC AY726553 | DENV1 anC GU131697 | DENV1 anC FJ898430 |
| DENV1 anC FJ410285 | DENV1 anC EU482718 | DENV1 anC EU081247 | DENV1 anC FJ898428 |
| DENV1 anC D00503 | DENV1 anC EU081274 | DENV1 anC AY376738 | DENV1 anC FJ639814 |
| DENV1 anC FJ898388 | DENV1 anC FJ182025 | DENV1 anC D00501 | DENV1 anC GU131763 |
| DENV1 anC GQ868529 | DENV1 anC GU131973 | DENV1 anC GU131776 | DENV1 anC FJ873814 |
| DENV1 anC FJ882579 | DENV1 anC EU482811 | DENV1 anC FJ390380 | DENV1 anC FJ850093 |
| DENV1 anC FJ024442 | DENV1 anC FJ410210 | DENV1 anC FJ882547 | DENV1 anC GU131728 |
| DENV1 anC GQ868563 | DENV1 anC GU131925 | DENV1 anC GQ868611 | DENV1 anC FJ898372 |
| DENV1 anC FJ639743 | DENV1 anC FJ373297 | DENV1 anC FJ410231 | DENV1 anC EU677172 |
| DENV1 anC FJ390378 | DENV1 anC FJ205875 | DENV1 anC GU131680 | DENV1 anC FJ639794 |
| DENV1 anC GU131837 | DENV1 anC DQ193572 | DENV1 anC M87512 | DENV1 anC GQ868527 |
| DENV1 anC FJ432732 | DENV1 anC U88535 | DENV1 anC FJ024440 | DENV1 anC FJ687430 |
| DENV1 anC GU131840 | DENV1 anC FJ882564 | DENV1 anC GU131774 | DENV1 anC FJ639672 |
| DENV1 anC EU677174 | DENV1 anC GQ199774 | DENV1 anC DQ672560 | DENV1 anC FJ410189 |
| DENV1 anC FJ639680 | DENV1 anC GQ199787 | DENV1 anC GQ868512 | DENV1 anC FJ182023 |
| DENV1 anC GQ199849 | DENV1 anC FJ850099 | DENV1 anC FJ024463 | DENV1 anC FJ410260 |
| DENV1 anC FJ882566 | DENV1 anC FJ410267 | DENV1 anC EF122231 | DENV1 anC EU081266 |
| DENV1 anC FJ882541 | DENV1 anC EU726777 | DENV1 anC GQ199810 | DENV1 anC GU131895 |
| DENV1 anC FJ639802 | DENV1 anC EU081241 | DENV1 anC FJ850081 | DENV1 anC GU131829 |
| DENV1 anC FJ432725 | DENV1 anC FJ898381 | DENV1 anC FJ024427 | DENV1 anC FJ410204 |
| DENV1 anC FN429888 | DENV1 anC CS477265 | DENV1 anC GQ868637 | DENV1 anC FJ410194 |
| DENV1 anC EU482492 | DENV1 anC GQ199780 | DENV1 anC FJ639796 | DENV1 anC FJ882528 |
| DENV1 anC FJ882557 | DENV1 anC FN429889 | DENV1 anC EU677159 | DENV1 anC FJ432730 |
| DENV1 anC AY277660 | DENV1 anC FJ024434 | DENV1 anC FJ882519 | DENV1 anC EU081230 |
| DENV1 anC FJ639669 | DENV1 anC FJ024483 | DENV1 anC GQ199825 | DENV1 anC FJ410206 |
| DENV1 anC AY277655 | DENV1 anC EU482502 | DENV1 anC EU482525 | DENV1 anC GU131969 |
| DENV1 anC EU482792 | DENV1 anC GU131962 | DENV1 anC EU482798 | DENV1 anC AY732478 |
| DENV1 anC FJ461340 | DENV1 anC FJ461339 | DENV1 anC FJ182032 | DENV1 anC FJ461330 |
| DENV1 anC GU131805 | DENV1 anC EU482821 | DENV1 anC GU131769 | DENV1 anC DQ672556 |

FIG. 66-10

| Virus Protein Accession No. | Virus Protein Accession No. | Virus Protein Accession No. | Virus Protein Accession No. |
|---|---|---|---|
| DENV1 anC GU131976 | DENV1 anC FJ410232 | DENV1 anC GQ868601 | DENV1 anC EU482800 |
| DENV1 anC FJ410216 | DENV1 anC EU482481 | DENV1 anC FJ182003 | DENV1 anC AY277653 |
| DENV1 anC GQ199801 | DENV1 anC AY726551 | DENV1 anC FJ410286 | DENV1 anC GU131745 |
| DENV1 anC FJ906728 | DENV1 anC FJ639811 | DENV1 anC FJ639684 | DENV1 anC FJ410184 |
| DENV1 anC GU131803 | DENV1 anC GU131800 | DENV1 anC EU482794 | DENV1 anC GQ199778 |
| DENV1 anC AY726555 | DENV1 anC FJ024425 | DENV1 anC AY722801 | DENV1 anC FJ390383 |
| DENV1 anC GQ199798 | DENV1 anC EU482527 | DENV1 anC FJ410199 | DENV1 anC FJ410203 |
| DENV1 anC GU056030 | DENV1 anC EU482500 | DENV1 anC EU482485 | DENV1 anC EU482476 |
| DENV1 anC GU131816 | DENV1 anC EU482828 | DENV1 anC EU482803 | DENV1 anC AY145123 |
| DENV1 anC EU482512 | DENV1 anC FJ205873 | DENV1 anC GU131767 | DENV1 anC EU081270 |
| DENV1 anC FJ882568 | DENV1 anC AY732481 | DENV1 anC AY726549 | DENV1 anC GQ199872 |
| DENV1 anC FJ898413 | DENV1 anC GQ199782 | DENV1 anC FJ176779 | DENV1 anC GQ199856 |
| DENV1 anC EU596504 | DENV1 anC EU677150 | DENV1 anC FJ461335 | DENV1 anC AY277662 |
| DENV1 anC FJ410276 | DENV1 anC EU482591 | DENV1 anC FJ898408 | DENV1 anC EU482709 |
| DENV1 anC FJ898386 | DENV1 anC GU131738 | DENV1 anC GQ199844 | DENV1 anC GQ868618 |
| DENV1 anC EU482506 | DENV1 anC FJ024485 | DENV1 anC GU131970 | DENV1 anC GU131699 |
| DENV1 anC GU131736 | DENV1 anC EU677177 | DENV1 anC EU482796 | DENV1 anC FJ182029 |
| DENV1 anC GU131948 | DENV1 anC GU131967 | DENV1 anC EU596502 | DENV1 anC GQ199855 |
| DENV1 anC GU131834 | DENV1 anC GU131814 | DENV1 anC GQ868607 | DENV1 anC FJ882539 |
| DENV1 anC EU482715 | DENV1 anC AJ968413 | DENV1 anC GQ868524 | DENV1 anC FJ410180 |
| DENV1 anC EU482716 | DENV1 anC FJ024436 | DENV1 anC GQ868517 | DENV1 anC GU131806 |
| DENV1 anC FJ850087 | DENV1 anC FJ432746 | DENV1 anC EU081268 | DENV1 anC DQ672564 |
| DENV1 anC AF514883 | DENV1 anC FJ850071 | DENV1 anC GQ199827 | DENV1 anC FJ410268 |
| DENV1 anC EU660395 | DENV1 anC EU081271 | DENV1 anC EU660394 | DENV1 anC GU131825 |
| DENV1 anC FJ410262 | DENV1 anC AY708047 | DENV1 anC EU482610 | DENV1 anC FJ850101 |
| DENV1 anC EU081243 | DENV1 anC EU677169 | DENV1 anC EU179861 | DENV1 anC FJ182002 |
| DENV1 anC CS477264 | DENV1 anC AY277658 | DENV1 anC AB074761 | DENV1 anC GU131683 |
| DENV1 anC FJ562104 | DENV1 anC FJ882535 | DENV1 anC GQ199829 | DENV1 anC FJ639685 |
| DENV1 anC GQ199823 | DENV1 anC FJ547087 | DENV1 anC GU131863 | DENV1 anC EU482535 |
| DENV1 anC FJ639741 | DENV1 anC EU677164 | DENV1 anC GU131892 | DENV1 anC FJ024433 |
| DENV1 anC GU131690 | DENV1 anC GU131725 | DENV1 anC GQ868530 | DENV1 anC FJ176780 |
| DENV1 anC EU482497 | DENV1 anC DQ285561 | DENV1 anC FJ410173 | DENV1 anC FJ373305 |
| DENV1 anC GU370049 | DENV1 anC GU131678 | DENV1 anC EU482814 | DENV1 anC FJ410279 |
| DENV1 anC GQ868632 | DENV1 anC GU131822 | DENV1 anC EU660393 | DENV1 anC EU081279 |
| DENV1 anC GQ868613 | DENV1 anC EU482479 | DENV1 anC FJ639815 | DENV1 anC GU131756 |
| DENV1 anC GU131893 | DENV1 anC FJ882518 | DENV1 anC GU131979 | DENV1 anC FJ478457 |
| DENV1 anC EU687247 | DENV1 anC FJ639696 | DENV1 anC EU482827 | DENV1 anC FJ024457 |
| DENV1 anC EU482813 | DENV1 anC GQ199857 | DENV1 anC FJ461316 | DENV1 anC AB189121 |
| DENV1 anC AY713475 | DENV1 anC GQ199808 | DENV1 anC FJ882544 | DENV1 anC DQ285562 |
| DENV1 anC FJ024438 | DENV1 anC FJ432749 | DENV1 anC GU131768 | DENV1 anC FJ850103 |
| DENV1 anC FJ882542 | DENV1 anC GU131771 | DENV1 anC EU482567 | DENV1 anC EU482499 |
| DENV1 anC GU131982 | DENV1 anC GQ199772 | DENV1 anC GU131957 | DENV1 anC GQ199805 |
| DENV1 anC FJ461328 | DENV1 anC FJ882538 | DENV1 anC DQ672559 | DENV1 anC GQ868568 |
| DENV1 anC FJ687432 | DENV1 anC FJ410283 | DENV1 anC EU677153 | DENV1 anC FJ547068 |
| DENV1 anC FJ410188 | DENV1 anC FJ882521 | DENV1 anC AF226687 | DENV1 anC EU081234 |
| DENV1 anC GQ199813 | DENV1 anC EU726779 | DENV1 anC EU482825 | DENV1 anC FJ432739 |
| DENV1 anC GQ199847 | DENV1 anC EU081253 | DENV1 anC FJ182022 | DENV1 anC GQ199816 |
| DENV1 anC FJ410212 | DENV1 anC FN429886 | DENV1 anC EU482592 | DENV1 anC FJ898401 |

FIG. 66-11

| Virus Protein Accession No. | Virus Protein Accession No. | Virus Protein Accession No. | Virus Protein Accession No. |
|---|---|---|---|
| DENV1 anC GU131812 | DENV1 anC FJ410280 | DENV1 anC EU482540 | DENV1 anC EF440432 |
| DENV1 anC EU660419 | DENV1 anC FJ882548 | DENV1 anC X70952 | DENV1 anC FJ461324 |
| DENV1 anC GQ199831 | DENV1 anC FJ859029 | DENV1 anC GU131681 | DENV1 anC AF311958 |
| DENV1 anC AY732475 | DENV1 anC GU131781 | DENV1 anC EU081226 | DENV1 anC FJ639813 |
| DENV1 anC EU249491 | DENV1 anC FJ410252 | DENV1 anC FJ182020 | DENV1 anC AF180817 |
| DENV1 anC GU131833 | DENV1 anC EU081262 | DENV1 anC AY277654 | DENV1 anC EU081277 |
| DENV1 anC GQ199836 | DENV1 anC GQ199842 | DENV1 anC FJ882524 | DENV1 anC FJ898426 |
| DENV1 anC FJ410240 | DENV1 anC EU726782 | DENV1 anC EU677139 | DENV1 anC GU131729 |
| DENV1 anC FJ410225 | DENV1 anC GQ868537 | DENV1 anC GU131920 | DENV1 anC GQ868539 |
| DENV1 anC GU131732 | DENV1 anC GQ199797 | DENV1 anC GQ868536 | DENV1 anC AY145121 |
| DENV1 anC FJ639677 | DENV1 anC FJ882515 | DENV1 anC GQ199776 | DENV1 anC EU677167 |
| DENV1 anC FJ810419 | DENV1 anC FJ024450 | DENV1 anC FJ390381 | DENV1 anC FJ898422 |
| DENV1 anC GU056032 | DENV1 anC GU131723 | DENV1 anC GU131751 | DENV1 anC FJ744702 |
| DENV1 anC FJ390374 | DENV1 anC GQ868503 | DENV1 anC FJ390388 | DENV1 anC GQ199838 |
| DENV1 anC FJ882527 | DENV1 anC FJ882551 | DENV1 anC EU482823 | DENV1 anC GQ199779 |
| DENV1 anC GU131830 | DENV1 anC FJ461318 | DENV1 anC FJ850073 | DENV1 anC FJ205883 |
| DENV1 anC EU482791 | DENV1 anC FJ898418 | DENV1 anC EU081237 | DENV1 anC GQ868635 |
| DENV1 anC FJ898427 | DENV1 anC GQ199820 | DENV1 anC EU482483 | DENV1 anC DQ285560 |
| DENV1 anC FJ410234 | DENV1 anC AF513110 | DENV1 anC GQ199853 | DENV1 anC FJ410239 |
| DENV1 anC EU482494 | DENV1 anC FJ410191 | DENV1 anC GU131921 | DENV1 anC FJ882554 |
| DENV1 anC FJ432720 | DENV1 anC FJ024431 | DENV1 anC FJ182031 | DENV1 anC GU131747 |
| DENV1 anC FJ639735 | DENV1 anC FJ898394 | DENV1 anC FJ639683 | DENV1 anC FJ024481 |
| DENV1 anC FJ898406 | DENV1 anC FJ024445 | DENV1 anC GU131740 | DENV1 anC FJ639675 |
| DENV1 anC DQ672563 | DENV1 anC EU081242 | DENV1 anC FJ562105 | DENV1 anC S75335 |
| DENV1 anC GQ199793 | DENV1 anC FJ461333 | DENV1 anC FJ432745 | DENV1 anC GU131810 |
| DENV1 anC EU482807 | DENV1 anC GQ868509 | DENV1 anC AY277664 | DENV1 anC FJ410249 |
| DENV1 anC GU131797 | DENV1 anC FJ410209 | DENV1 anC FJ882559 | DENV1 anC DQ672561 |
| DENV1 anC FJ410258 | DENV1 anC GU131839 | DENV1 anC FJ024435 | DENV1 anC FJ810415 |
| DENV1 anC EU482802 | DENV1 anC FJ410251 | DENV1 anC GQ199803 | DENV1 anC GQ199785 |
| DENV1 anC GQ868633 | DENV1 anC EU677175 | DENV1 anC FJ461320 | DENV1 anC FJ410220 |
| DENV1 anC AB074760 | DENV1 anC FJ639820 | DENV1 anC FJ850090 | DENV1 anC EU482504 |
| DENV1 anC EU081256 | DENV1 anC GQ199867 | DENV1 anC EU482528 | DENV1 anC FJ205881 |
| DENV1 anC FJ432735 | DENV1 anC FJ024428 | DENV1 anC FJ898448 | DENV1 anC EU081264 |
| DENV1 anC GQ199781 | DENV1 anC EU482537 | DENV1 anC FJ898420 | DENV1 anC GU131688 |
| DENV1 anC DQ285559 | DENV1 anC GU131778 | DENV1 anC GQ868519 | DENV1 anC A75711 |
| DENV1 anC FJ182036 | DENV1 anC FJ024464 | DENV1 anC FJ432727 | DENV1 anC EU081254 |
| DENV1 anC FJ547089 | DENV1 anC GU131972 | DENV1 anC EU677155 | DENV1 anC FJ898429 |
| DENV1 anC FJ898416 | DENV1 anC GQ868606 | DENV1 anC EU677162 | DENV1 anC FJ469908 |
| DENV1 anC GU131960 | DENV1 anC GU131679 | DENV1 anC GU131692 | DENV1 anC GU131799 |
| DENV1 anC GU131820 | DENV1 anC GU131708 | DENV1 anC EU596501 | DENV1 anC FJ182027 |
| DENV1 anC EU677170 | DENV1 anC EU687251 | DENV1 anC FJ410273 | DENV1 anC FJ432737 |
| DENV1 anC FJ882531 | DENV1 anC AF226685 | DENV1 anC FJ410182 | DENV1 anC FJ410201 |
| DENV1 anC AF514889 | DENV1 anC FJ882561 | DENV1 anC GQ199791 | DENV1 anC GU131701 |
| DENV1 anC EU863650 | DENV1 anC EU482488 | DENV1 anC GQ868630 | DENV1 anC EU081269 |
| DENV1 anC FB667403 | DENV1 anC FJ410214 | DENV1 anC EU482503 | DENV1 anC GQ199783 |
| DENV1 anC GU131714 | DENV1 anC FJ687429 | DENV1 anC FB730116 | DENV1 anC GU131754 |
| DENV1 anC AY277656 | DENV1 anC FJ898379 | DENV1 anC FJ410198 | DENV1 anC EU081251 |
| DENV1 anC FJ882569 | DENV1 anC GU131790 | DENV1 anC EU081276 | DENV1 anC FJ432733 |

FIG. 66-12

| Virus Protein Accession No. | Virus Protein Accession No. | Virus Protein Accession No. | Virus Protein Accession No. |
|---|---|---|---|
| DENV1 anC FJ024447 | DENV1 anC GQ199812 | DENV1 anC AY277666 | DENV1 anC GU131894 |
| DENV1 anC FJ547063 | DENV1 anC GU131737 | DENV1 anC GU131727 | DENV1 anC EU482490 |
| DENV1 anC EU482523 | DENV1 anC FJ547060 | DENV1 anC FJ024462 | DENV1 anC EU482521 |
| DENV1 anC EU482793 | DENV1 anC GQ199819 | DENV1 anC FJ024441 | DENV1 anC FJ898423 |
| DENV1 anC U88537 | DENV1 anC FJ024484 | DENV1 anC GQ199822 | DENV1 anC EU660396 |
| DENV1 anC FJ898399 | DENV1 anC GQ868500 | DENV1 anC FN429887 | DENV1 anC AF180818 |
| DENV1 anC GQ868609 | DENV1 anC EU249493 | DENV1 anC EU482539 | DENV1 anC AY726554 |
| DENV1 anC EU726780 | DENV1 anC EU081275 | DENV1 anC EU482804 | DENV1 anC FJ898403 |
| DENV1 anC EU482805 | DENV1 anC FJ432748 | DENV1 anC FJ882520 | DENV1 anC CS479203 |
| DENV1 anC GU131784 | DENV1 anC EU081228 | DENV1 anC FJ639689 | DENV1 anC EU482517 |
| DENV1 anC GU131827 | DENV1 anC EU482810 | DENV1 anC EU677140 | DENV1 anC EU482609 |
| DENV1 anC FJ410227 | DENV1 anC GQ199852 | DENV1 anC GQ199832 | DENV1 anC FJ410266 |
| DENV1 anC GQ868505 | DENV1 anC GU131923 | DENV1 anC FJ639695 | DENV1 anC EU482493 |
| DENV1 anC FN429884 | DENV1 anC GQ199790 | DENV1 anC FJ410244 | DENV1 anC FJ639674 |
| DENV1 anC FJ873809 | DENV1 anC FJ024423 | DENV1 anC FJ898397 | DENV1 anC FJ639673 |
| DENV1 anC EU081258 | DENV1 anC FJ882555 | DENV1 anC GU131819 | DENV1 anC AY732482 |
| DENV1 anC EU677173 | DENV1 anC FJ898405 | DENV1 anC GU131823 | DENV1 anC CS479204 |
| DENV1 anC FJ898392 | DENV1 anC GU131889 | DENV1 anC FJ882543 | DENV1 anC EU482819 |
| DENV1 anC FJ024448 | DENV1 anC GQ868499 | DENV1 anC GU131715 | DENV1 anC FJ882570 |
| DENV1 anC GQ868507 | DENV1 anC EU482501 | DENV1 anC EU677156 | DENV1 anC AF514885 |
| DENV1 anC EU482531 | DENV1 anC GU131775 | DENV1 anC FJ461317 | DENV1 anC GU131802 |
| DENV1 anC GQ868510 | DENV1 anC EU081246 | DENV1 anC GU131794 | DENV1 anC FJ687427 |
| DENV1 anC FJ410290 | DENV1 anC GQ199773 | DENV1 anC FJ461341 | DENV1 anC FJ182033 |
| DENV1 anC GU131981 | DENV1 anC FJ898431 | DENV1 anC EU482511 | DENV1 anC GQ199800 |
| DENV1 anC EU660391 | DENV1 anC EU081231 | DENV1 anC FJ024453 | DENV1 anC GU131702 |
| DENV1 anC EU482515 | DENV1 anC EU482486 | DENV1 anC GU131749 | DENV1 anC FJ432723 |
| DENV1 anC EU081232 | DENV1 anC FJ410187 | DENV1 anC FJ898389 | DENV1 anC EU482505 |
| DENV1 anC GQ199840 | DENV1 anC FN429881 | DENV1 anC GU131696 | DENV1 anC FJ882532 |
| DENV1 anC EU482710 | DENV1 anC GU131764 | DENV1 anC EU482508 | DENV1 anC AF514878 |
| DENV1 anC GQ868566 | DENV1 anC GQ868569 | DENV1 anC EU081265 | DENV1 anC FJ882540 |
| DENV1 anC GU131964 | DENV1 anC GQ868612 | DENV1 anC FJ410247 | DENV1 anC GU131703 |
| DENV1 anC EU482713 | DENV1 anC D00502 | DENV1 anC FJ461307 | DENV1 anC FJ410190 |
| DENV1 anC EU482538 | DENV1 anC FJ461331 | DENV1 anC GQ868560 | DENV1 anC GQ868564 |
| DENV1 anC EU081245 | DENV1 anC FJ410282 | DENV1 anC FJ461319 | DENV1 anC GU131717 |
| DENV1 anC GQ868619 | DENV1 anC FJ205872 | DENV1 anC FJ898412 | DENV1 anC EU081273 |
| DENV1 anC GU131789 | DENV1 anC GQ199809 | DENV1 anC GQ868521 | DENV1 anC GQ199846 |
| DENV1 anC AB178040 | DENV1 anC GU131722 | DENV1 anC GU131686 | DENV1 anC AY732483 |
| DENV1 anC AY732480 | DENV1 anC FJ873810 | DENV1 anC AY732479 | DENV1 anC CS477263 |
| DENV1 anC FJ898385 | DENV1 anC FJ882546 | DENV1 anC FJ384655 | DENV1 anC EU482496 |
| DENV1 anC FJ639688 | DENV1 anC FJ639797 | DENV1 anC FJ882537 | DENV1 anC FJ410265 |
| DENV1 anC FJ205884 | DENV1 anC EU677160 | DENV1 anC FJ898373 | DENV1 anC GU131720 |
| DENV1 anC FJ898380 | DENV1 anC FJ461312 | DENV1 anC GU131710 | DENV1 anC AY277661 |
| DENV1 anC FJ182026 | DENV1 anC NC_001477 | DENV1 anC EU677171 | DENV1 anC FJ461327 |
| DENV1 anC AF311957 | DENV1 anC GQ199841 | DENV1 anC FJ024479 | DENV1 anC GU370048 |
| DENV1 anC FJ639693 | DENV1 anC FJ882534 | DENV1 anC FJ687431 | DENV1 anC FJ898409 |
| DENV1 anC GU131735 | DENV1 anC FJ410289 | DENV1 anC FJ882523 | DENV1 anC FJ182024 |
| DENV1 anC FJ850114 | DENV1 anC FJ410179 | DENV1 anC FJ547065 | DENV1 anC FJ882565 |
| DENV1 anC FJ882563 | DENV1 anC FJ432719 | DENV1 anC GU131791 | DENV1 anC GU131966 |

FIG. 66-13

| Virus | Protein | Accession No. | Virus | Protein | Accession No. | Virus | Protein | Accession No. | Virus | Protein | Accession No. |
|---|---|---|---|---|---|---|---|---|---|---|---|
| DENV1 | anC | EU249490 | DENV1 | anC | EU482795 | DENV1 | anC | FJ410207 | DENV1 | anC | EU482513 |
| DENV1 | anC | AF514876 | DENV1 | anC | FJ639678 | DENV1 | anC | EU726781 | DENV1 | anC | EU081240 |
| DENV1 | anC | FN429885 | DENV1 | anC | EU482617 | DENV1 | anC | FJ182035 | DENV1 | anC | AY277659 |
| DENV1 | anC | EU081272 | DENV1 | anC | FJ410287 | DENV1 | anC | FJ882545 | DENV1 | anC | AY373427 |
| DENV1 | anC | GU131841 | DENV1 | anC | FJ024444 | DENV1 | anC | FJ410222 | DENV1 | anC | AY277663 |
| DENV1 | anC | GQ868570 | DENV1 | anC | EU482799 | DENV1 | anC | EU660401 | DENV1 | anC | AY277657 |
| DENV1 | anC | GU131890 | DENV1 | anC | GU131750 | DENV1 | anC | FJ639824 | DENV1 | anC | S64849 |
| DENV1 | anC | FJ882553 | DENV1 | anC | FJ906963 | DENV1 | anC | AY762084 | DENV1 | anC | M23027 |
| DENV1 | anC | GU131821 | DENV1 | anC | FJ410185 | DENV1 | anC | GQ868602 | DENV1 | anC | D00503 |
| DENV1 | anC | GQ199771 | DENV1 | anC | EU660412 | DENV1 | anC | GQ868532 | DENV1 | anC | AY277660 |
| DENV1 | anC | AB195673 | DENV1 | anC | GU131779 | DENV1 | anC | EF025110 | DENV1 | anC | AY277655 |
| DENV1 | anC | EU482812 | DENV1 | anC | FJ639691 | DENV1 | anC | GQ868528 | DENV1 | anC | AY376738 |
| DENV1 | anC | AF298807 | DENV1 | anC | EU677165 | DENV1 | anC | GU131694 | DENV1 | anC | D00501 |
| DENV1 | anC | GU131801 | DENV1 | anC | GU131773 | DENV1 | anC | EU482489 | DENV1 | anC | AY277658 |
| DENV1 | anC | GU131983 | DENV1 | anC | FJ882517 | DENV1 | anC | FJ850068 | DENV1 | anC | EU179861 |
| DENV1 | anC | EF122232 | DENV1 | anC | FJ410230 | DENV1 | anC | FJ898400 | DENV1 | anC | AY277653 |
| DENV1 | anC | AB519681 | DENV1 | anC | FJ410211 | DENV1 | anC | GU131968 | DENV1 | anC | AY277662 |
| DENV1 | anC | GQ199814 | DENV1 | anC | FJ850070 | DENV1 | anC | GQ868615 | DENV1 | anC | AY277656 |
| DENV1 | anC | AY726552 | DENV1 | anC | FJ024460 | DENV1 | anC | FJ882567 | DENV1 | anC | X70952 |
| DENV1 | anC | DQ836632 | DENV1 | anC | GQ868562 | DENV1 | anC | DQ672558 | DENV1 | anC | AY277654 |
| DENV1 | anC | EU482484 | DENV1 | anC | FJ882529 | DENV1 | anC | EU677151 | DENV1 | anC | EF440432 |
| DENV1 | anC | AY722803 | DENV1 | anC | FJ639687 | DENV1 | anC | AB204803 | DENV1 | anC | S75335 |
| DENV1 | anC | GU131787 | DENV1 | anC | GU131684 | DENV1 | anC | FJ182018 | DENV1 | anC | D00502 |
| DENV1 | anC | FJ373296 | DENV1 | anC | FJ205876 | DENV1 | anC | EU482809 | DENV1 | anC | AY277661 |
| DENV1 | anC | GU131887 | DENV1 | anC | FJ410205 | DENV1 | anC | FJ687433 | DENV1 | anC | DQ836632 |
| DENV1 | anC | GU131741 | DENV1 | anC | FJ478458 | DENV1 | anC | AY277652 | DENV1 | anC | AY376737 |
| DENV1 | anC | EU677178 | DENV1 | anC | EU677158 | DENV1 | anC | FJ410277 | DENV1 | anC | AY277652 |
| DENV1 | anC | FJ898433 | DENV1 | anC | EU482532 | DENV1 | anC | GQ868502 | DENV1 | anC | AY858983 |
| DENV1 | anC | FJ024443 | DENV1 | anC | FJ410242 | DENV1 | anC | FJ461310 | DENV1 | anC | X70952 |
| DENV1 | anC | FJ461336 | DENV1 | anC | EU482619 | DENV1 | anC | FJ898375 | DENV1 | anC | X70952 |
| DENV1 | anC | GQ199858 | DENV1 | anC | FJ410235 | DENV1 | anC | AY858983 | DENV1 | anC | X70952 |
| DENV1 | anC | EU482820 | DENV1 | anC | FJ898395 | DENV1 | anC | GU131835 | DENV1 | anC | X70952 |
| DENV1 | anC | EU482478 | DENV1 | anC | GU131949 | DENV1 | anC | FJ390386 | DENV1 | anC | X70952 |
| DENV1 | anC | GU131815 | DENV1 | anC | AY732477 | DENV1 | anC | EU482518 | DENV1 | E | AY732448 |
| DENV1 | anC | GQ199834 | DENV1 | anC | EU596503 | DENV1 | anC | FJ898414 | DENV1 | E | EU117307 |
| DENV1 | anC | GU131743 | DENV1 | anC | GQ199851 | DENV1 | anC | EU482717 | DENV1 | E | FJ639670 |
| DENV1 | anC | GQ868614 | DENV1 | anC | GU131796 | DENV1 | anC | DQ672557 | DENV1 | E | FJ024446 |
| DENV1 | anC | EU482706 | DENV1 | anC | EU081252 | DENV1 | anC | GQ199877 | DENV1 | E | EU069612 |
| DENV1 | anC | AY376737 | DENV1 | anC | GU131712 | DENV1 | anC | GU131719 | DENV1 | E | GU131759 |
| DENV1 | anC | FJ562101 | DENV1 | anC | EU081249 | DENV1 | anC | EU482817 | DENV1 | E | FJ882560 |
| DENV1 | anC | FB667398 | DENV1 | anC | GU131730 | DENV1 | anC | FJ410254 | DENV1 | E | GU131838 |
| DENV1 | anC | GU131808 | DENV1 | anC | GQ199795 | DENV1 | anC | EU482507 | DENV1 | E | FJ024437 |
| DENV1 | anC | GU131780 | DENV1 | anC | GQ199807 | DENV1 | anC | FJ410274 | DENV1 | E | DQ265068 |
| DENV1 | anC | FJ639671 | DENV1 | anC | GU131817 | DENV1 | anC | FJ898387 | DENV1 | E | GQ868639 |
| DENV1 | anC | FJ390379 | DENV1 | anC | FJ024455 | DENV1 | anC | GQ868514 | DENV1 | E | FJ639806 |
| DENV1 | anC | FJ024439 | DENV1 | anC | GU131766 | DENV1 | anC | GU131705 | DENV1 | E | EU069617 |
| DENV1 | anC | AF350498 | DENV1 | anC | GU056031 | DENV1 | anC | FJ432738 | DENV1 | E | DQ265031 |
| DENV1 | anC | FJ432747 | DENV1 | anC | GU131786 | DENV1 | anC | FJ639681 | DENV1 | E | GQ199837 |

FIG. 66-14

| Virus | Protein | Accession No. | Virus | Protein | Accession No. | Virus | Protein | Accession No. | Virus | Protein | Accession No. |
|---|---|---|---|---|---|---|---|---|---|---|---|
| DENV1 | E | AF425610 | DENV1 | E | GQ868535 | DENV1 | E | FJ410236 | DENV1 | E | AY422784 |
| DENV1 | E | AB189120 | DENV1 | E | EU482524 | DENV1 | E | DQ265041 | DENV1 | E | EU482477 |
| DENV1 | E | EU448396 | DENV1 | E | GU131726 | DENV1 | E | FJ410192 | DENV1 | E | EU069605 |
| DENV1 | E | AY732421 | DENV1 | E | GQ868501 | DENV1 | E | EU081281 | DENV1 | E | EU482826 |
| DENV1 | E | EU069604 | DENV1 | E | FJ432734 | DENV1 | E | DQ091258 | DENV1 | E | DQ264871 |
| DENV1 | E | EU081235 | DENV1 | E | AF425637 | DENV1 | E | AM746216 | DENV1 | E | DQ285549 |
| DENV1 | E | FJ410263 | DENV1 | E | FJ410253 | DENV1 | E | FJ432729 | DENV1 | E | EF113152 |
| DENV1 | E | EU069613 | DENV1 | E | FJ410281 | DENV1 | E | AY732466 | DENV1 | E | GQ199843 |
| DENV1 | E | AY713476 | DENV1 | E | DQ265026 | DENV1 | E | GQ868525 | DENV1 | E | GQ199821 |
| DENV1 | E | GQ199806 | DENV1 | E | EU482708 | DENV1 | E | FN429883 | DENV1 | E | GU131777 |
| DENV1 | E | GU131693 | DENV1 | E | GQ199784 | DENV1 | E | GQ199828 | DENV1 | E | FJ898378 |
| DENV1 | E | EF508201 | DENV1 | E | GQ868567 | DENV1 | E | FJ182021 | DENV1 | E | FJ461306 |
| DENV1 | E | GU131753 | DENV1 | E | EU280167 | DENV1 | E | EU482824 | DENV1 | E | DQ091261 |
| DENV1 | E | GU131711 | DENV1 | E | FJ850084 | DENV1 | E | DQ265070 | DENV1 | E | GU131707 |
| DENV1 | E | FJ639812 | DENV1 | E | EU482514 | DENV1 | E | GU131956 | DENV1 | E | AF226686 |
| DENV1 | E | GU131765 | DENV1 | E | AY732411 | DENV1 | E | EU482797 | DENV1 | E | EU677152 |
| DENV1 | E | FJ432744 | DENV1 | E | AY722802 | DENV1 | E | FJ410213 | DENV1 | E | GU131828 |
| DENV1 | E | GM059691 | DENV1 | E | AB111077 | DENV1 | E | FJ898384 | DENV1 | E | GU131971 |
| DENV1 | E | FJ410278 | DENV1 | E | FJ639808 | DENV1 | E | FJ410186 | DENV1 | E | GQ199826 |
| DENV1 | E | EU081261 | DENV1 | E | EU482526 | DENV1 | E | GQ868538 | DENV1 | E | EU677168 |
| DENV1 | E | DQ265060 | DENV1 | E | AY732476 | DENV1 | E | EU069607 | DENV1 | E | DQ265051 |
| DENV1 | E | EU482801 | DENV1 | E | AM746220 | DENV1 | E | EU677163 | DENV1 | E | AY732460 |
| DENV1 | E | FJ882526 | DENV1 | E | DQ091270 | DENV1 | E | FJ432742 | DENV1 | E | FJ461313 |
| DENV1 | E | FJ639823 | DENV1 | E | AY732435 | DENV1 | E | FJ461303 | DENV1 | E | EU081267 |
| DENV1 | E | EU081260 | DENV1 | E | GU131772 | DENV1 | E | FJ639679 | DENV1 | E | AY732458 |
| DENV1 | E | AB111070 | DENV1 | E | FJ882530 | DENV1 | E | FJ469909 | DENV1 | E | DQ265123 |
| DENV1 | E | GQ199786 | DENV1 | E | AY588273 | DENV1 | E | AY732459 | DENV1 | E | DQ264914 |
| DENV1 | E | AY726550 | DENV1 | E | GU131978 | DENV1 | E | EU081227 | DENV1 | E | FJ410175 |
| DENV1 | E | FJ882558 | DENV1 | E | AY277659 | DENV1 | E | DQ265035 | DENV1 | E | AY732441 |
| DENV1 | E | GU131809 | DENV1 | E | FJ547088 | DENV1 | E | EU482534 | DENV1 | E | DQ265004 |
| DENV1 | E | FJ182030 | DENV1 | E | FJ898374 | DENV1 | E | FJ410261 | DENV1 | E | FJ182028 |
| DENV1 | E | EU482816 | DENV1 | E | DQ264897 | DENV1 | E | FJ687428 | DENV1 | E | FJ882516 |
| DENV1 | E | GU131813 | DENV1 | E | DQ264874 | DENV1 | E | EU660392 | DENV1 | E | FJ024456 |
| DENV1 | E | EU482808 | DENV1 | E | DQ265074 | DENV1 | E | DQ264924 | DENV1 | E | AF311956 |
| DENV1 | E | EU482498 | DENV1 | E | GQ868504 | DENV1 | E | DQ265081 | DENV1 | E | GU131770 |
| DENV1 | E | AY732428 | DENV1 | E | FJ882550 | DENV1 | E | AY732387 | DENV1 | E | AY732402 |
| DENV1 | E | FJ882525 | DENV1 | E | FJ850113 | DENV1 | E | GQ199815 | DENV1 | E | AY277663 |
| DENV1 | E | EU448409 | DENV1 | E | GU131980 | DENV1 | E | EU482611 | DENV1 | E | DQ265048 |
| DENV1 | E | GU131731 | DENV1 | E | GU131783 | DENV1 | E | FJ639821 | DENV1 | E | GU131824 |
| DENV1 | E | GQ199794 | DENV1 | E | AY732474 | DENV1 | E | FJ410174 | DENV1 | E | GQ199854 |
| DENV1 | E | EU448411 | DENV1 | E | AY732469 | DENV1 | E | FJ687475 | DENV1 | E | FJ898410 |
| DENV1 | E | GU131832 | DENV1 | E | AY618210 | DENV1 | E | GU131706 | DENV1 | E | FJ024472 |
| DENV1 | E | EU848545 | DENV1 | E | GU131958 | DENV1 | E | AY373427 | DENV1 | E | EU081236 |
| DENV1 | E | GU131760 | DENV1 | E | FJ898393 | DENV1 | E | AY732452 | DENV1 | E | DQ265138 |
| DENV1 | E | GU131965 | DENV1 | E | EU677176 | DENV1 | E | AB111067 | DENV1 | E | EU482480 |
| DENV1 | E | FJ898415 | DENV1 | E | FJ850104 | DENV1 | E | DQ265023 | DENV1 | E | GU131795 |
| DENV1 | E | GU131782 | DENV1 | E | EU249492 | DENV1 | E | EU249495 | DENV1 | E | DQ264939 |
| DENV1 | E | AY422782 | DENV1 | E | EU482712 | DENV1 | E | DQ264980 | DENV1 | E | DQ265147 |

FIG. 66-15

| Virus Protein | Accession No. | Virus Protein | Accession No. | Virus Protein | Accession No. | Virus Protein | Accession No. |
|---|---|---|---|---|---|---|---|
| DENV1 E | FJ432736 | DENV1 E | AB111072 | DENV1 E | EU482790 | DENV1 E | FJ850100 |
| DENV1 E | FJ024480 | DENV1 E | FJ639676 | DENV1 E | EU081257 | DENV1 E | GU131709 |
| DENV1 E | EU081278 | DENV1 E | FJ410272 | DENV1 E | DQ265065 | DENV1 E | GQ199848 |
| DENV1 E | FJ182019 | DENV1 E | AY277665 | DENV1 E | EU069615 | DENV1 E | FJ024429 |
| DENV1 E | GU131919 | DENV1 E | GQ199802 | DENV1 E | FJ024449 | DENV1 E | FJ461315 |
| DENV1 E | AY422777 | DENV1 E | AY732388 | DENV1 E | FJ024430 | DENV1 E | DQ341193 |
| DENV1 E | GU131682 | DENV1 E | AY732472 | DENV1 E | EU482815 | DENV1 E | AM746212 |
| DENV1 E | EU448408 | DENV1 E | FJ882549 | DENV1 E | FJ898398 | DENV1 E | DQ264884 |
| DENV1 E | EU482714 | DENV1 E | AF425616 | DENV1 E | EU482530 | DENV1 E | EU677154 |
| DENV1 E | FJ410197 | DENV1 E | FJ898391 | DENV1 E | GQ868636 | DENV1 E | GU056033 |
| DENV1 E | GU131744 | DENV1 E | EU448394 | DENV1 E | FJ024459 | DENV1 E | AM746219 |
| DENV1 E | FJ410183 | DENV1 E | GQ199830 | DENV1 E | DQ265087 | DENV1 E | FN429890 |
| DENV1 E | GQ199875 | DENV1 E | EU117309 | DENV1 E | GQ868610 | DENV1 E | EU482822 |
| DENV1 E | GQ199845 | DENV1 E | DQ672562 | DENV1 E | EU081233 | DENV1 E | AY732391 |
| DENV1 E | GU131689 | DENV1 E | GU131757 | DENV1 E | AF425635 | DENV1 E | GU131746 |
| DENV1 E | DQ265095 | DENV1 E | EF654105 | DENV1 E | FJ687426 | DENV1 E | FJ390382 |
| DENV1 E | FJ461323 | DENV1 E | DQ264899 | DENV1 E | FJ898404 | DENV1 E | GU131724 |
| DENV1 E | FJ432740 | DENV1 E | GQ199839 | DENV1 E | EU081244 | DENV1 E | EU677161 |
| DENV1 E | AY713474 | DENV1 E | FJ898437 | DENV1 E | EU482522 | DENV1 E | AB111069 |
| DENV1 E | DQ265148 | DENV1 E | EU081250 | DENV1 E | FJ205882 | DENV1 E | EU482536 |
| DENV1 E | GQ199789 | DENV1 E | GU131963 | DENV1 E | GU131788 | DENV1 E | GU131713 |
| DENV1 E | GU131977 | DENV1 E | FJ410257 | DENV1 E | GU131762 | DENV1 E | GU131721 |
| DENV1 E | FJ850069 | DENV1 E | AY620952 | DENV1 E | EU448402 | DENV1 E | EU660397 |
| DENV1 E | EF457905 | DENV1 E | GU131798 | DENV1 E | FJ410238 | DENV1 E | FJ906965 |
| DENV1 E | FJ898421 | DENV1 E | AY620947 | DENV1 E | DQ285558 | DENV1 E | EU081280 |
| DENV1 E | FJ744701 | DENV1 E | EU448391 | DENV1 E | FJ898371 | DENV1 E | FJ639692 |
| DENV1 E | GQ199788 | DENV1 E | GQ868508 | DENV1 E | AY732383 | DENV1 E | EU249494 |
| DENV1 E | EU726778 | DENV1 E | EU482789 | DENV1 E | FJ461308 | DENV1 E | EU448406 |
| DENV1 E | AF425626 | DENV1 E | AY589692 | DENV1 E | EU482711 | DENV1 E | FJ639819 |
| DENV1 E | EU081263 | DENV1 E | U88536 | DENV1 E | AY871812 | DENV1 E | EU482529 |
| DENV1 E | FJ205874 | DENV1 E | GU131807 | DENV1 E | AJ438941 | DENV1 E | DQ264937 |
| DENV1 E | GU131826 | DENV1 E | GQ868533 | DENV1 E | GQ868605 | DENV1 E | EU482616 |
| DENV1 E | FJ898407 | DENV1 E | FJ898390 | DENV1 E | DQ264960 | DENV1 E | EU448412 |
| DENV1 E | GQ199804 | DENV1 E | EU081259 | DENV1 E | AY732396 | DENV1 E | AY732464 |
| DENV1 E | FJ024478 | DENV1 E | EU482806 | DENV1 E | GQ868565 | DENV1 E | FJ410284 |
| DENV1 E | FJ850102 | DENV1 E | FJ373298 | DENV1 E | AM746214 | DENV1 E | FJ410181 |
| DENV1 E | FJ432721 | DENV1 E | FJ898382 | DENV1 E | GQ868608 | DENV1 E | DQ265076 |
| DENV1 E | DQ264922 | DENV1 E | DQ265058 | DENV1 E | FJ898417 | DENV1 E | FJ461332 |
| DENV1 E | DQ091265 | DENV1 E | FJ410250 | DENV1 E | FJ024426 | DENV1 E | DQ091263 |
| DENV1 E | EF654106 | DENV1 E | AY780643 | DENV1 E | AB111079 | DENV1 E | GQ199777 |
| DENV1 E | EU660418 | DENV1 E | FJ410226 | DENV1 E | GQ868511 | DENV1 E | EU081229 |
| DENV1 E | EF032590 | DENV1 E | DQ264942 | DENV1 E | AY732381 | DENV1 E | FJ410270 |
| DENV1 E | AY713473 | DENV1 E | GU131785 | DENV1 E | FJ882562 | DENV1 E | GQ199873 |
| DENV1 E | GU131700 | DENV1 E | GU131842 | DENV1 E | GU131752 | DENV1 E | M23027 |
| DENV1 E | GQ868523 | DENV1 E | FJ158609 | DENV1 E | S64849 | DENV1 E | FJ024451 |
| DENV1 E | EU117311 | DENV1 E | GU131836 | DENV1 E | GQ199811 | DENV1 E | GU131739 |
| DENV1 E | GQ868522 | DENV1 E | GQ199824 | DENV1 E | GQ868518 | DENV1 E | EU482482 |
| DENV1 E | EU660402 | DENV1 E | AY277657 | DENV1 E | FJ850075 | DENV1 E | DQ265010 |

FIG. 66-16

| Virus Protein | Accession No. | Virus Protein | Accession No. | Virus Protein | Accession No. | Virus Protein | Accession No. |
|---|---|---|---|---|---|---|---|
| DENV1 E | FJ024482 | DENV1 E | GU131742 | DENV1 E | GU131837 | DENV1 E | EU482519 |
| DENV1 E | AF425632 | DENV1 E | AY732439 | DENV1 E | FJ432732 | DENV1 E | AY206457 |
| DENV1 E | GU131698 | DENV1 E | GU131761 | DENV1 E | GU131840 | DENV1 E | GQ199818 |
| DENV1 E | FJ024432 | DENV1 E | GQ868561 | DENV1 E | EU677174 | DENV1 E | FJ850077 |
| DENV1 E | FJ882556 | DENV1 E | FJ410245 | DENV1 E | FJ639680 | DENV1 E | AY726553 |
| DENV1 E | GU131831 | DENV1 E | AY732443 | DENV1 E | GQ199849 | DENV1 E | EU482718 |
| DENV1 E | AY835999 | DENV1 E | GQ868520 | DENV1 E | FJ882566 | DENV1 E | EU081274 |
| DENV1 E | GU131922 | DENV1 E | DQ285552 | DENV1 E | DQ264965 | DENV1 E | FJ182025 |
| DENV1 E | EF508206 | DENV1 E | EU482707 | DENV1 E | FJ882541 | DENV1 E | DQ265085 |
| DENV1 E | DQ265083 | DENV1 E | EU482520 | DENV1 E | AY732400 | DENV1 E | GU131973 |
| DENV1 E | DQ265020 | DENV1 E | FJ882536 | DENV1 E | FJ639802 | DENV1 E | EU482811 |
| DENV1 E | FJ898376 | DENV1 E | EU081248 | DENV1 E | FJ432725 | DENV1 E | FJ410210 |
| DENV1 E | FJ898425 | DENV1 E | GQ868531 | DENV1 E | FN429888 | DENV1 E | AF425629 |
| DENV1 E | FJ898419 | DENV1 E | EU482533 | DENV1 E | DQ285553 | DENV1 E | AY732412 |
| DENV1 E | AB111074 | DENV1 E | DQ091267 | DENV1 E | EU482492 | DENV1 E | GU131925 |
| DENV1 E | AY732414 | DENV1 E | FJ898411 | DENV1 E | DQ265053 | DENV1 E | DQ855296 |
| DENV1 E | GQ199799 | DENV1 E | GQ199796 | DENV1 E | FJ882557 | DENV1 E | FJ373297 |
| DENV1 E | GU056029 | DENV1 E | GU131818 | DENV1 E | AY277660 | DENV1 E | FJ205875 |
| DENV1 E | AY145122 | DENV1 E | EU081239 | DENV1 E | FJ639669 | DENV1 E | DQ265011 |
| DENV1 E | DQ265072 | DENV1 E | EU081255 | DENV1 E | AB111064 | DENV1 E | DQ193572 |
| DENV1 E | GU131811 | DENV1 E | EU359008 | DENV1 E | DQ264984 | DENV1 E | AF425622 |
| DENV1 E | DQ264916 | DENV1 E | FJ906964 | DENV1 E | AY277655 | DENV1 E | U88535 |
| DENV1 E | EU482495 | DENV1 E | EU482618 | DENV1 E | EU117308 | DENV1 E | FJ882564 |
| DENV1 E | GQ868506 | DENV1 E | FJ410246 | DENV1 E | EU482792 | DENV1 E | DQ264921 |
| DENV1 E | GU131961 | DENV1 E | AY732424 | DENV1 E | FJ461340 | DENV1 E | GQ199774 |
| DENV1 E | FJ410269 | DENV1 E | DQ265121 | DENV1 E | GU131805 | DENV1 E | GQ199787 |
| DENV1 E | DQ265098 | DENV1 E | GQ868534 | DENV1 E | FJ410264 | DENV1 E | FJ850099 |
| DENV1 E | GQ199833 | DENV1 E | GQ199835 | DENV1 E | DQ264905 | DENV1 E | FJ410267 |
| DENV1 E | DQ265002 | DENV1 E | DQ091259 | DENV1 E | EU482516 | DENV1 E | DQ264892 |
| DENV1 E | EU081238 | DENV1 E | GU131716 | DENV1 E | DQ265111 | DENV1 E | DQ264893 |
| DENV1 E | GU131748 | DENV1 E | FJ410256 | DENV1 E | FJ469907 | DENV1 E | EU726777 |
| DENV1 E | DQ265132 | DENV1 E | FJ898424 | DENV1 E | FJ898396 | DENV1 E | EU081241 |
| DENV1 E | FJ410248 | DENV1 E | EU069616 | DENV1 E | EU677157 | DENV1 E | DQ265093 |
| DENV1 E | GU131733 | DENV1 E | DQ265079 | DENV1 E | DQ264959 | DENV1 E | EU069600 |
| DENV1 E | FJ461325 | DENV1 E | EU069593 | DENV1 E | EU482510 | DENV1 E | FJ898381 |
| DENV1 E | AY732456 | DENV1 E | GU131687 | DENV1 E | FJ182034 | DENV1 E | CS477265 |
| DENV1 E | GQ199817 | DENV1 E | EU482615 | DENV1 E | FJ898377 | DENV1 E | GQ199780 |
| DENV1 E | GU131691 | DENV1 E | FJ410285 | DENV1 E | EU660390 | DENV1 E | FN429889 |
| DENV1 E | EU069621 | DENV1 E | D00503 | DENV1 E | GU131718 | DENV1 E | FJ024434 |
| DENV1 E | D00505 | DENV1 E | FJ898388 | DENV1 E | DQ265063 | DENV1 E | EU069619 |
| DENV1 E | GU131804 | DENV1 E | DQ264883 | DENV1 E | EF654108 | DENV1 E | FJ024483 |
| DENV1 E | FJ562106 | DENV1 E | GQ868529 | DENV1 E | GQ868513 | DENV1 E | EU482502 |
| DENV1 E | FJ639682 | DENV1 E | FJ882579 | DENV1 E | DQ265089 | DENV1 E | GU131962 |
| DENV1 E | EU069596 | DENV1 E | FJ024442 | DENV1 E | FJ639740 | DENV1 E | FJ461339 |
| DENV1 E | GU131792 | DENV1 E | GQ868563 | DENV1 E | FJ882533 | DENV1 E | EU482821 |
| DENV1 E | FJ882522 | DENV1 E | FJ639743 | DENV1 E | GU131926 | DENV1 E | GU131891 |
| DENV1 E | EU448405 | DENV1 E | DQ265152 | DENV1 E | GU131734 | DENV1 E | EU660403 |
| DENV1 E | DQ091273 | DENV1 E | FJ390378 | DENV1 E | AY732454 | DENV1 E | FJ410275 |

FIG. 66-17

| Virus Protein | Accession No. | Virus Protein | Accession No. | Virus Protein | Accession No. | Virus Protein | Accession No. |
|---|---|---|---|---|---|---|---|
| DENV1 E | GQ868559 | DENV1 E | FJ024463 | DENV1 E | FJ850093 | DENV1 E | GU131816 |
| DENV1 E | AF298808 | DENV1 E | EF122231 | DENV1 E | AY732416 | DENV1 E | DQ264954 |
| DENV1 E | AY618879 | DENV1 E | GQ199810 | DENV1 E | DQ091269 | DENV1 E | EU482512 |
| DENV1 E | FJ410218 | DENV1 E | FJ850081 | DENV1 E | DQ091271 | DENV1 E | DQ264913 |
| DENV1 E | DQ264877 | DENV1 E | DQ264935 | DENV1 E | AF425630 | DENV1 E | AF425612 |
| DENV1 E | AY732461 | DENV1 E | FJ024427 | DENV1 E | GU131728 | DENV1 E | DQ264926 |
| DENV1 E | GQ199775 | DENV1 E | GQ868637 | DENV1 E | FJ898372 | DENV1 E | DQ265045 |
| DENV1 E | EU448414 | DENV1 E | FJ639796 | DENV1 E | DQ341188 | DENV1 E | FJ882568 |
| DENV1 E | FJ882552 | DENV1 E | EU069601 | DENV1 E | EU677172 | DENV1 E | DQ265137 |
| DENV1 E | DQ264876 | DENV1 E | DQ265105 | DENV1 E | EU069610 | DENV1 E | FJ898413 |
| DENV1 E | DQ264951 | DENV1 E | AY732398 | DENV1 E | FJ639794 | DENV1 E | EU596504 |
| DENV1 E | AY732432 | DENV1 E | EU677159 | DENV1 E | GQ868527 | DENV1 E | FJ410276 |
| DENV1 E | FJ898402 | DENV1 E | FJ882519 | DENV1 E | FJ687430 | DENV1 E | FJ898386 |
| DENV1 E | GQ199859 | DENV1 E | GQ199825 | DENV1 E | FJ639672 | DENV1 E | EU482506 |
| DENV1 E | FJ410196 | DENV1 E | EU482525 | DENV1 E | FJ410189 | DENV1 E | GU131736 |
| DENV1 E | AF425619 | DENV1 E | EU482798 | DENV1 E | FJ182023 | DENV1 E | DQ264970 |
| DENV1 E | FJ639690 | DENV1 E | FJ182032 | DENV1 E | FJ410260 | DENV1 E | GU131948 |
| DENV1 E | FJ898383 | DENV1 E | GU131769 | DENV1 E | DQ265101 | DENV1 E | GU131834 |
| DENV1 E | GU131984 | DENV1 E | DQ265057 | DENV1 E | EU081266 | DENV1 E | DQ265018 |
| DENV1 E | AY620950 | DENV1 E | GQ199792 | DENV1 E | GU131895 | DENV1 E | EU482715 |
| DENV1 E | GQ868498 | DENV1 E | GU131888 | DENV1 E | GU131829 | DENV1 E | EU482716 |
| DENV1 E | EU482487 | DENV1 E | GU131704 | DENV1 E | FJ410204 | DENV1 E | DQ264967 |
| DENV1 E | FJ639818 | DENV1 E | GQ199850 | DENV1 E | FJ410194 | DENV1 E | FJ850087 |
| DENV1 E | EU677166 | DENV1 E | GQ868526 | DENV1 E | AY732405 | DENV1 E | AF514883 |
| DENV1 E | GU131758 | DENV1 E | EF032589 | DENV1 E | FJ882528 | DENV1 E | EU660395 |
| DENV1 E | AY732408 | DENV1 E | DQ264908 | DENV1 E | FJ432730 | DENV1 E | FJ410262 |
| DENV1 E | GU131697 | DENV1 E | GU131695 | DENV1 E | EU081230 | DENV1 E | EU069603 |
| DENV1 E | EU081247 | DENV1 E | FJ410243 | DENV1 E | FJ410206 | DENV1 E | EU081243 |
| DENV1 E | DQ265039 | DENV1 E | AF309641 | DENV1 E | FJ687478 | DENV1 E | DQ265091 |
| DENV1 E | AY376738 | DENV1 E | FJ639686 | DENV1 E | GU131969 | DENV1 E | CS477264 |
| DENV1 E | D00501 | DENV1 E | FJ410255 | DENV1 E | AY732478 | DENV1 E | FJ562104 |
| DENV1 E | DQ341194 | DENV1 E | EU482818 | DENV1 E | AF425614 | DENV1 E | GQ199823 |
| DENV1 E | FJ158611 | DENV1 E | DQ265047 | DENV1 E | FJ461330 | DENV1 E | FJ639741 |
| DENV1 E | GU131776 | DENV1 E | GU131685 | DENV1 E | DQ672556 | DENV1 E | GU131690 |
| DENV1 E | FJ390380 | DENV1 E | GU131793 | DENV1 E | EU448404 | DENV1 E | EU482497 |
| DENV1 E | AY732385 | DENV1 E | FN429882 | DENV1 E | GU131976 | DENV1 E | DQ265061 |
| DENV1 E | FJ882547 | DENV1 E | DQ264928 | DENV1 E | FJ410216 | DENV1 E | DQ265107 |
| DENV1 E | GQ868611 | DENV1 E | AF425639 | DENV1 E | EU117304 | DENV1 E | GU370049 |
| DENV1 E | FJ410231 | DENV1 E | EU482509 | DENV1 E | AF425634 | DENV1 E | GQ868632 |
| DENV1 E | GU131680 | DENV1 E | FJ547086 | DENV1 E | GQ199801 | DENV1 E | DQ264868 |
| DENV1 E | M87512 | DENV1 E | FJ639694 | DENV1 E | FJ906728 | DENV1 E | GQ868613 |
| DENV1 E | EU069624 | DENV1 E | EU482491 | DENV1 E | GU131803 | DENV1 E | X76219 |
| DENV1 E | FJ024440 | DENV1 E | GU131755 | DENV1 E | AY726555 | DENV1 E | GU131893 |
| DENV1 E | AY732392 | DENV1 E | FJ898430 | DENV1 E | DQ264879 | DENV1 E | EU687247 |
| DENV1 E | GU131774 | DENV1 E | FJ898428 | DENV1 E | GQ199798 | DENV1 E | EU482813 |
| DENV1 E | DQ672560 | DENV1 E | FJ639814 | DENV1 E | EU448388 | DENV1 E | AY422779 |
| DENV1 E | AF425636 | DENV1 E | GU131763 | DENV1 E | GU056030 | DENV1 E | DQ264982 |
| DENV1 E | GQ868512 | DENV1 E | FJ873814 | DENV1 E | AY732422 | DENV1 E | AY713475 |

FIG. 66-18

| Virus Protein | Accession No. | Virus Protein | Accession No. | Virus Protein | Accession No. | Virus Protein | Accession No. |
|---|---|---|---|---|---|---|---|
| DENV1 E | FJ024438 | DENV1 E | EU677169 | DENV1 E | FJ898408 | DENV1 E | DQ265139 |
| DENV1 E | FJ882542 | DENV1 E | AY277658 | DENV1 E | GQ199844 | DENV1 E | DQ672559 |
| DENV1 E | AY732394 | DENV1 E | FJ882535 | DENV1 E | GU131970 | DENV1 E | EU448403 |
| DENV1 E | DQ264957 | DENV1 E | FJ547087 | DENV1 E | DQ264870 | DENV1 E | EU677153 |
| DENV1 E | GU131982 | DENV1 E | DQ264938 | DENV1 E | EF508198 | DENV1 E | AF226687 |
| DENV1 E | FJ461328 | DENV1 E | DQ264940 | DENV1 E | AY732419 | DENV1 E | EU482825 |
| DENV1 E | FJ687432 | DENV1 E | AY732468 | DENV1 E | DQ264981 | DENV1 E | DQ264902 |
| DENV1 E | FJ410188 | DENV1 E | EU677164 | DENV1 E | EU482796 | DENV1 E | DQ265094 |
| DENV1 E | AB111075 | DENV1 E | GU131725 | DENV1 E | DQ264999 | DENV1 E | DQ264887 |
| DENV1 E | GQ199813 | DENV1 E | DQ285561 | DENV1 E | EU596502 | DENV1 E | DQ211348 |
| DENV1 E | AY732410 | DENV1 E | GU131678 | DENV1 E | DQ264869 | DENV1 E | FJ182022 |
| DENV1 E | DQ341189 | DENV1 E | GU131822 | DENV1 E | GQ868607 | DENV1 E | EU482592 |
| DENV1 E | GQ199847 | DENV1 E | EU482479 | DENV1 E | GQ868524 | DENV1 E | EU482800 |
| DENV1 E | FJ410212 | DENV1 E | FJ882518 | DENV1 E | DQ264873 | DENV1 E | DQ264915 |
| DENV1 E | DQ265128 | DENV1 E | FJ639696 | DENV1 E | GQ868517 | DENV1 E | AY277653 |
| DENV1 E | FJ410232 | DENV1 E | AY422781 | DENV1 E | EU081268 | DENV1 E | EU069622 |
| DENV1 E | EU482481 | DENV1 E | GQ199857 | DENV1 E | DQ265080 | DENV1 E | GU131745 |
| DENV1 E | AY726551 | DENV1 E | GQ199808 | DENV1 E | GQ199827 | DENV1 E | FJ410184 |
| DENV1 E | FJ639811 | DENV1 E | FJ432749 | DENV1 E | EU660394 | DENV1 E | GQ199778 |
| DENV1 E | DQ264947 | DENV1 E | GU131771 | DENV1 E | EU482610 | DENV1 E | FJ390383 |
| DENV1 E | AY732427 | DENV1 E | GQ199772 | DENV1 E | AY732380 | DENV1 E | FJ410203 |
| DENV1 E | GU131800 | DENV1 E | AY620948 | DENV1 E | AY732457 | DENV1 E | AY732442 |
| DENV1 E | FJ024425 | DENV1 E | FJ882538 | DENV1 E | AY732433 | DENV1 E | DQ265013 |
| DENV1 E | DQ091260 | DENV1 E | FJ410283 | DENV1 E | EU179861 | DENV1 E | EU482476 |
| DENV1 E | EU448398 | DENV1 E | FJ882521 | DENV1 E | AF425623 | DENV1 E | AY732450 |
| DENV1 E | EU482527 | DENV1 E | EU726779 | DENV1 E | AB074761 | DENV1 E | AY145123 |
| DENV1 E | EU482500 | DENV1 E | AF425624 | DENV1 E | GQ199829 | DENV1 E | EU081270 |
| DENV1 E | EU482828 | DENV1 E | EU081253 | DENV1 E | EU448389 | DENV1 E | GQ199872 |
| DENV1 E | FJ205873 | DENV1 E | FN429886 | DENV1 E | GU131863 | DENV1 E | GQ199856 |
| DENV1 E | AY732481 | DENV1 E | GQ868601 | DENV1 E | GU131892 | DENV1 E | AY277662 |
| DENV1 E | GQ199782 | DENV1 E | FJ182003 | DENV1 E | DQ264956 | DENV1 E | AF425615 |
| DENV1 E | EU677150 | DENV1 E | FJ410286 | DENV1 E | GQ868530 | DENV1 E | EU482709 |
| DENV1 E | EU482591 | DENV1 E | FJ639684 | DENV1 E | FJ410173 | DENV1 E | DQ264931 |
| DENV1 E | GU131738 | DENV1 E | EU482794 | DENV1 E | EU482814 | DENV1 E | GQ868618 |
| DENV1 E | AY732434 | DENV1 E | AY722801 | DENV1 E | EU660393 | DENV1 E | GU131699 |
| DENV1 E | AY732429 | DENV1 E | FJ410199 | DENV1 E | DQ264900 | DENV1 E | AY600860 |
| DENV1 E | FJ024485 | DENV1 E | EU482485 | DENV1 E | EU448386 | DENV1 E | FJ182029 |
| DENV1 E | EU677177 | DENV1 E | DQ264911 | DENV1 E | EU069606 | DENV1 E | GQ199855 |
| DENV1 E | GU131967 | DENV1 E | EU482803 | DENV1 E | FJ639815 | DENV1 E | FJ882539 |
| DENV1 E | GU131814 | DENV1 E | GU131767 | DENV1 E | GU131979 | DENV1 E | AB188830 |
| DENV1 E | AJ968413 | DENV1 E | AY726549 | DENV1 E | DQ264925 | DENV1 E | FJ410180 |
| DENV1 E | FJ024436 | DENV1 E | AY630407 | DENV1 E | EU482827 | DENV1 E | GU131806 |
| DENV1 E | FJ432746 | DENV1 E | EF508204 | DENV1 E | FJ461316 | DENV1 E | DQ672564 |
| DENV1 E | DQ265055 | DENV1 E | FJ176779 | DENV1 E | FJ882544 | DENV1 E | FJ410268 |
| DENV1 E | DQ264933 | DENV1 E | DQ341192 | DENV1 E | GU131768 | DENV1 E | AY422778 |
| DENV1 E | FJ850071 | DENV1 E | AY588272 | DENV1 E | DQ265119 | DENV1 E | GU131825 |
| DENV1 E | EU081271 | DENV1 E | FJ461335 | DENV1 E | EU482567 | DENV1 E | FJ850101 |
| DENV1 E | AY708047 | DENV1 E | DQ264918 | DENV1 E | GU131957 | DENV1 E | FJ182002 |

FIG. 66-19

| Virus Protein | Accession No. | Virus Protein | Accession No. | Virus Protein | Accession No. | Virus Protein | Accession No. |
|---|---|---|---|---|---|---|---|
| DENV1 E | GU131683 | DENV1 E | EU482791 | DENV1 E | GU131781 | DENV1 E | GU131708 |
| DENV1 E | FJ639685 | DENV1 E | FJ898427 | DENV1 E | FJ410252 | DENV1 E | EU687251 |
| DENV1 E | EU482535 | DENV1 E | FJ410234 | DENV1 E | EU081262 | DENV1 E | DQ265022 |
| DENV1 E | FJ024433 | DENV1 E | EU482494 | DENV1 E | GQ199842 | DENV1 E | DQ264891 |
| DENV1 E | FJ176780 | DENV1 E | FJ432720 | DENV1 E | EU726782 | DENV1 E | EU069608 |
| DENV1 E | FJ373305 | DENV1 E | AY732451 | DENV1 E | GQ868537 | DENV1 E | AF226685 |
| DENV1 E | FJ410279 | DENV1 E | EF508202 | DENV1 E | GQ199797 | DENV1 E | FJ882561 |
| DENV1 E | AY732403 | DENV1 E | FJ639735 | DENV1 E | FJ882515 | DENV1 E | EU482488 |
| DENV1 E | EU081279 | DENV1 E | FJ898406 | DENV1 E | FJ024450 | DENV1 E | FJ410214 |
| DENV1 E | DQ265049 | DENV1 E | DQ672563 | DENV1 E | GU131723 | DENV1 E | FJ687429 |
| DENV1 E | GU131756 | DENV1 E | GQ199793 | DENV1 E | GQ868503 | DENV1 E | AY732440 |
| DENV1 E | DQ265071 | DENV1 E | AY620946 | DENV1 E | DQ265069 | DENV1 E | FJ898379 |
| DENV1 E | FJ478457 | DENV1 E | EU482807 | DENV1 E | AM746217 | DENV1 E | EF079826 |
| DENV1 E | FJ024457 | DENV1 E | DQ265109 | DENV1 E | AY732378 | DENV1 E | GU131790 |
| DENV1 E | AB189121 | DENV1 E | GU131797 | DENV1 E | FJ882551 | DENV1 E | EU482540 |
| DENV1 E | DQ285562 | DENV1 E | FJ410258 | DENV1 E | AY732436 | DENV1 E | GU131681 |
| DENV1 E | FJ850103 | DENV1 E | EU482802 | DENV1 E | DQ264909 | DENV1 E | EU081226 |
| DENV1 E | EU482499 | DENV1 E | AF425625 | DENV1 E | FJ461318 | DENV1 E | AY732397 |
| DENV1 E | GQ199805 | DENV1 E | GQ868633 | DENV1 E | FJ898418 | DENV1 E | FJ182020 |
| DENV1 E | GQ868568 | DENV1 E | AB074760 | DENV1 E | GQ199820 | DENV1 E | AY277654 |
| DENV1 E | DQ265030 | DENV1 E | EU081256 | DENV1 E | AF513110 | DENV1 E | FJ882524 |
| DENV1 E | FJ547068 | DENV1 E | FJ432735 | DENV1 E | FJ410191 | DENV1 E | EU677139 |
| DENV1 E | EU081234 | DENV1 E | GQ199781 | DENV1 E | FJ024431 | DENV1 E | DQ091262 |
| DENV1 E | FJ432739 | DENV1 E | DQ285559 | DENV1 E | FJ898394 | DENV1 E | DQ264953 |
| DENV1 E | GQ199816 | DENV1 E | FJ182036 | DENV1 E | FJ024445 | DENV1 E | DQ264917 |
| DENV1 E | FJ898401 | DENV1 E | EU069614 | DENV1 E | EU081242 | DENV1 E | EF654110 |
| DENV1 E | EU448401 | DENV1 E | DQ264898 | DENV1 E | DQ264949 | DENV1 E | GU131920 |
| DENV1 E | EU448395 | DENV1 E | FJ547089 | DENV1 E | FJ461333 | DENV1 E | GQ868536 |
| DENV1 E | GU131812 | DENV1 E | FJ898416 | DENV1 E | DQ264961 | DENV1 E | EU448413 |
| DENV1 E | EU660419 | DENV1 E | GU131960 | DENV1 E | AY422786 | DENV1 E | GQ199776 |
| DENV1 E | GQ199831 | DENV1 E | GU131820 | DENV1 E | GQ868509 | DENV1 E | FJ390381 |
| DENV1 E | AY732475 | DENV1 E | EU677170 | DENV1 E | FJ410209 | DENV1 E | GU131751 |
| DENV1 E | EU249491 | DENV1 E | AY422783 | DENV1 E | GU131839 | DENV1 E | FJ390388 |
| DENV1 E | GU131833 | DENV1 E | FJ882531 | DENV1 E | FJ410251 | DENV1 E | AY732401 |
| DENV1 E | AY732473 | DENV1 E | EU069618 | DENV1 E | EU677175 | DENV1 E | EU482823 |
| DENV1 E | GQ199836 | DENV1 E | AF514889 | DENV1 E | FJ639820 | DENV1 E | FJ850073 |
| DENV1 E | FJ410240 | DENV1 E | EU863650 | DENV1 E | GQ199867 | DENV1 E | AY732465 |
| DENV1 E | DQ264880 | DENV1 E | DQ264936 | DENV1 E | DQ265073 | DENV1 E | EU081237 |
| DENV1 E | FJ410225 | DENV1 E | FB667403 | DENV1 E | EU069599 | DENV1 E | EU482483 |
| DENV1 E | GU131732 | DENV1 E | GU131714 | DENV1 E | FJ024428 | DENV1 E | GQ199853 |
| DENV1 E | AB111066 | DENV1 E | AY277656 | DENV1 E | EU482537 | DENV1 E | GU131921 |
| DENV1 E | FJ639677 | DENV1 E | DQ265007 | DENV1 E | DQ264875 | DENV1 E | FJ182031 |
| DENV1 E | FJ810419 | DENV1 E | FJ882569 | DENV1 E | GU131778 | DENV1 E | EU448407 |
| DENV1 E | GU056032 | DENV1 E | FJ158612 | DENV1 E | FJ024464 | DENV1 E | FJ639683 |
| DENV1 E | FJ390374 | DENV1 E | FJ410280 | DENV1 E | GU131972 | DENV1 E | GU131740 |
| DENV1 E | FJ882527 | DENV1 E | FJ882548 | DENV1 E | GQ868606 | DENV1 E | FJ562105 |
| DENV1 E | AY732420 | DENV1 E | DQ265075 | DENV1 E | GU131679 | DENV1 E | FJ432745 |
| DENV1 E | GU131830 | DENV1 E | FJ859029 | DENV1 E | FJ687476 | DENV1 E | DQ265145 |

FIG. 66-20

| Virus Protein | Accession No. | Virus Protein | Accession No. | Virus Protein | Accession No. | Virus Protein | Accession No. |
|---|---|---|---|---|---|---|---|
| DENV1 E | AY277664 | DENV1 E | FJ898422 | DENV1 E | EU448410 | DENV1 E | GU131964 |
| DENV1 E | FJ882559 | DENV1 E | DQ265077 | DENV1 E | EU448400 | DENV1 E | EU482713 |
| DENV1 E | AB111068 | DENV1 E | DQ264944 | DENV1 E | DQ265156 | DENV1 E | EU482538 |
| DENV1 E | FJ024435 | DENV1 E | FJ744702 | DENV1 E | EU081251 | DENV1 E | EU081245 |
| DENV1 E | GQ199803 | DENV1 E | GQ199838 | DENV1 E | FJ432733 | DENV1 E | GQ868619 |
| DENV1 E | FJ461320 | DENV1 E | GQ199779 | DENV1 E | AY732389 | DENV1 E | GU131789 |
| DENV1 E | FJ850090 | DENV1 E | FJ205883 | DENV1 E | FJ024447 | DENV1 E | AB178040 |
| DENV1 E | EU482528 | DENV1 E | GQ868635 | DENV1 E | FJ547063 | DENV1 E | AY732471 |
| DENV1 E | FJ898448 | DENV1 E | DQ285560 | DENV1 E | FJ158610 | DENV1 E | AY732480 |
| DENV1 E | FJ898420 | DENV1 E | FJ410239 | DENV1 E | AY732425 | DENV1 E | FJ898385 |
| DENV1 E | GQ868519 | DENV1 E | FJ882554 | DENV1 E | EU482523 | DENV1 E | DQ265086 |
| DENV1 E | AF425631 | DENV1 E | AM746215 | DENV1 E | DQ285554 | DENV1 E | FJ639688 |
| DENV1 E | FJ432727 | DENV1 E | DQ285557 | DENV1 E | EU482793 | DENV1 E | DQ265056 |
| DENV1 E | AB111073 | DENV1 E | GU131747 | DENV1 E | AY732438 | DENV1 E | DQ091264 |
| DENV1 E | EU677155 | DENV1 E | FJ024481 | DENV1 E | U88537 | DENV1 E | FJ205884 |
| DENV1 E | AF425620 | DENV1 E | FJ639675 | DENV1 E | FJ898399 | DENV1 E | FJ898380 |
| DENV1 E | DQ265082 | DENV1 E | GU131810 | DENV1 E | GQ868609 | DENV1 E | FJ182026 |
| DENV1 E | DQ265005 | DENV1 E | FJ410249 | DENV1 E | EU726780 | DENV1 E | DQ265084 |
| DENV1 E | AY732455 | DENV1 E | EU117310 | DENV1 E | EU482805 | DENV1 E | AF311957 |
| DENV1 E | EU677162 | DENV1 E | DQ672561 | DENV1 E | GU131784 | DENV1 E | FJ639693 |
| DENV1 E | GU131692 | DENV1 E | FJ810415 | DENV1 E | DQ264872 | DENV1 E | DQ265044 |
| DENV1 E | EU596501 | DENV1 E | GQ199785 | DENV1 E | GU131827 | DENV1 E | AM746213 |
| DENV1 E | FJ410273 | DENV1 E | FJ410220 | DENV1 E | AY618877 | DENV1 E | DQ265104 |
| DENV1 E | DQ264973 | DENV1 E | EU482504 | DENV1 E | AY422785 | DENV1 E | GU131735 |
| DENV1 E | FJ410182 | DENV1 E | FJ205881 | DENV1 E | FJ410227 | DENV1 E | FJ850114 |
| DENV1 E | GQ199791 | DENV1 E | EU081264 | DENV1 E | GQ868505 | DENV1 E | FJ882563 |
| DENV1 E | GQ868630 | DENV1 E | GU131688 | DENV1 E | FN429884 | DENV1 E | GQ199812 |
| DENV1 E | EU482503 | DENV1 E | A75711 | DENV1 E | FJ873809 | DENV1 E | GU131737 |
| DENV1 E | AY732445 | DENV1 E | AF425617 | DENV1 E | EU081258 | DENV1 E | FJ547060 |
| DENV1 E | FB730116 | DENV1 E | EU081254 | DENV1 E | EU677173 | DENV1 E | GQ199819 |
| DENV1 E | FJ410198 | DENV1 E | EU448393 | DENV1 E | EU117312 | DENV1 E | FJ687474 |
| DENV1 E | EU081276 | DENV1 E | FJ898429 | DENV1 E | FJ898392 | DENV1 E | FJ024484 |
| DENV1 E | EF440432 | DENV1 E | AB111071 | DENV1 E | FJ024448 | DENV1 E | GQ868500 |
| DENV1 E | FJ461324 | DENV1 E | FJ469908 | DENV1 E | GQ868507 | DENV1 E | DQ264878 |
| DENV1 E | AF311958 | DENV1 E | AY620953 | DENV1 E | AF425638 | DENV1 E | EU249493 |
| DENV1 E | EU069598 | DENV1 E | GU131799 | DENV1 E | EU482531 | DENV1 E | DQ265092 |
| DENV1 E | FJ639813 | DENV1 E | EF654104 | DENV1 E | GQ868510 | DENV1 E | AY732393 |
| DENV1 E | DQ264923 | DENV1 E | EU117306 | DENV1 E | FJ410290 | DENV1 E | AY732390 |
| DENV1 E | AF180817 | DENV1 E | DQ264989 | DENV1 E | GU131981 | DENV1 E | AF425628 |
| DENV1 E | EU081277 | DENV1 E | FJ182027 | DENV1 E | DQ265040 | DENV1 E | AB111076 |
| DENV1 E | FJ898426 | DENV1 E | FJ432737 | DENV1 E | EU660391 | DENV1 E | AY153755 |
| DENV1 E | AY732415 | DENV1 E | FJ410201 | DENV1 E | AY732382 | DENV1 E | EU081275 |
| DENV1 E | EF508207 | DENV1 E | GU131701 | DENV1 E | EU482515 | DENV1 E | FJ432748 |
| DENV1 E | GU131729 | DENV1 E | EU081269 | DENV1 E | EU081232 | DENV1 E | AY618211 |
| DENV1 E | GQ868539 | DENV1 E | EU448392 | DENV1 E | GQ199840 | DENV1 E | EU081228 |
| DENV1 E | AY145121 | DENV1 E | GQ199783 | DENV1 E | EU482710 | DENV1 E | EF508205 |
| DENV1 E | AY732447 | DENV1 E | EF508200 | DENV1 E | AF425627 | DENV1 E | AY732462 |
| DENV1 E | EU677167 | DENV1 E | GU131754 | DENV1 E | GQ868566 | DENV1 E | DQ264952 |

FIG. 66-21

| Virus Protein | Accession No. | Virus Protein | Accession No. | Virus Protein | Accession No. | Virus Protein | Accession No. |
|---|---|---|---|---|---|---|---|
| DENV1 E | EU482810 | DENV1 E | AB003090 | DENV1 E | FJ461319 | DENV1 E | EU482819 |
| DENV1 E | DQ855297 | DENV1 E | EU069620 | DENV1 E | FJ898412 | DENV1 E | FJ882570 |
| DENV1 E | AF425618 | DENV1 E | GU131727 | DENV1 E | GQ868521 | DENV1 E | AF514885 |
| DENV1 E | GQ199852 | DENV1 E | DQ341191 | DENV1 E | GU131686 | DENV1 E | AB219136 |
| DENV1 E | GU131923 | DENV1 E | FJ024462 | DENV1 E | AY732479 | DENV1 E | DQ265052 |
| DENV1 E | GQ199790 | DENV1 E | FJ024441 | DENV1 E | DQ285551 | DENV1 E | DQ264979 |
| DENV1 E | FJ024423 | DENV1 E | GQ199822 | DENV1 E | FJ384655 | DENV1 E | GU131802 |
| DENV1 E | AY732463 | DENV1 E | FN429887 | DENV1 E | AY732384 | DENV1 E | FJ687427 |
| DENV1 E | DQ265064 | DENV1 E | DQ264910 | DENV1 E | AY732437 | DENV1 E | FJ182033 |
| DENV1 E | AY618878 | DENV1 E | AY732417 | DENV1 E | FJ882537 | DENV1 E | EF441282 |
| DENV1 E | FJ882555 | DENV1 E | EU482539 | DENV1 E | EU448399 | DENV1 E | EU069597 |
| DENV1 E | FJ898405 | DENV1 E | EU482804 | DENV1 E | FJ898373 | DENV1 E | GQ199800 |
| DENV1 E | GU131889 | DENV1 E | FJ882520 | DENV1 E | GU131710 | DENV1 E | GU131702 |
| DENV1 E | GQ868499 | DENV1 E | AY732399 | DENV1 E | EU677171 | DENV1 E | FJ432723 |
| DENV1 E | EU482501 | DENV1 E | AY732407 | DENV1 E | AY732406 | DENV1 E | EU482505 |
| DENV1 E | DQ211349 | DENV1 E | DQ264934 | DENV1 E | FJ024479 | DENV1 E | FJ882532 |
| DENV1 E | DQ264950 | DENV1 E | FJ639689 | DENV1 E | FJ687431 | DENV1 E | AY780642 |
| DENV1 E | GU131775 | DENV1 E | EU677140 | DENV1 E | DQ265155 | DENV1 E | AY606062 |
| DENV1 E | EU081246 | DENV1 E | GQ199832 | DENV1 E | FJ882523 | DENV1 E | AY732446 |
| DENV1 E | GQ199773 | DENV1 E | EU282328 | DENV1 E | DQ265078 | DENV1 E | DQ264958 |
| DENV1 E | FJ898431 | DENV1 E | FJ639695 | DENV1 E | FJ547065 | DENV1 E | AF514878 |
| DENV1 E | EU081231 | DENV1 E | AM746218 | DENV1 E | GU131791 | DENV1 E | FJ882540 |
| DENV1 E | EU482486 | DENV1 E | FJ410244 | DENV1 E | DQ264996 | DENV1 E | GU131703 |
| DENV1 E | FJ410187 | DENV1 E | FJ898397 | DENV1 E | DQ264929 | DENV1 E | FJ410190 |
| DENV1 E | FN429881 | DENV1 E | DQ264886 | DENV1 E | AY732430 | DENV1 E | GQ868564 |
| DENV1 E | GU131764 | DENV1 E | GU131819 | DENV1 E | GU131894 | DENV1 E | GU131717 |
| DENV1 E | GQ868569 | DENV1 E | GU131823 | DENV1 E | EU482490 | DENV1 E | DQ264983 |
| DENV1 E | GQ868612 | DENV1 E | DQ265088 | DENV1 E | EU482521 | DENV1 E | AF425609 |
| DENV1 E | D00502 | DENV1 E | FJ882543 | DENV1 E | EU069594 | DENV1 E | DQ264945 |
| DENV1 E | FJ461331 | DENV1 E | GU131715 | DENV1 E | FJ898423 | DENV1 E | EU081273 |
| DENV1 E | FJ410282 | DENV1 E | EU069609 | DENV1 E | EU660396 | DENV1 E | GQ199846 |
| DENV1 E | EU069623 | DENV1 E | EU677156 | DENV1 E | AY732423 | DENV1 E | AY732483 |
| DENV1 E | FJ205872 | DENV1 E | FJ461317 | DENV1 E | AF180818 | DENV1 E | AY630408 |
| DENV1 E | GQ199809 | DENV1 E | GU131794 | DENV1 E | AY726554 | DENV1 E | CS477263 |
| DENV1 E | GU131722 | DENV1 E | FJ461341 | DENV1 E | FJ898403 | DENV1 E | EU482496 |
| DENV1 E | FJ873810 | DENV1 E | DQ091266 | DENV1 E | CS479203 | DENV1 E | FJ410265 |
| DENV1 E | AY732470 | DENV1 E | EU482511 | DENV1 E | EU482517 | DENV1 E | GU131720 |
| DENV1 E | FJ882546 | DENV1 E | FJ024453 | DENV1 E | EU482609 | DENV1 E | AY277661 |
| DENV1 E | FJ639797 | DENV1 E | GU131749 | DENV1 E | FJ410266 | DENV1 E | AF425621 |
| DENV1 E | EU677160 | DENV1 E | FJ898389 | DENV1 E | DQ264964 | DENV1 E | FJ461327 |
| DENV1 E | FJ461312 | DENV1 E | GU131696 | DENV1 E | EU482493 | DENV1 E | GU370048 |
| DENV1 E | NC_001477 | DENV1 E | EU482508 | DENV1 E | DQ265066 | DENV1 E | AY732386 |
| DENV1 E | GQ199841 | DENV1 E | EU081265 | DENV1 E | AY732426 | DENV1 E | DQ264904 |
| DENV1 E | FJ882534 | DENV1 E | FJ410247 | DENV1 E | FJ639674 | DENV1 E | FJ898409 |
| DENV1 E | FJ410289 | DENV1 E | D00504 | DENV1 E | DQ264881 | DENV1 E | FJ182024 |
| DENV1 E | FJ410179 | DENV1 E | FJ461307 | DENV1 E | FJ639673 | DENV1 E | FJ882565 |
| DENV1 E | FJ432719 | DENV1 E | EF654107 | DENV1 E | AY732482 | DENV1 E | GU131966 |
| DENV1 E | AY277666 | DENV1 E | GQ868560 | DENV1 E | CS479204 | DENV1 E | EU249490 |

FIG. 66-22

| Virus | Protein | Accession No. | Virus | Protein | Accession No. | Virus | Protein | Accession No. | Virus | Protein | Accession No. |
|---|---|---|---|---|---|---|---|---|---|---|---|
| DENV1 | E | AF514876 | DENV1 | E | DQ265117 | DENV1 | E | GU131684 | DENV1 | E | AY762084 |
| DENV1 | E | FN429885 | DENV1 | E | GU131743 | DENV1 | E | FJ205876 | DENV1 | E | AY732449 |
| DENV1 | E | EU081272 | DENV1 | E | EF508203 | DENV1 | E | FJ410205 | DENV1 | E | GQ868602 |
| DENV1 | E | AY732409 | DENV1 | E | GQ868614 | DENV1 | E | FJ478458 | DENV1 | E | DQ265115 |
| DENV1 | E | AY422780 | DENV1 | E | EU482706 | DENV1 | E | EU677158 | DENV1 | E | GQ868532 |
| DENV1 | E | DQ265054 | DENV1 | E | AY376737 | DENV1 | E | EU482532 | DENV1 | E | EF025110 |
| DENV1 | E | GU131841 | DENV1 | E | DQ091272 | DENV1 | E | AF425613 | DENV1 | E | GQ868528 |
| DENV1 | E | GQ868570 | DENV1 | E | FJ562101 | DENV1 | E | FJ410242 | DENV1 | E | GU131694 |
| DENV1 | E | DQ341190 | DENV1 | E | FB667398 | DENV1 | E | EU069611 | DENV1 | E | EU482489 |
| DENV1 | E | GU131890 | DENV1 | E | GU131808 | DENV1 | E | AY620949 | DENV1 | E | AY620951 |
| DENV1 | E | FJ882553 | DENV1 | E | GU131780 | DENV1 | E | D10513 | DENV1 | E | FJ687477 |
| DENV1 | E | AY732431 | DENV1 | E | FJ639671 | DENV1 | E | EU069595 | DENV1 | E | FJ850068 |
| DENV1 | E | DQ265062 | DENV1 | E | FJ390379 | DENV1 | E | EU448387 | DENV1 | E | AB111078 |
| DENV1 | E | AY732413 | DENV1 | E | FJ024439 | DENV1 | E | EU482619 | DENV1 | E | AF425633 |
| DENV1 | E | GU131821 | DENV1 | E | DQ265090 | DENV1 | E | DQ264966 | DENV1 | E | FJ898400 |
| DENV1 | E | GQ199771 | DENV1 | E | AF350498 | DENV1 | E | FJ410235 | DENV1 | E | GU131968 |
| DENV1 | E | AB195673 | DENV1 | E | DQ264932 | DENV1 | E | DQ265143 | DENV1 | E | DQ265136 |
| DENV1 | E | EU482812 | DENV1 | E | DQ091268 | DENV1 | E | FJ898395 | DENV1 | E | GQ868615 |
| DENV1 | E | AF298807 | DENV1 | E | FJ432747 | DENV1 | E | GU131949 | DENV1 | E | AF231721 |
| DENV1 | E | GU131801 | DENV1 | E | EU482795 | DENV1 | E | AY732477 | DENV1 | E | FJ882567 |
| DENV1 | E | GU131983 | DENV1 | E | AY732395 | DENV1 | E | EU596503 | DENV1 | E | AY618880 |
| DENV1 | E | EF122232 | DENV1 | E | EU069602 | DENV1 | E | GQ199851 | DENV1 | E | DQ672558 |
| DENV1 | E | AB519681 | DENV1 | E | FJ639678 | DENV1 | E | GU131796 | DENV1 | E | EU677151 |
| DENV1 | E | GQ199814 | DENV1 | E | EU482617 | DENV1 | E | EU081252 | DENV1 | E | AB204803 |
| DENV1 | E | AY726552 | DENV1 | E | FJ410287 | DENV1 | E | GU131712 | DENV1 | E | AY732453 |
| DENV1 | E | DQ836632 | DENV1 | E | FJ024444 | DENV1 | E | EU081249 | DENV1 | E | FJ182018 |
| DENV1 | E | EU482484 | DENV1 | E | EU482799 | DENV1 | E | AY732418 | DENV1 | E | EU482809 |
| DENV1 | E | DQ264946 | DENV1 | E | GU131750 | DENV1 | E | GU131730 | DENV1 | E | FJ687433 |
| DENV1 | E | AY722803 | DENV1 | E | FJ906963 | DENV1 | E | GQ199795 | DENV1 | E | AY277652 |
| DENV1 | E | GU131787 | DENV1 | E | FJ410185 | DENV1 | E | GQ199807 | DENV1 | E | FJ410277 |
| DENV1 | E | FJ373296 | DENV1 | E | EU660412 | DENV1 | E | GU131817 | DENV1 | E | GQ868502 |
| DENV1 | E | DQ264941 | DENV1 | E | GU131779 | DENV1 | E | FJ024455 | DENV1 | E | FJ461310 |
| DENV1 | E | GU131887 | DENV1 | E | FJ639691 | DENV1 | E | GU131766 | DENV1 | E | FJ898375 |
| DENV1 | E | GU131741 | DENV1 | E | EU677165 | DENV1 | E | GU056031 | DENV1 | E | AY858983 |
| DENV1 | E | EU677178 | DENV1 | E | GU131773 | DENV1 | E | GU131786 | DENV1 | E | GU131835 |
| DENV1 | E | FJ898433 | DENV1 | E | FJ882517 | DENV1 | E | FJ410207 | DENV1 | E | FJ390386 |
| DENV1 | E | DQ264930 | DENV1 | E | FJ410230 | DENV1 | E | AY732379 | DENV1 | E | EU482518 |
| DENV1 | E | FJ024443 | DENV1 | E | FJ410211 | DENV1 | E | DQ265019 | DENV1 | E | EU117305 |
| DENV1 | E | EU448397 | DENV1 | E | FJ850070 | DENV1 | E | EU726781 | DENV1 | E | DQ264927 |
| DENV1 | E | AY732467 | DENV1 | E | FJ024460 | DENV1 | E | AY732444 | DENV1 | E | AB188831 |
| DENV1 | E | FJ461336 | DENV1 | E | AB232666 | DENV1 | E | FJ182035 | DENV1 | E | DQ265046 |
| DENV1 | E | GQ199858 | DENV1 | E | AY732404 | DENV1 | E | FJ882545 | DENV1 | E | DQ264991 |
| DENV1 | E | EU482820 | DENV1 | E | EF508199 | DENV1 | E | DQ264912 | DENV1 | E | FJ898414 |
| DENV1 | E | DQ264889 | DENV1 | E | DQ264907 | DENV1 | E | FJ410222 | DENV1 | E | DQ264971 |
| DENV1 | E | EU482478 | DENV1 | E | GQ868562 | DENV1 | E | EU660401 | DENV1 | E | DQ264955 |
| DENV1 | E | GU131815 | DENV1 | E | AF425611 | DENV1 | E | EF113153 | DENV1 | E | EU482717 |
| DENV1 | E | EU448390 | DENV1 | E | FJ882529 | DENV1 | E | DQ265102 | DENV1 | E | DQ672557 |
| DENV1 | E | GQ199834 | DENV1 | E | FJ639687 | DENV1 | E | FJ639824 | DENV1 | E | GQ199877 |

FIG. 66-23

| Virus Protein | Accession No. | Virus Protein | Accession No. | Virus Protein | Accession No. | Virus Protein | Accession No. |
|---|---|---|---|---|---|---|---|
| DENV1 E | GU131719 | DENV1 E | DQ265041 | DENV1 E | AF425616 | DENV1 E | DQ265072 |
| DENV1 E | EU482817 | DENV1 E | DQ091258 | DENV1 E | EU448394 | DENV1 E | DQ264916 |
| DENV1 E | FJ410254 | DENV1 E | AM746216 | DENV1 E | EU117309 | DENV1 E | DQ265098 |
| DENV1 E | EU482507 | DENV1 E | AY732466 | DENV1 E | EF654105 | DENV1 E | DQ265002 |
| DENV1 E | DQ264974 | DENV1 E | DQ265070 | DENV1 E | DQ264899 | DENV1 E | DQ265132 |
| DENV1 E | DQ265050 | DENV1 E | EU069607 | DENV1 E | AY620952 | DENV1 E | AY732456 |
| DENV1 E | EF654109 | DENV1 E | FJ461303 | DENV1 E | AY620947 | DENV1 E | EU069621 |
| DENV1 E | FJ410274 | DENV1 E | AY732459 | DENV1 E | EU448391 | DENV1 E | D00505 |
| DENV1 E | AB111065 | DENV1 E | DQ265035 | DENV1 E | AY589692 | DENV1 E | EU069596 |
| DENV1 E | FJ898387 | DENV1 E | DQ264924 | DENV1 E | DQ265058 | DENV1 E | EU448405 |
| DENV1 E | GQ868514 | DENV1 E | DQ265081 | DENV1 E | AY780643 | DENV1 E | DQ091273 |
| DENV1 E | GU131705 | DENV1 E | AY732387 | DENV1 E | DQ264942 | DENV1 E | AY732439 |
| DENV1 E | FJ432738 | DENV1 E | FJ687475 | DENV1 E | FJ158609 | DENV1 E | AY732443 |
| DENV1 E | FJ639681 | DENV1 E | AY732452 | DENV1 E | AY277657 | DENV1 E | DQ285552 |
| DENV1 E | EU482513 | DENV1 E | AB111067 | DENV1 E | DQ265065 | DENV1 E | DQ091267 |
| DENV1 E | EU081240 | DENV1 E | DQ265023 | DENV1 E | EU069615 | DENV1 E | AY732424 |
| DENV1 E | AY732448 | DENV1 E | DQ264980 | DENV1 E | DQ265087 | DENV1 E | DQ265121 |
| DENV1 E | EU117307 | DENV1 E | AY422784 | DENV1 E | AF425635 | DENV1 E | DQ091259 |
| DENV1 E | EU069612 | DENV1 E | EU069605 | DENV1 E | EU448402 | DENV1 E | EU069616 |
| DENV1 E | DQ265068 | DENV1 E | DQ264871 | DENV1 E | AY732383 | DENV1 E | DQ265079 |
| DENV1 E | EU069617 | DENV1 E | DQ285549 | DENV1 E | AY871812 | DENV1 E | EU069593 |
| DENV1 E | DQ265031 | DENV1 E | EF113152 | DENV1 E | AJ438941 | DENV1 E | D00503 |
| DENV1 E | AF425610 | DENV1 E | DQ091261 | DENV1 E | DQ264960 | DENV1 E | DQ264883 |
| DENV1 E | EU448396 | DENV1 E | DQ265051 | DENV1 E | AY732396 | DENV1 E | DQ265152 |
| DENV1 E | AY732421 | DENV1 E | AY732460 | DENV1 E | AM746214 | DENV1 E | DQ264965 |
| DENV1 E | EU069604 | DENV1 E | AY732458 | DENV1 E | AB111079 | DENV1 E | AY732400 |
| DENV1 E | EU069613 | DENV1 E | DQ265123 | DENV1 E | AY732381 | DENV1 E | DQ285553 |
| DENV1 E | EF508201 | DENV1 E | DQ264914 | DENV1 E | S64849 | DENV1 E | DQ265053 |
| DENV1 E | DQ265060 | DENV1 E | AY732441 | DENV1 E | DQ341193 | DENV1 E | AY277660 |
| DENV1 E | AB111070 | DENV1 E | DQ265004 | DENV1 E | AM746212 | DENV1 E | AB111064 |
| DENV1 E | AY732428 | DENV1 E | AY732402 | DENV1 E | DQ264884 | DENV1 E | DQ264984 |
| DENV1 E | EU448409 | DENV1 E | AY277663 | DENV1 E | AM746219 | DENV1 E | AY277655 |
| DENV1 E | EU448411 | DENV1 E | DQ265048 | DENV1 E | AY732391 | DENV1 E | EU117308 |
| DENV1 E | AY422782 | DENV1 E | DQ265138 | DENV1 E | AB111069 | DENV1 E | DQ264905 |
| DENV1 E | AF425637 | DENV1 E | DQ264939 | DENV1 E | EU448406 | DENV1 E | DQ265111 |
| DENV1 E | DQ265026 | DENV1 E | DQ265147 | DENV1 E | DQ264937 | DENV1 E | DQ264959 |
| DENV1 E | AY732411 | DENV1 E | AY422777 | DENV1 E | EU448412 | DENV1 E | DQ265063 |
| DENV1 E | AB111077 | DENV1 E | EU448408 | DENV1 E | AY732464 | DENV1 E | EF654108 |
| DENV1 E | AM746220 | DENV1 E | DQ265095 | DENV1 E | DQ265076 | DENV1 E | DQ265089 |
| DENV1 E | DQ091270 | DENV1 E | DQ265148 | DENV1 E | DQ091263 | DENV1 E | AY732454 |
| DENV1 E | AY732435 | DENV1 E | AF425626 | DENV1 E | M23027 | DENV1 E | DQ265085 |
| DENV1 E | AY588273 | DENV1 E | DQ264922 | DENV1 E | DQ265010 | DENV1 E | AF425629 |
| DENV1 E | AY277659 | DENV1 E | DQ091265 | DENV1 E | AF425632 | DENV1 E | AY732412 |
| DENV1 E | DQ264897 | DENV1 E | EF654106 | DENV1 E | EF508206 | DENV1 E | DQ855296 |
| DENV1 E | DQ264874 | DENV1 E | EU117311 | DENV1 E | DQ265083 | DENV1 E | DQ265011 |
| DENV1 E | DQ265074 | DENV1 E | AB111072 | DENV1 E | DQ265020 | DENV1 E | AF425622 |
| DENV1 E | AY732469 | DENV1 E | AY732388 | DENV1 E | AB111074 | DENV1 E | DQ264921 |
| DENV1 E | AY618210 | DENV1 E | AY732472 | DENV1 E | AY732414 | DENV1 E | DQ264892 |

FIG. 66-24

| Virus Protein | Accession No. | Virus Protein | Accession No. | Virus Protein | Accession No. | Virus Protein | Accession No. |
|---|---|---|---|---|---|---|---|
| DENV1 E | DQ264893 | DENV1 E | DQ264954 | DENV1 E | DQ264999 | DENV1 E | EU069614 |
| DENV1 E | DQ265093 | DENV1 E | DQ264913 | DENV1 E | DQ264869 | DENV1 E | DQ264898 |
| DENV1 E | EU069600 | DENV1 E | AF425612 | DENV1 E | DQ264873 | DENV1 E | AY422783 |
| DENV1 E | EU069619 | DENV1 E | DQ264926 | DENV1 E | DQ265080 | DENV1 E | EU069618 |
| DENV1 E | AY618879 | DENV1 E | DQ265045 | DENV1 E | AY732380 | DENV1 E | DQ264936 |
| DENV1 E | DQ264877 | DENV1 E | DQ265137 | DENV1 E | AY732457 | DENV1 E | AY277656 |
| DENV1 E | AY732461 | DENV1 E | DQ264970 | DENV1 E | AY732433 | DENV1 E | DQ265007 |
| DENV1 E | EU448414 | DENV1 E | DQ265018 | DENV1 E | AF425623 | DENV1 E | FJ158612 |
| DENV1 E | DQ264876 | DENV1 E | DQ264967 | DENV1 E | EU448389 | DENV1 E | DQ265075 |
| DENV1 E | DQ264951 | DENV1 E | EU069603 | DENV1 E | DQ264956 | DENV1 E | DQ265069 |
| DENV1 E | AY732432 | DENV1 E | DQ265091 | DENV1 E | DQ264900 | DENV1 E | AM746217 |
| DENV1 E | AF425619 | DENV1 E | DQ265061 | DENV1 E | EU448386 | DENV1 E | AY732378 |
| DENV1 E | AY620950 | DENV1 E | DQ265107 | DENV1 E | EU069606 | DENV1 E | AY732436 |
| DENV1 E | AY732408 | DENV1 E | DQ264868 | DENV1 E | DQ264925 | DENV1 E | DQ264909 |
| DENV1 E | DQ265039 | DENV1 E | X76219 | DENV1 E | DQ265119 | DENV1 E | DQ264949 |
| DENV1 E | D00501 | DENV1 E | AY422779 | DENV1 E | DQ265139 | DENV1 E | DQ264961 |
| DENV1 E | DQ341194 | DENV1 E | DQ264982 | DENV1 E | EU448403 | DENV1 E | AY422786 |
| DENV1 E | FJ158611 | DENV1 E | AY732394 | DENV1 E | DQ264902 | DENV1 E | DQ265073 |
| DENV1 E | AY732385 | DENV1 E | DQ264957 | DENV1 E | DQ265094 | DENV1 E | EU069599 |
| DENV1 E | EU069624 | DENV1 E | AB111075 | DENV1 E | DQ264887 | DENV1 E | DQ264875 |
| DENV1 E | AY732392 | DENV1 E | AY732410 | DENV1 E | DQ211348 | DENV1 E | FJ687476 |
| DENV1 E | AF425636 | DENV1 E | DQ341189 | DENV1 E | DQ264915 | DENV1 E | DQ265022 |
| DENV1 E | DQ264935 | DENV1 E | DQ265128 | DENV1 E | AY277653 | DENV1 E | DQ264891 |
| DENV1 E | EU069601 | DENV1 E | DQ264947 | DENV1 E | EU069622 | DENV1 E | EU069608 |
| DENV1 E | DQ265105 | DENV1 E | AY732427 | DENV1 E | AY732442 | DENV1 E | AY732440 |
| DENV1 E | AY732398 | DENV1 E | DQ091260 | DENV1 E | DQ265013 | DENV1 E | EF079826 |
| DENV1 E | DQ265057 | DENV1 E | EU448398 | DENV1 E | AY732450 | DENV1 E | AY732397 |
| DENV1 E | EF032589 | DENV1 E | AY732434 | DENV1 E | AY277662 | DENV1 E | AY277654 |
| DENV1 E | DQ264908 | DENV1 E | AY732429 | DENV1 E | AF425615 | DENV1 E | DQ091262 |
| DENV1 E | DQ265047 | DENV1 E | DQ265055 | DENV1 E | DQ264931 | DENV1 E | DQ264953 |
| DENV1 E | DQ264928 | DENV1 E | DQ264933 | DENV1 E | AY600860 | DENV1 E | DQ264917 |
| DENV1 E | AF425639 | DENV1 E | AY277658 | DENV1 E | AB188830 | DENV1 E | EF654110 |
| DENV1 E | AY732416 | DENV1 E | DQ264938 | DENV1 E | AY422778 | DENV1 E | EU448413 |
| DENV1 E | DQ091269 | DENV1 E | DQ264940 | DENV1 E | AY732403 | DENV1 E | AY732401 |
| DENV1 E | DQ091271 | DENV1 E | AY732468 | DENV1 E | DQ265049 | DENV1 E | AY732465 |
| DENV1 E | AF425630 | DENV1 E | AY422781 | DENV1 E | DQ265071 | DENV1 E | EU448407 |
| DENV1 E | DQ341188 | DENV1 E | AY620948 | DENV1 E | DQ265030 | DENV1 E | DQ265145 |
| DENV1 E | EU069610 | DENV1 E | AF425624 | DENV1 E | EU448401 | DENV1 E | AB111068 |
| DENV1 E | DQ265101 | DENV1 E | DQ264911 | DENV1 E | EU448395 | DENV1 E | AF425631 |
| DENV1 E | AY732405 | DENV1 E | AY630407 | DENV1 E | AY732473 | DENV1 E | AB111073 |
| DENV1 E | FJ687478 | DENV1 E | EF508204 | DENV1 E | DQ264880 | DENV1 E | AF425620 |
| DENV1 E | AF425614 | DENV1 E | DQ341192 | DENV1 E | AB111066 | DENV1 E | DQ265082 |
| DENV1 E | EU448404 | DENV1 E | AY588272 | DENV1 E | AY732420 | DENV1 E | DQ265005 |
| DENV1 E | EU117304 | DENV1 E | DQ264918 | DENV1 E | AY732451 | DENV1 E | AY732455 |
| DENV1 E | AF425634 | DENV1 E | DQ264870 | DENV1 E | EF508202 | DENV1 E | DQ264973 |
| DENV1 E | DQ264879 | DENV1 E | EF508198 | DENV1 E | AY620946 | DENV1 E | AY732445 |
| DENV1 E | EU448388 | DENV1 E | AY732419 | DENV1 E | DQ265109 | DENV1 E | EF440432 |
| DENV1 E | AY732422 | DENV1 E | DQ264981 | DENV1 E | AF425625 | DENV1 E | EU069598 |

FIG. 66-25

| Virus Protein | Accession No. | Virus Protein | Accession No. | Virus Protein | Accession No. | Virus Protein | Accession No. |
|---|---|---|---|---|---|---|---|
| DENV1 E | DQ264923 | DENV1 E | AB111076 | DENV1 E | AB219136 | DENV1 E | EU069595 |
| DENV1 E | AY732415 | DENV1 E | AY153755 | DENV1 E | DQ265052 | DENV1 E | EU448387 |
| DENV1 E | EF508207 | DENV1 E | AY618211 | DENV1 E | DQ264979 | DENV1 E | DQ264966 |
| DENV1 E | AY732447 | DENV1 E | EF508205 | DENV1 E | EF441282 | DENV1 E | DQ265143 |
| DENV1 E | DQ265077 | DENV1 E | AY732462 | DENV1 E | EU069597 | DENV1 E | AY732418 |
| DENV1 E | DQ264944 | DENV1 E | DQ264952 | DENV1 E | AY780642 | DENV1 E | AY732379 |
| DENV1 E | AM746215 | DENV1 E | DQ855297 | DENV1 E | AY606062 | DENV1 E | DQ265019 |
| DENV1 E | DQ285557 | DENV1 E | AF425618 | DENV1 E | AY732446 | DENV1 E | AY732444 |
| DENV1 E | EU117310 | DENV1 E | AY732463 | DENV1 E | DQ264958 | DENV1 E | DQ264912 |
| DENV1 E | AF425617 | DENV1 E | DQ265064 | DENV1 E | DQ264983 | DENV1 E | EF113153 |
| DENV1 E | EU448393 | DENV1 E | AY618878 | DENV1 E | AF425609 | DENV1 E | DQ265102 |
| DENV1 E | AB111071 | DENV1 E | DQ211349 | DENV1 E | DQ264945 | DENV1 E | AY732449 |
| DENV1 E | AY620953 | DENV1 E | DQ264950 | DENV1 E | AY630408 | DENV1 E | DQ265115 |
| DENV1 E | EF654104 | DENV1 E | D00502 | DENV1 E | AY277661 | DENV1 E | AY620951 |
| DENV1 E | EU117306 | DENV1 E | EU069623 | DENV1 E | AF425621 | DENV1 E | FJ687477 |
| DENV1 E | DQ264989 | DENV1 E | AY732470 | DENV1 E | AY732386 | DENV1 E | AB111078 |
| DENV1 E | EU448392 | DENV1 E | AB003090 | DENV1 E | DQ264904 | DENV1 E | AF425633 |
| DENV1 E | EF508200 | DENV1 E | EU069620 | DENV1 E | AY732409 | DENV1 E | DQ265136 |
| DENV1 E | EU448410 | DENV1 E | DQ341191 | DENV1 E | AY422780 | DENV1 E | AF231721 |
| DENV1 E | EU448400 | DENV1 E | DQ264910 | DENV1 E | DQ265054 | DENV1 E | AY618880 |
| DENV1 E | DQ265156 | DENV1 E | AY732417 | DENV1 E | DQ341190 | DENV1 E | AY732453 |
| DENV1 E | AY732389 | DENV1 E | AY732399 | DENV1 E | AY732431 | DENV1 E | AY277652 |
| DENV1 E | FJ158610 | DENV1 E | AY732407 | DENV1 E | DQ265062 | DENV1 E | EU117305 |
| DENV1 E | AY732425 | DENV1 E | DQ264934 | DENV1 E | AY732413 | DENV1 E | DQ264927 |
| DENV1 E | DQ285554 | DENV1 E | EU282328 | DENV1 E | DQ264946 | DENV1 E | AB188831 |
| DENV1 E | AY732438 | DENV1 E | AM746218 | DENV1 E | DQ264941 | DENV1 E | DQ265046 |
| DENV1 E | DQ264872 | DENV1 E | DQ264886 | DENV1 E | DQ264930 | DENV1 E | DQ264991 |
| DENV1 E | AY618877 | DENV1 E | DQ265088 | DENV1 E | EU448397 | DENV1 E | DQ264971 |
| DENV1 E | AY422785 | DENV1 E | EU069609 | DENV1 E | AY732467 | DENV1 E | DQ264955 |
| DENV1 E | EU117312 | DENV1 E | DQ091266 | DENV1 E | DQ264889 | DENV1 E | DQ264974 |
| DENV1 E | AF425638 | DENV1 E | D00504 | DENV1 E | EU448390 | DENV1 E | DQ265050 |
| DENV1 E | DQ265040 | DENV1 E | EF654107 | DENV1 E | DQ265117 | DENV1 E | EF654109 |
| DENV1 E | AY732382 | DENV1 E | DQ285551 | DENV1 E | EF508203 | DENV1 E | AB111065 |
| DENV1 E | AF425627 | DENV1 E | AY732384 | DENV1 E | DQ091272 | DENV1 E | AY732448 |
| DENV1 E | AY732471 | DENV1 E | AY732437 | DENV1 E | DQ265090 | DENV1 E | EU117307 |
| DENV1 E | DQ265086 | DENV1 E | EU448399 | DENV1 E | DQ264932 | DENV1 E | EU069612 |
| DENV1 E | DQ265056 | DENV1 E | AY732406 | DENV1 E | DQ091268 | DENV1 E | DQ265068 |
| DENV1 E | DQ091264 | DENV1 E | DQ265155 | DENV1 E | AY732395 | DENV1 E | EU069617 |
| DENV1 E | DQ265084 | DENV1 E | DQ265078 | DENV1 E | EU069602 | DENV1 E | DQ265031 |
| DENV1 E | DQ265044 | DENV1 E | DQ264996 | DENV1 E | AB232666 | DENV1 E | AF425610 |
| DENV1 E | AM746213 | DENV1 E | DQ264929 | DENV1 E | AY732404 | DENV1 E | EU448396 |
| DENV1 E | DQ265104 | DENV1 E | AY732430 | DENV1 E | EF508199 | DENV1 E | AY732421 |
| DENV1 E | FJ687474 | DENV1 E | EU069594 | DENV1 E | DQ264907 | DENV1 E | EU069604 |
| DENV1 E | DQ264878 | DENV1 E | AY732423 | DENV1 E | AF425611 | DENV1 E | EU069613 |
| DENV1 E | DQ265092 | DENV1 E | DQ264964 | DENV1 E | AF425613 | DENV1 E | EF508201 |
| DENV1 E | AY732393 | DENV1 E | DQ265066 | DENV1 E | EU069611 | DENV1 E | DQ265060 |
| DENV1 E | AY732390 | DENV1 E | AY732426 | DENV1 E | AY620949 | DENV1 E | AB111070 |
| DENV1 E | AF425628 | DENV1 E | DQ264881 | DENV1 E | D10513 | DENV1 E | AY732428 |

FIG. 66-26

| Virus Protein | Accession No. | Virus Protein | Accession No. | Virus Protein | Accession No. | Virus Protein | Accession No. |
|---|---|---|---|---|---|---|---|
| DENV1 E | EU448409 | DENV1 E | DQ264939 | DENV1 E | EU448412 | DENV1 E | DQ265085 |
| DENV1 E | EU448411 | DENV1 E | DQ265147 | DENV1 E | AY732464 | DENV1 E | AF425629 |
| DENV1 E | AY422782 | DENV1 E | AY422777 | DENV1 E | DQ265076 | DENV1 E | AY732412 |
| DENV1 E | AF425637 | DENV1 E | EU448408 | DENV1 E | DQ091263 | DENV1 E | DQ855296 |
| DENV1 E | DQ265026 | DENV1 E | DQ265095 | DENV1 E | DQ265010 | DENV1 E | DQ265011 |
| DENV1 E | AY732411 | DENV1 E | DQ265148 | DENV1 E | AF425632 | DENV1 E | AF425622 |
| DENV1 E | AB111077 | DENV1 E | AF425626 | DENV1 E | EF508206 | DENV1 E | DQ264921 |
| DENV1 E | AM746220 | DENV1 E | DQ264922 | DENV1 E | DQ265083 | DENV1 E | DQ264892 |
| DENV1 E | DQ091270 | DENV1 E | DQ091265 | DENV1 E | DQ265020 | DENV1 E | DQ264893 |
| DENV1 E | AY732435 | DENV1 E | EF654106 | DENV1 E | AB111074 | DENV1 E | DQ265093 |
| DENV1 E | AY588273 | DENV1 E | EU117311 | DENV1 E | AY732414 | DENV1 E | EU069600 |
| DENV1 E | DQ264897 | DENV1 E | AB111072 | DENV1 E | DQ265072 | DENV1 E | EU069619 |
| DENV1 E | DQ264874 | DENV1 E | AY732388 | DENV1 E | DQ264916 | DENV1 E | AY618879 |
| DENV1 E | DQ265074 | DENV1 E | AY732472 | DENV1 E | DQ265098 | DENV1 E | DQ264877 |
| DENV1 E | AY732469 | DENV1 E | AF425616 | DENV1 E | DQ265002 | DENV1 E | AY732461 |
| DENV1 E | AY618210 | DENV1 E | EU448394 | DENV1 E | DQ265132 | DENV1 E | EU448414 |
| DENV1 E | DQ265041 | DENV1 E | EU117309 | DENV1 E | AY732456 | DENV1 E | DQ264876 |
| DENV1 E | DQ091258 | DENV1 E | EF654105 | DENV1 E | EU069621 | DENV1 E | DQ264951 |
| DENV1 E | AM746216 | DENV1 E | DQ264899 | DENV1 E | D00505 | DENV1 E | AY732432 |
| DENV1 E | AY732466 | DENV1 E | AY620952 | DENV1 E | EU069596 | DENV1 E | AF425619 |
| DENV1 E | DQ265070 | DENV1 E | AY620947 | DENV1 E | EU448405 | DENV1 E | AY620950 |
| DENV1 E | EU069607 | DENV1 E | EU448391 | DENV1 E | DQ091273 | DENV1 E | AY732408 |
| DENV1 E | AY732459 | DENV1 E | AY589692 | DENV1 E | AY732439 | DENV1 E | DQ265039 |
| DENV1 E | DQ265035 | DENV1 E | DQ265058 | DENV1 E | AY732443 | DENV1 E | DQ341194 |
| DENV1 E | DQ264924 | DENV1 E | AY780643 | DENV1 E | DQ285552 | DENV1 E | FJ158611 |
| DENV1 E | DQ265081 | DENV1 E | DQ264942 | DENV1 E | DQ091267 | DENV1 E | AY732385 |
| DENV1 E | AY732387 | DENV1 E | FJ158609 | DENV1 E | AY732424 | DENV1 E | EU069624 |
| DENV1 E | FJ687475 | DENV1 E | DQ265065 | DENV1 E | DQ265121 | DENV1 E | AY732392 |
| DENV1 E | AY732452 | DENV1 E | EU069615 | DENV1 E | DQ091259 | DENV1 E | AF425636 |
| DENV1 E | AB111067 | DENV1 E | DQ265087 | DENV1 E | EU069616 | DENV1 E | DQ264935 |
| DENV1 E | DQ265023 | DENV1 E | AF425635 | DENV1 E | DQ265079 | DENV1 E | EU069601 |
| DENV1 E | DQ264980 | DENV1 E | EU448402 | DENV1 E | EU069593 | DENV1 E | DQ265105 |
| DENV1 E | AY422784 | DENV1 E | AY732383 | DENV1 E | DQ264883 | DENV1 E | AY732398 |
| DENV1 E | EU069605 | DENV1 E | AY871812 | DENV1 E | DQ265152 | DENV1 E | DQ265057 |
| DENV1 E | DQ264871 | DENV1 E | AJ438941 | DENV1 E | DQ264965 | DENV1 E | EF032589 |
| DENV1 E | DQ285549 | DENV1 E | DQ264960 | DENV1 E | AY732400 | DENV1 E | DQ264908 |
| DENV1 E | EF113152 | DENV1 E | AY732396 | DENV1 E | DQ285553 | DENV1 E | DQ265047 |
| DENV1 E | DQ091261 | DENV1 E | AM746214 | DENV1 E | DQ265053 | DENV1 E | DQ264928 |
| DENV1 E | DQ265051 | DENV1 E | AB111079 | DENV1 E | AB111064 | DENV1 E | AF425639 |
| DENV1 E | AY732460 | DENV1 E | AY732381 | DENV1 E | DQ264984 | DENV1 E | AY732416 |
| DENV1 E | AY732458 | DENV1 E | DQ341193 | DENV1 E | EU117308 | DENV1 E | DQ091269 |
| DENV1 E | DQ265123 | DENV1 E | AM746212 | DENV1 E | DQ264905 | DENV1 E | DQ091271 |
| DENV1 E | DQ264914 | DENV1 E | DQ264884 | DENV1 E | DQ265111 | DENV1 E | AF425630 |
| DENV1 E | AY732441 | DENV1 E | AM746219 | DENV1 E | DQ264959 | DENV1 E | DQ341188 |
| DENV1 E | DQ265004 | DENV1 E | AY732391 | DENV1 E | DQ265063 | DENV1 E | EU069610 |
| DENV1 E | AY732402 | DENV1 E | AB111069 | DENV1 E | EF654108 | DENV1 E | DQ265101 |
| DENV1 E | DQ265048 | DENV1 E | EU448406 | DENV1 E | DQ265089 | DENV1 E | AY732405 |
| DENV1 E | DQ265138 | DENV1 E | DQ264937 | DENV1 E | AY732454 | DENV1 E | FJ687478 |

FIG. 66-27

| Virus Protein | Accession No. | Virus Protein | Accession No. | Virus Protein | Accession No. | Virus Protein | Accession No. |
|---|---|---|---|---|---|---|---|
| DENV1 E | AF425614 | DENV1 E | AY588272 | DENV1 E | EF508202 | DENV1 E | EU069598 |
| DENV1 E | EU448404 | DENV1 E | DQ264918 | DENV1 E | AY620946 | DENV1 E | DQ264923 |
| DENV1 E | EU117304 | DENV1 E | DQ264870 | DENV1 E | DQ265109 | DENV1 E | AY732415 |
| DENV1 E | AF425634 | DENV1 E | EF508198 | DENV1 E | AF425625 | DENV1 E | EF508207 |
| DENV1 E | DQ264879 | DENV1 E | AY732419 | DENV1 E | EU069614 | DENV1 E | AY732447 |
| DENV1 E | EU448388 | DENV1 E | DQ264981 | DENV1 E | DQ264898 | DENV1 E | DQ265077 |
| DENV1 E | AY732422 | DENV1 E | DQ264999 | DENV1 E | AY422783 | DENV1 E | DQ264944 |
| DENV1 E | DQ264954 | DENV1 E | DQ264869 | DENV1 E | EU069618 | DENV1 E | AM746215 |
| DENV1 E | DQ264913 | DENV1 E | DQ264873 | DENV1 E | DQ264936 | DENV1 E | DQ285557 |
| DENV1 E | AF425612 | DENV1 E | DQ265080 | DENV1 E | DQ265007 | DENV1 E | EU117310 |
| DENV1 E | DQ264926 | DENV1 E | AY732380 | DENV1 E | FJ158612 | DENV1 E | AF425617 |
| DENV1 E | DQ265045 | DENV1 E | AY732457 | DENV1 E | DQ265075 | DENV1 E | EU448393 |
| DENV1 E | DQ265137 | DENV1 E | AY732433 | DENV1 E | DQ265069 | DENV1 E | AB111071 |
| DENV1 E | DQ264970 | DENV1 E | AF425623 | DENV1 E | AM746217 | DENV1 E | AY620953 |
| DENV1 E | DQ265018 | DENV1 E | EU448389 | DENV1 E | AY732378 | DENV1 E | EF654104 |
| DENV1 E | DQ264967 | DENV1 E | DQ264956 | DENV1 E | AY732436 | DENV1 E | EU117306 |
| DENV1 E | EU069603 | DENV1 E | DQ264900 | DENV1 E | DQ264909 | DENV1 E | DQ264989 |
| DENV1 E | DQ265091 | DENV1 E | EU448386 | DENV1 E | DQ264949 | DENV1 E | EU448392 |
| DENV1 E | DQ265061 | DENV1 E | EU069606 | DENV1 E | DQ264961 | DENV1 E | EF508200 |
| DENV1 E | DQ265107 | DENV1 E | DQ264925 | DENV1 E | AY422786 | DENV1 E | EU448410 |
| DENV1 E | DQ264868 | DENV1 E | DQ265119 | DENV1 E | DQ265073 | DENV1 E | EU448400 |
| DENV1 E | X76219 | DENV1 E | DQ265139 | DENV1 E | EU069599 | DENV1 E | DQ265156 |
| DENV1 E | AY422779 | DENV1 E | EU448403 | DENV1 E | DQ264875 | DENV1 E | AY732389 |
| DENV1 E | DQ264982 | DENV1 E | DQ264902 | DENV1 E | FJ687476 | DENV1 E | FJ158610 |
| DENV1 E | AY732394 | DENV1 E | DQ265094 | DENV1 E | DQ265022 | DENV1 E | AY732425 |
| DENV1 E | DQ264957 | DENV1 E | DQ264887 | DENV1 E | DQ264891 | DENV1 E | DQ285554 |
| DENV1 E | AB111075 | DENV1 E | DQ211348 | DENV1 E | EU069608 | DENV1 E | AY732438 |
| DENV1 E | AY732410 | DENV1 E | DQ264915 | DENV1 E | AY732440 | DENV1 E | DQ264872 |
| DENV1 E | DQ341189 | DENV1 E | EU069622 | DENV1 E | EF079826 | DENV1 E | AY618877 |
| DENV1 E | DQ265128 | DENV1 E | AY732442 | DENV1 E | AY732397 | DENV1 E | AY422785 |
| DENV1 E | DQ264947 | DENV1 E | DQ265013 | DENV1 E | DQ091262 | DENV1 E | EU117312 |
| DENV1 E | AY732427 | DENV1 E | AY732450 | DENV1 E | DQ264953 | DENV1 E | AF425638 |
| DENV1 E | DQ091260 | DENV1 E | AF425615 | DENV1 E | DQ264917 | DENV1 E | DQ265040 |
| DENV1 E | EU448398 | DENV1 E | DQ264931 | DENV1 E | EF654110 | DENV1 E | AY732382 |
| DENV1 E | AY732434 | DENV1 E | AY600860 | DENV1 E | EU448413 | DENV1 E | AF425627 |
| DENV1 E | AY732429 | DENV1 E | AB188830 | DENV1 E | AY732401 | DENV1 E | AY732471 |
| DENV1 E | DQ265055 | DENV1 E | AY422778 | DENV1 E | AY732465 | DENV1 E | DQ265086 |
| DENV1 E | DQ264933 | DENV1 E | AY732403 | DENV1 E | EU448407 | DENV1 E | DQ265056 |
| DENV1 E | DQ264938 | DENV1 E | DQ265049 | DENV1 E | DQ265145 | DENV1 E | DQ091264 |
| DENV1 E | DQ264940 | DENV1 E | DQ265071 | DENV1 E | AB111068 | DENV1 E | DQ265084 |
| DENV1 E | AY732468 | DENV1 E | DQ265030 | DENV1 E | AF425631 | DENV1 E | DQ265044 |
| DENV1 E | AY422781 | DENV1 E | EU448401 | DENV1 E | AB111073 | DENV1 E | AM746213 |
| DENV1 E | AY620948 | DENV1 E | EU448395 | DENV1 E | AF425620 | DENV1 E | DQ265104 |
| DENV1 E | AF425624 | DENV1 E | AY732473 | DENV1 E | DQ265082 | DENV1 E | FJ687474 |
| DENV1 E | DQ264911 | DENV1 E | DQ264880 | DENV1 E | DQ265005 | DENV1 E | DQ264878 |
| DENV1 E | AY630407 | DENV1 E | AB111066 | DENV1 E | AY732455 | DENV1 E | DQ265092 |
| DENV1 E | EF508204 | DENV1 E | AY732420 | DENV1 E | DQ264973 | DENV1 E | AY732393 |
| DENV1 E | DQ341192 | DENV1 E | AY732451 | DENV1 E | AY732445 | DENV1 E | AY732390 |

FIG. 66-28

| Virus Protein | Accession No. | Virus Protein | Accession No. | Virus Protein | Accession No. | Virus Protein | Accession No. |
|---|---|---|---|---|---|---|---|
| DENV1 E | AF425628 | DENV1 E | AB219136 | DENV1 E | EU448387 | DENV1 E | AY422782 |
| DENV1 E | AB111076 | DENV1 E | DQ265052 | DENV1 E | DQ264966 | DENV1 E | AF425637 |
| DENV1 E | AY153755 | DENV1 E | DQ264979 | DENV1 E | DQ265143 | DENV1 E | DQ265026 |
| DENV1 E | AY618211 | DENV1 E | EF441282 | DENV1 E | AY732418 | DENV1 E | AY732411 |
| DENV1 E | EF508205 | DENV1 E | EU069597 | DENV1 E | AY732379 | DENV1 E | AB111077 |
| DENV1 E | AY732462 | DENV1 E | AY780642 | DENV1 E | DQ265019 | DENV1 E | AM746220 |
| DENV1 E | DQ264952 | DENV1 E | AY606062 | DENV1 E | AY732444 | DENV1 E | DQ091270 |
| DENV1 E | DQ855297 | DENV1 E | AY732446 | DENV1 E | DQ264912 | DENV1 E | AY732435 |
| DENV1 E | AF425618 | DENV1 E | DQ264958 | DENV1 E | EF113153 | DENV1 E | AY588273 |
| DENV1 E | AY732463 | DENV1 E | DQ264983 | DENV1 E | DQ265102 | DENV1 E | DQ264897 |
| DENV1 E | DQ265064 | DENV1 E | AF425609 | DENV1 E | AY732449 | DENV1 E | DQ264874 |
| DENV1 E | AY618878 | DENV1 E | DQ264945 | DENV1 E | DQ265115 | DENV1 E | DQ265074 |
| DENV1 E | DQ211349 | DENV1 E | AY630408 | DENV1 E | AY620951 | DENV1 E | AY732469 |
| DENV1 E | DQ264950 | DENV1 E | AF425621 | DENV1 E | FJ687477 | DENV1 E | AY618210 |
| DENV1 E | EU069623 | DENV1 E | AY732386 | DENV1 E | AB111078 | DENV1 E | DQ265041 |
| DENV1 E | AY732470 | DENV1 E | DQ264904 | DENV1 E | AF425633 | DENV1 E | DQ091258 |
| DENV1 E | AB003090 | DENV1 E | AY732409 | DENV1 E | DQ265136 | DENV1 E | AM746216 |
| DENV1 E | EU069620 | DENV1 E | AY422780 | DENV1 E | AF231721 | DENV1 E | AY732466 |
| DENV1 E | DQ341191 | DENV1 E | DQ265054 | DENV1 E | AY618880 | DENV1 E | DQ265070 |
| DENV1 E | DQ264910 | DENV1 E | DQ341190 | DENV1 E | AY732453 | DENV1 E | EU069607 |
| DENV1 E | AY732417 | DENV1 E | AY732431 | DENV1 E | EU117305 | DENV1 E | AY732459 |
| DENV1 E | AY732399 | DENV1 E | DQ265062 | DENV1 E | DQ264927 | DENV1 E | DQ265035 |
| DENV1 E | AY732407 | DENV1 E | AY732413 | DENV1 E | AB188831 | DENV1 E | DQ264924 |
| DENV1 E | DQ264934 | DENV1 E | DQ264946 | DENV1 E | DQ265046 | DENV1 E | DQ265081 |
| DENV1 E | EU282328 | DENV1 E | DQ264941 | DENV1 E | DQ264991 | DENV1 E | AY732387 |
| DENV1 E | AM746218 | DENV1 E | DQ264930 | DENV1 E | DQ264971 | DENV1 E | FJ687475 |
| DENV1 E | DQ264886 | DENV1 E | EU448397 | DENV1 E | DQ264955 | DENV1 E | AY732452 |
| DENV1 E | DQ265088 | DENV1 E | AY732467 | DENV1 E | DQ264974 | DENV1 E | AB111067 |
| DENV1 E | EU069609 | DENV1 E | DQ264889 | DENV1 E | DQ265050 | DENV1 E | DQ265023 |
| DENV1 E | DQ091266 | DENV1 E | EU448390 | DENV1 E | EF654109 | DENV1 E | DQ264980 |
| DENV1 E | D00504 | DENV1 E | DQ265117 | DENV1 E | AB111065 | DENV1 E | AY422784 |
| DENV1 E | EF654107 | DENV1 E | EF508203 | DENV1 E | AY732448 | DENV1 E | EU069605 |
| DENV1 E | DQ285551 | DENV1 E | DQ091272 | DENV1 E | EU117307 | DENV1 E | DQ264871 |
| DENV1 E | AY732384 | DENV1 E | DQ265090 | DENV1 E | EU069612 | DENV1 E | DQ285549 |
| DENV1 E | AY732437 | DENV1 E | DQ264932 | DENV1 E | DQ265068 | DENV1 E | EF113152 |
| DENV1 E | EU448399 | DENV1 E | DQ091268 | DENV1 E | EU069617 | DENV1 E | DQ091261 |
| DENV1 E | AY732406 | DENV1 E | AY732395 | DENV1 E | DQ265031 | DENV1 E | DQ265051 |
| DENV1 E | DQ265155 | DENV1 E | EU069602 | DENV1 E | AF425610 | DENV1 E | AY732460 |
| DENV1 E | DQ265078 | DENV1 E | AB232666 | DENV1 E | EU448396 | DENV1 E | AY732458 |
| DENV1 E | DQ264996 | DENV1 E | AY732404 | DENV1 E | AY732421 | DENV1 E | DQ265123 |
| DENV1 E | DQ264929 | DENV1 E | EF508199 | DENV1 E | EU069604 | DENV1 E | DQ264914 |
| DENV1 E | AY732430 | DENV1 E | DQ264907 | DENV1 E | EU069613 | DENV1 E | AY732441 |
| DENV1 E | EU069594 | DENV1 E | AF425611 | DENV1 E | EF508201 | DENV1 E | DQ265004 |
| DENV1 E | AY732423 | DENV1 E | AF425613 | DENV1 E | DQ265060 | DENV1 E | AY732402 |
| DENV1 E | DQ264964 | DENV1 E | EU069611 | DENV1 E | AB111070 | DENV1 E | DQ265048 |
| DENV1 E | DQ265066 | DENV1 E | AY620949 | DENV1 E | AY732428 | DENV1 E | DQ265138 |
| DENV1 E | AY732426 | DENV1 E | D10513 | DENV1 E | EU448409 | DENV1 E | DQ264939 |
| DENV1 E | DQ264881 | DENV1 E | EU069595 | DENV1 E | EU448411 | DENV1 E | DQ265147 |

FIG. 66-29

| Virus Protein | Accession No. | Virus Protein | Accession No. | Virus Protein | Accession No. | Virus Protein | Accession No. |
|---|---|---|---|---|---|---|---|
| DENV1 E | AY422777 | DENV1 E | DQ265076 | DENV1 E | AY732412 | DENV1 E | EU117304 |
| DENV1 E | EU448408 | DENV1 E | DQ091263 | DENV1 E | DQ855296 | DENV1 E | AF425634 |
| DENV1 E | DQ265095 | DENV1 E | DQ265010 | DENV1 E | DQ265011 | DENV1 E | DQ264879 |
| DENV1 E | DQ265148 | DENV1 E | AF425632 | DENV1 E | AF425622 | DENV1 E | EU448388 |
| DENV1 E | AF425626 | DENV1 E | EF508206 | DENV1 E | DQ264921 | DENV1 E | AY732422 |
| DENV1 E | DQ264922 | DENV1 E | DQ265083 | DENV1 E | DQ264892 | DENV1 E | DQ264954 |
| DENV1 E | DQ091265 | DENV1 E | DQ265020 | DENV1 E | DQ264893 | DENV1 E | DQ264913 |
| DENV1 E | EF654106 | DENV1 E | AB111074 | DENV1 E | DQ265093 | DENV1 E | AF425612 |
| DENV1 E | EU117311 | DENV1 E | AY732414 | DENV1 E | EU069600 | DENV1 E | DQ264926 |
| DENV1 E | AB111072 | DENV1 E | DQ265072 | DENV1 E | EU069619 | DENV1 E | DQ265045 |
| DENV1 E | AY732388 | DENV1 E | DQ264916 | DENV1 E | AY618879 | DENV1 E | DQ265137 |
| DENV1 E | AY732472 | DENV1 E | DQ265098 | DENV1 E | DQ264877 | DENV1 E | DQ264970 |
| DENV1 E | AF425616 | DENV1 E | DQ265002 | DENV1 E | AY732461 | DENV1 E | DQ265018 |
| DENV1 E | EU448394 | DENV1 E | DQ265132 | DENV1 E | EU448414 | DENV1 E | DQ264967 |
| DENV1 E | EU117309 | DENV1 E | AY732456 | DENV1 E | DQ264876 | DENV1 E | EU069603 |
| DENV1 E | EF654105 | DENV1 E | EU069621 | DENV1 E | DQ264951 | DENV1 E | DQ265091 |
| DENV1 E | DQ264899 | DENV1 E | D00505 | DENV1 E | AY732432 | DENV1 E | DQ265061 |
| DENV1 E | AY620952 | DENV1 E | EU069596 | DENV1 E | AF425619 | DENV1 E | DQ265107 |
| DENV1 E | AY620947 | DENV1 E | EU448405 | DENV1 E | AY620950 | DENV1 E | DQ264868 |
| DENV1 E | EU448391 | DENV1 E | DQ091273 | DENV1 E | AY732408 | DENV1 E | X76219 |
| DENV1 E | AY589692 | DENV1 E | AY732439 | DENV1 E | DQ265039 | DENV1 E | AY422779 |
| DENV1 E | DQ265058 | DENV1 E | AY732443 | DENV1 E | DQ341194 | DENV1 E | DQ264982 |
| DENV1 E | AY780643 | DENV1 E | DQ285552 | DENV1 E | FJ158611 | DENV1 E | AY732394 |
| DENV1 E | DQ264942 | DENV1 E | DQ091267 | DENV1 E | AY732385 | DENV1 E | DQ264957 |
| DENV1 E | FJ158609 | DENV1 E | AY732424 | DENV1 E | EU069624 | DENV1 E | AB111075 |
| DENV1 E | DQ265065 | DENV1 E | DQ265121 | DENV1 E | AY732392 | DENV1 E | AY732410 |
| DENV1 E | EU069615 | DENV1 E | DQ091259 | DENV1 E | AF425636 | DENV1 E | DQ341189 |
| DENV1 E | DQ265087 | DENV1 E | EU069616 | DENV1 E | DQ264935 | DENV1 E | DQ265128 |
| DENV1 E | AF425635 | DENV1 E | DQ265079 | DENV1 E | EU069601 | DENV1 E | DQ264947 |
| DENV1 E | EU448402 | DENV1 E | EU069593 | DENV1 E | DQ265105 | DENV1 E | AY732427 |
| DENV1 E | AY732383 | DENV1 E | DQ264883 | DENV1 E | AY732398 | DENV1 E | DQ091260 |
| DENV1 E | AY871812 | DENV1 E | DQ265152 | DENV1 E | DQ265057 | DENV1 E | EU448398 |
| DENV1 E | AJ438941 | DENV1 E | DQ264965 | DENV1 E | EF032589 | DENV1 E | AY732434 |
| DENV1 E | DQ264960 | DENV1 E | AY732400 | DENV1 E | DQ264908 | DENV1 E | AY732429 |
| DENV1 E | AY732396 | DENV1 E | DQ285553 | DENV1 E | DQ265047 | DENV1 E | DQ265055 |
| DENV1 E | AM746214 | DENV1 E | DQ265053 | DENV1 E | DQ264928 | DENV1 E | DQ264933 |
| DENV1 E | AB111079 | DENV1 E | AB111064 | DENV1 E | AF425639 | DENV1 E | DQ264938 |
| DENV1 E | AY732381 | DENV1 E | DQ264984 | DENV1 E | AY732416 | DENV1 E | DQ264940 |
| DENV1 E | DQ341193 | DENV1 E | EU117308 | DENV1 E | DQ091269 | DENV1 E | AY732468 |
| DENV1 E | AM746212 | DENV1 E | DQ264905 | DENV1 E | DQ091271 | DENV1 E | AY422781 |
| DENV1 E | DQ264884 | DENV1 E | DQ265111 | DENV1 E | AF425630 | DENV1 E | AY620948 |
| DENV1 E | AM746219 | DENV1 E | DQ264959 | DENV1 E | DQ341188 | DENV1 E | AF425624 |
| DENV1 E | AY732391 | DENV1 E | DQ265063 | DENV1 E | EU069610 | DENV1 E | DQ264911 |
| DENV1 E | AB111069 | DENV1 E | EF654108 | DENV1 E | DQ265101 | DENV1 E | AY630407 |
| DENV1 E | EU448406 | DENV1 E | DQ265089 | DENV1 E | AY732405 | DENV1 E | EF508204 |
| DENV1 E | DQ264937 | DENV1 E | AY732454 | DENV1 E | FJ687478 | DENV1 E | DQ341192 |
| DENV1 E | EU448412 | DENV1 E | DQ265085 | DENV1 E | AF425614 | DENV1 E | AY588272 |
| DENV1 E | AY732464 | DENV1 E | AF425629 | DENV1 E | EU448404 | DENV1 E | DQ264918 |

FIG. 66-30

| Virus Protein | Accession No. | Virus Protein | Accession No. | Virus Protein | Accession No. | Virus Protein | Accession No. |
|---|---|---|---|---|---|---|---|
| DENV1 E | DQ264870 | DENV1 E | DQ265109 | DENV1 E | AY732415 | DENV1 E | AY153755 |
| DENV1 E | EF508198 | DENV1 E | AF425625 | DENV1 E | EF508207 | DENV1 E | AY618211 |
| DENV1 E | AY732419 | DENV1 E | EU069614 | DENV1 E | AY732447 | DENV1 E | EF508205 |
| DENV1 E | DQ264981 | DENV1 E | DQ264898 | DENV1 E | DQ265077 | DENV1 E | AY732462 |
| DENV1 E | DQ264999 | DENV1 E | AY422783 | DENV1 E | DQ264944 | DENV1 E | DQ264952 |
| DENV1 E | DQ264869 | DENV1 E | EU069618 | DENV1 E | AM746215 | DENV1 E | DQ855297 |
| DENV1 E | DQ264873 | DENV1 E | DQ264936 | DENV1 E | DQ285557 | DENV1 E | AF425618 |
| DENV1 E | DQ265080 | DENV1 E | DQ265007 | DENV1 E | EU117310 | DENV1 E | AY732463 |
| DENV1 E | AY732380 | DENV1 E | FJ158612 | DENV1 E | AF425617 | DENV1 E | DQ265064 |
| DENV1 E | AY732457 | DENV1 E | DQ265075 | DENV1 E | EU448393 | DENV1 E | AY618878 |
| DENV1 E | AY732433 | DENV1 E | DQ265069 | DENV1 E | AB111071 | DENV1 E | DQ211349 |
| DENV1 E | AF425623 | DENV1 E | AM746217 | DENV1 E | AY620953 | DENV1 E | DQ264950 |
| DENV1 E | EU448389 | DENV1 E | AY732378 | DENV1 E | EF654104 | DENV1 E | EU069623 |
| DENV1 E | DQ264956 | DENV1 E | AY732436 | DENV1 E | EU117306 | DENV1 E | AY732470 |
| DENV1 E | DQ264900 | DENV1 E | DQ264909 | DENV1 E | DQ264989 | DENV1 E | AB003090 |
| DENV1 E | EU448386 | DENV1 E | DQ264949 | DENV1 E | EU448392 | DENV1 E | EU069620 |
| DENV1 E | EU069606 | DENV1 E | DQ264961 | DENV1 E | EF508200 | DENV1 E | DQ341191 |
| DENV1 E | DQ264925 | DENV1 E | AY422786 | DENV1 E | EU448410 | DENV1 E | DQ264910 |
| DENV1 E | DQ265119 | DENV1 E | DQ265073 | DENV1 E | EU448400 | DENV1 E | AY732417 |
| DENV1 E | DQ265139 | DENV1 E | EU069599 | DENV1 E | DQ265156 | DENV1 E | AY732399 |
| DENV1 E | EU448403 | DENV1 E | DQ264875 | DENV1 E | AY732389 | DENV1 E | AY732407 |
| DENV1 E | DQ264902 | DENV1 E | FJ687476 | DENV1 E | FJ158610 | DENV1 E | DQ264934 |
| DENV1 E | DQ265094 | DENV1 E | DQ265022 | DENV1 E | AY732425 | DENV1 E | EU282328 |
| DENV1 E | DQ264887 | DENV1 E | DQ264891 | DENV1 E | DQ285554 | DENV1 E | AM746218 |
| DENV1 E | DQ211348 | DENV1 E | EU069608 | DENV1 E | AY732438 | DENV1 E | DQ264886 |
| DENV1 E | DQ264915 | DENV1 E | AY732440 | DENV1 E | DQ264872 | DENV1 E | DQ265088 |
| DENV1 E | EU069622 | DENV1 E | EF079826 | DENV1 E | AY618877 | DENV1 E | EU069609 |
| DENV1 E | AY732442 | DENV1 E | AY732397 | DENV1 E | AY422785 | DENV1 E | DQ091266 |
| DENV1 E | DQ265013 | DENV1 E | DQ091262 | DENV1 E | EU117312 | DENV1 E | D00504 |
| DENV1 E | AY732450 | DENV1 E | DQ264953 | DENV1 E | AF425638 | DENV1 E | EF654107 |
| DENV1 E | AF425615 | DENV1 E | DQ264917 | DENV1 E | DQ265040 | DENV1 E | DQ285551 |
| DENV1 E | DQ264931 | DENV1 E | EF654110 | DENV1 E | AY732382 | DENV1 E | AY732384 |
| DENV1 E | AY600860 | DENV1 E | EU448413 | DENV1 E | AF425627 | DENV1 E | AY732437 |
| DENV1 E | AB188830 | DENV1 E | AY732401 | DENV1 E | AY732471 | DENV1 E | EU448399 |
| DENV1 E | AY422778 | DENV1 E | AY732465 | DENV1 E | DQ265086 | DENV1 E | AY732406 |
| DENV1 E | AY732403 | DENV1 E | EU448407 | DENV1 E | DQ265056 | DENV1 E | DQ265155 |
| DENV1 E | DQ265049 | DENV1 E | DQ265145 | DENV1 E | DQ091264 | DENV1 E | DQ265078 |
| DENV1 E | DQ265071 | DENV1 E | AB111068 | DENV1 E | DQ265084 | DENV1 E | DQ264996 |
| DENV1 E | DQ265030 | DENV1 E | AF425631 | DENV1 E | DQ265044 | DENV1 E | DQ264929 |
| DENV1 E | EU448401 | DENV1 E | AB111073 | DENV1 E | AM746213 | DENV1 E | AY732430 |
| DENV1 E | EU448395 | DENV1 E | AF425620 | DENV1 E | DQ265104 | DENV1 E | EU069594 |
| DENV1 E | AY732473 | DENV1 E | DQ265082 | DENV1 E | FJ687474 | DENV1 E | AY732423 |
| DENV1 E | DQ264880 | DENV1 E | DQ265005 | DENV1 E | DQ264878 | DENV1 E | DQ264964 |
| DENV1 E | AB111066 | DENV1 E | AY732455 | DENV1 E | DQ265092 | DENV1 E | DQ265066 |
| DENV1 E | AY732420 | DENV1 E | DQ264973 | DENV1 E | AY732393 | DENV1 E | AY732426 |
| DENV1 E | AY732451 | DENV1 E | AY732445 | DENV1 E | AY732390 | DENV1 E | DQ264881 |
| DENV1 E | EF508202 | DENV1 E | EU069598 | DENV1 E | AF425628 | DENV1 E | AB219136 |
| DENV1 E | AY620946 | DENV1 E | DQ264923 | DENV1 E | AB111076 | DENV1 E | DQ265052 |

FIG. 66-31

| Virus Protein | Accession No. | Virus Protein | Accession No. | Virus Protein | Accession No. | Virus Protein | Accession No. |
|---|---|---|---|---|---|---|---|
| DENV1 E | DQ264979 | DENV1 E | DQ265143 | DENV1 E | DQ265026 | DENV1 E | DQ265095 |
| DENV1 E | EF441282 | DENV1 E | AY732418 | DENV1 E | AY732411 | DENV1 E | DQ265148 |
| DENV1 E | EU069597 | DENV1 E | AY732379 | DENV1 E | AB111077 | DENV1 E | AF425626 |
| DENV1 E | AY780642 | DENV1 E | DQ265019 | DENV1 E | AM746220 | DENV1 E | DQ264922 |
| DENV1 E | AY606062 | DENV1 E | AY732444 | DENV1 E | DQ091270 | DENV1 E | DQ091265 |
| DENV1 E | AY732446 | DENV1 E | DQ264912 | DENV1 E | AY732435 | DENV1 E | EF654106 |
| DENV1 E | DQ264958 | DENV1 E | EF113153 | DENV1 E | AY588273 | DENV1 E | EU117311 |
| DENV1 E | DQ264983 | DENV1 E | DQ265102 | DENV1 E | DQ264897 | DENV1 E | AB111072 |
| DENV1 E | AF425609 | DENV1 E | AY732449 | DENV1 E | DQ264874 | DENV1 E | AY732388 |
| DENV1 E | DQ264945 | DENV1 E | DQ265115 | DENV1 E | DQ265074 | DENV1 E | AY732472 |
| DENV1 E | AY630408 | DENV1 E | AY620951 | DENV1 E | AY732469 | DENV1 E | AF425616 |
| DENV1 E | AF425621 | DENV1 E | FJ687477 | DENV1 E | AY618210 | DENV1 E | EU448394 |
| DENV1 E | AY732386 | DENV1 E | AB111078 | DENV1 E | DQ265041 | DENV1 E | EU117309 |
| DENV1 E | DQ264904 | DENV1 E | AF425633 | DENV1 E | DQ091258 | DENV1 E | EF654105 |
| DENV1 E | AY732409 | DENV1 E | DQ265136 | DENV1 E | AM746216 | DENV1 E | DQ264899 |
| DENV1 E | AY422780 | DENV1 E | AF231721 | DENV1 E | AY732466 | DENV1 E | AY620952 |
| DENV1 E | DQ265054 | DENV1 E | AY618880 | DENV1 E | DQ265070 | DENV1 E | AY620947 |
| DENV1 E | DQ341190 | DENV1 E | AY732453 | DENV1 E | EU069607 | DENV1 E | EU448391 |
| DENV1 E | AY732431 | DENV1 E | EU117305 | DENV1 E | AY732459 | DENV1 E | AY589692 |
| DENV1 E | DQ265062 | DENV1 E | DQ264927 | DENV1 E | DQ265035 | DENV1 E | DQ265058 |
| DENV1 E | AY732413 | DENV1 E | AB188831 | DENV1 E | DQ264924 | DENV1 E | AY780643 |
| DENV1 E | DQ264946 | DENV1 E | DQ265046 | DENV1 E | DQ265081 | DENV1 E | DQ264942 |
| DENV1 E | DQ264941 | DENV1 E | DQ264991 | DENV1 E | AY732387 | DENV1 E | FJ158609 |
| DENV1 E | DQ264930 | DENV1 E | DQ264971 | DENV1 E | FJ687475 | DENV1 E | DQ265065 |
| DENV1 E | EU448397 | DENV1 E | DQ264955 | DENV1 E | AY732452 | DENV1 E | EU069615 |
| DENV1 E | AY732467 | DENV1 E | DQ264974 | DENV1 E | AB111067 | DENV1 E | DQ265087 |
| DENV1 E | DQ264889 | DENV1 E | DQ265050 | DENV1 E | DQ265023 | DENV1 E | AF425635 |
| DENV1 E | EU448390 | DENV1 E | EF654109 | DENV1 E | DQ264980 | DENV1 E | EU448402 |
| DENV1 E | DQ265117 | DENV1 E | AB111065 | DENV1 E | AY422784 | DENV1 E | AY732383 |
| DENV1 E | EF508203 | DENV1 E | AY732448 | DENV1 E | EU069605 | DENV1 E | AY871812 |
| DENV1 E | DQ091272 | DENV1 E | EU117307 | DENV1 E | DQ264871 | DENV1 E | AJ438941 |
| DENV1 E | DQ265090 | DENV1 E | EU069612 | DENV1 E | DQ285549 | DENV1 E | DQ264960 |
| DENV1 E | DQ264932 | DENV1 E | DQ265068 | DENV1 E | EF113152 | DENV1 E | AY732396 |
| DENV1 E | DQ091268 | DENV1 E | EU069617 | DENV1 E | DQ091261 | DENV1 E | AM746214 |
| DENV1 E | AY732395 | DENV1 E | DQ265031 | DENV1 E | DQ265051 | DENV1 E | AB111079 |
| DENV1 E | EU069602 | DENV1 E | AF425610 | DENV1 E | AY732460 | DENV1 E | AY732381 |
| DENV1 E | AB232666 | DENV1 E | EU448396 | DENV1 E | AY732458 | DENV1 E | DQ341193 |
| DENV1 E | AY732404 | DENV1 E | AY732421 | DENV1 E | DQ265123 | DENV1 E | AM746212 |
| DENV1 E | EF508199 | DENV1 E | EU069604 | DENV1 E | DQ264914 | DENV1 E | DQ264884 |
| DENV1 E | DQ264907 | DENV1 E | EU069613 | DENV1 E | AY732441 | DENV1 E | AM746219 |
| DENV1 E | AF425611 | DENV1 E | EF508201 | DENV1 E | DQ265004 | DENV1 E | AY732391 |
| DENV1 E | AF425613 | DENV1 E | DQ265060 | DENV1 E | AY732402 | DENV1 E | AB111069 |
| DENV1 E | EU069611 | DENV1 E | AB111070 | DENV1 E | DQ265048 | DENV1 E | EU448406 |
| DENV1 E | AY620949 | DENV1 E | AY732428 | DENV1 E | DQ265138 | DENV1 E | DQ264937 |
| DENV1 E | D10513 | DENV1 E | EU448409 | DENV1 E | DQ264939 | DENV1 E | EU448412 |
| DENV1 E | EU069595 | DENV1 E | EU448411 | DENV1 E | DQ265147 | DENV1 E | AY732464 |
| DENV1 E | EU448387 | DENV1 E | AY422782 | DENV1 E | AY422777 | DENV1 E | DQ265076 |
| DENV1 E | DQ264966 | DENV1 E | AF425637 | DENV1 E | EU448408 | DENV1 E | DQ091263 |

FIG. 66-32

| Virus Protein | Accession No. | Virus Protein | Accession No. | Virus Protein | Accession No. | Virus Protein | Accession No. |
|---|---|---|---|---|---|---|---|
| DENV1 E | DQ265010 | DENV1 E | DQ265011 | DENV1 E | DQ264879 | DENV1 E | AY732419 |
| DENV1 E | AF425632 | DENV1 E | AF425622 | DENV1 E | EU448388 | DENV1 E | DQ264981 |
| DENV1 E | EF508206 | DENV1 E | DQ264921 | DENV1 E | AY732422 | DENV1 E | DQ264999 |
| DENV1 E | DQ265083 | DENV1 E | DQ264892 | DENV1 E | DQ264954 | DENV1 E | DQ264869 |
| DENV1 E | DQ265020 | DENV1 E | DQ264893 | DENV1 E | DQ264913 | DENV1 E | DQ264873 |
| DENV1 E | AB111074 | DENV1 E | DQ265093 | DENV1 E | AF425612 | DENV1 E | DQ265080 |
| DENV1 E | AY732414 | DENV1 E | EU069600 | DENV1 E | DQ264926 | DENV1 E | AY732380 |
| DENV1 E | DQ265072 | DENV1 E | EU069619 | DENV1 E | DQ265045 | DENV1 E | AY732457 |
| DENV1 E | DQ264916 | DENV1 E | AY618879 | DENV1 E | DQ265137 | DENV1 E | AY732433 |
| DENV1 E | DQ265098 | DENV1 E | DQ264877 | DENV1 E | DQ264970 | DENV1 E | AF425623 |
| DENV1 E | DQ265002 | DENV1 E | AY732461 | DENV1 E | DQ265018 | DENV1 E | EU448389 |
| DENV1 E | DQ265132 | DENV1 E | EU448414 | DENV1 E | DQ264967 | DENV1 E | DQ264956 |
| DENV1 E | AY732456 | DENV1 E | DQ264876 | DENV1 E | EU069603 | DENV1 E | DQ264900 |
| DENV1 E | EU069621 | DENV1 E | DQ264951 | DENV1 E | DQ265091 | DENV1 E | EU448386 |
| DENV1 E | D00505 | DENV1 E | AY732432 | DENV1 E | DQ265061 | DENV1 E | EU069606 |
| DENV1 E | EU069596 | DENV1 E | AF425619 | DENV1 E | DQ265107 | DENV1 E | DQ264925 |
| DENV1 E | EU448405 | DENV1 E | AY620950 | DENV1 E | DQ264868 | DENV1 E | DQ265119 |
| DENV1 E | DQ091273 | DENV1 E | AY732408 | DENV1 E | X76219 | DENV1 E | DQ265139 |
| DENV1 E | AY732439 | DENV1 E | DQ265039 | DENV1 E | AY422779 | DENV1 E | EU448403 |
| DENV1 E | AY732443 | DENV1 E | DQ341194 | DENV1 E | DQ264982 | DENV1 E | DQ264902 |
| DENV1 E | DQ285552 | DENV1 E | FJ158611 | DENV1 E | AY732394 | DENV1 E | DQ265094 |
| DENV1 E | DQ091267 | DENV1 E | AY732385 | DENV1 E | DQ264957 | DENV1 E | DQ264887 |
| DENV1 E | AY732424 | DENV1 E | EU069624 | DENV1 E | AB111075 | DENV1 E | DQ211348 |
| DENV1 E | DQ265121 | DENV1 E | AY732392 | DENV1 E | AY732410 | DENV1 E | DQ264915 |
| DENV1 E | DQ091259 | DENV1 E | AF425636 | DENV1 E | DQ341189 | DENV1 E | EU069622 |
| DENV1 E | EU069616 | DENV1 E | DQ264935 | DENV1 E | DQ265128 | DENV1 E | AY732442 |
| DENV1 E | DQ265079 | DENV1 E | EU069601 | DENV1 E | DQ264947 | DENV1 E | DQ265013 |
| DENV1 E | EU069593 | DENV1 E | DQ265105 | DENV1 E | AY732427 | DENV1 E | AY732450 |
| DENV1 E | DQ264883 | DENV1 E | AY732398 | DENV1 E | DQ091260 | DENV1 E | AF425615 |
| DENV1 E | DQ265152 | DENV1 E | DQ265057 | DENV1 E | EU448398 | DENV1 E | DQ264931 |
| DENV1 E | DQ264965 | DENV1 E | EF032589 | DENV1 E | AY732434 | DENV1 E | AY600860 |
| DENV1 E | AY732400 | DENV1 E | DQ264908 | DENV1 E | AY732429 | DENV1 E | AB188830 |
| DENV1 E | DQ285553 | DENV1 E | DQ265047 | DENV1 E | DQ265055 | DENV1 E | AY422778 |
| DENV1 E | DQ265053 | DENV1 E | DQ264928 | DENV1 E | DQ264933 | DENV1 E | AY732403 |
| DENV1 E | AB111064 | DENV1 E | AF425639 | DENV1 E | DQ264938 | DENV1 E | DQ265049 |
| DENV1 E | DQ264984 | DENV1 E | AY732416 | DENV1 E | DQ264940 | DENV1 E | DQ265071 |
| DENV1 E | EU117308 | DENV1 E | DQ091269 | DENV1 E | AY732468 | DENV1 E | DQ265030 |
| DENV1 E | DQ264905 | DENV1 E | DQ091271 | DENV1 E | AY422781 | DENV1 E | EU448401 |
| DENV1 E | DQ265111 | DENV1 E | AF425630 | DENV1 E | AY620948 | DENV1 E | EU448395 |
| DENV1 E | DQ264959 | DENV1 E | DQ341188 | DENV1 E | AF425624 | DENV1 E | AY732473 |
| DENV1 E | DQ265063 | DENV1 E | EU069610 | DENV1 E | DQ264911 | DENV1 E | DQ264880 |
| DENV1 E | EF654108 | DENV1 E | DQ265101 | DENV1 E | AY630407 | DENV1 E | AB111066 |
| DENV1 E | DQ265089 | DENV1 E | AY732405 | DENV1 E | EF508204 | DENV1 E | AY732420 |
| DENV1 E | AY732454 | DENV1 E | FJ687478 | DENV1 E | DQ341192 | DENV1 E | AY732451 |
| DENV1 E | DQ265085 | DENV1 E | AF425614 | DENV1 E | AY588272 | DENV1 E | EF508202 |
| DENV1 E | AF425629 | DENV1 E | EU448404 | DENV1 E | DQ264918 | DENV1 E | AY620946 |
| DENV1 E | AY732412 | DENV1 E | EU117304 | DENV1 E | DQ264870 | DENV1 E | DQ265109 |
| DENV1 E | DQ855296 | DENV1 E | AF425634 | DENV1 E | EF508198 | DENV1 E | AF425625 |

FIG. 66-33

| Virus Protein | Accession No. | Virus Protein | Accession No. | Virus Protein | Accession No. | Virus Protein | Accession No. |
|---|---|---|---|---|---|---|---|
| DENV1 E | EU069614 | DENV1 E | AY732447 | DENV1 E | EF508205 | DENV1 E | AY780642 |
| DENV1 E | DQ264898 | DENV1 E | DQ265077 | DENV1 E | AY732462 | DENV1 E | AY606062 |
| DENV1 E | AY422783 | DENV1 E | DQ264944 | DENV1 E | DQ264952 | DENV1 E | AY732446 |
| DENV1 E | EU069618 | DENV1 E | AM746215 | DENV1 E | DQ855297 | DENV1 E | DQ264958 |
| DENV1 E | DQ264936 | DENV1 E | DQ285557 | DENV1 E | AF425618 | DENV1 E | DQ264983 |
| DENV1 E | DQ265007 | DENV1 E | EU117310 | DENV1 E | AY732463 | DENV1 E | AF425609 |
| DENV1 E | FJ158612 | DENV1 E | AF425617 | DENV1 E | DQ265064 | DENV1 E | DQ264945 |
| DENV1 E | DQ265075 | DENV1 E | EU448393 | DENV1 E | AY618878 | DENV1 E | AY630408 |
| DENV1 E | DQ265069 | DENV1 E | AB111071 | DENV1 E | DQ211349 | DENV1 E | AF425621 |
| DENV1 E | AM746217 | DENV1 E | AY620953 | DENV1 E | DQ264950 | DENV1 E | AY732386 |
| DENV1 E | AY732378 | DENV1 E | EF654104 | DENV1 E | EU069623 | DENV1 E | DQ264904 |
| DENV1 E | AY732436 | DENV1 E | EU117306 | DENV1 E | AY732470 | DENV1 E | AY732409 |
| DENV1 E | DQ264909 | DENV1 E | DQ264989 | DENV1 E | AB003090 | DENV1 E | AY422780 |
| DENV1 E | DQ264949 | DENV1 E | EU448392 | DENV1 E | EU069620 | DENV1 E | DQ265054 |
| DENV1 E | DQ264961 | DENV1 E | EF508200 | DENV1 E | DQ341191 | DENV1 E | DQ341190 |
| DENV1 E | AY422786 | DENV1 E | EU448410 | DENV1 E | DQ264910 | DENV1 E | AY732431 |
| DENV1 E | DQ265073 | DENV1 E | EU448400 | DENV1 E | AY732417 | DENV1 E | DQ265062 |
| DENV1 E | EU069599 | DENV1 E | DQ265156 | DENV1 E | AY732399 | DENV1 E | AY732413 |
| DENV1 E | DQ264875 | DENV1 E | AY732389 | DENV1 E | AY732407 | DENV1 E | DQ264946 |
| DENV1 E | FJ687476 | DENV1 E | FJ158610 | DENV1 E | DQ264934 | DENV1 E | DQ264941 |
| DENV1 E | DQ265022 | DENV1 E | AY732425 | DENV1 E | EU282328 | DENV1 E | DQ264930 |
| DENV1 E | DQ264891 | DENV1 E | DQ285554 | DENV1 E | AM746218 | DENV1 E | EU448397 |
| DENV1 E | EU069608 | DENV1 E | AY732438 | DENV1 E | DQ264886 | DENV1 E | AY732467 |
| DENV1 E | AY732440 | DENV1 E | DQ264872 | DENV1 E | DQ265088 | DENV1 E | DQ264889 |
| DENV1 E | EF079826 | DENV1 E | AY618877 | DENV1 E | EU069609 | DENV1 E | EU448390 |
| DENV1 E | AY732397 | DENV1 E | AY422785 | DENV1 E | DQ091266 | DENV1 E | DQ265117 |
| DENV1 E | DQ091262 | DENV1 E | EU117312 | DENV1 E | D00504 | DENV1 E | EF508203 |
| DENV1 E | DQ264953 | DENV1 E | AF425638 | DENV1 E | EF654107 | DENV1 E | DQ091272 |
| DENV1 E | DQ264917 | DENV1 E | DQ265040 | DENV1 E | DQ285551 | DENV1 E | DQ265090 |
| DENV1 E | EF654110 | DENV1 E | AY732382 | DENV1 E | AY732384 | DENV1 E | DQ264932 |
| DENV1 E | EU448413 | DENV1 E | AF425627 | DENV1 E | AY732437 | DENV1 E | DQ091268 |
| DENV1 E | AY732401 | DENV1 E | AY732471 | DENV1 E | EU448399 | DENV1 E | AY732395 |
| DENV1 E | AY732465 | DENV1 E | DQ265086 | DENV1 E | AY732406 | DENV1 E | EU069602 |
| DENV1 E | EU448407 | DENV1 E | DQ265056 | DENV1 E | DQ265155 | DENV1 E | AB232666 |
| DENV1 E | DQ265145 | DENV1 E | DQ091264 | DENV1 E | DQ265078 | DENV1 E | AY732404 |
| DENV1 E | AB111068 | DENV1 E | DQ265084 | DENV1 E | DQ264996 | DENV1 E | EF508199 |
| DENV1 E | AF425631 | DENV1 E | DQ265044 | DENV1 E | DQ264929 | DENV1 E | DQ264907 |
| DENV1 E | AB111073 | DENV1 E | AM746213 | DENV1 E | AY732430 | DENV1 E | AF425611 |
| DENV1 E | AF425620 | DENV1 E | DQ265104 | DENV1 E | EU069594 | DENV1 E | AF425613 |
| DENV1 E | DQ265082 | DENV1 E | FJ687474 | DENV1 E | AY732423 | DENV1 E | EU069611 |
| DENV1 E | DQ265005 | DENV1 E | DQ264878 | DENV1 E | DQ264964 | DENV1 E | AY620949 |
| DENV1 E | AY732455 | DENV1 E | DQ265092 | DENV1 E | DQ265066 | DENV1 E | D10513 |
| DENV1 E | DQ264973 | DENV1 E | AY732393 | DENV1 E | AY732426 | DENV1 E | EU069595 |
| DENV1 E | AY732445 | DENV1 E | AY732390 | DENV1 E | DQ264881 | DENV1 E | EU448387 |
| DENV1 E | EU069598 | DENV1 E | AF425628 | DENV1 E | AB219136 | DENV1 E | DQ264966 |
| DENV1 E | DQ264923 | DENV1 E | AB111076 | DENV1 E | DQ265052 | DENV1 E | DQ265143 |
| DENV1 E | AY732415 | DENV1 E | AY153755 | DENV1 E | DQ264979 | DENV1 E | AY732418 |
| DENV1 E | EF508207 | DENV1 E | AY618211 | DENV1 E | EU069597 | DENV1 E | AY732379 |

FIG. 66-34

| Virus Protein | Accession No. | Virus Protein | Accession No. | Virus Protein | Accession No. | Virus Protein | Accession No. |
|---|---|---|---|---|---|---|---|
| DENV1 E | DQ265019 | DENV1 E | AM746220 | DENV1 E | DQ264922 | DENV1 E | DQ265083 |
| DENV1 E | AY732444 | DENV1 E | DQ091270 | DENV1 E | DQ091265 | DENV1 E | DQ265020 |
| DENV1 E | DQ264912 | DENV1 E | AY732435 | DENV1 E | EF654106 | DENV1 E | AB111074 |
| DENV1 E | EF113153 | DENV1 E | AY588273 | DENV1 E | EU117311 | DENV1 E | AY732414 |
| DENV1 E | DQ265102 | DENV1 E | DQ264897 | DENV1 E | AB111072 | DENV1 E | DQ265072 |
| DENV1 E | AY732449 | DENV1 E | DQ264874 | DENV1 E | AY732388 | DENV1 E | DQ264916 |
| DENV1 E | DQ265115 | DENV1 E | DQ265074 | DENV1 E | AY732472 | DENV1 E | DQ265098 |
| DENV1 E | AY620951 | DENV1 E | AY732469 | DENV1 E | AF425616 | DENV1 E | DQ265002 |
| DENV1 E | FJ687477 | DENV1 E | AY618210 | DENV1 E | EU448394 | DENV1 E | DQ265132 |
| DENV1 E | AB111078 | DENV1 E | DQ265041 | DENV1 E | EU117309 | DENV1 E | AY732456 |
| DENV1 E | AF425633 | DENV1 E | DQ091258 | DENV1 E | EF654105 | DENV1 E | EU069621 |
| DENV1 E | DQ265136 | DENV1 E | AM746216 | DENV1 E | DQ264899 | DENV1 E | D00505 |
| DENV1 E | AF231721 | DENV1 E | AY732466 | DENV1 E | AY620952 | DENV1 E | EU069596 |
| DENV1 E | AY618880 | DENV1 E | DQ265070 | DENV1 E | AY620947 | DENV1 E | EU448405 |
| DENV1 E | AY732453 | DENV1 E | EU069607 | DENV1 E | EU448391 | DENV1 E | DQ091273 |
| DENV1 E | EU117305 | DENV1 E | AY732459 | DENV1 E | AY589692 | DENV1 E | AY732439 |
| DENV1 E | DQ264927 | DENV1 E | DQ265035 | DENV1 E | DQ265058 | DENV1 E | AY732443 |
| DENV1 E | AB188831 | DENV1 E | DQ264924 | DENV1 E | AY780643 | DENV1 E | DQ285552 |
| DENV1 E | DQ265046 | DENV1 E | DQ265081 | DENV1 E | DQ264942 | DENV1 E | DQ091267 |
| DENV1 E | DQ264991 | DENV1 E | AY732387 | DENV1 E | FJ158609 | DENV1 E | AY732424 |
| DENV1 E | DQ264971 | DENV1 E | FJ687475 | DENV1 E | DQ265065 | DENV1 E | DQ265121 |
| DENV1 E | DQ264955 | DENV1 E | AY732452 | DENV1 E | EU069615 | DENV1 E | DQ091259 |
| DENV1 E | DQ264974 | DENV1 E | AB111067 | DENV1 E | DQ265087 | DENV1 E | EU069616 |
| DENV1 E | DQ265050 | DENV1 E | DQ265023 | DENV1 E | AF425635 | DENV1 E | DQ265079 |
| DENV1 E | EF654109 | DENV1 E | DQ264980 | DENV1 E | EU448402 | DENV1 E | EU069593 |
| DENV1 E | AB111065 | DENV1 E | AY422784 | DENV1 E | AY732383 | DENV1 E | DQ264883 |
| DENV1 E | AY732448 | DENV1 E | EU069605 | DENV1 E | AY871812 | DENV1 E | DQ265152 |
| DENV1 E | EU117307 | DENV1 E | DQ264871 | DENV1 E | AJ438941 | DENV1 E | DQ264965 |
| DENV1 E | EU069612 | DENV1 E | DQ285549 | DENV1 E | DQ264960 | DENV1 E | AY732400 |
| DENV1 E | DQ265068 | DENV1 E | EF113152 | DENV1 E | AY732396 | DENV1 E | DQ285553 |
| DENV1 E | EU069617 | DENV1 E | DQ091261 | DENV1 E | AM746214 | DENV1 E | DQ265053 |
| DENV1 E | DQ265031 | DENV1 E | DQ265051 | DENV1 E | AB111079 | DENV1 E | AB111064 |
| DENV1 E | AF425610 | DENV1 E | AY732460 | DENV1 E | AY732381 | DENV1 E | DQ264984 |
| DENV1 E | EU448396 | DENV1 E | AY732458 | DENV1 E | DQ341193 | DENV1 E | EU117308 |
| DENV1 E | AY732421 | DENV1 E | DQ265123 | DENV1 E | AM746212 | DENV1 E | DQ264905 |
| DENV1 E | EU069604 | DENV1 E | DQ264914 | DENV1 E | DQ264884 | DENV1 E | DQ265111 |
| DENV1 E | EU069613 | DENV1 E | AY732441 | DENV1 E | AM746219 | DENV1 E | DQ264959 |
| DENV1 E | EF508201 | DENV1 E | DQ265004 | DENV1 E | AY732391 | DENV1 E | DQ265063 |
| DENV1 E | DQ265060 | DENV1 E | AY732402 | DENV1 E | AB111069 | DENV1 E | EF654108 |
| DENV1 E | AB111070 | DENV1 E | DQ265048 | DENV1 E | EU448406 | DENV1 E | DQ265089 |
| DENV1 E | AY732428 | DENV1 E | DQ265138 | DENV1 E | DQ264937 | DENV1 E | AY732454 |
| DENV1 E | EU448409 | DENV1 E | DQ264939 | DENV1 E | EU448412 | DENV1 E | DQ265085 |
| DENV1 E | EU448411 | DENV1 E | DQ265147 | DENV1 E | AY732464 | DENV1 E | AF425629 |
| DENV1 E | AY422782 | DENV1 E | AY422777 | DENV1 E | DQ265076 | DENV1 E | AY732412 |
| DENV1 E | AF425637 | DENV1 E | EU448408 | DENV1 E | DQ091263 | DENV1 E | DQ855296 |
| DENV1 E | DQ265026 | DENV1 E | DQ265095 | DENV1 E | DQ265010 | DENV1 E | DQ265011 |
| DENV1 E | AY732411 | DENV1 E | DQ265148 | DENV1 E | AF425632 | DENV1 E | AF425622 |
| DENV1 E | AB111077 | DENV1 E | AF425626 | DENV1 E | EF508206 | DENV1 E | DQ264921 |

FIG. 66-35

| Virus Protein | Accession No. | Virus Protein | Accession No. | Virus Protein | Accession No. | Virus Protein | Accession No. |
|---|---|---|---|---|---|---|---|
| DENV1 E | DQ264892 | DENV1 E | DQ264954 | DENV1 E | DQ264869 | DENV1 E | EU069618 |
| DENV1 E | DQ264893 | DENV1 E | DQ264913 | DENV1 E | DQ264873 | DENV1 E | DQ264936 |
| DENV1 E | DQ265093 | DENV1 E | AF425612 | DENV1 E | DQ265080 | DENV1 E | DQ265007 |
| DENV1 E | EU069600 | DENV1 E | DQ264926 | DENV1 E | AY732380 | DENV1 E | FJ158612 |
| DENV1 E | EU069619 | DENV1 E | DQ265045 | DENV1 E | AY732457 | DENV1 E | DQ265075 |
| DENV1 E | AY618879 | DENV1 E | DQ265137 | DENV1 E | AY732433 | DENV1 E | DQ265069 |
| DENV1 E | DQ264877 | DENV1 E | DQ264970 | DENV1 E | AF425623 | DENV1 E | AM746217 |
| DENV1 E | AY732461 | DENV1 E | DQ265018 | DENV1 E | EU448389 | DENV1 E | AY732378 |
| DENV1 E | EU448414 | DENV1 E | DQ264967 | DENV1 E | DQ264956 | DENV1 E | AY732436 |
| DENV1 E | DQ264876 | DENV1 E | EU069603 | DENV1 E | DQ264900 | DENV1 E | DQ264909 |
| DENV1 E | DQ264951 | DENV1 E | DQ265091 | DENV1 E | EU448386 | DENV1 E | DQ264949 |
| DENV1 E | AY732432 | DENV1 E | DQ265061 | DENV1 E | EU069606 | DENV1 E | DQ264961 |
| DENV1 E | AF425619 | DENV1 E | DQ265107 | DENV1 E | DQ264925 | DENV1 E | AY422786 |
| DENV1 E | AY620950 | DENV1 E | DQ264868 | DENV1 E | DQ265119 | DENV1 E | DQ265073 |
| DENV1 E | AY732408 | DENV1 E | X76219 | DENV1 E | DQ265139 | DENV1 E | EU069599 |
| DENV1 E | DQ265039 | DENV1 E | AY422779 | DENV1 E | EU448403 | DENV1 E | DQ264875 |
| DENV1 E | DQ341194 | DENV1 E | DQ264982 | DENV1 E | DQ264902 | DENV1 E | FJ687476 |
| DENV1 E | FJ158611 | DENV1 E | AY732394 | DENV1 E | DQ265094 | DENV1 E | DQ265022 |
| DENV1 E | AY732385 | DENV1 E | DQ264957 | DENV1 E | DQ264887 | DENV1 E | DQ264891 |
| DENV1 E | EU069624 | DENV1 E | AB111075 | DENV1 E | DQ211348 | DENV1 E | EU069608 |
| DENV1 E | AY732392 | DENV1 E | AY732410 | DENV1 E | DQ264915 | DENV1 E | AY732440 |
| DENV1 E | AF425636 | DENV1 E | DQ341189 | DENV1 E | EU069622 | DENV1 E | EF079826 |
| DENV1 E | DQ264935 | DENV1 E | DQ265128 | DENV1 E | AY732442 | DENV1 E | AY732397 |
| DENV1 E | EU069601 | DENV1 E | DQ264947 | DENV1 E | DQ265013 | DENV1 E | DQ091262 |
| DENV1 E | DQ265105 | DENV1 E | AY732427 | DENV1 E | AY732450 | DENV1 E | DQ264953 |
| DENV1 E | AY732398 | DENV1 E | DQ091260 | DENV1 E | AF425615 | DENV1 E | DQ264917 |
| DENV1 E | DQ265057 | DENV1 E | EU448398 | DENV1 E | DQ264931 | DENV1 E | EF654110 |
| DENV1 E | EF032589 | DENV1 E | AY732434 | DENV1 E | AY600860 | DENV1 E | EU448413 |
| DENV1 E | DQ264908 | DENV1 E | AY732429 | DENV1 E | AB188830 | DENV1 E | AY732401 |
| DENV1 E | DQ265047 | DENV1 E | DQ265055 | DENV1 E | AY422778 | DENV1 E | AY732465 |
| DENV1 E | DQ264928 | DENV1 E | DQ264933 | DENV1 E | AY732403 | DENV1 E | EU448407 |
| DENV1 E | AF425639 | DENV1 E | DQ264938 | DENV1 E | DQ265049 | DENV1 E | DQ265145 |
| DENV1 E | AY732416 | DENV1 E | DQ264940 | DENV1 E | DQ265071 | DENV1 E | AB111068 |
| DENV1 E | DQ091269 | DENV1 E | AY732468 | DENV1 E | DQ265030 | DENV1 E | AF425631 |
| DENV1 E | DQ091271 | DENV1 E | AY422781 | DENV1 E | EU448401 | DENV1 E | AB111073 |
| DENV1 E | AF425630 | DENV1 E | AY620948 | DENV1 E | EU448395 | DENV1 E | AF425620 |
| DENV1 E | DQ341188 | DENV1 E | AF425624 | DENV1 E | AY732473 | DENV1 E | DQ265082 |
| DENV1 E | EU069610 | DENV1 E | DQ264911 | DENV1 E | DQ264880 | DENV1 E | DQ265005 |
| DENV1 E | DQ265101 | DENV1 E | AY630407 | DENV1 E | AB111066 | DENV1 E | AY732455 |
| DENV1 E | AY732405 | DENV1 E | EF508204 | DENV1 E | AY732420 | DENV1 E | DQ264973 |
| DENV1 E | FJ687478 | DENV1 E | DQ341192 | DENV1 E | AY732451 | DENV1 E | AY732445 |
| DENV1 E | AF425614 | DENV1 E | AY588272 | DENV1 E | EF508202 | DENV1 E | EU069598 |
| DENV1 E | EU448404 | DENV1 E | DQ264918 | DENV1 E | AY620946 | DENV1 E | DQ264923 |
| DENV1 E | EU117304 | DENV1 E | DQ264870 | DENV1 E | DQ265109 | DENV1 E | AY732415 |
| DENV1 E | AF425634 | DENV1 E | EF508198 | DENV1 E | AF425625 | DENV1 E | EF508207 |
| DENV1 E | DQ264879 | DENV1 E | AY732419 | DENV1 E | EU069614 | DENV1 E | AY732447 |
| DENV1 E | EU448388 | DENV1 E | DQ264981 | DENV1 E | DQ264898 | DENV1 E | DQ265077 |
| DENV1 E | AY732422 | DENV1 E | DQ264999 | DENV1 E | AY422783 | DENV1 E | DQ264944 |

FIG. 66-36

| Virus Protein | Accession No. | Virus Protein | Accession No. | Virus Protein | Accession No. | Virus Protein | Accession No. |
|---|---|---|---|---|---|---|---|
| DENV1 E | AM746215 | DENV1 E | DQ855297 | DENV1 E | DQ264958 | DENV1 E | EF113153 |
| DENV1 E | DQ285557 | DENV1 E | AF425618 | DENV1 E | DQ264983 | DENV1 E | DQ265102 |
| DENV1 E | EU117310 | DENV1 E | AY732463 | DENV1 E | AF425609 | DENV1 E | AY732449 |
| DENV1 E | AF425617 | DENV1 E | DQ265064 | DENV1 E | DQ264945 | DENV1 E | DQ265115 |
| DENV1 E | EU448393 | DENV1 E | AY618878 | DENV1 E | AY630408 | DENV1 E | AY620951 |
| DENV1 E | AB111071 | DENV1 E | DQ211349 | DENV1 E | AF425621 | DENV1 E | FJ687477 |
| DENV1 E | AY620953 | DENV1 E | DQ264950 | DENV1 E | AY732386 | DENV1 E | AB111078 |
| DENV1 E | EF654104 | DENV1 E | EU069623 | DENV1 E | DQ264904 | DENV1 E | AF425633 |
| DENV1 E | EU117306 | DENV1 E | AY732470 | DENV1 E | AY732409 | DENV1 E | DQ265136 |
| DENV1 E | DQ264989 | DENV1 E | AB003090 | DENV1 E | AY422780 | DENV1 E | AF231721 |
| DENV1 E | EU448392 | DENV1 E | EU069620 | DENV1 E | DQ265054 | DENV1 E | AY618880 |
| DENV1 E | EF508200 | DENV1 E | DQ341191 | DENV1 E | DQ341190 | DENV1 E | AY732453 |
| DENV1 E | EU448410 | DENV1 E | DQ264910 | DENV1 E | AY732431 | DENV1 E | EU117305 |
| DENV1 E | EU448400 | DENV1 E | AY732417 | DENV1 E | DQ265062 | DENV1 E | DQ264927 |
| DENV1 E | DQ265156 | DENV1 E | AY732399 | DENV1 E | AY732413 | DENV1 E | AB188831 |
| DENV1 E | AY732389 | DENV1 E | AY732407 | DENV1 E | DQ264946 | DENV1 E | DQ265046 |
| DENV1 E | FJ158610 | DENV1 E | DQ264934 | DENV1 E | DQ264941 | DENV1 E | DQ264991 |
| DENV1 E | AY732425 | DENV1 E | EU282328 | DENV1 E | DQ264930 | DENV1 E | DQ264971 |
| DENV1 E | DQ285554 | DENV1 E | AM746218 | DENV1 E | EU448397 | DENV1 E | DQ264955 |
| DENV1 E | AY732438 | DENV1 E | DQ264886 | DENV1 E | AY732467 | DENV1 E | DQ264974 |
| DENV1 E | DQ264872 | DENV1 E | DQ265088 | DENV1 E | DQ264889 | DENV1 E | DQ265050 |
| DENV1 E | AY618877 | DENV1 E | EU069609 | DENV1 E | EU448390 | DENV1 E | EF654109 |
| DENV1 E | AY422785 | DENV1 E | DQ091266 | DENV1 E | DQ265117 | DENV1 E | AB111065 |
| DENV1 E | EU117312 | DENV1 E | D00504 | DENV1 E | EF508203 | DENV1 E | AY732448 |
| DENV1 E | AF425638 | DENV1 E | EF654107 | DENV1 E | DQ091272 | DENV1 E | EU117307 |
| DENV1 E | DQ265040 | DENV1 E | DQ285551 | DENV1 E | DQ265090 | DENV1 E | EU069612 |
| DENV1 E | AY732382 | DENV1 E | AY732384 | DENV1 E | DQ264932 | DENV1 E | DQ265068 |
| DENV1 E | AF425627 | DENV1 E | AY732437 | DENV1 E | DQ091268 | DENV1 E | EU069617 |
| DENV1 E | AY732471 | DENV1 E | EU448399 | DENV1 E | AY732395 | DENV1 E | DQ265031 |
| DENV1 E | DQ265086 | DENV1 E | AY732406 | DENV1 E | EU069602 | DENV1 E | AF425610 |
| DENV1 E | DQ265056 | DENV1 E | DQ265155 | DENV1 E | AB232666 | DENV1 E | EU448396 |
| DENV1 E | DQ091264 | DENV1 E | DQ265078 | DENV1 E | AY732404 | DENV1 E | AY732421 |
| DENV1 E | DQ265084 | DENV1 E | DQ264996 | DENV1 E | EF508199 | DENV1 E | EU069604 |
| DENV1 E | DQ265044 | DENV1 E | DQ264929 | DENV1 E | DQ264907 | DENV1 E | EU069613 |
| DENV1 E | AM746213 | DENV1 E | AY732430 | DENV1 E | AF425611 | DENV1 E | EF508201 |
| DENV1 E | DQ265104 | DENV1 E | EU069594 | DENV1 E | AF425613 | DENV1 E | DQ265060 |
| DENV1 E | FJ687474 | DENV1 E | AY732423 | DENV1 E | EU069611 | DENV1 E | AB111070 |
| DENV1 E | DQ264878 | DENV1 E | DQ264964 | DENV1 E | AY620949 | DENV1 E | AY732428 |
| DENV1 E | DQ265092 | DENV1 E | DQ265066 | DENV1 E | D10513 | DENV1 E | EU448409 |
| DENV1 E | AY732393 | DENV1 E | AY732426 | DENV1 E | EU069595 | DENV1 E | EU448411 |
| DENV1 E | AY732390 | DENV1 E | DQ264881 | DENV1 E | EU448387 | DENV1 E | AY422782 |
| DENV1 E | AF425628 | DENV1 E | AB219136 | DENV1 E | DQ264966 | DENV1 E | AF425637 |
| DENV1 E | AB111076 | DENV1 E | DQ265052 | DENV1 E | DQ265143 | DENV1 E | DQ265026 |
| DENV1 E | AY153755 | DENV1 E | DQ264979 | DENV1 E | AY732418 | DENV1 E | AY732411 |
| DENV1 E | AY618211 | DENV1 E | EU069597 | DENV1 E | AY732379 | DENV1 E | AB111077 |
| DENV1 E | EF508205 | DENV1 E | AY780642 | DENV1 E | DQ265019 | DENV1 E | AM746220 |
| DENV1 E | AY732462 | DENV1 E | AY606062 | DENV1 E | AY732444 | DENV1 E | DQ091270 |
| DENV1 E | DQ264952 | DENV1 E | AY732446 | DENV1 E | DQ264912 | DENV1 E | AY732435 |

FIG. 66-37

| Virus Protein | Accession No. | Virus Protein | Accession No. | Virus Protein | Accession No. | Virus Protein | Accession No. |
|---|---|---|---|---|---|---|---|
| DENV1 E | AY588273 | DENV1 E | EU117311 | DENV1 E | AY732414 | DENV1 E | EU069600 |
| DENV1 E | DQ264897 | DENV1 E | AB111072 | DENV1 E | DQ265072 | DENV1 E | EU069619 |
| DENV1 E | DQ264874 | DENV1 E | AY732388 | DENV1 E | DQ264916 | DENV1 E | AY618879 |
| DENV1 E | DQ265074 | DENV1 E | AY732472 | DENV1 E | DQ265098 | DENV1 E | DQ264877 |
| DENV1 E | AY732469 | DENV1 E | AF425616 | DENV1 E | DQ265002 | DENV1 E | AY732461 |
| DENV1 E | AY618210 | DENV1 E | EU448394 | DENV1 E | DQ265132 | DENV1 E | EU448414 |
| DENV1 E | DQ265041 | DENV1 E | EU117309 | DENV1 E | AY732456 | DENV1 E | DQ264876 |
| DENV1 E | DQ091258 | DENV1 E | EF654105 | DENV1 E | EU069621 | DENV1 E | DQ264951 |
| DENV1 E | AM746216 | DENV1 E | DQ264899 | DENV1 E | D00505 | DENV1 E | AY732432 |
| DENV1 E | AY732466 | DENV1 E | AY620952 | DENV1 E | EU069596 | DENV1 E | AF425619 |
| DENV1 E | DQ265070 | DENV1 E | AY620947 | DENV1 E | EU448405 | DENV1 E | AY620950 |
| DENV1 E | EU069607 | DENV1 E | EU448391 | DENV1 E | DQ091273 | DENV1 E | AY732408 |
| DENV1 E | AY732459 | DENV1 E | AY589692 | DENV1 E | AY732439 | DENV1 E | DQ265039 |
| DENV1 E | DQ265035 | DENV1 E | DQ265058 | DENV1 E | AY732443 | DENV1 E | DQ341194 |
| DENV1 E | DQ264924 | DENV1 E | AY780643 | DENV1 E | DQ285552 | DENV1 E | FJ158611 |
| DENV1 E | DQ265081 | DENV1 E | DQ264942 | DENV1 E | DQ091267 | DENV1 E | AY732385 |
| DENV1 E | AY732387 | DENV1 E | FJ158609 | DENV1 E | AY732424 | DENV1 E | EU069624 |
| DENV1 E | FJ687475 | DENV1 E | DQ265065 | DENV1 E | DQ265121 | DENV1 E | AY732392 |
| DENV1 E | AY732452 | DENV1 E | EU069615 | DENV1 E | DQ091259 | DENV1 E | AF425636 |
| DENV1 E | AB111067 | DENV1 E | DQ265087 | DENV1 E | EU069616 | DENV1 E | DQ264935 |
| DENV1 E | DQ265023 | DENV1 E | AF425635 | DENV1 E | DQ265079 | DENV1 E | EU069601 |
| DENV1 E | DQ264980 | DENV1 E | EU448402 | DENV1 E | EU069593 | DENV1 E | DQ265105 |
| DENV1 E | AY422784 | DENV1 E | AY732383 | DENV1 E | DQ264883 | DENV1 E | AY732398 |
| DENV1 E | EU069605 | DENV1 E | AY871812 | DENV1 E | DQ265152 | DENV1 E | DQ265057 |
| DENV1 E | DQ264871 | DENV1 E | AJ438941 | DENV1 E | DQ264965 | DENV1 E | DQ264908 |
| DENV1 E | DQ285549 | DENV1 E | DQ264960 | DENV1 E | AY732400 | DENV1 E | DQ265047 |
| DENV1 E | EF113152 | DENV1 E | AY732396 | DENV1 E | DQ285553 | DENV1 E | DQ264928 |
| DENV1 E | DQ091261 | DENV1 E | AM746214 | DENV1 E | DQ265053 | DENV1 E | AF425639 |
| DENV1 E | DQ265051 | DENV1 E | AB111079 | DENV1 E | AB111064 | DENV1 E | AY732416 |
| DENV1 E | AY732460 | DENV1 E | AY732381 | DENV1 E | DQ264984 | DENV1 E | DQ091269 |
| DENV1 E | AY732458 | DENV1 E | DQ341193 | DENV1 E | EU117308 | DENV1 E | DQ091271 |
| DENV1 E | DQ265123 | DENV1 E | AM746212 | DENV1 E | DQ264905 | DENV1 E | AF425630 |
| DENV1 E | DQ264914 | DENV1 E | DQ264884 | DENV1 E | DQ265111 | DENV1 E | DQ341188 |
| DENV1 E | AY732441 | DENV1 E | AM746219 | DENV1 E | DQ264959 | DENV1 E | EU069610 |
| DENV1 E | DQ265004 | DENV1 E | AY732391 | DENV1 E | DQ265063 | DENV1 E | DQ265101 |
| DENV1 E | AY732402 | DENV1 E | AB111069 | DENV1 E | EF654108 | DENV1 E | AY732405 |
| DENV1 E | DQ265048 | DENV1 E | EU448406 | DENV1 E | DQ265089 | DENV1 E | FJ687478 |
| DENV1 E | DQ265138 | DENV1 E | DQ264937 | DENV1 E | AY732454 | DENV1 E | AF425614 |
| DENV1 E | DQ264939 | DENV1 E | EU448412 | DENV1 E | DQ265085 | DENV1 E | EU448404 |
| DENV1 E | DQ265147 | DENV1 E | AY732464 | DENV1 E | AF425629 | DENV1 E | EU117304 |
| DENV1 E | AY422777 | DENV1 E | DQ265076 | DENV1 E | AY732412 | DENV1 E | AF425634 |
| DENV1 E | EU448408 | DENV1 E | DQ091263 | DENV1 E | DQ855296 | DENV1 E | DQ264879 |
| DENV1 E | DQ265095 | DENV1 E | DQ265010 | DENV1 E | DQ265011 | DENV1 E | EU448388 |
| DENV1 E | DQ265148 | DENV1 E | AF425632 | DENV1 E | AF425622 | DENV1 E | AY732422 |
| DENV1 E | AF425626 | DENV1 E | EF508206 | DENV1 E | DQ264921 | DENV1 E | DQ264954 |
| DENV1 E | DQ264922 | DENV1 E | DQ265083 | DENV1 E | DQ264892 | DENV1 E | DQ264913 |
| DENV1 E | DQ091265 | DENV1 E | DQ265020 | DENV1 E | DQ264893 | DENV1 E | AF425612 |
| DENV1 E | EF654106 | DENV1 E | AB111074 | DENV1 E | DQ265093 | DENV1 E | DQ264926 |

FIG. 66-38

| Virus Protein | Accession No. | Virus Protein | Accession No. | Virus Protein | Accession No. | Virus Protein | Accession No. |
|---|---|---|---|---|---|---|---|
| DENV1 E | DQ265045 | DENV1 E | AY732457 | DENV1 E | DQ265075 | DENV1 E | EU448393 |
| DENV1 E | DQ265137 | DENV1 E | AY732433 | DENV1 E | DQ265069 | DENV1 E | AB111071 |
| DENV1 E | DQ264970 | DENV1 E | AF425623 | DENV1 E | AM746217 | DENV1 E | AY620953 |
| DENV1 E | DQ265018 | DENV1 E | EU448389 | DENV1 E | AY732378 | DENV1 E | EF654104 |
| DENV1 E | DQ264967 | DENV1 E | DQ264956 | DENV1 E | AY732436 | DENV1 E | EU117306 |
| DENV1 E | EU069603 | DENV1 E | DQ264900 | DENV1 E | DQ264909 | DENV1 E | DQ264989 |
| DENV1 E | DQ265091 | DENV1 E | EU448386 | DENV1 E | DQ264949 | DENV1 E | EU448392 |
| DENV1 E | DQ265061 | DENV1 E | EU069606 | DENV1 E | DQ264961 | DENV1 E | EF508200 |
| DENV1 E | DQ265107 | DENV1 E | DQ264925 | DENV1 E | AY422786 | DENV1 E | EU448410 |
| DENV1 E | DQ264868 | DENV1 E | DQ265119 | DENV1 E | DQ265073 | DENV1 E | EU448400 |
| DENV1 E | X76219 | DENV1 E | DQ265139 | DENV1 E | EU069599 | DENV1 E | DQ265156 |
| DENV1 E | AY422779 | DENV1 E | EU448403 | DENV1 E | DQ264875 | DENV1 E | AY732389 |
| DENV1 E | DQ264982 | DENV1 E | DQ264902 | DENV1 E | FJ687476 | DENV1 E | FJ158610 |
| DENV1 E | AY732394 | DENV1 E | DQ265094 | DENV1 E | DQ265022 | DENV1 E | AY732425 |
| DENV1 E | DQ264957 | DENV1 E | DQ264887 | DENV1 E | DQ264891 | DENV1 E | DQ285554 |
| DENV1 E | AB111075 | DENV1 E | DQ211348 | DENV1 E | EU069608 | DENV1 E | AY732438 |
| DENV1 E | AY732410 | DENV1 E | DQ264915 | DENV1 E | AY732440 | DENV1 E | DQ264872 |
| DENV1 E | DQ341189 | DENV1 E | EU069622 | DENV1 E | EF079826 | DENV1 E | AY618877 |
| DENV1 E | DQ265128 | DENV1 E | AY732442 | DENV1 E | AY732397 | DENV1 E | AY422785 |
| DENV1 E | DQ264947 | DENV1 E | DQ265013 | DENV1 E | DQ091262 | DENV1 E | EU117312 |
| DENV1 E | AY732427 | DENV1 E | AY732450 | DENV1 E | DQ264953 | DENV1 E | AF425638 |
| DENV1 E | DQ091260 | DENV1 E | AF425615 | DENV1 E | DQ264917 | DENV1 E | DQ265040 |
| DENV1 E | EU448398 | DENV1 E | DQ264931 | DENV1 E | EF654110 | DENV1 E | AY732382 |
| DENV1 E | AY732434 | DENV1 E | AY600860 | DENV1 E | EU448413 | DENV1 E | AF425627 |
| DENV1 E | AY732429 | DENV1 E | AB188830 | DENV1 E | AY732401 | DENV1 E | AY732471 |
| DENV1 E | DQ265055 | DENV1 E | AY422778 | DENV1 E | AY732465 | DENV1 E | DQ265086 |
| DENV1 E | DQ264933 | DENV1 E | AY732403 | DENV1 E | EU448407 | DENV1 E | DQ265056 |
| DENV1 E | DQ264938 | DENV1 E | DQ265049 | DENV1 E | DQ265145 | DENV1 E | DQ091264 |
| DENV1 E | DQ264940 | DENV1 E | DQ265071 | DENV1 E | AB111068 | DENV1 E | DQ265084 |
| DENV1 E | AY732468 | DENV1 E | DQ265030 | DENV1 E | AF425631 | DENV1 E | DQ265044 |
| DENV1 E | AY422781 | DENV1 E | EU448401 | DENV1 E | AB111073 | DENV1 E | AM746213 |
| DENV1 E | AY620948 | DENV1 E | EU448395 | DENV1 E | AF425620 | DENV1 E | DQ265104 |
| DENV1 E | AF425624 | DENV1 E | AY732473 | DENV1 E | DQ265082 | DENV1 E | FJ687474 |
| DENV1 E | DQ264911 | DENV1 E | DQ264880 | DENV1 E | DQ265005 | DENV1 E | DQ264878 |
| DENV1 E | AY630407 | DENV1 E | AB111066 | DENV1 E | AY732455 | DENV1 E | DQ265092 |
| DENV1 E | EF508204 | DENV1 E | AY732420 | DENV1 E | DQ264973 | DENV1 E | AY732393 |
| DENV1 E | DQ341192 | DENV1 E | AY732451 | DENV1 E | AY732445 | DENV1 E | AY732390 |
| DENV1 E | AY588272 | DENV1 E | EF508202 | DENV1 E | EU069598 | DENV1 E | AF425628 |
| DENV1 E | DQ264918 | DENV1 E | AY620946 | DENV1 E | DQ264923 | DENV1 E | AB111076 |
| DENV1 E | DQ264870 | DENV1 E | DQ265109 | DENV1 E | AY732415 | DENV1 E | AY153755 |
| DENV1 E | EF508198 | DENV1 E | AF425625 | DENV1 E | EF508207 | DENV1 E | AY618211 |
| DENV1 E | AY732419 | DENV1 E | EU069614 | DENV1 E | AY732447 | DENV1 E | EF508205 |
| DENV1 E | DQ264981 | DENV1 E | DQ264898 | DENV1 E | DQ265077 | DENV1 E | AY732462 |
| DENV1 E | DQ264999 | DENV1 E | AY422783 | DENV1 E | DQ264944 | DENV1 E | DQ264952 |
| DENV1 E | DQ264869 | DENV1 E | EU069618 | DENV1 E | AM746215 | DENV1 E | DQ855297 |
| DENV1 E | DQ264873 | DENV1 E | DQ264936 | DENV1 E | DQ285557 | DENV1 E | AF425618 |
| DENV1 E | DQ265080 | DENV1 E | DQ265007 | DENV1 E | EU117310 | DENV1 E | AY732463 |
| DENV1 E | AY732380 | DENV1 E | FJ158612 | DENV1 E | AF425617 | DENV1 E | DQ265064 |

FIG. 66-39

| Virus Protein | Accession No. | Virus Protein | Accession No. | Virus Protein | Accession No. | Virus Protein | Accession No. |
|---|---|---|---|---|---|---|---|
| DENV1 E | AY618878 | DENV1 E | AY630408 | DENV1 E | FJ687477 | DENV1 E | AY618210 |
| DENV1 E | DQ211349 | DENV1 E | AF425621 | DENV1 E | AB111078 | DENV1 E | DQ265041 |
| DENV1 E | DQ264950 | DENV1 E | AY732386 | DENV1 E | AF425633 | DENV1 E | DQ091258 |
| DENV1 E | EU069623 | DENV1 E | DQ264904 | DENV1 E | DQ265136 | DENV1 E | AM746216 |
| DENV1 E | AY732470 | DENV1 E | AY732409 | DENV1 E | AF231721 | DENV1 E | AY732466 |
| DENV1 E | AB003090 | DENV1 E | AY422780 | DENV1 E | AY618880 | DENV1 E | DQ265070 |
| DENV1 E | EU069620 | DENV1 E | DQ265054 | DENV1 E | AY732453 | DENV1 E | EU069607 |
| DENV1 E | DQ341191 | DENV1 E | DQ341190 | DENV1 E | EU117305 | DENV1 E | AY732459 |
| DENV1 E | DQ264910 | DENV1 E | AY732431 | DENV1 E | DQ264927 | DENV1 E | DQ265035 |
| DENV1 E | AY732417 | DENV1 E | DQ265062 | DENV1 E | AB188831 | DENV1 E | DQ264924 |
| DENV1 E | AY732399 | DENV1 E | AY732413 | DENV1 E | DQ265046 | DENV1 E | DQ265081 |
| DENV1 E | AY732407 | DENV1 E | DQ264946 | DENV1 E | DQ264991 | DENV1 E | AY732387 |
| DENV1 E | DQ264934 | DENV1 E | DQ264941 | DENV1 E | DQ264971 | DENV1 E | FJ687475 |
| DENV1 E | EU282328 | DENV1 E | DQ264930 | DENV1 E | DQ264955 | DENV1 E | AY732452 |
| DENV1 E | AM746218 | DENV1 E | EU448397 | DENV1 E | DQ264974 | DENV1 E | AB111067 |
| DENV1 E | DQ264886 | DENV1 E | AY732467 | DENV1 E | DQ265050 | DENV1 E | DQ265023 |
| DENV1 E | DQ265088 | DENV1 E | DQ264889 | DENV1 E | EF654109 | DENV1 E | DQ264980 |
| DENV1 E | EU069609 | DENV1 E | EU448390 | DENV1 E | AB111065 | DENV1 E | AY422784 |
| DENV1 E | DQ091266 | DENV1 E | DQ265117 | DENV1 E | AY732448 | DENV1 E | EU069605 |
| DENV1 E | D00504 | DENV1 E | EF508203 | DENV1 E | EU117307 | DENV1 E | DQ264871 |
| DENV1 E | EF654107 | DENV1 E | DQ091272 | DENV1 E | EU069612 | DENV1 E | DQ285549 |
| DENV1 E | DQ285551 | DENV1 E | DQ265090 | DENV1 E | DQ265068 | DENV1 E | EF113152 |
| DENV1 E | AY732384 | DENV1 E | DQ264932 | DENV1 E | EU069617 | DENV1 E | DQ091261 |
| DENV1 E | AY732437 | DENV1 E | DQ091268 | DENV1 E | DQ265031 | DENV1 E | DQ265051 |
| DENV1 E | EU448399 | DENV1 E | AY732395 | DENV1 E | AF425610 | DENV1 E | AY732460 |
| DENV1 E | AY732406 | DENV1 E | EU069602 | DENV1 E | EU448396 | DENV1 E | AY732458 |
| DENV1 E | DQ265155 | DENV1 E | AB232666 | DENV1 E | AY732421 | DENV1 E | DQ265123 |
| DENV1 E | DQ265078 | DENV1 E | AY732404 | DENV1 E | EU069604 | DENV1 E | DQ264914 |
| DENV1 E | DQ264996 | DENV1 E | EF508199 | DENV1 E | EU069613 | DENV1 E | AY732441 |
| DENV1 E | DQ264929 | DENV1 E | DQ264907 | DENV1 E | EF508201 | DENV1 E | DQ265004 |
| DENV1 E | AY732430 | DENV1 E | AF425611 | DENV1 E | DQ265060 | DENV1 E | AY732402 |
| DENV1 E | EU069594 | DENV1 E | AF425613 | DENV1 E | AB111070 | DENV1 E | DQ265048 |
| DENV1 E | AY732423 | DENV1 E | EU069611 | DENV1 E | AY732428 | DENV1 E | DQ265138 |
| DENV1 E | DQ264964 | DENV1 E | AY620949 | DENV1 E | EU448409 | DENV1 E | DQ264939 |
| DENV1 E | DQ265066 | DENV1 E | D10513 | DENV1 E | EU448411 | DENV1 E | DQ265147 |
| DENV1 E | AY732426 | DENV1 E | EU069595 | DENV1 E | AY422782 | DENV1 E | AY422777 |
| DENV1 E | DQ264881 | DENV1 E | EU448387 | DENV1 E | AF425637 | DENV1 E | EU448408 |
| DENV1 E | AB219136 | DENV1 E | DQ264966 | DENV1 E | DQ265026 | DENV1 E | DQ265095 |
| DENV1 E | DQ265052 | DENV1 E | DQ265143 | DENV1 E | AY732411 | DENV1 E | DQ265148 |
| DENV1 E | DQ264979 | DENV1 E | AY732418 | DENV1 E | AB111077 | DENV1 E | AF425626 |
| DENV1 E | EU069597 | DENV1 E | AY732379 | DENV1 E | AM746220 | DENV1 E | DQ264922 |
| DENV1 E | AY780642 | DENV1 E | DQ265019 | DENV1 E | DQ091270 | DENV1 E | DQ091265 |
| DENV1 E | AY606062 | DENV1 E | AY732444 | DENV1 E | AY732435 | DENV1 E | EF654106 |
| DENV1 E | AY732446 | DENV1 E | DQ264912 | DENV1 E | AY588273 | DENV1 E | EU117311 |
| DENV1 E | DQ264958 | DENV1 E | DQ265102 | DENV1 E | DQ264897 | DENV1 E | AB111072 |
| DENV1 E | DQ264983 | DENV1 E | AY732449 | DENV1 E | DQ264874 | DENV1 E | AY732388 |
| DENV1 E | AF425609 | DENV1 E | DQ265115 | DENV1 E | DQ265074 | DENV1 E | AY732472 |
| DENV1 E | DQ264945 | DENV1 E | AY620951 | DENV1 E | AY732469 | DENV1 E | AF425616 |

FIG. 66-40

| Virus Protein | Accession No. | Virus Protein | Accession No. | Virus Protein | Accession No. | Virus Protein | Accession No. |
|---|---|---|---|---|---|---|---|
| DENV1 E | EU448394 | DENV1 E | DQ265132 | DENV1 E | EU448414 | DENV1 E | EU069603 |
| DENV1 E | EU117309 | DENV1 E | AY732456 | DENV1 E | DQ264876 | DENV1 E | DQ265091 |
| DENV1 E | EF654105 | DENV1 E | EU069621 | DENV1 E | DQ264951 | DENV1 E | DQ265061 |
| DENV1 E | DQ264899 | DENV1 E | D00505 | DENV1 E | AY732432 | DENV1 E | DQ265107 |
| DENV1 E | AY620952 | DENV1 E | EU069596 | DENV1 E | AF425619 | DENV1 E | DQ264868 |
| DENV1 E | AY620947 | DENV1 E | EU448405 | DENV1 E | AY620950 | DENV1 E | X76219 |
| DENV1 E | EU448391 | DENV1 E | DQ091273 | DENV1 E | AY732408 | DENV1 E | AY422779 |
| DENV1 E | AY589692 | DENV1 E | AY732439 | DENV1 E | DQ265039 | DENV1 E | DQ264982 |
| DENV1 E | DQ265058 | DENV1 E | AY732443 | DENV1 E | DQ341194 | DENV1 E | AY732394 |
| DENV1 E | AY780643 | DENV1 E | DQ285552 | DENV1 E | FJ158611 | DENV1 E | DQ264957 |
| DENV1 E | DQ264942 | DENV1 E | DQ091267 | DENV1 E | AY732385 | DENV1 E | AB111075 |
| DENV1 E | FJ158609 | DENV1 E | AY732424 | DENV1 E | EU069624 | DENV1 E | AY732410 |
| DENV1 E | DQ265065 | DENV1 E | DQ265121 | DENV1 E | AY732392 | DENV1 E | DQ341189 |
| DENV1 E | EU069615 | DENV1 E | DQ091259 | DENV1 E | AF425636 | DENV1 E | DQ265128 |
| DENV1 E | DQ265087 | DENV1 E | EU069616 | DENV1 E | DQ264935 | DENV1 E | DQ264947 |
| DENV1 E | AF425635 | DENV1 E | DQ265079 | DENV1 E | EU069601 | DENV1 E | AY732427 |
| DENV1 E | EU448402 | DENV1 E | EU069593 | DENV1 E | DQ265105 | DENV1 E | DQ091260 |
| DENV1 E | AY732383 | DENV1 E | DQ264883 | DENV1 E | AY732398 | DENV1 E | EU448398 |
| DENV1 E | AY871812 | DENV1 E | DQ265152 | DENV1 E | DQ265057 | DENV1 E | AY732434 |
| DENV1 E | AJ438941 | DENV1 E | DQ264965 | DENV1 E | DQ264908 | DENV1 E | AY732429 |
| DENV1 E | DQ264960 | DENV1 E | AY732400 | DENV1 E | DQ265047 | DENV1 E | DQ265055 |
| DENV1 E | AY732396 | DENV1 E | DQ285553 | DENV1 E | DQ264928 | DENV1 E | DQ264933 |
| DENV1 E | AM746214 | DENV1 E | DQ265053 | DENV1 E | AF425639 | DENV1 E | DQ264938 |
| DENV1 E | AB111079 | DENV1 E | AB111064 | DENV1 E | AY732416 | DENV1 E | DQ264940 |
| DENV1 E | AY732381 | DENV1 E | DQ264984 | DENV1 E | DQ091269 | DENV1 E | AY732468 |
| DENV1 E | DQ341193 | DENV1 E | EU117308 | DENV1 E | DQ091271 | DENV1 E | AY422781 |
| DENV1 E | AM746212 | DENV1 E | DQ264905 | DENV1 E | AF425630 | DENV1 E | AY620948 |
| DENV1 E | DQ264884 | DENV1 E | DQ265111 | DENV1 E | DQ341188 | DENV1 E | AF425624 |
| DENV1 E | AM746219 | DENV1 E | DQ264959 | DENV1 E | EU069610 | DENV1 E | DQ264911 |
| DENV1 E | AY732391 | DENV1 E | DQ265063 | DENV1 E | DQ265101 | DENV1 E | AY630407 |
| DENV1 E | AB111069 | DENV1 E | EF654108 | DENV1 E | AY732405 | DENV1 E | EF508204 |
| DENV1 E | EU448406 | DENV1 E | DQ265089 | DENV1 E | FJ687478 | DENV1 E | DQ341192 |
| DENV1 E | DQ264937 | DENV1 E | AY732454 | DENV1 E | AF425614 | DENV1 E | AY588272 |
| DENV1 E | EU448412 | DENV1 E | DQ265085 | DENV1 E | EU448404 | DENV1 E | DQ264918 |
| DENV1 E | AY732464 | DENV1 E | AF425629 | DENV1 E | EU117304 | DENV1 E | DQ264870 |
| DENV1 E | DQ265076 | DENV1 E | AY732412 | DENV1 E | AF425634 | DENV1 E | EF508198 |
| DENV1 E | DQ091263 | DENV1 E | DQ855296 | DENV1 E | DQ264879 | DENV1 E | AY732419 |
| DENV1 E | DQ265010 | DENV1 E | DQ265011 | DENV1 E | EU448388 | DENV1 E | DQ264981 |
| DENV1 E | AF425632 | DENV1 E | AF425622 | DENV1 E | AY732422 | DENV1 E | DQ264999 |
| DENV1 E | EF508206 | DENV1 E | DQ264921 | DENV1 E | DQ264954 | DENV1 E | DQ264869 |
| DENV1 E | DQ265083 | DENV1 E | DQ264892 | DENV1 E | DQ264913 | DENV1 E | DQ264873 |
| DENV1 E | DQ265020 | DENV1 E | DQ264893 | DENV1 E | AF425612 | DENV1 E | DQ265080 |
| DENV1 E | AB111074 | DENV1 E | DQ265093 | DENV1 E | DQ264926 | DENV1 E | AY732380 |
| DENV1 E | AY732414 | DENV1 E | EU069600 | DENV1 E | DQ265045 | DENV1 E | AY732457 |
| DENV1 E | DQ265072 | DENV1 E | EU069619 | DENV1 E | DQ265137 | DENV1 E | AY732433 |
| DENV1 E | DQ264916 | DENV1 E | AY618879 | DENV1 E | DQ264970 | DENV1 E | AF425623 |
| DENV1 E | DQ265098 | DENV1 E | DQ264877 | DENV1 E | DQ265018 | DENV1 E | EU448389 |
| DENV1 E | DQ265002 | DENV1 E | AY732461 | DENV1 E | DQ264967 | DENV1 E | DQ264956 |

FIG. 66-41

| Virus Protein | Accession No. | Virus Protein | Accession No. | Virus Protein | Accession No. | Virus Protein | Accession No. |
|---|---|---|---|---|---|---|---|
| DENV1 E | DQ264900 | DENV1 E | DQ264909 | DENV1 E | DQ264989 | DENV1 E | AB003090 |
| DENV1 E | EU448386 | DENV1 E | DQ264949 | DENV1 E | EU448392 | DENV1 E | EU069620 |
| DENV1 E | EU069606 | DENV1 E | DQ264961 | DENV1 E | EF508200 | DENV1 E | DQ341191 |
| DENV1 E | DQ264925 | DENV1 E | AY422786 | DENV1 E | EU448410 | DENV1 E | DQ264910 |
| DENV1 E | DQ265119 | DENV1 E | DQ265073 | DENV1 E | EU448400 | DENV1 E | AY732417 |
| DENV1 E | DQ265139 | DENV1 E | EU069599 | DENV1 E | DQ265156 | DENV1 E | AY732399 |
| DENV1 E | EU448403 | DENV1 E | DQ264875 | DENV1 E | AY732389 | DENV1 E | AY732407 |
| DENV1 E | DQ264902 | DENV1 E | FJ687476 | DENV1 E | FJ158610 | DENV1 E | DQ264934 |
| DENV1 E | DQ265094 | DENV1 E | DQ265022 | DENV1 E | AY732425 | DENV1 E | EU282328 |
| DENV1 E | DQ264887 | DENV1 E | DQ264891 | DENV1 E | DQ285554 | DENV1 E | AM746218 |
| DENV1 E | DQ211348 | DENV1 E | EU069608 | DENV1 E | AY732438 | DENV1 E | DQ264886 |
| DENV1 E | DQ264915 | DENV1 E | AY732440 | DENV1 E | DQ264872 | DENV1 E | DQ265088 |
| DENV1 E | EU069622 | DENV1 E | EF079826 | DENV1 E | AY618877 | DENV1 E | EU069609 |
| DENV1 E | AY732442 | DENV1 E | AY732397 | DENV1 E | AY422785 | DENV1 E | DQ091266 |
| DENV1 E | DQ265013 | DENV1 E | DQ091262 | DENV1 E | EU117312 | DENV1 E | D00504 |
| DENV1 E | AY732450 | DENV1 E | DQ264953 | DENV1 E | AF425638 | DENV1 E | EF654107 |
| DENV1 E | AF425615 | DENV1 E | DQ264917 | DENV1 E | DQ265040 | DENV1 E | DQ285551 |
| DENV1 E | DQ264931 | DENV1 E | EF654110 | DENV1 E | AY732382 | DENV1 E | AY732384 |
| DENV1 E | AY600860 | DENV1 E | EU448413 | DENV1 E | AF425627 | DENV1 E | AY732437 |
| DENV1 E | AB188830 | DENV1 E | AY732401 | DENV1 E | AY732471 | DENV1 E | EU448399 |
| DENV1 E | AY422778 | DENV1 E | AY732465 | DENV1 E | DQ265086 | DENV1 E | AY732406 |
| DENV1 E | AY732403 | DENV1 E | EU448407 | DENV1 E | DQ265056 | DENV1 E | DQ265155 |
| DENV1 E | DQ265049 | DENV1 E | DQ265145 | DENV1 E | DQ091264 | DENV1 E | DQ265078 |
| DENV1 E | DQ265071 | DENV1 E | AB111068 | DENV1 E | DQ265084 | DENV1 E | DQ264996 |
| DENV1 E | DQ265030 | DENV1 E | AF425631 | DENV1 E | DQ265044 | DENV1 E | DQ264929 |
| DENV1 E | EU448401 | DENV1 E | AB111073 | DENV1 E | AM746213 | DENV1 E | AY732430 |
| DENV1 E | EU448395 | DENV1 E | AF425620 | DENV1 E | DQ265104 | DENV1 E | EU069594 |
| DENV1 E | AY732473 | DENV1 E | DQ265082 | DENV1 E | FJ687474 | DENV1 E | AY732423 |
| DENV1 E | DQ264880 | DENV1 E | DQ265005 | DENV1 E | DQ264878 | DENV1 E | DQ264964 |
| DENV1 E | AB111066 | DENV1 E | AY732455 | DENV1 E | DQ265092 | DENV1 E | DQ265066 |
| DENV1 E | AY732420 | DENV1 E | DQ264973 | DENV1 E | AY732393 | DENV1 E | AY732426 |
| DENV1 E | AY732451 | DENV1 E | AY732445 | DENV1 E | AY732390 | DENV1 E | DQ264881 |
| DENV1 E | EF508202 | DENV1 E | EU069598 | DENV1 E | AF425628 | DENV1 E | AB219136 |
| DENV1 E | AY620946 | DENV1 E | DQ264923 | DENV1 E | AB111076 | DENV1 E | DQ265052 |
| DENV1 E | DQ265109 | DENV1 E | AY732415 | DENV1 E | AY153755 | DENV1 E | DQ264979 |
| DENV1 E | AF425625 | DENV1 E | EF508207 | DENV1 E | AY618211 | DENV1 E | EU069597 |
| DENV1 E | EU069614 | DENV1 E | AY732447 | DENV1 E | EF508205 | DENV1 E | AY780642 |
| DENV1 E | DQ264898 | DENV1 E | DQ265077 | DENV1 E | AY732462 | DENV1 E | AY606062 |
| DENV1 E | AY422783 | DENV1 E | DQ264944 | DENV1 E | DQ264952 | DENV1 E | AY732446 |
| DENV1 E | EU069618 | DENV1 E | AM746215 | DENV1 E | DQ855297 | DENV1 E | DQ264958 |
| DENV1 E | DQ264936 | DENV1 E | DQ285557 | DENV1 E | AF425618 | DENV1 E | DQ264983 |
| DENV1 E | DQ265007 | DENV1 E | EU117310 | DENV1 E | AY732463 | DENV1 E | AF425609 |
| DENV1 E | FJ158612 | DENV1 E | AF425617 | DENV1 E | DQ265064 | DENV1 E | DQ264945 |
| DENV1 E | DQ265075 | DENV1 E | EU448393 | DENV1 E | AY618878 | DENV1 E | AY630408 |
| DENV1 E | DQ265069 | DENV1 E | AB111071 | DENV1 E | DQ211349 | DENV1 E | AF425621 |
| DENV1 E | AM746217 | DENV1 E | AY620953 | DENV1 E | DQ264950 | DENV1 E | AY732386 |
| DENV1 E | AY732378 | DENV1 E | EF654104 | DENV1 E | EU069623 | DENV1 E | DQ264904 |
| DENV1 E | AY732436 | DENV1 E | EU117306 | DENV1 E | AY732470 | DENV1 E | AY732409 |

FIG. 66-42

| Virus Protein | Accession No. | Virus Protein | Accession No. | Virus Protein | Accession No. | Virus Protein | Accession No. |
|---|---|---|---|---|---|---|---|
| DENV1 E | AY422780 | DENV1 E | AY618880 | DENV1 E | DQ265070 | DENV1 E | AY620947 |
| DENV1 E | DQ265054 | DENV1 E | AY732453 | DENV1 E | EU069607 | DENV1 E | EU448391 |
| DENV1 E | DQ341190 | DENV1 E | EU117305 | DENV1 E | AY732459 | DENV1 E | AY589692 |
| DENV1 E | AY732431 | DENV1 E | DQ264927 | DENV1 E | DQ265035 | DENV1 E | DQ265058 |
| DENV1 E | DQ265062 | DENV1 E | AB188831 | DENV1 E | DQ264924 | DENV1 E | AY780643 |
| DENV1 E | AY732413 | DENV1 E | DQ265046 | DENV1 E | DQ265081 | DENV1 E | DQ264942 |
| DENV1 E | DQ264946 | DENV1 E | DQ264991 | DENV1 E | AY732387 | DENV1 E | FJ158609 |
| DENV1 E | DQ264941 | DENV1 E | DQ264971 | DENV1 E | FJ687475 | DENV1 E | DQ265065 |
| DENV1 E | DQ264930 | DENV1 E | DQ264955 | DENV1 E | AY732452 | DENV1 E | EU069615 |
| DENV1 E | EU448397 | DENV1 E | DQ264974 | DENV1 E | AB111067 | DENV1 E | DQ265087 |
| DENV1 E | AY732467 | DENV1 E | DQ265050 | DENV1 E | DQ265023 | DENV1 E | AF425635 |
| DENV1 E | DQ264889 | DENV1 E | EF654109 | DENV1 E | DQ264980 | DENV1 E | EU448402 |
| DENV1 E | EU448390 | DENV1 E | AB111065 | DENV1 E | AY422784 | DENV1 E | AY732383 |
| DENV1 E | DQ265117 | DENV1 E | AY732448 | DENV1 E | EU069605 | DENV1 E | AY871812 |
| DENV1 E | EF508203 | DENV1 E | EU117307 | DENV1 E | DQ264871 | DENV1 E | AJ438941 |
| DENV1 E | DQ091272 | DENV1 E | EU069612 | DENV1 E | DQ285549 | DENV1 E | DQ264960 |
| DENV1 E | DQ265090 | DENV1 E | DQ265068 | DENV1 E | EF113152 | DENV1 E | AY732396 |
| DENV1 E | DQ264932 | DENV1 E | EU069617 | DENV1 E | DQ091261 | DENV1 E | AM746214 |
| DENV1 E | DQ091268 | DENV1 E | DQ265031 | DENV1 E | DQ265051 | DENV1 E | AB111079 |
| DENV1 E | AY732395 | DENV1 E | AF425610 | DENV1 E | AY732460 | DENV1 E | AY732381 |
| DENV1 E | EU069602 | DENV1 E | EU448396 | DENV1 E | AY732458 | DENV1 E | DQ341193 |
| DENV1 E | AB232666 | DENV1 E | AY732421 | DENV1 E | DQ265123 | DENV1 E | AM746212 |
| DENV1 E | AY732404 | DENV1 E | EU069604 | DENV1 E | DQ264914 | DENV1 E | DQ264884 |
| DENV1 E | EF508199 | DENV1 E | EU069613 | DENV1 E | AY732441 | DENV1 E | AM746219 |
| DENV1 E | DQ264907 | DENV1 E | EF508201 | DENV1 E | DQ265004 | DENV1 E | AY732391 |
| DENV1 E | AF425611 | DENV1 E | DQ265060 | DENV1 E | AY732402 | DENV1 E | AB111069 |
| DENV1 E | AF425613 | DENV1 E | AB111070 | DENV1 E | DQ265048 | DENV1 E | EU448406 |
| DENV1 E | EU069611 | DENV1 E | AY732428 | DENV1 E | DQ265138 | DENV1 E | DQ264937 |
| DENV1 E | AY620949 | DENV1 E | EU448409 | DENV1 E | DQ264939 | DENV1 E | EU448412 |
| DENV1 E | D10513 | DENV1 E | EU448411 | DENV1 E | DQ265147 | DENV1 E | AY732464 |
| DENV1 E | EU069595 | DENV1 E | AY422782 | DENV1 E | AY422777 | DENV1 E | DQ265076 |
| DENV1 E | EU448387 | DENV1 E | AF425637 | DENV1 E | EU448408 | DENV1 E | DQ091263 |
| DENV1 E | DQ264966 | DENV1 E | DQ265026 | DENV1 E | DQ265095 | DENV1 E | DQ265010 |
| DENV1 E | DQ265143 | DENV1 E | AY732411 | DENV1 E | DQ265148 | DENV1 E | AF425632 |
| DENV1 E | AY732418 | DENV1 E | AB111077 | DENV1 E | AF425626 | DENV1 E | EF508206 |
| DENV1 E | AY732379 | DENV1 E | AM746220 | DENV1 E | DQ264922 | DENV1 E | DQ265083 |
| DENV1 E | DQ265019 | DENV1 E | DQ091270 | DENV1 E | DQ091265 | DENV1 E | DQ265020 |
| DENV1 E | AY732444 | DENV1 E | AY732435 | DENV1 E | EF654106 | DENV1 E | AB111074 |
| DENV1 E | DQ264912 | DENV1 E | AY588273 | DENV1 E | EU117311 | DENV1 E | AY732414 |
| DENV1 E | DQ265102 | DENV1 E | DQ264897 | DENV1 E | AB111072 | DENV1 E | DQ265072 |
| DENV1 E | AY732449 | DENV1 E | DQ264874 | DENV1 E | AY732388 | DENV1 E | DQ264916 |
| DENV1 E | DQ265115 | DENV1 E | DQ265074 | DENV1 E | AY732472 | DENV1 E | DQ265098 |
| DENV1 E | AY620951 | DENV1 E | AY732469 | DENV1 E | AF425616 | DENV1 E | DQ265002 |
| DENV1 E | FJ687477 | DENV1 E | AY618210 | DENV1 E | EU448394 | DENV1 E | DQ265132 |
| DENV1 E | AB111078 | DENV1 E | DQ265041 | DENV1 E | EU117309 | DENV1 E | AY732456 |
| DENV1 E | AF425633 | DENV1 E | DQ091258 | DENV1 E | EF654105 | DENV1 E | EU069621 |
| DENV1 E | DQ265136 | DENV1 E | AM746216 | DENV1 E | DQ264899 | DENV1 E | D00505 |
| DENV1 E | AF231721 | DENV1 E | AY732466 | DENV1 E | AY620952 | DENV1 E | EU069596 |

FIG. 66-43

| Virus Protein | Accession No. | Virus Protein | Accession No. | Virus Protein | Accession No. | Virus Protein | Accession No. |
|---|---|---|---|---|---|---|---|
| DENV1 E | EU448405 | DENV1 E | AY620950 | DENV1 E | X76219 | DENV1 E | DQ265139 |
| DENV1 E | DQ091273 | DENV1 E | AY732408 | DENV1 E | AY422779 | DENV1 E | EU448403 |
| DENV1 E | AY732439 | DENV1 E | DQ265039 | DENV1 E | DQ264982 | DENV1 E | DQ264902 |
| DENV1 E | AY732443 | DENV1 E | DQ341194 | DENV1 E | AY732394 | DENV1 E | DQ265094 |
| DENV1 E | DQ285552 | DENV1 E | FJ158611 | DENV1 E | DQ264957 | DENV1 E | DQ264887 |
| DENV1 E | DQ091267 | DENV1 E | AY732385 | DENV1 E | AB111075 | DENV1 E | DQ211348 |
| DENV1 E | AY732424 | DENV1 E | EU069624 | DENV1 E | AY732410 | DENV1 E | DQ264915 |
| DENV1 E | DQ265121 | DENV1 E | AY732392 | DENV1 E | DQ341189 | DENV1 E | EU069622 |
| DENV1 E | DQ091259 | DENV1 E | AF425636 | DENV1 E | DQ265128 | DENV1 E | AY732442 |
| DENV1 E | EU069616 | DENV1 E | DQ264935 | DENV1 E | DQ264947 | DENV1 E | DQ265013 |
| DENV1 E | DQ265079 | DENV1 E | EU069601 | DENV1 E | AY732427 | DENV1 E | AY732450 |
| DENV1 E | EU069593 | DENV1 E | DQ265105 | DENV1 E | DQ091260 | DENV1 E | AF425615 |
| DENV1 E | DQ264883 | DENV1 E | AY732398 | DENV1 E | EU448398 | DENV1 E | DQ264931 |
| DENV1 E | DQ265152 | DENV1 E | DQ265057 | DENV1 E | AY732434 | DENV1 E | AY600860 |
| DENV1 E | DQ264965 | DENV1 E | DQ264908 | DENV1 E | AY732429 | DENV1 E | AB188830 |
| DENV1 E | AY732400 | DENV1 E | DQ265047 | DENV1 E | DQ265055 | DENV1 E | AY422778 |
| DENV1 E | DQ285553 | DENV1 E | DQ264928 | DENV1 E | DQ264933 | DENV1 E | AY732403 |
| DENV1 E | DQ265053 | DENV1 E | AF425639 | DENV1 E | DQ264938 | DENV1 E | DQ265049 |
| DENV1 E | AB111064 | DENV1 E | AY732416 | DENV1 E | DQ264940 | DENV1 E | DQ265071 |
| DENV1 E | DQ264984 | DENV1 E | DQ091269 | DENV1 E | AY732468 | DENV1 E | DQ265030 |
| DENV1 E | EU117308 | DENV1 E | DQ091271 | DENV1 E | AY422781 | DENV1 E | EU448401 |
| DENV1 E | DQ264905 | DENV1 E | AF425630 | DENV1 E | AY620948 | DENV1 E | EU448395 |
| DENV1 E | DQ265111 | DENV1 E | DQ341188 | DENV1 E | AF425624 | DENV1 E | AY732473 |
| DENV1 E | DQ264959 | DENV1 E | EU069610 | DENV1 E | DQ264911 | DENV1 E | DQ264880 |
| DENV1 E | DQ265063 | DENV1 E | DQ265101 | DENV1 E | AY630407 | DENV1 E | AB111066 |
| DENV1 E | EF654108 | DENV1 E | AY732405 | DENV1 E | EF508204 | DENV1 E | AY732420 |
| DENV1 E | DQ265089 | DENV1 E | FJ687478 | DENV1 E | DQ341192 | DENV1 E | AY732451 |
| DENV1 E | AY732454 | DENV1 E | AF425614 | DENV1 E | AY588272 | DENV1 E | EF508202 |
| DENV1 E | DQ265085 | DENV1 E | EU448404 | DENV1 E | DQ264918 | DENV1 E | AY620946 |
| DENV1 E | AF425629 | DENV1 E | EU117304 | DENV1 E | DQ264870 | DENV1 E | DQ265109 |
| DENV1 E | AY732412 | DENV1 E | AF425634 | DENV1 E | EF508198 | DENV1 E | AF425625 |
| DENV1 E | DQ855296 | DENV1 E | DQ264879 | DENV1 E | AY732419 | DENV1 E | EU069614 |
| DENV1 E | DQ265011 | DENV1 E | EU448388 | DENV1 E | DQ264981 | DENV1 E | DQ264898 |
| DENV1 E | AF425622 | DENV1 E | AY732422 | DENV1 E | DQ264999 | DENV1 E | AY422783 |
| DENV1 E | DQ264921 | DENV1 E | DQ264954 | DENV1 E | DQ264869 | DENV1 E | EU069618 |
| DENV1 E | DQ264892 | DENV1 E | DQ264913 | DENV1 E | DQ264873 | DENV1 E | DQ264936 |
| DENV1 E | DQ264893 | DENV1 E | AF425612 | DENV1 E | DQ265080 | DENV1 E | DQ265007 |
| DENV1 E | DQ265093 | DENV1 E | DQ264926 | DENV1 E | AY732380 | DENV1 E | FJ158612 |
| DENV1 E | EU069600 | DENV1 E | DQ265045 | DENV1 E | AY732457 | DENV1 E | DQ265075 |
| DENV1 E | EU069619 | DENV1 E | DQ265137 | DENV1 E | AY732433 | DENV1 E | DQ265069 |
| DENV1 E | AY618879 | DENV1 E | DQ264970 | DENV1 E | AF425623 | DENV1 E | AM746217 |
| DENV1 E | DQ264877 | DENV1 E | DQ265018 | DENV1 E | EU448389 | DENV1 E | AY732378 |
| DENV1 E | AY732461 | DENV1 E | DQ264967 | DENV1 E | DQ264956 | DENV1 E | AY732436 |
| DENV1 E | EU448414 | DENV1 E | EU069603 | DENV1 E | DQ264900 | DENV1 E | DQ264909 |
| DENV1 E | DQ264876 | DENV1 E | DQ265091 | DENV1 E | EU448386 | DENV1 E | DQ264949 |
| DENV1 E | DQ264951 | DENV1 E | DQ265061 | DENV1 E | EU069606 | DENV1 E | DQ264961 |
| DENV1 E | AY732432 | DENV1 E | DQ265107 | DENV1 E | DQ264925 | DENV1 E | AY422786 |
| DENV1 E | AF425619 | DENV1 E | DQ264868 | DENV1 E | DQ265119 | DENV1 E | DQ265073 |

FIG. 66-44

| Virus Protein | Accession No. | Virus Protein | Accession No. | Virus Protein | Accession No. | Virus Protein | Accession No. |
|---|---|---|---|---|---|---|---|
| DENV1 E | EU069599 | DENV1 E | DQ265156 | DENV1 E | AY732399 | DENV1 E | AY732413 |
| DENV1 E | DQ264875 | DENV1 E | AY732389 | DENV1 E | AY732407 | DENV1 E | DQ264946 |
| DENV1 E | FJ687476 | DENV1 E | FJ158610 | DENV1 E | DQ264934 | DENV1 E | DQ264941 |
| DENV1 E | DQ265022 | DENV1 E | AY732425 | DENV1 E | EU282328 | DENV1 E | DQ264930 |
| DENV1 E | DQ264891 | DENV1 E | DQ285554 | DENV1 E | AM746218 | DENV1 E | EU448397 |
| DENV1 E | EU069608 | DENV1 E | AY732438 | DENV1 E | DQ264886 | DENV1 E | AY732467 |
| DENV1 E | AY732440 | DENV1 E | DQ264872 | DENV1 E | DQ265088 | DENV1 E | DQ264889 |
| DENV1 E | EF079826 | DENV1 E | AY618877 | DENV1 E | EU069609 | DENV1 E | EU448390 |
| DENV1 E | AY732397 | DENV1 E | AY422785 | DENV1 E | DQ091266 | DENV1 E | DQ265117 |
| DENV1 E | DQ091262 | DENV1 E | EU117312 | DENV1 E | D00504 | DENV1 E | EF508203 |
| DENV1 E | DQ264953 | DENV1 E | AF425638 | DENV1 E | EF654107 | DENV1 E | DQ091272 |
| DENV1 E | DQ264917 | DENV1 E | DQ265040 | DENV1 E | DQ285551 | DENV1 E | DQ265090 |
| DENV1 E | EF654110 | DENV1 E | AY732382 | DENV1 E | AY732384 | DENV1 E | DQ264932 |
| DENV1 E | EU448413 | DENV1 E | AF425627 | DENV1 E | AY732437 | DENV1 E | DQ091268 |
| DENV1 E | AY732401 | DENV1 E | AY732471 | DENV1 E | EU448399 | DENV1 E | AY732395 |
| DENV1 E | AY732465 | DENV1 E | DQ265086 | DENV1 E | AY732406 | DENV1 E | EU069602 |
| DENV1 E | EU448407 | DENV1 E | DQ265056 | DENV1 E | DQ265155 | DENV1 E | AB232666 |
| DENV1 E | DQ265145 | DENV1 E | DQ091264 | DENV1 E | DQ265078 | DENV1 E | AY732404 |
| DENV1 E | AB111068 | DENV1 E | DQ265084 | DENV1 E | DQ264996 | DENV1 E | EF508199 |
| DENV1 E | AF425631 | DENV1 E | DQ265044 | DENV1 E | DQ264929 | DENV1 E | DQ264907 |
| DENV1 E | AB111073 | DENV1 E | AM746213 | DENV1 E | AY732430 | DENV1 E | AF425611 |
| DENV1 E | AF425620 | DENV1 E | DQ265104 | DENV1 E | EU069594 | DENV1 E | AF425613 |
| DENV1 E | DQ265082 | DENV1 E | FJ687474 | DENV1 E | AY732423 | DENV1 E | EU069611 |
| DENV1 E | DQ265005 | DENV1 E | DQ264878 | DENV1 E | DQ264964 | DENV1 E | AY620949 |
| DENV1 E | AY732455 | DENV1 E | DQ265092 | DENV1 E | DQ265066 | DENV1 E | D10513 |
| DENV1 E | DQ264973 | DENV1 E | AY732393 | DENV1 E | AY732426 | DENV1 E | EU069595 |
| DENV1 E | AY732445 | DENV1 E | AY732390 | DENV1 E | DQ264881 | DENV1 E | EU448387 |
| DENV1 E | EU069598 | DENV1 E | AF425628 | DENV1 E | AB219136 | DENV1 E | DQ264966 |
| DENV1 E | DQ264923 | DENV1 E | AB111076 | DENV1 E | DQ265052 | DENV1 E | DQ265143 |
| DENV1 E | AY732415 | DENV1 E | AY153755 | DENV1 E | DQ264979 | DENV1 E | AY732418 |
| DENV1 E | EF508207 | DENV1 E | AY618211 | DENV1 E | EU069597 | DENV1 E | AY732379 |
| DENV1 E | AY732447 | DENV1 E | EF508205 | DENV1 E | AY780642 | DENV1 E | DQ265019 |
| DENV1 E | DQ265077 | DENV1 E | AY732462 | DENV1 E | AY606062 | DENV1 E | AY732444 |
| DENV1 E | DQ264944 | DENV1 E | DQ264952 | DENV1 E | AY732446 | DENV1 E | DQ264912 |
| DENV1 E | AM746215 | DENV1 E | DQ855297 | DENV1 E | DQ264958 | DENV1 E | DQ265102 |
| DENV1 E | DQ285557 | DENV1 E | AF425618 | DENV1 E | DQ264983 | DENV1 E | AY732449 |
| DENV1 E | EU117310 | DENV1 E | AY732463 | DENV1 E | AF425609 | DENV1 E | DQ265115 |
| DENV1 E | AF425617 | DENV1 E | DQ265064 | DENV1 E | DQ264945 | DENV1 E | AY620951 |
| DENV1 E | EU448393 | DENV1 E | AY618878 | DENV1 E | AY630408 | DENV1 E | FJ687477 |
| DENV1 E | AB111071 | DENV1 E | DQ211349 | DENV1 E | AF425621 | DENV1 E | AB111078 |
| DENV1 E | AY620953 | DENV1 E | DQ264950 | DENV1 E | AY732386 | DENV1 E | AF425633 |
| DENV1 E | EF654104 | DENV1 E | EU069623 | DENV1 E | DQ264904 | DENV1 E | DQ265136 |
| DENV1 E | EU117306 | DENV1 E | AY732470 | DENV1 E | AY732409 | DENV1 E | AF231721 |
| DENV1 E | DQ264989 | DENV1 E | AB003090 | DENV1 E | AY422780 | DENV1 E | AY618880 |
| DENV1 E | EU448392 | DENV1 E | EU069620 | DENV1 E | DQ265054 | DENV1 E | AY732453 |
| DENV1 E | EF508200 | DENV1 E | DQ341191 | DENV1 E | DQ341190 | DENV1 E | EU117305 |
| DENV1 E | EU448410 | DENV1 E | DQ264910 | DENV1 E | AY732431 | DENV1 E | DQ264927 |
| DENV1 E | EU448400 | DENV1 E | AY732417 | DENV1 E | DQ265062 | DENV1 E | AB188831 |

FIG. 66-45

| Virus | Protein | Accession No. | Virus | Protein | Accession No. | Virus | Protein | Accession No. | Virus | Protein | Accession No. |
|---|---|---|---|---|---|---|---|---|---|---|---|
| DENV1 | E | DQ265046 | DENV1 | NS1 | EU848545 | DENV1 | NS1 | GU131956 | DENV1 | NS1 | FJ024472 |
| DENV1 | E | DQ264991 | DENV1 | NS1 | GU131760 | DENV1 | NS1 | EU482797 | DENV1 | NS1 | EU081236 |
| DENV1 | E | DQ264971 | DENV1 | NS1 | GU131965 | DENV1 | NS1 | FJ410213 | DENV1 | NS1 | EU482480 |
| DENV1 | E | DQ264955 | DENV1 | NS1 | FJ898415 | DENV1 | NS1 | FJ898384 | DENV1 | NS1 | GU131795 |
| DENV1 | E | DQ264974 | DENV1 | NS1 | GU131782 | DENV1 | NS1 | FJ410186 | DENV1 | NS1 | FJ432736 |
| DENV1 | E | DQ265050 | DENV1 | NS1 | GQ868535 | DENV1 | NS1 | GQ868538 | DENV1 | NS1 | FJ024480 |
| DENV1 | E | EF654109 | DENV1 | NS1 | EU482524 | DENV1 | NS1 | EU677163 | DENV1 | NS1 | EU081278 |
| DENV1 | E | AB111065 | DENV1 | NS1 | GU131726 | DENV1 | NS1 | FJ432742 | DENV1 | NS1 | FJ182019 |
| DENV1 | NS1 | FJ639670 | DENV1 | NS1 | GQ868501 | DENV1 | NS1 | FJ461303 | DENV1 | NS1 | GU131919 |
| DENV1 | NS1 | FJ024446 | DENV1 | NS1 | FJ432734 | DENV1 | NS1 | FJ639679 | DENV1 | NS1 | GU131682 |
| DENV1 | NS1 | GU131759 | DENV1 | NS1 | FJ410253 | DENV1 | NS1 | FJ469909 | DENV1 | NS1 | EU482714 |
| DENV1 | NS1 | FJ882560 | DENV1 | NS1 | FJ410281 | DENV1 | NS1 | EU081227 | DENV1 | NS1 | FJ410197 |
| DENV1 | NS1 | GU131838 | DENV1 | NS1 | EU482708 | DENV1 | NS1 | EU482534 | DENV1 | NS1 | GU131744 |
| DENV1 | NS1 | FJ024437 | DENV1 | NS1 | GQ199784 | DENV1 | NS1 | FJ410261 | DENV1 | NS1 | FJ410183 |
| DENV1 | NS1 | GQ868639 | DENV1 | NS1 | GQ868567 | DENV1 | NS1 | FJ687428 | DENV1 | NS1 | GQ199875 |
| DENV1 | NS1 | FJ639806 | DENV1 | NS1 | EU280167 | DENV1 | NS1 | EU660392 | DENV1 | NS1 | GQ199845 |
| DENV1 | NS1 | GQ199837 | DENV1 | NS1 | FJ850084 | DENV1 | NS1 | GQ199815 | DENV1 | NS1 | GU131689 |
| DENV1 | NS1 | AB189120 | DENV1 | NS1 | EU482514 | DENV1 | NS1 | EU482611 | DENV1 | NS1 | FJ461323 |
| DENV1 | NS1 | EU081235 | DENV1 | NS1 | AY722802 | DENV1 | NS1 | FJ639821 | DENV1 | NS1 | FJ432740 |
| DENV1 | NS1 | FJ410263 | DENV1 | NS1 | FJ639808 | DENV1 | NS1 | FJ410174 | DENV1 | NS1 | AY713474 |
| DENV1 | NS1 | AY713476 | DENV1 | NS1 | EU482526 | DENV1 | NS1 | GU131706 | DENV1 | NS1 | GQ199789 |
| DENV1 | NS1 | GQ199806 | DENV1 | NS1 | AY732476 | DENV1 | NS1 | AY373427 | DENV1 | NS1 | GU131977 |
| DENV1 | NS1 | GU131693 | DENV1 | NS1 | GU131772 | DENV1 | NS1 | EU249495 | DENV1 | NS1 | FJ850069 |
| DENV1 | NS1 | GU131753 | DENV1 | NS1 | FJ882530 | DENV1 | NS1 | EU482477 | DENV1 | NS1 | EF457905 |
| DENV1 | NS1 | GU131711 | DENV1 | NS1 | GU131978 | DENV1 | NS1 | EU482826 | DENV1 | NS1 | FJ898421 |
| DENV1 | NS1 | FJ639812 | DENV1 | NS1 | FJ547088 | DENV1 | NS1 | GQ199843 | DENV1 | NS1 | FJ744701 |
| DENV1 | NS1 | GU131765 | DENV1 | NS1 | FJ898374 | DENV1 | NS1 | GQ199821 | DENV1 | NS1 | GQ199788 |
| DENV1 | NS1 | FJ432744 | DENV1 | NS1 | GQ868504 | DENV1 | NS1 | GU131777 | DENV1 | NS1 | EU726778 |
| DENV1 | NS1 | GM059691 | DENV1 | NS1 | FJ882550 | DENV1 | NS1 | FJ898378 | DENV1 | NS1 | EU081263 |
| DENV1 | NS1 | FJ410278 | DENV1 | NS1 | FJ850113 | DENV1 | NS1 | FJ461306 | DENV1 | NS1 | FJ205874 |
| DENV1 | NS1 | EU081261 | DENV1 | NS1 | GU131980 | DENV1 | NS1 | GU131707 | DENV1 | NS1 | GU131826 |
| DENV1 | NS1 | EU482801 | DENV1 | NS1 | GU131783 | DENV1 | NS1 | AF226686 | DENV1 | NS1 | FJ898407 |
| DENV1 | NS1 | FJ882526 | DENV1 | NS1 | AY732474 | DENV1 | NS1 | EU677152 | DENV1 | NS1 | GQ199804 |
| DENV1 | NS1 | FJ639823 | DENV1 | NS1 | GU131958 | DENV1 | NS1 | GU131828 | DENV1 | NS1 | FJ024478 |
| DENV1 | NS1 | EU081260 | DENV1 | NS1 | FJ898393 | DENV1 | NS1 | GU131971 | DENV1 | NS1 | FJ850102 |
| DENV1 | NS1 | GQ199786 | DENV1 | NS1 | EU677176 | DENV1 | NS1 | GQ199826 | DENV1 | NS1 | FJ432721 |
| DENV1 | NS1 | AY726550 | DENV1 | NS1 | FJ850104 | DENV1 | NS1 | EU677168 | DENV1 | NS1 | EU660418 |
| DENV1 | NS1 | FJ882558 | DENV1 | NS1 | EU249492 | DENV1 | NS1 | FJ461313 | DENV1 | NS1 | EF032590 |
| DENV1 | NS1 | GU131809 | DENV1 | NS1 | EU482712 | DENV1 | NS1 | EU081267 | DENV1 | NS1 | AY713473 |
| DENV1 | NS1 | FJ182030 | DENV1 | NS1 | FJ410236 | DENV1 | NS1 | FJ410175 | DENV1 | NS1 | GU131700 |
| DENV1 | NS1 | EU482816 | DENV1 | NS1 | FJ410192 | DENV1 | NS1 | FJ182028 | DENV1 | NS1 | GQ868523 |
| DENV1 | NS1 | GU131813 | DENV1 | NS1 | EU081281 | DENV1 | NS1 | FJ882516 | DENV1 | NS1 | GQ868522 |
| DENV1 | NS1 | EU482808 | DENV1 | NS1 | FJ432729 | DENV1 | NS1 | FJ024456 | DENV1 | NS1 | EU660402 |
| DENV1 | NS1 | EU482498 | DENV1 | NS1 | GQ868525 | DENV1 | NS1 | AF311956 | DENV1 | NS1 | FJ639676 |
| DENV1 | NS1 | FJ882525 | DENV1 | NS1 | FN429883 | DENV1 | NS1 | GU131770 | DENV1 | NS1 | FJ410272 |
| DENV1 | NS1 | GU131731 | DENV1 | NS1 | GQ199828 | DENV1 | NS1 | GU131824 | DENV1 | NS1 | AY277665 |
| DENV1 | NS1 | GQ199794 | DENV1 | NS1 | FJ182021 | DENV1 | NS1 | GQ199854 | DENV1 | NS1 | GQ199802 |
| DENV1 | NS1 | GU131832 | DENV1 | NS1 | EU482824 | DENV1 | NS1 | FJ898410 | DENV1 | NS1 | FJ882549 |

FIG. 66-46

| Virus Protein Accession No. | Virus Protein Accession No. | Virus Protein Accession No. | Virus Protein Accession No. |
|---|---|---|---|
| DENV1 NS1FJ898391 | DENV1 NS1EU482711 | DENV1 NS1FJ024482 | DENV1 NS1FJ906964 |
| DENV1 NS1GQ199830 | DENV1 NS1GQ868605 | DENV1 NS1GU131698 | DENV1 NS1EU482618 |
| DENV1 NS1DQ672562 | DENV1 NS1GQ868565 | DENV1 NS1FJ024432 | DENV1 NS1FJ410246 |
| DENV1 NS1GU131757 | DENV1 NS1GQ868608 | DENV1 NS1FJ882556 | DENV1 NS1GQ868534 |
| DENV1 NS1GQ199839 | DENV1 NS1FJ898417 | DENV1 NS1GU131831 | DENV1 NS1GQ199835 |
| DENV1 NS1FJ898437 | DENV1 NS1FJ024426 | DENV1 NS1AY835999 | DENV1 NS1GU131716 |
| DENV1 NS1EU081250 | DENV1 NS1GQ868511 | DENV1 NS1GU131922 | DENV1 NS1FJ410256 |
| DENV1 NS1GU131963 | DENV1 NS1FJ882562 | DENV1 NS1FJ898376 | DENV1 NS1FJ898424 |
| DENV1 NS1FJ410257 | DENV1 NS1GU131752 | DENV1 NS1FJ898425 | DENV1 NS1GU131687 |
| DENV1 NS1GU131798 | DENV1 NS1GQ199811 | DENV1 NS1FJ898419 | DENV1 NS1EU482615 |
| DENV1 NS1GQ868508 | DENV1 NS1GQ868518 | DENV1 NS1GQ199799 | DENV1 NS1FJ410285 |
| DENV1 NS1EU482789 | DENV1 NS1FJ850075 | DENV1 NS1GU056029 | DENV1 NS1FJ898388 |
| DENV1 NS1U88536 | DENV1 NS1FJ850100 | DENV1 NS1AY145122 | DENV1 NS1GQ868529 |
| DENV1 NS1GU131807 | DENV1 NS1GU131709 | DENV1 NS1GU131811 | DENV1 NS1FJ882579 |
| DENV1 NS1GQ868533 | DENV1 NS1GQ199848 | DENV1 NS1EU482495 | DENV1 NS1FJ024442 |
| DENV1 NS1FJ898390 | DENV1 NS1FJ024429 | DENV1 NS1GQ868506 | DENV1 NS1GQ868563 |
| DENV1 NS1EU081259 | DENV1 NS1FJ461315 | DENV1 NS1GU131961 | DENV1 NS1FJ639743 |
| DENV1 NS1EU482806 | DENV1 NS1EU677154 | DENV1 NS1FJ410269 | DENV1 NS1FJ390378 |
| DENV1 NS1FJ373298 | DENV1 NS1GU056033 | DENV1 NS1GQ199833 | DENV1 NS1GU131837 |
| DENV1 NS1FJ898382 | DENV1 NS1FN429890 | DENV1 NS1EU081238 | DENV1 NS1FJ432732 |
| DENV1 NS1FJ410250 | DENV1 NS1EU482822 | DENV1 NS1GU131748 | DENV1 NS1GU131840 |
| DENV1 NS1FJ410226 | DENV1 NS1GU131746 | DENV1 NS1FJ410248 | DENV1 NS1EU677174 |
| DENV1 NS1GU131785 | DENV1 NS1FJ390382 | DENV1 NS1GU131733 | DENV1 NS1FJ639680 |
| DENV1 NS1GU131842 | DENV1 NS1GU131724 | DENV1 NS1FJ461325 | DENV1 NS1GQ199849 |
| DENV1 NS1GU131836 | DENV1 NS1EU677161 | DENV1 NS1GQ199817 | DENV1 NS1FJ882566 |
| DENV1 NS1GQ199824 | DENV1 NS1EU482536 | DENV1 NS1GU131691 | DENV1 NS1FJ882541 |
| DENV1 NS1EU482790 | DENV1 NS1GU131713 | DENV1 NS1GU131804 | DENV1 NS1FJ639802 |
| DENV1 NS1EU081257 | DENV1 NS1GU131721 | DENV1 NS1FJ562106 | DENV1 NS1FJ432725 |
| DENV1 NS1FJ024449 | DENV1 NS1EU660397 | DENV1 NS1FJ639682 | DENV1 NS1FN429888 |
| DENV1 NS1FJ024430 | DENV1 NS1AF493075 | DENV1 NS1GU131792 | DENV1 NS1EU482492 |
| DENV1 NS1EU482815 | DENV1 NS1FJ906965 | DENV1 NS1FJ882522 | DENV1 NS1FJ882557 |
| DENV1 NS1FJ898398 | DENV1 NS1EU081280 | DENV1 NS1GU131742 | DENV1 NS1FJ639669 |
| DENV1 NS1EU482530 | DENV1 NS1FJ639692 | DENV1 NS1GU131761 | DENV1 NS1EU482792 |
| DENV1 NS1GQ868636 | DENV1 NS1EU249494 | DENV1 NS1GQ868561 | DENV1 NS1FJ461340 |
| DENV1 NS1FJ024459 | DENV1 NS1FJ639819 | DENV1 NS1FJ410245 | DENV1 NS1GU131805 |
| DENV1 NS1GQ868610 | DENV1 NS1EU482529 | DENV1 NS1GQ868520 | DENV1 NS1FJ410264 |
| DENV1 NS1EU081233 | DENV1 NS1EU482616 | DENV1 NS1EU482707 | DENV1 NS1EU482516 |
| DENV1 NS1FJ687426 | DENV1 NS1FJ410284 | DENV1 NS1EU482520 | DENV1 NS1FJ469907 |
| DENV1 NS1FJ898404 | DENV1 NS1FJ410181 | DENV1 NS1FJ882536 | DENV1 NS1FJ898396 |
| DENV1 NS1EU081244 | DENV1 NS1FJ461332 | DENV1 NS1EU081248 | DENV1 NS1EU677157 |
| DENV1 NS1EU482522 | DENV1 NS1GQ199777 | DENV1 NS1GQ868531 | DENV1 NS1EU482510 |
| DENV1 NS1FJ205882 | DENV1 NS1EU081229 | DENV1 NS1EU482533 | DENV1 NS1FJ182034 |
| DENV1 NS1GU131788 | DENV1 NS1FJ410270 | DENV1 NS1FJ898411 | DENV1 NS1FJ898377 |
| DENV1 NS1GU131762 | DENV1 NS1GQ199873 | DENV1 NS1GQ199796 | DENV1 NS1EU660390 |
| DENV1 NS1FJ410238 | DENV1 NS1M23027 | DENV1 NS1GU131818 | DENV1 NS1GU131718 |
| DENV1 NS1DQ285558 | DENV1 NS1FJ024451 | DENV1 NS1EU081239 | DENV1 NS1GQ868513 |
| DENV1 NS1FJ898371 | DENV1 NS1GU131739 | DENV1 NS1EU081255 | DENV1 NS1FJ639740 |
| DENV1 NS1FJ461308 | DENV1 NS1EU482482 | DENV1 NS1EU359008 | DENV1 NS1FJ882533 |

FIG. 66-47

| Virus Protein Accession No. | Virus Protein Accession No. | Virus Protein Accession No. | Virus Protein Accession No. |
|---|---|---|---|
| DENV1 NS1GU131926 | DENV1 NS1FJ898383 | DENV1 NS1GU131793 | DENV1 NS1EU596504 |
| DENV1 NS1GU131734 | DENV1 NS1GU131984 | DENV1 NS1FN429882 | DENV1 NS1FJ410276 |
| DENV1 NS1EU482519 | DENV1 NS1GQ868498 | DENV1 NS1EU482509 | DENV1 NS1FJ898386 |
| DENV1 NS1AY206457 | DENV1 NS1EU482487 | DENV1 NS1FJ547086 | DENV1 NS1EU482506 |
| DENV1 NS1GQ199818 | DENV1 NS1FJ639818 | DENV1 NS1FJ639694 | DENV1 NS1GU131736 |
| DENV1 NS1FJ850077 | DENV1 NS1EU677166 | DENV1 NS1EU482491 | DENV1 NS1GU131948 |
| DENV1 NS1AY726553 | DENV1 NS1GU131758 | DENV1 NS1GU131755 | DENV1 NS1GU131834 |
| DENV1 NS1EU482718 | DENV1 NS1GU131697 | DENV1 NS1FJ898430 | DENV1 NS1EU482715 |
| DENV1 NS1EU081274 | DENV1 NS1EU081247 | DENV1 NS1FJ898428 | DENV1 NS1EU482716 |
| DENV1 NS1FJ182025 | DENV1 NS1AY376738 | DENV1 NS1FJ639814 | DENV1 NS1FJ850087 |
| DENV1 NS1GU131973 | DENV1 NS1GU131776 | DENV1 NS1GU131763 | DENV1 NS1AF514883 |
| DENV1 NS1EU482811 | DENV1 NS1FJ390380 | DENV1 NS1FJ873814 | DENV1 NS1EU660395 |
| DENV1 NS1FJ410210 | DENV1 NS1FJ882547 | DENV1 NS1FJ850093 | DENV1 NS1FJ410262 |
| DENV1 NS1GU131925 | DENV1 NS1GQ868611 | DENV1 NS1GU131728 | DENV1 NS1EU081243 |
| DENV1 NS1FJ373297 | DENV1 NS1FJ410231 | DENV1 NS1FJ898372 | DENV1 NS1CS477264 |
| DENV1 NS1FJ205875 | DENV1 NS1GU131680 | DENV1 NS1EU677172 | DENV1 NS1FJ562104 |
| DENV1 NS1DQ193572 | DENV1 NS1M87512 | DENV1 NS1FJ639794 | DENV1 NS1GQ199823 |
| DENV1 NS1U88535 | DENV1 NS1FJ024440 | DENV1 NS1GQ868527 | DENV1 NS1FJ639741 |
| DENV1 NS1FJ882564 | DENV1 NS1GU131774 | DENV1 NS1FJ687430 | DENV1 NS1GU131690 |
| DENV1 NS1GQ199774 | DENV1 NS1DQ672560 | DENV1 NS1FJ639672 | DENV1 NS1EU482497 |
| DENV1 NS1GQ199787 | DENV1 NS1GQ868512 | DENV1 NS1FJ410189 | DENV1 NS1GU370049 |
| DENV1 NS1FJ850099 | DENV1 NS1FJ024463 | DENV1 NS1FJ182023 | DENV1 NS1GQ868632 |
| DENV1 NS1FJ410267 | DENV1 NS1EF122231 | DENV1 NS1FJ410260 | DENV1 NS1GQ868613 |
| DENV1 NS1EU726777 | DENV1 NS1GQ199810 | DENV1 NS1EU081266 | DENV1 NS1GU131893 |
| DENV1 NS1EU081241 | DENV1 NS1FJ850081 | DENV1 NS1GU131895 | DENV1 NS1EU687247 |
| DENV1 NS1FJ898381 | DENV1 NS1FJ024427 | DENV1 NS1GU131829 | DENV1 NS1EU482813 |
| DENV1 NS1CS477265 | DENV1 NS1GQ868637 | DENV1 NS1FJ410204 | DENV1 NS1AY871814 |
| DENV1 NS1GQ199780 | DENV1 NS1FJ639796 | DENV1 NS1FJ410194 | DENV1 NS1AY713475 |
| DENV1 NS1FN429889 | DENV1 NS1EU677159 | DENV1 NS1FJ882528 | DENV1 NS1FJ024438 |
| DENV1 NS1FJ024434 | DENV1 NS1FJ882519 | DENV1 NS1FJ432730 | DENV1 NS1FJ882542 |
| DENV1 NS1FJ024483 | DENV1 NS1GQ199825 | DENV1 NS1EU081230 | DENV1 NS1GU131982 |
| DENV1 NS1EU482502 | DENV1 NS1EU482525 | DENV1 NS1FJ410206 | DENV1 NS1FJ461328 |
| DENV1 NS1GU131962 | DENV1 NS1EU482798 | DENV1 NS1GU131969 | DENV1 NS1FJ687432 |
| DENV1 NS1AY089980 | DENV1 NS1FJ182032 | DENV1 NS1AY732478 | DENV1 NS1FJ410188 |
| DENV1 NS1FJ461339 | DENV1 NS1GU131769 | DENV1 NS1FJ461330 | DENV1 NS1GQ199813 |
| DENV1 NS1EU482821 | DENV1 NS1GQ199792 | DENV1 NS1DQ672556 | DENV1 NS1GQ199847 |
| DENV1 NS1GU131891 | DENV1 NS1GU131888 | DENV1 NS1GU131976 | DENV1 NS1FJ410212 |
| DENV1 NS1EU660403 | DENV1 NS1GU131704 | DENV1 NS1FJ410216 | DENV1 NS1FJ410232 |
| DENV1 NS1FJ410275 | DENV1 NS1GQ199850 | DENV1 NS1GQ199801 | DENV1 NS1EU482481 |
| DENV1 NS1GQ868559 | DENV1 NS1GQ868526 | DENV1 NS1FJ906728 | DENV1 NS1AY726551 |
| DENV1 NS1AF298808 | DENV1 NS1EF032589 | DENV1 NS1GU131803 | DENV1 NS1FJ639811 |
| DENV1 NS1FJ410218 | DENV1 NS1GU131695 | DENV1 NS1AY726555 | DENV1 NS1GU131800 |
| DENV1 NS1GQ199775 | DENV1 NS1FJ410243 | DENV1 NS1GQ199798 | DENV1 NS1FJ024425 |
| DENV1 NS1FJ882552 | DENV1 NS1AF309641 | DENV1 NS1GU056030 | DENV1 NS1EU482527 |
| DENV1 NS1FJ898402 | DENV1 NS1FJ639686 | DENV1 NS1GU131816 | DENV1 NS1EU482500 |
| DENV1 NS1GQ199859 | DENV1 NS1FJ410255 | DENV1 NS1EU482512 | DENV1 NS1EU482828 |
| DENV1 NS1FJ410196 | DENV1 NS1EU482818 | DENV1 NS1FJ882568 | DENV1 NS1FJ205873 |
| DENV1 NS1FJ639690 | DENV1 NS1GU131685 | DENV1 NS1FJ898413 | DENV1 NS1AY732481 |

FIG. 66-48

| Virus Protein Accession No. | Virus Protein Accession No. | Virus Protein Accession No. | Virus Protein Accession No. |
|---|---|---|---|
| DENV1 NS1GQ199782 | DENV1 NS1FJ176779 | DENV1 NS1GQ199856 | DENV1 NS1GU056032 |
| DENV1 NS1EU677150 | DENV1 NS1FJ461335 | DENV1 NS1EU482709 | DENV1 NS1FJ390374 |
| DENV1 NS1EU482591 | DENV1 NS1FJ898408 | DENV1 NS1GQ868618 | DENV1 NS1FJ882527 |
| DENV1 NS1GU131738 | DENV1 NS1GQ199844 | DENV1 NS1GU131699 | DENV1 NS1GU131830 |
| DENV1 NS1EF032592 | DENV1 NS1GU131970 | DENV1 NS1FJ182029 | DENV1 NS1EU482791 |
| DENV1 NS1FJ024485 | DENV1 NS1EU482796 | DENV1 NS1GQ199855 | DENV1 NS1FJ898427 |
| DENV1 NS1EU677177 | DENV1 NS1EU596502 | DENV1 NS1FJ882539 | DENV1 NS1FJ410234 |
| DENV1 NS1GU131967 | DENV1 NS1GQ868607 | DENV1 NS1FJ410180 | DENV1 NS1EU482494 |
| DENV1 NS1GU131814 | DENV1 NS1GQ868524 | DENV1 NS1GU131806 | DENV1 NS1FJ432720 |
| DENV1 NS1AJ968413 | DENV1 NS1GQ868517 | DENV1 NS1DQ672564 | DENV1 NS1FJ639735 |
| DENV1 NS1FJ024436 | DENV1 NS1EU081268 | DENV1 NS1FJ410268 | DENV1 NS1FJ898406 |
| DENV1 NS1FJ432746 | DENV1 NS1GQ199827 | DENV1 NS1GU131825 | DENV1 NS1DQ672563 |
| DENV1 NS1FJ850071 | DENV1 NS1EU660394 | DENV1 NS1FJ850101 | DENV1 NS1GQ199793 |
| DENV1 NS1EU081271 | DENV1 NS1EU482610 | DENV1 NS1FJ182002 | DENV1 NS1EU482807 |
| DENV1 NS1AY708047 | DENV1 NS1EU179861 | DENV1 NS1GU131683 | DENV1 NS1GU131797 |
| DENV1 NS1EU677169 | DENV1 NS1AB074761 | DENV1 NS1FJ639685 | DENV1 NS1FJ410258 |
| DENV1 NS1FJ882535 | DENV1 NS1GQ199829 | DENV1 NS1EU482535 | DENV1 NS1EU482802 |
| DENV1 NS1FJ547087 | DENV1 NS1GU131863 | DENV1 NS1FJ024433 | DENV1 NS1GQ868633 |
| DENV1 NS1EU677164 | DENV1 NS1GU131892 | DENV1 NS1FJ176780 | DENV1 NS1AB074760 |
| DENV1 NS1GU131725 | DENV1 NS1GQ868530 | DENV1 NS1FJ373305 | DENV1 NS1EU081256 |
| DENV1 NS1DQ285561 | DENV1 NS1FJ410173 | DENV1 NS1FJ410279 | DENV1 NS1FJ432735 |
| DENV1 NS1GU131678 | DENV1 NS1EU482814 | DENV1 NS1EU081279 | DENV1 NS1GQ199781 |
| DENV1 NS1GU131822 | DENV1 NS1EU660393 | DENV1 NS1GU131756 | DENV1 NS1DQ285559 |
| DENV1 NS1EU482479 | DENV1 NS1FJ639815 | DENV1 NS1FJ478457 | DENV1 NS1FJ182036 |
| DENV1 NS1FJ882518 | DENV1 NS1GU131979 | DENV1 NS1FJ024457 | DENV1 NS1FJ547089 |
| DENV1 NS1FJ639696 | DENV1 NS1EU482827 | DENV1 NS1AB189121 | DENV1 NS1FJ898416 |
| DENV1 NS1GQ199857 | DENV1 NS1FJ461316 | DENV1 NS1DQ285562 | DENV1 NS1GU131960 |
| DENV1 NS1GQ199808 | DENV1 NS1FJ882544 | DENV1 NS1FJ850103 | DENV1 NS1GU131820 |
| DENV1 NS1FJ432749 | DENV1 NS1GU131768 | DENV1 NS1EU482499 | DENV1 NS1EU677170 |
| DENV1 NS1GU131771 | DENV1 NS1EU482567 | DENV1 NS1GQ199805 | DENV1 NS1FJ882531 |
| DENV1 NS1GQ199772 | DENV1 NS1GU131957 | DENV1 NS1GQ868568 | DENV1 NS1AF514889 |
| DENV1 NS1FJ882538 | DENV1 NS1DQ672559 | DENV1 NS1FJ547068 | DENV1 NS1EU863650 |
| DENV1 NS1FJ410283 | DENV1 NS1EU677153 | DENV1 NS1EU081234 | DENV1 NS1FB667403 |
| DENV1 NS1FJ882521 | DENV1 NS1AF226687 | DENV1 NS1FJ432739 | DENV1 NS1GU131714 |
| DENV1 NS1EU726779 | DENV1 NS1EU482825 | DENV1 NS1GQ199816 | DENV1 NS1FJ882569 |
| DENV1 NS1EU081253 | DENV1 NS1FJ182022 | DENV1 NS1FJ898401 | DENV1 NS1FJ410280 |
| DENV1 NS1FN429886 | DENV1 NS1EU482592 | DENV1 NS1GU131812 | DENV1 NS1FJ882548 |
| DENV1 NS1GQ868601 | DENV1 NS1EU482800 | DENV1 NS1EU660419 | DENV1 NS1FJ859029 |
| DENV1 NS1FJ182003 | DENV1 NS1X69395 | DENV1 NS1GQ199831 | DENV1 NS1GU131781 |
| DENV1 NS1FJ410286 | DENV1 NS1GU131745 | DENV1 NS1AY732475 | DENV1 NS1FJ410252 |
| DENV1 NS1FJ639684 | DENV1 NS1FJ410184 | DENV1 NS1EU249491 | DENV1 NS1EU081262 |
| DENV1 NS1EU482794 | DENV1 NS1GQ199778 | DENV1 NS1GU131833 | DENV1 NS1GQ199842 |
| DENV1 NS1AY722801 | DENV1 NS1FJ390383 | DENV1 NS1GQ199836 | DENV1 NS1EU726782 |
| DENV1 NS1FJ410199 | DENV1 NS1FJ410203 | DENV1 NS1FJ410240 | DENV1 NS1GQ868537 |
| DENV1 NS1EU482485 | DENV1 NS1EU482476 | DENV1 NS1FJ410225 | DENV1 NS1GQ199797 |
| DENV1 NS1EU482803 | DENV1 NS1AY145123 | DENV1 NS1GU131732 | DENV1 NS1FJ882515 |
| DENV1 NS1GU131767 | DENV1 NS1EU081270 | DENV1 NS1FJ639677 | DENV1 NS1FJ024450 |
| DENV1 NS1AY726549 | DENV1 NS1GQ199872 | DENV1 NS1FJ810419 | DENV1 NS1GU131723 |

FIG. 66-49

| Virus Protein Accession No. | Virus Protein Accession No. | Virus Protein Accession No. | Virus Protein Accession No. |
|---|---|---|---|
| DENV1 NS1GQ868503 | DENV1 NS1FJ850073 | DENV1 NS1GQ868635 | DENV1 NS1FJ898392 |
| DENV1 NS1FJ882551 | DENV1 NS1EU081237 | DENV1 NS1DQ285560 | DENV1 NS1FJ024448 |
| DENV1 NS1FJ461318 | DENV1 NS1EU482483 | DENV1 NS1FJ410239 | DENV1 NS1GQ868507 |
| DENV1 NS1FJ898418 | DENV1 NS1GQ199853 | DENV1 NS1FJ882554 | DENV1 NS1EU482531 |
| DENV1 NS1GQ199820 | DENV1 NS1GU131921 | DENV1 NS1GU131747 | DENV1 NS1GQ868510 |
| DENV1 NS1AF513110 | DENV1 NS1FJ182031 | DENV1 NS1FJ024481 | DENV1 NS1FJ410290 |
| DENV1 NS1FJ410191 | DENV1 NS1FJ639683 | DENV1 NS1FJ639675 | DENV1 NS1GU131981 |
| DENV1 NS1FJ024431 | DENV1 NS1GU131740 | DENV1 NS1GU131810 | DENV1 NS1EU660391 |
| DENV1 NS1FJ898394 | DENV1 NS1FJ562105 | DENV1 NS1FJ410249 | DENV1 NS1EU482515 |
| DENV1 NS1FJ024445 | DENV1 NS1FJ432745 | DENV1 NS1DQ672561 | DENV1 NS1EU081232 |
| DENV1 NS1EU081242 | DENV1 NS1AY277664 | DENV1 NS1FJ810415 | DENV1 NS1GQ199840 |
| DENV1 NS1FJ461333 | DENV1 NS1FJ882559 | DENV1 NS1GQ199785 | DENV1 NS1EU482710 |
| DENV1 NS1GQ868509 | DENV1 NS1FJ024435 | DENV1 NS1FJ410220 | DENV1 NS1GQ868566 |
| DENV1 NS1FJ410209 | DENV1 NS1GQ199803 | DENV1 NS1EU482504 | DENV1 NS1GU131964 |
| DENV1 NS1GU131839 | DENV1 NS1FJ461320 | DENV1 NS1FJ205881 | DENV1 NS1EU482713 |
| DENV1 NS1FJ410251 | DENV1 NS1FJ850090 | DENV1 NS1EU081264 | DENV1 NS1EU482538 |
| DENV1 NS1EU677175 | DENV1 NS1EU482528 | DENV1 NS1GU131688 | DENV1 NS1EU081245 |
| DENV1 NS1FJ639820 | DENV1 NS1FJ898448 | DENV1 NS1A75711 | DENV1 NS1GQ868619 |
| DENV1 NS1GQ199867 | DENV1 NS1FJ898420 | DENV1 NS1EU081254 | DENV1 NS1GU131789 |
| DENV1 NS1FJ024428 | DENV1 NS1GQ868519 | DENV1 NS1FJ898429 | DENV1 NS1AB178040 |
| DENV1 NS1EU482537 | DENV1 NS1FJ432727 | DENV1 NS1FJ469908 | DENV1 NS1AY732480 |
| DENV1 NS1GU131778 | DENV1 NS1EU677155 | DENV1 NS1GU131799 | DENV1 NS1FJ898385 |
| DENV1 NS1FJ024464 | DENV1 NS1EU677162 | DENV1 NS1FJ182027 | DENV1 NS1FJ639688 |
| DENV1 NS1GU131972 | DENV1 NS1GU131692 | DENV1 NS1FJ432737 | DENV1 NS1FJ205884 |
| DENV1 NS1GQ868606 | DENV1 NS1EU596501 | DENV1 NS1FJ410201 | DENV1 NS1FJ898380 |
| DENV1 NS1GU131679 | DENV1 NS1FJ410273 | DENV1 NS1GU131701 | DENV1 NS1FJ182026 |
| DENV1 NS1GU131708 | DENV1 NS1FJ410182 | DENV1 NS1EU081269 | DENV1 NS1AF311957 |
| DENV1 NS1EU687251 | DENV1 NS1GQ199791 | DENV1 NS1GQ199783 | DENV1 NS1FJ639693 |
| DENV1 NS1AF226685 | DENV1 NS1GQ868630 | DENV1 NS1GU131754 | DENV1 NS1GU131735 |
| DENV1 NS1FJ882561 | DENV1 NS1EU482503 | DENV1 NS1EU081251 | DENV1 NS1FJ850114 |
| DENV1 NS1EU482488 | DENV1 NS1FB730116 | DENV1 NS1FJ432733 | DENV1 NS1FJ882563 |
| DENV1 NS1FJ410214 | DENV1 NS1FJ410198 | DENV1 NS1FJ024447 | DENV1 NS1GQ199812 |
| DENV1 NS1FJ687429 | DENV1 NS1EU081276 | DENV1 NS1FJ547063 | DENV1 NS1GU131737 |
| DENV1 NS1FJ898379 | DENV1 NS1FJ461324 | DENV1 NS1EU482523 | DENV1 NS1FJ547060 |
| DENV1 NS1GU131790 | DENV1 NS1AF311958 | DENV1 NS1EU482793 | DENV1 NS1GQ199819 |
| DENV1 NS1EU482540 | DENV1 NS1FJ639813 | DENV1 NS1U88537 | DENV1 NS1FJ024484 |
| DENV1 NS1GU131681 | DENV1 NS1AF180817 | DENV1 NS1FJ898399 | DENV1 NS1GQ868500 |
| DENV1 NS1EU081226 | DENV1 NS1EU081277 | DENV1 NS1GQ868609 | DENV1 NS1EU249493 |
| DENV1 NS1FJ182020 | DENV1 NS1FJ898426 | DENV1 NS1EU726780 | DENV1 NS1EU081275 |
| DENV1 NS1FJ882524 | DENV1 NS1GU131729 | DENV1 NS1EU482805 | DENV1 NS1FJ432748 |
| DENV1 NS1EU677139 | DENV1 NS1GQ868539 | DENV1 NS1GU131784 | DENV1 NS1EU081228 |
| DENV1 NS1GU131920 | DENV1 NS1AY145121 | DENV1 NS1GU131827 | DENV1 NS1EU482810 |
| DENV1 NS1GQ868536 | DENV1 NS1EU677167 | DENV1 NS1FJ410227 | DENV1 NS1GQ199852 |
| DENV1 NS1GQ199776 | DENV1 NS1FJ898422 | DENV1 NS1GQ868505 | DENV1 NS1GU131923 |
| DENV1 NS1FJ390381 | DENV1 NS1FJ744702 | DENV1 NS1FN429884 | DENV1 NS1GQ199790 |
| DENV1 NS1GU131751 | DENV1 NS1GQ199838 | DENV1 NS1FJ873809 | DENV1 NS1FJ024423 |
| DENV1 NS1FJ390388 | DENV1 NS1GQ199779 | DENV1 NS1EU081258 | DENV1 NS1FJ882555 |
| DENV1 NS1EU482823 | DENV1 NS1FJ205883 | DENV1 NS1EU677173 | DENV1 NS1FJ898405 |

FIG. 66-50

| Virus Protein Accession No. | Virus Protein Accession No. | Virus Protein Accession No. | Virus Protein Accession No. |
|---|---|---|---|
| DENV1 NS1GU131889 | DENV1 NS1GU131715 | DENV1 NS1FJ882570 | DENV1 NS1AY726552 |
| DENV1 NS1GQ868499 | DENV1 NS1EU677156 | DENV1 NS1AF514885 | DENV1 NS1DQ836632 |
| DENV1 NS1EU482501 | DENV1 NS1FJ461317 | DENV1 NS1GU131802 | DENV1 NS1EU482484 |
| DENV1 NS1GU131775 | DENV1 NS1GU131794 | DENV1 NS1FJ687427 | DENV1 NS1AY722803 |
| DENV1 NS1EU081246 | DENV1 NS1FJ461341 | DENV1 NS1FJ182033 | DENV1 NS1GU131787 |
| DENV1 NS1GQ199773 | DENV1 NS1EU482511 | DENV1 NS1GQ199800 | DENV1 NS1FJ373296 |
| DENV1 NS1FJ898431 | DENV1 NS1FJ024453 | DENV1 NS1GU131702 | DENV1 NS1GU131887 |
| DENV1 NS1EU081231 | DENV1 NS1GU131749 | DENV1 NS1FJ432723 | DENV1 NS1GU131741 |
| DENV1 NS1EU482486 | DENV1 NS1FJ898389 | DENV1 NS1EU482505 | DENV1 NS1EU677178 |
| DENV1 NS1FJ410187 | DENV1 NS1GU131696 | DENV1 NS1FJ882532 | DENV1 NS1FJ898433 |
| DENV1 NS1FN429881 | DENV1 NS1EU482508 | DENV1 NS1AF514878 | DENV1 NS1FJ024443 |
| DENV1 NS1GU131764 | DENV1 NS1EU081265 | DENV1 NS1FJ882540 | DENV1 NS1FJ461336 |
| DENV1 NS1GQ868569 | DENV1 NS1FJ410247 | DENV1 NS1GU131703 | DENV1 NS1GQ199858 |
| DENV1 NS1GQ868612 | DENV1 NS1FJ461307 | DENV1 NS1FJ410190 | DENV1 NS1EU482820 |
| DENV1 NS1FJ461331 | DENV1 NS1GQ868560 | DENV1 NS1GQ868564 | DENV1 NS1EU482478 |
| DENV1 NS1FJ410282 | DENV1 NS1FJ461319 | DENV1 NS1GU131717 | DENV1 NS1GU131815 |
| DENV1 NS1FJ205872 | DENV1 NS1FJ898412 | DENV1 NS1EU081273 | DENV1 NS1GQ199834 |
| DENV1 NS1GQ199809 | DENV1 NS1GQ868521 | DENV1 NS1GQ199846 | DENV1 NS1GU131743 |
| DENV1 NS1GU131722 | DENV1 NS1GU131686 | DENV1 NS1AY732483 | DENV1 NS1GQ868614 |
| DENV1 NS1FJ873810 | DENV1 NS1AY732479 | DENV1 NS1CS477263 | DENV1 NS1EU482706 |
| DENV1 NS1FJ882546 | DENV1 NS1FJ384655 | DENV1 NS1EU482496 | DENV1 NS1AY376737 |
| DENV1 NS1FJ639797 | DENV1 NS1FJ882537 | DENV1 NS1FJ410265 | DENV1 NS1FJ562101 |
| DENV1 NS1EU677160 | DENV1 NS1FJ898373 | DENV1 NS1GU131720 | DENV1 NS1FB667398 |
| DENV1 NS1FJ461312 | DENV1 NS1GU131710 | DENV1 NS1FJ461327 | DENV1 NS1GU131808 |
| DENV1 NS1NC_001477 | DENV1 NS1EU677171 | DENV1 NS1GU370048 | DENV1 NS1GU131780 |
| DENV1 NS1GQ199841 | DENV1 NS1FJ024479 | DENV1 NS1FJ898409 | DENV1 NS1FJ639671 |
| DENV1 NS1FJ882534 | DENV1 NS1FJ687431 | DENV1 NS1FJ182024 | DENV1 NS1FJ390379 |
| DENV1 NS1FJ410289 | DENV1 NS1FJ882523 | DENV1 NS1FJ882565 | DENV1 NS1FJ024439 |
| DENV1 NS1FJ410179 | DENV1 NS1FJ547065 | DENV1 NS1GU131966 | DENV1 NS1AF350498 |
| DENV1 NS1FJ432719 | DENV1 NS1GU131791 | DENV1 NS1EU249490 | DENV1 NS1FJ432747 |
| DENV1 NS1AY277666 | DENV1 NS1GU131894 | DENV1 NS1AF514876 | DENV1 NS1EU482795 |
| DENV1 NS1GU131727 | DENV1 NS1EU482490 | DENV1 NS1FN429885 | DENV1 NS1FJ639678 |
| DENV1 NS1FJ024462 | DENV1 NS1EU482521 | DENV1 NS1EU081272 | DENV1 NS1EU482617 |
| DENV1 NS1FJ024441 | DENV1 NS1FJ898423 | DENV1 NS1GU131841 | DENV1 NS1FJ410287 |
| DENV1 NS1GQ199822 | DENV1 NS1EU660396 | DENV1 NS1GQ868570 | DENV1 NS1FJ024444 |
| DENV1 NS1FN429887 | DENV1 NS1AF180818 | DENV1 NS1GU131890 | DENV1 NS1EU482799 |
| DENV1 NS1EU482539 | DENV1 NS1AY726554 | DENV1 NS1FJ882553 | DENV1 NS1GU131750 |
| DENV1 NS1EU482804 | DENV1 NS1FJ898403 | DENV1 NS1GU131821 | DENV1 NS1FJ906963 |
| DENV1 NS1FJ882520 | DENV1 NS1CS479203 | DENV1 NS1GQ199771 | DENV1 NS1FJ410185 |
| DENV1 NS1FJ639689 | DENV1 NS1EU482517 | DENV1 NS1AB195673 | DENV1 NS1EU660412 |
| DENV1 NS1EU677140 | DENV1 NS1EU482609 | DENV1 NS1EU482812 | DENV1 NS1GU131779 |
| DENV1 NS1GQ199832 | DENV1 NS1FJ410266 | DENV1 NS1AF298807 | DENV1 NS1FJ639691 |
| DENV1 NS1FJ639695 | DENV1 NS1EU482493 | DENV1 NS1GU131801 | DENV1 NS1EU677165 |
| DENV1 NS1FJ410244 | DENV1 NS1FJ639674 | DENV1 NS1GU131983 | DENV1 NS1GU131773 |
| DENV1 NS1FJ898397 | DENV1 NS1FJ639673 | DENV1 NS1EF122232 | DENV1 NS1FJ882517 |
| DENV1 NS1GU131819 | DENV1 NS1AY732482 | DENV1 NS1AB519681 | DENV1 NS1FJ410230 |
| DENV1 NS1GU131823 | DENV1 NS1CS479204 | DENV1 NS1GQ199814 | DENV1 NS1FJ410211 |
| DENV1 NS1FJ882543 | DENV1 NS1EU482819 | DENV1 NS1X69396 | DENV1 NS1FJ850070 |

FIG. 66-51

| Virus Protein Accession No. | Virus Protein Accession No. | Virus Protein Accession No. | Virus Protein Accession No. |
|---|---|---|---|
| DENV1 NS1FJ024460 | DENV1 NS1GU131968 | DENV1 NS1AY089980 | DENV1 NS2A |
| DENV1 NS1GQ868562 | DENV1 NS1GQ868615 | DENV1 NS1EF032589 | FJ432744 |
| DENV1 NS1FJ882529 | DENV1 NS1FJ882567 | DENV1 NS1AY871814 | DENV1 NS2A |
| DENV1 NS1FJ639687 | DENV1 NS1DQ672558 | DENV1 NS1EF032592 | GM059691 |
| DENV1 NS1GU131684 | DENV1 NS1EU677151 | DENV1 NS1X69395 | DENV1 NS2A |
| DENV1 NS1FJ205876 | DENV1 NS1AB204803 | DENV1 NS1X69396 | FJ410278 |
| DENV1 NS1FJ410205 | DENV1 NS1FJ182018 | DENV1 NS1DQ836632 | DENV1 NS2A |
| DENV1 NS1FJ478458 | DENV1 NS1EU482809 | DENV1 NS1AY422468 | AF426122 |
| DENV1 NS1EU677158 | DENV1 NS1FJ687433 | DENV1 NS1EF113153 | DENV1 NS2A |
| DENV1 NS1EU482532 | DENV1 NS1FJ410277 | DENV1 NS1AY089979 | EU081261 |
| DENV1 NS1FJ410242 | DENV1 NS1GQ868502 | DENV1 NS2A | DENV1 NS2A |
| DENV1 NS1EU482619 | DENV1 NS1FJ461310 | FJ639670 | EU482801 |
| DENV1 NS1FJ410235 | DENV1 NS1FJ898375 | DENV1 NS2A | DENV1 NS2A |
| DENV1 NS1FJ898395 | DENV1 NS1AY858983 | FJ024446 | FJ882526 |
| DENV1 NS1GU131949 | DENV1 NS1GU131835 | DENV1 NS2A | DENV1 NS2A |
| DENV1 NS1AY732477 | DENV1 NS1FJ390386 | GU131759 | FJ639823 |
| DENV1 NS1EU596503 | DENV1 NS1EU482518 | DENV1 NS2A | DENV1 NS2A |
| DENV1 NS1GQ199851 | DENV1 NS1FJ898414 | FJ882560 | EU081260 |
| DENV1 NS1GU131796 | DENV1 NS1AY089979 | DENV1 NS2A | DENV1 NS2A |
| DENV1 NS1EU081252 | DENV1 NS1EU482717 | GU131838 | GQ199786 |
| DENV1 NS1GU131712 | DENV1 NS1DQ672557 | DENV1 NS2A | DENV1 NS2A |
| DENV1 NS1EU081249 | DENV1 NS1GQ199877 | FJ024437 | AY726550 |
| DENV1 NS1GU131730 | DENV1 NS1GU131719 | DENV1 NS2A | DENV1 NS2A |
| DENV1 NS1GQ199795 | DENV1 NS1EU482817 | GQ868639 | FJ882558 |
| DENV1 NS1GQ199807 | DENV1 NS1FJ410254 | DENV1 NS2A | DENV1 NS2A |
| DENV1 NS1GU131817 | DENV1 NS1EU482507 | FJ639806 | GU131809 |
| DENV1 NS1FJ024455 | DENV1 NS1FJ410274 | DENV1 NS2A | DENV1 NS2A |
| DENV1 NS1GU131766 | DENV1 NS1FJ898387 | GQ199837 | FJ182030 |
| DENV1 NS1GU056031 | DENV1 NS1GQ868514 | DENV1 NS2A | DENV1 NS2A |
| DENV1 NS1GU131786 | DENV1 NS1GU131705 | AB189120 | EU482816 |
| DENV1 NS1FJ410207 | DENV1 NS1FJ432738 | DENV1 NS2A | DENV1 NS2A |
| DENV1 NS1EU726781 | DENV1 NS1FJ639681 | EU081235 | GU131813 |
| DENV1 NS1FJ182035 | DENV1 NS1EU482513 | DENV1 NS2A | DENV1 NS2A |
| DENV1 NS1FJ882545 | DENV1 NS1EU081240 | FJ410263 | EU482808 |
| DENV1 NS1AY422468 | DENV1 NS1AF493075 | DENV1 NS2A | DENV1 NS2A |
| DENV1 NS1FJ410222 | DENV1 NS1M23027 | AY713476 | EU482498 |
| DENV1 NS1EU660401 | DENV1 NS1AY089980 | DENV1 NS2A | DENV1 NS2A |
| DENV1 NS1EF113153 | DENV1 NS1EF032589 | GQ199806 | FJ882525 |
| DENV1 NS1FJ639824 | DENV1 NS1AY871814 | DENV1 NS2A | DENV1 NS2A |
| DENV1 NS1AY762084 | DENV1 NS1EF032592 | GU131693 | GU131731 |
| DENV1 NS1GQ868602 | DENV1 NS1X69395 | DENV1 NS2A | DENV1 NS2A |
| DENV1 NS1GQ868532 | DENV1 NS1X69396 | GU131753 | GQ199794 |
| DENV1 NS1EF025110 | DENV1 NS1DQ836632 | DENV1 NS2A | DENV1 NS2A |
| DENV1 NS1GQ868528 | DENV1 NS1AY422468 | GU131711 | GU131832 |
| DENV1 NS1GU131694 | DENV1 NS1EF113153 | DENV1 NS2A | DENV1 NS2A |
| DENV1 NS1EU482489 | DENV1 NS1AY089979 | FJ639812 | EU848545 |
| DENV1 NS1FJ850068 | DENV1 NS1AF493075 | DENV1 NS2A | DENV1 NS2A |
| DENV1 NS1FJ898400 | DENV1 NS1M23027 | GU131765 | GU131760 |

FIG. 66-52

| Virus Protein Accession No. | Virus Protein Accession No. | Virus Protein Accession No. | Virus Protein Accession No. |
|---|---|---|---|
| DENV1 NS2A GU131965 | DENV1 NS2A FJ898374 | DENV1 NS2A FJ410213 | DENV1 NS2A GQ199821 |
| DENV1 NS2A FJ898415 | DENV1 NS2A GQ868504 | DENV1 NS2A FJ898384 | DENV1 NS2A GU131777 |
| DENV1 NS2A GU131782 | DENV1 NS2A FJ882550 | DENV1 NS2A FJ410186 | DENV1 NS2A FJ898378 |
| DENV1 NS2A GQ868535 | DENV1 NS2A FJ850113 | DENV1 NS2A GQ868538 | DENV1 NS2A FJ461306 |
| DENV1 NS2A EU482524 | DENV1 NS2A GU131980 | DENV1 NS2A EU677163 | DENV1 NS2A GU131707 |
| DENV1 NS2A GU131726 | DENV1 NS2A GU131783 | DENV1 NS2A FJ432742 | DENV1 NS2A AF226686 |
| DENV1 NS2A GQ868501 | DENV1 NS2A AY732474 | DENV1 NS2A FJ461303 | DENV1 NS2A EU677152 |
| DENV1 NS2A FJ432734 | DENV1 NS2A GU131958 | DENV1 NS2A FJ639679 | DENV1 NS2A GU131828 |
| DENV1 NS2A FJ410253 | DENV1 NS2A FJ898393 | DENV1 NS2A FJ469909 | DENV1 NS2A GU131971 |
| DENV1 NS2A FJ410281 | DENV1 NS2A EU677176 | DENV1 NS2A EU081227 | DENV1 NS2A GQ199826 |
| DENV1 NS2A EU482708 | DENV1 NS2A FJ850104 | DENV1 NS2A EU482534 | DENV1 NS2A EU677168 |
| DENV1 NS2A GQ199784 | DENV1 NS2A EU249492 | DENV1 NS2A FJ410261 | DENV1 NS2A AF426114 |
| DENV1 NS2A GQ868567 | DENV1 NS2A EU482712 | DENV1 NS2A FJ687428 | DENV1 NS2A FJ461313 |
| DENV1 NS2A EU280167 | DENV1 NS2A FJ410236 | DENV1 NS2A EU660392 | DENV1 NS2A EU081267 |
| DENV1 NS2A FJ850084 | DENV1 NS2A FJ410192 | DENV1 NS2A GQ199815 | DENV1 NS2A FJ410175 |
| DENV1 NS2A EU482514 | DENV1 NS2A EU081281 | DENV1 NS2A EU482611 | DENV1 NS2A AF426131 |
| DENV1 NS2A AY722802 | DENV1 NS2A FJ432729 | DENV1 NS2A FJ639821 | DENV1 NS2A FJ182028 |
| DENV1 NS2A FJ639808 | DENV1 NS2A GQ868525 | DENV1 NS2A FJ410174 | DENV1 NS2A FJ882516 |
| DENV1 NS2A EU482526 | DENV1 NS2A FN429883 | DENV1 NS2A GU131706 | DENV1 NS2A FJ024456 |
| DENV1 NS2A AY732476 | DENV1 NS2A GQ199828 | DENV1 NS2A AY373427 | DENV1 NS2A AF311956 |
| DENV1 NS2A GU131772 | DENV1 NS2A FJ182021 | DENV1 NS2A EU249495 | DENV1 NS2A GU131770 |
| DENV1 NS2A FJ882530 | DENV1 NS2A EU482824 | DENV1 NS2A EU482477 | DENV1 NS2A GU131824 |
| DENV1 NS2A GU131978 | DENV1 NS2A GU131956 | DENV1 NS2A EU482826 | DENV1 NS2A GQ199854 |
| DENV1 NS2A FJ547088 | DENV1 NS2A EU482797 | DENV1 NS2A GQ199843 | DENV1 NS2A DL180618 |

FIG. 66-53

| Virus Protein Accession No. | Virus Protein Accession No. | Virus Protein Accession No. | Virus Protein Accession No. |
|---|---|---|---|
| DENV1 NS2A FJ898410 | DENV1 NS2A EF457905 | DENV1 NS2A FJ882549 | DENV1 NS2A GU131785 |
| DENV1 NS2A FJ024472 | DENV1 NS2A FJ898421 | DENV1 NS2A FJ898391 | DENV1 NS2A GU131842 |
| DENV1 NS2A EU081236 | DENV1 NS2A FJ744701 | DENV1 NS2A GQ199830 | DENV1 NS2A GU131836 |
| DENV1 NS2A EU482480 | DENV1 NS2A GQ199788 | DENV1 NS2A DQ672562 | DENV1 NS2A GQ199824 |
| DENV1 NS2A GU131795 | DENV1 NS2A EU726778 | DENV1 NS2A GU131757 | DENV1 NS2A EU482790 |
| DENV1 NS2A FJ432736 | DENV1 NS2A EU081263 | DENV1 NS2A GQ199839 | DENV1 NS2A EU081257 |
| DENV1 NS2A FJ024480 | DENV1 NS2A FJ205874 | DENV1 NS2A FJ898437 | DENV1 NS2A FJ024449 |
| DENV1 NS2A EU081278 | DENV1 NS2A GU131826 | DENV1 NS2A EU081250 | DENV1 NS2A FJ024430 |
| DENV1 NS2A FJ182019 | DENV1 NS2A FJ898407 | DENV1 NS2A AY373383 | DENV1 NS2A EU482815 |
| DENV1 NS2A GU131919 | DENV1 NS2A GQ199804 | DENV1 NS2A GU131963 | DENV1 NS2A FJ898398 |
| DENV1 NS2A GU131682 | DENV1 NS2A FJ024478 | DENV1 NS2A FJ410257 | DENV1 NS2A EU482530 |
| DENV1 NS2A EU482714 | DENV1 NS2A FJ850102 | DENV1 NS2A GU131798 | DENV1 NS2A GQ868636 |
| DENV1 NS2A FJ410197 | DENV1 NS2A FJ432721 | DENV1 NS2A GQ868508 | DENV1 NS2A FJ024459 |
| DENV1 NS2A GU131744 | DENV1 NS2A EU660418 | DENV1 NS2A EU482789 | DENV1 NS2A GQ868610 |
| DENV1 NS2A FJ410183 | DENV1 NS2A EF032590 | DENV1 NS2A U88536 | DENV1 NS2A EU081233 |
| DENV1 NS2A GQ199875 | DENV1 NS2A AY713473 | DENV1 NS2A GU131807 | DENV1 NS2A FJ687426 |
| DENV1 NS2A GQ199845 | DENV1 NS2A GU131700 | DENV1 NS2A GQ868533 | DENV1 NS2A FJ898404 |
| DENV1 NS2A GU131689 | DENV1 NS2A GQ868523 | DENV1 NS2A FJ898390 | DENV1 NS2A EU081244 |
| DENV1 NS2A FJ461323 | DENV1 NS2A GQ868522 | DENV1 NS2A EU081259 | DENV1 NS2A EU482522 |
| DENV1 NS2A FJ432740 | DENV1 NS2A EU660402 | DENV1 NS2A EU482806 | DENV1 NS2A FJ205882 |
| DENV1 NS2A AY713474 | DENV1 NS2A FJ639676 | DENV1 NS2A FJ373298 | DENV1 NS2A GU131788 |
| DENV1 NS2A GQ199789 | DENV1 NS2A FJ410272 | DENV1 NS2A FJ898382 | DENV1 NS2A GU131762 |
| DENV1 NS2A GU131977 | DENV1 NS2A AY277665 | DENV1 NS2A FJ410250 | DENV1 NS2A FJ410238 |
| DENV1 NS2A FJ850069 | DENV1 NS2A GQ199802 | DENV1 NS2A FJ410226 | DENV1 NS2A DQ285558 |

FIG. 66-54

| Virus Protein Accession No. | Virus Protein Accession No. | Virus Protein Accession No. | Virus Protein Accession No. |
|---|---|---|---|
| DENV1 NS2A FJ898371 | DENV1 NS2A AF426112 | DENV1 NS2A GU131739 | DENV1 NS2A FJ410248 |
| DENV1 NS2A FJ461308 | DENV1 NS2A GU131746 | DENV1 NS2A EU482482 | DENV1 NS2A GU131733 |
| DENV1 NS2A EU482711 | DENV1 NS2A FJ390382 | DENV1 NS2A FJ024482 | DENV1 NS2A FJ461325 |
| DENV1 NS2A GQ868605 | DENV1 NS2A GU131724 | DENV1 NS2A GU131698 | DENV1 NS2A GQ199817 |
| DENV1 NS2A GQ868565 | DENV1 NS2A EU677161 | DENV1 NS2A FJ024432 | DENV1 NS2A GU131691 |
| DENV1 NS2A GQ868608 | DENV1 NS2A EU482536 | DENV1 NS2A FJ882556 | DENV1 NS2A GU131804 |
| DENV1 NS2A FJ898417 | DENV1 NS2A GU131713 | DENV1 NS2A GU131831 | DENV1 NS2A FJ562106 |
| DENV1 NS2A FJ024426 | DENV1 NS2A GU131721 | DENV1 NS2A AY835999 | DENV1 NS2A FJ639682 |
| DENV1 NS2A GQ868511 | DENV1 NS2A EU660397 | DENV1 NS2A GU131922 | DENV1 NS2A GU131792 |
| DENV1 NS2A FJ882562 | DENV1 NS2A FJ906965 | DENV1 NS2A FJ898376 | DENV1 NS2A FJ882522 |
| DENV1 NS2A GU131752 | DENV1 NS2A EU081280 | DENV1 NS2A FJ898425 | DENV1 NS2A GU131742 |
| DENV1 NS2A GQ199811 | DENV1 NS2A FJ639692 | DENV1 NS2A FJ898419 | DENV1 NS2A GU131761 |
| DENV1 NS2A GQ868518 | DENV1 NS2A EU249494 | DENV1 NS2A GQ199799 | DENV1 NS2A GQ868561 |
| DENV1 NS2A AF426127 | DENV1 NS2A FJ639819 | DENV1 NS2A GU056029 | DENV1 NS2A FJ410245 |
| DENV1 NS2A FJ850075 | DENV1 NS2A EU482529 | DENV1 NS2A AY145122 | DENV1 NS2A GQ868520 |
| DENV1 NS2A FJ850100 | DENV1 NS2A EU482616 | DENV1 NS2A GU131811 | DENV1 NS2A EU482707 |
| DENV1 NS2A GU131709 | DENV1 NS2A FJ410284 | DENV1 NS2A EU482495 | DENV1 NS2A EU482520 |
| DENV1 NS2A GQ199848 | DENV1 NS2A FJ410181 | DENV1 NS2A GQ868506 | DENV1 NS2A FJ882536 |
| DENV1 NS2A FJ024429 | DENV1 NS2A FJ461332 | DENV1 NS2A GU131961 | DENV1 NS2A EU081248 |
| DENV1 NS2A FJ461315 | DENV1 NS2A GQ199777 | DENV1 NS2A FJ410269 | DENV1 NS2A GQ868531 |
| DENV1 NS2A EU677154 | DENV1 NS2A EU081229 | DENV1 NS2A GQ199833 | DENV1 NS2A EU482533 |
| DENV1 NS2A GU056033 | DENV1 NS2A FJ410270 | DENV1 NS2A EU081238 | DENV1 NS2A FJ898411 |
| DENV1 NS2A FN429890 | DENV1 NS2A GQ199873 | DENV1 NS2A AF426124 | DENV1 NS2A GQ199796 |
| DENV1 NS2A EU482822 | DENV1 NS2A FJ024451 | DENV1 NS2A GU131748 | DENV1 NS2A GU131818 |

FIG. 66-55

| Virus Protein Accession No. | Virus Protein Accession No. | Virus Protein Accession No. | Virus Protein Accession No. |
|---|---|---|---|
| DENV1 NS2A EU081239 | DENV1 NS2A EU677174 | DENV1 NS2A GQ868513 | DENV1 NS2A GQ199774 |
| DENV1 NS2A EU081255 | DENV1 NS2A FJ639680 | DENV1 NS2A FJ639740 | DENV1 NS2A GQ199787 |
| DENV1 NS2A EU359008 | DENV1 NS2A GQ199849 | DENV1 NS2A FJ882533 | DENV1 NS2A FJ850099 |
| DENV1 NS2A FJ906964 | DENV1 NS2A FJ882566 | DENV1 NS2A GU131926 | DENV1 NS2A FJ410267 |
| DENV1 NS2A EU482618 | DENV1 NS2A FJ882541 | DENV1 NS2A GU131734 | DENV1 NS2A EU726777 |
| DENV1 NS2A FJ410246 | DENV1 NS2A FJ639802 | DENV1 NS2A EU482519 | DENV1 NS2A EU081241 |
| DENV1 NS2A GQ868534 | DENV1 NS2A FJ432725 | DENV1 NS2A AY206457 | DENV1 NS2A FJ898381 |
| DENV1 NS2A GQ199835 | DENV1 NS2A FN429888 | DENV1 NS2A GQ199818 | DENV1 NS2A CS477265 |
| DENV1 NS2A GU131716 | DENV1 NS2A EU482492 | DENV1 NS2A AF426129 | DENV1 NS2A GQ199780 |
| DENV1 NS2A FJ410256 | DENV1 NS2A FJ882557 | DENV1 NS2A FJ850077 | DENV1 NS2A FN429889 |
| DENV1 NS2A FJ898424 | DENV1 NS2A FJ639669 | DENV1 NS2A AY726553 | DENV1 NS2A FJ024434 |
| DENV1 NS2A GU131687 | DENV1 NS2A EU482792 | DENV1 NS2A EU482718 | DENV1 NS2A FJ024483 |
| DENV1 NS2A EU482615 | DENV1 NS2A FJ461340 | DENV1 NS2A EU081274 | DENV1 NS2A EU482502 |
| DENV1 NS2A FJ410285 | DENV1 NS2A GU131805 | DENV1 NS2A FJ182025 | DENV1 NS2A GU131962 |
| DENV1 NS2A FJ898388 | DENV1 NS2A FJ410264 | DENV1 NS2A GU131973 | DENV1 NS2A FJ461339 |
| DENV1 NS2A GQ868529 | DENV1 NS2A EU482516 | DENV1 NS2A EU482811 | DENV1 NS2A EU482821 |
| DENV1 NS2A FJ882579 | DENV1 NS2A FJ469907 | DENV1 NS2A FJ410210 | DENV1 NS2A GU131891 |
| DENV1 NS2A FJ024442 | DENV1 NS2A FJ898396 | DENV1 NS2A AF426118 | DENV1 NS2A EU660403 |
| DENV1 NS2A GQ868563 | DENV1 NS2A EU677157 | DENV1 NS2A GU131925 | DENV1 NS2A FJ410275 |
| DENV1 NS2A FJ639743 | DENV1 NS2A EU482510 | DENV1 NS2A FJ373297 | DENV1 NS2A GQ868559 |
| DENV1 NS2A FJ390378 | DENV1 NS2A FJ182034 | DENV1 NS2A FJ205875 | DENV1 NS2A AF298808 |
| DENV1 NS2A GU131837 | DENV1 NS2A FJ898377 | DENV1 NS2A DQ193572 | DENV1 NS2A FJ410218 |
| DENV1 NS2A FJ432732 | DENV1 NS2A EU660390 | DENV1 NS2A U88535 | DENV1 NS2A GQ199775 |
| DENV1 NS2A GU131840 | DENV1 NS2A GU131718 | DENV1 NS2A FJ882564 | DENV1 NS2A FJ882552 |

FIG. 66-56

| Virus Protein Accession No. | Virus Protein Accession No. | Virus Protein Accession No. | Virus Protein Accession No. |
|---|---|---|---|
| DENV1 NS2A AF426113 | DENV1 NS2A DQ672560 | DENV1 NS2A FJ639686 | DENV1 NS2A FJ639672 |
| DENV1 NS2A FJ898402 | DENV1 NS2A GQ868512 | DENV1 NS2A FJ410255 | DENV1 NS2A FJ410189 |
| DENV1 NS2A GQ199859 | DENV1 NS2A FJ024463 | DENV1 NS2A EU482818 | DENV1 NS2A FJ182023 |
| DENV1 NS2A FJ410196 | DENV1 NS2A EF122231 | DENV1 NS2A GU131685 | DENV1 NS2A FJ410260 |
| DENV1 NS2A FJ639690 | DENV1 NS2A GQ199810 | DENV1 NS2A GU131793 | DENV1 NS2A EU081266 |
| DENV1 NS2A FJ898383 | DENV1 NS2A FJ850081 | DENV1 NS2A FN429882 | DENV1 NS2A GU131895 |
| DENV1 NS2A GU131984 | DENV1 NS2A FJ024427 | DENV1 NS2A EU482509 | DENV1 NS2A GU131829 |
| DENV1 NS2A GQ868498 | DENV1 NS2A GQ868637 | DENV1 NS2A FJ547086 | DENV1 NS2A FJ410204 |
| DENV1 NS2A EU482487 | DENV1 NS2A FJ639796 | DENV1 NS2A FJ639694 | DENV1 NS2A FJ410194 |
| DENV1 NS2A FJ639818 | DENV1 NS2A EU677159 | DENV1 NS2A EU482491 | DENV1 NS2A FJ882528 |
| DENV1 NS2A EU677166 | DENV1 NS2A FJ882519 | DENV1 NS2A GU131755 | DENV1 NS2A FJ432730 |
| DENV1 NS2A GU131758 | DENV1 NS2A GQ199825 | DENV1 NS2A FJ898430 | DENV1 NS2A EU081230 |
| DENV1 NS2A GU131697 | DENV1 NS2A EU482525 | DENV1 NS2A FJ898428 | DENV1 NS2A FJ410206 |
| DENV1 NS2A EU081247 | DENV1 NS2A EU482798 | DENV1 NS2A FJ639814 | DENV1 NS2A GU131969 |
| DENV1 NS2A AY376738 | DENV1 NS2A FJ182032 | DENV1 NS2A AF426130 | DENV1 NS2A AY732478 |
| DENV1 NS2A GU131776 | DENV1 NS2A GU131769 | DENV1 NS2A GU131763 | DENV1 NS2A FJ461330 |
| DENV1 NS2A FJ390380 | DENV1 NS2A GQ199792 | DENV1 NS2A FJ873814 | DENV1 NS2A DQ672556 |
| DENV1 NS2A FJ882547 | DENV1 NS2A GU131888 | DENV1 NS2A FJ850093 | DENV1 NS2A GU131976 |
| DENV1 NS2A GQ868611 | DENV1 NS2A GU131704 | DENV1 NS2A GU131728 | DENV1 NS2A FJ410216 |
| DENV1 NS2A FJ410231 | DENV1 NS2A GQ199850 | DENV1 NS2A FJ898372 | DENV1 NS2A GQ199801 |
| DENV1 NS2A GU131680 | DENV1 NS2A GQ868526 | DENV1 NS2A EU677172 | DENV1 NS2A FJ906728 |
| DENV1 NS2A M87512 | DENV1 NS2A GU131695 | DENV1 NS2A FJ639794 | DENV1 NS2A GU131803 |
| DENV1 NS2A FJ024440 | DENV1 NS2A FJ410243 | DENV1 NS2A GQ868527 | DENV1 NS2A AY726555 |
| DENV1 NS2A GU131774 | DENV1 NS2A AF309641 | DENV1 NS2A FJ687430 | DENV1 NS2A GQ199798 |

FIG. 66-57

| Virus Protein Accession No. | Virus Protein Accession No. | Virus Protein Accession No. | Virus Protein Accession No. |
|---|---|---|---|
| DENV1 NS2A GU056030 | DENV1 NS2A EU482497 | DENV1 NS2A EU482500 | DENV1 NS2A DQ285561 |
| DENV1 NS2A GU131816 | DENV1 NS2A GU370049 | DENV1 NS2A EU482828 | DENV1 NS2A GU131678 |
| DENV1 NS2A EU482512 | DENV1 NS2A GQ868632 | DENV1 NS2A FJ205873 | DENV1 NS2A GU131822 |
| DENV1 NS2A FJ882568 | DENV1 NS2A GQ868613 | DENV1 NS2A AY732481 | DENV1 NS2A EU482479 |
| DENV1 NS2A FJ898413 | DENV1 NS2A GU131893 | DENV1 NS2A GQ199782 | DENV1 NS2A AF426120 |
| DENV1 NS2A EU596504 | DENV1 NS2A EU687247 | DENV1 NS2A EU677150 | DENV1 NS2A FJ882518 |
| DENV1 NS2A FJ410276 | DENV1 NS2A EU482813 | DENV1 NS2A EU482591 | DENV1 NS2A FJ639696 |
| DENV1 NS2A FJ898386 | DENV1 NS2A AY713475 | DENV1 NS2A GU131738 | DENV1 NS2A GQ199857 |
| DENV1 NS2A EU482506 | DENV1 NS2A FJ024438 | DENV1 NS2A FJ024485 | DENV1 NS2A GQ199808 |
| DENV1 NS2A GU131736 | DENV1 NS2A FJ882542 | DENV1 NS2A EU677177 | DENV1 NS2A FJ432749 |
| DENV1 NS2A GU131948 | DENV1 NS2A GU131982 | DENV1 NS2A GU131967 | DENV1 NS2A GU131771 |
| DENV1 NS2A GU131834 | DENV1 NS2A FJ461328 | DENV1 NS2A GU131814 | DENV1 NS2A GQ199772 |
| DENV1 NS2A EU482715 | DENV1 NS2A FJ687432 | DENV1 NS2A AJ968413 | DENV1 NS2A FJ882538 |
| DENV1 NS2A EU482716 | DENV1 NS2A FJ410188 | DENV1 NS2A FJ024436 | DENV1 NS2A FJ410283 |
| DENV1 NS2A FJ850087 | DENV1 NS2A GQ199813 | DENV1 NS2A AF426123 | DENV1 NS2A FJ882521 |
| DENV1 NS2A AF514883 | DENV1 NS2A GQ199847 | DENV1 NS2A FJ432746 | DENV1 NS2A EU726779 |
| DENV1 NS2A EU660395 | DENV1 NS2A FJ410212 | DENV1 NS2A FJ850071 | DENV1 NS2A EU081253 |
| DENV1 NS2A FJ410262 | DENV1 NS2A FJ410232 | DENV1 NS2A EU081271 | DENV1 NS2A FN429886 |
| DENV1 NS2A EU081243 | DENV1 NS2A EU482481 | DENV1 NS2A AY708047 | DENV1 NS2A GQ868601 |
| DENV1 NS2A CS477264 | DENV1 NS2A AY726551 | DENV1 NS2A EU677169 | DENV1 NS2A FJ182003 |
| DENV1 NS2A FJ562104 | DENV1 NS2A FJ639811 | DENV1 NS2A FJ882535 | DENV1 NS2A FJ410286 |
| DENV1 NS2A GQ199823 | DENV1 NS2A GU131800 | DENV1 NS2A FJ547087 | DENV1 NS2A FJ639684 |
| DENV1 NS2A FJ639741 | DENV1 NS2A FJ024425 | DENV1 NS2A EU677164 | DENV1 NS2A EU482794 |
| DENV1 NS2A GU131690 | DENV1 NS2A EU482527 | DENV1 NS2A GU131725 | DENV1 NS2A AY722801 |

FIG. 66-58

| Virus Protein Accession No. | Virus Protein Accession No. | Virus Protein Accession No. | Virus Protein Accession No. |
|---|---|---|---|
| DENV1 NS2A FJ410199 | DENV1 NS2A GU131863 | DENV1 NS2A GQ199778 | DENV1 NS2A FJ024433 |
| DENV1 NS2A EU482485 | DENV1 NS2A GU131892 | DENV1 NS2A FJ390383 | DENV1 NS2A FJ176780 |
| DENV1 NS2A AF426111 | DENV1 NS2A GQ868530 | DENV1 NS2A FJ410203 | DENV1 NS2A FJ373305 |
| DENV1 NS2A AF426116 | DENV1 NS2A FJ410173 | DENV1 NS2A EU482476 | DENV1 NS2A FJ410279 |
| DENV1 NS2A EU482803 | DENV1 NS2A EU482814 | DENV1 NS2A AY145123 | DENV1 NS2A EU081279 |
| DENV1 NS2A GU131767 | DENV1 NS2A EU660393 | DENV1 NS2A EU081270 | DENV1 NS2A GU131756 |
| DENV1 NS2A AY726549 | DENV1 NS2A FJ639815 | DENV1 NS2A GQ199872 | DENV1 NS2A FJ478457 |
| DENV1 NS2A FJ176779 | DENV1 NS2A GU131979 | DENV1 NS2A GQ199856 | DENV1 NS2A FJ024457 |
| DENV1 NS2A FJ461335 | DENV1 NS2A EU482827 | DENV1 NS2A EU482709 | DENV1 NS2A AB189121 |
| DENV1 NS2A FJ898408 | DENV1 NS2A FJ461316 | DENV1 NS2A GQ868618 | DENV1 NS2A DQ285562 |
| DENV1 NS2A GQ199844 | DENV1 NS2A FJ882544 | DENV1 NS2A GU131699 | DENV1 NS2A FJ850103 |
| DENV1 NS2A GU131970 | DENV1 NS2A GU131768 | DENV1 NS2A FJ182029 | DENV1 NS2A EU482499 |
| DENV1 NS2A EU482796 | DENV1 NS2A EU482567 | DENV1 NS2A GQ199855 | DENV1 NS2A GQ199805 |
| DENV1 NS2A EU596502 | DENV1 NS2A GU131957 | DENV1 NS2A FJ882539 | DENV1 NS2A GQ868568 |
| DENV1 NS2A GQ868607 | DENV1 NS2A DQ672559 | DENV1 NS2A FJ410180 | DENV1 NS2A FJ547068 |
| DENV1 NS2A GQ868524 | DENV1 NS2A AF426117 | DENV1 NS2A GU131806 | DENV1 NS2A EU081234 |
| DENV1 NS2A GQ868517 | DENV1 NS2A EU677153 | DENV1 NS2A DQ672564 | DENV1 NS2A FJ432739 |
| DENV1 NS2A EU081268 | DENV1 NS2A AF226687 | DENV1 NS2A FJ410268 | DENV1 NS2A GQ199816 |
| DENV1 NS2A GQ199827 | DENV1 NS2A EU482825 | DENV1 NS2A GU131825 | DENV1 NS2A FJ898401 |
| DENV1 NS2A EU660394 | DENV1 NS2A FJ182022 | DENV1 NS2A FJ850101 | DENV1 NS2A GU131812 |
| DENV1 NS2A EU482610 | DENV1 NS2A EU482592 | DENV1 NS2A FJ182002 | DENV1 NS2A EU660419 |
| DENV1 NS2A EU179861 | DENV1 NS2A EU482800 | DENV1 NS2A GU131683 | DENV1 NS2A GQ199831 |
| DENV1 NS2A AB074761 | DENV1 NS2A GU131745 | DENV1 NS2A FJ639685 | DENV1 NS2A AY732475 |
| DENV1 NS2A GQ199829 | DENV1 NS2A FJ410184 | DENV1 NS2A EU482535 | DENV1 NS2A EU249491 |

FIG. 66-59

| Virus Protein Accession No. | Virus Protein Accession No. | Virus Protein Accession No. | Virus Protein Accession No. |
|---|---|---|---|
| DENV1 NS2A GU131833 | DENV1 NS2A EU482802 | DENV1 NS2A EU081262 | DENV1 NS2A EU677175 |
| DENV1 NS2A GQ199836 | DENV1 NS2A GQ868633 | DENV1 NS2A GQ199842 | DENV1 NS2A FJ639820 |
| DENV1 NS2A AF426125 | DENV1 NS2A AB074760 | DENV1 NS2A EU726782 | DENV1 NS2A GQ199867 |
| DENV1 NS2A FJ410240 | DENV1 NS2A EU081256 | DENV1 NS2A GQ868537 | DENV1 NS2A FJ024428 |
| DENV1 NS2A FJ410225 | DENV1 NS2A FJ432735 | DENV1 NS2A GQ199797 | DENV1 NS2A EU482537 |
| DENV1 NS2A GU131732 | DENV1 NS2A GQ199781 | DENV1 NS2A FJ882515 | DENV1 NS2A GU131778 |
| DENV1 NS2A FJ639677 | DENV1 NS2A DQ285559 | DENV1 NS2A FJ024450 | DENV1 NS2A FJ024464 |
| DENV1 NS2A FJ810419 | DENV1 NS2A FJ182036 | DENV1 NS2A GU131723 | DENV1 NS2A GU131972 |
| DENV1 NS2A GU056032 | DENV1 NS2A FJ547089 | DENV1 NS2A GQ868503 | DENV1 NS2A GQ868606 |
| DENV1 NS2A FJ390374 | DENV1 NS2A FJ898416 | DENV1 NS2A FJ882551 | DENV1 NS2A GU131679 |
| DENV1 NS2A FJ882527 | DENV1 NS2A GU131960 | DENV1 NS2A FJ461318 | DENV1 NS2A GU131708 |
| DENV1 NS2A GU131830 | DENV1 NS2A GU131820 | DENV1 NS2A FJ898418 | DENV1 NS2A EU687251 |
| DENV1 NS2A EU482791 | DENV1 NS2A EU677170 | DENV1 NS2A GQ199820 | DENV1 NS2A AF426115 |
| DENV1 NS2A FJ898427 | DENV1 NS2A FJ882531 | DENV1 NS2A AF513110 | DENV1 NS2A AF226685 |
| DENV1 NS2A FJ410234 | DENV1 NS2A AF514889 | DENV1 NS2A FJ410191 | DENV1 NS2A FJ882561 |
| DENV1 NS2A EU482494 | DENV1 NS2A EU863650 | DENV1 NS2A FJ024431 | DENV1 NS2A EU482488 |
| DENV1 NS2A FJ432720 | DENV1 NS2A FB667403 | DENV1 NS2A FJ898394 | DENV1 NS2A FJ410214 |
| DENV1 NS2A FJ639735 | DENV1 NS2A GU131714 | DENV1 NS2A FJ024445 | DENV1 NS2A FJ687429 |
| DENV1 NS2A FJ898406 | DENV1 NS2A FJ882569 | DENV1 NS2A EU081242 | DENV1 NS2A FJ898379 |
| DENV1 NS2A DQ672563 | DENV1 NS2A FJ410280 | DENV1 NS2A FJ461333 | DENV1 NS2A GU131790 |
| DENV1 NS2A GQ199793 | DENV1 NS2A FJ882548 | DENV1 NS2A GQ868509 | DENV1 NS2A EU482540 |
| DENV1 NS2A EU482807 | DENV1 NS2A FJ859029 | DENV1 NS2A FJ410209 | DENV1 NS2A GU131681 |
| DENV1 NS2A GU131797 | DENV1 NS2A GU131781 | DENV1 NS2A GU131839 | DENV1 NS2A EU081226 |
| DENV1 NS2A FJ410258 | DENV1 NS2A FJ410252 | DENV1 NS2A FJ410251 | DENV1 NS2A FJ182020 |

FIG. 66-60

| Virus Protein | Accession No. | Virus Protein | Accession No. | Virus Protein | Accession No. | Virus Protein | Accession No. |
|---|---|---|---|---|---|---|---|
| DENV1 NS2A | FJ882524 | DENV1 NS2A | FJ850090 | DENV1 NS2A | GU131729 | DENV1 NS2A | FJ205881 |
| DENV1 NS2A | EU677139 | DENV1 NS2A | EU482528 | DENV1 NS2A | GQ868539 | DENV1 NS2A | EU081264 |
| DENV1 NS2A | GU131920 | DENV1 NS2A | FJ898448 | DENV1 NS2A | AY145121 | DENV1 NS2A | GU131688 |
| DENV1 NS2A | GQ868536 | DENV1 NS2A | FJ898420 | DENV1 NS2A | EU677167 | DENV1 NS2A | A75711 |
| DENV1 NS2A | GQ199776 | DENV1 NS2A | GQ868519 | DENV1 NS2A | FJ898422 | DENV1 NS2A | EU081254 |
| DENV1 NS2A | FJ390381 | DENV1 NS2A | FJ432727 | DENV1 NS2A | FJ744702 | DENV1 NS2A | FJ898429 |
| DENV1 NS2A | GU131751 | DENV1 NS2A | EU677155 | DENV1 NS2A | GQ199838 | DENV1 NS2A | FJ469908 |
| DENV1 NS2A | FJ390388 | DENV1 NS2A | EU677162 | DENV1 NS2A | GQ199779 | DENV1 NS2A | GU131799 |
| DENV1 NS2A | EU482823 | DENV1 NS2A | GU131692 | DENV1 NS2A | FJ205883 | DENV1 NS2A | FJ182027 |
| DENV1 NS2A | FJ850073 | DENV1 NS2A | EU596501 | DENV1 NS2A | GQ868635 | DENV1 NS2A | FJ432737 |
| DENV1 NS2A | EU081237 | DENV1 NS2A | FJ410273 | DENV1 NS2A | DQ285560 | DENV1 NS2A | FJ410201 |
| DENV1 NS2A | EU482483 | DENV1 NS2A | FJ410182 | DENV1 NS2A | FJ410239 | DENV1 NS2A | GU131701 |
| DENV1 NS2A | GQ199853 | DENV1 NS2A | GQ199791 | DENV1 NS2A | FJ882554 | DENV1 NS2A | EU081269 |
| DENV1 NS2A | GU131921 | DENV1 NS2A | GQ868630 | DENV1 NS2A | GU131747 | DENV1 NS2A | GQ199783 |
| DENV1 NS2A | FJ182031 | DENV1 NS2A | EU482503 | DENV1 NS2A | FJ024481 | DENV1 NS2A | GU131754 |
| DENV1 NS2A | FJ639683 | DENV1 NS2A | FB730116 | DENV1 NS2A | FJ639675 | DENV1 NS2A | EU081251 |
| DENV1 NS2A | GU131740 | DENV1 NS2A | FJ410198 | DENV1 NS2A | GU131810 | DENV1 NS2A | FJ432733 |
| DENV1 NS2A | FJ562105 | DENV1 NS2A | EU081276 | DENV1 NS2A | FJ410249 | DENV1 NS2A | FJ024447 |
| DENV1 NS2A | FJ432745 | DENV1 NS2A | FJ461324 | DENV1 NS2A | DQ672561 | DENV1 NS2A | FJ547063 |
| DENV1 NS2A | AY277664 | DENV1 NS2A | AF311958 | DENV1 NS2A | AY373384 | DENV1 NS2A | EU482523 |
| DENV1 NS2A | FJ882559 | DENV1 NS2A | FJ639813 | DENV1 NS2A | FJ810415 | DENV1 NS2A | EU482793 |
| DENV1 NS2A | FJ024435 | DENV1 NS2A | AF180817 | DENV1 NS2A | GQ199785 | DENV1 NS2A | U88537 |
| DENV1 NS2A | GQ199803 | DENV1 NS2A | EU081277 | DENV1 NS2A | FJ410220 | DENV1 NS2A | FJ898399 |
| DENV1 NS2A | FJ461320 | DENV1 NS2A | FJ898426 | DENV1 NS2A | EU482504 | DENV1 NS2A | GQ868609 |

FIG. 66-61

| Virus Protein Accession No. | Virus Protein Accession No. | Virus Protein Accession No. | Virus Protein Accession No. |
|---|---|---|---|
| DENV1 NS2A EU726780 | DENV1 NS2A EU482713 | DENV1 NS2A EU249493 | DENV1 NS2A GQ868612 |
| DENV1 NS2A EU482805 | DENV1 NS2A EU482538 | DENV1 NS2A EU081275 | DENV1 NS2A FJ461331 |
| DENV1 NS2A GU131784 | DENV1 NS2A EU081245 | DENV1 NS2A FJ432748 | DENV1 NS2A FJ410282 |
| DENV1 NS2A GU131827 | DENV1 NS2A GQ868619 | DENV1 NS2A EU081228 | DENV1 NS2A FJ205872 |
| DENV1 NS2A FJ410227 | DENV1 NS2A GU131789 | DENV1 NS2A EU482810 | DENV1 NS2A GQ199809 |
| DENV1 NS2A GQ868505 | DENV1 NS2A AB178040 | DENV1 NS2A GQ199852 | DENV1 NS2A GU131722 |
| DENV1 NS2A FN429884 | DENV1 NS2A AY732480 | DENV1 NS2A GU131923 | DENV1 NS2A FJ873810 |
| DENV1 NS2A FJ873809 | DENV1 NS2A FJ898385 | DENV1 NS2A GQ199790 | DENV1 NS2A FJ882546 |
| DENV1 NS2A EU081258 | DENV1 NS2A FJ639688 | DENV1 NS2A FJ024423 | DENV1 NS2A FJ639797 |
| DENV1 NS2A EU677173 | DENV1 NS2A FJ205884 | DENV1 NS2A FJ882555 | DENV1 NS2A EU677160 |
| DENV1 NS2A FJ898392 | DENV1 NS2A FJ898380 | DENV1 NS2A FJ898405 | DENV1 NS2A FJ461312 |
| DENV1 NS2A FJ024448 | DENV1 NS2A FJ182026 | DENV1 NS2A GU131889 | DENV1 NS2A NC_001477 |
| DENV1 NS2A GQ868507 | DENV1 NS2A AF311957 | DENV1 NS2A GQ868499 | DENV1 NS2A GQ199841 |
| DENV1 NS2A EU482531 | DENV1 NS2A FJ639693 | DENV1 NS2A EU482501 | DENV1 NS2A FJ882534 |
| DENV1 NS2A GQ868510 | DENV1 NS2A GU131735 | DENV1 NS2A GU131775 | DENV1 NS2A FJ410289 |
| DENV1 NS2A FJ410290 | DENV1 NS2A FJ850114 | DENV1 NS2A EU081246 | DENV1 NS2A FJ410179 |
| DENV1 NS2A GU131981 | DENV1 NS2A FJ882563 | DENV1 NS2A GQ199773 | DENV1 NS2A FJ432719 |
| DENV1 NS2A EU660391 | DENV1 NS2A GQ199812 | DENV1 NS2A FJ898431 | DENV1 NS2A AY277666 |
| DENV1 NS2A EU482515 | DENV1 NS2A GU131737 | DENV1 NS2A EU081231 | DENV1 NS2A GU131727 |
| DENV1 NS2A EU081232 | DENV1 NS2A AF426126 | DENV1 NS2A EU482486 | DENV1 NS2A FJ024462 |
| DENV1 NS2A GQ199840 | DENV1 NS2A FJ547060 | DENV1 NS2A FJ410187 | DENV1 NS2A FJ024441 |
| DENV1 NS2A EU482710 | DENV1 NS2A GQ199819 | DENV1 NS2A FN429881 | DENV1 NS2A GQ199822 |
| DENV1 NS2A GQ868566 | DENV1 NS2A FJ024484 | DENV1 NS2A GU131764 | DENV1 NS2A FN429887 |
| DENV1 NS2A GU131964 | DENV1 NS2A GQ868500 | DENV1 NS2A GQ868569 | DENV1 NS2A EU482539 |

FIG. 66-62

| Virus Protein Accession No. | Virus Protein Accession No. | Virus Protein Accession No. | Virus Protein Accession No. |
|---|---|---|---|
| DENV1 NS2A EU482804 | DENV1 NS2A FJ410247 | DENV1 NS2A AY726554 | DENV1 NS2A FJ882540 |
| DENV1 NS2A FJ882520 | DENV1 NS2A FJ461307 | DENV1 NS2A FJ898403 | DENV1 NS2A GU131703 |
| DENV1 NS2A FJ639689 | DENV1 NS2A GQ868560 | DENV1 NS2A CS479203 | DENV1 NS2A FJ410190 |
| DENV1 NS2A EU677140 | DENV1 NS2A FJ461319 | DENV1 NS2A EU482517 | DENV1 NS2A GQ868564 |
| DENV1 NS2A GQ199832 | DENV1 NS2A FJ898412 | DENV1 NS2A EU482609 | DENV1 NS2A GU131717 |
| DENV1 NS2A FJ639695 | DENV1 NS2A GQ868521 | DENV1 NS2A FJ410266 | DENV1 NS2A EU081273 |
| DENV1 NS2A FJ410244 | DENV1 NS2A GU131686 | DENV1 NS2A EU482493 | DENV1 NS2A GQ199846 |
| DENV1 NS2A FJ898397 | DENV1 NS2A AY732479 | DENV1 NS2A FJ639674 | DENV1 NS2A AY732483 |
| DENV1 NS2A GU131819 | DENV1 NS2A FJ384655 | DENV1 NS2A FJ639673 | DENV1 NS2A CS477263 |
| DENV1 NS2A GU131823 | DENV1 NS2A FJ882537 | DENV1 NS2A AY732482 | DENV1 NS2A EU482496 |
| DENV1 NS2A FJ882543 | DENV1 NS2A FJ898373 | DENV1 NS2A CS479204 | DENV1 NS2A FJ410265 |
| DENV1 NS2A GU131715 | DENV1 NS2A GU131710 | DENV1 NS2A EU482819 | DENV1 NS2A GU131720 |
| DENV1 NS2A AF426110 | DENV1 NS2A EU677171 | DENV1 NS2A FJ882570 | DENV1 NS2A FJ461327 |
| DENV1 NS2A EU677156 | DENV1 NS2A FJ024479 | DENV1 NS2A AF514885 | DENV1 NS2A GU370048 |
| DENV1 NS2A FJ461317 | DENV1 NS2A FJ687431 | DENV1 NS2A GU131802 | DENV1 NS2A FJ898409 |
| DENV1 NS2A GU131794 | DENV1 NS2A FJ882523 | DENV1 NS2A FJ687427 | DENV1 NS2A FJ182024 |
| DENV1 NS2A FJ461341 | DENV1 NS2A FJ547065 | DENV1 NS2A FJ182033 | DENV1 NS2A FJ882565 |
| DENV1 NS2A EU482511 | DENV1 NS2A GU131791 | DENV1 NS2A GQ199800 | DENV1 NS2A GU131966 |
| DENV1 NS2A FJ024453 | DENV1 NS2A GU131894 | DENV1 NS2A GU131702 | DENV1 NS2A EU249490 |
| DENV1 NS2A GU131749 | DENV1 NS2A EU482490 | DENV1 NS2A FJ432723 | DENV1 NS2A AF514876 |
| DENV1 NS2A FJ898389 | DENV1 NS2A EU482521 | DENV1 NS2A EU482505 | DENV1 NS2A FN429885 |
| DENV1 NS2A GU131696 | DENV1 NS2A FJ898423 | DENV1 NS2A FJ882532 | DENV1 NS2A EU081272 |
| DENV1 NS2A EU482508 | DENV1 NS2A EU660396 | DENV1 NS2A AY373385 | DENV1 NS2A GU131841 |
| DENV1 NS2A EU081265 | DENV1 NS2A AF180818 | DENV1 NS2A AF514878 | DENV1 NS2A AF426119 |

FIG. 66-63

| Virus Protein Accession No. | Virus Protein Accession No. | Virus Protein Accession No. | Virus Protein Accession No. |
|---|---|---|---|
| DENV1 NS2A GQ868570 | DENV1 NS2A FJ024443 | DENV1 NS2A FJ024444 | DENV1 NS2A EU482532 |
| DENV1 NS2A GU131890 | DENV1 NS2A FJ461336 | DENV1 NS2A EU482799 | DENV1 NS2A FJ410242 |
| DENV1 NS2A FJ882553 | DENV1 NS2A GQ199858 | DENV1 NS2A GU131750 | DENV1 NS2A EU482619 |
| DENV1 NS2A AF426128 | DENV1 NS2A EU482820 | DENV1 NS2A FJ906963 | DENV1 NS2A FJ410235 |
| DENV1 NS2A GU131821 | DENV1 NS2A EU482478 | DENV1 NS2A FJ410185 | DENV1 NS2A FJ898395 |
| DENV1 NS2A GQ199771 | DENV1 NS2A GU131815 | DENV1 NS2A EU660412 | DENV1 NS2A GU131949 |
| DENV1 NS2A AB195673 | DENV1 NS2A GQ199834 | DENV1 NS2A GU131779 | DENV1 NS2A AY732477 |
| DENV1 NS2A EU482812 | DENV1 NS2A GU131743 | DENV1 NS2A FJ639691 | DENV1 NS2A EU596503 |
| DENV1 NS2A AF298807 | DENV1 NS2A GQ868614 | DENV1 NS2A EU677165 | DENV1 NS2A GQ199851 |
| DENV1 NS2A GU131801 | DENV1 NS2A EU482706 | DENV1 NS2A GU131773 | DENV1 NS2A GU131796 |
| DENV1 NS2A GU131983 | DENV1 NS2A AY376737 | DENV1 NS2A FJ882517 | DENV1 NS2A EU081252 |
| DENV1 NS2A EF122232 | DENV1 NS2A FJ562101 | DENV1 NS2A FJ410230 | DENV1 NS2A GU131712 |
| DENV1 NS2A AB519681 | DENV1 NS2A FB667398 | DENV1 NS2A AF426121 | DENV1 NS2A EU081249 |
| DENV1 NS2A GQ199814 | DENV1 NS2A GU131808 | DENV1 NS2A FJ410211 | DENV1 NS2A GU131730 |
| DENV1 NS2A AY726552 | DENV1 NS2A GU131780 | DENV1 NS2A FJ850070 | DENV1 NS2A GQ199795 |
| DENV1 NS2A DQ836632 | DENV1 NS2A FJ639671 | DENV1 NS2A FJ024460 | DENV1 NS2A GQ199807 |
| DENV1 NS2A EU482484 | DENV1 NS2A FJ390379 | DENV1 NS2A GQ868562 | DENV1 NS2A GU131817 |
| DENV1 NS2A AY722803 | DENV1 NS2A FJ024439 | DENV1 NS2A FJ882529 | DENV1 NS2A FJ024455 |
| DENV1 NS2A GU131787 | DENV1 NS2A AF350498 | DENV1 NS2A FJ639687 | DENV1 NS2A GU131766 |
| DENV1 NS2A FJ373296 | DENV1 NS2A FJ432747 | DENV1 NS2A GU131684 | DENV1 NS2A GU056031 |
| DENV1 NS2A GU131887 | DENV1 NS2A EU482795 | DENV1 NS2A FJ205876 | DENV1 NS2A GU131786 |
| DENV1 NS2A GU131741 | DENV1 NS2A FJ639678 | DENV1 NS2A FJ410205 | DENV1 NS2A FJ410207 |
| DENV1 NS2A EU677178 | DENV1 NS2A EU482617 | DENV1 NS2A FJ478458 | DENV1 NS2A EU726781 |
| DENV1 NS2A FJ898433 | DENV1 NS2A FJ410287 | DENV1 NS2A EU677158 | DENV1 NS2A FJ182035 |

FIG. 66-64

| Virus Protein Accession No. | Virus Protein Accession No. | Virus Protein Accession No. | Virus Protein Accession No. |
|---|---|---|---|
| DENV1 NS2A FJ882545 | DENV1 NS2A FJ461310 | DENV1 NS2A AF426131 | DENV1 NS2B FJ639670 |
| DENV1 NS2A FJ410222 | DENV1 NS2A FJ898375 | DENV1 NS2A DL180618 | DENV1 NS2B FJ024446 |
| DENV1 NS2A EU660401 | DENV1 NS2A AY858983 | DENV1 NS2A AY373383 | DENV1 NS2B GU131759 |
| DENV1 NS2A FJ639824 | DENV1 NS2A GU131835 | DENV1 NS2A AF426127 | DENV1 NS2B FJ882560 |
| DENV1 NS2A AY762084 | DENV1 NS2A FJ390386 | DENV1 NS2A AF426112 | DENV1 NS2B GU131838 |
| DENV1 NS2A GQ868602 | DENV1 NS2A EU482518 | DENV1 NS2A AF426124 | DENV1 NS2B FJ024437 |
| DENV1 NS2A GQ868532 | DENV1 NS2A FJ898414 | DENV1 NS2A AF426129 | DENV1 NS2B GQ868639 |
| DENV1 NS2A EF025110 | DENV1 NS2A EU482717 | DENV1 NS2A AF426118 | DENV1 NS2B FJ639806 |
| DENV1 NS2A GQ868528 | DENV1 NS2A DQ672557 | DENV1 NS2A AF426113 | DENV1 NS2B GQ199837 |
| DENV1 NS2A GU131694 | DENV1 NS2A GQ199877 | DENV1 NS2A AF426130 | DENV1 NS2B AB189120 |
| DENV1 NS2A EU482489 | DENV1 NS2A GU131719 | DENV1 NS2A AF426123 | DENV1 NS2B EU081235 |
| DENV1 NS2A FJ850068 | DENV1 NS2A EU482817 | DENV1 NS2A AF426120 | DENV1 NS2B FJ410263 |
| DENV1 NS2A FJ898400 | DENV1 NS2A FJ410254 | DENV1 NS2A AF426111 | DENV1 NS2B AY713476 |
| DENV1 NS2A GU131968 | DENV1 NS2A EU482507 | DENV1 NS2A AF426116 | DENV1 NS2B GQ199806 |
| DENV1 NS2A GQ868615 | DENV1 NS2A FJ410274 | DENV1 NS2A AF426117 | DENV1 NS2B GU131693 |
| DENV1 NS2A FJ882567 | DENV1 NS2A FJ898387 | DENV1 NS2A AF426125 | DENV1 NS2B GU131753 |
| DENV1 NS2A DQ672558 | DENV1 NS2A GQ868514 | DENV1 NS2A AF426115 | DENV1 NS2B GU131711 |
| DENV1 NS2A EU677151 | DENV1 NS2A GU131705 | DENV1 NS2A AY373384 | DENV1 NS2B FJ639812 |
| DENV1 NS2A AB204803 | DENV1 NS2A FJ432738 | DENV1 NS2A AF426126 | DENV1 NS2B GU131765 |
| DENV1 NS2A FJ182018 | DENV1 NS2A FJ639681 | DENV1 NS2A AF426110 | DENV1 NS2B FJ432744 |
| DENV1 NS2A EU482809 | DENV1 NS2A EU482513 | DENV1 NS2A AY373385 | DENV1 NS2B GM059691 |
| DENV1 NS2A FJ687433 | DENV1 NS2A EU081240 | DENV1 NS2A AF426119 | DENV1 NS2B FJ410278 |
| DENV1 NS2A FJ410277 | DENV1 NS2A AF426122 | DENV1 NS2A AF426128 | DENV1 NS2B AF426122 |
| DENV1 NS2A GQ868502 | DENV1 NS2A AF426114 | DENV1 NS2A AF426121 | DENV1 NS2B EU081261 |

FIG. 66-65

| Virus Protein Accession No. | Virus Protein Accession No. | Virus Protein Accession No. | Virus Protein Accession No. |
|---|---|---|---|
| DENV1 NS2B EU482801 | DENV1 NS2B GU131726 | DENV1 NS2B GU131783 | DENV1 NS2B FJ432742 |
| DENV1 NS2B FJ882526 | DENV1 NS2B GQ868501 | DENV1 NS2B AY732474 | DENV1 NS2B FJ639679 |
| DENV1 NS2B FJ639823 | DENV1 NS2B FJ432734 | DENV1 NS2B GU131958 | DENV1 NS2B FJ469909 |
| DENV1 NS2B EU081260 | DENV1 NS2B FJ410253 | DENV1 NS2B FJ898393 | DENV1 NS2B EU081227 |
| DENV1 NS2B GQ199786 | DENV1 NS2B FJ410281 | DENV1 NS2B EU677176 | DENV1 NS2B EU482534 |
| DENV1 NS2B AY726550 | DENV1 NS2B EU482708 | DENV1 NS2B FJ850104 | DENV1 NS2B FJ410261 |
| DENV1 NS2B FJ882558 | DENV1 NS2B GQ199784 | DENV1 NS2B EU249492 | DENV1 NS2B FJ687428 |
| DENV1 NS2B GU131809 | DENV1 NS2B GQ868567 | DENV1 NS2B EU482712 | DENV1 NS2B EU660392 |
| DENV1 NS2B FJ182030 | DENV1 NS2B EU280167 | DENV1 NS2B FJ410236 | DENV1 NS2B GQ199815 |
| DENV1 NS2B EU482816 | DENV1 NS2B FJ850084 | DENV1 NS2B FJ410192 | DENV1 NS2B EU482611 |
| DENV1 NS2B GU131813 | DENV1 NS2B EU482514 | DENV1 NS2B EU081281 | DENV1 NS2B FJ639821 |
| DENV1 NS2B EU482808 | DENV1 NS2B AY722802 | DENV1 NS2B FJ432729 | DENV1 NS2B FJ410174 |
| DENV1 NS2B EU482498 | DENV1 NS2B FJ639808 | DENV1 NS2B GQ868525 | DENV1 NS2B GU131706 |
| DENV1 NS2B FJ882525 | DENV1 NS2B EU482526 | DENV1 NS2B FN429883 | DENV1 NS2B AY373427 |
| DENV1 NS2B GU131731 | DENV1 NS2B AY732476 | DENV1 NS2B GQ199828 | DENV1 NS2B EU249495 |
| DENV1 NS2B GQ199794 | DENV1 NS2B GU131772 | DENV1 NS2B FJ182021 | DENV1 NS2B EU482477 |
| DENV1 NS2B GU131832 | DENV1 NS2B FJ882530 | DENV1 NS2B EU482824 | DENV1 NS2B EU482826 |
| DENV1 NS2B EU848545 | DENV1 NS2B GU131978 | DENV1 NS2B GU131956 | DENV1 NS2B GQ199843 |
| DENV1 NS2B GU131760 | DENV1 NS2B FJ547088 | DENV1 NS2B EU482797 | DENV1 NS2B GQ199821 |
| DENV1 NS2B GU131965 | DENV1 NS2B FJ898374 | DENV1 NS2B FJ410213 | DENV1 NS2B GU131777 |
| DENV1 NS2B FJ898415 | DENV1 NS2B GQ868504 | DENV1 NS2B FJ898384 | DENV1 NS2B FJ898378 |
| DENV1 NS2B GU131782 | DENV1 NS2B FJ882550 | DENV1 NS2B FJ410186 | DENV1 NS2B FJ461306 |
| DENV1 NS2B GQ868535 | DENV1 NS2B FJ850113 | DENV1 NS2B GQ868538 | DENV1 NS2B GU131707 |
| DENV1 NS2B EU482524 | DENV1 NS2B GU131980 | DENV1 NS2B EU677163 | DENV1 NS2B AF226686 |

FIG. 66-66

| Virus Protein Accession No. | Virus Protein Accession No. | Virus Protein Accession No. | Virus Protein Accession No. |
|---|---|---|---|
| DENV1 NS2B EU677152 | DENV1 NS2B FJ024480 | DENV1 NS2B FJ205874 | DENV1 NS2B FJ898437 |
| DENV1 NS2B GU131828 | DENV1 NS2B EU081278 | DENV1 NS2B GU131826 | DENV1 NS2B EU081250 |
| DENV1 NS2B GU131971 | DENV1 NS2B FJ182019 | DENV1 NS2B FJ898407 | DENV1 NS2B AY373383 |
| DENV1 NS2B GQ199826 | DENV1 NS2B GU131919 | DENV1 NS2B GQ199804 | DENV1 NS2B GU131963 |
| DENV1 NS2B EU677168 | DENV1 NS2B GU131682 | DENV1 NS2B FJ024478 | DENV1 NS2B FJ410257 |
| DENV1 NS2B AF426114 | DENV1 NS2B EU482714 | DENV1 NS2B FJ850102 | DENV1 NS2B GU131798 |
| DENV1 NS2B FJ461313 | DENV1 NS2B FJ410197 | DENV1 NS2B FJ432721 | DENV1 NS2B GQ868508 |
| DENV1 NS2B EU081267 | DENV1 NS2B GU131744 | DENV1 NS2B EU660418 | DENV1 NS2B EU482789 |
| DENV1 NS2B FJ410175 | DENV1 NS2B FJ410183 | DENV1 NS2B EF032590 | DENV1 NS2B U88536 |
| DENV1 NS2B AF426131 | DENV1 NS2B GQ199875 | DENV1 NS2B AY713473 | DENV1 NS2B GU131807 |
| DENV1 NS2B FJ182028 | DENV1 NS2B GQ199845 | DENV1 NS2B GU131700 | DENV1 NS2B GQ868533 |
| DENV1 NS2B FJ882516 | DENV1 NS2B GU131689 | DENV1 NS2B GQ868523 | DENV1 NS2B FJ898390 |
| DENV1 NS2B FJ024456 | DENV1 NS2B FJ461323 | DENV1 NS2B GQ868522 | DENV1 NS2B EU081259 |
| DENV1 NS2B AF311956 | DENV1 NS2B FJ432740 | DENV1 NS2B EU660402 | DENV1 NS2B EU482806 |
| DENV1 NS2B GU131770 | DENV1 NS2B AY713474 | DENV1 NS2B FJ639676 | DENV1 NS2B FJ373298 |
| DENV1 NS2B GU131824 | DENV1 NS2B GQ199789 | DENV1 NS2B FJ410272 | DENV1 NS2B FJ898382 |
| DENV1 NS2B GQ199854 | DENV1 NS2B GU131977 | DENV1 NS2B AY277665 | DENV1 NS2B FJ410250 |
| DENV1 NS2B DL180618 | DENV1 NS2B FJ850069 | DENV1 NS2B GQ199802 | DENV1 NS2B FJ410226 |
| DENV1 NS2B FJ898410 | DENV1 NS2B EF457905 | DENV1 NS2B FJ882549 | DENV1 NS2B GU131785 |
| DENV1 NS2B FJ024472 | DENV1 NS2B FJ898421 | DENV1 NS2B FJ898391 | DENV1 NS2B GU131842 |
| DENV1 NS2B EU081236 | DENV1 NS2B FJ744701 | DENV1 NS2B GQ199830 | DENV1 NS2B GU131836 |
| DENV1 NS2B EU482480 | DENV1 NS2B GQ199788 | DENV1 NS2B DQ672562 | DENV1 NS2B GQ199824 |
| DENV1 NS2B GU131795 | DENV1 NS2B EU726778 | DENV1 NS2B GU131757 | DENV1 NS2B EU482790 |
| DENV1 NS2B FJ432736 | DENV1 NS2B EU081263 | DENV1 NS2B GQ199839 | DENV1 NS2B EU081257 |

FIG. 66-67

| Virus Protein Accession No. | Virus Protein Accession No. | Virus Protein Accession No. | Virus Protein Accession No. |
|---|---|---|---|
| DENV1 NS2B FJ024449 | DENV1 NS2B FJ898417 | DENV1 NS2B GU131713 | DENV1 NS2B GU131831 |
| DENV1 NS2B FJ024430 | DENV1 NS2B FJ024426 | DENV1 NS2B GU131721 | DENV1 NS2B AY835999 |
| DENV1 NS2B EU482815 | DENV1 NS2B GQ868511 | DENV1 NS2B EU660397 | DENV1 NS2B GU131922 |
| DENV1 NS2B FJ898398 | DENV1 NS2B FJ882562 | DENV1 NS2B FJ906965 | DENV1 NS2B FJ898376 |
| DENV1 NS2B EU482530 | DENV1 NS2B GU131752 | DENV1 NS2B EU081280 | DENV1 NS2B FJ898425 |
| DENV1 NS2B GQ868636 | DENV1 NS2B GQ199811 | DENV1 NS2B FJ639692 | DENV1 NS2B FJ898419 |
| DENV1 NS2B FJ024459 | DENV1 NS2B GQ868518 | DENV1 NS2B EU249494 | DENV1 NS2B GQ199799 |
| DENV1 NS2B GQ868610 | DENV1 NS2B AF426127 | DENV1 NS2B FJ639819 | DENV1 NS2B GU056029 |
| DENV1 NS2B EU081233 | DENV1 NS2B FJ850075 | DENV1 NS2B EU482529 | DENV1 NS2B AY145122 |
| DENV1 NS2B FJ687426 | DENV1 NS2B FJ850100 | DENV1 NS2B EU482616 | DENV1 NS2B GU131811 |
| DENV1 NS2B FJ898404 | DENV1 NS2B GU131709 | DENV1 NS2B FJ410284 | DENV1 NS2B EU482495 |
| DENV1 NS2B EU081244 | DENV1 NS2B GQ199848 | DENV1 NS2B FJ410181 | DENV1 NS2B GQ868506 |
| DENV1 NS2B EU482522 | DENV1 NS2B FJ024429 | DENV1 NS2B FJ461332 | DENV1 NS2B GU131961 |
| DENV1 NS2B FJ205882 | DENV1 NS2B FJ461315 | DENV1 NS2B GQ199777 | DENV1 NS2B FJ410269 |
| DENV1 NS2B GU131788 | DENV1 NS2B EU677154 | DENV1 NS2B EU081229 | DENV1 NS2B GQ199833 |
| DENV1 NS2B GU131762 | DENV1 NS2B GU056033 | DENV1 NS2B FJ410270 | DENV1 NS2B EU081238 |
| DENV1 NS2B FJ410238 | DENV1 NS2B FN429890 | DENV1 NS2B GQ199873 | DENV1 NS2B AF426124 |
| DENV1 NS2B DQ285558 | DENV1 NS2B EU482822 | DENV1 NS2B FJ024451 | DENV1 NS2B GU131748 |
| DENV1 NS2B FJ898371 | DENV1 NS2B AF426112 | DENV1 NS2B GU131739 | DENV1 NS2B FJ410248 |
| DENV1 NS2B FJ461308 | DENV1 NS2B GU131746 | DENV1 NS2B EU482482 | DENV1 NS2B GU131733 |
| DENV1 NS2B EU482711 | DENV1 NS2B FJ390382 | DENV1 NS2B FJ024482 | DENV1 NS2B FJ461325 |
| DENV1 NS2B GQ868605 | DENV1 NS2B GU131724 | DENV1 NS2B GU131698 | DENV1 NS2B GQ199817 |
| DENV1 NS2B GQ868565 | DENV1 NS2B EU677161 | DENV1 NS2B FJ024432 | DENV1 NS2B GU131691 |
| DENV1 NS2B GQ868608 | DENV1 NS2B EU482536 | DENV1 NS2B FJ882556 | DENV1 NS2B GU131804 |

FIG. 66-68

| Virus Protein Accession No. | Virus Protein Accession No. | Virus Protein Accession No. | Virus Protein Accession No. |
|---|---|---|---|
| DENV1 NS2B FJ562106 | DENV1 NS2B GQ868534 | DENV1 NS2B FJ432725 | DENV1 NS2B AY206457 |
| DENV1 NS2B FJ639682 | DENV1 NS2B GQ199835 | DENV1 NS2B FN429888 | DENV1 NS2B GQ199818 |
| DENV1 NS2B GU131792 | DENV1 NS2B GU131716 | DENV1 NS2B EU482492 | DENV1 NS2B AF426129 |
| DENV1 NS2B FJ882522 | DENV1 NS2B FJ410256 | DENV1 NS2B FJ882557 | DENV1 NS2B FJ850077 |
| DENV1 NS2B GU131742 | DENV1 NS2B FJ898424 | DENV1 NS2B FJ639669 | DENV1 NS2B AY726553 |
| DENV1 NS2B GU131761 | DENV1 NS2B GU131687 | DENV1 NS2B EU482792 | DENV1 NS2B EU482718 |
| DENV1 NS2B GQ868561 | DENV1 NS2B EU482615 | DENV1 NS2B FJ461340 | DENV1 NS2B EU081274 |
| DENV1 NS2B FJ410245 | DENV1 NS2B FJ410285 | DENV1 NS2B GU131805 | DENV1 NS2B FJ182025 |
| DENV1 NS2B GQ868520 | DENV1 NS2B FJ898388 | DENV1 NS2B FJ410264 | DENV1 NS2B GU131973 |
| DENV1 NS2B EU482707 | DENV1 NS2B GQ868529 | DENV1 NS2B EU482516 | DENV1 NS2B EU482811 |
| DENV1 NS2B EU482520 | DENV1 NS2B FJ882579 | DENV1 NS2B FJ469907 | DENV1 NS2B FJ410210 |
| DENV1 NS2B FJ882536 | DENV1 NS2B FJ024442 | DENV1 NS2B FJ898396 | DENV1 NS2B AF426118 |
| DENV1 NS2B EU081248 | DENV1 NS2B GQ868563 | DENV1 NS2B EU677157 | DENV1 NS2B GU131925 |
| DENV1 NS2B GQ868531 | DENV1 NS2B FJ639743 | DENV1 NS2B EU482510 | DENV1 NS2B FJ373297 |
| DENV1 NS2B EU482533 | DENV1 NS2B FJ390378 | DENV1 NS2B FJ182034 | DENV1 NS2B FJ205875 |
| DENV1 NS2B FJ898411 | DENV1 NS2B GU131837 | DENV1 NS2B FJ898377 | DENV1 NS2B DQ193572 |
| DENV1 NS2B GQ199796 | DENV1 NS2B FJ432732 | DENV1 NS2B EU660390 | DENV1 NS2B U88535 |
| DENV1 NS2B GU131818 | DENV1 NS2B GU131840 | DENV1 NS2B GU131718 | DENV1 NS2B FJ882564 |
| DENV1 NS2B EU081239 | DENV1 NS2B EU677174 | DENV1 NS2B GQ868513 | DENV1 NS2B GQ199774 |
| DENV1 NS2B EU081255 | DENV1 NS2B FJ639680 | DENV1 NS2B FJ639740 | DENV1 NS2B GQ199787 |
| DENV1 NS2B EU359008 | DENV1 NS2B GQ199849 | DENV1 NS2B FJ882533 | DENV1 NS2B FJ850099 |
| DENV1 NS2B FJ906964 | DENV1 NS2B FJ882566 | DENV1 NS2B GU131926 | DENV1 NS2B FJ410267 |
| DENV1 NS2B EU482618 | DENV1 NS2B FJ882541 | DENV1 NS2B GU131734 | DENV1 NS2B EU726777 |
| DENV1 NS2B FJ410246 | DENV1 NS2B FJ639802 | DENV1 NS2B EU482519 | DENV1 NS2B EU081241 |

FIG. 66-69

| Virus Protein Accession No. | Virus Protein Accession No. | Virus Protein Accession No. | Virus Protein Accession No. |
|---|---|---|---|
| DENV1 NS2B FJ898381 | DENV1 NS2B GU131984 | DENV1 NS2B FJ024427 | DENV1 NS2B EU482509 |
| DENV1 NS2B CS477265 | DENV1 NS2B GQ868498 | DENV1 NS2B GQ868637 | DENV1 NS2B FJ547086 |
| DENV1 NS2B GQ199780 | DENV1 NS2B EU482487 | DENV1 NS2B FJ639796 | DENV1 NS2B FJ639694 |
| DENV1 NS2B FN429889 | DENV1 NS2B FJ639818 | DENV1 NS2B EU677159 | DENV1 NS2B EU482491 |
| DENV1 NS2B FJ024434 | DENV1 NS2B EU677166 | DENV1 NS2B FJ882519 | DENV1 NS2B GU131755 |
| DENV1 NS2B FJ024483 | DENV1 NS2B GU131758 | DENV1 NS2B GQ199825 | DENV1 NS2B FJ898430 |
| DENV1 NS2B EU482502 | DENV1 NS2B GU131697 | DENV1 NS2B EU482525 | DENV1 NS2B FJ898428 |
| DENV1 NS2B GU131962 | DENV1 NS2B EU081247 | DENV1 NS2B EU482798 | DENV1 NS2B FJ639814 |
| DENV1 NS2B FJ461339 | DENV1 NS2B AY376738 | DENV1 NS2B FJ182032 | DENV1 NS2B AF426130 |
| DENV1 NS2B EU482821 | DENV1 NS2B GU131776 | DENV1 NS2B GU131769 | DENV1 NS2B GU131763 |
| DENV1 NS2B GU131891 | DENV1 NS2B FJ390380 | DENV1 NS2B GQ199792 | DENV1 NS2B FJ873814 |
| DENV1 NS2B EU660403 | DENV1 NS2B FJ882547 | DENV1 NS2B GU131888 | DENV1 NS2B FJ850093 |
| DENV1 NS2B FJ410275 | DENV1 NS2B GQ868611 | DENV1 NS2B GU131704 | DENV1 NS2B GU131728 |
| DENV1 NS2B GQ868559 | DENV1 NS2B FJ410231 | DENV1 NS2B GQ199850 | DENV1 NS2B FJ898372 |
| DENV1 NS2B AF298808 | DENV1 NS2B GU131680 | DENV1 NS2B GQ868526 | DENV1 NS2B EU677172 |
| DENV1 NS2B FJ410218 | DENV1 NS2B M87512 | DENV1 NS2B GU131695 | DENV1 NS2B FJ639794 |
| DENV1 NS2B GQ199775 | DENV1 NS2B FJ024440 | DENV1 NS2B FJ410243 | DENV1 NS2B GQ868527 |
| DENV1 NS2B FJ882552 | DENV1 NS2B GU131774 | DENV1 NS2B AF309641 | DENV1 NS2B FJ687430 |
| DENV1 NS2B AF426113 | DENV1 NS2B DQ672560 | DENV1 NS2B FJ639686 | DENV1 NS2B FJ639672 |
| DENV1 NS2B FJ898402 | DENV1 NS2B GQ868512 | DENV1 NS2B FJ410255 | DENV1 NS2B FJ410189 |
| DENV1 NS2B GQ199859 | DENV1 NS2B FJ024463 | DENV1 NS2B EU482818 | DENV1 NS2B FJ182023 |
| DENV1 NS2B FJ410196 | DENV1 NS2B EF122231 | DENV1 NS2B GU131685 | DENV1 NS2B FJ410260 |
| DENV1 NS2B FJ639690 | DENV1 NS2B GQ199810 | DENV1 NS2B GU131793 | DENV1 NS2B EU081266 |
| DENV1 NS2B FJ898383 | DENV1 NS2B FJ850081 | DENV1 NS2B FN429882 | DENV1 NS2B GU131895 |

FIG. 66-70

| Virus Protein Accession No. | Virus Protein Accession No. | Virus Protein Accession No. | Virus Protein Accession No. |
|---|---|---|---|
| DENV1 NS2B GU131829 | DENV1 NS2B FJ410276 | DENV1 NS2B EU482813 | DENV1 NS2B EU482591 |
| DENV1 NS2B FJ410204 | DENV1 NS2B FJ898386 | DENV1 NS2B AY713475 | DENV1 NS2B GU131738 |
| DENV1 NS2B FJ410194 | DENV1 NS2B EU482506 | DENV1 NS2B FJ024438 | DENV1 NS2B FJ024485 |
| DENV1 NS2B FJ882528 | DENV1 NS2B GU131736 | DENV1 NS2B FJ882542 | DENV1 NS2B EU677177 |
| DENV1 NS2B FJ432730 | DENV1 NS2B GU131948 | DENV1 NS2B GU131982 | DENV1 NS2B GU131967 |
| DENV1 NS2B EU081230 | DENV1 NS2B GU131834 | DENV1 NS2B FJ461328 | DENV1 NS2B GU131814 |
| DENV1 NS2B FJ410206 | DENV1 NS2B EU482715 | DENV1 NS2B FJ687432 | DENV1 NS2B AJ968413 |
| DENV1 NS2B GU131969 | DENV1 NS2B EU482716 | DENV1 NS2B FJ410188 | DENV1 NS2B FJ024436 |
| DENV1 NS2B AY732478 | DENV1 NS2B FJ850087 | DENV1 NS2B GQ199813 | DENV1 NS2B AF426123 |
| DENV1 NS2B FJ461330 | DENV1 NS2B AF514883 | DENV1 NS2B GQ199847 | DENV1 NS2B FJ432746 |
| DENV1 NS2B DQ672556 | DENV1 NS2B EU660395 | DENV1 NS2B FJ410212 | DENV1 NS2B FJ850071 |
| DENV1 NS2B GU131976 | DENV1 NS2B FJ410262 | DENV1 NS2B FJ410232 | DENV1 NS2B EU081271 |
| DENV1 NS2B FJ410216 | DENV1 NS2B EU081243 | DENV1 NS2B EU482481 | DENV1 NS2B AY708047 |
| DENV1 NS2B GQ199801 | DENV1 NS2B CS477264 | DENV1 NS2B AY726551 | DENV1 NS2B EU677169 |
| DENV1 NS2B FJ906728 | DENV1 NS2B FJ562104 | DENV1 NS2B FJ639811 | DENV1 NS2B FJ882535 |
| DENV1 NS2B GU131803 | DENV1 NS2B GQ199823 | DENV1 NS2B GU131800 | DENV1 NS2B FJ547087 |
| DENV1 NS2B AY726555 | DENV1 NS2B FJ639741 | DENV1 NS2B FJ024425 | DENV1 NS2B EU677164 |
| DENV1 NS2B GQ199798 | DENV1 NS2B GU131690 | DENV1 NS2B EU482527 | DENV1 NS2B GU131725 |
| DENV1 NS2B GU056030 | DENV1 NS2B EU482497 | DENV1 NS2B EU482500 | DENV1 NS2B DQ285561 |
| DENV1 NS2B GU131816 | DENV1 NS2B GU370049 | DENV1 NS2B EU482828 | DENV1 NS2B GU131678 |
| DENV1 NS2B EU482512 | DENV1 NS2B GQ868632 | DENV1 NS2B FJ205873 | DENV1 NS2B GU131822 |
| DENV1 NS2B FJ882568 | DENV1 NS2B GQ868613 | DENV1 NS2B AY732481 | DENV1 NS2B EU482479 |
| DENV1 NS2B FJ898413 | DENV1 NS2B GU131893 | DENV1 NS2B GQ199782 | DENV1 NS2B AF426120 |
| DENV1 NS2B EU596504 | DENV1 NS2B EU687247 | DENV1 NS2B EU677150 | DENV1 NS2B FJ882518 |

FIG. 66-71

| Virus Protein Accession No. | Virus Protein Accession No. | Virus Protein Accession No. | Virus Protein Accession No. |
|---|---|---|---|
| DENV1 NS2B FJ639696 | DENV1 NS2B AY726549 | DENV1 NS2B FJ639815 | DENV1 NS2B GQ199872 |
| DENV1 NS2B GQ199857 | DENV1 NS2B FJ176779 | DENV1 NS2B GU131979 | DENV1 NS2B GQ199856 |
| DENV1 NS2B GQ199808 | DENV1 NS2B FJ461335 | DENV1 NS2B EU482827 | DENV1 NS2B EU482709 |
| DENV1 NS2B FJ432749 | DENV1 NS2B FJ898408 | DENV1 NS2B FJ461316 | DENV1 NS2B GQ868618 |
| DENV1 NS2B GU131771 | DENV1 NS2B GQ199844 | DENV1 NS2B FJ882544 | DENV1 NS2B GU131699 |
| DENV1 NS2B GQ199772 | DENV1 NS2B GU131970 | DENV1 NS2B GU131768 | DENV1 NS2B FJ182029 |
| DENV1 NS2B FJ882538 | DENV1 NS2B EU482796 | DENV1 NS2B EU482567 | DENV1 NS2B GQ199855 |
| DENV1 NS2B FJ410283 | DENV1 NS2B EU596502 | DENV1 NS2B GU131957 | DENV1 NS2B FJ882539 |
| DENV1 NS2B FJ882521 | DENV1 NS2B GQ868607 | DENV1 NS2B DQ672559 | DENV1 NS2B FJ410180 |
| DENV1 NS2B EU726779 | DENV1 NS2B GQ868524 | DENV1 NS2B AF426117 | DENV1 NS2B GU131806 |
| DENV1 NS2B EU081253 | DENV1 NS2B GQ868517 | DENV1 NS2B EU677153 | DENV1 NS2B DQ672564 |
| DENV1 NS2B FN429886 | DENV1 NS2B EU081268 | DENV1 NS2B AF226687 | DENV1 NS2B FJ410268 |
| DENV1 NS2B GQ868601 | DENV1 NS2B GQ199827 | DENV1 NS2B EU482825 | DENV1 NS2B GU131825 |
| DENV1 NS2B FJ182003 | DENV1 NS2B EU660394 | DENV1 NS2B FJ182022 | DENV1 NS2B FJ850101 |
| DENV1 NS2B FJ410286 | DENV1 NS2B EU482610 | DENV1 NS2B EU482592 | DENV1 NS2B FJ182002 |
| DENV1 NS2B FJ639684 | DENV1 NS2B EU179861 | DENV1 NS2B EU482800 | DENV1 NS2B GU131683 |
| DENV1 NS2B EU482794 | DENV1 NS2B AB074761 | DENV1 NS2B GU131745 | DENV1 NS2B FJ639685 |
| DENV1 NS2B AY722801 | DENV1 NS2B GQ199829 | DENV1 NS2B FJ410184 | DENV1 NS2B EU482535 |
| DENV1 NS2B FJ410199 | DENV1 NS2B GU131863 | DENV1 NS2B GQ199778 | DENV1 NS2B FJ024433 |
| DENV1 NS2B EU482485 | DENV1 NS2B GU131892 | DENV1 NS2B FJ390383 | DENV1 NS2B FJ176780 |
| DENV1 NS2B AF426111 | DENV1 NS2B GQ868530 | DENV1 NS2B FJ410203 | DENV1 NS2B FJ373305 |
| DENV1 NS2B AF426116 | DENV1 NS2B FJ410173 | DENV1 NS2B EU482476 | DENV1 NS2B FJ410279 |
| DENV1 NS2B EU482803 | DENV1 NS2B EU482814 | DENV1 NS2B AY145123 | DENV1 NS2B EU081279 |
| DENV1 NS2B GU131767 | DENV1 NS2B EU660393 | DENV1 NS2B EU081270 | DENV1 NS2B GU131756 |

FIG. 66-72

| Virus Protein Accession No. | Virus Protein Accession No. | Virus Protein Accession No. | Virus Protein Accession No. |
|---|---|---|---|
| DENV1 NS2B FJ478457 | DENV1 NS2B FJ639677 | DENV1 NS2B DQ285559 | DENV1 NS2B FJ024450 |
| DENV1 NS2B FJ024457 | DENV1 NS2B FJ810419 | DENV1 NS2B FJ182036 | DENV1 NS2B GU131723 |
| DENV1 NS2B AB189121 | DENV1 NS2B GU056032 | DENV1 NS2B FJ547089 | DENV1 NS2B GQ868503 |
| DENV1 NS2B DQ285562 | DENV1 NS2B FJ390374 | DENV1 NS2B FJ898416 | DENV1 NS2B FJ882551 |
| DENV1 NS2B FJ850103 | DENV1 NS2B FJ882527 | DENV1 NS2B GU131960 | DENV1 NS2B FJ461318 |
| DENV1 NS2B EU482499 | DENV1 NS2B GU131830 | DENV1 NS2B GU131820 | DENV1 NS2B FJ898418 |
| DENV1 NS2B GQ199805 | DENV1 NS2B EU482791 | DENV1 NS2B EU677170 | DENV1 NS2B GQ199820 |
| DENV1 NS2B GQ868568 | DENV1 NS2B FJ898427 | DENV1 NS2B FJ882531 | DENV1 NS2B AF513110 |
| DENV1 NS2B FJ547068 | DENV1 NS2B FJ410234 | DENV1 NS2B AF514889 | DENV1 NS2B FJ410191 |
| DENV1 NS2B EU081234 | DENV1 NS2B EU482494 | DENV1 NS2B EU863650 | DENV1 NS2B FJ024431 |
| DENV1 NS2B FJ432739 | DENV1 NS2B FJ432720 | DENV1 NS2B FB667403 | DENV1 NS2B FJ898394 |
| DENV1 NS2B GQ199816 | DENV1 NS2B FJ639735 | DENV1 NS2B GU131714 | DENV1 NS2B FJ024445 |
| DENV1 NS2B FJ898401 | DENV1 NS2B FJ898406 | DENV1 NS2B FJ882569 | DENV1 NS2B EU081242 |
| DENV1 NS2B GU131812 | DENV1 NS2B DQ672563 | DENV1 NS2B FJ410280 | DENV1 NS2B FJ461333 |
| DENV1 NS2B EU660419 | DENV1 NS2B GQ199793 | DENV1 NS2B FJ882548 | DENV1 NS2B GQ868509 |
| DENV1 NS2B GQ199831 | DENV1 NS2B EU482807 | DENV1 NS2B FJ859029 | DENV1 NS2B FJ410209 |
| DENV1 NS2B AY732475 | DENV1 NS2B GU131797 | DENV1 NS2B GU131781 | DENV1 NS2B GU131839 |
| DENV1 NS2B EU249491 | DENV1 NS2B FJ410258 | DENV1 NS2B FJ410252 | DENV1 NS2B FJ410251 |
| DENV1 NS2B GU131833 | DENV1 NS2B EU482802 | DENV1 NS2B EU081262 | DENV1 NS2B EU677175 |
| DENV1 NS2B GQ199836 | DENV1 NS2B GQ868633 | DENV1 NS2B GQ199842 | DENV1 NS2B FJ639820 |
| DENV1 NS2B AF426125 | DENV1 NS2B AB074760 | DENV1 NS2B EU726782 | DENV1 NS2B GQ199867 |
| DENV1 NS2B FJ410240 | DENV1 NS2B EU081256 | DENV1 NS2B GQ868537 | DENV1 NS2B FJ024428 |
| DENV1 NS2B FJ410225 | DENV1 NS2B FJ432735 | DENV1 NS2B GQ199797 | DENV1 NS2B EU482537 |
| DENV1 NS2B GU131732 | DENV1 NS2B GQ199781 | DENV1 NS2B FJ882515 | DENV1 NS2B GU131778 |

FIG. 66-73

| Virus Protein Accession No. | Virus Protein Accession No. | Virus Protein Accession No. | Virus Protein Accession No. |
|---|---|---|---|
| DENV1 NS2B FJ024464 | DENV1 NS2B GU131751 | DENV1 NS2B EU677155 | DENV1 NS2B GQ199838 |
| DENV1 NS2B GU131972 | DENV1 NS2B FJ390388 | DENV1 NS2B EU677162 | DENV1 NS2B GQ199779 |
| DENV1 NS2B GQ868606 | DENV1 NS2B EU482823 | DENV1 NS2B GU131692 | DENV1 NS2B FJ205883 |
| DENV1 NS2B GU131679 | DENV1 NS2B FJ850073 | DENV1 NS2B EU596501 | DENV1 NS2B GQ868635 |
| DENV1 NS2B GU131708 | DENV1 NS2B EU081237 | DENV1 NS2B FJ410273 | DENV1 NS2B DQ285560 |
| DENV1 NS2B EU687251 | DENV1 NS2B EU482483 | DENV1 NS2B FJ410182 | DENV1 NS2B FJ410239 |
| DENV1 NS2B AF426115 | DENV1 NS2B GQ199853 | DENV1 NS2B GQ199791 | DENV1 NS2B FJ882554 |
| DENV1 NS2B AF226685 | DENV1 NS2B GU131921 | DENV1 NS2B GQ868630 | DENV1 NS2B GU131747 |
| DENV1 NS2B FJ882561 | DENV1 NS2B FJ182031 | DENV1 NS2B EU482503 | DENV1 NS2B FJ024481 |
| DENV1 NS2B EU482488 | DENV1 NS2B FJ639683 | DENV1 NS2B FB730116 | DENV1 NS2B FJ639675 |
| DENV1 NS2B FJ410214 | DENV1 NS2B GU131740 | DENV1 NS2B FJ410198 | DENV1 NS2B GU131810 |
| DENV1 NS2B FJ687429 | DENV1 NS2B FJ562105 | DENV1 NS2B EU081276 | DENV1 NS2B FJ410249 |
| DENV1 NS2B FJ898379 | DENV1 NS2B FJ432745 | DENV1 NS2B FJ461324 | DENV1 NS2B DQ672561 |
| DENV1 NS2B GU131790 | DENV1 NS2B AY277664 | DENV1 NS2B AF311958 | DENV1 NS2B AY373384 |
| DENV1 NS2B EU482540 | DENV1 NS2B FJ882559 | DENV1 NS2B FJ639813 | DENV1 NS2B FJ810415 |
| DENV1 NS2B GU131681 | DENV1 NS2B FJ024435 | DENV1 NS2B AF180817 | DENV1 NS2B GQ199785 |
| DENV1 NS2B EU081226 | DENV1 NS2B GQ199803 | DENV1 NS2B EU081277 | DENV1 NS2B FJ410220 |
| DENV1 NS2B FJ182020 | DENV1 NS2B FJ461320 | DENV1 NS2B FJ898426 | DENV1 NS2B EU482504 |
| DENV1 NS2B FJ882524 | DENV1 NS2B FJ850090 | DENV1 NS2B GU131729 | DENV1 NS2B FJ205881 |
| DENV1 NS2B EU677139 | DENV1 NS2B EU482528 | DENV1 NS2B GQ868539 | DENV1 NS2B EU081264 |
| DENV1 NS2B GU131920 | DENV1 NS2B FJ898448 | DENV1 NS2B AY145121 | DENV1 NS2B GU131688 |
| DENV1 NS2B GQ868536 | DENV1 NS2B FJ898420 | DENV1 NS2B EU677167 | DENV1 NS2B A75711 |
| DENV1 NS2B GQ199776 | DENV1 NS2B GQ868519 | DENV1 NS2B FJ898422 | DENV1 NS2B EU081254 |
| DENV1 NS2B FJ390381 | DENV1 NS2B FJ432727 | DENV1 NS2B FJ744702 | DENV1 NS2B FJ898429 |

FIG. 66-74

| Virus Protein | Accession No. | Virus Protein | Accession No. | Virus Protein | Accession No. | Virus Protein | Accession No. |
|---|---|---|---|---|---|---|---|
| DENV1 NS2B | FJ469908 | DENV1 NS2B | FN429884 | DENV1 NS2B | AY732480 | DENV1 NS2B | GU131923 |
| DENV1 NS2B | GU131799 | DENV1 NS2B | FJ873809 | DENV1 NS2B | FJ898385 | DENV1 NS2B | GQ199790 |
| DENV1 NS2B | FJ182027 | DENV1 NS2B | EU081258 | DENV1 NS2B | FJ639688 | DENV1 NS2B | FJ024423 |
| DENV1 NS2B | FJ432737 | DENV1 NS2B | EU677173 | DENV1 NS2B | FJ205884 | DENV1 NS2B | FJ882555 |
| DENV1 NS2B | FJ410201 | DENV1 NS2B | FJ898392 | DENV1 NS2B | FJ898380 | DENV1 NS2B | FJ898405 |
| DENV1 NS2B | GU131701 | DENV1 NS2B | FJ024448 | DENV1 NS2B | FJ182026 | DENV1 NS2B | GU131889 |
| DENV1 NS2B | EU081269 | DENV1 NS2B | GQ868507 | DENV1 NS2B | AF311957 | DENV1 NS2B | GQ868499 |
| DENV1 NS2B | GQ199783 | DENV1 NS2B | EU482531 | DENV1 NS2B | FJ639693 | DENV1 NS2B | EU482501 |
| DENV1 NS2B | GU131754 | DENV1 NS2B | GQ868510 | DENV1 NS2B | GU131735 | DENV1 NS2B | GU131775 |
| DENV1 NS2B | EU081251 | DENV1 NS2B | FJ410290 | DENV1 NS2B | FJ850114 | DENV1 NS2B | EU081246 |
| DENV1 NS2B | FJ432733 | DENV1 NS2B | GU131981 | DENV1 NS2B | FJ882563 | DENV1 NS2B | GQ199773 |
| DENV1 NS2B | FJ024447 | DENV1 NS2B | EU660391 | DENV1 NS2B | GQ199812 | DENV1 NS2B | FJ898431 |
| DENV1 NS2B | FJ547063 | DENV1 NS2B | EU482515 | DENV1 NS2B | GU131737 | DENV1 NS2B | EU081231 |
| DENV1 NS2B | EU482523 | DENV1 NS2B | EU081232 | DENV1 NS2B | AF426126 | DENV1 NS2B | EU482486 |
| DENV1 NS2B | EU482793 | DENV1 NS2B | GQ199840 | DENV1 NS2B | FJ547060 | DENV1 NS2B | FJ410187 |
| DENV1 NS2B | U88537 | DENV1 NS2B | EU482710 | DENV1 NS2B | GQ199819 | DENV1 NS2B | FN429881 |
| DENV1 NS2B | FJ898399 | DENV1 NS2B | GQ868566 | DENV1 NS2B | FJ024484 | DENV1 NS2B | GU131764 |
| DENV1 NS2B | GQ868609 | DENV1 NS2B | GU131964 | DENV1 NS2B | GQ868500 | DENV1 NS2B | GQ868569 |
| DENV1 NS2B | EU726780 | DENV1 NS2B | EU482713 | DENV1 NS2B | EU249493 | DENV1 NS2B | GQ868612 |
| DENV1 NS2B | EU482805 | DENV1 NS2B | EU482538 | DENV1 NS2B | EU081275 | DENV1 NS2B | FJ461331 |
| DENV1 NS2B | GU131784 | DENV1 NS2B | EU081245 | DENV1 NS2B | FJ432748 | DENV1 NS2B | FJ410282 |
| DENV1 NS2B | GU131827 | DENV1 NS2B | GQ868619 | DENV1 NS2B | EU081228 | DENV1 NS2B | FJ205872 |
| DENV1 NS2B | FJ410227 | DENV1 NS2B | GU131789 | DENV1 NS2B | EU482810 | DENV1 NS2B | GQ199809 |
| DENV1 NS2B | GQ868505 | DENV1 NS2B | AB178040 | DENV1 NS2B | GQ199852 | DENV1 NS2B | GU131722 |

FIG. 66-75

| Virus Protein Accession No. | Virus Protein Accession No. | Virus Protein Accession No. | Virus Protein Accession No. |
|---|---|---|---|
| DENV1 NS2B FJ873810 | DENV1 NS2B FJ410244 | DENV1 NS2B GU131686 | DENV1 NS2B EU482493 |
| DENV1 NS2B FJ882546 | DENV1 NS2B FJ898397 | DENV1 NS2B AY732479 | DENV1 NS2B FJ639674 |
| DENV1 NS2B FJ639797 | DENV1 NS2B GU131819 | DENV1 NS2B FJ384655 | DENV1 NS2B FJ639673 |
| DENV1 NS2B EU677160 | DENV1 NS2B GU131823 | DENV1 NS2B FJ882537 | DENV1 NS2B AY732482 |
| DENV1 NS2B FJ461312 | DENV1 NS2B FJ882543 | DENV1 NS2B FJ898373 | DENV1 NS2B CS479204 |
| DENV1 NS2B NC_001477 | DENV1 NS2B GU131715 | DENV1 NS2B GU131710 | DENV1 NS2B EU482819 |
| DENV1 NS2B GQ199841 | DENV1 NS2B AF426110 | DENV1 NS2B EU677171 | DENV1 NS2B FJ882570 |
| DENV1 NS2B FJ882534 | DENV1 NS2B EU677156 | DENV1 NS2B FJ024479 | DENV1 NS2B AF514885 |
| DENV1 NS2B FJ410289 | DENV1 NS2B FJ461317 | DENV1 NS2B FJ687431 | DENV1 NS2B GU131802 |
| DENV1 NS2B FJ410179 | DENV1 NS2B GU131794 | DENV1 NS2B FJ882523 | DENV1 NS2B FJ687427 |
| DENV1 NS2B FJ432719 | DENV1 NS2B FJ461341 | DENV1 NS2B FJ547065 | DENV1 NS2B FJ182033 |
| DENV1 NS2B AY277666 | DENV1 NS2B EU482511 | DENV1 NS2B GU131791 | DENV1 NS2B GQ199800 |
| DENV1 NS2B GU131727 | DENV1 NS2B FJ024453 | DENV1 NS2B GU131894 | DENV1 NS2B GU131702 |
| DENV1 NS2B FJ024462 | DENV1 NS2B GU131749 | DENV1 NS2B EU482490 | DENV1 NS2B FJ432723 |
| DENV1 NS2B FJ024441 | DENV1 NS2B FJ898389 | DENV1 NS2B EU482521 | DENV1 NS2B EU482505 |
| DENV1 NS2B GQ199822 | DENV1 NS2B GU131696 | DENV1 NS2B FJ898423 | DENV1 NS2B FJ882532 |
| DENV1 NS2B FN429887 | DENV1 NS2B EU482508 | DENV1 NS2B EU660396 | DENV1 NS2B AY373385 |
| DENV1 NS2B EU482539 | DENV1 NS2B EU081265 | DENV1 NS2B AF180818 | DENV1 NS2B AF514878 |
| DENV1 NS2B EU482804 | DENV1 NS2B FJ410247 | DENV1 NS2B AY726554 | DENV1 NS2B FJ882540 |
| DENV1 NS2B FJ882520 | DENV1 NS2B FJ461307 | DENV1 NS2B FJ898403 | DENV1 NS2B GU131703 |
| DENV1 NS2B FJ639689 | DENV1 NS2B GQ868560 | DENV1 NS2B CS479203 | DENV1 NS2B FJ410190 |
| DENV1 NS2B EU677140 | DENV1 NS2B FJ461319 | DENV1 NS2B EU482517 | DENV1 NS2B GQ868564 |
| DENV1 NS2B GQ199832 | DENV1 NS2B FJ898412 | DENV1 NS2B EU482609 | DENV1 NS2B GU131717 |
| DENV1 NS2B FJ639695 | DENV1 NS2B GQ868521 | DENV1 NS2B FJ410266 | DENV1 NS2B EU081273 |

FIG. 66-76

| Virus Protein Accession No. | Virus Protein Accession No. | Virus Protein Accession No. | Virus Protein Accession No. |
|---|---|---|---|
| DENV1 NS2B GQ199846 | DENV1 NS2B AB195673 | DENV1 NS2B GQ199834 | DENV1 NS2B GU131779 |
| DENV1 NS2B AY732483 | DENV1 NS2B EU482812 | DENV1 NS2B GU131743 | DENV1 NS2B FJ639691 |
| DENV1 NS2B CS477263 | DENV1 NS2B AF298807 | DENV1 NS2B GQ868614 | DENV1 NS2B EU677165 |
| DENV1 NS2B EU482496 | DENV1 NS2B GU131801 | DENV1 NS2B EU482706 | DENV1 NS2B GU131773 |
| DENV1 NS2B FJ410265 | DENV1 NS2B GU131983 | DENV1 NS2B AY376737 | DENV1 NS2B FJ882517 |
| DENV1 NS2B GU131720 | DENV1 NS2B EF122232 | DENV1 NS2B FJ562101 | DENV1 NS2B FJ410230 |
| DENV1 NS2B FJ461327 | DENV1 NS2B AB519681 | DENV1 NS2B FB667398 | DENV1 NS2B AF426121 |
| DENV1 NS2B GU370048 | DENV1 NS2B GQ199814 | DENV1 NS2B GU131808 | DENV1 NS2B FJ410211 |
| DENV1 NS2B FJ898409 | DENV1 NS2B AY726552 | DENV1 NS2B GU131780 | DENV1 NS2B FJ850070 |
| DENV1 NS2B FJ182024 | DENV1 NS2B DQ836632 | DENV1 NS2B FJ639671 | DENV1 NS2B FJ024460 |
| DENV1 NS2B FJ882565 | DENV1 NS2B EU482484 | DENV1 NS2B FJ390379 | DENV1 NS2B GQ868562 |
| DENV1 NS2B GU131966 | DENV1 NS2B AY722803 | DENV1 NS2B FJ024439 | DENV1 NS2B FJ882529 |
| DENV1 NS2B EU249490 | DENV1 NS2B GU131787 | DENV1 NS2B AF350498 | DENV1 NS2B FJ639687 |
| DENV1 NS2B AF514876 | DENV1 NS2B FJ373296 | DENV1 NS2B FJ432747 | DENV1 NS2B GU131684 |
| DENV1 NS2B FN429885 | DENV1 NS2B GU131887 | DENV1 NS2B EU482795 | DENV1 NS2B FJ205876 |
| DENV1 NS2B EU081272 | DENV1 NS2B GU131741 | DENV1 NS2B FJ639678 | DENV1 NS2B FJ410205 |
| DENV1 NS2B GU131841 | DENV1 NS2B EU677178 | DENV1 NS2B EU482617 | DENV1 NS2B FJ478458 |
| DENV1 NS2B AF426119 | DENV1 NS2B FJ898433 | DENV1 NS2B FJ410287 | DENV1 NS2B EU677158 |
| DENV1 NS2B GQ868570 | DENV1 NS2B FJ024443 | DENV1 NS2B FJ024444 | DENV1 NS2B EU482532 |
| DENV1 NS2B GU131890 | DENV1 NS2B FJ461336 | DENV1 NS2B EU482799 | DENV1 NS2B FJ410242 |
| DENV1 NS2B FJ882553 | DENV1 NS2B GQ199858 | DENV1 NS2B GU131750 | DENV1 NS2B EU482619 |
| DENV1 NS2B AF426128 | DENV1 NS2B EU482820 | DENV1 NS2B FJ906963 | DENV1 NS2B FJ410235 |
| DENV1 NS2B GU131821 | DENV1 NS2B EU482478 | DENV1 NS2B FJ410185 | DENV1 NS2B FJ898395 |
| DENV1 NS2B GQ199771 | DENV1 NS2B GU131815 | DENV1 NS2B EU660412 | DENV1 NS2B GU131949 |

FIG. 66-77

| Virus Protein Accession No. | Virus Protein Accession No. | Virus Protein Accession No. | Virus Protein Accession No. |
|---|---|---|---|
| DENV1 NS2B AY732477 | DENV1 NS2B GQ868532 | DENV1 NS2B FJ898414 | DENV1 NS2B AF426129 |
| DENV1 NS2B EU596503 | DENV1 NS2B EF025110 | DENV1 NS2B EU482717 | DENV1 NS2B AF426118 |
| DENV1 NS2B GQ199851 | DENV1 NS2B GQ868528 | DENV1 NS2B DQ672557 | DENV1 NS2B AF426113 |
| DENV1 NS2B GU131796 | DENV1 NS2B GU131694 | DENV1 NS2B GQ199877 | DENV1 NS2B AF426130 |
| DENV1 NS2B EU081252 | DENV1 NS2B EU482489 | DENV1 NS2B GU131719 | DENV1 NS2B AF426123 |
| DENV1 NS2B GU131712 | DENV1 NS2B FJ850068 | DENV1 NS2B EU482817 | DENV1 NS2B AF426120 |
| DENV1 NS2B EU081249 | DENV1 NS2B FJ898400 | DENV1 NS2B FJ410254 | DENV1 NS2B AF426111 |
| DENV1 NS2B GU131730 | DENV1 NS2B GU131968 | DENV1 NS2B EU482507 | DENV1 NS2B AF426116 |
| DENV1 NS2B GQ199795 | DENV1 NS2B GQ868615 | DENV1 NS2B FJ410274 | DENV1 NS2B AF426117 |
| DENV1 NS2B GQ199807 | DENV1 NS2B FJ882567 | DENV1 NS2B FJ898387 | DENV1 NS2B AF426125 |
| DENV1 NS2B GU131817 | DENV1 NS2B DQ672558 | DENV1 NS2B GQ868514 | DENV1 NS2B AF426115 |
| DENV1 NS2B FJ024455 | DENV1 NS2B EU677151 | DENV1 NS2B GU131705 | DENV1 NS2B AY373384 |
| DENV1 NS2B GU131766 | DENV1 NS2B AB204803 | DENV1 NS2B FJ432738 | DENV1 NS2B AF426126 |
| DENV1 NS2B GU056031 | DENV1 NS2B FJ182018 | DENV1 NS2B FJ639681 | DENV1 NS2B AF426110 |
| DENV1 NS2B GU131786 | DENV1 NS2B EU482809 | DENV1 NS2B EU482513 | DENV1 NS2B AY373385 |
| DENV1 NS2B FJ410207 | DENV1 NS2B FJ687433 | DENV1 NS2B EU081240 | DENV1 NS2B AF426119 |
| DENV1 NS2B EU726781 | DENV1 NS2B FJ410277 | DENV1 NS2B AF426122 | DENV1 NS2B AF426128 |
| DENV1 NS2B FJ182035 | DENV1 NS2B GQ868502 | DENV1 NS2B AF426114 | DENV1 NS2B AF426121 |
| DENV1 NS2B FJ882545 | DENV1 NS2B FJ461310 | DENV1 NS2B AF426131 | DENV1 NS2B AF426122 |
| DENV1 NS2B FJ410222 | DENV1 NS2B FJ898375 | DENV1 NS2B DL180618 | DENV1 NS2B AF426114 |
| DENV1 NS2B EU660401 | DENV1 NS2B AY858983 | DENV1 NS2B AY373383 | DENV1 NS2B AF426131 |
| DENV1 NS2B FJ639824 | DENV1 NS2B GU131835 | DENV1 NS2B AF426127 | DENV1 NS2B DL180618 |
| DENV1 NS2B AY762084 | DENV1 NS2B FJ390386 | DENV1 NS2B AF426112 | DENV1 NS2B AY373383 |
| DENV1 NS2B GQ868602 | DENV1 NS2B EU482518 | DENV1 NS2B AF426124 | DENV1 NS2B AF426127 |

FIG. 66-78

| Virus Protein Accession No. | Virus Protein Accession No. | Virus Protein Accession No. | Virus Protein Accession No. |
|---|---|---|---|
| DENV1 NS2B AF426112 | DENV1 NS2B AY373383 | DENV1 NS2B AF426131 | DENV1 NS2B AF426122 |
| DENV1 NS2B AF426124 | DENV1 NS2B AF426127 | DENV1 NS2B DL180618 | DENV1 NS2B AF426114 |
| DENV1 NS2B AF426129 | DENV1 NS2B AF426112 | DENV1 NS2B AY373383 | DENV1 NS2B AF426131 |
| DENV1 NS2B AF426118 | DENV1 NS2B AF426124 | DENV1 NS2B AF426127 | DENV1 NS2B DL180618 |
| DENV1 NS2B AF426113 | DENV1 NS2B AF426129 | DENV1 NS2B AF426112 | DENV1 NS2B AY373383 |
| DENV1 NS2B AF426130 | DENV1 NS2B AF426118 | DENV1 NS2B AF426124 | DENV1 NS2B AF426127 |
| DENV1 NS2B AF426123 | DENV1 NS2B AF426113 | DENV1 NS2B AF426129 | DENV1 NS2B AF426112 |
| DENV1 NS2B AF426120 | DENV1 NS2B AF426130 | DENV1 NS2B AF426118 | DENV1 NS2B AF426124 |
| DENV1 NS2B AF426111 | DENV1 NS2B AF426123 | DENV1 NS2B AF426113 | DENV1 NS2B AF426129 |
| DENV1 NS2B AF426116 | DENV1 NS2B AF426120 | DENV1 NS2B AF426130 | DENV1 NS2B AF426118 |
| DENV1 NS2B AF426117 | DENV1 NS2B AF426111 | DENV1 NS2B AF426123 | DENV1 NS2B AF426113 |
| DENV1 NS2B AF426125 | DENV1 NS2B AF426116 | DENV1 NS2B AF426120 | DENV1 NS2B AF426130 |
| DENV1 NS2B AF426115 | DENV1 NS2B AF426117 | DENV1 NS2B AF426111 | DENV1 NS2B AF426123 |
| DENV1 NS2B AY373384 | DENV1 NS2B AF426125 | DENV1 NS2B AF426116 | DENV1 NS2B AF426120 |
| DENV1 NS2B AF426126 | DENV1 NS2B AF426115 | DENV1 NS2B AF426117 | DENV1 NS2B AF426111 |
| DENV1 NS2B AF426110 | DENV1 NS2B AY373384 | DENV1 NS2B AF426125 | DENV1 NS2B AF426116 |
| DENV1 NS2B AY373385 | DENV1 NS2B AF426126 | DENV1 NS2B AF426115 | DENV1 NS2B AF426117 |
| DENV1 NS2B AF426119 | DENV1 NS2B AF426110 | DENV1 NS2B AY373384 | DENV1 NS2B AF426125 |
| DENV1 NS2B AF426128 | DENV1 NS2B AY373385 | DENV1 NS2B AF426126 | DENV1 NS2B AF426115 |
| DENV1 NS2B AF426121 | DENV1 NS2B AF426119 | DENV1 NS2B AF426110 | DENV1 NS2B AY373384 |
| DENV1 NS2B AF426122 | DENV1 NS2B AF426128 | DENV1 NS2B AY373385 | DENV1 NS2B AF426126 |
| DENV1 NS2B AF426114 | DENV1 NS2B AF426121 | DENV1 NS2B AF426119 | DENV1 NS2B AF426110 |
| DENV1 NS2B AF426131 | DENV1 NS2B AF426122 | DENV1 NS2B AF426128 | DENV1 NS2B AY373385 |
| DENV1 NS2B DL180618 | DENV1 NS2B AF426114 | DENV1 NS2B AF426121 | DENV1 NS2B AF426119 |

FIG. 66-79

| Virus Protein Accession No. | Virus Protein Accession No. | Virus Protein Accession No. | Virus Protein Accession No. |
|---|---|---|---|
| DENV1 NS2B AF426128 | DENV1 NS2B AY373385 | DENV1 NS2B AF426126 | DENV1 NS3GU131731 DENV1 NS3GQ199794 |
| DENV1 NS2B AF426121 | DENV1 NS2B AF426119 | DENV1 NS2B AF426110 | DENV1 NS3GU131832 DENV1 NS3EU848545 |
| DENV1 NS2B AF426122 | DENV1 NS2B AF426128 | DENV1 NS2B AY373385 | DENV1 NS3GU131760 DENV1 NS3GU131965 |
| DENV1 NS2B AF426114 | DENV1 NS2B AF426121 | DENV1 NS2B AF426119 | DENV1 NS3FJ898415 DENV1 NS3GU131782 |
| DENV1 NS2B AF426131 | DENV1 NS2B AF426122 | DENV1 NS2B AF426128 | DENV1 NS3GQ868535 DENV1 NS3EU482524 |
| DENV1 NS2B DL180618 | DENV1 NS2B AF426114 | DENV1 NS2B AF426121 | DENV1 NS3GU131726 DENV1 NS3GQ868501 |
| DENV1 NS2B AY373383 | DENV1 NS2B AF426131 | DENV1 NS3FJ024446 DENV1 NS3GU131759 | DENV1 NS3FJ432734 DENV1 NS3FJ410253 |
| DENV1 NS2B AF426127 | DENV1 NS2B DL180618 | DENV1 NS3FJ882560 DENV1 NS3GU131838 | DENV1 NS3FJ410281 DENV1 NS3EU482708 |
| DENV1 NS2B AF426112 | DENV1 NS2B AY373383 | DENV1 NS3FJ024437 DENV1 NS3GQ868639 | DENV1 NS3GQ199784 DENV1 NS3GQ868567 |
| DENV1 NS2B AF426124 | DENV1 NS2B AF426127 | DENV1 NS3FJ639806 DENV1 NS3GQ199837 | DENV1 NS3EU280167 DENV1 NS3FJ850084 |
| DENV1 NS2B AF426129 | DENV1 NS2B AF426112 | DENV1 NS3AB189120 DENV1 NS3EU081235 | DENV1 NS3EU482514 DENV1 NS3AY722802 |
| DENV1 NS2B AF426118 | DENV1 NS2B AF426124 | DENV1 NS3FJ410263 DENV1 NS3AY713476 | DENV1 NS3FJ639808 DENV1 NS3EU482526 |
| DENV1 NS2B AF426113 | DENV1 NS2B AF426129 | DENV1 NS3GQ199806 DENV1 NS3GU131693 | DENV1 NS3AY732476 DENV1 NS3GU131772 |
| DENV1 NS2B AF426130 | DENV1 NS2B AF426118 | DENV1 NS3GU131753 DENV1 NS3GU131711 | DENV1 NS3FJ882530 DENV1 NS3GU131978 |
| DENV1 NS2B AF426123 | DENV1 NS2B AF426113 | DENV1 NS3FJ639812 DENV1 NS3GU131765 | DENV1 NS3FJ547088 DENV1 NS3FJ898374 |
| DENV1 NS2B AF426120 | DENV1 NS2B AF426130 | DENV1 NS3FJ432744 DENV1 NS3GM059691 | DENV1 NS3GQ868504 DENV1 NS3FJ882550 |
| DENV1 NS2B AF426111 | DENV1 NS2B AF426123 | DENV1 NS3FJ410278 DENV1 NS3EU081261 | DENV1 NS3FJ850113 DENV1 NS3GU131980 |
| DENV1 NS2B AF426116 | DENV1 NS2B AF426120 | DENV1 NS3EU482801 DENV1 NS3FJ882526 | DENV1 NS3GU131783 DENV1 NS3AY732474 |
| DENV1 NS2B AF426117 | DENV1 NS2B AF426111 | DENV1 NS3FJ639823 DENV1 NS3EU081260 | DENV1 NS3GU131958 DENV1 NS3FJ898393 |
| DENV1 NS2B AF426125 | DENV1 NS2B AF426116 | DENV1 NS3GQ199786 DENV1 NS3AY726550 | DENV1 NS3EU677176 DENV1 NS3FJ850104 |
| DENV1 NS2B AF426115 | DENV1 NS2B AF426117 | DENV1 NS3FJ882558 DENV1 NS3GU131809 | DENV1 NS3EU249492 DENV1 NS3EU482712 |
| DENV1 NS2B AY373384 | DENV1 NS2B AF426125 | DENV1 NS3FJ182030 DENV1 NS3EU482816 | DENV1 NS3FJ410236 DENV1 NS3FJ410192 |
| DENV1 NS2B AF426126 | DENV1 NS2B AF426115 | DENV1 NS3GU131813 DENV1 NS3EU482808 | DENV1 NS3EU081281 DENV1 NS3FJ432729 |
| DENV1 NS2B AF426110 | DENV1 NS2B AY373384 | DENV1 NS3EU482498 DENV1 NS3FJ882525 | DENV1 NS3GQ868525 DENV1 NS3FN429883 |

FIG. 66-80

| Virus Protein Accession No. | Virus Protein Accession No. | Virus Protein Accession No. | Virus Protein Accession No. |
|---|---|---|---|
| DENV1 NS3GQ199828 | DENV1 NS3GU131824 | DENV1 NS3AY277665 | DENV1 NS3DQ285558 |
| DENV1 NS3FJ182021 | DENV1 NS3GQ199854 | DENV1 NS3GQ199802 | DENV1 NS3FJ898371 |
| DENV1 NS3EU482824 | DENV1 NS3FJ898410 | DENV1 NS3FJ882549 | DENV1 NS3FJ461308 |
| DENV1 NS3GU131956 | DENV1 NS3FJ024472 | DENV1 NS3FJ898391 | DENV1 NS3EU482711 |
| DENV1 NS3EU482797 | DENV1 NS3EU081236 | DENV1 NS3GQ199830 | DENV1 NS3GQ868605 |
| DENV1 NS3FJ410213 | DENV1 NS3EU482480 | DENV1 NS3DQ672562 | DENV1 NS3GQ868565 |
| DENV1 NS3FJ898384 | DENV1 NS3GU131795 | DENV1 NS3GU131757 | DENV1 NS3GQ868608 |
| DENV1 NS3FJ410186 | DENV1 NS3FJ432736 | DENV1 NS3GQ199839 | DENV1 NS3FJ898417 |
| DENV1 NS3GQ868538 | DENV1 NS3FJ024480 | DENV1 NS3FJ898437 | DENV1 NS3FJ024426 |
| DENV1 NS3EU677163 | DENV1 NS3EU081278 | DENV1 NS3EU081250 | DENV1 NS3GQ868511 |
| DENV1 NS3FJ432742 | DENV1 NS3FJ182019 | DENV1 NS3GU131963 | DENV1 NS3FJ882562 |
| DENV1 NS3FJ461303 | DENV1 NS3GU131919 | DENV1 NS3FJ410257 | DENV1 NS3GU131752 |
| DENV1 NS3FJ639679 | DENV1 NS3GU131682 | DENV1 NS3GU131798 | DENV1 NS3GQ199811 |
| DENV1 NS3FJ469909 | DENV1 NS3EU482714 | DENV1 NS3GQ868508 | DENV1 NS3GQ868518 |
| DENV1 NS3EU081227 | DENV1 NS3FJ410197 | DENV1 NS3EU482789 | DENV1 NS3FJ850075 |
| DENV1 NS3EU482534 | DENV1 NS3GU131744 | DENV1 NS3U88536 | DENV1 NS3FJ850100 |
| DENV1 NS3FJ410261 | DENV1 NS3FJ410183 | DENV1 NS3GU131807 | DENV1 NS3GU131709 |
| DENV1 NS3FJ687428 | DENV1 NS3GQ199875 | DENV1 NS3GQ868533 | DENV1 NS3GQ199848 |
| DENV1 NS3EU660392 | DENV1 NS3GQ199845 | DENV1 NS3FJ898390 | DENV1 NS3FJ024429 |
| DENV1 NS3GQ199815 | DENV1 NS3GU131689 | DENV1 NS3EU081259 | DENV1 NS3FJ461315 |
| DENV1 NS3EU482611 | DENV1 NS3FJ461323 | DENV1 NS3EU482806 | DENV1 NS3EU677154 |
| DENV1 NS3FJ639821 | DENV1 NS3FJ432740 | DENV1 NS3FJ373298 | DENV1 NS3GU056033 |
| DENV1 NS3FJ410174 | DENV1 NS3AY713474 | DENV1 NS3FJ898382 | DENV1 NS3FN429890 |
| DENV1 NS3GU131706 | DENV1 NS3GQ199789 | DENV1 NS3FJ410250 | DENV1 NS3EU482822 |
| DENV1 NS3AY373427 | DENV1 NS3GU131977 | DENV1 NS3FJ410226 | DENV1 NS3GU131746 |
| DENV1 NS3EU249495 | DENV1 NS3FJ850069 | DENV1 NS3GU131785 | DENV1 NS3FJ390382 |
| DENV1 NS3EU482477 | DENV1 NS3EF457905 | DENV1 NS3GU131842 | DENV1 NS3GU131724 |
| DENV1 NS3EU482826 | DENV1 NS3FJ898421 | DENV1 NS3GU131836 | DENV1 NS3EU677161 |
| DENV1 NS3GQ199843 | DENV1 NS3FJ744701 | DENV1 NS3GQ199824 | DENV1 NS3EU482536 |
| DENV1 NS3GQ199821 | DENV1 NS3GQ199788 | DENV1 NS3EU482790 | DENV1 NS3GU131713 |
| DENV1 NS3GU131777 | DENV1 NS3EU726778 | DENV1 NS3EU081257 | DENV1 NS3GU131721 |
| DENV1 NS3FJ898378 | DENV1 NS3EU081263 | DENV1 NS3FJ024449 | DENV1 NS3EU660397 |
| DENV1 NS3FJ461306 | DENV1 NS3FJ205874 | DENV1 NS3FJ024430 | DENV1 NS3FJ906965 |
| DENV1 NS3GU131707 | DENV1 NS3GU131826 | DENV1 NS3EU482815 | DENV1 NS3EU081280 |
| DENV1 NS3AF226686 | DENV1 NS3FJ898407 | DENV1 NS3FJ898398 | DENV1 NS3FJ639692 |
| DENV1 NS3EU677152 | DENV1 NS3GQ199804 | DENV1 NS3EU482530 | DENV1 NS3EU249494 |
| DENV1 NS3GU131828 | DENV1 NS3FJ024478 | DENV1 NS3GQ868636 | DENV1 NS3FJ639819 |
| DENV1 NS3GU131971 | DENV1 NS3FJ850102 | DENV1 NS3FJ024459 | DENV1 NS3EU482529 |
| DENV1 NS3GQ199826 | DENV1 NS3FJ432721 | DENV1 NS3GQ868610 | DENV1 NS3EU482616 |
| DENV1 NS3EU677168 | DENV1 NS3EU660418 | DENV1 NS3EU081233 | DENV1 NS3FJ410284 |
| DENV1 NS3FJ461313 | DENV1 NS3EF032590 | DENV1 NS3FJ687426 | DENV1 NS3FJ410181 |
| DENV1 NS3EU081267 | DENV1 NS3AY713473 | DENV1 NS3FJ898404 | DENV1 NS3FJ461332 |
| DENV1 NS3FJ410175 | DENV1 NS3GU131700 | DENV1 NS3EU081244 | DENV1 NS3GQ199777 |
| DENV1 NS3FJ182028 | DENV1 NS3GQ868523 | DENV1 NS3EU482522 | DENV1 NS3EU081229 |
| DENV1 NS3FJ882516 | DENV1 NS3GQ868522 | DENV1 NS3FJ205882 | DENV1 NS3FJ410270 |
| DENV1 NS3FJ024456 | DENV1 NS3EU660402 | DENV1 NS3GU131788 | DENV1 NS3GQ199873 |
| DENV1 NS3AF311956 | DENV1 NS3FJ639676 | DENV1 NS3GU131762 | DENV1 NS3FJ024451 |
| DENV1 NS3GU131770 | DENV1 NS3FJ410272 | DENV1 NS3FJ410238 | DENV1 NS3GU131739 |

FIG. 66-81

| Virus Protein Accession No. | Virus Protein Accession No. | Virus Protein Accession No. | Virus Protein Accession No. |
|---|---|---|---|
| DENV1 NS3EU482482 | DENV1 NS3EU359008 | DENV1 NS3FJ882533 | DENV1 NS3FJ898383 |
| DENV1 NS3FJ024482 | DENV1 NS3FJ906964 | DENV1 NS3GU131926 | DENV1 NS3GU131984 |
| DENV1 NS3GU131698 | DENV1 NS3EU482618 | DENV1 NS3GU131734 | DENV1 NS3GQ868498 |
| DENV1 NS3FJ024432 | DENV1 NS3FJ410246 | DENV1 NS3EU482519 | DENV1 NS3EU482487 |
| DENV1 NS3FJ882556 | DENV1 NS3GQ868534 | DENV1 NS3AY206457 | DENV1 NS3FJ639818 |
| DENV1 NS3GU131831 | DENV1 NS3GQ199835 | DENV1 NS3GQ199818 | DENV1 NS3EU677166 |
| DENV1 NS3AY835999 | DENV1 NS3GU131716 | DENV1 NS3FJ850077 | DENV1 NS3GU131758 |
| DENV1 NS3GU131922 | DENV1 NS3FJ410256 | DENV1 NS3AY726553 | DENV1 NS3GU131697 |
| DENV1 NS3FJ898376 | DENV1 NS3FJ898424 | DENV1 NS3EU482718 | DENV1 NS3EU081247 |
| DENV1 NS3FJ898425 | DENV1 NS3GU131687 | DENV1 NS3EU081274 | DENV1 NS3AY376738 |
| DENV1 NS3FJ898419 | DENV1 NS3EU482615 | DENV1 NS3FJ182025 | DENV1 NS3GU131776 |
| DENV1 NS3GQ199799 | DENV1 NS3FJ410285 | DENV1 NS3GU131973 | DENV1 NS3FJ390380 |
| DENV1 NS3GU056029 | DENV1 NS3FJ898388 | DENV1 NS3EU482811 | DENV1 NS3FJ882547 |
| DENV1 NS3AY145122 | DENV1 NS3GQ868529 | DENV1 NS3FJ410210 | DENV1 NS3GQ868611 |
| DENV1 NS3GU131811 | DENV1 NS3FJ882579 | DENV1 NS3GU131925 | DENV1 NS3FJ410231 |
| DENV1 NS3EU482495 | DENV1 NS3FJ024442 | DENV1 NS3FJ373297 | DENV1 NS3GU131680 |
| DENV1 NS3GQ868506 | DENV1 NS3GQ868563 | DENV1 NS3FJ205875 | DENV1 NS3M87512 |
| DENV1 NS3GU131961 | DENV1 NS3FJ639743 | DENV1 NS3DQ193572 | DENV1 NS3FJ024440 |
| DENV1 NS3FJ410269 | DENV1 NS3FJ390378 | DENV1 NS3U88535 | DENV1 NS3GU131774 |
| DENV1 NS3GQ199833 | DENV1 NS3GU131837 | DENV1 NS3FJ882564 | DENV1 NS3DQ672560 |
| DENV1 NS3EU081238 | DENV1 NS3FJ432732 | DENV1 NS3GQ199774 | DENV1 NS3GQ868512 |
| DENV1 NS3GU131748 | DENV1 NS3GU131840 | DENV1 NS3GQ199787 | DENV1 NS3FJ024463 |
| DENV1 NS3FJ410248 | DENV1 NS3EU677174 | DENV1 NS3FJ850099 | DENV1 NS3EF122231 |
| DENV1 NS3GU131733 | DENV1 NS3FJ639680 | DENV1 NS3FJ410267 | DENV1 NS3GQ199810 |
| DENV1 NS3FJ461325 | DENV1 NS3GQ199849 | DENV1 NS3EU726777 | DENV1 NS3FJ850081 |
| DENV1 NS3GQ199817 | DENV1 NS3FJ882566 | DENV1 NS3EU081241 | DENV1 NS3FJ024427 |
| DENV1 NS3GU131691 | DENV1 NS3FJ882541 | DENV1 NS3FJ898381 | DENV1 NS3GQ868637 |
| DENV1 NS3GU131804 | DENV1 NS3FJ639802 | DENV1 NS3CS477265 | DENV1 NS3FJ639796 |
| DENV1 NS3FJ562106 | DENV1 NS3FJ432725 | DENV1 NS3GQ199780 | DENV1 NS3EU677159 |
| DENV1 NS3FJ639682 | DENV1 NS3FN429888 | DENV1 NS3FN429889 | DENV1 NS3FJ882519 |
| DENV1 NS3GU131792 | DENV1 NS3EU482492 | DENV1 NS3FJ024434 | DENV1 NS3GQ199825 |
| DENV1 NS3FJ882522 | DENV1 NS3FJ882557 | DENV1 NS3FJ024483 | DENV1 NS3EU482525 |
| DENV1 NS3GU131742 | DENV1 NS3FJ639669 | DENV1 NS3EU482502 | DENV1 NS3EU482798 |
| DENV1 NS3GU131761 | DENV1 NS3EU482792 | DENV1 NS3GU131962 | DENV1 NS3FJ182032 |
| DENV1 NS3GQ868561 | DENV1 NS3FJ461340 | DENV1 NS3FJ461339 | DENV1 NS3GU131769 |
| DENV1 NS3FJ410245 | DENV1 NS3GU131805 | DENV1 NS3EU482821 | DENV1 NS3GQ199792 |
| DENV1 NS3GQ868520 | DENV1 NS3FJ410264 | DENV1 NS3GU131891 | DENV1 NS3GU131888 |
| DENV1 NS3EU482707 | DENV1 NS3EU482516 | DENV1 NS3EU660403 | DENV1 NS3GU131704 |
| DENV1 NS3EU482520 | DENV1 NS3FJ469907 | DENV1 NS3FJ410275 | DENV1 NS3GQ199850 |
| DENV1 NS3FJ882536 | DENV1 NS3FJ898396 | DENV1 NS3GQ868559 | DENV1 NS3GQ868526 |
| DENV1 NS3EU081248 | DENV1 NS3EU677157 | DENV1 NS3AF298808 | DENV1 NS3GU131695 |
| DENV1 NS3GQ868531 | DENV1 NS3EU482510 | DENV1 NS3FJ410218 | DENV1 NS3FJ410243 |
| DENV1 NS3EU482533 | DENV1 NS3FJ182034 | DENV1 NS3GQ199775 | DENV1 NS3AF309641 |
| DENV1 NS3FJ898411 | DENV1 NS3FJ898377 | DENV1 NS3FJ882552 | DENV1 NS3FJ639686 |
| DENV1 NS3GQ199796 | DENV1 NS3EU660390 | DENV1 NS3FJ898402 | DENV1 NS3FJ410255 |
| DENV1 NS3GU131818 | DENV1 NS3GU131718 | DENV1 NS3GQ199859 | DENV1 NS3EU482818 |
| DENV1 NS3EU081239 | DENV1 NS3GQ868513 | DENV1 NS3FJ410196 | DENV1 NS3GU131685 |
| DENV1 NS3EU081255 | DENV1 NS3FJ639740 | DENV1 NS3FJ639690 | DENV1 NS3GU131793 |

FIG. 66-82

| Virus Protein Accession No. | Virus Protein Accession No. | Virus Protein Accession No. | Virus Protein Accession No. |
|---|---|---|---|
| DENV1 NS3FN429882 | DENV1 NS3FJ410276 | DENV1 NS3EU482591 | DENV1 NS3GQ199844 |
| DENV1 NS3EU482509 | DENV1 NS3FJ898386 | DENV1 NS3GU131738 | DENV1 NS3GU131970 |
| DENV1 NS3FJ547086 | DENV1 NS3EU482506 | DENV1 NS3FJ024485 | DENV1 NS3EU482796 |
| DENV1 NS3FJ639694 | DENV1 NS3GU131736 | DENV1 NS3EU677177 | DENV1 NS3EU596502 |
| DENV1 NS3EU482491 | DENV1 NS3GU131948 | DENV1 NS3GU131967 | DENV1 NS3GQ868607 |
| DENV1 NS3GU131755 | DENV1 NS3GU131834 | DENV1 NS3GU131814 | DENV1 NS3GQ868524 |
| DENV1 NS3FJ898430 | DENV1 NS3EU482715 | DENV1 NS3AJ968413 | DENV1 NS3GQ868517 |
| DENV1 NS3FJ898428 | DENV1 NS3EU482716 | DENV1 NS3FJ024436 | DENV1 NS3EU081268 |
| DENV1 NS3FJ639814 | DENV1 NS3FJ850087 | DENV1 NS3FJ432746 | DENV1 NS3GQ199827 |
| DENV1 NS3GU131763 | DENV1 NS3AF514883 | DENV1 NS3FJ850071 | DENV1 NS3EU660394 |
| DENV1 NS3FJ873814 | DENV1 NS3EU660395 | DENV1 NS3EU081271 | DENV1 NS3EU482610 |
| DENV1 NS3FJ850093 | DENV1 NS3FJ410262 | DENV1 NS3AY708047 | DENV1 NS3EU179861 |
| DENV1 NS3GU131728 | DENV1 NS3EU081243 | DENV1 NS3EU677169 | DENV1 NS3AB074761 |
| DENV1 NS3FJ898372 | DENV1 NS3CS477264 | DENV1 NS3FJ882535 | DENV1 NS3GQ199829 |
| DENV1 NS3EU677172 | DENV1 NS3FJ562104 | DENV1 NS3FJ547087 | DENV1 NS3GU131863 |
| DENV1 NS3FJ639794 | DENV1 NS3GQ199823 | DENV1 NS3EU677164 | DENV1 NS3GU131892 |
| DENV1 NS3GQ868527 | DENV1 NS3FJ639741 | DENV1 NS3GU131725 | DENV1 NS3GQ868530 |
| DENV1 NS3FJ687430 | DENV1 NS3GU131690 | DENV1 NS3DQ285561 | DENV1 NS3FJ410173 |
| DENV1 NS3FJ639672 | DENV1 NS3EU482497 | DENV1 NS3GU131678 | DENV1 NS3EU482814 |
| DENV1 NS3FJ410189 | DENV1 NS3GU370049 | DENV1 NS3GU131822 | DENV1 NS3EU660393 |
| DENV1 NS3FJ182023 | DENV1 NS3GQ868632 | DENV1 NS3EU482479 | DENV1 NS3FJ639815 |
| DENV1 NS3FJ410260 | DENV1 NS3GQ868613 | DENV1 NS3FJ882518 | DENV1 NS3GU131979 |
| DENV1 NS3EU081266 | DENV1 NS3GU131893 | DENV1 NS3FJ639696 | DENV1 NS3EU482827 |
| DENV1 NS3GU131895 | DENV1 NS3EU687247 | DENV1 NS3GQ199857 | DENV1 NS3FJ461316 |
| DENV1 NS3GU131829 | DENV1 NS3EU482813 | DENV1 NS3GQ199808 | DENV1 NS3FJ882544 |
| DENV1 NS3FJ410204 | DENV1 NS3AY713475 | DENV1 NS3FJ432749 | DENV1 NS3GU131768 |
| DENV1 NS3FJ410194 | DENV1 NS3FJ024438 | DENV1 NS3GU131771 | DENV1 NS3EU482567 |
| DENV1 NS3FJ882528 | DENV1 NS3FJ882542 | DENV1 NS3GQ199772 | DENV1 NS3GU131957 |
| DENV1 NS3FJ432730 | DENV1 NS3GU131982 | DENV1 NS3FJ882538 | DENV1 NS3DQ672559 |
| DENV1 NS3EU081230 | DENV1 NS3FJ461328 | DENV1 NS3FJ410283 | DENV1 NS3EU677153 |
| DENV1 NS3FJ410206 | DENV1 NS3FJ687432 | DENV1 NS3FJ882521 | DENV1 NS3AF226687 |
| DENV1 NS3GU131969 | DENV1 NS3FJ410188 | DENV1 NS3EU726779 | DENV1 NS3EU482825 |
| DENV1 NS3AY732478 | DENV1 NS3GQ199813 | DENV1 NS3EU081253 | DENV1 NS3FJ182022 |
| DENV1 NS3FJ461330 | DENV1 NS3GQ199847 | DENV1 NS3FN429886 | DENV1 NS3EU482592 |
| DENV1 NS3DQ672556 | DENV1 NS3FJ410212 | DENV1 NS3GQ868601 | DENV1 NS3EU482800 |
| DENV1 NS3GU131976 | DENV1 NS3FJ410232 | DENV1 NS3FJ182003 | DENV1 NS3GU131745 |
| DENV1 NS3FJ410216 | DENV1 NS3EU482481 | DENV1 NS3FJ410286 | DENV1 NS3FJ410184 |
| DENV1 NS3GQ199801 | DENV1 NS3AY726551 | DENV1 NS3FJ639684 | DENV1 NS3GQ199778 |
| DENV1 NS3FJ906728 | DENV1 NS3FJ639811 | DENV1 NS3EU482794 | DENV1 NS3FJ390383 |
| DENV1 NS3GU131803 | DENV1 NS3GU131800 | DENV1 NS3AY722801 | DENV1 NS3FJ410203 |
| DENV1 NS3AY726555 | DENV1 NS3FJ024425 | DENV1 NS3FJ410199 | DENV1 NS3EU482476 |
| DENV1 NS3GQ199798 | DENV1 NS3EU482527 | DENV1 NS3EU482485 | DENV1 NS3AY145123 |
| DENV1 NS3GU056030 | DENV1 NS3EU482500 | DENV1 NS3EU482803 | DENV1 NS3EU081270 |
| DENV1 NS3GU131816 | DENV1 NS3EU482828 | DENV1 NS3GU131767 | DENV1 NS3GQ199872 |
| DENV1 NS3EU482512 | DENV1 NS3FJ205873 | DENV1 NS3AY726549 | DENV1 NS3GQ199856 |
| DENV1 NS3FJ882568 | DENV1 NS3AY732481 | DENV1 NS3FJ176779 | DENV1 NS3EU482709 |
| DENV1 NS3FJ898413 | DENV1 NS3GQ199782 | DENV1 NS3FJ461335 | DENV1 NS3GQ868618 |
| DENV1 NS3EU596504 | DENV1 NS3EU677150 | DENV1 NS3FJ898408 | DENV1 NS3GU131699 |

FIG. 66-83

| Virus Protein Accession No. | Virus Protein Accession No. | Virus Protein Accession No. | Virus Protein Accession No. |
|---|---|---|---|
| DENV1 NS3FJ182029 | DENV1 NS3EU482791 | DENV1 NS3GQ199820 | DENV1 NS3GU131921 |
| DENV1 NS3GQ199855 | DENV1 NS3FJ898427 | DENV1 NS3AF513110 | DENV1 NS3FJ182031 |
| DENV1 NS3FJ882539 | DENV1 NS3FJ410234 | DENV1 NS3FJ410191 | DENV1 NS3FJ639683 |
| DENV1 NS3FJ410180 | DENV1 NS3EU482494 | DENV1 NS3FJ024431 | DENV1 NS3GU131740 |
| DENV1 NS3GU131806 | DENV1 NS3FJ432720 | DENV1 NS3FJ898394 | DENV1 NS3FJ562105 |
| DENV1 NS3DQ672564 | DENV1 NS3FJ639735 | DENV1 NS3FJ024445 | DENV1 NS3FJ432745 |
| DENV1 NS3FJ410268 | DENV1 NS3FJ898406 | DENV1 NS3EU081242 | DENV1 NS3AY277664 |
| DENV1 NS3GU131825 | DENV1 NS3DQ672563 | DENV1 NS3FJ461333 | DENV1 NS3FJ882559 |
| DENV1 NS3FJ850101 | DENV1 NS3GQ199793 | DENV1 NS3GQ868509 | DENV1 NS3FJ024435 |
| DENV1 NS3FJ182002 | DENV1 NS3EU482807 | DENV1 NS3FJ410209 | DENV1 NS3GQ199803 |
| DENV1 NS3GU131683 | DENV1 NS3GU131797 | DENV1 NS3GU131839 | DENV1 NS3FJ461320 |
| DENV1 NS3FJ639685 | DENV1 NS3FJ410258 | DENV1 NS3FJ410251 | DENV1 NS3FJ850090 |
| DENV1 NS3EU482535 | DENV1 NS3EU482802 | DENV1 NS3EU677175 | DENV1 NS3EU482528 |
| DENV1 NS3FJ024433 | DENV1 NS3GQ868633 | DENV1 NS3FJ639820 | DENV1 NS3FJ898448 |
| DENV1 NS3FJ176780 | DENV1 NS3AB074760 | DENV1 NS3GQ199867 | DENV1 NS3FJ898420 |
| DENV1 NS3FJ373305 | DENV1 NS3EU081256 | DENV1 NS3FJ024428 | DENV1 NS3GQ868519 |
| DENV1 NS3FJ410279 | DENV1 NS3FJ432735 | DENV1 NS3EU482537 | DENV1 NS3FJ432727 |
| DENV1 NS3EU081279 | DENV1 NS3GQ199781 | DENV1 NS3GU131778 | DENV1 NS3EU677155 |
| DENV1 NS3GU131756 | DENV1 NS3DQ285559 | DENV1 NS3FJ024464 | DENV1 NS3EU677162 |
| DENV1 NS3FJ478457 | DENV1 NS3FJ182036 | DENV1 NS3GU131972 | DENV1 NS3GU131692 |
| DENV1 NS3FJ024457 | DENV1 NS3FJ547089 | DENV1 NS3GQ868606 | DENV1 NS3EU596501 |
| DENV1 NS3AB189121 | DENV1 NS3FJ898416 | DENV1 NS3GU131679 | DENV1 NS3FJ410273 |
| DENV1 NS3DQ285562 | DENV1 NS3GU131960 | DENV1 NS3GU131708 | DENV1 NS3FJ410182 |
| DENV1 NS3FJ850103 | DENV1 NS3GU131820 | DENV1 NS3EU687251 | DENV1 NS3GQ199791 |
| DENV1 NS3EU482499 | DENV1 NS3EU677170 | DENV1 NS3AF226685 | DENV1 NS3GQ868630 |
| DENV1 NS3GQ199805 | DENV1 NS3FJ882531 | DENV1 NS3FJ882561 | DENV1 NS3EU482503 |
| DENV1 NS3GQ868568 | DENV1 NS3AF514889 | DENV1 NS3EU482488 | DENV1 NS3FB730116 |
| DENV1 NS3FJ547068 | DENV1 NS3EU863650 | DENV1 NS3FJ410214 | DENV1 NS3FJ410198 |
| DENV1 NS3EU081234 | DENV1 NS3FB667403 | DENV1 NS3FJ687429 | DENV1 NS3EU081276 |
| DENV1 NS3FJ432739 | DENV1 NS3GU131714 | DENV1 NS3FJ898379 | DENV1 NS3FJ461324 |
| DENV1 NS3GQ199816 | DENV1 NS3FJ882569 | DENV1 NS3GU131790 | DENV1 NS3AF311958 |
| DENV1 NS3FJ898401 | DENV1 NS3FJ410280 | DENV1 NS3EU482540 | DENV1 NS3FJ639813 |
| DENV1 NS3GU131812 | DENV1 NS3FJ882548 | DENV1 NS3GU131681 | DENV1 NS3AF180817 |
| DENV1 NS3EU660419 | DENV1 NS3FJ859029 | DENV1 NS3EU081226 | DENV1 NS3EU081277 |
| DENV1 NS3GQ199831 | DENV1 NS3GU131781 | DENV1 NS3FJ182020 | DENV1 NS3FJ898426 |
| DENV1 NS3AY732475 | DENV1 NS3FJ410252 | DENV1 NS3FJ882524 | DENV1 NS3GU131729 |
| DENV1 NS3EU249491 | DENV1 NS3EU081262 | DENV1 NS3EU677139 | DENV1 NS3GQ868539 |
| DENV1 NS3GU131833 | DENV1 NS3GQ199842 | DENV1 NS3GU131920 | DENV1 NS3AY145121 |
| DENV1 NS3GQ199836 | DENV1 NS3EU726782 | DENV1 NS3GQ868536 | DENV1 NS3EU677167 |
| DENV1 NS3FJ410240 | DENV1 NS3GQ868537 | DENV1 NS3GQ199776 | DENV1 NS3FJ898422 |
| DENV1 NS3FJ410225 | DENV1 NS3GQ199797 | DENV1 NS3FJ390381 | DENV1 NS3FJ744702 |
| DENV1 NS3GU131732 | DENV1 NS3FJ882515 | DENV1 NS3GU131751 | DENV1 NS3GQ199838 |
| DENV1 NS3FJ639677 | DENV1 NS3FJ024450 | DENV1 NS3FJ390388 | DENV1 NS3GQ199779 |
| DENV1 NS3FJ810419 | DENV1 NS3GU131723 | DENV1 NS3EU482823 | DENV1 NS3FJ205883 |
| DENV1 NS3GU056032 | DENV1 NS3GQ868503 | DENV1 NS3FJ850073 | DENV1 NS3GQ868635 |
| DENV1 NS3FJ390374 | DENV1 NS3FJ882551 | DENV1 NS3EU081237 | DENV1 NS3DQ285560 |
| DENV1 NS3FJ882527 | DENV1 NS3FJ461318 | DENV1 NS3EU482483 | DENV1 NS3FJ410239 |
| DENV1 NS3GU131830 | DENV1 NS3FJ898418 | DENV1 NS3GQ199853 | DENV1 NS3FJ882554 |

FIG. 66-84

| Virus Protein Accession No. | Virus Protein Accession No. | Virus Protein Accession No. | Virus Protein Accession No. |
|---|---|---|---|
| DENV1 NS3GU131747 | DENV1 NS3GQ868510 | DENV1 NS3EU081246 | DENV1 NS3FJ461341 |
| DENV1 NS3FJ024481 | DENV1 NS3FJ410290 | DENV1 NS3GQ199773 | DENV1 NS3EU482511 |
| DENV1 NS3FJ639675 | DENV1 NS3GU131981 | DENV1 NS3FJ898431 | DENV1 NS3FJ024453 |
| DENV1 NS3GU131810 | DENV1 NS3EU660391 | DENV1 NS3EU081231 | DENV1 NS3GU131749 |
| DENV1 NS3FJ410249 | DENV1 NS3EU482515 | DENV1 NS3EU482486 | DENV1 NS3FJ898389 |
| DENV1 NS3DQ672561 | DENV1 NS3EU081232 | DENV1 NS3FJ410187 | DENV1 NS3GU131696 |
| DENV1 NS3FJ810415 | DENV1 NS3GQ199840 | DENV1 NS3FN429881 | DENV1 NS3EU482508 |
| DENV1 NS3GQ199785 | DENV1 NS3EU482710 | DENV1 NS3GU131764 | DENV1 NS3EU081265 |
| DENV1 NS3FJ410220 | DENV1 NS3GQ868566 | DENV1 NS3GQ868569 | DENV1 NS3FJ410247 |
| DENV1 NS3EU482504 | DENV1 NS3GU131964 | DENV1 NS3GQ868612 | DENV1 NS3FJ461307 |
| DENV1 NS3FJ205881 | DENV1 NS3EU482713 | DENV1 NS3FJ461331 | DENV1 NS3GQ868560 |
| DENV1 NS3EU081264 | DENV1 NS3EU482538 | DENV1 NS3FJ410282 | DENV1 NS3FJ461319 |
| DENV1 NS3GU131688 | DENV1 NS3EU081245 | DENV1 NS3FJ205872 | DENV1 NS3FJ898412 |
| DENV1 NS3A75711 | DENV1 NS3GQ868619 | DENV1 NS3GQ199809 | DENV1 NS3GQ868521 |
| DENV1 NS3EU081254 | DENV1 NS3GU131789 | DENV1 NS3GU131722 | DENV1 NS3GU131686 |
| DENV1 NS3FJ898429 | DENV1 NS3AB178040 | DENV1 NS3FJ873810 | DENV1 NS3AY732479 |
| DENV1 NS3FJ469908 | DENV1 NS3AY732480 | DENV1 NS3FJ882546 | DENV1 NS3FJ384655 |
| DENV1 NS3GU131799 | DENV1 NS3FJ898385 | DENV1 NS3FJ639797 | DENV1 NS3FJ882537 |
| DENV1 NS3FJ182027 | DENV1 NS3FJ639688 | DENV1 NS3EU677160 | DENV1 NS3FJ898373 |
| DENV1 NS3FJ432737 | DENV1 NS3FJ205884 | DENV1 NS3FJ461312 | DENV1 NS3GU131710 |
| DENV1 NS3FJ410201 | DENV1 NS3FJ898380 | DENV1 NS3NC_001477 | DENV1 NS3EU677171 |
| DENV1 NS3GU131701 | DENV1 NS3FJ182026 | DENV1 NS3GQ199841 | DENV1 NS3FJ024479 |
| DENV1 NS3EU081269 | DENV1 NS3AF311957 | DENV1 NS3FJ882534 | DENV1 NS3FJ687431 |
| DENV1 NS3GQ199783 | DENV1 NS3FJ639693 | DENV1 NS3FJ410289 | DENV1 NS3FJ882523 |
| DENV1 NS3GU131754 | DENV1 NS3GU131735 | DENV1 NS3FJ410179 | DENV1 NS3FJ547065 |
| DENV1 NS3EU081251 | DENV1 NS3FJ850114 | DENV1 NS3FJ432719 | DENV1 NS3GU131791 |
| DENV1 NS3FJ432733 | DENV1 NS3FJ882563 | DENV1 NS3AY277666 | DENV1 NS3GU131894 |
| DENV1 NS3FJ024447 | DENV1 NS3GQ199812 | DENV1 NS3GU131727 | DENV1 NS3EU482490 |
| DENV1 NS3FJ547063 | DENV1 NS3GU131737 | DENV1 NS3FJ024462 | DENV1 NS3EU482521 |
| DENV1 NS3EU482523 | DENV1 NS3FJ547060 | DENV1 NS3FJ024441 | DENV1 NS3FJ898423 |
| DENV1 NS3EU482793 | DENV1 NS3GQ199819 | DENV1 NS3GQ199822 | DENV1 NS3EU660396 |
| DENV1 NS3U88537 | DENV1 NS3FJ024484 | DENV1 NS3FN429887 | DENV1 NS3AF180818 |
| DENV1 NS3FJ898399 | DENV1 NS3GQ868500 | DENV1 NS3EU482539 | DENV1 NS3AY726554 |
| DENV1 NS3GQ868609 | DENV1 NS3EU249493 | DENV1 NS3EU482804 | DENV1 NS3FJ898403 |
| DENV1 NS3EU726780 | DENV1 NS3EU081275 | DENV1 NS3FJ882520 | DENV1 NS3CS479203 |
| DENV1 NS3EU482805 | DENV1 NS3FJ432748 | DENV1 NS3FJ639689 | DENV1 NS3EU482517 |
| DENV1 NS3GU131784 | DENV1 NS3EU081228 | DENV1 NS3EU677140 | DENV1 NS3EU482609 |
| DENV1 NS3GU131827 | DENV1 NS3EU482810 | DENV1 NS3GQ199832 | DENV1 NS3FJ410266 |
| DENV1 NS3FJ410227 | DENV1 NS3GQ199852 | DENV1 NS3FJ639695 | DENV1 NS3EU482493 |
| DENV1 NS3GQ868505 | DENV1 NS3GU131923 | DENV1 NS3FJ410244 | DENV1 NS3FJ639674 |
| DENV1 NS3FN429884 | DENV1 NS3GQ199790 | DENV1 NS3FJ898397 | DENV1 NS3FJ639673 |
| DENV1 NS3FJ873809 | DENV1 NS3FJ024423 | DENV1 NS3GU131819 | DENV1 NS3AY732482 |
| DENV1 NS3EU081258 | DENV1 NS3FJ882555 | DENV1 NS3GU131823 | DENV1 NS3CS479204 |
| DENV1 NS3EU677173 | DENV1 NS3FJ898405 | DENV1 NS3FJ882543 | DENV1 NS3EU482819 |
| DENV1 NS3FJ898392 | DENV1 NS3GU131889 | DENV1 NS3GU131715 | DENV1 NS3FJ882570 |
| DENV1 NS3FJ024448 | DENV1 NS3GQ868499 | DENV1 NS3EU677156 | DENV1 NS3AF514885 |
| DENV1 NS3GQ868507 | DENV1 NS3EU482501 | DENV1 NS3FJ461317 | DENV1 NS3GU131802 |
| DENV1 NS3EU482531 | DENV1 NS3GU131775 | DENV1 NS3GU131794 | DENV1 NS3FJ687427 |

FIG. 66-85

| Virus Protein Accession No. | Virus Protein Accession No. | Virus Protein Accession No. | Virus Protein Accession No. |
|---|---|---|---|
| DENV1 NS3FJ182033 | DENV1 NS3GU131887 | DENV1 NS3FJ410205 | DENV1 NS3FJ687433 |
| DENV1 NS3GQ199800 | DENV1 NS3GU131741 | DENV1 NS3FJ478458 | DENV1 NS3FJ410277 |
| DENV1 NS3GU131702 | DENV1 NS3EU677178 | DENV1 NS3EU677158 | DENV1 NS3GQ868502 |
| DENV1 NS3FJ432723 | DENV1 NS3FJ898433 | DENV1 NS3EU482532 | DENV1 NS3FJ461310 |
| DENV1 NS3EU482505 | DENV1 NS3FJ024443 | DENV1 NS3FJ410242 | DENV1 NS3FJ898375 |
| DENV1 NS3FJ882532 | DENV1 NS3FJ461336 | DENV1 NS3EU482619 | DENV1 NS3AY858983 |
| DENV1 NS3AF514878 | DENV1 NS3GQ199858 | DENV1 NS3FJ410235 | DENV1 NS3GU131835 |
| DENV1 NS3FJ882540 | DENV1 NS3EU482820 | DENV1 NS3FJ898395 | DENV1 NS3FJ390386 |
| DENV1 NS3GU131703 | DENV1 NS3EU482478 | DENV1 NS3GU131949 | DENV1 NS3EU482518 |
| DENV1 NS3FJ410190 | DENV1 NS3GU131815 | DENV1 NS3AY732477 | DENV1 NS3FJ898414 |
| DENV1 NS3GQ868564 | DENV1 NS3GQ199834 | DENV1 NS3EU596503 | DENV1 NS3EU482717 |
| DENV1 NS3GU131717 | DENV1 NS3GU131743 | DENV1 NS3GQ199851 | DENV1 NS3DQ672557 |
| DENV1 NS3EU081273 | DENV1 NS3GQ868614 | DENV1 NS3GU131796 | DENV1 NS3GQ199877 |
| DENV1 NS3GQ199846 | DENV1 NS3EU482706 | DENV1 NS3EU081252 | DENV1 NS3GU131719 |
| DENV1 NS3AY732483 | DENV1 NS3AY376737 | DENV1 NS3GU131712 | DENV1 NS3EU482817 |
| DENV1 NS3CS477263 | DENV1 NS3FJ562101 | DENV1 NS3EU081249 | DENV1 NS3FJ410254 |
| DENV1 NS3EU482496 | DENV1 NS3FB667398 | DENV1 NS3GU131730 | DENV1 NS3EU482507 |
| DENV1 NS3FJ410265 | DENV1 NS3GU131808 | DENV1 NS3GQ199795 | DENV1 NS3FJ410274 |
| DENV1 NS3GU131720 | DENV1 NS3GU131780 | DENV1 NS3GQ199807 | DENV1 NS3FJ898387 |
| DENV1 NS3FJ461327 | DENV1 NS3FJ639671 | DENV1 NS3GU131817 | DENV1 NS3GQ868514 |
| DENV1 NS3GU370048 | DENV1 NS3FJ390379 | DENV1 NS3FJ024455 | DENV1 NS3GU131705 |
| DENV1 NS3FJ898409 | DENV1 NS3FJ024439 | DENV1 NS3GU131766 | DENV1 NS3FJ432738 |
| DENV1 NS3FJ182024 | DENV1 NS3AF350498 | DENV1 NS3GU056031 | DENV1 NS3FJ639681 |
| DENV1 NS3FJ882565 | DENV1 NS3FJ432747 | DENV1 NS3GU131786 | DENV1 NS3EU482513 |
| DENV1 NS3GU131966 | DENV1 NS3EU482795 | DENV1 NS3FJ410207 | DENV1 NS3EU081240 |
| DENV1 NS3EU249490 | DENV1 NS3FJ639678 | DENV1 NS3EU726781 | DENV1 NS4A |
| DENV1 NS3AF514876 | DENV1 NS3EU482617 | DENV1 NS3FJ182035 | FJ639670 |
| DENV1 NS3FN429885 | DENV1 NS3FJ410287 | DENV1 NS3FJ882545 | DENV1 NS4A |
| DENV1 NS3EU081272 | DENV1 NS3FJ024444 | DENV1 NS3FJ410222 | FJ024446 |
| DENV1 NS3GU131841 | DENV1 NS3EU482799 | DENV1 NS3EU660401 | DENV1 NS4A |
| DENV1 NS3GQ868570 | DENV1 NS3GU131750 | DENV1 NS3FJ639824 | GU131759 |
| DENV1 NS3GU131890 | DENV1 NS3FJ906963 | DENV1 NS3AY762084 | DENV1 NS4A |
| DENV1 NS3FJ882553 | DENV1 NS3FJ410185 | DENV1 NS3GQ868602 | FJ882560 |
| DENV1 NS3GU131821 | DENV1 NS3EU660412 | DENV1 NS3GQ868532 | DENV1 NS4A |
| DENV1 NS3GQ199771 | DENV1 NS3GU131779 | DENV1 NS3EF025110 | GU131838 |
| DENV1 NS3AB195673 | DENV1 NS3FJ639691 | DENV1 NS3GQ868528 | DENV1 NS4A |
| DENV1 NS3EU482812 | DENV1 NS3EU677165 | DENV1 NS3GU131694 | FJ024437 |
| DENV1 NS3AF298807 | DENV1 NS3GU131773 | DENV1 NS3EU482489 | DENV1 NS4A |
| DENV1 NS3GU131801 | DENV1 NS3FJ882517 | DENV1 NS3FJ850068 | GQ868639 |
| DENV1 NS3GU131983 | DENV1 NS3FJ410230 | DENV1 NS3FJ898400 | DENV1 NS4A |
| DENV1 NS3EF122232 | DENV1 NS3FJ410211 | DENV1 NS3GU131968 | FJ639806 |
| DENV1 NS3AB519681 | DENV1 NS3FJ850070 | DENV1 NS3GQ868615 | DENV1 NS4A |
| DENV1 NS3GQ199814 | DENV1 NS3FJ024460 | DENV1 NS3FJ882567 | GQ199837 |
| DENV1 NS3AY726552 | DENV1 NS3GQ868562 | DENV1 NS3DQ672558 | DENV1 NS4A |
| DENV1 NS3EU482484 | DENV1 NS3FJ882529 | DENV1 NS3EU677151 | AB189120 |
| DENV1 NS3AY722803 | DENV1 NS3FJ639687 | DENV1 NS3AB204803 | DENV1 NS4A |
| DENV1 NS3GU131787 | DENV1 NS3GU131684 | DENV1 NS3FJ182018 | EU081235 |
| DENV1 NS3FJ373296 | DENV1 NS3FJ205876 | DENV1 NS3EU482809 | |

FIG. 66-86

| Virus Protein Accession No. | Virus Protein Accession No. | Virus Protein Accession No. | Virus Protein Accession No. |
|---|---|---|---|
| DENV1 NS4A FJ410263 | DENV1 NS4A EU482498 | DENV1 NS4A FJ639808 | DENV1 NS4A GQ868525 |
| DENV1 NS4A AY713476 | DENV1 NS4A FJ882525 | DENV1 NS4A EU482526 | DENV1 NS4A FN429883 |
| DENV1 NS4A GQ199806 | DENV1 NS4A GU131731 | DENV1 NS4A AY732476 | DENV1 NS4A GQ199828 |
| DENV1 NS4A GU131693 | DENV1 NS4A GQ199794 | DENV1 NS4A GU131772 | DENV1 NS4A FJ182021 |
| DENV1 NS4A GU131753 | DENV1 NS4A GU131832 | DENV1 NS4A FJ882530 | DENV1 NS4A EU482824 |
| DENV1 NS4A GU131711 | DENV1 NS4A EU848545 | DENV1 NS4A GU131978 | DENV1 NS4A GU131956 |
| DENV1 NS4A FJ639812 | DENV1 NS4A GU131760 | DENV1 NS4A FJ547088 | DENV1 NS4A EU482797 |
| DENV1 NS4A GU131765 | DENV1 NS4A GU131965 | DENV1 NS4A FJ898374 | DENV1 NS4A FJ410213 |
| DENV1 NS4A FJ432744 | DENV1 NS4A FJ898415 | DENV1 NS4A GQ868504 | DENV1 NS4A FJ898384 |
| DENV1 NS4A GM059691 | DENV1 NS4A GU131782 | DENV1 NS4A FJ882550 | DENV1 NS4A FJ410186 |
| DENV1 NS4A FJ410278 | DENV1 NS4A GQ868535 | DENV1 NS4A FJ850113 | DENV1 NS4A GQ868538 |
| DENV1 NS4A EU081261 | DENV1 NS4A EU482524 | DENV1 NS4A GU131980 | DENV1 NS4A EU677163 |
| DENV1 NS4A EU482801 | DENV1 NS4A GU131726 | DENV1 NS4A GU131783 | DENV1 NS4A FJ432742 |
| DENV1 NS4A FJ882526 | DENV1 NS4A GQ868501 | DENV1 NS4A AY732474 | DENV1 NS4A FJ461303 |
| DENV1 NS4A FJ639823 | DENV1 NS4A FJ432734 | DENV1 NS4A GU131958 | DENV1 NS4A FJ639679 |
| DENV1 NS4A EU081260 | DENV1 NS4A FJ410253 | DENV1 NS4A FJ898393 | DENV1 NS4A FJ469909 |
| DENV1 NS4A GQ199786 | DENV1 NS4A FJ410281 | DENV1 NS4A EU677176 | DENV1 NS4A EU081227 |
| DENV1 NS4A AY726550 | DENV1 NS4A EU482708 | DENV1 NS4A FJ850104 | DENV1 NS4A EU482534 |
| DENV1 NS4A FJ882558 | DENV1 NS4A GQ199784 | DENV1 NS4A EU249492 | DENV1 NS4A FJ410261 |
| DENV1 NS4A GU131809 | DENV1 NS4A GQ868567 | DENV1 NS4A EU482712 | DENV1 NS4A FJ687428 |
| DENV1 NS4A FJ182030 | DENV1 NS4A EU280167 | DENV1 NS4A FJ410236 | DENV1 NS4A EU660392 |
| DENV1 NS4A EU482816 | DENV1 NS4A FJ850084 | DENV1 NS4A FJ410192 | DENV1 NS4A GQ199815 |
| DENV1 NS4A GU131813 | DENV1 NS4A EU482514 | DENV1 NS4A EU081281 | DENV1 NS4A EU482611 |
| DENV1 NS4A EU482808 | DENV1 NS4A AY722802 | DENV1 NS4A FJ432729 | DENV1 NS4A FJ639821 |

FIG. 66-87

| Virus Protein Accession No. | Virus Protein Accession No. | Virus Protein Accession No. | Virus Protein Accession No. |
|---|---|---|---|
| DENV1 NS4A FJ410174 | DENV1 NS4A AF311956 | DENV1 NS4A AY713474 | DENV1 NS4A FJ639676 |
| DENV1 NS4A GU131706 | DENV1 NS4A GU131770 | DENV1 NS4A GQ199789 | DENV1 NS4A FJ410272 |
| DENV1 NS4A AY373427 | DENV1 NS4A GU131824 | DENV1 NS4A GU131977 | DENV1 NS4A AY277665 |
| DENV1 NS4A EU249495 | DENV1 NS4A GQ199854 | DENV1 NS4A FJ850069 | DENV1 NS4A GQ199802 |
| DENV1 NS4A EU482477 | DENV1 NS4A FJ898410 | DENV1 NS4A EF457905 | DENV1 NS4A FJ882549 |
| DENV1 NS4A EU482826 | DENV1 NS4A FJ024472 | DENV1 NS4A FJ898421 | DENV1 NS4A FJ898391 |
| DENV1 NS4A GQ199843 | DENV1 NS4A EU081236 | DENV1 NS4A FJ744701 | DENV1 NS4A GQ199830 |
| DENV1 NS4A GQ199821 | DENV1 NS4A EU482480 | DENV1 NS4A GQ199788 | DENV1 NS4A DQ672562 |
| DENV1 NS4A GU131777 | DENV1 NS4A GU131795 | DENV1 NS4A EU726778 | DENV1 NS4A GU131757 |
| DENV1 NS4A FJ898378 | DENV1 NS4A FJ432736 | DENV1 NS4A EU081263 | DENV1 NS4A GQ199839 |
| DENV1 NS4A FJ461306 | DENV1 NS4A FJ024480 | DENV1 NS4A FJ205874 | DENV1 NS4A FJ898437 |
| DENV1 NS4A GU131707 | DENV1 NS4A EU081278 | DENV1 NS4A GU131826 | DENV1 NS4A EU081250 |
| DENV1 NS4A AF226686 | DENV1 NS4A FJ182019 | DENV1 NS4A FJ898407 | DENV1 NS4A GU131963 |
| DENV1 NS4A EU677152 | DENV1 NS4A GU131919 | DENV1 NS4A GQ199804 | DENV1 NS4A FJ410257 |
| DENV1 NS4A GU131828 | DENV1 NS4A GU131682 | DENV1 NS4A FJ024478 | DENV1 NS4A GU131798 |
| DENV1 NS4A GU131971 | DENV1 NS4A EU482714 | DENV1 NS4A FJ850102 | DENV1 NS4A GQ868508 |
| DENV1 NS4A GQ199826 | DENV1 NS4A FJ410197 | DENV1 NS4A FJ432721 | DENV1 NS4A EU482789 |
| DENV1 NS4A EU677168 | DENV1 NS4A GU131744 | DENV1 NS4A EU660418 | DENV1 NS4A U88536 |
| DENV1 NS4A FJ461313 | DENV1 NS4A FJ410183 | DENV1 NS4A EF032590 | DENV1 NS4A GU131807 |
| DENV1 NS4A EU081267 | DENV1 NS4A GQ199875 | DENV1 NS4A AY713473 | DENV1 NS4A GQ868533 |
| DENV1 NS4A FJ410175 | DENV1 NS4A GQ199845 | DENV1 NS4A GU131700 | DENV1 NS4A FJ898390 |
| DENV1 NS4A FJ182028 | DENV1 NS4A GU131689 | DENV1 NS4A GQ868523 | DENV1 NS4A EU081259 |
| DENV1 NS4A FJ882516 | DENV1 NS4A FJ461323 | DENV1 NS4A GQ868522 | DENV1 NS4A EU482806 |
| DENV1 NS4A FJ024456 | DENV1 NS4A FJ432740 | DENV1 NS4A EU660402 | DENV1 NS4A FJ373298 |

FIG. 66-88

| Virus Protein Accession No. | Virus Protein Accession No. | Virus Protein Accession No. | Virus Protein Accession No. |
|---|---|---|---|
| DENV1 NS4A FJ898382 | DENV1 NS4A GU131762 | DENV1 NS4A FN429890 | DENV1 NS4A FJ024451 |
| DENV1 NS4A FJ410250 | DENV1 NS4A FJ410238 | DENV1 NS4A EU482822 | DENV1 NS4A GU131739 |
| DENV1 NS4A FJ410226 | DENV1 NS4A DQ285558 | DENV1 NS4A GU131746 | DENV1 NS4A EU482482 |
| DENV1 NS4A GU131785 | DENV1 NS4A FJ898371 | DENV1 NS4A FJ390382 | DENV1 NS4A FJ024482 |
| DENV1 NS4A GU131842 | DENV1 NS4A FJ461308 | DENV1 NS4A GU131724 | DENV1 NS4A GU131698 |
| DENV1 NS4A GU131836 | DENV1 NS4A EU482711 | DENV1 NS4A EU677161 | DENV1 NS4A FJ024432 |
| DENV1 NS4A GQ199824 | DENV1 NS4A GQ868605 | DENV1 NS4A EU482536 | DENV1 NS4A FJ882556 |
| DENV1 NS4A EU482790 | DENV1 NS4A GQ868565 | DENV1 NS4A GU131713 | DENV1 NS4A GU131831 |
| DENV1 NS4A EU081257 | DENV1 NS4A GQ868608 | DENV1 NS4A GU131721 | DENV1 NS4A AY835999 |
| DENV1 NS4A FJ024449 | DENV1 NS4A FJ898417 | DENV1 NS4A EU660397 | DENV1 NS4A GU131922 |
| DENV1 NS4A FJ024430 | DENV1 NS4A FJ024426 | DENV1 NS4A FJ906965 | DENV1 NS4A FJ898376 |
| DENV1 NS4A EU482815 | DENV1 NS4A GQ868511 | DENV1 NS4A EU081280 | DENV1 NS4A FJ898425 |
| DENV1 NS4A FJ898398 | DENV1 NS4A FJ882562 | DENV1 NS4A FJ639692 | DENV1 NS4A FJ898419 |
| DENV1 NS4A EU482530 | DENV1 NS4A GU131752 | DENV1 NS4A EU249494 | DENV1 NS4A GQ199799 |
| DENV1 NS4A GQ868636 | DENV1 NS4A GQ199811 | DENV1 NS4A FJ639819 | DENV1 NS4A GU056029 |
| DENV1 NS4A FJ024459 | DENV1 NS4A GQ868518 | DENV1 NS4A EU482529 | DENV1 NS4A AY145122 |
| DENV1 NS4A GQ868610 | DENV1 NS4A FJ850075 | DENV1 NS4A EU482616 | DENV1 NS4A GU131811 |
| DENV1 NS4A EU081233 | DENV1 NS4A FJ850100 | DENV1 NS4A FJ410284 | DENV1 NS4A EU482495 |
| DENV1 NS4A FJ687426 | DENV1 NS4A GU131709 | DENV1 NS4A FJ410181 | DENV1 NS4A GQ868506 |
| DENV1 NS4A FJ898404 | DENV1 NS4A GQ199848 | DENV1 NS4A FJ461332 | DENV1 NS4A GU131961 |
| DENV1 NS4A EU081244 | DENV1 NS4A FJ024429 | DENV1 NS4A GQ199777 | DENV1 NS4A FJ410269 |
| DENV1 NS4A EU482522 | DENV1 NS4A FJ461315 | DENV1 NS4A EU081229 | DENV1 NS4A GQ199833 |
| DENV1 NS4A FJ205882 | DENV1 NS4A EU677154 | DENV1 NS4A FJ410270 | DENV1 NS4A EU081238 |
| DENV1 NS4A GU131788 | DENV1 NS4A GU056033 | DENV1 NS4A GQ199873 | DENV1 NS4A GU131748 |

FIG. 66-89

| Virus Protein | Accession No. | Virus Protein | Accession No. | Virus Protein | Accession No. | Virus Protein | Accession No. |
|---|---|---|---|---|---|---|---|
| DENV1 NS4A | FJ410248 | DENV1 NS4A | EU081239 | DENV1 NS4A | EU677174 | DENV1 NS4A | GQ868513 |
| DENV1 NS4A | GU131733 | DENV1 NS4A | EU081255 | DENV1 NS4A | FJ639680 | DENV1 NS4A | FJ639740 |
| DENV1 NS4A | FJ461325 | DENV1 NS4A | EU359008 | DENV1 NS4A | GQ199849 | DENV1 NS4A | FJ882533 |
| DENV1 NS4A | GQ199817 | DENV1 NS4A | FJ906964 | DENV1 NS4A | FJ882566 | DENV1 NS4A | GU131926 |
| DENV1 NS4A | GU131691 | DENV1 NS4A | EU482618 | DENV1 NS4A | FJ882541 | DENV1 NS4A | GU131734 |
| DENV1 NS4A | GU131804 | DENV1 NS4A | FJ410246 | DENV1 NS4A | FJ639802 | DENV1 NS4A | EU482519 |
| DENV1 NS4A | FJ562106 | DENV1 NS4A | GQ868534 | DENV1 NS4A | FJ432725 | DENV1 NS4A | AY206457 |
| DENV1 NS4A | FJ639682 | DENV1 NS4A | GQ199835 | DENV1 NS4A | FN429888 | DENV1 NS4A | GQ199818 |
| DENV1 NS4A | GU131792 | DENV1 NS4A | GU131716 | DENV1 NS4A | EU482492 | DENV1 NS4A | FJ850077 |
| DENV1 NS4A | FJ882522 | DENV1 NS4A | FJ410256 | DENV1 NS4A | FJ882557 | DENV1 NS4A | AY726553 |
| DENV1 NS4A | GU131742 | DENV1 NS4A | FJ898424 | DENV1 NS4A | FJ639669 | DENV1 NS4A | EU482718 |
| DENV1 NS4A | GU131761 | DENV1 NS4A | GU131687 | DENV1 NS4A | EU482792 | DENV1 NS4A | EU081274 |
| DENV1 NS4A | GQ868561 | DENV1 NS4A | EU482615 | DENV1 NS4A | FJ461340 | DENV1 NS4A | FJ182025 |
| DENV1 NS4A | FJ410245 | DENV1 NS4A | FJ410285 | DENV1 NS4A | GU131805 | DENV1 NS4A | GU131973 |
| DENV1 NS4A | GQ868520 | DENV1 NS4A | FJ898388 | DENV1 NS4A | FJ410264 | DENV1 NS4A | EU482811 |
| DENV1 NS4A | EU482707 | DENV1 NS4A | GQ868529 | DENV1 NS4A | EU482516 | DENV1 NS4A | FJ410210 |
| DENV1 NS4A | EU482520 | DENV1 NS4A | FJ882579 | DENV1 NS4A | FJ469907 | DENV1 NS4A | GU131925 |
| DENV1 NS4A | FJ882536 | DENV1 NS4A | FJ024442 | DENV1 NS4A | FJ898396 | DENV1 NS4A | FJ373297 |
| DENV1 NS4A | EU081248 | DENV1 NS4A | GQ868563 | DENV1 NS4A | EU677157 | DENV1 NS4A | FJ205875 |
| DENV1 NS4A | GQ868531 | DENV1 NS4A | FJ639743 | DENV1 NS4A | EU482510 | DENV1 NS4A | DQ193572 |
| DENV1 NS4A | EU482533 | DENV1 NS4A | FJ390378 | DENV1 NS4A | FJ182034 | DENV1 NS4A | U88535 |
| DENV1 NS4A | FJ898411 | DENV1 NS4A | GU131837 | DENV1 NS4A | FJ898377 | DENV1 NS4A | FJ882564 |
| DENV1 NS4A | GQ199796 | DENV1 NS4A | FJ432732 | DENV1 NS4A | EU660390 | DENV1 NS4A | GQ199774 |
| DENV1 NS4A | GU131818 | DENV1 NS4A | GU131840 | DENV1 NS4A | GU131718 | DENV1 NS4A | GQ199787 |

FIG. 66-90

| Virus Protein Accession No. | Virus Protein Accession No. | Virus Protein Accession No. | Virus Protein Accession No. |
|---|---|---|---|
| DENV1 NS4A FJ850099 | DENV1 NS4A FJ410196 | DENV1 NS4A EF122231 | DENV1 NS4A GU131685 |
| DENV1 NS4A FJ410267 | DENV1 NS4A FJ639690 | DENV1 NS4A GQ199810 | DENV1 NS4A GU131793 |
| DENV1 NS4A EU726777 | DENV1 NS4A FJ898383 | DENV1 NS4A FJ850081 | DENV1 NS4A FN429882 |
| DENV1 NS4A EU081241 | DENV1 NS4A GU131984 | DENV1 NS4A FJ024427 | DENV1 NS4A EU482509 |
| DENV1 NS4A FJ898381 | DENV1 NS4A GQ868498 | DENV1 NS4A GQ868637 | DENV1 NS4A FJ547086 |
| DENV1 NS4A CS477265 | DENV1 NS4A EU482487 | DENV1 NS4A FJ639796 | DENV1 NS4A FJ639694 |
| DENV1 NS4A GQ199780 | DENV1 NS4A FJ639818 | DENV1 NS4A EU677159 | DENV1 NS4A EU482491 |
| DENV1 NS4A FN429889 | DENV1 NS4A EU677166 | DENV1 NS4A FJ882519 | DENV1 NS4A GU131755 |
| DENV1 NS4A FJ024434 | DENV1 NS4A GU131758 | DENV1 NS4A GQ199825 | DENV1 NS4A FJ898430 |
| DENV1 NS4A FJ024483 | DENV1 NS4A GU131697 | DENV1 NS4A EU482525 | DENV1 NS4A FJ898428 |
| DENV1 NS4A EU482502 | DENV1 NS4A EU081247 | DENV1 NS4A EU482798 | DENV1 NS4A FJ639814 |
| DENV1 NS4A GU131962 | DENV1 NS4A AY376738 | DENV1 NS4A FJ182032 | DENV1 NS4A GU131763 |
| DENV1 NS4A FJ461339 | DENV1 NS4A GU131776 | DENV1 NS4A GU131769 | DENV1 NS4A FJ873814 |
| DENV1 NS4A EU482821 | DENV1 NS4A FJ390380 | DENV1 NS4A GQ199792 | DENV1 NS4A FJ850093 |
| DENV1 NS4A GU131891 | DENV1 NS4A FJ882547 | DENV1 NS4A GU131888 | DENV1 NS4A GU131728 |
| DENV1 NS4A EU660403 | DENV1 NS4A GQ868611 | DENV1 NS4A GU131704 | DENV1 NS4A FJ898372 |
| DENV1 NS4A FJ410275 | DENV1 NS4A FJ410231 | DENV1 NS4A GQ199850 | DENV1 NS4A EU677172 |
| DENV1 NS4A GQ868559 | DENV1 NS4A GU131680 | DENV1 NS4A GQ868526 | DENV1 NS4A FJ639794 |
| DENV1 NS4A AF298808 | DENV1 NS4A M87512 | DENV1 NS4A GU131695 | DENV1 NS4A GQ868527 |
| DENV1 NS4A FJ410218 | DENV1 NS4A FJ024440 | DENV1 NS4A FJ410243 | DENV1 NS4A FJ687430 |
| DENV1 NS4A GQ199775 | DENV1 NS4A GU131774 | DENV1 NS4A AF309641 | DENV1 NS4A FJ639672 |
| DENV1 NS4A FJ882552 | DENV1 NS4A DQ672560 | DENV1 NS4A FJ639686 | DENV1 NS4A FJ410189 |
| DENV1 NS4A FJ898402 | DENV1 NS4A GQ868512 | DENV1 NS4A FJ410255 | DENV1 NS4A FJ182023 |
| DENV1 NS4A GQ199859 | DENV1 NS4A FJ024463 | DENV1 NS4A EU482818 | DENV1 NS4A FJ410260 |

FIG. 66-91

| Virus Protein Accession No. | Virus Protein Accession No. | Virus Protein Accession No. | Virus Protein Accession No. |
|---|---|---|---|
| DENV1 NS4A EU081266 | DENV1 NS4A FJ898413 | DENV1 NS4A GU131893 | DENV1 NS4A GQ199782 |
| DENV1 NS4A GU131895 | DENV1 NS4A EU596504 | DENV1 NS4A EU687247 | DENV1 NS4A EU677150 |
| DENV1 NS4A GU131829 | DENV1 NS4A FJ410276 | DENV1 NS4A EU482813 | DENV1 NS4A EU482591 |
| DENV1 NS4A FJ410204 | DENV1 NS4A FJ898386 | DENV1 NS4A AY713475 | DENV1 NS4A GU131738 |
| DENV1 NS4A FJ410194 | DENV1 NS4A EU482506 | DENV1 NS4A FJ024438 | DENV1 NS4A FJ024485 |
| DENV1 NS4A FJ882528 | DENV1 NS4A GU131736 | DENV1 NS4A FJ882542 | DENV1 NS4A EU677177 |
| DENV1 NS4A FJ432730 | DENV1 NS4A GU131948 | DENV1 NS4A GU131982 | DENV1 NS4A GU131967 |
| DENV1 NS4A EU081230 | DENV1 NS4A GU131834 | DENV1 NS4A FJ461328 | DENV1 NS4A GU131814 |
| DENV1 NS4A FJ410206 | DENV1 NS4A EU482715 | DENV1 NS4A FJ687432 | DENV1 NS4A AJ968413 |
| DENV1 NS4A GU131969 | DENV1 NS4A EU482716 | DENV1 NS4A FJ410188 | DENV1 NS4A FJ024436 |
| DENV1 NS4A AY732478 | DENV1 NS4A FJ850087 | DENV1 NS4A GQ199813 | DENV1 NS4A FJ432746 |
| DENV1 NS4A FJ461330 | DENV1 NS4A AF514883 | DENV1 NS4A GQ199847 | DENV1 NS4A FJ850071 |
| DENV1 NS4A DQ672556 | DENV1 NS4A EU660395 | DENV1 NS4A FJ410212 | DENV1 NS4A EU081271 |
| DENV1 NS4A GU131976 | DENV1 NS4A FJ410262 | DENV1 NS4A FJ410232 | DENV1 NS4A AY708047 |
| DENV1 NS4A FJ410216 | DENV1 NS4A EU081243 | DENV1 NS4A EU482481 | DENV1 NS4A EU677169 |
| DENV1 NS4A GQ199801 | DENV1 NS4A CS477264 | DENV1 NS4A AY726551 | DENV1 NS4A FJ882535 |
| DENV1 NS4A FJ906728 | DENV1 NS4A FJ562104 | DENV1 NS4A FJ639811 | DENV1 NS4A FJ547087 |
| DENV1 NS4A GU131803 | DENV1 NS4A GQ199823 | DENV1 NS4A GU131800 | DENV1 NS4A EU677164 |
| DENV1 NS4A AY726555 | DENV1 NS4A FJ639741 | DENV1 NS4A FJ024425 | DENV1 NS4A GU131725 |
| DENV1 NS4A GQ199798 | DENV1 NS4A GU131690 | DENV1 NS4A EU482527 | DENV1 NS4A DQ285561 |
| DENV1 NS4A GU056030 | DENV1 NS4A EU482497 | DENV1 NS4A EU482500 | DENV1 NS4A GU131678 |
| DENV1 NS4A GU131816 | DENV1 NS4A GU370049 | DENV1 NS4A EU482828 | DENV1 NS4A GU131822 |
| DENV1 NS4A EU482512 | DENV1 NS4A GQ868632 | DENV1 NS4A FJ205873 | DENV1 NS4A EU482479 |
| DENV1 NS4A FJ882568 | DENV1 NS4A GQ868613 | DENV1 NS4A AY732481 | DENV1 NS4A FJ882518 |

FIG. 66-92

| Virus Protein Accession No. | Virus Protein Accession No. | Virus Protein Accession No. | Virus Protein Accession No. |
|---|---|---|---|
| DENV1 NS4A FJ639696 | DENV1 NS4A FJ461335 | DENV1 NS4A EU482827 | DENV1 NS4A GQ868618 |
| DENV1 NS4A GQ199857 | DENV1 NS4A FJ898408 | DENV1 NS4A FJ461316 | DENV1 NS4A GU131699 |
| DENV1 NS4A GQ199808 | DENV1 NS4A GQ199844 | DENV1 NS4A FJ882544 | DENV1 NS4A FJ182029 |
| DENV1 NS4A FJ432749 | DENV1 NS4A GU131970 | DENV1 NS4A GU131768 | DENV1 NS4A GQ199855 |
| DENV1 NS4A GU131771 | DENV1 NS4A EU482796 | DENV1 NS4A EU482567 | DENV1 NS4A FJ882539 |
| DENV1 NS4A GQ199772 | DENV1 NS4A EU596502 | DENV1 NS4A GU131957 | DENV1 NS4A FJ410180 |
| DENV1 NS4A FJ882538 | DENV1 NS4A GQ868607 | DENV1 NS4A DQ672559 | DENV1 NS4A GU131806 |
| DENV1 NS4A FJ410283 | DENV1 NS4A GQ868524 | DENV1 NS4A EU677153 | DENV1 NS4A DQ672564 |
| DENV1 NS4A FJ882521 | DENV1 NS4A GQ868517 | DENV1 NS4A AF226687 | DENV1 NS4A FJ410268 |
| DENV1 NS4A EU726779 | DENV1 NS4A EU081268 | DENV1 NS4A EU482825 | DENV1 NS4A GU131825 |
| DENV1 NS4A EU081253 | DENV1 NS4A GQ199827 | DENV1 NS4A FJ182022 | DENV1 NS4A FJ850101 |
| DENV1 NS4A FN429886 | DENV1 NS4A EU660394 | DENV1 NS4A EU482592 | DENV1 NS4A FJ182002 |
| DENV1 NS4A GQ868601 | DENV1 NS4A EU482610 | DENV1 NS4A EU482800 | DENV1 NS4A GU131683 |
| DENV1 NS4A FJ182003 | DENV1 NS4A EU179861 | DENV1 NS4A GU131745 | DENV1 NS4A FJ639685 |
| DENV1 NS4A FJ410286 | DENV1 NS4A AB074761 | DENV1 NS4A FJ410184 | DENV1 NS4A EU482535 |
| DENV1 NS4A FJ639684 | DENV1 NS4A GQ199829 | DENV1 NS4A GQ199778 | DENV1 NS4A FJ024433 |
| DENV1 NS4A EU482794 | DENV1 NS4A GU131863 | DENV1 NS4A FJ390383 | DENV1 NS4A FJ176780 |
| DENV1 NS4A AY722801 | DENV1 NS4A GU131892 | DENV1 NS4A FJ410203 | DENV1 NS4A FJ373305 |
| DENV1 NS4A FJ410199 | DENV1 NS4A GQ868530 | DENV1 NS4A EU482476 | DENV1 NS4A FJ410279 |
| DENV1 NS4A EU482485 | DENV1 NS4A FJ410173 | DENV1 NS4A AY145123 | DENV1 NS4A EU081279 |
| DENV1 NS4A EU482803 | DENV1 NS4A EU482814 | DENV1 NS4A EU081270 | DENV1 NS4A GU131756 |
| DENV1 NS4A GU131767 | DENV1 NS4A EU660393 | DENV1 NS4A GQ199872 | DENV1 NS4A FJ478457 |
| DENV1 NS4A AY726549 | DENV1 NS4A FJ639815 | DENV1 NS4A GQ199856 | DENV1 NS4A FJ024457 |
| DENV1 NS4A FJ176779 | DENV1 NS4A GU131979 | DENV1 NS4A EU482709 | DENV1 NS4A AB189121 |

FIG. 66-93

| Virus Protein Accession No. | Virus Protein Accession No. | Virus Protein Accession No. | Virus Protein Accession No. |
|---|---|---|---|
| DENV1 NS4A DQ285562 | DENV1 NS4A FJ882527 | DENV1 NS4A GU131960 | DENV1 NS4A FJ461318 |
| DENV1 NS4A FJ850103 | DENV1 NS4A GU131830 | DENV1 NS4A GU131820 | DENV1 NS4A FJ898418 |
| DENV1 NS4A EU482499 | DENV1 NS4A EU482791 | DENV1 NS4A EU677170 | DENV1 NS4A GQ199820 |
| DENV1 NS4A GQ199805 | DENV1 NS4A FJ898427 | DENV1 NS4A FJ882531 | DENV1 NS4A AF513110 |
| DENV1 NS4A GQ868568 | DENV1 NS4A FJ410234 | DENV1 NS4A AF514889 | DENV1 NS4A FJ410191 |
| DENV1 NS4A FJ547068 | DENV1 NS4A EU482494 | DENV1 NS4A EU863650 | DENV1 NS4A FJ024431 |
| DENV1 NS4A EU081234 | DENV1 NS4A FJ432720 | DENV1 NS4A FB667403 | DENV1 NS4A FJ898394 |
| DENV1 NS4A FJ432739 | DENV1 NS4A FJ639735 | DENV1 NS4A GU131714 | DENV1 NS4A FJ024445 |
| DENV1 NS4A GQ199816 | DENV1 NS4A FJ898406 | DENV1 NS4A FJ882569 | DENV1 NS4A EU081242 |
| DENV1 NS4A FJ898401 | DENV1 NS4A DQ672563 | DENV1 NS4A FJ410280 | DENV1 NS4A FJ461333 |
| DENV1 NS4A GU131812 | DENV1 NS4A GQ199793 | DENV1 NS4A FJ882548 | DENV1 NS4A GQ868509 |
| DENV1 NS4A EU660419 | DENV1 NS4A EU482807 | DENV1 NS4A FJ859029 | DENV1 NS4A FJ410209 |
| DENV1 NS4A GQ199831 | DENV1 NS4A GU131797 | DENV1 NS4A GU131781 | DENV1 NS4A GU131839 |
| DENV1 NS4A AY732475 | DENV1 NS4A FJ410258 | DENV1 NS4A FJ410252 | DENV1 NS4A FJ410251 |
| DENV1 NS4A EU249491 | DENV1 NS4A EU482802 | DENV1 NS4A EU081262 | DENV1 NS4A EU677175 |
| DENV1 NS4A GU131833 | DENV1 NS4A GQ868633 | DENV1 NS4A GQ199842 | DENV1 NS4A FJ639820 |
| DENV1 NS4A GQ199836 | DENV1 NS4A AB074760 | DENV1 NS4A EU726782 | DENV1 NS4A GQ199867 |
| DENV1 NS4A FJ410240 | DENV1 NS4A EU081256 | DENV1 NS4A GQ868537 | DENV1 NS4A FJ024428 |
| DENV1 NS4A FJ410225 | DENV1 NS4A FJ432735 | DENV1 NS4A GQ199797 | DENV1 NS4A EU482537 |
| DENV1 NS4A GU131732 | DENV1 NS4A GQ199781 | DENV1 NS4A FJ882515 | DENV1 NS4A GU131778 |
| DENV1 NS4A FJ639677 | DENV1 NS4A DQ285559 | DENV1 NS4A FJ024450 | DENV1 NS4A FJ024464 |
| DENV1 NS4A FJ810419 | DENV1 NS4A FJ182036 | DENV1 NS4A GU131723 | DENV1 NS4A GU131972 |
| DENV1 NS4A GU056032 | DENV1 NS4A FJ547089 | DENV1 NS4A GQ868503 | DENV1 NS4A GQ868606 |
| DENV1 NS4A FJ390374 | DENV1 NS4A FJ898416 | DENV1 NS4A FJ882551 | DENV1 NS4A GU131679 |

FIG. 66-94

| Virus Protein Accession No. | Virus Protein Accession No. | Virus Protein Accession No. | Virus Protein Accession No. |
|---|---|---|---|
| DENV1 NS4A GU131708 | DENV1 NS4A EU482483 | DENV1 NS4A FJ410182 | DENV1 NS4A FJ410239 |
| DENV1 NS4A EU687251 | DENV1 NS4A GQ199853 | DENV1 NS4A GQ199791 | DENV1 NS4A FJ882554 |
| DENV1 NS4A AF226685 | DENV1 NS4A GU131921 | DENV1 NS4A GQ868630 | DENV1 NS4A GU131747 |
| DENV1 NS4A FJ882561 | DENV1 NS4A FJ182031 | DENV1 NS4A EU482503 | DENV1 NS4A FJ024481 |
| DENV1 NS4A EU482488 | DENV1 NS4A FJ639683 | DENV1 NS4A FB730116 | DENV1 NS4A FJ639675 |
| DENV1 NS4A FJ410214 | DENV1 NS4A GU131740 | DENV1 NS4A FJ410198 | DENV1 NS4A GU131810 |
| DENV1 NS4A FJ687429 | DENV1 NS4A FJ562105 | DENV1 NS4A EU081276 | DENV1 NS4A FJ410249 |
| DENV1 NS4A FJ898379 | DENV1 NS4A FJ432745 | DENV1 NS4A FJ461324 | DENV1 NS4A DQ672561 |
| DENV1 NS4A GU131790 | DENV1 NS4A AY277664 | DENV1 NS4A AF311958 | DENV1 NS4A FJ810415 |
| DENV1 NS4A EU482540 | DENV1 NS4A FJ882559 | DENV1 NS4A FJ639813 | DENV1 NS4A GQ199785 |
| DENV1 NS4A GU131681 | DENV1 NS4A FJ024435 | DENV1 NS4A AF180817 | DENV1 NS4A FJ410220 |
| DENV1 NS4A EU081226 | DENV1 NS4A GQ199803 | DENV1 NS4A EU081277 | DENV1 NS4A EU482504 |
| DENV1 NS4A FJ182020 | DENV1 NS4A FJ461320 | DENV1 NS4A FJ898426 | DENV1 NS4A FJ205881 |
| DENV1 NS4A FJ882524 | DENV1 NS4A FJ850090 | DENV1 NS4A GU131729 | DENV1 NS4A EU081264 |
| DENV1 NS4A EU677139 | DENV1 NS4A EU482528 | DENV1 NS4A GQ868539 | DENV1 NS4A GU131688 |
| DENV1 NS4A GU131920 | DENV1 NS4A FJ898448 | DENV1 NS4A AY145121 | DENV1 NS4A A75711 |
| DENV1 NS4A GQ868536 | DENV1 NS4A FJ898420 | DENV1 NS4A EU677167 | DENV1 NS4A EU081254 |
| DENV1 NS4A GQ199776 | DENV1 NS4A GQ868519 | DENV1 NS4A FJ898422 | DENV1 NS4A FJ898429 |
| DENV1 NS4A FJ390381 | DENV1 NS4A FJ432727 | DENV1 NS4A FJ744702 | DENV1 NS4A FJ469908 |
| DENV1 NS4A GU131751 | DENV1 NS4A EU677155 | DENV1 NS4A GQ199838 | DENV1 NS4A GU131799 |
| DENV1 NS4A FJ390388 | DENV1 NS4A EU677162 | DENV1 NS4A GQ199779 | DENV1 NS4A FJ182027 |
| DENV1 NS4A EU482823 | DENV1 NS4A GU131692 | DENV1 NS4A FJ205883 | DENV1 NS4A FJ432737 |
| DENV1 NS4A FJ850073 | DENV1 NS4A EU596501 | DENV1 NS4A GQ868635 | DENV1 NS4A FJ410201 |
| DENV1 NS4A EU081237 | DENV1 NS4A FJ410273 | DENV1 NS4A DQ285560 | DENV1 NS4A GU131701 |

FIG. 66-95

| Virus Protein Accession No. | Virus Protein Accession No. | Virus Protein Accession No. | Virus Protein Accession No. |
|---|---|---|---|
| DENV1 NS4A EU081269 | DENV1 NS4A GQ868507 | DENV1 NS4A AF311957 | DENV1 NS4A EU482501 |
| DENV1 NS4A GQ199783 | DENV1 NS4A EU482531 | DENV1 NS4A FJ639693 | DENV1 NS4A GU131775 |
| DENV1 NS4A GU131754 | DENV1 NS4A GQ868510 | DENV1 NS4A GU131735 | DENV1 NS4A EU081246 |
| DENV1 NS4A EU081251 | DENV1 NS4A FJ410290 | DENV1 NS4A FJ850114 | DENV1 NS4A GQ199773 |
| DENV1 NS4A FJ432733 | DENV1 NS4A GU131981 | DENV1 NS4A FJ882563 | DENV1 NS4A FJ898431 |
| DENV1 NS4A FJ024447 | DENV1 NS4A EU660391 | DENV1 NS4A GQ199812 | DENV1 NS4A EU081231 |
| DENV1 NS4A FJ547063 | DENV1 NS4A EU482515 | DENV1 NS4A GU131737 | DENV1 NS4A EU482486 |
| DENV1 NS4A EU482523 | DENV1 NS4A EU081232 | DENV1 NS4A FJ547060 | DENV1 NS4A FJ410187 |
| DENV1 NS4A EU482793 | DENV1 NS4A GQ199840 | DENV1 NS4A GQ199819 | DENV1 NS4A FN429881 |
| DENV1 NS4A U88537 | DENV1 NS4A EU482710 | DENV1 NS4A FJ024484 | DENV1 NS4A GU131764 |
| DENV1 NS4A FJ898399 | DENV1 NS4A GQ868566 | DENV1 NS4A GQ868500 | DENV1 NS4A GQ868569 |
| DENV1 NS4A GQ868609 | DENV1 NS4A GU131964 | DENV1 NS4A EU249493 | DENV1 NS4A GQ868612 |
| DENV1 NS4A EU726780 | DENV1 NS4A EU482713 | DENV1 NS4A EU081275 | DENV1 NS4A FJ461331 |
| DENV1 NS4A EU482805 | DENV1 NS4A EU482538 | DENV1 NS4A FJ432748 | DENV1 NS4A FJ410282 |
| DENV1 NS4A GU131784 | DENV1 NS4A EU081245 | DENV1 NS4A EU081228 | DENV1 NS4A FJ205872 |
| DENV1 NS4A GU131827 | DENV1 NS4A GQ868619 | DENV1 NS4A EU482810 | DENV1 NS4A GQ199809 |
| DENV1 NS4A FJ410227 | DENV1 NS4A GU131789 | DENV1 NS4A GQ199852 | DENV1 NS4A GU131722 |
| DENV1 NS4A GQ868505 | DENV1 NS4A AB178040 | DENV1 NS4A GU131923 | DENV1 NS4A FJ873810 |
| DENV1 NS4A FN429884 | DENV1 NS4A AY732480 | DENV1 NS4A GQ199790 | DENV1 NS4A FJ882546 |
| DENV1 NS4A FJ873809 | DENV1 NS4A FJ898385 | DENV1 NS4A FJ024423 | DENV1 NS4A FJ639797 |
| DENV1 NS4A EU081258 | DENV1 NS4A FJ639688 | DENV1 NS4A FJ882555 | DENV1 NS4A EU677160 |
| DENV1 NS4A EU677173 | DENV1 NS4A FJ205884 | DENV1 NS4A FJ898405 | DENV1 NS4A FJ461312 |
| DENV1 NS4A FJ898392 | DENV1 NS4A FJ898380 | DENV1 NS4A GU131889 | DENV1 NS4A NC_001477 |
| DENV1 NS4A FJ024448 | DENV1 NS4A FJ182026 | DENV1 NS4A GQ868499 | DENV1 NS4A GQ199841 |

FIG. 66-96

| Virus Protein | Accession No. | Virus Protein | Accession No. | Virus Protein | Accession No. | Virus Protein | Accession No. |
|---|---|---|---|---|---|---|---|
| DENV1 NS4A | FJ882534 | DENV1 NS4A | FJ461317 | DENV1 NS4A | FJ687431 | DENV1 NS4A | GU131802 |
| DENV1 NS4A | FJ410289 | DENV1 NS4A | GU131794 | DENV1 NS4A | FJ882523 | DENV1 NS4A | FJ687427 |
| DENV1 NS4A | FJ410179 | DENV1 NS4A | FJ461341 | DENV1 NS4A | FJ547065 | DENV1 NS4A | FJ182033 |
| DENV1 NS4A | FJ432719 | DENV1 NS4A | EU482511 | DENV1 NS4A | GU131791 | DENV1 NS4A | GQ199800 |
| DENV1 NS4A | AY277666 | DENV1 NS4A | FJ024453 | DENV1 NS4A | GU131894 | DENV1 NS4A | GU131702 |
| DENV1 NS4A | GU131727 | DENV1 NS4A | GU131749 | DENV1 NS4A | EU482490 | DENV1 NS4A | FJ432723 |
| DENV1 NS4A | FJ024462 | DENV1 NS4A | FJ898389 | DENV1 NS4A | EU482521 | DENV1 NS4A | EU482505 |
| DENV1 NS4A | FJ024441 | DENV1 NS4A | GU131696 | DENV1 NS4A | FJ898423 | DENV1 NS4A | FJ882532 |
| DENV1 NS4A | GQ199822 | DENV1 NS4A | EU482508 | DENV1 NS4A | EU660396 | DENV1 NS4A | AF514878 |
| DENV1 NS4A | FN429887 | DENV1 NS4A | EU081265 | DENV1 NS4A | AF180818 | DENV1 NS4A | FJ882540 |
| DENV1 NS4A | EU482539 | DENV1 NS4A | FJ410247 | DENV1 NS4A | AY726554 | DENV1 NS4A | GU131703 |
| DENV1 NS4A | EU482804 | DENV1 NS4A | FJ461307 | DENV1 NS4A | FJ898403 | DENV1 NS4A | FJ410190 |
| DENV1 NS4A | FJ882520 | DENV1 NS4A | GQ868560 | DENV1 NS4A | CS479203 | DENV1 NS4A | GQ868564 |
| DENV1 NS4A | FJ639689 | DENV1 NS4A | FJ461319 | DENV1 NS4A | EU482517 | DENV1 NS4A | GU131717 |
| DENV1 NS4A | EU677140 | DENV1 NS4A | FJ898412 | DENV1 NS4A | EU482609 | DENV1 NS4A | EU081273 |
| DENV1 NS4A | GQ199832 | DENV1 NS4A | GQ868521 | DENV1 NS4A | FJ410266 | DENV1 NS4A | GQ199846 |
| DENV1 NS4A | FJ639695 | DENV1 NS4A | GU131686 | DENV1 NS4A | EU482493 | DENV1 NS4A | AY732483 |
| DENV1 NS4A | FJ410244 | DENV1 NS4A | AY732479 | DENV1 NS4A | FJ639674 | DENV1 NS4A | CS477263 |
| DENV1 NS4A | FJ898397 | DENV1 NS4A | FJ384655 | DENV1 NS4A | FJ639673 | DENV1 NS4A | EU482496 |
| DENV1 NS4A | GU131819 | DENV1 NS4A | FJ882537 | DENV1 NS4A | AY732482 | DENV1 NS4A | FJ410265 |
| DENV1 NS4A | GU131823 | DENV1 NS4A | FJ898373 | DENV1 NS4A | CS479204 | DENV1 NS4A | GU131720 |
| DENV1 NS4A | FJ882543 | DENV1 NS4A | GU131710 | DENV1 NS4A | EU482819 | DENV1 NS4A | FJ461327 |
| DENV1 NS4A | GU131715 | DENV1 NS4A | EU677171 | DENV1 NS4A | FJ882570 | DENV1 NS4A | GU370048 |
| DENV1 NS4A | EU677156 | DENV1 NS4A | FJ024479 | DENV1 NS4A | AF514885 | DENV1 NS4A | FJ898409 |

FIG. 66-97

| Virus Protein Accession No. | Virus Protein Accession No. | Virus Protein Accession No. | Virus Protein Accession No. |
|---|---|---|---|
| DENV1 NS4A FJ182024 | DENV1 NS4A GU131787 | DENV1 NS4A AF350498 | DENV1 NS4A GU131684 |
| DENV1 NS4A FJ882565 | DENV1 NS4A FJ373296 | DENV1 NS4A FJ432747 | DENV1 NS4A FJ205876 |
| DENV1 NS4A GU131966 | DENV1 NS4A GU131887 | DENV1 NS4A EU482795 | DENV1 NS4A FJ410205 |
| DENV1 NS4A EU249490 | DENV1 NS4A GU131741 | DENV1 NS4A FJ639678 | DENV1 NS4A FJ478458 |
| DENV1 NS4A AF514876 | DENV1 NS4A EU677178 | DENV1 NS4A EU482617 | DENV1 NS4A EU677158 |
| DENV1 NS4A FN429885 | DENV1 NS4A FJ898433 | DENV1 NS4A FJ410287 | DENV1 NS4A EU482532 |
| DENV1 NS4A EU081272 | DENV1 NS4A FJ024443 | DENV1 NS4A FJ024444 | DENV1 NS4A FJ410242 |
| DENV1 NS4A GU131841 | DENV1 NS4A FJ461336 | DENV1 NS4A EU482799 | DENV1 NS4A EU482619 |
| DENV1 NS4A GQ868570 | DENV1 NS4A GQ199858 | DENV1 NS4A GU131750 | DENV1 NS4A FJ410235 |
| DENV1 NS4A GU131890 | DENV1 NS4A EU482820 | DENV1 NS4A FJ906963 | DENV1 NS4A FJ898395 |
| DENV1 NS4A FJ882553 | DENV1 NS4A EU482478 | DENV1 NS4A FJ410185 | DENV1 NS4A GU131949 |
| DENV1 NS4A GU131821 | DENV1 NS4A GU131815 | DENV1 NS4A EU660412 | DENV1 NS4A AY732477 |
| DENV1 NS4A GQ199771 | DENV1 NS4A GQ199834 | DENV1 NS4A GU131779 | DENV1 NS4A EU596503 |
| DENV1 NS4A AB195673 | DENV1 NS4A GU131743 | DENV1 NS4A FJ639691 | DENV1 NS4A GQ199851 |
| DENV1 NS4A EU482812 | DENV1 NS4A GQ868614 | DENV1 NS4A EU677165 | DENV1 NS4A GU131796 |
| DENV1 NS4A AF298807 | DENV1 NS4A EU482706 | DENV1 NS4A GU131773 | DENV1 NS4A EU081252 |
| DENV1 NS4A GU131801 | DENV1 NS4A AY376737 | DENV1 NS4A FJ882517 | DENV1 NS4A GU131712 |
| DENV1 NS4A GU131983 | DENV1 NS4A FJ562101 | DENV1 NS4A FJ410230 | DENV1 NS4A EU081249 |
| DENV1 NS4A EF122232 | DENV1 NS4A FB667398 | DENV1 NS4A FJ410211 | DENV1 NS4A GU131730 |
| DENV1 NS4A AB519681 | DENV1 NS4A GU131808 | DENV1 NS4A FJ850070 | DENV1 NS4A GQ199795 |
| DENV1 NS4A GQ199814 | DENV1 NS4A GU131780 | DENV1 NS4A FJ024460 | DENV1 NS4A GQ199807 |
| DENV1 NS4A AY726552 | DENV1 NS4A FJ639671 | DENV1 NS4A GQ868562 | DENV1 NS4A GU131817 |
| DENV1 NS4A EU482484 | DENV1 NS4A FJ390379 | DENV1 NS4A FJ882529 | DENV1 NS4A FJ024455 |
| DENV1 NS4A AY722803 | DENV1 NS4A FJ024439 | DENV1 NS4A FJ639687 | DENV1 NS4A GU131766 |

FIG. 66-98

| Virus Protein Accession No. | Virus Protein Accession No. | Virus Protein Accession No. | Virus Protein Accession No. |
|---|---|---|---|
| DENV1 NS4A GU056031 | DENV1 NS4A FJ182018 | DENV1 NS4A FJ639681 | DENV1 NS4B FJ410278 |
| DENV1 NS4A GU131786 | DENV1 NS4A EU482809 | DENV1 NS4A EU482513 | DENV1 NS4B EU081261 |
| DENV1 NS4A FJ410207 | DENV1 NS4A FJ687433 | DENV1 NS4A EU081240 | DENV1 NS4B EU482801 |
| DENV1 NS4A EU726781 | DENV1 NS4A FJ410277 | DENV1 NS4B FJ639670 | DENV1 NS4B FJ882526 |
| DENV1 NS4A FJ182035 | DENV1 NS4A GQ868502 | DENV1 NS4B FJ024446 | DENV1 NS4B FJ639823 |
| DENV1 NS4A FJ882545 | DENV1 NS4A FJ461310 | DENV1 NS4B GU131759 | DENV1 NS4B EU081260 |
| DENV1 NS4A FJ410222 | DENV1 NS4A FJ898375 | DENV1 NS4B FJ882560 | DENV1 NS4B GQ199786 |
| DENV1 NS4A EU660401 | DENV1 NS4A AY858983 | DENV1 NS4B GU131838 | DENV1 NS4B AY726550 |
| DENV1 NS4A FJ639824 | DENV1 NS4A GU131835 | DENV1 NS4B FJ024437 | DENV1 NS4B FJ882558 |
| DENV1 NS4A AY762084 | DENV1 NS4A FJ390386 | DENV1 NS4B GQ868639 | DENV1 NS4B GU131809 |
| DENV1 NS4A GQ868602 | DENV1 NS4A EU482518 | DENV1 NS4B FJ639806 | DENV1 NS4B FJ182030 |
| DENV1 NS4A GQ868532 | DENV1 NS4A FJ898414 | DENV1 NS4B GQ199837 | DENV1 NS4B EU482816 |
| DENV1 NS4A EF025110 | DENV1 NS4A EU482717 | DENV1 NS4B AB189120 | DENV1 NS4B GU131813 |
| DENV1 NS4A GQ868528 | DENV1 NS4A DQ672557 | DENV1 NS4B EU081235 | DENV1 NS4B EU482808 |
| DENV1 NS4A GU131694 | DENV1 NS4A GQ199877 | DENV1 NS4B FJ410263 | DENV1 NS4B EU482498 |
| DENV1 NS4A EU482489 | DENV1 NS4A GU131719 | DENV1 NS4B AY713476 | DENV1 NS4B FJ882525 |
| DENV1 NS4A FJ850068 | DENV1 NS4A EU482817 | DENV1 NS4B GQ199806 | DENV1 NS4B GU131731 |
| DENV1 NS4A FJ898400 | DENV1 NS4A FJ410254 | DENV1 NS4B GU131693 | DENV1 NS4B GQ199794 |
| DENV1 NS4A GU131968 | DENV1 NS4A EU482507 | DENV1 NS4B GU131753 | DENV1 NS4B GU131832 |
| DENV1 NS4A GQ868615 | DENV1 NS4A FJ410274 | DENV1 NS4B GU131711 | DENV1 NS4B EU848545 |
| DENV1 NS4A FJ882567 | DENV1 NS4A FJ898387 | DENV1 NS4B FJ639812 | DENV1 NS4B GU131760 |
| DENV1 NS4A DQ672558 | DENV1 NS4A GQ868514 | DENV1 NS4B GU131765 | DENV1 NS4B GU131965 |
| DENV1 NS4A EU677151 | DENV1 NS4A GU131705 | DENV1 NS4B FJ432744 | DENV1 NS4B FJ898415 |
| DENV1 NS4A AB204803 | DENV1 NS4A FJ432738 | DENV1 NS4B GM059691 | DENV1 NS4B GU131782 |

FIG. 66-99

| Virus Protein Accession No. | Virus Protein Accession No. | Virus Protein Accession No. | Virus Protein Accession No. |
|---|---|---|---|
| DENV1 NS4B GQ868535 | DENV1 NS4B FJ850113 | DENV1 NS4B GQ868538 | DENV1 NS4B FJ461306 |
| DENV1 NS4B EU482524 | DENV1 NS4B GU131980 | DENV1 NS4B EU677163 | DENV1 NS4B GU131707 |
| DENV1 NS4B GU131726 | DENV1 NS4B GU131783 | DENV1 NS4B FJ432742 | DENV1 NS4B AF226686 |
| DENV1 NS4B GQ868501 | DENV1 NS4B AY732474 | DENV1 NS4B FJ461303 | DENV1 NS4B EU677152 |
| DENV1 NS4B FJ432734 | DENV1 NS4B GU131958 | DENV1 NS4B FJ639679 | DENV1 NS4B GU131828 |
| DENV1 NS4B FJ410253 | DENV1 NS4B FJ898393 | DENV1 NS4B FJ469909 | DENV1 NS4B GU131971 |
| DENV1 NS4B FJ410281 | DENV1 NS4B EU677176 | DENV1 NS4B EU081227 | DENV1 NS4B GQ199826 |
| DENV1 NS4B EU482708 | DENV1 NS4B FJ850104 | DENV1 NS4B EU482534 | DENV1 NS4B EU677168 |
| DENV1 NS4B GQ199784 | DENV1 NS4B EU249492 | DENV1 NS4B FJ410261 | DENV1 NS4B FJ461313 |
| DENV1 NS4B GQ868567 | DENV1 NS4B EU482712 | DENV1 NS4B FJ687428 | DENV1 NS4B EU081267 |
| DENV1 NS4B EU280167 | DENV1 NS4B FJ410236 | DENV1 NS4B EU660392 | DENV1 NS4B FJ410175 |
| DENV1 NS4B FJ850084 | DENV1 NS4B FJ410192 | DENV1 NS4B GQ199815 | DENV1 NS4B FJ182028 |
| DENV1 NS4B EU482514 | DENV1 NS4B EU081281 | DENV1 NS4B EU482611 | DENV1 NS4B FJ882516 |
| DENV1 NS4B AY722802 | DENV1 NS4B FJ432729 | DENV1 NS4B FJ639821 | DENV1 NS4B FJ024456 |
| DENV1 NS4B FJ639808 | DENV1 NS4B GQ868525 | DENV1 NS4B FJ410174 | DENV1 NS4B AF311956 |
| DENV1 NS4B EU482526 | DENV1 NS4B FN429883 | DENV1 NS4B GU131706 | DENV1 NS4B GU131770 |
| DENV1 NS4B AY732476 | DENV1 NS4B GQ199828 | DENV1 NS4B AY373427 | DENV1 NS4B GU131824 |
| DENV1 NS4B GU131772 | DENV1 NS4B FJ182021 | DENV1 NS4B EU249495 | DENV1 NS4B GQ199854 |
| DENV1 NS4B FJ882530 | DENV1 NS4B EU482824 | DENV1 NS4B EU482477 | DENV1 NS4B FJ898410 |
| DENV1 NS4B GU131978 | DENV1 NS4B GU131956 | DENV1 NS4B EU482826 | DENV1 NS4B FJ024472 |
| DENV1 NS4B FJ547088 | DENV1 NS4B EU482797 | DENV1 NS4B GQ199843 | DENV1 NS4B EU081236 |
| DENV1 NS4B FJ898374 | DENV1 NS4B FJ410213 | DENV1 NS4B GQ199821 | DENV1 NS4B EU482480 |
| DENV1 NS4B GQ868504 | DENV1 NS4B FJ898384 | DENV1 NS4B GU131777 | DENV1 NS4B GU131795 |
| DENV1 NS4B FJ882550 | DENV1 NS4B FJ410186 | DENV1 NS4B FJ898378 | DENV1 NS4B FJ432736 |

FIG. 66-100

| Virus Protein | Accession No. | Virus Protein | Accession No. | Virus Protein | Accession No. | Virus Protein | Accession No. |
|---|---|---|---|---|---|---|---|
| DENV1 NS4B | FJ024480 | DENV1 NS4B | FJ205874 | DENV1 NS4B | FJ898437 | DENV1 NS4B | FJ024430 |
| DENV1 NS4B | EU081278 | DENV1 NS4B | GU131826 | DENV1 NS4B | EU081250 | DENV1 NS4B | EU482815 |
| DENV1 NS4B | FJ182019 | DENV1 NS4B | FJ898407 | DENV1 NS4B | GU131963 | DENV1 NS4B | FJ898398 |
| DENV1 NS4B | GU131919 | DENV1 NS4B | GQ199804 | DENV1 NS4B | FJ410257 | DENV1 NS4B | EU482530 |
| DENV1 NS4B | GU131682 | DENV1 NS4B | FJ024478 | DENV1 NS4B | GU131798 | DENV1 NS4B | GQ868636 |
| DENV1 NS4B | EU482714 | DENV1 NS4B | FJ850102 | DENV1 NS4B | GQ868508 | DENV1 NS4B | FJ024459 |
| DENV1 NS4B | FJ410197 | DENV1 NS4B | FJ432721 | DENV1 NS4B | EU482789 | DENV1 NS4B | GQ868610 |
| DENV1 NS4B | GU131744 | DENV1 NS4B | EU660418 | DENV1 NS4B | U88536 | DENV1 NS4B | EU081233 |
| DENV1 NS4B | FJ410183 | DENV1 NS4B | EF032590 | DENV1 NS4B | GU131807 | DENV1 NS4B | FJ687426 |
| DENV1 NS4B | GQ199875 | DENV1 NS4B | AY713473 | DENV1 NS4B | GQ868533 | DENV1 NS4B | FJ898404 |
| DENV1 NS4B | GQ199845 | DENV1 NS4B | GU131700 | DENV1 NS4B | FJ898390 | DENV1 NS4B | EU081244 |
| DENV1 NS4B | GU131689 | DENV1 NS4B | GQ868523 | DENV1 NS4B | EU081259 | DENV1 NS4B | EU482522 |
| DENV1 NS4B | FJ461323 | DENV1 NS4B | GQ868522 | DENV1 NS4B | EU482806 | DENV1 NS4B | FJ205882 |
| DENV1 NS4B | FJ432740 | DENV1 NS4B | EU660402 | DENV1 NS4B | FJ373298 | DENV1 NS4B | GU131788 |
| DENV1 NS4B | AY713474 | DENV1 NS4B | FJ639676 | DENV1 NS4B | FJ898382 | DENV1 NS4B | GU131762 |
| DENV1 NS4B | GQ199789 | DENV1 NS4B | FJ410272 | DENV1 NS4B | FJ410250 | DENV1 NS4B | FJ410238 |
| DENV1 NS4B | GU131977 | DENV1 NS4B | AY277665 | DENV1 NS4B | FJ410226 | DENV1 NS4B | DQ285558 |
| DENV1 NS4B | FJ850069 | DENV1 NS4B | GQ199802 | DENV1 NS4B | GU131785 | DENV1 NS4B | FJ898371 |
| DENV1 NS4B | EF457905 | DENV1 NS4B | FJ882549 | DENV1 NS4B | GU131842 | DENV1 NS4B | FJ461308 |
| DENV1 NS4B | FJ898421 | DENV1 NS4B | FJ898391 | DENV1 NS4B | GU131836 | DENV1 NS4B | EU482711 |
| DENV1 NS4B | FJ744701 | DENV1 NS4B | GQ199830 | DENV1 NS4B | GQ199824 | DENV1 NS4B | GQ868605 |
| DENV1 NS4B | GQ199788 | DENV1 NS4B | DQ672562 | DENV1 NS4B | EU482790 | DENV1 NS4B | GQ868565 |
| DENV1 NS4B | EU726778 | DENV1 NS4B | GU131757 | DENV1 NS4B | EU081257 | DENV1 NS4B | GQ868608 |
| DENV1 NS4B | EU081263 | DENV1 NS4B | GQ199839 | DENV1 NS4B | FJ024449 | DENV1 NS4B | FJ898417 |

FIG. 66-101

| Virus Protein Accession No. | Virus Protein Accession No. | Virus Protein Accession No. | Virus Protein Accession No. |
|---|---|---|---|
| DENV1 NS4B FJ024426 | DENV1 NS4B FJ906965 | DENV1 NS4B FJ898376 | DENV1 NS4B GU131742 |
| DENV1 NS4B GQ868511 | DENV1 NS4B EU081280 | DENV1 NS4B FJ898425 | DENV1 NS4B GU131761 |
| DENV1 NS4B FJ882562 | DENV1 NS4B FJ639692 | DENV1 NS4B FJ898419 | DENV1 NS4B GQ868561 |
| DENV1 NS4B GU131752 | DENV1 NS4B EU249494 | DENV1 NS4B GQ199799 | DENV1 NS4B FJ410245 |
| DENV1 NS4B GQ199811 | DENV1 NS4B FJ639819 | DENV1 NS4B GU056029 | DENV1 NS4B GQ868520 |
| DENV1 NS4B GQ868518 | DENV1 NS4B EU482529 | DENV1 NS4B AY145122 | DENV1 NS4B EU482707 |
| DENV1 NS4B FJ850075 | DENV1 NS4B EU482616 | DENV1 NS4B GU131811 | DENV1 NS4B EU482520 |
| DENV1 NS4B FJ850100 | DENV1 NS4B FJ410284 | DENV1 NS4B EU482495 | DENV1 NS4B FJ882536 |
| DENV1 NS4B GU131709 | DENV1 NS4B FJ410181 | DENV1 NS4B GQ868506 | DENV1 NS4B EU081248 |
| DENV1 NS4B GQ199848 | DENV1 NS4B FJ461332 | DENV1 NS4B GU131961 | DENV1 NS4B GQ868531 |
| DENV1 NS4B FJ024429 | DENV1 NS4B GQ199777 | DENV1 NS4B FJ410269 | DENV1 NS4B EU482533 |
| DENV1 NS4B FJ461315 | DENV1 NS4B EU081229 | DENV1 NS4B GQ199833 | DENV1 NS4B FJ898411 |
| DENV1 NS4B EU677154 | DENV1 NS4B FJ410270 | DENV1 NS4B EU081238 | DENV1 NS4B GQ199796 |
| DENV1 NS4B GU056033 | DENV1 NS4B GQ199873 | DENV1 NS4B GU131748 | DENV1 NS4B GU131818 |
| DENV1 NS4B FN429890 | DENV1 NS4B FJ024451 | DENV1 NS4B FJ410248 | DENV1 NS4B EU081239 |
| DENV1 NS4B EU482822 | DENV1 NS4B GU131739 | DENV1 NS4B GU131733 | DENV1 NS4B EU081255 |
| DENV1 NS4B GU131746 | DENV1 NS4B EU482482 | DENV1 NS4B FJ461325 | DENV1 NS4B EU359008 |
| DENV1 NS4B FJ390382 | DENV1 NS4B FJ024482 | DENV1 NS4B GQ199817 | DENV1 NS4B FJ906964 |
| DENV1 NS4B GU131724 | DENV1 NS4B GU131698 | DENV1 NS4B GU131691 | DENV1 NS4B EU482618 |
| DENV1 NS4B EU677161 | DENV1 NS4B FJ024432 | DENV1 NS4B GU131804 | DENV1 NS4B FJ410246 |
| DENV1 NS4B EU482536 | DENV1 NS4B FJ882556 | DENV1 NS4B FJ562106 | DENV1 NS4B GQ868534 |
| DENV1 NS4B GU131713 | DENV1 NS4B GU131831 | DENV1 NS4B FJ639682 | DENV1 NS4B GQ199835 |
| DENV1 NS4B GU131721 | DENV1 NS4B AY835999 | DENV1 NS4B GU131792 | DENV1 NS4B GU131716 |
| DENV1 NS4B EU660397 | DENV1 NS4B GU131922 | DENV1 NS4B FJ882522 | DENV1 NS4B FJ410256 |

FIG. 66-102

| Virus Protein | Accession No. | Virus Protein | Accession No. | Virus Protein | Accession No. | Virus Protein | Accession No. |
|---|---|---|---|---|---|---|---|
| DENV1 NS4B | FJ898424 | DENV1 NS4B | FJ639669 | DENV1 NS4B | EU482718 | DENV1 NS4B | EU482502 |
| DENV1 NS4B | GU131687 | DENV1 NS4B | EU482792 | DENV1 NS4B | EU081274 | DENV1 NS4B | GU131962 |
| DENV1 NS4B | EU482615 | DENV1 NS4B | FJ461340 | DENV1 NS4B | FJ182025 | DENV1 NS4B | FJ461339 |
| DENV1 NS4B | FJ410285 | DENV1 NS4B | GU131805 | DENV1 NS4B | GU131973 | DENV1 NS4B | EU482821 |
| DENV1 NS4B | FJ898388 | DENV1 NS4B | FJ410264 | DENV1 NS4B | EU482811 | DENV1 NS4B | GU131891 |
| DENV1 NS4B | GQ868529 | DENV1 NS4B | EU482516 | DENV1 NS4B | FJ410210 | DENV1 NS4B | EU660403 |
| DENV1 NS4B | FJ882579 | DENV1 NS4B | FJ469907 | DENV1 NS4B | GU131925 | DENV1 NS4B | FJ410275 |
| DENV1 NS4B | FJ024442 | DENV1 NS4B | FJ898396 | DENV1 NS4B | FJ373297 | DENV1 NS4B | GQ868559 |
| DENV1 NS4B | GQ868563 | DENV1 NS4B | EU677157 | DENV1 NS4B | FJ205875 | DENV1 NS4B | AF298808 |
| DENV1 NS4B | FJ639743 | DENV1 NS4B | EU482510 | DENV1 NS4B | DQ193572 | DENV1 NS4B | FJ410218 |
| DENV1 NS4B | FJ390378 | DENV1 NS4B | FJ182034 | DENV1 NS4B | U88535 | DENV1 NS4B | GQ199775 |
| DENV1 NS4B | GU131837 | DENV1 NS4B | FJ898377 | DENV1 NS4B | FJ882564 | DENV1 NS4B | FJ882552 |
| DENV1 NS4B | FJ432732 | DENV1 NS4B | EU660390 | DENV1 NS4B | GQ199774 | DENV1 NS4B | FJ898402 |
| DENV1 NS4B | GU131840 | DENV1 NS4B | GU131718 | DENV1 NS4B | GQ199787 | DENV1 NS4B | GQ199859 |
| DENV1 NS4B | EU677174 | DENV1 NS4B | GQ868513 | DENV1 NS4B | FJ850099 | DENV1 NS4B | FJ410196 |
| DENV1 NS4B | FJ639680 | DENV1 NS4B | FJ639740 | DENV1 NS4B | FJ410267 | DENV1 NS4B | FJ639690 |
| DENV1 NS4B | GQ199849 | DENV1 NS4B | FJ882533 | DENV1 NS4B | EU726777 | DENV1 NS4B | FJ898383 |
| DENV1 NS4B | FJ882566 | DENV1 NS4B | GU131926 | DENV1 NS4B | EU081241 | DENV1 NS4B | GU131984 |
| DENV1 NS4B | FJ882541 | DENV1 NS4B | GU131734 | DENV1 NS4B | FJ898381 | DENV1 NS4B | GQ868498 |
| DENV1 NS4B | FJ639802 | DENV1 NS4B | EU482519 | DENV1 NS4B | CS477265 | DENV1 NS4B | EU482487 |
| DENV1 NS4B | FJ432725 | DENV1 NS4B | AY206457 | DENV1 NS4B | GQ199780 | DENV1 NS4B | FJ639818 |
| DENV1 NS4B | FN429888 | DENV1 NS4B | GQ199818 | DENV1 NS4B | FN429889 | DENV1 NS4B | EU677166 |
| DENV1 NS4B | EU482492 | DENV1 NS4B | FJ850077 | DENV1 NS4B | FJ024434 | DENV1 NS4B | GU131758 |
| DENV1 NS4B | FJ882557 | DENV1 NS4B | AY726553 | DENV1 NS4B | FJ024483 | DENV1 NS4B | GU131697 |

FIG. 66-103

| Virus Protein Accession No. | Virus Protein Accession No. | Virus Protein Accession No. | Virus Protein Accession No. |
|---|---|---|---|
| DENV1 NS4B EU081247 | DENV1 NS4B EU482798 | DENV1 NS4B FJ639814 | DENV1 NS4B AY732478 |
| DENV1 NS4B AY376738 | DENV1 NS4B FJ182032 | DENV1 NS4B GU131763 | DENV1 NS4B FJ461330 |
| DENV1 NS4B GU131776 | DENV1 NS4B GU131769 | DENV1 NS4B FJ873814 | DENV1 NS4B DQ672556 |
| DENV1 NS4B FJ390380 | DENV1 NS4B GQ199792 | DENV1 NS4B FJ850093 | DENV1 NS4B GU131976 |
| DENV1 NS4B FJ882547 | DENV1 NS4B GU131888 | DENV1 NS4B GU131728 | DENV1 NS4B FJ410216 |
| DENV1 NS4B GQ868611 | DENV1 NS4B GU131704 | DENV1 NS4B FJ898372 | DENV1 NS4B GQ199801 |
| DENV1 NS4B FJ410231 | DENV1 NS4B GQ199850 | DENV1 NS4B EU677172 | DENV1 NS4B FJ906728 |
| DENV1 NS4B GU131680 | DENV1 NS4B GQ868526 | DENV1 NS4B FJ639794 | DENV1 NS4B GU131803 |
| DENV1 NS4B M87512 | DENV1 NS4B GU131695 | DENV1 NS4B GQ868527 | DENV1 NS4B AY726555 |
| DENV1 NS4B FJ024440 | DENV1 NS4B FJ410243 | DENV1 NS4B FJ687430 | DENV1 NS4B GQ199798 |
| DENV1 NS4B GU131774 | DENV1 NS4B AF309641 | DENV1 NS4B FJ639672 | DENV1 NS4B GU056030 |
| DENV1 NS4B DQ672560 | DENV1 NS4B FJ639686 | DENV1 NS4B FJ410189 | DENV1 NS4B GU131816 |
| DENV1 NS4B GQ868512 | DENV1 NS4B FJ410255 | DENV1 NS4B FJ182023 | DENV1 NS4B EU482512 |
| DENV1 NS4B FJ024463 | DENV1 NS4B EU482818 | DENV1 NS4B FJ410260 | DENV1 NS4B FJ882568 |
| DENV1 NS4B EF122231 | DENV1 NS4B GU131685 | DENV1 NS4B EU081266 | DENV1 NS4B FJ898413 |
| DENV1 NS4B GQ199810 | DENV1 NS4B GU131793 | DENV1 NS4B GU131895 | DENV1 NS4B EU596504 |
| DENV1 NS4B FJ850081 | DENV1 NS4B FN429882 | DENV1 NS4B GU131829 | DENV1 NS4B FJ410276 |
| DENV1 NS4B FJ024427 | DENV1 NS4B EU482509 | DENV1 NS4B FJ410204 | DENV1 NS4B FJ898386 |
| DENV1 NS4B GQ868637 | DENV1 NS4B FJ547086 | DENV1 NS4B FJ410194 | DENV1 NS4B EU482506 |
| DENV1 NS4B FJ639796 | DENV1 NS4B FJ639694 | DENV1 NS4B FJ882528 | DENV1 NS4B GU131736 |
| DENV1 NS4B EU677159 | DENV1 NS4B EU482491 | DENV1 NS4B FJ432730 | DENV1 NS4B GU131948 |
| DENV1 NS4B FJ882519 | DENV1 NS4B GU131755 | DENV1 NS4B EU081230 | DENV1 NS4B GU131834 |
| DENV1 NS4B GQ199825 | DENV1 NS4B FJ898430 | DENV1 NS4B FJ410206 | DENV1 NS4B EU482715 |
| DENV1 NS4B EU482525 | DENV1 NS4B FJ898428 | DENV1 NS4B GU131969 | DENV1 NS4B EU482716 |

FIG. 66-104

| Virus Protein Accession No. | Virus Protein Accession No. | Virus Protein Accession No. | Virus Protein Accession No. |
|---|---|---|---|
| DENV1 NS4B FJ850087 | DENV1 NS4B GQ199813 | DENV1 NS4B FJ432746 | DENV1 NS4B EU081253 |
| DENV1 NS4B AF514883 | DENV1 NS4B GQ199847 | DENV1 NS4B FJ850071 | DENV1 NS4B FN429886 |
| DENV1 NS4B EU660395 | DENV1 NS4B FJ410212 | DENV1 NS4B EU081271 | DENV1 NS4B GQ868601 |
| DENV1 NS4B FJ410262 | DENV1 NS4B FJ410232 | DENV1 NS4B AY708047 | DENV1 NS4B FJ182003 |
| DENV1 NS4B EU081243 | DENV1 NS4B EU482481 | DENV1 NS4B EU677169 | DENV1 NS4B FJ410286 |
| DENV1 NS4B CS477264 | DENV1 NS4B AY726551 | DENV1 NS4B FJ882535 | DENV1 NS4B FJ639684 |
| DENV1 NS4B FJ562104 | DENV1 NS4B FJ639811 | DENV1 NS4B FJ547087 | DENV1 NS4B EU482794 |
| DENV1 NS4B GQ199823 | DENV1 NS4B GU131800 | DENV1 NS4B EU677164 | DENV1 NS4B AY722801 |
| DENV1 NS4B FJ639741 | DENV1 NS4B FJ024425 | DENV1 NS4B GU131725 | DENV1 NS4B FJ410199 |
| DENV1 NS4B GU131690 | DENV1 NS4B EU482527 | DENV1 NS4B DQ285561 | DENV1 NS4B EU482485 |
| DENV1 NS4B EU482497 | DENV1 NS4B EU482500 | DENV1 NS4B GU131678 | DENV1 NS4B EU482803 |
| DENV1 NS4B GU370049 | DENV1 NS4B EU482828 | DENV1 NS4B GU131822 | DENV1 NS4B GU131767 |
| DENV1 NS4B GQ868632 | DENV1 NS4B FJ205873 | DENV1 NS4B EU482479 | DENV1 NS4B AY726549 |
| DENV1 NS4B GQ868613 | DENV1 NS4B AY732481 | DENV1 NS4B FJ882518 | DENV1 NS4B FJ176779 |
| DENV1 NS4B GU131893 | DENV1 NS4B GQ199782 | DENV1 NS4B FJ639696 | DENV1 NS4B FJ461335 |
| DENV1 NS4B EU687247 | DENV1 NS4B EU677150 | DENV1 NS4B GQ199857 | DENV1 NS4B FJ898408 |
| DENV1 NS4B EU482813 | DENV1 NS4B EU482591 | DENV1 NS4B GQ199808 | DENV1 NS4B GQ199844 |
| DENV1 NS4B AY713475 | DENV1 NS4B GU131738 | DENV1 NS4B FJ432749 | DENV1 NS4B GU131970 |
| DENV1 NS4B FJ024438 | DENV1 NS4B FJ024485 | DENV1 NS4B GU131771 | DENV1 NS4B EU482796 |
| DENV1 NS4B FJ882542 | DENV1 NS4B EU677177 | DENV1 NS4B GQ199772 | DENV1 NS4B EU596502 |
| DENV1 NS4B GU131982 | DENV1 NS4B GU131967 | DENV1 NS4B FJ882538 | DENV1 NS4B GQ868607 |
| DENV1 NS4B FJ461328 | DENV1 NS4B GU131814 | DENV1 NS4B FJ410283 | DENV1 NS4B GQ868524 |
| DENV1 NS4B FJ687432 | DENV1 NS4B AJ968413 | DENV1 NS4B FJ882521 | DENV1 NS4B GQ868517 |
| DENV1 NS4B FJ410188 | DENV1 NS4B FJ024436 | DENV1 NS4B EU726779 | DENV1 NS4B EU081268 |

FIG. 66-105

| Virus Protein | Accession No. | Virus Protein | Accession No. | Virus Protein | Accession No. | Virus Protein | Accession No. |
|---|---|---|---|---|---|---|---|
| DENV1 NS4B | GQ199827 | DENV1 NS4B | FJ182022 | DENV1 NS4B | FJ850101 | DENV1 NS4B | GU131812 |
| DENV1 NS4B | EU660394 | DENV1 NS4B | EU482592 | DENV1 NS4B | FJ182002 | DENV1 NS4B | EU660419 |
| DENV1 NS4B | EU482610 | DENV1 NS4B | EU482800 | DENV1 NS4B | GU131683 | DENV1 NS4B | GQ199831 |
| DENV1 NS4B | EU179861 | DENV1 NS4B | GU131745 | DENV1 NS4B | FJ639685 | DENV1 NS4B | AY732475 |
| DENV1 NS4B | AB074761 | DENV1 NS4B | FJ410184 | DENV1 NS4B | EU482535 | DENV1 NS4B | EU249491 |
| DENV1 NS4B | GQ199829 | DENV1 NS4B | GQ199778 | DENV1 NS4B | FJ024433 | DENV1 NS4B | GU131833 |
| DENV1 NS4B | GU131863 | DENV1 NS4B | FJ390383 | DENV1 NS4B | FJ176780 | DENV1 NS4B | GQ199836 |
| DENV1 NS4B | GU131892 | DENV1 NS4B | FJ410203 | DENV1 NS4B | FJ373305 | DENV1 NS4B | FJ410240 |
| DENV1 NS4B | GQ868530 | DENV1 NS4B | EU482476 | DENV1 NS4B | FJ410279 | DENV1 NS4B | FJ410225 |
| DENV1 NS4B | FJ410173 | DENV1 NS4B | AY145123 | DENV1 NS4B | EU081279 | DENV1 NS4B | GU131732 |
| DENV1 NS4B | EU482814 | DENV1 NS4B | EU081270 | DENV1 NS4B | GU131756 | DENV1 NS4B | FJ639677 |
| DENV1 NS4B | EU660393 | DENV1 NS4B | GQ199872 | DENV1 NS4B | FJ478457 | DENV1 NS4B | FJ810419 |
| DENV1 NS4B | FJ639815 | DENV1 NS4B | GQ199856 | DENV1 NS4B | FJ024457 | DENV1 NS4B | GU056032 |
| DENV1 NS4B | GU131979 | DENV1 NS4B | EU482709 | DENV1 NS4B | AB189121 | DENV1 NS4B | FJ390374 |
| DENV1 NS4B | EU482827 | DENV1 NS4B | GQ868618 | DENV1 NS4B | DQ285562 | DENV1 NS4B | FJ882527 |
| DENV1 NS4B | FJ461316 | DENV1 NS4B | GU131699 | DENV1 NS4B | FJ850103 | DENV1 NS4B | GU131830 |
| DENV1 NS4B | FJ882544 | DENV1 NS4B | FJ182029 | DENV1 NS4B | EU482499 | DENV1 NS4B | EU482791 |
| DENV1 NS4B | GU131768 | DENV1 NS4B | GQ199855 | DENV1 NS4B | GQ199805 | DENV1 NS4B | FJ898427 |
| DENV1 NS4B | EU482567 | DENV1 NS4B | FJ882539 | DENV1 NS4B | GQ868568 | DENV1 NS4B | FJ410234 |
| DENV1 NS4B | GU131957 | DENV1 NS4B | FJ410180 | DENV1 NS4B | FJ547068 | DENV1 NS4B | EU482494 |
| DENV1 NS4B | DQ672559 | DENV1 NS4B | GU131806 | DENV1 NS4B | EU081234 | DENV1 NS4B | FJ432720 |
| DENV1 NS4B | EU677153 | DENV1 NS4B | DQ672564 | DENV1 NS4B | FJ432739 | DENV1 NS4B | FJ639735 |
| DENV1 NS4B | AF226687 | DENV1 NS4B | FJ410268 | DENV1 NS4B | GQ199816 | DENV1 NS4B | FJ898406 |
| DENV1 NS4B | EU482825 | DENV1 NS4B | GU131825 | DENV1 NS4B | FJ898401 | DENV1 NS4B | DQ672563 |

FIG. 66-106

| Virus Protein Accession No. | Virus Protein Accession No. | Virus Protein Accession No. | Virus Protein Accession No. |
|---|---|---|---|
| DENV1 NS4B GQ199793 | DENV1 NS4B FJ882548 | DENV1 NS4B GQ868509 | DENV1 NS4B GU131681 |
| DENV1 NS4B EU482807 | DENV1 NS4B FJ859029 | DENV1 NS4B FJ410209 | DENV1 NS4B EU081226 |
| DENV1 NS4B GU131797 | DENV1 NS4B GU131781 | DENV1 NS4B GU131839 | DENV1 NS4B FJ182020 |
| DENV1 NS4B FJ410258 | DENV1 NS4B FJ410252 | DENV1 NS4B FJ410251 | DENV1 NS4B FJ882524 |
| DENV1 NS4B EU482802 | DENV1 NS4B EU081262 | DENV1 NS4B EU677175 | DENV1 NS4B EU677139 |
| DENV1 NS4B GQ868633 | DENV1 NS4B GQ199842 | DENV1 NS4B FJ639820 | DENV1 NS4B GU131920 |
| DENV1 NS4B AB074760 | DENV1 NS4B EU726782 | DENV1 NS4B GQ199867 | DENV1 NS4B GQ868536 |
| DENV1 NS4B EU081256 | DENV1 NS4B GQ868537 | DENV1 NS4B FJ024428 | DENV1 NS4B GQ199776 |
| DENV1 NS4B FJ432735 | DENV1 NS4B GQ199797 | DENV1 NS4B EU482537 | DENV1 NS4B FJ390381 |
| DENV1 NS4B GQ199781 | DENV1 NS4B FJ882515 | DENV1 NS4B GU131778 | DENV1 NS4B GU131751 |
| DENV1 NS4B DQ285559 | DENV1 NS4B FJ024450 | DENV1 NS4B FJ024464 | DENV1 NS4B FJ390388 |
| DENV1 NS4B FJ182036 | DENV1 NS4B GU131723 | DENV1 NS4B GU131972 | DENV1 NS4B EU482823 |
| DENV1 NS4B FJ547089 | DENV1 NS4B GQ868503 | DENV1 NS4B GQ868606 | DENV1 NS4B FJ850073 |
| DENV1 NS4B FJ898416 | DENV1 NS4B FJ882551 | DENV1 NS4B GU131679 | DENV1 NS4B EU081237 |
| DENV1 NS4B GU131960 | DENV1 NS4B FJ461318 | DENV1 NS4B GU131708 | DENV1 NS4B EU482483 |
| DENV1 NS4B GU131820 | DENV1 NS4B FJ898418 | DENV1 NS4B EU687251 | DENV1 NS4B GQ199853 |
| DENV1 NS4B EU677170 | DENV1 NS4B GQ199820 | DENV1 NS4B AF226685 | DENV1 NS4B GU131921 |
| DENV1 NS4B FJ882531 | DENV1 NS4B AF513110 | DENV1 NS4B FJ882561 | DENV1 NS4B FJ182031 |
| DENV1 NS4B AF514889 | DENV1 NS4B FJ410191 | DENV1 NS4B EU482488 | DENV1 NS4B FJ639683 |
| DENV1 NS4B EU863650 | DENV1 NS4B FJ024431 | DENV1 NS4B FJ410214 | DENV1 NS4B GU131740 |
| DENV1 NS4B FB667403 | DENV1 NS4B FJ898394 | DENV1 NS4B FJ687429 | DENV1 NS4B FJ562105 |
| DENV1 NS4B GU131714 | DENV1 NS4B FJ024445 | DENV1 NS4B FJ898379 | DENV1 NS4B FJ432745 |
| DENV1 NS4B FJ882569 | DENV1 NS4B EU081242 | DENV1 NS4B GU131790 | DENV1 NS4B AY277664 |
| DENV1 NS4B FJ410280 | DENV1 NS4B FJ461333 | DENV1 NS4B EU482540 | DENV1 NS4B FJ882559 |

FIG. 66-107

| Virus Protein Accession No. | Virus Protein Accession No. | Virus Protein Accession No. | Virus Protein Accession No. |
|---|---|---|---|
| DENV1 NS4B FJ024435 | DENV1 NS4B AF180817 | DENV1 NS4B FJ410220 | DENV1 NS4B FJ898399 |
| DENV1 NS4B GQ199803 | DENV1 NS4B EU081277 | DENV1 NS4B EU482504 | DENV1 NS4B GQ868609 |
| DENV1 NS4B FJ461320 | DENV1 NS4B FJ898426 | DENV1 NS4B FJ205881 | DENV1 NS4B EU726780 |
| DENV1 NS4B FJ850090 | DENV1 NS4B GU131729 | DENV1 NS4B EU081264 | DENV1 NS4B EU482805 |
| DENV1 NS4B EU482528 | DENV1 NS4B GQ868539 | DENV1 NS4B GU131688 | DENV1 NS4B GU131784 |
| DENV1 NS4B FJ898448 | DENV1 NS4B AY145121 | DENV1 NS4B A75711 | DENV1 NS4B GU131827 |
| DENV1 NS4B FJ898420 | DENV1 NS4B EU677167 | DENV1 NS4B EU081254 | DENV1 NS4B FJ410227 |
| DENV1 NS4B GQ868519 | DENV1 NS4B FJ898422 | DENV1 NS4B FJ898429 | DENV1 NS4B GQ868505 |
| DENV1 NS4B FJ432727 | DENV1 NS4B FJ744702 | DENV1 NS4B FJ469908 | DENV1 NS4B FN429884 |
| DENV1 NS4B EU677155 | DENV1 NS4B GQ199838 | DENV1 NS4B GU131799 | DENV1 NS4B FJ873809 |
| DENV1 NS4B EU677162 | DENV1 NS4B GQ199779 | DENV1 NS4B FJ182027 | DENV1 NS4B EU081258 |
| DENV1 NS4B GU131692 | DENV1 NS4B FJ205883 | DENV1 NS4B FJ432737 | DENV1 NS4B EU677173 |
| DENV1 NS4B EU596501 | DENV1 NS4B GQ868635 | DENV1 NS4B FJ410201 | DENV1 NS4B FJ898392 |
| DENV1 NS4B FJ410273 | DENV1 NS4B DQ285560 | DENV1 NS4B GU131701 | DENV1 NS4B FJ024448 |
| DENV1 NS4B FJ410182 | DENV1 NS4B FJ410239 | DENV1 NS4B EU081269 | DENV1 NS4B GQ868507 |
| DENV1 NS4B GQ199791 | DENV1 NS4B FJ882554 | DENV1 NS4B GQ199783 | DENV1 NS4B EU482531 |
| DENV1 NS4B GQ868630 | DENV1 NS4B GU131747 | DENV1 NS4B GU131754 | DENV1 NS4B GQ868510 |
| DENV1 NS4B EU482503 | DENV1 NS4B FJ024481 | DENV1 NS4B EU081251 | DENV1 NS4B FJ410290 |
| DENV1 NS4B FB730116 | DENV1 NS4B FJ639675 | DENV1 NS4B FJ432733 | DENV1 NS4B GU131981 |
| DENV1 NS4B FJ410198 | DENV1 NS4B GU131810 | DENV1 NS4B FJ024447 | DENV1 NS4B EU660391 |
| DENV1 NS4B EU081276 | DENV1 NS4B FJ410249 | DENV1 NS4B FJ547063 | DENV1 NS4B EU482515 |
| DENV1 NS4B FJ461324 | DENV1 NS4B DQ672561 | DENV1 NS4B EU482523 | DENV1 NS4B EU081232 |
| DENV1 NS4B AF311958 | DENV1 NS4B FJ810415 | DENV1 NS4B EU482793 | DENV1 NS4B GQ199840 |
| DENV1 NS4B FJ639813 | DENV1 NS4B GQ199785 | DENV1 NS4B U88537 | DENV1 NS4B EU482710 |

FIG. 66-108

| Virus Protein Accession No. | Virus Protein Accession No. | Virus Protein Accession No. | Virus Protein Accession No. |
|---|---|---|---|
| DENV1 NS4B GQ868566 | DENV1 NS4B GQ868500 | DENV1 NS4B GQ868569 | DENV1 NS4B EU482539 |
| DENV1 NS4B GU131964 | DENV1 NS4B EU249493 | DENV1 NS4B GQ868612 | DENV1 NS4B EU482804 |
| DENV1 NS4B EU482713 | DENV1 NS4B EU081275 | DENV1 NS4B FJ461331 | DENV1 NS4B FJ882520 |
| DENV1 NS4B EU482538 | DENV1 NS4B FJ432748 | DENV1 NS4B FJ410282 | DENV1 NS4B FJ639689 |
| DENV1 NS4B EU081245 | DENV1 NS4B EU081228 | DENV1 NS4B FJ205872 | DENV1 NS4B EU677140 |
| DENV1 NS4B GQ868619 | DENV1 NS4B EU482810 | DENV1 NS4B GQ199809 | DENV1 NS4B GQ199832 |
| DENV1 NS4B GU131789 | DENV1 NS4B GQ199852 | DENV1 NS4B GU131722 | DENV1 NS4B FJ639695 |
| DENV1 NS4B AB178040 | DENV1 NS4B GU131923 | DENV1 NS4B FJ873810 | DENV1 NS4B FJ410244 |
| DENV1 NS4B AY732480 | DENV1 NS4B GQ199790 | DENV1 NS4B FJ882546 | DENV1 NS4B FJ898397 |
| DENV1 NS4B FJ898385 | DENV1 NS4B FJ024423 | DENV1 NS4B FJ639797 | DENV1 NS4B GU131819 |
| DENV1 NS4B FJ639688 | DENV1 NS4B FJ882555 | DENV1 NS4B EU677160 | DENV1 NS4B GU131823 |
| DENV1 NS4B FJ205884 | DENV1 NS4B FJ898405 | DENV1 NS4B FJ461312 | DENV1 NS4B FJ882543 |
| DENV1 NS4B FJ898380 | DENV1 NS4B GU131889 | DENV1 NS4B NC_001477 | DENV1 NS4B GU131715 |
| DENV1 NS4B FJ182026 | DENV1 NS4B GQ868499 | DENV1 NS4B GQ199841 | DENV1 NS4B EU677156 |
| DENV1 NS4B AF311957 | DENV1 NS4B EU482501 | DENV1 NS4B FJ882534 | DENV1 NS4B FJ461317 |
| DENV1 NS4B FJ639693 | DENV1 NS4B GU131775 | DENV1 NS4B FJ410289 | DENV1 NS4B GU131794 |
| DENV1 NS4B GU131735 | DENV1 NS4B EU081246 | DENV1 NS4B FJ410179 | DENV1 NS4B FJ461341 |
| DENV1 NS4B FJ850114 | DENV1 NS4B GQ199773 | DENV1 NS4B FJ432719 | DENV1 NS4B EU482511 |
| DENV1 NS4B FJ882563 | DENV1 NS4B FJ898431 | DENV1 NS4B AY277666 | DENV1 NS4B FJ024453 |
| DENV1 NS4B GQ199812 | DENV1 NS4B EU081231 | DENV1 NS4B GU131727 | DENV1 NS4B GU131749 |
| DENV1 NS4B GU131737 | DENV1 NS4B EU482486 | DENV1 NS4B FJ024462 | DENV1 NS4B FJ898389 |
| DENV1 NS4B FJ547060 | DENV1 NS4B FJ410187 | DENV1 NS4B FJ024441 | DENV1 NS4B GU131696 |
| DENV1 NS4B GQ199819 | DENV1 NS4B FN429881 | DENV1 NS4B GQ199822 | DENV1 NS4B EU482508 |
| DENV1 NS4B FJ024484 | DENV1 NS4B GU131764 | DENV1 NS4B FN429887 | DENV1 NS4B EU081265 |

FIG. 66-109

| Virus Protein Accession No. | Virus Protein Accession No. | Virus Protein Accession No. | Virus Protein Accession No. |
|---|---|---|---|
| DENV1 NS4B FJ410247 | DENV1 NS4B AY726554 | DENV1 NS4B GU131703 | DENV1 NS4B FJ882553 |
| DENV1 NS4B FJ461307 | DENV1 NS4B FJ898403 | DENV1 NS4B FJ410190 | DENV1 NS4B GU131821 |
| DENV1 NS4B GQ868560 | DENV1 NS4B CS479203 | DENV1 NS4B GQ868564 | DENV1 NS4B GQ199771 |
| DENV1 NS4B FJ461319 | DENV1 NS4B EU482517 | DENV1 NS4B GU131717 | DENV1 NS4B AB195673 |
| DENV1 NS4B FJ898412 | DENV1 NS4B EU482609 | DENV1 NS4B EU081273 | DENV1 NS4B EU482812 |
| DENV1 NS4B GQ868521 | DENV1 NS4B FJ410266 | DENV1 NS4B GQ199846 | DENV1 NS4B AF298807 |
| DENV1 NS4B GU131686 | DENV1 NS4B EU482493 | DENV1 NS4B AY732483 | DENV1 NS4B GU131801 |
| DENV1 NS4B AY732479 | DENV1 NS4B FJ639674 | DENV1 NS4B CS477263 | DENV1 NS4B GU131983 |
| DENV1 NS4B FJ384655 | DENV1 NS4B FJ639673 | DENV1 NS4B EU482496 | DENV1 NS4B EF122232 |
| DENV1 NS4B FJ882537 | DENV1 NS4B AY732482 | DENV1 NS4B FJ410265 | DENV1 NS4B AB519681 |
| DENV1 NS4B FJ898373 | DENV1 NS4B CS479204 | DENV1 NS4B GU131720 | DENV1 NS4B GQ199814 |
| DENV1 NS4B GU131710 | DENV1 NS4B EU482819 | DENV1 NS4B FJ461327 | DENV1 NS4B AY726552 |
| DENV1 NS4B EU677171 | DENV1 NS4B FJ882570 | DENV1 NS4B GU370048 | DENV1 NS4B EU482484 |
| DENV1 NS4B FJ024479 | DENV1 NS4B AF514885 | DENV1 NS4B FJ898409 | DENV1 NS4B AY722803 |
| DENV1 NS4B FJ687431 | DENV1 NS4B GU131802 | DENV1 NS4B FJ182024 | DENV1 NS4B GU131787 |
| DENV1 NS4B FJ882523 | DENV1 NS4B FJ687427 | DENV1 NS4B FJ882565 | DENV1 NS4B FJ373296 |
| DENV1 NS4B FJ547065 | DENV1 NS4B FJ182033 | DENV1 NS4B GU131966 | DENV1 NS4B GU131887 |
| DENV1 NS4B GU131791 | DENV1 NS4B GQ199800 | DENV1 NS4B EU249490 | DENV1 NS4B GU131741 |
| DENV1 NS4B GU131894 | DENV1 NS4B GU131702 | DENV1 NS4B AF514876 | DENV1 NS4B EU677178 |
| DENV1 NS4B EU482490 | DENV1 NS4B FJ432723 | DENV1 NS4B FN429885 | DENV1 NS4B FJ898433 |
| DENV1 NS4B EU482521 | DENV1 NS4B EU482505 | DENV1 NS4B EU081272 | DENV1 NS4B FJ024443 |
| DENV1 NS4B FJ898423 | DENV1 NS4B FJ882532 | DENV1 NS4B GU131841 | DENV1 NS4B FJ461336 |
| DENV1 NS4B EU660396 | DENV1 NS4B AF514878 | DENV1 NS4B GQ868570 | DENV1 NS4B GQ199858 |
| DENV1 NS4B AF180818 | DENV1 NS4B FJ882540 | DENV1 NS4B GU131890 | DENV1 NS4B EU482820 |

FIG. 66-110

| Virus Protein Accession No. | Virus Protein Accession No. | Virus Protein Accession No. | Virus Protein Accession No. |
|---|---|---|---|
| DENV1 NS4B EU482478 | DENV1 NS4B FJ410185 | DENV1 NS4B GU131949 | DENV1 NS4B GQ868602 |
| DENV1 NS4B GU131815 | DENV1 NS4B EU660412 | DENV1 NS4B AY732477 | DENV1 NS4B GQ868532 |
| DENV1 NS4B GQ199834 | DENV1 NS4B GU131779 | DENV1 NS4B EU596503 | DENV1 NS4B EF025110 |
| DENV1 NS4B GU131743 | DENV1 NS4B FJ639691 | DENV1 NS4B GQ199851 | DENV1 NS4B GQ868528 |
| DENV1 NS4B GQ868614 | DENV1 NS4B EU677165 | DENV1 NS4B GU131796 | DENV1 NS4B GU131694 |
| DENV1 NS4B EU482706 | DENV1 NS4B GU131773 | DENV1 NS4B EU081252 | DENV1 NS4B EU482489 |
| DENV1 NS4B AY376737 | DENV1 NS4B FJ882517 | DENV1 NS4B GU131712 | DENV1 NS4B FJ850068 |
| DENV1 NS4B FJ562101 | DENV1 NS4B FJ410230 | DENV1 NS4B EU081249 | DENV1 NS4B FJ898400 |
| DENV1 NS4B FB667398 | DENV1 NS4B FJ410211 | DENV1 NS4B GU131730 | DENV1 NS4B GU131968 |
| DENV1 NS4B GU131808 | DENV1 NS4B FJ850070 | DENV1 NS4B GQ199795 | DENV1 NS4B GQ868615 |
| DENV1 NS4B GU131780 | DENV1 NS4B FJ024460 | DENV1 NS4B GQ199807 | DENV1 NS4B FJ882567 |
| DENV1 NS4B FJ639671 | DENV1 NS4B GQ868562 | DENV1 NS4B GU131817 | DENV1 NS4B DQ672558 |
| DENV1 NS4B FJ390379 | DENV1 NS4B FJ882529 | DENV1 NS4B FJ024455 | DENV1 NS4B EU677151 |
| DENV1 NS4B FJ024439 | DENV1 NS4B FJ639687 | DENV1 NS4B GU131766 | DENV1 NS4B AB204803 |
| DENV1 NS4B AF350498 | DENV1 NS4B GU131684 | DENV1 NS4B GU056031 | DENV1 NS4B FJ182018 |
| DENV1 NS4B FJ432747 | DENV1 NS4B FJ205876 | DENV1 NS4B GU131786 | DENV1 NS4B EU482809 |
| DENV1 NS4B EU482795 | DENV1 NS4B FJ410205 | DENV1 NS4B FJ410207 | DENV1 NS4B FJ687433 |
| DENV1 NS4B FJ639678 | DENV1 NS4B FJ478458 | DENV1 NS4B EU726781 | DENV1 NS4B FJ410277 |
| DENV1 NS4B EU482617 | DENV1 NS4B EU677158 | DENV1 NS4B FJ182035 | DENV1 NS4B GQ868502 |
| DENV1 NS4B FJ410287 | DENV1 NS4B EU482532 | DENV1 NS4B FJ882545 | DENV1 NS4B FJ461310 |
| DENV1 NS4B FJ024444 | DENV1 NS4B FJ410242 | DENV1 NS4B FJ410222 | DENV1 NS4B FJ898375 |
| DENV1 NS4B EU482799 | DENV1 NS4B EU482619 | DENV1 NS4B EU660401 | DENV1 NS4B GU131835 |
| DENV1 NS4B GU131750 | DENV1 NS4B FJ410235 | DENV1 NS4B FJ639824 | DENV1 NS4B FJ390386 |
| DENV1 NS4B FJ906963 | DENV1 NS4B FJ898395 | DENV1 NS4B AY762084 | DENV1 NS4B EU482518 |

FIG. 66-111

| Virus Protein Accession No. | Virus Protein Accession No. | Virus Protein Accession No. | Virus Protein Accession No. |
|---|---|---|---|
| DENV1 NS4B FJ898414 | DENV1 NS5GU131711 | DENV1 NS5GU131978 | DENV1 NS5GQ199843 |
| DENV1 NS4B EU482717 | DENV1 NS5FJ639812 | DENV1 NS5FJ547088 | DENV1 NS5GQ199821 |
| DENV1 NS4B DQ672557 | DENV1 NS5GU131765 | DENV1 NS5FJ898374 | DENV1 NS5GU131777 |
| DENV1 NS4B GQ199877 | DENV1 NS5FJ432744 | DENV1 NS5GQ868504 | DENV1 NS5FJ898378 |
| DENV1 NS4B GU131719 | DENV1 NS5GM059691 | DENV1 NS5FJ882550 | DENV1 NS5FJ461306 |
| DENV1 NS4B EU482817 | DENV1 NS5FJ410278 | DENV1 NS5FJ850113 | DENV1 NS5GU131707 |
| DENV1 NS4B FJ410254 | DENV1 NS5EU081261 | DENV1 NS5GU131980 | DENV1 NS5AF226686 |
| DENV1 NS4B EU482507 | DENV1 NS5EU482801 | DENV1 NS5GU131783 | DENV1 NS5EU677152 |
| DENV1 NS4B FJ410274 | DENV1 NS5FJ882526 | DENV1 NS5AY732474 | DENV1 NS5GU131828 |
| DENV1 NS4B FJ898387 | DENV1 NS5FJ639823 | DENV1 NS5GU131958 | DENV1 NS5GU131971 |
| DENV1 NS4B GQ868514 | DENV1 NS5EU081260 | DENV1 NS5FJ898393 | DENV1 NS5GQ199826 |
| DENV1 NS4B GU131705 | DENV1 NS5GQ199786 | DENV1 NS5EU677176 | DENV1 NS5EU677168 |
| DENV1 NS4B FJ432738 | DENV1 NS5AY726550 | DENV1 NS5FJ850104 | DENV1 NS5FJ461313 |
| DENV1 NS4B FJ639681 | DENV1 NS5FJ882558 | DENV1 NS5EU249492 | DENV1 NS5EU081267 |
| DENV1 NS4B EU482513 | DENV1 NS5GU131809 | DENV1 NS5EU482712 | DENV1 NS5FJ410175 |
| DENV1 NS4B EU081240 | DENV1 NS5FJ182030 | DENV1 NS5FJ410236 | DENV1 NS5FJ182028 |
| DENV1 NS5FJ639670 | DENV1 NS5EU482816 | DENV1 NS5FJ410192 | DENV1 NS5FJ882516 |
| DENV1 NS5FJ024446 | DENV1 NS5GU131813 | DENV1 NS5EU081281 | DENV1 NS5FJ024456 |
| DENV1 NS5GU131759 | DENV1 NS5EU482808 | DENV1 NS5FJ432729 | DENV1 NS5AF311956 |
| DENV1 NS5FJ882560 | DENV1 NS5EU482498 | DENV1 NS5GQ868525 | DENV1 NS5GU131770 |
| DENV1 NS5GU131838 | DENV1 NS5FJ882525 | DENV1 NS5FN429883 | DENV1 NS5GU131824 |
| DENV1 NS5FJ024437 | DENV1 NS5GU131731 | DENV1 NS5GQ199828 | DENV1 NS5GQ199854 |
| DENV1 NS5GQ868639 | DENV1 NS5GQ199794 | DENV1 NS5FJ182021 | DENV1 NS5FJ898410 |
| DENV1 NS5FJ639806 | DENV1 NS5GU131832 | DENV1 NS5EU482824 | DENV1 NS5FJ024472 |
| DENV1 NS5GQ199837 | DENV1 NS5EU848545 | DENV1 NS5GU131956 | DENV1 NS5EU081236 |
| DENV1 NS5AB189120 | DENV1 NS5GU131760 | DENV1 NS5EU482797 | DENV1 NS5EU482480 |
| DENV1 NS5EU081235 | DENV1 NS5GU131965 | DENV1 NS5FJ410213 | DENV1 NS5GU131795 |
| DENV1 NS5FJ410263 | DENV1 NS5FJ898415 | DENV1 NS5FJ898384 | DENV1 NS5FJ432736 |
| DENV1 NS5AY713476 | DENV1 NS5GU131782 | DENV1 NS5FJ410186 | DENV1 NS5FJ024480 |
| DENV1 NS5GQ199806 | DENV1 NS5GQ868535 | DENV1 NS5GQ868538 | DENV1 NS5EU081278 |
| DENV1 NS5GU131693 | DENV1 NS5EU482524 | DENV1 NS5EU677163 | DENV1 NS5FJ182019 |
| DENV1 NS5GU131753 | DENV1 NS5GU131726 | DENV1 NS5FJ432742 | DENV1 NS5GU131919 |
| | DENV1 NS5GQ868501 | DENV1 NS5FJ461303 | DENV1 NS5GU131682 |
| | DENV1 NS5FJ432734 | DENV1 NS5FJ639679 | DENV1 NS5EU482714 |
| | DENV1 NS5FJ410253 | DENV1 NS5FJ469909 | DENV1 NS5FJ410197 |
| | DENV1 NS5FJ410281 | DENV1 NS5EU081227 | DENV1 NS5GU131744 |
| | DENV1 NS5EU482708 | DENV1 NS5EU482534 | DENV1 NS5FJ410183 |
| | DENV1 NS5GQ199784 | DENV1 NS5FJ410261 | DENV1 NS5GQ199875 |
| | DENV1 NS5GQ868567 | DENV1 NS5FJ687428 | DENV1 NS5GQ199845 |
| | DENV1 NS5EU280167 | DENV1 NS5EU660392 | DENV1 NS5GU131689 |
| | DENV1 NS5FJ850084 | DENV1 NS5GQ199815 | DENV1 NS5FJ461323 |
| | DENV1 NS5EU482514 | DENV1 NS5EU482611 | DENV1 NS5FJ432740 |
| | DENV1 NS5AY722802 | DENV1 NS5FJ639821 | DENV1 NS5AY713474 |
| | DENV1 NS5FJ639808 | DENV1 NS5FJ410174 | DENV1 NS5GQ199789 |
| | DENV1 NS5EU482526 | DENV1 NS5GU131706 | DENV1 NS5GU131977 |
| | DENV1 NS5AY732476 | DENV1 NS5EU249495 | DENV1 NS5FJ850069 |
| | DENV1 NS5GU131772 | DENV1 NS5EU482477 | DENV1 NS5EF457905 |
| | DENV1 NS5FJ882530 | DENV1 NS5EU482826 | DENV1 NS5FJ898421 |

FIG. 66-112

| Virus Protein Accession No. | Virus Protein Accession No. | Virus Protein Accession No. | Virus Protein Accession No. |
|---|---|---|---|
| DENV1 NS5FJ744701 | DENV1 NS5GQ199824 | DENV1 NS5EU482536 | DENV1 NS5FJ562106 |
| DENV1 NS5GQ199788 | DENV1 NS5EU482790 | DENV1 NS5GU131713 | DENV1 NS5FJ639682 |
| DENV1 NS5EU726778 | DENV1 NS5EU081257 | DENV1 NS5GU131721 | DENV1 NS5GU131792 |
| DENV1 NS5EU081263 | DENV1 NS5FJ024449 | DENV1 NS5EU660397 | DENV1 NS5FJ882522 |
| DENV1 NS5FJ205874 | DENV1 NS5FJ024430 | DENV1 NS5FJ906965 | DENV1 NS5GU131742 |
| DENV1 NS5GU131826 | DENV1 NS5EU482815 | DENV1 NS5EU081280 | DENV1 NS5GU131761 |
| DENV1 NS5FJ898407 | DENV1 NS5FJ898398 | DENV1 NS5FJ639692 | DENV1 NS5GQ868561 |
| DENV1 NS5GQ199804 | DENV1 NS5EU482530 | DENV1 NS5EU249494 | DENV1 NS5FJ410245 |
| DENV1 NS5FJ024478 | DENV1 NS5GQ868636 | DENV1 NS5FJ639819 | DENV1 NS5GQ868520 |
| DENV1 NS5FJ850102 | DENV1 NS5FJ024459 | DENV1 NS5EU482529 | DENV1 NS5EU482707 |
| DENV1 NS5FJ432721 | DENV1 NS5GQ868610 | DENV1 NS5EU482616 | DENV1 NS5EU482520 |
| DENV1 NS5EU660418 | DENV1 NS5EU081233 | DENV1 NS5FJ410284 | DENV1 NS5FJ882536 |
| DENV1 NS5EF032590 | DENV1 NS5FJ687426 | DENV1 NS5FJ410181 | DENV1 NS5EU081248 |
| DENV1 NS5AY713473 | DENV1 NS5FJ898404 | DENV1 NS5FJ461332 | DENV1 NS5GQ868531 |
| DENV1 NS5GU131700 | DENV1 NS5EU081244 | DENV1 NS5GQ199777 | DENV1 NS5EU482533 |
| DENV1 NS5GQ868523 | DENV1 NS5EU482522 | DENV1 NS5EU081229 | DENV1 NS5FJ898411 |
| DENV1 NS5GQ868522 | DENV1 NS5FJ205882 | DENV1 NS5FJ410270 | DENV1 NS5GQ199796 |
| DENV1 NS5EU660402 | DENV1 NS5GU131788 | DENV1 NS5GQ199873 | DENV1 NS5GU131818 |
| DENV1 NS5FJ639676 | DENV1 NS5GU131762 | DENV1 NS5FJ024451 | DENV1 NS5EU081239 |
| DENV1 NS5FJ410272 | DENV1 NS5FJ410238 | DENV1 NS5GU131739 | DENV1 NS5EU081255 |
| DENV1 NS5AY277665 | DENV1 NS5DQ285558 | DENV1 NS5EU482482 | DENV1 NS5EU359008 |
| DENV1 NS5GQ199802 | DENV1 NS5FJ898371 | DENV1 NS5FJ024482 | DENV1 NS5FJ906964 |
| DENV1 NS5FJ882549 | DENV1 NS5FJ461308 | DENV1 NS5GU131698 | DENV1 NS5EU482618 |
| DENV1 NS5FJ898391 | DENV1 NS5EU482711 | DENV1 NS5FJ024432 | DENV1 NS5FJ410246 |
| DENV1 NS5GQ199830 | DENV1 NS5GQ868605 | DENV1 NS5FJ882556 | DENV1 NS5GQ868534 |
| DENV1 NS5DQ672562 | DENV1 NS5GQ868565 | DENV1 NS5GU131831 | DENV1 NS5GQ199835 |
| DENV1 NS5GU131757 | DENV1 NS5GQ868608 | DENV1 NS5AY835999 | DENV1 NS5GU131716 |
| DENV1 NS5GQ199839 | DENV1 NS5FJ898417 | DENV1 NS5GU131922 | DENV1 NS5FJ410256 |
| DENV1 NS5FJ898437 | DENV1 NS5FJ024426 | DENV1 NS5FJ898376 | DENV1 NS5FJ898424 |
| DENV1 NS5EU081250 | DENV1 NS5GQ868511 | DENV1 NS5FJ898425 | DENV1 NS5GU131687 |
| DENV1 NS5GU131963 | DENV1 NS5FJ882562 | DENV1 NS5FJ898419 | DENV1 NS5EU482615 |
| DENV1 NS5FJ410257 | DENV1 NS5GU131752 | DENV1 NS5GQ199799 | DENV1 NS5FJ410285 |
| DENV1 NS5GU131798 | DENV1 NS5GQ199811 | DENV1 NS5GU056029 | DENV1 NS5FJ898388 |
| DENV1 NS5GQ868508 | DENV1 NS5GQ868518 | DENV1 NS5AY145122 | DENV1 NS5GQ868529 |
| DENV1 NS5EU482789 | DENV1 NS5FJ850075 | DENV1 NS5GU131811 | DENV1 NS5FJ882579 |
| DENV1 NS5U88536 | DENV1 NS5FJ850100 | DENV1 NS5EU482495 | DENV1 NS5FJ024442 |
| DENV1 NS5GU131807 | DENV1 NS5GU131709 | DENV1 NS5GQ868506 | DENV1 NS5GQ868563 |
| DENV1 NS5GQ868533 | DENV1 NS5GQ199848 | DENV1 NS5GU131961 | DENV1 NS5FJ639743 |
| DENV1 NS5FJ898390 | DENV1 NS5FJ024429 | DENV1 NS5FJ410269 | DENV1 NS5FJ390378 |
| DENV1 NS5EU081259 | DENV1 NS5FJ461315 | DENV1 NS5GQ199833 | DENV1 NS5GU131837 |
| DENV1 NS5EU482806 | DENV1 NS5EU677154 | DENV1 NS5EU081238 | DENV1 NS5FJ432732 |
| DENV1 NS5FJ373298 | DENV1 NS5GU056033 | DENV1 NS5GU131748 | DENV1 NS5GU131840 |
| DENV1 NS5FJ898382 | DENV1 NS5FN429890 | DENV1 NS5FJ410248 | DENV1 NS5EU677174 |
| DENV1 NS5FJ410250 | DENV1 NS5EU482822 | DENV1 NS5GU131733 | DENV1 NS5FJ639680 |
| DENV1 NS5FJ410226 | DENV1 NS5GU131746 | DENV1 NS5FJ461325 | DENV1 NS5GQ199849 |
| DENV1 NS5GU131785 | DENV1 NS5FJ390382 | DENV1 NS5GQ199817 | DENV1 NS5FJ882566 |
| DENV1 NS5GU131842 | DENV1 NS5GU131724 | DENV1 NS5GU131691 | DENV1 NS5FJ882541 |
| DENV1 NS5GU131836 | DENV1 NS5EU677161 | DENV1 NS5GU131804 | DENV1 NS5FJ639802 |

FIG. 66-113

| Virus Protein Accession No. | Virus Protein Accession No. | Virus Protein Accession No. | Virus Protein Accession No. |
|---|---|---|---|
| DENV1 NS5FJ432725 | DENV1 NS5GQ199780 | DENV1 NS5FJ882519 | DENV1 NS5EU081230 |
| DENV1 NS5FN429888 | DENV1 NS5FN429889 | DENV1 NS5GQ199825 | DENV1 NS5FJ410206 |
| DENV1 NS5EU482492 | DENV1 NS5FJ024434 | DENV1 NS5EU482525 | DENV1 NS5GU131969 |
| DENV1 NS5FJ882557 | DENV1 NS5FJ024483 | DENV1 NS5EU482798 | DENV1 NS5AY732478 |
| DENV1 NS5FJ639669 | DENV1 NS5EU482502 | DENV1 NS5FJ182032 | DENV1 NS5FJ461330 |
| DENV1 NS5EU482792 | DENV1 NS5GU131962 | DENV1 NS5GU131769 | DENV1 NS5DQ672556 |
| DENV1 NS5FJ461340 | DENV1 NS5FJ461339 | DENV1 NS5GQ199792 | DENV1 NS5GU131976 |
| DENV1 NS5GU131805 | DENV1 NS5EU482821 | DENV1 NS5GU131888 | DENV1 NS5FJ410216 |
| DENV1 NS5FJ410264 | DENV1 NS5GU131891 | DENV1 NS5GU131704 | DENV1 NS5GQ199801 |
| DENV1 NS5EU482516 | DENV1 NS5EU660403 | DENV1 NS5GQ199850 | DENV1 NS5FJ906728 |
| DENV1 NS5FJ469907 | DENV1 NS5FJ410275 | DENV1 NS5GQ868526 | DENV1 NS5GU131803 |
| DENV1 NS5FJ898396 | DENV1 NS5GQ868559 | DENV1 NS5GU131695 | DENV1 NS5AY726555 |
| DENV1 NS5EU677157 | DENV1 NS5AF298808 | DENV1 NS5FJ410243 | DENV1 NS5GQ199798 |
| DENV1 NS5EU482510 | DENV1 NS5FJ410218 | DENV1 NS5AF309641 | DENV1 NS5GU056030 |
| DENV1 NS5FJ182034 | DENV1 NS5GQ199775 | DENV1 NS5FJ639686 | DENV1 NS5GU131816 |
| DENV1 NS5FJ898377 | DENV1 NS5FJ882552 | DENV1 NS5FJ410255 | DENV1 NS5EU482512 |
| DENV1 NS5EU660390 | DENV1 NS5FJ898402 | DENV1 NS5EU482818 | DENV1 NS5FJ882568 |
| DENV1 NS5GU131718 | DENV1 NS5GQ199859 | DENV1 NS5GU131685 | DENV1 NS5FJ898413 |
| DENV1 NS5GQ868513 | DENV1 NS5FJ410196 | DENV1 NS5GU131793 | DENV1 NS5EU596504 |
| DENV1 NS5FJ639740 | DENV1 NS5FJ639690 | DENV1 NS5FN429882 | DENV1 NS5FJ410276 |
| DENV1 NS5FJ882533 | DENV1 NS5FJ898383 | DENV1 NS5EU482509 | DENV1 NS5FJ898386 |
| DENV1 NS5GU131926 | DENV1 NS5GU131984 | DENV1 NS5FJ547086 | DENV1 NS5EU482506 |
| DENV1 NS5GU131734 | DENV1 NS5GQ868498 | DENV1 NS5FJ639694 | DENV1 NS5GU131736 |
| DENV1 NS5EU482519 | DENV1 NS5EU482487 | DENV1 NS5EU482491 | DENV1 NS5GU131948 |
| DENV1 NS5AY206457 | DENV1 NS5FJ639818 | DENV1 NS5GU131755 | DENV1 NS5GU131834 |
| DENV1 NS5GQ199818 | DENV1 NS5EU677166 | DENV1 NS5FJ898430 | DENV1 NS5EU482715 |
| DENV1 NS5FJ850077 | DENV1 NS5GU131758 | DENV1 NS5FJ898428 | DENV1 NS5EU482716 |
| DENV1 NS5AY726553 | DENV1 NS5GU131697 | DENV1 NS5FJ639814 | DENV1 NS5FJ850087 |
| DENV1 NS5EU482718 | DENV1 NS5EU081247 | DENV1 NS5GU131763 | DENV1 NS5AF514883 |
| DENV1 NS5EU081274 | DENV1 NS5GU131776 | DENV1 NS5FJ873814 | DENV1 NS5EU660395 |
| DENV1 NS5FJ182025 | DENV1 NS5FJ390380 | DENV1 NS5FJ850093 | DENV1 NS5FJ410262 |
| DENV1 NS5GU131973 | DENV1 NS5FJ882547 | DENV1 NS5GU131728 | DENV1 NS5EU081243 |
| DENV1 NS5EU482811 | DENV1 NS5GQ868611 | DENV1 NS5FJ898372 | DENV1 NS5CS477264 |
| DENV1 NS5FJ410210 | DENV1 NS5FJ410231 | DENV1 NS5EU677172 | DENV1 NS5FJ562104 |
| DENV1 NS5GU131925 | DENV1 NS5GU131680 | DENV1 NS5FJ639794 | DENV1 NS5GQ199823 |
| DENV1 NS5FJ373297 | DENV1 NS5M87512 | DENV1 NS5GQ868527 | DENV1 NS5FJ639741 |
| DENV1 NS5FJ205875 | DENV1 NS5FJ024440 | DENV1 NS5FJ687430 | DENV1 NS5GU131690 |
| DENV1 NS5DQ193572 | DENV1 NS5GU131774 | DENV1 NS5FJ639672 | DENV1 NS5EU482497 |
| DENV1 NS5U88535 | DENV1 NS5DQ672560 | DENV1 NS5FJ410189 | DENV1 NS5GU370049 |
| DENV1 NS5FJ882564 | DENV1 NS5GQ868512 | DENV1 NS5FJ182023 | DENV1 NS5GQ868632 |
| DENV1 NS5GQ199774 | DENV1 NS5FJ024463 | DENV1 NS5FJ410260 | DENV1 NS5GQ868613 |
| DENV1 NS5GQ199787 | DENV1 NS5EF122231 | DENV1 NS5EU081266 | DENV1 NS5GU131893 |
| DENV1 NS5FJ850099 | DENV1 NS5GQ199810 | DENV1 NS5GU131895 | DENV1 NS5EU687247 |
| DENV1 NS5FJ410267 | DENV1 NS5FJ850081 | DENV1 NS5GU131829 | DENV1 NS5EU482813 |
| DENV1 NS5EU726777 | DENV1 NS5FJ024427 | DENV1 NS5FJ410204 | DENV1 NS5AY713475 |
| DENV1 NS5EU081241 | DENV1 NS5GQ868637 | DENV1 NS5FJ410194 | DENV1 NS5FJ024438 |
| DENV1 NS5FJ898381 | DENV1 NS5FJ639796 | DENV1 NS5FJ882528 | DENV1 NS5FJ882542 |
| DENV1 NS5CS477265 | DENV1 NS5EU677159 | DENV1 NS5FJ432730 | DENV1 NS5GU131982 |

FIG. 66-114

| Virus Protein Accession No. | Virus Protein Accession No. | Virus Protein Accession No. | Virus Protein Accession No. |
|---|---|---|---|
| DENV1 NS5FJ461328 | DENV1 NS5FJ410283 | DENV1 NS5AF226687 | DENV1 NS5GQ199816 |
| DENV1 NS5FJ687432 | DENV1 NS5FJ882521 | DENV1 NS5EU482825 | DENV1 NS5FJ898401 |
| DENV1 NS5FJ410188 | DENV1 NS5EU726779 | DENV1 NS5FJ182022 | DENV1 NS5GU131812 |
| DENV1 NS5GQ199813 | DENV1 NS5EU081253 | DENV1 NS5EU482592 | DENV1 NS5EU660419 |
| DENV1 NS5GQ199847 | DENV1 NS5FN429886 | DENV1 NS5EU482800 | DENV1 NS5GQ199831 |
| DENV1 NS5FJ410212 | DENV1 NS5GQ868601 | DENV1 NS5GU131745 | DENV1 NS5AY732475 |
| DENV1 NS5FJ410232 | DENV1 NS5FJ182003 | DENV1 NS5FJ410184 | DENV1 NS5EU249491 |
| DENV1 NS5EU482481 | DENV1 NS5FJ410286 | DENV1 NS5GQ199778 | DENV1 NS5GU131833 |
| DENV1 NS5AY726551 | DENV1 NS5FJ639684 | DENV1 NS5FJ390383 | DENV1 NS5GQ199836 |
| DENV1 NS5FJ639811 | DENV1 NS5EU482794 | DENV1 NS5FJ410203 | DENV1 NS5FJ410240 |
| DENV1 NS5GU131800 | DENV1 NS5AY722801 | DENV1 NS5EU482476 | DENV1 NS5FJ410225 |
| DENV1 NS5FJ024425 | DENV1 NS5FJ410199 | DENV1 NS5AY145123 | DENV1 NS5GU131732 |
| DENV1 NS5EU482527 | DENV1 NS5EU482485 | DENV1 NS5EU081270 | DENV1 NS5FJ639677 |
| DENV1 NS5EU482500 | DENV1 NS5EU482803 | DENV1 NS5GQ199872 | DENV1 NS5FJ810419 |
| DENV1 NS5EU482828 | DENV1 NS5GU131767 | DENV1 NS5GQ199856 | DENV1 NS5GU056032 |
| DENV1 NS5FJ205873 | DENV1 NS5AY726549 | DENV1 NS5EU482709 | DENV1 NS5FJ390374 |
| DENV1 NS5AY732481 | DENV1 NS5FJ176779 | DENV1 NS5GQ868618 | DENV1 NS5FJ882527 |
| DENV1 NS5GQ199782 | DENV1 NS5FJ461335 | DENV1 NS5GU131699 | DENV1 NS5GU131830 |
| DENV1 NS5EU677150 | DENV1 NS5FJ898408 | DENV1 NS5FJ182029 | DENV1 NS5EU482791 |
| DENV1 NS5EU482591 | DENV1 NS5GQ199844 | DENV1 NS5GQ199855 | DENV1 NS5FJ898427 |
| DENV1 NS5GU131738 | DENV1 NS5GU131970 | DENV1 NS5FJ882539 | DENV1 NS5FJ410234 |
| DENV1 NS5FJ024485 | DENV1 NS5EU482796 | DENV1 NS5FJ410180 | DENV1 NS5EU482494 |
| DENV1 NS5EU677177 | DENV1 NS5EU596502 | DENV1 NS5GU131806 | DENV1 NS5FJ432720 |
| DENV1 NS5GU131967 | DENV1 NS5GQ868607 | DENV1 NS5DQ672564 | DENV1 NS5FJ639735 |
| DENV1 NS5GU131814 | DENV1 NS5GQ868524 | DENV1 NS5FJ410268 | DENV1 NS5FJ898406 |
| DENV1 NS5AJ968413 | DENV1 NS5GQ868517 | DENV1 NS5GU131825 | DENV1 NS5DQ672563 |
| DENV1 NS5FJ024436 | DENV1 NS5EU081268 | DENV1 NS5FJ850101 | DENV1 NS5GQ199793 |
| DENV1 NS5FJ432746 | DENV1 NS5GQ199827 | DENV1 NS5FJ182002 | DENV1 NS5EU482807 |
| DENV1 NS5FJ850071 | DENV1 NS5EU660394 | DENV1 NS5GU131683 | DENV1 NS5GU131797 |
| DENV1 NS5EU081271 | DENV1 NS5EU482610 | DENV1 NS5FJ639685 | DENV1 NS5FJ410258 |
| DENV1 NS5AY708047 | DENV1 NS5AB074761 | DENV1 NS5EU482535 | DENV1 NS5EU482802 |
| DENV1 NS5EU677169 | DENV1 NS5GQ199829 | DENV1 NS5FJ024433 | DENV1 NS5GQ868633 |
| DENV1 NS5FJ882535 | DENV1 NS5GU131863 | DENV1 NS5FJ176780 | DENV1 NS5AB074760 |
| DENV1 NS5FJ547087 | DENV1 NS5GU131892 | DENV1 NS5FJ373305 | DENV1 NS5EU081256 |
| DENV1 NS5EU677164 | DENV1 NS5GQ868530 | DENV1 NS5FJ410279 | DENV1 NS5FJ432735 |
| DENV1 NS5GU131725 | DENV1 NS5FJ410173 | DENV1 NS5EU081279 | DENV1 NS5GQ199781 |
| DENV1 NS5DQ285561 | DENV1 NS5EU482814 | DENV1 NS5GU131756 | DENV1 NS5DQ285559 |
| DENV1 NS5GU131678 | DENV1 NS5EU660393 | DENV1 NS5FJ478457 | DENV1 NS5FJ182036 |
| DENV1 NS5GU131822 | DENV1 NS5FJ639815 | DENV1 NS5FJ024457 | DENV1 NS5FJ547089 |
| DENV1 NS5EU482479 | DENV1 NS5GU131979 | DENV1 NS5AB189121 | DENV1 NS5FJ898416 |
| DENV1 NS5FJ882518 | DENV1 NS5EU482827 | DENV1 NS5DQ285562 | DENV1 NS5GU131960 |
| DENV1 NS5FJ639696 | DENV1 NS5FJ461316 | DENV1 NS5FJ850103 | DENV1 NS5GU131820 |
| DENV1 NS5GQ199857 | DENV1 NS5FJ882544 | DENV1 NS5EU482499 | DENV1 NS5EU677170 |
| DENV1 NS5GQ199808 | DENV1 NS5GU131768 | DENV1 NS5GQ199805 | DENV1 NS5FJ882531 |
| DENV1 NS5FJ432749 | DENV1 NS5EU482567 | DENV1 NS5GQ868568 | DENV1 NS5AF514889 |
| DENV1 NS5GU131771 | DENV1 NS5GU131957 | DENV1 NS5FJ547068 | DENV1 NS5EU863650 |
| DENV1 NS5GQ199772 | DENV1 NS5DQ672559 | DENV1 NS5EU081234 | DENV1 NS5FB667403 |
| DENV1 NS5FJ882538 | DENV1 NS5EU677153 | DENV1 NS5FJ432739 | DENV1 NS5GU131714 |

FIG. 66-115

| Virus Protein Accession No. | Virus Protein Accession No. | Virus Protein Accession No. | Virus Protein Accession No. |
|---|---|---|---|
| DENV1 NS5FJ882569 | DENV1 NS5GU131790 | DENV1 NS5AF311958 | DENV1 NS5EU482793 |
| DENV1 NS5FJ410280 | DENV1 NS5EU482540 | DENV1 NS5FJ639813 | DENV1 NS5U88537 |
| DENV1 NS5FJ882548 | DENV1 NS5GU131681 | DENV1 NS5AF180817 | DENV1 NS5FJ898399 |
| DENV1 NS5FJ859029 | DENV1 NS5EU081226 | DENV1 NS5EU081277 | DENV1 NS5GQ868609 |
| DENV1 NS5GU131781 | DENV1 NS5FJ182020 | DENV1 NS5FJ898426 | DENV1 NS5EU726780 |
| DENV1 NS5FJ410252 | DENV1 NS5FJ882524 | DENV1 NS5GU131729 | DENV1 NS5EU482805 |
| DENV1 NS5EU081262 | DENV1 NS5EU677139 | DENV1 NS5GQ868539 | DENV1 NS5GU131784 |
| DENV1 NS5GQ199842 | DENV1 NS5GU131920 | DENV1 NS5AY145121 | DENV1 NS5GU131827 |
| DENV1 NS5EU726782 | DENV1 NS5GQ868536 | DENV1 NS5EU677167 | DENV1 NS5FJ410227 |
| DENV1 NS5GQ868537 | DENV1 NS5GQ199776 | DENV1 NS5FJ898422 | DENV1 NS5GQ868505 |
| DENV1 NS5GQ199797 | DENV1 NS5FJ390381 | DENV1 NS5FJ744702 | DENV1 NS5FN429884 |
| DENV1 NS5FJ882515 | DENV1 NS5GU131751 | DENV1 NS5GQ199838 | DENV1 NS5FJ873809 |
| DENV1 NS5FJ024450 | DENV1 NS5FJ390388 | DENV1 NS5GQ199779 | DENV1 NS5EU081258 |
| DENV1 NS5GU131723 | DENV1 NS5EU482823 | DENV1 NS5FJ205883 | DENV1 NS5EU677173 |
| DENV1 NS5GQ868503 | DENV1 NS5FJ850073 | DENV1 NS5GQ868635 | DENV1 NS5FJ898392 |
| DENV1 NS5FJ882551 | DENV1 NS5EU081237 | DENV1 NS5DQ285560 | DENV1 NS5FJ024448 |
| DENV1 NS5FJ461318 | DENV1 NS5EU482483 | DENV1 NS5FJ410239 | DENV1 NS5GQ868507 |
| DENV1 NS5FJ898418 | DENV1 NS5GQ199853 | DENV1 NS5FJ882554 | DENV1 NS5EU482531 |
| DENV1 NS5GQ199820 | DENV1 NS5GU131921 | DENV1 NS5GU131747 | DENV1 NS5GQ868510 |
| DENV1 NS5AF513110 | DENV1 NS5FJ182031 | DENV1 NS5FJ024481 | DENV1 NS5FJ410290 |
| DENV1 NS5FJ410191 | DENV1 NS5FJ639683 | DENV1 NS5FJ639675 | DENV1 NS5GU131981 |
| DENV1 NS5FJ024431 | DENV1 NS5GU131740 | DENV1 NS5GU131810 | DENV1 NS5EU660391 |
| DENV1 NS5FJ898394 | DENV1 NS5FJ562105 | DENV1 NS5FJ410249 | DENV1 NS5EU482515 |
| DENV1 NS5FJ024445 | DENV1 NS5FJ432745 | DENV1 NS5DQ672561 | DENV1 NS5EU081232 |
| DENV1 NS5EU081242 | DENV1 NS5AY277664 | DENV1 NS5FJ810415 | DENV1 NS5GQ199840 |
| DENV1 NS5FJ461333 | DENV1 NS5FJ882559 | DENV1 NS5GQ199785 | DENV1 NS5EU482710 |
| DENV1 NS5GQ868509 | DENV1 NS5FJ024435 | DENV1 NS5FJ410220 | DENV1 NS5GQ868566 |
| DENV1 NS5FJ410209 | DENV1 NS5GQ199803 | DENV1 NS5EU482504 | DENV1 NS5GU131964 |
| DENV1 NS5GU131839 | DENV1 NS5FJ461320 | DENV1 NS5FJ205881 | DENV1 NS5EU482713 |
| DENV1 NS5FJ410251 | DENV1 NS5FJ850090 | DENV1 NS5EU081264 | DENV1 NS5EU482538 |
| DENV1 NS5EU677175 | DENV1 NS5EU482528 | DENV1 NS5GU131688 | DENV1 NS5EU081245 |
| DENV1 NS5FJ639820 | DENV1 NS5FJ898448 | DENV1 NS5A75711 | DENV1 NS5GQ868619 |
| DENV1 NS5GQ199867 | DENV1 NS5FJ898420 | DENV1 NS5EU081254 | DENV1 NS5GU131789 |
| DENV1 NS5FJ024428 | DENV1 NS5GQ868519 | DENV1 NS5FJ898429 | DENV1 NS5AB178040 |
| DENV1 NS5EU482537 | DENV1 NS5FJ432727 | DENV1 NS5FJ469908 | DENV1 NS5AY732480 |
| DENV1 NS5GU131778 | DENV1 NS5EU677155 | DENV1 NS5GU131799 | DENV1 NS5FJ898385 |
| DENV1 NS5FJ024464 | DENV1 NS5EU677162 | DENV1 NS5FJ182027 | DENV1 NS5FJ639688 |
| DENV1 NS5GU131972 | DENV1 NS5GU131692 | DENV1 NS5FJ432737 | DENV1 NS5FJ205884 |
| DENV1 NS5GQ868606 | DENV1 NS5EU596501 | DENV1 NS5FJ410201 | DENV1 NS5FJ898380 |
| DENV1 NS5GU131679 | DENV1 NS5FJ410273 | DENV1 NS5GU131701 | DENV1 NS5FJ182026 |
| DENV1 NS5GU131708 | DENV1 NS5FJ410182 | DENV1 NS5EU081269 | DENV1 NS5AF311957 |
| DENV1 NS5EU687251 | DENV1 NS5GQ199791 | DENV1 NS5GQ199783 | DENV1 NS5FJ639693 |
| DENV1 NS5AF226685 | DENV1 NS5GQ868630 | DENV1 NS5GU131754 | DENV1 NS5GU131735 |
| DENV1 NS5FJ882561 | DENV1 NS5EU482503 | DENV1 NS5EU081251 | DENV1 NS5FJ850114 |
| DENV1 NS5EU482488 | DENV1 NS5FB730116 | DENV1 NS5FJ432733 | DENV1 NS5FJ882563 |
| DENV1 NS5FJ410214 | DENV1 NS5FJ410198 | DENV1 NS5FJ024447 | DENV1 NS5GQ199812 |
| DENV1 NS5FJ687429 | DENV1 NS5EU081276 | DENV1 NS5FJ547063 | DENV1 NS5GU131737 |
| DENV1 NS5FJ898379 | DENV1 NS5FJ461324 | DENV1 NS5EU482523 | DENV1 NS5FJ547060 |

FIG. 66-116

| Virus Protein Accession No. | Virus Protein Accession No. | Virus Protein Accession No. | Virus Protein Accession No. |
|---|---|---|---|
| DENV1 NS5GQ199819 | DENV1 NS5GQ199822 | DENV1 NS5EU660396 | DENV1 NS5GQ868570 |
| DENV1 NS5FJ024484 | DENV1 NS5FN429887 | DENV1 NS5AF180818 | DENV1 NS5GU131890 |
| DENV1 NS5GQ868500 | DENV1 NS5EU482539 | DENV1 NS5AY726554 | DENV1 NS5FJ882553 |
| DENV1 NS5EU249493 | DENV1 NS5EU482804 | DENV1 NS5FJ898403 | DENV1 NS5GU131821 |
| DENV1 NS5EU081275 | DENV1 NS5FJ882520 | DENV1 NS5CS479203 | DENV1 NS5GQ199771 |
| DENV1 NS5FJ432748 | DENV1 NS5FJ639689 | DENV1 NS5EU482517 | DENV1 NS5AB195673 |
| DENV1 NS5EU081228 | DENV1 NS5EU677140 | DENV1 NS5EU482609 | DENV1 NS5EU482812 |
| DENV1 NS5EU482810 | DENV1 NS5GQ199832 | DENV1 NS5FJ410266 | DENV1 NS5AF298807 |
| DENV1 NS5GQ199852 | DENV1 NS5FJ639695 | DENV1 NS5EU482493 | DENV1 NS5GU131801 |
| DENV1 NS5GU131923 | DENV1 NS5FJ410244 | DENV1 NS5FJ639674 | DENV1 NS5GU131983 |
| DENV1 NS5GQ199790 | DENV1 NS5FJ898397 | DENV1 NS5FJ639673 | DENV1 NS5EF122232 |
| DENV1 NS5FJ024423 | DENV1 NS5GU131819 | DENV1 NS5AY732482 | DENV1 NS5AB519681 |
| DENV1 NS5FJ882555 | DENV1 NS5GU131823 | DENV1 NS5CS479204 | DENV1 NS5GQ199814 |
| DENV1 NS5FJ898405 | DENV1 NS5FJ882543 | DENV1 NS5EU482819 | DENV1 NS5AY726552 |
| DENV1 NS5GU131889 | DENV1 NS5GU131715 | DENV1 NS5FJ882570 | DENV1 NS5EU482484 |
| DENV1 NS5GQ868499 | DENV1 NS5EU677156 | DENV1 NS5AF514885 | DENV1 NS5AY722803 |
| DENV1 NS5EU482501 | DENV1 NS5FJ461317 | DENV1 NS5GU131802 | DENV1 NS5GU131787 |
| DENV1 NS5GU131775 | DENV1 NS5GU131794 | DENV1 NS5FJ687427 | DENV1 NS5FJ373296 |
| DENV1 NS5EU081246 | DENV1 NS5FJ461341 | DENV1 NS5FJ182033 | DENV1 NS5GU131887 |
| DENV1 NS5GQ199773 | DENV1 NS5EU482511 | DENV1 NS5GQ199800 | DENV1 NS5GU131741 |
| DENV1 NS5FJ898431 | DENV1 NS5FJ024453 | DENV1 NS5GU131702 | DENV1 NS5EU677178 |
| DENV1 NS5EU081231 | DENV1 NS5GU131749 | DENV1 NS5FJ432723 | DENV1 NS5FJ898433 |
| DENV1 NS5EU482486 | DENV1 NS5FJ898389 | DENV1 NS5EU482505 | DENV1 NS5FJ024443 |
| DENV1 NS5FJ410187 | DENV1 NS5GU131696 | DENV1 NS5FJ882532 | DENV1 NS5FJ461336 |
| DENV1 NS5FN429881 | DENV1 NS5EU482508 | DENV1 NS5AF514878 | DENV1 NS5GQ199858 |
| DENV1 NS5GU131764 | DENV1 NS5EU081265 | DENV1 NS5FJ882540 | DENV1 NS5EU482820 |
| DENV1 NS5GQ868569 | DENV1 NS5FJ410247 | DENV1 NS5GU131703 | DENV1 NS5EU482478 |
| DENV1 NS5GQ868612 | DENV1 NS5FJ461307 | DENV1 NS5FJ410190 | DENV1 NS5GU131815 |
| DENV1 NS5FJ461331 | DENV1 NS5GQ868560 | DENV1 NS5GQ868564 | DENV1 NS5GQ199834 |
| DENV1 NS5FJ410282 | DENV1 NS5FJ461319 | DENV1 NS5GU131717 | DENV1 NS5GU131743 |
| DENV1 NS5FJ205872 | DENV1 NS5FJ898412 | DENV1 NS5EU081273 | DENV1 NS5GQ868614 |
| DENV1 NS5GQ199809 | DENV1 NS5GQ868521 | DENV1 NS5GQ199846 | DENV1 NS5EU482706 |
| DENV1 NS5GU131722 | DENV1 NS5GU131686 | DENV1 NS5AY732483 | DENV1 NS5FJ562101 |
| DENV1 NS5FJ873810 | DENV1 NS5AY732479 | DENV1 NS5CS477263 | DENV1 NS5FB667398 |
| DENV1 NS5FJ882546 | DENV1 NS5FJ384655 | DENV1 NS5EU482496 | DENV1 NS5GU131808 |
| DENV1 NS5FJ639797 | DENV1 NS5FJ882537 | DENV1 NS5FJ410265 | DENV1 NS5GU131780 |
| DENV1 NS5EU677160 | DENV1 NS5FJ898373 | DENV1 NS5GU131720 | DENV1 NS5FJ639671 |
| DENV1 NS5FJ461312 | DENV1 NS5GU131710 | DENV1 NS5FJ461327 | DENV1 NS5FJ390379 |
| DENV1 NS5NC_001477 | DENV1 NS5EU677171 | DENV1 NS5GU370048 | DENV1 NS5FJ024439 |
| DENV1 NS5GQ199841 | DENV1 NS5FJ024479 | DENV1 NS5FJ898409 | DENV1 NS5AF350498 |
| DENV1 NS5FJ882534 | DENV1 NS5FJ687431 | DENV1 NS5FJ182024 | DENV1 NS5FJ432747 |
| DENV1 NS5FJ410289 | DENV1 NS5FJ882523 | DENV1 NS5FJ882565 | DENV1 NS5EU482795 |
| DENV1 NS5FJ410179 | DENV1 NS5FJ547065 | DENV1 NS5GU131966 | DENV1 NS5FJ639678 |
| DENV1 NS5FJ432719 | DENV1 NS5GU131791 | DENV1 NS5EU249490 | DENV1 NS5EU482617 |
| DENV1 NS5AY277666 | DENV1 NS5GU131894 | DENV1 NS5AF514876 | DENV1 NS5FJ410287 |
| DENV1 NS5GU131727 | DENV1 NS5EU482490 | DENV1 NS5FN429885 | DENV1 NS5FJ024444 |
| DENV1 NS5FJ024462 | DENV1 NS5EU482521 | DENV1 NS5EU081272 | DENV1 NS5EU482799 |
| DENV1 NS5FJ024441 | DENV1 NS5FJ898423 | DENV1 NS5GU131841 | DENV1 NS5GU131750 |

FIG. 66-117

| Virus Protein Accession No. | Virus Protein Accession No. | Virus Protein Accession No. | Virus Protein Accession No. |
|---|---|---|---|
| DENV1 NS5FJ906963 | DENV1 NS5AY762084 | DENV1 prMFJ639806 | DENV1 prMEU280167 |
| DENV1 NS5FJ410185 | DENV1 NS5GQ868602 | DENV1 prMGQ199837 | DENV1 prMFJ850084 |
| DENV1 NS5EU660412 | DENV1 NS5GQ868532 | DENV1 prMAB189120 | DENV1 prMEU482514 |
| DENV1 NS5GU131779 | DENV1 NS5EF025110 | DENV1 prMEU081235 | DENV1 prMAY722802 |
| DENV1 NS5FJ639691 | DENV1 NS5GQ868528 | DENV1 prMFJ410263 | DENV1 prMFJ639808 |
| DENV1 NS5EU677165 | DENV1 NS5GU131694 | DENV1 prMAY713476 | DENV1 prMEU482526 |
| DENV1 NS5GU131773 | DENV1 NS5EU482489 | DENV1 prMGQ199806 | DENV1 prMAY732476 |
| DENV1 NS5FJ882517 | DENV1 NS5FJ850068 | DENV1 prMGU131693 | DENV1 prMGU131772 |
| DENV1 NS5FJ410230 | DENV1 NS5FJ898400 | DENV1 prMGU131753 | DENV1 prMFJ882530 |
| DENV1 NS5FJ410211 | DENV1 NS5GU131968 | DENV1 prMGU131711 | DENV1 prMGU131978 |
| DENV1 NS5FJ850070 | DENV1 NS5GQ868615 | DENV1 prMFJ639812 | DENV1 prMAY277659 |
| DENV1 NS5FJ024460 | DENV1 NS5FJ882567 | DENV1 prMGU131765 | DENV1 prMFJ547088 |
| DENV1 NS5GQ868562 | DENV1 NS5DQ672558 | DENV1 prMFJ432744 | DENV1 prMFJ898374 |
| DENV1 NS5FJ882529 | DENV1 NS5EU677151 | DENV1 prMGM059691 | DENV1 prMGQ868504 |
| DENV1 NS5FJ639687 | DENV1 NS5AB204803 | DENV1 prMFJ410278 | DENV1 prMFJ882550 |
| DENV1 NS5GU131684 | DENV1 NS5FJ182018 | DENV1 prMEU081261 | DENV1 prMFJ850113 |
| DENV1 NS5FJ205876 | DENV1 NS5EU482809 | DENV1 prMEU482801 | DENV1 prMGU131980 |
| DENV1 NS5FJ410205 | DENV1 NS5FJ687433 | DENV1 prMFJ882526 | DENV1 prMGU131783 |
| DENV1 NS5FJ478458 | DENV1 NS5FJ410277 | DENV1 prMFJ639823 | DENV1 prMAY732474 |
| DENV1 NS5EU677158 | DENV1 NS5GQ868502 | DENV1 prMEU081260 | DENV1 prMGU131958 |
| DENV1 NS5EU482532 | DENV1 NS5FJ461310 | DENV1 prMGQ199786 | DENV1 prMFJ898393 |
| DENV1 NS5FJ410242 | DENV1 NS5FJ898375 | DENV1 prMAY726550 | DENV1 prMEU677176 |
| DENV1 NS5EU482619 | DENV1 NS5GU131835 | DENV1 prMFJ882558 | DENV1 prMFJ850104 |
| DENV1 NS5FJ410235 | DENV1 NS5FJ390386 | DENV1 prMGU131809 | DENV1 prMEU249492 |
| DENV1 NS5FJ898395 | DENV1 NS5EU482518 | DENV1 prMFJ182030 | DENV1 prMEU482712 |
| DENV1 NS5GU131949 | DENV1 NS5FJ898414 | DENV1 prMEU482816 | DENV1 prMFJ410236 |
| DENV1 NS5AY732477 | DENV1 NS5EU482717 | DENV1 prMGU131813 | DENV1 prMFJ410192 |
| DENV1 NS5EU596503 | DENV1 NS5DQ672557 | DENV1 prMEU482808 | DENV1 prMEU081281 |
| DENV1 NS5GQ199851 | DENV1 NS5GQ199877 | DENV1 prMEU482498 | DENV1 prMFJ432729 |
| DENV1 NS5GU131796 | DENV1 NS5GU131719 | DENV1 prMFJ882525 | DENV1 prMGQ868525 |
| DENV1 NS5EU081252 | DENV1 NS5EU482817 | DENV1 prMGU131731 | DENV1 prMFN429883 |
| DENV1 NS5GU131712 | DENV1 NS5FJ410254 | DENV1 prMGQ199794 | DENV1 prMGQ199828 |
| DENV1 NS5EU081249 | DENV1 NS5EU482507 | DENV1 prMGU131832 | DENV1 prMFJ182021 |
| DENV1 NS5GU131730 | DENV1 NS5FJ410274 | DENV1 prMEU848545 | DENV1 prMEU482824 |
| DENV1 NS5GQ199795 | DENV1 NS5FJ898387 | DENV1 prMGU131760 | DENV1 prMGU131956 |
| DENV1 NS5GQ199807 | DENV1 NS5GQ868514 | DENV1 prMGU131965 | DENV1 prMEU482797 |
| DENV1 NS5GU131817 | DENV1 NS5GU131705 | DENV1 prMFJ898415 | DENV1 prMFJ410213 |
| DENV1 NS5FJ024455 | DENV1 NS5FJ432738 | DENV1 prMGU131782 | DENV1 prMFJ898384 |
| DENV1 NS5GU131766 | DENV1 NS5FJ639681 | DENV1 prMGQ868535 | DENV1 prMFJ410186 |
| DENV1 NS5GU056031 | DENV1 NS5EU482513 | DENV1 prMEU482524 | DENV1 prMGQ868538 |
| DENV1 NS5GU131786 | DENV1 NS5EU081240 | DENV1 prMGU131726 | DENV1 prMEU677163 |
| DENV1 NS5FJ410207 | DENV1 prMFJ639670 | DENV1 prMGQ868501 | DENV1 prMFJ432742 |
| DENV1 NS5EU726781 | DENV1 prMFJ024446 | DENV1 prMFJ432734 | DENV1 prMFJ461303 |
| DENV1 NS5FJ182035 | DENV1 prMGU131759 | DENV1 prMFJ410253 | DENV1 prMFJ639679 |
| DENV1 NS5FJ882545 | DENV1 prMFJ882560 | DENV1 prMFJ410281 | DENV1 prMFJ469909 |
| DENV1 NS5FJ410222 | DENV1 prMGU131838 | DENV1 prMEU482708 | DENV1 prMEU081227 |
| DENV1 NS5EU660401 | DENV1 prMFJ024437 | DENV1 prMGQ199784 | DENV1 prMEU482534 |
| DENV1 NS5FJ639824 | DENV1 prMGQ868639 | DENV1 prMGQ868567 | DENV1 prMFJ410261 |

FIG. 66-118

| Virus | Protein Accession No. | Virus | Protein Accession No. | Virus | Protein Accession No. | Virus | Protein Accession No. |
|---|---|---|---|---|---|---|---|
| DENV1 | prMFJ687428 | DENV1 | prMFJ410183 | DENV1 | prMGU131807 | DENV1 | prMFJ850075 |
| DENV1 | prMEU660392 | DENV1 | prMGQ199875 | DENV1 | prMGQ868533 | DENV1 | prMFJ850100 |
| DENV1 | prMGQ199815 | DENV1 | prMGQ199845 | DENV1 | prMFJ898390 | DENV1 | prMGU131709 |
| DENV1 | prMEU482611 | DENV1 | prMGU131689 | DENV1 | prMEU081259 | DENV1 | prMGQ199848 |
| DENV1 | prMFJ639821 | DENV1 | prMFJ461323 | DENV1 | prMEU482806 | DENV1 | prMFJ024429 |
| DENV1 | prMFJ410174 | DENV1 | prMFJ432740 | DENV1 | prMFJ373298 | DENV1 | prMFJ461315 |
| DENV1 | prMGU131706 | DENV1 | prMAY713474 | DENV1 | prMFJ898382 | DENV1 | prMEU677154 |
| DENV1 | prMAY373427 | DENV1 | prMGQ199789 | DENV1 | prMFJ410250 | DENV1 | prMGU056033 |
| DENV1 | prMEU249495 | DENV1 | prMGU131977 | DENV1 | prMFJ410226 | DENV1 | prMFN429890 |
| DENV1 | prMEU482477 | DENV1 | prMFJ850069 | DENV1 | prMGU131785 | DENV1 | prMEU482822 |
| DENV1 | prMEU482826 | DENV1 | prMEF457905 | DENV1 | prMGU131842 | DENV1 | prMGU131746 |
| DENV1 | prMGQ199843 | DENV1 | prMFJ898421 | DENV1 | prMGU131836 | DENV1 | prMFJ390382 |
| DENV1 | prMGQ199821 | DENV1 | prMFJ744701 | DENV1 | prMGQ199824 | DENV1 | prMGU131724 |
| DENV1 | prMGU131777 | DENV1 | prMGQ199788 | DENV1 | prMAY277657 | DENV1 | prMEU677161 |
| DENV1 | prMFJ898378 | DENV1 | prMEU726778 | DENV1 | prMEU482790 | DENV1 | prMEU482536 |
| DENV1 | prMFJ461306 | DENV1 | prMEU081263 | DENV1 | prMEU081257 | DENV1 | prMGU131713 |
| DENV1 | prMGU131707 | DENV1 | prMFJ205874 | DENV1 | prMFJ024449 | DENV1 | prMGU131721 |
| DENV1 | prMAF226686 | DENV1 | prMGU131826 | DENV1 | prMFJ024430 | DENV1 | prMEU660397 |
| DENV1 | prMEU677152 | DENV1 | prMFJ898407 | DENV1 | prMEU482815 | DENV1 | prMFJ906965 |
| DENV1 | prMGU131828 | DENV1 | prMGQ199804 | DENV1 | prMFJ898398 | DENV1 | prMEU081280 |
| DENV1 | prMGU131971 | DENV1 | prMFJ024478 | DENV1 | prMEU482530 | DENV1 | prMFJ639692 |
| DENV1 | prMGQ199826 | DENV1 | prMFJ850102 | DENV1 | prMGQ868636 | DENV1 | prMEU249494 |
| DENV1 | prMEU677168 | DENV1 | prMFJ432721 | DENV1 | prMFJ024459 | DENV1 | prMFJ639819 |
| DENV1 | prMFJ461313 | DENV1 | prMEU660418 | DENV1 | prMGQ868610 | DENV1 | prMEU482529 |
| DENV1 | prMEU081267 | DENV1 | prMEF032590 | DENV1 | prMEU081233 | DENV1 | prMEU482616 |
| DENV1 | prMFJ410175 | DENV1 | prMAY713473 | DENV1 | prMFJ687426 | DENV1 | prMFJ410284 |
| DENV1 | prMFJ182028 | DENV1 | prMGU131700 | DENV1 | prMFJ898404 | DENV1 | prMFJ410181 |
| DENV1 | prMFJ882516 | DENV1 | prMGQ868523 | DENV1 | prMEU081244 | DENV1 | prMFJ461332 |
| DENV1 | prMFJ024456 | DENV1 | prMGQ868522 | DENV1 | prMEU482522 | DENV1 | prMGQ199777 |
| DENV1 | prMAF311956 | DENV1 | prMEU660402 | DENV1 | prMFJ205882 | DENV1 | prMEU081229 |
| DENV1 | prMGU131770 | DENV1 | prMFJ639676 | DENV1 | prMGU131788 | DENV1 | prMFJ410270 |
| DENV1 | prMAY277663 | DENV1 | prMFJ410272 | DENV1 | prMGU131762 | DENV1 | prMGQ199873 |
| DENV1 | prMGU131824 | DENV1 | prMAY277665 | DENV1 | prMFJ410238 | DENV1 | prMM23027 |
| DENV1 | prMGQ199854 | DENV1 | prMGQ199802 | DENV1 | prMDQ285558 | DENV1 | prMFJ024451 |
| DENV1 | prMFJ898410 | DENV1 | prMFJ882549 | DENV1 | prMFJ898371 | DENV1 | prMGU131739 |
| DENV1 | prMFJ024472 | DENV1 | prMFJ898391 | DENV1 | prMFJ461308 | DENV1 | prMEU482482 |
| DENV1 | prMEU081236 | DENV1 | prMGQ199830 | DENV1 | prMEU482711 | DENV1 | prMFJ024482 |
| DENV1 | prMEU482480 | DENV1 | prMDQ672562 | DENV1 | prMGQ868605 | DENV1 | prMGU131698 |
| DENV1 | prMGU131795 | DENV1 | prMGU131757 | DENV1 | prMGQ868565 | DENV1 | prMFJ024432 |
| DENV1 | prMFJ432736 | DENV1 | prMGQ199839 | DENV1 | prMGQ868608 | DENV1 | prMFJ882556 |
| DENV1 | prMFJ024480 | DENV1 | prMFJ898437 | DENV1 | prMFJ898417 | DENV1 | prMGU131831 |
| DENV1 | prMEU081278 | DENV1 | prMEU081250 | DENV1 | prMFJ024426 | DENV1 | prMAY835999 |
| DENV1 | prMFJ182019 | DENV1 | prMGU131963 | DENV1 | prMGQ868511 | DENV1 | prMGU131922 |
| DENV1 | prMGU131919 | DENV1 | prMFJ410257 | DENV1 | prMFJ882562 | DENV1 | prMFJ898376 |
| DENV1 | prMGU131682 | DENV1 | prMGU131798 | DENV1 | prMGU131752 | DENV1 | prMFJ898425 |
| DENV1 | prMEU482714 | DENV1 | prMGQ868508 | DENV1 | prMS64849 | DENV1 | prMFJ898419 |
| DENV1 | prMFJ410197 | DENV1 | prMEU482789 | DENV1 | prMGQ199811 | DENV1 | prMGQ199799 |
| DENV1 | prMGU131744 | DENV1 | prMU88536 | DENV1 | prMGQ868518 | DENV1 | prMGU056029 |

FIG. 66-119

| Virus Protein Accession No. | Virus Protein Accession No. | Virus Protein Accession No. | Virus Protein Accession No. |
|---|---|---|---|
| DENV1 prMAY145122 | DENV1 prMFJ898388 | DENV1 prMFJ182025 | DENV1 prMD00501 |
| DENV1 prMGU131811 | DENV1 prMGQ868529 | DENV1 prMGU131973 | DENV1 prMGU131776 |
| DENV1 prMEU482495 | DENV1 prMFJ882579 | DENV1 prMEU482811 | DENV1 prMFJ390380 |
| DENV1 prMGQ868506 | DENV1 prMFJ024442 | DENV1 prMFJ410210 | DENV1 prMFJ882547 |
| DENV1 prMGU131961 | DENV1 prMGQ868563 | DENV1 prMGU131925 | DENV1 prMGQ868611 |
| DENV1 prMFJ410269 | DENV1 prMFJ639743 | DENV1 prMFJ373297 | DENV1 prMFJ410231 |
| DENV1 prMGQ199833 | DENV1 prMFJ390378 | DENV1 prMFJ205875 | DENV1 prMGU131680 |
| DENV1 prMEU081238 | DENV1 prMGU131837 | DENV1 prMDQ193572 | DENV1 prMM87512 |
| DENV1 prMGU131748 | DENV1 prMFJ432732 | DENV1 prMU88535 | DENV1 prMFJ024440 |
| DENV1 prMFJ410248 | DENV1 prMGU131840 | DENV1 prMFJ882564 | DENV1 prMGU131774 |
| DENV1 prMGU131733 | DENV1 prMEU677174 | DENV1 prMGQ199774 | DENV1 prMDQ672560 |
| DENV1 prMFJ461325 | DENV1 prMFJ639680 | DENV1 prMGQ199787 | DENV1 prMGQ868512 |
| DENV1 prMGQ199817 | DENV1 prMGQ199849 | DENV1 prMFJ850099 | DENV1 prMFJ024463 |
| DENV1 prMGU131691 | DENV1 prMFJ882566 | DENV1 prMFJ410267 | DENV1 prMEF122231 |
| DENV1 prMGU131804 | DENV1 prMFJ882541 | DENV1 prMEU726777 | DENV1 prMGQ199810 |
| DENV1 prMFJ562106 | DENV1 prMFJ639802 | DENV1 prMEU081241 | DENV1 prMFJ850081 |
| DENV1 prMFJ639682 | DENV1 prMFJ432725 | DENV1 prMFJ898381 | DENV1 prMFJ024427 |
| DENV1 prMGU131792 | DENV1 prMFN429888 | DENV1 prMCS477265 | DENV1 prMGQ868637 |
| DENV1 prMFJ882522 | DENV1 prMEU482492 | DENV1 prMGQ199780 | DENV1 prMFJ639796 |
| DENV1 prMGU131742 | DENV1 prMFJ882557 | DENV1 prMFN429889 | DENV1 prMEU677159 |
| DENV1 prMGU131761 | DENV1 prMAY277660 | DENV1 prMFJ024434 | DENV1 prMFJ882519 |
| DENV1 prMGQ868561 | DENV1 prMFJ639669 | DENV1 prMFJ024483 | DENV1 prMGQ199825 |
| DENV1 prMFJ410245 | DENV1 prMAY277655 | DENV1 prMEU482502 | DENV1 prMEU482525 |
| DENV1 prMGQ868520 | DENV1 prMEU482792 | DENV1 prMGU131962 | DENV1 prMEU482798 |
| DENV1 prMEU482707 | DENV1 prMFJ461340 | DENV1 prMFJ461339 | DENV1 prMFJ182032 |
| DENV1 prMEU482520 | DENV1 prMGU131805 | DENV1 prMEU482821 | DENV1 prMGU131769 |
| DENV1 prMFJ882536 | DENV1 prMFJ410264 | DENV1 prMGU131891 | DENV1 prMGQ199792 |
| DENV1 prMEU081248 | DENV1 prMEU482516 | DENV1 prMEU660403 | DENV1 prMGU131888 |
| DENV1 prMGQ868531 | DENV1 prMFJ469907 | DENV1 prMFJ410275 | DENV1 prMGU131704 |
| DENV1 prMEU482533 | DENV1 prMFJ898396 | DENV1 prMGQ868559 | DENV1 prMGQ199850 |
| DENV1 prMFJ898411 | DENV1 prMEU677157 | DENV1 prMAF298808 | DENV1 prMGQ868526 |
| DENV1 prMGQ199796 | DENV1 prMEU482510 | DENV1 prMFJ410218 | DENV1 prMGU131695 |
| DENV1 prMGU131818 | DENV1 prMFJ182034 | DENV1 prMGQ199775 | DENV1 prMFJ410243 |
| DENV1 prMEU081239 | DENV1 prMFJ898377 | DENV1 prMFJ882552 | DENV1 prMAF309641 |
| DENV1 prMEU081255 | DENV1 prMEU660390 | DENV1 prMFJ898402 | DENV1 prMFJ639686 |
| DENV1 prMEU359008 | DENV1 prMGU131718 | DENV1 prMGQ199859 | DENV1 prMFJ410255 |
| DENV1 prMFJ906964 | DENV1 prMGQ868513 | DENV1 prMFJ410196 | DENV1 prMEU482818 |
| DENV1 prMEU482618 | DENV1 prMFJ639740 | DENV1 prMFJ639690 | DENV1 prMGU131685 |
| DENV1 prMFJ410246 | DENV1 prMFJ882533 | DENV1 prMFJ898383 | DENV1 prMGU131793 |
| DENV1 prMGQ868534 | DENV1 prMGU131926 | DENV1 prMGU131984 | DENV1 prMFN429882 |
| DENV1 prMGQ199835 | DENV1 prMGU131734 | DENV1 prMGQ868498 | DENV1 prMEU482509 |
| DENV1 prMGU131716 | DENV1 prMEU482519 | DENV1 prMEU482487 | DENV1 prMFJ547086 |
| DENV1 prMFJ410256 | DENV1 prMAY206457 | DENV1 prMFJ639818 | DENV1 prMFJ639694 |
| DENV1 prMFJ898424 | DENV1 prMGQ199818 | DENV1 prMEU677166 | DENV1 prMEU482491 |
| DENV1 prMGU131687 | DENV1 prMFJ850077 | DENV1 prMGU131758 | DENV1 prMGU131755 |
| DENV1 prMEU482615 | DENV1 prMAY726553 | DENV1 prMGU131697 | DENV1 prMFJ898430 |
| DENV1 prMFJ410285 | DENV1 prMEU482718 | DENV1 prMEU081247 | DENV1 prMFJ898428 |
| DENV1 prMD00503 | DENV1 prMEU081274 | DENV1 prMAY376738 | DENV1 prMFJ639814 |

FIG. 66-120

| Virus Protein Accession No. | Virus Protein Accession No. | Virus Protein Accession No. | Virus Protein Accession No. |
|---|---|---|---|
| DENV1 prMGU131763 | DENV1 prMAF514883 | DENV1 prMFJ850071 | DENV1 prMGQ199827 |
| DENV1 prMFJ873814 | DENV1 prMEU660395 | DENV1 prMEU081271 | DENV1 prMEU660394 |
| DENV1 prMFJ850093 | DENV1 prMFJ410262 | DENV1 prMAY708047 | DENV1 prMEU482610 |
| DENV1 prMGU131728 | DENV1 prMEU081243 | DENV1 prMEU677169 | DENV1 prMEU179861 |
| DENV1 prMFJ898372 | DENV1 prMCS477264 | DENV1 prMAY277658 | DENV1 prMAB074761 |
| DENV1 prMEU677172 | DENV1 prMFJ562104 | DENV1 prMFJ882535 | DENV1 prMGQ199829 |
| DENV1 prMFJ639794 | DENV1 prMGQ199823 | DENV1 prMFJ547087 | DENV1 prMGU131863 |
| DENV1 prMGQ868527 | DENV1 prMFJ639741 | DENV1 prMEU677164 | DENV1 prMGU131892 |
| DENV1 prMFJ687430 | DENV1 prMGU131690 | DENV1 prMGU131725 | DENV1 prMGQ868530 |
| DENV1 prMFJ639672 | DENV1 prMEU482497 | DENV1 prMDQ285561 | DENV1 prMFJ410173 |
| DENV1 prMFJ410189 | DENV1 prMGU370049 | DENV1 prMGU131678 | DENV1 prMEU482814 |
| DENV1 prMFJ182023 | DENV1 prMGQ868632 | DENV1 prMGU131822 | DENV1 prMEU660393 |
| DENV1 prMFJ410260 | DENV1 prMGQ868613 | DENV1 prMEU482479 | DENV1 prMFJ639815 |
| DENV1 prMEU081266 | DENV1 prMGU131893 | DENV1 prMFJ882518 | DENV1 prMGU131979 |
| DENV1 prMGU131895 | DENV1 prMEU687247 | DENV1 prMFJ639696 | DENV1 prMEU482827 |
| DENV1 prMGU131829 | DENV1 prMEU482813 | DENV1 prMGQ199857 | DENV1 prMFJ461316 |
| DENV1 prMFJ410204 | DENV1 prMAY713475 | DENV1 prMGQ199808 | DENV1 prMFJ882544 |
| DENV1 prMFJ410194 | DENV1 prMFJ024438 | DENV1 prMFJ432749 | DENV1 prMGU131768 |
| DENV1 prMFJ882528 | DENV1 prMFJ882542 | DENV1 prMGU131771 | DENV1 prMEU482567 |
| DENV1 prMFJ432730 | DENV1 prMGU131982 | DENV1 prMGQ199772 | DENV1 prMGU131957 |
| DENV1 prMEU081230 | DENV1 prMFJ461328 | DENV1 prMFJ882538 | DENV1 prMDQ672559 |
| DENV1 prMFJ410206 | DENV1 prMFJ687432 | DENV1 prMFJ410283 | DENV1 prMEU677153 |
| DENV1 prMGU131969 | DENV1 prMFJ410188 | DENV1 prMFJ882521 | DENV1 prMAF226687 |
| DENV1 prMAY732478 | DENV1 prMGQ199813 | DENV1 prMEU726779 | DENV1 prMEU482825 |
| DENV1 prMFJ461330 | DENV1 prMGQ199847 | DENV1 prMEU081253 | DENV1 prMFJ182022 |
| DENV1 prMDQ672556 | DENV1 prMFJ410212 | DENV1 prMFN429886 | DENV1 prMEU482592 |
| DENV1 prMGU131976 | DENV1 prMFJ410232 | DENV1 prMGQ868601 | DENV1 prMEU482800 |
| DENV1 prMFJ410216 | DENV1 prMEU482481 | DENV1 prMFJ182003 | DENV1 prMAY277653 |
| DENV1 prMGQ199801 | DENV1 prMAY726551 | DENV1 prMFJ410286 | DENV1 prMGU131745 |
| DENV1 prMFJ906728 | DENV1 prMFJ639811 | DENV1 prMFJ639684 | DENV1 prMFJ410184 |
| DENV1 prMGU131803 | DENV1 prMGU131800 | DENV1 prMEU482794 | DENV1 prMGQ199778 |
| DENV1 prMAY726555 | DENV1 prMFJ024425 | DENV1 prMAY722801 | DENV1 prMFJ390383 |
| DENV1 prMGQ199798 | DENV1 prMEU482527 | DENV1 prMFJ410199 | DENV1 prMFJ410203 |
| DENV1 prMGU056030 | DENV1 prMEU482500 | DENV1 prMEU482485 | DENV1 prMEU482476 |
| DENV1 prMGU131816 | DENV1 prMEU482828 | DENV1 prMEU482803 | DENV1 prMAY145123 |
| DENV1 prMEU482512 | DENV1 prMFJ205873 | DENV1 prMGU131767 | DENV1 prMEU081270 |
| DENV1 prMFJ882568 | DENV1 prMAY732481 | DENV1 prMAY726549 | DENV1 prMGQ199872 |
| DENV1 prMFJ898413 | DENV1 prMGQ199782 | DENV1 prMFJ176779 | DENV1 prMGQ199856 |
| DENV1 prMEU596504 | DENV1 prMEU677150 | DENV1 prMFJ461335 | DENV1 prMAY277662 |
| DENV1 prMFJ410276 | DENV1 prMEU482591 | DENV1 prMFJ898408 | DENV1 prMEU482709 |
| DENV1 prMFJ898386 | DENV1 prMGU131738 | DENV1 prMGQ199844 | DENV1 prMGQ868618 |
| DENV1 prMEU482506 | DENV1 prMFJ024485 | DENV1 prMGU131970 | DENV1 prMGU131699 |
| DENV1 prMGU131736 | DENV1 prMEU677177 | DENV1 prMEU482796 | DENV1 prMFJ182029 |
| DENV1 prMGU131948 | DENV1 prMGU131967 | DENV1 prMEU596502 | DENV1 prMGQ199855 |
| DENV1 prMGU131834 | DENV1 prMGU131814 | DENV1 prMGQ868607 | DENV1 prMFJ882539 |
| DENV1 prMEU482715 | DENV1 prMAJ968413 | DENV1 prMGQ868524 | DENV1 prMFJ410180 |
| DENV1 prMEU482716 | DENV1 prMFJ024436 | DENV1 prMGQ868517 | DENV1 prMGU131806 |
| DENV1 prMFJ850087 | DENV1 prMFJ432746 | DENV1 prMEU081268 | DENV1 prMDQ672564 |

FIG. 66-121

| Virus Protein Accession No. | Virus Protein Accession No. | Virus Protein Accession No. | Virus Protein Accession No. |
|---|---|---|---|
| DENV1 prMFJ410268 | DENV1 prMFJ898406 | DENV1 prMFJ024445 | DENV1 prMFJ562105 |
| DENV1 prMGU131825 | DENV1 prMDQ672563 | DENV1 prMEU081242 | DENV1 prMFJ432745 |
| DENV1 prMFJ850101 | DENV1 prMGQ199793 | DENV1 prMFJ461333 | DENV1 prMAY277664 |
| DENV1 prMFJ182002 | DENV1 prMEU482807 | DENV1 prMGQ868509 | DENV1 prMFJ882559 |
| DENV1 prMGU131683 | DENV1 prMGU131797 | DENV1 prMFJ410209 | DENV1 prMFJ024435 |
| DENV1 prMFJ639685 | DENV1 prMFJ410258 | DENV1 prMGU131839 | DENV1 prMGQ199803 |
| DENV1 prMEU482535 | DENV1 prMEU482802 | DENV1 prMFJ410251 | DENV1 prMFJ461320 |
| DENV1 prMFJ024433 | DENV1 prMGQ868633 | DENV1 prMEU677175 | DENV1 prMFJ850090 |
| DENV1 prMFJ176780 | DENV1 prMAB074760 | DENV1 prMFJ639820 | DENV1 prMEU482528 |
| DENV1 prMFJ373305 | DENV1 prMEU081256 | DENV1 prMGQ199867 | DENV1 prMFJ898448 |
| DENV1 prMFJ410279 | DENV1 prMFJ432735 | DENV1 prMFJ024428 | DENV1 prMFJ898420 |
| DENV1 prMEU081279 | DENV1 prMGQ199781 | DENV1 prMEU482537 | DENV1 prMGQ868519 |
| DENV1 prMGU131756 | DENV1 prMDQ285559 | DENV1 prMGU131778 | DENV1 prMFJ432727 |
| DENV1 prMFJ478457 | DENV1 prMFJ182036 | DENV1 prMFJ024464 | DENV1 prMEU677155 |
| DENV1 prMFJ024457 | DENV1 prMFJ547089 | DENV1 prMGU131972 | DENV1 prMEU677162 |
| DENV1 prMAB189121 | DENV1 prMFJ898416 | DENV1 prMGQ868606 | DENV1 prMGU131692 |
| DENV1 prMDQ285562 | DENV1 prMGU131960 | DENV1 prMGU131679 | DENV1 prMEU596501 |
| DENV1 prMFJ850103 | DENV1 prMGU131820 | DENV1 prMGU131708 | DENV1 prMFJ410273 |
| DENV1 prMEU482499 | DENV1 prMEU677170 | DENV1 prMEU687251 | DENV1 prMFJ410182 |
| DENV1 prMGQ199805 | DENV1 prMFJ882531 | DENV1 prMAF226685 | DENV1 prMGQ199791 |
| DENV1 prMGQ868568 | DENV1 prMAF514889 | DENV1 prMFJ882561 | DENV1 prMGQ868630 |
| DENV1 prMFJ547068 | DENV1 prMEU863650 | DENV1 prMEU482488 | DENV1 prMEU482503 |
| DENV1 prMEU081234 | DENV1 prMFB667403 | DENV1 prMFJ410214 | DENV1 prMFB730116 |
| DENV1 prMFJ432739 | DENV1 prMGU131714 | DENV1 prMFJ687429 | DENV1 prMFJ410198 |
| DENV1 prMGQ199816 | DENV1 prMAY277656 | DENV1 prMFJ898379 | DENV1 prMEU081276 |
| DENV1 prMFJ898401 | DENV1 prMFJ882569 | DENV1 prMGU131790 | DENV1 prMEF440432 |
| DENV1 prMGU131812 | DENV1 prMFJ410280 | DENV1 prMEU482540 | DENV1 prMFJ461324 |
| DENV1 prMEU660419 | DENV1 prMFJ882548 | DENV1 prMGU131681 | DENV1 prMAF311958 |
| DENV1 prMGQ199831 | DENV1 prMFJ859029 | DENV1 prMEU081226 | DENV1 prMFJ639813 |
| DENV1 prMAY732475 | DENV1 prMGU131781 | DENV1 prMFJ182020 | DENV1 prMAF180817 |
| DENV1 prMEU249491 | DENV1 prMFJ410252 | DENV1 prMAY277654 | DENV1 prMEU081277 |
| DENV1 prMGU131833 | DENV1 prMEU081262 | DENV1 prMFJ882524 | DENV1 prMFJ898426 |
| DENV1 prMGQ199836 | DENV1 prMGQ199842 | DENV1 prMEU677139 | DENV1 prMGU131729 |
| DENV1 prMFJ410240 | DENV1 prMEU726782 | DENV1 prMGU131920 | DENV1 prMGQ868539 |
| DENV1 prMFJ410225 | DENV1 prMGQ868537 | DENV1 prMGQ868536 | DENV1 prMAY145121 |
| DENV1 prMGU131732 | DENV1 prMGQ199797 | DENV1 prMGQ199776 | DENV1 prMEU677167 |
| DENV1 prMFJ639677 | DENV1 prMFJ882515 | DENV1 prMFJ390381 | DENV1 prMFJ898422 |
| DENV1 prMFJ810419 | DENV1 prMFJ024450 | DENV1 prMGU131751 | DENV1 prMFJ744702 |
| DENV1 prMGU056032 | DENV1 prMGU131723 | DENV1 prMFJ390388 | DENV1 prMGQ199838 |
| DENV1 prMFJ390374 | DENV1 prMGQ868503 | DENV1 prMEU482823 | DENV1 prMGQ199779 |
| DENV1 prMFJ882527 | DENV1 prMFJ882551 | DENV1 prMFJ850073 | DENV1 prMFJ205883 |
| DENV1 prMGU131830 | DENV1 prMFJ461318 | DENV1 prMEU081237 | DENV1 prMGQ868635 |
| DENV1 prMEU482791 | DENV1 prMFJ898418 | DENV1 prMEU482483 | DENV1 prMDQ285560 |
| DENV1 prMFJ898427 | DENV1 prMGQ199820 | DENV1 prMGQ199853 | DENV1 prMFJ410239 |
| DENV1 prMFJ410234 | DENV1 prMAF513110 | DENV1 prMGU131921 | DENV1 prMFJ882554 |
| DENV1 prMEU482494 | DENV1 prMFJ410191 | DENV1 prMFJ182031 | DENV1 prMGU131747 |
| DENV1 prMFJ432720 | DENV1 prMFJ024431 | DENV1 prMFJ639683 | DENV1 prMFJ024481 |
| DENV1 prMFJ639735 | DENV1 prMFJ898394 | DENV1 prMGU131740 | DENV1 prMFJ639675 |

FIG. 66-122

| Virus Protein Accession No. | Virus Protein Accession No. | Virus Protein Accession No. | Virus Protein Accession No. |
|---|---|---|---|
| DENV1 prMS75335 | DENV1 prMGU131981 | DENV1 prMFJ898431 | DENV1 prMEU482511 |
| DENV1 prMGU131810 | DENV1 prMEU660391 | DENV1 prMEU081231 | DENV1 prMFJ024453 |
| DENV1 prMFJ410249 | DENV1 prMEU482515 | DENV1 prMEU482486 | DENV1 prMGU131749 |
| DENV1 prMDQ672561 | DENV1 prMEU081232 | DENV1 prMFJ410187 | DENV1 prMFJ898389 |
| DENV1 prMFJ810415 | DENV1 prMGQ199840 | DENV1 prMFN429881 | DENV1 prMGU131696 |
| DENV1 prMGQ199785 | DENV1 prMEU482710 | DENV1 prMGU131764 | DENV1 prMEU482508 |
| DENV1 prMFJ410220 | DENV1 prMGQ868566 | DENV1 prMGQ868569 | DENV1 prMEU081265 |
| DENV1 prMEU482504 | DENV1 prMGU131964 | DENV1 prMGQ868612 | DENV1 prMFJ410247 |
| DENV1 prMFJ205881 | DENV1 prMEU482713 | DENV1 prMD00502 | DENV1 prMFJ461307 |
| DENV1 prMEU081264 | DENV1 prMEU482538 | DENV1 prMFJ461331 | DENV1 prMGQ868560 |
| DENV1 prMGU131688 | DENV1 prMEU081245 | DENV1 prMFJ410282 | DENV1 prMFJ461319 |
| DENV1 prMA75711 | DENV1 prMGQ868619 | DENV1 prMFJ205872 | DENV1 prMFJ898412 |
| DENV1 prMEU081254 | DENV1 prMGU131789 | DENV1 prMGQ199809 | DENV1 prMGQ868521 |
| DENV1 prMFJ898429 | DENV1 prMAB178040 | DENV1 prMGU131722 | DENV1 prMGU131686 |
| DENV1 prMFJ469908 | DENV1 prMAY732480 | DENV1 prMFJ873810 | DENV1 prMAY732479 |
| DENV1 prMGU131799 | DENV1 prMFJ898385 | DENV1 prMFJ882546 | DENV1 prMFJ384655 |
| DENV1 prMFJ182027 | DENV1 prMFJ639688 | DENV1 prMFJ639797 | DENV1 prMFJ882537 |
| DENV1 prMFJ432737 | DENV1 prMFJ205884 | DENV1 prMEU677160 | DENV1 prMFJ898373 |
| DENV1 prMFJ410201 | DENV1 prMFJ898380 | DENV1 prMFJ461312 | DENV1 prMGU131710 |
| DENV1 prMGU131701 | DENV1 prMFJ182026 | DENV1 prMNC_001477 | DENV1 prMEU677171 |
| DENV1 prMEU081269 | DENV1 prMAF311957 | DENV1 prMGQ199841 | DENV1 prMFJ024479 |
| DENV1 prMGQ199783 | DENV1 prMFJ639693 | DENV1 prMFJ882534 | DENV1 prMFJ687431 |
| DENV1 prMGU131754 | DENV1 prMGU131735 | DENV1 prMFJ410289 | DENV1 prMFJ882523 |
| DENV1 prMEU081251 | DENV1 prMFJ850114 | DENV1 prMFJ410179 | DENV1 prMFJ547065 |
| DENV1 prMFJ432733 | DENV1 prMFJ882563 | DENV1 prMFJ432719 | DENV1 prMGU131791 |
| DENV1 prMFJ024447 | DENV1 prMGQ199812 | DENV1 prMAY277666 | DENV1 prMGU131894 |
| DENV1 prMFJ547063 | DENV1 prMGU131737 | DENV1 prMGU131727 | DENV1 prMEU482490 |
| DENV1 prMEU482523 | DENV1 prMFJ547060 | DENV1 prMFJ024462 | DENV1 prMEU482521 |
| DENV1 prMEU482793 | DENV1 prMGQ199819 | DENV1 prMFJ024441 | DENV1 prMFJ898423 |
| DENV1 prMU88537 | DENV1 prMFJ024484 | DENV1 prMGQ199822 | DENV1 prMEU660396 |
| DENV1 prMFJ898399 | DENV1 prMGQ868500 | DENV1 prMFN429887 | DENV1 prMAF180818 |
| DENV1 prMGQ868609 | DENV1 prMEU249493 | DENV1 prMEU482539 | DENV1 prMAY726554 |
| DENV1 prMEU726780 | DENV1 prMEU081275 | DENV1 prMEU482804 | DENV1 prMFJ898403 |
| DENV1 prMEU482805 | DENV1 prMFJ432748 | DENV1 prMFJ882520 | DENV1 prMCS479203 |
| DENV1 prMGU131784 | DENV1 prMEU081228 | DENV1 prMFJ639689 | DENV1 prMEU482517 |
| DENV1 prMGU131827 | DENV1 prMEU482810 | DENV1 prMEU677140 | DENV1 prMEU482609 |
| DENV1 prMFJ410227 | DENV1 prMGQ199852 | DENV1 prMGQ199832 | DENV1 prMFJ410266 |
| DENV1 prMGQ868505 | DENV1 prMGU131923 | DENV1 prMFJ639695 | DENV1 prMEU482493 |
| DENV1 prMFN429884 | DENV1 prMGQ199790 | DENV1 prMFJ410244 | DENV1 prMFJ639674 |
| DENV1 prMFJ873809 | DENV1 prMFJ024423 | DENV1 prMFJ898397 | DENV1 prMFJ639673 |
| DENV1 prMEU081258 | DENV1 prMFJ882555 | DENV1 prMGU131819 | DENV1 prMAY732482 |
| DENV1 prMEU677173 | DENV1 prMFJ898405 | DENV1 prMGU131823 | DENV1 prMCS479204 |
| DENV1 prMFJ898392 | DENV1 prMGU131889 | DENV1 prMFJ882543 | DENV1 prMEU482819 |
| DENV1 prMFJ024448 | DENV1 prMGQ868499 | DENV1 prMGU131715 | DENV1 prMFJ882570 |
| DENV1 prMGQ868507 | DENV1 prMEU482501 | DENV1 prMEU677156 | DENV1 prMAF514885 |
| DENV1 prMEU482531 | DENV1 prMGU131775 | DENV1 prMFJ461317 | DENV1 prMGU131802 |
| DENV1 prMGQ868510 | DENV1 prMEU081246 | DENV1 prMGU131794 | DENV1 prMFJ687427 |
| DENV1 prMFJ410290 | DENV1 prMGQ199773 | DENV1 prMFJ461341 | DENV1 prMFJ182033 |

FIG. 66-123

| Virus Protein Accession No. | Virus Protein Accession No. | Virus Protein Accession No. | Virus Protein Accession No. |
|---|---|---|---|
| DENV1 prMEF441282 | DENV1 prMGU131787 | DENV1 prMGU131684 | DENV1 prMFJ182018 |
| DENV1 prMGQ199800 | DENV1 prMFJ373296 | DENV1 prMFJ205876 | DENV1 prMEU482809 |
| DENV1 prMGU131702 | DENV1 prMGU131887 | DENV1 prMFJ410205 | DENV1 prMFJ687433 |
| DENV1 prMFJ432723 | DENV1 prMGU131741 | DENV1 prMFJ478458 | DENV1 prMAY277652 |
| DENV1 prMEU482505 | DENV1 prMEU677178 | DENV1 prMEU677158 | DENV1 prMFJ410277 |
| DENV1 prMFJ882532 | DENV1 prMFJ898433 | DENV1 prMEU482532 | DENV1 prMGQ868502 |
| DENV1 prMAF514878 | DENV1 prMFJ024443 | DENV1 prMFJ410242 | DENV1 prMFJ461310 |
| DENV1 prMFJ882540 | DENV1 prMFJ461336 | DENV1 prMEU482619 | DENV1 prMFJ898375 |
| DENV1 prMGU131703 | DENV1 prMGQ199858 | DENV1 prMFJ410235 | DENV1 prMAY858983 |
| DENV1 prMFJ410190 | DENV1 prMEU482820 | DENV1 prMFJ898395 | DENV1 prMGU131835 |
| DENV1 prMGQ868564 | DENV1 prMEU482478 | DENV1 prMGU131949 | DENV1 prMFJ390386 |
| DENV1 prMGU131717 | DENV1 prMGU131815 | DENV1 prMAY732477 | DENV1 prMEU482518 |
| DENV1 prMEU081273 | DENV1 prMGQ199834 | DENV1 prMEU596503 | DENV1 prMFJ898414 |
| DENV1 prMGQ199846 | DENV1 prMGU131743 | DENV1 prMGQ199851 | DENV1 prMEU482717 |
| DENV1 prMAY732483 | DENV1 prMGQ868614 | DENV1 prMGU131796 | DENV1 prMDQ672557 |
| DENV1 prMCS477263 | DENV1 prMEU482706 | DENV1 prMEU081252 | DENV1 prMGQ199877 |
| DENV1 prMEU482496 | DENV1 prMAY376737 | DENV1 prMGU131712 | DENV1 prMGU131719 |
| DENV1 prMFJ410265 | DENV1 prMFJ562101 | DENV1 prMEU081249 | DENV1 prMEU482817 |
| DENV1 prMGU131720 | DENV1 prMFB667398 | DENV1 prMGU131730 | DENV1 prMFJ410254 |
| DENV1 prMAY277661 | DENV1 prMGU131808 | DENV1 prMGQ199795 | DENV1 prMEU482507 |
| DENV1 prMFJ461327 | DENV1 prMGU131780 | DENV1 prMGQ199807 | DENV1 prMFJ410274 |
| DENV1 prMGU370048 | DENV1 prMFJ639671 | DENV1 prMGU131817 | DENV1 prMFJ898387 |
| DENV1 prMFJ898409 | DENV1 prMFJ390379 | DENV1 prMFJ024455 | DENV1 prMGQ868514 |
| DENV1 prMFJ182024 | DENV1 prMFJ024439 | DENV1 prMGU131766 | DENV1 prMGU131705 |
| DENV1 prMFJ882565 | DENV1 prMAF350498 | DENV1 prMGU056031 | DENV1 prMFJ432738 |
| DENV1 prMGU131966 | DENV1 prMFJ432747 | DENV1 prMGU131786 | DENV1 prMFJ639681 |
| DENV1 prMEU249490 | DENV1 prMEU482795 | DENV1 prMFJ410207 | DENV1 prMEU482513 |
| DENV1 prMAF514876 | DENV1 prMFJ639678 | DENV1 prMEU726781 | DENV1 prMEU081240 |
| DENV1 prMFN429885 | DENV1 prMEU482617 | DENV1 prMFJ182035 | DENV1 prMAY277659 |
| DENV1 prMEU081272 | DENV1 prMFJ410287 | DENV1 prMFJ882545 | DENV1 prMAY277663 |
| DENV1 prMGU131841 | DENV1 prMFJ024444 | DENV1 prMFJ410222 | DENV1 prMAY277657 |
| DENV1 prMGQ868570 | DENV1 prMEU482799 | DENV1 prMEU660401 | DENV1 prMS64849 |
| DENV1 prMGU131890 | DENV1 prMGU131750 | DENV1 prMFJ639824 | DENV1 prMM23027 |
| DENV1 prMFJ882553 | DENV1 prMFJ906963 | DENV1 prMAY762084 | DENV1 prMD00503 |
| DENV1 prMGU131821 | DENV1 prMFJ410185 | DENV1 prMGQ868602 | DENV1 prMAY277660 |
| DENV1 prMGQ199771 | DENV1 prMEU660412 | DENV1 prMGQ868532 | DENV1 prMAY277655 |
| DENV1 prMAB195673 | DENV1 prMGU131779 | DENV1 prMEF025110 | DENV1 prMD00501 |
| DENV1 prMEU482812 | DENV1 prMFJ639691 | DENV1 prMGQ868528 | DENV1 prMAY277658 |
| DENV1 prMAF298807 | DENV1 prMEU677165 | DENV1 prMGU131694 | DENV1 prMAY277653 |
| DENV1 prMGU131801 | DENV1 prMGU131773 | DENV1 prMEU482489 | DENV1 prMAY277662 |
| DENV1 prMGU131983 | DENV1 prMFJ882517 | DENV1 prMFJ850068 | DENV1 prMAY277656 |
| DENV1 prMEF122232 | DENV1 prMFJ410230 | DENV1 prMFJ898400 | DENV1 prMAY277654 |
| DENV1 prMAB519681 | DENV1 prMFJ410211 | DENV1 prMGU131968 | DENV1 prMEF440432 |
| DENV1 prMGQ199814 | DENV1 prMFJ850070 | DENV1 prMGQ868615 | DENV1 prMS75335 |
| DENV1 prMAY726552 | DENV1 prMFJ024460 | DENV1 prMFJ882567 | DENV1 prMD00502 |
| DENV1 prMDQ836632 | DENV1 prMGQ868562 | DENV1 prMDQ672558 | DENV1 prMEF441282 |
| DENV1 prMEU482484 | DENV1 prMFJ882529 | DENV1 prMEU677151 | DENV1 prMAY277661 |
| DENV1 prMAY722803 | DENV1 prMFJ639687 | DENV1 prMAB204803 | DENV1 prMDQ836632 |

FIG. 66-124

| Virus Protein Accession No. | Virus Protein Accession No. | Virus Protein Accession No. | Virus Protein Accession No. |
|---|---|---|---|
| DENV1 prM AY277652 | DENV1 prM AY277658 | | |
| DENV1 prM AY858983 | DENV1 prM AY277653 | | |
| DENV1 prM AY277659 | DENV1 prM AY277662 | | |
| DENV1 prM AY277663 | DENV1 prM AY277656 | | |
| DENV1 prM AY277657 | DENV1 prM AY277654 | | |
| DENV1 prM S64849 | DENV1 prM EF440432 | | |
| DENV1 prM D00503 | DENV1 prM S75335 | | |
| DENV1 prM AY277660 | DENV1 prM D00502 | | |
| DENV1 prM AY277655 | DENV1 prM EF441282 | | |
| DENV1 prM D00501 | DENV1 prM AY277661 | | |
| DENV1 prM AY277658 | DENV1 prM AY277652 | | |
| DENV1 prM AY277653 | | | |
| DENV1 prM AY277662 | | | |
| DENV1 prM AY277656 | | | |
| DENV1 prM AY277654 | | | |
| DENV1 prM EF440432 | | | |
| DENV1 prM S75335 | | | |
| DENV1 prM D00502 | | | |
| DENV1 prM EF441282 | | | |
| DENV1 prM AY277661 | | | |
| DENV1 prM AY277652 | | | |
| DENV1 prM AY277659 | | | |
| DENV1 prM AY277663 | | | |
| DENV1 prM AY277657 | | | |
| DENV1 prM S64849 | | | |
| DENV1 prM D00503 | | | |
| DENV1 prM AY277660 | | | |
| DENV1 prM AY277655 | | | |
| DENV1 prM D00501 | | | |
| DENV1 prM AY277658 | | | |
| DENV1 prM AY277653 | | | |
| DENV1 prM AY277662 | | | |
| DENV1 prM AY277656 | | | |
| DENV1 prM AY277654 | | | |
| DENV1 prM EF440432 | | | |
| DENV1 prM S75335 | | | |
| DENV1 prM D00502 | | | |
| DENV1 prM EF441282 | | | |
| DENV1 prM AY277661 | | | |
| DENV1 prM AY277652 | | | |
| DENV1 prM AY277659 | | | |
| DENV1 prM AY277663 | | | |
| DENV1 prM AY277657 | | | |
| DENV1 prM S64849 | | | |
| DENV1 prM D00503 | | | |
| DENV1 prM AY277660 | | | |
| DENV1 prM AY277655 | | | |
| DENV1 prM D00501 | | | |

FIG. 67-1

| Virus Protein | Accession No. | Virus Protein | Accession No. | Virus Protein | Accession No. | Virus Protein | Accession No. |
|---|---|---|---|---|---|---|---|
| DENV2 2K | CS479165 | DENV2 2K | EU482775 | DENV2 2K | CS805344 | DENV2 2K | EU482765 |
| DENV2 2K | FJ205877 | DENV2 2K | GQ868620 | DENV2 2K | AY702038 | DENV2 2K | EU596498 |
| DENV2 2K | EU726767 | DENV2 2K | GU131902 | DENV2 2K | FJ467493 | DENV2 2K | CS479167 |
| DENV2 2K | EU482649 | DENV2 2K | GU131947 | DENV2 2K | EU482629 | DENV2 2K | FJ182012 |
| DENV2 2K | FM210221 | DENV2 2K | EU569707 | DENV2 2K | EU482593 | DENV2 2K | EF105381 |
| DENV2 2K | EU482740 | DENV2 2K | M20558 | DENV2 2K | FJ850085 | DENV2 2K | FJ410195 |
| DENV2 2K | EF105388 | DENV2 2K | EU482663 | DENV2 2K | FJ410224 | DENV2 2K | AF204178 |
| DENV2 2K | FJ410259 | DENV2 2K | DQ645543 | DENV2 2K | GQ868625 | DENV2 2K | FJ226066 |
| DENV2 2K | FJ024461 | DENV2 2K | FM210207 | DENV2 2K | EU854293 | DENV2 2K | EU482640 |
| DENV2 2K | DQ181801 | DENV2 2K | FJ873808 | DENV2 2K | EU482675 | DENV2 2K | GQ868592 |
| DENV2 2K | EU482650 | DENV2 2K | FM210203 | DENV2 2K | AY776328 | DENV2 2K | FJ639704 |
| DENV2 2K | EU482724 | DENV2 2K | EU687225 | DENV2 2K | GU370050 | DENV2 2K | EU687212 |
| DENV2 2K | FJ898435 | DENV2 2K | EU596486 | DENV2 2K | FJ850061 | DENV2 2K | AF100462 |
| DENV2 2K | FJ547064 | DENV2 2K | AF100459 | DENV2 2K | EU660413 | DENV2 2K | EU726775 |
| DENV2 2K | EU677144 | DENV2 2K | EU687238 | DENV2 2K | FJ205880 | DENV2 2K | EU677146 |
| DENV2 2K | EU569716 | DENV2 2K | EU482747 | DENV2 2K | EU687199 | DENV2 2K | AF022436 |
| DENV2 2K | EU482752 | DENV2 2K | GU131928 | DENV2 2K | DQ181804 | DENV2 2K | EU482680 |
| DENV2 2K | FJ906967 | DENV2 2K | FM210226 | DENV2 2K | FJ744723 | DENV2 2K | EU482464 |
| DENV2 2K | FJ410241 | DENV2 2K | M84728 | DENV2 2K | EU482686 | DENV2 2K | AF489932 |
| DENV2 2K | FJ639706 | DENV2 2K | FM210230 | DENV2 2K | EU482605 | DENV2 2K | GU131864 |
| DENV2 2K | EU596500 | DENV2 2K | EU482659 | DENV2 2K | GQ199900 | DENV2 2K | FJ390389 |
| DENV2 2K | FJ410208 | DENV2 2K | AJ487271 | DENV2 2K | FJ410221 | DENV2 2K | EU687240 |
| DENV2 2K | FJ906957 | DENV2 2K | EU660399 | DENV2 2K | AF100469 | DENV2 2K | DQ645545 |
| DENV2 2K | EU569702 | DENV2 2K | FJ639832 | DENV2 2K | FJ898461 | DENV2 2K | FJ906959 |
| DENV2 2K | FJ898478 | DENV2 2K | EU569698 | DENV2 2K | EU482550 | DENV2 2K | EU621672 |
| DENV2 2K | FJ882593 | DENV2 2K | EU854294 | DENV2 2K | FM210244 | DENV2 2K | GQ868599 |
| DENV2 2K | EU482763 | DENV2 2K | EU482561 | DENV2 2K | EU179858 | DENV2 2K | EU677138 |
| DENV2 2K | EU482661 | DENV2 2K | GQ868515 | DENV2 2K | EU687227 | DENV2 2K | EU482783 |
| DENV2 2K | M29095 | DENV2 2K | EU482473 | DENV2 2K | EU660417 | DENV2 2K | EU596484 |
| DENV2 2K | EU482585 | DENV2 2K | EU482622 | DENV2 2K | FJ850082 | DENV2 2K | EU569718 |
| DENV2 2K | FJ639711 | DENV2 2K | EU482693 | DENV2 2K | EU596491 | DENV2 2K | FJ639709 |
| DENV2 2K | FJ850067 | DENV2 2K | AY744148 | DENV2 2K | EU482582 | DENV2 2K | AF169688 |
| DENV2 2K | EU482777 | DENV2 2K | EU687249 | DENV2 2K | EU482749 | DENV2 2K | DQ181799 |
| DENV2 2K | FJ898479 | DENV2 2K | EU482761 | DENV2 2K | EU482779 | DENV2 2K | GQ199898 |
| DENV2 2K | AF100463 | DENV2 2K | FJ639837 | DENV2 2K | GQ868623 | DENV2 2K | FJ024458 |
| DENV2 2K | FJ744703 | DENV2 2K | FJ906960 | DENV2 2K | AF169680 | DENV2 2K | FJ687436 |
| DENV2 2K | EU482642 | DENV2 2K | AY702035 | DENV2 2K | U87411 | DENV2 2K | FB667404 |
| DENV2 2K | FJ744718 | DENV2 2K | GQ868590 | DENV2 2K | FM210213 | DENV2 2K | FJ850063 |
| DENV2 2K | EF457904 | DENV2 2K | GQ199896 | DENV2 2K | EU482647 | DENV2 2K | EU482541 |
| DENV2 2K | AF169687 | DENV2 2K | FN429892 | DENV2 2K | AF169681 | DENV2 2K | DQ645554 |
| DENV2 2K | FJ850072 | DENV2 2K | EU482466 | DENV2 2K | EU482548 | DENV2 2K | EU482657 |
| DENV2 2K | EU482445 | DENV2 2K | FJ639697 | DENV2 2K | FJ898439 | DENV2 2K | EU482768 |
| DENV2 2K | EU482598 | DENV2 2K | FM210209 | DENV2 2K | EU482637 | DENV2 2K | AF038402 |
| DENV2 2K | AF359579 | DENV2 2K | AB122022 | DENV2 2K | EU781135 | DENV2 2K | FJ850117 |
| DENV2 2K | GQ199605 | DENV2 2K | EU569697 | DENV2 2K | DQ645548 | DENV2 2K | EU482678 |
| DENV2 2K | EU482639 | DENV2 2K | EU482730 | DENV2 2K | AB189122 | DENV2 2K | EU482698 |
| DENV2 2K | GQ868551 | DENV2 2K | EU482577 | DENV2 2K | FJ810418 | DENV2 2K | FM210202 |
| DENV2 2K | EU569713 | DENV2 2K | FJ390384 | DENV2 2K | GU131896 | DENV2 2K | EU482594 |

FIG. 67-2

| Virus Protein | Accession No. | Virus Protein | Accession No. | Virus Protein | Accession No. | Virus Protein | Accession No. |
|---|---|---|---|---|---|---|---|
| DENV2 2K | FJ898465 | DENV2 2K | EU596497 | DENV2 2K | FJ850091 | DENV2 2K | FJ898450 |
| DENV2 2K | FJ639834 | DENV2 2K | EU482704 | DENV2 2K | FJ639698 | DENV2 2K | EU482570 |
| DENV2 2K | GQ868553 | DENV2 2K | EU569692 | DENV2 2K | FJ850050 | DENV2 2K | FN429894 |
| DENV2 2K | FJ850115 | DENV2 2K | CS477302 | DENV2 2K | AB189124 | DENV2 2K | EU482702 |
| DENV2 2K | EU482627 | DENV2 2K | AF169683 | DENV2 2K | EU482771 | DENV2 2K | EU482743 |
| DENV2 2K | M14970 | DENV2 2K | FM210232 | DENV2 2K | AF276619 | DENV2 2K | EU081179 |
| DENV2 2K | EU482620 | DENV2 2K | FJ898454 | DENV2 2K | EU482766 | DENV2 2K | EU529694 |
| DENV2 2K | FJ744721 | DENV2 2K | EU596483 | DENV2 2K | DQ645549 | DENV2 2K | EU660405 |
| DENV2 2K | EU687220 | DENV2 2K | FJ639700 | DENV2 2K | EU687242 | DENV2 2K | FJ859028 |
| DENV2 2K | EU687236 | DENV2 2K | GQ199892 | DENV2 2K | EU482635 | DENV2 2K | GQ252676 |
| DENV2 2K | FJ687442 | DENV2 2K | M84727 | DENV2 2K | EU687245 | DENV2 2K | FJ850065 |
| DENV2 2K | EU569705 | DENV2 2K | EU677148 | DENV2 2K | AY702039 | DENV2 2K | EU482589 |
| DENV2 2K | EU482780 | DENV2 2K | EU482645 | DENV2 2K | AY744150 | DENV2 2K | EU482641 |
| DENV2 2K | EU687231 | DENV2 2K | FJ639733 | DENV2 2K | EU482734 | DENV2 2K | FJ390385 |
| DENV2 2K | GQ199866 | DENV2 2K | FJ410223 | DENV2 2K | EU726770 | DENV2 2K | EU482784 |
| DENV2 2K | FJ850074 | DENV2 2K | FM210215 | DENV2 2K | FJ850119 | DENV2 2K | EU482727 |
| DENV2 2K | EU081178 | DENV2 2K | FM210210 | DENV2 2K | EU596489 | DENV2 2K | FM210212 |
| DENV2 2K | FJ410215 | DENV2 2K | FJ744708 | DENV2 2K | EU482470 | DENV2 2K | GQ868588 |
| DENV2 2K | DQ645555 | DENV2 2K | FJ024454 | DENV2 2K | EU687222 | DENV2 2K | EU569721 |
| DENV2 2K | EU482652 | DENV2 2K | FJ810409 | DENV2 2K | FJ205885 | DENV2 2K | EU482654 |
| DENV2 2K | FJ432726 | DENV2 2K | EU569695 | DENV2 2K | AB479042 | DENV2 2K | GU369819 |
| DENV2 2K | EU482688 | DENV2 2K | EF105383 | DENV2 2K | EU482748 | DENV2 2K | GQ868541 |
| DENV2 2K | FJ410202 | DENV2 2K | GU131882 | DENV2 2K | GU131924 | DENV2 2K | EU569711 |
| DENV2 2K | GQ868646 | DENV2 2K | EU482697 | DENV2 2K | GQ868640 | DENV2 2K | EU482553 |
| DENV2 2K | EU482575 | DENV2 2K | CS479202 | DENV2 2K | FJ639710 | DENV2 2K | FJ639717 |
| DENV2 2K | FM210246 | DENV2 2K | DQ181805 | DENV2 2K | AF119661 | DENV2 2K | CS477304 |
| DENV2 2K | FJ898449 | DENV2 2K | EF105378 | DENV2 2K | EU482545 | DENV2 2K | FJ687447 |
| DENV2 2K | EU482471 | DENV2 2K | AF022438 | DENV2 2K | EU687215 | DENV2 2K | FM210240 |
| DENV2 2K | FJ744705 | DENV2 2K | FJ639702 | DENV2 2K | FJ898432 | DENV2 2K | EU482672 |
| DENV2 2K | EU482572 | DENV2 2K | EU482729 | DENV2 2K | EU482700 | DENV2 2K | FJ639828 |
| DENV2 2K | GU131885 | DENV2 2K | EU569710 | DENV2 2K | EU482782 | DENV2 2K | EU482691 |
| DENV2 2K | FJ850116 | DENV2 2K | FJ547090 | DENV2 2K | FJ873811 | DENV2 2K | FJ687439 |
| DENV2 2K | FM210218 | DENV2 2K | GU131974 | DENV2 2K | EU482758 | DENV2 2K | GQ199874 |
| DENV2 2K | EU482754 | DENV2 2K | FJ639833 | DENV2 2K | GQ868624 | DENV2 2K | EU687217 |
| DENV2 2K | EU482756 | DENV2 2K | FJ410228 | DENV2 2K | FJ744715 | DENV2 2K | EU482731 |
| DENV2 2K | DQ181806 | DENV2 2K | FM210242 | DENV2 2K | FJ639783 | DENV2 2K | EU529706 |
| DENV2 2K | FB730117 | DENV2 2K | FM210228 | DENV2 2K | EU081177 | DENV2 2K | EU482656 |
| DENV2 2K | EU482737 | DENV2 2K | FJ390387 | DENV2 2K | FM210222 | DENV2 2K | EU482543 |
| DENV2 2K | AB122020 | DENV2 2K | EU482608 | DENV2 2K | EU569703 | DENV2 2K | EU482732 |
| DENV2 2K | EU482636 | DENV2 2K | EU482447 | DENV2 2K | EU482667 | DENV2 2K | EU482643 |
| DENV2 2K | EU482557 | DENV2 2K | FJ410291 | DENV2 2K | DQ645540 | DENV2 2K | DQ645542 |
| DENV2 2K | EU482701 | DENV2 2K | GQ199899 | DENV2 2K | FJ410288 | DENV2 2K | EU482695 |
| DENV2 2K | FJ024452 | DENV2 2K | EU482630 | DENV2 2K | GU131930 | DENV2 2K | FJ744745 |
| DENV2 2K | EU569700 | DENV2 2K | FJ687445 | DENV2 2K | AY037116 | DENV2 2K | FM210205 |
| DENV2 2K | EU482580 | DENV2 2K | GQ199890 | DENV2 2K | GQ868549 | DENV2 2K | GQ868622 |
| DENV2 2K | EU482670 | DENV2 2K | EU482651 | DENV2 2K | EU482751 | DENV2 2K | EU660414 |
| DENV2 2K | FJ687437 | DENV2 2K | EU482658 | DENV2 2K | EU482562 | DENV2 2K | FJ461309 |
| DENV2 2K | NC_001474 | DENV2 2K | EU687235 | DENV2 2K | FJ850107 | DENV2 2K | EU482745 |

FIG. 67-3

| Virus Protein | Accession No. | Virus Protein | Accession No. | Virus Protein | Accession No. | Virus Protein | Accession No. |
|---|---|---|---|---|---|---|---|
| DENV2 2K | EU482601 | DENV2 2K | FJ390390 | DENV2 2K | EU482669 | DENV2 2K | FJ639831 |
| DENV2 2K | AY702037 | DENV2 2K | GQ199894 | DENV2 2K | EU529695 | DENV2 2K | EU569708 |
| DENV2 2K | FJ639830 | DENV2 2K | FJ898434 | DENV2 2K | FJ850062 | DENV2 2K | EU482583 |
| DENV2 2K | FM210234 | DENV2 2K | EU482597 | DENV2 2K | GQ199901 | DENV2 2K | EU482444 |
| DENV2 2K | EU482787 | DENV2 2K | FJ906969 | DENV2 2K | EU359009 | DENV2 2K | EU482762 |
| DENV2 2K | EU482632 | DENV2 2K | AF169679 | DENV2 2K | GU131931 | DENV2 2K | EU482662 |
| DENV2 2K | FJ373299 | DENV2 2K | FJ461321 | DENV2 2K | FJ906961 | DENV2 2K | EU569696 |
| DENV2 2K | EU482683 | DENV2 2K | EU687224 | DENV2 2K | EU529700 | DENV2 2K | EU482760 |
| DENV2 2K | EU482569 | DENV2 2K | FJ687440 | DENV2 2K | EU482576 | DENV2 2K | GU131959 |
| DENV2 2K | EU482674 | DENV2 2K | EF105380 | DENV2 2K | EU482703 | DENV2 2K | AB479041 |
| DENV2 2K | FJ478459 | DENV2 2K | AF100467 | DENV2 2K | EU482685 | DENV2 2K | DQ645552 |
| DENV2 2K | FJ850121 | DENV2 2K | EU482753 | DENV2 2K | FM210214 | DENV2 2K | EU482776 |
| DENV2 2K | FJ205879 | DENV2 2K | AF022439 | DENV2 2K | FJ744724 | DENV2 2K | GQ868543 |
| DENV2 2K | FJ687434 | DENV2 2K | AF100460 | DENV2 2K | FM210245 | DENV2 2K | FJ410237 |
| DENV2 2K | EU482450 | DENV2 2K | EU596495 | DENV2 2K | GQ199895 | DENV2 2K | AF169686 |
| DENV2 2K | FJ850053 | DENV2 2K | FJ373301 | DENV2 2K | EU482604 | DENV2 2K | FJ639707 |
| DENV2 2K | EU056811 | DENV2 2K | FJ906962 | DENV2 2K | FM210236 | DENV2 2K | FJ850120 |
| DENV2 2K | EU596487 | DENV2 2K | FJ850105 | DENV2 2K | EU482736 | DENV2 2K | FJ639822 |
| DENV2 2K | EU482626 | DENV2 2K | EU482542 | DENV2 2K | EU482551 | DENV2 2K | EU482699 |
| DENV2 2K | EU482586 | DENV2 2K | AY702036 | DENV2 2K | DQ645546 | DENV2 2K | GQ868552 |
| DENV2 2K | EU482665 | DENV2 2K | AY744147 | DENV2 2K | EU687228 | DENV2 2K | EU660406 |
| DENV2 2K | FJ898452 | DENV2 2K | FM210227 | DENV2 2K | EF105387 | DENV2 2K | EU569715 |
| DENV2 2K | FM210219 | DENV2 2K | FM210231 | DENV2 2K | EU482648 | DENV2 2K | FJ898467 |
| DENV2 2K | EF105385 | DENV2 2K | FN429891 | DENV2 2K | FJ639705 | DENV2 2K | EF051521 |
| DENV2 2K | GQ868596 | DENV2 2K | EU482676 | DENV2 2K | FJ906968 | DENV2 2K | GQ868497 |
| DENV2 2K | FJ744719 | DENV2 2K | GQ868604 | DENV2 2K | AF100464 | DENV2 2K | EU003591 |
| DENV2 2K | FJ744713 | DENV2 2K | GQ868516 | DENV2 2K | EU677145 | DENV2 2K | EU569699 |
| DENV2 2K | EU482475 | DENV2 2K | EU482769 | DENV2 2K | EU596485 | DENV2 2K | EU482547 |
| DENV2 2K | FJ461311 | DENV2 2K | FJ744717 | DENV2 2K | FJ898477 | DENV2 2K | FJ850064 |
| DENV2 2K | GQ868597 | DENV2 2K | EU687213 | DENV2 2K | DQ181803 | DENV2 2K | EU482719 |
| DENV2 2K | GQ199869 | DENV2 2K | FM210239 | DENV2 2K | EU482786 | DENV2 2K | EU482448 |
| DENV2 2K | EU482449 | DENV2 2K | DQ645556 | DENV2 2K | EF105389 | DENV2 2K | EU482720 |
| DENV2 2K | EU482773 | DENV2 2K | EU081180 | DENV2 2K | EU482781 | DENV2 2K | EU687237 |
| DENV2 2K | EU569701 | DENV2 2K | AF204177 | DENV2 2K | EU482638 | DENV2 2K | AB122021 |
| DENV2 2K | EU482738 | DENV2 2K | EU482679 | DENV2 2K | FM210217 | DENV2 2K | EU687248 |
| DENV2 2K | EU482468 | DENV2 2K | EU482472 | DENV2 2K | EF105382 | DENV2 2K | EU482767 |
| DENV2 2K | EU482633 | DENV2 2K | AY858035 | DENV2 2K | FJ744742 | DENV2 2K | DQ181798 |
| DENV2 2K | GU131886 | DENV2 2K | EU596490 | DENV2 2K | GU131897 | DENV2 2K | EU482735 |
| DENV2 2K | EU677141 | DENV2 2K | FJ850051 | DENV2 2K | EU482584 | DENV2 2K | FJ850112 |
| DENV2 2K | GQ868557 | DENV2 2K | EU482446 | DENV2 2K | EU482624 | DENV2 2K | EU569719 |
| DENV2 2K | AJ968413 | DENV2 2K | EU482694 | DENV2 2K | EU482725 | DENV2 2K | EU660398 |
| DENV2 2K | FJ639835 | DENV2 2K | GQ868591 | DENV2 2K | FJ810410 | DENV2 2K | GQ199897 |
| DENV2 2K | EU482579 | DENV2 2K | FJ461305 | DENV2 2K | EU482726 | DENV2 2K | EU482677 |
| DENV2 2K | GU131881 | DENV2 2K | FJ744709 | DENV2 2K | FJ024475 | DENV2 2K | GQ868545 |
| DENV2 2K | GQ868556 | DENV2 2K | GQ199868 | DENV2 2K | FJ744704 | DENV2 2K | EU482621 |
| DENV2 2K | FJ744741 | DENV2 2K | EU660400 | DENV2 2K | EU482599 | DENV2 2K | EU687243 |
| DENV2 2K | FB667399 | DENV2 2K | EU482465 | DENV2 2K | FJ744712 | DENV2 2K | EU482463 |
| DENV2 2K | AF100466 | DENV2 2K | FM210208 | DENV2 2K | EU482681 | DENV2 2K | EU482606 |

FIG. 67-4

| Virus Protein | Accession No. | Virus Protein | Accession No. | Virus Protein | Accession No. | Virus Protein | Accession No. |
|---|---|---|---|---|---|---|---|
| DENV2 2K | DQ645553 | DENV2 2K | FJ182014 | DENV2 2K | FJ410233 | DENV2 2K | EU677137 |
| DENV2 2K | AF038403 | DENV2 2K | FJ562098 | DENV2 2K | GQ868600 | DENV2 2K | EU482744 |
| DENV2 2K | FM210204 | DENV2 2K | FJ913016 | DENV2 2K | GU131898 | DENV2 2K | FJ639701 |
| DENV2 2K | GQ868554 | DENV2 2K | EU482746 | DENV2 2K | AY858036 | DENV2 2K | EU660415 |
| DENV2 2K | DQ448231 | DENV2 2K | EU482646 | DENV2 2K | EU687244 | DENV2 2K | EU482631 |
| DENV2 2K | FJ687443 | DENV2 2K | FJ687444 | DENV2 2K | FJ850066 | DENV2 2K | FJ687435 |
| DENV2 2K | FJ744710 | DENV2 2K | GU131901 | DENV2 2K | EU482556 | DENV2 2K | FJ639836 |
| DENV2 2K | AY702040 | DENV2 2K | GQ868550 | DENV2 2K | FJ744744 | DENV2 2K | AY702034 |
| DENV2 2K | FJ898466 | DENV2 2K | EU482660 | DENV2 2K | FJ639788 | DENV2 2K | EU482696 |
| DENV2 2K | GQ252677 | DENV2 2K | FJ410219 | DENV2 2K | FN429895 | DENV2 2K | FJ687438 |
| DENV2 2K | FJ906966 | DENV2 2K | EU569717 | DENV2 2K | FJ850060 | DENV2 2K | EU596488 |
| DENV2 2K | GU289914 | DENV2 2K | AF022435 | DENV2 2K | EU660404 | DENV2 2K | FM210220 |
| DENV2 2K | FJ744706 | DENV2 2K | EU482788 | DENV2 2K | EU482690 | DENV2 2K | FJ898451 |
| DENV2 2K | EU596496 | DENV2 2K | FJ744743 | DENV2 2K | EU569720 | DENV2 2K | FJ639708 |
| DENV2 2K | EU482560 | DENV2 2K | FJ906956 | DENV2 2K | FJ687441 | DENV2 2K | EU687229 |
| DENV2 2K | EU482723 | DENV2 2K | EU482607 | DENV2 2K | AF169678 | DENV2 2K | EU482739 |
| DENV2 2K | EU482741 | DENV2 2K | EU726776 | DENV2 2K | AF100468 | DENV2 2K | EU569709 |
| DENV2 2K | EU482549 | DENV2 2K | EU687230 | DENV2 2K | EU482722 | DENV2 2K | EU687223 |
| DENV2 2K | EU482573 | DENV2 2K | EU482581 | DENV2 2K | GU131883 | DENV2 2K | EF105386 |
| DENV2 2K | EU482755 | DENV2 2K | EU482600 | DENV2 2K | FM210235 | DENV2 2K | FJ410217 |
| DENV2 2K | FN429893 | DENV2 2K | GU131927 | DENV2 2K | FJ744707 | DENV2 2K | EU482467 |
| DENV2 2K | AF022434 | DENV2 2K | FJ850076 | DENV2 2K | EU482588 | DENV2 2K | FJ461314 |
| DENV2 2K | EU529693 | DENV2 2K | GQ868638 | DENV2 2K | EU677149 | DENV2 2K | GQ868595 |
| DENV2 2K | EU596499 | DENV2 2K | EU482625 | DENV2 2K | FJ639734 | DENV2 2K | GU131932 |
| DENV2 2K | EU482687 | DENV2 2K | GU131843 | DENV2 2K | GQ868555 | DENV2 2K | EU056810 |
| DENV2 2K | AF022440 | DENV2 2K | EU482469 | DENV2 2K | GQ868540 | DENV2 2K | AF022441 |
| DENV2 2K | GU131884 | DENV2 2K | EU482772 | DENV2 2K | AF169682 | DENV2 2K | EU056812 |
| DENV2 2K | EU482757 | DENV2 2K | FM210225 | DENV2 2K | DQ181797 | DENV2 2K | EU482664 |
| DENV2 2K | EU482574 | DENV2 2K | AF100461 | DENV2 2K | FJ687446 | DENV2 2K | EU482568 |
| DENV2 2K | EU482764 | DENV2 2K | EU482668 | DENV2 2K | FJ639829 | DENV2 2K | EU482774 |
| DENV2 2K | FJ478455 | DENV2 2K | GQ868598 | DENV2 2K | FJ898453 | DENV2 2K | FJ547067 |
| DENV2 2K | EU179857 | DENV2 2K | EU529701 | DENV2 2K | EU482721 | DENV2 2K | EU482474 |
| DENV2 2K | FJ024473 | DENV2 2K | EU482451 | DENV2 2K | FJ898460 | DENV2 2K | FJ850118 |
| DENV2 2K | EU660416 | DENV2 2K | FJ882602 | DENV2 2K | FJ898438 | DENV2 2K | EU687216 |
| DENV2 2K | DQ645547 | DENV2 2K | EU482666 | DENV2 2K | EU569712 | DENV2 2K | EU482590 |
| DENV2 2K | GM059692 | DENV2 2K | EU482634 | DENV2 2K | EU687250 | DENV2 2K | AF208496 |
| DENV2 2K | EU569694 | DENV2 2K | DQ645550 | DENV2 2K | FJ432724 | DENV2 2K | EU569693 |
| DENV2 2K | FJ898436 | DENV2 2K | GQ868558 | DENV2 2K | AF022437 | DENV2 2K | FJ850106 |
| DENV2 2K | FM210216 | DENV2 2K | GQ868542 | DENV2 2K | DQ181800 | DENV2 2K | EU482623 |
| DENV2 2K | FM210224 | DENV2 2K | EU569706 | DENV2 2K | EU687241 | DENV2 2K | GU131879 |
| DENV2 2K | EU482778 | DENV2 2K | GQ868631 | DENV2 2K | FJ410200 | DENV2 2K | FM210223 |
| DENV2 2K | FJ810412 | DENV2 2K | EU482628 | DENV2 2K | FJ205878 | DENV2 2K | GQ199893 |
| DENV2 2K | GU131899 | DENV2 2K | FJ850108 | DENV2 2K | GU131955 | DENV2 2K | EU482578 |
| DENV2 2K | FJ639703 | DENV2 2K | EU687214 | DENV2 2K | FJ906958 | DENV2 2K | EU482544 |
| DENV2 2K | EF105384 | DENV2 2K | EU482689 | DENV2 2K | FJ744722 | DENV2 2K | EU482759 |
| DENV2 2K | AB189123 | DENV2 2K | FJ882594 | DENV2 2K | EU482770 | DENV2 2K | FJ744711 |
| DENV2 2K | FM210233 | DENV2 2K | FJ744716 | DENV2 2K | AY744149 | DENV2 2K | EU569704 |
| DENV2 2K | FJ639699 | DENV2 2K | EU482546 | DENV2 2K | EU482655 | DENV2 2K | AF169685 |

FIG. 67-5

| Virus Protein | Accession No. | Virus Protein | Accession No. | Virus Protein | Accession No. | Virus Protein | Accession No. |
|---|---|---|---|---|---|---|---|
| DENV2 2K | EU677147 | DENV2 2K | FJ744725 | DENV2 anC | DQ448233 | DENV2 anC | FJ639832 |
| DENV2 2K | GU370051 | DENV2 2K | GQ868621 | DENV2 anC | FJ898478 | DENV2 anC | EU569698 |
| DENV2 2K | EU482587 | DENV2 2K | EU482653 | DENV2 anC | FJ882593 | DENV2 anC | EU854294 |
| DENV2 2K | DQ645551 | DENV2 2K | FJ024477 | DENV2 anC | EU482763 | DENV2 anC | EU482561 |
| DENV2 2K | FJ390391 | DENV2 2K | U87412 | DENV2 anC | EU482661 | DENV2 anC | GQ868515 |
| DENV2 2K | FJ850054 | DENV2 2K | EU482692 | DENV2 anC | M29095 | DENV2 anC | EU482473 |
| DENV2 2K | EU482565 | DENV2 2K | FM210206 | DENV2 anC | EU482585 | DENV2 anC | EU482622 |
| DENV2 2K | FJ373300 | DENV2 2K | EU482644 | DENV2 anC | FJ639711 | DENV2 anC | EU482693 |
| DENV2 2K | AF169684 | DENV2 2K | GU131975 | DENV2 anC | FJ850067 | DENV2 anC | AY744148 |
| DENV2 2K | DL138662 | DENV2 2K | EU482602 | DENV2 anC | EU482777 | DENV2 anC | EU687249 |
| DENV2 2K | GQ868544 | DENV2 2K | EU482673 | DENV2 anC | FJ898479 | DENV2 anC | EU482761 |
| DENV2 2K | FJ744714 | DENV2 2K | FJ024474 | DENV2 anC | AF100463 | DENV2 anC | FJ639837 |
| DENV2 2K | EU179859 | DENV2 2K | FJ744720 | DENV2 anC | FJ744703 | DENV2 anC | FJ906960 |
| DENV2 2K | DQ645541 | DENV2 2K | FJ639809 | DENV2 anC | EU482642 | DENV2 anC | AY702035 |
| DENV2 2K | AF100465 | DENV2 2K | FJ639718 | DENV2 anC | FJ744718 | DENV2 anC | GQ868590 |
| DENV2 2K | EU687246 | DENV2 2K | DQ181802 | DENV2 anC | EF457904 | DENV2 anC | GQ199896 |
| DENV2 2K | EU482750 | DENV2 2K | FJ810411 | DENV2 anC | AF169687 | DENV2 anC | FN429892 |
| DENV2 2K | GU131900 | DENV2 2K | EU482554 | DENV2 anC | FJ850072 | DENV2 anC | EU482466 |
| DENV2 2K | FM210211 | DENV2 2K | FM210237 | DENV2 anC | EU482445 | DENV2 anC | FJ639697 |
| DENV2 2K | EU482742 | DENV2 2K | EU482603 | DENV2 anC | EU482598 | DENV2 anC | FM210209 |
| DENV2 2K | EU482705 | DENV2 2K | EU482733 | DENV2 anC | AF359579 | DENV2 anC | AB122022 |
| DENV2 2K | EF105390 | DENV2 2K | FJ850088 | DENV2 anC | GQ199605 | DENV2 anC | EU569697 |
| DENV2 2K | EU482684 | DENV2 2K | M14970 | DENV2 anC | EU482639 | DENV2 anC | EU482730 |
| DENV2 2K | EU569714 | DENV2 anC | CS479165 | DENV2 anC | GQ868551 | DENV2 anC | EU482577 |
| DENV2 2K | GQ868589 | DENV2 anC | FJ205877 | DENV2 anC | EU569713 | DENV2 anC | FJ390384 |
| DENV2 2K | FJ850078 | DENV2 anC | EU726767 | DENV2 anC | EU482775 | DENV2 anC | CS805344 |
| DENV2 2K | FM210243 | DENV2 anC | EU482649 | DENV2 anC | GQ868620 | DENV2 anC | AY702038 |
| DENV2 2K | EU482671 | DENV2 anC | FM210221 | DENV2 anC | GU131902 | DENV2 anC | FJ467493 |
| DENV2 2K | EU482571 | DENV2 anC | EU482740 | DENV2 anC | GU131947 | DENV2 anC | EU482629 |
| DENV2 2K | DQ645544 | DENV2 anC | EF105388 | DENV2 anC | EU569707 | DENV2 anC | EU482593 |
| DENV2 2K | FM210238 | DENV2 anC | FJ410259 | DENV2 anC | M20558 | DENV2 anC | FJ850085 |
| DENV2 2K | EF105379 | DENV2 anC | FJ024461 | DENV2 anC | EU482663 | DENV2 anC | FJ410224 |
| DENV2 2K | EU482728 | DENV2 anC | DQ181801 | DENV2 anC | DQ645543 | DENV2 anC | GQ868625 |
| DENV2 2K | FM210229 | DENV2 anC | EU482650 | DENV2 anC | FM210207 | DENV2 anC | EU854293 |
| DENV2 2K | GU131880 | DENV2 anC | EU482724 | DENV2 anC | FJ873808 | DENV2 anC | EU482675 |
| DENV2 2K | M19197 | DENV2 anC | FJ898435 | DENV2 anC | FM210203 | DENV2 anC | AY776328 |
| DENV2 2K | GQ868603 | DENV2 anC | FJ547064 | DENV2 anC | EU687225 | DENV2 anC | GU370050 |
| DENV2 2K | GU131929 | DENV2 anC | EU677144 | DENV2 anC | EU596486 | DENV2 anC | FJ850061 |
| DENV2 2K | FJ639732 | DENV2 anC | EU569716 | DENV2 anC | AF100459 | DENV2 anC | EU660413 |
| DENV2 2K | EU677143 | DENV2 anC | AY692466 | DENV2 anC | EU687238 | DENV2 anC | FJ205880 |
| DENV2 2K | EU482682 | DENV2 anC | EU482752 | DENV2 anC | EU482747 | DENV2 anC | EU687199 |
| DENV2 2K | GQ868641 | DENV2 anC | FJ906967 | DENV2 anC | GU131928 | DENV2 anC | EF440433 |
| DENV2 2K | EU482785 | DENV2 anC | FJ410241 | DENV2 anC | FM210226 | DENV2 anC | DQ181804 |
| DENV2 2K | FJ410193 | DENV2 anC | FJ639706 | DENV2 anC | M84728 | DENV2 anC | FJ744723 |
| DENV2 2K | EU482552 | DENV2 anC | EU596500 | DENV2 anC | FM210230 | DENV2 anC | EU482686 |
| DENV2 2K | EU677142 | DENV2 anC | FJ410208 | DENV2 anC | EU482659 | DENV2 anC | EU482605 |
| DENV2 2K | EU687232 | DENV2 anC | FJ906957 | DENV2 anC | AJ487271 | DENV2 anC | GQ199900 |
| DENV2 2K | FM210241 | DENV2 anC | EU569702 | DENV2 anC | EU660399 | DENV2 anC | FJ410221 |

FIG. 67-6

| Virus Protein Accession No. | Virus Protein Accession No. | Virus Protein Accession No. | Virus Protein Accession No. |
|---|---|---|---|
| DENV2 anC AF100469 | DENV2 anC EU687240 | DENV2 anC EU482688 | DENV2 anC EU569695 |
| DENV2 anC FJ898461 | DENV2 anC DQ645545 | DENV2 anC FJ410202 | DENV2 anC EF105383 |
| DENV2 anC EU482550 | DENV2 anC FJ906959 | DENV2 anC GQ868646 | DENV2 anC GU131882 |
| DENV2 anC FM210244 | DENV2 anC EU621672 | DENV2 anC EU482575 | DENV2 anC X65239 |
| DENV2 anC EU179858 | DENV2 anC GQ868599 | DENV2 anC FM210246 | DENV2 anC EU482697 |
| DENV2 anC EU687227 | DENV2 anC EU677138 | DENV2 anC FJ898449 | DENV2 anC CS479202 |
| DENV2 anC AY692465 | DENV2 anC EU482783 | DENV2 anC EU482471 | DENV2 anC DQ181805 |
| DENV2 anC EU660417 | DENV2 anC EU596484 | DENV2 anC FJ744705 | DENV2 anC EF105378 |
| DENV2 anC FJ850082 | DENV2 anC EU569718 | DENV2 anC EU482572 | DENV2 anC AF022438 |
| DENV2 anC EU596491 | DENV2 anC FJ639709 | DENV2 anC GU131885 | DENV2 anC FJ639702 |
| DENV2 anC EU482582 | DENV2 anC AF169688 | DENV2 anC FJ850116 | DENV2 anC EU482729 |
| DENV2 anC EU482749 | DENV2 anC DQ181799 | DENV2 anC FM210218 | DENV2 anC EU569710 |
| DENV2 anC EU482779 | DENV2 anC GQ199898 | DENV2 anC EU482754 | DENV2 anC FJ547090 |
| DENV2 anC GQ868623 | DENV2 anC FJ024458 | DENV2 anC EU482756 | DENV2 anC GU131974 |
| DENV2 anC AF169680 | DENV2 anC FJ687436 | DENV2 anC DQ181806 | DENV2 anC FJ639833 |
| DENV2 anC U87411 | DENV2 anC FB667404 | DENV2 anC FB730117 | DENV2 anC FJ410228 |
| DENV2 anC FM210213 | DENV2 anC FJ850063 | DENV2 anC EU482737 | DENV2 anC FM210242 |
| DENV2 anC EU482647 | DENV2 anC EU482541 | DENV2 anC AB122020 | DENV2 anC FM210228 |
| DENV2 anC AF169681 | DENV2 anC DQ645554 | DENV2 anC EU482636 | DENV2 anC FJ390387 |
| DENV2 anC EU482548 | DENV2 anC EU482657 | DENV2 anC EU482557 | DENV2 anC EU482608 |
| DENV2 anC FJ898439 | DENV2 anC EU482768 | DENV2 anC EU482701 | DENV2 anC AY692468 |
| DENV2 anC EU482637 | DENV2 anC AF038402 | DENV2 anC FJ024452 | DENV2 anC EU482447 |
| DENV2 anC EU781135 | DENV2 anC AF469175 | DENV2 anC EU569700 | DENV2 anC FJ410291 |
| DENV2 anC DQ645548 | DENV2 anC FJ850117 | DENV2 anC DQ448236 | DENV2 anC GQ199899 |
| DENV2 anC AB189122 | DENV2 anC EU482678 | DENV2 anC EU482580 | DENV2 anC EU482630 |
| DENV2 anC FJ810418 | DENV2 anC EU482698 | DENV2 anC EU482670 | DENV2 anC FJ687445 |
| DENV2 anC GU131896 | DENV2 anC FM210202 | DENV2 anC FJ687437 | DENV2 anC AF360861 |
| DENV2 anC EU482765 | DENV2 anC EU482594 | DENV2 anC NC_001474 | DENV2 anC GQ199890 |
| DENV2 anC EU596498 | DENV2 anC FJ898465 | DENV2 anC EU596497 | DENV2 anC EU482651 |
| DENV2 anC CS479167 | DENV2 anC FJ639834 | DENV2 anC EU482704 | DENV2 anC EU482658 |
| DENV2 anC FJ182012 | DENV2 anC GQ868553 | DENV2 anC EU569692 | DENV2 anC EU687235 |
| DENV2 anC EF105381 | DENV2 anC FJ850115 | DENV2 anC CS477302 | DENV2 anC FJ850091 |
| DENV2 anC FJ410195 | DENV2 anC EU482627 | DENV2 anC AF169683 | DENV2 anC FJ639698 |
| DENV2 anC AF204178 | DENV2 anC EU482620 | DENV2 anC FM210232 | DENV2 anC FJ850050 |
| DENV2 anC FJ226066 | DENV2 anC FJ744721 | DENV2 anC FJ898454 | DENV2 anC AB189124 |
| DENV2 anC EU482640 | DENV2 anC EU687220 | DENV2 anC EU596483 | DENV2 anC EU482771 |
| DENV2 anC GQ868592 | DENV2 anC EU687236 | DENV2 anC FJ639700 | DENV2 anC AF276619 |
| DENV2 anC FJ639704 | DENV2 anC FJ687442 | DENV2 anC GQ199892 | DENV2 anC EU482766 |
| DENV2 anC EU687212 | DENV2 anC EU569705 | DENV2 anC M84727 | DENV2 anC DQ645549 |
| DENV2 anC AF100462 | DENV2 anC EU482780 | DENV2 anC EU677148 | DENV2 anC EU687242 |
| DENV2 anC EU726775 | DENV2 anC EU687231 | DENV2 anC EU482645 | DENV2 anC EU482635 |
| DENV2 anC EU677146 | DENV2 anC GQ199866 | DENV2 anC FJ639733 | DENV2 anC EU687245 |
| DENV2 anC AF022436 | DENV2 anC FJ850074 | DENV2 anC FJ410223 | DENV2 anC AY702039 |
| DENV2 anC EU482680 | DENV2 anC EU081178 | DENV2 anC FM210215 | DENV2 anC AY744150 |
| DENV2 anC EU482464 | DENV2 anC FJ410215 | DENV2 anC FM210210 | DENV2 anC EU482734 |
| DENV2 anC AF489932 | DENV2 anC DQ645555 | DENV2 anC FJ744708 | DENV2 anC EU726770 |
| DENV2 anC GU131864 | DENV2 anC EU482652 | DENV2 anC FJ024454 | DENV2 anC FJ850119 |
| DENV2 anC FJ390389 | DENV2 anC FJ432726 | DENV2 anC FJ810409 | DENV2 anC EU596489 |

FIG. 67-7

| Virus Protein Accession No. | Virus Protein Accession No. | Virus Protein Accession No. | Virus Protein Accession No. |
|---|---|---|---|
| DENV2 anC EU482470 | DENV2 anC EU482727 | DENV2 anC FJ850053 | DENV2 anC AF022439 |
| DENV2 anC EU687222 | DENV2 anC FM210212 | DENV2 anC EU056811 | DENV2 anC AF100460 |
| DENV2 anC FJ205885 | DENV2 anC GQ868588 | DENV2 anC EU596487 | DENV2 anC EU596495 |
| DENV2 anC AB479042 | DENV2 anC EU569721 | DENV2 anC EU482626 | DENV2 anC FJ373301 |
| DENV2 anC EU482748 | DENV2 anC EU482654 | DENV2 anC EU482586 | DENV2 anC U88237 |
| DENV2 anC GU131924 | DENV2 anC GU369819 | DENV2 anC EU482665 | DENV2 anC DQ448235 |
| DENV2 anC GQ868640 | DENV2 anC GQ868541 | DENV2 anC FJ898452 | DENV2 anC FJ906962 |
| DENV2 anC U89517 | DENV2 anC EU569711 | DENV2 anC FM210219 | DENV2 anC FJ850105 |
| DENV2 anC FJ639710 | DENV2 anC EU482553 | DENV2 anC EF105385 | DENV2 anC EU482542 |
| DENV2 anC AF119661 | DENV2 anC FJ639717 | DENV2 anC AF360863 | DENV2 anC AY702036 |
| DENV2 anC EU482545 | DENV2 anC CS477304 | DENV2 anC GQ868596 | DENV2 anC AY744147 |
| DENV2 anC EU687215 | DENV2 anC FJ687447 | DENV2 anC FJ744719 | DENV2 anC FM210227 |
| DENV2 anC FJ898432 | DENV2 anC FM210240 | DENV2 anC FJ744713 | DENV2 anC FM210231 |
| DENV2 anC EU482700 | DENV2 anC EU482672 | DENV2 anC EU482475 | DENV2 anC FN429891 |
| DENV2 anC EU482782 | DENV2 anC FJ639828 | DENV2 anC FJ461311 | DENV2 anC EU482676 |
| DENV2 anC FJ873811 | DENV2 anC EU482691 | DENV2 anC GQ868597 | DENV2 anC GQ868604 |
| DENV2 anC EU482758 | DENV2 anC FJ687439 | DENV2 anC GQ199869 | DENV2 anC GQ868516 |
| DENV2 anC GQ868624 | DENV2 anC GQ199874 | DENV2 anC EU482449 | DENV2 anC EU482769 |
| DENV2 anC FJ744715 | DENV2 anC EU687217 | DENV2 anC EU482773 | DENV2 anC FJ744717 |
| DENV2 anC FJ639783 | DENV2 anC EU482731 | DENV2 anC AF469176 | DENV2 anC EU687213 |
| DENV2 anC EU081177 | DENV2 anC EU529706 | DENV2 anC EU569701 | DENV2 anC FM210239 |
| DENV2 anC FM210222 | DENV2 anC EU482656 | DENV2 anC EU482738 | DENV2 anC DQ645556 |
| DENV2 anC EU569703 | DENV2 anC EU482543 | DENV2 anC EU482468 | DENV2 anC EU081180 |
| DENV2 anC EU482667 | DENV2 anC EU482732 | DENV2 anC EU482633 | DENV2 anC AF204177 |
| DENV2 anC DQ645540 | DENV2 anC EU482643 | DENV2 anC GU131886 | DENV2 anC EU482679 |
| DENV2 anC X51710 | DENV2 anC DQ645542 | DENV2 anC AY692470 | DENV2 anC AF360862 |
| DENV2 anC FJ410288 | DENV2 anC EU482695 | DENV2 anC EU677141 | DENV2 anC EU482472 |
| DENV2 anC GU131930 | DENV2 anC FJ744745 | DENV2 anC GQ868557 | DENV2 anC AY858035 |
| DENV2 anC AY037116 | DENV2 anC FM210205 | DENV2 anC AJ968413 | DENV2 anC EU596490 |
| DENV2 anC GQ868549 | DENV2 anC GQ868622 | DENV2 anC FJ639835 | DENV2 anC FJ850051 |
| DENV2 anC EU482751 | DENV2 anC EU660414 | DENV2 anC EU482579 | DENV2 anC EU482446 |
| DENV2 anC EU482562 | DENV2 anC FJ461309 | DENV2 anC GU131881 | DENV2 anC EU482694 |
| DENV2 anC FJ850107 | DENV2 anC EU482745 | DENV2 anC GQ868556 | DENV2 anC GQ868591 |
| DENV2 anC FJ898450 | DENV2 anC EU482601 | DENV2 anC FJ744741 | DENV2 anC FJ461305 |
| DENV2 anC EU482570 | DENV2 anC AY702037 | DENV2 anC FB667399 | DENV2 anC FJ744709 |
| DENV2 anC FN429894 | DENV2 anC FJ639830 | DENV2 anC AF100466 | DENV2 anC GQ199868 |
| DENV2 anC EU482702 | DENV2 anC FM210234 | DENV2 anC FJ390390 | DENV2 anC EU660400 |
| DENV2 anC EU482743 | DENV2 anC EU482787 | DENV2 anC GQ199894 | DENV2 anC EU482465 |
| DENV2 anC EU081179 | DENV2 anC EU482632 | DENV2 anC FJ898434 | DENV2 anC FM210208 |
| DENV2 anC EU529694 | DENV2 anC FJ373299 | DENV2 anC EU482597 | DENV2 anC EU482669 |
| DENV2 anC EU660405 | DENV2 anC EU482683 | DENV2 anC FJ906969 | DENV2 anC EU529695 |
| DENV2 anC FJ859028 | DENV2 anC EU482569 | DENV2 anC AF169679 | DENV2 anC FJ850062 |
| DENV2 anC GQ252676 | DENV2 anC EU482674 | DENV2 anC FJ461321 | DENV2 anC X51708 |
| DENV2 anC FJ850065 | DENV2 anC FJ478459 | DENV2 anC EU687224 | DENV2 anC GQ199901 |
| DENV2 anC EU482589 | DENV2 anC FJ850121 | DENV2 anC FJ687440 | DENV2 anC EU359009 |
| DENV2 anC EU482641 | DENV2 anC FJ205879 | DENV2 anC EF105380 | DENV2 anC GU131931 |
| DENV2 anC FJ390385 | DENV2 anC FJ687434 | DENV2 anC AF100467 | DENV2 anC FJ906961 |
| DENV2 anC EU482784 | DENV2 anC EU482450 | DENV2 anC EU482753 | DENV2 anC EU529700 |

FIG. 67-8

| Virus Protein Accession No. | Virus Protein Accession No. | Virus Protein Accession No. | Virus Protein Accession No. |
|---|---|---|---|
| DENV2 anC EU482576 | DENV2 anC EU482760 | DENV2 anC EU179860 | DENV2 anC EU482646 |
| DENV2 anC EU482703 | DENV2 anC GU131959 | DENV2 anC FJ744710 | DENV2 anC FJ687444 |
| DENV2 anC EU482685 | DENV2 anC AB479041 | DENV2 anC AY702040 | DENV2 anC GU131901 |
| DENV2 anC FM210214 | DENV2 anC DQ645552 | DENV2 anC FJ898466 | DENV2 anC GQ868550 |
| DENV2 anC FJ744724 | DENV2 anC EU482776 | DENV2 anC GQ252677 | DENV2 anC EU482660 |
| DENV2 anC AF509530 | DENV2 anC GQ868543 | DENV2 anC FJ906966 | DENV2 anC FJ410219 |
| DENV2 anC FM210245 | DENV2 anC FJ410237 | DENV2 anC GU289914 | DENV2 anC EU569717 |
| DENV2 anC GQ199895 | DENV2 anC AF169686 | DENV2 anC FJ744706 | DENV2 anC AF022435 |
| DENV2 anC EU482604 | DENV2 anC FJ639707 | DENV2 anC EU596496 | DENV2 anC EU482788 |
| DENV2 anC FM210236 | DENV2 anC FJ850120 | DENV2 anC EU482560 | DENV2 anC FJ744743 |
| DENV2 anC EU482736 | DENV2 anC FJ639822 | DENV2 anC EU482723 | DENV2 anC FJ906956 |
| DENV2 anC EU482551 | DENV2 anC EU482699 | DENV2 anC EU482741 | DENV2 anC L04561 |
| DENV2 anC DQ645546 | DENV2 anC GQ868552 | DENV2 anC EU482549 | DENV2 anC EU482607 |
| DENV2 anC EU687228 | DENV2 anC EU660406 | DENV2 anC EU482573 | DENV2 anC EU726776 |
| DENV2 anC EF105387 | DENV2 anC EU569715 | DENV2 anC EU482755 | DENV2 anC EU687230 |
| DENV2 anC EU482648 | DENV2 anC FJ898467 | DENV2 anC FN429893 | DENV2 anC EU482581 |
| DENV2 anC FJ639705 | DENV2 anC EF051521 | DENV2 anC AF022434 | DENV2 anC EU482600 |
| DENV2 anC FJ906968 | DENV2 anC GQ868497 | DENV2 anC EU529693 | DENV2 anC GU131927 |
| DENV2 anC AF100464 | DENV2 anC EU003591 | DENV2 anC EU596499 | DENV2 anC FJ850076 |
| DENV2 anC EU677145 | DENV2 anC EU569699 | DENV2 anC EU482687 | DENV2 anC GQ868638 |
| DENV2 anC EU596485 | DENV2 anC EU482547 | DENV2 anC AF022440 | DENV2 anC EU482625 |
| DENV2 anC FJ898477 | DENV2 anC FJ850064 | DENV2 anC GU131884 | DENV2 anC GU131843 |
| DENV2 anC DQ181803 | DENV2 anC EU482719 | DENV2 anC EU482757 | DENV2 anC EU482469 |
| DENV2 anC EU482786 | DENV2 anC EU482448 | DENV2 anC DQ448238 | DENV2 anC EU482772 |
| DENV2 anC EF105389 | DENV2 anC EU482720 | DENV2 anC EU482574 | DENV2 anC FM210225 |
| DENV2 anC EU482781 | DENV2 anC EU687237 | DENV2 anC EU482764 | DENV2 anC AF100461 |
| DENV2 anC EU482638 | DENV2 anC AB122021 | DENV2 anC FJ478455 | DENV2 anC EU482668 |
| DENV2 anC FM210217 | DENV2 anC EU687248 | DENV2 anC EU179857 | DENV2 anC GQ868598 |
| DENV2 anC EF105382 | DENV2 anC EU482767 | DENV2 anC FJ024473 | DENV2 anC EU529701 |
| DENV2 anC FJ744742 | DENV2 anC DQ181798 | DENV2 anC EU660416 | DENV2 anC EU482451 |
| DENV2 anC GU131897 | DENV2 anC EU482735 | DENV2 anC DQ645547 | DENV2 anC FJ882602 |
| DENV2 anC EU482584 | DENV2 anC FJ850112 | DENV2 anC GM059692 | DENV2 anC EU482666 |
| DENV2 anC EU482624 | DENV2 anC EU569719 | DENV2 anC EU569694 | DENV2 anC EU482634 |
| DENV2 anC EU482725 | DENV2 anC EU660398 | DENV2 anC FJ898436 | DENV2 anC DQ645550 |
| DENV2 anC FJ810410 | DENV2 anC GQ199897 | DENV2 anC FM210216 | DENV2 anC GQ868558 |
| DENV2 anC EU482726 | DENV2 anC EU482677 | DENV2 anC FM210224 | DENV2 anC GQ868542 |
| DENV2 anC FJ024475 | DENV2 anC GQ868545 | DENV2 anC EU482778 | DENV2 anC EU569706 |
| DENV2 anC FJ744704 | DENV2 anC EU482621 | DENV2 anC FJ810412 | DENV2 anC GQ868631 |
| DENV2 anC EU482599 | DENV2 anC EU687243 | DENV2 anC GU131899 | DENV2 anC EU482628 |
| DENV2 anC FJ744712 | DENV2 anC EU482463 | DENV2 anC FJ639703 | DENV2 anC U89518 |
| DENV2 anC EU482681 | DENV2 anC DQ070873 | DENV2 anC EF105384 | DENV2 anC FJ850108 |
| DENV2 anC FJ639831 | DENV2 anC EU482606 | DENV2 anC AB189123 | DENV2 anC EU687214 |
| DENV2 anC EU569708 | DENV2 anC DQ645553 | DENV2 anC FM210233 | DENV2 anC AY044442 |
| DENV2 anC EU482583 | DENV2 anC AF038403 | DENV2 anC FJ639699 | DENV2 anC EU482689 |
| DENV2 anC EU482444 | DENV2 anC FM210204 | DENV2 anC FJ182014 | DENV2 anC FJ882594 |
| DENV2 anC EU482762 | DENV2 anC GQ868554 | DENV2 anC FJ562098 | DENV2 anC FJ744716 |
| DENV2 anC EU482662 | DENV2 anC DQ448231 | DENV2 anC FJ913016 | DENV2 anC EU482546 |
| DENV2 anC EU569696 | DENV2 anC FJ687443 | DENV2 anC EU482746 | DENV2 anC FJ410233 |

FIG. 67-9

| Virus Protein Accession No. | Virus Protein Accession No. | Virus Protein Accession No. | Virus Protein Accession No. |
|---|---|---|---|
| DENV2 anC GQ868600 | DENV2 anC AY744149 | DENV2 anC EU482759 | DENV2 anC EU482785 |
| DENV2 anC GU131898 | DENV2 anC EU482655 | DENV2 anC FJ744711 | DENV2 anC FJ410193 |
| DENV2 anC AY858036 | DENV2 anC EU677137 | DENV2 anC EU569704 | DENV2 anC EU482552 |
| DENV2 anC EU687244 | DENV2 anC EU482744 | DENV2 anC AF169685 | DENV2 anC EU677142 |
| DENV2 anC FJ850066 | DENV2 anC FJ639701 | DENV2 anC EU677147 | DENV2 anC EU687232 |
| DENV2 anC EU482556 | DENV2 anC EU660415 | DENV2 anC GU370051 | DENV2 anC FM210241 |
| DENV2 anC FJ744744 | DENV2 anC EU482631 | DENV2 anC EU482587 | DENV2 anC FJ744725 |
| DENV2 anC FJ639788 | DENV2 anC FJ687435 | DENV2 anC DQ645551 | DENV2 anC GQ868621 |
| DENV2 anC FN429895 | DENV2 anC AF360860 | DENV2 anC FJ390391 | DENV2 anC EU482653 |
| DENV2 anC FJ850060 | DENV2 anC FJ639836 | DENV2 anC M15075 | DENV2 anC AY692467 |
| DENV2 anC EU660404 | DENV2 anC AY702034 | DENV2 anC FJ850054 | DENV2 anC DQ448232 |
| DENV2 anC EU482690 | DENV2 anC EU482696 | DENV2 anC EU482565 | DENV2 anC FJ024477 |
| DENV2 anC EU569720 | DENV2 anC FJ687438 | DENV2 anC FJ373300 | DENV2 anC U87412 |
| DENV2 anC FJ687441 | DENV2 anC EU596488 | DENV2 anC AF169684 | DENV2 anC X51709 |
| DENV2 anC AF169678 | DENV2 anC FM210220 | DENV2 anC DL138662 | DENV2 anC EU482692 |
| DENV2 anC AF100468 | DENV2 anC FJ898451 | DENV2 anC GQ868544 | DENV2 anC FM210206 |
| DENV2 anC EU482722 | DENV2 anC FJ639708 | DENV2 anC FJ744714 | DENV2 anC EU482644 |
| DENV2 anC GU131883 | DENV2 anC EU687229 | DENV2 anC EU179859 | DENV2 anC GU131975 |
| DENV2 anC AY692469 | DENV2 anC EU482739 | DENV2 anC DQ448234 | DENV2 anC EU482602 |
| DENV2 anC FM210235 | DENV2 anC EU569709 | DENV2 anC DQ645541 | DENV2 anC EU482673 |
| DENV2 anC FJ744707 | DENV2 anC EU687223 | DENV2 anC AF100465 | DENV2 anC FJ024474 |
| DENV2 anC EU482588 | DENV2 anC EF105386 | DENV2 anC EU687246 | DENV2 anC FJ744720 |
| DENV2 anC EU677149 | DENV2 anC FJ410217 | DENV2 anC EU482750 | DENV2 anC FJ639809 |
| DENV2 anC FJ639734 | DENV2 anC EU482467 | DENV2 anC GU131900 | DENV2 anC FJ639718 |
| DENV2 anC GQ868555 | DENV2 anC FJ461314 | DENV2 anC FM210211 | DENV2 anC DQ181802 |
| DENV2 anC GQ868540 | DENV2 anC GQ868595 | DENV2 anC EU482742 | DENV2 anC FJ810411 |
| DENV2 anC AF169682 | DENV2 anC GU131932 | DENV2 anC EU482705 | DENV2 anC EU482554 |
| DENV2 anC DQ181797 | DENV2 anC EU056810 | DENV2 anC EF105390 | DENV2 anC FM210237 |
| DENV2 anC FJ687446 | DENV2 anC AY692471 | DENV2 anC EU482684 | DENV2 anC EU482603 |
| DENV2 anC FJ639829 | DENV2 anC AF022441 | DENV2 anC EU569714 | DENV2 anC EU482733 |
| DENV2 anC FJ898453 | DENV2 anC EU056812 | DENV2 anC GQ868589 | DENV2 anC FJ850088 |
| DENV2 anC EU482721 | DENV2 anC EU482664 | DENV2 anC FJ850078 | DENV2 anC AY692466 |
| DENV2 anC FJ898460 | DENV2 anC EU482568 | DENV2 anC FM210243 | DENV2 anC DQ448233 |
| DENV2 anC FJ898438 | DENV2 anC EU482774 | DENV2 anC EU482671 | DENV2 anC GQ199605 |
| DENV2 anC EU569712 | DENV2 anC FJ547067 | DENV2 anC EU482571 | DENV2 anC EF440433 |
| DENV2 anC DQ448237 | DENV2 anC EU482474 | DENV2 anC DQ645544 | DENV2 anC AY692465 |
| DENV2 anC EU687250 | DENV2 anC FJ850118 | DENV2 anC FM210238 | DENV2 anC AF469175 |
| DENV2 anC FJ432724 | DENV2 anC EU687216 | DENV2 anC EF105379 | DENV2 anC DQ448236 |
| DENV2 anC AF022437 | DENV2 anC EU482590 | DENV2 anC EU482728 | DENV2 anC X65239 |
| DENV2 anC DQ181800 | DENV2 anC AF208496 | DENV2 anC FM210229 | DENV2 anC AY692468 |
| DENV2 anC D00346 | DENV2 anC EU569693 | DENV2 anC GU131880 | DENV2 anC AF360861 |
| DENV2 anC EU687241 | DENV2 anC FJ850106 | DENV2 anC M19197 | DENV2 anC U89517 |
| DENV2 anC FJ410200 | DENV2 anC EU482623 | DENV2 anC GQ868603 | DENV2 anC X51710 |
| DENV2 anC FJ205878 | DENV2 anC GU131879 | DENV2 anC GU131929 | DENV2 anC AF360863 |
| DENV2 anC GU131955 | DENV2 anC FM210223 | DENV2 anC FJ639732 | DENV2 anC AF469176 |
| DENV2 anC FJ906958 | DENV2 anC GQ199893 | DENV2 anC EU677143 | DENV2 anC AY692470 |
| DENV2 anC FJ744722 | DENV2 anC EU482578 | DENV2 anC EU482682 | DENV2 anC U88237 |
| DENV2 anC EU482770 | DENV2 anC EU482544 | DENV2 anC GQ868641 | DENV2 anC DQ448235 |

FIG. 67-10

| Virus Protein | Accession No. | Virus Protein | Accession No. | Virus Protein | Accession No. | Virus Protein | Accession No. |
|---|---|---|---|---|---|---|---|
| DENV2 anC | AF360862 | DENV2 anC | X65239 | DENV2 E | DQ181839 | DENV2 E | GU211761 |
| DENV2 anC | X51708 | DENV2 anC | AY692468 | DENV2 E | EU482650 | DENV2 E | FJ744718 |
| DENV2 anC | AF509530 | DENV2 anC | X51710 | DENV2 E | EU482724 | DENV2 E | EF457904 |
| DENV2 anC | DQ070873 | DENV2 anC | AY692470 | DENV2 E | FJ898435 | DENV2 E | GU211741 |
| DENV2 anC | EU179860 | DENV2 anC | X51708 | DENV2 E | FJ547064 | DENV2 E | AF169687 |
| DENV2 anC | DQ448238 | DENV2 anC | DQ070873 | DENV2 E | EU677144 | DENV2 E | FJ850072 |
| DENV2 anC | FJ913016 | DENV2 anC | EU179860 | DENV2 E | EU569716 | DENV2 E | DQ181823 |
| DENV2 anC | L04561 | DENV2 anC | AY692469 | DENV2 E | L10044 | DENV2 E | EU448427 |
| DENV2 anC | U89518 | DENV2 anC | AY692471 | DENV2 E | GQ368167 | DENV2 E | EU482445 |
| DENV2 anC | AY044442 | DENV2 anC | AY692467 | DENV2 E | EU482752 | DENV2 E | EU117328 |
| DENV2 anC | AY692469 | DENV2 anC | X51709 | DENV2 E | DQ341201 | DENV2 E | EU482598 |
| DENV2 anC | DQ448237 | DENV2 anC | AY692466 | DENV2 E | FJ906967 | DENV2 E | AF359579 |
| DENV2 anC | D00346 | DENV2 anC | AY692465 | DENV2 E | FJ410241 | DENV2 E | GU434150 |
| DENV2 anC | AF360860 | DENV2 anC | X65239 | DENV2 E | FJ639706 | DENV2 E | GQ199605 |
| DENV2 anC | AY692471 | DENV2 anC | AY692468 | DENV2 E | EU596500 | DENV2 E | EU482639 |
| DENV2 anC | M15075 | DENV2 anC | X51710 | DENV2 E | FJ410208 | DENV2 E | AF363087 |
| DENV2 anC | DQ448234 | DENV2 anC | AY692470 | DENV2 E | FJ906957 | DENV2 E | EF016250 |
| DENV2 anC | AY692467 | DENV2 anC | X51708 | DENV2 E | EU569702 | DENV2 E | GQ868551 |
| DENV2 anC | DQ448232 | DENV2 anC | DQ070873 | DENV2 E | DQ181838 | DENV2 E | EU569713 |
| DENV2 anC | X51709 | DENV2 anC | EU179860 | DENV2 E | AM746223 | DENV2 E | EU482775 |
| DENV2 anC | AY692466 | DENV2 anC | AY692469 | DENV2 E | DQ448233 | DENV2 E | AY786384 |
| DENV2 anC | AY692465 | DENV2 anC | AY692471 | DENV2 E | AF363091 | DENV2 E | GQ868620 |
| DENV2 anC | X65239 | DENV2 anC | AY692467 | DENV2 E | EU117322 | DENV2 E | GU131902 |
| DENV2 anC | AY692468 | DENV2 anC | X51709 | DENV2 E | AY158331 | DENV2 E | AY158327 |
| DENV2 anC | X51710 | DENV2 anC | AY692466 | DENV2 E | FJ898478 | DENV2 E | GU131947 |
| DENV2 anC | AY692470 | DENV2 anC | AY692465 | DENV2 E | FJ882593 | DENV2 E | EU117321 |
| DENV2 anC | X51708 | DENV2 anC | X65239 | DENV2 E | AF398107 | DENV2 E | EU569707 |
| DENV2 anC | DQ070873 | DENV2 anC | AY692468 | DENV2 E | EU482763 | DENV2 E | AY158338 |
| DENV2 anC | EU179860 | DENV2 anC | X51710 | DENV2 E | AY786374 | DENV2 E | M20558 |
| DENV2 anC | AY692469 | DENV2 anC | AY692470 | DENV2 E | EU482661 | DENV2 E | AY512569 |
| DENV2 anC | AY692471 | DENV2 anC | X51708 | DENV2 E | M29095 | DENV2 E | EU482663 |
| DENV2 anC | AY692467 | DENV2 anC | DQ070873 | DENV2 E | EU482585 | DENV2 E | DQ645543 |
| DENV2 anC | X51709 | DENV2 anC | EU179860 | DENV2 E | FJ639711 | DENV2 E | AY577435 |
| DENV2 anC | AY692466 | DENV2 anC | AY692469 | DENV2 E | FJ538915 | DENV2 E | FM210207 |
| DENV2 anC | AY692465 | DENV2 anC | AY692471 | DENV2 E | AF295697 | DENV2 E | FJ873808 |
| DENV2 anC | X65239 | DENV2 anC | AY692467 | DENV2 E | FJ850067 | DENV2 E | AY775305 |
| DENV2 anC | AY692468 | DENV2 anC | X51709 | DENV2 E | AY786393 | DENV2 E | FM210203 |
| DENV2 anC | X51710 | DENV2 E | CS479165 | DENV2 E | EU069575 | DENV2 E | AY714062 |
| DENV2 anC | AY692470 | DENV2 E | FJ205877 | DENV2 E | DQ917243 | DENV2 E | AY786401 |
| DENV2 anC | X51708 | DENV2 E | EU726767 | DENV2 E | EU482777 | DENV2 E | EU687225 |
| DENV2 anC | DQ070873 | DENV2 E | GQ368160 | DENV2 E | FJ898479 | DENV2 E | EU596486 |
| DENV2 anC | EU179860 | DENV2 E | EU482649 | DENV2 E | AF100463 | DENV2 E | AF100459 |
| DENV2 anC | AY692469 | DENV2 E | FM210221 | DENV2 E | AY484603 | DENV2 E | EU687238 |
| DENV2 anC | AY692471 | DENV2 E | EU482740 | DENV2 E | FJ744703 | DENV2 E | DQ181822 |
| DENV2 anC | AY692467 | DENV2 E | EF105388 | DENV2 E | AY786382 | DENV2 E | EU482747 |
| DENV2 anC | X51709 | DENV2 E | FJ410259 | DENV2 E | AF195034 | DENV2 E | DQ181813 |
| DENV2 anC | AY692466 | DENV2 E | FJ024461 | DENV2 E | DM460984 | DENV2 E | GU131928 |
| DENV2 anC | AY692465 | DENV2 E | DQ181801 | DENV2 E | EU482642 | DENV2 E | FM210226 |

FIG. 67-11

| Virus Protein | Accession No. | Virus Protein | Accession No. | Virus Protein | Accession No. | Virus Protein | Accession No. |
|---|---|---|---|---|---|---|---|
| DENV2 E | FJ538910 | DENV2 E | DQ518641 | DENV2 E | GU434147 | DENV2 E | AY449679 |
| DENV2 E | M84728 | DENV2 E | DQ181882 | DENV2 E | EU179858 | DENV2 E | EU117313 |
| DENV2 E | GU211759 | DENV2 E | FJ390384 | DENV2 E | EU687227 | DENV2 E | M24449 |
| DENV2 E | AF295700 | DENV2 E | AF297009 | DENV2 E | L10051 | DENV2 E | GQ868592 |
| DENV2 E | FM210230 | DENV2 E | CS805344 | DENV2 E | EU660417 | DENV2 E | FJ639704 |
| DENV2 E | DQ181855 | DENV2 E | GU434159 | DENV2 E | AM746225 | DENV2 E | EU687212 |
| DENV2 E | DQ181891 | DENV2 E | DQ181852 | DENV2 E | FJ850082 | DENV2 E | AF100462 |
| DENV2 E | AY449682 | DENV2 E | AF195040 | DENV2 E | EU596491 | DENV2 E | EU726775 |
| DENV2 E | EU482659 | DENV2 E | FJ538923 | DENV2 E | EU482582 | DENV2 E | EU677146 |
| DENV2 E | AJ487271 | DENV2 E | AF410357 | DENV2 E | EU005258 | DENV2 E | AF022436 |
| DENV2 E | EU660399 | DENV2 E | AY702038 | DENV2 E | EU482749 | DENV2 E | GQ368169 |
| DENV2 E | AF398114 | DENV2 E | FJ467493 | DENV2 E | AB111450 | DENV2 E | AF410351 |
| DENV2 E | FJ639832 | DENV2 E | EU482629 | DENV2 E | FJ807638 | DENV2 E | EU448422 |
| DENV2 E | M24450 | DENV2 E | EU482593 | DENV2 E | EU482779 | DENV2 E | AY484605 |
| DENV2 E | EU569698 | DENV2 E | AY237288 | DENV2 E | FJ807634 | DENV2 E | EU482680 |
| DENV2 E | AY702041 | DENV2 E | EU069577 | DENV2 E | GQ868623 | DENV2 E | EU482464 |
| DENV2 E | DQ181846 | DENV2 E | FJ850085 | DENV2 E | AF169680 | DENV2 E | DQ181825 |
| DENV2 E | EU854294 | DENV2 E | FJ410224 | DENV2 E | U87411 | DENV2 E | AF489932 |
| DENV2 E | EU482561 | DENV2 E | EU117349 | DENV2 E | FM210213 | DENV2 E | AY786389 |
| DENV2 E | DQ917246 | DENV2 E | GQ868625 | DENV2 E | EU482647 | DENV2 E | AF195036 |
| DENV2 E | GQ868515 | DENV2 E | AF363074 | DENV2 E | AY158336 | DENV2 E | AF363083 |
| DENV2 E | EU482473 | DENV2 E | EU854293 | DENV2 E | AY786405 | DENV2 E | GU131864 |
| DENV2 E | EU482622 | DENV2 E | EU482675 | DENV2 E | AF169681 | DENV2 E | FJ390389 |
| DENV2 E | AF410377 | DENV2 E | DQ181897 | DENV2 E | EU482548 | DENV2 E | EU687240 |
| DENV2 E | EU482693 | DENV2 E | GU211748 | DENV2 E | DQ472146 | DENV2 E | AY786367 |
| DENV2 E | EU117315 | DENV2 E | AY776328 | DENV2 E | FJ898439 | DENV2 E | DQ645545 |
| DENV2 E | AY744148 | DENV2 E | GU370050 | DENV2 E | EU482637 | DENV2 E | DQ181861 |
| DENV2 E | EU687249 | DENV2 E | AF195038 | DENV2 E | EU069584 | DENV2 E | AY702057 |
| DENV2 E | EU482761 | DENV2 E | FJ850061 | DENV2 E | EU781135 | DENV2 E | FJ906959 |
| DENV2 E | FJ639837 | DENV2 E | EU660413 | DENV2 E | AF295699 | DENV2 E | EU621672 |
| DENV2 E | FJ906960 | DENV2 E | FJ205880 | DENV2 E | GU211753 | DENV2 E | EU117326 |
| DENV2 E | FJ538928 | DENV2 E | EU117340 | DENV2 E | DQ645548 | DENV2 E | GQ868599 |
| DENV2 E | AY702035 | DENV2 E | EU687199 | DENV2 E | DQ518631 | DENV2 E | EU677138 |
| DENV2 E | GQ868590 | DENV2 E | GU434152 | DENV2 E | DQ518653 | DENV2 E | EU482783 |
| DENV2 E | AY786378 | DENV2 E | EF440433 | DENV2 E | AB189122 | DENV2 E | EU596484 |
| DENV2 E | GQ199896 | DENV2 E | AB111454 | DENV2 E | FJ810418 | DENV2 E | EU569718 |
| DENV2 E | FN429892 | DENV2 E | EU069591 | DENV2 E | GU131896 | DENV2 E | AY577433 |
| DENV2 E | EU482466 | DENV2 E | DQ181804 | DENV2 E | EU482765 | DENV2 E | AY449677 |
| DENV2 E | FJ639697 | DENV2 E | FJ744723 | DENV2 E | EU596498 | DENV2 E | FJ639709 |
| DENV2 E | FM210209 | DENV2 E | EU482686 | DENV2 E | CS479167 | DENV2 E | AF169688 |
| DENV2 E | AY702051 | DENV2 E | EU482605 | DENV2 E | FJ182012 | DENV2 E | EU448429 |
| DENV2 E | AB122022 | DENV2 E | GQ199900 | DENV2 E | EF105381 | DENV2 E | AY449685 |
| DENV2 E | AY786400 | DENV2 E | FJ410221 | DENV2 E | FJ410195 | DENV2 E | DQ181810 |
| DENV2 E | DQ518643 | DENV2 E | AF100469 | DENV2 E | AF204178 | DENV2 E | DQ181799 |
| DENV2 E | EU569697 | DENV2 E | L10049 | DENV2 E | GQ368162 | DENV2 E | GQ199898 |
| DENV2 E | EU482730 | DENV2 E | FJ898461 | DENV2 E | FJ226066 | DENV2 E | FJ024458 |
| DENV2 E | EU482577 | DENV2 E | EU482550 | DENV2 E | EU482640 | DENV2 E | DQ181880 |
| DENV2 E | DQ181871 | DENV2 E | FM210244 | DENV2 E | EU448420 | DENV2 E | AB180478 |

FIG. 67-12

| Virus Protein | Accession No. | Virus Protein | Accession No. | Virus Protein | Accession No. | Virus Protein | Accession No. |
|---|---|---|---|---|---|---|---|
| DENV2 E | FJ687436 | DENV2 E | FJ410202 | DENV2 E | DQ448236 | DENV2 E | DQ181805 |
| DENV2 E | FB667404 | DENV2 E | GQ868646 | DENV2 E | AY786380 | DENV2 E | EF105378 |
| DENV2 E | FJ850063 | DENV2 E | EU482575 | DENV2 E | GQ368163 | DENV2 E | AF022438 |
| DENV2 E | EU482541 | DENV2 E | FM210246 | DENV2 E | DQ917247 | DENV2 E | FJ639702 |
| DENV2 E | DQ645554 | DENV2 E | AY466449 | DENV2 E | EU482580 | DENV2 E | DQ518651 |
| DENV2 E | FJ538921 | DENV2 E | FJ898449 | DENV2 E | EU482670 | DENV2 E | EU482729 |
| DENV2 E | EU117332 | DENV2 E | EU482471 | DENV2 E | GU211762 | DENV2 E | EU569710 |
| DENV2 E | EU482657 | DENV2 E | FJ744705 | DENV2 E | DQ181873 | DENV2 E | FJ547090 |
| DENV2 E | EU482768 | DENV2 E | EU482572 | DENV2 E | D10514 | DENV2 E | GU131974 |
| DENV2 E | AF038402 | DENV2 E | AF297006 | DENV2 E | FJ687437 | DENV2 E | FJ639833 |
| DENV2 E | AF469175 | DENV2 E | EF016252 | DENV2 E | NC_001474 | DENV2 E | FJ410228 |
| DENV2 E | FJ850117 | DENV2 E | AF410347 | DENV2 E | FJ807636 | DENV2 E | M24446 |
| DENV2 E | EU482678 | DENV2 E | GU131885 | DENV2 E | EU045313 | DENV2 E | EU069587 |
| DENV2 E | EU482698 | DENV2 E | DQ181853 | DENV2 E | X15214 | DENV2 E | FM210242 |
| DENV2 E | D00345 | DENV2 E | FJ937968 | DENV2 E | GU211755 | DENV2 E | DQ181850 |
| DENV2 E | FM210202 | DENV2 E | DQ181877 | DENV2 E | EU596497 | DENV2 E | AY512567 |
| DENV2 E | GU211739 | DENV2 E | EU117342 | DENV2 E | DQ181876 | DENV2 E | FM210228 |
| DENV2 E | EU482594 | DENV2 E | FJ850116 | DENV2 E | AF363081 | DENV2 E | DQ518646 |
| DENV2 E | FJ898465 | DENV2 E | FM210218 | DENV2 E | EU482704 | DENV2 E | GU211745 |
| DENV2 E | FJ639834 | DENV2 E | AY079423 | DENV2 E | FM986661 | DENV2 E | DQ181831 |
| DENV2 E | GQ868553 | DENV2 E | FM986658 | DENV2 E | EU569692 | DENV2 E | FM986659 |
| DENV2 E | GU211747 | DENV2 E | DQ341195 | DENV2 E | CS477302 | DENV2 E | AY484599 |
| DENV2 E | FJ850115 | DENV2 E | DQ518634 | DENV2 E | AF169683 | DENV2 E | FJ390387 |
| DENV2 E | EU482627 | DENV2 E | EU482754 | DENV2 E | GU211738 | DENV2 E | DQ181817 |
| DENV2 E | DQ181811 | DENV2 E | GU211757 | DENV2 E | FM210232 | DENV2 E | EU482608 |
| DENV2 E | AY449684 | DENV2 E | EU117331 | DENV2 E | EU448421 | DENV2 E | EU482447 |
| DENV2 E | EU069573 | DENV2 E | EU482756 | DENV2 E | FJ898454 | DENV2 E | AF295696 |
| DENV2 E | EU482620 | DENV2 E | DQ518648 | DENV2 E | EU596483 | DENV2 E | FJ410291 |
| DENV2 E | FJ744721 | DENV2 E | AY786391 | DENV2 E | FJ639700 | DENV2 E | DQ341198 |
| DENV2 E | EU687220 | DENV2 E | DQ181806 | DENV2 E | GQ199892 | DENV2 E | GQ199899 |
| DENV2 E | EU687236 | DENV2 E | FB730117 | DENV2 E | M84727 | DENV2 E | EU482630 |
| DENV2 E | FJ687442 | DENV2 E | EU482737 | DENV2 E | EU677148 | DENV2 E | DQ181841 |
| DENV2 E | EU569705 | DENV2 E | AB122020 | DENV2 E | EU482645 | DENV2 E | FJ687445 |
| DENV2 E | EU482780 | DENV2 E | EU448415 | DENV2 E | FJ639733 | DENV2 E | GQ199890 |
| DENV2 E | EU687231 | DENV2 E | DQ181893 | DENV2 E | FJ410223 | DENV2 E | GU211756 |
| DENV2 E | GQ199866 | DENV2 E | AY786376 | DENV2 E | FM210215 | DENV2 E | EU117316 |
| DENV2 E | FJ850074 | DENV2 E | AF410355 | DENV2 E | FM210210 | DENV2 E | EU482651 |
| DENV2 E | EU081178 | DENV2 E | AF363085 | DENV2 E | AY786366 | DENV2 E | AY702059 |
| DENV2 E | FJ410215 | DENV2 E | EU482636 | DENV2 E | FJ744708 | DENV2 E | EU482658 |
| DENV2 E | DQ645555 | DENV2 E | FJ538908 | DENV2 E | FJ024454 | DENV2 E | EU687235 |
| DENV2 E | EU482652 | DENV2 E | AF363088 | DENV2 E | FJ810409 | DENV2 E | AF363089 |
| DENV2 E | FJ432726 | DENV2 E | EU482557 | DENV2 E | DQ181896 | DENV2 E | FJ850091 |
| DENV2 E | EU482688 | DENV2 E | AY702056 | DENV2 E | EU569695 | DENV2 E | AY778961 |
| DENV2 E | L10041 | DENV2 E | EU482701 | DENV2 E | AF398109 | DENV2 E | FJ639698 |
| DENV2 E | DQ181848 | DENV2 E | AY237294 | DENV2 E | EF105383 | DENV2 E | FJ538905 |
| DENV2 E | FM986655 | DENV2 E | FJ024452 | DENV2 E | GU131882 | DENV2 E | AF297008 |
| DENV2 E | AY702046 | DENV2 E | EU569700 | DENV2 E | EU482697 | DENV2 E | FJ850050 |
| DENV2 E | AF363076 | DENV2 E | AY702045 | DENV2 E | CS479202 | DENV2 E | AF410354 |

FIG. 67-13

| Virus Protein | Accession No. | Virus Protein | Accession No. | Virus Protein | Accession No. | Virus Protein | Accession No. |
|---|---|---|---|---|---|---|---|
| DENV2 E | AB189124 | DENV2 E | AY484606 | DENV2 E | FJ859028 | DENV2 E | FJ538924 |
| DENV2 E | EU482771 | DENV2 E | FJ898432 | DENV2 E | AY702043 | DENV2 E | AF231720 |
| DENV2 E | AF410353 | DENV2 E | EU482700 | DENV2 E | AY158333 | DENV2 E | EU482643 |
| DENV2 E | AF276619 | DENV2 E | AY786371 | DENV2 E | GQ252676 | DENV2 E | DQ645542 |
| DENV2 E | FJ538913 | DENV2 E | AY786387 | DENV2 E | FJ850065 | DENV2 E | EU482695 |
| DENV2 E | X15434 | DENV2 E | EU482782 | DENV2 E | EU482589 | DENV2 E | DQ181901 |
| DENV2 E | AY577430 | DENV2 E | FJ873811 | DENV2 E | EU482641 | DENV2 E | EU117335 |
| DENV2 E | EU482766 | DENV2 E | DQ181833 | DENV2 E | FJ390385 | DENV2 E | AF264053 |
| DENV2 E | DQ645549 | DENV2 E | DQ472142 | DENV2 E | EU482784 | DENV2 E | AY702048 |
| DENV2 E | AF231718 | DENV2 E | AY449676 | DENV2 E | EU482727 | DENV2 E | FJ744745 |
| DENV2 E | AY786406 | DENV2 E | EU482758 | DENV2 E | FM210212 | DENV2 E | FM210205 |
| DENV2 E | EU687242 | DENV2 E | DQ181868 | DENV2 E | GQ868588 | DENV2 E | L10046 |
| DENV2 E | EU482635 | DENV2 E | GQ868624 | DENV2 E | EU569721 | DENV2 E | GQ868622 |
| DENV2 E | AF410345 | DENV2 E | FJ744715 | DENV2 E | AF363071 | DENV2 E | EU660414 |
| DENV2 E | EU687245 | DENV2 E | FJ639783 | DENV2 E | EU482654 | DENV2 E | DQ518639 |
| DENV2 E | AY702039 | DENV2 E | EU081177 | DENV2 E | GU369819 | DENV2 E | AB219135 |
| DENV2 E | DQ181866 | DENV2 E | AY484598 | DENV2 E | GQ868541 | DENV2 E | FJ461309 |
| DENV2 E | AY744150 | DENV2 E | FM210222 | DENV2 E | EU569711 | DENV2 E | DQ181820 |
| DENV2 E | DQ181829 | DENV2 E | EU448417 | DENV2 E | EU482553 | DENV2 E | EU482745 |
| DENV2 E | EU482734 | DENV2 E | AF231716 | DENV2 E | AF363073 | DENV2 E | EU482601 |
| DENV2 E | AY237291 | DENV2 E | EU569703 | DENV2 E | FJ639717 | DENV2 E | DQ181898 |
| DENV2 E | EU726770 | DENV2 E | AF297004 | DENV2 E | AY786397 | DENV2 E | AY702037 |
| DENV2 E | EU448430 | DENV2 E | EU482667 | DENV2 E | CS477304 | DENV2 E | FJ639830 |
| DENV2 E | FJ850119 | DENV2 E | DQ645540 | DENV2 E | GU211742 | DENV2 E | FM210234 |
| DENV2 E | EU596489 | DENV2 E | FJ410288 | DENV2 E | FJ687447 | DENV2 E | EU482787 |
| DENV2 E | EU482470 | DENV2 E | GU131930 | DENV2 E | AY158328 | DENV2 E | AF398111 |
| DENV2 E | AY706016 | DENV2 E | AY037116 | DENV2 E | FJ538911 | DENV2 E | EU482632 |
| DENV2 E | EU117338 | DENV2 E | GQ868549 | DENV2 E | FM210240 | DENV2 E | FJ373299 |
| DENV2 E | EU687222 | DENV2 E | EU482751 | DENV2 E | EU448423 | DENV2 E | AY484601 |
| DENV2 E | GQ368172 | DENV2 E | AF410366 | DENV2 E | EU069585 | DENV2 E | EU482683 |
| DENV2 E | FJ205885 | DENV2 E | EU482562 | DENV2 E | EU482672 | DENV2 E | EU482569 |
| DENV2 E | AB479042 | DENV2 E | FJ850107 | DENV2 E | FJ639828 | DENV2 E | AF363078 |
| DENV2 E | DQ181886 | DENV2 E | FJ898450 | DENV2 E | DQ181843 | DENV2 E | AF295694 |
| DENV2 E | EU482748 | DENV2 E | DQ181826 | DENV2 E | EU482691 | DENV2 E | AY775307 |
| DENV2 E | GU131924 | DENV2 E | EU482570 | DENV2 E | FJ687439 | DENV2 E | FJ807639 |
| DENV2 E | AF410375 | DENV2 E | EU117352 | DENV2 E | GQ368171 | DENV2 E | EU482674 |
| DENV2 E | GQ868640 | DENV2 E | AM746227 | DENV2 E | GQ199874 | DENV2 E | FJ478459 |
| DENV2 E | U89517 | DENV2 E | AY702054 | DENV2 E | EU687217 | DENV2 E | EU448425 |
| DENV2 E | GQ368173 | DENV2 E | FN429894 | DENV2 E | EU117318 | DENV2 E | AF410349 |
| DENV2 E | GU434155 | DENV2 E | EU482702 | DENV2 E | AY237289 | DENV2 E | FJ850121 |
| DENV2 E | EU117334 | DENV2 E | EU482743 | DENV2 E | EU482731 | DENV2 E | FJ205879 |
| DENV2 E | AY786395 | DENV2 E | AF410359 | DENV2 E | EU529706 | DENV2 E | EU448419 |
| DENV2 E | AY706005 | DENV2 E | EU117314 | DENV2 E | AY577439 | DENV2 E | GQ368175 |
| DENV2 E | FJ639710 | DENV2 E | AF398108 | DENV2 E | EU482656 | DENV2 E | FJ687434 |
| DENV2 E | AF119661 | DENV2 E | EU081179 | DENV2 E | DQ181836 | DENV2 E | M24445 |
| DENV2 E | L10048 | DENV2 E | EU529694 | DENV2 E | GU434157 | DENV2 E | DQ518632 |
| DENV2 E | EU482545 | DENV2 E | AF410368 | DENV2 E | EU482543 | DENV2 E | EU482450 |
| DENV2 E | EU687215 | DENV2 E | EU660405 | DENV2 E | EU482732 | DENV2 E | DQ181887 |

FIG. 67-14

| Virus Protein | Accession No. | Virus Protein | Accession No. | Virus Protein | Accession No. | Virus Protein | Accession No. |
|---|---|---|---|---|---|---|---|
| DENV2 E | DQ181864 | DENV2 E | DQ181815 | DENV2 E | FN429891 | DENV2 E | EU117343 |
| DENV2 E | FJ850053 | DENV2 E | GU131881 | DENV2 E | EU482676 | DENV2 E | EU249522 |
| DENV2 E | EU056811 | DENV2 E | DQ181859 | DENV2 E | GQ868604 | DENV2 E | GQ199901 |
| DENV2 E | GU211751 | DENV2 E | GQ868556 | DENV2 E | EU117330 | DENV2 E | EU359009 |
| DENV2 E | DQ181889 | DENV2 E | AY702052 | DENV2 E | GQ868516 | DENV2 E | M24451 |
| DENV2 E | EU596487 | DENV2 E | DQ181900 | DENV2 E | AF398113 | DENV2 E | GU131931 |
| DENV2 E | EU482626 | DENV2 E | AY786402 | DENV2 E | EU482769 | DENV2 E | GU211752 |
| DENV2 E | DQ181857 | DENV2 E | FJ744741 | DENV2 E | FJ744717 | DENV2 E | DQ181884 |
| DENV2 E | FJ538926 | DENV2 E | FB667399 | DENV2 E | FM986656 | DENV2 E | AY577437 |
| DENV2 E | EU482586 | DENV2 E | DQ917245 | DENV2 E | FJ807632 | DENV2 E | FJ906961 |
| DENV2 E | EU482665 | DENV2 E | AF100466 | DENV2 E | DQ181819 | DENV2 E | DQ181872 |
| DENV2 E | AF195043 | DENV2 E | EU117347 | DENV2 E | AY158341 | DENV2 E | DQ181856 |
| DENV2 E | FJ898452 | DENV2 E | FJ390390 | DENV2 E | EU687213 | DENV2 E | EU529700 |
| DENV2 E | FM210219 | DENV2 E | GQ368165 | DENV2 E | FM210239 | DENV2 E | AF363075 |
| DENV2 E | EF105385 | DENV2 E | GQ199894 | DENV2 E | AY786377 | DENV2 E | EU482576 |
| DENV2 E | AB194883 | DENV2 E | FJ898434 | DENV2 E | FJ538922 | DENV2 E | EU482703 |
| DENV2 E | DQ341199 | DENV2 E | EU482597 | DENV2 E | DQ645556 | DENV2 E | AY786404 |
| DENV2 E | EU117336 | DENV2 E | FJ906969 | DENV2 E | EU081180 | DENV2 E | EU482685 |
| DENV2 E | GQ868596 | DENV2 E | AF169679 | DENV2 E | AF410360 | DENV2 E | FM210214 |
| DENV2 E | DQ181808 | DENV2 E | FJ461321 | DENV2 E | AF204177 | DENV2 E | FJ744724 |
| DENV2 E | AY786390 | DENV2 E | EU687224 | DENV2 E | EU482679 | DENV2 E | AF509530 |
| DENV2 E | FJ744719 | DENV2 E | FJ687440 | DENV2 E | EU482472 | DENV2 E | DQ181899 |
| DENV2 E | AY786385 | DENV2 E | GQ368168 | DENV2 E | DQ341200 | DENV2 E | FM210245 |
| DENV2 E | X54319 | DENV2 E | AB111449 | DENV2 E | AY858035 | DENV2 E | GQ199895 |
| DENV2 E | FJ744713 | DENV2 E | EF105380 | DENV2 E | DQ181892 | DENV2 E | AF093674 |
| DENV2 E | EU482475 | DENV2 E | AF100467 | DENV2 E | EU596490 | DENV2 E | EU482604 |
| DENV2 E | FJ461311 | DENV2 E | EU482753 | DENV2 E | FJ850051 | DENV2 E | AF363069 |
| DENV2 E | FJ538918 | DENV2 E | AF022439 | DENV2 E | AF410371 | DENV2 E | FM210236 |
| DENV2 E | EU117324 | DENV2 E | AF100460 | DENV2 E | EU482446 | DENV2 E | AY786373 |
| DENV2 E | GQ868597 | DENV2 E | GU434154 | DENV2 E | EU069579 | DENV2 E | EU482736 |
| DENV2 E | GQ199869 | DENV2 E | EU596495 | DENV2 E | EU482694 | DENV2 E | EU482551 |
| DENV2 E | FJ606703 | DENV2 E | FJ373301 | DENV2 E | GQ868591 | DENV2 E | DQ518630 |
| DENV2 E | EU482449 | DENV2 E | U88237 | DENV2 E | FJ461305 | DENV2 E | AF195032 |
| DENV2 E | EU482773 | DENV2 E | EU069582 | DENV2 E | FJ744709 | DENV2 E | DQ181807 |
| DENV2 E | AF469176 | DENV2 E | DQ448235 | DENV2 E | GQ199868 | DENV2 E | DQ645546 |
| DENV2 E | EU569701 | DENV2 E | FJ906962 | DENV2 E | EU660400 | DENV2 E | EU687228 |
| DENV2 E | AF195033 | DENV2 E | FM986660 | DENV2 E | AJ421524 | DENV2 E | EF105387 |
| DENV2 E | EU482738 | DENV2 E | DQ181814 | DENV2 E | EU482465 | DENV2 E | EU482648 |
| DENV2 E | EU482468 | DENV2 E | FJ850105 | DENV2 E | FM210208 | DENV2 E | FJ538916 |
| DENV2 E | AY642588 | DENV2 E | AY786399 | DENV2 E | AB111453 | DENV2 E | FJ639705 |
| DENV2 E | EU482633 | DENV2 E | EU482542 | DENV2 E | EU482669 | DENV2 E | AF363090 |
| DENV2 E | GU131886 | DENV2 E | AY702036 | DENV2 E | AY702042 | DENV2 E | AF410350 |
| DENV2 E | EU677141 | DENV2 E | AY449680 | DENV2 E | EU529695 | DENV2 E | FJ807640 |
| DENV2 E | GQ868557 | DENV2 E | AY744147 | DENV2 E | AY158337 | DENV2 E | FJ906968 |
| DENV2 E | AJ968413 | DENV2 E | EF441283 | DENV2 E | DQ181881 | DENV2 E | AF100464 |
| DENV2 E | FJ639835 | DENV2 E | FM210227 | DENV2 E | AF195041 | DENV2 E | EU677145 |
| DENV2 E | EU482579 | DENV2 E | FM210231 | DENV2 E | FJ850062 | DENV2 E | EU596485 |
| DENV2 E | AF410373 | DENV2 E | AY237295 | DENV2 E | AF410356 | DENV2 E | FJ898477 |

FIG. 67-15

| Virus Protein | Accession No. | Virus Protein | Accession No. | Virus Protein | Accession No. | Virus Protein | Accession No. |
|---|---|---|---|---|---|---|---|
| DENV2 E | DQ181803 | DENV2 E | EU482760 | DENV2 E | AF410374 | DENV2 E | FJ744706 |
| DENV2 E | GU434148 | DENV2 E | GU131959 | DENV2 E | EU687237 | DENV2 E | X65240 |
| DENV2 E | EU482786 | DENV2 E | AB479041 | DENV2 E | AB122021 | DENV2 E | EU596496 |
| DENV2 E | EF486509 | DENV2 E | DQ518635 | DENV2 E | EU687248 | DENV2 E | AF297007 |
| DENV2 E | EU117323 | DENV2 E | AY702047 | DENV2 E | EU482767 | DENV2 E | M24448 |
| DENV2 E | DQ181869 | DENV2 E | DQ645552 | DENV2 E | DQ181798 | DENV2 E | DQ518649 |
| DENV2 E | EF105389 | DENV2 E | EU482776 | DENV2 E | GU211746 | DENV2 E | AF231715 |
| DENV2 E | EU482781 | DENV2 E | GQ868543 | DENV2 E | AY577432 | DENV2 E | AF363077 |
| DENV2 E | AY158332 | DENV2 E | FJ410237 | DENV2 E | EU482735 | DENV2 E | EU482560 |
| DENV2 E | EU482638 | DENV2 E | AF169686 | DENV2 E | DQ181847 | DENV2 E | EU482723 |
| DENV2 E | DQ917244 | DENV2 E | FJ639707 | DENV2 E | FJ850112 | DENV2 E | EU482741 |
| DENV2 E | FM210217 | DENV2 E | FJ850120 | DENV2 E | GU211758 | DENV2 E | AF455276 |
| DENV2 E | AY237293 | DENV2 E | DQ181862 | DENV2 E | EU569719 | DENV2 E | AY449681 |
| DENV2 E | GU434151 | DENV2 E | FJ639822 | DENV2 E | EU660398 | DENV2 E | EU482549 |
| DENV2 E | AM746222 | DENV2 E | GU211760 | DENV2 E | GQ199897 | DENV2 E | FJ538914 |
| DENV2 E | EF105382 | DENV2 E | EU482699 | DENV2 E | EU482677 | DENV2 E | EU482573 |
| DENV2 E | FJ744742 | DENV2 E | GQ868552 | DENV2 E | EF016253 | DENV2 E | EU482755 |
| DENV2 E | GU131897 | DENV2 E | EU117351 | DENV2 E | AF363082 | DENV2 E | FN429893 |
| DENV2 E | EU482584 | DENV2 E | EU660406 | DENV2 E | EU117317 | DENV2 E | EU069590 |
| DENV2 E | DQ472147 | DENV2 E | EU569715 | DENV2 E | AF410346 | DENV2 E | DQ518640 |
| DENV2 E | EU482624 | DENV2 E | EU069586 | DENV2 E | GQ868545 | DENV2 E | AF022434 |
| DENV2 E | EU482725 | DENV2 E | DQ181845 | DENV2 E | EU117333 | DENV2 E | DQ181878 |
| DENV2 E | FJ810410 | DENV2 E | DQ181821 | DENV2 E | EU069572 | DENV2 E | GQ368158 |
| DENV2 E | L10052 | DENV2 E | AY714061 | DENV2 E | EU482621 | DENV2 E | GU211749 |
| DENV2 E | EU482726 | DENV2 E | AF195035 | DENV2 E | EU687243 | DENV2 E | EU529693 |
| DENV2 E | FJ024475 | DENV2 E | EU045311 | DENV2 E | EU482463 | DENV2 E | EU596499 |
| DENV2 E | FJ744704 | DENV2 E | AF410376 | DENV2 E | EU482606 | DENV2 E | EU482687 |
| DENV2 E | AY786392 | DENV2 E | AF410378 | DENV2 E | DQ645553 | DENV2 E | AF022440 |
| DENV2 E | EU482599 | DENV2 E | L10045 | DENV2 E | AF038403 | DENV2 E | DQ181854 |
| DENV2 E | FJ744712 | DENV2 E | FJ898467 | DENV2 E | FM210204 | DENV2 E | GU131884 |
| DENV2 E | GU211740 | DENV2 E | EF051521 | DENV2 E | GQ868554 | DENV2 E | EU482757 |
| DENV2 E | EU448431 | DENV2 E | AF363084 | DENV2 E | DQ448231 | DENV2 E | AF398110 |
| DENV2 E | EU482681 | DENV2 E | AY484602 | DENV2 E | FJ687443 | DENV2 E | FJ538907 |
| DENV2 E | FJ639831 | DENV2 E | EF486510 | DENV2 E | FJ744710 | DENV2 E | DQ448238 |
| DENV2 E | EU569708 | DENV2 E | AF004020 | DENV2 E | AY702040 | DENV2 E | EU482574 |
| DENV2 E | AY359463 | DENV2 E | FJ158608 | DENV2 E | GU211764 | DENV2 E | EU482764 |
| DENV2 E | EU482583 | DENV2 E | AY786368 | DENV2 E | AY786379 | DENV2 E | AF398106 |
| DENV2 E | DQ518644 | DENV2 E | AY775306 | DENV2 E | FJ538920 | DENV2 E | DQ181830 |
| DENV2 E | AY702050 | DENV2 E | GQ868497 | DENV2 E | EU117339 | DENV2 E | FJ478455 |
| DENV2 E | EU482444 | DENV2 E | EU003591 | DENV2 E | AY786375 | DENV2 E | EU179857 |
| DENV2 E | EU482762 | DENV2 E | EU569699 | DENV2 E | FJ898466 | DENV2 E | FJ024473 |
| DENV2 E | EU482662 | DENV2 E | EU482547 | DENV2 E | EU069574 | DENV2 E | AM746224 |
| DENV2 E | AY577434 | DENV2 E | FJ850064 | DENV2 E | DQ181894 | DENV2 E | EU660416 |
| DENV2 E | AF363086 | DENV2 E | EU482719 | DENV2 E | GQ252677 | DENV2 E | EU069583 |
| DENV2 E | GQ368176 | DENV2 E | EU482448 | DENV2 E | FM986657 | DENV2 E | DQ645547 |
| DENV2 E | L10042 | DENV2 E | EU482720 | DENV2 E | FJ906966 | DENV2 E | AY786394 |
| DENV2 E | DQ181835 | DENV2 E | DQ181812 | DENV2 E | EU117345 | DENV2 E | GM059692 |
| DENV2 E | EU569696 | DENV2 E | AY786383 | DENV2 E | GU289914 | DENV2 E | EU569694 |

FIG. 67-16

| Virus Protein | Accession No. | Virus Protein | Accession No. | Virus Protein | Accession No. | Virus Protein | Accession No. |
|---|---|---|---|---|---|---|---|
| DENV2 E | FJ898436 | DENV2 E | EU482660 | DENV2 E | EU482451 | DENV2 E | EU069589 |
| DENV2 E | FM210216 | DENV2 E | FJ410219 | DENV2 E | FJ882602 | DENV2 E | AF410369 |
| DENV2 E | FJ807633 | DENV2 E | EU569717 | DENV2 E | EU482666 | DENV2 E | FJ850060 |
| DENV2 E | GQ368164 | DENV2 E | AF022435 | DENV2 E | EU482634 | DENV2 E | DQ917242 |
| DENV2 E | FJ807637 | DENV2 E | AY484604 | DENV2 E | DQ645550 | DENV2 E | EU660404 |
| DENV2 E | FM210224 | DENV2 E | EU482788 | DENV2 E | GQ868558 | DENV2 E | EU482690 |
| DENV2 E | DQ341196 | DENV2 E | FJ744743 | DENV2 E | GQ868542 | DENV2 E | EU069580 |
| DENV2 E | DQ181849 | DENV2 E | DQ181840 | DENV2 E | DQ181834 | DENV2 E | EU569720 |
| DENV2 E | AY786369 | DENV2 E | FJ937969 | DENV2 E | EU569706 | DENV2 E | EU069576 |
| DENV2 E | DQ181837 | DENV2 E | AY706002 | DENV2 E | DQ181888 | DENV2 E | AY484607 |
| DENV2 E | GU434146 | DENV2 E | FJ906956 | DENV2 E | AY577438 | DENV2 E | FJ687441 |
| DENV2 E | GU211754 | DENV2 E | DQ181824 | DENV2 E | GQ868631 | DENV2 E | FJ538925 |
| DENV2 E | AY786381 | DENV2 E | AY449678 | DENV2 E | DQ472144 | DENV2 E | AF169678 |
| DENV2 E | EU482778 | DENV2 E | L04561 | DENV2 E | EU482628 | DENV2 E | AF363080 |
| DENV2 E | DQ181860 | DENV2 E | EU482607 | DENV2 E | DQ181885 | DENV2 E | AF100468 |
| DENV2 E | FJ810412 | DENV2 E | EU726776 | DENV2 E | U89518 | DENV2 E | AY778960 |
| DENV2 E | GU131899 | DENV2 E | DQ181828 | DENV2 E | AF297005 | DENV2 E | EU482722 |
| DENV2 E | AB111448 | DENV2 E | DQ181818 | DENV2 E | FJ850108 | DENV2 E | GU131883 |
| DENV2 E | DQ518642 | DENV2 E | AB111451 | DENV2 E | EU448416 | DENV2 E | DQ181827 |
| DENV2 E | GQ368161 | DENV2 E | EU687230 | DENV2 E | EU687214 | DENV2 E | FM210235 |
| DENV2 E | AY158335 | DENV2 E | EU117327 | DENV2 E | AY044442 | DENV2 E | FJ744707 |
| DENV2 E | A91810 | DENV2 E | EU482581 | DENV2 E | EU117346 | DENV2 E | DQ181870 |
| DENV2 E | L10043 | DENV2 E | EU482600 | DENV2 E | AY702055 | DENV2 E | AF004019 |
| DENV2 E | DQ181809 | DENV2 E | FJ538909 | DENV2 E | AY786388 | DENV2 E | EU482588 |
| DENV2 E | FJ639703 | DENV2 E | EU117320 | DENV2 E | EU482689 | DENV2 E | EU677149 |
| DENV2 E | EF105384 | DENV2 E | GU131927 | DENV2 E | FJ882594 | DENV2 E | DQ518636 |
| DENV2 E | AF195037 | DENV2 E | FJ850076 | DENV2 E | FJ744716 | DENV2 E | FJ639734 |
| DENV2 E | AY775303 | DENV2 E | EU249523 | DENV2 E | DQ181865 | DENV2 E | GU211743 |
| DENV2 E | AB189123 | DENV2 E | GQ868638 | DENV2 E | EU482546 | DENV2 E | GQ868555 |
| DENV2 E | AF295698 | DENV2 E | L10053 | DENV2 E | FJ410233 | DENV2 E | GQ868540 |
| DENV2 E | AY484608 | DENV2 E | AF195042 | DENV2 E | AF231717 | DENV2 E | AF169682 |
| DENV2 E | L10054 | DENV2 E | EU482625 | DENV2 E | GQ868600 | DENV2 E | DQ181797 |
| DENV2 E | FM210233 | DENV2 E | FJ538919 | DENV2 E | GU131898 | DENV2 E | FJ687446 |
| DENV2 E | AF410352 | DENV2 E | L10040 | DENV2 E | EU117325 | DENV2 E | FJ639829 |
| DENV2 E | FJ639699 | DENV2 E | GU131843 | DENV2 E | GU211750 | DENV2 E | FJ898453 |
| DENV2 E | FJ182014 | DENV2 E | EU482469 | DENV2 E | FJ538912 | DENV2 E | EU482721 |
| DENV2 E | FJ562098 | DENV2 E | EU117337 | DENV2 E | AY858036 | DENV2 E | FJ898460 |
| DENV2 E | AB194884 | DENV2 E | AB111452 | DENV2 E | AY577431 | DENV2 E | GU434156 |
| DENV2 E | FJ913016 | DENV2 E | EU482772 | DENV2 E | EU687244 | DENV2 E | FJ898438 |
| DENV2 E | AY158330 | DENV2 E | X15433 | DENV2 E | DQ181867 | DENV2 E | FJ807635 |
| DENV2 E | AY775304 | DENV2 E | FM210225 | DENV2 E | FJ850066 | DENV2 E | EU117344 |
| DENV2 E | EU482746 | DENV2 E | AF100461 | DENV2 E | AY449675 | DENV2 E | EU569712 |
| DENV2 E | DQ518637 | DENV2 E | AF410372 | DENV2 E | EU482556 | DENV2 E | DQ181895 |
| DENV2 E | EU117329 | DENV2 E | AY158334 | DENV2 E | AF410367 | DENV2 E | DQ448237 |
| DENV2 E | EU482646 | DENV2 E | EU482668 | DENV2 E | FJ744744 | DENV2 E | EU687250 |
| DENV2 E | FJ687444 | DENV2 E | GQ868598 | DENV2 E | FJ639788 | DENV2 E | EU448424 |
| DENV2 E | GU131901 | DENV2 E | AY786370 | DENV2 E | FN429895 | DENV2 E | FJ432724 |
| DENV2 E | GQ868550 | DENV2 E | EU529701 | DENV2 E | AF231719 | DENV2 E | EU448426 |

FIG. 67-17

| Virus Protein | Accession No. | Virus Protein | Accession No. | Virus Protein | Accession No. | Virus Protein | Accession No. |
|---|---|---|---|---|---|---|---|
| DENV2 E | AF022437 | DENV2 E | EU687229 | DENV2 E | EU677147 | DENV2 E | DQ181844 |
| DENV2 E | DQ181800 | DENV2 E | EU482739 | DENV2 E | GU370051 | DENV2 E | EU569714 |
| DENV2 E | DQ181842 | DENV2 E | EU569709 | DENV2 E | DQ181874 | DENV2 E | AF363070 |
| DENV2 E | D00346 | DENV2 E | AY871813 | DENV2 E | EU482587 | DENV2 E | DQ181890 |
| DENV2 E | EU687241 | DENV2 E | EU687223 | DENV2 E | AF410379 | DENV2 E | GQ868589 |
| DENV2 E | FJ410200 | DENV2 E | AY158339 | DENV2 E | EU069578 | DENV2 E | FJ850078 |
| DENV2 E | FJ205878 | DENV2 E | EF486508 | DENV2 E | DQ645551 | DENV2 E | FM210243 |
| DENV2 E | GU131955 | DENV2 E | AY512568 | DENV2 E | FJ390391 | DENV2 E | EF016251 |
| DENV2 E | FJ906958 | DENV2 E | AY786386 | DENV2 E | DQ181858 | DENV2 E | EU069581 |
| DENV2 E | AY706007 | DENV2 E | EF105386 | DENV2 E | M15075 | DENV2 E | EU482671 |
| DENV2 E | AY449683 | DENV2 E | FJ410217 | DENV2 E | AY786403 | DENV2 E | EU482571 |
| DENV2 E | FJ744722 | DENV2 E | EU482467 | DENV2 E | FJ850054 | DENV2 E | DQ645544 |
| DENV2 E | EU482770 | DENV2 E | DQ341197 | DENV2 E | GU211763 | DENV2 E | FM210238 |
| DENV2 E | GU211744 | DENV2 E | EU117350 | DENV2 E | EU482565 | DENV2 E | AF363072 |
| DENV2 E | AY744149 | DENV2 E | FJ461314 | DENV2 E | EF540856 | DENV2 E | EF105379 |
| DENV2 E | EU482655 | DENV2 E | GQ868595 | DENV2 E | FJ373300 | DENV2 E | DQ518645 |
| DENV2 E | EU677137 | DENV2 E | GU131932 | DENV2 E | AY158340 | DENV2 E | L10047 |
| DENV2 E | AY786396 | DENV2 E | EU056810 | DENV2 E | AY702053 | DENV2 E | EU482728 |
| DENV2 E | EU482744 | DENV2 E | AF022441 | DENV2 E | AF169684 | DENV2 E | FM210229 |
| DENV2 E | FJ639701 | DENV2 E | EU056812 | DENV2 E | DL138662 | DENV2 E | GU131880 |
| DENV2 E | AY237290 | DENV2 E | EU482664 | DENV2 E | FJ538917 | DENV2 E | M19197 |
| DENV2 E | DQ518652 | DENV2 E | FM986654 | DENV2 E | AY702044 | DENV2 E | AY706011 |
| DENV2 E | EU660415 | DENV2 E | EU482568 | DENV2 E | FJ931535 | DENV2 E | GQ868603 |
| DENV2 E | EU482631 | DENV2 E | EU482774 | DENV2 E | GQ868544 | DENV2 E | GU131929 |
| DENV2 E | FJ606704 | DENV2 E | FJ547067 | DENV2 E | FJ744714 | DENV2 E | GQ368170 |
| DENV2 E | M24444 | DENV2 E | EU482474 | DENV2 E | GU434153 | DENV2 E | FJ639732 |
| DENV2 E | DQ518647 | DENV2 E | FJ850118 | DENV2 E | AM746226 | DENV2 E | GU434158 |
| DENV2 E | AF295695 | DENV2 E | EU687216 | DENV2 E | EU179859 | DENV2 E | EU677143 |
| DENV2 E | FJ687435 | DENV2 E | EU482590 | DENV2 E | AF363092 | DENV2 E | EU482682 |
| DENV2 E | DQ181875 | DENV2 E | GQ368174 | DENV2 E | DQ448234 | DENV2 E | EU045312 |
| DENV2 E | FJ639836 | DENV2 E | AF208496 | DENV2 E | GQ368166 | DENV2 E | EU069588 |
| DENV2 E | AY158329 | DENV2 E | EU569693 | DENV2 E | DQ645541 | DENV2 E | AY786372 |
| DENV2 E | FJ538906 | DENV2 E | FJ850106 | DENV2 E | AF100465 | DENV2 E | GQ868641 |
| DENV2 E | AY702034 | DENV2 E | EU117348 | DENV2 E | L10055 | DENV2 E | DQ518638 |
| DENV2 E | AY702058 | DENV2 E | EU482623 | DENV2 E | EU069592 | DENV2 E | DQ181851 |
| DENV2 E | AF363079 | DENV2 E | AM746221 | DENV2 E | EU117341 | DENV2 E | EU482785 |
| DENV2 E | M24447 | DENV2 E | GU131879 | DENV2 E | EU687246 | DENV2 E | AY644452 |
| DENV2 E | EU482696 | DENV2 E | FM210223 | DENV2 E | DQ181863 | DENV2 E | FJ410193 |
| DENV2 E | FJ687438 | DENV2 E | GQ199893 | DENV2 E | EU482750 | DENV2 E | AY706010 |
| DENV2 E | EU596488 | DENV2 E | EU482578 | DENV2 E | AY577436 | DENV2 E | EU482552 |
| DENV2 E | FM210220 | DENV2 E | EU482544 | DENV2 E | AY706017 | DENV2 E | EU677142 |
| DENV2 E | FJ898451 | DENV2 E | EU482759 | DENV2 E | GU131900 | DENV2 E | EU448428 |
| DENV2 E | FJ538927 | DENV2 E | FJ744711 | DENV2 E | FM210211 | DENV2 E | EU687232 |
| DENV2 E | DQ181832 | DENV2 E | AY079424 | DENV2 E | EU482742 | DENV2 E | FM210241 |
| DENV2 E | AB194882 | DENV2 E | EU569704 | DENV2 E | EU482705 | DENV2 E | GQ368159 |
| DENV2 E | FJ639708 | DENV2 E | DQ181816 | DENV2 E | AF195039 | DENV2 E | AY702060 |
| DENV2 E | AF264054 | DENV2 E | AF169685 | DENV2 E | EF105390 | DENV2 E | AY786398 |
| DENV2 E | AF163096 | DENV2 E | EU448418 | DENV2 E | EU482684 | DENV2 E | AY702049 |

FIG. 67-18

| Virus Protein | Accession No. | Virus Protein | Accession No. | Virus Protein | Accession No. | Virus Protein | Accession No. |
|---|---|---|---|---|---|---|---|
| DENV2 E | FJ744725 | DENV2 E | AY786374 | DENV2 E | DQ518641 | DENV2 E | AF363083 |
| DENV2 E | EU117319 | DENV2 E | FJ538915 | DENV2 E | DQ181882 | DENV2 E | AY786367 |
| DENV2 E | GQ868621 | DENV2 E | AF295697 | DENV2 E | AF297009 | DENV2 E | DQ181861 |
| DENV2 E | EU482653 | DENV2 E | AY786393 | DENV2 E | GU434159 | DENV2 E | AY702057 |
| DENV2 E | DQ448232 | DENV2 E | EU069575 | DENV2 E | DQ181852 | DENV2 E | EU117326 |
| DENV2 E | FJ024477 | DENV2 E | DQ917243 | DENV2 E | AF195040 | DENV2 E | AY577433 |
| DENV2 E | AF398112 | DENV2 E | AY484603 | DENV2 E | FJ538923 | DENV2 E | AY449677 |
| DENV2 E | AF410370 | DENV2 E | AY786382 | DENV2 E | AF410357 | DENV2 E | EU448429 |
| DENV2 E | DQ181883 | DENV2 E | AF195034 | DENV2 E | AY237288 | DENV2 E | AY449685 |
| DENV2 E | U87412 | DENV2 E | DM460984 | DENV2 E | EU069577 | DENV2 E | DQ181810 |
| DENV2 E | EU482692 | DENV2 E | GU211761 | DENV2 E | EU117349 | DENV2 E | DQ181880 |
| DENV2 E | L10050 | DENV2 E | GU211741 | DENV2 E | AF363074 | DENV2 E | AB180478 |
| DENV2 E | FM210206 | DENV2 E | DQ181823 | DENV2 E | DQ181897 | DENV2 E | FJ538921 |
| DENV2 E | CS673237 | DENV2 E | EU448427 | DENV2 E | GU211748 | DENV2 E | EU117332 |
| DENV2 E | EU482644 | DENV2 E | EU117328 | DENV2 E | AF195038 | DENV2 E | AF469175 |
| DENV2 E | GU131975 | DENV2 E | GU434150 | DENV2 E | EU117340 | DENV2 E | D00345 |
| DENV2 E | EU482602 | DENV2 E | AF363087 | DENV2 E | GU434152 | DENV2 E | GU211739 |
| DENV2 E | EU482673 | DENV2 E | EF016250 | DENV2 E | EF440433 | DENV2 E | GU211747 |
| DENV2 E | FJ024474 | DENV2 E | AY786384 | DENV2 E | AB111454 | DENV2 E | DQ181811 |
| DENV2 E | FJ744720 | DENV2 E | AY158327 | DENV2 E | EU069591 | DENV2 E | AY449684 |
| DENV2 E | FJ639809 | DENV2 E | EU117321 | DENV2 E | L10049 | DENV2 E | EU069573 |
| DENV2 E | DQ181879 | DENV2 E | AY158338 | DENV2 E | GU434147 | DENV2 E | L10041 |
| DENV2 E | FJ639718 | DENV2 E | AY512569 | DENV2 E | L10051 | DENV2 E | DQ181848 |
| DENV2 E | DQ181802 | DENV2 E | AY577435 | DENV2 E | AM746225 | DENV2 E | FM986655 |
| DENV2 E | FJ810411 | DENV2 E | AY775305 | DENV2 E | EU005258 | DENV2 E | AY702046 |
| DENV2 E | EU482554 | DENV2 E | AY714062 | DENV2 E | AB111450 | DENV2 E | AF363076 |
| DENV2 E | FM210237 | DENV2 E | AY786401 | DENV2 E | FJ807638 | DENV2 E | AY466449 |
| DENV2 E | AY484600 | DENV2 E | DQ181822 | DENV2 E | FJ807634 | DENV2 E | AF297006 |
| DENV2 E | DQ518650 | DENV2 E | DQ181813 | DENV2 E | AY158336 | DENV2 E | EF016252 |
| DENV2 E | GU434149 | DENV2 E | FJ538910 | DENV2 E | AY786405 | DENV2 E | AF410347 |
| DENV2 E | EU482603 | DENV2 E | GU211759 | DENV2 E | DQ472146 | DENV2 E | DQ181853 |
| DENV2 E | DQ518633 | DENV2 E | AF295700 | DENV2 E | EU069584 | DENV2 E | FJ937968 |
| DENV2 E | EF486507 | DENV2 E | DQ181855 | DENV2 E | AF295699 | DENV2 E | DQ181877 |
| DENV2 E | EU482733 | DENV2 E | DQ181891 | DENV2 E | GU211753 | DENV2 E | EU117342 |
| DENV2 E | AY237292 | DENV2 E | AY449682 | DENV2 E | DQ518631 | DENV2 E | AY079423 |
| DENV2 E | FJ850088 | DENV2 E | AF398114 | DENV2 E | DQ518653 | DENV2 E | FM986658 |
| DENV2 E | GQ368160 | DENV2 E | M24450 | DENV2 E | GQ368162 | DENV2 E | DQ341195 |
| DENV2 E | DQ181839 | DENV2 E | AY702041 | DENV2 E | EU448420 | DENV2 E | DQ518634 |
| DENV2 E | L10044 | DENV2 E | DQ181846 | DENV2 E | AY449679 | DENV2 E | GU211757 |
| DENV2 E | GQ368167 | DENV2 E | DQ917246 | DENV2 E | EU117313 | DENV2 E | EU117331 |
| DENV2 E | DQ341201 | DENV2 E | AF410377 | DENV2 E | M24449 | DENV2 E | DQ518648 |
| DENV2 E | DQ181838 | DENV2 E | EU117315 | DENV2 E | GQ368169 | DENV2 E | AY786391 |
| DENV2 E | AM746223 | DENV2 E | FJ538928 | DENV2 E | AF410351 | DENV2 E | EU448415 |
| DENV2 E | DQ448233 | DENV2 E | AY786378 | DENV2 E | EU448422 | DENV2 E | DQ181893 |
| DENV2 E | AF363091 | DENV2 E | AY702051 | DENV2 E | AY484605 | DENV2 E | AY786376 |
| DENV2 E | EU117322 | DENV2 E | AY786400 | DENV2 E | DQ181825 | DENV2 E | AF410355 |
| DENV2 E | AY158331 | DENV2 E | DQ518643 | DENV2 E | AY786389 | DENV2 E | AF363085 |
| DENV2 E | AF398107 | DENV2 E | DQ181871 | DENV2 E | AF195036 | DENV2 E | FJ538908 |

FIG. 67-19

| Virus Protein | Accession No. | Virus Protein | Accession No. | Virus Protein | Accession No. | Virus Protein | Accession No. |
|---|---|---|---|---|---|---|---|
| DENV2 E | AF363088 | DENV2 E | AY577430 | DENV2 E | EU448423 | DENV2 E | FJ606703 |
| DENV2 E | AY702056 | DENV2 E | AF231718 | DENV2 E | EU069585 | DENV2 E | AF469176 |
| DENV2 E | AY237294 | DENV2 E | AY786406 | DENV2 E | DQ181843 | DENV2 E | AF195033 |
| DENV2 E | AY702045 | DENV2 E | AF410345 | DENV2 E | GQ368171 | DENV2 E | AY642588 |
| DENV2 E | DQ448236 | DENV2 E | DQ181866 | DENV2 E | EU117318 | DENV2 E | AF410373 |
| DENV2 E | AY786380 | DENV2 E | DQ181829 | DENV2 E | AY237289 | DENV2 E | DQ181815 |
| DENV2 E | GQ368163 | DENV2 E | AY237291 | DENV2 E | AY577439 | DENV2 E | DQ181859 |
| DENV2 E | DQ917247 | DENV2 E | EU448430 | DENV2 E | DQ181836 | DENV2 E | AY702052 |
| DENV2 E | GU211762 | DENV2 E | AY706016 | DENV2 E | GU434157 | DENV2 E | DQ181900 |
| DENV2 E | DQ181873 | DENV2 E | EU117338 | DENV2 E | FJ538924 | DENV2 E | AY786402 |
| DENV2 E | D10514 | DENV2 E | GQ368172 | DENV2 E | AF231720 | DENV2 E | DQ917245 |
| DENV2 E | FJ807636 | DENV2 E | DQ181886 | DENV2 E | DQ181901 | DENV2 E | EU117347 |
| DENV2 E | EU045313 | DENV2 E | AF410375 | DENV2 E | EU117335 | DENV2 E | GQ368165 |
| DENV2 E | X15214 | DENV2 E | U89517 | DENV2 E | AF264053 | DENV2 E | GQ368168 |
| DENV2 E | GU211755 | DENV2 E | GQ368173 | DENV2 E | AY702048 | DENV2 E | AB111449 |
| DENV2 E | DQ181876 | DENV2 E | GU434155 | DENV2 E | L10046 | DENV2 E | GU434154 |
| DENV2 E | AF363081 | DENV2 E | EU117334 | DENV2 E | DQ518639 | DENV2 E | U88237 |
| DENV2 E | FM986661 | DENV2 E | AY786395 | DENV2 E | AB219135 | DENV2 E | EU069582 |
| DENV2 E | GU211738 | DENV2 E | AY706005 | DENV2 E | DQ181820 | DENV2 E | DQ448235 |
| DENV2 E | EU448421 | DENV2 E | L10048 | DENV2 E | DQ181898 | DENV2 E | FM986660 |
| DENV2 E | AY786366 | DENV2 E | AY484606 | DENV2 E | AF398111 | DENV2 E | DQ181814 |
| DENV2 E | DQ181896 | DENV2 E | AY786371 | DENV2 E | AY484601 | DENV2 E | AY786399 |
| DENV2 E | AF398109 | DENV2 E | AY786387 | DENV2 E | AF363078 | DENV2 E | AY449680 |
| DENV2 E | DQ518651 | DENV2 E | DQ181833 | DENV2 E | AF295694 | DENV2 E | EF441283 |
| DENV2 E | M24446 | DENV2 E | DQ472142 | DENV2 E | AY775307 | DENV2 E | AY237295 |
| DENV2 E | EU069587 | DENV2 E | AY449676 | DENV2 E | FJ807639 | DENV2 E | EU117330 |
| DENV2 E | DQ181850 | DENV2 E | DQ181868 | DENV2 E | EU448425 | DENV2 E | AF398113 |
| DENV2 E | AY512567 | DENV2 E | AY484598 | DENV2 E | AF410349 | DENV2 E | FM986656 |
| DENV2 E | DQ518646 | DENV2 E | EU448417 | DENV2 E | EU448419 | DENV2 E | FJ807632 |
| DENV2 E | GU211745 | DENV2 E | AF231716 | DENV2 E | GQ368175 | DENV2 E | DQ181819 |
| DENV2 E | DQ181831 | DENV2 E | AF297004 | DENV2 E | M24445 | DENV2 E | AY158341 |
| DENV2 E | FM986659 | DENV2 E | AF410366 | DENV2 E | DQ518632 | DENV2 E | AY786377 |
| DENV2 E | AY484599 | DENV2 E | DQ181826 | DENV2 E | DQ181887 | DENV2 E | FJ538922 |
| DENV2 E | DQ181817 | DENV2 E | EU117352 | DENV2 E | DQ181864 | DENV2 E | AF410360 |
| DENV2 E | AF295696 | DENV2 E | AM746227 | DENV2 E | GU211751 | DENV2 E | DQ341200 |
| DENV2 E | DQ341198 | DENV2 E | AY702054 | DENV2 E | DQ181889 | DENV2 E | DQ181892 |
| DENV2 E | DQ181841 | DENV2 E | AF410359 | DENV2 E | DQ181857 | DENV2 E | AF410371 |
| DENV2 E | GU211756 | DENV2 E | EU117314 | DENV2 E | FJ538926 | DENV2 E | EU069579 |
| DENV2 E | EU117316 | DENV2 E | AF398108 | DENV2 E | AF195043 | DENV2 E | AJ421524 |
| DENV2 E | AY702059 | DENV2 E | AF410368 | DENV2 E | AB194883 | DENV2 E | AB111453 |
| DENV2 E | AF363089 | DENV2 E | AY702043 | DENV2 E | DQ341199 | DENV2 E | AY702042 |
| DENV2 E | AY778961 | DENV2 E | AY158333 | DENV2 E | EU117336 | DENV2 E | AY158337 |
| DENV2 E | FJ538905 | DENV2 E | AF363071 | DENV2 E | DQ181808 | DENV2 E | DQ181881 |
| DENV2 E | AF297008 | DENV2 E | AF363073 | DENV2 E | AY786390 | DENV2 E | AF195041 |
| DENV2 E | AF410354 | DENV2 E | AY786397 | DENV2 E | AY786385 | DENV2 E | AF410356 |
| DENV2 E | AF410353 | DENV2 E | GU211742 | DENV2 E | X54319 | DENV2 E | EU117343 |
| DENV2 E | FJ538913 | DENV2 E | AY158328 | DENV2 E | FJ538918 | DENV2 E | EU249522 |
| DENV2 E | X15434 | DENV2 E | FJ538911 | DENV2 E | EU117324 | DENV2 E | M24451 |

FIG. 67-20

| Virus Protein | Accession No. | Virus Protein | Accession No. | Virus Protein | Accession No. | Virus Protein | Accession No. |
|---|---|---|---|---|---|---|---|
| DENV2 E | GU211752 | DENV2 E | DQ181821 | DENV2 E | GQ368158 | DENV2 E | DQ181818 |
| DENV2 E | DQ181884 | DENV2 E | AY714061 | DENV2 E | GU211749 | DENV2 E | AB111451 |
| DENV2 E | AY577437 | DENV2 E | AF195035 | DENV2 E | DQ181854 | DENV2 E | EU117327 |
| DENV2 E | DQ181872 | DENV2 E | EU045311 | DENV2 E | AF398110 | DENV2 E | FJ538909 |
| DENV2 E | DQ181856 | DENV2 E | AF410376 | DENV2 E | FJ538907 | DENV2 E | EU117320 |
| DENV2 E | AF363075 | DENV2 E | AF410378 | DENV2 E | DQ448238 | DENV2 E | EU249523 |
| DENV2 E | AY786404 | DENV2 E | L10045 | DENV2 E | AF398106 | DENV2 E | L10053 |
| DENV2 E | AF509530 | DENV2 E | AF363084 | DENV2 E | DQ181830 | DENV2 E | AF195042 |
| DENV2 E | DQ181899 | DENV2 E | AY484602 | DENV2 E | AM746224 | DENV2 E | FJ538919 |
| DENV2 E | AF093674 | DENV2 E | EF486510 | DENV2 E | EU069583 | DENV2 E | L10040 |
| DENV2 E | AF363069 | DENV2 E | AF004020 | DENV2 E | AY786394 | DENV2 E | EU117337 |
| DENV2 E | AY786373 | DENV2 E | FJ158608 | DENV2 E | FJ807633 | DENV2 E | AB111452 |
| DENV2 E | DQ518630 | DENV2 E | AY786368 | DENV2 E | GQ368164 | DENV2 E | X15433 |
| DENV2 E | AF195032 | DENV2 E | AY775306 | DENV2 E | FJ807637 | DENV2 E | AF410372 |
| DENV2 E | DQ181807 | DENV2 E | DQ181812 | DENV2 E | DQ341196 | DENV2 E | AY158334 |
| DENV2 E | FJ538916 | DENV2 E | AY786383 | DENV2 E | DQ181849 | DENV2 E | AY786370 |
| DENV2 E | AF363090 | DENV2 E | AF410374 | DENV2 E | AY786369 | DENV2 E | DQ181834 |
| DENV2 E | AF410350 | DENV2 E | GU211746 | DENV2 E | DQ181837 | DENV2 E | DQ181888 |
| DENV2 E | FJ807640 | DENV2 E | AY577432 | DENV2 E | GU434146 | DENV2 E | AY577438 |
| DENV2 E | GU434148 | DENV2 E | DQ181847 | DENV2 E | GU211754 | DENV2 E | DQ472144 |
| DENV2 E | EF486509 | DENV2 E | GU211758 | DENV2 E | AY786381 | DENV2 E | DQ181885 |
| DENV2 E | EU117323 | DENV2 E | EF016253 | DENV2 E | DQ181860 | DENV2 E | U89518 |
| DENV2 E | DQ181869 | DENV2 E | AF363082 | DENV2 E | AB111448 | DENV2 E | AF297005 |
| DENV2 E | AY158332 | DENV2 E | EU117317 | DENV2 E | DQ518642 | DENV2 E | EU448416 |
| DENV2 E | DQ917244 | DENV2 E | AF410346 | DENV2 E | GQ368161 | DENV2 E | AY044442 |
| DENV2 E | AY237293 | DENV2 E | EU117333 | DENV2 E | AY158335 | DENV2 E | EU117346 |
| DENV2 E | GU434151 | DENV2 E | EU069572 | DENV2 E | A91810 | DENV2 E | AY702055 |
| DENV2 E | AM746222 | DENV2 E | GU211764 | DENV2 E | L10043 | DENV2 E | AY786388 |
| DENV2 E | DQ472147 | DENV2 E | AY786379 | DENV2 E | DQ181809 | DENV2 E | DQ181865 |
| DENV2 E | L10052 | DENV2 E | FJ538920 | DENV2 E | AF195037 | DENV2 E | AF231717 |
| DENV2 E | AY786392 | DENV2 E | EU117339 | DENV2 E | AY775303 | DENV2 E | EU117325 |
| DENV2 E | GU211740 | DENV2 E | AY786375 | DENV2 E | AF295698 | DENV2 E | GU211750 |
| DENV2 E | EU448431 | DENV2 E | EU069574 | DENV2 E | AY484608 | DENV2 E | FJ538912 |
| DENV2 E | AY359463 | DENV2 E | DQ181894 | DENV2 E | L10054 | DENV2 E | AY577431 |
| DENV2 E | DQ518644 | DENV2 E | FM986657 | DENV2 E | AF410352 | DENV2 E | DQ181867 |
| DENV2 E | AY702050 | DENV2 E | EU117345 | DENV2 E | AB194884 | DENV2 E | AY449675 |
| DENV2 E | AY577434 | DENV2 E | X65240 | DENV2 E | AY158330 | DENV2 E | AF410367 |
| DENV2 E | AF363086 | DENV2 E | AF297007 | DENV2 E | AY775304 | DENV2 E | AF231719 |
| DENV2 E | GQ368176 | DENV2 E | M24448 | DENV2 E | DQ518637 | DENV2 E | EU069589 |
| DENV2 E | L10042 | DENV2 E | DQ518649 | DENV2 E | EU117329 | DENV2 E | AF410369 |
| DENV2 E | DQ181835 | DENV2 E | AF231715 | DENV2 E | AY484604 | DENV2 E | DQ917242 |
| DENV2 E | DQ518635 | DENV2 E | AF363077 | DENV2 E | DQ181840 | DENV2 E | EU069580 |
| DENV2 E | AY702047 | DENV2 E | AF455276 | DENV2 E | FJ937969 | DENV2 E | EU069576 |
| DENV2 E | DQ181862 | DENV2 E | AY449681 | DENV2 E | AY706002 | DENV2 E | AY484607 |
| DENV2 E | GU211760 | DENV2 E | FJ538914 | DENV2 E | DQ181824 | DENV2 E | FJ538925 |
| DENV2 E | EU117351 | DENV2 E | EU069590 | DENV2 E | AY449678 | DENV2 E | AF363080 |
| DENV2 E | EU069586 | DENV2 E | DQ518640 | DENV2 E | L04561 | DENV2 E | AY778960 |
| DENV2 E | DQ181845 | DENV2 E | DQ181878 | DENV2 E | DQ181828 | DENV2 E | DQ181827 |

FIG. 67-21

| Virus | Protein | Accession No. | Virus | Protein | Accession No. | Virus | Protein | Accession No. | Virus | Protein | Accession No. |
|---|---|---|---|---|---|---|---|---|---|---|---|
| DENV2 | E | DQ181870 | DENV2 | E | DQ181874 | DENV2 | E | EU117319 | DENV2 | E | AY577435 |
| DENV2 | E | AF004019 | DENV2 | E | AF410379 | DENV2 | E | DQ448232 | DENV2 | E | AY775305 |
| DENV2 | E | DQ518636 | DENV2 | E | EU069578 | DENV2 | E | AF398112 | DENV2 | E | AY714062 |
| DENV2 | E | GU211743 | DENV2 | E | DQ181858 | DENV2 | E | AF410370 | DENV2 | E | AY786401 |
| DENV2 | E | GU434156 | DENV2 | E | M15075 | DENV2 | E | DQ181883 | DENV2 | E | DQ181822 |
| DENV2 | E | FJ807635 | DENV2 | E | AY786403 | DENV2 | E | L10050 | DENV2 | E | DQ181813 |
| DENV2 | E | EU117344 | DENV2 | E | GU211763 | DENV2 | E | CS673237 | DENV2 | E | FJ538910 |
| DENV2 | E | DQ181895 | DENV2 | E | EF540856 | DENV2 | E | DQ181879 | DENV2 | E | GU211759 |
| DENV2 | E | DQ448237 | DENV2 | E | AY158340 | DENV2 | E | AY484600 | DENV2 | E | AF295700 |
| DENV2 | E | EU448424 | DENV2 | E | AY702053 | DENV2 | E | DQ518650 | DENV2 | E | DQ181855 |
| DENV2 | E | EU448426 | DENV2 | E | FJ538917 | DENV2 | E | GU434149 | DENV2 | E | DQ181891 |
| DENV2 | E | DQ181842 | DENV2 | E | AY702044 | DENV2 | E | DQ518633 | DENV2 | E | AY449682 |
| DENV2 | E | D00346 | DENV2 | E | FJ931535 | DENV2 | E | EF486507 | DENV2 | E | AF398114 |
| DENV2 | E | AY706007 | DENV2 | E | GU434153 | DENV2 | E | AY237292 | DENV2 | E | M24450 |
| DENV2 | E | AY449683 | DENV2 | E | AM746226 | DENV2 | E | GQ368160 | DENV2 | E | AY702041 |
| DENV2 | E | GU211744 | DENV2 | E | AF363092 | DENV2 | E | DQ181839 | DENV2 | E | DQ181846 |
| DENV2 | E | AY786396 | DENV2 | E | DQ448234 | DENV2 | E | L10044 | DENV2 | E | DQ917246 |
| DENV2 | E | AY237290 | DENV2 | E | GQ368166 | DENV2 | E | GQ368167 | DENV2 | E | AF410377 |
| DENV2 | E | DQ518652 | DENV2 | E | L10055 | DENV2 | E | DQ341201 | DENV2 | E | EU117315 |
| DENV2 | E | FJ606704 | DENV2 | E | EU069592 | DENV2 | E | DQ181838 | DENV2 | E | FJ538928 |
| DENV2 | E | M24444 | DENV2 | E | EU117341 | DENV2 | E | AM746223 | DENV2 | E | AY786378 |
| DENV2 | E | DQ518647 | DENV2 | E | DQ181863 | DENV2 | E | AF363091 | DENV2 | E | AY702051 |
| DENV2 | E | AF295695 | DENV2 | E | AY577436 | DENV2 | E | EU117322 | DENV2 | E | AY786400 |
| DENV2 | E | DQ181875 | DENV2 | E | AY706017 | DENV2 | E | AY158331 | DENV2 | E | DQ518643 |
| DENV2 | E | AY158329 | DENV2 | E | AF195039 | DENV2 | E | AF398107 | DENV2 | E | DQ181871 |
| DENV2 | E | FJ538906 | DENV2 | E | DQ181844 | DENV2 | E | AY786374 | DENV2 | E | DQ518641 |
| DENV2 | E | AY702058 | DENV2 | E | AF363070 | DENV2 | E | FJ538915 | DENV2 | E | DQ181882 |
| DENV2 | E | AF363079 | DENV2 | E | DQ181890 | DENV2 | E | AF295697 | DENV2 | E | AF297009 |
| DENV2 | E | M24447 | DENV2 | E | EF016251 | DENV2 | E | AY786393 | DENV2 | E | GU434159 |
| DENV2 | E | FJ538927 | DENV2 | E | EU069581 | DENV2 | E | EU069575 | DENV2 | E | DQ181852 |
| DENV2 | E | DQ181832 | DENV2 | E | AF363072 | DENV2 | E | DQ917243 | DENV2 | E | AF195040 |
| DENV2 | E | AB194882 | DENV2 | E | DQ518645 | DENV2 | E | AY484603 | DENV2 | E | FJ538923 |
| DENV2 | E | AF264054 | DENV2 | E | L10047 | DENV2 | E | AY786382 | DENV2 | E | AF410357 |
| DENV2 | E | AF163096 | DENV2 | E | AY706011 | DENV2 | E | AF195034 | DENV2 | E | AY237288 |
| DENV2 | E | AY871813 | DENV2 | E | GQ368170 | DENV2 | E | DM460984 | DENV2 | E | EU069577 |
| DENV2 | E | AY158339 | DENV2 | E | GU434158 | DENV2 | E | GU211761 | DENV2 | E | EU117349 |
| DENV2 | E | EF486508 | DENV2 | E | EU045312 | DENV2 | E | GU211741 | DENV2 | E | AF363074 |
| DENV2 | E | AY512568 | DENV2 | E | EU069588 | DENV2 | E | DQ181823 | DENV2 | E | DQ181897 |
| DENV2 | E | AY786386 | DENV2 | E | AY786372 | DENV2 | E | EU448427 | DENV2 | E | GU211748 |
| DENV2 | E | DQ341197 | DENV2 | E | DQ518638 | DENV2 | E | EU117328 | DENV2 | E | AF195038 |
| DENV2 | E | EU117350 | DENV2 | E | DQ181851 | DENV2 | E | GU434150 | DENV2 | E | EU117340 |
| DENV2 | E | FM986654 | DENV2 | E | AY644452 | DENV2 | E | AF363087 | DENV2 | E | GU434152 |
| DENV2 | E | GQ368174 | DENV2 | E | AY706010 | DENV2 | E | EF016250 | DENV2 | E | AB111454 |
| DENV2 | E | EU117348 | DENV2 | E | EU448428 | DENV2 | E | AY786384 | DENV2 | E | EU069591 |
| DENV2 | E | AM746221 | DENV2 | E | GQ368159 | DENV2 | E | AY158327 | DENV2 | E | L10049 |
| DENV2 | E | AY079424 | DENV2 | E | AY702060 | DENV2 | E | EU117321 | DENV2 | E | GU434147 |
| DENV2 | E | DQ181816 | DENV2 | E | AY786398 | DENV2 | E | AY158338 | DENV2 | E | L10051 |
| DENV2 | E | EU448418 | DENV2 | E | AY702049 | DENV2 | E | AY512569 | DENV2 | E | AM746225 |

FIG. 67-22

| Virus Protein | Accession No. | Virus Protein | Accession No. | Virus Protein | Accession No. | Virus Protein | Accession No. |
|---|---|---|---|---|---|---|---|
| DENV2 E | EU005258 | DENV2 E | AF363076 | DENV2 E | DQ181850 | DENV2 E | AY484598 |
| DENV2 E | AB111450 | DENV2 E | AY466449 | DENV2 E | AY512567 | DENV2 E | EU448417 |
| DENV2 E | FJ807638 | DENV2 E | AF297006 | DENV2 E | DQ518646 | DENV2 E | AF231716 |
| DENV2 E | FJ807634 | DENV2 E | EF016252 | DENV2 E | GU211745 | DENV2 E | AF297004 |
| DENV2 E | AY158336 | DENV2 E | AF410347 | DENV2 E | DQ181831 | DENV2 E | AF410366 |
| DENV2 E | AY786405 | DENV2 E | DQ181853 | DENV2 E | FM986659 | DENV2 E | DQ181826 |
| DENV2 E | DQ472146 | DENV2 E | FJ937968 | DENV2 E | AY484599 | DENV2 E | EU117352 |
| DENV2 E | EU069584 | DENV2 E | DQ181877 | DENV2 E | DQ181817 | DENV2 E | AM746227 |
| DENV2 E | AF295699 | DENV2 E | EU117342 | DENV2 E | AF295696 | DENV2 E | AY702054 |
| DENV2 E | GU211753 | DENV2 E | AY079423 | DENV2 E | DQ341198 | DENV2 E | AF410359 |
| DENV2 E | DQ518631 | DENV2 E | FM986658 | DENV2 E | DQ181841 | DENV2 E | EU117314 |
| DENV2 E | DQ518653 | DENV2 E | DQ341195 | DENV2 E | GU211756 | DENV2 E | AF398108 |
| DENV2 E | GQ368162 | DENV2 E | DQ518634 | DENV2 E | EU117316 | DENV2 E | AF410368 |
| DENV2 E | EU448420 | DENV2 E | GU211757 | DENV2 E | AY702059 | DENV2 E | AY702043 |
| DENV2 E | AY449679 | DENV2 E | EU117331 | DENV2 E | AF363089 | DENV2 E | AY158333 |
| DENV2 E | EU117313 | DENV2 E | DQ518648 | DENV2 E | AY778961 | DENV2 E | AF363071 |
| DENV2 E | M24449 | DENV2 E | AY786391 | DENV2 E | FJ538905 | DENV2 E | AF363073 |
| DENV2 E | GQ368169 | DENV2 E | EU448415 | DENV2 E | AF297008 | DENV2 E | AY786397 |
| DENV2 E | AF410351 | DENV2 E | DQ181893 | DENV2 E | AF410354 | DENV2 E | GU211742 |
| DENV2 E | EU448422 | DENV2 E | AY786376 | DENV2 E | AF410353 | DENV2 E | AY158328 |
| DENV2 E | AY484605 | DENV2 E | AF410355 | DENV2 E | FJ538913 | DENV2 E | FJ538911 |
| DENV2 E | DQ181825 | DENV2 E | AF363085 | DENV2 E | X15434 | DENV2 E | EU448423 |
| DENV2 E | AY786389 | DENV2 E | FJ538908 | DENV2 E | AY577430 | DENV2 E | EU069585 |
| DENV2 E | AF195036 | DENV2 E | AF363088 | DENV2 E | AF231718 | DENV2 E | DQ181843 |
| DENV2 E | AF363083 | DENV2 E | AY702056 | DENV2 E | AY786406 | DENV2 E | GQ368171 |
| DENV2 E | AY786367 | DENV2 E | AY237294 | DENV2 E | AF410345 | DENV2 E | EU117318 |
| DENV2 E | DQ181861 | DENV2 E | AY702045 | DENV2 E | DQ181866 | DENV2 E | AY237289 |
| DENV2 E | AY702057 | DENV2 E | AY786380 | DENV2 E | DQ181829 | DENV2 E | AY577439 |
| DENV2 E | EU117326 | DENV2 E | GQ368163 | DENV2 E | AY237291 | DENV2 E | DQ181836 |
| DENV2 E | AY577433 | DENV2 E | DQ917247 | DENV2 E | EU448430 | DENV2 E | GU434157 |
| DENV2 E | AY449677 | DENV2 E | GU211762 | DENV2 E | AY706016 | DENV2 E | FJ538924 |
| DENV2 E | EU448429 | DENV2 E | DQ181873 | DENV2 E | EU117338 | DENV2 E | AF231720 |
| DENV2 E | AY449685 | DENV2 E | D10514 | DENV2 E | GQ368172 | DENV2 E | DQ181901 |
| DENV2 E | DQ181810 | DENV2 E | FJ807636 | DENV2 E | DQ181886 | DENV2 E | EU117335 |
| DENV2 E | DQ181880 | DENV2 E | EU045313 | DENV2 E | AF410375 | DENV2 E | AF264053 |
| DENV2 E | AB180478 | DENV2 E | X15214 | DENV2 E | GQ368173 | DENV2 E | AY702048 |
| DENV2 E | FJ538921 | DENV2 E | GU211755 | DENV2 E | GU434155 | DENV2 E | L10046 |
| DENV2 E | EU117332 | DENV2 E | DQ181876 | DENV2 E | EU117334 | DENV2 E | DQ518639 |
| DENV2 E | D00345 | DENV2 E | AF363081 | DENV2 E | AY786395 | DENV2 E | AB219135 |
| DENV2 E | GU211739 | DENV2 E | FM986661 | DENV2 E | AY706005 | DENV2 E | DQ181820 |
| DENV2 E | GU211747 | DENV2 E | GU211738 | DENV2 E | L10048 | DENV2 E | DQ181898 |
| DENV2 E | DQ181811 | DENV2 E | EU448421 | DENV2 E | AY484606 | DENV2 E | AF398111 |
| DENV2 E | AY449684 | DENV2 E | AY786366 | DENV2 E | AY786371 | DENV2 E | AY484601 |
| DENV2 E | EU069573 | DENV2 E | DQ181896 | DENV2 E | AY786387 | DENV2 E | AF363078 |
| DENV2 E | L10041 | DENV2 E | AF398109 | DENV2 E | DQ181833 | DENV2 E | AF295694 |
| DENV2 E | DQ181848 | DENV2 E | DQ518651 | DENV2 E | DQ472142 | DENV2 E | AY775307 |
| DENV2 E | FM986655 | DENV2 E | M24446 | DENV2 E | AY449676 | DENV2 E | FJ807639 |
| DENV2 E | AY702046 | DENV2 E | EU069587 | DENV2 E | DQ181868 | DENV2 E | EU448425 |

FIG. 67-23

| Virus Protein | Accession No. | Virus Protein | Accession No. | Virus Protein | Accession No. | Virus Protein | Accession No. |
|---|---|---|---|---|---|---|---|
| DENV2 E | AF410349 | DENV2 E | AY158341 | DENV2 E | GU211740 | DENV2 E | AY786375 |
| DENV2 E | EU448419 | DENV2 E | AY786377 | DENV2 E | EU448431 | DENV2 E | EU069574 |
| DENV2 E | GQ368175 | DENV2 E | FJ538922 | DENV2 E | AY359463 | DENV2 E | DQ181894 |
| DENV2 E | M24445 | DENV2 E | AF410360 | DENV2 E | DQ518644 | DENV2 E | FM986657 |
| DENV2 E | DQ518632 | DENV2 E | DQ341200 | DENV2 E | AY702050 | DENV2 E | EU117345 |
| DENV2 E | DQ181887 | DENV2 E | DQ181892 | DENV2 E | AY577434 | DENV2 E | X65240 |
| DENV2 E | DQ181864 | DENV2 E | AF410371 | DENV2 E | AF363086 | DENV2 E | AF297007 |
| DENV2 E | GU211751 | DENV2 E | EU069579 | DENV2 E | GQ368176 | DENV2 E | M24448 |
| DENV2 E | DQ181889 | DENV2 E | AJ421524 | DENV2 E | L10042 | DENV2 E | DQ518649 |
| DENV2 E | DQ181857 | DENV2 E | AB111453 | DENV2 E | DQ181835 | DENV2 E | AF231715 |
| DENV2 E | FJ538926 | DENV2 E | AY702042 | DENV2 E | DQ518635 | DENV2 E | AF363077 |
| DENV2 E | AF195043 | DENV2 E | AY158337 | DENV2 E | AY702047 | DENV2 E | AF455276 |
| DENV2 E | AB194883 | DENV2 E | DQ181881 | DENV2 E | DQ181862 | DENV2 E | AY449681 |
| DENV2 E | DQ341199 | DENV2 E | AF195041 | DENV2 E | GU211760 | DENV2 E | FJ538914 |
| DENV2 E | EU117336 | DENV2 E | AF410356 | DENV2 E | EU117351 | DENV2 E | EU069590 |
| DENV2 E | DQ181808 | DENV2 E | EU117343 | DENV2 E | EU069586 | DENV2 E | DQ518640 |
| DENV2 E | AY786390 | DENV2 E | EU249522 | DENV2 E | DQ181845 | DENV2 E | DQ181878 |
| DENV2 E | AY786385 | DENV2 E | M24451 | DENV2 E | DQ181821 | DENV2 E | GQ368158 |
| DENV2 E | X54319 | DENV2 E | GU211752 | DENV2 E | AY714061 | DENV2 E | GU211749 |
| DENV2 E | FJ538918 | DENV2 E | DQ181884 | DENV2 E | AF195035 | DENV2 E | DQ181854 |
| DENV2 E | EU117324 | DENV2 E | AY577437 | DENV2 E | EU045311 | DENV2 E | AF398110 |
| DENV2 E | FJ606703 | DENV2 E | DQ181872 | DENV2 E | AF410376 | DENV2 E | FJ538907 |
| DENV2 E | AF195033 | DENV2 E | DQ181856 | DENV2 E | AF410378 | DENV2 E | AF398106 |
| DENV2 E | AY642588 | DENV2 E | AF363075 | DENV2 E | L10045 | DENV2 E | DQ181830 |
| DENV2 E | AF410373 | DENV2 E | AY786404 | DENV2 E | AF363084 | DENV2 E | AM746224 |
| DENV2 E | DQ181815 | DENV2 E | DQ181899 | DENV2 E | AY484602 | DENV2 E | EU069583 |
| DENV2 E | DQ181859 | DENV2 E | AF093674 | DENV2 E | EF486510 | DENV2 E | AY786394 |
| DENV2 E | AY702052 | DENV2 E | AF363069 | DENV2 E | AF004020 | DENV2 E | FJ807633 |
| DENV2 E | DQ181900 | DENV2 E | AY786373 | DENV2 E | FJ158608 | DENV2 E | GQ368164 |
| DENV2 E | AY786402 | DENV2 E | DQ518630 | DENV2 E | AY786368 | DENV2 E | FJ807637 |
| DENV2 E | DQ917245 | DENV2 E | AF195032 | DENV2 E | AY775306 | DENV2 E | DQ341196 |
| DENV2 E | EU117347 | DENV2 E | DQ181807 | DENV2 E | DQ181812 | DENV2 E | DQ181849 |
| DENV2 E | GQ368165 | DENV2 E | FJ538916 | DENV2 E | AY786383 | DENV2 E | AY786369 |
| DENV2 E | GQ368168 | DENV2 E | AF363090 | DENV2 E | AF410374 | DENV2 E | DQ181837 |
| DENV2 E | AB111449 | DENV2 E | AF410350 | DENV2 E | GU211746 | DENV2 E | GU434146 |
| DENV2 E | GU434154 | DENV2 E | FJ807640 | DENV2 E | AY577432 | DENV2 E | GU211754 |
| DENV2 E | EU069582 | DENV2 E | GU434148 | DENV2 E | DQ181847 | DENV2 E | AY786381 |
| DENV2 E | FM986660 | DENV2 E | EF486509 | DENV2 E | GU211758 | DENV2 E | DQ181860 |
| DENV2 E | DQ181814 | DENV2 E | EU117323 | DENV2 E | EF016253 | DENV2 E | AB111448 |
| DENV2 E | AY786399 | DENV2 E | DQ181869 | DENV2 E | AF363082 | DENV2 E | DQ518642 |
| DENV2 E | AY449680 | DENV2 E | AY158332 | DENV2 E | EU117317 | DENV2 E | GQ368161 |
| DENV2 E | EF441283 | DENV2 E | DQ917244 | DENV2 E | AF410346 | DENV2 E | AY158335 |
| DENV2 E | AY237295 | DENV2 E | AY237293 | DENV2 E | EU117333 | DENV2 E | A91810 |
| DENV2 E | EU117330 | DENV2 E | GU434151 | DENV2 E | EU069572 | DENV2 E | L10043 |
| DENV2 E | AF398113 | DENV2 E | AM746222 | DENV2 E | GU211764 | DENV2 E | DQ181809 |
| DENV2 E | FM986656 | DENV2 E | DQ472147 | DENV2 E | AY786379 | DENV2 E | AF195037 |
| DENV2 E | FJ807632 | DENV2 E | L10052 | DENV2 E | FJ538920 | DENV2 E | AY775303 |
| DENV2 E | DQ181819 | DENV2 E | AY786392 | DENV2 E | EU117339 | DENV2 E | AF295698 |

FIG. 67-24

| Virus Protein | Accession No. | Virus Protein | Accession No. | Virus Protein | Accession No. | Virus Protein | Accession No. |
|---|---|---|---|---|---|---|---|
| DENV2 E | AY484608 | DENV2 E | AY449675 | DENV2 E | AY512568 | DENV2 E | DQ518638 |
| DENV2 E | L10054 | DENV2 E | AF410367 | DENV2 E | AY786386 | DENV2 E | DQ181851 |
| DENV2 E | AF410352 | DENV2 E | AF231719 | DENV2 E | DQ341197 | DENV2 E | AY644452 |
| DENV2 E | AB194884 | DENV2 E | EU069589 | DENV2 E | EU117350 | DENV2 E | AY706010 |
| DENV2 E | AY158330 | DENV2 E | AF410369 | DENV2 E | FM986654 | DENV2 E | EU448428 |
| DENV2 E | AY775304 | DENV2 E | DQ917242 | DENV2 E | GQ368174 | DENV2 E | GQ368159 |
| DENV2 E | DQ518637 | DENV2 E | EU069580 | DENV2 E | EU117348 | DENV2 E | AY702060 |
| DENV2 E | EU117329 | DENV2 E | EU069576 | DENV2 E | AM746221 | DENV2 E | AY786398 |
| DENV2 E | AY484604 | DENV2 E | AY484607 | DENV2 E | AY079424 | DENV2 E | AY702049 |
| DENV2 E | DQ181840 | DENV2 E | FJ538925 | DENV2 E | DQ181816 | DENV2 E | EU117319 |
| DENV2 E | FJ937969 | DENV2 E | AF363080 | DENV2 E | EU448418 | DENV2 E | AF398112 |
| DENV2 E | AY706002 | DENV2 E | AY778960 | DENV2 E | DQ181874 | DENV2 E | AF410370 |
| DENV2 E | DQ181824 | DENV2 E | DQ181827 | DENV2 E | AF410379 | DENV2 E | DQ181883 |
| DENV2 E | AY449678 | DENV2 E | DQ181870 | DENV2 E | EU069578 | DENV2 E | L10050 |
| DENV2 E | DQ181828 | DENV2 E | AF004019 | DENV2 E | DQ181858 | DENV2 E | CS673237 |
| DENV2 E | DQ181818 | DENV2 E | DQ518636 | DENV2 E | AY786403 | DENV2 E | DQ181879 |
| DENV2 E | AB111451 | DENV2 E | GU211743 | DENV2 E | GU211763 | DENV2 E | AY484600 |
| DENV2 E | EU117327 | DENV2 E | GU434156 | DENV2 E | EF540856 | DENV2 E | DQ518650 |
| DENV2 E | FJ538909 | DENV2 E | FJ807635 | DENV2 E | AY158340 | DENV2 E | GU434149 |
| DENV2 E | EU117320 | DENV2 E | EU117344 | DENV2 E | AY702053 | DENV2 E | DQ518633 |
| DENV2 E | EU249523 | DENV2 E | DQ181895 | DENV2 E | FJ538917 | DENV2 E | EF486507 |
| DENV2 E | L10053 | DENV2 E | EU448424 | DENV2 E | AY702044 | DENV2 E | AY237292 |
| DENV2 E | AF195042 | DENV2 E | EU448426 | DENV2 E | FJ931535 | DENV2 E | GQ368160 |
| DENV2 E | FJ538919 | DENV2 E | DQ181842 | DENV2 E | GU434153 | DENV2 E | DQ181839 |
| DENV2 E | L10040 | DENV2 E | AY706007 | DENV2 E | AM746226 | DENV2 E | L10044 |
| DENV2 E | EU117337 | DENV2 E | AY449683 | DENV2 E | AF363092 | DENV2 E | GQ368167 |
| DENV2 E | AB111452 | DENV2 E | GU211744 | DENV2 E | GQ368166 | DENV2 E | DQ341201 |
| DENV2 E | X15433 | DENV2 E | AY786396 | DENV2 E | L10055 | DENV2 E | DQ181838 |
| DENV2 E | AF410372 | DENV2 E | AY237290 | DENV2 E | EU069592 | DENV2 E | AM746223 |
| DENV2 E | AY158334 | DENV2 E | DQ518652 | DENV2 E | EU117341 | DENV2 E | AF363091 |
| DENV2 E | AY786370 | DENV2 E | FJ606704 | DENV2 E | DQ181863 | DENV2 E | EU117322 |
| DENV2 E | DQ181834 | DENV2 E | M24444 | DENV2 E | AY577436 | DENV2 E | AY158331 |
| DENV2 E | DQ181888 | DENV2 E | DQ518647 | DENV2 E | AY706017 | DENV2 E | AF398107 |
| DENV2 E | AY577438 | DENV2 E | AF295695 | DENV2 E | AF195039 | DENV2 E | AY786374 |
| DENV2 E | DQ472144 | DENV2 E | DQ181875 | DENV2 E | DQ181844 | DENV2 E | FJ538915 |
| DENV2 E | DQ181885 | DENV2 E | AY158329 | DENV2 E | AF363070 | DENV2 E | AF295697 |
| DENV2 E | AF297005 | DENV2 E | FJ538906 | DENV2 E | DQ181890 | DENV2 E | AY786393 |
| DENV2 E | EU448416 | DENV2 E | AY702058 | DENV2 E | EF016251 | DENV2 E | EU069575 |
| DENV2 E | EU117346 | DENV2 E | AF363079 | DENV2 E | EU069581 | DENV2 E | DQ917243 |
| DENV2 E | AY702055 | DENV2 E | M24447 | DENV2 E | AF363072 | DENV2 E | AY484603 |
| DENV2 E | AY786388 | DENV2 E | FJ538927 | DENV2 E | DQ518645 | DENV2 E | AY786382 |
| DENV2 E | DQ181865 | DENV2 E | DQ181832 | DENV2 E | L10047 | DENV2 E | AF195034 |
| DENV2 E | AF231717 | DENV2 E | AB194882 | DENV2 E | AY706011 | DENV2 E | DM460984 |
| DENV2 E | EU117325 | DENV2 E | AF264054 | DENV2 E | GQ368170 | DENV2 E | GU211761 |
| DENV2 E | GU211750 | DENV2 E | AF163096 | DENV2 E | GU434158 | DENV2 E | GU211741 |
| DENV2 E | FJ538912 | DENV2 E | AY871813 | DENV2 E | EU045312 | DENV2 E | DQ181823 |
| DENV2 E | AY577431 | DENV2 E | AY158339 | DENV2 E | EU069588 | DENV2 E | EU448427 |
| DENV2 E | DQ181867 | DENV2 E | EF486508 | DENV2 E | AY786372 | DENV2 E | EU117328 |

FIG. 67-25

| Virus | Protein | Accession No. | Virus | Protein | Accession No. | Virus | Protein | Accession No. | Virus | Protein | Accession No. |
|---|---|---|---|---|---|---|---|---|---|---|---|
| DENV2 | E | GU434150 | DENV2 | E | EU117340 | DENV2 | E | GU211747 | DENV2 | E | GU211738 |
| DENV2 | E | AF363087 | DENV2 | E | GU434152 | DENV2 | E | DQ181811 | DENV2 | E | EU448421 |
| DENV2 | E | EF016250 | DENV2 | E | AB111454 | DENV2 | E | AY449684 | DENV2 | E | AY786366 |
| DENV2 | E | AY786384 | DENV2 | E | EU069591 | DENV2 | E | EU069573 | DENV2 | E | DQ181896 |
| DENV2 | E | AY158327 | DENV2 | E | L10049 | DENV2 | E | L10041 | DENV2 | E | AF398109 |
| DENV2 | E | EU117321 | DENV2 | E | GU434147 | DENV2 | E | DQ181848 | DENV2 | E | DQ518651 |
| DENV2 | E | AY158338 | DENV2 | E | L10051 | DENV2 | E | FM986655 | DENV2 | E | M24446 |
| DENV2 | E | AY512569 | DENV2 | E | AM746225 | DENV2 | E | AY702046 | DENV2 | E | EU069587 |
| DENV2 | E | AY577435 | DENV2 | E | EU005258 | DENV2 | E | AF363076 | DENV2 | E | DQ181850 |
| DENV2 | E | AY775305 | DENV2 | E | AB111450 | DENV2 | E | AY466449 | DENV2 | E | AY512567 |
| DENV2 | E | AY714062 | DENV2 | E | FJ807638 | DENV2 | E | AF297006 | DENV2 | E | DQ518646 |
| DENV2 | E | AY786401 | DENV2 | E | FJ807634 | DENV2 | E | EF016252 | DENV2 | E | GU211745 |
| DENV2 | E | DQ181822 | DENV2 | E | AY158336 | DENV2 | E | AF410347 | DENV2 | E | DQ181831 |
| DENV2 | E | DQ181813 | DENV2 | E | AY786405 | DENV2 | E | DQ181853 | DENV2 | E | FM986659 |
| DENV2 | E | FJ538910 | DENV2 | E | DQ472146 | DENV2 | E | FJ937968 | DENV2 | E | AY484599 |
| DENV2 | E | GU211759 | DENV2 | E | EU069584 | DENV2 | E | DQ181877 | DENV2 | E | DQ181817 |
| DENV2 | E | AF295700 | DENV2 | E | AF295699 | DENV2 | E | EU117342 | DENV2 | E | AF295696 |
| DENV2 | E | DQ181855 | DENV2 | E | GU211753 | DENV2 | E | AY079423 | DENV2 | E | DQ341198 |
| DENV2 | E | DQ181891 | DENV2 | E | DQ518631 | DENV2 | E | FM986658 | DENV2 | E | DQ181841 |
| DENV2 | E | AY449682 | DENV2 | E | DQ518653 | DENV2 | E | DQ341195 | DENV2 | E | GU211756 |
| DENV2 | E | AF398114 | DENV2 | E | GQ368162 | DENV2 | E | DQ518634 | DENV2 | E | EU117316 |
| DENV2 | E | M24450 | DENV2 | E | EU448420 | DENV2 | E | GU211757 | DENV2 | E | AY702059 |
| DENV2 | E | AY702041 | DENV2 | E | AY449679 | DENV2 | E | EU117331 | DENV2 | E | AF363089 |
| DENV2 | E | DQ181846 | DENV2 | E | EU117313 | DENV2 | E | DQ518648 | DENV2 | E | AY778961 |
| DENV2 | E | DQ917246 | DENV2 | E | M24449 | DENV2 | E | AY786391 | DENV2 | E | FJ538905 |
| DENV2 | E | AF410377 | DENV2 | E | GQ368169 | DENV2 | E | EU448415 | DENV2 | E | AF297008 |
| DENV2 | E | EU117315 | DENV2 | E | AF410351 | DENV2 | E | DQ181893 | DENV2 | E | AF410354 |
| DENV2 | E | FJ538928 | DENV2 | E | EU448422 | DENV2 | E | AY786376 | DENV2 | E | AF410353 |
| DENV2 | E | AY786378 | DENV2 | E | AY484605 | DENV2 | E | AF410355 | DENV2 | E | FJ538913 |
| DENV2 | E | AY702051 | DENV2 | E | DQ181825 | DENV2 | E | AF363085 | DENV2 | E | X15434 |
| DENV2 | E | AY786400 | DENV2 | E | AY786389 | DENV2 | E | FJ538908 | DENV2 | E | AY577430 |
| DENV2 | E | DQ518643 | DENV2 | E | AF195036 | DENV2 | E | AF363088 | DENV2 | E | AF231718 |
| DENV2 | E | DQ181871 | DENV2 | E | AF363083 | DENV2 | E | AY702056 | DENV2 | E | AY786406 |
| DENV2 | E | DQ518641 | DENV2 | E | AY786367 | DENV2 | E | AY237294 | DENV2 | E | AF410345 |
| DENV2 | E | DQ181882 | DENV2 | E | DQ181861 | DENV2 | E | AY702045 | DENV2 | E | DQ181866 |
| DENV2 | E | AF297009 | DENV2 | E | AY702057 | DENV2 | E | AY786380 | DENV2 | E | DQ181829 |
| DENV2 | E | GU434159 | DENV2 | E | EU117326 | DENV2 | E | GQ368163 | DENV2 | E | AY237291 |
| DENV2 | E | DQ181852 | DENV2 | E | AY577433 | DENV2 | E | DQ917247 | DENV2 | E | EU448430 |
| DENV2 | E | AF195040 | DENV2 | E | AY449677 | DENV2 | E | GU211762 | DENV2 | E | AY706016 |
| DENV2 | E | FJ538923 | DENV2 | E | EU448429 | DENV2 | E | DQ181873 | DENV2 | E | EU117338 |
| DENV2 | E | AF410357 | DENV2 | E | AY449685 | DENV2 | E | D10514 | DENV2 | E | GQ368172 |
| DENV2 | E | AY237288 | DENV2 | E | DQ181810 | DENV2 | E | FJ807636 | DENV2 | E | DQ181886 |
| DENV2 | E | EU069577 | DENV2 | E | DQ181880 | DENV2 | E | EU045313 | DENV2 | E | AF410375 |
| DENV2 | E | EU117349 | DENV2 | E | AB180478 | DENV2 | E | X15214 | DENV2 | E | GQ368173 |
| DENV2 | E | AF363074 | DENV2 | E | FJ538921 | DENV2 | E | GU211755 | DENV2 | E | GU434155 |
| DENV2 | E | DQ181897 | DENV2 | E | EU117332 | DENV2 | E | DQ181876 | DENV2 | E | EU117334 |
| DENV2 | E | GU211748 | DENV2 | E | D00345 | DENV2 | E | AF363081 | DENV2 | E | AY786395 |
| DENV2 | E | AF195038 | DENV2 | E | GU211739 | DENV2 | E | FM986661 | DENV2 | E | AY706005 |

FIG. 67-26

| Virus Protein | Accession No. | Virus Protein | Accession No. | Virus Protein | Accession No. | Virus Protein | Accession No. |
|---|---|---|---|---|---|---|---|
| DENV2 E | L10048 | DENV2 E | DQ181898 | DENV2 E | AY449680 | DENV2 E | AY158332 |
| DENV2 E | AY484606 | DENV2 E | AF398111 | DENV2 E | EF441283 | DENV2 E | DQ917244 |
| DENV2 E | AY786371 | DENV2 E | AY484601 | DENV2 E | AY237295 | DENV2 E | AY237293 |
| DENV2 E | AY786387 | DENV2 E | AF363078 | DENV2 E | EU117330 | DENV2 E | GU434151 |
| DENV2 E | DQ181833 | DENV2 E | AF295694 | DENV2 E | AF398113 | DENV2 E | AM746222 |
| DENV2 E | DQ472142 | DENV2 E | AY775307 | DENV2 E | FM986656 | DENV2 E | DQ472147 |
| DENV2 E | AY449676 | DENV2 E | FJ807639 | DENV2 E | FJ807632 | DENV2 E | L10052 |
| DENV2 E | DQ181868 | DENV2 E | EU448425 | DENV2 E | DQ181819 | DENV2 E | AY786392 |
| DENV2 E | AY484598 | DENV2 E | AF410349 | DENV2 E | AY158341 | DENV2 E | GU211740 |
| DENV2 E | EU448417 | DENV2 E | EU448419 | DENV2 E | AY786377 | DENV2 E | EU448431 |
| DENV2 E | AF231716 | DENV2 E | GQ368175 | DENV2 E | FJ538922 | DENV2 E | AY359463 |
| DENV2 E | AF297004 | DENV2 E | M24445 | DENV2 E | AF410360 | DENV2 E | DQ518644 |
| DENV2 E | AF410366 | DENV2 E | DQ518632 | DENV2 E | DQ341200 | DENV2 E | AY702050 |
| DENV2 E | DQ181826 | DENV2 E | DQ181887 | DENV2 E | DQ181892 | DENV2 E | AY577434 |
| DENV2 E | EU117352 | DENV2 E | DQ181864 | DENV2 E | AF410371 | DENV2 E | AF363086 |
| DENV2 E | AM746227 | DENV2 E | GU211751 | DENV2 E | EU069579 | DENV2 E | GQ368176 |
| DENV2 E | AY702054 | DENV2 E | DQ181889 | DENV2 E | AJ421524 | DENV2 E | L10042 |
| DENV2 E | AF410359 | DENV2 E | DQ181857 | DENV2 E | AB111453 | DENV2 E | DQ181835 |
| DENV2 E | EU117314 | DENV2 E | FJ538926 | DENV2 E | AY702042 | DENV2 E | DQ518635 |
| DENV2 E | AF398108 | DENV2 E | AF195043 | DENV2 E | AY158337 | DENV2 E | AY702047 |
| DENV2 E | AF410368 | DENV2 E | AB194883 | DENV2 E | DQ181881 | DENV2 E | DQ181862 |
| DENV2 E | AY702043 | DENV2 E | DQ341199 | DENV2 E | AF195041 | DENV2 E | GU211760 |
| DENV2 E | AY158333 | DENV2 E | EU117336 | DENV2 E | AF410356 | DENV2 E | EU117351 |
| DENV2 E | AF363071 | DENV2 E | DQ181808 | DENV2 E | EU117343 | DENV2 E | EU069586 |
| DENV2 E | AF363073 | DENV2 E | AY786390 | DENV2 E | EU249522 | DENV2 E | DQ181845 |
| DENV2 E | AY786397 | DENV2 E | AY786385 | DENV2 E | M24451 | DENV2 E | DQ181821 |
| DENV2 E | GU211742 | DENV2 E | X54319 | DENV2 E | GU211752 | DENV2 E | AY714061 |
| DENV2 E | AY158328 | DENV2 E | FJ538918 | DENV2 E | DQ181884 | DENV2 E | AF195035 |
| DENV2 E | FJ538911 | DENV2 E | EU117324 | DENV2 E | AY577437 | DENV2 E | EU045311 |
| DENV2 E | EU448423 | DENV2 E | FJ606703 | DENV2 E | DQ181872 | DENV2 E | AF410376 |
| DENV2 E | EU069585 | DENV2 E | AF195033 | DENV2 E | DQ181856 | DENV2 E | AF410378 |
| DENV2 E | DQ181843 | DENV2 E | AY642588 | DENV2 E | AF363075 | DENV2 E | L10045 |
| DENV2 E | GQ368171 | DENV2 E | AF410373 | DENV2 E | AY786404 | DENV2 E | AF363084 |
| DENV2 E | EU117318 | DENV2 E | DQ181815 | DENV2 E | DQ181899 | DENV2 E | AY484602 |
| DENV2 E | AY237289 | DENV2 E | DQ181859 | DENV2 E | AF093674 | DENV2 E | EF486510 |
| DENV2 E | AY577439 | DENV2 E | AY702052 | DENV2 E | AF363069 | DENV2 E | AF004020 |
| DENV2 E | DQ181836 | DENV2 E | DQ181900 | DENV2 E | AY786373 | DENV2 E | FJ158608 |
| DENV2 E | GU434157 | DENV2 E | AY786402 | DENV2 E | DQ518630 | DENV2 E | AY786368 |
| DENV2 E | FJ538924 | DENV2 E | DQ917245 | DENV2 E | AF195032 | DENV2 E | AY775306 |
| DENV2 E | AF231720 | DENV2 E | EU117347 | DENV2 E | DQ181807 | DENV2 E | DQ181812 |
| DENV2 E | DQ181901 | DENV2 E | GQ368165 | DENV2 E | FJ538916 | DENV2 E | AY786383 |
| DENV2 E | EU117335 | DENV2 E | GQ368168 | DENV2 E | AF363090 | DENV2 E | AF410374 |
| DENV2 E | AF264053 | DENV2 E | AB111449 | DENV2 E | AF410350 | DENV2 E | GU211746 |
| DENV2 E | AY702048 | DENV2 E | GU434154 | DENV2 E | FJ807640 | DENV2 E | AY577432 |
| DENV2 E | L10046 | DENV2 E | EU069582 | DENV2 E | GU434148 | DENV2 E | DQ181847 |
| DENV2 E | DQ518639 | DENV2 E | FM986660 | DENV2 E | EF486509 | DENV2 E | GU211758 |
| DENV2 E | AB219135 | DENV2 E | DQ181814 | DENV2 E | EU117323 | DENV2 E | EF016253 |
| DENV2 E | DQ181820 | DENV2 E | AY786399 | DENV2 E | DQ181869 | DENV2 E | AF363082 |

FIG. 67-27

| Virus | Protein | Accession No. | Virus | Protein | Accession No. | Virus | Protein | Accession No. | Virus | Protein | Accession No. |
|---|---|---|---|---|---|---|---|---|---|---|---|
| DENV2 | E | EU117317 | DENV2 | E | GQ368161 | DENV2 | E | AY786388 | DENV2 | E | FJ538927 |
| DENV2 | E | AF410346 | DENV2 | E | AY158335 | DENV2 | E | DQ181865 | DENV2 | E | DQ181832 |
| DENV2 | E | EU117333 | DENV2 | E | A91810 | DENV2 | E | AF231717 | DENV2 | E | AB194882 |
| DENV2 | E | EU069572 | DENV2 | E | L10043 | DENV2 | E | EU117325 | DENV2 | E | AF264054 |
| DENV2 | E | GU211764 | DENV2 | E | DQ181809 | DENV2 | E | GU211750 | DENV2 | E | AF163096 |
| DENV2 | E | AY786379 | DENV2 | E | AF195037 | DENV2 | E | FJ538912 | DENV2 | E | AY871813 |
| DENV2 | E | FJ538920 | DENV2 | E | AY775303 | DENV2 | E | AY577431 | DENV2 | E | AY158339 |
| DENV2 | E | EU117339 | DENV2 | E | AF295698 | DENV2 | E | DQ181867 | DENV2 | E | EF486508 |
| DENV2 | E | AY786375 | DENV2 | E | AY484608 | DENV2 | E | AY449675 | DENV2 | E | AY512568 |
| DENV2 | E | EU069574 | DENV2 | E | L10054 | DENV2 | E | AF410367 | DENV2 | E | AY786386 |
| DENV2 | E | DQ181894 | DENV2 | E | AF410352 | DENV2 | E | AF231719 | DENV2 | E | DQ341197 |
| DENV2 | E | FM986657 | DENV2 | E | AB194884 | DENV2 | E | EU069589 | DENV2 | E | EU117350 |
| DENV2 | E | EU117345 | DENV2 | E | AY158330 | DENV2 | E | AF410369 | DENV2 | E | FM986654 |
| DENV2 | E | X65240 | DENV2 | E | AY775304 | DENV2 | E | DQ917242 | DENV2 | E | GQ368174 |
| DENV2 | E | AF297007 | DENV2 | E | DQ518637 | DENV2 | E | EU069580 | DENV2 | E | EU117348 |
| DENV2 | E | M24448 | DENV2 | E | EU117329 | DENV2 | E | EU069576 | DENV2 | E | AM746221 |
| DENV2 | E | DQ518649 | DENV2 | E | AY484604 | DENV2 | E | AY484607 | DENV2 | E | AY079424 |
| DENV2 | E | AF231715 | DENV2 | E | DQ181840 | DENV2 | E | FJ538925 | DENV2 | E | DQ181816 |
| DENV2 | E | AF363077 | DENV2 | E | FJ937969 | DENV2 | E | AF363080 | DENV2 | E | EU448418 |
| DENV2 | E | AF455276 | DENV2 | E | AY706002 | DENV2 | E | AY778960 | DENV2 | E | DQ181874 |
| DENV2 | E | AY449681 | DENV2 | E | DQ181824 | DENV2 | E | DQ181827 | DENV2 | E | AF410379 |
| DENV2 | E | FJ538914 | DENV2 | E | AY449678 | DENV2 | E | DQ181870 | DENV2 | E | EU069578 |
| DENV2 | E | EU069590 | DENV2 | E | DQ181828 | DENV2 | E | AF004019 | DENV2 | E | DQ181858 |
| DENV2 | E | DQ518640 | DENV2 | E | DQ181818 | DENV2 | E | DQ518636 | DENV2 | E | AY786403 |
| DENV2 | E | DQ181878 | DENV2 | E | AB111451 | DENV2 | E | GU211743 | DENV2 | E | GU211763 |
| DENV2 | E | GQ368158 | DENV2 | E | EU117327 | DENV2 | E | GU434156 | DENV2 | E | EF540856 |
| DENV2 | E | GU211749 | DENV2 | E | FJ538909 | DENV2 | E | FJ807635 | DENV2 | E | AY158340 |
| DENV2 | E | DQ181854 | DENV2 | E | EU117320 | DENV2 | E | EU117344 | DENV2 | E | AY702053 |
| DENV2 | E | AF398110 | DENV2 | E | EU249523 | DENV2 | E | DQ181895 | DENV2 | E | FJ538917 |
| DENV2 | E | FJ538907 | DENV2 | E | L10053 | DENV2 | E | EU448424 | DENV2 | E | AY702044 |
| DENV2 | E | AF398106 | DENV2 | E | AF195042 | DENV2 | E | EU448426 | DENV2 | E | FJ931535 |
| DENV2 | E | DQ181830 | DENV2 | E | FJ538919 | DENV2 | E | DQ181842 | DENV2 | E | GU434153 |
| DENV2 | E | AM746224 | DENV2 | E | L10040 | DENV2 | E | AY706007 | DENV2 | E | AM746226 |
| DENV2 | E | EU069583 | DENV2 | E | EU117337 | DENV2 | E | AY449683 | DENV2 | E | AF363092 |
| DENV2 | E | AY786394 | DENV2 | E | AB111452 | DENV2 | E | GU211744 | DENV2 | E | GQ368166 |
| DENV2 | E | FJ807633 | DENV2 | E | X15433 | DENV2 | E | AY786396 | DENV2 | E | L10055 |
| DENV2 | E | GQ368164 | DENV2 | E | AF410372 | DENV2 | E | AY237290 | DENV2 | E | EU069592 |
| DENV2 | E | FJ807637 | DENV2 | E | AY158334 | DENV2 | E | DQ518652 | DENV2 | E | EU117341 |
| DENV2 | E | DQ341196 | DENV2 | E | AY786370 | DENV2 | E | FJ606704 | DENV2 | E | DQ181863 |
| DENV2 | E | DQ181849 | DENV2 | E | DQ181834 | DENV2 | E | M24444 | DENV2 | E | AY577436 |
| DENV2 | E | AY786369 | DENV2 | E | DQ181888 | DENV2 | E | DQ518647 | DENV2 | E | AY706017 |
| DENV2 | E | DQ181837 | DENV2 | E | AY577438 | DENV2 | E | AF295695 | DENV2 | E | AF195039 |
| DENV2 | E | GU434146 | DENV2 | E | DQ472144 | DENV2 | E | DQ181875 | DENV2 | E | DQ181844 |
| DENV2 | E | GU211754 | DENV2 | E | DQ181885 | DENV2 | E | AY158329 | DENV2 | E | AF363070 |
| DENV2 | E | AY786381 | DENV2 | E | AF297005 | DENV2 | E | FJ538906 | DENV2 | E | DQ181890 |
| DENV2 | E | DQ181860 | DENV2 | E | EU448416 | DENV2 | E | AY702058 | DENV2 | E | EF016251 |
| DENV2 | E | AB111448 | DENV2 | E | EU117346 | DENV2 | E | AF363079 | DENV2 | E | EU069581 |
| DENV2 | E | DQ518642 | DENV2 | E | AY702055 | DENV2 | E | M24447 | DENV2 | E | AF363072 |

FIG. 67-28

| Virus Protein | Accession No. | Virus Protein | Accession No. | Virus Protein | Accession No. | Virus Protein | Accession No. |
|---|---|---|---|---|---|---|---|
| DENV2 E | DQ518645 | DENV2 E | GU211761 | DENV2 E | AB111454 | DENV2 E | EF016252 |
| DENV2 E | L10047 | DENV2 E | GU211741 | DENV2 E | EU069591 | DENV2 E | AF410347 |
| DENV2 E | AY706011 | DENV2 E | DQ181823 | DENV2 E | L10049 | DENV2 E | DQ181853 |
| DENV2 E | GQ368170 | DENV2 E | EU448427 | DENV2 E | GU434147 | DENV2 E | DQ181877 |
| DENV2 E | GU434158 | DENV2 E | EU117328 | DENV2 E | L10051 | DENV2 E | EU117342 |
| DENV2 E | EU045312 | DENV2 E | GU434150 | DENV2 E | AM746225 | DENV2 E | AY079423 |
| DENV2 E | EU069588 | DENV2 E | AF363087 | DENV2 E | EU005258 | DENV2 E | FM986658 |
| DENV2 E | AY786372 | DENV2 E | EF016250 | DENV2 E | AB111450 | DENV2 E | DQ341195 |
| DENV2 E | DQ518638 | DENV2 E | AY158327 | DENV2 E | FJ807638 | DENV2 E | DQ518634 |
| DENV2 E | DQ181851 | DENV2 E | EU117321 | DENV2 E | FJ807634 | DENV2 E | GU211757 |
| DENV2 E | AY644452 | DENV2 E | AY158338 | DENV2 E | AY158336 | DENV2 E | EU117331 |
| DENV2 E | AY706010 | DENV2 E | AY512569 | DENV2 E | DQ472146 | DENV2 E | DQ518648 |
| DENV2 E | EU448428 | DENV2 E | AY577435 | DENV2 E | EU069584 | DENV2 E | EU448415 |
| DENV2 E | GQ368159 | DENV2 E | DQ181822 | DENV2 E | AF295699 | DENV2 E | DQ181893 |
| DENV2 E | AY702060 | DENV2 E | DQ181813 | DENV2 E | GU211753 | DENV2 E | AF410355 |
| DENV2 E | AY786398 | DENV2 E | FJ538910 | DENV2 E | DQ518631 | DENV2 E | AF363085 |
| DENV2 E | AY702049 | DENV2 E | GU211759 | DENV2 E | DQ518653 | DENV2 E | FJ538908 |
| DENV2 E | EU117319 | DENV2 E | AF295700 | DENV2 E | GQ368162 | DENV2 E | AF363088 |
| DENV2 E | AF398112 | DENV2 E | DQ181855 | DENV2 E | EU448420 | DENV2 E | AY702056 |
| DENV2 E | AF410370 | DENV2 E | DQ181891 | DENV2 E | EU117313 | DENV2 E | AY237294 |
| DENV2 E | DQ181883 | DENV2 E | AF398114 | DENV2 E | M24449 | DENV2 E | AY702045 |
| DENV2 E | L10050 | DENV2 E | M24450 | DENV2 E | GQ368169 | DENV2 E | GQ368163 |
| DENV2 E | CS673237 | DENV2 E | AY702041 | DENV2 E | AF410351 | DENV2 E | DQ917247 |
| DENV2 E | DQ181879 | DENV2 E | DQ181846 | DENV2 E | EU448422 | DENV2 E | GU211762 |
| DENV2 E | AY484600 | DENV2 E | DQ917246 | DENV2 E | AY484605 | DENV2 E | DQ181873 |
| DENV2 E | DQ518650 | DENV2 E | AF410377 | DENV2 E | DQ181825 | DENV2 E | D10514 |
| DENV2 E | GU434149 | DENV2 E | EU117315 | DENV2 E | AF195036 | DENV2 E | FJ807636 |
| DENV2 E | DQ518633 | DENV2 E | FJ538928 | DENV2 E | AF363083 | DENV2 E | EU045313 |
| DENV2 E | EF486507 | DENV2 E | AY702051 | DENV2 E | DQ181861 | DENV2 E | X15214 |
| DENV2 E | AY237292 | DENV2 E | DQ518643 | DENV2 E | AY702057 | DENV2 E | GU211755 |
| DENV2 E | GQ368160 | DENV2 E | DQ181871 | DENV2 E | EU117326 | DENV2 E | DQ181876 |
| DENV2 E | DQ181839 | DENV2 E | DQ518641 | DENV2 E | AY577433 | DENV2 E | AF363081 |
| DENV2 E | L10044 | DENV2 E | DQ181882 | DENV2 E | EU448429 | DENV2 E | FM986661 |
| DENV2 E | GQ368167 | DENV2 E | AF297009 | DENV2 E | DQ181810 | DENV2 E | GU211738 |
| DENV2 E | DQ341201 | DENV2 E | GU434159 | DENV2 E | DQ181880 | DENV2 E | EU448421 |
| DENV2 E | DQ181838 | DENV2 E | DQ181852 | DENV2 E | AB180478 | DENV2 E | DQ181896 |
| DENV2 E | AM746223 | DENV2 E | AF195040 | DENV2 E | FJ538921 | DENV2 E | AF398109 |
| DENV2 E | AF363091 | DENV2 E | FJ538923 | DENV2 E | EU117332 | DENV2 E | DQ518651 |
| DENV2 E | EU117322 | DENV2 E | AF410357 | DENV2 E | GU211739 | DENV2 E | M24446 |
| DENV2 E | AY158331 | DENV2 E | AY237288 | DENV2 E | GU211747 | DENV2 E | EU069587 |
| DENV2 E | AF398107 | DENV2 E | EU069577 | DENV2 E | DQ181811 | DENV2 E | DQ181850 |
| DENV2 E | FJ538915 | DENV2 E | EU117349 | DENV2 E | EU069573 | DENV2 E | AY512567 |
| DENV2 E | AF295697 | DENV2 E | AF363074 | DENV2 E | L10041 | DENV2 E | DQ518646 |
| DENV2 E | EU069575 | DENV2 E | DQ181897 | DENV2 E | DQ181848 | DENV2 E | GU211745 |
| DENV2 E | DQ917243 | DENV2 E | GU211748 | DENV2 E | FM986655 | DENV2 E | DQ181831 |
| DENV2 E | AY484603 | DENV2 E | AF195038 | DENV2 E | AY702046 | DENV2 E | FM986659 |
| DENV2 E | AF195034 | DENV2 E | EU117340 | DENV2 E | AF363076 | DENV2 E | AY484599 |
| DENV2 E | DM460984 | DENV2 E | GU434152 | DENV2 E | AF297006 | DENV2 E | DQ181817 |

FIG. 67-29

| Virus Protein | Accession No. | Virus Protein | Accession No. | Virus Protein | Accession No. | Virus Protein | Accession No. |
|---|---|---|---|---|---|---|---|
| DENV2 E | AF295696 | DENV2 E | AY158333 | DENV2 E | X54319 | DENV2 E | DQ181899 |
| DENV2 E | DQ341198 | DENV2 E | AF363071 | DENV2 E | FJ538918 | DENV2 E | AF093674 |
| DENV2 E | DQ181841 | DENV2 E | AF363073 | DENV2 E | EU117324 | DENV2 E | AF363069 |
| DENV2 E | GU211756 | DENV2 E | GU211742 | DENV2 E | FJ606703 | DENV2 E | DQ518630 |
| DENV2 E | EU117316 | DENV2 E | AY158328 | DENV2 E | AF195033 | DENV2 E | AF195032 |
| DENV2 E | AY702059 | DENV2 E | FJ538911 | DENV2 E | AF410373 | DENV2 E | DQ181807 |
| DENV2 E | AF363089 | DENV2 E | EU448423 | DENV2 E | DQ181815 | DENV2 E | FJ538916 |
| DENV2 E | FJ538905 | DENV2 E | EU069585 | DENV2 E | DQ181859 | DENV2 E | AF363090 |
| DENV2 E | AF297008 | DENV2 E | DQ181843 | DENV2 E | AY702052 | DENV2 E | AF410350 |
| DENV2 E | AF410354 | DENV2 E | GQ368171 | DENV2 E | DQ181900 | DENV2 E | FJ807640 |
| DENV2 E | AF410353 | DENV2 E | EU117318 | DENV2 E | DQ917245 | DENV2 E | GU434148 |
| DENV2 E | FJ538913 | DENV2 E | AY237289 | DENV2 E | EU117347 | DENV2 E | EF486509 |
| DENV2 E | X15434 | DENV2 E | AY577439 | DENV2 E | GQ368165 | DENV2 E | EU117323 |
| DENV2 E | AY577430 | DENV2 E | DQ181836 | DENV2 E | GQ368168 | DENV2 E | DQ181869 |
| DENV2 E | AF231718 | DENV2 E | GU434157 | DENV2 E | AB111449 | DENV2 E | AY158332 |
| DENV2 E | AF410345 | DENV2 E | FJ538924 | DENV2 E | GU434154 | DENV2 E | DQ917244 |
| DENV2 E | DQ181866 | DENV2 E | AF231720 | DENV2 E | EU069582 | DENV2 E | AY237293 |
| DENV2 E | DQ181829 | DENV2 E | DQ181901 | DENV2 E | FM986660 | DENV2 E | GU434151 |
| DENV2 E | AY237291 | DENV2 E | EU117335 | DENV2 E | DQ181814 | DENV2 E | AM746222 |
| DENV2 E | EU448430 | DENV2 E | AF264053 | DENV2 E | AY237295 | DENV2 E | DQ472147 |
| DENV2 E | AY706016 | DENV2 E | AY702048 | DENV2 E | EU117330 | DENV2 E | L10052 |
| DENV2 E | EU117338 | DENV2 E | L10046 | DENV2 E | AF398113 | DENV2 E | GU211740 |
| DENV2 E | GQ368172 | DENV2 E | DQ518639 | DENV2 E | FM986656 | DENV2 E | EU448431 |
| DENV2 E | DQ181886 | DENV2 E | AB219135 | DENV2 E | FJ807632 | DENV2 E | AY359463 |
| DENV2 E | AF410375 | DENV2 E | DQ181820 | DENV2 E | DQ181819 | DENV2 E | DQ518644 |
| DENV2 E | GQ368173 | DENV2 E | DQ181898 | DENV2 E | AY158341 | DENV2 E | AY702050 |
| DENV2 E | GU434155 | DENV2 E | AF398111 | DENV2 E | FJ538922 | DENV2 E | AY577434 |
| DENV2 E | EU117334 | DENV2 E | AY484601 | DENV2 E | AF410360 | DENV2 E | AF363086 |
| DENV2 E | AY706005 | DENV2 E | AF363078 | DENV2 E | DQ341200 | DENV2 E | GQ368176 |
| DENV2 E | L10048 | DENV2 E | AF295694 | DENV2 E | DQ181892 | DENV2 E | L10042 |
| DENV2 E | AY484606 | DENV2 E | FJ807639 | DENV2 E | AF410371 | DENV2 E | DQ181835 |
| DENV2 E | DQ181833 | DENV2 E | EU448425 | DENV2 E | EU069579 | DENV2 E | DQ518635 |
| DENV2 E | DQ472142 | DENV2 E | AF410349 | DENV2 E | AJ421524 | DENV2 E | AY702047 |
| DENV2 E | DQ181868 | DENV2 E | EU448419 | DENV2 E | AB111453 | DENV2 E | DQ181862 |
| DENV2 E | AY484598 | DENV2 E | GQ368175 | DENV2 E | AY702042 | DENV2 E | GU211760 |
| DENV2 E | EU448417 | DENV2 E | M24445 | DENV2 E | AY158337 | DENV2 E | EU117351 |
| DENV2 E | AF231716 | DENV2 E | DQ518632 | DENV2 E | DQ181881 | DENV2 E | EU069586 |
| DENV2 E | AF297004 | DENV2 E | DQ181887 | DENV2 E | AF195041 | DENV2 E | DQ181845 |
| DENV2 E | AF410366 | DENV2 E | DQ181864 | DENV2 E | AF410356 | DENV2 E | DQ181821 |
| DENV2 E | DQ181826 | DENV2 E | GU211751 | DENV2 E | EU117343 | DENV2 E | AF195035 |
| DENV2 E | EU117352 | DENV2 E | DQ181889 | DENV2 E | EU249522 | DENV2 E | EU045311 |
| DENV2 E | AM746227 | DENV2 E | DQ181857 | DENV2 E | M24451 | DENV2 E | AF410376 |
| DENV2 E | AY702054 | DENV2 E | FJ538926 | DENV2 E | GU211752 | DENV2 E | AF410378 |
| DENV2 E | AF410359 | DENV2 E | AF195043 | DENV2 E | DQ181884 | DENV2 E | L10045 |
| DENV2 E | EU117314 | DENV2 E | AB194883 | DENV2 E | AY577437 | DENV2 E | AF363084 |
| DENV2 E | AF398108 | DENV2 E | DQ341199 | DENV2 E | DQ181872 | DENV2 E | AY484602 |
| DENV2 E | AF410368 | DENV2 E | EU117336 | DENV2 E | DQ181856 | DENV2 E | EF486510 |
| DENV2 E | AY702043 | DENV2 E | DQ181808 | DENV2 E | AF363075 | DENV2 E | AF004020 |

FIG. 67-30

| Virus Protein | Accession No. | Virus Protein | Accession No. | Virus Protein | Accession No. | Virus Protein | Accession No. |
|---|---|---|---|---|---|---|---|
| DENV2 E | FJ158608 | DENV2 E | DQ181860 | DENV2 E | EU117325 | DENV2 E | EF486508 |
| DENV2 E | DQ181812 | DENV2 E | AB111448 | DENV2 E | GU211750 | DENV2 E | AY512568 |
| DENV2 E | AF410374 | DENV2 E | DQ518642 | DENV2 E | FJ538912 | DENV2 E | DQ341197 |
| DENV2 E | GU211746 | DENV2 E | GQ368161 | DENV2 E | AY577431 | DENV2 E | EU117350 |
| DENV2 E | AY577432 | DENV2 E | AY158335 | DENV2 E | DQ181867 | DENV2 E | FM986654 |
| DENV2 E | DQ181847 | DENV2 E | A91810 | DENV2 E | AF410367 | DENV2 E | GQ368174 |
| DENV2 E | GU211758 | DENV2 E | L10043 | DENV2 E | AF231719 | DENV2 E | EU117348 |
| DENV2 E | EF016253 | DENV2 E | DQ181809 | DENV2 E | EU069589 | DENV2 E | AM746221 |
| DENV2 E | AF363082 | DENV2 E | AF195037 | DENV2 E | AF410369 | DENV2 E | AY079424 |
| DENV2 E | EU117317 | DENV2 E | AF295698 | DENV2 E | DQ917242 | DENV2 E | DQ181816 |
| DENV2 E | AF410346 | DENV2 E | AY484608 | DENV2 E | EU069580 | DENV2 E | EU448418 |
| DENV2 E | EU117333 | DENV2 E | L10054 | DENV2 E | EU069576 | DENV2 E | DQ181874 |
| DENV2 E | EU069572 | DENV2 E | AF410352 | DENV2 E | AY484607 | DENV2 E | AF410379 |
| DENV2 E | GU211764 | DENV2 E | AB194884 | DENV2 E | FJ538925 | DENV2 E | EU069578 |
| DENV2 E | FJ538920 | DENV2 E | AY158330 | DENV2 E | AF363080 | DENV2 E | DQ181858 |
| DENV2 E | EU117339 | DENV2 E | DQ518637 | DENV2 E | DQ181827 | DENV2 E | GU211763 |
| DENV2 E | EU069574 | DENV2 E | EU117329 | DENV2 E | DQ181870 | DENV2 E | EF540856 |
| DENV2 E | DQ181894 | DENV2 E | AY484604 | DENV2 E | AF004019 | DENV2 E | AY158340 |
| DENV2 E | FM986657 | DENV2 E | DQ181840 | DENV2 E | DQ518636 | DENV2 E | AY702053 |
| DENV2 E | EU117345 | DENV2 E | AY706002 | DENV2 E | GU211743 | DENV2 E | FJ538917 |
| DENV2 E | X65240 | DENV2 E | DQ181824 | DENV2 E | GU434156 | DENV2 E | AY702044 |
| DENV2 E | AF297007 | DENV2 E | DQ181828 | DENV2 E | FJ807635 | DENV2 E | FJ931535 |
| DENV2 E | M24448 | DENV2 E | DQ181818 | DENV2 E | EU117344 | DENV2 E | GU434153 |
| DENV2 E | DQ518649 | DENV2 E | AB111451 | DENV2 E | DQ181895 | DENV2 E | AM746226 |
| DENV2 E | AF231715 | DENV2 E | EU117327 | DENV2 E | EU448424 | DENV2 E | AF363092 |
| DENV2 E | AF363077 | DENV2 E | FJ538909 | DENV2 E | EU448426 | DENV2 E | GQ368166 |
| DENV2 E | AF455276 | DENV2 E | EU117320 | DENV2 E | DQ181842 | DENV2 E | L10055 |
| DENV2 E | FJ538914 | DENV2 E | EU249523 | DENV2 E | AY706007 | DENV2 E | EU069592 |
| DENV2 E | EU069590 | DENV2 E | L10053 | DENV2 E | GU211744 | DENV2 E | EU117341 |
| DENV2 E | DQ518640 | DENV2 E | AF195042 | DENV2 E | AY237290 | DENV2 E | DQ181863 |
| DENV2 E | DQ181878 | DENV2 E | FJ538919 | DENV2 E | DQ518652 | DENV2 E | AY577436 |
| DENV2 E | GQ368158 | DENV2 E | L10040 | DENV2 E | FJ606704 | DENV2 E | AY706017 |
| DENV2 E | GU211749 | DENV2 E | EU117337 | DENV2 E | M24444 | DENV2 E | AF195039 |
| DENV2 E | DQ181854 | DENV2 E | AB111452 | DENV2 E | DQ518647 | DENV2 E | DQ181844 |
| DENV2 E | AF398110 | DENV2 E | X15433 | DENV2 E | AF295695 | DENV2 E | AF363070 |
| DENV2 E | FJ538907 | DENV2 E | AF410372 | DENV2 E | DQ181875 | DENV2 E | DQ181890 |
| DENV2 E | AF398106 | DENV2 E | AY158334 | DENV2 E | AY158329 | DENV2 E | EF016251 |
| DENV2 E | DQ181830 | DENV2 E | DQ181834 | DENV2 E | FJ538906 | DENV2 E | EU069581 |
| DENV2 E | AM746224 | DENV2 E | DQ181888 | DENV2 E | AY702058 | DENV2 E | AF363072 |
| DENV2 E | EU069583 | DENV2 E | AY577438 | DENV2 E | AF363079 | DENV2 E | DQ518645 |
| DENV2 E | FJ807633 | DENV2 E | DQ472144 | DENV2 E | M24447 | DENV2 E | L10047 |
| DENV2 E | GQ368164 | DENV2 E | DQ181885 | DENV2 E | FJ538927 | DENV2 E | AY706011 |
| DENV2 E | FJ807637 | DENV2 E | AF297005 | DENV2 E | DQ181832 | DENV2 E | GQ368170 |
| DENV2 E | DQ341196 | DENV2 E | EU448416 | DENV2 E | AB194882 | DENV2 E | GU434158 |
| DENV2 E | DQ181849 | DENV2 E | EU117346 | DENV2 E | AF264054 | DENV2 E | EU045312 |
| DENV2 E | DQ181837 | DENV2 E | AY702055 | DENV2 E | AF163096 | DENV2 E | EU069588 |
| DENV2 E | GU434146 | DENV2 E | DQ181865 | DENV2 E | AY871813 | DENV2 E | DQ518638 |
| DENV2 E | GU211754 | DENV2 E | AF231717 | DENV2 E | AY158339 | DENV2 E | DQ181851 |

FIG. 67-31

| Virus Protein | Accession No. | Virus Protein | Accession No. | Virus Protein | Accession No. | Virus Protein | Accession No. |
|---|---|---|---|---|---|---|---|
| DENV2 E | AY706010 | DENV2 E | AY577435 | DENV2 E | EU069584 | DENV2 E | EU448415 |
| DENV2 E | EU448428 | DENV2 E | DQ181822 | DENV2 E | AF295699 | DENV2 E | DQ181893 |
| DENV2 E | GQ368159 | DENV2 E | DQ181813 | DENV2 E | GU211753 | DENV2 E | AF410355 |
| DENV2 E | AY702060 | DENV2 E | FJ538910 | DENV2 E | DQ518631 | DENV2 E | AF363085 |
| DENV2 E | AY702049 | DENV2 E | GU211759 | DENV2 E | DQ518653 | DENV2 E | FJ538908 |
| DENV2 E | EU117319 | DENV2 E | AF295700 | DENV2 E | GQ368162 | DENV2 E | AF363088 |
| DENV2 E | AF398112 | DENV2 E | DQ181855 | DENV2 E | EU448420 | DENV2 E | AY702056 |
| DENV2 E | AF410370 | DENV2 E | DQ181891 | DENV2 E | EU117313 | DENV2 E | AY237294 |
| DENV2 E | DQ181883 | DENV2 E | AF398114 | DENV2 E | M24449 | DENV2 E | AY702045 |
| DENV2 E | L10050 | DENV2 E | M24450 | DENV2 E | GQ368169 | DENV2 E | GQ368163 |
| DENV2 E | CS673237 | DENV2 E | AY702041 | DENV2 E | AF410351 | DENV2 E | DQ917247 |
| DENV2 E | DQ181879 | DENV2 E | DQ181846 | DENV2 E | EU448422 | DENV2 E | GU211762 |
| DENV2 E | AY484600 | DENV2 E | DQ917246 | DENV2 E | AY484605 | DENV2 E | DQ181873 |
| DENV2 E | DQ518650 | DENV2 E | AF410377 | DENV2 E | DQ181825 | DENV2 E | D10514 |
| DENV2 E | GU434149 | DENV2 E | EU117315 | DENV2 E | AF195036 | DENV2 E | FJ807636 |
| DENV2 E | DQ518633 | DENV2 E | FJ538928 | DENV2 E | AF363083 | DENV2 E | EU045313 |
| DENV2 E | EF486507 | DENV2 E | AY702051 | DENV2 E | DQ181861 | DENV2 E | X15214 |
| DENV2 E | AY237292 | DENV2 E | DQ518643 | DENV2 E | AY702057 | DENV2 E | GU211755 |
| DENV2 E | GQ368160 | DENV2 E | DQ181871 | DENV2 E | EU117326 | DENV2 E | DQ181876 |
| DENV2 E | DQ181839 | DENV2 E | DQ518641 | DENV2 E | AY577433 | DENV2 E | AF363081 |
| DENV2 E | L10044 | DENV2 E | DQ181882 | DENV2 E | EU448429 | DENV2 E | FM986661 |
| DENV2 E | GQ368167 | DENV2 E | AF297009 | DENV2 E | DQ181810 | DENV2 E | GU211738 |
| DENV2 E | DQ341201 | DENV2 E | GU434159 | DENV2 E | DQ181880 | DENV2 E | EU448421 |
| DENV2 E | DQ181838 | DENV2 E | DQ181852 | DENV2 E | AB180478 | DENV2 E | DQ181896 |
| DENV2 E | AM746223 | DENV2 E | AF195040 | DENV2 E | FJ538921 | DENV2 E | AF398109 |
| DENV2 E | AF363091 | DENV2 E | FJ538923 | DENV2 E | EU117332 | DENV2 E | DQ518651 |
| DENV2 E | EU117322 | DENV2 E | AF410357 | DENV2 E | GU211739 | DENV2 E | M24446 |
| DENV2 E | AY158331 | DENV2 E | AY237288 | DENV2 E | GU211747 | DENV2 E | EU069587 |
| DENV2 E | AF398107 | DENV2 E | EU069577 | DENV2 E | DQ181811 | DENV2 E | DQ181850 |
| DENV2 E | FJ538915 | DENV2 E | EU117349 | DENV2 E | EU069573 | DENV2 E | AY512567 |
| DENV2 E | AF295697 | DENV2 E | AF363074 | DENV2 E | L10041 | DENV2 E | DQ518646 |
| DENV2 E | EU069575 | DENV2 E | DQ181897 | DENV2 E | DQ181848 | DENV2 E | GU211745 |
| DENV2 E | DQ917243 | DENV2 E | GU211748 | DENV2 E | FM986655 | DENV2 E | DQ181831 |
| DENV2 E | AY484603 | DENV2 E | AF195038 | DENV2 E | AY702046 | DENV2 E | FM986659 |
| DENV2 E | AF195034 | DENV2 E | EU117340 | DENV2 E | AF363076 | DENV2 E | AY484599 |
| DENV2 E | DM460984 | DENV2 E | GU434152 | DENV2 E | AF297006 | DENV2 E | DQ181817 |
| DENV2 E | GU211761 | DENV2 E | AB111454 | DENV2 E | EF016252 | DENV2 E | AF295696 |
| DENV2 E | GU211741 | DENV2 E | EU069591 | DENV2 E | AF410347 | DENV2 E | DQ341198 |
| DENV2 E | DQ181823 | DENV2 E | L10049 | DENV2 E | DQ181853 | DENV2 E | DQ181841 |
| DENV2 E | EU448427 | DENV2 E | GU434147 | DENV2 E | DQ181877 | DENV2 E | GU211756 |
| DENV2 E | EU117328 | DENV2 E | L10051 | DENV2 E | EU117342 | DENV2 E | EU117316 |
| DENV2 E | GU434150 | DENV2 E | AM746225 | DENV2 E | AY079423 | DENV2 E | AY702059 |
| DENV2 E | AF363087 | DENV2 E | EU005258 | DENV2 E | FM986658 | DENV2 E | AF363089 |
| DENV2 E | EF016250 | DENV2 E | AB111450 | DENV2 E | DQ341195 | DENV2 E | FJ538905 |
| DENV2 E | AY158327 | DENV2 E | FJ807638 | DENV2 E | DQ518634 | DENV2 E | AF297008 |
| DENV2 E | EU117321 | DENV2 E | FJ807634 | DENV2 E | GU211757 | DENV2 E | AF410354 |
| DENV2 E | AY158338 | DENV2 E | AY158336 | DENV2 E | EU117331 | DENV2 E | AF410353 |
| DENV2 E | AY512569 | DENV2 E | DQ472146 | DENV2 E | DQ518648 | DENV2 E | FJ538913 |

FIG. 67-32

| Virus Protein | Accession No. | Virus Protein | Accession No. | Virus Protein | Accession No. | Virus Protein | Accession No. |
|---|---|---|---|---|---|---|---|
| DENV2 E | X15434 | DENV2 E | AY577439 | DENV2 E | GQ368165 | DENV2 E | EU117323 |
| DENV2 E | AY577430 | DENV2 E | DQ181836 | DENV2 E | GQ368168 | DENV2 E | DQ181869 |
| DENV2 E | AF231718 | DENV2 E | GU434157 | DENV2 E | AB111449 | DENV2 E | AY158332 |
| DENV2 E | AF410345 | DENV2 E | FJ538924 | DENV2 E | GU434154 | DENV2 E | DQ917244 |
| DENV2 E | DQ181866 | DENV2 E | AF231720 | DENV2 E | EU069582 | DENV2 E | AY237293 |
| DENV2 E | DQ181829 | DENV2 E | DQ181901 | DENV2 E | FM986660 | DENV2 E | GU434151 |
| DENV2 E | AY237291 | DENV2 E | EU117335 | DENV2 E | DQ181814 | DENV2 E | AM746222 |
| DENV2 E | EU448430 | DENV2 E | AF264053 | DENV2 E | AY237295 | DENV2 E | DQ472147 |
| DENV2 E | AY706016 | DENV2 E | AY702048 | DENV2 E | EU117330 | DENV2 E | L10052 |
| DENV2 E | EU117338 | DENV2 E | L10046 | DENV2 E | AF398113 | DENV2 E | GU211740 |
| DENV2 E | GQ368172 | DENV2 E | DQ518639 | DENV2 E | FM986656 | DENV2 E | EU448431 |
| DENV2 E | DQ181886 | DENV2 E | AB219135 | DENV2 E | FJ807632 | DENV2 E | AY359463 |
| DENV2 E | AF410375 | DENV2 E | DQ181820 | DENV2 E | DQ181819 | DENV2 E | DQ518644 |
| DENV2 E | GQ368173 | DENV2 E | DQ181898 | DENV2 E | AY158341 | DENV2 E | AY702050 |
| DENV2 E | GU434155 | DENV2 E | AF398111 | DENV2 E | FJ538922 | DENV2 E | AY577434 |
| DENV2 E | EU117334 | DENV2 E | AY484601 | DENV2 E | AF410360 | DENV2 E | AF363086 |
| DENV2 E | AY706005 | DENV2 E | AF363078 | DENV2 E | DQ341200 | DENV2 E | GQ368176 |
| DENV2 E | L10048 | DENV2 E | AF295694 | DENV2 E | DQ181892 | DENV2 E | L10042 |
| DENV2 E | AY484606 | DENV2 E | FJ807639 | DENV2 E | AF410371 | DENV2 E | DQ181835 |
| DENV2 E | DQ181833 | DENV2 E | EU448425 | DENV2 E | EU069579 | DENV2 E | DQ518635 |
| DENV2 E | DQ472142 | DENV2 E | AF410349 | DENV2 E | AJ421524 | DENV2 E | AY702047 |
| DENV2 E | DQ181868 | DENV2 E | EU448419 | DENV2 E | AB111453 | DENV2 E | DQ181862 |
| DENV2 E | AY484598 | DENV2 E | GQ368175 | DENV2 E | AY702042 | DENV2 E | GU211760 |
| DENV2 E | EU448417 | DENV2 E | M24445 | DENV2 E | AY158337 | DENV2 E | EU117351 |
| DENV2 E | AF231716 | DENV2 E | DQ518632 | DENV2 E | DQ181881 | DENV2 E | EU069586 |
| DENV2 E | AF297004 | DENV2 E | DQ181887 | DENV2 E | AF195041 | DENV2 E | DQ181845 |
| DENV2 E | AF410366 | DENV2 E | DQ181864 | DENV2 E | AF410356 | DENV2 E | DQ181821 |
| DENV2 E | DQ181826 | DENV2 E | GU211751 | DENV2 E | EU117343 | DENV2 E | AF195035 |
| DENV2 E | EU117352 | DENV2 E | DQ181889 | DENV2 E | EU249522 | DENV2 E | EU045311 |
| DENV2 E | AM746227 | DENV2 E | DQ181857 | DENV2 E | M24451 | DENV2 E | AF410376 |
| DENV2 E | AY702054 | DENV2 E | FJ538926 | DENV2 E | GU211752 | DENV2 E | AF410378 |
| DENV2 E | AF410359 | DENV2 E | AF195043 | DENV2 E | DQ181884 | DENV2 E | L10045 |
| DENV2 E | EU117314 | DENV2 E | AB194883 | DENV2 E | AY577437 | DENV2 E | AF363084 |
| DENV2 E | AF398108 | DENV2 E | DQ341199 | DENV2 E | DQ181872 | DENV2 E | AY484602 |
| DENV2 E | AF410368 | DENV2 E | EU117336 | DENV2 E | DQ181856 | DENV2 E | EF486510 |
| DENV2 E | AY702043 | DENV2 E | DQ181808 | DENV2 E | AF363075 | DENV2 E | AF004020 |
| DENV2 E | AY158333 | DENV2 E | X54319 | DENV2 E | DQ181899 | DENV2 E | FJ158608 |
| DENV2 E | AF363071 | DENV2 E | FJ538918 | DENV2 E | AF093674 | DENV2 E | DQ181812 |
| DENV2 E | AF363073 | DENV2 E | EU117324 | DENV2 E | AF363069 | DENV2 E | AF410374 |
| DENV2 E | GU211742 | DENV2 E | FJ606703 | DENV2 E | DQ518630 | DENV2 E | GU211746 |
| DENV2 E | AY158328 | DENV2 E | AF195033 | DENV2 E | AF195032 | DENV2 E | AY577432 |
| DENV2 E | FJ538911 | DENV2 E | AF410373 | DENV2 E | DQ181807 | DENV2 E | DQ181847 |
| DENV2 E | EU448423 | DENV2 E | DQ181815 | DENV2 E | FJ538916 | DENV2 E | GU211758 |
| DENV2 E | EU069585 | DENV2 E | DQ181859 | DENV2 E | AF363090 | DENV2 E | EF016253 |
| DENV2 E | DQ181843 | DENV2 E | AY702052 | DENV2 E | AF410350 | DENV2 E | AF363082 |
| DENV2 E | GQ368171 | DENV2 E | DQ181900 | DENV2 E | FJ807640 | DENV2 E | EU117317 |
| DENV2 E | EU117318 | DENV2 E | DQ917245 | DENV2 E | GU434148 | DENV2 E | AF410346 |
| DENV2 E | AY237289 | DENV2 E | EU117347 | DENV2 E | EF486509 | DENV2 E | EU117333 |

FIG. 67-33

| Virus Protein | Accession No. | Virus Protein | Accession No. | Virus Protein | Accession No. | Virus Protein | Accession No. |
|---|---|---|---|---|---|---|---|
| DENV2 E | EU069572 | DENV2 E | AF410352 | DENV2 E | AY484607 | DENV2 E | AF410379 |
| DENV2 E | GU211764 | DENV2 E | AB194884 | DENV2 E | FJ538925 | DENV2 E | EU069578 |
| DENV2 E | FJ538920 | DENV2 E | AY158330 | DENV2 E | AF363080 | DENV2 E | DQ181858 |
| DENV2 E | EU117339 | DENV2 E | DQ518637 | DENV2 E | DQ181827 | DENV2 E | GU211763 |
| DENV2 E | EU069574 | DENV2 E | EU117329 | DENV2 E | DQ181870 | DENV2 E | EF540856 |
| DENV2 E | DQ181894 | DENV2 E | AY484604 | DENV2 E | AF004019 | DENV2 E | AY158340 |
| DENV2 E | FM986657 | DENV2 E | DQ181840 | DENV2 E | DQ518636 | DENV2 E | AY702053 |
| DENV2 E | EU117345 | DENV2 E | AY706002 | DENV2 E | GU211743 | DENV2 E | FJ538917 |
| DENV2 E | X65240 | DENV2 E | DQ181824 | DENV2 E | GU434156 | DENV2 E | AY702044 |
| DENV2 E | AF297007 | DENV2 E | DQ181828 | DENV2 E | FJ807635 | DENV2 E | FJ931535 |
| DENV2 E | M24448 | DENV2 E | DQ181818 | DENV2 E | EU117344 | DENV2 E | GU434153 |
| DENV2 E | DQ518649 | DENV2 E | AB111451 | DENV2 E | DQ181895 | DENV2 E | AM746226 |
| DENV2 E | AF231715 | DENV2 E | EU117327 | DENV2 E | EU448424 | DENV2 E | AF363092 |
| DENV2 E | AF363077 | DENV2 E | FJ538909 | DENV2 E | EU448426 | DENV2 E | GQ368166 |
| DENV2 E | AF455276 | DENV2 E | EU117320 | DENV2 E | DQ181842 | DENV2 E | L10055 |
| DENV2 E | FJ538914 | DENV2 E | EU249523 | DENV2 E | AY706007 | DENV2 E | EU069592 |
| DENV2 E | EU069590 | DENV2 E | L10053 | DENV2 E | GU211744 | DENV2 E | EU117341 |
| DENV2 E | DQ518640 | DENV2 E | AF195042 | DENV2 E | AY237290 | DENV2 E | DQ181863 |
| DENV2 E | DQ181878 | DENV2 E | FJ538919 | DENV2 E | DQ518652 | DENV2 E | AY577436 |
| DENV2 E | GQ368158 | DENV2 E | L10040 | DENV2 E | FJ606704 | DENV2 E | AY706017 |
| DENV2 E | GU211749 | DENV2 E | EU117337 | DENV2 E | M24444 | DENV2 E | AF195039 |
| DENV2 E | DQ181854 | DENV2 E | AB111452 | DENV2 E | DQ518647 | DENV2 E | DQ181844 |
| DENV2 E | AF398110 | DENV2 E | X15433 | DENV2 E | AF295695 | DENV2 E | AF363070 |
| DENV2 E | FJ538907 | DENV2 E | AF410372 | DENV2 E | DQ181875 | DENV2 E | DQ181890 |
| DENV2 E | AF398106 | DENV2 E | AY158334 | DENV2 E | AY158329 | DENV2 E | EF016251 |
| DENV2 E | DQ181830 | DENV2 E | DQ181834 | DENV2 E | FJ538906 | DENV2 E | EU069581 |
| DENV2 E | AM746224 | DENV2 E | DQ181888 | DENV2 E | AY702058 | DENV2 E | AF363072 |
| DENV2 E | EU069583 | DENV2 E | AY577438 | DENV2 E | AF363079 | DENV2 E | DQ518645 |
| DENV2 E | FJ807633 | DENV2 E | DQ472144 | DENV2 E | M24447 | DENV2 E | L10047 |
| DENV2 E | GQ368164 | DENV2 E | DQ181885 | DENV2 E | FJ538927 | DENV2 E | AY706011 |
| DENV2 E | FJ807637 | DENV2 E | AF297005 | DENV2 E | DQ181832 | DENV2 E | GQ368170 |
| DENV2 E | DQ341196 | DENV2 E | EU448416 | DENV2 E | AB194882 | DENV2 E | GU434158 |
| DENV2 E | DQ181849 | DENV2 E | EU117346 | DENV2 E | AF264054 | DENV2 E | EU045312 |
| DENV2 E | DQ181837 | DENV2 E | AY702055 | DENV2 E | AF163096 | DENV2 E | EU069588 |
| DENV2 E | GU434146 | DENV2 E | DQ181865 | DENV2 E | AY871813 | DENV2 E | DQ518638 |
| DENV2 E | GU211754 | DENV2 E | AF231717 | DENV2 E | AY158339 | DENV2 E | DQ181851 |
| DENV2 E | DQ181860 | DENV2 E | EU117325 | DENV2 E | EF486508 | DENV2 E | AY706010 |
| DENV2 E | AB111448 | DENV2 E | GU211750 | DENV2 E | AY512568 | DENV2 E | EU448428 |
| DENV2 E | DQ518642 | DENV2 E | FJ538912 | DENV2 E | DQ341197 | DENV2 E | GQ368159 |
| DENV2 E | GQ368161 | DENV2 E | AY577431 | DENV2 E | EU117350 | DENV2 E | AY702060 |
| DENV2 E | AY158335 | DENV2 E | DQ181867 | DENV2 E | FM986654 | DENV2 E | AY702049 |
| DENV2 E | A91810 | DENV2 E | AF410367 | DENV2 E | GQ368174 | DENV2 E | EU117319 |
| DENV2 E | L10043 | DENV2 E | AF231719 | DENV2 E | EU117348 | DENV2 E | AF398112 |
| DENV2 E | DQ181809 | DENV2 E | EU069589 | DENV2 E | AM746221 | DENV2 E | AF410370 |
| DENV2 E | AF195037 | DENV2 E | AF410369 | DENV2 E | AY079424 | DENV2 E | DQ181883 |
| DENV2 E | AF295698 | DENV2 E | DQ917242 | DENV2 E | DQ181816 | DENV2 E | L10050 |
| DENV2 E | AY484608 | DENV2 E | EU069580 | DENV2 E | EU448418 | DENV2 E | CS673237 |
| DENV2 E | L10054 | DENV2 E | EU069576 | DENV2 E | DQ181874 | DENV2 E | DQ181879 |

FIG. 67-34

| Virus Protein | Accession No. | Virus Protein | Accession No. | Virus Protein | Accession No. | Virus Protein | Accession No. |
|---|---|---|---|---|---|---|---|
| DENV2 E | AY484600 | DENV2 E | EU117315 | DENV2 E | EU117326 | DENV2 E | GU211738 |
| DENV2 E | DQ518650 | DENV2 E | AY702051 | DENV2 E | AY577433 | DENV2 E | EU448421 |
| DENV2 E | GU434149 | DENV2 E | DQ518643 | DENV2 E | EU448429 | DENV2 E | DQ181896 |
| DENV2 E | DQ518633 | DENV2 E | DQ181871 | DENV2 E | DQ181810 | DENV2 E | AF398109 |
| DENV2 E | EF486507 | DENV2 E | DQ518641 | DENV2 E | DQ181880 | DENV2 E | DQ518651 |
| DENV2 E | AY237292 | DENV2 E | DQ181882 | DENV2 E | AB180478 | DENV2 E | M24446 |
| DENV2 E | GQ368160 | DENV2 E | AF297009 | DENV2 E | EU117332 | DENV2 E | EU069587 |
| DENV2 E | DQ181839 | DENV2 E | GU434159 | DENV2 E | GU211739 | DENV2 E | DQ181850 |
| DENV2 E | L10044 | DENV2 E | DQ181852 | DENV2 E | GU211747 | DENV2 E | AY512567 |
| DENV2 E | GQ368167 | DENV2 E | AF195040 | DENV2 E | DQ181811 | DENV2 E | DQ518646 |
| DENV2 E | DQ341201 | DENV2 E | AF410357 | DENV2 E | EU069573 | DENV2 E | GU211745 |
| DENV2 E | DQ181838 | DENV2 E | EU069577 | DENV2 E | L10041 | DENV2 E | DQ181831 |
| DENV2 E | AM746223 | DENV2 E | EU117349 | DENV2 E | DQ181848 | DENV2 E | FM986659 |
| DENV2 E | AF363091 | DENV2 E | AF363074 | DENV2 E | FM986655 | DENV2 E | AY484599 |
| DENV2 E | EU117322 | DENV2 E | DQ181897 | DENV2 E | AY702046 | DENV2 E | DQ181817 |
| DENV2 E | AY158331 | DENV2 E | GU211748 | DENV2 E | AF363076 | DENV2 E | AF295696 |
| DENV2 E | AF398107 | DENV2 E | AF195038 | DENV2 E | AF297006 | DENV2 E | DQ341198 |
| DENV2 E | AF295697 | DENV2 E | EU117340 | DENV2 E | EF016252 | DENV2 E | DQ181841 |
| DENV2 E | EU069575 | DENV2 E | GU434152 | DENV2 E | AF410347 | DENV2 E | GU211756 |
| DENV2 E | DQ917243 | DENV2 E | AB111454 | DENV2 E | DQ181853 | DENV2 E | EU117316 |
| DENV2 E | AY484603 | DENV2 E | EU069591 | DENV2 E | DQ181877 | DENV2 E | AY702059 |
| DENV2 E | AF195034 | DENV2 E | L10049 | DENV2 E | EU117342 | DENV2 E | AF363089 |
| DENV2 E | DM460984 | DENV2 E | GU434147 | DENV2 E | AY079423 | DENV2 E | AF297008 |
| DENV2 E | GU211761 | DENV2 E | L10051 | DENV2 E | FM986658 | DENV2 E | AF410354 |
| DENV2 E | GU211741 | DENV2 E | AM746225 | DENV2 E | DQ341195 | DENV2 E | AF410353 |
| DENV2 E | DQ181823 | DENV2 E | EU005258 | DENV2 E | DQ518634 | DENV2 E | X15434 |
| DENV2 E | EU448427 | DENV2 E | AB111450 | DENV2 E | GU211757 | DENV2 E | AY577430 |
| DENV2 E | EU117328 | DENV2 E | FJ807638 | DENV2 E | EU117331 | DENV2 E | AF231718 |
| DENV2 E | GU434150 | DENV2 E | FJ807634 | DENV2 E | DQ518648 | DENV2 E | AF410345 |
| DENV2 E | AF363087 | DENV2 E | AY158336 | DENV2 E | EU448415 | DENV2 E | DQ181866 |
| DENV2 E | EF016250 | DENV2 E | EU069584 | DENV2 E | DQ181893 | DENV2 E | DQ181829 |
| DENV2 E | AY158327 | DENV2 E | AF295699 | DENV2 E | AF410355 | DENV2 E | EU448430 |
| DENV2 E | EU117321 | DENV2 E | GU211753 | DENV2 E | AF363085 | DENV2 E | AY706016 |
| DENV2 E | AY158338 | DENV2 E | DQ518631 | DENV2 E | AF363088 | DENV2 E | EU117338 |
| DENV2 E | AY512569 | DENV2 E | DQ518653 | DENV2 E | AY702056 | DENV2 E | GQ368172 |
| DENV2 E | AY577435 | DENV2 E | GQ368162 | DENV2 E | AY702045 | DENV2 E | DQ181886 |
| DENV2 E | DQ181822 | DENV2 E | EU448420 | DENV2 E | GQ368163 | DENV2 E | AF410375 |
| DENV2 E | DQ181813 | DENV2 E | EU117313 | DENV2 E | DQ917247 | DENV2 E | GQ368173 |
| DENV2 E | GU211759 | DENV2 E | M24449 | DENV2 E | GU211762 | DENV2 E | GU434155 |
| DENV2 E | AF295700 | DENV2 E | GQ368169 | DENV2 E | DQ181873 | DENV2 E | EU117334 |
| DENV2 E | DQ181855 | DENV2 E | AF410351 | DENV2 E | D10514 | DENV2 E | AY706005 |
| DENV2 E | DQ181891 | DENV2 E | EU448422 | DENV2 E | FJ807636 | DENV2 E | L10048 |
| DENV2 E | AF398114 | DENV2 E | AY484605 | DENV2 E | EU045313 | DENV2 E | AY484606 |
| DENV2 E | M24450 | DENV2 E | DQ181825 | DENV2 E | X15214 | DENV2 E | DQ181833 |
| DENV2 E | AY702041 | DENV2 E | AF195036 | DENV2 E | GU211755 | DENV2 E | DQ181868 |
| DENV2 E | DQ181846 | DENV2 E | AF363083 | DENV2 E | DQ181876 | DENV2 E | AY484598 |
| DENV2 E | DQ917246 | DENV2 E | DQ181861 | DENV2 E | AF363081 | DENV2 E | EU448417 |
| DENV2 E | AF410377 | DENV2 E | AY702057 | DENV2 E | FM986661 | DENV2 E | AF231716 |

FIG. 67-35

| Virus Protein | Accession No. | Virus Protein | Accession No. | Virus Protein | Accession No. | Virus Protein | Accession No. |
|---|---|---|---|---|---|---|---|
| DENV2 E | AF297004 | DENV2 E | DQ181889 | DENV2 E | AY577437 | DENV2 E | DQ181812 |
| DENV2 E | AF410366 | DENV2 E | DQ181857 | DENV2 E | DQ181872 | DENV2 E | AF410374 |
| DENV2 E | DQ181826 | DENV2 E | AF195043 | DENV2 E | DQ181856 | DENV2 E | GU211746 |
| DENV2 E | EU117352 | DENV2 E | AB194883 | DENV2 E | AF363075 | DENV2 E | AY577432 |
| DENV2 E | AM746227 | DENV2 E | DQ341199 | DENV2 E | DQ181899 | DENV2 E | DQ181847 |
| DENV2 E | AY702054 | DENV2 E | EU117336 | DENV2 E | AF093674 | DENV2 E | GU211758 |
| DENV2 E | AF410359 | DENV2 E | DQ181808 | DENV2 E | AF363069 | DENV2 E | EF016253 |
| DENV2 E | EU117314 | DENV2 E | X54319 | DENV2 E | DQ518630 | DENV2 E | AF363082 |
| DENV2 E | AF398108 | DENV2 E | EU117324 | DENV2 E | AF195032 | DENV2 E | EU117317 |
| DENV2 E | AF410368 | DENV2 E | FJ606703 | DENV2 E | DQ181807 | DENV2 E | AF410346 |
| DENV2 E | AY702043 | DENV2 E | AF195033 | DENV2 E | AF363090 | DENV2 E | EU117333 |
| DENV2 E | AY158333 | DENV2 E | AF410373 | DENV2 E | AF410350 | DENV2 E | EU069572 |
| DENV2 E | AF363071 | DENV2 E | DQ181815 | DENV2 E | FJ807640 | DENV2 E | GU211764 |
| DENV2 E | AF363073 | DENV2 E | DQ181859 | DENV2 E | GU434148 | DENV2 E | EU117339 |
| DENV2 E | GU211742 | DENV2 E | AY702052 | DENV2 E | EU117323 | DENV2 E | EU069574 |
| DENV2 E | AY158328 | DENV2 E | DQ181900 | DENV2 E | DQ181869 | DENV2 E | DQ181894 |
| DENV2 E | EU448423 | DENV2 E | DQ917245 | DENV2 E | AY158332 | DENV2 E | FM986657 |
| DENV2 E | EU069585 | DENV2 E | EU117347 | DENV2 E | DQ917244 | DENV2 E | EU117345 |
| DENV2 E | DQ181843 | DENV2 E | GQ368165 | DENV2 E | GU434151 | DENV2 E | X65240 |
| DENV2 E | GQ368171 | DENV2 E | GQ368168 | DENV2 E | AM746222 | DENV2 E | AF297007 |
| DENV2 E | EU117318 | DENV2 E | AB111449 | DENV2 E | L10052 | DENV2 E | M24448 |
| DENV2 E | AY577439 | DENV2 E | GU434154 | DENV2 E | GU211740 | DENV2 E | DQ518649 |
| DENV2 E | DQ181836 | DENV2 E | EU069582 | DENV2 E | EU448431 | DENV2 E | AF231715 |
| DENV2 E | GU434157 | DENV2 E | FM986660 | DENV2 E | AY359463 | DENV2 E | AF363077 |
| DENV2 E | AF231720 | DENV2 E | DQ181814 | DENV2 E | DQ518644 | DENV2 E | AF455276 |
| DENV2 E | DQ181901 | DENV2 E | EU117330 | DENV2 E | AY702050 | DENV2 E | EU069590 |
| DENV2 E | EU117335 | DENV2 E | AF398113 | DENV2 E | AY577434 | DENV2 E | DQ518640 |
| DENV2 E | AF264053 | DENV2 E | FM986656 | DENV2 E | AF363086 | DENV2 E | DQ181878 |
| DENV2 E | AY702048 | DENV2 E | FJ807632 | DENV2 E | GQ368176 | DENV2 E | GQ368158 |
| DENV2 E | L10046 | DENV2 E | DQ181819 | DENV2 E | L10042 | DENV2 E | GU211749 |
| DENV2 E | DQ518639 | DENV2 E | AY158341 | DENV2 E | DQ181835 | DENV2 E | DQ181854 |
| DENV2 E | AB219135 | DENV2 E | AF410360 | DENV2 E | DQ518635 | DENV2 E | AF398110 |
| DENV2 E | DQ181820 | DENV2 E | DQ341200 | DENV2 E | AY702047 | DENV2 E | AF398106 |
| DENV2 E | DQ181898 | DENV2 E | DQ181892 | DENV2 E | DQ181862 | DENV2 E | DQ181830 |
| DENV2 E | AF398111 | DENV2 E | AF410371 | DENV2 E | GU211760 | DENV2 E | AM746224 |
| DENV2 E | AY484601 | DENV2 E | EU069579 | DENV2 E | EU117351 | DENV2 E | EU069583 |
| DENV2 E | AF363078 | DENV2 E | AJ421524 | DENV2 E | EU069586 | DENV2 E | FJ807633 |
| DENV2 E | AF295694 | DENV2 E | AB111453 | DENV2 E | DQ181845 | DENV2 E | GQ368164 |
| DENV2 E | FJ807639 | DENV2 E | AY702042 | DENV2 E | DQ181821 | DENV2 E | FJ807637 |
| DENV2 E | EU448425 | DENV2 E | AY158337 | DENV2 E | AF195035 | DENV2 E | DQ341196 |
| DENV2 E | AF410349 | DENV2 E | DQ181881 | DENV2 E | EU045311 | DENV2 E | DQ181849 |
| DENV2 E | EU448419 | DENV2 E | AF195041 | DENV2 E | AF410376 | DENV2 E | DQ181837 |
| DENV2 E | GQ368175 | DENV2 E | AF410356 | DENV2 E | AF410378 | DENV2 E | GU434146 |
| DENV2 E | M24445 | DENV2 E | EU117343 | DENV2 E | L10045 | DENV2 E | GU211754 |
| DENV2 E | DQ518632 | DENV2 E | EU249522 | DENV2 E | AF363084 | DENV2 E | DQ181860 |
| DENV2 E | DQ181887 | DENV2 E | M24451 | DENV2 E | AY484602 | DENV2 E | AB111448 |
| DENV2 E | DQ181864 | DENV2 E | GU211752 | DENV2 E | AF004020 | DENV2 E | DQ518642 |
| DENV2 E | GU211751 | DENV2 E | DQ181884 | DENV2 E | FJ158608 | DENV2 E | GQ368161 |

FIG. 67-36

| Virus Protein | Accession No. | Virus Protein | Accession No. | Virus Protein | Accession No. | Virus Protein | Accession No. |
|---|---|---|---|---|---|---|---|
| DENV2 E | AY158335 | DENV2 E | AF410369 | DENV2 E | EU069578 | DENV2 E | GU434149 |
| DENV2 E | A91810 | DENV2 E | DQ917242 | DENV2 E | DQ181858 | DENV2 E | DQ518633 |
| DENV2 E | L10043 | DENV2 E | EU069580 | DENV2 E | GU211763 | DENV2 E | GQ368160 |
| DENV2 E | DQ181809 | DENV2 E | EU069576 | DENV2 E | EF540856 | DENV2 E | DQ181839 |
| DENV2 E | AF195037 | DENV2 E | AY484607 | DENV2 E | AY158340 | DENV2 E | L10044 |
| DENV2 E | AF295698 | DENV2 E | AF363080 | DENV2 E | AY702053 | DENV2 E | GQ368167 |
| DENV2 E | AY484608 | DENV2 E | DQ181827 | DENV2 E | AY702044 | DENV2 E | DQ341201 |
| DENV2 E | L10054 | DENV2 E | DQ181870 | DENV2 E | FJ931535 | DENV2 E | DQ181838 |
| DENV2 E | AF410352 | DENV2 E | AF004019 | DENV2 E | GU434153 | DENV2 E | AM746223 |
| DENV2 E | AB194884 | DENV2 E | DQ518636 | DENV2 E | AM746226 | DENV2 E | AF363091 |
| DENV2 E | AY158330 | DENV2 E | GU211743 | DENV2 E | AF363092 | DENV2 E | EU117322 |
| DENV2 E | DQ518637 | DENV2 E | GU434156 | DENV2 E | GQ368166 | DENV2 E | AY158331 |
| DENV2 E | EU117329 | DENV2 E | FJ807635 | DENV2 E | L10055 | DENV2 E | AF398107 |
| DENV2 E | AY484604 | DENV2 E | EU117344 | DENV2 E | EU069592 | DENV2 E | AF295697 |
| DENV2 E | DQ181840 | DENV2 E | DQ181895 | DENV2 E | EU117341 | DENV2 E | EU069575 |
| DENV2 E | AY706002 | DENV2 E | EU448424 | DENV2 E | DQ181863 | DENV2 E | DQ917243 |
| DENV2 E | DQ181824 | DENV2 E | EU448426 | DENV2 E | AY577436 | DENV2 E | AY484603 |
| DENV2 E | DQ181828 | DENV2 E | DQ181842 | DENV2 E | AY706017 | DENV2 E | AF195034 |
| DENV2 E | DQ181818 | DENV2 E | AY706007 | DENV2 E | AF195039 | DENV2 E | DM460984 |
| DENV2 E | AB111451 | DENV2 E | GU211744 | DENV2 E | DQ181844 | DENV2 E | GU211761 |
| DENV2 E | EU117327 | DENV2 E | DQ518652 | DENV2 E | AF363070 | DENV2 E | GU211741 |
| DENV2 E | EU117320 | DENV2 E | FJ606704 | DENV2 E | DQ181890 | DENV2 E | DQ181823 |
| DENV2 E | EU249523 | DENV2 E | M24444 | DENV2 E | EF016251 | DENV2 E | EU448427 |
| DENV2 E | L10053 | DENV2 E | DQ518647 | DENV2 E | EU069581 | DENV2 E | EU117328 |
| DENV2 E | AF195042 | DENV2 E | AF295695 | DENV2 E | AF363072 | DENV2 E | GU434150 |
| DENV2 E | L10040 | DENV2 E | DQ181875 | DENV2 E | DQ518645 | DENV2 E | AF363087 |
| DENV2 E | EU117337 | DENV2 E | AY158329 | DENV2 E | L10047 | DENV2 E | EF016250 |
| DENV2 E | AB111452 | DENV2 E | AY702058 | DENV2 E | AY706011 | DENV2 E | AY158327 |
| DENV2 E | X15433 | DENV2 E | AF363079 | DENV2 E | GQ368170 | DENV2 E | EU117321 |
| DENV2 E | AF410372 | DENV2 E | M24447 | DENV2 E | GU434158 | DENV2 E | AY158338 |
| DENV2 E | AY158334 | DENV2 E | DQ181832 | DENV2 E | EU045312 | DENV2 E | AY512569 |
| DENV2 E | DQ181834 | DENV2 E | AB194882 | DENV2 E | EU069588 | DENV2 E | AY577435 |
| DENV2 E | DQ181888 | DENV2 E | AF264054 | DENV2 E | DQ518638 | DENV2 E | DQ181822 |
| DENV2 E | AY577438 | DENV2 E | AF163096 | DENV2 E | DQ181851 | DENV2 E | DQ181813 |
| DENV2 E | DQ181885 | DENV2 E | AY871813 | DENV2 E | AY706010 | DENV2 E | GU211759 |
| DENV2 E | AF297005 | DENV2 E | AY158339 | DENV2 E | EU448428 | DENV2 E | AF295700 |
| DENV2 E | EU448416 | DENV2 E | AY512568 | DENV2 E | GQ368159 | DENV2 E | DQ181855 |
| DENV2 E | EU117346 | DENV2 E | DQ341197 | DENV2 E | AY702060 | DENV2 E | DQ181891 |
| DENV2 E | AY702055 | DENV2 E | EU117350 | DENV2 E | AY702049 | DENV2 E | AF398114 |
| DENV2 E | DQ181865 | DENV2 E | FM986654 | DENV2 E | EU117319 | DENV2 E | M24450 |
| DENV2 E | AF231717 | DENV2 E | GQ368174 | DENV2 E | AF398112 | DENV2 E | AY702041 |
| DENV2 E | EU117325 | DENV2 E | EU117348 | DENV2 E | AF410370 | DENV2 E | DQ181846 |
| DENV2 E | GU211750 | DENV2 E | AM746221 | DENV2 E | DQ181883 | DENV2 E | DQ917246 |
| DENV2 E | AY577431 | DENV2 E | AY079424 | DENV2 E | L10050 | DENV2 E | AF410377 |
| DENV2 E | DQ181867 | DENV2 E | DQ181816 | DENV2 E | CS673237 | DENV2 E | EU117315 |
| DENV2 E | AF410367 | DENV2 E | EU448418 | DENV2 E | DQ181879 | DENV2 E | AY702051 |
| DENV2 E | AF231719 | DENV2 E | DQ181874 | DENV2 E | AY484600 | DENV2 E | DQ518643 |
| DENV2 E | EU069589 | DENV2 E | AF410379 | DENV2 E | DQ518650 | DENV2 E | DQ181871 |

FIG. 67-37

| Virus Protein | Accession No. | Virus Protein | Accession No. | Virus Protein | Accession No. | Virus Protein | Accession No. |
|---|---|---|---|---|---|---|---|
| DENV2 E | DQ518641 | DENV2 E | DQ181880 | DENV2 E | DQ518651 | DENV2 E | AM746227 |
| DENV2 E | DQ181882 | DENV2 E | AB180478 | DENV2 E | M24446 | DENV2 E | AY702054 |
| DENV2 E | AF297009 | DENV2 E | EU117332 | DENV2 E | EU069587 | DENV2 E | AF410359 |
| DENV2 E | GU434159 | DENV2 E | GU211739 | DENV2 E | DQ181850 | DENV2 E | EU117314 |
| DENV2 E | DQ181852 | DENV2 E | GU211747 | DENV2 E | AY512567 | DENV2 E | AF398108 |
| DENV2 E | AF195040 | DENV2 E | DQ181811 | DENV2 E | DQ518646 | DENV2 E | AF410368 |
| DENV2 E | AF410357 | DENV2 E | EU069573 | DENV2 E | GU211745 | DENV2 E | AY702043 |
| DENV2 E | EU069577 | DENV2 E | L10041 | DENV2 E | DQ181831 | DENV2 E | AY158333 |
| DENV2 E | EU117349 | DENV2 E | DQ181848 | DENV2 E | FM986659 | DENV2 E | AF363071 |
| DENV2 E | AF363074 | DENV2 E | FM986655 | DENV2 E | AY484599 | DENV2 E | AF363073 |
| DENV2 E | DQ181897 | DENV2 E | AY702046 | DENV2 E | DQ181817 | DENV2 E | GU211742 |
| DENV2 E | GU211748 | DENV2 E | AF363076 | DENV2 E | AF295696 | DENV2 E | AY158328 |
| DENV2 E | AF195038 | DENV2 E | AF297006 | DENV2 E | DQ341198 | DENV2 E | EU448423 |
| DENV2 E | EU117340 | DENV2 E | EF016252 | DENV2 E | DQ181841 | DENV2 E | EU069585 |
| DENV2 E | GU434152 | DENV2 E | AF410347 | DENV2 E | GU211756 | DENV2 E | DQ181843 |
| DENV2 E | AB111454 | DENV2 E | DQ181853 | DENV2 E | EU117316 | DENV2 E | GQ368171 |
| DENV2 E | EU069591 | DENV2 E | DQ181877 | DENV2 E | AY702059 | DENV2 E | EU117318 |
| DENV2 E | L10049 | DENV2 E | EU117342 | DENV2 E | AF363089 | DENV2 E | AY577439 |
| DENV2 E | GU434147 | DENV2 E | AY079423 | DENV2 E | AF297008 | DENV2 E | DQ181836 |
| DENV2 E | L10051 | DENV2 E | FM986658 | DENV2 E | AF410354 | DENV2 E | GU434157 |
| DENV2 E | AM746225 | DENV2 E | DQ341195 | DENV2 E | AF410353 | DENV2 E | AF231720 |
| DENV2 E | EU005258 | DENV2 E | DQ518634 | DENV2 E | X15434 | DENV2 E | DQ181901 |
| DENV2 E | AB111450 | DENV2 E | GU211757 | DENV2 E | AY577430 | DENV2 E | EU117335 |
| DENV2 E | FJ807638 | DENV2 E | EU117331 | DENV2 E | AF231718 | DENV2 E | AF264053 |
| DENV2 E | FJ807634 | DENV2 E | DQ518648 | DENV2 E | AF410345 | DENV2 E | AY702048 |
| DENV2 E | AY158336 | DENV2 E | EU448415 | DENV2 E | DQ181866 | DENV2 E | L10046 |
| DENV2 E | EU069584 | DENV2 E | DQ181893 | DENV2 E | DQ181829 | DENV2 E | DQ518639 |
| DENV2 E | AF295699 | DENV2 E | AF410355 | DENV2 E | EU448430 | DENV2 E | AB219135 |
| DENV2 E | GU211753 | DENV2 E | AF363085 | DENV2 E | AY706016 | DENV2 E | DQ181820 |
| DENV2 E | DQ518631 | DENV2 E | AF363088 | DENV2 E | EU117338 | DENV2 E | DQ181898 |
| DENV2 E | DQ518653 | DENV2 E | AY702056 | DENV2 E | GQ368172 | DENV2 E | AF398111 |
| DENV2 E | GQ368162 | DENV2 E | AY702045 | DENV2 E | DQ181886 | DENV2 E | AY484601 |
| DENV2 E | EU448420 | DENV2 E | GQ368163 | DENV2 E | AF410375 | DENV2 E | AF363078 |
| DENV2 E | EU117313 | DENV2 E | DQ917247 | DENV2 E | GQ368173 | DENV2 E | AF295694 |
| DENV2 E | M24449 | DENV2 E | GU211762 | DENV2 E | GU434155 | DENV2 E | FJ807639 |
| DENV2 E | GQ368169 | DENV2 E | DQ181873 | DENV2 E | EU117334 | DENV2 E | EU448425 |
| DENV2 E | AF410351 | DENV2 E | D10514 | DENV2 E | AY706005 | DENV2 E | AF410349 |
| DENV2 E | EU448422 | DENV2 E | FJ807636 | DENV2 E | L10048 | DENV2 E | EU448419 |
| DENV2 E | AY484605 | DENV2 E | EU045313 | DENV2 E | AY484606 | DENV2 E | GQ368175 |
| DENV2 E | DQ181825 | DENV2 E | X15214 | DENV2 E | DQ181833 | DENV2 E | M24445 |
| DENV2 E | AF195036 | DENV2 E | GU211755 | DENV2 E | DQ181868 | DENV2 E | DQ518632 |
| DENV2 E | AF363083 | DENV2 E | DQ181876 | DENV2 E | AY484598 | DENV2 E | DQ181887 |
| DENV2 E | DQ181861 | DENV2 E | AF363081 | DENV2 E | EU448417 | DENV2 E | DQ181864 |
| DENV2 E | AY702057 | DENV2 E | FM986661 | DENV2 E | AF231716 | DENV2 E | GU211751 |
| DENV2 E | EU117326 | DENV2 E | GU211738 | DENV2 E | AF297004 | DENV2 E | DQ181889 |
| DENV2 E | AY577433 | DENV2 E | EU448421 | DENV2 E | AF410366 | DENV2 E | DQ181857 |
| DENV2 E | EU448429 | DENV2 E | DQ181896 | DENV2 E | DQ181826 | DENV2 E | AF195043 |
| DENV2 E | DQ181810 | DENV2 E | AF398109 | DENV2 E | EU117352 | DENV2 E | AB194883 |

FIG. 67-38

| Virus Protein | Accession No. | Virus Protein | Accession No. | Virus Protein | Accession No. | Virus Protein | Accession No. |
|---|---|---|---|---|---|---|---|
| DENV2 E | DQ341199 | DENV2 E | DQ181899 | DENV2 E | DQ181847 | DENV2 E | AF195037 |
| DENV2 E | EU117336 | DENV2 E | AF093674 | DENV2 E | GU211758 | DENV2 E | AF295698 |
| DENV2 E | DQ181808 | DENV2 E | AF363069 | DENV2 E | EF016253 | DENV2 E | AY484608 |
| DENV2 E | X54319 | DENV2 E | DQ518630 | DENV2 E | AF363082 | DENV2 E | L10054 |
| DENV2 E | EU117324 | DENV2 E | AF195032 | DENV2 E | EU117317 | DENV2 E | AF410352 |
| DENV2 E | FJ606703 | DENV2 E | DQ181807 | DENV2 E | AF410346 | DENV2 E | AB194884 |
| DENV2 E | AF195033 | DENV2 E | AF363090 | DENV2 E | EU117333 | DENV2 E | AY158330 |
| DENV2 E | AF410373 | DENV2 E | AF410350 | DENV2 E | EU069572 | DENV2 E | DQ518637 |
| DENV2 E | DQ181815 | DENV2 E | FJ807640 | DENV2 E | GU211764 | DENV2 E | EU117329 |
| DENV2 E | DQ181859 | DENV2 E | GU434148 | DENV2 E | EU117339 | DENV2 E | AY484604 |
| DENV2 E | AY702052 | DENV2 E | EU117323 | DENV2 E | EU069574 | DENV2 E | DQ181840 |
| DENV2 E | DQ181900 | DENV2 E | DQ181869 | DENV2 E | DQ181894 | DENV2 E | AY706002 |
| DENV2 E | DQ917245 | DENV2 E | AY158332 | DENV2 E | FM986657 | DENV2 E | DQ181824 |
| DENV2 E | EU117347 | DENV2 E | DQ917244 | DENV2 E | EU117345 | DENV2 E | DQ181828 |
| DENV2 E | GQ368165 | DENV2 E | GU434151 | DENV2 E | X65240 | DENV2 E | DQ181818 |
| DENV2 E | GQ368168 | DENV2 E | AM746222 | DENV2 E | AF297007 | DENV2 E | AB111451 |
| DENV2 E | AB111449 | DENV2 E | L10052 | DENV2 E | M24448 | DENV2 E | EU117327 |
| DENV2 E | GU434154 | DENV2 E | GU211740 | DENV2 E | DQ518649 | DENV2 E | EU117320 |
| DENV2 E | EU069582 | DENV2 E | EU448431 | DENV2 E | AF231715 | DENV2 E | EU249523 |
| DENV2 E | FM986660 | DENV2 E | AY359463 | DENV2 E | AF363077 | DENV2 E | L10053 |
| DENV2 E | DQ181814 | DENV2 E | DQ518644 | DENV2 E | AF455276 | DENV2 E | AF195042 |
| DENV2 E | EU117330 | DENV2 E | AY702050 | DENV2 E | EU069590 | DENV2 E | L10040 |
| DENV2 E | AF398113 | DENV2 E | AY577434 | DENV2 E | DQ518640 | DENV2 E | EU117337 |
| DENV2 E | FM986656 | DENV2 E | AF363086 | DENV2 E | DQ181878 | DENV2 E | AB111452 |
| DENV2 E | FJ807632 | DENV2 E | GQ368176 | DENV2 E | GQ368158 | DENV2 E | X15433 |
| DENV2 E | DQ181819 | DENV2 E | L10042 | DENV2 E | GU211749 | DENV2 E | AF410372 |
| DENV2 E | AY158341 | DENV2 E | DQ181835 | DENV2 E | DQ181854 | DENV2 E | AY158334 |
| DENV2 E | AF410360 | DENV2 E | DQ518635 | DENV2 E | AF398110 | DENV2 E | DQ181834 |
| DENV2 E | DQ341200 | DENV2 E | AY702047 | DENV2 E | AF398106 | DENV2 E | DQ181888 |
| DENV2 E | DQ181892 | DENV2 E | DQ181862 | DENV2 E | DQ181830 | DENV2 E | AY577438 |
| DENV2 E | AF410371 | DENV2 E | GU211760 | DENV2 E | AM746224 | DENV2 E | DQ181885 |
| DENV2 E | EU069579 | DENV2 E | EU117351 | DENV2 E | EU069583 | DENV2 E | AF297005 |
| DENV2 E | AJ421524 | DENV2 E | EU069586 | DENV2 E | FJ807633 | DENV2 E | EU448416 |
| DENV2 E | AB111453 | DENV2 E | DQ181845 | DENV2 E | GQ368164 | DENV2 E | EU117346 |
| DENV2 E | AY702042 | DENV2 E | DQ181821 | DENV2 E | FJ807637 | DENV2 E | AY702055 |
| DENV2 E | AY158337 | DENV2 E | AF195035 | DENV2 E | DQ341196 | DENV2 E | DQ181865 |
| DENV2 E | DQ181881 | DENV2 E | EU045311 | DENV2 E | DQ181849 | DENV2 E | AF231717 |
| DENV2 E | AF195041 | DENV2 E | AF410376 | DENV2 E | DQ181837 | DENV2 E | EU117325 |
| DENV2 E | AF410356 | DENV2 E | AF410378 | DENV2 E | GU434146 | DENV2 E | GU211750 |
| DENV2 E | EU117343 | DENV2 E | L10045 | DENV2 E | GU211754 | DENV2 E | AY577431 |
| DENV2 E | EU249522 | DENV2 E | AF363084 | DENV2 E | DQ181860 | DENV2 E | DQ181867 |
| DENV2 E | M24451 | DENV2 E | AY484602 | DENV2 E | AB111448 | DENV2 E | AF410367 |
| DENV2 E | GU211752 | DENV2 E | AF004020 | DENV2 E | DQ518642 | DENV2 E | AF231719 |
| DENV2 E | DQ181884 | DENV2 E | FJ158608 | DENV2 E | GQ368161 | DENV2 E | EU069589 |
| DENV2 E | AY577437 | DENV2 E | DQ181812 | DENV2 E | AY158335 | DENV2 E | AF410369 |
| DENV2 E | DQ181872 | DENV2 E | AF410374 | DENV2 E | A91810 | DENV2 E | DQ917242 |
| DENV2 E | DQ181856 | DENV2 E | GU211746 | DENV2 E | L10043 | DENV2 E | EU069580 |
| DENV2 E | AF363075 | DENV2 E | AY577432 | DENV2 E | DQ181809 | DENV2 E | EU069576 |

FIG. 67-39

| Virus Protein | Accession No. | Virus Protein | Accession No. | Virus Protein | Accession No. | Virus Protein | Accession No. |
|---|---|---|---|---|---|---|---|
| DENV2 E | AY484607 | DENV2 E | AY158340 | DENV2 E | L10044 | DENV2 E | DQ181852 |
| DENV2 E | AF363080 | DENV2 E | AY702053 | DENV2 E | GQ368167 | DENV2 E | AF195040 |
| DENV2 E | DQ181827 | DENV2 E | AY702044 | DENV2 E | DQ341201 | DENV2 E | AF410357 |
| DENV2 E | DQ181870 | DENV2 E | FJ931535 | DENV2 E | DQ181838 | DENV2 E | EU069577 |
| DENV2 E | AF004019 | DENV2 E | GU434153 | DENV2 E | AM746223 | DENV2 E | EU117349 |
| DENV2 E | DQ518636 | DENV2 E | AM746226 | DENV2 E | AF363091 | DENV2 E | AF363074 |
| DENV2 E | GU211743 | DENV2 E | AF363092 | DENV2 E | EU117322 | DENV2 E | DQ181897 |
| DENV2 E | GU434156 | DENV2 E | GQ368166 | DENV2 E | AY158331 | DENV2 E | GU211748 |
| DENV2 E | FJ807635 | DENV2 E | L10055 | DENV2 E | AF398107 | DENV2 E | AF195038 |
| DENV2 E | EU117344 | DENV2 E | EU069592 | DENV2 E | AF295697 | DENV2 E | EU117340 |
| DENV2 E | DQ181895 | DENV2 E | EU117341 | DENV2 E | EU069575 | DENV2 E | GU434152 |
| DENV2 E | EU448424 | DENV2 E | DQ181863 | DENV2 E | DQ917243 | DENV2 E | AB111454 |
| DENV2 E | EU448426 | DENV2 E | AY577436 | DENV2 E | AY484603 | DENV2 E | EU069591 |
| DENV2 E | DQ181842 | DENV2 E | AY706017 | DENV2 E | AF195034 | DENV2 E | L10049 |
| DENV2 E | AY706007 | DENV2 E | AF195039 | DENV2 E | DM460984 | DENV2 E | GU434147 |
| DENV2 E | GU211744 | DENV2 E | DQ181844 | DENV2 E | GU211761 | DENV2 E | L10051 |
| DENV2 E | DQ518652 | DENV2 E | AF363070 | DENV2 E | GU211741 | DENV2 E | AM746225 |
| DENV2 E | FJ606704 | DENV2 E | DQ181890 | DENV2 E | DQ181823 | DENV2 E | EU005258 |
| DENV2 E | M24444 | DENV2 E | EF016251 | DENV2 E | EU448427 | DENV2 E | AB111450 |
| DENV2 E | DQ518647 | DENV2 E | EU069581 | DENV2 E | EU117328 | DENV2 E | FJ807638 |
| DENV2 E | AF295695 | DENV2 E | AF363072 | DENV2 E | GU434150 | DENV2 E | FJ807634 |
| DENV2 E | DQ181875 | DENV2 E | DQ518645 | DENV2 E | AF363087 | DENV2 E | AY158336 |
| DENV2 E | AY158329 | DENV2 E | L10047 | DENV2 E | EF016250 | DENV2 E | EU069584 |
| DENV2 E | AY702058 | DENV2 E | AY706011 | DENV2 E | AY158327 | DENV2 E | AF295699 |
| DENV2 E | AF363079 | DENV2 E | GQ368170 | DENV2 E | EU117321 | DENV2 E | GU211753 |
| DENV2 E | M24447 | DENV2 E | GU434158 | DENV2 E | AY158338 | DENV2 E | DQ518631 |
| DENV2 E | DQ181832 | DENV2 E | EU045312 | DENV2 E | AY512569 | DENV2 E | DQ518653 |
| DENV2 E | AB194882 | DENV2 E | EU069588 | DENV2 E | AY577435 | DENV2 E | GQ368162 |
| DENV2 E | AF264054 | DENV2 E | DQ518638 | DENV2 E | DQ181822 | DENV2 E | EU448420 |
| DENV2 E | AF163096 | DENV2 E | DQ181851 | DENV2 E | DQ181813 | DENV2 E | EU117313 |
| DENV2 E | AY871813 | DENV2 E | AY706010 | DENV2 E | GU211759 | DENV2 E | M24449 |
| DENV2 E | AY158339 | DENV2 E | EU448428 | DENV2 E | AF295700 | DENV2 E | GQ368169 |
| DENV2 E | AY512568 | DENV2 E | GQ368159 | DENV2 E | DQ181855 | DENV2 E | AF410351 |
| DENV2 E | DQ341197 | DENV2 E | AY702060 | DENV2 E | DQ181891 | DENV2 E | EU448422 |
| DENV2 E | EU117350 | DENV2 E | AY702049 | DENV2 E | AF398114 | DENV2 E | AY484605 |
| DENV2 E | FM986654 | DENV2 E | EU117319 | DENV2 E | M24450 | DENV2 E | DQ181825 |
| DENV2 E | GQ368174 | DENV2 E | AF398112 | DENV2 E | AY702041 | DENV2 E | AF195036 |
| DENV2 E | EU117348 | DENV2 E | AF410370 | DENV2 E | DQ181846 | DENV2 E | AF363083 |
| DENV2 E | AM746221 | DENV2 E | DQ181883 | DENV2 E | DQ917246 | DENV2 E | DQ181861 |
| DENV2 E | AY079424 | DENV2 E | L10050 | DENV2 E | AF410377 | DENV2 E | AY702057 |
| DENV2 E | DQ181816 | DENV2 E | CS673237 | DENV2 E | EU117315 | DENV2 E | EU117326 |
| DENV2 E | EU448418 | DENV2 E | DQ181879 | DENV2 E | AY702051 | DENV2 E | AY577433 |
| DENV2 E | DQ181874 | DENV2 E | AY484600 | DENV2 E | DQ518643 | DENV2 E | EU448429 |
| DENV2 E | AF410379 | DENV2 E | DQ518650 | DENV2 E | DQ181871 | DENV2 E | DQ181810 |
| DENV2 E | EU069578 | DENV2 E | GU434149 | DENV2 E | DQ518641 | DENV2 E | DQ181880 |
| DENV2 E | DQ181858 | DENV2 E | DQ518633 | DENV2 E | DQ181882 | DENV2 E | AB180478 |
| DENV2 E | GU211763 | DENV2 E | GQ368160 | DENV2 E | AF297009 | DENV2 E | EU117332 |
| DENV2 E | EF540856 | DENV2 E | DQ181839 | DENV2 E | GU434159 | DENV2 E | GU211739 |

FIG. 67-40

| Virus Protein | Accession No. | Virus Protein | Accession No. | Virus Protein | Accession No. | Virus Protein | Accession No. |
|---|---|---|---|---|---|---|---|
| DENV2 E | GU211747 | DENV2 E | AY512567 | DENV2 E | AF398108 | DENV2 E | EU117324 |
| DENV2 E | DQ181811 | DENV2 E | DQ518646 | DENV2 E | AF410368 | DENV2 E | FJ606703 |
| DENV2 E | EU069573 | DENV2 E | GU211745 | DENV2 E | AY702043 | DENV2 E | AF195033 |
| DENV2 E | L10041 | DENV2 E | DQ181831 | DENV2 E | AY158333 | DENV2 E | AF410373 |
| DENV2 E | DQ181848 | DENV2 E | FM986659 | DENV2 E | AF363071 | DENV2 E | DQ181815 |
| DENV2 E | FM986655 | DENV2 E | AY484599 | DENV2 E | AF363073 | DENV2 E | DQ181859 |
| DENV2 E | AY702046 | DENV2 E | DQ181817 | DENV2 E | GU211742 | DENV2 E | AY702052 |
| DENV2 E | AF363076 | DENV2 E | AF295696 | DENV2 E | AY158328 | DENV2 E | DQ181900 |
| DENV2 E | AF297006 | DENV2 E | DQ341198 | DENV2 E | EU448423 | DENV2 E | DQ917245 |
| DENV2 E | EF016252 | DENV2 E | DQ181841 | DENV2 E | EU069585 | DENV2 E | EU117347 |
| DENV2 E | AF410347 | DENV2 E | GU211756 | DENV2 E | DQ181843 | DENV2 E | GQ368165 |
| DENV2 E | DQ181853 | DENV2 E | EU117316 | DENV2 E | GQ368171 | DENV2 E | GQ368168 |
| DENV2 E | DQ181877 | DENV2 E | AY702059 | DENV2 E | EU117318 | DENV2 E | AB111449 |
| DENV2 E | EU117342 | DENV2 E | AF363089 | DENV2 E | AY577439 | DENV2 E | GU434154 |
| DENV2 E | AY079423 | DENV2 E | AF297008 | DENV2 E | DQ181836 | DENV2 E | EU069582 |
| DENV2 E | FM986658 | DENV2 E | AF410354 | DENV2 E | GU434157 | DENV2 E | FM986660 |
| DENV2 E | DQ341195 | DENV2 E | AF410353 | DENV2 E | AF231720 | DENV2 E | DQ181814 |
| DENV2 E | DQ518634 | DENV2 E | X15434 | DENV2 E | DQ181901 | DENV2 E | EU117330 |
| DENV2 E | GU211757 | DENV2 E | AY577430 | DENV2 E | EU117335 | DENV2 E | AF398113 |
| DENV2 E | EU117331 | DENV2 E | AF231718 | DENV2 E | AF264053 | DENV2 E | FM986656 |
| DENV2 E | DQ518648 | DENV2 E | AF410345 | DENV2 E | AY702048 | DENV2 E | FJ807632 |
| DENV2 E | EU448415 | DENV2 E | DQ181866 | DENV2 E | L10046 | DENV2 E | DQ181819 |
| DENV2 E | DQ181893 | DENV2 E | DQ181829 | DENV2 E | DQ518639 | DENV2 E | AY158341 |
| DENV2 E | AF410355 | DENV2 E | EU448430 | DENV2 E | AB219135 | DENV2 E | AF410360 |
| DENV2 E | AF363085 | DENV2 E | AY706016 | DENV2 E | DQ181820 | DENV2 E | DQ341200 |
| DENV2 E | AF363088 | DENV2 E | EU117338 | DENV2 E | DQ181898 | DENV2 E | DQ181892 |
| DENV2 E | AY702056 | DENV2 E | GQ368172 | DENV2 E | AF398111 | DENV2 E | AF410371 |
| DENV2 E | AY702045 | DENV2 E | DQ181886 | DENV2 E | AY484601 | DENV2 E | EU069579 |
| DENV2 E | GQ368163 | DENV2 E | AF410375 | DENV2 E | AF363078 | DENV2 E | AJ421524 |
| DENV2 E | DQ917247 | DENV2 E | GQ368173 | DENV2 E | AF295694 | DENV2 E | AB111453 |
| DENV2 E | GU211762 | DENV2 E | GU434155 | DENV2 E | FJ807639 | DENV2 E | AY702042 |
| DENV2 E | DQ181873 | DENV2 E | EU117334 | DENV2 E | EU448425 | DENV2 E | AY158337 |
| DENV2 E | D10514 | DENV2 E | AY706005 | DENV2 E | AF410349 | DENV2 E | DQ181881 |
| DENV2 E | FJ807636 | DENV2 E | L10048 | DENV2 E | EU448419 | DENV2 E | AF195041 |
| DENV2 E | EU045313 | DENV2 E | AY484606 | DENV2 E | GQ368175 | DENV2 E | AF410356 |
| DENV2 E | X15214 | DENV2 E | DQ181833 | DENV2 E | M24445 | DENV2 E | EU117343 |
| DENV2 E | GU211755 | DENV2 E | DQ181868 | DENV2 E | DQ518632 | DENV2 E | EU249522 |
| DENV2 E | DQ181876 | DENV2 E | AY484598 | DENV2 E | DQ181887 | DENV2 E | M24451 |
| DENV2 E | AF363081 | DENV2 E | EU448417 | DENV2 E | DQ181864 | DENV2 E | GU211752 |
| DENV2 E | FM986661 | DENV2 E | AF231716 | DENV2 E | GU211751 | DENV2 E | DQ181884 |
| DENV2 E | GU211738 | DENV2 E | AF297004 | DENV2 E | DQ181889 | DENV2 E | AY577437 |
| DENV2 E | EU448421 | DENV2 E | AF410366 | DENV2 E | DQ181857 | DENV2 E | DQ181872 |
| DENV2 E | DQ181896 | DENV2 E | DQ181826 | DENV2 E | AF195043 | DENV2 E | DQ181856 |
| DENV2 E | AF398109 | DENV2 E | EU117352 | DENV2 E | AB194883 | DENV2 E | AF363075 |
| DENV2 E | DQ518651 | DENV2 E | AM746227 | DENV2 E | DQ341199 | DENV2 E | DQ181899 |
| DENV2 E | M24446 | DENV2 E | AY702054 | DENV2 E | EU117336 | DENV2 E | AF093674 |
| DENV2 E | EU069587 | DENV2 E | AF410359 | DENV2 E | DQ181808 | DENV2 E | AF363069 |
| DENV2 E | DQ181850 | DENV2 E | EU117314 | DENV2 E | X54319 | DENV2 E | DQ518630 |

FIG. 67-41

| Virus Protein | Accession No. | Virus Protein | Accession No. | Virus Protein | Accession No. | Virus Protein | Accession No. |
|---|---|---|---|---|---|---|---|
| DENV2 E | AF195032 | DENV2 E | EU117317 | DENV2 E | AF410352 | DENV2 E | AF004019 |
| DENV2 E | DQ181807 | DENV2 E | AF410346 | DENV2 E | AB194884 | DENV2 E | DQ518636 |
| DENV2 E | AF363090 | DENV2 E | EU117333 | DENV2 E | AY158330 | DENV2 E | GU211743 |
| DENV2 E | AF410350 | DENV2 E | EU069572 | DENV2 E | DQ518637 | DENV2 E | GU434156 |
| DENV2 E | FJ807640 | DENV2 E | GU211764 | DENV2 E | EU117329 | DENV2 E | FJ807635 |
| DENV2 E | GU434148 | DENV2 E | EU117339 | DENV2 E | AY484604 | DENV2 E | EU117344 |
| DENV2 E | EU117323 | DENV2 E | EU069574 | DENV2 E | DQ181840 | DENV2 E | DQ181895 |
| DENV2 E | DQ181869 | DENV2 E | DQ181894 | DENV2 E | AY706002 | DENV2 E | EU448424 |
| DENV2 E | AY158332 | DENV2 E | FM986657 | DENV2 E | DQ181824 | DENV2 E | EU448426 |
| DENV2 E | DQ917244 | DENV2 E | EU117345 | DENV2 E | DQ181828 | DENV2 E | DQ181842 |
| DENV2 E | GU434151 | DENV2 E | X65240 | DENV2 E | DQ181818 | DENV2 E | AY706007 |
| DENV2 E | AM746222 | DENV2 E | AF297007 | DENV2 E | AB111451 | DENV2 E | GU211744 |
| DENV2 E | L10052 | DENV2 E | M24448 | DENV2 E | EU117327 | DENV2 E | DQ518652 |
| DENV2 E | GU211740 | DENV2 E | DQ518649 | DENV2 E | EU117320 | DENV2 E | FJ606704 |
| DENV2 E | EU448431 | DENV2 E | AF231715 | DENV2 E | EU249523 | DENV2 E | M24444 |
| DENV2 E | AY359463 | DENV2 E | AF363077 | DENV2 E | L10053 | DENV2 E | DQ518647 |
| DENV2 E | DQ518644 | DENV2 E | AF455276 | DENV2 E | AF195042 | DENV2 E | AF295695 |
| DENV2 E | AY702050 | DENV2 E | EU069590 | DENV2 E | L10040 | DENV2 E | DQ181875 |
| DENV2 E | AY577434 | DENV2 E | DQ518640 | DENV2 E | EU117337 | DENV2 E | AY158329 |
| DENV2 E | AF363086 | DENV2 E | DQ181878 | DENV2 E | AB111452 | DENV2 E | AY702058 |
| DENV2 E | GQ368176 | DENV2 E | GQ368158 | DENV2 E | X15433 | DENV2 E | AF363079 |
| DENV2 E | L10042 | DENV2 E | GU211749 | DENV2 E | AF410372 | DENV2 E | M24447 |
| DENV2 E | DQ181835 | DENV2 E | DQ181854 | DENV2 E | AY158334 | DENV2 E | DQ181832 |
| DENV2 E | DQ518635 | DENV2 E | AF398110 | DENV2 E | DQ181834 | DENV2 E | AB194882 |
| DENV2 E | AY702047 | DENV2 E | AF398106 | DENV2 E | DQ181888 | DENV2 E | AF264054 |
| DENV2 E | DQ181862 | DENV2 E | DQ181830 | DENV2 E | AY577438 | DENV2 E | AF163096 |
| DENV2 E | GU211760 | DENV2 E | AM746224 | DENV2 E | DQ181885 | DENV2 E | AY871813 |
| DENV2 E | EU117351 | DENV2 E | EU069583 | DENV2 E | AF297005 | DENV2 E | AY158339 |
| DENV2 E | EU069586 | DENV2 E | FJ807633 | DENV2 E | EU448416 | DENV2 E | AY512568 |
| DENV2 E | DQ181845 | DENV2 E | GQ368164 | DENV2 E | EU117346 | DENV2 E | DQ341197 |
| DENV2 E | DQ181821 | DENV2 E | FJ807637 | DENV2 E | AY702055 | DENV2 E | EU117350 |
| DENV2 E | AF195035 | DENV2 E | DQ341196 | DENV2 E | DQ181865 | DENV2 E | FM986654 |
| DENV2 E | EU045311 | DENV2 E | DQ181849 | DENV2 E | AF231717 | DENV2 E | GQ368174 |
| DENV2 E | AF410376 | DENV2 E | DQ181837 | DENV2 E | EU117325 | DENV2 E | EU117348 |
| DENV2 E | AF410378 | DENV2 E | GU434146 | DENV2 E | GU211750 | DENV2 E | AM746221 |
| DENV2 E | L10045 | DENV2 E | GU211754 | DENV2 E | AY577431 | DENV2 E | AY079424 |
| DENV2 E | AF363084 | DENV2 E | DQ181860 | DENV2 E | DQ181867 | DENV2 E | DQ181816 |
| DENV2 E | AY484602 | DENV2 E | AB111448 | DENV2 E | AF410367 | DENV2 E | EU448418 |
| DENV2 E | AF004020 | DENV2 E | DQ518642 | DENV2 E | AF231719 | DENV2 E | DQ181874 |
| DENV2 E | FJ158608 | DENV2 E | GQ368161 | DENV2 E | EU069589 | DENV2 E | AF410379 |
| DENV2 E | DQ181812 | DENV2 E | AY158335 | DENV2 E | AF410369 | DENV2 E | EU069578 |
| DENV2 E | AF410374 | DENV2 E | A91810 | DENV2 E | DQ917242 | DENV2 E | DQ181858 |
| DENV2 E | GU211746 | DENV2 E | L10043 | DENV2 E | EU069580 | DENV2 E | GU211763 |
| DENV2 E | AY577432 | DENV2 E | DQ181809 | DENV2 E | EU069576 | DENV2 E | EF540856 |
| DENV2 E | DQ181847 | DENV2 E | AF195037 | DENV2 E | AY484607 | DENV2 E | AY158340 |
| DENV2 E | GU211758 | DENV2 E | AF295698 | DENV2 E | AF363080 | DENV2 E | AY702053 |
| DENV2 E | EF016253 | DENV2 E | AY484608 | DENV2 E | DQ181827 | DENV2 E | AY702044 |
| DENV2 E | AF363082 | DENV2 E | L10054 | DENV2 E | DQ181870 | DENV2 E | FJ931535 |

FIG. 67-42

| Virus | Protein | Accession No. | Virus | Protein | Accession No. | Virus | Protein | Accession No. | Virus | Protein | Accession No. |
|---|---|---|---|---|---|---|---|---|---|---|---|
| DENV2 | E | GU434153 | DENV2 | NS1 | EF105388 | DENV2 | NS1 | GU131947 | DENV2 | NS1 | FJ538923 |
| DENV2 | E | AM746226 | DENV2 | NS1 | FJ410259 | DENV2 | NS1 | EU569707 | DENV2 | NS1 | AY702038 |
| DENV2 | E | AF363092 | DENV2 | NS1 | FJ024461 | DENV2 | NS1 | M20558 | DENV2 | NS1 | FJ467493 |
| DENV2 | E | GQ368166 | DENV2 | NS1 | DQ181801 | DENV2 | NS1 | EU482663 | DENV2 | NS1 | EU482629 |
| DENV2 | E | L10055 | DENV2 | NS1 | EU482650 | DENV2 | NS1 | DQ645543 | DENV2 | NS1 | EU482593 |
| DENV2 | E | EU069592 | DENV2 | NS1 | EU482724 | DENV2 | NS1 | FM210207 | DENV2 | NS1 | AY237288 |
| DENV2 | E | EU117341 | DENV2 | NS1 | FJ898435 | DENV2 | NS1 | FJ873808 | DENV2 | NS1 | FJ850085 |
| DENV2 | E | DQ181863 | DENV2 | NS1 | FJ547064 | DENV2 | NS1 | FM210203 | DENV2 | NS1 | FJ410224 |
| DENV2 | E | AY577436 | DENV2 | NS1 | EU677144 | DENV2 | NS1 | EU687225 | DENV2 | NS1 | GQ868625 |
| DENV2 | E | AY706017 | DENV2 | NS1 | EU569716 | DENV2 | NS1 | EU596486 | DENV2 | NS1 | EU854293 |
| DENV2 | E | AF195039 | DENV2 | NS1 | EU482752 | DENV2 | NS1 | AF100459 | DENV2 | NS1 | EU482675 |
| DENV2 | E | DQ181844 | DENV2 | NS1 | FJ906967 | DENV2 | NS1 | EU687238 | DENV2 | NS1 | AY776328 |
| DENV2 | E | AF363070 | DENV2 | NS1 | FJ410241 | DENV2 | NS1 | EU482747 | DENV2 | NS1 | GU370050 |
| DENV2 | E | DQ181890 | DENV2 | NS1 | FJ639706 | DENV2 | NS1 | GU131928 | DENV2 | NS1 | FJ850061 |
| DENV2 | E | EF016251 | DENV2 | NS1 | EU596500 | DENV2 | NS1 | FM210226 | DENV2 | NS1 | EU660413 |
| DENV2 | E | EU069581 | DENV2 | NS1 | FJ410208 | DENV2 | NS1 | FJ538910 | DENV2 | NS1 | FJ205880 |
| DENV2 | E | AF363072 | DENV2 | NS1 | FJ906957 | DENV2 | NS1 | M84728 | DENV2 | NS1 | EU687199 |
| DENV2 | E | DQ518645 | DENV2 | NS1 | EU569702 | DENV2 | NS1 | FM210230 | DENV2 | NS1 | DQ181804 |
| DENV2 | E | L10047 | DENV2 | NS1 | DQ448233 | DENV2 | NS1 | EU482659 | DENV2 | NS1 | FJ744723 |
| DENV2 | E | AY706011 | DENV2 | NS1 | FJ898478 | DENV2 | NS1 | AJ487271 | DENV2 | NS1 | EU482686 |
| DENV2 | E | GQ368170 | DENV2 | NS1 | FJ882593 | DENV2 | NS1 | EU660399 | DENV2 | NS1 | EU482605 |
| DENV2 | E | GU434158 | DENV2 | NS1 | EU482763 | DENV2 | NS1 | FJ639832 | DENV2 | NS1 | GQ199900 |
| DENV2 | E | EU045312 | DENV2 | NS1 | EU482661 | DENV2 | NS1 | EU569698 | DENV2 | NS1 | FJ410221 |
| DENV2 | E | EU069588 | DENV2 | NS1 | M29095 | DENV2 | NS1 | EU854294 | DENV2 | NS1 | AF100469 |
| DENV2 | E | DQ518638 | DENV2 | NS1 | EU482585 | DENV2 | NS1 | EU482561 | DENV2 | NS1 | FJ898461 |
| DENV2 | E | DQ181851 | DENV2 | NS1 | FJ639711 | DENV2 | NS1 | GQ868515 | DENV2 | NS1 | EU482550 |
| DENV2 | E | AY706010 | DENV2 | NS1 | FJ538915 | DENV2 | NS1 | EU482473 | DENV2 | NS1 | FM210244 |
| DENV2 | E | EU448428 | DENV2 | NS1 | FJ850067 | DENV2 | NS1 | EU482622 | DENV2 | NS1 | EU179858 |
| DENV2 | E | GQ368159 | DENV2 | NS1 | EU482777 | DENV2 | NS1 | EU482693 | DENV2 | NS1 | EU687227 |
| DENV2 | E | AY702060 | DENV2 | NS1 | FJ898479 | DENV2 | NS1 | AY744148 | DENV2 | NS1 | EU660417 |
| DENV2 | E | AY702049 | DENV2 | NS1 | AF100463 | DENV2 | NS1 | EU687249 | DENV2 | NS1 | FJ850082 |
| DENV2 | E | EU117319 | DENV2 | NS1 | FJ744703 | DENV2 | NS1 | EU482761 | DENV2 | NS1 | EU596491 |
| DENV2 | E | AF398112 | DENV2 | NS1 | EU482642 | DENV2 | NS1 | FJ639837 | DENV2 | NS1 | EU482582 |
| DENV2 | E | AF410370 | DENV2 | NS1 | FJ744718 | DENV2 | NS1 | FJ906960 | DENV2 | NS1 | EU482749 |
| DENV2 | E | DQ181883 | DENV2 | NS1 | EF457904 | DENV2 | NS1 | FJ538928 | DENV2 | NS1 | EU482779 |
| DENV2 | E | L10050 | DENV2 | NS1 | AF169687 | DENV2 | NS1 | AY702035 | DENV2 | NS1 | GQ868623 |
| DENV2 | E | CS673237 | DENV2 | NS1 | FJ850072 | DENV2 | NS1 | GQ868590 | DENV2 | NS1 | AF169680 |
| DENV2 | E | DQ181879 | DENV2 | NS1 | EU482445 | DENV2 | NS1 | GQ199896 | DENV2 | NS1 | U87411 |
| DENV2 | E | AY484600 | DENV2 | NS1 | EU482598 | DENV2 | NS1 | FN429892 | DENV2 | NS1 | FM210213 |
| DENV2 | E | DQ518650 | DENV2 | NS1 | AF359579 | DENV2 | NS1 | EU482466 | DENV2 | NS1 | EU482647 |
| DENV2 | E | GU434149 | DENV2 | NS1 | GQ199605 | DENV2 | NS1 | FJ639697 | DENV2 | NS1 | AF169681 |
| DENV2 | E | DQ518633 | DENV2 | NS1 | EU482639 | DENV2 | NS1 | FM210209 | DENV2 | NS1 | EU482548 |
| DENV2 | NS1 | CS479165 | DENV2 | NS1 | U51929 | DENV2 | NS1 | AB122022 | DENV2 | NS1 | DQ472146 |
| DENV2 | NS1 | FJ205877 | DENV2 | NS1 | GQ868551 | DENV2 | NS1 | EU569697 | DENV2 | NS1 | FJ898439 |
| DENV2 | NS1 | EU726767 | DENV2 | NS1 | EU569713 | DENV2 | NS1 | EU482730 | DENV2 | NS1 | EU482637 |
| DENV2 | NS1 | EU482649 | DENV2 | NS1 | EU482775 | DENV2 | NS1 | EU482577 | DENV2 | NS1 | EU781135 |
| DENV2 | NS1 | FM210221 | DENV2 | NS1 | GQ868620 | DENV2 | NS1 | FJ390384 | DENV2 | NS1 | DQ645548 |
| DENV2 | NS1 | EU482740 | DENV2 | NS1 | GU131902 | DENV2 | NS1 | CS805344 | DENV2 | NS1 | AB189122 |

FIG. 67-43

| Virus Protein Accession No. | Virus Protein Accession No. | Virus Protein Accession No. | Virus Protein Accession No. |
|---|---|---|---|
| DENV2 NS1FJ810418 | DENV2 NS1FJ850117 | DENV2 NS1EU482701 | DENV2 NS1EU482608 |
| DENV2 NS1GU131896 | DENV2 NS1EU482678 | DENV2 NS1AY237294 | DENV2 NS1EU482447 |
| DENV2 NS1EU482765 | DENV2 NS1EU482698 | DENV2 NS1FJ024452 | DENV2 NS1FJ410291 |
| DENV2 NS1EU596498 | DENV2 NS1FM210202 | DENV2 NS1EU569700 | DENV2 NS1GQ199899 |
| DENV2 NS1CS479167 | DENV2 NS1EU482594 | DENV2 NS1DQ448236 | DENV2 NS1EU482630 |
| DENV2 NS1FJ182012 | DENV2 NS1FJ898465 | DENV2 NS1EU482580 | DENV2 NS1FJ687445 |
| DENV2 NS1EF105381 | DENV2 NS1FJ639834 | DENV2 NS1EU482670 | DENV2 NS1GQ199890 |
| DENV2 NS1FJ410195 | DENV2 NS1GQ868553 | DENV2 NS1FJ687437 | DENV2 NS1EU482651 |
| DENV2 NS1AF204178 | DENV2 NS1FJ850115 | DENV2 NS1NC_001474 | DENV2 NS1EU482658 |
| DENV2 NS1FJ226066 | DENV2 NS1EU482627 | DENV2 NS1EU596497 | DENV2 NS1EU687235 |
| DENV2 NS1EU482640 | DENV2 NS1EU482620 | DENV2 NS1EU482704 | DENV2 NS1FJ850091 |
| DENV2 NS1GQ868592 | DENV2 NS1FJ744721 | DENV2 NS1EU569692 | DENV2 NS1FJ639698 |
| DENV2 NS1FJ639704 | DENV2 NS1EU687220 | DENV2 NS1CS477302 | DENV2 NS1FJ538905 |
| DENV2 NS1EU687212 | DENV2 NS1EU687236 | DENV2 NS1AF169683 | DENV2 NS1FJ850050 |
| DENV2 NS1AF100462 | DENV2 NS1FJ687442 | DENV2 NS1FM210232 | DENV2 NS1AB189124 |
| DENV2 NS1EU726775 | DENV2 NS1EU569705 | DENV2 NS1FJ898454 | DENV2 NS1EU482771 |
| DENV2 NS1EU677146 | DENV2 NS1EU482780 | DENV2 NS1EU596483 | DENV2 NS1AF276619 |
| DENV2 NS1AF022436 | DENV2 NS1EU687231 | DENV2 NS1FJ639700 | DENV2 NS1FJ538913 |
| DENV2 NS1EU482680 | DENV2 NS1GQ199866 | DENV2 NS1GQ199892 | DENV2 NS1EU482766 |
| DENV2 NS1EU482464 | DENV2 NS1FJ850074 | DENV2 NS1M84727 | DENV2 NS1DQ645549 |
| DENV2 NS1AF489932 | DENV2 NS1EU081178 | DENV2 NS1EU677148 | DENV2 NS1EU687242 |
| DENV2 NS1GU131864 | DENV2 NS1FJ410215 | DENV2 NS1EU482645 | DENV2 NS1EU482635 |
| DENV2 NS1FJ390389 | DENV2 NS1DQ645555 | DENV2 NS1FJ639733 | DENV2 NS1EU687245 |
| DENV2 NS1EU687240 | DENV2 NS1EU482652 | DENV2 NS1FJ410223 | DENV2 NS1AY702039 |
| DENV2 NS1DQ645545 | DENV2 NS1FJ432726 | DENV2 NS1FM210215 | DENV2 NS1AY744150 |
| DENV2 NS1FJ906959 | DENV2 NS1EU482688 | DENV2 NS1FM210210 | DENV2 NS1EU482734 |
| DENV2 NS1EU621672 | DENV2 NS1M58488 | DENV2 NS1FJ744708 | DENV2 NS1AY237291 |
| DENV2 NS1GQ868599 | DENV2 NS1FJ410202 | DENV2 NS1FJ024454 | DENV2 NS1EU726770 |
| DENV2 NS1EU677138 | DENV2 NS1GQ868646 | DENV2 NS1FJ810409 | DENV2 NS1FJ850119 |
| DENV2 NS1EU482783 | DENV2 NS1EU482575 | DENV2 NS1EU569695 | DENV2 NS1EU596489 |
| DENV2 NS1EU596484 | DENV2 NS1FM210246 | DENV2 NS1EF105383 | DENV2 NS1EU482470 |
| DENV2 NS1EU569718 | DENV2 NS1FJ898449 | DENV2 NS1GU131882 | DENV2 NS1EU687222 |
| DENV2 NS1X17340 | DENV2 NS1EU482471 | DENV2 NS1EU482697 | DENV2 NS1FJ205885 |
| DENV2 NS1FJ639709 | DENV2 NS1FJ744705 | DENV2 NS1CS479202 | DENV2 NS1AB479042 |
| DENV2 NS1AF169688 | DENV2 NS1EU482572 | DENV2 NS1DQ181805 | DENV2 NS1EU482748 |
| DENV2 NS1DQ181799 | DENV2 NS1GU131885 | DENV2 NS1EF105378 | DENV2 NS1GU131924 |
| DENV2 NS1GQ199898 | DENV2 NS1FJ850116 | DENV2 NS1AF022438 | DENV2 NS1GQ868640 |
| DENV2 NS1FJ024458 | DENV2 NS1FM210218 | DENV2 NS1FJ639702 | DENV2 NS1U89517 |
| DENV2 NS1FJ687436 | DENV2 NS1EU482754 | DENV2 NS1EU482729 | DENV2 NS1FJ639710 |
| DENV2 NS1FB667404 | DENV2 NS1EU482756 | DENV2 NS1EU569710 | DENV2 NS1AF119661 |
| DENV2 NS1FJ850063 | DENV2 NS1X17339 | DENV2 NS1FJ547090 | DENV2 NS1EU482545 |
| DENV2 NS1EU482541 | DENV2 NS1DQ181806 | DENV2 NS1GU131974 | DENV2 NS1EU687215 |
| DENV2 NS1DQ645554 | DENV2 NS1FB730117 | DENV2 NS1FJ639833 | DENV2 NS1FJ898432 |
| DENV2 NS1M58490 | DENV2 NS1EU482737 | DENV2 NS1AX775700 | DENV2 NS1EU482700 |
| DENV2 NS1FJ538921 | DENV2 NS1AB122020 | DENV2 NS1FJ410228 | DENV2 NS1EU482782 |
| DENV2 NS1EU482657 | DENV2 NS1EU482636 | DENV2 NS1FM210242 | DENV2 NS1FJ873811 |
| DENV2 NS1EU482768 | DENV2 NS1FJ538908 | DENV2 NS1FM210228 | DENV2 NS1DQ472142 |
| DENV2 NS1AF038402 | DENV2 NS1EU482557 | DENV2 NS1FJ390387 | DENV2 NS1EU482758 |

FIG. 67-44

| Virus Protein Accession No. | Virus Protein Accession No. | Virus Protein Accession No. | Virus Protein Accession No. |
|---|---|---|---|
| DENV2 NS1GQ868624 | DENV2 NS1EU482691 | DENV2 NS1FJ744719 | DENV2 NS1AY744147 |
| DENV2 NS1FJ744715 | DENV2 NS1FJ687439 | DENV2 NS1FJ744713 | DENV2 NS1FM210227 |
| DENV2 NS1FJ639783 | DENV2 NS1GQ199874 | DENV2 NS1EU482475 | DENV2 NS1FM210231 |
| DENV2 NS1EU081177 | DENV2 NS1EU687217 | DENV2 NS1FJ461311 | DENV2 NS1AY237295 |
| DENV2 NS1FM210222 | DENV2 NS1AY237289 | DENV2 NS1FJ538918 | DENV2 NS1M58491 |
| DENV2 NS1EU569703 | DENV2 NS1EU482731 | DENV2 NS1GQ868597 | DENV2 NS1FN429891 |
| DENV2 NS1EU482667 | DENV2 NS1EU529706 | DENV2 NS1GQ199869 | DENV2 NS1EU482676 |
| DENV2 NS1DQ645540 | DENV2 NS1EU482656 | DENV2 NS1EU482449 | DENV2 NS1GQ868604 |
| DENV2 NS1M58487 | DENV2 NS1EU482543 | DENV2 NS1EU482773 | DENV2 NS1GQ868516 |
| DENV2 NS1FJ410288 | DENV2 NS1EU482732 | DENV2 NS1EU569701 | DENV2 NS1EU482769 |
| DENV2 NS1GU131930 | DENV2 NS1FJ538924 | DENV2 NS1EU482738 | DENV2 NS1FJ744717 |
| DENV2 NS1AY037116 | DENV2 NS1EU482643 | DENV2 NS1AY871815 | DENV2 NS1EU687213 |
| DENV2 NS1GQ868549 | DENV2 NS1DQ645542 | DENV2 NS1EU482468 | DENV2 NS1FM210239 |
| DENV2 NS1EU482751 | DENV2 NS1EU482695 | DENV2 NS1EU482633 | DENV2 NS1FJ538922 |
| DENV2 NS1EU482562 | DENV2 NS1FJ744745 | DENV2 NS1GU131886 | DENV2 NS1DQ645556 |
| DENV2 NS1FJ850107 | DENV2 NS1FM210205 | DENV2 NS1EU677141 | DENV2 NS1EU081180 |
| DENV2 NS1FJ898450 | DENV2 NS1GQ868622 | DENV2 NS1GQ868557 | DENV2 NS1AF204177 |
| DENV2 NS1EU482570 | DENV2 NS1EU660414 | DENV2 NS1AJ968413 | DENV2 NS1EU482679 |
| DENV2 NS1FN429894 | DENV2 NS1FJ461309 | DENV2 NS1FJ639835 | DENV2 NS1EU482472 |
| DENV2 NS1EU482702 | DENV2 NS1EU482745 | DENV2 NS1EU482579 | DENV2 NS1AY858035 |
| DENV2 NS1EU482743 | DENV2 NS1EU482601 | DENV2 NS1GU131881 | DENV2 NS1EU596490 |
| DENV2 NS1EU081179 | DENV2 NS1AY702037 | DENV2 NS1GQ868556 | DENV2 NS1FJ850051 |
| DENV2 NS1EU529694 | DENV2 NS1FJ639830 | DENV2 NS1FJ744741 | DENV2 NS1AY422469 |
| DENV2 NS1EU660405 | DENV2 NS1FM210234 | DENV2 NS1FB667399 | DENV2 NS1EU482446 |
| DENV2 NS1FJ859028 | DENV2 NS1EU482787 | DENV2 NS1AF100466 | DENV2 NS1EU482694 |
| DENV2 NS1Z17213 | DENV2 NS1EU482632 | DENV2 NS1M58493 | DENV2 NS1GQ868591 |
| DENV2 NS1GQ252676 | DENV2 NS1FJ373299 | DENV2 NS1FJ390390 | DENV2 NS1FJ461305 |
| DENV2 NS1FJ850065 | DENV2 NS1EU482683 | DENV2 NS1GQ199894 | DENV2 NS1FJ744709 |
| DENV2 NS1EU482589 | DENV2 NS1EU482569 | DENV2 NS1FJ898434 | DENV2 NS1GQ199868 |
| DENV2 NS1EU482641 | DENV2 NS1EU482674 | DENV2 NS1EU482597 | DENV2 NS1EU660400 |
| DENV2 NS1FJ390385 | DENV2 NS1FJ478459 | DENV2 NS1FJ906969 | DENV2 NS1EU482465 |
| DENV2 NS1EU482784 | DENV2 NS1FJ850121 | DENV2 NS1AF169679 | DENV2 NS1FM210208 |
| DENV2 NS1EU482727 | DENV2 NS1FJ205879 | DENV2 NS1FJ461321 | DENV2 NS1EU482669 |
| DENV2 NS1FM210212 | DENV2 NS1FJ687434 | DENV2 NS1EU687224 | DENV2 NS1EU529695 |
| DENV2 NS1GQ868588 | DENV2 NS1X69191 | DENV2 NS1FJ687440 | DENV2 NS1FJ850062 |
| DENV2 NS1EU569721 | DENV2 NS1EU482450 | DENV2 NS1EF105380 | DENV2 NS1GQ199901 |
| DENV2 NS1EU482654 | DENV2 NS1FJ850053 | DENV2 NS1AF100467 | DENV2 NS1EU359009 |
| DENV2 NS1GU369819 | DENV2 NS1EU056811 | DENV2 NS1EU482753 | DENV2 NS1GU131931 |
| DENV2 NS1GQ868541 | DENV2 NS1EU596487 | DENV2 NS1AF022439 | DENV2 NS1FJ906961 |
| DENV2 NS1EU569711 | DENV2 NS1EU482626 | DENV2 NS1AF100460 | DENV2 NS1EU529700 |
| DENV2 NS1EU482553 | DENV2 NS1FJ538926 | DENV2 NS1EU596495 | DENV2 NS1EU482576 |
| DENV2 NS1FJ639717 | DENV2 NS1EU482586 | DENV2 NS1FJ373301 | DENV2 NS1EU482703 |
| DENV2 NS1CS477304 | DENV2 NS1EU482665 | DENV2 NS1U88237 | DENV2 NS1EU482685 |
| DENV2 NS1FJ687447 | DENV2 NS1FJ898452 | DENV2 NS1DQ448235 | DENV2 NS1FM210214 |
| DENV2 NS1FJ538911 | DENV2 NS1FM210219 | DENV2 NS1FJ906962 | DENV2 NS1FJ744724 |
| DENV2 NS1FM210240 | DENV2 NS1EF105385 | DENV2 NS1FJ850105 | DENV2 NS1FM210245 |
| DENV2 NS1EU482672 | DENV2 NS1AF046858 | DENV2 NS1EU482542 | DENV2 NS1GQ199895 |
| DENV2 NS1FJ639828 | DENV2 NS1GQ868596 | DENV2 NS1AY702036 | DENV2 NS1EU482604 |

FIG. 67-45

| Virus Protein | Accession No. | Virus Protein | Accession No. | Virus Protein | Accession No. | Virus Protein | Accession No. |
|---|---|---|---|---|---|---|---|
| DENV2 NS1 | FM210236 | DENV2 NS1 | EU482776 | DENV2 NS1 | GQ252677 | DENV2 NS1 | FJ687444 |
| DENV2 NS1 | EU482736 | DENV2 NS1 | GQ868543 | DENV2 NS1 | FJ906966 | DENV2 NS1 | GU131901 |
| DENV2 NS1 | EU482551 | DENV2 NS1 | FJ410237 | DENV2 NS1 | GU289914 | DENV2 NS1 | GQ868550 |
| DENV2 NS1 | DQ645546 | DENV2 NS1 | AF169686 | DENV2 NS1 | FJ744706 | DENV2 NS1 | EU482660 |
| DENV2 NS1 | EU687228 | DENV2 NS1 | FJ639707 | DENV2 NS1 | EU596496 | DENV2 NS1 | FJ410219 |
| DENV2 NS1 | EF105387 | DENV2 NS1 | FJ850120 | DENV2 NS1 | EU482560 | DENV2 NS1 | EU569717 |
| DENV2 NS1 | EU482648 | DENV2 NS1 | FJ639822 | DENV2 NS1 | EU482723 | DENV2 NS1 | AF022435 |
| DENV2 NS1 | FJ538916 | DENV2 NS1 | EU482699 | DENV2 NS1 | EU482741 | DENV2 NS1 | EU482788 |
| DENV2 NS1 | FJ639705 | DENV2 NS1 | GQ868552 | DENV2 NS1 | M58489 | DENV2 NS1 | FJ744743 |
| DENV2 NS1 | FJ906968 | DENV2 NS1 | EU660406 | DENV2 NS1 | EU482549 | DENV2 NS1 | FJ906956 |
| DENV2 NS1 | AF100464 | DENV2 NS1 | EU569715 | DENV2 NS1 | FJ538914 | DENV2 NS1 | EU482607 |
| DENV2 NS1 | EU677145 | DENV2 NS1 | FJ898467 | DENV2 NS1 | EU482573 | DENV2 NS1 | EU726776 |
| DENV2 NS1 | EU596485 | DENV2 NS1 | EF051521 | DENV2 NS1 | EU482755 | DENV2 NS1 | EU687230 |
| DENV2 NS1 | FJ898477 | DENV2 NS1 | EF486510 | DENV2 NS1 | FN429893 | DENV2 NS1 | EU482581 |
| DENV2 NS1 | DQ181803 | DENV2 NS1 | GQ868497 | DENV2 NS1 | AF022434 | DENV2 NS1 | EU482600 |
| DENV2 NS1 | EU482786 | DENV2 NS1 | EU003591 | DENV2 NS1 | EU529693 | DENV2 NS1 | FJ538909 |
| DENV2 NS1 | EF486509 | DENV2 NS1 | EU569699 | DENV2 NS1 | EU596499 | DENV2 NS1 | GU131927 |
| DENV2 NS1 | EF105389 | DENV2 NS1 | EU482547 | DENV2 NS1 | EU482687 | DENV2 NS1 | FJ850076 |
| DENV2 NS1 | EU482781 | DENV2 NS1 | FJ850064 | DENV2 NS1 | AF022440 | DENV2 NS1 | GQ868638 |
| DENV2 NS1 | EU482638 | DENV2 NS1 | EU482719 | DENV

FIG. 67-46

| Virus Protein Accession No. | Virus Protein Accession No. | Virus Protein Accession No. | Virus Protein Accession No. |
|---|---|---|---|
| DENV2 NS1EU482546 | DENV2 NS1GU131955 | DENV2 NS1EU482590 | DENV2 NS1EF105379 |
| DENV2 NS1FJ410233 | DENV2 NS1FJ906958 | DENV2 NS1AF208496 | DENV2 NS1EU482728 |
| DENV2 NS1GQ868600 | DENV2 NS1AX775702 | DENV2 NS1EU569693 | DENV2 NS1FM210229 |
| DENV2 NS1GU131898 | DENV2 NS1FJ744722 | DENV2 NS1FJ850106 | DENV2 NS1GU131880 |
| DENV2 NS1FJ538912 | DENV2 NS1EU482770 | DENV2 NS1EU482623 | DENV2 NS1M19197 |
| DENV2 NS1AY858036 | DENV2 NS1AY744149 | DENV2 NS1GU131879 | DENV2 NS1GQ868603 |
| DENV2 NS1EU687244 | DENV2 NS1EU482655 | DENV2 NS1FM210223 | DENV2 NS1GU131929 |
| DENV2 NS1FJ850066 | DENV2 NS1EU677137 | DENV2 NS1GQ199893 | DENV2 NS1FJ639732 |
| DENV2 NS1EU482556 | DENV2 NS1EU482744 | DENV2 NS1EU482578 | DENV2 NS1EU677143 |
| DENV2 NS1FJ744744 | DENV2 NS1FJ639701 | DENV2 NS1EU482544 | DENV2 NS1EU482682 |
| DENV2 NS1FJ639788 | DENV2 NS1AY237290 | DENV2 NS1EU482759 | DENV2 NS1GQ868641 |
| DENV2 NS1FN429895 | DENV2 NS1EU660415 | DENV2 NS1FJ744711 | DENV2 NS1EU482785 |
| DENV2 NS1FJ850060 | DENV2 NS1EU482631 | DENV2 NS1EU569704 | DENV2 NS1FJ410193 |
| DENV2 NS1EU660404 | DENV2 NS1FJ687435 | DENV2 NS1AF169685 | DENV2 NS1EU482552 |
| DENV2 NS1EU482690 | DENV2 NS1FJ639836 | DENV2 NS1EU677147 | DENV2 NS1EU677142 |
| DENV2 NS1EU569720 | DENV2 NS1FJ538906 | DENV2 NS1GU370051 | DENV2 NS1EU687232 |
| DENV2 NS1FJ687441 | DENV2 NS1AY702034 | DENV2 NS1EU482587 | DENV2 NS1FM210241 |
| DENV2 NS1FJ538925 | DENV2 NS1EU482696 | DENV2 NS1DQ645551 | DENV2 NS1FJ744725 |
| DENV2 NS1AF169678 | DENV2 NS1FJ687438 | DENV2 NS1FJ390391 | DENV2 NS1GQ868621 |
| DENV2 NS1AF100468 | DENV2 NS1U51930 | DENV2 NS1FJ850054 | DENV2 NS1EU482653 |
| DENV2 NS1EU482722 | DENV2 NS1EU596488 | DENV2 NS1EU482565 | DENV2 NS1DQ448232 |
| DENV2 NS1GU131883 | DENV2 NS1FM210220 | DENV2 NS1FJ373300 | DENV2 NS1FJ024477 |
| DENV2 NS1FM210235 | DENV2 NS1FJ898451 | DENV2 NS1AF169684 | DENV2 NS1U87412 |
| DENV2 NS1FJ744707 | DENV2 NS1FJ538927 | DENV2 NS1DL138662 | DENV2 NS1EU482692 |
| DENV2 NS1EU482588 | DENV2 NS1X65241 | DENV2 NS1FJ538917 | DENV2 NS1FM210206 |
| DENV2 NS1EU677149 | DENV2 NS1FJ639708 | DENV2 NS1GQ868544 | DENV2 NS1EU482644 |
| DENV2 NS1FJ639734 | DENV2 NS1EU687229 | DENV2 NS1FJ744714 | DENV2 NS1GU131975 |
| DENV2 NS1GQ868555 | DENV2 NS1EU482739 | DENV2 NS1EU179859 | DENV2 NS1EU482602 |
| DENV2 NS1GQ868540 | DENV2 NS1EU569709 | DENV2 NS1DQ448234 | DENV2 NS1EU482673 |
| DENV2 NS1X57469 | DENV2 NS1EU687223 | DENV2 NS1DQ645541 | DENV2 NS1FJ024474 |
| DENV2 NS1AF169682 | DENV2 NS1EF486508 | DENV2 NS1AF100465 | DENV2 NS1FJ744720 |
| DENV2 NS1M58486 | DENV2 NS1EF105386 | DENV2 NS1EU687246 | DENV2 NS1FJ639809 |
| DENV2 NS1DQ181797 | DENV2 NS1FJ410217 | DENV2 NS1EU482750 | DENV2 NS1FJ639718 |
| DENV2 NS1FJ687446 | DENV2 NS1EU482467 | DENV2 NS1GU131900 | DENV2 NS1DQ181802 |
| DENV2 NS1FJ639829 | DENV2 NS1FJ461314 | DENV2 NS1FM210211 | DENV2 NS1FJ810411 |
| DENV2 NS1FJ898453 | DENV2 NS1GQ868595 | DENV2 NS1EU482742 | DENV2 NS1EU482554 |
| DENV2 NS1EU482721 | DENV2 NS1GU131932 | DENV2 NS1EU482705 | DENV2 NS1FM210237 |
| DENV2 NS1FJ898460 | DENV2 NS1EU056810 | DENV2 NS1AX775704 | DENV2 NS1EU482603 |
| DENV2 NS1FJ898438 | DENV2 NS1AF022441 | DENV2 NS1EF105390 | DENV2 NS1EF486507 |
| DENV2 NS1EU569712 | DENV2 NS1AF457574 | DENV2 NS1EU482684 | DENV2 NS1EU482733 |
| DENV2 NS1DQ448237 | DENV2 NS1EU056812 | DENV2 NS1EU569714 | DENV2 NS1AY237292 |
| DENV2 NS1EU687250 | DENV2 NS1EU482664 | DENV2 NS1GQ868589 | DENV2 NS1FJ850088 |
| DENV2 NS1FJ432724 | DENV2 NS1EU482568 | DENV2 NS1FJ850078 | DENV2 NS1DQ448233 |
| DENV2 NS1AF022437 | DENV2 NS1EU482774 | DENV2 NS1FM210243 | DENV2 NS1FJ538915 |
| DENV2 NS1DQ181800 | DENV2 NS1FJ547067 | DENV2 NS1EU482671 | DENV2 NS1U51929 |
| DENV2 NS1EU687241 | DENV2 NS1EU482474 | DENV2 NS1EU482571 | DENV2 NS1FJ538910 |
| DENV2 NS1FJ410200 | DENV2 NS1FJ850118 | DENV2 NS1DQ645544 | DENV2 NS1FJ538928 |
| DENV2 NS1FJ205878 | DENV2 NS1EU687216 | DENV2 NS1FM210238 | DENV2 NS1FJ538923 |

FIG. 67-47

| Virus Protein Accession No. | Virus Protein Accession No. | Virus Protein Accession No. | Virus Protein Accession No. |
|---|---|---|---|
| DENV2 NS1AY237288 | DENV2 NS1X17338 | DENV2 NS1X69191 | DENV2 NS2A |
| DENV2 NS1DQ472146 | DENV2 NS1M58492 | DENV2 NS1FJ538926 | CS479165 |
| DENV2 NS1X17340 | DENV2 NS1FJ538912 | DENV2 NS1AF046858 | DENV2 NS2A |
| DENV2 NS1M58490 | DENV2 NS1FJ538925 | DENV2 NS1FJ538918 | EU482542 |
| DENV2 NS1FJ538921 | DENV2 NS1X57469 | DENV2 NS1AY871815 | DENV2 NS2A |
| DENV2 NS1M58488 | DENV2 NS1M58486 | DENV2 NS1M58493 | FJ205877 |
| DENV2 NS1X17339 | DENV2 NS1DQ448237 | DENV2 NS1U88237 | DENV2 NS2A |
| DENV2 NS1FJ538908 | DENV2 NS1AX775702 | DENV2 NS1DQ448235 | EU726767 |
| DENV2 NS1AY237294 | DENV2 NS1AY237290 | DENV2 NS1AY237295 | DENV2 NS2A |
| DENV2 NS1DQ448236 | DENV2 NS1FJ538906 | DENV2 NS1M58491 | AY702036 |
| DENV2 NS1AX775700 | DENV2 NS1U51930 | DENV2 NS1FJ538922 | DENV2 NS2A |
| DENV2 NS1FJ538905 | DENV2 NS1FJ538927 | DENV2 NS1AY422469 | EU482649 |
| DENV2 NS1FJ538913 | DENV2 NS1X65241 | DENV2 NS1FJ538916 | DENV2 NS2A |
| DENV2 NS1AY237291 | DENV2 NS1EF486508 | DENV2 NS1EF486509 | AY744147 |
| DENV2 NS1U89517 | DENV2 NS1AF457574 | DENV2 NS1AY237293 | DENV2 NS2A |
| DENV2 NS1DQ472142 | DENV2 NS1FJ538917 | DENV2 NS1DQ472147 | FM210227 |
| DENV2 NS1M58487 | DENV2 NS1DQ448234 | DENV2 NS1U51928 | DENV2 NS2A |
| DENV2 NS1Z17213 | DENV2 NS1AX775704 | DENV2 NS1EF486510 | FM210221 |
| DENV2 NS1FJ538911 | DENV2 NS1DQ448232 | DENV2 NS1FJ538920 | DENV2 NS2A |
| DENV2 NS1AY237289 | DENV2 NS1EF486507 | DENV2 NS1M58489 | FM210231 |
| DENV2 NS1FJ538924 | DENV2 NS1AY237292 | DENV2 NS1FJ538914 | DENV2 NS2A |
| DENV2 NS1X69191 | DENV2 NS1DQ448233 | DENV2 NS1FJ538907 | EU482740 |
| DENV2 NS1FJ538926 | DENV2 NS1FJ538915 | DENV2 NS1DQ448238 | DENV2 NS2A |
| DENV2 NS1AF046858 | DENV2 NS1U51929 | DENV2 NS1FJ538909 | FN429891 |
| DENV2 NS1FJ538918 | DENV2 NS1FJ538910 | DENV2 NS1FJ538919 | DENV2 NS2A |
| DENV2 NS1AY871815 | DENV2 NS1FJ538928 | DENV2 NS1DQ472144 | EF105388 |
| DENV2 NS1M58493 | DENV2 NS1FJ538923 | DENV2 NS1U89518 | DENV2 NS2A |
| DENV2 NS1U88237 | DENV2 NS1AY237288 | DENV2 NS1X17338 | FJ410259 |
| DENV2 NS1DQ448235 | DENV2 NS1DQ472146 | DENV2 NS1M58492 | DENV2 NS2A |
| DENV2 NS1AY237295 | DENV2 NS1X17340 | DENV2 NS1FJ538912 | FJ024461 |
| DENV2 NS1M58491 | DENV2 NS1M58490 | DENV2 NS1FJ538925 | DENV2 NS2A |
| DENV2 NS1FJ538922 | DENV2 NS1FJ538921 | DENV2 NS1X57469 | DQ181801 |
| DENV2 NS1AY422469 | DENV2 NS1M58488 | DENV2 NS1M58486 | DENV2 NS2A |
| DENV2 NS1FJ538916 | DENV2 NS1X17339 | DENV2 NS1DQ448237 | GQ868604 |
| DENV2 NS1EF486509 | DENV2 NS1FJ538908 | DENV2 NS1AX775702 | DENV2 NS2A |
| DENV2 NS1AY237293 | DENV2 NS1AY237294 | DENV2 NS1AY237290 | EU482676 |
| DENV2 NS1DQ472147 | DENV2 NS1DQ448236 | DENV2 NS1FJ538906 | DENV2 NS2A |
| DENV2 NS1U51928 | DENV2 NS1AX775700 | DENV2 NS1U51930 | EU482650 |
| DENV2 NS1EF486510 | DENV2 NS1FJ538905 | DENV2 NS1FJ538927 | DENV2 NS2A |
| DENV2 NS1FJ538920 | DENV2 NS1FJ538913 | DENV2 NS1X65241 | EU482724 |
| DENV2 NS1M58489 | DENV2 NS1AY237291 | DENV2 NS1EF486508 | DENV2 NS2A |
| DENV2 NS1FJ538914 | DENV2 NS1U89517 | DENV2 NS1AF457574 | GQ868516 |
| DENV2 NS1FJ538907 | DENV2 NS1DQ472142 | DENV2 NS1FJ538917 | DENV2 NS2A |
| DENV2 NS1DQ448238 | DENV2 NS1M58487 | DENV2 NS1DQ448234 | FJ898435 |
| DENV2 NS1FJ538909 | DENV2 NS1Z17213 | DENV2 NS1AX775704 | DENV2 NS2A |
| DENV2 NS1FJ538919 | DENV2 NS1FJ538911 | DENV2 NS1DQ448232 | FJ547064 |
| DENV2 NS1DQ472144 | DENV2 NS1AY237289 | DENV2 NS1EF486507 | DENV2 NS2A |
| DENV2 NS1U89518 | DENV2 NS1FJ538924 | DENV2 NS1AY237292 | EU677144 |

FIG. 67-48

| Virus Protein | Accession No. | Virus Protein | Accession No. | Virus Protein | Accession No. | Virus Protein | Accession No. |
|---|---|---|---|---|---|---|---|
| DENV2 NS2A | EU569716 | DENV2 NS2A | EU482446 | DENV2 NS2A | AF169687 | DENV2 NS2A | M20558 |
| DENV2 NS2A | EU482769 | DENV2 NS2A | EU482661 | DENV2 NS2A | FJ850072 | DENV2 NS2A | EU482663 |
| DENV2 NS2A | FJ744717 | DENV2 NS2A | M29095 | DENV2 NS2A | EU482445 | DENV2 NS2A | FM210245 |
| DENV2 NS2A | EU482752 | DENV2 NS2A | EU482585 | DENV2 NS2A | GQ199901 | DENV2 NS2A | DQ645543 |
| DENV2 NS2A | FJ906967 | DENV2 NS2A | EU482694 | DENV2 NS2A | EU482598 | DENV2 NS2A | GQ199895 |
| DENV2 NS2A | FJ410241 | DENV2 NS2A | FJ639711 | DENV2 NS2A | AF359579 | DENV2 NS2A | FM210207 |
| DENV2 NS2A | FJ639706 | DENV2 NS2A | GQ868591 | DENV2 NS2A | EU359009 | DENV2 NS2A | EU482604 |
| DENV2 NS2A | EU596500 | DENV2 NS2A | FJ744709 | DENV2 NS2A | GU131931 | DENV2 NS2A | FJ873808 |
| DENV2 NS2A | FJ410208 | DENV2 NS2A | FJ461305 | DENV2 NS2A | GQ199605 | DENV2 NS2A | FM210203 |
| DENV2 NS2A | FJ906957 | DENV2 NS2A | FJ850067 | DENV2 NS2A | FJ906961 | DENV2 NS2A | FM210236 |
| DENV2 NS2A | EU687213 | DENV2 NS2A | GQ199868 | DENV2 NS2A | EU482639 | DENV2 NS2A | EU482551 |
| DENV2 NS2A | EU569702 | DENV2 NS2A | EU660400 | DENV2 NS2A | GQ868551 | DENV2 NS2A | EU482736 |
| DENV2 NS2A | FM210239 | DENV2 NS2A | EU482777 | DENV2 NS2A | EU569713 | DENV2 NS2A | EU687225 |
| DENV2 NS2A | EU081180 | DENV2 NS2A | FJ898479 | DENV2 NS2A | EU482775 | DENV2 NS2A | EU596486 |
| DENV2 NS2A | DQ645556 | DENV2 NS2A | EU482465 | DENV2 NS2A | EU529700 | DENV2 NS2A | AF100459 |
| DENV2 NS2A | AF204177 | DENV2 NS2A | AF100463 | DENV2 NS2A | GQ868620 | DENV2 NS2A | EU687238 |
| DENV2 NS2A | EU482679 | DENV2 NS2A | FM210208 | DENV2 NS2A | GU131902 | DENV2 NS2A | EU482747 |
| DENV2 NS2A | EU482472 | DENV2 NS2A | FJ744703 | DENV2 NS2A | EU482703 | DENV2 NS2A | GU131928 |
| DENV2 NS2A | FJ898478 | DENV2 NS2A | EU482669 | DENV2 NS2A | EU482576 | DENV2 NS2A | FM210226 |
| DENV2 NS2A | AY858035 | DENV2 NS2A | EU529695 | DENV2 NS2A | EU482685 | DENV2 NS2A | DQ645546 |
| DENV2 NS2A | FJ882593 | DENV2 NS2A | FJ850062 | DENV2 NS2A | FM210214 | DENV2 NS2A | M84728 |
| DENV2 NS2A | FJ850051 | DENV2 NS2A | EU482642 | DENV2 NS2A | GU131947 | DENV2 NS2A | EU687228 |
| DENV2 NS2A | EU482763 | DENV2 NS2A | FJ744718 | DENV2 NS2A | FJ744724 | DENV2 NS2A | FM210230 |
| DENV2 NS2A | EU596490 | DENV2 NS2A | EF457904 | DENV2 NS2A | EU569707 | DENV2 NS2A | EF105387 |

FIG. 67-49

| Virus Protein Accession No. | Virus Protein Accession No. | Virus Protein Accession No. | Virus Protein Accession No. |
|---|---|---|---|
| DENV2 NS2A EU482648 | DENV2 NS2A EU482761 | DENV2 NS2A EU482730 | DENV2 NS2A DQ645552 |
| DENV2 NS2A EU482659 | DENV2 NS2A FJ639837 | DENV2 NS2A FJ744712 | DENV2 NS2A FJ410237 |
| DENV2 NS2A FJ639705 | DENV2 NS2A EU482638 | DENV2 NS2A EU482599 | DENV2 NS2A FJ850085 |
| DENV2 NS2A AJ487271 | DENV2 NS2A FJ906960 | DENV2 NS2A EU482577 | DENV2 NS2A FJ410224 |
| DENV2 NS2A EU660399 | DENV2 NS2A FM210217 | DENV2 NS2A EU482681 | DENV2 NS2A AF169686 |
| DENV2 NS2A FJ639832 | DENV2 NS2A AY702035 | DENV2 NS2A FJ390384 | DENV2 NS2A FJ850120 |
| DENV2 NS2A FJ906968 | DENV2 NS2A EF105382 | DENV2 NS2A FJ639831 | DENV2 NS2A FJ639707 |
| DENV2 NS2A EU569698 | DENV2 NS2A GQ868590 | DENV2 NS2A CS805344 | DENV2 NS2A FJ639822 |
| DENV2 NS2A AF100464 | DENV2 NS2A FJ744742 | DENV2 NS2A EU569708 | DENV2 NS2A GQ868625 |
| DENV2 NS2A EU596485 | DENV2 NS2A GQ199896 | DENV2 NS2A EU482583 | DENV2 NS2A EU854293 |
| DENV2 NS2A EU677145 | DENV2 NS2A GU131897 | DENV2 NS2A EU482762 | DENV2 NS2A GQ868552 |
| DENV2 NS2A FJ898477 | DENV2 NS2A FN429892 | DENV2 NS2A EU482444 | DENV2 NS2A EU482675 |
| DENV2 NS2A EU854294 | DENV2 NS2A EU482466 | DENV2 NS2A EU482662 | DENV2 NS2A EU482699 |
| DENV2 NS2A EU482561 | DENV2 NS2A EU482584 | DENV2 NS2A M14969 | DENV2 NS2A EU569715 |
| DENV2 NS2A DQ181803 | DENV2 NS2A EU482624 | DENV2 NS2A EU569696 | DENV2 NS2A EU660406 |
| DENV2 NS2A EU482786 | DENV2 NS2A FJ810410 | DENV2 NS2A AY702038 | DENV2 NS2A AY776328 |
| DENV2 NS2A GQ868515 | DENV2 NS2A EU482725 | DENV2 NS2A GU131959 | DENV2 NS2A GU370050 |
| DENV2 NS2A EU482473 | DENV2 NS2A FJ639697 | DENV2 NS2A EU482760 | DENV2 NS2A FJ850061 |
| DENV2 NS2A EU482622 | DENV2 NS2A FM210209 | DENV2 NS2A AB479041 | DENV2 NS2A EU660413 |
| DENV2 NS2A EU482693 | DENV2 NS2A AB122022 | DENV2 NS2A FJ467493 | DENV2 NS2A FJ205880 |
| DENV2 NS2A AY744148 | DENV2 NS2A EU482726 | DENV2 NS2A EU482629 | DENV2 NS2A FJ898467 |
| DENV2 NS2A EU482781 | DENV2 NS2A FJ024475 | DENV2 NS2A EU482593 | DENV2 NS2A EU687199 |
| DENV2 NS2A EU687249 | DENV2 NS2A FJ744704 | DENV2 NS2A GQ868543 | DENV2 NS2A EF051521 |
| DENV2 NS2A EF105389 | DENV2 NS2A EU569697 | DENV2 NS2A EU482776 | DENV2 NS2A DQ181804 |

FIG. 67-50

| Virus Protein Accession No. | Virus Protein Accession No. | Virus Protein Accession No. | Virus Protein Accession No. |
|---|---|---|---|
| DENV2 NS2A FJ744723 | DENV2 NS2A EU687248 | DENV2 NS2A EU482621 | DENV2 NS2A GQ252677 |
| DENV2 NS2A EU482686 | DENV2 NS2A DQ181798 | DENV2 NS2A EU482463 | DENV2 NS2A EU482640 |
| DENV2 NS2A EU482605 | DENV2 NS2A EU596491 | DENV2 NS2A EU482606 | DENV2 NS2A FJ906966 |
| DENV2 NS2A GQ868497 | DENV2 NS2A EU482582 | DENV2 NS2A DQ645548 | DENV2 NS2A GQ868592 |
| DENV2 NS2A GQ199900 | DENV2 NS2A EU482749 | DENV2 NS2A FM210204 | DENV2 NS2A FJ639704 |
| DENV2 NS2A FJ410221 | DENV2 NS2A EU482735 | DENV2 NS2A AF038403 | DENV2 NS2A EU687212 |
| DENV2 NS2A AF100469 | DENV2 NS2A FJ850112 | DENV2 NS2A DQ645553 | DENV2 NS2A GU289914 |
| DENV2 NS2A EU003591 | DENV2 NS2A EU482779 | DENV2 NS2A GQ868554 | DENV2 NS2A AF100462 |
| DENV2 NS2A FJ898461 | DENV2 NS2A GQ868623 | DENV2 NS2A AB189122 | DENV2 NS2A EU726775 |
| DENV2 NS2A FJ850064 | DENV2 NS2A AF169680 | DENV2 NS2A FJ687443 | DENV2 NS2A EU677146 |
| DENV2 NS2A EU482547 | DENV2 NS2A EU660398 | DENV2 NS2A DQ448231 | DENV2 NS2A AF022436 |
| DENV2 NS2A EU569699 | DENV2 NS2A EU569719 | DENV2 NS2A FJ810418 | DENV2 NS2A FJ744706 |
| DENV2 NS2A EU482550 | DENV2 NS2A U87411 | DENV2 NS2A GU131896 | DENV2 NS2A EU596496 |
| DENV2 NS2A FM210244 | DENV2 NS2A GQ199897 | DENV2 NS2A EU482765 | DENV2 NS2A EU482680 |
| DENV2 NS2A EU482719 | DENV2 NS2A EU482677 | DENV2 NS2A EU596498 | DENV2 NS2A EU482464 |
| DENV2 NS2A EU482720 | DENV2 NS2A FM210213 | DENV2 NS2A CS479167 | DENV2 NS2A AF489932 |
| DENV2 NS2A EU482448 | DENV2 NS2A EU482647 | DENV2 NS2A FJ744710 | DENV2 NS2A EU482560 |
| DENV2 NS2A EU179858 | DENV2 NS2A GQ868545 | DENV2 NS2A FJ182012 | DENV2 NS2A EU482723 |
| DENV2 NS2A EU687227 | DENV2 NS2A AF169681 | DENV2 NS2A AY702040 | DENV2 NS2A EU482741 |
| DENV2 NS2A EU687237 | DENV2 NS2A EU482548 | DENV2 NS2A EF105381 | DENV2 NS2A GU131864 |
| DENV2 NS2A EU660417 | DENV2 NS2A FJ898439 | DENV2 NS2A FJ410195 | DENV2 NS2A EU482549 |
| DENV2 NS2A AB122021 | DENV2 NS2A EU482637 | DENV2 NS2A AF204178 | DENV2 NS2A EU482755 |
| DENV2 NS2A FJ850082 | DENV2 NS2A EU781135 | DENV2 NS2A FJ898466 | DENV2 NS2A FJ390389 |
| DENV2 NS2A EU482767 | DENV2 NS2A EU687243 | DENV2 NS2A FJ226066 | DENV2 NS2A EU482573 |

FIG. 67-51

| Virus Protein Accession No. | Virus Protein Accession No. | Virus Protein Accession No. | Virus Protein Accession No. |
|---|---|---|---|
| DENV2 NS2A FN429893 | DENV2 NS2A EU660416 | DENV2 NS2A FJ898465 | DENV2 NS2A EU482652 |
| DENV2 NS2A AF022434 | DENV2 NS2A DQ181799 | DENV2 NS2A FJ639834 | DENV2 NS2A FJ432726 |
| DENV2 NS2A EU687240 | DENV2 NS2A DQ645547 | DENV2 NS2A FJ810412 | DENV2 NS2A FJ639699 |
| DENV2 NS2A DQ645545 | DENV2 NS2A GQ199898 | DENV2 NS2A GU131899 | DENV2 NS2A EU482688 |
| DENV2 NS2A FJ906959 | DENV2 NS2A GM059692 | DENV2 NS2A GQ868553 | DENV2 NS2A FJ562098 |
| DENV2 NS2A EU621672 | DENV2 NS2A FJ024458 | DENV2 NS2A FJ850115 | DENV2 NS2A FJ182014 |
| DENV2 NS2A EU529693 | DENV2 NS2A FJ898436 | DENV2 NS2A EU482627 | DENV2 NS2A FJ913016 |
| DENV2 NS2A GQ868599 | DENV2 NS2A EU569694 | DENV2 NS2A EU482620 | DENV2 NS2A FJ410202 |
| DENV2 NS2A EU596499 | DENV2 NS2A FJ687436 | DENV2 NS2A FJ744721 | DENV2 NS2A GQ868646 |
| DENV2 NS2A AF022440 | DENV2 NS2A FM210216 | DENV2 NS2A EU687220 | DENV2 NS2A EU482575 |
| DENV2 NS2A EU482687 | DENV2 NS2A FB667404 | DENV2 NS2A EU687236 | DENV2 NS2A FM210246 |
| DENV2 NS2A GU131884 | DENV2 NS2A FJ850063 | DENV2 NS2A EF105384 | DENV2 NS2A EU482746 |
| DENV2 NS2A EU677138 | DENV2 NS2A EU482541 | DENV2 NS2A FJ639703 | DENV2 NS2A FJ898449 |
| DENV2 NS2A EU482757 | DENV2 NS2A DQ645554 | DENV2 NS2A FJ687442 | DENV2 NS2A EU482471 |
| DENV2 NS2A EU482783 | DENV2 NS2A EU482657 | DENV2 NS2A EU569705 | DENV2 NS2A FJ744705 |
| DENV2 NS2A EU596484 | DENV2 NS2A EU482768 | DENV2 NS2A EU482780 | DENV2 NS2A EU482572 |
| DENV2 NS2A EU569718 | DENV2 NS2A AF038402 | DENV2 NS2A EU687231 | DENV2 NS2A EU482646 |
| DENV2 NS2A EU482574 | DENV2 NS2A FM210224 | DENV2 NS2A AB189123 | DENV2 NS2A FJ687444 |
| DENV2 NS2A EU482764 | DENV2 NS2A FJ850117 | DENV2 NS2A GQ199866 | DENV2 NS2A GU131885 |
| DENV2 NS2A FJ639709 | DENV2 NS2A EU482678 | DENV2 NS2A FJ850074 | DENV2 NS2A GQ868550 |
| DENV2 NS2A FJ478455 | DENV2 NS2A EU482698 | DENV2 NS2A FM210233 | DENV2 NS2A GU131901 |
| DENV2 NS2A AF169688 | DENV2 NS2A FM210202 | DENV2 NS2A EU081178 | DENV2 NS2A FJ410219 |
| DENV2 NS2A FJ024473 | DENV2 NS2A EU482778 | DENV2 NS2A FJ410215 | DENV2 NS2A EU482660 |
| DENV2 NS2A EU179857 | DENV2 NS2A EU482594 | DENV2 NS2A DQ645555 | DENV2 NS2A AF022435 |

FIG. 67-52

| Virus Protein Accession No. | Virus Protein Accession No. | Virus Protein Accession No. | Virus Protein Accession No. |
|---|---|---|---|
| DENV2 NS2A EU569717 | DENV2 NS2A GQ868638 | DENV2 NS2A GQ199892 | DENV2 NS2A EU687214 |
| DENV2 NS2A FJ850116 | DENV2 NS2A EU482625 | DENV2 NS2A M84727 | DENV2 NS2A EU482697 |
| DENV2 NS2A FM210218 | DENV2 NS2A GU131843 | DENV2 NS2A EU677148 | DENV2 NS2A CS479202 |
| DENV2 NS2A FJ744743 | DENV2 NS2A EU482580 | DENV2 NS2A FJ882602 | DENV2 NS2A DQ181805 |
| DENV2 NS2A EU482788 | DENV2 NS2A EU482670 | DENV2 NS2A EU482645 | DENV2 NS2A EF105378 |
| DENV2 NS2A EU482754 | DENV2 NS2A EU482469 | DENV2 NS2A EU482666 | DENV2 NS2A AF022438 |
| DENV2 NS2A FJ906956 | DENV2 NS2A FJ687437 | DENV2 NS2A GQ868558 | DENV2 NS2A FJ639702 |
| DENV2 NS2A EU482756 | DENV2 NS2A NC_001474 | DENV2 NS2A DQ645550 | DENV2 NS2A EU482729 |
| DENV2 NS2A EU482607 | DENV2 NS2A EU482772 | DENV2 NS2A EU482634 | DENV2 NS2A EU569710 |
| DENV2 NS2A EU726776 | DENV2 NS2A FM210225 | DENV2 NS2A FJ639733 | DENV2 NS2A FJ547090 |
| DENV2 NS2A DQ181806 | DENV2 NS2A EU596497 | DENV2 NS2A FJ410223 | DENV2 NS2A GU131974 |
| DENV2 NS2A FB730117 | DENV2 NS2A AF100461 | DENV2 NS2A FM210215 | DENV2 NS2A FJ639833 |
| DENV2 NS2A EU482737 | DENV2 NS2A EU482704 | DENV2 NS2A GQ868542 | DENV2 NS2A FJ410228 |
| DENV2 NS2A AB122020 | DENV2 NS2A GQ868598 | DENV2 NS2A EU569706 | DENV2 NS2A EU482689 |
| DENV2 NS2A EU687230 | DENV2 NS2A EU482668 | DENV2 NS2A FM210210 | DENV2 NS2A FJ882594 |
| DENV2 NS2A EU482636 | DENV2 NS2A EU529701 | DENV2 NS2A FJ744708 | DENV2 NS2A FM210242 |
| DENV2 NS2A EU482557 | DENV2 NS2A EU569692 | DENV2 NS2A FJ024454 | DENV2 NS2A FJ744716 |
| DENV2 NS2A EU482581 | DENV2 NS2A CS477302 | DENV2 NS2A FJ810409 | DENV2 NS2A EU482546 |
| DENV2 NS2A EU482701 | DENV2 NS2A AF169683 | DENV2 NS2A EU569695 | DENV2 NS2A FJ410233 |
| DENV2 NS2A EU482600 | DENV2 NS2A FM210232 | DENV2 NS2A GQ868631 | DENV2 NS2A GQ868600 |
| DENV2 NS2A FJ024452 | DENV2 NS2A FJ898454 | DENV2 NS2A EF105383 | DENV2 NS2A FM210228 |
| DENV2 NS2A GU131927 | DENV2 NS2A EU596483 | DENV2 NS2A EU482628 | DENV2 NS2A GU131898 |
| DENV2 NS2A EU569700 | DENV2 NS2A FJ639700 | DENV2 NS2A GU131882 | DENV2 NS2A FJ390387 |
| DENV2 NS2A FJ850076 | DENV2 NS2A EU482451 | DENV2 NS2A FJ850108 | DENV2 NS2A AY858036 |

FIG. 67-53

| Virus Protein Accession No. | Virus Protein Accession No. | Virus Protein Accession No. | Virus Protein Accession No. |
|---|---|---|---|
| DENV2 NS2A EU482608 | DENV2 NS2A AF169678 | DENV2 NS2A FJ850119 | DENV2 NS2A AF022437 |
| DENV2 NS2A EU687244 | DENV2 NS2A AB189124 | DENV2 NS2A AF169682 | DENV2 NS2A FJ898432 |
| DENV2 NS2A EU482447 | DENV2 NS2A EU482771 | DENV2 NS2A EU596489 | DENV2 NS2A EU482700 |
| DENV2 NS2A FJ850066 | DENV2 NS2A AF276619 | DENV2 NS2A EU482470 | DENV2 NS2A DQ181800 |
| DENV2 NS2A FJ410291 | DENV2 NS2A EU482766 | DENV2 NS2A DQ181797 | DENV2 NS2A EU687241 |
| DENV2 NS2A GQ199899 | DENV2 NS2A DQ645549 | DENV2 NS2A FJ687446 | DENV2 NS2A EU482782 |
| DENV2 NS2A EU482630 | DENV2 NS2A AF100468 | DENV2 NS2A EU687222 | DENV2 NS2A FJ410200 |
| DENV2 NS2A FJ687445 | DENV2 NS2A EU687242 | DENV2 NS2A FJ205885 | DENV2 NS2A GU131955 |
| DENV2 NS2A EU482556 | DENV2 NS2A EU482635 | DENV2 NS2A AB479042 | DENV2 NS2A FJ205878 |
| DENV2 NS2A FJ744744 | DENV2 NS2A EU687245 | DENV2 NS2A FJ898453 | DENV2 NS2A FJ873811 |
| DENV2 NS2A FJ639788 | DENV2 NS2A EU482722 | DENV2 NS2A FJ639829 | DENV2 NS2A FJ906958 |
| DENV2 NS2A FN429895 | DENV2 NS2A GU131883 | DENV2 NS2A FJ898460 | DENV2 NS2A FJ744722 |
| DENV2 NS2A GQ199890 | DENV2 NS2A AY702039 | DENV2 NS2A EU482721 | DENV2 NS2A EU482758 |
| DENV2 NS2A EU482651 | DENV2 NS2A AY744150 | DENV2 NS2A EU482748 | DENV2 NS2A EU482770 |
| DENV2 NS2A FJ850060 | DENV2 NS2A FJ744707 | DENV2 NS2A FJ898438 | DENV2 NS2A AY744149 |
| DENV2 NS2A EU482658 | DENV2 NS2A FM210235 | DENV2 NS2A GU131924 | DENV2 NS2A EU482655 |
| DENV2 NS2A EU687235 | DENV2 NS2A EU482734 | DENV2 NS2A EU569712 | DENV2 NS2A GQ868624 |
| DENV2 NS2A FJ850091 | DENV2 NS2A EU482588 | DENV2 NS2A GQ868640 | DENV2 NS2A FJ744715 |
| DENV2 NS2A EU660404 | DENV2 NS2A EU677149 | DENV2 NS2A EU687250 | DENV2 NS2A EU677137 |
| DENV2 NS2A FJ639698 | DENV2 NS2A FJ639734 | DENV2 NS2A FJ432724 | DENV2 NS2A FJ639783 |
| DENV2 NS2A EU482690 | DENV2 NS2A EU726770 | DENV2 NS2A FJ639710 | DENV2 NS2A EU482744 |
| DENV2 NS2A EU569720 | DENV2 NS2A X57469 | DENV2 NS2A AF119661 | DENV2 NS2A EU081177 |
| DENV2 NS2A FJ850050 | DENV2 NS2A GQ868540 | DENV2 NS2A EU482545 | DENV2 NS2A FM210222 |
| DENV2 NS2A FJ687441 | DENV2 NS2A GQ868555 | DENV2 NS2A EU687215 | DENV2 NS2A FJ639701 |

FIG. 67-54

| Virus Protein Accession No. | Virus Protein Accession No. | Virus Protein Accession No. | Virus Protein Accession No. |
|---|---|---|---|
| DENV2 NS2A EU569703 | DENV2 NS2A FJ898451 | DENV2 NS2A GU369819 | DENV2 NS2A EU482691 |
| DENV2 NS2A EU482667 | DENV2 NS2A EU081179 | DENV2 NS2A GQ868541 | DENV2 NS2A FJ687439 |
| DENV2 NS2A DQ645540 | DENV2 NS2A EU529694 | DENV2 NS2A FJ461314 | DENV2 NS2A AF208496 |
| DENV2 NS2A EU660415 | DENV2 NS2A EU660405 | DENV2 NS2A GQ868595 | DENV2 NS2A GQ199874 |
| DENV2 NS2A EU482631 | DENV2 NS2A FJ639708 | DENV2 NS2A EU569711 | DENV2 NS2A EU687217 |
| DENV2 NS2A FJ410288 | DENV2 NS2A FJ859028 | DENV2 NS2A GU131932 | DENV2 NS2A FJ850106 |
| DENV2 NS2A GU131930 | DENV2 NS2A GQ252676 | DENV2 NS2A EU056810 | DENV2 NS2A EU569693 |
| DENV2 NS2A AY037116 | DENV2 NS2A EU687229 | DENV2 NS2A EU482553 | DENV2 NS2A EU482623 |
| DENV2 NS2A GQ868549 | DENV2 NS2A FJ850065 | DENV2 NS2A AF022441 | DENV2 NS2A EU482731 |
| DENV2 NS2A EU482751 | DENV2 NS2A EU482739 | DENV2 NS2A FJ639717 | DENV2 NS2A GU131879 |
| DENV2 NS2A FJ687435 | DENV2 NS2A EU482589 | DENV2 NS2A CS477304 | DENV2 NS2A EU529706 |
| DENV2 NS2A EU482562 | DENV2 NS2A EU482641 | DENV2 NS2A FJ687447 | DENV2 NS2A EU482656 |
| DENV2 NS2A FJ850107 | DENV2 NS2A FJ390385 | DENV2 NS2A EU056812 | DENV2 NS2A FM210223 |
| DENV2 NS2A FJ898450 | DENV2 NS2A EU482784 | DENV2 NS2A EU482664 | DENV2 NS2A GQ199893 |
| DENV2 NS2A EU482570 | DENV2 NS2A EU569709 | DENV2 NS2A EU482568 | DENV2 NS2A EU482543 |
| DENV2 NS2A FJ639836 | DENV2 NS2A EU482727 | DENV2 NS2A EU482774 | DENV2 NS2A EU482578 |
| DENV2 NS2A AY702034 | DENV2 NS2A EU687223 | DENV2 NS2A FJ850118 | DENV2 NS2A EU482732 |
| DENV2 NS2A EU482696 | DENV2 NS2A FM210212 | DENV2 NS2A FM210240 | DENV2 NS2A FJ744711 |
| DENV2 NS2A FN429894 | DENV2 NS2A GQ868588 | DENV2 NS2A EU482474 | DENV2 NS2A EU482759 |
| DENV2 NS2A FJ687438 | DENV2 NS2A EU569721 | DENV2 NS2A FJ547067 | DENV2 NS2A EU482544 |
| DENV2 NS2A EU482702 | DENV2 NS2A EU482654 | DENV2 NS2A EU687216 | DENV2 NS2A EU482643 |
| DENV2 NS2A EU482743 | DENV2 NS2A EF105386 | DENV2 NS2A EU482590 | DENV2 NS2A EU569704 |
| DENV2 NS2A EU596488 | DENV2 NS2A EU482467 | DENV2 NS2A EU482672 | DENV2 NS2A DQ645542 |
| DENV2 NS2A FM210220 | DENV2 NS2A FJ410217 | DENV2 NS2A FJ639828 | DENV2 NS2A EU482695 |

FIG. 67-55

| Virus Protein Accession No. | Virus Protein Accession No. | Virus Protein Accession No. | Virus Protein Accession No. |
|---|---|---|---|
| DENV2 NS2A AF169685 | DENV2 NS2A GQ868544 | DENV2 NS2A EU482586 | DENV2 NS2A GQ868597 |
| DENV2 NS2A GU370051 | DENV2 NS2A EU482683 | DENV2 NS2A EU482684 | DENV2 NS2A GQ199869 |
| DENV2 NS2A EU677147 | DENV2 NS2A EU482569 | DENV2 NS2A EU482665 | DENV2 NS2A GU131929 |
| DENV2 NS2A FJ744745 | DENV2 NS2A FJ744714 | DENV2 NS2A FJ898452 | DENV2 NS2A GQ868603 |
| DENV2 NS2A EU482587 | DENV2 NS2A EU179859 | DENV2 NS2A FM210219 | DENV2 NS2A EU482449 |
| DENV2 NS2A FM210205 | DENV2 NS2A EU482674 | DENV2 NS2A EF105385 | DENV2 NS2A FJ639732 |
| DENV2 NS2A GQ868622 | DENV2 NS2A FJ478459 | DENV2 NS2A EU569714 | DENV2 NS2A EU482773 |
| DENV2 NS2A FJ390391 | DENV2 NS2A DQ645541 | DENV2 NS2A GQ868589 | DENV2 NS2A EU569701 |
| DENV2 NS2A DQ645551 | DENV2 NS2A AF100465 | DENV2 NS2A FJ850078 | DENV2 NS2A EU482738 |
| DENV2 NS2A EU660414 | DENV2 NS2A FJ850121 | DENV2 NS2A FM210243 | DENV2 NS2A EU482468 |
| DENV2 NS2A FJ850054 | DENV2 NS2A EU687246 | DENV2 NS2A EU482671 | DENV2 NS2A EU677143 |
| DENV2 NS2A FJ461309 | DENV2 NS2A EU482750 | DENV2 NS2A EU482571 | DENV2 NS2A EU482682 |
| DENV2 NS2A EU482565 | DENV2 NS2A FJ205879 | DENV2 NS2A DQ645544 | DENV2 NS2A EU482633 |
| DENV2 NS2A EU482745 | DENV2 NS2A FJ687434 | DENV2 NS2A FM210238 | DENV2 NS2A GU131886 |
| DENV2 NS2A FJ373300 | DENV2 NS2A GU131900 | DENV2 NS2A EF105379 | DENV2 NS2A GQ868641 |
| DENV2 NS2A EU482601 | DENV2 NS2A FM210211 | DENV2 NS2A GQ868596 | DENV2 NS2A EU482785 |
| DENV2 NS2A AY702037 | DENV2 NS2A EU482742 | DENV2 NS2A EU482728 | DENV2 NS2A EU677141 |
| DENV2 NS2A FJ639830 | DENV2 NS2A EU482450 | DENV2 NS2A FJ744719 | DENV2 NS2A FJ410193 |
| DENV2 NS2A DL138662 | DENV2 NS2A EU482705 | DENV2 NS2A FM210229 | DENV2 NS2A EU482552 |
| DENV2 NS2A AF169684 | DENV2 NS2A FJ850053 | DENV2 NS2A GU131880 | DENV2 NS2A GQ868557 |
| DENV2 NS2A FM210234 | DENV2 NS2A EU056811 | DENV2 NS2A FJ744713 | DENV2 NS2A AJ968413 |
| DENV2 NS2A EU482787 | DENV2 NS2A EF105390 | DENV2 NS2A M19197 | DENV2 NS2A EU677142 |
| DENV2 NS2A EU482632 | DENV2 NS2A EU596487 | DENV2 NS2A EU482475 | DENV2 NS2A FJ639835 |
| DENV2 NS2A FJ373299 | DENV2 NS2A EU482626 | DENV2 NS2A FJ461311 | DENV2 NS2A EU482579 |

FIG. 67-56

| Virus Protein | Accession No. | Virus Protein | Accession No. | Virus Protein | Accession No. | Virus Protein | Accession No. |
|---|---|---|---|---|---|---|---|
| DENV2 NS2A | FM210241 | DENV2 NS2A | EU482597 | DENV2 NS2A | X57469 | DENV2 NS2B | FJ410241 |
| DENV2 NS2A | EU687232 | DENV2 NS2A | FJ906969 | DENV2 NS2A | X57469 | DENV2 NS2B | FJ639706 |
| DENV2 NS2A | FJ744725 | DENV2 NS2A | AF169679 | DENV2 NS2A | X57469 | DENV2 NS2B | EU596500 |
| DENV2 NS2A | GU131881 | DENV2 NS2A | FJ461321 | DENV2 NS2A | X57469 | DENV2 NS2B | FJ410208 |
| DENV2 NS2A | GQ868621 | DENV2 NS2A | DQ181802 | DENV2 NS2A | X57469 | DENV2 NS2B | FJ906957 |
| DENV2 NS2A | EU482653 | DENV2 NS2A | FJ639718 | DENV2 NS2A | X57469 | DENV2 NS2B | EU569702 |
| DENV2 NS2A | GQ868556 | DENV2 NS2A | FJ810411 | DENV2 NS2B | CS479165 | DENV2 NS2B | FJ898478 |
| DENV2 NS2A | FJ024477 | DENV2 NS2A | EU687224 | DENV2 NS2B | FJ205877 | DENV2 NS2B | FJ882593 |
| DENV2 NS2A | U87412 | DENV2 NS2A | FJ687440 | DENV2 NS2B | EU726767 | DENV2 NS2B | EU482763 |
| DENV2 NS2A | EU482692 | DENV2 NS2A | EU482554 | DENV2 NS2B | EU482649 | DENV2 NS2B | EU482661 |
| DENV2 NS2A | FM210206 | DENV2 NS2A | EF105380 | DENV2 NS2B | FM210221 | DENV2 NS2B | M29095 |
| DENV2 NS2A | FJ744741 | DENV2 NS2A | FM210237 | DENV2 NS2B | EU482740 | DENV2 NS2B | EU482585 |
| DENV2 NS2A | EU482644 | DENV2 NS2A | AF100467 | DENV2 NS2B | EF105388 | DENV2 NS2B | FJ639711 |
| DENV2 NS2A | GU131975 | DENV2 NS2A | EU482753 | DENV2 NS2B | FJ410259 | DENV2 NS2B | FJ850067 |
| DENV2 NS2A | FB667399 | DENV2 NS2A | AF022439 | DENV2 NS2B | FJ024461 | DENV2 NS2B | EU482777 |
| DENV2 NS2A | AF100466 | DENV2 NS2A | AF100460 | DENV2 NS2B | DQ181801 | DENV2 NS2B | FJ898479 |
| DENV2 NS2A | FJ024474 | DENV2 NS2A | EU596495 | DENV2 NS2B | EU482650 | DENV2 NS2B | AF100463 |
| DENV2 NS2A | EU482673 | DENV2 NS2A | FJ373301 | DENV2 NS2B | EU482724 | DENV2 NS2B | FJ744703 |
| DENV2 NS2A | FJ390390 | DENV2 NS2A | EU482603 | DENV2 NS2B | FJ898435 | DENV2 NS2B | EU482642 |
| DENV2 NS2A | EU482602 | DENV2 NS2A | FJ906962 | DENV2 NS2B | FJ547064 | DENV2 NS2B | FJ744718 |
| DENV2 NS2A | FJ744720 | DENV2 NS2A | EU482733 | DENV2 NS2B | EU677144 | DENV2 NS2B | EF457904 |
| DENV2 NS2A | GQ199894 | DENV2 NS2A | FJ850105 | DENV2 NS2B | EU569716 | DENV2 NS2B | AF169687 |
| DENV2 NS2A | FJ898434 | DENV2 NS2A | FJ850088 | DENV2 NS2B | EU482752 | DENV2 NS2B | FJ850072 |
| DENV2 NS2A | FJ639809 | DENV2 NS2A | M14969 | DENV2 NS2B | FJ906967 | DENV2 NS2B | EU482445 |

FIG. 67-57

| Virus Protein Accession No. | Virus Protein Accession No. | Virus Protein Accession No. | Virus Protein Accession No. |
|---|---|---|---|
| DENV2 NS2B EU482598 | DENV2 NS2B M84728 | DENV2 NS2B FM210209 | DENV2 NS2B EU482686 |
| DENV2 NS2B AF359579 | DENV2 NS2B FM210230 | DENV2 NS2B AB122022 | DENV2 NS2B EU482605 |
| DENV2 NS2B GQ199605 | DENV2 NS2B EU482659 | DENV2 NS2B EU569697 | DENV2 NS2B GQ199900 |
| DENV2 NS2B EU482639 | DENV2 NS2B AJ487271 | DENV2 NS2B EU482730 | DENV2 NS2B FJ410221 |
| DENV2 NS2B GQ868551 | DENV2 NS2B EU660399 | DENV2 NS2B EU482577 | DENV2 NS2B AF100469 |
| DENV2 NS2B EU569713 | DENV2 NS2B FJ639832 | DENV2 NS2B FJ390384 | DENV2 NS2B FJ898461 |
| DENV2 NS2B EU482775 | DENV2 NS2B EU569698 | DENV2 NS2B CS805344 | DENV2 NS2B EU482550 |
| DENV2 NS2B GQ868620 | DENV2 NS2B EU854294 | DENV2 NS2B AY702038 | DENV2 NS2B FM210244 |
| DENV2 NS2B GU131902 | DENV2 NS2B EU482561 | DENV2 NS2B FJ467493 | DENV2 NS2B EU179858 |
| DENV2 NS2B GU131947 | DENV2 NS2B GQ868515 | DENV2 NS2B EU482629 | DENV2 NS2B EU687227 |
| DENV2 NS2B EU569707 | DENV2 NS2B EU482473 | DENV2 NS2B EU482593 | DENV2 NS2B EU660417 |
| DENV2 NS2B M20558 | DENV2 NS2B EU482622 | DENV2 NS2B FJ850085 | DENV2 NS2B FJ850082 |
| DENV2 NS2B EU482663 | DENV2 NS2B EU482693 | DENV2 NS2B FJ410224 | DENV2 NS2B EU596491 |
| DENV2 NS2B DQ645543 | DENV2 NS2B AY744148 | DENV2 NS2B GQ868625 | DENV2 NS2B EU482582 |
| DENV2 NS2B FM210207 | DENV2 NS2B EU687249 | DENV2 NS2B EU854293 | DENV2 NS2B EU482749 |
| DENV2 NS2B FJ873808 | DENV2 NS2B EU482761 | DENV2 NS2B EU482675 | DENV2 NS2B EU482779 |
| DENV2 NS2B FM210203 | DENV2 NS2B FJ639837 | DENV2 NS2B AY776328 | DENV2 NS2B GQ868623 |
| DENV2 NS2B EU687225 | DENV2 NS2B FJ906960 | DENV2 NS2B GU370050 | DENV2 NS2B AF169680 |
| DENV2 NS2B EU596486 | DENV2 NS2B AY702035 | DENV2 NS2B FJ850061 | DENV2 NS2B U87411 |
| DENV2 NS2B AF100459 | DENV2 NS2B GQ868590 | DENV2 NS2B EU660413 | DENV2 NS2B FM210213 |
| DENV2 NS2B EU687238 | DENV2 NS2B GQ199896 | DENV2 NS2B FJ205880 | DENV2 NS2B EU482647 |
| DENV2 NS2B EU482747 | DENV2 NS2B FN429892 | DENV2 NS2B EU687199 | DENV2 NS2B AF169681 |
| DENV2 NS2B GU131928 | DENV2 NS2B EU482466 | DENV2 NS2B DQ181804 | DENV2 NS2B EU482548 |
| DENV2 NS2B FM210226 | DENV2 NS2B FJ639697 | DENV2 NS2B FJ744723 | DENV2 NS2B FJ898439 |

FIG. 67-58

| Virus Protein Accession No. | Virus Protein Accession No. | Virus Protein Accession No. | Virus Protein Accession No. |
|---|---|---|---|
| DENV2 NS2B EU482637 | DENV2 NS2B AF489932 | DENV2 NS2B AF038402 | DENV2 NS2B EU482652 |
| DENV2 NS2B EU781135 | DENV2 NS2B GU131864 | DENV2 NS2B FJ850117 | DENV2 NS2B FJ432726 |
| DENV2 NS2B DQ645548 | DENV2 NS2B FJ390389 | DENV2 NS2B EU482678 | DENV2 NS2B EU482688 |
| DENV2 NS2B AB189122 | DENV2 NS2B EU687240 | DENV2 NS2B EU482698 | DENV2 NS2B FJ410202 |
| DENV2 NS2B FJ810418 | DENV2 NS2B DQ645545 | DENV2 NS2B FM210202 | DENV2 NS2B GQ868646 |
| DENV2 NS2B GU131896 | DENV2 NS2B FJ906959 | DENV2 NS2B EU482594 | DENV2 NS2B EU482575 |
| DENV2 NS2B EU482765 | DENV2 NS2B EU621672 | DENV2 NS2B FJ898465 | DENV2 NS2B FM210246 |
| DENV2 NS2B EU596498 | DENV2 NS2B GQ868599 | DENV2 NS2B FJ639834 | DENV2 NS2B FJ898449 |
| DENV2 NS2B CS479167 | DENV2 NS2B EU677138 | DENV2 NS2B GQ868553 | DENV2 NS2B EU482471 |
| DENV2 NS2B FJ182012 | DENV2 NS2B EU482783 | DENV2 NS2B FJ850115 | DENV2 NS2B FJ744705 |
| DENV2 NS2B EF105381 | DENV2 NS2B EU596484 | DENV2 NS2B EU482627 | DENV2 NS2B EU482572 |
| DENV2 NS2B FJ410195 | DENV2 NS2B EU569718 | DENV2 NS2B EU482620 | DENV2 NS2B GU131885 |
| DENV2 NS2B AF204178 | DENV2 NS2B FJ639709 | DENV2 NS2B FJ744721 | DENV2 NS2B FJ850116 |
| DENV2 NS2B FJ226066 | DENV2 NS2B AF169688 | DENV2 NS2B EU687220 | DENV2 NS2B FM210218 |
| DENV2 NS2B EU482640 | DENV2 NS2B DQ181799 | DENV2 NS2B EU687236 | DENV2 NS2B EU482754 |
| DENV2 NS2B GQ868592 | DENV2 NS2B GQ199898 | DENV2 NS2B FJ687442 | DENV2 NS2B EU482756 |
| DENV2 NS2B FJ639704 | DENV2 NS2B FJ024458 | DENV2 NS2B EU569705 | DENV2 NS2B DQ181806 |
| DENV2 NS2B EU687212 | DENV2 NS2B FJ687436 | DENV2 NS2B EU482780 | DENV2 NS2B FB730117 |
| DENV2 NS2B AF100462 | DENV2 NS2B FB667404 | DENV2 NS2B EU687231 | DENV2 NS2B EU482737 |
| DENV2 NS2B EU726775 | DENV2 NS2B FJ850063 | DENV2 NS2B GQ199866 | DENV2 NS2B AB122020 |
| DENV2 NS2B EU677146 | DENV2 NS2B EU482541 | DENV2 NS2B FJ850074 | DENV2 NS2B EU482636 |
| DENV2 NS2B AF022436 | DENV2 NS2B DQ645554 | DENV2 NS2B EU081178 | DENV2 NS2B EU482557 |
| DENV2 NS2B EU482680 | DENV2 NS2B EU482657 | DENV2 NS2B FJ410215 | DENV2 NS2B EU482701 |
| DENV2 NS2B EU482464 | DENV2 NS2B EU482768 | DENV2 NS2B DQ645555 | DENV2 NS2B FJ024452 |

FIG. 67-59

| Virus Protein Accession No. | Virus Protein Accession No. | Virus Protein Accession No. | Virus Protein Accession No. |
|---|---|---|---|
| DENV2 NS2B EU569700 | DENV2 NS2B FJ810409 | DENV2 NS2B FJ687445 | DENV2 NS2B FJ205885 |
| DENV2 NS2B EU482580 | DENV2 NS2B EU569695 | DENV2 NS2B GQ199890 | DENV2 NS2B AB479042 |
| DENV2 NS2B EU482670 | DENV2 NS2B EF105383 | DENV2 NS2B EU482651 | DENV2 NS2B EU482748 |
| DENV2 NS2B FJ687437 | DENV2 NS2B GU131882 | DENV2 NS2B EU482658 | DENV2 NS2B GU131924 |
| DENV2 NS2B NC_001474 | DENV2 NS2B EU482697 | DENV2 NS2B EU687235 | DENV2 NS2B GQ868640 |
| DENV2 NS2B EU596497 | DENV2 NS2B CS479202 | DENV2 NS2B FJ850091 | DENV2 NS2B FJ639710 |
| DENV2 NS2B EU482704 | DENV2 NS2B DQ181805 | DENV2 NS2B FJ639698 | DENV2 NS2B AF119661 |
| DENV2 NS2B EU569692 | DENV2 NS2B EF105378 | DENV2 NS2B FJ850050 | DENV2 NS2B EU482545 |
| DENV2 NS2B CS477302 | DENV2 NS2B AF022438 | DENV2 NS2B AB189124 | DENV2 NS2B EU687215 |
| DENV2 NS2B AF169683 | DENV2 NS2B FJ639702 | DENV2 NS2B EU482771 | DENV2 NS2B FJ898432 |
| DENV2 NS2B FM210232 | DENV2 NS2B EU482729 | DENV2 NS2B AF276619 | DENV2 NS2B EU482700 |
| DENV2 NS2B FJ898454 | DENV2 NS2B EU569710 | DENV2 NS2B EU482766 | DENV2 NS2B EU482782 |
| DENV2 NS2B EU596483 | DENV2 NS2B FJ547090 | DENV2 NS2B DQ645549 | DENV2 NS2B FJ873811 |
| DENV2 NS2B FJ639700 | DENV2 NS2B GU131974 | DENV2 NS2B EU687242 | DENV2 NS2B EU482758 |
| DENV2 NS2B GQ199892 | DENV2 NS2B FJ639833 | DENV2 NS2B EU482635 | DENV2 NS2B GQ868624 |
| DENV2 NS2B M84727 | DENV2 NS2B FJ410228 | DENV2 NS2B EU687245 | DENV2 NS2B FJ744715 |
| DENV2 NS2B EU677148 | DENV2 NS2B FM210242 | DENV2 NS2B AY702039 | DENV2 NS2B FJ639783 |
| DENV2 NS2B EU482645 | DENV2 NS2B FM210228 | DENV2 NS2B AY744150 | DENV2 NS2B EU081177 |
| DENV2 NS2B FJ639733 | DENV2 NS2B FJ390387 | DENV2 NS2B EU482734 | DENV2 NS2B FM210222 |
| DENV2 NS2B FJ410223 | DENV2 NS2B EU482608 | DENV2 NS2B EU726770 | DENV2 NS2B EU569703 |
| DENV2 NS2B FM210215 | DENV2 NS2B EU482447 | DENV2 NS2B FJ850119 | DENV2 NS2B EU482667 |
| DENV2 NS2B FM210210 | DENV2 NS2B FJ410291 | DENV2 NS2B EU596489 | DENV2 NS2B DQ645540 |
| DENV2 NS2B FJ744708 | DENV2 NS2B GQ199899 | DENV2 NS2B EU482470 | DENV2 NS2B FJ410288 |
| DENV2 NS2B FJ024454 | DENV2 NS2B EU482630 | DENV2 NS2B EU687222 | DENV2 NS2B GU131930 |

FIG. 67-60

| Virus Protein Accession No. | Virus Protein Accession No. | Virus Protein Accession No. | Virus Protein Accession No. |
|---|---|---|---|
| DENV2 NS2B AY037116 | DENV2 NS2B EU482654 | DENV2 NS2B FM210205 | DENV2 NS2B EU482586 |
| DENV2 NS2B GQ868549 | DENV2 NS2B GU369819 | DENV2 NS2B GQ868622 | DENV2 NS2B EU482665 |
| DENV2 NS2B EU482751 | DENV2 NS2B GQ868541 | DENV2 NS2B EU660414 | DENV2 NS2B FJ898452 |
| DENV2 NS2B EU482562 | DENV2 NS2B EU569711 | DENV2 NS2B FJ461309 | DENV2 NS2B FM210219 |
| DENV2 NS2B FJ850107 | DENV2 NS2B EU482553 | DENV2 NS2B EU482745 | DENV2 NS2B EF105385 |
| DENV2 NS2B FJ898450 | DENV2 NS2B FJ639717 | DENV2 NS2B EU482601 | DENV2 NS2B GQ868596 |
| DENV2 NS2B EU482570 | DENV2 NS2B CS477304 | DENV2 NS2B AY702037 | DENV2 NS2B FJ744719 |
| DENV2 NS2B FN429894 | DENV2 NS2B FJ687447 | DENV2 NS2B FJ639830 | DENV2 NS2B FJ744713 |
| DENV2 NS2B EU482702 | DENV2 NS2B FM210240 | DENV2 NS2B FM210234 | DENV2 NS2B EU482475 |
| DENV2 NS2B EU482743 | DENV2 NS2B EU482672 | DENV2 NS2B EU482787 | DENV2 NS2B FJ461311 |
| DENV2 NS2B EU081179 | DENV2 NS2B FJ639828 | DENV2 NS2B EU482632 | DENV2 NS2B GQ868597 |
| DENV2 NS2B EU529694 | DENV2 NS2B EU482691 | DENV2 NS2B FJ373299 | DENV2 NS2B GQ199869 |
| DENV2 NS2B EU660405 | DENV2 NS2B FJ687439 | DENV2 NS2B EU482683 | DENV2 NS2B EU482449 |
| DENV2 NS2B FJ859028 | DENV2 NS2B GQ199874 | DENV2 NS2B EU482569 | DENV2 NS2B EU482773 |
| DENV2 NS2B GQ252676 | DENV2 NS2B EU687217 | DENV2 NS2B EU482674 | DENV2 NS2B EU569701 |
| DENV2 NS2B FJ850065 | DENV2 NS2B EU482731 | DENV2 NS2B FJ478459 | DENV2 NS2B EU482738 |
| DENV2 NS2B EU482589 | DENV2 NS2B EU529706 | DENV2 NS2B FJ850121 | DENV2 NS2B EU482468 |
| DENV2 NS2B EU482641 | DENV2 NS2B EU482656 | DENV2 NS2B FJ205879 | DENV2 NS2B EU482633 |
| DENV2 NS2B FJ390385 | DENV2 NS2B EU482543 | DENV2 NS2B FJ687434 | DENV2 NS2B GU131886 |
| DENV2 NS2B EU482784 | DENV2 NS2B EU482732 | DENV2 NS2B EU482450 | DENV2 NS2B EU677141 |
| DENV2 NS2B EU482727 | DENV2 NS2B EU482643 | DENV2 NS2B FJ850053 | DENV2 NS2B GQ868557 |
| DENV2 NS2B FM210212 | DENV2 NS2B DQ645542 | DENV2 NS2B EU056811 | DENV2 NS2B AJ968413 |
| DENV2 NS2B GQ868588 | DENV2 NS2B EU482695 | DENV2 NS2B EU596487 | DENV2 NS2B FJ639835 |
| DENV2 NS2B EU569721 | DENV2 NS2B FJ744745 | DENV2 NS2B EU482626 | DENV2 NS2B EU482579 |

FIG. 67-61

| Virus Protein Accession No. | Virus Protein Accession No. | Virus Protein Accession No. | Virus Protein Accession No. |
|---|---|---|---|
| DENV2 NS2B GU131881 | DENV2 NS2B AY702036 | DENV2 NS2B FJ744709 | DENV2 NS2B DQ645546 |
| DENV2 NS2B GQ868556 | DENV2 NS2B AY744147 | DENV2 NS2B GQ199868 | DENV2 NS2B EU687228 |
| DENV2 NS2B FJ744741 | DENV2 NS2B FM210227 | DENV2 NS2B EU660400 | DENV2 NS2B EF105387 |
| DENV2 NS2B FB667399 | DENV2 NS2B FM210231 | DENV2 NS2B EU482465 | DENV2 NS2B EU482648 |
| DENV2 NS2B AF100466 | DENV2 NS2B FN429891 | DENV2 NS2B FM210208 | DENV2 NS2B FJ639705 |
| DENV2 NS2B FJ390390 | DENV2 NS2B EU482676 | DENV2 NS2B EU482669 | DENV2 NS2B FJ906968 |
| DENV2 NS2B GQ199894 | DENV2 NS2B GQ868604 | DENV2 NS2B EU529695 | DENV2 NS2B AF100464 |
| DENV2 NS2B FJ898434 | DENV2 NS2B GQ868516 | DENV2 NS2B FJ850062 | DENV2 NS2B EU677145 |
| DENV2 NS2B EU482597 | DENV2 NS2B EU482769 | DENV2 NS2B GQ199901 | DENV2 NS2B EU596485 |
| DENV2 NS2B FJ906969 | DENV2 NS2B FJ744717 | DENV2 NS2B EU359009 | DENV2 NS2B FJ898477 |
| DENV2 NS2B AF169679 | DENV2 NS2B EU687213 | DENV2 NS2B GU131931 | DENV2 NS2B DQ181803 |
| DENV2 NS2B FJ461321 | DENV2 NS2B FM210239 | DENV2 NS2B FJ906961 | DENV2 NS2B EU482786 |
| DENV2 NS2B EU687224 | DENV2 NS2B DQ645556 | DENV2 NS2B EU529700 | DENV2 NS2B EF105389 |
| DENV2 NS2B FJ687440 | DENV2 NS2B EU081180 | DENV2 NS2B EU482576 | DENV2 NS2B EU482781 |
| DENV2 NS2B EF105380 | DENV2 NS2B AF204177 | DENV2 NS2B EU482703 | DENV2 NS2B EU482638 |
| DENV2 NS2B AF100467 | DENV2 NS2B EU482679 | DENV2 NS2B EU482685 | DENV2 NS2B FM210217 |
| DENV2 NS2B EU482753 | DENV2 NS2B EU482472 | DENV2 NS2B FM210214 | DENV2 NS2B EF105382 |
| DENV2 NS2B AF022439 | DENV2 NS2B AY858035 | DENV2 NS2B FJ744724 | DENV2 NS2B FJ744742 |
| DENV2 NS2B AF100460 | DENV2 NS2B EU596490 | DENV2 NS2B FM210245 | DENV2 NS2B GU131897 |
| DENV2 NS2B EU596495 | DENV2 NS2B FJ850051 | DENV2 NS2B GQ199895 | DENV2 NS2B EU482584 |
| DENV2 NS2B FJ373301 | DENV2 NS2B EU482446 | DENV2 NS2B EU482604 | DENV2 NS2B EU482624 |
| DENV2 NS2B FJ906962 | DENV2 NS2B EU482694 | DENV2 NS2B FM210236 | DENV2 NS2B EU482725 |
| DENV2 NS2B FJ850105 | DENV2 NS2B GQ868591 | DENV2 NS2B EU482736 | DENV2 NS2B FJ810410 |
| DENV2 NS2B EU482542 | DENV2 NS2B FJ461305 | DENV2 NS2B EU482551 | DENV2 NS2B EU482726 |

FIG. 67-62

| Virus Protein | Accession No. | Virus Protein | Accession No. | Virus Protein | Accession No. | Virus Protein | Accession No. |
|---|---|---|---|---|---|---|---|
| DENV2 NS2B | FJ024475 | DENV2 NS2B | EU482699 | DENV2 NS2B | EU482677 | DENV2 NS2B | EU482573 |
| DENV2 NS2B | FJ744704 | DENV2 NS2B | GQ868552 | DENV2 NS2B | GQ868545 | DENV2 NS2B | EU482755 |
| DENV2 NS2B | EU482599 | DENV2 NS2B | EU660406 | DENV2 NS2B | EU482621 | DENV2 NS2B | FN429893 |
| DENV2 NS2B | FJ744712 | DENV2 NS2B | EU569715 | DENV2 NS2B | EU687243 | DENV2 NS2B | AF022434 |
| DENV2 NS2B | EU482681 | DENV2 NS2B | FJ898467 | DENV2 NS2B | EU482463 | DENV2 NS2B | EU529693 |
| DENV2 NS2B | FJ639831 | DENV2 NS2B | EF051521 | DENV2 NS2B | EU482606 | DENV2 NS2B | EU596499 |
| DENV2 NS2B | EU569708 | DENV2 NS2B | GQ868497 | DENV2 NS2B | DQ645553 | DENV2 NS2B | EU482687 |
| DENV2 NS2B | EU482583 | DENV2 NS2B | EU003591 | DENV2 NS2B | AF038403 | DENV2 NS2B | AF022440 |
| DENV2 NS2B | EU482444 | DENV2 NS2B | EU569699 | DENV2 NS2B | FM210204 | DENV2 NS2B | GU131884 |
| DENV2 NS2B | EU482762 | DENV2 NS2B | EU482547 | DENV2 NS2B | GQ868554 | DENV2 NS2B | EU482757 |
| DENV2 NS2B | EU482662 | DENV2 NS2B | FJ850064 | DENV2 NS2B | DQ448231 | DENV2 NS2B | EU482574 |
| DENV2 NS2B | EU569696 | DENV2 NS2B | EU482719 | DENV2 NS2B | FJ687443 | DENV2 NS2B | EU482764 |
| DENV2 NS2B | M14969 | DENV2 NS2B | EU482448 | DENV2 NS2B | FJ744710 | DENV2 NS2B | FJ478455 |
| DENV2 NS2B | EU482760 | DENV2 NS2B | EU482720 | DENV2 NS2B | AY702040 | DENV2 NS2B | EU179857 |
| DENV2 NS2B | GU131959 | DENV2 NS2B | EU687237 | DENV2 NS2B | FJ898466 | DENV2 NS2B | FJ024473 |
| DENV2 NS2B | AB479041 | DENV2 NS2B | AB122021 | DENV2 NS2B | GQ252677 | DENV2 NS2B | EU660416 |
| DENV2 NS2B | DQ645552 | DENV2 NS2B | EU687248 | DENV2 NS2B | FJ906966 | DENV2 NS2B | DQ645547 |
| DENV2 NS2B | EU482776 | DENV2 NS2B | EU482767 | DENV2 NS2B | GU289914 | DENV2 NS2B | GM059692 |
| DENV2 NS2B | GQ868543 | DENV2 NS2B | DQ181798 | DENV2 NS2B | FJ744706 | DENV2 NS2B | EU569694 |
| DENV2 NS2B | FJ410237 | DENV2 NS2B | EU482735 | DENV2 NS2B | EU596496 | DENV2 NS2B | FJ898436 |
| DENV2 NS2B | AF169686 | DENV2 NS2B | FJ850112 | DENV2 NS2B | EU482560 | DENV2 NS2B | FM210216 |
| DENV2 NS2B | FJ639707 | DENV2 NS2B | EU569719 | DENV2 NS2B | EU482723 | DENV2 NS2B | FM210224 |
| DENV2 NS2B | FJ850120 | DENV2 NS2B | EU660398 | DENV2 NS2B | EU482741 | DENV2 NS2B | EU482778 |
| DENV2 NS2B | FJ639822 | DENV2 NS2B | GQ199897 | DENV2 NS2B | EU482549 | DENV2 NS2B | FJ810412 |

FIG. 67-63

| Virus Protein Accession No. | Virus Protein Accession No. | Virus Protein Accession No. | Virus Protein Accession No. |
|---|---|---|---|
| DENV2 NS2B GU131899 | DENV2 NS2B EU482581 | DENV2 NS2B FJ850108 | DENV2 NS2B GU131883 |
| DENV2 NS2B FJ639703 | DENV2 NS2B EU482600 | DENV2 NS2B EU687214 | DENV2 NS2B FM210235 |
| DENV2 NS2B EF105384 | DENV2 NS2B GU131927 | DENV2 NS2B EU482689 | DENV2 NS2B FJ744707 |
| DENV2 NS2B AB189123 | DENV2 NS2B FJ850076 | DENV2 NS2B FJ882594 | DENV2 NS2B EU482588 |
| DENV2 NS2B FM210233 | DENV2 NS2B GQ868638 | DENV2 NS2B FJ744716 | DENV2 NS2B EU677149 |
| DENV2 NS2B FJ639699 | DENV2 NS2B EU482625 | DENV2 NS2B EU482546 | DENV2 NS2B FJ639734 |
| DENV2 NS2B FJ182014 | DENV2 NS2B GU131843 | DENV2 NS2B FJ410233 | DENV2 NS2B GQ868555 |
| DENV2 NS2B FJ562098 | DENV2 NS2B EU482469 | DENV2 NS2B GQ868600 | DENV2 NS2B GQ868540 |
| DENV2 NS2B FJ913016 | DENV2 NS2B EU482772 | DENV2 NS2B GU131898 | DENV2 NS2B AF169682 |
| DENV2 NS2B EU482746 | DENV2 NS2B FM210225 | DENV2 NS2B AY858036 | DENV2 NS2B DQ181797 |
| DENV2 NS2B EU482646 | DENV2 NS2B AF100461 | DENV2 NS2B EU687244 | DENV2 NS2B FJ687446 |
| DENV2 NS2B FJ687444 | DENV2 NS2B EU482668 | DENV2 NS2B FJ850066 | DENV2 NS2B FJ639829 |
| DENV2 NS2B GU131901 | DENV2 NS2B GQ868598 | DENV2 NS2B EU482556 | DENV2 NS2B FJ898453 |
| DENV2 NS2B GQ868550 | DENV2 NS2B EU529701 | DENV2 NS2B FJ744744 | DENV2 NS2B EU482721 |
| DENV2 NS2B EU482660 | DENV2 NS2B EU482451 | DENV2 NS2B FJ639788 | DENV2 NS2B FJ898460 |
| DENV2 NS2B FJ410219 | DENV2 NS2B FJ882602 | DENV2 NS2B FN429895 | DENV2 NS2B FJ898438 |
| DENV2 NS2B EU569717 | DENV2 NS2B EU482666 | DENV2 NS2B FJ850060 | DENV2 NS2B EU569712 |
| DENV2 NS2B AF022435 | DENV2 NS2B EU482634 | DENV2 NS2B EU660404 | DENV2 NS2B EU687250 |
| DENV2 NS2B EU482788 | DENV2 NS2B DQ645550 | DENV2 NS2B EU482690 | DENV2 NS2B FJ432724 |
| DENV2 NS2B FJ744743 | DENV2 NS2B GQ868558 | DENV2 NS2B EU569720 | DENV2 NS2B AF022437 |
| DENV2 NS2B FJ906956 | DENV2 NS2B GQ868542 | DENV2 NS2B FJ687441 | DENV2 NS2B DQ181800 |
| DENV2 NS2B EU482607 | DENV2 NS2B EU569706 | DENV2 NS2B AF169678 | DENV2 NS2B EU687241 |
| DENV2 NS2B EU726776 | DENV2 NS2B GQ868631 | DENV2 NS2B AF100468 | DENV2 NS2B FJ410200 |
| DENV2 NS2B EU687230 | DENV2 NS2B EU482628 | DENV2 NS2B EU482722 | DENV2 NS2B FJ205878 |

FIG. 67-64

| Virus Protein Accession No. | Virus Protein Accession No. | Virus Protein Accession No. | Virus Protein Accession No. |
|---|---|---|---|
| DENV2 NS2B GU131955 | DENV2 NS2B EF105386 | DENV2 NS2B EU482578 | DENV2 NS2B FM210211 |
| DENV2 NS2B FJ906958 | DENV2 NS2B FJ410217 | DENV2 NS2B EU482544 | DENV2 NS2B EU482742 |
| DENV2 NS2B FJ744722 | DENV2 NS2B EU482467 | DENV2 NS2B EU482759 | DENV2 NS2B EU482705 |
| DENV2 NS2B EU482770 | DENV2 NS2B FJ461314 | DENV2 NS2B FJ744711 | DENV2 NS2B EF105390 |
| DENV2 NS2B AY744149 | DENV2 NS2B GQ868595 | DENV2 NS2B EU569704 | DENV2 NS2B EU482684 |
| DENV2 NS2B EU482655 | DENV2 NS2B GU131932 | DENV2 NS2B AF169685 | DENV2 NS2B EU569714 |
| DENV2 NS2B EU677137 | DENV2 NS2B EU056810 | DENV2 NS2B EU677147 | DENV2 NS2B GQ868589 |
| DENV2 NS2B EU482744 | DENV2 NS2B AF022441 | DENV2 NS2B GU370051 | DENV2 NS2B FJ850078 |
| DENV2 NS2B FJ639701 | DENV2 NS2B EU056812 | DENV2 NS2B EU482587 | DENV2 NS2B FM210243 |
| DENV2 NS2B EU660415 | DENV2 NS2B EU482664 | DENV2 NS2B DQ645551 | DENV2 NS2B EU482671 |
| DENV2 NS2B EU482631 | DENV2 NS2B EU482568 | DENV2 NS2B FJ390391 | DENV2 NS2B EU482571 |
| DENV2 NS2B FJ687435 | DENV2 NS2B EU482774 | DENV2 NS2B FJ850054 | DENV2 NS2B DQ645544 |
| DENV2 NS2B FJ639836 | DENV2 NS2B FJ547067 | DENV2 NS2B EU482565 | DENV2 NS2B FM210238 |
| DENV2 NS2B AY702034 | DENV2 NS2B EU482474 | DENV2 NS2B FJ373300 | DENV2 NS2B EF105379 |
| DENV2 NS2B EU482696 | DENV2 NS2B FJ850118 | DENV2 NS2B AF169684 | DENV2 NS2B EU482728 |
| DENV2 NS2B FJ687438 | DENV2 NS2B EU687216 | DENV2 NS2B DL138662 | DENV2 NS2B FM210229 |
| DENV2 NS2B EU596488 | DENV2 NS2B EU482590 | DENV2 NS2B GQ868544 | DENV2 NS2B GU131880 |
| DENV2 NS2B FM210220 | DENV2 NS2B AF208496 | DENV2 NS2B FJ744714 | DENV2 NS2B M19197 |
| DENV2 NS2B FJ898451 | DENV2 NS2B EU569693 | DENV2 NS2B EU179859 | DENV2 NS2B GQ868603 |
| DENV2 NS2B FJ639708 | DENV2 NS2B FJ850106 | DENV2 NS2B DQ645541 | DENV2 NS2B GU131929 |
| DENV2 NS2B EU687229 | DENV2 NS2B EU482623 | DENV2 NS2B AF100465 | DENV2 NS2B FJ639732 |
| DENV2 NS2B EU482739 | DENV2 NS2B GU131879 | DENV2 NS2B EU687246 | DENV2 NS2B EU677143 |
| DENV2 NS2B EU569709 | DENV2 NS2B FM210223 | DENV2 NS2B EU482750 | DENV2 NS2B EU482682 |
| DENV2 NS2B EU687223 | DENV2 NS2B GQ199893 | DENV2 NS2B GU131900 | DENV2 NS2B GQ868641 |

FIG. 67-65

| Virus Protein | Accession No. | Virus Protein | Accession No. | Virus Protein | Accession No. | Virus Protein | Accession No. |
|---|---|---|---|---|---|---|---|
| DENV2 NS2B | EU482785 | DENV2 NS2B | FM210237 | DENV2 NS3 | EU482763 | DENV2 NS3 | EU482561 |
| DENV2 NS2B | FJ410193 | DENV2 NS2B | EU482603 | DENV2 NS3 | EU482661 | DENV2 NS3 | GQ868515 |
| DENV2 NS2B | EU482552 | DENV2 NS2B | EU482733 | DENV2 NS3 | M29095 | DENV2 NS3 | EU482473 |
| DENV2 NS2B | EU677142 | DENV2 NS2B | FJ850088 | DENV2 NS3 | EU482585 | DENV2 NS3 | EU482622 |
| DENV2 NS2B | EU687232 | DENV2 NS2B | M14969 | DENV2 NS3 | FJ639711 | DENV2 NS3 | EU482693 |
| DENV2 NS2B | FM210241 | DENV2 NS2B | M14969 | DENV2 NS3 | FJ850067 | DENV2 NS3 | AY744148 |
| DENV2 NS2B | FJ744725 | DENV2 NS2B | M14969 | DENV2 NS3 | EU482777 | DENV2 NS3 | EU687249 |
| DENV2 NS2B | GQ868621 | DENV2 NS2B | M14969 | DENV2 NS3 | FJ898479 | DENV2 NS3 | EU482761 |
| DENV2 NS2B | EU482653 | DENV2 NS2B | M14969 | DENV2 NS3 | AF100463 | DENV2 NS3 | FJ639837 |
| DENV2 NS2B | FJ024477 | DENV2 NS2B | M14969 | DENV2 NS3 | FJ744703 | DENV2 NS3 | FJ906960 |
| DENV2 NS2B | U87412 | DENV2 NS2B | M14969 | DENV2 NS3 | EU482642 | DENV2 NS3 | AY702035 |
| DENV2 NS2B | EU482692 | DENV2 NS3 | CS479165 | DENV2 NS3 | FJ744718 | DENV2 NS3 | GQ868590 |
| DENV2 NS2B | FM210206 | DENV2 NS3 | FJ205877 | DENV2 NS3 | EF457904 | DENV2 NS3 | GQ199896 |
| DENV2 NS2B | EU482644 | DENV2 NS3 | EU726767 | DENV2 NS3 | AF169687 | DENV2 NS3 | FN429892 |
| DENV2 NS2B | GU131975 | DENV2 NS3 | EU482649 | DENV2 NS3 | FJ850072 | DENV2 NS3 | EU482466 |
| DENV2 NS2B | EU482602 | DENV2 NS3 | FM210221 | DENV2 NS3 | EU482445 | DENV2 NS3 | FJ639697 |
| DENV2 NS2B | EU482673 | DENV2 NS3 | EU482740 | DENV2 NS3 | EU482598 | DENV2 NS3 | FM210209 |
| DENV2 NS2B | FJ024474 | DENV2 NS3 | EF105388 | DENV2 NS3 | AF359579 | DENV2 NS3 | AB122022 |
| DENV2 NS2B | FJ744720 | DENV2 NS3 | FJ410259 | DENV2 NS3 | GQ199605 | DENV2 NS3 | EU569697 |
| DENV2 NS2B | FJ639809 | DENV2 NS3 | FJ024461 | DENV2 NS3 | EU482639 | DENV2 NS3 | EU482730 |
| DENV2 NS2B | FJ639718 | DENV2 NS3 | DQ181801 | DENV2 NS3 | GQ868551 | DENV2 NS3 | EU482577 |
| DENV2 NS2B | DQ181802 | DENV2 NS3 | EU482650 | DENV2 NS3 | EU569713 | DENV2 NS3 | FJ390384 |
| DENV2 NS2B | FJ810411 | DENV2 NS3 | EU482724 | DENV2 NS3 | EU482775 | DENV2 NS3 | CS805344 |
| DENV2 NS2B | EU482554 | DENV2 NS3 | FJ898435 | DENV2 NS3 | GQ868620 | DENV2 NS3 | AY702038 |
| | | DENV2 NS3 | FJ547064 | DENV2 NS3 | GU131902 | DENV2 NS3 | FJ467493 |
| | | DENV2 NS3 | EU677144 | DENV2 NS3 | GU131947 | DENV2 NS3 | EU482629 |
| | | DENV2 NS3 | EU569716 | DENV2 NS3 | EU569707 | DENV2 NS3 | EU482593 |
| | | DENV2 NS3 | EU482752 | DENV2 NS3 | M20558 | DENV2 NS3 | FJ850085 |
| | | DENV2 NS3 | FJ906967 | DENV2 NS3 | EU482663 | DENV2 NS3 | FJ410224 |
| | | DENV2 NS3 | FJ410241 | DENV2 NS3 | DQ645543 | DENV2 NS3 | GQ868625 |
| | | DENV2 NS3 | FJ639706 | DENV2 NS3 | FM210207 | DENV2 NS3 | EU854293 |
| | | DENV2 NS3 | EU596500 | DENV2 NS3 | FJ873808 | DENV2 NS3 | EU482675 |
| | | DENV2 NS3 | FJ410208 | DENV2 NS3 | FM210203 | DENV2 NS3 | AY776328 |
| | | DENV2 NS3 | FJ906957 | DENV2 NS3 | EU687225 | DENV2 NS3 | GU370050 |
| | | DENV2 NS3 | EU569702 | DENV2 NS3 | EU596486 | DENV2 NS3 | FJ850061 |
| | | DENV2 NS3 | FJ898478 | DENV2 NS3 | AF100459 | DENV2 NS3 | EU660413 |
| | | DENV2 NS3 | FJ882593 | DENV2 NS3 | EU687238 | DENV2 NS3 | FJ205880 |
| | | | | DENV2 NS3 | EU482747 | DENV2 NS3 | EU687199 |
| | | | | DENV2 NS3 | GU131928 | DENV2 NS3 | DQ181804 |
| | | | | DENV2 NS3 | FM210226 | DENV2 NS3 | FJ744723 |
| | | | | DENV2 NS3 | M84728 | DENV2 NS3 | EU482686 |
| | | | | DENV2 NS3 | FM210230 | DENV2 NS3 | EU482605 |
| | | | | DENV2 NS3 | EU482659 | DENV2 NS3 | GQ199900 |
| | | | | DENV2 NS3 | AJ487271 | DENV2 NS3 | FJ410221 |
| | | | | DENV2 NS3 | EU660399 | DENV2 NS3 | AF100469 |
| | | | | DENV2 NS3 | FJ639832 | DENV2 NS3 | FJ898461 |
| | | | | DENV2 NS3 | EU569698 | DENV2 NS3 | EU482550 |
| | | | | DENV2 NS3 | EU854294 | DENV2 NS3 | FM210244 |

FIG. 67-66

| Virus Protein Accession No. | Virus Protein Accession No. | Virus Protein Accession No. | Virus Protein Accession No. |
|---|---|---|---|
| DENV2 NS3EU179858 | DENV2 NS3EU677138 | DENV2 NS3EU482471 | DENV2 NS3AF022438 |
| DENV2 NS3EU687227 | DENV2 NS3EU482783 | DENV2 NS3FJ744705 | DENV2 NS3FJ639702 |
| DENV2 NS3EU660417 | DENV2 NS3EU596484 | DENV2 NS3EU482572 | DENV2 NS3EU482729 |
| DENV2 NS3FJ850082 | DENV2 NS3EU569718 | DENV2 NS3GU131885 | DENV2 NS3EU569710 |
| DENV2 NS3EU596491 | DENV2 NS3FJ639709 | DENV2 NS3FJ850116 | DENV2 NS3FJ547090 |
| DENV2 NS3EU482582 | DENV2 NS3AF169688 | DENV2 NS3FM210218 | DENV2 NS3GU131974 |
| DENV2 NS3EU482749 | DENV2 NS3DQ181799 | DENV2 NS3EU482754 | DENV2 NS3FJ639833 |
| DENV2 NS3EU482779 | DENV2 NS3GQ199898 | DENV2 NS3EU482756 | DENV2 NS3FJ410228 |
| DENV2 NS3GQ868623 | DENV2 NS3FJ024458 | DENV2 NS3DQ181806 | DENV2 NS3FM210242 |
| DENV2 NS3AF169680 | DENV2 NS3FJ687436 | DENV2 NS3FB730117 | DENV2 NS3FM210228 |
| DENV2 NS3U87411 | DENV2 NS3FB667404 | DENV2 NS3EU482737 | DENV2 NS3FJ390387 |
| DENV2 NS3FM210213 | DENV2 NS3FJ850063 | DENV2 NS3AB122020 | DENV2 NS3EU482608 |
| DENV2 NS3EU482647 | DENV2 NS3EU482541 | DENV2 NS3EU482636 | DENV2 NS3EU482447 |
| DENV2 NS3AF169681 | DENV2 NS3DQ645554 | DENV2 NS3EU482557 | DENV2 NS3FJ410291 |
| DENV2 NS3EU482548 | DENV2 NS3EU482657 | DENV2 NS3EU482701 | DENV2 NS3GQ199899 |
| DENV2 NS3FJ898439 | DENV2 NS3EU482768 | DENV2 NS3FJ024452 | DENV2 NS3EU482630 |
| DENV2 NS3EU482637 | DENV2 NS3AF038402 | DENV2 NS3EU569700 | DENV2 NS3FJ687445 |
| DENV2 NS3EU781135 | DENV2 NS3FJ850117 | DENV2 NS3EU482580 | DENV2 NS3GQ199890 |
| DENV2 NS3DQ645548 | DENV2 NS3EU482678 | DENV2 NS3EU482670 | DENV2 NS3EU482651 |
| DENV2 NS3AB189122 | DENV2 NS3EU482698 | DENV2 NS3FJ687437 | DENV2 NS3EU482658 |
| DENV2 NS3FJ810418 | DENV2 NS3FM210202 | DENV2 NS3NC_001474 | DENV2 NS3EU687235 |
| DENV2 NS3GU131896 | DENV2 NS3EU482594 | DENV2 NS3EU596497 | DENV2 NS3FJ850091 |
| DENV2 NS3EU482765 | DENV2 NS3FJ898465 | DENV2 NS3EU482704 | DENV2 NS3FJ639698 |
| DENV2 NS3EU596498 | DENV2 NS3FJ639834 | DENV2 NS3EU569692 | DENV2 NS3FJ850050 |
| DENV2 NS3CS479167 | DENV2 NS3GQ868553 | DENV2 NS3CS477302 | DENV2 NS3AB189124 |
| DENV2 NS3FJ182012 | DENV2 NS3FJ850115 | DENV2 NS3AF169683 | DENV2 NS3EU482771 |
| DENV2 NS3EF105381 | DENV2 NS3EU482627 | DENV2 NS3FM210232 | DENV2 NS3AF276619 |
| DENV2 NS3FJ410195 | DENV2 NS3EU482620 | DENV2 NS3FJ898454 | DENV2 NS3EU482766 |
| DENV2 NS3AF204178 | DENV2 NS3FJ744721 | DENV2 NS3EU596483 | DENV2 NS3DQ645549 |
| DENV2 NS3FJ226066 | DENV2 NS3EU687220 | DENV2 NS3FJ639700 | DENV2 NS3EU687242 |
| DENV2 NS3EU482640 | DENV2 NS3EU687236 | DENV2 NS3GQ199892 | DENV2 NS3EU482635 |
| DENV2 NS3GQ868592 | DENV2 NS3FJ687442 | DENV2 NS3M84727 | DENV2 NS3EU687245 |
| DENV2 NS3FJ639704 | DENV2 NS3EU569705 | DENV2 NS3EU677148 | DENV2 NS3AY702039 |
| DENV2 NS3EU687212 | DENV2 NS3EU482780 | DENV2 NS3EU482645 | DENV2 NS3AY744150 |
| DENV2 NS3AF100462 | DENV2 NS3EU687231 | DENV2 NS3FJ639733 | DENV2 NS3EU482734 |
| DENV2 NS3EU726775 | DENV2 NS3GQ199866 | DENV2 NS3FJ410223 | DENV2 NS3EU726770 |
| DENV2 NS3EU677146 | DENV2 NS3FJ850074 | DENV2 NS3FM210215 | DENV2 NS3FJ850119 |
| DENV2 NS3AF022436 | DENV2 NS3EU081178 | DENV2 NS3FM210210 | DENV2 NS3EU596489 |
| DENV2 NS3EU482680 | DENV2 NS3FJ410215 | DENV2 NS3FJ744708 | DENV2 NS3EU482470 |
| DENV2 NS3EU482464 | DENV2 NS3DQ645555 | DENV2 NS3FJ024454 | DENV2 NS3EU687222 |
| DENV2 NS3AF489932 | DENV2 NS3EU482652 | DENV2 NS3FJ810409 | DENV2 NS3FJ205885 |
| DENV2 NS3GU131864 | DENV2 NS3FJ432726 | DENV2 NS3EU569695 | DENV2 NS3AB479042 |
| DENV2 NS3FJ390389 | DENV2 NS3EU482688 | DENV2 NS3EF105383 | DENV2 NS3EU482748 |
| DENV2 NS3EU687240 | DENV2 NS3FJ410202 | DENV2 NS3GU131882 | DENV2 NS3GU131924 |
| DENV2 NS3DQ645545 | DENV2 NS3GQ868646 | DENV2 NS3EU482697 | DENV2 NS3GQ868640 |
| DENV2 NS3FJ906959 | DENV2 NS3EU482575 | DENV2 NS3CS479202 | DENV2 NS3FJ639710 |
| DENV2 NS3EU621672 | DENV2 NS3FM210246 | DENV2 NS3DQ181805 | DENV2 NS3AF119661 |
| DENV2 NS3GQ868599 | DENV2 NS3FJ898449 | DENV2 NS3EF105378 | DENV2 NS3EU482545 |

FIG. 67-67

| Virus Protein Accession No. | Virus Protein Accession No. | Virus Protein Accession No. | Virus Protein Accession No. |
|---|---|---|---|
| DENV2 NS3EU687215 | DENV2 NS3FJ687447 | DENV2 NS3FJ744713 | DENV2 NS3GQ868516 |
| DENV2 NS3FJ898432 | DENV2 NS3FM210240 | DENV2 NS3EU482475 | DENV2 NS3EU482769 |
| DENV2 NS3EU482700 | DENV2 NS3EU482672 | DENV2 NS3FJ461311 | DENV2 NS3FJ744717 |
| DENV2 NS3X57468 | DENV2 NS3FJ639828 | DENV2 NS3GQ868597 | DENV2 NS3EU687213 |
| DENV2 NS3EU482782 | DENV2 NS3EU482691 | DENV2 NS3GQ199869 | DENV2 NS3FM210239 |
| DENV2 NS3FJ873811 | DENV2 NS3FJ687439 | DENV2 NS3EU482449 | DENV2 NS3DQ645556 |
| DENV2 NS3EU482758 | DENV2 NS3GQ199874 | DENV2 NS3EU482773 | DENV2 NS3EU081180 |
| DENV2 NS3GQ868624 | DENV2 NS3EU687217 | DENV2 NS3EU569701 | DENV2 NS3AF204177 |
| DENV2 NS3FJ744715 | DENV2 NS3EU482731 | DENV2 NS3EU482738 | DENV2 NS3EU482679 |
| DENV2 NS3FJ639783 | DENV2 NS3EU529706 | DENV2 NS3EU482468 | DENV2 NS3EU482472 |
| DENV2 NS3EU081177 | DENV2 NS3EU482656 | DENV2 NS3EU482633 | DENV2 NS3AY858035 |
| DENV2 NS3FM210222 | DENV2 NS3EU482543 | DENV2 NS3GU131886 | DENV2 NS3EU596490 |
| DENV2 NS3EU569703 | DENV2 NS3EU482732 | DENV2 NS3EU677141 | DENV2 NS3FJ850051 |
| DENV2 NS3EU482667 | DENV2 NS3EU482643 | DENV2 NS3GQ868557 | DENV2 NS3EU482446 |
| DENV2 NS3DQ645540 | DENV2 NS3DQ645542 | DENV2 NS3AJ968413 | DENV2 NS3EU482694 |
| DENV2 NS3FJ410288 | DENV2 NS3EU482695 | DENV2 NS3FJ639835 | DENV2 NS3GQ868591 |
| DENV2 NS3GU131930 | DENV2 NS3FJ744745 | DENV2 NS3EU482579 | DENV2 NS3FJ461305 |
| DENV2 NS3AY037116 | DENV2 NS3FM210205 | DENV2 NS3GU131881 | DENV2 NS3FJ744709 |
| DENV2 NS3GQ868549 | DENV2 NS3GQ868622 | DENV2 NS3GQ868556 | DENV2 NS3GQ199868 |
| DENV2 NS3EU482751 | DENV2 NS3EU660414 | DENV2 NS3FJ744741 | DENV2 NS3EU660400 |
| DENV2 NS3EU482562 | DENV2 NS3FJ461309 | DENV2 NS3FB667399 | DENV2 NS3EU482465 |
| DENV2 NS3FJ850107 | DENV2 NS3EU482745 | DENV2 NS3AF100466 | DENV2 NS3FM210208 |
| DENV2 NS3FJ898450 | DENV2 NS3EU482601 | DENV2 NS3FJ390390 | DENV2 NS3EU482669 |
| DENV2 NS3EU482570 | DENV2 NS3AY702037 | DENV2 NS3GQ199894 | DENV2 NS3EU529695 |
| DENV2 NS3FN429894 | DENV2 NS3FJ639830 | DENV2 NS3FJ898434 | DENV2 NS3FJ850062 |
| DENV2 NS3EU482702 | DENV2 NS3FM210234 | DENV2 NS3EU482597 | DENV2 NS3GQ199901 |
| DENV2 NS3EU482743 | DENV2 NS3EU482787 | DENV2 NS3FJ906969 | DENV2 NS3EU359009 |
| DENV2 NS3EU081179 | DENV2 NS3EU482632 | DENV2 NS3AF169679 | DENV2 NS3GU131931 |
| DENV2 NS3EU529694 | DENV2 NS3FJ373299 | DENV2 NS3FJ461321 | DENV2 NS3FJ906961 |
| DENV2 NS3EU660405 | DENV2 NS3EU482683 | DENV2 NS3EU687224 | DENV2 NS3EU529700 |
| DENV2 NS3FJ859028 | DENV2 NS3EU482569 | DENV2 NS3FJ687440 | DENV2 NS3EU482576 |
| DENV2 NS3GQ252676 | DENV2 NS3EU482674 | DENV2 NS3EF105380 | DENV2 NS3EU482703 |
| DENV2 NS3FJ850065 | DENV2 NS3FJ478459 | DENV2 NS3AF100467 | DENV2 NS3EU482685 |
| DENV2 NS3EU482589 | DENV2 NS3FJ850121 | DENV2 NS3EU482753 | DENV2 NS3FM210214 |
| DENV2 NS3EU482641 | DENV2 NS3FJ205879 | DENV2 NS3AF022439 | DENV2 NS3FJ744724 |
| DENV2 NS3FJ390385 | DENV2 NS3FJ687434 | DENV2 NS3AF100460 | DENV2 NS3FM210245 |
| DENV2 NS3EU482784 | DENV2 NS3EU482450 | DENV2 NS3EU596495 | DENV2 NS3GQ199895 |
| DENV2 NS3EU482727 | DENV2 NS3FJ850053 | DENV2 NS3FJ373301 | DENV2 NS3EU482604 |
| DENV2 NS3FM210212 | DENV2 NS3EU056811 | DENV2 NS3FJ906962 | DENV2 NS3FM210236 |
| DENV2 NS3GQ868588 | DENV2 NS3EU596487 | DENV2 NS3FJ850105 | DENV2 NS3EU482736 |
| DENV2 NS3EU569721 | DENV2 NS3EU482626 | DENV2 NS3EU482542 | DENV2 NS3EU482551 |
| DENV2 NS3EU482654 | DENV2 NS3EU482586 | DENV2 NS3AY702036 | DENV2 NS3DQ645546 |
| DENV2 NS3GU369819 | DENV2 NS3EU482665 | DENV2 NS3AY744147 | DENV2 NS3EU687228 |
| DENV2 NS3GQ868541 | DENV2 NS3FJ898452 | DENV2 NS3FM210227 | DENV2 NS3EF105387 |
| DENV2 NS3EU569711 | DENV2 NS3FM210219 | DENV2 NS3FM210231 | DENV2 NS3EU482648 |
| DENV2 NS3EU482553 | DENV2 NS3EF105385 | DENV2 NS3FN429891 | DENV2 NS3FJ639705 |
| DENV2 NS3FJ639717 | DENV2 NS3GQ868596 | DENV2 NS3EU482676 | DENV2 NS3FJ906968 |
| DENV2 NS3CS477304 | DENV2 NS3FJ744719 | DENV2 NS3GQ868604 | DENV2 NS3AF100464 |

FIG. 67-68

| Virus Protein Accession No. | Virus Protein Accession No. | Virus Protein Accession No. | Virus Protein Accession No. |
|---|---|---|---|
| DENV2 NS3EU677145 | DENV2 NS3EU569699 | DENV2 NS3GU131884 | DENV2 NS3EU482772 |
| DENV2 NS3EU596485 | DENV2 NS3EU482547 | DENV2 NS3EU482757 | DENV2 NS3FM210225 |
| DENV2 NS3FJ898477 | DENV2 NS3FJ850064 | DENV2 NS3EU482574 | DENV2 NS3AF100461 |
| DENV2 NS3DQ181803 | DENV2 NS3EU482719 | DENV2 NS3EU482764 | DENV2 NS3EU482668 |
| DENV2 NS3EU482786 | DENV2 NS3EU482448 | DENV2 NS3FJ478455 | DENV2 NS3GQ868598 |
| DENV2 NS3EF105389 | DENV2 NS3EU482720 | DENV2 NS3EU179857 | DENV2 NS3EU529701 |
| DENV2 NS3EU482781 | DENV2 NS3EU687237 | DENV2 NS3FJ024473 | DENV2 NS3EU482451 |
| DENV2 NS3EU482638 | DENV2 NS3AB122021 | DENV2 NS3EU660416 | DENV2 NS3FJ882602 |
| DENV2 NS3FM210217 | DENV2 NS3EU687248 | DENV2 NS3DQ645547 | DENV2 NS3EU482666 |
| DENV2 NS3EF105382 | DENV2 NS3EU482767 | DENV2 NS3GM059692 | DENV2 NS3EU482634 |
| DENV2 NS3FJ744742 | DENV2 NS3DQ181798 | DENV2 NS3EU569694 | DENV2 NS3DQ645550 |
| DENV2 NS3GU131897 | DENV2 NS3EU482735 | DENV2 NS3FJ898436 | DENV2 NS3GQ868558 |
| DENV2 NS3EU482584 | DENV2 NS3FJ850112 | DENV2 NS3FM210216 | DENV2 NS3GQ868542 |
| DENV2 NS3EU482624 | DENV2 NS3EU569719 | DENV2 NS3FM210224 | DENV2 NS3EU569706 |
| DENV2 NS3EU482725 | DENV2 NS3EU660398 | DENV2 NS3EU482778 | DENV2 NS3GQ868631 |
| DENV2 NS3FJ810410 | DENV2 NS3GQ199897 | DENV2 NS3FJ810412 | DENV2 NS3EU482628 |
| DENV2 NS3EU482726 | DENV2 NS3EU482677 | DENV2 NS3GU131899 | DENV2 NS3FJ850108 |
| DENV2 NS3FJ024475 | DENV2 NS3GQ868545 | DENV2 NS3FJ639703 | DENV2 NS3EU687214 |
| DENV2 NS3FJ744704 | DENV2 NS3EU482621 | DENV2 NS3EF105384 | DENV2 NS3EU482689 |
| DENV2 NS3EU482599 | DENV2 NS3EU687243 | DENV2 NS3AB189123 | DENV2 NS3FJ882594 |
| DENV2 NS3FJ744712 | DENV2 NS3EU482463 | DENV2 NS3FM210233 | DENV2 NS3FJ744716 |
| DENV2 NS3EU482681 | DENV2 NS3EU482606 | DENV2 NS3FJ639699 | DENV2 NS3EU482546 |
| DENV2 NS3FJ639831 | DENV2 NS3DQ645553 | DENV2 NS3FJ182014 | DENV2 NS3FJ410233 |
| DENV2 NS3EU569708 | DENV2 NS3AF038403 | DENV2 NS3FJ562098 | DENV2 NS3GQ868600 |
| DENV2 NS3EU482583 | DENV2 NS3FM210204 | DENV2 NS3FJ913016 | DENV2 NS3GU131898 |
| DENV2 NS3EU482444 | DENV2 NS3GQ868554 | DENV2 NS3EU482746 | DENV2 NS3AY858036 |
| DENV2 NS3EU482762 | DENV2 NS3DQ448231 | DENV2 NS3EU482646 | DENV2 NS3EU687244 |
| DENV2 NS3EU482662 | DENV2 NS3FJ687443 | DENV2 NS3FJ687444 | DENV2 NS3FJ850066 |
| DENV2 NS3EU569696 | DENV2 NS3FJ744710 | DENV2 NS3GU131901 | DENV2 NS3EU482556 |
| DENV2 NS3EU482760 | DENV2 NS3AY702040 | DENV2 NS3GQ868550 | DENV2 NS3FJ744744 |
| DENV2 NS3GU131959 | DENV2 NS3FJ898466 | DENV2 NS3EU482660 | DENV2 NS3FJ639788 |
| DENV2 NS3AB479041 | DENV2 NS3GQ252677 | DENV2 NS3FJ410219 | DENV2 NS3FN429895 |
| DENV2 NS3DQ645552 | DENV2 NS3FJ906966 | DENV2 NS3EU569717 | DENV2 NS3FJ850060 |
| DENV2 NS3EU482776 | DENV2 NS3GU289914 | DENV2 NS3AF022435 | DENV2 NS3EU660404 |
| DENV2 NS3GQ868543 | DENV2 NS3FJ744706 | DENV2 NS3EU482788 | DENV2 NS3EU482690 |
| DENV2 NS3FJ410237 | DENV2 NS3EU596496 | DENV2 NS3FJ744743 | DENV2 NS3EU569720 |
| DENV2 NS3AF169686 | DENV2 NS3EU482560 | DENV2 NS3FJ906956 | DENV2 NS3FJ687441 |
| DENV2 NS3FJ639707 | DENV2 NS3EU482723 | DENV2 NS3EU482607 | DENV2 NS3AF169678 |
| DENV2 NS3FJ850120 | DENV2 NS3EU482741 | DENV2 NS3EU726776 | DENV2 NS3AF100468 |
| DENV2 NS3FJ639822 | DENV2 NS3EU482549 | DENV2 NS3EU687230 | DENV2 NS3EU482722 |
| DENV2 NS3EU482699 | DENV2 NS3EU482573 | DENV2 NS3EU482581 | DENV2 NS3GU131883 |
| DENV2 NS3GQ868552 | DENV2 NS3EU482755 | DENV2 NS3EU482600 | DENV2 NS3FM210235 |
| DENV2 NS3EU660406 | DENV2 NS3FN429893 | DENV2 NS3GU131927 | DENV2 NS3FJ744707 |
| DENV2 NS3EU569715 | DENV2 NS3AF022434 | DENV2 NS3FJ850076 | DENV2 NS3EU482588 |
| DENV2 NS3FJ898467 | DENV2 NS3EU529693 | DENV2 NS3GQ868638 | DENV2 NS3EU677149 |
| DENV2 NS3EF051521 | DENV2 NS3EU596499 | DENV2 NS3EU482625 | DENV2 NS3FJ639734 |
| DENV2 NS3GQ868497 | DENV2 NS3EU482687 | DENV2 NS3GU131843 | DENV2 NS3GQ868555 |
| DENV2 NS3EU003591 | DENV2 NS3AF022440 | DENV2 NS3EU482469 | DENV2 NS3GQ868540 |

FIG. 67-69

| Virus Protein Accession No. | Virus Protein Accession No. | Virus Protein Accession No. | Virus Protein Accession No. |
|---|---|---|---|
| DENV2 NS3AF169682 | DENV2 NS3EU056812 | DENV2 NS3FM210243 | DENV2 NS4A |
| DENV2 NS3DQ181797 | DENV2 NS3EU482664 | DENV2 NS3EU482671 | FJ205877 |
| DENV2 NS3FJ687446 | DENV2 NS3EU482568 | DENV2 NS3EU482571 | DENV2 NS4A |
| DENV2 NS3FJ639829 | DENV2 NS3EU482774 | DENV2 NS3DQ645544 | EU726767 |
| DENV2 NS3FJ898453 | DENV2 NS3FJ547067 | DENV2 NS3FM210238 | DENV2 NS4A |
| DENV2 NS3EU482721 | DENV2 NS3EU482474 | DENV2 NS3EF105379 | AY702036 |
| DENV2 NS3FJ898460 | DENV2 NS3FJ850118 | DENV2 NS3EU482728 | DENV2 NS4A |
| DENV2 NS3FJ898438 | DENV2 NS3EU687216 | DENV2 NS3FM210229 | EU482649 |
| DENV2 NS3EU569712 | DENV2 NS3EU482590 | DENV2 NS3GU131880 | DENV2 NS4A |
| DENV2 NS3EU687250 | DENV2 NS3AF208496 | DENV2 NS3M19197 | AY744147 |
| DENV2 NS3FJ432724 | DENV2 NS3EU569693 | DENV2 NS3GQ868603 | DENV2 NS4A |
| DENV2 NS3AF022437 | DENV2 NS3FJ850106 | DENV2 NS3GU131929 | FM210227 |
| DENV2 NS3DQ181800 | DENV2 NS3EU482623 | DENV2 NS3FJ639732 | DENV2 NS4A |
| DENV2 NS3EU687241 | DENV2 NS3GU131879 | DENV2 NS3EU677143 | FM210221 |
| DENV2 NS3FJ410200 | DENV2 NS3FM210223 | DENV2 NS3EU482682 | DENV2 NS4A |
| DENV2 NS3FJ205878 | DENV2 NS3GQ199893 | DENV2 NS3GQ868641 | FM210231 |
| DENV2 NS3GU131955 | DENV2 NS3EU482578 | DENV2 NS3EU482785 | DENV2 NS4A |
| DENV2 NS3FJ906958 | DENV2 NS3EU482544 | DENV2 NS3FJ410193 | EU482740 |
| DENV2 NS3FJ744722 | DENV2 NS3EU482759 | DENV2 NS3EU482552 | DENV2 NS4A |
| DENV2 NS3EU482770 | DENV2 NS3FJ744711 | DENV2 NS3EU677142 | FN429891 |
| DENV2 NS3AY744149 | DENV2 NS3EU569704 | DENV2 NS3EU687232 | DENV2 NS4A |
| DENV2 NS3EU482655 | DENV2 NS3AF169685 | DENV2 NS3FM210241 | EF105388 |
| DENV2 NS3EU677137 | DENV2 NS3EU677147 | DENV2 NS3FJ744725 | DENV2 NS4A |
| DENV2 NS3EU482744 | DENV2 NS3GU370051 | DENV2 NS3GQ868621 | FJ410259 |
| DENV2 NS3FJ639701 | DENV2 NS3EU482587 | DENV2 NS3EU482653 | DENV2 NS4A |
| DENV2 NS3EU660415 | DENV2 NS3DQ645551 | DENV2 NS3FJ024477 | FJ024461 |
| DENV2 NS3EU482631 | DENV2 NS3FJ390391 | DENV2 NS3U87412 | DENV2 NS4A |
| DENV2 NS3FJ687435 | DENV2 NS3FJ850054 | DENV2 NS3EU482692 | DQ181801 |
| DENV2 NS3FJ639836 | DENV2 NS3EU482565 | DENV2 NS3FM210206 | DENV2 NS4A |
| DENV2 NS3AY702034 | DENV2 NS3FJ373300 | DENV2 NS3EU482644 | GQ868604 |
| DENV2 NS3EU482696 | DENV2 NS3AF169684 | DENV2 NS3GU131975 | DENV2 NS4A |
| DENV2 NS3FJ687438 | DENV2 NS3DL138662 | DENV2 NS3EU482602 | EU482676 |
| DENV2 NS3EU596488 | DENV2 NS3GQ868544 | DENV2 NS3EU482673 | DENV2 NS4A |
| DENV2 NS3FM210220 | DENV2 NS3FJ744714 | DENV2 NS3FJ024474 | EU482650 |
| DENV2 NS3FJ898451 | DENV2 NS3EU179859 | DENV2 NS3FJ744720 | DENV2 NS4A |
| DENV2 NS3FJ639708 | DENV2 NS3DQ645541 | DENV2 NS3FJ639809 | EU482724 |
| DENV2 NS3EU687229 | DENV2 NS3AF100465 | DENV2 NS3FJ639718 | DENV2 NS4A |
| DENV2 NS3EU482739 | DENV2 NS3EU687246 | DENV2 NS3DQ181802 | GQ868516 |
| DENV2 NS3EU569709 | DENV2 NS3EU482750 | DENV2 NS3FJ810411 | DENV2 NS4A |
| DENV2 NS3EU687223 | DENV2 NS3GU131900 | DENV2 NS3EU482554 | FJ898435 |
| DENV2 NS3EF105386 | DENV2 NS3FM210211 | DENV2 NS3FM210237 | DENV2 NS4A |
| DENV2 NS3FJ410217 | DENV2 NS3EU482742 | DENV2 NS3EU482603 | FJ547064 |
| DENV2 NS3EU482467 | DENV2 NS3EU482705 | DENV2 NS3EU482733 | DENV2 NS4A |
| DENV2 NS3FJ461314 | DENV2 NS3EF105390 | DENV2 NS3FJ850088 | EU677144 |
| DENV2 NS3GQ868595 | DENV2 NS3EU482684 | DENV2 NS4A | DENV2 NS4A |
| DENV2 NS3GU131932 | DENV2 NS3EU569714 | CS479165 | EU569716 |
| DENV2 NS3EU056810 | DENV2 NS3GQ868589 | DENV2 NS4A | DENV2 NS4A |
| DENV2 NS3AF022441 | DENV2 NS3FJ850078 | EU482542 | EU482769 |

FIG. 67-70

| Virus Protein | Accession No. | Virus Protein | Accession No. | Virus Protein | Accession No. | Virus Protein | Accession No. |
|---|---|---|---|---|---|---|---|
| DENV2 NS4A | FJ744717 | DENV2 NS4A | M29095 | DENV2 NS4A | EU482445 | DENV2 NS4A | FM210245 |
| DENV2 NS4A | EU482752 | DENV2 NS4A | EU482585 | DENV2 NS4A | GQ199901 | DENV2 NS4A | DQ645543 |
| DENV2 NS4A | FJ906967 | DENV2 NS4A | EU482694 | DENV2 NS4A | EU482598 | DENV2 NS4A | GQ199895 |
| DENV2 NS4A | FJ410241 | DENV2 NS4A | FJ639711 | DENV2 NS4A | AF359579 | DENV2 NS4A | FM210207 |
| DENV2 NS4A | FJ639706 | DENV2 NS4A | GQ868591 | DENV2 NS4A | EU359009 | DENV2 NS4A | EU482604 |
| DENV2 NS4A | EU596500 | DENV2 NS4A | FJ744709 | DENV2 NS4A | GU131931 | DENV2 NS4A | FJ873808 |
| DENV2 NS4A | FJ410208 | DENV2 NS4A | FJ461305 | DENV2 NS4A | GQ199605 | DENV2 NS4A | FM210203 |
| DENV2 NS4A | FJ906957 | DENV2 NS4A | FJ850067 | DENV2 NS4A | FJ906961 | DENV2 NS4A | FM210236 |
| DENV2 NS4A | EU687213 | DENV2 NS4A | GQ199868 | DENV2 NS4A | EU482639 | DENV2 NS4A | EU482551 |
| DENV2 NS4A | EU569702 | DENV2 NS4A | EU660400 | DENV2 NS4A | GQ868551 | DENV2 NS4A | EU482736 |
| DENV2 NS4A | FM210239 | DENV2 NS4A | EU482777 | DENV2 NS4A | EU569713 | DENV2 NS4A | EU687225 |
| DENV2 NS4A | EU081180 | DENV2 NS4A | FJ898479 | DENV2 NS4A | EU482775 | DENV2 NS4A | EU596486 |
| DENV2 NS4A | DQ645556 | DENV2 NS4A | EU482465 | DENV2 NS4A | EU529700 | DENV2 NS4A | AF100459 |
| DENV2 NS4A | AF204177 | DENV2 NS4A | AF100463 | DENV2 NS4A | GQ868620 | DENV2 NS4A | EU687238 |
| DENV2 NS4A | EU482679 | DENV2 NS4A | FM210208 | DENV2 NS4A | GU131902 | DENV2 NS4A | EU482747 |
| DENV2 NS4A | EU482472 | DENV2 NS4A | FJ744703 | DENV2 NS4A | EU482703 | DENV2 NS4A | GU131928 |
| DENV2 NS4A | FJ898478 | DENV2 NS4A | EU482669 | DENV2 NS4A | EU482576 | DENV2 NS4A | FM210226 |
| DENV2 NS4A | AY858035 | DENV2 NS4A | EU529695 | DENV2 NS4A | EU482685 | DENV2 NS4A | DQ645546 |
| DENV2 NS4A | FJ882593 | DENV2 NS4A | FJ850062 | DENV2 NS4A | FM210214 | DENV2 NS4A | M84728 |
| DENV2 NS4A | FJ850051 | DENV2 NS4A | EU482642 | DENV2 NS4A | GU131947 | DENV2 NS4A | EU687228 |
| DENV2 NS4A | EU482763 | DENV2 NS4A | FJ744718 | DENV2 NS4A | FJ744724 | DENV2 NS4A | FM210230 |
| DENV2 NS4A | EU596490 | DENV2 NS4A | EF457904 | DENV2 NS4A | EU569707 | DENV2 NS4A | EF105387 |
| DENV2 NS4A | EU482446 | DENV2 NS4A | AF169687 | DENV2 NS4A | M20558 | DENV2 NS4A | EU482648 |
| DENV2 NS4A | EU482661 | DENV2 NS4A | FJ850072 | DENV2 NS4A | EU482663 | DENV2 NS4A | EU482659 |

FIG. 67-71

| Virus Protein | Accession No. | Virus Protein | Accession No. | Virus Protein | Accession No. | Virus Protein | Accession No. |
|---|---|---|---|---|---|---|---|
| DENV2 NS4A | FJ639705 | DENV2 NS4A | EU482638 | DENV2 NS4A | EU482599 | DENV2 NS4A | FJ410224 |
| DENV2 NS4A | AJ487271 | DENV2 NS4A | FJ906960 | DENV2 NS4A | EU482577 | DENV2 NS4A | AF169686 |
| DENV2 NS4A | EU660399 | DENV2 NS4A | FM210217 | DENV2 NS4A | EU482681 | DENV2 NS4A | FJ850120 |
| DENV2 NS4A | FJ639832 | DENV2 NS4A | AY702035 | DENV2 NS4A | FJ390384 | DENV2 NS4A | FJ639707 |
| DENV2 NS4A | FJ906968 | DENV2 NS4A | EF105382 | DENV2 NS4A | FJ639831 | DENV2 NS4A | FJ639822 |
| DENV2 NS4A | EU569698 | DENV2 NS4A | GQ868590 | DENV2 NS4A | CS805344 | DENV2 NS4A | GQ868625 |
| DENV2 NS4A | AF100464 | DENV2 NS4A | FJ744742 | DENV2 NS4A | EU569708 | DENV2 NS4A | EU854293 |
| DENV2 NS4A | EU596485 | DENV2 NS4A | GQ199896 | DENV2 NS4A | EU482583 | DENV2 NS4A | GQ868552 |
| DENV2 NS4A | EU677145 | DENV2 NS4A | GU131897 | DENV2 NS4A | EU482762 | DENV2 NS4A | EU482675 |
| DENV2 NS4A | FJ898477 | DENV2 NS4A | FN429892 | DENV2 NS4A | EU482444 | DENV2 NS4A | EU482699 |
| DENV2 NS4A | EU854294 | DENV2 NS4A | EU482466 | DENV2 NS4A | EU482662 | DENV2 NS4A | EU569715 |
| DENV2 NS4A | EU482561 | DENV2 NS4A | EU482584 | DENV2 NS4A | EU569696 | DENV2 NS4A | EU660406 |
| DENV2 NS4A | DQ181803 | DENV2 NS4A | EU482624 | DENV2 NS4A | AY702038 | DENV2 NS4A | AY776328 |
| DENV2 NS4A | EU482786 | DENV2 NS4A | FJ810410 | DENV2 NS4A | GU131959 | DENV2 NS4A | GU370050 |
| DENV2 NS4A | GQ868515 | DENV2 NS4A | EU482725 | DENV2 NS4A | EU482760 | DENV2 NS4A | FJ850061 |
| DENV2 NS4A | EU482473 | DENV2 NS4A | FJ639697 | DENV2 NS4A | AB479041 | DENV2 NS4A | EU660413 |
| DENV2 NS4A | EU482622 | DENV2 NS4A | FM210209 | DENV2 NS4A | FJ467493 | DENV2 NS4A | FJ205880 |
| DENV2 NS4A | EU482693 | DENV2 NS4A | AB122022 | DENV2 NS4A | EU482629 | DENV2 NS4A | FJ898467 |
| DENV2 NS4A | AY744148 | DENV2 NS4A | EU482726 | DENV2 NS4A | EU482593 | DENV2 NS4A | EU687199 |
| DENV2 NS4A | EU482781 | DENV2 NS4A | FJ024475 | DENV2 NS4A | GQ868543 | DENV2 NS4A | EF051521 |
| DENV2 NS4A | EU687249 | DENV2 NS4A | FJ744704 | DENV2 NS4A | EU482776 | DENV2 NS4A | DQ181804 |
| DENV2 NS4A | EF105389 | DENV2 NS4A | EU569697 | DENV2 NS4A | DQ645552 | DENV2 NS4A | FJ744723 |
| DENV2 NS4A | EU482761 | DENV2 NS4A | EU482730 | DENV2 NS4A | FJ410237 | DENV2 NS4A | EU482686 |
| DENV2 NS4A | FJ639837 | DENV2 NS4A | FJ744712 | DENV2 NS4A | FJ850085 | DENV2 NS4A | EU482605 |

FIG. 67-72

| Virus Protein | Accession No. | Virus Protein | Accession No. | Virus Protein | Accession No. | Virus Protein | Accession No. |
|---|---|---|---|---|---|---|---|
| DENV2 NS4A | GQ868497 | DENV2 NS4A | EU482582 | DENV2 NS4A | DQ645548 | DENV2 NS4A | GQ868592 |
| DENV2 NS4A | GQ199900 | DENV2 NS4A | EU482749 | DENV2 NS4A | FM210204 | DENV2 NS4A | FJ639704 |
| DENV2 NS4A | FJ410221 | DENV2 NS4A | EU482735 | DENV2 NS4A | AF038403 | DENV2 NS4A | EU687212 |
| DENV2 NS4A | AF100469 | DENV2 NS4A | FJ850112 | DENV2 NS4A | DQ645553 | DENV2 NS4A | GU289914 |
| DENV2 NS4A | EU003591 | DENV2 NS4A | EU482779 | DENV2 NS4A | GQ868554 | DENV2 NS4A | AF100462 |
| DENV2 NS4A | FJ898461 | DENV2 NS4A | GQ868623 | DENV2 NS4A | AB189122 | DENV2 NS4A | EU726775 |
| DENV2 NS4A | FJ850064 | DENV2 NS4A | AF169680 | DENV2 NS4A | FJ687443 | DENV2 NS4A | EU677146 |
| DENV2 NS4A | EU482547 | DENV2 NS4A | EU660398 | DENV2 NS4A | DQ448231 | DENV2 NS4A | AF022436 |
| DENV2 NS4A | EU569699 | DENV2 NS4A | EU569719 | DENV2 NS4A | FJ810418 | DENV2 NS4A | FJ744706 |
| DENV2 NS4A | EU482550 | DENV2 NS4A | U87411 | DENV2 NS4A | GU131896 | DENV2 NS4A | EU596496 |
| DENV2 NS4A | FM210244 | DENV2 NS4A | GQ199897 | DENV2 NS4A | EU482765 | DENV2 NS4A | EU482680 |
| DENV2 NS4A | EU482719 | DENV2 NS4A | EU482677 | DENV2 NS4A | EU596498 | DENV2 NS4A | EU482464 |
| DENV2 NS4A | EU482720 | DENV2 NS4A | FM210213 | DENV2 NS4A | CS479167 | DENV2 NS4A | AF489932 |
| DENV2 NS4A | EU482448 | DENV2 NS4A | EU482647 | DENV2 NS4A | FJ744710 | DENV2 NS4A | EU482560 |
| DENV2 NS4A | EU179858 | DENV2 NS4A | GQ868545 | DENV2 NS4A | FJ182012 | DENV2 NS4A | EU482723 |
| DENV2 NS4A | EU687227 | DENV2 NS4A | AF169681 | DENV2 NS4A | AY702040 | DENV2 NS4A | EU482741 |
| DENV2 NS4A | EU687237 | DENV2 NS4A | EU482548 | DENV2 NS4A | EF105381 | DENV2 NS4A | GU131864 |
| DENV2 NS4A | EU660417 | DENV2 NS4A | FJ898439 | DENV2 NS4A | FJ410195 | DENV2 NS4A | EU482549 |
| DENV2 NS4A | AB122021 | DENV2 NS4A | EU482637 | DENV2 NS4A | AF204178 | DENV2 NS4A | EU482755 |
| DENV2 NS4A | FJ850082 | DENV2 NS4A | EU781135 | DENV2 NS4A | FJ898466 | DENV2 NS4A | FJ390389 |
| DENV2 NS4A | EU482767 | DENV2 NS4A | EU687243 | DENV2 NS4A | FJ226066 | DENV2 NS4A | EU482573 |
| DENV2 NS4A | EU687248 | DENV2 NS4A | EU482621 | DENV2 NS4A | GQ252677 | DENV2 NS4A | FN429893 |
| DENV2 NS4A | DQ181798 | DENV2 NS4A | EU482463 | DENV2 NS4A | EU482640 | DENV2 NS4A | AF022434 |
| DENV2 NS4A | EU596491 | DENV2 NS4A | EU482606 | DENV2 NS4A | FJ906966 | DENV2 NS4A | EU687240 |

FIG. 67-73

| Virus Protein | Accession No. | Virus Protein | Accession No. | Virus Protein | Accession No. | Virus Protein | Accession No. |
|---|---|---|---|---|---|---|---|
| DENV2 NS4A | DQ645545 | DENV2 NS4A | GQ199898 | DENV2 NS4A | GU131899 | DENV2 NS4A | EU482688 |
| DENV2 NS4A | FJ906959 | DENV2 NS4A | GM059692 | DENV2 NS4A | GQ868553 | DENV2 NS4A | FJ562098 |
| DENV2 NS4A | EU621672 | DENV2 NS4A | FJ024458 | DENV2 NS4A | FJ850115 | DENV2 NS4A | FJ182014 |
| DENV2 NS4A | EU529693 | DENV2 NS4A | FJ898436 | DENV2 NS4A | EU482627 | DENV2 NS4A | FJ913016 |
| DENV2 NS4A | GQ868599 | DENV2 NS4A | EU569694 | DENV2 NS4A | EU482620 | DENV2 NS4A | FJ410202 |
| DENV2 NS4A | EU596499 | DENV2 NS4A | FJ687436 | DENV2 NS4A | FJ744721 | DENV2 NS4A | GQ868646 |
| DENV2 NS4A | AF022440 | DENV2 NS4A | FM210216 | DENV2 NS4A | EU687220 | DENV2 NS4A | EU482575 |
| DENV2 NS4A | EU482687 | DENV2 NS4A | FB667404 | DENV2 NS4A | EU687236 | DENV2 NS4A | FM210246 |
| DENV2 NS4A | GU131884 | DENV2 NS4A | FJ850063 | DENV2 NS4A | EF105384 | DENV2 NS4A | EU482746 |
| DENV2 NS4A | EU677138 | DENV2 NS4A | EU482541 | DENV2 NS4A | FJ639703 | DENV2 NS4A | FJ898449 |
| DENV2 NS4A | EU482757 | DENV2 NS4A | DQ645554 | DENV2 NS4A | FJ687442 | DENV2 NS4A | EU482471 |
| DENV2 NS4A | EU482783 | DENV2 NS4A | EU482657 | DENV2 NS4A | EU569705 | DENV2 NS4A | FJ744705 |
| DENV2 NS4A | EU596484 | DENV2 NS4A | EU482768 | DENV2 NS4A | EU482780 | DENV2 NS4A | EU482572 |
| DENV2 NS4A | EU569718 | DENV2 NS4A | AF038402 | DENV2 NS4A | EU687231 | DENV2 NS4A | EU482646 |
| DENV2 NS4A | EU482574 | DENV2 NS4A | FM210224 | DENV2 NS4A | AB189123 | DENV2 NS4A | FJ687444 |
| DENV2 NS4A | EU482764 | DENV2 NS4A | FJ850117 | DENV2 NS4A | GQ199866 | DENV2 NS4A | GU131885 |
| DENV2 NS4A | FJ639709 | DENV2 NS4A | EU482678 | DENV2 NS4A | FJ850074 | DENV2 NS4A | GQ868550 |
| DENV2 NS4A | FJ478455 | DENV2 NS4A | EU482698 | DENV2 NS4A | FM210233 | DENV2 NS4A | GU131901 |
| DENV2 NS4A | AF169688 | DENV2 NS4A | FM210202 | DENV2 NS4A | EU081178 | DENV2 NS4A | FJ410219 |
| DENV2 NS4A | FJ024473 | DENV2 NS4A | EU482778 | DENV2 NS4A | FJ410215 | DENV2 NS4A | EU482660 |
| DENV2 NS4A | EU179857 | DENV2 NS4A | EU482594 | DENV2 NS4A | DQ645555 | DENV2 NS4A | AF022435 |
| DENV2 NS4A | EU660416 | DENV2 NS4A | FJ898465 | DENV2 NS4A | EU482652 | DENV2 NS4A | EU569717 |
| DENV2 NS4A | DQ181799 | DENV2 NS4A | FJ639834 | DENV2 NS4A | FJ432726 | DENV2 NS4A | FJ850116 |
| DENV2 NS4A | DQ645547 | DENV2 NS4A | FJ810412 | DENV2 NS4A | FJ639699 | DENV2 NS4A | FM210218 |

FIG. 67-74

| Virus Protein Accession No. | Virus Protein Accession No. | Virus Protein Accession No. | Virus Protein Accession No. |
|---|---|---|---|
| DENV2 NS4A FJ744743 | DENV2 NS4A EU482580 | DENV2 NS4A FJ882602 | DENV2 NS4A DQ181805 |
| DENV2 NS4A EU482788 | DENV2 NS4A EU482670 | DENV2 NS4A EU482645 | DENV2 NS4A EF105378 |
| DENV2 NS4A EU482754 | DENV2 NS4A EU482469 | DENV2 NS4A EU482666 | DENV2 NS4A AF022438 |
| DENV2 NS4A FJ906956 | DENV2 NS4A FJ687437 | DENV2 NS4A GQ868558 | DENV2 NS4A FJ639702 |
| DENV2 NS4A EU482756 | DENV2 NS4A NC_001474 | DENV2 NS4A DQ645550 | DENV2 NS4A EU482729 |
| DENV2 NS4A EU482607 | DENV2 NS4A EU482772 | DENV2 NS4A EU482634 | DENV2 NS4A EU569710 |
| DENV2 NS4A EU726776 | DENV2 NS4A FM210225 | DENV2 NS4A FJ639733 | DENV2 NS4A FJ547090 |
| DENV2 NS4A DQ181806 | DENV2 NS4A EU596497 | DENV2 NS4A FJ410223 | DENV2 NS4A GU131974 |
| DENV2 NS4A FB730117 | DENV2 NS4A AF100461 | DENV2 NS4A FM210215 | DENV2 NS4A FJ639833 |
| DENV2 NS4A EU482737 | DENV2 NS4A EU482704 | DENV2 NS4A GQ868542 | DENV2 NS4A FJ410228 |
| DENV2 NS4A AB122020 | DENV2 NS4A GQ868598 | DENV2 NS4A EU569706 | DENV2 NS4A EU482689 |
| DENV2 NS4A EU687230 | DENV2 NS4A EU482668 | DENV2 NS4A FM210210 | DENV2 NS4A FJ882594 |
| DENV2 NS4A EU482636 | DENV2 NS4A EU529701 | DENV2 NS4A FJ744708 | DENV2 NS4A FM210242 |
| DENV2 NS4A EU482557 | DENV2 NS4A EU569692 | DENV2 NS4A FJ024454 | DENV2 NS4A FJ744716 |
| DENV2 NS4A EU482581 | DENV2 NS4A CS477302 | DENV2 NS4A FJ810409 | DENV2 NS4A EU482546 |
| DENV2 NS4A EU482701 | DENV2 NS4A AF169683 | DENV2 NS4A EU569695 | DENV2 NS4A FJ410233 |
| DENV2 NS4A EU482600 | DENV2 NS4A FM210232 | DENV2 NS4A GQ868631 | DENV2 NS4A GQ868600 |
| DENV2 NS4A FJ024452 | DENV2 NS4A FJ898454 | DENV2 NS4A EF105383 | DENV2 NS4A FM210228 |
| DENV2 NS4A GU131927 | DENV2 NS4A EU596483 | DENV2 NS4A EU482628 | DENV2 NS4A GU131898 |
| DENV2 NS4A EU569700 | DENV2 NS4A FJ639700 | DENV2 NS4A GU131882 | DENV2 NS4A FJ390387 |
| DENV2 NS4A FJ850076 | DENV2 NS4A EU482451 | DENV2 NS4A FJ850108 | DENV2 NS4A AY858036 |
| DENV2 NS4A GQ868638 | DENV2 NS4A GQ199892 | DENV2 NS4A EU687214 | DENV2 NS4A EU482608 |
| DENV2 NS4A EU482625 | DENV2 NS4A M84727 | DENV2 NS4A EU482697 | DENV2 NS4A EU687244 |
| DENV2 NS4A GU131843 | DENV2 NS4A EU677148 | DENV2 NS4A CS479202 | DENV2 NS4A EU482447 |

FIG. 67-75

| Virus Protein Accession No. | Virus Protein Accession No. | Virus Protein Accession No. | Virus Protein Accession No. |
|---|---|---|---|
| DENV2 NS4A FJ850066 | DENV2 NS4A AF276619 | DENV2 NS4A DQ181797 | DENV2 NS4A EU687241 |
| DENV2 NS4A FJ410291 | DENV2 NS4A EU482766 | DENV2 NS4A FJ687446 | DENV2 NS4A EU482782 |
| DENV2 NS4A GQ199899 | DENV2 NS4A DQ645549 | DENV2 NS4A EU687222 | DENV2 NS4A FJ410200 |
| DENV2 NS4A EU482630 | DENV2 NS4A AF100468 | DENV2 NS4A FJ205885 | DENV2 NS4A GU131955 |
| DENV2 NS4A FJ687445 | DENV2 NS4A EU687242 | DENV2 NS4A AB479042 | DENV2 NS4A FJ205878 |
| DENV2 NS4A EU482556 | DENV2 NS4A EU482635 | DENV2 NS4A FJ898453 | DENV2 NS4A FJ873811 |
| DENV2 NS4A FJ744744 | DENV2 NS4A EU687245 | DENV2 NS4A FJ639829 | DENV2 NS4A FJ906958 |
| DENV2 NS4A FJ639788 | DENV2 NS4A EU482722 | DENV2 NS4A FJ898460 | DENV2 NS4A FJ744722 |
| DENV2 NS4A FN429895 | DENV2 NS4A GU131883 | DENV2 NS4A EU482721 | DENV2 NS4A EU482758 |
| DENV2 NS4A GQ199890 | DENV2 NS4A AY702039 | DENV2 NS4A EU482748 | DENV2 NS4A EU482770 |
| DENV2 NS4A EU482651 | DENV2 NS4A AY744150 | DENV2 NS4A FJ898438 | DENV2 NS4A AY744149 |
| DENV2 NS4A FJ850060 | DENV2 NS4A FJ744707 | DENV2 NS4A GU131924 | DENV2 NS4A EU482655 |
| DENV2 NS4A EU482658 | DENV2 NS4A FM210235 | DENV2 NS4A EU569712 | DENV2 NS4A GQ868624 |
| DENV2 NS4A EU687235 | DENV2 NS4A EU482734 | DENV2 NS4A GQ868640 | DENV2 NS4A FJ744715 |
| DENV2 NS4A FJ850091 | DENV2 NS4A EU482588 | DENV2 NS4A EU687250 | DENV2 NS4A EU677137 |
| DENV2 NS4A EU660404 | DENV2 NS4A EU677149 | DENV2 NS4A FJ432724 | DENV2 NS4A FJ639783 |
| DENV2 NS4A FJ639698 | DENV2 NS4A FJ639734 | DENV2 NS4A FJ639710 | DENV2 NS4A EU482744 |
| DENV2 NS4A EU482690 | DENV2 NS4A EU726770 | DENV2 NS4A AF119661 | DENV2 NS4A EU081177 |
| DENV2 NS4A EU569720 | DENV2 NS4A GQ868540 | DENV2 NS4A EU482545 | DENV2 NS4A FM210222 |
| DENV2 NS4A FJ850050 | DENV2 NS4A GQ868555 | DENV2 NS4A EU687215 | DENV2 NS4A FJ639701 |
| DENV2 NS4A FJ687441 | DENV2 NS4A FJ850119 | DENV2 NS4A AF022437 | DENV2 NS4A EU569703 |
| DENV2 NS4A AF169678 | DENV2 NS4A AF169682 | DENV2 NS4A FJ898432 | DENV2 NS4A EU482667 |
| DENV2 NS4A AB189124 | DENV2 NS4A EU596489 | DENV2 NS4A EU482700 | DENV2 NS4A DQ645540 |
| DENV2 NS4A EU482771 | DENV2 NS4A EU482470 | DENV2 NS4A DQ181800 | DENV2 NS4A EU660415 |

FIG. 67-76

| Virus Protein Accession No. | Virus Protein Accession No. | Virus Protein Accession No. | Virus Protein Accession No. |
|---|---|---|---|
| DENV2 NS4A EU482631 | DENV2 NS4A FJ639708 | DENV2 NS4A EU569711 | DENV2 NS4A EU687217 |
| DENV2 NS4A FJ410288 | DENV2 NS4A FJ859028 | DENV2 NS4A GU131932 | DENV2 NS4A FJ850106 |
| DENV2 NS4A GU131930 | DENV2 NS4A GQ252676 | DENV2 NS4A EU056810 | DENV2 NS4A EU569693 |
| DENV2 NS4A AY037116 | DENV2 NS4A EU687229 | DENV2 NS4A EU482553 | DENV2 NS4A EU482623 |
| DENV2 NS4A GQ868549 | DENV2 NS4A FJ850065 | DENV2 NS4A AF022441 | DENV2 NS4A EU482731 |
| DENV2 NS4A EU482751 | DENV2 NS4A EU482739 | DENV2 NS4A FJ639717 | DENV2 NS4A GU131879 |
| DENV2 NS4A FJ687435 | DENV2 NS4A EU482589 | DENV2 NS4A CS477304 | DENV2 NS4A EU529706 |
| DENV2 NS4A EU482562 | DENV2 NS4A EU482641 | DENV2 NS4A FJ687447 | DENV2 NS4A EU482656 |
| DENV2 NS4A FJ850107 | DENV2 NS4A FJ390385 | DENV2 NS4A EU056812 | DENV2 NS4A FM210223 |
| DENV2 NS4A FJ898450 | DENV2 NS4A EU482784 | DENV2 NS4A EU482664 | DENV2 NS4A GQ199893 |
| DENV2 NS4A EU482570 | DENV2 NS4A EU569709 | DENV2 NS4A EU482568 | DENV2 NS4A EU482543 |
| DENV2 NS4A FJ639836 | DENV2 NS4A EU482727 | DENV2 NS4A EU482774 | DENV2 NS4A EU482578 |
| DENV2 NS4A AY702034 | DENV2 NS4A EU687223 | DENV2 NS4A FJ850118 | DENV2 NS4A EU482732 |
| DENV2 NS4A EU482696 | DENV2 NS4A FM210212 | DENV2 NS4A FM210240 | DENV2 NS4A FJ744711 |
| DENV2 NS4A FN429894 | DENV2 NS4A GQ868588 | DENV2 NS4A EU482474 | DENV2 NS4A EU482759 |
| DENV2 NS4A FJ687438 | DENV2 NS4A EU569721 | DENV2 NS4A FJ547067 | DENV2 NS4A EU482544 |
| DENV2 NS4A EU482702 | DENV2 NS4A EU482654 | DENV2 NS4A EU687216 | DENV2 NS4A EU482643 |
| DENV2 NS4A EU482743 | DENV2 NS4A EF105386 | DENV2 NS4A EU482590 | DENV2 NS4A EU569704 |
| DENV2 NS4A EU596488 | DENV2 NS4A EU482467 | DENV2 NS4A EU482672 | DENV2 NS4A DQ645542 |
| DENV2 NS4A FM210220 | DENV2 NS4A FJ410217 | DENV2 NS4A FJ639828 | DENV2 NS4A EU482695 |
| DENV2 NS4A FJ898451 | DENV2 NS4A GU369819 | DENV2 NS4A EU482691 | DENV2 NS4A AF169685 |
| DENV2 NS4A EU081179 | DENV2 NS4A GQ868541 | DENV2 NS4A FJ687439 | DENV2 NS4A GU370051 |
| DENV2 NS4A EU529694 | DENV2 NS4A FJ461314 | DENV2 NS4A AF208496 | DENV2 NS4A EU677147 |
| DENV2 NS4A EU660405 | DENV2 NS4A GQ868595 | DENV2 NS4A GQ199874 | DENV2 NS4A FJ744745 |

FIG. 67-77

| Virus Protein | Accession No. | Virus Protein | Accession No. | Virus Protein | Accession No. | Virus Protein | Accession No. |
|---|---|---|---|---|---|---|---|
| DENV2 NS4A | EU482587 | DENV2 NS4A | EU179859 | DENV2 NS4A | FM210219 | DENV2 NS4A | EU482449 |
| DENV2 NS4A | FM210205 | DENV2 NS4A | EU482674 | DENV2 NS4A | EF105385 | DENV2 NS4A | FJ639732 |
| DENV2 NS4A | GQ868622 | DENV2 NS4A | FJ478459 | DENV2 NS4A | EU569714 | DENV2 NS4A | EU482773 |
| DENV2 NS4A | FJ390391 | DENV2 NS4A | DQ645541 | DENV2 NS4A | GQ868589 | DENV2 NS4A | EU569701 |
| DENV2 NS4A | DQ645551 | DENV2 NS4A | AF100465 | DENV2 NS4A | FJ850078 | DENV2 NS4A | EU482738 |
| DENV2 NS4A | EU660414 | DENV2 NS4A | FJ850121 | DENV2 NS4A | FM210243 | DENV2 NS4A | EU482468 |
| DENV2 NS4A | FJ850054 | DENV2 NS4A | EU687246 | DENV2 NS4A | EU482671 | DENV2 NS4A | EU677143 |
| DENV2 NS4A | FJ461309 | DENV2 NS4A | EU482750 | DENV2 NS4A | EU482571 | DENV2 NS4A | EU482682 |
| DENV2 NS4A | EU482565 | DENV2 NS4A | FJ205879 | DENV2 NS4A | DQ645544 | DENV2 NS4A | EU482633 |
| DENV2 NS4A | EU482745 | DENV2 NS4A | FJ687434 | DENV2 NS4A | FM210238 | DENV2 NS4A | GU131886 |
| DENV2 NS4A | FJ373300 | DENV2 NS4A | GU131900 | DENV2 NS4A | EF105379 | DENV2 NS4A | GQ868641 |
| DENV2 NS4A | EU482601 | DENV2 NS4A | FM210211 | DENV2 NS4A | GQ868596 | DENV2 NS4A | EU482785 |
| DENV2 NS4A | AY702037 | DENV2 NS4A | EU482742 | DENV2 NS4A | EU482728 | DENV2 NS4A | EU677141 |
| DENV2 NS4A | FJ639830 | DENV2 NS4A | EU482450 | DENV2 NS4A | FJ744719 | DENV2 NS4A | FJ410193 |
| DENV2 NS4A | DL138662 | DENV2 NS4A | EU482705 | DENV2 NS4A | FM210229 | DENV2 NS4A | EU482552 |
| DENV2 NS4A | AF169684 | DENV2 NS4A | FJ850053 | DENV2 NS4A | GU131880 | DENV2 NS4A | GQ868557 |
| DENV2 NS4A | FM210234 | DENV2 NS4A | EU056811 | DENV2 NS4A | FJ744713 | DENV2 NS4A | AJ968413 |
| DENV2 NS4A | EU482787 | DENV2 NS4A | EF105390 | DENV2 NS4A | M19197 | DENV2 NS4A | EU677142 |
| DENV2 NS4A | EU482632 | DENV2 NS4A | EU596487 | DENV2 NS4A | EU482475 | DENV2 NS4A | FJ639835 |
| DENV2 NS4A | FJ373299 | DENV2 NS4A | EU482626 | DENV2 NS4A | FJ461311 | DENV2 NS4A | EU482579 |
| DENV2 NS4A | GQ868544 | DENV2 NS4A | EU482586 | DENV2 NS4A | GQ868597 | DENV2 NS4A | FM210241 |
| DENV2 NS4A | EU482683 | DENV2 NS4A | EU482684 | DENV2 NS4A | GQ199869 | DENV2 NS4A | EU687232 |
| DENV2 NS4A | EU482569 | DENV2 NS4A | EU482665 | DENV2 NS4A | GU131929 | DENV2 NS4A | FJ744725 |
| DENV2 NS4A | FJ744714 | DENV2 NS4A | FJ898452 | DENV2 NS4A | GQ868603 | DENV2 NS4A | GU131881 |

FIG. 67-78

| Virus Protein Accession No. | Virus Protein Accession No. | Virus Protein Accession No. | Virus Protein Accession No. |
|---|---|---|---|
| DENV2 NS4A GQ868621 | DENV2 NS4A DQ181802 | DENV2 NS4B EU482740 | DENV2 NS4B EU482585 |
| DENV2 NS4A EU482653 | DENV2 NS4A FJ639718 | DENV2 NS4B EF105388 | DENV2 NS4B FJ639711 |
| DENV2 NS4A GQ868556 | DENV2 NS4A FJ810411 | DENV2 NS4B FJ410259 | DENV2 NS4B FJ850067 |
| DENV2 NS4A FJ024477 | DENV2 NS4A EU687224 | DENV2 NS4B FJ024461 | DENV2 NS4B EU482777 |
| DENV2 NS4A U87412 | DENV2 NS4A FJ687440 | DENV2 NS4B DQ181801 | DENV2 NS4B FJ898479 |
| DENV2 NS4A EU482692 | DENV2 NS4A EU482554 | DENV2 NS4B EU482650 | DENV2 NS4B AF100463 |
| DENV2 NS4A FM210206 | DENV2 NS4A EF105380 | DENV2 NS4B EU482724 | DENV2 NS4B FJ744703 |
| DENV2 NS4A FJ744741 | DENV2 NS4A FM210237 | DENV2 NS4B FJ898435 | DENV2 NS4B EU482642 |
| DENV2 NS4A EU482644 | DENV2 NS4A AF100467 | DENV2 NS4B FJ547064 | DENV2 NS4B FJ744718 |
| DENV2 NS4A GU131975 | DENV2 NS4A EU482753 | DENV2 NS4B EU677144 | DENV2 NS4B EF457904 |
| DENV2 NS4A FB667399 | DENV2 NS4A AF022439 | DENV2 NS4B EU569716 | DENV2 NS4B AF169687 |
| DENV2 NS4A AF100466 | DENV2 NS4A AF100460 | DENV2 NS4B EU482752 | DENV2 NS4B FJ850072 |
| DENV2 NS4A FJ024474 | DENV2 NS4A EU596495 | DENV2 NS4B FJ906967 | DENV2 NS4B EU482445 |
| DENV2 NS4A EU482673 | DENV2 NS4A FJ373301 | DENV2 NS4B FJ410241 | DENV2 NS4B EU482598 |
| DENV2 NS4A FJ390390 | DENV2 NS4A EU482603 | DENV2 NS4B FJ639706 | DENV2 NS4B AF359579 |
| DENV2 NS4A EU482602 | DENV2 NS4A FJ906962 | DENV2 NS4B EU596500 | DENV2 NS4B GQ199605 |
| DENV2 NS4A FJ744720 | DENV2 NS4A EU482733 | DENV2 NS4B FJ410208 | DENV2 NS4B EU482639 |
| DENV2 NS4A GQ199894 | DENV2 NS4A FJ850105 | DENV2 NS4B FJ906957 | DENV2 NS4B GQ868551 |
| DENV2 NS4A FJ898434 | DENV2 NS4A FJ850088 | DENV2 NS4B EU569702 | DENV2 NS4B EU569713 |
| DENV2 NS4A FJ639809 | DENV2 NS4B CS479165 | DENV2 NS4B FJ898478 | DENV2 NS4B EU482775 |
| DENV2 NS4A EU482597 | DENV2 NS4B FJ205877 | DENV2 NS4B FJ882593 | DENV2 NS4B GQ868620 |
| DENV2 NS4A FJ906969 | DENV2 NS4B EU726767 | DENV2 NS4B EU482763 | DENV2 NS4B GU131902 |
| DENV2 NS4A AF169679 | DENV2 NS4B EU482649 | DENV2 NS4B EU482661 | DENV2 NS4B GU131947 |
| DENV2 NS4A FJ461321 | DENV2 NS4B FM210221 | DENV2 NS4B M29095 | DENV2 NS4B EU569707 |

FIG. 67-79

| Virus Protein Accession No. | Virus Protein Accession No. | Virus Protein Accession No. | Virus Protein Accession No. |
|---|---|---|---|
| DENV2 NS4B M20558 | DENV2 NS4B EU482622 | DENV2 NS4B FJ850085 | DENV2 NS4B FJ850082 |
| DENV2 NS4B EU482663 | DENV2 NS4B EU482693 | DENV2 NS4B FJ410224 | DENV2 NS4B EU596491 |
| DENV2 NS4B DQ645543 | DENV2 NS4B AY744148 | DENV2 NS4B GQ868625 | DENV2 NS4B EU482582 |
| DENV2 NS4B FM210207 | DENV2 NS4B EU687249 | DENV2 NS4B EU854293 | DENV2 NS4B EU482749 |
| DENV2 NS4B FJ873808 | DENV2 NS4B EU482761 | DENV2 NS4B EU482675 | DENV2 NS4B EU482779 |
| DENV2 NS4B FM210203 | DENV2 NS4B FJ639837 | DENV2 NS4B AY776328 | DENV2 NS4B GQ868623 |
| DENV2 NS4B EU687225 | DENV2 NS4B FJ906960 | DENV2 NS4B GU370050 | DENV2 NS4B AF169680 |
| DENV2 NS4B EU596486 | DENV2 NS4B AY702035 | DENV2 NS4B FJ850061 | DENV2 NS4B U87411 |
| DENV2 NS4B AF100459 | DENV2 NS4B GQ868590 | DENV2 NS4B EU660413 | DENV2 NS4B FM210213 |
| DENV2 NS4B EU687238 | DENV2 NS4B GQ199896 | DENV2 NS4B FJ205880 | DENV2 NS4B EU482647 |
| DENV2 NS4B EU482747 | DENV2 NS4B FN429892 | DENV2 NS4B EU687199 | DENV2 NS4B AF169681 |
| DENV2 NS4B GU131928 | DENV2 NS4B EU482466 | DENV2 NS4B DQ181804 | DENV2 NS4B EU482548 |
| DENV2 NS4B FM210226 | DENV2 NS4B FJ639697 | DENV2 NS4B FJ744723 | DENV2 NS4B FJ898439 |
| DENV2 NS4B M84728 | DENV2 NS4B FM210209 | DENV2 NS4B EU482686 | DENV2 NS4B EU482637 |
| DENV2 NS4B FM210230 | DENV2 NS4B AB122022 | DENV2 NS4B EU482605 | DENV2 NS4B EU781135 |
| DENV2 NS4B EU482659 | DENV2 NS4B EU569697 | DENV2 NS4B GQ199900 | DENV2 NS4B DQ645548 |
| DENV2 NS4B AJ487271 | DENV2 NS4B EU482730 | DENV2 NS4B FJ410221 | DENV2 NS4B AB189122 |
| DENV2 NS4B EU660399 | DENV2 NS4B EU482577 | DENV2 NS4B AF100469 | DENV2 NS4B FJ810418 |
| DENV2 NS4B FJ639832 | DENV2 NS4B FJ390384 | DENV2 NS4B FJ898461 | DENV2 NS4B GU131896 |
| DENV2 NS4B EU569698 | DENV2 NS4B CS805344 | DENV2 NS4B EU482550 | DENV2 NS4B EU482765 |
| DENV2 NS4B EU854294 | DENV2 NS4B AY702038 | DENV2 NS4B FM210244 | DENV2 NS4B EU596498 |
| DENV2 NS4B EU482561 | DENV2 NS4B FJ467493 | DENV2 NS4B EU179858 | DENV2 NS4B CS479167 |
| DENV2 NS4B GQ868515 | DENV2 NS4B EU482629 | DENV2 NS4B EU687227 | DENV2 NS4B FJ182012 |
| DENV2 NS4B EU482473 | DENV2 NS4B EU482593 | DENV2 NS4B EU660417 | DENV2 NS4B EF105381 |

FIG. 67-80

| Virus Protein Accession No. | Virus Protein Accession No. | Virus Protein Accession No. | Virus Protein Accession No. |
|---|---|---|---|
| DENV2 NS4B FJ410195 | DENV2 NS4B EU569718 | DENV2 NS4B M14970 | DENV2 NS4B EU482572 |
| DENV2 NS4B AF204178 | DENV2 NS4B FJ639709 | DENV2 NS4B EU482620 | DENV2 NS4B GU131885 |
| DENV2 NS4B FJ226066 | DENV2 NS4B AF169688 | DENV2 NS4B FJ744721 | DENV2 NS4B FJ850116 |
| DENV2 NS4B EU482640 | DENV2 NS4B DQ181799 | DENV2 NS4B EU687220 | DENV2 NS4B FM210218 |
| DENV2 NS4B GQ868592 | DENV2 NS4B GQ199898 | DENV2 NS4B EU687236 | DENV2 NS4B EU482754 |
| DENV2 NS4B FJ639704 | DENV2 NS4B FJ024458 | DENV2 NS4B FJ687442 | DENV2 NS4B EU482756 |
| DENV2 NS4B EU687212 | DENV2 NS4B FJ687436 | DENV2 NS4B EU569705 | DENV2 NS4B DQ181806 |
| DENV2 NS4B AF100462 | DENV2 NS4B FB667404 | DENV2 NS4B EU482780 | DENV2 NS4B FB730117 |
| DENV2 NS4B EU726775 | DENV2 NS4B FJ850063 | DENV2 NS4B EU687231 | DENV2 NS4B EU482737 |
| DENV2 NS4B EU677146 | DENV2 NS4B EU482541 | DENV2 NS4B GQ199866 | DENV2 NS4B AB122020 |
| DENV2 NS4B AF022436 | DENV2 NS4B DQ645554 | DENV2 NS4B FJ850074 | DENV2 NS4B EU482636 |
| DENV2 NS4B EU482680 | DENV2 NS4B EU482657 | DENV2 NS4B EU081178 | DENV2 NS4B EU482557 |
| DENV2 NS4B EU482464 | DENV2 NS4B EU482768 | DENV2 NS4B FJ410215 | DENV2 NS4B EU482701 |
| DENV2 NS4B AF489932 | DENV2 NS4B AF038402 | DENV2 NS4B DQ645555 | DENV2 NS4B FJ024452 |
| DENV2 NS4B GU131864 | DENV2 NS4B FJ850117 | DENV2 NS4B EU482652 | DENV2 NS4B EU569700 |
| DENV2 NS4B FJ390389 | DENV2 NS4B EU482678 | DENV2 NS4B FJ432726 | DENV2 NS4B EU482580 |
| DENV2 NS4B EU687240 | DENV2 NS4B EU482698 | DENV2 NS4B EU482688 | DENV2 NS4B EU482670 |
| DENV2 NS4B DQ645545 | DENV2 NS4B FM210202 | DENV2 NS4B FJ410202 | DENV2 NS4B FJ687437 |
| DENV2 NS4B FJ906959 | DENV2 NS4B EU482594 | DENV2 NS4B GQ868646 | DENV2 NS4B NC_001474 |
| DENV2 NS4B EU621672 | DENV2 NS4B FJ898465 | DENV2 NS4B EU482575 | DENV2 NS4B EU596497 |
| DENV2 NS4B GQ868599 | DENV2 NS4B FJ639834 | DENV2 NS4B FM210246 | DENV2 NS4B EU482704 |
| DENV2 NS4B EU677138 | DENV2 NS4B GQ868553 | DENV2 NS4B FJ898449 | DENV2 NS4B EU569692 |
| DENV2 NS4B EU482783 | DENV2 NS4B FJ850115 | DENV2 NS4B EU482471 | DENV2 NS4B CS477302 |
| DENV2 NS4B EU596484 | DENV2 NS4B EU482627 | DENV2 NS4B FJ744705 | DENV2 NS4B AF169683 |

FIG. 67-81

| Virus Protein | Accession No. | Virus Protein | Accession No. | Virus Protein | Accession No. | Virus Protein | Accession No. |
|---|---|---|---|---|---|---|---|
| DENV2 NS4B | FM210232 | DENV2 NS4B | EU482729 | DENV2 NS4B | AF276619 | DENV2 NS4B | EU482700 |
| DENV2 NS4B | FJ898454 | DENV2 NS4B | EU569710 | DENV2 NS4B | EU482766 | DENV2 NS4B | EU482782 |
| DENV2 NS4B | EU596483 | DENV2 NS4B | FJ547090 | DENV2 NS4B | DQ645549 | DENV2 NS4B | FJ873811 |
| DENV2 NS4B | FJ639700 | DENV2 NS4B | GU131974 | DENV2 NS4B | EU687242 | DENV2 NS4B | EU482758 |
| DENV2 NS4B | GQ199892 | DENV2 NS4B | FJ639833 | DENV2 NS4B | EU482635 | DENV2 NS4B | GQ868624 |
| DENV2 NS4B | M84727 | DENV2 NS4B | FJ410228 | DENV2 NS4B | EU687245 | DENV2 NS4B | FJ744715 |
| DENV2 NS4B | EU677148 | DENV2 NS4B | FM210242 | DENV2 NS4B | AY702039 | DENV2 NS4B | FJ639783 |
| DENV2 NS4B | EU482645 | DENV2 NS4B | FM210228 | DENV2 NS4B | AY744150 | DENV2 NS4B | EU081177 |
| DENV2 NS4B | FJ639733 | DENV2 NS4B | FJ390387 | DENV2 NS4B | EU482734 | DENV2 NS4B | FM210222 |
| DENV2 NS4B | FJ410223 | DENV2 NS4B | EU482608 | DENV2 NS4B | EU726770 | DENV2 NS4B | EU569703 |
| DENV2 NS4B | FM210215 | DENV2 NS4B | EU482447 | DENV2 NS4B | FJ850119 | DENV2 NS4B | EU482667 |
| DENV2 NS4B | FM210210 | DENV2 NS4B | FJ410291 | DENV2 NS4B | EU596489 | DENV2 NS4B | DQ645540 |
| DENV2 NS4B | FJ744708 | DENV2 NS4B | GQ199899 | DENV2 NS4B | EU482470 | DENV2 NS4B | FJ410288 |
| DENV2 NS4B | FJ024454 | DENV2 NS4B | EU482630 | DENV2 NS4B | EU687222 | DENV2 NS4B | GU131930 |
| DENV2 NS4B | FJ810409 | DENV2 NS4B | FJ687445 | DENV2 NS4B | FJ205885 | DENV2 NS4B | AY037116 |
| DENV2 NS4B | EU569695 | DENV2 NS4B | GQ199890 | DENV2 NS4B | AB479042 | DENV2 NS4B | GQ868549 |
| DENV2 NS4B | EF105383 | DENV2 NS4B | EU482651 | DENV2 NS4B | EU482748 | DENV2 NS4B | EU482751 |
| DENV2 NS4B | GU131882 | DENV2 NS4B | EU482658 | DENV2 NS4B | GU131924 | DENV2 NS4B | EU482562 |
| DENV2 NS4B | EU482697 | DENV2 NS4B | EU687235 | DENV2 NS4B | GQ868640 | DENV2 NS4B | FJ850107 |
| DENV2 NS4B | CS479202 | DENV2 NS4B | FJ850091 | DENV2 NS4B | FJ639710 | DENV2 NS4B | FJ898450 |
| DENV2 NS4B | DQ181805 | DENV2 NS4B | FJ639698 | DENV2 NS4B | AF119661 | DENV2 NS4B | EU482570 |
| DENV2 NS4B | EF105378 | DENV2 NS4B | FJ850050 | DENV2 NS4B | EU482545 | DENV2 NS4B | FN429894 |
| DENV2 NS4B | AF022438 | DENV2 NS4B | AB189124 | DENV2 NS4B | EU687215 | DENV2 NS4B | EU482702 |
| DENV2 NS4B | FJ639702 | DENV2 NS4B | EU482771 | DENV2 NS4B | FJ898432 | DENV2 NS4B | EU482743 |

FIG. 67-82

| Virus Protein | Accession No. | Virus Protein | Accession No. | Virus Protein | Accession No. | Virus Protein | Accession No. |
|---|---|---|---|---|---|---|---|
| DENV2 NS4B | EU081179 | DENV2 NS4B | FJ639828 | DENV2 NS4B | EU482632 | DENV2 NS4B | GQ868597 |
| DENV2 NS4B | EU529694 | DENV2 NS4B | EU482691 | DENV2 NS4B | FJ373299 | DENV2 NS4B | GQ199869 |
| DENV2 NS4B | EU660405 | DENV2 NS4B | FJ687439 | DENV2 NS4B | EU482683 | DENV2 NS4B | EU482449 |
| DENV2 NS4B | FJ859028 | DENV2 NS4B | GQ199874 | DENV2 NS4B | EU482569 | DENV2 NS4B | EU482773 |
| DENV2 NS4B | GQ252676 | DENV2 NS4B | EU687217 | DENV2 NS4B | EU482674 | DENV2 NS4B | EU569701 |
| DENV2 NS4B | FJ850065 | DENV2 NS4B | EU482731 | DENV2 NS4B | FJ478459 | DENV2 NS4B | EU482738 |
| DENV2 NS4B | EU482589 | DENV2 NS4B | EU529706 | DENV2 NS4B | FJ850121 | DENV2 NS4B | EU482468 |
| DENV2 NS4B | EU482641 | DENV2 NS4B | EU482656 | DENV2 NS4B | FJ205879 | DENV2 NS4B | EU482633 |
| DENV2 NS4B | FJ390385 | DENV2 NS4B | EU482543 | DENV2 NS4B | FJ687434 | DENV2 NS4B | GU131886 |
| DENV2 NS4B | EU482784 | DENV2 NS4B | EU482732 | DENV2 NS4B | EU482450 | DENV2 NS4B | EU677141 |
| DENV2 NS4B | EU482727 | DENV2 NS4B | EU482643 | DENV2 NS4B | FJ850053 | DENV2 NS4B | GQ868557 |
| DENV2 NS4B | FM210212 | DENV2 NS4B | DQ645542 | DENV2 NS4B | EU056811 | DENV2 NS4B | AJ968413 |
| DENV2 NS4B | GQ868588 | DENV2 NS4B | EU482695 | DENV2 NS4B | EU596487 | DENV2 NS4B | FJ639835 |
| DENV2 NS4B | EU569721 | DENV2 NS4B | FJ744745 | DENV2 NS4B | EU482626 | DENV2 NS4B | EU482579 |
| DENV2 NS4B | EU482654 | DENV2 NS4B | FM210205 | DENV2 NS4B | EU482586 | DENV2 NS4B | GU131881 |
| DENV2 NS4B | GU369819 | DENV2 NS4B | GQ868622 | DENV2 NS4B | EU482665 | DENV2 NS4B | GQ868556 |
| DENV2 NS4B | GQ868541 | DENV2 NS4B | EU660414 | DENV2 NS4B | FJ898452 | DENV2 NS4B | FJ744741 |
| DENV2 NS4B | EU569711 | DENV2 NS4B | FJ461309 | DENV2 NS4B | FM210219 | DENV2 NS4B | FB667399 |
| DENV2 NS4B | EU482553 | DENV2 NS4B | EU482745 | DENV2 NS4B | EF105385 | DENV2 NS4B | AF100466 |
| DENV2 NS4B | FJ639717 | DENV2 NS4B | EU482601 | DENV2 NS4B | GQ868596 | DENV2 NS4B | FJ390390 |
| DENV2 NS4B | CS477304 | DENV2 NS4B | AY702037 | DENV2 NS4B | FJ744719 | DENV2 NS4B | GQ199894 |
| DENV2 NS4B | FJ687447 | DENV2 NS4B | FJ639830 | DENV2 NS4B | FJ744713 | DENV2 NS4B | FJ898434 |
| DENV2 NS4B | FM210240 | DENV2 NS4B | FM210234 | DENV2 NS4B | EU482475 | DENV2 NS4B | EU482597 |
| DENV2 NS4B | EU482672 | DENV2 NS4B | EU482787 | DENV2 NS4B | FJ461311 | DENV2 NS4B | FJ906969 |

FIG. 67-83

| Virus Protein | Accession No. | Virus Protein | Accession No. | Virus Protein | Accession No. | Virus Protein | Accession No. |
|---|---|---|---|---|---|---|---|
| DENV2 NS4B | AF169679 | DENV2 NS4B | EU687213 | DENV2 NS4B | GU131931 | DENV2 NS4B | DQ181803 |
| DENV2 NS4B | FJ461321 | DENV2 NS4B | FM210239 | DENV2 NS4B | FJ906961 | DENV2 NS4B | EU482786 |
| DENV2 NS4B | EU687224 | DENV2 NS4B | DQ645556 | DENV2 NS4B | EU529700 | DENV2 NS4B | EF105389 |
| DENV2 NS4B | FJ687440 | DENV2 NS4B | EU081180 | DENV2 NS4B | EU482576 | DENV2 NS4B | EU482781 |
| DENV2 NS4B | EF105380 | DENV2 NS4B | AF204177 | DENV2 NS4B | EU482703 | DENV2 NS4B | EU482638 |
| DENV2 NS4B | AF100467 | DENV2 NS4B | EU482679 | DENV2 NS4B | EU482685 | DENV2 NS4B | FM210217 |
| DENV2 NS4B | EU482753 | DENV2 NS4B | EU482472 | DENV2 NS4B | FM210214 | DENV2 NS4B | EF105382 |
| DENV2 NS4B | AF022439 | DENV2 NS4B | AY858035 | DENV2 NS4B | FJ744724 | DENV2 NS4B | FJ744742 |
| DENV2 NS4B | AF100460 | DENV2 NS4B | EU596490 | DENV2 NS4B | FM210245 | DENV2 NS4B | GU131897 |
| DENV2 NS4B | EU596495 | DENV2 NS4B | FJ850051 | DENV2 NS4B | GQ199895 | DENV2 NS4B | EU482584 |
| DENV2 NS4B | FJ373301 | DENV2 NS4B | EU482446 | DENV2 NS4B | EU482604 | DENV2 NS4B | EU482624 |
| DENV2 NS4B | FJ906962 | DENV2 NS4B | EU482694 | DENV2 NS4B | FM210236 | DENV2 NS4B | EU482725 |
| DENV2 NS4B | FJ850105 | DENV2 NS4B | GQ868591 | DENV2 NS4B | EU482736 | DENV2 NS4B | FJ810410 |
| DENV2 NS4B | EU482542 | DENV2 NS4B | FJ461305 | DENV2 NS4B | EU482551 | DENV2 NS4B | EU482726 |
| DENV2 NS4B | AY702036 | DENV2 NS4B | FJ744709 | DENV2 NS4B | DQ645546 | DENV2 NS4B | FJ024475 |
| DENV2 NS4B | AY744147 | DENV2 NS4B | GQ199868 | DENV2 NS4B | EU687228 | DENV2 NS4B | FJ744704 |
| DENV2 NS4B | FM210227 | DENV2 NS4B | EU660400 | DENV2 NS4B | EF105387 | DENV2 NS4B | EU482599 |
| DENV2 NS4B | FM210231 | DENV2 NS4B | EU482465 | DENV2 NS4B | EU482648 | DENV2 NS4B | FJ744712 |
| DENV2 NS4B | FN429891 | DENV2 NS4B | FM210208 | DENV2 NS4B | FJ639705 | DENV2 NS4B | EU482681 |
| DENV2 NS4B | EU482676 | DENV2 NS4B | EU482669 | DENV2 NS4B | FJ906968 | DENV2 NS4B | FJ639831 |
| DENV2 NS4B | GQ868604 | DENV2 NS4B | EU529695 | DENV2 NS4B | AF100464 | DENV2 NS4B | EU569708 |
| DENV2 NS4B | GQ868516 | DENV2 NS4B | FJ850062 | DENV2 NS4B | EU677145 | DENV2 NS4B | EU482583 |
| DENV2 NS4B | EU482769 | DENV2 NS4B | GQ199901 | DENV2 NS4B | EU596485 | DENV2 NS4B | EU482444 |
| DENV2 NS4B | FJ744717 | DENV2 NS4B | EU359009 | DENV2 NS4B | FJ898477 | DENV2 NS4B | EU482762 |

FIG. 67-84

| Virus Protein Accession No. | Virus Protein Accession No. | Virus Protein Accession No. | Virus Protein Accession No. |
|---|---|---|---|
| DENV2 NS4B EU482662 | DENV2 NS4B EU482719 | DENV2 NS4B FJ687443 | DENV2 NS4B EU482764 |
| DENV2 NS4B EU569696 | DENV2 NS4B EU482448 | DENV2 NS4B FJ744710 | DENV2 NS4B FJ478455 |
| DENV2 NS4B EU482760 | DENV2 NS4B EU482720 | DENV2 NS4B AY702040 | DENV2 NS4B EU179857 |
| DENV2 NS4B GU131959 | DENV2 NS4B EU687237 | DENV2 NS4B FJ898466 | DENV2 NS4B FJ024473 |
| DENV2 NS4B AB479041 | DENV2 NS4B AB122021 | DENV2 NS4B GQ252677 | DENV2 NS4B EU660416 |
| DENV2 NS4B DQ645552 | DENV2 NS4B EU687248 | DENV2 NS4B FJ906966 | DENV2 NS4B DQ645547 |
| DENV2 NS4B EU482776 | DENV2 NS4B EU482767 | DENV2 NS4B GU289914 | DENV2 NS4B GM059692 |
| DENV2 NS4B GQ868543 | DENV2 NS4B DQ181798 | DENV2 NS4B FJ744706 | DENV2 NS4B EU569694 |
| DENV2 NS4B FJ410237 | DENV2 NS4B EU482735 | DENV2 NS4B EU596496 | DENV2 NS4B FJ898436 |
| DENV2 NS4B AF169686 | DENV2 NS4B FJ850112 | DENV2 NS4B EU482560 | DENV2 NS4B FM210216 |
| DENV2 NS4B FJ639707 | DENV2 NS4B EU569719 | DENV2 NS4B EU482723 | DENV2 NS4B FM210224 |
| DENV2 NS4B FJ850120 | DENV2 NS4B EU660398 | DENV2 NS4B EU482741 | DENV2 NS4B EU482778 |
| DENV2 NS4B FJ639822 | DENV2 NS4B GQ199897 | DENV2 NS4B EU482549 | DENV2 NS4B FJ810412 |
| DENV2 NS4B EU482699 | DENV2 NS4B EU482677 | DENV2 NS4B EU482573 | DENV2 NS4B GU131899 |
| DENV2 NS4B GQ868552 | DENV2 NS4B GQ868545 | DENV2 NS4B EU482755 | DENV2 NS4B FJ639703 |
| DENV2 NS4B EU660406 | DENV2 NS4B EU482621 | DENV2 NS4B FN429893 | DENV2 NS4B EF105384 |
| DENV2 NS4B EU569715 | DENV2 NS4B EU687243 | DENV2 NS4B AF022434 | DENV2 NS4B AB189123 |
| DENV2 NS4B FJ898467 | DENV2 NS4B EU482463 | DENV2 NS4B EU529693 | DENV2 NS4B FM210233 |
| DENV2 NS4B EF051521 | DENV2 NS4B EU482606 | DENV2 NS4B EU596499 | DENV2 NS4B FJ639699 |
| DENV2 NS4B GQ868497 | DENV2 NS4B DQ645553 | DENV2 NS4B EU482687 | DENV2 NS4B FJ182014 |
| DENV2 NS4B EU003591 | DENV2 NS4B AF038403 | DENV2 NS4B AF022440 | DENV2 NS4B FJ562098 |
| DENV2 NS4B EU569699 | DENV2 NS4B FM210204 | DENV2 NS4B GU131884 | DENV2 NS4B FJ913016 |
| DENV2 NS4B EU482547 | DENV2 NS4B GQ868554 | DENV2 NS4B EU482757 | DENV2 NS4B EU482746 |
| DENV2 NS4B FJ850064 | DENV2 NS4B DQ448231 | DENV2 NS4B EU482574 | DENV2 NS4B EU482646 |

FIG. 67-85

| Virus Protein | Accession No. | Virus Protein | Accession No. | Virus Protein | Accession No. | Virus Protein | Accession No. |
|---|---|---|---|---|---|---|---|
| DENV2 NS4B | FJ687444 | DENV2 NS4B | EU482668 | DENV2 NS4B | FJ850066 | DENV2 NS4B | FJ639829 |
| DENV2 NS4B | GU131901 | DENV2 NS4B | GQ868598 | DENV2 NS4B | EU482556 | DENV2 NS4B | FJ898453 |
| DENV2 NS4B | GQ868550 | DENV2 NS4B | EU529701 | DENV2 NS4B | FJ744744 | DENV2 NS4B | EU482721 |
| DENV2 NS4B | EU482660 | DENV2 NS4B | EU482451 | DENV2 NS4B | FJ639788 | DENV2 NS4B | FJ898460 |
| DENV2 NS4B | FJ410219 | DENV2 NS4B | FJ882602 | DENV2 NS4B | FN429895 | DENV2 NS4B | FJ898438 |
| DENV2 NS4B | EU569717 | DENV2 NS4B | EU482666 | DENV2 NS4B | FJ850060 | DENV2 NS4B | EU569712 |
| DENV2 NS4B | AF022435 | DENV2 NS4B | EU482634 | DENV2 NS4B | EU660404 | DENV2 NS4B | EU687250 |
| DENV2 NS4B | EU482788 | DENV2 NS4B | DQ645550 | DENV2 NS4B | EU482690 | DENV2 NS4B | FJ432724 |
| DENV2 NS4B | FJ744743 | DENV2 NS4B | GQ868558 | DENV2 NS4B | EU569720 | DENV2 NS4B | AF022437 |
| DENV2 NS4B | FJ906956 | DENV2 NS4B | GQ868542 | DENV2 NS4B | FJ687441 | DENV2 NS4B | DQ181800 |
| DENV2 NS4B | EU482607 | DENV2 NS4B | EU569706 | DENV2 NS4B | AF169678 | DENV2 NS4B | EU687241 |
| DENV2 NS4B | EU726776 | DENV2 NS4B | GQ868631 | DENV2 NS4B | AF100468 | DENV2 NS4B | FJ410200 |
| DENV2 NS4B | EU687230 | DENV2 NS4B | EU482628 | DENV2 NS4B | EU482722 | DENV2 NS4B | FJ205878 |
| DENV2 NS4B | EU482581 | DENV2 NS4B | FJ850108 | DENV2 NS4B | GU131883 | DENV2 NS4B | GU131955 |
| DENV2 NS4B | EU482600 | DENV2 NS4B | EU687214 | DENV2 NS4B | FM210235 | DENV2 NS4B | FJ906958 |
| DENV2 NS4B | GU131927 | DENV2 NS4B | EU482689 | DENV2 NS4B | FJ744707 | DENV2 NS4B | FJ744722 |
| DENV2 NS4B | FJ850076 | DENV2 NS4B | FJ882594 | DENV2 NS4B | EU482588 | DENV2 NS4B | EU482770 |
| DENV2 NS4B | GQ868638 | DENV2 NS4B | FJ744716 | DENV2 NS4B | EU677149 | DENV2 NS4B | AY744149 |
| DENV2 NS4B | EU482625 | DENV2 NS4B | EU482546 | DENV2 NS4B | FJ639734 | DENV2 NS4B | EU482655 |
| DENV2 NS4B | GU131843 | DENV2 NS4B | FJ410233 | DENV2 NS4B | GQ868555 | DENV2 NS4B | EU677137 |
| DENV2 NS4B | EU482469 | DENV2 NS4B | GQ868600 | DENV2 NS4B | GQ868540 | DENV2 NS4B | EU482744 |
| DENV2 NS4B | EU482772 | DENV2 NS4B | GU131898 | DENV2 NS4B | AF169682 | DENV2 NS4B | FJ639701 |
| DENV2 NS4B | FM210225 | DENV2 NS4B | AY858036 | DENV2 NS4B | DQ181797 | DENV2 NS4B | EU660415 |
| DENV2 NS4B | AF100461 | DENV2 NS4B | EU687244 | DENV2 NS4B | FJ687446 | DENV2 NS4B | EU482631 |

FIG. 67-86

| Virus Protein Accession No. | Virus Protein Accession No. | Virus Protein Accession No. | Virus Protein Accession No. |
|---|---|---|---|
| DENV2 NS4B FJ687435 | DENV2 NS4B EU482774 | DENV2 NS4B FJ850054 | DENV2 NS4B DQ645544 |
| DENV2 NS4B FJ639836 | DENV2 NS4B FJ547067 | DENV2 NS4B EU482565 | DENV2 NS4B FM210238 |
| DENV2 NS4B AY702034 | DENV2 NS4B EU482474 | DENV2 NS4B FJ373300 | DENV2 NS4B EF105379 |
| DENV2 NS4B EU482696 | DENV2 NS4B FJ850118 | DENV2 NS4B AF169684 | DENV2 NS4B EU482728 |
| DENV2 NS4B FJ687438 | DENV2 NS4B EU687216 | DENV2 NS4B DL138662 | DENV2 NS4B FM210229 |
| DENV2 NS4B EU596488 | DENV2 NS4B EU482590 | DENV2 NS4B GQ868544 | DENV2 NS4B GU131880 |
| DENV2 NS4B FM210220 | DENV2 NS4B AF208496 | DENV2 NS4B FJ744714 | DENV2 NS4B M19197 |
| DENV2 NS4B FJ898451 | DENV2 NS4B EU569693 | DENV2 NS4B EU179859 | DENV2 NS4B GQ868603 |
| DENV2 NS4B FJ639708 | DENV2 NS4B FJ850106 | DENV2 NS4B DQ645541 | DENV2 NS4B GU131929 |
| DENV2 NS4B EU687229 | DENV2 NS4B EU482623 | DENV2 NS4B AF100465 | DENV2 NS4B FJ639732 |
| DENV2 NS4B EU482739 | DENV2 NS4B GU131879 | DENV2 NS4B EU687246 | DENV2 NS4B EU677143 |
| DENV2 NS4B EU569709 | DENV2 NS4B FM210223 | DENV2 NS4B EU482750 | DENV2 NS4B EU482682 |
| DENV2 NS4B EU687223 | DENV2 NS4B GQ199893 | DENV2 NS4B GU131900 | DENV2 NS4B GQ868641 |
| DENV2 NS4B EF105386 | DENV2 NS4B EU482578 | DENV2 NS4B FM210211 | DENV2 NS4B EU482785 |
| DENV2 NS4B FJ410217 | DENV2 NS4B EU482544 | DENV2 NS4B EU482742 | DENV2 NS4B FJ410193 |
| DENV2 NS4B EU482467 | DENV2 NS4B EU482759 | DENV2 NS4B EU482705 | DENV2 NS4B EU482552 |
| DENV2 NS4B FJ461314 | DENV2 NS4B FJ744711 | DENV2 NS4B EF105390 | DENV2 NS4B EU677142 |
| DENV2 NS4B GQ868595 | DENV2 NS4B EU569704 | DENV2 NS4B EU482684 | DENV2 NS4B EU687232 |
| DENV2 NS4B GU131932 | DENV2 NS4B AF169685 | DENV2 NS4B EU569714 | DENV2 NS4B FM210241 |
| DENV2 NS4B EU056810 | DENV2 NS4B EU677147 | DENV2 NS4B GQ868589 | DENV2 NS4B FJ744725 |
| DENV2 NS4B AF022441 | DENV2 NS4B GU370051 | DENV2 NS4B FJ850078 | DENV2 NS4B GQ868621 |
| DENV2 NS4B EU056812 | DENV2 NS4B EU482587 | DENV2 NS4B FM210243 | DENV2 NS4B EU482653 |
| DENV2 NS4B EU482664 | DENV2 NS4B DQ645551 | DENV2 NS4B EU482671 | DENV2 NS4B FJ024477 |
| DENV2 NS4B EU482568 | DENV2 NS4B FJ390391 | DENV2 NS4B EU482571 | DENV2 NS4B U87412 |

FIG. 67-87

| Virus Protein Accession No. | Virus Protein Accession No. | Virus Protein Accession No. | Virus Protein Accession No. |
|---|---|---|---|
| DENV2 NS4B EU482692 | DENV2 NS5FJ898435 | DENV2 NS5AF100459 | DENV2 NS5EU660413 |
| DENV2 NS4B FM210206 | DENV2 NS5FJ547064 | DENV2 NS5EU687238 | DENV2 NS5FJ205880 |
| DENV2 NS4B EU482644 | DENV2 NS5EU677144 | DENV2 NS5EU482747 | DENV2 NS5EU687199 |
| DENV2 NS4B GU131975 | DENV2 NS5EU569716 | DENV2 NS5GU131928 | DENV2 NS5DQ181804 |
| DENV2 NS4B EU482602 | DENV2 NS5EU482752 | DENV2 NS5FM210226 | DENV2 NS5FJ744723 |
| DENV2 NS4B EU482673 | DENV2 NS5FJ906967 | DENV2 NS5M84728 | DENV2 NS5EU482686 |
| DENV2 NS4B FJ024474 | DENV2 NS5FJ410241 | DENV2 NS5FM210230 | DENV2 NS5EU482605 |
| DENV2 NS4B FJ744720 | DENV2 NS5FJ639706 | DENV2 NS5EU482659 | DENV2 NS5GQ199900 |
| DENV2 NS4B FJ639809 | DENV2 NS5EU596500 | DENV2 NS5AJ487271 | DENV2 NS5FJ410221 |
| DENV2 NS4B FJ639718 | DENV2 NS5FJ410208 | DENV2 NS5EU660399 | DENV2 NS5AF100469 |
| DENV2 NS4B DQ181802 | DENV2 NS5FJ906957 | DENV2 NS5FJ639832 | DENV2 NS5FJ898461 |
| DENV2 NS4B FJ810411 | DENV2 NS5EU569702 | DENV2 NS5EU569698 | DENV2 NS5EU482550 |
| DENV2 NS4B EU482554 | DENV2 NS5FJ898478 | DENV2 NS5EU854294 | DENV2 NS5FM210244 |
| DENV2 NS4B FM210237 | DENV2 NS5FJ882593 | DENV2 NS5EU482561 | DENV2 NS5EU179858 |
| DENV2 NS4B EU482603 | DENV2 NS5EU482763 | DENV2 NS5GQ868515 | DENV2 NS5EU687227 |
| DENV2 NS4B EU482733 | DENV2 NS5EU482661 | DENV2 NS5EU482473 | DENV2 NS5EU660417 |
| DENV2 NS4B FJ850088 | DENV2 NS5M29095 | DENV2 NS5EU482622 | DENV2 NS5FJ850082 |
| DENV2 NS4B M14970 | DENV2 NS5EU482585 | DENV2 NS5EU482693 | DENV2 NS5EU596491 |
| DENV2 NS5CS479165 | DENV2 NS5FJ639711 | DENV2 NS5AY744148 | DENV2 NS5EU482582 |
| DENV2 NS5FJ205877 | DENV2 NS5FJ850067 | DENV2 NS5EU687249 | DENV2 NS5EU482749 |
| DENV2 NS5EU726767 | DENV2 NS5EU482777 | DENV2 NS5EU482761 | DENV2 NS5EU482779 |
| DENV2 NS5EU482649 | DENV2 NS5FJ898479 | DENV2 NS5FJ639837 | DENV2 NS5GQ868623 |
| DENV2 NS5FM210221 | DENV2 NS5AF100463 | DENV2 NS5FJ906960 | DENV2 NS5AF169680 |
| DENV2 NS5EU482740 | DENV2 NS5FJ744703 | DENV2 NS5AY702035 | DENV2 NS5U87411 |
| DENV2 NS5EF105388 | DENV2 NS5EU482642 | DENV2 NS5GQ868590 | DENV2 NS5FM210213 |
| DENV2 NS5FJ410259 | DENV2 NS5FJ744718 | DENV2 NS5GQ199896 | DENV2 NS5EU482647 |
| DENV2 NS5FJ024461 | DENV2 NS5EF457904 | DENV2 NS5FN429892 | DENV2 NS5AF169681 |
| DENV2 NS5DQ181801 | DENV2 NS5AF169687 | DENV2 NS5EU482466 | DENV2 NS5EU482548 |
| DENV2 NS5EU482650 | DENV2 NS5FJ850072 | DENV2 NS5FJ639697 | DENV2 NS5FJ898439 |
| DENV2 NS5EU482724 | DENV2 NS5EU482445 | DENV2 NS5FM210209 | DENV2 NS5EU482637 |
| | DENV2 NS5EU482598 | DENV2 NS5AB122022 | DENV2 NS5EU781135 |
| | DENV2 NS5AF359579 | DENV2 NS5EU569697 | DENV2 NS5DQ645548 |
| | DENV2 NS5EU482639 | DENV2 NS5EU482730 | DENV2 NS5AB189122 |
| | DENV2 NS5GQ868551 | DENV2 NS5EU482577 | DENV2 NS5FJ810418 |
| | DENV2 NS5EU569713 | DENV2 NS5FJ390384 | DENV2 NS5GU131896 |
| | DENV2 NS5EU482775 | DENV2 NS5CS805344 | DENV2 NS5EU482765 |
| | DENV2 NS5GQ868620 | DENV2 NS5AY702038 | DENV2 NS5EU596498 |
| | DENV2 NS5GU131902 | DENV2 NS5FJ467493 | DENV2 NS5CS479167 |
| | DENV2 NS5GU131947 | DENV2 NS5EU482629 | DENV2 NS5FJ182012 |
| | DENV2 NS5EU569707 | DENV2 NS5EU482593 | DENV2 NS5EF105381 |
| | DENV2 NS5M20558 | DENV2 NS5FJ850085 | DENV2 NS5FJ410195 |
| | DENV2 NS5EU482663 | DENV2 NS5FJ410224 | DENV2 NS5AF204178 |
| | DENV2 NS5DQ645543 | DENV2 NS5GQ868625 | DENV2 NS5FJ226066 |
| | DENV2 NS5FM210207 | DENV2 NS5EU854293 | DENV2 NS5EU482640 |
| | DENV2 NS5FJ873808 | DENV2 NS5EU482675 | DENV2 NS5GQ868592 |
| | DENV2 NS5FM210203 | DENV2 NS5AY776328 | DENV2 NS5FJ639704 |
| | DENV2 NS5EU687225 | DENV2 NS5GU370050 | DENV2 NS5EU687212 |
| | DENV2 NS5EU596486 | DENV2 NS5FJ850061 | DENV2 NS5AF100462 |

FIG. 67-88

| Virus Protein Accession No. | Virus Protein Accession No. | Virus Protein Accession No. | Virus Protein Accession No. |
|---|---|---|---|
| DENV2 NS5EU726775 | DENV2 NS5GQ199866 | DENV2 NS5FJ410223 | DENV2 NS5EU726770 |
| DENV2 NS5EU677146 | DENV2 NS5FJ850074 | DENV2 NS5FM210215 | DENV2 NS5FJ850119 |
| DENV2 NS5AF022436 | DENV2 NS5EU081178 | DENV2 NS5FM210210 | DENV2 NS5EU596489 |
| DENV2 NS5EU482680 | DENV2 NS5FJ410215 | DENV2 NS5FJ744708 | DENV2 NS5EU482470 |
| DENV2 NS5EU482464 | DENV2 NS5DQ645555 | DENV2 NS5FJ024454 | DENV2 NS5EU687222 |
| DENV2 NS5AF489932 | DENV2 NS5EU482652 | DENV2 NS5FJ810409 | DENV2 NS5FJ205885 |
| DENV2 NS5GU131864 | DENV2 NS5FJ432726 | DENV2 NS5EU569695 | DENV2 NS5AB479042 |
| DENV2 NS5FJ390389 | DENV2 NS5EU482688 | DENV2 NS5EF105383 | DENV2 NS5EU482748 |
| DENV2 NS5EU687240 | DENV2 NS5FJ410202 | DENV2 NS5GU131882 | DENV2 NS5GU131924 |
| DENV2 NS5DQ645545 | DENV2 NS5GQ868646 | DENV2 NS5EU482697 | DENV2 NS5GQ868640 |
| DENV2 NS5FJ906959 | DENV2 NS5EU482575 | DENV2 NS5CS479202 | DENV2 NS5FJ639710 |
| DENV2 NS5EU621672 | DENV2 NS5FM210246 | DENV2 NS5DQ181805 | DENV2 NS5AF119661 |
| DENV2 NS5GQ868599 | DENV2 NS5FJ898449 | DENV2 NS5EF105378 | DENV2 NS5EU482545 |
| DENV2 NS5EU677138 | DENV2 NS5EU482471 | DENV2 NS5AF022438 | DENV2 NS5EU687215 |
| DENV2 NS5EU482783 | DENV2 NS5FJ744705 | DENV2 NS5FJ639702 | DENV2 NS5FJ898432 |
| DENV2 NS5EU596484 | DENV2 NS5EU482572 | DENV2 NS5EU482729 | DENV2 NS5EU482700 |
| DENV2 NS5EU569718 | DENV2 NS5GU131885 | DENV2 NS5EU569710 | DENV2 NS5EU482782 |
| DENV2 NS5FJ639709 | DENV2 NS5FJ850116 | DENV2 NS5FJ547090 | DENV2 NS5FJ873811 |
| DENV2 NS5AF169688 | DENV2 NS5FM210218 | DENV2 NS5GU131974 | DENV2 NS5EU482758 |
| DENV2 NS5DQ181799 | DENV2 NS5EU482754 | DENV2 NS5FJ639833 | DENV2 NS5GQ868624 |
| DENV2 NS5GQ199898 | DENV2 NS5EU482756 | DENV2 NS5FJ410228 | DENV2 NS5FJ744715 |
| DENV2 NS5FJ024458 | DENV2 NS5DQ181806 | DENV2 NS5FM210242 | DENV2 NS5FJ639783 |
| DENV2 NS5FJ687436 | DENV2 NS5FB730117 | DENV2 NS5FM210228 | DENV2 NS5EU081177 |
| DENV2 NS5FB667404 | DENV2 NS5EU482737 | DENV2 NS5FJ390387 | DENV2 NS5FM210222 |
| DENV2 NS5FJ850063 | DENV2 NS5AB122020 | DENV2 NS5EU482608 | DENV2 NS5EU569703 |
| DENV2 NS5EU482541 | DENV2 NS5EU482636 | DENV2 NS5EU482447 | DENV2 NS5EU482667 |
| DENV2 NS5DQ645554 | DENV2 NS5EU482557 | DENV2 NS5FJ410291 | DENV2 NS5DQ645540 |
| DENV2 NS5EU482657 | DENV2 NS5EU482701 | DENV2 NS5GQ199899 | DENV2 NS5FJ410288 |
| DENV2 NS5EU482768 | DENV2 NS5FJ024452 | DENV2 NS5EU482630 | DENV2 NS5GU131930 |
| DENV2 NS5AF038402 | DENV2 NS5EU569700 | DENV2 NS5FJ687445 | DENV2 NS5AY037116 |
| DENV2 NS5FJ850117 | DENV2 NS5EU482580 | DENV2 NS5GQ199890 | DENV2 NS5GQ868549 |
| DENV2 NS5EU482678 | DENV2 NS5EU482670 | DENV2 NS5EU482651 | DENV2 NS5EU482751 |
| DENV2 NS5EU482698 | DENV2 NS5FJ687437 | DENV2 NS5EU482658 | DENV2 NS5EU482562 |
| DENV2 NS5FM210202 | DENV2 NS5NC_001474 | DENV2 NS5EU687235 | DENV2 NS5FJ850107 |
| DENV2 NS5EU482594 | DENV2 NS5EU596497 | DENV2 NS5FJ850091 | DENV2 NS5FJ898450 |
| DENV2 NS5FJ898465 | DENV2 NS5EU482704 | DENV2 NS5FJ639698 | DENV2 NS5EU482570 |
| DENV2 NS5FJ639834 | DENV2 NS5EU569692 | DENV2 NS5FJ850050 | DENV2 NS5FN429894 |
| DENV2 NS5GQ868553 | DENV2 NS5CS477302 | DENV2 NS5AB189124 | DENV2 NS5EU482702 |
| DENV2 NS5FJ850115 | DENV2 NS5AF169683 | DENV2 NS5EU482771 | DENV2 NS5EU482743 |
| DENV2 NS5EU482627 | DENV2 NS5FM210232 | DENV2 NS5AF276619 | DENV2 NS5EU081179 |
| DENV2 NS5EU482620 | DENV2 NS5FJ898454 | DENV2 NS5EU482766 | DENV2 NS5EU529694 |
| DENV2 NS5FJ744721 | DENV2 NS5EU596483 | DENV2 NS5DQ645549 | DENV2 NS5EU660405 |
| DENV2 NS5EU687220 | DENV2 NS5FJ639700 | DENV2 NS5EU687242 | DENV2 NS5FJ859028 |
| DENV2 NS5EU687236 | DENV2 NS5GQ199892 | DENV2 NS5EU482635 | DENV2 NS5GQ252676 |
| DENV2 NS5FJ687442 | DENV2 NS5M84727 | DENV2 NS5EU687245 | DENV2 NS5FJ850065 |
| DENV2 NS5EU569705 | DENV2 NS5EU677148 | DENV2 NS5AY702039 | DENV2 NS5EU482589 |
| DENV2 NS5EU482780 | DENV2 NS5EU482645 | DENV2 NS5AY744150 | DENV2 NS5EU482641 |
| DENV2 NS5EU687231 | DENV2 NS5FJ639733 | DENV2 NS5EU482734 | DENV2 NS5FJ390385 |

FIG. 67-89

| Virus Protein Accession No. | Virus Protein Accession No. | Virus Protein Accession No. | Virus Protein Accession No. |
|---|---|---|---|
| DENV2 NS5EU482784 | DENV2 NS5EU482450 | DENV2 NS5EU596495 | DENV2 NS5GQ199895 |
| DENV2 NS5EU482727 | DENV2 NS5FJ850053 | DENV2 NS5FJ373301 | DENV2 NS5EU482604 |
| DENV2 NS5FM210212 | DENV2 NS5EU056811 | DENV2 NS5FJ906962 | DENV2 NS5FM210236 |
| DENV2 NS5GQ868588 | DENV2 NS5EU596487 | DENV2 NS5FJ850105 | DENV2 NS5EU482736 |
| DENV2 NS5EU569721 | DENV2 NS5EU482626 | DENV2 NS5EU482542 | DENV2 NS5EU482551 |
| DENV2 NS5EU482654 | DENV2 NS5EU482586 | DENV2 NS5AY702036 | DENV2 NS5DQ645546 |
| DENV2 NS5GU369819 | DENV2 NS5EU482665 | DENV2 NS5AY744147 | DENV2 NS5EU687228 |
| DENV2 NS5GQ868541 | DENV2 NS5FJ898452 | DENV2 NS5FM210227 | DENV2 NS5EF105387 |
| DENV2 NS5EU569711 | DENV2 NS5FM210219 | DENV2 NS5FM210231 | DENV2 NS5EU482648 |
| DENV2 NS5EU482553 | DENV2 NS5EF105385 | DENV2 NS5FN429891 | DENV2 NS5FJ639705 |
| DENV2 NS5FJ639717 | DENV2 NS5GQ868596 | DENV2 NS5EU482676 | DENV2 NS5FJ906968 |
| DENV2 NS5CS477304 | DENV2 NS5FJ744719 | DENV2 NS5GQ868604 | DENV2 NS5AF100464 |
| DENV2 NS5FJ687447 | DENV2 NS5FJ744713 | DENV2 NS5GQ868516 | DENV2 NS5EU677145 |
| DENV2 NS5FM210240 | DENV2 NS5EU482475 | DENV2 NS5EU482769 | DENV2 NS5EU596485 |
| DENV2 NS5EU482672 | DENV2 NS5FJ461311 | DENV2 NS5FJ744717 | DENV2 NS5FJ898477 |
| DENV2 NS5FJ639828 | DENV2 NS5GQ868597 | DENV2 NS5EU687213 | DENV2 NS5DQ181803 |
| DENV2 NS5EU482691 | DENV2 NS5GQ199869 | DENV2 NS5FM210239 | DENV2 NS5EU482786 |
| DENV2 NS5FJ687439 | DENV2 NS5EU482449 | DENV2 NS5DQ645556 | DENV2 NS5EF105389 |
| DENV2 NS5GQ199874 | DENV2 NS5EU482773 | DENV2 NS5EU081180 | DENV2 NS5EU482781 |
| DENV2 NS5EU687217 | DENV2 NS5EU569701 | DENV2 NS5AF204177 | DENV2 NS5EU482638 |
| DENV2 NS5EU482731 | DENV2 NS5EU482738 | DENV2 NS5EU482679 | DENV2 NS5FM210217 |
| DENV2 NS5EU529706 | DENV2 NS5EU482468 | DENV2 NS5EU482472 | DENV2 NS5EF105382 |
| DENV2 NS5EU482656 | DENV2 NS5EU482633 | DENV2 NS5AY858035 | DENV2 NS5FJ744742 |
| DENV2 NS5EU482543 | DENV2 NS5GU131886 | DENV2 NS5EU596490 | DENV2 NS5GU131897 |
| DENV2 NS5EU482732 | DENV2 NS5EU677141 | DENV2 NS5FJ850051 | DENV2 NS5EU482584 |
| DENV2 NS5EU482643 | DENV2 NS5GQ868557 | DENV2 NS5EU482446 | DENV2 NS5EU482624 |
| DENV2 NS5DQ645542 | DENV2 NS5AJ968413 | DENV2 NS5EU482694 | DENV2 NS5EU482725 |
| DENV2 NS5EU482695 | DENV2 NS5FJ639835 | DENV2 NS5GQ868591 | DENV2 NS5FJ810410 |
| DENV2 NS5FJ744745 | DENV2 NS5EU482579 | DENV2 NS5FJ461305 | DENV2 NS5EU482726 |
| DENV2 NS5FM210205 | DENV2 NS5GU131881 | DENV2 NS5FJ744709 | DENV2 NS5FJ024475 |
| DENV2 NS5GQ868622 | DENV2 NS5GQ868556 | DENV2 NS5GQ199868 | DENV2 NS5FJ744704 |
| DENV2 NS5EU660414 | DENV2 NS5FJ744741 | DENV2 NS5EU660400 | DENV2 NS5EU482599 |
| DENV2 NS5FJ461309 | DENV2 NS5FB667399 | DENV2 NS5EU482465 | DENV2 NS5FJ744712 |
| DENV2 NS5EU482745 | DENV2 NS5AF100466 | DENV2 NS5FM210208 | DENV2 NS5EU482681 |
| DENV2 NS5EU482601 | DENV2 NS5FJ390390 | DENV2 NS5EU482669 | DENV2 NS5FJ639831 |
| DENV2 NS5AY702037 | DENV2 NS5GQ199894 | DENV2 NS5EU529695 | DENV2 NS5EU569708 |
| DENV2 NS5FJ639830 | DENV2 NS5FJ898434 | DENV2 NS5FJ850062 | DENV2 NS5EU482583 |
| DENV2 NS5FM210234 | DENV2 NS5EU482597 | DENV2 NS5GQ199901 | DENV2 NS5EU482444 |
| DENV2 NS5EU482787 | DENV2 NS5FJ906969 | DENV2 NS5EU359009 | DENV2 NS5EU482762 |
| DENV2 NS5EU482632 | DENV2 NS5AF169679 | DENV2 NS5GU131931 | DENV2 NS5EU482662 |
| DENV2 NS5FJ373299 | DENV2 NS5FJ461321 | DENV2 NS5FJ906961 | DENV2 NS5EU569696 |
| DENV2 NS5EU482683 | DENV2 NS5EU687224 | DENV2 NS5EU529700 | DENV2 NS5EU482760 |
| DENV2 NS5EU482569 | DENV2 NS5FJ687440 | DENV2 NS5EU482576 | DENV2 NS5GU131959 |
| DENV2 NS5EU482674 | DENV2 NS5EF105380 | DENV2 NS5EU482703 | DENV2 NS5AB479041 |
| DENV2 NS5FJ478459 | DENV2 NS5AF100467 | DENV2 NS5EU482685 | DENV2 NS5DQ645552 |
| DENV2 NS5FJ850121 | DENV2 NS5EU482753 | DENV2 NS5FM210214 | DENV2 NS5EU482776 |
| DENV2 NS5FJ205879 | DENV2 NS5AF022439 | DENV2 NS5FJ744724 | DENV2 NS5GQ868543 |
| DENV2 NS5FJ687434 | DENV2 NS5AF100460 | DENV2 NS5FM210245 | DENV2 NS5FJ410237 |

FIG. 67-90

| Virus Protein Accession No. | Virus Protein Accession No. | Virus Protein Accession No. | Virus Protein Accession No. |
|---|---|---|---|
| DENV2 NS5AF169686 | DENV2 NS5EU482560 | DENV2 NS5EU482607 | DENV2 NS5AF169678 |
| DENV2 NS5FJ639707 | DENV2 NS5EU482723 | DENV2 NS5EU726776 | DENV2 NS5AF100468 |
| DENV2 NS5FJ850120 | DENV2 NS5EU482741 | DENV2 NS5EU687230 | DENV2 NS5EU482722 |
| DENV2 NS5FJ639822 | DENV2 NS5EU482549 | DENV2 NS5EU482581 | DENV2 NS5GU131883 |
| DENV2 NS5EU482699 | DENV2 NS5EU482573 | DENV2 NS5EU482600 | DENV2 NS5FM210235 |
| DENV2 NS5GQ868552 | DENV2 NS5EU482755 | DENV2 NS5GU131927 | DENV2 NS5FJ744707 |
| DENV2 NS5EU660406 | DENV2 NS5FN429893 | DENV2 NS5FJ850076 | DENV2 NS5EU482588 |
| DENV2 NS5EU569715 | DENV2 NS5AF022434 | DENV2 NS5GQ868638 | DENV2 NS5EU677149 |
| DENV2 NS5FJ898467 | DENV2 NS5EU529693 | DENV2 NS5EU482625 | DENV2 NS5FJ639734 |
| DENV2 NS5EF051521 | DENV2 NS5EU596499 | DENV2 NS5GU131843 | DENV2 NS5GQ868555 |
| DENV2 NS5GQ868497 | DENV2 NS5EU482687 | DENV2 NS5EU482469 | DENV2 NS5GQ868540 |
| DENV2 NS5EU003591 | DENV2 NS5AF022440 | DENV2 NS5EU482772 | DENV2 NS5AF169682 |
| DENV2 NS5EU569699 | DENV2 NS5GU131884 | DENV2 NS5FM210225 | DENV2 NS5DQ181797 |
| DENV2 NS5EU482547 | DENV2 NS5EU482757 | DENV2 NS5AF100461 | DENV2 NS5FJ687446 |
| DENV2 NS5FJ850064 | DENV2 NS5EU482574 | DENV2 NS5EU482668 | DENV2 NS5FJ639829 |
| DENV2 NS5EU482719 | DENV2 NS5EU482764 | DENV2 NS5GQ868598 | DENV2 NS5FJ898453 |
| DENV2 NS5EU482448 | DENV2 NS5FJ478455 | DENV2 NS5EU529701 | DENV2 NS5EU482721 |
| DENV2 NS5EU482720 | DENV2 NS5EU179857 | DENV2 NS5EU482451 | DENV2 NS5FJ898460 |
| DENV2 NS5EU687237 | DENV2 NS5FJ024473 | DENV2 NS5FJ882602 | DENV2 NS5FJ898438 |
| DENV2 NS5AB122021 | DENV2 NS5EU660416 | DENV2 NS5EU482666 | DENV2 NS5EU569712 |
| DENV2 NS5EU687248 | DENV2 NS5DQ645547 | DENV2 NS5EU482634 | DENV2 NS5EU687250 |
| DENV2 NS5EU482767 | DENV2 NS5GM059692 | DENV2 NS5DQ645550 | DENV2 NS5FJ432724 |
| DENV2 NS5DQ181798 | DENV2 NS5EU569694 | DENV2 NS5GQ868558 | DENV2 NS5AF022437 |
| DENV2 NS5EU482735 | DENV2 NS5FJ898436 | DENV2 NS5GQ868542 | DENV2 NS5DQ181800 |
| DENV2 NS5FJ850112 | DENV2 NS5FM210216 | DENV2 NS5EU569706 | DENV2 NS5EU687241 |
| DENV2 NS5EU569719 | DENV2 NS5FM210224 | DENV2 NS5GQ868631 | DENV2 NS5FJ410200 |
| DENV2 NS5EU660398 | DENV2 NS5EU482778 | DENV2 NS5EU482628 | DENV2 NS5FJ205878 |
| DENV2 NS5GQ199897 | DENV2 NS5FJ810412 | DENV2 NS5FJ850108 | DENV2 NS5GU131955 |
| DENV2 NS5EU482677 | DENV2 NS5GU131899 | DENV2 NS5EU687214 | DENV2 NS5FJ906958 |
| DENV2 NS5GQ868545 | DENV2 NS5FJ639703 | DENV2 NS5EU482689 | DENV2 NS5FJ744722 |
| DENV2 NS5EU482621 | DENV2 NS5EF105384 | DENV2 NS5FJ882594 | DENV2 NS5EU482770 |
| DENV2 NS5EU687243 | DENV2 NS5AB189123 | DENV2 NS5FJ744716 | DENV2 NS5AY744149 |
| DENV2 NS5EU482463 | DENV2 NS5FM210233 | DENV2 NS5EU482546 | DENV2 NS5EU482655 |
| DENV2 NS5EU482606 | DENV2 NS5FJ639699 | DENV2 NS5FJ410233 | DENV2 NS5EU677137 |
| DENV2 NS5DQ645553 | DENV2 NS5FJ182014 | DENV2 NS5GQ868600 | DENV2 NS5EU482744 |
| DENV2 NS5AF038403 | DENV2 NS5FJ562098 | DENV2 NS5GU131898 | DENV2 NS5FJ639701 |
| DENV2 NS5FM210204 | DENV2 NS5EU482746 | DENV2 NS5AY858036 | DENV2 NS5EU660415 |
| DENV2 NS5GQ868554 | DENV2 NS5EU482646 | DENV2 NS5EU687244 | DENV2 NS5EU482631 |
| DENV2 NS5DQ448231 | DENV2 NS5FJ687444 | DENV2 NS5FJ850066 | DENV2 NS5FJ687435 |
| DENV2 NS5FJ687443 | DENV2 NS5GU131901 | DENV2 NS5EU482556 | DENV2 NS5FJ639836 |
| DENV2 NS5FJ744710 | DENV2 NS5GQ868550 | DENV2 NS5FJ744744 | DENV2 NS5AY702034 |
| DENV2 NS5AY702040 | DENV2 NS5EU482660 | DENV2 NS5FJ639788 | DENV2 NS5EU482696 |
| DENV2 NS5FJ898466 | DENV2 NS5FJ410219 | DENV2 NS5FN429895 | DENV2 NS5FJ687438 |
| DENV2 NS5GQ252677 | DENV2 NS5EU569717 | DENV2 NS5FJ850060 | DENV2 NS5EU596488 |
| DENV2 NS5FJ906966 | DENV2 NS5AF022435 | DENV2 NS5EU660404 | DENV2 NS5FM210220 |
| DENV2 NS5GU289914 | DENV2 NS5EU482788 | DENV2 NS5EU482690 | DENV2 NS5FJ898451 |
| DENV2 NS5FJ744706 | DENV2 NS5FJ744743 | DENV2 NS5EU569720 | DENV2 NS5FJ639708 |
| DENV2 NS5EU596496 | DENV2 NS5FJ906956 | DENV2 NS5FJ687441 | DENV2 NS5EU687229 |

FIG. 67-91

| Virus Protein Accession No. | Virus Protein Accession No. | Virus Protein Accession No. | Virus Protein Accession No. |
|---|---|---|---|
| DENV2 NS5EU482739 | DENV2 NS5EU687246 | DENV2 NS5DQ181802 | DENV2 prMFJ744718 |
| DENV2 NS5EU569709 | DENV2 NS5EU482750 | DENV2 NS5FJ810411 | DENV2 prMEF457904 |
| DENV2 NS5EU687223 | DENV2 NS5GU131900 | DENV2 NS5EU482554 | DENV2 prMAF169687 |
| DENV2 NS5EF105386 | DENV2 NS5FM210211 | DENV2 NS5FM210237 | DENV2 prMFJ850072 |
| DENV2 NS5FJ410217 | DENV2 NS5EU482742 | DENV2 NS5EU482603 | DENV2 prMEU482445 |
| DENV2 NS5EU482467 | DENV2 NS5EU482705 | DENV2 NS5EU482733 | DENV2 prMEU482598 |
| DENV2 NS5FJ461314 | DENV2 NS5EF105390 | DENV2 NS5FJ850088 | DENV2 prMAF359579 |
| DENV2 NS5GQ868595 | DENV2 NS5EU482684 | DENV2 prMCS479165 | DENV2 prMGQ199605 |
| DENV2 NS5GU131932 | DENV2 NS5EU569714 | DENV2 prMFJ205877 | DENV2 prMEU482639 |
| DENV2 NS5EU056810 | DENV2 NS5GQ868589 | DENV2 prMEU726767 | DENV2 prMGQ868551 |
| DENV2 NS5AF022441 | DENV2 NS5FJ850078 | DENV2 prMEU482649 | DENV2 prMEU569713 |
| DENV2 NS5EU056812 | DENV2 NS5FM210243 | DENV2 prMFM210221 | DENV2 prMEU482775 |
| DENV2 NS5EU482664 | DENV2 NS5EU482671 | DENV2 prMEU482740 | DENV2 prMAY786384 |
| DENV2 NS5EU482568 | DENV2 NS5EU482571 | DENV2 prMEF105388 | DENV2 prMGQ868620 |
| DENV2 NS5EU482774 | DENV2 NS5DQ645544 | DENV2 prMFJ410259 | DENV2 prMGU131902 |
| DENV2 NS5FJ547067 | DENV2 NS5FM210238 | DENV2 prMFJ024461 | DENV2 prMGU131947 |
| DENV2 NS5EU482474 | DENV2 NS5EF105379 | DENV2 prMDQ181801 | DENV2 prMEU569707 |
| DENV2 NS5FJ850118 | DENV2 NS5EU482728 | DENV2 prMEU482650 | DENV2 prMM20558 |
| DENV2 NS5EU687216 | DENV2 NS5FM210229 | DENV2 prMEU482724 | DENV2 prMEU482663 |
| DENV2 NS5EU482590 | DENV2 NS5GU131880 | DENV2 prMFJ898435 | DENV2 prMDQ645543 |
| DENV2 NS5AF208496 | DENV2 NS5M19197 | DENV2 prMFJ547064 | DENV2 prMFM210207 |
| DENV2 NS5EU569693 | DENV2 NS5GQ868603 | DENV2 prMEU677144 | DENV2 prMFJ873808 |
| DENV2 NS5FJ850106 | DENV2 NS5GU131929 | DENV2 prMEU569716 | DENV2 prMAY775305 |
| DENV2 NS5EU482623 | DENV2 NS5FJ639732 | DENV2 prMEU482752 | DENV2 prMFM210203 |
| DENV2 NS5GU131879 | DENV2 NS5EU677143 | DENV2 prMFJ906967 | DENV2 prMAY714062 |
| DENV2 NS5FM210223 | DENV2 NS5EU482682 | DENV2 prMFJ410241 | DENV2 prMAY786401 |
| DENV2 NS5GQ199893 | DENV2 NS5GQ868641 | DENV2 prMFJ639706 | DENV2 prMEU687225 |
| DENV2 NS5EU482578 | DENV2 NS5EU482785 | DENV2 prMEU596500 | DENV2 prMEU596486 |
| DENV2 NS5EU482544 | DENV2 NS5FJ410193 | DENV2 prMFJ410208 | DENV2 prMAF100459 |
| DENV2 NS5EU482759 | DENV2 NS5EU482552 | DENV2 prMFJ906957 | DENV2 prMEU687238 |
| DENV2 NS5FJ744711 | DENV2 NS5EU677142 | DENV2 prMEU569702 | DENV2 prMEU482747 |
| DENV2 NS5EU569704 | DENV2 NS5EU687232 | DENV2 prMDQ448233 | DENV2 prMGU131928 |
| DENV2 NS5AF169685 | DENV2 NS5FM210241 | DENV2 prMFJ898478 | DENV2 prMFM210226 |
| DENV2 NS5EU677147 | DENV2 NS5FJ744725 | DENV2 prMFJ882593 | DENV2 prMM84728 |
| DENV2 NS5GU370051 | DENV2 NS5GQ868621 | DENV2 prMEU482763 | DENV2 prMFM210230 |
| DENV2 NS5EU482587 | DENV2 NS5EU482653 | DENV2 prMAY786374 | DENV2 prMAY449682 |
| DENV2 NS5DQ645551 | DENV2 NS5FJ024477 | DENV2 prMEU482661 | DENV2 prMEU482659 |
| DENV2 NS5FJ390391 | DENV2 NS5U87412 | DENV2 prMM29095 | DENV2 prMAJ487271 |
| DENV2 NS5FJ850054 | DENV2 NS5EU482692 | DENV2 prMEU482585 | DENV2 prMEU660399 |
| DENV2 NS5EU482565 | DENV2 NS5FM210206 | DENV2 prMFJ639711 | DENV2 prMFJ639832 |
| DENV2 NS5FJ373300 | DENV2 NS5EU482644 | DENV2 prMFJ850067 | DENV2 prMEU569698 |
| DENV2 NS5AF169684 | DENV2 NS5GU131975 | DENV2 prMAY786393 | DENV2 prMEU854294 |
| DENV2 NS5DL138662 | DENV2 NS5EU482602 | DENV2 prMEU482777 | DENV2 prMEU482561 |
| DENV2 NS5GQ868544 | DENV2 NS5EU482673 | DENV2 prMFJ898479 | DENV2 prMGQ868515 |
| DENV2 NS5FJ744714 | DENV2 NS5FJ024474 | DENV2 prMAF100463 | DENV2 prMEU482473 |
| DENV2 NS5EU179859 | DENV2 NS5FJ744720 | DENV2 prMFJ744703 | DENV2 prMEU482622 |
| DENV2 NS5DQ645541 | DENV2 NS5FJ639809 | DENV2 prMAY786382 | DENV2 prMEU482693 |
| DENV2 NS5AF100465 | DENV2 NS5FJ639718 | DENV2 prMEU482642 | DENV2 prMAY744148 |

FIG. 67-92

| Virus Protein Accession No. | Virus Protein Accession No. | Virus Protein Accession No. | Virus Protein Accession No. |
|---|---|---|---|
| DENV2 prMEU687249 | DENV2 prMFJ850082 | DENV2 prMGQ868599 | DENV2 prMFJ432726 |
| DENV2 prMEU482761 | DENV2 prMEU596491 | DENV2 prMEU677138 | DENV2 prMEU482688 |
| DENV2 prMFJ639837 | DENV2 prMEU482582 | DENV2 prMEU482783 | DENV2 prMFJ410202 |
| DENV2 prMFJ906960 | DENV2 prMEU482749 | DENV2 prMEU596484 | DENV2 prMGQ868646 |
| DENV2 prMAY702035 | DENV2 prMEU482779 | DENV2 prMEU569718 | DENV2 prMEU482575 |
| DENV2 prMGQ868590 | DENV2 prMGQ868623 | DENV2 prMAY449677 | DENV2 prMFM210246 |
| DENV2 prMAY786378 | DENV2 prMAF169680 | DENV2 prMFJ639709 | DENV2 prMAY466449 |
| DENV2 prMGQ199896 | DENV2 prMU87411 | DENV2 prMAF169688 | DENV2 prMFJ898449 |
| DENV2 prMFN429892 | DENV2 prMFM210213 | DENV2 prMAY449685 | DENV2 prMEU482471 |
| DENV2 prMEU482466 | DENV2 prMEU482647 | DENV2 prMDQ181799 | DENV2 prMFJ744705 |
| DENV2 prMFJ639697 | DENV2 prMAY786405 | DENV2 prMGQ199898 | DENV2 prMEU482572 |
| DENV2 prMFM210209 | DENV2 prMAF169681 | DENV2 prMFJ024458 | DENV2 prMGU131885 |
| DENV2 prMAB122022 | DENV2 prMEU482548 | DENV2 prMFJ687436 | DENV2 prMFJ937968 |
| DENV2 prMAY786400 | DENV2 prMFJ898439 | DENV2 prMFB667404 | DENV2 prMFJ850116 |
| DENV2 prMEU569697 | DENV2 prMEU482637 | DENV2 prMFJ850063 | DENV2 prMFM210218 |
| DENV2 prMEU482730 | DENV2 prMEU781135 | DENV2 prMEU482541 | DENV2 prMEU482754 |
| DENV2 prMEU482577 | DENV2 prMDQ645548 | DENV2 prMDQ645554 | DENV2 prMEU482756 |
| DENV2 prMFJ390384 | DENV2 prMAB189122 | DENV2 prMEU482657 | DENV2 prMAY786391 |
| DENV2 prMCS805344 | DENV2 prMFJ810418 | DENV2 prMEU482768 | DENV2 prMDQ181806 |
| DENV2 prMAY702038 | DENV2 prMGU131896 | DENV2 prMAF038402 | DENV2 prMFB730117 |
| DENV2 prMFJ467493 | DENV2 prMEU482765 | DENV2 prMAF469175 | DENV2 prMEU482737 |
| DENV2 prMEU482629 | DENV2 prMEU596498 | DENV2 prMFJ850117 | DENV2 prMAB122020 |
| DENV2 prMEU482593 | DENV2 prMCS479167 | DENV2 prMEU482678 | DENV2 prMAY786376 |
| DENV2 prMFJ850085 | DENV2 prMFJ182012 | DENV2 prMEU482698 | DENV2 prMEU482636 |
| DENV2 prMFJ410224 | DENV2 prMEF105381 | DENV2 prMD00345 | DENV2 prMEU482557 |
| DENV2 prMGQ868625 | DENV2 prMFJ410195 | DENV2 prMFM210202 | DENV2 prMEU482701 |
| DENV2 prMEU854293 | DENV2 prMAF204178 | DENV2 prMEU482594 | DENV2 prMFJ024452 |
| DENV2 prMEU482675 | DENV2 prMFJ226066 | DENV2 prMFJ898465 | DENV2 prMEU569700 |
| DENV2 prMAY776328 | DENV2 prMEU482640 | DENV2 prMDQ420622 | DENV2 prMDQ448236 |
| DENV2 prMGU370050 | DENV2 prMAY449679 | DENV2 prMFJ639834 | DENV2 prMAY786380 |
| DENV2 prMFJ850061 | DENV2 prMGQ868592 | DENV2 prMGQ868553 | DENV2 prMEU482580 |
| DENV2 prMEU660413 | DENV2 prMFJ639704 | DENV2 prMFJ850115 | DENV2 prMEU482670 |
| DENV2 prMFJ205880 | DENV2 prMEU687212 | DENV2 prMEU482627 | DENV2 prMFJ687437 |
| DENV2 prMEU687199 | DENV2 prMAF100462 | DENV2 prMAY449684 | DENV2 prMNC_001474 |
| DENV2 prMEF440433 | DENV2 prMEU726775 | DENV2 prMEU482620 | DENV2 prMEU596497 |
| DENV2 prMDQ181804 | DENV2 prMEU677146 | DENV2 prMFJ744721 | DENV2 prMEU482704 |
| DENV2 prMFJ744723 | DENV2 prMAF022436 | DENV2 prMEU687220 | DENV2 prMEU569692 |
| DENV2 prMEU482686 | DENV2 prMEU482680 | DENV2 prMEU687236 | DENV2 prMCS477302 |
| DENV2 prMEU482605 | DENV2 prMEU482464 | DENV2 prMFJ687442 | DENV2 prMAF169683 |
| DENV2 prMGQ199900 | DENV2 prMAF489932 | DENV2 prMEU569705 | DENV2 prMFM210232 |
| DENV2 prMFJ410221 | DENV2 prMAY786389 | DENV2 prMEU482780 | DENV2 prMFJ898454 |
| DENV2 prMAF100469 | DENV2 prMGU131864 | DENV2 prMEU687231 | DENV2 prMEU596483 |
| DENV2 prMFJ898461 | DENV2 prMFJ390389 | DENV2 prMGQ199866 | DENV2 prMFJ639700 |
| DENV2 prMEU482550 | DENV2 prMEU687240 | DENV2 prMFJ850074 | DENV2 prMGQ199892 |
| DENV2 prMFM210244 | DENV2 prMAY786367 | DENV2 prMEU081178 | DENV2 prMM84727 |
| DENV2 prMEU179858 | DENV2 prMDQ645545 | DENV2 prMFJ410215 | DENV2 prMEU677148 |
| DENV2 prMEU687227 | DENV2 prMFJ906959 | DENV2 prMDQ645555 | DENV2 prMEU482645 |
| DENV2 prMEU660417 | DENV2 prMEU621672 | DENV2 prMEU482652 | DENV2 prMFJ639733 |

FIG. 67-93

| Virus | Protein | Accession No. | Virus | Protein | Accession No. | Virus | Protein | Accession No. | Virus | Protein | Accession No. |
|---|---|---|---|---|---|---|---|---|---|---|---|
| DENV2 | prM | FJ410223 | DENV2 | prM | EU687245 | DENV2 | prM | EU081179 | DENV2 | prM | FM210234 |
| DENV2 | prM | FM210215 | DENV2 | prM | AY702039 | DENV2 | prM | EU529694 | DENV2 | prM | EU482787 |
| DENV2 | prM | FM210210 | DENV2 | prM | AY744150 | DENV2 | prM | EU660405 | DENV2 | prM | EU482632 |
| DENV2 | prM | AY786366 | DENV2 | prM | EU482734 | DENV2 | prM | FJ859028 | DENV2 | prM | FJ373299 |
| DENV2 | prM | FJ744708 | DENV2 | prM | EU726770 | DENV2 | prM | X51712 | DENV2 | prM | EU482683 |
| DENV2 | prM | FJ024454 | DENV2 | prM | FJ850119 | DENV2 | prM | GQ252676 | DENV2 | prM | EU482569 |
| DENV2 | prM | FJ810409 | DENV2 | prM | EU596489 | DENV2 | prM | FJ850065 | DENV2 | prM | AY775307 |
| DENV2 | prM | EU569695 | DENV2 | prM | EU482470 | DENV2 | prM | EU482589 | DENV2 | prM | EU482674 |
| DENV2 | prM | EF105383 | DENV2 | prM | EU687222 | DENV2 | prM | EU482641 | DENV2 | prM | FJ478459 |
| DENV2 | prM | GU131882 | DENV2 | prM | FJ205885 | DENV2 | prM | FJ390385 | DENV2 | prM | FJ850121 |
| DENV2 | prM | EU482697 | DENV2 | prM | AB479042 | DENV2 | prM | EU482784 | DENV2 | prM | FJ205879 |
| DENV2 | prM | CS479202 | DENV2 | prM | EU482748 | DENV2 | prM | EU482727 | DENV2 | prM | FJ687434 |
| DENV2 | prM | DQ181805 | DENV2 | prM | GU131924 | DENV2 | prM | FM210212 | DENV2 | prM | EU482450 |
| DENV2 | prM | EF105378 | DENV2 | prM | GQ868640 | DENV2 | prM | GQ868588 | DENV2 | prM | FJ850053 |
| DENV2 | prM | AF022438 | DENV2 | prM | U89517 | DENV2 | prM | EU569721 | DENV2 | prM | EU056811 |
| DENV2 | prM | FJ639702 | DENV2 | prM | AY786395 | DENV2 | prM | EU482654 | DENV2 | prM | EU596487 |
| DENV2 | prM | EU482729 | DENV2 | prM | FJ639710 | DENV2 | prM | GU369819 | DENV2 | prM | EU482626 |
| DENV2 | prM | EU569710 | DENV2 | prM | AF119661 | DENV2 | prM | GQ868541 | DENV2 | prM | EU482586 |
| DENV2 | prM | FJ547090 | DENV2 | prM | EU482545 | DENV2 | prM | EU569711 | DENV2 | prM | EU482665 |
| DENV2 | prM | GU131974 | DENV2 | prM | EU687215 | DENV2 | prM | EU482553 | DENV2 | prM | FJ898452 |
| DENV2 | prM | FJ639833 | DENV2 | prM | FJ898432 | DENV2 | prM | FJ639717 | DENV2 | prM | FM210219 |
| DENV2 | prM | FJ410228 | DENV2 | prM | EU482700 | DENV2 | prM | AY786397 | DENV2 | prM | EF105385 |
| DENV2 | prM | FM210242 | DENV2 | prM | AY786371 | DENV2 | prM | CS477304 | DENV2 | prM | AF360863 |
| DENV2 | prM | FM210228 | DENV2 | prM | AY786387 | DENV2 | prM | FJ687447 | DENV2 | prM | GQ868596 |
| DENV2 | prM | FJ390387 | DENV2 | prM | EU482782 | DENV2 | prM | FM210240 | DENV2 | prM | AY786390 |
| DENV2 | prM | EU482608 | DENV2 | prM | FJ873811 | DENV2 | prM | EU482672 | DENV2 | prM | FJ744719 |
| DENV2 | prM | EU482447 | DENV2 | prM | AY449676 | DENV2 | prM | FJ639828 | DENV2 | prM | AY786385 |
| DENV2 | prM | FJ410291 | DENV2 | prM | EU482758 | DENV2 | prM | EU482691 | DENV2 | prM | FJ744713 |
| DENV2 | prM | GQ199899 | DENV2 | prM | GQ868624 | DENV2 | prM | FJ687439 | DENV2 | prM | EU482475 |
| DENV2 | prM | EU482630 | DENV2 | prM | FJ744715 | DENV2 | prM | GQ199874 | DENV2 | prM | FJ461311 |
| DENV2 | prM | FJ687445 | DENV2 | prM | FJ639783 | DENV2 | prM | EU687217 | DENV2 | prM | GQ868597 |
| DENV2 | prM | AF360861 | DENV2 | prM | EU081177 | DENV2 | prM | EU482731 | DENV2 | prM | GQ199869 |
| DENV2 | prM | GQ199890 | DENV2 | prM | FM210222 | DENV2 | prM | EU529706 | DENV2 | prM | EU482449 |
| DENV2 | prM | EU482651 | DENV2 | prM | EU569703 | DENV2 | prM | EU482656 | DENV2 | prM | EU482773 |
| DENV2 | prM | EU482658 | DENV2 | prM | EU482667 | DENV2 | prM | EU482543 | DENV2 | prM | AF469176 |
| DENV2 | prM | EU687235 | DENV2 | prM | DQ645540 | DENV2 | prM | EU482732 | DENV2 | prM | EU569701 |
| DENV2 | prM | FJ850091 | DENV2 | prM | FJ410288 | DENV2 | prM | EU482643 | DENV2 | prM | EU482738 |
| DENV2 | prM | AY778961 | DENV2 | prM | GU131930 | DENV2 | prM | DQ645542 | DENV2 | prM | X65242 |
| DENV2 | prM | FJ639698 | DENV2 | prM | AY037116 | DENV2 | prM | EU482695 | DENV2 | prM | EU482468 |
| DENV2 | prM | FJ850050 | DENV2 | prM | GQ868549 | DENV2 | prM | FJ744745 | DENV2 | prM | AY642588 |
| DENV2 | prM | AB189124 | DENV2 | prM | EU482751 | DENV2 | prM | FM210205 | DENV2 | prM | EU482633 |
| DENV2 | prM | EU482771 | DENV2 | prM | EU482562 | DENV2 | prM | GQ868622 | DENV2 | prM | GU131886 |
| DENV2 | prM | AF276619 | DENV2 | prM | FJ850107 | DENV2 | prM | EU660414 | DENV2 | prM | EU677141 |
| DENV2 | prM | EU482766 | DENV2 | prM | FJ898450 | DENV2 | prM | FJ461309 | DENV2 | prM | GQ868557 |
| DENV2 | prM | DQ645549 | DENV2 | prM | EU482570 | DENV2 | prM | EU482745 | DENV2 | prM | AJ968413 |
| DENV2 | prM | AY786406 | DENV2 | prM | FN429894 | DENV2 | prM | EU482601 | DENV2 | prM | FJ639835 |
| DENV2 | prM | EU687242 | DENV2 | prM | EU482702 | DENV2 | prM | AY702037 | DENV2 | prM | EU482579 |
| DENV2 | prM | EU482635 | DENV2 | prM | EU482743 | DENV2 | prM | FJ639830 | DENV2 | prM | GU131881 |

FIG. 67-94

| Virus Protein Accession No. | Virus Protein Accession No. | Virus Protein Accession No. | Virus Protein Accession No. |
|---|---|---|---|
| DENV2 prMGQ868556 | DENV2 prMAY858035 | DENV2 prMEU482638 | DENV2 prMFJ850064 |
| DENV2 prMAY786402 | DENV2 prMEU596490 | DENV2 prMFM210217 | DENV2 prMEU482719 |
| DENV2 prMFJ744741 | DENV2 prMFJ850051 | DENV2 prMEF105382 | DENV2 prMEU482448 |
| DENV2 prMFB667399 | DENV2 prMEU482446 | DENV2 prMX51713 | DENV2 prMEU482720 |
| DENV2 prMAF100466 | DENV2 prMEU482694 | DENV2 prMFJ744742 | DENV2 prMAY786383 |
| DENV2 prMFJ390390 | DENV2 prMGQ868591 | DENV2 prMGU131897 | DENV2 prMEU687237 |
| DENV2 prMGQ199894 | DENV2 prMFJ461305 | DENV2 prMEU482584 | DENV2 prMAB122021 |
| DENV2 prMFJ898434 | DENV2 prMFJ744709 | DENV2 prMEU482624 | DENV2 prMEU687248 |
| DENV2 prMEU482597 | DENV2 prMGQ199868 | DENV2 prMEU482725 | DENV2 prMEU482767 |
| DENV2 prMFJ906969 | DENV2 prMEU660400 | DENV2 prMFJ810410 | DENV2 prMDQ181798 |
| DENV2 prMAF169679 | DENV2 prMEU482465 | DENV2 prMEU482726 | DENV2 prMEU482735 |
| DENV2 prMFJ461321 | DENV2 prMFM210208 | DENV2 prMFJ024475 | DENV2 prMFJ850112 |
| DENV2 prMEU687224 | DENV2 prMEU482669 | DENV2 prMFJ744704 | DENV2 prMEU569719 |
| DENV2 prMFJ687440 | DENV2 prMEU529695 | DENV2 prMAY786392 | DENV2 prMEU660398 |
| DENV2 prMEF105380 | DENV2 prMFJ850062 | DENV2 prMEU482599 | DENV2 prMGQ199897 |
| DENV2 prMAF100467 | DENV2 prMGQ199901 | DENV2 prMFJ744712 | DENV2 prMEU482677 |
| DENV2 prMEU482753 | DENV2 prMEU359009 | DENV2 prMEU482681 | DENV2 prMGQ868545 |
| DENV2 prMAF022439 | DENV2 prMGU131931 | DENV2 prMFJ639831 | DENV2 prMEU482621 |
| DENV2 prMAF100460 | DENV2 prMFJ906961 | DENV2 prMEU569708 | DENV2 prMEU687243 |
| DENV2 prMEU596495 | DENV2 prMEU529700 | DENV2 prMEU482583 | DENV2 prMEU482463 |
| DENV2 prMFJ373301 | DENV2 prMEU482576 | DENV2 prMEU482444 | DENV2 prMEU482606 |
| DENV2 prMU88237 | DENV2 prMEU482703 | DENV2 prMEU482762 | DENV2 prMDQ645553 |
| DENV2 prMDQ448235 | DENV2 prMAY786404 | DENV2 prMEU482662 | DENV2 prMAF038403 |
| DENV2 prMFJ906962 | DENV2 prMEU482685 | DENV2 prMEU569696 | DENV2 prMFM210204 |
| DENV2 prMFJ850105 | DENV2 prMFM210214 | DENV2 prMEU482760 | DENV2 prMX72849 |
| DENV2 prMAY786399 | DENV2 prMFJ744724 | DENV2 prMGU131959 | DENV2 prMGQ868554 |
| DENV2 prMEU482542 | DENV2 prMAF509530 | DENV2 prMAB479041 | DENV2 prMDQ448231 |
| DENV2 prMAY702036 | DENV2 prMFM210245 | DENV2 prMDQ645552 | DENV2 prMFJ687443 |
| DENV2 prMAY449680 | DENV2 prMGQ199895 | DENV2 prMEU482776 | DENV2 prMFJ744710 |
| DENV2 prMAY744147 | DENV2 prMEU482604 | DENV2 prMGQ868543 | DENV2 prMAY702040 |
| DENV2 prMEF441283 | DENV2 prMFM210236 | DENV2 prMFJ410237 | DENV2 prMAY786379 |
| DENV2 prMFM210227 | DENV2 prMAY786373 | DENV2 prMAF169686 | DENV2 prMAY786375 |
| DENV2 prMFM210231 | DENV2 prMEU482736 | DENV2 prMFJ639707 | DENV2 prMFJ898466 |
| DENV2 prMFN429891 | DENV2 prMEU482551 | DENV2 prMFJ850120 | DENV2 prMGQ252677 |
| DENV2 prMEU482676 | DENV2 prMDQ645546 | DENV2 prMFJ639822 | DENV2 prMFJ906966 |
| DENV2 prMGQ868604 | DENV2 prMEU687228 | DENV2 prMEU482699 | DENV2 prMGU289914 |
| DENV2 prMGQ868516 | DENV2 prMEF105387 | DENV2 prMGQ868552 | DENV2 prMFJ744706 |
| DENV2 prMEU482769 | DENV2 prMEU482648 | DENV2 prMEU660406 | DENV2 prMEU596496 |
| DENV2 prMFJ744717 | DENV2 prMFJ639705 | DENV2 prMEU569715 | DENV2 prMEU482560 |
| DENV2 prMEU687213 | DENV2 prMFJ906968 | DENV2 prMAY714061 | DENV2 prMEU482723 |
| DENV2 prMFM210239 | DENV2 prMAF100464 | DENV2 prMFJ898467 | DENV2 prMEU482741 |
| DENV2 prMAY786377 | DENV2 prMEU677145 | DENV2 prMEF051521 | DENV2 prMAY449681 |
| DENV2 prMDQ645556 | DENV2 prMEU596485 | DENV2 prMAY786368 | DENV2 prMEU482549 |
| DENV2 prMEU081180 | DENV2 prMFJ898477 | DENV2 prMAY775306 | DENV2 prMEU482573 |
| DENV2 prMAF204177 | DENV2 prMDQ181803 | DENV2 prMGQ868497 | DENV2 prMEU482755 |
| DENV2 prMEU482679 | DENV2 prMEU482786 | DENV2 prMEU003591 | DENV2 prMFN429893 |
| DENV2 prMAF360862 | DENV2 prMEF105389 | DENV2 prMEU569699 | DENV2 prMAF022434 |
| DENV2 prMEU482472 | DENV2 prMEU482781 | DENV2 prMEU482547 | DENV2 prMEU529693 |

FIG. 67-95

| Virus Protein Accession No. | Virus Protein Accession No. | Virus Protein Accession No. | Virus Protein Accession No. |
|---|---|---|---|
| DENV2 prMEU596499 | DENV2 prML04561 | DENV2 prMFN429895 | DENV2 prMEU482631 |
| DENV2 prMEU482687 | DENV2 prMEU482607 | DENV2 prMFJ850060 | DENV2 prMFJ687435 |
| DENV2 prMAF022440 | DENV2 prMEU726776 | DENV2 prMEU660404 | DENV2 prMAF360860 |
| DENV2 prMGU131884 | DENV2 prMEU687230 | DENV2 prMEU482690 | DENV2 prMFJ639836 |
| DENV2 prMEU482757 | DENV2 prMEU482581 | DENV2 prMEU569720 | DENV2 prMAY702034 |
| DENV2 prMDQ448238 | DENV2 prMEU482600 | DENV2 prMFJ687441 | DENV2 prMEU482696 |
| DENV2 prMEU482574 | DENV2 prMGU131927 | DENV2 prMAF169678 | DENV2 prMFJ687438 |
| DENV2 prMEU482764 | DENV2 prMFJ850076 | DENV2 prMAF100468 | DENV2 prMEU596488 |
| DENV2 prMFJ478455 | DENV2 prMGQ868638 | DENV2 prMAY778960 | DENV2 prMFM210220 |
| DENV2 prMEU179857 | DENV2 prMEU482625 | DENV2 prMEU482722 | DENV2 prMFJ898451 |
| DENV2 prMFJ024473 | DENV2 prMGU131843 | DENV2 prMGU131883 | DENV2 prMFJ639708 |
| DENV2 prMEU660416 | DENV2 prMEU482469 | DENV2 prMFM210235 | DENV2 prMEU687229 |
| DENV2 prMDQ645547 | DENV2 prMEU482772 | DENV2 prMFJ744707 | DENV2 prMEU482739 |
| DENV2 prMAY786394 | DENV2 prMFM210225 | DENV2 prMEU482588 | DENV2 prMEU569709 |
| DENV2 prMGM059692 | DENV2 prMAF100461 | DENV2 prMEU677149 | DENV2 prMEU687223 |
| DENV2 prMEU569694 | DENV2 prMEU482668 | DENV2 prMFJ639734 | DENV2 prMAY786386 |
| DENV2 prMFJ898436 | DENV2 prMGQ868598 | DENV2 prMGQ868555 | DENV2 prMEF105386 |
| DENV2 prMFM210216 | DENV2 prMAY786370 | DENV2 prMGQ868540 | DENV2 prMFJ410217 |
| DENV2 prMFM210224 | DENV2 prMEU529701 | DENV2 prMAF169682 | DENV2 prMEU482467 |
| DENV2 prMAY786369 | DENV2 prMEU482451 | DENV2 prMDQ181797 | DENV2 prMFJ461314 |
| DENV2 prMAY786381 | DENV2 prMFJ882602 | DENV2 prMFJ687446 | DENV2 prMGQ868595 |
| DENV2 prMEU482778 | DENV2 prMEU482666 | DENV2 prMFJ639829 | DENV2 prMGU131932 |
| DENV2 prMFJ810412 | DENV2 prMEU482634 | DENV2 prMFJ898453 | DENV2 prMEU056810 |
| DENV2 prMGU131899 | DENV2 prMDQ645550 | DENV2 prMEU482721 | DENV2 prMAF022441 |
| DENV2 prMFJ639703 | DENV2 prMGQ868558 | DENV2 prMFJ898460 | DENV2 prMEU056812 |
| DENV2 prMEF105384 | DENV2 prMGQ868542 | DENV2 prMFJ898438 | DENV2 prMEU482664 |
| DENV2 prMAY775303 | DENV2 prMEU569706 | DENV2 prMEU569712 | DENV2 prMEU482568 |
| DENV2 prMAB189123 | DENV2 prMGQ868631 | DENV2 prMDQ448237 | DENV2 prMEU482774 |
| DENV2 prMFM210233 | DENV2 prMEU482628 | DENV2 prMEU687250 | DENV2 prMFJ547067 |
| DENV2 prMFJ639699 | DENV2 prMU89518 | DENV2 prMFJ432724 | DENV2 prMEU482474 |
| DENV2 prMFJ182014 | DENV2 prMFJ850108 | DENV2 prMAF022437 | DENV2 prMFJ850118 |
| DENV2 prMFJ562098 | DENV2 prMEU687214 | DENV2 prMDQ181800 | DENV2 prMEU687216 |
| DENV2 prMFJ913016 | DENV2 prMAY044442 | DENV2 prMD00346 | DENV2 prMEU482590 |
| DENV2 prMAY775304 | DENV2 prMAY786388 | DENV2 prMEU687241 | DENV2 prMAF208496 |
| DENV2 prMEU482746 | DENV2 prMEU482689 | DENV2 prMFJ410200 | DENV2 prMEU569693 |
| DENV2 prMEU482646 | DENV2 prMFJ882594 | DENV2 prMFJ205878 | DENV2 prMFJ850106 |
| DENV2 prMFJ687444 | DENV2 prMFJ744716 | DENV2 prMGU131955 | DENV2 prMEU482623 |
| DENV2 prMGU131901 | DENV2 prMEU482546 | DENV2 prMFJ906958 | DENV2 prMGU131879 |
| DENV2 prMGQ868550 | DENV2 prMFJ410233 | DENV2 prMAY449683 | DENV2 prMFM210223 |
| DENV2 prMEU482660 | DENV2 prMGQ868600 | DENV2 prMFJ744722 | DENV2 prMGQ199893 |
| DENV2 prMFJ410219 | DENV2 prMGU131898 | DENV2 prMEU482770 | DENV2 prMEU482578 |
| DENV2 prMEU569717 | DENV2 prMAY858036 | DENV2 prMAY744149 | DENV2 prMEU482544 |
| DENV2 prMAF022435 | DENV2 prMEU687244 | DENV2 prMEU482655 | DENV2 prMEU482759 |
| DENV2 prMEU482788 | DENV2 prMFJ850066 | DENV2 prMEU677137 | DENV2 prMFJ744711 |
| DENV2 prMFJ744743 | DENV2 prMAY449675 | DENV2 prMAY786396 | DENV2 prMEU569704 |
| DENV2 prMFJ937969 | DENV2 prMEU482556 | DENV2 prMEU482744 | DENV2 prMAF169685 |
| DENV2 prMFJ906956 | DENV2 prMFJ744744 | DENV2 prMFJ639701 | DENV2 prMEU677147 |
| DENV2 prMAY449678 | DENV2 prMFJ639788 | DENV2 prMEU660415 | DENV2 prMGU370051 |

FIG. 67-96

| Virus Protein Accession No. | Virus Protein Accession No. | Virus Protein Accession No. | Virus Protein Accession No. |
|---|---|---|---|
| DENV2 prMEU482587 | DENV2 prMEU482552 | DENV2 prMDQ420622 | DENV2 prMAY786394 |
| DENV2 prMDQ645551 | DENV2 prMEU677142 | DENV2 prMAY449684 | DENV2 prMAY786369 |
| DENV2 prMFJ390391 | DENV2 prMEU687232 | DENV2 prMAY466449 | DENV2 prMAY786381 |
| DENV2 prMM15075 | DENV2 prMFM210241 | DENV2 prMFJ937968 | DENV2 prMAY775303 |
| DENV2 prMAY786403 | DENV2 prMAY786398 | DENV2 prMAY786391 | DENV2 prMAY775304 |
| DENV2 prMFJ850054 | DENV2 prMFJ744725 | DENV2 prMAY786376 | DENV2 prMFJ937969 |
| DENV2 prMEU482565 | DENV2 prMGQ868621 | DENV2 prMDQ448236 | DENV2 prMAY449678 |
| DENV2 prMFJ373300 | DENV2 prMEU482653 | DENV2 prMAY786380 | DENV2 prML04561 |
| DENV2 prMAF169684 | DENV2 prMDQ448232 | DENV2 prMAY786366 | DENV2 prMAY786370 |
| DENV2 prMDL138662 | DENV2 prMFJ024477 | DENV2 prMAF360861 | DENV2 prMU89518 |
| DENV2 prMGQ868544 | DENV2 prMU87412 | DENV2 prMAY778961 | DENV2 prMAY044442 |
| DENV2 prMFJ744714 | DENV2 prMEU482692 | DENV2 prMAY786406 | DENV2 prMAY786388 |
| DENV2 prMEU179859 | DENV2 prMFM210206 | DENV2 prMU89517 | DENV2 prMAY449675 |
| DENV2 prMDQ448234 | DENV2 prMEU482644 | DENV2 prMAY786395 | DENV2 prMAY778960 |
| DENV2 prMDQ645541 | DENV2 prMGU131975 | DENV2 prMAY786371 | DENV2 prMDQ448237 |
| DENV2 prMAF100465 | DENV2 prMEU482602 | DENV2 prMAY786387 | DENV2 prMD00346 |
| DENV2 prMEU687246 | DENV2 prMEU482673 | DENV2 prMAY449676 | DENV2 prMAY449683 |
| DENV2 prMEU482750 | DENV2 prMFJ024474 | DENV2 prMX51712 | DENV2 prMAY786396 |
| DENV2 prMGU131900 | DENV2 prMFJ744720 | DENV2 prMAY786397 | DENV2 prMAF360860 |
| DENV2 prMFM210211 | DENV2 prMFJ639809 | DENV2 prMAY775307 | DENV2 prMAY786386 |
| DENV2 prMEU482742 | DENV2 prMFJ639718 | DENV2 prMAF360863 | DENV2 prMM15075 |
| DENV2 prMEU482705 | DENV2 prMDQ181802 | DENV2 prMAY786390 | DENV2 prMAY786403 |
| DENV2 prMX51711 | DENV2 prMFJ810411 | DENV2 prMAY786385 | DENV2 prMDQ448234 |
| DENV2 prMEF105390 | DENV2 prMEU482554 | DENV2 prMAF469176 | DENV2 prMX51711 |
| DENV2 prMEU482684 | DENV2 prMFM210237 | DENV2 prMX65242 | DENV2 prMAY786372 |
| DENV2 prMEU569714 | DENV2 prMEU482603 | DENV2 prMAY642588 | DENV2 prMAY644452 |
| DENV2 prMGQ868589 | DENV2 prMEU482733 | DENV2 prMAY786402 | DENV2 prMAY786398 |
| DENV2 prMFJ850078 | DENV2 prMFJ850088 | DENV2 prMU88237 | DENV2 prMDQ448232 |
| DENV2 prMFM210243 | DENV2 prMDQ448233 | DENV2 prMDQ448235 | DENV2 prMAY786374 |
| DENV2 prMEU482671 | DENV2 prMAY786374 | DENV2 prMAY786399 | DENV2 prMAY786393 |
| DENV2 prMEU482571 | DENV2 prMAY786393 | DENV2 prMAY449680 | DENV2 prMAY786382 |
| DENV2 prMDQ645544 | DENV2 prMAY786382 | DENV2 prMEF441283 | DENV2 prMAY786384 |
| DENV2 prMFM210238 | DENV2 prMAY786384 | DENV2 prMAY786377 | DENV2 prMAY775305 |
| DENV2 prMEF105379 | DENV2 prMAY775305 | DENV2 prMAF360862 | DENV2 prMAY714062 |
| DENV2 prMEU482728 | DENV2 prMAY714062 | DENV2 prMAY786404 | DENV2 prMAY786401 |
| DENV2 prMFM210229 | DENV2 prMAY786401 | DENV2 prMAF509530 | DENV2 prMAY449682 |
| DENV2 prMGU131880 | DENV2 prMAY449682 | DENV2 prMAY786373 | DENV2 prMAY786378 |
| DENV2 prMM19197 | DENV2 prMAY786378 | DENV2 prMX51713 | DENV2 prMAY786400 |
| DENV2 prMGQ868603 | DENV2 prMAY786400 | DENV2 prMAY786392 | DENV2 prMEF440433 |
| DENV2 prMGU131929 | DENV2 prMEF440433 | DENV2 prMAY714061 | DENV2 prMAY786405 |
| DENV2 prMFJ639732 | DENV2 prMAY786405 | DENV2 prMAY786368 | DENV2 prMAY449679 |
| DENV2 prMEU677143 | DENV2 prMAY449679 | DENV2 prMAY775306 | DENV2 prMAY786389 |
| DENV2 prMEU482682 | DENV2 prMAY786389 | DENV2 prMAY786383 | DENV2 prMAY786367 |
| DENV2 prMAY786372 | DENV2 prMAY786367 | DENV2 prMX72849 | DENV2 prMAY449677 |
| DENV2 prMGQ868641 | DENV2 prMAY449677 | DENV2 prMAY786379 | DENV2 prMAY449685 |
| DENV2 prMEU482785 | DENV2 prMAY449685 | DENV2 prMAY786375 | DENV2 prMAF469175 |
| DENV2 prMAY644452 | DENV2 prMAF469175 | DENV2 prMAY449681 | DENV2 prMD00345 |
| DENV2 prMFJ410193 | DENV2 prMD00345 | DENV2 prMDQ448238 | DENV2 prMDQ420622 |

FIG. 67-97

| Virus Protein Accession No. | Virus Protein Accession No. | Virus Protein Accession No. | Virus Protein Accession No. |
|---|---|---|---|
| DENV2 prMAY449684 | DENV2 prMAY449678 | DENV2 prMAY786395 | DENV2 prMAF360860 |
| DENV2 prMAY466449 | DENV2 prML04561 | DENV2 prMAY786371 | DENV2 prMAY786386 |
| DENV2 prMFJ937968 | DENV2 prMAY786370 | DENV2 prMAY786387 | DENV2 prMM15075 |
| DENV2 prMAY786391 | DENV2 prMAY044442 | DENV2 prMAY449676 | DENV2 prMAY786403 |
| DENV2 prMAY786376 | DENV2 prMAY786388 | DENV2 prMX51712 | DENV2 prMX51711 |
| DENV2 prMAY786380 | DENV2 prMAY449675 | DENV2 prMAY786397 | DENV2 prMAY786372 |
| DENV2 prMAY786366 | DENV2 prMAY778960 | DENV2 prMAY775307 | DENV2 prMAY644452 |
| DENV2 prMAF360861 | DENV2 prMD00346 | DENV2 prMAF360863 | DENV2 prMAY786398 |
| DENV2 prMAY778961 | DENV2 prMAY449683 | DENV2 prMAY786390 | DENV2 prMAY786374 |
| DENV2 prMAY786406 | DENV2 prMAY786396 | DENV2 prMAY786385 | DENV2 prMAY786393 |
| DENV2 prMAY786395 | DENV2 prMAF360860 | DENV2 prMAF469176 | DENV2 prMAY786382 |
| DENV2 prMAY786371 | DENV2 prMAY786386 | DENV2 prMX65242 | DENV2 prMAY786384 |
| DENV2 prMAY786387 | DENV2 prMM15075 | DENV2 prMAY642588 | DENV2 prMAY775305 |
| DENV2 prMAY449676 | DENV2 prMAY786403 | DENV2 prMAY786402 | DENV2 prMAY714062 |
| DENV2 prMX51712 | DENV2 prMX51711 | DENV2 prMAY786399 | DENV2 prMAY786401 |
| DENV2 prMAY786397 | DENV2 prMAY786372 | DENV2 prMAY449680 | DENV2 prMAY449682 |
| DENV2 prMAY775307 | DENV2 prMAY644452 | DENV2 prMEF441283 | DENV2 prMAY786378 |
| DENV2 prMAF360863 | DENV2 prMAY786398 | DENV2 prMAY786377 | DENV2 prMAY786400 |
| DENV2 prMAY786390 | DENV2 prMAY786374 | DENV2 prMAF360862 | DENV2 prMEF440433 |
| DENV2 prMAY786385 | DENV2 prMAY786393 | DENV2 prMAY786404 | DENV2 prMAY786405 |
| DENV2 prMAF469176 | DENV2 prMAY786382 | DENV2 prMAF509530 | DENV2 prMAY449679 |
| DENV2 prMX65242 | DENV2 prMAY786384 | DENV2 prMAY786373 | DENV2 prMAY786389 |
| DENV2 prMAY642588 | DENV2 prMAY775305 | DENV2 prMX51713 | DENV2 prMAY786367 |
| DENV2 prMAY786402 | DENV2 prMAY714062 | DENV2 prMAY786392 | DENV2 prMAY449677 |
| DENV2 prMAY786399 | DENV2 prMAY786401 | DENV2 prMAY714061 | DENV2 prMAY449685 |
| DENV2 prMAY449680 | DENV2 prMAY449682 | DENV2 prMAY786368 | DENV2 prMAF469175 |
| DENV2 prMEF441283 | DENV2 prMAY786378 | DENV2 prMAY775306 | DENV2 prMD00345 |
| DENV2 prMAY786377 | DENV2 prMAY786400 | DENV2 prMAY786383 | DENV2 prMDQ420622 |
| DENV2 prMAF360862 | DENV2 prMEF440433 | DENV2 prMX72849 | DENV2 prMAY449684 |
| DENV2 prMAY786404 | DENV2 prMAY786405 | DENV2 prMAY786379 | DENV2 prMAY466449 |
| DENV2 prMAF509530 | DENV2 prMAY449679 | DENV2 prMAY786375 | DENV2 prMFJ937968 |
| DENV2 prMAY786373 | DENV2 prMAY786389 | DENV2 prMAY449681 | DENV2 prMAY786391 |
| DENV2 prMX51713 | DENV2 prMAY786367 | DENV2 prMAY786394 | DENV2 prMAY786376 |
| DENV2 prMAY786392 | DENV2 prMAY449677 | DENV2 prMAY786369 | DENV2 prMAY786380 |
| DENV2 prMAY714061 | DENV2 prMAY449685 | DENV2 prMAY786381 | DENV2 prMAY786366 |
| DENV2 prMAY786368 | DENV2 prMAF469175 | DENV2 prMAY775303 | DENV2 prMAF360861 |
| DENV2 prMAY775306 | DENV2 prMD00345 | DENV2 prMAY775304 | DENV2 prMAY778961 |
| DENV2 prMAY786383 | DENV2 prMDQ420622 | DENV2 prMFJ937969 | DENV2 prMAY786406 |
| DENV2 prMX72849 | DENV2 prMAY449684 | DENV2 prMAY449678 | DENV2 prMAY786395 |
| DENV2 prMAY786379 | DENV2 prMAY466449 | DENV2 prML04561 | DENV2 prMAY786371 |
| DENV2 prMAY786375 | DENV2 prMFJ937968 | DENV2 prMAY786370 | DENV2 prMAY786387 |
| DENV2 prMAY449681 | DENV2 prMAY786391 | DENV2 prMAY044442 | DENV2 prMAY449676 |
| DENV2 prMAY786394 | DENV2 prMAY786376 | DENV2 prMAY786388 | DENV2 prMX51712 |
| DENV2 prMAY786369 | DENV2 prMAY786380 | DENV2 prMAY449675 | DENV2 prMAY786397 |
| DENV2 prMAY786381 | DENV2 prMAY786366 | DENV2 prMAY778960 | DENV2 prMAY775307 |
| DENV2 prMAY775303 | DENV2 prMAF360861 | DENV2 prMD00346 | DENV2 prMAF360863 |
| DENV2 prMAY775304 | DENV2 prMAY778961 | DENV2 prMAY449683 | DENV2 prMAY786390 |
| DENV2 prMFJ937969 | DENV2 prMAY786406 | DENV2 prMAY786396 | DENV2 prMAY786385 |

FIG. 67-98

Virus Protein Accession No.   Virus  Protein Accession No.  Virus  Protein  Accession No.  Virus  Protein   Accession No.

DENV2 prM AF469176
DENV2 prM X65242
DENV2 prM AY642588
DENV2 prM AY786402
DENV2 prM AY786399
DENV2 prM AY449680
DENV2 prM EF441283
DENV2 prM AY786377
DENV2 prM AF360862
DENV2 prM AY786404
DENV2 prM AF509530
DENV2 prM AY786373
DENV2 prM X51713
DENV2 prM AY786392
DENV2 prM AY714061
DENV2 prM AY786368
DENV2 prM AY775306
DENV2 prM AY786383
DENV2 prM X72849
DENV2 prM AY786379
DENV2 prM AY786375
DENV2 prM AY449681
DENV2 prM AY786394
DENV2 prM AY786369
DENV2 prM AY786381
DENV2 prM AY775303
DENV2 prM AY775304
DENV2 prM FJ937969
DENV2 prM AY449678
DENV2 prM L04561
DENV2 prM AY786370
DENV2 prM AY044442
DENV2 prM AY786388
DENV2 prM AY449675
DENV2 prM AY778960
DENV2 prM D00346
DENV2 prM AY449683
DENV2 prM AY786396
DENV2 prM AF360860
DENV2 prM AY786386
DENV2 prM M15075
DENV2 prM AY786403
DENV2 prM X51711
DENV2 prM AY786372
DENV2 prM AY644452
DENV2 prM AY786398

FIG. 68-1

| Virus Protein | Accession No. | Virus Protein | Accession No. | Virus Protein | Accession No. | Virus Protein | Accession No. |
|---|---|---|---|---|---|---|---|
| DENV3 2K | FN429898 | DENV3 2K | DQ401691 | DENV3 2K | GQ868577 | DENV3 2K | FJ547084 |
| DENV3 2K | GQ868576 | DENV3 2K | FN429908 | DENV3 2K | EU081198 | DENV3 2K | FJ639774 |
| DENV3 2K | EU596493 | DENV3 2K | EU482566 | DENV3 2K | GU189648 | DENV3 2K | GU131915 |
| DENV3 2K | GQ868634 | DENV3 2K | EU687233 | DENV3 2K | EU660409 | DENV3 2K | FJ850056 |
| DENV3 2K | AB214880 | DENV3 2K | AY496874 | DENV3 2K | FJ373306 | DENV3 2K | FJ562107 |
| DENV3 2K | FJ639767 | DENV3 2K | GU131862 | DENV3 2K | FJ898463 | DENV3 2K | FJ639759 |
| DENV3 2K | EF629373 | DENV3 2K | EU482614 | DENV3 2K | FJ410177 | DENV3 2K | DQ675519 |
| DENV3 2K | AY858041 | DENV3 2K | GU131872 | DENV3 2K | DQ675530 | DENV3 2K | FJ639715 |
| DENV3 2K | AY744678 | DENV3 2K | FJ639770 | DENV3 2K | FJ744730 | DENV3 2K | FJ024466 |
| DENV3 2K | GQ199860 | DENV3 2K | FJ810413 | DENV3 2K | EU081206 | DENV3 2K | FJ898447 |
| DENV3 2K | FJ373302 | DENV3 2K | GU131861 | DENV3 2K | EU529691 | DENV3 2K | EU081184 |
| DENV3 2K | FJ390375 | DENV3 2K | FJ182040 | DENV3 2K | EU081220 | DENV3 2K | EU482595 |
| DENV3 2K | FJ639801 | DENV3 2K | FJ882573 | DENV3 2K | GQ868546 | DENV3 2K | GQ199871 |
| DENV3 2K | DQ675522 | DENV3 2K | EU529699 | DENV3 2K | FJ639805 | DENV3 2K | FJ024470 |
| DENV3 2K | FJ639771 | DENV3 2K | FJ744735 | DENV3 2K | EU854291 | DENV3 2K | FN429910 |
| DENV3 2K | EU781137 | DENV3 2K | FJ024468 | DENV3 2K | EU081196 | DENV3 2K | AY496877 |
| DENV3 2K | GU131844 | DENV3 2K | AY744685 | DENV3 2K | FJ182039 | DENV3 2K | EF629370 |
| DENV3 2K | FJ639747 | DENV3 2K | DQ675527 | DENV3 2K | GU131877 | DENV3 2K | FJ639775 |
| DENV3 2K | CS477305 | DENV3 2K | AY744682 | DENV3 2K | DQ675520 | DENV3 2K | GU131952 |
| DENV3 2K | FJ562099 | DENV3 2K | EU529683 | DENV3 2K | FJ024467 | DENV3 2K | EU660420 |
| DENV3 2K | FJ898455 | DENV3 2K | FJ639777 | DENV3 2K | FN429903 | DENV3 2K | GQ199865 |
| DENV3 2K | FJ639817 | DENV3 2K | EU529692 | DENV3 2K | FJ744738 | DENV3 2K | FJ810414 |
| DENV3 2K | EU081185 | DENV3 2K | FJ898476 | DENV3 2K | EU081188 | DENV3 2K | FJ639799 |
| DENV3 2K | FJ182037 | DENV3 2K | EU081211 | DENV3 2K | EU482462 | DENV3 2K | EU687219 |
| DENV3 2K | EU482455 | DENV3 2K | FJ547066 | DENV3 2K | FJ898440 | DENV3 2K | FJ898442 |
| DENV3 2K | AY858046 | DENV3 2K | FJ882577 | DENV3 2K | GQ252678 | DENV3 2K | FJ390371 |
| DENV3 2K | M93130 | DENV3 2K | FN429900 | DENV3 2K | FJ882575 | DENV3 2K | EF629368 |
| DENV3 2K | FJ850052 | DENV3 2K | FJ639765 | DENV3 2K | FJ639727 | DENV3 2K | EU081181 |
| DENV3 2K | EU660407 | DENV3 2K | EU726769 | DENV3 2K | GU131870 | DENV3 2K | FJ182007 |
| DENV3 2K | FJ024465 | DENV3 2K | GQ199888 | DENV3 2K | FJ639826 | DENV3 2K | FJ639827 |
| DENV3 2K | FJ461334 | DENV3 2K | FJ639786 | DENV3 2K | GU131934 | DENV3 2K | EU367962 |
| DENV3 2K | FN429917 | DENV3 2K | FJ478456 | DENV3 2K | EF643017 | DENV3 2K | DQ401689 |
| DENV3 2K | GQ868593 | DENV3 2K | GQ868617 | DENV3 2K | GU131856 | DENV3 2K | DQ675531 |
| DENV3 2K | GU131866 | DENV3 2K | FJ898444 | DENV3 2K | DQ675525 | DENV3 2K | FJ639750 |
| DENV3 2K | EU482559 | DENV3 2K | GU370052 | DENV3 2K | FJ850097 | DENV3 2K | FJ461326 |
| DENV3 2K | EU081201 | DENV3 2K | EU660411 | DENV3 2K | FJ639722 | DENV3 2K | GU131854 |
| DENV3 2K | FJ373304 | DENV3 2K | EU482453 | DENV3 2K | AB189127 | DENV3 2K | FJ432722 |
| DENV3 2K | FN429915 | DENV3 2K | FJ182005 | DENV3 2K | FJ639720 | DENV3 2K | DQ675523 |
| DENV3 2K | EU529687 | DENV3 2K | GQ868574 | DENV3 2K | FJ639729 | DENV3 2K | FJ547076 |
| DENV3 2K | EU081208 | DENV3 2K | GU131941 | DENV3 2K | GU131868 | DENV3 2K | FJ461337 |
| DENV3 2K | GU131951 | DENV3 2K | EU529689 | DENV3 2K | FJ639793 | DENV3 2K | FJ639769 |
| DENV3 2K | FJ898468 | DENV3 2K | GU131954 | DENV3 2K | GU363549 | DENV3 2K | GQ868629 |
| DENV3 2K | GU131846 | DENV3 2K | AY676352 | DENV3 2K | FJ850109 | DENV3 2K | FN429905 |
| DENV3 2K | FJ547078 | DENV3 2K | AY099337 | DENV3 2K | EU081218 | DENV3 2K | FJ898459 |
| DENV3 2K | FJ898457 | DENV3 2K | FJ182015 | DENV3 2K | FJ547081 | DENV3 2K | GQ868586 |
| DENV3 2K | FJ639795 | DENV3 2K | FJ850049 | DENV3 2K | GU131912 | DENV3 2K | EU081216 |
| DENV3 2K | FJ639757 | DENV3 2K | FJ639713 | DENV3 2K | AY923865 | DENV3 2K | EU482452 |
| DENV3 2K | EU569689 | DENV3 2K | CS479205 | DENV3 2K | AY858045 | DENV3 2K | AY766104 |

FIG. 68-2

| Virus | Protein | Accession No. | Virus | Protein | Accession No. | Virus | Protein | Accession No. | Virus | Protein | Accession No. |
|---|---|---|---|---|---|---|---|---|---|---|---|
| DENV3 | 2K | FJ898474 | DENV3 | 2K | EU081214 | DENV3 | 2K | AB189126 | DENV3 | 2K | AY744677 |
| DENV3 | 2K | FJ639724 | DENV3 | 2K | EF629366 | DENV3 | 2K | FJ898458 | DENV3 | 2K | FN429901 |
| DENV3 | 2K | EU081222 | DENV3 | 2K | AY744680 | DENV3 | 2K | FJ744740 | DENV3 | 2K | EU687226 |
| DENV3 | 2K | CS805345 | DENV3 | 2K | FJ639755 | DENV3 | 2K | EU854292 | DENV3 | 2K | FN429914 |
| DENV3 | 2K | AY648961 | DENV3 | 2K | DQ675533 | DENV3 | 2K | FN429902 | DENV3 | 2K | FJ639768 |
| DENV3 | 2K | FJ562102 | DENV3 | 2K | GU131906 | DENV3 | 2K | GU131907 | DENV3 | 2K | FJ547061 |
| DENV3 | 2K | EU081193 | DENV3 | 2K | GQ868627 | DENV3 | 2K | EU482612 | DENV3 | 2K | GU131917 |
| DENV3 | 2K | FJ639754 | DENV3 | 2K | GU131943 | DENV3 | 2K | GU131849 | DENV3 | 2K | FJ432728 |
| DENV3 | 2K | GU131865 | DENV3 | 2K | EU482564 | DENV3 | 2K | FJ373303 | DENV3 | 2K | EU482456 |
| DENV3 | 2K | GU131858 | DENV3 | 2K | GQ199887 | DENV3 | 2K | EU081224 | DENV3 | 2K | GU370053 |
| DENV3 | 2K | FJ639791 | DENV3 | 2K | EU726772 | DENV3 | 2K | FJ873812 | DENV3 | 2K | FJ744736 |
| DENV3 | 2K | EU529704 | DENV3 | 2K | FJ182010 | DENV3 | 2K | FJ744734 | DENV3 | 2K | DQ675532 |
| DENV3 | 2K | GU131936 | DENV3 | 2K | EU081203 | DENV3 | 2K | FJ850096 | DENV3 | 2K | FN429904 |
| DENV3 | 2K | GU131903 | DENV3 | 2K | FJ562097 | DENV3 | 2K | FJ639787 | DENV3 | 2K | FJ744731 |
| DENV3 | 2K | DQ401694 | DENV3 | 2K | FJ547071 | DENV3 | 2K | FJ882574 | DENV3 | 2K | FJ744737 |
| DENV3 | 2K | EU081205 | DENV3 | 2K | GU131946 | DENV3 | 2K | GU131873 | DENV3 | 2K | AY858037 |
| DENV3 | 2K | FJ898470 | DENV3 | 2K | EU529685 | DENV3 | 2K | GU131867 | DENV3 | 2K | FJ547077 |
| DENV3 | 2K | GQ868571 | DENV3 | 2K | EU081219 | DENV3 | 2K | GQ199889 | DENV3 | 2K | EU569688 |
| DENV3 | 2K | AB189128 | DENV3 | 2K | FJ882571 | DENV3 | 2K | GQ252674 | DENV3 | 2K | GU131871 |
| DENV3 | 2K | FJ182009 | DENV3 | 2K | FJ639762 | DENV3 | 2K | EU687198 | DENV3 | 2K | GU131845 |
| DENV3 | 2K | FJ810416 | DENV3 | 2K | EU081186 | DENV3 | 2K | FJ432743 | DENV3 | 2K | EU081195 |
| DENV3 | 2K | GU131852 | DENV3 | 2K | GQ868547 | DENV3 | 2K | FJ461322 | DENV3 | 2K | FJ898456 |
| DENV3 | 2K | FN429897 | DENV3 | 2K | GU131878 | DENV3 | 2K | GQ868626 | DENV3 | 2K | EU081187 |
| DENV3 | 2K | GU131950 | DENV3 | 2K | EU569690 | DENV3 | 2K | FJ639728 | DENV3 | 2K | GU131847 |
| DENV3 | 2K | FN429896 | DENV3 | 2K | FJ850110 | DENV3 | 2K | FJ639758 | DENV3 | 2K | EU081207 |
| DENV3 | 2K | FJ639789 | DENV3 | 2K | AY744679 | DENV3 | 2K | AY776329 | DENV3 | 2K | FJ410176 |
| DENV3 | 2K | FJ390373 | DENV3 | 2K | FJ639784 | DENV3 | 2K | FJ639721 | DENV3 | 2K | AY770511 |
| DENV3 | 2K | FJ687448 | DENV3 | 2K | FJ850080 | DENV3 | 2K | FJ547080 | DENV3 | 2K | GU131933 |
| DENV3 | 2K | FJ639731 | DENV3 | 2K | FJ205870 | DENV3 | 2K | FJ639778 | DENV3 | 2K | GQ199870 |
| DENV3 | 2K | FN429907 | DENV3 | 2K | AY858043 | DENV3 | 2K | EU081192 | DENV3 | 2K | FJ850098 |
| DENV3 | 2K | AY496879 | DENV3 | 2K | EU596492 | DENV3 | 2K | GQ199886 | DENV3 | 2K | AB189125 |
| DENV3 | 2K | EU529697 | DENV3 | 2K | GU131875 | DENV3 | 2K | GQ868587 | DENV3 | 2K | FJ432741 |
| DENV3 | 2K | FJ744728 | DENV3 | 2K | EU081191 | DENV3 | 2K | DQ675521 | DENV3 | 2K | EU529690 |
| DENV3 | 2K | FJ639825 | DENV3 | 2K | AY858040 | DENV3 | 2K | FJ182013 | DENV3 | 2K | FJ639804 |
| DENV3 | 2K | GU131914 | DENV3 | 2K | EU482458 | DENV3 | 2K | FJ882576 | DENV3 | 2K | FJ182038 |
| DENV3 | 2K | FJ898472 | DENV3 | 2K | EU687197 | DENV3 | 2K | FN429916 | DENV3 | 2K | DQ675526 |
| DENV3 | 2K | FJ547074 | DENV3 | 2K | GQ868578 | DENV3 | 2K | GU131913 | DENV3 | 2K | GU131857 |
| DENV3 | 2K | FJ898469 | DENV3 | 2K | GU131876 | DENV3 | 2K | EF629376 | DENV3 | 2K | AB214882 |
| DENV3 | 2K | FJ744726 | DENV3 | 2K | FJ547072 | DENV3 | 2K | EU781136 | DENV3 | 2K | EU081217 |
| DENV3 | 2K | FJ639725 | DENV3 | 2K | FJ639779 | DENV3 | 2K | FJ639726 | DENV3 | 2K | FJ024469 |
| DENV3 | 2K | GU131851 | DENV3 | 2K | FJ562103 | DENV3 | 2K | EU081209 | DENV3 | 2K | AB214881 |
| DENV3 | 2K | EU482555 | DENV3 | 2K | DQ401692 | DENV3 | 2K | FJ639712 | DENV3 | 2K | GU131911 |
| DENV3 | 2K | GU131938 | DENV3 | 2K | FJ639792 | DENV3 | 2K | EU482461 | DENV3 | 2K | GU131869 |
| DENV3 | 2K | EU726773 | DENV3 | 2K | AY496873 | DENV3 | 2K | AY858047 | DENV3 | 2K | EU932688 |
| DENV3 | 2K | GQ868616 | DENV3 | 2K | FN429909 | DENV3 | 2K | AY676353 | DENV3 | 2K | FJ547070 |
| DENV3 | 2K | GQ199862 | DENV3 | 2K | FJ639816 | DENV3 | 2K | EU081210 | DENV3 | 2K | FJ639790 |
| DENV3 | 2K | GU131908 | DENV3 | 2K | FJ744700 | DENV3 | 2K | EU081199 | DENV3 | 2K | FJ639772 |
| DENV3 | 2K | AY858039 | DENV3 | 2K | EU081202 | DENV3 | 2K | EU726774 | DENV3 | 2K | EU081190 |

FIG. 68-3

| Virus | Protein | Accession No. | Virus | Protein | Accession No. | Virus | Protein | Accession No. | Virus | Protein | Accession No. |
|---|---|---|---|---|---|---|---|---|---|---|---|
| DENV3 | 2K | FJ639723 | DENV3 | 2K | AY679147 | DENV3 | 2K | FJ639798 | DENV3 | 2K | EU529703 |
| DENV3 | 2K | EU482613 | DENV3 | 2K | GU131904 | DENV3 | 2K | FJ639803 | DENV3 | 2K | FJ639782 |
| DENV3 | 2K | FJ850055 | DENV3 | 2K | FJ461338 | DENV3 | 2K | FJ432731 | DENV3 | 2K | FJ639800 |
| DENV3 | 2K | EU482558 | DENV3 | 2K | EU081213 | DENV3 | 2K | AF317645 | DENV3 | 2K | GU131918 |
| DENV3 | 2K | FN429899 | DENV3 | 2K | AY744681 | DENV3 | 2K | FJ898445 | DENV3 | 2K | FJ182008 |
| DENV3 | 2K | EU660410 | DENV3 | 2K | AY662691 | DENV3 | 2K | FJ182006 | DENV3 | 2K | FJ639719 |
| DENV3 | 2K | AY858044 | DENV3 | 2K | AY876494 | DENV3 | 2K | FJ547069 | DENV3 | 2K | GU131939 |
| DENV3 | 2K | EU726768 | DENV3 | 2K | GU131944 | DENV3 | 2K | EU687234 | DENV3 | 2K | FJ639749 |
| DENV3 | 2K | FJ639766 | DENV3 | 2K | EU687221 | DENV3 | 2K | FJ850092 | DENV3 | 2K | GU131848 |
| DENV3 | 2K | EU529698 | DENV3 | 2K | EU529705 | DENV3 | 2K | FJ390377 | DENV3 | 2K | GU131859 |
| DENV3 | 2K | EU687239 | DENV3 | 2K | EU726771 | DENV3 | 2K | FJ547075 | DENV3 | 2K | FJ182011 |
| DENV3 | 2K | DQ675528 | DENV3 | 2K | GQ868572 | DENV3 | 2K | FJ850089 | DENV3 | 2K | AY858038 |
| DENV3 | 2K | FJ639807 | DENV3 | 2K | FJ898473 | DENV3 | 2K | AY744683 | DENV3 | 2K | FJ547085 |
| DENV3 | 2K | FJ898475 | DENV3 | 2K | EU687196 | DENV3 | 2K | FJ639756 | DENV3 | 2K | GU131953 |
| DENV3 | 2K | EU081200 | DENV3 | 2K | FN429906 | DENV3 | 2K | FJ547062 | DENV3 | 2K | DQ675524 |
| DENV3 | 2K | FJ390376 | DENV3 | 2K | FJ639730 | DENV3 | 2K | EF629367 | DENV3 | 2K | FJ898471 |
| DENV3 | 2K | EU529702 | DENV3 | 2K | EU081215 | DENV3 | 2K | AY858048 | DENV3 | 2K | EU596494 |
| DENV3 | 2K | FJ639781 | DENV3 | 2K | GU131935 | DENV3 | 2K | GU131905 | DENV3 | 2K | EU569691 |
| DENV3 | 2K | FJ182004 | DENV3 | 2K | FN429913 | DENV3 | 2K | FB667400 | DENV3 | 2K | AB214879 |
| DENV3 | 2K | FJ898443 | DENV3 | 2K | FJ639751 | DENV3 | 2K | EU482460 | DENV3 | 2K | EU854298 |
| DENV3 | 2K | AY744684 | DENV3 | 2K | FJ639780 | DENV3 | 2K | FJ639753 | DENV3 | 2K | FJ390372 |
| DENV3 | 2K | FJ850048 | DENV3 | 2K | EU081189 | DENV3 | 2K | FJ882572 | DENV3 | 2K | FN429918 |
| DENV3 | 2K | GQ868575 | DENV3 | 2K | AY676350 | DENV3 | 2K | EU529684 | DENV3 | 2K | FJ744727 |
| DENV3 | 2K | FJ562100 | DENV3 | 2K | FJ898441 | DENV3 | 2K | FJ182041 | DENV3 | 2K | FJ744732 |
| DENV3 | 2K | GU131942 | DENV3 | 2K | FJ024471 | DENV3 | 2K | GQ199891 | DENV3 | 2K | FJ898446 |
| DENV3 | 2K | EU529688 | DENV3 | 2K | EU081221 | DENV3 | 2K | EU932687 | DENV3 | 2K | FJ744733 |
| DENV3 | 2K | DQ401690 | DENV3 | 2K | EU081223 | DENV3 | 2K | GQ868548 | DENV3 | 2K | FJ873813 |
| DENV3 | 2K | EF629369 | DENV3 | 2K | FJ410178 | DENV3 | 2K | FN429911 | DENV3 | 2K | GQ199861 |
| DENV3 | 2K | FJ639714 | DENV3 | 2K | EU482563 | DENV3 | 2K | GU131945 | DENV3 | 2K | EU081225 |
| DENV3 | 2K | AY676351 | DENV3 | 2K | GU131874 | DENV3 | 2K | FJ461329 | DENV3 | 2K | GU131850 |
| DENV3 | 2K | GQ868573 | DENV3 | 2K | FJ547082 | DENV3 | 2K | FJ850111 | DENV3 | 2K | FJ850094 |
| DENV3 | 2K | AY099336 | DENV3 | 2K | FJ547083 | DENV3 | 2K | FJ639776 | DENV3 | 2K | DQ675529 |
| DENV3 | 2K | EU081182 | DENV3 | 2K | FJ639760 | DENV3 | 2K | EU081194 | DENV3 | 2K | FJ850079 |
| DENV3 | 2K | GU131855 | DENV3 | 2K | GU131853 | DENV3 | 2K | FJ639761 | DENV3 | 2K | FJ547079 |
| DENV3 | 2K | DQ863638 | DENV3 | 2K | EU081183 | DENV3 | 2K | EU081204 | DENV3 | 2K | GU131909 |
| DENV3 | 2K | FJ639746 | DENV3 | 2K | GQ199864 | DENV3 | 2K | GQ868628 | DENV3 | 2K | AY496871 |
| DENV3 | 2K | EU482454 | DENV3 | 2K | NC_001475 | DENV3 | 2K | FJ850086 | DENV3 | 2K | GU131937 |
| DENV3 | 2K | EU081197 | DENV3 | 2K | EU482459 | DENV3 | 2K | FJ639785 | DENV3 | 2K | DQ401693 |
| DENV3 | 2K | EU081212 | DENV3 | 2K | FJ639716 | DENV3 | 2K | FJ639810 | DENV3 | 2K | FJ177308 |
| DENV3 | 2K | FJ850083 | DENV3 | 2K | FJ547073 | DENV3 | 2K | FJ882578 | DENV3 | 2K | EF629376 |
| DENV3 | 2K | EU660408 | DENV3 | 2K | FJ639763 | DENV3 | 2K | GU131940 | DENV3 | anC | DQ109257 |
| DENV3 | 2K | FJ639752 | DENV3 | 2K | FJ410229 | DENV3 | 2K | DQ401695 | DENV3 | anC | FN429898 |
| DENV3 | 2K | AY676349 | DENV3 | 2K | FJ898464 | DENV3 | 2K | EU529696 | DENV3 | anC | GQ868576 |
| DENV3 | 2K | FJ898462 | DENV3 | 2K | FJ744729 | DENV3 | 2K | AY858042 | DENV3 | anC | DQ109181 |
| DENV3 | 2K | FN429912 | DENV3 | 2K | EU687218 | DENV3 | 2K | EU482596 | DENV3 | anC | DQ109277 |
| DENV3 | 2K | EU529686 | DENV3 | 2K | GU131910 | DENV3 | 2K | FJ205871 | DENV3 | anC | EU596493 |
| DENV3 | 2K | FJ744739 | DENV3 | 2K | GU131916 | DENV3 | 2K | GU131860 | DENV3 | anC | GQ868634 |
| DENV3 | 2K | AY676348 | DENV3 | 2K | GQ199863 | DENV3 | 2K | EU482457 | DENV3 | anC | AY912455 |

FIG. 68-4

| Virus Protein Accession No. | Virus Protein Accession No. | Virus Protein Accession No. | Virus Protein Accession No. |
|---|---|---|---|
| DENV3 anC AB214880 | DENV3 anC FJ547078 | DENV3 anC EU052796 | DENV3 anC DQ109243 |
| DENV3 anC DQ109302 | DENV3 anC FJ898457 | DENV3 anC GQ199888 | DENV3 anC DQ109268 |
| DENV3 anC FJ639767 | DENV3 anC FJ639795 | DENV3 anC FJ639786 | DENV3 anC FJ024467 |
| DENV3 anC AY858041 | DENV3 anC FJ639757 | DENV3 anC AB038479 | DENV3 anC FN429903 |
| DENV3 anC AY744678 | DENV3 anC EU569689 | DENV3 anC FJ478456 | DENV3 anC FJ744738 |
| DENV3 anC GQ199860 | DENV3 anC DQ109283 | DENV3 anC GQ868617 | DENV3 anC DQ109292 |
| DENV3 anC FJ373302 | DENV3 anC DQ401691 | DENV3 anC FJ898444 | DENV3 anC DQ109237 |
| DENV3 anC FJ390375 | DENV3 anC AB038473 | DENV3 anC GU370052 | DENV3 anC AB010990 |
| DENV3 anC FJ639801 | DENV3 anC DQ323041 | DENV3 anC EU660411 | DENV3 anC EU081188 |
| DENV3 anC DQ675522 | DENV3 anC FN429908 | DENV3 anC EU482453 | DENV3 anC EU482462 |
| DENV3 anC AB038466 | DENV3 anC EU482566 | DENV3 anC FJ182005 | DENV3 anC FJ898440 |
| DENV3 anC FJ639771 | DENV3 anC DQ109274 | DENV3 anC AY912454 | DENV3 anC GQ252678 |
| DENV3 anC EU781137 | DENV3 anC EU687233 | DENV3 anC DQ109195 | DENV3 anC FJ882575 |
| DENV3 anC DQ109266 | DENV3 anC AY496874 | DENV3 anC GQ868574 | DENV3 anC FJ639727 |
| DENV3 anC AB038477 | DENV3 anC GU131862 | DENV3 anC GU131941 | DENV3 anC GU131870 |
| DENV3 anC GU131844 | DENV3 anC DQ109204 | DENV3 anC EU529689 | DENV3 anC DQ109202 |
| DENV3 anC FJ639747 | DENV3 anC EU482614 | DENV3 anC GU131954 | DENV3 anC FJ639826 |
| DENV3 anC CS477305 | DENV3 anC GU131872 | DENV3 anC AY676352 | DENV3 anC GU131934 |
| DENV3 anC FJ562099 | DENV3 anC DQ109219 | DENV3 anC AY099337 | DENV3 anC EF643017 |
| DENV3 anC FJ898455 | DENV3 anC FJ639770 | DENV3 anC FJ182015 | DENV3 anC GU131856 |
| DENV3 anC FJ639817 | DENV3 anC FJ810413 | DENV3 anC FJ850049 | DENV3 anC DQ675525 |
| DENV3 anC EU081185 | DENV3 anC DQ109279 | DENV3 anC FJ639713 | DENV3 anC DQ109217 |
| DENV3 anC FJ182037 | DENV3 anC GU131861 | DENV3 anC DQ109174 | DENV3 anC FJ850097 |
| DENV3 anC EU482455 | DENV3 anC FJ182040 | DENV3 anC CS479205 | DENV3 anC FJ639722 |
| DENV3 anC AY858046 | DENV3 anC EU052793 | DENV3 anC GQ868577 | DENV3 anC AB189127 |
| DENV3 anC M93130 | DENV3 anC FJ882573 | DENV3 anC EU081198 | DENV3 anC FJ639720 |
| DENV3 anC DQ109175 | DENV3 anC EU529699 | DENV3 anC DQ109183 | DENV3 anC FJ639729 |
| DENV3 anC FJ850052 | DENV3 anC FJ744735 | DENV3 anC GU189648 | DENV3 anC GU131868 |
| DENV3 anC EU660407 | DENV3 anC FJ024468 | DENV3 anC EU660409 | DENV3 anC FJ639793 |
| DENV3 anC DQ109180 | DENV3 anC AY744685 | DENV3 anC AB010985 | DENV3 anC GU363549 |
| DENV3 anC DQ109235 | DENV3 anC DQ675527 | DENV3 anC FJ373306 | DENV3 anC FJ850109 |
| DENV3 anC FJ024465 | DENV3 anC DQ109226 | DENV3 anC FJ898463 | DENV3 anC EU081218 |
| DENV3 anC FJ461334 | DENV3 anC AY744682 | DENV3 anC FJ410177 | DENV3 anC FJ547081 |
| DENV3 anC FN429917 | DENV3 anC EU529683 | DENV3 anC DQ675530 | DENV3 anC GU131912 |
| DENV3 anC GQ868593 | DENV3 anC DQ109177 | DENV3 anC FJ744730 | DENV3 anC AY923865 |
| DENV3 anC GU131866 | DENV3 anC DQ109298 | DENV3 anC DQ109291 | DENV3 anC DQ109270 |
| DENV3 anC EU482559 | DENV3 anC FJ639777 | DENV3 anC EU081206 | DENV3 anC AY858045 |
| DENV3 anC EU081201 | DENV3 anC EU529692 | DENV3 anC EU529691 | DENV3 anC FJ547084 |
| DENV3 anC FJ373304 | DENV3 anC FJ898476 | DENV3 anC EU081220 | DENV3 anC FJ639774 |
| DENV3 anC FN429915 | DENV3 anC AB038468 | DENV3 anC DQ109285 | DENV3 anC DQ109273 |
| DENV3 anC EU529687 | DENV3 anC EU081211 | DENV3 anC GQ868546 | DENV3 anC AB038471 |
| DENV3 anC EU081208 | DENV3 anC FJ547066 | DENV3 anC FJ639805 | DENV3 anC GU131915 |
| DENV3 anC DQ109225 | DENV3 anC DQ109259 | DENV3 anC EU854291 | DENV3 anC FJ850056 |
| DENV3 anC DQ109245 | DENV3 anC FJ882577 | DENV3 anC EU081196 | DENV3 anC FJ562107 |
| DENV3 anC GU131951 | DENV3 anC FN429900 | DENV3 anC FJ182039 | DENV3 anC FJ639759 |
| DENV3 anC FJ898468 | DENV3 anC FJ639765 | DENV3 anC DQ109192 | DENV3 anC DQ675519 |
| DENV3 anC DQ109280 | DENV3 anC EU052795 | DENV3 anC GU131877 | DENV3 anC FJ639715 |
| DENV3 anC GU131846 | DENV3 anC EU726769 | DENV3 anC DQ675520 | DENV3 anC FJ024466 |

FIG. 68-5

| Virus Protein Accession No. | Virus Protein Accession No. | Virus Protein Accession No. | Virus Protein Accession No. |
|---|---|---|---|
| DENV3 anC FJ898447 | DENV3 anC EU081216 | DENV3 anC FJ639731 | DENV3 anC FJ639762 |
| DENV3 anC EU081184 | DENV3 anC DQ109203 | DENV3 anC FN429907 | DENV3 anC EU081186 |
| DENV3 anC EU482595 | DENV3 anC EU482452 | DENV3 anC AY496879 | DENV3 anC GQ868547 |
| DENV3 anC GQ199871 | DENV3 anC AY766104 | DENV3 anC EU529697 | DENV3 anC GU131878 |
| DENV3 anC FJ024470 | DENV3 anC DQ109196 | DENV3 anC DQ323042 | DENV3 anC EU569690 |
| DENV3 anC FN429910 | DENV3 anC FJ898474 | DENV3 anC FJ744728 | DENV3 anC FJ850110 |
| DENV3 anC AY496877 | DENV3 anC FJ639724 | DENV3 anC FJ639825 | DENV3 anC AY744679 |
| DENV3 anC EF629370 | DENV3 anC DQ109261 | DENV3 anC GU131914 | DENV3 anC DQ109206 |
| DENV3 anC FJ639775 | DENV3 anC EU081222 | DENV3 anC FJ898472 | DENV3 anC FJ639784 |
| DENV3 anC GU131952 | DENV3 anC DQ109229 | DENV3 anC FJ547074 | DENV3 anC FJ850080 |
| DENV3 anC EU660420 | DENV3 anC M25277 | DENV3 anC AB038467 | DENV3 anC DQ109232 |
| DENV3 anC GQ199865 | DENV3 anC CS805345 | DENV3 anC FJ898469 | DENV3 anC DQ109212 |
| DENV3 anC FJ810414 | DENV3 anC AY648961 | DENV3 anC FJ744726 | DENV3 anC FJ205870 |
| DENV3 anC DQ109186 | DENV3 anC DQ109199 | DENV3 anC FJ639725 | DENV3 anC AY912458 |
| DENV3 anC DQ109287 | DENV3 anC FJ562102 | DENV3 anC GU131851 | DENV3 anC AY858043 |
| DENV3 anC FJ639799 | DENV3 anC EU081193 | DENV3 anC EU482555 | DENV3 anC EU596492 |
| DENV3 anC EU687219 | DENV3 anC FJ639754 | DENV3 anC GU131938 | DENV3 anC GU131875 |
| DENV3 anC FJ898442 | DENV3 anC GU131865 | DENV3 anC DQ109250 | DENV3 anC EU081191 |
| DENV3 anC FJ390371 | DENV3 anC EU052797 | DENV3 anC AB010989 | DENV3 anC AY858040 |
| DENV3 anC DQ109284 | DENV3 anC GU131858 | DENV3 anC EU726773 | DENV3 anC DQ109211 |
| DENV3 anC EF629368 | DENV3 anC DQ109208 | DENV3 anC DQ109297 | DENV3 anC EU482458 |
| DENV3 anC EU081181 | DENV3 anC AB038465 | DENV3 anC DQ109252 | DENV3 anC EU687197 |
| DENV3 anC FJ182007 | DENV3 anC FJ639791 | DENV3 anC GQ868616 | DENV3 anC GQ868578 |
| DENV3 anC FJ639827 | DENV3 anC EU529704 | DENV3 anC DQ109275 | DENV3 anC DQ323040 |
| DENV3 anC AB010986 | DENV3 anC DQ109239 | DENV3 anC GQ199862 | DENV3 anC GU131876 |
| DENV3 anC EU367962 | DENV3 anC DQ109294 | DENV3 anC GU131908 | DENV3 anC FJ547072 |
| DENV3 anC DQ401689 | DENV3 anC GU131936 | DENV3 anC AY858039 | DENV3 anC DQ109299 |
| DENV3 anC DQ675531 | DENV3 anC GU131903 | DENV3 anC DQ109303 | DENV3 anC AB038469 |
| DENV3 anC DQ109194 | DENV3 anC DQ401694 | DENV3 anC DQ109230 | DENV3 anC AY099340 |
| DENV3 anC FJ639750 | DENV3 anC EU081205 | DENV3 anC EU081214 | DENV3 anC FJ639779 |
| DENV3 anC FJ461326 | DENV3 anC FJ898470 | DENV3 anC EF629366 | DENV3 anC FJ562103 |
| DENV3 anC DQ109254 | DENV3 anC GQ868571 | DENV3 anC AY744680 | DENV3 anC DQ401692 |
| DENV3 anC GU131854 | DENV3 anC DQ109214 | DENV3 anC FJ639755 | DENV3 anC FJ639792 |
| DENV3 anC FJ432722 | DENV3 anC DQ323038 | DENV3 anC DQ675533 | DENV3 anC DQ109207 |
| DENV3 anC AY099339 | DENV3 anC EU052799 | DENV3 anC GU131906 | DENV3 anC AY496873 |
| DENV3 anC DQ675523 | DENV3 anC AB189128 | DENV3 anC GQ868627 | DENV3 anC FN429909 |
| DENV3 anC FJ547076 | DENV3 anC FJ182009 | DENV3 anC GU131943 | DENV3 anC FJ639816 |
| DENV3 anC DQ109263 | DENV3 anC FJ810416 | DENV3 anC EU482564 | DENV3 anC FJ744700 |
| DENV3 anC FJ461337 | DENV3 anC GU131852 | DENV3 anC GQ199887 | DENV3 anC EU081202 |
| DENV3 anC DQ109201 | DENV3 anC FN429897 | DENV3 anC EU726772 | DENV3 anC AB189126 |
| DENV3 anC DQ109289 | DENV3 anC GU131950 | DENV3 anC FJ182010 | DENV3 anC DQ109224 |
| DENV3 anC FJ639769 | DENV3 anC FN429896 | DENV3 anC EU081203 | DENV3 anC FJ898458 |
| DENV3 anC GQ868629 | DENV3 anC AB010982 | DENV3 anC FJ562097 | DENV3 anC FJ744740 |
| DENV3 anC FN429905 | DENV3 anC FJ639789 | DENV3 anC FJ547071 | DENV3 anC DQ109244 |
| DENV3 anC AB038475 | DENV3 anC FJ390373 | DENV3 anC GU131946 | DENV3 anC EU854292 |
| DENV3 anC DQ109240 | DENV3 anC FJ687448 | DENV3 anC EU529685 | DENV3 anC FN429902 |
| DENV3 anC FJ898459 | DENV3 anC DQ109249 | DENV3 anC EU081219 | DENV3 anC GU131907 |
| DENV3 anC GQ868586 | DENV3 anC AY099342 | DENV3 anC FJ882571 | DENV3 anC EU482612 |

FIG. 68-6

| Virus Protein Accession No. | Virus Protein Accession No. | Virus Protein Accession No. | Virus Protein Accession No. |
|---|---|---|---|
| DENV3 anC GU131849 | DENV3 anC AB038478 | DENV3 anC FJ182038 | DENV3 anC FJ639714 |
| DENV3 anC DQ109247 | DENV3 anC AY676353 | DENV3 anC DQ109205 | DENV3 anC AY676351 |
| DENV3 anC EU052794 | DENV3 anC DQ109234 | DENV3 anC DQ675526 | DENV3 anC GQ868573 |
| DENV3 anC FJ373303 | DENV3 anC EU081210 | DENV3 anC GU131857 | DENV3 anC DQ109267 |
| DENV3 anC EU081224 | DENV3 anC DQ109176 | DENV3 anC DQ109276 | DENV3 anC AY099336 |
| DENV3 anC FJ873812 | DENV3 anC EU081199 | DENV3 anC AB214882 | DENV3 anC EU081182 |
| DENV3 anC FJ744734 | DENV3 anC EU726774 | DENV3 anC DQ109216 | DENV3 anC GU131855 |
| DENV3 anC FJ850096 | DENV3 anC AY744677 | DENV3 anC EU081217 | DENV3 anC DQ863638 |
| DENV3 anC FJ639787 | DENV3 anC FN429901 | DENV3 anC FJ024469 | DENV3 anC FJ639746 |
| DENV3 anC FJ882574 | DENV3 anC DQ109290 | DENV3 anC AB214881 | DENV3 anC EU482454 |
| DENV3 anC GU131873 | DENV3 anC EU687226 | DENV3 anC GU131911 | DENV3 anC EU081197 |
| DENV3 anC GU131867 | DENV3 anC FN429914 | DENV3 anC GU131869 | DENV3 anC EU081212 |
| DENV3 anC GQ199889 | DENV3 anC FJ639768 | DENV3 anC EU932688 | DENV3 anC FJ850083 |
| DENV3 anC GQ252674 | DENV3 anC FJ547061 | DENV3 anC FJ547070 | DENV3 anC EU660408 |
| DENV3 anC AB038472 | DENV3 anC GU131917 | DENV3 anC FJ639790 | DENV3 anC FJ639752 |
| DENV3 anC EU687198 | DENV3 anC FJ432728 | DENV3 anC AB038470 | DENV3 anC AY676349 |
| DENV3 anC FJ432743 | DENV3 anC EU482456 | DENV3 anC FJ639772 | DENV3 anC FJ898462 |
| DENV3 anC FJ461322 | DENV3 anC GU370053 | DENV3 anC DQ109258 | DENV3 anC FN429912 |
| DENV3 anC GQ868626 | DENV3 anC FJ744736 | DENV3 anC EU081190 | DENV3 anC DQ109236 |
| DENV3 anC FJ639728 | DENV3 anC DQ675532 | DENV3 anC FJ639723 | DENV3 anC EU529686 |
| DENV3 anC DQ109265 | DENV3 anC DQ109215 | DENV3 anC EU482613 | DENV3 anC FJ744739 |
| DENV3 anC DQ323037 | DENV3 anC FN429904 | DENV3 anC FJ850055 | DENV3 anC DQ109269 |
| DENV3 anC FJ639758 | DENV3 anC FJ744731 | DENV3 anC EU482558 | DENV3 anC AY676348 |
| DENV3 anC EF440434 | DENV3 anC FJ744737 | DENV3 anC FN429899 | DENV3 anC AY679147 |
| DENV3 anC DQ109218 | DENV3 anC DQ109191 | DENV3 anC EU660410 | DENV3 anC DQ109200 |
| DENV3 anC AY776329 | DENV3 anC AY858037 | DENV3 anC AY858044 | DENV3 anC GU131904 |
| DENV3 anC FJ639721 | DENV3 anC AB010984 | DENV3 anC DQ109182 | DENV3 anC FJ461338 |
| DENV3 anC FJ547080 | DENV3 anC FJ547077 | DENV3 anC EU726768 | DENV3 anC EU081213 |
| DENV3 anC FJ639778 | DENV3 anC DQ109282 | DENV3 anC FJ639766 | DENV3 anC AY744681 |
| DENV3 anC EU081192 | DENV3 anC DQ109220 | DENV3 anC EU529698 | DENV3 anC AY662691 |
| DENV3 anC GQ199886 | DENV3 anC EU569688 | DENV3 anC EU687239 | DENV3 anC AY876494 |
| DENV3 anC GQ868587 | DENV3 anC GU131871 | DENV3 anC DQ675528 | DENV3 anC GU131944 |
| DENV3 anC DQ109301 | DENV3 anC GU131845 | DENV3 anC FJ639807 | DENV3 anC EU687221 |
| DENV3 anC DQ675521 | DENV3 anC EU081195 | DENV3 anC FJ898475 | DENV3 anC DQ109253 |
| DENV3 anC FJ182013 | DENV3 anC FJ898456 | DENV3 anC EU081200 | DENV3 anC AB038474 |
| DENV3 anC DQ109300 | DENV3 anC DQ109242 | DENV3 anC FJ390376 | DENV3 anC DQ109262 |
| DENV3 anC FJ882576 | DENV3 anC EU081187 | DENV3 anC EU529702 | DENV3 anC DQ109288 |
| DENV3 anC FN429916 | DENV3 anC GU131847 | DENV3 anC FJ639781 | DENV3 anC EU529705 |
| DENV3 anC GU131913 | DENV3 anC EU081207 | DENV3 anC FJ182004 | DENV3 anC EU726771 |
| DENV3 anC DQ109188 | DENV3 anC FJ410176 | DENV3 anC FJ898443 | DENV3 anC GQ868572 |
| DENV3 anC DQ109256 | DENV3 anC AY770511 | DENV3 anC AY744684 | DENV3 anC FJ898473 |
| DENV3 anC EU781136 | DENV3 anC GU131933 | DENV3 anC FJ850048 | DENV3 anC EU687196 |
| DENV3 anC FJ639726 | DENV3 anC GQ199870 | DENV3 anC GQ868575 | DENV3 anC DQ109228 |
| DENV3 anC DQ109189 | DENV3 anC FJ850098 | DENV3 anC FJ562100 | DENV3 anC FN429906 |
| DENV3 anC EU081209 | DENV3 anC AB189125 | DENV3 anC GU131942 | DENV3 anC FJ639730 |
| DENV3 anC FJ639712 | DENV3 anC FJ432741 | DENV3 anC EU529688 | DENV3 anC EU081215 |
| DENV3 anC EU482461 | DENV3 anC EU529690 | DENV3 anC DQ401690 | DENV3 anC GU131935 |
| DENV3 anC AY858047 | DENV3 anC FJ639804 | DENV3 anC EF629369 | DENV3 anC FN429913 |

FIG. 68-7

| Virus Protein Accession No. | Virus Protein Accession No. | Virus Protein Accession No. | Virus Protein Accession No. |
|---|---|---|---|
| DENV3 anC DQ109260 | DENV3 anC FJ898445 | DENV3 anC GU131940 | DENV3 anC FJ850094 |
| DENV3 anC FJ639751 | DENV3 anC AB010987 | DENV3 anC DQ401695 | DENV3 anC DQ675529 |
| DENV3 anC EU052798 | DENV3 anC FJ182006 | DENV3 anC EU529696 | DENV3 anC AB038476 |
| DENV3 anC DQ109271 | DENV3 anC FJ547069 | DENV3 anC DQ109209 | DENV3 anC FJ850079 |
| DENV3 anC FJ639780 | DENV3 anC EU687234 | DENV3 anC AY858042 | DENV3 anC FJ547079 |
| DENV3 anC EU081189 | DENV3 anC FJ850092 | DENV3 anC EU482596 | DENV3 anC GU131909 |
| DENV3 anC AY676350 | DENV3 anC FJ390377 | DENV3 anC DQ109238 | DENV3 anC DQ109281 |
| DENV3 anC FJ898441 | DENV3 anC DQ109184 | DENV3 anC FJ205871 | DENV3 anC AY496871 |
| DENV3 anC DQ109293 | DENV3 anC FJ547075 | DENV3 anC DQ109210 | DENV3 anC DQ109193 |
| DENV3 anC FJ024471 | DENV3 anC DQ109304 | DENV3 anC EU052792 | DENV3 anC GU131937 |
| DENV3 anC DQ109278 | DENV3 anC FJ850089 | DENV3 anC GU131860 | DENV3 anC DQ401693 |
| DENV3 anC EU081221 | DENV3 anC DQ109233 | DENV3 anC EU482457 | DENV3 anC FJ177308 |
| DENV3 anC DQ109213 | DENV3 anC AY744683 | DENV3 anC EU529703 | DENV3 anC DQ109257 |
| DENV3 anC EU081223 | DENV3 anC FJ639756 | DENV3 anC FJ639782 | DENV3 anC DQ109181 |
| DENV3 anC FJ410178 | DENV3 anC FJ547062 | DENV3 anC DQ109178 | DENV3 anC DQ109277 |
| DENV3 anC EU482563 | DENV3 anC EF629367 | DENV3 anC FJ639800 | DENV3 anC AY912455 |
| DENV3 anC GU131874 | DENV3 anC AY099341 | DENV3 anC GU131918 | DENV3 anC DQ109302 |
| DENV3 anC FJ547082 | DENV3 anC DQ109264 | DENV3 anC FJ182008 | DENV3 anC AB038466 |
| DENV3 anC DQ109190 | DENV3 anC AY858048 | DENV3 anC DQ109179 | DENV3 anC DQ109266 |
| DENV3 anC FJ547083 | DENV3 anC GU131905 | DENV3 anC FJ639719 | DENV3 anC AB038477 |
| DENV3 anC FJ639760 | DENV3 anC DQ109231 | DENV3 anC DQ109187 | DENV3 anC DQ109175 |
| DENV3 anC GU131853 | DENV3 anC FB667400 | DENV3 anC GU131939 | DENV3 anC DQ109180 |
| DENV3 anC DQ323039 | DENV3 anC EU482460 | DENV3 anC FJ639749 | DENV3 anC DQ109235 |
| DENV3 anC EU081183 | DENV3 anC FJ639753 | DENV3 anC GU131848 | DENV3 anC DQ109225 |
| DENV3 anC GQ199864 | DENV3 anC DQ109286 | DENV3 anC GU131859 | DENV3 anC DQ109245 |
| DENV3 anC NC_001475 | DENV3 anC FJ882572 | DENV3 anC FJ182011 | DENV3 anC DQ109280 |
| DENV3 anC EU482459 | DENV3 anC EU529684 | DENV3 anC AY858038 | DENV3 anC DQ109283 |
| DENV3 anC FJ639716 | DENV3 anC FJ182041 | DENV3 anC FJ547085 | DENV3 anC AB038473 |
| DENV3 anC FJ547073 | DENV3 anC GQ199891 | DENV3 anC AB010983 | DENV3 anC DQ323041 |
| DENV3 anC FJ639763 | DENV3 anC DQ109296 | DENV3 anC GU131953 | DENV3 anC DQ109274 |
| DENV3 anC FJ410229 | DENV3 anC DQ109246 | DENV3 anC DQ675524 | DENV3 anC EU687233 |
| DENV3 anC FJ898464 | DENV3 anC EU932687 | DENV3 anC FJ898471 | DENV3 anC DQ109204 |
| DENV3 anC FJ744729 | DENV3 anC GQ868548 | DENV3 anC EU596494 | DENV3 anC DQ109219 |
| DENV3 anC DQ109185 | DENV3 anC FN429911 | DENV3 anC EU569691 | DENV3 anC DQ109279 |
| DENV3 anC EU687218 | DENV3 anC GU131945 | DENV3 anC AB214879 | DENV3 anC EU052793 |
| DENV3 anC GU131910 | DENV3 anC FJ461329 | DENV3 anC EU854298 | DENV3 anC DQ109226 |
| DENV3 anC GU131916 | DENV3 anC FJ850111 | DENV3 anC FJ390372 | DENV3 anC DQ109177 |
| DENV3 anC GQ199863 | DENV3 anC FJ639776 | DENV3 anC FN429918 | DENV3 anC DQ109298 |
| DENV3 anC FJ639798 | DENV3 anC EU081194 | DENV3 anC FJ744727 | DENV3 anC AB038468 |
| DENV3 anC DQ109248 | DENV3 anC FJ639761 | DENV3 anC FJ744732 | DENV3 anC DQ109259 |
| DENV3 anC AB010988 | DENV3 anC EU081204 | DENV3 anC FJ898446 | DENV3 anC EU052795 |
| DENV3 anC DQ109222 | DENV3 anC DQ109295 | DENV3 anC FJ744733 | DENV3 anC EU052796 |
| DENV3 anC AY099338 | DENV3 anC GQ868628 | DENV3 anC FJ873813 | DENV3 anC AB038479 |
| DENV3 anC FJ639803 | DENV3 anC FJ850086 | DENV3 anC GQ199861 | DENV3 anC AY912454 |
| DENV3 anC FJ432731 | DENV3 anC FJ639785 | DENV3 anC EU081225 | DENV3 anC DQ109195 |
| DENV3 anC DQ109305 | DENV3 anC FJ639810 | DENV3 anC DQ109251 | DENV3 anC DQ109174 |
| DENV3 anC AF317645 | DENV3 anC FJ882578 | DENV3 anC GU131850 | DENV3 anC DQ109183 |
| DENV3 anC DQ109255 | DENV3 anC DQ109272 | DENV3 anC DQ109241 | DENV3 anC AB010985 |

FIG. 68-8

| Virus Protein Accession No. | Virus Protein Accession No. | Virus Protein Accession No. | Virus Protein Accession No. |
|---|---|---|---|
| DENV3 anC DQ109291 | DENV3 anC DQ109275 | DENV3 anC AB038474 | DENV3 anC DQ109266 |
| DENV3 anC DQ109285 | DENV3 anC DQ109303 | DENV3 anC DQ109262 | DENV3 anC DQ109175 |
| DENV3 anC DQ109192 | DENV3 anC DQ109230 | DENV3 anC DQ109288 | DENV3 anC DQ109180 |
| DENV3 anC DQ109243 | DENV3 anC DQ109206 | DENV3 anC DQ109228 | DENV3 anC DQ109235 |
| DENV3 anC DQ109268 | DENV3 anC DQ109232 | DENV3 anC DQ109260 | DENV3 anC DQ109225 |
| DENV3 anC DQ109292 | DENV3 anC DQ109212 | DENV3 anC EU052798 | DENV3 anC DQ109245 |
| DENV3 anC DQ109237 | DENV3 anC AY912458 | DENV3 anC DQ109271 | DENV3 anC DQ109280 |
| DENV3 anC AB010990 | DENV3 anC DQ109211 | DENV3 anC DQ109293 | DENV3 anC DQ109283 |
| DENV3 anC DQ109202 | DENV3 anC DQ323040 | DENV3 anC DQ109278 | DENV3 anC DQ323041 |
| DENV3 anC DQ109217 | DENV3 anC DQ109299 | DENV3 anC DQ109213 | DENV3 anC DQ109274 |
| DENV3 anC DQ109270 | DENV3 anC AB038469 | DENV3 anC DQ109190 | DENV3 anC DQ109204 |
| DENV3 anC DQ109273 | DENV3 anC AY099340 | DENV3 anC DQ323039 | DENV3 anC DQ109219 |
| DENV3 anC AB038471 | DENV3 anC DQ109207 | DENV3 anC DQ109185 | DENV3 anC DQ109279 |
| DENV3 anC DQ109186 | DENV3 anC DQ109224 | DENV3 anC DQ109248 | DENV3 anC DQ109226 |
| DENV3 anC DQ109287 | DENV3 anC DQ109244 | DENV3 anC AB010988 | DENV3 anC DQ109177 |
| DENV3 anC DQ109284 | DENV3 anC DQ109247 | DENV3 anC DQ109222 | DENV3 anC DQ109298 |
| DENV3 anC AB010986 | DENV3 anC EU052794 | DENV3 anC AY099338 | DENV3 anC DQ109259 |
| DENV3 anC DQ109194 | DENV3 anC AB038472 | DENV3 anC DQ109305 | DENV3 anC DQ109195 |
| DENV3 anC DQ109254 | DENV3 anC DQ109265 | DENV3 anC DQ109255 | DENV3 anC DQ109174 |
| DENV3 anC AY099339 | DENV3 anC DQ323037 | DENV3 anC AB010987 | DENV3 anC DQ109183 |
| DENV3 anC DQ109263 | DENV3 anC EF440434 | DENV3 anC DQ109184 | DENV3 anC DQ109291 |
| DENV3 anC DQ109201 | DENV3 anC DQ109218 | DENV3 anC DQ109304 | DENV3 anC DQ109285 |
| DENV3 anC DQ109289 | DENV3 anC DQ109301 | DENV3 anC DQ109233 | DENV3 anC DQ109192 |
| DENV3 anC AB038475 | DENV3 anC DQ109300 | DENV3 anC AY099341 | DENV3 anC DQ109243 |
| DENV3 anC DQ109240 | DENV3 anC DQ109188 | DENV3 anC DQ109264 | DENV3 anC DQ109268 |
| DENV3 anC DQ109203 | DENV3 anC DQ109256 | DENV3 anC DQ109231 | DENV3 anC DQ109292 |
| DENV3 anC DQ109196 | DENV3 anC DQ109189 | DENV3 anC DQ109286 | DENV3 anC DQ109237 |
| DENV3 anC DQ109261 | DENV3 anC AB038478 | DENV3 anC DQ109296 | DENV3 anC DQ109202 |
| DENV3 anC DQ109229 | DENV3 anC DQ109234 | DENV3 anC DQ109246 | DENV3 anC DQ109217 |
| DENV3 anC M25277 | DENV3 anC DQ109176 | DENV3 anC DQ109295 | DENV3 anC DQ109270 |
| DENV3 anC DQ109199 | DENV3 anC DQ109290 | DENV3 anC DQ109272 | DENV3 anC DQ109273 |
| DENV3 anC EU052797 | DENV3 anC DQ109215 | DENV3 anC DQ109209 | DENV3 anC DQ109186 |
| DENV3 anC DQ109208 | DENV3 anC DQ109191 | DENV3 anC DQ109238 | DENV3 anC DQ109287 |
| DENV3 anC AB038465 | DENV3 anC AB010984 | DENV3 anC DQ109210 | DENV3 anC DQ109284 |
| DENV3 anC DQ109239 | DENV3 anC DQ109282 | DENV3 anC EU052792 | DENV3 anC DQ109194 |
| DENV3 anC DQ109294 | DENV3 anC DQ109220 | DENV3 anC DQ109178 | DENV3 anC DQ109254 |
| DENV3 anC DQ109214 | DENV3 anC DQ109242 | DENV3 anC DQ109179 | DENV3 anC DQ109263 |
| DENV3 anC DQ323038 | DENV3 anC DQ109205 | DENV3 anC DQ109187 | DENV3 anC DQ109201 |
| DENV3 anC EU052799 | DENV3 anC DQ109276 | DENV3 anC AB010983 | DENV3 anC DQ109289 |
| DENV3 anC AB010982 | DENV3 anC DQ109216 | DENV3 anC DQ109251 | DENV3 anC DQ109240 |
| DENV3 anC DQ109249 | DENV3 anC AB038470 | DENV3 anC DQ109241 | DENV3 anC DQ109203 |
| DENV3 anC AY099342 | DENV3 anC DQ109258 | DENV3 anC AB038476 | DENV3 anC DQ109196 |
| DENV3 anC DQ323042 | DENV3 anC DQ109182 | DENV3 anC DQ109281 | DENV3 anC DQ109261 |
| DENV3 anC AB038467 | DENV3 anC DQ109267 | DENV3 anC DQ109193 | DENV3 anC DQ109229 |
| DENV3 anC DQ109250 | DENV3 anC DQ109236 | DENV3 anC DQ109257 | DENV3 anC DQ109199 |
| DENV3 anC AB010989 | DENV3 anC DQ109269 | DENV3 anC DQ109181 | DENV3 anC DQ109208 |
| DENV3 anC DQ109297 | DENV3 anC DQ109200 | DENV3 anC DQ109277 | DENV3 anC DQ109239 |
| DENV3 anC DQ109252 | DENV3 anC DQ109253 | DENV3 anC DQ109302 | DENV3 anC DQ109294 |

FIG. 68-9

| Virus Protein Accession No. | Virus Protein Accession No. | Virus Protein Accession No. | Virus Protein Accession No. |
|---|---|---|---|
| DENV3 anC DQ109214 | DENV3 anC DQ109228 | DENV3 anC DQ109219 | DENV3 anC DQ109232 |
| DENV3 anC DQ323038 | DENV3 anC DQ109260 | DENV3 anC DQ109279 | DENV3 anC DQ109212 |
| DENV3 anC DQ109249 | DENV3 anC DQ109271 | DENV3 anC DQ109226 | DENV3 anC DQ109211 |
| DENV3 anC DQ323042 | DENV3 anC DQ109293 | DENV3 anC DQ109177 | DENV3 anC DQ323040 |
| DENV3 anC DQ109250 | DENV3 anC DQ109278 | DENV3 anC DQ109298 | DENV3 anC DQ109299 |
| DENV3 anC DQ109297 | DENV3 anC DQ109213 | DENV3 anC DQ109259 | DENV3 anC DQ109207 |
| DENV3 anC DQ109252 | DENV3 anC DQ109190 | DENV3 anC DQ109195 | DENV3 anC DQ109224 |
| DENV3 anC DQ109275 | DENV3 anC DQ323039 | DENV3 anC DQ109174 | DENV3 anC DQ109244 |
| DENV3 anC DQ109303 | DENV3 anC DQ109185 | DENV3 anC DQ109183 | DENV3 anC DQ109247 |
| DENV3 anC DQ109230 | DENV3 anC DQ109248 | DENV3 anC DQ109291 | DENV3 anC DQ109265 |
| DENV3 anC DQ109206 | DENV3 anC DQ109222 | DENV3 anC DQ109285 | DENV3 anC DQ323037 |
| DENV3 anC DQ109232 | DENV3 anC DQ109305 | DENV3 anC DQ109192 | DENV3 anC DQ109218 |
| DENV3 anC DQ109212 | DENV3 anC DQ109255 | DENV3 anC DQ109243 | DENV3 anC DQ109301 |
| DENV3 anC DQ109211 | DENV3 anC DQ109184 | DENV3 anC DQ109268 | DENV3 anC DQ109300 |
| DENV3 anC DQ323040 | DENV3 anC DQ109304 | DENV3 anC DQ109292 | DENV3 anC DQ109188 |
| DENV3 anC DQ109299 | DENV3 anC DQ109233 | DENV3 anC DQ109237 | DENV3 anC DQ109256 |
| DENV3 anC DQ109207 | DENV3 anC DQ109264 | DENV3 anC DQ109202 | DENV3 anC DQ109189 |
| DENV3 anC DQ109224 | DENV3 anC DQ109231 | DENV3 anC DQ109217 | DENV3 anC DQ109234 |
| DENV3 anC DQ109244 | DENV3 anC DQ109286 | DENV3 anC DQ109270 | DENV3 anC DQ109176 |
| DENV3 anC DQ109247 | DENV3 anC DQ109296 | DENV3 anC DQ109273 | DENV3 anC DQ109290 |
| DENV3 anC DQ109265 | DENV3 anC DQ109246 | DENV3 anC DQ109186 | DENV3 anC DQ109215 |
| DENV3 anC DQ323037 | DENV3 anC DQ109295 | DENV3 anC DQ109287 | DENV3 anC DQ109191 |
| DENV3 anC DQ109218 | DENV3 anC DQ109272 | DENV3 anC DQ109284 | DENV3 anC DQ109282 |
| DENV3 anC DQ109301 | DENV3 anC DQ109209 | DENV3 anC DQ109194 | DENV3 anC DQ109220 |
| DENV3 anC DQ109300 | DENV3 anC DQ109238 | DENV3 anC DQ109254 | DENV3 anC DQ109242 |
| DENV3 anC DQ109188 | DENV3 anC DQ109210 | DENV3 anC DQ109263 | DENV3 anC DQ109205 |
| DENV3 anC DQ109256 | DENV3 anC DQ109178 | DENV3 anC DQ109201 | DENV3 anC DQ109276 |
| DENV3 anC DQ109189 | DENV3 anC DQ109179 | DENV3 anC DQ109289 | DENV3 anC DQ109216 |
| DENV3 anC DQ109234 | DENV3 anC DQ109187 | DENV3 anC DQ109240 | DENV3 anC DQ109258 |
| DENV3 anC DQ109176 | DENV3 anC DQ109251 | DENV3 anC DQ109203 | DENV3 anC DQ109182 |
| DENV3 anC DQ109290 | DENV3 anC DQ109241 | DENV3 anC DQ109196 | DENV3 anC DQ109267 |
| DENV3 anC DQ109215 | DENV3 anC DQ109281 | DENV3 anC DQ109261 | DENV3 anC DQ109236 |
| DENV3 anC DQ109191 | DENV3 anC DQ109193 | DENV3 anC DQ109229 | DENV3 anC DQ109269 |
| DENV3 anC DQ109282 | DENV3 anC DQ109257 | DENV3 anC DQ109199 | DENV3 anC DQ109200 |
| DENV3 anC DQ109220 | DENV3 anC DQ109181 | DENV3 anC DQ109208 | DENV3 anC DQ109253 |
| DENV3 anC DQ109242 | DENV3 anC DQ109277 | DENV3 anC DQ109239 | DENV3 anC DQ109262 |
| DENV3 anC DQ109205 | DENV3 anC DQ109302 | DENV3 anC DQ109294 | DENV3 anC DQ109288 |
| DENV3 anC DQ109276 | DENV3 anC DQ109266 | DENV3 anC DQ109214 | DENV3 anC DQ109228 |
| DENV3 anC DQ109216 | DENV3 anC DQ109175 | DENV3 anC DQ323038 | DENV3 anC DQ109260 |
| DENV3 anC DQ109258 | DENV3 anC DQ109180 | DENV3 anC DQ109249 | DENV3 anC DQ109271 |
| DENV3 anC DQ109182 | DENV3 anC DQ109235 | DENV3 anC DQ323042 | DENV3 anC DQ109293 |
| DENV3 anC DQ109267 | DENV3 anC DQ109225 | DENV3 anC DQ109250 | DENV3 anC DQ109278 |
| DENV3 anC DQ109236 | DENV3 anC DQ109245 | DENV3 anC DQ109297 | DENV3 anC DQ109213 |
| DENV3 anC DQ109269 | DENV3 anC DQ109280 | DENV3 anC DQ109252 | DENV3 anC DQ109190 |
| DENV3 anC DQ109200 | DENV3 anC DQ109283 | DENV3 anC DQ109275 | DENV3 anC DQ323039 |
| DENV3 anC DQ109253 | DENV3 anC DQ323041 | DENV3 anC DQ109303 | DENV3 anC DQ109185 |
| DENV3 anC DQ109262 | DENV3 anC DQ109274 | DENV3 anC DQ109230 | DENV3 anC DQ109248 |
| DENV3 anC DQ109288 | DENV3 anC DQ109204 | DENV3 anC DQ109206 | DENV3 anC DQ109222 |

FIG. 68-10

| Virus Protein Accession No. | Virus Protein Accession No. | Virus Protein Accession No. | Virus Protein Accession No. |
|---|---|---|---|
| DENV3 anC DQ109305 | DENV3 anC DQ109192 | DENV3 anC DQ109218 | DENV3 anC DQ109272 |
| DENV3 anC DQ109255 | DENV3 anC DQ109243 | DENV3 anC DQ109301 | DENV3 anC DQ109209 |
| DENV3 anC DQ109184 | DENV3 anC DQ109268 | DENV3 anC DQ109300 | DENV3 anC DQ109238 |
| DENV3 anC DQ109304 | DENV3 anC DQ109292 | DENV3 anC DQ109188 | DENV3 anC DQ109210 |
| DENV3 anC DQ109233 | DENV3 anC DQ109237 | DENV3 anC DQ109256 | DENV3 anC DQ109178 |
| DENV3 anC DQ109264 | DENV3 anC DQ109202 | DENV3 anC DQ109189 | DENV3 anC DQ109179 |
| DENV3 anC DQ109231 | DENV3 anC DQ109217 | DENV3 anC DQ109234 | DENV3 anC DQ109187 |
| DENV3 anC DQ109286 | DENV3 anC DQ109270 | DENV3 anC DQ109176 | DENV3 anC DQ109251 |
| DENV3 anC DQ109296 | DENV3 anC DQ109273 | DENV3 anC DQ109290 | DENV3 anC DQ109241 |
| DENV3 anC DQ109246 | DENV3 anC DQ109186 | DENV3 anC DQ109215 | DENV3 anC DQ109281 |
| DENV3 anC DQ109295 | DENV3 anC DQ109287 | DENV3 anC DQ109191 | DENV3 anC DQ109193 |
| DENV3 anC DQ109272 | DENV3 anC DQ109284 | DENV3 anC DQ109282 | DENV3 anC DQ109257 |
| DENV3 anC DQ109209 | DENV3 anC DQ109194 | DENV3 anC DQ109220 | DENV3 anC DQ109181 |
| DENV3 anC DQ109238 | DENV3 anC DQ109254 | DENV3 anC DQ109242 | DENV3 anC DQ109277 |
| DENV3 anC DQ109210 | DENV3 anC DQ109263 | DENV3 anC DQ109205 | DENV3 anC DQ109302 |
| DENV3 anC DQ109178 | DENV3 anC DQ109201 | DENV3 anC DQ109276 | DENV3 anC DQ109266 |
| DENV3 anC DQ109179 | DENV3 anC DQ109289 | DENV3 anC DQ109216 | DENV3 anC DQ109175 |
| DENV3 anC DQ109187 | DENV3 anC DQ109240 | DENV3 anC DQ109258 | DENV3 anC DQ109180 |
| DENV3 anC DQ109251 | DENV3 anC DQ109203 | DENV3 anC DQ109182 | DENV3 anC DQ109235 |
| DENV3 anC DQ109241 | DENV3 anC DQ109196 | DENV3 anC DQ109267 | DENV3 anC DQ109225 |
| DENV3 anC DQ109281 | DENV3 anC DQ109261 | DENV3 anC DQ109236 | DENV3 anC DQ109245 |
| DENV3 anC DQ109193 | DENV3 anC DQ109229 | DENV3 anC DQ109269 | DENV3 anC DQ109280 |
| DENV3 anC DQ109257 | DENV3 anC DQ109199 | DENV3 anC DQ109200 | DENV3 anC DQ109283 |
| DENV3 anC DQ109181 | DENV3 anC DQ109208 | DENV3 anC DQ109253 | DENV3 anC DQ323041 |
| DENV3 anC DQ109277 | DENV3 anC DQ109239 | DENV3 anC DQ109262 | DENV3 anC DQ109274 |
| DENV3 anC DQ109302 | DENV3 anC DQ109294 | DENV3 anC DQ109288 | DENV3 anC DQ109204 |
| DENV3 anC DQ109266 | DENV3 anC DQ109214 | DENV3 anC DQ109228 | DENV3 anC DQ109219 |
| DENV3 anC DQ109175 | DENV3 anC DQ323038 | DENV3 anC DQ109260 | DENV3 anC DQ109279 |
| DENV3 anC DQ109180 | DENV3 anC DQ109249 | DENV3 anC DQ109271 | DENV3 anC DQ109226 |
| DENV3 anC DQ109235 | DENV3 anC DQ323042 | DENV3 anC DQ109293 | DENV3 anC DQ109177 |
| DENV3 anC DQ109225 | DENV3 anC DQ109250 | DENV3 anC DQ109278 | DENV3 anC DQ109298 |
| DENV3 anC DQ109245 | DENV3 anC DQ109297 | DENV3 anC DQ109213 | DENV3 anC DQ109259 |
| DENV3 anC DQ109280 | DENV3 anC DQ109252 | DENV3 anC DQ109190 | DENV3 anC DQ109195 |
| DENV3 anC DQ109283 | DENV3 anC DQ109275 | DENV3 anC DQ323039 | DENV3 anC DQ109174 |
| DENV3 anC DQ323041 | DENV3 anC DQ109303 | DENV3 anC DQ109185 | DENV3 anC DQ109183 |
| DENV3 anC DQ109274 | DENV3 anC DQ109230 | DENV3 anC DQ109248 | DENV3 anC DQ109291 |
| DENV3 anC DQ109204 | DENV3 anC DQ109206 | DENV3 anC DQ109222 | DENV3 anC DQ109285 |
| DENV3 anC DQ109219 | DENV3 anC DQ109232 | DENV3 anC DQ109305 | DENV3 anC DQ109192 |
| DENV3 anC DQ109279 | DENV3 anC DQ109212 | DENV3 anC DQ109255 | DENV3 anC DQ109243 |
| DENV3 anC DQ109226 | DENV3 anC DQ109211 | DENV3 anC DQ109184 | DENV3 anC DQ109268 |
| DENV3 anC DQ109177 | DENV3 anC DQ323040 | DENV3 anC DQ109304 | DENV3 anC DQ109292 |
| DENV3 anC DQ109298 | DENV3 anC DQ109299 | DENV3 anC DQ109233 | DENV3 anC DQ109237 |
| DENV3 anC DQ109259 | DENV3 anC DQ109207 | DENV3 anC DQ109264 | DENV3 anC DQ109202 |
| DENV3 anC DQ109195 | DENV3 anC DQ109224 | DENV3 anC DQ109231 | DENV3 anC DQ109217 |
| DENV3 anC DQ109174 | DENV3 anC DQ109244 | DENV3 anC DQ109286 | DENV3 anC DQ109270 |
| DENV3 anC DQ109183 | DENV3 anC DQ109247 | DENV3 anC DQ109296 | DENV3 anC DQ109273 |
| DENV3 anC DQ109291 | DENV3 anC DQ109265 | DENV3 anC DQ109246 | DENV3 anC DQ109186 |
| DENV3 anC DQ109285 | DENV3 anC DQ323037 | DENV3 anC DQ109295 | DENV3 anC DQ109287 |

FIG. 68-11

| Virus Protein | Accession No. | Virus Protein | Accession No. | Virus Protein | Accession No. | Virus Protein | Accession No. |
|---|---|---|---|---|---|---|---|
| DENV3 anC | DQ109284 | DENV3 anC | DQ109282 | DENV3 anC | DQ109257 | DENV3 anC | DQ109199 |
| DENV3 anC | DQ109194 | DENV3 anC | DQ109220 | DENV3 anC | DQ109181 | DENV3 anC | DQ109208 |
| DENV3 anC | DQ109254 | DENV3 anC | DQ109242 | DENV3 anC | DQ109277 | DENV3 anC | DQ109239 |
| DENV3 anC | DQ109263 | DENV3 anC | DQ109205 | DENV3 anC | DQ109302 | DENV3 anC | DQ109294 |
| DENV3 anC | DQ109201 | DENV3 anC | DQ109276 | DENV3 anC | DQ109266 | DENV3 anC | DQ109214 |
| DENV3 anC | DQ109289 | DENV3 anC | DQ109216 | DENV3 anC | DQ109175 | DENV3 anC | DQ323038 |
| DENV3 anC | DQ109240 | DENV3 anC | DQ109258 | DENV3 anC | DQ109180 | DENV3 anC | DQ109249 |
| DENV3 anC | DQ109203 | DENV3 anC | DQ109182 | DENV3 anC | DQ109235 | DENV3 anC | DQ323042 |
| DENV3 anC | DQ109196 | DENV3 anC | DQ109267 | DENV3 anC | DQ109225 | DENV3 anC | DQ109250 |
| DENV3 anC | DQ109261 | DENV3 anC | DQ109236 | DENV3 anC | DQ109245 | DENV3 anC | DQ109297 |
| DENV3 anC | DQ109229 | DENV3 anC | DQ109269 | DENV3 anC | DQ109280 | DENV3 anC | DQ109252 |
| DENV3 anC | DQ109199 | DENV3 anC | DQ109200 | DENV3 anC | DQ109283 | DENV3 anC | DQ109275 |
| DENV3 anC | DQ109208 | DENV3 anC | DQ109253 | DENV3 anC | DQ323041 | DENV3 anC | DQ109303 |
| DENV3 anC | DQ109239 | DENV3 anC | DQ109262 | DENV3 anC | DQ109274 | DENV3 anC | DQ109230 |
| DENV3 anC | DQ109294 | DENV3 anC | DQ109288 | DENV3 anC | DQ109204 | DENV3 anC | DQ109206 |
| DENV3 anC | DQ109214 | DENV3 anC | DQ109228 | DENV3 anC | DQ109219 | DENV3 anC | DQ109232 |
| DENV3 anC | DQ323038 | DENV3 anC | DQ109260 | DENV3 anC | DQ109279 | DENV3 anC | DQ109212 |
| DENV3 anC | DQ109249 | DENV3 anC | DQ109271 | DENV3 anC | DQ109226 | DENV3 anC | DQ109211 |
| DENV3 anC | DQ323042 | DENV3 anC | DQ109293 | DENV3 anC | DQ109177 | DENV3 anC | DQ323040 |
| DENV3 anC | DQ109250 | DENV3 anC | DQ109278 | DENV3 anC | DQ109298 | DENV3 anC | DQ109299 |
| DENV3 anC | DQ109297 | DENV3 anC | DQ109213 | DENV3 anC | DQ109259 | DENV3 anC | DQ109207 |
| DENV3 anC | DQ109252 | DENV3 anC | DQ109190 | DENV3 anC | DQ109195 | DENV3 anC | DQ109224 |
| DENV3 anC | DQ109275 | DENV3 anC | DQ323039 | DENV3 anC | DQ109174 | DENV3 anC | DQ109244 |
| DENV3 anC | DQ109303 | DENV3 anC | DQ109185 | DENV3 anC | DQ109183 | DENV3 anC | DQ109247 |
| DENV3 anC | DQ109230 | DENV3 anC | DQ109248 | DENV3 anC | DQ109291 | DENV3 anC | DQ109265 |
| DENV3 anC | DQ109206 | DENV3 anC | DQ109222 | DENV3 anC | DQ109285 | DENV3 anC | DQ323037 |
| DENV3 anC | DQ109232 | DENV3 anC | DQ109305 | DENV3 anC | DQ109192 | DENV3 anC | DQ109218 |
| DENV3 anC | DQ109212 | DENV3 anC | DQ109255 | DENV3 anC | DQ109243 | DENV3 anC | DQ109301 |
| DENV3 anC | DQ109211 | DENV3 anC | DQ109184 | DENV3 anC | DQ109268 | DENV3 anC | DQ109300 |
| DENV3 anC | DQ323040 | DENV3 anC | DQ109304 | DENV3 anC | DQ109292 | DENV3 anC | DQ109188 |
| DENV3 anC | DQ109299 | DENV3 anC | DQ109233 | DENV3 anC | DQ109237 | DENV3 anC | DQ109256 |
| DENV3 anC | DQ109207 | DENV3 anC | DQ109264 | DENV3 anC | DQ109202 | DENV3 anC | DQ109189 |
| DENV3 anC | DQ109224 | DENV3 anC | DQ109231 | DENV3 anC | DQ109217 | DENV3 anC | DQ109234 |
| DENV3 anC | DQ109244 | DENV3 anC | DQ109286 | DENV3 anC | DQ109270 | DENV3 anC | DQ109176 |
| DENV3 anC | DQ109247 | DENV3 anC | DQ109296 | DENV3 anC | DQ109273 | DENV3 anC | DQ109290 |
| DENV3 anC | DQ109265 | DENV3 anC | DQ109246 | DENV3 anC | DQ109186 | DENV3 anC | DQ109215 |
| DENV3 anC | DQ323037 | DENV3 anC | DQ109295 | DENV3 anC | DQ109287 | DENV3 anC | DQ109191 |
| DENV3 anC | DQ109218 | DENV3 anC | DQ109272 | DENV3 anC | DQ109284 | DENV3 anC | DQ109282 |
| DENV3 anC | DQ109301 | DENV3 anC | DQ109209 | DENV3 anC | DQ109194 | DENV3 anC | DQ109220 |
| DENV3 anC | DQ109300 | DENV3 anC | DQ109238 | DENV3 anC | DQ109254 | DENV3 anC | DQ109242 |
| DENV3 anC | DQ109188 | DENV3 anC | DQ109210 | DENV3 anC | DQ109263 | DENV3 anC | DQ109205 |
| DENV3 anC | DQ109256 | DENV3 anC | DQ109178 | DENV3 anC | DQ109201 | DENV3 anC | DQ109276 |
| DENV3 anC | DQ109189 | DENV3 anC | DQ109179 | DENV3 anC | DQ109289 | DENV3 anC | DQ109216 |
| DENV3 anC | DQ109234 | DENV3 anC | DQ109187 | DENV3 anC | DQ109240 | DENV3 anC | DQ109258 |
| DENV3 anC | DQ109176 | DENV3 anC | DQ109251 | DENV3 anC | DQ109203 | DENV3 anC | DQ109182 |
| DENV3 anC | DQ109290 | DENV3 anC | DQ109241 | DENV3 anC | DQ109196 | DENV3 anC | DQ109267 |
| DENV3 anC | DQ109215 | DENV3 anC | DQ109281 | DENV3 anC | DQ109261 | DENV3 anC | DQ109236 |
| DENV3 anC | DQ109191 | DENV3 anC | DQ109193 | DENV3 anC | DQ109229 | DENV3 anC | DQ109269 |

FIG. 68-12

| Virus Protein | Accession No. | Virus Protein | Accession No. | Virus Protein | Accession No. | Virus Protein | Accession No. |
|---|---|---|---|---|---|---|---|
| DENV3 anC | DQ109200 | DENV3 E | DQ118875 | DENV3 E | DQ518655 | DENV3 E | AY676420 |
| DENV3 anC | DQ109253 | DENV3 E | GU131876 | DENV3 E | GU131849 | DENV3 E | AY676364 |
| DENV3 anC | DQ109262 | DENV3 E | AY912455 | DENV3 E | EU482612 | DENV3 E | FJ639728 |
| DENV3 anC | DQ109288 | DENV3 E | FJ547072 | DENV3 E | EU617021 | DENV3 E | EU117365 |
| DENV3 anC | DQ109228 | DENV3 E | EU478409 | DENV3 E | DQ518670 | DENV3 E | FJ606698 |
| DENV3 anC | DQ109260 | DENV3 E | AY676378 | DENV3 E | FJ639771 | DENV3 E | FJ024465 |
| DENV3 anC | DQ109271 | DENV3 E | FJ189464 | DENV3 E | EU781137 | DENV3 E | AY656672 |
| DENV3 anC | DQ109293 | DENV3 E | AY676365 | DENV3 E | FJ389913 | DENV3 E | FJ639758 |
| DENV3 anC | DQ109278 | DENV3 E | AB214880 | DENV3 E | EU052794 | DENV3 E | EF440434 |
| DENV3 anC | DQ109213 | DENV3 E | DQ453968 | DENV3 E | L11429 | DENV3 E | AB219130 |
| DENV3 anC | DQ109190 | DENV3 E | DQ118887 | DENV3 E | FJ373303 | DENV3 E | DQ118870 |
| DENV3 anC | DQ323039 | DENV3 E | DQ177891 | DENV3 E | FJ873812 | DENV3 E | AY135419 |
| DENV3 anC | DQ109185 | DENV3 E | FJ606694 | DENV3 E | EU081224 | DENV3 E | FJ461334 |
| DENV3 anC | DQ109248 | DENV3 E | AY099340 | DENV3 E | FJ850096 | DENV3 E | FJ606709 |
| DENV3 anC | DQ109222 | DENV3 E | FJ639767 | DENV3 E | FJ744734 | DENV3 E | DQ453978 |
| DENV3 anC | DQ109305 | DENV3 E | FJ189455 | DENV3 E | AY676384 | DENV3 E | AY776329 |
| DENV3 anC | DQ109255 | DENV3 E | FJ639779 | DENV3 E | GU131844 | DENV3 E | DQ118883 |
| DENV3 anC | DQ109184 | DENV3 E | FJ562103 | DENV3 E | FJ639747 | DENV3 E | AY676359 |
| DENV3 anC | DQ109304 | DENV3 E | AY146764 | DENV3 E | CS477305 | DENV3 E | FJ639721 |
| DENV3 anC | DQ109233 | DENV3 E | EF629373 | DENV3 E | FJ562099 | DENV3 E | DQ518665 |
| DENV3 anC | DQ109264 | DENV3 E | DQ401692 | DENV3 E | AB219137 | DENV3 E | FJ547080 |
| DENV3 anC | DQ109231 | DENV3 E | FJ639792 | DENV3 E | DQ118871 | DENV3 E | FJ639778 |
| DENV3 anC | DQ109286 | DENV3 E | EU182245 | DENV3 E | FJ898455 | DENV3 E | AY676404 |
| DENV3 anC | DQ109296 | DENV3 E | AF533079 | DENV3 E | GU131873 | DENV3 E | FN429917 |
| DENV3 anC | DQ109246 | DENV3 E | AY858041 | DENV3 E | FJ882574 | DENV3 E | GQ868593 |
| DENV3 anC | DQ109295 | DENV3 E | FJ375135 | DENV3 E | FJ639787 | DENV3 E | GQ199886 |
| DENV3 anC | DQ109272 | DENV3 E | FN429909 | DENV3 E | EU117359 | DENV3 E | EU081192 |
| DENV3 anC | DQ109209 | DENV3 E | AY496873 | DENV3 E | GU131867 | DENV3 E | GQ868587 |
| DENV3 anC | DQ109238 | DENV3 E | FJ744700 | DENV3 E | FJ639817 | DENV3 E | GU131866 |
| DENV3 anC | DQ109210 | DENV3 E | AY744678 | DENV3 E | EU081185 | DENV3 E | EU482559 |
| DENV3 anC | DQ109178 | DENV3 E | FJ639816 | DENV3 E | AY632355 | DENV3 E | DQ675521 |
| DENV3 anC | DQ109179 | DENV3 E | EU081202 | DENV3 E | GQ199889 | DENV3 E | FJ182013 |
| DENV3 anC | DQ109187 | DENV3 E | AB189126 | DENV3 E | EU448443 | DENV3 E | AY146763 |
| DENV3 anC | DQ109251 | DENV3 E | GQ199860 | DENV3 E | FJ182037 | DENV3 E | DQ518678 |
| DENV3 anC | DQ109241 | DENV3 E | FJ373302 | DENV3 E | EU482455 | DENV3 E | EU081201 |
| DENV3 anC | DQ109281 | DENV3 E | AY145725 | DENV3 E | GQ252674 | DENV3 E | FJ373304 |
| DENV3 anC | DQ109193 | DENV3 E | FJ390375 | DENV3 E | AY676391 | DENV3 E | DQ118881 |
| DENV3 E | DQ177893 | DENV3 E | EU617033 | DENV3 E | AY858046 | DENV3 E | FN429915 |
| DENV3 E | FN429898 | DENV3 E | FJ744740 | DENV3 E | M93130 | DENV3 E | FJ882576 |
| DENV3 E | GQ868576 | DENV3 E | FJ898458 | DENV3 E | AF147458 | DENV3 E | EU182246 |
| DENV3 E | L11430 | DENV3 E | FJ639801 | DENV3 E | EU687198 | DENV3 E | EU117356 |
| DENV3 E | DQ453970 | DENV3 E | EU448434 | DENV3 E | FJ432743 | DENV3 E | EU529687 |
| DENV3 E | GQ868578 | DENV3 E | EU854292 | DENV3 E | EU045316 | DENV3 E | EU448445 |
| DENV3 E | AY676363 | DENV3 E | FN429902 | DENV3 E | AY676411 | DENV3 E | AY145713 |
| DENV3 E | EU448446 | DENV3 E | DQ675522 | DENV3 E | FJ461322 | DENV3 E | GU131913 |
| DENV3 E | AY146772 | DENV3 E | L11438 | DENV3 E | GQ868626 | DENV3 E | FN429916 |
| DENV3 E | EU596493 | DENV3 E | DQ518654 | DENV3 E | FJ850052 | DENV3 E | EU081208 |
| DENV3 E | GQ868634 | DENV3 E | GU131907 | DENV3 E | EU660407 | DENV3 E | FJ606712 |

FIG. 68-13

| Virus Protein | Accession No. | Virus Protein | Accession No. | Virus Protein | Accession No. | Virus Protein | Accession No. |
|---|---|---|---|---|---|---|---|
| DENV3 E | AY676405 | DENV3 E | GU131861 | DENV3 E | AY656669 | DENV3 E | AY656671 |
| DENV3 E | DQ367721 | DENV3 E | FJ182040 | DENV3 E | DQ675532 | DENV3 E | EU081187 |
| DENV3 E | GU131951 | DENV3 E | EU052793 | DENV3 E | EU081211 | DENV3 E | AY676355 |
| DENV3 E | FJ898468 | DENV3 E | FJ882573 | DENV3 E | DQ177886 | DENV3 E | AY145723 |
| DENV3 E | EU781136 | DENV3 E | EU081199 | DENV3 E | FJ547066 | DENV3 E | GU131847 |
| DENV3 E | GU131846 | DENV3 E | EU529699 | DENV3 E | FN429904 | DENV3 E | FJ410176 |
| DENV3 E | EU617026 | DENV3 E | FJ744735 | DENV3 E | FJ744731 | DENV3 E | EU482453 |
| DENV3 E | FJ547078 | DENV3 E | FJ024468 | DENV3 E | FJ744737 | DENV3 E | EU081207 |
| DENV3 E | FJ639726 | DENV3 E | FN429901 | DENV3 E | FJ882577 | DENV3 E | FJ182005 |
| DENV3 E | FJ898457 | DENV3 E | AY744677 | DENV3 E | AY676385 | DENV3 E | DQ341205 |
| DENV3 E | FJ639795 | DENV3 E | EU726774 | DENV3 E | FN429900 | DENV3 E | AY912454 |
| DENV3 E | DQ118884 | DENV3 E | FJ375134 | DENV3 E | AY858037 | DENV3 E | AY770511 |
| DENV3 E | FJ639757 | DENV3 E | AY145729 | DENV3 E | FJ547077 | DENV3 E | EU117353 |
| DENV3 E | EU448439 | DENV3 E | DQ177903 | DENV3 E | DQ367720 | DENV3 E | FJ189469 |
| DENV3 E | EU569689 | DENV3 E | AY744685 | DENV3 E | DQ371245 | DENV3 E | AY146762 |
| DENV3 E | AY676354 | DENV3 E | EU687226 | DENV3 E | FJ639765 | DENV3 E | GQ868574 |
| DENV3 E | DQ341204 | DENV3 E | FJ189451 | DENV3 E | AY676389 | DENV3 E | GU131941 |
| DENV3 E | AM746232 | DENV3 E | AY676358 | DENV3 E | AY676406 | DENV3 E | GU131933 |
| DENV3 E | DQ177894 | DENV3 E | GU721068 | DENV3 E | EU052795 | DENV3 E | EU529689 |
| DENV3 E | EU081209 | DENV3 E | AY676412 | DENV3 E | EU726769 | DENV3 E | FJ389915 |
| DENV3 E | FJ639712 | DENV3 E | DQ675527 | DENV3 E | EU617028 | DENV3 E | EU259606 |
| DENV3 E | DQ401691 | DENV3 E | FN429914 | DENV3 E | EU045318 | DENV3 E | L11440 |
| DENV3 E | AM746228 | DENV3 E | DQ453971 | DENV3 E | EU182239 | DENV3 E | GU131954 |
| DENV3 E | FN429908 | DENV3 E | AF147457 | DENV3 E | DQ518664 | DENV3 E | FJ850098 |
| DENV3 E | EU482566 | DENV3 E | FJ639768 | DENV3 E | EU052796 | DENV3 E | GQ199870 |
| DENV3 E | EU617036 | DENV3 E | FJ547061 | DENV3 E | AY146771 | DENV3 E | L11435 |
| DENV3 E | DQ118876 | DENV3 E | GU721069 | DENV3 E | EU045323 | DENV3 E | FJ432741 |
| DENV3 E | EU482461 | DENV3 E | AY960630 | DENV3 E | EU617027 | DENV3 E | AB189125 |
| DENV3 E | FJ389912 | DENV3 E | GU131917 | DENV3 E | AY676371 | DENV3 E | AY676352 |
| DENV3 E | FJ189463 | DENV3 E | DQ118872 | DENV3 E | GU131871 | DENV3 E | AY145728 |
| DENV3 E | DQ453979 | DENV3 E | FJ432728 | DENV3 E | GQ199888 | DENV3 E | FM986663 |
| DENV3 E | EU687233 | DENV3 E | AY744682 | DENV3 E | EU569688 | DENV3 E | FJ639804 |
| DENV3 E | AY496874 | DENV3 E | AY676362 | DENV3 E | FJ639786 | DENV3 E | EU529690 |
| DENV3 E | FJ606699 | DENV3 E | AY656673 | DENV3 E | DQ177895 | DENV3 E | DQ118865 |
| DENV3 E | AY858047 | DENV3 E | DQ118890 | DENV3 E | AY960633 | DENV3 E | AF349753 |
| DENV3 E | GU131862 | DENV3 E | EU617023 | DENV3 E | GU131845 | DENV3 E | AY099337 |
| DENV3 E | AY145712 | DENV3 E | L11428 | DENV3 E | FJ478456 | DENV3 E | FJ182015 |
| DENV3 E | EU482614 | DENV3 E | EU529683 | DENV3 E | GQ868617 | DENV3 E | FJ182038 |
| DENV3 E | AY676353 | DENV3 E | FJ606695 | DENV3 E | EU448441 | DENV3 E | EU045324 |
| DENV3 E | GU131872 | DENV3 E | EU045315 | DENV3 E | L11436 | DENV3 E | FJ850049 |
| DENV3 E | EU081210 | DENV3 E | EU482456 | DENV3 E | EU081195 | DENV3 E | FJ606707 |
| DENV3 E | FJ639770 | DENV3 E | FJ639777 | DENV3 E | AY145718 | DENV3 E | AY265857 |
| DENV3 E | FJ810413 | DENV3 E | EU529692 | DENV3 E | FJ389909 | DENV3 E | DQ675526 |
| DENV3 E | FJ189452 | DENV3 E | GU370053 | DENV3 E | FJ898456 | DENV3 E | FJ639713 |
| DENV3 E | EU117363 | DENV3 E | AY676392 | DENV3 E | FJ898444 | DENV3 E | GU131857 |
| DENV3 E | FJ389911 | DENV3 E | FJ744736 | DENV3 E | GU370052 | DENV3 E | DQ518679 |
| DENV3 E | AY960635 | DENV3 E | FJ898476 | DENV3 E | EU660411 | DENV3 E | AB214882 |
| DENV3 E | DQ118888 | DENV3 E | DQ518677 | DENV3 E | AY145722 | DENV3 E | EU081217 |

FIG. 68-14

| Virus Protein | Accession No. | Virus Protein | Accession No. | Virus Protein | Accession No. | Virus Protein | Accession No. |
|---|---|---|---|---|---|---|---|
| DENV3 E | FJ024469 | DENV3 E | EU687239 | DENV3 E | EU117358 | DENV3 E | FJ639722 |
| DENV3 E | CS479205 | DENV3 E | DQ453972 | DENV3 E | FJ189454 | DENV3 E | AB189127 |
| DENV3 E | DQ118889 | DENV3 E | AB219139 | DENV3 E | DQ118864 | DENV3 E | FJ639720 |
| DENV3 E | L11427 | DENV3 E | AY702033 | DENV3 E | GU131942 | DENV3 E | FJ639729 |
| DENV3 E | GQ868577 | DENV3 E | EU081206 | DENV3 E | EU529688 | DENV3 E | GU131868 |
| DENV3 E | AB214881 | DENV3 E | EU045322 | DENV3 E | DQ341206 | DENV3 E | FJ639793 |
| DENV3 E | FJ606711 | DENV3 E | DQ177887 | DENV3 E | EF629369 | DENV3 E | FJ639752 |
| DENV3 E | GU131911 | DENV3 E | FJ639807 | DENV3 E | EU081188 | DENV3 E | EU660408 |
| DENV3 E | AY146761 | DENV3 E | EU529691 | DENV3 E | DQ401690 | DENV3 E | GU363549 |
| DENV3 E | GU131869 | DENV3 E | FJ898475 | DENV3 E | EU482462 | DENV3 E | FJ389907 |
| DENV3 E | FJ606705 | DENV3 E | EU081220 | DENV3 E | AY676370 | DENV3 E | AY676360 |
| DENV3 E | EU081198 | DENV3 E | AY146776 | DENV3 E | FJ898440 | DENV3 E | FJ606706 |
| DENV3 E | AY676361 | DENV3 E | EU045317 | DENV3 E | GQ252678 | DENV3 E | FJ850109 |
| DENV3 E | EU932688 | DENV3 E | GQ868546 | DENV3 E | FJ882575 | DENV3 E | DQ177892 |
| DENV3 E | FJ606696 | DENV3 E | DQ453981 | DENV3 E | FJ639727 | DENV3 E | EU081218 |
| DENV3 E | FJ547070 | DENV3 E | AY145717 | DENV3 E | AY496875 | DENV3 E | AY676349 |
| DENV3 E | FJ639790 | DENV3 E | FJ639805 | DENV3 E | AY676356 | DENV3 E | M86733 |
| DENV3 E | FJ639772 | DENV3 E | FJ189465 | DENV3 E | FJ639714 | DENV3 E | FJ606708 |
| DENV3 E | AY145719 | DENV3 E | EU854291 | DENV3 E | DQ118886 | DENV3 E | FJ547081 |
| DENV3 E | EU617031 | DENV3 E | AY145727 | DENV3 E | GQ868573 | DENV3 E | GU131912 |
| DENV3 E | EU081190 | DENV3 E | EU081200 | DENV3 E | AY676351 | DENV3 E | FJ898462 |
| DENV3 E | EU117362 | DENV3 E | EU448444 | DENV3 E | GU131870 | DENV3 E | FN429912 |
| DENV3 E | DQ518676 | DENV3 E | EU081196 | DENV3 E | AY099336 | DENV3 E | AY923865 |
| DENV3 E | EU482613 | DENV3 E | FJ182039 | DENV3 E | EU617034 | DENV3 E | AY338494 |
| DENV3 E | FJ639723 | DENV3 E | GU131877 | DENV3 E | EU081182 | DENV3 E | EU529686 |
| DENV3 E | GU189648 | DENV3 E | L11426 | DENV3 E | EU617024 | DENV3 E | AY676415 |
| DENV3 E | FJ850055 | DENV3 E | DQ675520 | DENV3 E | DQ453969 | DENV3 E | FJ744739 |
| DENV3 E | EU482558 | DENV3 E | FJ390376 | DENV3 E | DQ863638 | DENV3 E | AY858045 |
| DENV3 E | EU660409 | DENV3 E | EU259608 | DENV3 E | GU131855 | DENV3 E | FJ547084 |
| DENV3 E | AB111085 | DENV3 E | AY676379 | DENV3 E | FJ639826 | DENV3 E | AY676373 |
| DENV3 E | FN429899 | DENV3 E | EU529702 | DENV3 E | FJ389914 | DENV3 E | FJ639774 |
| DENV3 E | FJ373306 | DENV3 E | FJ639781 | DENV3 E | AY702030 | DENV3 E | GU721065 |
| DENV3 E | AY676397 | DENV3 E | EF441284 | DENV3 E | FJ606697 | DENV3 E | EU259607 |
| DENV3 E | EU617022 | DENV3 E | AY496876 | DENV3 E | EU117361 | DENV3 E | AY676418 |
| DENV3 E | EU660410 | DENV3 E | FJ898443 | DENV3 E | FJ639746 | DENV3 E | GU131915 |
| DENV3 E | L11619 | DENV3 E | FJ182004 | DENV3 E | AY146770 | DENV3 E | AY676383 |
| DENV3 E | FJ898463 | DENV3 E | AY676390 | DENV3 E | GU131934 | DENV3 E | EU448438 |
| DENV3 E | AY858044 | DENV3 E | AY744684 | DENV3 E | EU482454 | DENV3 E | AY676348 |
| DENV3 E | EU726768 | DENV3 E | FJ850048 | DENV3 E | EF643017 | DENV3 E | AY145716 |
| DENV3 E | FJ189457 | DENV3 E | FJ024467 | DENV3 E | GU131856 | DENV3 E | AY679147 |
| DENV3 E | AY960625 | DENV3 E | GQ868575 | DENV3 E | DQ675525 | DENV3 E | FJ850056 |
| DENV3 E | FJ639766 | DENV3 E | FN429903 | DENV3 E | EU081212 | DENV3 E | FJ562107 |
| DENV3 E | EU529698 | DENV3 E | EU448433 | DENV3 E | EU081197 | DENV3 E | FJ639759 |
| DENV3 E | FJ410177 | DENV3 E | FJ744738 | DENV3 E | FJ850097 | DENV3 E | DQ675519 |
| DENV3 E | DQ675530 | DENV3 E | FJ562100 | DENV3 E | AY676409 | DENV3 E | GU131904 |
| DENV3 E | DQ518669 | DENV3 E | EU117370 | DENV3 E | FJ850083 | DENV3 E | DQ453976 |
| DENV3 E | FJ744730 | DENV3 E | AY146767 | DENV3 E | EU182243 | DENV3 E | FJ461338 |
| DENV3 E | DQ675528 | DENV3 E | AY145724 | DENV3 E | DQ453977 | DENV3 E | EU448447 |

FIG. 68-15

| Virus Protein | Accession No. | Virus Protein | Accession No. | Virus Protein | Accession No. | Virus Protein | Accession No. |
|---|---|---|---|---|---|---|---|
| DENV3 E | DQ518668 | DENV3 E | L11425 | DENV3 E | EU081223 | DENV3 E | EU117360 |
| DENV3 E | FJ639715 | DENV3 E | FJ639730 | DENV3 E | DQ675523 | DENV3 E | FJ744729 |
| DENV3 E | FJ024466 | DENV3 E | FJ189467 | DENV3 E | EU482563 | DENV3 E | DQ453980 |
| DENV3 E | AY960631 | DENV3 E | AY146775 | DENV3 E | AY676357 | DENV3 E | AY766104 |
| DENV3 E | FJ898447 | DENV3 E | FJ606701 | DENV3 E | FJ547076 | DENV3 E | AM746231 |
| DENV3 E | EU081184 | DENV3 E | FJ389906 | DENV3 E | GU131874 | DENV3 E | AY676408 |
| DENV3 E | EU482595 | DENV3 E | EF629368 | DENV3 E | DQ518663 | DENV3 E | EU687218 |
| DENV3 E | GQ199871 | DENV3 E | EU081215 | DENV3 E | FJ547082 | DENV3 E | AY676376 |
| DENV3 E | AY744681 | DENV3 E | EU081181 | DENV3 E | FJ461337 | DENV3 E | FJ389908 |
| DENV3 E | EU081213 | DENV3 E | FN429913 | DENV3 E | AY676382 | DENV3 E | DQ518667 |
| DENV3 E | DQ177888 | DENV3 E | GU131935 | DENV3 E | AY145715 | DENV3 E | FJ898474 |
| DENV3 E | FJ024470 | DENV3 E | FJ189458 | DENV3 E | FJ547083 | DENV3 E | DQ341208 |
| DENV3 E | AY876494 | DENV3 E | FJ182007 | DENV3 E | FJ639760 | DENV3 E | GU131910 |
| DENV3 E | AY662691 | DENV3 E | FJ639751 | DENV3 E | AY676366 | DENV3 E | GU131916 |
| DENV3 E | DQ118891 | DENV3 E | EU117369 | DENV3 E | GU131853 | DENV3 E | FJ606710 |
| DENV3 E | EU687221 | DENV3 E | EU052798 | DENV3 E | L11434 | DENV3 E | EU448436 |
| DENV3 E | FN429910 | DENV3 E | FJ639827 | DENV3 E | FJ639769 | DENV3 E | EU117366 |
| DENV3 E | GU131944 | DENV3 E | L11442 | DENV3 E | AY145730 | DENV3 E | GQ199863 |
| DENV3 E | AY496877 | DENV3 E | FJ204475 | DENV3 E | GQ868629 | DENV3 E | AY676401 |
| DENV3 E | EU045319 | DENV3 E | EU367962 | DENV3 E | EU081183 | DENV3 E | FJ639724 |
| DENV3 E | DQ518662 | DENV3 E | EU182242 | DENV3 E | EU617029 | DENV3 E | FJ639798 |
| DENV3 E | EU117368 | DENV3 E | EU117355 | DENV3 E | GQ199864 | DENV3 E | DQ341207 |
| DENV3 E | EF629370 | DENV3 E | DQ401689 | DENV3 E | AY676388 | DENV3 E | FJ189459 |
| DENV3 E | FJ639775 | DENV3 E | EU570161 | DENV3 E | NC_001475 | DENV3 E | EU617037 |
| DENV3 E | DQ518673 | DENV3 E | FJ639780 | DENV3 E | DQ453975 | DENV3 E | L11424 |
| DENV3 E | GU131952 | DENV3 E | EU081189 | DENV3 E | FN429905 | DENV3 E | EU081222 |
| DENV3 E | AY702031 | DENV3 E | DQ675531 | DENV3 E | AY656670 | DENV3 E | DQ118867 |
| DENV3 E | EU448435 | DENV3 E | AB111080 | DENV3 E | AY960634 | DENV3 E | AY099338 |
| DENV3 E | EU529705 | DENV3 E | L11433 | DENV3 E | EU482459 | DENV3 E | DQ118880 |
| DENV3 E | EU660420 | DENV3 E | FJ639750 | DENV3 E | FJ898459 | DENV3 E | AY146768 |
| DENV3 E | EU448440 | DENV3 E | AY676350 | DENV3 E | FJ639716 | DENV3 E | FJ639803 |
| DENV3 E | GQ199865 | DENV3 E | FJ898441 | DENV3 E | FJ547073 | DENV3 E | M25277 |
| DENV3 E | EU726771 | DENV3 E | AY146766 | DENV3 E | DQ518661 | DENV3 E | CS805345 |
| DENV3 E | FJ810414 | DENV3 E | FJ024471 | DENV3 E | FM986662 | DENV3 E | DQ118866 |
| DENV3 E | AB219133 | DENV3 E | AY676395 | DENV3 E | FJ204476 | DENV3 E | AF147460 |
| DENV3 E | AY146777 | DENV3 E | EU081221 | DENV3 E | GQ868586 | DENV3 E | AY648961 |
| DENV3 E | L11431 | DENV3 E | EU182244 | DENV3 E | FJ639763 | DENV3 E | FJ432731 |
| DENV3 E | GQ868572 | DENV3 E | DQ118874 | DENV3 E | AB219131 | DENV3 E | L11439 |
| DENV3 E | FJ898473 | DENV3 E | FJ461326 | DENV3 E | EU081216 | DENV3 E | AY676375 |
| DENV3 E | EU617038 | DENV3 E | DQ177897 | DENV3 E | AY676368 | DENV3 E | AY702032 |
| DENV3 E | EU687196 | DENV3 E | DQ367722 | DENV3 E | FJ410229 | DENV3 E | FJ562102 |
| DENV3 E | FJ639799 | DENV3 E | GU131854 | DENV3 E | EU182241 | DENV3 E | EU081193 |
| DENV3 E | EU687219 | DENV3 E | DQ118868 | DENV3 E | FJ898464 | DENV3 E | FJ189468 |
| DENV3 E | FJ898442 | DENV3 E | AY676400 | DENV3 E | DQ118885 | DENV3 E | FJ639754 |
| DENV3 E | FN429906 | DENV3 E | FJ432722 | DENV3 E | AY676419 | DENV3 E | AY960628 |
| DENV3 E | FJ390371 | DENV3 E | AY099339 | DENV3 E | FJ189449 | DENV3 E | AF317645 |
| DENV3 E | EU617025 | DENV3 E | AY676414 | DENV3 E | EU482452 | DENV3 E | GU131865 |
| DENV3 E | AB219134 | DENV3 E | FJ410178 | DENV3 E | EU448442 | DENV3 E | EU045325 |

FIG. 68-16

| Virus Protein | Accession No. | Virus Protein | Accession No. | Virus Protein | Accession No. | Virus Protein | Accession No. |
|---|---|---|---|---|---|---|---|
| DENV3 E | FJ898445 | DENV3 E | AY858048 | DENV3 E | FJ744726 | DENV3 E | EU529703 |
| DENV3 E | DQ177900 | DENV3 E | FN429897 | DENV3 E | FJ850111 | DENV3 E | EU117357 |
| DENV3 E | L11432 | DENV3 E | DQ518660 | DENV3 E | EU081204 | DENV3 E | AY676416 |
| DENV3 E | FJ606700 | DENV3 E | GU131950 | DENV3 E | FJ639761 | DENV3 E | AY146769 |
| DENV3 E | FJ182006 | DENV3 E | EU448437 | DENV3 E | EU081194 | DENV3 E | FJ639782 |
| DENV3 E | EU052797 | DENV3 E | FN429896 | DENV3 E | L11441 | DENV3 E | GU131908 |
| DENV3 E | FJ389916 | DENV3 E | GU131905 | DENV3 E | FJ639725 | DENV3 E | AY858039 |
| DENV3 E | FJ189456 | DENV3 E | FJ639789 | DENV3 E | GQ868628 | DENV3 E | FJ189462 |
| DENV3 E | FJ547069 | DENV3 E | FB667400 | DENV3 E | FJ189453 | DENV3 E | AY146765 |
| DENV3 E | GU131858 | DENV3 E | AY676367 | DENV3 E | FJ389910 | DENV3 E | DQ518674 |
| DENV3 E | AY676413 | DENV3 E | FJ390373 | DENV3 E | FJ639785 | DENV3 E | GU721067 |
| DENV3 E | EU687234 | DENV3 E | EU482460 | DENV3 E | FJ850086 | DENV3 E | AY676374 |
| DENV3 E | DQ518675 | DENV3 E | FJ639753 | DENV3 E | AB111083 | DENV3 E | EU081214 |
| DENV3 E | AY676372 | DENV3 E | DQ341203 | DENV3 E | EU117367 | DENV3 E | EF629366 |
| DENV3 E | FJ639791 | DENV3 E | AY676407 | DENV3 E | EU448432 | DENV3 E | EU045321 |
| DENV3 E | FJ850092 | DENV3 E | FJ687448 | DENV3 E | AY676402 | DENV3 E | DQ118869 |
| DENV3 E | AY676396 | DENV3 E | EU045314 | DENV3 E | FJ639810 | DENV3 E | FJ639800 |
| DENV3 E | FJ390377 | DENV3 E | DQ118882 | DENV3 E | AY676393 | DENV3 E | FJ189460 |
| DENV3 E | EU617032 | DENV3 E | AY099342 | DENV3 E | L11423 | DENV3 E | FJ182008 |
| DENV3 E | DQ177890 | DENV3 E | FJ639731 | DENV3 E | DQ518656 | DENV3 E | AY744680 |
| DENV3 E | AY146774 | DENV3 E | FN429907 | DENV3 E | DQ177902 | DENV3 E | GU131918 |
| DENV3 E | AY145721 | DENV3 E | EU529684 | DENV3 E | FJ882578 | DENV3 E | AY960632 |
| DENV3 E | EU529704 | DENV3 E | FJ882572 | DENV3 E | GU131851 | DENV3 E | AY496878 |
| DENV3 E | AY338493 | DENV3 E | AY676410 | DENV3 E | GU131940 | DENV3 E | DQ518672 |
| DENV3 E | FJ547075 | DENV3 E | AY676377 | DENV3 E | EU482555 | DENV3 E | EU617019 |
| DENV3 E | GU131936 | DENV3 E | FJ182041 | DENV3 E | GU131938 | DENV3 E | AY676399 |
| DENV3 E | GU131903 | DENV3 E | AY496879 | DENV3 E | EU529696 | DENV3 E | FJ639755 |
| DENV3 E | DQ401694 | DENV3 E | EU529697 | DENV3 E | DQ401695 | DENV3 E | FJ189450 |
| DENV3 E | DQ177889 | DENV3 E | GQ199891 | DENV3 E | EU726773 | DENV3 E | DQ177899 |
| DENV3 E | EU081205 | DENV3 E | AY656674 | DENV3 E | DQ518666 | DENV3 E | FJ639719 |
| DENV3 E | FJ850089 | DENV3 E | EU932687 | DENV3 E | FJ606692 | DENV3 E | DQ675533 |
| DENV3 E | FJ898470 | DENV3 E | EU617035 | DENV3 E | AY676381 | DENV3 E | AY146773 |
| DENV3 E | GQ868571 | DENV3 E | GQ868548 | DENV3 E | AY338492 | DENV3 E | AY145720 |
| DENV3 E | AY744683 | DENV3 E | EU259605 | DENV3 E | GQ868616 | DENV3 E | FJ189466 |
| DENV3 E | EU182240 | DENV3 E | FJ744728 | DENV3 E | AY145726 | DENV3 E | GU131939 |
| DENV3 E | FJ639756 | DENV3 E | DQ453973 | DENV3 E | EU482596 | DENV3 E | FJ639749 |
| DENV3 E | EU045320 | DENV3 E | FJ639825 | DENV3 E | AY858042 | DENV3 E | AY146778 |
| DENV3 E | FJ547062 | DENV3 E | FN429911 | DENV3 E | DQ518659 | DENV3 E | GU131848 |
| DENV3 E | EU052799 | DENV3 E | GU131914 | DENV3 E | DQ177896 | DENV3 E | GU131906 |
| DENV3 E | AB189128 | DENV3 E | GU131945 | DENV3 E | EU617030 | DENV3 E | L11437 |
| DENV3 E | FJ182009 | DENV3 E | FJ898472 | DENV3 E | FJ205871 | DENV3 E | GQ868627 |
| DENV3 E | AY676387 | DENV3 E | FJ547074 | DENV3 E | EU052792 | DENV3 E | GU131859 |
| DENV3 E | FJ810416 | DENV3 E | AM746230 | DENV3 E | GU131860 | DENV3 E | FJ182011 |
| DENV3 E | AY099341 | DENV3 E | DQ518671 | DENV3 E | EU482457 | DENV3 E | AY858038 |
| DENV3 E | EF629367 | DENV3 E | FJ461329 | DENV3 E | GQ199862 | DENV3 E | GU131943 |
| DENV3 E | GU131852 | DENV3 E | AB219132 | DENV3 E | AJ563355 | DENV3 E | FJ547085 |
| DENV3 E | DQ518657 | DENV3 E | FJ898469 | DENV3 E | DQ118877 | DENV3 E | DQ341202 |
| DENV3 E | AY676398 | DENV3 E | FJ639776 | DENV3 E | AY676386 | DENV3 E | AF147459 |

FIG. 68-17

| Virus Protein | Accession No. | Virus Protein | Accession No. | Virus Protein | Accession No. | Virus Protein | Accession No. |
|---|---|---|---|---|---|---|---|
| DENV3 E | FJ606693 | DENV3 E | EU569690 | DENV3 E | AY912455 | DENV3 E | AY676359 |
| DENV3 E | AY496872 | DENV3 E | FJ850110 | DENV3 E | EU478409 | DENV3 E | DQ518665 |
| DENV3 E | GU131953 | DENV3 E | AY744679 | DENV3 E | AY676378 | DENV3 E | AY676404 |
| DENV3 E | EU617020 | DENV3 E | GU131850 | DENV3 E | FJ189464 | DENV3 E | AY146763 |
| DENV3 E | L11422 | DENV3 E | DQ118879 | DENV3 E | AY676365 | DENV3 E | DQ518678 |
| DENV3 E | DQ341209 | DENV3 E | AB219138 | DENV3 E | DQ453968 | DENV3 E | DQ118881 |
| DENV3 E | EU482564 | DENV3 E | AY676421 | DENV3 E | DQ118887 | DENV3 E | EU182246 |
| DENV3 E | GQ199887 | DENV3 E | FJ850094 | DENV3 E | DQ177891 | DENV3 E | EU117356 |
| DENV3 E | DQ675524 | DENV3 E | FJ606702 | DENV3 E | FJ606694 | DENV3 E | EU448445 |
| DENV3 E | AB111082 | DENV3 E | EU117364 | DENV3 E | AY099340 | DENV3 E | AY145713 |
| DENV3 E | EU596494 | DENV3 E | AY145714 | DENV3 E | FJ189455 | DENV3 E | FJ606712 |
| DENV3 E | EU726772 | DENV3 E | DQ118873 | DENV3 E | AY146764 | DENV3 E | AY676405 |
| DENV3 E | FJ898471 | DENV3 E | AY676403 | DENV3 E | EU182245 | DENV3 E | DQ367721 |
| DENV3 E | EU569691 | DENV3 E | FJ639784 | DENV3 E | AF533079 | DENV3 E | EU617026 |
| DENV3 E | AM746229 | DENV3 E | FJ850080 | DENV3 E | FJ375135 | DENV3 E | DQ118884 |
| DENV3 E | DQ453974 | DENV3 E | DQ518658 | DENV3 E | AY145725 | DENV3 E | EU448439 |
| DENV3 E | AB111081 | DENV3 E | DQ675529 | DENV3 E | EU617033 | DENV3 E | AY676354 |
| DENV3 E | EU570160 | DENV3 E | GU721066 | DENV3 E | EU448434 | DENV3 E | DQ341204 |
| DENV3 E | FJ182010 | DENV3 E | AY265856 | DENV3 E | L11438 | DENV3 E | AM746232 |
| DENV3 E | AB214879 | DENV3 E | EU117354 | DENV3 E | DQ518654 | DENV3 E | DQ177894 |
| DENV3 E | EU081203 | DENV3 E | FJ850079 | DENV3 E | DQ518655 | DENV3 E | AM746228 |
| DENV3 E | EU854298 | DENV3 E | AY676369 | DENV3 E | EU617021 | DENV3 E | EU617036 |
| DENV3 E | FJ562097 | DENV3 E | FJ547079 | DENV3 E | DQ518670 | DENV3 E | DQ118876 |
| DENV3 E | AY676417 | DENV3 E | GU131909 | DENV3 E | FJ389913 | DENV3 E | FJ389912 |
| DENV3 E | AY960629 | DENV3 E | DQ177898 | DENV3 E | EU052794 | DENV3 E | FJ189463 |
| DENV3 E | FJ547071 | DENV3 E | FJ189461 | DENV3 E | L11429 | DENV3 E | DQ453979 |
| DENV3 E | FJ390372 | DENV3 E | FJ205870 | DENV3 E | AY676384 | DENV3 E | FJ606699 |
| DENV3 E | GU131946 | DENV3 E | AY496871 | DENV3 E | AB219137 | DENV3 E | AY145712 |
| DENV3 E | DQ177901 | DENV3 E | AY912458 | DENV3 E | DQ118871 | DENV3 E | FJ189452 |
| DENV3 E | EU529685 | DENV3 E | AY858043 | DENV3 E | EU117359 | DENV3 E | EU117363 |
| DENV3 E | EU081219 | DENV3 E | DQ118878 | DENV3 E | AY632355 | DENV3 E | FJ389911 |
| DENV3 E | FN429918 | DENV3 E | EU596492 | DENV3 E | EU448443 | DENV3 E | AY960635 |
| DENV3 E | FJ744727 | DENV3 E | GU131937 | DENV3 E | AY676391 | DENV3 E | DQ118888 |
| DENV3 E | FJ744732 | DENV3 E | GU131875 | DENV3 E | AF147458 | DENV3 E | EU052793 |
| DENV3 E | FJ898446 | DENV3 E | EU081191 | DENV3 E | EU045316 | DENV3 E | FJ375134 |
| DENV3 E | FJ882571 | DENV3 E | AY858040 | DENV3 E | AY676411 | DENV3 E | AY145729 |
| DENV3 E | FJ744733 | DENV3 E | AY676380 | DENV3 E | AY676420 | DENV3 E | DQ177903 |
| DENV3 E | GQ199861 | DENV3 E | EU482458 | DENV3 E | AY676364 | DENV3 E | FJ189451 |
| DENV3 E | FJ873813 | DENV3 E | EU687197 | DENV3 E | EU117365 | DENV3 E | AY676358 |
| DENV3 E | FJ639762 | DENV3 E | FJ177308 | DENV3 E | FJ606698 | DENV3 E | GU721068 |
| DENV3 E | EU081186 | DENV3 E | DQ401693 | DENV3 E | AY656672 | DENV3 E | AY676412 |
| DENV3 E | L11620 | DENV3 E | DQ177893 | DENV3 E | EF440434 | DENV3 E | DQ453971 |
| DENV3 E | EU081225 | DENV3 E | L11430 | DENV3 E | AB219130 | DENV3 E | AF147457 |
| DENV3 E | GQ868547 | DENV3 E | DQ453970 | DENV3 E | DQ118870 | DENV3 E | GU721069 |
| DENV3 E | AY676394 | DENV3 E | AY676363 | DENV3 E | AY135419 | DENV3 E | AY960630 |
| DENV3 E | AB111084 | DENV3 E | EU448446 | DENV3 E | FJ606709 | DENV3 E | DQ118872 |
| DENV3 E | AY038605 | DENV3 E | AY146772 | DENV3 E | DQ453978 | DENV3 E | AY676362 |
| DENV3 E | GU131878 | DENV3 E | DQ118875 | DENV3 E | DQ118883 | DENV3 E | AY656673 |

FIG. 68-18

| Virus Protein | Accession No. | Virus Protein | Accession No. | Virus Protein | Accession No. | Virus Protein | Accession No. |
|---|---|---|---|---|---|---|---|
| DENV3 E | DQ118890 | DENV3 E | FJ606707 | DENV3 E | AY496875 | DENV3 E | L11425 |
| DENV3 E | EU617023 | DENV3 E | AY265857 | DENV3 E | AY676356 | DENV3 E | FJ189467 |
| DENV3 E | L11428 | DENV3 E | DQ518679 | DENV3 E | DQ118886 | DENV3 E | AY146775 |
| DENV3 E | FJ606695 | DENV3 E | DQ118889 | DENV3 E | EU617034 | DENV3 E | FJ606701 |
| DENV3 E | EU045315 | DENV3 E | L11427 | DENV3 E | EU617024 | DENV3 E | FJ389906 |
| DENV3 E | AY676392 | DENV3 E | FJ606711 | DENV3 E | DQ453969 | DENV3 E | FJ189458 |
| DENV3 E | DQ518677 | DENV3 E | AY146761 | DENV3 E | FJ389914 | DENV3 E | EU117369 |
| DENV3 E | AY656669 | DENV3 E | FJ606705 | DENV3 E | AY702030 | DENV3 E | EU052798 |
| DENV3 E | DQ177886 | DENV3 E | AY676361 | DENV3 E | FJ606697 | DENV3 E | L11442 |
| DENV3 E | AY676385 | DENV3 E | FJ606696 | DENV3 E | EU117361 | DENV3 E | FJ204475 |
| DENV3 E | DQ367720 | DENV3 E | AY145719 | DENV3 E | AY146770 | DENV3 E | EU182242 |
| DENV3 E | DQ371245 | DENV3 E | EU617031 | DENV3 E | AY676409 | DENV3 E | EU117355 |
| DENV3 E | AY676389 | DENV3 E | EU117362 | DENV3 E | EU182243 | DENV3 E | EU570161 |
| DENV3 E | AY676406 | DENV3 E | DQ518676 | DENV3 E | DQ453977 | DENV3 E | AB111080 |
| DENV3 E | EU052795 | DENV3 E | AB111085 | DENV3 E | FJ389907 | DENV3 E | L11433 |
| DENV3 E | EU617028 | DENV3 E | AY676397 | DENV3 E | AY676360 | DENV3 E | AY146766 |
| DENV3 E | EU045318 | DENV3 E | EU617022 | DENV3 E | FJ606706 | DENV3 E | AY676395 |
| DENV3 E | EU182239 | DENV3 E | L11619 | DENV3 E | DQ177892 | DENV3 E | EU182244 |
| DENV3 E | DQ518664 | DENV3 E | FJ189457 | DENV3 E | M86733 | DENV3 E | DQ118874 |
| DENV3 E | EU052796 | DENV3 E | AY960625 | DENV3 E | FJ606708 | DENV3 E | DQ177897 |
| DENV3 E | AY146771 | DENV3 E | DQ518669 | DENV3 E | AY338494 | DENV3 E | DQ367722 |
| DENV3 E | EU045323 | DENV3 E | DQ453972 | DENV3 E | AY676415 | DENV3 E | DQ118868 |
| DENV3 E | EU617027 | DENV3 E | AB219139 | DENV3 E | AY676373 | DENV3 E | AY676400 |
| DENV3 E | AY676371 | DENV3 E | AY702033 | DENV3 E | GU721065 | DENV3 E | AY099339 |
| DENV3 E | DQ177895 | DENV3 E | EU045322 | DENV3 E | EU259607 | DENV3 E | AY676414 |
| DENV3 E | AY960633 | DENV3 E | DQ177887 | DENV3 E | AY676418 | DENV3 E | AY676357 |
| DENV3 E | EU448441 | DENV3 E | AY146776 | DENV3 E | AY676383 | DENV3 E | DQ518663 |
| DENV3 E | L11436 | DENV3 E | EU045317 | DENV3 E | EU448438 | DENV3 E | AY676382 |
| DENV3 E | AY145718 | DENV3 E | DQ453981 | DENV3 E | AY145716 | DENV3 E | AY145715 |
| DENV3 E | FJ389909 | DENV3 E | AY145717 | DENV3 E | DQ453976 | DENV3 E | AY676366 |
| DENV3 E | AY145722 | DENV3 E | FJ189465 | DENV3 E | EU448447 | DENV3 E | L11434 |
| DENV3 E | AY656671 | DENV3 E | AY145727 | DENV3 E | DQ518668 | DENV3 E | AY145730 |
| DENV3 E | AY676355 | DENV3 E | EU448444 | DENV3 E | AY960631 | DENV3 E | EU617029 |
| DENV3 E | AY145723 | DENV3 E | L11426 | DENV3 E | DQ177888 | DENV3 E | AY676388 |
| DENV3 E | DQ341205 | DENV3 E | EU259608 | DENV3 E | DQ118891 | DENV3 E | DQ453975 |
| DENV3 E | AY912454 | DENV3 E | AY676379 | DENV3 E | EU045319 | DENV3 E | AY656670 |
| DENV3 E | EU117353 | DENV3 E | EF441284 | DENV3 E | DQ518662 | DENV3 E | AY960634 |
| DENV3 E | FJ189469 | DENV3 E | AY496876 | DENV3 E | EU117368 | DENV3 E | DQ518661 |
| DENV3 E | AY146762 | DENV3 E | AY676390 | DENV3 E | DQ518673 | DENV3 E | FM986662 |
| DENV3 E | FJ389915 | DENV3 E | EU448433 | DENV3 E | AY702031 | DENV3 E | FJ204476 |
| DENV3 E | EU259606 | DENV3 E | EU117370 | DENV3 E | EU448435 | DENV3 E | AB219131 |
| DENV3 E | L11440 | DENV3 E | AY146767 | DENV3 E | EU448440 | DENV3 E | AY676368 |
| DENV3 E | L11435 | DENV3 E | AY145724 | DENV3 E | AB219133 | DENV3 E | EU182241 |
| DENV3 E | AY145728 | DENV3 E | EU117358 | DENV3 E | AY146777 | DENV3 E | DQ118885 |
| DENV3 E | FM986663 | DENV3 E | FJ189454 | DENV3 E | L11431 | DENV3 E | AY676419 |
| DENV3 E | DQ118865 | DENV3 E | DQ118864 | DENV3 E | EU617038 | DENV3 E | FJ189449 |
| DENV3 E | AF349753 | DENV3 E | DQ341206 | DENV3 E | EU617025 | DENV3 E | EU448442 |
| DENV3 E | EU045324 | DENV3 E | AY676370 | DENV3 E | AB219134 | DENV3 E | EU117360 |

FIG. 68-19

| Virus Protein | Accession No. | Virus Protein | Accession No. | Virus Protein | Accession No. | Virus Protein | Accession No. |
|---|---|---|---|---|---|---|---|
| DENV3 E | DQ453980 | DENV3 E | AY099341 | DENV3 E | DQ518674 | DENV3 E | EU117354 |
| DENV3 E | AM746231 | DENV3 E | DQ518657 | DENV3 E | GU721067 | DENV3 E | AY676369 |
| DENV3 E | AY676408 | DENV3 E | AY676398 | DENV3 E | AY676374 | DENV3 E | DQ177898 |
| DENV3 E | AY676376 | DENV3 E | DQ518660 | DENV3 E | EU045321 | DENV3 E | FJ189461 |
| DENV3 E | FJ389908 | DENV3 E | EU448437 | DENV3 E | DQ118869 | DENV3 E | AY912458 |
| DENV3 E | DQ518667 | DENV3 E | AY676367 | DENV3 E | FJ189460 | DENV3 E | DQ118878 |
| DENV3 E | DQ341208 | DENV3 E | DQ341203 | DENV3 E | AY960632 | DENV3 E | AY676380 |
| DENV3 E | FJ606710 | DENV3 E | AY676407 | DENV3 E | AY496878 | DENV3 E | DQ177893 |
| DENV3 E | EU448436 | DENV3 E | EU045314 | DENV3 E | DQ518672 | DENV3 E | DQ453970 |
| DENV3 E | EU117366 | DENV3 E | DQ118882 | DENV3 E | EU617019 | DENV3 E | AY146772 |
| DENV3 E | AY676401 | DENV3 E | AY099342 | DENV3 E | AY676399 | DENV3 E | DQ118875 |
| DENV3 E | DQ341207 | DENV3 E | AY676410 | DENV3 E | FJ189450 | DENV3 E | EU478409 |
| DENV3 E | FJ189459 | DENV3 E | AY676377 | DENV3 E | DQ177899 | DENV3 E | AY676378 |
| DENV3 E | EU617037 | DENV3 E | AY656674 | DENV3 E | AY146773 | DENV3 E | AY676365 |
| DENV3 E | L11424 | DENV3 E | EU617035 | DENV3 E | AY145720 | DENV3 E | DQ453968 |
| DENV3 E | DQ118867 | DENV3 E | EU259605 | DENV3 E | FJ189466 | DENV3 E | DQ118887 |
| DENV3 E | AY099338 | DENV3 E | DQ453973 | DENV3 E | AY146778 | DENV3 E | FJ606694 |
| DENV3 E | DQ118880 | DENV3 E | AM746230 | DENV3 E | L11437 | DENV3 E | EU182245 |
| DENV3 E | AY146768 | DENV3 E | DQ518671 | DENV3 E | DQ341202 | DENV3 E | AF533079 |
| DENV3 E | M25277 | DENV3 E | AB219132 | DENV3 E | AF147459 | DENV3 E | FJ375135 |
| DENV3 E | DQ118866 | DENV3 E | L11441 | DENV3 E | FJ606693 | DENV3 E | AY145725 |
| DENV3 E | AF147460 | DENV3 E | FJ189453 | DENV3 E | AY496872 | DENV3 E | EU617033 |
| DENV3 E | L11439 | DENV3 E | FJ389910 | DENV3 E | EU617020 | DENV3 E | EU448434 |
| DENV3 E | AY676375 | DENV3 E | AB111083 | DENV3 E | L11422 | DENV3 E | L11438 |
| DENV3 E | AY702032 | DENV3 E | EU117367 | DENV3 E | DQ341209 | DENV3 E | DQ518655 |
| DENV3 E | FJ189468 | DENV3 E | EU448432 | DENV3 E | AB111082 | DENV3 E | EU617021 |
| DENV3 E | AY960628 | DENV3 E | AY676402 | DENV3 E | AM746229 | DENV3 E | DQ518670 |
| DENV3 E | EU045325 | DENV3 E | AY676393 | DENV3 E | DQ453974 | DENV3 E | FJ389913 |
| DENV3 E | DQ177900 | DENV3 E | L11423 | DENV3 E | AB111081 | DENV3 E | L11429 |
| DENV3 E | L11432 | DENV3 E | DQ518656 | DENV3 E | EU570160 | DENV3 E | EU117359 |
| DENV3 E | FJ606700 | DENV3 E | DQ177902 | DENV3 E | AY676417 | DENV3 E | AY676391 |
| DENV3 E | EU052797 | DENV3 E | DQ518666 | DENV3 E | AY960629 | DENV3 E | AF147458 |
| DENV3 E | FJ389916 | DENV3 E | FJ606692 | DENV3 E | DQ177901 | DENV3 E | AY676411 |
| DENV3 E | FJ189456 | DENV3 E | AY676381 | DENV3 E | L11620 | DENV3 E | AY676420 |
| DENV3 E | AY676413 | DENV3 E | AY338492 | DENV3 E | AY676394 | DENV3 E | FJ606698 |
| DENV3 E | DQ518675 | DENV3 E | AY145726 | DENV3 E | AB111084 | DENV3 E | AY656672 |
| DENV3 E | AY676372 | DENV3 E | DQ518659 | DENV3 E | AY038605 | DENV3 E | AY135419 |
| DENV3 E | AY676396 | DENV3 E | DQ177896 | DENV3 E | DQ118879 | DENV3 E | FJ606709 |
| DENV3 E | EU617032 | DENV3 E | EU617030 | DENV3 E | AB219138 | DENV3 E | DQ453978 |
| DENV3 E | DQ177890 | DENV3 E | EU052792 | DENV3 E | AY676421 | DENV3 E | DQ118883 |
| DENV3 E | AY146774 | DENV3 E | AJ563355 | DENV3 E | FJ606702 | DENV3 E | DQ518665 |
| DENV3 E | AY145721 | DENV3 E | DQ118877 | DENV3 E | EU117364 | DENV3 E | AY676404 |
| DENV3 E | AY338493 | DENV3 E | AY676386 | DENV3 E | AY145714 | DENV3 E | AY146763 |
| DENV3 E | DQ177889 | DENV3 E | EU117357 | DENV3 E | DQ118873 | DENV3 E | EU448445 |
| DENV3 E | EU182240 | DENV3 E | AY676416 | DENV3 E | AY676403 | DENV3 E | FJ606712 |
| DENV3 E | EU045320 | DENV3 E | AY146769 | DENV3 E | DQ518658 | DENV3 E | EU448439 |
| DENV3 E | EU052799 | DENV3 E | FJ189462 | DENV3 E | GU721066 | DENV3 E | AY676354 |
| DENV3 E | AY676387 | DENV3 E | AY146765 | DENV3 E | AY265856 | DENV3 E | DQ341204 |

FIG. 68-20

| Virus Protein | Accession No. | Virus Protein | Accession No. | Virus Protein | Accession No. | Virus Protein | Accession No. |
|---|---|---|---|---|---|---|---|
| DENV3 E | FJ189463 | DENV3 E | FJ189457 | DENV3 E | AY656670 | DENV3 E | EU617030 |
| DENV3 E | AY145712 | DENV3 E | DQ518669 | DENV3 E | DQ518661 | DENV3 E | AY676386 |
| DENV3 E | FJ189452 | DENV3 E | DQ453972 | DENV3 E | FJ204476 | DENV3 E | AY146769 |
| DENV3 E | FJ389911 | DENV3 E | AY702033 | DENV3 E | AY676368 | DENV3 E | AY146765 |
| DENV3 E | AY960635 | DENV3 E | AY146776 | DENV3 E | EU182241 | DENV3 E | DQ518674 |
| DENV3 E | AY145729 | DENV3 E | EU045317 | DENV3 E | DQ118885 | DENV3 E | AY676374 |
| DENV3 E | AY676358 | DENV3 E | DQ453981 | DENV3 E | FJ189449 | DENV3 E | EU045321 |
| DENV3 E | AY960630 | DENV3 E | FJ189465 | DENV3 E | EU448442 | DENV3 E | DQ518672 |
| DENV3 E | DQ118872 | DENV3 E | AY145727 | DENV3 E | EU117360 | DENV3 E | FJ189450 |
| DENV3 E | AY676362 | DENV3 E | EU448444 | DENV3 E | AM746231 | DENV3 E | DQ177899 |
| DENV3 E | DQ118890 | DENV3 E | L11426 | DENV3 E | AY676408 | DENV3 E | AY146773 |
| DENV3 E | EU617023 | DENV3 E | EF441284 | DENV3 E | AY676376 | DENV3 E | L11437 |
| DENV3 E | EU045315 | DENV3 E | EU117370 | DENV3 E | FJ389908 | DENV3 E | FJ606693 |
| DENV3 E | DQ518677 | DENV3 E | AY146767 | DENV3 E | DQ518667 | DENV3 E | AM746229 |
| DENV3 E | AY656669 | DENV3 E | FJ189454 | DENV3 E | DQ341208 | DENV3 E | AB111081 |
| DENV3 E | DQ177886 | DENV3 E | DQ118864 | DENV3 E | FJ606710 | DENV3 E | EU570160 |
| DENV3 E | AY676385 | DENV3 E | DQ341206 | DENV3 E | DQ341207 | DENV3 E | AY960629 |
| DENV3 E | DQ367720 | DENV3 E | AY676370 | DENV3 E | FJ189459 | DENV3 E | DQ177901 |
| DENV3 E | DQ371245 | DENV3 E | AY676356 | DENV3 E | EU617037 | DENV3 E | AY676394 |
| DENV3 E | AY676406 | DENV3 E | DQ453969 | DENV3 E | L11424 | DENV3 E | DQ118879 |
| DENV3 E | EU182239 | DENV3 E | EU182243 | DENV3 E | AF147460 | DENV3 E | AY676421 |
| DENV3 E | AY146771 | DENV3 E | AY676360 | DENV3 E | L11439 | DENV3 E | FJ606702 |
| DENV3 E | EU045323 | DENV3 E | DQ177892 | DENV3 E | AY702032 | DENV3 E | AY145714 |
| DENV3 E | EU617027 | DENV3 E | AY676415 | DENV3 E | L11432 | DENV3 E | DQ118873 |
| DENV3 E | DQ177895 | DENV3 E | AY676373 | DENV3 E | FJ606700 | DENV3 E | DQ518658 |
| DENV3 E | AY960633 | DENV3 E | AY676418 | DENV3 E | AY676413 | DENV3 E | GU721066 |
| DENV3 E | L11436 | DENV3 E | AY676383 | DENV3 E | AY676396 | DENV3 E | AY265856 |
| DENV3 E | AY145718 | DENV3 E | AY960631 | DENV3 E | EU617032 | DENV3 E | EU117354 |
| DENV3 E | FJ389909 | DENV3 E | DQ177888 | DENV3 E | DQ177890 | DENV3 E | FJ189461 |
| DENV3 E | AY145722 | DENV3 E | EU117368 | DENV3 E | AY145721 | DENV3 E | DQ118878 |
| DENV3 E | AY145723 | DENV3 E | EU448435 | DENV3 E | AY338493 | DENV3 E | L11430 |
| DENV3 E | FJ189469 | DENV3 E | AB219133 | DENV3 E | AY676398 | DENV3 E | AY676363 |
| DENV3 E | AY146762 | DENV3 E | AB219134 | DENV3 E | EU448437 | DENV3 E | EU448446 |
| DENV3 E | FJ389915 | DENV3 E | FJ189467 | DENV3 E | AY676367 | DENV3 E | FJ189464 |
| DENV3 E | EU259606 | DENV3 E | AY146775 | DENV3 E | DQ341203 | DENV3 E | DQ177891 |
| DENV3 E | FM986663 | DENV3 E | EU117369 | DENV3 E | AY656674 | DENV3 E | FJ189455 |
| DENV3 E | EU045324 | DENV3 E | L11442 | DENV3 E | EU617035 | DENV3 E | AY146764 |
| DENV3 E | FJ606707 | DENV3 E | AY146766 | DENV3 E | DQ453973 | DENV3 E | DQ518654 |
| DENV3 E | DQ518679 | DENV3 E | DQ177897 | DENV3 E | AB219132 | DENV3 E | AY676384 |
| DENV3 E | DQ118889 | DENV3 E | DQ118868 | DENV3 E | FJ189453 | DENV3 E | DQ118871 |
| DENV3 E | L11427 | DENV3 E | AY676400 | DENV3 E | FJ389910 | DENV3 E | AB219137 |
| DENV3 E | AY146761 | DENV3 E | AY676357 | DENV3 E | AB111083 | DENV3 E | AY632355 |
| DENV3 E | FJ606705 | DENV3 E | DQ518663 | DENV3 E | EU117367 | DENV3 E | EU448443 |
| DENV3 E | FJ606696 | DENV3 E | AY145715 | DENV3 E | EU448432 | DENV3 E | EU045316 |
| DENV3 E | AY145719 | DENV3 E | L11434 | DENV3 E | AY676402 | DENV3 E | AY676364 |
| DENV3 E | EU617031 | DENV3 E | AY145730 | DENV3 E | DQ518656 | DENV3 E | EU117365 |
| DENV3 E | EU117362 | DENV3 E | AY676388 | DENV3 E | AY676381 | DENV3 E | DQ118870 |
| DENV3 E | L11619 | DENV3 E | DQ453975 | DENV3 E | DQ177896 | DENV3 E | AB219130 |

FIG. 68-21

| Virus Protein | Accession No. | Virus Protein | Accession No. | Virus Protein | Accession No. | Virus Protein | Accession No. |
|---|---|---|---|---|---|---|---|
| DENV3 E | AY676359 | DENV3 E | FJ606711 | DENV3 E | AY146777 | DENV3 E | DQ518660 |
| DENV3 E | DQ518678 | DENV3 E | AY676361 | DENV3 E | EU617038 | DENV3 E | AY676407 |
| DENV3 E | DQ118881 | DENV3 E | DQ518676 | DENV3 E | L11425 | DENV3 E | DQ118882 |
| DENV3 E | EU182246 | DENV3 E | AB111085 | DENV3 E | EU617025 | DENV3 E | EU045314 |
| DENV3 E | EU117356 | DENV3 E | AY676397 | DENV3 E | FJ389906 | DENV3 E | AY676410 |
| DENV3 E | AY145713 | DENV3 E | EU617022 | DENV3 E | FJ606701 | DENV3 E | AY676377 |
| DENV3 E | AY676405 | DENV3 E | AY960625 | DENV3 E | FJ189458 | DENV3 E | EU259605 |
| DENV3 E | DQ367721 | DENV3 E | AB219139 | DENV3 E | FJ204475 | DENV3 E | AM746230 |
| DENV3 E | EU617026 | DENV3 E | DQ177887 | DENV3 E | EU117355 | DENV3 E | DQ518671 |
| DENV3 E | DQ118884 | DENV3 E | EU045322 | DENV3 E | EU182242 | DENV3 E | L11441 |
| DENV3 E | DQ177894 | DENV3 E | AY145717 | DENV3 E | EU570161 | DENV3 E | L11423 |
| DENV3 E | AM746232 | DENV3 E | AY676379 | DENV3 E | AB111080 | DENV3 E | AY676393 |
| DENV3 E | AM746228 | DENV3 E | EU259608 | DENV3 E | L11433 | DENV3 E | DQ177902 |
| DENV3 E | EU617036 | DENV3 E | AY496876 | DENV3 E | AY676395 | DENV3 E | DQ518666 |
| DENV3 E | DQ118876 | DENV3 E | AY676390 | DENV3 E | EU182244 | DENV3 E | FJ606692 |
| DENV3 E | FJ389912 | DENV3 E | EU448433 | DENV3 E | DQ118874 | DENV3 E | AY338492 |
| DENV3 E | DQ453979 | DENV3 E | AY145724 | DENV3 E | DQ367722 | DENV3 E | AY145726 |
| DENV3 E | FJ606699 | DENV3 E | EU117358 | DENV3 E | AY676414 | DENV3 E | DQ518659 |
| DENV3 E | EU117363 | DENV3 E | AY496875 | DENV3 E | AY676382 | DENV3 E | AJ563355 |
| DENV3 E | DQ118888 | DENV3 E | DQ118886 | DENV3 E | AY676366 | DENV3 E | DQ118877 |
| DENV3 E | FJ375134 | DENV3 E | EU617034 | DENV3 E | EU617029 | DENV3 E | AY676416 |
| DENV3 E | DQ177903 | DENV3 E | EU617024 | DENV3 E | AY960634 | DENV3 E | EU117357 |
| DENV3 E | FJ189451 | DENV3 E | AY702030 | DENV3 E | FM986662 | DENV3 E | FJ189462 |
| DENV3 E | AY676412 | DENV3 E | FJ389914 | DENV3 E | AB219131 | DENV3 E | GU721067 |
| DENV3 E | GU721068 | DENV3 E | EU117361 | DENV3 E | AY676419 | DENV3 E | DQ118869 |
| DENV3 E | AF147457 | DENV3 E | FJ606697 | DENV3 E | DQ453980 | DENV3 E | FJ189460 |
| DENV3 E | DQ453971 | DENV3 E | AY146770 | DENV3 E | EU117366 | DENV3 E | AY496878 |
| DENV3 E | GU721069 | DENV3 E | AY676409 | DENV3 E | EU448436 | DENV3 E | AY960632 |
| DENV3 E | AY656673 | DENV3 E | DQ453977 | DENV3 E | AY676401 | DENV3 E | EU617019 |
| DENV3 E | L11428 | DENV3 E | FJ389907 | DENV3 E | DQ118867 | DENV3 E | AY676399 |
| DENV3 E | FJ606695 | DENV3 E | FJ606706 | DENV3 E | DQ118880 | DENV3 E | AY145720 |
| DENV3 E | AY676392 | DENV3 E | M86733 | DENV3 E | AY146768 | DENV3 E | FJ189466 |
| DENV3 E | AY676389 | DENV3 E | FJ606708 | DENV3 E | DQ118866 | DENV3 E | AY146778 |
| DENV3 E | EU045318 | DENV3 E | AY338494 | DENV3 E | AY676375 | DENV3 E | DQ341202 |
| DENV3 E | EU617028 | DENV3 E | EU259607 | DENV3 E | FJ189468 | DENV3 E | AF147459 |
| DENV3 E | DQ518664 | DENV3 E | GU721065 | DENV3 E | AY960628 | DENV3 E | AY496872 |
| DENV3 E | AY676371 | DENV3 E | EU448438 | DENV3 E | EU045325 | DENV3 E | L11422 |
| DENV3 E | EU448441 | DENV3 E | AY145716 | DENV3 E | DQ177900 | DENV3 E | EU617020 |
| DENV3 E | AY656671 | DENV3 E | DQ453976 | DENV3 E | FJ389916 | DENV3 E | DQ341209 |
| DENV3 E | AY676355 | DENV3 E | EU448447 | DENV3 E | FJ189456 | DENV3 E | AB111082 |
| DENV3 E | DQ341205 | DENV3 E | DQ518668 | DENV3 E | AY676372 | DENV3 E | DQ453974 |
| DENV3 E | EU117353 | DENV3 E | DQ118891 | DENV3 E | DQ518675 | DENV3 E | AY676417 |
| DENV3 E | L11440 | DENV3 E | EU045319 | DENV3 E | AY146774 | DENV3 E | L11620 |
| DENV3 E | L11435 | DENV3 E | DQ518662 | DENV3 E | DQ177889 | DENV3 E | AY038605 |
| DENV3 E | AY145728 | DENV3 E | DQ518673 | DENV3 E | EU182240 | DENV3 E | AB111084 |
| DENV3 E | AF349753 | DENV3 E | AY702031 | DENV3 E | EU045320 | DENV3 E | AB219138 |
| DENV3 E | DQ118865 | DENV3 E | EU448440 | DENV3 E | AY676387 | DENV3 E | EU117364 |
| DENV3 E | AY265857 | DENV3 E | L11431 | DENV3 E | DQ518657 | DENV3 E | AY676403 |

FIG. 68-22

| Virus Protein | Accession No. | Virus Protein | Accession No. | Virus Protein | Accession No. | Virus Protein | Accession No. |
|---|---|---|---|---|---|---|---|
| DENV3 E | AY676369 | DENV3 E | AY960635 | DENV3 E | AY146776 | DENV3 E | EU182241 |
| DENV3 E | DQ177898 | DENV3 E | AY145729 | DENV3 E | EU045317 | DENV3 E | DQ118885 |
| DENV3 E | AY676380 | DENV3 E | AY676358 | DENV3 E | DQ453981 | DENV3 E | FJ189449 |
| DENV3 E | DQ177893 | DENV3 E | AY960630 | DENV3 E | FJ189465 | DENV3 E | EU448442 |
| DENV3 E | DQ453970 | DENV3 E | DQ118872 | DENV3 E | AY145727 | DENV3 E | EU117360 |
| DENV3 E | AY146772 | DENV3 E | AY676362 | DENV3 E | EU448444 | DENV3 E | AM746231 |
| DENV3 E | DQ118875 | DENV3 E | DQ118890 | DENV3 E | L11426 | DENV3 E | AY676408 |
| DENV3 E | EU478409 | DENV3 E | EU617023 | DENV3 E | EF441284 | DENV3 E | AY676376 |
| DENV3 E | AY676378 | DENV3 E | EU045315 | DENV3 E | EU117370 | DENV3 E | FJ389908 |
| DENV3 E | AY676365 | DENV3 E | DQ518677 | DENV3 E | AY146767 | DENV3 E | DQ518667 |
| DENV3 E | DQ453968 | DENV3 E | AY656669 | DENV3 E | FJ189454 | DENV3 E | DQ341208 |
| DENV3 E | DQ118887 | DENV3 E | DQ177886 | DENV3 E | DQ118864 | DENV3 E | FJ606710 |
| DENV3 E | FJ606694 | DENV3 E | AY676385 | DENV3 E | DQ341206 | DENV3 E | DQ341207 |
| DENV3 E | EU182245 | DENV3 E | DQ367720 | DENV3 E | AY676370 | DENV3 E | FJ189459 |
| DENV3 E | AF533079 | DENV3 E | DQ371245 | DENV3 E | AY676356 | DENV3 E | EU617037 |
| DENV3 E | FJ375135 | DENV3 E | AY676406 | DENV3 E | DQ453969 | DENV3 E | L11424 |
| DENV3 E | AY145725 | DENV3 E | EU182239 | DENV3 E | EU182243 | DENV3 E | AF147460 |
| DENV3 E | EU617033 | DENV3 E | AY146771 | DENV3 E | AY676360 | DENV3 E | L11439 |
| DENV3 E | EU448434 | DENV3 E | EU045323 | DENV3 E | DQ177892 | DENV3 E | AY702032 |
| DENV3 E | L11438 | DENV3 E | EU617027 | DENV3 E | AY676415 | DENV3 E | L11432 |
| DENV3 E | DQ518655 | DENV3 E | DQ177895 | DENV3 E | AY676373 | DENV3 E | FJ606700 |
| DENV3 E | EU617021 | DENV3 E | AY960633 | DENV3 E | AY676418 | DENV3 E | AY676413 |
| DENV3 E | DQ518670 | DENV3 E | L11436 | DENV3 E | AY676383 | DENV3 E | AY676396 |
| DENV3 E | FJ389913 | DENV3 E | AY145718 | DENV3 E | AY960631 | DENV3 E | EU617032 |
| DENV3 E | L11429 | DENV3 E | FJ389909 | DENV3 E | DQ177888 | DENV3 E | DQ177890 |
| DENV3 E | EU117359 | DENV3 E | AY145722 | DENV3 E | EU117368 | DENV3 E | AY145721 |
| DENV3 E | AY676391 | DENV3 E | AY145723 | DENV3 E | EU448435 | DENV3 E | AY338493 |
| DENV3 E | AF147458 | DENV3 E | FJ189469 | DENV3 E | AB219133 | DENV3 E | AY676398 |
| DENV3 E | AY676411 | DENV3 E | AY146762 | DENV3 E | AB219134 | DENV3 E | EU448437 |
| DENV3 E | AY676420 | DENV3 E | FJ389915 | DENV3 E | FJ189467 | DENV3 E | AY676367 |
| DENV3 E | FJ606698 | DENV3 E | EU259606 | DENV3 E | AY146775 | DENV3 E | DQ341203 |
| DENV3 E | AY656672 | DENV3 E | FM986663 | DENV3 E | EU117369 | DENV3 E | AY656674 |
| DENV3 E | AY135419 | DENV3 E | EU045324 | DENV3 E | L11442 | DENV3 E | EU617035 |
| DENV3 E | FJ606709 | DENV3 E | FJ606707 | DENV3 E | AY146766 | DENV3 E | DQ453973 |
| DENV3 E | DQ453978 | DENV3 E | DQ518679 | DENV3 E | DQ177897 | DENV3 E | AB219132 |
| DENV3 E | DQ118883 | DENV3 E | DQ118889 | DENV3 E | DQ118868 | DENV3 E | FJ189453 |
| DENV3 E | DQ518665 | DENV3 E | L11427 | DENV3 E | AY676400 | DENV3 E | FJ389910 |
| DENV3 E | AY676404 | DENV3 E | AY146761 | DENV3 E | AY676357 | DENV3 E | AB111083 |
| DENV3 E | AY146763 | DENV3 E | FJ606705 | DENV3 E | DQ518663 | DENV3 E | EU117367 |
| DENV3 E | EU448445 | DENV3 E | FJ606696 | DENV3 E | AY145715 | DENV3 E | EU448432 |
| DENV3 E | FJ606712 | DENV3 E | AY145719 | DENV3 E | L11434 | DENV3 E | AY676402 |
| DENV3 E | EU448439 | DENV3 E | EU617031 | DENV3 E | AY145730 | DENV3 E | DQ518656 |
| DENV3 E | AY676354 | DENV3 E | EU117362 | DENV3 E | AY676388 | DENV3 E | AY676381 |
| DENV3 E | DQ341204 | DENV3 E | L11619 | DENV3 E | DQ453975 | DENV3 E | DQ177896 |
| DENV3 E | FJ189463 | DENV3 E | FJ189457 | DENV3 E | AY656670 | DENV3 E | EU617030 |
| DENV3 E | AY145712 | DENV3 E | DQ518669 | DENV3 E | DQ518661 | DENV3 E | AY676386 |
| DENV3 E | FJ189452 | DENV3 E | DQ453972 | DENV3 E | FJ204476 | DENV3 E | AY146769 |
| DENV3 E | FJ389911 | DENV3 E | AY702033 | DENV3 E | AY676368 | DENV3 E | AY146765 |

FIG. 68-23

| Virus Protein | Accession No. | Virus Protein | Accession No. | Virus Protein | Accession No. | Virus Protein | Accession No. |
|---|---|---|---|---|---|---|---|
| DENV3 E | DQ518674 | DENV3 E | EU117356 | DENV3 E | AY676397 | DENV3 E | FJ389906 |
| DENV3 E | AY676374 | DENV3 E | AY145713 | DENV3 E | EU617022 | DENV3 E | FJ606701 |
| DENV3 E | EU045321 | DENV3 E | AY676405 | DENV3 E | AY960625 | DENV3 E | FJ189458 |
| DENV3 E | DQ518672 | DENV3 E | DQ367721 | DENV3 E | AB219139 | DENV3 E | FJ204475 |
| DENV3 E | FJ189450 | DENV3 E | EU617026 | DENV3 E | DQ177887 | DENV3 E | EU117355 |
| DENV3 E | DQ177899 | DENV3 E | DQ118884 | DENV3 E | EU045322 | DENV3 E | EU182242 |
| DENV3 E | AY146773 | DENV3 E | DQ177894 | DENV3 E | AY145717 | DENV3 E | EU570161 |
| DENV3 E | L11437 | DENV3 E | AM746232 | DENV3 E | AY676379 | DENV3 E | AB111080 |
| DENV3 E | FJ606693 | DENV3 E | AM746228 | DENV3 E | EU259608 | DENV3 E | L11433 |
| DENV3 E | AM746229 | DENV3 E | EU617036 | DENV3 E | AY496876 | DENV3 E | AY676395 |
| DENV3 E | AB111081 | DENV3 E | DQ118876 | DENV3 E | AY676390 | DENV3 E | EU182244 |
| DENV3 E | EU570160 | DENV3 E | FJ389912 | DENV3 E | EU448433 | DENV3 E | DQ118874 |
| DENV3 E | AY960629 | DENV3 E | DQ453979 | DENV3 E | AY145724 | DENV3 E | DQ367722 |
| DENV3 E | DQ177901 | DENV3 E | FJ606699 | DENV3 E | EU117358 | DENV3 E | AY676414 |
| DENV3 E | AY676394 | DENV3 E | EU117363 | DENV3 E | AY496875 | DENV3 E | AY676382 |
| DENV3 E | DQ118879 | DENV3 E | DQ118888 | DENV3 E | DQ118886 | DENV3 E | AY676366 |
| DENV3 E | AY676421 | DENV3 E | FJ375134 | DENV3 E | EU617034 | DENV3 E | EU617029 |
| DENV3 E | FJ606702 | DENV3 E | DQ177903 | DENV3 E | EU617024 | DENV3 E | AY960634 |
| DENV3 E | AY145714 | DENV3 E | FJ189451 | DENV3 E | AY702030 | DENV3 E | FM986662 |
| DENV3 E | DQ118873 | DENV3 E | AY676412 | DENV3 E | FJ389914 | DENV3 E | AB219131 |
| DENV3 E | DQ518658 | DENV3 E | GU721068 | DENV3 E | EU117361 | DENV3 E | AY676419 |
| DENV3 E | GU721066 | DENV3 E | AF147457 | DENV3 E | FJ606697 | DENV3 E | DQ453980 |
| DENV3 E | AY265856 | DENV3 E | DQ453971 | DENV3 E | AY146770 | DENV3 E | EU117366 |
| DENV3 E | EU117354 | DENV3 E | GU721069 | DENV3 E | AY676409 | DENV3 E | EU448436 |
| DENV3 E | FJ189461 | DENV3 E | AY656673 | DENV3 E | DQ453977 | DENV3 E | AY676401 |
| DENV3 E | DQ118878 | DENV3 E | L11428 | DENV3 E | FJ389907 | DENV3 E | DQ118867 |
| DENV3 E | L11430 | DENV3 E | FJ606695 | DENV3 E | FJ606706 | DENV3 E | DQ118880 |
| DENV3 E | AY676363 | DENV3 E | AY676392 | DENV3 E | M86733 | DENV3 E | AY146768 |
| DENV3 E | EU448446 | DENV3 E | AY676389 | DENV3 E | FJ606708 | DENV3 E | DQ118866 |
| DENV3 E | FJ189464 | DENV3 E | EU045318 | DENV3 E | AY338494 | DENV3 E | AY676375 |
| DENV3 E | DQ177891 | DENV3 E | EU617028 | DENV3 E | EU259607 | DENV3 E | FJ189468 |
| DENV3 E | FJ189455 | DENV3 E | DQ518664 | DENV3 E | GU721065 | DENV3 E | AY960628 |
| DENV3 E | AY146764 | DENV3 E | AY676371 | DENV3 E | EU448438 | DENV3 E | EU045325 |
| DENV3 E | DQ518654 | DENV3 E | EU448441 | DENV3 E | AY145716 | DENV3 E | DQ177900 |
| DENV3 E | AY676384 | DENV3 E | AY656671 | DENV3 E | DQ453976 | DENV3 E | FJ389916 |
| DENV3 E | DQ118871 | DENV3 E | AY676355 | DENV3 E | EU448447 | DENV3 E | FJ189456 |
| DENV3 E | AB219137 | DENV3 E | DQ341205 | DENV3 E | DQ518668 | DENV3 E | AY676372 |
| DENV3 E | AY632355 | DENV3 E | EU117353 | DENV3 E | DQ118891 | DENV3 E | DQ518675 |
| DENV3 E | EU448443 | DENV3 E | L11440 | DENV3 E | EU045319 | DENV3 E | AY146774 |
| DENV3 E | EU045316 | DENV3 E | L11435 | DENV3 E | DQ518662 | DENV3 E | DQ177889 |
| DENV3 E | AY676364 | DENV3 E | AY145728 | DENV3 E | DQ518673 | DENV3 E | EU182240 |
| DENV3 E | EU117365 | DENV3 E | AF349753 | DENV3 E | AY702031 | DENV3 E | EU045320 |
| DENV3 E | DQ118870 | DENV3 E | DQ118865 | DENV3 E | EU448440 | DENV3 E | AY676387 |
| DENV3 E | AB219130 | DENV3 E | AY265857 | DENV3 E | L11431 | DENV3 E | DQ518657 |
| DENV3 E | AY676359 | DENV3 E | FJ606711 | DENV3 E | AY146777 | DENV3 E | DQ518660 |
| DENV3 E | DQ518678 | DENV3 E | AY676361 | DENV3 E | EU617038 | DENV3 E | AY676407 |
| DENV3 E | DQ118881 | DENV3 E | DQ518676 | DENV3 E | L11425 | DENV3 E | DQ118882 |
| DENV3 E | EU182246 | DENV3 E | AB111085 | DENV3 E | EU617025 | DENV3 E | EU045314 |

FIG. 68-24

| Virus Protein | Accession No. | Virus Protein | Accession No. | Virus Protein | Accession No. | Virus Protein | Accession No. |
|---|---|---|---|---|---|---|---|
| DENV3 E | AY676410 | DENV3 E | AY146772 | DENV3 E | AY656669 | DENV3 E | AY676383 |
| DENV3 E | AY676377 | DENV3 E | DQ118875 | DENV3 E | AY676385 | DENV3 E | EU117368 |
| DENV3 E | EU259605 | DENV3 E | EU478409 | DENV3 E | AY676406 | DENV3 E | EU448435 |
| DENV3 E | AM746230 | DENV3 E | AY676378 | DENV3 E | EU182239 | DENV3 E | AB219133 |
| DENV3 E | DQ518671 | DENV3 E | AY676365 | DENV3 E | AY146771 | DENV3 E | AB219134 |
| DENV3 E | L11441 | DENV3 E | DQ453968 | DENV3 E | EU045323 | DENV3 E | FJ189467 |
| DENV3 E | L11423 | DENV3 E | DQ118887 | DENV3 E | EU617027 | DENV3 E | AY146775 |
| DENV3 E | AY676393 | DENV3 E | FJ606694 | DENV3 E | AY145718 | DENV3 E | EU117369 |
| DENV3 E | DQ177902 | DENV3 E | EU182245 | DENV3 E | FJ389909 | DENV3 E | AY146766 |
| DENV3 E | DQ518666 | DENV3 E | AF533079 | DENV3 E | AY145722 | DENV3 E | DQ118868 |
| DENV3 E | FJ606692 | DENV3 E | AY145725 | DENV3 E | AY145723 | DENV3 E | AY676400 |
| DENV3 E | AY338492 | DENV3 E | EU617033 | DENV3 E | FJ189469 | DENV3 E | AY676357 |
| DENV3 E | AY145726 | DENV3 E | EU448434 | DENV3 E | AY146762 | DENV3 E | DQ518663 |
| DENV3 E | DQ518659 | DENV3 E | DQ518655 | DENV3 E | FJ389915 | DENV3 E | AY145715 |
| DENV3 E | AJ563355 | DENV3 E | EU617021 | DENV3 E | FM986663 | DENV3 E | AY145730 |
| DENV3 E | DQ118877 | DENV3 E | DQ518670 | DENV3 E | EU045324 | DENV3 E | AY676388 |
| DENV3 E | AY676416 | DENV3 E | FJ389913 | DENV3 E | FJ606707 | DENV3 E | DQ453975 |
| DENV3 E | EU117357 | DENV3 E | EU117359 | DENV3 E | DQ518679 | DENV3 E | AY656670 |
| DENV3 E | FJ189462 | DENV3 E | AY676391 | DENV3 E | DQ118889 | DENV3 E | DQ518661 |
| DENV3 E | GU721067 | DENV3 E | AF147458 | DENV3 E | AY146761 | DENV3 E | FJ204476 |
| DENV3 E | DQ118869 | DENV3 E | AY676411 | DENV3 E | FJ606705 | DENV3 E | AY676368 |
| DENV3 E | FJ189460 | DENV3 E | AY676420 | DENV3 E | FJ606696 | DENV3 E | EU182241 |
| DENV3 E | AY496878 | DENV3 E | FJ606698 | DENV3 E | AY145719 | DENV3 E | DQ118885 |
| DENV3 E | AY960632 | DENV3 E | AY656672 | DENV3 E | EU617031 | DENV3 E | FJ189449 |
| DENV3 E | EU617019 | DENV3 E | AY135419 | DENV3 E | EU117362 | DENV3 E | EU448442 |
| DENV3 E | AY676399 | DENV3 E | FJ606709 | DENV3 E | FJ189457 | DENV3 E | EU117360 |
| DENV3 E | AY145720 | DENV3 E | DQ453978 | DENV3 E | DQ518669 | DENV3 E | AM746231 |
| DENV3 E | FJ189466 | DENV3 E | DQ118883 | DENV3 E | DQ453972 | DENV3 E | AY676408 |
| DENV3 E | AY146778 | DENV3 E | DQ518665 | DENV3 E | AY702033 | DENV3 E | AY676376 |
| DENV3 E | DQ341202 | DENV3 E | AY676404 | DENV3 E | AY146776 | DENV3 E | FJ389908 |
| DENV3 E | AF147459 | DENV3 E | AY146763 | DENV3 E | EU045317 | DENV3 E | DQ518667 |
| DENV3 E | AY496872 | DENV3 E | EU448445 | DENV3 E | DQ453981 | DENV3 E | DQ341208 |
| DENV3 E | L11422 | DENV3 E | FJ606712 | DENV3 E | FJ189465 | DENV3 E | FJ606710 |
| DENV3 E | EU617020 | DENV3 E | EU448439 | DENV3 E | AY145727 | DENV3 E | DQ341207 |
| DENV3 E | DQ341209 | DENV3 E | AY676354 | DENV3 E | EU448444 | DENV3 E | FJ189459 |
| DENV3 E | AB111082 | DENV3 E | DQ341204 | DENV3 E | EU117370 | DENV3 E | EU617037 |
| DENV3 E | DQ453974 | DENV3 E | FJ189463 | DENV3 E | AY146767 | DENV3 E | AF147460 |
| DENV3 E | AY676417 | DENV3 E | AY145712 | DENV3 E | FJ189454 | DENV3 E | AY702032 |
| DENV3 E | L11620 | DENV3 E | FJ189452 | DENV3 E | DQ118864 | DENV3 E | FJ606700 |
| DENV3 E | AY038605 | DENV3 E | FJ389911 | DENV3 E | DQ341206 | DENV3 E | AY676413 |
| DENV3 E | AB111084 | DENV3 E | AY145729 | DENV3 E | AY676370 | DENV3 E | AY676396 |
| DENV3 E | AB219138 | DENV3 E | AY676358 | DENV3 E | AY676356 | DENV3 E | EU617032 |
| DENV3 E | EU117364 | DENV3 E | DQ118872 | DENV3 E | DQ453969 | DENV3 E | AY145721 |
| DENV3 E | AY676403 | DENV3 E | AY676362 | DENV3 E | EU182243 | DENV3 E | AY338493 |
| DENV3 E | AY676369 | DENV3 E | DQ118890 | DENV3 E | AY676360 | DENV3 E | AY676398 |
| DENV3 E | DQ177898 | DENV3 E | EU617023 | DENV3 E | AY676415 | DENV3 E | EU448437 |
| DENV3 E | AY676380 | DENV3 E | EU045315 | DENV3 E | AY676373 | DENV3 E | AY676367 |
| DENV3 E | DQ453970 | DENV3 E | DQ518677 | DENV3 E | AY676418 | DENV3 E | DQ341203 |

FIG. 68-25

| Virus | Protein | Accession No. | Virus | Protein | Accession No. | Virus | Protein | Accession No. | Virus | Protein | Accession No. |
|---|---|---|---|---|---|---|---|---|---|---|---|
| DENV3 | E | AY656674 | DENV3 | E | AY676364 | DENV3 | E | EU617022 | DENV3 | E | DQ118874 |
| DENV3 | E | EU617035 | DENV3 | E | EU117365 | DENV3 | E | AB219139 | DENV3 | E | AY676414 |
| DENV3 | E | DQ453973 | DENV3 | E | DQ118870 | DENV3 | E | EU045322 | DENV3 | E | AY676382 |
| DENV3 | E | AB219132 | DENV3 | E | AB219130 | DENV3 | E | AY145717 | DENV3 | E | AY676366 |
| DENV3 | E | FJ189453 | DENV3 | E | AY676359 | DENV3 | E | AY676379 | DENV3 | E | EU617029 |
| DENV3 | E | FJ389910 | DENV3 | E | DQ518678 | DENV3 | E | AY676390 | DENV3 | E | FM986662 |
| DENV3 | E | AB111083 | DENV3 | E | DQ118881 | DENV3 | E | EU448433 | DENV3 | E | AB219131 |
| DENV3 | E | EU117367 | DENV3 | E | EU182246 | DENV3 | E | AY145724 | DENV3 | E | AY676419 |
| DENV3 | E | EU448432 | DENV3 | E | EU117356 | DENV3 | E | EU117358 | DENV3 | E | DQ453980 |
| DENV3 | E | AY676402 | DENV3 | E | AY145713 | DENV3 | E | DQ118886 | DENV3 | E | EU117366 |
| DENV3 | E | DQ518656 | DENV3 | E | AY676405 | DENV3 | E | EU617034 | DENV3 | E | EU448436 |
| DENV3 | E | AY676381 | DENV3 | E | EU617026 | DENV3 | E | EU617024 | DENV3 | E | AY676401 |
| DENV3 | E | EU617030 | DENV3 | E | DQ118884 | DENV3 | E | AY702030 | DENV3 | E | DQ118867 |
| DENV3 | E | AY676386 | DENV3 | E | AM746232 | DENV3 | E | FJ389914 | DENV3 | E | DQ118880 |
| DENV3 | E | AY146769 | DENV3 | E | AM746228 | DENV3 | E | EU117361 | DENV3 | E | AY146768 |
| DENV3 | E | AY146765 | DENV3 | E | EU617036 | DENV3 | E | FJ606697 | DENV3 | E | DQ118866 |
| DENV3 | E | DQ518674 | DENV3 | E | DQ118876 | DENV3 | E | AY146770 | DENV3 | E | AY676375 |
| DENV3 | E | AY676374 | DENV3 | E | FJ389912 | DENV3 | E | AY676409 | DENV3 | E | FJ189468 |
| DENV3 | E | EU045321 | DENV3 | E | DQ453979 | DENV3 | E | DQ453977 | DENV3 | E | EU045325 |
| DENV3 | E | DQ518672 | DENV3 | E | FJ606699 | DENV3 | E | FJ389907 | DENV3 | E | FJ389916 |
| DENV3 | E | FJ189450 | DENV3 | E | EU117363 | DENV3 | E | FJ606706 | DENV3 | E | FJ189456 |
| DENV3 | E | AY146773 | DENV3 | E | DQ118888 | DENV3 | E | FJ606708 | DENV3 | E | AY676372 |
| DENV3 | E | FJ606693 | DENV3 | E | FJ189451 | DENV3 | E | AY338494 | DENV3 | E | DQ518675 |
| DENV3 | E | AM746229 | DENV3 | E | AY676412 | DENV3 | E | GU721065 | DENV3 | E | AY146774 |
| DENV3 | E | AB111081 | DENV3 | E | GU721068 | DENV3 | E | EU448438 | DENV3 | E | EU182240 |
| DENV3 | E | EU570160 | DENV3 | E | AF147457 | DENV3 | E | AY145716 | DENV3 | E | EU045320 |
| DENV3 | E | AY676394 | DENV3 | E | DQ453971 | DENV3 | E | DQ453976 | DENV3 | E | AY676387 |
| DENV3 | E | DQ118879 | DENV3 | E | GU721069 | DENV3 | E | EU448447 | DENV3 | E | DQ518657 |
| DENV3 | E | AY676421 | DENV3 | E | AY656673 | DENV3 | E | DQ518668 | DENV3 | E | DQ518660 |
| DENV3 | E | FJ606702 | DENV3 | E | FJ606695 | DENV3 | E | DQ118891 | DENV3 | E | AY676407 |
| DENV3 | E | AY145714 | DENV3 | E | AY676392 | DENV3 | E | EU045319 | DENV3 | E | DQ118882 |
| DENV3 | E | DQ118873 | DENV3 | E | AY676389 | DENV3 | E | DQ518662 | DENV3 | E | EU045314 |
| DENV3 | E | DQ518658 | DENV3 | E | EU045318 | DENV3 | E | DQ518673 | DENV3 | E | AY676410 |
| DENV3 | E | GU721066 | DENV3 | E | EU617028 | DENV3 | E | AY702031 | DENV3 | E | AY676377 |
| DENV3 | E | EU117354 | DENV3 | E | DQ518664 | DENV3 | E | EU448440 | DENV3 | E | AM746230 |
| DENV3 | E | FJ189461 | DENV3 | E | AY676371 | DENV3 | E | AY146777 | DENV3 | E | DQ518671 |
| DENV3 | E | DQ118878 | DENV3 | E | EU448441 | DENV3 | E | EU617038 | DENV3 | E | AY676393 |
| DENV3 | E | AY676363 | DENV3 | E | AY656671 | DENV3 | E | EU617025 | DENV3 | E | DQ518666 |
| DENV3 | E | EU448446 | DENV3 | E | AY676355 | DENV3 | E | FJ389906 | DENV3 | E | FJ606692 |
| DENV3 | E | FJ189464 | DENV3 | E | DQ341205 | DENV3 | E | FJ606701 | DENV3 | E | AY338492 |
| DENV3 | E | FJ189455 | DENV3 | E | EU117353 | DENV3 | E | FJ189458 | DENV3 | E | AY145726 |
| DENV3 | E | AY146764 | DENV3 | E | AY145728 | DENV3 | E | FJ204475 | DENV3 | E | DQ518659 |
| DENV3 | E | DQ518654 | DENV3 | E | DQ118865 | DENV3 | E | EU117355 | DENV3 | E | DQ118877 |
| DENV3 | E | AY676384 | DENV3 | E | FJ606711 | DENV3 | E | EU182242 | DENV3 | E | AY676416 |
| DENV3 | E | DQ118871 | DENV3 | E | AY676361 | DENV3 | E | EU570161 | DENV3 | E | EU117357 |
| DENV3 | E | AB219137 | DENV3 | E | DQ518676 | DENV3 | E | AB111080 | DENV3 | E | FJ189462 |
| DENV3 | E | EU448443 | DENV3 | E | AB111085 | DENV3 | E | AY676395 | DENV3 | E | GU721067 |
| DENV3 | E | EU045316 | DENV3 | E | AY676397 | DENV3 | E | EU182244 | DENV3 | E | DQ118869 |

FIG. 68-26

| Virus Protein | Accession No. | Virus Protein | Accession No. | Virus Protein | Accession No. | Virus Protein | Accession No. |
|---|---|---|---|---|---|---|---|
| DENV3 E | FJ189460 | DENV3 E | DQ518665 | DENV3 E | AY702033 | DENV3 E | AY676376 |
| DENV3 E | EU617019 | DENV3 E | AY676404 | DENV3 E | AY146776 | DENV3 E | FJ389908 |
| DENV3 E | AY676399 | DENV3 E | AY146763 | DENV3 E | EU045317 | DENV3 E | DQ518667 |
| DENV3 E | AY145720 | DENV3 E | EU448445 | DENV3 E | DQ453981 | DENV3 E | DQ341208 |
| DENV3 E | FJ189466 | DENV3 E | FJ606712 | DENV3 E | FJ189465 | DENV3 E | FJ606710 |
| DENV3 E | AY146778 | DENV3 E | EU448439 | DENV3 E | AY145727 | DENV3 E | DQ341207 |
| DENV3 E | DQ341202 | DENV3 E | AY676354 | DENV3 E | EU448444 | DENV3 E | FJ189459 |
| DENV3 E | AF147459 | DENV3 E | DQ341204 | DENV3 E | EU117370 | DENV3 E | EU617037 |
| DENV3 E | EU617020 | DENV3 E | FJ189463 | DENV3 E | AY146767 | DENV3 E | AF147460 |
| DENV3 E | DQ341209 | DENV3 E | AY145712 | DENV3 E | FJ189454 | DENV3 E | AY702032 |
| DENV3 E | AB111082 | DENV3 E | FJ189452 | DENV3 E | DQ118864 | DENV3 E | FJ606700 |
| DENV3 E | DQ453974 | DENV3 E | FJ389911 | DENV3 E | DQ341206 | DENV3 E | AY676413 |
| DENV3 E | AY676417 | DENV3 E | AY145729 | DENV3 E | AY676370 | DENV3 E | AY676396 |
| DENV3 E | AB111084 | DENV3 E | AY676358 | DENV3 E | AY676356 | DENV3 E | EU617032 |
| DENV3 E | AB219138 | DENV3 E | DQ118872 | DENV3 E | DQ453969 | DENV3 E | AY145721 |
| DENV3 E | EU117364 | DENV3 E | AY676362 | DENV3 E | EU182243 | DENV3 E | AY338493 |
| DENV3 E | AY676403 | DENV3 E | DQ118890 | DENV3 E | AY676360 | DENV3 E | AY676398 |
| DENV3 E | AY676369 | DENV3 E | EU617023 | DENV3 E | AY676415 | DENV3 E | EU448437 |
| DENV3 E | AY676380 | DENV3 E | EU045315 | DENV3 E | AY676373 | DENV3 E | AY676367 |
| DENV3 E | DQ453970 | DENV3 E | DQ518677 | DENV3 E | AY676418 | DENV3 E | DQ341203 |
| DENV3 E | AY146772 | DENV3 E | AY656669 | DENV3 E | AY676383 | DENV3 E | AY656674 |
| DENV3 E | DQ118875 | DENV3 E | AY676385 | DENV3 E | EU117368 | DENV3 E | EU617035 |
| DENV3 E | EU478409 | DENV3 E | AY676406 | DENV3 E | EU448435 | DENV3 E | DQ453973 |
| DENV3 E | AY676378 | DENV3 E | EU182239 | DENV3 E | AB219133 | DENV3 E | AB219132 |
| DENV3 E | AY676365 | DENV3 E | AY146771 | DENV3 E | AB219134 | DENV3 E | FJ189453 |
| DENV3 E | DQ453968 | DENV3 E | EU045323 | DENV3 E | FJ189467 | DENV3 E | FJ389910 |
| DENV3 E | DQ118887 | DENV3 E | EU617027 | DENV3 E | AY146775 | DENV3 E | AB111083 |
| DENV3 E | FJ606694 | DENV3 E | AY145718 | DENV3 E | EU117369 | DENV3 E | EU117367 |
| DENV3 E | EU182245 | DENV3 E | FJ389909 | DENV3 E | AY146766 | DENV3 E | EU448432 |
| DENV3 E | AF533079 | DENV3 E | AY145722 | DENV3 E | DQ118868 | DENV3 E | AY676402 |
| DENV3 E | AY145725 | DENV3 E | AY145723 | DENV3 E | AY676400 | DENV3 E | DQ518656 |
| DENV3 E | EU617033 | DENV3 E | FJ189469 | DENV3 E | AY676357 | DENV3 E | AY676381 |
| DENV3 E | EU448434 | DENV3 E | AY146762 | DENV3 E | DQ518663 | DENV3 E | EU617030 |
| DENV3 E | DQ518655 | DENV3 E | FJ389915 | DENV3 E | AY145715 | DENV3 E | AY676386 |
| DENV3 E | EU617021 | DENV3 E | FM986663 | DENV3 E | AY145730 | DENV3 E | AY146769 |
| DENV3 E | DQ518670 | DENV3 E | EU045324 | DENV3 E | AY676388 | DENV3 E | AY146765 |
| DENV3 E | FJ389913 | DENV3 E | FJ606707 | DENV3 E | DQ453975 | DENV3 E | DQ518674 |
| DENV3 E | EU117359 | DENV3 E | DQ518679 | DENV3 E | AY656670 | DENV3 E | AY676374 |
| DENV3 E | AY676391 | DENV3 E | DQ118889 | DENV3 E | DQ518661 | DENV3 E | EU045321 |
| DENV3 E | AF147458 | DENV3 E | AY146761 | DENV3 E | FJ204476 | DENV3 E | DQ518672 |
| DENV3 E | AY676411 | DENV3 E | FJ606705 | DENV3 E | AY676368 | DENV3 E | FJ189450 |
| DENV3 E | AY676420 | DENV3 E | FJ606696 | DENV3 E | EU182241 | DENV3 E | AY146773 |
| DENV3 E | FJ606698 | DENV3 E | AY145719 | DENV3 E | DQ118885 | DENV3 E | FJ606693 |
| DENV3 E | AY656672 | DENV3 E | EU617031 | DENV3 E | FJ189449 | DENV3 E | AM746229 |
| DENV3 E | AY135419 | DENV3 E | EU117362 | DENV3 E | EU448442 | DENV3 E | AB111081 |
| DENV3 E | FJ606709 | DENV3 E | FJ189457 | DENV3 E | EU117360 | DENV3 E | EU570160 |
| DENV3 E | DQ453978 | DENV3 E | DQ518669 | DENV3 E | AM746231 | DENV3 E | AY676394 |
| DENV3 E | DQ118883 | DENV3 E | DQ453972 | DENV3 E | AY676408 | DENV3 E | DQ118879 |

FIG. 68-27

| Virus Protein | Accession No. | Virus Protein | Accession No. | Virus Protein | Accession No. | Virus Protein | Accession No. |
|---|---|---|---|---|---|---|---|
| DENV3 E | AY676421 | DENV3 E | AY656673 | DENV3 E | DQ518668 | DENV3 E | DQ518660 |
| DENV3 E | FJ606702 | DENV3 E | FJ606695 | DENV3 E | DQ118891 | DENV3 E | AY676407 |
| DENV3 E | AY145714 | DENV3 E | AY676392 | DENV3 E | EU045319 | DENV3 E | DQ118882 |
| DENV3 E | DQ118873 | DENV3 E | AY676389 | DENV3 E | DQ518662 | DENV3 E | EU045314 |
| DENV3 E | DQ518658 | DENV3 E | EU045318 | DENV3 E | DQ518673 | DENV3 E | AY676410 |
| DENV3 E | GU721066 | DENV3 E | EU617028 | DENV3 E | AY702031 | DENV3 E | AY676377 |
| DENV3 E | EU117354 | DENV3 E | DQ518664 | DENV3 E | EU448440 | DENV3 E | AM746230 |
| DENV3 E | FJ189461 | DENV3 E | AY676371 | DENV3 E | AY146777 | DENV3 E | DQ518671 |
| DENV3 E | DQ118878 | DENV3 E | EU448441 | DENV3 E | EU617038 | DENV3 E | AY676393 |
| DENV3 E | AY676363 | DENV3 E | AY656671 | DENV3 E | EU617025 | DENV3 E | DQ518666 |
| DENV3 E | EU448446 | DENV3 E | AY676355 | DENV3 E | FJ389906 | DENV3 E | FJ606692 |
| DENV3 E | FJ189464 | DENV3 E | DQ341205 | DENV3 E | FJ606701 | DENV3 E | AY338492 |
| DENV3 E | FJ189455 | DENV3 E | EU117353 | DENV3 E | FJ189458 | DENV3 E | AY145726 |
| DENV3 E | AY146764 | DENV3 E | AY145728 | DENV3 E | FJ204475 | DENV3 E | DQ518659 |
| DENV3 E | DQ518654 | DENV3 E | DQ118865 | DENV3 E | EU117355 | DENV3 E | DQ118877 |
| DENV3 E | AY676384 | DENV3 E | FJ606711 | DENV3 E | EU182242 | DENV3 E | AY676416 |
| DENV3 E | DQ118871 | DENV3 E | AY676361 | DENV3 E | EU570161 | DENV3 E | EU117357 |
| DENV3 E | AB219137 | DENV3 E | DQ518676 | DENV3 E | AB111080 | DENV3 E | FJ189462 |
| DENV3 E | EU448443 | DENV3 E | AB111085 | DENV3 E | AY676395 | DENV3 E | GU721067 |
| DENV3 E | EU045316 | DENV3 E | AY676397 | DENV3 E | EU182244 | DENV3 E | DQ118869 |
| DENV3 E | AY676364 | DENV3 E | EU617022 | DENV3 E | DQ118874 | DENV3 E | FJ189460 |
| DENV3 E | EU117365 | DENV3 E | AB219139 | DENV3 E | AY676414 | DENV3 E | EU617019 |
| DENV3 E | DQ118870 | DENV3 E | EU045322 | DENV3 E | AY676382 | DENV3 E | AY676399 |
| DENV3 E | AB219130 | DENV3 E | AY145717 | DENV3 E | AY676366 | DENV3 E | AY145720 |
| DENV3 E | AY676359 | DENV3 E | AY676379 | DENV3 E | EU617029 | DENV3 E | FJ189466 |
| DENV3 E | DQ518678 | DENV3 E | AY676390 | DENV3 E | FM986662 | DENV3 E | AY146778 |
| DENV3 E | DQ118881 | DENV3 E | EU448433 | DENV3 E | AB219131 | DENV3 E | DQ341202 |
| DENV3 E | EU182246 | DENV3 E | AY145724 | DENV3 E | AY676419 | DENV3 E | AF147459 |
| DENV3 E | EU117356 | DENV3 E | EU117358 | DENV3 E | DQ453980 | DENV3 E | EU617020 |
| DENV3 E | AY145713 | DENV3 E | DQ118886 | DENV3 E | EU117366 | DENV3 E | DQ341209 |
| DENV3 E | AY676405 | DENV3 E | EU617034 | DENV3 E | EU448436 | DENV3 E | AB111082 |
| DENV3 E | EU617026 | DENV3 E | EU617024 | DENV3 E | AY676401 | DENV3 E | DQ453974 |
| DENV3 E | DQ118884 | DENV3 E | AY702030 | DENV3 E | DQ118867 | DENV3 E | AY676417 |
| DENV3 E | AM746232 | DENV3 E | FJ389914 | DENV3 E | DQ118880 | DENV3 E | AB111084 |
| DENV3 E | AM746228 | DENV3 E | EU117361 | DENV3 E | AY146768 | DENV3 E | AB219138 |
| DENV3 E | EU617036 | DENV3 E | FJ606697 | DENV3 E | DQ118866 | DENV3 E | EU117364 |
| DENV3 E | DQ118876 | DENV3 E | AY146770 | DENV3 E | AY676375 | DENV3 E | AY676403 |
| DENV3 E | FJ389912 | DENV3 E | AY676409 | DENV3 E | FJ189468 | DENV3 E | AY676369 |
| DENV3 E | DQ453979 | DENV3 E | DQ453977 | DENV3 E | EU045325 | DENV3 E | AY676380 |
| DENV3 E | FJ606699 | DENV3 E | FJ389907 | DENV3 E | FJ389916 | DENV3 E | DQ453970 |
| DENV3 E | EU117363 | DENV3 E | FJ606706 | DENV3 E | FJ189456 | DENV3 E | AY146772 |
| DENV3 E | DQ118888 | DENV3 E | FJ606708 | DENV3 E | AY676372 | DENV3 E | DQ118875 |
| DENV3 E | FJ189451 | DENV3 E | AY338494 | DENV3 E | DQ518675 | DENV3 E | EU478409 |
| DENV3 E | AY676412 | DENV3 E | GU721065 | DENV3 E | AY146774 | DENV3 E | AY676378 |
| DENV3 E | GU721068 | DENV3 E | EU448438 | DENV3 E | EU182240 | DENV3 E | AY676365 |
| DENV3 E | AF147457 | DENV3 E | AY145716 | DENV3 E | EU045320 | DENV3 E | DQ453968 |
| DENV3 E | DQ453971 | DENV3 E | DQ453976 | DENV3 E | AY676387 | DENV3 E | DQ118887 |
| DENV3 E | GU721069 | DENV3 E | EU448447 | DENV3 E | DQ518657 | DENV3 E | FJ606694 |

FIG. 68-28

| Virus Protein | Accession No. | Virus Protein | Accession No. | Virus Protein | Accession No. | Virus Protein | Accession No. |
|---|---|---|---|---|---|---|---|
| DENV3 E | EU182245 | DENV3 E | FJ389909 | DENV3 E | AY146766 | DENV3 E | EU448432 |
| DENV3 E | AF533079 | DENV3 E | AY145722 | DENV3 E | DQ118868 | DENV3 E | AY676402 |
| DENV3 E | AY145725 | DENV3 E | AY145723 | DENV3 E | AY676400 | DENV3 E | DQ518656 |
| DENV3 E | EU617033 | DENV3 E | FJ189469 | DENV3 E | AY676357 | DENV3 E | AY676381 |
| DENV3 E | EU448434 | DENV3 E | AY146762 | DENV3 E | DQ518663 | DENV3 E | EU617030 |
| DENV3 E | DQ518655 | DENV3 E | FJ389915 | DENV3 E | AY145715 | DENV3 E | AY676386 |
| DENV3 E | EU617021 | DENV3 E | FM986663 | DENV3 E | AY145730 | DENV3 E | AY146769 |
| DENV3 E | DQ518670 | DENV3 E | EU045324 | DENV3 E | AY676388 | DENV3 E | AY146765 |
| DENV3 E | FJ389913 | DENV3 E | FJ606707 | DENV3 E | DQ453975 | DENV3 E | DQ518674 |
| DENV3 E | EU117359 | DENV3 E | DQ518679 | DENV3 E | AY656670 | DENV3 E | AY676374 |
| DENV3 E | AY676391 | DENV3 E | DQ118889 | DENV3 E | DQ518661 | DENV3 E | EU045321 |
| DENV3 E | AF147458 | DENV3 E | AY146761 | DENV3 E | FJ204476 | DENV3 E | DQ518672 |
| DENV3 E | AY676411 | DENV3 E | FJ606705 | DENV3 E | AY676368 | DENV3 E | FJ189450 |
| DENV3 E | AY676420 | DENV3 E | FJ606696 | DENV3 E | EU182241 | DENV3 E | AY146773 |
| DENV3 E | FJ606698 | DENV3 E | AY145719 | DENV3 E | DQ118885 | DENV3 E | FJ606693 |
| DENV3 E | AY656672 | DENV3 E | EU617031 | DENV3 E | FJ189449 | DENV3 E | AM746229 |
| DENV3 E | AY135419 | DENV3 E | EU117362 | DENV3 E | EU448442 | DENV3 E | AB111081 |
| DENV3 E | FJ606709 | DENV3 E | FJ189457 | DENV3 E | EU117360 | DENV3 E | EU570160 |
| DENV3 E | DQ453978 | DENV3 E | DQ518669 | DENV3 E | AM746231 | DENV3 E | AY676394 |
| DENV3 E | DQ118883 | DENV3 E | DQ453972 | DENV3 E | AY676408 | DENV3 E | DQ118879 |
| DENV3 E | DQ518665 | DENV3 E | AY702033 | DENV3 E | AY676376 | DENV3 E | AY676421 |
| DENV3 E | AY676404 | DENV3 E | AY146776 | DENV3 E | FJ389908 | DENV3 E | FJ606702 |
| DENV3 E | AY146763 | DENV3 E | EU045317 | DENV3 E | DQ518667 | DENV3 E | AY145714 |
| DENV3 E | EU448445 | DENV3 E | DQ453981 | DENV3 E | DQ341208 | DENV3 E | DQ118873 |
| DENV3 E | FJ606712 | DENV3 E | FJ189465 | DENV3 E | FJ606710 | DENV3 E | DQ518658 |
| DENV3 E | EU448439 | DENV3 E | AY145727 | DENV3 E | DQ341207 | DENV3 E | GU721066 |
| DENV3 E | AY676354 | DENV3 E | EU448444 | DENV3 E | FJ189459 | DENV3 E | EU117354 |
| DENV3 E | DQ341204 | DENV3 E | EU117370 | DENV3 E | EU617037 | DENV3 E | FJ189461 |
| DENV3 E | FJ189463 | DENV3 E | AY146767 | DENV3 E | AF147460 | DENV3 E | DQ118878 |
| DENV3 E | AY145712 | DENV3 E | FJ189454 | DENV3 E | AY702032 | DENV3 E | AY676363 |
| DENV3 E | FJ189452 | DENV3 E | DQ118864 | DENV3 E | FJ606700 | DENV3 E | EU448446 |
| DENV3 E | FJ389911 | DENV3 E | DQ341206 | DENV3 E | AY676413 | DENV3 E | FJ189464 |
| DENV3 E | AY145729 | DENV3 E | AY676370 | DENV3 E | AY676396 | DENV3 E | FJ189455 |
| DENV3 E | AY676358 | DENV3 E | AY676356 | DENV3 E | EU617032 | DENV3 E | AY146764 |
| DENV3 E | DQ118872 | DENV3 E | DQ453969 | DENV3 E | AY145721 | DENV3 E | DQ518654 |
| DENV3 E | AY676362 | DENV3 E | EU182243 | DENV3 E | AY338493 | DENV3 E | AY676384 |
| DENV3 E | DQ118890 | DENV3 E | AY676360 | DENV3 E | AY676398 | DENV3 E | DQ118871 |
| DENV3 E | EU617023 | DENV3 E | AY676415 | DENV3 E | EU448437 | DENV3 E | AB219137 |
| DENV3 E | EU045315 | DENV3 E | AY676373 | DENV3 E | AY676367 | DENV3 E | EU448443 |
| DENV3 E | DQ518677 | DENV3 E | AY676418 | DENV3 E | DQ341203 | DENV3 E | EU045316 |
| DENV3 E | AY656669 | DENV3 E | AY676383 | DENV3 E | AY656674 | DENV3 E | AY676364 |
| DENV3 E | AY676385 | DENV3 E | EU117368 | DENV3 E | EU617035 | DENV3 E | EU117365 |
| DENV3 E | AY676406 | DENV3 E | EU448435 | DENV3 E | DQ453973 | DENV3 E | DQ118870 |
| DENV3 E | EU182239 | DENV3 E | AB219133 | DENV3 E | AB219132 | DENV3 E | AB219130 |
| DENV3 E | AY146771 | DENV3 E | AB219134 | DENV3 E | FJ189453 | DENV3 E | AY676359 |
| DENV3 E | EU045323 | DENV3 E | FJ189467 | DENV3 E | FJ389910 | DENV3 E | DQ518678 |
| DENV3 E | EU617027 | DENV3 E | AY146775 | DENV3 E | AB111083 | DENV3 E | DQ118881 |
| DENV3 E | AY145718 | DENV3 E | EU117369 | DENV3 E | EU117367 | DENV3 E | EU182246 |

FIG. 68-29

| Virus Protein | Accession No. | Virus Protein | Accession No. | Virus Protein | Accession No. | Virus Protein | Accession No. |
|---|---|---|---|---|---|---|---|
| DENV3 E | EU117356 | DENV3 E | EU117358 | DENV3 E | DQ453980 | DENV3 E | EU617020 |
| DENV3 E | AY145713 | DENV3 E | DQ118886 | DENV3 E | EU117366 | DENV3 E | DQ341209 |
| DENV3 E | AY676405 | DENV3 E | EU617034 | DENV3 E | EU448436 | DENV3 E | AB111082 |
| DENV3 E | EU617026 | DENV3 E | EU617024 | DENV3 E | AY676401 | DENV3 E | DQ453974 |
| DENV3 E | DQ118884 | DENV3 E | AY702030 | DENV3 E | DQ118867 | DENV3 E | AY676417 |
| DENV3 E | AM746232 | DENV3 E | FJ389914 | DENV3 E | DQ118880 | DENV3 E | AB111084 |
| DENV3 E | AM746228 | DENV3 E | EU117361 | DENV3 E | AY146768 | DENV3 E | AB219138 |
| DENV3 E | EU617036 | DENV3 E | FJ606697 | DENV3 E | DQ118866 | DENV3 E | EU117364 |
| DENV3 E | DQ118876 | DENV3 E | AY146770 | DENV3 E | AY676375 | DENV3 E | AY676403 |
| DENV3 E | FJ389912 | DENV3 E | AY676409 | DENV3 E | FJ189468 | DENV3 E | AY676369 |
| DENV3 E | DQ453979 | DENV3 E | DQ453977 | DENV3 E | EU045325 | DENV3 E | AY676380 |
| DENV3 E | FJ606699 | DENV3 E | FJ389907 | DENV3 E | FJ389916 | DENV3 E | DQ453970 |
| DENV3 E | EU117363 | DENV3 E | FJ606706 | DENV3 E | FJ189456 | DENV3 E | AY146772 |
| DENV3 E | DQ118888 | DENV3 E | FJ606708 | DENV3 E | AY676372 | DENV3 E | DQ118875 |
| DENV3 E | FJ189451 | DENV3 E | AY338494 | DENV3 E | DQ518675 | DENV3 E | EU478409 |
| DENV3 E | AY676412 | DENV3 E | GU721065 | DENV3 E | AY146774 | DENV3 E | AY676378 |
| DENV3 E | GU721068 | DENV3 E | EU448438 | DENV3 E | EU182240 | DENV3 E | AY676365 |
| DENV3 E | AF147457 | DENV3 E | AY145716 | DENV3 E | EU045320 | DENV3 E | DQ453968 |
| DENV3 E | DQ453971 | DENV3 E | DQ453976 | DENV3 E | AY676387 | DENV3 E | DQ118887 |
| DENV3 E | GU721069 | DENV3 E | EU448447 | DENV3 E | DQ518657 | DENV3 E | FJ606694 |
| DENV3 E | AY656673 | DENV3 E | DQ518668 | DENV3 E | DQ518660 | DENV3 E | EU182245 |
| DENV3 E | FJ606695 | DENV3 E | DQ118891 | DENV3 E | AY676407 | DENV3 E | AF533079 |
| DENV3 E | AY676392 | DENV3 E | EU045319 | DENV3 E | DQ118882 | DENV3 E | AY145725 |
| DENV3 E | AY676389 | DENV3 E | DQ518662 | DENV3 E | EU045314 | DENV3 E | EU617033 |
| DENV3 E | EU045318 | DENV3 E | DQ518673 | DENV3 E | AY676410 | DENV3 E | EU448434 |
| DENV3 E | EU617028 | DENV3 E | AY702031 | DENV3 E | AY676377 | DENV3 E | DQ518655 |
| DENV3 E | DQ518664 | DENV3 E | EU448440 | DENV3 E | AM746230 | DENV3 E | EU617021 |
| DENV3 E | AY676371 | DENV3 E | AY146777 | DENV3 E | DQ518671 | DENV3 E | DQ518670 |
| DENV3 E | EU448441 | DENV3 E | EU617038 | DENV3 E | AY676393 | DENV3 E | FJ389913 |
| DENV3 E | AY656671 | DENV3 E | EU617025 | DENV3 E | DQ518666 | DENV3 E | EU117359 |
| DENV3 E | AY676355 | DENV3 E | FJ389906 | DENV3 E | FJ606692 | DENV3 E | AY676391 |
| DENV3 E | DQ341205 | DENV3 E | FJ606701 | DENV3 E | AY338492 | DENV3 E | AF147458 |
| DENV3 E | EU117353 | DENV3 E | FJ189458 | DENV3 E | AY145726 | DENV3 E | AY676411 |
| DENV3 E | AY145728 | DENV3 E | FJ204475 | DENV3 E | DQ518659 | DENV3 E | AY676420 |
| DENV3 E | DQ118865 | DENV3 E | EU117355 | DENV3 E | DQ118877 | DENV3 E | FJ606698 |
| DENV3 E | FJ606711 | DENV3 E | EU182242 | DENV3 E | AY676416 | DENV3 E | AY656672 |
| DENV3 E | AY676361 | DENV3 E | EU570161 | DENV3 E | EU117357 | DENV3 E | AY135419 |
| DENV3 E | DQ518676 | DENV3 E | AB111080 | DENV3 E | FJ189462 | DENV3 E | FJ606709 |
| DENV3 E | AB111085 | DENV3 E | AY676395 | DENV3 E | GU721067 | DENV3 E | DQ453978 |
| DENV3 E | AY676397 | DENV3 E | EU182244 | DENV3 E | DQ118869 | DENV3 E | DQ118883 |
| DENV3 E | EU617022 | DENV3 E | DQ118874 | DENV3 E | FJ189460 | DENV3 E | DQ518665 |
| DENV3 E | AB219139 | DENV3 E | AY676414 | DENV3 E | EU617019 | DENV3 E | AY676404 |
| DENV3 E | EU045322 | DENV3 E | AY676382 | DENV3 E | AY676399 | DENV3 E | AY146763 |
| DENV3 E | AY145717 | DENV3 E | AY676366 | DENV3 E | AY145720 | DENV3 E | EU448445 |
| DENV3 E | AY676379 | DENV3 E | EU617029 | DENV3 E | FJ189466 | DENV3 E | FJ606712 |
| DENV3 E | AY676390 | DENV3 E | FM986662 | DENV3 E | AY146778 | DENV3 E | EU448439 |
| DENV3 E | EU448433 | DENV3 E | AB219131 | DENV3 E | DQ341202 | DENV3 E | AY676354 |
| DENV3 E | AY145724 | DENV3 E | AY676419 | DENV3 E | AF147459 | DENV3 E | DQ341204 |

FIG. 68-30

| Virus Protein | Accession No. | Virus Protein | Accession No. | Virus Protein | Accession No. | Virus Protein | Accession No. |
|---|---|---|---|---|---|---|---|
| DENV3 E | FJ189463 | DENV3 E | AY146767 | DENV3 E | AF147460 | DENV3 E | DQ118878 |
| DENV3 E | AY145712 | DENV3 E | FJ189454 | DENV3 E | AY702032 | DENV3 E | AY676363 |
| DENV3 E | FJ189452 | DENV3 E | DQ118864 | DENV3 E | FJ606700 | DENV3 E | EU448446 |
| DENV3 E | FJ389911 | DENV3 E | DQ341206 | DENV3 E | AY676413 | DENV3 E | FJ189464 |
| DENV3 E | AY145729 | DENV3 E | AY676370 | DENV3 E | AY676396 | DENV3 E | FJ189455 |
| DENV3 E | AY676358 | DENV3 E | AY676356 | DENV3 E | EU617032 | DENV3 E | AY146764 |
| DENV3 E | DQ118872 | DENV3 E | DQ453969 | DENV3 E | AY145721 | DENV3 E | DQ518654 |
| DENV3 E | AY676362 | DENV3 E | EU182243 | DENV3 E | AY338493 | DENV3 E | AY676384 |
| DENV3 E | DQ118890 | DENV3 E | AY676360 | DENV3 E | AY676398 | DENV3 E | DQ118871 |
| DENV3 E | EU617023 | DENV3 E | AY676415 | DENV3 E | EU448437 | DENV3 E | AB219137 |
| DENV3 E | EU045315 | DENV3 E | AY676373 | DENV3 E | AY676367 | DENV3 E | EU448443 |
| DENV3 E | DQ518677 | DENV3 E | AY676418 | DENV3 E | DQ341203 | DENV3 E | EU045316 |
| DENV3 E | AY656669 | DENV3 E | AY676383 | DENV3 E | AY656674 | DENV3 E | AY676364 |
| DENV3 E | AY676385 | DENV3 E | EU117368 | DENV3 E | EU617035 | DENV3 E | EU117365 |
| DENV3 E | AY676406 | DENV3 E | EU448435 | DENV3 E | DQ453973 | DENV3 E | DQ118870 |
| DENV3 E | EU182239 | DENV3 E | AB219133 | DENV3 E | AB219132 | DENV3 E | AB219130 |
| DENV3 E | AY146771 | DENV3 E | AB219134 | DENV3 E | FJ189453 | DENV3 E | AY676359 |
| DENV3 E | EU045323 | DENV3 E | FJ189467 | DENV3 E | FJ389910 | DENV3 E | DQ518678 |
| DENV3 E | EU617027 | DENV3 E | AY146775 | DENV3 E | AB111083 | DENV3 E | DQ118881 |
| DENV3 E | AY145718 | DENV3 E | EU117369 | DENV3 E | EU117367 | DENV3 E | EU182246 |
| DENV3 E | FJ389909 | DENV3 E | AY146766 | DENV3 E | EU448432 | DENV3 E | EU117356 |
| DENV3 E | AY145722 | DENV3 E | DQ118868 | DENV3 E | AY676402 | DENV3 E | AY145713 |
| DENV3 E | AY145723 | DENV3 E | AY676400 | DENV3 E | DQ518656 | DENV3 E | AY676405 |
| DENV3 E | FJ189469 | DENV3 E | AY676357 | DENV3 E | AY676381 | DENV3 E | EU617026 |
| DENV3 E | AY146762 | DENV3 E | DQ518663 | DENV3 E | EU617030 | DENV3 E | DQ118884 |
| DENV3 E | FJ389915 | DENV3 E | AY145715 | DENV3 E | AY676386 | DENV3 E | AM746232 |
| DENV3 E | FM986663 | DENV3 E | AY145730 | DENV3 E | AY146769 | DENV3 E | AM746228 |
| DENV3 E | EU045324 | DENV3 E | AY676388 | DENV3 E | AY146765 | DENV3 E | EU617036 |
| DENV3 E | FJ606707 | DENV3 E | DQ453975 | DENV3 E | DQ518674 | DENV3 E | DQ118876 |
| DENV3 E | DQ518679 | DENV3 E | AY656670 | DENV3 E | AY676374 | DENV3 E | FJ389912 |
| DENV3 E | DQ118889 | DENV3 E | DQ518661 | DENV3 E | EU045321 | DENV3 E | DQ453979 |
| DENV3 E | AY146761 | DENV3 E | FJ204476 | DENV3 E | DQ518672 | DENV3 E | FJ606699 |
| DENV3 E | FJ606705 | DENV3 E | AY676368 | DENV3 E | FJ189450 | DENV3 E | EU117363 |
| DENV3 E | FJ606696 | DENV3 E | EU182241 | DENV3 E | AY146773 | DENV3 E | DQ118888 |
| DENV3 E | AY145719 | DENV3 E | DQ118885 | DENV3 E | FJ606693 | DENV3 E | FJ189451 |
| DENV3 E | EU617031 | DENV3 E | FJ189449 | DENV3 E | AM746229 | DENV3 E | AY676412 |
| DENV3 E | EU117362 | DENV3 E | EU448442 | DENV3 E | AB111081 | DENV3 E | GU721068 |
| DENV3 E | FJ189457 | DENV3 E | EU117360 | DENV3 E | EU570160 | DENV3 E | AF147457 |
| DENV3 E | DQ518669 | DENV3 E | AM746231 | DENV3 E | AY676394 | DENV3 E | DQ453971 |
| DENV3 E | DQ453972 | DENV3 E | AY676408 | DENV3 E | DQ118879 | DENV3 E | GU721069 |
| DENV3 E | AY702033 | DENV3 E | AY676376 | DENV3 E | AY676421 | DENV3 E | AY656673 |
| DENV3 E | AY146776 | DENV3 E | FJ389908 | DENV3 E | FJ606702 | DENV3 E | FJ606695 |
| DENV3 E | EU045317 | DENV3 E | DQ518667 | DENV3 E | AY145714 | DENV3 E | AY676392 |
| DENV3 E | DQ453981 | DENV3 E | DQ341208 | DENV3 E | DQ118873 | DENV3 E | AY676389 |
| DENV3 E | FJ189465 | DENV3 E | FJ606710 | DENV3 E | DQ518658 | DENV3 E | EU045318 |
| DENV3 E | AY145727 | DENV3 E | DQ341207 | DENV3 E | GU721066 | DENV3 E | EU617028 |
| DENV3 E | EU448444 | DENV3 E | FJ189459 | DENV3 E | EU117354 | DENV3 E | DQ518664 |
| DENV3 E | EU117370 | DENV3 E | EU617037 | DENV3 E | FJ189461 | DENV3 E | AY676371 |

FIG. 68-31

| Virus Protein | Accession No. | Virus Protein | Accession No. | Virus Protein | Accession No. | Virus Protein | Accession No. |
|---|---|---|---|---|---|---|---|
| DENV3 E | EU448441 | DENV3 E | EU617038 | DENV3 E | AY676393 | DENV3 E | FJ389913 |
| DENV3 E | AY656671 | DENV3 E | EU617025 | DENV3 E | DQ518666 | DENV3 E | EU117359 |
| DENV3 E | AY676355 | DENV3 E | FJ389906 | DENV3 E | FJ606692 | DENV3 E | AY676391 |
| DENV3 E | DQ341205 | DENV3 E | FJ606701 | DENV3 E | AY338492 | DENV3 E | AF147458 |
| DENV3 E | EU117353 | DENV3 E | FJ189458 | DENV3 E | AY145726 | DENV3 E | AY676411 |
| DENV3 E | AY145728 | DENV3 E | FJ204475 | DENV3 E | DQ518659 | DENV3 E | AY676420 |
| DENV3 E | DQ118865 | DENV3 E | EU117355 | DENV3 E | DQ118877 | DENV3 E | FJ606698 |
| DENV3 E | FJ606711 | DENV3 E | EU182242 | DENV3 E | AY676416 | DENV3 E | AY656672 |
| DENV3 E | AY676361 | DENV3 E | EU570161 | DENV3 E | EU117357 | DENV3 E | AY135419 |
| DENV3 E | DQ518676 | DENV3 E | AB111080 | DENV3 E | FJ189462 | DENV3 E | FJ606709 |
| DENV3 E | AB111085 | DENV3 E | AY676395 | DENV3 E | GU721067 | DENV3 E | DQ453978 |
| DENV3 E | AY676397 | DENV3 E | EU182244 | DENV3 E | DQ118869 | DENV3 E | DQ118883 |
| DENV3 E | EU617022 | DENV3 E | DQ118874 | DENV3 E | FJ189460 | DENV3 E | DQ518665 |
| DENV3 E | AB219139 | DENV3 E | AY676414 | DENV3 E | EU617019 | DENV3 E | AY676404 |
| DENV3 E | EU045322 | DENV3 E | AY676382 | DENV3 E | AY676399 | DENV3 E | AY146763 |
| DENV3 E | AY145717 | DENV3 E | AY676366 | DENV3 E | AY145720 | DENV3 E | EU448445 |
| DENV3 E | AY676379 | DENV3 E | EU617029 | DENV3 E | FJ189466 | DENV3 E | FJ606712 |
| DENV3 E | AY676390 | DENV3 E | FM986662 | DENV3 E | AY146778 | DENV3 E | EU448439 |
| DENV3 E | EU448433 | DENV3 E | AB219131 | DENV3 E | DQ341202 | DENV3 E | AY676354 |
| DENV3 E | AY145724 | DENV3 E | AY676419 | DENV3 E | AF147459 | DENV3 E | DQ341204 |
| DENV3 E | EU117358 | DENV3 E | DQ453980 | DENV3 E | EU617020 | DENV3 E | FJ189463 |
| DENV3 E | DQ118886 | DENV3 E | EU117366 | DENV3 E | DQ341209 | DENV3 E | AY145712 |
| DENV3 E | EU617034 | DENV3 E | EU448436 | DENV3 E | AB111082 | DENV3 E | FJ189452 |
| DENV3 E | EU617024 | DENV3 E | AY676401 | DENV3 E | DQ453974 | DENV3 E | FJ389911 |
| DENV3 E | AY702030 | DENV3 E | DQ118867 | DENV3 E | AY676417 | DENV3 E | AY145729 |
| DENV3 E | FJ389914 | DENV3 E | DQ118880 | DENV3 E | AB111084 | DENV3 E | AY676358 |
| DENV3 E | EU117361 | DENV3 E | AY146768 | DENV3 E | AB219138 | DENV3 E | DQ118872 |
| DENV3 E | FJ606697 | DENV3 E | DQ118866 | DENV3 E | EU117364 | DENV3 E | AY676362 |
| DENV3 E | AY146770 | DENV3 E | AY676375 | DENV3 E | AY676403 | DENV3 E | DQ118890 |
| DENV3 E | AY676409 | DENV3 E | FJ189468 | DENV3 E | AY676369 | DENV3 E | EU617023 |
| DENV3 E | DQ453977 | DENV3 E | EU045325 | DENV3 E | AY676380 | DENV3 E | EU045315 |
| DENV3 E | FJ389907 | DENV3 E | FJ389916 | DENV3 E | DQ453970 | DENV3 E | DQ518677 |
| DENV3 E | FJ606706 | DENV3 E | FJ189456 | DENV3 E | AY146772 | DENV3 E | AY656669 |
| DENV3 E | FJ606708 | DENV3 E | AY676372 | DENV3 E | DQ118875 | DENV3 E | AY676385 |
| DENV3 E | AY338494 | DENV3 E | DQ518675 | DENV3 E | EU478409 | DENV3 E | AY676406 |
| DENV3 E | GU721065 | DENV3 E | AY146774 | DENV3 E | AY676378 | DENV3 E | EU182239 |
| DENV3 E | EU448438 | DENV3 E | EU182240 | DENV3 E | AY676365 | DENV3 E | AY146771 |
| DENV3 E | AY145716 | DENV3 E | EU045320 | DENV3 E | DQ453968 | DENV3 E | EU045323 |
| DENV3 E | DQ453976 | DENV3 E | AY676387 | DENV3 E | DQ118887 | DENV3 E | EU617027 |
| DENV3 E | EU448447 | DENV3 E | DQ518657 | DENV3 E | FJ606694 | DENV3 E | AY145718 |
| DENV3 E | DQ518668 | DENV3 E | DQ518660 | DENV3 E | EU182245 | DENV3 E | FJ389909 |
| DENV3 E | DQ118891 | DENV3 E | AY676407 | DENV3 E | AF533079 | DENV3 E | AY145722 |
| DENV3 E | EU045319 | DENV3 E | DQ118882 | DENV3 E | AY145725 | DENV3 E | AY145723 |
| DENV3 E | DQ518662 | DENV3 E | EU045314 | DENV3 E | EU617033 | DENV3 E | FJ189469 |
| DENV3 E | DQ518673 | DENV3 E | AY676410 | DENV3 E | EU448434 | DENV3 E | AY146762 |
| DENV3 E | AY702031 | DENV3 E | AY676377 | DENV3 E | DQ518655 | DENV3 E | FJ389915 |
| DENV3 E | EU448440 | DENV3 E | AM746230 | DENV3 E | EU617021 | DENV3 E | FM986663 |
| DENV3 E | AY146777 | DENV3 E | DQ518671 | DENV3 E | DQ518670 | DENV3 E | EU045324 |

FIG. 68-32

| Virus | Protein | Accession No. | Virus | Protein | Accession No. | Virus | Protein | Accession No. | Virus | Protein | Accession No. |
|---|---|---|---|---|---|---|---|---|---|---|---|
| DENV3 | E | FJ606707 | DENV3 | E | DQ453975 | DENV3 | E | DQ518674 | DENV3 | E | DQ118876 |
| DENV3 | E | DQ518679 | DENV3 | E | AY656670 | DENV3 | E | AY676374 | DENV3 | E | FJ389912 |
| DENV3 | E | DQ118889 | DENV3 | E | DQ518661 | DENV3 | E | EU045321 | DENV3 | E | DQ453979 |
| DENV3 | E | AY146761 | DENV3 | E | FJ204476 | DENV3 | E | DQ518672 | DENV3 | E | FJ606699 |
| DENV3 | E | FJ606705 | DENV3 | E | AY676368 | DENV3 | E | FJ189450 | DENV3 | E | EU117363 |
| DENV3 | E | FJ606696 | DENV3 | E | EU182241 | DENV3 | E | AY146773 | DENV3 | E | DQ118888 |
| DENV3 | E | AY145719 | DENV3 | E | DQ118885 | DENV3 | E | FJ606693 | DENV3 | E | FJ189451 |
| DENV3 | E | EU617031 | DENV3 | E | FJ189449 | DENV3 | E | AM746229 | DENV3 | E | AY676412 |
| DENV3 | E | EU117362 | DENV3 | E | EU448442 | DENV3 | E | AB111081 | DENV3 | E | GU721068 |
| DENV3 | E | FJ189457 | DENV3 | E | EU117360 | DENV3 | E | EU570160 | DENV3 | E | AF147457 |
| DENV3 | E | DQ518669 | DENV3 | E | AM746231 | DENV3 | E | AY676394 | DENV3 | E | DQ453971 |
| DENV3 | E | DQ453972 | DENV3 | E | AY676408 | DENV3 | E | DQ118879 | DENV3 | E | GU721069 |
| DENV3 | E | AY702033 | DENV3 | E | AY676376 | DENV3 | E | AY676421 | DENV3 | E | AY656673 |
| DENV3 | E | AY146776 | DENV3 | E | FJ389908 | DENV3 | E | FJ606702 | DENV3 | E | FJ606695 |
| DENV3 | E | EU045317 | DENV3 | E | DQ518667 | DENV3 | E | AY145714 | DENV3 | E | AY676392 |
| DENV3 | E | DQ453981 | DENV3 | E | DQ341208 | DENV3 | E | DQ118873 | DENV3 | E | AY676389 |
| DENV3 | E | FJ189465 | DENV3 | E | FJ606710 | DENV3 | E | DQ518658 | DENV3 | E | EU045318 |
| DENV3 | E | AY145727 | DENV3 | E | DQ341207 | DENV3 | E | GU721066 | DENV3 | E | EU617028 |
| DENV3 | E | EU448444 | DENV3 | E | FJ189459 | DENV3 | E | EU117354 | DENV3 | E | DQ518664 |
| DENV3 | E | EU117370 | DENV3 | E | EU617037 | DENV3 | E | FJ189461 | DENV3 | E | AY676371 |
| DENV3 | E | AY146767 | DENV3 | E | AF147460 | DENV3 | E | DQ118878 | DENV3 | E | EU448441 |
| DENV3 | E | FJ189454 | DENV3 | E | AY702032 | DENV3 | E | AY676363 | DENV3 | E | AY656671 |
| DENV3 | E | DQ118864 | DENV3 | E | FJ606700 | DENV3 | E | EU448446 | DENV3 | E | AY676355 |
| DENV3 | E | DQ341206 | DENV3 | E | AY676413 | DENV3 | E | FJ189464 | DENV3 | E | DQ341205 |
| DENV3 | E | AY676370 | DENV3 | E | AY676396 | DENV3 | E | FJ189455 | DENV3 | E | EU117353 |
| DENV3 | E | AY676356 | DENV3 | E | EU617032 | DENV3 | E | AY146764 | DENV3 | E | AY145728 |
| DENV3 | E | DQ453969 | DENV3 | E | AY145721 | DENV3 | E | DQ518654 | DENV3 | E | DQ118865 |
| DENV3 | E | EU182243 | DENV3 | E | AY338493 | DENV3 | E | AY676384 | DENV3 | E | FJ606711 |
| DENV3 | E | AY676360 | DENV3 | E | AY676398 | DENV3 | E | DQ118871 | DENV3 | E | AY676361 |
| DENV3 | E | AY676415 | DENV3 | E | EU448437 | DENV3 | E | AB219137 | DENV3 | E | DQ518676 |
| DENV3 | E | AY676373 | DENV3 | E | AY676367 | DENV3 | E | EU448443 | DENV3 | E | AB111085 |
| DENV3 | E | AY676418 | DENV3 | E | DQ341203 | DENV3 | E | EU045316 | DENV3 | E | AY676397 |
| DENV3 | E | AY676383 | DENV3 | E | AY656674 | DENV3 | E | AY676364 | DENV3 | E | EU617022 |
| DENV3 | E | EU117368 | DENV3 | E | EU617035 | DENV3 | E | EU117365 | DENV3 | E | AB219139 |
| DENV3 | E | EU448435 | DENV3 | E | DQ453973 | DENV3 | E | DQ118870 | DENV3 | E | EU045322 |
| DENV3 | E | AB219133 | DENV3 | E | AB219132 | DENV3 | E | AB219130 | DENV3 | E | AY145717 |
| DENV3 | E | AB219134 | DENV3 | E | FJ189453 | DENV3 | E | AY676359 | DENV3 | E | AY676379 |
| DENV3 | E | FJ189467 | DENV3 | E | FJ389910 | DENV3 | E | DQ518678 | DENV3 | E | AY676390 |
| DENV3 | E | AY146775 | DENV3 | E | AB111083 | DENV3 | E | DQ118881 | DENV3 | E | EU448433 |
| DENV3 | E | EU117369 | DENV3 | E | EU117367 | DENV3 | E | EU182246 | DENV3 | E | AY145724 |
| DENV3 | E | AY146766 | DENV3 | E | EU448432 | DENV3 | E | EU117356 | DENV3 | E | EU117358 |
| DENV3 | E | DQ118868 | DENV3 | E | AY676402 | DENV3 | E | AY145713 | DENV3 | E | DQ118886 |
| DENV3 | E | AY676400 | DENV3 | E | DQ518656 | DENV3 | E | AY676405 | DENV3 | E | EU617034 |
| DENV3 | E | AY676357 | DENV3 | E | AY676381 | DENV3 | E | EU617026 | DENV3 | E | EU617024 |
| DENV3 | E | DQ518663 | DENV3 | E | EU617030 | DENV3 | E | DQ118884 | DENV3 | E | AY702030 |
| DENV3 | E | AY145715 | DENV3 | E | AY676386 | DENV3 | E | AM746232 | DENV3 | E | FJ389914 |
| DENV3 | E | AY145730 | DENV3 | E | AY146769 | DENV3 | E | AM746228 | DENV3 | E | EU117361 |
| DENV3 | E | AY676388 | DENV3 | E | AY146765 | DENV3 | E | EU617036 | DENV3 | E | FJ606697 |

FIG. 68-33

| Virus Protein | Accession No. | Virus Protein | Accession No. | Virus Protein | Accession No. | Virus Protein | Accession No. |
|---|---|---|---|---|---|---|---|
| DENV3 E | AY146770 | DENV3 E | AY676375 | DENV3 E | AY676403 | DENV3 NS1 | GU131846 |
| DENV3 E | AY676409 | DENV3 E | FJ189468 | DENV3 E | AY676369 | DENV3 NS1 | FJ547078 |
| DENV3 E | DQ453977 | DENV3 E | EU045325 | DENV3 E | AY676380 | DENV3 NS1 | FJ898457 |
| DENV3 E | FJ389907 | DENV3 E | FJ389916 | DENV3 NS1 | FN429898 | DENV3 NS1 | FJ639795 |
| DENV3 E | FJ606706 | DENV3 E | FJ189456 | DENV3 NS1 | GQ868576 | DENV3 NS1 | FJ639757 |
| DENV3 E | FJ606708 | DENV3 E | AY676372 | DENV3 NS1 | EU596493 | DENV3 NS1 | EU569689 |
| DENV3 E | AY338494 | DENV3 E | DQ518675 | DENV3 NS1 | GQ868634 | DENV3 NS1 | DQ401691 |
| DENV3 E | GU721065 | DENV3 E | AY146774 | DENV3 NS1 | U93297 | DENV3 NS1 | FN429908 |
| DENV3 E | EU448438 | DENV3 E | EU182240 | DENV3 NS1 | AY912455 | DENV3 NS1 | EU482566 |
| DENV3 E | AY145716 | DENV3 E | EU045320 | DENV3 NS1 | AB214880 | DENV3 NS1 | EU687233 |
| DENV3 E | DQ453976 | DENV3 E | AY676387 | DENV3 NS1 | FJ639767 | DENV3 NS1 | AY496874 |
| DENV3 E | EU448447 | DENV3 E | DQ518657 | DENV3 NS1 | EF629373 | DENV3 NS1 | GU131862 |
| DENV3 E | DQ518668 | DENV3 E | DQ518660 | DENV3 NS1 | AY858041 | DENV3 NS1 | EU482614 |
| DENV3 E | DQ118891 | DENV3 E | AY676407 | DENV3 NS1 | AY744678 | DENV3 NS1 | GU131872 |
| DENV3 E | EU045319 | DENV3 E | DQ118882 | DENV3 NS1 | GQ199860 | DENV3 NS1 | FJ639770 |
| DENV3 E | DQ518662 | DENV3 E | EU045314 | DENV3 NS1 | FJ373302 | DENV3 NS1 | FJ810413 |
| DENV3 E | DQ518673 | DENV3 E | AY676410 | DENV3 NS1 | FJ390375 | DENV3 NS1 | GU131861 |
| DENV3 E | AY702031 | DENV3 E | AY676377 | DENV3 NS1 | FJ639801 | DENV3 NS1 | FJ182040 |
| DENV3 E | EU448440 | DENV3 E | AM746230 | DENV3 NS1 | DQ675522 | DENV3 NS1 | EU052793 |
| DENV3 E | AY146777 | DENV3 E | DQ518671 | DENV3 NS1 | FJ639771 | DENV3 NS1 | FJ882573 |
| DENV3 E | EU617038 | DENV3 E | AY676393 | DENV3 NS1 | EU781137 | DENV3 NS1 | EU529699 |
| DENV3 E | EU617025 | DENV3 E | DQ518666 | DENV3 NS1 | GU131844 | DENV3 NS1 | FJ744735 |
| DENV3 E | FJ389906 | DENV3 E | FJ606692 | DENV3 NS1 | FJ639747 | DENV3 NS1 | FJ024468 |
| DENV3 E | FJ606701 | DENV3 E | AY338492 | DENV3 NS1 | CS477305 | DENV3 NS1 | AY744685 |
| DENV3 E | FJ189458 | DENV3 E | AY145726 | DENV3 NS1 | FJ562099 | DENV3 NS1 | DQ675527 |
| DENV3 E | FJ204475 | DENV3 E | DQ518659 | DENV3 NS1 | FJ898455 | DENV3 NS1 | AY744682 |
| DENV3 E | EU117355 | DENV3 E | DQ118877 | DENV3 NS1 | FJ639817 | DENV3 NS1 | EU529683 |
| DENV3 E | EU182242 | DENV3 E | AY676416 | DENV3 NS1 | EU081185 | DENV3 NS1 | FJ639777 |
| DENV3 E | EU570161 | DENV3 E | EU117357 | DENV3 NS1 | FJ182037 | DENV3 NS1 | EU529692 |
| DENV3 E | AB111080 | DENV3 E | FJ189462 | DENV3 NS1 | EU482455 | DENV3 NS1 | FJ898476 |
| DENV3 E | AY676395 | DENV3 E | GU721067 | DENV3 NS1 | AY858046 | DENV3 NS1 | EU081211 |
| DENV3 E | EU182244 | DENV3 E | DQ118869 | DENV3 NS1 | M93130 | DENV3 NS1 | FJ547066 |
| DENV3 E | DQ118874 | DENV3 E | FJ189460 | DENV3 NS1 | FJ850052 | DENV3 NS1 | FJ882577 |
| DENV3 E | AY676414 | DENV3 E | EU617019 | DENV3 NS1 | EU660407 | DENV3 NS1 | FN429900 |
| DENV3 E | AY676382 | DENV3 E | AY676399 | DENV3 NS1 | FJ024465 | DENV3 NS1 | FJ639765 |
| DENV3 E | AY676366 | DENV3 E | AY145720 | DENV3 NS1 | AF046856 | DENV3 NS1 | EU052795 |
| DENV3 E | EU617029 | DENV3 E | FJ189466 | DENV3 NS1 | FJ461334 | DENV3 NS1 | EU726769 |
| DENV3 E | FM986662 | DENV3 E | AY146778 | DENV3 NS1 | FN429917 | DENV3 NS1 | EU052796 |
| DENV3 E | AB219131 | DENV3 E | DQ341202 | DENV3 NS1 | GQ868593 | DENV3 NS1 | GQ199888 |
| DENV3 E | AY676419 | DENV3 E | AF147459 | DENV3 NS1 | GU131866 | DENV3 NS1 | FJ639786 |
| DENV3 E | DQ453980 | DENV3 E | EU617020 | DENV3 NS1 | EU482559 | DENV3 NS1 | FJ478456 |
| DENV3 E | EU117366 | DENV3 E | DQ341209 | DENV3 NS1 | EU081201 | DENV3 NS1 | GQ868617 |
| DENV3 E | EU448436 | DENV3 E | AB111082 | DENV3 NS1 | FJ373304 | DENV3 NS1 | FJ898444 |
| DENV3 E | AY676401 | DENV3 E | DQ453974 | DENV3 NS1 | FN429915 | DENV3 NS1 | GU370052 |
| DENV3 E | DQ118867 | DENV3 E | AY676417 | DENV3 NS1 | EU529687 | DENV3 NS1 | EU660411 |
| DENV3 E | DQ118880 | DENV3 E | AB111084 | DENV3 NS1 | EU081208 | DENV3 NS1 | EU482453 |
| DENV3 E | AY146768 | DENV3 E | AB219138 | DENV3 NS1 | GU131951 | DENV3 NS1 | FJ182005 |
| DENV3 E | DQ118866 | DENV3 E | EU117364 | DENV3 NS1 | FJ898468 | DENV3 NS1 | AY912454 |

FIG. 68-34

| Virus Protein Accession No. | Virus Protein Accession No. | Virus Protein Accession No. | Virus Protein Accession No. |
|---|---|---|---|
| DENV3 NS1GQ868574 | DENV3 NS1AB189127 | DENV3 NS1FJ481174 | DENV3 NS1FJ639825 |
| DENV3 NS1GU131941 | DENV3 NS1FJ639720 | DENV3 NS1FJ432722 | DENV3 NS1GU131914 |
| DENV3 NS1EU529689 | DENV3 NS1FJ639729 | DENV3 NS1DQ675523 | DENV3 NS1FJ898472 |
| DENV3 NS1GU131954 | DENV3 NS1GU131868 | DENV3 NS1FJ547076 | DENV3 NS1FJ547074 |
| DENV3 NS1AY676352 | DENV3 NS1FJ639793 | DENV3 NS1FJ461337 | DENV3 NS1FJ898469 |
| DENV3 NS1AY099337 | DENV3 NS1GU363549 | DENV3 NS1FJ639769 | DENV3 NS1FJ744726 |
| DENV3 NS1FJ182015 | DENV3 NS1FJ850109 | DENV3 NS1GQ868629 | DENV3 NS1FJ639725 |
| DENV3 NS1FJ850049 | DENV3 NS1EU081218 | DENV3 NS1FN429905 | DENV3 NS1GU131851 |
| DENV3 NS1FJ639713 | DENV3 NS1FJ547081 | DENV3 NS1FJ898459 | DENV3 NS1EU482555 |
| DENV3 NS1U93295 | DENV3 NS1GU131912 | DENV3 NS1GQ868586 | DENV3 NS1GU131938 |
| DENV3 NS1CS479205 | DENV3 NS1AY923865 | DENV3 NS1EU081216 | DENV3 NS1EU726773 |
| DENV3 NS1GQ868577 | DENV3 NS1AY858045 | DENV3 NS1EU482452 | DENV3 NS1GQ868616 |
| DENV3 NS1EU081198 | DENV3 NS1FJ547084 | DENV3 NS1AY766104 | DENV3 NS1GQ199862 |
| DENV3 NS1GU189648 | DENV3 NS1FJ639774 | DENV3 NS1FJ898474 | DENV3 NS1GU131908 |
| DENV3 NS1EU660409 | DENV3 NS1GU131915 | DENV3 NS1FJ639724 | DENV3 NS1AY858039 |
| DENV3 NS1FJ373306 | DENV3 NS1FJ850056 | DENV3 NS1EU081222 | DENV3 NS1EU081214 |
| DENV3 NS1FJ898463 | DENV3 NS1FJ562107 | DENV3 NS1CS805345 | DENV3 NS1EF629366 |
| DENV3 NS1FJ410177 | DENV3 NS1FJ639759 | DENV3 NS1AY648961 | DENV3 NS1U93298 |
| DENV3 NS1DQ675530 | DENV3 NS1DQ675519 | DENV3 NS1FJ562102 | DENV3 NS1AY744680 |
| DENV3 NS1FJ744730 | DENV3 NS1FJ639715 | DENV3 NS1EU081193 | DENV3 NS1FJ639755 |
| DENV3 NS1EU081206 | DENV3 NS1FJ024466 | DENV3 NS1FJ639754 | DENV3 NS1DQ675533 |
| DENV3 NS1EU529691 | DENV3 NS1FJ898447 | DENV3 NS1GU131865 | DENV3 NS1U93299 |
| DENV3 NS1EU081220 | DENV3 NS1EU081184 | DENV3 NS1EU052797 | DENV3 NS1GU131906 |
| DENV3 NS1GQ868546 | DENV3 NS1EU482595 | DENV3 NS1GU131858 | DENV3 NS1GQ868627 |
| DENV3 NS1FJ639805 | DENV3 NS1GQ199871 | DENV3 NS1FJ639791 | DENV3 NS1GU131943 |
| DENV3 NS1EU854291 | DENV3 NS1FJ024470 | DENV3 NS1EU529704 | DENV3 NS1EU482564 |
| DENV3 NS1EU081196 | DENV3 NS1FN429910 | DENV3 NS1GU131936 | DENV3 NS1GQ199887 |
| DENV3 NS1FJ182039 | DENV3 NS1AY496877 | DENV3 NS1GU131903 | DENV3 NS1EU726772 |
| DENV3 NS1GU131877 | DENV3 NS1EF629370 | DENV3 NS1DQ401694 | DENV3 NS1FJ182010 |
| DENV3 NS1DQ675520 | DENV3 NS1FJ639775 | DENV3 NS1EU081205 | DENV3 NS1U93300 |
| DENV3 NS1FJ024467 | DENV3 NS1GU131952 | DENV3 NS1FJ898470 | DENV3 NS1EU081203 |
| DENV3 NS1FN429903 | DENV3 NS1EU660420 | DENV3 NS1GQ868571 | DENV3 NS1FJ562097 |
| DENV3 NS1FJ744738 | DENV3 NS1GQ199865 | DENV3 NS1EU052799 | DENV3 NS1FJ547071 |
| DENV3 NS1EU081188 | DENV3 NS1FJ810414 | DENV3 NS1AB189128 | DENV3 NS1GU131946 |
| DENV3 NS1EU482462 | DENV3 NS1FJ639799 | DENV3 NS1FJ182009 | DENV3 NS1EU529685 |
| DENV3 NS1FJ898440 | DENV3 NS1EU687219 | DENV3 NS1FJ810416 | DENV3 NS1EU081219 |
| DENV3 NS1GQ252678 | DENV3 NS1FJ898442 | DENV3 NS1GU131852 | DENV3 NS1FJ882571 |
| DENV3 NS1FJ882575 | DENV3 NS1FJ390371 | DENV3 NS1FN429897 | DENV3 NS1FJ639762 |
| DENV3 NS1FJ639727 | DENV3 NS1EF629368 | DENV3 NS1GU131950 | DENV3 NS1EU081186 |
| DENV3 NS1GU131870 | DENV3 NS1EU081181 | DENV3 NS1FN429896 | DENV3 NS1GQ868547 |
| DENV3 NS1FJ639826 | DENV3 NS1FJ182007 | DENV3 NS1FJ639789 | DENV3 NS1GU131878 |
| DENV3 NS1GU131934 | DENV3 NS1FJ639827 | DENV3 NS1FJ390373 | DENV3 NS1EU569690 |
| DENV3 NS1EF643017 | DENV3 NS1EU367962 | DENV3 NS1FJ687448 | DENV3 NS1FJ850110 |
| DENV3 NS1GU131856 | DENV3 NS1DQ401689 | DENV3 NS1FJ639731 | DENV3 NS1AY744679 |
| DENV3 NS1DQ675525 | DENV3 NS1DQ675531 | DENV3 NS1FN429907 | DENV3 NS1FJ639784 |
| DENV3 NS1FJ850097 | DENV3 NS1FJ639750 | DENV3 NS1AY496879 | DENV3 NS1FJ850080 |
| DENV3 NS1EF629375 | DENV3 NS1FJ461326 | DENV3 NS1EU529697 | DENV3 NS1FJ205870 |
| DENV3 NS1FJ639722 | DENV3 NS1GU131854 | DENV3 NS1FJ744728 | DENV3 NS1AY912458 |

FIG. 68-35

| Virus Protein Accession No. | Virus Protein Accession No. | Virus Protein Accession No. | Virus Protein Accession No. |
|---|---|---|---|
| DENV3 NS1AY858043 | DENV3 NS1FJ639778 | DENV3 NS1FJ410176 | DENV3 NS1FJ562100 |
| DENV3 NS1EU596492 | DENV3 NS1EU081192 | DENV3 NS1AY770511 | DENV3 NS1GU131942 |
| DENV3 NS1GU131875 | DENV3 NS1GQ199886 | DENV3 NS1GU131933 | DENV3 NS1EU529688 |
| DENV3 NS1EU081191 | DENV3 NS1GQ868587 | DENV3 NS1GQ199870 | DENV3 NS1DQ401690 |
| DENV3 NS1AY858040 | DENV3 NS1DQ675521 | DENV3 NS1FJ850098 | DENV3 NS1EF629369 |
| DENV3 NS1EU482458 | DENV3 NS1FJ182013 | DENV3 NS1AB189125 | DENV3 NS1AY496875 |
| DENV3 NS1EU687197 | DENV3 NS1FJ882576 | DENV3 NS1FJ432741 | DENV3 NS1FJ639714 |
| DENV3 NS1GQ868578 | DENV3 NS1FN429916 | DENV3 NS1EU529690 | DENV3 NS1AY676351 |
| DENV3 NS1GU131876 | DENV3 NS1GU131913 | DENV3 NS1FJ639804 | DENV3 NS1GQ868573 |
| DENV3 NS1FJ547072 | DENV3 NS1EU781136 | DENV3 NS1FJ182038 | DENV3 NS1AY099336 |
| DENV3 NS1FJ639779 | DENV3 NS1FJ639726 | DENV3 NS1DQ675526 | DENV3 NS1EU081182 |
| DENV3 NS1FJ562103 | DENV3 NS1U93296 | DENV3 NS1GU131857 | DENV3 NS1GU131855 |
| DENV3 NS1DQ401692 | DENV3 NS1U93303 | DENV3 NS1AB214882 | DENV3 NS1DQ863638 |
| DENV3 NS1FJ639792 | DENV3 NS1EU081209 | DENV3 NS1U93301 | DENV3 NS1FJ639746 |
| DENV3 NS1AY496873 | DENV3 NS1FJ639712 | DENV3 NS1EU081217 | DENV3 NS1EU482454 |
| DENV3 NS1FN429909 | DENV3 NS1EU482461 | DENV3 NS1FJ024469 | DENV3 NS1EU081197 |
| DENV3 NS1FJ639816 | DENV3 NS1AY858047 | DENV3 NS1AB214881 | DENV3 NS1EU081212 |
| DENV3 NS1FJ744700 | DENV3 NS1AY676353 | DENV3 NS1GU131911 | DENV3 NS1FJ850083 |
| DENV3 NS1EU081202 | DENV3 NS1EU081210 | DENV3 NS1GU131869 | DENV3 NS1EU660408 |
| DENV3 NS1AB189126 | DENV3 NS1AF046855 | DENV3 NS1EU932688 | DENV3 NS1FJ639752 |
| DENV3 NS1FJ898458 | DENV3 NS1EU081199 | DENV3 NS1FJ547070 | DENV3 NS1AY676349 |
| DENV3 NS1FJ744740 | DENV3 NS1EU726774 | DENV3 NS1FJ639790 | DENV3 NS1FJ898462 |
| DENV3 NS1EU854292 | DENV3 NS1AY744677 | DENV3 NS1FJ639772 | DENV3 NS1FN429912 |
| DENV3 NS1FN429902 | DENV3 NS1FN429901 | DENV3 NS1EU081190 | DENV3 NS1EU529686 |
| DENV3 NS1GU131907 | DENV3 NS1EU687226 | DENV3 NS1FJ639723 | DENV3 NS1FJ744739 |
| DENV3 NS1EU482612 | DENV3 NS1FN429914 | DENV3 NS1EU482613 | DENV3 NS1AY676348 |
| DENV3 NS1GU131849 | DENV3 NS1FJ639768 | DENV3 NS1FJ850055 | DENV3 NS1AY679147 |
| DENV3 NS1EU052794 | DENV3 NS1FJ547061 | DENV3 NS1EU482558 | DENV3 NS1GU131904 |
| DENV3 NS1FJ373303 | DENV3 NS1GU131917 | DENV3 NS1FN429899 | DENV3 NS1FJ461338 |
| DENV3 NS1EU081224 | DENV3 NS1FJ432728 | DENV3 NS1EU660410 | DENV3 NS1EU081213 |
| DENV3 NS1FJ873812 | DENV3 NS1EU482456 | DENV3 NS1AY858044 | DENV3 NS1AY744681 |
| DENV3 NS1FJ744734 | DENV3 NS1GU370053 | DENV3 NS1EU726768 | DENV3 NS1AY662691 |
| DENV3 NS1FJ850096 | DENV3 NS1FJ744736 | DENV3 NS1FJ639766 | DENV3 NS1AY876494 |
| DENV3 NS1FJ639787 | DENV3 NS1DQ675532 | DENV3 NS1EU529698 | DENV3 NS1GU131944 |
| DENV3 NS1FJ882574 | DENV3 NS1FN429904 | DENV3 NS1EU687239 | DENV3 NS1EU687221 |
| DENV3 NS1GU131873 | DENV3 NS1FJ744731 | DENV3 NS1DQ675528 | DENV3 NS1EU529705 |
| DENV3 NS1GU131867 | DENV3 NS1FJ744737 | DENV3 NS1FJ639807 | DENV3 NS1EU726771 |
| DENV3 NS1GQ199889 | DENV3 NS1AY858037 | DENV3 NS1FJ898475 | DENV3 NS1GQ868572 |
| DENV3 NS1GQ252674 | DENV3 NS1FJ547077 | DENV3 NS1EU081200 | DENV3 NS1FJ898473 |
| DENV3 NS1EU687198 | DENV3 NS1EU569688 | DENV3 NS1FJ390376 | DENV3 NS1EU687196 |
| DENV3 NS1FJ432743 | DENV3 NS1GU131871 | DENV3 NS1EU529702 | DENV3 NS1FN429906 |
| DENV3 NS1FJ461322 | DENV3 NS1GU131845 | DENV3 NS1FJ639781 | DENV3 NS1FJ639730 |
| DENV3 NS1GQ868626 | DENV3 NS1EU081195 | DENV3 NS1FJ182004 | DENV3 NS1EU081215 |
| DENV3 NS1FJ639728 | DENV3 NS1AY422470 | DENV3 NS1FJ898443 | DENV3 NS1GU131935 |
| DENV3 NS1FJ639758 | DENV3 NS1FJ898456 | DENV3 NS1AY496876 | DENV3 NS1FN429913 |
| DENV3 NS1AY776329 | DENV3 NS1EU081187 | DENV3 NS1AY744684 | DENV3 NS1FJ639751 |
| DENV3 NS1FJ639721 | DENV3 NS1GU131847 | DENV3 NS1FJ850048 | DENV3 NS1EU052798 |
| DENV3 NS1FJ547080 | DENV3 NS1EU081207 | DENV3 NS1GQ868575 | DENV3 NS1FJ639780 |

FIG. 68-36

| Virus Protein Accession No. | Virus Protein Accession No. | Virus Protein Accession No. | Virus Protein Accession No. |
|---|---|---|---|
| DENV3 NS1EU081

FIG. 68-37

| Virus Protein Accession No. | Virus Protein Accession No. | Virus Protein Accession No. | Virus Protein Accession No. |
|---|---|---|---|
| DENV3 NS2A FJ547072 | DENV3 NS2A DQ675522 | DENV3 NS2A EU482455 | DENV3 NS2A EU482559 |
| DENV3 NS2A AB214880 | DENV3 NS2A GU131907 | DENV3 NS2A GQ252674 | DENV3 NS2A DQ675521 |
| DENV3 NS2A FJ639767 | DENV3 NS2A GU131849 | DENV3 NS2A AY858046 | DENV3 NS2A FJ182013 |
| DENV3 NS2A FJ639779 | DENV3 NS2A EU482612 | DENV3 NS2A M93130 | DENV3 NS2A EU081201 |
| DENV3 NS2A FJ562103 | DENV3 NS2A FJ639771 | DENV3 NS2A EU687198 | DENV3 NS2A FJ373304 |
| DENV3 NS2A EF629373 | DENV3 NS2A EU781137 | DENV3 NS2A FJ432743 | DENV3 NS2A FN429915 |
| DENV3 NS2A DQ401692 | DENV3 NS2A FJ373303 | DENV3 NS2A FJ461322 | DENV3 NS2A FJ882576 |
| DENV3 NS2A FJ639792 | DENV3 NS2A FJ873812 | DENV3 NS2A GQ868626 | DENV3 NS2A EU529687 |
| DENV3 NS2A AY858041 | DENV3 NS2A EU081224 | DENV3 NS2A FJ850052 | DENV3 NS2A GU131913 |
| DENV3 NS2A FN429909 | DENV3 NS2A FJ850096 | DENV3 NS2A EU660407 | DENV3 NS2A FN429916 |
| DENV3 NS2A AY496873 | DENV3 NS2A FJ744734 | DENV3 NS2A FJ639728 | DENV3 NS2A EU081208 |
| DENV3 NS2A FJ744700 | DENV3 NS2A GU131844 | DENV3 NS2A FJ024465 | DENV3 NS2A GU131951 |
| DENV3 NS2A AY744678 | DENV3 NS2A FJ639747 | DENV3 NS2A FJ639758 | DENV3 NS2A FJ898468 |
| DENV3 NS2A FJ639816 | DENV3 NS2A CS477305 | DENV3 NS2A FJ461334 | DENV3 NS2A EU781136 |
| DENV3 NS2A EU081202 | DENV3 NS2A FJ562099 | DENV3 NS2A AY776329 | DENV3 NS2A GU131846 |
| DENV3 NS2A AB189126 | DENV3 NS2A FJ898455 | DENV3 NS2A FJ639721 | DENV3 NS2A FJ547078 |
| DENV3 NS2A GQ199860 | DENV3 NS2A GU131873 | DENV3 NS2A FJ547080 | DENV3 NS2A FJ639726 |
| DENV3 NS2A FJ373302 | DENV3 NS2A FJ882574 | DENV3 NS2A FJ639778 | DENV3 NS2A FJ898457 |
| DENV3 NS2A FJ390375 | DENV3 NS2A FJ639787 | DENV3 NS2A FN429917 | DENV3 NS2A FJ639795 |
| DENV3 NS2A FJ744740 | DENV3 NS2A GU131867 | DENV3 NS2A GQ868593 | DENV3 NS2A FJ639757 |
| DENV3 NS2A FJ898458 | DENV3 NS2A FJ639817 | DENV3 NS2A GQ199886 | DENV3 NS2A EU569689 |
| DENV3 NS2A FJ639801 | DENV3 NS2A EU081185 | DENV3 NS2A EU081192 | DENV3 NS2A EU081209 |
| DENV3 NS2A EU854292 | DENV3 NS2A GQ199889 | DENV3 NS2A GQ868587 | DENV3 NS2A FJ639712 |
| DENV3 NS2A FN429902 | DENV3 NS2A FJ182037 | DENV3 NS2A GU131866 | DENV3 NS2A DQ401691 |

FIG. 68-38

| Virus Protein Accession No. | Virus Protein Accession No. | Virus Protein Accession No. | Virus Protein Accession No. |
|---|---|---|---|
| DENV3 NS2A FN429908 | DENV3 NS2A EU687226 | DENV3 NS2A FJ547077 | DENV3 NS2A GU131933 |
| DENV3 NS2A EU482566 | DENV3 NS2A DQ675527 | DENV3 NS2A FJ639765 | DENV3 NS2A EU529689 |
| DENV3 NS2A EU482461 | DENV3 NS2A FN429914 | DENV3 NS2A EU726769 | DENV3 NS2A GU131954 |
| DENV3 NS2A EU687233 | DENV3 NS2A FJ639768 | DENV3 NS2A GU131871 | DENV3 NS2A FJ850098 |
| DENV3 NS2A AY496874 | DENV3 NS2A FJ547061 | DENV3 NS2A GQ199888 | DENV3 NS2A GQ199870 |
| DENV3 NS2A AY858047 | DENV3 NS2A GU131917 | DENV3 NS2A EU569688 | DENV3 NS2A FJ432741 |
| DENV3 NS2A GU131862 | DENV3 NS2A FJ432728 | DENV3 NS2A FJ639786 | DENV3 NS2A AB189125 |
| DENV3 NS2A EU482614 | DENV3 NS2A AY744682 | DENV3 NS2A GU131845 | DENV3 NS2A AY676352 |
| DENV3 NS2A AY676353 | DENV3 NS2A EU529683 | DENV3 NS2A FJ478456 | DENV3 NS2A FJ639804 |
| DENV3 NS2A GU131872 | DENV3 NS2A EU482456 | DENV3 NS2A GQ868617 | DENV3 NS2A EU529690 |
| DENV3 NS2A EU081210 | DENV3 NS2A FJ639777 | DENV3 NS2A EU081195 | DENV3 NS2A AY099337 |
| DENV3 NS2A FJ639770 | DENV3 NS2A EU529692 | DENV3 NS2A FJ898456 | DENV3 NS2A FJ182015 |
| DENV3 NS2A FJ810413 | DENV3 NS2A GU370053 | DENV3 NS2A FJ898444 | DENV3 NS2A FJ182038 |
| DENV3 NS2A GU131861 | DENV3 NS2A FJ744736 | DENV3 NS2A GU370052 | DENV3 NS2A FJ850049 |
| DENV3 NS2A FJ182040 | DENV3 NS2A FJ898476 | DENV3 NS2A EU660411 | DENV3 NS2A DQ675526 |
| DENV3 NS2A FJ882573 | DENV3 NS2A DQ675532 | DENV3 NS2A EU081187 | DENV3 NS2A FJ639713 |
| DENV3 NS2A EU081199 | DENV3 NS2A EU081211 | DENV3 NS2A GU131847 | DENV3 NS2A GU131857 |
| DENV3 NS2A EU529699 | DENV3 NS2A FJ547066 | DENV3 NS2A FJ410176 | DENV3 NS2A AB214882 |
| DENV3 NS2A FJ744735 | DENV3 NS2A FN429904 | DENV3 NS2A EU482453 | DENV3 NS2A EU081217 |
| DENV3 NS2A FJ024468 | DENV3 NS2A FJ744731 | DENV3 NS2A EU081207 | DENV3 NS2A FJ024469 |
| DENV3 NS2A FN429901 | DENV3 NS2A FJ744737 | DENV3 NS2A FJ182005 | DENV3 NS2A CS479205 |
| DENV3 NS2A AY744677 | DENV3 NS2A FJ882577 | DENV3 NS2A AY770511 | DENV3 NS2A GQ868577 |
| DENV3 NS2A EU726774 | DENV3 NS2A FN429900 | DENV3 NS2A GQ868574 | DENV3 NS2A AB214881 |
| DENV3 NS2A AY744685 | DENV3 NS2A AY858037 | DENV3 NS2A GU131941 | DENV3 NS2A GU131911 |

FIG. 68-39

| Virus Protein Accession No. | Virus Protein Accession No. | Virus Protein Accession No. | Virus Protein Accession No. |
|---|---|---|---|
| DENV3 NS2A GU131869 | DENV3 NS2A DQ675528 | DENV3 NS2A FN429903 | DENV3 NS2A EU482454 |
| DENV3 NS2A EU081198 | DENV3 NS2A EU687239 | DENV3 NS2A FJ744738 | DENV3 NS2A EF643017 |
| DENV3 NS2A EU932688 | DENV3 NS2A EU081206 | DENV3 NS2A FJ562100 | DENV3 NS2A GU131856 |
| DENV3 NS2A FJ547070 | DENV3 NS2A FJ639807 | DENV3 NS2A GU131942 | DENV3 NS2A DQ675525 |
| DENV3 NS2A FJ639790 | DENV3 NS2A EU529691 | DENV3 NS2A EU529688 | DENV3 NS2A EU081212 |
| DENV3 NS2A FJ639772 | DENV3 NS2A FJ898475 | DENV3 NS2A EF629369 | DENV3 NS2A EU081197 |
| DENV3 NS2A EU081190 | DENV3 NS2A EU081220 | DENV3 NS2A EU081188 | DENV3 NS2A FJ850097 |
| DENV3 NS2A EU482613 | DENV3 NS2A GQ868546 | DENV3 NS2A DQ401690 | DENV3 NS2A FJ850083 |
| DENV3 NS2A FJ639723 | DENV3 NS2A FJ639805 | DENV3 NS2A EU482462 | DENV3 NS2A FJ639722 |
| DENV3 NS2A GU189648 | DENV3 NS2A EU854291 | DENV3 NS2A FJ898440 | DENV3 NS2A AB189127 |
| DENV3 NS2A FJ850055 | DENV3 NS2A EU081200 | DENV3 NS2A GQ252678 | DENV3 NS2A FJ639720 |
| DENV3 NS2A EU482558 | DENV3 NS2A EU081196 | DENV3 NS2A FJ882575 | DENV3 NS2A FJ639729 |
| DENV3 NS2A EU660409 | DENV3 NS2A FJ182039 | DENV3 NS2A FJ639727 | DENV3 NS2A GU131868 |
| DENV3 NS2A FN429899 | DENV3 NS2A GU131877 | DENV3 NS2A FJ639714 | DENV3 NS2A FJ639793 |
| DENV3 NS2A FJ373306 | DENV3 NS2A DQ675520 | DENV3 NS2A GQ868573 | DENV3 NS2A FJ639752 |
| DENV3 NS2A EU660410 | DENV3 NS2A FJ390376 | DENV3 NS2A AY676351 | DENV3 NS2A EU660408 |
| DENV3 NS2A FJ898463 | DENV3 NS2A EU529702 | DENV3 NS2A GU131870 | DENV3 NS2A GU363549 |
| DENV3 NS2A AY858044 | DENV3 NS2A FJ639781 | DENV3 NS2A AY099336 | DENV3 NS2A FJ850109 |
| DENV3 NS2A EU726768 | DENV3 NS2A FJ898443 | DENV3 NS2A EU081182 | DENV3 NS2A EU081218 |
| DENV3 NS2A FJ639766 | DENV3 NS2A FJ182004 | DENV3 NS2A DQ863638 | DENV3 NS2A AY676349 |
| DENV3 NS2A EU529698 | DENV3 NS2A AY744684 | DENV3 NS2A GU131855 | DENV3 NS2A FJ547081 |
| DENV3 NS2A FJ410177 | DENV3 NS2A FJ850048 | DENV3 NS2A FJ639826 | DENV3 NS2A GU131912 |
| DENV3 NS2A DQ675530 | DENV3 NS2A FJ024467 | DENV3 NS2A FJ639746 | DENV3 NS2A FJ898462 |
| DENV3 NS2A FJ744730 | DENV3 NS2A GQ868575 | DENV3 NS2A GU131934 | DENV3 NS2A FN429912 |

FIG. 68-40

| Virus Protein Accession No. | Virus Protein Accession No. | Virus Protein Accession No. | Virus Protein Accession No. |
|---|---|---|---|
| DENV3 NS2A AY923865 | DENV3 NS2A AY876494 | DENV3 NS2A EU081215 | DENV3 NS2A FJ547076 |
| DENV3 NS2A EU529686 | DENV3 NS2A AY662691 | DENV3 NS2A EU081181 | DENV3 NS2A GU131874 |
| DENV3 NS2A FJ744739 | DENV3 NS2A EU687221 | DENV3 NS2A FN429913 | DENV3 NS2A FJ547082 |
| DENV3 NS2A AY858045 | DENV3 NS2A FN429910 | DENV3 NS2A GU131935 | DENV3 NS2A FJ461337 |
| DENV3 NS2A FJ547084 | DENV3 NS2A GU131944 | DENV3 NS2A FJ182007 | DENV3 NS2A FJ547083 |
| DENV3 NS2A FJ639774 | DENV3 NS2A AY496877 | DENV3 NS2A FJ639751 | DENV3 NS2A FJ639760 |
| DENV3 NS2A GU131915 | DENV3 NS2A EF629370 | DENV3 NS2A FJ639827 | DENV3 NS2A GU131853 |
| DENV3 NS2A AY676348 | DENV3 NS2A FJ639775 | DENV3 NS2A EU367962 | DENV3 NS2A FJ639769 |
| DENV3 NS2A AY679147 | DENV3 NS2A GU131952 | DENV3 NS2A DQ401689 | DENV3 NS2A GQ868629 |
| DENV3 NS2A FJ850056 | DENV3 NS2A EU529705 | DENV3 NS2A FJ639780 | DENV3 NS2A EU081183 |
| DENV3 NS2A FJ562107 | DENV3 NS2A EU660420 | DENV3 NS2A EU081189 | DENV3 NS2A GQ199864 |
| DENV3 NS2A FJ639759 | DENV3 NS2A GQ199865 | DENV3 NS2A DQ675531 | DENV3 NS2A NC_001475 |
| DENV3 NS2A DQ675519 | DENV3 NS2A EU726771 | DENV3 NS2A FJ639750 | DENV3 NS2A FN429905 |
| DENV3 NS2A GU131904 | DENV3 NS2A FJ810414 | DENV3 NS2A AY676350 | DENV3 NS2A EU482459 |
| DENV3 NS2A FJ461338 | DENV3 NS2A GQ868572 | DENV3 NS2A FJ898441 | DENV3 NS2A FJ898459 |
| DENV3 NS2A FJ639715 | DENV3 NS2A FJ898473 | DENV3 NS2A FJ024471 | DENV3 NS2A FJ639716 |
| DENV3 NS2A FJ024466 | DENV3 NS2A EU687196 | DENV3 NS2A EU081221 | DENV3 NS2A FJ547073 |
| DENV3 NS2A FJ898447 | DENV3 NS2A FJ639799 | DENV3 NS2A FJ461326 | DENV3 NS2A GQ868586 |
| DENV3 NS2A EU081184 | DENV3 NS2A EU687219 | DENV3 NS2A GU131854 | DENV3 NS2A FJ639763 |
| DENV3 NS2A EU482595 | DENV3 NS2A FJ898442 | DENV3 NS2A FJ432722 | DENV3 NS2A EU081216 |
| DENV3 NS2A GQ199871 | DENV3 NS2A FN429906 | DENV3 NS2A FJ410178 | DENV3 NS2A FJ410229 |
| DENV3 NS2A AY744681 | DENV3 NS2A FJ390371 | DENV3 NS2A EU081223 | DENV3 NS2A FJ898464 |
| DENV3 NS2A EU081213 | DENV3 NS2A FJ639730 | DENV3 NS2A DQ675523 | DENV3 NS2A EU482452 |
| DENV3 NS2A FJ024470 | DENV3 NS2A EF629368 | DENV3 NS2A EU482563 | DENV3 NS2A FJ744729 |

FIG. 68-41

| Virus Protein Accession No. | Virus Protein Accession No. | Virus Protein Accession No. | Virus Protein Accession No. |
|---|---|---|---|
| DENV3 NS2A AY766104 | DENV3 NS2A FJ850092 | DENV3 NS2A FJ639789 | DENV3 NS2A FJ898469 |
| DENV3 NS2A EU687218 | DENV3 NS2A FJ390377 | DENV3 NS2A FB667400 | DENV3 NS2A FJ639776 |
| DENV3 NS2A FJ898474 | DENV3 NS2A EU529704 | DENV3 NS2A FJ390373 | DENV3 NS2A FJ744726 |
| DENV3 NS2A GU131910 | DENV3 NS2A FJ547075 | DENV3 NS2A EU482460 | DENV3 NS2A FJ850111 |
| DENV3 NS2A GU131916 | DENV3 NS2A GU131936 | DENV3 NS2A FJ639753 | DENV3 NS2A EU081204 |
| DENV3 NS2A GQ199863 | DENV3 NS2A GU131903 | DENV3 NS2A FJ687448 | DENV3 NS2A FJ639761 |
| DENV3 NS2A FJ639724 | DENV3 NS2A DQ401694 | DENV3 NS2A FJ639731 | DENV3 NS2A EU081194 |
| DENV3 NS2A FJ639798 | DENV3 NS2A EU081205 | DENV3 NS2A FN429907 | DENV3 NS2A FJ639725 |
| DENV3 NS2A EU081222 | DENV3 NS2A FJ850089 | DENV3 NS2A EU529684 | DENV3 NS2A GQ868628 |
| DENV3 NS2A FJ639803 | DENV3 NS2A FJ898470 | DENV3 NS2A FJ882572 | DENV3 NS2A FJ639785 |
| DENV3 NS2A CS805345 | DENV3 NS2A GQ868571 | DENV3 NS2A FJ182041 | DENV3 NS2A FJ850086 |
| DENV3 NS2A AY648961 | DENV3 NS2A AY744683 | DENV3 NS2A AY496879 | DENV3 NS2A FJ639810 |
| DENV3 NS2A FJ432731 | DENV3 NS2A FJ639756 | DENV3 NS2A EU529697 | DENV3 NS2A FJ882578 |
| DENV3 NS2A FJ562102 | DENV3 NS2A FJ547062 | DENV3 NS2A GQ199891 | DENV3 NS2A GU131851 |
| DENV3 NS2A EU081193 | DENV3 NS2A AB189128 | DENV3 NS2A EU932687 | DENV3 NS2A GU131940 |
| DENV3 NS2A FJ639754 | DENV3 NS2A FJ182009 | DENV3 NS2A GQ868548 | DENV3 NS2A EU482555 |
| DENV3 NS2A AF317645 | DENV3 NS2A FJ810416 | DENV3 NS2A FJ744728 | DENV3 NS2A GU131938 |
| DENV3 NS2A GU131865 | DENV3 NS2A EF629367 | DENV3 NS2A FJ639825 | DENV3 NS2A EU529696 |
| DENV3 NS2A FJ898445 | DENV3 NS2A GU131852 | DENV3 NS2A FN429911 | DENV3 NS2A DQ401695 |
| DENV3 NS2A FJ182006 | DENV3 NS2A AY858048 | DENV3 NS2A GU131914 | DENV3 NS2A EU726773 |
| DENV3 NS2A FJ547069 | DENV3 NS2A FN429897 | DENV3 NS2A GU131945 | DENV3 NS2A GQ868616 |
| DENV3 NS2A GU131858 | DENV3 NS2A GU131950 | DENV3 NS2A FJ898472 | DENV3 NS2A EU482596 |
| DENV3 NS2A EU687234 | DENV3 NS2A FN429896 | DENV3 NS2A FJ547074 | DENV3 NS2A AY858042 |
| DENV3 NS2A FJ639791 | DENV3 NS2A GU131905 | DENV3 NS2A FJ461329 | DENV3 NS2A FJ205871 |

FIG. 68-42

| Virus Protein Accession No. | Virus Protein Accession No. | Virus Protein Accession No. | Virus Protein Accession No. |
|---|---|---|---|
| DENV3 NS2A GU131860 | DENV3 NS2A GU131943 | DENV3 NS2A FJ882571 | DENV3 NS2A GU131937 |
| DENV3 NS2A EU482457 | DENV3 NS2A FJ547085 | DENV3 NS2A FJ744733 | DENV3 NS2A GU131875 |
| DENV3 NS2A GQ199862 | DENV3 NS2A GU131953 | DENV3 NS2A GQ199861 | DENV3 NS2A EU081191 |
| DENV3 NS2A EU529703 | DENV3 NS2A EU482564 | DENV3 NS2A FJ873813 | DENV3 NS2A AY858040 |
| DENV3 NS2A FJ639782 | DENV3 NS2A GQ199887 | DENV3 NS2A FJ639762 | DENV3 NS2A EU482458 |
| DENV3 NS2A GU131908 | DENV3 NS2A DQ675524 | DENV3 NS2A EU081186 | DENV3 NS2A EU687197 |
| DENV3 NS2A AY858039 | DENV3 NS2A EU596494 | DENV3 NS2A EU081225 | DENV3 NS2A FJ177308 |
| DENV3 NS2A EU081214 | DENV3 NS2A EU726772 | DENV3 NS2A GQ868547 | DENV3 NS2A DQ401693 |
| DENV3 NS2A EF629366 | DENV3 NS2A FJ898471 | DENV3 NS2A GU131878 | DENV3 NS2B FN429898 |
| DENV3 NS2A FJ639800 | DENV3 NS2A EU569691 | DENV3 NS2A EU569690 | DENV3 NS2B GQ868576 |
| DENV3 NS2A FJ182008 | DENV3 NS2A FJ182010 | DENV3 NS2A FJ850110 | DENV3 NS2B GQ868578 |
| DENV3 NS2A AY744680 | DENV3 NS2A AB214879 | DENV3 NS2A AY744679 | DENV3 NS2B EU596493 |
| DENV3 NS2A GU131918 | DENV3 NS2A EU081203 | DENV3 NS2A GU131850 | DENV3 NS2B GQ868634 |
| DENV3 NS2A FJ639755 | DENV3 NS2A EU854298 | DENV3 NS2A FJ850094 | DENV3 NS2B GU131876 |
| DENV3 NS2A FJ639719 | DENV3 NS2A FJ562097 | DENV3 NS2A FJ639784 | DENV3 NS2B FJ547072 |
| DENV3 NS2A DQ675533 | DENV3 NS2A FJ547071 | DENV3 NS2A FJ850080 | DENV3 NS2B AB214880 |
| DENV3 NS2A GU131939 | DENV3 NS2A FJ390372 | DENV3 NS2A DQ675529 | DENV3 NS2B FJ639767 |
| DENV3 NS2A FJ639749 | DENV3 NS2A GU131946 | DENV3 NS2A FJ850079 | DENV3 NS2B FJ639779 |
| DENV3 NS2A GU131848 | DENV3 NS2A EU529685 | DENV3 NS2A FJ547079 | DENV3 NS2B FJ562103 |
| DENV3 NS2A GU131906 | DENV3 NS2A EU081219 | DENV3 NS2A GU131909 | DENV3 NS2B EF629373 |
| DENV3 NS2A GQ868627 | DENV3 NS2A FN429918 | DENV3 NS2A FJ205870 | DENV3 NS2B DQ401692 |
| DENV3 NS2A GU131859 | DENV3 NS2A FJ744727 | DENV3 NS2A AY496871 | DENV3 NS2B FJ639792 |
| DENV3 NS2A FJ182011 | DENV3 NS2A FJ744732 | DENV3 NS2A AY858043 | DENV3 NS2B AY858041 |
| DENV3 NS2A AY858038 | DENV3 NS2A FJ898446 | DENV3 NS2A EU596492 | DENV3 NS2B FN429909 |

FIG. 68-43

| Virus Protein Accession No. | Virus Protein Accession No. | Virus Protein Accession No. | Virus Protein Accession No. |
|---|---|---|---|
| DENV3 NS2B AY496873 | DENV3 NS2B FJ744734 | DENV3 NS2B FJ639728 | DENV3 NS2B EU081208 |
| DENV3 NS2B FJ744700 | DENV3 NS2B GU131844 | DENV3 NS2B FJ024465 | DENV3 NS2B GU131951 |
| DENV3 NS2B AY744678 | DENV3 NS2B FJ639747 | DENV3 NS2B FJ639758 | DENV3 NS2B FJ898468 |
| DENV3 NS2B FJ639816 | DENV3 NS2B CS477305 | DENV3 NS2B FJ461334 | DENV3 NS2B EU781136 |
| DENV3 NS2B EU081202 | DENV3 NS2B FJ562099 | DENV3 NS2B AY776329 | DENV3 NS2B GU131846 |
| DENV3 NS2B AB189126 | DENV3 NS2B FJ898455 | DENV3 NS2B FJ639721 | DENV3 NS2B FJ547078 |
| DENV3 NS2B GQ199860 | DENV3 NS2B GU131873 | DENV3 NS2B FJ547080 | DENV3 NS2B FJ639726 |
| DENV3 NS2B FJ373302 | DENV3 NS2B FJ882574 | DENV3 NS2B FJ639778 | DENV3 NS2B FJ898457 |
| DENV3 NS2B FJ390375 | DENV3 NS2B FJ639787 | DENV3 NS2B FN429917 | DENV3 NS2B FJ639795 |
| DENV3 NS2B FJ744740 | DENV3 NS2B GU131867 | DENV3 NS2B GQ868593 | DENV3 NS2B FJ639757 |
| DENV3 NS2B FJ898458 | DENV3 NS2B FJ639817 | DENV3 NS2B GQ199886 | DENV3 NS2B EU569689 |
| DENV3 NS2B FJ639801 | DENV3 NS2B EU081185 | DENV3 NS2B EU081192 | DENV3 NS2B EU081209 |
| DENV3 NS2B EU854292 | DENV3 NS2B GQ199889 | DENV3 NS2B GQ868587 | DENV3 NS2B FJ639712 |
| DENV3 NS2B FN429902 | DENV3 NS2B FJ182037 | DENV3 NS2B GU131866 | DENV3 NS2B DQ401691 |
| DENV3 NS2B DQ675522 | DENV3 NS2B EU482455 | DENV3 NS2B EU482559 | DENV3 NS2B FN429908 |
| DENV3 NS2B GU131907 | DENV3 NS2B GQ252674 | DENV3 NS2B DQ675521 | DENV3 NS2B EU482566 |
| DENV3 NS2B GU131849 | DENV3 NS2B AY858046 | DENV3 NS2B FJ182013 | DENV3 NS2B EU482461 |
| DENV3 NS2B EU482612 | DENV3 NS2B M93130 | DENV3 NS2B EU081201 | DENV3 NS2B EU687233 |
| DENV3 NS2B FJ639771 | DENV3 NS2B EU687198 | DENV3 NS2B FJ373304 | DENV3 NS2B AY496874 |
| DENV3 NS2B EU781137 | DENV3 NS2B FJ432743 | DENV3 NS2B FN429915 | DENV3 NS2B AY858047 |
| DENV3 NS2B FJ373303 | DENV3 NS2B FJ461322 | DENV3 NS2B FJ882576 | DENV3 NS2B GU131862 |
| DENV3 NS2B FJ873812 | DENV3 NS2B GQ868626 | DENV3 NS2B EU529687 | DENV3 NS2B EU482614 |
| DENV3 NS2B EU081224 | DENV3 NS2B FJ850052 | DENV3 NS2B GU131913 | DENV3 NS2B AY676353 |
| DENV3 NS2B FJ850096 | DENV3 NS2B EU660407 | DENV3 NS2B FN429916 | DENV3 NS2B GU131872 |

FIG. 68-44

| Virus Protein Accession No. | Virus Protein Accession No. | Virus Protein Accession No. | Virus Protein Accession No. |
|---|---|---|---|
| DENV3 NS2B EU081210 | DENV3 NS2B FJ639777 | DENV3 NS2B EU081195 | DENV3 NS2B AY099337 |
| DENV3 NS2B FJ639770 | DENV3 NS2B EU529692 | DENV3 NS2B FJ898456 | DENV3 NS2B FJ182015 |
| DENV3 NS2B FJ810413 | DENV3 NS2B GU370053 | DENV3 NS2B FJ898444 | DENV3 NS2B FJ182038 |
| DENV3 NS2B GU131861 | DENV3 NS2B FJ744736 | DENV3 NS2B GU370052 | DENV3 NS2B FJ850049 |
| DENV3 NS2B FJ182040 | DENV3 NS2B FJ898476 | DENV3 NS2B EU660411 | DENV3 NS2B DQ675526 |
| DENV3 NS2B FJ882573 | DENV3 NS2B DQ675532 | DENV3 NS2B EU081187 | DENV3 NS2B FJ639713 |
| DENV3 NS2B EU081199 | DENV3 NS2B EU081211 | DENV3 NS2B GU131847 | DENV3 NS2B GU131857 |
| DENV3 NS2B EU529699 | DENV3 NS2B FJ547066 | DENV3 NS2B FJ410176 | DENV3 NS2B AB214882 |
| DENV3 NS2B FJ744735 | DENV3 NS2B FN429904 | DENV3 NS2B EU482453 | DENV3 NS2B EU081217 |
| DENV3 NS2B FJ024468 | DENV3 NS2B FJ744731 | DENV3 NS2B EU081207 | DENV3 NS2B FJ024469 |
| DENV3 NS2B FN429901 | DENV3 NS2B FJ744737 | DENV3 NS2B FJ182005 | DENV3 NS2B CS479205 |
| DENV3 NS2B AY744677 | DENV3 NS2B FJ882577 | DENV3 NS2B AY770511 | DENV3 NS2B GQ868577 |
| DENV3 NS2B EU726774 | DENV3 NS2B FN429900 | DENV3 NS2B GQ868574 | DENV3 NS2B AB214881 |
| DENV3 NS2B AY744685 | DENV3 NS2B AY858037 | DENV3 NS2B GU131941 | DENV3 NS2B GU131911 |
| DENV3 NS2B EU687226 | DENV3 NS2B FJ547077 | DENV3 NS2B GU131933 | DENV3 NS2B GU131869 |
| DENV3 NS2B DQ675527 | DENV3 NS2B FJ639765 | DENV3 NS2B EU529689 | DENV3 NS2B EU081198 |
| DENV3 NS2B FN429914 | DENV3 NS2B EU726769 | DENV3 NS2B GU131954 | DENV3 NS2B EU932688 |
| DENV3 NS2B FJ639768 | DENV3 NS2B GU131871 | DENV3 NS2B FJ850098 | DENV3 NS2B FJ547070 |
| DENV3 NS2B FJ547061 | DENV3 NS2B GQ199888 | DENV3 NS2B GQ199870 | DENV3 NS2B FJ639790 |
| DENV3 NS2B GU131917 | DENV3 NS2B EU569688 | DENV3 NS2B FJ432741 | DENV3 NS2B FJ639772 |
| DENV3 NS2B FJ432728 | DENV3 NS2B FJ639786 | DENV3 NS2B AB189125 | DENV3 NS2B EU081190 |
| DENV3 NS2B AY744682 | DENV3 NS2B GU131845 | DENV3 NS2B AY676352 | DENV3 NS2B EU482613 |
| DENV3 NS2B EU529683 | DENV3 NS2B FJ478456 | DENV3 NS2B FJ639804 | DENV3 NS2B FJ639723 |
| DENV3 NS2B EU482456 | DENV3 NS2B GQ868617 | DENV3 NS2B EU529690 | DENV3 NS2B GU189648 |

FIG. 68-45

| Virus Protein Accession No. | Virus Protein Accession No. | Virus Protein Accession No. | Virus Protein Accession No. |
|---|---|---|---|
| DENV3 NS2B FJ850055 | DENV3 NS2B EU081200 | DENV3 NS2B GQ252678 | DENV3 NS2B FJ639720 |
| DENV3 NS2B EU482558 | DENV3 NS2B EU081196 | DENV3 NS2B FJ882575 | DENV3 NS2B FJ639729 |
| DENV3 NS2B EU660409 | DENV3 NS2B FJ182039 | DENV3 NS2B FJ639727 | DENV3 NS2B GU131868 |
| DENV3 NS2B FN429899 | DENV3 NS2B GU131877 | DENV3 NS2B FJ639714 | DENV3 NS2B FJ639793 |
| DENV3 NS2B FJ373306 | DENV3 NS2B DQ675520 | DENV3 NS2B GQ868573 | DENV3 NS2B FJ639752 |
| DENV3 NS2B EU660410 | DENV3 NS2B FJ390376 | DENV3 NS2B AY676351 | DENV3 NS2B EU660408 |
| DENV3 NS2B FJ898463 | DENV3 NS2B EU529702 | DENV3 NS2B GU131870 | DENV3 NS2B GU363549 |
| DENV3 NS2B AY858044 | DENV3 NS2B FJ639781 | DENV3 NS2B AY099336 | DENV3 NS2B FJ850109 |
| DENV3 NS2B EU726768 | DENV3 NS2B FJ898443 | DENV3 NS2B EU081182 | DENV3 NS2B EU081218 |
| DENV3 NS2B FJ639766 | DENV3 NS2B FJ182004 | DENV3 NS2B DQ863638 | DENV3 NS2B AY676349 |
| DENV3 NS2B EU529698 | DENV3 NS2B AY744684 | DENV3 NS2B GU131855 | DENV3 NS2B FJ547081 |
| DENV3 NS2B FJ410177 | DENV3 NS2B FJ850048 | DENV3 NS2B FJ639826 | DENV3 NS2B GU131912 |
| DENV3 NS2B DQ675530 | DENV3 NS2B FJ024467 | DENV3 NS2B FJ639746 | DENV3 NS2B FJ898462 |
| DENV3 NS2B FJ744730 | DENV3 NS2B GQ868575 | DENV3 NS2B GU131934 | DENV3 NS2B FN429912 |
| DENV3 NS2B DQ675528 | DENV3 NS2B FN429903 | DENV3 NS2B EU482454 | DENV3 NS2B AY923865 |
| DENV3 NS2B EU687239 | DENV3 NS2B FJ744738 | DENV3 NS2B EF643017 | DENV3 NS2B EU529686 |
| DENV3 NS2B EU081206 | DENV3 NS2B FJ562100 | DENV3 NS2B GU131856 | DENV3 NS2B FJ744739 |
| DENV3 NS2B FJ639807 | DENV3 NS2B GU131942 | DENV3 NS2B DQ675525 | DENV3 NS2B AY858045 |
| DENV3 NS2B EU529691 | DENV3 NS2B EU529688 | DENV3 NS2B EU081212 | DENV3 NS2B FJ547084 |
| DENV3 NS2B FJ898475 | DENV3 NS2B EF629369 | DENV3 NS2B EU081197 | DENV3 NS2B FJ639774 |
| DENV3 NS2B EU081220 | DENV3 NS2B EU081188 | DENV3 NS2B FJ850097 | DENV3 NS2B GU131915 |
| DENV3 NS2B GQ868546 | DENV3 NS2B DQ401690 | DENV3 NS2B FJ850083 | DENV3 NS2B AY676348 |
| DENV3 NS2B FJ639805 | DENV3 NS2B EU482462 | DENV3 NS2B FJ639722 | DENV3 NS2B AY679147 |
| DENV3 NS2B EU854291 | DENV3 NS2B FJ898440 | DENV3 NS2B AB189127 | DENV3 NS2B FJ850056 |

FIG. 68-46

| Virus Protein Accession No. | Virus Protein Accession No. | Virus Protein Accession No. | Virus Protein Accession No. |
|---|---|---|---|
| DENV3 NS2B FJ562107 | DENV3 NS2B EU660420 | DENV3 NS2B EU081189 | DENV3 NS2B GQ199864 |
| DENV3 NS2B FJ639759 | DENV3 NS2B GQ199865 | DENV3 NS2B DQ675531 | DENV3 NS2B NC_001475 |
| DENV3 NS2B DQ675519 | DENV3 NS2B EU726771 | DENV3 NS2B FJ639750 | DENV3 NS2B FN429905 |
| DENV3 NS2B GU131904 | DENV3 NS2B FJ810414 | DENV3 NS2B AY676350 | DENV3 NS2B EU482459 |
| DENV3 NS2B FJ461338 | DENV3 NS2B GQ868572 | DENV3 NS2B FJ898441 | DENV3 NS2B FJ898459 |
| DENV3 NS2B FJ639715 | DENV3 NS2B FJ898473 | DENV3 NS2B FJ024471 | DENV3 NS2B FJ639716 |
| DENV3 NS2B FJ024466 | DENV3 NS2B EU687196 | DENV3 NS2B EU081221 | DENV3 NS2B FJ547073 |
| DENV3 NS2B FJ898447 | DENV3 NS2B FJ639799 | DENV3 NS2B FJ461326 | DENV3 NS2B GQ868586 |
| DENV3 NS2B EU081184 | DENV3 NS2B EU687219 | DENV3 NS2B GU131854 | DENV3 NS2B FJ639763 |
| DENV3 NS2B EU482595 | DENV3 NS2B FJ898442 | DENV3 NS2B FJ432722 | DENV3 NS2B EU081216 |
| DENV3 NS2B GQ199871 | DENV3 NS2B FN429906 | DENV3 NS2B FJ410178 | DENV3 NS2B FJ410229 |
| DENV3 NS2B AY744681 | DENV3 NS2B FJ390371 | DENV3 NS2B EU081223 | DENV3 NS2B FJ898464 |
| DENV3 NS2B EU081213 | DENV3 NS2B FJ639730 | DENV3 NS2B DQ675523 | DENV3 NS2B EU482452 |
| DENV3 NS2B FJ024470 | DENV3 NS2B EF629368 | DENV3 NS2B EU482563 | DENV3 NS2B FJ744729 |
| DENV3 NS2B AY876494 | DENV3 NS2B EU081215 | DENV3 NS2B FJ547076 | DENV3 NS2B AY766104 |
| DENV3 NS2B AY662691 | DENV3 NS2B EU081181 | DENV3 NS2B GU131874 | DENV3 NS2B EU687218 |
| DENV3 NS2B EU687221 | DENV3 NS2B FN429913 | DENV3 NS2B FJ547082 | DENV3 NS2B FJ898474 |
| DENV3 NS2B FN429910 | DENV3 NS2B GU131935 | DENV3 NS2B FJ461337 | DENV3 NS2B GU131910 |
| DENV3 NS2B GU131944 | DENV3 NS2B FJ182007 | DENV3 NS2B FJ547083 | DENV3 NS2B GU131916 |
| DENV3 NS2B AY496877 | DENV3 NS2B FJ639751 | DENV3 NS2B FJ639760 | DENV3 NS2B GQ199863 |
| DENV3 NS2B EF629370 | DENV3 NS2B FJ639827 | DENV3 NS2B GU131853 | DENV3 NS2B FJ639724 |
| DENV3 NS2B FJ639775 | DENV3 NS2B EU367962 | DENV3 NS2B FJ639769 | DENV3 NS2B FJ639798 |
| DENV3 NS2B GU131952 | DENV3 NS2B DQ401689 | DENV3 NS2B GQ868629 | DENV3 NS2B EU081222 |
| DENV3 NS2B EU529705 | DENV3 NS2B FJ639780 | DENV3 NS2B EU081183 | DENV3 NS2B FJ639803 |

FIG. 68-47

| Virus Protein | Accession No. | Virus Protein | Accession No. | Virus Protein | Accession No. | Virus Protein | Accession No. |
|---|---|---|---|---|---|---|---|
| DENV3 NS2B | CS805345 | DENV3 NS2B | GQ868571 | DENV3 NS2B | FJ182041 | DENV3 NS2B | FJ850086 |
| DENV3 NS2B | AY648961 | DENV3 NS2B | AY744683 | DENV3 NS2B | AY496879 | DENV3 NS2B | FJ639810 |
| DENV3 NS2B | FJ432731 | DENV3 NS2B | FJ639756 | DENV3 NS2B | EU529697 | DENV3 NS2B | FJ882578 |
| DENV3 NS2B | FJ562102 | DENV3 NS2B | FJ547062 | DENV3 NS2B | GQ199891 | DENV3 NS2B | GU131851 |
| DENV3 NS2B | EU081193 | DENV3 NS2B | AB189128 | DENV3 NS2B | EU932687 | DENV3 NS2B | GU131940 |
| DENV3 NS2B | FJ639754 | DENV3 NS2B | FJ182009 | DENV3 NS2B | GQ868548 | DENV3 NS2B | EU482555 |
| DENV3 NS2B | AF317645 | DENV3 NS2B | FJ810416 | DENV3 NS2B | FJ744728 | DENV3 NS2B | GU131938 |
| DENV3 NS2B | GU131865 | DENV3 NS2B | EF629367 | DENV3 NS2B | FJ639825 | DENV3 NS2B | EU529696 |
| DENV3 NS2B | FJ898445 | DENV3 NS2B | GU131852 | DENV3 NS2B | FN429911 | DENV3 NS2B | DQ401695 |
| DENV3 NS2B | FJ182006 | DENV3 NS2B | AY858048 | DENV3 NS2B | GU131914 | DENV3 NS2B | EU726773 |
| DENV3 NS2B | FJ547069 | DENV3 NS2B | FN429897 | DENV3 NS2B | GU131945 | DENV3 NS2B | GQ868616 |
| DENV3 NS2B | GU131858 | DENV3 NS2B | GU131950 | DENV3 NS2B | FJ898472 | DENV3 NS2B | EU482596 |
| DENV3 NS2B | EU687234 | DENV3 NS2B | FN429896 | DENV3 NS2B | FJ547074 | DENV3 NS2B | AY858042 |
| DENV3 NS2B | FJ639791 | DENV3 NS2B | GU131905 | DENV3 NS2B | FJ461329 | DENV3 NS2B | FJ205871 |
| DENV3 NS2B | FJ850092 | DENV3 NS2B | FJ639789 | DENV3 NS2B | FJ898469 | DENV3 NS2B | GU131860 |
| DENV3 NS2B | FJ390377 | DENV3 NS2B | FB667400 | DENV3 NS2B | FJ639776 | DENV3 NS2B | EU482457 |
| DENV3 NS2B | EU529704 | DENV3 NS2B | FJ390373 | DENV3 NS2B | FJ744726 | DENV3 NS2B | GQ199862 |
| DENV3 NS2B | FJ547075 | DENV3 NS2B | EU482460 | DENV3 NS2B | FJ850111 | DENV3 NS2B | EU529703 |
| DENV3 NS2B | GU131936 | DENV3 NS2B | FJ639753 | DENV3 NS2B | EU081204 | DENV3 NS2B | FJ639782 |
| DENV3 NS2B | GU131903 | DENV3 NS2B | FJ687448 | DENV3 NS2B | FJ639761 | DENV3 NS2B | GU131908 |
| DENV3 NS2B | DQ401694 | DENV3 NS2B | FJ639731 | DENV3 NS2B | EU081194 | DENV3 NS2B | AY858039 |
| DENV3 NS2B | EU081205 | DENV3 NS2B | FN429907 | DENV3 NS2B | FJ639725 | DENV3 NS2B | EU081214 |
| DENV3 NS2B | FJ850089 | DENV3 NS2B | EU529684 | DENV3 NS2B | GQ868628 | DENV3 NS2B | EF629366 |
| DENV3 NS2B | FJ898470 | DENV3 NS2B | FJ882572 | DENV3 NS2B | FJ639785 | DENV3 NS2B | FJ639800 |

FIG. 68-48

| Virus Protein | Accession No. | Virus Protein | Accession No. | Virus Protein | Accession No. | Virus Protein | Accession No. |
|---|---|---|---|---|---|---|---|
| DENV3 NS2B | FJ182008 | DENV3 NS2B | FJ182010 | DENV3 NS2B | FJ850110 | DENV3 NS3 | EU596493 |
| DENV3 NS2B | AY744680 | DENV3 NS2B | AB214879 | DENV3 NS2B | AY744679 | DENV3 NS3 | GQ868634 |
| DENV3 NS2B | GU131918 | DENV3 NS2B | EU081203 | DENV3 NS2B | GU131850 | DENV3 NS3 | AB214880 |
| DENV3 NS2B | FJ639755 | DENV3 NS2B | EU854298 | DENV3 NS2B | FJ850094 | DENV3 NS3 | FJ639767 |
| DENV3 NS2B | FJ639719 | DENV3 NS2B | FJ562097 | DENV3 NS2B | FJ639784 | DENV3 NS3 | EF629373 |
| DENV3 NS2B | DQ675533 | DENV3 NS2B | FJ547071 | DENV3 NS2B | FJ850080 | DENV3 NS3 | AY858041 |
| DENV3 NS2B | GU131939 | DENV3 NS2B | FJ390372 | DENV3 NS2B | DQ675529 | DENV3 NS3 | AY744678 |
| DENV3 NS2B | FJ639749 | DENV3 NS2B | GU131946 | DENV3 NS2B | FJ850079 | DENV3 NS3 | GQ199860 |
| DENV3 NS2B | GU131848 | DENV3 NS2B | EU529685 | DENV3 NS2B | FJ547079 | DENV3 NS3 | FJ373302 |
| DENV3 NS2B | GU131906 | DENV3 NS2B | EU081219 | DENV3 NS2B | GU131909 | DENV3 NS3 | FJ390375 |
| DENV3 NS2B | GQ868627 | DENV3 NS2B | FN429918 | DENV3 NS2B | FJ205870 | DENV3 NS3 | FJ639801 |
| DENV3 NS2B | GU131859 | DENV3 NS2B | FJ744727 | DENV3 NS2B | AY496871 | DENV3 NS3 | DQ675522 |
| DENV3 NS2B | FJ182011 | DENV3 NS2B | FJ744732 | DENV3 NS2B | AY858043 | DENV3 NS3 | FJ639771 |
| DENV3 NS2B | AY858038 | DENV3 NS2B | FJ898446 | DENV3 NS2B | EU596492 | DENV3 NS3 | EU781137 |
| DENV3 NS2B | GU131943 | DENV3 NS2B | FJ882571 | DENV3 NS2B | GU131937 | DENV3 NS3 | GU131844 |
| DENV3 NS2B | FJ547085 | DENV3 NS2B | FJ744733 | DENV3 NS2B | GU131875 | DENV3 NS3 | FJ639747 |
| DENV3 NS2B | GU131953 | DENV3 NS2B | GQ199861 | DENV3 NS2B | EU081191 | DENV3 NS3 | CS477305 |
| DENV3 NS2B | EU482564 | DENV3 NS2B | FJ873813 | DENV3 NS2B | AY858040 | DENV3 NS3 | FJ562099 |
| DENV3 NS2B | GQ199887 | DENV3 NS2B | FJ639762 | DENV3 NS2B | EU482458 | DENV3 NS3 | FJ898455 |
| DENV3 NS2B | DQ675524 | DENV3 NS2B | EU081186 | DENV3 NS2B | EU687197 | DENV3 NS3 | FJ639817 |
| DENV3 NS2B | EU596494 | DENV3 NS2B | EU081225 | DENV3 NS2B | FJ177308 | DENV3 NS3 | EU081185 |
| DENV3 NS2B | EU726772 | DENV3 NS2B | GQ868547 | DENV3 NS2B | DQ401693 | DENV3 NS3 | FJ182037 |
| DENV3 NS2B | FJ898471 | DENV3 NS2B | GU131878 | DENV3 NS2B | EF629373 | DENV3 NS3 | EU482455 |
| DENV3 NS2B | EU569691 | DENV3 NS2B | EU569690 | DENV3 NS3 | FN429898 | DENV3 NS3 | AY858046 |
| | | | | DENV3 NS3 | GQ868576 | DENV3 NS3 | M93130 |
| | | | | | | DENV3 NS3 | FJ850052 |
| | | | | | | DENV3 NS3 | EU660407 |
| | | | | | | DENV3 NS3 | FJ024465 |
| | | | | | | DENV3 NS3 | FJ461334 |
| | | | | | | DENV3 NS3 | FN429917 |
| | | | | | | DENV3 NS3 | GQ868593 |
| | | | | | | DENV3 NS3 | GU131866 |
| | | | | | | DENV3 NS3 | EU482559 |
| | | | | | | DENV3 NS3 | EU081201 |
| | | | | | | DENV3 NS3 | FJ373304 |
| | | | | | | DENV3 NS3 | FN429915 |
| | | | | | | DENV3 NS3 | EU529687 |
| | | | | | | DENV3 NS3 | EU081208 |
| | | | | | | DENV3 NS3 | GU131951 |
| | | | | | | DENV3 NS3 | FJ898468 |
| | | | | | | DENV3 NS3 | GU131846 |
| | | | | | | DENV3 NS3 | FJ547078 |
| | | | | | | DENV3 NS3 | FJ898457 |
| | | | | | | DENV3 NS3 | FJ639795 |
| | | | | | | DENV3 NS3 | FJ639757 |
| | | | | | | DENV3 NS3 | EU569689 |
| | | | | | | DENV3 NS3 | DQ401691 |
| | | | | | | DENV3 NS3 | FN429908 |

FIG. 68-49

| Virus Protein Accession No. | Virus Protein Accession No. | Virus Protein Accession No. | Virus Protein Accession No. |
|---|---|---|---|
| DENV3 NS3EU482566 | DENV3 NS3GU189648 | DENV3 NS3GU131915 | DENV3 NS3EU081222 |
| DENV3 NS3EU687233 | DENV3 NS3EU660409 | DENV3 NS3FJ850056 | DENV3 NS3CS805345 |
| DENV3 NS3AY496874 | DENV3 NS3FJ373306 | DENV3 NS3FJ562107 | DENV3 NS3AY648961 |
| DENV3 NS3GU131862 | DENV3 NS3FJ898463 | DENV3 NS3FJ639759 | DENV3 NS3FJ562102 |
| DENV3 NS3EU482614 | DENV3 NS3FJ410177 | DENV3 NS3DQ675519 | DENV3 NS3EU081193 |
| DENV3 NS3GU131872 | DENV3 NS3DQ675530 | DENV3 NS3FJ639715 | DENV3 NS3FJ639754 |
| DENV3 NS3FJ639770 | DENV3 NS3FJ744730 | DENV3 NS3FJ024466 | DENV3 NS3GU131865 |
| DENV3 NS3FJ810413 | DENV3 NS3EU081206 | DENV3 NS3FJ898447 | DENV3 NS3GU131858 |
| DENV3 NS3GU131861 | DENV3 NS3EU529691 | DENV3 NS3EU081184 | DENV3 NS3FJ639791 |
| DENV3 NS3FJ182040 | DENV3 NS3EU081220 | DENV3 NS3EU482595 | DENV3 NS3EU529704 |
| DENV3 NS3FJ882573 | DENV3 NS3GQ868546 | DENV3 NS3GQ199871 | DENV3 NS3GU131936 |
| DENV3 NS3EU529699 | DENV3 NS3FJ639805 | DENV3 NS3FJ024470 | DENV3 NS3GU131903 |
| DENV3 NS3FJ744735 | DENV3 NS3EU854291 | DENV3 NS3FN429910 | DENV3 NS3DQ401694 |
| DENV3 NS3FJ024468 | DENV3 NS3EU081196 | DENV3 NS3AY496877 | DENV3 NS3EU081205 |
| DENV3 NS3AY744685 | DENV3 NS3FJ182039 | DENV3 NS3EF629370 | DENV3 NS3FJ898470 |
| DENV3 NS3DQ675527 | DENV3 NS3GU131877 | DENV3 NS3FJ639775 | DENV3 NS3GQ868571 |
| DENV3 NS3AY744682 | DENV3 NS3DQ675520 | DENV3 NS3GU131952 | DENV3 NS3AB189128 |
| DENV3 NS3EU529683 | DENV3 NS3FJ024467 | DENV3 NS3EU660420 | DENV3 NS3FJ182009 |
| DENV3 NS3FJ639777 | DENV3 NS3FN429903 | DENV3 NS3GQ199865 | DENV3 NS3FJ810416 |
| DENV3 NS3EU529692 | DENV3 NS3FJ744738 | DENV3 NS3FJ810414 | DENV3 NS3GU131852 |
| DENV3 NS3FJ898476 | DENV3 NS3EU081188 | DENV3 NS3FJ639799 | DENV3 NS3FN429897 |
| DENV3 NS3EU081211 | DENV3 NS3EU482462 | DENV3 NS3EU687219 | DENV3 NS3GU131950 |
| DENV3 NS3FJ547066 | DENV3 NS3FJ898440 | DENV3 NS3FJ898442 | DENV3 NS3FN429896 |
| DENV3 NS3FJ882577 | DENV3 NS3GQ252678 | DENV3 NS3FJ390371 | DENV3 NS3FJ639789 |
| DENV3 NS3FN429900 | DENV3 NS3FJ882575 | DENV3 NS3EF629368 | DENV3 NS3FJ390373 |
| DENV3 NS3FJ639765 | DENV3 NS3FJ639727 | DENV3 NS3EU081181 | DENV3 NS3FJ687448 |
| DENV3 NS3EU726769 | DENV3 NS3GU131870 | DENV3 NS3FJ182007 | DENV3 NS3FJ639731 |
| DENV3 NS3GQ199888 | DENV3 NS3FJ639826 | DENV3 NS3FJ639827 | DENV3 NS3FN429907 |
| DENV3 NS3FJ639786 | DENV3 NS3GU131934 | DENV3 NS3EU367962 | DENV3 NS3AY496879 |
| DENV3 NS3FJ478456 | DENV3 NS3EF643017 | DENV3 NS3DQ401689 | DENV3 NS3EU529697 |
| DENV3 NS3GQ868617 | DENV3 NS3GU131856 | DENV3 NS3DQ675531 | DENV3 NS3FJ744728 |
| DENV3 NS3FJ898444 | DENV3 NS3DQ675525 | DENV3 NS3FJ639750 | DENV3 NS3FJ639825 |
| DENV3 NS3GU370052 | DENV3 NS3FJ850097 | DENV3 NS3FJ461326 | DENV3 NS3GU131914 |
| DENV3 NS3EU660411 | DENV3 NS3FJ639722 | DENV3 NS3GU131854 | DENV3 NS3FJ898472 |
| DENV3 NS3EU482453 | DENV3 NS3AB189127 | DENV3 NS3FJ432722 | DENV3 NS3FJ547074 |
| DENV3 NS3FJ182005 | DENV3 NS3FJ639720 | DENV3 NS3DQ675523 | DENV3 NS3FJ898469 |
| DENV3 NS3GQ868574 | DENV3 NS3FJ639729 | DENV3 NS3FJ547076 | DENV3 NS3FJ744726 |
| DENV3 NS3GU131941 | DENV3 NS3GU131868 | DENV3 NS3FJ461337 | DENV3 NS3FJ639725 |
| DENV3 NS3EU529689 | DENV3 NS3FJ639793 | DENV3 NS3FJ639769 | DENV3 NS3GU131851 |
| DENV3 NS3GU131954 | DENV3 NS3GU363549 | DENV3 NS3GQ868629 | DENV3 NS3EU482555 |
| DENV3 NS3AY676352 | DENV3 NS3FJ850109 | DENV3 NS3FN429905 | DENV3 NS3GU131938 |
| DENV3 NS3AY099337 | DENV3 NS3EU081218 | DENV3 NS3FJ898459 | DENV3 NS3EU726773 |
| DENV3 NS3FJ182015 | DENV3 NS3FJ547081 | DENV3 NS3GQ868586 | DENV3 NS3GQ868616 |
| DENV3 NS3FJ850049 | DENV3 NS3GU131912 | DENV3 NS3EU081216 | DENV3 NS3GQ199862 |
| DENV3 NS3FJ639713 | DENV3 NS3AY923865 | DENV3 NS3EU482452 | DENV3 NS3GU131908 |
| DENV3 NS3CS479205 | DENV3 NS3AY858045 | DENV3 NS3AY766104 | DENV3 NS3AY858039 |
| DENV3 NS3GQ868577 | DENV3 NS3FJ547084 | DENV3 NS3FJ898474 | DENV3 NS3EU081214 |
| DENV3 NS3EU081198 | DENV3 NS3FJ639774 | DENV3 NS3FJ639724 | DENV3 NS3EF629366 |

FIG. 68-50

| Virus Protein Accession No. | Virus Protein Accession No. | Virus Protein Accession No. | Virus Protein Accession No. |
|---|---|---|---|
| DENV3 NS3AY744680 | DENV3 NS3FJ744740 | DENV3 NS3FN429914 | DENV3 NS3EU482558 |
| DENV3 NS3FJ639755 | DENV3 NS3EU854292 | DENV3 NS3FJ639768 | DENV3 NS3FN429899 |
| DENV3 NS3DQ675533 | DENV3 NS3FN429902 | DENV3 NS3FJ547061 | DENV3 NS3EU660410 |
| DENV3 NS3GU131906 | DENV3 NS3GU131907 | DENV3 NS3GU131917 | DENV3 NS3AY858044 |
| DENV3 NS3GQ868627 | DENV3 NS3EU482612 | DENV3 NS3FJ432728 | DENV3 NS3EU726768 |
| DENV3 NS3GU131943 | DENV3 NS3GU131849 | DENV3 NS3EU482456 | DENV3 NS3FJ639766 |
| DENV3 NS3EU482564 | DENV3 NS3FJ373303 | DENV3 NS3GU370053 | DENV3 NS3EU529698 |
| DENV3 NS3GQ199887 | DENV3 NS3EU081224 | DENV3 NS3FJ744736 | DENV3 NS3EU687239 |
| DENV3 NS3EU726772 | DENV3 NS3FJ873812 | DENV3 NS3DQ675532 | DENV3 NS3DQ675528 |
| DENV3 NS3FJ182010 | DENV3 NS3FJ744734 | DENV3 NS3FN429904 | DENV3 NS3FJ639807 |
| DENV3 NS3EU081203 | DENV3 NS3FJ850096 | DENV3 NS3FJ744731 | DENV3 NS3FJ898475 |
| DENV3 NS3FJ562097 | DENV3 NS3FJ639787 | DENV3 NS3FJ744737 | DENV3 NS3EU081200 |
| DENV3 NS3FJ547071 | DENV3 NS3FJ882574 | DENV3 NS3AY858037 | DENV3 NS3FJ390376 |
| DENV3 NS3GU131946 | DENV3 NS3GU131873 | DENV3 NS3FJ547077 | DENV3 NS3EU529702 |
| DENV3 NS3EU529685 | DENV3 NS3GU131867 | DENV3 NS3EU569688 | DENV3 NS3FJ639781 |
| DENV3 NS3EU081219 | DENV3 NS3GQ199889 | DENV3 NS3GU131871 | DENV3 NS3FJ182004 |
| DENV3 NS3FJ882571 | DENV3 NS3GQ252674 | DENV3 NS3GU131845 | DENV3 NS3FJ898443 |
| DENV3 NS3FJ639762 | DENV3 NS3EU687198 | DENV3 NS3EU081195 | DENV3 NS3AY744684 |
| DENV3 NS3EU081186 | DENV3 NS3FJ432743 | DENV3 NS3FJ898456 | DENV3 NS3FJ850048 |
| DENV3 NS3GQ868547 | DENV3 NS3FJ461322 | DENV3 NS3EU081187 | DENV3 NS3GQ868575 |
| DENV3 NS3GU131878 | DENV3 NS3GQ868626 | DENV3 NS3GU131847 | DENV3 NS3FJ562100 |
| DENV3 NS3EU569690 | DENV3 NS3FJ639728 | DENV3 NS3EU081207 | DENV3 NS3GU131942 |
| DENV3 NS3FJ850110 | DENV3 NS3FJ639758 | DENV3 NS3FJ410176 | DENV3 NS3EU529688 |
| DENV3 NS3AY744679 | DENV3 NS3AY776329 | DENV3 NS3AY770511 | DENV3 NS3DQ401690 |
| DENV3 NS3FJ639784 | DENV3 NS3FJ639721 | DENV3 NS3GU131933 | DENV3 NS3EF629369 |
| DENV3 NS3FJ850080 | DENV3 NS3FJ547080 | DENV3 NS3GQ199870 | DENV3 NS3FJ639714 |
| DENV3 NS3FJ205870 | DENV3 NS3FJ639778 | DENV3 NS3FJ850098 | DENV3 NS3AY676351 |
| DENV3 NS3AY858043 | DENV3 NS3EU081192 | DENV3 NS3AB189125 | DENV3 NS3GQ868573 |
| DENV3 NS3EU596492 | DENV3 NS3GQ199886 | DENV3 NS3FJ432741 | DENV3 NS3AY099336 |
| DENV3 NS3GU131875 | DENV3 NS3GQ868587 | DENV3 NS3EU529690 | DENV3 NS3EU081182 |
| DENV3 NS3EU081191 | DENV3 NS3DQ675521 | DENV3 NS3FJ639804 | DENV3 NS3GU131855 |
| DENV3 NS3AY858040 | DENV3 NS3FJ182013 | DENV3 NS3FJ182038 | DENV3 NS3DQ863638 |
| DENV3 NS3EU482458 | DENV3 NS3FJ882576 | DENV3 NS3DQ675526 | DENV3 NS3FJ639746 |
| DENV3 NS3EU687197 | DENV3 NS3FN429916 | DENV3 NS3GU131857 | DENV3 NS3EU482454 |
| DENV3 NS3GQ868578 | DENV3 NS3GU131913 | DENV3 NS3AB214882 | DENV3 NS3EU081197 |
| DENV3 NS3GU131876 | DENV3 NS3EU781136 | DENV3 NS3EU081217 | DENV3 NS3EU081212 |
| DENV3 NS3FJ547072 | DENV3 NS3FJ639726 | DENV3 NS3FJ024469 | DENV3 NS3FJ850083 |
| DENV3 NS3FJ639779 | DENV3 NS3EU081209 | DENV3 NS3AB214881 | DENV3 NS3EU660408 |
| DENV3 NS3FJ562103 | DENV3 NS3FJ639712 | DENV3 NS3GU131911 | DENV3 NS3FJ639752 |
| DENV3 NS3DQ401692 | DENV3 NS3EU482461 | DENV3 NS3GU131869 | DENV3 NS3AY676349 |
| DENV3 NS3FJ639792 | DENV3 NS3AY858047 | DENV3 NS3EU932688 | DENV3 NS3FJ898462 |
| DENV3 NS3AY496873 | DENV3 NS3AY676353 | DENV3 NS3FJ547070 | DENV3 NS3FN429912 |
| DENV3 NS3FN429909 | DENV3 NS3EU081210 | DENV3 NS3FJ639790 | DENV3 NS3EU529686 |
| DENV3 NS3FJ639816 | DENV3 NS3EU081199 | DENV3 NS3FJ639772 | DENV3 NS3FJ744739 |
| DENV3 NS3FJ744700 | DENV3 NS3EU726774 | DENV3 NS3EU081190 | DENV3 NS3AY676348 |
| DENV3 NS3EU081202 | DENV3 NS3AY744677 | DENV3 NS3FJ639723 | DENV3 NS3AY679147 |
| DENV3 NS3AB189126 | DENV3 NS3FN429901 | DENV3 NS3EU482613 | DENV3 NS3GU131904 |
| DENV3 NS3FJ898458 | DENV3 NS3EU687226 | DENV3 NS3FJ850055 | DENV3 NS3FJ461338 |

FIG. 68-51

| Virus Protein Accession No. | Virus Protein Accession No. | Virus Protein Accession No. | Virus Protein Accession No. |
|---|---|---|---|
| DENV3 NS3EU081213 | DENV3 NS3AF317645 | DENV3 NS3GU131918 | DENV3 NS4A |
| DENV3 NS3AY744681 | DENV3 NS3FJ898445 | DENV3 NS3FJ182008 | FJ547072 |
| DENV3 NS3AY662691 | DENV3 NS3FJ182006 | DENV3 NS3FJ639719 | DENV3 NS4A |
| DENV3 NS3AY876494 | DENV3 NS3FJ547069 | DENV3 NS3GU131939 | AB214880 |
| DENV3 NS3GU131944 | DENV3 NS3EU687234 | DENV3 NS3FJ639749 | DENV3 NS4A |
| DENV3 NS3EU687221 | DENV3 NS3FJ850092 | DENV3 NS3GU131848 | FJ639767 |
| DENV3 NS3EU529705 | DENV3 NS3FJ390377 | DENV3 NS3GU131859 | DENV3 NS4A |
| DENV3 NS3EU726771 | DENV3 NS3FJ547075 | DENV3 NS3FJ182011 | FJ639779 |
| DENV3 NS3GQ868572 | DENV3 NS3FJ850089 | DENV3 NS3AY858038 | DENV3 NS4A |
| DENV3 NS3FJ898473 | DENV3 NS3AY744683 | DENV3 NS3FJ547085 | FJ562103 |
| DENV3 NS3EU687196 | DENV3 NS3FJ639756 | DENV3 NS3GU131953 | DENV3 NS4A |
| DENV3 NS3FN429906 | DENV3 NS3FJ547062 | DENV3 NS3DQ675524 | EF629373 |
| DENV3 NS3FJ639730 | DENV3 NS3EF629367 | DENV3 NS3FJ898471 | DENV3 NS4A |
| DENV3 NS3EU081215 | DENV3 NS3AY858048 | DENV3 NS3EU596494 | DQ401692 |
| DENV3 NS3GU131935 | DENV3 NS3GU131905 | DENV3 NS3EU569691 | DENV3 NS4A |
| DENV3 NS3FN429913 | DENV3 NS3FB667400 | DENV3 NS3AB214879 | FJ639792 |
| DENV3 NS3FJ639751 | DENV3 NS3EU482460 | DENV3 NS3EU854298 | DENV3 NS4A |
| DENV3 NS3FJ639780 | DENV3 NS3FJ639753 | DENV3 NS3FJ390372 | AY858041 |
| DENV3 NS3EU081189 | DENV3 NS3FJ882572 | DENV3 NS3FN429918 | DENV3 NS4A |
| DENV3 NS3AY676350 | DENV3 NS3EU529684 | DENV3 NS3FJ744727 | FN429909 |
| DENV3 NS3FJ898441 | DENV3 NS3FJ182041 | DENV3 NS3FJ744732 | DENV3 NS4A |
| DENV3 NS3FJ024471 | DENV3 NS3GQ199891 | DENV3 NS3FJ898446 | AY496873 |
| DENV3 NS3EU081221 | DENV3 NS3EU932687 | DENV3 NS3FJ744733 | DENV3 NS4A |
| DENV3 NS3EU081223 | DENV3 NS3GQ868548 | DENV3 NS3FJ873813 | FJ744700 |
| DENV3 NS3FJ410178 | DENV3 NS3FN429911 | DENV3 NS3GQ199861 | DENV3 NS4A |
| DENV3 NS3EU482563 | DENV3 NS3GU131945 | DENV3 NS3EU081225 | AY744678 |
| DENV3 NS3GU131874 | DENV3 NS3FJ461329 | DENV3 NS3GU131850 | DENV3 NS4A |
| DENV3 NS3FJ547082 | DENV3 NS3FJ850111 | DENV3 NS3FJ850094 | FJ639816 |
| DENV3 NS3FJ547083 | DENV3 NS3FJ639776 | DENV3 NS3DQ675529 | DENV3 NS4A |
| DENV3 NS3FJ639760 | DENV3 NS3EU081194 | DENV3 NS3FJ850079 | EU081202 |
| DENV3 NS3GU131853 | DENV3 NS3FJ639761 | DENV3 NS3FJ547079 | DENV3 NS4A |
| DENV3 NS3EU081183 | DENV3 NS3EU081204 | DENV3 NS3GU131909 | AB189126 |
| DENV3 NS3GQ199864 | DENV3 NS3GQ868628 | DENV3 NS3AY496871 | DENV3 NS4A |
| DENV3 NS3NC_001475 | DENV3 NS3FJ850086 | DENV3 NS3GU131937 | GQ199860 |
| DENV3 NS3EU482459 | DENV3 NS3FJ639785 | DENV3 NS3DQ401693 | DENV3 NS4A |
| DENV3 NS3FJ639716 | DENV3 NS3FJ639810 | DENV3 NS3FJ177308 | FJ373302 |
| DENV3 NS3FJ547073 | DENV3 NS3FJ882578 | DENV3 NS4A | DENV3 NS4A |
| DENV3 NS3FJ639763 | DENV3 NS3GU131940 | FN429898 | FJ390375 |
| DENV3 NS3FJ410229 | DENV3 NS3DQ401695 | DENV3 NS4A | DENV3 NS4A |
| DENV3 NS3FJ898464 | DENV3 NS3EU529696 | GQ868576 | FJ744740 |
| DENV3 NS3FJ744729 | DENV3 NS3AY858042 | DENV3 NS4A | DENV3 NS4A |
| DENV3 NS3EU687218 | DENV3 NS3EU482596 | GQ868578 | FJ898458 |
| DENV3 NS3GU131910 | DENV3 NS3FJ205871 | DENV3 NS4A | DENV3 NS4A |
| DENV3 NS3GU131916 | DENV3 NS3GU131860 | EU596493 | FJ639801 |
| DENV3 NS3GQ199863 | DENV3 NS3EU482457 | DENV3 NS4A | DENV3 NS4A |
| DENV3 NS3FJ639798 | DENV3 NS3EU529703 | GQ868634 | EU854292 |
| DENV3 NS3FJ639803 | DENV3 NS3FJ639782 | DENV3 NS4A | DENV3 NS4A |
| DENV3 NS3FJ432731 | DENV3 NS3FJ639800 | GU131876 | FN429902 |

FIG. 68-52

| Virus Protein | Accession No. | Virus Protein | Accession No. | Virus Protein | Accession No. | Virus Protein | Accession No. |
|---|---|---|---|---|---|---|---|
| DENV3 NS4A | DQ675522 | DENV3 NS4A | EU482455 | DENV3 NS4A | EU482559 | DENV3 NS4A | DQ401691 |
| DENV3 NS4A | GU131907 | DENV3 NS4A | GQ252674 | DENV3 NS4A | DQ675521 | DENV3 NS4A | FN429908 |
| DENV3 NS4A | GU131849 | DENV3 NS4A | AY858046 | DENV3 NS4A | FJ182013 | DENV3 NS4A | EU482566 |
| DENV3 NS4A | EU482612 | DENV3 NS4A | M93130 | DENV3 NS4A | EU081201 | DENV3 NS4A | EU482461 |
| DENV3 NS4A | FJ639771 | DENV3 NS4A | EU687198 | DENV3 NS4A | FJ373304 | DENV3 NS4A | EU687233 |
| DENV3 NS4A | EU781137 | DENV3 NS4A | FJ432743 | DENV3 NS4A | FN429915 | DENV3 NS4A | AY496874 |
| DENV3 NS4A | FJ373303 | DENV3 NS4A | FJ461322 | DENV3 NS4A | FJ882576 | DENV3 NS4A | AY858047 |
| DENV3 NS4A | FJ873812 | DENV3 NS4A | GQ868626 | DENV3 NS4A | EU529687 | DENV3 NS4A | GU131862 |
| DENV3 NS4A | EU081224 | DENV3 NS4A | FJ850052 | DENV3 NS4A | GU131913 | DENV3 NS4A | EU482614 |
| DENV3 NS4A | FJ850096 | DENV3 NS4A | EU660407 | DENV3 NS4A | FN429916 | DENV3 NS4A | AY676353 |
| DENV3 NS4A | FJ744734 | DENV3 NS4A | FJ639728 | DENV3 NS4A | EU081208 | DENV3 NS4A | GU131872 |
| DENV3 NS4A | GU131844 | DENV3 NS4A | FJ024465 | DENV3 NS4A | GU131951 | DENV3 NS4A | EU081210 |
| DENV3 NS4A | FJ639747 | DENV3 NS4A | FJ639758 | DENV3 NS4A | FJ898468 | DENV3 NS4A | FJ639770 |
| DENV3 NS4A | CS477305 | DENV3 NS4A | FJ461334 | DENV3 NS4A | EF629376 | DENV3 NS4A | FJ810413 |
| DENV3 NS4A | FJ562099 | DENV3 NS4A | AY776329 | DENV3 NS4A | EU781136 | DENV3 NS4A | GU131861 |
| DENV3 NS4A | FJ898455 | DENV3 NS4A | FJ639721 | DENV3 NS4A | GU131846 | DENV3 NS4A | FJ182040 |
| DENV3 NS4A | GU131873 | DENV3 NS4A | FJ547080 | DENV3 NS4A | FJ547078 | DENV3 NS4A | FJ882573 |
| DENV3 NS4A | FJ882574 | DENV3 NS4A | FJ639778 | DENV3 NS4A | FJ639726 | DENV3 NS4A | EU081199 |
| DENV3 NS4A | FJ639787 | DENV3 NS4A | FN429917 | DENV3 NS4A | FJ898457 | DENV3 NS4A | EU529699 |
| DENV3 NS4A | GU131867 | DENV3 NS4A | GQ868593 | DENV3 NS4A | FJ639795 | DENV3 NS4A | FJ744735 |
| DENV3 NS4A | FJ639817 | DENV3 NS4A | GQ199886 | DENV3 NS4A | FJ639757 | DENV3 NS4A | FJ024468 |
| DENV3 NS4A | EU081185 | DENV3 NS4A | EU081192 | DENV3 NS4A | EU569689 | DENV3 NS4A | FN429901 |
| DENV3 NS4A | GQ199889 | DENV3 NS4A | GQ868587 | DENV3 NS4A | EU081209 | DENV3 NS4A | AY744677 |
| DENV3 NS4A | FJ182037 | DENV3 NS4A | GU131866 | DENV3 NS4A | FJ639712 | DENV3 NS4A | EU726774 |

FIG. 68-53

| Virus Protein Accession No. | Virus Protein Accession No. | Virus Protein Accession No. | Virus Protein Accession No. |
|---|---|---|---|
| DENV3 NS4A AY744685 | DENV3 NS4A AY858037 | DENV3 NS4A GU131941 | DENV3 NS4A GU131911 |
| DENV3 NS4A EU687226 | DENV3 NS4A FJ547077 | DENV3 NS4A GU131933 | DENV3 NS4A GU131869 |
| DENV3 NS4A DQ675527 | DENV3 NS4A FJ639765 | DENV3 NS4A EU529689 | DENV3 NS4A EU081198 |
| DENV3 NS4A FN429914 | DENV3 NS4A EU726769 | DENV3 NS4A GU131954 | DENV3 NS4A EU932688 |
| DENV3 NS4A FJ639768 | DENV3 NS4A GU131871 | DENV3 NS4A FJ850098 | DENV3 NS4A FJ547070 |
| DENV3 NS4A FJ547061 | DENV3 NS4A GQ199888 | DENV3 NS4A GQ199870 | DENV3 NS4A FJ639790 |
| DENV3 NS4A GU131917 | DENV3 NS4A EU569688 | DENV3 NS4A FJ432741 | DENV3 NS4A FJ639772 |
| DENV3 NS4A FJ432728 | DENV3 NS4A FJ639786 | DENV3 NS4A AB189125 | DENV3 NS4A EU081190 |
| DENV3 NS4A AY744682 | DENV3 NS4A GU131845 | DENV3 NS4A AY676352 | DENV3 NS4A EU482613 |
| DENV3 NS4A EU529683 | DENV3 NS4A FJ478456 | DENV3 NS4A FJ639804 | DENV3 NS4A FJ639723 |
| DENV3 NS4A EU482456 | DENV3 NS4A GQ868617 | DENV3 NS4A EU529690 | DENV3 NS4A GU189648 |
| DENV3 NS4A FJ639777 | DENV3 NS4A EU081195 | DENV3 NS4A AY099337 | DENV3 NS4A FJ850055 |
| DENV3 NS4A EU529692 | DENV3 NS4A FJ898456 | DENV3 NS4A FJ182015 | DENV3 NS4A EU482558 |
| DENV3 NS4A GU370053 | DENV3 NS4A FJ898444 | DENV3 NS4A FJ182038 | DENV3 NS4A EU660409 |
| DENV3 NS4A FJ744736 | DENV3 NS4A GU370052 | DENV3 NS4A FJ850049 | DENV3 NS4A FN429899 |
| DENV3 NS4A FJ898476 | DENV3 NS4A EU660411 | DENV3 NS4A DQ675526 | DENV3 NS4A FJ373306 |
| DENV3 NS4A DQ675532 | DENV3 NS4A EU081187 | DENV3 NS4A FJ639713 | DENV3 NS4A EU660410 |
| DENV3 NS4A EU081211 | DENV3 NS4A GU131847 | DENV3 NS4A GU131857 | DENV3 NS4A FJ898463 |
| DENV3 NS4A FJ547066 | DENV3 NS4A FJ410176 | DENV3 NS4A AB214882 | DENV3 NS4A AY858044 |
| DENV3 NS4A FN429904 | DENV3 NS4A EU482453 | DENV3 NS4A EU081217 | DENV3 NS4A EU726768 |
| DENV3 NS4A FJ744731 | DENV3 NS4A EU081207 | DENV3 NS4A FJ024469 | DENV3 NS4A FJ639766 |
| DENV3 NS4A FJ744737 | DENV3 NS4A FJ182005 | DENV3 NS4A CS479205 | DENV3 NS4A EU529698 |
| DENV3 NS4A FJ882577 | DENV3 NS4A AY770511 | DENV3 NS4A GQ868577 | DENV3 NS4A FJ410177 |
| DENV3 NS4A FN429900 | DENV3 NS4A GQ868574 | DENV3 NS4A AB214881 | DENV3 NS4A DQ675530 |

FIG. 68-54

| Virus Protein Accession No. | Virus Protein Accession No. | Virus Protein Accession No. | Virus Protein Accession No. |
|---|---|---|---|
| DENV3 NS4A FJ744730 | DENV3 NS4A GQ868575 | DENV3 NS4A GU131934 | DENV3 NS4A FN429912 |
| DENV3 NS4A DQ675528 | DENV3 NS4A FN429903 | DENV3 NS4A EU482454 | DENV3 NS4A AY923865 |
| DENV3 NS4A EU687239 | DENV3 NS4A FJ744738 | DENV3 NS4A EF643017 | DENV3 NS4A EU529686 |
| DENV3 NS4A EU081206 | DENV3 NS4A FJ562100 | DENV3 NS4A GU131856 | DENV3 NS4A FJ744739 |
| DENV3 NS4A FJ639807 | DENV3 NS4A GU131942 | DENV3 NS4A DQ675525 | DENV3 NS4A AY858045 |
| DENV3 NS4A EU529691 | DENV3 NS4A EU529688 | DENV3 NS4A EU081212 | DENV3 NS4A FJ547084 |
| DENV3 NS4A FJ898475 | DENV3 NS4A EF629369 | DENV3 NS4A EU081197 | DENV3 NS4A FJ639774 |
| DENV3 NS4A EU081220 | DENV3 NS4A EU081188 | DENV3 NS4A FJ850097 | DENV3 NS4A GU131915 |
| DENV3 NS4A GQ868546 | DENV3 NS4A DQ401690 | DENV3 NS4A FJ850083 | DENV3 NS4A AY676348 |
| DENV3 NS4A FJ639805 | DENV3 NS4A EU482462 | DENV3 NS4A FJ639722 | DENV3 NS4A AY679147 |
| DENV3 NS4A EU854291 | DENV3 NS4A FJ898440 | DENV3 NS4A AB189127 | DENV3 NS4A FJ850056 |
| DENV3 NS4A EU081200 | DENV3 NS4A GQ252678 | DENV3 NS4A FJ639720 | DENV3 NS4A FJ562107 |
| DENV3 NS4A EU081196 | DENV3 NS4A FJ882575 | DENV3 NS4A FJ639729 | DENV3 NS4A FJ639759 |
| DENV3 NS4A FJ182039 | DENV3 NS4A FJ639727 | DENV3 NS4A GU131868 | DENV3 NS4A DQ675519 |
| DENV3 NS4A GU131877 | DENV3 NS4A FJ639714 | DENV3 NS4A FJ639793 | DENV3 NS4A GU131904 |
| DENV3 NS4A DQ675520 | DENV3 NS4A GQ868573 | DENV3 NS4A FJ639752 | DENV3 NS4A FJ461338 |
| DENV3 NS4A FJ390376 | DENV3 NS4A AY676351 | DENV3 NS4A EU660408 | DENV3 NS4A FJ639715 |
| DENV3 NS4A EU529702 | DENV3 NS4A GU131870 | DENV3 NS4A GU363549 | DENV3 NS4A FJ024466 |
| DENV3 NS4A FJ639781 | DENV3 NS4A AY099336 | DENV3 NS4A FJ850109 | DENV3 NS4A FJ898447 |
| DENV3 NS4A FJ898443 | DENV3 NS4A EU081182 | DENV3 NS4A EU081218 | DENV3 NS4A EU081184 |
| DENV3 NS4A FJ182004 | DENV3 NS4A DQ863638 | DENV3 NS4A AY676349 | DENV3 NS4A EU482595 |
| DENV3 NS4A AY744684 | DENV3 NS4A GU131855 | DENV3 NS4A FJ547081 | DENV3 NS4A GQ199871 |
| DENV3 NS4A FJ850048 | DENV3 NS4A FJ639826 | DENV3 NS4A GU131912 | DENV3 NS4A AY744681 |
| DENV3 NS4A FJ024467 | DENV3 NS4A FJ639746 | DENV3 NS4A FJ898462 | DENV3 NS4A EU081213 |

FIG. 68-55

| Virus Protein Accession No. | Virus Protein Accession No. | Virus Protein Accession No. | Virus Protein Accession No. |
|---|---|---|---|
| DENV3 NS4A FJ024470 | DENV3 NS4A EF629368 | DENV3 NS4A EU482563 | DENV3 NS4A FJ744729 |
| DENV3 NS4A AY876494 | DENV3 NS4A EU081215 | DENV3 NS4A FJ547076 | DENV3 NS4A AY766104 |
| DENV3 NS4A AY662691 | DENV3 NS4A EU081181 | DENV3 NS4A GU131874 | DENV3 NS4A EU687218 |
| DENV3 NS4A EU687221 | DENV3 NS4A FN429913 | DENV3 NS4A FJ547082 | DENV3 NS4A FJ898474 |
| DENV3 NS4A FN429910 | DENV3 NS4A GU131935 | DENV3 NS4A FJ461337 | DENV3 NS4A GU131910 |
| DENV3 NS4A GU131944 | DENV3 NS4A FJ182007 | DENV3 NS4A FJ547083 | DENV3 NS4A GU131916 |
| DENV3 NS4A AY496877 | DENV3 NS4A FJ639751 | DENV3 NS4A FJ639760 | DENV3 NS4A GQ199863 |
| DENV3 NS4A EF629370 | DENV3 NS4A FJ639827 | DENV3 NS4A GU131853 | DENV3 NS4A FJ639724 |
| DENV3 NS4A FJ639775 | DENV3 NS4A EU367962 | DENV3 NS4A FJ639769 | DENV3 NS4A FJ639798 |
| DENV3 NS4A GU131952 | DENV3 NS4A DQ401689 | DENV3 NS4A GQ868629 | DENV3 NS4A EU081222 |
| DENV3 NS4A EU529705 | DENV3 NS4A FJ639780 | DENV3 NS4A EU081183 | DENV3 NS4A FJ639803 |
| DENV3 NS4A EU660420 | DENV3 NS4A EU081189 | DENV3 NS4A GQ199864 | DENV3 NS4A CS805345 |
| DENV3 NS4A GQ199865 | DENV3 NS4A DQ675531 | DENV3 NS4A NC_001475 | DENV3 NS4A AY648961 |
| DENV3 NS4A EU726771 | DENV3 NS4A FJ639750 | DENV3 NS4A FN429905 | DENV3 NS4A FJ432731 |
| DENV3 NS4A FJ810414 | DENV3 NS4A AY676350 | DENV3 NS4A EU482459 | DENV3 NS4A FJ562102 |
| DENV3 NS4A GQ868572 | DENV3 NS4A FJ898441 | DENV3 NS4A FJ898459 | DENV3 NS4A EU081193 |
| DENV3 NS4A FJ898473 | DENV3 NS4A FJ024471 | DENV3 NS4A FJ639716 | DENV3 NS4A FJ639754 |
| DENV3 NS4A EU687196 | DENV3 NS4A EU081221 | DENV3 NS4A FJ547073 | DENV3 NS4A AF317645 |
| DENV3 NS4A FJ639799 | DENV3 NS4A FJ461326 | DENV3 NS4A GQ868586 | DENV3 NS4A GU131865 |
| DENV3 NS4A EU687219 | DENV3 NS4A GU131854 | DENV3 NS4A FJ639763 | DENV3 NS4A FJ898445 |
| DENV3 NS4A FJ898442 | DENV3 NS4A FJ432722 | DENV3 NS4A EU081216 | DENV3 NS4A FJ182006 |
| DENV3 NS4A FN429906 | DENV3 NS4A FJ410178 | DENV3 NS4A FJ410229 | DENV3 NS4A FJ547069 |
| DENV3 NS4A FJ390371 | DENV3 NS4A EU081223 | DENV3 NS4A FJ898464 | DENV3 NS4A GU131858 |
| DENV3 NS4A FJ639730 | DENV3 NS4A DQ675523 | DENV3 NS4A EU482452 | DENV3 NS4A EU687234 |

FIG. 68-56

| Virus Protein | Accession No. | Virus Protein | Accession No. | Virus Protein | Accession No. | Virus Protein | Accession No. |
|---|---|---|---|---|---|---|---|
| DENV3 NS4A | FJ639791 | DENV3 NS4A | GU131905 | DENV3 NS4A | FJ461329 | DENV3 NS4A | FJ205871 |
| DENV3 NS4A | FJ850092 | DENV3 NS4A | FJ639789 | DENV3 NS4A | FJ898469 | DENV3 NS4A | GU131860 |
| DENV3 NS4A | FJ390377 | DENV3 NS4A | FB667400 | DENV3 NS4A | FJ639776 | DENV3 NS4A | EU482457 |
| DENV3 NS4A | EU529704 | DENV3 NS4A | FJ390373 | DENV3 NS4A | FJ744726 | DENV3 NS4A | GQ199862 |
| DENV3 NS4A | FJ547075 | DENV3 NS4A | EU482460 | DENV3 NS4A | FJ850111 | DENV3 NS4A | EU529703 |
| DENV3 NS4A | GU131936 | DENV3 NS4A | FJ639753 | DENV3 NS4A | EU081204 | DENV3 NS4A | FJ639782 |
| DENV3 NS4A | GU131903 | DENV3 NS4A | FJ687448 | DENV3 NS4A | FJ639761 | DENV3 NS4A | GU131908 |
| DENV3 NS4A | DQ401694 | DENV3 NS4A | FJ639731 | DENV3 NS4A | EU081194 | DENV3 NS4A | AY858039 |
| DENV3 NS4A | EU081205 | DENV3 NS4A | FN429907 | DENV3 NS4A | FJ639725 | DENV3 NS4A | EU081214 |
| DENV3 NS4A | FJ850089 | DENV3 NS4A | EU529684 | DENV3 NS4A | GQ868628 | DENV3 NS4A | EF629366 |
| DENV3 NS4A | FJ898470 | DENV3 NS4A | FJ882572 | DENV3 NS4A | FJ639785 | DENV3 NS4A | FJ639800 |
| DENV3 NS4A | GQ868571 | DENV3 NS4A | FJ182041 | DENV3 NS4A | FJ850086 | DENV3 NS4A | FJ182008 |
| DENV3 NS4A | AY744683 | DENV3 NS4A | AY496879 | DENV3 NS4A | FJ639810 | DENV3 NS4A | AY744680 |
| DENV3 NS4A | FJ639756 | DENV3 NS4A | EU529697 | DENV3 NS4A | FJ882578 | DENV3 NS4A | GU131918 |
| DENV3 NS4A | FJ547062 | DENV3 NS4A | GQ199891 | DENV3 NS4A | GU131851 | DENV3 NS4A | FJ639755 |
| DENV3 NS4A | AB189128 | DENV3 NS4A | EU932687 | DENV3 NS4A | GU131940 | DENV3 NS4A | FJ639719 |
| DENV3 NS4A | FJ182009 | DENV3 NS4A | GQ868548 | DENV3 NS4A | EU482555 | DENV3 NS4A | DQ675533 |
| DENV3 NS4A | FJ810416 | DENV3 NS4A | FJ744728 | DENV3 NS4A | GU131938 | DENV3 NS4A | GU131939 |
| DENV3 NS4A | EF629367 | DENV3 NS4A | FJ639825 | DENV3 NS4A | EU529696 | DENV3 NS4A | FJ639749 |
| DENV3 NS4A | GU131852 | DENV3 NS4A | FN429911 | DENV3 NS4A | DQ401695 | DENV3 NS4A | GU131848 |
| DENV3 NS4A | AY858048 | DENV3 NS4A | GU131914 | DENV3 NS4A | EU726773 | DENV3 NS4A | GU131906 |
| DENV3 NS4A | FN429897 | DENV3 NS4A | GU131945 | DENV3 NS4A | GQ868616 | DENV3 NS4A | GQ868627 |
| DENV3 NS4A | GU131950 | DENV3 NS4A | FJ898472 | DENV3 NS4A | EU482596 | DENV3 NS4A | GU131859 |
| DENV3 NS4A | FN429896 | DENV3 NS4A | FJ547074 | DENV3 NS4A | AY858042 | DENV3 NS4A | FJ182011 |

FIG. 68-57

| Virus Protein Accession No. | Virus Protein Accession No. | Virus Protein Accession No. | Virus Protein Accession No. |
|---|---|---|---|
| DENV3 NS4A AY858038 | DENV3 NS4A FJ898446 | DENV3 NS4A EU596492 | DENV3 NS4B FJ390375 |
| DENV3 NS4A GU131943 | DENV3 NS4A FJ882571 | DENV3 NS4A GU131937 | DENV3 NS4B FJ639801 |
| DENV3 NS4A FJ547085 | DENV3 NS4A FJ744733 | DENV3 NS4A GU131875 | DENV3 NS4B DQ675522 |
| DENV3 NS4A GU131953 | DENV3 NS4A GQ199861 | DENV3 NS4A EU081191 | DENV3 NS4B FJ639771 |
| DENV3 NS4A EU482564 | DENV3 NS4A FJ873813 | DENV3 NS4A AY858040 | DENV3 NS4B EU781137 |
| DENV3 NS4A GQ199887 | DENV3 NS4A FJ639762 | DENV3 NS4A EU482458 | DENV3 NS4B GU131844 |
| DENV3 NS4A DQ675524 | DENV3 NS4A EU081186 | DENV3 NS4A EU687197 | DENV3 NS4B FJ639747 |
| DENV3 NS4A EU596494 | DENV3 NS4A EU081225 | DENV3 NS4A FJ177308 | DENV3 NS4B CS477305 |
| DENV3 NS4A EU726772 | DENV3 NS4A GQ868547 | DENV3 NS4A DQ401693 | DENV3 NS4B FJ562099 |
| DENV3 NS4A FJ898471 | DENV3 NS4A GU131878 | DENV3 NS4A EF629376 | DENV3 NS4B FJ898455 |
| DENV3 NS4A EU569691 | DENV3 NS4A EU569690 | DENV3 NS4A EF629376 | DENV3 NS4B FJ639817 |
| DENV3 NS4A FJ182010 | DENV3 NS4A FJ850110 | DENV3 NS4A EF629376 | DENV3 NS4B EU081185 |
| DENV3 NS4A AB214879 | DENV3 NS4A AY744679 | DENV3 NS4A EF629376 | DENV3 NS4B FJ182037 |
| DENV3 NS4A EU081203 | DENV3 NS4A GU131850 | DENV3 NS4B FN429898 | DENV3 NS4B EU482455 |
| DENV3 NS4A EU854298 | DENV3 NS4A FJ850094 | DENV3 NS4B GQ868576 | DENV3 NS4B AY858046 |
| DENV3 NS4A FJ562097 | DENV3 NS4A FJ639784 | DENV3 NS4B EU596493 | DENV3 NS4B M93130 |
| DENV3 NS4A FJ547071 | DENV3 NS4A FJ850080 | DENV3 NS4B GQ868634 | DENV3 NS4B FJ850052 |
| DENV3 NS4A FJ390372 | DENV3 NS4A DQ675529 | DENV3 NS4B AB214880 | DENV3 NS4B EU660407 |
| DENV3 NS4A GU131946 | DENV3 NS4A FJ850079 | DENV3 NS4B FJ639767 | DENV3 NS4B FJ024465 |
| DENV3 NS4A EU529685 | DENV3 NS4A FJ547079 | DENV3 NS4B EF629373 | DENV3 NS4B FJ461334 |
| DENV3 NS4A EU081219 | DENV3 NS4A GU131909 | DENV3 NS4B AY858041 | DENV3 NS4B FN429917 |
| DENV3 NS4A FN429918 | DENV3 NS4A FJ205870 | DENV3 NS4B AY744678 | DENV3 NS4B GQ868593 |
| DENV3 NS4A FJ744727 | DENV3 NS4A AY496871 | DENV3 NS4B GQ199860 | DENV3 NS4B GU131866 |
| DENV3 NS4A FJ744732 | DENV3 NS4A AY858043 | DENV3 NS4B FJ373302 | DENV3 NS4B EU482559 |

FIG. 68-58

| Virus Protein Accession No. | Virus Protein Accession No. | Virus Protein Accession No. | Virus Protein Accession No. |
|---|---|---|---|
| DENV3 NS4B EU081201 | DENV3 NS4B FJ182040 | DENV3 NS4B EU660411 | DENV3 NS4B EU081220 |
| DENV3 NS4B FJ373304 | DENV3 NS4B FJ882573 | DENV3 NS4B EU482453 | DENV3 NS4B GQ868546 |
| DENV3 NS4B FN429915 | DENV3 NS4B EU529699 | DENV3 NS4B FJ182005 | DENV3 NS4B FJ639805 |
| DENV3 NS4B EU529687 | DENV3 NS4B FJ744735 | DENV3 NS4B GQ868574 | DENV3 NS4B EU854291 |
| DENV3 NS4B EU081208 | DENV3 NS4B FJ024468 | DENV3 NS4B GU131941 | DENV3 NS4B EU081196 |
| DENV3 NS4B GU131951 | DENV3 NS4B AY744685 | DENV3 NS4B EU529689 | DENV3 NS4B FJ182039 |
| DENV3 NS4B FJ898468 | DENV3 NS4B DQ675527 | DENV3 NS4B GU131954 | DENV3 NS4B GU131877 |
| DENV3 NS4B GU131846 | DENV3 NS4B AY744682 | DENV3 NS4B AY676352 | DENV3 NS4B DQ675520 |
| DENV3 NS4B FJ547078 | DENV3 NS4B EU529683 | DENV3 NS4B AY099337 | DENV3 NS4B FJ024467 |
| DENV3 NS4B FJ898457 | DENV3 NS4B FJ639777 | DENV3 NS4B FJ182015 | DENV3 NS4B FN429903 |
| DENV3 NS4B FJ639795 | DENV3 NS4B EU529692 | DENV3 NS4B FJ850049 | DENV3 NS4B FJ744738 |
| DENV3 NS4B FJ639757 | DENV3 NS4B FJ898476 | DENV3 NS4B FJ639713 | DENV3 NS4B EU081188 |
| DENV3 NS4B EU569689 | DENV3 NS4B EU081211 | DENV3 NS4B CS479205 | DENV3 NS4B EU482462 |
| DENV3 NS4B DQ401691 | DENV3 NS4B FJ547066 | DENV3 NS4B GQ868577 | DENV3 NS4B FJ898440 |
| DENV3 NS4B FN429908 | DENV3 NS4B FJ882577 | DENV3 NS4B EU081198 | DENV3 NS4B GQ252678 |
| DENV3 NS4B EU482566 | DENV3 NS4B FN429900 | DENV3 NS4B GU189648 | DENV3 NS4B FJ882575 |
| DENV3 NS4B EU687233 | DENV3 NS4B FJ639765 | DENV3 NS4B EU660409 | DENV3 NS4B FJ639727 |
| DENV3 NS4B AY496874 | DENV3 NS4B EU726769 | DENV3 NS4B FJ373306 | DENV3 NS4B GU131870 |
| DENV3 NS4B GU131862 | DENV3 NS4B GQ199888 | DENV3 NS4B FJ898463 | DENV3 NS4B FJ639826 |
| DENV3 NS4B EU482614 | DENV3 NS4B FJ639786 | DENV3 NS4B FJ410177 | DENV3 NS4B GU131934 |
| DENV3 NS4B GU131872 | DENV3 NS4B FJ478456 | DENV3 NS4B DQ675530 | DENV3 NS4B EF643017 |
| DENV3 NS4B FJ639770 | DENV3 NS4B GQ868617 | DENV3 NS4B FJ744730 | DENV3 NS4B GU131856 |
| DENV3 NS4B FJ810413 | DENV3 NS4B FJ898444 | DENV3 NS4B EU081206 | DENV3 NS4B DQ675525 |
| DENV3 NS4B GU131861 | DENV3 NS4B GU370052 | DENV3 NS4B EU529691 | DENV3 NS4B FJ850097 |

FIG. 68-59

| Virus Protein | Accession No. | Virus Protein | Accession No. | Virus Protein | Accession No. | Virus Protein | Accession No. |
|---|---|---|---|---|---|---|---|
| DENV3 NS4B | FJ639722 | DENV3 NS4B | EU482595 | DENV3 NS4B | GU131854 | DENV3 NS4B | EU529704 |
| DENV3 NS4B | AB189127 | DENV3 NS4B | GQ199871 | DENV3 NS4B | FJ432722 | DENV3 NS4B | GU131936 |
| DENV3 NS4B | FJ639720 | DENV3 NS4B | FJ024470 | DENV3 NS4B | DQ675523 | DENV3 NS4B | GU131903 |
| DENV3 NS4B | FJ639729 | DENV3 NS4B | FN429910 | DENV3 NS4B | FJ547076 | DENV3 NS4B | DQ401694 |
| DENV3 NS4B | GU131868 | DENV3 NS4B | AY496877 | DENV3 NS4B | FJ461337 | DENV3 NS4B | EU081205 |
| DENV3 NS4B | FJ639793 | DENV3 NS4B | EF629370 | DENV3 NS4B | FJ639769 | DENV3 NS4B | FJ898470 |
| DENV3 NS4B | GU363549 | DENV3 NS4B | FJ639775 | DENV3 NS4B | GQ868629 | DENV3 NS4B | GQ868571 |
| DENV3 NS4B | FJ850109 | DENV3 NS4B | GU131952 | DENV3 NS4B | FN429905 | DENV3 NS4B | AB189128 |
| DENV3 NS4B | EU081218 | DENV3 NS4B | EU660420 | DENV3 NS4B | FJ898459 | DENV3 NS4B | FJ182009 |
| DENV3 NS4B | FJ547081 | DENV3 NS4B | GQ199865 | DENV3 NS4B | GQ868586 | DENV3 NS4B | FJ810416 |
| DENV3 NS4B | GU131912 | DENV3 NS4B | FJ810414 | DENV3 NS4B | EU081216 | DENV3 NS4B | GU131852 |
| DENV3 NS4B | AY923865 | DENV3 NS4B | FJ639799 | DENV3 NS4B | EU482452 | DENV3 NS4B | FN429897 |
| DENV3 NS4B | AY858045 | DENV3 NS4B | EU687219 | DENV3 NS4B | AY766104 | DENV3 NS4B | GU131950 |
| DENV3 NS4B | FJ547084 | DENV3 NS4B | FJ898442 | DENV3 NS4B | FJ898474 | DENV3 NS4B | FN429896 |
| DENV3 NS4B | FJ639774 | DENV3 NS4B | FJ390371 | DENV3 NS4B | FJ639724 | DENV3 NS4B | FJ639789 |
| DENV3 NS4B | GU131915 | DENV3 NS4B | EF629368 | DENV3 NS4B | EU081222 | DENV3 NS4B | FJ390373 |
| DENV3 NS4B | FJ850056 | DENV3 NS4B | EU081181 | DENV3 NS4B | CS805345 | DENV3 NS4B | FJ687448 |
| DENV3 NS4B | FJ562107 | DENV3 NS4B | FJ182007 | DENV3 NS4B | AY648961 | DENV3 NS4B | FJ639731 |
| DENV3 NS4B | FJ639759 | DENV3 NS4B | FJ639827 | DENV3 NS4B | FJ562102 | DENV3 NS4B | FN429907 |
| DENV3 NS4B | DQ675519 | DENV3 NS4B | EU367962 | DENV3 NS4B | EU081193 | DENV3 NS4B | AY496879 |
| DENV3 NS4B | FJ639715 | DENV3 NS4B | DQ401689 | DENV3 NS4B | FJ639754 | DENV3 NS4B | EU529697 |
| DENV3 NS4B | FJ024466 | DENV3 NS4B | DQ675531 | DENV3 NS4B | GU131865 | DENV3 NS4B | FJ744728 |
| DENV3 NS4B | FJ898447 | DENV3 NS4B | FJ639750 | DENV3 NS4B | GU131858 | DENV3 NS4B | FJ639825 |
| DENV3 NS4B | EU081184 | DENV3 NS4B | FJ461326 | DENV3 NS4B | FJ639791 | DENV3 NS4B | GU131914 |

FIG. 68-60

| Virus Protein Accession No. | Virus Protein Accession No. | Virus Protein Accession No. | Virus Protein Accession No. |
|---|---|---|---|
| DENV3 NS4B FJ898472 | DENV3 NS4B FJ182010 | DENV3 NS4B EU687197 | DENV3 NS4B FJ744734 |
| DENV3 NS4B FJ547074 | DENV3 NS4B EU081203 | DENV3 NS4B GQ868578 | DENV3 NS4B FJ850096 |
| DENV3 NS4B FJ898469 | DENV3 NS4B FJ562097 | DENV3 NS4B GU131876 | DENV3 NS4B FJ639787 |
| DENV3 NS4B FJ744726 | DENV3 NS4B FJ547071 | DENV3 NS4B FJ547072 | DENV3 NS4B FJ882574 |
| DENV3 NS4B FJ639725 | DENV3 NS4B GU131946 | DENV3 NS4B FJ639779 | DENV3 NS4B GU131873 |
| DENV3 NS4B GU131851 | DENV3 NS4B EU529685 | DENV3 NS4B FJ562103 | DENV3 NS4B GU131867 |
| DENV3 NS4B EU482555 | DENV3 NS4B EU081219 | DENV3 NS4B DQ401692 | DENV3 NS4B GQ199889 |
| DENV3 NS4B GU131938 | DENV3 NS4B FJ882571 | DENV3 NS4B FJ639792 | DENV3 NS4B GQ252674 |
| DENV3 NS4B EU726773 | DENV3 NS4B FJ639762 | DENV3 NS4B AY496873 | DENV3 NS4B EU687198 |
| DENV3 NS4B GQ868616 | DENV3 NS4B EU081186 | DENV3 NS4B FN429909 | DENV3 NS4B FJ432743 |
| DENV3 NS4B GQ199862 | DENV3 NS4B GQ868547 | DENV3 NS4B FJ639816 | DENV3 NS4B FJ461322 |
| DENV3 NS4B GU131908 | DENV3 NS4B GU131878 | DENV3 NS4B FJ744700 | DENV3 NS4B GQ868626 |
| DENV3 NS4B AY858039 | DENV3 NS4B EU569690 | DENV3 NS4B EU081202 | DENV3 NS4B FJ639728 |
| DENV3 NS4B EU081214 | DENV3 NS4B FJ850110 | DENV3 NS4B AB189126 | DENV3 NS4B FJ639758 |
| DENV3 NS4B EF629366 | DENV3 NS4B AY744679 | DENV3 NS4B FJ898458 | DENV3 NS4B AY776329 |
| DENV3 NS4B AY744680 | DENV3 NS4B FJ639784 | DENV3 NS4B FJ744740 | DENV3 NS4B FJ639721 |
| DENV3 NS4B FJ639755 | DENV3 NS4B FJ850080 | DENV3 NS4B EU854292 | DENV3 NS4B FJ547080 |
| DENV3 NS4B DQ675533 | DENV3 NS4B FJ205870 | DENV3 NS4B FN429902 | DENV3 NS4B FJ639778 |
| DENV3 NS4B GU131906 | DENV3 NS4B AY858043 | DENV3 NS4B GU131907 | DENV3 NS4B EU081192 |
| DENV3 NS4B GQ868627 | DENV3 NS4B EU596492 | DENV3 NS4B EU482612 | DENV3 NS4B GQ199886 |
| DENV3 NS4B GU131943 | DENV3 NS4B GU131875 | DENV3 NS4B GU131849 | DENV3 NS4B GQ868587 |
| DENV3 NS4B EU482564 | DENV3 NS4B EU081191 | DENV3 NS4B FJ373303 | DENV3 NS4B DQ675521 |
| DENV3 NS4B GQ199887 | DENV3 NS4B AY858040 | DENV3 NS4B EU081224 | DENV3 NS4B FJ182013 |
| DENV3 NS4B EU726772 | DENV3 NS4B EU482458 | DENV3 NS4B FJ873812 | DENV3 NS4B FJ882576 |

FIG. 68-61

| Virus Protein Accession No. | Virus Protein Accession No. | Virus Protein Accession No. | Virus Protein Accession No. |
|---|---|---|---|
| DENV3 NS4B FN429916 | DENV3 NS4B DQ675532 | DENV3 NS4B DQ675526 | DENV3 NS4B DQ675528 |
| DENV3 NS4B GU131913 | DENV3 NS4B FN429904 | DENV3 NS4B GU131857 | DENV3 NS4B FJ639807 |
| DENV3 NS4B EF629376 | DENV3 NS4B FJ744731 | DENV3 NS4B AB214882 | DENV3 NS4B FJ898475 |
| DENV3 NS4B EU781136 | DENV3 NS4B FJ744737 | DENV3 NS4B EU081217 | DENV3 NS4B EU081200 |
| DENV3 NS4B FJ639726 | DENV3 NS4B AY858037 | DENV3 NS4B FJ024469 | DENV3 NS4B FJ390376 |
| DENV3 NS4B EU081209 | DENV3 NS4B FJ547077 | DENV3 NS4B AB214881 | DENV3 NS4B EU529702 |
| DENV3 NS4B FJ639712 | DENV3 NS4B EU569688 | DENV3 NS4B GU131911 | DENV3 NS4B FJ639781 |
| DENV3 NS4B EU482461 | DENV3 NS4B GU131871 | DENV3 NS4B GU131869 | DENV3 NS4B FJ182004 |
| DENV3 NS4B AY858047 | DENV3 NS4B GU131845 | DENV3 NS4B EU932688 | DENV3 NS4B FJ898443 |
| DENV3 NS4B AY676353 | DENV3 NS4B EU081195 | DENV3 NS4B FJ547070 | DENV3 NS4B AY744684 |
| DENV3 NS4B EU081210 | DENV3 NS4B FJ898456 | DENV3 NS4B FJ639790 | DENV3 NS4B FJ850048 |
| DENV3 NS4B EU081199 | DENV3 NS4B EU081187 | DENV3 NS4B FJ639772 | DENV3 NS4B GQ868575 |
| DENV3 NS4B EU726774 | DENV3 NS4B GU131847 | DENV3 NS4B EU081190 | DENV3 NS4B FJ562100 |
| DENV3 NS4B AY744677 | DENV3 NS4B EU081207 | DENV3 NS4B FJ639723 | DENV3 NS4B GU131942 |
| DENV3 NS4B FN429901 | DENV3 NS4B FJ410176 | DENV3 NS4B EU482613 | DENV3 NS4B EU529688 |
| DENV3 NS4B EU687226 | DENV3 NS4B AY770511 | DENV3 NS4B FJ850055 | DENV3 NS4B DQ401690 |
| DENV3 NS4B FN429914 | DENV3 NS4B GU131933 | DENV3 NS4B EU482558 | DENV3 NS4B EF629369 |
| DENV3 NS4B FJ639768 | DENV3 NS4B GQ199870 | DENV3 NS4B FN429899 | DENV3 NS4B FJ639714 |
| DENV3 NS4B FJ547061 | DENV3 NS4B FJ850098 | DENV3 NS4B EU660410 | DENV3 NS4B AY676351 |
| DENV3 NS4B GU131917 | DENV3 NS4B AB189125 | DENV3 NS4B AY858044 | DENV3 NS4B GQ868573 |
| DENV3 NS4B FJ432728 | DENV3 NS4B FJ432741 | DENV3 NS4B EU726768 | DENV3 NS4B AY099336 |
| DENV3 NS4B EU482456 | DENV3 NS4B EU529690 | DENV3 NS4B FJ639766 | DENV3 NS4B EU081182 |
| DENV3 NS4B GU370053 | DENV3 NS4B FJ639804 | DENV3 NS4B EU529698 | DENV3 NS4B GU131855 |
| DENV3 NS4B FJ744736 | DENV3 NS4B FJ182038 | DENV3 NS4B EU687239 | DENV3 NS4B DQ863638 |

FIG. 68-62

| Virus Protein Accession No. | Virus Protein Accession No. | Virus Protein Accession No. | Virus Protein Accession No. |
|---|---|---|---|
| DENV3 NS4B FJ639746 | DENV3 NS4B GQ868572 | DENV3 NS4B GQ199864 | DENV3 NS4B FJ850089 |
| DENV3 NS4B EU482454 | DENV3 NS4B FJ898473 | DENV3 NS4B NC_001475 | DENV3 NS4B AY744683 |
| DENV3 NS4B EU081197 | DENV3 NS4B EU687196 | DENV3 NS4B EU482459 | DENV3 NS4B FJ639756 |
| DENV3 NS4B EU081212 | DENV3 NS4B FN429906 | DENV3 NS4B FJ639716 | DENV3 NS4B FJ547062 |
| DENV3 NS4B FJ850083 | DENV3 NS4B FJ639730 | DENV3 NS4B FJ547073 | DENV3 NS4B EF629367 |
| DENV3 NS4B EU660408 | DENV3 NS4B EU081215 | DENV3 NS4B FJ639763 | DENV3 NS4B AY858048 |
| DENV3 NS4B FJ639752 | DENV3 NS4B GU131935 | DENV3 NS4B FJ410229 | DENV3 NS4B GU131905 |
| DENV3 NS4B AY676349 | DENV3 NS4B FN429913 | DENV3 NS4B FJ898464 | DENV3 NS4B FB667400 |
| DENV3 NS4B FJ898462 | DENV3 NS4B FJ639751 | DENV3 NS4B FJ744729 | DENV3 NS4B EU482460 |
| DENV3 NS4B FN429912 | DENV3 NS4B FJ639780 | DENV3 NS4B EU687218 | DENV3 NS4B FJ639753 |
| DENV3 NS4B EU529686 | DENV3 NS4B EU081189 | DENV3 NS4B GU131910 | DENV3 NS4B FJ882572 |
| DENV3 NS4B FJ744739 | DENV3 NS4B AY676350 | DENV3 NS4B GU131916 | DENV3 NS4B EU529684 |
| DENV3 NS4B AY676348 | DENV3 NS4B FJ898441 | DENV3 NS4B GQ199863 | DENV3 NS4B FJ182041 |
| DENV3 NS4B AY679147 | DENV3 NS4B FJ024471 | DENV3 NS4B FJ639798 | DENV3 NS4B GQ199891 |
| DENV3 NS4B GU131904 | DENV3 NS4B EU081221 | DENV3 NS4B FJ639803 | DENV3 NS4B EU932687 |
| DENV3 NS4B FJ461338 | DENV3 NS4B EU081223 | DENV3 NS4B FJ432731 | DENV3 NS4B GQ868548 |
| DENV3 NS4B EU081213 | DENV3 NS4B FJ410178 | DENV3 NS4B AF317645 | DENV3 NS4B FN429911 |
| DENV3 NS4B AY744681 | DENV3 NS4B EU482563 | DENV3 NS4B FJ898445 | DENV3 NS4B GU131945 |
| DENV3 NS4B AY662691 | DENV3 NS4B GU131874 | DENV3 NS4B FJ182006 | DENV3 NS4B FJ461329 |
| DENV3 NS4B AY876494 | DENV3 NS4B FJ547082 | DENV3 NS4B FJ547069 | DENV3 NS4B FJ850111 |
| DENV3 NS4B GU131944 | DENV3 NS4B FJ547083 | DENV3 NS4B EU687234 | DENV3 NS4B FJ639776 |
| DENV3 NS4B EU687221 | DENV3 NS4B FJ639760 | DENV3 NS4B FJ850092 | DENV3 NS4B EU081194 |
| DENV3 NS4B EU529705 | DENV3 NS4B GU131853 | DENV3 NS4B FJ390377 | DENV3 NS4B FJ639761 |
| DENV3 NS4B EU726771 | DENV3 NS4B EU081183 | DENV3 NS4B FJ547075 | DENV3 NS4B EU081204 |

FIG. 68-63

| Virus Protein Accession No. | Virus Protein Accession No. | Virus Protein Accession No. | Virus Protein Accession No. |
|---|---|---|---|
| DENV3 NS4B GQ868628 | DENV3 NS4B AY858038 | DENV3 NS4B AY496871 | DENV3 NS5EU529687 DENV3 NS5EU081208 |
| DENV3 NS4B FJ850086 | DENV3 NS4B FJ547085 | DENV3 NS4B GU131937 | DENV3 NS5GU131951 DENV3 NS5FJ898468 |
| DENV3 NS4B FJ639785 | DENV3 NS4B GU131953 | DENV3 NS4B DQ401693 | DENV3 NS5GU131846 DENV3 NS5FJ547078 |
| DENV3 NS4B FJ639810 | DENV3 NS4B DQ675524 | DENV3 NS4B FJ177308 | DENV3 NS5FJ898457 DENV3 NS5FJ639795 |
| DENV3 NS4B FJ882578 | DENV3 NS4B FJ898471 | DENV3 NS4B EF629376 | DENV3 NS5FJ639757 DENV3 NS5EU569689 |
| DENV3 NS4B GU131940 | DENV3 NS4B EU596494 | DENV3 NS5FN429898 DENV3 NS5GQ868576 | DENV3 NS5DQ401691 DENV3 NS5FN429908 |
| DENV3 NS4B DQ401695 | DENV3 NS4B EU569691 | DENV3 NS5EU596493 DENV3 NS5GQ868634 | DENV3 NS5EU482566 DENV3 NS5AY496874 |
| DENV3 NS4B EU529696 | DENV3 NS4B AB214879 | DENV3 NS5AB214880 DENV3 NS5FJ639767 | DENV3 NS5GU131862 DENV3 NS5EU482614 |
| DENV3 NS4B AY858042 | DENV3 NS4B EU854298 | DENV3 NS5EF629373 DENV3 NS5AY858041 | DENV3 NS5GU131872 DENV3 NS5FJ639770 |
| DENV3 NS4B EU482596 | DENV3 NS4B FJ390372 | DENV3 NS5AY744678 DENV3 NS5GQ199860 | DENV3 NS5FJ810413 DENV3 NS5GU131861 |
| DENV3 NS4B FJ205871 | DENV3 NS4B FN429918 | DENV3 NS5FJ373302 DENV3 NS5FJ390375 | DENV3 NS5FJ182040 DENV3 NS5FJ882573 |
| DENV3 NS4B GU131860 | DENV3 NS4B FJ744727 | DENV3 NS5FJ639801 DENV3 NS5DQ675522 | DENV3 NS5EU529699 DENV3 NS5FJ744735 |
| DENV3 NS4B EU482457 | DENV3 NS4B FJ744732 | DENV3 NS5FJ639771 DENV3 NS5EU781137 | DENV3 NS5FJ024468 DENV3 NS5AY744685 |
| DENV3 NS4B EU529703 | DENV3 NS4B FJ898446 | DENV3 NS5GU131844 DENV3 NS5FJ639747 | DENV3 NS5DQ675527 DENV3 NS5AY744682 |
| DENV3 NS4B FJ639782 | DENV3 NS4B FJ744733 | DENV3 NS5CS477305 DENV3 NS5FJ562099 | DENV3 NS5EU529683 DENV3 NS5FJ639777 |
| DENV3 NS4B FJ639800 | DENV3 NS4B FJ873813 | DENV3 NS5FJ898455 DENV3 NS5FJ639817 | DENV3 NS5EU529692 DENV3 NS5FJ898476 |
| DENV3 NS4B GU131918 | DENV3 NS4B GQ199861 | DENV3 NS5EU081185 DENV3 NS5FJ182037 | DENV3 NS5EU081211 DENV3 NS5FJ547066 |
| DENV3 NS4B FJ182008 | DENV3 NS4B EU081225 | DENV3 NS5EU482455 DENV3 NS5AY858046 | DENV3 NS5FJ882577 DENV3 NS5FN429900 |
| DENV3 NS4B FJ639719 | DENV3 NS4B GU131850 | DENV3 NS5M93130 DENV3 NS5FJ850052 | DENV3 NS5FJ639765 DENV3 NS5EU726769 |
| DENV3 NS4B GU131939 | DENV3 NS4B FJ850094 | DENV3 NS5EU660407 DENV3 NS5FJ024465 | DENV3 NS5GQ199888 DENV3 NS5FJ639786 |
| DENV3 NS4B FJ639749 | DENV3 NS4B DQ675529 | DENV3 NS5FJ461334 DENV3 NS5FN429917 | DENV3 NS5FJ478456 DENV3 NS5GQ868617 |
| DENV3 NS4B GU131848 | DENV3 NS4B FJ850079 | DENV3 NS5GQ868593 DENV3 NS5GU131866 | DENV3 NS5FJ898444 DENV3 NS5GU370052 |
| DENV3 NS4B GU131859 | DENV3 NS4B FJ547079 | DENV3 NS5EU482559 DENV3 NS5EU081201 | DENV3 NS5EU660411 DENV3 NS5EU482453 |
| DENV3 NS4B FJ182011 | DENV3 NS4B GU131909 | DENV3 NS5FJ373304 DENV3 NS5FN429915 | DENV3 NS5FJ182005 DENV3 NS5GQ868574 |

FIG. 68-64

| Virus Protein Accession No. | Virus Protein Accession No. | Virus Protein Accession No. | Virus Protein Accession No. |
|---|---|---|---|
| DENV3 NS5GU131941 | DENV3 NS5GU131868 | DENV3 NS5FJ461337 | DENV3 NS5FJ639725 |
| DENV3 NS5EU529689 | DENV3 NS5FJ639793 | DENV3 NS5FJ639769 | DENV3 NS5GU131851 |
| DENV3 NS5GU131954 | DENV3 NS5GU363549 | DENV3 NS5GQ868629 | DENV3 NS5EU482555 |
| DENV3 NS5AY676352 | DENV3 NS5FJ850109 | DENV3 NS5FN429905 | DENV3 NS5GU131938 |
| DENV3 NS5AY099337 | DENV3 NS5EU081218 | DENV3 NS5FJ898459 | DENV3 NS5EU726773 |
| DENV3 NS5FJ182015 | DENV3 NS5FJ547081 | DENV3 NS5GQ868586 | DENV3 NS5GQ868616 |
| DENV3 NS5FJ850049 | DENV3 NS5GU131912 | DENV3 NS5EU081216 | DENV3 NS5GQ199862 |
| DENV3 NS5FJ639713 | DENV3 NS5AY923865 | DENV3 NS5EU482452 | DENV3 NS5GU131908 |
| DENV3 NS5CS479205 | DENV3 NS5AY858045 | DENV3 NS5AY766104 | DENV3 NS5AY858039 |
| DENV3 NS5GQ868577 | DENV3 NS5FJ547084 | DENV3 NS5FJ898474 | DENV3 NS5EU081214 |
| DENV3 NS5EU081198 | DENV3 NS5FJ639774 | DENV3 NS5FJ639724 | DENV3 NS5EF629366 |
| DENV3 NS5GU189648 | DENV3 NS5GU131915 | DENV3 NS5EU081222 | DENV3 NS5AY744680 |
| DENV3 NS5EU660409 | DENV3 NS5FJ850056 | DENV3 NS5CS805345 | DENV3 NS5FJ639755 |
| DENV3 NS5FJ373306 | DENV3 NS5FJ562107 | DENV3 NS5AY648961 | DENV3 NS5DQ675533 |
| DENV3 NS5FJ898463 | DENV3 NS5FJ639759 | DENV3 NS5FJ562102 | DENV3 NS5GU131906 |
| DENV3 NS5FJ410177 | DENV3 NS5DQ675519 | DENV3 NS5EU081193 | DENV3 NS5GQ868627 |
| DENV3 NS5DQ675530 | DENV3 NS5FJ639715 | DENV3 NS5FJ639754 | DENV3 NS5GU131943 |
| DENV3 NS5FJ744730 | DENV3 NS5FJ024466 | DENV3 NS5GU131865 | DENV3 NS5EU482564 |
| DENV3 NS5EU081206 | DENV3 NS5FJ898447 | DENV3 NS5GU131858 | DENV3 NS5GQ199887 |
| DENV3 NS5EU529691 | DENV3 NS5EU081184 | DENV3 NS5FJ639791 | DENV3 NS5EU726772 |
| DENV3 NS5EU081220 | DENV3 NS5EU482595 | DENV3 NS5EU529704 | DENV3 NS5FJ182010 |
| DENV3 NS5GQ868546 | DENV3 NS5GQ199871 | DENV3 NS5GU131936 | DENV3 NS5EU081203 |
| DENV3 NS5FJ639805 | DENV3 NS5FJ024470 | DENV3 NS5GU131903 | DENV3 NS5FJ562097 |
| DENV3 NS5EU854291 | DENV3 NS5FN429910 | DENV3 NS5DQ401694 | DENV3 NS5FJ547071 |
| DENV3 NS5EU081196 | DENV3 NS5AY496877 | DENV3 NS5EU081205 | DENV3 NS5GU131946 |
| DENV3 NS5FJ182039 | DENV3 NS5EF629370 | DENV3 NS5FJ898470 | DENV3 NS5EU529685 |
| DENV3 NS5GU131877 | DENV3 NS5FJ639775 | DENV3 NS5GQ868571 | DENV3 NS5EU081219 |
| DENV3 NS5DQ675520 | DENV3 NS5GU131952 | DENV3 NS5AB189128 | DENV3 NS5FJ882571 |
| DENV3 NS5FJ024467 | DENV3 NS5EU660420 | DENV3 NS5FJ182009 | DENV3 NS5FJ639762 |
| DENV3 NS5FN429903 | DENV3 NS5GQ199865 | DENV3 NS5FJ810416 | DENV3 NS5EU081186 |
| DENV3 NS5FJ744738 | DENV3 NS5FJ810414 | DENV3 NS5GU131852 | DENV3 NS5GQ868547 |
| DENV3 NS5EU081188 | DENV3 NS5FJ639799 | DENV3 NS5FN429897 | DENV3 NS5GU131878 |
| DENV3 NS5EU482462 | DENV3 NS5EU687219 | DENV3 NS5GU131950 | DENV3 NS5EU569690 |
| DENV3 NS5FJ898440 | DENV3 NS5FJ898442 | DENV3 NS5FN429896 | DENV3 NS5FJ850110 |
| DENV3 NS5GQ252678 | DENV3 NS5FJ390371 | DENV3 NS5FJ639789 | DENV3 NS5AY744679 |
| DENV3 NS5FJ882575 | DENV3 NS5EF629368 | DENV3 NS5FJ390373 | DENV3 NS5FJ639784 |
| DENV3 NS5FJ639727 | DENV3 NS5EU081181 | DENV3 NS5FJ687448 | DENV3 NS5FJ850080 |
| DENV3 NS5GU131870 | DENV3 NS5FJ182007 | DENV3 NS5FJ639731 | DENV3 NS5FJ205870 |
| DENV3 NS5FJ639826 | DENV3 NS5FJ639827 | DENV3 NS5FN429907 | DENV3 NS5AY858043 |
| DENV3 NS5GU131934 | DENV3 NS5EU367962 | DENV3 NS5AY496879 | DENV3 NS5EU596492 |
| DENV3 NS5EF643017 | DENV3 NS5DQ401689 | DENV3 NS5EU529697 | DENV3 NS5GU131875 |
| DENV3 NS5GU131856 | DENV3 NS5DQ675531 | DENV3 NS5FJ744728 | DENV3 NS5EU081191 |
| DENV3 NS5DQ675525 | DENV3 NS5FJ639750 | DENV3 NS5FJ639825 | DENV3 NS5AY858040 |
| DENV3 NS5FJ850097 | DENV3 NS5FJ461326 | DENV3 NS5GU131914 | DENV3 NS5EU482458 |
| DENV3 NS5FJ639722 | DENV3 NS5GU131854 | DENV3 NS5FJ898472 | DENV3 NS5EU687197 |
| DENV3 NS5AB189127 | DENV3 NS5FJ432722 | DENV3 NS5FJ547074 | DENV3 NS5GQ868578 |
| DENV3 NS5FJ639720 | DENV3 NS5DQ675523 | DENV3 NS5FJ898469 | DENV3 NS5GU131876 |
| DENV3 NS5FJ639729 | DENV3 NS5FJ547076 | DENV3 NS5FJ744726 | DENV3 NS5FJ547072 |

FIG. 68-65

| Virus Protein Accession No. | Virus Protein Accession No. | Virus Protein Accession No. | Virus Protein Accession No. |
|---|---|---|---|
| DENV3 NS5FJ639779 | DENV3 NS5FJ639726 | DENV3 NS5FJ024469 | DENV3 NS5FJ850083 |
| DENV3 NS5FJ562103 | DENV3 NS5EU081209 | DENV3 NS5AB214881 | DENV3 NS5EU660408 |
| DENV3 NS5DQ401692 | DENV3 NS5FJ639712 | DENV3 NS5GU131911 | DENV3 NS5FJ639752 |
| DENV3 NS5FJ639792 | DENV3 NS5EU482461 | DENV3 NS5GU131869 | DENV3 NS5AY676349 |
| DENV3 NS5AY496873 | DENV3 NS5AY858047 | DENV3 NS5EU932688 | DENV3 NS5FJ898462 |
| DENV3 NS5FN429909 | DENV3 NS5AY676353 | DENV3 NS5FJ547070 | DENV3 NS5FN429912 |
| DENV3 NS5FJ639816 | DENV3 NS5EU081210 | DENV3 NS5FJ639790 | DENV3 NS5EU529686 |
| DENV3 NS5FJ744700 | DENV3 NS5EU081199 | DENV3 NS5FJ639772 | DENV3 NS5FJ744739 |
| DENV3 NS5EU081202 | DENV3 NS5EU726774 | DENV3 NS5EU081190 | DENV3 NS5AY676348 |
| DENV3 NS5AB189126 | DENV3 NS5AY744677 | DENV3 NS5FJ639723 | DENV3 NS5AY679147 |
| DENV3 NS5FJ898458 | DENV3 NS5FN429901 | DENV3 NS5EU482613 | DENV3 NS5GU131904 |
| DENV3 NS5FJ744740 | DENV3 NS5EU687226 | DENV3 NS5FJ850055 | DENV3 NS5FJ461338 |
| DENV3 NS5EU854292 | DENV3 NS5FN429914 | DENV3 NS5EU482558 | DENV3 NS5EU081213 |
| DENV3 NS5FN429902 | DENV3 NS5FJ639768 | DENV3 NS5FN429899 | DENV3 NS5AY744681 |
| DENV3 NS5GU131907 | DENV3 NS5FJ547061 | DENV3 NS5EU660410 | DENV3 NS5AY662691 |
| DENV3 NS5EU482612 | DENV3 NS5GU131917 | DENV3 NS5AY858044 | DENV3 NS5AY876494 |
| DENV3 NS5GU131849 | DENV3 NS5FJ432728 | DENV3 NS5EU726768 | DENV3 NS5GU131944 |
| DENV3 NS5FJ373303 | DENV3 NS5EU482456 | DENV3 NS5FJ639766 | DENV3 NS5EU687221 |
| DENV3 NS5EU081224 | DENV3 NS5GU370053 | DENV3 NS5EU529698 | DENV3 NS5EU529705 |
| DENV3 NS5FJ873812 | DENV3 NS5FJ744736 | DENV3 NS5EU687239 | DENV3 NS5EU726771 |
| DENV3 NS5FJ744734 | DENV3 NS5DQ675532 | DENV3 NS5DQ675528 | DENV3 NS5GQ868572 |
| DENV3 NS5FJ850096 | DENV3 NS5FN429904 | DENV3 NS5FJ639807 | DENV3 NS5FJ898473 |
| DENV3 NS5FJ639787 | DENV3 NS5FJ744731 | DENV3 NS5FJ898475 | DENV3 NS5EU687196 |
| DENV3 NS5FJ882574 | DENV3 NS5FJ744737 | DENV3 NS5EU081200 | DENV3 NS5FN429906 |
| DENV3 NS5GU131873 | DENV3 NS5AY858037 | DENV3 NS5FJ390376 | DENV3 NS5FJ639730 |
| DENV3 NS5GU131867 | DENV3 NS5FJ547077 | DENV3 NS5EU529702 | DENV3 NS5EU081215 |
| DENV3 NS5GQ199889 | DENV3 NS5EU569688 | DENV3 NS5FJ639781 | DENV3 NS5GU131935 |
| DENV3 NS5GQ252674 | DENV3 NS5GU131871 | DENV3 NS5FJ182004 | DENV3 NS5FN429913 |
| DENV3 NS5EU687198 | DENV3 NS5GU131845 | DENV3 NS5FJ898443 | DENV3 NS5FJ639751 |
| DENV3 NS5FJ432743 | DENV3 NS5EU081195 | DENV3 NS5AY744684 | DENV3 NS5FJ639780 |
| DENV3 NS5FJ461322 | DENV3 NS5FJ898456 | DENV3 NS5FJ850048 | DENV3 NS5EU081189 |
| DENV3 NS5GQ868626 | DENV3 NS5EU081187 | DENV3 NS5GQ868575 | DENV3 NS5AY676350 |
| DENV3 NS5FJ639728 | DENV3 NS5GU131847 | DENV3 NS5FJ562100 | DENV3 NS5FJ898441 |
| DENV3 NS5FJ639758 | DENV3 NS5EU081207 | DENV3 NS5GU131942 | DENV3 NS5FJ024471 |
| DENV3 NS5AY776329 | DENV3 NS5FJ410176 | DENV3 NS5EU529688 | DENV3 NS5EU081221 |
| DENV3 NS5FJ639721 | DENV3 NS5AY770511 | DENV3 NS5DQ401690 | DENV3 NS5EU081223 |
| DENV3 NS5FJ547080 | DENV3 NS5GU131933 | DENV3 NS5EF629369 | DENV3 NS5FJ410178 |
| DENV3 NS5FJ639778 | DENV3 NS5GQ199870 | DENV3 NS5FJ639714 | DENV3 NS5EU482563 |
| DENV3 NS5EU081192 | DENV3 NS5FJ850098 | DENV3 NS5AY676351 | DENV3 NS5GU131874 |
| DENV3 NS5GQ199886 | DENV3 NS5AB189125 | DENV3 NS5GQ868573 | DENV3 NS5FJ547082 |
| DENV3 NS5GQ868587 | DENV3 NS5FJ432741 | DENV3 NS5AY099336 | DENV3 NS5FJ547083 |
| DENV3 NS5DQ675521 | DENV3 NS5EU529690 | DENV3 NS5EU081182 | DENV3 NS5FJ639760 |
| DENV3 NS5FJ182013 | DENV3 NS5FJ639804 | DENV3 NS5GU131855 | DENV3 NS5GU131853 |
| DENV3 NS5FJ882576 | DENV3 NS5FJ182038 | DENV3 NS5DQ863638 | DENV3 NS5EU081183 |
| DENV3 NS5FN429916 | DENV3 NS5DQ675526 | DENV3 NS5FJ639746 | DENV3 NS5GQ199864 |
| DENV3 NS5GU131913 | DENV3 NS5GU131857 | DENV3 NS5EU482454 | DENV3 NS5NC_001475 |
| DENV3 NS5EF629376 | DENV3 NS5AB214882 | DENV3 NS5EU081197 | DENV3 NS5EU482459 |
| DENV3 NS5EU781136 | DENV3 NS5EU081217 | DENV3 NS5EU081212 | DENV3 NS5FJ639716 |

FIG. 68-66

| Virus Protein Accession No. | Virus Protein Accession No. | Virus Protein Accession No. | Virus Protein Accession No. |
|---|---|---|---|
| DENV3 NS5FJ547073 | DENV3 NS5FJ882578 | DENV3 NS5EF629376 | DENV3 prMEU529687 |
| DENV3 NS5FJ639763 | DENV3 NS5GU131940 | DENV3 prMDQ177893 | DENV3 prMEU081208 |
| DENV3 NS5FJ410229 | DENV3 NS5DQ401695 | DENV3 prMFN429898 | DENV3 prMFJ225464 |
| DENV3 NS5FJ898464 | DENV3 NS5EU529696 | DENV3 prMGQ868576 | DENV3 prMGU131951 |
| DENV3 NS5FJ744729 | DENV3 NS5AY858042 | DENV3 prMEU596493 | DENV3 prMFJ898468 |
| DENV3 NS5EU687218 | DENV3 NS5EU482596 | DENV3 prMGQ868634 | DENV3 prMGU131846 |
| DENV3 NS5GU131910 | DENV3 NS5FJ205871 | DENV3 prMAY912455 | DENV3 prMFJ547078 |
| DENV3 NS5GU131916 | DENV3 NS5GU131860 | DENV3 prMAB214880 | DENV3 prMFJ898457 |
| DENV3 NS5GQ199863 | DENV3 NS5EU482457 | DENV3 prMFJ639767 | DENV3 prMFJ639795 |
| DENV3 NS5FJ639798 | DENV3 NS5EU529703 | DENV3 prMEF629373 | DENV3 prMFJ639757 |
| DENV3 NS5FJ639803 | DENV3 NS5FJ639782 | DENV3 prMAY858041 | DENV3 prMEU569689 |
| DENV3 NS5FJ432731 | DENV3 NS5FJ639800 | DENV3 prMFJ375135 | DENV3 prMAF547234 |
| DENV3 NS5AF317645 | DENV3 NS5GU131918 | DENV3 prMAY744678 | DENV3 prMDQ401691 |
| DENV3 NS5FJ898445 | DENV3 NS5FJ182008 | DENV3 prMGQ199860 | DENV3 prMAB038473 |
| DENV3 NS5FJ182006 | DENV3 NS5FJ639719 | DENV3 prMFJ373302 | DENV3 prMFN429908 |
| DENV3 NS5FJ547069 | DENV3 NS5GU131939 | DENV3 prMFJ390375 | DENV3 prMEU482566 |
| DENV3 NS5EU687234 | DENV3 NS5FJ639749 | DENV3 prMFJ639801 | DENV3 prMEU687233 |
| DENV3 NS5FJ850092 | DENV3 NS5GU131848 | DENV3 prMDQ675522 | DENV3 prMAY496874 |
| DENV3 NS5FJ390377 | DENV3 NS5GU131859 | DENV3 prMAF547240 | DENV3 prMGU131862 |
| DENV3 NS5FJ547075 | DENV3 NS5FJ182011 | DENV3 prML11438 | DENV3 prMEU482614 |
| DENV3 NS5FJ850089 | DENV3 NS5AY858038 | DENV3 prMAB038466 | DENV3 prMGU131872 |
| DENV3 NS5AY744683 | DENV3 NS5FJ547085 | DENV3 prMFJ639771 | DENV3 prMFJ639770 |
| DENV3 NS5FJ639756 | DENV3 NS5GU131953 | DENV3 prMEU781137 | DENV3 prMFJ810413 |
| DENV3 NS5FJ547062 | DENV3 NS5DQ675524 | DENV3 prMAB038477 | DENV3 prMAF547254 |
| DENV3 NS5EF629367 | DENV3 NS5FJ898471 | DENV3 prML11429 | DENV3 prMAY960635 |
| DENV3 NS5AY858048 | DENV3 NS5EU596494 | DENV3 prMGU131844 | DENV3 prMGU131861 |
| DENV3 NS5GU131905 | DENV3 NS5EU569691 | DENV3 prMFJ639747 | DENV3 prMFJ182040 |
| DENV3 NS5FB667400 | DENV3 NS5AB214879 | DENV3 prMCS477305 | DENV3 prMEU052793 |
| DENV3 NS5EU482460 | DENV3 NS5EU854298 | DENV3 prMFJ562099 | DENV3 prMFJ882573 |
| DENV3 NS5FJ639753 | DENV3 NS5FJ390372 | DENV3 prMFJ898455 | DENV3 prMEU529699 |
| DENV3 NS5FJ882572 | DENV3 NS5FN429918 | DENV3 prMFJ639817 | DENV3 prMFJ744735 |
| DENV3 NS5EU529684 | DENV3 NS5FJ744727 | DENV3 prMEU081185 | DENV3 prMFJ024468 |
| DENV3 NS5FJ182041 | DENV3 NS5FJ744732 | DENV3 prMFJ182037 | DENV3 prMAY744685 |
| DENV3 NS5GQ199891 | DENV3 NS5FJ898446 | DENV3 prMEU482455 | DENV3 prMDQ675527 |
| DENV3 NS5EU932687 | DENV3 NS5FJ744733 | DENV3 prMAY858046 | DENV3 prMAY960630 |
| DENV3 NS5GQ868548 | DENV3 NS5FJ873813 | DENV3 prMM93130 | DENV3 prMAY744682 |
| DENV3 NS5FN429911 | DENV3 NS5GQ199861 | DENV3 prMFJ850052 | DENV3 prMEU529683 |
| DENV3 NS5GU131945 | DENV3 NS5EU081225 | DENV3 prMEU660407 | DENV3 prMFJ639777 |
| DENV3 NS5FJ461329 | DENV3 NS5GU131850 | DENV3 prMFJ024465 | DENV3 prMEU529692 |
| DENV3 NS5FJ850111 | DENV3 NS5FJ850094 | DENV3 prMFJ461334 | DENV3 prMFJ898476 |
| DENV3 NS5FJ639776 | DENV3 NS5DQ675529 | DENV3 prMFN429917 | DENV3 prMAB038468 |
| DENV3 NS5EU081194 | DENV3 NS5FJ850079 | DENV3 prMGQ868593 | DENV3 prMEU081211 |
| DENV3 NS5FJ639761 | DENV3 NS5FJ547079 | DENV3 prMAY750718 | DENV3 prMDQ177886 |
| DENV3 NS5EU081204 | DENV3 NS5GU131909 | DENV3 prMGU131866 | DENV3 prMFJ547066 |
| DENV3 NS5GQ868628 | DENV3 NS5AY496871 | DENV3 prMEU482559 | DENV3 prMFJ882577 |
| DENV3 NS5FJ850086 | DENV3 NS5GU131937 | DENV3 prMEU081201 | DENV3 prMFN429900 |
| DENV3 NS5FJ639785 | DENV3 NS5DQ401693 | DENV3 prMFJ373304 | DENV3 prMDQ367720 |
| DENV3 NS5FJ639810 | DENV3 NS5FJ177308 | DENV3 prMFN429915 | DENV3 prMDQ371245 |

FIG. 68-67

| Virus Protein Accession No. | Virus Protein Accession No. | Virus Protein Accession No. | Virus Protein Accession No. |
|---|---|---|---|
| DENV3 prMFJ639765 | DENV3 prMEU529691 | DENV3 prMAB038471 | DENV3 prMFJ639769 |
| DENV3 prMEU052795 | DENV3 prMEU081220 | DENV3 prMGU131915 | DENV3 prMGQ868629 |
| DENV3 prMEU726769 | DENV3 prMGQ868546 | DENV3 prMFJ850056 | DENV3 prMFN429905 |
| DENV3 prMEU052796 | DENV3 prMFJ639805 | DENV3 prMFJ562107 | DENV3 prMAB038475 |
| DENV3 prMAF547246 | DENV3 prMEU854291 | DENV3 prMFJ639759 | DENV3 prMFJ898459 |
| DENV3 prMGQ199888 | DENV3 prMEU081196 | DENV3 prMDQ675519 | DENV3 prMGQ868586 |
| DENV3 prMFJ639786 | DENV3 prMFJ182039 | DENV3 prMFJ639715 | DENV3 prMAF547262 |
| DENV3 prMDQ177895 | DENV3 prMGU131877 | DENV3 prMFJ024466 | DENV3 prMEU081216 |
| DENV3 prMAB038479 | DENV3 prML11426 | DENV3 prMAY960631 | DENV3 prMEU482452 |
| DENV3 prMAY960633 | DENV3 prMDQ675520 | DENV3 prMFJ898447 | DENV3 prMAF547247 |
| DENV3 prMFJ478456 | DENV3 prMEF441284 | DENV3 prMEU081184 | DENV3 prMAY766104 |
| DENV3 prMGQ868617 | DENV3 prMFJ024467 | DENV3 prMEU482595 | DENV3 prMFJ898474 |
| DENV3 prML11436 | DENV3 prMFN429903 | DENV3 prMGQ199871 | DENV3 prMAF547258 |
| DENV3 prMAF547251 | DENV3 prMFJ744738 | DENV3 prMDQ177888 | DENV3 prMFJ639724 |
| DENV3 prMFJ898444 | DENV3 prMAB010990 | DENV3 prMFJ024470 | DENV3 prML11424 |
| DENV3 prMGU370052 | DENV3 prMEU081188 | DENV3 prMFN429910 | DENV3 prMEU081222 |
| DENV3 prMEU660411 | DENV3 prMEU482462 | DENV3 prMAY496877 | DENV3 prMM25277 |
| DENV3 prMEU482453 | DENV3 prMFJ898440 | DENV3 prMEF629370 | DENV3 prMCS805345 |
| DENV3 prMFJ182005 | DENV3 prMGQ252678 | DENV3 prMFJ639775 | DENV3 prMAY648961 |
| DENV3 prMAY912454 | DENV3 prMFJ882575 | DENV3 prMGU131952 | DENV3 prML11439 |
| DENV3 prMGQ868574 | DENV3 prMFJ639727 | DENV3 prMEU660420 | DENV3 prMFJ562102 |
| DENV3 prMGU131941 | DENV3 prMAF547225 | DENV3 prMGQ199865 | DENV3 prMEU081193 |
| DENV3 prMEU529689 | DENV3 prMGU131870 | DENV3 prMFJ810414 | DENV3 prMFJ639754 |
| DENV3 prMEU259606 | DENV3 prMAY485355 | DENV3 prMFJ639799 | DENV3 prMGU131865 |
| DENV3 prMGU131954 | DENV3 prMFJ639826 | DENV3 prMEU687219 | DENV3 prMAF547231 |
| DENV3 prMAY676352 | DENV3 prMGU131934 | DENV3 prMFJ898442 | DENV3 prML11432 |
| DENV3 prMAY485353 | DENV3 prMEF643017 | DENV3 prMFJ390371 | DENV3 prMEU052797 |
| DENV3 prMAY099337 | DENV3 prMGU131856 | DENV3 prMEF629368 | DENV3 prMGU131858 |
| DENV3 prMFJ182015 | DENV3 prMDQ675525 | DENV3 prMEU081181 | DENV3 prMAY485356 |
| DENV3 prMFJ850049 | DENV3 prMFJ850097 | DENV3 prMAF547232 | DENV3 prMAB038465 |
| DENV3 prMFJ639713 | DENV3 prMFJ639722 | DENV3 prMFJ182007 | DENV3 prMFJ639791 |
| DENV3 prMCS479205 | DENV3 prMAB189127 | DENV3 prMFJ639827 | DENV3 prMDQ177890 |
| DENV3 prML11427 | DENV3 prMFJ639720 | DENV3 prMAB010986 | DENV3 prMEU529704 |
| DENV3 prMGQ868577 | DENV3 prMFJ639729 | DENV3 prML11442 | DENV3 prMGU131936 |
| DENV3 prMEU081198 | DENV3 prMGU131868 | DENV3 prMEU367962 | DENV3 prMGU131903 |
| DENV3 prMAY485350 | DENV3 prMFJ639793 | DENV3 prMDQ401689 | DENV3 prMDQ401694 |
| DENV3 prMGU189648 | DENV3 prMGU363549 | DENV3 prMDQ675531 | DENV3 prMEU081205 |
| DENV3 prMAF547261 | DENV3 prMFJ850109 | DENV3 prMAF547227 | DENV3 prMFJ898470 |
| DENV3 prMEU660409 | DENV3 prMDQ177892 | DENV3 prMFJ639750 | DENV3 prMGQ868571 |
| DENV3 prMAB010985 | DENV3 prMAF547256 | DENV3 prMFJ461326 | DENV3 prMAF547253 |
| DENV3 prMFJ373306 | DENV3 prMEU081218 | DENV3 prMDQ177897 | DENV3 prMEU052799 |
| DENV3 prML11619 | DENV3 prMFJ547081 | DENV3 prMGU131854 | DENV3 prMAB189128 |
| DENV3 prMFJ898463 | DENV3 prMGU131912 | DENV3 prMFJ432722 | DENV3 prMFJ182009 |
| DENV3 prMFJ410177 | DENV3 prMAY923865 | DENV3 prMAY099339 | DENV3 prMFJ810416 |
| DENV3 prMDQ675530 | DENV3 prMAY750713 | DENV3 prMDQ675523 | DENV3 prMGU131852 |
| DENV3 prMFJ744730 | DENV3 prMAY858045 | DENV3 prMFJ547076 | DENV3 prMFN429897 |
| DENV3 prMAY485349 | DENV3 prMFJ547084 | DENV3 prMFJ461337 | DENV3 prMGU131950 |
| DENV3 prMEU081206 | DENV3 prMFJ639774 | DENV3 prML11434 | DENV3 prMFN429896 |

FIG. 68-68

| Virus Protein Accession No. | Virus Protein Accession No. | Virus Protein Accession No. | Virus Protein Accession No. |
|---|---|---|---|
| DENV3 prMAB010982 | DENV3 prMAF547242 | DENV3 prMFJ744700 | DENV3 prMDQ177894 |
| DENV3 prMAF547248 | DENV3 prMAF547228 | DENV3 prMEU081202 | DENV3 prMEU081209 |
| DENV3 prMFJ639789 | DENV3 prMEU081203 | DENV3 prMAB189126 | DENV3 prMFJ639712 |
| DENV3 prMFJ390373 | DENV3 prMFJ562097 | DENV3 prMFJ898458 | DENV3 prMEU482461 |
| DENV3 prMAF547238 | DENV3 prMAY960629 | DENV3 prMFJ744740 | DENV3 prMAY858047 |
| DENV3 prMFJ687448 | DENV3 prMFJ547071 | DENV3 prMEU854292 | DENV3 prMAB038478 |
| DENV3 prMAY099342 | DENV3 prMGU131946 | DENV3 prMFN429902 | DENV3 prMAY676353 |
| DENV3 prMFJ639731 | DENV3 prMDQ177901 | DENV3 prMGU131907 | DENV3 prMEU081210 |
| DENV3 prMFN429907 | DENV3 prMEU529685 | DENV3 prMEU482612 | DENV3 prMEU081199 |
| DENV3 prMAY496879 | DENV3 prMEU081219 | DENV3 prMGU131849 | DENV3 prMEU726774 |
| DENV3 prMEU529697 | DENV3 prMAY665402 | DENV3 prMEU052794 | DENV3 prMAY744677 |
| DENV3 prMFJ744728 | DENV3 prMFJ882571 | DENV3 prMFJ373303 | DENV3 prMFN429901 |
| DENV3 prMFJ639825 | DENV3 prMFJ639762 | DENV3 prMEU081224 | DENV3 prMFJ375134 |
| DENV3 prMGU131914 | DENV3 prMEU081186 | DENV3 prMFJ873812 | DENV3 prMAY750715 |
| DENV3 prMFJ898472 | DENV3 prMGQ868547 | DENV3 prMFJ744734 | DENV3 prMEU687226 |
| DENV3 prMFJ547074 | DENV3 prMGU131878 | DENV3 prMFJ850096 | DENV3 prMDQ177903 |
| DENV3 prMAB038467 | DENV3 prMEU569690 | DENV3 prMFJ639787 | DENV3 prMFN429914 |
| DENV3 prMFJ898469 | DENV3 prMFJ850110 | DENV3 prMFJ882574 | DENV3 prMFJ639768 |
| DENV3 prMFJ744726 | DENV3 prMAY744679 | DENV3 prMGU131873 | DENV3 prMFJ547061 |
| DENV3 prMFJ639725 | DENV3 prMFJ639784 | DENV3 prMGU131867 | DENV3 prMFJ225462 |
| DENV3 prMFJ225463 | DENV3 prMFJ850080 | DENV3 prMGQ199889 | DENV3 prMGU131917 |
| DENV3 prMAF547255 | DENV3 prMAY265856 | DENV3 prMAY632355 | DENV3 prMFJ432728 |
| DENV3 prMGU131851 | DENV3 prMAF547264 | DENV3 prMAF547257 | DENV3 prMAY485352 |
| DENV3 prMEU482555 | DENV3 prMFJ205870 | DENV3 prMGQ252674 | DENV3 prML11428 |
| DENV3 prMGU131938 | DENV3 prMAY912458 | DENV3 prMAF547250 | DENV3 prMEU482456 |
| DENV3 prMAB010989 | DENV3 prMAY858043 | DENV3 prMAB038472 | DENV3 prMGU370053 |
| DENV3 prMEU726773 | DENV3 prMEU596492 | DENV3 prMEU687198 | DENV3 prMFJ744736 |
| DENV3 prMGQ868616 | DENV3 prMGU131875 | DENV3 prMFJ432743 | DENV3 prMDQ675532 |
| DENV3 prMDQ177896 | DENV3 prMEU081191 | DENV3 prMFJ461322 | DENV3 prMFN429904 |
| DENV3 prMGQ199862 | DENV3 prMAY858040 | DENV3 prMGQ868626 | DENV3 prMFJ744731 |
| DENV3 prMGU131908 | DENV3 prMEU482458 | DENV3 prMFJ639728 | DENV3 prMFJ744737 |
| DENV3 prMAY858039 | DENV3 prMEU687197 | DENV3 prMFJ639758 | DENV3 prMAY858037 |
| DENV3 prMEU081214 | DENV3 prML11430 | DENV3 prMEF440434 | DENV3 prMAB010984 |
| DENV3 prMEF629366 | DENV3 prMGQ868578 | DENV3 prMAY776329 | DENV3 prMFJ547077 |
| DENV3 prMAY744680 | DENV3 prMGU131876 | DENV3 prMFJ639721 | DENV3 prMEU569688 |
| DENV3 prMFJ639755 | DENV3 prMFJ547072 | DENV3 prMFJ547080 | DENV3 prMGU131871 |
| DENV3 prMDQ177899 | DENV3 prMAF547235 | DENV3 prMFJ639778 | DENV3 prMGU131845 |
| DENV3 prMDQ675533 | DENV3 prMDQ177891 | DENV3 prMEU081192 | DENV3 prMAF547259 |
| DENV3 prMGU131906 | DENV3 prMAB038469 | DENV3 prMGQ199886 | DENV3 prMEU081195 |
| DENV3 prML11437 | DENV3 prMAY099340 | DENV3 prMGQ868587 | DENV3 prMFJ898456 |
| DENV3 prMGQ868627 | DENV3 prMFJ639779 | DENV3 prMDQ675521 | DENV3 prMEU081187 |
| DENV3 prMGU131943 | DENV3 prMFJ562103 | DENV3 prMFJ182013 | DENV3 prMGU131847 |
| DENV3 prMAF547245 | DENV3 prMDQ401692 | DENV3 prMFJ882576 | DENV3 prMEU081207 |
| DENV3 prMEU482564 | DENV3 prMFJ639792 | DENV3 prMFN429916 | DENV3 prMFJ410176 |
| DENV3 prMGQ199887 | DENV3 prMAF547236 | DENV3 prMGU131913 | DENV3 prMAY770511 |
| DENV3 prMEU726772 | DENV3 prMAY496873 | DENV3 prMDQ367721 | DENV3 prMGU131933 |
| DENV3 prMAY485358 | DENV3 prMFN429909 | DENV3 prMEU781136 | DENV3 prML11440 |
| DENV3 prMFJ182010 | DENV3 prMFJ639816 | DENV3 prMFJ639726 | DENV3 prMGQ199870 |

FIG. 68-69

| Virus Protein Accession No. | Virus Protein Accession No. | Virus Protein Accession No. | Virus Protein Accession No. |
|---|---|---|---|
| DENV3 prMFJ850098 | DENV3 prMFJ898443 | DENV3 prMEU726771 | DENV3 prMFJ639798 |
| DENV3 prMAB189125 | DENV3 prMAY496876 | DENV3 prML11431 | DENV3 prMAB010988 |
| DENV3 prMFJ432741 | DENV3 prMAY744684 | DENV3 prMGQ868572 | DENV3 prMAY099338 |
| DENV3 prML11435 | DENV3 prMFJ850048 | DENV3 prMFJ898473 | DENV3 prMFJ639803 |
| DENV3 prMEU529690 | DENV3 prMGQ868575 | DENV3 prMEU687196 | DENV3 prMFJ432731 |
| DENV3 prMFJ639804 | DENV3 prMFJ562100 | DENV3 prMFN429906 | DENV3 prMAY960628 |
| DENV3 prMAF349753 | DENV3 prMGU131942 | DENV3 prMFJ639730 | DENV3 prMAF317645 |
| DENV3 prMFJ182038 | DENV3 prMEU529688 | DENV3 prML11425 | DENV3 prMFJ898445 |
| DENV3 prMDQ675526 | DENV3 prMDQ401690 | DENV3 prMEU081215 | DENV3 prMAB010987 |
| DENV3 prMAY265857 | DENV3 prMEF629369 | DENV3 prMGU131935 | DENV3 prMDQ177900 |
| DENV3 prMGU131857 | DENV3 prMAF547241 | DENV3 prMFN429913 | DENV3 prMFJ182006 |
| DENV3 prMAB214882 | DENV3 prMAY496875 | DENV3 prMFJ639751 | DENV3 prMAF547239 |
| DENV3 prMEU081217 | DENV3 prMFJ639714 | DENV3 prMEU052798 | DENV3 prMFJ547069 |
| DENV3 prMFJ024469 | DENV3 prMAF547233 | DENV3 prMAF547244 | DENV3 prMEU687234 |
| DENV3 prMAB214881 | DENV3 prMAY676351 | DENV3 prMFJ639780 | DENV3 prMFJ850092 |
| DENV3 prMGU131911 | DENV3 prMGQ868573 | DENV3 prMEU081189 | DENV3 prMFJ390377 |
| DENV3 prMGU131869 | DENV3 prMAY099336 | DENV3 prML11433 | DENV3 prMFJ547075 |
| DENV3 prMEU932688 | DENV3 prMEU081182 | DENV3 prMAY676350 | DENV3 prMDQ177889 |
| DENV3 prMFJ547070 | DENV3 prMGU131855 | DENV3 prMFJ898441 | DENV3 prMFJ850089 |
| DENV3 prMFJ639790 | DENV3 prMDQ863638 | DENV3 prMFJ024471 | DENV3 prMAY744683 |
| DENV3 prMAB038470 | DENV3 prMFJ639746 | DENV3 prMEU081221 | DENV3 prMFJ639756 |
| DENV3 prMFJ639772 | DENV3 prMEU482454 | DENV3 prMAY485357 | DENV3 prMFJ547062 |
| DENV3 prMEU081190 | DENV3 prMEU081197 | DENV3 prMDQ367722 | DENV3 prMEF629367 |
| DENV3 prMFJ639723 | DENV3 prMEU081212 | DENV3 prMEU081223 | DENV3 prMAY099341 |
| DENV3 prMEU482613 | DENV3 prMAY485354 | DENV3 prMFJ410178 | DENV3 prMFJ225465 |
| DENV3 prMFJ850055 | DENV3 prMFJ850083 | DENV3 prMEU482563 | DENV3 prMAY858048 |
| DENV3 prMEU482558 | DENV3 prMEU660408 | DENV3 prMAF547226 | DENV3 prMGU131905 |
| DENV3 prMAF547260 | DENV3 prMFJ639752 | DENV3 prMGU131874 | DENV3 prMFB667400 |
| DENV3 prMFN429899 | DENV3 prMAY485351 | DENV3 prMFJ547082 | DENV3 prMEU482460 |
| DENV3 prMEU660410 | DENV3 prMAY676349 | DENV3 prMFJ547083 | DENV3 prMFJ639753 |
| DENV3 prMAY750717 | DENV3 prMM86733 | DENV3 prMFJ639760 | DENV3 prMFJ882572 |
| DENV3 prMAY858044 | DENV3 prMFJ898462 | DENV3 prMGU131853 | DENV3 prMEU529684 |
| DENV3 prMEU726768 | DENV3 prMFN429912 | DENV3 prMEU081183 | DENV3 prMFJ182041 |
| DENV3 prMFJ639766 | DENV3 prMEU529686 | DENV3 prMGQ199864 | DENV3 prMGQ199891 |
| DENV3 prMAY960625 | DENV3 prMFJ744739 | DENV3 prMAY750714 | DENV3 prMEU932687 |
| DENV3 prMEU529698 | DENV3 prMEU259607 | DENV3 prMNC_001475 | DENV3 prMGQ868548 |
| DENV3 prMEU687239 | DENV3 prMAY676348 | DENV3 prMAY960634 | DENV3 prMEU259605 |
| DENV3 prMDQ675528 | DENV3 prMAY679147 | DENV3 prMEU482459 | DENV3 prMFN429911 |
| DENV3 prMFJ639807 | DENV3 prMGU131904 | DENV3 prMFJ639716 | DENV3 prMGU131945 |
| DENV3 prMDQ177887 | DENV3 prMFJ461338 | DENV3 prMFJ547073 | DENV3 prMAF547243 |
| DENV3 prMFJ898475 | DENV3 prMEU081213 | DENV3 prMFJ639763 | DENV3 prMFJ461329 |
| DENV3 prMEU081200 | DENV3 prMAY744681 | DENV3 prMFJ410229 | DENV3 prMFJ850111 |
| DENV3 prMAF547230 | DENV3 prMAY662691 | DENV3 prMFJ898464 | DENV3 prMFJ639776 |
| DENV3 prMFJ390376 | DENV3 prMAY876494 | DENV3 prMFJ744729 | DENV3 prMEU081194 |
| DENV3 prMEU529702 | DENV3 prMGU131944 | DENV3 prMEU687218 | DENV3 prMFJ639761 |
| DENV3 prMEU259608 | DENV3 prMEU687221 | DENV3 prMGU131910 | DENV3 prMEU081204 |
| DENV3 prMFJ639781 | DENV3 prMAB038474 | DENV3 prMGU131916 | DENV3 prMGQ868628 |
| DENV3 prMFJ182004 | DENV3 prMEU529705 | DENV3 prMGQ199863 | DENV3 prML11441 |

FIG. 68-70

| Virus Protein Accession No. | Virus Protein Accession No. | Virus Protein Accession No. | Virus Protein Accession No. |
|---|---|---|---|
| DENV3 prMFJ850086 | DENV3 prMFJ390372 | DENV3 prMAB038479 | DENV3 prMAF547238 |
| DENV3 prMFJ639785 | DENV3 prMAF547237 | DENV3 prMAY960633 | DENV3 prMAY099342 |
| DENV3 prMAF547249 | DENV3 prMFN429918 | DENV3 prML11436 | DENV3 prMAB038467 |
| DENV3 prMFJ639810 | DENV3 prMFJ744727 | DENV3 prMAF547251 | DENV3 prMFJ225463 |
| DENV3 prML11423 | DENV3 prMFJ744732 | DENV3 prMAY912454 | DENV3 prMAF547255 |
| DENV3 prMFJ882578 | DENV3 prMFJ898446 | DENV3 prMEU259606 | DENV3 prMAB010989 |
| DENV3 prMDQ177902 | DENV3 prMFJ744733 | DENV3 prMAY485353 | DENV3 prMDQ177896 |
| DENV3 prMGU131940 | DENV3 prMFJ873813 | DENV3 prML11427 | DENV3 prMDQ177899 |
| DENV3 prMDQ401695 | DENV3 prMGQ199861 | DENV3 prMAY485350 | DENV3 prML11437 |
| DENV3 prMEU529696 | DENV3 prML11620 | DENV3 prMAF547261 | DENV3 prMAF547245 |
| DENV3 prMAF547229 | DENV3 prMEU081225 | DENV3 prMAB010985 | DENV3 prMAY485358 |
| DENV3 prMAF547263 | DENV3 prMAY038605 | DENV3 prML11619 | DENV3 prMAF547242 |
| DENV3 prMAY750716 | DENV3 prMGU131850 | DENV3 prMAY485349 | DENV3 prMAF547228 |
| DENV3 prMAY858042 | DENV3 prMFJ850094 | DENV3 prML11426 | DENV3 prMAY960629 |
| DENV3 prMEU482596 | DENV3 prMDQ675529 | DENV3 prMEF441284 | DENV3 prMDQ177901 |
| DENV3 prMAY485360 | DENV3 prMAB038476 | DENV3 prMAB010990 | DENV3 prMAY665402 |
| DENV3 prMFJ205871 | DENV3 prMFJ850079 | DENV3 prMAF547225 | DENV3 prMAY265856 |
| DENV3 prMEU052792 | DENV3 prMFJ547079 | DENV3 prMAY485355 | DENV3 prMAF547264 |
| DENV3 prMGU131860 | DENV3 prMGU131909 | DENV3 prMDQ177892 | DENV3 prMAY912458 |
| DENV3 prMEU482457 | DENV3 prMDQ177898 | DENV3 prMAF547256 | DENV3 prML11430 |
| DENV3 prMAY485359 | DENV3 prMAY496871 | DENV3 prMAY750713 | DENV3 prMAF547235 |
| DENV3 prMAJ563355 | DENV3 prMGU131937 | DENV3 prMAB038471 | DENV3 prMDQ177891 |
| DENV3 prMEU529703 | DENV3 prMDQ401693 | DENV3 prMAY960631 | DENV3 prMAB038469 |
| DENV3 prMFJ639782 | DENV3 prMFJ177308 | DENV3 prMDQ177888 | DENV3 prMAY099340 |
| DENV3 prMFJ639800 | DENV3 prMDQ177893 | DENV3 prMAF547232 | DENV3 prMAF547236 |
| DENV3 prMGU131918 | DENV3 prMAY912455 | DENV3 prMAB010986 | DENV3 prMEU052794 |
| DENV3 prMFJ182008 | DENV3 prMFJ375135 | DENV3 prML11442 | DENV3 prMAY632355 |
| DENV3 prMAY496878 | DENV3 prMAF547240 | DENV3 prMAF547227 | DENV3 prMAF547257 |
| DENV3 prMAY960632 | DENV3 prML11438 | DENV3 prMDQ177897 | DENV3 prMAF547250 |
| DENV3 prMFJ639719 | DENV3 prMAB038466 | DENV3 prMAY099339 | DENV3 prMAB038472 |
| DENV3 prMGU131939 | DENV3 prMAB038477 | DENV3 prML11434 | DENV3 prMEF440434 |
| DENV3 prMFJ639749 | DENV3 prML11429 | DENV3 prMAB038475 | DENV3 prMDQ367721 |
| DENV3 prMGU131848 | DENV3 prMAY750718 | DENV3 prMAF547262 | DENV3 prMDQ177894 |
| DENV3 prMGU131859 | DENV3 prMFJ225464 | DENV3 prMAF547247 | DENV3 prMAB038478 |
| DENV3 prMFJ182011 | DENV3 prMAF547234 | DENV3 prMAF547258 | DENV3 prMFJ375134 |
| DENV3 prMAY858038 | DENV3 prMAB038473 | DENV3 prML11424 | DENV3 prMAY750715 |
| DENV3 prMFJ547085 | DENV3 prMAF547254 | DENV3 prMM25277 | DENV3 prMDQ177903 |
| DENV3 prMAB010983 | DENV3 prMAY960635 | DENV3 prML11439 | DENV3 prMFJ225462 |
| DENV3 prMAY496872 | DENV3 prMEU052793 | DENV3 prMAF547231 | DENV3 prMAY485352 |
| DENV3 prMGU131953 | DENV3 prMAY960630 | DENV3 prML11432 | DENV3 prML11428 |
| DENV3 prML11422 | DENV3 prMAB038468 | DENV3 prMEU052797 | DENV3 prMAB010984 |
| DENV3 prMDQ675524 | DENV3 prMDQ177886 | DENV3 prMAY485356 | DENV3 prMAF547259 |
| DENV3 prMAF547252 | DENV3 prMDQ367720 | DENV3 prMAB038465 | DENV3 prML11440 |
| DENV3 prMFJ898471 | DENV3 prMDQ371245 | DENV3 prMDQ177890 | DENV3 prML11435 |
| DENV3 prMEU596494 | DENV3 prMEU052795 | DENV3 prMAF547253 | DENV3 prMAF349753 |
| DENV3 prMEU569691 | DENV3 prMEU052796 | DENV3 prMEU052799 | DENV3 prMAY265857 |
| DENV3 prMAB214879 | DENV3 prMAF547246 | DENV3 prMAB010982 | DENV3 prMAB038470 |
| DENV3 prMEU854298 | DENV3 prMDQ177895 | DENV3 prMAF547248 | DENV3 prMAF547260 |

FIG. 68-71

| Virus Protein Accession No. | Virus Protein Accession No. | Virus Protein Accession No. | Virus Protein Accession No. |
|---|---|---|---|
| DENV3 prMAY750717 | DENV3 prMAB010983 | DENV3 prMAY750713 | DENV3 prMAY099340 |
| DENV3 prMAY960625 | DENV3 prMAY496872 | DENV3 prMAB038471 | DENV3 prMAF547236 |
| DENV3 prMDQ177887 | DENV3 prML11422 | DENV3 prMAY960631 | DENV3 prMAY632355 |
| DENV3 prMAF547230 | DENV3 prMAF547252 | DENV3 prMDQ177888 | DENV3 prMAF547257 |
| DENV3 prMEU259608 | DENV3 prMAF547237 | DENV3 prMAF547232 | DENV3 prMAF547250 |
| DENV3 prMAY496876 | DENV3 prML11620 | DENV3 prMAB010986 | DENV3 prMAB038472 |
| DENV3 prMAF547241 | DENV3 prMAY038605 | DENV3 prML11442 | DENV3 prMEF440434 |
| DENV3 prMAY496875 | DENV3 prMAB038476 | DENV3 prMAF547227 | DENV3 prMDQ367721 |
| DENV3 prMAF547233 | DENV3 prMDQ177898 | DENV3 prMDQ177897 | DENV3 prMDQ177894 |
| DENV3 prMAY485354 | DENV3 prMDQ177893 | DENV3 prMAY099339 | DENV3 prMAB038478 |
| DENV3 prMAY485351 | DENV3 prMFJ375135 | DENV3 prML11434 | DENV3 prMFJ375134 |
| DENV3 prMM86733 | DENV3 prMAF547240 | DENV3 prMAB038475 | DENV3 prMAY750715 |
| DENV3 prMEU259607 | DENV3 prML11438 | DENV3 prMAF547262 | DENV3 prMDQ177903 |
| DENV3 prMAB038474 | DENV3 prMAB038466 | DENV3 prMAF547247 | DENV3 prMFJ225462 |
| DENV3 prML11431 | DENV3 prMAB038477 | DENV3 prMAF547258 | DENV3 prMAY485352 |
| DENV3 prML11425 | DENV3 prML11429 | DENV3 prML11424 | DENV3 prML11428 |
| DENV3 prMEU052798 | DENV3 prMAY750718 | DENV3 prMM25277 | DENV3 prMAB010984 |
| DENV3 prMAF547244 | DENV3 prMFJ225464 | DENV3 prML11439 | DENV3 prMAF547259 |
| DENV3 prML11433 | DENV3 prMAF547234 | DENV3 prMAF547231 | DENV3 prML11440 |
| DENV3 prMAY485357 | DENV3 prMAB038473 | DENV3 prML11432 | DENV3 prML11435 |
| DENV3 prMDQ367722 | DENV3 prMAF547254 | DENV3 prMAY485356 | DENV3 prMAF349753 |
| DENV3 prMAF547226 | DENV3 prMAY960635 | DENV3 prMAB038465 | DENV3 prMAY265857 |
| DENV3 prMAY750714 | DENV3 prMAY960630 | DENV3 prMDQ177890 | DENV3 prMAB038470 |
| DENV3 prMAY960634 | DENV3 prMAB038468 | DENV3 prMAF547253 | DENV3 prMAF547260 |
| DENV3 prMAB010988 | DENV3 prMDQ177886 | DENV3 prMAB010982 | DENV3 prMAY750717 |
| DENV3 prMAY099338 | DENV3 prMDQ367720 | DENV3 prMAF547248 | DENV3 prMAY960625 |
| DENV3 prMAY960628 | DENV3 prMDQ371245 | DENV3 prMAF547238 | DENV3 prMDQ177887 |
| DENV3 prMAB010987 | DENV3 prMAF547246 | DENV3 prMAY099342 | DENV3 prMAF547230 |
| DENV3 prMDQ177900 | DENV3 prMDQ177895 | DENV3 prMAB038467 | DENV3 prMEU259608 |
| DENV3 prMAF547239 | DENV3 prMAB038479 | DENV3 prMFJ225463 | DENV3 prMAF547241 |
| DENV3 prMDQ177889 | DENV3 prMAY960633 | DENV3 prMAF547255 | DENV3 prMAF547233 |
| DENV3 prMAY099341 | DENV3 prML11436 | DENV3 prMAB010989 | DENV3 prMAY485354 |
| DENV3 prMFJ225465 | DENV3 prMAF547251 | DENV3 prMDQ177896 | DENV3 prMAY485351 |
| DENV3 prMEU259605 | DENV3 prMEU259606 | DENV3 prMDQ177899 | DENV3 prMM86733 |
| DENV3 prMAF547243 | DENV3 prMAY485353 | DENV3 prML11437 | DENV3 prMEU259607 |
| DENV3 prML11441 | DENV3 prML11427 | DENV3 prMAF547245 | DENV3 prMAB038474 |
| DENV3 prMAF547249 | DENV3 prMAY485350 | DENV3 prMAY485358 | DENV3 prML11431 |
| DENV3 prML11423 | DENV3 prMAF547261 | DENV3 prMAF547242 | DENV3 prML11425 |
| DENV3 prMDQ177902 | DENV3 prMAB010985 | DENV3 prMAF547228 | DENV3 prMAF547244 |
| DENV3 prMAF547229 | DENV3 prML11619 | DENV3 prMAY960629 | DENV3 prML11433 |
| DENV3 prMAF547263 | DENV3 prMAY485349 | DENV3 prMDQ177901 | DENV3 prMAY485357 |
| DENV3 prMAY750716 | DENV3 prML11426 | DENV3 prMAY665402 | DENV3 prMDQ367722 |
| DENV3 prMAY485360 | DENV3 prMEF441284 | DENV3 prMAY265856 | DENV3 prMAF547226 |
| DENV3 prMEU052792 | DENV3 prMAB010990 | DENV3 prMAF547264 | DENV3 prMAY750714 |
| DENV3 prMAY485359 | DENV3 prMAF547225 | DENV3 prML11430 | DENV3 prMAY960634 |
| DENV3 prMAJ563355 | DENV3 prMAY485355 | DENV3 prMAF547235 | DENV3 prMAB010988 |
| DENV3 prMAY496878 | DENV3 prMDQ177892 | DENV3 prMDQ177891 | DENV3 prMAY099338 |
| DENV3 prMAY960632 | DENV3 prMAF547256 | DENV3 prMAB038469 | DENV3 prMAY960628 |

FIG. 68-72

| Virus Protein Accession No. | Virus Protein Accession No. | Virus Protein Accession No. | Virus Protein Accession No. |
|---|---|---|---|
| DENV3 prMAB010987 | DENV3 prMAY960633 | DENV3 prMAF547255 | DENV3 prMAF547233 |
| DENV3 prMDQ177900 | DENV3 prML11436 | DENV3 prMAB010989 | DENV3 prMAY485354 |
| DENV3 prMAF547239 | DENV3 prMAF547251 | DENV3 prMDQ177896 | DENV3 prMAY485351 |
| DENV3 prMDQ177889 | DENV3 prMEU259606 | DENV3 prMDQ177899 | DENV3 prMM86733 |
| DENV3 prMAY099341 | DENV3 prMAY485353 | DENV3 prML11437 | DENV3 prMEU259607 |
| DENV3 prMFJ225465 | DENV3 prML11427 | DENV3 prMAF547245 | DENV3 prMAB038474 |
| DENV3 prMEU259605 | DENV3 prMAY485350 | DENV3 prMAY485358 | DENV3 prML11431 |
| DENV3 prMAF547243 | DENV3 prMAF547261 | DENV3 prMAF547242 | DENV3 prML11425 |
| DENV3 prML11441 | DENV3 prMAB010985 | DENV3 prMAF547228 | DENV3 prMAF547244 |
| DENV3 prMAF547249 | DENV3 prML11619 | DENV3 prMAY960629 | DENV3 prML11433 |
| DENV3 prML11423 | DENV3 prMAY485349 | DENV3 prMDQ177901 | DENV3 prMAY485357 |
| DENV3 prMDQ177902 | DENV3 prML11426 | DENV3 prMAY665402 | DENV3 prMDQ367722 |
| DENV3 prMAF547229 | DENV3 prMEF441284 | DENV3 prMAY265856 | DENV3 prMAF547226 |
| DENV3 prMAF547263 | DENV3 prMAB010990 | DENV3 prMAF547264 | DENV3 prMAY750714 |
| DENV3 prMAY750716 | DENV3 prMAF547225 | DENV3 prML11430 | DENV3 prMAY960634 |
| DENV3 prMAY485360 | DENV3 prMAY485355 | DENV3 prMAF547235 | DENV3 prMAB010988 |
| DENV3 prMAY485359 | DENV3 prMDQ177892 | DENV3 prMDQ177891 | DENV3 prMAY099338 |
| DENV3 prMAJ563355 | DENV3 prMAF547256 | DENV3 prMAB038469 | DENV3 prMAY960628 |
| DENV3 prMAY960632 | DENV3 prMAY750713 | DENV3 prMAY099340 | DENV3 prMAB010987 |
| DENV3 prMAB010983 | DENV3 prMAB038471 | DENV3 prMAF547236 | DENV3 prMDQ177900 |
| DENV3 prML11422 | DENV3 prMAY960631 | DENV3 prMAY632355 | DENV3 prMAF547239 |
| DENV3 prMAF547252 | DENV3 prMDQ177888 | DENV3 prMAF547257 | DENV3 prMDQ177889 |
| DENV3 prMAF547237 | DENV3 prMAF547232 | DENV3 prMAF547250 | DENV3 prMAY099341 |
| DENV3 prML11620 | DENV3 prMAB010986 | DENV3 prMAB038472 | DENV3 prMFJ225465 |
| DENV3 prMAY038605 | DENV3 prML11442 | DENV3 prMEF440434 | DENV3 prMEU259605 |
| DENV3 prMAB038476 | DENV3 prMAF547227 | DENV3 prMDQ367721 | DENV3 prMAF547243 |
| DENV3 prMDQ177898 | DENV3 prMDQ177897 | DENV3 prMDQ177894 | DENV3 prML11441 |
| DENV3 prMDQ177893 | DENV3 prMAY099339 | DENV3 prMAB038478 | DENV3 prMAF547249 |
| DENV3 prMFJ375135 | DENV3 prML11434 | DENV3 prMFJ375134 | DENV3 prML11423 |
| DENV3 prMAF547240 | DENV3 prMAB038475 | DENV3 prMAY750715 | DENV3 prMDQ177902 |
| DENV3 prML11438 | DENV3 prMAF547262 | DENV3 prMDQ177903 | DENV3 prMAF547229 |
| DENV3 prMAB038466 | DENV3 prMAF547247 | DENV3 prMFJ225462 | DENV3 prMAF547263 |
| DENV3 prMAB038477 | DENV3 prMAF547258 | DENV3 prMAY485352 | DENV3 prMAY750716 |
| DENV3 prML11429 | DENV3 prML11424 | DENV3 prML11428 | DENV3 prMAY485360 |
| DENV3 prMAY750718 | DENV3 prMM25277 | DENV3 prMAB010984 | DENV3 prMAY485359 |
| DENV3 prMFJ225464 | DENV3 prML11439 | DENV3 prMAF547259 | DENV3 prMAJ563355 |
| DENV3 prMAF547234 | DENV3 prMAF547231 | DENV3 prML11440 | DENV3 prMAY960632 |
| DENV3 prMAB038473 | DENV3 prML11432 | DENV3 prML11435 | DENV3 prMAB010983 |
| DENV3 prMAF547254 | DENV3 prMAY485356 | DENV3 prMAF349753 | DENV3 prML11422 |
| DENV3 prMAY960635 | DENV3 prMAB038465 | DENV3 prMAY265857 | DENV3 prMAF547252 |
| DENV3 prMAY960630 | DENV3 prMDQ177890 | DENV3 prMAB038470 | DENV3 prMAF547237 |
| DENV3 prMAB038468 | DENV3 prMAF547253 | DENV3 prMAF547260 | DENV3 prML11620 |
| DENV3 prMDQ177886 | DENV3 prMAB010982 | DENV3 prMAY750717 | DENV3 prMAY038605 |
| DENV3 prMDQ367720 | DENV3 prMAF547248 | DENV3 prMAY960625 | DENV3 prMAB038476 |
| DENV3 prMDQ371245 | DENV3 prMAF547238 | DENV3 prMDQ177887 | DENV3 prMDQ177898 |
| DENV3 prMAF547246 | DENV3 prMAY099342 | DENV3 prMAF547230 | DENV3 prMDQ177893 |
| DENV3 prMDQ177895 | DENV3 prMAB038467 | DENV3 prMEU259608 | DENV3 prMFJ375135 |
| DENV3 prMAB038479 | DENV3 prMFJ225463 | DENV3 prMAF547241 | DENV3 prMAF547240 |

FIG. 68-73

| Virus Protein Accession No. | Virus Protein Accession No. | Virus Protein Accession No. | Virus Protein Accession No. |
|---|---|---|---|
| DENV3 prML11438 | DENV3 prMAF547262 | DENV3 prMDQ177903 | DENV3 prMAF547229 |
| DENV3 prMAB038466 | DENV3 prMAF547247 | DENV3 prMFJ225462 | DENV3 prMAF547263 |
| DENV3 prMAB038477 | DENV3 prMAF547258 | DENV3 prMAY485352 | DENV3 prMAY750716 |
| DENV3 prML11429 | DENV3 prML11424 | DENV3 prML11428 | DENV3 prMAY485360 |
| DENV3 prMAY750718 | DENV3 prMM25277 | DENV3 prMAB010984 | DENV3 prMAY485359 |
| DENV3 prMFJ225464 | DENV3 prML11439 | DENV3 prMAF547259 | DENV3 prMAJ563355 |
| DENV3 prMAF547234 | DENV3 prMAF547231 | DENV3 prML11440 | DENV3 prMAY960632 |
| DENV3 prMAB038473 | DENV3 prML11432 | DENV3 prML11435 | DENV3 prMAB010983 |
| DENV3 prMAF547254 | DENV3 prMAY485356 | DENV3 prMAF349753 | DENV3 prML11422 |
| DENV3 prMAY960635 | DENV3 prMAB038465 | DENV3 prMAY265857 | DENV3 prMAF547252 |
| DENV3 prMAY960630 | DENV3 prMDQ177890 | DENV3 prMAB038470 | DENV3 prMAF547237 |
| DENV3 prMAB038468 | DENV3 prMAF547253 | DENV3 prMAF547260 | DENV3 prML11620 |
| DENV3 prMDQ177886 | DENV3 prMAB010982 | DENV3 prMAY750717 | DENV3 prMAY038605 |
| DENV3 prMDQ367720 | DENV3 prMAF547248 | DENV3 prMAY960625 | DENV3 prMAB038476 |
| DENV3 prMDQ371245 | DENV3 prMAF547238 | DENV3 prMDQ177887 | DENV3 prMDQ177898 |
| DENV3 prMAF547246 | DENV3 prMAY099342 | DENV3 prMAF547230 | |
| DENV3 prMDQ177895 | DENV3 prMAB038467 | DENV3 prMEU259608 | |
| DENV3 prMAB038479 | DENV3 prMFJ225463 | DENV3 prMAF547241 | |
| DENV3 prMAY960633 | DENV3 prMAF547255 | DENV3 prMAF547233 | |
| DENV3 prML11436 | DENV3 prMAB010989 | DENV3 prMAY485354 | |
| DENV3 prMAF547251 | DENV3 prMDQ177896 | DENV3 prMAY485351 | |
| DENV3 prMEU259606 | DENV3 prMDQ177899 | DENV3 prMM86733 | |
| DENV3 prMAY485353 | DENV3 prML11437 | DENV3 prMEU259607 | |
| DENV3 prML11427 | DENV3 prMAF547245 | DENV3 prMAB038474 | |
| DENV3 prMAY485350 | DENV3 prMAY485358 | DENV3 prML11431 | |
| DENV3 prMAF547261 | DENV3 prMAF547242 | DENV3 prML11425 | |
| DENV3 prMAB010985 | DENV3 prMAF547228 | DENV3 prMAF547244 | |
| DENV3 prML11619 | DENV3 prMAY960629 | DENV3 prML11433 | |
| DENV3 prMAY485349 | DENV3 prMDQ177901 | DENV3 prMAY485357 | |
| DENV3 prML11426 | DENV3 prMAY665402 | DENV3 prMDQ367722 | |
| DENV3 prMEF441284 | DENV3 prMAY265856 | DENV3 prMAF547226 | |
| DENV3 prMAB010990 | DENV3 prMAF547264 | DENV3 prMAY750714 | |
| DENV3 prMAF547225 | DENV3 prML11430 | DENV3 prMAY960634 | |
| DENV3 prMAY485355 | DENV3 prMAF547235 | DENV3 prMAB010988 | |
| DENV3 prMDQ177892 | DENV3 prMDQ177891 | DENV3 prMAY099338 | |
| DENV3 prMAF547256 | DENV3 prMAB038469 | DENV3 prMAY960628 | |
| DENV3 prMAY750713 | DENV3 prMAY099340 | DENV3 prMAB010987 | |
| DENV3 prMAB038471 | DENV3 prMAF547236 | DENV3 prMDQ177900 | |
| DENV3 prMAY960631 | DENV3 prMAY632355 | DENV3 prMAF547239 | |
| DENV3 prMDQ177888 | DENV3 prMAF547257 | DENV3 prMDQ177889 | |
| DENV3 prMAF547232 | DENV3 prMAF547250 | DENV3 prMAY099341 | |
| DENV3 prMAB010986 | DENV3 prMAB038472 | DENV3 prMFJ225465 | |
| DENV3 prML11442 | DENV3 prMEF440434 | DENV3 prMEU259605 | |
| DENV3 prMAF547227 | DENV3 prMDQ367721 | DENV3 prMAF547243 | |
| DENV3 prMDQ177897 | DENV3 prMDQ177894 | DENV3 prML11441 | |
| DENV3 prMAY099339 | DENV3 prMAB038478 | DENV3 prMAF547249 | |
| DENV3 prML11434 | DENV3 prMFJ375134 | DENV3 prML11423 | |
| DENV3 prMAB038475 | DENV3 prMAY750715 | DENV3 prMDQ177902 | |

FIG. 69-1

| Virus Protein | Accession No. | Virus Protein | Accession No. | Virus Protein | Accession No. |
|---|---|---|---|---|---|
| DENV4 NS4A | GU289913 | DENV4 NS4A | FN429922 | DENV4 NS4A | AF326827 |
| DENV4 NS4A | FJ639742 | DENV4 NS4A | GQ868583 | DENV4 NS4A | GQ868579 |
| DENV4 NS4A | FN429919 | DENV4 NS4A | FJ182016 | DENV4 NS4A | FJ882588 |
| DENV4 NS4A | AY947539 | DENV4 NS4A | FJ226067 | DENV4 NS4A | AF326826 |
| DENV4 NS4A | GQ868645 | DENV4 NS4A | EU854296 | DENV4 NS4A | AY243469 |
| DENV4 NS4A | FJ639773 | DENV4 NS4A | GQ868584 | DENV4 NS4A | M14931 |
| DENV4 NS4A | AY858050 | DENV4 NS4A | GQ868643 | DENV4 NS4A | FJ882596 |
| DENV4 NS4A | GQ199883 | DENV4 NS4A | GQ199880 | DENV4 NS4A | GQ199876 |
| DENV4 NS4A | FJ850057 | DENV4 NS4A | AY776330 | DENV4 NS2A | GU289913 |
| DENV4 NS4A | GQ199878 | DENV4 NS4A | FJ882580 | DENV4 NS2A | FJ639742 |
| DENV4 NS4A | AY762085 | DENV4 NS4A | GQ868585 | DENV4 NS2A | FN429919 |
| DENV4 NS4A | AY243468 | DENV4 NS4A | GQ199882 | DENV4 NS2A | AY947539 |
| DENV4 NS4A | FJ882600 | DENV4 NS4A | NC_002640 | DENV4 NS2A | GQ868645 |
| DENV4 NS4A | EF457906 | DENV4 NS4A | AY618993 | DENV4 NS2A | FJ639773 |
| DENV4 NS4A | GQ868581 | DENV4 NS4A | FJ882595 | DENV4 NS2A | AY858050 |
| DENV4 NS4A | GQ199884 | DENV4 NS4A | FJ882589 | DENV4 NS2A | GQ199883 |
| DENV4 NS4A | EU854297 | DENV4 NS4A | FJ639736 | DENV4 NS2A | FJ850057 |
| DENV4 NS4A | FJ882597 | DENV4 NS4A | FJ882592 | DENV4 NS2A | GQ199878 |
| DENV4 NS4A | AY618991 | DENV4 NS4A | FJ024424 | DENV4 NS2A | AY762085 |
| DENV4 NS4A | GQ199879 | DENV4 NS4A | FJ882581 | DENV4 NS2A | AY243468 |
| DENV4 NS4A | FJ639764 | DENV4 NS4A | FJ882601 | DENV4 NS2A | FJ882600 |
| DENV4 NS4A | GQ252675 | DENV4 NS4A | FJ850095 | DENV4 NS2A | EF457906 |
| DENV4 NS4A | GQ868642 | DENV4 NS4A | AY618992 | DENV4 NS2A | GQ868581 |
| DENV4 NS4A | AF375822 | DENV4 NS4A | FJ639748 | DENV4 NS2A | GQ199884 |
| DENV4 NS4A | FJ639744 | DENV4 NS4A | EU854301 | DENV4 NS2A | EU854297 |
| DENV4 NS4A | AF326573 | DENV4 NS4A | FN429925 | DENV4 NS2A | FJ882597 |
| DENV4 NS4A | FJ639739 | DENV4 NS4A | EU854299 | DENV4 NS2A | AY618991 |
| DENV4 NS4A | FN429924 | DENV4 NS4A | AY618990 | DENV4 NS2A | GQ199879 |
| DENV4 NS4A | FN429923 | DENV4 NS4A | FJ182017 | DENV4 NS2A | FJ639764 |
| DENV4 NS4A | FJ850058 | DENV4 NS4A | AF326825 | DENV4 NS2A | GQ252675 |
| DENV4 NS4A | GQ868580 | DENV4 NS4A | FJ882586 | DENV4 NS2A | GQ868642 |
| DENV4 NS4A | GQ199885 | DENV4 NS4A | CS479206 | DENV4 NS2A | AF375822 |
| DENV4 NS4A | FN429920 | DENV4 NS4A | FJ882587 | DENV4 NS2A | FJ639744 |
| DENV4 NS4A | AY376438 | DENV4 NS4A | AY858049 | DENV4 NS2A | AF326573 |
| DENV4 NS4A | GQ199881 | DENV4 NS4A | EU854300 | DENV4 NS2A | FJ639739 |
| DENV4 NS4A | AY618988 | DENV4 NS4A | FJ882599 | DENV4 NS2A | FN429924 |
| DENV4 NS4A | FJ639738 | DENV4 NS4A | FJ024476 | DENV4 NS2A | FN429923 |
| DENV4 NS4A | FJ882598 | DENV4 NS4A | AY648301 | DENV4 NS2A | FJ850058 |
| DENV4 NS4A | AF289029 | DENV4 NS4A | GQ868582 | DENV4 NS2A | GQ868580 |
| DENV4 NS4A | FB667402 | DENV4 NS4A | FN429926 | DENV4 NS2A | GQ199885 |
| DENV4 NS4A | FJ810417 | DENV4 NS4A | FJ639745 | DENV4 NS2A | FN429920 |
| DENV4 NS4A | AY618989 | DENV4 NS4A | FJ850059 | DENV4 NS2A | AY376438 |
| DENV4 NS4A | GQ868644 | DENV4 NS4A | FN429921 | DENV4 NS2A | GQ199881 |
| DENV4 NS4A | FJ882585 | DENV4 NS4A | FJ882590 | DENV4 NS2A | AY618988 |
| DENV4 NS4A | FJ882584 | DENV4 NS4A | GQ868594 | DENV4 NS2A | FJ639738 |
| DENV4 NS4A | EU854295 | DENV4 NS4A | FJ639737 | DENV4 NS2A | FJ882598 |
| DENV4 NS4A | CS477306 | DENV4 NS4A | FJ882583 | DENV4 NS2A | AF289029 |
| DENV4 NS4A | FJ882582 | DENV4 NS4A | FJ882591 | DENV4 NS2A | FB667402 |

FIG. 69-2

| Virus Protein | Accession No. | Virus Protein | Accession No. | Virus Protein | Accession No. |
|---|---|---|---|---|---|
| DENV4 NS2A | FJ810417 | DENV4 NS2A | FJ639745 | DENV4 E | GQ139563 |
| DENV4 NS2A | AY618989 | DENV4 NS2A | FJ850059 | DENV4 E | FB667402 |
| DENV4 NS2A | GQ868644 | DENV4 NS2A | FN429921 | DENV4 E | AY618989 |
| DENV4 NS2A | FJ882585 | DENV4 NS2A | FJ882590 | DENV4 E | GQ868644 |
| DENV4 NS2A | FJ882584 | DENV4 NS2A | GQ868594 | DENV4 E | AY152248 |
| DENV4 NS2A | EU854295 | DENV4 NS2A | FJ639737 | DENV4 E | FJ882582 |
| DENV4 NS2A | CS477306 | DENV4 NS2A | FJ882583 | DENV4 E | EU448459 |
| DENV4 NS2A | FJ882582 | DENV4 NS2A | FJ882591 | DENV4 E | FN429922 |
| DENV4 NS2A | FN429922 | DENV4 NS2A | AF326827 | DENV4 E | AB111086 |
| DENV4 NS2A | GQ868583 | DENV4 NS2A | GQ868579 | DENV4 E | EU854296 |
| DENV4 NS2A | FJ182016 | DENV4 NS2A | FJ882588 | DENV4 E | GQ868584 |
| DENV4 NS2A | FJ226067 | DENV4 NS2A | AF326826 | DENV4 E | AF231725 |
| DENV4 NS2A | EU854296 | DENV4 NS2A | AY243469 | DENV4 E | AY776330 |
| DENV4 NS2A | GQ868584 | DENV4 NS2A | M14931 | DENV4 E | GQ868585 |
| DENV4 NS2A | GQ868643 | DENV4 NS2A | FJ882596 | DENV4 E | GQ199882 |
| DENV4 NS2A | GQ199880 | DENV4 NS2A | GQ199876 | DENV4 E | AY152228 |
| DENV4 NS2A | AY776330 | DENV4 E | AY618951 | DENV4 E | AY618993 |
| DENV4 NS2A | FJ882580 | DENV4 E | AY152204 | DENV4 E | GQ139552 |
| DENV4 NS2A | GQ868585 | DENV4 E | GQ139571 | DENV4 E | AY152272 |
| DENV4 NS2A | GQ199882 | DENV4 E | FJ639742 | DENV4 E | FM986665 |
| DENV4 NS2A | NC_002640 | DENV4 E | AY618965 | DENV4 E | FJ639736 |
| DENV4 NS2A | AY618993 | DENV4 E | FM986669 | DENV4 E | GQ139589 |
| DENV4 NS2A | FJ882595 | DENV4 E | GQ139559 | DENV4 E | U18433 |
| DENV4 NS2A | FJ882589 | DENV4 E | AY152381 | DENV4 E | FJ439174 |
| DENV4 NS2A | FJ639736 | DENV4 E | AY618975 | DENV4 E | FJ024424 |
| DENV4 NS2A | FJ882592 | DENV4 E | AY858050 | DENV4 E | AY152048 |
| DENV4 NS2A | FJ024424 | DENV4 E | AY618947 | DENV4 E | AY152366 |
| DENV4 NS2A | FJ882581 | DENV4 E | GQ199883 | DENV4 E | GQ139548 |
| DENV4 NS2A | FJ882601 | DENV4 E | AY762085 | DENV4 E | AY152108 |
| DENV4 NS2A | FJ850095 | DENV4 E | AY618944 | DENV4 E | AY152116 |
| DENV4 NS2A | AY618992 | DENV4 E | EU448458 | DENV4 E | FJ850095 |
| DENV4 NS2A | FJ639748 | DENV4 E | GQ868581 | DENV4 E | AY152140 |
| DENV4 NS2A | EU854301 | DENV4 E | GQ139585 | DENV4 E | GQ139555 |
| DENV4 NS2A | FN429925 | DENV4 E | DQ390326 | DENV4 E | AY152076 |
| DENV4 NS2A | EU854299 | DENV4 E | AY152280 | DENV4 E | FN429925 |
| DENV4 NS2A | AY618990 | DENV4 E | AY618976 | DENV4 E | EU854299 |
| DENV4 NS2A | FJ182017 | DENV4 E | AY152340 | DENV4 E | AY152372 |
| DENV4 NS2A | AF326825 | DENV4 E | AY152378 | DENV4 E | AY152386 |
| DENV4 NS2A | FJ882586 | DENV4 E | FJ639739 | DENV4 E | FJ182017 |
| DENV4 NS2A | CS479206 | DENV4 E | AY152324 | DENV4 E | GQ139583 |
| DENV4 NS2A | FJ882587 | DENV4 E | AF231723 | DENV4 E | AY618940 |
| DENV4 NS2A | AY858049 | DENV4 E | U18439 | DENV4 E | AY858049 |
| DENV4 NS2A | EU854300 | DENV4 E | EU448455 | DENV4 E | EU854300 |
| DENV4 NS2A | FJ882599 | DENV4 E | AY618939 | DENV4 E | FJ024476 |
| DENV4 NS2A | FJ024476 | DENV4 E | AY376438 | DENV4 E | GQ139562 |
| DENV4 NS2A | AY648301 | DENV4 E | AY152369 | DENV4 E | AY618938 |
| DENV4 NS2A | GQ868582 | DENV4 E | DQ341216 | DENV4 E | DQ390324 |
| DENV4 NS2A | FN429926 | DENV4 E | AF289029 | DENV4 E | AY152196 |

FIG. 69-3

| Virus Protein | Accession No. | Virus Protein | Accession No. | Virus Protein | Accession No. |
|---|---|---|---|---|---|
| DENV4 E | EU448463 | DENV4 E | AY152084 | DENV4 E | GQ139591 |
| DENV4 E | AY618958 | DENV4 E | FJ639744 | DENV4 E | AY618942 |
| DENV4 E | DQ341213 | DENV4 E | AY152320 | DENV4 E | AY618935 |
| DENV4 E | GQ139584 | DENV4 E | AY152304 | DENV4 E | AY152857 |
| DENV4 E | U18426 | DENV4 E | AY152360 | DENV4 E | FJ882586 |
| DENV4 E | GQ868579 | DENV4 E | AY618977 | DENV4 E | AY152096 |
| DENV4 E | GQ139547 | DENV4 E | AY152244 | DENV4 E | AB111091 |
| DENV4 E | U18440 | DENV4 E | AJ428558 | DENV4 E | AY152152 |
| DENV4 E | EU448454 | DENV4 E | AY934757 | DENV4 E | FJ882587 |
| DENV4 E | AY152288 | DENV4 E | GQ199885 | DENV4 E | FJ882599 |
| DENV4 E | FJ882588 | DENV4 E | AY152292 | DENV4 E | AY152072 |
| DENV4 E | AF326826 | DENV4 E | U18432 | DENV4 E | GQ139576 |
| DENV4 E | AY152132 | DENV4 E | GQ139577 | DENV4 E | AY152104 |
| DENV4 E | FJ882596 | DENV4 E | GQ199881 | DENV4 E | GQ868582 |
| DENV4 E | GQ199876 | DENV4 E | AY618954 | DENV4 E | FN429926 |
| DENV4 E | GQ139564 | DENV4 E | GQ139582 | DENV4 E | AY618969 |
| DENV4 E | AJ428560 | DENV4 E | AY618972 | DENV4 E | FN429921 |
| DENV4 E | GU289913 | DENV4 E | AY152316 | DENV4 E | GQ139551 |
| DENV4 E | AY550909 | DENV4 E | AY618986 | DENV4 E | AY152236 |
| DENV4 E | DQ341212 | DENV4 E | AY152100 | DENV4 E | DQ390319 |
| DENV4 E | AY152312 | DENV4 E | AY152387 | DENV4 E | GQ868594 |
| DENV4 E | AY947539 | DENV4 E | AY152044 | DENV4 E | AY152188 |
| DENV4 E | FN429919 | DENV4 E | FJ182016 | DENV4 E | EF436282 |
| DENV4 E | AY152056 | DENV4 E | FM986672 | DENV4 E | AY618982 |
| DENV4 E | AY618949 | DENV4 E | EF436279 | DENV4 E | AY152376 |
| DENV4 E | AY618950 | DENV4 E | AY152164 | DENV4 E | AY618959 |
| DENV4 E | FJ639773 | DENV4 E | FJ226067 | DENV4 E | AF326827 |
| DENV4 E | AY152382 | DENV4 E | AY618943 | DENV4 E | AY152080 |
| DENV4 E | AY152176 | DENV4 E | AY152377 | DENV4 E | DQ390329 |
| DENV4 E | FJ850057 | DENV4 E | GQ139550 | DENV4 E | AY152276 |
| DENV4 E | GQ139554 | DENV4 E | AY618946 | DENV4 E | AY152308 |
| DENV4 E | DQ341219 | DENV4 E | EU448462 | DENV4 E | AY152374 |
| DENV4 E | EF457906 | DENV4 E | FM986664 | DENV4 E | AY618955 |
| DENV4 E | U18429 | DENV4 E | AY152232 | DENV4 E | U18437 |
| DENV4 E | AY618985 | DENV4 E | GQ139567 | DENV4 E | FM986671 |
| DENV4 E | EU448451 | DENV4 E | AY618960 | DENV4 E | S66064 |
| DENV4 E | AY618964 | DENV4 E | DQ341211 | DENV4 E | AY152388 |
| DENV4 E | DQ390323 | DENV4 E | AY152365 | DENV4 E | AJ428559 |
| DENV4 E | AY152208 | DENV4 E | FJ882601 | DENV4 E | AY618973 |
| DENV4 E | AY152336 | DENV4 E | EU448450 | DENV4 E | AY152036 |
| DENV4 E | EU854297 | DENV4 E | GQ139560 | DENV4 E | GQ199878 |
| DENV4 E | AY152368 | DENV4 E | AF231724 | DENV4 E | AY243468 |
| DENV4 E | AY152352 | DENV4 E | AB111087 | DENV4 E | EU478410 |
| DENV4 E | AY152192 | DENV4 E | AY152092 | DENV4 E | AY152124 |
| DENV4 E | AY152348 | DENV4 E | AY152371 | DENV4 E | GQ199884 |
| DENV4 E | GQ199879 | DENV4 E | EU854301 | DENV4 E | AY618937 |
| DENV4 E | GQ252675 | DENV4 E | FJ639748 | DENV4 E | AY618967 |
| DENV4 E | GQ139561 | DENV4 E | AY618992 | DENV4 E | FJ882597 |

FIG. 69-4

| Virus Protein | Accession No. | Virus Protein | Accession No. | Virus Protein | Accession No. |
|---|---|---|---|---|---|
| DENV4 E | AY618991 | DENV4 E | AY152370 | DENV4 E | FM986667 |
| DENV4 E | GQ139573 | DENV4 E | AY152120 | DENV4 E | GQ139586 |
| DENV4 E | FJ639764 | DENV4 E | CS479206 | DENV4 E | AF326573 |
| DENV4 E | EU448452 | DENV4 E | GQ139570 | DENV4 E | FM986673 |
| DENV4 E | AY152383 | DENV4 E | AY618945 | DENV4 E | FN429923 |
| DENV4 E | AY152160 | DENV4 E | AY618968 | DENV4 E | GQ868580 |
| DENV4 E | GQ139553 | DENV4 E | AY648301 | DENV4 E | AY152252 |
| DENV4 E | AY152144 | DENV4 E | GQ139590 | DENV4 E | U18434 |
| DENV4 E | FJ850058 | DENV4 E | FJ639745 | DENV4 E | GQ139580 |
| DENV4 E | FN429924 | DENV4 E | AY152184 | DENV4 E | AY152380 |
| DENV4 E | AY152264 | DENV4 E | AY618963 | DENV4 E | AY152180 |
| DENV4 E | AJ428557 | DENV4 E | U18428 | DENV4 E | AB111089 |
| DENV4 E | FN429920 | DENV4 E | AY618980 | DENV4 E | DQ390321 |
| DENV4 E | DQ390322 | DENV4 E | GQ139572 | DENV4 E | AY152136 |
| DENV4 E | FJ639738 | DENV4 E | AY152855 | DENV4 E | FM986666 |
| DENV4 E | DQ390328 | DENV4 E | AY152268 | DENV4 E | AY152856 |
| DENV4 E | FM986668 | DENV4 E | AY152332 | DENV4 E | GQ139568 |
| DENV4 E | AB111090 | DENV4 E | FJ882583 | DENV4 E | EU448457 |
| DENV4 E | CS477306 | DENV4 E | FJ639737 | DENV4 E | AY618952 |
| DENV4 E | EU854295 | DENV4 E | AY152256 | DENV4 E | GQ139575 |
| DENV4 E | FJ882584 | DENV4 E | FJ882591 | DENV4 E | AY618988 |
| DENV4 E | EU448456 | DENV4 E | AY152379 | DENV4 E | FJ882598 |
| DENV4 E | AJ563356 | DENV4 E | AY152375 | DENV4 E | FM986670 |
| DENV4 E | FM986674 | DENV4 E | AY152060 | DENV4 E | EU448461 |
| DENV4 E | EU448449 | DENV4 E | M14931 | DENV4 E | AY618941 |
| DENV4 E | AY152367 | DENV4 E | AY243469 | DENV4 E | FJ810417 |
| DENV4 E | U18431 | DENV4 E | DQ341218 | DENV4 E | AY152344 |
| DENV4 E | GQ868643 | DENV4 E | GQ139557 | DENV4 E | AY618974 |
| DENV4 E | GQ199880 | DENV4 E | AY618971 | DENV4 E | AY152300 |
| DENV4 E | FJ882580 | DENV4 E | EU478408 | DENV4 E | FJ882585 |
| DENV4 E | AY618936 | DENV4 E | U18436 | DENV4 E | GQ139574 |
| DENV4 E | AY705988 | DENV4 E | EU448464 | DENV4 E | GQ868583 |
| DENV4 E | GQ139587 | DENV4 E | EU448453 | DENV4 E | AY618956 |
| DENV4 E | DQ341215 | DENV4 E | AY152088 | DENV4 E | GQ139556 |
| DENV4 E | AY152148 | DENV4 E | GQ868645 | DENV4 E | DQ390325 |
| DENV4 E | AY618978 | DENV4 E | AY152389 | DENV4 E | GQ139581 |
| DENV4 E | FJ882592 | DENV4 E | EU448448 | DENV4 E | GQ139578 |
| DENV4 E | AY152040 | DENV4 E | AY152373 | DENV4 E | AY618981 |
| DENV4 E | AY152064 | DENV4 E | AY152212 | DENV4 E | NC_002640 |
| DENV4 E | AY618961 | DENV4 E | FJ882600 | DENV4 E | FJ882595 |
| DENV4 E | U18442 | DENV4 E | AY618966 | DENV4 E | AY780644 |
| DENV4 E | AY152224 | DENV4 E | AY152384 | DENV4 E | FJ882589 |
| DENV4 E | AY152364 | DENV4 E | DQ341217 | DENV4 E | AY152284 |
| DENV4 E | AY152356 | DENV4 E | AF231722 | DENV4 E | AY618987 |
| DENV4 E | AY152220 | DENV4 E | GQ868642 | DENV4 E | FJ882581 |
| DENV4 E | AY618953 | DENV4 E | AF375822 | DENV4 E | AB111088 |
| DENV4 E | AY618983 | DENV4 E | DQ390320 | DENV4 E | AY152328 |
| DENV4 E | GQ139565 | DENV4 E | DQ341210 | DENV4 E | U18430 |

FIG. 69-5

| Virus | Protein | Accession No. | Virus | Protein | Accession No. | Virus | Protein | Accession No. |
|---|---|---|---|---|---|---|---|---|
| DENV4 | E | AY152156 | DENV4 | NS2B | AY858050 | DENV4 | E | AY152048 |
| DENV4 | E | GQ139588 | DENV4 | E | AY618947 | DENV4 | E | AY152366 |
| DENV4 | E | AY152240 | DENV4 | NS2B | GQ199883 | DENV4 | E | GQ139548 |
| DENV4 | E | AY618979 | DENV4 | NS2B | AY762085 | DENV4 | E | AY152108 |
| DENV4 | E | U18425 | DENV4 | E | AY618944 | DENV4 | E | AY152116 |
| DENV4 | E | AY618990 | DENV4 | E | EU448458 | DENV4 | NS2B | FJ850095 |
| DENV4 | E | AY152216 | DENV4 | NS2B | GQ868581 | DENV4 | E | AY152140 |
| DENV4 | E | DQ390327 | DENV4 | E | GQ139585 | DENV4 | E | GQ139555 |
| DENV4 | E | AY152260 | DENV4 | E | DQ390326 | DENV4 | E | AY152076 |
| DENV4 | E | AF326825 | DENV4 | E | AY152280 | DENV4 | NS2B | FN429925 |
| DENV4 | E | GQ139566 | DENV4 | E | AY618976 | DENV4 | NS2B | EU854299 |
| DENV4 | E | AY152385 | DENV4 | E | AY152340 | DENV4 | E | AY152372 |
| DENV4 | E | GQ139549 | DENV4 | E | AY152378 | DENV4 | E | AY152386 |
| DENV4 | E | AY152068 | DENV4 | NS2B | FJ639739 | DENV4 | NS2B | FJ182017 |
| DENV4 | E | U18435 | DENV4 | E | AY152324 | DENV4 | E | GQ139583 |
| DENV4 | E | AY618962 | DENV4 | E | AF231723 | DENV4 | E | AY618940 |
| DENV4 | E | AY152296 | DENV4 | E | U18439 | DENV4 | NS2B | AY858049 |
| DENV4 | E | U18441 | DENV4 | E | EU448455 | DENV4 | NS2B | EU854300 |
| DENV4 | E | AY618970 | DENV4 | E | AY618939 | DENV4 | NS2B | FJ024476 |
| DENV4 | E | FJ850059 | DENV4 | NS2B | AY376438 | DENV4 | E | GQ139562 |
| DENV4 | E | GQ139579 | DENV4 | E | AY152369 | DENV4 | E | AY618938 |
| DENV4 | E | FJ882590 | DENV4 | E | DQ341216 | DENV4 | E | DQ390324 |
| DENV4 | E | U18427 | DENV4 | NS2B | AF289029 | DENV4 | E | AY152196 |
| DENV4 | E | DQ341214 | DENV4 | E | GQ139563 | DENV4 | E | EU448463 |
| DENV4 | E | AJ428556 | DENV4 | NS2B | FB667402 | DENV4 | E | AY618958 |
| DENV4 | E | AY152112 | DENV4 | NS2B | AY618989 | DENV4 | E | DQ341213 |
| DENV4 | E | AY152168 | DENV4 | NS2B | GQ868644 | DENV4 | E | GQ139584 |
| DENV4 | E | U18438 | DENV4 | E | AY152248 | DENV4 | E | U18426 |
| DENV4 | E | AY152200 | DENV4 | NS2B | FJ882582 | DENV4 | NS2B | GQ868579 |
| DENV4 | E | AY152128 | DENV4 | E | EU448459 | DENV4 | E | GQ139547 |
| DENV4 | E | GQ139569 | DENV4 | NS2B | FN429922 | DENV4 | E | U18440 |
| DENV4 | E | AY618957 | DENV4 | E | AB111086 | DENV4 | E | EU448454 |
| DENV4 | E | EF440435 | DENV4 | NS2B | EU854296 | DENV4 | E | AY152288 |
| DENV4 | E | AY618984 | DENV4 | NS2B | GQ868584 | DENV4 | NS2B | FJ882588 |
| DENV4 | E | AY152052 | DENV4 | E | AF231725 | DENV4 | NS2B | AF326826 |
| DENV4 | E | AY618948 | DENV4 | NS2B | AY776330 | DENV4 | E | AY152132 |
| DENV4 | E | GQ139558 | DENV4 | NS2B | GQ868585 | DENV4 | NS2B | FJ882596 |
| DENV4 | E | AY152172 | DENV4 | NS2B | GQ199882 | DENV4 | NS2B | GQ199876 |
| DENV4 | E | EU448460 | DENV4 | E | AY152228 | DENV4 | E | GQ139564 |
| DENV4 | E | AY618951 | DENV4 | NS2B | AY618993 | DENV4 | E | AJ428560 |
| DENV4 | E | AY152204 | DENV4 | E | GQ139552 | DENV4 | NS2B | GU289913 |
| DENV4 | E | GQ139571 | DENV4 | E | AY152272 | DENV4 | E | AY550909 |
| DENV4 | NS2B | FJ639742 | DENV4 | E | FM986665 | DENV4 | E | DQ341212 |
| DENV4 | E | AY618965 | DENV4 | NS2B | FJ639736 | DENV4 | E | AY152312 |
| DENV4 | E | FM986669 | DENV4 | E | GQ139589 | DENV4 | NS2B | AY947539 |
| DENV4 | E | GQ139559 | DENV4 | E | U18433 | DENV4 | NS2B | FN429919 |
| DENV4 | E | AY152381 | DENV4 | E | FJ439174 | DENV4 | E | AY152056 |
| DENV4 | E | AY618975 | DENV4 | NS2B | FJ024424 | DENV4 | E | AY618949 |

FIG. 69-6

| Virus | Protein | Accession No. | Virus | Protein | Accession No. | Virus | Protein | Accession No. |
|---|---|---|---|---|---|---|---|---|
| DENV4 | E | AY618950 | DENV4 | E | AY152164 | DENV4 | E | AY618959 |
| DENV4 | NS2B | FJ639773 | DENV4 | NS2B | FJ226067 | DENV4 | NS2B | AF326827 |
| DENV4 | E | AY152382 | DENV4 | E | AY618943 | DENV4 | E | AY152080 |
| DENV4 | E | AY152176 | DENV4 | E | AY152377 | DENV4 | E | DQ390329 |
| DENV4 | NS2B | FJ850057 | DENV4 | E | GQ139550 | DENV4 | E | AY152276 |
| DENV4 | E | GQ139554 | DENV4 | E | AY618946 | DENV4 | E | AY152308 |
| DENV4 | E | DQ341219 | DENV4 | E | EU448462 | DENV4 | E | AY152374 |
| DENV4 | NS2B | EF457906 | DENV4 | E | FM986664 | DENV4 | E | AY618955 |
| DENV4 | E | U18429 | DENV4 | E | AY152232 | DENV4 | E | U18437 |
| DENV4 | E | AY618985 | DENV4 | E | GQ139567 | DENV4 | E | FM986671 |
| DENV4 | E | EU448451 | DENV4 | E | AY618960 | DENV4 | E | S66064 |
| DENV4 | E | AY618964 | DENV4 | E | DQ341211 | DENV4 | E | AY152388 |
| DENV4 | E | DQ390323 | DENV4 | E | AY152365 | DENV4 | E | AJ428559 |
| DENV4 | E | AY152208 | DENV4 | NS2B | FJ882601 | DENV4 | E | AY618973 |
| DENV4 | E | AY152336 | DENV4 | E | EU448450 | DENV4 | E | AY152036 |
| DENV4 | NS2B | EU854297 | DENV4 | E | GQ139560 | DENV4 | NS2B | GQ199878 |
| DENV4 | E | AY152368 | DENV4 | E | AF231724 | DENV4 | NS2B | AY243468 |
| DENV4 | E | AY152352 | DENV4 | E | AB111087 | DENV4 | E | EU478410 |
| DENV4 | E | AY152192 | DENV4 | E | AY152092 | DENV4 | E | AY152124 |
| DENV4 | E | AY152348 | DENV4 | E | AY152371 | DENV4 | NS2B | GQ199884 |
| DENV4 | NS2B | GQ199879 | DENV4 | NS2B | EU854301 | DENV4 | E | AY618937 |
| DENV4 | NS2B | GQ252675 | DENV4 | NS2B | FJ639748 | DENV4 | E | AY618967 |
| DENV4 | E | GQ139561 | DENV4 | NS2B | AY618992 | DENV4 | NS2B | FJ882597 |
| DENV4 | E | AY152084 | DENV4 | E | GQ139591 | DENV4 | NS2B | AY618991 |
| DENV4 | NS2B | FJ639744 | DENV4 | E | AY618942 | DENV4 | E | GQ139573 |
| DENV4 | E | AY152320 | DENV4 | E | AY618935 | DENV4 | NS2B | FJ639764 |
| DENV4 | E | AY152304 | DENV4 | E | AY152857 | DENV4 | E | EU448452 |
| DENV4 | E | AY152360 | DENV4 | NS2B | FJ882586 | DENV4 | E | AY152383 |
| DENV4 | E | AY618977 | DENV4 | E | AY152096 | DENV4 | E | AY152160 |
| DENV4 | E | AY152244 | DENV4 | E | AB111091 | DENV4 | E | GQ139553 |
| DENV4 | E | AJ428558 | DENV4 | E | AY152152 | DENV4 | E | AY152144 |
| DENV4 | E | AY934757 | DENV4 | NS2B | FJ882587 | DENV4 | NS2B | FJ850058 |
| DENV4 | NS2B | GQ199885 | DENV4 | NS2B | FJ882599 | DENV4 | NS2B | FN429924 |
| DENV4 | E | AY152292 | DENV4 | E | AY152072 | DENV4 | E | AY152264 |
| DENV4 | E | U18432 | DENV4 | E | GQ139576 | DENV4 | E | AJ428557 |
| DENV4 | E | GQ139577 | DENV4 | E | AY152104 | DENV4 | NS2B | FN429920 |
| DENV4 | NS2B | GQ199881 | DENV4 | NS2B | GQ868582 | DENV4 | E | DQ390322 |
| DENV4 | E | AY618954 | DENV4 | NS2B | FN429926 | DENV4 | NS2B | FJ639738 |
| DENV4 | E | GQ139582 | DENV4 | E | AY618969 | DENV4 | E | DQ390328 |
| DENV4 | E | AY618972 | DENV4 | NS2B | FN429921 | DENV4 | E | FM986668 |
| DENV4 | E | AY152316 | DENV4 | E | GQ139551 | DENV4 | E | AB111090 |
| DENV4 | E | AY618986 | DENV4 | E | AY152236 | DENV4 | NS2B | CS477306 |
| DENV4 | E | AY152100 | DENV4 | E | DQ390319 | DENV4 | NS2B | EU854295 |
| DENV4 | E | AY152387 | DENV4 | NS2B | GQ868594 | DENV4 | NS2B | FJ882584 |
| DENV4 | E | AY152044 | DENV4 | E | AY152188 | DENV4 | E | EU448456 |
| DENV4 | NS2B | FJ182016 | DENV4 | E | EF436282 | DENV4 | E | AJ563356 |
| DENV4 | E | FM986672 | DENV4 | E | AY618982 | DENV4 | E | FM986674 |
| DENV4 | E | EF436279 | DENV4 | E | AY152376 | DENV4 | E | EU448449 |

FIG. 69-7

| Virus | Protein | Accession No. | Virus | Protein | Accession No. | Virus | Protein | Accession No. |
|---|---|---|---|---|---|---|---|---|
| DENV4 | E | AY152367 | DENV4 | NS2B | AY243469 | DENV4 | NS2B | FJ810417 |
| DENV4 | E | U18431 | DENV4 | E | DQ341218 | DENV4 | E | AY152344 |
| DENV4 | NS2B | GQ868643 | DENV4 | E | GQ139557 | DENV4 | E | AY618974 |
| DENV4 | NS2B | GQ199880 | DENV4 | E | AY618971 | DENV4 | E | AY152300 |
| DENV4 | NS2B | FJ882580 | DENV4 | E | EU478408 | DENV4 | NS2B | FJ882585 |
| DENV4 | E | AY618936 | DENV4 | E | U18436 | DENV4 | E | GQ139574 |
| DENV4 | E | AY705988 | DENV4 | E | EU448464 | DENV4 | NS2B | GQ868583 |
| DENV4 | E | GQ139587 | DENV4 | E | EU448453 | DENV4 | E | AY618956 |
| DENV4 | E | DQ341215 | DENV4 | E | AY152088 | DENV4 | E | GQ139556 |
| DENV4 | E | AY152148 | DENV4 | NS2B | GQ868645 | DENV4 | E | DQ390325 |
| DENV4 | E | AY618978 | DENV4 | E | AY152389 | DENV4 | E | GQ139581 |
| DENV4 | NS2B | FJ882592 | DENV4 | E | EU448448 | DENV4 | E | GQ139578 |
| DENV4 | E | AY152040 | DENV4 | E | AY152373 | DENV4 | E | AY618981 |
| DENV4 | E | AY152064 | DENV4 | E | AY152212 | DENV4 | NS2B | NC_002640 |
| DENV4 | E | AY618961 | DENV4 | NS2B | FJ882600 | DENV4 | NS2B | FJ882595 |
| DENV4 | E | U18442 | DENV4 | E | AY618966 | DENV4 | E | AY780644 |
| DENV4 | E | AY152224 | DENV4 | E | AY152384 | DENV4 | NS2B | FJ882589 |
| DENV4 | E | AY152364 | DENV4 | E | DQ341217 | DENV4 | E | AY152284 |
| DENV4 | E | AY152356 | DENV4 | E | AF231722 | DENV4 | E | AY618987 |
| DENV4 | E | AY152220 | DENV4 | NS2B | GQ868642 | DENV4 | NS2B | FJ882581 |
| DENV4 | E | AY618953 | DENV4 | NS2B | AF375822 | DENV4 | E | AB111088 |
| DENV4 | E | AY618983 | DENV4 | E | DQ390320 | DENV4 | E | AY152328 |
| DENV4 | E | GQ139565 | DENV4 | E | DQ341210 | DENV4 | E | U18430 |
| DENV4 | E | AY152370 | DENV4 | E | FM986667 | DENV4 | E | AY152156 |
| DENV4 | E | AY152120 | DENV4 | E | GQ139586 | DENV4 | E | GQ139588 |
| DENV4 | NS2B | CS479206 | DENV4 | NS2B | AF326573 | DENV4 | E | AY152240 |
| DENV4 | E | GQ139570 | DENV4 | E | FM986673 | DENV4 | E | AY618979 |
| DENV4 | E | AY618945 | DENV4 | NS2B | FN429923 | DENV4 | E | U18425 |
| DENV4 | E | AY618968 | DENV4 | NS2B | GQ868580 | DENV4 | NS2B | AY618990 |
| DENV4 | NS2B | AY648301 | DENV4 | E | AY152252 | DENV4 | E | AY152216 |
| DENV4 | E | GQ139590 | DENV4 | E | U18434 | DENV4 | E | DQ390327 |
| DENV4 | NS2B | FJ639745 | DENV4 | E | GQ139580 | DENV4 | E | AY152260 |
| DENV4 | E | AY152184 | DENV4 | E | AY152380 | DENV4 | NS2B | AF326825 |
| DENV4 | E | AY618963 | DENV4 | E | AY152180 | DENV4 | E | GQ139566 |
| DENV4 | E | U18428 | DENV4 | E | AB111089 | DENV4 | E | AY152385 |
| DENV4 | E | AY618980 | DENV4 | E | DQ390321 | DENV4 | E | GQ139549 |
| DENV4 | E | GQ139572 | DENV4 | E | AY152136 | DENV4 | E | AY152068 |
| DENV4 | E | AY152855 | DENV4 | E | FM986666 | DENV4 | E | U18435 |
| DENV4 | E | AY152268 | DENV4 | E | AY152856 | DENV4 | E | AY618962 |
| DENV4 | E | AY152332 | DENV4 | E | GQ139568 | DENV4 | E | AY152296 |
| DENV4 | NS2B | FJ882583 | DENV4 | E | EU448457 | DENV4 | E | U18441 |
| DENV4 | NS2B | FJ639737 | DENV4 | E | AY618952 | DENV4 | E | AY618970 |
| DENV4 | E | AY152256 | DENV4 | E | GQ139575 | DENV4 | NS2B | FJ850059 |
| DENV4 | NS2B | FJ882591 | DENV4 | NS2B | AY618988 | DENV4 | E | GQ139579 |
| DENV4 | E | AY152379 | DENV4 | NS2B | FJ882598 | DENV4 | NS2B | FJ882590 |
| DENV4 | E | AY152375 | DENV4 | E | FM986670 | DENV4 | E | U18427 |
| DENV4 | E | AY152060 | DENV4 | E | EU448461 | DENV4 | E | DQ341214 |
| DENV4 | NS2B | M14931 | DENV4 | E | AY618941 | DENV4 | E | AJ428556 |

FIG. 69-8

| Virus | Protein | Accession No. | Virus | Protein | Accession No. | Virus | Protein | Accession No. |
|---|---|---|---|---|---|---|---|---|
| DENV4 | E | AY152112 | DENV4 | anC | AY618989 | DENV4 | E | DQ341213 |
| DENV4 | E | AY152168 | DENV4 | anC | GQ868644 | DENV4 | E | GQ139584 |
| DENV4 | E | U18438 | DENV4 | anC | AY152248 | DENV4 | E | U18426 |
| DENV4 | E | AY152200 | DENV4 | anC | FJ882582 | DENV4 | anC | GQ868579 |
| DENV4 | E | AY152128 | DENV4 | E | EU448459 | DENV4 | E | GQ139547 |
| DENV4 | E | GQ139569 | DENV4 | anC | FN429922 | DENV4 | E | U18440 |
| DENV4 | E | AY618957 | DENV4 | E | AB111086 | DENV4 | E | EU448454 |
| DENV4 | E | EF440435 | DENV4 | anC | EU854296 | DENV4 | anC | AY152288 |
| DENV4 | E | AY618984 | DENV4 | anC | GQ868584 | DENV4 | anC | FJ882588 |
| DENV4 | E | AY152052 | DENV4 | E | AF231725 | DENV4 | anC | AF326826 |
| DENV4 | E | AY618948 | DENV4 | anC | AY776330 | DENV4 | anC | AY152132 |
| DENV4 | E | GQ139558 | DENV4 | anC | GQ868585 | DENV4 | anC | FJ882596 |
| DENV4 | E | AY152172 | DENV4 | anC | GQ199882 | DENV4 | anC | GQ199876 |
| DENV4 | E | EU448460 | DENV4 | anC | AY152228 | DENV4 | E | GQ139564 |
| DENV4 | E | AY618951 | DENV4 | anC | AY618993 | DENV4 | E | AJ428560 |
| DENV4 | anC | AY152204 | DENV4 | E | GQ139552 | DENV4 | anC | GU289913 |
| DENV4 | E | GQ139571 | DENV4 | anC | AY152272 | DENV4 | anC | AY550909 |
| DENV4 | anC | FJ639742 | DENV4 | E | FM986665 | DENV4 | E | DQ341212 |
| DENV4 | E | AY618965 | DENV4 | anC | FJ639736 | DENV4 | anC | AY152312 |
| DENV4 | E | FM986669 | DENV4 | E | GQ139589 | DENV4 | anC | AY947539 |
| DENV4 | E | GQ139559 | DENV4 | E | U18433 | DENV4 | anC | FN429919 |
| DENV4 | E | AY152381 | DENV4 | anC | FJ439174 | DENV4 | anC | AY152056 |
| DENV4 | E | AY618975 | DENV4 | anC | FJ024424 | DENV4 | E | AY618949 |
| DENV4 | NS2B | AY858050 | DENV4 | anC | AY152048 | DENV4 | E | AY618950 |
| DENV4 | E | AY618947 | DENV4 | E | AY152366 | DENV4 | anC | FJ639773 |
| DENV4 | anC | GQ199883 | DENV4 | E | GQ139548 | DENV4 | E | AY152382 |
| DENV4 | anC | AY762085 | DENV4 | anC | AY152108 | DENV4 | anC | AY152176 |
| DENV4 | E | AY618944 | DENV4 | anC | AY152116 | DENV4 | anC | FJ850057 |
| DENV4 | E | EU448458 | DENV4 | anC | FJ850095 | DENV4 | E | GQ139554 |
| DENV4 | anC | GQ868581 | DENV4 | anC | AY152140 | DENV4 | E | DQ341219 |
| DENV4 | E | GQ139585 | DENV4 | E | GQ139555 | DENV4 | anC | EF457906 |
| DENV4 | E | DQ390326 | DENV4 | anC | AY152076 | DENV4 | E | U18429 |
| DENV4 | anC | AY152280 | DENV4 | anC | FN429925 | DENV4 | E | AY618985 |
| DENV4 | E | AY618976 | DENV4 | anC | EU854299 | DENV4 | E | EU448451 |
| DENV4 | anC | AY152340 | DENV4 | E | AY152372 | DENV4 | E | AY618964 |
| DENV4 | E | AY152378 | DENV4 | E | AY152386 | DENV4 | E | DQ390323 |
| DENV4 | anC | FJ639739 | DENV4 | anC | FJ182017 | DENV4 | anC | AY152208 |
| DENV4 | anC | AY152324 | DENV4 | E | GQ139583 | DENV4 | anC | AY152336 |
| DENV4 | E | AF231723 | DENV4 | E | AY618940 | DENV4 | anC | EU854297 |
| DENV4 | E | U18439 | DENV4 | NS2B | AY858049 | DENV4 | E | AY152368 |
| DENV4 | E | EU448455 | DENV4 | anC | EU854300 | DENV4 | anC | AY152352 |
| DENV4 | E | AY618939 | DENV4 | anC | FJ024476 | DENV4 | anC | AY152192 |
| DENV4 | anC | AY376438 | DENV4 | E | GQ139562 | DENV4 | anC | AY152348 |
| DENV4 | E | AY152369 | DENV4 | E | AY618938 | DENV4 | anC | GQ199879 |
| DENV4 | E | DQ341216 | DENV4 | E | DQ390324 | DENV4 | anC | GQ252675 |
| DENV4 | anC | AF289029 | DENV4 | anC | AY152196 | DENV4 | E | GQ139561 |
| DENV4 | E | GQ139563 | DENV4 | E | EU448463 | DENV4 | anC | AY152084 |
| DENV4 | anC | FB667402 | DENV4 | E | AY618958 | DENV4 | anC | FJ639744 |

FIG. 69-9

| Virus Protein Accession No. | Virus Protein Accession No. | Virus Protein Accession No. |
|---|---|---|
| DENV4 anC AY152320 | DENV4 E AY618935 | DENV4 anC FJ639764 |
| DENV4 anC AY152304 | DENV4 E AY152857 | DENV4 E EU448452 |
| DENV4 anC AY152360 | DENV4 anC FJ882586 | DENV4 E AY152383 |
| DENV4 E AY618977 | DENV4 anC AY152096 | DENV4 anC AY152160 |
| DENV4 anC AY152244 | DENV4 E AB111091 | DENV4 E GQ139553 |
| DENV4 E AJ428558 | DENV4 anC AY152152 | DENV4 anC AY152144 |
| DENV4 E AY934757 | DENV4 anC FJ882587 | DENV4 anC FJ850058 |
| DENV4 anC GQ199885 | DENV4 anC FJ882599 | DENV4 anC FN429924 |
| DENV4 anC AY152292 | DENV4 anC AY152072 | DENV4 anC AY152264 |
| DENV4 E U18432 | DENV4 E GQ139576 | DENV4 E AJ428557 |
| DENV4 E GQ139577 | DENV4 anC AY152104 | DENV4 anC FN429920 |
| DENV4 anC GQ199881 | DENV4 anC GQ868582 | DENV4 E DQ390322 |
| DENV4 E AY618954 | DENV4 anC FN429926 | DENV4 anC FJ639738 |
| DENV4 E GQ139582 | DENV4 E AY618969 | DENV4 E DQ390328 |
| DENV4 E AY618972 | DENV4 anC FN429921 | DENV4 E FM986668 |
| DENV4 anC AY152316 | DENV4 E GQ139551 | DENV4 E AB111090 |
| DENV4 E AY618986 | DENV4 anC AY152236 | DENV4 anC CS477306 |
| DENV4 anC AY152100 | DENV4 E DQ390319 | DENV4 anC EU854295 |
| DENV4 E AY152387 | DENV4 anC GQ868594 | DENV4 anC FJ882584 |
| DENV4 anC AY152044 | DENV4 anC AY152188 | DENV4 E EU448456 |
| DENV4 anC FJ182016 | DENV4 E EF436282 | DENV4 E AJ563356 |
| DENV4 E FM986672 | DENV4 E AY618982 | DENV4 E FM986674 |
| DENV4 E EF436279 | DENV4 E AY152376 | DENV4 E EU448449 |
| DENV4 anC AY152164 | DENV4 E AY618959 | DENV4 E AY152367 |
| DENV4 anC FJ226067 | DENV4 anC AF326827 | DENV4 E U18431 |
| DENV4 E AY618943 | DENV4 anC AY152080 | DENV4 anC GQ868643 |
| DENV4 E AY152377 | DENV4 E DQ390329 | DENV4 anC GQ199880 |
| DENV4 E GQ139550 | DENV4 anC AY152276 | DENV4 anC FJ882580 |
| DENV4 E AY618946 | DENV4 anC AY152308 | DENV4 E AY618936 |
| DENV4 E EU448462 | DENV4 E AY152374 | DENV4 E AY705988 |
| DENV4 E FM986664 | DENV4 E AY618955 | DENV4 E GQ139587 |
| DENV4 anC AY152232 | DENV4 E U18437 | DENV4 E DQ341215 |
| DENV4 E GQ139567 | DENV4 E FM986671 | DENV4 anC AY152148 |
| DENV4 E AY618960 | DENV4 anC S66064 | DENV4 E AY618978 |
| DENV4 E DQ341211 | DENV4 E AY152388 | DENV4 anC FJ882592 |
| DENV4 E AY152365 | DENV4 E AJ428559 | DENV4 anC AY152040 |
| DENV4 anC FJ882601 | DENV4 E AY618973 | DENV4 anC AY152064 |
| DENV4 E EU448450 | DENV4 anC AY152036 | DENV4 E AY618961 |
| DENV4 E GQ139560 | DENV4 anC GQ199878 | DENV4 E U18442 |
| DENV4 E AF231724 | DENV4 anC AY243468 | DENV4 anC AY152224 |
| DENV4 E AB111087 | DENV4 E EU478410 | DENV4 E AY152364 |
| DENV4 anC AY152092 | DENV4 anC AY152124 | DENV4 anC AY152356 |
| DENV4 E AY152371 | DENV4 anC GQ199884 | DENV4 anC AY152220 |
| DENV4 anC EU854301 | DENV4 E AY618937 | DENV4 E AY618953 |
| DENV4 anC FJ639748 | DENV4 E AY618967 | DENV4 E AY618983 |
| DENV4 anC AY618992 | DENV4 anC FJ882597 | DENV4 E GQ139565 |
| DENV4 E GQ139591 | DENV4 anC AY618991 | DENV4 E AY152370 |
| DENV4 E AY618942 | DENV4 E GQ139573 | DENV4 anC AY152120 |

FIG. 69-10

| Virus | Protein | Accession No. | Virus | Protein | Accession No. | Virus | Protein | Accession No. |
|---|---|---|---|---|---|---|---|---|
| DENV4 | anC | CS479206 | DENV4 | anC | AF326573 | DENV4 | anC | AY152240 |
| DENV4 | E | GQ139570 | DENV4 | E | FM986673 | DENV4 | E | AY618979 |
| DENV4 | E | AY618945 | DENV4 | anC | FN429923 | DENV4 | E | U18425 |
| DENV4 | E | AY618968 | DENV4 | anC | GQ868580 | DENV4 | anC | AY618990 |
| DENV4 | anC | AY648301 | DENV4 | anC | AY152252 | DENV4 | anC | AY152216 |
| DENV4 | E | GQ139590 | DENV4 | E | U18434 | DENV4 | E | DQ390327 |
| DENV4 | anC | FJ639745 | DENV4 | E | GQ139580 | DENV4 | anC | AY152260 |
| DENV4 | anC | AY152184 | DENV4 | E | AY152380 | DENV4 | anC | AF326825 |
| DENV4 | E | AY618963 | DENV4 | anC | AY152180 | DENV4 | E | GQ139566 |
| DENV4 | E | U18428 | DENV4 | E | AB111089 | DENV4 | E | AY152385 |
| DENV4 | E | AY618980 | DENV4 | E | DQ390321 | DENV4 | E | GQ139549 |
| DENV4 | E | GQ139572 | DENV4 | anC | AY152136 | DENV4 | anC | AY152068 |
| DENV4 | E | AY152855 | DENV4 | E | FM986666 | DENV4 | E | U18435 |
| DENV4 | anC | AY152268 | DENV4 | E | AY152856 | DENV4 | E | AY618962 |
| DENV4 | anC | AY152332 | DENV4 | E | GQ139568 | DENV4 | anC | AY152296 |
| DENV4 | anC | FJ882583 | DENV4 | E | EU448457 | DENV4 | E | U18441 |
| DENV4 | anC | FJ639737 | DENV4 | E | AY618952 | DENV4 | E | AY618970 |
| DENV4 | anC | AY152256 | DENV4 | E | GQ139575 | DENV4 | anC | FJ850059 |
| DENV4 | anC | FJ882591 | DENV4 | anC | AY618988 | DENV4 | E | GQ139579 |
| DENV4 | E | AY152379 | DENV4 | anC | FJ882598 | DENV4 | anC | FJ882590 |
| DENV4 | E | AY152375 | DENV4 | E | FM986670 | DENV4 | E | U18427 |
| DENV4 | anC | AY152060 | DENV4 | E | EU448461 | DENV4 | E | DQ341214 |
| DENV4 | anC | M14931 | DENV4 | E | AY618941 | DENV4 | E | AJ428556 |
| DENV4 | anC | AY243469 | DENV4 | anC | FJ810417 | DENV4 | anC | AY152112 |
| DENV4 | E | DQ341218 | DENV4 | anC | AY152344 | DENV4 | anC | AY152168 |
| DENV4 | E | GQ139557 | DENV4 | E | AY618974 | DENV4 | E | U18438 |
| DENV4 | E | AY618971 | DENV4 | anC | AY152300 | DENV4 | anC | AY152200 |
| DENV4 | E | EU478408 | DENV4 | anC | FJ882585 | DENV4 | anC | AY152128 |
| DENV4 | E | U18436 | DENV4 | E | GQ139574 | DENV4 | E | GQ139569 |
| DENV4 | E | EU448464 | DENV4 | anC | GQ868583 | DENV4 | E | AY618957 |
| DENV4 | E | EU448453 | DENV4 | E | AY618956 | DENV4 | anC | EF440435 |
| DENV4 | anC | AY152088 | DENV4 | E | GQ139556 | DENV4 | E | AY618984 |
| DENV4 | anC | GQ868645 | DENV4 | E | DQ390325 | DENV4 | anC | AY152052 |
| DENV4 | E | AY152389 | DENV4 | E | GQ139581 | DENV4 | E | AY618948 |
| DENV4 | E | EU448448 | DENV4 | E | GQ139578 | DENV4 | E | GQ139558 |
| DENV4 | E | AY152373 | DENV4 | E | AY618981 | DENV4 | anC | AY152172 |
| DENV4 | anC | AY152212 | DENV4 | anC | NC_002640 | DENV4 | E | EU448460 |
| DENV4 | anC | FJ882600 | DENV4 | anC | FJ882595 | DENV4 | E | AY618951 |
| DENV4 | E | AY618966 | DENV4 | E | AY780644 | DENV4 | anC | AY152204 |
| DENV4 | E | AY152384 | DENV4 | anC | FJ882589 | DENV4 | E | GQ139571 |
| DENV4 | E | DQ341217 | DENV4 | anC | AY152284 | DENV4 | NS5 | FJ639742 |
| DENV4 | E | AF231722 | DENV4 | E | AY618987 | DENV4 | E | AY618965 |
| DENV4 | anC | GQ868642 | DENV4 | anC | FJ882581 | DENV4 | E | FM986669 |
| DENV4 | anC | AF375822 | DENV4 | E | AB111088 | DENV4 | E | GQ139559 |
| DENV4 | E | DQ390320 | DENV4 | anC | AY152328 | DENV4 | E | AY152381 |
| DENV4 | E | DQ341210 | DENV4 | E | U18430 | DENV4 | E | AY618975 |
| DENV4 | E | FM986667 | DENV4 | anC | AY152156 | DENV4 | NS5 | AY858050 |
| DENV4 | E | GQ139586 | DENV4 | E | GQ139588 | DENV4 | E | AY618947 |

FIG. 69-11

| Virus Protein | Accession No. | Virus Protein | Accession No. | Virus Protein | Accession No. |
|---|---|---|---|---|---|
| DENV4 NS5 | GQ199883 | DENV4 E | GQ139548 | DENV4 E | AY152382 |
| DENV4 NS5 | AY762085 | DENV4 anC | AY152108 | DENV4 anC | AY152176 |
| DENV4 E | AY618944 | DENV4 anC | AY152116 | DENV4 NS5 | FJ850057 |
| DENV4 E | EU448458 | DENV4 NS5 | FJ850095 | DENV4 E | GQ139554 |
| DENV4 NS5 | GQ868581 | DENV4 anC | AY152140 | DENV4 E | DQ341219 |
| DENV4 E | GQ139585 | DENV4 E | GQ139555 | DENV4 NS5 | EF457906 |
| DENV4 E | DQ390326 | DENV4 anC | AY152076 | DENV4 E | U18429 |
| DENV4 anC | AY152280 | DENV4 NS5 | FN429925 | DENV4 E | AY618985 |
| DENV4 E | AY618976 | DENV4 NS5 | EU854299 | DENV4 E | EU448451 |
| DENV4 anC | AY152340 | DENV4 E | AY152372 | DENV4 E | AY618964 |
| DENV4 E | AY152378 | DENV4 E | AY152386 | DENV4 E | DQ390323 |
| DENV4 NS5 | FJ639739 | DENV4 NS5 | FJ182017 | DENV4 anC | AY152208 |
| DENV4 anC | AY152324 | DENV4 E | GQ139583 | DENV4 anC | AY152336 |
| DENV4 E | AF231723 | DENV4 E | AY618940 | DENV4 NS5 | EU854297 |
| DENV4 E | U18439 | DENV4 NS5 | AY858049 | DENV4 E | AY152368 |
| DENV4 E | EU448455 | DENV4 NS5 | EU854300 | DENV4 anC | AY152352 |
| DENV4 E | AY618939 | DENV4 NS5 | FJ024476 | DENV4 anC | AY152192 |
| DENV4 NS5 | AY376438 | DENV4 E | GQ139562 | DENV4 anC | AY152348 |
| DENV4 E | AY152369 | DENV4 E | AY618938 | DENV4 NS5 | GQ199879 |
| DENV4 E | DQ341216 | DENV4 E | DQ390324 | DENV4 NS5 | GQ252675 |
| DENV4 NS5 | AF289029 | DENV4 anC | AY152196 | DENV4 E | GQ139561 |
| DENV4 E | GQ139563 | DENV4 E | EU448463 | DENV4 anC | AY152084 |
| DENV4 NS5 | B667402 | DENV4 E | AY618958 | DENV4 NS5 | FJ639744 |
| DENV4 NS5 | AY618989 | DENV4 E | DQ341213 | DENV4 anC | AY152320 |
| DENV4 NS5 | GQ868644 | DENV4 E | GQ139584 | DENV4 anC | AY152304 |
| DENV4 anC | AY152248 | DENV4 E | U18426 | DENV4 anC | AY152360 |
| DENV4 NS5 | FJ882582 | DENV4 NS5 | GQ868579 | DENV4 E | AY618977 |
| DENV4 E | EU448459 | DENV4 E | GQ139547 | DENV4 anC | AY152244 |
| DENV4 NS5 | FN429922 | DENV4 E | U18440 | DENV4 E | AJ428558 |
| DENV4 E | AB111086 | DENV4 E | EU448454 | DENV4 E | AY934757 |
| DENV4 NS5 | EU854296 | DENV4 anC | AY152288 | DENV4 NS5 | GQ199885 |
| DENV4 NS5 | GQ868584 | DENV4 NS5 | FJ882588 | DENV4 anC | AY152292 |
| DENV4 E | AF231725 | DENV4 NS5 | AF326826 | DENV4 E | U18432 |
| DENV4 NS5 | AY776330 | DENV4 anC | AY152132 | DENV4 E | GQ139577 |
| DENV4 NS5 | GQ868585 | DENV4 NS5 | FJ882596 | DENV4 NS5 | GQ199881 |
| DENV4 NS5 | GQ199882 | DENV4 NS5 | GQ199876 | DENV4 E | AY618954 |
| DENV4 anC | AY152228 | DENV4 E | GQ139564 | DENV4 E | GQ139582 |
| DENV4 NS5 | AY618993 | DENV4 E | AJ428560 | DENV4 E | AY618972 |
| DENV4 E | GQ139552 | DENV4 NS5 | GU289913 | DENV4 anC | AY152316 |
| DENV4 anC | AY152272 | DENV4 anC | AY550909 | DENV4 E | AY618986 |
| DENV4 E | FM986665 | DENV4 E | DQ341212 | DENV4 anC | AY152100 |
| DENV4 NS5 | FJ639736 | DENV4 anC | AY152312 | DENV4 E | AY152387 |
| DENV4 E | GQ139589 | DENV4 NS5 | AY947539 | DENV4 anC | AY152044 |
| DENV4 E | U18433 | DENV4 NS5 | FN429919 | DENV4 NS5 | FJ182016 |
| DENV4 anC | FJ439174 | DENV4 anC | AY152056 | DENV4 E | FM986672 |
| DENV4 NS5 | FJ024424 | DENV4 E | AY618949 | DENV4 E | EF436279 |
| DENV4 anC | AY152048 | DENV4 E | AY618950 | DENV4 anC | AY152164 |
| DENV4 E | AY152366 | DENV4 NS5 | FJ639773 | DENV4 NS5 | FJ226067 |

FIG. 69-12

| Virus Protein | Accession No. | Virus Protein | Accession No. | Virus Protein | Accession No. |
|---|---|---|---|---|---|
| DENV4 E | AY618943 | DENV4 anC | AY152080 | DENV4 NS5 | GQ868643 |
| DENV4 E | AY152377 | DENV4 E | DQ390329 | DENV4 NS5 | GQ199880 |
| DENV4 E | GQ139550 | DENV4 anC | AY152276 | DENV4 NS5 | FJ882580 |
| DENV4 E | AY618946 | DENV4 anC | AY152308 | DENV4 E | AY618936 |
| DENV4 E | EU448462 | DENV4 E | AY152374 | DENV4 E | AY705988 |
| DENV4 E | FM986664 | DENV4 E | AY618955 | DENV4 E | GQ139587 |
| DENV4 anC | AY152232 | DENV4 E | U18437 | DENV4 E | DQ341215 |
| DENV4 E | GQ139567 | DENV4 E | FM986671 | DENV4 anC | AY152148 |
| DENV4 E | AY618960 | DENV4 anC | S66064 | DENV4 E | AY618978 |
| DENV4 E | DQ341211 | DENV4 E | AY152388 | DENV4 NS5 | FJ882592 |
| DENV4 E | AY152365 | DENV4 E | AJ428559 | DENV4 anC | AY152040 |
| DENV4 NS5 | FJ882601 | DENV4 E | AY618973 | DENV4 anC | AY152064 |
| DENV4 E | EU448450 | DENV4 anC | AY152036 | DENV4 E | AY618961 |
| DENV4 E | GQ139560 | DENV4 NS5 | GQ199878 | DENV4 E | U18442 |
| DENV4 E | AF231724 | DENV4 NS5 | AY243468 | DENV4 anC | AY152224 |
| DENV4 E | AB111087 | DENV4 E | EU478410 | DENV4 E | AY152364 |
| DENV4 anC | AY152092 | DENV4 anC | AY152124 | DENV4 anC | AY152356 |
| DENV4 E | AY152371 | DENV4 NS5 | GQ199884 | DENV4 anC | AY152220 |
| DENV4 NS5 | EU854301 | DENV4 E | AY618937 | DENV4 E | AY618953 |
| DENV4 NS5 | FJ639748 | DENV4 E | AY618967 | DENV4 E | AY618983 |
| DENV4 NS5 | AY618992 | DENV4 NS5 | FJ882597 | DENV4 E | GQ139565 |
| DENV4 E | GQ139591 | DENV4 NS5 | AY618991 | DENV4 E | AY152370 |
| DENV4 E | AY618942 | DENV4 E | GQ139573 | DENV4 anC | AY152120 |
| DENV4 E | AY618935 | DENV4 NS5 | FJ639764 | DENV4 NS5 | CS479206 |
| DENV4 E | AY152857 | DENV4 E | EU448452 | DENV4 E | GQ139570 |
| DENV4 NS5 | FJ882586 | DENV4 E | AY152383 | DENV4 E | AY618945 |
| DENV4 anC | AY152096 | DENV4 anC | AY152160 | DENV4 E | AY618968 |
| DENV4 E | AB111091 | DENV4 E | GQ139553 | DENV4 NS5 | AY648301 |
| DENV4 anC | AY152152 | DENV4 anC | AY152144 | DENV4 E | GQ139590 |
| DENV4 NS5 | FJ882587 | DENV4 NS5 | FJ850058 | DENV4 NS5 | FJ639745 |
| DENV4 NS5 | FJ882599 | DENV4 NS5 | FN429924 | DENV4 anC | AY152184 |
| DENV4 anC | AY152072 | DENV4 anC | AY152264 | DENV4 E | AY618963 |
| DENV4 E | GQ139576 | DENV4 E | AJ428557 | DENV4 E | U18428 |
| DENV4 anC | AY152104 | DENV4 NS5 | FN429920 | DENV4 E | AY618980 |
| DENV4 NS5 | GQ868582 | DENV4 E | DQ390322 | DENV4 E | GQ139572 |
| DENV4 NS5 | FN429926 | DENV4 NS5 | FJ639738 | DENV4 E | AY152855 |
| DENV4 E | AY618969 | DENV4 E | DQ390328 | DENV4 anC | AY152268 |
| DENV4 NS5 | FN429921 | DENV4 E | FM986668 | DENV4 anC | AY152332 |
| DENV4 E | GQ139551 | DENV4 E | AB111090 | DENV4 NS5 | FJ882583 |
| DENV4 anC | AY152236 | DENV4 NS5 | CS477306 | DENV4 NS5 | FJ639737 |
| DENV4 E | DQ390319 | DENV4 NS5 | EU854295 | DENV4 anC | AY152256 |
| DENV4 NS5 | GQ868594 | DENV4 NS5 | FJ882584 | DENV4 NS5 | FJ882591 |
| DENV4 anC | AY152188 | DENV4 E | EU448456 | DENV4 E | AY152379 |
| DENV4 E | EF436282 | DENV4 E | AJ563356 | DENV4 E | AY152375 |
| DENV4 E | AY618982 | DENV4 E | FM986674 | DENV4 anC | AY152060 |
| DENV4 E | AY152376 | DENV4 E | EU448449 | DENV4 NS5 | M14931 |
| DENV4 E | AY618959 | DENV4 E | AY152367 | DENV4 NS5 | AY243469 |
| DENV4 NS5 | AF326827 | DENV4 E | U18431 | DENV4 E | DQ341218 |

FIG. 69-13

| Virus Protein Accession No. | Virus Protein Accession No. | Virus Protein Accession No. |
|---|---|---|
| DENV4 E GQ139557 | DENV4 E AY618974 | DENV4 E U18438 |
| DENV4 E AY618971 | DENV4 anC AY152300 | DENV4 anC AY152200 |
| DENV4 E EU478408 | DENV4 NS5 FJ882585 | DENV4 anC AY152128 |
| DENV4 E U18436 | DENV4 E GQ139574 | DENV4 E GQ139569 |
| DENV4 E EU448464 | DENV4 NS5 GQ868583 | DENV4 E AY618957 |
| DENV4 E EU448453 | DENV4 E AY618956 | DENV4 anC EF440435 |
| DENV4 anC AY152088 | DENV4 E GQ139556 | DENV4 E AY618984 |
| DENV4 NS5 GQ868645 | DENV4 E DQ390325 | DENV4 anC AY152052 |
| DENV4 E AY152389 | DENV4 E GQ139581 | DENV4 E AY618948 |
| DENV4 E EU448448 | DENV4 E GQ139578 | DENV4 E GQ139558 |
| DENV4 E AY152373 | DENV4 E AY618981 | DENV4 anC AY152172 |
| DENV4 anC AY152212 | DENV4 NS5 NC_002640 | DENV4 E EU448460 |
| DENV4 NS5 FJ882600 | DENV4 NS5 FJ882595 | DENV4 E AY618951 |
| DENV4 E AY618966 | DENV4 E AY780644 | DENV4 prM AY152204 |
| DENV4 E AY152384 | DENV4 NS5 FJ882589 | DENV4 E GQ139571 |
| DENV4 E DQ341217 | DENV4 anC AY152284 | DENV4 prM FJ639742 |
| DENV4 E AF231722 | DENV4 E AY618987 | DENV4 E AY618965 |
| DENV4 NS5 GQ868642 | DENV4 NS5 FJ882581 | DENV4 E FM986669 |
| DENV4 NS5 AF375822 | DENV4 E AB111088 | DENV4 E GQ139559 |
| DENV4 E DQ390320 | DENV4 anC AY152328 | DENV4 E AY152381 |
| DENV4 E DQ341210 | DENV4 E U18430 | DENV4 E AY618975 |
| DENV4 E FM986667 | DENV4 anC AY152156 | DENV4 prM AY858050 |
| DENV4 E GQ139586 | DENV4 E GQ139588 | DENV4 E AY618947 |
| DENV4 NS5 AF326573 | DENV4 anC AY152240 | DENV4 prM GQ199883 |
| DENV4 E FM986673 | DENV4 E AY618979 | DENV4 prM AY762085 |
| DENV4 NS5 FN429923 | DENV4 E U18425 | DENV4 E AY618944 |
| DENV4 NS5 GQ868580 | DENV4 NS5 AY618990 | DENV4 E EU448458 |
| DENV4 anC AY152252 | DENV4 anC AY152216 | DENV4 prM GQ868581 |
| DENV4 E U18434 | DENV4 E DQ390327 | DENV4 E GQ139585 |
| DENV4 E GQ139580 | DENV4 anC AY152260 | DENV4 E DQ390326 |
| DENV4 E AY152380 | DENV4 NS5 AF326825 | DENV4 prM AY152280 |
| DENV4 anC AY152180 | DENV4 E GQ139566 | DENV4 E AY618976 |
| DENV4 E AB111089 | DENV4 E AY152385 | DENV4 prM AY152340 |
| DENV4 E DQ390321 | DENV4 E GQ139549 | DENV4 E AY152378 |
| DENV4 anC AY152136 | DENV4 anC AY152068 | DENV4 prM FJ639739 |
| DENV4 E FM986666 | DENV4 E U18435 | DENV4 prM AY152324 |
| DENV4 E AY152856 | DENV4 E AY618962 | DENV4 E AF231723 |
| DENV4 E GQ139568 | DENV4 anC AY152296 | DENV4 E U18439 |
| DENV4 E EU448457 | DENV4 E U18441 | DENV4 E EU448455 |
| DENV4 E AY618952 | DENV4 E AY618970 | DENV4 E AY618939 |
| DENV4 E GQ139575 | DENV4 NS5 FJ850059 | DENV4 prM AY376438 |
| DENV4 NS5 AY618988 | DENV4 E GQ139579 | DENV4 E AY152369 |
| DENV4 NS5 FJ882598 | DENV4 NS5 FJ882590 | DENV4 E DQ341216 |
| DENV4 E FM986670 | DENV4 E U18427 | DENV4 prM AF289029 |
| DENV4 E EU448461 | DENV4 E DQ341214 | DENV4 E GQ139563 |
| DENV4 E AY618941 | DENV4 E AJ428556 | DENV4 prM FB667402 |
| DENV4 NS5 FJ810417 | DENV4 anC AY152112 | DENV4 prM AY618989 |
| DENV4 anC AY152344 | DENV4 anC AY152168 | DENV4 prM GQ868644 |

FIG. 69-14

| Virus Protein Accession No. | Virus Protein Accession No. | Virus Protein Accession No. |
|---|---|---|
| DENV4 prMAY152248 | DENV4 E U18426 | DENV4 prMAY152320 |
| DENV4 prMFJ882582 | DENV4 prMGQ868579 | DENV4 prMAY152304 |
| DENV4 E EU448459 | DENV4 E GQ139547 | DENV4 prMAY152360 |
| DENV4 prMFN429922 | DENV4 E U18440 | DENV4 E AY618977 |
| DENV4 E AB111086 | DENV4 E EU448454 | DENV4 prMAY152244 |
| DENV4 prMEU854296 | DENV4 prMAY152288 | DENV4 E AJ428558 |
| DENV4 prMGQ868584 | DENV4 prMFJ882588 | DENV4 E AY934757 |
| DENV4 E AF231725 | DENV4 prMAF326826 | DENV4 prMGQ199885 |
| DENV4 prMAY776330 | DENV4 prMAY152132 | DENV4 prMAY152292 |
| DENV4 prMGQ868585 | DENV4 prMFJ882596 | DENV4 E U18432 |
| DENV4 prMGQ199882 | DENV4 prMGQ199876 | DENV4 E GQ139577 |
| DENV4 prMAY152228 | DENV4 E GQ139564 | DENV4 prMGQ199881 |
| DENV4 prMAY618993 | DENV4 E AJ428560 | DENV4 E AY618954 |
| DENV4 E GQ139552 | DENV4 prMGU289913 | DENV4 E GQ139582 |
| DENV4 prMAY152272 | DENV4 prMAY550909 | DENV4 E AY618972 |
| DENV4 E FM986665 | DENV4 E DQ341212 | DENV4 prMAY152316 |
| DENV4 prMFJ639736 | DENV4 prMAY152312 | DENV4 E AY618986 |
| DENV4 E GQ139589 | DENV4 prMAY947539 | DENV4 prMAY152100 |
| DENV4 E U18433 | DENV4 prMFN429919 | DENV4 E AY152387 |
| DENV4 prMFJ439174 | DENV4 prMAY152056 | DENV4 prMAY152044 |
| DENV4 prMFJ024424 | DENV4 E AY618949 | DENV4 prMFJ182016 |
| DENV4 prMAY152048 | DENV4 E AY618950 | DENV4 E FM986672 |
| DENV4 E AY152366 | DENV4 prMFJ639773 | DENV4 E EF436279 |
| DENV4 E GQ139548 | DENV4 E AY152382 | DENV4 prMAY152164 |
| DENV4 prMAY152108 | DENV4 prMAY152176 | DENV4 prMFJ226067 |
| DENV4 prMAY152116 | DENV4 prMEF436280 | DENV4 E AY618943 |
| DENV4 prMFJ850095 | DENV4 prMFJ850057 | DENV4 E AY152377 |
| DENV4 prMAY152140 | DENV4 E GQ139554 | DENV4 E GQ139550 |
| DENV4 E GQ139555 | DENV4 E DQ341219 | DENV4 E AY618946 |
| DENV4 prMAY152076 | DENV4 prMEF457906 | DENV4 E EU448462 |
| DENV4 prMFN429925 | DENV4 E U18429 | DENV4 E FM986664 |
| DENV4 prMEU854299 | DENV4 E AY618985 | DENV4 prMAY152232 |
| DENV4 E AY152372 | DENV4 E EU448451 | DENV4 E GQ139567 |
| DENV4 E AY152386 | DENV4 E AY618964 | DENV4 E AY618960 |
| DENV4 prMFJ182017 | DENV4 E DQ390323 | DENV4 E DQ341211 |
| DENV4 E GQ139583 | DENV4 prMAY152208 | DENV4 E AY152365 |
| DENV4 E AY618940 | DENV4 prMAY152336 | DENV4 prMFJ882601 |
| DENV4 NS5AY858049 | DENV4 prMEU854297 | DENV4 E EU448450 |
| DENV4 prMEU854300 | DENV4 E AY152368 | DENV4 E GQ139560 |
| DENV4 prMFJ024476 | DENV4 prMAY152352 | DENV4 E AF231724 |
| DENV4 E GQ139562 | DENV4 prMAY152192 | DENV4 E AB111087 |
| DENV4 E AY618938 | DENV4 prMAY152348 | DENV4 prMAY152092 |
| DENV4 E DQ390324 | DENV4 prMGQ199879 | DENV4 E AY152371 |
| DENV4 prMAY152196 | DENV4 prMGQ252675 | DENV4 prMEU854301 |
| DENV4 E EU448463 | DENV4 E GQ139561 | DENV4 prMFJ639748 |
| DENV4 E AY618958 | DENV4 prMAY152084 | DENV4 prMAY618992 |
| DENV4 E DQ341213 | DENV4 prMFJ639744 | DENV4 E GQ139591 |
| DENV4 E GQ139584 | DENV4 prMAY559316 | DENV4 E AY618942 |

FIG. 69-15

| Virus Protein Accession No. | Virus Protein Accession No. | Virus Protein Accession No. |
|---|---|---|
| DENV4 E AY618935 | DENV4 E GQ139573 | DENV4 prM AY152120 |
| DENV4 E AY152857 | DENV4 prM FJ639764 | DENV4 prM CS479206 |
| DENV4 prM FJ882586 | DENV4 E EU448452 | DENV4 E GQ139570 |
| DENV4 prM AY152096 | DENV4 E AY152383 | DENV4 E AY618945 |
| DENV4 E AB111091 | DENV4 prM AY152160 | DENV4 E AY618968 |
| DENV4 prM AY152152 | DENV4 E GQ139553 | DENV4 prM AY648301 |
| DENV4 prM FJ882587 | DENV4 prM AY152144 | DENV4 E GQ139590 |
| DENV4 prM FJ882599 | DENV4 prM FJ850058 | DENV4 prM FJ639745 |
| DENV4 prM AY152072 | DENV4 prM FN429924 | DENV4 prM AY152184 |
| DENV4 E GQ139576 | DENV4 prM AY152264 | DENV4 E AY618963 |
| DENV4 prM AY152104 | DENV4 E AJ428557 | DENV4 E U18428 |
| DENV4 prM GQ868582 | DENV4 prM FN429920 | DENV4 E AY618980 |
| DENV4 prM FN429926 | DENV4 E DQ390322 | DENV4 E GQ139572 |
| DENV4 E AY618969 | DENV4 prM FJ639738 | DENV4 E AY152855 |
| DENV4 prM FN429921 | DENV4 E DQ390328 | DENV4 prM AY152268 |
| DENV4 E GQ139551 | DENV4 E FM986668 | DENV4 prM AY152332 |
| DENV4 prM AY152236 | DENV4 E AB111090 | DENV4 prM FJ882583 |
| DENV4 prM EF436281 | DENV4 prM CS477306 | DENV4 prM FJ639737 |
| DENV4 E DQ390319 | DENV4 prM EU854295 | DENV4 prM AY152256 |
| DENV4 prM GQ868594 | DENV4 prM FJ882584 | DENV4 prM FJ882591 |
| DENV4 prM AY152188 | DENV4 E EU448456 | DENV4 E AY152379 |
| DENV4 E EF436282 | DENV4 prM AJ563356 | DENV4 E AY152375 |
| DENV4 E AY618982 | DENV4 E FM986674 | DENV4 prM AY152060 |
| DENV4 E AY152376 | DENV4 E EU448449 | DENV4 prM M14931 |
| DENV4 E AY618959 | DENV4 E AY152367 | DENV4 prM AY243469 |
| DENV4 prM AF326827 | DENV4 E U18431 | DENV4 E DQ341218 |
| DENV4 prM AY152080 | DENV4 prM GQ868643 | DENV4 E GQ139557 |
| DENV4 E DQ390329 | DENV4 prM GQ199880 | DENV4 E AY618971 |
| DENV4 prM AY152276 | DENV4 prM FJ882580 | DENV4 E EU478408 |
| DENV4 prM AY152308 | DENV4 E AY618936 | DENV4 E U18436 |
| DENV4 E AY152374 | DENV4 E AY705988 | DENV4 E EU448464 |
| DENV4 E AY618955 | DENV4 E GQ139587 | DENV4 E EU448453 |
| DENV4 E U18437 | DENV4 E DQ341215 | DENV4 prM AY152088 |
| DENV4 E FM986671 | DENV4 prM AY152148 | DENV4 prM GQ868645 |
| DENV4 prM S66064 | DENV4 E AY618978 | DENV4 E AY152389 |
| DENV4 E AY152388 | DENV4 prM FJ882592 | DENV4 E EU448448 |
| DENV4 E AJ428559 | DENV4 prM AY152040 | DENV4 E AY152373 |
| DENV4 E AY618973 | DENV4 prM AY152064 | DENV4 prM AY152212 |
| DENV4 prM AY152036 | DENV4 E AY618961 | DENV4 prM FJ882600 |
| DENV4 prM GQ199878 | DENV4 E U18442 | DENV4 E AY618966 |
| DENV4 prM AY243468 | DENV4 prM AY152224 | DENV4 E AY152384 |
| DENV4 E EU478410 | DENV4 E AY152364 | DENV4 E DQ341217 |
| DENV4 prM AY152124 | DENV4 prM AY152356 | DENV4 E AF231722 |
| DENV4 prM GQ199884 | DENV4 prM AY152220 | DENV4 prM GQ868642 |
| DENV4 E AY618937 | DENV4 E AY618953 | DENV4 prM AF375822 |
| DENV4 E AY618967 | DENV4 E AY618983 | DENV4 E DQ390320 |
| DENV4 prM FJ882597 | DENV4 E GQ139565 | DENV4 E DQ341210 |
| DENV4 prM AY618991 | DENV4 E AY152370 | DENV4 E FM986667 |

FIG. 69-16

| Virus | Protein | Accession No. | Virus | Protein | Accession No. | Virus | Protein | Accession No. |
|---|---|---|---|---|---|---|---|---|
| DENV4 | E | GQ139586 | DENV4 | E | GQ139588 | DENV4 | E | AY618947 |
| DENV4 | prM | AF326573 | DENV4 | prM | AY152240 | DENV4 | NS4B | GQ199883 |
| DENV4 | E | FM986673 | DENV4 | E | AY618979 | DENV4 | NS4B | AY762085 |
| DENV4 | prM | FN429923 | DENV4 | E | U18425 | DENV4 | E | AY618944 |
| DENV4 | prM | GQ868580 | DENV4 | prM | AY618990 | DENV4 | E | EU448458 |
| DENV4 | prM | AY152252 | DENV4 | prM | AY152216 | DENV4 | NS4B | GQ868581 |
| DENV4 | E | U18434 | DENV4 | E | DQ390327 | DENV4 | E | GQ139585 |
| DENV4 | E | GQ139580 | DENV4 | prM | AY152260 | DENV4 | E | DQ390326 |
| DENV4 | E | AY152380 | DENV4 | prM | AF326825 | DENV4 | prM | AY152280 |
| DENV4 | prM | AY152180 | DENV4 | E | GQ139566 | DENV4 | E | AY618976 |
| DENV4 | E | AB111089 | DENV4 | E | AY152385 | DENV4 | prM | AY152340 |
| DENV4 | E | DQ390321 | DENV4 | E | GQ139549 | DENV4 | E | AY152378 |
| DENV4 | prM | AY152136 | DENV4 | prM | AY152068 | DENV4 | NS4B | FJ639739 |
| DENV4 | E | FM986666 | DENV4 | E | U18435 | DENV4 | prM | AY152324 |
| DENV4 | E | AY152856 | DENV4 | E | AY618962 | DENV4 | E | AF231723 |
| DENV4 | E | GQ139568 | DENV4 | prM | AY152296 | DENV4 | E | U18439 |
| DENV4 | E | EU448457 | DENV4 | E | U18441 | DENV4 | E | EU448455 |
| DENV4 | E | AY618952 | DENV4 | E | AY618970 | DENV4 | E | AY618939 |
| DENV4 | E | GQ139575 | DENV4 | prM | FJ850059 | DENV4 | NS4B | AY376438 |
| DENV4 | prM | AY618988 | DENV4 | E | GQ139579 | DENV4 | E | AY152369 |
| DENV4 | prM | FJ882598 | DENV4 | prM | FJ882590 | DENV4 | E | DQ341216 |
| DENV4 | E | FM986670 | DENV4 | E | U18427 | DENV4 | NS4B | AF289029 |
| DENV4 | E | EU448461 | DENV4 | E | DQ341214 | DENV4 | E | GQ139563 |
| DENV4 | E | AY618941 | DENV4 | E | AJ428556 | DENV4 | NS4B | FB667402 |
| DENV4 | prM | FJ810417 | DENV4 | prM | AY152112 | DENV4 | NS4B | AY618989 |
| DENV4 | prM | AY152344 | DENV4 | prM | AY152168 | DENV4 | NS4B | GQ868644 |
| DENV4 | E | AY618974 | DENV4 | E | U18438 | DENV4 | prM | AY152248 |
| DENV4 | prM | AY152300 | DENV4 | prM | AY152200 | DENV4 | NS4B | FJ882582 |
| DENV4 | prM | FJ882585 | DENV4 | prM | AY152128 | DENV4 | E | EU448459 |
| DENV4 | E | GQ139574 | DENV4 | E | GQ139569 | DENV4 | NS4B | FN429922 |
| DENV4 | prM | GQ868583 | DENV4 | E | AY618957 | DENV4 | E | AB111086 |
| DENV4 | E | AY618956 | DENV4 | prM | EF440435 | DENV4 | NS4B | EU854296 |
| DENV4 | E | GQ139556 | DENV4 | E | AY618984 | DENV4 | NS4B | GQ868584 |
| DENV4 | E | DQ390325 | DENV4 | prM | AY152052 | DENV4 | E | AF231725 |
| DENV4 | E | GQ139581 | DENV4 | E | AY618948 | DENV4 | NS4B | AY776330 |
| DENV4 | E | GQ139578 | DENV4 | E | GQ139558 | DENV4 | NS4B | GQ868585 |
| DENV4 | E | AY618981 | DENV4 | prM | AY152172 | DENV4 | NS4B | GQ199882 |
| DENV4 | prM | NC_002640 | DENV4 | E | EU448460 | DENV4 | prM | AY152228 |
| DENV4 | prM | FJ882595 | DENV4 | E | AY618951 | DENV4 | NS4B | AY618993 |
| DENV4 | E | AY780644 | DENV4 | prM | AY152204 | DENV4 | E | GQ139552 |
| DENV4 | prM | FJ882589 | DENV4 | E | GQ139571 | DENV4 | prM | AY152272 |
| DENV4 | prM | AY152284 | DENV4 | NS4B | FJ639742 | DENV4 | E | FM986665 |
| DENV4 | E | AY618987 | DENV4 | E | AY618965 | DENV4 | NS4B | FJ639736 |
| DENV4 | prM | FJ882581 | DENV4 | E | FM986669 | DENV4 | E | GQ139589 |
| DENV4 | E | AB111088 | DENV4 | E | GQ139559 | DENV4 | E | U18433 |
| DENV4 | prM | AY152328 | DENV4 | E | AY152381 | DENV4 | prM | FJ439174 |
| DENV4 | E | U18430 | DENV4 | E | AY618975 | DENV4 | NS4B | FJ024424 |
| DENV4 | prM | AY152156 | DENV4 | NS4B | AY858050 | DENV4 | prM | AY152048 |

FIG. 69-17

| Virus Protein Accession No. | Virus Protein Accession No. | Virus Protein Accession No. |
|---|---|---|
| DENV4 E AY152366 | DENV4 NS4B FJ639773 | DENV4 E EF436279 |
| DENV4 E GQ139548 | DENV4 E AY152382 | DENV4 prM AY152164 |
| DENV4 prM AY152108 | DENV4 prM AY152176 | DENV4 NS4B FJ226067 |
| DENV4 prM AY152116 | DENV4 prM EF436280 | DENV4 E AY618943 |
| DENV4 NS4B FJ850095 | DENV4 NS4B FJ850057 | DENV4 E AY152377 |
| DENV4 prM AY152140 | DENV4 E GQ139554 | DENV4 E GQ139550 |
| DENV4 E GQ139555 | DENV4 E DQ341219 | DENV4 E AY618946 |
| DENV4 prM AY152076 | DENV4 NS4B EF457906 | DENV4 E EU448462 |
| DENV4 NS4B FN429925 | DENV4 E U18429 | DENV4 E FM986664 |
| DENV4 NS4B EU854299 | DENV4 E AY618985 | DENV4 prM AY152232 |
| DENV4 E AY152372 | DENV4 E EU448451 | DENV4 E GQ139567 |
| DENV4 E AY152386 | DENV4 E AY618964 | DENV4 E AY618960 |
| DENV4 NS4B FJ182017 | DENV4 E DQ390323 | DENV4 E DQ341211 |
| DENV4 E GQ139583 | DENV4 prM AY152208 | DENV4 E AY152365 |
| DENV4 E AY618940 | DENV4 prM AY152336 | DENV4 NS4B FJ882601 |
| DENV4 NS4B AY858049 | DENV4 NS4B EU854297 | DENV4 E EU448450 |
| DENV4 NS4B EU854300 | DENV4 E AY152368 | DENV4 E GQ139560 |
| DENV4 NS4B FJ024476 | DENV4 prM AY152352 | DENV4 E AF231724 |
| DENV4 E GQ139562 | DENV4 prM AY152192 | DENV4 E AB111087 |
| DENV4 E AY618938 | DENV4 prM AY152348 | DENV4 prM AY152092 |
| DENV4 E DQ390324 | DENV4 NS4B GQ199879 | DENV4 E AY152371 |
| DENV4 prM AY152196 | DENV4 NS4B GQ252675 | DENV4 NS4B EU854301 |
| DENV4 E EU448463 | DENV4 E GQ139561 | DENV4 NS4B FJ639748 |
| DENV4 E AY618958 | DENV4 prM AY152084 | DENV4 NS4B AY618992 |
| DENV4 E DQ341213 | DENV4 NS4B FJ639744 | DENV4 E GQ139591 |
| DENV4 E GQ139584 | DENV4 prM AY559316 | DENV4 E AY618942 |
| DENV4 E U18426 | DENV4 prM AY152320 | DENV4 E AY618935 |
| DENV4 NS4B GQ868579 | DENV4 prM AY152304 | DENV4 E AY152857 |
| DENV4 E GQ139547 | DENV4 prM AY152360 | DENV4 NS4B FJ882586 |
| DENV4 E U18440 | DENV4 E AY618977 | DENV4 prM AY152096 |
| DENV4 E EU448454 | DENV4 prM AY152244 | DENV4 E AB111091 |
| DENV4 prM AY152288 | DENV4 E AJ428558 | DENV4 prM AY152152 |
| DENV4 NS4B FJ882588 | DENV4 E AY934757 | DENV4 NS4B FJ882587 |
| DENV4 NS4B AF326826 | DENV4 NS4B GQ199885 | DENV4 NS4B FJ882599 |
| DENV4 prM AY152132 | DENV4 prM AY152292 | DENV4 prM AY152072 |
| DENV4 NS4B FJ882596 | DENV4 E U18432 | DENV4 E GQ139576 |
| DENV4 NS4B GQ199876 | DENV4 E GQ139577 | DENV4 prM AY152104 |
| DENV4 E GQ139564 | DENV4 NS4B GQ199881 | DENV4 NS4B GQ868582 |
| DENV4 E AJ428560 | DENV4 E AY618954 | DENV4 NS4B FN429926 |
| DENV4 NS4B GU289913 | DENV4 E GQ139582 | DENV4 E AY618969 |
| DENV4 prM AY550909 | DENV4 E AY618972 | DENV4 NS4B FN429921 |
| DENV4 E DQ341212 | DENV4 prM AY152316 | DENV4 E GQ139551 |
| DENV4 prM AY152312 | DENV4 E AY618986 | DENV4 prM AY152236 |
| DENV4 NS4B AY947539 | DENV4 prM AY152100 | DENV4 prM EF436281 |
| DENV4 NS4B FN429919 | DENV4 E AY152387 | DENV4 E DQ390319 |
| DENV4 prM AY152056 | DENV4 prM AY152044 | DENV4 NS4B GQ868594 |
| DENV4 E AY618949 | DENV4 NS4B FJ182016 | DENV4 prM AY152188 |
| DENV4 E AY618950 | DENV4 E FM986672 | DENV4 E EF436282 |

FIG. 69-18

| Virus Protein Accession No. | Virus Protein Accession No. | Virus Protein Accession No. |
|---|---|---|
| DENV4 E AY618982 | DENV4 E FM986674 | DENV4 prM AY152060 |
| DENV4 E AY152376 | DENV4 E EU448449 | DENV4 NS4B M14931 |
| DENV4 E AY618959 | DENV4 E AY152367 | DENV4 NS4B AY243469 |
| DENV4 NS4B AF326827 | DENV4 E U18431 | DENV4 E DQ341218 |
| DENV4 prM AY152080 | DENV4 NS4B GQ868643 | DENV4 E GQ139557 |
| DENV4 E DQ390329 | DENV4 NS4B GQ199880 | DENV4 E AY618971 |
| DENV4 prM AY152276 | DENV4 NS4B FJ882580 | DENV4 E EU478408 |
| DENV4 prM AY152308 | DENV4 E AY618936 | DENV4 E U18436 |
| DENV4 E AY152374 | DENV4 E AY705988 | DENV4 E EU448464 |
| DENV4 E AY618955 | DENV4 E GQ139587 | DENV4 E EU448453 |
| DENV4 E U18437 | DENV4 E DQ341215 | DENV4 prM AY152088 |
| DENV4 E FM986671 | DENV4 prM AY152148 | DENV4 NS4B GQ868645 |
| DENV4 prM S66064 | DENV4 E AY618978 | DENV4 E AY152389 |
| DENV4 E AY152388 | DENV4 NS4B FJ882592 | DENV4 E EU448448 |
| DENV4 E AJ428559 | DENV4 prM AY152040 | DENV4 E AY152373 |
| DENV4 E AY618973 | DENV4 prM AY152064 | DENV4 prM AY152212 |
| DENV4 prM AY152036 | DENV4 E AY618961 | DENV4 NS4B FJ882600 |
| DENV4 NS4B GQ199878 | DENV4 E U18442 | DENV4 E AY618966 |
| DENV4 NS4B AY243468 | DENV4 prM AY152224 | DENV4 E AY152384 |
| DENV4 E EU478410 | DENV4 E AY152364 | DENV4 E DQ341217 |
| DENV4 prM AY152124 | DENV4 prM AY152356 | DENV4 E AF231722 |
| DENV4 NS4B GQ199884 | DENV4 prM AY152220 | DENV4 NS4B GQ868642 |
| DENV4 E AY618937 | DENV4 E AY618953 | DENV4 NS4B AF375822 |
| DENV4 E AY618967 | DENV4 E AY618983 | DENV4 E DQ390320 |
| DENV4 NS4B FJ882597 | DENV4 E GQ139565 | DENV4 E DQ341210 |
| DENV4 NS4B AY618991 | DENV4 E AY152370 | DENV4 E FM986667 |
| DENV4 E GQ139573 | DENV4 prM AY152120 | DENV4 E GQ139586 |
| DENV4 NS4B FJ639764 | DENV4 NS4B CS479206 | DENV4 NS4B AF326573 |
| DENV4 E EU448452 | DENV4 E GQ139570 | DENV4 E FM986673 |
| DENV4 E AY152383 | DENV4 E AY618945 | DENV4 NS4B FN429923 |
| DENV4 prM AY152160 | DENV4 E AY618968 | DENV4 NS4B GQ868580 |
| DENV4 E GQ139553 | DENV4 NS4B AY648301 | DENV4 prM AY152252 |
| DENV4 prM AY152144 | DENV4 E GQ139590 | DENV4 E U18434 |
| DENV4 NS4B FJ850058 | DENV4 NS4B FJ639745 | DENV4 E GQ139580 |
| DENV4 NS4B FN429924 | DENV4 prM AY152184 | DENV4 E AY152380 |
| DENV4 prM AY152264 | DENV4 E AY618963 | DENV4 prM AY152180 |
| DENV4 E AJ428557 | DENV4 E U18428 | DENV4 E AB111089 |
| DENV4 NS4B FN429920 | DENV4 E AY618980 | DENV4 E DQ390321 |
| DENV4 E DQ390322 | DENV4 E GQ139572 | DENV4 prM AY152136 |
| DENV4 NS4B FJ639738 | DENV4 E AY152855 | DENV4 E FM986666 |
| DENV4 E DQ390328 | DENV4 prM AY152268 | DENV4 E AY152856 |
| DENV4 E FM986668 | DENV4 prM AY152332 | DENV4 E GQ139568 |
| DENV4 E AB111090 | DENV4 NS4B FJ882583 | DENV4 E EU448457 |
| DENV4 NS4B CS477306 | DENV4 NS4B FJ639737 | DENV4 E AY618952 |
| DENV4 NS4B EU854295 | DENV4 prM AY152256 | DENV4 E GQ139575 |
| DENV4 NS4B FJ882584 | DENV4 NS4B FJ882591 | DENV4 NS4B AY618988 |
| DENV4 E EU448456 | DENV4 E AY152379 | DENV4 NS4B FJ882598 |
| DENV4 prM AJ563356 | DENV4 E AY152375 | DENV4 E FM986670 |

FIG. 69-19

| Virus Protein Accession No. | Virus Protein Accession No. | Virus Protein Accession No. |
|---|---|---|
| DENV4 E EU448461 | DENV4 E DQ341214 | DENV4 E GQ139563 |
| DENV4 E AY618941 | DENV4 E AJ428556 | DENV4 NS1FB667402 |
| DENV4 NS4B FJ810417 | DENV4 prMAY152112 | DENV4 NS1AY618989 |
| DENV4 prMAY152344 | DENV4 prMAY152168 | DENV4 NS1GQ868644 |
| DENV4 E AY618974 | DENV4 E U18438 | DENV4 prMAY152248 |
| DENV4 prMAY152300 | DENV4 prMAY152200 | DENV4 NS1FJ882582 |
| DENV4 NS4B FJ882585 | DENV4 prMAY152128 | DENV4 E EU448459 |
| DENV4 E GQ139574 | DENV4 E GQ139569 | DENV4 NS1FN429922 |
| DENV4 NS4B GQ868583 | DENV4 E AY618957 | DENV4 E AB111086 |
| DENV4 E AY618956 | DENV4 prMEF440435 | DENV4 NS1EU854296 |
| DENV4 E GQ139556 | DENV4 E AY618984 | DENV4 NS1GQ868584 |
| DENV4 E DQ390325 | DENV4 prMAY152052 | DENV4 E AF231725 |
| DENV4 E GQ139581 | DENV4 E AY618948 | DENV4 NS1AY776330 |
| DENV4 E GQ139578 | DENV4 E GQ139558 | DENV4 NS1GQ868585 |
| DENV4 E AY618981 | DENV4 prMAY152172 | DENV4 NS1GQ199882 |
| DENV4 NS4B NC_002640 | DENV4 E EU448460 | DENV4 prMAY152228 |
| DENV4 NS4B FJ882595 | DENV4 E AY618951 | DENV4 NS1AY618993 |
| DENV4 E AY780644 | DENV4 prMAY152204 | DENV4 E GQ139552 |
| DENV4 NS4B FJ882589 | DENV4 E GQ139571 | DENV4 prMAY152272 |
| DENV4 prMAY152284 | DENV4 NS1FJ639742 | DENV4 E FM986665 |
| DENV4 E AY618987 | DENV4 E AY618965 | DENV4 NS1FJ639736 |
| DENV4 NS4B FJ882581 | DENV4 E FM986669 | DENV4 E GQ139589 |
| DENV4 E AB111088 | DENV4 E GQ139559 | DENV4 E U18433 |
| DENV4 prMAY152328 | DENV4 E AY152381 | DENV4 prMFJ439174 |
| DENV4 E U18430 | DENV4 E AY618975 | DENV4 NS1FJ024424 |
| DENV4 prMAY152156 | DENV4 NS1AY858050 | DENV4 prMAY152048 |
| DENV4 E GQ139588 | DENV4 E AY618947 | DENV4 E AY152366 |
| DENV4 prMAY152240 | DENV4 NS1GQ199883 | DENV4 E GQ139548 |
| DENV4 E AY618979 | DENV4 NS1AY762085 | DENV4 prMAY152108 |
| DENV4 E U18425 | DENV4 E AY618944 | DENV4 prMAY152116 |
| DENV4 NS4B AY618990 | DENV4 E EU448458 | DENV4 NS1FJ850095 |
| DENV4 prMAY152216 | DENV4 NS1GQ868581 | DENV4 prMAY152140 |
| DENV4 E DQ390327 | DENV4 E GQ139585 | DENV4 E GQ139555 |
| DENV4 prMAY152260 | DENV4 E DQ390326 | DENV4 prMAY152076 |
| DENV4 NS4B AF326825 | DENV4 prMAY152280 | DENV4 NS1FN429925 |
| DENV4 E GQ139566 | DENV4 E AY618976 | DENV4 NS1EU854299 |
| DENV4 E AY152385 | DENV4 prMAY152340 | DENV4 E AY152372 |
| DENV4 E GQ139549 | DENV4 E AY152378 | DENV4 E AY152386 |
| DENV4 prMAY152068 | DENV4 NS1FJ639739 | DENV4 NS1FJ182017 |
| DENV4 E U18435 | DENV4 prMAY152324 | DENV4 E GQ139583 |
| DENV4 E AY618962 | DENV4 E AF231723 | DENV4 E AY618940 |
| DENV4 prMAY152296 | DENV4 E U18439 | DENV4 NS1AY858049 |
| DENV4 E U18441 | DENV4 E EU448455 | DENV4 NS1EU854300 |
| DENV4 E AY618970 | DENV4 E AY618939 | DENV4 NS1FJ024476 |
| DENV4 NS4B FJ850059 | DENV4 NS1AY376438 | DENV4 E GQ139562 |
| DENV4 E GQ139579 | DENV4 E AY152369 | DENV4 E AY618938 |
| DENV4 NS4B FJ882590 | DENV4 E DQ341216 | DENV4 E DQ390324 |
| DENV4 E U18427 | DENV4 NS1AF289029 | DENV4 prMAY152196 |

FIG. 69-20

| Virus Protein Accession No. | Virus Protein Accession No. | Virus Protein Accession No. |
|---|---|---|
| DENV4 NS1AY422471 | DENV4 NS1GQ252675 | DENV4 NS1EU854301 |
| DENV4 E EU448463 | DENV4 E GQ139561 | DENV4 NS1FJ639748 |
| DENV4 E AY618958 | DENV4 prMAY152084 | DENV4 NS1AY618992 |
| DENV4 E DQ341213 | DENV4 NS1FJ639744 | DENV4 E GQ139591 |
| DENV4 E GQ139584 | DENV4 prMAY559316 | DENV4 E AY618942 |
| DENV4 E U18426 | DENV4 prMAY152320 | DENV4 E AY618935 |
| DENV4 NS1GQ868579 | DENV4 prMAY152304 | DENV4 E AY152857 |
| DENV4 E GQ139547 | DENV4 prMAY152360 | DENV4 NS1FJ882586 |
| DENV4 E U18440 | DENV4 E AY618977 | DENV4 prMAY152096 |
| DENV4 E EU448454 | DENV4 prMAY152244 | DENV4 E AB111091 |
| DENV4 prMAY152288 | DENV4 E AJ428558 | DENV4 prMAY152152 |
| DENV4 NS1FJ882588 | DENV4 E AY934757 | DENV4 NS1FJ882587 |
| DENV4 NS1AF326826 | DENV4 NS1GQ199885 | DENV4 NS1FJ882599 |
| DENV4 prMAY152132 | DENV4 prMAY152292 | DENV4 prMAY152072 |
| DENV4 NS1FJ882596 | DENV4 E U18432 | DENV4 E GQ139576 |
| DENV4 NS1GQ199876 | DENV4 E GQ139577 | DENV4 prMAY152104 |
| DENV4 E GQ139564 | DENV4 NS1GQ199881 | DENV4 NS1GQ868582 |
| DENV4 E AJ428560 | DENV4 E AY618954 | DENV4 NS1FN429926 |
| DENV4 NS1GU289913 | DENV4 E GQ139582 | DENV4 E AY618969 |
| DENV4 prMAY550909 | DENV4 E AY618972 | DENV4 NS1FN429921 |
| DENV4 E DQ341212 | DENV4 prMAY152316 | DENV4 E GQ139551 |
| DENV4 prMAY152312 | DENV4 E AY618986 | DENV4 prMAY152236 |
| DENV4 NS1AY947539 | DENV4 prMAY152100 | DENV4 prMEF436281 |
| DENV4 NS1FN429919 | DENV4 E AY152387 | DENV4 E DQ390319 |
| DENV4 prMAY152056 | DENV4 prMAY152044 | DENV4 NS1GQ868594 |
| DENV4 E AY618949 | DENV4 NS1FJ182016 | DENV4 prMAY152188 |
| DENV4 E AY618950 | DENV4 E FM986672 | DENV4 E EF436282 |
| DENV4 NS1FJ639773 | DENV4 E EF436279 | DENV4 E AY618982 |
| DENV4 E AY152382 | DENV4 prMAY152164 | DENV4 E AY152376 |
| DENV4 prMAY152176 | DENV4 NS1FJ226067 | DENV4 E AY618959 |
| DENV4 prMEF436280 | DENV4 E AY618943 | DENV4 NS1AF326827 |
| DENV4 NS1FJ850057 | DENV4 E AY152377 | DENV4 prMAY152080 |
| DENV4 E GQ139554 | DENV4 E GQ139550 | DENV4 E DQ390329 |
| DENV4 E DQ341219 | DENV4 E AY618946 | DENV4 prMAY152276 |
| DENV4 NS1EF457906 | DENV4 E EU448462 | DENV4 prMAY152308 |
| DENV4 E U18429 | DENV4 E FM986664 | DENV4 E AY152374 |
| DENV4 E AY618985 | DENV4 prMAY152232 | DENV4 E AY618955 |
| DENV4 E EU448451 | DENV4 E GQ139567 | DENV4 E U18437 |
| DENV4 E AY618964 | DENV4 E AY618960 | DENV4 E FM986671 |
| DENV4 E DQ390323 | DENV4 E DQ341211 | DENV4 prMS66064 |
| DENV4 prMAY152208 | DENV4 E AY152365 | DENV4 E AY152388 |
| DENV4 prMAY152336 | DENV4 NS1FJ882601 | DENV4 E AJ428559 |
| DENV4 NS1EU854297 | DENV4 E EU448450 | DENV4 E AY618973 |
| DENV4 E AY152368 | DENV4 E GQ139560 | DENV4 prMAY152036 |
| DENV4 prMAY152352 | DENV4 E AF231724 | DENV4 NS1GQ199878 |
| DENV4 prMAY152192 | DENV4 E AB111087 | DENV4 NS1AY243468 |
| DENV4 prMAY152348 | DENV4 prMAY152092 | DENV4 E EU478410 |
| DENV4 NS1GQ199879 | DENV4 E AY152371 | DENV4 prMAY152124 |

FIG. 69-21

| Virus Protein Accession No. | Virus Protein Accession No. | Virus Protein Accession No. |
|---|---|---|
| DENV4 NS1 GQ199884 | DENV4 prM AY152220 | DENV4 NS1 GQ868642 |
| DENV4 E AY618937 | DENV4 E AY618953 | DENV4 NS1 AF375822 |
| DENV4 E AY618967 | DENV4 E AY618983 | DENV4 E DQ390320 |
| DENV4 NS1 FJ882597 | DENV4 E GQ139565 | DENV4 E DQ341210 |
| DENV4 NS1 AY618991 | DENV4 E AY152370 | DENV4 E FM986667 |
| DENV4 E GQ139573 | DENV4 prM AY152120 | DENV4 E GQ139586 |
| DENV4 NS1 FJ639764 | DENV4 NS1 CS479206 | DENV4 NS1 AF326573 |
| DENV4 E EU448452 | DENV4 E GQ139570 | DENV4 E FM986673 |
| DENV4 E AY152383 | DENV4 E AY618945 | DENV4 NS1 FN429923 |
| DENV4 prM AY152160 | DENV4 E AY618968 | DENV4 NS1 GQ868580 |
| DENV4 E GQ139553 | DENV4 NS1 AY648301 | DENV4 prM AY152252 |
| DENV4 prM AY152144 | DENV4 E GQ139590 | DENV4 E U18434 |
| DENV4 NS1 FJ850058 | DENV4 NS1 FJ639745 | DENV4 E GQ139580 |
| DENV4 NS1 FN429924 | DENV4 prM AY152184 | DENV4 E AY152380 |
| DENV4 prM AY152264 | DENV4 E AY618963 | DENV4 prM AY152180 |
| DENV4 E AJ428557 | DENV4 E U18428 | DENV4 E AB111089 |
| DENV4 NS1 FN429920 | DENV4 E AY618980 | DENV4 E DQ390321 |
| DENV4 E DQ390322 | DENV4 E GQ139572 | DENV4 prM AY152136 |
| DENV4 NS1 FJ639738 | DENV4 E AY152855 | DENV4 E FM986666 |
| DENV4 E DQ390328 | DENV4 prM AY152268 | DENV4 E AY152856 |
| DENV4 E FM986668 | DENV4 prM AY152332 | DENV4 E GQ139568 |
| DENV4 E AB111090 | DENV4 NS1 FJ882583 | DENV4 E EU448457 |
| DENV4 NS1 CS477306 | DENV4 NS1 FJ639737 | DENV4 E AY618952 |
| DENV4 NS1 EU854295 | DENV4 prM AY152256 | DENV4 E GQ139575 |
| DENV4 NS1 FJ882584 | DENV4 NS1 FJ882591 | DENV4 NS1 AY618988 |
| DENV4 E EU448456 | DENV4 E AY152379 | DENV4 NS1 FJ882598 |
| DENV4 prM AJ563356 | DENV4 E AY152375 | DENV4 E FM986670 |
| DENV4 E FM986674 | DENV4 prM AY152060 | DENV4 E EU448461 |
| DENV4 E EU448449 | DENV4 NS1 M14931 | DENV4 E AY618941 |
| DENV4 E AY152367 | DENV4 NS1 AY243469 | DENV4 NS1 FJ810417 |
| DENV4 E U18431 | DENV4 E DQ341218 | DENV4 prM AY152344 |
| DENV4 NS1 GQ868643 | DENV4 E GQ139557 | DENV4 E AY618974 |
| DENV4 NS1 GQ199880 | DENV4 E AY618971 | DENV4 prM AY152300 |
| DENV4 NS1 FJ882580 | DENV4 E EU478408 | DENV4 NS1 FJ882585 |
| DENV4 E AY618936 | DENV4 E U18436 | DENV4 E GQ139574 |
| DENV4 E AY705988 | DENV4 E EU448464 | DENV4 NS1 GQ868583 |
| DENV4 E GQ139587 | DENV4 E EU448453 | DENV4 E AY618956 |
| DENV4 E DQ341215 | DENV4 prM AY152088 | DENV4 E GQ139556 |
| DENV4 prM AY152148 | DENV4 NS1 GQ868645 | DENV4 E DQ390325 |
| DENV4 E AY618978 | DENV4 E AY152389 | DENV4 E GQ139581 |
| DENV4 NS1 FJ882592 | DENV4 E EU448448 | DENV4 E GQ139578 |
| DENV4 prM AY152040 | DENV4 E AY152373 | DENV4 E AY618981 |
| DENV4 prM AY152064 | DENV4 prM AY152212 | DENV4 NS1 NC_002640 |
| DENV4 E AY618961 | DENV4 NS1 FJ882600 | DENV4 NS1 FJ882595 |
| DENV4 E U18442 | DENV4 E AY618966 | DENV4 E AY780644 |
| DENV4 prM AY152224 | DENV4 E AY152384 | DENV4 NS1 FJ882589 |
| DENV4 E AY152364 | DENV4 E DQ341217 | DENV4 prM AY152284 |
| DENV4 prM AY152356 | DENV4 E AF231722 | DENV4 E AY618987 |

FIG. 69-22

| Virus Protein | Accession No. | Virus Protein | Accession No. | Virus Protein | Accession No. |
|---|---|---|---|---|---|
| DENV4 NS1 | FJ882581 | DENV4 E | FM986669 | DENV4 E | GQ139589 |
| DENV4 E | AB111088 | DENV4 E | GQ139559 | DENV4 E | U18433 |
| DENV4 prM | AY152328 | DENV4 E | AY152381 | DENV4 prM | FJ439174 |
| DENV4 E | U18430 | DENV4 E | AY618975 | DENV4 2K | FJ024424 |
| DENV4 prM | AY152156 | DENV4 2K | AY858050 | DENV4 prM | AY152048 |
| DENV4 E | GQ139588 | DENV4 E | AY618947 | DENV4 E | AY152366 |
| DENV4 prM | AY152240 | DENV4 2K | GQ199883 | DENV4 E | GQ139548 |
| DENV4 E | AY618979 | DENV4 2K | AY762085 | DENV4 prM | AY152108 |
| DENV4 E | U18425 | DENV4 E | AY618944 | DENV4 prM | AY152116 |
| DENV4 NS1 | AY618990 | DENV4 E | EU448458 | DENV4 2K | FJ850095 |
| DENV4 prM | AY152216 | DENV4 2K | GQ868581 | DENV4 prM | AY152140 |
| DENV4 E | DQ390327 | DENV4 E | GQ139585 | DENV4 E | GQ139555 |
| DENV4 prM | AY152260 | DENV4 E | DQ390326 | DENV4 prM | AY152076 |
| DENV4 NS1 | AF326825 | DENV4 prM | AY152280 | DENV4 2K | FN429925 |
| DENV4 E | GQ139566 | DENV4 E | AY618976 | DENV4 2K | EU854299 |
| DENV4 E | AY152385 | DENV4 prM | AY152340 | DENV4 E | AY152372 |
| DENV4 E | GQ139549 | DENV4 E | AY152378 | DENV4 E | AY152386 |
| DENV4 prM | AY152068 | DENV4 2K | FJ639739 | DENV4 2K | FJ182017 |
| DENV4 E | U18435 | DENV4 prM | AY152324 | DENV4 E | GQ139583 |
| DENV4 E | AY618962 | DENV4 E | AF231723 | DENV4 E | AY618940 |
| DENV4 prM | AY152296 | DENV4 E | U18439 | DENV4 2K | AY858049 |
| DENV4 E | U18441 | DENV4 E | EU448455 | DENV4 2K | EU854300 |
| DENV4 E | AY618970 | DENV4 E | AY618939 | DENV4 2K | FJ024476 |
| DENV4 NS1 | FJ850059 | DENV4 2K | AY376438 | DENV4 E | GQ139562 |
| DENV4 E | GQ139579 | DENV4 E | AY152369 | DENV4 E | AY618938 |
| DENV4 NS1 | FJ882590 | DENV4 E | DQ341216 | DENV4 E | DQ390324 |
| DENV4 E | U18427 | DENV4 2K | AF289029 | DENV4 prM | AY152196 |
| DENV4 E | DQ341214 | DENV4 E | GQ139563 | DENV4 NS1 | AY422471 |
| DENV4 E | AJ428556 | DENV4 2K | FB667402 | DENV4 E | EU448463 |
| DENV4 prM | AY152112 | DENV4 2K | AY618989 | DENV4 E | AY618958 |
| DENV4 prM | AY152168 | DENV4 2K | GQ868644 | DENV4 E | DQ341213 |
| DENV4 E | U18438 | DENV4 prM | AY152248 | DENV4 E | GQ139584 |
| DENV4 prM | AY152200 | DENV4 2K | FJ882582 | DENV4 E | U18426 |
| DENV4 prM | AY152128 | DENV4 E | EU448459 | DENV4 2K | GQ868579 |
| DENV4 E | GQ139569 | DENV4 2K | FN429922 | DENV4 E | GQ139547 |
| DENV4 E | AY618957 | DENV4 E | AB111086 | DENV4 E | U18440 |
| DENV4 prM | EF440435 | DENV4 2K | EU854296 | DENV4 E | EU448454 |
| DENV4 E | AY618984 | DENV4 2K | GQ868584 | DENV4 prM | AY152288 |
| DENV4 prM | AY152052 | DENV4 E | AF231725 | DENV4 2K | FJ882588 |
| DENV4 E | AY618948 | DENV4 2K | AY776330 | DENV4 2K | AF326826 |
| DENV4 E | GQ139558 | DENV4 2K | GQ868585 | DENV4 prM | AY152132 |
| DENV4 prM | AY152172 | DENV4 2K | GQ199882 | DENV4 2K | FJ882596 |
| DENV4 E | EU448460 | DENV4 prM | AY152228 | DENV4 2K | GQ199876 |
| DENV4 E | AY618951 | DENV4 2K | AY618993 | DENV4 E | GQ139564 |
| DENV4 prM | AY152204 | DENV4 E | GQ139552 | DENV4 E | AJ428560 |
| DENV4 E | GQ139571 | DENV4 prM | AY152272 | DENV4 2K | GU289913 |
| DENV4 2K | FJ639742 | DENV4 E | FM986665 | DENV4 prM | AY550909 |
| DENV4 E | AY618965 | DENV4 2K | FJ639736 | DENV4 E | DQ341212 |

FIG. 69-23

| Virus Protein | Accession No. | Virus Protein | Accession No. | Virus Protein | Accession No. |
|---|---|---|---|---|---|
| DENV4 prM | AY152312 | DENV4 E | AY618986 | DENV4 prM | AY152236 |
| DENV4 2K | AY947539 | DENV4 prM | AY152100 | DENV4 prM | EF436281 |
| DENV4 2K | FN429919 | DENV4 E | AY152387 | DENV4 E | DQ390319 |
| DENV4 prM | AY152056 | DENV4 prM | AY152044 | DENV4 2K | GQ868594 |
| DENV4 E | AY618949 | DENV4 2K | FJ182016 | DENV4 prM | AY152188 |
| DENV4 E | AY618950 | DENV4 E | FM986672 | DENV4 E | EF436282 |
| DENV4 2K | FJ639773 | DENV4 E | EF436279 | DENV4 E | AY618982 |
| DENV4 E | AY152382 | DENV4 prM | AY152164 | DENV4 E | AY152376 |
| DENV4 prM | AY152176 | DENV4 2K | FJ226067 | DENV4 E | AY618959 |
| DENV4 prM | EF436280 | DENV4 E | AY618943 | DENV4 2K | AF326827 |
| DENV4 2K | FJ850057 | DENV4 E | AY152377 | DENV4 prM | AY152080 |
| DENV4 E | GQ139554 | DENV4 E | GQ139550 | DENV4 E | DQ390329 |
| DENV4 E | DQ341219 | DENV4 E | AY618946 | DENV4 prM | AY152276 |
| DENV4 2K | EF457906 | DENV4 E | EU448462 | DENV4 prM | AY152308 |
| DENV4 E | U18429 | DENV4 E | FM986664 | DENV4 E | AY152374 |
| DENV4 E | AY618985 | DENV4 prM | AY152232 | DENV4 E | AY618955 |
| DENV4 E | EU448451 | DENV4 E | GQ139567 | DENV4 E | U18437 |
| DENV4 E | AY618964 | DENV4 E | AY618960 | DENV4 E | FM986671 |
| DENV4 E | DQ390323 | DENV4 E | DQ341211 | DENV4 prM | S66064 |
| DENV4 prM | AY152208 | DENV4 E | AY152365 | DENV4 E | AY152388 |
| DENV4 prM | AY152336 | DENV4 2K | FJ882601 | DENV4 E | AJ428559 |
| DENV4 2K | EU854297 | DENV4 E | EU448450 | DENV4 E | AY618973 |
| DENV4 E | AY152368 | DENV4 E | GQ139560 | DENV4 prM | AY152036 |
| DENV4 prM | AY152352 | DENV4 E | AF231724 | DENV4 2K | GQ199878 |
| DENV4 prM | AY152192 | DENV4 E | AB111087 | DENV4 2K | AY243468 |
| DENV4 prM | AY152348 | DENV4 prM | AY152092 | DENV4 E | EU478410 |
| DENV4 2K | GQ199879 | DENV4 E | AY152371 | DENV4 prM | AY152124 |
| DENV4 2K | GQ252675 | DENV4 2K | EU854301 | DENV4 2K | GQ199884 |
| DENV4 E | GQ139561 | DENV4 2K | FJ639748 | DENV4 E | AY618937 |
| DENV4 prM | AY152084 | DENV4 2K | AY618992 | DENV4 E | AY618967 |
| DENV4 2K | FJ639744 | DENV4 E | GQ139591 | DENV4 2K | FJ882597 |
| DENV4 prM | AY559316 | DENV4 E | AY618942 | DENV4 2K | AY618991 |
| DENV4 prM | AY152320 | DENV4 E | AY618935 | DENV4 E | GQ139573 |
| DENV4 prM | AY152304 | DENV4 E | AY152857 | DENV4 2K | FJ639764 |
| DENV4 prM | AY152360 | DENV4 2K | FJ882586 | DENV4 E | EU448452 |
| DENV4 E | AY618977 | DENV4 prM | AY152096 | DENV4 E | AY152383 |
| DENV4 prM | AY152244 | DENV4 E | AB111091 | DENV4 prM | AY152160 |
| DENV4 E | AJ428558 | DENV4 prM | AY152152 | DENV4 E | GQ139553 |
| DENV4 E | AY934757 | DENV4 2K | FJ882587 | DENV4 prM | AY152144 |
| DENV4 2K | GQ199885 | DENV4 2K | FJ882599 | DENV4 2K | FJ850058 |
| DENV4 prM | AY152292 | DENV4 prM | AY152072 | DENV4 2K | FN429924 |
| DENV4 E | U18432 | DENV4 E | GQ139576 | DENV4 prM | AY152264 |
| DENV4 E | GQ139577 | DENV4 prM | AY152104 | DENV4 E | AJ428557 |
| DENV4 2K | GQ199881 | DENV4 2K | GQ868582 | DENV4 2K | FN429920 |
| DENV4 E | AY618954 | DENV4 2K | FN429926 | DENV4 E | DQ390322 |
| DENV4 E | GQ139582 | DENV4 E | AY618969 | DENV4 2K | FJ639738 |
| DENV4 E | AY618972 | DENV4 2K | FN429921 | DENV4 E | DQ390328 |
| DENV4 prM | AY152316 | DENV4 E | GQ139551 | DENV4 E | FM986668 |

FIG. 69-24

| Virus Protein | Accession No. | Virus Protein | Accession No. | Virus Protein | Accession No. |
|---|---|---|---|---|---|
| DENV4 E | AB111090 | DENV4 2K | FJ882583 | DENV4 E | EU448457 |
| DENV4 2K | CS477306 | DENV4 2K | FJ639737 | DENV4 E | AY618952 |
| DENV4 2K | EU854295 | DENV4 prM | AY152256 | DENV4 E | GQ139575 |
| DENV4 2K | FJ882584 | DENV4 2K | FJ882591 | DENV4 2K | AY618988 |
| DENV4 E | EU448456 | DENV4 E | AY152379 | DENV4 2K | FJ882598 |
| DENV4 prM | AJ563356 | DENV4 E | AY152375 | DENV4 E | FM986670 |
| DENV4 E | FM986674 | DENV4 prM | AY152060 | DENV4 E | EU448461 |
| DENV4 E | EU448449 | DENV4 2K | M14931 | DENV4 E | AY618941 |
| DENV4 E | AY152367 | DENV4 2K | AY243469 | DENV4 2K | FJ810417 |
| DENV4 E | U18431 | DENV4 E | DQ341218 | DENV4 prM | AY152344 |
| DENV4 2K | GQ868643 | DENV4 E | GQ139557 | DENV4 E | AY618974 |
| DENV4 2K | GQ199880 | DENV4 E | AY618971 | DENV4 prM | AY152300 |
| DENV4 2K | FJ882580 | DENV4 E | EU478408 | DENV4 2K | FJ882585 |
| DENV4 E | AY618936 | DENV4 E | U18436 | DENV4 E | GQ139574 |
| DENV4 E | AY705988 | DENV4 E | EU448464 | DENV4 2K | GQ868583 |
| DENV4 E | GQ139587 | DENV4 E | EU448453 | DENV4 E | AY618956 |
| DENV4 E | DQ341215 | DENV4 prM | AY152088 | DENV4 E | GQ139556 |
| DENV4 prM | AY152148 | DENV4 2K | GQ868645 | DENV4 E | DQ390325 |
| DENV4 E | AY618978 | DENV4 E | AY152389 | DENV4 E | GQ139581 |
| DENV4 2K | FJ882592 | DENV4 E | EU448448 | DENV4 E | GQ139578 |
| DENV4 prM | AY152040 | DENV4 E | AY152373 | DENV4 E | AY618981 |
| DENV4 prM | AY152064 | DENV4 prM | AY152212 | DENV4 2K | NC_002640 |
| DENV4 E | AY618961 | DENV4 2K | FJ882600 | DENV4 2K | FJ882595 |
| DENV4 E | U18442 | DENV4 E | AY618966 | DENV4 E | AY780644 |
| DENV4 prM | AY152224 | DENV4 E | AY152384 | DENV4 2K | FJ882589 |
| DENV4 E | AY152364 | DENV4 E | DQ341217 | DENV4 prM | AY152284 |
| DENV4 prM | AY152356 | DENV4 E | AF231722 | DENV4 E | AY618987 |
| DENV4 prM | AY152220 | DENV4 2K | GQ868642 | DENV4 2K | FJ882581 |
| DENV4 E | AY618953 | DENV4 2K | AF375822 | DENV4 E | AB111088 |
| DENV4 E | AY618983 | DENV4 E | DQ390320 | DENV4 prM | AY152328 |
| DENV4 E | GQ139565 | DENV4 E | DQ341210 | DENV4 E | U18430 |
| DENV4 E | AY152370 | DENV4 E | FM986667 | DENV4 prM | AY152156 |
| DENV4 prM | AY152120 | DENV4 E | GQ139586 | DENV4 E | GQ139588 |
| DENV4 2K | CS479206 | DENV4 2K | AF326573 | DENV4 prM | AY152240 |
| DENV4 E | GQ139570 | DENV4 E | FM986673 | DENV4 E | AY618979 |
| DENV4 E | AY618945 | DENV4 2K | FN429923 | DENV4 E | U18425 |
| DENV4 E | AY618968 | DENV4 2K | GQ868580 | DENV4 2K | AY618990 |
| DENV4 2K | AY648301 | DENV4 prM | AY152252 | DENV4 prM | AY152216 |
| DENV4 E | GQ139590 | DENV4 E | U18434 | DENV4 E | DQ390327 |
| DENV4 2K | FJ639745 | DENV4 E | GQ139580 | DENV4 prM | AY152260 |
| DENV4 prM | AY152184 | DENV4 E | AY152380 | DENV4 2K | AF326825 |
| DENV4 E | AY618963 | DENV4 prM | AY152180 | DENV4 E | GQ139566 |
| DENV4 E | U18428 | DENV4 E | AB111089 | DENV4 E | AY152385 |
| DENV4 E | AY618980 | DENV4 E | DQ390321 | DENV4 E | GQ139549 |
| DENV4 E | GQ139572 | DENV4 prM | AY152136 | DENV4 prM | AY152068 |
| DENV4 E | AY152855 | DENV4 E | FM986666 | DENV4 E | U18435 |
| DENV4 prM | AY152268 | DENV4 E | AY152856 | DENV4 E | AY618962 |
| DENV4 prM | AY152332 | DENV4 E | GQ139568 | DENV4 prM | AY152296 |

FIG. 69-25

| Virus | Protein | Accession No. | Virus | Protein | Accession No. | Virus | Protein | Accession No. |
|---|---|---|---|---|---|---|---|---|
| DENV4 | E | U18441 | DENV4 | E | EU448455 | DENV4 | NS3 | EU854300 |
| DENV4 | E | AY618970 | DENV4 | E | AY618939 | DENV4 | NS3 | FJ024476 |
| DENV4 | 2K | FJ850059 | DENV4 | NS3 | AY376438 | DENV4 | E | GQ139562 |
| DENV4 | E | GQ139579 | DENV4 | E | AY152369 | DENV4 | E | AY618938 |
| DENV4 | 2K | FJ882590 | DENV4 | E | DQ341216 | DENV4 | E | DQ390324 |
| DENV4 | E | U18427 | DENV4 | NS3 | AF289029 | DENV4 | prM | AY152196 |
| DENV4 | E | DQ341214 | DENV4 | E | GQ139563 | DENV4 | NS1 | AY422471 |
| DENV4 | E | AJ428556 | DENV4 | NS3 | FB667402 | DENV4 | E | EU448463 |
| DENV4 | prM | AY152112 | DENV4 | NS3 | AY618989 | DENV4 | E | AY618958 |
| DENV4 | prM | AY152168 | DENV4 | NS3 | GQ868644 | DENV4 | E | DQ341213 |
| DENV4 | E | U18438 | DENV4 | prM | AY152248 | DENV4 | E | GQ139584 |
| DENV4 | prM | AY152200 | DENV4 | NS3 | FJ882582 | DENV4 | E | U18426 |
| DENV4 | prM | AY152128 | DENV4 | E | EU448459 | DENV4 | NS3 | GQ868579 |
| DENV4 | E | GQ139569 | DENV4 | NS3 | FN429922 | DENV4 | E | GQ139547 |
| DENV4 | E | AY618957 | DENV4 | E | AB111086 | DENV4 | E | U18440 |
| DENV4 | prM | EF440435 | DENV4 | NS3 | EU854296 | DENV4 | E | EU448454 |
| DENV4 | E | AY618984 | DENV4 | NS3 | GQ868584 | DENV4 | prM | AY152288 |
| DENV4 | prM | AY152052 | DENV4 | E | AF231725 | DENV4 | NS3 | FJ882588 |
| DENV4 | E | AY618948 | DENV4 | NS3 | AY776330 | DENV4 | NS3 | AF326826 |
| DENV4 | E | GQ139558 | DENV4 | NS3 | GQ868585 | DENV4 | prM | AY152132 |
| DENV4 | prM | AY152172 | DENV4 | NS3 | GQ199882 | DENV4 | NS3 | FJ882596 |
| DENV4 | E | EU448460 | DENV4 | prM | AY152228 | DENV4 | NS3 | GQ199876 |
| DENV4 | E | AY618951 | DENV4 | NS3 | AY618993 | DENV4 | E | GQ139564 |
| DENV4 | prM | AY152204 | DENV4 | E | GQ139552 | DENV4 | E | AJ428560 |
| DENV4 | E | GQ139571 | DENV4 | prM | AY152272 | DENV4 | NS3 | GU289913 |
| DENV4 | NS3 | FJ639742 | DENV4 | E | FM986665 | DENV4 | prM | AY550909 |
| DENV4 | E | AY618965 | DENV4 | NS3 | FJ639736 | DENV4 | E | DQ341212 |
| DENV4 | E | FM986669 | DENV4 | E | GQ139589 | DENV4 | prM | AY152312 |
| DENV4 | E | GQ139559 | DENV4 | E | U18433 | DENV4 | NS3 | AY947539 |
| DENV4 | E | AY152381 | DENV4 | prM | FJ439174 | DENV4 | NS3 | FN429919 |
| DENV4 | E | AY618975 | DENV4 | NS3 | FJ024424 | DENV4 | prM | AY152056 |
| DENV4 | NS3 | AY858050 | DENV4 | prM | AY152048 | DENV4 | E | AY618949 |
| DENV4 | E | AY618947 | DENV4 | E | AY152366 | DENV4 | E | AY618950 |
| DENV4 | NS3 | GQ199883 | DENV4 | E | GQ139548 | DENV4 | NS3 | FJ639773 |
| DENV4 | NS3 | AY762085 | DENV4 | prM | AY152108 | DENV4 | E | AY152382 |
| DENV4 | E | AY618944 | DENV4 | prM | AY152116 | DENV4 | prM | AY152176 |
| DENV4 | E | EU448458 | DENV4 | NS3 | FJ850095 | DENV4 | prM | EF436280 |
| DENV4 | NS3 | GQ868581 | DENV4 | prM | AY152140 | DENV4 | NS3 | FJ850057 |
| DENV4 | E | GQ139585 | DENV4 | E | GQ139555 | DENV4 | E | GQ139554 |
| DENV4 | E | DQ390326 | DENV4 | prM | AY152076 | DENV4 | E | DQ341219 |
| DENV4 | prM | AY152280 | DENV4 | NS3 | FN429925 | DENV4 | NS3 | EF457906 |
| DENV4 | E | AY618976 | DENV4 | NS3 | EU854299 | DENV4 | E | U18429 |
| DENV4 | prM | AY152340 | DENV4 | E | AY152372 | DENV4 | E | AY618985 |
| DENV4 | E | AY152378 | DENV4 | E | AY152386 | DENV4 | E | EU448451 |
| DENV4 | NS3 | FJ639739 | DENV4 | NS3 | FJ182017 | DENV4 | E | AY618964 |
| DENV4 | prM | AY152324 | DENV4 | E | GQ139583 | DENV4 | E | DQ390323 |
| DENV4 | E | AF231723 | DENV4 | E | AY618940 | DENV4 | prM | AY152208 |
| DENV4 | E | U18439 | DENV4 | NS3 | AY858049 | DENV4 | prM | AY152336 |

FIG. 69-26

| Virus Protein Accession No. | Virus Protein Accession No. | Virus Protein Accession No. |
|---|---|---|
| DENV4 NS3EU854297 | DENV4 E EU448450 | DENV4 E AY618973 |
| DENV4 E AY152368 | DENV4 E GQ139560 | DENV4 prM AY152036 |
| DENV4 prM AY152352 | DENV4 E AF231724 | DENV4 NS3GQ199878 |
| DENV4 prM AY152192 | DENV4 E AB111087 | DENV4 NS3AY243468 |
| DENV4 prM AY152348 | DENV4 prM AY152092 | DENV4 E EU478410 |
| DENV4 NS3GQ199879 | DENV4 E AY152371 | DENV4 prM AY152124 |
| DENV4 NS3GQ252675 | DENV4 NS3EU854301 | DENV4 NS3GQ199884 |
| DENV4 E GQ139561 | DENV4 NS3FJ639748 | DENV4 E AY618937 |
| DENV4 prM AY152084 | DENV4 NS3AY618992 | DENV4 E AY618967 |
| DENV4 NS3FJ639744 | DENV4 E GQ139591 | DENV4 NS3FJ882597 |
| DENV4 prM AY559316 | DENV4 E AY618942 | DENV4 NS3AY618991 |
| DENV4 prM AY152320 | DENV4 E AY618935 | DENV4 E GQ139573 |
| DENV4 prM AY152304 | DENV4 E AY152857 | DENV4 NS3FJ639764 |
| DENV4 prM AY152360 | DENV4 NS3FJ882586 | DENV4 E EU448452 |
| DENV4 E AY618977 | DENV4 prM AY152096 | DENV4 E AY152383 |
| DENV4 prM AY152244 | DENV4 E AB111091 | DENV4 prM AY152160 |
| DENV4 E AJ428558 | DENV4 prM AY152152 | DENV4 E GQ139553 |
| DENV4 E AY934757 | DENV4 NS3FJ882587 | DENV4 prM AY152144 |
| DENV4 NS3GQ199885 | DENV4 NS3FJ882599 | DENV4 NS3FJ850058 |
| DENV4 prM AY152292 | DENV4 prM AY152072 | DENV4 NS3FN429924 |
| DENV4 E U18432 | DENV4 E GQ139576 | DENV4 prM AY152264 |
| DENV4 E GQ139577 | DENV4 prM AY152104 | DENV4 E AJ428557 |
| DENV4 NS3GQ199881 | DENV4 NS3GQ868582 | DENV4 NS3FN429920 |
| DENV4 E AY618954 | DENV4 NS3FN429926 | DENV4 E DQ390322 |
| DENV4 E GQ139582 | DENV4 E AY618969 | DENV4 NS3FJ639738 |
| DENV4 E AY618972 | DENV4 NS3FN429921 | DENV4 E DQ390328 |
| DENV4 prM AY152316 | DENV4 E GQ139551 | DENV4 E FM986668 |
| DENV4 E AY618986 | DENV4 prM AY152236 | DENV4 E AB111090 |
| DENV4 prM AY152100 | DENV4 prM EF436281 | DENV4 NS3CS477306 |
| DENV4 E AY152387 | DENV4 E DQ390319 | DENV4 NS3EU854295 |
| DENV4 prM AY152044 | DENV4 NS3GQ868594 | DENV4 NS3FJ882584 |
| DENV4 NS3FJ182016 | DENV4 prM AY152188 | DENV4 E EU448456 |
| DENV4 E FM986672 | DENV4 E EF436282 | DENV4 prM AJ563356 |
| DENV4 E EF436279 | DENV4 E AY618982 | DENV4 E FM986674 |
| DENV4 prM AY152164 | DENV4 E AY152376 | DENV4 E EU448449 |
| DENV4 NS3FJ226067 | DENV4 E AY618959 | DENV4 E AY152367 |
| DENV4 E AY618943 | DENV4 NS3AF326827 | DENV4 E U18431 |
| DENV4 E AY152377 | DENV4 prM AY152080 | DENV4 NS3GQ868643 |
| DENV4 E GQ139550 | DENV4 E DQ390329 | DENV4 NS3GQ199880 |
| DENV4 E AY618946 | DENV4 prM AY152276 | DENV4 NS3FJ882580 |
| DENV4 E EU448462 | DENV4 prM AY152308 | DENV4 E AY618936 |
| DENV4 E FM986664 | DENV4 E AY152374 | DENV4 E AY705988 |
| DENV4 prM AY152232 | DENV4 E AY618955 | DENV4 E GQ139587 |
| DENV4 E GQ139567 | DENV4 E U18437 | DENV4 E DQ341215 |
| DENV4 E AY618960 | DENV4 E FM986671 | DENV4 prM AY152148 |
| DENV4 E DQ341211 | DENV4 prM S66064 | DENV4 E AY618978 |
| DENV4 E AY152365 | DENV4 E AY152388 | DENV4 NS3FJ882592 |
| DENV4 NS3FJ882601 | DENV4 E AJ428559 | DENV4 prM AY152040 |

FIG. 69-27

| Virus Protein Accession No. | Virus Protein Accession No. | Virus Protein Accession No. |
|---|---|---|
| DENV4 prMAY152064 | DENV4 prMAY152212 | DENV4 NS3NC_002640 |
| DENV4 E AY618961 | DENV4 NS3FJ882600 | DENV4 NS3FJ882595 |
| DENV4 E U18442 | DENV4 E AY618966 | DENV4 E AY780644 |
| DENV4 prMAY152224 | DENV4 E AY152384 | DENV4 NS3FJ882589 |
| DENV4 E AY152364 | DENV4 E DQ341217 | DENV4 prMAY152284 |
| DENV4 prMAY152356 | DENV4 E AF231722 | DENV4 E AY618987 |
| DENV4 prMAY152220 | DENV4 NS3GQ868642 | DENV4 NS3FJ882581 |
| DENV4 E AY618953 | DENV4 NS3AF375822 | DENV4 E AB111088 |
| DENV4 E AY618983 | DENV4 E DQ390320 | DENV4 prMAY152328 |
| DENV4 E GQ139565 | DENV4 E DQ341210 | DENV4 E U18430 |
| DENV4 E AY152370 | DENV4 E FM986667 | DENV4 prMAY152156 |
| DENV4 prMAY152120 | DENV4 E GQ139586 | DENV4 E GQ139588 |
| DENV4 NS3CS479206 | DENV4 NS3AF326573 | DENV4 prMAY152240 |
| DENV4 E GQ139570 | DENV4 E FM986673 | DENV4 E AY618979 |
| DENV4 E AY618945 | DENV4 NS3FN429923 | DENV4 E U18425 |
| DENV4 E AY618968 | DENV4 NS3GQ868580 | DENV4 NS3AY618990 |
| DENV4 NS3AY648301 | DENV4 prMAY152252 | DENV4 prMAY152216 |
| DENV4 E GQ139590 | DENV4 E U18434 | DENV4 E DQ390327 |
| DENV4 NS3FJ639745 | DENV4 E GQ139580 | DENV4 prMAY152260 |
| DENV4 prMAY152184 | DENV4 E AY152380 | DENV4 NS3AF326825 |
| DENV4 E AY618963 | DENV4 prMAY152180 | DENV4 E GQ139566 |
| DENV4 E U18428 | DENV4 E AB111089 | DENV4 E AY152385 |
| DENV4 E AY618980 | DENV4 E DQ390321 | DENV4 E GQ139549 |
| DENV4 E GQ139572 | DENV4 prMAY152136 | DENV4 prMAY152068 |
| DENV4 E AY152855 | DENV4 E FM986666 | DENV4 E U18435 |
| DENV4 prMAY152268 | DENV4 E AY152856 | DENV4 E AY618962 |
| DENV4 prMAY152332 | DENV4 E GQ139568 | DENV4 prMAY152296 |
| DENV4 NS3FJ882583 | DENV4 E EU448457 | DENV4 E U18441 |
| DENV4 NS3FJ639737 | DENV4 E AY618952 | DENV4 E AY618970 |
| DENV4 prMAY152256 | DENV4 E GQ139575 | DENV4 NS3FJ850059 |
| DENV4 NS3FJ882591 | DENV4 NS3AY618988 | DENV4 E GQ139579 |
| DENV4 E AY152379 | DENV4 NS3FJ882598 | DENV4 NS3FJ882590 |
| DENV4 E AY152375 | DENV4 E FM986670 | DENV4 E U18427 |
| DENV4 prMAY152060 | DENV4 E EU448461 | DENV4 E DQ341214 |
| DENV4 NS3M14931 | DENV4 E AY618941 | DENV4 E AJ428556 |
| DENV4 NS3AY243469 | DENV4 NS3FJ810417 | DENV4 prMAY152112 |
| DENV4 E DQ341218 | DENV4 prMAY152344 | DENV4 prMAY152168 |
| DENV4 E GQ139557 | DENV4 E AY618974 | DENV4 E U18438 |
| DENV4 E AY618971 | DENV4 prMAY152300 | DENV4 prMAY152200 |
| DENV4 E EU478408 | DENV4 NS3FJ882585 | DENV4 prMAY152128 |
| DENV4 E U18436 | DENV4 E GQ139574 | DENV4 E GQ139569 |
| DENV4 E EU448464 | DENV4 NS3GQ868583 | DENV4 E AY618957 |
| DENV4 E EU448453 | DENV4 E AY618956 | DENV4 prMEF440435 |
| DENV4 prMAY152088 | DENV4 E GQ139556 | DENV4 E AY618984 |
| DENV4 NS3GQ868645 | DENV4 E DQ390325 | DENV4 prMAY152052 |
| DENV4 E AY152389 | DENV4 E GQ139581 | DENV4 E AY618948 |
| DENV4 E EU448448 | DENV4 E GQ139578 | DENV4 E GQ139558 |
| DENV4 E AY152373 | DENV4 E AY618981 | DENV4 prMAY152172 |

FIG. 69-28

| Virus Protein | Accession No. | Virus Protein | Accession No. | Virus Protein | Accession No. |
|---|---|---|---|---|---|
| DENV4 E | EU448460 | | | | |

FIG. 70-1

| Virus | Protein | Accession No. | Virus | Protein | Accession No. | Virus | Protein | Accession No. |
|---|---|---|---|---|---|---|---|---|
| ADV | 2K | NC_012932 | AHFV | NS4A | NC_004355 | BAV | E | AY632545 |
| ADV | 2K | AB488408 | AHFV | NS4B | AF331718 | BAV | NS1 | EU684972 |
| ADV | anC | NC_012932 | AHFV | NS4B | NC_004355 | BAV | NS1 | NC_012534 |
| ADV | anC | AB488408 | AHFV | NS5 | AF331718 | BAV | NS1 | AY632545 |
| ADV | E | NC_012932 | AHFV | NS5 | NC_004355 | BAV | NS2A | EU684972 |
| ADV | E | AB488408 | AHFV | prM | AF331718 | BAV | NS2A | NC_012534 |
| ADV | NS1 | NC_012932 | AHFV | prM | NC_004355 | BAV | NS2A | AY632545 |
| ADV | NS1 | AB488408 | APV | 2K | AF160193 | BAV | NS2B | EU684972 |
| ADV | NS2A | NC_012932 | APV | 2K | NC_003676 | BAV | NS2B | NC_012534 |
| ADV | NS2A | AB488408 | APV | anC | AF160193 | BAV | NS2B | AY632545 |
| ADV | NS2B | NC_012932 | APV | anC | NC_003676 | BAV | NS3 | EU684972 |
| ADV | NS2B | AB488408 | APV | E | AF160193 | BAV | NS3 | NC_012534 |
| ADV | NS3 | NC_012932 | APV | E | NC_003676 | BAV | NS3 | AY632545 |
| ADV | NS3 | AB488408 | APV | NS1 | AF160193 | BAV | NS4A | EU684972 |
| ADV | NS4A | NC_012932 | APV | NS1 | NC_003676 | BAV | NS4A | NC_012534 |
| ADV | NS4A | AB488408 | APV | NS2A | AF160193 | BAV | NS4A | AY632545 |
| ADV | NS4B | NC_012932 | APV | NS2A | NC_003676 | BAV | NS4B | EU684972 |
| ADV | NS4B | AB488408 | APV | NS2B | AF160193 | BAV | NS4B | NC_012534 |
| ADV | NS5 | NC_012932 | APV | NS2B | NC_003676 | BAV | NS4B | AY632545 |
| ADV | NS5 | AB488408 | APV | NS3 | AF160193 | BAV | NS5 | EU684972 |
| ADV | prM | NC_012932 | APV | NS3 | NC_003676 | BAV | NS5 | NC_012534 |
| ADV | prM | AB488408 | APV | NS4A | AF160193 | BAV | NS5 | AY632545 |
| AFV | 2K | AY898809 | APV | NS4A | NC_003676 | BAV | prM | EU684972 |
| AFV | anC | AY898809 | APV | NS4B | AF160193 | BAV | prM | NC_012534 |
| AFV | E | AY898809 | APV | NS4B | NC_003676 | BAV | prM | AY632545 |
| AFV | NS1 | AY898809 | APV | NS5 | AF160193 | BNV | 2K | DQ859056 |
| AFV | NS2A | AY898809 | APV | NS5 | NC_003676 | BNV | anC | DQ859056 |
| AFV | NS2B | AY898809 | APV | prM | AF160193 | BNV | E | DQ859056 |
| AFV | NS3 | AY898809 | APV | prM | NC_003676 | BNV | NS1 | DQ859056 |
| AFV | NS4A | AY898809 | ARV | 2K | NC_009026 | BNV | NS2A | DQ859056 |
| AFV | NS4B | AY898809 | ARV | anC | NC_009026 | BNV | NS2B | DQ859056 |
| AFV | NS5 | AY898809 | ARV | E | NC_009026 | BNV | NS3 | DQ859056 |
| AFV | prM | AY898809 | ARV | NS1 | NC_009026 | BNV | NS4A | DQ859056 |
| AHFV | 2K | AF331718 | ARV | NS2A | NC_009026 | BNV | NS4B | DQ859056 |
| AHFV | 2K | NC_004355 | ARV | NS2B | NC_009026 | BNV | NS5 | DQ859056 |
| AHFV | anC | AF331718 | ARV | NS3 | NC_009026 | BNV | prM | DQ859056 |
| AHFV | anC | NC_004355 | ARV | NS4A | NC_009026 | BUV | 2K | DQ859057 |
| AHFV | E | AF331718 | ARV | NS4B | NC_009026 | BUV | anC | DQ859057 |
| AHFV | E | NC_004355 | ARV | NS5 | NC_009026 | BUV | E | DQ859057 |
| AHFV | NS1 | AF331718 | ARV | prM | NC_009026 | BUV | NS1 | DQ859057 |
| AHFV | NS1 | NC_004355 | BAV | 2K | EU684972 | BUV | NS2A | DQ859057 |
| AHFV | NS2A | AF331718 | BAV | 2K | NC_012534 | BUV | NS2B | DQ859057 |
| AHFV | NS2A | NC_004355 | BAV | 2K | AY632545 | BUV | NS3 | DQ859057 |
| AHFV | NS2B | AF331718 | BAV | anC | EU684972 | BUV | NS4A | DQ859057 |
| AHFV | NS2B | NC_004355 | BAV | anC | NC_012534 | BUV | NS4B | DQ859057 |
| AHFV | NS3 | AF331718 | BAV | anC | AY632545 | BUV | NS5 | DQ859057 |
| AHFV | NS3 | NC_004355 | BAV | E | EU684972 | BUV | prM | DQ859057 |
| AHFV | NS4A | AF331718 | BAV | E | NC_012534 | BQV | 2K | AY632536 |

FIG. 70-2

| Virus | Protein | Accession No. | Virus | Protein | Accession No. | Virus | Protein | Accession No. |
|---|---|---|---|---|---|---|---|---|
| BQV | anC | AY632536 | DENV | 2K | FJ639693 | DENV | 2K | DQ285560 |
| BQV | E | AY632536 | DENV | 2K | FJ461317 | DENV | 2K | FJ182002 |
| BQV | NS1 | AY632536 | DENV | 2K | FJ384655 | DENV | 2K | EU677177 |
| BQV | NS2A | AY632536 | DENV | 2K | EU482508 | DENV | 2K | FJ639680 |
| BQV | NS2B | AY632536 | DENV | 2K | AF311958 | DENV | 2K | EU677160 |
| BQV | NS3 | AY632536 | DENV | 2K | FJ024451 | DENV | 2K | AY835999 |
| BQV | NS4A | AY632536 | DENV | 2K | EU482528 | DENV | 2K | EU249494 |
| BQV | NS4B | AY632536 | DENV | 2K | EU482821 | DENV | 2K | AF226687 |
| BQV | NS5 | AY632536 | DENV | 2K | FJ410267 | DENV | 2K | FJ024432 |
| BQV | prM | AY632536 | DENV | 2K | AB074761 | DENV | 2K | EU081229 |
| CYV | 2K | FJ883471 | DENV | 2K | AY762084 | DENV | 2K | FJ410184 |
| CYV | anC | FJ883471 | DENV | 2K | AY732480 | DENV | 2K | FJ182022 |
| CYV | E | FJ883471 | DENV | 2K | EU482481 | DENV | 2K | EU677153 |
| CYV | NS1 | FJ883471 | DENV | 2K | FJ410232 | DENV | 2K | DQ672559 |
| CYV | NS2A | FJ883471 | DENV | 2K | EU081254 | DENV | 2K | EU081234 |
| CYV | NS2B | FJ883471 | DENV | 2K | EU482806 | DENV | 2K | FJ639802 |
| CYV | NS3 | FJ883471 | DENV | 2K | FJ410257 | DENV | 2K | EU482483 |
| CYV | NS4A | FJ883471 | DENV | 2K | FJ432720 | DENV | 2K | FJ024445 |
| CYV | NS4B | FJ883471 | DENV | 2K | FJ547089 | DENV | 2K | FJ410236 |
| CYV | NS5 | FJ883471 | DENV | 2K | EU482819 | DENV | 2K | FJ410242 |
| CYV | prM | FJ883471 | DENV | 2K | EU081270 | DENV | 2K | FJ390378 |
| DTV | 2K | AF311056 | DENV | 2K | FJ205875 | DENV | 2K | EU081236 |
| DTV | anC | AF311056 | DENV | 2K | FJ410210 | DENV | 2K | EU081278 |
| DTV | E | AF311056 | DENV | 2K | FJ205884 | DENV | 2K | FJ432736 |
| DTV | NS1 | AF311056 | DENV | 2K | FJ176780 | DENV | 2K | FJ639694 |
| DTV | NS2A | AF311056 | DENV | 2K | FJ461340 | DENV | 2K | EU482500 |
| DTV | NS2B | AF311056 | DENV | 2K | AY732475 | DENV | 2K | DQ672560 |
| DTV | NS3 | AF311056 | DENV | 2K | AY732474 | DENV | 2K | AY713473 |
| DTV | NS4A | AF311056 | DENV | 2K | FJ024435 | DENV | 2K | EU726780 |
| DTV | NS4B | AF311056 | DENV | 2K | FJ639669 | DENV | 2K | FJ410255 |
| DTV | NS5 | AF311056 | DENV | 2K | EU482540 | DENV | 2K | FJ373298 |
| DTV | prM | AF311056 | DENV | 2K | FJ024429 | DENV | 2K | EU081276 |
| DENV | 2K | AY277665 | DENV | 2K | EU677167 | DENV | 2K | FJ410198 |
| DENV | 2K | AY713474 | DENV | 2K | EU482512 | DENV | 2K | EU482536 |
| DENV | 2K | AF311957 | DENV | 2K | FJ390381 | DENV | 2K | FJ390382 |
| DENV | 2K | FJ205881 | DENV | 2K | FJ410226 | DENV | 2K | FJ024462 |
| DENV | 2K | EU482817 | DENV | 2K | FJ410191 | DENV | 2K | EU482822 |
| DENV | 2K | DQ672557 | DENV | 2K | AJ968413 | DENV | 2K | FJ024447 |
| DENV | 2K | EU677151 | DENV | 2K | FJ639689 | DENV | 2K | FJ410274 |
| DENV | 2K | FJ410256 | DENV | 2K | AY277664 | DENV | 2K | FJ410216 |
| DENV | 2K | FJ432735 | DENV | 2K | FJ639811 | DENV | 2K | EU482527 |
| DENV | 2K | EU660390 | DENV | 2K | FJ639695 | DENV | 2K | EU280167 |
| DENV | 2K | EU482824 | DENV | 2K | EU081226 | DENV | 2K | EU482567 |
| DENV | 2K | FJ410222 | DENV | 2K | FJ410280 | DENV | 2K | EU081265 |
| DENV | 2K | AY726551 | DENV | 2K | EU596504 | DENV | 2K | EU482489 |
| DENV | 2K | EU482716 | DENV | 2K | FJ639685 | DENV | 2K | AB178040 |
| DENV | 2K | AF226685 | DENV | 2K | EU482715 | DENV | 2K | EU482827 |
| DENV | 2K | EU677174 | DENV | 2K | FJ410227 | DENV | 2K | FJ024455 |

FIG. 70-3

| Virus | Protein | Accession No. | Virus | Protein | Accession No. | Virus | Protein | Accession No. |
|---|---|---|---|---|---|---|---|---|
| DENV | 2K | EU081238 | DENV | 2K | FJ024463 | DENV | 2K | AY277666 |
| DENV | 2K | FJ410245 | DENV | 2K | FJ410275 | DENV | 2K | FJ024483 |
| DENV | 2K | FJ461318 | DENV | 2K | FJ410234 | DENV | 2K | DQ193572 |
| DENV | 2K | FJ410263 | DENV | 2K | EU482487 | DENV | 2K | EF122231 |
| DENV | 2K | FJ410269 | DENV | 2K | FJ410182 | DENV | 2K | EU081266 |
| DENV | 2K | FJ410289 | DENV | 2K | EU482812 | DENV | 2K | EU482818 |
| DENV | 2K | FJ639692 | DENV | 2K | EU081247 | DENV | 2K | FJ410186 |
| DENV | 2K | EU660397 | DENV | 2K | AB074760 | DENV | 2K | EU249493 |
| DENV | 2K | EU482477 | DENV | 2K | EU482802 | DENV | 2K | FJ024478 |
| DENV | 2K | FJ024434 | DENV | 2K | EU677172 | DENV | 2K | FJ205874 |
| DENV | 2K | FJ410204 | DENV | 2K | EU482496 | DENV | 2K | EU482791 |
| DENV | 2K | EU249495 | DENV | 2K | EU726777 | DENV | 2K | EU482798 |
| DENV | 2K | AF513110 | DENV | 2K | U88535 | DENV | 2K | EU081248 |
| DENV | 2K | FJ024438 | DENV | 2K | EU482519 | DENV | 2K | EU596501 |
| DENV | 2K | EU081264 | DENV | 2K | FJ461339 | DENV | 2K | FJ461336 |
| DENV | 2K | EU482525 | DENV | 2K | FJ562101 | DENV | 2K | FJ024457 |
| DENV | 2K | EU687251 | DENV | 2K | FJ461316 | DENV | 2K | EU482485 |
| DENV | 2K | EU482486 | DENV | 2K | EU482814 | DENV | 2K | FJ176779 |
| DENV | 2K | DQ285558 | DENV | 2K | AY726555 | DENV | 2K | EU482799 |
| DENV | 2K | FJ205883 | DENV | 2K | FJ639677 | DENV | 2K | EU081233 |
| DENV | 2K | AY145121 | DENV | 2K | EU482506 | DENV | 2K | EU482497 |
| DENV | 2K | AY732478 | DENV | 2K | FJ410283 | DENV | 2K | EU482616 |
| DENV | 2K | FJ410199 | DENV | 2K | FJ639696 | DENV | 2K | EU482507 |
| DENV | 2K | FJ390383 | DENV | 2K | FJ410235 | DENV | 2K | EU482809 |
| DENV | 2K | EU482592 | DENV | 2K | EU482532 | DENV | 2K | FJ410262 |
| DENV | 2K | FJ182030 | DENV | 2K | FJ182031 | DENV | 2K | FJ024480 |
| DENV | 2K | FJ024431 | DENV | 2K | FJ024428 | DENV | 2K | EU482495 |
| DENV | 2K | FJ024450 | DENV | 2K | FJ432749 | DENV | 2K | FJ182032 |
| DENV | 2K | FJ410252 | DENV | 2K | DQ285561 | DENV | 2K | FJ410197 |
| DENV | 2K | FJ478457 | DENV | 2K | EU482518 | DENV | 2K | AF514883 |
| DENV | 2K | EU596502 | DENV | 2K | EU726779 | DENV | 2K | FJ461330 |
| DENV | 2K | FJ410201 | DENV | 2K | EU677161 | DENV | 2K | FJ639690 |
| DENV | 2K | FJ562105 | DENV | 2K | AY145123 | DENV | 2K | FJ410209 |
| DENV | 2K | FJ639684 | DENV | 2K | EU482800 | DENV | 2K | EU482514 |
| DENV | 2K | FJ639682 | DENV | 2K | AY732482 | DENV | 2K | EU848545 |
| DENV | 2K | FJ410240 | DENV | 2K | EU482517 | DENV | 2K | EU249492 |
| DENV | 2K | EU081279 | DENV | 2K | EU482488 | DENV | 2K | EU081240 |
| DENV | 2K | EU081231 | DENV | 2K | FJ373305 | DENV | 2K | EU482499 |
| DENV | 2K | FJ410214 | DENV | 2K | FJ432746 | DENV | 2K | FJ410281 |
| DENV | 2K | FJ182036 | DENV | 2K | FJ432734 | DENV | 2K | FJ410270 |
| DENV | 2K | FJ182023 | DENV | 2K | EU482797 | DENV | 2K | EU482808 |
| DENV | 2K | EU482479 | DENV | 2K | EU482711 | DENV | 2K | EU081281 |
| DENV | 2K | FJ547087 | DENV | 2K | FJ024459 | DENV | 2K | AF309641 |
| DENV | 2K | FJ639683 | DENV | 2K | FJ410174 | DENV | 2K | EU677159 |
| DENV | 2K | FJ024442 | DENV | 2K | EU596503 | DENV | 2K | EU482526 |
| DENV | 2K | FJ410285 | DENV | 2K | FJ432730 | DENV | 2K | FJ024427 |
| DENV | 2K | EU482615 | DENV | 2K | EU081227 | DENV | 2K | EU482618 |
| DENV | 2K | AY732476 | DENV | 2K | EU677163 | DENV | 2K | AF350498 |

FIG. 70-4

| Virus | Protein | Accession No. | Virus | Protein | Accession No. | Virus | Protein | Accession No. |
|---|---|---|---|---|---|---|---|---|
| DENV | 2K | EU677169 | DENV | 2K | EU081252 | DENV | 2K | EU482513 |
| DENV | 2K | EU482828 | DENV | 2K | EU482706 | DENV | 2K | FJ410196 |
| DENV | 2K | EU482537 | DENV | 2K | AY726553 | DENV | 2K | FJ410250 |
| DENV | 2K | EU726782 | DENV | 2K | FJ205882 | DENV | 2K | EU660392 |
| DENV | 2K | FJ410225 | DENV | 2K | FJ390386 | DENV | 2K | FJ461313 |
| DENV | 2K | FJ410180 | DENV | 2K | EU677139 | DENV | 2K | EU677168 |
| DENV | 2K | FJ024460 | DENV | 2K | FJ410260 | DENV | 2K | FJ432723 |
| DENV | 2K | FJ410231 | DENV | 2K | EU677170 | DENV | 2K | FJ410181 |
| DENV | 2K | FJ390380 | DENV | 2K | EU081256 | DENV | 2K | FJ410239 |
| DENV | 2K | FJ410238 | DENV | 2K | FJ024443 | DENV | 2K | EU482480 |
| DENV | 2K | FJ390379 | DENV | 2K | FJ410278 | DENV | 2K | AY206457 |
| DENV | 2K | AF311956 | DENV | 2K | FJ432744 | DENV | 2K | EU482523 |
| DENV | 2K | EU081257 | DENV | 2K | AB189120 | DENV | 2K | FJ410290 |
| DENV | 2K | FJ432721 | DENV | 2K | FJ461327 | DENV | 2K | DQ672562 |
| DENV | 2K | FJ639672 | DENV | 2K | EU660391 | DENV | 2K | EU482521 |
| DENV | 2K | FJ639794 | DENV | 2K | FJ562106 | DENV | 2K | EU660402 |
| DENV | 2K | EU660403 | DENV | 2K | FJ182035 | DENV | 2K | FJ461307 |
| DENV | 2K | EU482619 | DENV | 2K | FJ461306 | DENV | 2K | EU081272 |
| DENV | 2K | EU677155 | DENV | 2K | EU482510 | DENV | 2K | FJ461315 |
| DENV | 2K | FJ182021 | DENV | 2K | FJ024440 | DENV | 2K | FJ410188 |
| DENV | 2K | EU482712 | DENV | 2K | EU081258 | DENV | 2K | AY713475 |
| DENV | 2K | EU482591 | DENV | 2K | EU081268 | DENV | 2K | AY732479 |
| DENV | 2K | FJ410253 | DENV | 2K | EU677178 | DENV | 2K | EU677156 |
| DENV | 2K | EF032590 | DENV | 2K | FJ410276 | DENV | 2K | EU482707 |
| DENV | 2K | EU081243 | DENV | 2K | EU081273 | DENV | 2K | EU482811 |
| DENV | 2K | FJ639818 | DENV | 2K | EU482820 | DENV | 2K | AF226686 |
| DENV | 2K | EU081237 | DENV | 2K | AF514878 | DENV | 2K | EU081235 |
| DENV | 2K | AF514876 | DENV | 2K | EU660394 | DENV | 2K | EU660419 |
| DENV | 2K | FJ639688 | DENV | 2K | FJ410218 | DENV | 2K | FJ547068 |
| DENV | 2K | EU482713 | DENV | 2K | EU081241 | DENV | 2K | AB189121 |
| DENV | 2K | EU677154 | DENV | 2K | FJ410244 | DENV | 2K | FJ461308 |
| DENV | 2K | EU081242 | DENV | 2K | EU482789 | DENV | 2K | FJ410213 |
| DENV | 2K | EU687247 | DENV | 2K | EU482524 | DENV | 2K | AY726550 |
| DENV | 2K | AY726552 | DENV | 2K | EU081261 | DENV | 2K | AY732477 |
| DENV | 2K | FJ024436 | DENV | 2K | FJ639812 | DENV | 2K | EU660401 |
| DENV | 2K | FJ639681 | DENV | 2K | EU482533 | DENV | 2K | FJ639815 |
| DENV | 2K | EU482484 | DENV | 2K | DQ285559 | DENV | 2K | FJ410268 |
| DENV | 2K | EU482815 | DENV | 2K | FJ410246 | DENV | 2K | FJ478458 |
| DENV | 2K | EU249490 | DENV | 2K | FJ461310 | DENV | 2K | FJ639808 |
| DENV | 2K | EU081253 | DENV | 2K | AB195673 | DENV | 2K | EU482611 |
| DENV | 2K | AY726549 | DENV | 2K | FJ182024 | DENV | 2K | FJ410261 |
| DENV | 2K | EU677166 | DENV | 2K | AB204803 | DENV | 2K | FJ432729 |
| DENV | 2K | FJ639821 | DENV | 2K | EF025110 | DENV | 2K | FJ639813 |
| DENV | 2K | FJ024430 | DENV | 2K | DQ672564 | DENV | 2K | EU482520 |
| DENV | 2K | FJ410183 | DENV | 2K | EU726778 | DENV | 2K | AF514885 |
| DENV | 2K | EU081267 | DENV | 2K | EF457905 | DENV | 2K | FJ639673 |
| DENV | 2K | EU482491 | DENV | 2K | FJ547088 | DENV | 2K | FJ410266 |
| DENV | 2K | EU081249 | DENV | 2K | FJ024437 | DENV | 2K | EU482805 |

FIG. 70-5

| Virus | Protein | Accession No. | Virus | Protein | Accession No. | Virus | Protein | Accession No. |
|---|---|---|---|---|---|---|---|---|
| DENV | 2K | FJ432740 | DENV | 2K | FJ639819 | DENV | 2K | FJ182028 |
| DENV | 2K | AY726554 | DENV | 2K | FJ639806 | DENV | 2K | EU677152 |
| DENV | 2K | FJ024441 | DENV | 2K | FJ432738 | DENV | 2K | EU081228 |
| DENV | 2K | DQ672556 | DENV | 2K | FJ432719 | DENV | 2K | FJ410173 |
| DENV | 2K | FJ410272 | DENV | 2K | FJ461303 | DENV | 2K | EU482796 |
| DENV | 2K | FJ639676 | DENV | 2K | FJ410203 | DENV | 2K | EU726781 |
| DENV | 2K | FJ639686 | DENV | 2K | FJ410194 | DENV | 2K | FJ410207 |
| DENV | 2K | EU482498 | DENV | 2K | EU081244 | DENV | 2K | FJ410243 |
| DENV | 2K | FJ432725 | DENV | 2K | EU482482 | DENV | 2K | EU081239 |
| DENV | 2K | EU482529 | DENV | 2K | FJ410179 | DENV | 2K | EU482816 |
| DENV | 2K | FJ547086 | DENV | 2K | AY722803 | DENV | 2K | EU081260 |
| DENV | 2K | FJ461323 | DENV | 2K | EU482539 | DENV | 2K | FJ182029 |
| DENV | 2K | FJ410230 | DENV | 2K | FJ639671 | DENV | 2K | FJ024449 |
| DENV | 2K | FJ410248 | DENV | 2K | EU482478 | DENV | 2K | EU081250 |
| DENV | 2K | EU482609 | DENV | 2K | FJ547060 | DENV | 2K | EU482825 |
| DENV | 2K | FJ639824 | DENV | 2K | FJ432739 | DENV | 2K | EU482530 |
| DENV | 2K | FJ410279 | DENV | 2K | FJ639740 | DENV | 2K | FJ639820 |
| DENV | 2K | EU482535 | DENV | 2K | FJ182034 | DENV | 2K | EU677175 |
| DENV | 2K | FJ024453 | DENV | 2K | EU482710 | DENV | 2K | FJ410251 |
| DENV | 2K | FJ432748 | DENV | 2K | EU081232 | DENV | 2K | EU482794 |
| DENV | 2K | EU660393 | DENV | 2K | EU482515 | DENV | 2K | EU359008 |
| DENV | 2K | AY145122 | DENV | 2K | EU482531 | DENV | 2K | AF180818 |
| DENV | 2K | FJ024446 | DENV | 2K | AF298807 | DENV | 2K | EU660396 |
| DENV | 2K | FJ432747 | DENV | 2K | FJ205873 | DENV | 2K | FJ182003 |
| DENV | 2K | FJ410205 | DENV | 2K | FJ639674 | DENV | 2K | EU482476 |
| DENV | 2K | FJ205876 | DENV | 2K | FJ547065 | DENV | 2K | EU482505 |
| DENV | 2K | FJ410211 | DENV | 2K | FJ410212 | DENV | 2K | EU081255 |
| DENV | 2K | FJ182025 | DENV | 2K | FJ461341 | DENV | 2K | FJ639743 |
| DENV | 2K | FJ182026 | DENV | 2K | EU081259 | DENV | 2K | U88537 |
| DENV | 2K | FJ373296 | DENV | 2K | FJ639823 | DENV | 2K | FJ432733 |
| DENV | 2K | AY722802 | DENV | 2K | FJ410190 | DENV | 2K | EU660395 |
| DENV | 2K | EU482522 | DENV | 2K | FJ432745 | DENV | 2K | EU081263 |
| DENV | 2K | FJ390388 | DENV | 2K | FJ410175 | DENV | 2K | EU482826 |
| DENV | 2K | EU677173 | DENV | 2K | EU677176 | DENV | 2K | FJ410192 |
| DENV | 2K | EU081277 | DENV | 2K | FJ639679 | DENV | 2K | FJ182020 |
| DENV | 2K | EU482492 | DENV | 2K | FJ432742 | DENV | 2K | DQ672561 |
| DENV | 2K | FJ432732 | DENV | 2K | FJ639670 | DENV | 2K | FJ024481 |
| DENV | 2K | FJ639691 | DENV | 2K | FJ182027 | DENV | 2K | EU677165 |
| DENV | 2K | EU482511 | DENV | 2K | EU482718 | DENV | 2K | FJ410287 |
| DENV | 2K | EU081230 | DENV | 2K | EU677158 | DENV | 2K | EU482502 |
| DENV | 2K | FJ410206 | DENV | 2K | FJ639687 | DENV | 2K | EU081274 |
| DENV | 2K | FJ410189 | DENV | 2K | FJ461325 | DENV | 2K | FJ024448 |
| DENV | 2K | FJ182019 | DENV | 2K | FJ024444 | DENV | 2K | FJ024425 |
| DENV | 2K | FJ024472 | DENV | 2K | EU482617 | DENV | 2K | FJ639741 |
| DENV | 2K | FJ205872 | DENV | 2K | FJ639678 | DENV | 2K | FJ562104 |
| DENV | 2K | FJ410282 | DENV | 2K | EU081269 | DENV | 2K | DQ672563 |
| DENV | 2K | EU482538 | DENV | 2K | EU482714 | DENV | 2K | EU482708 |
| DENV | 2K | EU660418 | DENV | 2K | FJ024456 | DENV | 2K | FJ410247 |

FIG. 70-6

| Virus | Protein | Accession No. | Virus | Protein | Accession No. | Virus | Protein | Accession No. |
|---|---|---|---|---|---|---|---|---|
| DENV | 2K | AF180817 | DENV | 2K | EU677162 | DENV | 2K | FJ882563 |
| DENV | 2K | AY722801 | DENV | 2K | FJ024485 | DENV | 2K | GQ199812 |
| DENV | 2K | EU482504 | DENV | 2K | EU081271 | DENV | 2K | FJ873810 |
| DENV | 2K | FJ639675 | DENV | 2K | FJ024426 | DENV | 2K | FJ898397 |
| DENV | 2K | FJ024433 | DENV | 2K | EU482790 | DENV | 2K | FJ898400 |
| DENV | 2K | FJ461331 | DENV | 2K | FJ410286 | DENV | 2K | FJ687433 |
| DENV | 2K | FJ410187 | DENV | 2K | FJ639735 | DENV | 2K | GQ199877 |
| DENV | 2K | FJ410258 | DENV | 2K | EU482494 | DENV | 2K | GQ199788 |
| DENV | 2K | AY708047 | DENV | 2K | FJ390374 | DENV | 2K | GQ199823 |
| DENV | 2K | FJ024423 | DENV | 2K | EU482813 | DENV | 2K | FJ898407 |
| DENV | 2K | FJ024484 | DENV | 2K | FJ461335 | DENV | 2K | GQ199804 |
| DENV | 2K | EU081251 | DENV | 2K | EU482803 | DENV | 2K | FJ882533 |
| DENV | 2K | FJ410249 | DENV | 2K | EU482490 | DENV | 2K | GQ199818 |
| DENV | 2K | EU482610 | DENV | 2K | FJ024482 | DENV | 2K | FJ882560 |
| DENV | 2K | FJ182033 | DENV | 2K | FJ410284 | DENV | 2K | FJ898415 |
| DENV | 2K | EU482493 | DENV | 2K | EU081280 | DENV | 2K | FJ850113 |
| DENV | 2K | EU482807 | DENV | 2K | EU677150 | DENV | 2K | FJ898384 |
| DENV | 2K | FJ639814 | DENV | 2K | AY732481 | DENV | 2K | FJ882538 |
| DENV | 2K | EU482501 | DENV | 2K | FJ461324 | DENV | 2K | FJ882521 |
| DENV | 2K | FJ410254 | DENV | 2K | FJ639796 | DENV | 2K | GQ199811 |
| DENV | 2K | EU081246 | DENV | 2K | EU482709 | DENV | 2K | FJ850075 |
| DENV | 2K | EU081275 | DENV | 2K | AF298808 | DENV | 2K | GQ199848 |
| DENV | 2K | FJ410264 | DENV | 2K | FJ182018 | DENV | 2K | FJ898378 |
| DENV | 2K | FJ024479 | DENV | 2K | DQ672558 | DENV | 2K | FJ873814 |
| DENV | 2K | FJ410185 | DENV | 2K | EU482795 | DENV | 2K | FJ898410 |
| DENV | 2K | FJ410273 | DENV | 2K | EU677164 | DENV | 2K | FJ882528 |
| DENV | 2K | EU482801 | DENV | 2K | FJ410277 | DENV | 2K | FJ898382 |
| DENV | 2K | AY713476 | DENV | 2K | FJ024464 | DENV | 2K | FJ898404 |
| DENV | 2K | FJ461312 | DENV | 2K | FJ461332 | DENV | 2K | FJ687426 |
| DENV | 2K | FJ639797 | DENV | 2K | EF122232 | DENV | 2K | FJ898371 |
| DENV | 2K | FJ461319 | DENV | 2K | FJ432727 | DENV | 2K | GQ199872 |
| DENV | 2K | FJ461333 | DENV | 2K | EU482823 | DENV | 2K | GQ199855 |
| DENV | 2K | EU482516 | DENV | 2K | EU482810 | DENV | 2K | FJ882535 |
| DENV | 2K | EU482792 | DENV | 2K | EU081245 | DENV | 2K | NC_001477 |
| DENV | 2K | AF514889 | DENV | 2K | EU081262 | DENV | 2K | FJ898423 |
| DENV | 2K | EU482509 | DENV | 2K | EU863650 | DENV | 2K | FJ882565 |
| DENV | 2K | FJ432737 | DENV | 2K | AY732483 | DENV | 2K | FJ882517 |
| DENV | 2K | FJ547063 | DENV | 2K | FJ410265 | DENV | 2K | GQ199814 |
| DENV | 2K | FJ373297 | DENV | 2K | EU660412 | DENV | 2K | FJ898395 |
| DENV | 2K | EU677157 | DENV | 2K | EU677171 | DENV | 2K | GQ199851 |
| DENV | 2K | EU482534 | DENV | 2K | EU677140 | DENV | 2K | GQ199837 |
| DENV | 2K | EU249491 | DENV | 2K | FJ898428 | DENV | 2K | FJ882558 |
| DENV | 2K | DQ285562 | DENV | 2K | FJ882569 | DENV | 2K | FJ850084 |
| DENV | 2K | EU482793 | DENV | 2K | GQ199776 | DENV | 2K | FJ898374 |
| DENV | 2K | EU482717 | DENV | 2K | GQ199853 | DENV | 2K | FJ850104 |
| DENV | 2K | FJ024439 | DENV | 2K | GQ199803 | DENV | 2K | GQ199815 |
| DENV | 2K | EU482804 | DENV | 2K | FJ882554 | DENV | 2K | GQ199843 |
| DENV | 2K | EU482503 | DENV | 2K | FJ873809 | DENV | 2K | GQ199826 |

FIG. 70-7

| Virus | Protein | Accession No. | Virus | Protein | Accession No. | Virus | Protein | Accession No. |
|---|---|---|---|---|---|---|---|---|
| DENV | 2K | FJ882550 | DENV | 2K | FJ882547 | DENV | 2K | FJ744702 |
| DENV | 2K | FJ744701 | DENV | 2K | GQ199798 | DENV | 2K | FJ898386 |
| DENV | 2K | FJ898391 | DENV | 2K | GQ199844 | DENV | 2K | FJ882542 |
| DENV | 2K | FJ898417 | DENV | 2K | GQ199829 | DENV | 2K | GQ199782 |
| DENV | 2K | GQ199806 | DENV | 2K | FJ882530 | DENV | 2K | GQ199852 |
| DENV | 2K | GQ199794 | DENV | 2K | FJ898422 | DENV | 2K | FJ898421 |
| DENV | 2K | FJ898425 | DENV | 2K | FJ810415 | DENV | 2K | FJ687432 |
| DENV | 2K | FJ898393 | DENV | 2K | FJ898411 | DENV | 2K | GQ199813 |
| DENV | 2K | GQ199799 | DENV | 2K | GQ199856 | DENV | 2K | FJ882534 |
| DENV | 2K | GQ199833 | DENV | 2K | FJ850101 | DENV | 2K | GQ199854 |
| DENV | 2K | GQ199781 | DENV | 2K | FJ850093 | DENV | 2K | GQ199846 |
| DENV | 2K | GQ199797 | DENV | 2K | FJ882551 | DENV | 2K | FJ882539 |
| DENV | 2K | FJ882522 | DENV | 2K | GQ199795 | DENV | 2K | FJ898437 |
| DENV | 2K | FJ906964 | DENV | 2K | FJ850100 | DENV | 2K | FJ898390 |
| DENV | 2K | GQ199821 | DENV | 2K | FJ898416 | DENV | 2K | FJ898405 |
| DENV | 2K | GQ199847 | DENV | 2K | GQ199785 | DENV | 2K | GQ199783 |
| DENV | 2K | FJ882524 | DENV | 2K | GQ199784 | DENV | 2K | FJ882526 |
| DENV | 2K | FJ850077 | DENV | 2K | GQ199828 | DENV | 2K | FJ461320 |
| DENV | 2K | FJ882552 | DENV | 2K | GQ199780 | DENV | 2K | FJ898420 |
| DENV | 2K | GQ199778 | DENV | 2K | FJ850103 | DENV | 2K | FJ687431 |
| DENV | 2K | FJ882549 | DENV | 2K | FJ882555 | DENV | 2K | GQ199801 |
| DENV | 2K | GQ199816 | DENV | 2K | FJ882561 | DENV | 2K | FJ906728 |
| DENV | 2K | GQ199824 | DENV | 2K | FJ687430 | DENV | 2K | FJ882544 |
| DENV | 2K | FJ898398 | DENV | 2K | FJ898381 | DENV | 2K | FJ882553 |
| DENV | 2K | FJ859029 | DENV | 2K | FJ882518 | DENV | 2K | FJ882531 |
| DENV | 2K | FJ882515 | DENV | 2K | FJ898392 | DENV | 2K | GQ199810 |
| DENV | 2K | GQ199820 | DENV | 2K | FJ898380 | DENV | 2K | GQ199825 |
| DENV | 2K | GQ199867 | DENV | 2K | GQ199835 | DENV | 2K | FJ882546 |
| DENV | 2K | FJ898448 | DENV | 2K | FJ898430 | DENV | 2K | FJ882568 |
| DENV | 2K | FJ882556 | DENV | 2K | FJ850087 | DENV | 2K | FJ898413 |
| DENV | 2K | FJ882536 | DENV | 2K | FJ898385 | DENV | 2K | GQ199773 |
| DENV | 2K | GQ199796 | DENV | 2K | GQ199857 | DENV | 2K | GQ199822 |
| DENV | 2K | FJ882570 | DENV | 2K | FJ898403 | DENV | 2K | GQ199832 |
| DENV | 2K | FJ898376 | DENV | 2K | GQ199800 | DENV | 2K | GQ199790 |
| DENV | 2K | GQ199771 | DENV | 2K | FJ882540 | DENV | 2K | GQ199841 |
| DENV | 2K | FJ850069 | DENV | 2K | GQ199792 | DENV | 2K | FJ882520 |
| DENV | 2K | FJ850102 | DENV | 2K | FJ882516 | DENV | 2K | GQ199875 |
| DENV | 2K | GQ199834 | DENV | 2K | GQ199850 | DENV | 2K | GQ199802 |
| DENV | 2K | FJ898388 | DENV | 2K | FJ898372 | DENV | 2K | GQ199791 |
| DENV | 2K | GQ199830 | DENV | 2K | GQ199775 | DENV | 2K | FJ898426 |
| DENV | 2K | GQ199839 | DENV | 2K | FJ882559 | DENV | 2K | FJ898431 |
| DENV | 2K | GQ199777 | DENV | 2K | GQ199789 | DENV | 2K | GQ199809 |
| DENV | 2K | FJ882579 | DENV | 2K | FJ850099 | DENV | 2K | FJ898406 |
| DENV | 2K | FJ898429 | DENV | 2K | FJ850114 | DENV | 2K | GQ199805 |
| DENV | 2K | FJ882541 | DENV | 2K | GQ199819 | DENV | 2K | GQ199831 |
| DENV | 2K | FJ898402 | DENV | 2K | FJ882523 | DENV | 2K | FJ850070 |
| DENV | 2K | GQ199808 | DENV | 2K | GQ199845 | DENV | 2K | GQ199807 |
| DENV | 2K | GQ199786 | DENV | 2K | FJ850081 | DENV | 2K | FJ882543 |

FIG. 70-8

| Virus | Protein | Accession No. | Virus | Protein | Accession No. | Virus | Protein | Accession No. |
|---|---|---|---|---|---|---|---|---|
| DENV | 2K | FJ898408 | DENV | 2K | GQ199840 | DENV | 2K | GU131804 |
| DENV | 2K | FJ810419 | DENV | 2K | FJ898433 | DENV | 2K | GU131762 |
| DENV | 2K | GQ199793 | DENV | 2K | FJ882567 | DENV | 2K | GU131827 |
| DENV | 2K | FJ882562 | DENV | 2K | FJ898387 | DENV | 2K | GU131837 |
| DENV | 2K | FJ898424 | DENV | 2K | FJ882532 | DENV | 2K | GQ868630 |
| DENV | 2K | FJ898389 | DENV | 2K | FJ898409 | DENV | 2K | GU131767 |
| DENV | 2K | FJ898412 | DENV | 2K | FJ882545 | DENV | 2K | GU131737 |
| DENV | 2K | FJ882537 | DENV | 2K | FJ898375 | DENV | 2K | GQ868500 |
| DENV | 2K | FJ898418 | DENV | 2K | FJ898414 | DENV | 2K | GU131722 |
| DENV | 2K | FJ898394 | DENV | 2K | CS477306 | DENV | 2K | GQ868607 |
| DENV | 2K | GQ199849 | DENV | 2K | A75711 | DENV | 2K | GQ868517 |
| DENV | 2K | FJ882548 | DENV | 2K | GU131816 | DENV | 2K | GU131727 |
| DENV | 2K | FJ906963 | DENV | 2K | FJ469907 | DENV | 2K | GU131715 |
| DENV | 2K | FJ906965 | DENV | 2K | GU131814 | DENV | 2K | FN429885 |
| DENV | 2K | GQ199873 | DENV | 2K | GU131725 | DENV | 2K | GU131780 |
| DENV | 2K | FJ850073 | DENV | 2K | GU131822 | DENV | 2K | GU131750 |
| DENV | 2K | FJ850071 | DENV | 2K | GQ868633 | DENV | 2K | GU131787 |
| DENV | 2K | GQ199772 | DENV | 2K | GU131820 | DENV | 2K | GU056031 |
| DENV | 2K | FJ898373 | DENV | 2K | GU131679 | DENV | 2K | GQ868602 |
| DENV | 2K | FJ687429 | DENV | 2K | GQ868507 | DENV | 2K | GU131711 |
| DENV | 2K | FJ898379 | DENV | 2K | GU131789 | DENV | 2K | GQ868567 |
| DENV | 2K | FJ882566 | DENV | 2K | GU131710 | DENV | 2K | GU131813 |
| DENV | 2K | FJ898396 | DENV | 2K | FN429887 | DENV | 2K | FJ687428 |
| DENV | 2K | FJ882529 | DENV | 2K | GU131720 | DENV | 2K | GU131707 |
| DENV | 2K | GQ199838 | DENV | 2K | GU131841 | DENV | 2K | GU131689 |
| DENV | 2K | GQ199779 | DENV | 2K | GQ868564 | DENV | 2K | GU131700 |
| DENV | 2K | GQ199827 | DENV | 2K | AB519681 | DENV | 2K | GU131798 |
| DENV | 2K | GQ199836 | DENV | 2K | GU131743 | DENV | 2K | GU131713 |
| DENV | 2K | GQ199858 | DENV | 2K | GQ868522 | DENV | 2K | GU131829 |
| DENV | 2K | GQ199787 | DENV | 2K | GU131739 | DENV | 2K | GU131782 |
| DENV | 2K | FJ850068 | DENV | 2K | GU131971 | DENV | 2K | GU131698 |
| DENV | 2K | FJ882564 | DENV | 2K | GU131834 | DENV | 2K | GU131732 |
| DENV | 2K | FJ898419 | DENV | 2K | GQ868523 | DENV | 2K | GU131772 |
| DENV | 2K | FJ898383 | DENV | 2K | GU131982 | DENV | 2K | GU131978 |
| DENV | 2K | FJ461328 | DENV | 2K | GU131965 | DENV | 2K | GU131958 |
| DENV | 2K | FJ882527 | DENV | 2K | GU131760 | DENV | 2K | GU131811 |
| DENV | 2K | FJ898427 | DENV | 2K | GQ868535 | DENV | 2K | GQ868506 |
| DENV | 2K | FJ882525 | DENV | 2K | GU131962 | DENV | 2K | GQ868525 |
| DENV | 2K | FJ882557 | DENV | 2K | GU131891 | DENV | 2K | GQ868538 |
| DENV | 2K | GQ199859 | DENV | 2K | GQ868504 | DENV | 2K | FJ469909 |
| DENV | 2K | GQ199842 | DENV | 2K | GU131783 | DENV | 2K | GU131818 |
| DENV | 2K | GQ199817 | DENV | 2K | GU131680 | DENV | 2K | GU131893 |
| DENV | 2K | FJ898401 | DENV | 2K | GU131704 | DENV | 2K | GQ868509 |
| DENV | 2K | FJ882519 | DENV | 2K | GU131685 | DENV | 2K | GU131706 |
| DENV | 2K | FJ850090 | DENV | 2K | GU131770 | DENV | 2K | GU131777 |
| DENV | 2K | FJ898377 | DENV | 2K | GU131795 | DENV | 2K | GU131925 |
| DENV | 2K | GQ199774 | DENV | 2K | GU131961 | DENV | 2K | GU131977 |
| DENV | 2K | FJ898399 | DENV | 2K | GU131733 | DENV | 2K | GQ868611 |

FIG. 70-9

| Virus | Protein | Accession No. | Virus | Protein | Accession No. | Virus | Protein | Accession No. |
|---|---|---|---|---|---|---|---|---|
| DENV | 2K | GU131745 | DENV | 2K | GU131763 | DENV | 2K | GU131747 |
| DENV | 2K | GQ868635 | DENV | 2K | GQ868527 | DENV | 2K | GU131748 |
| DENV | 2K | GU056032 | DENV | 2K | GU131708 | DENV | 2K | FN429889 |
| DENV | 2K | GQ868610 | DENV | 2K | GU131766 | DENV | 2K | GU131776 |
| DENV | 2K | GU131889 | DENV | 2K | FN429890 | DENV | 2K | GU131755 |
| DENV | 2K | GQ868499 | DENV | 2K | GU131694 | DENV | 2K | GU131810 |
| DENV | 2K | GU131756 | DENV | 2K | GQ868615 | DENV | 2K | GU131701 |
| DENV | 2K | GU131786 | DENV | 2K | GU131688 | DENV | 2K | GU131754 |
| DENV | 2K | GQ868565 | DENV | 2K | FJ469908 | DENV | 2K | GU131784 |
| DENV | 2K | GU131709 | DENV | 2K | GU131734 | DENV | 2K | GU131807 |
| DENV | 2K | GQ868569 | DENV | 2K | GQ868637 | DENV | 2K | GU131842 |
| DENV | 2K | GU131723 | DENV | 2K | GU131888 | DENV | 2K | GU131923 |
| DENV | 2K | GU131696 | DENV | 2K | GQ868568 | DENV | 2K | GU131809 |
| DENV | 2K | GQ868519 | DENV | 2K | GU131790 | DENV | 2K | GU131726 |
| DENV | 2K | GU131838 | DENV | 2K | GU131920 | DENV | 2K | GU131970 |
| DENV | 2K | GQ868520 | DENV | 2K | GQ868528 | DENV | 2K | GU131751 |
| DENV | 2K | GU131791 | DENV | 2K | GQ868612 | DENV | 2K | GU131828 |
| DENV | 2K | GU131765 | DENV | 2K | GU131794 | DENV | 2K | GQ868524 |
| DENV | 2K | GU131702 | DENV | 2K | GQ868606 | DENV | 2K | GU131863 |
| DENV | 2K | GU131682 | DENV | 2K | GU131969 | DENV | 2K | GU131892 |
| DENV | 2K | GU131801 | DENV | 2K | GQ868608 | DENV | 2K | GU131823 |
| DENV | 2K | GQ868562 | DENV | 2K | GU131921 | DENV | 2K | GU131821 |
| DENV | 2K | GU131684 | DENV | 2K | GQ868502 | DENV | 2K | GU131983 |
| DENV | 2K | GU131744 | DENV | 2K | GU131719 | DENV | 2K | GQ868518 |
| DENV | 2K | GQ868534 | DENV | 2K | GU131973 | DENV | 2K | GU131764 |
| DENV | 2K | GU131687 | DENV | 2K | GU131967 | DENV | 2K | GU056030 |
| DENV | 2K | GQ868529 | DENV | 2K | GU131803 | DENV | 2K | GU131979 |
| DENV | 2K | GU131840 | DENV | 2K | GU131736 | DENV | 2K | GU131768 |
| DENV | 2K | GU131808 | DENV | 2K | GU131981 | DENV | 2K | GU131699 |
| DENV | 2K | GU131922 | DENV | 2K | GU131964 | DENV | 2K | FJ687427 |
| DENV | 2K | GU131836 | DENV | 2K | GU131771 | DENV | 2K | GU131963 |
| DENV | 2K | GQ868613 | DENV | 2K | GU131984 | DENV | 2K | GU131793 |
| DENV | 2K | GU131721 | DENV | 2K | GU131695 | DENV | 2K | GQ868618 |
| DENV | 2K | GU131730 | DENV | 2K | GU131728 | DENV | 2K | GU131799 |
| DENV | 2K | GU131968 | DENV | 2K | GQ868601 | DENV | 2K | GU131724 |
| DENV | 2K | GU131832 | DENV | 2K | FN429886 | DENV | 2K | GU131740 |
| DENV | 2K | GU131774 | DENV | 2K | GU131826 | DENV | 2K | GU131806 |
| DENV | 2K | GU131976 | DENV | 2K | GQ868512 | DENV | 2K | GQ868614 |
| DENV | 2K | GU131831 | DENV | 2K | GU131718 | DENV | 2K | FN429881 |
| DENV | 2K | GQ868501 | DENV | 2K | GQ868513 | DENV | 2K | GQ868636 |
| DENV | 2K | GQ868531 | DENV | 2K | GU131731 | DENV | 2K | GU131746 |
| DENV | 2K | GU131957 | DENV | 2K | GU131686 | DENV | 2K | GQ868560 |
| DENV | 2K | GU131980 | DENV | 2K | GU131894 | DENV | 2K | GQ868508 |
| DENV | 2K | GQ868609 | DENV | 2K | GU131895 | DENV | 2K | GQ868570 |
| DENV | 2K | GU131769 | DENV | 2K | GU131678 | DENV | 2K | GU131788 |
| DENV | 2K | GQ868526 | DENV | 2K | GQ868619 | DENV | 2K | GU131949 |
| DENV | 2K | GQ868510 | DENV | 2K | GU131729 | DENV | 2K | GU131796 |
| DENV | 2K | FN429882 | DENV | 2K | GQ868539 | DENV | 2K | GU056029 |

FIG. 70-10

| Virus | Protein | Accession No. | Virus | Protein | Accession No. | Virus | Protein | Accession No. |
|---|---|---|---|---|---|---|---|---|
| DENV | 2K | GU131792 | DENV | 2K | GU131835 | DENV | 2K | EU854296 |
| DENV | 2K | GU131690 | DENV | 2K | GU131716 | DENV | 2K | EU854300 |
| DENV | 2K | GQ868632 | DENV | 2K | GQ868498 | DENV | 2K | AY858050 |
| DENV | 2K | GU131781 | DENV | 2K | GU131683 | DENV | 2K | AF375822 |
| DENV | 2K | GQ868537 | DENV | 2K | GU131960 | DENV | 2K | EU854295 |
| DENV | 2K | GU131815 | DENV | 2K | GU131714 | DENV | 2K | M14931 |
| DENV | 2K | GU056033 | DENV | 2K | GU131779 | DENV | 2K | AY618992 |
| DENV | 2K | GU131812 | DENV | 2K | GU131773 | DENV | 2K | EU854297 |
| DENV | 2K | GU131833 | DENV | 2K | GQ868605 | DENV | 2K | FJ639738 |
| DENV | 2K | GU131830 | DENV | 2K | GQ868511 | DENV | 2K | AY618993 |
| DENV | 2K | GU131742 | DENV | 2K | GU131752 | DENV | 2K | FJ639764 |
| DENV | 2K | GQ868561 | DENV | 2K | GU131691 | DENV | 2K | FJ639737 |
| DENV | 2K | GU131800 | DENV | 2K | GU131692 | DENV | 2K | AY776330 |
| DENV | 2K | GU131738 | DENV | 2K | GU131705 | DENV | 2K | AY618991 |
| DENV | 2K | GU131824 | DENV | 2K | GQ868639 | DENV | 2K | FJ639736 |
| DENV | 2K | GU131919 | DENV | 2K | GU131805 | DENV | 2K | FJ639739 |
| DENV | 2K | GU131802 | DENV | 2K | GU131735 | DENV | 2K | AF326826 |
| DENV | 2K | GQ868503 | DENV | 2K | GU131966 | DENV | 2K | AY947539 |
| DENV | 2K | GU131839 | DENV | 2K | GU131890 | DENV | 2K | EU854299 |
| DENV | 2K | GU131681 | DENV | 2K | GQ868566 | DENV | 2K | AY618990 |
| DENV | 2K | GQ868505 | DENV | 2K | GU131775 | DENV | 2K | FJ639748 |
| DENV | 2K | FN429884 | DENV | 2K | GU131749 | DENV | 2K | FJ639744 |
| DENV | 2K | GQ868536 | DENV | 2K | GQ868521 | DENV | 2K | EU854301 |
| DENV | 2K | GU131825 | DENV | 2K | GU131703 | DENV | 2K | FJ639773 |
| DENV | 2K | FN429888 | DENV | 2K | GU131717 | DENV | 2K | FJ182016 |
| DENV | 2K | GU131778 | DENV | 2K | GU131712 | DENV | 2K | AF326573 |
| DENV | 2K | GU131972 | DENV | 2K | GQ868532 | DENV | 2K | FJ182017 |
| DENV | 2K | GU131817 | DENV | 2K | GQ868514 | DENV | 2K | FJ024476 |
| DENV | 2K | GU131759 | DENV | 2K | FJ410220 | DENV | 2K | EF457906 |
| DENV | 2K | GU131819 | DENV | 2K | CS477302 | DENV | 2K | FJ639742 |
| DENV | 2K | GU131757 | DENV | 2K | CS477304 | DENV | 2K | AF289029 |
| DENV | 2K | GQ868533 | DENV | 2K | CS477264 | DENV | 2K | GQ199880 |
| DENV | 2K | FN429883 | DENV | 2K | CS477305 | DENV | 2K | FJ882597 |
| DENV | 2K | GU131956 | DENV | 2K | CS477263 | DENV | 2K | NC_002640 |
| DENV | 2K | GQ868563 | DENV | 2K | CS477265 | DENV | 2K | FJ882587 |
| DENV | 2K | GU131926 | DENV | 2K | M87512 | DENV | 2K | FJ882595 |
| DENV | 2K | GU131887 | DENV | 2K | FB730116 | DENV | 2K | FJ882582 |
| DENV | 2K | GU131741 | DENV | 2K | GM059691 | DENV | 2K | FJ810417 |
| DENV | 2K | GU131761 | DENV | 2K | U88536 | DENV | 2K | FJ850095 |
| DENV | 2K | GU131693 | DENV | 2K | GU370048 | DENV | 2K | FJ882599 |
| DENV | 2K | GU131753 | DENV | 2K | GU370049 | DENV | 2K | FJ882580 |
| DENV | 2K | GU131948 | DENV | 2K | AY762085 | DENV | 2K | GQ199884 |
| DENV | 2K | GQ868559 | DENV | 2K | FJ024424 | DENV | 2K | FJ882588 |
| DENV | 2K | GQ868530 | DENV | 2K | FJ226067 | DENV | 2K | FJ882598 |
| DENV | 2K | GU131797 | DENV | 2K | FJ639745 | DENV | 2K | FJ882601 |
| DENV | 2K | GU131785 | DENV | 2K | AY618989 | DENV | 2K | FJ850058 |
| DENV | 2K | GU131758 | DENV | 2K | AF326827 | DENV | 2K | FJ882584 |
| DENV | 2K | GU131697 | DENV | 2K | AY618988 | DENV | 2K | FJ850059 |

FIG. 70-11

| Virus | Protein | Accession No. | Virus | Protein | Accession No. | Virus | Protein | Accession No. |
|---|---|---|---|---|---|---|---|---|
| DENV | 2K | GQ199883 | DENV | 2K | DQ401690 | DENV | 2K | EU482455 |
| DENV | 2K | FJ882586 | DENV | 2K | EU529683 | DENV | 2K | AY744680 |
| DENV | 2K | GQ252675 | DENV | 2K | AY679147 | DENV | 2K | FJ182015 |
| DENV | 2K | FJ882581 | DENV | 2K | AY676348 | DENV | 2K | FJ562103 |
| DENV | 2K | GQ199881 | DENV | 2K | EF629368 | DENV | 2K | FJ639792 |
| DENV | 2K | GQ199878 | DENV | 2K | FJ639752 | DENV | 2K | DQ675527 |
| DENV | 2K | FJ882596 | DENV | 2K | FJ639807 | DENV | 2K | FJ547066 |
| DENV | 2K | FJ882583 | DENV | 2K | EU529684 | DENV | 2K | EU529698 |
| DENV | 2K | FJ882600 | DENV | 2K | FJ373304 | DENV | 2K | EU726769 |
| DENV | 2K | FJ850057 | DENV | 2K | FJ639723 | DENV | 2K | AY676349 |
| DENV | 2K | GQ199879 | DENV | 2K | EU569691 | DENV | 2K | EU529688 |
| DENV | 2K | FJ882585 | DENV | 2K | DQ675524 | DENV | 2K | EU482558 |
| DENV | 2K | GQ199876 | DENV | 2K | EU081203 | DENV | 2K | FJ547070 |
| DENV | 2K | GQ199885 | DENV | 2K | EU482564 | DENV | 2K | EU687198 |
| DENV | 2K | FJ882592 | DENV | 2K | FJ182039 | DENV | 2K | FJ639817 |
| DENV | 2K | GQ199882 | DENV | 2K | EU482453 | DENV | 2K | EU081202 |
| DENV | 2K | FJ882591 | DENV | 2K | FJ639779 | DENV | 2K | EU081225 |
| DENV | 2K | FJ882589 | DENV | 2K | EU081183 | DENV | 2K | DQ675520 |
| DENV | 2K | GQ868642 | DENV | 2K | EU529690 | DENV | 2K | EU854298 |
| DENV | 2K | GQ868581 | DENV | 2K | FJ182011 | DENV | 2K | FJ205870 |
| DENV | 2K | FN429919 | DENV | 2K | EU081187 | DENV | 2K | FJ639793 |
| DENV | 2K | GQ868583 | DENV | 2K | EU482461 | DENV | 2K | DQ675532 |
| DENV | 2K | FN429920 | DENV | 2K | FJ639803 | DENV | 2K | FJ024470 |
| DENV | 2K | FN429923 | DENV | 2K | AY858047 | DENV | 2K | EU081210 |
| DENV | 2K | GQ868585 | DENV | 2K | FJ639774 | DENV | 2K | EU687226 |
| DENV | 2K | GQ868579 | DENV | 2K | FJ639726 | DENV | 2K | FJ639715 |
| DENV | 2K | GQ868644 | DENV | 2K | AY858037 | DENV | 2K | AY676352 |
| DENV | 2K | FN429925 | DENV | 2K | EU081215 | DENV | 2K | AY858043 |
| DENV | 2K | GU289913 | DENV | 2K | FJ639785 | DENV | 2K | EU081196 |
| DENV | 2K | GQ868580 | DENV | 2K | FJ639761 | DENV | 2K | FJ432741 |
| DENV | 2K | FN429922 | DENV | 2K | EU569688 | DENV | 2K | EU726773 |
| DENV | 2K | GQ868645 | DENV | 2K | DQ675533 | DENV | 2K | EU482555 |
| DENV | 2K | GQ868594 | DENV | 2K | FJ410177 | DENV | 2K | DQ401694 |
| DENV | 2K | FN429924 | DENV | 2K | FJ478456 | DENV | 2K | EU081216 |
| DENV | 2K | FJ882590 | DENV | 2K | EU081195 | DENV | 2K | EU529704 |
| DENV | 2K | GQ868582 | DENV | 2K | EU081221 | DENV | 2K | FJ639777 |
| DENV | 2K | GQ868584 | DENV | 2K | EU529689 | DENV | 2K | FJ639730 |
| DENV | 2K | FN429926 | DENV | 2K | EU660408 | DENV | 2K | EU081190 |
| DENV | 2K | FN429921 | DENV | 2K | EU687219 | DENV | 2K | EU529703 |
| DENV | 2K | GQ868643 | DENV | 2K | FJ639780 | DENV | 2K | FJ639725 |
| DENV | 2K | AF326825 | DENV | 2K | EU687196 | DENV | 2K | EU081205 |
| DENV | 2K | AY376438 | DENV | 2K | EF643017 | DENV | 2K | AY876494 |
| DENV | 2K | AY648301 | DENV | 2K | FJ373303 | DENV | 2K | FJ639747 |
| DENV | 2K | AY099336 | DENV | 2K | FJ639729 | DENV | 2K | FJ373302 |
| DENV | 2K | GU363549 | DENV | 2K | FJ639775 | DENV | 2K | FJ639778 |
| DENV | 2K | GU370052 | DENV | 2K | FJ461322 | DENV | 2K | DQ401692 |
| DENV | 2K | GU370053 | DENV | 2K | FJ390371 | DENV | 2K | FJ182038 |
| DENV | 2K | EU081191 | DENV | 2K | AY858046 | DENV | 2K | EU081220 |

FIG. 70-12

| Virus | Protein | Accession No. | Virus | Protein | Accession No. | Virus | Protein | Accession No. |
|---|---|---|---|---|---|---|---|---|
| DENV | 2K | AY923865 | DENV | 2K | EU081222 | DENV | 2K | DQ675531 |
| DENV | 2K | EU081188 | DENV | 2K | EU660407 | DENV | 2K | FJ461326 |
| DENV | 2K | FJ461337 | DENV | 2K | M93130 | DENV | 2K | FJ373306 |
| DENV | 2K | EU081224 | DENV | 2K | EU529687 | DENV | 2K | EU569689 |
| DENV | 2K | EU081207 | DENV | 2K | DQ675523 | DENV | 2K | AY858041 |
| DENV | 2K | FJ639750 | DENV | 2K | FJ432722 | DENV | 2K | EU482566 |
| DENV | 2K | AB189128 | DENV | 2K | EU482559 | DENV | 2K | EF629370 |
| DENV | 2K | AY676353 | DENV | 2K | FJ639721 | DENV | 2K | AY496877 |
| DENV | 2K | EU081209 | DENV | 2K | AY744682 | DENV | 2K | FJ562102 |
| DENV | 2K | FJ639772 | DENV | 2K | EU081184 | DENV | 2K | EF629367 |
| DENV | 2K | FJ182040 | DENV | 2K | FJ639805 | DENV | 2K | FJ547077 |
| DENV | 2K | AY648961 | DENV | 2K | FJ547074 | DENV | 2K | FJ639770 |
| DENV | 2K | FJ410178 | DENV | 2K | EU529685 | DENV | 2K | EU081182 |
| DENV | 2K | EU529699 | DENV | 2K | DQ401695 | DENV | 2K | EU596494 |
| DENV | 2K | EU081199 | DENV | 2K | FJ432743 | DENV | 2K | FJ639749 |
| DENV | 2K | FJ639786 | DENV | 2K | EU854291 | DENV | 2K | EU726771 |
| DENV | 2K | FJ639768 | DENV | 2K | FJ182008 | DENV | 2K | FJ639746 |
| DENV | 2K | FJ639731 | DENV | 2K | FJ547062 | DENV | 2K | EU081214 |
| DENV | 2K | FJ390373 | DENV | 2K | FJ024467 | DENV | 2K | AY858039 |
| DENV | 2K | FJ639800 | DENV | 2K | EU687239 | DENV | 2K | EU660411 |
| DENV | 2K | FJ547079 | DENV | 2K | FJ024468 | DENV | 2K | EU482563 |
| DENV | 2K | FJ547072 | DENV | 2K | AY496874 | DENV | 2K | AY744678 |
| DENV | 2K | EU081219 | DENV | 2K | FJ547061 | DENV | 2K | FJ461334 |
| DENV | 2K | EU596493 | DENV | 2K | FJ547076 | DENV | 2K | EU660420 |
| DENV | 2K | EU081192 | DENV | 2K | FJ639767 | DENV | 2K | FJ024466 |
| DENV | 2K | FJ432731 | DENV | 2K | AB189125 | DENV | 2K | FJ639795 |
| DENV | 2K | AB189126 | DENV | 2K | AF317645 | DENV | 2K | FJ024465 |
| DENV | 2K | FJ024471 | DENV | 2K | AB189127 | DENV | 2K | EU726768 |
| DENV | 2K | FJ639769 | DENV | 2K | EU781137 | DENV | 2K | FJ639720 |
| DENV | 2K | FJ547078 | DENV | 2K | DQ675522 | DENV | 2K | EU529696 |
| DENV | 2K | FJ547080 | DENV | 2K | EU482614 | DENV | 2K | FJ639810 |
| DENV | 2K | AY744679 | DENV | 2K | AB214879 | DENV | 2K | AY744681 |
| DENV | 2K | EU081217 | DENV | 2K | FJ639765 | DENV | 2K | FJ639724 |
| DENV | 2K | AY858045 | DENV | 2K | EU081211 | DENV | 2K | EU482595 |
| DENV | 2K | FJ547084 | DENV | 2K | FJ639787 | DENV | 2K | AY676351 |
| DENV | 2K | DQ675521 | DENV | 2K | FJ639784 | DENV | 2K | DQ401689 |
| DENV | 2K | AY776329 | DENV | 2K | EU569690 | DENV | 2K | FJ182005 |
| DENV | 2K | FJ639789 | DENV | 2K | EU081223 | DENV | 2K | FJ547085 |
| DENV | 2K | AY496871 | DENV | 2K | FJ639816 | DENV | 2K | EU081193 |
| DENV | 2K | EU781136 | DENV | 2K | AY496873 | DENV | 2K | FJ639751 |
| DENV | 2K | FJ182013 | DENV | 2K | FJ182010 | DENV | 2K | DQ675525 |
| DENV | 2K | EU596492 | DENV | 2K | AY099337 | DENV | 2K | FJ639826 |
| DENV | 2K | EU726774 | DENV | 2K | AY496879 | DENV | 2K | EU482458 |
| DENV | 2K | EU081198 | DENV | 2K | EU482462 | DENV | 2K | EU081204 |
| DENV | 2K | FJ639728 | DENV | 2K | FJ639825 | DENV | 2K | EU529691 |
| DENV | 2K | DQ675530 | DENV | 2K | AY766104 | DENV | 2K | FJ639719 |
| DENV | 2K | EU660409 | DENV | 2K | FJ182007 | DENV | 2K | FJ182037 |
| DENV | 2K | EU081206 | DENV | 2K | DQ401693 | DENV | 2K | EU482612 |

FIG. 70-13

| Virus | Protein | Accession No. | Virus | Protein | Accession No. | Virus | Protein | Accession No. |
|---|---|---|---|---|---|---|---|---|
| DENV | 2K | EU482596 | DENV | 2K | EU081197 | DENV | 2K | AY858038 |
| DENV | 2K | EU081208 | DENV | 2K | FJ639755 | DENV | 2K | EU482456 |
| DENV | 2K | EU081201 | DENV | 2K | FJ639798 | DENV | 2K | EU081200 |
| DENV | 2K | FJ639757 | DENV | 2K | FJ639758 | DENV | 2K | FJ639756 |
| DENV | 2K | FJ639713 | DENV | 2K | EU687218 | DENV | 2K | AY744677 |
| DENV | 2K | AY744685 | DENV | 2K | EU081189 | DENV | 2K | AY744683 |
| DENV | 2K | FJ182041 | DENV | 2K | FJ639759 | DENV | 2K | FJ639753 |
| DENV | 2K | FJ562099 | DENV | 2K | EU081212 | DENV | 2K | FJ639716 |
| DENV | 2K | FJ562100 | DENV | 2K | EU482460 | DENV | 2K | EU081194 |
| DENV | 2K | FJ547081 | DENV | 2K | FJ547075 | DENV | 2K | FJ639776 |
| DENV | 2K | AY858044 | DENV | 2K | AY676350 | DENV | 2K | FJ898469 |
| DENV | 2K | FJ639714 | DENV | 2K | EU854292 | DENV | 2K | GQ252674 |
| DENV | 2K | EU529686 | DENV | 2K | EU660410 | DENV | 2K | FJ850055 |
| DENV | 2K | FJ410229 | DENV | 2K | FJ432728 | DENV | 2K | FJ898475 |
| DENV | 2K | FJ547073 | DENV | 2K | FJ024469 | DENV | 2K | FJ744739 |
| DENV | 2K | FJ639791 | DENV | 2K | AY858048 | DENV | 2K | NC_001475 |
| DENV | 2K | EU529692 | DENV | 2K | FJ639804 | DENV | 2K | GQ199863 |
| DENV | 2K | FJ547082 | DENV | 2K | EU529705 | DENV | 2K | FJ850089 |
| DENV | 2K | EU367962 | DENV | 2K | EU482454 | DENV | 2K | FJ898442 |
| DENV | 2K | FJ390375 | DENV | 2K | DQ401691 | DENV | 2K | FJ898459 |
| DENV | 2K | AY858040 | DENV | 2K | FJ639771 | DENV | 2K | FJ850049 |
| DENV | 2K | FJ547069 | DENV | 2K | FJ639754 | DENV | 2K | FJ744730 |
| DENV | 2K | FJ562107 | DENV | 2K | EU482459 | DENV | 2K | FJ850097 |
| DENV | 2K | FJ461338 | DENV | 2K | FJ205871 | DENV | 2K | FJ744728 |
| DENV | 2K | FJ639722 | DENV | 2K | EU081186 | DENV | 2K | FJ898458 |
| DENV | 2K | FJ639782 | DENV | 2K | FJ547083 | DENV | 2K | FJ744740 |
| DENV | 2K | AY858042 | DENV | 2K | FJ639762 | DENV | 2K | GQ199889 |
| DENV | 2K | EU081185 | DENV | 2K | FJ547071 | DENV | 2K | GQ199886 |
| DENV | 2K | FJ390377 | DENV | 2K | EU529702 | DENV | 2K | FJ687448 |
| DENV | 2K | FJ639763 | DENV | 2K | EU687234 | DENV | 2K | FJ744732 |
| DENV | 2K | FJ639760 | DENV | 2K | FJ182006 | DENV | 2K | FJ898446 |
| DENV | 2K | FJ182009 | DENV | 2K | AY662691 | DENV | 2K | GQ199861 |
| DENV | 2K | EU529697 | DENV | 2K | EU081213 | DENV | 2K | FJ898455 |
| DENV | 2K | DQ675529 | DENV | 2K | EU081181 | DENV | 2K | FJ882573 |
| DENV | 2K | FJ639727 | DENV | 2K | FJ390372 | DENV | 2K | FJ898463 |
| DENV | 2K | FJ461329 | DENV | 2K | EU482613 | DENV | 2K | FJ898447 |
| DENV | 2K | EU482457 | DENV | 2K | FJ639790 | DENV | 2K | FJ882571 |
| DENV | 2K | FJ639827 | DENV | 2K | DQ675519 | DENV | 2K | FJ898462 |
| DENV | 2K | EU687197 | DENV | 2K | EU687233 | DENV | 2K | GQ199870 |
| DENV | 2K | FJ639801 | DENV | 2K | EF629369 | DENV | 2K | FJ898471 |
| DENV | 2K | FJ410176 | DENV | 2K | FJ182004 | DENV | 2K | FJ882575 |
| DENV | 2K | EU081218 | DENV | 2K | FJ639799 | DENV | 2K | FJ744738 |
| DENV | 2K | AY744684 | DENV | 2K | FJ562097 | DENV | 2K | FJ898440 |
| DENV | 2K | FJ390376 | DENV | 2K | FJ639712 | DENV | 2K | FJ898444 |
| DENV | 2K | FJ639781 | DENV | 2K | EF629366 | DENV | 2K | GQ199865 |
| DENV | 2K | DQ675528 | DENV | 2K | EU726772 | DENV | 2K | GQ252678 |
| DENV | 2K | FJ639766 | DENV | 2K | DQ675526 | DENV | 2K | FJ850110 |
| DENV | 2K | EU687221 | DENV | 2K | EU482452 | DENV | 2K | FJ744734 |

FIG. 70-14

| Virus | Protein | Accession No. | Virus | Protein | Accession No. | Virus | Protein | Accession No. |
|---|---|---|---|---|---|---|---|---|
| DENV | 2K | FJ898457 | DENV | 2K | FJ850086 | DENV | 2K | FN429917 |
| DENV | 2K | FJ744736 | DENV | 2K | FJ882572 | DENV | 2K | FN429915 |
| DENV | 2K | FJ810416 | DENV | 2K | FJ882578 | DENV | 2K | GU131855 |
| DENV | 2K | FJ898474 | DENV | 2K | FJ850092 | DENV | 2K | FN429896 |
| DENV | 2K | FJ850094 | DENV | 2K | AB214882 | DENV | 2K | GU131844 |
| DENV | 2K | FJ898470 | DENV | 2K | AB214880 | DENV | 2K | GQ868573 |
| DENV | 2K | FJ810413 | DENV | 2K | AB214881 | DENV | 2K | GQ868586 |
| DENV | 2K | FJ744735 | DENV | 2K | FB667400 | DENV | 2K | GU131858 |
| DENV | 2K | GQ199860 | DENV | 2K | GQ868587 | DENV | 2K | FN429903 |
| DENV | 2K | FJ898464 | DENV | 2K | EU932688 | DENV | 2K | GU131874 |
| DENV | 2K | FJ744729 | DENV | 2K | FN429906 | DENV | 2K | GU131914 |
| DENV | 2K | FJ898472 | DENV | 2K | GU131916 | DENV | 2K | FN429912 |
| DENV | 2K | GQ199862 | DENV | 2K | GU131953 | DENV | 2K | FN429898 |
| DENV | 2K | FJ873812 | DENV | 2K | GU131850 | DENV | 2K | GU131851 |
| DENV | 2K | FJ898441 | DENV | 2K | FN429900 | DENV | 2K | GU131938 |
| DENV | 2K | FJ850048 | DENV | 2K | GQ868576 | DENV | 2K | GU131853 |
| DENV | 2K | FJ850080 | DENV | 2K | GU131946 | DENV | 2K | FN429907 |
| DENV | 2K | FJ882577 | DENV | 2K | GU131866 | DENV | 2K | GU131865 |
| DENV | 2K | FJ850096 | DENV | 2K | GU131862 | DENV | 2K | GU131906 |
| DENV | 2K | FJ898473 | DENV | 2K | GU131852 | DENV | 2K | GU131944 |
| DENV | 2K | FJ882574 | DENV | 2K | FN429897 | DENV | 2K | GU131936 |
| DENV | 2K | FJ898445 | DENV | 2K | GQ868571 | DENV | 2K | GU131903 |
| DENV | 2K | GQ199888 | DENV | 2K | GQ868626 | DENV | 2K | GU131908 |
| DENV | 2K | FJ898443 | DENV | 2K | GQ868546 | DENV | 2K | GU131878 |
| DENV | 2K | FJ744726 | DENV | 2K | FN429904 | DENV | 2K | GU131950 |
| DENV | 2K | FJ898476 | DENV | 2K | GU131904 | DENV | 2K | GQ868634 |
| DENV | 2K | FJ898468 | DENV | 2K | GU131935 | DENV | 2K | GU131873 |
| DENV | 2K | FJ744733 | DENV | 2K | GU131910 | DENV | 2K | GQ868593 |
| DENV | 2K | GQ199871 | DENV | 2K | GU131918 | DENV | 2K | GQ868572 |
| DENV | 2K | GQ199887 | DENV | 2K | GU131937 | DENV | 2K | DQ863638 |
| DENV | 2K | GQ199864 | DENV | 2K | GU131868 | DENV | 2K | GU131876 |
| DENV | 2K | FJ744737 | DENV | 2K | GU131951 | DENV | 2K | EU932687 |
| DENV | 2K | FJ898456 | DENV | 2K | FN429910 | DENV | 2K | GU189648 |
| DENV | 2K | FJ850083 | DENV | 2K | GU131854 | DENV | 2K | FN429913 |
| DENV | 2K | FJ744731 | DENV | 2K | GU131943 | DENV | 2K | GU131867 |
| DENV | 2K | FJ850079 | DENV | 2K | GU131861 | DENV | 2K | GQ868575 |
| DENV | 2K | FJ744700 | DENV | 2K | GU131871 | DENV | 2K | GQ868617 |
| DENV | 2K | FJ882576 | DENV | 2K | GU131933 | DENV | 2K | GQ868616 |
| DENV | 2K | GQ199891 | DENV | 2K | GU131877 | DENV | 2K | GU131870 |
| DENV | 2K | FJ850111 | DENV | 2K | GU131911 | DENV | 2K | GU131869 |
| DENV | 2K | FJ850056 | DENV | 2K | GQ868628 | DENV | 2K | GU131846 |
| DENV | 2K | FJ744727 | DENV | 2K | GQ868574 | DENV | 2K | GU131934 |
| DENV | 2K | FJ873813 | DENV | 2K | GU131941 | DENV | 2K | GQ868627 |
| DENV | 2K | AY770511 | DENV | 2K | GQ868577 | DENV | 2K | FN429908 |
| DENV | 2K | FJ850098 | DENV | 2K | GQ868547 | DENV | 2K | GU131872 |
| DENV | 2K | FJ810414 | DENV | 2K | GU131845 | DENV | 2K | FN429901 |
| DENV | 2K | FJ850109 | DENV | 2K | FN429899 | DENV | 2K | GU131917 |
| DENV | 2K | FJ850052 | DENV | 2K | FN429902 | DENV | 2K | GU131875 |

FIG. 70-15

| Virus | Protein | Accession No. | Virus | Protein | Accession No. | Virus | Protein | Accession No. |
|---|---|---|---|---|---|---|---|---|
| DENV | 2K | FN429909 | DENV | 2K | EU482468 | DENV | 2K | EU482787 |
| DENV | 2K | FN429911 | DENV | 2K | FJ410195 | DENV | 2K | FM210216 |
| DENV | 2K | GU131945 | DENV | 2K | AB122021 | DENV | 2K | EU569694 |
| DENV | 2K | FN429916 | DENV | 2K | EU482469 | DENV | 2K | EU482648 |
| DENV | 2K | FN429914 | DENV | 2K | FM210231 | DENV | 2K | EU482620 |
| DENV | 2K | GU131942 | DENV | 2K | FJ639831 | DENV | 2K | EU482471 |
| DENV | 2K | GU131849 | DENV | 2K | EU482657 | DENV | 2K | EU482644 |
| DENV | 2K | GU131952 | DENV | 2K | EU482674 | DENV | 2K | FJ639833 |
| DENV | 2K | GU131915 | DENV | 2K | EU482753 | DENV | 2K | EU482445 |
| DENV | 2K | GQ868578 | DENV | 2K | DQ645545 | DENV | 2K | EU482606 |
| DENV | 2K | GQ868548 | DENV | 2K | FJ639835 | DENV | 2K | FM210236 |
| DENV | 2K | GU131913 | DENV | 2K | FJ432726 | DENV | 2K | EU482639 |
| DENV | 2K | GU131940 | DENV | 2K | EU482607 | DENV | 2K | EU003591 |
| DENV | 2K | FN429918 | DENV | 2K | EU482660 | DENV | 2K | EU482547 |
| DENV | 2K | FN429905 | DENV | 2K | EU482766 | DENV | 2K | FJ478459 |
| DENV | 2K | GU131907 | DENV | 2K | AB189124 | DENV | 2K | FJ639837 |
| DENV | 2K | GU131860 | DENV | 2K | AF100461 | DENV | 2K | FJ390387 |
| DENV | 2K | GU131954 | DENV | 2K | EU482600 | DENV | 2K | DQ645547 |
| DENV | 2K | GU131856 | DENV | 2K | EU687230 | DENV | 2K | EU596496 |
| DENV | 2K | GU131847 | DENV | 2K | EU482633 | DENV | 2K | EU482597 |
| DENV | 2K | GU131909 | DENV | 2K | EU482726 | DENV | 2K | EU482463 |
| DENV | 2K | GU131939 | DENV | 2K | EU482557 | DENV | 2K | EU482553 |
| DENV | 2K | GU131912 | DENV | 2K | EU482444 | DENV | 2K | EU482548 |
| DENV | 2K | GU131859 | DENV | 2K | FJ205877 | DENV | 2K | EU482641 |
| DENV | 2K | GU131857 | DENV | 2K | EU482621 | DENV | 2K | FJ639703 |
| DENV | 2K | GQ868629 | DENV | 2K | EU482736 | DENV | 2K | EU482647 |
| DENV | 2K | GU131905 | DENV | 2K | EU596497 | DENV | 2K | EU596487 |
| DENV | 2K | GU131848 | DENV | 2K | M84728 | DENV | 2K | FJ639788 |
| DENV | 2K | FB667402 | DENV | 2K | EU482549 | DENV | 2K | FM210206 |
| DENV | 2K | FB667403 | DENV | 2K | FM210228 | DENV | 2K | DQ645556 |
| DENV | 2K | FJ177308 | DENV | 2K | EU687216 | DENV | 2K | AF169682 |
| DENV | 2K | FB667404 | DENV | 2K | EU596489 | DENV | 2K | AY858035 |
| DENV | 2K | FB667398 | DENV | 2K | EU482576 | DENV | 2K | EU687220 |
| DENV | 2K | FB667399 | DENV | 2K | AF100460 | DENV | 2K | EU482636 |
| DENV | 2K | CS805345 | DENV | 2K | AF169679 | DENV | 2K | EU482650 |
| DENV | 2K | EU482634 | DENV | 2K | EU482665 | DENV | 2K | EU482704 |
| DENV | 2K | FJ373301 | DENV | 2K | EU482586 | DENV | 2K | EU482661 |
| DENV | 2K | EU482582 | DENV | 2K | AF169681 | DENV | 2K | EU569699 |
| DENV | 2K | EU687227 | DENV | 2K | FM210205 | DENV | 2K | EU482580 |
| DENV | 2K | EU569710 | DENV | 2K | EU482767 | DENV | 2K | FM210215 |
| DENV | 2K | EF105383 | DENV | 2K | EU687240 | DENV | 2K | FJ639733 |
| DENV | 2K | EU687249 | DENV | 2K | AF169686 | DENV | 2K | EF105389 |
| DENV | 2K | EU687242 | DENV | 2K | EU687244 | DENV | 2K | EF105384 |
| DENV | 2K | EU482658 | DENV | 2K | EU482683 | DENV | 2K | EU677146 |
| DENV | 2K | FJ639710 | DENV | 2K | FJ373299 | DENV | 2K | EU596498 |
| DENV | 2K | EU482748 | DENV | 2K | EU482601 | DENV | 2K | FJ410288 |
| DENV | 2K | FJ205885 | DENV | 2K | EU660404 | DENV | 2K | FJ373300 |
| DENV | 2K | EU482470 | DENV | 2K | EU482651 | DENV | 2K | EU482702 |

FIG. 70-16

| Virus | Protein | Accession No. | Virus | Protein | Accession No. | Virus | Protein | Accession No. |
|---|---|---|---|---|---|---|---|---|
| DENV | 2K | FJ205879 | DENV | 2K | FJ639707 | DENV | 2K | EU482784 |
| DENV | 2K | EU569697 | DENV | 2K | EU482637 | DENV | 2K | EU482584 |
| DENV | 2K | EU482691 | DENV | 2K | EU482699 | DENV | 2K | EU482670 |
| DENV | 2K | FJ461309 | DENV | 2K | EU482583 | DENV | 2K | DQ181801 |
| DENV | 2K | EU482608 | DENV | 2K | FJ639717 | DENV | 2K | EU482603 |
| DENV | 2K | EU726776 | DENV | 2K | EU687223 | DENV | 2K | EU482769 |
| DENV | 2K | EU081177 | DENV | 2K | AY702036 | DENV | 2K | FM210227 |
| DENV | 2K | FM210213 | DENV | 2K | EU482542 | DENV | 2K | AY744147 |
| DENV | 2K | EU854293 | DENV | 2K | EU482587 | DENV | 2K | EU482656 |
| DENV | 2K | EU482632 | DENV | 2K | EU482667 | DENV | 2K | EU529706 |
| DENV | 2K | FM210234 | DENV | 2K | EU482695 | DENV | 2K | EU687212 |
| DENV | 2K | EU482745 | DENV | 2K | EU569720 | DENV | 2K | DQ645541 |
| DENV | 2K | EU482593 | DENV | 2K | AY702037 | DENV | 2K | DQ181800 |
| DENV | 2K | EU569718 | DENV | 2K | AY858036 | DENV | 2K | EU482721 |
| DENV | 2K | EU482719 | DENV | 2K | DQ645544 | DENV | 2K | EU677145 |
| DENV | 2K | EF051521 | DENV | 2K | FJ639822 | DENV | 2K | EU482450 |
| DENV | 2K | FM210238 | DENV | 2K | AF100466 | DENV | 2K | EU482541 |
| DENV | 2K | FJ478455 | DENV | 2K | FJ410215 | DENV | 2K | AF169688 |
| DENV | 2K | AF100465 | DENV | 2K | EU569705 | DENV | 2K | M19197 |
| DENV | 2K | EU529694 | DENV | 2K | FM210241 | DENV | 2K | EU482594 |
| DENV | 2K | EU081178 | DENV | 2K | FM210221 | DENV | 2K | DQ645554 |
| DENV | 2K | EU482676 | DENV | 2K | EU687228 | DENV | 2K | DQ181798 |
| DENV | 2K | FJ639709 | DENV | 2K | EU482703 | DENV | 2K | AY702038 |
| DENV | 2K | FM210208 | DENV | 2K | EU529700 | DENV | 2K | EU596495 |
| DENV | 2K | FJ410208 | DENV | 2K | DQ645555 | DENV | 2K | FM210245 |
| DENV | 2K | EU569716 | DENV | 2K | EU687231 | DENV | 2K | FM210214 |
| DENV | 2K | EU482786 | DENV | 2K | EU660406 | DENV | 2K | EU482685 |
| DENV | 2K | AF276619 | DENV | 2K | EU687241 | DENV | 2K | EU482570 |
| DENV | 2K | EU482625 | DENV | 2K | FJ639700 | DENV | 2K | DQ645540 |
| DENV | 2K | EU687248 | DENV | 2K | FJ639711 | DENV | 2K | EU660414 |
| DENV | 2K | EU482662 | DENV | 2K | U87412 | DENV | 2K | FJ024477 |
| DENV | 2K | EU569708 | DENV | 2K | EU482599 | DENV | 2K | AF100463 |
| DENV | 2K | FM210240 | DENV | 2K | EU482654 | DENV | 2K | DQ645546 |
| DENV | 2K | EU482777 | DENV | 2K | EU569721 | DENV | 2K | EU569703 |
| DENV | 2K | FJ639705 | DENV | 2K | FJ390385 | DENV | 2K | EU482652 |
| DENV | 2K | EU482669 | DENV | 2K | EU482589 | DENV | 2K | EU596490 |
| DENV | 2K | DQ645553 | DENV | 2K | EU482551 | DENV | 2K | EU482693 |
| DENV | 2K | FM210210 | DENV | 2K | EU660400 | DENV | 2K | EU482734 |
| DENV | 2K | EF457904 | DENV | 2K | EU482679 | DENV | 2K | FM210202 |
| DENV | 2K | FJ410237 | DENV | 2K | AF204177 | DENV | 2K | EU482729 |
| DENV | 2K | AY702035 | DENV | 2K | FJ461311 | DENV | 2K | AF169680 |
| DENV | 2K | EU482757 | DENV | 2K | EU569700 | DENV | 2K | EU482623 |
| DENV | 2K | EU596499 | DENV | 2K | EU482737 | DENV | 2K | EU569693 |
| DENV | 2K | EU482543 | DENV | 2K | EU482573 | DENV | 2K | EU482590 |
| DENV | 2K | EU687217 | DENV | 2K | AY702040 | DENV | 2K | FJ639834 |
| DENV | 2K | EU482646 | DENV | 2K | DQ181803 | DENV | 2K | EU482449 |
| DENV | 2K | EU482746 | DENV | 2K | EU482741 | DENV | 2K | EU687237 |
| DENV | 2K | FJ410217 | DENV | 2K | EU660399 | DENV | 2K | EF105381 |

FIG. 70-17

| Virus | Protein | Accession No. | Virus | Protein | Accession No. | Virus | Protein | Accession No. |
|---|---|---|---|---|---|---|---|---|
| DENV | 2K | EU482578 | DENV | 2K | EU677138 | DENV | 2K | EU482742 |
| DENV | 2K | EU482781 | DENV | 2K | EU621672 | DENV | 2K | FJ461314 |
| DENV | 2K | EU596485 | DENV | 2K | AF359579 | DENV | 2K | EU482688 |
| DENV | 2K | EU687224 | DENV | 2K | EU482645 | DENV | 2K | DQ181802 |
| DENV | 2K | FJ461321 | DENV | 2K | EU482760 | DENV | 2K | FJ639809 |
| DENV | 2K | FJ390390 | DENV | 2K | FJ639732 | DENV | 2K | EU482701 |
| DENV | 2K | EU482562 | DENV | 2K | FM210229 | DENV | 2K | AF204178 |
| DENV | 2K | EF105390 | DENV | 2K | EU482684 | DENV | 2K | FJ639706 |
| DENV | 2K | EU482782 | DENV | 2K | EF105378 | DENV | 2K | EU482550 |
| DENV | 2K | EU482682 | DENV | 2K | EU482681 | DENV | 2K | EU482605 |
| DENV | 2K | EU056810 | DENV | 2K | FJ547090 | DENV | 2K | EU482554 |
| DENV | 2K | EU687236 | DENV | 2K | EU482447 | DENV | 2K | EU482692 |
| DENV | 2K | EU482448 | DENV | 2K | EU482624 | DENV | 2K | EU482680 |
| DENV | 2K | FJ639698 | DENV | 2K | AF119661 | DENV | 2K | AF169683 |
| DENV | 2K | EU482630 | DENV | 2K | EU660413 | DENV | 2K | FJ024458 |
| DENV | 2K | EU359009 | DENV | 2K | AF169685 | DENV | 2K | EU482780 |
| DENV | 2K | EU482768 | DENV | 2K | EU482771 | DENV | 2K | EU482750 |
| DENV | 2K | EU482672 | DENV | 2K | EU482604 | DENV | 2K | EU179857 |
| DENV | 2K | EU569711 | DENV | 2K | FJ410223 | DENV | 2K | EU569698 |
| DENV | 2K | EU482627 | DENV | 2K | EU482739 | DENV | 2K | EU482571 |
| DENV | 2K | EU569715 | DENV | 2K | EU687243 | DENV | 2K | EU081179 |
| DENV | 2K | EU482678 | DENV | 2K | EU482720 | DENV | 2K | EU482690 |
| DENV | 2K | DQ181799 | DENV | 2K | EU482730 | DENV | 2K | EU687215 |
| DENV | 2K | EU687235 | DENV | 2K | EU482779 | DENV | 2K | EU482664 |
| DENV | 2K | EU687238 | DENV | 2K | AB122020 | DENV | 2K | DQ181797 |
| DENV | 2K | M84727 | DENV | 2K | FM210244 | DENV | 2K | EU569701 |
| DENV | 2K | EU482763 | DENV | 2K | AF100469 | DENV | 2K | EU482773 |
| DENV | 2K | EU482758 | DENV | 2K | FJ410221 | DENV | 2K | EU482722 |
| DENV | 2K | FJ639830 | DENV | 2K | EU482626 | DENV | 2K | EU482635 |
| DENV | 2K | EU482754 | DENV | 2K | EU482788 | DENV | 2K | DQ645549 |
| DENV | 2K | FM210218 | DENV | 2K | FJ410219 | DENV | 2K | EU482629 |
| DENV | 2K | FJ410224 | DENV | 2K | AF100462 | DENV | 2K | EU596488 |
| DENV | 2K | FJ410193 | DENV | 2K | EU482696 | DENV | 2K | FJ639836 |
| DENV | 2K | EU056811 | DENV | 2K | EU482544 | DENV | 2K | EU482733 |
| DENV | 2K | EU482774 | DENV | 2K | EU482640 | DENV | 2K | EU677143 |
| DENV | 2K | EU482568 | DENV | 2K | FJ182012 | DENV | 2K | EU482653 |
| DENV | 2K | EU482588 | DENV | 2K | DQ645548 | DENV | 2K | AF208496 |
| DENV | 2K | EU482475 | DENV | 2K | FJ639701 | DENV | 2K | EU482565 |
| DENV | 2K | AF489932 | DENV | 2K | EU482655 | DENV | 2K | EU482598 |
| DENV | 2K | FM210211 | DENV | 2K | AB189122 | DENV | 2K | M29095 |
| DENV | 2K | EU687246 | DENV | 2K | DQ181804 | DENV | 2K | EU660415 |
| DENV | 2K | FJ390389 | DENV | 2K | EU482732 | DENV | 2K | FM210239 |
| DENV | 2K | EU482464 | DENV | 2K | DQ645543 | DENV | 2K | EU687213 |
| DENV | 2K | EU482697 | DENV | 2K | FJ639832 | DENV | 2K | EU677144 |
| DENV | 2K | EU482765 | DENV | 2K | FJ226066 | DENV | 2K | FM210243 |
| DENV | 2K | FM210209 | DENV | 2K | AF169687 | DENV | 2K | AF100459 |
| DENV | 2K | EU482474 | DENV | 2K | EU482752 | DENV | 2K | EU482466 |
| DENV | 2K | EU596484 | DENV | 2K | EU482783 | DENV | 2K | FM210230 |

FIG. 70-18

| Virus | Protein | Accession No. | Virus | Protein | Accession No. | Virus | Protein | Accession No. |
|---|---|---|---|---|---|---|---|---|
| DENV | 2K | FJ410200 | DENV | 2K | AY776328 | DENV | 2K | EF105380 |
| DENV | 2K | DQ645552 | DENV | 2K | EU482675 | DENV | 2K | EU482677 |
| DENV | 2K | EU482574 | DENV | 2K | EU660417 | DENV | 2K | AF100468 |
| DENV | 2K | EU482622 | DENV | 2K | EU482727 | DENV | 2K | EU482569 |
| DENV | 2K | EU482561 | DENV | 2K | EU482602 | DENV | 2K | DQ645542 |
| DENV | 2K | EU596486 | DENV | 2K | EU482577 | DENV | 2K | EU482643 |
| DENV | 2K | EU569695 | DENV | 2K | EU482756 | DENV | 2K | EU482694 |
| DENV | 2K | FJ024461 | DENV | 2K | EU529701 | DENV | 2K | EU482724 |
| DENV | 2K | EU569713 | DENV | 2K | FJ639702 | DENV | 2K | EU482446 |
| DENV | 2K | FM210224 | DENV | 2K | EU482772 | DENV | 2K | FM210226 |
| DENV | 2K | EU482556 | DENV | 2K | FM210246 | DENV | 2K | EU482744 |
| DENV | 2K | EU482731 | DENV | 2K | FJ390391 | DENV | 2K | EU677137 |
| DENV | 2K | EU179858 | DENV | 2K | AF100464 | DENV | 2K | EU482770 |
| DENV | 2K | EU781135 | DENV | 2K | FJ547067 | DENV | 2K | AF038403 |
| DENV | 2K | EU482743 | DENV | 2K | EF105386 | DENV | 2K | EU660398 |
| DENV | 2K | EU482751 | DENV | 2K | EF105387 | DENV | 2K | EU569709 |
| DENV | 2K | FJ410259 | DENV | 2K | EU726775 | DENV | 2K | FM210237 |
| DENV | 2K | EU482747 | DENV | 2K | FJ639704 | DENV | 2K | EU660416 |
| DENV | 2K | EU687225 | DENV | 2K | AF169678 | DENV | 2K | EU677142 |
| DENV | 2K | FJ639718 | DENV | 2K | EU482749 | DENV | 2K | EU482700 |
| DENV | 2K | EU569707 | DENV | 2K | EU482631 | DENV | 2K | EU482545 |
| DENV | 2K | EU677147 | DENV | 2K | EF105388 | DENV | 2K | EU482585 |
| DENV | 2K | FM210223 | DENV | 2K | AB189123 | DENV | 2K | FJ024475 |
| DENV | 2K | EU081180 | DENV | 2K | EU482663 | DENV | 2K | EU482725 |
| DENV | 2K | EU482728 | DENV | 2K | EU677149 | DENV | 2K | EU482687 |
| DENV | 2K | EU596500 | DENV | 2K | EU569719 | DENV | 2K | EU529693 |
| DENV | 2K | EU482671 | DENV | 2K | EU482778 | DENV | 2K | FJ390384 |
| DENV | 2K | EU179859 | DENV | 2K | DQ645551 | DENV | 2K | EU482560 |
| DENV | 2K | EU482705 | DENV | 2K | EU482689 | DENV | 2K | EU482761 |
| DENV | 2K | EU482552 | DENV | 2K | EU726770 | DENV | 2K | EU482638 |
| DENV | 2K | EU482546 | DENV | 2K | AB122022 | DENV | 2K | EU482698 |
| DENV | 2K | EU482642 | DENV | 2K | FJ639697 | DENV | 2K | EU482764 |
| DENV | 2K | EU482579 | DENV | 2K | EU482628 | DENV | 2K | FJ182014 |
| DENV | 2K | M20558 | DENV | 2K | EU687232 | DENV | 2K | EU482776 |
| DENV | 2K | EU482775 | DENV | 2K | FM210225 | DENV | 2K | DQ645550 |
| DENV | 2K | EU596491 | DENV | 2K | AY037116 | DENV | 2K | FJ024473 |
| DENV | 2K | FJ639708 | DENV | 2K | FJ205878 | DENV | 2K | DQ181806 |
| DENV | 2K | FM210220 | DENV | 2K | AY702034 | DENV | 2K | FJ461305 |
| DENV | 2K | EU569717 | DENV | 2K | FM210232 | DENV | 2K | FJ024452 |
| DENV | 2K | EF105379 | DENV | 2K | AY702039 | DENV | 2K | EU677141 |
| DENV | 2K | EU569712 | DENV | 2K | EU687245 | DENV | 2K | FJ639828 |
| DENV | 2K | EU482755 | DENV | 2K | EU482465 | DENV | 2K | EU569706 |
| DENV | 2K | DQ181805 | DENV | 2K | EU482472 | DENV | 2K | EU482666 |
| DENV | 2K | FM210207 | DENV | 2K | EU569714 | DENV | 2K | EU482673 |
| DENV | 2K | FM210233 | DENV | 2K | EU569692 | DENV | 2K | FJ024474 |
| DENV | 2K | EU687199 | DENV | 2K | FJ410233 | DENV | 2K | EU687214 |
| DENV | 2K | EU482686 | DENV | 2K | AF100467 | DENV | 2K | FJ410291 |
| DENV | 2K | FJ205880 | DENV | 2K | EU677148 | DENV | 2K | FM210242 |

FIG. 70-19

| Virus | Protein | Accession No. | Virus | Protein | Accession No. | Virus | Protein | Accession No. |
|---|---|---|---|---|---|---|---|---|
| DENV | 2K | EU687250 | DENV | 2K | GQ199874 | DENV | 2K | FJ810409 |
| DENV | 2K | EU482735 | DENV | 2K | FJ744745 | DENV | 2K | FJ687434 |
| DENV | 2K | EU482785 | DENV | 2K | FJ898467 | DENV | 2K | GQ199890 |
| DENV | 2K | EU596483 | DENV | 2K | FJ687444 | DENV | 2K | FJ744743 |
| DENV | 2K | EU569702 | DENV | 2K | FJ810411 | DENV | 2K | FJ850063 |
| DENV | 2K | FJ410241 | DENV | 2K | FJ850067 | DENV | 2K | FJ898466 |
| DENV | 2K | EU482659 | DENV | 2K | FJ850121 | DENV | 2K | FJ850119 |
| DENV | 2K | FM210203 | DENV | 2K | FJ898452 | DENV | 2K | FJ898432 |
| DENV | 2K | EU482581 | DENV | 2K | FJ744713 | DENV | 2K | FJ744718 |
| DENV | 2K | EU569696 | DENV | 2K | FJ810418 | DENV | 2K | FJ810412 |
| DENV | 2K | FJ562098 | DENV | 2K | FJ906962 | DENV | 2K | FJ906956 |
| DENV | 2K | FM210222 | DENV | 2K | FJ744721 | DENV | 2K | FJ850064 |
| DENV | 2K | EU482473 | DENV | 2K | FJ850107 | DENV | 2K | GQ199892 |
| DENV | 2K | EU854294 | DENV | 2K | FJ467493 | DENV | 2K | FJ898436 |
| DENV | 2K | EU482649 | DENV | 2K | FJ906966 | DENV | 2K | FJ906957 |
| DENV | 2K | EU726767 | DENV | 2K | FJ687446 | DENV | 2K | FJ898478 |
| DENV | 2K | FJ024454 | DENV | 2K | FJ906958 | DENV | 2K | FJ873811 |
| DENV | 2K | FJ639699 | DENV | 2K | FJ687435 | DENV | 2K | GQ199898 |
| DENV | 2K | FM210204 | DENV | 2K | FJ850054 | DENV | 2K | FJ850115 |
| DENV | 2K | EU529695 | DENV | 2K | FJ906967 | DENV | 2K | FJ687442 |
| DENV | 2K | EU687222 | DENV | 2K | FJ850072 | DENV | 2K | FJ687439 |
| DENV | 2K | EF105382 | DENV | 2K | FJ898439 | DENV | 2K | FJ432724 |
| DENV | 2K | EU482738 | DENV | 2K | FJ850088 | DENV | 2K | FJ687447 |
| DENV | 2K | EF105385 | DENV | 2K | FJ898435 | DENV | 2K | FJ873808 |
| DENV | 2K | FM210219 | DENV | 2K | GQ252676 | DENV | 2K | DQ448231 |
| DENV | 2K | EU482723 | DENV | 2K | FJ850065 | DENV | 2K | FJ744710 |
| DENV | 2K | FJ639829 | DENV | 2K | FJ898477 | DENV | 2K | GQ252677 |
| DENV | 2K | EU482575 | DENV | 2K | FJ850116 | DENV | 2K | NC_001474 |
| DENV | 2K | AF038402 | DENV | 2K | FJ898454 | DENV | 2K | FJ687445 |
| DENV | 2K | FJ639783 | DENV | 2K | GQ199897 | DENV | 2K | FJ850091 |
| DENV | 2K | EU482572 | DENV | 2K | GQ199899 | DENV | 2K | FJ687443 |
| DENV | 2K | FJ639734 | DENV | 2K | FJ744723 | DENV | 2K | GQ199869 |
| DENV | 2K | EU482762 | DENV | 2K | GQ199900 | DENV | 2K | FJ850105 |
| DENV | 2K | EU569704 | DENV | 2K | FJ850082 | DENV | 2K | FJ850051 |
| DENV | 2K | EU482759 | DENV | 2K | FJ744715 | DENV | 2K | FJ850050 |
| DENV | 2K | EU056812 | DENV | 2K | FJ744709 | DENV | 2K | FJ744719 |
| DENV | 2K | FJ410228 | DENV | 2K | GQ199868 | DENV | 2K | FJ898453 |
| DENV | 2K | EU482467 | DENV | 2K | FJ906960 | DENV | 2K | FJ898460 |
| DENV | 2K | FM210217 | DENV | 2K | FJ882602 | DENV | 2K | FJ898438 |
| DENV | 2K | FM210212 | DENV | 2K | GQ199895 | DENV | 2K | FJ850053 |
| DENV | 2K | EU660405 | DENV | 2K | FJ687436 | DENV | 2K | FJ898450 |
| DENV | 2K | FJ547064 | DENV | 2K | FJ744725 | DENV | 2K | FJ744708 |
| DENV | 2K | EU482740 | DENV | 2K | FJ850117 | DENV | 2K | GQ199896 |
| DENV | 2K | EU482451 | DENV | 2K | FJ687441 | DENV | 2K | FJ744722 |
| DENV | 2K | EU482668 | DENV | 2K | FJ744706 | DENV | 2K | FJ850062 |
| DENV | 2K | EU687229 | DENV | 2K | FJ850074 | DENV | 2K | FJ898461 |
| DENV | 2K | AF169684 | DENV | 2K | FJ850085 | DENV | 2K | FJ810410 |
| DENV | 2K | FM210235 | DENV | 2K | FJ850061 | DENV | 2K | FJ850060 |

FIG. 70-20

| Virus | Protein | Accession No. | Virus | Protein | Accession No. | Virus | Protein | Accession No. |
|---|---|---|---|---|---|---|---|---|
| DENV | 2K | FJ906961 | DENV | 2K | AF022438 | DENV | 2K | GQ868558 |
| DENV | 2K | FJ882593 | DENV | 2K | AF022440 | DENV | 2K | GQ868625 |
| DENV | 2K | FJ898479 | DENV | 2K | CS479165 | DENV | 2K | GQ868624 |
| DENV | 2K | FJ744703 | DENV | 2K | GQ868556 | DENV | 2K | GQ868631 |
| DENV | 2K | FJ744712 | DENV | 2K | AB479041 | DENV | 2K | GU131899 |
| DENV | 2K | FJ882594 | DENV | 2K | GU289914 | DENV | 2K | GQ868515 |
| DENV | 2K | FJ744716 | DENV | 2K | GU131884 | DENV | 2K | GU131898 |
| DENV | 2K | FJ850066 | DENV | 2K | GQ868600 | DENV | 2K | GQ868623 |
| DENV | 2K | FJ744744 | DENV | 2K | FN429895 | DENV | 2K | GU131886 |
| DENV | 2K | FJ850108 | DENV | 2K | GU131879 | DENV | 2K | GQ868622 |
| DENV | 2K | FJ859028 | DENV | 2K | GQ868596 | DENV | 2K | GQ868595 |
| DENV | 2K | FJ898465 | DENV | 2K | GQ868516 | DENV | 2K | GQ868557 |
| DENV | 2K | FJ898451 | DENV | 2K | GU131864 | DENV | 2K | GU131959 |
| DENV | 2K | FJ898449 | DENV | 2K | FN429893 | DENV | 2K | GU131955 |
| DENV | 2K | FJ744705 | DENV | 2K | GQ868598 | DENV | 2K | GQ868597 |
| DENV | 2K | FJ898434 | DENV | 2K | GQ868544 | DENV | 2K | GU131883 |
| DENV | 2K | FJ906969 | DENV | 2K | GQ868589 | DENV | 2K | GQ868591 |
| DENV | 2K | FJ744741 | DENV | 2K | GQ868551 | DENV | 2K | GQ868543 |
| DENV | 2K | FJ906959 | DENV | 2K | GU131902 | DENV | 2K | GU131901 |
| DENV | 2K | FJ850106 | DENV | 2K | GU131896 | DENV | 2K | GQ868545 |
| DENV | 2K | FJ744742 | DENV | 2K | GU131924 | DENV | 2K | GU131931 |
| DENV | 2K | FJ687437 | DENV | 2K | GQ868640 | DENV | 2K | GU131885 |
| DENV | 2K | FJ744707 | DENV | 2K | GU131880 | DENV | 2K | GU131932 |
| DENV | 2K | FJ687438 | DENV | 2K | GU131882 | DENV | 2K | GU131881 |
| DENV | 2K | FJ744714 | DENV | 2K | GQ868638 | DENV | 2K | GU131897 |
| DENV | 2K | GQ199866 | DENV | 2K | GQ868553 | DENV | 2K | GQ868592 |
| DENV | 2K | GQ199894 | DENV | 2K | GQ868646 | DENV | 2K | GQ868552 |
| DENV | 2K | FJ687440 | DENV | 2K | FN429891 | DENV | 2K | GU131900 |
| DENV | 2K | FJ850112 | DENV | 2K | GQ868604 | DENV | 2K | GQ868599 |
| DENV | 2K | FJ850078 | DENV | 2K | GU131947 | DENV | 2K | GU131929 |
| DENV | 2K | FJ744717 | DENV | 2K | GU131928 | DENV | 2K | GU131930 |
| DENV | 2K | FJ906968 | DENV | 2K | GQ868497 | DENV | 2K | GQ868550 |
| DENV | 2K | GQ199893 | DENV | 2K | GQ868603 | DENV | 2K | GU131975 |
| DENV | 2K | FJ744711 | DENV | 2K | GQ868621 | DENV | 2K | GU131927 |
| DENV | 2K | FJ744704 | DENV | 2K | AB479042 | DENV | 2K | GQ868540 |
| DENV | 2K | FJ744720 | DENV | 2K | GQ868620 | DENV | 2K | FJ410202 |
| DENV | 2K | GQ199901 | DENV | 2K | GQ868590 | DENV | 2K | CS479202 |
| DENV | 2K | FJ744724 | DENV | 2K | FN429892 | DENV | 2K | U87411 |
| DENV | 2K | FJ850120 | DENV | 2K | GQ868554 | DENV | 2K | CS479203 |
| DENV | 2K | FJ850118 | DENV | 2K | GU131974 | DENV | 2K | CS479204 |
| DENV | 2K | FJ850076 | DENV | 2K | GU131843 | DENV | 2K | CS479167 |
| DENV | 2K | AF022436 | DENV | 2K | GQ868641 | DENV | 2K | CS479205 |
| DENV | 2K | AF022439 | DENV | 2K | GQ868542 | DENV | 2K | CS479206 |
| DENV | 2K | AF022441 | DENV | 2K | GQ868555 | DENV | 2K | CS805344 |
| DENV | 2K | AF022437 | DENV | 2K | FN429894 | DENV | 2K | FB730117 |
| DENV | 2K | AJ487271 | DENV | 2K | GQ868549 | DENV | 2K | DL138662 |
| DENV | 2K | AF022435 | DENV | 2K | GQ868588 | DENV | 2K | GM059692 |
| DENV | 2K | AF022434 | DENV | 2K | GQ868541 | DENV | 2K | AY243468 |

FIG. 70-21

| Virus | Protein | Accession No. | Virus | Protein | Accession No. | Virus | Protein | Accession No. |
|---|---|---|---|---|---|---|---|---|
| DENV | 2K | AY243469 | DENV | anC | FJ176780 | DENV | anC | FJ639694 |
| DENV | 2K | AY744148 | DENV | anC | FJ461340 | DENV | anC | EU482500 |
| DENV | 2K | AY744149 | DENV | anC | AY732475 | DENV | anC | DQ672560 |
| DENV | 2K | AY744150 | DENV | anC | AY732474 | DENV | anC | AY713473 |
| DENV | 2K | AJ968413 | DENV | anC | FJ024435 | DENV | anC | EU726780 |
| DENV | 2K | GU369819 | DENV | anC | FJ639669 | DENV | anC | FJ410255 |
| DENV | 2K | GU370050 | DENV | anC | EU482540 | DENV | anC | FJ373298 |
| DENV | 2K | GU370051 | DENV | anC | FJ024429 | DENV | anC | EU081276 |
| DENV | anC | AY277665 | DENV | anC | EU677167 | DENV | anC | FJ410198 |
| DENV | anC | AY713474 | DENV | anC | EU482512 | DENV | anC | EU482536 |
| DENV | anC | AF311957 | DENV | anC | FJ390381 | DENV | anC | FJ390382 |
| DENV | anC | FJ205881 | DENV | anC | FJ410226 | DENV | anC | FJ024462 |
| DENV | anC | EU482817 | DENV | anC | FJ410191 | DENV | anC | EU482822 |
| DENV | anC | DQ672557 | DENV | anC | AJ968413 | DENV | anC | FJ024447 |
| DENV | anC | EU677151 | DENV | anC | FJ639689 | DENV | anC | FJ410274 |
| DENV | anC | FJ410256 | DENV | anC | AY277664 | DENV | anC | FJ410216 |
| DENV | anC | FJ432735 | DENV | anC | FJ639811 | DENV | anC | EU482527 |
| DENV | anC | EU660390 | DENV | anC | FJ639695 | DENV | anC | EU280167 |
| DENV | anC | EU482824 | DENV | anC | EU081226 | DENV | anC | EU482567 |
| DENV | anC | FJ410222 | DENV | anC | FJ410280 | DENV | anC | EU081265 |
| DENV | anC | AY726551 | DENV | anC | EU596504 | DENV | anC | EU482489 |
| DENV | anC | EU482716 | DENV | anC | FJ639685 | DENV | anC | AB178040 |
| DENV | anC | AF226685 | DENV | anC | EU482715 | DENV | anC | EU482827 |
| DENV | anC | EU677174 | DENV | anC | FJ410227 | DENV | anC | FJ024455 |
| DENV | anC | FJ639693 | DENV | anC | DQ285560 | DENV | anC | EU081238 |
| DENV | anC | FJ461317 | DENV | anC | FJ182002 | DENV | anC | FJ410245 |
| DENV | anC | FJ384655 | DENV | anC | EU677177 | DENV | anC | FJ461318 |
| DENV | anC | EU482508 | DENV | anC | FJ639680 | DENV | anC | FJ410263 |
| DENV | anC | AF311958 | DENV | anC | EU677160 | DENV | anC | FJ410269 |
| DENV | anC | FJ024451 | DENV | anC | AY835999 | DENV | anC | FJ410289 |
| DENV | anC | EU482528 | DENV | anC | EU249494 | DENV | anC | FJ639692 |
| DENV | anC | EU482821 | DENV | anC | AF226687 | DENV | anC | EU660397 |
| DENV | anC | FJ410267 | DENV | anC | FJ024432 | DENV | anC | EU482477 |
| DENV | anC | AB074761 | DENV | anC | EU081229 | DENV | anC | FJ024434 |
| DENV | anC | AY762084 | DENV | anC | FJ410184 | DENV | anC | FJ410204 |
| DENV | anC | AY732480 | DENV | anC | FJ182022 | DENV | anC | EU249495 |
| DENV | anC | EU482481 | DENV | anC | EU677153 | DENV | anC | AF513110 |
| DENV | anC | FJ410232 | DENV | anC | DQ672559 | DENV | anC | FJ024438 |
| DENV | anC | EU081254 | DENV | anC | EU081234 | DENV | anC | EU081264 |
| DENV | anC | EU482806 | DENV | anC | FJ639802 | DENV | anC | EU482525 |
| DENV | anC | FJ410257 | DENV | anC | EU482483 | DENV | anC | EU687251 |
| DENV | anC | FJ432720 | DENV | anC | FJ024445 | DENV | anC | EU482486 |
| DENV | anC | FJ547089 | DENV | anC | FJ410236 | DENV | anC | DQ285558 |
| DENV | anC | EU482819 | DENV | anC | FJ410242 | DENV | anC | FJ205883 |
| DENV | anC | EU081270 | DENV | anC | FJ390378 | DENV | anC | AY145121 |
| DENV | anC | FJ205875 | DENV | anC | EU081236 | DENV | anC | AY732478 |
| DENV | anC | FJ410210 | DENV | anC | EU081278 | DENV | anC | FJ410199 |
| DENV | anC | FJ205884 | DENV | anC | FJ432736 | DENV | anC | FJ390383 |

FIG. 70-22

| Virus | Protein | Accession No. | Virus | Protein | Accession No. | Virus | Protein | Accession No. |
|---|---|---|---|---|---|---|---|---|
| DENV | anC | EU482592 | DENV | anC | EU482532 | DENV | anC | FJ410262 |
| DENV | anC | FJ182030 | DENV | anC | FJ182031 | DENV | anC | FJ024480 |
| DENV | anC | FJ024431 | DENV | anC | FJ024428 | DENV | anC | EU482495 |
| DENV | anC | FJ024450 | DENV | anC | FJ432749 | DENV | anC | FJ182032 |
| DENV | anC | FJ410252 | DENV | anC | DQ285561 | DENV | anC | FJ410197 |
| DENV | anC | FJ478457 | DENV | anC | EU482518 | DENV | anC | AF514883 |
| DENV | anC | EU596502 | DENV | anC | EU726779 | DENV | anC | FJ461330 |
| DENV | anC | FJ410201 | DENV | anC | EU677161 | DENV | anC | FJ639690 |
| DENV | anC | FJ562105 | DENV | anC | AY145123 | DENV | anC | FJ410209 |
| DENV | anC | FJ639684 | DENV | anC | EU482800 | DENV | anC | EU482514 |
| DENV | anC | FJ639682 | DENV | anC | AY732482 | DENV | anC | EU848545 |
| DENV | anC | FJ410240 | DENV | anC | EU482517 | DENV | anC | EU249492 |
| DENV | anC | EU081279 | DENV | anC | EU482488 | DENV | anC | EU081240 |
| DENV | anC | EU081231 | DENV | anC | FJ373305 | DENV | anC | EU482499 |
| DENV | anC | FJ410214 | DENV | anC | FJ432746 | DENV | anC | FJ410281 |
| DENV | anC | FJ182036 | DENV | anC | FJ432734 | DENV | anC | FJ410270 |
| DENV | anC | FJ182023 | DENV | anC | EU482797 | DENV | anC | EU482808 |
| DENV | anC | EU482479 | DENV | anC | EU482711 | DENV | anC | EU081281 |
| DENV | anC | FJ547087 | DENV | anC | FJ024459 | DENV | anC | AF309641 |
| DENV | anC | FJ639683 | DENV | anC | FJ410174 | DENV | anC | EU677159 |
| DENV | anC | FJ024442 | DENV | anC | EU596503 | DENV | anC | EU482526 |
| DENV | anC | FJ410285 | DENV | anC | FJ432730 | DENV | anC | FJ024427 |
| DENV | anC | EU482615 | DENV | anC | EU081227 | DENV | anC | EU482618 |
| DENV | anC | AY732476 | DENV | anC | EU677163 | DENV | anC | AF350498 |
| DENV | anC | FJ024463 | DENV | anC | AY277666 | DENV | anC | EU677169 |
| DENV | anC | FJ410275 | DENV | anC | FJ024483 | DENV | anC | EU482828 |
| DENV | anC | FJ410234 | DENV | anC | DQ193572 | DENV | anC | EU482537 |
| DENV | anC | EU482487 | DENV | anC | EF122231 | DENV | anC | EU726782 |
| DENV | anC | FJ410182 | DENV | anC | EU081266 | DENV | anC | FJ410225 |
| DENV | anC | EU482812 | DENV | anC | EU482818 | DENV | anC | FJ410180 |
| DENV | anC | EU081247 | DENV | anC | FJ410186 | DENV | anC | FJ024460 |
| DENV | anC | AB074760 | DENV | anC | EU249493 | DENV | anC | FJ410231 |
| DENV | anC | EU482802 | DENV | anC | FJ024478 | DENV | anC | FJ390380 |
| DENV | anC | EU677172 | DENV | anC | FJ205874 | DENV | anC | FJ410238 |
| DENV | anC | EU482496 | DENV | anC | EU482791 | DENV | anC | FJ390379 |
| DENV | anC | EU726777 | DENV | anC | EU482798 | DENV | anC | AF311956 |
| DENV | anC | U88535 | DENV | anC | EU081248 | DENV | anC | EU081257 |
| DENV | anC | EU482519 | DENV | anC | EU596501 | DENV | anC | FJ432721 |
| DENV | anC | FJ461339 | DENV | anC | FJ461336 | DENV | anC | FJ639672 |
| DENV | anC | FJ562101 | DENV | anC | FJ024457 | DENV | anC | FJ639794 |
| DENV | anC | FJ461316 | DENV | anC | EU482485 | DENV | anC | EU660403 |
| DENV | anC | EU482814 | DENV | anC | FJ176779 | DENV | anC | EU482619 |
| DENV | anC | AY726555 | DENV | anC | EU482799 | DENV | anC | EU677155 |
| DENV | anC | FJ639677 | DENV | anC | EU081233 | DENV | anC | FJ182021 |
| DENV | anC | EU482506 | DENV | anC | EU482497 | DENV | anC | EU482712 |
| DENV | anC | FJ410283 | DENV | anC | EU482616 | DENV | anC | EU482591 |
| DENV | anC | FJ639696 | DENV | anC | EU482507 | DENV | anC | FJ410253 |
| DENV | anC | FJ410235 | DENV | anC | EU482809 | DENV | anC | EF032590 |

FIG. 70-23

| Virus | Protein | Accession No. | Virus | Protein | Accession No. | Virus | Protein | Accession No. |
|---|---|---|---|---|---|---|---|---|
| DENV | anC | EU081243 | DENV | anC | EU081273 | DENV | anC | EU482811 |
| DENV | anC | FJ639818 | DENV | anC | EU482820 | DENV | anC | AF226686 |
| DENV | anC | EU081237 | DENV | anC | AF514878 | DENV | anC | EU081235 |
| DENV | anC | AF514876 | DENV | anC | EU660394 | DENV | anC | EU660419 |
| DENV | anC | FJ639688 | DENV | anC | FJ410218 | DENV | anC | FJ547068 |
| DENV | anC | EU482713 | DENV | anC | EU081241 | DENV | anC | AB189121 |
| DENV | anC | EU677154 | DENV | anC | FJ410244 | DENV | anC | FJ461308 |
| DENV | anC | EU081242 | DENV | anC | EU482789 | DENV | anC | FJ410213 |
| DENV | anC | EU687247 | DENV | anC | EU482524 | DENV | anC | AY726550 |
| DENV | anC | AY726552 | DENV | anC | EU081261 | DENV | anC | AY732477 |
| DENV | anC | FJ024436 | DENV | anC | FJ639812 | DENV | anC | EU660401 |
| DENV | anC | FJ639681 | DENV | anC | EU482533 | DENV | anC | FJ639815 |
| DENV | anC | EU482484 | DENV | anC | DQ285559 | DENV | anC | FJ410268 |
| DENV | anC | EU482815 | DENV | anC | FJ410246 | DENV | anC | FJ478458 |
| DENV | anC | EU249490 | DENV | anC | FJ461310 | DENV | anC | FJ639808 |
| DENV | anC | EU081253 | DENV | anC | AB195673 | DENV | anC | EU482611 |
| DENV | anC | AY726549 | DENV | anC | FJ182024 | DENV | anC | FJ410261 |
| DENV | anC | EU677166 | DENV | anC | AB204803 | DENV | anC | FJ432729 |
| DENV | anC | FJ639821 | DENV | anC | EF025110 | DENV | anC | FJ639813 |
| DENV | anC | FJ024430 | DENV | anC | DQ672564 | DENV | anC | EU482520 |
| DENV | anC | FJ410183 | DENV | anC | EU726778 | DENV | anC | AF514885 |
| DENV | anC | EU081267 | DENV | anC | EF457905 | DENV | anC | FJ639673 |
| DENV | anC | EU482491 | DENV | anC | FJ547088 | DENV | anC | FJ410266 |
| DENV | anC | EU081249 | DENV | anC | FJ024437 | DENV | anC | EU482805 |
| DENV | anC | EU081252 | DENV | anC | EU482513 | DENV | anC | FJ432740 |
| DENV | anC | EU482706 | DENV | anC | FJ410196 | DENV | anC | AY726554 |
| DENV | anC | AY726553 | DENV | anC | FJ410250 | DENV | anC | FJ024441 |
| DENV | anC | FJ205882 | DENV | anC | EU660392 | DENV | anC | DQ672556 |
| DENV | anC | FJ390386 | DENV | anC | FJ461313 | DENV | anC | FJ410272 |
| DENV | anC | EU677139 | DENV | anC | EU677168 | DENV | anC | FJ639676 |
| DENV | anC | FJ410260 | DENV | anC | FJ432723 | DENV | anC | FJ639686 |
| DENV | anC | EU677170 | DENV | anC | FJ410181 | DENV | anC | EU482498 |
| DENV | anC | EU081256 | DENV | anC | FJ410239 | DENV | anC | FJ432725 |
| DENV | anC | FJ024443 | DENV | anC | EU482480 | DENV | anC | EU482529 |
| DENV | anC | FJ410278 | DENV | anC | AY206457 | DENV | anC | FJ547086 |
| DENV | anC | FJ432744 | DENV | anC | EU482523 | DENV | anC | FJ461323 |
| DENV | anC | AB189120 | DENV | anC | FJ410290 | DENV | anC | FJ410230 |
| DENV | anC | FJ461327 | DENV | anC | DQ672562 | DENV | anC | FJ410248 |
| DENV | anC | EU660391 | DENV | anC | EU482521 | DENV | anC | EU482609 |
| DENV | anC | FJ562106 | DENV | anC | EU660402 | DENV | anC | FJ639824 |
| DENV | anC | FJ182035 | DENV | anC | FJ461307 | DENV | anC | FJ410279 |
| DENV | anC | FJ461306 | DENV | anC | EU081272 | DENV | anC | EU482535 |
| DENV | anC | EU482510 | DENV | anC | FJ461315 | DENV | anC | FJ024453 |
| DENV | anC | FJ024440 | DENV | anC | FJ410188 | DENV | anC | FJ432748 |
| DENV | anC | EU081258 | DENV | anC | AY713475 | DENV | anC | EU660393 |
| DENV | anC | EU081268 | DENV | anC | AY732479 | DENV | anC | AY145122 |
| DENV | anC | EU677178 | DENV | anC | EU677156 | DENV | anC | FJ024446 |
| DENV | anC | FJ410276 | DENV | anC | EU482707 | DENV | anC | FJ432747 |

FIG. 70-24

| Virus | Protein | Accession No. | Virus | Protein | Accession No. | Virus | Protein | Accession No. |
|---|---|---|---|---|---|---|---|---|
| DENV | anC | FJ410205 | DENV | anC | FJ639674 | DENV | anC | EU482476 |
| DENV | anC | FJ205876 | DENV | anC | FJ547065 | DENV | anC | EU482505 |
| DENV | anC | FJ410211 | DENV | anC | FJ410212 | DENV | anC | EU081255 |
| DENV | anC | FJ182025 | DENV | anC | FJ461341 | DENV | anC | FJ639743 |
| DENV | anC | FJ182026 | DENV | anC | EU081259 | DENV | anC | U88537 |
| DENV | anC | FJ373296 | DENV | anC | FJ639823 | DENV | anC | FJ432733 |
| DENV | anC | AY722802 | DENV | anC | FJ410190 | DENV | anC | EU660395 |
| DENV | anC | EU482522 | DENV | anC | FJ432745 | DENV | anC | EU081263 |
| DENV | anC | FJ390388 | DENV | anC | FJ410175 | DENV | anC | EU482826 |
| DENV | anC | EU677173 | DENV | anC | EU677176 | DENV | anC | FJ410192 |
| DENV | anC | EU081277 | DENV | anC | FJ639679 | DENV | anC | FJ182020 |
| DENV | anC | EU482492 | DENV | anC | FJ432742 | DENV | anC | DQ672561 |
| DENV | anC | FJ432732 | DENV | anC | FJ639670 | DENV | anC | FJ024481 |
| DENV | anC | FJ639691 | DENV | anC | FJ182027 | DENV | anC | EU677165 |
| DENV | anC | EU482511 | DENV | anC | EU482718 | DENV | anC | FJ410287 |
| DENV | anC | EU081230 | DENV | anC | EU677158 | DENV | anC | EU482502 |
| DENV | anC | FJ410206 | DENV | anC | FJ639687 | DENV | anC | EU081274 |
| DENV | anC | FJ410189 | DENV | anC | FJ461325 | DENV | anC | FJ024448 |
| DENV | anC | FJ182019 | DENV | anC | FJ024444 | DENV | anC | FJ024425 |
| DENV | anC | FJ024472 | DENV | anC | EU482617 | DENV | anC | FJ639741 |
| DENV | anC | FJ205872 | DENV | anC | FJ639678 | DENV | anC | FJ562104 |
| DENV | anC | FJ410282 | DENV | anC | EU081269 | DENV | anC | DQ672563 |
| DENV | anC | EU482538 | DENV | anC | EU482714 | DENV | anC | EU482708 |
| DENV | anC | EU660418 | DENV | anC | FJ024456 | DENV | anC | FJ410247 |
| DENV | anC | FJ639819 | DENV | anC | FJ182028 | DENV | anC | AF180817 |
| DENV | anC | FJ639806 | DENV | anC | EU677152 | DENV | anC | AY722801 |
| DENV | anC | FJ432738 | DENV | anC | EU081228 | DENV | anC | EU482504 |
| DENV | anC | FJ432719 | DENV | anC | FJ410173 | DENV | anC | FJ639675 |
| DENV | anC | FJ461303 | DENV | anC | EU482796 | DENV | anC | FJ024433 |
| DENV | anC | FJ410203 | DENV | anC | EU726781 | DENV | anC | FJ461331 |
| DENV | anC | FJ410194 | DENV | anC | FJ410207 | DENV | anC | FJ410187 |
| DENV | anC | EU081244 | DENV | anC | FJ410243 | DENV | anC | FJ410258 |
| DENV | anC | EU482482 | DENV | anC | EU081239 | DENV | anC | AY708047 |
| DENV | anC | FJ410179 | DENV | anC | EU482816 | DENV | anC | FJ024423 |
| DENV | anC | AY722803 | DENV | anC | EU081260 | DENV | anC | FJ024484 |
| DENV | anC | EU482539 | DENV | anC | FJ182029 | DENV | anC | EU081251 |
| DENV | anC | FJ639671 | DENV | anC | FJ024449 | DENV | anC | FJ410249 |
| DENV | anC | EU482478 | DENV | anC | EU081250 | DENV | anC | EU482610 |
| DENV | anC | FJ547060 | DENV | anC | EU482825 | DENV | anC | FJ182033 |
| DENV | anC | FJ432739 | DENV | anC | EU482530 | DENV | anC | EU482493 |
| DENV | anC | FJ639740 | DENV | anC | FJ639820 | DENV | anC | EU482807 |
| DENV | anC | FJ182034 | DENV | anC | EU677175 | DENV | anC | FJ639814 |
| DENV | anC | EU482710 | DENV | anC | FJ410251 | DENV | anC | EU482501 |
| DENV | anC | EU081232 | DENV | anC | EU482794 | DENV | anC | FJ410254 |
| DENV | anC | EU482515 | DENV | anC | EU359008 | DENV | anC | EU081246 |
| DENV | anC | EU482531 | DENV | anC | AF180818 | DENV | anC | EU081275 |
| DENV | anC | AF298807 | DENV | anC | EU660396 | DENV | anC | FJ410264 |
| DENV | anC | FJ205873 | DENV | anC | FJ182003 | DENV | anC | FJ024479 |

FIG. 70-25

| Virus | Protein | Accession No. | Virus | Protein | Accession No. | Virus | Protein | Accession No. |
|---|---|---|---|---|---|---|---|---|
| DENV | anC | FJ410185 | DENV | anC | EU482795 | DENV | anC | FJ898410 |
| DENV | anC | FJ410273 | DENV | anC | EU677164 | DENV | anC | FJ882528 |
| DENV | anC | EU482801 | DENV | anC | FJ410277 | DENV | anC | FJ898382 |
| DENV | anC | AY713476 | DENV | anC | FJ024464 | DENV | anC | FJ898404 |
| DENV | anC | FJ461312 | DENV | anC | FJ461332 | DENV | anC | FJ687426 |
| DENV | anC | FJ639797 | DENV | anC | EF122232 | DENV | anC | FJ898371 |
| DENV | anC | FJ461319 | DENV | anC | FJ432727 | DENV | anC | GQ199872 |
| DENV | anC | FJ461333 | DENV | anC | EU482823 | DENV | anC | GQ199855 |
| DENV | anC | EU482516 | DENV | anC | EU482810 | DENV | anC | FJ882535 |
| DENV | anC | EU482792 | DENV | anC | EU081245 | DENV | anC | NC_001477 |
| DENV | anC | AF514889 | DENV | anC | EU081262 | DENV | anC | FJ898423 |
| DENV | anC | EU482509 | DENV | anC | EU863650 | DENV | anC | FJ882565 |
| DENV | anC | FJ432737 | DENV | anC | AY732483 | DENV | anC | FJ882517 |
| DENV | anC | FJ547063 | DENV | anC | FJ410265 | DENV | anC | GQ199814 |
| DENV | anC | FJ373297 | DENV | anC | EU660412 | DENV | anC | FJ898395 |
| DENV | anC | EU677157 | DENV | anC | EU677171 | DENV | anC | GQ199851 |
| DENV | anC | EU482534 | DENV | anC | EU677140 | DENV | anC | GQ199837 |
| DENV | anC | EU249491 | DENV | anC | FJ898428 | DENV | anC | FJ882558 |
| DENV | anC | DQ285562 | DENV | anC | FJ882569 | DENV | anC | FJ850084 |
| DENV | anC | EU482793 | DENV | anC | GQ199776 | DENV | anC | FJ898374 |
| DENV | anC | EU482717 | DENV | anC | GQ199853 | DENV | anC | FJ850104 |
| DENV | anC | FJ024439 | DENV | anC | GQ199803 | DENV | anC | GQ199815 |
| DENV | anC | EU482804 | DENV | anC | FJ882554 | DENV | anC | GQ199843 |
| DENV | anC | EU482503 | DENV | anC | FJ873809 | DENV | anC | GQ199826 |
| DENV | anC | EU677162 | DENV | anC | FJ882563 | DENV | anC | FJ882550 |
| DENV | anC | FJ024485 | DENV | anC | GQ199812 | DENV | anC | FJ744701 |
| DENV | anC | EU081271 | DENV | anC | FJ873810 | DENV | anC | FJ898391 |
| DENV | anC | FJ024426 | DENV | anC | FJ898397 | DENV | anC | FJ898417 |
| DENV | anC | EU482790 | DENV | anC | FJ898400 | DENV | anC | GQ199806 |
| DENV | anC | FJ410286 | DENV | anC | FJ687433 | DENV | anC | GQ199794 |
| DENV | anC | FJ639735 | DENV | anC | GQ199877 | DENV | anC | FJ898425 |
| DENV | anC | EU482494 | DENV | anC | GQ199788 | DENV | anC | FJ898393 |
| DENV | anC | FJ390374 | DENV | anC | GQ199823 | DENV | anC | GQ199799 |
| DENV | anC | EU482813 | DENV | anC | FJ898407 | DENV | anC | GQ199833 |
| DENV | anC | FJ461335 | DENV | anC | GQ199804 | DENV | anC | GQ199781 |
| DENV | anC | EU482803 | DENV | anC | FJ882533 | DENV | anC | GQ199797 |
| DENV | anC | EU482490 | DENV | anC | GQ199818 | DENV | anC | FJ882522 |
| DENV | anC | FJ024482 | DENV | anC | FJ882560 | DENV | anC | FJ906964 |
| DENV | anC | FJ410284 | DENV | anC | FJ898415 | DENV | anC | GQ199821 |
| DENV | anC | EU081280 | DENV | anC | FJ850113 | DENV | anC | GQ199847 |
| DENV | anC | EU677150 | DENV | anC | FJ898384 | DENV | anC | FJ882524 |
| DENV | anC | AY732481 | DENV | anC | FJ882538 | DENV | anC | FJ850077 |
| DENV | anC | FJ461324 | DENV | anC | FJ882521 | DENV | anC | FJ882552 |
| DENV | anC | FJ639796 | DENV | anC | GQ199811 | DENV | anC | GQ199778 |
| DENV | anC | EU482709 | DENV | anC | FJ850075 | DENV | anC | FJ882549 |
| DENV | anC | AF298808 | DENV | anC | GQ199848 | DENV | anC | GQ199816 |
| DENV | anC | FJ182018 | DENV | anC | FJ898378 | DENV | anC | GQ199824 |
| DENV | anC | DQ672558 | DENV | anC | FJ873814 | DENV | anC | FJ898398 |

FIG. 70-26

| Virus | Protein | Accession No. | Virus | Protein | Accession No. | Virus | Protein | Accession No. |
|---|---|---|---|---|---|---|---|---|
| DENV | anC | FJ859029 | DENV | anC | FJ882518 | DENV | anC | FJ882531 |
| DENV | anC | FJ882515 | DENV | anC | FJ898392 | DENV | anC | GQ199810 |
| DENV | anC | GQ199820 | DENV | anC | FJ898380 | DENV | anC | GQ199825 |
| DENV | anC | GQ199867 | DENV | anC | GQ199835 | DENV | anC | FJ882546 |
| DENV | anC | FJ898448 | DENV | anC | FJ898430 | DENV | anC | FJ882568 |
| DENV | anC | FJ882556 | DENV | anC | FJ850087 | DENV | anC | FJ898413 |
| DENV | anC | FJ882536 | DENV | anC | FJ898385 | DENV | anC | GQ199773 |
| DENV | anC | GQ199796 | DENV | anC | GQ199857 | DENV | anC | GQ199822 |
| DENV | anC | FJ882570 | DENV | anC | FJ898403 | DENV | anC | GQ199832 |
| DENV | anC | FJ898376 | DENV | anC | GQ199800 | DENV | anC | GQ199790 |
| DENV | anC | GQ199771 | DENV | anC | FJ882540 | DENV | anC | GQ199841 |
| DENV | anC | FJ850069 | DENV | anC | GQ199792 | DENV | anC | FJ882520 |
| DENV | anC | FJ850102 | DENV | anC | FJ882516 | DENV | anC | GQ199875 |
| DENV | anC | GQ199834 | DENV | anC | GQ199850 | DENV | anC | GQ199802 |
| DENV | anC | FJ898388 | DENV | anC | FJ898372 | DENV | anC | GQ199791 |
| DENV | anC | GQ199830 | DENV | anC | GQ199775 | DENV | anC | FJ898426 |
| DENV | anC | GQ199839 | DENV | anC | FJ882559 | DENV | anC | FJ898431 |
| DENV | anC | GQ199777 | DENV | anC | GQ199789 | DENV | anC | GQ199809 |
| DENV | anC | FJ882579 | DENV | anC | FJ850099 | DENV | anC | FJ898406 |
| DENV | anC | FJ898429 | DENV | anC | FJ850114 | DENV | anC | GQ199805 |
| DENV | anC | FJ882541 | DENV | anC | GQ199819 | DENV | anC | GQ199831 |
| DENV | anC | FJ898402 | DENV | anC | FJ882523 | DENV | anC | FJ850070 |
| DENV | anC | GQ199808 | DENV | anC | GQ199845 | DENV | anC | GQ199807 |
| DENV | anC | GQ199786 | DENV | anC | FJ850081 | DENV | anC | FJ882543 |
| DENV | anC | FJ882547 | DENV | anC | FJ744702 | DENV | anC | FJ898408 |
| DENV | anC | GQ199798 | DENV | anC | FJ898386 | DENV | anC | FJ810419 |
| DENV | anC | GQ199844 | DENV | anC | FJ882542 | DENV | anC | GQ199793 |
| DENV | anC | GQ199829 | DENV | anC | GQ199782 | DENV | anC | FJ882562 |
| DENV | anC | FJ882530 | DENV | anC | GQ199852 | DENV | anC | FJ898424 |
| DENV | anC | FJ898422 | DENV | anC | FJ898421 | DENV | anC | FJ898389 |
| DENV | anC | FJ810415 | DENV | anC | FJ687432 | DENV | anC | FJ898412 |
| DENV | anC | FJ898411 | DENV | anC | GQ199813 | DENV | anC | FJ882537 |
| DENV | anC | GQ199856 | DENV | anC | FJ882534 | DENV | anC | FJ898418 |
| DENV | anC | FJ850101 | DENV | anC | GQ199854 | DENV | anC | FJ898394 |
| DENV | anC | FJ850093 | DENV | anC | GQ199846 | DENV | anC | GQ199849 |
| DENV | anC | FJ882551 | DENV | anC | FJ882539 | DENV | anC | FJ882548 |
| DENV | anC | GQ199795 | DENV | anC | FJ898437 | DENV | anC | FJ906963 |
| DENV | anC | FJ850100 | DENV | anC | FJ898390 | DENV | anC | FJ906965 |
| DENV | anC | FJ898416 | DENV | anC | FJ898405 | DENV | anC | GQ199873 |
| DENV | anC | GQ199785 | DENV | anC | GQ199783 | DENV | anC | FJ850073 |
| DENV | anC | GQ199784 | DENV | anC | FJ882526 | DENV | anC | FJ850071 |
| DENV | anC | GQ199828 | DENV | anC | FJ461320 | DENV | anC | GQ199772 |
| DENV | anC | GQ199780 | DENV | anC | FJ898420 | DENV | anC | FJ898373 |
| DENV | anC | FJ850103 | DENV | anC | FJ687431 | DENV | anC | FJ687429 |
| DENV | anC | FJ882555 | DENV | anC | GQ199801 | DENV | anC | FJ898379 |
| DENV | anC | FJ882561 | DENV | anC | FJ906728 | DENV | anC | FJ882566 |
| DENV | anC | FJ687430 | DENV | anC | FJ882544 | DENV | anC | FJ898396 |
| DENV | anC | FJ898381 | DENV | anC | FJ882553 | DENV | anC | FJ882529 |

FIG. 70-27

| Virus | Protein | Accession No. | Virus | Protein | Accession No. | Virus | Protein | Accession No. |
|---|---|---|---|---|---|---|---|---|
| DENV | anC | GQ199838 | DENV | anC | GU131841 | DENV | anC | GU131689 |
| DENV | anC | GQ199779 | DENV | anC | GQ868564 | DENV | anC | GU131700 |
| DENV | anC | GQ199827 | DENV | anC | AB519681 | DENV | anC | GU131798 |
| DENV | anC | GQ199836 | DENV | anC | GU131743 | DENV | anC | GU131713 |
| DENV | anC | GQ199858 | DENV | anC | GQ868522 | DENV | anC | GU131829 |
| DENV | anC | GQ199787 | DENV | anC | GU131739 | DENV | anC | GU131782 |
| DENV | anC | FJ850068 | DENV | anC | GU131971 | DENV | anC | GU131698 |
| DENV | anC | FJ882564 | DENV | anC | GU131834 | DENV | anC | GU131732 |
| DENV | anC | FJ898419 | DENV | anC | GQ868523 | DENV | anC | GU131772 |
| DENV | anC | FJ898383 | DENV | anC | GU131982 | DENV | anC | GU131978 |
| DENV | anC | FJ461328 | DENV | anC | GU131965 | DENV | anC | GU131958 |
| DENV | anC | FJ882527 | DENV | anC | GU131760 | DENV | anC | GU131811 |
| DENV | anC | FJ898427 | DENV | anC | GQ868535 | DENV | anC | GQ868506 |
| DENV | anC | FJ882525 | DENV | anC | GU131962 | DENV | anC | GQ868525 |
| DENV | anC | FJ882557 | DENV | anC | GU131891 | DENV | anC | GQ868538 |
| DENV | anC | GQ199859 | DENV | anC | GQ868504 | DENV | anC | FJ469909 |
| DENV | anC | GQ199842 | DENV | anC | GU131783 | DENV | anC | GU131818 |
| DENV | anC | GQ199817 | DENV | anC | GU131680 | DENV | anC | GU131893 |
| DENV | anC | FJ898401 | DENV | anC | GU131704 | DENV | anC | GQ868509 |
| DENV | anC | FJ882519 | DENV | anC | GU131685 | DENV | anC | GU131706 |
| DENV | anC | FJ850090 | DENV | anC | GU131770 | DENV | anC | GU131777 |
| DENV | anC | FJ898377 | DENV | anC | GU131795 | DENV | anC | GU131925 |
| DENV | anC | GQ199774 | DENV | anC | GU131961 | DENV | anC | GU131977 |
| DENV | anC | FJ898399 | DENV | anC | GU131733 | DENV | anC | GQ868611 |
| DENV | anC | GQ199840 | DENV | anC | GU131804 | DENV | anC | GU131745 |
| DENV | anC | FJ898433 | DENV | anC | GU131762 | DENV | anC | GQ868635 |
| DENV | anC | FJ882567 | DENV | anC | GU131827 | DENV | anC | GU056032 |
| DENV | anC | FJ898387 | DENV | anC | GU131837 | DENV | anC | GQ868610 |
| DENV | anC | FJ882532 | DENV | anC | GQ868630 | DENV | anC | GU131889 |
| DENV | anC | FJ898409 | DENV | anC | GU131767 | DENV | anC | GQ868499 |
| DENV | anC | FJ882545 | DENV | anC | GU131737 | DENV | anC | GU131756 |
| DENV | anC | FJ898375 | DENV | anC | GQ868500 | DENV | anC | GU131786 |
| DENV | anC | FJ898414 | DENV | anC | GU131722 | DENV | anC | GQ868565 |
| DENV | anC | CS477306 | DENV | anC | GQ868607 | DENV | anC | GU131709 |
| DENV | anC | A75711 | DENV | anC | GQ868517 | DENV | anC | GQ868569 |
| DENV | anC | GU131816 | DENV | anC | GU131727 | DENV | anC | GU131723 |
| DENV | anC | FJ469907 | DENV | anC | GU131715 | DENV | anC | GU131696 |
| DENV | anC | GU131814 | DENV | anC | FN429885 | DENV | anC | GQ868519 |
| DENV | anC | GU131725 | DENV | anC | GU131780 | DENV | anC | GU131838 |
| DENV | anC | GU131822 | DENV | anC | GU131750 | DENV | anC | GQ868520 |
| DENV | anC | GQ868633 | DENV | anC | GU131787 | DENV | anC | GU131791 |
| DENV | anC | GU131820 | DENV | anC | GU056031 | DENV | anC | GU131765 |
| DENV | anC | GU131679 | DENV | anC | GQ868602 | DENV | anC | GU131702 |
| DENV | anC | GQ868507 | DENV | anC | GU131711 | DENV | anC | GU131682 |
| DENV | anC | GU131789 | DENV | anC | GQ868567 | DENV | anC | GU131801 |
| DENV | anC | GU131710 | DENV | anC | GU131813 | DENV | anC | GQ868562 |
| DENV | anC | FN429887 | DENV | anC | FJ687428 | DENV | anC | GU131684 |
| DENV | anC | GU131720 | DENV | anC | GU131707 | DENV | anC | GU131744 |

FIG. 70-28

| Virus | Protein | Accession No. | Virus | Protein | Accession No. | Virus | Protein | Accession No. |
|---|---|---|---|---|---|---|---|---|
| DENV | anC | GQ868534 | DENV | anC | GU131973 | DENV | anC | GU131764 |
| DENV | anC | GU131687 | DENV | anC | GU131967 | DENV | anC | GU056030 |
| DENV | anC | GQ868529 | DENV | anC | GU131803 | DENV | anC | GU131979 |
| DENV | anC | GU131840 | DENV | anC | GU131736 | DENV | anC | GU131768 |
| DENV | anC | GU131808 | DENV | anC | GU131981 | DENV | anC | GU131699 |
| DENV | anC | GU131922 | DENV | anC | GU131964 | DENV | anC | FJ687427 |
| DENV | anC | GU131836 | DENV | anC | GU131771 | DENV | anC | GU131963 |
| DENV | anC | GQ868613 | DENV | anC | GU131984 | DENV | anC | GU131793 |
| DENV | anC | GU131721 | DENV | anC | GU131695 | DENV | anC | GQ868618 |
| DENV | anC | GU131730 | DENV | anC | GU131728 | DENV | anC | GU131799 |
| DENV | anC | GU131968 | DENV | anC | GQ868601 | DENV | anC | GU131724 |
| DENV | anC | GU131832 | DENV | anC | FN429886 | DENV | anC | GU131740 |
| DENV | anC | GU131774 | DENV | anC | GU131826 | DENV | anC | GU131806 |
| DENV | anC | GU131976 | DENV | anC | GQ868512 | DENV | anC | GQ868614 |
| DENV | anC | GU131831 | DENV | anC | GU131718 | DENV | anC | FN429881 |
| DENV | anC | GQ868501 | DENV | anC | GQ868513 | DENV | anC | GQ868636 |
| DENV | anC | GQ868531 | DENV | anC | GU131731 | DENV | anC | GU131746 |
| DENV | anC | GU131957 | DENV | anC | GU131686 | DENV | anC | GQ868560 |
| DENV | anC | GU131980 | DENV | anC | GU131894 | DENV | anC | GQ868508 |
| DENV | anC | GQ868609 | DENV | anC | GU131895 | DENV | anC | GQ868570 |
| DENV | anC | GU131769 | DENV | anC | GU131678 | DENV | anC | GU131788 |
| DENV | anC | GQ868526 | DENV | anC | GQ868619 | DENV | anC | GU131949 |
| DENV | anC | GQ868510 | DENV | anC | GU131729 | DENV | anC | GU131796 |
| DENV | anC | FN429882 | DENV | anC | GQ868539 | DENV | anC | GU056029 |
| DENV | anC | GU131763 | DENV | anC | GU131747 | DENV | anC | GU131792 |
| DENV | anC | GQ868527 | DENV | anC | GU131748 | DENV | anC | GU131690 |
| DENV | anC | GU131708 | DENV | anC | FN429889 | DENV | anC | GQ868632 |
| DENV | anC | GU131766 | DENV | anC | GU131776 | DENV | anC | GU131781 |
| DENV | anC | FN429890 | DENV | anC | GU131755 | DENV | anC | GQ868537 |
| DENV | anC | GU131694 | DENV | anC | GU131810 | DENV | anC | GU131815 |
| DENV | anC | GQ868615 | DENV | anC | GU131701 | DENV | anC | GU056033 |
| DENV | anC | GU131688 | DENV | anC | GU131754 | DENV | anC | GU131812 |
| DENV | anC | FJ469908 | DENV | anC | GU131784 | DENV | anC | GU131833 |
| DENV | anC | GU131734 | DENV | anC | GU131807 | DENV | anC | GU131830 |
| DENV | anC | GQ868637 | DENV | anC | GU131842 | DENV | anC | GU131742 |
| DENV | anC | GU131888 | DENV | anC | GU131923 | DENV | anC | GQ868561 |
| DENV | anC | GQ868568 | DENV | anC | GU131809 | DENV | anC | GU131800 |
| DENV | anC | GU131790 | DENV | anC | GU131726 | DENV | anC | GU131738 |
| DENV | anC | GU131920 | DENV | anC | GU131970 | DENV | anC | GU131824 |
| DENV | anC | GQ868528 | DENV | anC | GU131751 | DENV | anC | GU131919 |
| DENV | anC | GQ868612 | DENV | anC | GU131828 | DENV | anC | GU131802 |
| DENV | anC | GU131794 | DENV | anC | GQ868524 | DENV | anC | GQ868503 |
| DENV | anC | GQ868606 | DENV | anC | GU131863 | DENV | anC | GU131839 |
| DENV | anC | GU131969 | DENV | anC | GU131892 | DENV | anC | GU131681 |
| DENV | anC | GQ868608 | DENV | anC | GU131823 | DENV | anC | GQ868505 |
| DENV | anC | GU131921 | DENV | anC | GU131821 | DENV | anC | FN429884 |
| DENV | anC | GQ868502 | DENV | anC | GU131983 | DENV | anC | GQ868536 |
| DENV | anC | GU131719 | DENV | anC | GQ868518 | DENV | anC | GU131825 |

FIG. 70-29

| Virus | Protein | Accession No. | Virus | Protein | Accession No. | Virus | Protein | Accession No. |
|---|---|---|---|---|---|---|---|---|
| DENV | anC | FN429888 | DENV | anC | GU131717 | DENV | anC | FJ182016 |
| DENV | anC | GU131778 | DENV | anC | GU131712 | DENV | anC | AF326573 |
| DENV | anC | GU131972 | DENV | anC | GQ868532 | DENV | anC | FJ182017 |
| DENV | anC | GU131817 | DENV | anC | GQ868514 | DENV | anC | FJ024476 |
| DENV | anC | GU131759 | DENV | anC | FJ410220 | DENV | anC | EF457906 |
| DENV | anC | GU131819 | DENV | anC | CS477302 | DENV | anC | FJ639742 |
| DENV | anC | GU131757 | DENV | anC | CS477304 | DENV | anC | AF289029 |
| DENV | anC | GQ868533 | DENV | anC | CS477264 | DENV | anC | GQ199880 |
| DENV | anC | FN429883 | DENV | anC | CS477305 | DENV | anC | FJ882597 |
| DENV | anC | GU131956 | DENV | anC | CS477263 | DENV | anC | NC_002640 |
| DENV | anC | GQ868563 | DENV | anC | CS477265 | DENV | anC | FJ882587 |
| DENV | anC | GU131926 | DENV | anC | M87512 | DENV | anC | FJ882595 |
| DENV | anC | GU131887 | DENV | anC | FB730116 | DENV | anC | FJ882582 |
| DENV | anC | GU131741 | DENV | anC | GM059691 | DENV | anC | FJ810417 |
| DENV | anC | GU131761 | DENV | anC | U88536 | DENV | anC | FJ850095 |
| DENV | anC | GU131693 | DENV | anC | GU370048 | DENV | anC | FJ882599 |
| DENV | anC | GU131753 | DENV | anC | GU370049 | DENV | anC | FJ882580 |
| DENV | anC | GU131948 | DENV | anC | AY762085 | DENV | anC | GQ199884 |
| DENV | anC | GQ868559 | DENV | anC | FJ024424 | DENV | anC | FJ882588 |
| DENV | anC | GQ868530 | DENV | anC | FJ226067 | DENV | anC | FJ882598 |
| DENV | anC | GU131797 | DENV | anC | FJ639745 | DENV | anC | FJ882601 |
| DENV | anC | GU131785 | DENV | anC | AY618989 | DENV | anC | FJ850058 |
| DENV | anC | GU131758 | DENV | anC | AF326827 | DENV | anC | FJ882584 |
| DENV | anC | GU131697 | DENV | anC | AY618988 | DENV | anC | FJ850059 |
| DENV | anC | GU131835 | DENV | anC | EU854296 | DENV | anC | GQ199883 |
| DENV | anC | GU131716 | DENV | anC | EU854300 | DENV | anC | FJ882586 |
| DENV | anC | GQ868498 | DENV | anC | AY858050 | DENV | anC | GQ252675 |
| DENV | anC | GU131683 | DENV | anC | AF375822 | DENV | anC | FJ882581 |
| DENV | anC | GU131960 | DENV | anC | EU854295 | DENV | anC | GQ199881 |
| DENV | anC | GU131714 | DENV | anC | M14931 | DENV | anC | GQ199878 |
| DENV | anC | GU131779 | DENV | anC | AY618992 | DENV | anC | FJ882596 |
| DENV | anC | GU131773 | DENV | anC | EU854297 | DENV | anC | FJ882583 |
| DENV | anC | GQ868605 | DENV | anC | FJ639738 | DENV | anC | FJ882600 |
| DENV | anC | GQ868511 | DENV | anC | AY618993 | DENV | anC | FJ850057 |
| DENV | anC | GU131752 | DENV | anC | FJ639764 | DENV | anC | GQ199879 |
| DENV | anC | GU131691 | DENV | anC | FJ639737 | DENV | anC | FJ882585 |
| DENV | anC | GU131692 | DENV | anC | AY776330 | DENV | anC | GQ199876 |
| DENV | anC | GU131705 | DENV | anC | AY618991 | DENV | anC | GQ199885 |
| DENV | anC | GQ868639 | DENV | anC | FJ639736 | DENV | anC | FJ882592 |
| DENV | anC | GU131805 | DENV | anC | FJ639739 | DENV | anC | GQ199882 |
| DENV | anC | GU131735 | DENV | anC | AF326826 | DENV | anC | FJ882591 |
| DENV | anC | GU131966 | DENV | anC | AY947539 | DENV | anC | FJ882589 |
| DENV | anC | GU131890 | DENV | anC | EU854299 | DENV | anC | GQ868642 |
| DENV | anC | GQ868566 | DENV | anC | AY618990 | DENV | anC | GQ868581 |
| DENV | anC | GU131775 | DENV | anC | FJ639748 | DENV | anC | FN429919 |
| DENV | anC | GU131749 | DENV | anC | FJ639744 | DENV | anC | GQ868583 |
| DENV | anC | GQ868521 | DENV | anC | EU854301 | DENV | anC | FN429920 |
| DENV | anC | GU131703 | DENV | anC | FJ639773 | DENV | anC | FN429923 |

FIG. 70-30

| Virus | Protein | Accession No. | Virus | Protein | Accession No. | Virus | Protein | Accession No. |
|---|---|---|---|---|---|---|---|---|
| DENV | anC | GQ868585 | DENV | anC | FJ639774 | DENV | anC | EU687226 |
| DENV | anC | GQ868579 | DENV | anC | FJ639726 | DENV | anC | FJ639715 |
| DENV | anC | GQ868644 | DENV | anC | AY858037 | DENV | anC | AY676352 |
| DENV | anC | FN429925 | DENV | anC | EU081215 | DENV | anC | AY858043 |
| DENV | anC | GU289913 | DENV | anC | FJ639785 | DENV | anC | EU081196 |
| DENV | anC | GQ868580 | DENV | anC | FJ639761 | DENV | anC | FJ432741 |
| DENV | anC | FN429922 | DENV | anC | EU569688 | DENV | anC | EU726773 |
| DENV | anC | GQ868645 | DENV | anC | DQ675533 | DENV | anC | EU482555 |
| DENV | anC | GQ868594 | DENV | anC | FJ410177 | DENV | anC | DQ401694 |
| DENV | anC | FN429924 | DENV | anC | FJ478456 | DENV | anC | EU081216 |
| DENV | anC | FJ882590 | DENV | anC | EU081195 | DENV | anC | EU529704 |
| DENV | anC | GQ868582 | DENV | anC | EU081221 | DENV | anC | FJ639777 |
| DENV | anC | GQ868584 | DENV | anC | EU529689 | DENV | anC | FJ639730 |
| DENV | anC | FN429926 | DENV | anC | EU660408 | DENV | anC | EU081190 |
| DENV | anC | FN429921 | DENV | anC | EU687219 | DENV | anC | EU529703 |
| DENV | anC | GQ868643 | DENV | anC | FJ639780 | DENV | anC | FJ639725 |
| DENV | anC | AF326825 | DENV | anC | EU687196 | DENV | anC | EU081205 |
| DENV | anC | AY376438 | DENV | anC | EF643017 | DENV | anC | AY876494 |
| DENV | anC | AY648301 | DENV | anC | FJ373303 | DENV | anC | FJ639747 |
| DENV | anC | AY099336 | DENV | anC | FJ639729 | DENV | anC | FJ373302 |
| DENV | anC | GU363549 | DENV | anC | FJ639775 | DENV | anC | FJ639778 |
| DENV | anC | GU370052 | DENV | anC | FJ461322 | DENV | anC | DQ401692 |
| DENV | anC | GU370053 | DENV | anC | FJ390371 | DENV | anC | FJ182038 |
| DENV | anC | EU081191 | DENV | anC | AY858046 | DENV | anC | EU081220 |
| DENV | anC | DQ401690 | DENV | anC | EU482455 | DENV | anC | AY923865 |
| DENV | anC | EU529683 | DENV | anC | AY744680 | DENV | anC | EU081188 |
| DENV | anC | AY679147 | DENV | anC | FJ182015 | DENV | anC | FJ461337 |
| DENV | anC | AY676348 | DENV | anC | FJ562103 | DENV | anC | EU081224 |
| DENV | anC | EF629368 | DENV | anC | FJ639792 | DENV | anC | EU081207 |
| DENV | anC | FJ639752 | DENV | anC | DQ675527 | DENV | anC | FJ639750 |
| DENV | anC | FJ639807 | DENV | anC | FJ547066 | DENV | anC | AB189128 |
| DENV | anC | EU529684 | DENV | anC | EU529698 | DENV | anC | AY676353 |
| DENV | anC | FJ373304 | DENV | anC | EU726769 | DENV | anC | EU081209 |
| DENV | anC | FJ639723 | DENV | anC | AY676349 | DENV | anC | FJ639772 |
| DENV | anC | EU569691 | DENV | anC | EU529688 | DENV | anC | FJ182040 |
| DENV | anC | DQ675524 | DENV | anC | EU482558 | DENV | anC | AY648961 |
| DENV | anC | EU081203 | DENV | anC | FJ547070 | DENV | anC | FJ410178 |
| DENV | anC | EU482564 | DENV | anC | EU687198 | DENV | anC | EU529699 |
| DENV | anC | FJ182039 | DENV | anC | FJ639817 | DENV | anC | EU081199 |
| DENV | anC | EU482453 | DENV | anC | EU081202 | DENV | anC | FJ639786 |
| DENV | anC | FJ639779 | DENV | anC | EU081225 | DENV | anC | FJ639768 |
| DENV | anC | EU081183 | DENV | anC | DQ675520 | DENV | anC | FJ639731 |
| DENV | anC | EU529690 | DENV | anC | EU854298 | DENV | anC | FJ390373 |
| DENV | anC | FJ182011 | DENV | anC | FJ205870 | DENV | anC | FJ639800 |
| DENV | anC | EU081187 | DENV | anC | FJ639793 | DENV | anC | FJ547079 |
| DENV | anC | EU482461 | DENV | anC | DQ675532 | DENV | anC | FJ547072 |
| DENV | anC | FJ639803 | DENV | anC | FJ024470 | DENV | anC | EU081219 |
| DENV | anC | AY858047 | DENV | anC | EU081210 | DENV | anC | EU596493 |

FIG. 70-31

| Virus | Protein | Accession No. | Virus | Protein | Accession No. | Virus | Protein | Accession No. |
|---|---|---|---|---|---|---|---|---|
| DENV | anC | EU081192 | DENV | anC | FJ639767 | DENV | anC | FJ024466 |
| DENV | anC | FJ432731 | DENV | anC | AB189125 | DENV | anC | FJ639795 |
| DENV | anC | AB189126 | DENV | anC | AF317645 | DENV | anC | FJ024465 |
| DENV | anC | FJ024471 | DENV | anC | AB189127 | DENV | anC | EU726768 |
| DENV | anC | FJ639769 | DENV | anC | EU781137 | DENV | anC | FJ639720 |
| DENV | anC | FJ547078 | DENV | anC | DQ675522 | DENV | anC | EU529696 |
| DENV | anC | FJ547080 | DENV | anC | EU482614 | DENV | anC | FJ639810 |
| DENV | anC | AY744679 | DENV | anC | AB214879 | DENV | anC | AY744681 |
| DENV | anC | EU081217 | DENV | anC | FJ639765 | DENV | anC | FJ639724 |
| DENV | anC | AY858045 | DENV | anC | EU081211 | DENV | anC | EU482595 |
| DENV | anC | FJ547084 | DENV | anC | FJ639787 | DENV | anC | AY676351 |
| DENV | anC | DQ675521 | DENV | anC | FJ639784 | DENV | anC | DQ401689 |
| DENV | anC | AY776329 | DENV | anC | EU569690 | DENV | anC | FJ182005 |
| DENV | anC | FJ639789 | DENV | anC | EU081223 | DENV | anC | FJ547085 |
| DENV | anC | AY496871 | DENV | anC | FJ639816 | DENV | anC | EU081193 |
| DENV | anC | EU781136 | DENV | anC | AY496873 | DENV | anC | FJ639751 |
| DENV | anC | FJ182013 | DENV | anC | FJ182010 | DENV | anC | DQ675525 |
| DENV | anC | EU596492 | DENV | anC | AY099337 | DENV | anC | FJ639826 |
| DENV | anC | EU726774 | DENV | anC | AY496879 | DENV | anC | EU482458 |
| DENV | anC | EU081198 | DENV | anC | EU482462 | DENV | anC | EU081204 |
| DENV | anC | FJ639728 | DENV | anC | FJ639825 | DENV | anC | EU529691 |
| DENV | anC | DQ675530 | DENV | anC | AY766104 | DENV | anC | FJ639719 |
| DENV | anC | EU660409 | DENV | anC | FJ182007 | DENV | anC | FJ182037 |
| DENV | anC | EU081206 | DENV | anC | DQ401693 | DENV | anC | EU482612 |
| DENV | anC | EU081222 | DENV | anC | DQ675531 | DENV | anC | EU482596 |
| DENV | anC | EU660407 | DENV | anC | FJ461326 | DENV | anC | EU081208 |
| DENV | anC | M93130 | DENV | anC | FJ373306 | DENV | anC | EU081201 |
| DENV | anC | EU529687 | DENV | anC | EU569689 | DENV | anC | FJ639757 |
| DENV | anC | DQ675523 | DENV | anC | AY858041 | DENV | anC | FJ639713 |
| DENV | anC | FJ432722 | DENV | anC | EU482566 | DENV | anC | AY744685 |
| DENV | anC | EU482559 | DENV | anC | EF629370 | DENV | anC | FJ182041 |
| DENV | anC | FJ639721 | DENV | anC | AY496877 | DENV | anC | FJ562099 |
| DENV | anC | AY744682 | DENV | anC | FJ562102 | DENV | anC | FJ562100 |
| DENV | anC | EU081184 | DENV | anC | EF629367 | DENV | anC | FJ547081 |
| DENV | anC | FJ639805 | DENV | anC | FJ547077 | DENV | anC | AY858044 |
| DENV | anC | FJ547074 | DENV | anC | FJ639770 | DENV | anC | FJ639714 |
| DENV | anC | EU529685 | DENV | anC | EU081182 | DENV | anC | EU529686 |
| DENV | anC | DQ401695 | DENV | anC | EU596494 | DENV | anC | FJ410229 |
| DENV | anC | FJ432743 | DENV | anC | FJ639749 | DENV | anC | FJ547073 |
| DENV | anC | EU854291 | DENV | anC | EU726771 | DENV | anC | FJ639791 |
| DENV | anC | FJ182008 | DENV | anC | FJ639746 | DENV | anC | EU529692 |
| DENV | anC | FJ547062 | DENV | anC | EU081214 | DENV | anC | FJ547082 |
| DENV | anC | FJ024467 | DENV | anC | AY858039 | DENV | anC | EU367962 |
| DENV | anC | EU687239 | DENV | anC | EU660411 | DENV | anC | FJ390375 |
| DENV | anC | FJ024468 | DENV | anC | EU482563 | DENV | anC | AY858040 |
| DENV | anC | AY496874 | DENV | anC | AY744678 | DENV | anC | FJ547069 |
| DENV | anC | FJ547061 | DENV | anC | FJ461334 | DENV | anC | FJ562107 |
| DENV | anC | FJ547076 | DENV | anC | EU660420 | DENV | anC | FJ461338 |

FIG. 70-32

| Virus | Protein | Accession No. | Virus | Protein | Accession No. | Virus | Protein | Accession No. |
|---|---|---|---|---|---|---|---|---|
| DENV | anC | FJ639722 | DENV | anC | EU081186 | DENV | anC | FJ898458 |
| DENV | anC | FJ639782 | DENV | anC | FJ547083 | DENV | anC | FJ744740 |
| DENV | anC | AY858042 | DENV | anC | FJ639762 | DENV | anC | GQ199889 |
| DENV | anC | EU081185 | DENV | anC | FJ547071 | DENV | anC | GQ199886 |
| DENV | anC | FJ390377 | DENV | anC | EU529702 | DENV | anC | FJ687448 |
| DENV | anC | FJ639763 | DENV | anC | EU687234 | DENV | anC | FJ744732 |
| DENV | anC | FJ639760 | DENV | anC | FJ182006 | DENV | anC | FJ898446 |
| DENV | anC | FJ182009 | DENV | anC | AY662691 | DENV | anC | GQ199861 |
| DENV | anC | EU529697 | DENV | anC | EU081213 | DENV | anC | FJ898455 |
| DENV | anC | DQ675529 | DENV | anC | EU081181 | DENV | anC | FJ882573 |
| DENV | anC | FJ639727 | DENV | anC | FJ390372 | DENV | anC | FJ898463 |
| DENV | anC | FJ461329 | DENV | anC | EU482613 | DENV | anC | FJ898447 |
| DENV | anC | EU482457 | DENV | anC | FJ639790 | DENV | anC | FJ882571 |
| DENV | anC | FJ639827 | DENV | anC | DQ675519 | DENV | anC | FJ898462 |
| DENV | anC | EU687197 | DENV | anC | EU687233 | DENV | anC | GQ199870 |
| DENV | anC | FJ639801 | DENV | anC | EF629369 | DENV | anC | FJ898471 |
| DENV | anC | FJ410176 | DENV | anC | FJ182004 | DENV | anC | FJ882575 |
| DENV | anC | EU081218 | DENV | anC | FJ639799 | DENV | anC | FJ744738 |
| DENV | anC | AY744684 | DENV | anC | FJ562097 | DENV | anC | FJ898440 |
| DENV | anC | FJ390376 | DENV | anC | FJ639712 | DENV | anC | FJ898444 |
| DENV | anC | FJ639781 | DENV | anC | EF629366 | DENV | anC | GQ199865 |
| DENV | anC | DQ675528 | DENV | anC | EU726772 | DENV | anC | GQ252678 |
| DENV | anC | FJ639766 | DENV | anC | DQ675526 | DENV | anC | FJ850110 |
| DENV | anC | EU687221 | DENV | anC | EU482452 | DENV | anC | FJ744734 |
| DENV | anC | EU081197 | DENV | anC | AY858038 | DENV | anC | FJ898457 |
| DENV | anC | FJ639755 | DENV | anC | EU482456 | DENV | anC | FJ744736 |
| DENV | anC | FJ639798 | DENV | anC | EU081200 | DENV | anC | FJ810416 |
| DENV | anC | FJ639758 | DENV | anC | FJ639756 | DENV | anC | FJ898474 |
| DENV | anC | EU687218 | DENV | anC | AY744677 | DENV | anC | FJ850094 |
| DENV | anC | EU081189 | DENV | anC | AY744683 | DENV | anC | FJ898470 |
| DENV | anC | FJ639759 | DENV | anC | FJ639753 | DENV | anC | FJ810413 |
| DENV | anC | EU081212 | DENV | anC | FJ639716 | DENV | anC | FJ744735 |
| DENV | anC | EU482460 | DENV | anC | EU081194 | DENV | anC | GQ199860 |
| DENV | anC | FJ547075 | DENV | anC | FJ639776 | DENV | anC | FJ898464 |
| DENV | anC | AY676350 | DENV | anC | FJ898469 | DENV | anC | FJ744729 |
| DENV | anC | EU854292 | DENV | anC | GQ252674 | DENV | anC | FJ898472 |
| DENV | anC | EU660410 | DENV | anC | FJ850055 | DENV | anC | GQ199862 |
| DENV | anC | FJ432728 | DENV | anC | FJ898475 | DENV | anC | FJ873812 |
| DENV | anC | FJ024469 | DENV | anC | FJ744739 | DENV | anC | FJ898441 |
| DENV | anC | AY858048 | DENV | anC | NC_001475 | DENV | anC | FJ850048 |
| DENV | anC | FJ639804 | DENV | anC | GQ199863 | DENV | anC | FJ850080 |
| DENV | anC | EU529705 | DENV | anC | FJ850089 | DENV | anC | FJ882577 |
| DENV | anC | EU482454 | DENV | anC | FJ898442 | DENV | anC | FJ850096 |
| DENV | anC | DQ401691 | DENV | anC | FJ898459 | DENV | anC | FJ898473 |
| DENV | anC | FJ639771 | DENV | anC | FJ850049 | DENV | anC | FJ882574 |
| DENV | anC | FJ639754 | DENV | anC | FJ744730 | DENV | anC | FJ898445 |
| DENV | anC | EU482459 | DENV | anC | FJ850097 | DENV | anC | GQ199888 |
| DENV | anC | FJ205871 | DENV | anC | FJ744728 | DENV | anC | FJ898443 |

FIG. 70-33

| Virus | Protein | Accession No. | Virus | Protein | Accession No. | Virus | Protein | Accession No. |
|---|---|---|---|---|---|---|---|---|
| DENV | anC | FJ744726 | DENV | anC | FN429904 | DENV | anC | GU131950 |
| DENV | anC | FJ898476 | DENV | anC | GU131904 | DENV | anC | GQ868634 |
| DENV | anC | FJ898468 | DENV | anC | GU131935 | DENV | anC | GU131873 |
| DENV | anC | FJ744733 | DENV | anC | GU131910 | DENV | anC | GQ868593 |
| DENV | anC | GQ199871 | DENV | anC | GU131918 | DENV | anC | GQ868572 |
| DENV | anC | GQ199887 | DENV | anC | GU131937 | DENV | anC | DQ863638 |
| DENV | anC | GQ199864 | DENV | anC | GU131868 | DENV | anC | GU131876 |
| DENV | anC | FJ744737 | DENV | anC | GU131951 | DENV | anC | EU932687 |
| DENV | anC | FJ898456 | DENV | anC | FN429910 | DENV | anC | GU189648 |
| DENV | anC | FJ850083 | DENV | anC | GU131854 | DENV | anC | FN429913 |
| DENV | anC | FJ744731 | DENV | anC | GU131943 | DENV | anC | GU131867 |
| DENV | anC | FJ850079 | DENV | anC | GU131861 | DENV | anC | GQ868575 |
| DENV | anC | FJ744700 | DENV | anC | GU131871 | DENV | anC | GQ868617 |
| DENV | anC | FJ882576 | DENV | anC | GU131933 | DENV | anC | GQ868616 |
| DENV | anC | GQ199891 | DENV | anC | GU131877 | DENV | anC | GU131870 |
| DENV | anC | FJ850111 | DENV | anC | GU131911 | DENV | anC | GU131869 |
| DENV | anC | FJ850056 | DENV | anC | GQ868628 | DENV | anC | GU131846 |
| DENV | anC | FJ744727 | DENV | anC | GQ868574 | DENV | anC | GU131934 |
| DENV | anC | FJ873813 | DENV | anC | GU131941 | DENV | anC | GQ868627 |
| DENV | anC | AY770511 | DENV | anC | GQ868577 | DENV | anC | FN429908 |
| DENV | anC | FJ850098 | DENV | anC | GQ868547 | DENV | anC | GU131872 |
| DENV | anC | FJ810414 | DENV | anC | GU131845 | DENV | anC | FN429901 |
| DENV | anC | FJ850109 | DENV | anC | FN429899 | DENV | anC | GU131917 |
| DENV | anC | FJ850052 | DENV | anC | FN429902 | DENV | anC | GU131875 |
| DENV | anC | FJ850086 | DENV | anC | FN429917 | DENV | anC | FN429909 |
| DENV | anC | FJ882572 | DENV | anC | FN429915 | DENV | anC | FN429911 |
| DENV | anC | FJ882578 | DENV | anC | GU131855 | DENV | anC | GU131945 |
| DENV | anC | FJ850092 | DENV | anC | FN429896 | DENV | anC | FN429916 |
| DENV | anC | AB214882 | DENV | anC | GU131844 | DENV | anC | FN429914 |
| DENV | anC | AB214880 | DENV | anC | GQ868573 | DENV | anC | GU131942 |
| DENV | anC | AB214881 | DENV | anC | GQ868586 | DENV | anC | GU131849 |
| DENV | anC | FB667400 | DENV | anC | GU131858 | DENV | anC | GU131952 |
| DENV | anC | GQ868587 | DENV | anC | FN429903 | DENV | anC | GU131915 |
| DENV | anC | EU932688 | DENV | anC | GU131874 | DENV | anC | GQ868578 |
| DENV | anC | FN429906 | DENV | anC | GU131914 | DENV | anC | GQ868548 |
| DENV | anC | GU131916 | DENV | anC | FN429912 | DENV | anC | GU131913 |
| DENV | anC | GU131953 | DENV | anC | FN429898 | DENV | anC | GU131940 |
| DENV | anC | GU131850 | DENV | anC | GU131851 | DENV | anC | FN429918 |
| DENV | anC | FN429900 | DENV | anC | GU131938 | DENV | anC | FN429905 |
| DENV | anC | GQ868576 | DENV | anC | GU131853 | DENV | anC | GU131907 |
| DENV | anC | GU131946 | DENV | anC | FN429907 | DENV | anC | GU131860 |
| DENV | anC | GU131866 | DENV | anC | GU131865 | DENV | anC | GU131954 |
| DENV | anC | GU131862 | DENV | anC | GU131906 | DENV | anC | GU131856 |
| DENV | anC | GU131852 | DENV | anC | GU131944 | DENV | anC | GU131847 |
| DENV | anC | FN429897 | DENV | anC | GU131936 | DENV | anC | GU131909 |
| DENV | anC | GQ868571 | DENV | anC | GU131903 | DENV | anC | GU131939 |
| DENV | anC | GQ868626 | DENV | anC | GU131908 | DENV | anC | GU131912 |
| DENV | anC | GQ868546 | DENV | anC | GU131878 | DENV | anC | GU131859 |

FIG. 70-34

| Virus | Protein | Accession No. | Virus | Protein | Accession No. | Virus | Protein | Accession No. |
|---|---|---|---|---|---|---|---|---|
| DENV | anC | GU131857 | DENV | anC | EU482621 | DENV | anC | FJ639703 |
| DENV | anC | GQ868629 | DENV | anC | EU482736 | DENV | anC | EU482647 |
| DENV | anC | GU131905 | DENV | anC | EU596497 | DENV | anC | EU596487 |
| DENV | anC | GU131848 | DENV | anC | M84728 | DENV | anC | FJ639788 |
| DENV | anC | FB667402 | DENV | anC | EU482549 | DENV | anC | FM210206 |
| DENV | anC | FB667403 | DENV | anC | FM210228 | DENV | anC | DQ645556 |
| DENV | anC | FJ177308 | DENV | anC | EU687216 | DENV | anC | AF169682 |
| DENV | anC | FB667404 | DENV | anC | EU596489 | DENV | anC | AY858035 |
| DENV | anC | FB667398 | DENV | anC | EU482576 | DENV | anC | EU687220 |
| DENV | anC | FB667399 | DENV | anC | AF100460 | DENV | anC | EU482636 |
| DENV | anC | CS805345 | DENV | anC | AF169679 | DENV | anC | EU482650 |
| DENV | anC | EU482634 | DENV | anC | EU482665 | DENV | anC | EU482704 |
| DENV | anC | FJ373301 | DENV | anC | EU482586 | DENV | anC | EU482661 |
| DENV | anC | EU482582 | DENV | anC | AF169681 | DENV | anC | EU569699 |
| DENV | anC | EU687227 | DENV | anC | FM210205 | DENV | anC | EU482580 |
| DENV | anC | EU569710 | DENV | anC | EU482767 | DENV | anC | FM210215 |
| DENV | anC | EF105383 | DENV | anC | EU687240 | DENV | anC | FJ639733 |
| DENV | anC | EU687249 | DENV | anC | AF169686 | DENV | anC | EF105389 |
| DENV | anC | EU687242 | DENV | anC | EU687244 | DENV | anC | EF105384 |
| DENV | anC | EU482658 | DENV | anC | EU482683 | DENV | anC | EU677146 |
| DENV | anC | FJ639710 | DENV | anC | FJ373299 | DENV | anC | EU596498 |
| DENV | anC | EU482748 | DENV | anC | EU482601 | DENV | anC | FJ410288 |
| DENV | anC | FJ205885 | DENV | anC | EU660404 | DENV | anC | FJ373300 |
| DENV | anC | EU482470 | DENV | anC | EU482651 | DENV | anC | EU482702 |
| DENV | anC | EU482468 | DENV | anC | EU482787 | DENV | anC | FJ205879 |
| DENV | anC | FJ410195 | DENV | anC | FM210216 | DENV | anC | EU569697 |
| DENV | anC | AB122021 | DENV | anC | EU569694 | DENV | anC | EU482691 |
| DENV | anC | EU482469 | DENV | anC | EU482648 | DENV | anC | FJ461309 |
| DENV | anC | FM210231 | DENV | anC | EU482620 | DENV | anC | EU482608 |
| DENV | anC | FJ639831 | DENV | anC | EU482471 | DENV | anC | EU726776 |
| DENV | anC | EU482657 | DENV | anC | EU482644 | DENV | anC | EU081177 |
| DENV | anC | EU482674 | DENV | anC | FJ639833 | DENV | anC | FM210213 |
| DENV | anC | EU482753 | DENV | anC | EU482445 | DENV | anC | EU854293 |
| DENV | anC | DQ645545 | DENV | anC | EU482606 | DENV | anC | EU482632 |
| DENV | anC | FJ639835 | DENV | anC | FM210236 | DENV | anC | FM210234 |
| DENV | anC | FJ432726 | DENV | anC | EU482639 | DENV | anC | EU482745 |
| DENV | anC | EU482607 | DENV | anC | EU003591 | DENV | anC | EU482593 |
| DENV | anC | EU482660 | DENV | anC | EU482547 | DENV | anC | EU569718 |
| DENV | anC | EU482766 | DENV | anC | FJ478459 | DENV | anC | EU482719 |
| DENV | anC | AB189124 | DENV | anC | FJ639837 | DENV | anC | EF051521 |
| DENV | anC | AF100461 | DENV | anC | FJ390387 | DENV | anC | FM210238 |
| DENV | anC | EU482600 | DENV | anC | DQ645547 | DENV | anC | FJ478455 |
| DENV | anC | EU687230 | DENV | anC | EU596496 | DENV | anC | AF100465 |
| DENV | anC | EU482633 | DENV | anC | EU482597 | DENV | anC | EU529694 |
| DENV | anC | EU482726 | DENV | anC | EU482463 | DENV | anC | EU081178 |
| DENV | anC | EU482557 | DENV | anC | EU482553 | DENV | anC | EU482676 |
| DENV | anC | EU482444 | DENV | anC | EU482548 | DENV | anC | FJ639709 |
| DENV | anC | FJ205877 | DENV | anC | EU482641 | DENV | anC | FM210208 |

FIG. 70-35

| Virus | Protein | Accession No. | Virus | Protein | Accession No. | Virus | Protein | Accession No. |
|---|---|---|---|---|---|---|---|---|
| DENV | anC | FJ410208 | DENV | anC | DQ645555 | DENV | anC | FM210245 |
| DENV | anC | EU569716 | DENV | anC | EU687231 | DENV | anC | FM210214 |
| DENV | anC | EU482786 | DENV | anC | EU660406 | DENV | anC | EU482685 |
| DENV | anC | AF276619 | DENV | anC | EU687241 | DENV | anC | EU482570 |
| DENV | anC | EU482625 | DENV | anC | FJ639700 | DENV | anC | DQ645540 |
| DENV | anC | EU687248 | DENV | anC | FJ639711 | DENV | anC | EU660414 |
| DENV | anC | EU482662 | DENV | anC | U87412 | DENV | anC | FJ024477 |
| DENV | anC | EU569708 | DENV | anC | EU482599 | DENV | anC | AF100463 |
| DENV | anC | FM210240 | DENV | anC | EU482654 | DENV | anC | DQ645546 |
| DENV | anC | EU482777 | DENV | anC | EU569721 | DENV | anC | EU569703 |
| DENV | anC | FJ639705 | DENV | anC | FJ390385 | DENV | anC | EU482652 |
| DENV | anC | EU482669 | DENV | anC | EU482589 | DENV | anC | EU596490 |
| DENV | anC | DQ645553 | DENV | anC | EU482551 | DENV | anC | EU482693 |
| DENV | anC | FM210210 | DENV | anC | EU660400 | DENV | anC | EU482734 |
| DENV | anC | EF457904 | DENV | anC | EU482679 | DENV | anC | FM210202 |
| DENV | anC | FJ410237 | DENV | anC | AF204177 | DENV | anC | EU482729 |
| DENV | anC | AY702035 | DENV | anC | FJ461311 | DENV | anC | AF169680 |
| DENV | anC | EU482757 | DENV | anC | EU569700 | DENV | anC | EU482623 |
| DENV | anC | EU596499 | DENV | anC | EU482737 | DENV | anC | EU569693 |
| DENV | anC | EU482543 | DENV | anC | EU482573 | DENV | anC | EU482590 |
| DENV | anC | EU687217 | DENV | anC | AY702040 | DENV | anC | FJ639834 |
| DENV | anC | EU482646 | DENV | anC | DQ181803 | DENV | anC | EU482449 |
| DENV | anC | EU482746 | DENV | anC | EU482741 | DENV | anC | EU687237 |
| DENV | anC | FJ410217 | DENV | anC | EU660399 | DENV | anC | EF105381 |
| DENV | anC | FJ639707 | DENV | anC | EU482784 | DENV | anC | EU482578 |
| DENV | anC | EU482637 | DENV | anC | EU482584 | DENV | anC | EU482781 |
| DENV | anC | EU482699 | DENV | anC | EU482670 | DENV | anC | EU596485 |
| DENV | anC | EU482583 | DENV | anC | DQ181801 | DENV | anC | EU687224 |
| DENV | anC | FJ639717 | DENV | anC | EU482603 | DENV | anC | FJ461321 |
| DENV | anC | EU687223 | DENV | anC | EU482769 | DENV | anC | FJ390390 |
| DENV | anC | AY702036 | DENV | anC | FM210227 | DENV | anC | EU482562 |
| DENV | anC | EU482542 | DENV | anC | AY744147 | DENV | anC | EF105390 |
| DENV | anC | EU482587 | DENV | anC | EU482656 | DENV | anC | EU482782 |
| DENV | anC | EU482667 | DENV | anC | EU529706 | DENV | anC | EU482682 |
| DENV | anC | EU482695 | DENV | anC | EU687212 | DENV | anC | EU056810 |
| DENV | anC | EU569720 | DENV | anC | DQ645541 | DENV | anC | EU687236 |
| DENV | anC | AY702037 | DENV | anC | DQ181800 | DENV | anC | EU482448 |
| DENV | anC | AY858036 | DENV | anC | EU482721 | DENV | anC | FJ639698 |
| DENV | anC | DQ645544 | DENV | anC | EU677145 | DENV | anC | EU482630 |
| DENV | anC | FJ639822 | DENV | anC | EU482450 | DENV | anC | EU359009 |
| DENV | anC | AF100466 | DENV | anC | EU482541 | DENV | anC | EU482768 |
| DENV | anC | FJ410215 | DENV | anC | AF169688 | DENV | anC | EU482672 |
| DENV | anC | EU569705 | DENV | anC | M19197 | DENV | anC | EU569711 |
| DENV | anC | FM210241 | DENV | anC | EU482594 | DENV | anC | EU482627 |
| DENV | anC | FM210221 | DENV | anC | DQ645554 | DENV | anC | EU569715 |
| DENV | anC | EU687228 | DENV | anC | DQ181798 | DENV | anC | EU482678 |
| DENV | anC | EU482703 | DENV | anC | AY702038 | DENV | anC | DQ181799 |
| DENV | anC | EU529700 | DENV | anC | EU596495 | DENV | anC | EU687235 |

FIG. 70-36

| Virus | Protein | Accession No. | Virus | Protein | Accession No. | Virus | Protein | Accession No. |
|---|---|---|---|---|---|---|---|---|
| DENV | anC | EU687238 | DENV | anC | AB122020 | DENV | anC | DQ181797 |
| DENV | anC | M84727 | DENV | anC | FM210244 | DENV | anC | EU569701 |
| DENV | anC | EU482763 | DENV | anC | AF100469 | DENV | anC | EU482773 |
| DENV | anC | EU482758 | DENV | anC | FJ410221 | DENV | anC | EU482722 |
| DENV | anC | FJ639830 | DENV | anC | EU482626 | DENV | anC | EU482635 |
| DENV | anC | EU482754 | DENV | anC | EU482788 | DENV | anC | DQ645549 |
| DENV | anC | FM210218 | DENV | anC | FJ410219 | DENV | anC | EU482629 |
| DENV | anC | FJ410224 | DENV | anC | AF100462 | DENV | anC | EU596488 |
| DENV | anC | FJ410193 | DENV | anC | EU482696 | DENV | anC | FJ639836 |
| DENV | anC | EU056811 | DENV | anC | EU482544 | DENV | anC | EU482733 |
| DENV | anC | EU482774 | DENV | anC | EU482640 | DENV | anC | EU677143 |
| DENV | anC | EU482568 | DENV | anC | FJ182012 | DENV | anC | EU482653 |
| DENV | anC | EU482588 | DENV | anC | DQ645548 | DENV | anC | AF208496 |
| DENV | anC | EU482475 | DENV | anC | FJ639701 | DENV | anC | EU482565 |
| DENV | anC | AF489932 | DENV | anC | EU482655 | DENV | anC | EU482598 |
| DENV | anC | FM210211 | DENV | anC | AB189122 | DENV | anC | M29095 |
| DENV | anC | EU687246 | DENV | anC | DQ181804 | DENV | anC | EU660415 |
| DENV | anC | FJ390389 | DENV | anC | EU482732 | DENV | anC | FM210239 |
| DENV | anC | EU482464 | DENV | anC | DQ645543 | DENV | anC | EU687213 |
| DENV | anC | EU482697 | DENV | anC | FJ639832 | DENV | anC | EU677144 |
| DENV | anC | EU482765 | DENV | anC | FJ226066 | DENV | anC | FM210243 |
| DENV | anC | FM210209 | DENV | anC | AF169687 | DENV | anC | AF100459 |
| DENV | anC | EU482474 | DENV | anC | EU482752 | DENV | anC | EU482466 |
| DENV | anC | EU596484 | DENV | anC | EU482783 | DENV | anC | FM210230 |
| DENV | anC | EU677138 | DENV | anC | EU482742 | DENV | anC | FJ410200 |
| DENV | anC | EU621672 | DENV | anC | FJ461314 | DENV | anC | DQ645552 |
| DENV | anC | AF359579 | DENV | anC | EU482688 | DENV | anC | EU482574 |
| DENV | anC | EU482645 | DENV | anC | DQ181802 | DENV | anC | EU482622 |
| DENV | anC | EU482760 | DENV | anC | FJ639809 | DENV | anC | EU482561 |
| DENV | anC | FJ639732 | DENV | anC | EU482701 | DENV | anC | EU596486 |
| DENV | anC | FM210229 | DENV | anC | AF204178 | DENV | anC | EU569695 |
| DENV | anC | EU482684 | DENV | anC | FJ639706 | DENV | anC | FJ024461 |
| DENV | anC | EF105378 | DENV | anC | EU482550 | DENV | anC | EU569713 |
| DENV | anC | EU482681 | DENV | anC | EU482605 | DENV | anC | FM210224 |
| DENV | anC | FJ547090 | DENV | anC | EU482554 | DENV | anC | EU482556 |
| DENV | anC | EU482447 | DENV | anC | EU482692 | DENV | anC | EU482731 |
| DENV | anC | EU482624 | DENV | anC | EU482680 | DENV | anC | EU179858 |
| DENV | anC | AF119661 | DENV | anC | AF169683 | DENV | anC | EU781135 |
| DENV | anC | EU660413 | DENV | anC | FJ024458 | DENV | anC | EU482743 |
| DENV | anC | AF169685 | DENV | anC | EU482780 | DENV | anC | EU482751 |
| DENV | anC | EU482771 | DENV | anC | EU482750 | DENV | anC | FJ410259 |
| DENV | anC | EU482604 | DENV | anC | EU179857 | DENV | anC | EU482747 |
| DENV | anC | FJ410223 | DENV | anC | EU569698 | DENV | anC | EU687225 |
| DENV | anC | EU482739 | DENV | anC | EU482571 | DENV | anC | FJ639718 |
| DENV | anC | EU687243 | DENV | anC | EU081179 | DENV | anC | EU569707 |
| DENV | anC | EU482720 | DENV | anC | EU482690 | DENV | anC | EU677147 |
| DENV | anC | EU482730 | DENV | anC | EU687215 | DENV | anC | FM210223 |
| DENV | anC | EU482779 | DENV | anC | EU482664 | DENV | anC | EU081180 |

FIG. 70-37

| Virus | Protein | Accession No. | Virus | Protein | Accession No. | Virus | Protein | Accession No. |
|---|---|---|---|---|---|---|---|---|
| DENV | anC | EU482728 | DENV | anC | EU677149 | DENV | anC | EU482687 |
| DENV | anC | EU596500 | DENV | anC | EU569719 | DENV | anC | EU529693 |
| DENV | anC | EU482671 | DENV | anC | EU482778 | DENV | anC | FJ390384 |
| DENV | anC | EU179859 | DENV | anC | DQ645551 | DENV | anC | EU482560 |
| DENV | anC | EU482705 | DENV | anC | EU482689 | DENV | anC | EU482761 |
| DENV | anC | EU482552 | DENV | anC | EU726770 | DENV | anC | EU482638 |
| DENV | anC | EU482546 | DENV | anC | AB122022 | DENV | anC | EU482698 |
| DENV | anC | EU482642 | DENV | anC | FJ639697 | DENV | anC | EU482764 |
| DENV | anC | EU482579 | DENV | anC | EU482628 | DENV | anC | FJ182014 |
| DENV | anC | M20558 | DENV | anC | EU687232 | DENV | anC | EU482776 |
| DENV | anC | EU482775 | DENV | anC | FM210225 | DENV | anC | DQ645550 |
| DENV | anC | EU596491 | DENV | anC | AY037116 | DENV | anC | FJ024473 |
| DENV | anC | FJ639708 | DENV | anC | FJ205878 | DENV | anC | DQ181806 |
| DENV | anC | FM210220 | DENV | anC | AY702034 | DENV | anC | FJ461305 |
| DENV | anC | EU569717 | DENV | anC | FM210232 | DENV | anC | FJ024452 |
| DENV | anC | EF105379 | DENV | anC | AY702039 | DENV | anC | EU677141 |
| DENV | anC | EU569712 | DENV | anC | EU687245 | DENV | anC | FJ639828 |
| DENV | anC | EU482755 | DENV | anC | EU482465 | DENV | anC | EU569706 |
| DENV | anC | DQ181805 | DENV | anC | EU482472 | DENV | anC | EU482666 |
| DENV | anC | FM210207 | DENV | anC | EU569714 | DENV | anC | EU482673 |
| DENV | anC | FM210233 | DENV | anC | EU569692 | DENV | anC | FJ024474 |
| DENV | anC | EU687199 | DENV | anC | FJ410233 | DENV | anC | EU687214 |
| DENV | anC | EU482686 | DENV | anC | AF100467 | DENV | anC | FJ410291 |
| DENV | anC | FJ205880 | DENV | anC | EU677148 | DENV | anC | FM210242 |
| DENV | anC | AY776328 | DENV | anC | EF105380 | DENV | anC | EU687250 |
| DENV | anC | EU482675 | DENV | anC | EU482677 | DENV | anC | EU482735 |
| DENV | anC | EU660417 | DENV | anC | AF100468 | DENV | anC | EU482785 |
| DENV | anC | EU482727 | DENV | anC | EU482569 | DENV | anC | EU596483 |
| DENV | anC | EU482602 | DENV | anC | DQ645542 | DENV | anC | EU569702 |
| DENV | anC | EU482577 | DENV | anC | EU482643 | DENV | anC | FJ410241 |
| DENV | anC | EU482756 | DENV | anC | EU482694 | DENV | anC | EU482659 |
| DENV | anC | EU529701 | DENV | anC | EU482724 | DENV | anC | FM210203 |
| DENV | anC | FJ639702 | DENV | anC | EU482446 | DENV | anC | EU482581 |
| DENV | anC | EU482772 | DENV | anC | FM210226 | DENV | anC | EU569696 |
| DENV | anC | FM210246 | DENV | anC | EU482744 | DENV | anC | FJ562098 |
| DENV | anC | FJ390391 | DENV | anC | EU677137 | DENV | anC | FM210222 |
| DENV | anC | AF100464 | DENV | anC | EU482770 | DENV | anC | EU482473 |
| DENV | anC | FJ547067 | DENV | anC | AF038403 | DENV | anC | EU854294 |
| DENV | anC | EF105386 | DENV | anC | EU660398 | DENV | anC | EU482649 |
| DENV | anC | EF105387 | DENV | anC | EU569709 | DENV | anC | EU726767 |
| DENV | anC | EU726775 | DENV | anC | FM210237 | DENV | anC | FJ024454 |
| DENV | anC | FJ639704 | DENV | anC | EU660416 | DENV | anC | FJ639699 |
| DENV | anC | AF169678 | DENV | anC | EU677142 | DENV | anC | FM210204 |
| DENV | anC | EU482749 | DENV | anC | EU482700 | DENV | anC | EU529695 |
| DENV | anC | EU482631 | DENV | anC | EU482545 | DENV | anC | EU687222 |
| DENV | anC | EF105388 | DENV | anC | EU482585 | DENV | anC | EF105382 |
| DENV | anC | AB189123 | DENV | anC | FJ024475 | DENV | anC | EU482738 |
| DENV | anC | EU482663 | DENV | anC | EU482725 | DENV | anC | EF105385 |

FIG. 70-38

| Virus | Protein | Accession No. | Virus | Protein | Accession No. | Virus | Protein | Accession No. |
|---|---|---|---|---|---|---|---|---|
| DENV | anC | FM210219 | DENV | anC | GQ252676 | DENV | anC | DQ448231 |
| DENV | anC | EU482723 | DENV | anC | FJ850065 | DENV | anC | FJ744710 |
| DENV | anC | FJ639829 | DENV | anC | FJ898477 | DENV | anC | GQ252677 |
| DENV | anC | EU482575 | DENV | anC | FJ850116 | DENV | anC | NC_001474 |
| DENV | anC | AF038402 | DENV | anC | FJ898454 | DENV | anC | FJ687445 |
| DENV | anC | FJ639783 | DENV | anC | GQ199897 | DENV | anC | FJ850091 |
| DENV | anC | EU482572 | DENV | anC | GQ199899 | DENV | anC | FJ687443 |
| DENV | anC | FJ639734 | DENV | anC | FJ744723 | DENV | anC | GQ199869 |
| DENV | anC | EU482762 | DENV | anC | GQ199900 | DENV | anC | FJ850105 |
| DENV | anC | EU569704 | DENV | anC | FJ850082 | DENV | anC | FJ850051 |
| DENV | anC | EU482759 | DENV | anC | FJ744715 | DENV | anC | FJ850050 |
| DENV | anC | EU056812 | DENV | anC | FJ744709 | DENV | anC | FJ744719 |
| DENV | anC | FJ410228 | DENV | anC | GQ199868 | DENV | anC | FJ898453 |
| DENV | anC | EU482467 | DENV | anC | FJ906960 | DENV | anC | FJ898460 |
| DENV | anC | FM210217 | DENV | anC | FJ882602 | DENV | anC | FJ898438 |
| DENV | anC | FM210212 | DENV | anC | GQ199895 | DENV | anC | FJ850053 |
| DENV | anC | EU660405 | DENV | anC | FJ687436 | DENV | anC | FJ898450 |
| DENV | anC | FJ547064 | DENV | anC | FJ744725 | DENV | anC | FJ744708 |
| DENV | anC | EU482740 | DENV | anC | FJ850117 | DENV | anC | GQ199896 |
| DENV | anC | EU482451 | DENV | anC | FJ687441 | DENV | anC | FJ744722 |
| DENV | anC | EU482668 | DENV | anC | FJ744706 | DENV | anC | FJ850062 |
| DENV | anC | EU687229 | DENV | anC | FJ850074 | DENV | anC | FJ898461 |
| DENV | anC | AF169684 | DENV | anC | FJ850085 | DENV | anC | FJ810410 |
| DENV | anC | FM210235 | DENV | anC | FJ850061 | DENV | anC | FJ850060 |
| DENV | anC | GQ199874 | DENV | anC | FJ810409 | DENV | anC | FJ906961 |
| DENV | anC | FJ744745 | DENV | anC | FJ687434 | DENV | anC | FJ882593 |
| DENV | anC | FJ898467 | DENV | anC | GQ199890 | DENV | anC | FJ898479 |
| DENV | anC | FJ687444 | DENV | anC | FJ744743 | DENV | anC | FJ744703 |
| DENV | anC | FJ810411 | DENV | anC | FJ850063 | DENV | anC | FJ744712 |
| DENV | anC | FJ850067 | DENV | anC | FJ898466 | DENV | anC | FJ882594 |
| DENV | anC | FJ850121 | DENV | anC | FJ850119 | DENV | anC | FJ744716 |
| DENV | anC | FJ898452 | DENV | anC | FJ898432 | DENV | anC | FJ850066 |
| DENV | anC | FJ744713 | DENV | anC | FJ744718 | DENV | anC | FJ744744 |
| DENV | anC | FJ810418 | DENV | anC | FJ810412 | DENV | anC | FJ850108 |
| DENV | anC | FJ906962 | DENV | anC | FJ906956 | DENV | anC | FJ859028 |
| DENV | anC | FJ744721 | DENV | anC | FJ850064 | DENV | anC | FJ898465 |
| DENV | anC | FJ850107 | DENV | anC | GQ199892 | DENV | anC | FJ898451 |
| DENV | anC | FJ467493 | DENV | anC | FJ898436 | DENV | anC | FJ898449 |
| DENV | anC | FJ906966 | DENV | anC | FJ906957 | DENV | anC | FJ744705 |
| DENV | anC | FJ687446 | DENV | anC | FJ898478 | DENV | anC | FJ898434 |
| DENV | anC | FJ906958 | DENV | anC | FJ873811 | DENV | anC | FJ906969 |
| DENV | anC | FJ687435 | DENV | anC | GQ199898 | DENV | anC | FJ744741 |
| DENV | anC | FJ850054 | DENV | anC | FJ850115 | DENV | anC | FJ906959 |
| DENV | anC | FJ906967 | DENV | anC | FJ687442 | DENV | anC | FJ850106 |
| DENV | anC | FJ850072 | DENV | anC | FJ687439 | DENV | anC | FJ744742 |
| DENV | anC | FJ898439 | DENV | anC | FJ432724 | DENV | anC | FJ687437 |
| DENV | anC | FJ850088 | DENV | anC | FJ687447 | DENV | anC | FJ744707 |
| DENV | anC | FJ898435 | DENV | anC | FJ873808 | DENV | anC | FJ687438 |

FIG. 70-39

| Virus | Protein | Accession No. | Virus | Protein | Accession No. | Virus | Protein | Accession No. |
|---|---|---|---|---|---|---|---|---|
| DENV | anC | FJ744714 | DENV | anC | GQ868638 | DENV | anC | GU131897 |
| DENV | anC | GQ199866 | DENV | anC | GQ868553 | DENV | anC | GQ868592 |
| DENV | anC | GQ199894 | DENV | anC | GQ868646 | DENV | anC | GQ868552 |
| DENV | anC | FJ687440 | DENV | anC | FN429891 | DENV | anC | GU131900 |
| DENV | anC | FJ850112 | DENV | anC | GQ868604 | DENV | anC | GQ868599 |
| DENV | anC | FJ850078 | DENV | anC | GU131947 | DENV | anC | GU131929 |
| DENV | anC | FJ744717 | DENV | anC | GU131928 | DENV | anC | GU131930 |
| DENV | anC | FJ906968 | DENV | anC | GQ868497 | DENV | anC | GQ868550 |
| DENV | anC | GQ199893 | DENV | anC | GQ868603 | DENV | anC | GU131975 |
| DENV | anC | FJ744711 | DENV | anC | GQ868621 | DENV | anC | GU131927 |
| DENV | anC | FJ744704 | DENV | anC | AB479042 | DENV | anC | GQ868540 |
| DENV | anC | FJ744720 | DENV | anC | GQ868620 | DENV | anC | FJ410202 |
| DENV | anC | GQ199901 | DENV | anC | GQ868590 | DENV | anC | CS479202 |
| DENV | anC | FJ744724 | DENV | anC | FN429892 | DENV | anC | U87411 |
| DENV | anC | FJ850120 | DENV | anC | GQ868554 | DENV | anC | CS479203 |
| DENV | anC | FJ850118 | DENV | anC | GU131974 | DENV | anC | CS479204 |
| DENV | anC | FJ850076 | DENV | anC | GU131843 | DENV | anC | CS479167 |
| DENV | anC | AF022436 | DENV | anC | GQ868641 | DENV | anC | CS479205 |
| DENV | anC | AF022439 | DENV | anC | GQ868542 | DENV | anC | CS479206 |
| DENV | anC | AF022441 | DENV | anC | GQ868555 | DENV | anC | CS805344 |
| DENV | anC | AF022437 | DENV | anC | FN429894 | DENV | anC | FB730117 |
| DENV | anC | AJ487271 | DENV | anC | GQ868549 | DENV | anC | DL138662 |
| DENV | anC | AF022435 | DENV | anC | GQ868588 | DENV | anC | GM059692 |
| DENV | anC | AF022434 | DENV | anC | GQ868541 | DENV | anC | AY243468 |
| DENV | anC | AF022438 | DENV | anC | GQ868558 | DENV | anC | AY243469 |
| DENV | anC | AF022440 | DENV | anC | GQ868625 | DENV | anC | AY744148 |
| DENV | anC | CS479165 | DENV | anC | GQ868624 | DENV | anC | AY744149 |
| DENV | anC | GQ868556 | DENV | anC | GQ868631 | DENV | anC | AY744150 |
| DENV | anC | AB479041 | DENV | anC | GU131899 | DENV | anC | AJ968413 |
| DENV | anC | GU289914 | DENV | anC | GQ868515 | DENV | anC | GU369819 |
| DENV | anC | GU131884 | DENV | anC | GU131898 | DENV | anC | GU370050 |
| DENV | anC | GQ868600 | DENV | anC | GQ868623 | DENV | anC | GU370051 |
| DENV | anC | FN429895 | DENV | anC | GU131886 | DENV | E | AY277665 |
| DENV | anC | GU131879 | DENV | anC | GQ868622 | DENV | E | AY713474 |
| DENV | anC | GQ868596 | DENV | anC | GQ868595 | DENV | E | AF311957 |
| DENV | anC | GQ868516 | DENV | anC | GQ868557 | DENV | E | FJ205881 |
| DENV | anC | GU131864 | DENV | anC | GU131959 | DENV | E | EU482817 |
| DENV | anC | FN429893 | DENV | anC | GU131955 | DENV | E | DQ672557 |
| DENV | anC | GQ868598 | DENV | anC | GQ868597 | DENV | E | EU677151 |
| DENV | anC | GQ868544 | DENV | anC | GU131883 | DENV | E | FJ410256 |
| DENV | anC | GQ868589 | DENV | anC | GQ868591 | DENV | E | FJ432735 |
| DENV | anC | GQ868551 | DENV | anC | GQ868543 | DENV | E | EU660390 |
| DENV | anC | GU131902 | DENV | anC | GU131901 | DENV | E | EU482824 |
| DENV | anC | GU131896 | DENV | anC | GQ868545 | DENV | E | FJ410222 |
| DENV | anC | GU131924 | DENV | anC | GU131931 | DENV | E | AY726551 |
| DENV | anC | GQ868640 | DENV | anC | GU131885 | DENV | E | EU482716 |
| DENV | anC | GU131880 | DENV | anC | GU131932 | DENV | E | AF226685 |
| DENV | anC | GU131882 | DENV | anC | GU131881 | DENV | E | EU677174 |

FIG. 70-40

| Virus | Protein | Accession No. | Virus | Protein | Accession No. | Virus | Protein | Accession No. |
|---|---|---|---|---|---|---|---|---|
| DENV | E | FJ639693 | DENV | E | DQ285560 | DENV | E | EU081238 |
| DENV | E | FJ461317 | DENV | E | FJ182002 | DENV | E | FJ410245 |
| DENV | E | FJ384655 | DENV | E | EU677177 | DENV | E | FJ461318 |
| DENV | E | EU482508 | DENV | E | FJ639680 | DENV | E | FJ410263 |
| DENV | E | AF311958 | DENV | E | EU677160 | DENV | E | FJ410269 |
| DENV | E | FJ024451 | DENV | E | AY835999 | DENV | E | FJ410289 |
| DENV | E | EU482528 | DENV | E | EU249494 | DENV | E | FJ639692 |
| DENV | E | EU482821 | DENV | E | AF226687 | DENV | E | EU660397 |
| DENV | E | FJ410267 | DENV | E | FJ024432 | DENV | E | EU482477 |
| DENV | E | AB074761 | DENV | E | EU081229 | DENV | E | FJ024434 |
| DENV | E | AY762084 | DENV | E | FJ410184 | DENV | E | FJ410204 |
| DENV | E | AY732480 | DENV | E | FJ182022 | DENV | E | EU249495 |
| DENV | E | EU482481 | DENV | E | EU677153 | DENV | E | AF513110 |
| DENV | E | FJ410232 | DENV | E | DQ672559 | DENV | E | FJ024438 |
| DENV | E | EU081254 | DENV | E | EU081234 | DENV | E | EU081264 |
| DENV | E | EU482806 | DENV | E | FJ639802 | DENV | E | EU482525 |
| DENV | E | FJ410257 | DENV | E | EU482483 | DENV | E | EU687251 |
| DENV | E | FJ432720 | DENV | E | FJ024445 | DENV | E | EU482486 |
| DENV | E | FJ547089 | DENV | E | FJ410236 | DENV | E | DQ285558 |
| DENV | E | EU482819 | DENV | E | FJ410242 | DENV | E | FJ205883 |
| DENV | E | EU081270 | DENV | E | FJ390378 | DENV | E | AY145121 |
| DENV | E | FJ205875 | DENV | E | EU081236 | DENV | E | AY732478 |
| DENV | E | FJ410210 | DENV | E | EU081278 | DENV | E | FJ410199 |
| DENV | E | FJ205884 | DENV | E | FJ432736 | DENV | E | FJ390383 |
| DENV | E | FJ176780 | DENV | E | FJ639694 | DENV | E | EU482592 |
| DENV | E | FJ461340 | DENV | E | EU482500 | DENV | E | FJ182030 |
| DENV | E | AY732475 | DENV | E | DQ672560 | DENV | E | FJ024431 |
| DENV | E | AY732474 | DENV | E | AY713473 | DENV | E | FJ024450 |
| DENV | E | FJ024435 | DENV | E | EU726780 | DENV | E | FJ410252 |
| DENV | E | FJ639669 | DENV | E | FJ410255 | DENV | E | FJ478457 |
| DENV | E | EU482540 | DENV | E | FJ373298 | DENV | E | EU596502 |
| DENV | E | FJ024429 | DENV | E | EU081276 | DENV | E | FJ410201 |
| DENV | E | EU677167 | DENV | E | FJ410198 | DENV | E | FJ562105 |
| DENV | E | EU482512 | DENV | E | EU482536 | DENV | E | FJ639684 |
| DENV | E | FJ390381 | DENV | E | FJ390382 | DENV | E | FJ639682 |
| DENV | E | FJ410226 | DENV | E | FJ024462 | DENV | E | FJ410240 |
| DENV | E | FJ410191 | DENV | E | EU482822 | DENV | E | EU081279 |
| DENV | E | AJ968413 | DENV | E | FJ024447 | DENV | E | EU081231 |
| DENV | E | FJ639689 | DENV | E | FJ410274 | DENV | E | FJ410214 |
| DENV | E | AY277664 | DENV | E | FJ410216 | DENV | E | FJ182036 |
| DENV | E | FJ639811 | DENV | E | EU482527 | DENV | E | FJ182023 |
| DENV | E | FJ639695 | DENV | E | EU280167 | DENV | E | EU482479 |
| DENV | E | EU081226 | DENV | E | EU482567 | DENV | E | FJ547087 |
| DENV | E | FJ410280 | DENV | E | EU081265 | DENV | E | FJ639683 |
| DENV | E | EU596504 | DENV | E | EU482489 | DENV | E | FJ024442 |
| DENV | E | FJ639685 | DENV | E | AB178040 | DENV | E | FJ410285 |
| DENV | E | EU482715 | DENV | E | EU482827 | DENV | E | EU482615 |
| DENV | E | FJ410227 | DENV | E | FJ024455 | DENV | E | AY732476 |

FIG. 70-41

| Virus | Protein | Accession No. | Virus | Protein | Accession No. | Virus | Protein | Accession No. |
|---|---|---|---|---|---|---|---|---|
| DENV | E | FJ024463 | DENV | E | AY277666 | DENV | E | EU677169 |
| DENV | E | FJ410275 | DENV | E | FJ024483 | DENV | E | EU482828 |
| DENV | E | FJ410234 | DENV | E | DQ193572 | DENV | E | EU482537 |
| DENV | E | EU482487 | DENV | E | EF122231 | DENV | E | EU726782 |
| DENV | E | FJ410182 | DENV | E | EU081266 | DENV | E | FJ410225 |
| DENV | E | EU482812 | DENV | E | EU482818 | DENV | E | FJ410180 |
| DENV | E | EU081247 | DENV | E | FJ410186 | DENV | E | FJ024460 |
| DENV | E | AB074760 | DENV | E | EU249493 | DENV | E | FJ410231 |
| DENV | E | EU482802 | DENV | E | FJ024478 | DENV | E | FJ390380 |
| DENV | E | EU677172 | DENV | E | FJ205874 | DENV | E | FJ410238 |
| DENV | E | EU482496 | DENV | E | EU482791 | DENV | E | FJ390379 |
| DENV | E | EU726777 | DENV | E | EU482798 | DENV | E | AF311956 |
| DENV | E | U88535 | DENV | E | EU081248 | DENV | E | EU081257 |
| DENV | E | EU482519 | DENV | E | EU596501 | DENV | E | FJ432721 |
| DENV | E | FJ461339 | DENV | E | FJ461336 | DENV | E | FJ639672 |
| DENV | E | FJ562101 | DENV | E | FJ024457 | DENV | E | FJ639794 |
| DENV | E | FJ461316 | DENV | E | EU482485 | DENV | E | EU660403 |
| DENV | E | EU482814 | DENV | E | FJ176779 | DENV | E | EU482619 |
| DENV | E | AY726555 | DENV | E | EU482799 | DENV | E | EU677155 |
| DENV | E | FJ639677 | DENV | E | EU081233 | DENV | E | FJ182021 |
| DENV | E | EU482506 | DENV | E | EU482497 | DENV | E | EU482712 |
| DENV | E | FJ410283 | DENV | E | EU482616 | DENV | E | EU482591 |
| DENV | E | FJ639696 | DENV | E | EU482507 | DENV | E | FJ410253 |
| DENV | E | FJ410235 | DENV | E | EU482809 | DENV | E | EF032590 |
| DENV | E | EU482532 | DENV | E | FJ410262 | DENV | E | EU081243 |
| DENV | E | FJ182031 | DENV | E | FJ024480 | DENV | E | FJ639818 |
| DENV | E | FJ024428 | DENV | E | EU482495 | DENV | E | EU081237 |
| DENV | E | FJ432749 | DENV | E | FJ182032 | DENV | E | AF514876 |
| DENV | E | DQ285561 | DENV | E | FJ410197 | DENV | E | FJ639688 |
| DENV | E | EU482518 | DENV | E | AF514883 | DENV | E | EU482713 |
| DENV | E | EU726779 | DENV | E | FJ461330 | DENV | E | EU677154 |
| DENV | E | EU677161 | DENV | E | FJ639690 | DENV | E | EU081242 |
| DENV | E | AY145123 | DENV | E | FJ410209 | DENV | E | EU687247 |
| DENV | E | EU482800 | DENV | E | EU482514 | DENV | E | AY726552 |
| DENV | E | AY732482 | DENV | E | EU848545 | DENV | E | FJ024436 |
| DENV | E | EU482517 | DENV | E | EU249492 | DENV | E | FJ639681 |
| DENV | E | EU482488 | DENV | E | EU081240 | DENV | E | EU482484 |
| DENV | E | FJ373305 | DENV | E | EU482499 | DENV | E | EU482815 |
| DENV | E | FJ432746 | DENV | E | FJ410281 | DENV | E | EU249490 |
| DENV | E | FJ432734 | DENV | E | FJ410270 | DENV | E | EU081253 |
| DENV | E | EU482797 | DENV | E | EU482808 | DENV | E | AY726549 |
| DENV | E | EU482711 | DENV | E | EU081281 | DENV | E | EU677166 |
| DENV | E | FJ024459 | DENV | E | AF309641 | DENV | E | FJ639821 |
| DENV | E | FJ410174 | DENV | E | EU677159 | DENV | E | FJ024430 |
| DENV | E | EU596503 | DENV | E | EU482526 | DENV | E | FJ410183 |
| DENV | E | FJ432730 | DENV | E | FJ024427 | DENV | E | EU081267 |
| DENV | E | EU081227 | DENV | E | EU482618 | DENV | E | EU482491 |
| DENV | E | EU677163 | DENV | E | AF350498 | DENV | E | EU081249 |

FIG. 70-42

| Virus | Protein | Accession No. | Virus | Protein | Accession No. | Virus | Protein | Accession No. |
|---|---|---|---|---|---|---|---|---|
| DENV | E | EU081252 | DENV | E | EU482513 | DENV | E | FJ432740 |
| DENV | E | EU482706 | DENV | E | FJ410196 | DENV | E | AY726554 |
| DENV | E | AY726553 | DENV | E | FJ410250 | DENV | E | FJ024441 |
| DENV | E | FJ205882 | DENV | E | EU660392 | DENV | E | DQ672556 |
| DENV | E | FJ390386 | DENV | E | FJ461313 | DENV | E | FJ410272 |
| DENV | E | EU677139 | DENV | E | EU677168 | DENV | E | FJ639676 |
| DENV | E | FJ410260 | DENV | E | FJ432723 | DENV | E | FJ639686 |
| DENV | E | EU677170 | DENV | E | FJ410181 | DENV | E | EU482498 |
| DENV | E | EU081256 | DENV | E | FJ410239 | DENV | E | FJ432725 |
| DENV | E | FJ024443 | DENV | E | EU482480 | DENV | E | EU482529 |
| DENV | E | FJ410278 | DENV | E | AY206457 | DENV | E | FJ547086 |
| DENV | E | FJ432744 | DENV | E | EU482523 | DENV | E | FJ461323 |
| DENV | E | AB189120 | DENV | E | FJ410290 | DENV | E | FJ410230 |
| DENV | E | FJ461327 | DENV | E | DQ672562 | DENV | E | FJ410248 |
| DENV | E | EU660391 | DENV | E | EU482521 | DENV | E | EU482609 |
| DENV | E | FJ562106 | DENV | E | EU660402 | DENV | E | FJ639824 |
| DENV | E | FJ182035 | DENV | E | FJ461307 | DENV | E | FJ410279 |
| DENV | E | FJ461306 | DENV | E | EU081272 | DENV | E | EU482535 |
| DENV | E | EU482510 | DENV | E | FJ461315 | DENV | E | FJ024453 |
| DENV | E | FJ024440 | DENV | E | FJ410188 | DENV | E | FJ432748 |
| DENV | E | EU081258 | DENV | E | AY713475 | DENV | E | EU660393 |
| DENV | E | EU081268 | DENV | E | AY732479 | DENV | E | AY145122 |
| DENV | E | EU677178 | DENV | E | EU677156 | DENV | E | FJ024446 |
| DENV | E | FJ410276 | DENV | E | EU482707 | DENV | E | FJ432747 |
| DENV | E | EU081273 | DENV | E | EU482811 | DENV | E | FJ410205 |
| DENV | E | EU482820 | DENV | E | AF226686 | DENV | E | FJ205876 |
| DENV | E | AF514878 | DENV | E | EU081235 | DENV | E | FJ410211 |
| DENV | E | EU660394 | DENV | E | EU660419 | DENV | E | FJ182025 |
| DENV | E | FJ410218 | DENV | E | FJ547068 | DENV | E | FJ182026 |
| DENV | E | EU081241 | DENV | E | AB189121 | DENV | E | FJ373296 |
| DENV | E | FJ410244 | DENV | E | FJ461308 | DENV | E | AY722802 |
| DENV | E | EU482789 | DENV | E | FJ410213 | DENV | E | EU482522 |
| DENV | E | EU482524 | DENV | E | AY726550 | DENV | E | FJ390388 |
| DENV | E | EU081261 | DENV | E | AY732477 | DENV | E | EU677173 |
| DENV | E | FJ639812 | DENV | E | EU660401 | DENV | E | EU081277 |
| DENV | E | EU482533 | DENV | E | FJ639815 | DENV | E | EU482492 |
| DENV | E | DQ285559 | DENV | E | FJ410268 | DENV | E | FJ432732 |
| DENV | E | FJ410246 | DENV | E | FJ478458 | DENV | E | FJ639691 |
| DENV | E | FJ461310 | DENV | E | FJ639808 | DENV | E | EU482511 |
| DENV | E | AB195673 | DENV | E | EU482611 | DENV | E | EU081230 |
| DENV | E | FJ182024 | DENV | E | FJ410261 | DENV | E | FJ410206 |
| DENV | E | AB204803 | DENV | E | FJ432729 | DENV | E | FJ410189 |
| DENV | E | EF025110 | DENV | E | FJ639813 | DENV | E | FJ182019 |
| DENV | E | DQ672564 | DENV | E | EU482520 | DENV | E | FJ024472 |
| DENV | E | EU726778 | DENV | E | AF514885 | DENV | E | FJ205872 |
| DENV | E | EF457905 | DENV | E | FJ639673 | DENV | E | FJ410282 |
| DENV | E | FJ547088 | DENV | E | FJ410266 | DENV | E | EU482538 |
| DENV | E | FJ024437 | DENV | E | EU482805 | DENV | E | EU660418 |

FIG. 70-43

| Virus | Protein | Accession No. | Virus | Protein | Accession No. | Virus | Protein | Accession No. |
|---|---|---|---|---|---|---|---|---|
| DENV | E | FJ639819 | DENV | E | FJ182028 | DENV | E | AF180817 |
| DENV | E | FJ639806 | DENV | E | EU677152 | DENV | E | AY722801 |
| DENV | E | FJ432738 | DENV | E | EU081228 | DENV | E | EU482504 |
| DENV | E | FJ432719 | DENV | E | FJ410173 | DENV | E | FJ639675 |
| DENV | E | FJ461303 | DENV | E | EU482796 | DENV | E | FJ024433 |
| DENV | E | FJ410203 | DENV | E | EU726781 | DENV | E | FJ461331 |
| DENV | E | FJ410194 | DENV | E | FJ410207 | DENV | E | FJ410187 |
| DENV | E | EU081244 | DENV | E | FJ410243 | DENV | E | FJ410258 |
| DENV | E | EU482482 | DENV | E | EU081239 | DENV | E | AY708047 |
| DENV | E | FJ410179 | DENV | E | EU482816 | DENV | E | FJ024423 |
| DENV | E | AY722803 | DENV | E | EU081260 | DENV | E | FJ024484 |
| DENV | E | EU482539 | DENV | E | FJ182029 | DENV | E | EU081251 |
| DENV | E | FJ639671 | DENV | E | FJ024449 | DENV | E | FJ410249 |
| DENV | E | EU482478 | DENV | E | EU081250 | DENV | E | EU482610 |
| DENV | E | FJ547060 | DENV | E | EU482825 | DENV | E | FJ182033 |
| DENV | E | FJ432739 | DENV | E | EU482530 | DENV | E | EU482493 |
| DENV | E | FJ639740 | DENV | E | FJ639820 | DENV | E | EU482807 |
| DENV | E | FJ182034 | DENV | E | EU677175 | DENV | E | FJ639814 |
| DENV | E | EU482710 | DENV | E | FJ410251 | DENV | E | EU482501 |
| DENV | E | EU081232 | DENV | E | EU482794 | DENV | E | FJ410254 |
| DENV | E | EU482515 | DENV | E | EU359008 | DENV | E | EU081246 |
| DENV | E | EU482531 | DENV | E | AF180818 | DENV | E | EU081275 |
| DENV | E | AF298807 | DENV | E | EU660396 | DENV | E | FJ410264 |
| DENV | E | FJ205873 | DENV | E | FJ182003 | DENV | E | FJ024479 |
| DENV | E | FJ639674 | DENV | E | EU482476 | DENV | E | FJ410185 |
| DENV | E | FJ547065 | DENV | E | EU482505 | DENV | E | FJ410273 |
| DENV | E | FJ410212 | DENV | E | EU081255 | DENV | E | EU482801 |
| DENV | E | FJ461341 | DENV | E | FJ639743 | DENV | E | AY713476 |
| DENV | E | EU081259 | DENV | E | U88537 | DENV | E | FJ461312 |
| DENV | E | FJ639823 | DENV | E | FJ432733 | DENV | E | FJ639797 |
| DENV | E | FJ410190 | DENV | E | EU660395 | DENV | E | FJ461319 |
| DENV | E | FJ432745 | DENV | E | EU081263 | DENV | E | FJ461333 |
| DENV | E | FJ410175 | DENV | E | EU482826 | DENV | E | EU482516 |
| DENV | E | EU677176 | DENV | E | FJ410192 | DENV | E | EU482792 |
| DENV | E | FJ639679 | DENV | E | FJ182020 | DENV | E | AF514889 |
| DENV | E | FJ432742 | DENV | E | DQ672561 | DENV | E | EU482509 |
| DENV | E | FJ639670 | DENV | E | FJ024481 | DENV | E | FJ432737 |
| DENV | E | FJ182027 | DENV | E | EU677165 | DENV | E | FJ547063 |
| DENV | E | EU482718 | DENV | E | FJ410287 | DENV | E | FJ373297 |
| DENV | E | EU677158 | DENV | E | EU482502 | DENV | E | EU677157 |
| DENV | E | FJ639687 | DENV | E | EU081274 | DENV | E | EU482534 |
| DENV | E | FJ461325 | DENV | E | FJ024448 | DENV | E | EU249491 |
| DENV | E | FJ024444 | DENV | E | FJ024425 | DENV | E | DQ285562 |
| DENV | E | EU482617 | DENV | E | FJ639741 | DENV | E | EU482793 |
| DENV | E | FJ639678 | DENV | E | FJ562104 | DENV | E | EU482717 |
| DENV | E | EU081269 | DENV | E | DQ672563 | DENV | E | FJ024439 |
| DENV | E | EU482714 | DENV | E | EU482708 | DENV | E | EU482804 |
| DENV | E | FJ024456 | DENV | E | FJ410247 | DENV | E | EU482503 |

FIG. 70-44

| Virus | Protein | Accession No. | Virus | Protein | Accession No. | Virus | Protein | Accession No. |
|---|---|---|---|---|---|---|---|---|
| DENV | E | EU677162 | DENV | E | FJ882563 | DENV | E | FJ882550 |
| DENV | E | FJ024485 | DENV | E | GQ199812 | DENV | E | FJ744701 |
| DENV | E | EU081271 | DENV | E | FJ873810 | DENV | E | FJ898391 |
| DENV | E | FJ024426 | DENV | E | FJ898397 | DENV | E | FJ898417 |
| DENV | E | EU482790 | DENV | E | FJ898400 | DENV | E | GQ199806 |
| DENV | E | FJ410286 | DENV | E | FJ687433 | DENV | E | GQ199794 |
| DENV | E | FJ639735 | DENV | E | GQ199877 | DENV | E | FJ898425 |
| DENV | E | EU482494 | DENV | E | GQ199788 | DENV | E | FJ898393 |
| DENV | E | FJ390374 | DENV | E | GQ199823 | DENV | E | GQ199799 |
| DENV | E | EU482813 | DENV | E | FJ898407 | DENV | E | GQ199833 |
| DENV | E | FJ461335 | DENV | E | GQ199804 | DENV | E | GQ199781 |
| DENV | E | EU482803 | DENV | E | FJ882533 | DENV | E | GQ199797 |
| DENV | E | EU482490 | DENV | E | GQ199818 | DENV | E | FJ882522 |
| DENV | E | FJ024482 | DENV | E | FJ882560 | DENV | E | FJ906964 |
| DENV | E | FJ410284 | DENV | E | FJ898415 | DENV | E | GQ199821 |
| DENV | E | EU081280 | DENV | E | FJ850113 | DENV | E | GQ199847 |
| DENV | E | EU677150 | DENV | E | FJ898384 | DENV | E | FJ882524 |
| DENV | E | AY732481 | DENV | E | FJ882538 | DENV | E | FJ850077 |
| DENV | E | FJ461324 | DENV | E | FJ882521 | DENV | E | FJ882552 |
| DENV | E | FJ639796 | DENV | E | GQ199811 | DENV | E | GQ199778 |
| DENV | E | EU482709 | DENV | E | FJ850075 | DENV | E | FJ882549 |
| DENV | E | AF298808 | DENV | E | GQ199848 | DENV | E | GQ199816 |
| DENV | E | FJ182018 | DENV | E | FJ898378 | DENV | E | GQ199824 |
| DENV | E | DQ672558 | DENV | E | FJ873814 | DENV | E | FJ898398 |
| DENV | E | EU482795 | DENV | E | FJ898410 | DENV | E | FJ859029 |
| DENV | E | EU677164 | DENV | E | FJ882528 | DENV | E | FJ882515 |
| DENV | E | FJ410277 | DENV | E | FJ898382 | DENV | E | GQ199820 |
| DENV | E | FJ024464 | DENV | E | FJ898404 | DENV | E | GQ199867 |
| DENV | E | FJ461332 | DENV | E | FJ687426 | DENV | E | FJ898448 |
| DENV | E | EF122232 | DENV | E | FJ898371 | DENV | E | FJ882556 |
| DENV | E | FJ432727 | DENV | E | GQ199872 | DENV | E | FJ882536 |
| DENV | E | EU482823 | DENV | E | GQ199855 | DENV | E | GQ199796 |
| DENV | E | EU482810 | DENV | E | FJ882535 | DENV | E | FJ882570 |
| DENV | E | EU081245 | DENV | E | NC_001477 | DENV | E | FJ898376 |
| DENV | E | EU081262 | DENV | E | FJ898423 | DENV | E | GQ199771 |
| DENV | E | EU863650 | DENV | E | FJ882565 | DENV | E | FJ850069 |
| DENV | E | AY732483 | DENV | E | FJ882517 | DENV | E | FJ850102 |
| DENV | E | FJ410265 | DENV | E | GQ199814 | DENV | E | GQ199834 |
| DENV | E | EU660412 | DENV | E | FJ898395 | DENV | E | FJ898388 |
| DENV | E | EU677171 | DENV | E | GQ199851 | DENV | E | GQ199830 |
| DENV | E | EU677140 | DENV | E | GQ199837 | DENV | E | GQ199839 |
| DENV | E | FJ898428 | DENV | E | FJ882558 | DENV | E | GQ199777 |
| DENV | E | FJ882569 | DENV | E | FJ850084 | DENV | E | FJ882579 |
| DENV | E | GQ199776 | DENV | E | FJ898374 | DENV | E | FJ898429 |
| DENV | E | GQ199853 | DENV | E | FJ850104 | DENV | E | FJ882541 |
| DENV | E | GQ199803 | DENV | E | GQ199815 | DENV | E | FJ898402 |
| DENV | E | FJ882554 | DENV | E | GQ199843 | DENV | E | GQ199808 |
| DENV | E | FJ873809 | DENV | E | GQ199826 | DENV | E | GQ199786 |

FIG. 70-45

| Virus | Protein | Accession No. | Virus | Protein | Accession No. | Virus | Protein | Accession No. |
|---|---|---|---|---|---|---|---|---|
| DENV | E | FJ882547 | DENV | E | FJ744702 | DENV | E | FJ898408 |
| DENV | E | GQ199798 | DENV | E | FJ898386 | DENV | E | FJ810419 |
| DENV | E | GQ199844 | DENV | E | FJ882542 | DENV | E | GQ199793 |
| DENV | E | GQ199829 | DENV | E | GQ199782 | DENV | E | FJ882562 |
| DENV | E | FJ882530 | DENV | E | GQ199852 | DENV | E | FJ898424 |
| DENV | E | FJ898422 | DENV | E | FJ898421 | DENV | E | FJ898389 |
| DENV | E | FJ810415 | DENV | E | FJ687432 | DENV | E | FJ898412 |
| DENV | E | FJ898411 | DENV | E | GQ199813 | DENV | E | FJ882537 |
| DENV | E | GQ199856 | DENV | E | FJ882534 | DENV | E | FJ898418 |
| DENV | E | FJ850101 | DENV | E | GQ199854 | DENV | E | FJ898394 |
| DENV | E | FJ850093 | DENV | E | GQ199846 | DENV | E | GQ199849 |
| DENV | E | FJ882551 | DENV | E | FJ882539 | DENV | E | FJ882548 |
| DENV | E | GQ199795 | DENV | E | FJ898437 | DENV | E | FJ906963 |
| DENV | E | FJ850100 | DENV | E | FJ898390 | DENV | E | FJ906965 |
| DENV | E | FJ898416 | DENV | E | FJ898405 | DENV | E | GQ199873 |
| DENV | E | GQ199785 | DENV | E | GQ199783 | DENV | E | FJ850073 |
| DENV | E | GQ199784 | DENV | E | FJ882526 | DENV | E | FJ850071 |
| DENV | E | GQ199828 | DENV | E | FJ461320 | DENV | E | GQ199772 |
| DENV | E | GQ199780 | DENV | E | FJ898420 | DENV | E | FJ898373 |
| DENV | E | FJ850103 | DENV | E | FJ687431 | DENV | E | FJ687429 |
| DENV | E | FJ882555 | DENV | E | GQ199801 | DENV | E | FJ898379 |
| DENV | E | FJ882561 | DENV | E | FJ906728 | DENV | E | FJ882566 |
| DENV | E | FJ687430 | DENV | E | FJ882544 | DENV | E | FJ898396 |
| DENV | E | FJ898381 | DENV | E | FJ882553 | DENV | E | FJ882529 |
| DENV | E | FJ882518 | DENV | E | FJ882531 | DENV | E | GQ199838 |
| DENV | E | FJ898392 | DENV | E | GQ199810 | DENV | E | GQ199779 |
| DENV | E | FJ898380 | DENV | E | GQ199825 | DENV | E | GQ199827 |
| DENV | E | GQ199835 | DENV | E | FJ882546 | DENV | E | GQ199836 |
| DENV | E | FJ898430 | DENV | E | FJ882568 | DENV | E | GQ199858 |
| DENV | E | FJ850087 | DENV | E | FJ898413 | DENV | E | GQ199787 |
| DENV | E | FJ898385 | DENV | E | GQ199773 | DENV | E | FJ850068 |
| DENV | E | GQ199857 | DENV | E | GQ199822 | DENV | E | FJ882564 |
| DENV | E | FJ898403 | DENV | E | GQ199832 | DENV | E | FJ898419 |
| DENV | E | GQ199800 | DENV | E | GQ199790 | DENV | E | FJ898383 |
| DENV | E | FJ882540 | DENV | E | GQ199841 | DENV | E | FJ461328 |
| DENV | E | GQ199792 | DENV | E | FJ882520 | DENV | E | FJ882527 |
| DENV | E | FJ882516 | DENV | E | GQ199875 | DENV | E | FJ898427 |
| DENV | E | GQ199850 | DENV | E | GQ199802 | DENV | E | FJ882525 |
| DENV | E | FJ898372 | DENV | E | GQ199791 | DENV | E | FJ882557 |
| DENV | E | GQ199775 | DENV | E | FJ898426 | DENV | E | GQ199859 |
| DENV | E | FJ882559 | DENV | E | FJ898431 | DENV | E | GQ199842 |
| DENV | E | GQ199789 | DENV | E | GQ199809 | DENV | E | GQ199817 |
| DENV | E | FJ850099 | DENV | E | FJ898406 | DENV | E | FJ898401 |
| DENV | E | FJ850114 | DENV | E | GQ199805 | DENV | E | FJ882519 |
| DENV | E | GQ199819 | DENV | E | GQ199831 | DENV | E | FJ850090 |
| DENV | E | FJ882523 | DENV | E | FJ850070 | DENV | E | FJ898377 |
| DENV | E | GQ199845 | DENV | E | GQ199807 | DENV | E | GQ199774 |
| DENV | E | FJ850081 | DENV | E | FJ882543 | DENV | E | FJ898399 |

FIG. 70-46

| Virus | Protein | Accession No. | Virus | Protein | Accession No. | Virus | Protein | Accession No. |
|---|---|---|---|---|---|---|---|---|
| DENV | E | GQ199840 | DENV | E | GU131804 | DENV | E | GU131745 |
| DENV | E | FJ898433 | DENV | E | GU131762 | DENV | E | GQ868635 |
| DENV | E | FJ882567 | DENV | E | GU131827 | DENV | E | GU056032 |
| DENV | E | FJ898387 | DENV | E | GU131837 | DENV | E | GQ868610 |
| DENV | E | FJ882532 | DENV | E | GQ868630 | DENV | E | GU131889 |
| DENV | E | FJ898409 | DENV | E | GU131767 | DENV | E | GQ868499 |
| DENV | E | FJ882545 | DENV | E | GU131737 | DENV | E | GU131756 |
| DENV | E | FJ898375 | DENV | E | GQ868500 | DENV | E | GU131786 |
| DENV | E | FJ898414 | DENV | E | GU131722 | DENV | E | GQ868565 |
| DENV | E | CS477306 | DENV | E | GQ868607 | DENV | E | GU131709 |
| DENV | E | A75711 | DENV | E | GQ868517 | DENV | E | GQ868569 |
| DENV | E | GU131816 | DENV | E | GU131727 | DENV | E | GU131723 |
| DENV | E | FJ469907 | DENV | E | GU131715 | DENV | E | GU131696 |
| DENV | E | GU131814 | DENV | E | FN429885 | DENV | E | GQ868519 |
| DENV | E | GU131725 | DENV | E | GU131780 | DENV | E | GU131838 |
| DENV | E | GU131822 | DENV | E | GU131750 | DENV | E | GQ868520 |
| DENV | E | GQ868633 | DENV | E | GU131787 | DENV | E | GU131791 |
| DENV | E | GU131820 | DENV | E | GU056031 | DENV | E | GU131765 |
| DENV | E | GU131679 | DENV | E | GQ868602 | DENV | E | GU131702 |
| DENV | E | GQ868507 | DENV | E | GU131711 | DENV | E | GU131682 |
| DENV | E | GU131789 | DENV | E | GQ868567 | DENV | E | GU131801 |
| DENV | E | GU131710 | DENV | E | GU131813 | DENV | E | GQ868562 |
| DENV | E | FN429887 | DENV | E | FJ687428 | DENV | E | GU131684 |
| DENV | E | GU131720 | DENV | E | GU131707 | DENV | E | GU131744 |
| DENV | E | GU131841 | DENV | E | GU131689 | DENV | E | GQ868534 |
| DENV | E | GQ868564 | DENV | E | GU131700 | DENV | E | GU131687 |
| DENV | E | AB519681 | DENV | E | GU131798 | DENV | E | GQ868529 |
| DENV | E | GU131743 | DENV | E | GU131713 | DENV | E | GU131840 |
| DENV | E | GQ868522 | DENV | E | GU131829 | DENV | E | GU131808 |
| DENV | E | GU131739 | DENV | E | GU131782 | DENV | E | GU131922 |
| DENV | E | GU131971 | DENV | E | GU131698 | DENV | E | GU131836 |
| DENV | E | GU131834 | DENV | E | GU131732 | DENV | E | GQ868613 |
| DENV | E | GQ868523 | DENV | E | GU131772 | DENV | E | GU131721 |
| DENV | E | GU131982 | DENV | E | GU131978 | DENV | E | GU131730 |
| DENV | E | GU131965 | DENV | E | GU131958 | DENV | E | GU131968 |
| DENV | E | GU131760 | DENV | E | GU131811 | DENV | E | GU131832 |
| DENV | E | GQ868535 | DENV | E | GQ868506 | DENV | E | GU131774 |
| DENV | E | GU131962 | DENV | E | GQ868525 | DENV | E | GU131976 |
| DENV | E | GU131891 | DENV | E | GQ868538 | DENV | E | GU131831 |
| DENV | E | GQ868504 | DENV | E | FJ469909 | DENV | E | GQ868501 |
| DENV | E | GU131783 | DENV | E | GU131818 | DENV | E | GQ868531 |
| DENV | E | GU131680 | DENV | E | GU131893 | DENV | E | GU131957 |
| DENV | E | GU131704 | DENV | E | GQ868509 | DENV | E | GU131980 |
| DENV | E | GU131685 | DENV | E | GU131706 | DENV | E | GQ868609 |
| DENV | E | GU131770 | DENV | E | GU131777 | DENV | E | GU131769 |
| DENV | E | GU131795 | DENV | E | GU131925 | DENV | E | GQ868526 |
| DENV | E | GU131961 | DENV | E | GU131977 | DENV | E | GQ868510 |
| DENV | E | GU131733 | DENV | E | GQ868611 | DENV | E | FN429882 |

FIG. 70-47

| Virus | Protein | Accession No. | Virus | Protein | Accession No. | Virus | Protein | Accession No. |
|---|---|---|---|---|---|---|---|---|
| DENV | E | GU131763 | DENV | E | GU131747 | DENV | E | GU131792 |
| DENV | E | GQ868527 | DENV | E | GU131748 | DENV | E | GU131690 |
| DENV | E | GU131708 | DENV | E | FN429889 | DENV | E | GQ868632 |
| DENV | E | GU131766 | DENV | E | GU131776 | DENV | E | GU131781 |
| DENV | E | FN429890 | DENV | E | GU131755 | DENV | E | GQ868537 |
| DENV | E | GU131694 | DENV | E | GU131810 | DENV | E | GU131815 |
| DENV | E | GQ868615 | DENV | E | GU131701 | DENV | E | GU056033 |
| DENV | E | GU131688 | DENV | E | GU131754 | DENV | E | GU131812 |
| DENV | E | FJ469908 | DENV | E | GU131784 | DENV | E | GU131833 |
| DENV | E | GU131734 | DENV | E | GU131807 | DENV | E | GU131830 |
| DENV | E | GQ868637 | DENV | E | GU131842 | DENV | E | GU131742 |
| DENV | E | GU131888 | DENV | E | GU131923 | DENV | E | GQ868561 |
| DENV | E | GQ868568 | DENV | E | GU131809 | DENV | E | GU131800 |
| DENV | E | GU131790 | DENV | E | GU131726 | DENV | E | GU131738 |
| DENV | E | GU131920 | DENV | E | GU131970 | DENV | E | GU131824 |
| DENV | E | GQ868528 | DENV | E | GU131751 | DENV | E | GU131919 |
| DENV | E | GQ868612 | DENV | E | GU131828 | DENV | E | GU131802 |
| DENV | E | GU131794 | DENV | E | GQ868524 | DENV | E | GQ868503 |
| DENV | E | GQ868606 | DENV | E | GU131863 | DENV | E | GU131839 |
| DENV | E | GU131969 | DENV | E | GU131892 | DENV | E | GU131681 |
| DENV | E | GQ868608 | DENV | E | GU131823 | DENV | E | GQ868505 |
| DENV | E | GU131921 | DENV | E | GU131821 | DENV | E | FN429884 |
| DENV | E | GQ868502 | DENV | E | GU131983 | DENV | E | GQ868536 |
| DENV | E | GU131719 | DENV | E | GQ868518 | DENV | E | GU131825 |
| DENV | E | GU131973 | DENV | E | GU131764 | DENV | E | FN429888 |
| DENV | E | GU131967 | DENV | E | GU056030 | DENV | E | GU131778 |
| DENV | E | GU131803 | DENV | E | GU131979 | DENV | E | GU131972 |
| DENV | E | GU131736 | DENV | E | GU131768 | DENV | E | GU131817 |
| DENV | E | GU131981 | DENV | E | GU131699 | DENV | E | GU131759 |
| DENV | E | GU131964 | DENV | E | FJ687427 | DENV | E | GU131819 |
| DENV | E | GU131771 | DENV | E | GU131963 | DENV | E | GU131757 |
| DENV | E | GU131984 | DENV | E | GU131793 | DENV | E | GQ868533 |
| DENV | E | GU131695 | DENV | E | GQ868618 | DENV | E | FN429883 |
| DENV | E | GU131728 | DENV | E | GU131799 | DENV | E | GU131956 |
| DENV | E | GQ868601 | DENV | E | GU131724 | DENV | E | GQ868563 |
| DENV | E | FN429886 | DENV | E | GU131740 | DENV | E | GU131926 |
| DENV | E | GU131826 | DENV | E | GU131806 | DENV | E | GU131887 |
| DENV | E | GQ868512 | DENV | E | GQ868614 | DENV | E | GU131741 |
| DENV | E | GU131718 | DENV | E | FN429881 | DENV | E | GU131761 |
| DENV | E | GQ868513 | DENV | E | GQ868636 | DENV | E | GU131693 |
| DENV | E | GU131731 | DENV | E | GU131746 | DENV | E | GU131753 |
| DENV | E | GU131686 | DENV | E | GQ868560 | DENV | E | GU131948 |
| DENV | E | GU131894 | DENV | E | GQ868508 | DENV | E | GQ868559 |
| DENV | E | GU131895 | DENV | E | GQ868570 | DENV | E | GQ868530 |
| DENV | E | GU131678 | DENV | E | GU131788 | DENV | E | GU131797 |
| DENV | E | GQ868619 | DENV | E | GU131949 | DENV | E | GU131785 |
| DENV | E | GU131729 | DENV | E | GU131796 | DENV | E | GU131758 |
| DENV | E | GQ868539 | DENV | E | GU056029 | DENV | E | GU131697 |

FIG. 70-48

| Virus | Protein | Accession No. | Virus | Protein | Accession No. | Virus | Protein | Accession No. |
|---|---|---|---|---|---|---|---|---|
| DENV | E | GU131835 | DENV | E | EU854296 | DENV | E | GQ199883 |
| DENV | E | GU131716 | DENV | E | EU854300 | DENV | E | FJ882586 |
| DENV | E | GQ868498 | DENV | E | AY858050 | DENV | E | GQ252675 |
| DENV | E | GU131683 | DENV | E | AF375822 | DENV | E | FJ882581 |
| DENV | E | GU131960 | DENV | E | EU854295 | DENV | E | GQ199881 |
| DENV | E | GU131714 | DENV | E | M14931 | DENV | E | GQ199878 |
| DENV | E | GU131779 | DENV | E | AY618992 | DENV | E | FJ882596 |
| DENV | E | GU131773 | DENV | E | EU854297 | DENV | E | FJ882583 |
| DENV | E | GQ868605 | DENV | E | FJ639738 | DENV | E | FJ882600 |
| DENV | E | GQ868511 | DENV | E | AY618993 | DENV | E | FJ850057 |
| DENV | E | GU131752 | DENV | E | FJ639764 | DENV | E | GQ199879 |
| DENV | E | GU131691 | DENV | E | FJ639737 | DENV | E | FJ882585 |
| DENV | E | GU131692 | DENV | E | AY776330 | DENV | E | GQ199876 |
| DENV | E | GU131705 | DENV | E | AY618991 | DENV | E | GQ199885 |
| DENV | E | GQ868639 | DENV | E | FJ639736 | DENV | E | FJ882592 |
| DENV | E | GU131805 | DENV | E | FJ639739 | DENV | E | GQ199882 |
| DENV | E | GU131735 | DENV | E | AF326826 | DENV | E | FJ882591 |
| DENV | E | GU131966 | DENV | E | AY947539 | DENV | E | FJ882589 |
| DENV | E | GU131890 | DENV | E | EU854299 | DENV | E | GQ868642 |
| DENV | E | GQ868566 | DENV | E | AY618990 | DENV | E | GQ868581 |
| DENV | E | GU131775 | DENV | E | FJ639748 | DENV | E | FN429919 |
| DENV | E | GU131749 | DENV | E | FJ639744 | DENV | E | GQ868583 |
| DENV | E | GQ868521 | DENV | E | EU854301 | DENV | E | FN429920 |
| DENV | E | GU131703 | DENV | E | FJ639773 | DENV | E | FN429923 |
| DENV | E | GU131717 | DENV | E | FJ182016 | DENV | E | GQ868585 |
| DENV | E | GU131712 | DENV | E | AF326573 | DENV | E | GQ868579 |
| DENV | E | GQ868532 | DENV | E | FJ182017 | DENV | E | GQ868644 |
| DENV | E | GQ868514 | DENV | E | FJ024476 | DENV | E | FN429925 |
| DENV | E | FJ410220 | DENV | E | EF457906 | DENV | E | GU289913 |
| DENV | E | CS477302 | DENV | E | FJ639742 | DENV | E | GQ868580 |
| DENV | E | CS477304 | DENV | E | AF289029 | DENV | E | FN429922 |
| DENV | E | CS477264 | DENV | E | GQ199880 | DENV | E | GQ868645 |
| DENV | E | CS477305 | DENV | E | FJ882597 | DENV | E | GQ868594 |
| DENV | E | CS477263 | DENV | E | NC_002640 | DENV | E | FN429924 |
| DENV | E | CS477265 | DENV | E | FJ882587 | DENV | E | FJ882590 |
| DENV | E | M87512 | DENV | E | FJ882595 | DENV | E | GQ868582 |
| DENV | E | FB730116 | DENV | E | FJ882582 | DENV | E | GQ868584 |
| DENV | E | GM059691 | DENV | E | FJ810417 | DENV | E | FN429926 |
| DENV | E | U88536 | DENV | E | FJ850095 | DENV | E | FN429921 |
| DENV | E | GU370048 | DENV | E | FJ882599 | DENV | E | GQ868643 |
| DENV | E | GU370049 | DENV | E | FJ882580 | DENV | E | AF326825 |
| DENV | E | AY762085 | DENV | E | GQ199884 | DENV | E | AY376438 |
| DENV | E | FJ024424 | DENV | E | FJ882588 | DENV | E | AY648301 |
| DENV | E | FJ226067 | DENV | E | FJ882598 | DENV | E | AY099336 |
| DENV | E | FJ639745 | DENV | E | FJ882601 | DENV | E | GU363549 |
| DENV | E | AY618989 | DENV | E | FJ850058 | DENV | E | GU370052 |
| DENV | E | AF326827 | DENV | E | FJ882584 | DENV | E | GU370053 |
| DENV | E | AY618988 | DENV | E | FJ850059 | DENV | E | EU081191 |

FIG. 70-49

| Virus | Protein | Accession No. | Virus | Protein | Accession No. | Virus | Protein | Accession No. |
|---|---|---|---|---|---|---|---|---|
| DENV | E | DQ401690 | DENV | E | EU482455 | DENV | E | AY923865 |
| DENV | E | EU529683 | DENV | E | AY744680 | DENV | E | EU081188 |
| DENV | E | AY679147 | DENV | E | FJ182015 | DENV | E | FJ461337 |
| DENV | E | AY676348 | DENV | E | FJ562103 | DENV | E | EU081224 |
| DENV | E | EF629368 | DENV | E | FJ639792 | DENV | E | EU081207 |
| DENV | E | FJ639752 | DENV | E | DQ675527 | DENV | E | FJ639750 |
| DENV | E | FJ639807 | DENV | E | FJ547066 | DENV | E | AB189128 |
| DENV | E | EU529684 | DENV | E | EU529698 | DENV | E | AY676353 |
| DENV | E | FJ373304 | DENV | E | EU726769 | DENV | E | EU081209 |
| DENV | E | FJ639723 | DENV | E | AY676349 | DENV | E | FJ639772 |
| DENV | E | EU569691 | DENV | E | EU529688 | DENV | E | FJ182040 |
| DENV | E | DQ675524 | DENV | E | EU482558 | DENV | E | AY648961 |
| DENV | E | EU081203 | DENV | E | FJ547070 | DENV | E | FJ410178 |
| DENV | E | EU482564 | DENV | E | EU687198 | DENV | E | EU529699 |
| DENV | E | FJ182039 | DENV | E | FJ639817 | DENV | E | EU081199 |
| DENV | E | EU482453 | DENV | E | EU081202 | DENV | E | FJ639786 |
| DENV | E | FJ639779 | DENV | E | EU081225 | DENV | E | FJ639768 |
| DENV | E | EU081183 | DENV | E | DQ675520 | DENV | E | FJ639731 |
| DENV | E | EU529690 | DENV | E | EU854298 | DENV | E | FJ390373 |
| DENV | E | FJ182011 | DENV | E | FJ205870 | DENV | E | FJ639800 |
| DENV | E | EU081187 | DENV | E | FJ639793 | DENV | E | FJ547079 |
| DENV | E | EU482461 | DENV | E | DQ675532 | DENV | E | FJ547072 |
| DENV | E | FJ639803 | DENV | E | FJ024470 | DENV | E | EU081219 |
| DENV | E | AY858047 | DENV | E | EU081210 | DENV | E | EU596493 |
| DENV | E | FJ639774 | DENV | E | EU687226 | DENV | E | EU081192 |
| DENV | E | FJ639726 | DENV | E | FJ639715 | DENV | E | FJ432731 |
| DENV | E | AY858037 | DENV | E | AY676352 | DENV | E | AB189126 |
| DENV | E | EU081215 | DENV | E | AY858043 | DENV | E | FJ024471 |
| DENV | E | FJ639785 | DENV | E | EU081196 | DENV | E | FJ639769 |
| DENV | E | FJ639761 | DENV | E | FJ432741 | DENV | E | FJ547078 |
| DENV | E | EU569688 | DENV | E | EU726773 | DENV | E | FJ547080 |
| DENV | E | DQ675533 | DENV | E | EU482555 | DENV | E | AY744679 |
| DENV | E | FJ410177 | DENV | E | DQ401694 | DENV | E | EU081217 |
| DENV | E | FJ478456 | DENV | E | EU081216 | DENV | E | AY858045 |
| DENV | E | EU081195 | DENV | E | EU529704 | DENV | E | FJ547084 |
| DENV | E | EU081221 | DENV | E | FJ639777 | DENV | E | DQ675521 |
| DENV | E | EU529689 | DENV | E | FJ639730 | DENV | E | AY776329 |
| DENV | E | EU660408 | DENV | E | EU081190 | DENV | E | FJ639789 |
| DENV | E | EU687219 | DENV | E | EU529703 | DENV | E | AY496871 |
| DENV | E | FJ639780 | DENV | E | FJ639725 | DENV | E | EU781136 |
| DENV | E | EU687196 | DENV | E | EU081205 | DENV | E | FJ182013 |
| DENV | E | EF643017 | DENV | E | AY876494 | DENV | E | EU596492 |
| DENV | E | FJ373303 | DENV | E | FJ639747 | DENV | E | EU726774 |
| DENV | E | FJ639729 | DENV | E | FJ373302 | DENV | E | EU081198 |
| DENV | E | FJ639775 | DENV | E | FJ639778 | DENV | E | FJ639728 |
| DENV | E | FJ461322 | DENV | E | DQ401692 | DENV | E | DQ675530 |
| DENV | E | FJ390371 | DENV | E | FJ182038 | DENV | E | EU660409 |
| DENV | E | AY858046 | DENV | E | EU081220 | DENV | E | EU081206 |

FIG. 70-50

| Virus | Protein | Accession No. | Virus | Protein | Accession No. | Virus | Protein | Accession No. |
|---|---|---|---|---|---|---|---|---|
| DENV | E | EU081222 | DENV | E | DQ675531 | DENV | E | EU482596 |
| DENV | E | EU660407 | DENV | E | FJ461326 | DENV | E | EU081208 |
| DENV | E | M93130 | DENV | E | FJ373306 | DENV | E | EU081201 |
| DENV | E | EU529687 | DENV | E | EU569689 | DENV | E | FJ639757 |
| DENV | E | DQ675523 | DENV | E | AY858041 | DENV | E | FJ639713 |
| DENV | E | FJ432722 | DENV | E | EU482566 | DENV | E | AY744685 |
| DENV | E | EU482559 | DENV | E | EF629370 | DENV | E | FJ182041 |
| DENV | E | FJ639721 | DENV | E | AY496877 | DENV | E | FJ562099 |
| DENV | E | AY744682 | DENV | E | FJ562102 | DENV | E | FJ562100 |
| DENV | E | EU081184 | DENV | E | EF629367 | DENV | E | FJ547081 |
| DENV | E | FJ639805 | DENV | E | FJ547077 | DENV | E | AY858044 |
| DENV | E | FJ547074 | DENV | E | FJ639770 | DENV | E | FJ639714 |
| DENV | E | EU529685 | DENV | E | EU081182 | DENV | E | EU529686 |
| DENV | E | DQ401695 | DENV | E | EU596494 | DENV | E | FJ410229 |
| DENV | E | FJ432743 | DENV | E | FJ639749 | DENV | E | FJ547073 |
| DENV | E | EU854291 | DENV | E | EU726771 | DENV | E | FJ639791 |
| DENV | E | FJ182008 | DENV | E | FJ639746 | DENV | E | EU529692 |
| DENV | E | FJ547062 | DENV | E | EU081214 | DENV | E | FJ547082 |
| DENV | E | FJ024467 | DENV | E | AY858039 | DENV | E | EU367962 |
| DENV | E | EU687239 | DENV | E | EU660411 | DENV | E | FJ390375 |
| DENV | E | FJ024468 | DENV | E | EU482563 | DENV | E | AY858040 |
| DENV | E | AY496874 | DENV | E | AY744678 | DENV | E | FJ547069 |
| DENV | E | FJ547061 | DENV | E | FJ461334 | DENV | E | FJ562107 |
| DENV | E | FJ547076 | DENV | E | EU660420 | DENV | E | FJ461338 |
| DENV | E | FJ639767 | DENV | E | FJ024466 | DENV | E | FJ639722 |
| DENV | E | AB189125 | DENV | E | FJ639795 | DENV | E | FJ639782 |
| DENV | E | AF317645 | DENV | E | FJ024465 | DENV | E | AY858042 |
| DENV | E | AB189127 | DENV | E | EU726768 | DENV | E | EU081185 |
| DENV | E | EU781137 | DENV | E | FJ639720 | DENV | E | FJ390377 |
| DENV | E | DQ675522 | DENV | E | EU529696 | DENV | E | FJ639763 |
| DENV | E | EU482614 | DENV | E | FJ639810 | DENV | E | FJ639760 |
| DENV | E | AB214879 | DENV | E | AY744681 | DENV | E | FJ182009 |
| DENV | E | FJ639765 | DENV | E | FJ639724 | DENV | E | EU529697 |
| DENV | E | EU081211 | DENV | E | EU482595 | DENV | E | DQ675529 |
| DENV | E | FJ639787 | DENV | E | AY676351 | DENV | E | FJ639727 |
| DENV | E | FJ639784 | DENV | E | DQ401689 | DENV | E | FJ461329 |
| DENV | E | EU569690 | DENV | E | FJ182005 | DENV | E | EU482457 |
| DENV | E | EU081223 | DENV | E | FJ547085 | DENV | E | FJ639827 |
| DENV | E | FJ639816 | DENV | E | EU081193 | DENV | E | EU687197 |
| DENV | E | AY496873 | DENV | E | FJ639751 | DENV | E | FJ639801 |
| DENV | E | FJ182010 | DENV | E | DQ675525 | DENV | E | FJ410176 |
| DENV | E | AY099337 | DENV | E | FJ639826 | DENV | E | EU081218 |
| DENV | E | AY496879 | DENV | E | EU482458 | DENV | E | AY744684 |
| DENV | E | EU482462 | DENV | E | EU081204 | DENV | E | FJ390376 |
| DENV | E | FJ639825 | DENV | E | EU529691 | DENV | E | FJ639781 |
| DENV | E | AY766104 | DENV | E | FJ639719 | DENV | E | DQ675528 |
| DENV | E | FJ182007 | DENV | E | FJ182037 | DENV | E | FJ639766 |
| DENV | E | DQ401693 | DENV | E | EU482612 | DENV | E | EU687221 |

FIG. 70-51

| Virus | Protein | Accession No. | Virus | Protein | Accession No. | Virus | Protein | Accession No. |
|---|---|---|---|---|---|---|---|---|
| DENV | E | EU081197 | DENV | E | AY858038 | DENV | E | FJ898457 |
| DENV | E | FJ639755 | DENV | E | EU482456 | DENV | E | FJ744736 |
| DENV | E | FJ639798 | DENV | E | EU081200 | DENV | E | FJ810416 |
| DENV | E | FJ639758 | DENV | E | FJ639756 | DENV | E | FJ898474 |
| DENV | E | EU687218 | DENV | E | AY744677 | DENV | E | FJ850094 |
| DENV | E | EU081189 | DENV | E | AY744683 | DENV | E | FJ898470 |
| DENV | E | FJ639759 | DENV | E | FJ639753 | DENV | E | FJ810413 |
| DENV | E | EU081212 | DENV | E | FJ639716 | DENV | E | FJ744735 |
| DENV | E | EU482460 | DENV | E | EU081194 | DENV | E | GQ199860 |
| DENV | E | FJ547075 | DENV | E | FJ639776 | DENV | E | FJ898464 |
| DENV | E | AY676350 | DENV | E | FJ898469 | DENV | E | FJ744729 |
| DENV | E | EU854292 | DENV | E | GQ252674 | DENV | E | FJ898472 |
| DENV | E | EU660410 | DENV | E | FJ850055 | DENV | E | GQ199862 |
| DENV | E | FJ432728 | DENV | E | FJ898475 | DENV | E | FJ873812 |
| DENV | E | FJ024469 | DENV | E | FJ744739 | DENV | E | FJ898441 |
| DENV | E | AY858048 | DENV | E | NC_001475 | DENV | E | FJ850048 |
| DENV | E | FJ639804 | DENV | E | GQ199863 | DENV | E | FJ850080 |
| DENV | E | EU529705 | DENV | E | FJ850089 | DENV | E | FJ882577 |
| DENV | E | EU482454 | DENV | E | FJ898442 | DENV | E | FJ850096 |
| DENV | E | DQ401691 | DENV | E | FJ898459 | DENV | E | FJ898473 |
| DENV | E | FJ639771 | DENV | E | FJ850049 | DENV | E | FJ882574 |
| DENV | E | FJ639754 | DENV | E | FJ744730 | DENV | E | FJ898445 |
| DENV | E | EU482459 | DENV | E | FJ850097 | DENV | E | GQ199888 |
| DENV | E | FJ205871 | DENV | E | FJ744728 | DENV | E | FJ898443 |
| DENV | E | EU081186 | DENV | E | FJ898458 | DENV | E | FJ744726 |
| DENV | E | FJ547083 | DENV | E | FJ744740 | DENV | E | FJ898476 |
| DENV | E | FJ639762 | DENV | E | GQ199889 | DENV | E | FJ898468 |
| DENV | E | FJ547071 | DENV | E | GQ199886 | DENV | E | FJ744733 |
| DENV | E | EU529702 | DENV | E | FJ687448 | DENV | E | GQ199871 |
| DENV | E | EU687234 | DENV | E | FJ744732 | DENV | E | GQ199887 |
| DENV | E | FJ182006 | DENV | E | FJ898446 | DENV | E | GQ199864 |
| DENV | E | AY662691 | DENV | E | GQ199861 | DENV | E | FJ744737 |
| DENV | E | EU081213 | DENV | E | FJ898455 | DENV | E | FJ898456 |
| DENV | E | EU081181 | DENV | E | FJ882573 | DENV | E | FJ850083 |
| DENV | E | FJ390372 | DENV | E | FJ898463 | DENV | E | FJ744731 |
| DENV | E | EU482613 | DENV | E | FJ898447 | DENV | E | FJ850079 |
| DENV | E | FJ639790 | DENV | E | FJ882571 | DENV | E | FJ744700 |
| DENV | E | DQ675519 | DENV | E | FJ898462 | DENV | E | FJ882576 |
| DENV | E | EU687233 | DENV | E | GQ199870 | DENV | E | GQ199891 |
| DENV | E | EF629369 | DENV | E | FJ898471 | DENV | E | FJ850111 |
| DENV | E | FJ182004 | DENV | E | FJ882575 | DENV | E | FJ850056 |
| DENV | E | FJ639799 | DENV | E | FJ744738 | DENV | E | FJ744727 |
| DENV | E | FJ562097 | DENV | E | FJ898440 | DENV | E | FJ873813 |
| DENV | E | FJ639712 | DENV | E | FJ898444 | DENV | E | AY770511 |
| DENV | E | EF629366 | DENV | E | GQ199865 | DENV | E | FJ850098 |
| DENV | E | EU726772 | DENV | E | GQ252678 | DENV | E | FJ810414 |
| DENV | E | DQ675526 | DENV | E | FJ850110 | DENV | E | FJ850109 |
| DENV | E | EU482452 | DENV | E | FJ744734 | DENV | E | FJ850052 |

FIG. 70-52

| Virus | Protein | Accession No. | Virus | Protein | Accession No. | Virus | Protein | Accession No. |
|---|---|---|---|---|---|---|---|---|
| DENV | E | FJ850086 | DENV | E | FN429917 | DENV | E | FN429909 |
| DENV | E | FJ882572 | DENV | E | FN429915 | DENV | E | FN429911 |
| DENV | E | FJ882578 | DENV | E | GU131855 | DENV | E | GU131945 |
| DENV | E | FJ850092 | DENV | E | FN429896 | DENV | E | FN429916 |
| DENV | E | AB214882 | DENV | E | GU131844 | DENV | E | FN429914 |
| DENV | E | AB214880 | DENV | E | GQ868573 | DENV | E | GU131942 |
| DENV | E | AB214881 | DENV | E | GQ868586 | DENV | E | GU131849 |
| DENV | E | FB667400 | DENV | E | GU131858 | DENV | E | GU131952 |
| DENV | E | GQ868587 | DENV | E | FN429903 | DENV | E | GU131915 |
| DENV | E | EU932688 | DENV | E | GU131874 | DENV | E | GQ868578 |
| DENV | E | FN429906 | DENV | E | GU131914 | DENV | E | GQ868548 |
| DENV | E | GU131916 | DENV | E | FN429912 | DENV | E | GU131913 |
| DENV | E | GU131953 | DENV | E | FN429898 | DENV | E | GU131940 |
| DENV | E | GU131850 | DENV | E | GU131851 | DENV | E | FN429918 |
| DENV | E | FN429900 | DENV | E | GU131938 | DENV | E | FN429905 |
| DENV | E | GQ868576 | DENV | E | GU131853 | DENV | E | GU131907 |
| DENV | E | GU131946 | DENV | E | FN429907 | DENV | E | GU131860 |
| DENV | E | GU131866 | DENV | E | GU131865 | DENV | E | GU131954 |
| DENV | E | GU131862 | DENV | E | GU131906 | DENV | E | GU131856 |
| DENV | E | GU131852 | DENV | E | GU131944 | DENV | E | GU131847 |
| DENV | E | FN429897 | DENV | E | GU131936 | DENV | E | GU131909 |
| DENV | E | GQ868571 | DENV | E | GU131903 | DENV | E | GU131939 |
| DENV | E | GQ868626 | DENV | E | GU131908 | DENV | E | GU131912 |
| DENV | E | GQ868546 | DENV | E | GU131878 | DENV | E | GU131859 |
| DENV | E | FN429904 | DENV | E | GU131950 | DENV | E | GU131857 |
| DENV | E | GU131904 | DENV | E | GQ868634 | DENV | E | GQ868629 |
| DENV | E | GU131935 | DENV | E | GU131873 | DENV | E | GU131905 |
| DENV | E | GU131910 | DENV | E | GQ868593 | DENV | E | GU131848 |
| DENV | E | GU131918 | DENV | E | GQ868572 | DENV | E | FB667402 |
| DENV | E | GU131937 | DENV | E | DQ863638 | DENV | E | FB667403 |
| DENV | E | GU131868 | DENV | E | GU131876 | DENV | E | FJ177308 |
| DENV | E | GU131951 | DENV | E | EU932687 | DENV | E | FB667404 |
| DENV | E | FN429910 | DENV | E | GU189648 | DENV | E | FB667398 |
| DENV | E | GU131854 | DENV | E | FN429913 | DENV | E | FB667399 |
| DENV | E | GU131943 | DENV | E | GU131867 | DENV | E | CS805345 |
| DENV | E | GU131861 | DENV | E | GQ868575 | DENV | E | EU482634 |
| DENV | E | GU131871 | DENV | E | GQ868617 | DENV | E | FJ373301 |
| DENV | E | GU131933 | DENV | E | GQ868616 | DENV | E | EU482582 |
| DENV | E | GU131877 | DENV | E | GU131870 | DENV | E | EU687227 |
| DENV | E | GU131911 | DENV | E | GU131869 | DENV | E | EU569710 |
| DENV | E | GQ868628 | DENV | E | GU131846 | DENV | E | EF105383 |
| DENV | E | GQ868574 | DENV | E | GU131934 | DENV | E | EU687249 |
| DENV | E | GU131941 | DENV | E | GQ868627 | DENV | E | EU687242 |
| DENV | E | GQ868577 | DENV | E | FN429908 | DENV | E | EU482658 |
| DENV | E | GQ868547 | DENV | E | GU131872 | DENV | E | FJ639710 |
| DENV | E | GU131845 | DENV | E | FN429901 | DENV | E | EU482748 |
| DENV | E | FN429899 | DENV | E | GU131917 | DENV | E | FJ205885 |
| DENV | E | FN429902 | DENV | E | GU131875 | DENV | E | EU482470 |

FIG. 70-53

| Virus | Protein | Accession No. | Virus | Protein | Accession No. | Virus | Protein | Accession No. |
|---|---|---|---|---|---|---|---|---|
| DENV | E | EU482468 | DENV | E | EU482787 | DENV | E | FJ205879 |
| DENV | E | FJ410195 | DENV | E | FM210216 | DENV | E | EU569697 |
| DENV | E | AB122021 | DENV | E | EU569694 | DENV | E | EU482691 |
| DENV | E | EU482469 | DENV | E | EU482648 | DENV | E | FJ461309 |
| DENV | E | FM210231 | DENV | E | EU482620 | DENV | E | EU482608 |
| DENV | E | FJ639831 | DENV | E | EU482471 | DENV | E | EU726776 |
| DENV | E | EU482657 | DENV | E | EU482644 | DENV | E | EU081177 |
| DENV | E | EU482674 | DENV | E | FJ639833 | DENV | E | FM210213 |
| DENV | E | EU482753 | DENV | E | EU482445 | DENV | E | EU854293 |
| DENV | E | DQ645545 | DENV | E | EU482606 | DENV | E | EU482632 |
| DENV | E | FJ639835 | DENV | E | FM210236 | DENV | E | FM210234 |
| DENV | E | FJ432726 | DENV | E | EU482639 | DENV | E | EU482745 |
| DENV | E | EU482607 | DENV | E | EU003591 | DENV | E | EU482593 |
| DENV | E | EU482660 | DENV | E | EU482547 | DENV | E | EU569718 |
| DENV | E | EU482766 | DENV | E | FJ478459 | DENV | E | EU482719 |
| DENV | E | AB189124 | DENV | E | FJ639837 | DENV | E | EF051521 |
| DENV | E | AF100461 | DENV | E | FJ390387 | DENV | E | FM210238 |
| DENV | E | EU482600 | DENV | E | DQ645547 | DENV | E | FJ478455 |
| DENV | E | EU687230 | DENV | E | EU596496 | DENV | E | AF100465 |
| DENV | E | EU482633 | DENV | E | EU482597 | DENV | E | EU529694 |
| DENV | E | EU482726 | DENV | E | EU482463 | DENV | E | EU081178 |
| DENV | E | EU482557 | DENV | E | EU482553 | DENV | E | EU482676 |
| DENV | E | EU482444 | DENV | E | EU482548 | DENV | E | FJ639709 |
| DENV | E | FJ205877 | DENV | E | EU482641 | DENV | E | FM210208 |
| DENV | E | EU482621 | DENV | E | FJ639703 | DENV | E | FJ410208 |
| DENV | E | EU482736 | DENV | E | EU482647 | DENV | E | EU569716 |
| DENV | E | EU596497 | DENV | E | EU596487 | DENV | E | EU482786 |
| DENV | E | M84728 | DENV | E | FJ639788 | DENV | E | AF276619 |
| DENV | E | EU482549 | DENV | E | FM210206 | DENV | E | EU482625 |
| DENV | E | FM210228 | DENV | E | DQ645556 | DENV | E | EU687248 |
| DENV | E | EU687216 | DENV | E | AF169682 | DENV | E | EU482662 |
| DENV | E | EU596489 | DENV | E | AY858035 | DENV | E | EU569708 |
| DENV | E | EU482576 | DENV | E | EU687220 | DENV | E | FM210240 |
| DENV | E | AF100460 | DENV | E | EU482636 | DENV | E | EU482777 |
| DENV | E | AF169679 | DENV | E | EU482650 | DENV | E | FJ639705 |
| DENV | E | EU482665 | DENV | E | EU482704 | DENV | E | EU482669 |
| DENV | E | EU482586 | DENV | E | EU482661 | DENV | E | DQ645553 |
| DENV | E | AF169681 | DENV | E | EU569699 | DENV | E | FM210210 |
| DENV | E | FM210205 | DENV | E | EU482580 | DENV | E | EF457904 |
| DENV | E | EU482767 | DENV | E | FM210215 | DENV | E | FJ410237 |
| DENV | E | EU687240 | DENV | E | FJ639733 | DENV | E | AY702035 |
| DENV | E | AF169686 | DENV | E | EF105389 | DENV | E | EU482757 |
| DENV | E | EU687244 | DENV | E | EF105384 | DENV | E | EU596499 |
| DENV | E | EU482683 | DENV | E | EU677146 | DENV | E | EU482543 |
| DENV | E | FJ373299 | DENV | E | EU596498 | DENV | E | EU687217 |
| DENV | E | EU482601 | DENV | E | FJ410288 | DENV | E | EU482646 |
| DENV | E | EU660404 | DENV | E | FJ373300 | DENV | E | EU482746 |
| DENV | E | EU482651 | DENV | E | EU482702 | DENV | E | FJ410217 |

FIG. 70-54

| Virus | Protein | Accession No. | Virus | Protein | Accession No. | Virus | Protein | Accession No. |
|---|---|---|---|---|---|---|---|---|
| DENV | E | FJ639707 | DENV | E | EU482784 | DENV | E | EU482578 |
| DENV | E | EU482637 | DENV | E | EU482584 | DENV | E | EU482781 |
| DENV | E | EU482699 | DENV | E | EU482670 | DENV | E | EU596485 |
| DENV | E | EU482583 | DENV | E | DQ181801 | DENV | E | EU687224 |
| DENV | E | FJ639717 | DENV | E | EU482603 | DENV | E | FJ461321 |
| DENV | E | EU687223 | DENV | E | EU482769 | DENV | E | FJ390390 |
| DENV | E | AY702036 | DENV | E | FM210227 | DENV | E | EU482562 |
| DENV | E | EU482542 | DENV | E | AY744147 | DENV | E | EF105390 |
| DENV | E | EU482587 | DENV | E | EU482656 | DENV | E | EU482782 |
| DENV | E | EU482667 | DENV | E | EU529706 | DENV | E | EU482682 |
| DENV | E | EU482695 | DENV | E | EU687212 | DENV | E | EU056810 |
| DENV | E | EU569720 | DENV | E | DQ645541 | DENV | E | EU687236 |
| DENV | E | AY702037 | DENV | E | DQ181800 | DENV | E | EU482448 |
| DENV | E | AY858036 | DENV | E | EU482721 | DENV | E | FJ639698 |
| DENV | E | DQ645544 | DENV | E | EU677145 | DENV | E | EU482630 |
| DENV | E | FJ639822 | DENV | E | EU482450 | DENV | E | EU359009 |
| DENV | E | AF100466 | DENV | E | EU482541 | DENV | E | EU482768 |
| DENV | E | FJ410215 | DENV | E | AF169688 | DENV | E | EU482672 |
| DENV | E | EU569705 | DENV | E | M19197 | DENV | E | EU569711 |
| DENV | E | FM210241 | DENV | E | EU482594 | DENV | E | EU482627 |
| DENV | E | FM210221 | DENV | E | DQ645554 | DENV | E | EU569715 |
| DENV | E | EU687228 | DENV | E | DQ181798 | DENV | E | EU482678 |
| DENV | E | EU482703 | DENV | E | AY702038 | DENV | E | DQ181799 |
| DENV | E | EU529700 | DENV | E | EU596495 | DENV | E | EU687235 |
| DENV | E | DQ645555 | DENV | E | FM210245 | DENV | E | EU687238 |
| DENV | E | EU687231 | DENV | E | FM210214 | DENV | E | M84727 |
| DENV | E | EU660406 | DENV | E | EU482685 | DENV | E | EU482763 |
| DENV | E | EU687241 | DENV | E | EU482570 | DENV | E | EU482758 |
| DENV | E | FJ639700 | DENV | E | DQ645540 | DENV | E | FJ639830 |
| DENV | E | FJ639711 | DENV | E | EU660414 | DENV | E | EU482754 |
| DENV | E | U87412 | DENV | E | FJ024477 | DENV | E | FM210218 |
| DENV | E | EU482599 | DENV | E | AF100463 | DENV | E | FJ410224 |
| DENV | E | EU482654 | DENV | E | DQ645546 | DENV | E | FJ410193 |
| DENV | E | EU569721 | DENV | E | EU569703 | DENV | E | EU056811 |
| DENV | E | FJ390385 | DENV | E | EU482652 | DENV | E | EU482774 |
| DENV | E | EU482589 | DENV | E | EU596490 | DENV | E | EU482568 |
| DENV | E | EU482551 | DENV | E | EU482693 | DENV | E | EU482588 |
| DENV | E | EU660400 | DENV | E | EU482734 | DENV | E | EU482475 |
| DENV | E | EU482679 | DENV | E | FM210202 | DENV | E | AF489932 |
| DENV | E | AF204177 | DENV | E | EU482729 | DENV | E | FM210211 |
| DENV | E | FJ461311 | DENV | E | AF169680 | DENV | E | EU687246 |
| DENV | E | EU569700 | DENV | E | EU482623 | DENV | E | FJ390389 |
| DENV | E | EU482737 | DENV | E | EU569693 | DENV | E | EU482464 |
| DENV | E | EU482573 | DENV | E | EU482590 | DENV | E | EU482697 |
| DENV | E | AY702040 | DENV | E | FJ639834 | DENV | E | EU482765 |
| DENV | E | DQ181803 | DENV | E | EU482449 | DENV | E | FM210209 |
| DENV | E | EU482741 | DENV | E | EU687237 | DENV | E | EU482474 |
| DENV | E | EU660399 | DENV | E | EF105381 | DENV | E | EU596484 |

FIG. 70-55

| Virus | Protein | Accession No. | Virus | Protein | Accession No. | Virus | Protein | Accession No. |
|---|---|---|---|---|---|---|---|---|
| DENV | E | EU677138 | DENV | E | EU482742 | DENV | E | FJ410200 |
| DENV | E | EU621672 | DENV | E | FJ461314 | DENV | E | DQ645552 |
| DENV | E | AF359579 | DENV | E | EU482688 | DENV | E | EU482574 |
| DENV | E | EU482645 | DENV | E | DQ181802 | DENV | E | EU482622 |
| DENV | E | EU482760 | DENV | E | FJ639809 | DENV | E | EU482561 |
| DENV | E | FJ639732 | DENV | E | EU482701 | DENV | E | EU596486 |
| DENV | E | FM210229 | DENV | E | AF204178 | DENV | E | EU569695 |
| DENV | E | EU482684 | DENV | E | FJ639706 | DENV | E | FJ024461 |
| DENV | E | EF105378 | DENV | E | EU482550 | DENV | E | EU569713 |
| DENV | E | EU482681 | DENV | E | EU482605 | DENV | E | FM210224 |
| DENV | E | FJ547090 | DENV | E | EU482554 | DENV | E | EU482556 |
| DENV | E | EU482447 | DENV | E | EU482692 | DENV | E | EU482731 |
| DENV | E | EU482624 | DENV | E | EU482680 | DENV | E | EU179858 |
| DENV | E | AF119661 | DENV | E | AF169683 | DENV | E | EU781135 |
| DENV | E | EU660413 | DENV | E | FJ024458 | DENV | E | EU482743 |
| DENV | E | AF169685 | DENV | E | EU482780 | DENV | E | EU482751 |
| DENV | E | EU482771 | DENV | E | EU482750 | DENV | E | FJ410259 |
| DENV | E | EU482604 | DENV | E | EU179857 | DENV | E | EU482747 |
| DENV | E | FJ410223 | DENV | E | EU569698 | DENV | E | EU687225 |
| DENV | E | EU482739 | DENV | E | EU482571 | DENV | E | FJ639718 |
| DENV | E | EU687243 | DENV | E | EU081179 | DENV | E | EU569707 |
| DENV | E | EU482720 | DENV | E | EU482690 | DENV | E | EU677147 |
| DENV | E | EU482730 | DENV | E | EU687215 | DENV | E | FM210223 |
| DENV | E | EU482779 | DENV | E | EU482664 | DENV | E | EU081180 |
| DENV | E | AB122020 | DENV | E | DQ181797 | DENV | E | EU482728 |
| DENV | E | FM210244 | DENV | E | EU569701 | DENV | E | EU596500 |
| DENV | E | AF100469 | DENV | E | EU482773 | DENV | E | EU482671 |
| DENV | E | FJ410221 | DENV | E | EU482722 | DENV | E | EU179859 |
| DENV | E | EU482626 | DENV | E | EU482635 | DENV | E | EU482705 |
| DENV | E | EU482788 | DENV | E | DQ645549 | DENV | E | EU482552 |
| DENV | E | FJ410219 | DENV | E | EU482629 | DENV | E | EU482546 |
| DENV | E | AF100462 | DENV | E | EU596488 | DENV | E | EU482642 |
| DENV | E | EU482696 | DENV | E | FJ639836 | DENV | E | EU482579 |
| DENV | E | EU482544 | DENV | E | EU482733 | DENV | E | M20558 |
| DENV | E | EU482640 | DENV | E | EU677143 | DENV | E | EU482775 |
| DENV | E | FJ182012 | DENV | E | EU482653 | DENV | E | EU596491 |
| DENV | E | DQ645548 | DENV | E | AF208496 | DENV | E | FJ639708 |
| DENV | E | FJ639701 | DENV | E | EU482565 | DENV | E | FM210220 |
| DENV | E | EU482655 | DENV | E | EU482598 | DENV | E | EU569717 |
| DENV | E | AB189122 | DENV | E | M29095 | DENV | E | EF105379 |
| DENV | E | DQ181804 | DENV | E | EU660415 | DENV | E | EU569712 |
| DENV | E | EU482732 | DENV | E | FM210239 | DENV | E | EU482755 |
| DENV | E | DQ645543 | DENV | E | EU687213 | DENV | E | DQ181805 |
| DENV | E | FJ639832 | DENV | E | EU677144 | DENV | E | FM210207 |
| DENV | E | FJ226066 | DENV | E | FM210243 | DENV | E | FM210233 |
| DENV | E | AF169687 | DENV | E | AF100459 | DENV | E | EU687199 |
| DENV | E | EU482752 | DENV | E | EU482466 | DENV | E | EU482686 |
| DENV | E | EU482783 | DENV | E | FM210230 | DENV | E | FJ205880 |

FIG. 70-56

| Virus | Protein | Accession No. | Virus | Protein | Accession No. | Virus | Protein | Accession No. |
|---|---|---|---|---|---|---|---|---|
| DENV | E | AY776328 | DENV | E | EF105380 | DENV | E | EU687250 |
| DENV | E | EU482675 | DENV | E | EU482677 | DENV | E | EU482735 |
| DENV | E | EU660417 | DENV | E | AF100468 | DENV | E | EU482785 |
| DENV | E | EU482727 | DENV | E | EU482569 | DENV | E | EU596483 |
| DENV | E | EU482602 | DENV | E | DQ645542 | DENV | E | EU569702 |
| DENV | E | EU482577 | DENV | E | EU482643 | DENV | E | FJ410241 |
| DENV | E | EU482756 | DENV | E | EU482694 | DENV | E | EU482659 |
| DENV | E | EU529701 | DENV | E | EU482724 | DENV | E | FM210203 |
| DENV | E | FJ639702 | DENV | E | EU482446 | DENV | E | EU482581 |
| DENV | E | EU482772 | DENV | E | FM210226 | DENV | E | EU569696 |
| DENV | E | FM210246 | DENV | E | EU482744 | DENV | E | FJ562098 |
| DENV | E | FJ390391 | DENV | E | EU677137 | DENV | E | FM210222 |
| DENV | E | AF100464 | DENV | E | EU482770 | DENV | E | EU482473 |
| DENV | E | FJ547067 | DENV | E | AF038403 | DENV | E | EU854294 |
| DENV | E | EF105386 | DENV | E | EU660398 | DENV | E | EU482649 |
| DENV | E | EF105387 | DENV | E | EU569709 | DENV | E | EU726767 |
| DENV | E | EU726775 | DENV | E | FM210237 | DENV | E | FJ024454 |
| DENV | E | FJ639704 | DENV | E | EU660416 | DENV | E | FJ639699 |
| DENV | E | AF169678 | DENV | E | EU677142 | DENV | E | FM210204 |
| DENV | E | EU482749 | DENV | E | EU482700 | DENV | E | EU529695 |
| DENV | E | EU482631 | DENV | E | EU482545 | DENV | E | EU687222 |
| DENV | E | EF105388 | DENV | E | EU482585 | DENV | E | EF105382 |
| DENV | E | AB189123 | DENV | E | FJ024475 | DENV | E | EU482738 |
| DENV | E | EU482663 | DENV | E | EU482725 | DENV | E | EF105385 |
| DENV | E | EU677149 | DENV | E | EU482687 | DENV | E | FM210219 |
| DENV | E | EU569719 | DENV | E | EU529693 | DENV | E | EU482723 |
| DENV | E | EU482778 | DENV | E | FJ390384 | DENV | E | FJ639829 |
| DENV | E | DQ645551 | DENV | E | EU482560 | DENV | E | EU482575 |
| DENV | E | EU482689 | DENV | E | EU482761 | DENV | E | AF038402 |
| DENV | E | EU726770 | DENV | E | EU482638 | DENV | E | FJ639783 |
| DENV | E | AB122022 | DENV | E | EU482698 | DENV | E | EU482572 |
| DENV | E | FJ639697 | DENV | E | EU482764 | DENV | E | FJ639734 |
| DENV | E | EU482628 | DENV | E | FJ182014 | DENV | E | EU482762 |
| DENV | E | EU687232 | DENV | E | EU482776 | DENV | E | EU569704 |
| DENV | E | FM210225 | DENV | E | DQ645550 | DENV | E | EU482759 |
| DENV | E | AY037116 | DENV | E | FJ024473 | DENV | E | EU056812 |
| DENV | E | FJ205878 | DENV | E | DQ181806 | DENV | E | FJ410228 |
| DENV | E | AY702034 | DENV | E | FJ461305 | DENV | E | EU482467 |
| DENV | E | FM210232 | DENV | E | FJ024452 | DENV | E | FM210217 |
| DENV | E | AY702039 | DENV | E | EU677141 | DENV | E | FM210212 |
| DENV | E | EU687245 | DENV | E | FJ639828 | DENV | E | EU660405 |
| DENV | E | EU482465 | DENV | E | EU569706 | DENV | E | FJ547064 |
| DENV | E | EU482472 | DENV | E | EU482666 | DENV | E | EU482740 |
| DENV | E | EU569714 | DENV | E | EU482673 | DENV | E | EU482451 |
| DENV | E | EU569692 | DENV | E | FJ024474 | DENV | E | EU482668 |
| DENV | E | FJ410233 | DENV | E | EU687214 | DENV | E | EU687229 |
| DENV | E | AF100467 | DENV | E | FJ410291 | DENV | E | AF169684 |
| DENV | E | EU677148 | DENV | E | FM210242 | DENV | E | FM210235 |

FIG. 70-57

| Virus | Protein | Accession No. | Virus | Protein | Accession No. | Virus | Protein | Accession No. |
|---|---|---|---|---|---|---|---|---|
| DENV | E | GQ199874 | DENV | E | FJ810409 | DENV | E | FJ906961 |
| DENV | E | FJ744745 | DENV | E | FJ687434 | DENV | E | FJ882593 |
| DENV | E | FJ898467 | DENV | E | GQ199890 | DENV | E | FJ898479 |
| DENV | E | FJ687444 | DENV | E | FJ744743 | DENV | E | FJ744703 |
| DENV | E | FJ810411 | DENV | E | FJ850063 | DENV | E | FJ744712 |
| DENV | E | FJ850067 | DENV | E | FJ898466 | DENV | E | FJ882594 |
| DENV | E | FJ850121 | DENV | E | FJ850119 | DENV | E | FJ744716 |
| DENV | E | FJ898452 | DENV | E | FJ898432 | DENV | E | FJ850066 |
| DENV | E | FJ744713 | DENV | E | FJ744718 | DENV | E | FJ744744 |
| DENV | E | FJ810418 | DENV | E | FJ810412 | DENV | E | FJ850108 |
| DENV | E | FJ906962 | DENV | E | FJ906956 | DENV | E | FJ859028 |
| DENV | E | FJ744721 | DENV | E | FJ850064 | DENV | E | FJ898465 |
| DENV | E | FJ850107 | DENV | E | GQ199892 | DENV | E | FJ898451 |
| DENV | E | FJ467493 | DENV | E | FJ898436 | DENV | E | FJ898449 |
| DENV | E | FJ906966 | DENV | E | FJ906957 | DENV | E | FJ744705 |
| DENV | E | FJ687446 | DENV | E | FJ898478 | DENV | E | FJ898434 |
| DENV | E | FJ906958 | DENV | E | FJ873811 | DENV | E | FJ906969 |
| DENV | E | FJ687435 | DENV | E | GQ199898 | DENV | E | FJ744741 |
| DENV | E | FJ850054 | DENV | E | FJ850115 | DENV | E | FJ906959 |
| DENV | E | FJ906967 | DENV | E | FJ687442 | DENV | E | FJ850106 |
| DENV | E | FJ850072 | DENV | E | FJ687439 | DENV | E | FJ744742 |
| DENV | E | FJ898439 | DENV | E | FJ432724 | DENV | E | FJ687437 |
| DENV | E | FJ850088 | DENV | E | FJ687447 | DENV | E | FJ744707 |
| DENV | E | FJ898435 | DENV | E | FJ873808 | DENV | E | FJ687438 |
| DENV | E | GQ252676 | DENV | E | DQ448231 | DENV | E | FJ744714 |
| DENV | E | FJ850065 | DENV | E | FJ744710 | DENV | E | GQ199866 |
| DENV | E | FJ898477 | DENV | E | GQ252677 | DENV | E | GQ199894 |
| DENV | E | FJ850116 | DENV | E | NC_001474 | DENV | E | FJ687440 |
| DENV | E | FJ898454 | DENV | E | FJ687445 | DENV | E | FJ850112 |
| DENV | E | GQ199897 | DENV | E | FJ850091 | DENV | E | FJ850078 |
| DENV | E | GQ199899 | DENV | E | FJ687443 | DENV | E | FJ744717 |
| DENV | E | FJ744723 | DENV | E | GQ199869 | DENV | E | FJ906968 |
| DENV | E | GQ199900 | DENV | E | FJ850105 | DENV | E | GQ199893 |
| DENV | E | FJ850082 | DENV | E | FJ850051 | DENV | E | FJ744711 |
| DENV | E | FJ744715 | DENV | E | FJ850050 | DENV | E | FJ744704 |
| DENV | E | FJ744709 | DENV | E | FJ744719 | DENV | E | FJ744720 |
| DENV | E | GQ199868 | DENV | E | FJ898453 | DENV | E | GQ199901 |
| DENV | E | FJ906960 | DENV | E | FJ898460 | DENV | E | FJ744724 |
| DENV | E | FJ882602 | DENV | E | FJ898438 | DENV | E | FJ850120 |
| DENV | E | GQ199895 | DENV | E | FJ850053 | DENV | E | FJ850118 |
| DENV | E | FJ687436 | DENV | E | FJ898450 | DENV | E | FJ850076 |
| DENV | E | FJ744725 | DENV | E | FJ744708 | DENV | E | AF022436 |
| DENV | E | FJ850117 | DENV | E | GQ199896 | DENV | E | AF022439 |
| DENV | E | FJ687441 | DENV | E | FJ744722 | DENV | E | AF022441 |
| DENV | E | FJ744706 | DENV | E | FJ850062 | DENV | E | AF022437 |
| DENV | E | FJ850074 | DENV | E | FJ898461 | DENV | E | AJ487271 |
| DENV | E | FJ850085 | DENV | E | FJ810410 | DENV | E | AF022435 |
| DENV | E | FJ850061 | DENV | E | FJ850060 | DENV | E | AF022434 |

FIG. 70-58

| Virus | Protein | Accession No. | Virus | Protein | Accession No. | Virus | Protein | Accession No. |
|---|---|---|---|---|---|---|---|---|
| DENV | E | AF022438 | DENV | E | GQ868558 | DENV | E | AY243469 |
| DENV | E | AF022440 | DENV | E | GQ868625 | DENV | E | AY744148 |
| DENV | E | CS479165 | DENV | E | GQ868624 | DENV | E | AY744149 |
| DENV | E | GQ868556 | DENV | E | GQ868631 | DENV | E | AY744150 |
| DENV | E | AB479041 | DENV | E | GU131899 | DENV | E | AJ968413 |
| DENV | E | GU289914 | DENV | E | GQ868515 | DENV | E | GU369819 |
| DENV | E | GU131884 | DENV | E | GU131898 | DENV | E | GU370050 |
| DENV | E | GQ868600 | DENV | E | GQ868623 | DENV | E | GU370051 |
| DENV | E | FN429895 | DENV | E | GU131886 | DENV | NS1 | AY277665 |
| DENV | E | GU131879 | DENV | E | GQ868622 | DENV | NS1 | AY713474 |
| DENV | E | GQ868596 | DENV | E | GQ868595 | DENV | NS1 | AF311957 |
| DENV | E | GQ868516 | DENV | E | GQ868557 | DENV | NS1 | FJ205881 |
| DENV | E | GU131864 | DENV | E | GU131959 | DENV | NS1 | EU482817 |
| DENV | E | FN429893 | DENV | E | GU131955 | DENV | NS1 | DQ672557 |
| DENV | E | GQ868598 | DENV | E | GQ868597 | DENV | NS1 | EU677151 |
| DENV | E | GQ868544 | DENV | E | GU131883 | DENV | NS1 | FJ410256 |
| DENV | E | GQ868589 | DENV | E | GQ868591 | DENV | NS1 | FJ432735 |
| DENV | E | GQ868551 | DENV | E | GQ868543 | DENV | NS1 | EU660390 |
| DENV | E | GU131902 | DENV | E | GU131901 | DENV | NS1 | EU482824 |
| DENV | E | GU131896 | DENV | E | GQ868545 | DENV | NS1 | FJ410222 |
| DENV | E | GU131924 | DENV | E | GU131931 | DENV | NS1 | AY726551 |
| DENV | E | GQ868640 | DENV | E | GU131885 | DENV | NS1 | EU482716 |
| DENV | E | GU131880 | DENV | E | GU131932 | DENV | NS1 | AF226685 |
| DENV | E | GU131882 | DENV | E | GU131881 | DENV | NS1 | EU677174 |
| DENV | E | GQ868638 | DENV | E | GU131897 | DENV | NS1 | FJ639693 |
| DENV | E | GQ868553 | DENV | E | GQ868592 | DENV | NS1 | FJ461317 |
| DENV | E | GQ868646 | DENV | E | GQ868552 | DENV | NS1 | FJ384655 |
| DENV | E | FN429891 | DENV | E | GU131900 | DENV | NS1 | EU482508 |
| DENV | E | GQ868604 | DENV | E | GQ868599 | DENV | NS1 | AF311958 |
| DENV | E | GU131947 | DENV | E | GU131929 | DENV | NS1 | FJ024451 |
| DENV | E | GU131928 | DENV | E | GU131930 | DENV | NS1 | EU482528 |
| DENV | E | GQ868497 | DENV | E | GQ868550 | DENV | NS1 | EU482821 |
| DENV | E | GQ868603 | DENV | E | GU131975 | DENV | NS1 | FJ410267 |
| DENV | E | GQ868621 | DENV | E | GU131927 | DENV | NS1 | AB074761 |
| DENV | E | AB479042 | DENV | E | GQ868540 | DENV | NS1 | AY762084 |
| DENV | E | GQ868620 | DENV | E | FJ410202 | DENV | NS1 | AY732480 |
| DENV | E | GQ868590 | DENV | E | CS479202 | DENV | NS1 | EU482481 |
| DENV | E | FN429892 | DENV | E | U87411 | DENV | NS1 | FJ410232 |
| DENV | E | GQ868554 | DENV | E | CS479203 | DENV | NS1 | EU081254 |
| DENV | E | GU131974 | DENV | E | CS479204 | DENV | NS1 | EU482806 |
| DENV | E | GU131843 | DENV | E | CS479167 | DENV | NS1 | FJ410257 |
| DENV | E | GQ868641 | DENV | E | CS479205 | DENV | NS1 | FJ432720 |
| DENV | E | GQ868542 | DENV | E | CS479206 | DENV | NS1 | FJ547089 |
| DENV | E | GQ868555 | DENV | E | CS805344 | DENV | NS1 | EU482819 |
| DENV | E | FN429894 | DENV | E | FB730117 | DENV | NS1 | EU081270 |
| DENV | E | GQ868549 | DENV | E | DL138662 | DENV | NS1 | FJ205875 |
| DENV | E | GQ868588 | DENV | E | GM059692 | DENV | NS1 | FJ410210 |
| DENV | E | GQ868541 | DENV | E | AY243468 | DENV | NS1 | FJ205884 |

FIG. 70-59

| Virus | Protein | Accession No. | Virus | Protein | Accession No. | Virus | Protein | Accession No. |
|---|---|---|---|---|---|---|---|---|
| DENV | NS1 | FJ176780 | DENV | NS1 | FJ639694 | DENV | NS1 | EU482592 |
| DENV | NS1 | FJ461340 | DENV | NS1 | EU482500 | DENV | NS1 | FJ182030 |
| DENV | NS1 | AY732475 | DENV | NS1 | DQ672560 | DENV | NS1 | FJ024431 |
| DENV | NS1 | AY732474 | DENV | NS1 | AY713473 | DENV | NS1 | FJ024450 |
| DENV | NS1 | FJ024435 | DENV | NS1 | EU726780 | DENV | NS1 | FJ410252 |
| DENV | NS1 | FJ639669 | DENV | NS1 | FJ410255 | DENV | NS1 | FJ478457 |
| DENV | NS1 | EU482540 | DENV | NS1 | FJ373298 | DENV | NS1 | EU596502 |
| DENV | NS1 | FJ024429 | DENV | NS1 | EU081276 | DENV | NS1 | FJ410201 |
| DENV | NS1 | EU677167 | DENV | NS1 | FJ410198 | DENV | NS1 | FJ562105 |
| DENV | NS1 | EU482512 | DENV | NS1 | EU482536 | DENV | NS1 | FJ639684 |
| DENV | NS1 | FJ390381 | DENV | NS1 | FJ390382 | DENV | NS1 | FJ639682 |
| DENV | NS1 | FJ410226 | DENV | NS1 | FJ024462 | DENV | NS1 | FJ410240 |
| DENV | NS1 | FJ410191 | DENV | NS1 | EU482822 | DENV | NS1 | EU081279 |
| DENV | NS1 | AJ968413 | DENV | NS1 | FJ024447 | DENV | NS1 | EU081231 |
| DENV | NS1 | FJ639689 | DENV | NS1 | FJ410274 | DENV | NS1 | FJ410214 |
| DENV | NS1 | AY277664 | DENV | NS1 | FJ410216 | DENV | NS1 | FJ182036 |
| DENV | NS1 | FJ639811 | DENV | NS1 | EU482527 | DENV | NS1 | FJ182023 |
| DENV | NS1 | FJ639695 | DENV | NS1 | EU280167 | DENV | NS1 | EU482479 |
| DENV | NS1 | EU081226 | DENV | NS1 | EU482567 | DENV | NS1 | FJ547087 |
| DENV | NS1 | FJ410280 | DENV | NS1 | EU081265 | DENV | NS1 | FJ639683 |
| DENV | NS1 | EU596504 | DENV | NS1 | EU482489 | DENV | NS1 | FJ024442 |
| DENV | NS1 | FJ639685 | DENV | NS1 | AB178040 | DENV | NS1 | FJ410285 |
| DENV | NS1 | EU482715 | DENV | NS1 | EU482827 | DENV | NS1 | EU482615 |
| DENV | NS1 | FJ410227 | DENV | NS1 | FJ024455 | DENV | NS1 | AY732476 |
| DENV | NS1 | DQ285560 | DENV | NS1 | EU081238 | DENV | NS1 | FJ024463 |
| DENV | NS1 | FJ182002 | DENV | NS1 | FJ410245 | DENV | NS1 | FJ410275 |
| DENV | NS1 | EU677177 | DENV | NS1 | FJ461318 | DENV | NS1 | FJ410234 |
| DENV | NS1 | FJ639680 | DENV | NS1 | FJ410263 | DENV | NS1 | EU482487 |
| DENV | NS1 | EU677160 | DENV | NS1 | FJ410269 | DENV | NS1 | FJ410182 |
| DENV | NS1 | AY835999 | DENV | NS1 | FJ410289 | DENV | NS1 | EU482812 |
| DENV | NS1 | EU249494 | DENV | NS1 | FJ639692 | DENV | NS1 | EU081247 |
| DENV | NS1 | AF226687 | DENV | NS1 | EU660397 | DENV | NS1 | AB074760 |
| DENV | NS1 | FJ024432 | DENV | NS1 | EU482477 | DENV | NS1 | EU482802 |
| DENV | NS1 | EU081229 | DENV | NS1 | FJ024434 | DENV | NS1 | EU677172 |
| DENV | NS1 | FJ410184 | DENV | NS1 | FJ410204 | DENV | NS1 | EU482496 |
| DENV | NS1 | FJ182022 | DENV | NS1 | EU249495 | DENV | NS1 | EU726777 |
| DENV | NS1 | EU677153 | DENV | NS1 | AF513110 | DENV | NS1 | U88535 |
| DENV | NS1 | DQ672559 | DENV | NS1 | FJ024438 | DENV | NS1 | EU482519 |
| DENV | NS1 | EU081234 | DENV | NS1 | EU081264 | DENV | NS1 | FJ461339 |
| DENV | NS1 | FJ639802 | DENV | NS1 | EU482525 | DENV | NS1 | FJ562101 |
| DENV | NS1 | EU482483 | DENV | NS1 | EU687251 | DENV | NS1 | FJ461316 |
| DENV | NS1 | FJ024445 | DENV | NS1 | EU482486 | DENV | NS1 | EU482814 |
| DENV | NS1 | FJ410236 | DENV | NS1 | DQ285558 | DENV | NS1 | AY726555 |
| DENV | NS1 | FJ410242 | DENV | NS1 | FJ205883 | DENV | NS1 | FJ639677 |
| DENV | NS1 | FJ390378 | DENV | NS1 | AY145121 | DENV | NS1 | EU482506 |
| DENV | NS1 | EU081236 | DENV | NS1 | AY732478 | DENV | NS1 | FJ410283 |
| DENV | NS1 | EU081278 | DENV | NS1 | FJ410199 | DENV | NS1 | FJ639696 |
| DENV | NS1 | FJ432736 | DENV | NS1 | FJ390383 | DENV | NS1 | FJ410235 |

FIG. 70-60

| Virus | Protein Accession No. | Virus | Protein Accession No. | Virus | Protein Accession No. |
|---|---|---|---|---|---|
| DENV | NS1EU482532 | DENV | NS1FJ410262 | DENV | NS1EU081243 |
| DENV | NS1FJ182031 | DENV | NS1FJ024480 | DENV | NS1FJ639818 |
| DENV | NS1FJ024428 | DENV | NS1EU482495 | DENV | NS1EU081237 |
| DENV | NS1FJ432749 | DENV | NS1FJ182032 | DENV | NS1AF514876 |
| DENV | NS1DQ285561 | DENV | NS1FJ410197 | DENV | NS1FJ639688 |
| DENV | NS1EU482518 | DENV | NS1AF514883 | DENV | NS1EU482713 |
| DENV | NS1EU726779 | DENV | NS1FJ461330 | DENV | NS1EU677154 |
| DENV | NS1EU677161 | DENV | NS1FJ639690 | DENV | NS1EU081242 |
| DENV | NS1AY145123 | DENV | NS1FJ410209 | DENV | NS1EU687247 |
| DENV | NS1EU482800 | DENV | NS1EU482514 | DENV | NS1AY726552 |
| DENV | NS1AY732482 | DENV | NS1EU848545 | DENV | NS1FJ024436 |
| DENV | NS1EU482517 | DENV | NS1EU249492 | DENV | NS1FJ639681 |
| DENV | NS1EU482488 | DENV | NS1EU081240 | DENV | NS1EU482484 |
| DENV | NS1FJ373305 | DENV | NS1EU482499 | DENV | NS1EU482815 |
| DENV | NS1FJ432746 | DENV | NS1FJ410281 | DENV | NS1EU249490 |
| DENV | NS1FJ432734 | DENV | NS1FJ410270 | DENV | NS1EU081253 |
| DENV | NS1EU482797 | DENV | NS1EU482808 | DENV | NS1AY726549 |
| DENV | NS1EU482711 | DENV | NS1EU081281 | DENV | NS1EU677166 |
| DENV | NS1FJ024459 | DENV | NS1AF309641 | DENV | NS1FJ639821 |
| DENV | NS1FJ410174 | DENV | NS1EU677159 | DENV | NS1FJ024430 |
| DENV | NS1EU596503 | DENV | NS1EU482526 | DENV | NS1FJ410183 |
| DENV | NS1FJ432730 | DENV | NS1FJ024427 | DENV | NS1EU081267 |
| DENV | NS1EU081227 | DENV | NS1EU482618 | DENV | NS1EU482491 |
| DENV | NS1EU677163 | DENV | NS1AF350498 | DENV | NS1EU081249 |
| DENV | NS1AY277666 | DENV | NS1EU677169 | DENV | NS1EU081252 |
| DENV | NS1FJ024483 | DENV | NS1EU482828 | DENV | NS1EU482706 |
| DENV | NS1DQ193572 | DENV | NS1EU482537 | DENV | NS1AY726553 |
| DENV | NS1EF122231 | DENV | NS1EU726782 | DENV | NS1FJ205882 |
| DENV | NS1EU081266 | DENV | NS1FJ410225 | DENV | NS1FJ390386 |
| DENV | NS1EU482818 | DENV | NS1FJ410180 | DENV | NS1EU677139 |
| DENV | NS1FJ410186 | DENV | NS1FJ024460 | DENV | NS1FJ410260 |
| DENV | NS1EU249493 | DENV | NS1FJ410231 | DENV | NS1EU677170 |
| DENV | NS1FJ024478 | DENV | NS1FJ390380 | DENV | NS1EU081256 |
| DENV | NS1FJ205874 | DENV | NS1FJ410238 | DENV | NS1FJ024443 |
| DENV | NS1EU482791 | DENV | NS1FJ390379 | DENV | NS1FJ410278 |
| DENV | NS1EU482798 | DENV | NS1AF311956 | DENV | NS1FJ432744 |
| DENV | NS1EU081248 | DENV | NS1EU081257 | DENV | NS1AB189120 |
| DENV | NS1EU596501 | DENV | NS1FJ432721 | DENV | NS1FJ461327 |
| DENV | NS1FJ461336 | DENV | NS1FJ639672 | DENV | NS1EU660391 |
| DENV | NS1FJ024457 | DENV | NS1FJ639794 | DENV | NS1FJ562106 |
| DENV | NS1EU482485 | DENV | NS1EU660403 | DENV | NS1FJ182035 |
| DENV | NS1FJ176779 | DENV | NS1EU482619 | DENV | NS1FJ461306 |
| DENV | NS1EU482799 | DENV | NS1EU677155 | DENV | NS1EU482510 |
| DENV | NS1EU081233 | DENV | NS1FJ182021 | DENV | NS1FJ024440 |
| DENV | NS1EU482497 | DENV | NS1EU482712 | DENV | NS1EU081258 |
| DENV | NS1EU482616 | DENV | NS1EU482591 | DENV | NS1EU081268 |
| DENV | NS1EU482507 | DENV | NS1FJ410253 | DENV | NS1EU677178 |
| DENV | NS1EU482809 | DENV | NS1EF032590 | DENV | NS1FJ410276 |

FIG. 70-61

| Virus | Protein | Accession No. | Virus | Protein | Accession No. | Virus | Protein | Accession No. |
|---|---|---|---|---|---|---|---|---|
| DENV | NS1 | EU081273 | DENV | NS1 | EU482811 | DENV | NS1 | FJ410205 |
| DENV | NS1 | EU482820 | DENV | NS1 | AF226686 | DENV | NS1 | FJ205876 |
| DENV | NS1 | AF514878 | DENV | NS1 | EU081235 | DENV | NS1 | FJ410211 |
| DENV | NS1 | EU660394 | DENV | NS1 | EU660419 | DENV | NS1 | FJ182025 |
| DENV | NS1 | FJ410218 | DENV | NS1 | FJ547068 | DENV | NS1 | FJ182026 |
| DENV | NS1 | EU081241 | DENV | NS1 | AB189121 | DENV | NS1 | FJ373296 |
| DENV | NS1 | FJ410244 | DENV | NS1 | FJ461308 | DENV | NS1 | AY722802 |
| DENV | NS1 | EU482789 | DENV | NS1 | FJ410213 | DENV | NS1 | EU482522 |
| DENV | NS1 | EU482524 | DENV | NS1 | AY726550 | DENV | NS1 | FJ390388 |
| DENV | NS1 | EU081261 | DENV | NS1 | AY732477 | DENV | NS1 | EU677173 |
| DENV | NS1 | FJ639812 | DENV | NS1 | EU660401 | DENV | NS1 | EU081277 |
| DENV | NS1 | EU482533 | DENV | NS1 | FJ639815 | DENV | NS1 | EU482492 |
| DENV | NS1 | DQ285559 | DENV | NS1 | FJ410268 | DENV | NS1 | FJ432732 |
| DENV | NS1 | FJ410246 | DENV | NS1 | FJ478458 | DENV | NS1 | FJ639691 |
| DENV | NS1 | FJ461310 | DENV | NS1 | FJ639808 | DENV | NS1 | EU482511 |
| DENV | NS1 | AB195673 | DENV | NS1 | EU482611 | DENV | NS1 | EU081230 |
| DENV | NS1 | FJ182024 | DENV | NS1 | FJ410261 | DENV | NS1 | FJ410206 |
| DENV | NS1 | AB204803 | DENV | NS1 | FJ432729 | DENV | NS1 | FJ410189 |
| DENV | NS1 | EF025110 | DENV | NS1 | FJ639813 | DENV | NS1 | FJ182019 |
| DENV | NS1 | DQ672564 | DENV | NS1 | EU482520 | DENV | NS1 | FJ024472 |
| DENV | NS1 | EU726778 | DENV | NS1 | AF514885 | DENV | NS1 | FJ205872 |
| DENV | NS1 | EF457905 | DENV | NS1 | FJ639673 | DENV | NS1 | FJ410282 |
| DENV | NS1 | FJ547088 | DENV | NS1 | FJ410266 | DENV | NS1 | EU482538 |
| DENV | NS1 | FJ024437 | DENV | NS1 | EU482805 | DENV | NS1 | EU660418 |
| DENV | NS1 | EU482513 | DENV | NS1 | FJ432740 | DENV | NS1 | FJ639819 |
| DENV | NS1 | FJ410196 | DENV | NS1 | AY726554 | DENV | NS1 | FJ639806 |
| DENV | NS1 | FJ410250 | DENV | NS1 | FJ024441 | DENV | NS1 | FJ432738 |
| DENV | NS1 | EU660392 | DENV | NS1 | DQ672556 | DENV | NS1 | FJ432719 |
| DENV | NS1 | FJ461313 | DENV | NS1 | FJ410272 | DENV | NS1 | FJ461303 |
| DENV | NS1 | EU677168 | DENV | NS1 | FJ639676 | DENV | NS1 | FJ410203 |
| DENV | NS1 | FJ432723 | DENV | NS1 | FJ639686 | DENV | NS1 | FJ410194 |
| DENV | NS1 | FJ410181 | DENV | NS1 | EU482498 | DENV | NS1 | EU081244 |
| DENV | NS1 | FJ410239 | DENV | NS1 | FJ432725 | DENV | NS1 | EU482482 |
| DENV | NS1 | EU482480 | DENV | NS1 | EU482529 | DENV | NS1 | FJ410179 |
| DENV | NS1 | AY206457 | DENV | NS1 | FJ547086 | DENV | NS1 | AY722803 |
| DENV | NS1 | EU482523 | DENV | NS1 | FJ461323 | DENV | NS1 | EU482539 |
| DENV | NS1 | FJ410290 | DENV | NS1 | FJ410230 | DENV | NS1 | FJ639671 |
| DENV | NS1 | DQ672562 | DENV | NS1 | FJ410248 | DENV | NS1 | EU482478 |
| DENV | NS1 | EU482521 | DENV | NS1 | EU482609 | DENV | NS1 | FJ547060 |
| DENV | NS1 | EU660402 | DENV | NS1 | FJ639824 | DENV | NS1 | FJ432739 |
| DENV | NS1 | FJ461307 | DENV | NS1 | FJ410279 | DENV | NS1 | FJ639740 |
| DENV | NS1 | EU081272 | DENV | NS1 | EU482535 | DENV | NS1 | FJ182034 |
| DENV | NS1 | FJ461315 | DENV | NS1 | FJ024453 | DENV | NS1 | EU482710 |
| DENV | NS1 | FJ410188 | DENV | NS1 | FJ432748 | DENV | NS1 | EU081232 |
| DENV | NS1 | AY713475 | DENV | NS1 | EU660393 | DENV | NS1 | EU482515 |
| DENV | NS1 | AY732479 | DENV | NS1 | AY145122 | DENV | NS1 | EU482531 |
| DENV | NS1 | EU677156 | DENV | NS1 | FJ024446 | DENV | NS1 | AF298807 |
| DENV | NS1 | EU482707 | DENV | NS1 | FJ432747 | DENV | NS1 | FJ205873 |

FIG. 70-62

| Virus | Protein | Accession No. | Virus | Protein | Accession No. | Virus | Protein | Accession No. |
|---|---|---|---|---|---|---|---|---|
| DENV | NS1 | FJ639674 | DENV | NS1 | EU482476 | DENV | NS1 | FJ410185 |
| DENV | NS1 | FJ547065 | DENV | NS1 | EU482505 | DENV | NS1 | FJ410273 |
| DENV | NS1 | FJ410212 | DENV | NS1 | EU081255 | DENV | NS1 | EU482801 |
| DENV | NS1 | FJ461341 | DENV | NS1 | FJ639743 | DENV | NS1 | AY713476 |
| DENV | NS1 | EU081259 | DENV | NS1 | U88537 | DENV | NS1 | FJ461312 |
| DENV | NS1 | FJ639823 | DENV | NS1 | FJ432733 | DENV | NS1 | FJ639797 |
| DENV | NS1 | FJ410190 | DENV | NS1 | EU660395 | DENV | NS1 | FJ461319 |
| DENV | NS1 | FJ432745 | DENV | NS1 | EU081263 | DENV | NS1 | FJ461333 |
| DENV | NS1 | FJ410175 | DENV | NS1 | EU482826 | DENV | NS1 | EU482516 |
| DENV | NS1 | EU677176 | DENV | NS1 | FJ410192 | DENV | NS1 | EU482792 |
| DENV | NS1 | FJ639679 | DENV | NS1 | FJ182020 | DENV | NS1 | AF514889 |
| DENV | NS1 | FJ432742 | DENV | NS1 | DQ672561 | DENV | NS1 | EU482509 |
| DENV | NS1 | FJ639670 | DENV | NS1 | FJ024481 | DENV | NS1 | FJ432737 |
| DENV | NS1 | FJ182027 | DENV | NS1 | EU677165 | DENV | NS1 | FJ547063 |
| DENV | NS1 | EU482718 | DENV | NS1 | FJ410287 | DENV | NS1 | FJ373297 |
| DENV | NS1 | EU677158 | DENV | NS1 | EU482502 | DENV | NS1 | EU677157 |
| DENV | NS1 | FJ639687 | DENV | NS1 | EU081274 | DENV | NS1 | EU482534 |
| DENV | NS1 | FJ461325 | DENV | NS1 | FJ024448 | DENV | NS1 | EU249491 |
| DENV | NS1 | FJ024444 | DENV | NS1 | FJ024425 | DENV | NS1 | DQ285562 |
| DENV | NS1 | EU482617 | DENV | NS1 | FJ639741 | DENV | NS1 | EU482793 |
| DENV | NS1 | FJ639678 | DENV | NS1 | FJ562104 | DENV | NS1 | EU482717 |
| DENV | NS1 | EU081269 | DENV | NS1 | DQ672563 | DENV | NS1 | FJ024439 |
| DENV | NS1 | EU482714 | DENV | NS1 | EU482708 | DENV | NS1 | EU482804 |
| DENV | NS1 | FJ024456 | DENV | NS1 | FJ410247 | DENV | NS1 | EU482503 |
| DENV | NS1 | FJ182028 | DENV | NS1 | AF180817 | DENV | NS1 | EU677162 |
| DENV | NS1 | EU677152 | DENV | NS1 | AY722801 | DENV | NS1 | FJ024485 |
| DENV | NS1 | EU081228 | DENV | NS1 | EU482504 | DENV | NS1 | EU081271 |
| DENV | NS1 | FJ410173 | DENV | NS1 | FJ639675 | DENV | NS1 | FJ024426 |
| DENV | NS1 | EU482796 | DENV | NS1 | FJ024433 | DENV | NS1 | EU482790 |
| DENV | NS1 | EU726781 | DENV | NS1 | FJ461331 | DENV | NS1 | FJ410286 |
| DENV | NS1 | FJ410207 | DENV | NS1 | FJ410187 | DENV | NS1 | FJ639735 |
| DENV | NS1 | FJ410243 | DENV | NS1 | FJ410258 | DENV | NS1 | EU482494 |
| DENV | NS1 | EU081239 | DENV | NS1 | AY708047 | DENV | NS1 | FJ390374 |
| DENV | NS1 | EU482816 | DENV | NS1 | FJ024423 | DENV | NS1 | EU482813 |
| DENV | NS1 | EU081260 | DENV | NS1 | FJ024484 | DENV | NS1 | FJ461335 |
| DENV | NS1 | FJ182029 | DENV | NS1 | EU081251 | DENV | NS1 | EU482803 |
| DENV | NS1 | FJ024449 | DENV | NS1 | FJ410249 | DENV | NS1 | EU482490 |
| DENV | NS1 | EU081250 | DENV | NS1 | EU482610 | DENV | NS1 | FJ024482 |
| DENV | NS1 | EU482825 | DENV | NS1 | FJ182033 | DENV | NS1 | FJ410284 |
| DENV | NS1 | EU482530 | DENV | NS1 | EU482493 | DENV | NS1 | EU081280 |
| DENV | NS1 | FJ639820 | DENV | NS1 | EU482807 | DENV | NS1 | EU677150 |
| DENV | NS1 | EU677175 | DENV | NS1 | FJ639814 | DENV | NS1 | AY732481 |
| DENV | NS1 | FJ410251 | DENV | NS1 | EU482501 | DENV | NS1 | FJ461324 |
| DENV | NS1 | EU482794 | DENV | NS1 | FJ410254 | DENV | NS1 | FJ639796 |
| DENV | NS1 | EU359008 | DENV | NS1 | EU081246 | DENV | NS1 | EU482709 |
| DENV | NS1 | AF180818 | DENV | NS1 | EU081275 | DENV | NS1 | AF298808 |
| DENV | NS1 | EU660396 | DENV | NS1 | FJ410264 | DENV | NS1 | FJ182018 |
| DENV | NS1 | FJ182003 | DENV | NS1 | FJ024479 | DENV | NS1 | DQ672558 |

FIG. 70-63

| Virus | Protein | Accession No. | Virus | Protein | Accession No. | Virus | Protein | Accession No. |
|---|---|---|---|---|---|---|---|---|
| DENV | NS1 | EU482795 | DENV | NS1 | FJ898410 | DENV | NS1 | FJ859029 |
| DENV | NS1 | EU677164 | DENV | NS1 | FJ882528 | DENV | NS1 | FJ882515 |
| DENV | NS1 | FJ410277 | DENV | NS1 | FJ898382 | DENV | NS1 | GQ199820 |
| DENV | NS1 | FJ024464 | DENV | NS1 | FJ898404 | DENV | NS1 | GQ199867 |
| DENV | NS1 | FJ461332 | DENV | NS1 | FJ687426 | DENV | NS1 | FJ898448 |
| DENV | NS1 | EF122232 | DENV | NS1 | FJ898371 | DENV | NS1 | FJ882556 |
| DENV | NS1 | FJ432727 | DENV | NS1 | GQ199872 | DENV | NS1 | FJ882536 |
| DENV | NS1 | EU482823 | DENV | NS1 | GQ199855 | DENV | NS1 | GQ199796 |
| DENV | NS1 | EU482810 | DENV | NS1 | FJ882535 | DENV | NS1 | FJ882570 |
| DENV | NS1 | EU081245 | DENV | NS1 | NC_001477 | DENV | NS1 | FJ898376 |
| DENV | NS1 | EU081262 | DENV | NS1 | FJ898423 | DENV | NS1 | GQ199771 |
| DENV | NS1 | EU863650 | DENV | NS1 | FJ882565 | DENV | NS1 | FJ850069 |
| DENV | NS1 | AY732483 | DENV | NS1 | FJ882517 | DENV | NS1 | FJ850102 |
| DENV | NS1 | FJ410265 | DENV | NS1 | GQ199814 | DENV | NS1 | GQ199834 |
| DENV | NS1 | EU660412 | DENV | NS1 | FJ898395 | DENV | NS1 | FJ898388 |
| DENV | NS1 | EU677171 | DENV | NS1 | GQ199851 | DENV | NS1 | GQ199830 |
| DENV | NS1 | EU677140 | DENV | NS1 | GQ199837 | DENV | NS1 | GQ199839 |
| DENV | NS1 | FJ898428 | DENV | NS1 | FJ882558 | DENV | NS1 | GQ199777 |
| DENV | NS1 | FJ882569 | DENV | NS1 | FJ850084 | DENV | NS1 | FJ882579 |
| DENV | NS1 | GQ199776 | DENV | NS1 | FJ898374 | DENV | NS1 | FJ898429 |
| DENV | NS1 | GQ199853 | DENV | NS1 | FJ850104 | DENV | NS1 | FJ882541 |
| DENV | NS1 | GQ199803 | DENV | NS1 | GQ199815 | DENV | NS1 | FJ898402 |
| DENV | NS1 | FJ882554 | DENV | NS1 | GQ199843 | DENV | NS1 | GQ199808 |
| DENV | NS1 | FJ873809 | DENV | NS1 | GQ199826 | DENV | NS1 | GQ199786 |
| DENV | NS1 | FJ882563 | DENV | NS1 | FJ882550 | DENV | NS1 | FJ882547 |
| DENV | NS1 | GQ199812 | DENV | NS1 | FJ744701 | DENV | NS1 | GQ199798 |
| DENV | NS1 | FJ873810 | DENV | NS1 | FJ898391 | DENV | NS1 | GQ199844 |
| DENV | NS1 | FJ898397 | DENV | NS1 | FJ898417 | DENV | NS1 | GQ199829 |
| DENV | NS1 | FJ898400 | DENV | NS1 | GQ199806 | DENV | NS1 | FJ882530 |
| DENV | NS1 | FJ687433 | DENV | NS1 | GQ199794 | DENV | NS1 | FJ898422 |
| DENV | NS1 | GQ199877 | DENV | NS1 | FJ898425 | DENV | NS1 | FJ810415 |
| DENV | NS1 | GQ199788 | DENV | NS1 | FJ898393 | DENV | NS1 | FJ898411 |
| DENV | NS1 | GQ199823 | DENV | NS1 | GQ199799 | DENV | NS1 | GQ199856 |
| DENV | NS1 | FJ898407 | DENV | NS1 | GQ199833 | DENV | NS1 | FJ850101 |
| DENV | NS1 | GQ199804 | DENV | NS1 | GQ199781 | DENV | NS1 | FJ850093 |
| DENV | NS1 | FJ882533 | DENV | NS1 | GQ199797 | DENV | NS1 | FJ882551 |
| DENV | NS1 | GQ199818 | DENV | NS1 | FJ882522 | DENV | NS1 | GQ199795 |
| DENV | NS1 | FJ882560 | DENV | NS1 | FJ906964 | DENV | NS1 | FJ850100 |
| DENV | NS1 | FJ898415 | DENV | NS1 | GQ199821 | DENV | NS1 | FJ898416 |
| DENV | NS1 | FJ850113 | DENV | NS1 | GQ199847 | DENV | NS1 | GQ199785 |
| DENV | NS1 | FJ898384 | DENV | NS1 | FJ882524 | DENV | NS1 | GQ199784 |
| DENV | NS1 | FJ882538 | DENV | NS1 | FJ850077 | DENV | NS1 | GQ199828 |
| DENV | NS1 | FJ882521 | DENV | NS1 | FJ882552 | DENV | NS1 | GQ199780 |
| DENV | NS1 | GQ199811 | DENV | NS1 | GQ199778 | DENV | NS1 | FJ850103 |
| DENV | NS1 | FJ850075 | DENV | NS1 | FJ882549 | DENV | NS1 | FJ882555 |
| DENV | NS1 | GQ199848 | DENV | NS1 | GQ199816 | DENV | NS1 | FJ882561 |
| DENV | NS1 | FJ898378 | DENV | NS1 | GQ199824 | DENV | NS1 | FJ687430 |
| DENV | NS1 | FJ873814 | DENV | NS1 | FJ898398 | DENV | NS1 | FJ898381 |

FIG. 70-64

| Virus | Protein | Accession No. | Virus | Protein | Accession No. | Virus | Protein | Accession No. |
|---|---|---|---|---|---|---|---|---|
| DENV | NS1 | FJ882518 | DENV | NS1 | FJ882531 | DENV | NS1 | GQ199838 |
| DENV | NS1 | FJ898392 | DENV | NS1 | GQ199810 | DENV | NS1 | GQ199779 |
| DENV | NS1 | FJ898380 | DENV | NS1 | GQ199825 | DENV | NS1 | GQ199827 |
| DENV | NS1 | GQ199835 | DENV | NS1 | FJ882546 | DENV | NS1 | GQ199836 |
| DENV | NS1 | FJ898430 | DENV | NS1 | FJ882568 | DENV | NS1 | GQ199858 |
| DENV | NS1 | FJ850087 | DENV | NS1 | FJ898413 | DENV | NS1 | GQ199787 |
| DENV | NS1 | FJ898385 | DENV | NS1 | GQ199773 | DENV | NS1 | FJ850068 |
| DENV | NS1 | GQ199857 | DENV | NS1 | GQ199822 | DENV | NS1 | FJ882564 |
| DENV | NS1 | FJ898403 | DENV | NS1 | GQ199832 | DENV | NS1 | FJ898419 |
| DENV | NS1 | GQ199800 | DENV | NS1 | GQ199790 | DENV | NS1 | FJ898383 |
| DENV | NS1 | FJ882540 | DENV | NS1 | GQ199841 | DENV | NS1 | FJ461328 |
| DENV | NS1 | GQ199792 | DENV | NS1 | FJ882520 | DENV | NS1 | FJ882527 |
| DENV | NS1 | FJ882516 | DENV | NS1 | GQ199875 | DENV | NS1 | FJ898427 |
| DENV | NS1 | GQ199850 | DENV | NS1 | GQ199802 | DENV | NS1 | FJ882525 |
| DENV | NS1 | FJ898372 | DENV | NS1 | GQ199791 | DENV | NS1 | FJ882557 |
| DENV | NS1 | GQ199775 | DENV | NS1 | FJ898426 | DENV | NS1 | GQ199859 |
| DENV | NS1 | FJ882559 | DENV | NS1 | FJ898431 | DENV | NS1 | GQ199842 |
| DENV | NS1 | GQ199789 | DENV | NS1 | GQ199809 | DENV | NS1 | GQ199817 |
| DENV | NS1 | FJ850099 | DENV | NS1 | FJ898406 | DENV | NS1 | FJ898401 |
| DENV | NS1 | FJ850114 | DENV | NS1 | GQ199805 | DENV | NS1 | FJ882519 |
| DENV | NS1 | GQ199819 | DENV | NS1 | GQ199831 | DENV | NS1 | FJ850090 |
| DENV | NS1 | FJ882523 | DENV | NS1 | FJ850070 | DENV | NS1 | FJ898377 |
| DENV | NS1 | GQ199845 | DENV | NS1 | GQ199807 | DENV | NS1 | GQ199774 |
| DENV | NS1 | FJ850081 | DENV | NS1 | FJ882543 | DENV | NS1 | FJ898399 |
| DENV | NS1 | FJ744702 | DENV | NS1 | FJ898408 | DENV | NS1 | GQ199840 |
| DENV | NS1 | FJ898386 | DENV | NS1 | FJ810419 | DENV | NS1 | FJ898433 |
| DENV | NS1 | FJ882542 | DENV | NS1 | GQ199793 | DENV | NS1 | FJ882567 |
| DENV | NS1 | GQ199782 | DENV | NS1 | FJ882562 | DENV | NS1 | FJ898387 |
| DENV | NS1 | GQ199852 | DENV | NS1 | FJ898424 | DENV | NS1 | FJ882532 |
| DENV | NS1 | FJ898421 | DENV | NS1 | FJ898389 | DENV | NS1 | FJ898409 |
| DENV | NS1 | FJ687432 | DENV | NS1 | FJ898412 | DENV | NS1 | FJ882545 |
| DENV | NS1 | GQ199813 | DENV | NS1 | FJ882537 | DENV | NS1 | FJ898375 |
| DENV | NS1 | FJ882534 | DENV | NS1 | FJ898418 | DENV | NS1 | FJ898414 |
| DENV | NS1 | GQ199854 | DENV | NS1 | FJ898394 | DENV | NS1 | CS477306 |
| DENV | NS1 | GQ199846 | DENV | NS1 | GQ199849 | DENV | NS1 | A75711 |
| DENV | NS1 | FJ882539 | DENV | NS1 | FJ882548 | DENV | NS1 | GU131816 |
| DENV | NS1 | FJ898437 | DENV | NS1 | FJ906963 | DENV | NS1 | FJ469907 |
| DENV | NS1 | FJ898390 | DENV | NS1 | FJ906965 | DENV | NS1 | GU131814 |
| DENV | NS1 | FJ898405 | DENV | NS1 | GQ199873 | DENV | NS1 | GU131725 |
| DENV | NS1 | GQ199783 | DENV | NS1 | FJ850073 | DENV | NS1 | GU131822 |
| DENV | NS1 | FJ882526 | DENV | NS1 | FJ850071 | DENV | NS1 | GQ868633 |
| DENV | NS1 | FJ461320 | DENV | NS1 | GQ199772 | DENV | NS1 | GU131820 |
| DENV | NS1 | FJ898420 | DENV | NS1 | FJ898373 | DENV | NS1 | GU131679 |
| DENV | NS1 | FJ687431 | DENV | NS1 | FJ687429 | DENV | NS1 | GQ868507 |
| DENV | NS1 | GQ199801 | DENV | NS1 | FJ898379 | DENV | NS1 | GU131789 |
| DENV | NS1 | FJ906728 | DENV | NS1 | FJ882566 | DENV | NS1 | GU131710 |
| DENV | NS1 | FJ882544 | DENV | NS1 | FJ898396 | DENV | NS1 | FN429887 |
| DENV | NS1 | FJ882553 | DENV | NS1 | FJ882529 | DENV | NS1 | GU131720 |

FIG. 70-65

| Virus | Protein Accession No. | Virus | Protein Accession No. | Virus | Protein Accession No. |
|---|---|---|---|---|---|
| DENV | NS1GU131841 | DENV | NS1GU131689 | DENV | NS1GQ868534 |
| DENV | NS1GQ868564 | DENV | NS1GU131700 | DENV | NS1GU131687 |
| DENV | NS1AB519681 | DENV | NS1GU131798 | DENV | NS1GQ868529 |
| DENV | NS1GU131743 | DENV | NS1GU131713 | DENV | NS1GU131840 |
| DENV | NS1GQ868522 | DENV | NS1GU131829 | DENV | NS1GU131808 |
| DENV | NS1GU131739 | DENV | NS1GU131782 | DENV | NS1GU131922 |
| DENV | NS1GU131971 | DENV | NS1GU131698 | DENV | NS1GU131836 |
| DENV | NS1GU131834 | DENV | NS1GU131732 | DENV | NS1GQ868613 |
| DENV | NS1GQ868523 | DENV | NS1GU131772 | DENV | NS1GU131721 |
| DENV | NS1GU131982 | DENV | NS1GU131978 | DENV | NS1GU131730 |
| DENV | NS1GU131965 | DENV | NS1GU131958 | DENV | NS1GU131968 |
| DENV | NS1GU131760 | DENV | NS1GU131811 | DENV | NS1GU131832 |
| DENV | NS1GQ868535 | DENV | NS1GQ868506 | DENV | NS1GU131774 |
| DENV | NS1GU131962 | DENV | NS1GQ868525 | DENV | NS1GU131976 |
| DENV | NS1GU131891 | DENV | NS1GQ868538 | DENV | NS1GU131831 |
| DENV | NS1GQ868504 | DENV | NS1FJ469909 | DENV | NS1GQ868501 |
| DENV | NS1GU131783 | DENV | NS1GU131818 | DENV | NS1GQ868531 |
| DENV | NS1GU131680 | DENV | NS1GU131893 | DENV | NS1GU131957 |
| DENV | NS1GU131704 | DENV | NS1GQ868509 | DENV | NS1GU131980 |
| DENV | NS1GU131685 | DENV | NS1GU131706 | DENV | NS1GQ868609 |
| DENV | NS1GU131770 | DENV | NS1GU131777 | DENV | NS1GU131769 |
| DENV | NS1GU131795 | DENV | NS1GU131925 | DENV | NS1GQ868526 |
| DENV | NS1GU131961 | DENV | NS1GU131977 | DENV | NS1GQ868510 |
| DENV | NS1GU131733 | DENV | NS1GQ868611 | DENV | NS1FN429882 |
| DENV | NS1GU131804 | DENV | NS1GU131745 | DENV | NS1GU131763 |
| DENV | NS1GU131762 | DENV | NS1GQ868635 | DENV | NS1GQ868527 |
| DENV | NS1GU131827 | DENV | NS1GU056032 | DENV | NS1GU131708 |
| DENV | NS1GU131837 | DENV | NS1GQ868610 | DENV | NS1GU131766 |
| DENV | NS1GQ868630 | DENV | NS1GU131889 | DENV | NS1FN429890 |
| DENV | NS1GU131767 | DENV | NS1GQ868499 | DENV | NS1GU131694 |
| DENV | NS1GU131737 | DENV | NS1GU131756 | DENV | NS1GQ868615 |
| DENV | NS1GQ868500 | DENV | NS1GU131786 | DENV | NS1GU131688 |
| DENV | NS1GU131722 | DENV | NS1GQ868565 | DENV | NS1FJ469908 |
| DENV | NS1GQ868607 | DENV | NS1GU131709 | DENV | NS1GU131734 |
| DENV | NS1GQ868517 | DENV | NS1GQ868569 | DENV | NS1GQ868637 |
| DENV | NS1GU131727 | DENV | NS1GU131723 | DENV | NS1GU131888 |
| DENV | NS1GU131715 | DENV | NS1GU131696 | DENV | NS1GQ868568 |
| DENV | NS1FN429885 | DENV | NS1GQ868519 | DENV | NS1GU131790 |
| DENV | NS1GU131780 | DENV | NS1GU131838 | DENV | NS1GU131920 |
| DENV | NS1GU131750 | DENV | NS1GQ868520 | DENV | NS1GQ868528 |
| DENV | NS1GU131787 | DENV | NS1GU131791 | DENV | NS1GQ868612 |
| DENV | NS1GU056031 | DENV | NS1GU131765 | DENV | NS1GU131794 |
| DENV | NS1GQ868602 | DENV | NS1GU131702 | DENV | NS1GQ868606 |
| DENV | NS1GU131711 | DENV | NS1GU131682 | DENV | NS1GU131969 |
| DENV | NS1GQ868567 | DENV | NS1GU131801 | DENV | NS1GQ868608 |
| DENV | NS1GU131813 | DENV | NS1GQ868562 | DENV | NS1GU131921 |
| DENV | NS1FJ687428 | DENV | NS1GU131684 | DENV | NS1GQ868502 |
| DENV | NS1GU131707 | DENV | NS1GU131744 | DENV | NS1GU131719 |

FIG. 70-66

| Virus | Protein Accession No. | Virus | Protein Accession No. | Virus | Protein Accession No. |
|---|---|---|---|---|---|
| DENV | NS1GU131973 | DENV | NS1GU131764 | DENV | NS1FN429888 |
| DENV | NS1GU131967 | DENV | NS1GU056030 | DENV | NS1GU131778 |
| DENV | NS1GU131803 | DENV | NS1GU131979 | DENV | NS1GU131972 |
| DENV | NS1GU131736 | DENV | NS1GU131768 | DENV | NS1GU131817 |
| DENV | NS1GU131981 | DENV | NS1GU131699 | DENV | NS1GU131759 |
| DENV | NS1GU131964 | DENV | NS1FJ687427 | DENV | NS1GU131819 |
| DENV | NS1GU131771 | DENV | NS1GU131963 | DENV | NS1GU131757 |
| DENV | NS1GU131984 | DENV | NS1GU131793 | DENV | NS1GQ868533 |
| DENV | NS1GU131695 | DENV | NS1GQ868618 | DENV | NS1FN429883 |
| DENV | NS1GU131728 | DENV | NS1GU131799 | DENV | NS1GU131956 |
| DENV | NS1GQ868601 | DENV | NS1GU131724 | DENV | NS1GQ868563 |
| DENV | NS1FN429886 | DENV | NS1GU131740 | DENV | NS1GU131926 |
| DENV | NS1GU131826 | DENV | NS1GU131806 | DENV | NS1GU131887 |
| DENV | NS1GQ868512 | DENV | NS1GQ868614 | DENV | NS1GU131741 |
| DENV | NS1GU131718 | DENV | NS1FN429881 | DENV | NS1GU131761 |
| DENV | NS1GQ868513 | DENV | NS1GQ868636 | DENV | NS1GU131693 |
| DENV | NS1GU131731 | DENV | NS1GU131746 | DENV | NS1GU131753 |
| DENV | NS1GU131686 | DENV | NS1GQ868560 | DENV | NS1GU131948 |
| DENV | NS1GU131894 | DENV | NS1GQ868508 | DENV | NS1GQ868559 |
| DENV | NS1GU131895 | DENV | NS1GQ868570 | DENV | NS1GQ868530 |
| DENV | NS1GU131678 | DENV | NS1GU131788 | DENV | NS1GU131797 |
| DENV | NS1GQ868619 | DENV | NS1GU131949 | DENV | NS1GU131785 |
| DENV | NS1GU131729 | DENV | NS1GU131796 | DENV | NS1GU131758 |
| DENV | NS1GQ868539 | DENV | NS1GU056029 | DENV | NS1GU131697 |
| DENV | NS1GU131747 | DENV | NS1GU131792 | DENV | NS1GU131835 |
| DENV | NS1GU131748 | DENV | NS1GU131690 | DENV | NS1GU131716 |
| DENV | NS1FN429889 | DENV | NS1GQ868632 | DENV | NS1GQ868498 |
| DENV | NS1GU131776 | DENV | NS1GU131781 | DENV | NS1GU131683 |
| DENV | NS1GU131755 | DENV | NS1GQ868537 | DENV | NS1GU131960 |
| DENV | NS1GU131810 | DENV | NS1GU131815 | DENV | NS1GU131714 |
| DENV | NS1GU131701 | DENV | NS1GU056033 | DENV | NS1GU131779 |
| DENV | NS1GU131754 | DENV | NS1GU131812 | DENV | NS1GU131773 |
| DENV | NS1GU131784 | DENV | NS1GU131833 | DENV | NS1GQ868605 |
| DENV | NS1GU131807 | DENV | NS1GU131830 | DENV | NS1GQ868511 |
| DENV | NS1GU131842 | DENV | NS1GU131742 | DENV | NS1GU131752 |
| DENV | NS1GU131923 | DENV | NS1GQ868561 | DENV | NS1GU131691 |
| DENV | NS1GU131809 | DENV | NS1GU131800 | DENV | NS1GU131692 |
| DENV | NS1GU131726 | DENV | NS1GU131738 | DENV | NS1GU131705 |
| DENV | NS1GU131970 | DENV | NS1GU131824 | DENV | NS1GQ868639 |
| DENV | NS1GU131751 | DENV | NS1GU131919 | DENV | NS1GU131805 |
| DENV | NS1GU131828 | DENV | NS1GU131802 | DENV | NS1GU131735 |
| DENV | NS1GQ868524 | DENV | NS1GQ868503 | DENV | NS1GU131966 |
| DENV | NS1GU131863 | DENV | NS1GU131839 | DENV | NS1GU131890 |
| DENV | NS1GU131892 | DENV | NS1GU131681 | DENV | NS1GQ868566 |
| DENV | NS1GU131823 | DENV | NS1GQ868505 | DENV | NS1GU131775 |
| DENV | NS1GU131821 | DENV | NS1FN429884 | DENV | NS1GU131749 |
| DENV | NS1GU131983 | DENV | NS1GQ868536 | DENV | NS1GQ868521 |
| DENV | NS1GQ868518 | DENV | NS1GU131825 | DENV | NS1GU131703 |

FIG. 70-67

| Virus | Protein Accession No. | Virus | Protein Accession No. | Virus | Protein Accession No. |
|---|---|---|---|---|---|
| DENV | NS1GU131717 | DENV | NS1FJ182016 | DENV | NS1GQ868585 |
| DENV | NS1GU131712 | DENV | NS1AF326573 | DENV | NS1GQ868579 |
| DENV | NS1GQ868532 | DENV | NS1FJ182017 | DENV | NS1GQ868644 |
| DENV | NS1GQ868514 | DENV | NS1FJ024476 | DENV | NS1FN429925 |
| DENV | NS1FJ410220 | DENV | NS1EF457906 | DENV | NS1GU289913 |
| DENV | NS1CS477302 | DENV | NS1FJ639742 | DENV | NS1GQ868580 |
| DENV | NS1CS477304 | DENV | NS1AF289029 | DENV | NS1FN429922 |
| DENV | NS1CS477264 | DENV | NS1GQ199880 | DENV | NS1GQ868645 |
| DENV | NS1CS477305 | DENV | NS1FJ882597 | DENV | NS1GQ868594 |
| DENV | NS1CS477263 | DENV | NS1NC_002640 | DENV | NS1FN429924 |
| DENV | NS1CS477265 | DENV | NS1FJ882587 | DENV | NS1FJ882590 |
| DENV | NS1M87512 | DENV | NS1FJ882595 | DENV | NS1GQ868582 |
| DENV | NS1FB730116 | DENV | NS1FJ882582 | DENV | NS1GQ868584 |
| DENV | NS1GM059691 | DENV | NS1FJ810417 | DENV | NS1FN429926 |
| DENV | NS1U88536 | DENV | NS1FJ850095 | DENV | NS1FN429921 |
| DENV | NS1GU370048 | DENV | NS1FJ882599 | DENV | NS1GQ868643 |
| DENV | NS1GU370049 | DENV | NS1FJ882580 | DENV | NS1AF326825 |
| DENV | NS1AY762085 | DENV | NS1GQ199884 | DENV | NS1AY376438 |
| DENV | NS1FJ024424 | DENV | NS1FJ882588 | DENV | NS1AY648301 |
| DENV | NS1FJ226067 | DENV | NS1FJ882598 | DENV | NS1AY099336 |
| DENV | NS1FJ639745 | DENV | NS1FJ882601 | DENV | NS1GU363549 |
| DENV | NS1AY618989 | DENV | NS1FJ850058 | DENV | NS1GU370052 |
| DENV | NS1AF326827 | DENV | NS1FJ882584 | DENV | NS1GU370053 |
| DENV | NS1AY618988 | DENV | NS1FJ850059 | DENV | NS1EU081191 |
| DENV | NS1EU854296 | DENV | NS1GQ199883 | DENV | NS1DQ401690 |
| DENV | NS1EU854300 | DENV | NS1FJ882586 | DENV | NS1EU529683 |
| DENV | NS1AY858050 | DENV | NS1GQ252675 | DENV | NS1AY679147 |
| DENV | NS1AF375822 | DENV | NS1FJ882581 | DENV | NS1AY676348 |
| DENV | NS1EU854295 | DENV | NS1GQ199881 | DENV | NS1EF629368 |
| DENV | NS1M14931 | DENV | NS1GQ199878 | DENV | NS1FJ639752 |
| DENV | NS1AY618992 | DENV | NS1FJ882596 | DENV | NS1FJ639807 |
| DENV | NS1EU854297 | DENV | NS1FJ882583 | DENV | NS1EU529684 |
| DENV | NS1FJ639738 | DENV | NS1FJ882600 | DENV | NS1FJ373304 |
| DENV | NS1AY618993 | DENV | NS1FJ850057 | DENV | NS1FJ639723 |
| DENV | NS1FJ639764 | DENV | NS1GQ199879 | DENV | NS1EU569691 |
| DENV | NS1FJ639737 | DENV | NS1FJ882585 | DENV | NS1DQ675524 |
| DENV | NS1AY776330 | DENV | NS1GQ199876 | DENV | NS1EU081203 |
| DENV | NS1AY618991 | DENV | NS1GQ199885 | DENV | NS1EU482564 |
| DENV | NS1FJ639736 | DENV | NS1FJ882592 | DENV | NS1FJ182039 |
| DENV | NS1FJ639739 | DENV | NS1GQ199882 | DENV | NS1EU482453 |
| DENV | NS1AF326826 | DENV | NS1FJ882591 | DENV | NS1FJ639779 |
| DENV | NS1AY947539 | DENV | NS1FJ882589 | DENV | NS1EU081183 |
| DENV | NS1EU854299 | DENV | NS1GQ868642 | DENV | NS1EU529690 |
| DENV | NS1AY618990 | DENV | NS1GQ868581 | DENV | NS1FJ182011 |
| DENV | NS1FJ639748 | DENV | NS1FN429919 | DENV | NS1EU081187 |
| DENV | NS1FJ639744 | DENV | NS1GQ868583 | DENV | NS1EU482461 |
| DENV | NS1EU854301 | DENV | NS1FN429920 | DENV | NS1FJ639803 |
| DENV | NS1FJ639773 | DENV | NS1FN429923 | DENV | NS1AY858047 |

FIG. 70-68

| Virus | Protein | Accession No. | Virus | Protein | Accession No. | Virus | Protein | Accession No. |
|---|---|---|---|---|---|---|---|---|
| DENV | NS1 | FJ639774 | DENV | NS1 | EU687226 | DENV | NS1 | EU081192 |
| DENV | NS1 | FJ639726 | DENV | NS1 | FJ639715 | DENV | NS1 | FJ432731 |
| DENV | NS1 | AY858037 | DENV | NS1 | AY676352 | DENV | NS1 | AB189126 |
| DENV | NS1 | EU081215 | DENV | NS1 | AY858043 | DENV | NS1 | FJ024471 |
| DENV | NS1 | FJ639785 | DENV | NS1 | EU081196 | DENV | NS1 | FJ639769 |
| DENV | NS1 | FJ639761 | DENV | NS1 | FJ432741 | DENV | NS1 | FJ547078 |
| DENV | NS1 | EU569688 | DENV | NS1 | EU726773 | DENV | NS1 | FJ547080 |
| DENV | NS1 | DQ675533 | DENV | NS1 | EU482555 | DENV | NS1 | AY744679 |
| DENV | NS1 | FJ410177 | DENV | NS1 | DQ401694 | DENV | NS1 | EU081217 |
| DENV | NS1 | FJ478456 | DENV | NS1 | EU081216 | DENV | NS1 | AY858045 |
| DENV | NS1 | EU081195 | DENV | NS1 | EU529704 | DENV | NS1 | FJ547084 |
| DENV | NS1 | EU081221 | DENV | NS1 | FJ639777 | DENV | NS1 | DQ675521 |
| DENV | NS1 | EU529689 | DENV | NS1 | FJ639730 | DENV | NS1 | AY776329 |
| DENV | NS1 | EU660408 | DENV | NS1 | EU081190 | DENV | NS1 | FJ639789 |
| DENV | NS1 | EU687219 | DENV | NS1 | EU529703 | DENV | NS1 | AY496871 |
| DENV | NS1 | FJ639780 | DENV | NS1 | FJ639725 | DENV | NS1 | EU781136 |
| DENV | NS1 | EU687196 | DENV | NS1 | EU081205 | DENV | NS1 | FJ182013 |
| DENV | NS1 | EF643017 | DENV | NS1 | AY876494 | DENV | NS1 | EU596492 |
| DENV | NS1 | FJ373303 | DENV | NS1 | FJ639747 | DENV | NS1 | EU726774 |
| DENV | NS1 | FJ639729 | DENV | NS1 | FJ373302 | DENV | NS1 | EU081198 |
| DENV | NS1 | FJ639775 | DENV | NS1 | FJ639778 | DENV | NS1 | FJ639728 |
| DENV | NS1 | FJ461322 | DENV | NS1 | DQ401692 | DENV | NS1 | DQ675530 |
| DENV | NS1 | FJ390371 | DENV | NS1 | FJ182038 | DENV | NS1 | EU660409 |
| DENV | NS1 | AY858046 | DENV | NS1 | EU081220 | DENV | NS1 | EU081206 |
| DENV | NS1 | EU482455 | DENV | NS1 | AY923865 | DENV | NS1 | EU081222 |
| DENV | NS1 | AY744680 | DENV | NS1 | EU081188 | DENV | NS1 | EU660407 |
| DENV | NS1 | FJ182015 | DENV | NS1 | FJ461337 | DENV | NS1 | M93130 |
| DENV | NS1 | FJ562103 | DENV | NS1 | EU081224 | DENV | NS1 | EU529687 |
| DENV | NS1 | FJ639792 | DENV | NS1 | EU081207 | DENV | NS1 | DQ675523 |
| DENV | NS1 | DQ675527 | DENV | NS1 | FJ639750 | DENV | NS1 | FJ432722 |
| DENV | NS1 | FJ547066 | DENV | NS1 | AB189128 | DENV | NS1 | EU482559 |
| DENV | NS1 | EU529698 | DENV | NS1 | AY676353 | DENV | NS1 | FJ639721 |
| DENV | NS1 | EU726769 | DENV | NS1 | EU081209 | DENV | NS1 | AY744682 |
| DENV | NS1 | AY676349 | DENV | NS1 | FJ639772 | DENV | NS1 | EU081184 |
| DENV | NS1 | EU529688 | DENV | NS1 | FJ182040 | DENV | NS1 | FJ639805 |
| DENV | NS1 | EU482558 | DENV | NS1 | AY648961 | DENV | NS1 | FJ547074 |
| DENV | NS1 | FJ547070 | DENV | NS1 | FJ410178 | DENV | NS1 | EU529685 |
| DENV | NS1 | EU687198 | DENV | NS1 | EU529699 | DENV | NS1 | DQ401695 |
| DENV | NS1 | FJ639817 | DENV | NS1 | EU081199 | DENV | NS1 | FJ432743 |
| DENV | NS1 | EU081202 | DENV | NS1 | FJ639786 | DENV | NS1 | EU854291 |
| DENV | NS1 | EU081225 | DENV | NS1 | FJ639768 | DENV | NS1 | FJ182008 |
| DENV | NS1 | DQ675520 | DENV | NS1 | FJ639731 | DENV | NS1 | FJ547062 |
| DENV | NS1 | EU854298 | DENV | NS1 | FJ390373 | DENV | NS1 | FJ024467 |
| DENV | NS1 | FJ205870 | DENV | NS1 | FJ639800 | DENV | NS1 | EU687239 |
| DENV | NS1 | FJ639793 | DENV | NS1 | FJ547079 | DENV | NS1 | FJ024468 |
| DENV | NS1 | DQ675532 | DENV | NS1 | FJ547072 | DENV | NS1 | AY496874 |
| DENV | NS1 | FJ024470 | DENV | NS1 | EU081219 | DENV | NS1 | FJ547061 |
| DENV | NS1 | EU081210 | DENV | NS1 | EU596493 | DENV | NS1 | FJ547076 |

FIG. 70-69

| Virus | Protein | Accession No. | Virus | Protein | Accession No. | Virus | Protein | Accession No. |
|---|---|---|---|---|---|---|---|---|
| DENV | NS1 | FJ639767 | DENV | NS1 | FJ024466 | DENV | NS1 | FJ639722 |
| DENV | NS1 | AB189125 | DENV | NS1 | FJ639795 | DENV | NS1 | FJ639782 |
| DENV | NS1 | AF317645 | DENV | NS1 | FJ024465 | DENV | NS1 | AY858042 |
| DENV | NS1 | AB189127 | DENV | NS1 | EU726768 | DENV | NS1 | EU081185 |
| DENV | NS1 | EU781137 | DENV | NS1 | FJ639720 | DENV | NS1 | FJ390377 |
| DENV | NS1 | DQ675522 | DENV | NS1 | EU529696 | DENV | NS1 | FJ639763 |
| DENV | NS1 | EU482614 | DENV | NS1 | FJ639810 | DENV | NS1 | FJ639760 |
| DENV | NS1 | AB214879 | DENV | NS1 | AY744681 | DENV | NS1 | FJ182009 |
| DENV | NS1 | FJ639765 | DENV | NS1 | FJ639724 | DENV | NS1 | EU529697 |
| DENV | NS1 | EU081211 | DENV | NS1 | EU482595 | DENV | NS1 | DQ675529 |
| DENV | NS1 | FJ639787 | DENV | NS1 | AY676351 | DENV | NS1 | FJ639727 |
| DENV | NS1 | FJ639784 | DENV | NS1 | DQ401689 | DENV | NS1 | FJ461329 |
| DENV | NS1 | EU569690 | DENV | NS1 | FJ182005 | DENV | NS1 | EU482457 |
| DENV | NS1 | EU081223 | DENV | NS1 | FJ547085 | DENV | NS1 | FJ639827 |
| DENV | NS1 | FJ639816 | DENV | NS1 | EU081193 | DENV | NS1 | EU687197 |
| DENV | NS1 | AY496873 | DENV | NS1 | FJ639751 | DENV | NS1 | FJ639801 |
| DENV | NS1 | FJ182010 | DENV | NS1 | DQ675525 | DENV | NS1 | FJ410176 |
| DENV | NS1 | AY099337 | DENV | NS1 | FJ639826 | DENV | NS1 | EU081218 |
| DENV | NS1 | AY496879 | DENV | NS1 | EU482458 | DENV | NS1 | AY744684 |
| DENV | NS1 | EU482462 | DENV | NS1 | EU081204 | DENV | NS1 | FJ390376 |
| DENV | NS1 | FJ639825 | DENV | NS1 | EU529691 | DENV | NS1 | FJ639781 |
| DENV | NS1 | AY766104 | DENV | NS1 | FJ639719 | DENV | NS1 | DQ675528 |
| DENV | NS1 | FJ182007 | DENV | NS1 | FJ182037 | DENV | NS1 | FJ639766 |
| DENV | NS1 | DQ401693 | DENV | NS1 | EU482612 | DENV | NS1 | EU687221 |
| DENV | NS1 | DQ675531 | DENV | NS1 | EU482596 | DENV | NS1 | EU081197 |
| DENV | NS1 | FJ461326 | DENV | NS1 | EU081208 | DENV | NS1 | FJ639755 |
| DENV | NS1 | FJ373306 | DENV | NS1 | EU081201 | DENV | NS1 | FJ639798 |
| DENV | NS1 | EU569689 | DENV | NS1 | FJ639757 | DENV | NS1 | FJ639758 |
| DENV | NS1 | AY858041 | DENV | NS1 | FJ639713 | DENV | NS1 | EU687218 |
| DENV | NS1 | EU482566 | DENV | NS1 | AY744685 | DENV | NS1 | EU081189 |
| DENV | NS1 | EF629370 | DENV | NS1 | FJ182041 | DENV | NS1 | FJ639759 |
| DENV | NS1 | AY496877 | DENV | NS1 | FJ562099 | DENV | NS1 | EU081212 |
| DENV | NS1 | FJ562102 | DENV | NS1 | FJ562100 | DENV | NS1 | EU482460 |
| DENV | NS1 | EF629367 | DENV | NS1 | FJ547081 | DENV | NS1 | FJ547075 |
| DENV | NS1 | FJ547077 | DENV | NS1 | AY858044 | DENV | NS1 | AY676350 |
| DENV | NS1 | FJ639770 | DENV | NS1 | FJ639714 | DENV | NS1 | EU854292 |
| DENV | NS1 | EU081182 | DENV | NS1 | EU529686 | DENV | NS1 | EU660410 |
| DENV | NS1 | EU596494 | DENV | NS1 | FJ410229 | DENV | NS1 | FJ432728 |
| DENV | NS1 | FJ639749 | DENV | NS1 | FJ547073 | DENV | NS1 | FJ024469 |
| DENV | NS1 | EU726771 | DENV | NS1 | FJ639791 | DENV | NS1 | AY858048 |
| DENV | NS1 | FJ639746 | DENV | NS1 | EU529692 | DENV | NS1 | FJ639804 |
| DENV | NS1 | EU081214 | DENV | NS1 | FJ547082 | DENV | NS1 | EU529705 |
| DENV | NS1 | AY858039 | DENV | NS1 | EU367962 | DENV | NS1 | EU482454 |
| DENV | NS1 | EU660411 | DENV | NS1 | FJ390375 | DENV | NS1 | DQ401691 |
| DENV | NS1 | EU482563 | DENV | NS1 | AY858040 | DENV | NS1 | FJ639771 |
| DENV | NS1 | AY744678 | DENV | NS1 | FJ547069 | DENV | NS1 | FJ639754 |
| DENV | NS1 | FJ461334 | DENV | NS1 | FJ562107 | DENV | NS1 | EU482459 |
| DENV | NS1 | EU660420 | DENV | NS1 | FJ461338 | DENV | NS1 | FJ205871 |

FIG. 70-70

| Virus | Protein | Accession No. | Virus | Protein | Accession No. | Virus | Protein | Accession No. |
|---|---|---|---|---|---|---|---|---|
| DENV | NS1 | EU081186 | DENV | NS1 | FJ898458 | DENV | NS1 | FJ744726 |
| DENV | NS1 | FJ547083 | DENV | NS1 | FJ744740 | DENV | NS1 | FJ898476 |
| DENV | NS1 | FJ639762 | DENV | NS1 | GQ199889 | DENV | NS1 | FJ898468 |
| DENV | NS1 | FJ547071 | DENV | NS1 | GQ199886 | DENV | NS1 | FJ744733 |
| DENV | NS1 | EU529702 | DENV | NS1 | FJ687448 | DENV | NS1 | GQ199871 |
| DENV | NS1 | EU687234 | DENV | NS1 | FJ744732 | DENV | NS1 | GQ199887 |
| DENV | NS1 | FJ182006 | DENV | NS1 | FJ898446 | DENV | NS1 | GQ199864 |
| DENV | NS1 | AY662691 | DENV | NS1 | GQ199861 | DENV | NS1 | FJ744737 |
| DENV | NS1 | EU081213 | DENV | NS1 | FJ898455 | DENV | NS1 | FJ898456 |
| DENV | NS1 | EU081181 | DENV | NS1 | FJ882573 | DENV | NS1 | FJ850083 |
| DENV | NS1 | FJ390372 | DENV | NS1 | FJ898463 | DENV | NS1 | FJ744731 |
| DENV | NS1 | EU482613 | DENV | NS1 | FJ898447 | DENV | NS1 | FJ850079 |
| DENV | NS1 | FJ639790 | DENV | NS1 | FJ882571 | DENV | NS1 | FJ744700 |
| DENV | NS1 | DQ675519 | DENV | NS1 | FJ898462 | DENV | NS1 | FJ882576 |
| DENV | NS1 | EU687233 | DENV | NS1 | GQ199870 | DENV | NS1 | GQ199891 |
| DENV | NS1 | EF629369 | DENV | NS1 | FJ898471 | DENV | NS1 | FJ850111 |
| DENV | NS1 | FJ182004 | DENV | NS1 | FJ882575 | DENV | NS1 | FJ850056 |
| DENV | NS1 | FJ639799 | DENV | NS1 | FJ744738 | DENV | NS1 | FJ744727 |
| DENV | NS1 | FJ562097 | DENV | NS1 | FJ898440 | DENV | NS1 | FJ873813 |
| DENV | NS1 | FJ639712 | DENV | NS1 | FJ898444 | DENV | NS1 | AY770511 |
| DENV | NS1 | EF629366 | DENV | NS1 | GQ199865 | DENV | NS1 | FJ850098 |
| DENV | NS1 | EU726772 | DENV | NS1 | GQ252678 | DENV | NS1 | FJ810414 |
| DENV | NS1 | DQ675526 | DENV | NS1 | FJ850110 | DENV | NS1 | FJ850109 |
| DENV | NS1 | EU482452 | DENV | NS1 | FJ744734 | DENV | NS1 | FJ850052 |
| DENV | NS1 | AY858038 | DENV | NS1 | FJ898457 | DENV | NS1 | FJ850086 |
| DENV | NS1 | EU482456 | DENV | NS1 | FJ744736 | DENV | NS1 | FJ882572 |
| DENV | NS1 | EU081200 | DENV | NS1 | FJ810416 | DENV | NS1 | FJ882578 |
| DENV | NS1 | FJ639756 | DENV | NS1 | FJ898474 | DENV | NS1 | FJ850092 |
| DENV | NS1 | AY744677 | DENV | NS1 | FJ850094 | DENV | NS1 | AB214882 |
| DENV | NS1 | AY744683 | DENV | NS1 | FJ898470 | DENV | NS1 | AB214880 |
| DENV | NS1 | FJ639753 | DENV | NS1 | FJ810413 | DENV | NS1 | AB214881 |
| DENV | NS1 | FJ639716 | DENV | NS1 | FJ744735 | DENV | NS1 | FB667400 |
| DENV | NS1 | EU081194 | DENV | NS1 | GQ199860 | DENV | NS1 | GQ868587 |
| DENV | NS1 | FJ639776 | DENV | NS1 | FJ898464 | DENV | NS1 | EU932688 |
| DENV | NS1 | FJ898469 | DENV | NS1 | FJ744729 | DENV | NS1 | FN429906 |
| DENV | NS1 | GQ252674 | DENV | NS1 | FJ898472 | DENV | NS1 | GU131916 |
| DENV | NS1 | FJ850055 | DENV | NS1 | GQ199862 | DENV | NS1 | GU131953 |
| DENV | NS1 | FJ898475 | DENV | NS1 | FJ873812 | DENV | NS1 | GU131850 |
| DENV | NS1 | FJ744739 | DENV | NS1 | FJ898441 | DENV | NS1 | FN429900 |
| DENV | NS1 | NC_001475 | DENV | NS1 | FJ850048 | DENV | NS1 | GQ868576 |
| DENV | NS1 | GQ199863 | DENV | NS1 | FJ850080 | DENV | NS1 | GU131946 |
| DENV | NS1 | FJ850089 | DENV | NS1 | FJ882577 | DENV | NS1 | GU131866 |
| DENV | NS1 | FJ898442 | DENV | NS1 | FJ850096 | DENV | NS1 | GU131862 |
| DENV | NS1 | FJ898459 | DENV | NS1 | FJ898473 | DENV | NS1 | GU131852 |
| DENV | NS1 | FJ850049 | DENV | NS1 | FJ882574 | DENV | NS1 | FN429897 |
| DENV | NS1 | FJ744730 | DENV | NS1 | FJ898445 | DENV | NS1 | GQ868571 |
| DENV | NS1 | FJ850097 | DENV | NS1 | GQ199888 | DENV | NS1 | GQ868626 |
| DENV | NS1 | FJ744728 | DENV | NS1 | FJ898443 | DENV | NS1 | GQ868546 |

FIG. 70-71

| Virus | Protein | Accession No. | Virus | Protein | Accession No. | Virus | Protein | Accession No. |
|---|---|---|---|---|---|---|---|---|
| DENV | NS1 | FN429904 | DENV | NS1 | GU131950 | DENV | NS1 | GU131857 |
| DENV | NS1 | GU131904 | DENV | NS1 | GQ868634 | DENV | NS1 | GQ868629 |
| DENV | NS1 | GU131935 | DENV | NS1 | GU131873 | DENV | NS1 | GU131905 |
| DENV | NS1 | GU131910 | DENV | NS1 | GQ868593 | DENV | NS1 | GU131848 |
| DENV | NS1 | GU131918 | DENV | NS1 | GQ868572 | DENV | NS1 | FB667402 |
| DENV | NS1 | GU131937 | DENV | NS1 | DQ863638 | DENV | NS1 | FB667403 |
| DENV | NS1 | GU131868 | DENV | NS1 | GU131876 | DENV | NS1 | FJ177308 |
| DENV | NS1 | GU131951 | DENV | NS1 | EU932687 | DENV | NS1 | FB667404 |
| DENV | NS1 | FN429910 | DENV | NS1 | GU189648 | DENV | NS1 | FB667398 |
| DENV | NS1 | GU131854 | DENV | NS1 | FN429913 | DENV | NS1 | FB667399 |
| DENV | NS1 | GU131943 | DENV | NS1 | GU131867 | DENV | NS1 | CS805345 |
| DENV | NS1 | GU131861 | DENV | NS1 | GQ868575 | DENV | NS1 | EU482634 |
| DENV | NS1 | GU131871 | DENV | NS1 | GQ868617 | DENV | NS1 | FJ373301 |
| DENV | NS1 | GU131933 | DENV | NS1 | GQ868616 | DENV | NS1 | EU482582 |
| DENV | NS1 | GU131877 | DENV | NS1 | GU131870 | DENV | NS1 | EU687227 |
| DENV | NS1 | GU131911 | DENV | NS1 | GU131869 | DENV | NS1 | EU569710 |
| DENV | NS1 | GQ868628 | DENV | NS1 | GU131846 | DENV | NS1 | EF105383 |
| DENV | NS1 | GQ868574 | DENV | NS1 | GU131934 | DENV | NS1 | EU687249 |
| DENV | NS1 | GU131941 | DENV | NS1 | GQ868627 | DENV | NS1 | EU687242 |
| DENV | NS1 | GQ868577 | DENV | NS1 | FN429908 | DENV | NS1 | EU482658 |
| DENV | NS1 | GQ868547 | DENV | NS1 | GU131872 | DENV | NS1 | FJ639710 |
| DENV | NS1 | GU131845 | DENV | NS1 | FN429901 | DENV | NS1 | EU482748 |
| DENV | NS1 | FN429899 | DENV | NS1 | GU131917 | DENV | NS1 | FJ205885 |
| DENV | NS1 | FN429902 | DENV | NS1 | GU131875 | DENV | NS1 | EU482470 |
| DENV | NS1 | FN429917 | DENV | NS1 | FN429909 | DENV | NS1 | EU482468 |
| DENV | NS1 | FN429915 | DENV | NS1 | FN429911 | DENV | NS1 | FJ410195 |
| DENV | NS1 | GU131855 | DENV | NS1 | GU131945 | DENV | NS1 | AB122021 |
| DENV | NS1 | FN429896 | DENV | NS1 | FN429916 | DENV | NS1 | EU482469 |
| DENV | NS1 | GU131844 | DENV | NS1 | FN429914 | DENV | NS1 | FM210231 |
| DENV | NS1 | GQ868573 | DENV | NS1 | GU131942 | DENV | NS1 | FJ639831 |
| DENV | NS1 | GQ868586 | DENV | NS1 | GU131849 | DENV | NS1 | EU482657 |
| DENV | NS1 | GU131858 | DENV | NS1 | GU131952 | DENV | NS1 | EU482674 |
| DENV | NS1 | FN429903 | DENV | NS1 | GU131915 | DENV | NS1 | EU482753 |
| DENV | NS1 | GU131874 | DENV | NS1 | GQ868578 | DENV | NS1 | DQ645545 |
| DENV | NS1 | GU131914 | DENV | NS1 | GQ868548 | DENV | NS1 | FJ639835 |
| DENV | NS1 | FN429912 | DENV | NS1 | GU131913 | DENV | NS1 | FJ432726 |
| DENV | NS1 | FN429898 | DENV | NS1 | GU131940 | DENV | NS1 | EU482607 |
| DENV | NS1 | GU131851 | DENV | NS1 | FN429918 | DENV | NS1 | EU482660 |
| DENV | NS1 | GU131938 | DENV | NS1 | FN429905 | DENV | NS1 | EU482766 |
| DENV | NS1 | GU131853 | DENV | NS1 | GU131907 | DENV | NS1 | AB189124 |
| DENV | NS1 | FN429907 | DENV | NS1 | GU131860 | DENV | NS1 | AF100461 |
| DENV | NS1 | GU131865 | DENV | NS1 | GU131954 | DENV | NS1 | EU482600 |
| DENV | NS1 | GU131906 | DENV | NS1 | GU131856 | DENV | NS1 | EU687230 |
| DENV | NS1 | GU131944 | DENV | NS1 | GU131847 | DENV | NS1 | EU482633 |
| DENV | NS1 | GU131936 | DENV | NS1 | GU131909 | DENV | NS1 | EU482726 |
| DENV | NS1 | GU131903 | DENV | NS1 | GU131939 | DENV | NS1 | EU482557 |
| DENV | NS1 | GU131908 | DENV | NS1 | GU131912 | DENV | NS1 | EU482444 |
| DENV | NS1 | GU131878 | DENV | NS1 | GU131859 | DENV | NS1 | FJ205877 |

FIG. 70-72

| Virus | Protein Accession No. | Virus | Protein Accession No. | Virus | Protein Accession No. |
|---|---|---|---|---|---|
| DENV | NS1EU482621 | DENV | NS1FJ639703 | DENV | NS1FJ410208 |
| DENV | NS1EU482736 | DENV | NS1EU482647 | DENV | NS1EU569716 |
| DENV | NS1EU596497 | DENV | NS1EU596487 | DENV | NS1EU482786 |
| DENV | NS1M84728 | DENV | NS1FJ639788 | DENV | NS1AF276619 |
| DENV | NS1EU482549 | DENV | NS1FM210206 | DENV | NS1EU482625 |
| DENV | NS1FM210228 | DENV | NS1DQ645556 | DENV | NS1EU687248 |
| DENV | NS1EU687216 | DENV | NS1AF169682 | DENV | NS1EU482662 |
| DENV | NS1EU596489 | DENV | NS1AY858035 | DENV | NS1EU569708 |
| DENV | NS1EU482576 | DENV | NS1EU687220 | DENV | NS1FM210240 |
| DENV | NS1AF100460 | DENV | NS1EU482636 | DENV | NS1EU482777 |
| DENV | NS1AF169679 | DENV | NS1EU482650 | DENV | NS1FJ639705 |
| DENV | NS1EU482665 | DENV | NS1EU482704 | DENV | NS1EU482669 |
| DENV | NS1EU482586 | DENV | NS1EU482661 | DENV | NS1DQ645553 |
| DENV | NS1AF169681 | DENV | NS1EU569699 | DENV | NS1FM210210 |
| DENV | NS1FM210205 | DENV | NS1EU482580 | DENV | NS1EF457904 |
| DENV | NS1EU482767 | DENV | NS1FM210215 | DENV | NS1FJ410237 |
| DENV | NS1EU687240 | DENV | NS1FJ639733 | DENV | NS1AY702035 |
| DENV | NS1AF169686 | DENV | NS1EF105389 | DENV | NS1EU482757 |
| DENV | NS1EU687244 | DENV | NS1EF105384 | DENV | NS1EU596499 |
| DENV | NS1EU482683 | DENV | NS1EU677146 | DENV | NS1EU482543 |
| DENV | NS1FJ373299 | DENV | NS1EU596498 | DENV | NS1EU687217 |
| DENV | NS1EU482601 | DENV | NS1FJ410288 | DENV | NS1EU482646 |
| DENV | NS1EU660404 | DENV | NS1FJ373300 | DENV | NS1EU482746 |
| DENV | NS1EU482651 | DENV | NS1EU482702 | DENV | NS1FJ410217 |
| DENV | NS1EU482787 | DENV | NS1FJ205879 | DENV | NS1FJ639707 |
| DENV | NS1FM210216 | DENV | NS1EU569697 | DENV | NS1EU482637 |
| DENV | NS1EU569694 | DENV | NS1EU482691 | DENV | NS1EU482699 |
| DENV | NS1EU482648 | DENV | NS1FJ461309 | DENV | NS1EU482583 |
| DENV | NS1EU482620 | DENV | NS1EU482608 | DENV | NS1FJ639717 |
| DENV | NS1EU482471 | DENV | NS1EU726776 | DENV | NS1EU687223 |
| DENV | NS1EU482644 | DENV | NS1EU081177 | DENV | NS1AY702036 |
| DENV | NS1FJ639833 | DENV | NS1FM210213 | DENV | NS1EU482542 |
| DENV | NS1EU482445 | DENV | NS1EU854293 | DENV | NS1EU482587 |
| DENV | NS1EU482606 | DENV | NS1EU482632 | DENV | NS1EU482667 |
| DENV | NS1FM210236 | DENV | NS1FM210234 | DENV | NS1EU482695 |
| DENV | NS1EU482639 | DENV | NS1EU482745 | DENV | NS1EU569720 |
| DENV | NS1EU003591 | DENV | NS1EU482593 | DENV | NS1AY702037 |
| DENV | NS1EU482547 | DENV | NS1EU569718 | DENV | NS1AY858036 |
| DENV | NS1FJ478459 | DENV | NS1EU482719 | DENV | NS1DQ645544 |
| DENV | NS1FJ639837 | DENV | NS1EF051521 | DENV | NS1FJ639822 |
| DENV | NS1FJ390387 | DENV | NS1FM210238 | DENV | NS1AF100466 |
| DENV | NS1DQ645547 | DENV | NS1FJ478455 | DENV | NS1FJ410215 |
| DENV | NS1EU596496 | DENV | NS1AF100465 | DENV | NS1EU569705 |
| DENV | NS1EU482597 | DENV | NS1EU529694 | DENV | NS1FM210241 |
| DENV | NS1EU482463 | DENV | NS1EU081178 | DENV | NS1FM210221 |
| DENV | NS1EU482553 | DENV | NS1EU482676 | DENV | NS1EU687228 |
| DENV | NS1EU482548 | DENV | NS1FJ639709 | DENV | NS1EU482703 |
| DENV | NS1EU482641 | DENV | NS1FM210208 | DENV | NS1EU529700 |

FIG. 70-73

| Virus | Protein Accession No. | Virus | Protein Accession No. | Virus | Protein Accession No. |
|---|---|---|---|---|---|
| DENV | NS1DQ645555 | DENV | NS1FM210245 | DENV | NS1EU687238 |
| DENV | NS1EU687231 | DENV | NS1FM210214 | DENV | NS1M84727 |
| DENV | NS1EU660406 | DENV | NS1EU482685 | DENV | NS1EU482763 |
| DENV | NS1EU687241 | DENV | NS1EU482570 | DENV | NS1EU482758 |
| DENV | NS1FJ639700 | DENV | NS1DQ645540 | DENV | NS1FJ639830 |
| DENV | NS1FJ639711 | DENV | NS1EU660414 | DENV | NS1EU482754 |
| DENV | NS1U87412 | DENV | NS1FJ024477 | DENV | NS1FM210218 |
| DENV | NS1EU482599 | DENV | NS1AF100463 | DENV | NS1FJ410224 |
| DENV | NS1EU482654 | DENV | NS1DQ645546 | DENV | NS1FJ410193 |
| DENV | NS1EU569721 | DENV | NS1EU569703 | DENV | NS1EU056811 |
| DENV | NS1FJ390385 | DENV | NS1EU482652 | DENV | NS1EU482774 |
| DENV | NS1EU482589 | DENV | NS1EU596490 | DENV | NS1EU482568 |
| DENV | NS1EU482551 | DENV | NS1EU482693 | DENV | NS1EU482588 |
| DENV | NS1EU660400 | DENV | NS1EU482734 | DENV | NS1EU482475 |
| DENV | NS1EU482679 | DENV | NS1FM210202 | DENV | NS1AF489932 |
| DENV | NS1AF204177 | DENV | NS1EU482729 | DENV | NS1FM210211 |
| DENV | NS1FJ461311 | DENV | NS1AF169680 | DENV | NS1EU687246 |
| DENV | NS1EU569700 | DENV | NS1EU482623 | DENV | NS1FJ390389 |
| DENV | NS1EU482737 | DENV | NS1EU569693 | DENV | NS1EU482464 |
| DENV | NS1EU482573 | DENV | NS1EU482590 | DENV | NS1EU482697 |
| DENV | NS1AY702040 | DENV | NS1FJ639834 | DENV | NS1EU482765 |
| DENV | NS1DQ181803 | DENV | NS1EU482449 | DENV | NS1FM210209 |
| DENV | NS1EU482741 | DENV | NS1EU687237 | DENV | NS1EU482474 |
| DENV | NS1EU660399 | DENV | NS1EF105381 | DENV | NS1EU596484 |
| DENV | NS1EU482784 | DENV | NS1EU482578 | DENV | NS1EU677138 |
| DENV | NS1EU482584 | DENV | NS1EU482781 | DENV | NS1EU621672 |
| DENV | NS1EU482670 | DENV | NS1EU596485 | DENV | NS1AF359579 |
| DENV | NS1DQ181801 | DENV | NS1EU687224 | DENV | NS1EU482645 |
| DENV | NS1EU482603 | DENV | NS1FJ461321 | DENV | NS1EU482760 |
| DENV | NS1EU482769 | DENV | NS1FJ390390 | DENV | NS1FJ639732 |
| DENV | NS1FM210227 | DENV | NS1EU482562 | DENV | NS1FM210229 |
| DENV | NS1AY744147 | DENV | NS1EF105390 | DENV | NS1EU482684 |
| DENV | NS1EU482656 | DENV | NS1EU482782 | DENV | NS1EF105378 |
| DENV | NS1EU529706 | DENV | NS1EU482682 | DENV | NS1EU482681 |
| DENV | NS1EU687212 | DENV | NS1EU056810 | DENV | NS1FJ547090 |
| DENV | NS1DQ645541 | DENV | NS1EU687236 | DENV | NS1EU482447 |
| DENV | NS1DQ181800 | DENV | NS1EU482448 | DENV | NS1EU482624 |
| DENV | NS1EU482721 | DENV | NS1FJ639698 | DENV | NS1AF119661 |
| DENV | NS1EU677145 | DENV | NS1EU482630 | DENV | NS1EU660413 |
| DENV | NS1EU482450 | DENV | NS1EU359009 | DENV | NS1AF169685 |
| DENV | NS1EU482541 | DENV | NS1EU482768 | DENV | NS1EU482771 |
| DENV | NS1AF169688 | DENV | NS1EU482672 | DENV | NS1EU482604 |
| DENV | NS1M19197 | DENV | NS1EU569711 | DENV | NS1FJ410223 |
| DENV | NS1EU482594 | DENV | NS1EU482627 | DENV | NS1EU482739 |
| DENV | NS1DQ645554 | DENV | NS1EU569715 | DENV | NS1EU687243 |
| DENV | NS1DQ181798 | DENV | NS1EU482678 | DENV | NS1EU482720 |
| DENV | NS1AY702038 | DENV | NS1DQ181799 | DENV | NS1EU482730 |
| DENV | NS1EU596495 | DENV | NS1EU687235 | DENV | NS1EU482779 |

FIG. 70-74

| Virus | Protein | Accession No. | Virus | Protein | Accession No. | Virus | Protein | Accession No. |
|---|---|---|---|---|---|---|---|---|
| DENV | NS1 | AB122020 | DENV | NS1 | DQ181797 | DENV | NS1 | EU482728 |
| DENV | NS1 | FM210244 | DENV | NS1 | EU569701 | DENV | NS1 | EU596500 |
| DENV | NS1 | AF100469 | DENV | NS1 | EU482773 | DENV | NS1 | EU482671 |
| DENV | NS1 | FJ410221 | DENV | NS1 | EU482722 | DENV | NS1 | EU179859 |
| DENV | NS1 | EU482626 | DENV | NS1 | EU482635 | DENV | NS1 | EU482705 |
| DENV | NS1 | EU482788 | DENV | NS1 | DQ645549 | DENV | NS1 | EU482552 |
| DENV | NS1 | FJ410219 | DENV | NS1 | EU482629 | DENV | NS1 | EU482546 |
| DENV | NS1 | AF100462 | DENV | NS1 | EU596488 | DENV | NS1 | EU482642 |
| DENV | NS1 | EU482696 | DENV | NS1 | FJ639836 | DENV | NS1 | EU482579 |
| DENV | NS1 | EU482544 | DENV | NS1 | EU482733 | DENV | NS1 | M20558 |
| DENV | NS1 | EU482640 | DENV | NS1 | EU677143 | DENV | NS1 | EU482775 |
| DENV | NS1 | FJ182012 | DENV | NS1 | EU482653 | DENV | NS1 | EU596491 |
| DENV | NS1 | DQ645548 | DENV | NS1 | AF208496 | DENV | NS1 | FJ639708 |
| DENV | NS1 | FJ639701 | DENV | NS1 | EU482565 | DENV | NS1 | FM210220 |
| DENV | NS1 | EU482655 | DENV | NS1 | EU482598 | DENV | NS1 | EU569717 |
| DENV | NS1 | AB189122 | DENV | NS1 | M29095 | DENV | NS1 | EF105379 |
| DENV | NS1 | DQ181804 | DENV | NS1 | EU660415 | DENV | NS1 | EU569712 |
| DENV | NS1 | EU482732 | DENV | NS1 | FM210239 | DENV | NS1 | EU482755 |
| DENV | NS1 | DQ645543 | DENV | NS1 | EU687213 | DENV | NS1 | DQ181805 |
| DENV | NS1 | FJ639832 | DENV | NS1 | EU677144 | DENV | NS1 | FM210207 |
| DENV | NS1 | FJ226066 | DENV | NS1 | FM210243 | DENV | NS1 | FM210233 |
| DENV | NS1 | AF169687 | DENV | NS1 | AF100459 | DENV | NS1 | EU687199 |
| DENV | NS1 | EU482752 | DENV | NS1 | EU482466 | DENV | NS1 | EU482686 |
| DENV | NS1 | EU482783 | DENV | NS1 | FM210230 | DENV | NS1 | FJ205880 |
| DENV | NS1 | EU482742 | DENV | NS1 | FJ410200 | DENV | NS1 | AY776328 |
| DENV | NS1 | FJ461314 | DENV | NS1 | DQ645552 | DENV | NS1 | EU482675 |
| DENV | NS1 | EU482688 | DENV | NS1 | EU482574 | DENV | NS1 | EU660417 |
| DENV | NS1 | DQ181802 | DENV | NS1 | EU482622 | DENV | NS1 | EU482727 |
| DENV | NS1 | FJ639809 | DENV | NS1 | EU482561 | DENV | NS1 | EU482602 |
| DENV | NS1 | EU482701 | DENV | NS1 | EU596486 | DENV | NS1 | EU482577 |
| DENV | NS1 | AF204178 | DENV | NS1 | EU569695 | DENV | NS1 | EU482756 |
| DENV | NS1 | FJ639706 | DENV | NS1 | FJ024461 | DENV | NS1 | EU529701 |
| DENV | NS1 | EU482550 | DENV | NS1 | EU569713 | DENV | NS1 | FJ639702 |
| DENV | NS1 | EU482605 | DENV | NS1 | FM210224 | DENV | NS1 | EU482772 |
| DENV | NS1 | EU482554 | DENV | NS1 | EU482556 | DENV | NS1 | FM210246 |
| DENV | NS1 | EU482692 | DENV | NS1 | EU482731 | DENV | NS1 | FJ390391 |
| DENV | NS1 | EU482680 | DENV | NS1 | EU179858 | DENV | NS1 | AF100464 |
| DENV | NS1 | AF169683 | DENV | NS1 | EU781135 | DENV | NS1 | FJ547067 |
| DENV | NS1 | FJ024458 | DENV | NS1 | EU482743 | DENV | NS1 | EF105386 |
| DENV | NS1 | EU482780 | DENV | NS1 | EU482751 | DENV | NS1 | EF105387 |
| DENV | NS1 | EU482750 | DENV | NS1 | FJ410259 | DENV | NS1 | EU726775 |
| DENV | NS1 | EU179857 | DENV | NS1 | EU482747 | DENV | NS1 | FJ639704 |
| DENV | NS1 | EU569698 | DENV | NS1 | EU687225 | DENV | NS1 | AF169678 |
| DENV | NS1 | EU482571 | DENV | NS1 | FJ639718 | DENV | NS1 | EU482749 |
| DENV | NS1 | EU081179 | DENV | NS1 | EU569707 | DENV | NS1 | EU482631 |
| DENV | NS1 | EU482690 | DENV | NS1 | EU677147 | DENV | NS1 | EF105388 |
| DENV | NS1 | EU687215 | DENV | NS1 | FM210223 | DENV | NS1 | AB189123 |
| DENV | NS1 | EU482664 | DENV | NS1 | EU081180 | DENV | NS1 | EU482663 |

FIG. 70-75

| Virus | Protein | Accession No. | Virus | Protein | Accession No. | Virus | Protein | Accession No. |
|---|---|---|---|---|---|---|---|---|
| DENV | NS1 | EU677149 | DENV | NS1 | EU482687 | DENV | NS1 | FM210219 |
| DENV | NS1 | EU569719 | DENV | NS1 | EU529693 | DENV | NS1 | EU482723 |
| DENV | NS1 | EU482778 | DENV | NS1 | FJ390384 | DENV | NS1 | FJ639829 |
| DENV | NS1 | DQ645551 | DENV | NS1 | EU482560 | DENV | NS1 | EU482575 |
| DENV | NS1 | EU482689 | DENV | NS1 | EU482761 | DENV | NS1 | AF038402 |
| DENV | NS1 | EU726770 | DENV | NS1 | EU482638 | DENV | NS1 | FJ639783 |
| DENV | NS1 | AB122022 | DENV | NS1 | EU482698 | DENV | NS1 | EU482572 |
| DENV | NS1 | FJ639697 | DENV | NS1 | EU482764 | DENV | NS1 | FJ639734 |
| DENV | NS1 | EU482628 | DENV | NS1 | FJ182014 | DENV | NS1 | EU482762 |
| DENV | NS1 | EU687232 | DENV | NS1 | EU482776 | DENV | NS1 | EU569704 |
| DENV | NS1 | FM210225 | DENV | NS1 | DQ645550 | DENV | NS1 | EU482759 |
| DENV | NS1 | AY037116 | DENV | NS1 | FJ024473 | DENV | NS1 | EU056812 |
| DENV | NS1 | FJ205878 | DENV | NS1 | DQ181806 | DENV | NS1 | FJ410228 |
| DENV | NS1 | AY702034 | DENV | NS1 | FJ461305 | DENV | NS1 | EU482467 |
| DENV | NS1 | FM210232 | DENV | NS1 | FJ024452 | DENV | NS1 | FM210217 |
| DENV | NS1 | AY702039 | DENV | NS1 | EU677141 | DENV | NS1 | FM210212 |
| DENV | NS1 | EU687245 | DENV | NS1 | FJ639828 | DENV | NS1 | EU660405 |
| DENV | NS1 | EU482465 | DENV | NS1 | EU569706 | DENV | NS1 | FJ547064 |
| DENV | NS1 | EU482472 | DENV | NS1 | EU482666 | DENV | NS1 | EU482740 |
| DENV | NS1 | EU569714 | DENV | NS1 | EU482673 | DENV | NS1 | EU482451 |
| DENV | NS1 | EU569692 | DENV | NS1 | FJ024474 | DENV | NS1 | EU482668 |
| DENV | NS1 | FJ410233 | DENV | NS1 | EU687214 | DENV | NS1 | EU687229 |
| DENV | NS1 | AF100467 | DENV | NS1 | FJ410291 | DENV | NS1 | AF169684 |
| DENV | NS1 | EU677148 | DENV | NS1 | FM210242 | DENV | NS1 | FM210235 |
| DENV | NS1 | EF105380 | DENV | NS1 | EU687250 | DENV | NS1 | GQ199874 |
| DENV | NS1 | EU482677 | DENV | NS1 | EU482735 | DENV | NS1 | FJ744745 |
| DENV | NS1 | AF100468 | DENV | NS1 | EU482785 | DENV | NS1 | FJ898467 |
| DENV | NS1 | EU482569 | DENV | NS1 | EU596483 | DENV | NS1 | FJ687444 |
| DENV | NS1 | DQ645542 | DENV | NS1 | EU569702 | DENV | NS1 | FJ810411 |
| DENV | NS1 | EU482643 | DENV | NS1 | FJ410241 | DENV | NS1 | FJ850067 |
| DENV | NS1 | EU482694 | DENV | NS1 | EU482659 | DENV | NS1 | FJ850121 |
| DENV | NS1 | EU482724 | DENV | NS1 | FM210203 | DENV | NS1 | FJ898452 |
| DENV | NS1 | EU482446 | DENV | NS1 | EU482581 | DENV | NS1 | FJ744713 |
| DENV | NS1 | FM210226 | DENV | NS1 | EU569696 | DENV | NS1 | FJ810418 |
| DENV | NS1 | EU482744 | DENV | NS1 | FJ562098 | DENV | NS1 | FJ906962 |
| DENV | NS1 | EU677137 | DENV | NS1 | FM210222 | DENV | NS1 | FJ744721 |
| DENV | NS1 | EU482770 | DENV | NS1 | EU482473 | DENV | NS1 | FJ850107 |
| DENV | NS1 | AF038403 | DENV | NS1 | EU854294 | DENV | NS1 | FJ467493 |
| DENV | NS1 | EU660398 | DENV | NS1 | EU482649 | DENV | NS1 | FJ906966 |
| DENV | NS1 | EU569709 | DENV | NS1 | EU726767 | DENV | NS1 | FJ687446 |
| DENV | NS1 | FM210237 | DENV | NS1 | FJ024454 | DENV | NS1 | FJ906958 |
| DENV | NS1 | EU660416 | DENV | NS1 | FJ639699 | DENV | NS1 | FJ687435 |
| DENV | NS1 | EU677142 | DENV | NS1 | FM210204 | DENV | NS1 | FJ850054 |
| DENV | NS1 | EU482700 | DENV | NS1 | EU529695 | DENV | NS1 | FJ906967 |
| DENV | NS1 | EU482545 | DENV | NS1 | EU687222 | DENV | NS1 | FJ850072 |
| DENV | NS1 | EU482585 | DENV | NS1 | EF105382 | DENV | NS1 | FJ898439 |
| DENV | NS1 | FJ024475 | DENV | NS1 | EU482738 | DENV | NS1 | FJ850088 |
| DENV | NS1 | EU482725 | DENV | NS1 | EF105385 | DENV | NS1 | FJ898435 |

FIG. 70-76

| Virus | Protein | Accession No. | Virus | Protein | Accession No. | Virus | Protein | Accession No. |
|---|---|---|---|---|---|---|---|---|
| DENV | NS1 | GQ252676 | DENV | NS1 | DQ448231 | DENV | NS1 | FJ744714 |
| DENV | NS1 | FJ850065 | DENV | NS1 | FJ744710 | DENV | NS1 | GQ199866 |
| DENV | NS1 | FJ898477 | DENV | NS1 | GQ252677 | DENV | NS1 | GQ199894 |
| DENV | NS1 | FJ850116 | DENV | NS1 | NC_001474 | DENV | NS1 | FJ687440 |
| DENV | NS1 | FJ898454 | DENV | NS1 | FJ687445 | DENV | NS1 | FJ850112 |
| DENV | NS1 | GQ199897 | DENV | NS1 | FJ850091 | DENV | NS1 | FJ850078 |
| DENV | NS1 | GQ199899 | DENV | NS1 | FJ687443 | DENV | NS1 | FJ744717 |
| DENV | NS1 | FJ744723 | DENV | NS1 | GQ199869 | DENV | NS1 | FJ906968 |
| DENV | NS1 | GQ199900 | DENV | NS1 | FJ850105 | DENV | NS1 | GQ199893 |
| DENV | NS1 | FJ850082 | DENV | NS1 | FJ850051 | DENV | NS1 | FJ744711 |
| DENV | NS1 | FJ744715 | DENV | NS1 | FJ850050 | DENV | NS1 | FJ744704 |
| DENV | NS1 | FJ744709 | DENV | NS1 | FJ744719 | DENV | NS1 | FJ744720 |
| DENV | NS1 | GQ199868 | DENV | NS1 | FJ898453 | DENV | NS1 | GQ199901 |
| DENV | NS1 | FJ906960 | DENV | NS1 | FJ898460 | DENV | NS1 | FJ744724 |
| DENV | NS1 | FJ882602 | DENV | NS1 | FJ898438 | DENV | NS1 | FJ850120 |
| DENV | NS1 | GQ199895 | DENV | NS1 | FJ850053 | DENV | NS1 | FJ850118 |
| DENV | NS1 | FJ687436 | DENV | NS1 | FJ898450 | DENV | NS1 | FJ850076 |
| DENV | NS1 | FJ744725 | DENV | NS1 | FJ744708 | DENV | NS1 | AF022436 |
| DENV | NS1 | FJ850117 | DENV | NS1 | GQ199896 | DENV | NS1 | AF022439 |
| DENV | NS1 | FJ687441 | DENV | NS1 | FJ744722 | DENV | NS1 | AF022441 |
| DENV | NS1 | FJ744706 | DENV | NS1 | FJ850062 | DENV | NS1 | AF022437 |
| DENV | NS1 | FJ850074 | DENV | NS1 | FJ898461 | DENV | NS1 | AJ487271 |
| DENV | NS1 | FJ850085 | DENV | NS1 | FJ810410 | DENV | NS1 | AF022435 |
| DENV | NS1 | FJ850061 | DENV | NS1 | FJ850060 | DENV | NS1 | AF022434 |
| DENV | NS1 | FJ810409 | DENV | NS1 | FJ906961 | DENV | NS1 | AF022438 |
| DENV | NS1 | FJ687434 | DENV | NS1 | FJ882593 | DENV | NS1 | AF022440 |
| DENV | NS1 | GQ199890 | DENV | NS1 | FJ898479 | DENV | NS1 | CS479165 |
| DENV | NS1 | FJ744743 | DENV | NS1 | FJ744703 | DENV | NS1 | GQ868556 |
| DENV | NS1 | FJ850063 | DENV | NS1 | FJ744712 | DENV | NS1 | AB479041 |
| DENV | NS1 | FJ898466 | DENV | NS1 | FJ882594 | DENV | NS1 | GU289914 |
| DENV | NS1 | FJ850119 | DENV | NS1 | FJ744716 | DENV | NS1 | GU131884 |
| DENV | NS1 | FJ898432 | DENV | NS1 | FJ850066 | DENV | NS1 | GQ868600 |
| DENV | NS1 | FJ744718 | DENV | NS1 | FJ744744 | DENV | NS1 | FN429895 |
| DENV | NS1 | FJ810412 | DENV | NS1 | FJ850108 | DENV | NS1 | GU131879 |
| DENV | NS1 | FJ906956 | DENV | NS1 | FJ859028 | DENV | NS1 | GQ868596 |
| DENV | NS1 | FJ850064 | DENV | NS1 | FJ898465 | DENV | NS1 | GQ868516 |
| DENV | NS1 | GQ199892 | DENV | NS1 | FJ898451 | DENV | NS1 | GU131864 |
| DENV | NS1 | FJ898436 | DENV | NS1 | FJ898449 | DENV | NS1 | FN429893 |
| DENV | NS1 | FJ906957 | DENV | NS1 | FJ744705 | DENV | NS1 | GQ868598 |
| DENV | NS1 | FJ898478 | DENV | NS1 | FJ898434 | DENV | NS1 | GQ868544 |
| DENV | NS1 | FJ873811 | DENV | NS1 | FJ906969 | DENV | NS1 | GQ868589 |
| DENV | NS1 | GQ199898 | DENV | NS1 | FJ744741 | DENV | NS1 | GQ868551 |
| DENV | NS1 | FJ850115 | DENV | NS1 | FJ906959 | DENV | NS1 | GU131902 |
| DENV | NS1 | FJ687442 | DENV | NS1 | FJ850106 | DENV | NS1 | GU131896 |
| DENV | NS1 | FJ687439 | DENV | NS1 | FJ744742 | DENV | NS1 | GU131924 |
| DENV | NS1 | FJ432724 | DENV | NS1 | FJ687437 | DENV | NS1 | GQ868640 |
| DENV | NS1 | FJ687447 | DENV | NS1 | FJ744707 | DENV | NS1 | GU131880 |
| DENV | NS1 | FJ873808 | DENV | NS1 | FJ687438 | DENV | NS1 | GU131882 |

FIG. 70-77

| Virus | Protein | Accession No. | Virus | Protein | Accession No. | Virus | Protein | Accession No. |
|---|---|---|---|---|---|---|---|---|
| DENV | NS1 | GQ868638 | DENV | NS1 | GU131897 | DENV | NS2A | FJ639693 |
| DENV | NS1 | GQ868553 | DENV | NS1 | GQ868592 | DENV | NS2A | FJ461317 |
| DENV | NS1 | GQ868646 | DENV | NS1 | GQ868552 | DENV | NS2A | FJ384655 |
| DENV | NS1 | FN429891 | DENV | NS1 | GU131900 | DENV | NS2A | EU482508 |
| DENV | NS1 | GQ868604 | DENV | NS1 | GQ868599 | DENV | NS2A | AF311958 |
| DENV | NS1 | GU131947 | DENV | NS1 | GU131929 | DENV | NS2A | FJ024451 |
| DENV | NS1 | GU131928 | DENV | NS1 | GU131930 | DENV | NS2A | EU482528 |
| DENV | NS1 | GQ868497 | DENV | NS1 | GQ868550 | DENV | NS2A | EU482821 |
| DENV | NS1 | GQ868603 | DENV | NS1 | GU131975 | DENV | NS2A | FJ410267 |
| DENV | NS1 | GQ868621 | DENV | NS1 | GU131927 | DENV | NS2A | AB074761 |
| DENV | NS1 | AB479042 | DENV | NS1 | GQ868540 | DENV | NS2A | AY762084 |
| DENV | NS1 | GQ868620 | DENV | NS1 | FJ410202 | DENV | NS2A | AY732480 |
| DENV | NS1 | GQ868590 | DENV | NS1 | CS479202 | DENV | NS2A | EU482481 |
| DENV | NS1 | FN429892 | DENV | NS1 | U87411 | DENV | NS2A | FJ410232 |
| DENV | NS1 | GQ868554 | DENV | NS1 | CS479203 | DENV | NS2A | EU081254 |
| DENV | NS1 | GU131974 | DENV | NS1 | CS479204 | DENV | NS2A | EU482806 |
| DENV | NS1 | GU131843 | DENV | NS1 | CS479167 | DENV | NS2A | FJ410257 |
| DENV | NS1 | GQ868641 | DENV | NS1 | CS479205 | DENV | NS2A | FJ432720 |
| DENV | NS1 | GQ868542 | DENV | NS1 | CS479206 | DENV | NS2A | FJ547089 |
| DENV | NS1 | GQ868555 | DENV | NS1 | CS805344 | DENV | NS2A | EU482819 |
| DENV | NS1 | FN429894 | DENV | NS1 | FB730117 | DENV | NS2A | EU081270 |
| DENV | NS1 | GQ868549 | DENV | NS1 | DL138662 | DENV | NS2A | FJ205875 |
| DENV | NS1 | GQ868588 | DENV | NS1 | GM059692 | DENV | NS2A | FJ410210 |
| DENV | NS1 | GQ868541 | DENV | NS1 | AY243468 | DENV | NS2A | FJ205884 |
| DENV | NS1 | GQ868558 | DENV | NS1 | AY243469 | DENV | NS2A | FJ176780 |
| DENV | NS1 | GQ868625 | DENV | NS1 | AY744148 | DENV | NS2A | FJ461340 |
| DENV | NS1 | GQ868624 | DENV | NS1 | AY744149 | DENV | NS2A | AY732475 |
| DENV | NS1 | GQ868631 | DENV | NS1 | AY744150 | DENV | NS2A | AY732474 |
| DENV | NS1 | GU131899 | DENV | NS1 | AJ968413 | DENV | NS2A | FJ024435 |
| DENV | NS1 | GQ868515 | DENV | NS1 | GU369819 | DENV | NS2A | FJ639669 |
| DENV | NS1 | GU131898 | DENV | NS1 | GU370050 | DENV | NS2A | EU482540 |
| DENV | NS1 | GQ868623 | DENV | NS1 | GU370051 | DENV | NS2A | FJ024429 |
| DENV | NS1 | GU131886 | DENV | NS2A | AY277665 | DENV | NS2A | EU677167 |
| DENV | NS1 | GQ868622 | DENV | NS2A | AY713474 | DENV | NS2A | EU482512 |
| DENV | NS1 | GQ868595 | DENV | NS2A | AF311957 | DENV | NS2A | FJ390381 |
| DENV | NS1 | GQ868557 | DENV | NS2A | FJ205881 | DENV | NS2A | FJ410226 |
| DENV | NS1 | GU131959 | DENV | NS2A | EU482817 | DENV | NS2A | FJ410191 |
| DENV | NS1 | GU131955 | DENV | NS2A | DQ672557 | DENV | NS2A | AJ968413 |
| DENV | NS1 | GQ868597 | DENV | NS2A | EU677151 | DENV | NS2A | FJ639689 |
| DENV | NS1 | GU131883 | DENV | NS2A | FJ410256 | DENV | NS2A | AY277664 |
| DENV | NS1 | GQ868591 | DENV | NS2A | FJ432735 | DENV | NS2A | FJ639811 |
| DENV | NS1 | GQ868543 | DENV | NS2A | EU660390 | DENV | NS2A | FJ639695 |
| DENV | NS1 | GU131901 | DENV | NS2A | EU482824 | DENV | NS2A | EU081226 |
| DENV | NS1 | GQ868545 | DENV | NS2A | FJ410222 | DENV | NS2A | FJ410280 |
| DENV | NS1 | GU131931 | DENV | NS2A | AY726551 | DENV | NS2A | EU596504 |
| DENV | NS1 | GU131885 | DENV | NS2A | EU482716 | DENV | NS2A | FJ639685 |
| DENV | NS1 | GU131932 | DENV | NS2A | AF226685 | DENV | NS2A | EU482715 |
| DENV | NS1 | GU131881 | DENV | NS2A | EU677174 | DENV | NS2A | FJ410227 |

FIG. 70-78

| Virus | Protein | Accession No. | Virus | Protein | Accession No. | Virus | Protein | Accession No. |
|---|---|---|---|---|---|---|---|---|
| DENV | NS2A | DQ285560 | DENV | NS2A | EU081238 | DENV | NS2A | FJ024463 |
| DENV | NS2A | FJ182002 | DENV | NS2A | FJ410245 | DENV | NS2A | FJ410275 |
| DENV | NS2A | EU677177 | DENV | NS2A | FJ461318 | DENV | NS2A | FJ410234 |
| DENV | NS2A | FJ639680 | DENV | NS2A | FJ410263 | DENV | NS2A | EU482487 |
| DENV | NS2A | EU677160 | DENV | NS2A | FJ410269 | DENV | NS2A | FJ410182 |
| DENV | NS2A | AY835999 | DENV | NS2A | FJ410289 | DENV | NS2A | EU482812 |
| DENV | NS2A | EU249494 | DENV | NS2A | FJ639692 | DENV | NS2A | EU081247 |
| DENV | NS2A | AF226687 | DENV | NS2A | EU660397 | DENV | NS2A | AB074760 |
| DENV | NS2A | FJ024432 | DENV | NS2A | EU482477 | DENV | NS2A | EU482802 |
| DENV | NS2A | EU081229 | DENV | NS2A | FJ024434 | DENV | NS2A | EU677172 |
| DENV | NS2A | FJ410184 | DENV | NS2A | FJ410204 | DENV | NS2A | EU482496 |
| DENV | NS2A | FJ182022 | DENV | NS2A | EU249495 | DENV | NS2A | EU726777 |
| DENV | NS2A | EU677153 | DENV | NS2A | AF513110 | DENV | NS2A | U88535 |
| DENV | NS2A | DQ672559 | DENV | NS2A | FJ024438 | DENV | NS2A | EU482519 |
| DENV | NS2A | EU081234 | DENV | NS2A | EU081264 | DENV | NS2A | FJ461339 |
| DENV | NS2A | FJ639802 | DENV | NS2A | EU482525 | DENV | NS2A | FJ562101 |
| DENV | NS2A | EU482483 | DENV | NS2A | EU687251 | DENV | NS2A | FJ461316 |
| DENV | NS2A | FJ024445 | DENV | NS2A | EU482486 | DENV | NS2A | EU482814 |
| DENV | NS2A | FJ410236 | DENV | NS2A | DQ285558 | DENV | NS2A | AY726555 |
| DENV | NS2A | FJ410242 | DENV | NS2A | FJ205883 | DENV | NS2A | FJ639677 |
| DENV | NS2A | FJ390378 | DENV | NS2A | AY145121 | DENV | NS2A | EU482506 |
| DENV | NS2A | EU081236 | DENV | NS2A | AY732478 | DENV | NS2A | FJ410283 |
| DENV | NS2A | EU081278 | DENV | NS2A | FJ410199 | DENV | NS2A | FJ639696 |
| DENV | NS2A | FJ432736 | DENV | NS2A | FJ390383 | DENV | NS2A | FJ410235 |
| DENV | NS2A | FJ639694 | DENV | NS2A | EU482592 | DENV | NS2A | EU482532 |
| DENV | NS2A | EU482500 | DENV | NS2A | FJ182030 | DENV | NS2A | FJ182031 |
| DENV | NS2A | DQ672560 | DENV | NS2A | FJ024431 | DENV | NS2A | FJ024428 |
| DENV | NS2A | AY713473 | DENV | NS2A | FJ024450 | DENV | NS2A | FJ432749 |
| DENV | NS2A | EU726780 | DENV | NS2A | FJ410252 | DENV | NS2A | DQ285561 |
| DENV | NS2A | FJ410255 | DENV | NS2A | FJ478457 | DENV | NS2A | EU482518 |
| DENV | NS2A | FJ373298 | DENV | NS2A | EU596502 | DENV | NS2A | EU726779 |
| DENV | NS2A | EU081276 | DENV | NS2A | FJ410201 | DENV | NS2A | EU677161 |
| DENV | NS2A | FJ410198 | DENV | NS2A | FJ562105 | DENV | NS2A | AY145123 |
| DENV | NS2A | EU482536 | DENV | NS2A | FJ639684 | DENV | NS2A | EU482800 |
| DENV | NS2A | FJ390382 | DENV | NS2A | FJ639682 | DENV | NS2A | AY732482 |
| DENV | NS2A | FJ024462 | DENV | NS2A | FJ410240 | DENV | NS2A | EU482517 |
| DENV | NS2A | EU482822 | DENV | NS2A | EU081279 | DENV | NS2A | EU482488 |
| DENV | NS2A | FJ024447 | DENV | NS2A | EU081231 | DENV | NS2A | FJ373305 |
| DENV | NS2A | FJ410274 | DENV | NS2A | FJ410214 | DENV | NS2A | FJ432746 |
| DENV | NS2A | FJ410216 | DENV | NS2A | FJ182036 | DENV | NS2A | FJ432734 |
| DENV | NS2A | EU482527 | DENV | NS2A | FJ182023 | DENV | NS2A | EU482797 |
| DENV | NS2A | EU280167 | DENV | NS2A | EU482479 | DENV | NS2A | EU482711 |
| DENV | NS2A | EU482567 | DENV | NS2A | FJ547087 | DENV | NS2A | FJ024459 |
| DENV | NS2A | EU081265 | DENV | NS2A | FJ639683 | DENV | NS2A | FJ410174 |
| DENV | NS2A | EU482489 | DENV | NS2A | FJ024442 | DENV | NS2A | EU596503 |
| DENV | NS2A | AB178040 | DENV | NS2A | FJ410285 | DENV | NS2A | FJ432730 |
| DENV | NS2A | EU482827 | DENV | NS2A | EU482615 | DENV | NS2A | EU081227 |
| DENV | NS2A | FJ024455 | DENV | NS2A | AY732476 | DENV | NS2A | EU677163 |

FIG. 70-79

| Virus | Protein | Accession No. | Virus | Protein | Accession No. | Virus | Protein | Accession No. |
|---|---|---|---|---|---|---|---|---|
| DENV | NS2A | AY277666 | DENV | NS2A | EU677169 | DENV | NS2A | EU081252 |
| DENV | NS2A | FJ024483 | DENV | NS2A | EU482828 | DENV | NS2A | EU482706 |
| DENV | NS2A | DQ193572 | DENV | NS2A | EU482537 | DENV | NS2A | AY726553 |
| DENV | NS2A | EF122231 | DENV | NS2A | EU726782 | DENV | NS2A | FJ205882 |
| DENV | NS2A | EU081266 | DENV | NS2A | FJ410225 | DENV | NS2A | FJ390386 |
| DENV | NS2A | EU482818 | DENV | NS2A | FJ410180 | DENV | NS2A | EU677139 |
| DENV | NS2A | FJ410186 | DENV | NS2A | FJ024460 | DENV | NS2A | FJ410260 |
| DENV | NS2A | EU249493 | DENV | NS2A | FJ410231 | DENV | NS2A | EU677170 |
| DENV | NS2A | FJ024478 | DENV | NS2A | FJ390380 | DENV | NS2A | EU081256 |
| DENV | NS2A | FJ205874 | DENV | NS2A | FJ410238 | DENV | NS2A | FJ024443 |
| DENV | NS2A | EU482791 | DENV | NS2A | FJ390379 | DENV | NS2A | FJ410278 |
| DENV | NS2A | EU482798 | DENV | NS2A | AF311956 | DENV | NS2A | FJ432744 |
| DENV | NS2A | EU081248 | DENV | NS2A | EU081257 | DENV | NS2A | AB189120 |
| DENV | NS2A | EU596501 | DENV | NS2A | FJ432721 | DENV | NS2A | FJ461327 |
| DENV | NS2A | FJ461336 | DENV | NS2A | FJ639672 | DENV | NS2A | EU660391 |
| DENV | NS2A | FJ024457 | DENV | NS2A | FJ639794 | DENV | NS2A | FJ562106 |
| DENV | NS2A | EU482485 | DENV | NS2A | EU660403 | DENV | NS2A | FJ182035 |
| DENV | NS2A | FJ176779 | DENV | NS2A | EU482619 | DENV | NS2A | FJ461306 |
| DENV | NS2A | EU482799 | DENV | NS2A | EU677155 | DENV | NS2A | EU482510 |
| DENV | NS2A | EU081233 | DENV | NS2A | FJ182021 | DENV | NS2A | FJ024440 |
| DENV | NS2A | EU482497 | DENV | NS2A | EU482712 | DENV | NS2A | EU081258 |
| DENV | NS2A | EU482616 | DENV | NS2A | EU482591 | DENV | NS2A | EU081268 |
| DENV | NS2A | EU482507 | DENV | NS2A | FJ410253 | DENV | NS2A | EU677178 |
| DENV | NS2A | EU482809 | DENV | NS2A | EF032590 | DENV | NS2A | FJ410276 |
| DENV | NS2A | FJ410262 | DENV | NS2A | EU081243 | DENV | NS2A | EU081273 |
| DENV | NS2A | FJ024480 | DENV | NS2A | FJ639818 | DENV | NS2A | EU482820 |
| DENV | NS2A | EU482495 | DENV | NS2A | EU081237 | DENV | NS2A | AF514878 |
| DENV | NS2A | FJ182032 | DENV | NS2A | AF514876 | DENV | NS2A | EU660394 |
| DENV | NS2A | FJ410197 | DENV | NS2A | FJ639688 | DENV | NS2A | FJ410218 |
| DENV | NS2A | AF514883 | DENV | NS2A | EU482713 | DENV | NS2A | EU081241 |
| DENV | NS2A | FJ461330 | DENV | NS2A | EU677154 | DENV | NS2A | FJ410244 |
| DENV | NS2A | FJ639690 | DENV | NS2A | EU081242 | DENV | NS2A | EU482789 |
| DENV | NS2A | FJ410209 | DENV | NS2A | EU687247 | DENV | NS2A | EU482524 |
| DENV | NS2A | EU482514 | DENV | NS2A | AY726552 | DENV | NS2A | EU081261 |
| DENV | NS2A | EU848545 | DENV | NS2A | FJ024436 | DENV | NS2A | FJ639812 |
| DENV | NS2A | EU249492 | DENV | NS2A | FJ639681 | DENV | NS2A | EU482533 |
| DENV | NS2A | EU081240 | DENV | NS2A | EU482484 | DENV | NS2A | DQ285559 |
| DENV | NS2A | EU482499 | DENV | NS2A | EU482815 | DENV | NS2A | FJ410246 |
| DENV | NS2A | FJ410281 | DENV | NS2A | EU249490 | DENV | NS2A | FJ461310 |
| DENV | NS2A | FJ410270 | DENV | NS2A | EU081253 | DENV | NS2A | AB195673 |
| DENV | NS2A | EU482808 | DENV | NS2A | AY726549 | DENV | NS2A | FJ182024 |
| DENV | NS2A | EU081281 | DENV | NS2A | EU677166 | DENV | NS2A | AB204803 |
| DENV | NS2A | AF309641 | DENV | NS2A | FJ639821 | DENV | NS2A | EF025110 |
| DENV | NS2A | EU677159 | DENV | NS2A | FJ024430 | DENV | NS2A | DQ672564 |
| DENV | NS2A | EU482526 | DENV | NS2A | FJ410183 | DENV | NS2A | EU726778 |
| DENV | NS2A | FJ024427 | DENV | NS2A | EU081267 | DENV | NS2A | EF457905 |
| DENV | NS2A | EU482618 | DENV | NS2A | EU482491 | DENV | NS2A | FJ547088 |
| DENV | NS2A | AF350498 | DENV | NS2A | EU081249 | DENV | NS2A | FJ024437 |

FIG. 70-80

| Virus | Protein | Accession No. | Virus | Protein | Accession No. | Virus | Protein | Accession No. |
|---|---|---|---|---|---|---|---|---|
| DENV | NS2A | EU482513 | DENV | NS2A | FJ432740 | DENV | NS2A | FJ639819 |
| DENV | NS2A | FJ410196 | DENV | NS2A | AY726554 | DENV | NS2A | FJ639806 |
| DENV | NS2A | FJ410250 | DENV | NS2A | FJ024441 | DENV | NS2A | FJ432738 |
| DENV | NS2A | EU660392 | DENV | NS2A | DQ672556 | DENV | NS2A | FJ432719 |
| DENV | NS2A | FJ461313 | DENV | NS2A | FJ410272 | DENV | NS2A | FJ461303 |
| DENV | NS2A | EU677168 | DENV | NS2A | FJ639676 | DENV | NS2A | FJ410203 |
| DENV | NS2A | FJ432723 | DENV | NS2A | FJ639686 | DENV | NS2A | FJ410194 |
| DENV | NS2A | FJ410181 | DENV | NS2A | EU482498 | DENV | NS2A | EU081244 |
| DENV | NS2A | FJ410239 | DENV | NS2A | FJ432725 | DENV | NS2A | EU482482 |
| DENV | NS2A | EU482480 | DENV | NS2A | EU482529 | DENV | NS2A | FJ410179 |
| DENV | NS2A | AY206457 | DENV | NS2A | FJ547086 | DENV | NS2A | AY722803 |
| DENV | NS2A | EU482523 | DENV | NS2A | FJ461323 | DENV | NS2A | EU482539 |
| DENV | NS2A | FJ410290 | DENV | NS2A | FJ410230 | DENV | NS2A | FJ639671 |
| DENV | NS2A | DQ672562 | DENV | NS2A | FJ410248 | DENV | NS2A | EU482478 |
| DENV | NS2A | EU482521 | DENV | NS2A | EU482609 | DENV | NS2A | FJ547060 |
| DENV | NS2A | EU660402 | DENV | NS2A | FJ639824 | DENV | NS2A | FJ432739 |
| DENV | NS2A | FJ461307 | DENV | NS2A | FJ410279 | DENV | NS2A | FJ639740 |
| DENV | NS2A | EU081272 | DENV | NS2A | EU482535 | DENV | NS2A | FJ182034 |
| DENV | NS2A | FJ461315 | DENV | NS2A | FJ024453 | DENV | NS2A | EU482710 |
| DENV | NS2A | FJ410188 | DENV | NS2A | FJ432748 | DENV | NS2A | EU081232 |
| DENV | NS2A | AY713475 | DENV | NS2A | EU660393 | DENV | NS2A | EU482515 |
| DENV | NS2A | AY732479 | DENV | NS2A | AY145122 | DENV | NS2A | EU482531 |
| DENV | NS2A | EU677156 | DENV | NS2A | FJ024446 | DENV | NS2A | AF298807 |
| DENV | NS2A | EU482707 | DENV | NS2A | FJ432747 | DENV | NS2A | FJ205873 |
| DENV | NS2A | EU482811 | DENV | NS2A | FJ410205 | DENV | NS2A | FJ639674 |
| DENV | NS2A | AF226686 | DENV | NS2A | FJ205876 | DENV | NS2A | FJ547065 |
| DENV | NS2A | EU081235 | DENV | NS2A | FJ410211 | DENV | NS2A | FJ410212 |
| DENV | NS2A | EU660419 | DENV | NS2A | FJ182025 | DENV | NS2A | FJ461341 |
| DENV | NS2A | FJ547068 | DENV | NS2A | FJ182026 | DENV | NS2A | EU081259 |
| DENV | NS2A | AB189121 | DENV | NS2A | FJ373296 | DENV | NS2A | FJ639823 |
| DENV | NS2A | FJ461308 | DENV | NS2A | AY722802 | DENV | NS2A | FJ410190 |
| DENV | NS2A | FJ410213 | DENV | NS2A | EU482522 | DENV | NS2A | FJ432745 |
| DENV | NS2A | AY726550 | DENV | NS2A | FJ390388 | DENV | NS2A | FJ410175 |
| DENV | NS2A | AY732477 | DENV | NS2A | EU677173 | DENV | NS2A | EU677176 |
| DENV | NS2A | EU660401 | DENV | NS2A | EU081277 | DENV | NS2A | FJ639679 |
| DENV | NS2A | FJ639815 | DENV | NS2A | EU482492 | DENV | NS2A | FJ432742 |
| DENV | NS2A | FJ410268 | DENV | NS2A | FJ432732 | DENV | NS2A | FJ639670 |
| DENV | NS2A | FJ478458 | DENV | NS2A | FJ639691 | DENV | NS2A | FJ182027 |
| DENV | NS2A | FJ639808 | DENV | NS2A | EU482511 | DENV | NS2A | EU482718 |
| DENV | NS2A | EU482611 | DENV | NS2A | EU081230 | DENV | NS2A | EU677158 |
| DENV | NS2A | FJ410261 | DENV | NS2A | FJ410206 | DENV | NS2A | FJ639687 |
| DENV | NS2A | FJ432729 | DENV | NS2A | FJ410189 | DENV | NS2A | FJ461325 |
| DENV | NS2A | FJ639813 | DENV | NS2A | FJ182019 | DENV | NS2A | FJ024444 |
| DENV | NS2A | EU482520 | DENV | NS2A | FJ024472 | DENV | NS2A | EU482617 |
| DENV | NS2A | AF514885 | DENV | NS2A | FJ205872 | DENV | NS2A | FJ639678 |
| DENV | NS2A | FJ639673 | DENV | NS2A | FJ410282 | DENV | NS2A | EU081269 |
| DENV | NS2A | FJ410266 | DENV | NS2A | EU482538 | DENV | NS2A | EU482714 |
| DENV | NS2A | EU482805 | DENV | NS2A | EU660418 | DENV | NS2A | FJ024456 |

FIG. 70-81

| Virus | Protein | Accession No. | Virus | Protein | Accession No. | Virus | Protein | Accession No. |
|---|---|---|---|---|---|---|---|---|
| DENV | NS2A | FJ182028 | DENV | NS2A | AF180817 | DENV | NS2A | EU677162 |
| DENV | NS2A | EU677152 | DENV | NS2A | AY722801 | DENV | NS2A | FJ024485 |
| DENV | NS2A | EU081228 | DENV | NS2A | EU482504 | DENV | NS2A | EU081271 |
| DENV | NS2A | FJ410173 | DENV | NS2A | FJ639675 | DENV | NS2A | FJ024426 |
| DENV | NS2A | EU482796 | DENV | NS2A | FJ024433 | DENV | NS2A | EU482790 |
| DENV | NS2A | EU726781 | DENV | NS2A | FJ461331 | DENV | NS2A | FJ410286 |
| DENV | NS2A | FJ410207 | DENV | NS2A | FJ410187 | DENV | NS2A | FJ639735 |
| DENV | NS2A | FJ410243 | DENV | NS2A | FJ410258 | DENV | NS2A | EU482494 |
| DENV | NS2A | EU081239 | DENV | NS2A | AY708047 | DENV | NS2A | FJ390374 |
| DENV | NS2A | EU482816 | DENV | NS2A | FJ024423 | DENV | NS2A | EU482813 |
| DENV | NS2A | EU081260 | DENV | NS2A | FJ024484 | DENV | NS2A | FJ461335 |
| DENV | NS2A | FJ182029 | DENV | NS2A | EU081251 | DENV | NS2A | EU482803 |
| DENV | NS2A | FJ024449 | DENV | NS2A | FJ410249 | DENV | NS2A | EU482490 |
| DENV | NS2A | EU081250 | DENV | NS2A | EU482610 | DENV | NS2A | FJ024482 |
| DENV | NS2A | EU482825 | DENV | NS2A | FJ182033 | DENV | NS2A | FJ410284 |
| DENV | NS2A | EU482530 | DENV | NS2A | EU482493 | DENV | NS2A | EU081280 |
| DENV | NS2A | FJ639820 | DENV | NS2A | EU482807 | DENV | NS2A | EU677150 |
| DENV | NS2A | EU677175 | DENV | NS2A | FJ639814 | DENV | NS2A | AY732481 |
| DENV | NS2A | FJ410251 | DENV | NS2A | EU482501 | DENV | NS2A | FJ461324 |
| DENV | NS2A | EU482794 | DENV | NS2A | FJ410254 | DENV | NS2A | FJ639796 |
| DENV | NS2A | EU359008 | DENV | NS2A | EU081246 | DENV | NS2A | EU482709 |
| DENV | NS2A | AF180818 | DENV | NS2A | EU081275 | DENV | NS2A | AF298808 |
| DENV | NS2A | EU660396 | DENV | NS2A | FJ410264 | DENV | NS2A | FJ182018 |
| DENV | NS2A | FJ182003 | DENV | NS2A | FJ024479 | DENV | NS2A | DQ672558 |
| DENV | NS2A | EU482476 | DENV | NS2A | FJ410185 | DENV | NS2A | EU482795 |
| DENV | NS2A | EU482505 | DENV | NS2A | FJ410273 | DENV | NS2A | EU677164 |
| DENV | NS2A | EU081255 | DENV | NS2A | EU482801 | DENV | NS2A | FJ410277 |
| DENV | NS2A | FJ639743 | DENV | NS2A | AY713476 | DENV | NS2A | FJ024464 |
| DENV | NS2A | U88537 | DENV | NS2A | FJ461312 | DENV | NS2A | FJ461332 |
| DENV | NS2A | FJ432733 | DENV | NS2A | FJ639797 | DENV | NS2A | EF122232 |
| DENV | NS2A | EU660395 | DENV | NS2A | FJ461319 | DENV | NS2A | FJ432727 |
| DENV | NS2A | EU081263 | DENV | NS2A | FJ461333 | DENV | NS2A | EU482823 |
| DENV | NS2A | EU482826 | DENV | NS2A | EU482516 | DENV | NS2A | EU482810 |
| DENV | NS2A | FJ410192 | DENV | NS2A | EU482792 | DENV | NS2A | EU081245 |
| DENV | NS2A | FJ182020 | DENV | NS2A | AF514889 | DENV | NS2A | EU081262 |
| DENV | NS2A | DQ672561 | DENV | NS2A | EU482509 | DENV | NS2A | EU863650 |
| DENV | NS2A | FJ024481 | DENV | NS2A | FJ432737 | DENV | NS2A | AY732483 |
| DENV | NS2A | EU677165 | DENV | NS2A | FJ547063 | DENV | NS2A | FJ410265 |
| DENV | NS2A | FJ410287 | DENV | NS2A | FJ373297 | DENV | NS2A | EU660412 |
| DENV | NS2A | EU482502 | DENV | NS2A | EU677157 | DENV | NS2A | EU677171 |
| DENV | NS2A | EU081274 | DENV | NS2A | EU482534 | DENV | NS2A | EU677140 |
| DENV | NS2A | FJ024448 | DENV | NS2A | EU249491 | DENV | NS2A | FJ898428 |
| DENV | NS2A | FJ024425 | DENV | NS2A | DQ285562 | DENV | NS2A | FJ882569 |
| DENV | NS2A | FJ639741 | DENV | NS2A | EU482793 | DENV | NS2A | GQ199776 |
| DENV | NS2A | FJ562104 | DENV | NS2A | EU482717 | DENV | NS2A | GQ199853 |
| DENV | NS2A | DQ672563 | DENV | NS2A | FJ024439 | DENV | NS2A | GQ199803 |
| DENV | NS2A | EU482708 | DENV | NS2A | EU482804 | DENV | NS2A | FJ882554 |
| DENV | NS2A | FJ410247 | DENV | NS2A | EU482503 | DENV | NS2A | FJ873809 |

FIG. 70-82

| Virus | Protein | Accession No. | Virus | Protein | Accession No. | Virus | Protein | Accession No. |
|---|---|---|---|---|---|---|---|---|
| DENV | NS2A | FJ882563 | DENV | NS2A | FJ882550 | DENV | NS2A | FJ882547 |
| DENV | NS2A | GQ199812 | DENV | NS2A | FJ744701 | DENV | NS2A | GQ199798 |
| DENV | NS2A | FJ873810 | DENV | NS2A | FJ898391 | DENV | NS2A | GQ199844 |
| DENV | NS2A | FJ898397 | DENV | NS2A | FJ898417 | DENV | NS2A | GQ199829 |
| DENV | NS2A | FJ898400 | DENV | NS2A | GQ199806 | DENV | NS2A | FJ882530 |
| DENV | NS2A | FJ687433 | DENV | NS2A | GQ199794 | DENV | NS2A | FJ898422 |
| DENV | NS2A | GQ199877 | DENV | NS2A | FJ898425 | DENV | NS2A | FJ810415 |
| DENV | NS2A | GQ199788 | DENV | NS2A | FJ898393 | DENV | NS2A | FJ898411 |
| DENV | NS2A | GQ199823 | DENV | NS2A | GQ199799 | DENV | NS2A | GQ199856 |
| DENV | NS2A | FJ898407 | DENV | NS2A | GQ199833 | DENV | NS2A | FJ850101 |
| DENV | NS2A | GQ199804 | DENV | NS2A | GQ199781 | DENV | NS2A | FJ850093 |
| DENV | NS2A | FJ882533 | DENV | NS2A | GQ199797 | DENV | NS2A | FJ882551 |
| DENV | NS2A | GQ199818 | DENV | NS2A | FJ882522 | DENV | NS2A | GQ199795 |
| DENV | NS2A | FJ882560 | DENV | NS2A | FJ906964 | DENV | NS2A | FJ850100 |
| DENV | NS2A | FJ898415 | DENV | NS2A | GQ199821 | DENV | NS2A | FJ898416 |
| DENV | NS2A | FJ850113 | DENV | NS2A | GQ199847 | DENV | NS2A | GQ199785 |
| DENV | NS2A | FJ898384 | DENV | NS2A | FJ882524 | DENV | NS2A | GQ199784 |
| DENV | NS2A | FJ882538 | DENV | NS2A | FJ850077 | DENV | NS2A | GQ199828 |
| DENV | NS2A | FJ882521 | DENV | NS2A | FJ882552 | DENV | NS2A | GQ199780 |
| DENV | NS2A | GQ199811 | DENV | NS2A | GQ199778 | DENV | NS2A | FJ850103 |
| DENV | NS2A | FJ850075 | DENV | NS2A | FJ882549 | DENV | NS2A | FJ882555 |
| DENV | NS2A | GQ199848 | DENV | NS2A | GQ199816 | DENV | NS2A | FJ882561 |
| DENV | NS2A | FJ898378 | DENV | NS2A | GQ199824 | DENV | NS2A | FJ687430 |
| DENV | NS2A | FJ873814 | DENV | NS2A | FJ898398 | DENV | NS2A | FJ898381 |
| DENV | NS2A | FJ898410 | DENV | NS2A | FJ859029 | DENV | NS2A | FJ882518 |
| DENV | NS2A | FJ882528 | DENV | NS2A | FJ882515 | DENV | NS2A | FJ898392 |
| DENV | NS2A | FJ898382 | DENV | NS2A | GQ199820 | DENV | NS2A | FJ898380 |
| DENV | NS2A | FJ898404 | DENV | NS2A | GQ199867 | DENV | NS2A | GQ199835 |
| DENV | NS2A | FJ687426 | DENV | NS2A | FJ898448 | DENV | NS2A | FJ898430 |
| DENV | NS2A | FJ898371 | DENV | NS2A | FJ882556 | DENV | NS2A | FJ850087 |
| DENV | NS2A | GQ199872 | DENV | NS2A | FJ882536 | DENV | NS2A | FJ898385 |
| DENV | NS2A | GQ199855 | DENV | NS2A | GQ199796 | DENV | NS2A | GQ199857 |
| DENV | NS2A | FJ882535 | DENV | NS2A | FJ882570 | DENV | NS2A | FJ898403 |
| DENV | NS2A | NC_001477 | DENV | NS2A | FJ898376 | DENV | NS2A | GQ199800 |
| DENV | NS2A | FJ898423 | DENV | NS2A | GQ199771 | DENV | NS2A | FJ882540 |
| DENV | NS2A | FJ882565 | DENV | NS2A | FJ850069 | DENV | NS2A | GQ199792 |
| DENV | NS2A | FJ882517 | DENV | NS2A | FJ850102 | DENV | NS2A | FJ882516 |
| DENV | NS2A | GQ199814 | DENV | NS2A | GQ199834 | DENV | NS2A | GQ199850 |
| DENV | NS2A | FJ898395 | DENV | NS2A | FJ898388 | DENV | NS2A | FJ898372 |
| DENV | NS2A | GQ199851 | DENV | NS2A | GQ199830 | DENV | NS2A | GQ199775 |
| DENV | NS2A | GQ199837 | DENV | NS2A | GQ199839 | DENV | NS2A | FJ882559 |
| DENV | NS2A | FJ882558 | DENV | NS2A | GQ199777 | DENV | NS2A | GQ199789 |
| DENV | NS2A | FJ850084 | DENV | NS2A | FJ882579 | DENV | NS2A | FJ850099 |
| DENV | NS2A | FJ898374 | DENV | NS2A | FJ898429 | DENV | NS2A | FJ850114 |
| DENV | NS2A | FJ850104 | DENV | NS2A | FJ882541 | DENV | NS2A | GQ199819 |
| DENV | NS2A | GQ199815 | DENV | NS2A | FJ898402 | DENV | NS2A | FJ882523 |
| DENV | NS2A | GQ199843 | DENV | NS2A | GQ199808 | DENV | NS2A | GQ199845 |
| DENV | NS2A | GQ199826 | DENV | NS2A | GQ199786 | DENV | NS2A | FJ850081 |

FIG. 70-83

| Virus | Protein | Accession No. | Virus | Protein | Accession No. | Virus | Protein | Accession No. |
|---|---|---|---|---|---|---|---|---|
| DENV | NS2A | FJ744702 | DENV | NS2A | FJ898408 | DENV | NS2A | GQ199840 |
| DENV | NS2A | FJ898386 | DENV | NS2A | FJ810419 | DENV | NS2A | FJ898433 |
| DENV | NS2A | FJ882542 | DENV | NS2A | GQ199793 | DENV | NS2A | FJ882567 |
| DENV | NS2A | GQ199782 | DENV | NS2A | FJ882562 | DENV | NS2A | FJ898387 |
| DENV | NS2A | GQ199852 | DENV | NS2A | FJ898424 | DENV | NS2A | FJ882532 |
| DENV | NS2A | FJ898421 | DENV | NS2A | FJ898389 | DENV | NS2A | FJ898409 |
| DENV | NS2A | FJ687432 | DENV | NS2A | FJ898412 | DENV | NS2A | FJ882545 |
| DENV | NS2A | GQ199813 | DENV | NS2A | FJ882537 | DENV | NS2A | FJ898375 |
| DENV | NS2A | FJ882534 | DENV | NS2A | FJ898418 | DENV | NS2A | FJ898414 |
| DENV | NS2A | GQ199854 | DENV | NS2A | FJ898394 | DENV | NS2A | CS477306 |
| DENV | NS2A | GQ199846 | DENV | NS2A | GQ199849 | DENV | NS2A | A75711 |
| DENV | NS2A | FJ882539 | DENV | NS2A | FJ882548 | DENV | NS2A | GU131816 |
| DENV | NS2A | FJ898437 | DENV | NS2A | FJ906963 | DENV | NS2A | FJ469907 |
| DENV | NS2A | FJ898390 | DENV | NS2A | FJ906965 | DENV | NS2A | GU131814 |
| DENV | NS2A | FJ898405 | DENV | NS2A | GQ199873 | DENV | NS2A | GU131725 |
| DENV | NS2A | GQ199783 | DENV | NS2A | FJ850073 | DENV | NS2A | GU131822 |
| DENV | NS2A | FJ882526 | DENV | NS2A | FJ850071 | DENV | NS2A | GQ868633 |
| DENV | NS2A | FJ461320 | DENV | NS2A | GQ199772 | DENV | NS2A | GU131820 |
| DENV | NS2A | FJ898420 | DENV | NS2A | FJ898373 | DENV | NS2A | GU131679 |
| DENV | NS2A | FJ687431 | DENV | NS2A | FJ687429 | DENV | NS2A | GQ868507 |
| DENV | NS2A | GQ199801 | DENV | NS2A | FJ898379 | DENV | NS2A | GU131789 |
| DENV | NS2A | FJ906728 | DENV | NS2A | FJ882566 | DENV | NS2A | GU131710 |
| DENV | NS2A | FJ882544 | DENV | NS2A | FJ898396 | DENV | NS2A | FN429887 |
| DENV | NS2A | FJ882553 | DENV | NS2A | FJ882529 | DENV | NS2A | GU131720 |
| DENV | NS2A | FJ882531 | DENV | NS2A | GQ199838 | DENV | NS2A | GU131841 |
| DENV | NS2A | GQ199810 | DENV | NS2A | GQ199779 | DENV | NS2A | GQ868564 |
| DENV | NS2A | GQ199825 | DENV | NS2A | GQ199827 | DENV | NS2A | AB519681 |
| DENV | NS2A | FJ882546 | DENV | NS2A | GQ199836 | DENV | NS2A | GU131743 |
| DENV | NS2A | FJ882568 | DENV | NS2A | GQ199858 | DENV | NS2A | GQ868522 |
| DENV | NS2A | FJ898413 | DENV | NS2A | GQ199787 | DENV | NS2A | GU131739 |
| DENV | NS2A | GQ199773 | DENV | NS2A | FJ850068 | DENV | NS2A | GU131971 |
| DENV | NS2A | GQ199822 | DENV | NS2A | FJ882564 | DENV | NS2A | GU131834 |
| DENV | NS2A | GQ199832 | DENV | NS2A | FJ898419 | DENV | NS2A | GQ868523 |
| DENV | NS2A | GQ199790 | DENV | NS2A | FJ898383 | DENV | NS2A | GU131982 |
| DENV | NS2A | GQ199841 | DENV | NS2A | FJ461328 | DENV | NS2A | GU131965 |
| DENV | NS2A | FJ882520 | DENV | NS2A | FJ882527 | DENV | NS2A | GU131760 |
| DENV | NS2A | GQ199875 | DENV | NS2A | FJ898427 | DENV | NS2A | GQ868535 |
| DENV | NS2A | GQ199802 | DENV | NS2A | FJ882525 | DENV | NS2A | GU131962 |
| DENV | NS2A | GQ199791 | DENV | NS2A | FJ882557 | DENV | NS2A | GU131891 |
| DENV | NS2A | FJ898426 | DENV | NS2A | GQ199859 | DENV | NS2A | GQ868504 |
| DENV | NS2A | FJ898431 | DENV | NS2A | GQ199842 | DENV | NS2A | GU131783 |
| DENV | NS2A | GQ199809 | DENV | NS2A | GQ199817 | DENV | NS2A | GU131680 |
| DENV | NS2A | FJ898406 | DENV | NS2A | FJ898401 | DENV | NS2A | GU131704 |
| DENV | NS2A | GQ199805 | DENV | NS2A | FJ882519 | DENV | NS2A | GU131685 |
| DENV | NS2A | GQ199831 | DENV | NS2A | FJ850090 | DENV | NS2A | GU131770 |
| DENV | NS2A | FJ850070 | DENV | NS2A | FJ898377 | DENV | NS2A | GU131795 |
| DENV | NS2A | GQ199807 | DENV | NS2A | GQ199774 | DENV | NS2A | GU131961 |
| DENV | NS2A | FJ882543 | DENV | NS2A | FJ898399 | DENV | NS2A | GU131733 |

FIG. 70-84

| Virus | Protein | Accession No. | Virus | Protein | Accession No. | Virus | Protein | Accession No. |
|---|---|---|---|---|---|---|---|---|
| DENV | NS2A | GU131804 | DENV | NS2A | GU131745 | DENV | NS2A | GU131763 |
| DENV | NS2A | GU131762 | DENV | NS2A | GQ868635 | DENV | NS2A | GQ868527 |
| DENV | NS2A | GU131827 | DENV | NS2A | GU056032 | DENV | NS2A | GU131708 |
| DENV | NS2A | GU131837 | DENV | NS2A | GQ868610 | DENV | NS2A | GU131766 |
| DENV | NS2A | GQ868630 | DENV | NS2A | GU131889 | DENV | NS2A | FN429890 |
| DENV | NS2A | GU131767 | DENV | NS2A | GQ868499 | DENV | NS2A | GU131694 |
| DENV | NS2A | GU131737 | DENV | NS2A | GU131756 | DENV | NS2A | GQ868615 |
| DENV | NS2A | GQ868500 | DENV | NS2A | GU131786 | DENV | NS2A | GU131688 |
| DENV | NS2A | GU131722 | DENV | NS2A | GQ868565 | DENV | NS2A | FJ469908 |
| DENV | NS2A | GQ868607 | DENV | NS2A | GU131709 | DENV | NS2A | GU131734 |
| DENV | NS2A | GQ868517 | DENV | NS2A | GQ868569 | DENV | NS2A | GQ868637 |
| DENV | NS2A | GU131727 | DENV | NS2A | GU131723 | DENV | NS2A | GU131888 |
| DENV | NS2A | GU131715 | DENV | NS2A | GU131696 | DENV | NS2A | GQ868568 |
| DENV | NS2A | FN429885 | DENV | NS2A | GQ868519 | DENV | NS2A | GU131790 |
| DENV | NS2A | GU131780 | DENV | NS2A | GU131838 | DENV | NS2A | GU131920 |
| DENV | NS2A | GU131750 | DENV | NS2A | GQ868520 | DENV | NS2A | GQ868528 |
| DENV | NS2A | GU131787 | DENV | NS2A | GU131791 | DENV | NS2A | GQ868612 |
| DENV | NS2A | GU056031 | DENV | NS2A | GU131765 | DENV | NS2A | GU131794 |
| DENV | NS2A | GQ868602 | DENV | NS2A | GU131702 | DENV | NS2A | GQ868606 |
| DENV | NS2A | GU131711 | DENV | NS2A | GU131682 | DENV | NS2A | GU131969 |
| DENV | NS2A | GQ868567 | DENV | NS2A | GU131801 | DENV | NS2A | GQ868608 |
| DENV | NS2A | GU131813 | DENV | NS2A | GQ868562 | DENV | NS2A | GU131921 |
| DENV | NS2A | FJ687428 | DENV | NS2A | GU131684 | DENV | NS2A | GQ868502 |
| DENV | NS2A | GU131707 | DENV | NS2A | GU131744 | DENV | NS2A | GU131719 |
| DENV | NS2A | GU131689 | DENV | NS2A | GQ868534 | DENV | NS2A | GU131973 |
| DENV | NS2A | GU131700 | DENV | NS2A | GU131687 | DENV | NS2A | GU131967 |
| DENV | NS2A | GU131798 | DENV | NS2A | GQ868529 | DENV | NS2A | GU131803 |
| DENV | NS2A | GU131713 | DENV | NS2A | GU131840 | DENV | NS2A | GU131736 |
| DENV | NS2A | GU131829 | DENV | NS2A | GU131808 | DENV | NS2A | GU131981 |
| DENV | NS2A | GU131782 | DENV | NS2A | GU131922 | DENV | NS2A | GU131964 |
| DENV | NS2A | GU131698 | DENV | NS2A | GU131836 | DENV | NS2A | GU131771 |
| DENV | NS2A | GU131732 | DENV | NS2A | GQ868613 | DENV | NS2A | GU131984 |
| DENV | NS2A | GU131772 | DENV | NS2A | GU131721 | DENV | NS2A | GU131695 |
| DENV | NS2A | GU131978 | DENV | NS2A | GU131730 | DENV | NS2A | GU131728 |
| DENV | NS2A | GU131958 | DENV | NS2A | GU131968 | DENV | NS2A | GQ868601 |
| DENV | NS2A | GU131811 | DENV | NS2A | GU131832 | DENV | NS2A | FN429886 |
| DENV | NS2A | GQ868506 | DENV | NS2A | GU131774 | DENV | NS2A | GU131826 |
| DENV | NS2A | GQ868525 | DENV | NS2A | GU131976 | DENV | NS2A | GQ868512 |
| DENV | NS2A | GQ868538 | DENV | NS2A | GU131831 | DENV | NS2A | GU131718 |
| DENV | NS2A | FJ469909 | DENV | NS2A | GQ868501 | DENV | NS2A | GQ868513 |
| DENV | NS2A | GU131818 | DENV | NS2A | GQ868531 | DENV | NS2A | GU131731 |
| DENV | NS2A | GU131893 | DENV | NS2A | GU131957 | DENV | NS2A | GU131686 |
| DENV | NS2A | GQ868509 | DENV | NS2A | GU131980 | DENV | NS2A | GU131894 |
| DENV | NS2A | GU131706 | DENV | NS2A | GQ868609 | DENV | NS2A | GU131895 |
| DENV | NS2A | GU131777 | DENV | NS2A | GU131769 | DENV | NS2A | GU131678 |
| DENV | NS2A | GU131925 | DENV | NS2A | GQ868526 | DENV | NS2A | GQ868619 |
| DENV | NS2A | GU131977 | DENV | NS2A | GQ868510 | DENV | NS2A | GU131729 |
| DENV | NS2A | GQ868611 | DENV | NS2A | FN429882 | DENV | NS2A | GQ868539 |

FIG. 70-85

| Virus | Protein | Accession No. | Virus | Protein | Accession No. | Virus | Protein | Accession No. |
|---|---|---|---|---|---|---|---|---|
| DENV | NS2A | GU131747 | DENV | NS2A | GU131792 | DENV | NS2A | GU131835 |
| DENV | NS2A | GU131748 | DENV | NS2A | GU131690 | DENV | NS2A | GU131716 |
| DENV | NS2A | FN429889 | DENV | NS2A | GQ868632 | DENV | NS2A | GQ868498 |
| DENV | NS2A | GU131776 | DENV | NS2A | GU131781 | DENV | NS2A | GU131683 |
| DENV | NS2A | GU131755 | DENV | NS2A | GQ868537 | DENV | NS2A | GU131960 |
| DENV | NS2A | GU131810 | DENV | NS2A | GU131815 | DENV | NS2A | GU131714 |
| DENV | NS2A | GU131701 | DENV | NS2A | GU056033 | DENV | NS2A | GU131779 |
| DENV | NS2A | GU131754 | DENV | NS2A | GU131812 | DENV | NS2A | GU131773 |
| DENV | NS2A | GU131784 | DENV | NS2A | GU131833 | DENV | NS2A | GQ868605 |
| DENV | NS2A | GU131807 | DENV | NS2A | GU131830 | DENV | NS2A | GQ868511 |
| DENV | NS2A | GU131842 | DENV | NS2A | GU131742 | DENV | NS2A | GU131752 |
| DENV | NS2A | GU131923 | DENV | NS2A | GQ868561 | DENV | NS2A | GU131691 |
| DENV | NS2A | GU131809 | DENV | NS2A | GU131800 | DENV | NS2A | GU131692 |
| DENV | NS2A | GU131726 | DENV | NS2A | GU131738 | DENV | NS2A | GU131705 |
| DENV | NS2A | GU131970 | DENV | NS2A | GU131824 | DENV | NS2A | GQ868639 |
| DENV | NS2A | GU131751 | DENV | NS2A | GU131919 | DENV | NS2A | GU131805 |
| DENV | NS2A | GU131828 | DENV | NS2A | GU131802 | DENV | NS2A | GU131735 |
| DENV | NS2A | GQ868524 | DENV | NS2A | GQ868503 | DENV | NS2A | GU131966 |
| DENV | NS2A | GU131863 | DENV | NS2A | GU131839 | DENV | NS2A | GU131890 |
| DENV | NS2A | GU131892 | DENV | NS2A | GU131681 | DENV | NS2A | GQ868566 |
| DENV | NS2A | GU131823 | DENV | NS2A | GQ868505 | DENV | NS2A | GU131775 |
| DENV | NS2A | GU131821 | DENV | NS2A | FN429884 | DENV | NS2A | GU131749 |
| DENV | NS2A | GU131983 | DENV | NS2A | GQ868536 | DENV | NS2A | GQ868521 |
| DENV | NS2A | GQ868518 | DENV | NS2A | GU131825 | DENV | NS2A | GU131703 |
| DENV | NS2A | GU131764 | DENV | NS2A | FN429888 | DENV | NS2A | GU131717 |
| DENV | NS2A | GU056030 | DENV | NS2A | GU131778 | DENV | NS2A | GU131712 |
| DENV | NS2A | GU131979 | DENV | NS2A | GU131972 | DENV | NS2A | GQ868532 |
| DENV | NS2A | GU131768 | DENV | NS2A | GU131817 | DENV | NS2A | GQ868514 |
| DENV | NS2A | GU131699 | DENV | NS2A | GU131759 | DENV | NS2A | FJ410220 |
| DENV | NS2A | FJ687427 | DENV | NS2A | GU131819 | DENV | NS2A | CS477302 |
| DENV | NS2A | GU131963 | DENV | NS2A | GU131757 | DENV | NS2A | CS477304 |
| DENV | NS2A | GU131793 | DENV | NS2A | GQ868533 | DENV | NS2A | CS477264 |
| DENV | NS2A | GQ868618 | DENV | NS2A | FN429883 | DENV | NS2A | CS477305 |
| DENV | NS2A | GU131799 | DENV | NS2A | GU131956 | DENV | NS2A | CS477263 |
| DENV | NS2A | GU131724 | DENV | NS2A | GQ868563 | DENV | NS2A | CS477265 |
| DENV | NS2A | GU131740 | DENV | NS2A | GU131926 | DENV | NS2A | M87512 |
| DENV | NS2A | GU131806 | DENV | NS2A | GU131887 | DENV | NS2A | FB730116 |
| DENV | NS2A | GQ868614 | DENV | NS2A | GU131741 | DENV | NS2A | GM059691 |
| DENV | NS2A | FN429881 | DENV | NS2A | GU131761 | DENV | NS2A | U88536 |
| DENV | NS2A | GQ868636 | DENV | NS2A | GU131693 | DENV | NS2A | GU370048 |
| DENV | NS2A | GU131746 | DENV | NS2A | GU131753 | DENV | NS2A | GU370049 |
| DENV | NS2A | GQ868560 | DENV | NS2A | GU131948 | DENV | NS2A | AY762085 |
| DENV | NS2A | GQ868508 | DENV | NS2A | GQ868559 | DENV | NS2A | FJ024424 |
| DENV | NS2A | GQ868570 | DENV | NS2A | GQ868530 | DENV | NS2A | FJ226067 |
| DENV | NS2A | GU131788 | DENV | NS2A | GU131797 | DENV | NS2A | FJ639745 |
| DENV | NS2A | GU131949 | DENV | NS2A | GU131785 | DENV | NS2A | AY618989 |
| DENV | NS2A | GU131796 | DENV | NS2A | GU131758 | DENV | NS2A | AF326827 |
| DENV | NS2A | GU056029 | DENV | NS2A | GU131697 | DENV | NS2A | AY618988 |

FIG. 70-86

| Virus | Protein | Accession No. | Virus | Protein | Accession No. | Virus | Protein | Accession No. |
|---|---|---|---|---|---|---|---|---|
| DENV | NS2A | EU854296 | DENV | NS2A | GQ199883 | DENV | NS2A | DQ401690 |
| DENV | NS2A | EU854300 | DENV | NS2A | FJ882586 | DENV | NS2A | EU529683 |
| DENV | NS2A | AY858050 | DENV | NS2A | GQ252675 | DENV | NS2A | AY679147 |
| DENV | NS2A | AF375822 | DENV | NS2A | FJ882581 | DENV | NS2A | AY676348 |
| DENV | NS2A | EU854295 | DENV | NS2A | GQ199881 | DENV | NS2A | EF629368 |
| DENV | NS2A | M14931 | DENV | NS2A | GQ199878 | DENV | NS2A | FJ639752 |
| DENV | NS2A | AY618992 | DENV | NS2A | FJ882596 | DENV | NS2A | FJ639807 |
| DENV | NS2A | EU854297 | DENV | NS2A | FJ882583 | DENV | NS2A | EU529684 |
| DENV | NS2A | FJ639738 | DENV | NS2A | FJ882600 | DENV | NS2A | FJ373304 |
| DENV | NS2A | AY618993 | DENV | NS2A | FJ850057 | DENV | NS2A | FJ639723 |
| DENV | NS2A | FJ639764 | DENV | NS2A | GQ199879 | DENV | NS2A | EU569691 |
| DENV | NS2A | FJ639737 | DENV | NS2A | FJ882585 | DENV | NS2A | DQ675524 |
| DENV | NS2A | AY776330 | DENV | NS2A | GQ199876 | DENV | NS2A | EU081203 |
| DENV | NS2A | AY618991 | DENV | NS2A | GQ199885 | DENV | NS2A | EU482564 |
| DENV | NS2A | FJ639736 | DENV | NS2A | FJ882592 | DENV | NS2A | FJ182039 |
| DENV | NS2A | FJ639739 | DENV | NS2A | GQ199882 | DENV | NS2A | EU482453 |
| DENV | NS2A | AF326826 | DENV | NS2A | FJ882591 | DENV | NS2A | FJ639779 |
| DENV | NS2A | AY947539 | DENV | NS2A | FJ882589 | DENV | NS2A | EU081183 |
| DENV | NS2A | EU854299 | DENV | NS2A | GQ868642 | DENV | NS2A | EU529690 |
| DENV | NS2A | AY618990 | DENV | NS2A | GQ868581 | DENV | NS2A | FJ182011 |
| DENV | NS2A | FJ639748 | DENV | NS2A | FN429919 | DENV | NS2A | EU081187 |
| DENV | NS2A | FJ639744 | DENV | NS2A | GQ868583 | DENV | NS2A | EU482461 |
| DENV | NS2A | EU854301 | DENV | NS2A | FN429920 | DENV | NS2A | FJ639803 |
| DENV | NS2A | FJ639773 | DENV | NS2A | FN429923 | DENV | NS2A | AY858047 |
| DENV | NS2A | FJ182016 | DENV | NS2A | GQ868585 | DENV | NS2A | FJ639774 |
| DENV | NS2A | AF326573 | DENV | NS2A | GQ868579 | DENV | NS2A | FJ639726 |
| DENV | NS2A | FJ182017 | DENV | NS2A | GQ868644 | DENV | NS2A | AY858037 |
| DENV | NS2A | FJ024476 | DENV | NS2A | FN429925 | DENV | NS2A | EU081215 |
| DENV | NS2A | EF457906 | DENV | NS2A | GU289913 | DENV | NS2A | FJ639785 |
| DENV | NS2A | FJ639742 | DENV | NS2A | GQ868580 | DENV | NS2A | FJ639761 |
| DENV | NS2A | AF289029 | DENV | NS2A | FN429922 | DENV | NS2A | EU569688 |
| DENV | NS2A | GQ199880 | DENV | NS2A | GQ868645 | DENV | NS2A | DQ675533 |
| DENV | NS2A | FJ882597 | DENV | NS2A | GQ868594 | DENV | NS2A | FJ410177 |
| DENV | NS2A | NC_002640 | DENV | NS2A | FN429924 | DENV | NS2A | FJ478456 |
| DENV | NS2A | FJ882587 | DENV | NS2A | FJ882590 | DENV | NS2A | EU081195 |
| DENV | NS2A | FJ882595 | DENV | NS2A | GQ868582 | DENV | NS2A | EU081221 |
| DENV | NS2A | FJ882582 | DENV | NS2A | GQ868584 | DENV | NS2A | EU529689 |
| DENV | NS2A | FJ810417 | DENV | NS2A | FN429926 | DENV | NS2A | EU660408 |
| DENV | NS2A | FJ850095 | DENV | NS2A | FN429921 | DENV | NS2A | EU687219 |
| DENV | NS2A | FJ882599 | DENV | NS2A | GQ868643 | DENV | NS2A | FJ639780 |
| DENV | NS2A | FJ882580 | DENV | NS2A | AF326825 | DENV | NS2A | EU687196 |
| DENV | NS2A | GQ199884 | DENV | NS2A | AY376438 | DENV | NS2A | EF643017 |
| DENV | NS2A | FJ882588 | DENV | NS2A | AY648301 | DENV | NS2A | FJ373303 |
| DENV | NS2A | FJ882598 | DENV | NS2A | AY099336 | DENV | NS2A | FJ639729 |
| DENV | NS2A | FJ882601 | DENV | NS2A | GU363549 | DENV | NS2A | FJ639775 |
| DENV | NS2A | FJ850058 | DENV | NS2A | GU370052 | DENV | NS2A | FJ461322 |
| DENV | NS2A | FJ882584 | DENV | NS2A | GU370053 | DENV | NS2A | FJ390371 |
| DENV | NS2A | FJ850059 | DENV | NS2A | EU081191 | DENV | NS2A | AY858046 |

FIG. 70-87

| Virus | Protein | Accession No. | Virus | Protein | Accession No. | Virus | Protein | Accession No. |
|---|---|---|---|---|---|---|---|---|
| DENV | NS2A | EU482455 | DENV | NS2A | AY923865 | DENV | NS2A | EU081222 |
| DENV | NS2A | AY744680 | DENV | NS2A | EU081188 | DENV | NS2A | EU660407 |
| DENV | NS2A | FJ182015 | DENV | NS2A | FJ461337 | DENV | NS2A | M93130 |
| DENV | NS2A | FJ562103 | DENV | NS2A | EU081224 | DENV | NS2A | EU529687 |
| DENV | NS2A | FJ639792 | DENV | NS2A | EU081207 | DENV | NS2A | DQ675523 |
| DENV | NS2A | DQ675527 | DENV | NS2A | FJ639750 | DENV | NS2A | FJ432722 |
| DENV | NS2A | FJ547066 | DENV | NS2A | AB189128 | DENV | NS2A | EU482559 |
| DENV | NS2A | EU529698 | DENV | NS2A | AY676353 | DENV | NS2A | FJ639721 |
| DENV | NS2A | EU726769 | DENV | NS2A | EU081209 | DENV | NS2A | AY744682 |
| DENV | NS2A | AY676349 | DENV | NS2A | FJ639772 | DENV | NS2A | EU081184 |
| DENV | NS2A | EU529688 | DENV | NS2A | FJ182040 | DENV | NS2A | FJ639805 |
| DENV | NS2A | EU482558 | DENV | NS2A | AY648961 | DENV | NS2A | FJ547074 |
| DENV | NS2A | FJ547070 | DENV | NS2A | FJ410178 | DENV | NS2A | EU529685 |
| DENV | NS2A | EU687198 | DENV | NS2A | EU529699 | DENV | NS2A | DQ401695 |
| DENV | NS2A | FJ639817 | DENV | NS2A | EU081199 | DENV | NS2A | FJ432743 |
| DENV | NS2A | EU081202 | DENV | NS2A | FJ639786 | DENV | NS2A | EU854291 |
| DENV | NS2A | EU081225 | DENV | NS2A | FJ639768 | DENV | NS2A | FJ182008 |
| DENV | NS2A | DQ675520 | DENV | NS2A | FJ639731 | DENV | NS2A | FJ547062 |
| DENV | NS2A | EU854298 | DENV | NS2A | FJ390373 | DENV | NS2A | FJ024467 |
| DENV | NS2A | FJ205870 | DENV | NS2A | FJ639800 | DENV | NS2A | EU687239 |
| DENV | NS2A | FJ639793 | DENV | NS2A | FJ547079 | DENV | NS2A | FJ024468 |
| DENV | NS2A | DQ675532 | DENV | NS2A | FJ547072 | DENV | NS2A | AY496874 |
| DENV | NS2A | FJ024470 | DENV | NS2A | EU081219 | DENV | NS2A | FJ547061 |
| DENV | NS2A | EU081210 | DENV | NS2A | EU596493 | DENV | NS2A | FJ547076 |
| DENV | NS2A | EU687226 | DENV | NS2A | EU081192 | DENV | NS2A | FJ639767 |
| DENV | NS2A | FJ639715 | DENV | NS2A | FJ432731 | DENV | NS2A | AB189125 |
| DENV | NS2A | AY676352 | DENV | NS2A | AB189126 | DENV | NS2A | AF317645 |
| DENV | NS2A | AY858043 | DENV | NS2A | FJ024471 | DENV | NS2A | AB189127 |
| DENV | NS2A | EU081196 | DENV | NS2A | FJ639769 | DENV | NS2A | EU781137 |
| DENV | NS2A | FJ432741 | DENV | NS2A | FJ547078 | DENV | NS2A | DQ675522 |
| DENV | NS2A | EU726773 | DENV | NS2A | FJ547080 | DENV | NS2A | EU482614 |
| DENV | NS2A | EU482555 | DENV | NS2A | AY744679 | DENV | NS2A | AB214879 |
| DENV | NS2A | DQ401694 | DENV | NS2A | EU081217 | DENV | NS2A | FJ639765 |
| DENV | NS2A | EU081216 | DENV | NS2A | AY858045 | DENV | NS2A | EU081211 |
| DENV | NS2A | EU529704 | DENV | NS2A | FJ547084 | DENV | NS2A | FJ639787 |
| DENV | NS2A | FJ639777 | DENV | NS2A | DQ675521 | DENV | NS2A | FJ639784 |
| DENV | NS2A | FJ639730 | DENV | NS2A | AY776329 | DENV | NS2A | EU569690 |
| DENV | NS2A | EU081190 | DENV | NS2A | FJ639789 | DENV | NS2A | EU081223 |
| DENV | NS2A | EU529703 | DENV | NS2A | AY496871 | DENV | NS2A | FJ639816 |
| DENV | NS2A | FJ639725 | DENV | NS2A | EU781136 | DENV | NS2A | AY496873 |
| DENV | NS2A | EU081205 | DENV | NS2A | FJ182013 | DENV | NS2A | FJ182010 |
| DENV | NS2A | AY876494 | DENV | NS2A | EU596492 | DENV | NS2A | AY099337 |
| DENV | NS2A | FJ639747 | DENV | NS2A | EU726774 | DENV | NS2A | AY496879 |
| DENV | NS2A | FJ373302 | DENV | NS2A | EU081198 | DENV | NS2A | EU482462 |
| DENV | NS2A | FJ639778 | DENV | NS2A | FJ639728 | DENV | NS2A | FJ639825 |
| DENV | NS2A | DQ401692 | DENV | NS2A | DQ675530 | DENV | NS2A | AY766104 |
| DENV | NS2A | FJ182038 | DENV | NS2A | EU660409 | DENV | NS2A | FJ182007 |
| DENV | NS2A | EU081220 | DENV | NS2A | EU081206 | DENV | NS2A | DQ401693 |

FIG. 70-88

| Virus | Protein | Accession No. | Virus | Protein | Accession No. | Virus | Protein | Accession No. |
|---|---|---|---|---|---|---|---|---|
| DENV | NS2A | DQ675531 | DENV | NS2A | EU482596 | DENV | NS2A | EU081197 |
| DENV | NS2A | FJ461326 | DENV | NS2A | EU081208 | DENV | NS2A | FJ639755 |
| DENV | NS2A | FJ373306 | DENV | NS2A | EU081201 | DENV | NS2A | FJ639798 |
| DENV | NS2A | EU569689 | DENV | NS2A | FJ639757 | DENV | NS2A | FJ639758 |
| DENV | NS2A | AY858041 | DENV | NS2A | FJ639713 | DENV | NS2A | EU687218 |
| DENV | NS2A | EU482566 | DENV | NS2A | AY744685 | DENV | NS2A | EU081189 |
| DENV | NS2A | EF629370 | DENV | NS2A | FJ182041 | DENV | NS2A | FJ639759 |
| DENV | NS2A | AY496877 | DENV | NS2A | FJ562099 | DENV | NS2A | EU081212 |
| DENV | NS2A | FJ562102 | DENV | NS2A | FJ562100 | DENV | NS2A | EU482460 |
| DENV | NS2A | EF629367 | DENV | NS2A | FJ547081 | DENV | NS2A | FJ547075 |
| DENV | NS2A | FJ547077 | DENV | NS2A | AY858044 | DENV | NS2A | AY676350 |
| DENV | NS2A | FJ639770 | DENV | NS2A | FJ639714 | DENV | NS2A | EU854292 |
| DENV | NS2A | EU081182 | DENV | NS2A | EU529686 | DENV | NS2A | EU660410 |
| DENV | NS2A | EU596494 | DENV | NS2A | FJ410229 | DENV | NS2A | FJ432728 |
| DENV | NS2A | FJ639749 | DENV | NS2A | FJ547073 | DENV | NS2A | FJ024469 |
| DENV | NS2A | EU726771 | DENV | NS2A | FJ639791 | DENV | NS2A | AY858048 |
| DENV | NS2A | FJ639746 | DENV | NS2A | EU529692 | DENV | NS2A | FJ639804 |
| DENV | NS2A | EU081214 | DENV | NS2A | FJ547082 | DENV | NS2A | EU529705 |
| DENV | NS2A | AY858039 | DENV | NS2A | EU367962 | DENV | NS2A | EU482454 |
| DENV | NS2A | EU660411 | DENV | NS2A | FJ390375 | DENV | NS2A | DQ401691 |
| DENV | NS2A | EU482563 | DENV | NS2A | AY858040 | DENV | NS2A | FJ639771 |
| DENV | NS2A | AY744678 | DENV | NS2A | FJ547069 | DENV | NS2A | FJ639754 |
| DENV | NS2A | FJ461334 | DENV | NS2A | FJ562107 | DENV | NS2A | EU482459 |
| DENV | NS2A | EU660420 | DENV | NS2A | FJ461338 | DENV | NS2A | FJ205871 |
| DENV | NS2A | FJ024466 | DENV | NS2A | FJ639722 | DENV | NS2A | EU081186 |
| DENV | NS2A | FJ639795 | DENV | NS2A | FJ639782 | DENV | NS2A | FJ547083 |
| DENV | NS2A | FJ024465 | DENV | NS2A | AY858042 | DENV | NS2A | FJ639762 |
| DENV | NS2A | EU726768 | DENV | NS2A | EU081185 | DENV | NS2A | FJ547071 |
| DENV | NS2A | FJ639720 | DENV | NS2A | FJ390377 | DENV | NS2A | EU529702 |
| DENV | NS2A | EU529696 | DENV | NS2A | FJ639763 | DENV | NS2A | EU687234 |
| DENV | NS2A | FJ639810 | DENV | NS2A | FJ639760 | DENV | NS2A | FJ182006 |
| DENV | NS2A | AY744681 | DENV | NS2A | FJ182009 | DENV | NS2A | AY662691 |
| DENV | NS2A | FJ639724 | DENV | NS2A | EU529697 | DENV | NS2A | EU081213 |
| DENV | NS2A | EU482595 | DENV | NS2A | DQ675529 | DENV | NS2A | EU081181 |
| DENV | NS2A | AY676351 | DENV | NS2A | FJ639727 | DENV | NS2A | FJ390372 |
| DENV | NS2A | DQ401689 | DENV | NS2A | FJ461329 | DENV | NS2A | EU482613 |
| DENV | NS2A | FJ182005 | DENV | NS2A | EU482457 | DENV | NS2A | FJ639790 |
| DENV | NS2A | FJ547085 | DENV | NS2A | FJ639827 | DENV | NS2A | DQ675519 |
| DENV | NS2A | EU081193 | DENV | NS2A | EU687197 | DENV | NS2A | EU687233 |
| DENV | NS2A | FJ639751 | DENV | NS2A | FJ639801 | DENV | NS2A | EF629369 |
| DENV | NS2A | DQ675525 | DENV | NS2A | FJ410176 | DENV | NS2A | FJ182004 |
| DENV | NS2A | FJ639826 | DENV | NS2A | EU081218 | DENV | NS2A | FJ639799 |
| DENV | NS2A | EU482458 | DENV | NS2A | AY744684 | DENV | NS2A | FJ562097 |
| DENV | NS2A | EU081204 | DENV | NS2A | FJ390376 | DENV | NS2A | FJ639712 |
| DENV | NS2A | EU529691 | DENV | NS2A | FJ639781 | DENV | NS2A | EF629366 |
| DENV | NS2A | FJ639719 | DENV | NS2A | DQ675528 | DENV | NS2A | EU726772 |
| DENV | NS2A | FJ182037 | DENV | NS2A | FJ639766 | DENV | NS2A | DQ675526 |
| DENV | NS2A | EU482612 | DENV | NS2A | EU687221 | DENV | NS2A | EU482452 |

FIG. 70-89

| Virus | Protein | Accession No. | Virus | Protein | Accession No. | Virus | Protein | Accession No. |
|---|---|---|---|---|---|---|---|---|
| DENV | NS2A | AY858038 | DENV | NS2A | FJ898457 | DENV | NS2A | FJ850086 |
| DENV | NS2A | EU482456 | DENV | NS2A | FJ744736 | DENV | NS2A | FJ882572 |
| DENV | NS2A | EU081200 | DENV | NS2A | FJ810416 | DENV | NS2A | FJ882578 |
| DENV | NS2A | FJ639756 | DENV | NS2A | FJ898474 | DENV | NS2A | FJ850092 |
| DENV | NS2A | AY744677 | DENV | NS2A | FJ850094 | DENV | NS2A | AB214882 |
| DENV | NS2A | AY744683 | DENV | NS2A | FJ898470 | DENV | NS2A | AB214880 |
| DENV | NS2A | FJ639753 | DENV | NS2A | FJ810413 | DENV | NS2A | AB214881 |
| DENV | NS2A | FJ639716 | DENV | NS2A | FJ744735 | DENV | NS2A | FB667400 |
| DENV | NS2A | EU081194 | DENV | NS2A | GQ199860 | DENV | NS2A | GQ868587 |
| DENV | NS2A | FJ639776 | DENV | NS2A | FJ898464 | DENV | NS2A | EU932688 |
| DENV | NS2A | FJ898469 | DENV | NS2A | FJ744729 | DENV | NS2A | FN429906 |
| DENV | NS2A | GQ252674 | DENV | NS2A | FJ898472 | DENV | NS2A | GU131916 |
| DENV | NS2A | FJ850055 | DENV | NS2A | GQ199862 | DENV | NS2A | GU131953 |
| DENV | NS2A | FJ898475 | DENV | NS2A | FJ873812 | DENV | NS2A | GU131850 |
| DENV | NS2A | FJ744739 | DENV | NS2A | FJ898441 | DENV | NS2A | FN429900 |
| DENV | NS2A | NC_001475 | DENV | NS2A | FJ850048 | DENV | NS2A | GQ868576 |
| DENV | NS2A | GQ199863 | DENV | NS2A | FJ850080 | DENV | NS2A | GU131946 |
| DENV | NS2A | FJ850089 | DENV | NS2A | FJ882577 | DENV | NS2A | GU131866 |
| DENV | NS2A | FJ898442 | DENV | NS2A | FJ850096 | DENV | NS2A | GU131862 |
| DENV | NS2A | FJ898459 | DENV | NS2A | FJ898473 | DENV | NS2A | GU131852 |
| DENV | NS2A | FJ850049 | DENV | NS2A | FJ882574 | DENV | NS2A | FN429897 |
| DENV | NS2A | FJ744730 | DENV | NS2A | FJ898445 | DENV | NS2A | GQ868571 |
| DENV | NS2A | FJ850097 | DENV | NS2A | GQ199888 | DENV | NS2A | GQ868626 |
| DENV | NS2A | FJ744728 | DENV | NS2A | FJ898443 | DENV | NS2A | GQ868546 |
| DENV | NS2A | FJ898458 | DENV | NS2A | FJ744726 | DENV | NS2A | FN429904 |
| DENV | NS2A | FJ744740 | DENV | NS2A | FJ898476 | DENV | NS2A | GU131904 |
| DENV | NS2A | GQ199889 | DENV | NS2A | FJ898468 | DENV | NS2A | GU131935 |
| DENV | NS2A | GQ199886 | DENV | NS2A | FJ744733 | DENV | NS2A | GU131910 |
| DENV | NS2A | FJ687448 | DENV | NS2A | GQ199871 | DENV | NS2A | GU131918 |
| DENV | NS2A | FJ744732 | DENV | NS2A | GQ199887 | DENV | NS2A | GU131937 |
| DENV | NS2A | FJ898446 | DENV | NS2A | GQ199864 | DENV | NS2A | GU131868 |
| DENV | NS2A | GQ199861 | DENV | NS2A | FJ744737 | DENV | NS2A | GU131951 |
| DENV | NS2A | FJ898455 | DENV | NS2A | FJ898456 | DENV | NS2A | FN429910 |
| DENV | NS2A | FJ882573 | DENV | NS2A | FJ850083 | DENV | NS2A | GU131854 |
| DENV | NS2A | FJ898463 | DENV | NS2A | FJ744731 | DENV | NS2A | GU131943 |
| DENV | NS2A | FJ898447 | DENV | NS2A | FJ850079 | DENV | NS2A | GU131861 |
| DENV | NS2A | FJ882571 | DENV | NS2A | FJ744700 | DENV | NS2A | GU131871 |
| DENV | NS2A | FJ898462 | DENV | NS2A | FJ882576 | DENV | NS2A | GU131933 |
| DENV | NS2A | GQ199870 | DENV | NS2A | GQ199891 | DENV | NS2A | GU131877 |
| DENV | NS2A | FJ898471 | DENV | NS2A | FJ850111 | DENV | NS2A | GU131911 |
| DENV | NS2A | FJ882575 | DENV | NS2A | FJ850056 | DENV | NS2A | GQ868628 |
| DENV | NS2A | FJ744738 | DENV | NS2A | FJ744727 | DENV | NS2A | GQ868574 |
| DENV | NS2A | FJ898440 | DENV | NS2A | FJ873813 | DENV | NS2A | GU131941 |
| DENV | NS2A | FJ898444 | DENV | NS2A | AY770511 | DENV | NS2A | GQ868577 |
| DENV | NS2A | GQ199865 | DENV | NS2A | FJ850098 | DENV | NS2A | GQ868547 |
| DENV | NS2A | GQ252678 | DENV | NS2A | FJ810414 | DENV | NS2A | GU131845 |
| DENV | NS2A | FJ850110 | DENV | NS2A | FJ850109 | DENV | NS2A | FN429899 |
| DENV | NS2A | FJ744734 | DENV | NS2A | FJ850052 | DENV | NS2A | FN429902 |

FIG. 70-90

| Virus | Protein | Accession No. | Virus | Protein | Accession No. | Virus | Protein | Accession No. |
|---|---|---|---|---|---|---|---|---|
| DENV | NS2A | FN429917 | DENV | NS2A | FN429909 | DENV | NS2A | EU482468 |
| DENV | NS2A | FN429915 | DENV | NS2A | FN429911 | DENV | NS2A | FJ410195 |
| DENV | NS2A | GU131855 | DENV | NS2A | GU131945 | DENV | NS2A | AB122021 |
| DENV | NS2A | FN429896 | DENV | NS2A | FN429916 | DENV | NS2A | EU482469 |
| DENV | NS2A | GU131844 | DENV | NS2A | FN429914 | DENV | NS2A | FM210231 |
| DENV | NS2A | GQ868573 | DENV | NS2A | GU131942 | DENV | NS2A | FJ639831 |
| DENV | NS2A | GQ868586 | DENV | NS2A | GU131849 | DENV | NS2A | EU482657 |
| DENV | NS2A | GU131858 | DENV | NS2A | GU131952 | DENV | NS2A | EU482674 |
| DENV | NS2A | FN429903 | DENV | NS2A | GU131915 | DENV | NS2A | EU482753 |
| DENV | NS2A | GU131874 | DENV | NS2A | GQ868578 | DENV | NS2A | DQ645545 |
| DENV | NS2A | GU131914 | DENV | NS2A | GQ868548 | DENV | NS2A | FJ639835 |
| DENV | NS2A | FN429912 | DENV | NS2A | GU131913 | DENV | NS2A | FJ432726 |
| DENV | NS2A | FN429898 | DENV | NS2A | GU131940 | DENV | NS2A | EU482607 |
| DENV | NS2A | GU131851 | DENV | NS2A | FN429918 | DENV | NS2A | EU482660 |
| DENV | NS2A | GU131938 | DENV | NS2A | FN429905 | DENV | NS2A | EU482766 |
| DENV | NS2A | GU131853 | DENV | NS2A | GU131907 | DENV | NS2A | AB189124 |
| DENV | NS2A | FN429907 | DENV | NS2A | GU131860 | DENV | NS2A | AF100461 |
| DENV | NS2A | GU131865 | DENV | NS2A | GU131954 | DENV | NS2A | EU482600 |
| DENV | NS2A | GU131906 | DENV | NS2A | GU131856 | DENV | NS2A | EU687230 |
| DENV | NS2A | GU131944 | DENV | NS2A | GU131847 | DENV | NS2A | EU482633 |
| DENV | NS2A | GU131936 | DENV | NS2A | GU131909 | DENV | NS2A | EU482726 |
| DENV | NS2A | GU131903 | DENV | NS2A | GU131939 | DENV | NS2A | EU482557 |
| DENV | NS2A | GU131908 | DENV | NS2A | GU131912 | DENV | NS2A | EU482444 |
| DENV | NS2A | GU131878 | DENV | NS2A | GU131859 | DENV | NS2A | FJ205877 |
| DENV | NS2A | GU131950 | DENV | NS2A | GU131857 | DENV | NS2A | EU482621 |
| DENV | NS2A | GQ868634 | DENV | NS2A | GQ868629 | DENV | NS2A | EU482736 |
| DENV | NS2A | GU131873 | DENV | NS2A | GU131905 | DENV | NS2A | EU596497 |
| DENV | NS2A | GQ868593 | DENV | NS2A | GU131848 | DENV | NS2A | M84728 |
| DENV | NS2A | GQ868572 | DENV | NS2A | FB667402 | DENV | NS2A | EU482549 |
| DENV | NS2A | DQ863638 | DENV | NS2A | FB667403 | DENV | NS2A | FM210228 |
| DENV | NS2A | GU131876 | DENV | NS2A | FJ177308 | DENV | NS2A | EU687216 |
| DENV | NS2A | EU932687 | DENV | NS2A | FB667404 | DENV | NS2A | EU596489 |
| DENV | NS2A | GU189648 | DENV | NS2A | FB667398 | DENV | NS2A | EU482576 |
| DENV | NS2A | FN429913 | DENV | NS2A | FB667399 | DENV | NS2A | AF100460 |
| DENV | NS2A | GU131867 | DENV | NS2A | CS805345 | DENV | NS2A | AF169679 |
| DENV | NS2A | GQ868575 | DENV | NS2A | EU482634 | DENV | NS2A | EU482665 |
| DENV | NS2A | GQ868617 | DENV | NS2A | FJ373301 | DENV | NS2A | EU482586 |
| DENV | NS2A | GQ868616 | DENV | NS2A | EU482582 | DENV | NS2A | AF169681 |
| DENV | NS2A | GU131870 | DENV | NS2A | EU687227 | DENV | NS2A | FM210205 |
| DENV | NS2A | GU131869 | DENV | NS2A | EU569710 | DENV | NS2A | EU482767 |
| DENV | NS2A | GU131846 | DENV | NS2A | EF105383 | DENV | NS2A | EU687240 |
| DENV | NS2A | GU131934 | DENV | NS2A | EU687249 | DENV | NS2A | AF169686 |
| DENV | NS2A | GQ868627 | DENV | NS2A | EU687242 | DENV | NS2A | EU687244 |
| DENV | NS2A | FN429908 | DENV | NS2A | EU482658 | DENV | NS2A | EU482683 |
| DENV | NS2A | GU131872 | DENV | NS2A | FJ639710 | DENV | NS2A | FJ373299 |
| DENV | NS2A | FN429901 | DENV | NS2A | EU482748 | DENV | NS2A | EU482601 |
| DENV | NS2A | GU131917 | DENV | NS2A | FJ205885 | DENV | NS2A | EU660404 |
| DENV | NS2A | GU131875 | DENV | NS2A | EU482470 | DENV | NS2A | EU482651 |

FIG. 70-91

| Virus | Protein | Accession No. | Virus | Protein | Accession No. | Virus | Protein | Accession No. |
|---|---|---|---|---|---|---|---|---|
| DENV | NS2A | EU482787 | DENV | NS2A | FJ205879 | DENV | NS2A | FJ639707 |
| DENV | NS2A | FM210216 | DENV | NS2A | EU569697 | DENV | NS2A | EU482637 |
| DENV | NS2A | EU569694 | DENV | NS2A | EU482691 | DENV | NS2A | EU482699 |
| DENV | NS2A | EU482648 | DENV | NS2A | FJ461309 | DENV | NS2A | EU482583 |
| DENV | NS2A | EU482620 | DENV | NS2A | EU482608 | DENV | NS2A | FJ639717 |
| DENV | NS2A | EU482471 | DENV | NS2A | EU726776 | DENV | NS2A | EU687223 |
| DENV | NS2A | EU482644 | DENV | NS2A | EU081177 | DENV | NS2A | AY702036 |
| DENV | NS2A | FJ639833 | DENV | NS2A | FM210213 | DENV | NS2A | EU482542 |
| DENV | NS2A | EU482445 | DENV | NS2A | EU854293 | DENV | NS2A | EU482587 |
| DENV | NS2A | EU482606 | DENV | NS2A | EU482632 | DENV | NS2A | EU482667 |
| DENV | NS2A | FM210236 | DENV | NS2A | FM210234 | DENV | NS2A | EU482695 |
| DENV | NS2A | EU482639 | DENV | NS2A | EU482745 | DENV | NS2A | EU569720 |
| DENV | NS2A | EU003591 | DENV | NS2A | EU482593 | DENV | NS2A | AY702037 |
| DENV | NS2A | EU482547 | DENV | NS2A | EU569718 | DENV | NS2A | AY858036 |
| DENV | NS2A | FJ478459 | DENV | NS2A | EU482719 | DENV | NS2A | DQ645544 |
| DENV | NS2A | FJ639837 | DENV | NS2A | EF051521 | DENV | NS2A | FJ639822 |
| DENV | NS2A | FJ390387 | DENV | NS2A | FM210238 | DENV | NS2A | AF100466 |
| DENV | NS2A | DQ645547 | DENV | NS2A | FJ478455 | DENV | NS2A | FJ410215 |
| DENV | NS2A | EU596496 | DENV | NS2A | AF100465 | DENV | NS2A | EU569705 |
| DENV | NS2A | EU482597 | DENV | NS2A | EU529694 | DENV | NS2A | FM210241 |
| DENV | NS2A | EU482463 | DENV | NS2A | EU081178 | DENV | NS2A | FM210221 |
| DENV | NS2A | EU482553 | DENV | NS2A | EU482676 | DENV | NS2A | EU687228 |
| DENV | NS2A | EU482548 | DENV | NS2A | FJ639709 | DENV | NS2A | EU482703 |
| DENV | NS2A | EU482641 | DENV | NS2A | FM210208 | DENV | NS2A | EU529700 |
| DENV | NS2A | FJ639703 | DENV | NS2A | FJ410208 | DENV | NS2A | DQ645555 |
| DENV | NS2A | EU482647 | DENV | NS2A | EU569716 | DENV | NS2A | EU687231 |
| DENV | NS2A | EU596487 | DENV | NS2A | EU482786 | DENV | NS2A | EU660406 |
| DENV | NS2A | FJ639788 | DENV | NS2A | AF276619 | DENV | NS2A | EU687241 |
| DENV | NS2A | FM210206 | DENV | NS2A | EU482625 | DENV | NS2A | FJ639700 |
| DENV | NS2A | DQ645556 | DENV | NS2A | EU687248 | DENV | NS2A | FJ639711 |
| DENV | NS2A | AF169682 | DENV | NS2A | EU482662 | DENV | NS2A | U87412 |
| DENV | NS2A | AY858035 | DENV | NS2A | EU569708 | DENV | NS2A | EU482599 |
| DENV | NS2A | EU687220 | DENV | NS2A | FM210240 | DENV | NS2A | EU482654 |
| DENV | NS2A | EU482636 | DENV | NS2A | EU482777 | DENV | NS2A | EU569721 |
| DENV | NS2A | EU482650 | DENV | NS2A | FJ639705 | DENV | NS2A | FJ390385 |
| DENV | NS2A | EU482704 | DENV | NS2A | EU482669 | DENV | NS2A | EU482589 |
| DENV | NS2A | EU482661 | DENV | NS2A | DQ645553 | DENV | NS2A | EU482551 |
| DENV | NS2A | EU569699 | DENV | NS2A | FM210210 | DENV | NS2A | EU660400 |
| DENV | NS2A | EU482580 | DENV | NS2A | EF457904 | DENV | NS2A | EU482679 |
| DENV | NS2A | FM210215 | DENV | NS2A | FJ410237 | DENV | NS2A | AF204177 |
| DENV | NS2A | FJ639733 | DENV | NS2A | AY702035 | DENV | NS2A | FJ461311 |
| DENV | NS2A | EF105389 | DENV | NS2A | EU482757 | DENV | NS2A | EU569700 |
| DENV | NS2A | EF105384 | DENV | NS2A | EU596499 | DENV | NS2A | EU482737 |
| DENV | NS2A | EU677146 | DENV | NS2A | EU482543 | DENV | NS2A | EU482573 |
| DENV | NS2A | EU596498 | DENV | NS2A | EU687217 | DENV | NS2A | AY702040 |
| DENV | NS2A | FJ410288 | DENV | NS2A | EU482646 | DENV | NS2A | DQ181803 |
| DENV | NS2A | FJ373300 | DENV | NS2A | EU482746 | DENV | NS2A | EU482741 |
| DENV | NS2A | EU482702 | DENV | NS2A | FJ410217 | DENV | NS2A | EU660399 |

FIG. 70-92

| Virus | Protein | Accession No. | Virus | Protein | Accession No. | Virus | Protein | Accession No. |
|---|---|---|---|---|---|---|---|---|
| DENV | NS2A | EU482784 | DENV | NS2A | EU482578 | DENV | NS2A | EU677138 |
| DENV | NS2A | EU482584 | DENV | NS2A | EU482781 | DENV | NS2A | EU621672 |
| DENV | NS2A | EU482670 | DENV | NS2A | EU596485 | DENV | NS2A | AF359579 |
| DENV | NS2A | DQ181801 | DENV | NS2A | EU687224 | DENV | NS2A | EU482645 |
| DENV | NS2A | EU482603 | DENV | NS2A | FJ461321 | DENV | NS2A | EU482760 |
| DENV | NS2A | EU482769 | DENV | NS2A | FJ390390 | DENV | NS2A | FJ639732 |
| DENV | NS2A | FM210227 | DENV | NS2A | EU482562 | DENV | NS2A | FM210229 |
| DENV | NS2A | AY744147 | DENV | NS2A | EF105390 | DENV | NS2A | EU482684 |
| DENV | NS2A | EU482656 | DENV | NS2A | EU482782 | DENV | NS2A | EF105378 |
| DENV | NS2A | EU529706 | DENV | NS2A | EU482682 | DENV | NS2A | EU482681 |
| DENV | NS2A | EU687212 | DENV | NS2A | EU056810 | DENV | NS2A | FJ547090 |
| DENV | NS2A | DQ645541 | DENV | NS2A | EU687236 | DENV | NS2A | EU482447 |
| DENV | NS2A | DQ181800 | DENV | NS2A | EU482448 | DENV | NS2A | EU482624 |
| DENV | NS2A | EU482721 | DENV | NS2A | FJ639698 | DENV | NS2A | AF119661 |
| DENV | NS2A | EU677145 | DENV | NS2A | EU482630 | DENV | NS2A | EU660413 |
| DENV | NS2A | EU482450 | DENV | NS2A | EU359009 | DENV | NS2A | AF169685 |
| DENV | NS2A | EU482541 | DENV | NS2A | EU482768 | DENV | NS2A | EU482771 |
| DENV | NS2A | AF169688 | DENV | NS2A | EU482672 | DENV | NS2A | EU482604 |
| DENV | NS2A | M19197 | DENV | NS2A | EU569711 | DENV | NS2A | FJ410223 |
| DENV | NS2A | EU482594 | DENV | NS2A | EU482627 | DENV | NS2A | EU482739 |
| DENV | NS2A | DQ645554 | DENV | NS2A | EU569715 | DENV | NS2A | EU687243 |
| DENV | NS2A | DQ181798 | DENV | NS2A | EU482678 | DENV | NS2A | EU482720 |
| DENV | NS2A | AY702038 | DENV | NS2A | DQ181799 | DENV | NS2A | EU482730 |
| DENV | NS2A | EU596495 | DENV | NS2A | EU687235 | DENV | NS2A | EU482779 |
| DENV | NS2A | FM210245 | DENV | NS2A | EU687238 | DENV | NS2A | AB122020 |
| DENV | NS2A | FM210214 | DENV | NS2A | M84727 | DENV | NS2A | FM210244 |
| DENV | NS2A | EU482685 | DENV | NS2A | EU482763 | DENV | NS2A | AF100469 |
| DENV | NS2A | EU482570 | DENV | NS2A | EU482758 | DENV | NS2A | FJ410221 |
| DENV | NS2A | DQ645540 | DENV | NS2A | FJ639830 | DENV | NS2A | EU482626 |
| DENV | NS2A | EU660414 | DENV | NS2A | EU482754 | DENV | NS2A | EU482788 |
| DENV | NS2A | FJ024477 | DENV | NS2A | FM210218 | DENV | NS2A | FJ410219 |
| DENV | NS2A | AF100463 | DENV | NS2A | FJ410224 | DENV | NS2A | AF100462 |
| DENV | NS2A | DQ645546 | DENV | NS2A | FJ410193 | DENV | NS2A | EU482696 |
| DENV | NS2A | EU569703 | DENV | NS2A | EU056811 | DENV | NS2A | EU482544 |
| DENV | NS2A | EU482652 | DENV | NS2A | EU482774 | DENV | NS2A | EU482640 |
| DENV | NS2A | EU596490 | DENV | NS2A | EU482568 | DENV | NS2A | FJ182012 |
| DENV | NS2A | EU482693 | DENV | NS2A | EU482588 | DENV | NS2A | DQ645548 |
| DENV | NS2A | EU482734 | DENV | NS2A | EU482475 | DENV | NS2A | FJ639701 |
| DENV | NS2A | FM210202 | DENV | NS2A | AF489932 | DENV | NS2A | EU482655 |
| DENV | NS2A | EU482729 | DENV | NS2A | FM210211 | DENV | NS2A | AB189122 |
| DENV | NS2A | AF169680 | DENV | NS2A | EU687246 | DENV | NS2A | DQ181804 |
| DENV | NS2A | EU482623 | DENV | NS2A | FJ390389 | DENV | NS2A | EU482732 |
| DENV | NS2A | EU569693 | DENV | NS2A | EU482464 | DENV | NS2A | DQ645543 |
| DENV | NS2A | EU482590 | DENV | NS2A | EU482697 | DENV | NS2A | FJ639832 |
| DENV | NS2A | FJ639834 | DENV | NS2A | EU482765 | DENV | NS2A | FJ226066 |
| DENV | NS2A | EU482449 | DENV | NS2A | FM210209 | DENV | NS2A | AF169687 |
| DENV | NS2A | EU687237 | DENV | NS2A | EU482474 | DENV | NS2A | EU482752 |
| DENV | NS2A | EF105381 | DENV | NS2A | EU596484 | DENV | NS2A | EU482783 |

FIG. 70-93

| Virus | Protein | Accession No. | Virus | Protein | Accession No. | Virus | Protein | Accession No. |
|---|---|---|---|---|---|---|---|---|
| DENV | NS2A | EU482742 | DENV | NS2A | FJ410200 | DENV | NS2A | AY776328 |
| DENV | NS2A | FJ461314 | DENV | NS2A | DQ645552 | DENV | NS2A | EU482675 |
| DENV | NS2A | EU482688 | DENV | NS2A | EU482574 | DENV | NS2A | EU660417 |
| DENV | NS2A | DQ181802 | DENV | NS2A | EU482622 | DENV | NS2A | EU482727 |
| DENV | NS2A | FJ639809 | DENV | NS2A | EU482561 | DENV | NS2A | EU482602 |
| DENV | NS2A | EU482701 | DENV | NS2A | EU596486 | DENV | NS2A | EU482577 |
| DENV | NS2A | AF204178 | DENV | NS2A | EU569695 | DENV | NS2A | EU482756 |
| DENV | NS2A | FJ639706 | DENV | NS2A | FJ024461 | DENV | NS2A | EU529701 |
| DENV | NS2A | EU482550 | DENV | NS2A | EU569713 | DENV | NS2A | FJ639702 |
| DENV | NS2A | EU482605 | DENV | NS2A | FM210224 | DENV | NS2A | EU482772 |
| DENV | NS2A | EU482554 | DENV | NS2A | EU482556 | DENV | NS2A | FM210246 |
| DENV | NS2A | EU482692 | DENV | NS2A | EU482731 | DENV | NS2A | FJ390391 |
| DENV | NS2A | EU482680 | DENV | NS2A | EU179858 | DENV | NS2A | AF100464 |
| DENV | NS2A | AF169683 | DENV | NS2A | EU781135 | DENV | NS2A | FJ547067 |
| DENV | NS2A | FJ024458 | DENV | NS2A | EU482743 | DENV | NS2A | EF105386 |
| DENV | NS2A | EU482780 | DENV | NS2A | EU482751 | DENV | NS2A | EF105387 |
| DENV | NS2A | EU482750 | DENV | NS2A | FJ410259 | DENV | NS2A | EU726775 |
| DENV | NS2A | EU179857 | DENV | NS2A | EU482747 | DENV | NS2A | FJ639704 |
| DENV | NS2A | EU569698 | DENV | NS2A | EU687225 | DENV | NS2A | AF169678 |
| DENV | NS2A | EU482571 | DENV | NS2A | FJ639718 | DENV | NS2A | EU482749 |
| DENV | NS2A | EU081179 | DENV | NS2A | EU569707 | DENV | NS2A | EU482631 |
| DENV | NS2A | EU482690 | DENV | NS2A | EU677147 | DENV | NS2A | EF105388 |
| DENV | NS2A | EU687215 | DENV | NS2A | FM210223 | DENV | NS2A | AB189123 |
| DENV | NS2A | EU482664 | DENV | NS2A | EU081180 | DENV | NS2A | EU482663 |
| DENV | NS2A | DQ181797 | DENV | NS2A | EU482728 | DENV | NS2A | EU677149 |
| DENV | NS2A | EU569701 | DENV | NS2A | EU596500 | DENV | NS2A | EU569719 |
| DENV | NS2A | EU482773 | DENV | NS2A | EU482671 | DENV | NS2A | EU482778 |
| DENV | NS2A | EU482722 | DENV | NS2A | EU179859 | DENV | NS2A | DQ645551 |
| DENV | NS2A | EU482635 | DENV | NS2A | EU482705 | DENV | NS2A | EU482689 |
| DENV | NS2A | DQ645549 | DENV | NS2A | EU482552 | DENV | NS2A | EU726770 |
| DENV | NS2A | EU482629 | DENV | NS2A | EU482546 | DENV | NS2A | AB122022 |
| DENV | NS2A | EU596488 | DENV | NS2A | EU482642 | DENV | NS2A | FJ639697 |
| DENV | NS2A | FJ639836 | DENV | NS2A | EU482579 | DENV | NS2A | EU482628 |
| DENV | NS2A | EU482733 | DENV | NS2A | M20558 | DENV | NS2A | EU687232 |
| DENV | NS2A | EU677143 | DENV | NS2A | EU482775 | DENV | NS2A | FM210225 |
| DENV | NS2A | EU482653 | DENV | NS2A | EU596491 | DENV | NS2A | AY037116 |
| DENV | NS2A | AF208496 | DENV | NS2A | FJ639708 | DENV | NS2A | FJ205878 |
| DENV | NS2A | EU482565 | DENV | NS2A | FM210220 | DENV | NS2A | AY702034 |
| DENV | NS2A | EU482598 | DENV | NS2A | EU569717 | DENV | NS2A | FM210232 |
| DENV | NS2A | M29095 | DENV | NS2A | EF105379 | DENV | NS2A | AY702039 |
| DENV | NS2A | EU660415 | DENV | NS2A | EU569712 | DENV | NS2A | EU687245 |
| DENV | NS2A | FM210239 | DENV | NS2A | EU482755 | DENV | NS2A | EU482465 |
| DENV | NS2A | EU687213 | DENV | NS2A | DQ181805 | DENV | NS2A | EU482472 |
| DENV | NS2A | EU677144 | DENV | NS2A | FM210207 | DENV | NS2A | EU569714 |
| DENV | NS2A | FM210243 | DENV | NS2A | FM210233 | DENV | NS2A | EU569692 |
| DENV | NS2A | AF100459 | DENV | NS2A | EU687199 | DENV | NS2A | FJ410233 |
| DENV | NS2A | EU482466 | DENV | NS2A | EU482686 | DENV | NS2A | AF100467 |
| DENV | NS2A | FM210230 | DENV | NS2A | FJ205880 | DENV | NS2A | EU677148 |

FIG. 70-94

| Virus | Protein | Accession No. | Virus | Protein | Accession No. | Virus | Protein | Accession No. |
|---|---|---|---|---|---|---|---|---|
| DENV | NS2A | EF105380 | DENV | NS2A | EU687250 | DENV | NS2A | GQ199874 |
| DENV | NS2A | EU482677 | DENV | NS2A | EU482735 | DENV | NS2A | FJ744745 |
| DENV | NS2A | AF100468 | DENV | NS2A | EU482785 | DENV | NS2A | FJ898467 |
| DENV | NS2A | EU482569 | DENV | NS2A | EU596483 | DENV | NS2A | FJ687444 |
| DENV | NS2A | DQ645542 | DENV | NS2A | EU569702 | DENV | NS2A | FJ810411 |
| DENV | NS2A | EU482643 | DENV | NS2A | FJ410241 | DENV | NS2A | FJ850067 |
| DENV | NS2A | EU482694 | DENV | NS2A | EU482659 | DENV | NS2A | FJ850121 |
| DENV | NS2A | EU482724 | DENV | NS2A | FM210203 | DENV | NS2A | FJ898452 |
| DENV | NS2A | EU482446 | DENV | NS2A | EU482581 | DENV | NS2A | FJ744713 |
| DENV | NS2A | FM210226 | DENV | NS2A | EU569696 | DENV | NS2A | FJ810418 |
| DENV | NS2A | EU482744 | DENV | NS2A | FJ562098 | DENV | NS2A | FJ906962 |
| DENV | NS2A | EU677137 | DENV | NS2A | FM210222 | DENV | NS2A | FJ744721 |
| DENV | NS2A | EU482770 | DENV | NS2A | EU482473 | DENV | NS2A | FJ850107 |
| DENV | NS2A | AF038403 | DENV | NS2A | EU854294 | DENV | NS2A | FJ467493 |
| DENV | NS2A | EU660398 | DENV | NS2A | EU482649 | DENV | NS2A | FJ906966 |
| DENV | NS2A | EU569709 | DENV | NS2A | EU726767 | DENV | NS2A | FJ687446 |
| DENV | NS2A | FM210237 | DENV | NS2A | FJ024454 | DENV | NS2A | FJ906958 |
| DENV | NS2A | EU660416 | DENV | NS2A | FJ639699 | DENV | NS2A | FJ687435 |
| DENV | NS2A | EU677142 | DENV | NS2A | FM210204 | DENV | NS2A | FJ850054 |
| DENV | NS2A | EU482700 | DENV | NS2A | EU529695 | DENV | NS2A | FJ906967 |
| DENV | NS2A | EU482545 | DENV | NS2A | EU687222 | DENV | NS2A | FJ850072 |
| DENV | NS2A | EU482585 | DENV | NS2A | EF105382 | DENV | NS2A | FJ898439 |
| DENV | NS2A | FJ024475 | DENV | NS2A | EU482738 | DENV | NS2A | FJ850088 |
| DENV | NS2A | EU482725 | DENV | NS2A | EF105385 | DENV | NS2A | FJ898435 |
| DENV | NS2A | EU482687 | DENV | NS2A | FM210219 | DENV | NS2A | GQ252676 |
| DENV | NS2A | EU529693 | DENV | NS2A | EU482723 | DENV | NS2A | FJ850065 |
| DENV | NS2A | FJ390384 | DENV | NS2A | FJ639829 | DENV | NS2A | FJ898477 |
| DENV | NS2A | EU482560 | DENV | NS2A | EU482575 | DENV | NS2A | FJ850116 |
| DENV | NS2A | EU482761 | DENV | NS2A | AF038402 | DENV | NS2A | FJ898454 |
| DENV | NS2A | EU482638 | DENV | NS2A | FJ639783 | DENV | NS2A | GQ199897 |
| DENV | NS2A | EU482698 | DENV | NS2A | EU482572 | DENV | NS2A | GQ199899 |
| DENV | NS2A | EU482764 | DENV | NS2A | FJ639734 | DENV | NS2A | FJ744723 |
| DENV | NS2A | FJ182014 | DENV | NS2A | EU482762 | DENV | NS2A | GQ199900 |
| DENV | NS2A | EU482776 | DENV | NS2A | EU569704 | DENV | NS2A | FJ850082 |
| DENV | NS2A | DQ645550 | DENV | NS2A | EU482759 | DENV | NS2A | FJ744715 |
| DENV | NS2A | FJ024473 | DENV | NS2A | EU056812 | DENV | NS2A | FJ744709 |
| DENV | NS2A | DQ181806 | DENV | NS2A | FJ410228 | DENV | NS2A | GQ199868 |
| DENV | NS2A | FJ461305 | DENV | NS2A | EU482467 | DENV | NS2A | FJ906960 |
| DENV | NS2A | FJ024452 | DENV | NS2A | FM210217 | DENV | NS2A | FJ882602 |
| DENV | NS2A | EU677141 | DENV | NS2A | FM210212 | DENV | NS2A | GQ199895 |
| DENV | NS2A | FJ639828 | DENV | NS2A | EU660405 | DENV | NS2A | FJ687436 |
| DENV | NS2A | EU569706 | DENV | NS2A | FJ547064 | DENV | NS2A | FJ744725 |
| DENV | NS2A | EU482666 | DENV | NS2A | EU482740 | DENV | NS2A | FJ850117 |
| DENV | NS2A | EU482673 | DENV | NS2A | EU482451 | DENV | NS2A | FJ687441 |
| DENV | NS2A | FJ024474 | DENV | NS2A | EU482668 | DENV | NS2A | FJ744706 |
| DENV | NS2A | EU687214 | DENV | NS2A | EU687229 | DENV | NS2A | FJ850074 |
| DENV | NS2A | FJ410291 | DENV | NS2A | AF169684 | DENV | NS2A | FJ850085 |
| DENV | NS2A | FM210242 | DENV | NS2A | FM210235 | DENV | NS2A | FJ850061 |

FIG. 70-95

| Virus | Protein | Accession No. | Virus | Protein | Accession No. | Virus | Protein | Accession No. |
|---|---|---|---|---|---|---|---|---|
| DENV | NS2A | FJ810409 | DENV | NS2A | FJ906961 | DENV | NS2A | AF022438 |
| DENV | NS2A | FJ687434 | DENV | NS2A | FJ882593 | DENV | NS2A | AF022440 |
| DENV | NS2A | GQ199890 | DENV | NS2A | FJ898479 | DENV | NS2A | CS479165 |
| DENV | NS2A | FJ744743 | DENV | NS2A | FJ744703 | DENV | NS2A | GQ868556 |
| DENV | NS2A | FJ850063 | DENV | NS2A | FJ744712 | DENV | NS2A | AB479041 |
| DENV | NS2A | FJ898466 | DENV | NS2A | FJ882594 | DENV | NS2A | GU289914 |
| DENV | NS2A | FJ850119 | DENV | NS2A | FJ744716 | DENV | NS2A | GU131884 |
| DENV | NS2A | FJ898432 | DENV | NS2A | FJ850066 | DENV | NS2A | GQ868600 |
| DENV | NS2A | FJ744718 | DENV | NS2A | FJ744744 | DENV | NS2A | FN429895 |
| DENV | NS2A | FJ810412 | DENV | NS2A | FJ850108 | DENV | NS2A | GU131879 |
| DENV | NS2A | FJ906956 | DENV | NS2A | FJ859028 | DENV | NS2A | GQ868596 |
| DENV | NS2A | FJ850064 | DENV | NS2A | FJ898465 | DENV | NS2A | GQ868516 |
| DENV | NS2A | GQ199892 | DENV | NS2A | FJ898451 | DENV | NS2A | GU131864 |
| DENV | NS2A | FJ898436 | DENV | NS2A | FJ898449 | DENV | NS2A | FN429893 |
| DENV | NS2A | FJ906957 | DENV | NS2A | FJ744705 | DENV | NS2A | GQ868598 |
| DENV | NS2A | FJ898478 | DENV | NS2A | FJ898434 | DENV | NS2A | GQ868544 |
| DENV | NS2A | FJ873811 | DENV | NS2A | FJ906969 | DENV | NS2A | GQ868589 |
| DENV | NS2A | GQ199898 | DENV | NS2A | FJ744741 | DENV | NS2A | GQ868551 |
| DENV | NS2A | FJ850115 | DENV | NS2A | FJ906959 | DENV | NS2A | GU131902 |
| DENV | NS2A | FJ687442 | DENV | NS2A | FJ850106 | DENV | NS2A | GU131896 |
| DENV | NS2A | FJ687439 | DENV | NS2A | FJ744742 | DENV | NS2A | GU131924 |
| DENV | NS2A | FJ432724 | DENV | NS2A | FJ687437 | DENV | NS2A | GQ868640 |
| DENV | NS2A | FJ687447 | DENV | NS2A | FJ744707 | DENV | NS2A | GU131880 |
| DENV | NS2A | FJ873808 | DENV | NS2A | FJ687438 | DENV | NS2A | GU131882 |
| DENV | NS2A | DQ448231 | DENV | NS2A | FJ744714 | DENV | NS2A | GQ868638 |
| DENV | NS2A | FJ744710 | DENV | NS2A | GQ199866 | DENV | NS2A | GQ868553 |
| DENV | NS2A | GQ252677 | DENV | NS2A | GQ199894 | DENV | NS2A | GQ868646 |
| DENV | NS2A | NC_001474 | DENV | NS2A | FJ687440 | DENV | NS2A | FN429891 |
| DENV | NS2A | FJ687445 | DENV | NS2A | FJ850112 | DENV | NS2A | GQ868604 |
| DENV | NS2A | FJ850091 | DENV | NS2A | FJ850078 | DENV | NS2A | GU131947 |
| DENV | NS2A | FJ687443 | DENV | NS2A | FJ744717 | DENV | NS2A | GU131928 |
| DENV | NS2A | GQ199869 | DENV | NS2A | FJ906968 | DENV | NS2A | GQ868497 |
| DENV | NS2A | FJ850105 | DENV | NS2A | GQ199893 | DENV | NS2A | GQ868603 |
| DENV | NS2A | FJ850051 | DENV | NS2A | FJ744711 | DENV | NS2A | GQ868621 |
| DENV | NS2A | FJ850050 | DENV | NS2A | FJ744704 | DENV | NS2A | AB479042 |
| DENV | NS2A | FJ744719 | DENV | NS2A | FJ744720 | DENV | NS2A | GQ868620 |
| DENV | NS2A | FJ898453 | DENV | NS2A | GQ199901 | DENV | NS2A | GQ868590 |
| DENV | NS2A | FJ898460 | DENV | NS2A | FJ744724 | DENV | NS2A | FN429892 |
| DENV | NS2A | FJ898438 | DENV | NS2A | FJ850120 | DENV | NS2A | GQ868554 |
| DENV | NS2A | FJ850053 | DENV | NS2A | FJ850118 | DENV | NS2A | GU131974 |
| DENV | NS2A | FJ898450 | DENV | NS2A | FJ850076 | DENV | NS2A | GU131843 |
| DENV | NS2A | FJ744708 | DENV | NS2A | AF022436 | DENV | NS2A | GQ868641 |
| DENV | NS2A | GQ199896 | DENV | NS2A | AF022439 | DENV | NS2A | GQ868542 |
| DENV | NS2A | FJ744722 | DENV | NS2A | AF022441 | DENV | NS2A | GQ868555 |
| DENV | NS2A | FJ850062 | DENV | NS2A | AF022437 | DENV | NS2A | FN429894 |
| DENV | NS2A | FJ898461 | DENV | NS2A | AJ487271 | DENV | NS2A | GQ868549 |
| DENV | NS2A | FJ810410 | DENV | NS2A | AF022435 | DENV | NS2A | GQ868588 |
| DENV | NS2A | FJ850060 | DENV | NS2A | AF022434 | DENV | NS2A | GQ868541 |

FIG. 70-96

| Virus | Protein | Accession No. | Virus | Protein | Accession No. | Virus | Protein | Accession No. |
|---|---|---|---|---|---|---|---|---|
| DENV | NS2A | GQ868558 | DENV | NS2A | AY243469 | DENV | NS2B | FJ176780 |
| DENV | NS2A | GQ868625 | DENV | NS2A | AY744148 | DENV | NS2B | FJ461340 |
| DENV | NS2A | GQ868624 | DENV | NS2A | AY744149 | DENV | NS2B | AY732475 |
| DENV | NS2A | GQ868631 | DENV | NS2A | AY744150 | DENV | NS2B | AY732474 |
| DENV | NS2A | GU131899 | DENV | NS2A | AJ968413 | DENV | NS2B | FJ024435 |
| DENV | NS2A | GQ868515 | DENV | NS2A | GU369819 | DENV | NS2B | FJ639669 |
| DENV | NS2A | GU131898 | DENV | NS2A | GU370050 | DENV | NS2B | EU482540 |
| DENV | NS2A | GQ868623 | DENV | NS2A | GU370051 | DENV | NS2B | FJ024429 |
| DENV | NS2A | GU131886 | DENV | NS2B | AY277665 | DENV | NS2B | EU677167 |
| DENV | NS2A | GQ868622 | DENV | NS2B | AY713474 | DENV | NS2B | EU482512 |
| DENV | NS2A | GQ868595 | DENV | NS2B | AF311957 | DENV | NS2B | FJ390381 |
| DENV | NS2A | GQ868557 | DENV | NS2B | FJ205881 | DENV | NS2B | FJ410226 |
| DENV | NS2A | GU131959 | DENV | NS2B | EU482817 | DENV | NS2B | FJ410191 |
| DENV | NS2A | GU131955 | DENV | NS2B | DQ672557 | DENV | NS2B | AJ968413 |
| DENV | NS2A | GQ868597 | DENV | NS2B | EU677151 | DENV | NS2B | FJ639689 |
| DENV | NS2A | GU131883 | DENV | NS2B | FJ410256 | DENV | NS2B | AY277664 |
| DENV | NS2A | GQ868591 | DENV | NS2B | FJ432735 | DENV | NS2B | FJ639811 |
| DENV | NS2A | GQ868543 | DENV | NS2B | EU660390 | DENV | NS2B | FJ639695 |
| DENV | NS2A | GU131901 | DENV | NS2B | EU482824 | DENV | NS2B | EU081226 |
| DENV | NS2A | GQ868545 | DENV | NS2B | FJ410222 | DENV | NS2B | FJ410280 |
| DENV | NS2A | GU131931 | DENV | NS2B | AY726551 | DENV | NS2B | EU596504 |
| DENV | NS2A | GU131885 | DENV | NS2B | EU482716 | DENV | NS2B | FJ639685 |
| DENV | NS2A | GU131932 | DENV | NS2B | AF226685 | DENV | NS2B | EU482715 |
| DENV | NS2A | GU131881 | DENV | NS2B | EU677174 | DENV | NS2B | FJ410227 |
| DENV | NS2A | GU131897 | DENV | NS2B | FJ639693 | DENV | NS2B | DQ285560 |
| DENV | NS2A | GQ868592 | DENV | NS2B | FJ461317 | DENV | NS2B | FJ182002 |
| DENV | NS2A | GQ868552 | DENV | NS2B | FJ384655 | DENV | NS2B | EU677177 |
| DENV | NS2A | GU131900 | DENV | NS2B | EU482508 | DENV | NS2B | FJ639680 |
| DENV | NS2A | GQ868599 | DENV | NS2B | AF311958 | DENV | NS2B | EU677160 |
| DENV | NS2A | GU131929 | DENV | NS2B | FJ024451 | DENV | NS2B | AY835999 |
| DENV | NS2A | GU131930 | DENV | NS2B | EU482528 | DENV | NS2B | EU249494 |
| DENV | NS2A | GQ868550 | DENV | NS2B | EU482821 | DENV | NS2B | AF226687 |
| DENV | NS2A | GU131975 | DENV | NS2B | FJ410267 | DENV | NS2B | FJ024432 |
| DENV | NS2A | GU131927 | DENV | NS2B | AB074761 | DENV | NS2B | EU081229 |
| DENV | NS2A | GQ868540 | DENV | NS2B | AY762084 | DENV | NS2B | FJ410184 |
| DENV | NS2A | FJ410202 | DENV | NS2B | AY732480 | DENV | NS2B | FJ182022 |
| DENV | NS2A | CS479202 | DENV | NS2B | EU482481 | DENV | NS2B | EU677153 |
| DENV | NS2A | U87411 | DENV | NS2B | FJ410232 | DENV | NS2B | DQ672559 |
| DENV | NS2A | CS479203 | DENV | NS2B | EU081254 | DENV | NS2B | EU081234 |
| DENV | NS2A | CS479204 | DENV | NS2B | EU482806 | DENV | NS2B | FJ639802 |
| DENV | NS2A | CS479167 | DENV | NS2B | FJ410257 | DENV | NS2B | EU482483 |
| DENV | NS2A | CS479205 | DENV | NS2B | FJ432720 | DENV | NS2B | FJ024445 |
| DENV | NS2A | CS479206 | DENV | NS2B | FJ547089 | DENV | NS2B | FJ410236 |
| DENV | NS2A | CS805344 | DENV | NS2B | EU482819 | DENV | NS2B | FJ410242 |
| DENV | NS2A | FB730117 | DENV | NS2B | EU081270 | DENV | NS2B | FJ390378 |
| DENV | NS2A | DL138662 | DENV | NS2B | FJ205875 | DENV | NS2B | EU081236 |
| DENV | NS2A | GM059692 | DENV | NS2B | FJ410210 | DENV | NS2B | EU081278 |
| DENV | NS2A | AY243468 | DENV | NS2B | FJ205884 | DENV | NS2B | FJ432736 |

FIG. 70-97

| Virus | Protein | Accession No. | Virus | Protein | Accession No. | Virus | Protein | Accession No. |
|---|---|---|---|---|---|---|---|---|
| DENV | NS2B | FJ639694 | DENV | NS2B | EU482592 | DENV | NS2B | EU482532 |
| DENV | NS2B | EU482500 | DENV | NS2B | FJ182030 | DENV | NS2B | FJ182031 |
| DENV | NS2B | DQ672560 | DENV | NS2B | FJ024431 | DENV | NS2B | FJ024428 |
| DENV | NS2B | AY713473 | DENV | NS2B | FJ024450 | DENV | NS2B | FJ432749 |
| DENV | NS2B | EU726780 | DENV | NS2B | FJ410252 | DENV | NS2B | DQ285561 |
| DENV | NS2B | FJ410255 | DENV | NS2B | FJ478457 | DENV | NS2B | EU482518 |
| DENV | NS2B | FJ373298 | DENV | NS2B | EU596502 | DENV | NS2B | EU726779 |
| DENV | NS2B | EU081276 | DENV | NS2B | FJ410201 | DENV | NS2B | EU677161 |
| DENV | NS2B | FJ410198 | DENV | NS2B | FJ562105 | DENV | NS2B | AY145123 |
| DENV | NS2B | EU482536 | DENV | NS2B | FJ639684 | DENV | NS2B | EU482800 |
| DENV | NS2B | FJ390382 | DENV | NS2B | FJ639682 | DENV | NS2B | AY732482 |
| DENV | NS2B | FJ024462 | DENV | NS2B | FJ410240 | DENV | NS2B | EU482517 |
| DENV | NS2B | EU482822 | DENV | NS2B | EU081279 | DENV | NS2B | EU482488 |
| DENV | NS2B | FJ024447 | DENV | NS2B | EU081231 | DENV | NS2B | FJ373305 |
| DENV | NS2B | FJ410274 | DENV | NS2B | FJ410214 | DENV | NS2B | FJ432746 |
| DENV | NS2B | FJ410216 | DENV | NS2B | FJ182036 | DENV | NS2B | FJ432734 |
| DENV | NS2B | EU482527 | DENV | NS2B | FJ182023 | DENV | NS2B | EU482797 |
| DENV | NS2B | EU280167 | DENV | NS2B | EU482479 | DENV | NS2B | EU482711 |
| DENV | NS2B | EU482567 | DENV | NS2B | FJ547087 | DENV | NS2B | FJ024459 |
| DENV | NS2B | EU081265 | DENV | NS2B | FJ639683 | DENV | NS2B | FJ410174 |
| DENV | NS2B | EU482489 | DENV | NS2B | FJ024442 | DENV | NS2B | EU596503 |
| DENV | NS2B | AB178040 | DENV | NS2B | FJ410285 | DENV | NS2B | FJ432730 |
| DENV | NS2B | EU482827 | DENV | NS2B | EU482615 | DENV | NS2B | EU081227 |
| DENV | NS2B | FJ024455 | DENV | NS2B | AY732476 | DENV | NS2B | EU677163 |
| DENV | NS2B | EU081238 | DENV | NS2B | FJ024463 | DENV | NS2B | AY277666 |
| DENV | NS2B | FJ410245 | DENV | NS2B | FJ410275 | DENV | NS2B | FJ024483 |
| DENV | NS2B | FJ461318 | DENV | NS2B | FJ410234 | DENV | NS2B | DQ193572 |
| DENV | NS2B | FJ410263 | DENV | NS2B | EU482487 | DENV | NS2B | EF122231 |
| DENV | NS2B | FJ410269 | DENV | NS2B | FJ410182 | DENV | NS2B | EU081266 |
| DENV | NS2B | FJ410289 | DENV | NS2B | EU482812 | DENV | NS2B | EU482818 |
| DENV | NS2B | FJ639692 | DENV | NS2B | EU081247 | DENV | NS2B | FJ410186 |
| DENV | NS2B | EU660397 | DENV | NS2B | AB074760 | DENV | NS2B | EU249493 |
| DENV | NS2B | EU482477 | DENV | NS2B | EU482802 | DENV | NS2B | FJ024478 |
| DENV | NS2B | FJ024434 | DENV | NS2B | EU677172 | DENV | NS2B | FJ205874 |
| DENV | NS2B | FJ410204 | DENV | NS2B | EU482496 | DENV | NS2B | EU482791 |
| DENV | NS2B | EU249495 | DENV | NS2B | EU726777 | DENV | NS2B | EU482798 |
| DENV | NS2B | AF513110 | DENV | NS2B | U88535 | DENV | NS2B | EU081248 |
| DENV | NS2B | FJ024438 | DENV | NS2B | EU482519 | DENV | NS2B | EU596501 |
| DENV | NS2B | EU081264 | DENV | NS2B | FJ461339 | DENV | NS2B | FJ461336 |
| DENV | NS2B | EU482525 | DENV | NS2B | FJ562101 | DENV | NS2B | FJ024457 |
| DENV | NS2B | EU687251 | DENV | NS2B | FJ461316 | DENV | NS2B | EU482485 |
| DENV | NS2B | EU482486 | DENV | NS2B | EU482814 | DENV | NS2B | FJ176779 |
| DENV | NS2B | DQ285558 | DENV | NS2B | AY726555 | DENV | NS2B | EU482799 |
| DENV | NS2B | FJ205883 | DENV | NS2B | FJ639677 | DENV | NS2B | EU081233 |
| DENV | NS2B | AY145121 | DENV | NS2B | EU482506 | DENV | NS2B | EU482497 |
| DENV | NS2B | AY732478 | DENV | NS2B | FJ410283 | DENV | NS2B | EU482616 |
| DENV | NS2B | FJ410199 | DENV | NS2B | FJ639696 | DENV | NS2B | EU482507 |
| DENV | NS2B | FJ390383 | DENV | NS2B | FJ410235 | DENV | NS2B | EU482809 |

FIG. 70-98

| Virus | Protein | Accession No. | Virus | Protein | Accession No. | Virus | Protein | Accession No. |
|---|---|---|---|---|---|---|---|---|
| DENV | NS2B | FJ410262 | DENV | NS2B | EU081243 | DENV | NS2B | EU081273 |
| DENV | NS2B | FJ024480 | DENV | NS2B | FJ639818 | DENV | NS2B | EU482820 |
| DENV | NS2B | EU482495 | DENV | NS2B | EU081237 | DENV | NS2B | AF514878 |
| DENV | NS2B | FJ182032 | DENV | NS2B | AF514876 | DENV | NS2B | EU660394 |
| DENV | NS2B | FJ410197 | DENV | NS2B | FJ639688 | DENV | NS2B | FJ410218 |
| DENV | NS2B | AF514883 | DENV | NS2B | EU482713 | DENV | NS2B | EU081241 |
| DENV | NS2B | FJ461330 | DENV | NS2B | EU677154 | DENV | NS2B | FJ410244 |
| DENV | NS2B | FJ639690 | DENV | NS2B | EU081242 | DENV | NS2B | EU482789 |
| DENV | NS2B | FJ410209 | DENV | NS2B | EU687247 | DENV | NS2B | EU482524 |
| DENV | NS2B | EU482514 | DENV | NS2B | AY726552 | DENV | NS2B | EU081261 |
| DENV | NS2B | EU848545 | DENV | NS2B | FJ024436 | DENV | NS2B | FJ639812 |
| DENV | NS2B | EU249492 | DENV | NS2B | FJ639681 | DENV | NS2B | EU482533 |
| DENV | NS2B | EU081240 | DENV | NS2B | EU482484 | DENV | NS2B | DQ285559 |
| DENV | NS2B | EU482499 | DENV | NS2B | EU482815 | DENV | NS2B | FJ410246 |
| DENV | NS2B | FJ410281 | DENV | NS2B | EU249490 | DENV | NS2B | FJ461310 |
| DENV | NS2B | FJ410270 | DENV | NS2B | EU081253 | DENV | NS2B | AB195673 |
| DENV | NS2B | EU482808 | DENV | NS2B | AY726549 | DENV | NS2B | FJ182024 |
| DENV | NS2B | EU081281 | DENV | NS2B | EU677166 | DENV | NS2B | AB204803 |
| DENV | NS2B | AF309641 | DENV | NS2B | FJ639821 | DENV | NS2B | EF025110 |
| DENV | NS2B | EU677159 | DENV | NS2B | FJ024430 | DENV | NS2B | DQ672564 |
| DENV | NS2B | EU482526 | DENV | NS2B | FJ410183 | DENV | NS2B | EU726778 |
| DENV | NS2B | FJ024427 | DENV | NS2B | EU081267 | DENV | NS2B | EF457905 |
| DENV | NS2B | EU482618 | DENV | NS2B | EU482491 | DENV | NS2B | FJ547088 |
| DENV | NS2B | AF350498 | DENV | NS2B | EU081249 | DENV | NS2B | FJ024437 |
| DENV | NS2B | EU677169 | DENV | NS2B | EU081252 | DENV | NS2B | EU482513 |
| DENV | NS2B | EU482828 | DENV | NS2B | EU482706 | DENV | NS2B | FJ410196 |
| DENV | NS2B | EU482537 | DENV | NS2B | AY726553 | DENV | NS2B | FJ410250 |
| DENV | NS2B | EU726782 | DENV | NS2B | FJ205882 | DENV | NS2B | EU660392 |
| DENV | NS2B | FJ410225 | DENV | NS2B | FJ390386 | DENV | NS2B | FJ461313 |
| DENV | NS2B | FJ410180 | DENV | NS2B | EU677139 | DENV | NS2B | EU677168 |
| DENV | NS2B | FJ024460 | DENV | NS2B | FJ410260 | DENV | NS2B | FJ432723 |
| DENV | NS2B | FJ410231 | DENV | NS2B | EU677170 | DENV | NS2B | FJ410181 |
| DENV | NS2B | FJ390380 | DENV | NS2B | EU081256 | DENV | NS2B | FJ410239 |
| DENV | NS2B | FJ410238 | DENV | NS2B | FJ024443 | DENV | NS2B | EU482480 |
| DENV | NS2B | FJ390379 | DENV | NS2B | FJ410278 | DENV | NS2B | AY206457 |
| DENV | NS2B | AF311956 | DENV | NS2B | FJ432744 | DENV | NS2B | EU482523 |
| DENV | NS2B | EU081257 | DENV | NS2B | AB189120 | DENV | NS2B | FJ410290 |
| DENV | NS2B | FJ432721 | DENV | NS2B | FJ461327 | DENV | NS2B | DQ672562 |
| DENV | NS2B | FJ639672 | DENV | NS2B | EU660391 | DENV | NS2B | EU482521 |
| DENV | NS2B | FJ639794 | DENV | NS2B | FJ562106 | DENV | NS2B | EU660402 |
| DENV | NS2B | EU660403 | DENV | NS2B | FJ182035 | DENV | NS2B | FJ461307 |
| DENV | NS2B | EU482619 | DENV | NS2B | FJ461306 | DENV | NS2B | EU081272 |
| DENV | NS2B | EU677155 | DENV | NS2B | EU482510 | DENV | NS2B | FJ461315 |
| DENV | NS2B | FJ182021 | DENV | NS2B | FJ024440 | DENV | NS2B | FJ410188 |
| DENV | NS2B | EU482712 | DENV | NS2B | EU081258 | DENV | NS2B | AY713475 |
| DENV | NS2B | EU482591 | DENV | NS2B | EU081268 | DENV | NS2B | AY732479 |
| DENV | NS2B | FJ410253 | DENV | NS2B | EU677178 | DENV | NS2B | EU677156 |
| DENV | NS2B | EF032590 | DENV | NS2B | FJ410276 | DENV | NS2B | EU482707 |

FIG. 70-99

| Virus | Protein | Accession No. | Virus | Protein | Accession No. | Virus | Protein | Accession No. |
|---|---|---|---|---|---|---|---|---|
| DENV | NS2B | EU482811 | DENV | NS2B | FJ410205 | DENV | NS2B | FJ639674 |
| DENV | NS2B | AF226686 | DENV | NS2B | FJ205876 | DENV | NS2B | FJ547065 |
| DENV | NS2B | EU081235 | DENV | NS2B | FJ410211 | DENV | NS2B | FJ410212 |
| DENV | NS2B | EU660419 | DENV | NS2B | FJ182025 | DENV | NS2B | FJ461341 |
| DENV | NS2B | FJ547068 | DENV | NS2B | FJ182026 | DENV | NS2B | EU081259 |
| DENV | NS2B | AB189121 | DENV | NS2B | FJ373296 | DENV | NS2B | FJ639823 |
| DENV | NS2B | FJ461308 | DENV | NS2B | AY722802 | DENV | NS2B | FJ410190 |
| DENV | NS2B | FJ410213 | DENV | NS2B | EU482522 | DENV | NS2B | FJ432745 |
| DENV | NS2B | AY726550 | DENV | NS2B | FJ390388 | DENV | NS2B | FJ410175 |
| DENV | NS2B | AY732477 | DENV | NS2B | EU677173 | DENV | NS2B | EU677176 |
| DENV | NS2B | EU660401 | DENV | NS2B | EU081277 | DENV | NS2B | FJ639679 |
| DENV | NS2B | FJ639815 | DENV | NS2B | EU482492 | DENV | NS2B | FJ432742 |
| DENV | NS2B | FJ410268 | DENV | NS2B | FJ432732 | DENV | NS2B | FJ639670 |
| DENV | NS2B | FJ478458 | DENV | NS2B | FJ639691 | DENV | NS2B | FJ182027 |
| DENV | NS2B | FJ639808 | DENV | NS2B | EU482511 | DENV | NS2B | EU482718 |
| DENV | NS2B | EU482611 | DENV | NS2B | EU081230 | DENV | NS2B | EU677158 |
| DENV | NS2B | FJ410261 | DENV | NS2B | FJ410206 | DENV | NS2B | FJ639687 |
| DENV | NS2B | FJ432729 | DENV | NS2B | FJ410189 | DENV | NS2B | FJ461325 |
| DENV | NS2B | FJ639813 | DENV | NS2B | FJ182019 | DENV | NS2B | FJ024444 |
| DENV | NS2B | EU482520 | DENV | NS2B | FJ024472 | DENV | NS2B | EU482617 |
| DENV | NS2B | AF514885 | DENV | NS2B | FJ205872 | DENV | NS2B | FJ639678 |
| DENV | NS2B | FJ639673 | DENV | NS2B | FJ410282 | DENV | NS2B | EU081269 |
| DENV | NS2B | FJ410266 | DENV | NS2B | EU482538 | DENV | NS2B | EU482714 |
| DENV | NS2B | EU482805 | DENV | NS2B | EU660418 | DENV | NS2B | FJ024456 |
| DENV | NS2B | FJ432740 | DENV | NS2B | FJ639819 | DENV | NS2B | FJ182028 |
| DENV | NS2B | AY726554 | DENV | NS2B | FJ639806 | DENV | NS2B | EU677152 |
| DENV | NS2B | FJ024441 | DENV | NS2B | FJ432738 | DENV | NS2B | EU081228 |
| DENV | NS2B | DQ672556 | DENV | NS2B | FJ432719 | DENV | NS2B | FJ410173 |
| DENV | NS2B | FJ410272 | DENV | NS2B | FJ461303 | DENV | NS2B | EU482796 |
| DENV | NS2B | FJ639676 | DENV | NS2B | FJ410203 | DENV | NS2B | EU726781 |
| DENV | NS2B | FJ639686 | DENV | NS2B | FJ410194 | DENV | NS2B | FJ410207 |
| DENV | NS2B | EU482498 | DENV | NS2B | EU081244 | DENV | NS2B | FJ410243 |
| DENV | NS2B | FJ432725 | DENV | NS2B | EU482482 | DENV | NS2B | EU081239 |
| DENV | NS2B | EU482529 | DENV | NS2B | FJ410179 | DENV | NS2B | EU482816 |
| DENV | NS2B | FJ547086 | DENV | NS2B | AY722803 | DENV | NS2B | EU081260 |
| DENV | NS2B | FJ461323 | DENV | NS2B | EU482539 | DENV | NS2B | FJ182029 |
| DENV | NS2B | FJ410230 | DENV | NS2B | FJ639671 | DENV | NS2B | FJ024449 |
| DENV | NS2B | FJ410248 | DENV | NS2B | EU482478 | DENV | NS2B | EU081250 |
| DENV | NS2B | EU482609 | DENV | NS2B | FJ547060 | DENV | NS2B | EU482825 |
| DENV | NS2B | FJ639824 | DENV | NS2B | FJ432739 | DENV | NS2B | EU482530 |
| DENV | NS2B | FJ410279 | DENV | NS2B | FJ639740 | DENV | NS2B | FJ639820 |
| DENV | NS2B | EU482535 | DENV | NS2B | FJ182034 | DENV | NS2B | EU677175 |
| DENV | NS2B | FJ024453 | DENV | NS2B | EU482710 | DENV | NS2B | FJ410251 |
| DENV | NS2B | FJ432748 | DENV | NS2B | EU081232 | DENV | NS2B | EU482794 |
| DENV | NS2B | EU660393 | DENV | NS2B | EU482515 | DENV | NS2B | EU359008 |
| DENV | NS2B | AY145122 | DENV | NS2B | EU482531 | DENV | NS2B | AF180818 |
| DENV | NS2B | FJ024446 | DENV | NS2B | AF298807 | DENV | NS2B | EU660396 |
| DENV | NS2B | FJ432747 | DENV | NS2B | FJ205873 | DENV | NS2B | FJ182003 |

FIG. 70-100

| Virus | Protein | Accession No. | Virus | Protein | Accession No. | Virus | Protein | Accession No. |
|---|---|---|---|---|---|---|---|---|
| DENV | NS2B | EU482476 | DENV | NS2B | FJ410185 | DENV | NS2B | EU482795 |
| DENV | NS2B | EU482505 | DENV | NS2B | FJ410273 | DENV | NS2B | EU677164 |
| DENV | NS2B | EU081255 | DENV | NS2B | EU482801 | DENV | NS2B | FJ410277 |
| DENV | NS2B | FJ639743 | DENV | NS2B | AY713476 | DENV | NS2B | FJ024464 |
| DENV | NS2B | U88537 | DENV | NS2B | FJ461312 | DENV | NS2B | FJ461332 |
| DENV | NS2B | FJ432733 | DENV | NS2B | FJ639797 | DENV | NS2B | EF122232 |
| DENV | NS2B | EU660395 | DENV | NS2B | FJ461319 | DENV | NS2B | FJ432727 |
| DENV | NS2B | EU081263 | DENV | NS2B | FJ461333 | DENV | NS2B | EU482823 |
| DENV | NS2B | EU482826 | DENV | NS2B | EU482516 | DENV | NS2B | EU482810 |
| DENV | NS2B | FJ410192 | DENV | NS2B | EU482792 | DENV | NS2B | EU081245 |
| DENV | NS2B | FJ182020 | DENV | NS2B | AF514889 | DENV | NS2B | EU081262 |
| DENV | NS2B | DQ672561 | DENV | NS2B | EU482509 | DENV | NS2B | EU863650 |
| DENV | NS2B | FJ024481 | DENV | NS2B | FJ432737 | DENV | NS2B | AY732483 |
| DENV | NS2B | EU677165 | DENV | NS2B | FJ547063 | DENV | NS2B | FJ410265 |
| DENV | NS2B | FJ410287 | DENV | NS2B | FJ373297 | DENV | NS2B | EU660412 |
| DENV | NS2B | EU482502 | DENV | NS2B | EU677157 | DENV | NS2B | EU677171 |
| DENV | NS2B | EU081274 | DENV | NS2B | EU482534 | DENV | NS2B | EU677140 |
| DENV | NS2B | FJ024448 | DENV | NS2B | EU249491 | DENV | NS2B | FJ898428 |
| DENV | NS2B | FJ024425 | DENV | NS2B | DQ285562 | DENV | NS2B | FJ882569 |
| DENV | NS2B | FJ639741 | DENV | NS2B | EU482793 | DENV | NS2B | GQ199776 |
| DENV | NS2B | FJ562104 | DENV | NS2B | EU482717 | DENV | NS2B | GQ199853 |
| DENV | NS2B | DQ672563 | DENV | NS2B | FJ024439 | DENV | NS2B | GQ199803 |
| DENV | NS2B | EU482708 | DENV | NS2B | EU482804 | DENV | NS2B | FJ882554 |
| DENV | NS2B | FJ410247 | DENV | NS2B | EU482503 | DENV | NS2B | FJ873809 |
| DENV | NS2B | AF180817 | DENV | NS2B | EU677162 | DENV | NS2B | FJ882563 |
| DENV | NS2B | AY722801 | DENV | NS2B | FJ024485 | DENV | NS2B | GQ199812 |
| DENV | NS2B | EU482504 | DENV | NS2B | EU081271 | DENV | NS2B | FJ873810 |
| DENV | NS2B | FJ639675 | DENV | NS2B | FJ024426 | DENV | NS2B | FJ898397 |
| DENV | NS2B | FJ024433 | DENV | NS2B | EU482790 | DENV | NS2B | FJ898400 |
| DENV | NS2B | FJ461331 | DENV | NS2B | FJ410286 | DENV | NS2B | FJ687433 |
| DENV | NS2B | FJ410187 | DENV | NS2B | FJ639735 | DENV | NS2B | GQ199877 |
| DENV | NS2B | FJ410258 | DENV | NS2B | EU482494 | DENV | NS2B | GQ199788 |
| DENV | NS2B | AY708047 | DENV | NS2B | FJ390374 | DENV | NS2B | GQ199823 |
| DENV | NS2B | FJ024423 | DENV | NS2B | EU482813 | DENV | NS2B | FJ898407 |
| DENV | NS2B | FJ024484 | DENV | NS2B | FJ461335 | DENV | NS2B | GQ199804 |
| DENV | NS2B | EU081251 | DENV | NS2B | EU482803 | DENV | NS2B | FJ882533 |
| DENV | NS2B | FJ410249 | DENV | NS2B | EU482490 | DENV | NS2B | GQ199818 |
| DENV | NS2B | EU482610 | DENV | NS2B | FJ024482 | DENV | NS2B | FJ882560 |
| DENV | NS2B | FJ182033 | DENV | NS2B | FJ410284 | DENV | NS2B | FJ898415 |
| DENV | NS2B | EU482493 | DENV | NS2B | EU081280 | DENV | NS2B | FJ850113 |
| DENV | NS2B | EU482807 | DENV | NS2B | EU677150 | DENV | NS2B | FJ898384 |
| DENV | NS2B | FJ639814 | DENV | NS2B | AY732481 | DENV | NS2B | FJ882538 |
| DENV | NS2B | EU482501 | DENV | NS2B | FJ461324 | DENV | NS2B | FJ882521 |
| DENV | NS2B | FJ410254 | DENV | NS2B | FJ639796 | DENV | NS2B | GQ199811 |
| DENV | NS2B | EU081246 | DENV | NS2B | EU482709 | DENV | NS2B | FJ850075 |
| DENV | NS2B | EU081275 | DENV | NS2B | AF298808 | DENV | NS2B | GQ199848 |
| DENV | NS2B | FJ410264 | DENV | NS2B | FJ182018 | DENV | NS2B | FJ898378 |
| DENV | NS2B | FJ024479 | DENV | NS2B | DQ672558 | DENV | NS2B | FJ873814 |

FIG. 70-101

| Virus | Protein | Accession No. | Virus | Protein | Accession No. | Virus | Protein | Accession No. |
|---|---|---|---|---|---|---|---|---|
| DENV | NS2B | FJ898410 | DENV | NS2B | FJ859029 | DENV | NS2B | FJ882518 |
| DENV | NS2B | FJ882528 | DENV | NS2B | FJ882515 | DENV | NS2B | FJ898392 |
| DENV | NS2B | FJ898382 | DENV | NS2B | GQ199820 | DENV | NS2B | FJ898380 |
| DENV | NS2B | FJ898404 | DENV | NS2B | GQ199867 | DENV | NS2B | GQ199835 |
| DENV | NS2B | FJ687426 | DENV | NS2B | FJ898448 | DENV | NS2B | FJ898430 |
| DENV | NS2B | FJ898371 | DENV | NS2B | FJ882556 | DENV | NS2B | FJ850087 |
| DENV | NS2B | GQ199872 | DENV | NS2B | FJ882536 | DENV | NS2B | FJ898385 |
| DENV | NS2B | GQ199855 | DENV | NS2B | GQ199796 | DENV | NS2B | GQ199857 |
| DENV | NS2B | FJ882535 | DENV | NS2B | FJ882570 | DENV | NS2B | FJ898403 |
| DENV | NS2B | NC_001477 | DENV | NS2B | FJ898376 | DENV | NS2B | GQ199800 |
| DENV | NS2B | FJ898423 | DENV | NS2B | GQ199771 | DENV | NS2B | FJ882540 |
| DENV | NS2B | FJ882565 | DENV | NS2B | FJ850069 | DENV | NS2B | GQ199792 |
| DENV | NS2B | FJ882517 | DENV | NS2B | FJ850102 | DENV | NS2B | FJ882516 |
| DENV | NS2B | GQ199814 | DENV | NS2B | GQ199834 | DENV | NS2B | GQ199850 |
| DENV | NS2B | FJ898395 | DENV | NS2B | FJ898388 | DENV | NS2B | FJ898372 |
| DENV | NS2B | GQ199851 | DENV | NS2B | GQ199830 | DENV | NS2B | GQ199775 |
| DENV | NS2B | GQ199837 | DENV | NS2B | GQ199839 | DENV | NS2B | FJ882559 |
| DENV | NS2B | FJ882558 | DENV | NS2B | GQ199777 | DENV | NS2B | GQ199789 |
| DENV | NS2B | FJ850084 | DENV | NS2B | FJ882579 | DENV | NS2B | FJ850099 |
| DENV | NS2B | FJ898374 | DENV | NS2B | FJ898429 | DENV | NS2B | FJ850114 |
| DENV | NS2B | FJ850104 | DENV | NS2B | FJ882541 | DENV | NS2B | GQ199819 |
| DENV | NS2B | GQ199815 | DENV | NS2B | FJ898402 | DENV | NS2B | FJ882523 |
| DENV | NS2B | GQ199843 | DENV | NS2B | GQ199808 | DENV | NS2B | GQ199845 |
| DENV | NS2B | GQ199826 | DENV | NS2B | GQ199786 | DENV | NS2B | FJ850081 |
| DENV | NS2B | FJ882550 | DENV | NS2B | FJ882547 | DENV | NS2B | FJ744702 |
| DENV | NS2B | FJ744701 | DENV | NS2B | GQ199798 | DENV | NS2B | FJ898386 |
| DENV | NS2B | FJ898391 | DENV | NS2B | GQ199844 | DENV | NS2B | FJ882542 |
| DENV | NS2B | FJ898417 | DENV | NS2B | GQ199829 | DENV | NS2B | GQ199782 |
| DENV | NS2B | GQ199806 | DENV | NS2B | FJ882530 | DENV | NS2B | GQ199852 |
| DENV | NS2B | GQ199794 | DENV | NS2B | FJ898422 | DENV | NS2B | FJ898421 |
| DENV | NS2B | FJ898425 | DENV | NS2B | FJ810415 | DENV | NS2B | FJ687432 |
| DENV | NS2B | FJ898393 | DENV | NS2B | FJ898411 | DENV | NS2B | GQ199813 |
| DENV | NS2B | GQ199799 | DENV | NS2B | GQ199856 | DENV | NS2B | FJ882534 |
| DENV | NS2B | GQ199833 | DENV | NS2B | FJ850101 | DENV | NS2B | GQ199854 |
| DENV | NS2B | GQ199781 | DENV | NS2B | FJ850093 | DENV | NS2B | GQ199846 |
| DENV | NS2B | GQ199797 | DENV | NS2B | FJ882551 | DENV | NS2B | FJ882539 |
| DENV | NS2B | FJ882522 | DENV | NS2B | GQ199795 | DENV | NS2B | FJ898437 |
| DENV | NS2B | FJ906964 | DENV | NS2B | FJ850100 | DENV | NS2B | FJ898390 |
| DENV | NS2B | GQ199821 | DENV | NS2B | FJ898416 | DENV | NS2B | FJ898405 |
| DENV | NS2B | GQ199847 | DENV | NS2B | GQ199785 | DENV | NS2B | GQ199783 |
| DENV | NS2B | FJ882524 | DENV | NS2B | GQ199784 | DENV | NS2B | FJ882526 |
| DENV | NS2B | FJ850077 | DENV | NS2B | GQ199828 | DENV | NS2B | FJ461320 |
| DENV | NS2B | FJ882552 | DENV | NS2B | GQ199780 | DENV | NS2B | FJ898420 |
| DENV | NS2B | GQ199778 | DENV | NS2B | FJ850103 | DENV | NS2B | FJ687431 |
| DENV | NS2B | FJ882549 | DENV | NS2B | FJ882555 | DENV | NS2B | GQ199801 |
| DENV | NS2B | GQ199816 | DENV | NS2B | FJ882561 | DENV | NS2B | FJ906728 |
| DENV | NS2B | GQ199824 | DENV | NS2B | FJ687430 | DENV | NS2B | FJ882544 |
| DENV | NS2B | FJ898398 | DENV | NS2B | FJ898381 | DENV | NS2B | FJ882553 |

FIG. 70-102

| Virus | Protein | Accession No. | Virus | Protein | Accession No. | Virus | Protein | Accession No. |
|---|---|---|---|---|---|---|---|---|
| DENV | NS2B | FJ882531 | DENV | NS2B | GQ199838 | DENV | NS2B | GU131841 |
| DENV | NS2B | GQ199810 | DENV | NS2B | GQ199779 | DENV | NS2B | GQ868564 |
| DENV | NS2B | GQ199825 | DENV | NS2B | GQ199827 | DENV | NS2B | AB519681 |
| DENV | NS2B | FJ882546 | DENV | NS2B | GQ199836 | DENV | NS2B | GU131743 |
| DENV | NS2B | FJ882568 | DENV | NS2B | GQ199858 | DENV | NS2B | GQ868522 |
| DENV | NS2B | FJ898413 | DENV | NS2B | GQ199787 | DENV | NS2B | GU131739 |
| DENV | NS2B | GQ199773 | DENV | NS2B | FJ850068 | DENV | NS2B | GU131971 |
| DENV | NS2B | GQ199822 | DENV | NS2B | FJ882564 | DENV | NS2B | GU131834 |
| DENV | NS2B | GQ199832 | DENV | NS2B | FJ898419 | DENV | NS2B | GQ868523 |
| DENV | NS2B | GQ199790 | DENV | NS2B | FJ898383 | DENV | NS2B | GU131982 |
| DENV | NS2B | GQ199841 | DENV | NS2B | FJ461328 | DENV | NS2B | GU131965 |
| DENV | NS2B | FJ882520 | DENV | NS2B | FJ882527 | DENV | NS2B | GU131760 |
| DENV | NS2B | GQ199875 | DENV | NS2B | FJ898427 | DENV | NS2B | GQ868535 |
| DENV | NS2B | GQ199802 | DENV | NS2B | FJ882525 | DENV | NS2B | GU131962 |
| DENV | NS2B | GQ199791 | DENV | NS2B | FJ882557 | DENV | NS2B | GU131891 |
| DENV | NS2B | FJ898426 | DENV | NS2B | GQ199859 | DENV | NS2B | GQ868504 |
| DENV | NS2B | FJ898431 | DENV | NS2B | GQ199842 | DENV | NS2B | GU131783 |
| DENV | NS2B | GQ199809 | DENV | NS2B | GQ199817 | DENV | NS2B | GU131680 |
| DENV | NS2B | FJ898406 | DENV | NS2B | FJ898401 | DENV | NS2B | GU131704 |
| DENV | NS2B | GQ199805 | DENV | NS2B | FJ882519 | DENV | NS2B | GU131685 |
| DENV | NS2B | GQ199831 | DENV | NS2B | FJ850090 | DENV | NS2B | GU131770 |
| DENV | NS2B | FJ850070 | DENV | NS2B | FJ898377 | DENV | NS2B | GU131795 |
| DENV | NS2B | GQ199807 | DENV | NS2B | GQ199774 | DENV | NS2B | GU131961 |
| DENV | NS2B | FJ882543 | DENV | NS2B | FJ898399 | DENV | NS2B | GU131733 |
| DENV | NS2B | FJ898408 | DENV | NS2B | GQ199840 | DENV | NS2B | GU131804 |
| DENV | NS2B | FJ810419 | DENV | NS2B | FJ898433 | DENV | NS2B | GU131762 |
| DENV | NS2B | GQ199793 | DENV | NS2B | FJ882567 | DENV | NS2B | GU131827 |
| DENV | NS2B | FJ882562 | DENV | NS2B | FJ898387 | DENV | NS2B | GU131837 |
| DENV | NS2B | FJ898424 | DENV | NS2B | FJ882532 | DENV | NS2B | GQ868630 |
| DENV | NS2B | FJ898389 | DENV | NS2B | FJ898409 | DENV | NS2B | GU131767 |
| DENV | NS2B | FJ898412 | DENV | NS2B | FJ882545 | DENV | NS2B | GU131737 |
| DENV | NS2B | FJ882537 | DENV | NS2B | FJ898375 | DENV | NS2B | GQ868500 |
| DENV | NS2B | FJ898418 | DENV | NS2B | FJ898414 | DENV | NS2B | GU131722 |
| DENV | NS2B | FJ898394 | DENV | NS2B | CS477306 | DENV | NS2B | GQ868607 |
| DENV | NS2B | GQ199849 | DENV | NS2B | A75711 | DENV | NS2B | GQ868517 |
| DENV | NS2B | FJ882548 | DENV | NS2B | GU131816 | DENV | NS2B | GU131727 |
| DENV | NS2B | FJ906963 | DENV | NS2B | FJ469907 | DENV | NS2B | GU131715 |
| DENV | NS2B | FJ906965 | DENV | NS2B | GU131814 | DENV | NS2B | FN429885 |
| DENV | NS2B | GQ199873 | DENV | NS2B | GU131725 | DENV | NS2B | GU131780 |
| DENV | NS2B | FJ850073 | DENV | NS2B | GU131822 | DENV | NS2B | GU131750 |
| DENV | NS2B | FJ850071 | DENV | NS2B | GQ868633 | DENV | NS2B | GU131787 |
| DENV | NS2B | GQ199772 | DENV | NS2B | GU131820 | DENV | NS2B | GU056031 |
| DENV | NS2B | FJ898373 | DENV | NS2B | GU131679 | DENV | NS2B | GQ868602 |
| DENV | NS2B | FJ687429 | DENV | NS2B | GQ868507 | DENV | NS2B | GU131711 |
| DENV | NS2B | FJ898379 | DENV | NS2B | GU131789 | DENV | NS2B | GQ868567 |
| DENV | NS2B | FJ882566 | DENV | NS2B | GU131710 | DENV | NS2B | GU131813 |
| DENV | NS2B | FJ898396 | DENV | NS2B | FN429887 | DENV | NS2B | FJ687428 |
| DENV | NS2B | FJ882529 | DENV | NS2B | GU131720 | DENV | NS2B | GU131707 |

FIG. 70-103

| Virus | Protein | Accession No. | Virus | Protein | Accession No. | Virus | Protein | Accession No. |
|---|---|---|---|---|---|---|---|---|
| DENV | NS2B | G

FIG. 70-104

| Virus | Protein | Accession No. | Virus | Protein | Accession No. | Virus | Protein | Accession No. |
|---|---|---|---|---|---|---|---|---|
| DENV | NS2B | GU131764 | DENV | NS2B | FN429888 | DENV | NS2B | GU131717 |
| DENV | NS2B | GU056030 | DENV | NS2B | GU131778 | DENV | NS2B | GU131712 |
| DENV | NS2B | GU131979 | DENV | NS2B | GU131972 | DENV | NS2B | GQ868532 |
| DENV | NS2B | GU131768 | DENV | NS2B | GU131817 | DENV | NS2B | GQ868514 |
| DENV | NS2B | GU131699 | DENV | NS2B | GU131759 | DENV | NS2B | FJ410220 |
| DENV | NS2B | FJ687427 | DENV | NS2B | GU131819 | DENV | NS2B | CS477302 |
| DENV | NS2B | GU131963 | DENV | NS2B | GU131757 | DENV | NS2B | CS477304 |
| DENV | NS2B | GU131793 | DENV | NS2B | GQ868533 | DENV | NS2B | CS477264 |
| DENV | NS2B | GQ868618 | DENV | NS2B | FN429883 | DENV | NS2B | CS477305 |
| DENV | NS2B | GU131799 | DENV | NS2B | GU131956 | DENV | NS2B | CS477263 |
| DENV | NS2B | GU131724 | DENV | NS2B | GQ868563 | DENV | NS2B | CS477265 |
| DENV | NS2B | GU131740 | DENV | NS2B | GU131926 | DENV | NS2B | M87512 |
| DENV | NS2B | GU131806 | DENV | NS2B | GU131887 | DENV | NS2B | FB730116 |
| DENV | NS2B | GQ868614 | DENV | NS2B | GU131741 | DENV | NS2B | GM059691 |
| DENV | NS2B | FN429881 | DENV | NS2B | GU131761 | DENV | NS2B | U88536 |
| DENV | NS2B | GQ868636 | DENV | NS2B | GU131693 | DENV | NS2B | GU370048 |
| DENV | NS2B | GU131746 | DENV | NS2B | GU131753 | DENV | NS2B | GU370049 |
| DENV | NS2B | GQ868560 | DENV | NS2B | GU131948 | DENV | NS2B | AY762085 |
| DENV | NS2B | GQ868508 | DENV | NS2B | GQ868559 | DENV | NS2B | FJ024424 |
| DENV | NS2B | GQ868570 | DENV | NS2B | GQ868530 | DENV | NS2B | FJ226067 |
| DENV | NS2B | GU131788 | DENV | NS2B | GU131797 | DENV | NS2B | FJ639745 |
| DENV | NS2B | GU131949 | DENV | NS2B | GU131785 | DENV | NS2B | AY618989 |
| DENV | NS2B | GU131796 | DENV | NS2B | GU131758 | DENV | NS2B | AF326827 |
| DENV | NS2B | GU056029 | DENV | NS2B | GU131697 | DENV | NS2B | AY618988 |
| DENV | NS2B | GU131792 | DENV | NS2B | GU131835 | DENV | NS2B | EU854296 |
| DENV | NS2B | GU131690 | DENV | NS2B | GU131716 | DENV | NS2B | EU854300 |
| DENV | NS2B | GQ868632 | DENV | NS2B | GQ868498 | DENV | NS2B | AY858050 |
| DENV | NS2B | GU131781 | DENV | NS2B | GU131683 | DENV | NS2B | AF375822 |
| DENV | NS2B | GQ868537 | DENV | NS2B | GU131960 | DENV | NS2B | EU854295 |
| DENV | NS2B | GU131815 | DENV | NS2B | GU131714 | DENV | NS2B | M14931 |
| DENV | NS2B | GU056033 | DENV | NS2B | GU131779 | DENV | NS2B | AY618992 |
| DENV | NS2B | GU131812 | DENV | NS2B | GU131773 | DENV | NS2B | EU854297 |
| DENV | NS2B | GU131833 | DENV | NS2B | GQ868605 | DENV | NS2B | FJ639738 |
| DENV | NS2B | GU131830 | DENV | NS2B | GQ868511 | DENV | NS2B | AY618993 |
| DENV | NS2B | GU131742 | DENV | NS2B | GU131752 | DENV | NS2B | FJ639764 |
| DENV | NS2B | GQ868561 | DENV | NS2B | GU131691 | DENV | NS2B | FJ639737 |
| DENV | NS2B | GU131800 | DENV | NS2B | GU131692 | DENV | NS2B | AY776330 |
| DENV | NS2B | GU131738 | DENV | NS2B | GU131705 | DENV | NS2B | AY618991 |
| DENV | NS2B | GU131824 | DENV | NS2B | GQ868639 | DENV | NS2B | FJ639736 |
| DENV | NS2B | GU131919 | DENV | NS2B | GU131805 | DENV | NS2B | FJ639739 |
| DENV | NS2B | GU131802 | DENV | NS2B | GU131735 | DENV | NS2B | AF326826 |
| DENV | NS2B | GQ868503 | DENV | NS2B | GU131966 | DENV | NS2B | AY947539 |
| DENV | NS2B | GU131839 | DENV | NS2B | GU131890 | DENV | NS2B | EU854299 |
| DENV | NS2B | GU131681 | DENV | NS2B | GQ868566 | DENV | NS2B | AY618990 |
| DENV | NS2B | GQ868505 | DENV | NS2B | GU131775 | DENV | NS2B | FJ639748 |
| DENV | NS2B | FN429884 | DENV | NS2B | GU131749 | DENV | NS2B | FJ639744 |
| DENV | NS2B | GQ868536 | DENV | NS2B | GQ868521 | DENV | NS2B | EU854301 |
| DENV | NS2B | GU131825 | DENV | NS2B | GU131703 | DENV | NS2B | FJ639773 |

FIG. 70-105

| Virus | Protein | Accession No. | Virus | Protein | Accession No. | Virus | Protein | Accession No. |
|---|---|---|---|---|---|---|---|---|
| DENV | NS2B | FJ182016 | DENV | NS2B | GQ868585 | DENV | NS2B | FJ639774 |
| DENV | NS2B | AF326573 | DENV | NS2B | GQ868579 | DENV | NS2B | FJ639726 |
| DENV | NS2B | FJ182017 | DENV | NS2B | GQ868644 | DENV | NS2B | AY858037 |
| DENV | NS2B | FJ024476 | DENV | NS2B | FN429925 | DENV | NS2B | EU081215 |
| DENV | NS2B | EF457906 | DENV | NS2B | GU289913 | DENV | NS2B | FJ639785 |
| DENV | NS2B | FJ639742 | DENV | NS2B | GQ868580 | DENV | NS2B | FJ639761 |
| DENV | NS2B | AF289029 | DENV | NS2B | FN429922 | DENV | NS2B | EU569688 |
| DENV | NS2B | GQ199880 | DENV | NS2B | GQ868645 | DENV | NS2B | DQ675533 |
| DENV | NS2B | FJ882597 | DENV | NS2B | GQ868594 | DENV | NS2B | FJ410177 |
| DENV | NS2B | NC_002640 | DENV | NS2B | FN429924 | DENV | NS2B | FJ478456 |
| DENV | NS2B | FJ882587 | DENV | NS2B | FJ882590 | DENV | NS2B | EU081195 |
| DENV | NS2B | FJ882595 | DENV | NS2B | GQ868582 | DENV | NS2B | EU081221 |
| DENV | NS2B | FJ882582 | DENV | NS2B | GQ868584 | DENV | NS2B | EU529689 |
| DENV | NS2B | FJ810417 | DENV | NS2B | FN429926 | DENV | NS2B | EU660408 |
| DENV | NS2B | FJ850095 | DENV | NS2B | FN429921 | DENV | NS2B | EU687219 |
| DENV | NS2B | FJ882599 | DENV | NS2B | GQ868643 | DENV | NS2B | FJ639780 |
| DENV | NS2B | FJ882580 | DENV | NS2B | AF326825 | DENV | NS2B | EU687196 |
| DENV | NS2B | GQ199884 | DENV | NS2B | AY376438 | DENV | NS2B | EF643017 |
| DENV | NS2B | FJ882588 | DENV | NS2B | AY648301 | DENV | NS2B | FJ373303 |
| DENV | NS2B | FJ882598 | DENV | NS2B | AY099336 | DENV | NS2B | FJ639729 |
| DENV | NS2B | FJ882601 | DENV | NS2B | GU363549 | DENV | NS2B | FJ639775 |
| DENV | NS2B | FJ850058 | DENV | NS2B | GU370052 | DENV | NS2B | FJ461322 |
| DENV | NS2B | FJ882584 | DENV | NS2B | GU370053 | DENV | NS2B | FJ390371 |
| DENV | NS2B | FJ850059 | DENV | NS2B | EU081191 | DENV | NS2B | AY858046 |
| DENV | NS2B | GQ199883 | DENV | NS2B | DQ401690 | DENV | NS2B | EU482455 |
| DENV | NS2B | FJ882586 | DENV | NS2B | EU529683 | DENV | NS2B | AY744680 |
| DENV | NS2B | GQ252675 | DENV | NS2B | AY679147 | DENV | NS2B | FJ182015 |
| DENV | NS2B | FJ882581 | DENV | NS2B | AY676348 | DENV | NS2B | FJ562103 |
| DENV | NS2B | GQ199881 | DENV | NS2B | EF629368 | DENV | NS2B | FJ639792 |
| DENV | NS2B | GQ199878 | DENV | NS2B | FJ639752 | DENV | NS2B | DQ675527 |
| DENV | NS2B | FJ882596 | DENV | NS2B | FJ639807 | DENV | NS2B | FJ547066 |
| DENV | NS2B | FJ882583 | DENV | NS2B | EU529684 | DENV | NS2B | EU529698 |
| DENV | NS2B | FJ882600 | DENV | NS2B | FJ373304 | DENV | NS2B | EU726769 |
| DENV | NS2B | FJ850057 | DENV | NS2B | FJ639723 | DENV | NS2B | AY676349 |
| DENV | NS2B | GQ199879 | DENV | NS2B | EU569691 | DENV | NS2B | EU529688 |
| DENV | NS2B | FJ882585 | DENV | NS2B | DQ675524 | DENV | NS2B | EU482558 |
| DENV | NS2B | GQ199876 | DENV | NS2B | EU081203 | DENV | NS2B | FJ547070 |
| DENV | NS2B | GQ199885 | DENV | NS2B | EU482564 | DENV | NS2B | EU687198 |
| DENV | NS2B | FJ882592 | DENV | NS2B | FJ182039 | DENV | NS2B | FJ639817 |
| DENV | NS2B | GQ199882 | DENV | NS2B | EU482453 | DENV | NS2B | EU081202 |
| DENV | NS2B | FJ882591 | DENV | NS2B | FJ639779 | DENV | NS2B | EU081225 |
| DENV | NS2B | FJ882589 | DENV | NS2B | EU081183 | DENV | NS2B | DQ675520 |
| DENV | NS2B | GQ868642 | DENV | NS2B | EU529690 | DENV | NS2B | EU854298 |
| DENV | NS2B | GQ868581 | DENV | NS2B | FJ182011 | DENV | NS2B | FJ205870 |
| DENV | NS2B | FN429919 | DENV | NS2B | EU081187 | DENV | NS2B | FJ639793 |
| DENV | NS2B | GQ868583 | DENV | NS2B | EU482461 | DENV | NS2B | DQ675532 |
| DENV | NS2B | FN429920 | DENV | NS2B | FJ639803 | DENV | NS2B | FJ024470 |
| DENV | NS2B | FN429923 | DENV | NS2B | AY858047 | DENV | NS2B | EU081210 |

FIG. 70-106

| Virus | Protein | Accession No. | Virus | Protein | Accession No. | Virus | Protein | Accession No. |
|---|---|---|---|---|---|---|---|---|
| DENV | NS2B | EU687226 | DENV | NS2B | EU081192 | DENV | NS2B | FJ639767 |
| DENV | NS2B | FJ639715 | DENV | NS2B | FJ432731 | DENV | NS2B | AB189125 |
| DENV | NS2B | AY676352 | DENV | NS2B | AB189126 | DENV | NS2B | AF317645 |
| DENV | NS2B | AY858043 | DENV | NS2B | FJ024471 | DENV | NS2B | AB189127 |
| DENV | NS2B | EU081196 | DENV | NS2B | FJ639769 | DENV | NS2B | EU781137 |
| DENV | NS2B | FJ432741 | DENV | NS2B | FJ547078 | DENV | NS2B | DQ675522 |
| DENV | NS2B | EU726773 | DENV | NS2B | FJ547080 | DENV | NS2B | EU482614 |
| DENV | NS2B | EU482555 | DENV | NS2B | AY744679 | DENV | NS2B | AB214879 |
| DENV | NS2B | DQ401694 | DENV | NS2B | EU081217 | DENV | NS2B | FJ639765 |
| DENV | NS2B | EU081216 | DENV | NS2B | AY858045 | DENV | NS2B | EU081211 |
| DENV | NS2B | EU529704 | DENV | NS2B | FJ547084 | DENV | NS2B | FJ639787 |
| DENV | NS2B | FJ639777 | DENV | NS2B | DQ675521 | DENV | NS2B | FJ639784 |
| DENV | NS2B | FJ639730 | DENV | NS2B | AY776329 | DENV | NS2B | EU569690 |
| DENV | NS2B | EU081190 | DENV | NS2B | FJ639789 | DENV | NS2B | EU081223 |
| DENV | NS2B | EU529703 | DENV | NS2B | AY496871 | DENV | NS2B | FJ639816 |
| DENV | NS2B | FJ639725 | DENV | NS2B | EU781136 | DENV | NS2B | AY496873 |
| DENV | NS2B | EU081205 | DENV | NS2B | FJ182013 | DENV | NS2B | FJ182010 |
| DENV | NS2B | AY876494 | DENV | NS2B | EU596492 | DENV | NS2B | AY099337 |
| DENV | NS2B | FJ639747 | DENV | NS2B | EU726774 | DENV | NS2B | AY496879 |
| DENV | NS2B | FJ373302 | DENV | NS2B | EU081198 | DENV | NS2B | EU482462 |
| DENV | NS2B | FJ639778 | DENV | NS2B | FJ639728 | DENV | NS2B | FJ639825 |
| DENV | NS2B | DQ401692 | DENV | NS2B | DQ675530 | DENV | NS2B | AY766104 |
| DENV | NS2B | FJ182038 | DENV | NS2B | EU660409 | DENV | NS2B | FJ182007 |
| DENV | NS2B | EU081220 | DENV | NS2B | EU081206 | DENV | NS2B | DQ401693 |
| DENV | NS2B | AY923865 | DENV | NS2B | EU081222 | DENV | NS2B | DQ675531 |
| DENV | NS2B | EU081188 | DENV | NS2B | EU660407 | DENV | NS2B | FJ461326 |
| DENV | NS2B | FJ461337 | DENV | NS2B | M93130 | DENV | NS2B | FJ373306 |
| DENV | NS2B | EU081224 | DENV | NS2B | EU529687 | DENV | NS2B | EU569689 |
| DENV | NS2B | EU081207 | DENV | NS2B | DQ675523 | DENV | NS2B | AY858041 |
| DENV | NS2B | FJ639750 | DENV | NS2B | FJ432722 | DENV | NS2B | EU482566 |
| DENV | NS2B | AB189128 | DENV | NS2B | EU482559 | DENV | NS2B | EF629370 |
| DENV | NS2B | AY676353 | DENV | NS2B | FJ639721 | DENV | NS2B | AY496877 |
| DENV | NS2B | EU081209 | DENV | NS2B | AY744682 | DENV | NS2B | FJ562102 |
| DENV | NS2B | FJ639772 | DENV | NS2B | EU081184 | DENV | NS2B | EF629367 |
| DENV | NS2B | FJ182040 | DENV | NS2B | FJ639805 | DENV | NS2B | FJ547077 |
| DENV | NS2B | AY648961 | DENV | NS2B | FJ547074 | DENV | NS2B | FJ639770 |
| DENV | NS2B | FJ410178 | DENV | NS2B | EU529685 | DENV | NS2B | EU081182 |
| DENV | NS2B | EU529699 | DENV | NS2B | DQ401695 | DENV | NS2B | EU596494 |
| DENV | NS2B | EU081199 | DENV | NS2B | FJ432743 | DENV | NS2B | FJ639749 |
| DENV | NS2B | FJ639786 | DENV | NS2B | EU854291 | DENV | NS2B | EU726771 |
| DENV | NS2B | FJ639768 | DENV | NS2B | FJ182008 | DENV | NS2B | FJ639746 |
| DENV | NS2B | FJ639731 | DENV | NS2B | FJ547062 | DENV | NS2B | EU081214 |
| DENV | NS2B | FJ390373 | DENV | NS2B | FJ024467 | DENV | NS2B | AY858039 |
| DENV | NS2B | FJ639800 | DENV | NS2B | EU687239 | DENV | NS2B | EU660411 |
| DENV | NS2B | FJ547079 | DENV | NS2B | FJ024468 | DENV | NS2B | EU482563 |
| DENV | NS2B | FJ547072 | DENV | NS2B | AY496874 | DENV | NS2B | AY744678 |
| DENV | NS2B | EU081219 | DENV | NS2B | FJ547061 | DENV | NS2B | FJ461334 |
| DENV | NS2B | EU596493 | DENV | NS2B | FJ547076 | DENV | NS2B | EU660420 |

FIG. 70-107

| Virus | Protein | Accession No. | Virus | Protein | Accession No. | Virus | Protein | Accession No. |
|---|---|---|---|---|---|---|---|---|
| DENV | NS2B | FJ024466 | DENV | NS2B | FJ639722 | DENV | NS2B | EU081186 |
| DENV | NS2B | FJ639795 | DENV | NS2B | FJ639782 | DENV | NS2B | FJ547083 |
| DENV | NS2B | FJ024465 | DENV | NS2B | AY858042 | DENV | NS2B | FJ639762 |
| DENV | NS2B | EU726768 | DENV | NS2B | EU081185 | DENV | NS2B | FJ547071 |
| DENV | NS2B | FJ639720 | DENV | NS2B | FJ390377 | DENV | NS2B | EU529702 |
| DENV | NS2B | EU529696 | DENV | NS2B | FJ639763 | DENV | NS2B | EU687234 |
| DENV | NS2B | FJ639810 | DENV | NS2B | FJ639760 | DENV | NS2B | FJ182006 |
| DENV | NS2B | AY744681 | DENV | NS2B | FJ182009 | DENV | NS2B | AY662691 |
| DENV | NS2B | FJ639724 | DENV | NS2B | EU529697 | DENV | NS2B | EU081213 |
| DENV | NS2B | EU482595 | DENV | NS2B | DQ675529 | DENV | NS2B | EU081181 |
| DENV | NS2B | AY676351 | DENV | NS2B | FJ639727 | DENV | NS2B | FJ390372 |
| DENV | NS2B | DQ401689 | DENV | NS2B | FJ461329 | DENV | NS2B | EU482613 |
| DENV | NS2B | FJ182005 | DENV | NS2B | EU482457 | DENV | NS2B | FJ639790 |
| DENV | NS2B | FJ547085 | DENV | NS2B | FJ639827 | DENV | NS2B | DQ675519 |
| DENV | NS2B | EU081193 | DENV | NS2B | EU687197 | DENV | NS2B | EU687233 |
| DENV | NS2B | FJ639751 | DENV | NS2B | FJ639801 | DENV | NS2B | EF629369 |
| DENV | NS2B | DQ675525 | DENV | NS2B | FJ410176 | DENV | NS2B | FJ182004 |
| DENV | NS2B | FJ639826 | DENV | NS2B | EU081218 | DENV | NS2B | FJ639799 |
| DENV | NS2B | EU482458 | DENV | NS2B | AY744684 | DENV | NS2B | FJ562097 |
| DENV | NS2B | EU081204 | DENV | NS2B | FJ390376 | DENV | NS2B | FJ639712 |
| DENV | NS2B | EU529691 | DENV | NS2B | FJ639781 | DENV | NS2B | EF629366 |
| DENV | NS2B | FJ639719 | DENV | NS2B | DQ675528 | DENV | NS2B | EU726772 |
| DENV | NS2B | FJ182037 | DENV | NS2B | FJ639766 | DENV | NS2B | DQ675526 |
| DENV | NS2B | EU482612 | DENV | NS2B | EU687221 | DENV | NS2B | EU482452 |
| DENV | NS2B | EU482596 | DENV | NS2B | EU081197 | DENV | NS2B | AY858038 |
| DENV | NS2B | EU081208 | DENV | NS2B | FJ639755 | DENV | NS2B | EU482456 |
| DENV | NS2B | EU081201 | DENV | NS2B | FJ639798 | DENV | NS2B | EU081200 |
| DENV | NS2B | FJ639757 | DENV | NS2B | FJ639758 | DENV | NS2B | FJ639756 |
| DENV | NS2B | FJ639713 | DENV | NS2B | EU687218 | DENV | NS2B | AY744677 |
| DENV | NS2B | AY744685 | DENV | NS2B | EU081189 | DENV | NS2B | AY744683 |
| DENV | NS2B | FJ182041 | DENV | NS2B | FJ639759 | DENV | NS2B | FJ639753 |
| DENV | NS2B | FJ562099 | DENV | NS2B | EU081212 | DENV | NS2B | FJ639716 |
| DENV | NS2B | FJ562100 | DENV | NS2B | EU482460 | DENV | NS2B | EU081194 |
| DENV | NS2B | FJ547081 | DENV | NS2B | FJ547075 | DENV | NS2B | FJ639776 |
| DENV | NS2B | AY858044 | DENV | NS2B | AY676350 | DENV | NS2B | FJ898469 |
| DENV | NS2B | FJ639714 | DENV | NS2B | EU854292 | DENV | NS2B | GQ252674 |
| DENV | NS2B | EU529686 | DENV | NS2B | EU660410 | DENV | NS2B | FJ850055 |
| DENV | NS2B | FJ410229 | DENV | NS2B | FJ432728 | DENV | NS2B | FJ898475 |
| DENV | NS2B | FJ547073 | DENV | NS2B | FJ024469 | DENV | NS2B | FJ744739 |
| DENV | NS2B | FJ639791 | DENV | NS2B | AY858048 | DENV | NS2B | NC_001475 |
| DENV | NS2B | EU529692 | DENV | NS2B | FJ639804 | DENV | NS2B | GQ199863 |
| DENV | NS2B | FJ547082 | DENV | NS2B | EU529705 | DENV | NS2B | FJ850089 |
| DENV | NS2B | EU367962 | DENV | NS2B | EU482454 | DENV | NS2B | FJ898442 |
| DENV | NS2B | FJ390375 | DENV | NS2B | DQ401691 | DENV | NS2B | FJ898459 |
| DENV | NS2B | AY858040 | DENV | NS2B | FJ639771 | DENV | NS2B | FJ850049 |
| DENV | NS2B | FJ547069 | DENV | NS2B | FJ639754 | DENV | NS2B | FJ744730 |
| DENV | NS2B | FJ562107 | DENV | NS2B | EU482459 | DENV | NS2B | FJ850097 |
| DENV | NS2B | FJ461338 | DENV | NS2B | FJ205871 | DENV | NS2B | FJ744728 |

FIG. 70-108

| Virus | Protein | Accession No. | Virus | Protein | Accession No. | Virus | Protein | Accession No. |
|---|---|---|---|---|---|---|---|---|
| DENV | NS2B | FJ898458 | DENV | NS2B | FJ744726 | DENV | NS2B | FN429904 |
| DENV | NS2B | FJ744740 | DENV | NS2B | FJ898476 | DENV | NS2B | GU131904 |
| DENV | NS2B | GQ199889 | DENV | NS2B | FJ898468 | DENV | NS2B | GU131935 |
| DENV | NS2B | GQ199886 | DENV | NS2B | FJ744733 | DENV | NS2B | GU131910 |
| DENV | NS2B | FJ687448 | DENV | NS2B | GQ199871 | DENV | NS2B | GU131918 |
| DENV | NS2B | FJ744732 | DENV | NS2B | GQ199887 | DENV | NS2B | GU131937 |
| DENV | NS2B | FJ898446 | DENV | NS2B | GQ199864 | DENV | NS2B | GU131868 |
| DENV | NS2B | GQ199861 | DENV | NS2B | FJ744737 | DENV | NS2B | GU131951 |
| DENV | NS2B | FJ898455 | DENV | NS2B | FJ898456 | DENV | NS2B | FN429910 |
| DENV | NS2B | FJ882573 | DENV | NS2B | FJ850083 | DENV | NS2B | GU131854 |
| DENV | NS2B | FJ898463 | DENV | NS2B | FJ744731 | DENV | NS2B | GU131943 |
| DENV | NS2B | FJ898447 | DENV | NS2B | FJ850079 | DENV | NS2B | GU131861 |
| DENV | NS2B | FJ882571 | DENV | NS2B | FJ744700 | DENV | NS2B | GU131871 |
| DENV | NS2B | FJ898462 | DENV | NS2B | FJ882576 | DENV | NS2B | GU131933 |
| DENV | NS2B | GQ199870 | DENV | NS2B | GQ199891 | DENV | NS2B | GU131877 |
| DENV | NS2B | FJ898471 | DENV | NS2B | FJ850111 | DENV | NS2B | GU131911 |
| DENV | NS2B | FJ882575 | DENV | NS2B | FJ850056 | DENV | NS2B | GQ868628 |
| DENV | NS2B | FJ744738 | DENV | NS2B | FJ744727 | DENV | NS2B | GQ868574 |
| DENV | NS2B | FJ898440 | DENV | NS2B | FJ873813 | DENV | NS2B | GU131941 |
| DENV | NS2B | FJ898444 | DENV | NS2B | AY770511 | DENV | NS2B | GQ868577 |
| DENV | NS2B | GQ199865 | DENV | NS2B | FJ850098 | DENV | NS2B | GQ868547 |
| DENV | NS2B | GQ252678 | DENV | NS2B | FJ810414 | DENV | NS2B | GU131845 |
| DENV | NS2B | FJ850110 | DENV | NS2B | FJ850109 | DENV | NS2B | FN429899 |
| DENV | NS2B | FJ744734 | DENV | NS2B | FJ850052 | DENV | NS2B | FN429902 |
| DENV | NS2B | FJ898457 | DENV | NS2B | FJ850086 | DENV | NS2B | FN429917 |
| DENV | NS2B | FJ744736 | DENV | NS2B | FJ882572 | DENV | NS2B | FN429915 |
| DENV | NS2B | FJ810416 | DENV | NS2B | FJ882578 | DENV | NS2B | GU131855 |
| DENV | NS2B | FJ898474 | DENV | NS2B | FJ850092 | DENV | NS2B | FN429896 |
| DENV | NS2B | FJ850094 | DENV | NS2B | AB214882 | DENV | NS2B | GU131844 |
| DENV | NS2B | FJ898470 | DENV | NS2B | AB214880 | DENV | NS2B | GQ868573 |
| DENV | NS2B | FJ810413 | DENV | NS2B | AB214881 | DENV | NS2B | GQ868586 |
| DENV | NS2B | FJ744735 | DENV | NS2B | FB667400 | DENV | NS2B | GU131858 |
| DENV | NS2B | GQ199860 | DENV | NS2B | GQ868587 | DENV | NS2B | FN429903 |
| DENV | NS2B | FJ898464 | DENV | NS2B | EU932688 | DENV | NS2B | GU131874 |
| DENV | NS2B | FJ744729 | DENV | NS2B | FN429906 | DENV | NS2B | GU131914 |
| DENV | NS2B | FJ898472 | DENV | NS2B | GU131916 | DENV | NS2B | FN429912 |
| DENV | NS2B | GQ199862 | DENV | NS2B | GU131953 | DENV | NS2B | FN429898 |
| DENV | NS2B | FJ873812 | DENV | NS2B | GU131850 | DENV | NS2B | GU131851 |
| DENV | NS2B | FJ898441 | DENV | NS2B | FN429900 | DENV | NS2B | GU131938 |
| DENV | NS2B | FJ850048 | DENV | NS2B | GQ868576 | DENV | NS2B | GU131853 |
| DENV | NS2B | FJ850080 | DENV | NS2B | GU131946 | DENV | NS2B | FN429907 |
| DENV | NS2B | FJ882577 | DENV | NS2B | GU131866 | DENV | NS2B | GU131865 |
| DENV | NS2B | FJ850096 | DENV | NS2B | GU131862 | DENV | NS2B | GU131906 |
| DENV | NS2B | FJ898473 | DENV | NS2B | GU131852 | DENV | NS2B | GU131944 |
| DENV | NS2B | FJ882574 | DENV | NS2B | FN429897 | DENV | NS2B | GU131936 |
| DENV | NS2B | FJ898445 | DENV | NS2B | GQ868571 | DENV | NS2B | GU131903 |
| DENV | NS2B | GQ199888 | DENV | NS2B | GQ868626 | DENV | NS2B | GU131908 |
| DENV | NS2B | FJ898443 | DENV | NS2B | GQ868546 | DENV | NS2B | GU131878 |

FIG. 70-109

| Virus | Protein | Accession No. | Virus | Protein | Accession No. | Virus | Protein | Accession No. |
|---|---|---|---|---|---|---|---|---|
| DENV | NS2B | GU131950 | DENV | NS2B | GU131857 | DENV | NS2B | EU482621 |
| DENV | NS2B | GQ868634 | DENV | NS2B | GQ868629 | DENV | NS2B | EU482736 |
| DENV | NS2B | GU131873 | DENV | NS2B | GU131905 | DENV | NS2B | EU596497 |
| DENV | NS2B | GQ868593 | DENV | NS2B | GU131848 | DENV | NS2B | M84728 |
| DENV | NS2B | GQ868572 | DENV | NS2B | FB667402 | DENV | NS2B | EU482549 |
| DENV | NS2B | DQ863638 | DENV | NS2B | FB667403 | DENV | NS2B | FM210228 |
| DENV | NS2B | GU131876 | DENV | NS2B | FJ177308 | DENV | NS2B | EU687216 |
| DENV | NS2B | EU932687 | DENV | NS2B | FB667404 | DENV | NS2B | EU596489 |
| DENV | NS2B | GU189648 | DENV | NS2B | FB667398 | DENV | NS2B | EU482576 |
| DENV | NS2B | FN429913 | DENV | NS2B | FB667399 | DENV | NS2B | AF100460 |
| DENV | NS2B | GU131867 | DENV | NS2B | CS805345 | DENV | NS2B | AF169679 |
| DENV | NS2B | GQ868575 | DENV | NS2B | EU482634 | DENV | NS2B | EU482665 |
| DENV | NS2B | GQ868617 | DENV | NS2B | FJ373301 | DENV | NS2B | EU482586 |
| DENV | NS2B | GQ868616 | DENV | NS2B | EU482582 | DENV | NS2B | AF169681 |
| DENV | NS2B | GU131870 | DENV | NS2B | EU687227 | DENV | NS2B | FM210205 |
| DENV | NS2B | GU131869 | DENV | NS2B | EU569710 | DENV | NS2B | EU482767 |
| DENV | NS2B | GU131846 | DENV | NS2B | EF105383 | DENV | NS2B | EU687240 |
| DENV | NS2B | GU131934 | DENV | NS2B | EU687249 | DENV | NS2B | AF169686 |
| DENV | NS2B | GQ868627 | DENV | NS2B | EU687242 | DENV | NS2B | EU687244 |
| DENV | NS2B | FN429908 | DENV | NS2B | EU482658 | DENV | NS2B | EU482683 |
| DENV | NS2B | GU131872 | DENV | NS2B | FJ639710 | DENV | NS2B | FJ373299 |
| DENV | NS2B | FN429901 | DENV | NS2B | EU482748 | DENV | NS2B | EU482601 |
| DENV | NS2B | GU131917 | DENV | NS2B | FJ205885 | DENV | NS2B | EU660404 |
| DENV | NS2B | GU131875 | DENV | NS2B | EU482470 | DENV | NS2B | EU482651 |
| DENV | NS2B | FN429909 | DENV | NS2B | EU482468 | DENV | NS2B | EU482787 |
| DENV | NS2B | FN429911 | DENV | NS2B | FJ410195 | DENV | NS2B | FM210216 |
| DENV | NS2B | GU131945 | DENV | NS2B | AB122021 | DENV | NS2B | EU569694 |
| DENV | NS2B | FN429916 | DENV | NS2B | EU482469 | DENV | NS2B | EU482648 |
| DENV | NS2B | FN429914 | DENV | NS2B | FM210231 | DENV | NS2B | EU482620 |
| DENV | NS2B | GU131942 | DENV | NS2B | FJ639831 | DENV | NS2B | EU482471 |
| DENV | NS2B | GU131849 | DENV | NS2B | EU482657 | DENV | NS2B | EU482644 |
| DENV | NS2B | GU131952 | DENV | NS2B | EU482674 | DENV | NS2B | FJ639833 |
| DENV | NS2B | GU131915 | DENV | NS2B | EU482753 | DENV | NS2B | EU482445 |
| DENV | NS2B | GQ868578 | DENV | NS2B | DQ645545 | DENV | NS2B | EU482606 |
| DENV | NS2B | GQ868548 | DENV | NS2B | FJ639835 | DENV | NS2B | FM210236 |
| DENV | NS2B | GU131913 | DENV | NS2B | FJ432726 | DENV | NS2B | EU482639 |
| DENV | NS2B | GU131940 | DENV | NS2B | EU482607 | DENV | NS2B | EU003591 |
| DENV | NS2B | FN429918 | DENV | NS2B | EU482660 | DENV | NS2B | EU482547 |
| DENV | NS2B | FN429905 | DENV | NS2B | EU482766 | DENV | NS2B | FJ478459 |
| DENV | NS2B | GU131907 | DENV | NS2B | AB189124 | DENV | NS2B | FJ639837 |
| DENV | NS2B | GU131860 | DENV | NS2B | AF100461 | DENV | NS2B | FJ390387 |
| DENV | NS2B | GU131954 | DENV | NS2B | EU482600 | DENV | NS2B | DQ645547 |
| DENV | NS2B | GU131856 | DENV | NS2B | EU687230 | DENV | NS2B | EU596496 |
| DENV | NS2B | GU131847 | DENV | NS2B | EU482633 | DENV | NS2B | EU482597 |
| DENV | NS2B | GU131909 | DENV | NS2B | EU482726 | DENV | NS2B | EU482463 |
| DENV | NS2B | GU131939 | DENV | NS2B | EU482557 | DENV | NS2B | EU482553 |
| DENV | NS2B | GU131912 | DENV | NS2B | EU482444 | DENV | NS2B | EU482548 |
| DENV | NS2B | GU131859 | DENV | NS2B | FJ205877 | DENV | NS2B | EU482641 |

FIG. 70-110

| Virus | Protein | Accession No. | Virus | Protein | Accession No. | Virus | Protein | Accession No. |
|---|---|---|---|---|---|---|---|---|
| DENV | NS2B | FJ639703 | DENV | NS2B | FJ410208 | DENV | NS2B | DQ645555 |
| DENV | NS2B | EU482647 | DENV | NS2B | EU569716 | DENV | NS2B | EU687231 |
| DENV | NS2B | EU596487 | DENV | NS2B | EU482786 | DENV | NS2B | EU660406 |
| DENV | NS2B | FJ639788 | DENV | NS2B | AF276619 | DENV | NS2B | EU687241 |
| DENV | NS2B | FM210206 | DENV | NS2B | EU482625 | DENV | NS2B | FJ639700 |
| DENV | NS2B | DQ645556 | DENV | NS2B | EU687248 | DENV | NS2B | FJ639711 |
| DENV | NS2B | AF169682 | DENV | NS2B | EU482662 | DENV | NS2B | U87412 |
| DENV | NS2B | AY858035 | DENV | NS2B | EU569708 | DENV | NS2B | EU482599 |
| DENV | NS2B | EU687220 | DENV | NS2B | FM210240 | DENV | NS2B | EU482654 |
| DENV | NS2B | EU482636 | DENV | NS2B | EU482777 | DENV | NS2B | EU569721 |
| DENV | NS2B | EU482650 | DENV | NS2B | FJ639705 | DENV | NS2B | FJ390385 |
| DENV | NS2B | EU482704 | DENV | NS2B | EU482669 | DENV | NS2B | EU482589 |
| DENV | NS2B | EU482661 | DENV | NS2B | DQ645553 | DENV | NS2B | EU482551 |
| DENV | NS2B | EU569699 | DENV | NS2B | FM210210 | DENV | NS2B | EU660400 |
| DENV | NS2B | EU482580 | DENV | NS2B | EF457904 | DENV | NS2B | EU482679 |
| DENV | NS2B | FM210215 | DENV | NS2B | FJ410237 | DENV | NS2B | AF204177 |
| DENV | NS2B | FJ639733 | DENV | NS2B | AY702035 | DENV | NS2B | FJ461311 |
| DENV | NS2B | EF105389 | DENV | NS2B | EU482757 | DENV | NS2B | EU569700 |
| DENV | NS2B | EF105384 | DENV | NS2B | EU596499 | DENV | NS2B | EU482737 |
| DENV | NS2B | EU677146 | DENV | NS2B | EU482543 | DENV | NS2B | EU482573 |
| DENV | NS2B | EU596498 | DENV | NS2B | EU687217 | DENV | NS2B | AY702040 |
| DENV | NS2B | FJ410288 | DENV | NS2B | EU482646 | DENV | NS2B | DQ181803 |
| DENV | NS2B | FJ373300 | DENV | NS2B | EU482746 | DENV | NS2B | EU482741 |
| DENV | NS2B | EU482702 | DENV | NS2B | FJ410217 | DENV | NS2B | EU660399 |
| DENV | NS2B | FJ205879 | DENV | NS2B | FJ639707 | DENV | NS2B | EU482784 |
| DENV | NS2B | EU569697 | DENV | NS2B | EU482637 | DENV | NS2B | EU482584 |
| DENV | NS2B | EU482691 | DENV | NS2B | EU482699 | DENV | NS2B | EU482670 |
| DENV | NS2B | FJ461309 | DENV | NS2B | EU482583 | DENV | NS2B | DQ181801 |
| DENV | NS2B | EU482608 | DENV | NS2B | FJ639717 | DENV | NS2B | EU482603 |
| DENV | NS2B | EU726776 | DENV | NS2B | EU687223 | DENV | NS2B | EU482769 |
| DENV | NS2B | EU081177 | DENV | NS2B | AY702036 | DENV | NS2B | FM210227 |
| DENV | NS2B | FM210213 | DENV | NS2B | EU482542 | DENV | NS2B | AY744147 |
| DENV | NS2B | EU854293 | DENV | NS2B | EU482587 | DENV | NS2B | EU482656 |
| DENV | NS2B | EU482632 | DENV | NS2B | EU482667 | DENV | NS2B | EU529706 |
| DENV | NS2B | FM210234 | DENV | NS2B | EU482695 | DENV | NS2B | EU687212 |
| DENV | NS2B | EU482745 | DENV | NS2B | EU569720 | DENV | NS2B | DQ645541 |
| DENV | NS2B | EU482593 | DENV | NS2B | AY702037 | DENV | NS2B | DQ181800 |
| DENV | NS2B | EU569718 | DENV | NS2B | AY858036 | DENV | NS2B | EU482721 |
| DENV | NS2B | EU482719 | DENV | NS2B | DQ645544 | DENV | NS2B | EU677145 |
| DENV | NS2B | EF051521 | DENV | NS2B | FJ639822 | DENV | NS2B | EU482450 |
| DENV | NS2B | FM210238 | DENV | NS2B | AF100466 | DENV | NS2B | EU482541 |
| DENV | NS2B | FJ478455 | DENV | NS2B | FJ410215 | DENV | NS2B | AF169688 |
| DENV | NS2B | AF100465 | DENV | NS2B | EU569705 | DENV | NS2B | M19197 |
| DENV | NS2B | EU529694 | DENV | NS2B | FM210241 | DENV | NS2B | EU482594 |
| DENV | NS2B | EU081178 | DENV | NS2B | FM210221 | DENV | NS2B | DQ645554 |
| DENV | NS2B | EU482676 | DENV | NS2B | EU687228 | DENV | NS2B | DQ181798 |
| DENV | NS2B | FJ639709 | DENV | NS2B | EU482703 | DENV | NS2B | AY702038 |
| DENV | NS2B | FM210208 | DENV | NS2B | EU529700 | DENV | NS2B | EU596495 |

FIG. 70-111

| Virus | Protein | Accession No. | Virus | Protein | Accession No. | Virus | Protein | Accession No. |
|---|---|---|---|---|---|---|---|---|
| DENV | NS2B | FM210245 | DENV | NS2B | EU687238 | DENV | NS2B | AB122020 |
| DENV | NS2B | FM210214 | DENV | NS2B | M84727 | DENV | NS2B | FM210244 |
| DENV | NS2B | EU482685 | DENV | NS2B | EU482763 | DENV | NS2B | AF100469 |
| DENV | NS2B | EU482570 | DENV | NS2B | EU482758 | DENV | NS2B | FJ410221 |
| DENV | NS2B | DQ645540 | DENV | NS2B | FJ639830 | DENV | NS2B | EU482626 |
| DENV | NS2B | EU660414 | DENV | NS2B | EU482754 | DENV | NS2B | EU482788 |
| DENV | NS2B | FJ024477 | DENV | NS2B | FM210218 | DENV | NS2B | FJ410219 |
| DENV | NS2B | AF100463 | DENV | NS2B | FJ410224 | DENV | NS2B | AF100462 |
| DENV | NS2B | DQ645546 | DENV | NS2B | FJ410193 | DENV | NS2B | EU482696 |
| DENV | NS2B | EU569703 | DENV | NS2B | EU056811 | DENV | NS2B | EU482544 |
| DENV | NS2B | EU482652 | DENV | NS2B | EU482774 | DENV | NS2B | EU482640 |
| DENV | NS2B | EU596490 | DENV | NS2B | EU482568 | DENV | NS2B | FJ182012 |
| DENV | NS2B | EU482693 | DENV | NS2B | EU482588 | DENV | NS2B | DQ645548 |
| DENV | NS2B | EU482734 | DENV | NS2B | EU482475 | DENV | NS2B | FJ639701 |
| DENV | NS2B | FM210202 | DENV | NS2B | AF489932 | DENV | NS2B | EU482655 |
| DENV | NS2B | EU482729 | DENV | NS2B | FM210211 | DENV | NS2B | AB189122 |
| DENV | NS2B | AF169680 | DENV | NS2B | EU687246 | DENV | NS2B | DQ181804 |
| DENV | NS2B | EU482623 | DENV | NS2B | FJ390389 | DENV | NS2B | EU482732 |
| DENV | NS2B | EU569693 | DENV | NS2B | EU482464 | DENV | NS2B | DQ645543 |
| DENV | NS2B | EU482590 | DENV | NS2B | EU482697 | DENV | NS2B | FJ639832 |
| DENV | NS2B | FJ639834 | DENV | NS2B | EU482765 | DENV | NS2B | FJ226066 |
| DENV | NS2B | EU482449 | DENV | NS2B | FM210209 | DENV | NS2B | AF169687 |
| DENV | NS2B | EU687237 | DENV | NS2B | EU482474 | DENV | NS2B | EU482752 |
| DENV | NS2B | EF105381 | DENV | NS2B | EU596484 | DENV | NS2B | EU482783 |
| DENV | NS2B | EU482578 | DENV | NS2B | EU677138 | DENV | NS2B | EU482742 |
| DENV | NS2B | EU482781 | DENV | NS2B | EU621672 | DENV | NS2B | FJ461314 |
| DENV | NS2B | EU596485 | DENV | NS2B | AF359579 | DENV | NS2B | EU482688 |
| DENV | NS2B | EU687224 | DENV | NS2B | EU482645 | DENV | NS2B | DQ181802 |
| DENV | NS2B | FJ461321 | DENV | NS2B | EU482760 | DENV | NS2B | FJ639809 |
| DENV | NS2B | FJ390390 | DENV | NS2B | FJ639732 | DENV | NS2B | EU482701 |
| DENV | NS2B | EU482562 | DENV | NS2B | FM210229 | DENV | NS2B | AF204178 |
| DENV | NS2B | EF105390 | DENV | NS2B | EU482684 | DENV | NS2B | FJ639706 |
| DENV | NS2B | EU482782 | DENV | NS2B | EF105378 | DENV | NS2B | EU482550 |
| DENV | NS2B | EU482682 | DENV | NS2B | EU482681 | DENV | NS2B | EU482605 |
| DENV | NS2B | EU056810 | DENV | NS2B | FJ547090 | DENV | NS2B | EU482554 |
| DENV | NS2B | EU687236 | DENV | NS2B | EU482447 | DENV | NS2B | EU482692 |
| DENV | NS2B | EU482448 | DENV | NS2B | EU482624 | DENV | NS2B | EU482680 |
| DENV | NS2B | FJ639698 | DENV | NS2B | AF119661 | DENV | NS2B | AF169683 |
| DENV | NS2B | EU482630 | DENV | NS2B | EU660413 | DENV | NS2B | FJ024458 |
| DENV | NS2B | EU359009 | DENV | NS2B | AF169685 | DENV | NS2B | EU482780 |
| DENV | NS2B | EU482768 | DENV | NS2B | EU482771 | DENV | NS2B | EU482750 |
| DENV | NS2B | EU482672 | DENV | NS2B | EU482604 | DENV | NS2B | EU179857 |
| DENV | NS2B | EU569711 | DENV | NS2B | FJ410223 | DENV | NS2B | EU569698 |
| DENV | NS2B | EU482627 | DENV | NS2B | EU482739 | DENV | NS2B | EU482571 |
| DENV | NS2B | EU569715 | DENV | NS2B | EU687243 | DENV | NS2B | EU081179 |
| DENV | NS2B | EU482678 | DENV | NS2B | EU482720 | DENV | NS2B | EU482690 |
| DENV | NS2B | DQ181799 | DENV | NS2B | EU482730 | DENV | NS2B | EU687215 |
| DENV | NS2B | EU687235 | DENV | NS2B | EU482779 | DENV | NS2B | EU482664 |

FIG. 70-112

| Virus | Protein | Accession No. | Virus | Protein | Accession No. | Virus | Protein | Accession No. |
|---|---|---|---|---|---|---|---|---|
| DENV | NS2B | DQ181797 | DENV | NS2B | EU482728 | DENV | NS2B | EU677149 |
| DENV | NS2B | EU569701 | DENV | NS2B | EU596500 | DENV | NS2B | EU569719 |
| DENV | NS2B | EU482773 | DENV | NS2B | EU482671 | DENV | NS2B | EU482778 |
| DENV | NS2B | EU482722 | DENV | NS2B | EU179859 | DENV | NS2B | DQ645551 |
| DENV | NS2B | EU482635 | DENV | NS2B | EU482705 | DENV | NS2B | EU482689 |
| DENV | NS2B | DQ645549 | DENV | NS2B | EU482552 | DENV | NS2B | EU726770 |
| DENV | NS2B | EU482629 | DENV | NS2B | EU482546 | DENV | NS2B | AB122022 |
| DENV | NS2B | EU596488 | DENV | NS2B | EU482642 | DENV | NS2B | FJ639697 |
| DENV | NS2B | FJ639836 | DENV | NS2B | EU482579 | DENV | NS2B | EU482628 |
| DENV | NS2B | EU482733 | DENV | NS2B | M20558 | DENV | NS2B | EU687232 |
| DENV | NS2B | EU677143 | DENV | NS2B | EU482775 | DENV | NS2B | FM210225 |
| DENV | NS2B | EU482653 | DENV | NS2B | EU596491 | DENV | NS2B | AY037116 |
| DENV | NS2B | AF208496 | DENV | NS2B | FJ639708 | DENV | NS2B | FJ205878 |
| DENV | NS2B | EU482565 | DENV | NS2B | FM210220 | DENV | NS2B | AY702034 |
| DENV | NS2B | EU482598 | DENV | NS2B | EU569717 | DENV | NS2B | FM210232 |
| DENV | NS2B | M29095 | DENV | NS2B | EF105379 | DENV | NS2B | AY702039 |
| DENV | NS2B | EU660415 | DENV | NS2B | EU569712 | DENV | NS2B | EU687245 |
| DENV | NS2B | FM210239 | DENV | NS2B | EU482755 | DENV | NS2B | EU482465 |
| DENV | NS2B | EU687213 | DENV | NS2B | DQ181805 | DENV | NS2B | EU482472 |
| DENV | NS2B | EU677144 | DENV | NS2B | FM210207 | DENV | NS2B | EU569714 |
| DENV | NS2B | FM210243 | DENV | NS2B | FM210233 | DENV | NS2B | EU569692 |
| DENV | NS2B | AF100459 | DENV | NS2B | EU687199 | DENV | NS2B | FJ410233 |
| DENV | NS2B | EU482466 | DENV | NS2B | EU482686 | DENV | NS2B | AF100467 |
| DENV | NS2B | FM210230 | DENV | NS2B | FJ205880 | DENV | NS2B | EU677148 |
| DENV | NS2B | FJ410200 | DENV | NS2B | AY776328 | DENV | NS2B | EF105380 |
| DENV | NS2B | DQ645552 | DENV | NS2B | EU482675 | DENV | NS2B | EU482677 |
| DENV | NS2B | EU482574 | DENV | NS2B | EU660417 | DENV | NS2B | AF100468 |
| DENV | NS2B | EU482622 | DENV | NS2B | EU482727 | DENV | NS2B | EU482569 |
| DENV | NS2B | EU482561 | DENV | NS2B | EU482602 | DENV | NS2B | DQ645542 |
| DENV | NS2B | EU596486 | DENV | NS2B | EU482577 | DENV | NS2B | EU482643 |
| DENV | NS2B | EU569695 | DENV | NS2B | EU482756 | DENV | NS2B | EU482694 |
| DENV | NS2B | FJ024461 | DENV | NS2B | EU529701 | DENV | NS2B | EU482724 |
| DENV | NS2B | EU569713 | DENV | NS2B | FJ639702 | DENV | NS2B | EU482446 |
| DENV | NS2B | FM210224 | DENV | NS2B | EU482772 | DENV | NS2B | FM210226 |
| DENV | NS2B | EU482556 | DENV | NS2B | FM210246 | DENV | NS2B | EU482744 |
| DENV | NS2B | EU482731 | DENV | NS2B | FJ390391 | DENV | NS2B | EU677137 |
| DENV | NS2B | EU179858 | DENV | NS2B | AF100464 | DENV | NS2B | EU482770 |
| DENV | NS2B | EU781135 | DENV | NS2B | FJ547067 | DENV | NS2B | AF038403 |
| DENV | NS2B | EU482743 | DENV | NS2B | EF105386 | DENV | NS2B | EU660398 |
| DENV | NS2B | EU482751 | DENV | NS2B | EF105387 | DENV | NS2B | EU569709 |
| DENV | NS2B | FJ410259 | DENV | NS2B | EU726775 | DENV | NS2B | FM210237 |
| DENV | NS2B | EU482747 | DENV | NS2B | FJ639704 | DENV | NS2B | EU660416 |
| DENV | NS2B | EU687225 | DENV | NS2B | AF169678 | DENV | NS2B | EU677142 |
| DENV | NS2B | FJ639718 | DENV | NS2B | EU482749 | DENV | NS2B | EU482700 |
| DENV | NS2B | EU569707 | DENV | NS2B | EU482631 | DENV | NS2B | EU482545 |
| DENV | NS2B | EU677147 | DENV | NS2B | EF105388 | DENV | NS2B | EU482585 |
| DENV | NS2B | FM210223 | DENV | NS2B | AB189123 | DENV | NS2B | FJ024475 |
| DENV | NS2B | EU081180 | DENV | NS2B | EU482663 | DENV | NS2B | EU482725 |

FIG. 70-113

| Virus | Protein | Accession No. | Virus | Protein | Accession No. | Virus | Protein | Accession No. |
|---|---|---|---|---|---|---|---|---|
| DENV | NS2B | EU482687 | DENV | NS2B | FM210219 | DENV | NS2B | GQ252676 |
| DENV | NS2B | EU529693 | DENV | NS2B | EU482723 | DENV | NS2B | FJ850065 |
| DENV | NS2B | FJ390384 | DENV | NS2B | FJ639829 | DENV | NS2B | FJ898477 |
| DENV | NS2B | EU482560 | DENV | NS2B | EU482575 | DENV | NS2B | FJ850116 |
| DENV | NS2B | EU482761 | DENV | NS2B | AF038402 | DENV | NS2B | FJ898454 |
| DENV | NS2B | EU482638 | DENV | NS2B | FJ639783 | DENV | NS2B | GQ199897 |
| DENV | NS2B | EU482698 | DENV | NS2B | EU482572 | DENV | NS2B | GQ199899 |
| DENV | NS2B | EU482764 | DENV | NS2B | FJ639734 | DENV | NS2B | FJ744723 |
| DENV | NS2B | FJ182014 | DENV | NS2B | EU482762 | DENV | NS2B | GQ199900 |
| DENV | NS2B | EU482776 | DENV | NS2B | EU569704 | DENV | NS2B | FJ850082 |
| DENV | NS2B | DQ645550 | DENV | NS2B | EU482759 | DENV | NS2B | FJ744715 |
| DENV | NS2B | FJ024473 | DENV | NS2B | EU056812 | DENV | NS2B | FJ744709 |
| DENV | NS2B | DQ181806 | DENV | NS2B | FJ410228 | DENV | NS2B | GQ199868 |
| DENV | NS2B | FJ461305 | DENV | NS2B | EU482467 | DENV | NS2B | FJ906960 |
| DENV | NS2B | FJ024452 | DENV | NS2B | FM210217 | DENV | NS2B | FJ882602 |
| DENV | NS2B | EU677141 | DENV | NS2B | FM210212 | DENV | NS2B | GQ199895 |
| DENV | NS2B | FJ639828 | DENV | NS2B | EU660405 | DENV | NS2B | FJ687436 |
| DENV | NS2B | EU569706 | DENV | NS2B | FJ547064 | DENV | NS2B | FJ744725 |
| DENV | NS2B | EU482666 | DENV | NS2B | EU482740 | DENV | NS2B | FJ850117 |
| DENV | NS2B | EU482673 | DENV | NS2B | EU482451 | DENV | NS2B | FJ687441 |
| DENV | NS2B | FJ024474 | DENV | NS2B | EU482668 | DENV | NS2B | FJ744706 |
| DENV | NS2B | EU687214 | DENV | NS2B | EU687229 | DENV | NS2B | FJ850074 |
| DENV | NS2B | FJ410291 | DENV | NS2B | AF169684 | DENV | NS2B | FJ850085 |
| DENV | NS2B | FM210242 | DENV | NS2B | FM210235 | DENV | NS2B | FJ850061 |
| DENV | NS2B | EU687250 | DENV | NS2B | GQ199874 | DENV | NS2B | FJ810409 |
| DENV | NS2B | EU482735 | DENV | NS2B | FJ744745 | DENV | NS2B | FJ687434 |
| DENV | NS2B | EU482785 | DENV | NS2B | FJ898467 | DENV | NS2B | GQ199890 |
| DENV | NS2B | EU596483 | DENV | NS2B | FJ687444 | DENV | NS2B | FJ744743 |
| DENV | NS2B | EU569702 | DENV | NS2B | FJ810411 | DENV | NS2B | FJ850063 |
| DENV | NS2B | FJ410241 | DENV | NS2B | FJ850067 | DENV | NS2B | FJ898466 |
| DENV | NS2B | EU482659 | DENV | NS2B | FJ850121 | DENV | NS2B | FJ850119 |
| DENV | NS2B | FM210203 | DENV | NS2B | FJ898452 | DENV | NS2B | FJ898432 |
| DENV | NS2B | EU482581 | DENV | NS2B | FJ744713 | DENV | NS2B | FJ744718 |
| DENV | NS2B | EU569696 | DENV | NS2B | FJ810418 | DENV | NS2B | FJ810412 |
| DENV | NS2B | FJ562098 | DENV | NS2B | FJ906962 | DENV | NS2B | FJ906956 |
| DENV | NS2B | FM210222 | DENV | NS2B | FJ744721 | DENV | NS2B | FJ850064 |
| DENV | NS2B | EU482473 | DENV | NS2B | FJ850107 | DENV | NS2B | GQ199892 |
| DENV | NS2B | EU854294 | DENV | NS2B | FJ467493 | DENV | NS2B | FJ898436 |
| DENV | NS2B | EU482649 | DENV | NS2B | FJ906966 | DENV | NS2B | FJ906957 |
| DENV | NS2B | EU726767 | DENV | NS2B | FJ687446 | DENV | NS2B | FJ898478 |
| DENV | NS2B | FJ024454 | DENV | NS2B | FJ906958 | DENV | NS2B | FJ873811 |
| DENV | NS2B | FJ639699 | DENV | NS2B | FJ687435 | DENV | NS2B | GQ199898 |
| DENV | NS2B | FM210204 | DENV | NS2B | FJ850054 | DENV | NS2B | FJ850115 |
| DENV | NS2B | EU529695 | DENV | NS2B | FJ906967 | DENV | NS2B | FJ687442 |
| DENV | NS2B | EU687222 | DENV | NS2B | FJ850072 | DENV | NS2B | FJ687439 |
| DENV | NS2B | EF105382 | DENV | NS2B | FJ898439 | DENV | NS2B | FJ432724 |
| DENV | NS2B | EU482738 | DENV | NS2B | FJ850088 | DENV | NS2B | FJ687447 |
| DENV | NS2B | EF105385 | DENV | NS2B | FJ898435 | DENV | NS2B | FJ873808 |

FIG. 70-114

| Virus | Protein | Accession No. | Virus | Protein | Accession No. | Virus | Protein | Accession No. |
|---|---|---|---|---|---|---|---|---|
| DENV | NS2B | DQ448231 | DENV | NS2B | FJ744714 | DENV | NS2B | GQ868638 |
| DENV | NS2B | FJ744710 | DENV | NS2B | GQ199866 | DENV | NS2B | GQ868553 |
| DENV | NS2B | GQ252677 | DENV | NS2B | GQ199894 | DENV | NS2B | GQ868646 |
| DENV | NS2B | NC_001474 | DENV | NS2B | FJ687440 | DENV | NS2B | FN429891 |
| DENV | NS2B | FJ687445 | DENV | NS2B | FJ850112 | DENV | NS2B | GQ868604 |
| DENV | NS2B | FJ850091 | DENV | NS2B | FJ850078 | DENV | NS2B | GU131947 |
| DENV | NS2B | FJ687443 | DENV | NS2B | FJ744717 | DENV | NS2B | GU131928 |
| DENV | NS2B | GQ199869 | DENV | NS2B | FJ906968 | DENV | NS2B | GQ868497 |
| DENV | NS2B | FJ850105 | DENV | NS2B | GQ199893 | DENV | NS2B | GQ868603 |
| DENV | NS2B | FJ850051 | DENV | NS2B | FJ744711 | DENV | NS2B | GQ868621 |
| DENV | NS2B | FJ850050 | DENV | NS2B | FJ744704 | DENV | NS2B | AB479042 |
| DENV | NS2B | FJ744719 | DENV | NS2B | FJ744720 | DENV | NS2B | GQ868620 |
| DENV | NS2B | FJ898453 | DENV | NS2B | GQ199901 | DENV | NS2B | GQ868590 |
| DENV | NS2B | FJ898460 | DENV | NS2B | FJ744724 | DENV | NS2B | FN429892 |
| DENV | NS2B | FJ898438 | DENV | NS2B | FJ850120 | DENV | NS2B | GQ868554 |
| DENV | NS2B | FJ850053 | DENV | NS2B | FJ850118 | DENV | NS2B | GU131974 |
| DENV | NS2B | FJ898450 | DENV | NS2B | FJ850076 | DENV | NS2B | GU131843 |
| DENV | NS2B | FJ744708 | DENV | NS2B | AF022436 | DENV | NS2B | GQ868641 |
| DENV | NS2B | GQ199896 | DENV | NS2B | AF022439 | DENV | NS2B | GQ868542 |
| DENV | NS2B | FJ744722 | DENV | NS2B | AF022441 | DENV | NS2B | GQ868555 |
| DENV | NS2B | FJ850062 | DENV | NS2B | AF022437 | DENV | NS2B | FN429894 |
| DENV | NS2B | FJ898461 | DENV | NS2B | AJ487271 | DENV | NS2B | GQ868549 |
| DENV | NS2B | FJ810410 | DENV | NS2B | AF022435 | DENV | NS2B | GQ868588 |
| DENV | NS2B | FJ850060 | DENV | NS2B | AF022434 | DENV | NS2B | GQ868541 |
| DENV | NS2B | FJ906961 | DENV | NS2B | AF022438 | DENV | NS2B | GQ868558 |
| DENV | NS2B | FJ882593 | DENV | NS2B | AF022440 | DENV | NS2B | GQ868625 |
| DENV | NS2B | FJ898479 | DENV | NS2B | CS479165 | DENV | NS2B | GQ868624 |
| DENV | NS2B | FJ744703 | DENV | NS2B | GQ868556 | DENV | NS2B | GQ868631 |
| DENV | NS2B | FJ744712 | DENV | NS2B | AB479041 | DENV | NS2B | GU131899 |
| DENV | NS2B | FJ882594 | DENV | NS2B | GU289914 | DENV | NS2B | GQ868515 |
| DENV | NS2B | FJ744716 | DENV | NS2B | GU131884 | DENV | NS2B | GU131898 |
| DENV | NS2B | FJ850066 | DENV | NS2B | GQ868600 | DENV | NS2B | GQ868623 |
| DENV | NS2B | FJ744744 | DENV | NS2B | FN429895 | DENV | NS2B | GU131886 |
| DENV | NS2B | FJ850108 | DENV | NS2B | GU131879 | DENV | NS2B | GQ868622 |
| DENV | NS2B | FJ859028 | DENV | NS2B | GQ868596 | DENV | NS2B | GQ868595 |
| DENV | NS2B | FJ898465 | DENV | NS2B | GQ868516 | DENV | NS2B | GQ868557 |
| DENV | NS2B | FJ898451 | DENV | NS2B | GU131864 | DENV | NS2B | GU131959 |
| DENV | NS2B | FJ898449 | DENV | NS2B | FN429893 | DENV | NS2B | GU131955 |
| DENV | NS2B | FJ744705 | DENV | NS2B | GQ868598 | DENV | NS2B | GQ868597 |
| DENV | NS2B | FJ898434 | DENV | NS2B | GQ868544 | DENV | NS2B | GU131883 |
| DENV | NS2B | FJ906969 | DENV | NS2B | GQ868589 | DENV | NS2B | GQ868591 |
| DENV | NS2B | FJ744741 | DENV | NS2B | GQ868551 | DENV | NS2B | GQ868543 |
| DENV | NS2B | FJ906959 | DENV | NS2B | GU131902 | DENV | NS2B | GU131901 |
| DENV | NS2B | FJ850106 | DENV | NS2B | GU131896 | DENV | NS2B | GQ868545 |
| DENV | NS2B | FJ744742 | DENV | NS2B | GU131924 | DENV | NS2B | GU131931 |
| DENV | NS2B | FJ687437 | DENV | NS2B | GQ868640 | DENV | NS2B | GU131885 |
| DENV | NS2B | FJ744707 | DENV | NS2B | GU131880 | DENV | NS2B | GU131932 |
| DENV | NS2B | FJ687438 | DENV | NS2B | GU131882 | DENV | NS2B | GU131881 |

FIG. 70-115

| Virus | Protein | Accession No. | Virus | Protein | Accession No. | Virus | Protein | Accession No. |
|---|---|---|---|---|---|---|---|---|
| DENV | NS2B | GU131897 | DENV | NS3 | FJ639693 | DENV | NS3 | DQ285560 |
| DENV | NS2B | GQ868592 | DENV | NS3 | FJ461317 | DENV | NS3 | FJ182002 |
| DENV | NS2B | GQ868552 | DENV | NS3 | FJ384655 | DENV | NS3 | EU677177 |
| DENV | NS2B | GU131900 | DENV | NS3 | EU482508 | DENV | NS3 | FJ639680 |
| DENV | NS2B | GQ868599 | DENV | NS3 | AF311958 | DENV | NS3 | EU677160 |
| DENV | NS2B | GU131929 | DENV | NS3 | FJ024451 | DENV | NS3 | AY835999 |
| DENV | NS2B | GU131930 | DENV | NS3 | EU482528 | DENV | NS3 | EU249494 |
| DENV | NS2B | GQ868550 | DENV | NS3 | EU482821 | DENV | NS3 | AF226687 |
| DENV | NS2B | GU131975 | DENV | NS3 | FJ410267 | DENV | NS3 | FJ024432 |
| DENV | NS2B | GU131927 | DENV | NS3 | AB074761 | DENV | NS3 | EU081229 |
| DENV | NS2B | GQ868540 | DENV | NS3 | AY762084 | DENV | NS3 | FJ410184 |
| DENV | NS2B | FJ410202 | DENV | NS3 | AY732480 | DENV | NS3 | FJ182022 |
| DENV | NS2B | CS479202 | DENV | NS3 | EU482481 | DENV | NS3 | EU677153 |
| DENV | NS2B | U87411 | DENV | NS3 | FJ410232 | DENV | NS3 | DQ672559 |
| DENV | NS2B | CS479203 | DENV | NS3 | EU081254 | DENV | NS3 | EU081234 |
| DENV | NS2B | CS479204 | DENV | NS3 | EU482806 | DENV | NS3 | FJ639802 |
| DENV | NS2B | CS479167 | DENV | NS3 | FJ410257 | DENV | NS3 | EU482483 |
| DENV | NS2B | CS479205 | DENV | NS3 | FJ432720 | DENV | NS3 | FJ024445 |
| DENV | NS2B | CS479206 | DENV | NS3 | FJ547089 | DENV | NS3 | FJ410236 |
| DENV | NS2B | CS805344 | DENV | NS3 | EU482819 | DENV | NS3 | FJ410242 |
| DENV | NS2B | FB730117 | DENV | NS3 | EU081270 | DENV | NS3 | FJ390378 |
| DENV | NS2B | DL138662 | DENV | NS3 | FJ205875 | DENV | NS3 | EU081236 |
| DENV | NS2B | GM059692 | DENV | NS3 | FJ410210 | DENV | NS3 | EU081278 |
| DENV | NS2B | AY243468 | DENV | NS3 | FJ205884 | DENV | NS3 | FJ432736 |
| DENV | NS2B | AY243469 | DENV | NS3 | FJ176780 | DENV | NS3 | FJ639694 |
| DENV | NS2B | AY744148 | DENV | NS3 | FJ461340 | DENV | NS3 | EU482500 |
| DENV | NS2B | AY744149 | DENV | NS3 | AY732475 | DENV | NS3 | DQ672560 |
| DENV | NS2B | AY744150 | DENV | NS3 | AY732474 | DENV | NS3 | AY713473 |
| DENV | NS2B | AJ968413 | DENV | NS3 | FJ024435 | DENV | NS3 | EU726780 |
| DENV | NS2B | GU369819 | DENV | NS3 | FJ639669 | DENV | NS3 | FJ410255 |
| DENV | NS2B | GU370050 | DENV | NS3 | EU482540 | DENV | NS3 | FJ373298 |
| DENV | NS2B | GU370051 | DENV | NS3 | FJ024429 | DENV | NS3 | EU081276 |
| DENV | NS3 | AY277665 | DENV | NS3 | EU677167 | DENV | NS3 | FJ410198 |
| DENV | NS3 | AY713474 | DENV | NS3 | EU482512 | DENV | NS3 | EU482536 |
| DENV | NS3 | AF311957 | DENV | NS3 | FJ390381 | DENV | NS3 | FJ390382 |
| DENV | NS3 | FJ205881 | DENV | NS3 | FJ410226 | DENV | NS3 | FJ024462 |
| DENV | NS3 | EU482817 | DENV | NS3 | FJ410191 | DENV | NS3 | EU482822 |
| DENV | NS3 | DQ672557 | DENV | NS3 | AJ968413 | DENV | NS3 | FJ024447 |
| DENV | NS3 | EU677151 | DENV | NS3 | FJ639689 | DENV | NS3 | FJ410274 |
| DENV | NS3 | FJ410256 | DENV | NS3 | AY277664 | DENV | NS3 | FJ410216 |
| DENV | NS3 | FJ432735 | DENV | NS3 | FJ639811 | DENV | NS3 | EU482527 |
| DENV | NS3 | EU660390 | DENV | NS3 | FJ639695 | DENV | NS3 | EU280167 |
| DENV | NS3 | EU482824 | DENV | NS3 | EU081226 | DENV | NS3 | EU482567 |
| DENV | NS3 | FJ410222 | DENV | NS3 | FJ410280 | DENV | NS3 | EU081265 |
| DENV | NS3 | AY726551 | DENV | NS3 | EU596504 | DENV | NS3 | EU482489 |
| DENV | NS3 | EU482716 | DENV | NS3 | FJ639685 | DENV | NS3 | AB178040 |
| DENV | NS3 | AF226685 | DENV | NS3 | EU482715 | DENV | NS3 | EU482827 |
| DENV | NS3 | EU677174 | DENV | NS3 | FJ410227 | DENV | NS3 | FJ024455 |

FIG. 70-116

| Virus | Protein | Accession No. | Virus | Protein | Accession No. | Virus | Protein | Accession No. |
|---|---|---|---|---|---|---|---|---|
| DENV | NS3 | EU081238 | DENV | NS3 | FJ024463 | DENV | NS3 | AY277666 |
| DENV | NS3 | FJ410245 | DENV | NS3 | FJ410275 | DENV | NS3 | FJ024483 |
| DENV | NS3 | FJ461318 | DENV | NS3 | FJ410234 | DENV | NS3 | DQ193572 |
| DENV | NS3 | FJ410263 | DENV | NS3 | EU482487 | DENV | NS3 | EF122231 |
| DENV | NS3 | FJ410269 | DENV | NS3 | FJ410182 | DENV | NS3 | EU081266 |
| DENV | NS3 | FJ410289 | DENV | NS3 | EU482812 | DENV | NS3 | EU482818 |
| DENV | NS3 | FJ639692 | DENV | NS3 | EU081247 | DENV | NS3 | FJ410186 |
| DENV | NS3 | EU660397 | DENV | NS3 | AB074760 | DENV | NS3 | EU249493 |
| DENV | NS3 | EU482477 | DENV | NS3 | EU482802 | DENV | NS3 | FJ024478 |
| DENV | NS3 | FJ024434 | DENV | NS3 | EU677172 | DENV | NS3 | FJ205874 |
| DENV | NS3 | FJ410204 | DENV | NS3 | EU482496 | DENV | NS3 | EU482791 |
| DENV | NS3 | EU249495 | DENV | NS3 | EU726777 | DENV | NS3 | EU482798 |
| DENV | NS3 | AF513110 | DENV | NS3 | U88535 | DENV | NS3 | EU081248 |
| DENV | NS3 | FJ024438 | DENV | NS3 | EU482519 | DENV | NS3 | EU596501 |
| DENV | NS3 | EU081264 | DENV | NS3 | FJ461339 | DENV | NS3 | FJ461336 |
| DENV | NS3 | EU482525 | DENV | NS3 | FJ562101 | DENV | NS3 | FJ024457 |
| DENV | NS3 | EU687251 | DENV | NS3 | FJ461316 | DENV | NS3 | EU482485 |
| DENV | NS3 | EU482486 | DENV | NS3 | EU482814 | DENV | NS3 | FJ176779 |
| DENV | NS3 | DQ285558 | DENV | NS3 | AY726555 | DENV | NS3 | EU482799 |
| DENV | NS3 | FJ205883 | DENV | NS3 | FJ639677 | DENV | NS3 | EU081233 |
| DENV | NS3 | AY145121 | DENV | NS3 | EU482506 | DENV | NS3 | EU482497 |
| DENV | NS3 | AY732478 | DENV | NS3 | FJ410283 | DENV | NS3 | EU482616 |
| DENV | NS3 | FJ410199 | DENV | NS3 | FJ639696 | DENV | NS3 | EU482507 |
| DENV | NS3 | FJ390383 | DENV | NS3 | FJ410235 | DENV | NS3 | EU482809 |
| DENV | NS3 | EU482592 | DENV | NS3 | EU482532 | DENV | NS3 | FJ410262 |
| DENV | NS3 | FJ182030 | DENV | NS3 | FJ182031 | DENV | NS3 | FJ024480 |
| DENV | NS3 | FJ024431 | DENV | NS3 | FJ024428 | DENV | NS3 | EU482495 |
| DENV | NS3 | FJ024450 | DENV | NS3 | FJ432749 | DENV | NS3 | FJ182032 |
| DENV | NS3 | FJ410252 | DENV | NS3 | DQ285561 | DENV | NS3 | FJ410197 |
| DENV | NS3 | FJ478457 | DENV | NS3 | EU482518 | DENV | NS3 | AF514883 |
| DENV | NS3 | EU596502 | DENV | NS3 | EU726779 | DENV | NS3 | FJ461330 |
| DENV | NS3 | FJ410201 | DENV | NS3 | EU677161 | DENV | NS3 | FJ639690 |
| DENV | NS3 | FJ562105 | DENV | NS3 | AY145123 | DENV | NS3 | FJ410209 |
| DENV | NS3 | FJ639684 | DENV | NS3 | EU482800 | DENV | NS3 | EU482514 |
| DENV | NS3 | FJ639682 | DENV | NS3 | AY732482 | DENV | NS3 | EU848545 |
| DENV | NS3 | FJ410240 | DENV | NS3 | EU482517 | DENV | NS3 | EU249492 |
| DENV | NS3 | EU081279 | DENV | NS3 | EU482488 | DENV | NS3 | EU081240 |
| DENV | NS3 | EU081231 | DENV | NS3 | FJ373305 | DENV | NS3 | EU482499 |
| DENV | NS3 | FJ410214 | DENV | NS3 | FJ432746 | DENV | NS3 | FJ410281 |
| DENV | NS3 | FJ182036 | DENV | NS3 | FJ432734 | DENV | NS3 | FJ410270 |
| DENV | NS3 | FJ182023 | DENV | NS3 | EU482797 | DENV | NS3 | EU482808 |
| DENV | NS3 | EU482479 | DENV | NS3 | EU482711 | DENV | NS3 | EU081281 |
| DENV | NS3 | FJ547087 | DENV | NS3 | FJ024459 | DENV | NS3 | AF309641 |
| DENV | NS3 | FJ639683 | DENV | NS3 | FJ410174 | DENV | NS3 | EU677159 |
| DENV | NS3 | FJ024442 | DENV | NS3 | EU596503 | DENV | NS3 | EU482526 |
| DENV | NS3 | FJ410285 | DENV | NS3 | FJ432730 | DENV | NS3 | FJ024427 |
| DENV | NS3 | EU482615 | DENV | NS3 | EU081227 | DENV | NS3 | EU482618 |
| DENV | NS3 | AY732476 | DENV | NS3 | EU677163 | DENV | NS3 | AF350498 |

FIG. 70-117

| Virus | Protein | Accession No. | Virus | Protein | Accession No. | Virus | Protein | Accession No. |
|---|---|---|---|---|---|---|---|---|
| DENV | NS3 | EU677169 | DENV | NS3 | EU081252 | DENV | NS3 | EU482513 |
| DENV | NS3 | EU482828 | DENV | NS3 | EU482706 | DENV | NS3 | FJ410196 |
| DENV | NS3 | EU482537 | DENV | NS3 | AY726553 | DENV | NS3 | FJ410250 |
| DENV | NS3 | EU726782 | DENV | NS3 | FJ205882 | DENV | NS3 | EU660392 |
| DENV | NS3 | FJ410225 | DENV | NS3 | FJ390386 | DENV | NS3 | FJ461313 |
| DENV | NS3 | FJ410180 | DENV | NS3 | EU677139 | DENV | NS3 | EU677168 |
| DENV | NS3 | FJ024460 | DENV | NS3 | FJ410260 | DENV | NS3 | FJ432723 |
| DENV | NS3 | FJ410231 | DENV | NS3 | EU677170 | DENV | NS3 | FJ410181 |
| DENV | NS3 | FJ390380 | DENV | NS3 | EU081256 | DENV | NS3 | FJ410239 |
| DENV | NS3 | FJ410238 | DENV | NS3 | FJ024443 | DENV | NS3 | EU482480 |
| DENV | NS3 | FJ390379 | DENV | NS3 | FJ410278 | DENV | NS3 | AY206457 |
| DENV | NS3 | AF311956 | DENV | NS3 | FJ432744 | DENV | NS3 | EU482523 |
| DENV | NS3 | EU081257 | DENV | NS3 | AB189120 | DENV | NS3 | FJ410290 |
| DENV | NS3 | FJ432721 | DENV | NS3 | FJ461327 | DENV | NS3 | DQ672562 |
| DENV | NS3 | FJ639672 | DENV | NS3 | EU660391 | DENV | NS3 | EU482521 |
| DENV | NS3 | FJ639794 | DENV | NS3 | FJ562106 | DENV | NS3 | EU660402 |
| DENV | NS3 | EU660403 | DENV | NS3 | FJ182035 | DENV | NS3 | FJ461307 |
| DENV | NS3 | EU482619 | DENV | NS3 | FJ461306 | DENV | NS3 | EU081272 |
| DENV | NS3 | EU677155 | DENV | NS3 | EU482510 | DENV | NS3 | FJ461315 |
| DENV | NS3 | FJ182021 | DENV | NS3 | FJ024440 | DENV | NS3 | FJ410188 |
| DENV | NS3 | EU482712 | DENV | NS3 | EU081258 | DENV | NS3 | AY713475 |
| DENV | NS3 | EU482591 | DENV | NS3 | EU081268 | DENV | NS3 | AY732479 |
| DENV | NS3 | FJ410253 | DENV | NS3 | EU677178 | DENV | NS3 | EU677156 |
| DENV | NS3 | EF032590 | DENV | NS3 | FJ410276 | DENV | NS3 | EU482707 |
| DENV | NS3 | EU081243 | DENV | NS3 | EU081273 | DENV | NS3 | EU482811 |
| DENV | NS3 | FJ639818 | DENV | NS3 | EU482820 | DENV | NS3 | AF226686 |
| DENV | NS3 | EU081237 | DENV | NS3 | AF514878 | DENV | NS3 | EU081235 |
| DENV | NS3 | AF514876 | DENV | NS3 | EU660394 | DENV | NS3 | EU660419 |
| DENV | NS3 | FJ639688 | DENV | NS3 | FJ410218 | DENV | NS3 | FJ547068 |
| DENV | NS3 | EU482713 | DENV | NS3 | EU081241 | DENV | NS3 | AB189121 |
| DENV | NS3 | EU677154 | DENV | NS3 | FJ410244 | DENV | NS3 | FJ461308 |
| DENV | NS3 | EU081242 | DENV | NS3 | EU482789 | DENV | NS3 | FJ410213 |
| DENV | NS3 | EU687247 | DENV | NS3 | EU482524 | DENV | NS3 | AY726550 |
| DENV | NS3 | AY726552 | DENV | NS3 | EU081261 | DENV | NS3 | AY732477 |
| DENV | NS3 | FJ024436 | DENV | NS3 | FJ639812 | DENV | NS3 | EU660401 |
| DENV | NS3 | FJ639681 | DENV | NS3 | EU482533 | DENV | NS3 | FJ639815 |
| DENV | NS3 | EU482484 | DENV | NS3 | DQ285559 | DENV | NS3 | FJ410268 |
| DENV | NS3 | EU482815 | DENV | NS3 | FJ410246 | DENV | NS3 | FJ478458 |
| DENV | NS3 | EU249490 | DENV | NS3 | FJ461310 | DENV | NS3 | FJ639808 |
| DENV | NS3 | EU081253 | DENV | NS3 | AB195673 | DENV | NS3 | EU482611 |
| DENV | NS3 | AY726549 | DENV | NS3 | FJ182024 | DENV | NS3 | FJ410261 |
| DENV | NS3 | EU677166 | DENV | NS3 | AB204803 | DENV | NS3 | FJ432729 |
| DENV | NS3 | FJ639821 | DENV | NS3 | EF025110 | DENV | NS3 | FJ639813 |
| DENV | NS3 | FJ024430 | DENV | NS3 | DQ672564 | DENV | NS3 | EU482520 |
| DENV | NS3 | FJ410183 | DENV | NS3 | EU726778 | DENV | NS3 | AF514885 |
| DENV | NS3 | EU081267 | DENV | NS3 | EF457905 | DENV | NS3 | FJ639673 |
| DENV | NS3 | EU482491 | DENV | NS3 | FJ547088 | DENV | NS3 | FJ410266 |
| DENV | NS3 | EU081249 | DENV | NS3 | FJ024437 | DENV | NS3 | EU482805 |

FIG. 70-118

| Virus | Protein | Accession No. | Virus | Protein | Accession No. | Virus | Protein | Accession No. |
|---|---|---|---|---|---|---|---|---|
| DENV | NS3 | FJ432740 | DENV | NS3 | FJ639819 | DENV | NS3 | FJ182028 |
| DENV | NS3 | AY726554 | DENV | NS3 | FJ639806 | DENV | NS3 | EU677152 |
| DENV | NS3 | FJ024441 | DENV | NS3 | FJ432738 | DENV | NS3 | EU081228 |
| DENV | NS3 | DQ672556 | DENV | NS3 | FJ432719 | DENV | NS3 | FJ410173 |
| DENV | NS3 | FJ410272 | DENV | NS3 | FJ461303 | DENV | NS3 | EU482796 |
| DENV | NS3 | FJ639676 | DENV | NS3 | FJ410203 | DENV | NS3 | EU726781 |
| DENV | NS3 | FJ639686 | DENV | NS3 | FJ410194 | DENV | NS3 | FJ410207 |
| DENV | NS3 | EU482498 | DENV | NS3 | EU081244 | DENV | NS3 | FJ410243 |
| DENV | NS3 | FJ432725 | DENV | NS3 | EU482482 | DENV | NS3 | EU081239 |
| DENV | NS3 | EU482529 | DENV | NS3 | FJ410179 | DENV | NS3 | EU482816 |
| DENV | NS3 | FJ547086 | DENV | NS3 | AY722803 | DENV | NS3 | EU081260 |
| DENV | NS3 | FJ461323 | DENV | NS3 | EU482539 | DENV | NS3 | FJ182029 |
| DENV | NS3 | FJ410230 | DENV | NS3 | FJ639671 | DENV | NS3 | FJ024449 |
| DENV | NS3 | FJ410248 | DENV | NS3 | EU482478 | DENV | NS3 | EU081250 |
| DENV | NS3 | EU482609 | DENV | NS3 | FJ547060 | DENV | NS3 | EU482825 |
| DENV | NS3 | FJ639824 | DENV | NS3 | FJ432739 | DENV | NS3 | EU482530 |
| DENV | NS3 | FJ410279 | DENV | NS3 | FJ639740 | DENV | NS3 | FJ639820 |
| DENV | NS3 | EU482535 | DENV | NS3 | FJ182034 | DENV | NS3 | EU677175 |
| DENV | NS3 | FJ024453 | DENV | NS3 | EU482710 | DENV | NS3 | FJ410251 |
| DENV | NS3 | FJ432748 | DENV | NS3 | EU081232 | DENV | NS3 | EU482794 |
| DENV | NS3 | EU660393 | DENV | NS3 | EU482515 | DENV | NS3 | EU359008 |
| DENV | NS3 | AY145122 | DENV | NS3 | EU482531 | DENV | NS3 | AF180818 |
| DENV | NS3 | FJ024446 | DENV | NS3 | AF298807 | DENV | NS3 | EU660396 |
| DENV | NS3 | FJ432747 | DENV | NS3 | FJ205873 | DENV | NS3 | FJ182003 |
| DENV | NS3 | FJ410205 | DENV | NS3 | FJ639674 | DENV | NS3 | EU482476 |
| DENV | NS3 | FJ205876 | DENV | NS3 | FJ547065 | DENV | NS3 | EU482505 |
| DENV | NS3 | FJ410211 | DENV | NS3 | FJ410212 | DENV | NS3 | EU081255 |
| DENV | NS3 | FJ182025 | DENV | NS3 | FJ461341 | DENV | NS3 | FJ639743 |
| DENV | NS3 | FJ182026 | DENV | NS3 | EU081259 | DENV | NS3 | U88537 |
| DENV | NS3 | FJ373296 | DENV | NS3 | FJ639823 | DENV | NS3 | FJ432733 |
| DENV | NS3 | AY722802 | DENV | NS3 | FJ410190 | DENV | NS3 | EU660395 |
| DENV | NS3 | EU482522 | DENV | NS3 | FJ432745 | DENV | NS3 | EU081263 |
| DENV | NS3 | FJ390388 | DENV | NS3 | FJ410175 | DENV | NS3 | EU482826 |
| DENV | NS3 | EU677173 | DENV | NS3 | EU677176 | DENV | NS3 | FJ410192 |
| DENV | NS3 | EU081277 | DENV | NS3 | FJ639679 | DENV | NS3 | FJ182020 |
| DENV | NS3 | EU482492 | DENV | NS3 | FJ432742 | DENV | NS3 | DQ672561 |
| DENV | NS3 | FJ432732 | DENV | NS3 | FJ639670 | DENV | NS3 | FJ024481 |
| DENV | NS3 | FJ639691 | DENV | NS3 | FJ182027 | DENV | NS3 | EU677165 |
| DENV | NS3 | EU482511 | DENV | NS3 | EU482718 | DENV | NS3 | FJ410287 |
| DENV | NS3 | EU081230 | DENV | NS3 | EU677158 | DENV | NS3 | EU482502 |
| DENV | NS3 | FJ410206 | DENV | NS3 | FJ639687 | DENV | NS3 | EU081274 |
| DENV | NS3 | FJ410189 | DENV | NS3 | FJ461325 | DENV | NS3 | FJ024448 |
| DENV | NS3 | FJ182019 | DENV | NS3 | FJ024444 | DENV | NS3 | FJ024425 |
| DENV | NS3 | FJ024472 | DENV | NS3 | EU482617 | DENV | NS3 | FJ639741 |
| DENV | NS3 | FJ205872 | DENV | NS3 | FJ639678 | DENV | NS3 | FJ562104 |
| DENV | NS3 | FJ410282 | DENV | NS3 | EU081269 | DENV | NS3 | DQ672563 |
| DENV | NS3 | EU482538 | DENV | NS3 | EU482714 | DENV | NS3 | EU482708 |
| DENV | NS3 | EU660418 | DENV | NS3 | FJ024456 | DENV | NS3 | FJ410247 |

FIG. 70-119

| Virus | Protein Accession No. | Virus | Protein Accession No. | Virus | Protein Accession No. |
|---|---|---|---|---|---|
| DENV | NS3AF180817 | DENV | NS3EU677162 | DENV | NS3FJ882563 |
| DENV | NS3AY722801 | DENV | NS3FJ024485 | DENV | NS3GQ199812 |
| DENV | NS3EU482504 | DENV | NS3EU081271 | DENV | NS3FJ873810 |
| DENV | NS3FJ639675 | DENV | NS3FJ024426 | DENV | NS3FJ898397 |
| DENV | NS3FJ024433 | DENV | NS3EU482790 | DENV | NS3FJ898400 |
| DENV | NS3FJ461331 | DENV | NS3FJ410286 | DENV | NS3FJ687433 |
| DENV | NS3FJ410187 | DENV | NS3FJ639735 | DENV | NS3GQ199877 |
| DENV | NS3FJ410258 | DENV | NS3EU482494 | DENV | NS3GQ199788 |
| DENV | NS3AY708047 | DENV | NS3FJ390374 | DENV | NS3GQ199823 |
| DENV | NS3FJ024423 | DENV | NS3EU482813 | DENV | NS3FJ898407 |
| DENV | NS3FJ024484 | DENV | NS3FJ461335 | DENV | NS3GQ199804 |
| DENV | NS3EU081251 | DENV | NS3EU482803 | DENV | NS3FJ882533 |
| DENV | NS3FJ410249 | DENV | NS3EU482490 | DENV | NS3GQ199818 |
| DENV | NS3EU482610 | DENV | NS3FJ024482 | DENV | NS3FJ882560 |
| DENV | NS3FJ182033 | DENV | NS3FJ410284 | DENV | NS3FJ898415 |
| DENV | NS3EU482493 | DENV | NS3EU081280 | DENV | NS3FJ850113 |
| DENV | NS3EU482807 | DENV | NS3EU677150 | DENV | NS3FJ898384 |
| DENV | NS3FJ639814 | DENV | NS3AY732481 | DENV | NS3FJ882538 |
| DENV | NS3EU482501 | DENV | NS3FJ461324 | DENV | NS3FJ882521 |
| DENV | NS3FJ410254 | DENV | NS3FJ639796 | DENV | NS3GQ199811 |
| DENV | NS3EU081246 | DENV | NS3EU482709 | DENV | NS3FJ850075 |
| DENV | NS3EU081275 | DENV | NS3AF298808 | DENV | NS3GQ199848 |
| DENV | NS3FJ410264 | DENV | NS3FJ182018 | DENV | NS3FJ898378 |
| DENV | NS3FJ024479 | DENV | NS3DQ672558 | DENV | NS3FJ873814 |
| DENV | NS3FJ410185 | DENV | NS3EU482795 | DENV | NS3FJ898410 |
| DENV | NS3FJ410273 | DENV | NS3EU677164 | DENV | NS3FJ882528 |
| DENV | NS3EU482801 | DENV | NS3FJ410277 | DENV | NS3FJ898382 |
| DENV | NS3AY713476 | DENV | NS3FJ024464 | DENV | NS3FJ898404 |
| DENV | NS3FJ461312 | DENV | NS3FJ461332 | DENV | NS3FJ687426 |
| DENV | NS3FJ639797 | DENV | NS3EF122232 | DENV | NS3FJ898371 |
| DENV | NS3FJ461319 | DENV | NS3FJ432727 | DENV | NS3GQ199872 |
| DENV | NS3FJ461333 | DENV | NS3EU482823 | DENV | NS3GQ199855 |
| DENV | NS3EU482516 | DENV | NS3EU482810 | DENV | NS3FJ882535 |
| DENV | NS3EU482792 | DENV | NS3EU081245 | DENV | NS3NC_001477 |
| DENV | NS3AF514889 | DENV | NS3EU081262 | DENV | NS3FJ898423 |
| DENV | NS3EU482509 | DENV | NS3EU863650 | DENV | NS3FJ882565 |
| DENV | NS3FJ432737 | DENV | NS3AY732483 | DENV | NS3FJ882517 |
| DENV | NS3FJ547063 | DENV | NS3FJ410265 | DENV | NS3GQ199814 |
| DENV | NS3FJ373297 | DENV | NS3EU660412 | DENV | NS3FJ898395 |
| DENV | NS3EU677157 | DENV | NS3EU677171 | DENV | NS3GQ199851 |
| DENV | NS3EU482534 | DENV | NS3EU677140 | DENV | NS3GQ199837 |
| DENV | NS3EU249491 | DENV | NS3FJ898428 | DENV | NS3FJ882558 |
| DENV | NS3DQ285562 | DENV | NS3FJ882569 | DENV | NS3FJ850084 |
| DENV | NS3EU482793 | DENV | NS3GQ199776 | DENV | NS3FJ898374 |
| DENV | NS3EU482717 | DENV | NS3GQ199853 | DENV | NS3FJ850104 |
| DENV | NS3FJ024439 | DENV | NS3GQ199803 | DENV | NS3GQ199815 |
| DENV | NS3EU482804 | DENV | NS3FJ882554 | DENV | NS3GQ199843 |
| DENV | NS3EU482503 | DENV | NS3FJ873809 | DENV | NS3GQ199826 |

FIG. 70-120

| Virus | Protein Accession No. | Virus | Protein Accession No. | Virus | Protein Accession No. |
|---|---|---|---|---|---|
| DENV | NS3FJ882550 | DENV | NS3FJ882547 | DENV | NS3FJ744702 |
| DENV | NS3FJ744701 | DENV | NS3GQ199798 | DENV | NS3FJ898386 |
| DENV | NS3FJ898391 | DENV | NS3GQ199844 | DENV | NS3FJ882542 |
| DENV | NS3FJ898417 | DENV | NS3GQ199829 | DENV | NS3GQ199782 |
| DENV | NS3GQ199806 | DENV | NS3FJ882530 | DENV | NS3GQ199852 |
| DENV | NS3GQ199794 | DENV | NS3FJ898422 | DENV | NS3FJ898421 |
| DENV | NS3FJ898425 | DENV | NS3FJ810415 | DENV | NS3FJ687432 |
| DENV | NS3FJ898393 | DENV | NS3FJ898411 | DENV | NS3GQ199813 |
| DENV | NS3GQ199799 | DENV | NS3GQ199856 | DENV | NS3FJ882534 |
| DENV | NS3GQ199833 | DENV | NS3FJ850101 | DENV | NS3GQ199854 |
| DENV | NS3GQ199781 | DENV | NS3FJ850093 | DENV | NS3GQ199846 |
| DENV | NS3GQ199797 | DENV | NS3FJ882551 | DENV | NS3FJ882539 |
| DENV | NS3FJ882522 | DENV | NS3GQ199795 | DENV | NS3FJ898437 |
| DENV | NS3FJ906964 | DENV | NS3FJ850100 | DENV | NS3FJ898390 |
| DENV | NS3GQ199821 | DENV | NS3FJ898416 | DENV | NS3FJ898405 |
| DENV | NS3GQ199847 | DENV | NS3GQ199785 | DENV | NS3GQ199783 |
| DENV | NS3FJ882524 | DENV | NS3GQ199784 | DENV | NS3FJ882526 |
| DENV | NS3FJ850077 | DENV | NS3GQ199828 | DENV | NS3FJ461320 |
| DENV | NS3FJ882552 | DENV | NS3GQ199780 | DENV | NS3FJ898420 |
| DENV | NS3GQ199778 | DENV | NS3FJ850103 | DENV | NS3FJ687431 |
| DENV | NS3FJ882549 | DENV | NS3FJ882555 | DENV | NS3GQ199801 |
| DENV | NS3GQ199816 | DENV | NS3FJ882561 | DENV | NS3FJ906728 |
| DENV | NS3GQ199824 | DENV | NS3FJ687430 | DENV | NS3FJ882544 |
| DENV | NS3FJ898398 | DENV | NS3FJ898381 | DENV | NS3FJ882553 |
| DENV | NS3FJ859029 | DENV | NS3FJ882518 | DENV | NS3FJ882531 |
| DENV | NS3FJ882515 | DENV | NS3FJ898392 | DENV | NS3GQ199810 |
| DENV | NS3GQ199820 | DENV | NS3FJ898380 | DENV | NS3GQ199825 |
| DENV | NS3GQ199867 | DENV | NS3GQ199835 | DENV | NS3FJ882546 |
| DENV | NS3FJ898448 | DENV | NS3FJ898430 | DENV | NS3FJ882568 |
| DENV | NS3FJ882556 | DENV | NS3FJ850087 | DENV | NS3FJ898413 |
| DENV | NS3FJ882536 | DENV | NS3FJ898385 | DENV | NS3GQ199773 |
| DENV | NS3GQ199796 | DENV | NS3GQ199857 | DENV | NS3GQ199822 |
| DENV | NS3FJ882570 | DENV | NS3FJ898403 | DENV | NS3GQ199832 |
| DENV | NS3FJ898376 | DENV | NS3GQ199800 | DENV | NS3GQ199790 |
| DENV | NS3GQ199771 | DENV | NS3FJ882540 | DENV | NS3GQ199841 |
| DENV | NS3FJ850069 | DENV | NS3FJ899792 | DENV | NS3FJ882520 |
| DENV | NS3FJ850102 | DENV | NS3FJ882516 | DENV | NS3GQ199875 |
| DENV | NS3GQ199834 | DENV | NS3GQ199850 | DENV | NS3GQ199802 |
| DENV | NS3FJ898388 | DENV | NS3FJ898372 | DENV | NS3GQ199791 |
| DENV | NS3GQ199830 | DENV | NS3GQ199775 | DENV | NS3FJ898426 |
| DENV | NS3GQ199839 | DENV | NS3FJ882559 | DENV | NS3FJ898431 |
| DENV | NS3GQ199777 | DENV | NS3GQ199789 | DENV | NS3GQ199809 |
| DENV | NS3FJ882579 | DENV | NS3FJ850099 | DENV | NS3FJ898406 |
| DENV | NS3FJ898429 | DENV | NS3FJ850114 | DENV | NS3GQ199805 |
| DENV | NS3FJ882541 | DENV | NS3GQ199819 | DENV | NS3GQ199831 |
| DENV | NS3FJ898402 | DENV | NS3FJ882523 | DENV | NS3FJ850070 |
| DENV | NS3GQ199808 | DENV | NS3GQ199845 | DENV | NS3GQ199807 |
| DENV | NS3GQ199786 | DENV | NS3FJ850081 | DENV | NS3FJ882543 |

FIG. 70-121

| Virus | Protein | Accession No. | Virus | Protein | Accession No. | Virus | Protein | Accession No. |
|---|---|---|---|---|---|---|---|---|
| DENV | NS3 | FJ898408 | DENV | NS3 | GQ199840 | DENV | NS3 | GU131804 |
| DENV | NS3 | FJ810419 | DENV | NS3 | FJ898433 | DENV | NS3 | GU131762 |
| DENV | NS3 | GQ199793 | DENV | NS3 | FJ882567 | DENV | NS3 | GU131827 |
| DENV | NS3 | FJ882562 | DENV | NS3 | FJ898387 | DENV | NS3 | GU131837 |
| DENV | NS3 | FJ898424 | DENV | NS3 | FJ882532 | DENV | NS3 | GQ868630 |
| DENV | NS3 | FJ898389 | DENV | NS3 | FJ898409 | DENV | NS3 | GU131767 |
| DENV | NS3 | FJ898412 | DENV | NS3 | FJ882545 | DENV | NS3 | GU131737 |
| DENV | NS3 | FJ882537 | DENV | NS3 | FJ898375 | DENV | NS3 | GQ868500 |
| DENV | NS3 | FJ898418 | DENV | NS3 | FJ898414 | DENV | NS3 | GU131722 |
| DENV | NS3 | FJ898394 | DENV | NS3 | CS477306 | DENV | NS3 | GQ868607 |
| DENV | NS3 | GQ199849 | DENV | NS3 | A75711 | DENV | NS3 | GQ868517 |
| DENV | NS3 | FJ882548 | DENV | NS3 | GU131816 | DENV | NS3 | GU131727 |
| DENV | NS3 | FJ906963 | DENV | NS3 | FJ469907 | DENV | NS3 | GU131715 |
| DENV | NS3 | FJ906965 | DENV | NS3 | GU131814 | DENV | NS3 | FN429885 |
| DENV | NS3 | GQ199873 | DENV | NS3 | GU131725 | DENV | NS3 | GU131780 |
| DENV | NS3 | FJ850073 | DENV | NS3 | GU131822 | DENV | NS3 | GU131750 |
| DENV | NS3 | FJ850071 | DENV | NS3 | GQ868633 | DENV | NS3 | GU131787 |
| DENV | NS3 | GQ199772 | DENV | NS3 | GU131820 | DENV | NS3 | GU056031 |
| DENV | NS3 | FJ898373 | DENV | NS3 | GU131679 | DENV | NS3 | GQ868602 |
| DENV | NS3 | FJ687429 | DENV | NS3 | GQ868507 | DENV | NS3 | GU131711 |
| DENV | NS3 | FJ898379 | DENV | NS3 | GU131789 | DENV | NS3 | GQ868567 |
| DENV | NS3 | FJ882566 | DENV | NS3 | GU131710 | DENV | NS3 | GU131813 |
| DENV | NS3 | FJ898396 | DENV | NS3 | FN429887 | DENV | NS3 | FJ687428 |
| DENV | NS3 | FJ882529 | DENV | NS3 | GU131720 | DENV | NS3 | GU131707 |
| DENV | NS3 | GQ199838 | DENV | NS3 | GU131841 | DENV | NS3 | GU131689 |
| DENV | NS3 | GQ199779 | DENV | NS3 | GQ868564 | DENV | NS3 | GU131700 |
| DENV | NS3 | GQ199827 | DENV | NS3 | AB519681 | DENV | NS3 | GU131798 |
| DENV | NS3 | GQ199836 | DENV | NS3 | GU131743 | DENV | NS3 | GU131713 |
| DENV | NS3 | GQ199858 | DENV | NS3 | GQ868522 | DENV | NS3 | GU131829 |
| DENV | NS3 | GQ199787 | DENV | NS3 | GU131739 | DENV | NS3 | GU131782 |
| DENV | NS3 | FJ850068 | DENV | NS3 | GU131971 | DENV | NS3 | GU131698 |
| DENV | NS3 | FJ882564 | DENV | NS3 | GU131834 | DENV | NS3 | GU131732 |
| DENV | NS3 | FJ898419 | DENV | NS3 | GQ868523 | DENV | NS3 | GU131772 |
| DENV | NS3 | FJ898383 | DENV | NS3 | GU131982 | DENV | NS3 | GU131978 |
| DENV | NS3 | FJ461328 | DENV | NS3 | GU131965 | DENV | NS3 | GU131958 |
| DENV | NS3 | FJ882527 | DENV | NS3 | GU131760 | DENV | NS3 | GU131811 |
| DENV | NS3 | FJ898427 | DENV | NS3 | GQ868535 | DENV | NS3 | GQ868506 |
| DENV | NS3 | FJ882525 | DENV | NS3 | GU131962 | DENV | NS3 | GQ868525 |
| DENV | NS3 | FJ882557 | DENV | NS3 | GU131891 | DENV | NS3 | GQ868538 |
| DENV | NS3 | GQ199859 | DENV | NS3 | GQ868504 | DENV | NS3 | FJ469909 |
| DENV | NS3 | GQ199842 | DENV | NS3 | GU131783 | DENV | NS3 | GU131818 |
| DENV | NS3 | GQ199817 | DENV | NS3 | GU131680 | DENV | NS3 | GU131893 |
| DENV | NS3 | FJ898401 | DENV | NS3 | GU131704 | DENV | NS3 | GQ868509 |
| DENV | NS3 | FJ882519 | DENV | NS3 | GU131685 | DENV | NS3 | GU131706 |
| DENV | NS3 | FJ850090 | DENV | NS3 | GU131770 | DENV | NS3 | GU131777 |
| DENV | NS3 | FJ898377 | DENV | NS3 | GU131795 | DENV | NS3 | GU131925 |
| DENV | NS3 | GQ199774 | DENV | NS3 | GU131961 | DENV | NS3 | GU131977 |
| DENV | NS3 | FJ898399 | DENV | NS3 | GU131733 | DENV | NS3 | GQ868611 |

FIG. 70-122

| Virus | Protein | Accession No. | Virus | Protein | Accession No. | Virus | Protein | Accession No. |
|---|---|---|---|---|---|---|---|---|
| DENV | NS3 | GU131745 | DENV | NS3 | GU131763 | DENV | NS3 | GU131747 |
| DENV | NS3 | GQ868635 | DENV | NS3 | GQ868527 | DENV | NS3 | GU131748 |
| DENV | NS3 | GU056032 | DENV | NS3 | GU131708 | DENV | NS3 | FN429889 |
| DENV | NS3 | GQ868610 | DENV | NS3 | GU131766 | DENV | NS3 | GU131776 |
| DENV | NS3 | GU131889 | DENV | NS3 | FN429890 | DENV | NS3 | GU131755 |
| DENV | NS3 | GQ868499 | DENV | NS3 | GU131694 | DENV | NS3 | GU131810 |
| DENV | NS3 | GU131756 | DENV | NS3 | GQ868615 | DENV | NS3 | GU131701 |
| DENV | NS3 | GU131786 | DENV | NS3 | GU131688 | DENV | NS3 | GU131754 |
| DENV | NS3 | GQ868565 | DENV | NS3 | FJ469908 | DENV | NS3 | GU131784 |
| DENV | NS3 | GU131709 | DENV | NS3 | GU131734 | DENV | NS3 | GU131807 |
| DENV | NS3 | GQ868569 | DENV | NS3 | GQ868637 | DENV | NS3 | GU131842 |
| DENV | NS3 | GU131723 | DENV | NS3 | GU131888 | DENV | NS3 | GU131923 |
| DENV | NS3 | GU131696 | DENV | NS3 | GQ868568 | DENV | NS3 | GU131809 |
| DENV | NS3 | GQ868519 | DENV | NS3 | GU131790 | DENV | NS3 | GU131726 |
| DENV | NS3 | GU131838 | DENV | NS3 | GU131920 | DENV | NS3 | GU131970 |
| DENV | NS3 | GQ868520 | DENV | NS3 | GQ868528 | DENV | NS3 | GU131751 |
| DENV | NS3 | GU131791 | DENV | NS3 | GQ868612 | DENV | NS3 | GU131828 |
| DENV | NS3 | GU131765 | DENV | NS3 | GU131794 | DENV | NS3 | GQ868524 |
| DENV | NS3 | GU131702 | DENV | NS3 | GQ868606 | DENV | NS3 | GU131863 |
| DENV | NS3 | GU131682 | DENV | NS3 | GU131969 | DENV | NS3 | GU131892 |
| DENV | NS3 | GU131801 | DENV | NS3 | GQ868608 | DENV | NS3 | GU131823 |
| DENV | NS3 | GQ868562 | DENV | NS3 | GU131921 | DENV | NS3 | GU131821 |
| DENV | NS3 | GU131684 | DENV | NS3 | GQ868502 | DENV | NS3 | GU131983 |
| DENV | NS3 | GU131744 | DENV | NS3 | GU131719 | DENV | NS3 | GQ868518 |
| DENV | NS3 | GQ868534 | DENV | NS3 | GU131973 | DENV | NS3 | GU131764 |
| DENV | NS3 | GU131687 | DENV | NS3 | GU131967 | DENV | NS3 | GU056030 |
| DENV | NS3 | GQ868529 | DENV | NS3 | GU131803 | DENV | NS3 | GU131979 |
| DENV | NS3 | GU131840 | DENV | NS3 | GU131736 | DENV | NS3 | GU131768 |
| DENV | NS3 | GU131808 | DENV | NS3 | GU131981 | DENV | NS3 | GU131699 |
| DENV | NS3 | GU131922 | DENV | NS3 | GU131964 | DENV | NS3 | FJ687427 |
| DENV | NS3 | GU131836 | DENV | NS3 | GU131771 | DENV | NS3 | GU131963 |
| DENV | NS3 | GQ868613 | DENV | NS3 | GU131984 | DENV | NS3 | GU131793 |
| DENV | NS3 | GU131721 | DENV | NS3 | GU131695 | DENV | NS3 | GQ868618 |
| DENV | NS3 | GU131730 | DENV | NS3 | GU131728 | DENV | NS3 | GU131799 |
| DENV | NS3 | GU131968 | DENV | NS3 | GQ868601 | DENV | NS3 | GU131724 |
| DENV | NS3 | GU131832 | DENV | NS3 | FN429886 | DENV | NS3 | GU131740 |
| DENV | NS3 | GU131774 | DENV | NS3 | GU131826 | DENV | NS3 | GU131806 |
| DENV | NS3 | GU131976 | DENV | NS3 | GQ868512 | DENV | NS3 | GQ868614 |
| DENV | NS3 | GU131831 | DENV | NS3 | GU131718 | DENV | NS3 | FN429881 |
| DENV | NS3 | GQ868501 | DENV | NS3 | GQ868513 | DENV | NS3 | GQ868636 |
| DENV | NS3 | GQ868531 | DENV | NS3 | GU131731 | DENV | NS3 | GU131746 |
| DENV | NS3 | GU131957 | DENV | NS3 | GU131686 | DENV | NS3 | GQ868560 |
| DENV | NS3 | GU131980 | DENV | NS3 | GU131894 | DENV | NS3 | GQ868508 |
| DENV | NS3 | GQ868609 | DENV | NS3 | GU131895 | DENV | NS3 | GQ868570 |
| DENV | NS3 | GU131769 | DENV | NS3 | GU131678 | DENV | NS3 | GU131788 |
| DENV | NS3 | GQ868526 | DENV | NS3 | GQ868619 | DENV | NS3 | GU131949 |
| DENV | NS3 | GQ868510 | DENV | NS3 | GU131729 | DENV | NS3 | GU131796 |
| DENV | NS3 | FN429882 | DENV | NS3 | GQ868539 | DENV | NS3 | GU056029 |

FIG. 70-123

| Virus | Protein | Accession No. | Virus | Protein | Accession No. | Virus | Protein | Accession No. |
|---|---|---|---|---|---|---|---|---|
| DENV | NS3 | GU131792 | DENV | NS3 | GU131835 | DENV | NS3 | EU854296 |
| DENV | NS3 | GU131690 | DENV | NS3 | GU131716 | DENV | NS3 | EU854300 |
| DENV | NS3 | GQ868632 | DENV | NS3 | GQ868498 | DENV | NS3 | AY858050 |
| DENV | NS3 | GU131781 | DENV | NS3 | GU131683 | DENV | NS3 | AF375822 |
| DENV | NS3 | GQ868537 | DENV | NS3 | GU131960 | DENV | NS3 | EU854295 |
| DENV | NS3 | GU131815 | DENV | NS3 | GU131714 | DENV | NS3 | M14931 |
| DENV | NS3 | GU056033 | DENV | NS3 | GU131779 | DENV | NS3 | AY618992 |
| DENV | NS3 | GU131812 | DENV | NS3 | GU131773 | DENV | NS3 | EU854297 |
| DENV | NS3 | GU131833 | DENV | NS3 | GQ868605 | DENV | NS3 | FJ639738 |
| DENV | NS3 | GU131830 | DENV | NS3 | GQ868511 | DENV | NS3 | AY618993 |
| DENV | NS3 | GU131742 | DENV | NS3 | GU131752 | DENV | NS3 | FJ639764 |
| DENV | NS3 | GQ868561 | DENV | NS3 | GU131691 | DENV | NS3 | FJ639737 |
| DENV | NS3 | GU131800 | DENV | NS3 | GU131692 | DENV | NS3 | AY776330 |
| DENV | NS3 | GU131738 | DENV | NS3 | GU131705 | DENV | NS3 | AY618991 |
| DENV | NS3 | GU131824 | DENV | NS3 | GQ868639 | DENV | NS3 | FJ639736 |
| DENV | NS3 | GU131919 | DENV | NS3 | GU131805 | DENV | NS3 | FJ639739 |
| DENV | NS3 | GU131802 | DENV | NS3 | GU131735 | DENV | NS3 | AF326826 |
| DENV | NS3 | GQ868503 | DENV | NS3 | GU131966 | DENV | NS3 | AY947539 |
| DENV | NS3 | GU131839 | DENV | NS3 | GU131890 | DENV | NS3 | EU854299 |
| DENV | NS3 | GU131681 | DENV | NS3 | GQ868566 | DENV | NS3 | AY618990 |
| DENV | NS3 | GQ868505 | DENV | NS3 | GU131775 | DENV | NS3 | FJ639748 |
| DENV | NS3 | FN429884 | DENV | NS3 | GU131749 | DENV | NS3 | FJ639744 |
| DENV | NS3 | GQ868536 | DENV | NS3 | GQ868521 | DENV | NS3 | EU854301 |
| DENV | NS3 | GU131825 | DENV | NS3 | GU131703 | DENV | NS3 | FJ639773 |
| DENV | NS3 | FN429888 | DENV | NS3 | GU131717 | DENV | NS3 | FJ182016 |
| DENV | NS3 | GU131778 | DENV | NS3 | GU131712 | DENV | NS3 | AF326573 |
| DENV | NS3 | GU131972 | DENV | NS3 | GQ868532 | DENV | NS3 | FJ182017 |
| DENV | NS3 | GU131817 | DENV | NS3 | GQ868514 | DENV | NS3 | FJ024476 |
| DENV | NS3 | GU131759 | DENV | NS3 | FJ410220 | DENV | NS3 | EF457906 |
| DENV | NS3 | GU131819 | DENV | NS3 | CS477302 | DENV | NS3 | FJ639742 |
| DENV | NS3 | GU131757 | DENV | NS3 | CS477304 | DENV | NS3 | AF289029 |
| DENV | NS3 | GQ868533 | DENV | NS3 | CS477264 | DENV | NS3 | GQ199880 |
| DENV | NS3 | FN429883 | DENV | NS3 | CS477305 | DENV | NS3 | FJ882597 |
| DENV | NS3 | GU131956 | DENV | NS3 | CS477263 | DENV | NS3 | NC_002640 |
| DENV | NS3 | GQ868563 | DENV | NS3 | CS477265 | DENV | NS3 | FJ882587 |
| DENV | NS3 | GU131926 | DENV | NS3 | M87512 | DENV | NS3 | FJ882595 |
| DENV | NS3 | GU131887 | DENV | NS3 | FB730116 | DENV | NS3 | FJ882582 |
| DENV | NS3 | GU131741 | DENV | NS3 | GM059691 | DENV | NS3 | FJ810417 |
| DENV | NS3 | GU131761 | DENV | NS3 | U88536 | DENV | NS3 | FJ850095 |
| DENV | NS3 | GU131693 | DENV | NS3 | GU370048 | DENV | NS3 | FJ882599 |
| DENV | NS3 | GU131753 | DENV | NS3 | GU370049 | DENV | NS3 | FJ882580 |
| DENV | NS3 | GU131948 | DENV | NS3 | AY762085 | DENV | NS3 | GQ199884 |
| DENV | NS3 | GQ868559 | DENV | NS3 | FJ024424 | DENV | NS3 | FJ882588 |
| DENV | NS3 | GQ868530 | DENV | NS3 | FJ226067 | DENV | NS3 | FJ882598 |
| DENV | NS3 | GU131797 | DENV | NS3 | FJ639745 | DENV | NS3 | FJ882601 |
| DENV | NS3 | GU131785 | DENV | NS3 | AY618989 | DENV | NS3 | FJ850058 |
| DENV | NS3 | GU131758 | DENV | NS3 | AF326827 | DENV | NS3 | FJ882584 |
| DENV | NS3 | GU131697 | DENV | NS3 | AY618988 | DENV | NS3 | FJ850059 |

FIG. 70-124

| Virus | Protein Accession No. | Virus | Protein Accession No. | Virus | Protein Accession No. |
|---|---|---|---|---|---|
| DENV | NS3GQ199883 | DENV | NS3DQ401690 | DENV | NS3EU482455 |
| DENV | NS3FJ882586 | DENV | NS3EU529683 | DENV | NS3AY744680 |
| DENV | NS3GQ252675 | DENV | NS3AY679147 | DENV | NS3FJ182015 |
| DENV | NS3FJ882581 | DENV | NS3AY676348 | DENV | NS3FJ562103 |
| DENV | NS3GQ199881 | DENV | NS3EF629368 | DENV | NS3FJ639792 |
| DENV | NS3GQ199878 | DENV | NS3FJ639752 | DENV | NS3DQ675527 |
| DENV | NS3FJ882596 | DENV | NS3FJ639807 | DENV | NS3FJ547066 |
| DENV | NS3FJ882583 | DENV | NS3EU529684 | DENV | NS3EU529698 |
| DENV | NS3FJ882600 | DENV | NS3FJ373304 | DENV | NS3EU726769 |
| DENV | NS3FJ850057 | DENV | NS3FJ639723 | DENV | NS3AY676349 |
| DENV | NS3GQ199879 | DENV | NS3EU569691 | DENV | NS3EU529688 |
| DENV | NS3FJ882585 | DENV | NS3DQ675524 | DENV | NS3EU482558 |
| DENV | NS3GQ199876 | DENV | NS3EU081203 | DENV | NS3FJ547070 |
| DENV | NS3GQ199885 | DENV | NS3EU482564 | DENV | NS3EU687198 |
| DENV | NS3FJ882592 | DENV | NS3FJ182039 | DENV | NS3FJ639817 |
| DENV | NS3GQ199882 | DENV | NS3EU482453 | DENV | NS3EU081202 |
| DENV | NS3FJ882591 | DENV | NS3FJ639779 | DENV | NS3EU081225 |
| DENV | NS3FJ882589 | DENV | NS3EU081183 | DENV | NS3DQ675520 |
| DENV | NS3GQ868642 | DENV | NS3EU529690 | DENV | NS3EU854298 |
| DENV | NS3GQ868581 | DENV | NS3FJ182011 | DENV | NS3FJ205870 |
| DENV | NS3FN429919 | DENV | NS3EU081187 | DENV | NS3FJ639793 |
| DENV | NS3GQ868583 | DENV | NS3EU482461 | DENV | NS3DQ675532 |
| DENV | NS3FN429920 | DENV | NS3FJ639803 | DENV | NS3FJ024470 |
| DENV | NS3FN429923 | DENV | NS3AY858047 | DENV | NS3EU081210 |
| DENV | NS3GQ868585 | DENV | NS3FJ639774 | DENV | NS3EU687226 |
| DENV | NS3GQ868579 | DENV | NS3FJ639726 | DENV | NS3FJ639715 |
| DENV | NS3GQ868644 | DENV | NS3AY858037 | DENV | NS3AY676352 |
| DENV | NS3FN429925 | DENV | NS3EU081215 | DENV | NS3AY858043 |
| DENV | NS3GU289913 | DENV | NS3FJ639785 | DENV | NS3EU081196 |
| DENV | NS3GQ868580 | DENV | NS3FJ639761 | DENV | NS3FJ432741 |
| DENV | NS3FN429922 | DENV | NS3EU569688 | DENV | NS3EU726773 |
| DENV | NS3GQ868645 | DENV | NS3DQ675533 | DENV | NS3EU482555 |
| DENV | NS3GQ868594 | DENV | NS3FJ410177 | DENV | NS3DQ401694 |
| DENV | NS3FN429924 | DENV | NS3FJ478456 | DENV | NS3EU081216 |
| DENV | NS3FJ882590 | DENV | NS3EU081195 | DENV | NS3EU529704 |
| DENV | NS3GQ868582 | DENV | NS3EU081221 | DENV | NS3FJ639777 |
| DENV | NS3GQ868584 | DENV | NS3EU529689 | DENV | NS3FJ639730 |
| DENV | NS3FN429926 | DENV | NS3EU660408 | DENV | NS3EU081190 |
| DENV | NS3FN429921 | DENV | NS3EU687219 | DENV | NS3EU529703 |
| DENV | NS3GQ868643 | DENV | NS3FJ639780 | DENV | NS3FJ639725 |
| DENV | NS3AF326825 | DENV | NS3EU687196 | DENV | NS3EU081205 |
| DENV | NS3AY376438 | DENV | NS3EF643017 | DENV | NS3AY876494 |
| DENV | NS3AY648301 | DENV | NS3FJ373303 | DENV | NS3FJ639747 |
| DENV | NS3AY099336 | DENV | NS3FJ639729 | DENV | NS3FJ373302 |
| DENV | NS3GU363549 | DENV | NS3FJ639775 | DENV | NS3FJ639778 |
| DENV | NS3GU370052 | DENV | NS3FJ461322 | DENV | NS3DQ401692 |
| DENV | NS3GU370053 | DENV | NS3FJ390371 | DENV | NS3FJ182038 |
| DENV | NS3EU081191 | DENV | NS3AY858046 | DENV | NS3EU081220 |

FIG. 70-125

| Virus | Protein | Accession No. | Virus | Protein | Accession No. | Virus | Protein | Accession No. |
|---|---|---|---|---|---|---|---|---|
| DENV | NS3 | AY923865 | DENV | NS3 | EU081222 | DENV | NS3 | DQ675531 |
| DENV | NS3 | EU081188 | DENV | NS3 | EU660407 | DENV | NS3 | FJ461326 |
| DENV | NS3 | FJ461337 | DENV | NS3 | M93130 | DENV | NS3 | FJ373306 |
| DENV | NS3 | EU081224 | DENV | NS3 | EU529687 | DENV | NS3 | EU569689 |
| DENV | NS3 | EU081207 | DENV | NS3 | DQ675523 | DENV | NS3 | AY858041 |
| DENV | NS3 | FJ639750 | DENV | NS3 | FJ432722 | DENV | NS3 | EU482566 |
| DENV | NS3 | AB189128 | DENV | NS3 | EU482559 | DENV | NS3 | EF629370 |
| DENV | NS3 | AY676353 | DENV | NS3 | FJ639721 | DENV | NS3 | AY496877 |
| DENV | NS3 | EU081209 | DENV | NS3 | AY744682 | DENV | NS3 | FJ562102 |
| DENV | NS3 | FJ639772 | DENV | NS3 | EU081184 | DENV | NS3 | EF629367 |
| DENV | NS3 | FJ182040 | DENV | NS3 | FJ639805 | DENV | NS3 | FJ547077 |
| DENV | NS3 | AY648961 | DENV | NS3 | FJ547074 | DENV | NS3 | FJ639770 |
| DENV | NS3 | FJ410178 | DENV | NS3 | EU529685 | DENV | NS3 | EU081182 |
| DENV | NS3 | EU529699 | DENV | NS3 | DQ401695 | DENV | NS3 | EU596494 |
| DENV | NS3 | EU081199 | DENV | NS3 | FJ432743 | DENV | NS3 | FJ639749 |
| DENV | NS3 | FJ639786 | DENV | NS3 | EU854291 | DENV | NS3 | EU726771 |
| DENV | NS3 | FJ639768 | DENV | NS3 | FJ182008 | DENV | NS3 | FJ639746 |
| DENV | NS3 | FJ639731 | DENV | NS3 | FJ547062 | DENV | NS3 | EU081214 |
| DENV | NS3 | FJ390373 | DENV | NS3 | FJ024467 | DENV | NS3 | AY858039 |
| DENV | NS3 | FJ639800 | DENV | NS3 | EU687239 | DENV | NS3 | EU660411 |
| DENV | NS3 | FJ547079 | DENV | NS3 | FJ024468 | DENV | NS3 | EU482563 |
| DENV | NS3 | FJ547072 | DENV | NS3 | AY496874 | DENV | NS3 | AY744678 |
| DENV | NS3 | EU081219 | DENV | NS3 | FJ547061 | DENV | NS3 | FJ461334 |
| DENV | NS3 | EU596493 | DENV | NS3 | FJ547076 | DENV | NS3 | EU660420 |
| DENV | NS3 | EU081192 | DENV | NS3 | FJ639767 | DENV | NS3 | FJ024466 |
| DENV | NS3 | FJ432731 | DENV | NS3 | AB189125 | DENV | NS3 | FJ639795 |
| DENV | NS3 | AB189126 | DENV | NS3 | AF317645 | DENV | NS3 | FJ024465 |
| DENV | NS3 | FJ024471 | DENV | NS3 | AB189127 | DENV | NS3 | EU726768 |
| DENV | NS3 | FJ639769 | DENV | NS3 | EU781137 | DENV | NS3 | FJ639720 |
| DENV | NS3 | FJ547078 | DENV | NS3 | DQ675522 | DENV | NS3 | EU529696 |
| DENV | NS3 | FJ547080 | DENV | NS3 | EU482614 | DENV | NS3 | FJ639810 |
| DENV | NS3 | AY744679 | DENV | NS3 | AB214879 | DENV | NS3 | AY744681 |
| DENV | NS3 | EU081217 | DENV | NS3 | FJ639765 | DENV | NS3 | FJ639724 |
| DENV | NS3 | AY858045 | DENV | NS3 | EU081211 | DENV | NS3 | EU482595 |
| DENV | NS3 | FJ547084 | DENV | NS3 | FJ639787 | DENV | NS3 | AY676351 |
| DENV | NS3 | DQ675521 | DENV | NS3 | FJ639784 | DENV | NS3 | DQ401689 |
| DENV | NS3 | AY776329 | DENV | NS3 | EU569690 | DENV | NS3 | FJ182005 |
| DENV | NS3 | FJ639789 | DENV | NS3 | EU081223 | DENV | NS3 | FJ547085 |
| DENV | NS3 | AY496871 | DENV | NS3 | FJ639816 | DENV | NS3 | EU081193 |
| DENV | NS3 | EU781136 | DENV | NS3 | AY496873 | DENV | NS3 | FJ639751 |
| DENV | NS3 | FJ182013 | DENV | NS3 | FJ182010 | DENV | NS3 | DQ675525 |
| DENV | NS3 | EU596492 | DENV | NS3 | AY099337 | DENV | NS3 | FJ639826 |
| DENV | NS3 | EU726774 | DENV | NS3 | AY496879 | DENV | NS3 | EU482458 |
| DENV | NS3 | EU081198 | DENV | NS3 | EU482462 | DENV | NS3 | EU081204 |
| DENV | NS3 | FJ639728 | DENV | NS3 | FJ639825 | DENV | NS3 | EU529691 |
| DENV | NS3 | DQ675530 | DENV | NS3 | AY766104 | DENV | NS3 | FJ639719 |
| DENV | NS3 | EU660409 | DENV | NS3 | FJ182007 | DENV | NS3 | FJ182037 |
| DENV | NS3 | EU081206 | DENV | NS3 | DQ401693 | DENV | NS3 | EU482612 |

FIG. 70-126

| Virus | Protein Accession No. | Virus | Protein Accession No. | Virus | Protein Accession No. |
|---|---|---|---|---|---|
| DENV | NS3EU482596 | DENV | NS3EU081197 | DENV | NS3AY858038 |
| DENV | NS3EU081208 | DENV | NS3FJ639755 | DENV | NS3EU482456 |
| DENV | NS3EU081201 | DENV | NS3FJ639798 | DENV | NS3EU081200 |
| DENV | NS3FJ639757 | DENV | NS3FJ639758 | DENV | NS3FJ639756 |
| DENV | NS3FJ639713 | DENV | NS3EU687218 | DENV | NS3AY744677 |
| DENV | NS3AY744685 | DENV | NS3EU081189 | DENV | NS3AY744683 |
| DENV | NS3FJ182041 | DENV | NS3FJ639759 | DENV | NS3FJ639753 |
| DENV | NS3FJ562099 | DENV | NS3EU081212 | DENV | NS3FJ639716 |
| DENV | NS3FJ562100 | DENV | NS3EU482460 | DENV | NS3EU081194 |
| DENV | NS3FJ547081 | DENV | NS3FJ547075 | DENV | NS3FJ639776 |
| DENV | NS3AY858044 | DENV | NS3AY676350 | DENV | NS3FJ898469 |
| DENV | NS3FJ639714 | DENV | NS3EU854292 | DENV | NS3GQ252674 |
| DENV | NS3EU529686 | DENV | NS3EU660410 | DENV | NS3FJ850055 |
| DENV | NS3FJ410229 | DENV | NS3FJ432728 | DENV | NS3FJ898475 |
| DENV | NS3FJ547073 | DENV | NS3FJ024469 | DENV | NS3FJ744739 |
| DENV | NS3FJ639791 | DENV | NS3AY858048 | DENV | NS3NC_001475 |
| DENV | NS3EU529692 | DENV | NS3FJ639804 | DENV | NS3GQ199863 |
| DENV | NS3FJ547082 | DENV | NS3EU529705 | DENV | NS3FJ850089 |
| DENV | NS3EU367962 | DENV | NS3EU482454 | DENV | NS3FJ898442 |
| DENV | NS3FJ390375 | DENV | NS3DQ401691 | DENV | NS3FJ898459 |
| DENV | NS3AY858040 | DENV | NS3FJ639771 | DENV | NS3FJ850049 |
| DENV | NS3FJ547069 | DENV | NS3FJ639754 | DENV | NS3FJ744730 |
| DENV | NS3FJ562107 | DENV | NS3EU482459 | DENV | NS3FJ850097 |
| DENV | NS3FJ461338 | DENV | NS3FJ205871 | DENV | NS3FJ744728 |
| DENV | NS3FJ639722 | DENV | NS3EU081186 | DENV | NS3FJ898458 |
| DENV | NS3FJ639782 | DENV | NS3FJ547083 | DENV | NS3FJ744740 |
| DENV | NS3AY858042 | DENV | NS3FJ639762 | DENV | NS3GQ199889 |
| DENV | NS3EU081185 | DENV | NS3FJ547071 | DENV | NS3GQ199886 |
| DENV | NS3FJ390377 | DENV | NS3EU529702 | DENV | NS3FJ687448 |
| DENV | NS3FJ639763 | DENV | NS3EU687234 | DENV | NS3FJ744732 |
| DENV | NS3FJ639760 | DENV | NS3FJ182006 | DENV | NS3FJ898446 |
| DENV | NS3FJ182009 | DENV | NS3AY662691 | DENV | NS3GQ199861 |
| DENV | NS3EU529697 | DENV | NS3EU081213 | DENV | NS3FJ898455 |
| DENV | NS3DQ675529 | DENV | NS3EU081181 | DENV | NS3FJ882573 |
| DENV | NS3FJ639727 | DENV | NS3FJ390372 | DENV | NS3FJ898463 |
| DENV | NS3FJ461329 | DENV | NS3EU482613 | DENV | NS3FJ898447 |
| DENV | NS3EU482457 | DENV | NS3FJ639790 | DENV | NS3FJ882571 |
| DENV | NS3FJ639827 | DENV | NS3DQ675519 | DENV | NS3FJ898462 |
| DENV | NS3EU687197 | DENV | NS3EU687233 | DENV | NS3GQ199870 |
| DENV | NS3FJ639801 | DENV | NS3EF629369 | DENV | NS3FJ898471 |
| DENV | NS3FJ410176 | DENV | NS3FJ182004 | DENV | NS3FJ882575 |
| DENV | NS3EU081218 | DENV | NS3FJ639799 | DENV | NS3FJ744738 |
| DENV | NS3AY744684 | DENV | NS3FJ562097 | DENV | NS3FJ898440 |
| DENV | NS3FJ390376 | DENV | NS3FJ639712 | DENV | NS3FJ898444 |
| DENV | NS3FJ639781 | DENV | NS3EF629366 | DENV | NS3GQ199865 |
| DENV | NS3DQ675528 | DENV | NS3EU726772 | DENV | NS3GQ252678 |
| DENV | NS3FJ639766 | DENV | NS3DQ675526 | DENV | NS3FJ850110 |
| DENV | NS3EU687221 | DENV | NS3EU482452 | DENV | NS3FJ744734 |

FIG. 70-127

| Virus | Protein Accession No. | Virus | Protein Accession No. | Virus | Protein Accession No. |
|---|---|---|---|---|---|
| DENV | NS3FJ898457 | DENV | NS3FJ850086 | DENV | NS3FN429917 |
| DENV | NS3FJ744736 | DENV | NS3FJ882572 | DENV | NS3FN429915 |
| DENV | NS3FJ810416 | DENV | NS3FJ882578 | DENV | NS3GU131855 |
| DENV | NS3FJ898474 | DENV | NS3FJ850092 | DENV | NS3FN429896 |
| DENV | NS3FJ850094 | DENV | NS3AB214882 | DENV | NS3GU131844 |
| DENV | NS3FJ898470 | DENV | NS3AB214880 | DENV | NS3GQ868573 |
| DENV | NS3FJ810413 | DENV | NS3AB214881 | DENV | NS3GQ868586 |
| DENV | NS3FJ744735 | DENV | NS3FB667400 | DENV | NS3GU131858 |
| DENV | NS3GQ199860 | DENV | NS3GQ868587 | DENV | NS3FN429903 |
| DENV | NS3FJ898464 | DENV | NS3EU932688 | DENV | NS3GU131874 |
| DENV | NS3FJ744729 | DENV | NS3FN429906 | DENV | NS3GU131914 |
| DENV | NS3FJ898472 | DENV | NS3GU131916 | DENV | NS3FN429912 |
| DENV | NS3GQ199862 | DENV | NS3GU131953 | DENV | NS3FN429898 |
| DENV | NS3FJ873812 | DENV | NS3GU131850 | DENV | NS3GU131851 |
| DENV | NS3FJ898441 | DENV | NS3FN429900 | DENV | NS3GU131938 |
| DENV | NS3FJ850048 | DENV | NS3GQ868576 | DENV | NS3GU131853 |
| DENV | NS3FJ850080 | DENV | NS3GU131946 | DENV | NS3FN429907 |
| DENV | NS3FJ882577 | DENV | NS3GU131866 | DENV | NS3GU131865 |
| DENV | NS3FJ850096 | DENV | NS3GU131862 | DENV | NS3GU131906 |
| DENV | NS3FJ898473 | DENV | NS3GU131852 | DENV | NS3GU131944 |
| DENV | NS3FJ882574 | DENV | NS3FN429897 | DENV | NS3GU131936 |
| DENV | NS3FJ898445 | DENV | NS3GQ868571 | DENV | NS3GU131903 |
| DENV | NS3GQ199888 | DENV | NS3GQ868626 | DENV | NS3GU131908 |
| DENV | NS3FJ898443 | DENV | NS3GQ868546 | DENV | NS3GU131878 |
| DENV | NS3FJ744726 | DENV | NS3FN429904 | DENV | NS3GU131950 |
| DENV | NS3FJ898476 | DENV | NS3GU131904 | DENV | NS3GQ868634 |
| DENV | NS3FJ898468 | DENV | NS3GU131935 | DENV | NS3GU131873 |
| DENV | NS3FJ744733 | DENV | NS3GU131910 | DENV | NS3GQ868593 |
| DENV | NS3GQ199871 | DENV | NS3GU131918 | DENV | NS3GQ868572 |
| DENV | NS3GQ199887 | DENV | NS3GU131937 | DENV | NS3DQ863638 |
| DENV | NS3GQ199864 | DENV | NS3GU131868 | DENV | NS3GU131876 |
| DENV | NS3FJ744737 | DENV | NS3GU131951 | DENV | NS3EU932687 |
| DENV | NS3FJ898456 | DENV | NS3FN429910 | DENV | NS3GU189648 |
| DENV | NS3FJ850083 | DENV | NS3GU131854 | DENV | NS3FN429913 |
| DENV | NS3FJ744731 | DENV | NS3GU131943 | DENV | NS3GU131867 |
| DENV | NS3FJ850079 | DENV | NS3GU131861 | DENV | NS3GQ868575 |
| DENV | NS3FJ744700 | DENV | NS3GU131871 | DENV | NS3GQ868617 |
| DENV | NS3FJ882576 | DENV | NS3GU131933 | DENV | NS3GQ868616 |
| DENV | NS3GQ199891 | DENV | NS3GU131877 | DENV | NS3GU131870 |
| DENV | NS3FJ850111 | DENV | NS3GU131911 | DENV | NS3GU131869 |
| DENV | NS3FJ850056 | DENV | NS3GQ868628 | DENV | NS3GU131846 |
| DENV | NS3FJ744727 | DENV | NS3GQ868574 | DENV | NS3GU131934 |
| DENV | NS3FJ873813 | DENV | NS3GU131941 | DENV | NS3GQ868627 |
| DENV | NS3AY770511 | DENV | NS3GQ868577 | DENV | NS3FN429908 |
| DENV | NS3FJ850098 | DENV | NS3GQ868547 | DENV | NS3GU131872 |
| DENV | NS3FJ810414 | DENV | NS3GU131845 | DENV | NS3FN429901 |
| DENV | NS3FJ850109 | DENV | NS3FN429899 | DENV | NS3GU131917 |
| DENV | NS3FJ850052 | DENV | NS3FN429902 | DENV | NS3GU131875 |

FIG. 70-128

| Virus | Protein Accession No. | Virus | Protein Accession No. | Virus | Protein Accession No. |
|---|---|---|---|---|---|
| DENV | NS3FN429909 | DENV | NS3EU482468 | DENV | NS3EU482787 |
| DENV | NS3FN429911 | DENV | NS3FJ410195 | DENV | NS3FM210216 |
| DENV | NS3GU131945 | DENV | NS3AB122021 | DENV | NS3EU569694 |
| DENV | NS3FN429916 | DENV | NS3EU482469 | DENV | NS3EU482648 |
| DENV | NS3FN429914 | DENV | NS3FM210231 | DENV | NS3EU482620 |
| DENV | NS3GU131942 | DENV | NS3FJ639831 | DENV | NS3EU482471 |
| DENV | NS3GU131849 | DENV | NS3EU482657 | DENV | NS3EU482644 |
| DENV | NS3GU131952 | DENV | NS3EU482674 | DENV | NS3FJ639833 |
| DENV | NS3GU131915 | DENV | NS3EU482753 | DENV | NS3EU482445 |
| DENV | NS3GQ868578 | DENV | NS3DQ645545 | DENV | NS3EU482606 |
| DENV | NS3GQ868548 | DENV | NS3FJ639835 | DENV | NS3FM210236 |
| DENV | NS3GU131913 | DENV | NS3FJ432726 | DENV | NS3EU482639 |
| DENV | NS3GU131940 | DENV | NS3EU482607 | DENV | NS3EU003591 |
| DENV | NS3FN429918 | DENV | NS3EU482660 | DENV | NS3EU482547 |
| DENV | NS3FN429905 | DENV | NS3EU482766 | DENV | NS3FJ478459 |
| DENV | NS3GU131907 | DENV | NS3AB189124 | DENV | NS3FJ639837 |
| DENV | NS3GU131860 | DENV | NS3AF100461 | DENV | NS3FJ390387 |
| DENV | NS3GU131954 | DENV | NS3EU482600 | DENV | NS3DQ645547 |
| DENV | NS3GU131856 | DENV | NS3EU687230 | DENV | NS3EU596496 |
| DENV | NS3GU131847 | DENV | NS3EU482633 | DENV | NS3EU482597 |
| DENV | NS3GU131909 | DENV | NS3EU482726 | DENV | NS3EU482463 |
| DENV | NS3GU131939 | DENV | NS3EU482557 | DENV | NS3EU482553 |
| DENV | NS3GU131912 | DENV | NS3EU482444 | DENV | NS3EU482548 |
| DENV | NS3GU131859 | DENV | NS3FJ205877 | DENV | NS3EU482641 |
| DENV | NS3GU131857 | DENV | NS3EU482621 | DENV | NS3FJ639703 |
| DENV | NS3GQ868629 | DENV | NS3EU482736 | DENV | NS3EU482647 |
| DENV | NS3GU131905 | DENV | NS3EU596497 | DENV | NS3EU596487 |
| DENV | NS3GU131848 | DENV | NS3M84728 | DENV | NS3FJ639788 |
| DENV | NS3FB667402 | DENV | NS3EU482549 | DENV | NS3FM210206 |
| DENV | NS3FB667403 | DENV | NS3FM210228 | DENV | NS3DQ645556 |
| DENV | NS3FJ177308 | DENV | NS3EU687216 | DENV | NS3AF169682 |
| DENV | NS3FB667404 | DENV | NS3EU596489 | DENV | NS3AY858035 |
| DENV | NS3FB667398 | DENV | NS3EU482576 | DENV | NS3EU687220 |
| DENV | NS3FB667399 | DENV | NS3AF100460 | DENV | NS3EU482636 |
| DENV | NS3CS805345 | DENV | NS3AF169679 | DENV | NS3EU482650 |
| DENV | NS3EU482634 | DENV | NS3EU482665 | DENV | NS3EU482704 |
| DENV | NS3FJ373301 | DENV | NS3EU482586 | DENV | NS3EU482661 |
| DENV | NS3EU482582 | DENV | NS3AF169681 | DENV | NS3EU569699 |
| DENV | NS3EU687227 | DENV | NS3FM210205 | DENV | NS3EU482580 |
| DENV | NS3EU569710 | DENV | NS3EU482767 | DENV | NS3FM210215 |
| DENV | NS3EF105383 | DENV | NS3EU687240 | DENV | NS3FJ639733 |
| DENV | NS3EU687249 | DENV | NS3AF169686 | DENV | NS3EF105389 |
| DENV | NS3EU687242 | DENV | NS3EU687244 | DENV | NS3EF105384 |
| DENV | NS3EU482658 | DENV | NS3EU482683 | DENV | NS3EU677146 |
| DENV | NS3FJ639710 | DENV | NS3FJ373299 | DENV | NS3EU596498 |
| DENV | NS3EU482748 | DENV | NS3EU482601 | DENV | NS3FJ410288 |
| DENV | NS3FJ205885 | DENV | NS3EU660404 | DENV | NS3FJ373300 |
| DENV | NS3EU482470 | DENV | NS3EU482651 | DENV | NS3EU482702 |

FIG. 70-129

| Virus | Protein Accession No. | Virus | Protein Accession No. | Virus | Protein Accession No. |
|---|---|---|---|---|---|
| DENV | NS3FJ205879 | DENV | NS3FJ639707 | DENV | NS3EU482784 |
| DENV | NS3EU569697 | DENV | NS3EU482637 | DENV | NS3EU482584 |
| DENV | NS3EU482691 | DENV | NS3EU482699 | DENV | NS3EU482670 |
| DENV | NS3FJ461309 | DENV | NS3EU482583 | DENV | NS3DQ181801 |
| DENV | NS3EU482608 | DENV | NS3FJ639717 | DENV | NS3EU482603 |
| DENV | NS3EU726776 | DENV | NS3EU687223 | DENV | NS3EU482769 |
| DENV | NS3EU081177 | DENV | NS3AY702036 | DENV | NS3FM210227 |
| DENV | NS3FM210213 | DENV | NS3EU482542 | DENV | NS3AY744147 |
| DENV | NS3EU854293 | DENV | NS3EU482587 | DENV | NS3EU482656 |
| DENV | NS3EU482632 | DENV | NS3EU482667 | DENV | NS3EU529706 |
| DENV | NS3FM210234 | DENV | NS3EU482695 | DENV | NS3EU687212 |
| DENV | NS3EU482745 | DENV | NS3EU569720 | DENV | NS3DQ645541 |
| DENV | NS3EU482593 | DENV | NS3AY702037 | DENV | NS3DQ181800 |
| DENV | NS3EU569718 | DENV | NS3AY858036 | DENV | NS3EU482721 |
| DENV | NS3EU482719 | DENV | NS3DQ645544 | DENV | NS3EU677145 |
| DENV | NS3EF051521 | DENV | NS3FJ639822 | DENV | NS3EU482450 |
| DENV | NS3FM210238 | DENV | NS3AF100466 | DENV | NS3EU482541 |
| DENV | NS3FJ478455 | DENV | NS3FJ410215 | DENV | NS3AF169688 |
| DENV | NS3AF100465 | DENV | NS3EU569705 | DENV | NS3M19197 |
| DENV | NS3EU529694 | DENV | NS3FM210241 | DENV | NS3EU482594 |
| DENV | NS3EU081178 | DENV | NS3FM210221 | DENV | NS3DQ645554 |
| DENV | NS3EU482676 | DENV | NS3EU687228 | DENV | NS3DQ181798 |
| DENV | NS3FJ639709 | DENV | NS3EU482703 | DENV | NS3AY702038 |
| DENV | NS3FM210208 | DENV | NS3EU529700 | DENV | NS3EU596495 |
| DENV | NS3FJ410208 | DENV | NS3DQ645555 | DENV | NS3FM210245 |
| DENV | NS3EU569716 | DENV | NS3EU687231 | DENV | NS3FM210214 |
| DENV | NS3EU482786 | DENV | NS3EU660406 | DENV | NS3EU482685 |
| DENV | NS3AF276619 | DENV | NS3EU687241 | DENV | NS3EU482570 |
| DENV | NS3EU482625 | DENV | NS3FJ639700 | DENV | NS3DQ645540 |
| DENV | NS3EU687248 | DENV | NS3FJ639711 | DENV | NS3EU660414 |
| DENV | NS3EU482662 | DENV | NS3U87412 | DENV | NS3FJ024477 |
| DENV | NS3EU569708 | DENV | NS3EU482599 | DENV | NS3AF100463 |
| DENV | NS3FM210240 | DENV | NS3EU482654 | DENV | NS3DQ645546 |
| DENV | NS3EU482777 | DENV | NS3EU569721 | DENV | NS3EU569703 |
| DENV | NS3FJ639705 | DENV | NS3FJ390385 | DENV | NS3EU482652 |
| DENV | NS3EU482669 | DENV | NS3EU482589 | DENV | NS3EU596490 |
| DENV | NS3DQ645553 | DENV | NS3EU482551 | DENV | NS3EU482693 |
| DENV | NS3FM210210 | DENV | NS3EU660400 | DENV | NS3EU482734 |
| DENV | NS3EF457904 | DENV | NS3EU482679 | DENV | NS3FM210202 |
| DENV | NS3FJ410237 | DENV | NS3AF204177 | DENV | NS3EU482729 |
| DENV | NS3AY702035 | DENV | NS3FJ461311 | DENV | NS3AF169680 |
| DENV | NS3EU482757 | DENV | NS3EU569700 | DENV | NS3EU482623 |
| DENV | NS3EU596499 | DENV | NS3EU482737 | DENV | NS3EU569693 |
| DENV | NS3EU482543 | DENV | NS3EU482573 | DENV | NS3EU482590 |
| DENV | NS3EU687217 | DENV | NS3AY702040 | DENV | NS3FJ639834 |
| DENV | NS3EU482646 | DENV | NS3DQ181803 | DENV | NS3EU482449 |
| DENV | NS3EU482746 | DENV | NS3EU482741 | DENV | NS3EU687237 |
| DENV | NS3FJ410217 | DENV | NS3EU660399 | DENV | NS3EF105381 |

FIG. 70-130

| Virus | Protein Accession No. | Virus | Protein Accession No. | Virus | Protein Accession No. |
|---|---|---|---|---|---|
| DENV | NS3EU482578 | DENV | NS3EU677138 | DENV | NS3EU482742 |
| DENV | NS3EU482781 | DENV | NS3EU621672 | DENV | NS3FJ461314 |
| DENV | NS3EU596485 | DENV | NS3AF359579 | DENV | NS3EU482688 |
| DENV | NS3EU687224 | DENV | NS3EU482645 | DENV | NS3DQ181802 |
| DENV | NS3FJ461321 | DENV | NS3EU482760 | DENV | NS3FJ639809 |
| DENV | NS3FJ390390 | DENV | NS3FJ639732 | DENV | NS3EU482701 |
| DENV | NS3EU482562 | DENV | NS3FM210229 | DENV | NS3AF204178 |
| DENV | NS3EF105390 | DENV | NS3EU482684 | DENV | NS3FJ639706 |
| DENV | NS3EU482782 | DENV | NS3EF105378 | DENV | NS3EU482550 |
| DENV | NS3EU482682 | DENV | NS3EU482681 | DENV | NS3EU482605 |
| DENV | NS3EU056810 | DENV | NS3FJ547090 | DENV | NS3EU482554 |
| DENV | NS3EU687236 | DENV | NS3EU482447 | DENV | NS3EU482692 |
| DENV | NS3EU482448 | DENV | NS3EU482624 | DENV | NS3EU482680 |
| DENV | NS3FJ639698 | DENV | NS3AF119661 | DENV | NS3AF169683 |
| DENV | NS3EU482630 | DENV | NS3EU660413 | DENV | NS3FJ024458 |
| DENV | NS3EU359009 | DENV | NS3AF169685 | DENV | NS3EU482780 |
| DENV | NS3EU482768 | DENV | NS3EU482771 | DENV | NS3EU482750 |
| DENV | NS3EU482672 | DENV | NS3EU482604 | DENV | NS3EU179857 |
| DENV | NS3EU569711 | DENV | NS3FJ410223 | DENV | NS3EU569698 |
| DENV | NS3EU482627 | DENV | NS3EU482739 | DENV | NS3EU482571 |
| DENV | NS3EU569715 | DENV | NS3EU687243 | DENV | NS3EU081179 |
| DENV | NS3EU482678 | DENV | NS3EU482720 | DENV | NS3EU482690 |
| DENV | NS3DQ181799 | DENV | NS3EU482730 | DENV | NS3EU687215 |
| DENV | NS3EU687235 | DENV | NS3EU482779 | DENV | NS3EU482664 |
| DENV | NS3EU687238 | DENV | NS3AB122020 | DENV | NS3DQ181797 |
| DENV | NS3M84727 | DENV | NS3FM210244 | DENV | NS3EU569701 |
| DENV | NS3EU482763 | DENV | NS3AF100469 | DENV | NS3EU482773 |
| DENV | NS3EU482758 | DENV | NS3FJ410221 | DENV | NS3EU482722 |
| DENV | NS3FJ639830 | DENV | NS3EU482626 | DENV | NS3EU482635 |
| DENV | NS3EU482754 | DENV | NS3EU482788 | DENV | NS3DQ645549 |
| DENV | NS3FM210218 | DENV | NS3FJ410219 | DENV | NS3EU482629 |
| DENV | NS3FJ410224 | DENV | NS3AF100462 | DENV | NS3EU596488 |
| DENV | NS3FJ410193 | DENV | NS3EU482696 | DENV | NS3FJ639836 |
| DENV | NS3EU056811 | DENV | NS3EU482544 | DENV | NS3EU482733 |
| DENV | NS3EU482774 | DENV | NS3EU482640 | DENV | NS3EU677143 |
| DENV | NS3EU482568 | DENV | NS3FJ182012 | DENV | NS3EU482653 |
| DENV | NS3EU482588 | DENV | NS3DQ645548 | DENV | NS3AF208496 |
| DENV | NS3EU482475 | DENV | NS3FJ639701 | DENV | NS3EU482565 |
| DENV | NS3AF489932 | DENV | NS3EU482655 | DENV | NS3EU482598 |
| DENV | NS3FM210211 | DENV | NS3AB189122 | DENV | NS3M29095 |
| DENV | NS3EU687246 | DENV | NS3DQ181804 | DENV | NS3EU660415 |
| DENV | NS3FJ390389 | DENV | NS3EU482732 | DENV | NS3FM210239 |
| DENV | NS3EU482464 | DENV | NS3DQ645543 | DENV | NS3EU687213 |
| DENV | NS3EU482697 | DENV | NS3FJ639832 | DENV | NS3EU677144 |
| DENV | NS3EU482765 | DENV | NS3FJ226066 | DENV | NS3FM210243 |
| DENV | NS3FM210209 | DENV | NS3AF169687 | DENV | NS3AF100459 |
| DENV | NS3EU482474 | DENV | NS3EU482752 | DENV | NS3EU482466 |
| DENV | NS3EU596484 | DENV | NS3EU482783 | DENV | NS3FM210230 |

FIG. 70-131

| Virus | Protein Accession No. | Virus | Protein Accession No. | Virus | Protein Accession No. |
|---|---|---|---|---|---|
| DENV | NS3FJ410200 | DENV | NS3AY776328 | DENV | NS3EF105380 |
| DENV | NS3DQ645552 | DENV | NS3EU482675 | DENV | NS3EU482677 |
| DENV | NS3EU482574 | DENV | NS3EU660417 | DENV | NS3AF100468 |
| DENV | NS3EU482622 | DENV | NS3EU482727 | DENV | NS3EU482569 |
| DENV | NS3EU482561 | DENV | NS3EU482602 | DENV | NS3DQ645542 |
| DENV | NS3EU596486 | DENV | NS3EU482577 | DENV | NS3EU482643 |
| DENV | NS3EU569695 | DENV | NS3EU482756 | DENV | NS3EU482694 |
| DENV | NS3FJ024461 | DENV | NS3EU529701 | DENV | NS3EU482724 |
| DENV | NS3EU569713 | DENV | NS3FJ639702 | DENV | NS3EU482446 |
| DENV | NS3FM210224 | DENV | NS3EU482772 | DENV | NS3FM210226 |
| DENV | NS3EU482556 | DENV | NS3FM210246 | DENV | NS3EU482744 |
| DENV | NS3EU482731 | DENV | NS3FJ390391 | DENV | NS3EU677137 |
| DENV | NS3EU179858 | DENV | NS3AF100464 | DENV | NS3EU482770 |
| DENV | NS3EU781135 | DENV | NS3FJ547067 | DENV | NS3AF038403 |
| DENV | NS3EU482743 | DENV | NS3EF105386 | DENV | NS3EU660398 |
| DENV | NS3EU482751 | DENV | NS3EF105387 | DENV | NS3EU569709 |
| DENV | NS3FJ410259 | DENV | NS3EU726775 | DENV | NS3FM210237 |
| DENV | NS3EU482747 | DENV | NS3FJ639704 | DENV | NS3EU660416 |
| DENV | NS3EU687225 | DENV | NS3AF169678 | DENV | NS3EU677142 |
| DENV | NS3FJ639718 | DENV | NS3EU482749 | DENV | NS3EU482700 |
| DENV | NS3EU569707 | DENV | NS3EU482631 | DENV | NS3EU482545 |
| DENV | NS3EU677147 | DENV | NS3EF105388 | DENV | NS3EU482585 |
| DENV | NS3FM210223 | DENV | NS3AB189123 | DENV | NS3FJ024475 |
| DENV | NS3EU081180 | DENV | NS3EU482663 | DENV | NS3EU482725 |
| DENV | NS3EU482728 | DENV | NS3EU677149 | DENV | NS3EU482687 |
| DENV | NS3EU596500 | DENV | NS3EU569719 | DENV | NS3EU529693 |
| DENV | NS3EU482671 | DENV | NS3EU482778 | DENV | NS3FJ390384 |
| DENV | NS3EU179859 | DENV | NS3DQ645551 | DENV | NS3EU482560 |
| DENV | NS3EU482705 | DENV | NS3EU482689 | DENV | NS3EU482761 |
| DENV | NS3EU482552 | DENV | NS3EU726770 | DENV | NS3EU482638 |
| DENV | NS3EU482546 | DENV | NS3AB122022 | DENV | NS3EU482698 |
| DENV | NS3EU482642 | DENV | NS3FJ639697 | DENV | NS3EU482764 |
| DENV | NS3EU482579 | DENV | NS3EU482628 | DENV | NS3FJ182014 |
| DENV | NS3M20558 | DENV | NS3EU687232 | DENV | NS3EU482776 |
| DENV | NS3EU482775 | DENV | NS3FM210225 | DENV | NS3DQ645550 |
| DENV | NS3EU596491 | DENV | NS3AY037116 | DENV | NS3FJ024473 |
| DENV | NS3FJ639708 | DENV | NS3FJ205878 | DENV | NS3DQ181806 |
| DENV | NS3FM210220 | DENV | NS3AY702034 | DENV | NS3FJ461305 |
| DENV | NS3EU569717 | DENV | NS3FM210232 | DENV | NS3FJ024452 |
| DENV | NS3EF105379 | DENV | NS3AY702039 | DENV | NS3EU677141 |
| DENV | NS3EU569712 | DENV | NS3EU687245 | DENV | NS3FJ639828 |
| DENV | NS3EU482755 | DENV | NS3EU482465 | DENV | NS3EU569706 |
| DENV | NS3DQ181805 | DENV | NS3EU482472 | DENV | NS3EU482666 |
| DENV | NS3FM210207 | DENV | NS3EU569714 | DENV | NS3EU482673 |
| DENV | NS3FM210233 | DENV | NS3EU569692 | DENV | NS3FJ024474 |
| DENV | NS3EU687199 | DENV | NS3FJ410233 | DENV | NS3EU687214 |
| DENV | NS3EU482686 | DENV | NS3AF100467 | DENV | NS3FJ410291 |
| DENV | NS3FJ205880 | DENV | NS3EU677148 | DENV | NS3FM210242 |

FIG. 70-132

| Virus | Protein | Accession No. | Virus | Protein | Accession No. | Virus | Protein | Accession No. |
|---|---|---|---|---|---|---|---|---|
| DENV | NS3 | EU687250 | DENV | NS3 | GQ199874 | DENV | NS3 | FJ810409 |
| DENV | NS3 | EU482735 | DENV | NS3 | FJ744745 | DENV | NS3 | FJ687434 |
| DENV | NS3 | EU482785 | DENV | NS3 | FJ898467 | DENV | NS3 | GQ199890 |
| DENV | NS3 | EU596483 | DENV | NS3 | FJ687444 | DENV | NS3 | FJ744743 |
| DENV | NS3 | EU569702 | DENV | NS3 | FJ810411 | DENV | NS3 | FJ850063 |
| DENV | NS3 | FJ410241 | DENV | NS3 | FJ850067 | DENV | NS3 | FJ898466 |
| DENV | NS3 | EU482659 | DENV | NS3 | FJ850121 | DENV | NS3 | FJ850119 |
| DENV | NS3 | FM210203 | DENV | NS3 | FJ898452 | DENV | NS3 | FJ898432 |
| DENV | NS3 | EU482581 | DENV | NS3 | FJ744713 | DENV | NS3 | FJ744718 |
| DENV | NS3 | EU569696 | DENV | NS3 | FJ810418 | DENV | NS3 | FJ810412 |
| DENV | NS3 | FJ562098 | DENV | NS3 | FJ906962 | DENV | NS3 | FJ906956 |
| DENV | NS3 | FM210222 | DENV | NS3 | FJ744721 | DENV | NS3 | FJ850064 |
| DENV | NS3 | EU482473 | DENV | NS3 | FJ850107 | DENV | NS3 | GQ199892 |
| DENV | NS3 | EU854294 | DENV | NS3 | FJ467493 | DENV | NS3 | FJ898436 |
| DENV | NS3 | EU482649 | DENV | NS3 | FJ906966 | DENV | NS3 | FJ906957 |
| DENV | NS3 | EU726767 | DENV | NS3 | FJ687446 | DENV | NS3 | FJ898478 |
| DENV | NS3 | FJ024454 | DENV | NS3 | FJ906958 | DENV | NS3 | FJ873811 |
| DENV | NS3 | FJ639699 | DENV | NS3 | FJ687435 | DENV | NS3 | GQ199898 |
| DENV | NS3 | FM210204 | DENV | NS3 | FJ850054 | DENV | NS3 | FJ850115 |
| DENV | NS3 | EU529695 | DENV | NS3 | FJ906967 | DENV | NS3 | FJ687442 |
| DENV | NS3 | EU687222 | DENV | NS3 | FJ850072 | DENV | NS3 | FJ687439 |
| DENV | NS3 | EF105382 | DENV | NS3 | FJ898439 | DENV | NS3 | FJ432724 |
| DENV | NS3 | EU482738 | DENV | NS3 | FJ850088 | DENV | NS3 | FJ687447 |
| DENV | NS3 | EF105385 | DENV | NS3 | FJ898435 | DENV | NS3 | FJ873808 |
| DENV | NS3 | FM210219 | DENV | NS3 | GQ252676 | DENV | NS3 | DQ448231 |
| DENV | NS3 | EU482723 | DENV | NS3 | FJ850065 | DENV | NS3 | FJ744710 |
| DENV | NS3 | FJ639829 | DENV | NS3 | FJ898477 | DENV | NS3 | GQ252677 |
| DENV | NS3 | EU482575 | DENV | NS3 | FJ850116 | DENV | NS3 | NC_001474 |
| DENV | NS3 | AF038402 | DENV | NS3 | FJ898454 | DENV | NS3 | FJ687445 |
| DENV | NS3 | FJ639783 | DENV | NS3 | GQ199897 | DENV | NS3 | FJ850091 |
| DENV | NS3 | EU482572 | DENV | NS3 | GQ199899 | DENV | NS3 | FJ687443 |
| DENV | NS3 | FJ639734 | DENV | NS3 | FJ744723 | DENV | NS3 | GQ199869 |
| DENV | NS3 | EU482762 | DENV | NS3 | GQ199900 | DENV | NS3 | FJ850105 |
| DENV | NS3 | EU569704 | DENV | NS3 | FJ850082 | DENV | NS3 | FJ850051 |
| DENV | NS3 | EU482759 | DENV | NS3 | FJ744715 | DENV | NS3 | FJ850050 |
| DENV | NS3 | EU056812 | DENV | NS3 | FJ744709 | DENV | NS3 | FJ744719 |
| DENV | NS3 | FJ410228 | DENV | NS3 | GQ199868 | DENV | NS3 | FJ898453 |
| DENV | NS3 | EU482467 | DENV | NS3 | FJ906960 | DENV | NS3 | FJ898460 |
| DENV | NS3 | FM210217 | DENV | NS3 | FJ882602 | DENV | NS3 | FJ898438 |
| DENV | NS3 | FM210212 | DENV | NS3 | GQ199895 | DENV | NS3 | FJ850053 |
| DENV | NS3 | EU660405 | DENV | NS3 | FJ687436 | DENV | NS3 | FJ898450 |
| DENV | NS3 | FJ547064 | DENV | NS3 | FJ744725 | DENV | NS3 | FJ744708 |
| DENV | NS3 | EU482740 | DENV | NS3 | FJ850117 | DENV | NS3 | GQ199896 |
| DENV | NS3 | EU482451 | DENV | NS3 | FJ687441 | DENV | NS3 | FJ744722 |
| DENV | NS3 | EU482668 | DENV | NS3 | FJ744706 | DENV | NS3 | FJ850062 |
| DENV | NS3 | EU687229 | DENV | NS3 | FJ850074 | DENV | NS3 | FJ898461 |
| DENV | NS3 | AF169684 | DENV | NS3 | FJ850085 | DENV | NS3 | FJ810410 |
| DENV | NS3 | FM210235 | DENV | NS3 | FJ850061 | DENV | NS3 | FJ850060 |

FIG. 70-133

| Virus | Protein Accession No. | Virus | Protein Accession No. | Virus | Protein Accession No. |
|---|---|---|---|---|---|
| DENV | NS3FJ906961 | DENV | NS3AF022438 | DENV | NS3GQ868558 |
| DENV | NS3FJ882593 | DENV | NS3AF022440 | DENV | NS3GQ868625 |
| DENV | NS3FJ898479 | DENV | NS3CS479165 | DENV | NS3GQ868624 |
| DENV | NS3FJ744703 | DENV | NS3GQ868556 | DENV | NS3GQ868631 |
| DENV | NS3FJ744712 | DENV | NS3AB479041 | DENV | NS3GU131899 |
| DENV | NS3FJ882594 | DENV | NS3GU289914 | DENV | NS3GQ868515 |
| DENV | NS3FJ744716 | DENV | NS3GU131884 | DENV | NS3GU131898 |
| DENV | NS3FJ850066 | DENV | NS3GQ868600 | DENV | NS3GQ868623 |
| DENV | NS3FJ744744 | DENV | NS3FN429895 | DENV | NS3GU131886 |
| DENV | NS3FJ850108 | DENV | NS3GU131879 | DENV | NS3GQ868622 |
| DENV | NS3FJ859028 | DENV | NS3GQ868596 | DENV | NS3GQ868595 |
| DENV | NS3FJ898465 | DENV | NS3GQ868516 | DENV | NS3GQ868557 |
| DENV | NS3FJ898451 | DENV | NS3GU131864 | DENV | NS3GU131959 |
| DENV | NS3FJ898449 | DENV | NS3FN429893 | DENV | NS3GU131955 |
| DENV | NS3FJ744705 | DENV | NS3GQ868598 | DENV | NS3GQ868597 |
| DENV | NS3FJ898434 | DENV | NS3GQ868544 | DENV | NS3GU131883 |
| DENV | NS3FJ906969 | DENV | NS3GQ868589 | DENV | NS3GQ868591 |
| DENV | NS3FJ744741 | DENV | NS3GQ868551 | DENV | NS3GQ868543 |
| DENV | NS3FJ906959 | DENV | NS3GU131902 | DENV | NS3GU131901 |
| DENV | NS3FJ850106 | DENV | NS3GU131896 | DENV | NS3GQ868545 |
| DENV | NS3FJ744742 | DENV | NS3GU131924 | DENV | NS3GU131931 |
| DENV | NS3FJ687437 | DENV | NS3GQ868640 | DENV | NS3GU131885 |
| DENV | NS3FJ744707 | DENV | NS3GU131880 | DENV | NS3GU131932 |
| DENV | NS3FJ687438 | DENV | NS3GU131882 | DENV | NS3GU131881 |
| DENV | NS3FJ744714 | DENV | NS3GQ868638 | DENV | NS3GU131897 |
| DENV | NS3GQ199866 | DENV | NS3GQ868553 | DENV | NS3GQ868592 |
| DENV | NS3GQ199894 | DENV | NS3GQ868646 | DENV | NS3GQ868552 |
| DENV | NS3FJ687440 | DENV | NS3FN429891 | DENV | NS3GU131900 |
| DENV | NS3FJ850112 | DENV | NS3GQ868604 | DENV | NS3GQ868599 |
| DENV | NS3FJ850078 | DENV | NS3GU131947 | DENV | NS3GU131929 |
| DENV | NS3FJ744717 | DENV | NS3GU131928 | DENV | NS3GU131930 |
| DENV | NS3FJ906968 | DENV | NS3GQ868497 | DENV | NS3GQ868550 |
| DENV | NS3GQ199893 | DENV | NS3GQ868603 | DENV | NS3GU131975 |
| DENV | NS3FJ744711 | DENV | NS3GQ868621 | DENV | NS3GU131927 |
| DENV | NS3FJ744704 | DENV | NS3AB479042 | DENV | NS3GQ868540 |
| DENV | NS3FJ744720 | DENV | NS3GQ868620 | DENV | NS3FJ410202 |
| DENV | NS3GQ199901 | DENV | NS3GQ868590 | DENV | NS3CS479202 |
| DENV | NS3FJ744724 | DENV | NS3FN429892 | DENV | NS3U87411 |
| DENV | NS3FJ850120 | DENV | NS3GQ868554 | DENV | NS3CS479203 |
| DENV | NS3FJ850118 | DENV | NS3GU131974 | DENV | NS3CS479204 |
| DENV | NS3FJ850076 | DENV | NS3GU131843 | DENV | NS3CS479167 |
| DENV | NS3AF022436 | DENV | NS3GQ868641 | DENV | NS3CS479205 |
| DENV | NS3AF022439 | DENV | NS3GQ868542 | DENV | NS3CS479206 |
| DENV | NS3AF022441 | DENV | NS3GQ868555 | DENV | NS3CS805344 |
| DENV | NS3AF022437 | DENV | NS3FN429894 | DENV | NS3FB730117 |
| DENV | NS3AJ487271 | DENV | NS3GQ868549 | DENV | NS3DL138662 |
| DENV | NS3AF022435 | DENV | NS3GQ868588 | DENV | NS3GM059692 |
| DENV | NS3AF022434 | DENV | NS3GQ868541 | DENV | NS3AY243468 |

FIG. 70-134

| Virus | Protein | Accession No. | Virus | Protein | Accession No. | Virus | Protein | Accession No. |
|---|---|---|---|---|---|---|---|---|
| DENV | NS3 | AY243469 | DENV | NS4A | FJ176780 | DENV | NS4A | FJ639694 |
| DENV | NS3 | AY744148 | DENV | NS4A | FJ461340 | DENV | NS4A | EU482500 |
| DENV | NS3 | AY744149 | DENV | NS4A | AY732475 | DENV | NS4A | DQ672560 |
| DENV | NS3 | AY744150 | DENV | NS4A | AY732474 | DENV | NS4A | AY713473 |
| DENV | NS3 | AJ968413 | DENV | NS4A | FJ024435 | DENV | NS4A | EU726780 |
| DENV | NS3 | GU369819 | DENV | NS4A | FJ639669 | DENV | NS4A | FJ410255 |
| DENV | NS3 | GU370050 | DENV | NS4A | EU482540 | DENV | NS4A | FJ373298 |
| DENV | NS3 | GU370051 | DENV | NS4A | FJ024429 | DENV | NS4A | EU081276 |
| DENV | NS4A | AY277665 | DENV | NS4A | EU677167 | DENV | NS4A | FJ410198 |
| DENV | NS4A | AY713474 | DENV | NS4A | EU482512 | DENV | NS4A | EU482536 |
| DENV | NS4A | AF311957 | DENV | NS4A | FJ390381 | DENV | NS4A | FJ390382 |
| DENV | NS4A | FJ205881 | DENV | NS4A | FJ410226 | DENV | NS4A | FJ024462 |
| DENV | NS4A | EU482817 | DENV | NS4A | FJ410191 | DENV | NS4A | EU482822 |
| DENV | NS4A | DQ672557 | DENV | NS4A | AJ968413 | DENV | NS4A | FJ024447 |
| DENV | NS4A | EU677151 | DENV | NS4A | FJ639689 | DENV | NS4A | FJ410274 |
| DENV | NS4A | FJ410256 | DENV | NS4A | AY277664 | DENV | NS4A | FJ410216 |
| DENV | NS4A | FJ432735 | DENV | NS4A | FJ639811 | DENV | NS4A | EU482527 |
| DENV | NS4A | EU660390 | DENV | NS4A | FJ639695 | DENV | NS4A | EU280167 |
| DENV | NS4A | EU482824 | DENV | NS4A | EU081226 | DENV | NS4A | EU482567 |
| DENV | NS4A | FJ410222 | DENV | NS4A | FJ410280 | DENV | NS4A | EU081265 |
| DENV | NS4A | AY726551 | DENV | NS4A | EU596504 | DENV | NS4A | EU482489 |
| DENV | NS4A | EU482716 | DENV | NS4A | FJ639685 | DENV | NS4A | AB178040 |
| DENV | NS4A | AF226685 | DENV | NS4A | EU482715 | DENV | NS4A | EU482827 |
| DENV | NS4A | EU677174 | DENV | NS4A | FJ410227 | DENV | NS4A | FJ024455 |
| DENV | NS4A | FJ639693 | DENV | NS4A | DQ285560 | DENV | NS4A | EU081238 |
| DENV | NS4A | FJ461317 | DENV | NS4A | FJ182002 | DENV | NS4A | FJ410245 |
| DENV | NS4A | FJ384655 | DENV | NS4A | EU677177 | DENV | NS4A | FJ461318 |
| DENV | NS4A | EU482508 | DENV | NS4A | FJ639680 | DENV | NS4A | FJ410263 |
| DENV | NS4A | AF311958 | DENV | NS4A | EU677160 | DENV | NS4A | FJ410269 |
| DENV | NS4A | FJ024451 | DENV | NS4A | AY835999 | DENV | NS4A | FJ410289 |
| DENV | NS4A | EU482528 | DENV | NS4A | EU249494 | DENV | NS4A | FJ639692 |
| DENV | NS4A | EU482821 | DENV | NS4A | AF226687 | DENV | NS4A | EU660397 |
| DENV | NS4A | FJ410267 | DENV | NS4A | FJ024432 | DENV | NS4A | EU482477 |
| DENV | NS4A | AB074761 | DENV | NS4A | EU081229 | DENV | NS4A | FJ024434 |
| DENV | NS4A | AY762084 | DENV | NS4A | FJ410184 | DENV | NS4A | FJ410204 |
| DENV | NS4A | AY732480 | DENV | NS4A | FJ182022 | DENV | NS4A | EU249495 |
| DENV | NS4A | EU482481 | DENV | NS4A | EU677153 | DENV | NS4A | AF513110 |
| DENV | NS4A | FJ410232 | DENV | NS4A | DQ672559 | DENV | NS4A | FJ024438 |
| DENV | NS4A | EU081254 | DENV | NS4A | EU081234 | DENV | NS4A | EU081264 |
| DENV | NS4A | EU482806 | DENV | NS4A | FJ639802 | DENV | NS4A | EU482525 |
| DENV | NS4A | FJ410257 | DENV | NS4A | EU482483 | DENV | NS4A | EU687251 |
| DENV | NS4A | FJ432720 | DENV | NS4A | FJ024445 | DENV | NS4A | EU482486 |
| DENV | NS4A | FJ547089 | DENV | NS4A | FJ410236 | DENV | NS4A | DQ285558 |
| DENV | NS4A | EU482819 | DENV | NS4A | FJ410242 | DENV | NS4A | FJ205883 |
| DENV | NS4A | EU081270 | DENV | NS4A | FJ390378 | DENV | NS4A | AY145121 |
| DENV | NS4A | FJ205875 | DENV | NS4A | EU081236 | DENV | NS4A | AY732478 |
| DENV | NS4A | FJ410210 | DENV | NS4A | EU081278 | DENV | NS4A | FJ410199 |
| DENV | NS4A | FJ205884 | DENV | NS4A | FJ432736 | DENV | NS4A | FJ390383 |

FIG. 70-135

| Virus | Protein | Accession No. | Virus | Protein | Accession No. | Virus | Protein | Accession No. |
|---|---|---|---|---|---|---|---|---|
| DENV | NS4A | EU482592 | DENV | NS4A | EU482532 | DENV | NS4A | FJ410262 |
| DENV | NS4A | FJ182030 | DENV | NS4A | FJ182031 | DENV | NS4A | FJ024480 |
| DENV | NS4A | FJ024431 | DENV | NS4A | FJ024428 | DENV | NS4A | EU482495 |
| DENV | NS4A | FJ024450 | DENV | NS4A | FJ432749 | DENV | NS4A | FJ182032 |
| DENV | NS4A | FJ410252 | DENV | NS4A | DQ285561 | DENV | NS4A | FJ410197 |
| DENV | NS4A | FJ478457 | DENV | NS4A | EU482518 | DENV | NS4A | AF514883 |
| DENV | NS4A | EU596502 | DENV | NS4A | EU726779 | DENV | NS4A | FJ461330 |
| DENV | NS4A | FJ410201 | DENV | NS4A | EU677161 | DENV | NS4A | FJ639690 |
| DENV | NS4A | FJ562105 | DENV | NS4A | AY145123 | DENV | NS4A | FJ410209 |
| DENV | NS4A | FJ639684 | DENV | NS4A | EU482800 | DENV | NS4A | EU482514 |
| DENV | NS4A | FJ639682 | DENV | NS4A | AY732482 | DENV | NS4A | EU848545 |
| DENV | NS4A | FJ410240 | DENV | NS4A | EU482517 | DENV | NS4A | EU249492 |
| DENV | NS4A | EU081279 | DENV | NS4A | EU482488 | DENV | NS4A | EU081240 |
| DENV | NS4A | EU081231 | DENV | NS4A | FJ373305 | DENV | NS4A | EU482499 |
| DENV | NS4A | FJ410214 | DENV | NS4A | FJ432746 | DENV | NS4A | FJ410281 |
| DENV | NS4A | FJ182036 | DENV | NS4A | FJ432734 | DENV | NS4A | FJ410270 |
| DENV | NS4A | FJ182023 | DENV | NS4A | EU482797 | DENV | NS4A | EU482808 |
| DENV | NS4A | EU482479 | DENV | NS4A | EU482711 | DENV | NS4A | EU081281 |
| DENV | NS4A | FJ547087 | DENV | NS4A | FJ024459 | DENV | NS4A | AF309641 |
| DENV | NS4A | FJ639683 | DENV | NS4A | FJ410174 | DENV | NS4A | EU677159 |
| DENV | NS4A | FJ024442 | DENV | NS4A | EU596503 | DENV | NS4A | EU482526 |
| DENV | NS4A | FJ410285 | DENV | NS4A | FJ432730 | DENV | NS4A | FJ024427 |
| DENV | NS4A | EU482615 | DENV | NS4A | EU081227 | DENV | NS4A | EU482618 |
| DENV | NS4A | AY732476 | DENV | NS4A | EU677163 | DENV | NS4A | AF350498 |
| DENV | NS4A | FJ024463 | DENV | NS4A | AY277666 | DENV | NS4A | EU677169 |
| DENV | NS4A | FJ410275 | DENV | NS4A | FJ024483 | DENV | NS4A | EU482828 |
| DENV | NS4A | FJ410234 | DENV | NS4A | DQ193572 | DENV | NS4A | EU482537 |
| DENV | NS4A | EU482487 | DENV | NS4A | EF122231 | DENV | NS4A | EU726782 |
| DENV | NS4A | FJ410182 | DENV | NS4A | EU081266 | DENV | NS4A | FJ410225 |
| DENV | NS4A | EU482812 | DENV | NS4A | EU482818 | DENV | NS4A | FJ410180 |
| DENV | NS4A | EU081247 | DENV | NS4A | FJ410186 | DENV | NS4A | FJ024460 |
| DENV | NS4A | AB074760 | DENV | NS4A | EU249493 | DENV | NS4A | FJ410231 |
| DENV | NS4A | EU482802 | DENV | NS4A | FJ024478 | DENV | NS4A | FJ390380 |
| DENV | NS4A | EU677172 | DENV | NS4A | FJ205874 | DENV | NS4A | FJ410238 |
| DENV | NS4A | EU482496 | DENV | NS4A | EU482791 | DENV | NS4A | FJ390379 |
| DENV | NS4A | EU726777 | DENV | NS4A | EU482798 | DENV | NS4A | AF311956 |
| DENV | NS4A | U88535 | DENV | NS4A | EU081248 | DENV | NS4A | EU081257 |
| DENV | NS4A | EU482519 | DENV | NS4A | EU596501 | DENV | NS4A | FJ432721 |
| DENV | NS4A | FJ461339 | DENV | NS4A | FJ461336 | DENV | NS4A | FJ639672 |
| DENV | NS4A | FJ562101 | DENV | NS4A | FJ024457 | DENV | NS4A | FJ639794 |
| DENV | NS4A | FJ461316 | DENV | NS4A | EU482485 | DENV | NS4A | EU660403 |
| DENV | NS4A | EU482814 | DENV | NS4A | FJ176779 | DENV | NS4A | EU482619 |
| DENV | NS4A | AY726555 | DENV | NS4A | EU482799 | DENV | NS4A | EU677155 |
| DENV | NS4A | FJ639677 | DENV | NS4A | EU081233 | DENV | NS4A | FJ182021 |
| DENV | NS4A | EU482506 | DENV | NS4A | EU482497 | DENV | NS4A | EU482712 |
| DENV | NS4A | FJ410283 | DENV | NS4A | EU482616 | DENV | NS4A | EU482591 |
| DENV | NS4A | FJ639696 | DENV | NS4A | EU482507 | DENV | NS4A | FJ410253 |
| DENV | NS4A | FJ410235 | DENV | NS4A | EU482809 | DENV | NS4A | EF032590 |

FIG. 70-136

| Virus | Protein | Accession No. | Virus | Protein | Accession No. | Virus | Protein | Accession No. |
|---|---|---|---|---|---|---|---|---|
| DENV | NS4A | EU081243 | DENV | NS4A | EU081273 | DENV | NS4A | EU482811 |
| DENV | NS4A | FJ639818 | DENV | NS4A | EU482820 | DENV | NS4A | AF226686 |
| DENV | NS4A | EU081237 | DENV | NS4A | AF514878 | DENV | NS4A | EU081235 |
| DENV | NS4A | AF514876 | DENV | NS4A | EU660394 | DENV | NS4A | EU660419 |
| DENV | NS4A | FJ639688 | DENV | NS4A | FJ410218 | DENV | NS4A | FJ547068 |
| DENV | NS4A | EU482713 | DENV | NS4A | EU081241 | DENV | NS4A | AB189121 |
| DENV | NS4A | EU677154 | DENV | NS4A | FJ410244 | DENV | NS4A | FJ461308 |
| DENV | NS4A | EU081242 | DENV | NS4A | EU482789 | DENV | NS4A | FJ410213 |
| DENV | NS4A | EU687247 | DENV | NS4A | EU482524 | DENV | NS4A | AY726550 |
| DENV | NS4A | AY726552 | DENV | NS4A | EU081261 | DENV | NS4A | AY732477 |
| DENV | NS4A | FJ024436 | DENV | NS4A | FJ639812 | DENV | NS4A | EU660401 |
| DENV | NS4A | FJ639681 | DENV | NS4A | EU482533 | DENV | NS4A | FJ639815 |
| DENV | NS4A | EU482484 | DENV | NS4A | DQ285559 | DENV | NS4A | FJ410268 |
| DENV | NS4A | EU482815 | DENV | NS4A | FJ410246 | DENV | NS4A | FJ478458 |
| DENV | NS4A | EU249490 | DENV | NS4A | FJ461310 | DENV | NS4A | FJ639808 |
| DENV | NS4A | EU081253 | DENV | NS4A | AB195673 | DENV | NS4A | EU482611 |
| DENV | NS4A | AY726549 | DENV | NS4A | FJ182024 | DENV | NS4A | FJ410261 |
| DENV | NS4A | EU677166 | DENV | NS4A | AB204803 | DENV | NS4A | FJ432729 |
| DENV | NS4A | FJ639821 | DENV | NS4A | EF025110 | DENV | NS4A | FJ639813 |
| DENV | NS4A | FJ024430 | DENV | NS4A | DQ672564 | DENV | NS4A | EU482520 |
| DENV | NS4A | FJ410183 | DENV | NS4A | EU726778 | DENV | NS4A | AF514885 |
| DENV | NS4A | EU081267 | DENV | NS4A | EF457905 | DENV | NS4A | FJ639673 |
| DENV | NS4A | EU482491 | DENV | NS4A | FJ547088 | DENV | NS4A | FJ410266 |
| DENV | NS4A | EU081249 | DENV | NS4A | FJ024437 | DENV | NS4A | EU482805 |
| DENV | NS4A | EU081252 | DENV | NS4A | EU482513 | DENV | NS4A | FJ432740 |
| DENV | NS4A | EU482706 | DENV | NS4A | FJ410196 | DENV | NS4A | AY726554 |
| DENV | NS4A | AY726553 | DENV | NS4A | FJ410250 | DENV | NS4A | FJ024441 |
| DENV | NS4A | FJ205882 | DENV | NS4A | EU660392 | DENV | NS4A | DQ672556 |
| DENV | NS4A | FJ390386 | DENV | NS4A | FJ461313 | DENV | NS4A | FJ410272 |
| DENV | NS4A | EU677139 | DENV | NS4A | EU677168 | DENV | NS4A | FJ639676 |
| DENV | NS4A | FJ410260 | DENV | NS4A | FJ432723 | DENV | NS4A | FJ639686 |
| DENV | NS4A | EU677170 | DENV | NS4A | FJ410181 | DENV | NS4A | EU482498 |
| DENV | NS4A | EU081256 | DENV | NS4A | FJ410239 | DENV | NS4A | FJ432725 |
| DENV | NS4A | FJ024443 | DENV | NS4A | EU482480 | DENV | NS4A | EU482529 |
| DENV | NS4A | FJ410278 | DENV | NS4A | AY206457 | DENV | NS4A | FJ547086 |
| DENV | NS4A | FJ432744 | DENV | NS4A | EU482523 | DENV | NS4A | FJ461323 |
| DENV | NS4A | AB189120 | DENV | NS4A | FJ410290 | DENV | NS4A | FJ410230 |
| DENV | NS4A | FJ461327 | DENV | NS4A | DQ672562 | DENV | NS4A | FJ410248 |
| DENV | NS4A | EU660391 | DENV | NS4A | EU482521 | DENV | NS4A | EU482609 |
| DENV | NS4A | FJ562106 | DENV | NS4A | EU660402 | DENV | NS4A | FJ639824 |
| DENV | NS4A | FJ182035 | DENV | NS4A | FJ461307 | DENV | NS4A | FJ410279 |
| DENV | NS4A | FJ461306 | DENV | NS4A | EU081272 | DENV | NS4A | EU482535 |
| DENV | NS4A | EU482510 | DENV | NS4A | FJ461315 | DENV | NS4A | FJ024453 |
| DENV | NS4A | FJ024440 | DENV | NS4A | FJ410188 | DENV | NS4A | FJ432748 |
| DENV | NS4A | EU081258 | DENV | NS4A | AY713475 | DENV | NS4A | EU660393 |
| DENV | NS4A | EU081268 | DENV | NS4A | AY732479 | DENV | NS4A | AY145122 |
| DENV | NS4A | EU677178 | DENV | NS4A | EU677156 | DENV | NS4A | FJ024446 |
| DENV | NS4A | FJ410276 | DENV | NS4A | EU482707 | DENV | NS4A | FJ432747 |

FIG. 70-137

| Virus | Protein | Accession No. | Virus | Protein | Accession No. | Virus | Protein | Accession No. |
|---|---|---|---|---|---|---|---|---|
| DENV | NS4A | FJ410205 | DENV | NS4A | FJ639674 | DENV | NS4A | EU482476 |
| DENV | NS4A | FJ205876 | DENV | NS4A | FJ547065 | DENV | NS4A | EU482505 |
| DENV | NS4A | FJ410211 | DENV | NS4A | FJ410212 | DENV | NS4A | EU081255 |
| DENV | NS4A | FJ182025 | DENV | NS4A | FJ461341 | DENV | NS4A | FJ639743 |
| DENV | NS4A | FJ182026 | DENV | NS4A | EU081259 | DENV | NS4A | U88537 |
| DENV | NS4A | FJ373296 | DENV | NS4A | FJ639823 | DENV | NS4A | FJ432733 |
| DENV | NS4A | AY722802 | DENV | NS4A | FJ410190 | DENV | NS4A | EU660395 |
| DENV | NS4A | EU482522 | DENV | NS4A | FJ432745 | DENV | NS4A | EU081263 |
| DENV | NS4A | FJ390388 | DENV | NS4A | FJ410175 | DENV | NS4A | EU482826 |
| DENV | NS4A | EU677173 | DENV | NS4A | EU677176 | DENV | NS4A | FJ410192 |
| DENV | NS4A | EU081277 | DENV | NS4A | FJ639679 | DENV | NS4A | FJ182020 |
| DENV | NS4A | EU482492 | DENV | NS4A | FJ432742 | DENV | NS4A | DQ672561 |
| DENV | NS4A | FJ432732 | DENV | NS4A | FJ639670 | DENV | NS4A | FJ024481 |
| DENV | NS4A | FJ639691 | DENV | NS4A | FJ182027 | DENV | NS4A | EU677165 |
| DENV | NS4A | EU482511 | DENV | NS4A | EU482718 | DENV | NS4A | FJ410287 |
| DENV | NS4A | EU081230 | DENV | NS4A | EU677158 | DENV | NS4A | EU482502 |
| DENV | NS4A | FJ410206 | DENV | NS4A | FJ639687 | DENV | NS4A | EU081274 |
| DENV | NS4A | FJ410189 | DENV | NS4A | FJ461325 | DENV | NS4A | FJ024448 |
| DENV | NS4A | FJ182019 | DENV | NS4A | FJ024444 | DENV | NS4A | FJ024425 |
| DENV | NS4A | FJ024472 | DENV | NS4A | EU482617 | DENV | NS4A | FJ639741 |
| DENV | NS4A | FJ205872 | DENV | NS4A | FJ639678 | DENV | NS4A | FJ562104 |
| DENV | NS4A | FJ410282 | DENV | NS4A | EU081269 | DENV | NS4A | DQ672563 |
| DENV | NS4A | EU482538 | DENV | NS4A | EU482714 | DENV | NS4A | EU482708 |
| DENV | NS4A | EU660418 | DENV | NS4A | FJ024456 | DENV | NS4A | FJ410247 |
| DENV | NS4A | FJ639819 | DENV | NS4A | FJ182028 | DENV | NS4A | AF180817 |
| DENV | NS4A | FJ639806 | DENV | NS4A | EU677152 | DENV | NS4A | AY722801 |
| DENV | NS4A | FJ432738 | DENV | NS4A | EU081228 | DENV | NS4A | EU482504 |
| DENV | NS4A | FJ432719 | DENV | NS4A | FJ410173 | DENV | NS4A | FJ639675 |
| DENV | NS4A | FJ461303 | DENV | NS4A | EU482796 | DENV | NS4A | FJ024433 |
| DENV | NS4A | FJ410203 | DENV | NS4A | EU726781 | DENV | NS4A | FJ461331 |
| DENV | NS4A | FJ410194 | DENV | NS4A | FJ410207 | DENV | NS4A | FJ410187 |
| DENV | NS4A | EU081244 | DENV | NS4A | FJ410243 | DENV | NS4A | FJ410258 |
| DENV | NS4A | EU482482 | DENV | NS4A | EU081239 | DENV | NS4A | AY708047 |
| DENV | NS4A | FJ410179 | DENV | NS4A | EU482816 | DENV | NS4A | FJ024423 |
| DENV | NS4A | AY722803 | DENV | NS4A | EU081260 | DENV | NS4A | FJ024484 |
| DENV | NS4A | EU482539 | DENV | NS4A | FJ182029 | DENV | NS4A | EU081251 |
| DENV | NS4A | FJ639671 | DENV | NS4A | FJ024449 | DENV | NS4A | FJ410249 |
| DENV | NS4A | EU482478 | DENV | NS4A | EU081250 | DENV | NS4A | EU482610 |
| DENV | NS4A | FJ547060 | DENV | NS4A | EU482825 | DENV | NS4A | FJ182033 |
| DENV | NS4A | FJ432739 | DENV | NS4A | EU482530 | DENV | NS4A | EU482493 |
| DENV | NS4A | FJ639740 | DENV | NS4A | FJ639820 | DENV | NS4A | EU482807 |
| DENV | NS4A | FJ182034 | DENV | NS4A | EU677175 | DENV | NS4A | FJ639814 |
| DENV | NS4A | EU482710 | DENV | NS4A | FJ410251 | DENV | NS4A | EU482501 |
| DENV | NS4A | EU081232 | DENV | NS4A | EU482794 | DENV | NS4A | FJ410254 |
| DENV | NS4A | EU482515 | DENV | NS4A | EU359008 | DENV | NS4A | EU081246 |
| DENV | NS4A | EU482531 | DENV | NS4A | AF180818 | DENV | NS4A | EU081275 |
| DENV | NS4A | AF298807 | DENV | NS4A | EU660396 | DENV | NS4A | FJ410264 |
| DENV | NS4A | FJ205873 | DENV | NS4A | FJ182003 | DENV | NS4A | FJ024479 |

FIG. 70-138

| Virus | Protein | Accession No. | Virus | Protein | Accession No. | Virus | Protein | Accession No. |
|---|---|---|---|---|---|---|---|---|
| DENV | NS4A | FJ410185 | DENV | NS4A | EU482795 | DENV | NS4A | FJ898410 |
| DENV | NS4A | FJ410273 | DENV | NS4A | EU677164 | DENV | NS4A | FJ882528 |
| DENV | NS4A | EU482801 | DENV | NS4A | FJ410277 | DENV | NS4A | FJ898382 |
| DENV | NS4A | AY713476 | DENV | NS4A | FJ024464 | DENV | NS4A | FJ898404 |
| DENV | NS4A | FJ461312 | DENV | NS4A | FJ461332 | DENV | NS4A | FJ687426 |
| DENV | NS4A | FJ639797 | DENV | NS4A | EF122232 | DENV | NS4A | FJ898371 |
| DENV | NS4A | FJ461319 | DENV | NS4A | FJ432727 | DENV | NS4A | GQ199872 |
| DENV | NS4A | FJ461333 | DENV | NS4A | EU482823 | DENV | NS4A | GQ199855 |
| DENV | NS4A | EU482516 | DENV | NS4A | EU482810 | DENV | NS4A | FJ882535 |
| DENV | NS4A | EU482792 | DENV | NS4A | EU081245 | DENV | NS4A | NC_001477 |
| DENV | NS4A | AF514889 | DENV | NS4A | EU081262 | DENV | NS4A | FJ898423 |
| DENV | NS4A | EU482509 | DENV | NS4A | EU863650 | DENV | NS4A | FJ882565 |
| DENV | NS4A | FJ432737 | DENV | NS4A | AY732483 | DENV | NS4A | FJ882517 |
| DENV | NS4A | FJ547063 | DENV | NS4A | FJ410265 | DENV | NS4A | GQ199814 |
| DENV | NS4A | FJ373297 | DENV | NS4A | EU660412 | DENV | NS4A | FJ898395 |
| DENV | NS4A | EU677157 | DENV | NS4A | EU677171 | DENV | NS4A | GQ199851 |
| DENV | NS4A | EU482534 | DENV | NS4A | EU677140 | DENV | NS4A | GQ199837 |
| DENV | NS4A | EU249491 | DENV | NS4A | FJ898428 | DENV | NS4A | FJ882558 |
| DENV | NS4A | DQ285562 | DENV | NS4A | FJ882569 | DENV | NS4A | FJ850084 |
| DENV | NS4A | EU482793 | DENV | NS4A | GQ199776 | DENV | NS4A | FJ898374 |
| DENV | NS4A | EU482717 | DENV | NS4A | GQ199853 | DENV | NS4A | FJ850104 |
| DENV | NS4A | FJ024439 | DENV | NS4A | GQ199803 | DENV | NS4A | GQ199815 |
| DENV | NS4A | EU482804 | DENV | NS4A | FJ882554 | DENV | NS4A | GQ199843 |
| DENV | NS4A | EU482503 | DENV | NS4A | FJ873809 | DENV | NS4A | GQ199826 |
| DENV | NS4A | EU677162 | DENV | NS4A | FJ882563 | DENV | NS4A | FJ882550 |
| DENV | NS4A | FJ024485 | DENV | NS4A | GQ199812 | DENV | NS4A | FJ744701 |
| DENV | NS4A | EU081271 | DENV | NS4A | FJ873810 | DENV | NS4A | FJ898391 |
| DENV | NS4A | FJ024426 | DENV | NS4A | FJ898397 | DENV | NS4A | FJ898417 |
| DENV | NS4A | EU482790 | DENV | NS4A | FJ898400 | DENV | NS4A | GQ199806 |
| DENV | NS4A | FJ410286 | DENV | NS4A | FJ687433 | DENV | NS4A | GQ199794 |
| DENV | NS4A | FJ639735 | DENV | NS4A | GQ199877 | DENV | NS4A | FJ898425 |
| DENV | NS4A | EU482494 | DENV | NS4A | GQ199788 | DENV | NS4A | FJ898393 |
| DENV | NS4A | FJ390374 | DENV | NS4A | GQ199823 | DENV | NS4A | GQ199799 |
| DENV | NS4A | EU482813 | DENV | NS4A | FJ898407 | DENV | NS4A | GQ199833 |
| DENV | NS4A | FJ461335 | DENV | NS4A | GQ199804 | DENV | NS4A | GQ199781 |
| DENV | NS4A | EU482803 | DENV | NS4A | FJ882533 | DENV | NS4A | GQ199797 |
| DENV | NS4A | EU482490 | DENV | NS4A | GQ199818 | DENV | NS4A | FJ882522 |
| DENV | NS4A | FJ024482 | DENV | NS4A | FJ882560 | DENV | NS4A | FJ906964 |
| DENV | NS4A | FJ410284 | DENV | NS4A | FJ898415 | DENV | NS4A | GQ199821 |
| DENV | NS4A | EU081280 | DENV | NS4A | FJ850113 | DENV | NS4A | GQ199847 |
| DENV | NS4A | EU677150 | DENV | NS4A | FJ898384 | DENV | NS4A | FJ882524 |
| DENV | NS4A | AY732481 | DENV | NS4A | FJ882538 | DENV | NS4A | FJ850077 |
| DENV | NS4A | FJ461324 | DENV | NS4A | FJ882521 | DENV | NS4A | FJ882552 |
| DENV | NS4A | FJ639796 | DENV | NS4A | GQ199811 | DENV | NS4A | GQ199778 |
| DENV | NS4A | EU482709 | DENV | NS4A | FJ850075 | DENV | NS4A | FJ882549 |
| DENV | NS4A | AF298808 | DENV | NS4A | GQ199848 | DENV | NS4A | GQ199816 |
| DENV | NS4A | FJ182018 | DENV | NS4A | FJ898378 | DENV | NS4A | GQ199824 |
| DENV | NS4A | DQ672558 | DENV | NS4A | FJ873814 | DENV | NS4A | FJ898398 |

FIG. 70-139

| Virus | Protein | Accession No. | Virus | Protein | Accession No. | Virus | Protein | Accession No. |
|---|---|---|---|---|---|---|---|---|
| DENV | NS4A | FJ859029 | DENV | NS4A | FJ882518 | DENV | NS4A | FJ882531 |
| DENV | NS4A | FJ882515 | DENV | NS4A | FJ898392 | DENV | NS4A | GQ199810 |
| DENV | NS4A | GQ199820 | DENV | NS4A | FJ898380 | DENV | NS4A | GQ199825 |
| DENV | NS4A | GQ199867 | DENV | NS4A | GQ199835 | DENV | NS4A | FJ882546 |
| DENV | NS4A | FJ898448 | DENV | NS4A | FJ898430 | DENV | NS4A | FJ882568 |
| DENV | NS4A | FJ882556 | DENV | NS4A | FJ850087 | DENV | NS4A | FJ898413 |
| DENV | NS4A | FJ882536 | DENV | NS4A | FJ898385 | DENV | NS4A | GQ199773 |
| DENV | NS4A | GQ199796 | DENV | NS4A | GQ199857 | DENV | NS4A | GQ199822 |
| DENV | NS4A | FJ882570 | DENV | NS4A | FJ898403 | DENV | NS4A | GQ199832 |
| DENV | NS4A | FJ898376 | DENV | NS4A | GQ199800 | DENV | NS4A | GQ199790 |
| DENV | NS4A | GQ199771 | DENV | NS4A | FJ882540 | DENV | NS4A | GQ199841 |
| DENV | NS4A | FJ850069 | DENV | NS4A | GQ199792 | DENV | NS4A | FJ882520 |
| DENV | NS4A | FJ850102 | DENV | NS4A | FJ882516 | DENV | NS4A | GQ199875 |
| DENV | NS4A | GQ199834 | DENV | NS4A | GQ199850 | DENV | NS4A | GQ199802 |
| DENV | NS4A | FJ898388 | DENV | NS4A | FJ898372 | DENV | NS4A | GQ199791 |
| DENV | NS4A | GQ199830 | DENV | NS4A | GQ199775 | DENV | NS4A | FJ898426 |
| DENV | NS4A | GQ199839 | DENV | NS4A | FJ882559 | DENV | NS4A | FJ898431 |
| DENV | NS4A | GQ199777 | DENV | NS4A | GQ199789 | DENV | NS4A | GQ199809 |
| DENV | NS4A | FJ882579 | DENV | NS4A | FJ850099 | DENV | NS4A | FJ898406 |
| DENV | NS4A | FJ898429 | DENV | NS4A | FJ850114 | DENV | NS4A | GQ199805 |
| DENV | NS4A | FJ882541 | DENV | NS4A | GQ199819 | DENV | NS4A | GQ199831 |
| DENV | NS4A | FJ898402 | DENV | NS4A | FJ882523 | DENV | NS4A | FJ850070 |
| DENV | NS4A | GQ199808 | DENV | NS4A | GQ199845 | DENV | NS4A | GQ199807 |
| DENV | NS4A | GQ199786 | DENV | NS4A | FJ850081 | DENV | NS4A | FJ882543 |
| DENV | NS4A | FJ882547 | DENV | NS4A | FJ744702 | DENV | NS4A | FJ898408 |
| DENV | NS4A | GQ199798 | DENV | NS4A | FJ898386 | DENV | NS4A | FJ810419 |
| DENV | NS4A | GQ199844 | DENV | NS4A | FJ882542 | DENV | NS4A | GQ199793 |
| DENV | NS4A | GQ199829 | DENV | NS4A | GQ199782 | DENV | NS4A | FJ882562 |
| DENV | NS4A | FJ882530 | DENV | NS4A | GQ199852 | DENV | NS4A | FJ898424 |
| DENV | NS4A | FJ898422 | DENV | NS4A | FJ898421 | DENV | NS4A | FJ898389 |
| DENV | NS4A | FJ810415 | DENV | NS4A | FJ687432 | DENV | NS4A | FJ898412 |
| DENV | NS4A | FJ898411 | DENV | NS4A | GQ199813 | DENV | NS4A | FJ882537 |
| DENV | NS4A | GQ199856 | DENV | NS4A | FJ882534 | DENV | NS4A | FJ898418 |
| DENV | NS4A | FJ850101 | DENV | NS4A | GQ199854 | DENV | NS4A | FJ898394 |
| DENV | NS4A | FJ850093 | DENV | NS4A | GQ199846 | DENV | NS4A | GQ199849 |
| DENV | NS4A | FJ882551 | DENV | NS4A | FJ882539 | DENV | NS4A | FJ882548 |
| DENV | NS4A | GQ199795 | DENV | NS4A | FJ898437 | DENV | NS4A | FJ906963 |
| DENV | NS4A | FJ850100 | DENV | NS4A | FJ898390 | DENV | NS4A | FJ906965 |
| DENV | NS4A | FJ898416 | DENV | NS4A | FJ898405 | DENV | NS4A | GQ199873 |
| DENV | NS4A | GQ199785 | DENV | NS4A | GQ199783 | DENV | NS4A | FJ850073 |
| DENV | NS4A | GQ199784 | DENV | NS4A | FJ882526 | DENV | NS4A | FJ850071 |
| DENV | NS4A | GQ199828 | DENV | NS4A | FJ461320 | DENV | NS4A | GQ199772 |
| DENV | NS4A | GQ199780 | DENV | NS4A | FJ898420 | DENV | NS4A | FJ898373 |
| DENV | NS4A | FJ850103 | DENV | NS4A | FJ687431 | DENV | NS4A | FJ687429 |
| DENV | NS4A | FJ882555 | DENV | NS4A | GQ199801 | DENV | NS4A | FJ898379 |
| DENV | NS4A | FJ882561 | DENV | NS4A | FJ906728 | DENV | NS4A | FJ882566 |
| DENV | NS4A | FJ687430 | DENV | NS4A | FJ882544 | DENV | NS4A | FJ898396 |
| DENV | NS4A | FJ898381 | DENV | NS4A | FJ882553 | DENV | NS4A | FJ882529 |

FIG. 70-140

| Virus | Protein | Accession No. | Virus | Protein | Accession No. | Virus | Protein | Accession No. |
|---|---|---|---|---|---|---|---|---|
| DENV | NS4A | GQ199838 | DENV | NS4A | GU131841 | DENV | NS4A | GU131689 |
| DENV | NS4A | GQ199779 | DENV | NS4A | GQ868564 | DENV | NS4A | GU131700 |
| DENV | NS4A | GQ199827 | DENV | NS4A | AB519681 | DENV | NS4A | GU131798 |
| DENV | NS4A | GQ199836 | DENV | NS4A | GU131743 | DENV | NS4A | GU131713 |
| DENV | NS4A | GQ199858 | DENV | NS4A | GQ868522 | DENV | NS4A | GU131829 |
| DENV | NS4A | GQ199787 | DENV | NS4A | GU131739 | DENV | NS4A | GU131782 |
| DENV | NS4A | FJ850068 | DENV | NS4A | GU131971 | DENV | NS4A | GU131698 |
| DENV | NS4A | FJ882564 | DENV | NS4A | GU131834 | DENV | NS4A | GU131732 |
| DENV | NS4A | FJ898419 | DENV | NS4A | GQ868523 | DENV | NS4A | GU131772 |
| DENV | NS4A | FJ898383 | DENV | NS4A | GU131982 | DENV | NS4A | GU131978 |
| DENV | NS4A | FJ461328 | DENV | NS4A | GU131965 | DENV | NS4A | GU131958 |
| DENV | NS4A | FJ882527 | DENV | NS4A | GU131760 | DENV | NS4A | GU131811 |
| DENV | NS4A | FJ898427 | DENV | NS4A | GQ868535 | DENV | NS4A | GQ868506 |
| DENV | NS4A | FJ882525 | DENV | NS4A | GU131962 | DENV | NS4A | GQ868525 |
| DENV | NS4A | FJ882557 | DENV | NS4A | GU131891 | DENV | NS4A | GQ868538 |
| DENV | NS4A | GQ199859 | DENV | NS4A | GQ868504 | DENV | NS4A | FJ469909 |
| DENV | NS4A | GQ199842 | DENV | NS4A | GU131783 | DENV | NS4A | GU131818 |
| DENV | NS4A | GQ199817 | DENV | NS4A | GU131680 | DENV | NS4A | GU131893 |
| DENV | NS4A | FJ898401 | DENV | NS4A | GU131704 | DENV | NS4A | GQ868509 |
| DENV | NS4A | FJ882519 | DENV | NS4A | GU131685 | DENV | NS4A | GU131706 |
| DENV | NS4A | FJ850090 | DENV | NS4A | GU131770 | DENV | NS4A | GU131777 |
| DENV | NS4A | FJ898377 | DENV | NS4A | GU131795 | DENV | NS4A | GU131925 |
| DENV | NS4A | GQ199774 | DENV | NS4A | GU131961 | DENV | NS4A | GU131977 |
| DENV | NS4A | FJ898399 | DENV | NS4A | GU131733 | DENV | NS4A | GQ868611 |
| DENV | NS4A | GQ199840 | DENV | NS4A | GU131804 | DENV | NS4A | GU131745 |
| DENV | NS4A | FJ898433 | DENV | NS4A | GU131762 | DENV | NS4A | GQ868635 |
| DENV | NS4A | FJ882567 | DENV | NS4A | GU131827 | DENV | NS4A | GU056032 |
| DENV | NS4A | FJ898387 | DENV | NS4A | GU131837 | DENV | NS4A | GQ868610 |
| DENV | NS4A | FJ882532 | DENV | NS4A | GQ868630 | DENV | NS4A | GU131889 |
| DENV | NS4A | FJ898409 | DENV | NS4A | GU131767 | DENV | NS4A | GQ868499 |
| DENV | NS4A | FJ882545 | DENV | NS4A | GU131737 | DENV | NS4A | GU131756 |
| DENV | NS4A | FJ898375 | DENV | NS4A | GQ868500 | DENV | NS4A | GU131786 |
| DENV | NS4A | FJ898414 | DENV | NS4A | GU131722 | DENV | NS4A | GQ868565 |
| DENV | NS4A | CS477306 | DENV | NS4A | GQ868607 | DENV | NS4A | GU131709 |
| DENV | NS4A | A75711 | DENV | NS4A | GQ868517 | DENV | NS4A | GQ868569 |
| DENV | NS4A | GU131816 | DENV | NS4A | GU131727 | DENV | NS4A | GU131723 |
| DENV | NS4A | FJ469907 | DENV | NS4A | GU131715 | DENV | NS4A | GU131696 |
| DENV | NS4A | GU131814 | DENV | NS4A | FN429885 | DENV | NS4A | GQ868519 |
| DENV | NS4A | GU131725 | DENV | NS4A | GU131780 | DENV | NS4A | GU131838 |
| DENV | NS4A | GU131822 | DENV | NS4A | GU131750 | DENV | NS4A | GQ868520 |
| DENV | NS4A | GQ868633 | DENV | NS4A | GU131787 | DENV | NS4A | GU131791 |
| DENV | NS4A | GU131820 | DENV | NS4A | GU056031 | DENV | NS4A | GU131765 |
| DENV | NS4A | GU131679 | DENV | NS4A | GQ868602 | DENV | NS4A | GU131702 |
| DENV | NS4A | GQ868507 | DENV | NS4A | GU131711 | DENV | NS4A | GU131682 |
| DENV | NS4A | GU131789 | DENV | NS4A | GQ868567 | DENV | NS4A | GU131801 |
| DENV | NS4A | GU131710 | DENV | NS4A | GU131813 | DENV | NS4A | GQ868562 |
| DENV | NS4A | FN429887 | DENV | NS4A | FJ687428 | DENV | NS4A | GU131684 |
| DENV | NS4A | GU131720 | DENV | NS4A | GU131707 | DENV | NS4A | GU131744 |

FIG. 70-141

| Virus | Protein | Accession No. | Virus | Protein | Accession No. | Virus | Protein | Accession No. |
|---|---|---|---|---|---|---|---|---|
| DENV | NS4A | GQ868534 | DENV | NS4A | GU131973 | DENV | NS4A | GU131764 |
| DENV | NS4A | GU131687 | DENV | NS4A | GU131967 | DENV | NS4A | GU056030 |
| DENV | NS4A | GQ868529 | DENV | NS4A | GU131803 | DENV | NS4A | GU131979 |
| DENV | NS4A | GU131840 | DENV | NS4A | GU131736 | DENV | NS4A | GU131768 |
| DENV | NS4A | GU131808 | DENV | NS4A | GU131981 | DENV | NS4A | GU131699 |
| DENV | NS4A | GU131922 | DENV | NS4A | GU131964 | DENV | NS4A | FJ687427 |
| DENV | NS4A | GU131836 | DENV | NS4A | GU131771 | DENV | NS4A | GU131963 |
| DENV | NS4A | GQ868613 | DENV | NS4A | GU131984 | DENV | NS4A | GU131793 |
| DENV | NS4A | GU131721 | DENV | NS4A | GU131695 | DENV | NS4A | GQ868618 |
| DENV | NS4A | GU131730 | DENV | NS4A | GU131728 | DENV | NS4A | GU131799 |
| DENV | NS4A | GU131968 | DENV | NS4A | GQ868601 | DENV | NS4A | GU131724 |
| DENV | NS4A | GU131832 | DENV | NS4A | FN429886 | DENV | NS4A | GU131740 |
| DENV | NS4A | GU131774 | DENV | NS4A | GU131826 | DENV | NS4A | GU131806 |
| DENV | NS4A | GU131976 | DENV | NS4A | GQ868512 | DENV | NS4A | GQ868614 |
| DENV | NS4A | GU131831 | DENV | NS4A | GU131718 | DENV | NS4A | FN429881 |
| DENV | NS4A | GQ868501 | DENV | NS4A | GQ868513 | DENV | NS4A | GQ868636 |
| DENV | NS4A | GQ868531 | DENV | NS4A | GU131731 | DENV | NS4A | GU131746 |
| DENV | NS4A | GU131957 | DENV | NS4A | GU131686 | DENV | NS4A | GQ868560 |
| DENV | NS4A | GU131980 | DENV | NS4A | GU131894 | DENV | NS4A | GQ868508 |
| DENV | NS4A | GQ868609 | DENV | NS4A | GU131895 | DENV | NS4A | GQ868570 |
| DENV | NS4A | GU131769 | DENV | NS4A | GU131678 | DENV | NS4A | GU131788 |
| DENV | NS4A | GQ868526 | DENV | NS4A | GQ868619 | DENV | NS4A | GU131949 |
| DENV | NS4A | GQ868510 | DENV | NS4A | GU131729 | DENV | NS4A | GU131796 |
| DENV | NS4A | FN429882 | DENV | NS4A | GQ868539 | DENV | NS4A | GU056029 |
| DENV | NS4A | GU131763 | DENV | NS4A | GU131747 | DENV | NS4A | GU131792 |
| DENV | NS4A | GQ868527 | DENV | NS4A | GU131748 | DENV | NS4A | GU131690 |
| DENV | NS4A | GU131708 | DENV | NS4A | FN429889 | DENV | NS4A | GQ868632 |
| DENV | NS4A | GU131766 | DENV | NS4A | GU131776 | DENV | NS4A | GU131781 |
| DENV | NS4A | FN429890 | DENV | NS4A | GU131755 | DENV | NS4A | GQ868537 |
| DENV | NS4A | GU131694 | DENV | NS4A | GU131810 | DENV | NS4A | GU131815 |
| DENV | NS4A | GQ868615 | DENV | NS4A | GU131701 | DENV | NS4A | GU056033 |
| DENV | NS4A | GU131688 | DENV | NS4A | GU131754 | DENV | NS4A | GU131812 |
| DENV | NS4A | FJ469908 | DENV | NS4A | GU131784 | DENV | NS4A | GU131833 |
| DENV | NS4A | GU131734 | DENV | NS4A | GU131807 | DENV | NS4A | GU131830 |
| DENV | NS4A | GQ868637 | DENV | NS4A | GU131842 | DENV | NS4A | GU131742 |
| DENV | NS4A | GU131888 | DENV | NS4A | GU131923 | DENV | NS4A | GQ868561 |
| DENV | NS4A | GQ868568 | DENV | NS4A | GU131809 | DENV | NS4A | GU131800 |
| DENV | NS4A | GU131790 | DENV | NS4A | GU131726 | DENV | NS4A | GU131738 |
| DENV | NS4A | GU131920 | DENV | NS4A | GU131970 | DENV | NS4A | GU131824 |
| DENV | NS4A | GQ868528 | DENV | NS4A | GU131751 | DENV | NS4A | GU131919 |
| DENV | NS4A | GQ868612 | DENV | NS4A | GU131828 | DENV | NS4A | GU131802 |
| DENV | NS4A | GU131794 | DENV | NS4A | GQ868524 | DENV | NS4A | GQ868503 |
| DENV | NS4A | GQ868606 | DENV | NS4A | GU131863 | DENV | NS4A | GU131839 |
| DENV | NS4A | GU131969 | DENV | NS4A | GU131892 | DENV | NS4A | GU131681 |
| DENV | NS4A | GQ868608 | DENV | NS4A | GU131823 | DENV | NS4A | GQ868505 |
| DENV | NS4A | GU131921 | DENV | NS4A | GU131821 | DENV | NS4A | FN429884 |
| DENV | NS4A | GQ868502 | DENV | NS4A | GU131983 | DENV | NS4A | GQ868536 |
| DENV | NS4A | GU131719 | DENV | NS4A | GQ868518 | DENV | NS4A | GU131825 |

FIG. 70-142

| Virus | Protein | Accession No. | Virus | Protein | Accession No. | Virus | Protein | Accession No. |
|---|---|---|---|---|---|---|---|---|
| DENV | NS4A | FN429888 | DENV | NS4A | GU131717 | DENV | NS4A | FJ182016 |
| DENV | NS4A | GU131778 | DENV | NS4A | GU131712 | DENV | NS4A | AF326573 |
| DENV | NS4A | GU131972 | DENV | NS4A | GQ868532 | DENV | NS4A | FJ182017 |
| DENV | NS4A | GU131817 | DENV | NS4A | GQ868514 | DENV | NS4A | FJ024476 |
| DENV | NS4A | GU131759 | DENV | NS4A | FJ410220 | DENV | NS4A | EF457906 |
| DENV | NS4A | GU131819 | DENV | NS4A | CS477302 | DENV | NS4A | FJ639742 |
| DENV | NS4A | GU131757 | DENV | NS4A | CS477304 | DENV | NS4A | AF289029 |
| DENV | NS4A | GQ868533 | DENV | NS4A | CS477264 | DENV | NS4A | GQ199880 |
| DENV | NS4A | FN429883 | DENV | NS4A | CS477305 | DENV | NS4A | FJ882597 |
| DENV | NS4A | GU131956 | DENV | NS4A | CS477263 | DENV | NS4A | NC_002640 |
| DENV | NS4A | GQ868563 | DENV | NS4A | CS477265 | DENV | NS4A | FJ882587 |
| DENV | NS4A | GU131926 | DENV | NS4A | M87512 | DENV | NS4A | FJ882595 |
| DENV | NS4A | GU131887 | DENV | NS4A | FB730116 | DENV | NS4A | FJ882582 |
| DENV | NS4A | GU131741 | DENV | NS4A | GM059691 | DENV | NS4A | FJ810417 |
| DENV | NS4A | GU131761 | DENV | NS4A | U88536 | DENV | NS4A | FJ850095 |
| DENV | NS4A | GU131693 | DENV | NS4A | GU370048 | DENV | NS4A | FJ882599 |
| DENV | NS4A | GU131753 | DENV | NS4A | GU370049 | DENV | NS4A | FJ882580 |
| DENV | NS4A | GU131948 | DENV | NS4A | AY762085 | DENV | NS4A | GQ199884 |
| DENV | NS4A | GQ868559 | DENV | NS4A | FJ024424 | DENV | NS4A | FJ882588 |
| DENV | NS4A | GQ868530 | DENV | NS4A | FJ226067 | DENV | NS4A | FJ882598 |
| DENV | NS4A | GU131797 | DENV | NS4A | FJ639745 | DENV | NS4A | FJ882601 |
| DENV | NS4A | GU131785 | DENV | NS4A | AY618989 | DENV | NS4A | FJ850058 |
| DENV | NS4A | GU131758 | DENV | NS4A | AF326827 | DENV | NS4A | FJ882584 |
| DENV | NS4A | GU131697 | DENV | NS4A | AY618988 | DENV | NS4A | FJ850059 |
| DENV | NS4A | GU131835 | DENV | NS4A | EU854296 | DENV | NS4A | GQ199883 |
| DENV | NS4A | GU131716 | DENV | NS4A | EU854300 | DENV | NS4A | FJ882586 |
| DENV | NS4A | GQ868498 | DENV | NS4A | AY858050 | DENV | NS4A | GQ252675 |
| DENV | NS4A | GU131683 | DENV | NS4A | AF375822 | DENV | NS4A | FJ882581 |
| DENV | NS4A | GU131960 | DENV | NS4A | EU854295 | DENV | NS4A | GQ199881 |
| DENV | NS4A | GU131714 | DENV | NS4A | M14931 | DENV | NS4A | GQ199878 |
| DENV | NS4A | GU131779 | DENV | NS4A | AY618992 | DENV | NS4A | FJ882596 |
| DENV | NS4A | GU131773 | DENV | NS4A | EU854297 | DENV | NS4A | FJ882583 |
| DENV | NS4A | GQ868605 | DENV | NS4A | FJ639738 | DENV | NS4A | FJ882600 |
| DENV | NS4A | GQ868511 | DENV | NS4A | AY618993 | DENV | NS4A | FJ850057 |
| DENV | NS4A | GU131752 | DENV | NS4A | FJ639764 | DENV | NS4A | GQ199879 |
| DENV | NS4A | GU131691 | DENV | NS4A | FJ639737 | DENV | NS4A | FJ882585 |
| DENV | NS4A | GU131692 | DENV | NS4A | AY776330 | DENV | NS4A | GQ199876 |
| DENV | NS4A | GU131705 | DENV | NS4A | AY618991 | DENV | NS4A | GQ199885 |
| DENV | NS4A | GQ868639 | DENV | NS4A | FJ639736 | DENV | NS4A | FJ882592 |
| DENV | NS4A | GU131805 | DENV | NS4A | FJ639739 | DENV | NS4A | GQ199882 |
| DENV | NS4A | GU131735 | DENV | NS4A | AF326826 | DENV | NS4A | FJ882591 |
| DENV | NS4A | GU131966 | DENV | NS4A | AY947539 | DENV | NS4A | FJ882589 |
| DENV | NS4A | GU131890 | DENV | NS4A | EU854299 | DENV | NS4A | GQ868642 |
| DENV | NS4A | GQ868566 | DENV | NS4A | AY618990 | DENV | NS4A | GQ868581 |
| DENV | NS4A | GU131775 | DENV | NS4A | FJ639748 | DENV | NS4A | FN429919 |
| DENV | NS4A | GU131749 | DENV | NS4A | FJ639744 | DENV | NS4A | GQ868583 |
| DENV | NS4A | GQ868521 | DENV | NS4A | EU854301 | DENV | NS4A | FN429920 |
| DENV | NS4A | GU131703 | DENV | NS4A | FJ639773 | DENV | NS4A | FN429923 |

FIG. 70-143

| Virus | Protein | Accession No. | Virus | Protein | Accession No. | Virus | Protein | Accession No. |
|---|---|---|---|---|---|---|---|---|
| DENV | NS4A | GQ868585 | DENV | NS4A | FJ639774 | DENV | NS4A | EU687226 |
| DENV | NS4A | GQ868579 | DENV | NS4A | FJ639726 | DENV | NS4A | FJ639715 |
| DENV | NS4A | GQ868644 | DENV | NS4A | AY858037 | DENV | NS4A | AY676352 |
| DENV | NS4A | FN429925 | DENV | NS4A | EU081215 | DENV | NS4A | AY858043 |
| DENV | NS4A | GU289913 | DENV | NS4A | FJ639785 | DENV | NS4A | EU081196 |
| DENV | NS4A | GQ868580 | DENV | NS4A | FJ639761 | DENV | NS4A | FJ432741 |
| DENV | NS4A | FN429922 | DENV | NS4A | EU569688 | DENV | NS4A | EU726773 |
| DENV | NS4A | GQ868645 | DENV | NS4A | DQ675533 | DENV | NS4A | EU482555 |
| DENV | NS4A | GQ868594 | DENV | NS4A | FJ410177 | DENV | NS4A | DQ401694 |
| DENV | NS4A | FN429924 | DENV | NS4A | FJ478456 | DENV | NS4A | EU081216 |
| DENV | NS4A | FJ882590 | DENV | NS4A | EU081195 | DENV | NS4A | EU529704 |
| DENV | NS4A | GQ868582 | DENV | NS4A | EU081221 | DENV | NS4A | FJ639777 |
| DENV | NS4A | GQ868584 | DENV | NS4A | EU529689 | DENV | NS4A | FJ639730 |
| DENV | NS4A | FN429926 | DENV | NS4A | EU660408 | DENV | NS4A | EU081190 |
| DENV | NS4A | FN429921 | DENV | NS4A | EU687219 | DENV | NS4A | EU529703 |
| DENV | NS4A | GQ868643 | DENV | NS4A | FJ639780 | DENV | NS4A | FJ639725 |
| DENV | NS4A | AF326825 | DENV | NS4A | EU687196 | DENV | NS4A | EU081205 |
| DENV | NS4A | AY376438 | DENV | NS4A | EF643017 | DENV | NS4A | AY876494 |
| DENV | NS4A | AY648301 | DENV | NS4A | FJ373303 | DENV | NS4A | FJ639747 |
| DENV | NS4A | AY099336 | DENV | NS4A | FJ639729 | DENV | NS4A | FJ373302 |
| DENV | NS4A | GU363549 | DENV | NS4A | FJ639775 | DENV | NS4A | FJ639778 |
| DENV | NS4A | GU370052 | DENV | NS4A | FJ461322 | DENV | NS4A | DQ401692 |
| DENV | NS4A | GU370053 | DENV | NS4A | FJ390371 | DENV | NS4A | FJ182038 |
| DENV | NS4A | EU081191 | DENV | NS4A | AY858046 | DENV | NS4A | EU081220 |
| DENV | NS4A | DQ401690 | DENV | NS4A | EU482455 | DENV | NS4A | AY923865 |
| DENV | NS4A | EU529683 | DENV | NS4A | AY744680 | DENV | NS4A | EU081188 |
| DENV | NS4A | AY679147 | DENV | NS4A | FJ182015 | DENV | NS4A | FJ461337 |
| DENV | NS4A | AY676348 | DENV | NS4A | FJ562103 | DENV | NS4A | EU081224 |
| DENV | NS4A | EF629368 | DENV | NS4A | FJ639792 | DENV | NS4A | EU081207 |
| DENV | NS4A | FJ639752 | DENV | NS4A | DQ675527 | DENV | NS4A | FJ639750 |
| DENV | NS4A | FJ639807 | DENV | NS4A | FJ547066 | DENV | NS4A | AB189128 |
| DENV | NS4A | EU529684 | DENV | NS4A | EU529698 | DENV | NS4A | AY676353 |
| DENV | NS4A | FJ373304 | DENV | NS4A | EU726769 | DENV | NS4A | EU081209 |
| DENV | NS4A | FJ639723 | DENV | NS4A | AY676349 | DENV | NS4A | FJ639772 |
| DENV | NS4A | EU569691 | DENV | NS4A | EU529688 | DENV | NS4A | FJ182040 |
| DENV | NS4A | DQ675524 | DENV | NS4A | EU482558 | DENV | NS4A | AY648961 |
| DENV | NS4A | EU081203 | DENV | NS4A | FJ547070 | DENV | NS4A | FJ410178 |
| DENV | NS4A | EU482564 | DENV | NS4A | EU687198 | DENV | NS4A | EU529699 |
| DENV | NS4A | FJ182039 | DENV | NS4A | FJ639817 | DENV | NS4A | EU081199 |
| DENV | NS4A | EU482453 | DENV | NS4A | EU081202 | DENV | NS4A | FJ639786 |
| DENV | NS4A | FJ639779 | DENV | NS4A | EU081225 | DENV | NS4A | FJ639768 |
| DENV | NS4A | EU081183 | DENV | NS4A | DQ675520 | DENV | NS4A | FJ639731 |
| DENV | NS4A | EU529690 | DENV | NS4A | EU854298 | DENV | NS4A | FJ390373 |
| DENV | NS4A | FJ182011 | DENV | NS4A | FJ205870 | DENV | NS4A | FJ639800 |
| DENV | NS4A | EU081187 | DENV | NS4A | FJ639793 | DENV | NS4A | FJ547079 |
| DENV | NS4A | EU482461 | DENV | NS4A | DQ675532 | DENV | NS4A | FJ547072 |
| DENV | NS4A | FJ639803 | DENV | NS4A | FJ024470 | DENV | NS4A | EU081219 |
| DENV | NS4A | AY858047 | DENV | NS4A | EU081210 | DENV | NS4A | EU596493 |

FIG. 70-144

| Virus | Protein | Accession No. | Virus | Protein | Accession No. | Virus | Protein | Accession No. |
|---|---|---|---|---|---|---|---|---|
| DENV | NS4A | EU081192 | DENV | NS4A | FJ639767 | DENV | NS4A | FJ024466 |
| DENV | NS4A | FJ432731 | DENV | NS4A | AB189125 | DENV | NS4A | FJ639795 |
| DENV | NS4A | AB189126 | DENV | NS4A | AF317645 | DENV | NS4A | FJ024465 |
| DENV | NS4A | FJ024471 | DENV | NS4A | AB189127 | DENV | NS4A | EU726768 |
| DENV | NS4A | FJ639769 | DENV | NS4A | EU781137 | DENV | NS4A | FJ639720 |
| DENV | NS4A | FJ547078 | DENV | NS4A | DQ675522 | DENV | NS4A | EU529696 |
| DENV | NS4A | FJ547080 | DENV | NS4A | EU482614 | DENV | NS4A | FJ639810 |
| DENV | NS4A | AY744679 | DENV | NS4A | AB214879 | DENV | NS4A | AY744681 |
| DENV | NS4A | EU081217 | DENV | NS4A | FJ639765 | DENV | NS4A | FJ639724 |
| DENV | NS4A | AY858045 | DENV | NS4A | EU081211 | DENV | NS4A | EU482595 |
| DENV | NS4A | FJ547084 | DENV | NS4A | FJ639787 | DENV | NS4A | AY676351 |
| DENV | NS4A | DQ675521 | DENV | NS4A | FJ639784 | DENV | NS4A | DQ401689 |
| DENV | NS4A | AY776329 | DENV | NS4A | EU569690 | DENV | NS4A | FJ182005 |
| DENV | NS4A | FJ639789 | DENV | NS4A | EU081223 | DENV | NS4A | FJ547085 |
| DENV | NS4A | AY496871 | DENV | NS4A | FJ639816 | DENV | NS4A | EU081193 |
| DENV | NS4A | EU781136 | DENV | NS4A | AY496873 | DENV | NS4A | FJ639751 |
| DENV | NS4A | FJ182013 | DENV | NS4A | FJ182010 | DENV | NS4A | DQ675525 |
| DENV | NS4A | EU596492 | DENV | NS4A | AY099337 | DENV | NS4A | FJ639826 |
| DENV | NS4A | EU726774 | DENV | NS4A | AY496879 | DENV | NS4A | EU482458 |
| DENV | NS4A | EU081198 | DENV | NS4A | EU482462 | DENV | NS4A | EU081204 |
| DENV | NS4A | FJ639728 | DENV | NS4A | FJ639825 | DENV | NS4A | EU529691 |
| DENV | NS4A | DQ675530 | DENV | NS4A | AY766104 | DENV | NS4A | FJ639719 |
| DENV | NS4A | EU660409 | DENV | NS4A | FJ182007 | DENV | NS4A | FJ182037 |
| DENV | NS4A | EU081206 | DENV | NS4A | DQ401693 | DENV | NS4A | EU482612 |
| DENV | NS4A | EU081222 | DENV | NS4A | DQ675531 | DENV | NS4A | EU482596 |
| DENV | NS4A | EU660407 | DENV | NS4A | FJ461326 | DENV | NS4A | EU081208 |
| DENV | NS4A | M93130 | DENV | NS4A | FJ373306 | DENV | NS4A | EU081201 |
| DENV | NS4A | EU529687 | DENV | NS4A | EU569689 | DENV | NS4A | FJ639757 |
| DENV | NS4A | DQ675523 | DENV | NS4A | AY858041 | DENV | NS4A | FJ639713 |
| DENV | NS4A | FJ432722 | DENV | NS4A | EU482566 | DENV | NS4A | AY744685 |
| DENV | NS4A | EU482559 | DENV | NS4A | EF629370 | DENV | NS4A | FJ182041 |
| DENV | NS4A | FJ639721 | DENV | NS4A | AY496877 | DENV | NS4A | FJ562099 |
| DENV | NS4A | AY744682 | DENV | NS4A | FJ562102 | DENV | NS4A | FJ562100 |
| DENV | NS4A | EU081184 | DENV | NS4A | EF629367 | DENV | NS4A | FJ547081 |
| DENV | NS4A | FJ639805 | DENV | NS4A | FJ547077 | DENV | NS4A | AY858044 |
| DENV | NS4A | FJ547074 | DENV | NS4A | FJ639770 | DENV | NS4A | FJ639714 |
| DENV | NS4A | EU529685 | DENV | NS4A | EU081182 | DENV | NS4A | EU529686 |
| DENV | NS4A | DQ401695 | DENV | NS4A | EU596494 | DENV | NS4A | FJ410229 |
| DENV | NS4A | FJ432743 | DENV | NS4A | FJ639749 | DENV | NS4A | FJ547073 |
| DENV | NS4A | EU854291 | DENV | NS4A | EU726771 | DENV | NS4A | FJ639791 |
| DENV | NS4A | FJ182008 | DENV | NS4A | FJ639746 | DENV | NS4A | EU529692 |
| DENV | NS4A | FJ547062 | DENV | NS4A | EU081214 | DENV | NS4A | FJ547082 |
| DENV | NS4A | FJ024467 | DENV | NS4A | AY858039 | DENV | NS4A | EU367962 |
| DENV | NS4A | EU687239 | DENV | NS4A | EU660411 | DENV | NS4A | FJ390375 |
| DENV | NS4A | FJ024468 | DENV | NS4A | EU482563 | DENV | NS4A | AY858040 |
| DENV | NS4A | AY496874 | DENV | NS4A | AY744678 | DENV | NS4A | FJ547069 |
| DENV | NS4A | FJ547061 | DENV | NS4A | FJ461334 | DENV | NS4A | FJ562107 |
| DENV | NS4A | FJ547076 | DENV | NS4A | EU660420 | DENV | NS4A | FJ461338 |

FIG. 70-145

| Virus | Protein | Accession No. | Virus | Protein | Accession No. | Virus | Protein | Accession No. |
|---|---|---|---|---|---|---|---|---|
| DENV | NS4A | FJ639722 | DENV | NS4A | EU081186 | DENV | NS4A | FJ898458 |
| DENV | NS4A | FJ639782 | DENV | NS4A | FJ547083 | DENV | NS4A | FJ744740 |
| DENV | NS4A | AY858042 | DENV | NS4A | FJ639762 | DENV | NS4A | GQ199889 |
| DENV | NS4A | EU081185 | DENV | NS4A | FJ547071 | DENV | NS4A | GQ199886 |
| DENV | NS4A | FJ390377 | DENV | NS4A | EU529702 | DENV | NS4A | FJ687448 |
| DENV | NS4A | FJ639763 | DENV | NS4A | EU687234 | DENV | NS4A | FJ744732 |
| DENV | NS4A | FJ639760 | DENV | NS4A | FJ182006 | DENV | NS4A | FJ898446 |
| DENV | NS4A | FJ182009 | DENV | NS4A | AY662691 | DENV | NS4A | GQ199861 |
| DENV | NS4A | EU529697 | DENV | NS4A | EU081213 | DENV | NS4A | FJ898455 |
| DENV | NS4A | DQ675529 | DENV | NS4A | EU081181 | DENV | NS4A | FJ882573 |
| DENV | NS4A | FJ639727 | DENV | NS4A | FJ390372 | DENV | NS4A | FJ898463 |
| DENV | NS4A | FJ461329 | DENV | NS4A | EU482613 | DENV | NS4A | FJ898447 |
| DENV | NS4A | EU482457 | DENV | NS4A | FJ639790 | DENV | NS4A | FJ882571 |
| DENV | NS4A | FJ639827 | DENV | NS4A | DQ675519 | DENV | NS4A | FJ898462 |
| DENV | NS4A | EU687197 | DENV | NS4A | EU687233 | DENV | NS4A | GQ199870 |
| DENV | NS4A | FJ639801 | DENV | NS4A | EF629369 | DENV | NS4A | FJ898471 |
| DENV | NS4A | FJ410176 | DENV | NS4A | FJ182004 | DENV | NS4A | FJ882575 |
| DENV | NS4A | EU081218 | DENV | NS4A | FJ639799 | DENV | NS4A | FJ744738 |
| DENV | NS4A | AY744684 | DENV | NS4A | FJ562097 | DENV | NS4A | FJ898440 |
| DENV | NS4A | FJ390376 | DENV | NS4A | FJ639712 | DENV | NS4A | FJ898444 |
| DENV | NS4A | FJ639781 | DENV | NS4A | EF629366 | DENV | NS4A | GQ199865 |
| DENV | NS4A | DQ675528 | DENV | NS4A | EU726772 | DENV | NS4A | GQ252678 |
| DENV | NS4A | FJ639766 | DENV | NS4A | DQ675526 | DENV | NS4A | FJ850110 |
| DENV | NS4A | EU687221 | DENV | NS4A | EU482452 | DENV | NS4A | FJ744734 |
| DENV | NS4A | EU081197 | DENV | NS4A | AY858038 | DENV | NS4A | FJ898457 |
| DENV | NS4A | FJ639755 | DENV | NS4A | EU482456 | DENV | NS4A | FJ744736 |
| DENV | NS4A | FJ639798 | DENV | NS4A | EU081200 | DENV | NS4A | FJ810416 |
| DENV | NS4A | FJ639758 | DENV | NS4A | FJ639756 | DENV | NS4A | FJ898474 |
| DENV | NS4A | EU687218 | DENV | NS4A | AY744677 | DENV | NS4A | FJ850094 |
| DENV | NS4A | EU081189 | DENV | NS4A | AY744683 | DENV | NS4A | FJ898470 |
| DENV | NS4A | FJ639759 | DENV | NS4A | FJ639753 | DENV | NS4A | FJ810413 |
| DENV | NS4A | EU081212 | DENV | NS4A | FJ639716 | DENV | NS4A | FJ744735 |
| DENV | NS4A | EU482460 | DENV | NS4A | EU081194 | DENV | NS4A | GQ199860 |
| DENV | NS4A | FJ547075 | DENV | NS4A | FJ639776 | DENV | NS4A | FJ898464 |
| DENV | NS4A | AY676350 | DENV | NS4A | FJ898469 | DENV | NS4A | FJ744729 |
| DENV | NS4A | EU854292 | DENV | NS4A | GQ252674 | DENV | NS4A | FJ898472 |
| DENV | NS4A | EU660410 | DENV | NS4A | FJ850055 | DENV | NS4A | GQ199862 |
| DENV | NS4A | FJ432728 | DENV | NS4A | FJ898475 | DENV | NS4A | FJ873812 |
| DENV | NS4A | FJ024469 | DENV | NS4A | FJ744739 | DENV | NS4A | FJ898441 |
| DENV | NS4A | AY858048 | DENV | NS4A | NC_001475 | DENV | NS4A | FJ850048 |
| DENV | NS4A | FJ639804 | DENV | NS4A | GQ199863 | DENV | NS4A | FJ850080 |
| DENV | NS4A | EU529705 | DENV | NS4A | FJ850089 | DENV | NS4A | FJ882577 |
| DENV | NS4A | EU482454 | DENV | NS4A | FJ898442 | DENV | NS4A | FJ850096 |
| DENV | NS4A | DQ401691 | DENV | NS4A | FJ898459 | DENV | NS4A | FJ898473 |
| DENV | NS4A | FJ639771 | DENV | NS4A | FJ850049 | DENV | NS4A | FJ882574 |
| DENV | NS4A | FJ639754 | DENV | NS4A | FJ744730 | DENV | NS4A | FJ898445 |
| DENV | NS4A | EU482459 | DENV | NS4A | FJ850097 | DENV | NS4A | GQ199888 |
| DENV | NS4A | FJ205871 | DENV | NS4A | FJ744728 | DENV | NS4A | FJ898443 |

FIG. 70-146

| Virus | Protein | Accession No. | Virus | Protein | Accession No. | Virus | Protein | Accession No. |
|---|---|---|---|---|---|---|---|---|
| DENV | NS4A | FJ744726 | DENV | NS4A | FN429904 | DENV | NS4A | GU131950 |
| DENV | NS4A | FJ898476 | DENV | NS4A | GU131904 | DENV | NS4A | GQ868634 |
| DENV | NS4A | FJ898468 | DENV | NS4A | GU131935 | DENV | NS4A | GU131873 |
| DENV | NS4A | FJ744733 | DENV | NS4A | GU131910 | DENV | NS4A | GQ868593 |
| DENV | NS4A | GQ199871 | DENV | NS4A | GU131918 | DENV | NS4A | GQ868572 |
| DENV | NS4A | GQ199887 | DENV | NS4A | GU131937 | DENV | NS4A | DQ863638 |
| DENV | NS4A | GQ199864 | DENV | NS4A | GU131868 | DENV | NS4A | GU131876 |
| DENV | NS4A | FJ744737 | DENV | NS4A | GU131951 | DENV | NS4A | EU932687 |
| DENV | NS4A | FJ898456 | DENV | NS4A | FN429910 | DENV | NS4A | GU189648 |
| DENV | NS4A | FJ850083 | DENV | NS4A | GU131854 | DENV | NS4A | FN429913 |
| DENV | NS4A | FJ744731 | DENV | NS4A | GU131943 | DENV | NS4A | GU131867 |
| DENV | NS4A | FJ850079 | DENV | NS4A | GU131861 | DENV | NS4A | GQ868575 |
| DENV | NS4A | FJ744700 | DENV | NS4A | GU131871 | DENV | NS4A | GQ868617 |
| DENV | NS4A | FJ882576 | DENV | NS4A | GU131933 | DENV | NS4A | GQ868616 |
| DENV | NS4A | GQ199891 | DENV | NS4A | GU131877 | DENV | NS4A | GU131870 |
| DENV | NS4A | FJ850111 | DENV | NS4A | GU131911 | DENV | NS4A | GU131869 |
| DENV | NS4A | FJ850056 | DENV | NS4A | GQ868628 | DENV | NS4A | GU131846 |
| DENV | NS4A | FJ744727 | DENV | NS4A | GQ868574 | DENV | NS4A | GU131934 |
| DENV | NS4A | FJ873813 | DENV | NS4A | GU131941 | DENV | NS4A | GQ868627 |
| DENV | NS4A | AY770511 | DENV | NS4A | GQ868577 | DENV | NS4A | FN429908 |
| DENV | NS4A | FJ850098 | DENV | NS4A | GQ868547 | DENV | NS4A | GU131872 |
| DENV | NS4A | FJ810414 | DENV | NS4A | GU131845 | DENV | NS4A | FN429901 |
| DENV | NS4A | FJ850109 | DENV | NS4A | FN429899 | DENV | NS4A | GU131917 |
| DENV | NS4A | FJ850052 | DENV | NS4A | FN429902 | DENV | NS4A | GU131875 |
| DENV | NS4A | FJ850086 | DENV | NS4A | FN429917 | DENV | NS4A | FN429909 |
| DENV | NS4A | FJ882572 | DENV | NS4A | FN429915 | DENV | NS4A | FN429911 |
| DENV | NS4A | FJ882578 | DENV | NS4A | GU131855 | DENV | NS4A | GU131945 |
| DENV | NS4A | FJ850092 | DENV | NS4A | FN429896 | DENV | NS4A | FN429916 |
| DENV | NS4A | AB214882 | DENV | NS4A | GU131844 | DENV | NS4A | FN429914 |
| DENV | NS4A | AB214880 | DENV | NS4A | GQ868573 | DENV | NS4A | GU131942 |
| DENV | NS4A | AB214881 | DENV | NS4A | GQ868586 | DENV | NS4A | GU131849 |
| DENV | NS4A | FB667400 | DENV | NS4A | GU131858 | DENV | NS4A | GU131952 |
| DENV | NS4A | GQ868587 | DENV | NS4A | FN429903 | DENV | NS4A | GU131915 |
| DENV | NS4A | EU932688 | DENV | NS4A | GU131874 | DENV | NS4A | GQ868578 |
| DENV | NS4A | FN429906 | DENV | NS4A | GU131914 | DENV | NS4A | GQ868548 |
| DENV | NS4A | GU131916 | DENV | NS4A | FN429912 | DENV | NS4A | GU131913 |
| DENV | NS4A | GU131953 | DENV | NS4A | FN429898 | DENV | NS4A | GU131940 |
| DENV | NS4A | GU131850 | DENV | NS4A | GU131851 | DENV | NS4A | FN429918 |
| DENV | NS4A | FN429900 | DENV | NS4A | GU131938 | DENV | NS4A | FN429905 |
| DENV | NS4A | GQ868576 | DENV | NS4A | GU131853 | DENV | NS4A | GU131907 |
| DENV | NS4A | GU131946 | DENV | NS4A | FN429907 | DENV | NS4A | GU131860 |
| DENV | NS4A | GU131866 | DENV | NS4A | GU131865 | DENV | NS4A | GU131954 |
| DENV | NS4A | GU131862 | DENV | NS4A | GU131906 | DENV | NS4A | GU131856 |
| DENV | NS4A | GU131852 | DENV | NS4A | GU131944 | DENV | NS4A | GU131847 |
| DENV | NS4A | FN429897 | DENV | NS4A | GU131936 | DENV | NS4A | GU131909 |
| DENV | NS4A | GQ868571 | DENV | NS4A | GU131903 | DENV | NS4A | GU131939 |
| DENV | NS4A | GQ868626 | DENV | NS4A | GU131908 | DENV | NS4A | GU131912 |
| DENV | NS4A | GQ868546 | DENV | NS4A | GU131878 | DENV | NS4A | GU131859 |

FIG. 70-147

| Virus | Protein | Accession No. | Virus | Protein | Accession No. | Virus | Protein | Accession No. |
|---|---|---|---|---|---|---|---|---|
| DENV | NS4A | GU131857 | DENV | NS4A | EU482621 | DENV | NS4A | FJ639703 |
| DENV | NS4A | GQ868629 | DENV | NS4A | EU482736 | DENV | NS4A | EU482647 |
| DENV | NS4A | GU131905 | DENV | NS4A | EU596497 | DENV | NS4A | EU596487 |
| DENV | NS4A | GU131848 | DENV | NS4A | M84728 | DENV | NS4A | FJ639788 |
| DENV | NS4A | FB667402 | DENV | NS4A | EU482549 | DENV | NS4A | FM210206 |
| DENV | NS4A | FB667403 | DENV | NS4A | FM210228 | DENV | NS4A | DQ645556 |
| DENV | NS4A | FJ177308 | DENV | NS4A | EU687216 | DENV | NS4A | AF169682 |
| DENV | NS4A | FB667404 | DENV | NS4A | EU596489 | DENV | NS4A | AY858035 |
| DENV | NS4A | FB667398 | DENV | NS4A | EU482576 | DENV | NS4A | EU687220 |
| DENV | NS4A | FB667399 | DENV | NS4A | AF100460 | DENV | NS4A | EU482636 |
| DENV | NS4A | CS805345 | DENV | NS4A | AF169679 | DENV | NS4A | EU482650 |
| DENV | NS4A | EU482634 | DENV | NS4A | EU482665 | DENV | NS4A | EU482704 |
| DENV | NS4A | FJ373301 | DENV | NS4A | EU482586 | DENV | NS4A | EU482661 |
| DENV | NS4A | EU482582 | DENV | NS4A | AF169681 | DENV | NS4A | EU569699 |
| DENV | NS4A | EU687227 | DENV | NS4A | FM210205 | DENV | NS4A | EU482580 |
| DENV | NS4A | EU569710 | DENV | NS4A | EU482767 | DENV | NS4A | FM210215 |
| DENV | NS4A | EF105383 | DENV | NS4A | EU687240 | DENV | NS4A | FJ639733 |
| DENV | NS4A | EU687249 | DENV | NS4A | AF169686 | DENV | NS4A | EF105389 |
| DENV | NS4A | EU687242 | DENV | NS4A | EU687244 | DENV | NS4A | EF105384 |
| DENV | NS4A | EU482658 | DENV | NS4A | EU482683 | DENV | NS4A | EU677146 |
| DENV | NS4A | FJ639710 | DENV | NS4A | FJ373299 | DENV | NS4A | EU596498 |
| DENV | NS4A | EU482748 | DENV | NS4A | EU482601 | DENV | NS4A | FJ410288 |
| DENV | NS4A | FJ205885 | DENV | NS4A | EU660404 | DENV | NS4A | FJ373300 |
| DENV | NS4A | EU482470 | DENV | NS4A | EU482651 | DENV | NS4A | EU482702 |
| DENV | NS4A | EU482468 | DENV | NS4A | EU482787 | DENV | NS4A | FJ205879 |
| DENV | NS4A | FJ410195 | DENV | NS4A | FM210216 | DENV | NS4A | EU569697 |
| DENV | NS4A | AB122021 | DENV | NS4A | EU569694 | DENV | NS4A | EU482691 |
| DENV | NS4A | EU482469 | DENV | NS4A | EU482648 | DENV | NS4A | FJ461309 |
| DENV | NS4A | FM210231 | DENV | NS4A | EU482620 | DENV | NS4A | EU482608 |
| DENV | NS4A | FJ639831 | DENV | NS4A | EU482471 | DENV | NS4A | EU726776 |
| DENV | NS4A | EU482657 | DENV | NS4A | EU482644 | DENV | NS4A | EU081177 |
| DENV | NS4A | EU482674 | DENV | NS4A | FJ639833 | DENV | NS4A | FM210213 |
| DENV | NS4A | EU482753 | DENV | NS4A | EU482445 | DENV | NS4A | EU854293 |
| DENV | NS4A | DQ645545 | DENV | NS4A | EU482606 | DENV | NS4A | EU482632 |
| DENV | NS4A | FJ639835 | DENV | NS4A | FM210236 | DENV | NS4A | FM210234 |
| DENV | NS4A | FJ432726 | DENV | NS4A | EU482639 | DENV | NS4A | EU482745 |
| DENV | NS4A | EU482607 | DENV | NS4A | EU003591 | DENV | NS4A | EU482593 |
| DENV | NS4A | EU482660 | DENV | NS4A | EU482547 | DENV | NS4A | EU569718 |
| DENV | NS4A | EU482766 | DENV | NS4A | FJ478459 | DENV | NS4A | EU482719 |
| DENV | NS4A | AB189124 | DENV | NS4A | FJ639837 | DENV | NS4A | EF051521 |
| DENV | NS4A | AF100461 | DENV | NS4A | FJ390387 | DENV | NS4A | FM210238 |
| DENV | NS4A | EU482600 | DENV | NS4A | DQ645547 | DENV | NS4A | FJ478455 |
| DENV | NS4A | EU687230 | DENV | NS4A | EU596496 | DENV | NS4A | AF100465 |
| DENV | NS4A | EU482633 | DENV | NS4A | EU482597 | DENV | NS4A | EU529694 |
| DENV | NS4A | EU482726 | DENV | NS4A | EU482463 | DENV | NS4A | EU081178 |
| DENV | NS4A | EU482557 | DENV | NS4A | EU482553 | DENV | NS4A | EU482676 |
| DENV | NS4A | EU482444 | DENV | NS4A | EU482548 | DENV | NS4A | FJ639709 |
| DENV | NS4A | FJ205877 | DENV | NS4A | EU482641 | DENV | NS4A | FM210208 |

FIG. 70-148

| Virus | Protein | Accession No. | Virus | Protein | Accession No. | Virus | Protein | Accession No. |
|---|---|---|---|---|---|---|---|---|
| DENV | NS4A | FJ410208 | DENV | NS4A | DQ645555 | DENV | NS4A | FM210245 |
| DENV | NS4A | EU569716 | DENV | NS4A | EU687231 | DENV | NS4A | FM210214 |
| DENV | NS4A | EU482786 | DENV | NS4A | EU660406 | DENV | NS4A | EU482685 |
| DENV | NS4A | AF276619 | DENV | NS4A | EU687241 | DENV | NS4A | EU482570 |
| DENV | NS4A | EU482625 | DENV | NS4A | FJ639700 | DENV | NS4A | DQ645540 |
| DENV | NS4A | EU687248 | DENV | NS4A | FJ639711 | DENV | NS4A | EU660414 |
| DENV | NS4A | EU482662 | DENV | NS4A | U87412 | DENV | NS4A | FJ024477 |
| DENV | NS4A | EU569708 | DENV | NS4A | EU482599 | DENV | NS4A | AF100463 |
| DENV | NS4A | FM210240 | DENV | NS4A | EU482654 | DENV | NS4A | DQ645546 |
| DENV | NS4A | EU482777 | DENV | NS4A | EU569721 | DENV | NS4A | EU569703 |
| DENV | NS4A | FJ639705 | DENV | NS4A | FJ390385 | DENV | NS4A | EU482652 |
| DENV | NS4A | EU482669 | DENV | NS4A | EU482589 | DENV | NS4A | EU596490 |
| DENV | NS4A | DQ645553 | DENV | NS4A | EU482551 | DENV | NS4A | EU482693 |
| DENV | NS4A | FM210210 | DENV | NS4A | EU660400 | DENV | NS4A | EU482734 |
| DENV | NS4A | EF457904 | DENV | NS4A | EU482679 | DENV | NS4A | FM210202 |
| DENV | NS4A | FJ410237 | DENV | NS4A | AF204177 | DENV | NS4A | EU482729 |
| DENV | NS4A | AY702035 | DENV | NS4A | FJ461311 | DENV | NS4A | AF169680 |
| DENV | NS4A | EU482757 | DENV | NS4A | EU569700 | DENV | NS4A | EU482623 |
| DENV | NS4A | EU596499 | DENV | NS4A | EU482737 | DENV | NS4A | EU569693 |
| DENV | NS4A | EU482543 | DENV | NS4A | EU482573 | DENV | NS4A | EU482590 |
| DENV | NS4A | EU687217 | DENV | NS4A | AY702040 | DENV | NS4A | FJ639834 |
| DENV | NS4A | EU482646 | DENV | NS4A | DQ181803 | DENV | NS4A | EU482449 |
| DENV | NS4A | EU482746 | DENV | NS4A | EU482741 | DENV | NS4A | EU687237 |
| DENV | NS4A | FJ410217 | DENV | NS4A | EU660399 | DENV | NS4A | EF105381 |
| DENV | NS4A | FJ639707 | DENV | NS4A | EU482784 | DENV | NS4A | EU482578 |
| DENV | NS4A | EU482637 | DENV | NS4A | EU482584 | DENV | NS4A | EU482781 |
| DENV | NS4A | EU482699 | DENV | NS4A | EU482670 | DENV | NS4A | EU596485 |
| DENV | NS4A | EU482583 | DENV | NS4A | DQ181801 | DENV | NS4A | EU687224 |
| DENV | NS4A | FJ639717 | DENV | NS4A | EU482603 | DENV | NS4A | FJ461321 |
| DENV | NS4A | EU687223 | DENV | NS4A | EU482769 | DENV | NS4A | FJ390390 |
| DENV | NS4A | AY702036 | DENV | NS4A | FM210227 | DENV | NS4A | EU482562 |
| DENV | NS4A | EU482542 | DENV | NS4A | AY744147 | DENV | NS4A | EF105390 |
| DENV | NS4A | EU482587 | DENV | NS4A | EU482656 | DENV | NS4A | EU482782 |
| DENV | NS4A | EU482667 | DENV | NS4A | EU529706 | DENV | NS4A | EU482682 |
| DENV | NS4A | EU482695 | DENV | NS4A | EU687212 | DENV | NS4A | EU056810 |
| DENV | NS4A | EU569720 | DENV | NS4A | DQ645541 | DENV | NS4A | EU687236 |
| DENV | NS4A | AY702037 | DENV | NS4A | DQ181800 | DENV | NS4A | EU482448 |
| DENV | NS4A | AY858036 | DENV | NS4A | EU482721 | DENV | NS4A | FJ639698 |
| DENV | NS4A | DQ645544 | DENV | NS4A | EU677145 | DENV | NS4A | EU482630 |
| DENV | NS4A | FJ639822 | DENV | NS4A | EU482450 | DENV | NS4A | EU359009 |
| DENV | NS4A | AF100466 | DENV | NS4A | EU482541 | DENV | NS4A | EU482768 |
| DENV | NS4A | FJ410215 | DENV | NS4A | AF169688 | DENV | NS4A | EU482672 |
| DENV | NS4A | EU569705 | DENV | NS4A | M19197 | DENV | NS4A | EU569711 |
| DENV | NS4A | FM210241 | DENV | NS4A | EU482594 | DENV | NS4A | EU482627 |
| DENV | NS4A | FM210221 | DENV | NS4A | DQ645554 | DENV | NS4A | EU569715 |
| DENV | NS4A | EU687228 | DENV | NS4A | DQ181798 | DENV | NS4A | EU482678 |
| DENV | NS4A | EU482703 | DENV | NS4A | AY702038 | DENV | NS4A | DQ181799 |
| DENV | NS4A | EU529700 | DENV | NS4A | EU596495 | DENV | NS4A | EU687235 |

FIG. 70-149

| Virus | Protein | Accession No. | Virus | Protein | Accession No. | Virus | Protein | Accession No. |
|---|---|---|---|---|---|---|---|---|
| DENV | NS4A | EU687238 | DENV | NS4A | AB122020 | DENV | NS4A | DQ181797 |
| DENV | NS4A | M84727 | DENV | NS4A | FM210244 | DENV | NS4A | EU569701 |
| DENV | NS4A | EU482763 | DENV | NS4A | AF100469 | DENV | NS4A | EU482773 |
| DENV | NS4A | EU482758 | DENV | NS4A | FJ410221 | DENV | NS4A | EU482722 |
| DENV | NS4A | FJ639830 | DENV | NS4A | EU482626 | DENV | NS4A | EU482635 |
| DENV | NS4A | EU482754 | DENV | NS4A | EU482788 | DENV | NS4A | DQ645549 |
| DENV | NS4A | FM210218 | DENV | NS4A | FJ410219 | DENV | NS4A | EU482629 |
| DENV | NS4A | FJ410224 | DENV | NS4A | AF100462 | DENV | NS4A | EU596488 |
| DENV | NS4A | FJ410193 | DENV | NS4A | EU482696 | DENV | NS4A | FJ639836 |
| DENV | NS4A | EU056811 | DENV | NS4A | EU482544 | DENV | NS4A | EU482733 |
| DENV | NS4A | EU482774 | DENV | NS4A | EU482640 | DENV | NS4A | EU677143 |
| DENV | NS4A | EU482568 | DENV | NS4A | FJ182012 | DENV | NS4A | EU482653 |
| DENV | NS4A | EU482588 | DENV | NS4A | DQ645548 | DENV | NS4A | AF208496 |
| DENV | NS4A | EU482475 | DENV | NS4A | FJ639701 | DENV | NS4A | EU482565 |
| DENV | NS4A | AF489932 | DENV | NS4A | EU482655 | DENV | NS4A | EU482598 |
| DENV | NS4A | FM210211 | DENV | NS4A | AB189122 | DENV | NS4A | M29095 |
| DENV | NS4A | EU687246 | DENV | NS4A | DQ181804 | DENV | NS4A | EU660415 |
| DENV | NS4A | FJ390389 | DENV | NS4A | EU482732 | DENV | NS4A | FM210239 |
| DENV | NS4A | EU482464 | DENV | NS4A | DQ645543 | DENV | NS4A | EU687213 |
| DENV | NS4A | EU482697 | DENV | NS4A | FJ639832 | DENV | NS4A | EU677144 |
| DENV | NS4A | EU482765 | DENV | NS4A | FJ226066 | DENV | NS4A | FM210243 |
| DENV | NS4A | FM210209 | DENV | NS4A | AF169687 | DENV | NS4A | AF100459 |
| DENV | NS4A | EU482474 | DENV | NS4A | EU482752 | DENV | NS4A | EU482466 |
| DENV | NS4A | EU596484 | DENV | NS4A | EU482783 | DENV | NS4A | FM210230 |
| DENV | NS4A | EU677138 | DENV | NS4A | EU482742 | DENV | NS4A | FJ410200 |
| DENV | NS4A | EU621672 | DENV | NS4A | FJ461314 | DENV | NS4A | DQ645552 |
| DENV | NS4A | AF359579 | DENV | NS4A | EU482688 | DENV | NS4A | EU482574 |
| DENV | NS4A | EU482645 | DENV | NS4A | DQ181802 | DENV | NS4A | EU482622 |
| DENV | NS4A | EU482760 | DENV | NS4A | FJ639809 | DENV | NS4A | EU482561 |
| DENV | NS4A | FJ639732 | DENV | NS4A | EU482701 | DENV | NS4A | EU596486 |
| DENV | NS4A | FM210229 | DENV | NS4A | AF204178 | DENV | NS4A | EU569695 |
| DENV | NS4A | EU482684 | DENV | NS4A | FJ639706 | DENV | NS4A | FJ024461 |
| DENV | NS4A | EF105378 | DENV | NS4A | EU482550 | DENV | NS4A | EU569713 |
| DENV | NS4A | EU482681 | DENV | NS4A | EU482605 | DENV | NS4A | FM210224 |
| DENV | NS4A | FJ547090 | DENV | NS4A | EU482554 | DENV | NS4A | EU482556 |
| DENV | NS4A | EU482447 | DENV | NS4A | EU482692 | DENV | NS4A | EU482731 |
| DENV | NS4A | EU482624 | DENV | NS4A | EU482680 | DENV | NS4A | EU179858 |
| DENV | NS4A | AF119661 | DENV | NS4A | AF169683 | DENV | NS4A | EU781135 |
| DENV | NS4A | EU660413 | DENV | NS4A | FJ024458 | DENV | NS4A | EU482743 |
| DENV | NS4A | AF169685 | DENV | NS4A | EU482780 | DENV | NS4A | EU482751 |
| DENV | NS4A | EU482771 | DENV | NS4A | EU482750 | DENV | NS4A | FJ410259 |
| DENV | NS4A | EU482604 | DENV | NS4A | EU179857 | DENV | NS4A | EU482747 |
| DENV | NS4A | FJ410223 | DENV | NS4A | EU569698 | DENV | NS4A | EU687225 |
| DENV | NS4A | EU482739 | DENV | NS4A | EU482571 | DENV | NS4A | FJ639718 |
| DENV | NS4A | EU687243 | DENV | NS4A | EU081179 | DENV | NS4A | EU569707 |
| DENV | NS4A | EU482720 | DENV | NS4A | EU482690 | DENV | NS4A | EU677147 |
| DENV | NS4A | EU482730 | DENV | NS4A | EU687215 | DENV | NS4A | FM210223 |
| DENV | NS4A | EU482779 | DENV | NS4A | EU482664 | DENV | NS4A | EU081180 |

FIG. 70-150

| Virus | Protein | Accession No. | Virus | Protein | Accession No. | Virus | Protein | Accession No. |
|---|---|---|---|---|---|---|---|---|
| DENV | NS4A | EU482728 | DENV | NS4A | EU677149 | DENV | NS4A | EU482687 |
| DENV | NS4A | EU596500 | DENV | NS4A | EU569719 | DENV | NS4A | EU529693 |
| DENV | NS4A | EU482671 | DENV | NS4A | EU482778 | DENV | NS4A | FJ390384 |
| DENV | NS4A | EU179859 | DENV | NS4A | DQ645551 | DENV | NS4A | EU482560 |
| DENV | NS4A | EU482705 | DENV | NS4A | EU482689 | DENV | NS4A | EU482761 |
| DENV | NS4A | EU482552 | DENV | NS4A | EU726770 | DENV | NS4A | EU482638 |
| DENV | NS4A | EU482546 | DENV | NS4A | AB122022 | DENV | NS4A | EU482698 |
| DENV | NS4A | EU482642 | DENV | NS4A | FJ639697 | DENV | NS4A | EU482764 |
| DENV | NS4A | EU482579 | DENV | NS4A | EU482628 | DENV | NS4A | FJ182014 |
| DENV | NS4A | M20558 | DENV | NS4A | EU687232 | DENV | NS4A | EU482776 |
| DENV | NS4A | EU482775 | DENV | NS4A | FM210225 | DENV | NS4A | DQ645550 |
| DENV | NS4A | EU596491 | DENV | NS4A | AY037116 | DENV | NS4A | FJ024473 |
| DENV | NS4A | FJ639708 | DENV | NS4A | FJ205878 | DENV | NS4A | DQ181806 |
| DENV | NS4A | FM210220 | DENV | NS4A | AY702034 | DENV | NS4A | FJ461305 |
| DENV | NS4A | EU569717 | DENV | NS4A | FM210232 | DENV | NS4A | FJ024452 |
| DENV | NS4A | EF105379 | DENV | NS4A | AY702039 | DENV | NS4A | EU677141 |
| DENV | NS4A | EU569712 | DENV | NS4A | EU687245 | DENV | NS4A | FJ639828 |
| DENV | NS4A | EU482755 | DENV | NS4A | EU482465 | DENV | NS4A | EU569706 |
| DENV | NS4A | DQ181805 | DENV | NS4A | EU482472 | DENV | NS4A | EU482666 |
| DENV | NS4A | FM210207 | DENV | NS4A | EU569714 | DENV | NS4A | EU482673 |
| DENV | NS4A | FM210233 | DENV | NS4A | EU569692 | DENV | NS4A | FJ024474 |
| DENV | NS4A | EU687199 | DENV | NS4A | FJ410233 | DENV | NS4A | EU687214 |
| DENV | NS4A | EU482686 | DENV | NS4A | AF100467 | DENV | NS4A | FJ410291 |
| DENV | NS4A | FJ205880 | DENV | NS4A | EU677148 | DENV | NS4A | FM210242 |
| DENV | NS4A | AY776328 | DENV | NS4A | EF105380 | DENV | NS4A | EU687250 |
| DENV | NS4A | EU482675 | DENV | NS4A | EU482677 | DENV | NS4A | EU482735 |
| DENV | NS4A | EU660417 | DENV | NS4A | AF100468 | DENV | NS4A | EU482785 |
| DENV | NS4A | EU482727 | DENV | NS4A | EU482569 | DENV | NS4A | EU596483 |
| DENV | NS4A | EU482602 | DENV | NS4A | DQ645542 | DENV | NS4A | EU569702 |
| DENV | NS4A | EU482577 | DENV | NS4A | EU482643 | DENV | NS4A | FJ410241 |
| DENV | NS4A | EU482756 | DENV | NS4A | EU482694 | DENV | NS4A | EU482659 |
| DENV | NS4A | EU529701 | DENV | NS4A | EU482724 | DENV | NS4A | FM210203 |
| DENV | NS4A | FJ639702 | DENV | NS4A | EU482446 | DENV | NS4A | EU482581 |
| DENV | NS4A | EU482772 | DENV | NS4A | FM210226 | DENV | NS4A | EU569696 |
| DENV | NS4A | FM210246 | DENV | NS4A | EU482744 | DENV | NS4A | FJ562098 |
| DENV | NS4A | FJ390391 | DENV | NS4A | EU677137 | DENV | NS4A | FM210222 |
| DENV | NS4A | AF100464 | DENV | NS4A | EU482770 | DENV | NS4A | EU482473 |
| DENV | NS4A | FJ547067 | DENV | NS4A | AF038403 | DENV | NS4A | EU854294 |
| DENV | NS4A | EF105386 | DENV | NS4A | EU660398 | DENV | NS4A | EU482649 |
| DENV | NS4A | EF105387 | DENV | NS4A | EU569709 | DENV | NS4A | EU726767 |
| DENV | NS4A | EU726775 | DENV | NS4A | FM210237 | DENV | NS4A | FJ024454 |
| DENV | NS4A | FJ639704 | DENV | NS4A | EU660416 | DENV | NS4A | FJ639699 |
| DENV | NS4A | AF169678 | DENV | NS4A | EU677142 | DENV | NS4A | FM210204 |
| DENV | NS4A | EU482749 | DENV | NS4A | EU482700 | DENV | NS4A | EU529695 |
| DENV | NS4A | EU482631 | DENV | NS4A | EU482545 | DENV | NS4A | EU687222 |
| DENV | NS4A | EF105388 | DENV | NS4A | EU482585 | DENV | NS4A | EF105382 |
| DENV | NS4A | AB189123 | DENV | NS4A | FJ024475 | DENV | NS4A | EU482738 |
| DENV | NS4A | EU482663 | DENV | NS4A | EU482725 | DENV | NS4A | EF105385 |

FIG. 70-151

| Virus | Protein | Accession No. | Virus | Protein | Accession No. | Virus | Protein | Accession No. |
|---|---|---|---|---|---|---|---|---|
| DENV | NS4A | FM210219 | DENV | NS4A | GQ252676 | DENV | NS4A | DQ448231 |
| DENV | NS4A | EU482723 | DENV | NS4A | FJ850065 | DENV | NS4A | FJ744710 |
| DENV | NS4A | FJ639829 | DENV | NS4A | FJ898477 | DENV | NS4A | GQ252677 |
| DENV | NS4A | EU482575 | DENV | NS4A | FJ850116 | DENV | NS4A | NC_001474 |
| DENV | NS4A | AF038402 | DENV | NS4A | FJ898454 | DENV | NS4A | FJ687445 |
| DENV | NS4A | FJ639783 | DENV | NS4A | GQ199897 | DENV | NS4A | FJ850091 |
| DENV | NS4A | EU482572 | DENV | NS4A | GQ199899 | DENV | NS4A | FJ687443 |
| DENV | NS4A | FJ639734 | DENV | NS4A | FJ744723 | DENV | NS4A | GQ199869 |
| DENV | NS4A | EU482762 | DENV | NS4A | GQ199900 | DENV | NS4A | FJ850105 |
| DENV | NS4A | EU569704 | DENV | NS4A | FJ850082 | DENV | NS4A | FJ850051 |
| DENV | NS4A | EU482759 | DENV | NS4A | FJ744715 | DENV | NS4A | FJ850050 |
| DENV | NS4A | EU056812 | DENV | NS4A | FJ744709 | DENV | NS4A | FJ744719 |
| DENV | NS4A | FJ410228 | DENV | NS4A | GQ199868 | DENV | NS4A | FJ898453 |
| DENV | NS4A | EU482467 | DENV | NS4A | FJ906960 | DENV | NS4A | FJ898460 |
| DENV | NS4A | FM210217 | DENV | NS4A | FJ882602 | DENV | NS4A | FJ898438 |
| DENV | NS4A | FM210212 | DENV | NS4A | GQ199895 | DENV | NS4A | FJ850053 |
| DENV | NS4A | EU660405 | DENV | NS4A | FJ687436 | DENV | NS4A | FJ898450 |
| DENV | NS4A | FJ547064 | DENV | NS4A | FJ744725 | DENV | NS4A | FJ744708 |
| DENV | NS4A | EU482740 | DENV | NS4A | FJ850117 | DENV | NS4A | GQ199896 |
| DENV | NS4A | EU482451 | DENV | NS4A | FJ687441 | DENV | NS4A | FJ744722 |
| DENV | NS4A | EU482668 | DENV | NS4A | FJ744706 | DENV | NS4A | FJ850062 |
| DENV | NS4A | EU687229 | DENV | NS4A | FJ850074 | DENV | NS4A | FJ898461 |
| DENV | NS4A | AF169684 | DENV | NS4A | FJ850085 | DENV | NS4A | FJ810410 |
| DENV | NS4A | FM210235 | DENV | NS4A | FJ850061 | DENV | NS4A | FJ850060 |
| DENV | NS4A | GQ199874 | DENV | NS4A | FJ810409 | DENV | NS4A | FJ906961 |
| DENV | NS4A | FJ744745 | DENV | NS4A | FJ687434 | DENV | NS4A | FJ882593 |
| DENV | NS4A | FJ898467 | DENV | NS4A | GQ199890 | DENV | NS4A | FJ898479 |
| DENV | NS4A | FJ687444 | DENV | NS4A | FJ744743 | DENV | NS4A | FJ744703 |
| DENV | NS4A | FJ810411 | DENV | NS4A | FJ850063 | DENV | NS4A | FJ744712 |
| DENV | NS4A | FJ850067 | DENV | NS4A | FJ898466 | DENV | NS4A | FJ882594 |
| DENV | NS4A | FJ850121 | DENV | NS4A | FJ850119 | DENV | NS4A | FJ744716 |
| DENV | NS4A | FJ898452 | DENV | NS4A | FJ898432 | DENV | NS4A | FJ850066 |
| DENV | NS4A | FJ744713 | DENV | NS4A | FJ744718 | DENV | NS4A | FJ744744 |
| DENV | NS4A | FJ810418 | DENV | NS4A | FJ810412 | DENV | NS4A | FJ850108 |
| DENV | NS4A | FJ906962 | DENV | NS4A | FJ906956 | DENV | NS4A | FJ859028 |
| DENV | NS4A | FJ744721 | DENV | NS4A | FJ850064 | DENV | NS4A | FJ898465 |
| DENV | NS4A | FJ850107 | DENV | NS4A | GQ199892 | DENV | NS4A | FJ898451 |
| DENV | NS4A | FJ467493 | DENV | NS4A | FJ898436 | DENV | NS4A | FJ898449 |
| DENV | NS4A | FJ906966 | DENV | NS4A | FJ906957 | DENV | NS4A | FJ744705 |
| DENV | NS4A | FJ687446 | DENV | NS4A | FJ898478 | DENV | NS4A | FJ898434 |
| DENV | NS4A | FJ906958 | DENV | NS4A | FJ873811 | DENV | NS4A | FJ906969 |
| DENV | NS4A | FJ687435 | DENV | NS4A | GQ199898 | DENV | NS4A | FJ744741 |
| DENV | NS4A | FJ850054 | DENV | NS4A | FJ850115 | DENV | NS4A | FJ906959 |
| DENV | NS4A | FJ906967 | DENV | NS4A | FJ687442 | DENV | NS4A | FJ850106 |
| DENV | NS4A | FJ850072 | DENV | NS4A | FJ687439 | DENV | NS4A | FJ744742 |
| DENV | NS4A | FJ898439 | DENV | NS4A | FJ432724 | DENV | NS4A | FJ687437 |
| DENV | NS4A | FJ850088 | DENV | NS4A | FJ687447 | DENV | NS4A | FJ744707 |
| DENV | NS4A | FJ898435 | DENV | NS4A | FJ873808 | DENV | NS4A | FJ687438 |

FIG. 70-152

| Virus | Protein | Accession No. | Virus | Protein | Accession No. | Virus | Protein | Accession No. |
|---|---|---|---|---|---|---|---|---|
| DENV | NS4A | FJ744714 | DENV | NS4A | GQ868638 | DENV | NS4A | GU131897 |
| DENV | NS4A | GQ199866 | DENV | NS4A | GQ868553 | DENV | NS4A | GQ868592 |
| DENV | NS4A | GQ199894 | DENV | NS4A | GQ868646 | DENV | NS4A | GQ868552 |
| DENV | NS4A | FJ687440 | DENV | NS4A | FN429891 | DENV | NS4A | GU131900 |
| DENV | NS4A | FJ850112 | DENV | NS4A | GQ868604 | DENV | NS4A | GQ868599 |
| DENV | NS4A | FJ850078 | DENV | NS4A | GU131947 | DENV | NS4A | GU131929 |
| DENV | NS4A | FJ744717 | DENV | NS4A | GU131928 | DENV | NS4A | GU131930 |
| DENV | NS4A | FJ906968 | DENV | NS4A | GQ868497 | DENV | NS4A | GQ868550 |
| DENV | NS4A | GQ199893 | DENV | NS4A | GQ868603 | DENV | NS4A | GU131975 |
| DENV | NS4A | FJ744711 | DENV | NS4A | GQ868621 | DENV | NS4A | GU131927 |
| DENV | NS4A | FJ744704 | DENV | NS4A | AB479042 | DENV | NS4A | GQ868540 |
| DENV | NS4A | FJ744720 | DENV | NS4A | GQ868620 | DENV | NS4A | FJ410202 |
| DENV | NS4A | GQ199901 | DENV | NS4A | GQ868590 | DENV | NS4A | CS479202 |
| DENV | NS4A | FJ744724 | DENV | NS4A | FN429892 | DENV | NS4A | U87411 |
| DENV | NS4A | FJ850120 | DENV | NS4A | GQ868554 | DENV | NS4A | CS479203 |
| DENV | NS4A | FJ850118 | DENV | NS4A | GU131974 | DENV | NS4A | CS479204 |
| DENV | NS4A | FJ850076 | DENV | NS4A | GU131843 | DENV | NS4A | CS479167 |
| DENV | NS4A | AF022436 | DENV | NS4A | GQ868641 | DENV | NS4A | CS479205 |
| DENV | NS4A | AF022439 | DENV | NS4A | GQ868542 | DENV | NS4A | CS479206 |
| DENV | NS4A | AF022441 | DENV | NS4A | GQ868555 | DENV | NS4A | CS805344 |
| DENV | NS4A | AF022437 | DENV | NS4A | FN429894 | DENV | NS4A | FB730117 |
| DENV | NS4A | AJ487271 | DENV | NS4A | GQ868549 | DENV | NS4A | DL138662 |
| DENV | NS4A | AF022435 | DENV | NS4A | GQ868588 | DENV | NS4A | GM059692 |
| DENV | NS4A | AF022434 | DENV | NS4A | GQ868541 | DENV | NS4A | AY243468 |
| DENV | NS4A | AF022438 | DENV | NS4A | GQ868558 | DENV | NS4A | AY243469 |
| DENV | NS4A | AF022440 | DENV | NS4A | GQ868625 | DENV | NS4A | AY744148 |
| DENV | NS4A | CS479165 | DENV | NS4A | GQ868624 | DENV | NS4A | AY744149 |
| DENV | NS4A | GQ868556 | DENV | NS4A | GQ868631 | DENV | NS4A | AY744150 |
| DENV | NS4A | AB479041 | DENV | NS4A | GU131899 | DENV | NS4A | AJ968413 |
| DENV | NS4A | GU289914 | DENV | NS4A | GQ868515 | DENV | NS4A | GU369819 |
| DENV | NS4A | GU131884 | DENV | NS4A | GU131898 | DENV | NS4A | GU370050 |
| DENV | NS4A | GQ868600 | DENV | NS4A | GQ868623 | DENV | NS4A | GU370051 |
| DENV | NS4A | FN429895 | DENV | NS4A | GU131886 | DENV | NS4B | AY277665 |
| DENV | NS4A | GU131879 | DENV | NS4A | GQ868622 | DENV | NS4B | AY713474 |
| DENV | NS4A | GQ868596 | DENV | NS4A | GQ868595 | DENV | NS4B | AF311957 |
| DENV | NS4A | GQ868516 | DENV | NS4A | GQ868557 | DENV | NS4B | FJ205881 |
| DENV | NS4A | GU131864 | DENV | NS4A | GU131959 | DENV | NS4B | EU482817 |
| DENV | NS4A | FN429893 | DENV | NS4A | GU131955 | DENV | NS4B | DQ672557 |
| DENV | NS4A | GQ868598 | DENV | NS4A | GQ868597 | DENV | NS4B | EU677151 |
| DENV | NS4A | GQ868544 | DENV | NS4A | GU131883 | DENV | NS4B | FJ410256 |
| DENV | NS4A | GQ868589 | DENV | NS4A | GQ868591 | DENV | NS4B | FJ432735 |
| DENV | NS4A | GQ868551 | DENV | NS4A | GQ868543 | DENV | NS4B | EU660390 |
| DENV | NS4A | GU131902 | DENV | NS4A | GU131901 | DENV | NS4B | EU482824 |
| DENV | NS4A | GU131896 | DENV | NS4A | GQ868545 | DENV | NS4B | FJ410222 |
| DENV | NS4A | GU131924 | DENV | NS4A | GU131931 | DENV | NS4B | AY726551 |
| DENV | NS4A | GQ868640 | DENV | NS4A | GU131885 | DENV | NS4B | EU482716 |
| DENV | NS4A | GU131880 | DENV | NS4A | GU131932 | DENV | NS4B | AF226685 |
| DENV | NS4A | GU131882 | DENV | NS4A | GU131881 | DENV | NS4B | EU677174 |

FIG. 70-153

| Virus | Protein | Accession No. | Virus | Protein | Accession No. | Virus | Protein | Accession No. |
|---|---|---|---|---|---|---|---|---|
| DENV | NS4B | FJ639693 | DENV | NS4B | DQ285560 | DENV | NS4B | EU081238 |
| DENV | NS4B | FJ461317 | DENV | NS4B | FJ182002 | DENV | NS4B | FJ410245 |
| DENV | NS4B | FJ384655 | DENV | NS4B | EU677177 | DENV | NS4B | FJ461318 |
| DENV | NS4B | EU482508 | DENV | NS4B | FJ639680 | DENV | NS4B | FJ410263 |
| DENV | NS4B | AF311958 | DENV | NS4B | EU677160 | DENV | NS4B | FJ410269 |
| DENV | NS4B | FJ024451 | DENV | NS4B | AY835999 | DENV | NS4B | FJ410289 |
| DENV | NS4B | EU482528 | DENV | NS4B | EU249494 | DENV | NS4B | FJ639692 |
| DENV | NS4B | EU482821 | DENV | NS4B | AF226687 | DENV | NS4B | EU660397 |
| DENV | NS4B | FJ410267 | DENV | NS4B | FJ024432 | DENV | NS4B | EU482477 |
| DENV | NS4B | AB074761 | DENV | NS4B | EU081229 | DENV | NS4B | FJ024434 |
| DENV | NS4B | AY762084 | DENV | NS4B | FJ410184 | DENV | NS4B | FJ410204 |
| DENV | NS4B | AY732480 | DENV | NS4B | FJ182022 | DENV | NS4B | EU249495 |
| DENV | NS4B | EU482481 | DENV | NS4B | EU677153 | DENV | NS4B | AF513110 |
| DENV | NS4B | FJ410232 | DENV | NS4B | DQ672559 | DENV | NS4B | FJ024438 |
| DENV | NS4B | EU081254 | DENV | NS4B | EU081234 | DENV | NS4B | EU081264 |
| DENV | NS4B | EU482806 | DENV | NS4B | FJ639802 | DENV | NS4B | EU482525 |
| DENV | NS4B | FJ410257 | DENV | NS4B | EU482483 | DENV | NS4B | EU687251 |
| DENV | NS4B | FJ432720 | DENV | NS4B | FJ024445 | DENV | NS4B | EU482486 |
| DENV | NS4B | FJ547089 | DENV | NS4B | FJ410236 | DENV | NS4B | DQ285558 |
| DENV | NS4B | EU482819 | DENV | NS4B | FJ410242 | DENV | NS4B | FJ205883 |
| DENV | NS4B | EU081270 | DENV | NS4B | FJ390378 | DENV | NS4B | AY145121 |
| DENV | NS4B | FJ205875 | DENV | NS4B | EU081236 | DENV | NS4B | AY732478 |
| DENV | NS4B | FJ410210 | DENV | NS4B | EU081278 | DENV | NS4B | FJ410199 |
| DENV | NS4B | FJ205884 | DENV | NS4B | FJ432736 | DENV | NS4B | FJ390383 |
| DENV | NS4B | FJ176780 | DENV | NS4B | FJ639694 | DENV | NS4B | EU482592 |
| DENV | NS4B | FJ461340 | DENV | NS4B | EU482500 | DENV | NS4B | FJ182030 |
| DENV | NS4B | AY732475 | DENV | NS4B | DQ672560 | DENV | NS4B | FJ024431 |
| DENV | NS4B | AY732474 | DENV | NS4B | AY713473 | DENV | NS4B | FJ024450 |
| DENV | NS4B | FJ024435 | DENV | NS4B | EU726780 | DENV | NS4B | FJ410252 |
| DENV | NS4B | FJ639669 | DENV | NS4B | FJ410255 | DENV | NS4B | FJ478457 |
| DENV | NS4B | EU482540 | DENV | NS4B | FJ373298 | DENV | NS4B | EU596502 |
| DENV | NS4B | FJ024429 | DENV | NS4B | EU081276 | DENV | NS4B | FJ410201 |
| DENV | NS4B | EU677167 | DENV | NS4B | FJ410198 | DENV | NS4B | FJ562105 |
| DENV | NS4B | EU482512 | DENV | NS4B | EU482536 | DENV | NS4B | FJ639684 |
| DENV | NS4B | FJ390381 | DENV | NS4B | FJ390382 | DENV | NS4B | FJ639682 |
| DENV | NS4B | FJ410226 | DENV | NS4B | FJ024462 | DENV | NS4B | FJ410240 |
| DENV | NS4B | FJ410191 | DENV | NS4B | EU482822 | DENV | NS4B | EU081279 |
| DENV | NS4B | AJ968413 | DENV | NS4B | FJ024447 | DENV | NS4B | EU081231 |
| DENV | NS4B | FJ639689 | DENV | NS4B | FJ410274 | DENV | NS4B | FJ410214 |
| DENV | NS4B | AY277664 | DENV | NS4B | FJ410216 | DENV | NS4B | FJ182036 |
| DENV | NS4B | FJ639811 | DENV | NS4B | EU482527 | DENV | NS4B | FJ182023 |
| DENV | NS4B | FJ639695 | DENV | NS4B | EU280167 | DENV | NS4B | EU482479 |
| DENV | NS4B | EU081226 | DENV | NS4B | EU482567 | DENV | NS4B | FJ547087 |
| DENV | NS4B | FJ410280 | DENV | NS4B | EU081265 | DENV | NS4B | FJ639683 |
| DENV | NS4B | EU596504 | DENV | NS4B | EU482489 | DENV | NS4B | FJ024442 |
| DENV | NS4B | FJ639685 | DENV | NS4B | AB178040 | DENV | NS4B | FJ410285 |
| DENV | NS4B | EU482715 | DENV | NS4B | EU482827 | DENV | NS4B | EU482615 |
| DENV | NS4B | FJ410227 | DENV | NS4B | FJ024455 | DENV | NS4B | AY732476 |

FIG. 70-154

| Virus | Protein | Accession No. | Virus | Protein | Accession No. | Virus | Protein | Accession No. |
|---|---|---|---|---|---|---|---|---|
| DENV | NS4B | FJ024463 | DENV | NS4B | AY277666 | DENV | NS4B | EU677169 |
| DENV | NS4B | FJ410275 | DENV | NS4B | FJ024483 | DENV | NS4B | EU482828 |
| DENV | NS4B | FJ410234 | DENV | NS4B | DQ193572 | DENV | NS4B | EU482537 |
| DENV | NS4B | EU482487 | DENV | NS4B | EF122231 | DENV | NS4B | EU726782 |
| DENV | NS4B | FJ410182 | DENV | NS4B | EU081266 | DENV | NS4B | FJ410225 |
| DENV | NS4B | EU482812 | DENV | NS4B | EU482818 | DENV | NS4B | FJ410180 |
| DENV | NS4B | EU081247 | DENV | NS4B | FJ410186 | DENV | NS4B | FJ024460 |
| DENV | NS4B | AB074760 | DENV | NS4B | EU249493 | DENV | NS4B | FJ410231 |
| DENV | NS4B | EU482802 | DENV | NS4B | FJ024478 | DENV | NS4B | FJ390380 |
| DENV | NS4B | EU677172 | DENV | NS4B | FJ205874 | DENV | NS4B | FJ410238 |
| DENV | NS4B | EU482496 | DENV | NS4B | EU482791 | DENV | NS4B | FJ390379 |
| DENV | NS4B | EU726777 | DENV | NS4B | EU482798 | DENV | NS4B | AF311956 |
| DENV | NS4B | U88535 | DENV | NS4B | EU081248 | DENV | NS4B | EU081257 |
| DENV | NS4B | EU482519 | DENV | NS4B | EU596501 | DENV | NS4B | FJ432721 |
| DENV | NS4B | FJ461339 | DENV | NS4B | FJ461336 | DENV | NS4B | FJ639672 |
| DENV | NS4B | FJ562101 | DENV | NS4B | FJ024457 | DENV | NS4B | FJ639794 |
| DENV | NS4B | FJ461316 | DENV | NS4B | EU482485 | DENV | NS4B | EU660403 |
| DENV | NS4B | EU482814 | DENV | NS4B | FJ176779 | DENV | NS4B | EU482619 |
| DENV | NS4B | AY726555 | DENV | NS4B | EU482799 | DENV | NS4B | EU677155 |
| DENV | NS4B | FJ639677 | DENV | NS4B | EU081233 | DENV | NS4B | FJ182021 |
| DENV | NS4B | EU482506 | DENV | NS4B | EU482497 | DENV | NS4B | EU482712 |
| DENV | NS4B | FJ410283 | DENV | NS4B | EU482616 | DENV | NS4B | EU482591 |
| DENV | NS4B | FJ639696 | DENV | NS4B | EU482507 | DENV | NS4B | FJ410253 |
| DENV | NS4B | FJ410235 | DENV | NS4B | EU482809 | DENV | NS4B | EF032590 |
| DENV | NS4B | EU482532 | DENV | NS4B | FJ410262 | DENV | NS4B | EU081243 |
| DENV | NS4B | FJ182031 | DENV | NS4B | FJ024480 | DENV | NS4B | FJ639818 |
| DENV | NS4B | FJ024428 | DENV | NS4B | EU482495 | DENV | NS4B | EU081237 |
| DENV | NS4B | FJ432749 | DENV | NS4B | FJ182032 | DENV | NS4B | AF514876 |
| DENV | NS4B | DQ285561 | DENV | NS4B | FJ410197 | DENV | NS4B | FJ639688 |
| DENV | NS4B | EU482518 | DENV | NS4B | AF514883 | DENV | NS4B | EU482713 |
| DENV | NS4B | EU726779 | DENV | NS4B | FJ461330 | DENV | NS4B | EU677154 |
| DENV | NS4B | EU677161 | DENV | NS4B | FJ639690 | DENV | NS4B | EU081242 |
| DENV | NS4B | AY145123 | DENV | NS4B | FJ410209 | DENV | NS4B | EU687247 |
| DENV | NS4B | EU482800 | DENV | NS4B | EU482514 | DENV | NS4B | AY726552 |
| DENV | NS4B | AY732482 | DENV | NS4B | EU848545 | DENV | NS4B | FJ024436 |
| DENV | NS4B | EU482517 | DENV | NS4B | EU249492 | DENV | NS4B | FJ639681 |
| DENV | NS4B | EU482488 | DENV | NS4B | EU081240 | DENV | NS4B | EU482484 |
| DENV | NS4B | FJ373305 | DENV | NS4B | EU482499 | DENV | NS4B | EU482815 |
| DENV | NS4B | FJ432746 | DENV | NS4B | FJ410281 | DENV | NS4B | EU249490 |
| DENV | NS4B | FJ432734 | DENV | NS4B | FJ410270 | DENV | NS4B | EU081253 |
| DENV | NS4B | EU482797 | DENV | NS4B | EU482808 | DENV | NS4B | AY726549 |
| DENV | NS4B | EU482711 | DENV | NS4B | EU081281 | DENV | NS4B | EU677166 |
| DENV | NS4B | FJ024459 | DENV | NS4B | AF309641 | DENV | NS4B | FJ639821 |
| DENV | NS4B | FJ410174 | DENV | NS4B | EU677159 | DENV | NS4B | FJ024430 |
| DENV | NS4B | EU596503 | DENV | NS4B | EU482526 | DENV | NS4B | FJ410183 |
| DENV | NS4B | FJ432730 | DENV | NS4B | FJ024427 | DENV | NS4B | EU081267 |
| DENV | NS4B | EU081227 | DENV | NS4B | EU482618 | DENV | NS4B | EU482491 |
| DENV | NS4B | EU677163 | DENV | NS4B | AF350498 | DENV | NS4B | EU081249 |

FIG. 70-155

| Virus | Protein | Accession No. | Virus | Protein | Accession No. | Virus | Protein | Accession No. |
|---|---|---|---|---|---|---|---|---|
| DENV | NS4B | EU081252 | DENV | NS4B | EU482513 | DENV | NS4B | FJ432740 |
| DENV | NS4B | EU482706 | DENV | NS4B | FJ410196 | DENV | NS4B | AY726554 |
| DENV | NS4B | AY726553 | DENV | NS4B | FJ410250 | DENV | NS4B | FJ024441 |
| DENV | NS4B | FJ205882 | DENV | NS4B | EU660392 | DENV | NS4B | DQ672556 |
| DENV | NS4B | FJ390386 | DENV | NS4B | FJ461313 | DENV | NS4B | FJ410272 |
| DENV | NS4B | EU677139 | DENV | NS4B | EU677168 | DENV | NS4B | FJ639676 |
| DENV | NS4B | FJ410260 | DENV | NS4B | FJ432723 | DENV | NS4B | FJ639686 |
| DENV | NS4B | EU677170 | DENV | NS4B | FJ410181 | DENV | NS4B | EU482498 |
| DENV | NS4B | EU081256 | DENV | NS4B | FJ410239 | DENV | NS4B | FJ432725 |
| DENV | NS4B | FJ024443 | DENV | NS4B | EU482480 | DENV | NS4B | EU482529 |
| DENV | NS4B | FJ410278 | DENV | NS4B | AY206457 | DENV | NS4B | FJ547086 |
| DENV | NS4B | FJ432744 | DENV | NS4B | EU482523 | DENV | NS4B | FJ461323 |
| DENV | NS4B | AB189120 | DENV | NS4B | FJ410290 | DENV | NS4B | FJ410230 |
| DENV | NS4B | FJ461327 | DENV | NS4B | DQ672562 | DENV | NS4B | FJ410248 |
| DENV | NS4B | EU660391 | DENV | NS4B | EU482521 | DENV | NS4B | EU482609 |
| DENV | NS4B | FJ562106 | DENV | NS4B | EU660402 | DENV | NS4B | FJ639824 |
| DENV | NS4B | FJ182035 | DENV | NS4B | FJ461307 | DENV | NS4B | FJ410279 |
| DENV | NS4B | FJ461306 | DENV | NS4B | EU081272 | DENV | NS4B | EU482535 |
| DENV | NS4B | EU482510 | DENV | NS4B | FJ461315 | DENV | NS4B | FJ024453 |
| DENV | NS4B | FJ024440 | DENV | NS4B | FJ410188 | DENV | NS4B | FJ432748 |
| DENV | NS4B | EU081258 | DENV | NS4B | AY713475 | DENV | NS4B | EU660393 |
| DENV | NS4B | EU081268 | DENV | NS4B | AY732479 | DENV | NS4B | AY145122 |
| DENV | NS4B | EU677178 | DENV | NS4B | EU677156 | DENV | NS4B | FJ024446 |
| DENV | NS4B | FJ410276 | DENV | NS4B | EU482707 | DENV | NS4B | FJ432747 |
| DENV | NS4B | EU081273 | DENV | NS4B | EU482811 | DENV | NS4B | FJ410205 |
| DENV | NS4B | EU482820 | DENV | NS4B | AF226686 | DENV | NS4B | FJ205876 |
| DENV | NS4B | AF514878 | DENV | NS4B | EU081235 | DENV | NS4B | FJ410211 |
| DENV | NS4B | EU660394 | DENV | NS4B | EU660419 | DENV | NS4B | FJ182025 |
| DENV | NS4B | FJ410218 | DENV | NS4B | FJ547068 | DENV | NS4B | FJ182026 |
| DENV | NS4B | EU081241 | DENV | NS4B | AB189121 | DENV | NS4B | FJ373296 |
| DENV | NS4B | FJ410244 | DENV | NS4B | FJ461308 | DENV | NS4B | AY722802 |
| DENV | NS4B | EU482789 | DENV | NS4B | FJ410213 | DENV | NS4B | EU482522 |
| DENV | NS4B | EU482524 | DENV | NS4B | AY726550 | DENV | NS4B | FJ390388 |
| DENV | NS4B | EU081261 | DENV | NS4B | AY732477 | DENV | NS4B | EU677173 |
| DENV | NS4B | FJ639812 | DENV | NS4B | EU660401 | DENV | NS4B | EU081277 |
| DENV | NS4B | EU482533 | DENV | NS4B | FJ639815 | DENV | NS4B | EU482492 |
| DENV | NS4B | DQ285559 | DENV | NS4B | FJ410268 | DENV | NS4B | FJ432732 |
| DENV | NS4B | FJ410246 | DENV | NS4B | FJ478458 | DENV | NS4B | FJ639691 |
| DENV | NS4B | FJ461310 | DENV | NS4B | FJ639808 | DENV | NS4B | EU482511 |
| DENV | NS4B | AB195673 | DENV | NS4B | EU482611 | DENV | NS4B | EU081230 |
| DENV | NS4B | FJ182024 | DENV | NS4B | FJ410261 | DENV | NS4B | FJ410206 |
| DENV | NS4B | AB204803 | DENV | NS4B | FJ432729 | DENV | NS4B | FJ410189 |
| DENV | NS4B | EF025110 | DENV | NS4B | FJ639813 | DENV | NS4B | FJ182019 |
| DENV | NS4B | DQ672564 | DENV | NS4B | EU482520 | DENV | NS4B | FJ024472 |
| DENV | NS4B | EU726778 | DENV | NS4B | AF514885 | DENV | NS4B | FJ205872 |
| DENV | NS4B | EF457905 | DENV | NS4B | FJ639673 | DENV | NS4B | FJ410282 |
| DENV | NS4B | FJ547088 | DENV | NS4B | FJ410266 | DENV | NS4B | EU482538 |
| DENV | NS4B | FJ024437 | DENV | NS4B | EU482805 | DENV | NS4B | EU660418 |

FIG. 70-156

| Virus | Protein | Accession No. | Virus | Protein | Accession No. | Virus | Protein | Accession No. |
|---|---|---|---|---|---|---|---|---|
| DENV | NS4B | FJ639819 | DENV | NS4B | FJ182028 | DENV | NS4B | AF180817 |
| DENV | NS4B | FJ639806 | DENV | NS4B | EU677152 | DENV | NS4B | AY722801 |
| DENV | NS4B | FJ432738 | DENV | NS4B | EU081228 | DENV | NS4B | EU482504 |
| DENV | NS4B | FJ432719 | DENV | NS4B | FJ410173 | DENV | NS4B | FJ639675 |
| DENV | NS4B | FJ461303 | DENV | NS4B | EU482796 | DENV | NS4B | FJ024433 |
| DENV | NS4B | FJ410203 | DENV | NS4B | EU726781 | DENV | NS4B | FJ461331 |
| DENV | NS4B | FJ410194 | DENV | NS4B | FJ410207 | DENV | NS4B | FJ410187 |
| DENV | NS4B | EU081244 | DENV | NS4B | FJ410243 | DENV | NS4B | FJ410258 |
| DENV | NS4B | EU482482 | DENV | NS4B | EU081239 | DENV | NS4B | AY708047 |
| DENV | NS4B | FJ410179 | DENV | NS4B | EU482816 | DENV | NS4B | FJ024423 |
| DENV | NS4B | AY722803 | DENV | NS4B | EU081260 | DENV | NS4B | FJ024484 |
| DENV | NS4B | EU482539 | DENV | NS4B | FJ182029 | DENV | NS4B | EU081251 |
| DENV | NS4B | FJ639671 | DENV | NS4B | FJ024449 | DENV | NS4B | FJ410249 |
| DENV | NS4B | EU482478 | DENV | NS4B | EU081250 | DENV | NS4B | EU482610 |
| DENV | NS4B | FJ547060 | DENV | NS4B | EU482825 | DENV | NS4B | FJ182033 |
| DENV | NS4B | FJ432739 | DENV | NS4B | EU482530 | DENV | NS4B | EU482493 |
| DENV | NS4B | FJ639740 | DENV | NS4B | FJ639820 | DENV | NS4B | EU482807 |
| DENV | NS4B | FJ182034 | DENV | NS4B | EU677175 | DENV | NS4B | FJ639814 |
| DENV | NS4B | EU482710 | DENV | NS4B | FJ410251 | DENV | NS4B | EU482501 |
| DENV | NS4B | EU081232 | DENV | NS4B | EU482794 | DENV | NS4B | FJ410254 |
| DENV | NS4B | EU482515 | DENV | NS4B | EU359008 | DENV | NS4B | EU081246 |
| DENV | NS4B | EU482531 | DENV | NS4B | AF180818 | DENV | NS4B | EU081275 |
| DENV | NS4B | AF298807 | DENV | NS4B | EU660396 | DENV | NS4B | FJ410264 |
| DENV | NS4B | FJ205873 | DENV | NS4B | FJ182003 | DENV | NS4B | FJ024479 |
| DENV | NS4B | FJ639674 | DENV | NS4B | EU482476 | DENV | NS4B | FJ410185 |
| DENV | NS4B | FJ547065 | DENV | NS4B | EU482505 | DENV | NS4B | FJ410273 |
| DENV | NS4B | FJ410212 | DENV | NS4B | EU081255 | DENV | NS4B | EU482801 |
| DENV | NS4B | FJ461341 | DENV | NS4B | FJ639743 | DENV | NS4B | AY713476 |
| DENV | NS4B | EU081259 | DENV | NS4B | U88537 | DENV | NS4B | FJ461312 |
| DENV | NS4B | FJ639823 | DENV | NS4B | FJ432733 | DENV | NS4B | FJ639797 |
| DENV | NS4B | FJ410190 | DENV | NS4B | EU660395 | DENV | NS4B | FJ461319 |
| DENV | NS4B | FJ432745 | DENV | NS4B | EU081263 | DENV | NS4B | FJ461333 |
| DENV | NS4B | FJ410175 | DENV | NS4B | EU482826 | DENV | NS4B | EU482516 |
| DENV | NS4B | EU677176 | DENV | NS4B | FJ410192 | DENV | NS4B | EU482792 |
| DENV | NS4B | FJ639679 | DENV | NS4B | FJ182020 | DENV | NS4B | AF514889 |
| DENV | NS4B | FJ432742 | DENV | NS4B | DQ672561 | DENV | NS4B | EU482509 |
| DENV | NS4B | FJ639670 | DENV | NS4B | FJ024481 | DENV | NS4B | FJ432737 |
| DENV | NS4B | FJ182027 | DENV | NS4B | EU677165 | DENV | NS4B | FJ547063 |
| DENV | NS4B | EU482718 | DENV | NS4B | FJ410287 | DENV | NS4B | FJ373297 |
| DENV | NS4B | EU677158 | DENV | NS4B | EU482502 | DENV | NS4B | EU677157 |
| DENV | NS4B | FJ639687 | DENV | NS4B | EU081274 | DENV | NS4B | EU482534 |
| DENV | NS4B | FJ461325 | DENV | NS4B | FJ024448 | DENV | NS4B | EU249491 |
| DENV | NS4B | FJ024444 | DENV | NS4B | FJ024425 | DENV | NS4B | DQ285562 |
| DENV | NS4B | EU482617 | DENV | NS4B | FJ639741 | DENV | NS4B | EU482793 |
| DENV | NS4B | FJ639678 | DENV | NS4B | FJ562104 | DENV | NS4B | EU482717 |
| DENV | NS4B | EU081269 | DENV | NS4B | DQ672563 | DENV | NS4B | FJ024439 |
| DENV | NS4B | EU482714 | DENV | NS4B | EU482708 | DENV | NS4B | EU482804 |
| DENV | NS4B | FJ024456 | DENV | NS4B | FJ410247 | DENV | NS4B | EU482503 |

FIG. 70-157

| Virus | Protein | Accession No. | Virus | Protein | Accession No. | Virus | Protein | Accession No. |
|---|---|---|---|---|---|---|---|---|
| DENV | NS4B | EU677162 | DENV | NS4B | FJ882563 | DENV | NS4B | FJ882550 |
| DENV | NS4B | FJ024485 | DENV | NS4B | GQ199812 | DENV | NS4B | FJ744701 |
| DENV | NS4B | EU081271 | DENV | NS4B | FJ873810 | DENV | NS4B | FJ898391 |
| DENV | NS4B | FJ024426 | DENV | NS4B | FJ898397 | DENV | NS4B | FJ898417 |
| DENV | NS4B | EU482790 | DENV | NS4B | FJ898400 | DENV | NS4B | GQ199806 |
| DENV | NS4B | FJ410286 | DENV | NS4B | FJ687433 | DENV | NS4B | GQ199794 |
| DENV | NS4B | FJ639735 | DENV | NS4B | GQ199877 | DENV | NS4B | FJ898425 |
| DENV | NS4B | EU482494 | DENV | NS4B | GQ199788 | DENV | NS4B | FJ898393 |
| DENV | NS4B | FJ390374 | DENV | NS4B | GQ199823 | DENV | NS4B | GQ199799 |
| DENV | NS4B | EU482813 | DENV | NS4B | FJ898407 | DENV | NS4B | GQ199833 |
| DENV | NS4B | FJ461335 | DENV | NS4B | GQ199804 | DENV | NS4B | GQ199781 |
| DENV | NS4B | EU482803 | DENV | NS4B | FJ882533 | DENV | NS4B | GQ199797 |
| DENV | NS4B | EU482490 | DENV | NS4B | GQ199818 | DENV | NS4B | FJ882522 |
| DENV | NS4B | FJ024482 | DENV | NS4B | FJ882560 | DENV | NS4B | FJ906964 |
| DENV | NS4B | FJ410284 | DENV | NS4B | FJ898415 | DENV | NS4B | GQ199821 |
| DENV | NS4B | EU081280 | DENV | NS4B | FJ850113 | DENV | NS4B | GQ199847 |
| DENV | NS4B | EU677150 | DENV | NS4B | FJ898384 | DENV | NS4B | FJ882524 |
| DENV | NS4B | AY732481 | DENV | NS4B | FJ882538 | DENV | NS4B | FJ850077 |
| DENV | NS4B | FJ461324 | DENV | NS4B | FJ882521 | DENV | NS4B | FJ882552 |
| DENV | NS4B | FJ639796 | DENV | NS4B | GQ199811 | DENV | NS4B | GQ199778 |
| DENV | NS4B | EU482709 | DENV | NS4B | FJ850075 | DENV | NS4B | FJ882549 |
| DENV | NS4B | AF298808 | DENV | NS4B | GQ199848 | DENV | NS4B | GQ199816 |
| DENV | NS4B | FJ182018 | DENV | NS4B | FJ898378 | DENV | NS4B | GQ199824 |
| DENV | NS4B | DQ672558 | DENV | NS4B | FJ873814 | DENV | NS4B | FJ898398 |
| DENV | NS4B | EU482795 | DENV | NS4B | FJ898410 | DENV | NS4B | FJ859029 |
| DENV | NS4B | EU677164 | DENV | NS4B | FJ882528 | DENV | NS4B | FJ882515 |
| DENV | NS4B | FJ410277 | DENV | NS4B | FJ898382 | DENV | NS4B | GQ199820 |
| DENV | NS4B | FJ024464 | DENV | NS4B | FJ898404 | DENV | NS4B | GQ199867 |
| DENV | NS4B | FJ461332 | DENV | NS4B | FJ687426 | DENV | NS4B | FJ898448 |
| DENV | NS4B | EF122232 | DENV | NS4B | FJ898371 | DENV | NS4B | FJ882556 |
| DENV | NS4B | FJ432727 | DENV | NS4B | GQ199872 | DENV | NS4B | FJ882536 |
| DENV | NS4B | EU482823 | DENV | NS4B | GQ199855 | DENV | NS4B | GQ199796 |
| DENV | NS4B | EU482810 | DENV | NS4B | FJ882535 | DENV | NS4B | FJ882570 |
| DENV | NS4B | EU081245 | DENV | NS4B | NC_001477 | DENV | NS4B | FJ898376 |
| DENV | NS4B | EU081262 | DENV | NS4B | FJ898423 | DENV | NS4B | GQ199771 |
| DENV | NS4B | EU863650 | DENV | NS4B | FJ882565 | DENV | NS4B | FJ850069 |
| DENV | NS4B | AY732483 | DENV | NS4B | FJ882517 | DENV | NS4B | FJ850102 |
| DENV | NS4B | FJ410265 | DENV | NS4B | GQ199814 | DENV | NS4B | GQ199834 |
| DENV | NS4B | EU660412 | DENV | NS4B | FJ898395 | DENV | NS4B | FJ898388 |
| DENV | NS4B | EU677171 | DENV | NS4B | GQ199851 | DENV | NS4B | GQ199830 |
| DENV | NS4B | EU677140 | DENV | NS4B | GQ199837 | DENV | NS4B | GQ199839 |
| DENV | NS4B | FJ898428 | DENV | NS4B | FJ882558 | DENV | NS4B | GQ199777 |
| DENV | NS4B | FJ882569 | DENV | NS4B | FJ850084 | DENV | NS4B | FJ882579 |
| DENV | NS4B | GQ199776 | DENV | NS4B | FJ898374 | DENV | NS4B | FJ898429 |
| DENV | NS4B | GQ199853 | DENV | NS4B | FJ850104 | DENV | NS4B | FJ882541 |
| DENV | NS4B | GQ199803 | DENV | NS4B | GQ199815 | DENV | NS4B | FJ898402 |
| DENV | NS4B | FJ882554 | DENV | NS4B | GQ199843 | DENV | NS4B | GQ199808 |
| DENV | NS4B | FJ873809 | DENV | NS4B | GQ199826 | DENV | NS4B | GQ199786 |

FIG. 70-158

| Virus | Protein | Accession No. | Virus | Protein | Accession No. | Virus | Protein | Accession No. |
|---|---|---|---|---|---|---|---|---|
| DENV | NS4B | FJ882547 | DENV | NS4B | FJ744702 | DENV | NS4B | FJ898408 |
| DENV | NS4B | GQ199798 | DENV | NS4B | FJ898386 | DENV | NS4B | FJ810419 |
| DENV | NS4B | GQ199844 | DENV | NS4B | FJ882542 | DENV | NS4B | GQ199793 |
| DENV | NS4B | GQ199829 | DENV | NS4B | GQ199782 | DENV | NS4B | FJ882562 |
| DENV | NS4B | FJ882530 | DENV | NS4B | GQ199852 | DENV | NS4B | FJ898424 |
| DENV | NS4B | FJ898422 | DENV | NS4B | FJ898421 | DENV | NS4B | FJ898389 |
| DENV | NS4B | FJ810415 | DENV | NS4B | FJ687432 | DENV | NS4B | FJ898412 |
| DENV | NS4B | FJ898411 | DENV | NS4B | GQ199813 | DENV | NS4B | FJ882537 |
| DENV | NS4B | GQ199856 | DENV | NS4B | FJ882534 | DENV | NS4B | FJ898418 |
| DENV | NS4B | FJ850101 | DENV | NS4B | GQ199854 | DENV | NS4B | FJ898394 |
| DENV | NS4B | FJ850093 | DENV | NS4B | GQ199846 | DENV | NS4B | GQ199849 |
| DENV | NS4B | FJ882551 | DENV | NS4B | FJ882539 | DENV | NS4B | FJ882548 |
| DENV | NS4B | GQ199795 | DENV | NS4B | FJ898437 | DENV | NS4B | FJ906963 |
| DENV | NS4B | FJ850100 | DENV | NS4B | FJ898390 | DENV | NS4B | FJ906965 |
| DENV | NS4B | FJ898416 | DENV | NS4B | FJ898405 | DENV | NS4B | GQ199873 |
| DENV | NS4B | GQ199785 | DENV | NS4B | GQ199783 | DENV | NS4B | FJ850073 |
| DENV | NS4B | GQ199784 | DENV | NS4B | FJ882526 | DENV | NS4B | FJ850071 |
| DENV | NS4B | GQ199828 | DENV | NS4B | FJ461320 | DENV | NS4B | GQ199772 |
| DENV | NS4B | GQ199780 | DENV | NS4B | FJ898420 | DENV | NS4B | FJ898373 |
| DENV | NS4B | FJ850103 | DENV | NS4B | FJ687431 | DENV | NS4B | FJ687429 |
| DENV | NS4B | FJ882555 | DENV | NS4B | GQ199801 | DENV | NS4B | FJ898379 |
| DENV | NS4B | FJ882561 | DENV | NS4B | FJ906728 | DENV | NS4B | FJ882566 |
| DENV | NS4B | FJ687430 | DENV | NS4B | FJ882544 | DENV | NS4B | FJ898396 |
| DENV | NS4B | FJ898381 | DENV | NS4B | FJ882553 | DENV | NS4B | FJ882529 |
| DENV | NS4B | FJ882518 | DENV | NS4B | FJ882531 | DENV | NS4B | GQ199838 |
| DENV | NS4B | FJ898392 | DENV | NS4B | GQ199810 | DENV | NS4B | GQ199779 |
| DENV | NS4B | FJ898380 | DENV | NS4B | GQ199825 | DENV | NS4B | GQ199827 |
| DENV | NS4B | GQ199835 | DENV | NS4B | FJ882546 | DENV | NS4B | GQ199836 |
| DENV | NS4B | FJ898430 | DENV | NS4B | FJ882568 | DENV | NS4B | GQ199858 |
| DENV | NS4B | FJ850087 | DENV | NS4B | FJ898413 | DENV | NS4B | GQ199787 |
| DENV | NS4B | FJ898385 | DENV | NS4B | GQ199773 | DENV | NS4B | FJ850068 |
| DENV | NS4B | GQ199857 | DENV | NS4B | GQ199822 | DENV | NS4B | FJ882564 |
| DENV | NS4B | FJ898403 | DENV | NS4B | GQ199832 | DENV | NS4B | FJ898419 |
| DENV | NS4B | GQ199800 | DENV | NS4B | GQ199790 | DENV | NS4B | FJ898383 |
| DENV | NS4B | FJ882540 | DENV | NS4B | GQ199841 | DENV | NS4B | FJ461328 |
| DENV | NS4B | GQ199792 | DENV | NS4B | FJ882520 | DENV | NS4B | FJ882527 |
| DENV | NS4B | FJ882516 | DENV | NS4B | GQ199875 | DENV | NS4B | FJ898427 |
| DENV | NS4B | GQ199850 | DENV | NS4B | GQ199802 | DENV | NS4B | FJ882525 |
| DENV | NS4B | FJ898372 | DENV | NS4B | GQ199791 | DENV | NS4B | FJ882557 |
| DENV | NS4B | GQ199775 | DENV | NS4B | FJ898426 | DENV | NS4B | GQ199859 |
| DENV | NS4B | FJ882559 | DENV | NS4B | FJ898431 | DENV | NS4B | GQ199842 |
| DENV | NS4B | GQ199789 | DENV | NS4B | GQ199809 | DENV | NS4B | GQ199817 |
| DENV | NS4B | FJ850099 | DENV | NS4B | FJ898406 | DENV | NS4B | FJ898401 |
| DENV | NS4B | FJ850114 | DENV | NS4B | GQ199805 | DENV | NS4B | FJ882519 |
| DENV | NS4B | GQ199819 | DENV | NS4B | GQ199831 | DENV | NS4B | FJ850090 |
| DENV | NS4B | FJ882523 | DENV | NS4B | FJ850070 | DENV | NS4B | FJ898377 |
| DENV | NS4B | GQ199845 | DENV | NS4B | GQ199807 | DENV | NS4B | GQ199774 |
| DENV | NS4B | FJ850081 | DENV | NS4B | FJ882543 | DENV | NS4B | FJ898399 |

FIG. 70-159

| Virus | Protein | Accession No. | Virus | Protein | Accession No. | Virus | Protein | Accession No. |
|---|---|---|---|---|---|---|---|---|
| DENV | NS4B | GQ199840 | DENV | NS4B | GU131804 | DENV | NS4B | GU131745 |
| DENV | NS4B | FJ898433 | DENV | NS4B | GU131762 | DENV | NS4B | GQ868635 |
| DENV | NS4B | FJ882567 | DENV | NS4B | GU131827 | DENV | NS4B | GU056032 |
| DENV | NS4B | FJ898387 | DENV | NS4B | GU131837 | DENV | NS4B | GQ868610 |
| DENV | NS4B | FJ882532 | DENV | NS4B | GQ868630 | DENV | NS4B | GU131889 |
| DENV | NS4B | FJ898409 | DENV | NS4B | GU131767 | DENV | NS4B | GQ868499 |
| DENV | NS4B | FJ882545 | DENV | NS4B | GU131737 | DENV | NS4B | GU131756 |
| DENV | NS4B | FJ898375 | DENV | NS4B | GQ868500 | DENV | NS4B | GU131786 |
| DENV | NS4B | FJ898414 | DENV | NS4B | GU131722 | DENV | NS4B | GQ868565 |
| DENV | NS4B | CS477306 | DENV | NS4B | GQ868607 | DENV | NS4B | GU131709 |
| DENV | NS4B | A75711 | DENV | NS4B | GQ868517 | DENV | NS4B | GQ868569 |
| DENV | NS4B | GU131816 | DENV | NS4B | GU131727 | DENV | NS4B | GU131723 |
| DENV | NS4B | FJ469907 | DENV | NS4B | GU131715 | DENV | NS4B | GU131696 |
| DENV | NS4B | GU131814 | DENV | NS4B | FN429885 | DENV | NS4B | GQ868519 |
| DENV | NS4B | GU131725 | DENV | NS4B | GU131780 | DENV | NS4B | GU131838 |
| DENV | NS4B | GU131822 | DENV | NS4B | GU131750 | DENV | NS4B | GQ868520 |
| DENV | NS4B | GQ868633 | DENV | NS4B | GU131787 | DENV | NS4B | GU131791 |
| DENV | NS4B | GU131820 | DENV | NS4B | GU056031 | DENV | NS4B | GU131765 |
| DENV | NS4B | GU131679 | DENV | NS4B | GQ868602 | DENV | NS4B | GU131702 |
| DENV | NS4B | GQ868507 | DENV | NS4B | GU131711 | DENV | NS4B | GU131682 |
| DENV | NS4B | GU131789 | DENV | NS4B | GQ868567 | DENV | NS4B | GU131801 |
| DENV | NS4B | GU131710 | DENV | NS4B | GU131813 | DENV | NS4B | GQ868562 |
| DENV | NS4B | FN429887 | DENV | NS4B | FJ687428 | DENV | NS4B | GU131684 |
| DENV | NS4B | GU131720 | DENV | NS4B | GU131707 | DENV | NS4B | GU131744 |
| DENV | NS4B | GU131841 | DENV | NS4B | GU131689 | DENV | NS4B | GQ868534 |
| DENV | NS4B | GQ868564 | DENV | NS4B | GU131700 | DENV | NS4B | GU131687 |
| DENV | NS4B | AB519681 | DENV | NS4B | GU131798 | DENV | NS4B | GQ868529 |
| DENV | NS4B | GU131743 | DENV | NS4B | GU131713 | DENV | NS4B | GU131840 |
| DENV | NS4B | GQ868522 | DENV | NS4B | GU131829 | DENV | NS4B | GU131808 |
| DENV | NS4B | GU131739 | DENV | NS4B | GU131782 | DENV | NS4B | GU131922 |
| DENV | NS4B | GU131971 | DENV | NS4B | GU131698 | DENV | NS4B | GU131836 |
| DENV | NS4B | GU131834 | DENV | NS4B | GU131732 | DENV | NS4B | GQ868613 |
| DENV | NS4B | GQ868523 | DENV | NS4B | GU131772 | DENV | NS4B | GU131721 |
| DENV | NS4B | GU131982 | DENV | NS4B | GU131978 | DENV | NS4B | GU131730 |
| DENV | NS4B | GU131965 | DENV | NS4B | GU131958 | DENV | NS4B | GU131968 |
| DENV | NS4B | GU131760 | DENV | NS4B | GU131811 | DENV | NS4B | GU131832 |
| DENV | NS4B | GQ868535 | DENV | NS4B | GQ868506 | DENV | NS4B | GU131774 |
| DENV | NS4B | GU131962 | DENV | NS4B | GQ868525 | DENV | NS4B | GU131976 |
| DENV | NS4B | GU131891 | DENV | NS4B | GQ868538 | DENV | NS4B | GU131831 |
| DENV | NS4B | GQ868504 | DENV | NS4B | FJ469909 | DENV | NS4B | GQ868501 |
| DENV | NS4B | GU131783 | DENV | NS4B | GU131818 | DENV | NS4B | GQ868531 |
| DENV | NS4B | GU131680 | DENV | NS4B | GU131893 | DENV | NS4B | GU131957 |
| DENV | NS4B | GU131704 | DENV | NS4B | GQ868509 | DENV | NS4B | GU131980 |
| DENV | NS4B | GU131685 | DENV | NS4B | GU131706 | DENV | NS4B | GQ868609 |
| DENV | NS4B | GU131770 | DENV | NS4B | GU131777 | DENV | NS4B | GU131769 |
| DENV | NS4B | GU131795 | DENV | NS4B | GU131925 | DENV | NS4B | GQ868526 |
| DENV | NS4B | GU131961 | DENV | NS4B | GU131977 | DENV | NS4B | GQ868510 |
| DENV | NS4B | GU131733 | DENV | NS4B | GQ868611 | DENV | NS4B | FN429882 |

FIG. 70-160

| Virus | Protein | Accession No. | Virus | Protein | Accession No. | Virus | Protein | Accession No. |
|---|---|---|---|---|---|---|---|---|
| DENV | NS4B | GU131763 | DENV | NS4B | GU131747 | DENV | NS4B | GU131792 |
| DENV | NS4B | GQ868527 | DENV | NS4B | GU131748 | DENV | NS4B | GU131690 |
| DENV | NS4B | GU131708 | DENV | NS4B | FN429889 | DENV | NS4B | GQ868632 |
| DENV | NS4B | GU131766 | DENV | NS4B | GU131776 | DENV | NS4B | GU131781 |
| DENV | NS4B | FN429890 | DENV | NS4B | GU131755 | DENV | NS4B | GQ868537 |
| DENV | NS4B | GU131694 | DENV | NS4B | GU131810 | DENV | NS4B | GU131815 |
| DENV | NS4B | GQ868615 | DENV | NS4B | GU131701 | DENV | NS4B | GU056033 |
| DENV | NS4B | GU131688 | DENV | NS4B | GU131754 | DENV | NS4B | GU131812 |
| DENV | NS4B | FJ469908 | DENV | NS4B | GU131784 | DENV | NS4B | GU131833 |
| DENV | NS4B | GU131734 | DENV | NS4B | GU131807 | DENV | NS4B | GU131830 |
| DENV | NS4B | GQ868637 | DENV | NS4B | GU131842 | DENV | NS4B | GU131742 |
| DENV | NS4B | GU131888 | DENV | NS4B | GU131923 | DENV | NS4B | GQ868561 |
| DENV | NS4B | GQ868568 | DENV | NS4B | GU131809 | DENV | NS4B | GU131800 |
| DENV | NS4B | GU131790 | DENV | NS4B | GU131726 | DENV | NS4B | GU131738 |
| DENV | NS4B | GU131920 | DENV | NS4B | GU131970 | DENV | NS4B | GU131824 |
| DENV | NS4B | GQ868528 | DENV | NS4B | GU131751 | DENV | NS4B | GU131919 |
| DENV | NS4B | GQ868612 | DENV | NS4B | GU131828 | DENV | NS4B | GU131802 |
| DENV | NS4B | GU131794 | DENV | NS4B | GQ868524 | DENV | NS4B | GQ868503 |
| DENV | NS4B | GQ868606 | DENV | NS4B | GU131863 | DENV | NS4B | GU131839 |
| DENV | NS4B | GU131969 | DENV | NS4B | GU131892 | DENV | NS4B | GU131681 |
| DENV | NS4B | GQ868608 | DENV | NS4B | GU131823 | DENV | NS4B | GQ868505 |
| DENV | NS4B | GU131921 | DENV | NS4B | GU131821 | DENV | NS4B | FN429884 |
| DENV | NS4B | GQ868502 | DENV | NS4B | GU131983 | DENV | NS4B | GQ868536 |
| DENV | NS4B | GU131719 | DENV | NS4B | GQ868518 | DENV | NS4B | GU131825 |
| DENV | NS4B | GU131973 | DENV | NS4B | GU131764 | DENV | NS4B | FN429888 |
| DENV | NS4B | GU131967 | DENV | NS4B | GU056030 | DENV | NS4B | GU131778 |
| DENV | NS4B | GU131803 | DENV | NS4B | GU131979 | DENV | NS4B | GU131972 |
| DENV | NS4B | GU131736 | DENV | NS4B | GU131768 | DENV | NS4B | GU131817 |
| DENV | NS4B | GU131981 | DENV | NS4B | GU131699 | DENV | NS4B | GU131759 |
| DENV | NS4B | GU131964 | DENV | NS4B | FJ687427 | DENV | NS4B | GU131819 |
| DENV | NS4B | GU131771 | DENV | NS4B | GU131963 | DENV | NS4B | GU131757 |
| DENV | NS4B | GU131984 | DENV | NS4B | GU131793 | DENV | NS4B | GQ868533 |
| DENV | NS4B | GU131695 | DENV | NS4B | GQ868618 | DENV | NS4B | FN429883 |
| DENV | NS4B | GU131728 | DENV | NS4B | GU131799 | DENV | NS4B | GU131956 |
| DENV | NS4B | GQ868601 | DENV | NS4B | GU131724 | DENV | NS4B | GQ868563 |
| DENV | NS4B | FN429886 | DENV | NS4B | GU131740 | DENV | NS4B | GU131926 |
| DENV | NS4B | GU131826 | DENV | NS4B | GU131806 | DENV | NS4B | GU131887 |
| DENV | NS4B | GQ868512 | DENV | NS4B | GQ868614 | DENV | NS4B | GU131741 |
| DENV | NS4B | GU131718 | DENV | NS4B | FN429881 | DENV | NS4B | GU131761 |
| DENV | NS4B | GQ868513 | DENV | NS4B | GQ868636 | DENV | NS4B | GU131693 |
| DENV | NS4B | GU131731 | DENV | NS4B | GU131746 | DENV | NS4B | GU131753 |
| DENV | NS4B | GU131686 | DENV | NS4B | GQ868560 | DENV | NS4B | GU131948 |
| DENV | NS4B | GU131894 | DENV | NS4B | GQ868508 | DENV | NS4B | GQ868559 |
| DENV | NS4B | GU131895 | DENV | NS4B | GQ868570 | DENV | NS4B | GQ868530 |
| DENV | NS4B | GU131678 | DENV | NS4B | GU131788 | DENV | NS4B | GU131797 |
| DENV | NS4B | GQ868619 | DENV | NS4B | GU131949 | DENV | NS4B | GU131785 |
| DENV | NS4B | GU131729 | DENV | NS4B | GU131796 | DENV | NS4B | GU131758 |
| DENV | NS4B | GQ868539 | DENV | NS4B | GU056029 | DENV | NS4B | GU131697 |

FIG. 70-161

| Virus | Protein | Accession No. | Virus | Protein | Accession No. | Virus | Protein | Accession No. |
|---|---|---|---|---|---|---|---|---|
| DENV | NS4B | GU131835 | DENV | NS4B | EU854296 | DENV | NS4B | GQ199883 |
| DENV | NS4B | GU131716 | DENV | NS4B | EU854300 | DENV | NS4B | FJ882586 |
| DENV | NS4B | GQ868498 | DENV | NS4B | AY858050 | DENV | NS4B | GQ252675 |
| DENV | NS4B | GU131683 | DENV | NS4B | AF375822 | DENV | NS4B | FJ882581 |
| DENV | NS4B | GU131960 | DENV | NS4B | EU854295 | DENV | NS4B | GQ199881 |
| DENV | NS4B | GU131714 | DENV | NS4B | M14931 | DENV | NS4B | GQ199878 |
| DENV | NS4B | GU131779 | DENV | NS4B | AY618992 | DENV | NS4B | FJ882596 |
| DENV | NS4B | GU131773 | DENV | NS4B | EU854297 | DENV | NS4B | FJ882583 |
| DENV | NS4B | GQ868605 | DENV | NS4B | FJ639738 | DENV | NS4B | FJ882600 |
| DENV | NS4B | GQ868511 | DENV | NS4B | AY618993 | DENV | NS4B | FJ850057 |
| DENV | NS4B | GU131752 | DENV | NS4B | FJ639764 | DENV | NS4B | GQ199879 |
| DENV | NS4B | GU131691 | DENV | NS4B | FJ639737 | DENV | NS4B | FJ882585 |
| DENV | NS4B | GU131692 | DENV | NS4B | AY776330 | DENV | NS4B | GQ199876 |
| DENV | NS4B | GU131705 | DENV | NS4B | AY618991 | DENV | NS4B | GQ199885 |
| DENV | NS4B | GQ868639 | DENV | NS4B | FJ639736 | DENV | NS4B | FJ882592 |
| DENV | NS4B | GU131805 | DENV | NS4B | FJ639739 | DENV | NS4B | GQ199882 |
| DENV | NS4B | GU131735 | DENV | NS4B | AF326826 | DENV | NS4B | FJ882591 |
| DENV | NS4B | GU131966 | DENV | NS4B | AY947539 | DENV | NS4B | FJ882589 |
| DENV | NS4B | GU131890 | DENV | NS4B | EU854299 | DENV | NS4B | GQ868642 |
| DENV | NS4B | GQ868566 | DENV | NS4B | AY618990 | DENV | NS4B | GQ868581 |
| DENV | NS4B | GU131775 | DENV | NS4B | FJ639748 | DENV | NS4B | FN429919 |
| DENV | NS4B | GU131749 | DENV | NS4B | FJ639744 | DENV | NS4B | GQ868583 |
| DENV | NS4B | GQ868521 | DENV | NS4B | EU854301 | DENV | NS4B | FN429920 |
| DENV | NS4B | GU131703 | DENV | NS4B | FJ639773 | DENV | NS4B | FN429923 |
| DENV | NS4B | GU131717 | DENV | NS4B | FJ182016 | DENV | NS4B | GQ868585 |
| DENV | NS4B | GU131712 | DENV | NS4B | AF326573 | DENV | NS4B | GQ868579 |
| DENV | NS4B | GQ868532 | DENV | NS4B | FJ182017 | DENV | NS4B | GQ868644 |
| DENV | NS4B | GQ868514 | DENV | NS4B | FJ024476 | DENV | NS4B | FN429925 |
| DENV | NS4B | FJ410220 | DENV | NS4B | EF457906 | DENV | NS4B | GU289913 |
| DENV | NS4B | CS477302 | DENV | NS4B | FJ639742 | DENV | NS4B | GQ868580 |
| DENV | NS4B | CS477304 | DENV | NS4B | AF289029 | DENV | NS4B | FN429922 |
| DENV | NS4B | CS477264 | DENV | NS4B | GQ199880 | DENV | NS4B | GQ868645 |
| DENV | NS4B | CS477305 | DENV | NS4B | FJ882597 | DENV | NS4B | GQ868594 |
| DENV | NS4B | CS477263 | DENV | NS4B | NC_002640 | DENV | NS4B | FN429924 |
| DENV | NS4B | CS477265 | DENV | NS4B | FJ882587 | DENV | NS4B | FJ882590 |
| DENV | NS4B | M87512 | DENV | NS4B | FJ882595 | DENV | NS4B | GQ868582 |
| DENV | NS4B | FB730116 | DENV | NS4B | FJ882582 | DENV | NS4B | GQ868584 |
| DENV | NS4B | GM059691 | DENV | NS4B | FJ810417 | DENV | NS4B | FN429926 |
| DENV | NS4B | U88536 | DENV | NS4B | FJ850095 | DENV | NS4B | FN429921 |
| DENV | NS4B | GU370048 | DENV | NS4B | FJ882599 | DENV | NS4B | GQ868643 |
| DENV | NS4B | GU370049 | DENV | NS4B | FJ882580 | DENV | NS4B | AF326825 |
| DENV | NS4B | AY762085 | DENV | NS4B | GQ199884 | DENV | NS4B | AY376438 |
| DENV | NS4B | FJ024424 | DENV | NS4B | FJ882588 | DENV | NS4B | AY648301 |
| DENV | NS4B | FJ226067 | DENV | NS4B | FJ882598 | DENV | NS4B | AY099336 |
| DENV | NS4B | FJ639745 | DENV | NS4B | FJ882601 | DENV | NS4B | GU363549 |
| DENV | NS4B | AY618989 | DENV | NS4B | FJ850058 | DENV | NS4B | GU370052 |
| DENV | NS4B | AF326827 | DENV | NS4B | FJ882584 | DENV | NS4B | GU370053 |
| DENV | NS4B | AY618988 | DENV | NS4B | FJ850059 | DENV | NS4B | EU081191 |

FIG. 70-162

| Virus | Protein | Accession No. | Virus | Protein | Accession No. | Virus | Protein | Accession No. |
|---|---|---|---|---|---|---|---|---|
| DENV | NS4B | DQ401690 | DENV | NS4B | EU482455 | DENV | NS4B | AY923865 |
| DENV | NS4B | EU529683 | DENV | NS4B | AY744680 | DENV | NS4B | EU081188 |
| DENV | NS4B | AY679147 | DENV | NS4B | FJ182015 | DENV | NS4B | FJ461337 |
| DENV | NS4B | AY676348 | DENV | NS4B | FJ562103 | DENV | NS4B | EU081224 |
| DENV | NS4B | EF629368 | DENV | NS4B | FJ639792 | DENV | NS4B | EU081207 |
| DENV | NS4B | FJ639752 | DENV | NS4B | DQ675527 | DENV | NS4B | FJ639750 |
| DENV | NS4B | FJ639807 | DENV | NS4B | FJ547066 | DENV | NS4B | AB189128 |
| DENV | NS4B | EU529684 | DENV | NS4B | EU529698 | DENV | NS4B | AY676353 |
| DENV | NS4B | FJ373304 | DENV | NS4B | EU726769 | DENV | NS4B | EU081209 |
| DENV | NS4B | FJ639723 | DENV | NS4B | AY676349 | DENV | NS4B | FJ639772 |
| DENV | NS4B | EU569691 | DENV | NS4B | EU529688 | DENV | NS4B | FJ182040 |
| DENV | NS4B | DQ675524 | DENV | NS4B | EU482558 | DENV | NS4B | AY648961 |
| DENV | NS4B | EU081203 | DENV | NS4B | FJ547070 | DENV | NS4B | FJ410178 |
| DENV | NS4B | EU482564 | DENV | NS4B | EU687198 | DENV | NS4B | EU529699 |
| DENV | NS4B | FJ182039 | DENV | NS4B | FJ639817 | DENV | NS4B | EU081199 |
| DENV | NS4B | EU482453 | DENV | NS4B | EU081202 | DENV | NS4B | FJ639786 |
| DENV | NS4B | FJ639779 | DENV | NS4B | EU081225 | DENV | NS4B | FJ639768 |
| DENV | NS4B | EU081183 | DENV | NS4B | DQ675520 | DENV | NS4B | FJ639731 |
| DENV | NS4B | EU529690 | DENV | NS4B | EU854298 | DENV | NS4B | FJ390373 |
| DENV | NS4B | FJ182011 | DENV | NS4B | FJ205870 | DENV | NS4B | FJ639800 |
| DENV | NS4B | EU081187 | DENV | NS4B | FJ639793 | DENV | NS4B | FJ547079 |
| DENV | NS4B | EU482461 | DENV | NS4B | DQ675532 | DENV | NS4B | FJ547072 |
| DENV | NS4B | FJ639803 | DENV | NS4B | FJ024470 | DENV | NS4B | EU081219 |
| DENV | NS4B | AY858047 | DENV | NS4B | EU081210 | DENV | NS4B | EU596493 |
| DENV | NS4B | FJ639774 | DENV | NS4B | EU687226 | DENV | NS4B | EU081192 |
| DENV | NS4B | FJ639726 | DENV | NS4B | FJ639715 | DENV | NS4B | FJ432731 |
| DENV | NS4B | AY858037 | DENV | NS4B | AY676352 | DENV | NS4B | AB189126 |
| DENV | NS4B | EU081215 | DENV | NS4B | AY858043 | DENV | NS4B | FJ024471 |
| DENV | NS4B | FJ639785 | DENV | NS4B | EU081196 | DENV | NS4B | FJ639769 |
| DENV | NS4B | FJ639761 | DENV | NS4B | FJ432741 | DENV | NS4B | FJ547078 |
| DENV | NS4B | EU569688 | DENV | NS4B | EU726773 | DENV | NS4B | FJ547080 |
| DENV | NS4B | DQ675533 | DENV | NS4B | EU482555 | DENV | NS4B | AY744679 |
| DENV | NS4B | FJ410177 | DENV | NS4B | DQ401694 | DENV | NS4B | EU081217 |
| DENV | NS4B | FJ478456 | DENV | NS4B | EU081216 | DENV | NS4B | AY858045 |
| DENV | NS4B | EU081195 | DENV | NS4B | EU529704 | DENV | NS4B | FJ547084 |
| DENV | NS4B | EU081221 | DENV | NS4B | FJ639777 | DENV | NS4B | DQ675521 |
| DENV | NS4B | EU529689 | DENV | NS4B | FJ639730 | DENV | NS4B | AY776329 |
| DENV | NS4B | EU660408 | DENV | NS4B | EU081190 | DENV | NS4B | FJ639789 |
| DENV | NS4B | EU687219 | DENV | NS4B | EU529703 | DENV | NS4B | AY496871 |
| DENV | NS4B | FJ639780 | DENV | NS4B | FJ639725 | DENV | NS4B | EU781136 |
| DENV | NS4B | EU687196 | DENV | NS4B | EU081205 | DENV | NS4B | FJ182013 |
| DENV | NS4B | EF643017 | DENV | NS4B | AY876494 | DENV | NS4B | EU596492 |
| DENV | NS4B | FJ373303 | DENV | NS4B | FJ639747 | DENV | NS4B | EU726774 |
| DENV | NS4B | FJ639729 | DENV | NS4B | FJ373302 | DENV | NS4B | EU081198 |
| DENV | NS4B | FJ639775 | DENV | NS4B | FJ639778 | DENV | NS4B | FJ639728 |
| DENV | NS4B | FJ461322 | DENV | NS4B | DQ401692 | DENV | NS4B | DQ675530 |
| DENV | NS4B | FJ390371 | DENV | NS4B | FJ182038 | DENV | NS4B | EU660409 |
| DENV | NS4B | AY858046 | DENV | NS4B | EU081220 | DENV | NS4B | EU081206 |

FIG. 70-163

| Virus | Protein | Accession No. | Virus | Protein | Accession No. | Virus | Protein | Accession No. |
|---|---|---|---|---|---|---|---|---|
| DENV | NS4B | EU081222 | DENV | NS4B | DQ675531 | DENV | NS4B | EU482596 |
| DENV | NS4B | EU660407 | DENV | NS4B | FJ461326 | DENV | NS4B | EU081208 |
| DENV | NS4B | M93130 | DENV | NS4B | FJ373306 | DENV | NS4B | EU081201 |
| DENV | NS4B | EU529687 | DENV | NS4B | EU569689 | DENV | NS4B | FJ639757 |
| DENV | NS4B | DQ675523 | DENV | NS4B | AY858041 | DENV | NS4B | FJ639713 |
| DENV | NS4B | FJ432722 | DENV | NS4B | EU482566 | DENV | NS4B | AY744685 |
| DENV | NS4B | EU482559 | DENV | NS4B | EF629370 | DENV | NS4B | FJ182041 |
| DENV | NS4B | FJ639721 | DENV | NS4B | AY496877 | DENV | NS4B | FJ562099 |
| DENV | NS4B | AY744682 | DENV | NS4B | FJ562102 | DENV | NS4B | FJ562100 |
| DENV | NS4B | EU081184 | DENV | NS4B | EF629367 | DENV | NS4B | FJ547081 |
| DENV | NS4B | FJ639805 | DENV | NS4B | FJ547077 | DENV | NS4B | AY858044 |
| DENV | NS4B | FJ547074 | DENV | NS4B | FJ639770 | DENV | NS4B | FJ639714 |
| DENV | NS4B | EU529685 | DENV | NS4B | EU081182 | DENV | NS4B | EU529686 |
| DENV | NS4B | DQ401695 | DENV | NS4B | EU596494 | DENV | NS4B | FJ410229 |
| DENV | NS4B | FJ432743 | DENV | NS4B | FJ639749 | DENV | NS4B | FJ547073 |
| DENV | NS4B | EU854291 | DENV | NS4B | EU726771 | DENV | NS4B | FJ639791 |
| DENV | NS4B | FJ182008 | DENV | NS4B | FJ639746 | DENV | NS4B | EU529692 |
| DENV | NS4B | FJ547062 | DENV | NS4B | EU081214 | DENV | NS4B | FJ547082 |
| DENV | NS4B | FJ024467 | DENV | NS4B | AY858039 | DENV | NS4B | EU367962 |
| DENV | NS4B | EU687239 | DENV | NS4B | EU660411 | DENV | NS4B | FJ390375 |
| DENV | NS4B | FJ024468 | DENV | NS4B | EU482563 | DENV | NS4B | AY858040 |
| DENV | NS4B | AY496874 | DENV | NS4B | AY744678 | DENV | NS4B | FJ547069 |
| DENV | NS4B | FJ547061 | DENV | NS4B | FJ461334 | DENV | NS4B | FJ562107 |
| DENV | NS4B | FJ547076 | DENV | NS4B | EU660420 | DENV | NS4B | FJ461338 |
| DENV | NS4B | FJ639767 | DENV | NS4B | FJ024466 | DENV | NS4B | FJ639722 |
| DENV | NS4B | AB189125 | DENV | NS4B | FJ639795 | DENV | NS4B | FJ639782 |
| DENV | NS4B | AF317645 | DENV | NS4B | FJ024465 | DENV | NS4B | AY858042 |
| DENV | NS4B | AB189127 | DENV | NS4B | EU726768 | DENV | NS4B | EU081185 |
| DENV | NS4B | EU781137 | DENV | NS4B | FJ639720 | DENV | NS4B | FJ390377 |
| DENV | NS4B | DQ675522 | DENV | NS4B | EU529696 | DENV | NS4B | FJ639763 |
| DENV | NS4B | EU482614 | DENV | NS4B | FJ639810 | DENV | NS4B | FJ639760 |
| DENV | NS4B | AB214879 | DENV | NS4B | AY744681 | DENV | NS4B | FJ182009 |
| DENV | NS4B | FJ639765 | DENV | NS4B | FJ639724 | DENV | NS4B | EU529697 |
| DENV | NS4B | EU081211 | DENV | NS4B | EU482595 | DENV | NS4B | DQ675529 |
| DENV | NS4B | FJ639787 | DENV | NS4B | AY676351 | DENV | NS4B | FJ639727 |
| DENV | NS4B | FJ639784 | DENV | NS4B | DQ401689 | DENV | NS4B | FJ461329 |
| DENV | NS4B | EU569690 | DENV | NS4B | FJ182005 | DENV | NS4B | EU482457 |
| DENV | NS4B | EU081223 | DENV | NS4B | FJ547085 | DENV | NS4B | FJ639827 |
| DENV | NS4B | FJ639816 | DENV | NS4B | EU081193 | DENV | NS4B | EU687197 |
| DENV | NS4B | AY496873 | DENV | NS4B | FJ639751 | DENV | NS4B | FJ639801 |
| DENV | NS4B | FJ182010 | DENV | NS4B | DQ675525 | DENV | NS4B | FJ410176 |
| DENV | NS4B | AY099337 | DENV | NS4B | FJ639826 | DENV | NS4B | EU081218 |
| DENV | NS4B | AY496879 | DENV | NS4B | EU482458 | DENV | NS4B | AY744684 |
| DENV | NS4B | EU482462 | DENV | NS4B | EU081204 | DENV | NS4B | FJ390376 |
| DENV | NS4B | FJ639825 | DENV | NS4B | EU529691 | DENV | NS4B | FJ639781 |
| DENV | NS4B | AY766104 | DENV | NS4B | FJ639719 | DENV | NS4B | DQ675528 |
| DENV | NS4B | FJ182007 | DENV | NS4B | FJ182037 | DENV | NS4B | FJ639766 |
| DENV | NS4B | DQ401693 | DENV | NS4B | EU482612 | DENV | NS4B | EU687221 |

FIG. 70-164

| Virus | Protein | Accession No. | Virus | Protein | Accession No. | Virus | Protein | Accession No. |
|---|---|---|---|---|---|---|---|---|
| DENV | NS4B | EU081197 | DENV | NS4B | AY858038 | DENV | NS4B | FJ898457 |
| DENV | NS4B | FJ639755 | DENV | NS4B | EU482456 | DENV | NS4B | FJ744736 |
| DENV | NS4B | FJ639798 | DENV | NS4B | EU081200 | DENV | NS4B | FJ810416 |
| DENV | NS4B | FJ639758 | DENV | NS4B | FJ639756 | DENV | NS4B | FJ898474 |
| DENV | NS4B | EU687218 | DENV | NS4B | AY744677 | DENV | NS4B | FJ850094 |
| DENV | NS4B | EU081189 | DENV | NS4B | AY744683 | DENV | NS4B | FJ898470 |
| DENV | NS4B | FJ639759 | DENV | NS4B | FJ639753 | DENV | NS4B | FJ810413 |
| DENV | NS4B | EU081212 | DENV | NS4B | FJ639716 | DENV | NS4B | FJ744735 |
| DENV | NS4B | EU482460 | DENV | NS4B | EU081194 | DENV | NS4B | GQ199860 |
| DENV | NS4B | FJ547075 | DENV | NS4B | FJ639776 | DENV | NS4B | FJ898464 |
| DENV | NS4B | AY676350 | DENV | NS4B | FJ898469 | DENV | NS4B | FJ744729 |
| DENV | NS4B | EU854292 | DENV | NS4B | GQ252674 | DENV | NS4B | FJ898472 |
| DENV | NS4B | EU660410 | DENV | NS4B | FJ850055 | DENV | NS4B | GQ199862 |
| DENV | NS4B | FJ432728 | DENV | NS4B | FJ898475 | DENV | NS4B | FJ873812 |
| DENV | NS4B | FJ024469 | DENV | NS4B | FJ744739 | DENV | NS4B | FJ898441 |
| DENV | NS4B | AY858048 | DENV | NS4B | NC_001475 | DENV | NS4B | FJ850048 |
| DENV | NS4B | FJ639804 | DENV | NS4B | GQ199863 | DENV | NS4B | FJ850080 |
| DENV | NS4B | EU529705 | DENV | NS4B | FJ850089 | DENV | NS4B | FJ882577 |
| DENV | NS4B | EU482454 | DENV | NS4B | FJ898442 | DENV | NS4B | FJ850096 |
| DENV | NS4B | DQ401691 | DENV | NS4B | FJ898459 | DENV | NS4B | FJ898473 |
| DENV | NS4B | FJ639771 | DENV | NS4B | FJ850049 | DENV | NS4B | FJ882574 |
| DENV | NS4B | FJ639754 | DENV | NS4B | FJ744730 | DENV | NS4B | FJ898445 |
| DENV | NS4B | EU482459 | DENV | NS4B | FJ850097 | DENV | NS4B | GQ199888 |
| DENV | NS4B | FJ205871 | DENV | NS4B | FJ744728 | DENV | NS4B | FJ898443 |
| DENV | NS4B | EU081186 | DENV | NS4B | FJ898458 | DENV | NS4B | FJ744726 |
| DENV | NS4B | FJ547083 | DENV | NS4B | FJ744740 | DENV | NS4B | FJ898476 |
| DENV | NS4B | FJ639762 | DENV | NS4B | GQ199889 | DENV | NS4B | FJ898468 |
| DENV | NS4B | FJ547071 | DENV | NS4B | GQ199886 | DENV | NS4B | FJ744733 |
| DENV | NS4B | EU529702 | DENV | NS4B | FJ687448 | DENV | NS4B | GQ199871 |
| DENV | NS4B | EU687234 | DENV | NS4B | FJ744732 | DENV | NS4B | GQ199887 |
| DENV | NS4B | FJ182006 | DENV | NS4B | FJ898446 | DENV | NS4B | GQ199864 |
| DENV | NS4B | AY662691 | DENV | NS4B | GQ199861 | DENV | NS4B | FJ744737 |
| DENV | NS4B | EU081213 | DENV | NS4B | FJ898455 | DENV | NS4B | FJ898456 |
| DENV | NS4B | EU081181 | DENV | NS4B | FJ882573 | DENV | NS4B | FJ850083 |
| DENV | NS4B | FJ390372 | DENV | NS4B | FJ898463 | DENV | NS4B | FJ744731 |
| DENV | NS4B | EU482613 | DENV | NS4B | FJ898447 | DENV | NS4B | FJ850079 |
| DENV | NS4B | FJ639790 | DENV | NS4B | FJ882571 | DENV | NS4B | FJ744700 |
| DENV | NS4B | DQ675519 | DENV | NS4B | FJ898462 | DENV | NS4B | FJ882576 |
| DENV | NS4B | EU687233 | DENV | NS4B | GQ199870 | DENV | NS4B | GQ199891 |
| DENV | NS4B | EF629369 | DENV | NS4B | FJ898471 | DENV | NS4B | FJ850111 |
| DENV | NS4B | FJ182004 | DENV | NS4B | FJ882575 | DENV | NS4B | FJ850056 |
| DENV | NS4B | FJ639799 | DENV | NS4B | FJ744738 | DENV | NS4B | FJ744727 |
| DENV | NS4B | FJ562097 | DENV | NS4B | FJ898440 | DENV | NS4B | FJ873813 |
| DENV | NS4B | FJ639712 | DENV | NS4B | FJ898444 | DENV | NS4B | AY770511 |
| DENV | NS4B | EF629366 | DENV | NS4B | GQ199865 | DENV | NS4B | FJ850098 |
| DENV | NS4B | EU726772 | DENV | NS4B | GQ252678 | DENV | NS4B | FJ810414 |
| DENV | NS4B | DQ675526 | DENV | NS4B | FJ850110 | DENV | NS4B | FJ850109 |
| DENV | NS4B | EU482452 | DENV | NS4B | FJ744734 | DENV | NS4B | FJ850052 |

FIG. 70-165

| Virus | Protein | Accession No. | Virus | Protein | Accession No. | Virus | Protein | Accession No. |
|---|---|---|---|---|---|---|---|---|
| DENV | NS4B | FJ850086 | DENV | NS4B | FN429917 | DENV | NS4B | FN429909 |
| DENV | NS4B | FJ882572 | DENV | NS4B | FN429915 | DENV | NS4B | FN429911 |
| DENV | NS4B | FJ882578 | DENV | NS4B | GU131855 | DENV | NS4B | GU131945 |
| DENV | NS4B | FJ850092 | DENV | NS4B | FN429896 | DENV | NS4B | FN429916 |
| DENV | NS4B | AB214882 | DENV | NS4B | GU131844 | DENV | NS4B | FN429914 |
| DENV | NS4B | AB214880 | DENV | NS4B | GQ868573 | DENV | NS4B | GU131942 |
| DENV | NS4B | AB214881 | DENV | NS4B | GQ868586 | DENV | NS4B | GU131849 |
| DENV | NS4B | FB667400 | DENV | NS4B | GU131858 | DENV | NS4B | GU131952 |
| DENV | NS4B | GQ868587 | DENV | NS4B | FN429903 | DENV | NS4B | GU131915 |
| DENV | NS4B | EU932688 | DENV | NS4B | GU131874 | DENV | NS4B | GQ868578 |
| DENV | NS4B | FN429906 | DENV | NS4B | GU131914 | DENV | NS4B | GQ868548 |
| DENV | NS4B | GU131916 | DENV | NS4B | FN429912 | DENV | NS4B | GU131913 |
| DENV | NS4B | GU131953 | DENV | NS4B | FN429898 | DENV | NS4B | GU131940 |
| DENV | NS4B | GU131850 | DENV | NS4B | GU131851 | DENV | NS4B | FN429918 |
| DENV | NS4B | FN429900 | DENV | NS4B | GU131938 | DENV | NS4B | FN429905 |
| DENV | NS4B | GQ868576 | DENV | NS4B | GU131853 | DENV | NS4B | GU131907 |
| DENV | NS4B | GU131946 | DENV | NS4B | FN429907 | DENV | NS4B | GU131860 |
| DENV | NS4B | GU131866 | DENV | NS4B | GU131865 | DENV | NS4B | GU131954 |
| DENV | NS4B | GU131862 | DENV | NS4B | GU131906 | DENV | NS4B | GU131856 |
| DENV | NS4B | GU131852 | DENV | NS4B | GU131944 | DENV | NS4B | GU131847 |
| DENV | NS4B | FN429897 | DENV | NS4B | GU131936 | DENV | NS4B | GU131909 |
| DENV | NS4B | GQ868571 | DENV | NS4B | GU131903 | DENV | NS4B | GU131939 |
| DENV | NS4B | GQ868626 | DENV | NS4B | GU131908 | DENV | NS4B | GU131912 |
| DENV | NS4B | GQ868546 | DENV | NS4B | GU131878 | DENV | NS4B | GU131859 |
| DENV | NS4B | FN429904 | DENV | NS4B | GU131950 | DENV | NS4B | GU131857 |
| DENV | NS4B | GU131904 | DENV | NS4B | GQ868634 | DENV | NS4B | GQ868629 |
| DENV | NS4B | GU131935 | DENV | NS4B | GU131873 | DENV | NS4B | GU131905 |
| DENV | NS4B | GU131910 | DENV | NS4B | GQ868593 | DENV | NS4B | GU131848 |
| DENV | NS4B | GU131918 | DENV | NS4B | GQ868572 | DENV | NS4B | FB667402 |
| DENV | NS4B | GU131937 | DENV | NS4B | DQ863638 | DENV | NS4B | FB667403 |
| DENV | NS4B | GU131868 | DENV | NS4B | GU131876 | DENV | NS4B | FJ177308 |
| DENV | NS4B | GU131951 | DENV | NS4B | EU932687 | DENV | NS4B | FB667404 |
| DENV | NS4B | FN429910 | DENV | NS4B | GU189648 | DENV | NS4B | FB667398 |
| DENV | NS4B | GU131854 | DENV | NS4B | FN429913 | DENV | NS4B | FB667399 |
| DENV | NS4B | GU131943 | DENV | NS4B | GU131867 | DENV | NS4B | CS805345 |
| DENV | NS4B | GU131861 | DENV | NS4B | GQ868575 | DENV | NS4B | EU482634 |
| DENV | NS4B | GU131871 | DENV | NS4B | GQ868617 | DENV | NS4B | FJ373301 |
| DENV | NS4B | GU131933 | DENV | NS4B | GQ868616 | DENV | NS4B | EU482582 |
| DENV | NS4B | GU131877 | DENV | NS4B | GU131870 | DENV | NS4B | EU687227 |
| DENV | NS4B | GU131911 | DENV | NS4B | GU131869 | DENV | NS4B | EU569710 |
| DENV | NS4B | GQ868628 | DENV | NS4B | GU131846 | DENV | NS4B | EF105383 |
| DENV | NS4B | GQ868574 | DENV | NS4B | GU131934 | DENV | NS4B | EU687249 |
| DENV | NS4B | GU131941 | DENV | NS4B | GQ868627 | DENV | NS4B | EU687242 |
| DENV | NS4B | GQ868577 | DENV | NS4B | FN429908 | DENV | NS4B | EU482658 |
| DENV | NS4B | GQ868547 | DENV | NS4B | GU131872 | DENV | NS4B | FJ639710 |
| DENV | NS4B | GU131845 | DENV | NS4B | FN429901 | DENV | NS4B | EU482748 |
| DENV | NS4B | FN429899 | DENV | NS4B | GU131917 | DENV | NS4B | FJ205885 |
| DENV | NS4B | FN429902 | DENV | NS4B | GU131875 | DENV | NS4B | EU482470 |

FIG. 70-166

| Virus | Protein | Accession No. | Virus | Protein | Accession No. | Virus | Protein | Accession No. |
|---|---|---|---|---|---|---|---|---|
| DENV | NS4B | EU482468 | DENV | NS4B | EU482787 | DENV | NS4B | FJ205879 |
| DENV | NS4B | FJ410195 | DENV | NS4B | FM210216 | DENV | NS4B | EU569697 |
| DENV | NS4B | AB122021 | DENV | NS4B | EU569694 | DENV | NS4B | EU482691 |
| DENV | NS4B | EU482469 | DENV | NS4B | EU482648 | DENV | NS4B | FJ461309 |
| DENV | NS4B | FM210231 | DENV | NS4B | EU482620 | DENV | NS4B | EU482608 |
| DENV | NS4B | FJ639831 | DENV | NS4B | EU482471 | DENV | NS4B | EU726776 |
| DENV | NS4B | EU482657 | DENV | NS4B | EU482644 | DENV | NS4B | EU081177 |
| DENV | NS4B | EU482674 | DENV | NS4B | FJ639833 | DENV | NS4B | FM210213 |
| DENV | NS4B | EU482753 | DENV | NS4B | EU482445 | DENV | NS4B | EU854293 |
| DENV | NS4B | DQ645545 | DENV | NS4B | EU482606 | DENV | NS4B | EU482632 |
| DENV | NS4B | FJ639835 | DENV | NS4B | FM210236 | DENV | NS4B | FM210234 |
| DENV | NS4B | FJ432726 | DENV | NS4B | EU482639 | DENV | NS4B | EU482745 |
| DENV | NS4B | EU482607 | DENV | NS4B | EU003591 | DENV | NS4B | EU482593 |
| DENV | NS4B | EU482660 | DENV | NS4B | EU482547 | DENV | NS4B | EU569718 |
| DENV | NS4B | EU482766 | DENV | NS4B | FJ478459 | DENV | NS4B | EU482719 |
| DENV | NS4B | AB189124 | DENV | NS4B | FJ639837 | DENV | NS4B | EF051521 |
| DENV | NS4B | AF100461 | DENV | NS4B | FJ390387 | DENV | NS4B | FM210238 |
| DENV | NS4B | EU482600 | DENV | NS4B | DQ645547 | DENV | NS4B | FJ478455 |
| DENV | NS4B | EU687230 | DENV | NS4B | EU596496 | DENV | NS4B | AF100465 |
| DENV | NS4B | EU482633 | DENV | NS4B | EU482597 | DENV | NS4B | EU529694 |
| DENV | NS4B | EU482726 | DENV | NS4B | EU482463 | DENV | NS4B | EU081178 |
| DENV | NS4B | EU482557 | DENV | NS4B | EU482553 | DENV | NS4B | EU482676 |
| DENV | NS4B | EU482444 | DENV | NS4B | EU482548 | DENV | NS4B | FJ639709 |
| DENV | NS4B | FJ205877 | DENV | NS4B | EU482641 | DENV | NS4B | FM210208 |
| DENV | NS4B | EU482621 | DENV | NS4B | FJ639703 | DENV | NS4B | FJ410208 |
| DENV | NS4B | EU482736 | DENV | NS4B | EU482647 | DENV | NS4B | EU569716 |
| DENV | NS4B | EU596497 | DENV | NS4B | EU596487 | DENV | NS4B | EU482786 |
| DENV | NS4B | M84728 | DENV | NS4B | FJ639788 | DENV | NS4B | AF276619 |
| DENV | NS4B | EU482549 | DENV | NS4B | FM210206 | DENV | NS4B | EU482625 |
| DENV | NS4B | FM210228 | DENV | NS4B | DQ645556 | DENV | NS4B | EU687248 |
| DENV | NS4B | EU687216 | DENV | NS4B | AF169682 | DENV | NS4B | EU482662 |
| DENV | NS4B | EU596489 | DENV | NS4B | AY858035 | DENV | NS4B | EU569708 |
| DENV | NS4B | EU482576 | DENV | NS4B | EU687220 | DENV | NS4B | FM210240 |
| DENV | NS4B | AF100460 | DENV | NS4B | EU482636 | DENV | NS4B | EU482777 |
| DENV | NS4B | AF169679 | DENV | NS4B | EU482650 | DENV | NS4B | FJ639705 |
| DENV | NS4B | EU482665 | DENV | NS4B | EU482704 | DENV | NS4B | EU482669 |
| DENV | NS4B | EU482586 | DENV | NS4B | EU482661 | DENV | NS4B | DQ645553 |
| DENV | NS4B | AF169681 | DENV | NS4B | EU569699 | DENV | NS4B | FM210210 |
| DENV | NS4B | FM210205 | DENV | NS4B | EU482580 | DENV | NS4B | EF457904 |
| DENV | NS4B | EU482767 | DENV | NS4B | FM210215 | DENV | NS4B | FJ410237 |
| DENV | NS4B | EU687240 | DENV | NS4B | FJ639733 | DENV | NS4B | AY702035 |
| DENV | NS4B | AF169686 | DENV | NS4B | EF105389 | DENV | NS4B | EU482757 |
| DENV | NS4B | EU687244 | DENV | NS4B | EF105384 | DENV | NS4B | EU596499 |
| DENV | NS4B | EU482683 | DENV | NS4B | EU677146 | DENV | NS4B | EU482543 |
| DENV | NS4B | FJ373299 | DENV | NS4B | EU596498 | DENV | NS4B | EU687217 |
| DENV | NS4B | EU482601 | DENV | NS4B | FJ410288 | DENV | NS4B | EU482646 |
| DENV | NS4B | EU660404 | DENV | NS4B | FJ373300 | DENV | NS4B | EU482746 |
| DENV | NS4B | EU482651 | DENV | NS4B | EU482702 | DENV | NS4B | FJ410217 |

FIG. 70-167

| Virus | Protein | Accession No. | Virus | Protein | Accession No. | Virus | Protein | Accession No. |
|---|---|---|---|---|---|---|---|---|
| DENV | NS4B | FJ639707 | DENV | NS4B | EU482784 | DENV | NS4B | EU482578 |
| DENV | NS4B | EU482637 | DENV | NS4B | EU482584 | DENV | NS4B | EU482781 |
| DENV | NS4B | EU482699 | DENV | NS4B | EU482670 | DENV | NS4B | EU596485 |
| DENV | NS4B | EU482583 | DENV | NS4B | DQ181801 | DENV | NS4B | EU687224 |
| DENV | NS4B | FJ639717 | DENV | NS4B | EU482603 | DENV | NS4B | FJ461321 |
| DENV | NS4B | EU687223 | DENV | NS4B | EU482769 | DENV | NS4B | FJ390390 |
| DENV | NS4B | AY702036 | DENV | NS4B | FM210227 | DENV | NS4B | EU482562 |
| DENV | NS4B | EU482542 | DENV | NS4B | AY744147 | DENV | NS4B | EF105390 |
| DENV | NS4B | EU482587 | DENV | NS4B | EU482656 | DENV | NS4B | EU482782 |
| DENV | NS4B | EU482667 | DENV | NS4B | EU529706 | DENV | NS4B | EU482682 |
| DENV | NS4B | EU482695 | DENV | NS4B | EU687212 | DENV | NS4B | EU056810 |
| DENV | NS4B | EU569720 | DENV | NS4B | DQ645541 | DENV | NS4B | EU687236 |
| DENV | NS4B | AY702037 | DENV | NS4B | DQ181800 | DENV | NS4B | EU482448 |
| DENV | NS4B | AY858036 | DENV | NS4B | EU482721 | DENV | NS4B | FJ639698 |
| DENV | NS4B | DQ645544 | DENV | NS4B | EU677145 | DENV | NS4B | EU482630 |
| DENV | NS4B | FJ639822 | DENV | NS4B | EU482450 | DENV | NS4B | EU359009 |
| DENV | NS4B | AF100466 | DENV | NS4B | EU482541 | DENV | NS4B | EU482768 |
| DENV | NS4B | FJ410215 | DENV | NS4B | AF169688 | DENV | NS4B | EU482672 |
| DENV | NS4B | EU569705 | DENV | NS4B | M19197 | DENV | NS4B | EU569711 |
| DENV | NS4B | FM210241 | DENV | NS4B | EU482594 | DENV | NS4B | EU482627 |
| DENV | NS4B | FM210221 | DENV | NS4B | DQ645554 | DENV | NS4B | EU569715 |
| DENV | NS4B | EU687228 | DENV | NS4B | DQ181798 | DENV | NS4B | EU482678 |
| DENV | NS4B | EU482703 | DENV | NS4B | AY702038 | DENV | NS4B | DQ181799 |
| DENV | NS4B | EU529700 | DENV | NS4B | EU596495 | DENV | NS4B | EU687235 |
| DENV | NS4B | DQ645555 | DENV | NS4B | FM210245 | DENV | NS4B | EU687238 |
| DENV | NS4B | EU687231 | DENV | NS4B | FM210214 | DENV | NS4B | M84727 |
| DENV | NS4B | EU660406 | DENV | NS4B | EU482685 | DENV | NS4B | EU482763 |
| DENV | NS4B | EU687241 | DENV | NS4B | EU482570 | DENV | NS4B | EU482758 |
| DENV | NS4B | FJ639700 | DENV | NS4B | DQ645540 | DENV | NS4B | FJ639830 |
| DENV | NS4B | FJ639711 | DENV | NS4B | EU660414 | DENV | NS4B | EU482754 |
| DENV | NS4B | U87412 | DENV | NS4B | FJ024477 | DENV | NS4B | FM210218 |
| DENV | NS4B | EU482599 | DENV | NS4B | AF100463 | DENV | NS4B | FJ410224 |
| DENV | NS4B | EU482654 | DENV | NS4B | DQ645546 | DENV | NS4B | FJ410193 |
| DENV | NS4B | EU569721 | DENV | NS4B | EU569703 | DENV | NS4B | EU056811 |
| DENV | NS4B | FJ390385 | DENV | NS4B | EU482652 | DENV | NS4B | EU482774 |
| DENV | NS4B | EU482589 | DENV | NS4B | EU596490 | DENV | NS4B | EU482568 |
| DENV | NS4B | EU482551 | DENV | NS4B | EU482693 | DENV | NS4B | EU482588 |
| DENV | NS4B | EU660400 | DENV | NS4B | EU482734 | DENV | NS4B | EU482475 |
| DENV | NS4B | EU482679 | DENV | NS4B | FM210202 | DENV | NS4B | AF489932 |
| DENV | NS4B | AF204177 | DENV | NS4B | EU482729 | DENV | NS4B | FM210211 |
| DENV | NS4B | FJ461311 | DENV | NS4B | AF169680 | DENV | NS4B | EU687246 |
| DENV | NS4B | EU569700 | DENV | NS4B | EU482623 | DENV | NS4B | FJ390389 |
| DENV | NS4B | EU482737 | DENV | NS4B | EU569693 | DENV | NS4B | EU482464 |
| DENV | NS4B | EU482573 | DENV | NS4B | EU482590 | DENV | NS4B | EU482697 |
| DENV | NS4B | AY702040 | DENV | NS4B | FJ639834 | DENV | NS4B | EU482765 |
| DENV | NS4B | DQ181803 | DENV | NS4B | EU482449 | DENV | NS4B | FM210209 |
| DENV | NS4B | EU482741 | DENV | NS4B | EU687237 | DENV | NS4B | EU482474 |
| DENV | NS4B | EU660399 | DENV | NS4B | EF105381 | DENV | NS4B | EU596484 |

FIG. 70-168

| Virus | Protein | Accession No. | Virus | Protein | Accession No. | Virus | Protein | Accession No. |
|---|---|---|---|---|---|---|---|---|
| DENV | NS4B | EU677138 | DENV | NS4B | EU482742 | DENV | NS4B | FJ410200 |
| DENV | NS4B | EU621672 | DENV | NS4B | FJ461314 | DENV | NS4B | DQ645552 |
| DENV | NS4B | AF359579 | DENV | NS4B | EU482688 | DENV | NS4B | EU482574 |
| DENV | NS4B | EU482645 | DENV | NS4B | DQ181802 | DENV | NS4B | EU482622 |
| DENV | NS4B | EU482760 | DENV | NS4B | FJ639809 | DENV | NS4B | EU482561 |
| DENV | NS4B | FJ639732 | DENV | NS4B | EU482701 | DENV | NS4B | EU596486 |
| DENV | NS4B | FM210229 | DENV | NS4B | AF204178 | DENV | NS4B | EU569695 |
| DENV | NS4B | EU482684 | DENV | NS4B | FJ639706 | DENV | NS4B | FJ024461 |
| DENV | NS4B | EF105378 | DENV | NS4B | EU482550 | DENV | NS4B | EU569713 |
| DENV | NS4B | EU482681 | DENV | NS4B | EU482605 | DENV | NS4B | FM210224 |
| DENV | NS4B | FJ547090 | DENV | NS4B | EU482554 | DENV | NS4B | EU482556 |
| DENV | NS4B | EU482447 | DENV | NS4B | EU482692 | DENV | NS4B | EU482731 |
| DENV | NS4B | EU482624 | DENV | NS4B | EU482680 | DENV | NS4B | EU179858 |
| DENV | NS4B | AF119661 | DENV | NS4B | AF169683 | DENV | NS4B | EU781135 |
| DENV | NS4B | EU660413 | DENV | NS4B | FJ024458 | DENV | NS4B | EU482743 |
| DENV | NS4B | AF169685 | DENV | NS4B | EU482780 | DENV | NS4B | EU482751 |
| DENV | NS4B | EU482771 | DENV | NS4B | EU482750 | DENV | NS4B | FJ410259 |
| DENV | NS4B | EU482604 | DENV | NS4B | EU179857 | DENV | NS4B | EU482747 |
| DENV | NS4B | FJ410223 | DENV | NS4B | EU569698 | DENV | NS4B | EU687225 |
| DENV | NS4B | EU482739 | DENV | NS4B | EU482571 | DENV | NS4B | FJ639718 |
| DENV | NS4B | EU687243 | DENV | NS4B | EU081179 | DENV | NS4B | EU569707 |
| DENV | NS4B | EU482720 | DENV | NS4B | EU482690 | DENV | NS4B | EU677147 |
| DENV | NS4B | EU482730 | DENV | NS4B | EU687215 | DENV | NS4B | FM210223 |
| DENV | NS4B | EU482779 | DENV | NS4B | EU482664 | DENV | NS4B | EU081180 |
| DENV | NS4B | AB122020 | DENV | NS4B | DQ181797 | DENV | NS4B | EU482728 |
| DENV | NS4B | FM210244 | DENV | NS4B | EU569701 | DENV | NS4B | EU596500 |
| DENV | NS4B | AF100469 | DENV | NS4B | EU482773 | DENV | NS4B | EU482671 |
| DENV | NS4B | FJ410221 | DENV | NS4B | EU482722 | DENV | NS4B | EU179859 |
| DENV | NS4B | EU482626 | DENV | NS4B | EU482635 | DENV | NS4B | EU482705 |
| DENV | NS4B | EU482788 | DENV | NS4B | DQ645549 | DENV | NS4B | EU482552 |
| DENV | NS4B | FJ410219 | DENV | NS4B | EU482629 | DENV | NS4B | EU482546 |
| DENV | NS4B | AF100462 | DENV | NS4B | EU596488 | DENV | NS4B | EU482642 |
| DENV | NS4B | EU482696 | DENV | NS4B | FJ639836 | DENV | NS4B | EU482579 |
| DENV | NS4B | EU482544 | DENV | NS4B | EU482733 | DENV | NS4B | M20558 |
| DENV | NS4B | EU482640 | DENV | NS4B | EU677143 | DENV | NS4B | EU482775 |
| DENV | NS4B | FJ182012 | DENV | NS4B | EU482653 | DENV | NS4B | EU596491 |
| DENV | NS4B | DQ645548 | DENV | NS4B | AF208496 | DENV | NS4B | FJ639708 |
| DENV | NS4B | FJ639701 | DENV | NS4B | EU482565 | DENV | NS4B | FM210220 |
| DENV | NS4B | EU482655 | DENV | NS4B | EU482598 | DENV | NS4B | EU569717 |
| DENV | NS4B | AB189122 | DENV | NS4B | M29095 | DENV | NS4B | EF105379 |
| DENV | NS4B | DQ181804 | DENV | NS4B | EU660415 | DENV | NS4B | EU569712 |
| DENV | NS4B | EU482732 | DENV | NS4B | FM210239 | DENV | NS4B | EU482755 |
| DENV | NS4B | DQ645543 | DENV | NS4B | EU687213 | DENV | NS4B | DQ181805 |
| DENV | NS4B | FJ639832 | DENV | NS4B | EU677144 | DENV | NS4B | FM210207 |
| DENV | NS4B | FJ226066 | DENV | NS4B | FM210243 | DENV | NS4B | FM210233 |
| DENV | NS4B | AF169687 | DENV | NS4B | AF100459 | DENV | NS4B | EU687199 |
| DENV | NS4B | EU482752 | DENV | NS4B | EU482466 | DENV | NS4B | EU482686 |
| DENV | NS4B | EU482783 | DENV | NS4B | FM210230 | DENV | NS4B | FJ205880 |

FIG. 70-169

| Virus | Protein | Accession No. | Virus | Protein | Accession No. | Virus | Protein | Accession No. |
|---|---|---|---|---|---|---|---|---|
| DENV | NS4B | AY776328 | DENV | NS4B | EF105380 | DENV | NS4B | EU687250 |
| DENV | NS4B | EU482675 | DENV | NS4B | EU482677 | DENV | NS4B | EU482735 |
| DENV | NS4B | EU660417 | DENV | NS4B | AF100468 | DENV | NS4B | EU482785 |
| DENV | NS4B | EU482727 | DENV | NS4B | EU482569 | DENV | NS4B | EU596483 |
| DENV | NS4B | EU482602 | DENV | NS4B | DQ645542 | DENV | NS4B | EU569702 |
| DENV | NS4B | EU482577 | DENV | NS4B | EU482643 | DENV | NS4B | FJ410241 |
| DENV | NS4B | EU482756 | DENV | NS4B | EU482694 | DENV | NS4B | EU482659 |
| DENV | NS4B | EU529701 | DENV | NS4B | EU482724 | DENV | NS4B | FM210203 |
| DENV | NS4B | FJ639702 | DENV | NS4B | EU482446 | DENV | NS4B | EU482581 |
| DENV | NS4B | EU482772 | DENV | NS4B | FM210226 | DENV | NS4B | EU569696 |
| DENV | NS4B | FM210246 | DENV | NS4B | EU482744 | DENV | NS4B | FJ562098 |
| DENV | NS4B | FJ390391 | DENV | NS4B | EU677137 | DENV | NS4B | FM210222 |
| DENV | NS4B | AF100464 | DENV | NS4B | EU482770 | DENV | NS4B | EU482473 |
| DENV | NS4B | FJ547067 | DENV | NS4B | AF038403 | DENV | NS4B | EU854294 |
| DENV | NS4B | EF105386 | DENV | NS4B | EU660398 | DENV | NS4B | EU482649 |
| DENV | NS4B | EF105387 | DENV | NS4B | EU569709 | DENV | NS4B | EU726767 |
| DENV | NS4B | EU726775 | DENV | NS4B | FM210237 | DENV | NS4B | FJ024454 |
| DENV | NS4B | FJ639704 | DENV | NS4B | EU660416 | DENV | NS4B | FJ639699 |
| DENV | NS4B | AF169678 | DENV | NS4B | EU677142 | DENV | NS4B | FM210204 |
| DENV | NS4B | EU482749 | DENV | NS4B | EU482700 | DENV | NS4B | EU529695 |
| DENV | NS4B | EU482631 | DENV | NS4B | EU482545 | DENV | NS4B | EU687222 |
| DENV | NS4B | EF105388 | DENV | NS4B | EU482585 | DENV | NS4B | EF105382 |
| DENV | NS4B | AB189123 | DENV | NS4B | FJ024475 | DENV | NS4B | EU482738 |
| DENV | NS4B | EU482663 | DENV | NS4B | EU482725 | DENV | NS4B | EF105385 |
| DENV | NS4B | EU677149 | DENV | NS4B | EU482687 | DENV | NS4B | FM210219 |
| DENV | NS4B | EU569719 | DENV | NS4B | EU529693 | DENV | NS4B | EU482723 |
| DENV | NS4B | EU482778 | DENV | NS4B | FJ390384 | DENV | NS4B | FJ639829 |
| DENV | NS4B | DQ645551 | DENV | NS4B | EU482560 | DENV | NS4B | EU482575 |
| DENV | NS4B | EU482689 | DENV | NS4B | EU482761 | DENV | NS4B | AF038402 |
| DENV | NS4B | EU726770 | DENV | NS4B | EU482638 | DENV | NS4B | FJ639783 |
| DENV | NS4B | AB122022 | DENV | NS4B | EU482698 | DENV | NS4B | EU482572 |
| DENV | NS4B | FJ639697 | DENV | NS4B | EU482764 | DENV | NS4B | FJ639734 |
| DENV | NS4B | EU482628 | DENV | NS4B | FJ182014 | DENV | NS4B | EU482762 |
| DENV | NS4B | EU687232 | DENV | NS4B | EU482776 | DENV | NS4B | EU569704 |
| DENV | NS4B | FM210225 | DENV | NS4B | DQ645550 | DENV | NS4B | EU482759 |
| DENV | NS4B | AY037116 | DENV | NS4B | FJ024473 | DENV | NS4B | EU056812 |
| DENV | NS4B | FJ205878 | DENV | NS4B | DQ181806 | DENV | NS4B | FJ410228 |
| DENV | NS4B | AY702034 | DENV | NS4B | FJ461305 | DENV | NS4B | EU482467 |
| DENV | NS4B | FM210232 | DENV | NS4B | FJ024452 | DENV | NS4B | FM210217 |
| DENV | NS4B | AY702039 | DENV | NS4B | EU677141 | DENV | NS4B | FM210212 |
| DENV | NS4B | EU687245 | DENV | NS4B | FJ639828 | DENV | NS4B | EU660405 |
| DENV | NS4B | EU482465 | DENV | NS4B | EU569706 | DENV | NS4B | FJ547064 |
| DENV | NS4B | EU482472 | DENV | NS4B | EU482666 | DENV | NS4B | EU482740 |
| DENV | NS4B | EU569714 | DENV | NS4B | EU482673 | DENV | NS4B | EU482451 |
| DENV | NS4B | EU569692 | DENV | NS4B | FJ024474 | DENV | NS4B | EU482668 |
| DENV | NS4B | FJ410233 | DENV | NS4B | EU687214 | DENV | NS4B | EU687229 |
| DENV | NS4B | AF100467 | DENV | NS4B | FJ410291 | DENV | NS4B | AF169684 |
| DENV | NS4B | EU677148 | DENV | NS4B | FM210242 | DENV | NS4B | FM210235 |

FIG. 70-170

| Virus | Protein | Accession No. | Virus | Protein | Accession No. | Virus | Protein | Accession No. |
|---|---|---|---|---|---|---|---|---|
| DENV | NS4B | GQ199874 | DENV | NS4B | FJ810409 | DENV | NS4B | FJ906961 |
| DENV | NS4B | FJ744745 | DENV | NS4B | FJ687434 | DENV | NS4B | FJ882593 |
| DENV | NS4B | FJ898467 | DENV | NS4B | GQ199890 | DENV | NS4B | FJ898479 |
| DENV | NS4B | FJ687444 | DENV | NS4B | FJ744743 | DENV | NS4B | FJ744703 |
| DENV | NS4B | FJ810411 | DENV | NS4B | FJ850063 | DENV | NS4B | FJ744712 |
| DENV | NS4B | FJ850067 | DENV | NS4B | FJ898466 | DENV | NS4B | FJ882594 |
| DENV | NS4B | FJ850121 | DENV | NS4B | FJ850119 | DENV | NS4B | FJ744716 |
| DENV | NS4B | FJ898452 | DENV | NS4B | FJ898432 | DENV | NS4B | FJ850066 |
| DENV | NS4B | FJ744713 | DENV | NS4B | FJ744718 | DENV | NS4B | FJ744744 |
| DENV | NS4B | FJ810418 | DENV | NS4B | FJ810412 | DENV | NS4B | FJ850108 |
| DENV | NS4B | FJ906962 | DENV | NS4B | FJ906956 | DENV | NS4B | FJ859028 |
| DENV | NS4B | FJ744721 | DENV | NS4B | FJ850064 | DENV | NS4B | FJ898465 |
| DENV | NS4B | FJ850107 | DENV | NS4B | GQ199892 | DENV | NS4B | FJ898451 |
| DENV | NS4B | FJ467493 | DENV | NS4B | FJ898436 | DENV | NS4B | FJ898449 |
| DENV | NS4B | FJ906966 | DENV | NS4B | FJ906957 | DENV | NS4B | FJ744705 |
| DENV | NS4B | FJ687446 | DENV | NS4B | FJ898478 | DENV | NS4B | FJ898434 |
| DENV | NS4B | FJ906958 | DENV | NS4B | FJ873811 | DENV | NS4B | FJ906969 |
| DENV | NS4B | FJ687435 | DENV | NS4B | GQ199898 | DENV | NS4B | FJ744741 |
| DENV | NS4B | FJ850054 | DENV | NS4B | FJ850115 | DENV | NS4B | FJ906959 |
| DENV | NS4B | FJ906967 | DENV | NS4B | FJ687442 | DENV | NS4B | FJ850106 |
| DENV | NS4B | FJ850072 | DENV | NS4B | FJ687439 | DENV | NS4B | FJ744742 |
| DENV | NS4B | FJ898439 | DENV | NS4B | FJ432724 | DENV | NS4B | FJ687437 |
| DENV | NS4B | FJ850088 | DENV | NS4B | FJ687447 | DENV | NS4B | FJ744707 |
| DENV | NS4B | FJ898435 | DENV | NS4B | FJ873808 | DENV | NS4B | FJ687438 |
| DENV | NS4B | GQ252676 | DENV | NS4B | DQ448231 | DENV | NS4B | FJ744714 |
| DENV | NS4B | FJ850065 | DENV | NS4B | FJ744710 | DENV | NS4B | GQ199866 |
| DENV | NS4B | FJ898477 | DENV | NS4B | GQ252677 | DENV | NS4B | GQ199894 |
| DENV | NS4B | FJ850116 | DENV | NS4B | NC_001474 | DENV | NS4B | FJ687440 |
| DENV | NS4B | FJ898454 | DENV | NS4B | FJ687445 | DENV | NS4B | FJ850112 |
| DENV | NS4B | GQ199897 | DENV | NS4B | FJ850091 | DENV | NS4B | FJ850078 |
| DENV | NS4B | GQ199899 | DENV | NS4B | FJ687443 | DENV | NS4B | FJ744717 |
| DENV | NS4B | FJ744723 | DENV | NS4B | GQ199869 | DENV | NS4B | FJ906968 |
| DENV | NS4B | GQ199900 | DENV | NS4B | FJ850105 | DENV | NS4B | GQ199893 |
| DENV | NS4B | FJ850082 | DENV | NS4B | FJ850051 | DENV | NS4B | FJ744711 |
| DENV | NS4B | FJ744715 | DENV | NS4B | FJ850050 | DENV | NS4B | FJ744704 |
| DENV | NS4B | FJ744709 | DENV | NS4B | FJ744719 | DENV | NS4B | FJ744720 |
| DENV | NS4B | GQ199868 | DENV | NS4B | FJ898453 | DENV | NS4B | GQ199901 |
| DENV | NS4B | FJ906960 | DENV | NS4B | FJ898460 | DENV | NS4B | FJ744724 |
| DENV | NS4B | FJ882602 | DENV | NS4B | FJ898438 | DENV | NS4B | FJ850120 |
| DENV | NS4B | GQ199895 | DENV | NS4B | FJ850053 | DENV | NS4B | FJ850118 |
| DENV | NS4B | FJ687436 | DENV | NS4B | FJ898450 | DENV | NS4B | FJ850076 |
| DENV | NS4B | FJ744725 | DENV | NS4B | FJ744708 | DENV | NS4B | AF022436 |
| DENV | NS4B | FJ850117 | DENV | NS4B | GQ199896 | DENV | NS4B | AF022439 |
| DENV | NS4B | FJ687441 | DENV | NS4B | FJ744722 | DENV | NS4B | AF022441 |
| DENV | NS4B | FJ744706 | DENV | NS4B | FJ850062 | DENV | NS4B | AF022437 |
| DENV | NS4B | FJ850074 | DENV | NS4B | FJ898461 | DENV | NS4B | AJ487271 |
| DENV | NS4B | FJ850085 | DENV | NS4B | FJ810410 | DENV | NS4B | AF022435 |
| DENV | NS4B | FJ850061 | DENV | NS4B | FJ850060 | DENV | NS4B | AF022434 |

FIG. 70-171

| Virus | Protein | Accession No. | Virus | Protein | Accession No. | Virus | Protein | Accession No. |
|---|---|---|---|---|---|---|---|---|
| DENV | NS4B | AF022438 | DENV | NS4B | GQ868558 | DENV | NS4B | AY243469 |
| DENV | NS4B | AF022440 | DENV | NS4B | GQ868625 | DENV | NS4B | AY744148 |
| DENV | NS4B | CS479165 | DENV | NS4B | GQ868624 | DENV | NS4B | AY744149 |
| DENV | NS4B | GQ868556 | DENV | NS4B | GQ868631 | DENV | NS4B | AY744150 |
| DENV | NS4B | AB479041 | DENV | NS4B | GU131899 | DENV | NS4B | AJ968413 |
| DENV | NS4B | GU289914 | DENV | NS4B | GQ868515 | DENV | NS4B | GU369819 |
| DENV | NS4B | GU131884 | DENV | NS4B | GU131898 | DENV | NS4B | GU370050 |
| DENV | NS4B | GQ868600 | DENV | NS4B | GQ868623 | DENV | NS4B | GU370051 |
| DENV | NS4B | FN429895 | DENV | NS4B | GU131886 | DENV | NS5 | AY277665 |
| DENV | NS4B | GU131879 | DENV | NS4B | GQ868622 | DENV | NS5 | AY713474 |
| DENV | NS4B | GQ868596 | DENV | NS4B | GQ868595 | DENV | NS5 | AF311957 |
| DENV | NS4B | GQ868516 | DENV | NS4B | GQ868557 | DENV | NS5 | FJ205881 |
| DENV | NS4B | GU131864 | DENV | NS4B | GU131959 | DENV | NS5 | EU482817 |
| DENV | NS4B | FN429893 | DENV | NS4B | GU131955 | DENV | NS5 | DQ672557 |
| DENV | NS4B | GQ868598 | DENV | NS4B | GQ868597 | DENV | NS5 | EU677151 |
| DENV | NS4B | GQ868544 | DENV | NS4B | GU131883 | DENV | NS5 | FJ410256 |
| DENV | NS4B | GQ868589 | DENV | NS4B | GQ868591 | DENV | NS5 | FJ432735 |
| DENV | NS4B | GQ868551 | DENV | NS4B | GQ868543 | DENV | NS5 | EU660390 |
| DENV | NS4B | GU131902 | DENV | NS4B | GU131901 | DENV | NS5 | EU482824 |
| DENV | NS4B | GU131896 | DENV | NS4B | GQ868545 | DENV | NS5 | FJ410222 |
| DENV | NS4B | GU131924 | DENV | NS4B | GU131931 | DENV | NS5 | AY726551 |
| DENV | NS4B | GQ868640 | DENV | NS4B | GU131885 | DENV | NS5 | EU482716 |
| DENV | NS4B | GU131880 | DENV | NS4B | GU131932 | DENV | NS5 | AF226685 |
| DENV | NS4B | GU131882 | DENV | NS4B | GU131881 | DENV | NS5 | EU677174 |
| DENV | NS4B | GQ868638 | DENV | NS4B | GU131897 | DENV | NS5 | FJ639693 |
| DENV | NS4B | GQ868553 | DENV | NS4B | GQ868592 | DENV | NS5 | FJ461317 |
| DENV | NS4B | GQ868646 | DENV | NS4B | GQ868552 | DENV | NS5 | FJ384655 |
| DENV | NS4B | FN429891 | DENV | NS4B | GU131900 | DENV | NS5 | EU482508 |
| DENV | NS4B | GQ868604 | DENV | NS4B | GQ868599 | DENV | NS5 | AF311958 |
| DENV | NS4B | GU131947 | DENV | NS4B | GU131929 | DENV | NS5 | FJ024451 |
| DENV | NS4B | GU131928 | DENV | NS4B | GU131930 | DENV | NS5 | EU482528 |
| DENV | NS4B | GQ868497 | DENV | NS4B | GQ868550 | DENV | NS5 | EU482821 |
| DENV | NS4B | GQ868603 | DENV | NS4B | GU131975 | DENV | NS5 | FJ410267 |
| DENV | NS4B | GQ868621 | DENV | NS4B | GU131927 | DENV | NS5 | AB074761 |
| DENV | NS4B | AB479042 | DENV | NS4B | GQ868540 | DENV | NS5 | AY762084 |
| DENV | NS4B | GQ868620 | DENV | NS4B | FJ410202 | DENV | NS5 | AY732480 |
| DENV | NS4B | GQ868590 | DENV | NS4B | CS479202 | DENV | NS5 | EU482481 |
| DENV | NS4B | FN429892 | DENV | NS4B | U87411 | DENV | NS5 | FJ410232 |
| DENV | NS4B | GQ868554 | DENV | NS4B | CS479203 | DENV | NS5 | EU081254 |
| DENV | NS4B | GU131974 | DENV | NS4B | CS479204 | DENV | NS5 | EU482806 |
| DENV | NS4B | GU131843 | DENV | NS4B | CS479167 | DENV | NS5 | FJ410257 |
| DENV | NS4B | GQ868641 | DENV | NS4B | CS479205 | DENV | NS5 | FJ432720 |
| DENV | NS4B | GQ868542 | DENV | NS4B | CS479206 | DENV | NS5 | FJ547089 |
| DENV | NS4B | GQ868555 | DENV | NS4B | CS805344 | DENV | NS5 | EU482819 |
| DENV | NS4B | FN429894 | DENV | NS4B | FB730117 | DENV | NS5 | EU081270 |
| DENV | NS4B | GQ868549 | DENV | NS4B | DL138662 | DENV | NS5 | FJ205875 |
| DENV | NS4B | GQ868588 | DENV | NS4B | GM059692 | DENV | NS5 | FJ410210 |
| DENV | NS4B | GQ868541 | DENV | NS4B | AY243468 | DENV | NS5 | FJ205884 |

FIG. 70-172

| Virus | Protein | Accession No. | Virus | Protein | Accession No. | Virus | Protein | Accession No. |
|---|---|---|---|---|---|---|---|---|
| DENV | NS5 | FJ176780 | DENV | NS5 | FJ639694 | DENV | NS5 | EU482592 |
| DENV | NS5 | FJ461340 | DENV | NS5 | EU482500 | DENV | NS5 | FJ182030 |
| DENV | NS5 | AY732475 | DENV | NS5 | DQ672560 | DENV | NS5 | FJ024431 |
| DENV | NS5 | AY732474 | DENV | NS5 | AY713473 | DENV | NS5 | FJ024450 |
| DENV | NS5 | FJ024435 | DENV | NS5 | EU726780 | DENV | NS5 | FJ410252 |
| DENV | NS5 | FJ639669 | DENV | NS5 | FJ410255 | DENV | NS5 | FJ478457 |
| DENV | NS5 | EU482540 | DENV | NS5 | FJ373298 | DENV | NS5 | EU596502 |
| DENV | NS5 | FJ024429 | DENV | NS5 | EU081276 | DENV | NS5 | FJ410201 |
| DENV | NS5 | EU677167 | DENV | NS5 | FJ410198 | DENV | NS5 | FJ562105 |
| DENV | NS5 | EU482512 | DENV | NS5 | EU482536 | DENV | NS5 | FJ639684 |
| DENV | NS5 | FJ390381 | DENV | NS5 | FJ390382 | DENV | NS5 | FJ639682 |
| DENV | NS5 | FJ410226 | DENV | NS5 | FJ024462 | DENV | NS5 | FJ410240 |
| DENV | NS5 | FJ410191 | DENV | NS5 | EU482822 | DENV | NS5 | EU081279 |
| DENV | NS5 | AJ968413 | DENV | NS5 | FJ024447 | DENV | NS5 | EU081231 |
| DENV | NS5 | FJ639689 | DENV | NS5 | FJ410274 | DENV | NS5 | FJ410214 |
| DENV | NS5 | AY277664 | DENV | NS5 | FJ410216 | DENV | NS5 | FJ182036 |
| DENV | NS5 | FJ639811 | DENV | NS5 | EU482527 | DENV | NS5 | FJ182023 |
| DENV | NS5 | FJ639695 | DENV | NS5 | EU280167 | DENV | NS5 | EU482479 |
| DENV | NS5 | EU081226 | DENV | NS5 | EU482567 | DENV | NS5 | FJ547087 |
| DENV | NS5 | FJ410280 | DENV | NS5 | EU081265 | DENV | NS5 | FJ639683 |
| DENV | NS5 | EU596504 | DENV | NS5 | EU482489 | DENV | NS5 | FJ024442 |
| DENV | NS5 | FJ639685 | DENV | NS5 | AB178040 | DENV | NS5 | FJ410285 |
| DENV | NS5 | EU482715 | DENV | NS5 | EU482827 | DENV | NS5 | EU482615 |
| DENV | NS5 | FJ410227 | DENV | NS5 | FJ024455 | DENV | NS5 | AY732476 |
| DENV | NS5 | DQ285560 | DENV | NS5 | EU081238 | DENV | NS5 | FJ024463 |
| DENV | NS5 | FJ182002 | DENV | NS5 | FJ410245 | DENV | NS5 | FJ410275 |
| DENV | NS5 | EU677177 | DENV | NS5 | FJ461318 | DENV | NS5 | FJ410234 |
| DENV | NS5 | FJ639680 | DENV | NS5 | FJ410263 | DENV | NS5 | EU482487 |
| DENV | NS5 | EU677160 | DENV | NS5 | FJ410269 | DENV | NS5 | FJ410182 |
| DENV | NS5 | AY835999 | DENV | NS5 | FJ410289 | DENV | NS5 | EU482812 |
| DENV | NS5 | EU249494 | DENV | NS5 | FJ639692 | DENV | NS5 | EU081247 |
| DENV | NS5 | AF226687 | DENV | NS5 | EU660397 | DENV | NS5 | AB074760 |
| DENV | NS5 | FJ024432 | DENV | NS5 | EU482477 | DENV | NS5 | EU482802 |
| DENV | NS5 | EU081229 | DENV | NS5 | FJ024434 | DENV | NS5 | EU677172 |
| DENV | NS5 | FJ410184 | DENV | NS5 | FJ410204 | DENV | NS5 | EU482496 |
| DENV | NS5 | FJ182022 | DENV | NS5 | EU249495 | DENV | NS5 | EU726777 |
| DENV | NS5 | EU677153 | DENV | NS5 | AF513110 | DENV | NS5 | U88535 |
| DENV | NS5 | DQ672559 | DENV | NS5 | FJ024438 | DENV | NS5 | EU482519 |
| DENV | NS5 | EU081234 | DENV | NS5 | EU081264 | DENV | NS5 | FJ461339 |
| DENV | NS5 | FJ639802 | DENV | NS5 | EU482525 | DENV | NS5 | FJ562101 |
| DENV | NS5 | EU482483 | DENV | NS5 | EU687251 | DENV | NS5 | FJ461316 |
| DENV | NS5 | FJ024445 | DENV | NS5 | EU482486 | DENV | NS5 | EU482814 |
| DENV | NS5 | FJ410236 | DENV | NS5 | DQ285558 | DENV | NS5 | AY726555 |
| DENV | NS5 | FJ410242 | DENV | NS5 | FJ205883 | DENV | NS5 | FJ639677 |
| DENV | NS5 | FJ390378 | DENV | NS5 | AY145121 | DENV | NS5 | EU482506 |
| DENV | NS5 | EU081236 | DENV | NS5 | AY732478 | DENV | NS5 | FJ410283 |
| DENV | NS5 | EU081278 | DENV | NS5 | FJ410199 | DENV | NS5 | FJ639696 |
| DENV | NS5 | FJ432736 | DENV | NS5 | FJ390383 | DENV | NS5 | FJ410235 |

FIG. 70-173

| Virus | Protein | Accession No. | Virus | Protein | Accession No. | Virus | Protein | Accession No. |
|---|---|---|---|---|---|---|---|---|
| DENV | NS5 | EU482532 | DENV | NS5 | FJ410262 | DENV | NS5 | EU081243 |
| DENV | NS5 | FJ182031 | DENV | NS5 | FJ024480 | DENV | NS5 | FJ639818 |
| DENV | NS5 | FJ024428 | DENV | NS5 | EU482495 | DENV | NS5 | EU081237 |
| DENV | NS5 | FJ432749 | DENV | NS5 | FJ182032 | DENV | NS5 | AF514876 |
| DENV | NS5 | DQ285561 | DENV | NS5 | FJ410197 | DENV | NS5 | FJ639688 |
| DENV | NS5 | EU482518 | DENV | NS5 | AF514883 | DENV | NS5 | EU482713 |
| DENV | NS5 | EU726779 | DENV | NS5 | FJ461330 | DENV | NS5 | EU677154 |
| DENV | NS5 | EU677161 | DENV | NS5 | FJ639690 | DENV | NS5 | EU081242 |
| DENV | NS5 | AY145123 | DENV | NS5 | FJ410209 | DENV | NS5 | EU687247 |
| DENV | NS5 | EU482800 | DENV | NS5 | EU482514 | DENV | NS5 | AY726552 |
| DENV | NS5 | AY732482 | DENV | NS5 | EU848545 | DENV | NS5 | FJ024436 |
| DENV | NS5 | EU482517 | DENV | NS5 | EU249492 | DENV | NS5 | FJ639681 |
| DENV | NS5 | EU482488 | DENV | NS5 | EU081240 | DENV | NS5 | EU482484 |
| DENV | NS5 | FJ373305 | DENV | NS5 | EU482499 | DENV | NS5 | EU482815 |
| DENV | NS5 | FJ432746 | DENV | NS5 | FJ410281 | DENV | NS5 | EU249490 |
| DENV | NS5 | FJ432734 | DENV | NS5 | FJ410270 | DENV | NS5 | EU081253 |
| DENV | NS5 | EU482797 | DENV | NS5 | EU482808 | DENV | NS5 | AY726549 |
| DENV | NS5 | EU482711 | DENV | NS5 | EU081281 | DENV | NS5 | EU677166 |
| DENV | NS5 | FJ024459 | DENV | NS5 | AF309641 | DENV | NS5 | FJ639821 |
| DENV | NS5 | FJ410174 | DENV | NS5 | EU677159 | DENV | NS5 | FJ024430 |
| DENV | NS5 | EU596503 | DENV | NS5 | EU482526 | DENV | NS5 | FJ410183 |
| DENV | NS5 | FJ432730 | DENV | NS5 | FJ024427 | DENV | NS5 | EU081267 |
| DENV | NS5 | EU081227 | DENV | NS5 | EU482618 | DENV | NS5 | EU482491 |
| DENV | NS5 | EU677163 | DENV | NS5 | AF350498 | DENV | NS5 | EU081249 |
| DENV | NS5 | AY277666 | DENV | NS5 | EU677169 | DENV | NS5 | EU081252 |
| DENV | NS5 | FJ024483 | DENV | NS5 | EU482828 | DENV | NS5 | EU482706 |
| DENV | NS5 | DQ193572 | DENV | NS5 | EU482537 | DENV | NS5 | AY726553 |
| DENV | NS5 | EF122231 | DENV | NS5 | EU726782 | DENV | NS5 | FJ205882 |
| DENV | NS5 | EU081266 | DENV | NS5 | FJ410225 | DENV | NS5 | FJ390386 |
| DENV | NS5 | EU482818 | DENV | NS5 | FJ410180 | DENV | NS5 | EU677139 |
| DENV | NS5 | FJ410186 | DENV | NS5 | FJ024460 | DENV | NS5 | FJ410260 |
| DENV | NS5 | EU249493 | DENV | NS5 | FJ410231 | DENV | NS5 | EU677170 |
| DENV | NS5 | FJ024478 | DENV | NS5 | FJ390380 | DENV | NS5 | EU081256 |
| DENV | NS5 | FJ205874 | DENV | NS5 | FJ410238 | DENV | NS5 | FJ024443 |
| DENV | NS5 | EU482791 | DENV | NS5 | FJ390379 | DENV | NS5 | FJ410278 |
| DENV | NS5 | EU482798 | DENV | NS5 | AF311956 | DENV | NS5 | FJ432744 |
| DENV | NS5 | EU081248 | DENV | NS5 | EU081257 | DENV | NS5 | AB189120 |
| DENV | NS5 | EU596501 | DENV | NS5 | FJ432721 | DENV | NS5 | FJ461327 |
| DENV | NS5 | FJ461336 | DENV | NS5 | FJ639672 | DENV | NS5 | EU660391 |
| DENV | NS5 | FJ024457 | DENV | NS5 | FJ639794 | DENV | NS5 | FJ562106 |
| DENV | NS5 | EU482485 | DENV | NS5 | EU660403 | DENV | NS5 | FJ182035 |
| DENV | NS5 | FJ176779 | DENV | NS5 | EU482619 | DENV | NS5 | FJ461306 |
| DENV | NS5 | EU482799 | DENV | NS5 | EU677155 | DENV | NS5 | EU482510 |
| DENV | NS5 | EU081233 | DENV | NS5 | FJ182021 | DENV | NS5 | FJ024440 |
| DENV | NS5 | EU482497 | DENV | NS5 | EU482712 | DENV | NS5 | EU081258 |
| DENV | NS5 | EU482616 | DENV | NS5 | EU482591 | DENV | NS5 | EU081268 |
| DENV | NS5 | EU482507 | DENV | NS5 | FJ410253 | DENV | NS5 | EU677178 |
| DENV | NS5 | EU482809 | DENV | NS5 | EF032590 | DENV | NS5 | FJ410276 |

FIG. 70-174

| Virus | Protein | Accession No. | Virus | Protein | Accession No. | Virus | Protein | Accession No. |
|---|---|---|---|---|---|---|---|---|
| DENV | NS5 | EU081273 | DENV | NS5 | EU482811 | DENV | NS5 | FJ410205 |
| DENV | NS5 | EU482820 | DENV | NS5 | AF226686 | DENV | NS5 | FJ205876 |
| DENV | NS5 | AF514878 | DENV | NS5 | EU081235 | DENV | NS5 | FJ410211 |
| DENV | NS5 | EU660394 | DENV | NS5 | EU660419 | DENV | NS5 | FJ182025 |
| DENV | NS5 | FJ410218 | DENV | NS5 | FJ547068 | DENV | NS5 | FJ182026 |
| DENV | NS5 | EU081241 | DENV | NS5 | AB189121 | DENV | NS5 | FJ373296 |
| DENV | NS5 | FJ410244 | DENV | NS5 | FJ461308 | DENV | NS5 | AY722802 |
| DENV | NS5 | EU482789 | DENV | NS5 | FJ410213 | DENV | NS5 | EU482522 |
| DENV | NS5 | EU482524 | DENV | NS5 | AY726550 | DENV | NS5 | FJ390388 |
| DENV | NS5 | EU081261 | DENV | NS5 | AY732477 | DENV | NS5 | EU677173 |
| DENV | NS5 | FJ639812 | DENV | NS5 | EU660401 | DENV | NS5 | EU081277 |
| DENV | NS5 | EU482533 | DENV | NS5 | FJ639815 | DENV | NS5 | EU482492 |
| DENV | NS5 | DQ285559 | DENV | NS5 | FJ410268 | DENV | NS5 | FJ432732 |
| DENV | NS5 | FJ410246 | DENV | NS5 | FJ478458 | DENV | NS5 | FJ639691 |
| DENV | NS5 | FJ461310 | DENV | NS5 | FJ639808 | DENV | NS5 | EU482511 |
| DENV | NS5 | AB195673 | DENV | NS5 | EU482611 | DENV | NS5 | EU081230 |
| DENV | NS5 | FJ182024 | DENV | NS5 | FJ410261 | DENV | NS5 | FJ410206 |
| DENV | NS5 | AB204803 | DENV | NS5 | FJ432729 | DENV | NS5 | FJ410189 |
| DENV | NS5 | EF025110 | DENV | NS5 | FJ639813 | DENV | NS5 | FJ182019 |
| DENV | NS5 | DQ672564 | DENV | NS5 | EU482520 | DENV | NS5 | FJ024472 |
| DENV | NS5 | EU726778 | DENV | NS5 | AF514885 | DENV | NS5 | FJ205872 |
| DENV | NS5 | EF457905 | DENV | NS5 | FJ639673 | DENV | NS5 | FJ410282 |
| DENV | NS5 | FJ547088 | DENV | NS5 | FJ410266 | DENV | NS5 | EU482538 |
| DENV | NS5 | FJ024437 | DENV | NS5 | EU482805 | DENV | NS5 | EU660418 |
| DENV | NS5 | EU482513 | DENV | NS5 | FJ432740 | DENV | NS5 | FJ639819 |
| DENV | NS5 | FJ410196 | DENV | NS5 | AY726554 | DENV | NS5 | FJ639806 |
| DENV | NS5 | FJ410250 | DENV | NS5 | FJ024441 | DENV | NS5 | FJ432738 |
| DENV | NS5 | EU660392 | DENV | NS5 | DQ672556 | DENV | NS5 | FJ432719 |
| DENV | NS5 | FJ461313 | DENV | NS5 | FJ410272 | DENV | NS5 | FJ461303 |
| DENV | NS5 | EU677168 | DENV | NS5 | FJ639676 | DENV | NS5 | FJ410203 |
| DENV | NS5 | FJ432723 | DENV | NS5 | FJ639686 | DENV | NS5 | FJ410194 |
| DENV | NS5 | FJ410181 | DENV | NS5 | EU482498 | DENV | NS5 | EU081244 |
| DENV | NS5 | FJ410239 | DENV | NS5 | FJ432725 | DENV | NS5 | EU482482 |
| DENV | NS5 | EU482480 | DENV | NS5 | EU482529 | DENV | NS5 | FJ410179 |
| DENV | NS5 | AY206457 | DENV | NS5 | FJ547086 | DENV | NS5 | AY722803 |
| DENV | NS5 | EU482523 | DENV | NS5 | FJ461323 | DENV | NS5 | EU482539 |
| DENV | NS5 | FJ410290 | DENV | NS5 | FJ410230 | DENV | NS5 | FJ639671 |
| DENV | NS5 | DQ672562 | DENV | NS5 | FJ410248 | DENV | NS5 | EU482478 |
| DENV | NS5 | EU482521 | DENV | NS5 | EU482609 | DENV | NS5 | FJ547060 |
| DENV | NS5 | EU660402 | DENV | NS5 | FJ639824 | DENV | NS5 | FJ432739 |
| DENV | NS5 | FJ461307 | DENV | NS5 | FJ410279 | DENV | NS5 | FJ639740 |
| DENV | NS5 | EU081272 | DENV | NS5 | EU482535 | DENV | NS5 | FJ182034 |
| DENV | NS5 | FJ461315 | DENV | NS5 | FJ024453 | DENV | NS5 | EU482710 |
| DENV | NS5 | FJ410188 | DENV | NS5 | FJ432748 | DENV | NS5 | EU081232 |
| DENV | NS5 | AY713475 | DENV | NS5 | EU660393 | DENV | NS5 | EU482515 |
| DENV | NS5 | AY732479 | DENV | NS5 | AY145122 | DENV | NS5 | EU482531 |
| DENV | NS5 | EU677156 | DENV | NS5 | FJ024446 | DENV | NS5 | AF298807 |
| DENV | NS5 | EU482707 | DENV | NS5 | FJ432747 | DENV | NS5 | FJ205873 |

FIG. 70-175

| Virus | Protein | Accession No. | Virus | Protein | Accession No. | Virus | Protein | Accession No. |
|---|---|---|---|---|---|---|---|---|
| DENV | NS5 | FJ639674 | DENV | NS5 | EU482476 | DENV | NS5 | FJ410185 |
| DENV | NS5 | FJ547065 | DENV | NS5 | EU482505 | DENV | NS5 | FJ410273 |
| DENV | NS5 | FJ410212 | DENV | NS5 | EU081255 | DENV | NS5 | EU482801 |
| DENV | NS5 | FJ461341 | DENV | NS5 | FJ639743 | DENV | NS5 | AY713476 |
| DENV | NS5 | EU081259 | DENV | NS5 | U88537 | DENV | NS5 | FJ461312 |
| DENV | NS5 | FJ639823 | DENV | NS5 | FJ432733 | DENV | NS5 | FJ639797 |
| DENV | NS5 | FJ410190 | DENV | NS5 | EU660395 | DENV | NS5 | FJ461319 |
| DENV | NS5 | FJ432745 | DENV | NS5 | EU081263 | DENV | NS5 | FJ461333 |
| DENV | NS5 | FJ410175 | DENV | NS5 | EU482826 | DENV | NS5 | EU482516 |
| DENV | NS5 | EU677176 | DENV | NS5 | FJ410192 | DENV | NS5 | EU482792 |
| DENV | NS5 | FJ639679 | DENV | NS5 | FJ182020 | DENV | NS5 | AF514889 |
| DENV | NS5 | FJ432742 | DENV | NS5 | DQ672561 | DENV | NS5 | EU482509 |
| DENV | NS5 | FJ639670 | DENV | NS5 | FJ024481 | DENV | NS5 | FJ432737 |
| DENV | NS5 | FJ182027 | DENV | NS5 | EU677165 | DENV | NS5 | FJ547063 |
| DENV | NS5 | EU482718 | DENV | NS5 | FJ410287 | DENV | NS5 | FJ373297 |
| DENV | NS5 | EU677158 | DENV | NS5 | EU482502 | DENV | NS5 | EU677157 |
| DENV | NS5 | FJ639687 | DENV | NS5 | EU081274 | DENV | NS5 | EU482534 |
| DENV | NS5 | FJ461325 | DENV | NS5 | FJ024448 | DENV | NS5 | EU249491 |
| DENV | NS5 | FJ024444 | DENV | NS5 | FJ024425 | DENV | NS5 | DQ285562 |
| DENV | NS5 | EU482617 | DENV | NS5 | FJ639741 | DENV | NS5 | EU482793 |
| DENV | NS5 | FJ639678 | DENV | NS5 | FJ562104 | DENV | NS5 | EU482717 |
| DENV | NS5 | EU081269 | DENV | NS5 | DQ672563 | DENV | NS5 | FJ024439 |
| DENV | NS5 | EU482714 | DENV | NS5 | EU482708 | DENV | NS5 | EU482804 |
| DENV | NS5 | FJ024456 | DENV | NS5 | FJ410247 | DENV | NS5 | EU482503 |
| DENV | NS5 | FJ182028 | DENV | NS5 | AF180817 | DENV | NS5 | EU677162 |
| DENV | NS5 | EU677152 | DENV | NS5 | AY722801 | DENV | NS5 | FJ024485 |
| DENV | NS5 | EU081228 | DENV | NS5 | EU482504 | DENV | NS5 | EU081271 |
| DENV | NS5 | FJ410173 | DENV | NS5 | FJ639675 | DENV | NS5 | FJ024426 |
| DENV | NS5 | EU482796 | DENV | NS5 | FJ024433 | DENV | NS5 | EU482790 |
| DENV | NS5 | EU726781 | DENV | NS5 | FJ461331 | DENV | NS5 | FJ410286 |
| DENV | NS5 | FJ410207 | DENV | NS5 | FJ410187 | DENV | NS5 | FJ639735 |
| DENV | NS5 | FJ410243 | DENV | NS5 | FJ410258 | DENV | NS5 | EU482494 |
| DENV | NS5 | EU081239 | DENV | NS5 | AY708047 | DENV | NS5 | FJ390374 |
| DENV | NS5 | EU482816 | DENV | NS5 | FJ024423 | DENV | NS5 | EU482813 |
| DENV | NS5 | EU081260 | DENV | NS5 | FJ024484 | DENV | NS5 | FJ461335 |
| DENV | NS5 | FJ182029 | DENV | NS5 | EU081251 | DENV | NS5 | EU482803 |
| DENV | NS5 | FJ024449 | DENV | NS5 | FJ410249 | DENV | NS5 | EU482490 |
| DENV | NS5 | EU081250 | DENV | NS5 | EU482610 | DENV | NS5 | FJ024482 |
| DENV | NS5 | EU482825 | DENV | NS5 | FJ182033 | DENV | NS5 | FJ410284 |
| DENV | NS5 | EU482530 | DENV | NS5 | EU482493 | DENV | NS5 | EU081280 |
| DENV | NS5 | FJ639820 | DENV | NS5 | EU482807 | DENV | NS5 | EU677150 |
| DENV | NS5 | EU677175 | DENV | NS5 | FJ639814 | DENV | NS5 | AY732481 |
| DENV | NS5 | FJ410251 | DENV | NS5 | EU482501 | DENV | NS5 | FJ461324 |
| DENV | NS5 | EU482794 | DENV | NS5 | FJ410254 | DENV | NS5 | FJ639796 |
| DENV | NS5 | EU359008 | DENV | NS5 | EU081246 | DENV | NS5 | EU482709 |
| DENV | NS5 | AF180818 | DENV | NS5 | EU081275 | DENV | NS5 | AF298808 |
| DENV | NS5 | EU660396 | DENV | NS5 | FJ410264 | DENV | NS5 | FJ182018 |
| DENV | NS5 | FJ182003 | DENV | NS5 | FJ024479 | DENV | NS5 | DQ672558 |

FIG. 70-176

| Virus | Protein Accession No. | Virus | Protein Accession No. | Virus | Protein Accession No. |
|---|---|---|---|---|---|
| DENV | NS5EU482795 | DENV | NS5FJ898410 | DENV | NS5FJ859029 |
| DENV | NS5EU677164 | DENV | NS5FJ882528 | DENV | NS5FJ882515 |
| DENV | NS5FJ410277 | DENV | NS5FJ898382 | DENV | NS5GQ199820 |
| DENV | NS5FJ024464 | DENV | NS5FJ898404 | DENV | NS5GQ199867 |
| DENV | NS5FJ461332 | DENV | NS5FJ687426 | DENV | NS5FJ898448 |
| DENV | NS5EF122232 | DENV | NS5FJ898371 | DENV | NS5FJ882556 |
| DENV | NS5FJ432727 | DENV | NS5GQ199872 | DENV | NS5FJ882536 |
| DENV | NS5EU482823 | DENV | NS5GQ199855 | DENV | NS5GQ199796 |
| DENV | NS5EU482810 | DENV | NS5FJ882535 | DENV | NS5FJ882570 |
| DENV | NS5EU081245 | DENV | NS5NC_001477 | DENV | NS5FJ898376 |
| DENV | NS5EU081262 | DENV | NS5FJ898423 | DENV | NS5GQ199771 |
| DENV | NS5EU863650 | DENV | NS5FJ882565 | DENV | NS5FJ850069 |
| DENV | NS5AY732483 | DENV | NS5FJ882517 | DENV | NS5FJ850102 |
| DENV | NS5FJ410265 | DENV | NS5GQ199814 | DENV | NS5GQ199834 |
| DENV | NS5EU660412 | DENV | NS5FJ898395 | DENV | NS5FJ898388 |
| DENV | NS5EU677171 | DENV | NS5GQ199851 | DENV | NS5GQ199830 |
| DENV | NS5EU677140 | DENV | NS5GQ199837 | DENV | NS5GQ199839 |
| DENV | NS5FJ898428 | DENV | NS5FJ882558 | DENV | NS5GQ199777 |
| DENV | NS5FJ882569 | DENV | NS5FJ850084 | DENV | NS5FJ882579 |
| DENV | NS5GQ199776 | DENV | NS5FJ898374 | DENV | NS5FJ898429 |
| DENV | NS5GQ199853 | DENV | NS5FJ850104 | DENV | NS5FJ882541 |
| DENV | NS5GQ199803 | DENV | NS5GQ199815 | DENV | NS5FJ898402 |
| DENV | NS5FJ882554 | DENV | NS5GQ199843 | DENV | NS5GQ199808 |
| DENV | NS5FJ873809 | DENV | NS5GQ199826 | DENV | NS5GQ199786 |
| DENV | NS5FJ882563 | DENV | NS5FJ882550 | DENV | NS5FJ882547 |
| DENV | NS5GQ199812 | DENV | NS5FJ744701 | DENV | NS5GQ199798 |
| DENV | NS5FJ873810 | DENV | NS5FJ898391 | DENV | NS5GQ199844 |
| DENV | NS5FJ898397 | DENV | NS5FJ898417 | DENV | NS5GQ199829 |
| DENV | NS5FJ898400 | DENV | NS5GQ199806 | DENV | NS5FJ882530 |
| DENV | NS5FJ687433 | DENV | NS5GQ199794 | DENV | NS5FJ898422 |
| DENV | NS5GQ199877 | DENV | NS5FJ898425 | DENV | NS5FJ810415 |
| DENV | NS5GQ199788 | DENV | NS5FJ898393 | DENV | NS5FJ898411 |
| DENV | NS5GQ199823 | DENV | NS5GQ199799 | DENV | NS5GQ199856 |
| DENV | NS5FJ898407 | DENV | NS5GQ199833 | DENV | NS5FJ850101 |
| DENV | NS5GQ199804 | DENV | NS5GQ199781 | DENV | NS5FJ850093 |
| DENV | NS5FJ882533 | DENV | NS5GQ199797 | DENV | NS5FJ882551 |
| DENV | NS5GQ199818 | DENV | NS5FJ882522 | DENV | NS5GQ199795 |
| DENV | NS5FJ882560 | DENV | NS5FJ906964 | DENV | NS5FJ850100 |
| DENV | NS5FJ898415 | DENV | NS5GQ199821 | DENV | NS5FJ898416 |
| DENV | NS5FJ850113 | DENV | NS5GQ199847 | DENV | NS5GQ199785 |
| DENV | NS5FJ898384 | DENV | NS5FJ882524 | DENV | NS5GQ199784 |
| DENV | NS5FJ882538 | DENV | NS5FJ850077 | DENV | NS5GQ199828 |
| DENV | NS5FJ882521 | DENV | NS5FJ882552 | DENV | NS5GQ199780 |
| DENV | NS5GQ199811 | DENV | NS5GQ199778 | DENV | NS5FJ850103 |
| DENV | NS5FJ850075 | DENV | NS5FJ882549 | DENV | NS5FJ882555 |
| DENV | NS5GQ199848 | DENV | NS5GQ199816 | DENV | NS5FJ882561 |
| DENV | NS5FJ898378 | DENV | NS5GQ199824 | DENV | NS5FJ687430 |
| DENV | NS5FJ873814 | DENV | NS5FJ898398 | DENV | NS5FJ898381 |

FIG. 70-177

| Virus | Protein | Accession No. | Virus | Protein | Accession No. | Virus | Protein | Accession No. |
|---|---|---|---|---|---|---|---|---|
| DENV | NS5 | FJ882518 | DENV | NS5 | FJ882531 | DENV | NS5 | GQ199838 |
| DENV | NS5 | FJ898392 | DENV | NS5 | GQ199810 | DENV | NS5 | GQ199779 |
| DENV | NS5 | FJ898380 | DENV | NS5 | GQ199825 | DENV | NS5 | GQ199827 |
| DENV | NS5 | GQ199835 | DENV | NS5 | FJ882546 | DENV | NS5 | GQ199836 |
| DENV | NS5 | FJ898430 | DENV | NS5 | FJ882568 | DENV | NS5 | GQ199858 |
| DENV | NS5 | FJ850087 | DENV | NS5 | FJ898413 | DENV | NS5 | GQ199787 |
| DENV | NS5 | FJ898385 | DENV | NS5 | GQ199773 | DENV | NS5 | FJ850068 |
| DENV | NS5 | GQ199857 | DENV | NS5 | GQ199822 | DENV | NS5 | FJ882564 |
| DENV | NS5 | FJ898403 | DENV | NS5 | GQ199832 | DENV | NS5 | FJ898419 |
| DENV | NS5 | GQ199800 | DENV | NS5 | GQ199790 | DENV | NS5 | FJ898383 |
| DENV | NS5 | FJ882540 | DENV | NS5 | GQ199841 | DENV | NS5 | FJ461328 |
| DENV | NS5 | GQ199792 | DENV | NS5 | FJ882520 | DENV | NS5 | FJ882527 |
| DENV | NS5 | FJ882516 | DENV | NS5 | GQ199875 | DENV | NS5 | FJ898427 |
| DENV | NS5 | GQ199850 | DENV | NS5 | GQ199802 | DENV | NS5 | FJ882525 |
| DENV | NS5 | FJ898372 | DENV | NS5 | GQ199791 | DENV | NS5 | FJ882557 |
| DENV | NS5 | GQ199775 | DENV | NS5 | FJ898426 | DENV | NS5 | GQ199859 |
| DENV | NS5 | FJ882559 | DENV | NS5 | FJ898431 | DENV | NS5 | GQ199842 |
| DENV | NS5 | GQ199789 | DENV | NS5 | GQ199809 | DENV | NS5 | GQ199817 |
| DENV | NS5 | FJ850099 | DENV | NS5 | FJ898406 | DENV | NS5 | FJ898401 |
| DENV | NS5 | FJ850114 | DENV | NS5 | GQ199805 | DENV | NS5 | FJ882519 |
| DENV | NS5 | GQ199819 | DENV | NS5 | GQ199831 | DENV | NS5 | FJ850090 |
| DENV | NS5 | FJ882523 | DENV | NS5 | FJ850070 | DENV | NS5 | FJ898377 |
| DENV | NS5 | GQ199845 | DENV | NS5 | GQ199807 | DENV | NS5 | GQ199774 |
| DENV | NS5 | FJ850081 | DENV | NS5 | FJ882543 | DENV | NS5 | FJ898399 |
| DENV | NS5 | FJ744702 | DENV | NS5 | FJ898408 | DENV | NS5 | GQ199840 |
| DENV | NS5 | FJ898386 | DENV | NS5 | FJ810419 | DENV | NS5 | FJ898433 |
| DENV | NS5 | FJ882542 | DENV | NS5 | GQ199793 | DENV | NS5 | FJ882567 |
| DENV | NS5 | GQ199782 | DENV | NS5 | FJ882562 | DENV | NS5 | FJ898387 |
| DENV | NS5 | GQ199852 | DENV | NS5 | FJ898424 | DENV | NS5 | FJ882532 |
| DENV | NS5 | FJ898421 | DENV | NS5 | FJ898389 | DENV | NS5 | FJ898409 |
| DENV | NS5 | FJ687432 | DENV | NS5 | FJ898412 | DENV | NS5 | FJ882545 |
| DENV | NS5 | GQ199813 | DENV | NS5 | FJ882537 | DENV | NS5 | FJ898375 |
| DENV | NS5 | FJ882534 | DENV | NS5 | FJ898418 | DENV | NS5 | FJ898414 |
| DENV | NS5 | GQ199854 | DENV | NS5 | FJ898394 | DENV | NS5 | CS477306 |
| DENV | NS5 | GQ199846 | DENV | NS5 | GQ199849 | DENV | NS5 | A75711 |
| DENV | NS5 | FJ882539 | DENV | NS5 | FJ882548 | DENV | NS5 | GU131816 |
| DENV | NS5 | FJ898437 | DENV | NS5 | FJ906963 | DENV | NS5 | FJ469907 |
| DENV | NS5 | FJ898390 | DENV | NS5 | FJ906965 | DENV | NS5 | GU131814 |
| DENV | NS5 | FJ898405 | DENV | NS5 | GQ199873 | DENV | NS5 | GU131725 |
| DENV | NS5 | GQ199783 | DENV | NS5 | FJ850073 | DENV | NS5 | GU131822 |
| DENV | NS5 | FJ882526 | DENV | NS5 | FJ850071 | DENV | NS5 | GQ868633 |
| DENV | NS5 | FJ461320 | DENV | NS5 | GQ199772 | DENV | NS5 | GU131820 |
| DENV | NS5 | FJ898420 | DENV | NS5 | FJ898373 | DENV | NS5 | GU131679 |
| DENV | NS5 | FJ687431 | DENV | NS5 | FJ687429 | DENV | NS5 | GQ868507 |
| DENV | NS5 | GQ199801 | DENV | NS5 | FJ898379 | DENV | NS5 | GU131789 |
| DENV | NS5 | FJ906728 | DENV | NS5 | FJ882566 | DENV | NS5 | GU131710 |
| DENV | NS5 | FJ882544 | DENV | NS5 | FJ898396 | DENV | NS5 | FN429887 |
| DENV | NS5 | FJ882553 | DENV | NS5 | FJ882529 | DENV | NS5 | GU131720 |

FIG. 70-178

| Virus | Protein | Accession No. | Virus | Protein | Accession No. | Virus | Protein | Accession No. |
|---|---|---|---|---|---|---|---|---|
| DENV | NS5 | GU131841 | DENV | NS5 | GU131689 | DENV | NS5 | GQ868534 |
| DENV | NS5 | GQ868564 | DENV | NS5 | GU131700 | DENV | NS5 | GU131687 |
| DENV | NS5 | AB519681 | DENV | NS5 | GU131798 | DENV | NS5 | GQ868529 |
| DENV | NS5 | GU131743 | DENV | NS5 | GU131713 | DENV | NS5 | GU131840 |
| DENV | NS5 | GQ868522 | DENV | NS5 | GU131829 | DENV | NS5 | GU131808 |
| DENV | NS5 | GU131739 | DENV | NS5 | GU131782 | DENV | NS5 | GU131922 |
| DENV | NS5 | GU131971 | DENV | NS5 | GU131698 | DENV | NS5 | GU131836 |
| DENV | NS5 | GU131834 | DENV | NS5 | GU131732 | DENV | NS5 | GQ868613 |
| DENV | NS5 | GQ868523 | DENV | NS5 | GU131772 | DENV | NS5 | GU131721 |
| DENV | NS5 | GU131982 | DENV | NS5 | GU131978 | DENV | NS5 | GU131730 |
| DENV | NS5 | GU131965 | DENV | NS5 | GU131958 | DENV | NS5 | GU131968 |
| DENV | NS5 | GU131760 | DENV | NS5 | GU131811 | DENV | NS5 | GU131832 |
| DENV | NS5 | GQ868535 | DENV | NS5 | GQ868506 | DENV | NS5 | GU131774 |
| DENV | NS5 | GU131962 | DENV | NS5 | GQ868525 | DENV | NS5 | GU131976 |
| DENV | NS5 | GU131891 | DENV | NS5 | GQ868538 | DENV | NS5 | GU131831 |
| DENV | NS5 | GQ868504 | DENV | NS5 | FJ469909 | DENV | NS5 | GQ868501 |
| DENV | NS5 | GU131783 | DENV | NS5 | GU131818 | DENV | NS5 | GQ868531 |
| DENV | NS5 | GU131680 | DENV | NS5 | GU131893 | DENV | NS5 | GU131957 |
| DENV | NS5 | GU131704 | DENV | NS5 | GQ868509 | DENV | NS5 | GU131980 |
| DENV | NS5 | GU131685 | DENV | NS5 | GU131706 | DENV | NS5 | GQ868609 |
| DENV | NS5 | GU131770 | DENV | NS5 | GU131777 | DENV | NS5 | GU131769 |
| DENV | NS5 | GU131795 | DENV | NS5 | GU131925 | DENV | NS5 | GQ868526 |
| DENV | NS5 | GU131961 | DENV | NS5 | GU131977 | DENV | NS5 | GQ868510 |
| DENV | NS5 | GU131733 | DENV | NS5 | GQ868611 | DENV | NS5 | FN429882 |
| DENV | NS5 | GU131804 | DENV | NS5 | GU131745 | DENV | NS5 | GU131763 |
| DENV | NS5 | GU131762 | DENV | NS5 | GQ868635 | DENV | NS5 | GQ868527 |
| DENV | NS5 | GU131827 | DENV | NS5 | GU056032 | DENV | NS5 | GU131708 |
| DENV | NS5 | GU131837 | DENV | NS5 | GQ868610 | DENV | NS5 | GU131766 |
| DENV | NS5 | GQ868630 | DENV | NS5 | GU131889 | DENV | NS5 | FN429890 |
| DENV | NS5 | GU131767 | DENV | NS5 | GQ868499 | DENV | NS5 | GU131694 |
| DENV | NS5 | GU131737 | DENV | NS5 | GU131756 | DENV | NS5 | GQ868615 |
| DENV | NS5 | GQ868500 | DENV | NS5 | GU131786 | DENV | NS5 | GU131688 |
| DENV | NS5 | GU131722 | DENV | NS5 | GQ868565 | DENV | NS5 | FJ469908 |
| DENV | NS5 | GQ868607 | DENV | NS5 | GU131709 | DENV | NS5 | GU131734 |
| DENV | NS5 | GQ868517 | DENV | NS5 | GQ868569 | DENV | NS5 | GQ868637 |
| DENV | NS5 | GU131727 | DENV | NS5 | GU131723 | DENV | NS5 | GU131888 |
| DENV | NS5 | GU131715 | DENV | NS5 | GU131696 | DENV | NS5 | GQ868568 |
| DENV | NS5 | FN429885 | DENV | NS5 | GQ868519 | DENV | NS5 | GU131790 |
| DENV | NS5 | GU131780 | DENV | NS5 | GU131838 | DENV | NS5 | GU131920 |
| DENV | NS5 | GU131750 | DENV | NS5 | GQ868520 | DENV | NS5 | GQ868528 |
| DENV | NS5 | GU131787 | DENV | NS5 | GU131791 | DENV | NS5 | GQ868612 |
| DENV | NS5 | GU056031 | DENV | NS5 | GU131765 | DENV | NS5 | GU131794 |
| DENV | NS5 | GQ868602 | DENV | NS5 | GU131702 | DENV | NS5 | GQ868606 |
| DENV | NS5 | GU131711 | DENV | NS5 | GU131682 | DENV | NS5 | GU131969 |
| DENV | NS5 | GQ868567 | DENV | NS5 | GU131801 | DENV | NS5 | GQ868608 |
| DENV | NS5 | GU131813 | DENV | NS5 | GQ868562 | DENV | NS5 | GU131921 |
| DENV | NS5 | FJ687428 | DENV | NS5 | GU131684 | DENV | NS5 | GQ868502 |
| DENV | NS5 | GU131707 | DENV | NS5 | GU131744 | DENV | NS5 | GU131719 |

FIG. 70-179

| Virus | Protein Accession No. | Virus | Protein Accession No. | Virus | Protein Accession No. |
|---|---|---|---|---|---|
| DENV | NS5GU131973 | DENV | NS5GU131764 | DENV | NS5FN429888 |
| DENV | NS5GU131967 | DENV | NS5GU056030 | DENV | NS5GU131778 |
| DENV | NS5GU131803 | DENV | NS5GU131979 | DENV | NS5GU131972 |
| DENV | NS5GU131736 | DENV | NS5GU131768 | DENV | NS5GU131817 |
| DENV | NS5GU131981 | DENV | NS5GU131699 | DENV | NS5GU131759 |
| DENV | NS5GU131964 | DENV | NS5FJ687427 | DENV | NS5GU131819 |
| DENV | NS5GU131771 | DENV | NS5GU131963 | DENV | NS5GU131757 |
| DENV | NS5GU131984 | DENV | NS5GU131793 | DENV | NS5GQ868533 |
| DENV | NS5GU131695 | DENV | NS5GQ868618 | DENV | NS5FN429883 |
| DENV | NS5GU131728 | DENV | NS5GU131799 | DENV | NS5GU131956 |
| DENV | NS5GQ868601 | DENV | NS5GU131724 | DENV | NS5GQ868563 |
| DENV | NS5FN429886 | DENV | NS5GU131740 | DENV | NS5GU131926 |
| DENV | NS5GU131826 | DENV | NS5GU131806 | DENV | NS5GU131887 |
| DENV | NS5GQ868512 | DENV | NS5GQ868614 | DENV | NS5GU131741 |
| DENV | NS5GU131718 | DENV | NS5FN429881 | DENV | NS5GU131761 |
| DENV | NS5GQ868513 | DENV | NS5GQ868636 | DENV | NS5GU131693 |
| DENV | NS5GU131731 | DENV | NS5GU131746 | DENV | NS5GU131753 |
| DENV | NS5GU131686 | DENV | NS5GQ868560 | DENV | NS5GU131948 |
| DENV | NS5GU131894 | DENV | NS5GQ868508 | DENV | NS5GQ868559 |
| DENV | NS5GU131895 | DENV | NS5GQ868570 | DENV | NS5GQ868530 |
| DENV | NS5GU131678 | DENV | NS5GU131788 | DENV | NS5GU131797 |
| DENV | NS5GQ868619 | DENV | NS5GU131949 | DENV | NS5GU131785 |
| DENV | NS5GU131729 | DENV | NS5GU131796 | DENV | NS5GU131758 |
| DENV | NS5GQ868539 | DENV | NS5GU056029 | DENV | NS5GU131697 |
| DENV | NS5GU131747 | DENV | NS5GU131792 | DENV | NS5GU131835 |
| DENV | NS5GU131748 | DENV | NS5GU131690 | DENV | NS5GU131716 |
| DENV | NS5FN429889 | DENV | NS5GQ868632 | DENV | NS5GQ868498 |
| DENV | NS5GU131776 | DENV | NS5GU131781 | DENV | NS5GU131683 |
| DENV | NS5GU131755 | DENV | NS5GQ868537 | DENV | NS5GU131960 |
| DENV | NS5GU131810 | DENV | NS5GU131815 | DENV | NS5GU131714 |
| DENV | NS5GU131701 | DENV | NS5GU056033 | DENV | NS5GU131779 |
| DENV | NS5GU131754 | DENV | NS5GU131812 | DENV | NS5GU131773 |
| DENV | NS5GU131784 | DENV | NS5GU131833 | DENV | NS5GQ868605 |
| DENV | NS5GU131807 | DENV | NS5GU131830 | DENV | NS5GQ868511 |
| DENV | NS5GU131842 | DENV | NS5GU131742 | DENV | NS5GU131752 |
| DENV | NS5GU131923 | DENV | NS5GQ868561 | DENV | NS5GU131691 |
| DENV | NS5GU131809 | DENV | NS5GU131800 | DENV | NS5GU131692 |
| DENV | NS5GU131726 | DENV | NS5GU131738 | DENV | NS5GU131705 |
| DENV | NS5GU131970 | DENV | NS5GU131824 | DENV | NS5GQ868639 |
| DENV | NS5GU131751 | DENV | NS5GU131919 | DENV | NS5GU131805 |
| DENV | NS5GU131828 | DENV | NS5GU131802 | DENV | NS5GU131735 |
| DENV | NS5GQ868524 | DENV | NS5GQ868503 | DENV | NS5GU131966 |
| DENV | NS5GU131863 | DENV | NS5GU131839 | DENV | NS5GU131890 |
| DENV | NS5GU131892 | DENV | NS5GU131681 | DENV | NS5GQ868566 |
| DENV | NS5GU131823 | DENV | NS5GQ868505 | DENV | NS5GU131775 |
| DENV | NS5GU131821 | DENV | NS5FN429884 | DENV | NS5GU131749 |
| DENV | NS5GU131983 | DENV | NS5GQ868536 | DENV | NS5GQ868521 |
| DENV | NS5GQ868518 | DENV | NS5GU131825 | DENV | NS5GU131703 |

FIG. 70-180

| Virus | Protein Accession No. | Virus | Protein Accession No. | Virus | Protein Accession No. |
|---|---|---|---|---|---|
| DENV | NS5GU131717 | DENV | NS5FJ182016 | DENV | NS5GQ868585 |
| DENV | NS5GU131712 | DENV | NS5AF326573 | DENV | NS5GQ868579 |
| DENV | NS5GQ868532 | DENV | NS5FJ182017 | DENV | NS5GQ868644 |
| DENV | NS5GQ868514 | DENV | NS5FJ024476 | DENV | NS5FN429925 |
| DENV | NS5FJ410220 | DENV | NS5EF457906 | DENV | NS5GU289913 |
| DENV | NS5CS477302 | DENV | NS5FJ639742 | DENV | NS5GQ868580 |
| DENV | NS5CS477304 | DENV | NS5AF289029 | DENV | NS5FN429922 |
| DENV | NS5CS477264 | DENV | NS5GQ199880 | DENV | NS5GQ868645 |
| DENV | NS5CS477305 | DENV | NS5FJ882597 | DENV | NS5GQ868594 |
| DENV | NS5CS477263 | DENV | NS5NC_002640 | DENV | NS5FN429924 |
| DENV | NS5CS477265 | DENV | NS5FJ882587 | DENV | NS5FJ882590 |
| DENV | NS5M87512 | DENV | NS5FJ882595 | DENV | NS5GQ868582 |
| DENV | NS5FB730116 | DENV | NS5FJ882582 | DENV | NS5GQ868584 |
| DENV | NS5GM059691 | DENV | NS5FJ810417 | DENV | NS5FN429926 |
| DENV | NS5U88536 | DENV | NS5FJ850095 | DENV | NS5FN429921 |
| DENV | NS5GU370048 | DENV | NS5FJ882599 | DENV | NS5GQ868643 |
| DENV | NS5GU370049 | DENV | NS5FJ882580 | DENV | NS5AF326825 |
| DENV | NS5AY762085 | DENV | NS5GQ199884 | DENV | NS5AY376438 |
| DENV | NS5FJ024424 | DENV | NS5FJ882588 | DENV | NS5AY648301 |
| DENV | NS5FJ226067 | DENV | NS5FJ882598 | DENV | NS5AY099336 |
| DENV | NS5FJ639745 | DENV | NS5FJ882601 | DENV | NS5GU363549 |
| DENV | NS5AY618989 | DENV | NS5FJ850058 | DENV | NS5GU370052 |
| DENV | NS5AF326827 | DENV | NS5FJ882584 | DENV | NS5GU370053 |
| DENV | NS5AY618988 | DENV | NS5FJ850059 | DENV | NS5EU081191 |
| DENV | NS5EU854296 | DENV | NS5GQ199883 | DENV | NS5DQ401690 |
| DENV | NS5EU854300 | DENV | NS5FJ882586 | DENV | NS5EU529683 |
| DENV | NS5AY858050 | DENV | NS5GQ252675 | DENV | NS5AY679147 |
| DENV | NS5AF375822 | DENV | NS5FJ882581 | DENV | NS5AY676348 |
| DENV | NS5EU854295 | DENV | NS5GQ199881 | DENV | NS5EF629368 |
| DENV | NS5M14931 | DENV | NS5GQ199878 | DENV | NS5FJ639752 |
| DENV | NS5AY618992 | DENV | NS5FJ882596 | DENV | NS5FJ639807 |
| DENV | NS5EU854297 | DENV | NS5FJ882583 | DENV | NS5EU529684 |
| DENV | NS5FJ639738 | DENV | NS5FJ882600 | DENV | NS5FJ373304 |
| DENV | NS5AY618993 | DENV | NS5FJ850057 | DENV | NS5FJ639723 |
| DENV | NS5FJ639764 | DENV | NS5GQ199879 | DENV | NS5EU569691 |
| DENV | NS5FJ639737 | DENV | NS5FJ882585 | DENV | NS5DQ675524 |
| DENV | NS5AY776330 | DENV | NS5GQ199876 | DENV | NS5EU081203 |
| DENV | NS5AY618991 | DENV | NS5GQ199885 | DENV | NS5EU482564 |
| DENV | NS5FJ639736 | DENV | NS5FJ882592 | DENV | NS5FJ182039 |
| DENV | NS5FJ639739 | DENV | NS5GQ199882 | DENV | NS5EU482453 |
| DENV | NS5AF326826 | DENV | NS5FJ882591 | DENV | NS5FJ639779 |
| DENV | NS5AY947539 | DENV | NS5FJ882589 | DENV | NS5EU081183 |
| DENV | NS5EU854299 | DENV | NS5GQ868642 | DENV | NS5EU529690 |
| DENV | NS5AY618990 | DENV | NS5GQ868581 | DENV | NS5FJ182011 |
| DENV | NS5FJ639748 | DENV | NS5FN429919 | DENV | NS5EU081187 |
| DENV | NS5FJ639744 | DENV | NS5GQ868583 | DENV | NS5EU482461 |
| DENV | NS5EU854301 | DENV | NS5FN429920 | DENV | NS5FJ639803 |
| DENV | NS5FJ639773 | DENV | NS5FN429923 | DENV | NS5AY858047 |

FIG. 70-181

| Virus | Protein | Accession No. | Virus | Protein | Accession No. | Virus | Protein | Accession No. |
|---|---|---|---|---|---|---|---|---|
| DENV | NS5 | FJ639774 | DENV | NS5 | EU687226 | DENV | NS5 | EU081192 |
| DENV | NS5 | FJ639726 | DENV | NS5 | FJ639715 | DENV | NS5 | FJ432731 |
| DENV | NS5 | AY858037 | DENV | NS5 | AY676352 | DENV | NS5 | AB189126 |
| DENV | NS5 | EU081215 | DENV | NS5 | AY858043 | DENV | NS5 | FJ024471 |
| DENV | NS5 | FJ639785 | DENV | NS5 | EU081196 | DENV | NS5 | FJ639769 |
| DENV | NS5 | FJ639761 | DENV | NS5 | FJ432741 | DENV | NS5 | FJ547078 |
| DENV | NS5 | EU569688 | DENV | NS5 | EU726773 | DENV | NS5 | FJ547080 |
| DENV | NS5 | DQ675533 | DENV | NS5 | EU482555 | DENV | NS5 | AY744679 |
| DENV | NS5 | FJ410177 | DENV | NS5 | DQ401694 | DENV | NS5 | EU081217 |
| DENV | NS5 | FJ478456 | DENV | NS5 | EU081216 | DENV | NS5 | AY858045 |
| DENV | NS5 | EU081195 | DENV | NS5 | EU529704 | DENV | NS5 | FJ547084 |
| DENV | NS5 | EU081221 | DENV | NS5 | FJ639777 | DENV | NS5 | DQ675521 |
| DENV | NS5 | EU529689 | DENV | NS5 | FJ639730 | DENV | NS5 | AY776329 |
| DENV | NS5 | EU660408 | DENV | NS5 | EU081190 | DENV | NS5 | FJ639789 |
| DENV | NS5 | EU687219 | DENV | NS5 | EU529703 | DENV | NS5 | AY496871 |
| DENV | NS5 | FJ639780 | DENV | NS5 | FJ639725 | DENV | NS5 | EU781136 |
| DENV | NS5 | EU687196 | DENV | NS5 | EU081205 | DENV | NS5 | FJ182013 |
| DENV | NS5 | EF643017 | DENV | NS5 | AY876494 | DENV | NS5 | EU596492 |
| DENV | NS5 | FJ373303 | DENV | NS5 | FJ639747 | DENV | NS5 | EU726774 |
| DENV | NS5 | FJ639729 | DENV | NS5 | FJ373302 | DENV | NS5 | EU081198 |
| DENV | NS5 | FJ639775 | DENV | NS5 | FJ639778 | DENV | NS5 | FJ639728 |
| DENV | NS5 | FJ461322 | DENV | NS5 | DQ401692 | DENV | NS5 | DQ675530 |
| DENV | NS5 | FJ390371 | DENV | NS5 | FJ182038 | DENV | NS5 | EU660409 |
| DENV | NS5 | AY858046 | DENV | NS5 | EU081220 | DENV | NS5 | EU081206 |
| DENV | NS5 | EU482455 | DENV | NS5 | AY923865 | DENV | NS5 | EU081222 |
| DENV | NS5 | AY744680 | DENV | NS5 | EU081188 | DENV | NS5 | EU660407 |
| DENV | NS5 | FJ182015 | DENV | NS5 | FJ461337 | DENV | NS5 | M93130 |
| DENV | NS5 | FJ562103 | DENV | NS5 | EU081224 | DENV | NS5 | EU529687 |
| DENV | NS5 | FJ639792 | DENV | NS5 | EU081207 | DENV | NS5 | DQ675523 |
| DENV | NS5 | DQ675527 | DENV | NS5 | FJ639750 | DENV | NS5 | FJ432722 |
| DENV | NS5 | FJ547066 | DENV | NS5 | AB189128 | DENV | NS5 | EU482559 |
| DENV | NS5 | EU529698 | DENV | NS5 | AY676353 | DENV | NS5 | FJ639721 |
| DENV | NS5 | EU726769 | DENV | NS5 | EU081209 | DENV | NS5 | AY744682 |
| DENV | NS5 | AY676349 | DENV | NS5 | FJ639772 | DENV | NS5 | EU081184 |
| DENV | NS5 | EU529688 | DENV | NS5 | FJ182040 | DENV | NS5 | FJ639805 |
| DENV | NS5 | EU482558 | DENV | NS5 | AY648961 | DENV | NS5 | FJ547074 |
| DENV | NS5 | FJ547070 | DENV | NS5 | FJ410178 | DENV | NS5 | EU529685 |
| DENV | NS5 | EU687198 | DENV | NS5 | EU529699 | DENV | NS5 | DQ401695 |
| DENV | NS5 | FJ639817 | DENV | NS5 | EU081199 | DENV | NS5 | FJ432743 |
| DENV | NS5 | EU081202 | DENV | NS5 | FJ639786 | DENV | NS5 | EU854291 |
| DENV | NS5 | EU081225 | DENV | NS5 | FJ639768 | DENV | NS5 | FJ182008 |
| DENV | NS5 | DQ675520 | DENV | NS5 | FJ639731 | DENV | NS5 | FJ547062 |
| DENV | NS5 | EU854298 | DENV | NS5 | FJ390373 | DENV | NS5 | FJ024467 |
| DENV | NS5 | FJ205870 | DENV | NS5 | FJ639800 | DENV | NS5 | EU687239 |
| DENV | NS5 | FJ639793 | DENV | NS5 | FJ547079 | DENV | NS5 | FJ024468 |
| DENV | NS5 | DQ675532 | DENV | NS5 | FJ547072 | DENV | NS5 | AY496874 |
| DENV | NS5 | FJ024470 | DENV | NS5 | EU081219 | DENV | NS5 | FJ547061 |
| DENV | NS5 | EU081210 | DENV | NS5 | EU596493 | DENV | NS5 | FJ547076 |

FIG. 70-182

| Virus | Protein | Accession No. | Virus | Protein | Accession No. | Virus | Protein | Accession No. |
|---|---|---|---|---|---|---|---|---|
| DENV | NS5 | FJ639767 | DENV | NS5 | FJ024466 | DENV | NS5 | FJ639722 |
| DENV | NS5 | AB189125 | DENV | NS5 | FJ639795 | DENV | NS5 | FJ639782 |
| DENV | NS5 | AF317645 | DENV | NS5 | FJ024465 | DENV | NS5 | AY858042 |
| DENV | NS5 | AB189127 | DENV | NS5 | EU726768 | DENV | NS5 | EU081185 |
| DENV | NS5 | EU781137 | DENV | NS5 | FJ639720 | DENV | NS5 | FJ390377 |
| DENV | NS5 | DQ675522 | DENV | NS5 | EU529696 | DENV | NS5 | FJ639763 |
| DENV | NS5 | EU482614 | DENV | NS5 | FJ639810 | DENV | NS5 | FJ639760 |
| DENV | NS5 | AB214879 | DENV | NS5 | AY744681 | DENV | NS5 | FJ182009 |
| DENV | NS5 | FJ639765 | DENV | NS5 | FJ639724 | DENV | NS5 | EU529697 |
| DENV | NS5 | EU081211 | DENV | NS5 | EU482595 | DENV | NS5 | DQ675529 |
| DENV | NS5 | FJ639787 | DENV | NS5 | AY676351 | DENV | NS5 | FJ639727 |
| DENV | NS5 | FJ639784 | DENV | NS5 | DQ401689 | DENV | NS5 | FJ461329 |
| DENV | NS5 | EU569690 | DENV | NS5 | FJ182005 | DENV | NS5 | EU482457 |
| DENV | NS5 | EU081223 | DENV | NS5 | FJ547085 | DENV | NS5 | FJ639827 |
| DENV | NS5 | FJ639816 | DENV | NS5 | EU081193 | DENV | NS5 | EU687197 |
| DENV | NS5 | AY496873 | DENV | NS5 | FJ639751 | DENV | NS5 | FJ639801 |
| DENV | NS5 | FJ182010 | DENV | NS5 | DQ675525 | DENV | NS5 | FJ410176 |
| DENV | NS5 | AY099337 | DENV | NS5 | FJ639826 | DENV | NS5 | EU081218 |
| DENV | NS5 | AY496879 | DENV | NS5 | EU482458 | DENV | NS5 | AY744684 |
| DENV | NS5 | EU482462 | DENV | NS5 | EU081204 | DENV | NS5 | FJ390376 |
| DENV | NS5 | FJ639825 | DENV | NS5 | EU529691 | DENV | NS5 | FJ639781 |
| DENV | NS5 | AY766104 | DENV | NS5 | FJ639719 | DENV | NS5 | DQ675528 |
| DENV | NS5 | FJ182007 | DENV | NS5 | FJ182037 | DENV | NS5 | FJ639766 |
| DENV | NS5 | DQ401693 | DENV | NS5 | EU482612 | DENV | NS5 | EU687221 |
| DENV | NS5 | DQ675531 | DENV | NS5 | EU482596 | DENV | NS5 | EU081197 |
| DENV | NS5 | FJ461326 | DENV | NS5 | EU081208 | DENV | NS5 | FJ639755 |
| DENV | NS5 | FJ373306 | DENV | NS5 | EU081201 | DENV | NS5 | FJ639798 |
| DENV | NS5 | EU569689 | DENV | NS5 | FJ639757 | DENV | NS5 | FJ639758 |
| DENV | NS5 | AY858041 | DENV | NS5 | FJ639713 | DENV | NS5 | EU687218 |
| DENV | NS5 | EU482566 | DENV | NS5 | AY744685 | DENV | NS5 | EU081189 |
| DENV | NS5 | EF629370 | DENV | NS5 | FJ182041 | DENV | NS5 | FJ639759 |
| DENV | NS5 | AY496877 | DENV | NS5 | FJ562099 | DENV | NS5 | EU081212 |
| DENV | NS5 | FJ562102 | DENV | NS5 | FJ562100 | DENV | NS5 | EU482460 |
| DENV | NS5 | EF629367 | DENV | NS5 | FJ547081 | DENV | NS5 | FJ547075 |
| DENV | NS5 | FJ547077 | DENV | NS5 | AY858044 | DENV | NS5 | AY676350 |
| DENV | NS5 | FJ639770 | DENV | NS5 | FJ639714 | DENV | NS5 | EU854292 |
| DENV | NS5 | EU081182 | DENV | NS5 | EU529686 | DENV | NS5 | EU660410 |
| DENV | NS5 | EU596494 | DENV | NS5 | FJ410229 | DENV | NS5 | FJ432728 |
| DENV | NS5 | FJ639749 | DENV | NS5 | FJ547073 | DENV | NS5 | FJ024469 |
| DENV | NS5 | EU726771 | DENV | NS5 | FJ639791 | DENV | NS5 | AY858048 |
| DENV | NS5 | FJ639746 | DENV | NS5 | EU529692 | DENV | NS5 | FJ639804 |
| DENV | NS5 | EU081214 | DENV | NS5 | FJ547082 | DENV | NS5 | EU529705 |
| DENV | NS5 | AY858039 | DENV | NS5 | EU367962 | DENV | NS5 | EU482454 |
| DENV | NS5 | EU660411 | DENV | NS5 | FJ390375 | DENV | NS5 | DQ401691 |
| DENV | NS5 | EU482563 | DENV | NS5 | AY858040 | DENV | NS5 | FJ639771 |
| DENV | NS5 | AY744678 | DENV | NS5 | FJ547069 | DENV | NS5 | FJ639754 |
| DENV | NS5 | FJ461334 | DENV | NS5 | FJ562107 | DENV | NS5 | EU482459 |
| DENV | NS5 | EU660420 | DENV | NS5 | FJ461338 | DENV | NS5 | FJ205871 |

FIG. 70-183

| Virus | Protein | Accession No. | Virus | Protein | Accession No. | Virus | Protein | Accession No. |
|---|---|---|---|---|---|---|---|---|
| DENV | NS5 | EU081186 | DENV | NS5 | FJ898458 | DENV | NS5 | FJ744726 |
| DENV | NS5 | FJ547083 | DENV | NS5 | FJ744740 | DENV | NS5 | FJ898476 |
| DENV | NS5 | FJ639762 | DENV | NS5 | GQ199889 | DENV | NS5 | FJ898468 |
| DENV | NS5 | FJ547071 | DENV | NS5 | GQ199886 | DENV | NS5 | FJ744733 |
| DENV | NS5 | EU529702 | DENV | NS5 | FJ687448 | DENV | NS5 | GQ199871 |
| DENV | NS5 | EU687234 | DENV | NS5 | FJ744732 | DENV | NS5 | GQ199887 |
| DENV | NS5 | FJ182006 | DENV | NS5 | FJ898446 | DENV | NS5 | GQ199864 |
| DENV | NS5 | AY662691 | DENV | NS5 | GQ199861 | DENV | NS5 | FJ744737 |
| DENV | NS5 | EU081213 | DENV | NS5 | FJ898455 | DENV | NS5 | FJ898456 |
| DENV | NS5 | EU081181 | DENV | NS5 | FJ882573 | DENV | NS5 | FJ850083 |
| DENV | NS5 | FJ390372 | DENV | NS5 | FJ898463 | DENV | NS5 | FJ744731 |
| DENV | NS5 | EU482613 | DENV | NS5 | FJ898447 | DENV | NS5 | FJ850079 |
| DENV | NS5 | FJ639790 | DENV | NS5 | FJ882571 | DENV | NS5 | FJ744700 |
| DENV | NS5 | DQ675519 | DENV | NS5 | FJ898462 | DENV | NS5 | FJ882576 |
| DENV | NS5 | EU687233 | DENV | NS5 | GQ199870 | DENV | NS5 | GQ199891 |
| DENV | NS5 | EF629369 | DENV | NS5 | FJ898471 | DENV | NS5 | FJ850111 |
| DENV | NS5 | FJ182004 | DENV | NS5 | FJ882575 | DENV | NS5 | FJ850056 |
| DENV | NS5 | FJ639799 | DENV | NS5 | FJ744738 | DENV | NS5 | FJ744727 |
| DENV | NS5 | FJ562097 | DENV | NS5 | FJ898440 | DENV | NS5 | FJ873813 |
| DENV | NS5 | FJ639712 | DENV | NS5 | FJ898444 | DENV | NS5 | AY770511 |
| DENV | NS5 | EF629366 | DENV | NS5 | GQ199865 | DENV | NS5 | FJ850098 |
| DENV | NS5 | EU726772 | DENV | NS5 | GQ252678 | DENV | NS5 | FJ810414 |
| DENV | NS5 | DQ675526 | DENV | NS5 | FJ850110 | DENV | NS5 | FJ850109 |
| DENV | NS5 | EU482452 | DENV | NS5 | FJ744734 | DENV | NS5 | FJ850052 |
| DENV | NS5 | AY858038 | DENV | NS5 | FJ898457 | DENV | NS5 | FJ850086 |
| DENV | NS5 | EU482456 | DENV | NS5 | FJ744736 | DENV | NS5 | FJ882572 |
| DENV | NS5 | EU081200 | DENV | NS5 | FJ810416 | DENV | NS5 | FJ882578 |
| DENV | NS5 | FJ639756 | DENV | NS5 | FJ898474 | DENV | NS5 | FJ850092 |
| DENV | NS5 | AY744677 | DENV | NS5 | FJ850094 | DENV | NS5 | AB214882 |
| DENV | NS5 | AY744683 | DENV | NS5 | FJ898470 | DENV | NS5 | AB214880 |
| DENV | NS5 | FJ639753 | DENV | NS5 | FJ810413 | DENV | NS5 | AB214881 |
| DENV | NS5 | FJ639716 | DENV | NS5 | FJ744735 | DENV | NS5 | FB667400 |
| DENV | NS5 | EU081194 | DENV | NS5 | GQ199860 | DENV | NS5 | GQ868587 |
| DENV | NS5 | FJ639776 | DENV | NS5 | FJ898464 | DENV | NS5 | EU932688 |
| DENV | NS5 | FJ898469 | DENV | NS5 | FJ744729 | DENV | NS5 | FN429906 |
| DENV | NS5 | GQ252674 | DENV | NS5 | FJ898472 | DENV | NS5 | GU131916 |
| DENV | NS5 | FJ850055 | DENV | NS5 | GQ199862 | DENV | NS5 | GU131953 |
| DENV | NS5 | FJ898475 | DENV | NS5 | FJ873812 | DENV | NS5 | GU131850 |
| DENV | NS5 | FJ744739 | DENV | NS5 | FJ898441 | DENV | NS5 | FN429900 |
| DENV | NS5 | NC_001475 | DENV | NS5 | FJ850048 | DENV | NS5 | GQ868576 |
| DENV | NS5 | GQ199863 | DENV | NS5 | FJ850080 | DENV | NS5 | GU131946 |
| DENV | NS5 | FJ850089 | DENV | NS5 | FJ882577 | DENV | NS5 | GU131866 |
| DENV | NS5 | FJ898442 | DENV | NS5 | FJ850096 | DENV | NS5 | GU131862 |
| DENV | NS5 | FJ898459 | DENV | NS5 | FJ898473 | DENV | NS5 | GU131852 |
| DENV | NS5 | FJ850049 | DENV | NS5 | FJ882574 | DENV | NS5 | FN429897 |
| DENV | NS5 | FJ744730 | DENV | NS5 | FJ898445 | DENV | NS5 | GQ868571 |
| DENV | NS5 | FJ850097 | DENV | NS5 | GQ199888 | DENV | NS5 | GQ868626 |
| DENV | NS5 | FJ744728 | DENV | NS5 | FJ898443 | DENV | NS5 | GQ868546 |

FIG. 70-184

| Virus | Protein | Accession No. | Virus | Protein | Accession No. | Virus | Protein | Accession No. |
|---|---|---|---|---|---|---|---|---|
| DENV | NS5 | FN429904 | DENV | NS5 | GU131950 | DENV | NS5 | GU131857 |
| DENV | NS5 | GU131904 | DENV | NS5 | GQ868634 | DENV | NS5 | GQ868629 |
| DENV | NS5 | GU131935 | DENV | NS5 | GU131873 | DENV | NS5 | GU131905 |
| DENV | NS5 | GU131910 | DENV | NS5 | GQ868593 | DENV | NS5 | GU131848 |
| DENV | NS5 | GU131918 | DENV | NS5 | GQ868572 | DENV | NS5 | FB667402 |
| DENV | NS5 | GU131937 | DENV | NS5 | DQ863638 | DENV | NS5 | FB667403 |
| DENV | NS5 | GU131868 | DENV | NS5 | GU131876 | DENV | NS5 | FJ177308 |
| DENV | NS5 | GU131951 | DENV | NS5 | EU932687 | DENV | NS5 | FB667404 |
| DENV | NS5 | FN429910 | DENV | NS5 | GU189648 | DENV | NS5 | FB667398 |
| DENV | NS5 | GU131854 | DENV | NS5 | FN429913 | DENV | NS5 | FB667399 |
| DENV | NS5 | GU131943 | DENV | NS5 | GU131867 | DENV | NS5 | CS805345 |
| DENV | NS5 | GU131861 | DENV | NS5 | GQ868575 | DENV | NS5 | EU482634 |
| DENV | NS5 | GU131871 | DENV | NS5 | GQ868617 | DENV | NS5 | FJ373301 |
| DENV | NS5 | GU131933 | DENV | NS5 | GQ868616 | DENV | NS5 | EU482582 |
| DENV | NS5 | GU131877 | DENV | NS5 | GU131870 | DENV | NS5 | EU687227 |
| DENV | NS5 | GU131911 | DENV | NS5 | GU131869 | DENV | NS5 | EU569710 |
| DENV | NS5 | GQ868628 | DENV | NS5 | GU131846 | DENV | NS5 | EF105383 |
| DENV | NS5 | GQ868574 | DENV | NS5 | GU131934 | DENV | NS5 | EU687249 |
| DENV | NS5 | GU131941 | DENV | NS5 | GQ868627 | DENV | NS5 | EU687242 |
| DENV | NS5 | GQ868577 | DENV | NS5 | FN429908 | DENV | NS5 | EU482658 |
| DENV | NS5 | GQ868547 | DENV | NS5 | GU131872 | DENV | NS5 | FJ639710 |
| DENV | NS5 | GU131845 | DENV | NS5 | FN429901 | DENV | NS5 | EU482748 |
| DENV | NS5 | FN429899 | DENV | NS5 | GU131917 | DENV | NS5 | FJ205885 |
| DENV | NS5 | FN429902 | DENV | NS5 | GU131875 | DENV | NS5 | EU482470 |
| DENV | NS5 | FN429917 | DENV | NS5 | FN429909 | DENV | NS5 | EU482468 |
| DENV | NS5 | FN429915 | DENV | NS5 | FN429911 | DENV | NS5 | FJ410195 |
| DENV | NS5 | GU131855 | DENV | NS5 | GU131945 | DENV | NS5 | AB122021 |
| DENV | NS5 | FN429896 | DENV | NS5 | FN429916 | DENV | NS5 | EU482469 |
| DENV | NS5 | GU131844 | DENV | NS5 | FN429914 | DENV | NS5 | FM210231 |
| DENV | NS5 | GQ868573 | DENV | NS5 | GU131942 | DENV | NS5 | FJ639831 |
| DENV | NS5 | GQ868586 | DENV | NS5 | GU131849 | DENV | NS5 | EU482657 |
| DENV | NS5 | GU131858 | DENV | NS5 | GU131952 | DENV | NS5 | EU482674 |
| DENV | NS5 | FN429903 | DENV | NS5 | GU131915 | DENV | NS5 | EU482753 |
| DENV | NS5 | GU131874 | DENV | NS5 | GQ868578 | DENV | NS5 | DQ645545 |
| DENV | NS5 | GU131914 | DENV | NS5 | GQ868548 | DENV | NS5 | FJ639835 |
| DENV | NS5 | FN429912 | DENV | NS5 | GU131913 | DENV | NS5 | FJ432726 |
| DENV | NS5 | FN429898 | DENV | NS5 | GU131940 | DENV | NS5 | EU482607 |
| DENV | NS5 | GU131851 | DENV | NS5 | FN429918 | DENV | NS5 | EU482660 |
| DENV | NS5 | GU131938 | DENV | NS5 | FN429905 | DENV | NS5 | EU482766 |
| DENV | NS5 | GU131853 | DENV | NS5 | GU131907 | DENV | NS5 | AB189124 |
| DENV | NS5 | FN429907 | DENV | NS5 | GU131860 | DENV | NS5 | AF100461 |
| DENV | NS5 | GU131865 | DENV | NS5 | GU131954 | DENV | NS5 | EU482600 |
| DENV | NS5 | GU131906 | DENV | NS5 | GU131856 | DENV | NS5 | EU687230 |
| DENV | NS5 | GU131944 | DENV | NS5 | GU131847 | DENV | NS5 | EU482633 |
| DENV | NS5 | GU131936 | DENV | NS5 | GU131909 | DENV | NS5 | EU482726 |
| DENV | NS5 | GU131903 | DENV | NS5 | GU131939 | DENV | NS5 | EU482557 |
| DENV | NS5 | GU131908 | DENV | NS5 | GU131912 | DENV | NS5 | EU482444 |
| DENV | NS5 | GU131878 | DENV | NS5 | GU131859 | DENV | NS5 | FJ205877 |

FIG. 70-185

| Virus | Protein | Accession No. | Virus | Protein | Accession No. | Virus | Protein | Accession No. |
|---|---|---|---|---|---|---|---|---|
| DENV | NS5 | EU482621 | DENV | NS5 | FJ639703 | DENV | NS5 | FJ410208 |
| DENV | NS5 | EU482736 | DENV | NS5 | EU482647 | DENV | NS5 | EU569716 |
| DENV | NS5 | EU596497 | DENV | NS5 | EU596487 | DENV | NS5 | EU482786 |
| DENV | NS5 | M84728 | DENV | NS5 | FJ639788 | DENV | NS5 | AF276619 |
| DENV | NS5 | EU482549 | DENV | NS5 | FM210206 | DENV | NS5 | EU482625 |
| DENV | NS5 | FM210228 | DENV | NS5 | DQ645556 | DENV | NS5 | EU687248 |
| DENV | NS5 | EU687216 | DENV | NS5 | AF169682 | DENV | NS5 | EU482662 |
| DENV | NS5 | EU596489 | DENV | NS5 | AY858035 | DENV | NS5 | EU569708 |
| DENV | NS5 | EU482576 | DENV | NS5 | EU687220 | DENV | NS5 | FM210240 |
| DENV | NS5 | AF100460 | DENV | NS5 | EU482636 | DENV | NS5 | EU482777 |
| DENV | NS5 | AF169679 | DENV | NS5 | EU482650 | DENV | NS5 | FJ639705 |
| DENV | NS5 | EU482665 | DENV | NS5 | EU482704 | DENV | NS5 | EU482669 |
| DENV | NS5 | EU482586 | DENV | NS5 | EU482661 | DENV | NS5 | DQ645553 |
| DENV | NS5 | AF169681 | DENV | NS5 | EU569699 | DENV | NS5 | FM210210 |
| DENV | NS5 | FM210205 | DENV | NS5 | EU482580 | DENV | NS5 | EF457904 |
| DENV | NS5 | EU482767 | DENV | NS5 | FM210215 | DENV | NS5 | FJ410237 |
| DENV | NS5 | EU687240 | DENV | NS5 | FJ639733 | DENV | NS5 | AY702035 |
| DENV | NS5 | AF169686 | DENV | NS5 | EF105389 | DENV | NS5 | EU482757 |
| DENV | NS5 | EU687244 | DENV | NS5 | EF105384 | DENV | NS5 | EU596499 |
| DENV | NS5 | EU482683 | DENV | NS5 | EU677146 | DENV | NS5 | EU482543 |
| DENV | NS5 | FJ373299 | DENV | NS5 | EU596498 | DENV | NS5 | EU687217 |
| DENV | NS5 | EU482601 | DENV | NS5 | FJ410288 | DENV | NS5 | EU482646 |
| DENV | NS5 | EU660404 | DENV | NS5 | FJ373300 | DENV | NS5 | EU482746 |
| DENV | NS5 | EU482651 | DENV | NS5 | EU482702 | DENV | NS5 | FJ410217 |
| DENV | NS5 | EU482787 | DENV | NS5 | FJ205879 | DENV | NS5 | FJ639707 |
| DENV | NS5 | FM210216 | DENV | NS5 | EU569697 | DENV | NS5 | EU482637 |
| DENV | NS5 | EU569694 | DENV | NS5 | EU482691 | DENV | NS5 | EU482699 |
| DENV | NS5 | EU482648 | DENV | NS5 | FJ461309 | DENV | NS5 | EU482583 |
| DENV | NS5 | EU482620 | DENV | NS5 | EU482608 | DENV | NS5 | FJ639717 |
| DENV | NS5 | EU482471 | DENV | NS5 | EU726776 | DENV | NS5 | EU687223 |
| DENV | NS5 | EU482644 | DENV | NS5 | EU081177 | DENV | NS5 | AY702036 |
| DENV | NS5 | FJ639833 | DENV | NS5 | FM210213 | DENV | NS5 | EU482542 |
| DENV | NS5 | EU482445 | DENV | NS5 | EU854293 | DENV | NS5 | EU482587 |
| DENV | NS5 | EU482606 | DENV | NS5 | EU482632 | DENV | NS5 | EU482667 |
| DENV | NS5 | FM210236 | DENV | NS5 | FM210234 | DENV | NS5 | EU482695 |
| DENV | NS5 | EU482639 | DENV | NS5 | EU482745 | DENV | NS5 | EU569720 |
| DENV | NS5 | EU003591 | DENV | NS5 | EU482593 | DENV | NS5 | AY702037 |
| DENV | NS5 | EU482547 | DENV | NS5 | EU569718 | DENV | NS5 | AY858036 |
| DENV | NS5 | FJ478459 | DENV | NS5 | EU482719 | DENV | NS5 | DQ645544 |
| DENV | NS5 | FJ639837 | DENV | NS5 | EF051521 | DENV | NS5 | FJ639822 |
| DENV | NS5 | FJ390387 | DENV | NS5 | FM210238 | DENV | NS5 | AF100466 |
| DENV | NS5 | DQ645547 | DENV | NS5 | FJ478455 | DENV | NS5 | FJ410215 |
| DENV | NS5 | EU596496 | DENV | NS5 | AF100465 | DENV | NS5 | EU569705 |
| DENV | NS5 | EU482597 | DENV | NS5 | EU529694 | DENV | NS5 | FM210241 |
| DENV | NS5 | EU482463 | DENV | NS5 | EU081178 | DENV | NS5 | FM210221 |
| DENV | NS5 | EU482553 | DENV | NS5 | EU482676 | DENV | NS5 | EU687228 |
| DENV | NS5 | EU482548 | DENV | NS5 | FJ639709 | DENV | NS5 | EU482703 |
| DENV | NS5 | EU482641 | DENV | NS5 | FM210208 | DENV | NS5 | EU529700 |

FIG. 70-186

| Virus | Protein | Accession No. | Virus | Protein | Accession No. | Virus | Protein | Accession No. |
|---|---|---|---|---|---|---|---|---|
| DENV | NS5 | DQ645555 | DENV | NS5 | FM210245 | DENV | NS5 | EU687238 |
| DENV | NS5 | EU687231 | DENV | NS5 | FM210214 | DENV | NS5 | M84727 |
| DENV | NS5 | EU660406 | DENV | NS5 | EU482685 | DENV | NS5 | EU482763 |
| DENV | NS5 | EU687241 | DENV | NS5 | EU482570 | DENV | NS5 | EU482758 |
| DENV | NS5 | FJ639700 | DENV | NS5 | DQ645540 | DENV | NS5 | FJ639830 |
| DENV | NS5 | FJ639711 | DENV | NS5 | EU660414 | DENV | NS5 | EU482754 |
| DENV | NS5 | U87412 | DENV | NS5 | FJ024477 | DENV | NS5 | FM210218 |
| DENV | NS5 | EU482599 | DENV | NS5 | AF100463 | DENV | NS5 | FJ410224 |
| DENV | NS5 | EU482654 | DENV | NS5 | DQ645546 | DENV | NS5 | FJ410193 |
| DENV | NS5 | EU569721 | DENV | NS5 | EU569703 | DENV | NS5 | EU056811 |
| DENV | NS5 | FJ390385 | DENV | NS5 | EU482652 | DENV | NS5 | EU482774 |
| DENV | NS5 | EU482589 | DENV | NS5 | EU596490 | DENV | NS5 | EU482568 |
| DENV | NS5 | EU482551 | DENV | NS5 | EU482693 | DENV | NS5 | EU482588 |
| DENV | NS5 | EU660400 | DENV | NS5 | EU482734 | DENV | NS5 | EU482475 |
| DENV | NS5 | EU482679 | DENV | NS5 | FM210202 | DENV | NS5 | AF489932 |
| DENV | NS5 | AF204177 | DENV | NS5 | EU482729 | DENV | NS5 | FM210211 |
| DENV | NS5 | FJ461311 | DENV | NS5 | AF169680 | DENV | NS5 | EU687246 |
| DENV | NS5 | EU569700 | DENV | NS5 | EU482623 | DENV | NS5 | FJ390389 |
| DENV | NS5 | EU482737 | DENV | NS5 | EU569693 | DENV | NS5 | EU482464 |
| DENV | NS5 | EU482573 | DENV | NS5 | EU482590 | DENV | NS5 | EU482697 |
| DENV | NS5 | AY702040 | DENV | NS5 | FJ639834 | DENV | NS5 | EU482765 |
| DENV | NS5 | DQ181803 | DENV | NS5 | EU482449 | DENV | NS5 | FM210209 |
| DENV | NS5 | EU482741 | DENV | NS5 | EU687237 | DENV | NS5 | EU482474 |
| DENV | NS5 | EU660399 | DENV | NS5 | EF105381 | DENV | NS5 | EU596484 |
| DENV | NS5 | EU482784 | DENV | NS5 | EU482578 | DENV | NS5 | EU677138 |
| DENV | NS5 | EU482584 | DENV | NS5 | EU482781 | DENV | NS5 | EU621672 |
| DENV | NS5 | EU482670 | DENV | NS5 | EU596485 | DENV | NS5 | AF359579 |
| DENV | NS5 | DQ181801 | DENV | NS5 | EU687224 | DENV | NS5 | EU482645 |
| DENV | NS5 | EU482603 | DENV | NS5 | FJ461321 | DENV | NS5 | EU482760 |
| DENV | NS5 | EU482769 | DENV | NS5 | FJ390390 | DENV | NS5 | FJ639732 |
| DENV | NS5 | FM210227 | DENV | NS5 | EU482562 | DENV | NS5 | FM210229 |
| DENV | NS5 | AY744147 | DENV | NS5 | EF105390 | DENV | NS5 | EU482684 |
| DENV | NS5 | EU482656 | DENV | NS5 | EU482782 | DENV | NS5 | EF105378 |
| DENV | NS5 | EU529706 | DENV | NS5 | EU482682 | DENV | NS5 | EU482681 |
| DENV | NS5 | EU687212 | DENV | NS5 | EU056810 | DENV | NS5 | FJ547090 |
| DENV | NS5 | DQ645541 | DENV | NS5 | EU687236 | DENV | NS5 | EU482447 |
| DENV | NS5 | DQ181800 | DENV | NS5 | EU482448 | DENV | NS5 | EU482624 |
| DENV | NS5 | EU482721 | DENV | NS5 | FJ639698 | DENV | NS5 | AF119661 |
| DENV | NS5 | EU677145 | DENV | NS5 | EU482630 | DENV | NS5 | EU660413 |
| DENV | NS5 | EU482450 | DENV | NS5 | EU359009 | DENV | NS5 | AF169685 |
| DENV | NS5 | EU482541 | DENV | NS5 | EU482768 | DENV | NS5 | EU482771 |
| DENV | NS5 | AF169688 | DENV | NS5 | EU482672 | DENV | NS5 | EU482604 |
| DENV | NS5 | M19197 | DENV | NS5 | EU569711 | DENV | NS5 | FJ410223 |
| DENV | NS5 | EU482594 | DENV | NS5 | EU482627 | DENV | NS5 | EU482739 |
| DENV | NS5 | DQ645554 | DENV | NS5 | EU569715 | DENV | NS5 | EU687243 |
| DENV | NS5 | DQ181798 | DENV | NS5 | EU482678 | DENV | NS5 | EU482720 |
| DENV | NS5 | AY702038 | DENV | NS5 | DQ181799 | DENV | NS5 | EU482730 |
| DENV | NS5 | EU596495 | DENV | NS5 | EU687235 | DENV | NS5 | EU482779 |

FIG. 70-187

| Virus | Protein Accession No. | Virus | Protein Accession No. | Virus | Protein Accession No. |
|---|---|---|---|---|---|
| DENV | NS5AB122020 | DENV | NS5DQ181797 | DENV | NS5EU482728 |
| DENV | NS5FM210244 | DENV | NS5EU569701 | DENV | NS5EU596500 |
| DENV | NS5AF100469 | DENV | NS5EU482773 | DENV | NS5EU482671 |
| DENV | NS5FJ410221 | DENV | NS5EU482722 | DENV | NS5EU179859 |
| DENV | NS5EU482626 | DENV | NS5EU482635 | DENV | NS5EU482705 |
| DENV | NS5EU482788 | DENV | NS5DQ645549 | DENV | NS5EU482552 |
| DENV | NS5FJ410219 | DENV | NS5EU482629 | DENV | NS5EU482546 |
| DENV | NS5AF100462 | DENV | NS5EU596488 | DENV | NS5EU482642 |
| DENV | NS5EU482696 | DENV | NS5FJ639836 | DENV | NS5EU482579 |
| DENV | NS5EU482544 | DENV | NS5EU482733 | DENV | NS5M20558 |
| DENV | NS5EU482640 | DENV | NS5EU677143 | DENV | NS5EU482775 |
| DENV | NS5FJ182012 | DENV | NS5EU482653 | DENV | NS5EU596491 |
| DENV | NS5DQ645548 | DENV | NS5AF208496 | DENV | NS5FJ639708 |
| DENV | NS5FJ639701 | DENV | NS5EU482565 | DENV | NS5FM210220 |
| DENV | NS5EU482655 | DENV | NS5EU482598 | DENV | NS5EU569717 |
| DENV | NS5AB189122 | DENV | NS5M29095 | DENV | NS5EF105379 |
| DENV | NS5DQ181804 | DENV | NS5EU660415 | DENV | NS5EU569712 |
| DENV | NS5EU482732 | DENV | NS5FM210239 | DENV | NS5EU482755 |
| DENV | NS5DQ645543 | DENV | NS5EU687213 | DENV | NS5DQ181805 |
| DENV | NS5FJ639832 | DENV | NS5EU677144 | DENV | NS5FM210207 |
| DENV | NS5FJ226066 | DENV | NS5FM210243 | DENV | NS5FM210233 |
| DENV | NS5AF169687 | DENV | NS5AF100459 | DENV | NS5EU687199 |
| DENV | NS5EU482752 | DENV | NS5EU482466 | DENV | NS5EU482686 |
| DENV | NS5EU482783 | DENV | NS5FM210230 | DENV | NS5FJ205880 |
| DENV | NS5EU482742 | DENV | NS5FJ410200 | DENV | NS5AY776328 |
| DENV | NS5FJ461314 | DENV | NS5DQ645552 | DENV | NS5EU482675 |
| DENV | NS5EU482688 | DENV | NS5EU482574 | DENV | NS5EU660417 |
| DENV | NS5DQ181802 | DENV | NS5EU482622 | DENV | NS5EU482727 |
| DENV | NS5FJ639809 | DENV | NS5EU482561 | DENV | NS5EU482602 |
| DENV | NS5EU482701 | DENV | NS5EU596486 | DENV | NS5EU482577 |
| DENV | NS5AF204178 | DENV | NS5EU569695 | DENV | NS5EU482756 |
| DENV | NS5FJ639706 | DENV | NS5FJ024461 | DENV | NS5EU529701 |
| DENV | NS5EU482550 | DENV | NS5EU569713 | DENV | NS5FJ639702 |
| DENV | NS5EU482605 | DENV | NS5FM210224 | DENV | NS5EU482772 |
| DENV | NS5EU482554 | DENV | NS5EU482556 | DENV | NS5FM210246 |
| DENV | NS5EU482692 | DENV | NS5EU482731 | DENV | NS5FJ390391 |
| DENV | NS5EU482680 | DENV | NS5EU179858 | DENV | NS5AF100464 |
| DENV | NS5AF169683 | DENV | NS5EU781135 | DENV | NS5FJ547067 |
| DENV | NS5FJ024458 | DENV | NS5EU482743 | DENV | NS5EF105386 |
| DENV | NS5EU482780 | DENV | NS5EU482751 | DENV | NS5EF105387 |
| DENV | NS5EU482750 | DENV | NS5FJ410259 | DENV | NS5EU726775 |
| DENV | NS5EU179857 | DENV | NS5EU482747 | DENV | NS5FJ639704 |
| DENV | NS5EU569698 | DENV | NS5EU687225 | DENV | NS5AF169678 |
| DENV | NS5EU482571 | DENV | NS5FJ639718 | DENV | NS5EU482749 |
| DENV | NS5EU081179 | DENV | NS5EU569707 | DENV | NS5EU482631 |
| DENV | NS5EU482690 | DENV | NS5EU677147 | DENV | NS5EF105388 |
| DENV | NS5EU687215 | DENV | NS5FM210223 | DENV | NS5AB189123 |
| DENV | NS5EU482664 | DENV | NS5EU081180 | DENV | NS5EU482663 |

FIG. 70-188

| Virus | Protein | Accession No. | Virus | Protein | Accession No. | Virus | Protein | Accession No. |
|---|---|---|---|---|---|---|---|---|
| DENV | NS5 | EU677149 | DENV | NS5 | EU482687 | DENV | NS5 | FM210219 |
| DENV | NS5 | EU569719 | DENV | NS5 | EU529693 | DENV | NS5 | EU482723 |
| DENV | NS5 | EU482778 | DENV | NS5 | FJ390384 | DENV | NS5 | FJ639829 |
| DENV | NS5 | DQ645551 | DENV | NS5 | EU482560 | DENV | NS5 | EU482575 |
| DENV | NS5 | EU482689 | DENV | NS5 | EU482761 | DENV | NS5 | AF038402 |
| DENV | NS5 | EU726770 | DENV | NS5 | EU482638 | DENV | NS5 | FJ639783 |
| DENV | NS5 | AB122022 | DENV | NS5 | EU482698 | DENV | NS5 | EU482572 |
| DENV | NS5 | FJ639697 | DENV | NS5 | EU482764 | DENV | NS5 | FJ639734 |
| DENV | NS5 | EU482628 | DENV | NS5 | FJ182014 | DENV | NS5 | EU482762 |
| DENV | NS5 | EU687232 | DENV | NS5 | EU482776 | DENV | NS5 | EU569704 |
| DENV | NS5 | FM210225 | DENV | NS5 | DQ645550 | DENV | NS5 | EU482759 |
| DENV | NS5 | AY037116 | DENV | NS5 | FJ024473 | DENV | NS5 | EU056812 |
| DENV | NS5 | FJ205878 | DENV | NS5 | DQ181806 | DENV | NS5 | FJ410228 |
| DENV | NS5 | AY702034 | DENV | NS5 | FJ461305 | DENV | NS5 | EU482467 |
| DENV | NS5 | FM210232 | DENV | NS5 | FJ024452 | DENV | NS5 | FM210217 |
| DENV | NS5 | AY702039 | DENV | NS5 | EU677141 | DENV | NS5 | FM210212 |
| DENV | NS5 | EU687245 | DENV | NS5 | FJ639828 | DENV | NS5 | EU660405 |
| DENV | NS5 | EU482465 | DENV | NS5 | EU569706 | DENV | NS5 | FJ547064 |
| DENV | NS5 | EU482472 | DENV | NS5 | EU482666 | DENV | NS5 | EU482740 |
| DENV | NS5 | EU569714 | DENV | NS5 | EU482673 | DENV | NS5 | EU482451 |
| DENV | NS5 | EU569692 | DENV | NS5 | FJ024474 | DENV | NS5 | EU482668 |
| DENV | NS5 | FJ410233 | DENV | NS5 | EU687214 | DENV | NS5 | EU687229 |
| DENV | NS5 | AF100467 | DENV | NS5 | FJ410291 | DENV | NS5 | AF169684 |
| DENV | NS5 | EU677148 | DENV | NS5 | FM210242 | DENV | NS5 | FM210235 |
| DENV | NS5 | EF105380 | DENV | NS5 | EU687250 | DENV | NS5 | GQ199874 |
| DENV | NS5 | EU482677 | DENV | NS5 | EU482735 | DENV | NS5 | FJ744745 |
| DENV | NS5 | AF100468 | DENV | NS5 | EU482785 | DENV | NS5 | FJ898467 |
| DENV | NS5 | EU482569 | DENV | NS5 | EU596483 | DENV | NS5 | FJ687444 |
| DENV | NS5 | DQ645542 | DENV | NS5 | EU569702 | DENV | NS5 | FJ810411 |
| DENV | NS5 | EU482643 | DENV | NS5 | FJ410241 | DENV | NS5 | FJ850067 |
| DENV | NS5 | EU482694 | DENV | NS5 | EU482659 | DENV | NS5 | FJ850121 |
| DENV | NS5 | EU482724 | DENV | NS5 | FM210203 | DENV | NS5 | FJ898452 |
| DENV | NS5 | EU482446 | DENV | NS5 | EU482581 | DENV | NS5 | FJ744713 |
| DENV | NS5 | FM210226 | DENV | NS5 | EU569696 | DENV | NS5 | FJ810418 |
| DENV | NS5 | EU482744 | DENV | NS5 | FJ562098 | DENV | NS5 | FJ906962 |
| DENV | NS5 | EU677137 | DENV | NS5 | FM210222 | DENV | NS5 | FJ744721 |
| DENV | NS5 | EU482770 | DENV | NS5 | EU482473 | DENV | NS5 | FJ850107 |
| DENV | NS5 | AF038403 | DENV | NS5 | EU854294 | DENV | NS5 | FJ467493 |
| DENV | NS5 | EU660398 | DENV | NS5 | EU482649 | DENV | NS5 | FJ906966 |
| DENV | NS5 | EU569709 | DENV | NS5 | EU726767 | DENV | NS5 | FJ687446 |
| DENV | NS5 | FM210237 | DENV | NS5 | FJ024454 | DENV | NS5 | FJ906958 |
| DENV | NS5 | EU660416 | DENV | NS5 | FJ639699 | DENV | NS5 | FJ687435 |
| DENV | NS5 | EU677142 | DENV | NS5 | FM210204 | DENV | NS5 | FJ850054 |
| DENV | NS5 | EU482700 | DENV | NS5 | EU529695 | DENV | NS5 | FJ906967 |
| DENV | NS5 | EU482545 | DENV | NS5 | EU687222 | DENV | NS5 | FJ850072 |
| DENV | NS5 | EU482585 | DENV | NS5 | EF105382 | DENV | NS5 | FJ898439 |
| DENV | NS5 | FJ024475 | DENV | NS5 | EU482738 | DENV | NS5 | FJ850088 |
| DENV | NS5 | EU482725 | DENV | NS5 | EF105385 | DENV | NS5 | FJ898435 |

FIG. 70-189

| Virus | Protein | Accession No. | Virus | Protein | Accession No. | Virus | Protein | Accession No. |
|---|---|---|---|---|---|---|---|---|
| DENV | NS5 | GQ252676 | DENV | NS5 | DQ448231 | DENV | NS5 | FJ744714 |
| DENV | NS5 | FJ850065 | DENV | NS5 | FJ744710 | DENV | NS5 | GQ199866 |
| DENV | NS5 | FJ898477 | DENV | NS5 | GQ252677 | DENV | NS5 | GQ199894 |
| DENV | NS5 | FJ850116 | DENV | NS5 | NC_001474 | DENV | NS5 | FJ687440 |
| DENV | NS5 | FJ898454 | DENV | NS5 | FJ687445 | DENV | NS5 | FJ850112 |
| DENV | NS5 | GQ199897 | DENV | NS5 | FJ850091 | DENV | NS5 | FJ850078 |
| DENV | NS5 | GQ199899 | DENV | NS5 | FJ687443 | DENV | NS5 | FJ744717 |
| DENV | NS5 | FJ744723 | DENV | NS5 | GQ199869 | DENV | NS5 | FJ906968 |
| DENV | NS5 | GQ199900 | DENV | NS5 | FJ850105 | DENV | NS5 | GQ199893 |
| DENV | NS5 | FJ850082 | DENV | NS5 | FJ850051 | DENV | NS5 | FJ744711 |
| DENV | NS5 | FJ744715 | DENV | NS5 | FJ850050 | DENV | NS5 | FJ744704 |
| DENV | NS5 | FJ744709 | DENV | NS5 | FJ744719 | DENV | NS5 | FJ744720 |
| DENV | NS5 | GQ199868 | DENV | NS5 | FJ898453 | DENV | NS5 | GQ199901 |
| DENV | NS5 | FJ906960 | DENV | NS5 | FJ898460 | DENV | NS5 | FJ744724 |
| DENV | NS5 | FJ882602 | DENV | NS5 | FJ898438 | DENV | NS5 | FJ850120 |
| DENV | NS5 | GQ199895 | DENV | NS5 | FJ850053 | DENV | NS5 | FJ850118 |
| DENV | NS5 | FJ687436 | DENV | NS5 | FJ898450 | DENV | NS5 | FJ850076 |
| DENV | NS5 | FJ744725 | DENV | NS5 | FJ744708 | DENV | NS5 | AF022436 |
| DENV | NS5 | FJ850117 | DENV | NS5 | GQ199896 | DENV | NS5 | AF022439 |
| DENV | NS5 | FJ687441 | DENV | NS5 | FJ744722 | DENV | NS5 | AF022441 |
| DENV | NS5 | FJ744706 | DENV | NS5 | FJ850062 | DENV | NS5 | AF022437 |
| DENV | NS5 | FJ850074 | DENV | NS5 | FJ898461 | DENV | NS5 | AJ487271 |
| DENV | NS5 | FJ850085 | DENV | NS5 | FJ810410 | DENV | NS5 | AF022435 |
| DENV | NS5 | FJ850061 | DENV | NS5 | FJ850060 | DENV | NS5 | AF022434 |
| DENV | NS5 | FJ810409 | DENV | NS5 | FJ906961 | DENV | NS5 | AF022438 |
| DENV | NS5 | FJ687434 | DENV | NS5 | FJ882593 | DENV | NS5 | AF022440 |
| DENV | NS5 | GQ199890 | DENV | NS5 | FJ898479 | DENV | NS5 | CS479165 |
| DENV | NS5 | FJ744743 | DENV | NS5 | FJ744703 | DENV | NS5 | GQ868556 |
| DENV | NS5 | FJ850063 | DENV | NS5 | FJ744712 | DENV | NS5 | AB479041 |
| DENV | NS5 | FJ898466 | DENV | NS5 | FJ882594 | DENV | NS5 | GU289914 |
| DENV | NS5 | FJ850119 | DENV | NS5 | FJ744716 | DENV | NS5 | GU131884 |
| DENV | NS5 | FJ898432 | DENV | NS5 | FJ850066 | DENV | NS5 | GQ868600 |
| DENV | NS5 | FJ744718 | DENV | NS5 | FJ744744 | DENV | NS5 | FN429895 |
| DENV | NS5 | FJ810412 | DENV | NS5 | FJ850108 | DENV | NS5 | GU131879 |
| DENV | NS5 | FJ906956 | DENV | NS5 | FJ859028 | DENV | NS5 | GQ868596 |
| DENV | NS5 | FJ850064 | DENV | NS5 | FJ898465 | DENV | NS5 | GQ868516 |
| DENV | NS5 | GQ199892 | DENV | NS5 | FJ898451 | DENV | NS5 | GU131864 |
| DENV | NS5 | FJ898436 | DENV | NS5 | FJ898449 | DENV | NS5 | FN429893 |
| DENV | NS5 | FJ906957 | DENV | NS5 | FJ744705 | DENV | NS5 | GQ868598 |
| DENV | NS5 | FJ898478 | DENV | NS5 | FJ898434 | DENV | NS5 | GQ868544 |
| DENV | NS5 | FJ873811 | DENV | NS5 | FJ906969 | DENV | NS5 | GQ868589 |
| DENV | NS5 | GQ199898 | DENV | NS5 | FJ744741 | DENV | NS5 | GQ868551 |
| DENV | NS5 | FJ850115 | DENV | NS5 | FJ906959 | DENV | NS5 | GU131902 |
| DENV | NS5 | FJ687442 | DENV | NS5 | FJ850106 | DENV | NS5 | GU131896 |
| DENV | NS5 | FJ687439 | DENV | NS5 | FJ744742 | DENV | NS5 | GU131924 |
| DENV | NS5 | FJ432724 | DENV | NS5 | FJ687437 | DENV | NS5 | GQ868640 |
| DENV | NS5 | FJ687447 | DENV | NS5 | FJ744707 | DENV | NS5 | GU131880 |
| DENV | NS5 | FJ873808 | DENV | NS5 | FJ687438 | DENV | NS5 | GU131882 |

FIG. 70-190

| Virus | Protein Accession No. | Virus | Protein Accession No. | Virus | Protein Accession No. |
|---|---|---|---|---|---|
| DENV | NS5GQ868638 | DENV | NS5GU131897 | DENV | prMFJ639693 |
| DENV | NS5GQ868553 | DENV | NS5GQ868592 | DENV | prMFJ461317 |
| DENV | NS5GQ868646 | DENV | NS5GQ868552 | DENV | prMFJ384655 |
| DENV | NS5FN429891 | DENV | NS5GU131900 | DENV | prMEU482508 |
| DENV | NS5GQ868604 | DENV | NS5GQ868599 | DENV | prMAF311958 |
| DENV | NS5GU131947 | DENV | NS5GU131929 | DENV | prMFJ024451 |
| DENV | NS5GU131928 | DENV | NS5GU131930 | DENV | prMEU482528 |
| DENV | NS5GQ868497 | DENV | NS5GQ868550 | DENV | prMEU482821 |
| DENV | NS5GQ868603 | DENV | NS5GU131975 | DENV | prMFJ410267 |
| DENV | NS5GQ868621 | DENV | NS5GU131927 | DENV | prMAB074761 |
| DENV | NS5AB479042 | DENV | NS5GQ868540 | DENV | prMAY762084 |
| DENV | NS5GQ868620 | DENV | NS5FJ410202 | DENV | prMAY732480 |
| DENV | NS5GQ868590 | DENV | NS5CS479202 | DENV | prMEU482481 |
| DENV | NS5FN429892 | DENV | NS5U87411 | DENV | prMFJ410232 |
| DENV | NS5GQ868554 | DENV | NS5CS479203 | DENV | prMEU081254 |
| DENV | NS5GU131974 | DENV | NS5CS479204 | DENV | prMEU482806 |
| DENV | NS5GU131843 | DENV | NS5CS479167 | DENV | prMFJ410257 |
| DENV | NS5GQ868641 | DENV | NS5CS479205 | DENV | prMFJ432720 |
| DENV | NS5GQ868542 | DENV | NS5CS479206 | DENV | prMFJ547089 |
| DENV | NS5GQ868555 | DENV | NS5CS805344 | DENV | prMEU482819 |
| DENV | NS5FN429894 | DENV | NS5FB730117 | DENV | prMEU081270 |
| DENV | NS5GQ868549 | DENV | NS5DL138662 | DENV | prMFJ205875 |
| DENV | NS5GQ868588 | DENV | NS5GM059692 | DENV | prMFJ410210 |
| DENV | NS5GQ868541 | DENV | NS5AY243468 | DENV | prMFJ205884 |
| DENV | NS5GQ868558 | DENV | NS5AY243469 | DENV | prMFJ176780 |
| DENV | NS5GQ868625 | DENV | NS5AY744148 | DENV | prMFJ461340 |
| DENV | NS5GQ868624 | DENV | NS5AY744149 | DENV | prMAY732475 |
| DENV | NS5GQ868631 | DENV | NS5AY744150 | DENV | prMAY732474 |
| DENV | NS5GU131899 | DENV | NS5AJ968413 | DENV | prMFJ024435 |
| DENV | NS5GQ868515 | DENV | NS5GU369819 | DENV | prMFJ639669 |
| DENV | NS5GU131898 | DENV | NS5GU370050 | DENV | prMEU482540 |
| DENV | NS5GQ868623 | DENV | NS5GU370051 | DENV | prMFJ024429 |
| DENV | NS5GU131886 | DENV | prMAY277665 | DENV | prMEU677167 |
| DENV | NS5GQ868622 | DENV | prMAY713474 | DENV | prMEU482512 |
| DENV | NS5GQ868595 | DENV | prMAF311957 | DENV | prMFJ390381 |
| DENV | NS5GQ868557 | DENV | prMFJ205881 | DENV | prMFJ410226 |
| DENV | NS5GU131959 | DENV | prMEU482817 | DENV | prMFJ410191 |
| DENV | NS5GU131955 | DENV | prMDQ672557 | DENV | prMAJ968413 |
| DENV | NS5GQ868597 | DENV | prMEU677151 | DENV | prMFJ639689 |
| DENV | NS5GU131883 | DENV | prMFJ410256 | DENV | prMAY277664 |
| DENV | NS5GQ868591 | DENV | prMFJ432735 | DENV | prMFJ639811 |
| DENV | NS5GQ868543 | DENV | prMEU660390 | DENV | prMFJ639695 |
| DENV | NS5GU131901 | DENV | prMEU482824 | DENV | prMEU081226 |
| DENV | NS5GQ868545 | DENV | prMFJ410222 | DENV | prMFJ410280 |
| DENV | NS5GU131931 | DENV | prMAY726551 | DENV | prMEU596504 |
| DENV | NS5GU131885 | DENV | prMEU482716 | DENV | prMFJ639685 |
| DENV | NS5GU131932 | DENV | prMAF226685 | DENV | prMEU482715 |
| DENV | NS5GU131881 | DENV | prMEU677174 | DENV | prMFJ410227 |

FIG. 70-191

| Virus | Protein | Accession No. | Virus | Protein | Accession No. | Virus | Protein | Accession No. |
|---|---|---|---|---|---|---|---|---|
| DENV | prM | DQ285560 | DENV | prM | EU081238 | DENV | prM | FJ024463 |
| DENV | prM | FJ182002 | DENV | prM | FJ410245 | DENV | prM | FJ410275 |
| DENV | prM | EU677177 | DENV | prM | FJ461318 | DENV | prM | FJ410234 |
| DENV | prM | FJ639680 | DENV | prM | FJ410263 | DENV | prM | EU482487 |
| DENV | prM | EU677160 | DENV | prM | FJ410269 | DENV | prM | FJ410182 |
| DENV | prM | AY835999 | DENV | prM | FJ410289 | DENV | prM | EU482812 |
| DENV | prM | EU249494 | DENV | prM | FJ639692 | DENV | prM | EU081247 |
| DENV | prM | AF226687 | DENV | prM | EU660397 | DENV | prM | AB074760 |
| DENV | prM | FJ024432 | DENV | prM | EU482477 | DENV | prM | EU482802 |
| DENV | prM | EU081229 | DENV | prM | FJ024434 | DENV | prM | EU677172 |
| DENV | prM | FJ410184 | DENV | prM | FJ410204 | DENV | prM | EU482496 |
| DENV | prM | FJ182022 | DENV | prM | EU249495 | DENV | prM | EU726777 |
| DENV | prM | EU677153 | DENV | prM | AF513110 | DENV | prM | U88535 |
| DENV | prM | DQ672559 | DENV | prM | FJ024438 | DENV | prM | EU482519 |
| DENV | prM | EU081234 | DENV | prM | EU081264 | DENV | prM | FJ461339 |
| DENV | prM | FJ639802 | DENV | prM | EU482525 | DENV | prM | FJ562101 |
| DENV | prM | EU482483 | DENV | prM | EU687251 | DENV | prM | FJ461316 |
| DENV | prM | FJ024445 | DENV | prM | EU482486 | DENV | prM | EU482814 |
| DENV | prM | FJ410236 | DENV | prM | DQ285558 | DENV | prM | AY726555 |
| DENV | prM | FJ410242 | DENV | prM | FJ205883 | DENV | prM | FJ639677 |
| DENV | prM | FJ390378 | DENV | prM | AY145121 | DENV | prM | EU482506 |
| DENV | prM | EU081236 | DENV | prM | AY732478 | DENV | prM | FJ410283 |
| DENV | prM | EU081278 | DENV | prM | FJ410199 | DENV | prM | FJ639696 |
| DENV | prM | FJ432736 | DENV | prM | FJ390383 | DENV | prM | FJ410235 |
| DENV | prM | FJ639694 | DENV | prM | EU482592 | DENV | prM | EU482532 |
| DENV | prM | EU482500 | DENV | prM | FJ182030 | DENV | prM | FJ182031 |
| DENV | prM | DQ672560 | DENV | prM | FJ024431 | DENV | prM | FJ024428 |
| DENV | prM | AY713473 | DENV | prM | FJ024450 | DENV | prM | FJ432749 |
| DENV | prM | EU726780 | DENV | prM | FJ410252 | DENV | prM | DQ285561 |
| DENV | prM | FJ410255 | DENV | prM | FJ478457 | DENV | prM | EU482518 |
| DENV | prM | FJ373298 | DENV | prM | EU596502 | DENV | prM | EU726779 |
| DENV | prM | EU081276 | DENV | prM | FJ410201 | DENV | prM | EU677161 |
| DENV | prM | FJ410198 | DENV | prM | FJ562105 | DENV | prM | AY145123 |
| DENV | prM | EU482536 | DENV | prM | FJ639684 | DENV | prM | EU482800 |
| DENV | prM | FJ390382 | DENV | prM | FJ639682 | DENV | prM | AY732482 |
| DENV | prM | FJ024462 | DENV | prM | FJ410240 | DENV | prM | EU482517 |
| DENV | prM | EU482822 | DENV | prM | EU081279 | DENV | prM | EU482488 |
| DENV | prM | FJ024447 | DENV | prM | EU081231 | DENV | prM | FJ373305 |
| DENV | prM | FJ410274 | DENV | prM | FJ410214 | DENV | prM | FJ432746 |
| DENV | prM | FJ410216 | DENV | prM | FJ182036 | DENV | prM | FJ432734 |
| DENV | prM | EU482527 | DENV | prM | FJ182023 | DENV | prM | EU482797 |
| DENV | prM | EU280167 | DENV | prM | EU482479 | DENV | prM | EU482711 |
| DENV | prM | EU482567 | DENV | prM | FJ547087 | DENV | prM | FJ024459 |
| DENV | prM | EU081265 | DENV | prM | FJ639683 | DENV | prM | FJ410174 |
| DENV | prM | EU482489 | DENV | prM | FJ024442 | DENV | prM | EU596503 |
| DENV | prM | AB178040 | DENV | prM | FJ410285 | DENV | prM | FJ432730 |
| DENV | prM | EU482827 | DENV | prM | EU482615 | DENV | prM | EU081227 |
| DENV | prM | FJ024455 | DENV | prM | AY732476 | DENV | prM | EU677163 |

FIG. 70-192

| Virus | Protein Accession No. | Virus | Protein Accession No. | Virus | Protein Accession No. |
|---|---|---|---|---|---|
| DENV | prMAY277666 | DENV | prMEU677169 | DENV | prMEU081252 |
| DENV | prMFJ024483 | DENV | prMEU482828 | DENV | prMEU482706 |
| DENV | prMDQ193572 | DENV | prMEU482537 | DENV | prMAY726553 |
| DENV | prMEF122231 | DENV | prMEU726782 | DENV | prMFJ205882 |
| DENV | prMEU081266 | DENV | prMFJ410225 | DENV | prMFJ390386 |
| DENV | prMEU482818 | DENV | prMFJ410180 | DENV | prMEU677139 |
| DENV | prMFJ410186 | DENV | prMFJ024460 | DENV | prMFJ410260 |
| DENV | prMEU249493 | DENV | prMFJ410231 | DENV | prMEU677170 |
| DENV | prMFJ024478 | DENV | prMFJ390380 | DENV | prMEU081256 |
| DENV | prMFJ205874 | DENV | prMFJ410238 | DENV | prMFJ024443 |
| DENV | prMEU482791 | DENV | prMFJ390379 | DENV | prMFJ410278 |
| DENV | prMEU482798 | DENV | prMAF311956 | DENV | prMFJ432744 |
| DENV | prMEU081248 | DENV | prMEU081257 | DENV | prMAB189120 |
| DENV | prMEU596501 | DENV | prMFJ432721 | DENV | prMFJ461327 |
| DENV | prMFJ461336 | DENV | prMFJ639672 | DENV | prMEU660391 |
| DENV | prMFJ024457 | DENV | prMFJ639794 | DENV | prMFJ562106 |
| DENV | prMEU482485 | DENV | prMEU660403 | DENV | prMFJ182035 |
| DENV | prMFJ176779 | DENV | prMEU482619 | DENV | prMFJ461306 |
| DENV | prMEU482799 | DENV | prMEU677155 | DENV | prMEU482510 |
| DENV | prMEU081233 | DENV | prMFJ182021 | DENV | prMFJ024440 |
| DENV | prMEU482497 | DENV | prMEU482712 | DENV | prMEU081258 |
| DENV | prMEU482616 | DENV | prMEU482591 | DENV | prMEU081268 |
| DENV | prMEU482507 | DENV | prMFJ410253 | DENV | prMEU677178 |
| DENV | prMEU482809 | DENV | prMEF032590 | DENV | prMFJ410276 |
| DENV | prMFJ410262 | DENV | prMEU081243 | DENV | prMEU081273 |
| DENV | prMFJ024480 | DENV | prMFJ639818 | DENV | prMEU482820 |
| DENV | prMEU482495 | DENV | prMEU081237 | DENV | prMAF514878 |
| DENV | prMFJ182032 | DENV | prMAF514876 | DENV | prMEU660394 |
| DENV | prMFJ410197 | DENV | prMFJ639688 | DENV | prMFJ410218 |
| DENV | prMAF514883 | DENV | prMEU482713 | DENV | prMEU081241 |
| DENV | prMFJ461330 | DENV | prMEU677154 | DENV | prMFJ410244 |
| DENV | prMFJ639690 | DENV | prMEU081242 | DENV | prMEU482789 |
| DENV | prMFJ410209 | DENV | prMEU687247 | DENV | prMEU482524 |
| DENV | prMEU482514 | DENV | prMAY726552 | DENV | prMEU081261 |
| DENV | prMEU848545 | DENV | prMFJ024436 | DENV | prMFJ639812 |
| DENV | prMEU249492 | DENV | prMFJ639681 | DENV | prMEU482533 |
| DENV | prMEU081240 | DENV | prMEU482484 | DENV | prMDQ285559 |
| DENV | prMEU482499 | DENV | prMEU482815 | DENV | prMFJ410246 |
| DENV | prMFJ410281 | DENV | prMEU249490 | DENV | prMFJ461310 |
| DENV | prMFJ410270 | DENV | prMEU081253 | DENV | prMAB195673 |
| DENV | prMEU482808 | DENV | prMAY726549 | DENV | prMFJ182024 |
| DENV | prMEU081281 | DENV | prMEU677166 | DENV | prMAB204803 |
| DENV | prMAF309641 | DENV | prMFJ639821 | DENV | prMEF025110 |
| DENV | prMEU677159 | DENV | prMFJ024430 | DENV | prMDQ672564 |
| DENV | prMEU482526 | DENV | prMFJ410183 | DENV | prMEU726778 |
| DENV | prMFJ024427 | DENV | prMEU081267 | DENV | prMEF457905 |
| DENV | prMEU482618 | DENV | prMEU482491 | DENV | prMFJ547088 |
| DENV | prMAF350498 | DENV | prMEU081249 | DENV | prMFJ024437 |

FIG. 70-193

| Virus | Protein Accession No. | Virus | Protein Accession No. | Virus | Protein Accession No. |
|---|---|---|---|---|---|
| DENV | prMEU482513 | DENV | prMFJ432740 | DENV | prMFJ639819 |
| DENV | prMFJ410196 | DENV | prMAY726554 | DENV | prMFJ639806 |
| DENV | prMFJ410250 | DENV | prMFJ024441 | DENV | prMFJ432738 |
| DENV | prMEU660392 | DENV | prMDQ672556 | DENV | prMFJ432719 |
| DENV | prMFJ461313 | DENV | prMFJ410272 | DENV | prMFJ461303 |
| DENV | prMEU677168 | DENV | prMFJ639676 | DENV | prMFJ410203 |
| DENV | prMFJ432723 | DENV | prMFJ639686 | DENV | prMFJ410194 |
| DENV | prMFJ410181 | DENV | prMEU482498 | DENV | prMEU081244 |
| DENV | prMFJ410239 | DENV | prMFJ432725 | DENV | prMEU482482 |
| DENV | prMEU482480 | DENV | prMEU482529 | DENV | prMFJ410179 |
| DENV | prMAY206457 | DENV | prMFJ547086 | DENV | prMAY722803 |
| DENV | prMEU482523 | DENV | prMFJ461323 | DENV | prMEU482539 |
| DENV | prMFJ410290 | DENV | prMFJ410230 | DENV | prMFJ639671 |
| DENV | prMDQ672562 | DENV | prMFJ410248 | DENV | prMEU482478 |
| DENV | prMEU482521 | DENV | prMEU482609 | DENV | prMFJ547060 |
| DENV | prMEU660402 | DENV | prMFJ639824 | DENV | prMFJ432739 |
| DENV | prMFJ461307 | DENV | prMFJ410279 | DENV | prMFJ639740 |
| DENV | prMEU081272 | DENV | prMEU482535 | DENV | prMFJ182034 |
| DENV | prMFJ461315 | DENV | prMFJ024453 | DENV | prMEU482710 |
| DENV | prMFJ410188 | DENV | prMFJ432748 | DENV | prMEU081232 |
| DENV | prMAY713475 | DENV | prMEU660393 | DENV | prMEU482515 |
| DENV | prMAY732479 | DENV | prMAY145122 | DENV | prMEU482531 |
| DENV | prMEU677156 | DENV | prMFJ024446 | DENV | prMAF298807 |
| DENV | prMEU482707 | DENV | prMFJ432747 | DENV | prMFJ205873 |
| DENV | prMEU482811 | DENV | prMFJ410205 | DENV | prMFJ639674 |
| DENV | prMAF226686 | DENV | prMFJ205876 | DENV | prMFJ547065 |
| DENV | prMEU081235 | DENV | prMFJ410211 | DENV | prMFJ410212 |
| DENV | prMEU660419 | DENV | prMFJ182025 | DENV | prMFJ461341 |
| DENV | prMFJ547068 | DENV | prMFJ182026 | DENV | prMEU081259 |
| DENV | prMAB189121 | DENV | prMFJ373296 | DENV | prMFJ639823 |
| DENV | prMFJ461308 | DENV | prMAY722802 | DENV | prMFJ410190 |
| DENV | prMFJ410213 | DENV | prMEU482522 | DENV | prMFJ432745 |
| DENV | prMAY726550 | DENV | prMFJ390388 | DENV | prMFJ410175 |
| DENV | prMAY732477 | DENV | prMEU677173 | DENV | prMEU677176 |
| DENV | prMEU660401 | DENV | prMEU081277 | DENV | prMFJ639679 |
| DENV | prMFJ639815 | DENV | prMEU482492 | DENV | prMFJ432742 |
| DENV | prMFJ410268 | DENV | prMFJ432732 | DENV | prMFJ639670 |
| DENV | prMFJ478458 | DENV | prMFJ639691 | DENV | prMFJ182027 |
| DENV | prMFJ639808 | DENV | prMEU482511 | DENV | prMEU482718 |
| DENV | prMEU482611 | DENV | prMEU081230 | DENV | prMEU677158 |
| DENV | prMFJ410261 | DENV | prMFJ410206 | DENV | prMFJ639687 |
| DENV | prMFJ432729 | DENV | prMFJ410189 | DENV | prMFJ461325 |
| DENV | prMFJ639813 | DENV | prMFJ182019 | DENV | prMFJ024444 |
| DENV | prMEU482520 | DENV | prMFJ024472 | DENV | prMEU482617 |
| DENV | prMAF514885 | DENV | prMFJ205872 | DENV | prMFJ639678 |
| DENV | prMFJ639673 | DENV | prMFJ410282 | DENV | prMEU081269 |
| DENV | prMFJ410266 | DENV | prMEU482538 | DENV | prMEU482714 |
| DENV | prMEU482805 | DENV | prMEU660418 | DENV | prMFJ024456 |

FIG. 70-194

| Virus | Protein | Accession No. | Virus | Protein | Accession No. | Virus | Protein | Accession No. |
|---|---|---|---|---|---|---|---|---|
| DENV | prM | FJ182028 | DENV | prM | AF180817 | DENV | prM | EU677162 |
| DENV | prM | EU677152 | DENV | prM | AY722801 | DENV | prM | FJ024485 |
| DENV | prM | EU081228 | DENV | prM | EU482504 | DENV | prM | EU081271 |
| DENV | prM | FJ410173 | DENV | prM | FJ639675 | DENV | prM | FJ024426 |
| DENV | prM | EU482796 | DENV | prM | FJ024433 | DENV | prM | EU482790 |
| DENV | prM | EU726781 | DENV | prM | FJ461331 | DENV | prM | FJ410286 |
| DENV | prM | FJ410207 | DENV | prM | FJ410187 | DENV | prM | FJ639735 |
| DENV | prM | FJ410243 | DENV | prM | FJ410258 | DENV | prM | EU482494 |
| DENV | prM | EU081239 | DENV | prM | AY708047 | DENV | prM | FJ390374 |
| DENV | prM | EU482816 | DENV | prM | FJ024423 | DENV | prM | EU482813 |
| DENV | prM | EU081260 | DENV | prM | FJ024484 | DENV | prM | FJ461335 |
| DENV | prM | FJ182029 | DENV | prM | EU081251 | DENV | prM | EU482803 |
| DENV | prM | FJ024449 | DENV | prM | FJ410249 | DENV | prM | EU482490 |
| DENV | prM | EU081250 | DENV | prM | EU482610 | DENV | prM | FJ024482 |
| DENV | prM | EU482825 | DENV | prM | FJ182033 | DENV | prM | FJ410284 |
| DENV | prM | EU482530 | DENV | prM | EU482493 | DENV | prM | EU081280 |
| DENV | prM | FJ639820 | DENV | prM | EU482807 | DENV | prM | EU677150 |
| DENV | prM | EU677175 | DENV | prM | FJ639814 | DENV | prM | AY732481 |
| DENV | prM | FJ410251 | DENV | prM | EU482501 | DENV | prM | FJ461324 |
| DENV | prM | EU482794 | DENV | prM | FJ410254 | DENV | prM | FJ639796 |
| DENV | prM | EU359008 | DENV | prM | EU081246 | DENV | prM | EU482709 |
| DENV | prM | AF180818 | DENV | prM | EU081275 | DENV | prM | AF298808 |
| DENV | prM | EU660396 | DENV | prM | FJ410264 | DENV | prM | FJ182018 |
| DENV | prM | FJ182003 | DENV | prM | FJ024479 | DENV | prM | DQ672558 |
| DENV | prM | EU482476 | DENV | prM | FJ410185 | DENV | prM | EU482795 |
| DENV | prM | EU482505 | DENV | prM | FJ410273 | DENV | prM | EU677164 |
| DENV | prM | EU081255 | DENV | prM | EU482801 | DENV | prM | FJ410277 |
| DENV | prM | FJ639743 | DENV | prM | AY713476 | DENV | prM | FJ024464 |
| DENV | prM | U88537 | DENV | prM | FJ461312 | DENV | prM | FJ461332 |
| DENV | prM | FJ432733 | DENV | prM | FJ639797 | DENV | prM | EF122232 |
| DENV | prM | EU660395 | DENV | prM | FJ461319 | DENV | prM | FJ432727 |
| DENV | prM | EU081263 | DENV | prM | FJ461333 | DENV | prM | EU482823 |
| DENV | prM | EU482826 | DENV | prM | EU482516 | DENV | prM | EU482810 |
| DENV | prM | FJ410192 | DENV | prM | EU482792 | DENV | prM | EU081245 |
| DENV | prM | FJ182020 | DENV | prM | AF514889 | DENV | prM | EU081262 |
| DENV | prM | DQ672561 | DENV | prM | EU482509 | DENV | prM | EU863650 |
| DENV | prM | FJ024481 | DENV | prM | FJ432737 | DENV | prM | AY732483 |
| DENV | prM | EU677165 | DENV | prM | FJ547063 | DENV | prM | FJ410265 |
| DENV | prM | FJ410287 | DENV | prM | FJ373297 | DENV | prM | EU660412 |
| DENV | prM | EU482502 | DENV | prM | EU677157 | DENV | prM | EU677171 |
| DENV | prM | EU081274 | DENV | prM | EU482534 | DENV | prM | EU677140 |
| DENV | prM | FJ024448 | DENV | prM | EU249491 | DENV | prM | FJ898428 |
| DENV | prM | FJ024425 | DENV | prM | DQ285562 | DENV | prM | FJ882569 |
| DENV | prM | FJ639741 | DENV | prM | EU482793 | DENV | prM | GQ199776 |
| DENV | prM | FJ562104 | DENV | prM | EU482717 | DENV | prM | GQ199853 |
| DENV | prM | DQ672563 | DENV | prM | FJ024439 | DENV | prM | GQ199803 |
| DENV | prM | EU482708 | DENV | prM | EU482804 | DENV | prM | FJ882554 |
| DENV | prM | FJ410247 | DENV | prM | EU482503 | DENV | prM | FJ873809 |

FIG. 70-195

| Virus | Protein Accession No. | Virus | Protein Accession No. | Virus | Protein Accession No. |
|---|---|---|---|---|---|
| DENV | prMFJ882563 | DENV | prMFJ882550 | DENV | prMFJ882547 |
| DENV | prMGQ199812 | DENV | prMFJ744701 | DENV | prMGQ199798 |
| DENV | prMFJ873810 | DENV | prMFJ898391 | DENV | prMGQ199844 |
| DENV | prMFJ898397 | DENV | prMFJ898417 | DENV | prMGQ199829 |
| DENV | prMFJ898400 | DENV | prMGQ199806 | DENV | prMFJ882530 |
| DENV | prMFJ687433 | DENV | prMGQ199794 | DENV | prMFJ898422 |
| DENV | prMGQ199877 | DENV | prMFJ898425 | DENV | prMFJ810415 |
| DENV | prMGQ199788 | DENV | prMFJ898393 | DENV | prMFJ898411 |
| DENV | prMGQ199823 | DENV | prMGQ199799 | DENV | prMGQ199856 |
| DENV | prMFJ898407 | DENV | prMGQ199833 | DENV | prMFJ850101 |
| DENV | prMGQ199804 | DENV | prMGQ199781 | DENV | prMFJ850093 |
| DENV | prMFJ882533 | DENV | prMGQ199797 | DENV | prMFJ882551 |
| DENV | prMGQ199818 | DENV | prMFJ882522 | DENV | prMGQ199795 |
| DENV | prMFJ882560 | DENV | prMFJ906964 | DENV | prMFJ850100 |
| DENV | prMFJ898415 | DENV | prMGQ199821 | DENV | prMFJ898416 |
| DENV | prMFJ850113 | DENV | prMGQ199847 | DENV | prMGQ199785 |
| DENV | prMFJ898384 | DENV | prMFJ882524 | DENV | prMGQ199784 |
| DENV | prMFJ882538 | DENV | prMFJ850077 | DENV | prMGQ199828 |
| DENV | prMFJ882521 | DENV | prMFJ882552 | DENV | prMGQ199780 |
| DENV | prMGQ199811 | DENV | prMGQ199778 | DENV | prMFJ850103 |
| DENV | prMFJ850075 | DENV | prMFJ882549 | DENV | prMFJ882555 |
| DENV | prMGQ199848 | DENV | prMGQ199816 | DENV | prMFJ882561 |
| DENV | prMFJ898378 | DENV | prMGQ199824 | DENV | prMFJ687430 |
| DENV | prMFJ873814 | DENV | prMFJ898398 | DENV | prMFJ898381 |
| DENV | prMFJ898410 | DENV | prMFJ859029 | DENV | prMFJ882518 |
| DENV | prMFJ882528 | DENV | prMFJ882515 | DENV | prMFJ898392 |
| DENV | prMFJ898382 | DENV | prMGQ199820 | DENV | prMFJ898380 |
| DENV | prMFJ898404 | DENV | prMGQ199867 | DENV | prMGQ199835 |
| DENV | prMFJ687426 | DENV | prMFJ898448 | DENV | prMFJ898430 |
| DENV | prMFJ898371 | DENV | prMFJ882556 | DENV | prMFJ850087 |
| DENV | prMGQ199872 | DENV | prMFJ882536 | DENV | prMFJ898385 |
| DENV | prMGQ199855 | DENV | prMGQ199796 | DENV | prMGQ199857 |
| DENV | prMFJ882535 | DENV | prMFJ882570 | DENV | prMFJ898403 |
| DENV | prMNC_001477 | DENV | prMFJ898376 | DENV | prMGQ199800 |
| DENV | prMFJ898423 | DENV | prMGQ199771 | DENV | prMFJ882540 |
| DENV | prMFJ882565 | DENV | prMFJ850069 | DENV | prMGQ199792 |
| DENV | prMFJ882517 | DENV | prMFJ850102 | DENV | prMFJ882516 |
| DENV | prMGQ199814 | DENV | prMGQ199834 | DENV | prMGQ199850 |
| DENV | prMFJ898395 | DENV | prMFJ898388 | DENV | prMFJ898372 |
| DENV | prMGQ199851 | DENV | prMGQ199830 | DENV | prMGQ199775 |
| DENV | prMGQ199837 | DENV | prMGQ199839 | DENV | prMFJ882559 |
| DENV | prMFJ882558 | DENV | prMGQ199777 | DENV | prMGQ199789 |
| DENV | prMFJ850084 | DENV | prMFJ882579 | DENV | prMFJ850099 |
| DENV | prMFJ898374 | DENV | prMFJ898429 | DENV | prMFJ850114 |
| DENV | prMFJ850104 | DENV | prMFJ882541 | DENV | prMGQ199819 |
| DENV | prMGQ199815 | DENV | prMFJ898402 | DENV | prMFJ882523 |
| DENV | prMGQ199843 | DENV | prMGQ199808 | DENV | prMGQ199845 |
| DENV | prMGQ199826 | DENV | prMGQ199786 | DENV | prMFJ850081 |

FIG. 70-196

| Virus | Protein Accession No. | Virus | Protein Accession No. | Virus | Protein Accession No. |
|---|---|---|---|---|---|
| DENV | prMFJ744702 | DENV | prMFJ898408 | DENV | prMGQ199840 |
| DENV | prMFJ898386 | DENV | prMFJ810419 | DENV | prMFJ898433 |
| DENV | prMFJ882542 | DENV | prMGQ199793 | DENV | prMFJ882567 |
| DENV | prMGQ199782 | DENV | prMFJ882562 | DENV | prMFJ898387 |
| DENV | prMGQ199852 | DENV | prMFJ898424 | DENV | prMFJ882532 |
| DENV | prMFJ898421 | DENV | prMFJ898389 | DENV | prMFJ898409 |
| DENV | prMFJ687432 | DENV | prMFJ898412 | DENV | prMFJ882545 |
| DENV | prMGQ199813 | DENV | prMFJ882537 | DENV | prMFJ898375 |
| DENV | prMFJ882534 | DENV | prMFJ898418 | DENV | prMFJ898414 |
| DENV | prMGQ199854 | DENV | prMFJ898394 | DENV | prMCS477306 |
| DENV | prMGQ199846 | DENV | prMGQ199849 | DENV | prMA75711 |
| DENV | prMFJ882539 | DENV | prMFJ882548 | DENV | prMGU131816 |
| DENV | prMFJ898437 | DENV | prMFJ906963 | DENV | prMFJ469907 |
| DENV | prMFJ898390 | DENV | prMFJ906965 | DENV | prMGU131814 |
| DENV | prMFJ898405 | DENV | prMGQ199873 | DENV | prMGU131725 |
| DENV | prMGQ199783 | DENV | prMFJ850073 | DENV | prMGU131822 |
| DENV | prMFJ882526 | DENV | prMFJ850071 | DENV | prMGQ868633 |
| DENV | prMFJ461320 | DENV | prMGQ199772 | DENV | prMGU131820 |
| DENV | prMFJ898420 | DENV | prMFJ898373 | DENV | prMGU131679 |
| DENV | prMFJ687431 | DENV | prMFJ687429 | DENV | prMGQ868507 |
| DENV | prMGQ199801 | DENV | prMFJ898379 | DENV | prMGU131789 |
| DENV | prMFJ906728 | DENV | prMFJ882566 | DENV | prMGU131710 |
| DENV | prMFJ882544 | DENV | prMFJ898396 | DENV | prMFN429887 |
| DENV | prMFJ882553 | DENV | prMFJ882529 | DENV | prMGU131720 |
| DENV | prMFJ882531 | DENV | prMGQ199838 | DENV | prMGU131841 |
| DENV | prMGQ199810 | DENV | prMGQ199779 | DENV | prMGQ868564 |
| DENV | prMGQ199825 | DENV | prMGQ199827 | DENV | prMAB519681 |
| DENV | prMFJ882546 | DENV | prMGQ199836 | DENV | prMGU131743 |
| DENV | prMFJ882568 | DENV | prMGQ199858 | DENV | prMGQ868522 |
| DENV | prMFJ898413 | DENV | prMGQ199787 | DENV | prMGU131739 |
| DENV | prMGQ199773 | DENV | prMFJ850068 | DENV | prMGU131971 |
| DENV | prMGQ199822 | DENV | prMFJ882564 | DENV | prMGU131834 |
| DENV | prMGQ199832 | DENV | prMFJ898419 | DENV | prMGQ868523 |
| DENV | prMGQ199790 | DENV | prMFJ898383 | DENV | prMGU131982 |
| DENV | prMGQ199841 | DENV | prMFJ461328 | DENV | prMGU131965 |
| DENV | prMFJ882520 | DENV | prMFJ882527 | DENV | prMGU131760 |
| DENV | prMGQ199875 | DENV | prMFJ898427 | DENV | prMGQ868535 |
| DENV | prMGQ199802 | DENV | prMFJ882525 | DENV | prMGU131962 |
| DENV | prMGQ199791 | DENV | prMFJ882557 | DENV | prMGU131891 |
| DENV | prMFJ898426 | DENV | prMGQ199859 | DENV | prMGQ868504 |
| DENV | prMFJ898431 | DENV | prMGQ199842 | DENV | prMGU131783 |
| DENV | prMGQ199809 | DENV | prMGQ199817 | DENV | prMGU131680 |
| DENV | prMFJ898406 | DENV | prMFJ898401 | DENV | prMGU131704 |
| DENV | prMGQ199805 | DENV | prMFJ882519 | DENV | prMGU131685 |
| DENV | prMGQ199831 | DENV | prMFJ850090 | DENV | prMGU131770 |
| DENV | prMFJ850070 | DENV | prMFJ898377 | DENV | prMGU131795 |
| DENV | prMGQ199807 | DENV | prMGQ199774 | DENV | prMGU131961 |
| DENV | prMFJ882543 | DENV | prMFJ898399 | DENV | prMGU131733 |

FIG. 70-197

| Virus | Protein Accession No. | Virus | Protein Accession No. | Virus | Protein Accession No. |
|---|---|---|---|---|---|
| DENV | prMGU131804 | DENV | prMGU131745 | DENV | prMGU131763 |
| DENV | prMGU131762 | DENV | prMGQ868635 | DENV | prMGQ868527 |
| DENV | prMGU131827 | DENV | prMGU056032 | DENV | prMGU131708 |
| DENV | prMGU131837 | DENV | prMGQ868610 | DENV | prMGU131766 |
| DENV | prMGQ868630 | DENV | prMGU131889 | DENV | prMFN429890 |
| DENV | prMGU131767 | DENV | prMGQ868499 | DENV | prMGU131694 |
| DENV | prMGU131737 | DENV | prMGU131756 | DENV | prMGQ868615 |
| DENV | prMGQ868500 | DENV | prMGU131786 | DENV | prMGU131688 |
| DENV | prMGU131722 | DENV | prMGQ868565 | DENV | prMFJ469908 |
| DENV | prMGQ868607 | DENV | prMGU131709 | DENV | prMGU131734 |
| DENV | prMGQ868517 | DENV | prMGQ868569 | DENV | prMGQ868637 |
| DENV | prMGU131727 | DENV | prMGU131723 | DENV | prMGU131888 |
| DENV | prMGU131715 | DENV | prMGU131696 | DENV | prMGQ868568 |
| DENV | prMFN429885 | DENV | prMGQ868519 | DENV | prMGU131790 |
| DENV | prMGU131780 | DENV | prMGU131838 | DENV | prMGU131920 |
| DENV | prMGU131750 | DENV | prMGQ868520 | DENV | prMGQ868528 |
| DENV | prMGU131787 | DENV | prMGU131791 | DENV | prMGQ868612 |
| DENV | prMGU056031 | DENV | prMGU131765 | DENV | prMGU131794 |
| DENV | prMGQ868602 | DENV | prMGU131702 | DENV | prMGQ868606 |
| DENV | prMGU131711 | DENV | prMGU131682 | DENV | prMGU131969 |
| DENV | prMGQ868567 | DENV | prMGU131801 | DENV | prMGQ868608 |
| DENV | prMGU131813 | DENV | prMGQ868562 | DENV | prMGU131921 |
| DENV | prMFJ687428 | DENV | prMGU131684 | DENV | prMGQ868502 |
| DENV | prMGU131707 | DENV | prMGU131744 | DENV | prMGU131719 |
| DENV | prMGU131689 | DENV | prMGQ868534 | DENV | prMGU131973 |
| DENV | prMGU131700 | DENV | prMGU131687 | DENV | prMGU131967 |
| DENV | prMGU131798 | DENV | prMGQ868529 | DENV | prMGU131803 |
| DENV | prMGU131713 | DENV | prMGU131840 | DENV | prMGU131736 |
| DENV | prMGU131829 | DENV | prMGU131808 | DENV | prMGU131981 |
| DENV | prMGU131782 | DENV | prMGU131922 | DENV | prMGU131964 |
| DENV | prMGU131698 | DENV | prMGU131836 | DENV | prMGU131771 |
| DENV | prMGU131732 | DENV | prMGQ868613 | DENV | prMGU131984 |
| DENV | prMGU131772 | DENV | prMGU131721 | DENV | prMGU131695 |
| DENV | prMGU131978 | DENV | prMGU131730 | DENV | prMGU131728 |
| DENV | prMGU131958 | DENV | prMGU131968 | DENV | prMGQ868601 |
| DENV | prMGU131811 | DENV | prMGU131832 | DENV | prMFN429886 |
| DENV | prMGQ868506 | DENV | prMGU131774 | DENV | prMGU131826 |
| DENV | prMGQ868525 | DENV | prMGU131976 | DENV | prMGQ868512 |
| DENV | prMGQ868538 | DENV | prMGU131831 | DENV | prMGU131718 |
| DENV | prMFJ469909 | DENV | prMGQ868501 | DENV | prMGQ868513 |
| DENV | prMGU131818 | DENV | prMGQ868531 | DENV | prMGU131731 |
| DENV | prMGU131893 | DENV | prMGU131957 | DENV | prMGU131686 |
| DENV | prMGQ868509 | DENV | prMGU131980 | DENV | prMGU131894 |
| DENV | prMGU131706 | DENV | prMGQ868609 | DENV | prMGU131895 |
| DENV | prMGU131777 | DENV | prMGU131769 | DENV | prMGU131678 |
| DENV | prMGU131925 | DENV | prMGQ868526 | DENV | prMGQ868619 |
| DENV | prMGU131977 | DENV | prMGQ868510 | DENV | prMGU131729 |
| DENV | prMGQ868611 | DENV | prMFN429882 | DENV | prMGQ868539 |

FIG. 70-198

| Virus | Protein Accession No. | Virus | Protein Accession No. | Virus | Protein Accession No. |
|---|---|---|---|---|---|
| DENV | prM GU131747 | DENV | prM GU131792 | DENV | prM GU131835 |
| DENV | prM GU131748 | DENV | prM GU131690 | DENV | prM GU131716 |
| DENV | prM FN429889 | DENV | prM GQ868632 | DENV | prM GQ868498 |
| DENV | prM GU131776 | DENV | prM GU131781 | DENV | prM GU131683 |
| DENV | prM GU131755 | DENV | prM GQ868537 | DENV | prM GU131960 |
| DENV | prM GU131810 | DENV | prM GU131815 | DENV | prM GU131714 |
| DENV | prM GU131701 | DENV | prM GU056033 | DENV | prM GU131779 |
| DENV | prM GU131754 | DENV | prM GU131812 | DENV | prM GU131773 |
| DENV | prM GU131784 | DENV | prM GU131833 | DENV | prM GQ868605 |
| DENV | prM GU131807 | DENV | prM GU131830 | DENV | prM GQ868511 |
| DENV | prM GU131842 | DENV | prM GU131742 | DENV | prM GU131752 |
| DENV | prM GU131923 | DENV | prM GQ868561 | DENV | prM GU131691 |
| DENV | prM GU131809 | DENV | prM GU131800 | DENV | prM GU131692 |
| DENV | prM GU131726 | DENV | prM GU131738 | DENV | prM GU131705 |
| DENV | prM GU131970 | DENV | prM GU131824 | DENV | prM GQ868639 |
| DENV | prM GU131751 | DENV | prM GU131919 | DENV | prM GU131805 |
| DENV | prM GU131828 | DENV | prM GU131802 | DENV | prM GU131735 |
| DENV | prM GQ868524 | DENV | prM GQ868503 | DENV | prM GU131966 |
| DENV | prM GU131863 | DENV | prM GU131839 | DENV | prM GU131890 |
| DENV | prM GU131892 | DENV | prM GU131681 | DENV | prM GQ868566 |
| DENV | prM GU131823 | DENV | prM GQ868505 | DENV | prM GU131775 |
| DENV | prM GU131821 | DENV | prM FN429884 | DENV | prM GU131749 |
| DENV | prM GU131983 | DENV | prM GQ868536 | DENV | prM GQ868521 |
| DENV | prM GQ868518 | DENV | prM GU131825 | DENV | prM GU131703 |
| DENV | prM GU131764 | DENV | prM FN429888 | DENV | prM GU131717 |
| DENV | prM GU056030 | DENV | prM GU131778 | DENV | prM GU131712 |
| DENV | prM GU131979 | DENV | prM GU131972 | DENV | prM GQ868532 |
| DENV | prM GU131768 | DENV | prM GU131817 | DENV | prM GQ868514 |
| DENV | prM GU131699 | DENV | prM GU131759 | DENV | prM FJ410220 |
| DENV | prM FJ687427 | DENV | prM GU131819 | DENV | prM CS477302 |
| DENV | prM GU131963 | DENV | prM GU131757 | DENV | prM CS477304 |
| DENV | prM GU131793 | DENV | prM GQ868533 | DENV | prM CS477264 |
| DENV | prM GQ868618 | DENV | prM FN429883 | DENV | prM CS477305 |
| DENV | prM GU131799 | DENV | prM GU131956 | DENV | prM CS477263 |
| DENV | prM GU131724 | DENV | prM GQ868563 | DENV | prM CS477265 |
| DENV | prM GU131740 | DENV | prM GU131926 | DENV | prM M87512 |
| DENV | prM GU131806 | DENV | prM GU131887 | DENV | prM FB730116 |
| DENV | prM GQ868614 | DENV | prM GU131741 | DENV | prM GM059691 |
| DENV | prM FN429881 | DENV | prM GU131761 | DENV | prM U88536 |
| DENV | prM GQ868636 | DENV | prM GU131693 | DENV | prM GU370048 |
| DENV | prM GU131746 | DENV | prM GU131753 | DENV | prM GU370049 |
| DENV | prM GQ868560 | DENV | prM GU131948 | DENV | prM AY762085 |
| DENV | prM GQ868508 | DENV | prM GQ868559 | DENV | prM FJ024424 |
| DENV | prM GQ868570 | DENV | prM GQ868530 | DENV | prM FJ226067 |
| DENV | prM GU131788 | DENV | prM GU131797 | DENV | prM FJ639745 |
| DENV | prM GU131949 | DENV | prM GU131785 | DENV | prM AY618989 |
| DENV | prM GU131796 | DENV | prM GU131758 | DENV | prM AF326827 |
| DENV | prM GU056029 | DENV | prM GU131697 | DENV | prM AY618988 |

FIG. 70-199

| Virus | Protein Accession No. | Virus | Protein Accession No. | Virus | Protein Accession No. |
|---|---|---|---|---|---|
| DENV | prMEU854296 | DENV | prMGQ199883 | DENV | prMDQ401690 |
| DENV | prMEU854300 | DENV | prMFJ882586 | DENV | prMEU529683 |
| DENV | prMAY858050 | DENV | prMGQ252675 | DENV | prMAY679147 |
| DENV | prMAF375822 | DENV | prMFJ882581 | DENV | prMAY676348 |
| DENV | prMEU854295 | DENV | prMGQ199881 | DENV | prMEF629368 |
| DENV | prMM14931 | DENV | prMGQ199878 | DENV | prMFJ639752 |
| DENV | prMAY618992 | DENV | prMFJ882596 | DENV | prMFJ639807 |
| DENV | prMEU854297 | DENV | prMFJ882583 | DENV | prMEU529684 |
| DENV | prMFJ639738 | DENV | prMFJ882600 | DENV | prMFJ373304 |
| DENV | prMAY618993 | DENV | prMFJ850057 | DENV | prMFJ639723 |
| DENV | prMFJ639764 | DENV | prMGQ199879 | DENV | prMEU569691 |
| DENV | prMFJ639737 | DENV | prMFJ882585 | DENV | prMDQ675524 |
| DENV | prMAY776330 | DENV | prMGQ199876 | DENV | prMEU081203 |
| DENV | prMAY618991 | DENV | prMGQ199885 | DENV | prMEU482564 |
| DENV | prMFJ639736 | DENV | prMFJ882592 | DENV | prMFJ182039 |
| DENV | prMFJ639739 | DENV | prMGQ199882 | DENV | prMEU482453 |
| DENV | prMAF326826 | DENV | prMFJ882591 | DENV | prMFJ639779 |
| DENV | prMAY947539 | DENV | prMFJ882589 | DENV | prMEU081183 |
| DENV | prMEU854299 | DENV | prMGQ868642 | DENV | prMEU529690 |
| DENV | prMAY618990 | DENV | prMGQ868581 | DENV | prMFJ182011 |
| DENV | prMFJ639748 | DENV | prMFN429919 | DENV | prMEU081187 |
| DENV | prMFJ639744 | DENV | prMGQ868583 | DENV | prMEU482461 |
| DENV | prMEU854301 | DENV | prMFN429920 | DENV | prMFJ639803 |
| DENV | prMFJ639773 | DENV | prMFN429923 | DENV | prMAY858047 |
| DENV | prMFJ182016 | DENV | prMGQ868585 | DENV | prMFJ639774 |
| DENV | prMAF326573 | DENV | prMGQ868579 | DENV | prMFJ639726 |
| DENV | prMFJ182017 | DENV | prMGQ868644 | DENV | prMAY858037 |
| DENV | prMFJ024476 | DENV | prMFN429925 | DENV | prMEU081215 |
| DENV | prMEF457906 | DENV | prMGU289913 | DENV | prMFJ639785 |
| DENV | prMFJ639742 | DENV | prMGQ868580 | DENV | prMFJ639761 |
| DENV | prMAF289029 | DENV | prMFN429922 | DENV | prMEU569688 |
| DENV | prMGQ199880 | DENV | prMGQ868645 | DENV | prMDQ675533 |
| DENV | prMFJ882597 | DENV | prMGQ868594 | DENV | prMFJ410177 |
| DENV | prMNC_002640 | DENV | prMFN429924 | DENV | prMFJ478456 |
| DENV | prMFJ882587 | DENV | prMFJ882590 | DENV | prMEU081195 |
| DENV | prMFJ882595 | DENV | prMGQ868582 | DENV | prMEU081221 |
| DENV | prMFJ882582 | DENV | prMGQ868584 | DENV | prMEU529689 |
| DENV | prMFJ810417 | DENV | prMFN429926 | DENV | prMEU660408 |
| DENV | prMFJ850095 | DENV | prMFN429921 | DENV | prMEU687219 |
| DENV | prMFJ882599 | DENV | prMGQ868643 | DENV | prMFJ639780 |
| DENV | prMFJ882580 | DENV | prMAF326825 | DENV | prMEU687196 |
| DENV | prMGQ199884 | DENV | prMAY376438 | DENV | prMEF643017 |
| DENV | prMFJ882588 | DENV | prMAY648301 | DENV | prMFJ373303 |
| DENV | prMFJ882598 | DENV | prMAY099336 | DENV | prMFJ639729 |
| DENV | prMFJ882601 | DENV | prMGU363549 | DENV | prMFJ639775 |
| DENV | prMFJ850058 | DENV | prMGU370052 | DENV | prMFJ461322 |
| DENV | prMFJ882584 | DENV | prMGU370053 | DENV | prMFJ390371 |
| DENV | prMFJ850059 | DENV | prMEU081191 | DENV | prMAY858046 |

FIG. 70-200

| Virus | Protein Accession No. | Virus | Protein Accession No. | Virus | Protein Accession No. |
|---|---|---|---|---|---|
| DENV | prMEU482455 | DENV | prMAY923865 | DENV | prMEU081222 |
| DENV | prMAY744680 | DENV | prMEU081188 | DENV | prMEU660407 |
| DENV | prMFJ182015 | DENV | prMFJ461337 | DENV | prMM93130 |
| DENV | prMFJ562103 | DENV | prMEU081224 | DENV | prMEU529687 |
| DENV | prMFJ639792 | DENV | prMEU081207 | DENV | prMDQ675523 |
| DENV | prMDQ675527 | DENV | prMFJ639750 | DENV | prMFJ432722 |
| DENV | prMFJ547066 | DENV | prMAB189128 | DENV | prMEU482559 |
| DENV | prMEU529698 | DENV | prMAY676353 | DENV | prMFJ639721 |
| DENV | prMEU726769 | DENV | prMEU081209 | DENV | prMAY744682 |
| DENV | prMAY676349 | DENV | prMFJ639772 | DENV | prMEU081184 |
| DENV | prMEU529688 | DENV | prMFJ182040 | DENV | prMFJ639805 |
| DENV | prMEU482558 | DENV | prMAY648961 | DENV | prMFJ547074 |
| DENV | prMFJ547070 | DENV | prMFJ410178 | DENV | prMEU529685 |
| DENV | prMEU687198 | DENV | prMEU529699 | DENV | prMDQ401695 |
| DENV | prMFJ639817 | DENV | prMEU081199 | DENV | prMFJ432743 |
| DENV | prMEU081202 | DENV | prMFJ639786 | DENV | prMEU854291 |
| DENV | prMEU081225 | DENV | prMFJ639768 | DENV | prMFJ182008 |
| DENV | prMDQ675520 | DENV | prMFJ639731 | DENV | prMFJ547062 |
| DENV | prMEU854298 | DENV | prMFJ390373 | DENV | prMFJ024467 |
| DENV | prMFJ205870 | DENV | prMFJ639800 | DENV | prMEU687239 |
| DENV | prMFJ639793 | DENV | prMFJ547079 | DENV | prMFJ024468 |
| DENV | prMDQ675532 | DENV | prMFJ547072 | DENV | prMAY496874 |
| DENV | prMFJ024470 | DENV | prMEU081219 | DENV | prMFJ547061 |
| DENV | prMEU081210 | DENV | prMEU596493 | DENV | prMFJ547076 |
| DENV | prMEU687226 | DENV | prMEU081192 | DENV | prMFJ639767 |
| DENV | prMFJ639715 | DENV | prMFJ432731 | DENV | prMAB189125 |
| DENV | prMAY676352 | DENV | prMAB189126 | DENV | prMAF317645 |
| DENV | prMAY858043 | DENV | prMFJ024471 | DENV | prMAB189127 |
| DENV | prMEU081196 | DENV | prMFJ639769 | DENV | prMEU781137 |
| DENV | prMFJ432741 | DENV | prMFJ547078 | DENV | prMDQ675522 |
| DENV | prMEU726773 | DENV | prMFJ547080 | DENV | prMEU482614 |
| DENV | prMEU482555 | DENV | prMAY744679 | DENV | prMAB214879 |
| DENV | prMDQ401694 | DENV | prMEU081217 | DENV | prMFJ639765 |
| DENV | prMEU081216 | DENV | prMAY858045 | DENV | prMEU081211 |
| DENV | prMEU529704 | DENV | prMFJ547084 | DENV | prMFJ639787 |
| DENV | prMFJ639777 | DENV | prMDQ675521 | DENV | prMFJ639784 |
| DENV | prMFJ639730 | DENV | prMAY776329 | DENV | prMEU569690 |
| DENV | prMEU081190 | DENV | prMFJ639789 | DENV | prMEU081223 |
| DENV | prMEU529703 | DENV | prMAY496871 | DENV | prMFJ639816 |
| DENV | prMFJ639725 | DENV | prMEU781136 | DENV | prMAY496873 |
| DENV | prMEU081205 | DENV | prMFJ182013 | DENV | prMFJ182010 |
| DENV | prMAY876494 | DENV | prMEU596492 | DENV | prMAY099337 |
| DENV | prMFJ639747 | DENV | prMEU726774 | DENV | prMAY496879 |
| DENV | prMFJ373302 | DENV | prMEU081198 | DENV | prMEU482462 |
| DENV | prMFJ639778 | DENV | prMFJ639728 | DENV | prMFJ639825 |
| DENV | prMDQ401692 | DENV | prMDQ675530 | DENV | prMAY766104 |
| DENV | prMFJ182038 | DENV | prMEU660409 | DENV | prMFJ182007 |
| DENV | prMEU081220 | DENV | prMEU081206 | DENV | prMDQ401693 |

FIG. 70-201

| Virus | Protein Accession No. | Virus | Protein Accession No. | Virus | Protein Accession No. |
|---|---|---|---|---|---|
| DENV | prMDQ675531 | DENV | prMEU482596 | DENV | prMEU081197 |
| DENV | prMFJ461326 | DENV | prMEU081208 | DENV | prMFJ639755 |
| DENV | prMFJ373306 | DENV | prMEU081201 | DENV | prMFJ639798 |
| DENV | prMEU569689 | DENV | prMFJ639757 | DENV | prMFJ639758 |
| DENV | prMAY858041 | DENV | prMFJ639713 | DENV | prMEU687218 |
| DENV | prMEU482566 | DENV | prMAY744685 | DENV | prMEU081189 |
| DENV | prMEF629370 | DENV | prMFJ182041 | DENV | prMFJ639759 |
| DENV | prMAY496877 | DENV | prMFJ562099 | DENV | prMEU081212 |
| DENV | prMFJ562102 | DENV | prMFJ562100 | DENV | prMEU482460 |
| DENV | prMEF629367 | DENV | prMFJ547081 | DENV | prMFJ547075 |
| DENV | prMFJ547077 | DENV | prMAY858044 | DENV | prMAY676350 |
| DENV | prMFJ639770 | DENV | prMFJ639714 | DENV | prMEU854292 |
| DENV | prMEU081182 | DENV | prMEU529686 | DENV | prMEU660410 |
| DENV | prMEU596494 | DENV | prMFJ410229 | DENV | prMFJ432728 |
| DENV | prMFJ639749 | DENV | prMFJ547073 | DENV | prMFJ024469 |
| DENV | prMEU726771 | DENV | prMFJ639791 | DENV | prMAY858048 |
| DENV | prMFJ639746 | DENV | prMEU529692 | DENV | prMFJ639804 |
| DENV | prMEU081214 | DENV | prMFJ547082 | DENV | prMEU529705 |
| DENV | prMAY858039 | DENV | prMEU367962 | DENV | prMEU482454 |
| DENV | prMEU660411 | DENV | prMFJ390375 | DENV | prMDQ401691 |
| DENV | prMEU482563 | DENV | prMAY858040 | DENV | prMFJ639771 |
| DENV | prMAY744678 | DENV | prMFJ547069 | DENV | prMFJ639754 |
| DENV | prMFJ461334 | DENV | prMFJ562107 | DENV | prMEU482459 |
| DENV | prMEU660420 | DENV | prMFJ461338 | DENV | prMFJ205871 |
| DENV | prMFJ024466 | DENV | prMFJ639722 | DENV | prMEU081186 |
| DENV | prMFJ639795 | DENV | prMFJ639782 | DENV | prMFJ547083 |
| DENV | prMFJ024465 | DENV | prMAY858042 | DENV | prMFJ639762 |
| DENV | prMEU726768 | DENV | prMEU081185 | DENV | prMFJ547071 |
| DENV | prMFJ639720 | DENV | prMFJ390377 | DENV | prMEU529702 |
| DENV | prMEU529696 | DENV | prMFJ639763 | DENV | prMEU687234 |
| DENV | prMFJ639810 | DENV | prMFJ639760 | DENV | prMFJ182006 |
| DENV | prMAY744681 | DENV | prMFJ182009 | DENV | prMAY662691 |
| DENV | prMFJ639724 | DENV | prMEU529697 | DENV | prMEU081213 |
| DENV | prMEU482595 | DENV | prMDQ675529 | DENV | prMEU081181 |
| DENV | prMAY676351 | DENV | prMFJ639727 | DENV | prMFJ390372 |
| DENV | prMDQ401689 | DENV | prMFJ461329 | DENV | prMEU482613 |
| DENV | prMFJ182005 | DENV | prMEU482457 | DENV | prMFJ639790 |
| DENV | prMFJ547085 | DENV | prMFJ639827 | DENV | prMDQ675519 |
| DENV | prMEU081193 | DENV | prMEU687197 | DENV | prMEU687233 |
| DENV | prMFJ639751 | DENV | prMFJ639801 | DENV | prMEF629369 |
| DENV | prMDQ675525 | DENV | prMFJ410176 | DENV | prMFJ182004 |
| DENV | prMFJ639826 | DENV | prMEU081218 | DENV | prMFJ639799 |
| DENV | prMEU482458 | DENV | prMAY744684 | DENV | prMFJ562097 |
| DENV | prMEU081204 | DENV | prMFJ390376 | DENV | prMFJ639712 |
| DENV | prMEU529691 | DENV | prMFJ639781 | DENV | prMEF629366 |
| DENV | prMFJ639719 | DENV | prMDQ675528 | DENV | prMEU726772 |
| DENV | prMFJ182037 | DENV | prMFJ639766 | DENV | prMDQ675526 |
| DENV | prMEU482612 | DENV | prMEU687221 | DENV | prMEU482452 |

FIG. 70-202

| Virus | Protein | Accession No. | Virus | Protein | Accession No. | Virus | Protein | Accession No. |
|---|---|---|---|---|---|---|---|---|
| DENV | prM | AY858038 | DENV | prM | FJ898457 | DENV | prM | FJ850086 |
| DENV | prM | EU482456 | DENV | prM | FJ744736 | DENV | prM | FJ882572 |
| DENV | prM | EU081200 | DENV | prM | FJ810416 | DENV | prM | FJ882578 |
| DENV | prM | FJ639756 | DENV | prM | FJ898474 | DENV | prM | FJ850092 |
| DENV | prM | AY744677 | DENV | prM | FJ850094 | DENV | prM | AB214882 |
| DENV | prM | AY744683 | DENV | prM | FJ898470 | DENV | prM | AB214880 |
| DENV | prM | FJ639753 | DENV | prM | FJ810413 | DENV | prM | AB214881 |
| DENV | prM | FJ639716 | DENV | prM | FJ744735 | DENV | prM | FB667400 |
| DENV | prM | EU081194 | DENV | prM | GQ199860 | DENV | prM | GQ868587 |
| DENV | prM | FJ639776 | DENV | prM | FJ898464 | DENV | prM | EU932688 |
| DENV | prM | FJ898469 | DENV | prM | FJ744729 | DENV | prM | FN429906 |
| DENV | prM | GQ252674 | DENV | prM | FJ898472 | DENV | prM | GU131916 |
| DENV | prM | FJ850055 | DENV | prM | GQ199862 | DENV | prM | GU131953 |
| DENV | prM | FJ898475 | DENV | prM | FJ873812 | DENV | prM | GU131850 |
| DENV | prM | FJ744739 | DENV | prM | FJ898441 | DENV | prM | FN429900 |
| DENV | prM | NC_001475 | DENV | prM | FJ850048 | DENV | prM | GQ868576 |
| DENV | prM | GQ199863 | DENV | prM | FJ850080 | DENV | prM | GU131946 |
| DENV | prM | FJ850089 | DENV | prM | FJ882577 | DENV | prM | GU131866 |
| DENV | prM | FJ898442 | DENV | prM | FJ850096 | DENV | prM | GU131862 |
| DENV | prM | FJ898459 | DENV | prM | FJ898473 | DENV | prM | GU131852 |
| DENV | prM | FJ850049 | DENV | prM | FJ882574 | DENV | prM | FN429897 |
| DENV | prM | FJ744730 | DENV | prM | FJ898445 | DENV | prM | GQ868571 |
| DENV | prM | FJ850097 | DENV | prM | GQ199888 | DENV | prM | GQ868626 |
| DENV | prM | FJ744728 | DENV | prM | FJ898443 | DENV | prM | GQ868546 |
| DENV | prM | FJ898458 | DENV | prM | FJ744726 | DENV | prM | FN429904 |
| DENV | prM | FJ744740 | DENV | prM | FJ898476 | DENV | prM | GU131904 |
| DENV | prM | GQ199889 | DENV | prM | FJ898468 | DENV | prM | GU131935 |
| DENV | prM | GQ199886 | DENV | prM | FJ744733 | DENV | prM | GU131910 |
| DENV | prM | FJ687448 | DENV | prM | GQ199871 | DENV | prM | GU131918 |
| DENV | prM | FJ744732 | DENV | prM | GQ199887 | DENV | prM | GU131937 |
| DENV | prM | FJ898446 | DENV | prM | GQ199864 | DENV | prM | GU131868 |
| DENV | prM | GQ199861 | DENV | prM | FJ744737 | DENV | prM | GU131951 |
| DENV | prM | FJ898455 | DENV | prM | FJ898456 | DENV | prM | FN429910 |
| DENV | prM | FJ882573 | DENV | prM | FJ850083 | DENV | prM | GU131854 |
| DENV | prM | FJ898463 | DENV | prM | FJ744731 | DENV | prM | GU131943 |
| DENV | prM | FJ898447 | DENV | prM | FJ850079 | DENV | prM | GU131861 |
| DENV | prM | FJ882571 | DENV | prM | FJ744700 | DENV | prM | GU131871 |
| DENV | prM | FJ898462 | DENV | prM | FJ882576 | DENV | prM | GU131933 |
| DENV | prM | GQ199870 | DENV | prM | GQ199891 | DENV | prM | GU131877 |
| DENV | prM | FJ898471 | DENV | prM | FJ850111 | DENV | prM | GU131911 |
| DENV | prM | FJ882575 | DENV | prM | FJ850056 | DENV | prM | GQ868628 |
| DENV | prM | FJ744738 | DENV | prM | FJ744727 | DENV | prM | GQ868574 |
| DENV | prM | FJ898440 | DENV | prM | FJ873813 | DENV | prM | GU131941 |
| DENV | prM | FJ898444 | DENV | prM | AY770511 | DENV | prM | GQ868577 |
| DENV | prM | GQ199865 | DENV | prM | FJ850098 | DENV | prM | GQ868547 |
| DENV | prM | GQ252678 | DENV | prM | FJ810414 | DENV | prM | GU131845 |
| DENV | prM | FJ850110 | DENV | prM | FJ850109 | DENV | prM | FN429899 |
| DENV | prM | FJ744734 | DENV | prM | FJ850052 | DENV | prM | FN429902 |

FIG. 70-203

| Virus | Protein Accession No. | Virus | Protein Accession No. | Virus | Protein Accession No. |
|---|---|---|---|---|---|
| DENV | prMFN429917 | DENV | prMFN429909 | DENV | prMEU482468 |
| DENV | prMFN429915 | DENV | prMFN429911 | DENV | prMFJ410195 |
| DENV | prMGU131855 | DENV | prMGU131945 | DENV | prMAB122021 |
| DENV | prMFN429896 | DENV | prMFN429916 | DENV | prMEU482469 |
| DENV | prMGU131844 | DENV | prMFN429914 | DENV | prMFM210231 |
| DENV | prMGQ868573 | DENV | prMGU131942 | DENV | prMFJ639831 |
| DENV | prMGQ868586 | DENV | prMGU131849 | DENV | prMEU482657 |
| DENV | prMGU131858 | DENV | prMGU131952 | DENV | prMEU482674 |
| DENV | prMFN429903 | DENV | prMGU131915 | DENV | prMEU482753 |
| DENV | prMGU131874 | DENV | prMGQ868578 | DENV | prMDQ645545 |
| DENV | prMGU131914 | DENV | prMGQ868548 | DENV | prMFJ639835 |
| DENV | prMFN429912 | DENV | prMGU131913 | DENV | prMFJ432726 |
| DENV | prMFN429898 | DENV | prMGU131940 | DENV | prMEU482607 |
| DENV | prMGU131851 | DENV | prMFN429918 | DENV | prMEU482660 |
| DENV | prMGU131938 | DENV | prMFN429905 | DENV | prMEU482766 |
| DENV | prMGU131853 | DENV | prMGU131907 | DENV | prMAB189124 |
| DENV | prMFN429907 | DENV | prMGU131860 | DENV | prMAF100461 |
| DENV | prMGU131865 | DENV | prMGU131954 | DENV | prMEU482600 |
| DENV | prMGU131906 | DENV | prMGU131856 | DENV | prMEU687230 |
| DENV | prMGU131944 | DENV | prMGU131847 | DENV | prMEU482633 |
| DENV | prMGU131936 | DENV | prMGU131909 | DENV | prMEU482726 |
| DENV | prMGU131903 | DENV | prMGU131939 | DENV | prMEU482557 |
| DENV | prMGU131908 | DENV | prMGU131912 | DENV | prMEU482444 |
| DENV | prMGU131878 | DENV | prMGU131859 | DENV | prMFJ205877 |
| DENV | prMGU131950 | DENV | prMGU131857 | DENV | prMEU482621 |
| DENV | prMGQ868634 | DENV | prMGQ868629 | DENV | prMEU482736 |
| DENV | prMGU131873 | DENV | prMGU131905 | DENV | prMEU596497 |
| DENV | prMGQ868593 | DENV | prMGU131848 | DENV | prMM84728 |
| DENV | prMGQ868572 | DENV | prMFB667402 | DENV | prMEU482549 |
| DENV | prMDQ863638 | DENV | prMFB667403 | DENV | prMFM210228 |
| DENV | prMGU131876 | DENV | prMFJ177308 | DENV | prMEU687216 |
| DENV | prMEU932687 | DENV | prMFB667404 | DENV | prMEU596489 |
| DENV | prMGU189648 | DENV | prMFB667398 | DENV | prMEU482576 |
| DENV | prMFN429913 | DENV | prMFB667399 | DENV | prMAF100460 |
| DENV | prMGU131867 | DENV | prMCS805345 | DENV | prMAF169679 |
| DENV | prMGQ868575 | DENV | prMEU482634 | DENV | prMEU482665 |
| DENV | prMGQ868617 | DENV | prMFJ373301 | DENV | prMEU482586 |
| DENV | prMGQ868616 | DENV | prMEU482582 | DENV | prMAF169681 |
| DENV | prMGU131870 | DENV | prMEU687227 | DENV | prMFM210205 |
| DENV | prMGU131869 | DENV | prMEU569710 | DENV | prMEU482767 |
| DENV | prMGU131846 | DENV | prMEF105383 | DENV | prMEU687240 |
| DENV | prMGU131934 | DENV | prMEU687249 | DENV | prMAF169686 |
| DENV | prMGQ868627 | DENV | prMEU687242 | DENV | prMEU687244 |
| DENV | prMFN429908 | DENV | prMEU482658 | DENV | prMEU482683 |
| DENV | prMGU131872 | DENV | prMFJ639710 | DENV | prMFJ373299 |
| DENV | prMFN429901 | DENV | prMEU482748 | DENV | prMEU482601 |
| DENV | prMGU131917 | DENV | prMFJ205885 | DENV | prMEU660404 |
| DENV | prMGU131875 | DENV | prMEU482470 | DENV | prMEU482651 |

FIG. 70-204

| Virus | Protein Accession No. | Virus | Protein Accession No. | Virus | Protein Accession No. |
|---|---|---|---|---|---|
| DENV | prMEU482787 | DENV | prMFJ205879 | DENV | prMFJ639707 |
| DENV | prMFM210216 | DENV | prMEU569697 | DENV | prMEU482637 |
| DENV | prMEU569694 | DENV | prMEU482691 | DENV | prMEU482699 |
| DENV | prMEU482648 | DENV | prMFJ461309 | DENV | prMEU482583 |
| DENV | prMEU482620 | DENV | prMEU482608 | DENV | prMFJ639717 |
| DENV | prMEU482471 | DENV | prMEU726776 | DENV | prMEU687223 |
| DENV | prMEU482644 | DENV | prMEU081177 | DENV | prMAY702036 |
| DENV | prMFJ639833 | DENV | prMFM210213 | DENV | prMEU482542 |
| DENV | prMEU482445 | DENV | prMEU854293 | DENV | prMEU482587 |
| DENV | prMEU482606 | DENV | prMEU482632 | DENV | prMEU482667 |
| DENV | prMFM210236 | DENV | prMFM210234 | DENV | prMEU482695 |
| DENV | prMEU482639 | DENV | prMEU482745 | DENV | prMEU569720 |
| DENV | prMEU003591 | DENV | prMEU482593 | DENV | prMAY702037 |
| DENV | prMEU482547 | DENV | prMEU569718 | DENV | prMAY858036 |
| DENV | prMFJ478459 | DENV | prMEU482719 | DENV | prMDQ645544 |
| DENV | prMFJ639837 | DENV | prMEF051521 | DENV | prMFJ639822 |
| DENV | prMFJ390387 | DENV | prMFM210238 | DENV | prMAF100466 |
| DENV | prMDQ645547 | DENV | prMFJ478455 | DENV | prMFJ410215 |
| DENV | prMEU596496 | DENV | prMAF100465 | DENV | prMEU569705 |
| DENV | prMEU482597 | DENV | prMEU529694 | DENV | prMFM210241 |
| DENV | prMEU482463 | DENV | prMEU081178 | DENV | prMFM210221 |
| DENV | prMEU482553 | DENV | prMEU482676 | DENV | prMEU687228 |
| DENV | prMEU482548 | DENV | prMFJ639709 | DENV | prMEU482703 |
| DENV | prMEU482641 | DENV | prMFM210208 | DENV | prMEU529700 |
| DENV | prMFJ639703 | DENV | prMFJ410208 | DENV | prMDQ645555 |
| DENV | prMEU482647 | DENV | prMEU569716 | DENV | prMEU687231 |
| DENV | prMEU596487 | DENV | prMEU482786 | DENV | prMEU660406 |
| DENV | prMFJ639788 | DENV | prMAF276619 | DENV | prMEU687241 |
| DENV | prMFM210206 | DENV | prMEU482625 | DENV | prMFJ639700 |
| DENV | prMDQ645556 | DENV | prMEU687248 | DENV | prMFJ639711 |
| DENV | prMAF169682 | DENV | prMEU482662 | DENV | prMU87412 |
| DENV | prMAY858035 | DENV | prMEU569708 | DENV | prMEU482599 |
| DENV | prMEU687220 | DENV | prMFM210240 | DENV | prMEU482654 |
| DENV | prMEU482636 | DENV | prMEU482777 | DENV | prMEU569721 |
| DENV | prMEU482650 | DENV | prMFJ639705 | DENV | prMFJ390385 |
| DENV | prMEU482704 | DENV | prMEU482669 | DENV | prMEU482589 |
| DENV | prMEU482661 | DENV | prMDQ645553 | DENV | prMEU482551 |
| DENV | prMEU569699 | DENV | prMFM210210 | DENV | prMEU660400 |
| DENV | prMEU482580 | DENV | prMEF457904 | DENV | prMEU482679 |
| DENV | prMFM210215 | DENV | prMFJ410237 | DENV | prMAF204177 |
| DENV | prMFJ639733 | DENV | prMAY702035 | DENV | prMFJ461311 |
| DENV | prMEF105389 | DENV | prMEU482757 | DENV | prMEU569700 |
| DENV | prMEF105384 | DENV | prMEU596499 | DENV | prMEU482737 |
| DENV | prMEU677146 | DENV | prMEU482543 | DENV | prMEU482573 |
| DENV | prMEU596498 | DENV | prMEU687217 | DENV | prMAY702040 |
| DENV | prMFJ410288 | DENV | prMEU482646 | DENV | prMDQ181803 |
| DENV | prMFJ373300 | DENV | prMEU482746 | DENV | prMEU482741 |
| DENV | prMEU482702 | DENV | prMFJ410217 | DENV | prMEU660399 |

FIG. 70-205

| Virus | Protein | Accession No. | Virus | Protein | Accession No. | Virus | Protein | Accession No. |
|---|---|---|---|---|---|---|---|---|
| DENV | prM | EU482784 | DENV | prM | EU482578 | DENV | prM | EU677138 |
| DENV | prM | EU482584 | DENV | prM | EU482781 | DENV | prM | EU621672 |
| DENV | prM | EU482670 | DENV | prM | EU596485 | DENV | prM | AF359579 |
| DENV | prM | DQ181801 | DENV | prM | EU687224 | DENV | prM | EU482645 |
| DENV | prM | EU482603 | DENV | prM | FJ461321 | DENV | prM | EU482760 |
| DENV | prM | EU482769 | DENV | prM | FJ390390 | DENV | prM | FJ639732 |
| DENV | prM | FM210227 | DENV | prM | EU482562 | DENV | prM | FM210229 |
| DENV | prM | AY744147 | DENV | prM | EF105390 | DENV | prM | EU482684 |
| DENV | prM | EU482656 | DENV | prM | EU482782 | DENV | prM | EF105378 |
| DENV | prM | EU529706 | DENV | prM | EU482682 | DENV | prM | EU482681 |
| DENV | prM | EU687212 | DENV | prM | EU056810 | DENV | prM | FJ547090 |
| DENV | prM | DQ645541 | DENV | prM | EU687236 | DENV | prM | EU482447 |
| DENV | prM | DQ181800 | DENV | prM | EU482448 | DENV | prM | EU482624 |
| DENV | prM | EU482721 | DENV | prM | FJ639698 | DENV | prM | AF119661 |
| DENV | prM | EU677145 | DENV | prM | EU482630 | DENV | prM | EU660413 |
| DENV | prM | EU482450 | DENV | prM | EU359009 | DENV | prM | AF169685 |
| DENV | prM | EU482541 | DENV | prM | EU482768 | DENV | prM | EU482771 |
| DENV | prM | AF169688 | DENV | prM | EU482672 | DENV | prM | EU482604 |
| DENV | prM | M19197 | DENV | prM | EU569711 | DENV | prM | FJ410223 |
| DENV | prM | EU482594 | DENV | prM | EU482627 | DENV | prM | EU482739 |
| DENV | prM | DQ645554 | DENV | prM | EU569715 | DENV | prM | EU687243 |
| DENV | prM | DQ181798 | DENV | prM | EU482678 | DENV | prM | EU482720 |
| DENV | prM | AY702038 | DENV | prM | DQ181799 | DENV | prM | EU482730 |
| DENV | prM | EU596495 | DENV | prM | EU687235 | DENV | prM | EU482779 |
| DENV | prM | FM210245 | DENV | prM | EU687238 | DENV | prM | AB122020 |
| DENV | prM | FM210214 | DENV | prM | M84727 | DENV | prM | FM210244 |
| DENV | prM | EU482685 | DENV | prM | EU482763 | DENV | prM | AF100469 |
| DENV | prM | EU482570 | DENV | prM | EU482758 | DENV | prM | FJ410221 |
| DENV | prM | DQ645540 | DENV | prM | FJ639830 | DENV | prM | EU482626 |
| DENV | prM | EU660414 | DENV | prM | EU482754 | DENV | prM | EU482788 |
| DENV | prM | FJ024477 | DENV | prM | FM210218 | DENV | prM | FJ410219 |
| DENV | prM | AF100463 | DENV | prM | FJ410224 | DENV | prM | AF100462 |
| DENV | prM | DQ645546 | DENV | prM | FJ410193 | DENV | prM | EU482696 |
| DENV | prM | EU569703 | DENV | prM | EU056811 | DENV | prM | EU482544 |
| DENV | prM | EU482652 | DENV | prM | EU482774 | DENV | prM | EU482640 |
| DENV | prM | EU596490 | DENV | prM | EU482568 | DENV | prM | FJ182012 |
| DENV | prM | EU482693 | DENV | prM | EU482588 | DENV | prM | DQ645548 |
| DENV | prM | EU482734 | DENV | prM | EU482475 | DENV | prM | FJ639701 |
| DENV | prM | FM210202 | DENV | prM | AF489932 | DENV | prM | EU482655 |
| DENV | prM | EU482729 | DENV | prM | FM210211 | DENV | prM | AB189122 |
| DENV | prM | AF169680 | DENV | prM | EU687246 | DENV | prM | DQ181804 |
| DENV | prM | EU482623 | DENV | prM | FJ390389 | DENV | prM | EU482732 |
| DENV | prM | EU569693 | DENV | prM | EU482464 | DENV | prM | DQ645543 |
| DENV | prM | EU482590 | DENV | prM | EU482697 | DENV | prM | FJ639832 |
| DENV | prM | FJ639834 | DENV | prM | EU482765 | DENV | prM | FJ226066 |
| DENV | prM | EU482449 | DENV | prM | FM210209 | DENV | prM | AF169687 |
| DENV | prM | EU687237 | DENV | prM | EU482474 | DENV | prM | EU482752 |
| DENV | prM | EF105381 | DENV | prM | EU596484 | DENV | prM | EU482783 |

FIG. 70-206

| Virus | Protein | Accession No. | Virus | Protein | Accession No. | Virus | Protein | Accession No. |
|---|---|---|---|---|---|---|---|---|
| DENV | prM | EU482742 | DENV | prM | FJ410200 | DENV | prM | AY776328 |
| DENV | prM | FJ461314 | DENV | prM | DQ645552 | DENV | prM | EU482675 |
| DENV | prM | EU482688 | DENV | prM | EU482574 | DENV | prM | EU660417 |
| DENV | prM | DQ181802 | DENV | prM | EU482622 | DENV | prM | EU482727 |
| DENV | prM | FJ639809 | DENV | prM | EU482561 | DENV | prM | EU482602 |
| DENV | prM | EU482701 | DENV | prM | EU596486 | DENV | prM | EU482577 |
| DENV | prM | AF204178 | DENV | prM | EU569695 | DENV | prM | EU482756 |
| DENV | prM | FJ639706 | DENV | prM | FJ024461 | DENV | prM | EU529701 |
| DENV | prM | EU482550 | DENV | prM | EU569713 | DENV | prM | FJ639702 |
| DENV | prM | EU482605 | DENV | prM | FM210224 | DENV | prM | EU482772 |
| DENV | prM | EU482554 | DENV | prM | EU482556 | DENV | prM | FM210246 |
| DENV | prM | EU482692 | DENV | prM | EU482731 | DENV | prM | FJ390391 |
| DENV | prM | EU482680 | DENV | prM | EU179858 | DENV | prM | AF100464 |
| DENV | prM | AF169683 | DENV | prM | EU781135 | DENV | prM | FJ547067 |
| DENV | prM | FJ024458 | DENV | prM | EU482743 | DENV | prM | EF105386 |
| DENV | prM | EU482780 | DENV | prM | EU482751 | DENV | prM | EF105387 |
| DENV | prM | EU482750 | DENV | prM | FJ410259 | DENV | prM | EU726775 |
| DENV | prM | EU179857 | DENV | prM | EU482747 | DENV | prM | FJ639704 |
| DENV | prM | EU569698 | DENV | prM | EU687225 | DENV | prM | AF169678 |
| DENV | prM | EU482571 | DENV | prM | FJ639718 | DENV | prM | EU482749 |
| DENV | prM | EU081179 | DENV | prM | EU569707 | DENV | prM | EU482631 |
| DENV | prM | EU482690 | DENV | prM | EU677147 | DENV | prM | EF105388 |
| DENV | prM | EU687215 | DENV | prM | FM210223 | DENV | prM | AB189123 |
| DENV | prM | EU482664 | DENV | prM | EU081180 | DENV | prM | EU482663 |
| DENV | prM | DQ181797 | DENV | prM | EU482728 | DENV | prM | EU677149 |
| DENV | prM | EU569701 | DENV | prM | EU596500 | DENV | prM | EU569719 |
| DENV | prM | EU482773 | DENV | prM | EU482671 | DENV | prM | EU482778 |
| DENV | prM | EU482722 | DENV | prM | EU179859 | DENV | prM | DQ645551 |
| DENV | prM | EU482635 | DENV | prM | EU482705 | DENV | prM | EU482689 |
| DENV | prM | DQ645549 | DENV | prM | EU482552 | DENV | prM | EU726770 |
| DENV | prM | EU482629 | DENV | prM | EU482546 | DENV | prM | AB122022 |
| DENV | prM | EU596488 | DENV | prM | EU482642 | DENV | prM | FJ639697 |
| DENV | prM | FJ639836 | DENV | prM | EU482579 | DENV | prM | EU482628 |
| DENV | prM | EU482733 | DENV | prM | M20558 | DENV | prM | EU687232 |
| DENV | prM | EU677143 | DENV | prM | EU482775 | DENV | prM | FM210225 |
| DENV | prM | EU482653 | DENV | prM | EU596491 | DENV | prM | AY037116 |
| DENV | prM | AF208496 | DENV | prM | FJ639708 | DENV | prM | FJ205878 |
| DENV | prM | EU482565 | DENV | prM | FM210220 | DENV | prM | AY702034 |
| DENV | prM | EU482598 | DENV | prM | EU569717 | DENV | prM | FM210232 |
| DENV | prM | M29095 | DENV | prM | EF105379 | DENV | prM | AY702039 |
| DENV | prM | EU660415 | DENV | prM | EU569712 | DENV | prM | EU687245 |
| DENV | prM | FM210239 | DENV | prM | EU482755 | DENV | prM | EU482465 |
| DENV | prM | EU687213 | DENV | prM | DQ181805 | DENV | prM | EU482472 |
| DENV | prM | EU677144 | DENV | prM | FM210207 | DENV | prM | EU569714 |
| DENV | prM | FM210243 | DENV | prM | FM210233 | DENV | prM | EU569692 |
| DENV | prM | AF100459 | DENV | prM | EU687199 | DENV | prM | FJ410233 |
| DENV | prM | EU482466 | DENV | prM | EU482686 | DENV | prM | AF100467 |
| DENV | prM | FM210230 | DENV | prM | FJ205880 | DENV | prM | EU677148 |

FIG. 70-207

| Virus | Protein Accession No. | Virus | Protein Accession No. | Virus | Protein Accession No. |
|---|---|---|---|---|---|
| DENV | prMEF105380 | DENV | prMEU687250 | DENV | prMGQ199874 |
| DENV | prMEU482677 | DENV | prMEU482735 | DENV | prMFJ744745 |
| DENV | prMAF100468 | DENV | prMEU482785 | DENV | prMFJ898467 |
| DENV | prMEU482569 | DENV | prMEU596483 | DENV | prMFJ687444 |
| DENV | prMDQ645542 | DENV | prMEU569702 | DENV | prMFJ810411 |
| DENV | prMEU482643 | DENV | prMFJ410241 | DENV | prMFJ850067 |
| DENV | prMEU482694 | DENV | prMEU482659 | DENV | prMFJ850121 |
| DENV | prMEU482724 | DENV | prMFM210203 | DENV | prMFJ898452 |
| DENV | prMEU482446 | DENV | prMEU482581 | DENV | prMFJ744713 |
| DENV | prMFM210226 | DENV | prMEU569696 | DENV | prMFJ810418 |
| DENV | prMEU482744 | DENV | prMFJ562098 | DENV | prMFJ906962 |
| DENV | prMEU677137 | DENV | prMFM210222 | DENV | prMFJ744721 |
| DENV | prMEU482770 | DENV | prMEU482473 | DENV | prMFJ850107 |
| DENV | prMAF038403 | DENV | prMEU854294 | DENV | prMFJ467493 |
| DENV | prMEU660398 | DENV | prMEU482649 | DENV | prMFJ906966 |
| DENV | prMEU569709 | DENV | prMEU726767 | DENV | prMFJ687446 |
| DENV | prMFM210237 | DENV | prMFJ024454 | DENV | prMFJ906958 |
| DENV | prMEU660416 | DENV | prMFJ639699 | DENV | prMFJ687435 |
| DENV | prMEU677142 | DENV | prMFM210204 | DENV | prMFJ850054 |
| DENV | prMEU482700 | DENV | prMEU529695 | DENV | prMFJ906967 |
| DENV | prMEU482545 | DENV | prMEU687222 | DENV | prMFJ850072 |
| DENV | prMEU482585 | DENV | prMEF105382 | DENV | prMFJ898439 |
| DENV | prMFJ024475 | DENV | prMEU482738 | DENV | prMFJ850088 |
| DENV | prMEU482725 | DENV | prMEF105385 | DENV | prMFJ898435 |
| DENV | prMEU482687 | DENV | prMFM210219 | DENV | prMGQ252676 |
| DENV | prMEU529693 | DENV | prMEU482723 | DENV | prMFJ850065 |
| DENV | prMFJ390384 | DENV | prMFJ639829 | DENV | prMFJ898477 |
| DENV | prMEU482560 | DENV | prMEU482575 | DENV | prMFJ850116 |
| DENV | prMEU482761 | DENV | prMAF038402 | DENV | prMFJ898454 |
| DENV | prMEU482638 | DENV | prMFJ639783 | DENV | prMGQ199897 |
| DENV | prMEU482698 | DENV | prMEU482572 | DENV | prMGQ199899 |
| DENV | prMEU482764 | DENV | prMFJ639734 | DENV | prMFJ744723 |
| DENV | prMFJ182014 | DENV | prMEU482762 | DENV | prMGQ199900 |
| DENV | prMEU482776 | DENV | prMEU569704 | DENV | prMFJ850082 |
| DENV | prMDQ645550 | DENV | prMEU482759 | DENV | prMFJ744715 |
| DENV | prMFJ024473 | DENV | prMEU056812 | DENV | prMFJ744709 |
| DENV | prMDQ181806 | DENV | prMFJ410228 | DENV | prMGQ199868 |
| DENV | prMFJ461305 | DENV | prMEU482467 | DENV | prMFJ906960 |
| DENV | prMFJ024452 | DENV | prMFM210217 | DENV | prMFJ882602 |
| DENV | prMEU677141 | DENV | prMFM210212 | DENV | prMGQ199895 |
| DENV | prMFJ639828 | DENV | prMEU660405 | DENV | prMFJ687436 |
| DENV | prMEU569706 | DENV | prMFJ547064 | DENV | prMFJ744725 |
| DENV | prMEU482666 | DENV | prMEU482740 | DENV | prMFJ850117 |
| DENV | prMEU482673 | DENV | prMEU482451 | DENV | prMFJ687441 |
| DENV | prMFJ024474 | DENV | prMEU482668 | DENV | prMFJ744706 |
| DENV | prMEU687214 | DENV | prMEU687229 | DENV | prMFJ850074 |
| DENV | prMFJ410291 | DENV | prMAF169684 | DENV | prMFJ850085 |
| DENV | prMFM210242 | DENV | prMFM210235 | DENV | prMFJ850061 |

FIG. 70-208

| Virus | Protein Accession No. | Virus | Protein Accession No. | Virus | Protein Accession No. |
|---|---|---|---|---|---|
| DENV | prMFJ810409 | DENV | prMFJ906961 | DENV | prMAF022438 |
| DENV | prMFJ687434 | DENV | prMFJ882593 | DENV | prMAF022440 |
| DENV | prMGQ199890 | DENV | prMFJ898479 | DENV | prMCS479165 |
| DENV | prMFJ744743 | DENV | prMFJ744703 | DENV | prMGQ868556 |
| DENV | prMFJ850063 | DENV | prMFJ744712 | DENV | prMAB479041 |
| DENV | prMFJ898466 | DENV | prMFJ882594 | DENV | prMGU289914 |
| DENV | prMFJ850119 | DENV | prMFJ744716 | DENV | prMGU131884 |
| DENV | prMFJ898432 | DENV | prMFJ850066 | DENV | prMGQ868600 |
| DENV | prMFJ744718 | DENV | prMFJ744744 | DENV | prMFN429895 |
| DENV | prMFJ810412 | DENV | prMFJ850108 | DENV | prMGU131879 |
| DENV | prMFJ906956 | DENV | prMFJ859028 | DENV | prMGQ868596 |
| DENV | prMFJ850064 | DENV | prMFJ898465 | DENV | prMGQ868516 |
| DENV | prMGQ199892 | DENV | prMFJ898451 | DENV | prMGU131864 |
| DENV | prMFJ898436 | DENV | prMFJ898449 | DENV | prMFN429893 |
| DENV | prMFJ906957 | DENV | prMFJ744705 | DENV | prMGQ868598 |
| DENV | prMFJ898478 | DENV | prMFJ898434 | DENV | prMGQ868544 |
| DENV | prMFJ873811 | DENV | prMFJ906969 | DENV | prMGQ868589 |
| DENV | prMGQ199898 | DENV | prMFJ744741 | DENV | prMGQ868551 |
| DENV | prMFJ850115 | DENV | prMFJ906959 | DENV | prMGU131902 |
| DENV | prMFJ687442 | DENV | prMFJ850106 | DENV | prMGU131896 |
| DENV | prMFJ687439 | DENV | prMFJ744742 | DENV | prMGU131924 |
| DENV | prMFJ432724 | DENV | prMFJ687437 | DENV | prMGQ868640 |
| DENV | prMFJ687447 | DENV | prMFJ744707 | DENV | prMGU131880 |
| DENV | prMFJ873808 | DENV | prMFJ687438 | DENV | prMGU131882 |
| DENV | prMDQ448231 | DENV | prMFJ744714 | DENV | prMGQ868638 |
| DENV | prMFJ744710 | DENV | prMGQ199866 | DENV | prMGQ868553 |
| DENV | prMGQ252677 | DENV | prMGQ199894 | DENV | prMGQ868646 |
| DENV | prMNC_001474 | DENV | prMFJ687440 | DENV | prMFN429891 |
| DENV | prMFJ687445 | DENV | prMFJ850112 | DENV | prMGQ868604 |
| DENV | prMFJ850091 | DENV | prMFJ850078 | DENV | prMGU131947 |
| DENV | prMFJ687443 | DENV | prMFJ744717 | DENV | prMGU131928 |
| DENV | prMGQ199869 | DENV | prMFJ906968 | DENV | prMGQ868497 |
| DENV | prMFJ850105 | DENV | prMGQ199893 | DENV | prMGQ868603 |
| DENV | prMFJ850051 | DENV | prMFJ744711 | DENV | prMGQ868621 |
| DENV | prMFJ850050 | DENV | prMFJ744704 | DENV | prMAB479042 |
| DENV | prMFJ744719 | DENV | prMFJ744720 | DENV | prMGQ868620 |
| DENV | prMFJ898453 | DENV | prMGQ199901 | DENV | prMGQ868590 |
| DENV | prMFJ898460 | DENV | prMFJ744724 | DENV | prMFN429892 |
| DENV | prMFJ898438 | DENV | prMFJ850120 | DENV | prMGQ868554 |
| DENV | prMFJ850053 | DENV | prMFJ850118 | DENV | prMGU131974 |
| DENV | prMFJ898450 | DENV | prMFJ850076 | DENV | prMGU131843 |
| DENV | prMFJ744708 | DENV | prMAF022436 | DENV | prMGQ868641 |
| DENV | prMGQ199896 | DENV | prMAF022439 | DENV | prMGQ868542 |
| DENV | prMFJ744722 | DENV | prMAF022441 | DENV | prMGQ868555 |
| DENV | prMFJ850062 | DENV | prMAF022437 | DENV | prMFN429894 |
| DENV | prMFJ898461 | DENV | prMAJ487271 | DENV | prMGQ868549 |
| DENV | prMFJ810410 | DENV | prMAF022435 | DENV | prMGQ868588 |
| DENV | prMFJ850060 | DENV | prMAF022434 | DENV | prMGQ868541 |

FIG. 70-209

| Virus | Protein | Accession No. | Virus | Protein | Accession No. | Virus | Protein | Accession No. |
|---|---|---|---|---|---|---|---|---|
| DENV | prM | GQ868558 | DENV | prM | AY243469 | EBV | NS5 | DQ837641 |
| DENV | prM | GQ868625 | DENV | prM | AY744148 | EBV | prM | AY632537 |
| DENV | prM | GQ868624 | DENV | prM | AY744149 | EBV | prM | NC_008718 |
| DENV | prM | GQ868631 | DENV | prM | AY744150 | EBV | prM | DQ837641 |
| DENV | prM | GU131899 | DENV | prM | AJ968413 | GGV | 2K | DQ235145 |
| DENV | prM | GQ868515 | DENV | prM | GU369819 | GGV | anC | DQ235145 |
| DENV | prM | GU131898 | DENV | prM | GU370050 | GGV | E | DQ235145 |
| DENV | prM | GQ868623 | DENV | prM | GU370051 | GGV | NS1 | DQ235145 |
| DENV | prM | GU131886 | EHV | 2K | DQ859060 | GGV | NS2A | DQ235145 |
| DENV | prM | GQ868622 | EHV | anC | DQ859060 | GGV | NS2B | DQ235145 |
| DENV | prM | GQ868595 | EHV | E | DQ859060 | GGV | NS3 | DQ235145 |
| DENV | prM | GQ868557 | EHV | NS1 | DQ859060 | GGV | NS4A | DQ235145 |
| DENV | prM | GU131959 | EHV | NS2A | DQ859060 | GGV | NS4B | DQ235145 |
| DENV | prM | GU131955 | EHV | NS2B | DQ859060 | GGV | NS5 | DQ235145 |
| DENV | prM | GQ868597 | EHV | NS3 | DQ859060 | GGV | prM | DQ235145 |
| DENV | prM | GU131883 | EHV | NS4A | DQ859060 | GGEV | 2K | DQ235153 |
| DENV | prM | GQ868591 | EHV | NS4B | DQ859060 | GGEV | anC | DQ235153 |
| DENV | prM | GQ868543 | EHV | NS5 | DQ859060 | GGEV | E | DQ235153 |
| DENV | prM | GU131901 | EHV | prM | DQ859060 | GGEV | NS1 | DQ235153 |
| DENV | prM | GQ868545 | EBV | 2K | AY632537 | GGEV | NS2A | DQ235153 |
| DENV | prM | GU131931 | EBV | 2K | NC_008718 | GGEV | NS2B | DQ235153 |
| DENV | prM | GU131885 | EBV | 2K | DQ837641 | GGEV | NS3 | DQ235153 |
| DENV | prM | GU131932 | EBV | anC | AY632537 | GGEV | NS4A | DQ235153 |
| DENV | prM | GU131881 | EBV | anC | NC_008718 | GGEV | NS4B | DQ235153 |
| DENV | prM | GU131897 | EBV | anC | DQ837641 | GGEV | NS5 | DQ235153 |
| DENV | prM | GQ868592 | EBV | E | AY632537 | GGEV | prM | DQ235153 |
| DENV | prM | GQ868552 | EBV | E | NC_008718 | IGV | 2K | AY632538 |
| DENV | prM | GU131900 | EBV | E | DQ837641 | IGV | anC | AY632538 |
| DENV | prM | GQ868599 | EBV | NS1 | AY632537 | IGV | E | AY632538 |
| DENV | prM | GU131929 | EBV | NS1 | NC_008718 | IGV | NS1 | AY632538 |
| DENV | prM | GU131930 | EBV | NS1 | DQ837641 | IGV | NS2A | AY632538 |
| DENV | prM | GQ868550 | EBV | NS2A | AY632537 | IGV | NS2B | AY632538 |
| DENV | prM | GU131975 | EBV | NS2A | NC_008718 | IGV | NS3 | AY632538 |
| DENV | prM | GU131927 | EBV | NS2A | DQ837641 | IGV | NS4A | AY632538 |
| DENV | prM | GQ868540 | EBV | NS2B | AY632537 | IGV | NS4B | AY632538 |
| DENV | prM | FJ410202 | EBV | NS2B | NC_008718 | IGV | NS5 | AY632538 |
| DENV | prM | CS479202 | EBV | NS2B | DQ837641 | IGV | prM | AY632538 |
| DENV | prM | U87411 | EBV | NS3 | AY632537 | IV | 2K | AY632539 |
| DENV | prM | CS479203 | EBV | NS3 | NC_008718 | IV | 2K | NC_009028 |
| DENV | prM | CS479204 | EBV | NS3 | DQ837641 | IV | anC | AY632539 |
| DENV | prM | CS479167 | EBV | NS4A | AY632537 | IV | anC | NC_009028 |
| DENV | prM | CS479205 | EBV | NS4A | NC_008718 | IV | E | AY632539 |
| DENV | prM | CS479206 | EBV | NS4A | DQ837641 | IV | E | NC_009028 |
| DENV | prM | CS805344 | EBV | NS4B | AY632537 | IV | NS1 | AY632539 |
| DENV | prM | FB730117 | EBV | NS4B | NC_008718 | IV | NS1 | NC_009028 |
| DENV | prM | DL138662 | EBV | NS4B | DQ837641 | IV | NS2A | AY632539 |
| DENV | prM | GM059692 | EBV | NS5 | AY632537 | IV | NS2A | NC_009028 |
| DENV | prM | AY243468 | EBV | NS5 | NC_008718 | IV | NS2B | AY632539 |

FIG. 70-210

| Virus | Protein | Accession No. | Virus | Protein | Accession No. | Virus | Protein | Accession No. |
|---|---|---|---|---|---|---|---|---|
| IV | NS2B | NC_009028 | JEV | 2K | M55506 | JEV | anC | GU187972 |
| IV | NS3 | AY632539 | JEV | 2K | M18370 | JEV | anC | AY316157 |
| IV | NS3 | NC_009028 | JEV | 2K | AF045551 | JEV | anC | AY184212 |
| IV | NS4A | AY632539 | JEV | 2K | AB241119 | JEV | anC | AF486638 |
| IV | NS4A | NC_009028 | JEV | 2K | AB241118 | JEV | anC | L78128 |
| IV | NS4B | AY632539 | JEV | 2K | FJ495189 | JEV | anC | AF315119 |
| IV | NS4B | NC_009028 | JEV | 2K | NC_001437 | JEV | anC | AF217620 |
| IV | NS5 | AY632539 | JEV | 2K | EF623989 | JEV | anC | AF221500 |
| IV | NS5 | NC_009028 | JEV | 2K | EF623988 | JEV | anC | AF221499 |
| IV | prM | AY632539 | JEV | 2K | EF623987 | JEV | anC | AF069076 |
| IV | prM | NC_009028 | JEV | 2K | AF254453 | JEV | anC | AF098737 |
| JEV | 2K | AB551992 | JEV | 2K | AF254452 | JEV | anC | AF098736 |
| JEV | 2K | AB551991 | JEV | 2K | D90194 | JEV | anC | AF098735 |
| JEV | 2K | AB551990 | JEV | 2K | D90195 | JEV | anC | AF080251 |
| JEV | 2K | GU556217 | JEV | 2K | EF571853 | JEV | anC | AF075723 |
| JEV | 2K | EU693899 | JEV | 2K | EF543861 | JEV | anC | AF014161 |
| JEV | 2K | AY849939 | JEV | 2K | EF107523 | JEV | anC | AF014160 |
| JEV | 2K | AY585243 | JEV | 2K | AB196926 | JEV | anC | U47032 |
| JEV | 2K | AY585242 | JEV | 2K | AB196925 | JEV | anC | U15763 |
| JEV | 2K | AF416457 | JEV | 2K | AB196924 | JEV | anC | M55506 |
| JEV | 2K | AY508813 | JEV | 2K | AB196923 | JEV | anC | M18370 |
| JEV | 2K | AY508812 | JEV | 2K | AY303797 | JEV | anC | AF045551 |
| JEV | 2K | GQ918133 | JEV | 2K | AY303796 | JEV | anC | AB241119 |
| JEV | 2K | GQ199609 | JEV | 2K | AY303794 | JEV | anC | AB241118 |
| JEV | 2K | EU429297 | JEV | 2K | AY303793 | JEV | anC | FJ495189 |
| JEV | 2K | U14163 | JEV | 2K | AY303792 | JEV | anC | NC_001437 |
| JEV | 2K | FJ185037 | JEV | 2K | AY303791 | JEV | anC | EF623989 |
| JEV | 2K | FJ185036 | JEV | 2K | AY303798 | JEV | anC | EF623988 |
| JEV | 2K | EU880214 | JEV | 2K | AY303795 | JEV | anC | EF623987 |
| JEV | 2K | GU187972 | JEV | 2K | AB051292 | JEV | anC | AF254453 |
| JEV | 2K | AY316157 | JEV | anC | AB551992 | JEV | anC | AF254452 |
| JEV | 2K | AY184212 | JEV | anC | AB551991 | JEV | anC | D90194 |
| JEV | 2K | AF486638 | JEV | anC | AB551990 | JEV | anC | D90195 |
| JEV | 2K | L78128 | JEV | anC | GU556217 | JEV | anC | EF571853 |
| JEV | 2K | AF315119 | JEV | anC | EU693899 | JEV | anC | EF543861 |
| JEV | 2K | AF217620 | JEV | anC | AY849939 | JEV | anC | EF107523 |
| JEV | 2K | AF221500 | JEV | anC | AY585243 | JEV | anC | AB196926 |
| JEV | 2K | AF221499 | JEV | anC | AY585242 | JEV | anC | AB196925 |
| JEV | 2K | AF069076 | JEV | anC | AF416457 | JEV | anC | AB196924 |
| JEV | 2K | AF098737 | JEV | anC | AY508813 | JEV | anC | AB196923 |
| JEV | 2K | AF098736 | JEV | anC | AY508812 | JEV | anC | AY303797 |
| JEV | 2K | AF098735 | JEV | anC | GQ918133 | JEV | anC | AY303796 |
| JEV | 2K | AF080251 | JEV | anC | GQ199609 | JEV | anC | AY303794 |
| JEV | 2K | AF075723 | JEV | anC | EU429297 | JEV | anC | AY303793 |
| JEV | 2K | AF014161 | JEV | anC | U14163 | JEV | anC | AY303792 |
| JEV | 2K | AF014160 | JEV | anC | FJ185037 | JEV | anC | AY303791 |
| JEV | 2K | U47032 | JEV | anC | FJ185036 | JEV | anC | AY303798 |
| JEV | 2K | U15763 | JEV | anC | EU880214 | JEV | anC | AY303795 |

FIG. 70-211

| Virus | Protein | Accession No. | Virus | Protein | Accession No. | Virus | Protein | Accession No. |
|---|---|---|---|---|---|---|---|---|
| JEV | anC | AB051292 | JEV | E | AF254453 | JEV | NS1 | AF098737 |
| JEV | E | AB551992 | JEV | E | AF254452 | JEV | NS1 | AF098736 |
| JEV | E | AB551991 | JEV | E | D90194 | JEV | NS1 | AF098735 |
| JEV | E | AB551990 | JEV | E | D90195 | JEV | NS1 | AF080251 |
| JEV | E | GU556217 | JEV | E | EF571853 | JEV | NS1 | AF075723 |
| JEV | E | EU693899 | JEV | E | EF543861 | JEV | NS1 | AF014161 |
| JEV | E | AY849939 | JEV | E | EF107523 | JEV | NS1 | AF014160 |
| JEV | E | AY585243 | JEV | E | AB196926 | JEV | NS1 | U47032 |
| JEV | E | AY585242 | JEV | E | AB196925 | JEV | NS1 | U15763 |
| JEV | E | AF416457 | JEV | E | AB196924 | JEV | NS1 | M55506 |
| JEV | E | AY508813 | JEV | E | AB196923 | JEV | NS1 | M18370 |
| JEV | E | AY508812 | JEV | E | AY303797 | JEV | NS1 | AF045551 |
| JEV | E | GQ918133 | JEV | E | AY303796 | JEV | NS1 | AB241119 |
| JEV | E | GQ199609 | JEV | E | AY303794 | JEV | NS1 | AB241118 |
| JEV | E | EU429297 | JEV | E | AY303793 | JEV | NS1 | FJ495189 |
| JEV | E | U14163 | JEV | E | AY303792 | JEV | NS1 | NC_001437 |
| JEV | E | FJ185037 | JEV | E | AY303791 | JEV | NS1 | EF623989 |
| JEV | E | FJ185036 | JEV | E | AY303798 | JEV | NS1 | EF623988 |
| JEV | E | EU880214 | JEV | E | AY303795 | JEV | NS1 | EF623987 |
| JEV | E | GU187972 | JEV | E | AB051292 | JEV | NS1 | AF254453 |
| JEV | E | AY316157 | JEV | NS1 | AB551992 | JEV | NS1 | AF254452 |
| JEV | E | AY184212 | JEV | NS1 | AB551991 | JEV | NS1 | D90194 |
| JEV | E | AF486638 | JEV | NS1 | AB551990 | JEV | NS1 | D90195 |
| JEV | E | L78128 | JEV | NS1 | GU556217 | JEV | NS1 | EF571853 |
| JEV | E | AF315119 | JEV | NS1 | EU693899 | JEV | NS1 | EF543861 |
| JEV | E | AF217620 | JEV | NS1 | AY849939 | JEV | NS1 | EF107523 |
| JEV | E | AF221500 | JEV | NS1 | AY585243 | JEV | NS1 | AB196926 |
| JEV | E | AF221499 | JEV | NS1 | AY585242 | JEV | NS1 | AB196925 |
| JEV | E | AF069076 | JEV | NS1 | AF416457 | JEV | NS1 | AB196924 |
| JEV | E | AF098737 | JEV | NS1 | AY508813 | JEV | NS1 | AB196923 |
| JEV | E | AF098736 | JEV | NS1 | AY508812 | JEV | NS1 | AY303797 |
| JEV | E | AF098735 | JEV | NS1 | GQ918133 | JEV | NS1 | AY303796 |
| JEV | E | AF080251 | JEV | NS1 | GQ199609 | JEV | NS1 | AY303794 |
| JEV | E | AF075723 | JEV | NS1 | EU429297 | JEV | NS1 | AY303793 |
| JEV | E | AF014161 | JEV | NS1 | U14163 | JEV | NS1 | AY303792 |
| JEV | E | AF014160 | JEV | NS1 | FJ185037 | JEV | NS1 | AY303791 |
| JEV | E | U47032 | JEV | NS1 | FJ185036 | JEV | NS1 | AY303798 |
| JEV | E | U15763 | JEV | NS1 | EU880214 | JEV | NS1 | AY303795 |
| JEV | E | M55506 | JEV | NS1 | GU187972 | JEV | NS1 | AB051292 |
| JEV | E | M18370 | JEV | NS1 | AY316157 | JEV | NS2A | AB551992 |
| JEV | E | AF045551 | JEV | NS1 | AY184212 | JEV | NS2A | AB551991 |
| JEV | E | AB241119 | JEV | NS1 | AF486638 | JEV | NS2A | AB551990 |
| JEV | E | AB241118 | JEV | NS1 | L78128 | JEV | NS2A | GU556217 |
| JEV | E | FJ495189 | JEV | NS1 | AF315119 | JEV | NS2A | EU693899 |
| JEV | E | NC_001437 | JEV | NS1 | AF217620 | JEV | NS2A | AY849939 |
| JEV | E | EF623989 | JEV | NS1 | AF221500 | JEV | NS2A | AY585243 |
| JEV | E | EF623988 | JEV | NS1 | AF221499 | JEV | NS2A | AY585242 |
| JEV | E | EF623987 | JEV | NS1 | AF069076 | JEV | NS2A | AF416457 |

FIG. 70-212

| Virus Protein | Accession No. | Virus Protein | Accession No. | Virus Protein | Accession No. |
|---|---|---|---|---|---|
| JEVNS2A | AY508813 | JEVNS2A | AB196923 | JEVNS2B | M18370 |
| JEVNS2A | AY508812 | JEVNS2A | AY303797 | JEVNS2B | AF045551 |
| JEVNS2A | GQ918133 | JEVNS2A | AY303796 | JEVNS2B | AB241119 |
| JEVNS2A | GQ199609 | JEVNS2A | AY303794 | JEVNS2B | AB241118 |
| JEVNS2A | EU429297 | JEVNS2A | AY303793 | JEVNS2B | FJ495189 |
| JEVNS2A | U14163 | JEVNS2A | AY303792 | JEVNS2B | NC_001437 |
| JEVNS2A | FJ185037 | JEVNS2A | AY303791 | JEVNS2B | EF623989 |
| JEVNS2A | FJ185036 | JEVNS2A | AY303798 | JEVNS2B | EF623988 |
| JEVNS2A | EU880214 | JEVNS2A | AY303795 | JEVNS2B | EF623987 |
| JEVNS2A | GU187972 | JEVNS2A | AB051292 | JEVNS2B | AF254453 |
| JEVNS2A | AY316157 | JEVNS2B | AB551992 | JEVNS2B | AF254452 |
| JEVNS2A | AY184212 | JEVNS2B | AB551991 | JEVNS2B | D90194 |
| JEVNS2A | AF486638 | JEVNS2B | AB551990 | JEVNS2B | D90195 |
| JEVNS2A | L78128 | JEVNS2B | GU556217 | JEVNS2B | EF571853 |
| JEVNS2A | AF315119 | JEVNS2B | EU693899 | JEVNS2B | EF543861 |
| JEVNS2A | AF217620 | JEVNS2B | AY849939 | JEVNS2B | EF107523 |
| JEVNS2A | AF221500 | JEVNS2B | AY585243 | JEVNS2B | AB196926 |
| JEVNS2A | AF221499 | JEVNS2B | AY585242 | JEVNS2B | AB196925 |
| JEVNS2A | AF069076 | JEVNS2B | AF416457 | JEVNS2B | AB196924 |
| JEVNS2A | AF098737 | JEVNS2B | AY508813 | JEVNS2B | AB196923 |
| JEVNS2A | AF098736 | JEVNS2B | AY508812 | JEVNS2B | AY303797 |
| JEVNS2A | AF098735 | JEVNS2B | GQ918133 | JEVNS2B | AY303796 |
| JEVNS2A | AF080251 | JEVNS2B | GQ199609 | JEVNS2B | AY303794 |
| JEVNS2A | AF075723 | JEVNS2B | EU429297 | JEVNS2B | AY303793 |
| JEVNS2A | AF014161 | JEVNS2B | U14163 | JEVNS2B | AY303792 |
| JEVNS2A | AF014160 | JEVNS2B | FJ185037 | JEVNS2B | AY303791 |
| JEVNS2A | U47032 | JEVNS2B | FJ185036 | JEVNS2B | AY303798 |
| JEVNS2A | U15763 | JEVNS2B | EU880214 | JEVNS2B | AY303795 |
| JEVNS2A | M55506 | JEVNS2B | GU187972 | JEVNS2B | AB051292 |
| JEVNS2A | M18370 | JEVNS2B | AY316157 | JEVNS3 | AB551992 |
| JEVNS2A | AF045551 | JEVNS2B | AY184212 | JEVNS3 | AB551991 |
| JEVNS2A | AB241119 | JEVNS2B | AF486638 | JEVNS3 | AB551990 |
| JEVNS2A | AB241118 | JEVNS2B | L78128 | JEVNS3 | GU556217 |
| JEVNS2A | FJ495189 | JEVNS2B | AF315119 | JEVNS3 | EU693899 |
| JEVNS2A | NC_001437 | JEVNS2B | AF217620 | JEVNS3 | AY849939 |
| JEVNS2A | EF623989 | JEVNS2B | AF221500 | JEVNS3 | AY585243 |
| JEVNS2A | EF623988 | JEVNS2B | AF221499 | JEVNS3 | AY585242 |
| JEVNS2A | EF623987 | JEVNS2B | AF069076 | JEVNS3 | AF416457 |
| JEVNS2A | AF254453 | JEVNS2B | AF098737 | JEVNS3 | AY508813 |
| JEVNS2A | AF254452 | JEVNS2B | AF098736 | JEVNS3 | AY508812 |
| JEVNS2A | D90194 | JEVNS2B | AF098735 | JEVNS3 | GQ918133 |
| JEVNS2A | D90195 | JEVNS2B | AF080251 | JEVNS3 | GQ199609 |
| JEVNS2A | EF571853 | JEVNS2B | AF075723 | JEVNS3 | EU429297 |
| JEVNS2A | EF543861 | JEVNS2B | AF014161 | JEVNS3 | U14163 |
| JEVNS2A | EF107523 | JEVNS2B | AF014160 | JEVNS3 | FJ185037 |
| JEVNS2A | AB196926 | JEVNS2B | U47032 | JEVNS3 | FJ185036 |
| JEVNS2A | AB196925 | JEVNS2B | U15763 | JEVNS3 | EU880214 |
| JEVNS2A | AB196924 | JEVNS2B | M55506 | JEVNS3 | GU187972 |

FIG. 70-213

| Virus Protein | Accession No. | Virus Protein | Accession No. | Virus Protein | Accession No. |
|---|---|---|---|---|---|
| JEVNS3 | AY316157 | JEVNS4A | AB551992 | JEVNS4A | AF254452 |
| JEVNS3 | AY184212 | JEVNS4A | AB551991 | JEVNS4A | D90194 |
| JEVNS3 | AF486638 | JEVNS4A | AB551990 | JEVNS4A | D90195 |
| JEVNS3 | L78128 | JEVNS4A | GU556217 | JEVNS4A | EF571853 |
| JEVNS3 | AF315119 | JEVNS4A | EU693899 | JEVNS4A | EF543861 |
| JEVNS3 | AF217620 | JEVNS4A | AY849939 | JEVNS4A | EF107523 |
| JEVNS3 | AF221500 | JEVNS4A | AY585243 | JEVNS4A | AB196926 |
| JEVNS3 | AF221499 | JEVNS4A | AY585242 | JEVNS4A | AB196925 |
| JEVNS3 | AF069076 | JEVNS4A | AF416457 | JEVNS4A | AB196924 |
| JEVNS3 | AF098737 | JEVNS4A | AY508813 | JEVNS4A | AB196923 |
| JEVNS3 | AF098736 | JEVNS4A | AY508812 | JEVNS4A | AY303797 |
| JEVNS3 | AF098735 | JEVNS4A | GQ918133 | JEVNS4A | AY303796 |
| JEVNS3 | AF080251 | JEVNS4A | GQ199609 | JEVNS4A | AY303794 |
| JEVNS3 | AF075723 | JEVNS4A | EU429297 | JEVNS4A | AY303793 |
| JEVNS3 | AF014161 | JEVNS4A | U14163 | JEVNS4A | AY303792 |
| JEVNS3 | AF014160 | JEVNS4A | FJ185037 | JEVNS4A | AY303791 |
| JEVNS3 | U47032 | JEVNS4A | FJ185036 | JEVNS4A | AY303798 |
| JEVNS3 | U15763 | JEVNS4A | EU880214 | JEVNS4A | AY303795 |
| JEVNS3 | M55506 | JEVNS4A | GU187972 | JEVNS4A | AB051292 |
| JEVNS3 | M18370 | JEVNS4A | AY316157 | JEVNS4B | AB551992 |
| JEVNS3 | AF045551 | JEVNS4A | AY184212 | JEVNS4B | AB551991 |
| JEVNS3 | AB241119 | JEVNS4A | AF486638 | JEVNS4B | AB551990 |
| JEVNS3 | AB241118 | JEVNS4A | L78128 | JEVNS4B | GU556217 |
| JEVNS3 | FJ495189 | JEVNS4A | AF315119 | JEVNS4B | EU693899 |
| JEVNS3 | NC_001437 | JEVNS4A | AF217620 | JEVNS4B | AY849939 |
| JEVNS3 | EF623989 | JEVNS4A | AF221500 | JEVNS4B | AY585243 |
| JEVNS3 | EF623988 | JEVNS4A | AF221499 | JEVNS4B | AY585242 |
| JEVNS3 | EF623987 | JEVNS4A | AF069076 | JEVNS4B | AF416457 |
| JEVNS3 | AF254453 | JEVNS4A | AF098737 | JEVNS4B | AY508813 |
| JEVNS3 | AF254452 | JEVNS4A | AF098736 | JEVNS4B | AY508812 |
| JEVNS3 | D90194 | JEVNS4A | AF098735 | JEVNS4B | GQ918133 |
| JEVNS3 | D90195 | JEVNS4A | AF080251 | JEVNS4B | GQ199609 |
| JEVNS3 | EF571853 | JEVNS4A | AF075723 | JEVNS4B | EU429297 |
| JEVNS3 | EF543861 | JEVNS4A | AF014161 | JEVNS4B | U14163 |
| JEVNS3 | EF107523 | JEVNS4A | AF014160 | JEVNS4B | FJ185037 |
| JEVNS3 | AB196926 | JEVNS4A | U47032 | JEVNS4B | FJ185036 |
| JEVNS3 | AB196925 | JEVNS4A | U15763 | JEVNS4B | EU880214 |
| JEVNS3 | AB196924 | JEVNS4A | M55506 | JEVNS4B | GU187972 |
| JEVNS3 | AB196923 | JEVNS4A | M18370 | JEVNS4B | AY316157 |
| JEVNS3 | AY303797 | JEVNS4A | AF045551 | JEVNS4B | AY184212 |
| JEVNS3 | AY303796 | JEVNS4A | AB241119 | JEVNS4B | AF486638 |
| JEVNS3 | AY303794 | JEVNS4A | AB241118 | JEVNS4B | L78128 |
| JEVNS3 | AY303793 | JEVNS4A | FJ495189 | JEVNS4B | AF315119 |
| JEVNS3 | AY303792 | JEVNS4A | NC_001437 | JEVNS4B | AF217620 |
| JEVNS3 | AY303791 | JEVNS4A | EF623989 | JEVNS4B | AF221500 |
| JEVNS3 | AY303798 | JEVNS4A | EF623988 | JEVNS4B | AF221499 |
| JEVNS3 | AY303795 | JEVNS4A | EF623987 | JEVNS4B | AF069076 |
| JEVNS3 | AB051292 | JEVNS4A | AF254453 | JEVNS4B | AF098737 |

FIG. 70-214

| Virus Protein | Accession No. | Virus Protein | Accession No. | Virus Protein | Accession No. |
|---|---|---|---|---|---|
| JEVNS4B | AF098736 | JEVNS5 | AY508812 | JEVNS5 | AY303797 |
| JEVNS4B | AF098735 | JEVNS5 | GQ918133 | JEVNS5 | AY303796 |
| JEVNS4B | AF080251 | JEVNS5 | GQ199609 | JEVNS5 | AY303794 |
| JEVNS4B | AF075723 | JEVNS5 | EU429297 | JEVNS5 | AY303793 |
| JEVNS4B | AF014161 | JEVNS5 | U14163 | JEVNS5 | AY303792 |
| JEVNS4B | AF014160 | JEVNS5 | FJ185037 | JEVNS5 | AY303791 |
| JEVNS4B | U47032 | JEVNS5 | FJ185036 | JEVNS5 | AY303798 |
| JEVNS4B | U15763 | JEVNS5 | EU880214 | JEVNS5 | AY303795 |
| JEVNS4B | M55506 | JEVNS5 | GU187972 | JEVNS5 | AB051292 |
| JEVNS4B | M18370 | JEVNS5 | AY316157 | JEVprM | AB551992 |
| JEVNS4B | AF045551 | JEVNS5 | AY184212 | JEVprM | AB551991 |
| JEVNS4B | AB241119 | JEVNS5 | AF486638 | JEVprM | AB551990 |
| JEVNS4B | AB241118 | JEVNS5 | L78128 | JEVprM | GU556217 |
| JEVNS4B | FJ495189 | JEVNS5 | AF315119 | JEVprM | EU693899 |
| JEVNS4B | NC_001437 | JEVNS5 | AF217620 | JEVprM | AY849939 |
| JEVNS4B | EF623989 | JEVNS5 | AF221500 | JEVprM | AY585243 |
| JEVNS4B | EF623988 | JEVNS5 | AF221499 | JEVprM | AY585242 |
| JEVNS4B | EF623987 | JEVNS5 | AF069076 | JEVprM | AF416457 |
| JEVNS4B | AF254453 | JEVNS5 | AF098737 | JEVprM | AY508813 |
| JEVNS4B | AF254452 | JEVNS5 | AF098736 | JEVprM | AY508812 |
| JEVNS4B | D90194 | JEVNS5 | AF098735 | JEVprM | GQ918133 |
| JEVNS4B | D90195 | JEVNS5 | AF080251 | JEVprM | GQ199609 |
| JEVNS4B | EF571853 | JEVNS5 | AF075723 | JEVprM | EU429297 |
| JEVNS4B | EF543861 | JEVNS5 | AF014161 | JEVprM | U14163 |
| JEVNS4B | EF107523 | JEVNS5 | AF014160 | JEVprM | FJ185037 |
| JEVNS4B | AB196926 | JEVNS5 | U47032 | JEVprM | FJ185036 |
| JEVNS4B | AB196925 | JEVNS5 | U15763 | JEVprM | EU880214 |
| JEVNS4B | AB196924 | JEVNS5 | M55506 | JEVprM | GU187972 |
| JEVNS4B | AB196923 | JEVNS5 | M18370 | JEVprM | AY316157 |
| JEVNS4B | AY303797 | JEVNS5 | AF045551 | JEVprM | AY184212 |
| JEVNS4B | AY303796 | JEVNS5 | AB241119 | JEVprM | AF486638 |
| JEVNS4B | AY303794 | JEVNS5 | AB241118 | JEVprM | L78128 |
| JEVNS4B | AY303793 | JEVNS5 | FJ495189 | JEVprM | AF315119 |
| JEVNS4B | AY303792 | JEVNS5 | NC_001437 | JEVprM | AF217620 |
| JEVNS4B | AY303791 | JEVNS5 | EF623989 | JEVprM | AF221500 |
| JEVNS4B | AY303798 | JEVNS5 | EF623988 | JEVprM | AF221499 |
| JEVNS4B | AY303795 | JEVNS5 | EF623987 | JEVprM | AF069076 |
| JEVNS4B | AB051292 | JEVNS5 | AF254453 | JEVprM | AF098737 |
| JEVNS5 | AB551992 | JEVNS5 | AF254452 | JEVprM | AF098736 |
| JEVNS5 | AB551991 | JEVNS5 | D90194 | JEVprM | AF098735 |
| JEVNS5 | AB551990 | JEVNS5 | D90195 | JEVprM | AF080251 |
| JEVNS5 | GU556217 | JEVNS5 | EF571853 | JEVprM | AF075723 |
| JEVNS5 | EU693899 | JEVNS5 | EF543861 | JEVprM | AF014161 |
| JEVNS5 | AY849939 | JEVNS5 | EF107523 | JEVprM | AF014160 |
| JEVNS5 | AY585243 | JEVNS5 | AB196926 | JEVprM | U47032 |
| JEVNS5 | AY585242 | JEVNS5 | AB196925 | JEVprM | U15763 |
| JEVNS5 | AF416457 | JEVNS5 | AB196924 | JEVprM | M55506 |
| JEVNS5 | AY508813 | JEVNS5 | AB196923 | JEVprM | M18370 |

FIG. 70-215

| Virus | Protein | Accession No. | Virus | Protein | Accession No. | Virus | Protein | Accession No. |
|---|---|---|---|---|---|---|---|---|
| JEV | prM | AF045551 | KV | NS5 | DQ235146 | KAV | NS1 | NC_006947 |
| JEV | prM | AB241119 | KV | prM | DQ235146 | KAV | NS1 | AY863002 |
| JEV | prM | AB241118 | KRV | 2K | NC_005064 | KAV | NS1 | DQ235147 |
| JEV | prM | FJ495189 | KRV | 2K | AY149904 | KAV | NS2A | DQ462443 |
| JEV | prM | NC_001437 | KRV | 2K | AY149905 | KAV | NS2A | NC_006947 |
| JEV | prM | EF623989 | KRV | anC | NC_005064 | KAV | NS2A | AY863002 |
| JEV | prM | EF623988 | KRV | anC | AY149904 | KAV | NS2A | DQ235147 |
| JEV | prM | EF623987 | KRV | anC | AY149905 | KAV | NS2B | DQ462443 |
| JEV | prM | AF254453 | KRV | E | NC_005064 | KAV | NS2B | NC_006947 |
| JEV | prM | AF254452 | KRV | E | AY149904 | KAV | NS2B | AY863002 |
| JEV | prM | D90194 | KRV | E | AY149905 | KAV | NS2B | DQ235147 |
| JEV | prM | D90195 | KRV | NS1 | NC_005064 | KAV | NS3 | DQ462443 |
| JEV | prM | EF571853 | KRV | NS1 | AY149904 | KAV | NS3 | NC_006947 |
| JEV | prM | EF543861 | KRV | NS1 | AY149905 | KAV | NS3 | AY863002 |
| JEV | prM | EF107523 | KRV | NS2A | NC_005064 | KAV | NS3 | DQ235147 |
| JEV | prM | AB196926 | KRV | NS2A | AY149904 | KAV | NS4A | DQ462443 |
| JEV | prM | AB196925 | KRV | NS2A | AY149905 | KAV | NS4A | NC_006947 |
| JEV | prM | AB196924 | KRV | NS2B | NC_005064 | KAV | NS4A | AY863002 |
| JEV | prM | AB196923 | KRV | NS2B | AY149904 | KAV | NS4A | DQ235147 |
| JEV | prM | AY303797 | KRV | NS2B | AY149905 | KAV | NS4B | DQ462443 |
| JEV | prM | AY303796 | KRV | NS3 | NC_005064 | KAV | NS4B | NC_006947 |
| JEV | prM | AY303794 | KRV | NS3 | AY149904 | KAV | NS4B | AY863002 |
| JEV | prM | AY303793 | KRV | NS3 | AY149905 | KAV | NS4B | DQ235147 |
| JEV | prM | AY303792 | KRV | NS4A | NC_005064 | KAV | NS5 | DQ462443 |
| JEV | prM | AY303791 | KRV | NS4A | AY149904 | KAV | NS5 | NC_006947 |
| JEV | prM | AY303798 | KRV | NS4A | AY149905 | KAV | NS5 | AY863002 |
| JEV | prM | AY303795 | KRV | NS4B | NC_005064 | KAV | NS5 | DQ235147 |
| JEV | prM | AB051292 | KRV | NS4B | AY149904 | KAV | prM | DQ462443 |
| JV | 2K | DQ859066 | KRV | NS4B | AY149905 | KAV | prM | NC_006947 |
| JV | anC | DQ859066 | KRV | NS5 | NC_005064 | KAV | prM | AY863002 |
| JV | E | DQ859066 | KRV | NS5 | AY149904 | KAV | prM | DQ235147 |
| JV | NS1 | DQ859066 | KRV | NS5 | AY149905 | KOV | 2K | DQ859061 |
| JV | NS2A | DQ859066 | KRV | prM | NC_005064 | KOV | 2K | NC_012533 |
| JV | NS2B | DQ859066 | KRV | prM | AY149904 | KOV | 2K | AY632540 |
| JV | NS3 | DQ859066 | KRV | prM | AY149905 | KOV | anC | DQ859061 |
| JV | NS4A | DQ859066 | KAV | 2K | DQ462443 | KOV | anC | NC_012533 |
| JV | NS4B | DQ859066 | KAV | 2K | NC_006947 | KOV | anC | AY632540 |
| JV | NS5 | DQ859066 | KAV | 2K | AY863002 | KOV | E | DQ859061 |
| JV | prM | DQ859066 | KAV | 2K | DQ235147 | KOV | E | NC_012533 |
| KV | 2K | DQ235146 | KAV | anC | DQ462443 | KOV | E | AY632540 |
| KV | anC | DQ235146 | KAV | anC | NC_006947 | KOV | NS1 | DQ859061 |
| KV | E | DQ235146 | KAV | anC | AY863002 | KOV | NS1 | NC_012533 |
| KV | NS1 | DQ235146 | KAV | anC | DQ235147 | KOV | NS1 | AY632540 |
| KV | NS2A | DQ235146 | KAV | E | DQ462443 | KOV | NS2A | DQ859061 |
| KV | NS2B | DQ235146 | KAV | E | NC_006947 | KOV | NS2A | NC_012533 |
| KV | NS3 | DQ235146 | KAV | E | AY863002 | KOV | NS2A | AY632540 |
| KV | NS4A | DQ235146 | KAV | E | DQ235147 | KOV | NS2B | DQ859061 |
| KV | NS4B | DQ235146 | KAV | NS1 | DQ462443 | KOV | NS2B | NC_012533 |

FIG. 70-216

| Virus | Protein | Accession No. | Virus | Protein | Accession No. | Virus | Protein | Accession No. |
|---|---|---|---|---|---|---|---|---|
| KOV | NS2B | AY632540 | KJV | NS1 | AY274504 | LV | 2K | EU790644 |
| KOV | NS3 | DQ859061 | KJV | NS1 | D00246 | LV | anC | NC_003690 |
| KOV | NS3 | NC_012533 | KJV | NS2A | AY274505 | LV | anC | AF253420 |
| KOV | NS3 | AY632540 | KJV | NS2A | AY274504 | LV | anC | AF253419 |
| KOV | NS4A | DQ859061 | KJV | NS2A | D00246 | LV | anC | EU790644 |
| KOV | NS4A | NC_012533 | KJV | NS2B | AY274505 | LV | E | NC_003690 |
| KOV | NS4A | AY632540 | KJV | NS2B | AY274504 | LV | E | AF253420 |
| KOV | NS4B | DQ859061 | KJV | NS2B | D00246 | LV | E | AF253419 |
| KOV | NS4B | NC_012533 | KJV | NS3 | AY274505 | LV | E | EU790644 |
| KOV | NS4B | AY632540 | KJV | NS3 | AY274504 | LV | NS1 | NC_003690 |
| KOV | NS5 | DQ859061 | KJV | NS3 | D00246 | LV | NS1 | AF253420 |
| KOV | NS5 | NC_012533 | KJV | NS4A | AY274505 | LV | NS1 | AF253419 |
| KOV | NS5 | AY632540 | KJV | NS4A | AY274504 | LV | NS1 | EU790644 |
| KOV | prM | DQ859061 | KJV | NS4A | D00246 | LV | NS2A | NC_003690 |
| KOV | prM | NC_012533 | KJV | NS4B | AY274505 | LV | NS2A | AF253420 |
| KOV | prM | AY632540 | KJV | NS4B | AY274504 | LV | NS2A | AF253419 |
| KKV | 2K | NC_009029 | KJV | NS4B | D00246 | LV | NS2A | EU790644 |
| KKV | 2K | AY632541 | KJV | NS5 | AY274505 | LV | NS2B | NC_003690 |
| KKV | anC | NC_009029 | KJV | NS5 | AY274504 | LV | NS2B | AF253420 |
| KKV | anC | AY632541 | KJV | NS5 | D00246 | LV | NS2B | AF253419 |
| KKV | E | NC_009029 | KJV | prM | AY274505 | LV | NS2B | EU790644 |
| KKV | E | AY632541 | KJV | prM | AY274504 | LV | NS3 | NC_003690 |
| KKV | NS1 | NC_009029 | KJV | prM | D00246 | LV | NS3 | AF253420 |
| KKV | NS1 | AY632541 | KFDV | 2K | EU480689 | LV | NS3 | AF253419 |
| KKV | NS2A | NC_009029 | KFDV | 2K | AY323490 | LV | NS3 | EU790644 |
| KKV | NS2A | AY632541 | KFDV | anC | EU480689 | LV | NS4A | NC_003690 |
| KKV | NS2B | NC_009029 | KFDV | anC | AY323490 | LV | NS4A | AF253420 |
| KKV | NS2B | AY632541 | KFDV | E | EU480689 | LV | NS4A | AF253419 |
| KKV | NS3 | NC_009029 | KFDV | E | AY323490 | LV | NS4A | EU790644 |
| KKV | NS3 | AY632541 | KFDV | NS1 | EU480689 | LV | NS4B | NC_003690 |
| KKV | NS4A | NC_009029 | KFDV | NS1 | AY323490 | LV | NS4B | AF253420 |
| KKV | NS4A | AY632541 | KFDV | NS2A | EU480689 | LV | NS4B | AF253419 |
| KKV | NS4B | NC_009029 | KFDV | NS2A | AY323490 | LV | NS4B | EU790644 |
| KKV | NS4B | AY632541 | KFDV | NS2B | EU480689 | LV | NS5 | NC_003690 |
| KKV | NS5 | NC_009029 | KFDV | NS2B | AY323490 | LV | NS5 | AF253420 |
| KKV | NS5 | AY632541 | KFDV | NS3 | EU480689 | LV | NS5 | AF253419 |
| KKV | prM | NC_009029 | KFDV | NS3 | AY323490 | LV | NS5 | EU790644 |
| KKV | prM | AY632541 | KFDV | NS4A | EU480689 | LV | prM | NC_003690 |
| KJV | 2K | AY274505 | KFDV | NS4A | AY323490 | LV | prM | AF253420 |
| KJV | 2K | AY274504 | KFDV | NS4B | EU480689 | LV | prM | AF253419 |
| KJV | 2K | D00246 | KFDV | NS4B | AY323490 | LV | prM | EU790644 |
| KJV | anC | AY274505 | KFDV | NS5 | EU480689 | LIV | 2K | NC_001809 |
| KJV | anC | AY274504 | KFDV | NS5 | AY323490 | LIV | 2K | Y07863 |
| KJV | anC | D00246 | KFDV | prM | EU480689 | LIV | anC | NC_001809 |
| KJV | E | AY274505 | KFDV | prM | AY323490 | LIV | anC | Y07863 |
| KJV | E | AY274504 | LV | 2K | NC_003690 | LIV | E | NC_001809 |
| KJV | E | D00246 | LV | 2K | AF253420 | LIV | E | Y07863 |
| KJV | NS1 | AY274505 | LV | 2K | AF253419 | LIV | NS1 | NC_001809 |

FIG. 70-217

| Virus | Protein | Accession No. | Virus | Protein | Accession No. | Virus | Protein | Accession No. |
|---|---|---|---|---|---|---|---|---|
| LIV | NS1 | Y07863 | MMLV | 2K | NC_004119 | NOV | E | FJ711167 |
| LIV | NS2A | NC_001809 | MMLV | 2K | AJ299445 | NOV | E | EU159426 |
| LIV | NS2A | Y07863 | MMLV | anC | NC_004119 | NOV | NS1 | FJ711167 |
| LIV | NS2B | NC_001809 | MMLV | anC | AJ299445 | NOV | NS1 | EU159426 |
| LIV | NS2B | Y07863 | MMLV | E | NC_004119 | NOV | NS2A | FJ711167 |
| LIV | NS3 | NC_001809 | MMLV | E | AJ299445 | NOV | NS2A | EU159426 |
| LIV | NS3 | Y07863 | MMLV | NS1 | NC_004119 | NOV | NS2B | FJ711167 |
| LIV | NS4A | NC_001809 | MMLV | NS1 | AJ299445 | NOV | NS2B | EU159426 |
| LIV | NS4A | Y07863 | MMLV | NS2A | NC_004119 | NOV | NS3 | FJ711167 |
| LIV | NS4B | NC_001809 | MMLV | NS2A | AJ299445 | NOV | NS3 | EU159426 |
| LIV | NS4B | Y07863 | MMLV | NS2B | NC_004119 | NOV | NS4A | FJ711167 |
| LIV | NS5 | NC_001809 | MMLV | NS2B | AJ299445 | NOV | NS4A | EU159426 |
| LIV | NS5 | Y07863 | MMLV | NS3 | NC_004119 | NOV | NS4B | FJ711167 |
| LIV | prM | NC_001809 | MMLV | NS3 | AJ299445 | NOV | NS4B | EU159426 |
| LIV | prM | Y07863 | MMLV | NS4A | NC_004119 | NOV | NS5 | FJ711167 |
| MV | 2K | DQ235144 | MMLV | NS4A | AJ299445 | NOV | NS5 | EU159426 |
| MV | anC | DQ235144 | MMLV | NS4B | NC_004119 | NOV | prM | FJ711167 |
| MV | E | DQ235144 | MMLV | NS4B | AJ299445 | NOV | prM | EU159426 |
| MV | NS1 | DQ235144 | MMLV | NS5 | NC_004119 | OHFV | 2K | NC_005062 |
| MV | NS2A | DQ235144 | MMLV | NS5 | AJ299445 | OHFV | 2K | AY193805 |
| MV | NS2B | DQ235144 | MMLV | prM | NC_004119 | OHFV | 2K | AB507800 |
| MV | NS3 | DQ235144 | MMLV | prM | AJ299445 | OHFV | 2K | AY323489 |
| MV | NS4A | DQ235144 | MVEV | 2K | AF161266 | OHFV | 2K | AY438626 |
| MV | NS4B | DQ235144 | MVEV | 2K | NC_000943 | OHFV | anC | NC_005062 |
| MV | NS5 | DQ235144 | MVEV | anC | AF161266 | OHFV | anC | AY193805 |
| MV | prM | DQ235144 | MVEV | anC | NC_000943 | OHFV | anC | AB507800 |
| MOV | 2K | NC_003635 | MVEV | E | AF161266 | OHFV | anC | AY323489 |
| MOV | 2K | AJ242984 | MVEV | E | NC_000943 | OHFV | anC | AY438626 |
| MOV | anC | NC_003635 | MVEV | NS1 | AF161266 | OHFV | E | NC_005062 |
| MOV | anC | AJ242984 | MVEV | NS1 | NC_000943 | OHFV | E | AY193805 |
| MOV | E | NC_003635 | MVEV | NS2A | AF161266 | OHFV | E | AB507800 |
| MOV | E | AJ242984 | MVEV | NS2A | NC_000943 | OHFV | E | AY323489 |
| MOV | NS1 | NC_003635 | MVEV | NS2B | AF161266 | OHFV | E | AY438626 |
| MOV | NS1 | AJ242984 | MVEV | NS2B | NC_000943 | OHFV | NS1 | NC_005062 |
| MOV | NS2A | NC_003635 | MVEV | NS3 | AF161266 | OHFV | NS1 | AY193805 |
| MOV | NS2A | AJ242984 | MVEV | NS3 | NC_000943 | OHFV | NS1 | AB507800 |
| MOV | NS2B | NC_003635 | MVEV | NS4A | AF161266 | OHFV | NS1 | AY323489 |
| MOV | NS2B | AJ242984 | MVEV | NS4A | NC_000943 | OHFV | NS1 | AY438626 |
| MOV | NS3 | NC_003635 | MVEV | NS4B | AF161266 | OHFV | NS2A | NC_005062 |
| MOV | NS3 | AJ242984 | MVEV | NS4B | NC_000943 | OHFV | NS2A | AY193805 |
| MOV | NS4A | NC_003635 | MVEV | NS5 | AF161266 | OHFV | NS2A | AB507800 |
| MOV | NS4A | AJ242984 | MVEV | NS5 | NC_000943 | OHFV | NS2A | AY323489 |
| MOV | NS4B | NC_003635 | MVEV | prM | AF161266 | OHFV | NS2A | AY438626 |
| MOV | NS4B | AJ242984 | MVEV | prM | NC_000943 | OHFV | NS2B | NC_005062 |
| MOV | NS5 | NC_003635 | NOV | 2K | FJ711167 | OHFV | NS2B | AY193805 |
| MOV | NS5 | AJ242984 | NOV | 2K | EU159426 | OHFV | NS2B | AB507800 |
| MOV | prM | NC_003635 | NOV | anC | FJ711167 | OHFV | NS2B | AY323489 |
| MOV | prM | AJ242984 | NOV | anC | EU159426 | OHFV | NS2B | AY438626 |

FIG. 70-218

| Virus | Protein | Accession No. | Virus | Protein | Accession No. | Virus | Protein | Accession No. |
|---|---|---|---|---|---|---|---|---|
| OHFV | NS3 | NC_005062 | POV | E | EU543649 | RBV | E | NC_003675 |
| OHFV | NS3 | AY193805 | POV | E | NC_003687 | RBV | NS1 | AF144692 |
| OHFV | NS3 | AB507800 | POV | E | L06436 | RBV | NS1 | NC_003675 |
| OHFV | NS3 | AY323489 | POV | NS1 | EU770575 | RBV | NS2A | AF144692 |
| OHFV | NS3 | AY438626 | POV | NS1 | EU670438 | RBV | NS2A | NC_003675 |
| OHFV | NS4A | NC_005062 | POV | NS1 | EU543649 | RBV | NS2B | AF144692 |
| OHFV | NS4A | AY193805 | POV | NS1 | NC_003687 | RBV | NS2B | NC_003675 |
| OHFV | NS4A | AB507800 | POV | NS1 | L06436 | RBV | NS3 | AF144692 |
| OHFV | NS4A | AY323489 | POV | NS2A | EU770575 | RBV | NS3 | NC_003675 |
| OHFV | NS4A | AY438626 | POV | NS2A | EU670438 | RBV | NS4A | AF144692 |
| OHFV | NS4B | NC_005062 | POV | NS2A | EU543649 | RBV | NS4A | NC_003675 |
| OHFV | NS4B | AY193805 | POV | NS2A | NC_003687 | RBV | NS4B | AF144692 |
| OHFV | NS4B | AB507800 | POV | NS2A | L06436 | RBV | NS4B | NC_003675 |
| OHFV | NS4B | AY323489 | POV | NS2B | EU770575 | RBV | NS5 | AF144692 |
| OHFV | NS4B | AY438626 | POV | NS2B | EU670438 | RBV | NS5 | NC_003675 |
| OHFV | NS5 | NC_005062 | POV | NS2B | EU543649 | RBV | prM | AF144692 |
| OHFV | NS5 | AY193805 | POV | NS2B | NC_003687 | RBV | prM | NC_003675 |
| OHFV | NS5 | AB507800 | POV | NS2B | L06436 | ROV | 2K | AY632542 |
| OHFV | NS5 | AY323489 | POV | NS3 | EU770575 | ROV | anC | AY632542 |
| OHFV | NS5 | AY438626 | POV | NS3 | EU670438 | ROV | E | AY632542 |
| OHFV | prM | NC_005062 | POV | NS3 | EU543649 | ROV | NS1 | AY632542 |
| OHFV | prM | AY193805 | POV | NS3 | NC_003687 | ROV | NS2A | AY632542 |
| OHFV | prM | AB507800 | POV | NS3 | L06436 | ROV | NS2B | AY632542 |
| OHFV | prM | AY323489 | POV | NS4A | EU770575 | ROV | NS3 | AY632542 |
| OHFV | prM | AY438626 | POV | NS4A | EU670438 | ROV | NS4A | AY632542 |
| PSV | 2K | DQ859067 | POV | NS4A | EU543649 | ROV | NS4B | AY632542 |
| PSV | anC | DQ859067 | POV | NS4A | NC_003687 | ROV | NS5 | AY632542 |
| PSV | E | DQ859067 | POV | NS4A | L06436 | ROV | prM | AY632542 |
| PSV | NS1 | DQ859067 | POV | NS4B | EU770575 | RFV | 2K | DQ235149 |
| PSV | NS2A | DQ859067 | POV | NS4B | EU670438 | RFV | anC | DQ235149 |
| PSV | NS2B | DQ859067 | POV | NS4B | EU543649 | RFV | E | DQ235149 |
| PSV | NS3 | DQ859067 | POV | NS4B | NC_003687 | RFV | NS1 | DQ235149 |
| PSV | NS4A | DQ859067 | POV | NS4B | L06436 | RFV | NS2A | DQ235149 |
| PSV | NS4B | DQ859067 | POV | NS5 | EU770575 | RFV | NS2B | DQ235149 |
| PSV | NS5 | DQ859067 | POV | NS5 | EU670438 | RFV | NS3 | DQ235149 |
| PSV | prM | DQ859067 | POV | NS5 | EU543649 | RFV | NS4A | DQ235149 |
| POV | 2K | EU770575 | POV | NS5 | NC_003687 | RFV | NS4B | DQ235149 |
| POV | 2K | EU670438 | POV | NS5 | L06436 | RFV | NS5 | DQ235149 |
| POV | 2K | EU543649 | POV | prM | EU770575 | RFV | prM | DQ235149 |
| POV | 2K | NC_003687 | POV | prM | EU670438 | SAV | 2K | DQ859062 |
| POV | 2K | L06436 | POV | prM | EU543649 | SAV | anC | DQ859062 |
| POV | anC | EU770575 | POV | prM | NC_003687 | SAV | E | DQ859062 |
| POV | anC | EU670438 | POV | prM | L06436 | SAV | NS1 | DQ859062 |
| POV | anC | EU543649 | RBV | 2K | AF144692 | SAV | NS2A | DQ859062 |
| POV | anC | NC_003687 | RBV | 2K | NC_003675 | SAV | NS2B | DQ859062 |
| POV | anC | L06436 | RBV | anC | AF144692 | SAV | NS3 | DQ859062 |
| POV | E | EU770575 | RBV | anC | NC_003675 | SAV | NS4A | DQ859062 |
| POV | E | EU670438 | RBV | E | AF144692 | SAV | NS4B | DQ859062 |

FIG. 70-219

| Virus | Protein | Accession No. | Virus | Protein | Accession No. | Virus | Protein | Accession No. |
|---|---|---|---|---|---|---|---|---|
| SAV | NS5 | DQ859062 | SEV | NS4B | DQ837642 | SLEV | NS1 | DQ359217 |
| SAV | prM | DQ859062 | SEV | NS5 | DQ859063 | SLEV | NS1 | AY632544 |
| SRV | 2K | DQ235150 | SEV | NS5 | AY632543 | SLEV | NS1 | NC_007580 |
| SRV | anC | DQ235150 | SEV | NS5 | NC_008719 | SLEV | NS2A | DQ525916 |
| SRV | E | DQ235150 | SEV | NS5 | DQ837642 | SLEV | NS2A | EU566860 |
| SRV | NS1 | DQ235150 | SEV | prM | DQ859063 | SLEV | NS2A | DQ359217 |
| SRV | NS2A | DQ235150 | SEV | prM | AY632543 | SLEV | NS2A | AY632544 |
| SRV | NS2B | DQ235150 | SEV | prM | NC_008719 | SLEV | NS2A | NC_007580 |
| SRV | NS3 | DQ235150 | SEV | prM | DQ837642 | SLEV | NS2B | DQ525916 |
| SRV | NS4A | DQ235150 | SSEV | 2K | DQ235152 | SLEV | NS2B | EU566860 |
| SRV | NS4B | DQ235150 | SSEV | anC | DQ235152 | SLEV | NS2B | DQ359217 |
| SRV | NS5 | DQ235150 | SSEV | E | DQ235152 | SLEV | NS2B | AY632544 |
| SRV | prM | DQ235150 | SSEV | NS1 | DQ235152 | SLEV | NS2B | NC_007580 |
| SEV | 2K | DQ859063 | SSEV | NS2A | DQ235152 | SLEV | NS3 | DQ525916 |
| SEV | 2K | AY632543 | SSEV | NS2B | DQ235152 | SLEV | NS3 | EU566860 |
| SEV | 2K | NC_008719 | SSEV | NS3 | DQ235152 | SLEV | NS3 | DQ359217 |
| SEV | 2K | DQ837642 | SSEV | NS4A | DQ235152 | SLEV | NS3 | AY632544 |
| SEV | anC | DQ859063 | SSEV | NS4B | DQ235152 | SLEV | NS3 | NC_007580 |
| SEV | anC | AY632543 | SSEV | NS5 | DQ235152 | SLEV | NS4A | DQ525916 |
| SEV | anC | NC_008719 | SSEV | prM | DQ235152 | SLEV | NS4A | EU566860 |
| SEV | anC | DQ837642 | SPV | 2K | DQ859064 | SLEV | NS4A | DQ359217 |
| SEV | E | DQ859063 | SPV | anC | DQ859064 | SLEV | NS4A | AY632544 |
| SEV | E | AY632543 | SPV | E | DQ859064 | SLEV | NS4A | NC_007580 |
| SEV | E | NC_008719 | SPV | NS1 | DQ859064 | SLEV | NS4B | DQ525916 |
| SEV | E | DQ837642 | SPV | NS2A | DQ859064 | SLEV | NS4B | EU566860 |
| SEV | NS1 | DQ859063 | SPV | NS2B | DQ859064 | SLEV | NS4B | DQ359217 |
| SEV | NS1 | AY632543 | SPV | NS3 | DQ859064 | SLEV | NS4B | AY632544 |
| SEV | NS1 | NC_008719 | SPV | NS4A | DQ859064 | SLEV | NS4B | NC_007580 |
| SEV | NS1 | DQ837642 | SPV | NS4B | DQ859064 | SLEV | NS5 | DQ525916 |
| SEV | NS2A | DQ859063 | SPV | NS5 | DQ859064 | SLEV | NS5 | EU566860 |
| SEV | NS2A | AY632543 | SPV | prM | DQ859064 | SLEV | NS5 | DQ359217 |
| SEV | NS2A | NC_008719 | SLEV | 2K | DQ525916 | SLEV | NS5 | AY632544 |
| SEV | NS2A | DQ837642 | SLEV | 2K | EU566860 | SLEV | NS5 | NC_007580 |
| SEV | NS2B | DQ859063 | SLEV | 2K | DQ359217 | SLEV | prM | DQ525916 |
| SEV | NS2B | AY632543 | SLEV | 2K | AY632544 | SLEV | prM | EU566860 |
| SEV | NS2B | NC_008719 | SLEV | 2K | NC_007580 | SLEV | prM | DQ359217 |
| SEV | NS2B | DQ837642 | SLEV | anC | DQ525916 | SLEV | prM | AY632544 |
| SEV | NS3 | DQ859063 | SLEV | anC | EU566860 | SLEV

FIG. 70-220

| Virus | Protein | Accession No. | Virus | Protein | Accession No. | Virus | Protein | Accession No. |
|---|---|---|---|---|---|---|---|---|
| TMBV | NS1 | AF285080 | TBEV | 2K | EF469661 | TBEV | E | L40361 |
| TMBV | NS1 | NC_003996 | TBEV | 2K | DQ862460 | TBEV | E | AF069066 |
| TMBV | NS2A | AF346759 | TBEV | 2K | DQ486861 | TBEV | E | U39292 |
| TMBV | NS2A | AF285080 | TBEV | 2K | AM600965 | TBEV | E | U27491 |
| TMBV | NS2A | NC_003996 | TBEV | 2K | DQ989336 | TBEV | E | U27495 |
| TMBV | NS2B | AF346759 | TBEV | 2K | AB062063 | TBEV | E | FJ997899 |
| TMBV | NS2B | AF285080 | TBEV | 2K | AB062064 | TBEV | E | FJ968751 |
| TMBV | NS2B | NC_003996 | TBEV | 2K | FJ828987 | TBEV | E | FJ906622 |
| TMBV | NS3 | AF346759 | TBEV | 2K | FJ828986 | TBEV | E | AY169390 |
| TMBV | NS3 | AF285080 | TBEV | anC | DQ401140 | TBEV | E | FJ572210 |
| TMBV | NS3 | NC_003996 | TBEV | anC | DQ153877 | TBEV | E | NC_001672 |
| TMBV | NS4A | AF346759 | TBEV | anC | GQ228395 | TBEV | E | EU816455 |
| TMBV | NS4A | AF285080 | TBEV | anC | AF527415 | TBEV | E | FJ402886 |
| TMBV | NS4A | NC_003996 | TBEV | anC | AY182009 | TBEV | E | FJ402885 |
| TMBV | NS4B | AF346759 | TBEV | anC | L40361 | TBEV | E | EU816454 |
| TMBV | NS4B | AF285080 | TBEV | anC | AF069066 | TBEV | E | EU816453 |
| TMBV | NS4B | NC_003996 | TBEV | anC | U39292 | TBEV | E | EU816452 |
| TMBV | NS5 | AF346759 | TBEV | anC | U27491 | TBEV | E | EU816451 |
| TMBV | NS5 | AF285080 | TBEV | anC | U27495 | TBEV | E | EU816450 |
| TMBV | NS5 | NC_003996 | TBEV | anC | FJ997899 | TBEV | E | EF469662 |
| TMBV | prM | AF346759 | TBEV | anC | FJ968751 | TBEV | E | EF469661 |
| TMBV | prM | AF285080 | TBEV | anC | FJ906622 | TBEV | E | DQ862460 |
| TMBV | prM | NC_003996 | TBEV | anC | AY169390 | TBEV | E | DQ486861 |
| TBEV | 2K | DQ401140 | TBEV | anC | FJ572210 | TBEV | E | AM600965 |
| TBEV | 2K | DQ153877 | TBEV | anC | NC_001672 | TBEV | E | DQ989336 |
| TBEV | 2K | GQ228395 | TBEV | anC | EU816455 | TBEV | E | AB062063 |
| TBEV | 2K | AF527415 | TBEV | anC | FJ402886 | TBEV | E | AB062064 |
| TBEV | 2K | AY182009 | TBEV | anC | FJ402885 | TBEV | E | FJ828987 |
| TBEV | 2K | L40361 | TBEV | anC | EU816454 | TBEV | E | FJ828986 |
| TBEV | 2K | AF069066 | TBEV | anC | EU816453 | TBEV | NS1 | DQ401140 |
| TBEV | 2K | U39292 | TBEV | anC | EU816452 | TBEV | NS1 | DQ153877 |
| TBEV | 2K | U27491 | TBEV | anC | EU816451 | TBEV | NS1 | GQ228395 |
| TBEV | 2K | U27495 | TBEV | anC | EU816450 | TBEV | NS1 | AF527415 |
| TBEV | 2K | FJ997899 | TBEV | anC | EF469662 | TBEV | NS1 | AY182009 |
| TBEV | 2K | FJ968751 | TBEV | anC | EF469661 | TBEV | NS1 | L40361 |
| TBEV | 2K | FJ906622 | TBEV | anC | DQ862460 | TBEV | NS1 | AF069066 |
| TBEV | 2K | AY169390 | TBEV | anC | DQ486861 | TBEV | NS1 | U39292 |
| TBEV | 2K | FJ572210 | TBEV | anC | AM600965 | TBEV | NS1 | U27491 |
| TBEV | 2K | NC_001672 | TBEV | anC | DQ989336 | TBEV | NS1 | U27495 |
| TBEV | 2K | EU816455 | TBEV | anC | AB062063 | TBEV | NS1 | FJ997899 |
| TBEV | 2K | FJ402886 | TBEV | anC | AB062064 | TBEV | NS1 | FJ968751 |
| TBEV | 2K | FJ402885 | TBEV | anC | FJ828987 | TBEV | NS1 | FJ906622 |
| TBEV | 2K | EU816454 | TBEV | anC | FJ828986 | TBEV | NS1 | AY169390 |
| TBEV | 2K | EU816453 | TBEV | E | DQ401140 | TBEV | NS1 | FJ572210 |
| TBEV | 2K | EU816452 | TBEV | E | DQ153877 | TBEV | NS1 | NC_001672 |
| TBEV | 2K | EU816451 | TBEV | E | GQ228395 | TBEV | NS1 | EU816455 |
| TBEV | 2K | EU816450 | TBEV | E | AF527415 | TBEV | NS1 | FJ402886 |
| TBEV | 2K | EF469662 | TBEV | E | AY182009 | TBEV | NS1 | FJ402885 |

FIG. 70-221

| Virus | Protein | Accession No. | Virus | Protein | Accession No. | Virus | Protein | Accession No. |
|---|---|---|---|---|---|---|---|---|
| TBEV | NS1 | EU816454 | TBEV | NS2A | FJ828986 | TBEV | NS3 | AY169390 |
| TBEV | NS1 | EU816453 | TBEV | NS2B | DQ401140 | TBEV | NS3 | FJ572210 |
| TBEV | NS1 | EU816452 | TBEV | NS2B | DQ153877 | TBEV | NS3 | NC_001672 |
| TBEV | NS1 | EU816451 | TBEV | NS2B | GQ228395 | TBEV | NS3 | EU816455 |
| TBEV | NS1 | EU816450 | TBEV | NS2B | AF527415 | TBEV | NS3 | FJ402886 |
| TBEV | NS1 | EF469662 | TBEV | NS2B | AY182009 | TBEV | NS3 | FJ402885 |
| TBEV | NS1 | EF469661 | TBEV | NS2B | L40361 | TBEV | NS3 | EU816454 |
| TBEV | NS1 | DQ862460 | TBEV | NS2B | AF069066 | TBEV | NS3 | EU816453 |
| TBEV | NS1 | DQ486861 | TBEV | NS2B | U39292 | TBEV | NS3 | EU816452 |
| TBEV | NS1 | AM600965 | TBEV | NS2B | U27491 | TBEV | NS3 | EU816451 |
| TBEV | NS1 | DQ989336 | TBEV | NS2B | U27495 | TBEV | NS3 | EU816450 |
| TBEV | NS1 | AB062063 | TBEV | NS2B | FJ997899 | TBEV | NS3 | EF469662 |
| TBEV | NS1 | AB062064 | TBEV | NS2B | FJ968751 | TBEV | NS3 | EF469661 |
| TBEV | NS1 | FJ828987 | TBEV | NS2B | FJ906622 | TBEV | NS3 | DQ862460 |
| TBEV | NS1 | FJ828986 | TBEV | NS2B | AY169390 | TBEV | NS3 | DQ486861 |
| TBEV | NS2A | DQ401140 | TBEV | NS2B | FJ572210 | TBEV | NS3 | AM600965 |
| TBEV | NS2A | DQ153877 | TBEV | NS2B | NC_001672 | TBEV | NS3 | DQ989336 |
| TBEV | NS2A | GQ228395 | TBEV | NS2B | EU816455 | TBEV | NS3 | AB062063 |
| TBEV | NS2A | AF527415 | TBEV | NS2B | FJ402886 | TBEV | NS3 | AB062064 |
| TBEV | NS2A | AY182009 | TBEV | NS2B | FJ402885 | TBEV | NS3 | FJ828987 |
| TBEV | NS2A | L40361 | TBEV | NS2B | EU816454 | TBEV | NS3 | FJ828986 |
| TBEV | NS2A | AF069066 | TBEV | NS2B | EU816453 | TBEV | NS4A | DQ401140 |
| TBEV | NS2A | U39292 | TBEV | NS2B | EU816452 | TBEV | NS4A | DQ153877 |
| TBEV | NS2A | U27491 | TBEV | NS2B | EU816451 | TBEV | NS4A | GQ228395 |
| TBEV | NS2A | U27495 | TBEV | NS2B | EU816450 | TBEV | NS4A | AF527415 |
| TBEV | NS2A | FJ997899 | TBEV | NS2B | EF469662 | TBEV | NS4A | AY182009 |
| TBEV | NS2A | FJ968751 | TBEV | NS2B | EF469661 | TBEV | NS4A | L40361 |
| TBEV | NS2A | FJ906622 | TBEV | NS2B | DQ862460 | TBEV | NS4A | AF069066 |
| TBEV | NS2A | AY169390 | TBEV | NS2B | DQ486861 | TBEV | NS4A | U39292 |
| TBEV | NS2A | FJ572210 | TBEV | NS2B | AM600965 | TBEV | NS4A | U27491 |
| TBEV | NS2A | NC_001672 | TBEV | NS2B | DQ989336 | TBEV | NS4A | U27495 |
| TBEV | NS2A | EU816455 | TBEV | NS2B | AB062063 | TBEV | NS4A | FJ997899 |
| TBEV | NS2A | FJ402886 | TBEV | NS2B | AB062064 | TBEV | NS4A | FJ968751 |
| TBEV | NS2A | FJ402885 | TBEV | NS2B | FJ828987 | TBEV | NS4A | FJ906622 |
| TBEV | NS2A | EU816454 | TBEV | NS2B | FJ828986 | TBEV | NS4A | AY169390 |
| TBEV | NS2A | EU816453 | TBEV | NS3 | DQ401140 | TBEV | NS4A | FJ572210 |
| TBEV | NS2A | EU816452 | TBEV | NS3 | DQ153877 | TBEV | NS4A | NC_001672 |
| TBEV | NS2A | EU816451 | TBEV | NS3 | GQ228395 | TBEV | NS4A | EU816455 |
| TBEV | NS2A | EU816450 | TBEV | NS3 | AF527415 | TBEV | NS4A | FJ402886 |
| TBEV | NS2A | EF469662 | TBEV | NS3 | AY182009 | TBEV | NS4A | FJ402885 |
| TBEV | NS2A | EF469661 | TBEV | NS3 | L40361 | TBEV | NS4A | EU816454 |
| TBEV | NS2A | DQ862460 | TBEV | NS3 | AF069066 | TBEV | NS4A | EU816453 |
| TBEV | NS2A | DQ486861 | TBEV | NS3 | U39292 | TBEV | NS4A | EU816452 |
| TBEV | NS2A | AM600965 | TBEV | NS3 | U27491 | TBEV | NS4A | EU816451 |
| TBEV | NS2A | DQ989336 | TBEV | NS3 | U27495 | TBEV | NS4A | EU816450 |
| TBEV | NS2A | AB062063 | TBEV | NS3 | FJ997899 | TBEV | NS4A | EF469662 |
| TBEV | NS2A | AB062064 | TBEV | NS3 | FJ968751 | TBEV | NS4A | EF469661 |
| TBEV | NS2A | FJ828987 | TBEV | NS3 | FJ906622 | TBEV | NS4A | DQ862460 |

FIG. 70-222

| Virus | Protein | Accession No. | Virus | Protein | Accession No. | Virus | Protein | Accession No. |
|---|---|---|---|---|---|---|---|---|
| TBEV | NS4A | DQ486861 | TBEV | NS5 | U39292 | TBEV | prM | EU816452 |
| TBEV | NS4A | AM600965 | TBEV | NS5 | U27491 | TBEV | prM | EU816451 |
| TBEV | NS4A | DQ989336 | TBEV | NS5 | U27495 | TBEV | prM | EU816450 |
| TBEV | NS4A | AB062063 | TBEV | NS5 | FJ997899 | TBEV | prM | EF469662 |
| TBEV | NS4A | AB062064 | TBEV | NS5 | FJ968751 | TBEV | prM | EF469661 |
| TBEV | NS4A | FJ828987 | TBEV | NS5 | FJ906622 | TBEV | prM | DQ862460 |
| TBEV | NS4A | FJ828986 | TBEV | NS5 | AY169390 | TBEV | prM | DQ486861 |
| TBEV | NS4B | DQ401140 | TBEV | NS5 | FJ572210 | TBEV | prM | AM600965 |
| TBEV | NS4B | DQ153877 | TBEV | NS5 | NC_001672 | TBEV | prM | DQ989336 |
| TBEV | NS4B | GQ228395 | TBEV | NS5 | EU816455 | TBEV | prM | AB062063 |
| TBEV | NS4B | AF527415 | TBEV | NS5 | FJ402886 | TBEV | prM | AB062064 |
| TBEV | NS4B | AY182009 | TBEV | NS5 | FJ402885 | TBEV | prM | FJ828987 |
| TBEV | NS4B | L40361 | TBEV | NS5 | EU816454 | TBEV | prM | FJ828986 |
| TBEV | NS4B | AF069066 | TBEV | NS5 | EU816453 | TSEV | 2K | DQ235151 |
| TBEV | NS4B | U39292 | TBEV | NS5 | EU816452 | TSEV | anC | DQ235151 |
| TBEV | NS4B | U27491 | TBEV | NS5 | EU816451 | TSEV | E | DQ235151 |
| TBEV | NS4B | U27495 | TBEV | NS5 | EU816450 | TSEV | NS1 | DQ235151 |
| TBEV | NS4B | FJ997899 | TBEV | NS5 | EF469662 | TSEV | NS2A | DQ235151 |
| TBEV | NS4B | FJ968751 | TBEV | NS5 | EF469661 | TSEV | NS2B | DQ235151 |
| TBEV | NS4B | FJ906622 | TBEV | NS5 | DQ862460 | TSEV | NS3 | DQ235151 |
| TBEV | NS4B | AY169390 | TBEV | NS5 | DQ486861 | TSEV | NS4A | DQ235151 |
| TBEV | NS4B | FJ572210 | TBEV | NS5 | AM600965 | TSEV | NS4B | DQ235151 |
| TBEV | NS4B | NC_001672 | TBEV | NS5 | DQ989336 | TSEV | NS5 | DQ235151 |
| TBEV | NS4B | EU816455 | TBEV | NS5 | AB062063 | TSEV | prM | DQ235151 |
| TBEV | NS4B | FJ402886 | TBEV | NS5 | AB062064 | TUV | 2K | DQ235148 |
| TBEV | NS4B | FJ402885 | TBEV | NS5 | FJ828987 | TUV | anC | DQ235148 |
| TBEV | NS4B | EU816454 | TBEV | NS5 | FJ828986 | TUV | E | DQ235148 |
| TBEV | NS4B | EU816453 | TBEV | prM | DQ401140 | TUV | NS1 | DQ235148 |
| TBEV | NS4B | EU816452 | TBEV | prM | DQ153877 | TUV | NS2A | DQ235148 |
| TBEV | NS4B | EU816451 | TBEV | prM | GQ228395 | TUV | NS2B | DQ235148 |
| TBEV | NS4B | EU816450 | TBEV | prM | AF527415 | TUV | NS3 | DQ235148 |
| TBEV | NS4B | EF469662 | TBEV | prM | AY182009 | TUV | NS4A | DQ235148 |
| TBEV | NS4B | EF469661 | TBEV | prM | L40361 | TUV | NS4B | DQ235148 |
| TBEV | NS4B | DQ862460 | TBEV | prM | AF069066 | TUV | NS5 | DQ235148 |
| TBEV | NS4B | DQ486861 | TBEV | prM | U39292 | TUV | prM | DQ235148 |
| TBEV | NS4B | AM600965 | TBEV | prM | U27491 | USV | 2K | DQ859065 |
| TBEV | NS4B | DQ989336 | TBEV | prM | U27495 | USV | anC | DQ859065 |
| TBEV | NS4B | AB062063 | TBEV | prM | FJ997899 | USV | E | DQ859065 |
| TBEV | NS4B | AB062064 | TBEV | prM | FJ968751 | USV | NS1 | DQ859065 |
| TBEV | NS4B | FJ828987 | TBEV | prM | FJ906622 | USV | NS2A | DQ859065 |
| TBEV | NS4B | FJ828986 | TBEV | prM | AY169390 | USV | NS2B | DQ859065 |
| TBEV | NS5 | DQ401140 | TBEV | prM | FJ572210 | USV | NS3 | DQ859065 |
| TBEV | NS5 | DQ153877 | TBEV | prM | NC_001672 | USV | NS4A | DQ859065 |
| TBEV | NS5 | GQ228395 | TBEV | prM | EU816455 | USV | NS4B | DQ859065 |
| TBEV | NS5 | AF527415 | TBEV | prM | FJ402886 | USV | NS5 | DQ859065 |
| TBEV | NS5 | AY182009 | TBEV | prM | FJ402885 | USV | prM | DQ859065 |
| TBEV | NS5 | L40361 | TBEV | prM | EU816454 | UTV | 2K | NC_006551 |
| TBEV | NS5 | AF069066 | TBEV | prM | EU816453 | UTV | 2K | AY453412 |

FIG. 70-223

| Virus | Protein | Accession No. | Virus | Protein | Accession No. | Virus | Protein | Accession No. |
|---|---|---|---|---|---|---|---|---|
| UTV | 2K | AY453411 | WBV | E | DQ859058 | WNV | 2K | DQ164187 |
| UTV | 2K | EF206350 | WBV | E | NC_012735 | WNV | 2K | DQ431703 |
| UTV | anC | NC_006551 | WBV | E | EU707555 | WNV | 2K | DQ374650 |
| UTV | anC | AY453412 | WBV | NS1 | DQ859058 | WNV | 2K | DQ164201 |
| UTV | anC | AY453411 | WBV | NS1 | NC_012735 | WNV | 2K | AY278441 |
| UTV | anC | EF206350 | WBV | NS1 | EU707555 | WNV | 2K | DQ431712 |
| UTV | E | NC_006551 | WBV | NS2A | DQ859058 | WNV | 2K | AY660002 |
| UTV | E | AY453412 | WBV | NS2A | NC_012735 | WNV | 2K | DQ411035 |
| UTV | E | AY453411 | WBV | NS2A | EU707555 | WNV | 2K | DQ374653 |
| UTV | E | EF206350 | WBV | NS2B | DQ859058 | WNV | 2K | AY688948 |
| UTV | NS1 | NC_006551 | WBV | NS2B | NC_012735 | WNV | 2K | NC_009942 |
| UTV | NS1 | AY453412 | WBV | NS2B | EU707555 | WNV | 2K | AF206518 |
| UTV | NS1 | AY453411 | WBV | NS3 | DQ859058 | WNV | 2K | DQ080061 |
| UTV | NS1 | EF206350 | WBV | NS3 | NC_012735 | WNV | 2K | DQ164199 |
| UTV | NS2A | NC_006551 | WBV | NS3 | EU707555 | WNV | 2K | FJ425721 |
| UTV | NS2A | AY453412 | WBV | NS4A | DQ859058 | WNV | 2K | DQ377178 |
| UTV | NS2A | AY453411 | WBV | NS4A | NC_012735 | WNV | 2K | DQ666452 |
| UTV | NS2A | EF206350 | WBV | NS4A | EU707555 | WNV | 2K | DQ080064 |
| UTV | NS2B | NC_006551 | WBV | NS4B | DQ859058 | WNV | 2K | DQ431697 |
| UTV | NS2B | AY453412 | WBV | NS4B | NC_012735 | WNV | 2K | AY532665 |
| UTV | NS2B | AY453411 | WBV | NS4B | EU707555 | WNV | 2K | DQ431707 |
| UTV | NS2B | EF206350 | WBV | NS5 | DQ859058 | WNV | 2K | FJ483548 |
| UTV | NS3 | NC_006551 | WBV | NS5 | NC_012735 | WNV | 2K | AF404757 |
| UTV | NS3 | AY453412 | WBV | NS5 | EU707555 | WNV | 2K | DQ374652 |
| UTV | NS3 | AY453411 | WBV | prM | DQ859058 | WNV | 2K | DQ431696 |
| UTV | NS3 | EF206350 | WBV | prM | NC_012735 | WNV | 2K | DQ666450 |
| UTV | NS4A | NC_006551 | WBV | prM | EU707555 | WNV | 2K | AY712948 |
| UTV | NS4A | AY453412 | WNV | 2K | AJ965628 | WNV | 2K | DQ164193 |
| UTV | NS4A | AY453411 | WNV | 2K | GQ379159 | WNV | 2K | EF657887 |
| UTV | NS4A | EF206350 | WNV | 2K | GQ379157 | WNV | 2K | FJ159130 |
| UTV | NS4B | NC_006551 | WNV | 2K | GQ379160 | WNV | 2K | DQ080065 |
| UTV | NS4B | AY453412 | WNV | 2K | GQ379161 | WNV | 2K | DQ118127 |
| UTV | NS4B | AY453411 | WNV | 2K | FJ527738 | WNV | 2K | DQ318020 |
| UTV | NS4B | EF206350 | WNV | 2K | GU011992 | WNV | 2K | EU068667 |
| UTV | NS5 | NC_006551 | WNV | 2K | FJ766331 | WNV | 2K | DQ080071 |
| UTV | NS5 | AY453412 | WNV | 2K | GQ379156 | WNV | 2K | DQ431711 |
| UTV | NS5 | AY453411 | WNV | 2K | GQ379158 | WNV | 2K | DQ164202 |
| UTV | NS5 | EF206350 | WNV | 2K | AJ965626 | WNV | 2K | AY274505 |
| UTV | prM | NC_006551 | WNV | 2K | FJ766332 | WNV | 2K | DQ786573 |
| UTV | prM | AY453412 | WNV | 2K | CS543188 | WNV | 2K | DQ080068 |
| UTV | prM | AY453411 | WNV | 2K | DQ431694 | WNV | 2K | DQ411031 |
| UTV | prM | EF206350 | WNV | 2K | DQ431700 | WNV | 2K | DQ411030 |
| WBV | 2K | DQ859058 | WNV | 2K | AY277252 | WNV | 2K | DQ374651 |
| WBV | 2K | NC_012735 | WNV | 2K | DQ005530 | WNV | 2K | AF260968 |
| WBV | 2K | EU707555 | WNV | 2K | AF317203 | WNV | 2K | DQ080052 |
| WBV | anC | DQ859058 | WNV | 2K | AY268132 | WNV | 2K | DQ080060 |
| WBV | anC | NC_012735 | WNV | 2K | DQ431708 | WNV | 2K | AY277251 |
| WBV | anC | EU707555 | WNV | 2K | AF533540 | WNV | 2K | DQ080059 |

FIG. 70-224

| Virus | Protein | Accession No. | Virus | Protein | Accession No. | Virus | Protein | Accession No. |
|---|---|---|---|---|---|---|---|---|
| WNV | 2K | AY712946 | WNV | 2K | AY289214 | WNV | 2K | DQ431706 |
| WNV | 2K | AY274504 | WNV | 2K | AY490240 | WNV | 2K | DQ431710 |
| WNV | 2K | DQ080051 | WNV | 2K | AB185916 | WNV | 2K | DQ786572 |
| WNV | 2K | DQ256376 | WNV | 2K | AB185917 | WNV | 2K | DQ666448 |
| WNV | 2K | DQ164194 | WNV | 2K | AY701413 | WNV | 2K | DQ666449 |
| WNV | 2K | DQ431695 | WNV | 2K | AY712945 | WNV | 2K | EF571854 |
| WNV | 2K | DQ431701 | WNV | 2K | AY712947 | WNV | 2K | EF429199 |
| WNV | 2K | EU155484 | WNV | 2K | AY646354 | WNV | 2K | EU081844 |
| WNV | 2K | AY278442 | WNV | 2K | AY795965 | WNV | 2K | FJ159129 |
| WNV | 2K | DQ666451 | WNV | 2K | DQ066423 | WNV | 2K | FJ159131 |
| WNV | 2K | DQ431704 | WNV | 2K | DQ080053 | WNV | 2K | FJ151394 |
| WNV | 2K | DQ080070 | WNV | 2K | DQ080054 | WNV | 2K | FJ411043 |
| WNV | 2K | DQ164189 | WNV | 2K | DQ080055 | WNV | anC | AJ965628 |
| WNV | 2K | DQ080058 | WNV | 2K | DQ080057 | WNV | anC | GQ379159 |
| WNV | 2K | FJ483549 | WNV | 2K | DQ080062 | WNV | anC | GQ379157 |
| WNV | 2K | DQ164188 | WNV | 2K | DQ080063 | WNV | anC | GQ379160 |
| WNV | 2K | AY765264 | WNV | 2K | DQ080067 | WNV | anC | GQ379161 |
| WNV | 2K | DQ080066 | WNV | 2K | DQ080069 | WNV | anC | FJ527738 |
| WNV | 2K | DQ983578 | WNV | 2K | DQ080072 | WNV | anC | GU011992 |
| WNV | 2K | EF429198 | WNV | 2K | DQ116961 | WNV | anC | FJ766331 |
| WNV | 2K | DQ431709 | WNV | 2K | AY842931 | WNV | anC | GQ379156 |
| WNV | 2K | DQ411029 | WNV | 2K | DQ164186 | WNV | anC | GQ379158 |
| WNV | 2K | DQ411034 | WNV | 2K | DQ164190 | WNV | anC | AJ965626 |
| WNV | 2K | DQ431698 | WNV | 2K | DQ164191 | WNV | anC | FJ766332 |
| WNV | 2K | AY268133 | WNV | 2K | DQ164192 | WNV | anC | CS543188 |
| WNV | 2K | DQ080056 | WNV | 2K | DQ164195 | WNV | anC | DQ431694 |
| WNV | 2K | EF530047 | WNV | 2K | DQ164196 | WNV | anC | DQ431700 |
| WNV | 2K | AB185914 | WNV | 2K | DQ164197 | WNV | anC | AY277252 |
| WNV | 2K | AF196835 | WNV | 2K | DQ164198 | WNV | anC | DQ005530 |
| WNV | 2K | M12294 | WNV | 2K | DQ164200 | WNV | anC | AF317203 |
| WNV | 2K | EF429200 | WNV | 2K | DQ164203 | WNV | anC | AY268132 |
| WNV | 2K | EF429197 | WNV | 2K | DQ164204 | WNV | anC | DQ431708 |
| WNV | 2K | EU249803 | WNV | 2K | DQ164205 | WNV | anC | AF533540 |
| WNV | 2K | AM404308 | WNV | 2K | DQ164206 | WNV | anC | DQ164187 |
| WNV | 2K | AY603654 | WNV | 2K | DQ211652 | WNV | anC | DQ431703 |
| WNV | 2K | DQ176636 | WNV | 2K | DQ176637 | WNV | anC | DQ374650 |
| WNV | 2K | NC_001563 | WNV | 2K | AY848697 | WNV | anC | DQ164201 |
| WNV | 2K | AY701412 | WNV | 2K | AY848695 | WNV | anC | AY278441 |
| WNV | 2K | AF260969 | WNV | 2K | AY848696 | WNV | anC | DQ431712 |
| WNV | 2K | AF481864 | WNV | 2K | DQ318019 | WNV | anC | AY660002 |
| WNV | 2K | AY262283 | WNV | 2K | DQ377179 | WNV | anC | DQ411035 |
| WNV | 2K | D00246 | WNV | 2K | DQ377180 | WNV | anC | DQ374653 |
| WNV | 2K | AF202541 | WNV | 2K | DQ411032 | WNV | anC | AY688948 |
| WNV | 2K | AF260967 | WNV | 2K | DQ411033 | WNV | anC | NC_009942 |
| WNV | 2K | AF404753 | WNV | 2K | DQ431693 | WNV | anC | AF206518 |
| WNV | 2K | AF404754 | WNV | 2K | DQ431699 | WNV | anC | DQ080061 |
| WNV | 2K | AF404755 | WNV | 2K | DQ431702 | WNV | anC | DQ164199 |
| WNV | 2K | AF404756 | WNV | 2K | DQ431705 | WNV | anC | FJ425721 |

FIG. 70-225

| Virus | Protein | Accession No. | Virus | Protein | Accession No. | Virus | Protein | Accession No. |
|---|---|---|---|---|---|---|---|---|
| WNV | anC | DQ377178 | WNV | anC | DQ164188 | WNV | anC | DQ080063 |
| WNV | anC | DQ666452 | WNV | anC | AY765264 | WNV | anC | DQ080067 |
| WNV | anC | DQ080064 | WNV | anC | DQ080066 | WNV | anC | DQ080069 |
| WNV | anC | DQ431697 | WNV | anC | DQ983578 | WNV | anC | DQ080072 |
| WNV | anC | AY532665 | WNV | anC | EF429198 | WNV | anC | DQ116961 |
| WNV | anC | DQ431707 | WNV | anC | DQ431709 | WNV | anC | AY842931 |
| WNV | anC | FJ483548 | WNV | anC | DQ411029 | WNV | anC | DQ164186 |
| WNV | anC | AF404757 | WNV | anC | DQ411034 | WNV | anC | DQ164190 |
| WNV | anC | DQ374652 | WNV | anC | DQ431698 | WNV | anC | DQ164191 |
| WNV | anC | DQ431696 | WNV | anC | AY268133 | WNV | anC | DQ164192 |
| WNV | anC | DQ666450 | WNV | anC | DQ080056 | WNV | anC | DQ164195 |
| WNV | anC | AY712948 | WNV | anC | EF530047 | WNV | anC | DQ164196 |
| WNV | anC | DQ164193 | WNV | anC | AB185914 | WNV | anC | DQ164197 |
| WNV | anC | EF657887 | WNV | anC | AF196835 | WNV | anC | DQ164198 |
| WNV | anC | FJ159130 | WNV | anC | M12294 | WNV | anC | DQ164200 |
| WNV | anC | DQ080065 | WNV | anC | EF429200 | WNV | anC | DQ164203 |
| WNV | anC | DQ118127 | WNV | anC | EF429197 | WNV | anC | DQ164204 |
| WNV | anC | DQ318020 | WNV | anC | EU249803 | WNV | anC | DQ164205 |
| WNV | anC | EU068667 | WNV | anC | AM404308 | WNV | anC | DQ164206 |
| WNV | anC | DQ080071 | WNV | anC | AY603654 | WNV | anC | DQ211652 |
| WNV | anC | DQ431711 | WNV | anC | DQ176636 | WNV | anC | DQ176637 |
| WNV | anC | DQ164202 | WNV | anC | NC_001563 | WNV | anC | AY848697 |
| WNV | anC | AY274505 | WNV | anC | AY701412 | WNV | anC | AY848695 |
| WNV | anC | DQ786573 | WNV | anC | AF260969 | WNV | anC | AY848696 |
| WNV | anC | DQ080068 | WNV | anC | AF481864 | WNV | anC | DQ318019 |
| WNV | anC | DQ411031 | WNV | anC | AY262283 | WNV | anC | DQ377179 |
| WNV | anC | DQ411030 | WNV | anC | D00246 | WNV | anC | DQ377180 |
| WNV | anC | DQ374651 | WNV | anC | AF202541 | WNV | anC | DQ411032 |
| WNV | anC | AF260968 | WNV | anC | AF260967 | WNV | anC | DQ411033 |
| WNV | anC | DQ080052 | WNV | anC | AF404753 | WNV | anC | DQ431693 |
| WNV | anC | DQ080060 | WNV | anC | AF404754 | WNV | anC | DQ431699 |
| WNV | anC | AY277251 | WNV | anC | AF404755 | WNV | anC | DQ431702 |
| WNV | anC | DQ080059 | WNV | anC | AF404756 | WNV | anC | DQ431705 |
| WNV | anC | AY712946 | WNV | anC | AY289214 | WNV | anC | DQ431706 |
| WNV | anC | AY274504 | WNV | anC | AY490240 | WNV | anC | DQ431710 |
| WNV | anC | DQ080051 | WNV | anC | AB185916 | WNV | anC | DQ786572 |
| WNV | anC | DQ256376 | WNV | anC | AB185917 | WNV | anC | DQ666448 |
| WNV | anC | DQ164194 | WNV | anC | AY701413 | WNV | anC | DQ666449 |
| WNV | anC | DQ431695 | WNV | anC | AY712945 | WNV | anC | EF571854 |
| WNV | anC | DQ431701 | WNV | anC | AY712947 | WNV | anC | EF429199 |
| WNV | anC | EU155484 | WNV | anC | AY646354 | WNV | anC | EU081844 |
| WNV | anC | AY278442 | WNV | anC | AY795965 | WNV | anC | FJ159129 |
| WNV | anC | DQ666451 | WNV | anC | DQ066423 | WNV | anC | FJ159131 |
| WNV | anC | DQ431704 | WNV | anC | DQ080053 | WNV | anC | FJ151394 |
| WNV | anC | DQ080070 | WNV | anC | DQ080054 | WNV | anC | FJ411043 |
| WNV | anC | DQ164189 | WNV | anC | DQ080055 | WNV | E | AJ965628 |
| WNV | anC | DQ080058 | WNV | anC | DQ080057 | WNV | E | GQ379159 |
| WNV | anC | FJ483549 | WNV | anC | DQ080062 | WNV | E | GQ379157 |

FIG. 70-226

| Virus | Protein | Accession No. | Virus | Protein | Accession No. | Virus | Protein | Accession No. |
|---|---|---|---|---|---|---|---|---|
| WNV | E | GQ379160 | WNV | E | DQ080065 | WNV | E | EF429200 |
| WNV | E | GQ379161 | WNV | E | DQ118127 | WNV | E | EF429197 |
| WNV | E | FJ527738 | WNV | E | DQ318020 | WNV | E | EU249803 |
| WNV | E | GU011992 | WNV | E | EU068667 | WNV | E | AM404308 |
| WNV | E | FJ766331 | WNV | E | DQ080071 | WNV | E | AY603654 |
| WNV | E | GQ379156 | WNV | E | DQ431711 | WNV | E | DQ176636 |
| WNV | E | GQ379158 | WNV | E | DQ164202 | WNV | E | NC_001563 |
| WNV | E | AJ965626 | WNV | E | AY274505 | WNV | E | AY701412 |
| WNV | E | FJ766332 | WNV | E | DQ786573 | WNV | E | AF260969 |
| WNV | E | CS543188 | WNV | E | DQ080068 | WNV | E | AF481864 |
| WNV | E | DQ431694 | WNV | E | DQ411031 | WNV | E | AY262283 |
| WNV | E | DQ431700 | WNV | E | DQ411030 | WNV | E | D00246 |
| WNV | E | AY277252 | WNV | E | DQ374651 | WNV | E | AF202541 |
| WNV | E | DQ005530 | WNV | E | AF260968 | WNV | E | AF260967 |
| WNV | E | AF317203 | WNV | E | DQ080052 | WNV | E | AF404753 |
| WNV | E | AY268132 | WNV | E | DQ080060 | WNV | E | AF404754 |
| WNV | E | DQ431708 | WNV | E | AY277251 | WNV | E | AF404755 |
| WNV | E | AF533540 | WNV | E | DQ080059 | WNV | E | AF404756 |
| WNV | E | DQ164187 | WNV | E | AY712946 | WNV | E | AY289214 |
| WNV | E | DQ431703 | WNV | E | AY274504 | WNV | E | AY490240 |
| WNV | E | DQ374650 | WNV | E | DQ080051 | WNV | E | AB185916 |
| WNV | E | DQ164201 | WNV | E | DQ256376 | WNV | E | AB185917 |
| WNV | E | AY278441 | WNV | E | DQ164194 | WNV | E | AY701413 |
| WNV | E | DQ431712 | WNV | E | DQ431695 | WNV | E | AY712945 |
| WNV | E | AY660002 | WNV | E | DQ431701 | WNV | E | AY712947 |
| WNV | E | DQ411035 | WNV | E | EU155484 | WNV | E | AY646354 |
| WNV | E | DQ374653 | WNV | E | AY278442 | WNV | E | AY795965 |
| WNV | E | AY688948 | WNV | E | DQ666451 | WNV | E | DQ066423 |
| WNV | E | NC_009942 | WNV | E | DQ431704 | WNV | E | DQ080053 |
| WNV | E | AF206518 | WNV | E | DQ080070 | WNV | E | DQ080054 |
| WNV | E | DQ080061 | WNV | E | DQ164189 | WNV | E | DQ080055 |
| WNV | E | DQ164199 | WNV | E | DQ080058 | WNV | E | DQ080057 |
| WNV | E | FJ425721 | WNV | E | FJ483549 | WNV | E | DQ080062 |
| WNV | E | DQ377178 | WNV | E | DQ164188 | WNV | E | DQ080063 |
| WNV | E | DQ666452 | WNV | E | AY765264 | WNV | E | DQ080067 |
| WNV | E | DQ080064 | WNV | E | DQ080066 | WNV | E | DQ080069 |
| WNV | E | DQ431697 | WNV | E | DQ983578 | WNV | E | DQ080072 |
| WNV | E | AY532665 | WNV | E | EF429198 | WNV | E | DQ116961 |
| WNV | E | DQ431707 | WNV | E | DQ431709 | WNV | E | AY842931 |
| WNV | E | FJ483548 | WNV | E | DQ411029 | WNV | E | DQ164186 |
| WNV | E | AF404757 | WNV | E | DQ411034 | WNV | E | DQ164190 |
| WNV | E | DQ374652 | WNV | E | DQ431698 | WNV | E | DQ164191 |
| WNV | E | DQ431696 | WNV | E | AY268133 | WNV | E | DQ164192 |
| WNV | E | DQ666450 | WNV | E | DQ080056 | WNV | E | DQ164195 |
| WNV | E | AY712948 | WNV | E | EF530047 | WNV | E | DQ164196 |
| WNV | E | DQ164193 | WNV | E | AB185914 | WNV | E | DQ164197 |
| WNV | E | EF657887 | WNV | E | AF196835 | WNV | E | DQ164198 |
| WNV | E | FJ159130 | WNV | E | M12294 | WNV | E | DQ164200 |

FIG. 70-227

| Virus | Protein | Accession No. | Virus | Protein | Accession No. | Virus | Protein | Accession No. |
|---|---|---|---|---|---|---|---|---|
| WNV | E | DQ164203 | WNV | NS1 | AY268132 | WNV | NS1 | DQ080060 |
| WNV | E | DQ164204 | WNV | NS1 | DQ431708 | WNV | NS1 | AY277251 |
| WNV | E | DQ164205 | WNV | NS1 | AF533540 | WNV | NS1 | DQ080059 |
| WNV | E | DQ164206 | WNV | NS1 | DQ164187 | WNV | NS1 | AY712946 |
| WNV | E | DQ211652 | WNV | NS1 | DQ431703 | WNV | NS1 | AY274504 |
| WNV | E | DQ176637 | WNV | NS1 | DQ374650 | WNV | NS1 | DQ080051 |
| WNV | E | AY848697 | WNV | NS1 | DQ164201 | WNV | NS1 | DQ256376 |
| WNV | E | AY848695 | WNV | NS1 | AY278441 | WNV | NS1 | DQ164194 |
| WNV | E | AY848696 | WNV | NS1 | DQ431712 | WNV | NS1 | DQ431695 |
| WNV | E | DQ318019 | WNV | NS1 | AY660002 | WNV | NS1 | DQ431701 |
| WNV | E | DQ377179 | WNV | NS1 | DQ411035 | WNV | NS1 | EU155484 |
| WNV | E | DQ377180 | WNV | NS1 | DQ374653 | WNV | NS1 | AY278442 |
| WNV | E | DQ411032 | WNV | NS1 | AY688948 | WNV | NS1 | DQ666451 |
| WNV | E | DQ411033 | WNV | NS1 | NC_009942 | WNV | NS1 | DQ431704 |
| WNV | E | DQ431693 | WNV | NS1 | AF206518 | WNV | NS1 | DQ080070 |
| WNV | E | DQ431699 | WNV | NS1 | DQ080061 | WNV | NS1 | DQ164189 |
| WNV | E | DQ431702 | WNV | NS1 | DQ164199 | WNV | NS1 | DQ080058 |
| WNV | E | DQ431705 | WNV | NS1 | FJ425721 | WNV | NS1 | FJ483549 |
| WNV | E | DQ431706 | WNV | NS1 | DQ377178 | WNV | NS1 | DQ164188 |
| WNV | E | DQ431710 | WNV | NS1 | DQ666452 | WNV | NS1 | AY765264 |
| WNV | E | DQ786572 | WNV | NS1 | DQ080064 | WNV | NS1 | DQ080066 |
| WNV | E | DQ666448 | WNV | NS1 | DQ431697 | WNV | NS1 | DQ983578 |
| WNV | E | DQ666449 | WNV | NS1 | AY532665 | WNV | NS1 | EF429198 |
| WNV | E | EF571854 | WNV | NS1 | DQ431707 | WNV | NS1 | DQ431709 |
| WNV | E | EF429199 | WNV | NS1 | FJ483548 | WNV | NS1 | DQ411029 |
| WNV | E | EU081844 | WNV | NS1 | AF404757 | WNV | NS1 | DQ411034 |
| WNV | E | FJ159129 | WNV | NS1 | DQ374652 | WNV | NS1 | DQ431698 |
| WNV | E | FJ159131 | WNV | NS1 | DQ431696 | WNV | NS1 | AY268133 |
| WNV | E | FJ151394 | WNV | NS1 | DQ666450 | WNV | NS1 | DQ080056 |
| WNV | E | FJ411043 | WNV | NS1 | AY712948 | WNV | NS1 | EF530047 |
| WNV | NS1 | AJ965628 | WNV | NS1 | DQ164193 | WNV | NS1 | AB185914 |
| WNV | NS1 | GQ379159 | WNV | NS1 | EF657887 | WNV | NS1 | AF196835 |
| WNV | NS1 | GQ379157 | WNV | NS1 | FJ159130 | WNV | NS1 | M12294 |
| WNV | NS1 | GQ379160 | WNV | NS1 | DQ080065 | WNV | NS1 | EF429200 |
| WNV | NS1 | GQ379161 | WNV | NS1 | DQ118127 | WNV | NS1 | EF429197 |
| WNV | NS1 | FJ527738 | WNV | NS1 | DQ318020 | WNV | NS1 | EU249803 |
| WNV | NS1 | GU011992 | WNV | NS1 | EU068667 | WNV | NS1 | AM404308 |
| WNV | NS1 | FJ766331 | WNV | NS1 | DQ080071 | WNV | NS1 | AY603654 |
| WNV | NS1 | GQ379156 | WNV | NS1 | DQ431711 | WNV | NS1 | DQ176636 |
| WNV | NS1 | GQ379158 | WNV | NS1 | DQ164202 | WNV | NS1 | NC_001563 |
| WNV | NS1 | AJ965626 | WNV | NS1 | AY274505 | WNV | NS1 | AY701412 |
| WNV | NS1 | FJ766332 | WNV | NS1 | DQ786573 | WNV | NS1 | AF260969 |
| WNV | NS1 | CS543188 | WNV | NS1 | DQ080068 | WNV | NS1 | AF481864 |
| WNV | NS1 | DQ431694 | WNV | NS1 | DQ411031 | WNV | NS1 | AY262283 |
| WNV | NS1 | DQ431700 | WNV | NS1 | DQ411030 | WNV | NS1 | D00246 |
| WNV | NS1 | AY277252 | WNV | NS1 | DQ374651 | WNV | NS1 | AF202541 |
| WNV | NS1 | DQ005530 | WNV | NS1 | AF260968 | WNV | NS1 | AF260967 |
| WNV | NS1 | AF317203 | WNV | NS1 | DQ080052 | WNV | NS1 | AF404753 |

FIG. 70-228

| Virus | Protein | Accession No. | Virus | Protein | Accession No. | Virus | Protein | Accession No. |
|---|---|---|---|---|---|---|---|---|
| WNV | NS1 | AF404754 | WNV | NS1 | DQ431699 | WNV | NS2A | DQ080061 |
| WNV | NS1 | AF404755 | WNV | NS1 | DQ431702 | WNV | NS2A | DQ164199 |
| WNV | NS1 | AF404756 | WNV | NS1 | DQ431705 | WNV | NS2A | FJ425721 |
| WNV | NS1 | AY289214 | WNV | NS1 | DQ431706 | WNV | NS2A | DQ377178 |
| WNV | NS1 | AY490240 | WNV | NS1 | DQ431710 | WNV | NS2A | DQ666452 |
| WNV | NS1 | AB185916 | WNV | NS1 | DQ786572 | WNV | NS2A | DQ080064 |
| WNV | NS1 | AB185917 | WNV | NS1 | DQ666448 | WNV | NS2A | DQ431697 |
| WNV | NS1 | AY701413 | WNV | NS1 | DQ666449 | WNV | NS2A | AY532665 |
| WNV | NS1 | AY712945 | WNV | NS1 | EF571854 | WNV | NS2A | DQ431707 |
| WNV | NS1 | AY712947 | WNV | NS1 | EF429199 | WNV | NS2A | FJ483548 |
| WNV | NS1 | AY646354 | WNV | NS1 | EU081844 | WNV | NS2A | AF404757 |
| WNV | NS1 | AY795965 | WNV | NS1 | FJ159129 | WNV | NS2A | DQ374652 |
| WNV | NS1 | DQ066423 | WNV | NS1 | FJ159131 | WNV | NS2A | DQ431696 |
| WNV | NS1 | DQ080053 | WNV | NS1 | FJ151394 | WNV | NS2A | DQ666450 |
| WNV | NS1 | DQ080054 | WNV | NS1 | FJ411043 | WNV | NS2A | AY712948 |
| WNV | NS1 | DQ080055 | WNV | NS2A | AJ965628 | WNV | NS2A | DQ164193 |
| WNV | NS1 | DQ080057 | WNV | NS2A | GQ379159 | WNV | NS2A | EF657887 |
| WNV | NS1 | DQ080062 | WNV | NS2A | GQ379157 | WNV | NS2A | FJ159130 |
| WNV | NS1 | DQ080063 | WNV | NS2A | GQ379160 | WNV | NS2A | DQ080065 |
| WNV | NS1 | DQ080067 | WNV | NS2A | GQ379161 | WNV | NS2A | DQ118127 |
| WNV | NS1 | DQ080069 | WNV | NS2A | FJ527738 | WNV | NS2A | DQ318020 |
| WNV | NS1 | DQ080072 | WNV | NS2A | GU011992 | WNV | NS2A | EU068667 |
| WNV | NS1 | DQ116961 | WNV | NS2A | FJ766331 | WNV | NS2A | DQ080071 |
| WNV | NS1 | AY842931 | WNV | NS2A | GQ379156 | WNV | NS2A | DQ431711 |
| WNV | NS1 | DQ164186 | WNV | NS2A | GQ379158 | WNV | NS2A | DQ164202 |
| WNV | NS1 | DQ164190 | WNV | NS2A | AJ965626 | WNV | NS2A | AY274505 |
| WNV | NS1 | DQ164191 | WNV | NS2A | FJ766332 | WNV | NS2A | DQ786573 |
| WNV | NS1 | DQ164192 | WNV | NS2A | CS543188 | WNV | NS2A | DQ080068 |
| WNV | NS1 | DQ164195 | WNV | NS2A | DQ431694 | WNV | NS2A | DQ411031 |
| WNV | NS1 | DQ164196 | WNV | NS2A | DQ431700 | WNV | NS2A | DQ411030 |
| WNV | NS1 | DQ164197 | WNV | NS2A | AY277252 | WNV | NS2A | DQ374651 |
| WNV | NS1 | DQ164198 | WNV | NS2A | DQ005530 | WNV | NS2A | AF260968 |
| WNV | NS1 | DQ164200 | WNV | NS2A | AF317203 | WNV | NS2A | DQ080052 |
| WNV | NS1 | DQ164203 | WNV | NS2A | AY268132 | WNV | NS2A | DQ080060 |
| WNV | NS1 | DQ164204 | WNV | NS2A | DQ431708 | WNV | NS2A | AY277251 |
| WNV | NS1 | DQ164205 | WNV | NS2A | AF533540 | WNV | NS2A | DQ080059 |
| WNV | NS1 | DQ164206 | WNV | NS2A | DQ164187 | WNV | NS2A | AY712946 |
| WNV | NS1 | DQ211652 | WNV | NS2A | DQ431703 | WNV | NS2A | AY274504 |
| WNV | NS1 | DQ176637 | WNV | NS2A | DQ374650 | WNV | NS2A | DQ080051 |
| WNV | NS1 | AY848697 | WNV | NS2A | DQ164201 | WNV | NS2A | DQ256376 |
| WNV | NS1 | AY848695 | WNV | NS2A | AY278441 | WNV | NS2A | DQ164194 |
| WNV | NS1 | AY848696 | WNV | NS2A | DQ431712 | WNV | NS2A | DQ431695 |
| WNV | NS1 | DQ318019 | WNV | NS2A | AY660002 | WNV | NS2A | DQ431701 |
| WNV | NS1 | DQ377179 | WNV | NS2A | DQ411035 | WNV | NS2A | EU155484 |
| WNV | NS1 | DQ377180 | WNV | NS2A | DQ374653 | WNV | NS2A | AY278442 |
| WNV | NS1 | DQ411032 | WNV | NS2A | AY688948 | WNV | NS2A | DQ666451 |
| WNV | NS1 | DQ411033 | WNV | NS2A | NC_009942 | WNV | NS2A | DQ431704 |
| WNV | NS1 | DQ431693 | WNV | NS2A | AF206518 | WNV | NS2A | DQ080070 |

FIG. 70-229

| Virus | Protein | Accession No. | Virus | Protein | Accession No. | Virus | Protein | Accession No. |
|---|---|---|---|---|---|---|---|---|
| WNV | NS2A | DQ164189 | WNV | NS2A | DQ080055 | WNV | NS2B | AJ965628 |
| WNV | NS2A | DQ080058 | WNV | NS2A | DQ080057 | WNV | NS2B | GQ379159 |
| WNV | NS2A | FJ483549 | WNV | NS2A | DQ080062 | WNV | NS2B | GQ379157 |
| WNV | NS2A | DQ164188 | WNV | NS2A | DQ080063 | WNV | NS2B | GQ379160 |
| WNV | NS2A | AY765264 | WNV | NS2A | DQ080067 | WNV | NS2B | GQ379161 |
| WNV | NS2A | DQ080066 | WNV | NS2A | DQ080069 | WNV | NS2B | FJ527738 |
| WNV | NS2A | DQ983578 | WNV | NS2A | DQ080072 | WNV | NS2B | GU011992 |
| WNV | NS2A | EF429198 | WNV | NS2A | DQ116961 | WNV | NS2B | FJ766331 |
| WNV | NS2A | DQ431709 | WNV | NS2A | AY842931 | WNV | NS2B | GQ379156 |
| WNV | NS2A | DQ411029 | WNV | NS2A | DQ164186 | WNV | NS2B | GQ379158 |
| WNV | NS2A | DQ411034 | WNV | NS2A | DQ164190 | WNV | NS2B | AJ965626 |
| WNV | NS2A | DQ431698 | WNV | NS2A | DQ164191 | WNV | NS2B | FJ766332 |
| WNV | NS2A | AY268133 | WNV | NS2A | DQ164192 | WNV | NS2B | CS543188 |
| WNV | NS2A | DQ080056 | WNV | NS2A | DQ164195 | WNV | NS2B | DQ431694 |
| WNV | NS2A | EF530047 | WNV | NS2A | DQ164196 | WNV | NS2B | DQ431700 |
| WNV | NS2A | AB185914 | WNV | NS2A | DQ164197 | WNV | NS2B | AY277252 |
| WNV | NS2A | AF196835 | WNV | NS2A | DQ164198 | WNV | NS2B | DQ005530 |
| WNV | NS2A | M12294 | WNV | NS2A | DQ164200 | WNV | NS2B | AF317203 |
| WNV | NS2A | EF429200 | WNV | NS2A | DQ164203 | WNV | NS2B | AY268132 |
| WNV | NS2A | EF429197 | WNV | NS2A | DQ164204 | WNV | NS2B | DQ431708 |
| WNV | NS2A | EU249803 | WNV | NS2A | DQ164205 | WNV | NS2B | AF533540 |
| WNV | NS2A | AM404308 | WNV | NS2A | DQ164206 | WNV | NS2B | DQ164187 |
| WNV | NS2A | AY603654 | WNV | NS2A | DQ211652 | WNV | NS2B | DQ431703 |
| WNV | NS2A | DQ176636 | WNV | NS2A | DQ176637 | WNV | NS2B | DQ374650 |
| WNV | NS2A | NC_001563 | WNV | NS2A | AY848697 | WNV | NS2B | DQ164201 |
| WNV | NS2A | AY701412 | WNV | NS2A | AY848695 | WNV | NS2B | AY278441 |
| WNV | NS2A | AF260969 | WNV | NS2A | AY848696 | WNV | NS2B | DQ431712 |
| WNV | NS2A | AF481864 | WNV | NS2A | DQ318019 | WNV | NS2B | AY660002 |
| WNV | NS2A | AY262283 | WNV | NS2A | DQ377179 | WNV | NS2B | DQ411035 |
| WNV | NS2A | D00246 | WNV | NS2A | DQ377180 | WNV | NS2B | DQ374653 |
| WNV | NS2A | AF202541 | WNV | NS2A | DQ411032 | WNV | NS2B | AY688948 |
| WNV | NS2A | AF260967 | WNV | NS2A | DQ411033 | WNV | NS2B | NC_009942 |
| WNV | NS2A | AF404753 | WNV | NS2A | DQ431693 | WNV | NS2B | AF206518 |
| WNV | NS2A | AF404754 | WNV | NS2A | DQ431699 | WNV | NS2B | DQ080061 |
| WNV | NS2A | AF404755 | WNV | NS2A | DQ431702 | WNV | NS2B | DQ164199 |
| WNV | NS2A | AF404756 | WNV | NS2A | DQ431705 | WNV | NS2B | FJ425721 |
| WNV | NS2A | AY289214 | WNV | NS2A | DQ431706 | WNV | NS2B | DQ377178 |
| WNV | NS2A | AY490240 | WNV | NS2A | DQ431710 | WNV | NS2B | DQ666452 |
| WNV | NS2A | AB185916 | WNV | NS2A | DQ786572 | WNV | NS2B | DQ080064 |
| WNV | NS2A | AB185917 | WNV | NS2A | DQ666448 | WNV | NS2B | DQ431697 |
| WNV | NS2A | AY701413 | WNV | NS2A | DQ666449 | WNV | NS2B | AY532665 |
| WNV | NS2A | AY712945 | WNV | NS2A | EF571854 | WNV | NS2B | DQ431707 |
| WNV | NS2A | AY712947 | WNV | NS2A | EF429199 | WNV | NS2B | FJ483548 |
| WNV | NS2A | AY646354 | WNV | NS2A | EU081844 | WNV | NS2B | AF404757 |
| WNV | NS2A | AY795965 | WNV | NS2A | FJ159129 | WNV | NS2B | DQ374652 |
| WNV | NS2A | DQ066423 | WNV | NS2A | FJ159131 | WNV | NS2B | DQ431696 |
| WNV | NS2A | DQ080053 | WNV | NS2A | FJ151394 | WNV | NS2B | DQ666450 |
| WNV | NS2A | DQ080054 | WNV | NS2A | FJ411043 | WNV | NS2B | AY712948 |

FIG. 70-230

| Virus | Protein | Accession No. | Virus | Protein | Accession No. | Virus | Protein | Accession No. |
|---|---|---|---|---|---|---|---|---|
| WNV | NS2B | DQ164193 | WNV | NS2B | AB185914 | WNV | NS2B | DQ164197 |
| WNV | NS2B | EF657887 | WNV | NS2B | AF196835 | WNV | NS2B | DQ164198 |
| WNV | NS2B | FJ159130 | WNV | NS2B | M12294 | WNV | NS2B | DQ164200 |
| WNV | NS2B | DQ080065 | WNV | NS2B | EF429200 | WNV | NS2B | DQ164203 |
| WNV | NS2B | DQ118127 | WNV | NS2B | EF429197 | WNV | NS2B | DQ164204 |
| WNV | NS2B | DQ318020 | WNV | NS2B | EU249803 | WNV | NS2B | DQ164205 |
| WNV | NS2B | EU068667 | WNV | NS2B | AM404308 | WNV | NS2B | DQ164206 |
| WNV | NS2B | DQ080071 | WNV | NS2B | AY603654 | WNV | NS2B | DQ211652 |
| WNV | NS2B | DQ431711 | WNV | NS2B | DQ176636 | WNV | NS2B | DQ176637 |
| WNV | NS2B | DQ164202 | WNV | NS2B | NC_001563 | WNV | NS2B | AY848697 |
| WNV | NS2B | AY274505 | WNV | NS2B | AY701412 | WNV | NS2B | AY848695 |
| WNV | NS2B | DQ786573 | WNV | NS2B | AF260969 | WNV | NS2B | AY848696 |
| WNV | NS2B | DQ080068 | WNV | NS2B | AF481864 | WNV | NS2B | DQ318019 |
| WNV | NS2B | DQ411031 | WNV | NS2B | AY262283 | WNV | NS2B | DQ377179 |
| WNV | NS2B | DQ411030 | WNV | NS2B | D00246 | WNV | NS2B | DQ377180 |
| WNV | NS2B | DQ374651 | WNV | NS2B | AF202541 | WNV | NS2B | DQ411032 |
| WNV | NS2B | AF260968 | WNV | NS2B | AF260967 | WNV | NS2B | DQ411033 |
| WNV | NS2B | DQ080052 | WNV | NS2B | AF404753 | WNV | NS2B | DQ431693 |
| WNV | NS2B | DQ080060 | WNV | NS2B | AF404754 | WNV | NS2B | DQ431699 |
| WNV | NS2B | AY277251 | WNV | NS2B | AF404755 | WNV | NS2B | DQ431702 |
| WNV | NS2B | DQ080059 | WNV | NS2B | AF404756 | WNV | NS2B | DQ431705 |
| WNV | NS2B | AY712946 | WNV | NS2B | AY289214 | WNV | NS2B | DQ431706 |
| WNV | NS2B | AY274504 | WNV | NS2B | AY490240 | WNV | NS2B | DQ431710 |
| WNV | NS2B | DQ080051 | WNV | NS2B | AB185916 | WNV | NS2B | DQ786572 |
| WNV | NS2B | DQ256376 | WNV | NS2B | AB185917 | WNV | NS2B | DQ666448 |
| WNV | NS2B | DQ164194 | WNV | NS2B | AY701413 | WNV | NS2B | DQ666449 |
| WNV | NS2B | DQ431695 | WNV | NS2B | AY712945 | WNV | NS2B | EF571854 |
| WNV | NS2B | DQ431701 | WNV | NS2B | AY712947 | WNV | NS2B | EF429199 |
| WNV | NS2B | EU155484 | WNV | NS2B | AY646354 | WNV | NS2B | EU081844 |
| WNV | NS2B | AY278442 | WNV | NS2B | AY795965 | WNV | NS2B | FJ159129 |
| WNV | NS2B | DQ666451 | WNV | NS2B | DQ066423 | WNV | NS2B | FJ159131 |
| WNV | NS2B | DQ431704 | WNV | NS2B | DQ080053 | WNV | NS2B | FJ151394 |
| WNV | NS2B | DQ080070 | WNV | NS2B | DQ080054 | WNV | NS2B | FJ411043 |
| WNV | NS2B | DQ164189 | WNV | NS2B | DQ080055 | WNV | NS3 | AJ965628 |
| WNV | NS2B | DQ080058 | WNV | NS2B | DQ080057 | WNV | NS3 | GQ379159 |
| WNV | NS2B | FJ483549 | WNV | NS2B | DQ080062 | WNV | NS3 | GQ379157 |
| WNV | NS2B | DQ164188 | WNV | NS2B | DQ080063 | WNV | NS3 | GQ379160 |
| WNV | NS2B | AY765264 | WNV | NS2B | DQ080067 | WNV | NS3 | GQ379161 |
| WNV | NS2B | DQ080066 | WNV | NS2B | DQ080069 | WNV | NS3 | FJ527738 |
| WNV | NS2B | DQ983578 | WNV | NS2B | DQ080072 | WNV | NS3 | GU011992 |
| WNV | NS2B | EF429198 | WNV | NS2B | DQ116961 | WNV | NS3 | FJ766331 |
| WNV | NS2B | DQ431709 | WNV | NS2B | AY842931 | WNV | NS3 | GQ379156 |
| WNV | NS2B | DQ411029 | WNV | NS2B | DQ164186 | WNV | NS3 | GQ379158 |
| WNV | NS2B | DQ411034 | WNV | NS2B | DQ164190 | WNV | NS3 | AJ965626 |
| WNV | NS2B | DQ431698 | WNV | NS2B | DQ164191 | WNV | NS3 | FJ766332 |
| WNV | NS2B | AY268133 | WNV | NS2B | DQ164192 | WNV | NS3 | CS543188 |
| WNV | NS2B | DQ080056 | WNV | NS2B | DQ164195 | WNV | NS3 | DQ431694 |
| WNV | NS2B | EF530047 | WNV | NS2B | DQ164196 | WNV | NS3 | DQ431700 |

FIG. 70-231

| Virus | Protein Accession No. | Virus | Protein Accession No. | Virus | Protein Accession No. |
|---|---|---|---|---|---|
| WNV | NS3AY277252 | WNV | NS3DQ374651 | WNV | NS3AF202541 |
| WNV | NS3DQ005530 | WNV | NS3AF260968 | WNV | NS3AF260967 |
| WNV | NS3AF317203 | WNV | NS3DQ080052 | WNV | NS3AF404753 |
| WNV | NS3AY268132 | WNV | NS3DQ080060 | WNV | NS3AF404754 |
| WNV | NS3DQ431708 | WNV | NS3AY277251 | WNV | NS3AF404755 |
| WNV | NS3AF533540 | WNV | NS3DQ080059 | WNV | NS3AF404756 |
| WNV | NS3DQ164187 | WNV | NS3AY712946 | WNV | NS3AY289214 |
| WNV | NS3DQ431703 | WNV | NS3AY274504 | WNV | NS3AY490240 |
| WNV | NS3DQ374650 | WNV | NS3DQ080051 | WNV | NS3AB185916 |
| WNV | NS3DQ164201 | WNV | NS3DQ256376 | WNV | NS3AB185917 |
| WNV | NS3AY278441 | WNV | NS3DQ164194 | WNV | NS3AY701413 |
| WNV | NS3DQ431712 | WNV | NS3DQ431695 | WNV | NS3AY712945 |
| WNV | NS3AY660002 | WNV | NS3DQ431701 | WNV | NS3AY712947 |
| WNV | NS3DQ411035 | WNV | NS3EU155484 | WNV | NS3AY646354 |
| WNV | NS3DQ374653 | WNV | NS3AY278442 | WNV | NS3AY795965 |
| WNV | NS3AY688948 | WNV | NS3DQ666451 | WNV | NS3DQ066423 |
| WNV | NS3NC_009942 | WNV | NS3DQ431704 | WNV | NS3DQ080053 |
| WNV | NS3AF206518 | WNV | NS3DQ080070 | WNV | NS3DQ080054 |
| WNV | NS3DQ080061 | WNV | NS3DQ164189 | WNV | NS3DQ080055 |
| WNV | NS3DQ164199 | WNV | NS3DQ080058 | WNV | NS3DQ080057 |
| WNV | NS3FJ425721 | WNV | NS3FJ483549 | WNV | NS3DQ080062 |
| WNV | NS3DQ377178 | WNV | NS3DQ164188 | WNV | NS3DQ080063 |
| WNV | NS3DQ666452 | WNV | NS3AY765264 | WNV | NS3DQ080067 |
| WNV | NS3DQ080064 | WNV | NS3DQ080066 | WNV | NS3DQ080069 |
| WNV | NS3DQ431697 | WNV | NS3DQ983578 | WNV | NS3DQ080072 |
| WNV | NS3AY532665 | WNV | NS3EF429198 | WNV | NS3DQ116961 |
| WNV | NS3DQ431707 | WNV | NS3DQ431709 | WNV | NS3AY842931 |
| WNV | NS3FJ483548 | WNV | NS3DQ411029 | WNV | NS3DQ164186 |
| WNV | NS3AF404757 | WNV | NS3DQ411034 | WNV | NS3DQ164190 |
| WNV | NS3DQ374652 | WNV | NS3DQ431698 | WNV | NS3DQ164191 |
| WNV | NS3DQ431696 | WNV | NS3AY268133 | WNV | NS3DQ164192 |
| WNV | NS3DQ666450 | WNV | NS3DQ080056 | WNV | NS3DQ164195 |
| WNV | NS3AY712948 | WNV | NS3EF530047 | WNV | NS3DQ164196 |
| WNV | NS3DQ164193 | WNV | NS3AB185914 | WNV | NS3DQ164197 |
| WNV | NS3EF657887 | WNV | NS3AF196835 | WNV | NS3DQ164198 |
| WNV | NS3FJ159130 | WNV | NS3M12294 | WNV | NS3DQ164200 |
| WNV | NS3DQ080065 | WNV | NS3EF429200 | WNV | NS3DQ164203 |
| WNV | NS3DQ118127 | WNV | NS3EF429197 | WNV | NS3DQ164204 |
| WNV | NS3DQ318020 | WNV | NS3EU249803 | WNV | NS3DQ164205 |
| WNV | NS3EU068667 | WNV | NS3AM404308 | WNV | NS3DQ164206 |
| WNV | NS3DQ080071 | WNV | NS3AY603654 | WNV | NS3DQ211652 |
| WNV | NS3DQ431711 | WNV | NS3DQ176636 | WNV | NS3DQ176637 |
| WNV | NS3DQ164202 | WNV | NS3NC_001563 | WNV | NS3AY848697 |
| WNV | NS3AY274505 | WNV | NS3AY701412 | WNV | NS3AY848695 |
| WNV | NS3DQ786573 | WNV | NS3AF260969 | WNV | NS3AY848696 |
| WNV | NS3DQ080068 | WNV | NS3AF481864 | WNV | NS3DQ318019 |
| WNV | NS3DQ411031 | WNV | NS3AY262283 | WNV | NS3DQ377179 |
| WNV | NS3DQ411030 | WNV | NS3D00246 | WNV | NS3DQ377180 |

FIG. 70-232

| Virus | Protein | Accession No. | Virus | Protein | Accession No. | Virus | Protein | Accession No. |
|---|---|---|---|---|---|---|---|---|
| WNV | NS3 | DQ411032 | WNV | NS4A | AY688948 | WNV | NS4A | DQ666451 |
| WNV | NS3 | DQ411033 | WNV | NS4A | NC_009942 | WNV | NS4A | DQ431704 |
| WNV | NS3 | DQ431693 | WNV | NS4A | AF206518 | WNV | NS4A | DQ080070 |
| WNV | NS3 | DQ431699 | WNV | NS4A | DQ080061 | WNV | NS4A | DQ164189 |
| WNV | NS3 | DQ431702 | WNV | NS4A | DQ164199 | WNV | NS4A | DQ080058 |
| WNV | NS3 | DQ431705 | WNV | NS4A | FJ425721 | WNV | NS4A | FJ483549 |
| WNV | NS3 | DQ431706 | WNV | NS4A | DQ377178 | WNV | NS4A | DQ164188 |
| WNV | NS3 | DQ431710 | WNV | NS4A | DQ666452 | WNV | NS4A | AY765264 |
| WNV | NS3 | DQ786572 | WNV | NS4A | DQ080064 | WNV | NS4A | DQ080066 |
| WNV | NS3 | DQ666448 | WNV | NS4A | DQ431697 | WNV | NS4A | DQ983578 |
| WNV | NS3 | DQ666449 | WNV | NS4A | AY532665 | WNV | NS4A | EF429198 |
| WNV | NS3 | EF571854 | WNV | NS4A | DQ431707 | WNV | NS4A | DQ431709 |
| WNV | NS3 | EF429199 | WNV | NS4A | FJ483548 | WNV | NS4A | DQ411029 |
| WNV | NS3 | EU081844 | WNV | NS4A | AF404757 | WNV | NS4A | DQ411034 |
| WNV | NS3 | FJ159129 | WNV | NS4A | DQ374652 | WNV | NS4A | DQ431698 |
| WNV | NS3 | FJ159131 | WNV | NS4A | DQ431696 | WNV | NS4A | AY268133 |
| WNV | NS3 | FJ151394 | WNV | NS4A | DQ666450 | WNV | NS4A | DQ080056 |
| WNV | NS3 | FJ411043 | WNV | NS4A | AY712948 | WNV | NS4A | EF530047 |
| WNV | NS4A | AJ965628 | WNV | NS4A | DQ164193 | WNV | NS4A | AB185914 |
| WNV | NS4A | GQ379159 | WNV | NS4A | EF657887 | WNV | NS4A | AF196835 |
| WNV | NS4A | GQ379157 | WNV | NS4A | FJ159130 | WNV | NS4A | M12294 |
| WNV | NS4A | GQ379160 | WNV | NS4A | DQ080065 | WNV | NS4A | EF429200 |
| WNV | NS4A | GQ379161 | WNV | NS4A | DQ118127 | WNV | NS4A | EF429197 |
| WNV | NS4A | FJ527738 | WNV | NS4A | DQ318020 | WNV | NS4A | EU249803 |
| WNV | NS4A | GU011992 | WNV | NS4A | EU068667 | WNV | NS4A | AM404308 |
| WNV | NS4A | FJ766331 | WNV | NS4A | DQ080071 | WNV | NS4A | AY603654 |
| WNV | NS4A | GQ379156 | WNV | NS4A | DQ431711 | WNV | NS4A | DQ176636 |
| WNV | NS4A | GQ379158 | WNV | NS4A | DQ164202 | WNV | NS4A | NC_001563 |
| WNV | NS4A | AJ965626 | WNV | NS4A | AY274505 | WNV | NS4A | AY701412 |
| WNV | NS4A | FJ766332 | WNV | NS4A | DQ786573 | WNV | NS4A | AF260969 |
| WNV | NS4A | CS543188 | WNV | NS4A | DQ080068 | WNV | NS4A | AF481864 |
| WNV | NS4A | DQ431694 | WNV | NS4A | DQ411031 | WNV | NS4A | AY262283 |
| WNV | NS4A | DQ431700 | WNV | NS4A | DQ411030 | WNV | NS4A | D00246 |
| WNV | NS4A | AY277252 | WNV | NS4A | DQ374651 | WNV | NS4A | AF202541 |
| WNV | NS4A | DQ005530 | WNV | NS4A | AF260968 | WNV | NS4A | AF260967 |
| WNV | NS4A | AF317203 | WNV | NS4A | DQ080052 | WNV | NS4A | AF404753 |
| WNV | NS4A | AY268132 | WNV | NS4A | DQ080060 | WNV | NS4A | AF404754 |
| WNV | NS4A | DQ431708 | WNV | NS4A | AY277251 | WNV | NS4A | AF404755 |
| WNV | NS4A | AF533540 | WNV | NS4A | DQ080059 | WNV | NS4A | AF404756 |
| WNV | NS4A | DQ164187 | WNV | NS4A | AY712946 | WNV | NS4A | AY289214 |
| WNV | NS4A | DQ431703 | WNV | NS4A | AY274504 | WNV | NS4A | AY490240 |
| WNV | NS4A | DQ374650 | WNV | NS4A | DQ080051 | WNV | NS4A | AB185916 |
| WNV | NS4A | DQ164201 | WNV | NS4A | DQ256376 | WNV | NS4A | AB185917 |
| WNV | NS4A | AY278441 | WNV | NS4A | DQ164194 | WNV | NS4A | AY701413 |
| WNV | NS4A | DQ431712 | WNV | NS4A | DQ431695 | WNV | NS4A | AY712945 |
| WNV | NS4A | AY660002 | WNV | NS4A | DQ431701 | WNV | NS4A | AY712947 |
| WNV | NS4A | DQ411035 | WNV | NS4A | EU155484 | WNV | NS4A | AY646354 |
| WNV | NS4A | DQ374653 | WNV | NS4A | AY278442 | WNV | NS4A | AY795965 |

FIG. 70-233

| Virus | Protein | Accession No. | Virus | Protein | Accession No. | Virus | Protein | Accession No. |
|---|---|---|---|---|---|---|---|---|
| WNV | NS4A | DQ066423 | WNV | NS4A | FJ159131 | WNV | NS4B | DQ431696 |
| WNV | NS4A | DQ080053 | WNV | NS4A | FJ151394 | WNV | NS4B | DQ666450 |
| WNV | NS4A | DQ080054 | WNV | NS4A | FJ411043 | WNV | NS4B | AY712948 |
| WNV | NS4A | DQ080055 | WNV | NS4B | AJ965628 | WNV | NS4B | DQ164193 |
| WNV | NS4A | DQ080057 | WNV | NS4B | GQ379159 | WNV | NS4B | EF657887 |
| WNV | NS4A | DQ080062 | WNV | NS4B | GQ379157 | WNV | NS4B | FJ159130 |
| WNV | NS4A | DQ080063 | WNV | NS4B | GQ379160 | WNV | NS4B | DQ080065 |
| WNV | NS4A | DQ080067 | WNV | NS4B | GQ379161 | WNV | NS4B | DQ118127 |
| WNV | NS4A | DQ080069 | WNV | NS4B | FJ527738 | WNV | NS4B | DQ318020 |
| WNV | NS4A | DQ080072 | WNV | NS4B | GU011992 | WNV | NS4B | EU068667 |
| WNV | NS4A | DQ116961 | WNV | NS4B | FJ766331 | WNV | NS4B | DQ080071 |
| WNV | NS4A | AY842931 | WNV | NS4B | GQ379156 | WNV | NS4B | DQ431711 |
| WNV | NS4A | DQ164186 | WNV | NS4B | GQ379158 | WNV | NS4B | DQ164202 |
| WNV | NS4A | DQ164190 | WNV | NS4B | AJ965626 | WNV | NS4B | AY274505 |
| WNV | NS4A | DQ164191 | WNV | NS4B | FJ766332 | WNV | NS4B | DQ786573 |
| WNV | NS4A | DQ164192 | WNV | NS4B | CS543188 | WNV | NS4B | DQ080068 |
| WNV | NS4A | DQ164195 | WNV | NS4B | DQ431694 | WNV | NS4B | DQ411031 |
| WNV | NS4A | DQ164196 | WNV | NS4B | DQ431700 | WNV | NS4B | DQ411030 |
| WNV | NS4A | DQ164197 | WNV | NS4B | AY277252 | WNV | NS4B | DQ374651 |
| WNV | NS4A | DQ164198 | WNV | NS4B | DQ005530 | WNV | NS4B | AF260968 |
| WNV | NS4A | DQ164200 | WNV | NS4B | AF317203 | WNV | NS4B | DQ080052 |
| WNV | NS4A | DQ164203 | WNV | NS4B | AY268132 | WNV | NS4B | DQ080060 |
| WNV | NS4A | DQ164204 | WNV | NS4B | DQ431708 | WNV | NS4B | AY277251 |
| WNV | NS4A | DQ164205 | WNV | NS4B | AF533540 | WNV | NS4B | DQ080059 |
| WNV | NS4A | DQ164206 | WNV | NS4B | DQ164187 | WNV | NS4B | AY712946 |
| WNV | NS4A | DQ211652 | WNV | NS4B | DQ431703 | WNV | NS4B | AY274504 |
| WNV | NS4A | DQ176637 | WNV | NS4B | DQ374650 | WNV | NS4B | DQ080051 |
| WNV | NS4A | AY848697 | WNV | NS4B | DQ164201 | WNV | NS4B | DQ256376 |
| WNV | NS4A | AY848695 | WNV | NS4B | AY278441 | WNV | NS4B | DQ164194 |
| WNV | NS4A | AY848696 | WNV | NS4B | DQ431712 | WNV | NS4B | DQ431695 |
| WNV | NS4A | DQ318019 | WNV | NS4B | AY660002 | WNV | NS4B | DQ431701 |
| WNV | NS4A | DQ377179 | WNV | NS4B | DQ411035 | WNV | NS4B | EU155484 |
| WNV | NS4A | DQ377180 | WNV | NS4B | DQ374653 | WNV | NS4B | AY278442 |
| WNV | NS4A | DQ411032 | WNV | NS4B | AY688948 | WNV | NS4B | DQ666451 |
| WNV | NS4A | DQ411033 | WNV | NS4B | NC_009942 | WNV | NS4B | DQ431704 |
| WNV | NS4A | DQ431693 | WNV | NS4B | AF206518 | WNV | NS4B | DQ080070 |
| WNV | NS4A | DQ431699 | WNV | NS4B | DQ080061 | WNV | NS4B | DQ164189 |
| WNV | NS4A | DQ431702 | WNV | NS4B | DQ164199 | WNV | NS4B | DQ080058 |
| WNV | NS4A | DQ431705 | WNV | NS4B | FJ425721 | WNV | NS4B | FJ483549 |
| WNV | NS4A | DQ431706 | WNV | NS4B | DQ377178 | WNV | NS4B | DQ164188 |
| WNV | NS4A | DQ431710 | WNV | NS4B | DQ666452 | WNV | NS4B | AY765264 |
| WNV | NS4A | DQ786572 | WNV | NS4B | DQ080064 | WNV | NS4B | DQ080066 |
| WNV | NS4A | DQ666448 | WNV | NS4B | DQ431697 | WNV | NS4B | DQ983578 |
| WNV | NS4A | DQ666449 | WNV | NS4B | AY532665 | WNV | NS4B | EF429198 |
| WNV | NS4A | EF571854 | WNV | NS4B | DQ431707 | WNV | NS4B | DQ431709 |
| WNV | NS4A | EF429199 | WNV | NS4B | FJ483548 | WNV | NS4B | DQ411029 |
| WNV | NS4A | EU081844 | WNV | NS4B | AF404757 | WNV | NS4B | DQ411034 |
| WNV | NS4A | FJ159129 | WNV | NS4B | DQ374652 | WNV | NS4B | DQ431698 |

FIG. 70-234

| Virus | Protein | Accession No. | Virus | Protein | Accession No. | Virus | Protein | Accession No. |
|---|---|---|---|---|---|---|---|---|
| WNV | NS4B | AY268133 | WNV | NS4B | DQ164192 | WNV | NS5 | CS543188 |
| WNV | NS4B | DQ080056 | WNV | NS4B | DQ164195 | WNV | NS5 | DQ431694 |
| WNV | NS4B | EF530047 | WNV | NS4B | DQ164196 | WNV | NS5 | DQ431700 |
| WNV | NS4B | AB185914 | WNV | NS4B | DQ164197 | WNV | NS5 | AY277252 |
| WNV | NS4B | AF196835 | WNV | NS4B | DQ164198 | WNV | NS5 | DQ005530 |
| WNV | NS4B | M12294 | WNV | NS4B | DQ164200 | WNV | NS5 | AF317203 |
| WNV | NS4B | EF429200 | WNV | NS4B | DQ164203 | WNV | NS5 | AY268132 |
| WNV | NS4B | EF429197 | WNV | NS4B | DQ164204 | WNV | NS5 | DQ431708 |
| WNV | NS4B | EU249803 | WNV | NS4B | DQ164205 | WNV | NS5 | AF533540 |
| WNV | NS4B | AM404308 | WNV | NS4B | DQ164206 | WNV | NS5 | DQ164187 |
| WNV | NS4B | AY603654 | WNV | NS4B | DQ211652 | WNV | NS5 | DQ431703 |
| WNV | NS4B | DQ176636 | WNV | NS4B | DQ176637 | WNV | NS5 | DQ374650 |
| WNV | NS4B | NC_001563 | WNV | NS4B | AY848697 | WNV | NS5 | DQ164201 |
| WNV | NS4B | AY701412 | WNV | NS4B | AY848695 | WNV | NS5 | AY278441 |
| WNV | NS4B | AF260969 | WNV | NS4B | AY848696 | WNV | NS5 | DQ431712 |
| WNV | NS4B | AF481864 | WNV | NS4B | DQ318019 | WNV | NS5 | AY660002 |
| WNV | NS4B | AY262283 | WNV | NS4B | DQ377179 | WNV | NS5 | DQ411035 |
| WNV | NS4B | D00246 | WNV | NS4B | DQ377180 | WNV | NS5 | DQ374653 |
| WNV | NS4B | AF202541 | WNV | NS4B | DQ411032 | WNV | NS5 | AY688948 |
| WNV | NS4B | AF260967 | WNV | NS4B | DQ411033 | WNV | NS5 | NC_009942 |
| WNV | NS4B | AF404753 | WNV | NS4B | DQ431693 | WNV | NS5 | AF206518 |
| WNV | NS4B | AF404754 | WNV | NS4B | DQ431699 | WNV | NS5 | DQ080061 |
| WNV | NS4B | AF404755 | WNV | NS4B | DQ431702 | WNV | NS5 | DQ164199 |
| WNV | NS4B | AF404756 | WNV | NS4B | DQ431705 | WNV | NS5 | FJ425721 |
| WNV | NS4B | AY289214 | WNV | NS4B | DQ431706 | WNV | NS5 | DQ377178 |
| WNV | NS4B | AY490240 | WNV | NS4B | DQ431710 | WNV | NS5 | DQ666452 |
| WNV | NS4B | AB185916 | WNV | NS4B | DQ786572 | WNV | NS5 | DQ080064 |
| WNV | NS4B | AB185917 | WNV | NS4B | DQ666448 | WNV | NS5 | DQ431697 |
| WNV | NS4B | AY701413 | WNV | NS4B | DQ666449 | WNV | NS5 | AY532665 |
| WNV | NS4B | AY712945 | WNV | NS4B | EF571854 | WNV | NS5 | DQ431707 |
| WNV | NS4B | AY712947 | WNV | NS4B | EF429199 | WNV | NS5 | FJ483548 |
| WNV | NS4B | AY646354 | WNV | NS4B | EU081844 | WNV | NS5 | AF404757 |
| WNV | NS4B | AY795965 | WNV | NS4B | FJ159129 | WNV | NS5 | DQ374652 |
| WNV | NS4B | DQ066423 | WNV | NS4B | FJ159131 | WNV | NS5 | DQ431696 |
| WNV | NS4B | DQ080053 | WNV | NS4B | FJ151394 | WNV | NS5 | DQ666450 |
| WNV | NS4B | DQ080054 | WNV | NS4B | FJ411043 | WNV | NS5 | AY712948 |
| WNV | NS4B | DQ080055 | WNV | NS5 | AJ965628 | WNV | NS5 | DQ164193 |
| WNV | NS4B | DQ080057 | WNV | NS5 | GQ379159 | WNV | NS5 | EF657887 |
| WNV | NS4B | DQ080062 | WNV | NS5 | GQ379157 | WNV | NS5 | FJ159130 |
| WNV | NS4B | DQ080063 | WNV | NS5 | GQ379160 | WNV | NS5 | DQ080065 |
| WNV | NS4B | DQ080067 | WNV | NS5 | GQ379161 | WNV | NS5 | DQ118127 |
| WNV | NS4B | DQ080069 | WNV | NS5 | FJ527738 | WNV | NS5 | DQ318020 |
| WNV | NS4B | DQ080072 | WNV | NS5 | GU011992 | WNV | NS5 | EU068667 |
| WNV | NS4B | DQ116961 | WNV | NS5 | FJ766331 | WNV | NS5 | DQ080071 |
| WNV | NS4B | AY842931 | WNV | NS5 | GQ379156 | WNV | NS5 | DQ431711 |
| WNV | NS4B | DQ164186 | WNV | NS5 | GQ379158 | WNV | NS5 | DQ164202 |
| WNV | NS4B | DQ164190 | WNV | NS5 | AJ965626 | WNV | NS5 | AY274505 |
| WNV | NS4B | DQ164191 | WNV | NS5 | FJ766332 | WNV | NS5 | DQ786573 |

FIG. 70-235

| Virus | Protein Accession No. | Virus | Protein Accession No. | Virus | Protein Accession No. |
|---|---|---|---|---|---|
| WNV | NS5DQ080068 | WNV | NS5AF481864 | WNV | NS5DQ318019 |
| WNV | NS5DQ411031 | WNV | NS5AY262283 | WNV | NS5DQ377179 |
| WNV | NS5DQ411030 | WNV | NS5D00246 | WNV | NS5DQ377180 |
| WNV | NS5DQ374651 | WNV | NS5AF202541 | WNV | NS5DQ411032 |
| WNV | NS5AF260968 | WNV | NS5AF260967 | WNV | NS5DQ411033 |
| WNV | NS5DQ080052 | WNV | NS5AF404753 | WNV | NS5DQ431693 |
| WNV | NS5DQ080060 | WNV | NS5AF404754 | WNV | NS5DQ431699 |
| WNV | NS5AY277251 | WNV | NS5AF404755 | WNV | NS5DQ431702 |
| WNV | NS5DQ080059 | WNV | NS5AF404756 | WNV | NS5DQ431705 |
| WNV | NS5AY712946 | WNV | NS5AY289214 | WNV | NS5DQ431706 |
| WNV | NS5AY274504 | WNV | NS5AY490240 | WNV | NS5DQ431710 |
| WNV | NS5DQ080051 | WNV | NS5AB185916 | WNV | NS5DQ786572 |
| WNV | NS5DQ256376 | WNV | NS5AB185917 | WNV | NS5DQ666448 |
| WNV | NS5DQ164194 | WNV | NS5AY701413 | WNV | NS5DQ666449 |
| WNV | NS5DQ431695 | WNV | NS5AY712945 | WNV | NS5EF571854 |
| WNV | NS5DQ431701 | WNV | NS5AY712947 | WNV | NS5EF429199 |
| WNV | NS5EU155484 | WNV | NS5AY646354 | WNV | NS5EU081844 |
| WNV | NS5AY278442 | WNV | NS5AY795965 | WNV | NS5FJ159129 |
| WNV | NS5DQ666451 | WNV | NS5DQ066423 | WNV | NS5FJ159131 |
| WNV | NS5DQ431704 | WNV | NS5DQ080053 | WNV | NS5FJ151394 |
| WNV | NS5DQ080070 | WNV | NS5DQ080054 | WNV | NS5FJ411043 |
| WNV | NS5DQ164189 | WNV | NS5DQ080055 | WNV | prMAJ965628 |
| WNV | NS5DQ080058 | WNV | NS5DQ080057 | WNV | prMGQ379159 |
| WNV | NS5FJ483549 | WNV | NS5DQ080062 | WNV | prMGQ379157 |
| WNV | NS5DQ164188 | WNV | NS5DQ080063 | WNV | prMGQ379160 |
| WNV | NS5AY765264 | WNV | NS5DQ080067 | WNV | prMGQ379161 |
| WNV | NS5DQ080066 | WNV | NS5DQ080069 | WNV | prMFJ527738 |
| WNV | NS5DQ983578 | WNV | NS5DQ080072 | WNV | prMGU011992 |
| WNV | NS5EF429198 | WNV | NS5DQ116961 | WNV | prMFJ766331 |
| WNV | NS5DQ431709 | WNV | NS5AY842931 | WNV | prMGQ379156 |
| WNV | NS5DQ411029 | WNV | NS5DQ164186 | WNV | prMGQ379158 |
| WNV | NS5DQ411034 | WNV | NS5DQ164190 | WNV | prMAJ965626 |
| WNV | NS5DQ431698 | WNV | NS5DQ164191 | WNV | prMFJ766332 |
| WNV | NS5AY268133 | WNV | NS5DQ164192 | WNV | prMCS543188 |
| WNV | NS5DQ080056 | WNV | NS5DQ164195 | WNV | prMDQ431694 |
| WNV | NS5EF530047 | WNV | NS5DQ164196 | WNV | prMDQ431700 |
| WNV | NS5AB185914 | WNV | NS5DQ164197 | WNV | prMAY277252 |
| WNV | NS5AF196835 | WNV | NS5DQ164198 | WNV | prMDQ005530 |
| WNV | NS5M12294 | WNV | NS5DQ164200 | WNV | prMAF317203 |
| WNV | NS5EF429200 | WNV | NS5DQ164203 | WNV | prMAY268132 |
| WNV | NS5EF429197 | WNV | NS5DQ164204 | WNV | prMDQ431708 |
| WNV | NS5EU249803 | WNV | NS5DQ164205 | WNV | prMAF533540 |
| WNV | NS5AM404308 | WNV | NS5DQ164206 | WNV | prMDQ164187 |
| WNV | NS5AY603654 | WNV | NS5DQ211652 | WNV | prMDQ431703 |
| WNV | NS5DQ176636 | WNV | NS5DQ176637 | WNV | prMDQ374650 |
| WNV | NS5NC_001563 | WNV | NS5AY848697 | WNV | prMDQ164201 |
| WNV | NS5AY701412 | WNV | NS5AY848695 | WNV | prMAY278441 |
| WNV | NS5AF260969 | WNV | NS5AY848696 | WNV | prMDQ431712 |

FIG. 70-236

| Virus | Protein Accession No. | Virus | Protein Accession No. | Virus | Protein Accession No. |
|---|---|---|---|---|---|
| WNV | prMAY660002 | WNV | prMDQ431701 | WNV | prMAY712947 |
| WNV | prMDQ411035 | WNV | prMEU155484 | WNV | prMAY646354 |
| WNV | prMDQ374653 | WNV | prMAY278442 | WNV | prMAY795965 |
| WNV | prMAY688948 | WNV | prMDQ666451 | WNV | prMDQ066423 |
| WNV | prMNC_009942 | WNV | prMDQ431704 | WNV | prMDQ080053 |
| WNV | prMAF206518 | WNV | prMDQ080070 | WNV | prMDQ080054 |
| WNV | prMDQ080061 | WNV | prMDQ164189 | WNV | prMDQ080055 |
| WNV | prMDQ164199 | WNV | prMDQ080058 | WNV | prMDQ080057 |
| WNV | prMFJ425721 | WNV | prMFJ483549 | WNV | prMDQ080062 |
| WNV | prMDQ377178 | WNV | prMDQ164188 | WNV | prMDQ080063 |
| WNV | prMDQ666452 | WNV | prMAY765264 | WNV | prMDQ080067 |
| WNV | prMDQ080064 | WNV | prMDQ080066 | WNV | prMDQ080069 |
| WNV | prMDQ431697 | WNV | prMDQ983578 | WNV | prMDQ080072 |
| WNV | prMAY532665 | WNV | prMEF429198 | WNV | prMDQ116961 |
| WNV | prMDQ431707 | WNV | prMDQ431709 | WNV | prMAY842931 |
| WNV | prMFJ483548 | WNV | prMDQ411029 | WNV | prMDQ164186 |
| WNV | prMAF404757 | WNV | prMDQ411034 | WNV | prMDQ164190 |
| WNV | prMDQ374652 | WNV | prMDQ431698 | WNV | prMDQ164191 |
| WNV | prMDQ431696 | WNV | prMAY268133 | WNV | prMDQ164192 |
| WNV | prMDQ666450 | WNV | prMDQ080056 | WNV | prMDQ164195 |
| WNV | prMAY712948 | WNV | prMEF530047 | WNV | prMDQ164196 |
| WNV | prMDQ164193 | WNV | prMAB185914 | WNV | prMDQ164197 |
| WNV | prMEF657887 | WNV | prMAF196835 | WNV | prMDQ164198 |
| WNV | prMFJ159130 | WNV | prMM12294 | WNV | prMDQ164200 |
| WNV | prMDQ080065 | WNV | prMEF429200 | WNV | prMDQ164203 |
| WNV | prMDQ118127 | WNV | prMEF429197 | WNV | prMDQ164204 |
| WNV | prMDQ318020 | WNV | prMEU249803 | WNV | prMDQ164205 |
| WNV | prMEU068667 | WNV | prMAM404308 | WNV | prMDQ164206 |
| WNV | prMDQ080071 | WNV | prMAY603654 | WNV | prMDQ211652 |
| WNV | prMDQ431711 | WNV | prMDQ176636 | WNV | prMDQ176637 |
| WNV | prMDQ164202 | WNV | prMNC_001563 | WNV | prMAY848697 |
| WNV | prMAY274505 | WNV | prMAY701412 | WNV | prMAY848695 |
| WNV | prMDQ786573 | WNV | prMAF260969 | WNV | prMAY848696 |
| WNV | prMDQ080068 | WNV | prMAF481864 | WNV | prMDQ318019 |
| WNV | prMDQ411031 | WNV | prMAY262283 | WNV | prMDQ377179 |
| WNV | prMDQ411030 | WNV | prMD00246 | WNV | prMDQ377180 |
| WNV | prMDQ374651 | WNV | prMAF202541 | WNV | prMDQ411032 |
| WNV | prMAF260968 | WNV | prMAF260967 | WNV | prMDQ411033 |
| WNV | prMDQ080052 | WNV | prMAF404753 | WNV | prMDQ431693 |
| WNV | prMDQ080060 | WNV | prMAF404754 | WNV | prMDQ431699 |
| WNV | prMAY277251 | WNV | prMAF404755 | WNV | prMDQ431702 |
| WNV | prMDQ080059 | WNV | prMAF404756 | WNV | prMDQ431705 |
| WNV | prMAY712946 | WNV | prMAY289214 | WNV | prMDQ431706 |
| WNV | prMAY274504 | WNV | prMAY490240 | WNV | prMDQ431710 |
| WNV | prMDQ080051 | WNV | prMAB185916 | WNV | prMDQ786572 |
| WNV | prMDQ256376 | WNV | prMAB185917 | WNV | prMDQ666448 |
| WNV | prMDQ164194 | WNV | prMAY701413 | WNV | prMDQ666449 |
| WNV | prMDQ431695 | WNV | prMAY712945 | WNV | prMEF571854 |

FIG. 70-237

| Virus | Protein | Accession No. | Virus | Protein | Accession No. | Virus | Protein | Accession No. |
|---|---|---|---|---|---|---|---|---|
| WNV | prM | EF429199 | YFV | anC | AF052445 | YFV | NS1 | DQ100292 |
| WNV | prM | EU081844 | YFV | anC | AF052446 | YFV | NS1 | AY968064 |
| WNV | prM | FJ159129 | YFV | anC | AF052444 | YFV | NS1 | X15062 |
| WNV | prM | FJ159131 | YFV | anC | U17066 | YFV | NS1 | U17067 |
| WNV | prM | FJ151394 | YFV | anC | AF052439 | YFV | NS1 | AF052445 |
| WNV | prM | FJ411043 | YFV | anC | AF052437 | YFV | NS1 | AF052446 |
| YFV | 2K | GQ379162 | YFV | anC | AF052438 | YFV | NS1 | AF052444 |
| YFV | 2K | FJ654700 | YFV | anC | DQ118157 | YFV | NS1 | U17066 |
| YFV | 2K | AY572535 | YFV | anC | X03700 | YFV | NS1 | AF052439 |
| YFV | 2K | AY968065 | YFV | anC | GQ379163 | YFV | NS1 | AF052437 |
| YFV | 2K | U54798 | YFV | E | GQ379162 | YFV | NS1 | AF052438 |
| YFV | 2K | U21055 | YFV | E | FJ654700 | YFV | NS1 | DQ118157 |
| YFV | 2K | AY603338 | YFV | E | AY572535 | YFV | NS1 | X03700 |
| YFV | 2K | U21056 | YFV | E | AY968065 | YFV | NS1 | GQ379163 |
| YFV | 2K | DQ235229 | YFV | E | U54798 | YFV | NS2A | GQ379162 |
| YFV | 2K | NC_002031 | YFV | E | U21055 | YFV | NS2A | FJ654700 |
| YFV | 2K | AY640589 | YFV | E | AY603338 | YFV | NS2A | AY572535 |
| YFV | 2K | AF094612 | YFV | E | U21056 | YFV | NS2A | AY968065 |
| YFV | 2K | DQ100292 | YFV | E | DQ235229 | YFV | NS2A | U54798 |
| YFV | 2K | AY968064 | YFV | E | NC_002031 | YFV | NS2A | U21055 |
| YFV | 2K | X15062 | YFV | E | AY640589 | YFV | NS2A | AY603338 |
| YFV | 2K | U17067 | YFV | E | AF094612 | YFV | NS2A | U21056 |
| YFV | 2K | AF052445 | YFV | E | DQ100292 | YFV | NS2A | DQ235229 |
| YFV | 2K | AF052446 | YFV | E | AY968064 | YFV | NS2A | NC_002031 |
| YFV | 2K | AF052444 | YFV | E | X15062 | YFV | NS2A | AY640589 |
| YFV | 2K | U17066 | YFV | E | U17067 | YFV | NS2A | AF094612 |
| YFV | 2K | AF052439 | YFV | E | AF052445 | YFV | NS2A | DQ100292 |
| YFV | 2K | AF052437 | YFV | E | AF052446 | YFV | NS2A | AY968064 |
| YFV | 2K | AF052438 | YFV | E | AF052444 | YFV | NS2A | X15062 |
| YFV | 2K | DQ118157 | YFV | E | U17066 | YFV | NS2A | U17067 |
| YFV | 2K | X03700 | YFV | E | AF052439 | YFV | NS2A | AF052445 |
| YFV | 2K | GQ379163 | YFV | E | AF052437 | YFV | NS2A | AF052446 |
| YFV | anC | GQ379162 | YFV | E | AF052438 | YFV | NS2A | AF052444 |
| YFV | anC | FJ654700 | YFV | E | DQ118157 | YFV | NS2A | U17066 |
| YFV | anC | AY572535 | YFV | E | X03700 | YFV | NS2A | AF052439 |
| YFV | anC | AY968065 | YFV | E | GQ379163 | YFV | NS2A | AF052437 |
| YFV | anC | U54798 | YFV | NS1 | GQ379162 | YFV | NS2A | AF052438 |
| YFV | anC | U21055 | YFV | NS1 | FJ654700 | YFV | NS2A | DQ118157 |
| YFV | anC | AY603338 | YFV | NS1 | AY572535 | YFV | NS2A | X03700 |
| YFV | anC | U21056 | YFV | NS1 | AY968065 | YFV | NS2A | GQ379163 |
| YFV | anC | DQ235229 | YFV | NS1 | U54798 | YFV | NS2B | GQ379162 |
| YFV | anC | NC_002031 | YFV | NS1 | U21055 | YFV | NS2B | FJ654700 |
| YFV | anC | AY640589 | YFV | NS1 | AY603338 | YFV | NS2B | AY572535 |
| YFV | anC | AF094612 | YFV | NS1 | U21056 | YFV | NS2B | AY968065 |
| YFV | anC | DQ100292 | YFV | NS1 | DQ235229 | YFV | NS2B | U54798 |
| YFV | anC | AY968064 | YFV | NS1 | NC_002031 | YFV | NS2B | U21055 |
| YFV | anC | X15062 | YFV | NS1 | AY640589 | YFV | NS2B | AY603338 |
| YFV | anC | U17067 | YFV | NS1 | AF094612 | YFV | NS2B | U21056 |

FIG. 70-238

| Virus | Protein | Accession No. | Virus | Protein | Accession No. | Virus | Protein | Accession No. |
|---|---|---|---|---|---|---|---|---|
| YFV | NS2B | DQ235229 | YFV | NS4A | U54798 | YFV | NS5 | GQ379162 |
| YFV | NS2B | NC_002031 | YFV | NS4A | U21055 | YFV | NS5 | FJ654700 |
| YFV | NS2B | AY640589 | YFV | NS4A | AY603338 | YFV | NS5 | AY572535 |
| YFV | NS2B | AF094612 | YFV | NS4A | U21056 | YFV | NS5 | AY968065 |
| YFV | NS2B | DQ100292 | YFV | NS4A | DQ235229 | YFV | NS5 | U54798 |
| YFV | NS2B | AY968064 | YFV | NS4A | NC_002031 | YFV | NS5 | U21055 |
| YFV | NS2B | X15062 | YFV | NS4A | AY640589 | YFV | NS5 | AY603338 |
| YFV | NS2B | U17067 | YFV | NS4A | AF094612 | YFV | NS5 | U21056 |
| YFV | NS2B | AF052445 | YFV | NS4A | DQ100292 | YFV | NS5 | DQ235229 |
| YFV | NS2B | AF052446 | YFV | NS4A | AY968064 | YFV | NS5 | NC_002031 |
| YFV | NS2B | AF052444 | YFV | NS4A | X15062 | YFV | NS5 | AY640589 |
| YFV | NS2B | U17066 | YFV | NS4A | U17067 | YFV | NS5 | AF094612 |
| YFV | NS2B | AF052439 | YFV | NS4A | AF052445 | YFV | NS5 | DQ100292 |
| YFV | NS2B | AF052437 | YFV | NS4A | AF052446 | YFV | NS5 | AY968064 |
| YFV | NS2B | AF052438 | YFV | NS4A | AF052444 | YFV | NS5 | X15062 |
| YFV | NS2B | DQ118157 | YFV | NS4A | U17066 | YFV | NS5 | U17067 |
| YFV | NS2B | X03700 | YFV | NS4A | AF052439 | YFV | NS5 | AF052445 |
| YFV | NS2B | GQ379163 | YFV | NS4A | AF052437 | YFV | NS5 | AF052446 |
| YFV | NS3 | GQ379162 | YFV | NS4A | AF052438 | YFV | NS5 | AF052444 |
| YFV | NS3 | FJ654700 | YFV | NS4A | DQ118157 | YFV | NS5 | U17066 |
| YFV | NS3 | AY572535 | YFV | NS4A | X03700 | YFV | NS5 | AF052439 |
| YFV | NS3 | AY968065 | YFV | NS4A | GQ379163 | YFV | NS5 | AF052437 |
| YFV | NS3 | U54798 | YFV | NS4B | GQ379162 | YFV | NS5 | AF052438 |
| YFV | NS3 | U21055 | YFV | NS4B | FJ654700 | YFV | NS5 | DQ118157 |
| YFV | NS3 | AY603338 | YFV | NS4B | AY572535 | YFV | NS5 | X03700 |
| YFV | NS3 | U21056 | YFV | NS4B | AY968065 | YFV | NS5 | GQ379163 |
| YFV | NS3 | DQ235229 | YFV | NS4B | U54798 | YFV | prM | GQ379162 |
| YFV | NS3 | NC_002031 | YFV | NS4B | U21055 | YFV | prM | FJ654700 |
| YFV | NS3 | AY640589 | YFV | NS4B | AY603338 | YFV | prM | AY572535 |
| YFV | NS3 | AF094612 | YFV | NS4B | U21056 | YFV | prM | AY968065 |
| YFV | NS3 | DQ100292 | YFV | NS4B | DQ235229 | YFV | prM | U54798 |
| YFV | NS3 | AY968064 | YFV | NS4B | NC_002031 | YFV | prM | U21055 |
| YFV | NS3 | X15062 | YFV | NS4B | AY640589 | YFV | prM | AY603338 |
| YFV | NS3 | U17067 | YFV | NS4B | AF094612 | YFV | prM | U21056 |
| YFV | NS3 | AF052445 | YFV | NS4B | DQ100292 | YFV | prM | DQ235229 |
| YFV | NS3 | AF052446 | YFV | NS4B | AY968064 | YFV | prM | NC_002031 |
| YFV | NS3 | AF052444 | YFV | NS4B | X15062 | YFV | prM | AY640589 |
| YFV | NS3 | U17066 | YFV | NS4B | U17067 | YFV | prM | AF094612 |
| YFV | NS3 | AF052439 | YFV | NS4B | AF052445 | YFV | prM | DQ100292 |
| YFV | NS3 | AF052437 | YFV | NS4B | AF052446 | YFV | prM | AY968064 |
| YFV | NS3 | AF052438 | YFV | NS4B | AF052444 | YFV | prM | X15062 |
| YFV | NS3 | DQ118157 | YFV | NS4B | U17066 | YFV | prM | U17067 |
| YFV | NS3 | X03700 | YFV | NS4B | AF052439 | YFV | prM | AF052445 |
| YFV | NS3 | GQ379163 | YFV | NS4B | AF052437 | YFV | prM | AF052446 |
| YFV | NS4A | GQ379162 | YFV | NS4B | AF052438 | YFV | prM | AF052444 |
| YFV | NS4A | FJ654700 | YFV | NS4B | DQ118157 | YFV | prM | U17066 |
| YFV | NS4A | AY572535 | YFV | NS4B | X03700 | YFV | prM | AF052439 |
| YFV | NS4A | AY968065 | YFV | NS4B | GQ379163 | YFV | prM | AF052437 |

FIG. 70-239

| Virus | Protein | Accession No. |
|---|---|---|
| YFV | prM | AF052438 |
| YFV | prM | D

FIG. 71-1

| Virus Protein Accession No. | Virus Protein Accession No. | Virus Protein Accession No. |
|---|---|---|
| NV NTPase ADF45588.1 | NV NTPase BAJ13665.1 | NV NTPase BAJ13872.1 |
| NV NTPase AAC64602.1 | NV NTPase BAJ13608.1 | NV NTPase BAJ13869.1 |
| NV NTPase AAM95184.2 | NV NTPase BAJ13584.1 | NV NTPase BAJ13866.1 |
| NV NTPase ACU56257.1 | NV NTPase BAJ13563.1 | NV NTPase BAJ13863.1 |
| NV NTPase AAB50465.1 | NV NTPase BAJ13542.1 | NV NTPase BAJ13860.1 |
| NV NTPase AAM81234.2 | NV NTPase ADM52742.1 | NV NTPase BAJ13857.1 |
| NV NTPase BAF38402.1 | NV NTPase ADK23786.1 | NV NTPase BAJ13854.1 |
| NV NTPase BAF38399.1 | NV NTPase BAJ14016.1 | NV NTPase BAJ13851.1 |
| NV NTPase BAF38396.1 | NV NTPase BAJ14013.1 | NV NTPase BAJ13839.1 |
| NV NTPase BAF38393.1 | NV NTPase BAJ14010.1 | NV NTPase BAJ13833.1 |
| NV NTPase BAC98439.1 | NV NTPase BAJ14007.1 | NV NTPase BAJ13827.1 |
| NV NTPase NP_786946.1 | NV NTPase BAJ14001.1 | NV NTPase BAJ13824.1 |
| NV NTPase NP_056820.1 | NV NTPase BAJ13998.1 | NV NTPase BAJ13821.1 |
| NV NTPase BAE43832.1 | NV NTPase BAJ13995.1 | NV NTPase BAJ13818.1 |
| NV NTPase BAA96531.2 | NV NTPase BAJ13992.1 | NV NTPase BAJ13815.1 |
| NV NTPase BAC11839.1 | NV NTPase BAJ13989.1 | NV NTPase BAJ13812.1 |
| NV NTPase BAC11836.1 | NV NTPase BAJ13986.1 | NV NTPase BAJ13809.1 |
| NV NTPase BAC11833.1 | NV NTPase BAJ13983.1 | NV NTPase BAJ13803.1 |
| NV NTPase BAC11830.1 | NV NTPase BAJ13977.1 | NV NTPase BAJ13800.1 |
| NV NTPase BAC11827.1 | NV NTPase BAJ13974.1 | NV NTPase BAJ13797.1 |
| NV NTPase BAC11824.1 | NV NTPase BAJ13971.1 | NV NTPase BAJ13794.1 |
| NV NTPase BAC11821.1 | NV NTPase BAJ13968.1 | NV NTPase BAJ13791.1 |
| NV NTPase BAC11818.1 | NV NTPase BAJ13965.1 | NV NTPase BAJ13788.1 |
| NV NTPase BAC11815.1 | NV NTPase BAJ13956.1 | NV NTPase BAJ13782.1 |
| NV NTPase BAC11812.1 | NV NTPase BAJ13953.1 | NV NTPase BAJ13779.1 |
| NV NTPase ACX31888.2 | NV NTPase BAJ13950.1 | NV NTPase BAJ13776.1 |
| NV NTPase ACX31892.2 | NV NTPase BAJ13947.1 | NV NTPase BAJ13773.1 |
| NV NTPase BAJ13752.1 | NV NTPase BAJ13944.1 | NV NTPase BAJ13770.1 |
| NV NTPase BAJ13746.1 | NV NTPase BAJ13941.1 | NV NTPase BAJ13758.1 |
| NV NTPase BAJ14004.1 | NV NTPase BAJ13935.1 | NV NTPase BAJ13755.1 |
| NV NTPase BAJ13980.1 | NV NTPase BAJ13932.1 | NV NTPase BAJ13743.1 |
| NV NTPase BAJ13962.1 | NV NTPase BAJ13926.1 | NV NTPase BAJ13740.1 |
| NV NTPase BAJ13959.1 | NV NTPase BAJ13923.1 | NV NTPase BAJ13737.1 |
| NV NTPase BAJ13938.1 | NV NTPase BAJ13920.1 | NV NTPase BAJ13734.1 |
| NV NTPase BAJ13929.1 | NV NTPase BAJ13917.1 | NV NTPase BAJ13731.1 |
| NV NTPase BAJ13878.1 | NV NTPase BAJ13914.1 | NV NTPase BAJ13728.1 |
| NV NTPase BAJ13848.1 | NV NTPase BAJ13911.1 | NV NTPase BAJ13722.1 |
| NV NTPase BAJ13845.1 | NV NTPase BAJ13908.1 | NV NTPase BAJ13719.1 |
| NV NTPase BAJ13842.1 | NV NTPase BAJ13905.1 | NV NTPase BAJ13716.1 |
| NV NTPase BAJ13836.1 | NV NTPase BAJ13902.1 | NV NTPase BAJ13713.1 |
| NV NTPase BAJ13830.1 | NV NTPase BAJ13899.1 | NV NTPase BAJ13710.1 |
| NV NTPase BAJ13806.1 | NV NTPase BAJ13896.1 | NV NTPase BAJ13707.1 |
| NV NTPase BAJ13785.1 | NV NTPase BAJ13893.1 | NV NTPase BAJ13704.1 |
| NV NTPase BAJ13767.1 | NV NTPase BAJ13890.1 | NV NTPase BAJ13701.1 |
| NV NTPase BAJ13764.1 | NV NTPase BAJ13887.1 | NV NTPase BAJ13698.1 |
| NV NTPase BAJ13761.1 | NV NTPase BAJ13884.1 | NV NTPase BAJ13695.1 |
| NV NTPase BAJ13749.1 | NV NTPase BAJ13881.1 | NV NTPase BAJ13692.1 |
| NV NTPase BAJ13725.1 | NV NTPase BAJ13875.1 | NV NTPase BAJ13689.1 |

FIG. 71-2

| Virus | Protein | Accession No. | Virus | Protein | Accession No. | Virus | Protein | Accession No. |
|---|---|---|---|---|---|---|---|---|
| NV | NTPase | BAJ13686.1 | NV | NTPase | BAJ13522.1 | NV | NTPase | BAG70439.1 |
| NV | NTPase | BAJ13683.1 | NV | NTPase | BAJ13515.1 | NV | NTPase | BAG70436.1 |
| NV | NTPase | BAJ13680.1 | NV | NTPase | AAB97767.2 | NV | NTPase | BAG70433.1 |
| NV | NTPase | BAJ13677.1 | NV | NTPase | ADF47124.1 | NV | NTPase | BAG70430.1 |
| NV | NTPase | BAJ13674.1 | NV | NTPase | ADE28700.1 | NV | NTPase | BAG70427.1 |
| NV | NTPase | BAJ13671.1 | NV | NTPase | ACV32668.1 | NV | NTPase | ABQ12780.1 |
| NV | NTPase | BAJ13668.1 | NV | NTPase | BAI70517.1 | NV | NTPase | ABZ89548.1 |
| NV | NTPase | BAJ13662.1 | NV | NTPase | ACT76150.1 | NV | NTPase | ABG49508.1 |
| NV | NTPase | BAJ13659.1 | NV | NTPase | ACT76147.1 | NV | NTPase | ABD73935.1 |
| NV | NTPase | BAJ13656.1 | NV | NTPase | ACT76144.1 | NV | NTPase | CAA60254.1 |
| NV | NTPase | BAJ13653.1 | NV | NTPase | ACT76141.1 | NV | NTPase | ADK94753.1 |
| NV | NTPase | BAJ13650.1 | NV | NTPase | ACT76138.1 | NV | NTPase | ADK94751.1 |
| NV | NTPase | BAJ13647.1 | NV | NTPase | ABQ12783.1 | NV | NTPase | ADK94749.1 |
| NV | NTPase | BAJ13644.1 | NV | NTPase | AAR97662.1 | NV | NTPase | ADF47130.1 |
| NV | NTPase | BAJ13641.1 | NV | NTPase | AAR97653.1 | NV | NTPase | ADF47127.1 |
| NV | NTPase | BAJ13638.1 | NV | NTPase | ACL36374.1 | NV | NTPase | ACX81344.2 |
| NV | NTPase | BAJ13635.1 | NV | NTPase | BAG70535.1 | NV | NTPase | ABS12174.2 |
| NV | NTPase | BAJ13632.1 | NV | NTPase | BAG70532.1 | NV | NTPase | ABE41640.1 |
| NV | NTPase | BAJ13629.1 | NV | NTPase | BAG70529.1 | NV | NTPase | ABC96755.1 |
| NV | NTPase | BAJ13626.1 | NV | NTPase | BAG70526.1 | NV | NTPase | AAS47823.1 |
| NV | NTPase | BAJ13623.1 | NV | NTPase | BAG70523.1 | NV | NTPase | BAG30938.1 |
| NV | NTPase | BAJ13620.1 | NV | NTPase | BAG70520.1 | NV | NTPase | ABY27559.1 |
| NV | NTPase | BAJ13617.1 | NV | NTPase | BAG70517.1 | NV | NTPase | BAE98196.1 |
| NV | NTPase | BAJ13614.1 | NV | NTPase | BAG70514.1 | NV | NTPase | BAE98193.1 |
| NV | NTPase | BAJ13611.1 | NV | NTPase | BAG70511.1 | NV | NTPase | BAE98190.1 |
| NV | NTPase | BAJ13605.1 | NV | NTPase | BAG70508.1 | NV | NTPase | ABC96331.1 |
| NV | NTPase | BAJ13602.1 | NV | NTPase | BAG70505.1 | NV | PRO | AAC64602.1 |
| NV | NTPase | BAJ13599.1 | NV | NTPase | BAG70502.1 | NV | PRO | AAM95184.2 |
| NV | NTPase | BAJ13596.1 | NV | NTPase | BAG70499.1 | NV | PRO | ACU56257.1 |
| NV | NTPase | BAJ13593.1 | NV | NTPase | BAG70496.1 | NV | PRO | AAB50465.1 |
| NV | NTPase | BAJ13590.1 | NV | NTPase | BAG70493.1 | NV | PRO | AAM81234.2 |
| NV | NTPase | BAJ13587.1 | NV | NTPase | BAG70490.1 | NV | PRO | BAF38402.1 |
| NV | NTPase | BAJ13581.1 | NV | NTPase | BAG70487.1 | NV | PRO | BAF38399.1 |
| NV | NTPase | BAJ13578.1 | NV | NTPase | BAG70484.1 | NV | PRO | BAF38396.1 |
| NV | NTPase | BAJ13575.1 | NV | NTPase | BAG70481.1 | NV | PRO | BAF38393.1 |
| NV | NTPase | BAJ13572.1 | NV | NTPase | BAG70478.1 | NV | PRO | BAC98439.1 |
| NV | NTPase | BAJ13569.1 | NV | NTPase | BAG70475.1 | NV | PRO | NP_786949.1 |
| NV | NTPase | BAJ13566.1 | NV | NTPase | BAG70472.1 | NV | PRO | NP_056820.1 |
| NV | NTPase | BAJ13560.1 | NV | NTPase | BAG70469.1 | NV | PRO | BAE43832.1 |
| NV | NTPase | BAJ13557.1 | NV | NTPase | BAG70466.1 | NV | PRO | CAE47528.2 |
| NV | NTPase | BAJ13554.1 | NV | NTPase | BAG70463.1 | NV | PRO | BAA96531.2 |
| NV | NTPase | BAJ13551.1 | NV | NTPase | BAG70460.1 | NV | PRO | BAC11839.1 |
| NV | NTPase | BAJ13548.1 | NV | NTPase | BAG70457.1 | NV | PRO | BAC11836.1 |
| NV | NTPase | BAJ13545.1 | NV | NTPase | BAG70454.1 | NV | PRO | BAC11833.1 |
| NV | NTPase | BAJ13539.1 | NV | NTPase | BAG70451.1 | NV | PRO | BAC11830.1 |
| NV | NTPase | BAJ13536.1 | NV | NTPase | BAG70448.1 | NV | PRO | BAC11827.1 |
| NV | NTPase | BAJ13533.1 | NV | NTPase | BAG70445.1 | NV | PRO | BAC11824.1 |
| NV | NTPase | BAJ13529.1 | NV | NTPase | BAG70442.1 | NV | PRO | BAC11821.1 |

FIG. 71-3

| Virus Protein | Accession No. | Virus Protein | Accession No. | Virus Protein | Accession No. |
|---|---|---|---|---|---|
| NV PRO | BAC11818.1 | NV PRO | BAJ13965.1 | NV PRO | BAJ13788.1 |
| NV PRO | BAC11815.1 | NV PRO | BAJ13956.1 | NV PRO | BAJ13782.1 |
| NV PRO | BAC11812.1 | NV PRO | BAJ13953.1 | NV PRO | BAJ13779.1 |
| NV PRO | ACX31888.2 | NV PRO | BAJ13950.1 | NV PRO | BAJ13776.1 |
| NV PRO | ACX31892.2 | NV PRO | BAJ13947.1 | NV PRO | BAJ13773.1 |
| NV PRO | BAJ13752.1 | NV PRO | BAJ13944.1 | NV PRO | BAJ13770.1 |
| NV PRO | BAJ13746.1 | NV PRO | BAJ13941.1 | NV PRO | BAJ13758.1 |
| NV PRO | BAJ14004.1 | NV PRO | BAJ13935.1 | NV PRO | BAJ13755.1 |
| NV PRO | BAJ13980.1 | NV PRO | BAJ13932.1 | NV PRO | BAJ13743.1 |
| NV PRO | BAJ13962.1 | NV PRO | BAJ13926.1 | NV PRO | BAJ13740.1 |
| NV PRO | BAJ13959.1 | NV PRO | BAJ13923.1 | NV PRO | BAJ13737.1 |
| NV PRO | BAJ13938.1 | NV PRO | BAJ13920.1 | NV PRO | BAJ13734.1 |
| NV PRO | BAJ13929.1 | NV PRO | BAJ13917.1 | NV PRO | BAJ13731.1 |
| NV PRO | BAJ13878.1 | NV PRO | BAJ13914.1 | NV PRO | BAJ13728.1 |
| NV PRO | BAJ13848.1 | NV PRO | BAJ13911.1 | NV PRO | BAJ13722.1 |
| NV PRO | BAJ13845.1 | NV PRO | BAJ13908.1 | NV PRO | BAJ13719.1 |
| NV PRO | BAJ13842.1 | NV PRO | BAJ13905.1 | NV PRO | BAJ13716.1 |
| NV PRO | BAJ13836.1 | NV PRO | BAJ13902.1 | NV PRO | BAJ13713.1 |
| NV PRO | BAJ13830.1 | NV PRO | BAJ13899.1 | NV PRO | BAJ13710.1 |
| NV PRO | BAJ13806.1 | NV PRO | BAJ13896.1 | NV PRO | BAJ13707.1 |
| NV PRO | BAJ13785.1 | NV PRO | BAJ13893.1 | NV PRO | BAJ13704.1 |
| NV PRO | BAJ13767.1 | NV PRO | BAJ13890.1 | NV PRO | BAJ13701.1 |
| NV PRO | BAJ13764.1 | NV PRO | BAJ13887.1 | NV PRO | BAJ13698.1 |
| NV PRO | BAJ13761.1 | NV PRO | BAJ13884.1 | NV PRO | BAJ13695.1 |
| NV PRO | BAJ13749.1 | NV PRO | BAJ13881.1 | NV PRO | BAJ13692.1 |
| NV PRO | BAJ13725.1 | NV PRO | BAJ13875.1 | NV PRO | BAJ13689.1 |
| NV PRO | BAJ13665.1 | NV PRO | BAJ13872.1 | NV PRO | BAJ13686.1 |
| NV PRO | BAJ13608.1 | NV PRO | BAJ13869.1 | NV PRO | BAJ13683.1 |
| NV PRO | BAJ13584.1 | NV PRO | BAJ13866.1 | NV PRO | BAJ13680.1 |
| NV PRO | BAJ13563.1 | NV PRO | BAJ13863.1 | NV PRO | BAJ13677.1 |
| NV PRO | BAJ13542.1 | NV PRO | BAJ13860.1 | NV PRO | BAJ13674.1 |
| NV PRO | ADM52742.1 | NV PRO | BAJ13857.1 | NV PRO | BAJ13671.1 |
| NV PRO | ADK23786.1 | NV PRO | BAJ13854.1 | NV PRO | BAJ13668.1 |
| NV PRO | BAJ14016.1 | NV PRO | BAJ13851.1 | NV PRO | BAJ13662.1 |
| NV PRO | BAJ14013.1 | NV PRO | BAJ13839.1 | NV PRO | BAJ13659.1 |
| NV PRO | BAJ14010.1 | NV PRO | BAJ13833.1 | NV PRO | BAJ13656.1 |
| NV PRO | BAJ14007.1 | NV PRO | BAJ13827.1 | NV PRO | BAJ13653.1 |
| NV PRO | BAJ14001.1 | NV PRO | BAJ13824.1 | NV PRO | BAJ13650.1 |
| NV PRO | BAJ13998.1 | NV PRO | BAJ13821.1 | NV PRO | BAJ13647.1 |
| NV PRO | BAJ13995.1 | NV PRO | BAJ13818.1 | NV PRO | BAJ13644.1 |
| NV PRO | BAJ13992.1 | NV PRO | BAJ13815.1 | NV PRO | BAJ13641.1 |
| NV PRO | BAJ13989.1 | NV PRO | BAJ13812.1 | NV PRO | BAJ13638.1 |
| NV PRO | BAJ13986.1 | NV PRO | BAJ13809.1 | NV PRO | BAJ13635.1 |
| NV PRO | BAJ13983.1 | NV PRO | BAJ13803.1 | NV PRO | BAJ13632.1 |
| NV PRO | BAJ13977.1 | NV PRO | BAJ13800.1 | NV PRO | BAJ13629.1 |
| NV PRO | BAJ13974.1 | NV PRO | BAJ13797.1 | NV PRO | BAJ13626.1 |
| NV PRO | BAJ13971.1 | NV PRO | BAJ13794.1 | NV PRO | BAJ13623.1 |
| NV PRO | BAJ13968.1 | NV PRO | BAJ13791.1 | NV PRO | BAJ13620.1 |

FIG. 71-4

| Virus | Protein | Accession No. | Virus | Protein | Accession No. | Virus | Protein | Accession No. |
|---|---|---|---|---|---|---|---|---|
| NV | PRO | BAJ13617.1 | NV | PRO | BAG70517.1 | NV | PRO | BAE98196.1 |
| NV | PRO | BAJ13614.1 | NV | PRO | BAG70514.1 | NV | PRO | BAE98193.1 |
| NV | PRO | BAJ13611.1 | NV | PRO | BAG70511.1 | NV | PRO | BAE98190.1 |
| NV | PRO | BAJ13605.1 | NV | PRO | BAG70508.1 | NV | PRO | ABC96331.1 |
| NV | PRO | BAJ13602.1 | NV | PRO | BAG70505.1 | NV | VPg | ADF45588.1 |
| NV | PRO | BAJ13599.1 | NV | PRO | BAG70502.1 | NV | VPg | AAM81234.2 |
| NV | PRO | BAJ13596.1 | NV | PRO | BAG70499.1 | NV | VPg | BAF38402.1 |
| NV | PRO | BAJ13593.1 | NV | PRO | BAG70496.1 | NV | VPg | BAF38399.1 |
| NV | PRO | BAJ13590.1 | NV | PRO | BAG70493.1 | NV | VPg | BAF38396.1 |
| NV | PRO | BAJ13587.1 | NV | PRO | BAG70490.1 | NV | VPg | BAF38393.1 |
| NV | PRO | BAJ13581.1 | NV | PRO | BAG70487.1 | NV | VPg | BAC98439.1 |
| NV | PRO | BAJ13578.1 | NV | PRO | BAG70484.1 | NV | VPg | CAE47528.2 |
| NV | PRO | BAJ13575.1 | NV | PRO | BAG70481.1 | NV | VPg | BAA96531.2 |
| NV | PRO | BAJ13572.1 | NV | PRO | BAG70478.1 | NV | VPg | BAC11836.1 |
| NV | PRO | BAJ13569.1 | NV | PRO | BAG70475.1 | NV | VPg | BAC11833.1 |
| NV | PRO | BAJ13566.1 | NV | PRO | BAG70472.1 | NV | VPg | BAC11830.1 |
| NV | PRO | BAJ13560.1 | NV | PRO | BAG70469.1 | NV | VPg | BAC11827.1 |
| NV | PRO | BAJ13557.1 | NV | PRO | BAG70466.1 | NV | VPg | BAC11824.1 |
| NV | PRO | BAJ13554.1 | NV | PRO | BAG70463.1 | NV | VPg | BAC11821.1 |
| NV | PRO | BAJ13551.1 | NV | PRO | BAG70460.1 | NV | VPg | BAC11818.1 |
| NV | PRO | BAJ13548.1 | NV | PRO | BAG70457.1 | NV | VPg | BAC11815.1 |
| NV | PRO | BAJ13545.1 | NV | PRO | BAG70454.1 | NV | VPg | ACX31892.2 |
| NV | PRO | BAJ13539.1 | NV | PRO | BAG70451.1 | NV | VPg | BAJ13752.1 |
| NV | PRO | BAJ13536.1 | NV | PRO | BAG70448.1 | NV | VPg | BAJ13746.1 |
| NV | PRO | BAJ13533.1 | NV | PRO | BAG70445.1 | NV | VPg | BAJ14004.1 |
| NV | PRO | BAJ13529.1 | NV | PRO | BAG70442.1 | NV | VPg | BAJ13980.1 |
| NV | PRO | BAJ13522.1 | NV | PRO | BAG70439.1 | NV | VPg | BAJ13962.1 |
| NV | PRO | BAJ13515.1 | NV | PRO | BAG70436.1 | NV | VPg | BAJ13959.1 |
| NV | PRO | AAB97767.2 | NV | PRO | BAG70433.1 | NV | VPg | BAJ13938.1 |
| NV | PRO | ADF47124.1 | NV | PRO | BAG70430.1 | NV | VPg | BAJ13929.1 |
| NV | PRO | ADE28700.1 | NV | PRO | BAG70427.1 | NV | VPg | BAJ13878.1 |
| NV | PRO | ACV32668.1 | NV | PRO | ABQ12780.1 | NV | VPg | BAJ13848.1 |
| NV | PRO | BAI70517.1 | NV | PRO | ABZ89548.1 | NV | VPg | BAJ13845.1 |
| NV | PRO | ACT76150.1 | NV | PRO | ABG49508.1 | NV | VPg | BAJ13842.1 |
| NV | PRO | ACT76147.1 | NV | PRO | ABD73935.1 | NV | VPg | BAJ13836.1 |
| NV | PRO | ACT76144.1 | NV | PRO | CAA60254.1 | NV | VPg | BAJ13830.1 |
| NV | PRO | ACT76141.1 | NV | PRO | ADK94753.1 | NV | VPg | BAJ13806.1 |
| NV | PRO | ACT76138.1 | NV | PRO | ADK94751.1 | NV | VPg | BAJ13785.1 |
| NV | PRO | ABQ12783.1 | NV | PRO | ADK94749.1 | NV | VPg | BAJ13767.1 |
| NV | PRO | AAR97662.1 | NV | PRO | ADF47130.1 | NV | VPg | BAJ13764.1 |
| NV | PRO | AAR97653.1 | NV | PRO | ADF47127.1 | NV | VPg | BAJ13761.1 |
| NV | PRO | ACL36374.1 | NV | PRO | ACX81344.2 | NV | VPg | BAJ13749.1 |
| NV | PRO | BAG70535.1 | NV | PRO | ABS12174.2 | NV | VPg | BAJ13725.1 |
| NV | PRO | BAG70532.1 | NV | PRO | ABE41640.1 | NV | VPg | BAJ13665.1 |
| NV | PRO | BAG70529.1 | NV | PRO | ABC96755.1 | NV | VPg | BAJ13608.1 |
| NV | PRO | BAG70526.1 | NV | PRO | AAS47823.1 | NV | VPg | BAJ13584.1 |
| NV | PRO | BAG70523.1 | NV | PRO | BAG30938.1 | NV | VPg | BAJ13563.1 |
| NV | PRO | BAG70520.1 | NV | PRO | ABY27559.1 | NV | VPg | BAJ13542.1 |

FIG. 71-5

| Virus | Protein | Accession No. | Virus | Protein | Accession No. | Virus | Protein | Accession No. |
|---|---|---|---|---|---|---|---|---|
| NV | VPg | ADM52742.1 | NV | VPg | BAJ13857.1 | NV | VPg | BAJ13671.1 |
| NV | VPg | ADK23786.1 | NV | VPg | BAJ13854.1 | NV | VPg | BAJ13668.1 |
| NV | VPg | BAJ14016.1 | NV | VPg | BAJ13851.1 | NV | VPg | BAJ13662.1 |
| NV | VPg | BAJ14013.1 | NV | VPg | BAJ13839.1 | NV | VPg | BAJ13659.1 |
| NV | VPg | BAJ14010.1 | NV | VPg | BAJ13833.1 | NV | VPg | BAJ13656.1 |
| NV | VPg | BAJ14007.1 | NV | VPg | BAJ13827.1 | NV | VPg | BAJ13653.1 |
| NV | VPg | BAJ14001.1 | NV | VPg | BAJ13824.1 | NV | VPg | BAJ13650.1 |
| NV | VPg | BAJ13998.1 | NV | VPg | BAJ13821.1 | NV | VPg | BAJ13647.1 |
| NV | VPg | BAJ13995.1 | NV | VPg | BAJ13818.1 | NV | VPg | BAJ13644.1 |
| NV | VPg | BAJ13992.1 | NV | VPg | BAJ13815.1 | NV | VPg | BAJ13641.1 |
| NV | VPg | BAJ13989.1 | NV | VPg | BAJ13812.1 | NV | VPg | BAJ13638.1 |
| NV | VPg | BAJ13986.1 | NV | VPg | BAJ13809.1 | NV | VPg | BAJ13635.1 |
| NV | VPg | BAJ13983.1 | NV | VPg | BAJ13803.1 | NV | VPg | BAJ13632.1 |
| NV | VPg | BAJ13977.1 | NV | VPg | BAJ13800.1 | NV | VPg | BAJ13629.1 |
| NV | VPg | BAJ13974.1 | NV | VPg | BAJ13797.1 | NV | VPg | BAJ13626.1 |
| NV | VPg | BAJ13971.1 | NV | VPg | BAJ13794.1 | NV | VPg | BAJ13623.1 |
| NV | VPg | BAJ13968.1 | NV | VPg | BAJ13791.1 | NV | VPg | BAJ13620.1 |
| NV | VPg | BAJ13965.1 | NV | VPg | BAJ13788.1 | NV | VPg | BAJ13617.1 |
| NV | VPg | BAJ13956.1 | NV | VPg | BAJ13782.1 | NV | VPg | BAJ13614.1 |
| NV | VPg | BAJ13953.1 | NV | VPg | BAJ13779.1 | NV | VPg | BAJ13611.1 |
| NV | VPg | BAJ13950.1 | NV | VPg | BAJ13776.1 | NV | VPg | BAJ13605.1 |
| NV | VPg | BAJ13947.1 | NV | VPg | BAJ13773.1 | NV | VPg | BAJ13602.1 |
| NV | VPg | BAJ13944.1 | NV | VPg | BAJ13770.1 | NV | VPg | BAJ13599.1 |
| NV | VPg | BAJ13941.1 | NV | VPg | BAJ13758.1 | NV | VPg | BAJ13596.1 |
| NV | VPg | BAJ13935.1 | NV | VPg | BAJ13755.1 | NV | VPg | BAJ13593.1 |
| NV | VPg | BAJ13932.1 | NV | VPg | BAJ13743.1 | NV | VPg | BAJ13590.1 |
| NV | VPg | BAJ13926.1 | NV | VPg | BAJ13740.1 | NV | VPg | BAJ13587.1 |
| NV | VPg | BAJ13923.1 | NV | VPg | BAJ13737.1 | NV | VPg | BAJ13581.1 |
| NV | VPg | BAJ13920.1 | NV | VPg | BAJ13734.1 | NV | VPg | BAJ13578.1 |
| NV | VPg | BAJ13917.1 | NV | VPg | BAJ13731.1 | NV | VPg | BAJ13575.1 |
| NV | VPg | BAJ13914.1 | NV | VPg | BAJ13728.1 | NV | VPg | BAJ13572.1 |
| NV | VPg | BAJ13911.1 | NV | VPg | BAJ13722.1 | NV | VPg | BAJ13569.1 |
| NV | VPg | BAJ13908.1 | NV | VPg | BAJ13719.1 | NV | VPg | BAJ13566.1 |
| NV | VPg | BAJ13905.1 | NV | VPg | BAJ13716.1 | NV | VPg | BAJ13560.1 |
| NV | VPg | BAJ13902.1 | NV | VPg | BAJ13713.1 | NV | VPg | BAJ13557.1 |
| NV | VPg | BAJ13899.1 | NV | VPg | BAJ13710.1 | NV | VPg | BAJ13554.1 |
| NV | VPg | BAJ13896.1 | NV | VPg | BAJ13707.1 | NV | VPg | BAJ13551.1 |
| NV | VPg | BAJ13893.1 | NV | VPg | BAJ13704.1 | NV | VPg | BAJ13548.1 |
| NV | VPg | BAJ13890.1 | NV | VPg | BAJ13701.1 | NV | VPg | BAJ13545.1 |
| NV | VPg | BAJ13887.1 | NV | VPg | BAJ13698.1 | NV | VPg | BAJ13539.1 |
| NV | VPg | BAJ13884.1 | NV | VPg | BAJ13695.1 | NV | VPg | BAJ13536.1 |
| NV | VPg | BAJ13881.1 | NV | VPg | BAJ13692.1 | NV | VPg | BAJ13533.1 |
| NV | VPg | BAJ13875.1 | NV | VPg | BAJ13689.1 | NV | VPg | BAJ13529.1 |
| NV | VPg | BAJ13872.1 | NV | VPg | BAJ13686.1 | NV | VPg | BAJ13522.1 |
| NV | VPg | BAJ13869.1 | NV | VPg | BAJ13683.1 | NV | VPg | BAJ13515.1 |
| NV | VPg | BAJ13866.1 | NV | VPg | BAJ13680.1 | NV | VPg | AAB97767.2 |
| NV | VPg | BAJ13863.1 | NV | VPg | BAJ13677.1 | NV | VPg | ADF47124.1 |
| NV | VPg | BAJ13860.1 | NV | VPg | BAJ13674.1 | NV | VPg | ADE28700.1 |

FIG. 71-6

| Virus | Protein | Accession No. | Virus | Protein | Accession No. | Virus | Protein | Accession No. |
|---|---|---|---|---|---|---|---|---|
| NV | VPg | ACV32668.1 | NV | VPg | ABQ12780.1 | NV | p48 | BAJ13608.1 |
| NV | VPg | BAI70517.1 | NV | VPg | ABZ89548.1 | NV | p48 | BAJ13584.1 |
| NV | VPg | ACT76150.1 | NV | VPg | ABG49508.1 | NV | p48 | BAJ13563.1 |
| NV | VPg | ACT76147.1 | NV | VPg | ABD73935.1 | NV | p48 | BAJ13542.1 |
| NV | VPg | ACT76144.1 | NV | VPg | CAA60254.1 | NV | p48 | ADM52742.1 |
| NV | VPg | ACT76141.1 | NV | VPg | ADK94753.1 | NV | p48 | ADK23786.1 |
| NV | VPg | ACT76138.1 | NV | VPg | ADK94751.1 | NV | p48 | BAJ14016.1 |
| NV | VPg | ABQ12783.1 | NV | VPg | ADK94749.1 | NV | p48 | BAJ14013.1 |
| NV | VPg | AAR97662.1 | NV | VPg | ADF47130.1 | NV | p48 | BAJ14010.1 |
| NV | VPg | AAR97653.1 | NV | VPg | ADF47127.1 | NV | p48 | BAJ14007.1 |
| NV | VPg | ACL36374.1 | NV | VPg | ACX81344.2 | NV | p48 | BAJ13998.1 |
| NV | VPg | BAG70535.1 | NV | VPg | ABS12174.2 | NV | p48 | BAJ13995.1 |
| NV | VPg | BAG70532.1 | NV | VPg | ABE41640.1 | NV | p48 | BAJ13992.1 |
| NV | VPg | BAG70529.1 | NV | VPg | ABC96755.1 | NV | p48 | BAJ13989.1 |
| NV | VPg | BAG70526.1 | NV | VPg | AAS47823.1 | NV | p48 | BAJ13986.1 |
| NV | VPg | BAG70523.1 | NV | VPg | BAG30938.1 | NV | p48 | BAJ13983.1 |
| NV | VPg | BAG70520.1 | NV | VPg | ABY27559.1 | NV | p48 | BAJ13977.1 |
| NV | VPg | BAG70517.1 | NV | VPg | BAE98196.1 | NV | p48 | BAJ13974.1 |
| NV | VPg | BAG70514.1 | NV | VPg | BAE98193.1 | NV | p48 | BAJ13971.1 |
| NV | VPg | BAG70511.1 | NV | VPg | BAE98190.1 | NV | p48 | BAJ13968.1 |
| NV | VPg | BAG70508.1 | NV | VPg | ABC96331.1 | NV | p48 | BAJ13965.1 |
| NV | VPg | BAG70505.1 | NV | p48 | AAM81234.2 | NV | p48 | BAJ13956.1 |
| NV | VPg | BAG70502.1 | NV | p48 | BAF38396.1 | NV | p48 | BAJ13953.1 |
| NV | VPg | BAG70499.1 | NV | p48 | BAC98439.1 | NV | p48 | BAJ13950.1 |
| NV | VPg | BAG70496.1 | NV | p48 | BAA96531.2 | NV | p48 | BAJ13947.1 |
| NV | VPg | BAG70493.1 | NV | p48 | BAC11815.1 | NV | p48 | BAJ13944.1 |
| NV | VPg | BAG70490.1 | NV | p48 | ACX31888.2 | NV | p48 | BAJ13941.1 |
| NV | VPg | BAG70487.1 | NV | p48 | BAJ13752.1 | NV | p48 | BAJ13935.1 |
| NV | VPg | BAG70484.1 | NV | p48 | BAJ13746.1 | NV | p48 | BAJ13932.1 |
| NV | VPg | BAG70481.1 | NV | p48 | BAJ14004.1 | NV | p48 | BAJ13926.1 |
| NV | VPg | BAG70478.1 | NV | p48 | BAJ13980.1 | NV | p48 | BAJ13923.1 |
| NV | VPg | BAG70475.1 | NV | p48 | BAJ13962.1 | NV | p48 | BAJ13920.1 |
| NV | VPg | BAG70472.1 | NV | p48 | BAJ13959.1 | NV | p48 | BAJ13917.1 |
| NV | VPg | BAG70469.1 | NV | p48 | BAJ13938.1 | NV | p48 | BAJ13914.1 |
| NV | VPg | BAG70466.1 | NV | p48 | BAJ13929.1 | NV | p48 | BAJ13911.1 |
| NV | VPg | BAG70463.1 | NV | p48 | BAJ13878.1 | NV | p48 | BAJ13908.1 |
| NV | VPg | BAG70460.1 | NV | p48 | BAJ13848.1 | NV | p48 | BAJ13905.1 |
| NV | VPg | BAG70457.1 | NV | p48 | BAJ13842.1 | NV | p48 | BAJ13902.1 |
| NV | VPg | BAG70454.1 | NV | p48 | BAJ13836.1 | NV | p48 | BAJ13899.1 |
| NV | VPg | BAG70451.1 | NV | p48 | BAJ13830.1 | NV | p48 | BAJ13896.1 |
| NV | VPg | BAG70448.1 | NV | p48 | BAJ13806.1 | NV | p48 | BAJ13893.1 |
| NV | VPg | BAG70445.1 | NV | p48 | BAJ13785.1 | NV | p48 | BAJ13890.1 |
| NV | VPg | BAG70442.1 | NV | p48 | BAJ13767.1 | NV | p48 | BAJ13887.1 |
| NV | VPg | BAG70439.1 | NV | p48 | BAJ13764.1 | NV | p48 | BAJ13884.1 |
| NV | VPg | BAG70436.1 | NV | p48 | BAJ13761.1 | NV | p48 | BAJ13881.1 |
| NV | VPg | BAG70433.1 | NV | p48 | BAJ13749.1 | NV | p48 | BAJ13875.1 |
| NV | VPg | BAG70430.1 | NV | p48 | BAJ13725.1 | NV | p48 | BAJ13872.1 |
| NV | VPg | BAG70427.1 | NV | p48 | BAJ13665.1 | NV | p48 | BAJ13869.1 |

FIG. 71-7

| Virus | Protein | Accession No. | Virus | Protein | Accession No. | Virus | Protein | Accession No. |
|---|---|---|---|---|---|---|---|---|
| NV | p48 | BAJ13866.1 | NV | p48 | BAJ13680.1 | NV | p48 | AAB97767.2 |
| NV | p48 | BAJ13863.1 | NV | p48 | BAJ13677.1 | NV | p48 | ADF47124.1 |
| NV | p48 | BAJ13860.1 | NV | p48 | BAJ13674.1 | NV | p48 | ACV32668.1 |
| NV | p48 | BAJ13857.1 | NV | p48 | BAJ13671.1 | NV | p48 | BAI70517.1 |
| NV | p48 | BAJ13854.1 | NV | p48 | BAJ13668.1 | NV | p48 | ACT76150.1 |
| NV | p48 | BAJ13851.1 | NV | p48 | BAJ13662.1 | NV | p48 | ACT76147.1 |
| NV | p48 | BAJ13839.1 | NV | p48 | BAJ13659.1 | NV | p48 | ACT76144.1 |
| NV | p48 | BAJ13833.1 | NV | p48 | BAJ13656.1 | NV | p48 | ACT76141.1 |
| NV | p48 | BAJ13827.1 | NV | p48 | BAJ13653.1 | NV | p48 | ACT76138.1 |
| NV | p48 | BAJ13824.1 | NV | p48 | BAJ13650.1 | NV | p48 | ABQ12783.1 |
| NV | p48 | BAJ13821.1 | NV | p48 | BAJ13647.1 | NV | p48 | AAR97662.1 |
| NV | p48 | BAJ13818.1 | NV | p48 | BAJ13644.1 | NV | p48 | AAR97653.1 |
| NV | p48 | BAJ13815.1 | NV | p48 | BAJ13641.1 | NV | p48 | ACL36374.1 |
| NV | p48 | BAJ13812.1 | NV | p48 | BAJ13638.1 | NV | p48 | BAG70535.1 |
| NV | p48 | BAJ13809.1 | NV | p48 | BAJ13635.1 | NV | p48 | BAG70532.1 |
| NV | p48 | BAJ13803.1 | NV | p48 | BAJ13632.1 | NV | p48 | BAG70529.1 |
| NV | p48 | BAJ13800.1 | NV | p48 | BAJ13629.1 | NV | p48 | BAG70526.1 |
| NV | p48 | BAJ13797.1 | NV | p48 | BAJ13626.1 | NV | p48 | BAG70523.1 |
| NV | p48 | BAJ13794.1 | NV | p48 | BAJ13623.1 | NV | p48 | BAG70520.1 |
| NV | p48 | BAJ13791.1 | NV | p48 | BAJ13620.1 | NV | p48 | BAG70517.1 |
| NV | p48 | BAJ13788.1 | NV | p48 | BAJ13617.1 | NV | p48 | BAG70514.1 |
| NV | p48 | BAJ13782.1 | NV | p48 | BAJ13614.1 | NV | p48 | BAG70511.1 |
| NV | p48 | BAJ13779.1 | NV | p48 | BAJ13611.1 | NV | p48 | BAG70508.1 |
| NV | p48 | BAJ13776.1 | NV | p48 | BAJ13605.1 | NV | p48 | BAG70505.1 |
| NV | p48 | BAJ13773.1 | NV | p48 | BAJ13602.1 | NV | p48 | BAG70502.1 |
| NV | p48 | BAJ13770.1 | NV | p48 | BAJ13599.1 | NV | p48 | BAG70499.1 |
| NV | p48 | BAJ13758.1 | NV | p48 | BAJ13596.1 | NV | p48 | BAG70496.1 |
| NV | p48 | BAJ13755.1 | NV | p48 | BAJ13593.1 | NV | p48 | BAG70493.1 |
| NV | p48 | BAJ13743.1 | NV | p48 | BAJ13590.1 | NV | p48 | BAG70490.1 |
| NV | p48 | BAJ13740.1 | NV | p48 | BAJ13587.1 | NV | p48 | BAG70487.1 |
| NV | p48 | BAJ13737.1 | NV | p48 | BAJ13581.1 | NV | p48 | BAG70484.1 |
| NV | p48 | BAJ13734.1 | NV | p48 | BAJ13578.1 | NV | p48 | BAG70481.1 |
| NV | p48 | BAJ13731.1 | NV | p48 | BAJ13575.1 | NV | p48 | BAG70478.1 |
| NV | p48 | BAJ13728.1 | NV | p48 | BAJ13572.1 | NV | p48 | BAG70475.1 |
| NV | p48 | BAJ13722.1 | NV | p48 | BAJ13569.1 | NV | p48 | BAG70472.1 |
| NV | p48 | BAJ13719.1 | NV | p48 | BAJ13566.1 | NV | p48 | BAG70469.1 |
| NV | p48 | BAJ13716.1 | NV | p48 | BAJ13560.1 | NV | p48 | BAG70466.1 |
| NV | p48 | BAJ13713.1 | NV | p48 | BAJ13557.1 | NV | p48 | BAG70463.1 |
| NV | p48 | BAJ13710.1 | NV | p48 | BAJ13554.1 | NV | p48 | BAG70460.1 |
| NV | p48 | BAJ13707.1 | NV | p48 | BAJ13551.1 | NV | p48 | BAG70457.1 |
| NV | p48 | BAJ13704.1 | NV | p48 | BAJ13548.1 | NV | p48 | BAG70454.1 |
| NV | p48 | BAJ13701.1 | NV | p48 | BAJ13545.1 | NV | p48 | BAG70451.1 |
| NV | p48 | BAJ13698.1 | NV | p48 | BAJ13539.1 | NV | p48 | BAG70448.1 |
| NV | p48 | BAJ13695.1 | NV | p48 | BAJ13536.1 | NV | p48 | BAG70445.1 |
| NV | p48 | BAJ13692.1 | NV | p48 | BAJ13533.1 | NV | p48 | BAG70442.1 |
| NV | p48 | BAJ13689.1 | NV | p48 | BAJ13529.1 | NV | p48 | BAG70439.1 |
| NV | p48 | BAJ13686.1 | NV | p48 | BAJ13522.1 | NV | p48 | BAG70436.1 |
| NV | p48 | BAJ13683.1 | NV | p48 | BAJ13515.1 | NV | p48 | BAG70433.1 |

FIG. 71-8

| Virus | Protein | Accession No. | Virus | Protein | Accession No. | Virus | Protein | Accession No. |
|---|---|---|---|---|---|---|---|---|
| NV | p48 | BAG70430.1 | NV | p22 | BAJ13842.1 | NV | p22 | BAJ13905.1 |
| NV | p48 | BAG70427.1 | NV | p22 | BAJ13836.1 | NV | p22 | BAJ13902.1 |
| NV | p48 | ABQ12780.1 | NV | p22 | BAJ13830.1 | NV | p22 | BAJ13899.1 |
| NV | p48 | ABG49508.1 | NV | p22 | BAJ13806.1 | NV | p22 | BAJ13896.1 |
| NV | p48 | ABD73935.1 | NV | p22 | BAJ13785.1 | NV | p22 | BAJ13893.1 |
| NV | p48 | CAA60254.1 | NV | p22 | BAJ13767.1 | NV | p22 | BAJ13890.1 |
| NV | p48 | ADK94753.1 | NV | p22 | BAJ13764.1 | NV | p22 | BAJ13887.1 |
| NV | p48 | ADK94751.1 | NV | p22 | BAJ13761.1 | NV | p22 | BAJ13884.1 |
| NV | p48 | ADK94749.1 | NV | p22 | BAJ13749.1 | NV | p22 | BAJ13881.1 |
| NV | p48 | ADF47130.1 | NV | p22 | BAJ13725.1 | NV | p22 | BAJ13875.1 |
| NV | p48 | ADF47127.1 | NV | p22 | BAJ13665.1 | NV | p22 | BAJ13872.1 |
| NV | p48 | ABE41640.1 | NV | p22 | BAJ13608.1 | NV | p22 | BAJ13869.1 |
| NV | p48 | AAS47823.1 | NV | p22 | BAJ13584.1 | NV | p22 | BAJ13866.1 |
| NV | p48 | BAG30938.1 | NV | p22 | BAJ13563.1 | NV | p22 | BAJ13863.1 |
| NV | p48 | ABY27559.1 | NV | p22 | BAJ13542.1 | NV | p22 | BAJ13860.1 |
| NV | p48 | BAE98196.1 | NV | p22 | ADM52742.1 | NV | p22 | BAJ13857.1 |
| NV | p48 | BAE98193.1 | NV | p22 | ADK23786.1 | NV | p22 | BAJ13854.1 |
| NV | p48 | BAE98190.1 | NV | p22 | BAJ14016.1 | NV | p22 | BAJ13851.1 |
| NV | p48 | ABC96331.1 | NV | p22 | BAJ14013.1 | NV | p22 | BAJ13839.1 |
| NV | p22 | ADF45588.1 | NV | p22 | BAJ14010.1 | NV | p22 | BAJ13833.1 |
| NV | p22 | ADF32094.1 | NV | p22 | BAJ14007.1 | NV | p22 | BAJ13827.1 |
| NV | p22 | AAM81234.2 | NV | p22 | BAJ14001.1 | NV | p22 | BAJ13824.1 |
| NV | p22 | BAF38402.1 | NV | p22 | BAJ13998.1 | NV | p22 | BAJ13821.1 |
| NV | p22 | BAF38399.1 | NV | p22 | BAJ13995.1 | NV | p22 | BAJ13818.1 |
| NV | p22 | BAF38396.1 | NV | p22 | BAJ13992.1 | NV | p22 | BAJ13815.1 |
| NV | p22 | BAC98439.1 | NV | p22 | BAJ13989.1 | NV | p22 | BAJ13812.1 |
| NV | p22 | BAA96531.2 | NV | p22 | BAJ13986.1 | NV | p22 | BAJ13809.1 |
| NV | p22 | BAC11836.1 | NV | p22 | BAJ13983.1 | NV | p22 | BAJ13803.1 |
| NV | p22 | BAC11833.1 | NV | p22 | BAJ13977.1 | NV | p22 | BAJ13800.1 |
| NV | p22 | BAC11830.1 | NV | p22 | BAJ13974.1 | NV | p22 | BAJ13797.1 |
| NV | p22 | BAC11827.1 | NV | p22 | BAJ13971.1 | NV | p22 | BAJ13794.1 |
| NV | p22 | BAC11824.1 | NV | p22 | BAJ13968.1 | NV | p22 | BAJ13791.1 |
| NV | p22 | BAC11821.1 | NV | p22 | BAJ13965.1 | NV | p22 | BAJ13788.1 |
| NV | p22 | BAC11818.1 | NV | p22 | BAJ13956.1 | NV | p22 | BAJ13782.1 |
| NV | p22 | BAC11815.1 | NV | p22 | BAJ13953.1 | NV | p22 | BAJ13779.1 |
| NV | p22 | ACX31888.2 | NV | p22 | BAJ13950.1 | NV | p22 | BAJ13776.1 |
| NV | p22 | ACX31892.2 | NV | p22 | BAJ13947.1 | NV | p22 | BAJ13773.1 |
| NV | p22 | BAJ13752.1 | NV | p22 | BAJ13944.1 | NV | p22 | BAJ13770.1 |
| NV | p22 | BAJ13746.1 | NV | p22 | BAJ13941.1 | NV | p22 | BAJ13758.1 |
| NV | p22 | BAJ14004.1 | NV | p22 | BAJ13935.1 | NV | p22 | BAJ13755.1 |
| NV | p22 | BAJ13980.1 | NV | p22 | BAJ13932.1 | NV | p22 | BAJ13743.1 |
| NV | p22 | BAJ13962.1 | NV | p22 | BAJ13926.1 | NV | p22 | BAJ13740.1 |
| NV | p22 | BAJ13959.1 | NV | p22 | BAJ13923.1 | NV | p22 | BAJ13737.1 |
| NV | p22 | BAJ13938.1 | NV | p22 | BAJ13920.1 | NV | p22 | BAJ13734.1 |
| NV | p22 | BAJ13929.1 | NV | p22 | BAJ13917.1 | NV | p22 | BAJ13731.1 |
| NV | p22 | BAJ13878.1 | NV | p22 | BAJ13914.1 | NV | p22 | BAJ13728.1 |
| NV | p22 | BAJ13848.1 | NV | p22 | BAJ13911.1 | NV | p22 | BAJ13722.1 |
| NV | p22 | BAJ13845.1 | NV | p22 | BAJ13908.1 | NV | p22 | BAJ13719.1 |

FIG. 71-9

| Virus Protein Accession No. | Virus Protein Accession No. | Virus Protein Accession No. |
|---|---|---|
| NV p22 BAJ13716.1 | NV p22 BAJ13560.1 | NV p22 BAG70469.1 |
| NV p22 BAJ13713.1 | NV p22 BAJ13557.1 | NV p22 BAG70466.1 |
| NV p22 BAJ13710.1 | NV p22 BAJ13554.1 | NV p22 BAG70463.1 |
| NV p22 BAJ13707.1 | NV p22 BAJ13551.1 | NV p22 BAG70460.1 |
| NV p22 BAJ13704.1 | NV p22 BAJ13548.1 | NV p22 BAG70457.1 |
| NV p22 BAJ13701.1 | NV p22 BAJ13545.1 | NV p22 BAG70454.1 |
| NV p22 BAJ13698.1 | NV p22 BAJ13539.1 | NV p22 BAG70451.1 |
| NV p22 BAJ13695.1 | NV p22 BAJ13536.1 | NV p22 BAG70448.1 |
| NV p22 BAJ13692.1 | NV p22 BAJ13533.1 | NV p22 BAG70445.1 |
| NV p22 BAJ13689.1 | NV p22 BAJ13529.1 | NV p22 BAG70442.1 |
| NV p22 BAJ13686.1 | NV p22 BAJ13522.1 | NV p22 BAG70439.1 |
| NV p22 BAJ13683.1 | NV p22 BAJ13515.1 | NV p22 BAG70436.1 |
| NV p22 BAJ13680.1 | NV p22 AAB97767.2 | NV p22 BAG70433.1 |
| NV p22 BAJ13677.1 | NV p22 ADF47124.1 | NV p22 BAG70430.1 |
| NV p22 BAJ13674.1 | NV p22 ADE28700.1 | NV p22 BAG70427.1 |
| NV p22 BAJ13671.1 | NV p22 ACV32668.1 | NV p22 ABQ12780.1 |
| NV p22 BAJ13668.1 | NV p22 BAI70517.1 | NV p22 ABZ89548.1 |
| NV p22 BAJ13662.1 | NV p22 ACT76150.1 | NV p22 ABG49508.1 |
| NV p22 BAJ13659.1 | NV p22 ACT76147.1 | NV p22 ABD73935.1 |
| NV p22 BAJ13656.1 | NV p22 ACT76144.1 | NV p22 CAA60254.1 |
| NV p22 BAJ13653.1 | NV p22 ACT76141.1 | NV p22 ADK94753.1 |
| NV p22 BAJ13650.1 | NV p22 ACT76138.1 | NV p22 ADK94751.1 |
| NV p22 BAJ13647.1 | NV p22 ABQ12783.1 | NV p22 ADK94749.1 |
| NV p22 BAJ13644.1 | NV p22 AAR97662.1 | NV p22 ADF47130.1 |
| NV p22 BAJ13641.1 | NV p22 AAR97653.1 | NV p22 ADF47127.1 |
| NV p22 BAJ13638.1 | NV p22 ACL36374.1 | NV p22 ACX81344.2 |
| NV p22 BAJ13635.1 | NV p22 BAG70535.1 | NV p22 ABS12174.2 |
| NV p22 BAJ13632.1 | NV p22 BAG70532.1 | NV p22 ABE41640.1 |
| NV p22 BAJ13629.1 | NV p22 BAG70529.1 | NV p22 AAS47823.1 |
| NV p22 BAJ13626.1 | NV p22 BAG70526.1 | NV p22 BAG30938.1 |
| NV p22 BAJ13623.1 | NV p22 BAG70523.1 | NV p22 ABY27559.1 |
| NV p22 BAJ13620.1 | NV p22 BAG70520.1 | NV p22 BAE98196.1 |
| NV p22 BAJ13617.1 | NV p22 BAG70517.1 | NV p22 BAE98193.1 |
| NV p22 BAJ13614.1 | NV p22 BAG70514.1 | NV p22 BAE98190.1 |
| NV p22 BAJ13611.1 | NV p22 BAG70511.1 | NV p22 ABC96331.1 |
| NV p22 BAJ13605.1 | NV p22 BAG70508.1 | NV VP1 ADX99266.1 |
| NV p22 BAJ13602.1 | NV p22 BAG70505.1 | NV VP1 ADX99265.1 |
| NV p22 BAJ13599.1 | NV p22 BAG70502.1 | NV VP1 ADK22022.1 |
| NV p22 BAJ13596.1 | NV p22 BAG70499.1 | NV VP1 ADK22021.1 |
| NV p22 BAJ13593.1 | NV p22 BAG70496.1 | NV VP1 ADK22020.1 |
| NV p22 BAJ13590.1 | NV p22 BAG70493.1 | NV VP1 ADK22019.1 |
| NV p22 BAJ13587.1 | NV p22 BAG70490.1 | NV VP1 ADK22018.1 |
| NV p22 BAJ13581.1 | NV p22 BAG70487.1 | NV VP1 ADK22017.1 |
| NV p22 BAJ13578.1 | NV p22 BAG70484.1 | NV VP1 ADK22016.1 |
| NV p22 BAJ13575.1 | NV p22 BAG70481.1 | NV VP1 ADK22015.1 |
| NV p22 BAJ13572.1 | NV p22 BAG70478.1 | NV VP1 ADK22014.1 |
| NV p22 BAJ13569.1 | NV p22 BAG70475.1 | NV VP1 ADK22013.1 |
| NV p22 BAJ13566.1 | NV p22 BAG70472.1 | NV VP1 ADK22012.1 |

FIG. 71-10

| Virus Protein Accession No. | Virus Protein Accession No. | Virus Protein Accession No. |
|---|---|---|
| NV VP1 ADK22011.1 | NV VP1 ADU60021.1 | NV VP1 BAJ24976.1 |
| NV VP1 ADK22010.1 | NV VP1 ADU59996.1 | NV VP1 BAJ24975.1 |
| NV VP1 ADK22009.1 | NV VP1 ADU59987.1 | NV VP1 BAJ24974.1 |
| NV VP1 ADK22008.1 | NV VP1 ADU59986.1 | NV VP1 BAJ24973.1 |
| NV VP1 ADK22007.1 | NV VP1 ADU59984.1 | NV VP1 BAJ24972.1 |
| NV VP1 ADK22006.1 | NV VP1 ADU59983.1 | NV VP1 BAJ24971.1 |
| NV VP1 ADK22005.1 | NV VP1 ADU59982.1 | NV VP1 BAJ24970.1 |
| NV VP1 ADK22004.1 | NV VP1 ADU59981.1 | NV VP1 BAJ24969.1 |
| NV VP1 ADK22003.1 | NV VP1 ACJ04867.1 | NV VP1 BAJ24968.1 |
| NV VP1 ADK22002.1 | NV VP1 ACZ26235.1 | NV VP1 BAJ24967.1 |
| NV VP1 ADK22001.1 | NV VP1 ADH51675.1 | NV VP1 BAJ24966.1 |
| NV VP1 ADX60473.1 | NV VP1 ADH51674.1 | NV VP1 BAJ24965.1 |
| NV VP1 ADX60472.1 | NV VP1 ADH51672.1 | NV VP1 BAJ24964.1 |
| NV VP1 ADX60471.1 | NV VP1 ADH51671.1 | NV VP1 BAJ24963.1 |
| NV VP1 ADX60470.1 | NV VP1 ADH51670.1 | NV VP1 BAJ24962.1 |
| NV VP1 ADX60469.1 | NV VP1 ADH51667.1 | NV VP1 BAJ24961.1 |
| NV VP1 ADX60468.1 | NV VP1 ADH51666.1 | NV VP1 BAJ24960.1 |
| NV VP1 ADX60467.1 | NV VP1 ADH51665.1 | NV VP1 BAJ24959.1 |
| NV VP1 ADX60466.1 | NV VP1 ADH51664.1 | NV VP1 BAJ24958.1 |
| NV VP1 ADX60465.1 | NV VP1 ADQ53493.1 | NV VP1 BAJ24957.1 |
| NV VP1 ADX60464.1 | NV VP1 ADQ53492.1 | NV VP1 BAJ24956.1 |
| NV VP1 ADX60463.1 | NV VP1 ADQ53489.1 | NV VP1 BAJ24955.1 |
| NV VP1 ADX60462.1 | NV VP1 ADQ53488.1 | NV VP1 BAJ24954.1 |
| NV VP1 ADX60461.1 | NV VP1 ADN97072.1 | NV VP1 BAJ24953.1 |
| NV VP1 ADX60460.1 | NV VP1 ADN97071.1 | NV VP1 BAJ24952.1 |
| NV VP1 ADX60459.1 | NV VP1 ADN97070.1 | NV VP1 BAJ24951.1 |
| NV VP1 ADX60458.1 | NV VP1 ADN97069.1 | NV VP1 BAJ24950.1 |
| NV VP1 ADX60457.1 | NV VP1 ADN97057.1 | NV VP1 BAJ24949.1 |
| NV VP1 ADX60456.1 | NV VP1 BAJ24996.1 | NV VP1 BAJ24948.1 |
| NV VP1 ADU60032.1 | NV VP1 BAJ24995.1 | NV VP1 BAJ24947.1 |
| NV VP1 ADU60029.1 | NV VP1 BAJ24994.1 | NV VP1 BAJ24946.1 |
| NV VP1 ADU60023.1 | NV VP1 BAJ24993.1 | NV VP1 BAJ24945.1 |
| NV VP1 ADU60065.1 | NV VP1 BAJ24992.1 | NV VP1 BAJ24944.1 |
| NV VP1 ADU60064.1 | NV VP1 BAJ24991.1 | NV VP1 BAJ24943.1 |
| NV VP1 ADU60055.1 | NV VP1 BAJ24990.1 | NV VP1 BAJ24942.1 |
| NV VP1 ADU60054.1 | NV VP1 BAJ24989.1 | NV VP1 BAJ24941.1 |
| NV VP1 ADU60053.1 | NV VP1 BAJ24988.1 | NV VP1 BAJ24940.1 |
| NV VP1 ADU60052.1 | NV VP1 BAJ24987.1 | NV VP1 BAJ24939.1 |
| NV VP1 ADU60051.1 | NV VP1 BAJ24986.1 | NV VP1 BAJ24938.1 |
| NV VP1 ADU60050.1 | NV VP1 BAJ24985.1 | NV VP1 BAJ24937.1 |
| NV VP1 ADU60049.1 | NV VP1 BAJ24984.1 | NV VP1 BAJ24936.1 |
| NV VP1 ADU60031.1 | NV VP1 BAJ24983.1 | NV VP1 BAJ24935.1 |
| NV VP1 ADU60028.1 | NV VP1 BAJ24982.1 | NV VP1 BAJ24934.1 |
| NV VP1 ADU60027.1 | NV VP1 BAJ24981.1 | NV VP1 BAJ24933.1 |
| NV VP1 ADU60026.1 | NV VP1 BAJ24980.1 | NV VP1 BAJ24932.1 |
| NV VP1 ADU60025.1 | NV VP1 BAJ24979.1 | NV VP1 BAJ24931.1 |
| NV VP1 ADU60024.1 | NV VP1 BAJ24978.1 | NV VP1 BAJ24930.1 |
| NV VP1 ADU60022.1 | NV VP1 BAJ24977.1 | NV VP1 BAJ24929.1 |

FIG. 71-11

| Virus Protein Accession No. | Virus Protein Accession No. | Virus Protein Accession No. |
|---|---|---|
| NV VP1BAJ24928.1 | NV VP1BAJ25550.1 | NV VP1BAJ25224.1 |
| NV VP1BAJ24927.1 | NV VP1BAJ25540.1 | NV VP1BAJ25222.1 |
| NV VP1BAJ24926.1 | NV VP1BAJ25533.1 | NV VP1BAJ25210.1 |
| NV VP1BAJ24925.1 | NV VP1BAJ25529.1 | NV VP1BAJ25204.1 |
| NV VP1BAJ24924.1 | NV VP1BAJ25526.1 | NV VP1BAJ25202.1 |
| NV VP1BAJ24923.1 | NV VP1BAJ25518.1 | NV VP1BAJ25194.1 |
| NV VP1BAJ24922.1 | NV VP1BAJ25516.1 | NV VP1BAJ25191.1 |
| NV VP1BAJ24921.1 | NV VP1BAJ25514.1 | NV VP1BAJ25189.1 |
| NV VP1BAJ24920.1 | NV VP1BAJ25510.1 | NV VP1BAJ25186.1 |
| NV VP1BAJ24919.1 | NV VP1BAJ25474.1 | NV VP1BAJ25171.1 |
| NV VP1BAJ24918.1 | NV VP1BAJ25417.1 | NV VP1BAJ25169.1 |
| NV VP1BAJ24917.1 | NV VP1BAJ25399.1 | NV VP1BAJ25168.1 |
| NV VP1BAJ24916.1 | NV VP1BAJ25398.1 | NV VP1BAJ25161.1 |
| NV VP1BAJ24915.1 | NV VP1BAJ25391.1 | NV VP1BAJ25156.1 |
| NV VP1BAJ24914.1 | NV VP1BAJ25390.1 | NV VP1BAJ25154.1 |
| NV VP1BAJ24913.1 | NV VP1BAJ25389.1 | NV VP1BAJ25147.1 |
| NV VP1BAJ24912.1 | NV VP1BAJ25388.1 | NV VP1BAJ25133.1 |
| NV VP1BAJ24911.1 | NV VP1BAJ25385.1 | NV VP1BAJ25129.1 |
| NV VP1BAJ24910.1 | NV VP1BAJ25380.1 | NV VP1BAJ25122.1 |
| NV VP1BAJ24909.1 | NV VP1BAJ25378.1 | NV VP1BAJ25121.1 |
| NV VP1BAJ24908.1 | NV VP1BAJ25373.1 | NV VP1BAJ25118.1 |
| NV VP1BAJ24907.1 | NV VP1BAJ25370.1 | NV VP1BAJ25116.1 |
| NV VP1BAJ24906.1 | NV VP1BAJ25363.1 | NV VP1BAJ25113.1 |
| NV VP1BAJ24905.1 | NV VP1BAJ25354.1 | NV VP1BAJ25110.1 |
| NV VP1BAJ24904.1 | NV VP1BAJ25340.1 | NV VP1BAJ25096.1 |
| NV VP1BAJ24903.1 | NV VP1BAJ25332.1 | NV VP1BAJ25087.1 |
| NV VP1BAJ24902.1 | NV VP1BAJ25323.1 | NV VP1BAH23707.1 |
| NV VP1BAJ24901.1 | NV VP1BAJ25320.1 | NV VP1BAH23706.1 |
| NV VP1BAJ24900.1 | NV VP1BAJ25316.1 | NV VP1BAH23705.1 |
| NV VP1BAJ24899.1 | NV VP1BAJ25314.1 | NV VP1BAH23704.1 |
| NV VP1BAJ24898.1 | NV VP1BAJ25312.1 | NV VP1BAH23703.1 |
| NV VP1BAJ24897.1 | NV VP1BAJ25311.1 | NV VP1BAH23702.1 |
| NV VP1BAJ24896.1 | NV VP1BAJ25303.1 | NV VP1BAH23701.1 |
| NV VP1BAJ24895.1 | NV VP1BAJ25302.1 | NV VP1BAH23700.1 |
| NV VP1BAJ24894.1 | NV VP1BAJ25291.1 | NV VP1BAH23699.1 |
| NV VP1BAJ24893.1 | NV VP1BAJ25287.1 | NV VP1BAH23698.1 |
| NV VP1BAJ24892.1 | NV VP1BAJ25286.1 | NV VP1BAH23697.1 |
| NV VP1BAJ24891.1 | NV VP1BAJ25282.1 | NV VP1BAH23692.1 |
| NV VP1BAJ24890.1 | NV VP1BAJ25274.1 | NV VP1BAH23691.1 |
| NV VP1BAJ25607.1 | NV VP1BAJ25272.1 | NV VP1BAH23690.1 |
| NV VP1BAJ25597.1 | NV VP1BAJ25271.1 | NV VP1BAH23687.1 |
| NV VP1BAJ25589.1 | NV VP1BAJ25265.1 | NV VP1BAH23686.1 |
| NV VP1BAJ25585.1 | NV VP1BAJ25263.1 | NV VP1BAH23685.1 |
| NV VP1BAJ25584.1 | NV VP1BAJ25255.1 | NV VP1BAH23681.1 |
| NV VP1BAJ25581.1 | NV VP1BAJ25245.1 | NV VP1BAH23679.1 |
| NV VP1BAJ25580.1 | NV VP1BAJ25239.1 | NV VP1BAH23677.1 |
| NV VP1BAJ25556.1 | NV VP1BAJ25238.1 | NV VP1ADO20994.1 |
| NV VP1BAJ25552.1 | NV VP1BAJ25229.1 | NV VP1ADO20993.1 |

FIG. 71-12

| Virus Protein Accession No. | Virus Protein Accession No. | Virus Protein Accession No. |
|---|---|---|
| NV VP1ADO20992.1 | NV VP1ACY05131.1 | NV VP1ACY05083.1 |
| NV VP1AAA59233.1 | NV VP1ACY05130.1 | NV VP1ACY05082.1 |
| NV VP1ADE05542.1 | NV VP1ACY05129.1 | NV VP1ACY05081.1 |
| NV VP1ADE19336.1 | NV VP1ACY05128.1 | NV VP1ACY05080.1 |
| NV VP1ADE19335.1 | NV VP1ACY05127.1 | NV VP1ACY05079.1 |
| NV VP1ADE19334.1 | NV VP1ACY05126.1 | NV VP1ACY05078.1 |
| NV VP1ACL31301.1 | NV VP1ACY05125.1 | NV VP1ADH84019.1 |
| NV VP1ACY05172.1 | NV VP1ACY05124.1 | NV VP1ADH84018.1 |
| NV VP1ACY05171.1 | NV VP1ACY05123.1 | NV VP1ADH84017.1 |
| NV VP1ACY05170.1 | NV VP1ACY05122.1 | NV VP1ADH84016.1 |
| NV VP1ACY05169.1 | NV VP1ACY05121.1 | NV VP1BAI40056.1 |
| NV VP1ACY05168.1 | NV VP1ACY05120.1 | NV VP1BAI40050.1 |
| NV VP1ACY05167.1 | NV VP1ACY05119.1 | NV VP1BAI40044.1 |
| NV VP1ACY05166.1 | NV VP1ACY05118.1 | NV VP1BAI40042.1 |
| NV VP1ACY05165.1 | NV VP1ACY05117.1 | NV VP1BAI40036.1 |
| NV VP1ACY05164.1 | NV VP1ACY05116.1 | NV VP1BAI40034.1 |
| NV VP1ACY05163.1 | NV VP1ACY05115.1 | NV VP1BAI40030.1 |
| NV VP1ACY05162.1 | NV VP1ACY05114.1 | NV VP1BAI40024.1 |
| NV VP1ACY05161.1 | NV VP1ACY05113.1 | NV VP1BAI40016.1 |
| NV VP1ACY05160.1 | NV VP1ACY05112.1 | NV VP1ACF40318.1 |
| NV VP1ACY05159.1 | NV VP1ACY05111.1 | NV VP1ACF40317.1 |
| NV VP1ACY05158.1 | NV VP1ACY05110.1 | NV VP1ADG41742.1 |
| NV VP1ACY05157.1 | NV VP1ACY05109.1 | NV VP1ADG41741.1 |
| NV VP1ACY05156.1 | NV VP1ACY05108.1 | NV VP1ADG41740.1 |
| NV VP1ACY05155.1 | NV VP1ACY05107.1 | NV VP1ADF45586.1 |
| NV VP1ACY05154.1 | NV VP1ACY05106.1 | NV VP1ACV33066.1 |
| NV VP1ACY05153.1 | NV VP1ACY05105.1 | NV VP1ACV30026.1 |
| NV VP1ACY05152.1 | NV VP1ACY05104.1 | NV VP1ACV30025.1 |
| NV VP1ACY05151.1 | NV VP1ACY05103.1 | NV VP1ACV30024.1 |
| NV VP1ACY05150.1 | NV VP1ACY05102.1 | NV VP1ACV30023.1 |
| NV VP1ACY05149.1 | NV VP1ACY05101.1 | NV VP1ACV30022.1 |
| NV VP1ACY05148.1 | NV VP1ACY05100.1 | NV VP1ACV30021.1 |
| NV VP1ACY05147.1 | NV VP1ACY05099.1 | NV VP1ACV30020.1 |
| NV VP1ACY05146.1 | NV VP1ACY05098.1 | NV VP1ACV30019.1 |
| NV VP1ACY05145.1 | NV VP1ACY05097.1 | NV VP1ACV30018.1 |
| NV VP1ACY05144.1 | NV VP1ACY05096.1 | NV VP1ACV30017.1 |
| NV VP1ACY05143.1 | NV VP1ACY05095.1 | NV VP1ACV30016.1 |
| NV VP1ACY05142.1 | NV VP1ACY05094.1 | NV VP1ACL15084.1 |
| NV VP1ACY05141.1 | NV VP1ACY05093.1 | NV VP1ACL15083.1 |
| NV VP1ACY05140.1 | NV VP1ACY05092.1 | NV VP1ACL15082.1 |
| NV VP1ACY05139.1 | NV VP1ACY05091.1 | NV VP1ACL15081.1 |
| NV VP1ACY05138.1 | NV VP1ACY05090.1 | NV VP1ACL15080.1 |
| NV VP1ACY05137.1 | NV VP1ACY05089.1 | NV VP1ACL15079.1 |
| NV VP1ACY05136.1 | NV VP1ACY05088.1 | NV VP1ACL15078.1 |
| NV VP1ACY05135.1 | NV VP1ACY05087.1 | NV VP1ACL15077.1 |
| NV VP1ACY05134.1 | NV VP1ACY05086.1 | NV VP1ACL15076.1 |
| NV VP1ACY05133.1 | NV VP1ACY05085.1 | NV VP1ACL15075.1 |
| NV VP1ACY05132.1 | NV VP1ACY05084.1 | NV VP1ACL15074.1 |

FIG. 71-13

| Virus Protein Accession No. | Virus Protein Accession No. | Virus Protein Accession No. |
|---|---|---|
| NV VP1 ACL14979.1 | NV VP1 ACA23360.1 | NV VP1 ABP01857.1 |
| NV VP1 ACL14977.1 | NV VP1 ACA23359.1 | NV VP1 ABP01856.1 |
| NV VP1 ACL14975.1 | NV VP1 ACA23358.1 | NV VP1 ABP01855.1 |
| NV VP1 ACL14973.1 | NV VP1 ACA23357.1 | NV VP1 ABP01854.1 |
| NV VP1 ACL14970.1 | NV VP1 ACA23356.1 | NV VP1 ABP01853.1 |
| NV VP1 ACL14968.1 | NV VP1 ACA23355.1 | NV VP1 ABP01852.1 |
| NV VP1 ACL14966.1 | NV VP1 ACA23354.1 | NV VP1 ABP01851.1 |
| NV VP1 ACL14964.1 | NV VP1 ACA23353.1 | NV VP1 ABP01850.1 |
| NV VP1 ACL14962.1 | NV VP1 ACA23352.1 | NV VP1 ABP01849.1 |
| NV VP1 ACL14960.1 | NV VP1 ACA23351.1 | NV VP1 ABP01848.1 |
| NV VP1 ACL14958.1 | NV VP1 ACA23350.1 | NV VP1 ABP01847.1 |
| NV VP1 ACL14955.1 | NV VP1 ACA23349.1 | NV VP1 ABP01846.1 |
| NV VP1 ACL14953.1 | NV VP1 ACA23348.1 | NV VP1 ABP01845.1 |
| NV VP1 ACB71310.1 | NV VP1 ACA23347.1 | NV VP1 ABP01844.1 |
| NV VP1 ACB71309.1 | NV VP1 ACA23346.1 | NV VP1 ABP01843.1 |
| NV VP1 ACB71308.1 | NV VP1 ACA23345.1 | NV VP1 ABP01842.1 |
| NV VP1 ACB71307.1 | NV VP1 ACA23344.1 | NV VP1 ABP01841.1 |
| NV VP1 ACB71306.1 | NV VP1 ACA23343.1 | NV VP1 ABP01840.1 |
| NV VP1 ACB71305.1 | NV VP1 ACA23342.1 | NV VP1 ABP01837.1 |
| NV VP1 ACB71304.1 | NV VP1 ACA23341.1 | NV VP1 ABF71671.1 |
| NV VP1 ACB71303.1 | NV VP1 ACA23340.1 | NV VP1 ABF71670.1 |
| NV VP1 ACB71302.1 | NV VP1 ACA23339.1 | NV VP1 ABF71669.1 |
| NV VP1 ACB71301.1 | NV VP1 ACA23338.1 | NV VP1 ABF71668.1 |
| NV VP1 ACB71300.1 | NV VP1 ACA23337.1 | NV VP1 ABF71666.1 |
| NV VP1 ACB71299.1 | NV VP1 ACA23336.1 | NV VP1 ABF71665.1 |
| NV VP1 ACB71298.1 | NV VP1 ACA23335.1 | NV VP1 ABD64122.1 |
| NV VP1 ACB71297.1 | NV VP1 ACA23334.1 | NV VP1 ABD64121.1 |
| NV VP1 ACB71296.1 | NV VP1 ABW16666.1 | NV VP1 ABD64119.1 |
| NV VP1 ACB71295.1 | NV VP1 ABW16665.1 | NV VP1 ABD64117.1 |
| NV VP1 ACB71294.1 | NV VP1 ABW16664.1 | NV VP1 ABD64116.1 |
| NV VP1 ACB71293.1 | NV VP1 ABW16663.1 | NV VP1 ABD64115.1 |
| NV VP1 ACB71292.1 | NV VP1 ABW16662.1 | NV VP1 ABD64114.1 |
| NV VP1 ACB71291.1 | NV VP1 ABW16661.1 | NV VP1 ABD64112.1 |
| NV VP1 ACB71290.1 | NV VP1 ABP01872.1 | NV VP1 ABD64111.1 |
| NV VP1 ACB71289.1 | NV VP1 ABP01871.1 | NV VP1 ABD64109.1 |
| NV VP1 ACB71288.1 | NV VP1 ABP01870.1 | NV VP1 ABD64108.1 |
| NV VP1 ACB71287.1 | NV VP1 ABP01869.1 | NV VP1 ABD64107.1 |
| NV VP1 ACB71286.1 | NV VP1 ABP01868.1 | NV VP1 ABD64106.1 |
| NV VP1 ACB71285.1 | NV VP1 ABP01867.1 | NV VP1 ABD64105.1 |
| NV VP1 ACB71284.1 | NV VP1 ABP01866.1 | NV VP1 ABD64104.1 |
| NV VP1 ACB71283.1 | NV VP1 ABP01865.1 | NV VP1 ABD64103.1 |
| NV VP1 ACA23367.1 | NV VP1 ABP01864.1 | NV VP1 ABD64102.1 |
| NV VP1 ACA23366.1 | NV VP1 ABP01863.1 | NV VP1 ABD64101.1 |
| NV VP1 ACA23365.1 | NV VP1 ABP01862.1 | NV VP1 ABD64100.1 |
| NV VP1 ACA23364.1 | NV VP1 ABP01861.1 | NV VP1 ABD64099.1 |
| NV VP1 ACA23363.1 | NV VP1 ABP01860.1 | NV VP1 ABD64098.1 |
| NV VP1 ACA23362.1 | NV VP1 ABP01859.1 | NV VP1 ABD64097.1 |
| NV VP1 ACA23361.1 | NV VP1 ABP01858.1 | NV VP1 ABD64096.1 |

FIG. 71-14

| Virus Protein Accession No. | Virus Protein Accession No. | Virus Protein Accession No. |
|---|---|---|
| NV VP1ABD64095.1 | NV VP1ADB89906.1 | NV VP1ACO05122.1 |
| NV VP1ABD64094.1 | NV VP1ACZ92272.1 | NV VP1ACO05121.1 |
| NV VP1ABD64093.1 | NV VP1ABO15287.1 | NV VP1ACO05120.1 |
| NV VP1ABD64092.1 | NV VP1ABO15285.1 | NV VP1ACO05119.1 |
| NV VP1ABD64091.1 | NV VP1ABO15283.1 | NV VP1ACO05118.1 |
| NV VP1ABD64090.1 | NV VP1ABO15275.1 | NV VP1ACO05117.1 |
| NV VP1ABD64089.1 | NV VP1ACX33984.1 | NV VP1ACO05116.1 |
| NV VP1ABA43158.1 | NV VP1ABB81850.1 | NV VP1ACO05115.1 |
| NV VP1ABA43106.1 | NV VP1AAZ66777.1 | NV VP1ACO05114.1 |
| NV VP1ABA42201.1 | NV VP1AAZ66776.1 | NV VP1ACO05113.1 |
| NV VP1ABA42200.1 | NV VP1AAZ66774.1 | NV VP1ACO05112.1 |
| NV VP1ABA42199.1 | NV VP1AAZ66773.1 | NV VP1ACO05111.1 |
| NV VP1ABA42198.1 | NV VP1AAP82923.1 | NV VP1ACO05110.1 |
| NV VP1AAM56034.1 | NV VP1AAP82922.1 | NV VP1ACO05109.1 |
| NV VP1AAD40498.1 | NV VP1AAP82921.1 | NV VP1ACO05108.1 |
| NV VP1AAD40497.1 | NV VP1AAP82920.1 | NV VP1ACO05107.1 |
| NV VP1AAD40496.1 | NV VP1AAM81247.1 | NV VP1ACO05106.1 |
| NV VP1AAD40495.1 | NV VP1AAM81245.1 | NV VP1ACO05105.1 |
| NV VP1AAD40494.1 | NV VP1AAM81241.1 | NV VP1ACO05104.1 |
| NV VP1AAD40493.1 | NV VP1AAM81240.1 | NV VP1ACO05103.1 |
| NV VP1AAD40492.1 | NV VP1AAU10610.1 | NV VP1ACO05102.1 |
| NV VP1AAD40491.1 | NV VP1AAU10609.1 | NV VP1ACO05101.1 |
| NV VP1AAD40490.1 | NV VP1AAU10608.1 | NV VP1ACO05100.1 |
| NV VP1AAD40489.1 | NV VP1AAU10607.1 | NV VP1ACO05099.1 |
| NV VP1AAD40488.1 | NV VP1AAU10606.1 | NV VP1ACO05098.1 |
| NV VP1ACZ52643.2 | NV VP1AAU10605.1 | NV VP1ACO05097.1 |
| NV VP1BAH23696.1 | NV VP1AAU10604.1 | NV VP1ACO05096.1 |
| NV VP1BAH23695.1 | NV VP1AAU10603.1 | NV VP1ACO05095.1 |
| NV VP1BAH23694.1 | NV VP1AAU10602.1 | NV VP1ACO05094.1 |
| NV VP1BAH23693.1 | NV VP1AAU10601.1 | NV VP1ACO05093.1 |
| NV VP1BAH23689.1 | NV VP1AAT84350.1 | NV VP1ACO05092.1 |
| NV VP1BAH23688.1 | NV VP1AAT84349.1 | NV VP1ACO05091.1 |
| NV VP1BAH23684.1 | NV VP1AAT12445.1 | NV VP1ACO05090.1 |
| NV VP1BAH23683.1 | NV VP1AAQ63198.1 | NV VP1ACO05089.1 |
| NV VP1BAH23682.1 | NV VP1AAQ63197.1 | NV VP1ACO05088.1 |
| NV VP1BAH23680.1 | NV VP1AAQ63196.1 | NV VP1BAD88600.1 |
| NV VP1BAH23678.1 | NV VP1AAQ63195.1 | NV VP1BAD88599.1 |
| NV VP1ADB89917.1 | NV VP1AAQ63194.1 | NV VP1BAD88598.1 |
| NV VP1ADB89916.1 | NV VP1AAQ63193.1 | NV VP1BAD88597.1 |
| NV VP1ADB89915.1 | NV VP1AAQ63191.1 | NV VP1BAD88596.1 |
| NV VP1ADB89914.1 | NV VP1AAQ63190.1 | NV VP1BAD88595.1 |
| NV VP1ADB89913.1 | NV VP1AAQ63189.1 | NV VP1BAD88594.1 |
| NV VP1ADB89912.1 | NV VP1AAQ55822.1 | NV VP1BAD88593.1 |
| NV VP1ADB89911.1 | NV VP1AAQ55821.1 | NV VP1BAD88592.1 |
| NV VP1ADB89910.1 | NV VP1AAQ55820.1 | NV VP1BAD88591.1 |
| NV VP1ADB89909.1 | NV VP1AAQ55819.1 | NV VP1BAD88590.1 |
| NV VP1ADB89908.1 | NV VP1AAQ55818.1 | NV VP1BAD88589.1 |
| NV VP1ADB89907.1 | NV VP1AAQ55817.1 | NV VP1BAD88588.1 |

FIG. 71-15

| Virus | Protein | Accession No. | Virus | Protein | Accession No. | Virus | Protein | Accession No. |
|---|---|---|---|---|---|---|---|---|
| NV | VP1 | BAD88587.1 | NV | VP1 | BAF46185.1 | NV | VP1 | BAF81921.1 |
| NV | VP1 | BAD88586.1 | NV | VP1 | BAF46178.1 | NV | VP1 | BAF81920.1 |
| NV | VP1 | BAD88585.1 | NV | VP1 | BAF46177.1 | NV | VP1 | BAF81919.1 |
| NV | VP1 | BAD88584.1 | NV | VP1 | BAF46176.1 | NV | VP1 | BAF81918.1 |
| NV | VP1 | BAD88583.1 | NV | VP1 | BAF46153.1 | NV | VP1 | BAF81916.1 |
| NV | VP1 | BAD88582.1 | NV | VP1 | BAF46152.1 | NV | VP1 | BAF81915.1 |
| NV | VP1 | BAD88581.1 | NV | VP1 | BAF46148.1 | NV | VP1 | BAF81913.1 |
| NV | VP1 | BAD88580.1 | NV | VP1 | BAF46147.1 | NV | VP1 | BAF81911.1 |
| NV | VP1 | BAD88579.1 | NV | VP1 | BAF46146.1 | NV | VP1 | BAF81909.1 |
| NV | VP1 | BAD88578.1 | NV | VP1 | BAF46145.1 | NV | VP1 | BAF81908.1 |
| NV | VP1 | BAD88577.1 | NV | VP1 | BAF46143.1 | NV | VP1 | BAF81906.1 |
| NV | VP1 | BAD88576.1 | NV | VP1 | BAF46142.1 | NV | VP1 | BAF81905.1 |
| NV | VP1 | BAD88575.1 | NV | VP1 | BAF46141.1 | NV | VP1 | BAF81904.1 |
| NV | VP1 | BAD88574.1 | NV | VP1 | BAF46128.1 | NV | VP1 | BAD04009.1 |
| NV | VP1 | BAD88573.1 | NV | VP1 | BAC98461.1 | NV | VP1 | BAB85803.1 |
| NV | VP1 | BAD88572.1 | NV | VP1 | BAC98460.1 | NV | VP1 | BAB85801.1 |
| NV | VP1 | BAD88571.1 | NV | VP1 | BAC98459.1 | NV | VP1 | BAB85798.1 |
| NV | VP1 | BAD88570.1 | NV | VP1 | BAC98458.1 | NV | VP1 | BAB85792.1 |
| NV | VP1 | BAD88569.1 | NV | VP1 | BAC98457.1 | NV | VP1 | BAB85779.1 |
| NV | VP1 | BAD88568.1 | NV | VP1 | BAC98456.1 | NV | VP1 | BAB85769.1 |
| NV | VP1 | BAD88567.1 | NV | VP1 | BAC98455.1 | NV | VP1 | BAG31370.1 |
| NV | VP1 | BAD88566.1 | NV | VP1 | BAC98454.1 | NV | VP1 | ABX38908.1 |
| NV | VP1 | BAD88565.1 | NV | VP1 | BAC98453.1 | NV | VP1 | ABX38907.1 |
| NV | VP1 | BAD88564.1 | NV | VP1 | BAC98452.1 | NV | VP1 | ABO27810.1 |
| NV | VP1 | BAD88563.1 | NV | VP1 | BAC98451.1 | NV | VP1 | ABO27811.1 |
| NV | VP1 | BAD88562.1 | NV | VP1 | BAC98450.1 | NV | VP1 | BAF95472.1 |
| NV | VP1 | BAD88561.1 | NV | VP1 | BAC98449.1 | NV | VP1 | BAF95471.1 |
| NV | VP1 | BAD88560.1 | NV | VP1 | BAC98448.1 | NV | VP1 | BAF81957.1 |
| NV | VP1 | BAD88559.1 | NV | VP1 | BAC98447.1 | NV | VP1 | BAF81955.1 |
| NV | VP1 | BAD88555.1 | NV | VP1 | BAC98446.1 | NV | VP1 | ABR92757.1 |
| NV | VP1 | BAD88554.1 | NV | VP1 | BAC98445.1 | NV | VP1 | BAA35029.1 |
| NV | VP1 | BAD88553.1 | NV | VP1 | BAC98444.1 | NV | VP1 | BAA35018.1 |
| NV | VP1 | BAD88552.1 | NV | VP1 | BAC98443.1 | NV | VP1 | BAA35017.1 |
| NV | VP1 | BAD88551.1 | NV | VP1 | BAF81917.1 | NV | VP1 | BAA35015.1 |
| NV | VP1 | BAD88550.1 | NV | VP1 | BAF81914.1 | NV | VP1 | BAA35013.1 |
| NV | VP1 | BAF46200.1 | NV | VP1 | BAF81912.1 | NV | VP1 | BAB84185.1 |
| NV | VP1 | BAF46199.1 | NV | VP1 | BAF81910.1 | NV | VP1 | BAB84184.1 |
| NV | VP1 | BAF46198.1 | NV | VP1 | BAF81907.1 | NV | VP1 | BAB84183.1 |
| NV | VP1 | BAF46197.1 | NV | VP1 | BAF38403.1 | NV | VP1 | BAB84182.1 |
| NV | VP1 | BAF46196.1 | NV | VP1 | BAF46209.1 | NV | VP1 | BAB84181.1 |
| NV | VP1 | BAF46193.1 | NV | VP1 | BAF46206.1 | NV | VP1 | BAB84180.1 |
| NV | VP1 | BAF46192.1 | NV | VP1 | BAF38400.1 | NV | VP1 | BAB84179.1 |
| NV | VP1 | BAF46191.1 | NV | VP1 | BAF38397.1 | NV | VP1 | BAB84178.1 |
| NV | VP1 | BAF46190.1 | NV | VP1 | BAF38394.1 | NV | VP1 | BAB84177.1 |
| NV | VP1 | BAF46189.1 | NV | VP1 | BAD99211.1 | NV | VP1 | BAB84176.1 |
| NV | VP1 | BAF46188.1 | NV | VP1 | BAC98440.1 | NV | VP1 | BAB84166.1 |
| NV | VP1 | BAF46187.1 | NV | VP1 | BAF81923.1 | NV | VP1 | BAB84165.1 |
| NV | VP1 | BAF46186.1 | NV | VP1 | BAF81922.1 | NV | VP1 | BAB84164.1 |

FIG. 71-16

| Virus Protein Accession No. | Virus Protein Accession No. | Virus Protein Accession No. |
|---|---|---|
| NV VP1BAB84163.1 | NV VP1AAY41769.1 | NV VP1BAB68476.1 |
| NV VP1BAB84162.1 | NV VP1AAY41768.1 | NV VP1BAB68475.1 |
| NV VP1BAB84161.1 | NV VP1AAY41767.1 | NV VP1BAB68474.1 |
| NV VP1BAB84160.1 | NV VP1AAY41766.1 | NV VP1BAB68473.1 |
| NV VP1BAB84158.1 | NV VP1AAY41765.1 | NV VP1BAB68472.1 |
| NV VP1BAB84155.1 | NV VP1AAY41764.1 | NV VP1BAB68471.1 |
| NV VP1BAB84152.1 | NV VP1AAY41763.1 | NV VP1BAB68470.1 |
| NV VP1BAB84149.1 | NV VP1AAY41762.1 | NV VP1BAB68469.1 |
| NV VP1BAB84146.1 | NV VP1AAY41761.1 | NV VP1BAB68468.1 |
| NV VP1BAB84143.1 | NV VP1CAE47529.1 | NV VP1BAB68467.1 |
| NV VP1BAB84140.1 | NV VP1BAD20208.1 | NV VP1BAB68466.1 |
| NV VP1BAB84137.1 | NV VP1BAC97799.1 | NV VP1BAB68465.1 |
| NV VP1AAZ66775.1 | NV VP1BAC97798.1 | NV VP1BAB68464.1 |
| NV VP1CAH59631.1 | NV VP1BAB87781.1 | NV VP1BAB68463.1 |
| NV VP1CAH59630.1 | NV VP1BAB87778.1 | NV VP1BAB68462.1 |
| NV VP1CAH59629.1 | NV VP1BAB87777.1 | NV VP1BAB68461.1 |
| NV VP1CAH59628.1 | NV VP1BAB87776.1 | NV VP1BAB68460.1 |
| NV VP1CAH59627.1 | NV VP1BAB87760.1 | NV VP1BAB68459.1 |
| NV VP1CAH59626.1 | NV VP1BAB87759.1 | NV VP1BAB68458.1 |
| NV VP1CAH59625.1 | NV VP1BAB87758.1 | NV VP1BAB68457.1 |
| NV VP1CAH59624.1 | NV VP1BAB87756.1 | NV VP1BAB68456.1 |
| NV VP1CAH59623.1 | NV VP1BAB87755.1 | NV VP1BAB68450.1 |
| NV VP1CAH59622.1 | NV VP1BAB87753.1 | NV VP1BAB68449.1 |
| NV VP1CAH59620.1 | NV VP1BAB87752.1 | NV VP1BAB68448.1 |
| NV VP1AAY41805.1 | NV VP1BAB87750.1 | NV VP1BAB68447.1 |
| NV VP1AAY41804.1 | NV VP1BAB87749.1 | NV VP1BAB68446.1 |
| NV VP1AAY41802.1 | NV VP1BAB87747.1 | NV VP1BAB68445.1 |
| NV VP1AAY41801.1 | NV VP1BAB87741.1 | NV VP1BAB68444.1 |
| NV VP1AAY41800.1 | NV VP1BAB87740.1 | NV VP1BAB68443.1 |
| NV VP1AAY41788.1 | NV VP1BAB68499.1 | NV VP1BAB68442.1 |
| NV VP1AAY41787.1 | NV VP1BAB68498.1 | NV VP1BAB68441.1 |
| NV VP1AAY41786.1 | NV VP1BAB68497.1 | NV VP1BAB68440.1 |
| NV VP1AAY41785.1 | NV VP1BAB68496.1 | NV VP1BAB68439.1 |
| NV VP1AAY41784.1 | NV VP1BAB68495.1 | NV VP1BAB68438.1 |
| NV VP1AAY41783.1 | NV VP1BAB68494.1 | NV VP1BAB68437.1 |
| NV VP1AAY41782.1 | NV VP1BAB68493.1 | NV VP1BAB68436.1 |
| NV VP1AAY41781.1 | NV VP1BAB68492.1 | NV VP1BAB68435.1 |
| NV VP1AAY41780.1 | NV VP1BAB68491.1 | NV VP1BAB68434.1 |
| NV VP1AAY41779.1 | NV VP1BAB68490.1 | NV VP1BAB68433.1 |
| NV VP1AAY41778.1 | NV VP1BAB68489.1 | NV VP1BAB68432.1 |
| NV VP1AAY41777.1 | NV VP1BAB68488.1 | NV VP1BAB68431.1 |
| NV VP1AAY41776.1 | NV VP1BAB68486.1 | NV VP1BAB68430.1 |
| NV VP1AAY41775.1 | NV VP1BAB68485.1 | NV VP1BAB68429.1 |
| NV VP1AAY41774.1 | NV VP1BAB68484.1 | NV VP1BAB68428.1 |
| NV VP1AAY41773.1 | NV VP1BAB68483.1 | NV VP1BAB68427.1 |
| NV VP1AAY41772.1 | NV VP1BAB68482.1 | NV VP1BAB68426.1 |
| NV VP1AAY41771.1 | NV VP1BAB68481.1 | NV VP1BAB68425.1 |
| NV VP1AAY41770.1 | NV VP1BAB68479.1 | NV VP1BAB68424.1 |

FIG. 71-17

| Virus Protein Accession No. | Virus Protein Accession No. | Virus Protein Accession No. |
|---|---|---|
| NV VP1BAB68423.1 | NV VP1ADV59766.1 | NV VP1ADV37905.1 |
| NV VP1BAB68422.1 | NV VP1ADV59765.1 | NV VP1ADV37903.1 |
| NV VP1BAB68421.1 | NV VP1ADV59764.1 | NV VP1ADV37901.1 |
| NV VP1BAB68420.1 | NV VP1ADV59763.1 | NV VP1ADV37899.1 |
| NV VP1BAB68419.1 | NV VP1ADV59762.1 | NV VP1ADV37897.1 |
| NV VP1BAB68418.1 | NV VP1ADV59761.1 | NV VP1ADV37895.1 |
| NV VP1BAB68417.1 | NV VP1ADV59760.1 | NV VP1ADV37893.1 |
| NV VP1BAB68416.1 | NV VP1ADV59759.1 | NV VP1ADV37891.1 |
| NV VP1BAB68415.1 | NV VP1ADV59758.1 | NV VP1ADV37889.1 |
| NV VP1BAB68414.1 | NV VP1ADV59757.1 | NV VP1ADV37887.1 |
| NV VP1BAB68413.1 | NV VP1ADV59756.1 | NV VP1ADV37885.1 |
| NV VP1BAB68412.1 | NV VP1ADV59755.1 | NV VP1ADV37883.1 |
| NV VP1BAA89029.2 | NV VP1ADV59754.1 | NV VP1ADV37881.1 |
| NV VP1BAC11837.1 | NV VP1ADV59753.1 | NV VP1ADV37879.1 |
| NV VP1BAC11834.1 | NV VP1ADV59752.1 | NV VP1ADV37877.1 |
| NV VP1BAC11831.1 | NV VP1ADV59751.1 | NV VP1ADV37875.1 |
| NV VP1BAC11828.1 | NV VP1ADV59750.1 | NV VP1ADV37873.1 |
| NV VP1BAC11825.1 | NV VP1ADV59749.1 | NV VP1ADV37871.1 |
| NV VP1BAC11822.1 | NV VP1ADV59748.1 | NV VP1ADV37869.1 |
| NV VP1BAC11819.1 | NV VP1ADV59747.1 | NV VP1ADV37867.1 |
| NV VP1BAC11816.1 | NV VP1ADV59746.1 | NV VP1ADV37865.1 |
| NV VP1BAC05518.1 | NV VP1ADV59745.1 | NV VP1ADV37863.1 |
| NV VP1BAC05517.1 | NV VP1ADV59744.1 | NV VP1ADV37861.1 |
| NV VP1BAC05515.1 | NV VP1ADV59743.1 | NV VP1ADV37859.1 |
| NV VP1BAA89030.1 | NV VP1ADV59742.1 | NV VP1ADV37857.1 |
| NV VP1BAA89028.1 | NV VP1ADV59741.1 | NV VP1ADV37855.1 |
| NV VP1ADK22047.1 | NV VP1ADV59740.1 | NV VP1ADV37853.1 |
| NV VP1ADK22046.1 | NV VP1ADV59739.1 | NV VP1ADV37851.1 |
| NV VP1ADK22039.1 | NV VP1ADV59738.1 | NV VP1ADV37849.1 |
| NV VP1ADK22038.1 | NV VP1ADV37943.1 | NV VP1ADV37847.1 |
| NV VP1ADK22035.1 | NV VP1ADV37941.1 | NV VP1ADV37845.1 |
| NV VP1ADK22034.1 | NV VP1ADV37939.1 | NV VP1ADV37843.1 |
| NV VP1ADK22033.1 | NV VP1ADV37937.1 | NV VP1ADV37841.1 |
| NV VP1ADK22032.1 | NV VP1ADV37935.1 | NV VP1ADV37839.1 |
| NV VP1ADK22028.1 | NV VP1ADV37933.1 | NV VP1ADV37837.1 |
| NV VP1ADX60494.1 | NV VP1ADV37931.1 | NV VP1ADV37834.1 |
| NV VP1ADX60493.1 | NV VP1ADV37929.1 | NV VP1ADV37833.1 |
| NV VP1ADX60492.1 | NV VP1ADV37927.1 | NV VP1ADV37831.1 |
| NV VP1ADX60491.1 | NV VP1ADV37925.1 | NV VP1ADV37829.1 |
| NV VP1ADX60490.1 | NV VP1ADV37923.1 | NV VP1ADV37827.1 |
| NV VP1ADX60484.1 | NV VP1ADV37921.1 | NV VP1ADV37821.1 |
| NV VP1ADX60481.1 | NV VP1ADV37919.1 | NV VP1ADV37819.1 |
| NV VP1CBX26415.1 | NV VP1ADV37917.1 | NV VP1ADV37817.1 |
| NV VP1CBX26414.1 | NV VP1ADV37915.1 | NV VP1ADV37815.1 |
| NV VP1ADV59770.1 | NV VP1ADV37913.1 | NV VP1ADV37813.1 |
| NV VP1ADV59769.1 | NV VP1ADV37911.1 | NV VP1ADV37811.1 |
| NV VP1ADV59768.1 | NV VP1ADV37909.1 | NV VP1ADV37809.1 |
| NV VP1ADV59767.1 | NV VP1ADV37907.1 | NV VP1ADV37807.1 |

FIG. 71-18

| Virus Protein Accession No. | Virus Protein Accession No. | Virus Protein Accession No. |
|---|---|---|
| NV VP1ADV37805.1 | NV VP1BAJ53323.1 | NV VP1ADR78950.1 |
| NV VP1ADV37803.1 | NV VP1BAJ53322.1 | NV VP1ADR78947.1 |
| NV VP1ADV37801.1 | NV VP1BAJ53319.1 | NV VP1ADR78944.1 |
| NV VP1ADV37799.1 | NV VP1BAJ53318.1 | NV VP1ADR78941.1 |
| NV VP1ADV37797.1 | NV VP1BAJ53317.1 | NV VP1ADR78938.1 |
| NV VP1ADV37795.1 | NV VP1BAJ53316.1 | NV VP1ADR78935.1 |
| NV VP1ADV37793.1 | NV VP1BAJ53315.1 | NV VP1ADR78932.1 |
| NV VP1ADV37791.1 | NV VP1BAJ53314.1 | NV VP1ADR78929.1 |
| NV VP1ADV37789.1 | NV VP1ACJ04879.1 | NV VP1ADR78926.1 |
| NV VP1ADV37787.1 | NV VP1ACJ04878.1 | NV VP1ADR78923.1 |
| NV VP1ADV37785.1 | NV VP1ACJ04857.1 | NV VP1ADR78920.1 |
| NV VP1ADV37783.1 | NV VP1ACJ04852.1 | NV VP1ADR78917.1 |
| NV VP1ADV37781.1 | NV VP1ACJ04851.1 | NV VP1ADR78914.1 |
| NV VP1ADV37779.1 | NV VP1ACJ04850.1 | NV VP1ADR78911.1 |
| NV VP1ADV37777.1 | NV VP1ADT92165.2 | NV VP1ADR78908.1 |
| NV VP1ADU60047.1 | NV VP1ADT92185.1 | NV VP1ADR78905.1 |
| NV VP1ADU60019.1 | NV VP1ADT92184.1 | NV VP1ADR78902.1 |
| NV VP1ADU60017.1 | NV VP1ADT92183.1 | NV VP1ADR78899.1 |
| NV VP1ADU60016.1 | NV VP1ADT92182.1 | NV VP1ADR78896.1 |
| NV VP1ADU60015.1 | NV VP1ADT92181.1 | NV VP1ADR78893.1 |
| NV VP1ADU60014.1 | NV VP1ADT92180.1 | NV VP1ADR78890.1 |
| NV VP1ADU60013.1 | NV VP1ADT92179.1 | NV VP1ADR78887.1 |
| NV VP1ADU60010.1 | NV VP1ADT92178.1 | NV VP1ADR78884.1 |
| NV VP1ADU60002.1 | NV VP1ADT92177.1 | NV VP1ADR78881.1 |
| NV VP1ADU59997.1 | NV VP1ADT92176.1 | NV VP1ADR78878.1 |
| NV VP1ADU60063.1 | NV VP1ADT92175.1 | NV VP1ADR78875.1 |
| NV VP1ADU60062.1 | NV VP1ADT92174.1 | NV VP1ADR78872.1 |
| NV VP1ADU60061.1 | NV VP1ADT92173.1 | NV VP1ADR78869.1 |
| NV VP1ADU60060.1 | NV VP1ADT92172.1 | NV VP1ADR78866.1 |
| NV VP1ADU60059.1 | NV VP1ADT92171.1 | NV VP1ADR57236.1 |
| NV VP1ADU60058.1 | NV VP1ADT92170.1 | NV VP1ADR57235.1 |
| NV VP1ADU60057.1 | NV VP1ADT92169.1 | NV VP1ADR57234.1 |
| NV VP1ADU60056.1 | NV VP1ADT92168.1 | NV VP1ADR57233.1 |
| NV VP1ADU60048.1 | NV VP1ADT92167.1 | NV VP1BAJ19466.1 |
| NV VP1ADU60046.1 | NV VP1ADT92166.1 | NV VP1BAJ19464.1 |
| NV VP1ADU60045.1 | NV VP1ADT92164.1 | NV VP1BAJ19462.1 |
| NV VP1ADU60044.1 | NV VP1ADT92163.1 | NV VP1BAJ19460.1 |
| NV VP1ADU60034.1 | NV VP1ADT92162.1 | NV VP1BAJ19458.1 |
| NV VP1ADU60033.1 | NV VP1ADT92161.1 | NV VP1BAJ19456.1 |
| NV VP1ADU60020.1 | NV VP1ADT92160.1 | NV VP1BAJ19454.1 |
| NV VP1ADU60018.1 | NV VP1ADT92159.1 | NV VP1ADR30514.1 |
| NV VP1ADU60012.1 | NV VP1ADT92158.1 | NV VP1ADR30500.1 |
| NV VP1ADU60011.1 | NV VP1ADT92157.1 | NV VP1ADR30499.1 |
| NV VP1ADU60005.1 | NV VP1ACC69028.1 | NV VP1ADR30498.1 |
| NV VP1ADU60000.1 | NV VP1ACC69026.1 | NV VP1ADR30497.1 |
| NV VP1ADU59998.1 | NV VP1ACC69023.1 | NV VP1ADR30496.1 |
| NV VP1BAH23756.1 | NV VP1ADR78956.1 | NV VP1ACX31841.2 |
| NV VP1BAJ53334.1 | NV VP1ADR78953.1 | NV VP1ACZ26240.1 |

FIG. 71-19

| Virus Protein Accession No. | Virus Protein Accession No. | Virus Protein Accession No. |
|---|---|---|
| NV VP1ACZ26238.1 | NV VP1ACT09068.1 | NV VP1BAJ25051.1 |
| NV VP1ACZ26237.1 | NV VP1ACT09067.1 | NV VP1BAJ25050.1 |
| NV VP1ACZ26236.1 | NV VP1ADQ53490.1 | NV VP1BAJ25048.1 |
| NV VP1ACX85810.1 | NV VP1ADQ53487.1 | NV VP1BAJ25047.1 |
| NV VP1ACX85809.1 | NV VP1ADQ53486.1 | NV VP1BAJ25046.1 |
| NV VP1ACX85808.1 | NV VP1ADQ53485.1 | NV VP1BAJ25045.1 |
| NV VP1ACX85807.1 | NV VP1ADQ53484.1 | NV VP1BAJ25044.1 |
| NV VP1ACX85806.1 | NV VP1ADQ48133.1 | NV VP1BAJ25043.1 |
| NV VP1ACX31893.1 | NV VP1ADQ48132.1 | NV VP1BAJ25042.1 |
| NV VP1ACX31891.1 | NV VP1ADQ48131.1 | NV VP1BAJ25041.1 |
| NV VP1ACX31889.1 | NV VP1ADQ48130.1 | NV VP1BAJ25040.1 |
| NV VP1ACX31887.1 | NV VP1ADQ48129.1 | NV VP1BAJ25039.1 |
| NV VP1ACX31885.1 | NV VP1ADQ43783.1 | NV VP1BAJ25038.1 |
| NV VP1ACX31884.1 | NV VP1ADQ43781.1 | NV VP1BAJ25035.1 |
| NV VP1ACX31883.1 | NV VP1ADQ43779.1 | NV VP1BAJ25033.1 |
| NV VP1ACX31882.1 | NV VP1ADN97068.1 | NV VP1BAJ25032.1 |
| NV VP1ACX31881.1 | NV VP1ADN97067.1 | NV VP1BAJ25031.1 |
| NV VP1ACX31880.1 | NV VP1ADN97066.1 | NV VP1BAJ25030.1 |
| NV VP1ACX31879.1 | NV VP1ADN97065.1 | NV VP1BAJ25029.1 |
| NV VP1ACX31878.1 | NV VP1ADN97064.1 | NV VP1BAJ25028.1 |
| NV VP1ACX31877.1 | NV VP1ADN97063.1 | NV VP1BAJ25027.1 |
| NV VP1ACX31876.1 | NV VP1ADN97062.1 | NV VP1BAJ25026.1 |
| NV VP1ACX31875.1 | NV VP1ADN97061.1 | NV VP1BAJ25023.1 |
| NV VP1ACW19927.1 | NV VP1ACF41191.1 | NV VP1BAJ25022.1 |
| NV VP1BAJ13753.1 | NV VP1ACF41190.1 | NV VP1BAJ25021.1 |
| NV VP1BAJ13747.1 | NV VP1ACF41189.1 | NV VP1BAJ25020.1 |
| NV VP1ADQ57405.1 | NV VP1ACF41188.1 | NV VP1BAJ25019.1 |
| NV VP1ADQ57404.1 | NV VP1ACF41187.1 | NV VP1BAJ25017.1 |
| NV VP1ADQ57403.1 | NV VP1ACF41186.1 | NV VP1BAJ25016.1 |
| NV VP1ADQ57402.1 | NV VP1ACF41185.1 | NV VP1BAJ25015.1 |
| NV VP1ADQ57401.1 | NV VP1ACF41184.1 | NV VP1BAJ25014.1 |
| NV VP1ADQ57400.1 | NV VP1ACF41183.1 | NV VP1BAJ25013.1 |
| NV VP1ADQ57399.1 | NV VP1ACF41182.1 | NV VP1BAJ25011.1 |
| NV VP1ADQ57398.1 | NV VP1ACF41181.1 | NV VP1BAJ25009.1 |
| NV VP1ADQ57397.1 | NV VP1ACF41180.1 | NV VP1BAJ25007.1 |
| NV VP1ADQ57396.1 | NV VP1ACF41179.1 | NV VP1BAJ25005.1 |
| NV VP1ADQ57395.1 | NV VP1ACF41178.1 | NV VP1BAJ25004.1 |
| NV VP1ADQ57394.1 | NV VP1ACF41177.1 | NV VP1BAJ25622.1 |
| NV VP1ADQ57393.1 | NV VP1ACB56491.1 | NV VP1BAJ25621.1 |
| NV VP1ADQ57392.1 | NV VP1ACB56490.1 | NV VP1BAJ25620.1 |
| NV VP1ADQ57391.1 | NV VP1ACB56489.1 | NV VP1BAJ25618.1 |
| NV VP1ADQ57390.1 | NV VP1ADP92340.1 | NV VP1BAJ25617.1 |
| NV VP1ADQ57389.1 | NV VP1BAJ25058.1 | NV VP1BAJ25615.1 |
| NV VP1ADQ57388.1 | NV VP1BAJ25057.1 | NV VP1BAJ25614.1 |
| NV VP1ACT09072.1 | NV VP1BAJ25056.1 | NV VP1BAJ25611.1 |
| NV VP1ACT09071.1 | NV VP1BAJ25055.1 | NV VP1BAJ25605.1 |
| NV VP1ACT09070.1 | NV VP1BAJ25054.1 | NV VP1BAJ25604.1 |
| NV VP1ACT09069.1 | NV VP1BAJ25053.1 | NV VP1BAJ25601.1 |

FIG. 71-20

| Virus Protein Accession No. | Virus Protein Accession No. | Virus Protein Accession No. |
|---|---|---|
| NV VP1BAJ25600.1 | NV VP1BAJ25386.1 | NV VP1BAJ25273.1 |
| NV VP1BAJ25596.1 | NV VP1BAJ25383.1 | NV VP1BAJ25270.1 |
| NV VP1BAJ25595.1 | NV VP1BAJ25381.1 | NV VP1BAJ25269.1 |
| NV VP1BAJ25594.1 | NV VP1BAJ25376.1 | NV VP1BAJ25266.1 |
| NV VP1BAJ25593.1 | NV VP1BAJ25375.1 | NV VP1BAJ25261.1 |
| NV VP1BAJ25588.1 | NV VP1BAJ25374.1 | NV VP1BAJ25259.1 |
| NV VP1BAJ25586.1 | NV VP1BAJ25372.1 | NV VP1BAJ25256.1 |
| NV VP1BAJ25578.1 | NV VP1BAJ25371.1 | NV VP1BAJ25254.1 |
| NV VP1BAJ25570.1 | NV VP1BAJ25369.1 | NV VP1BAJ25250.1 |
| NV VP1BAJ25564.1 | NV VP1BAJ25368.1 | NV VP1BAJ25248.1 |
| NV VP1BAJ25561.1 | NV VP1BAJ25367.1 | NV VP1BAJ25247.1 |
| NV VP1BAJ25559.1 | NV VP1BAJ25366.1 | NV VP1BAJ25246.1 |
| NV VP1BAJ25558.1 | NV VP1BAJ25361.1 | NV VP1BAJ25244.1 |
| NV VP1BAJ25557.1 | NV VP1BAJ25358.1 | NV VP1BAJ25243.1 |
| NV VP1BAJ25555.1 | NV VP1BAJ25353.1 | NV VP1BAJ25241.1 |
| NV VP1BAJ25554.1 | NV VP1BAJ25352.1 | NV VP1BAJ25237.1 |
| NV VP1BAJ25551.1 | NV VP1BAJ25351.1 | NV VP1BAJ25236.1 |
| NV VP1BAJ25546.1 | NV VP1BAJ25349.1 | NV VP1BAJ25235.1 |
| NV VP1BAJ25545.1 | NV VP1BAJ25348.1 | NV VP1BAJ25234.1 |
| NV VP1BAJ25544.1 | NV VP1BAJ25347.1 | NV VP1BAJ25232.1 |
| NV VP1BAJ25543.1 | NV VP1BAJ25346.1 | NV VP1BAJ25231.1 |
| NV VP1BAJ25541.1 | NV VP1BAJ25345.1 | NV VP1BAJ25230.1 |
| NV VP1BAJ25536.1 | NV VP1BAJ25343.1 | NV VP1BAJ25228.1 |
| NV VP1BAJ25535.1 | NV VP1BAJ25342.1 | NV VP1BAJ25227.1 |
| NV VP1BAJ25532.1 | NV VP1BAJ25341.1 | NV VP1BAJ25226.1 |
| NV VP1BAJ25527.1 | NV VP1BAJ25339.1 | NV VP1BAJ25225.1 |
| NV VP1BAJ25523.1 | NV VP1BAJ25338.1 | NV VP1BAJ25223.1 |
| NV VP1BAJ25520.1 | NV VP1BAJ25337.1 | NV VP1BAJ25221.1 |
| NV VP1BAJ25515.1 | NV VP1BAJ25333.1 | NV VP1BAJ25220.1 |
| NV VP1BAJ25511.1 | NV VP1BAJ25326.1 | NV VP1BAJ25219.1 |
| NV VP1BAJ25508.1 | NV VP1BAJ25324.1 | NV VP1BAJ25218.1 |
| NV VP1BAJ25499.1 | NV VP1BAJ25322.1 | NV VP1BAJ25217.1 |
| NV VP1BAJ25490.1 | NV VP1BAJ25321.1 | NV VP1BAJ25216.1 |
| NV VP1BAJ25486.1 | NV VP1BAJ25317.1 | NV VP1BAJ25215.1 |
| NV VP1BAJ25420.1 | NV VP1BAJ25315.1 | NV VP1BAJ25214.1 |
| NV VP1BAJ25416.1 | NV VP1BAJ25313.1 | NV VP1BAJ25213.1 |
| NV VP1BAJ25412.1 | NV VP1BAJ25310.1 | NV VP1BAJ25212.1 |
| NV VP1BAJ25409.1 | NV VP1BAJ25307.1 | NV VP1BAJ25211.1 |
| NV VP1BAJ25408.1 | NV VP1BAJ25305.1 | NV VP1BAJ25209.1 |
| NV VP1BAJ25405.1 | NV VP1BAJ25301.1 | NV VP1BAJ25208.1 |
| NV VP1BAJ25401.1 | NV VP1BAJ25298.1 | NV VP1BAJ25207.1 |
| NV VP1BAJ25397.1 | NV VP1BAJ25292.1 | NV VP1BAJ25205.1 |
| NV VP1BAJ25396.1 | NV VP1BAJ25289.1 | NV VP1BAJ25203.1 |
| NV VP1BAJ25395.1 | NV VP1BAJ25288.1 | NV VP1BAJ25201.1 |
| NV VP1BAJ25394.1 | NV VP1BAJ25284.1 | NV VP1BAJ25198.1 |
| NV VP1BAJ25393.1 | NV VP1BAJ25279.1 | NV VP1BAJ25197.1 |
| NV VP1BAJ25392.1 | NV VP1BAJ25277.1 | NV VP1BAJ25196.1 |
| NV VP1BAJ25387.1 | NV VP1BAJ25275.1 | NV VP1BAJ25195.1 |

FIG. 71-21

| Virus Protein Accession No. | Virus Protein Accession No. | Virus Protein Accession No. |
|---|---|---|
| NV VP1BAJ25193.1 | NV VP1BAJ25123.1 | NV VP1ADP24677.1 |
| NV VP1BAJ25192.1 | NV VP1BAJ25120.1 | NV VP1ADP24676.1 |
| NV VP1BAJ25190.1 | NV VP1BAJ25119.1 | NV VP1ADP24675.1 |
| NV VP1BAJ25188.1 | NV VP1BAJ25117.1 | NV VP1ADP24674.1 |
| NV VP1BAJ25187.1 | NV VP1BAJ25115.1 | NV VP1ADP24673.1 |
| NV VP1BAJ25185.1 | NV VP1BAJ25114.1 | NV VP1ADP24672.1 |
| NV VP1BAJ25184.1 | NV VP1BAJ25112.1 | NV VP1ADP24671.1 |
| NV VP1BAJ25183.1 | NV VP1BAJ25111.1 | NV VP1ADP24670.1 |
| NV VP1BAJ25182.1 | NV VP1BAJ25109.1 | NV VP1ADP24669.1 |
| NV VP1BAJ25181.1 | NV VP1BAJ25108.1 | NV VP1ADP24668.1 |
| NV VP1BAJ25180.1 | NV VP1BAJ25107.1 | NV VP1ADP24667.1 |
| NV VP1BAJ25179.1 | NV VP1BAJ25106.1 | NV VP1ADP24666.1 |
| NV VP1BAJ25178.1 | NV VP1BAJ25105.1 | NV VP1ADP24665.1 |
| NV VP1BAJ25176.1 | NV VP1BAJ25104.1 | NV VP1ADP24664.1 |
| NV VP1BAJ25174.1 | NV VP1BAJ25103.1 | NV VP1ADP24663.1 |
| NV VP1BAJ25172.1 | NV VP1BAJ25102.1 | NV VP1ADP24662.1 |
| NV VP1BAJ25170.1 | NV VP1BAJ25101.1 | NV VP1ADP24661.1 |
| NV VP1BAJ25167.1 | NV VP1BAJ25100.1 | NV VP1ADP24660.1 |
| NV VP1BAJ25166.1 | NV VP1BAJ25099.1 | NV VP1ADP24659.1 |
| NV VP1BAJ25165.1 | NV VP1BAJ25098.1 | NV VP1ADP24658.1 |
| NV VP1BAJ25164.1 | NV VP1BAJ25097.1 | NV VP1ADP24657.1 |
| NV VP1BAJ25163.1 | NV VP1BAJ25095.1 | NV VP1ADP24656.1 |
| NV VP1BAJ25160.1 | NV VP1BAJ25094.1 | NV VP1ADP24655.1 |
| NV VP1BAJ25159.1 | NV VP1BAJ25093.1 | NV VP1ADP24654.1 |
| NV VP1BAJ25157.1 | NV VP1BAJ25092.1 | NV VP1ADP24653.1 |
| NV VP1BAJ25155.1 | NV VP1BAJ25091.1 | NV VP1ADP24652.1 |
| NV VP1BAJ25153.1 | NV VP1BAJ25090.1 | NV VP1ADP24651.1 |
| NV VP1BAJ25152.1 | NV VP1BAJ25089.1 | NV VP1ADP24650.1 |
| NV VP1BAJ25151.1 | NV VP1BAJ25088.1 | NV VP1ADP24649.1 |
| NV VP1BAJ25150.1 | NV VP1BAJ25086.1 | NV VP1ADP24648.1 |
| NV VP1BAJ25149.1 | NV VP1BAJ25085.1 | NV VP1ADP24647.1 |
| NV VP1BAJ25148.1 | NV VP1BAJ25083.1 | NV VP1ADP24646.1 |
| NV VP1BAJ25146.1 | NV VP1BAJ25082.1 | NV VP1ADP24645.1 |
| NV VP1BAJ25145.1 | NV VP1BAJ25080.1 | NV VP1ADP24644.1 |
| NV VP1BAJ25143.1 | NV VP1BAJ25079.1 | NV VP1ADP24643.1 |
| NV VP1BAJ25142.1 | NV VP1BAJ25078.1 | NV VP1ADP24642.1 |
| NV VP1BAJ25141.1 | NV VP1BAJ25077.1 | NV VP1ADP24641.1 |
| NV VP1BAJ25139.1 | NV VP1BAJ25067.1 | NV VP1ADP24640.1 |
| NV VP1BAJ25138.1 | NV VP1BAJ25066.1 | NV VP1ADP24639.1 |
| NV VP1BAJ25137.1 | NV VP1BAJ25065.1 | NV VP1ADP24638.1 |
| NV VP1BAJ25136.1 | NV VP1BAH23752.1 | NV VP1ADP24637.1 |
| NV VP1BAJ25135.1 | NV VP1ADP24684.1 | NV VP1ADP24636.1 |
| NV VP1BAJ25132.1 | NV VP1ADP24683.1 | NV VP1ADP24635.1 |
| NV VP1BAJ25131.1 | NV VP1ADP24682.1 | NV VP1ADP24634.1 |
| NV VP1BAJ25130.1 | NV VP1ADP24681.1 | NV VP1ADP24633.1 |
| NV VP1BAJ25128.1 | NV VP1ADP24680.1 | NV VP1ADP24632.1 |
| NV VP1BAJ25126.1 | NV VP1ADP24679.1 | NV VP1ADP24631.1 |
| NV VP1BAJ25125.1 | NV VP1ADP24678.1 | NV VP1ADP24630.1 |

FIG. 71-22

| Virus Protein Accession No. | Virus Protein Accession No. | Virus Protein Accession No. |
|---|---|---|
| NV VP1ADP24629.1 | NV VP1ACY00632.1 | NV VP1ACY05249.1 |
| NV VP1ADP24628.1 | NV VP1ACY00629.1 | NV VP1ACY05248.1 |
| NV VP1ADP24627.1 | NV VP1ACY00626.1 | NV VP1ACY05247.1 |
| NV VP1ADP24626.1 | NV VP1ACY00623.1 | NV VP1ACY05246.1 |
| NV VP1ADP24625.1 | NV VP1ACY00612.1 | NV VP1ACY05245.1 |
| NV VP1ADP24624.1 | NV VP1ACY00609.1 | NV VP1ACY05244.1 |
| NV VP1ADP24623.1 | NV VP1ACY00606.1 | NV VP1ACY05242.1 |
| NV VP1ADP24622.1 | NV VP1ACY00603.1 | NV VP1ACY05241.1 |
| NV VP1ADP24621.1 | NV VP1ACY00600.1 | NV VP1ACY05240.1 |
| NV VP1ADP24620.1 | NV VP1ACY00597.1 | NV VP1ACY05236.1 |
| NV VP1ADP24619.1 | NV VP1ACY00594.1 | NV VP1ACY05235.1 |
| NV VP1ADP24618.1 | NV VP1ACY00591.1 | NV VP1ACY05233.1 |
| NV VP1ADP24617.1 | NV VP1ACY00588.1 | NV VP1ACY05232.1 |
| NV VP1ADP24616.1 | NV VP1ACY00585.1 | NV VP1ACY05231.1 |
| NV VP1ADP24615.1 | NV VP1ACY00582.1 | NV VP1ACY05230.1 |
| NV VP1ADP24614.1 | NV VP1ACY00579.1 | NV VP1ACY05229.1 |
| NV VP1ADP24613.1 | NV VP1ACY00576.1 | NV VP1ACY05227.1 |
| NV VP1ADP24612.1 | NV VP1ACY00573.1 | NV VP1ACY05220.1 |
| NV VP1ADP24611.1 | NV VP1ACY00571.1 | NV VP1ACY05219.1 |
| NV VP1ADO85555.1 | NV VP1ACY00568.1 | NV VP1ACY05217.1 |
| NV VP1ADO85552.1 | NV VP1ACY00565.1 | NV VP1ACY05216.1 |
| NV VP1BAJ14005.1 | NV VP1ADO20991.1 | NV VP1ACY05211.1 |
| NV VP1BAJ13981.1 | NV VP1ADO20990.1 | NV VP1ACY05210.1 |
| NV VP1BAJ13963.1 | NV VP1ADO20989.1 | NV VP1ACY05208.1 |
| NV VP1BAJ13960.1 | NV VP1ADO20988.1 | NV VP1ACY05207.1 |
| NV VP1BAJ13939.1 | NV VP1ADO20987.1 | NV VP1ACY05205.1 |
| NV VP1BAJ13930.1 | NV VP1ADO20986.1 | NV VP1ACY05204.1 |
| NV VP1BAJ13879.1 | NV VP1ADO20985.1 | NV VP1ACY05202.1 |
| NV VP1BAJ13849.1 | NV VP1ADO20984.1 | NV VP1ACY05201.1 |
| NV VP1BAJ13846.1 | NV VP1ADO20983.1 | NV VP1ACY05199.1 |
| NV VP1BAJ13843.1 | NV VP1ADO20946.1 | NV VP1ACY05196.1 |
| NV VP1BAJ13837.1 | NV VP1ADO20945.1 | NV VP1ACY05195.1 |
| NV VP1BAJ13831.1 | NV VP1ADO20944.1 | NV VP1ACY05194.1 |
| NV VP1BAJ13807.1 | NV VP1ADO20943.1 | NV VP1ACY05193.1 |
| NV VP1BAJ13786.1 | NV VP1ADO20942.1 | NV VP1ACY05191.1 |
| NV VP1BAJ13768.1 | NV VP1ADO20941.1 | NV VP1ACY05188.1 |
| NV VP1BAJ13765.1 | NV VP1ADO20940.1 | NV VP1ACY05187.1 |
| NV VP1BAJ13762.1 | NV VP1ADO20939.1 | NV VP1ACY05186.1 |
| NV VP1BAJ13750.1 | NV VP1ADO20938.1 | NV VP1ACY05185.1 |
| NV VP1BAJ13726.1 | NV VP1ADO20937.1 | NV VP1ACY05182.1 |
| NV VP1BAJ13666.1 | NV VP1ADN95819.1 | NV VP1BAJ14017.1 |
| NV VP1BAJ13609.1 | NV VP1ADN95818.1 | NV VP1BAJ14014.1 |
| NV VP1BAJ13585.1 | NV VP1ADN06080.1 | NV VP1BAJ14011.1 |
| NV VP1BAJ13564.1 | NV VP1ADM52743.1 | NV VP1BAJ14008.1 |
| NV VP1BAJ13543.1 | NV VP1ADK23787.1 | NV VP1BAJ14002.1 |
| NV VP1ACY00656.1 | NV VP1ACY05255.1 | NV VP1BAJ13999.1 |
| NV VP1ACY00650.1 | NV VP1ACY05254.1 | NV VP1BAJ13996.1 |
| NV VP1ACY00635.1 | NV VP1ACY05251.1 | NV VP1BAJ13993.1 |

FIG. 71-23

| Virus | Protein | Accession No. | Virus | Protein | Accession No. | Virus | Protein | Accession No. |
|---|---|---|---|---|---|---|---|---|
| NV | VP1 | BAJ13990.1 | NV | VP1 | BAJ13813.1 | NV | VP1 | BAJ13639.1 |
| NV | VP1 | BAJ13987.1 | NV | VP1 | BAJ13810.1 | NV | VP1 | BAJ13636.1 |
| NV | VP1 | BAJ13984.1 | NV | VP1 | BAJ13804.1 | NV | VP1 | BAJ13633.1 |
| NV | VP1 | BAJ13978.1 | NV | VP1 | BAJ13801.1 | NV | VP1 | BAJ13630.1 |
| NV | VP1 | BAJ13975.1 | NV | VP1 | BAJ13798.1 | NV | VP1 | BAJ13627.1 |
| NV | VP1 | BAJ13972.1 | NV | VP1 | BAJ13795.1 | NV | VP1 | BAJ13624.1 |
| NV | VP1 | BAJ13969.1 | NV | VP1 | BAJ13792.1 | NV | VP1 | BAJ13621.1 |
| NV | VP1 | BAJ13966.1 | NV | VP1 | BAJ13789.1 | NV | VP1 | BAJ13618.1 |
| NV | VP1 | BAJ13957.1 | NV | VP1 | BAJ13783.1 | NV | VP1 | BAJ13615.1 |
| NV | VP1 | BAJ13954.1 | NV | VP1 | BAJ13780.1 | NV | VP1 | BAJ13612.1 |
| NV | VP1 | BAJ13951.1 | NV | VP1 | BAJ13777.1 | NV | VP1 | BAJ13606.1 |
| NV | VP1 | BAJ13948.1 | NV | VP1 | BAJ13774.1 | NV | VP1 | BAJ13603.1 |
| NV | VP1 | BAJ13945.1 | NV | VP1 | BAJ13771.1 | NV | VP1 | BAJ13600.1 |
| NV | VP1 | BAJ13942.1 | NV | VP1 | BAJ13759.1 | NV | VP1 | BAJ13597.1 |
| NV | VP1 | BAJ13936.1 | NV | VP1 | BAJ13756.1 | NV | VP1 | BAJ13594.1 |
| NV | VP1 | BAJ13933.1 | NV | VP1 | BAJ13744.1 | NV | VP1 | BAJ13591.1 |
| NV | VP1 | BAJ13927.1 | NV | VP1 | BAJ13741.1 | NV | VP1 | BAJ13588.1 |
| NV | VP1 | BAJ13924.1 | NV | VP1 | BAJ13738.1 | NV | VP1 | BAJ13582.1 |
| NV | VP1 | BAJ13921.1 | NV | VP1 | BAJ13735.1 | NV | VP1 | BAJ13579.1 |
| NV | VP1 | BAJ13918.1 | NV | VP1 | BAJ13732.1 | NV | VP1 | BAJ13576.1 |
| NV | VP1 | BAJ13915.1 | NV | VP1 | BAJ13729.1 | NV | VP1 | BAJ13573.1 |
| NV | VP1 | BAJ13912.1 | NV | VP1 | BAJ13723.1 | NV | VP1 | BAJ13570.1 |
| NV | VP1 | BAJ13909.1 | NV | VP1 | BAJ13720.1 | NV | VP1 | BAJ13567.1 |
| NV | VP1 | BAJ13906.1 | NV | VP1 | BAJ13717.1 | NV | VP1 | BAJ13561.1 |
| NV | VP1 | BAJ13903.1 | NV | VP1 | BAJ13714.1 | NV | VP1 | BAJ13558.1 |
| NV | VP1 | BAJ13900.1 | NV | VP1 | BAJ13711.1 | NV | VP1 | BAJ13555.1 |
| NV | VP1 | BAJ13897.1 | NV | VP1 | BAJ13708.1 | NV | VP1 | BAJ13552.1 |
| NV | VP1 | BAJ13894.1 | NV | VP1 | BAJ13705.1 | NV | VP1 | BAJ13549.1 |
| NV | VP1 | BAJ13891.1 | NV | VP1 | BAJ13702.1 | NV | VP1 | BAJ13546.1 |
| NV | VP1 | BAJ13888.1 | NV | VP1 | BAJ13699.1 | NV | VP1 | BAJ13540.1 |
| NV | VP1 | BAJ13885.1 | NV | VP1 | BAJ13696.1 | NV | VP1 | BAJ13537.1 |
| NV | VP1 | BAJ13882.1 | NV | VP1 | BAJ13693.1 | NV | VP1 | BAJ13534.1 |
| NV | VP1 | BAJ13876.1 | NV | VP1 | BAJ13690.1 | NV | VP1 | BAJ13532.1 |
| NV | VP1 | BAJ13873.1 | NV | VP1 | BAJ13687.1 | NV | VP1 | BAJ13527.1 |
| NV | VP1 | BAJ13870.1 | NV | VP1 | BAJ13684.1 | NV | VP1 | BAJ13525.1 |
| NV | VP1 | BAJ13867.1 | NV | VP1 | BAJ13681.1 | NV | VP1 | BAJ13520.1 |
| NV | VP1 | BAJ13864.1 | NV | VP1 | BAJ13678.1 | NV | VP1 | BAJ13518.1 |
| NV | VP1 | BAJ13861.1 | NV | VP1 | BAJ13675.1 | NV | VP1 | BAJ13513.1 |
| NV | VP1 | BAJ13858.1 | NV | VP1 | BAJ13672.1 | NV | VP1 | BAJ13511.1 |
| NV | VP1 | BAJ13855.1 | NV | VP1 | BAJ13669.1 | NV | VP1 | BAJ13508.1 |
| NV | VP1 | BAJ13852.1 | NV | VP1 | BAJ13663.1 | NV | VP1 | ADB81858.1 |
| NV | VP1 | BAJ13840.1 | NV | VP1 | BAJ13660.1 | NV | VP1 | ADB81857.1 |
| NV | VP1 | BAJ13834.1 | NV | VP1 | BAJ13657.1 | NV | VP1 | ADB81856.1 |
| NV | VP1 | BAJ13828.1 | NV | VP1 | BAJ13654.1 | NV | VP1 | ADB81855.1 |
| NV | VP1 | BAJ13825.1 | NV | VP1 | BAJ13651.1 | NV | VP1 | ADB81854.1 |
| NV | VP1 | BAJ13822.1 | NV | VP1 | BAJ13648.1 | NV | VP1 | ADB81853.1 |
| NV | VP1 | BAJ13819.1 | NV | VP1 | BAJ13645.1 | NV | VP1 | ADB81852.1 |
| NV | VP1 | BAJ13816.1 | NV | VP1 | BAJ13642.1 | NV | VP1 | ADB81851.1 |

FIG. 71-24

| Virus | Protein | Accession No. | Virus | Protein | Accession No. | Virus | Protein | Accession No. |
|---|---|---|---|---|---|---|---|---|
| NV | VP1 | ADB81850.1 | NV | VP1 | ACF40299.1 | NV | VP1 | ACX81341.1 |
| NV | VP1 | ADI45818.1 | NV | VP1 | ACF40298.1 | NV | VP1 | ACX81339.1 |
| NV | VP1 | ADI45817.1 | NV | VP1 | ADC91995.1 | NV | VP1 | ADE06254.1 |
| NV | VP1 | ADI45816.1 | NV | VP1 | ADC91994.1 | NV | VP1 | ADE06253.1 |
| NV | VP1 | ADI45815.1 | NV | VP1 | ADC91993.1 | NV | VP1 | ADE06252.1 |
| NV | VP1 | ADI45814.1 | NV | VP1 | ADF50103.1 | NV | VP1 | ADE06251.1 |
| NV | VP1 | ADI45813.1 | NV | VP1 | ADF50102.1 | NV | VP1 | ADE06250.1 |
| NV | VP1 | ADI45812.1 | NV | VP1 | ADF50101.1 | NV | VP1 | ADE06249.1 |
| NV | VP1 | ADI45811.1 | NV | VP1 | ADF50100.1 | NV | VP1 | ADE06248.1 |
| NV | VP1 | ADI45810.1 | NV | VP1 | ADF50099.1 | NV | VP1 | ADE06247.1 |
| NV | VP1 | ADI45809.1 | NV | VP1 | ADF50098.1 | NV | VP1 | ADE06246.1 |
| NV | VP1 | ADI45808.1 | NV | VP1 | ADF50097.1 | NV | VP1 | ADE06245.1 |
| NV | VP1 | AAB97768.2 | NV | VP1 | ADF50096.1 | NV | VP1 | ADE06244.1 |
| NV | VP1 | ADI48364.1 | NV | VP1 | ADF50095.1 | NV | VP1 | ADE06243.1 |
| NV | VP1 | ADI48362.1 | NV | VP1 | ADF50094.1 | NV | VP1 | ADE06242.1 |
| NV | VP1 | ADI48360.1 | NV | VP1 | ADF50093.1 | NV | VP1 | ADE06241.1 |
| NV | VP1 | ADG96164.1 | NV | VP1 | ADF50092.1 | NV | VP1 | ADE06240.1 |
| NV | VP1 | ADG96163.1 | NV | VP1 | ADF50091.1 | NV | VP1 | ADE06239.1 |
| NV | VP1 | BAI82416.1 | NV | VP1 | ADF50090.1 | NV | VP1 | ADE06238.1 |
| NV | VP1 | BAI82415.1 | NV | VP1 | ADF50089.1 | NV | VP1 | ADE06237.1 |
| NV | VP1 | BAI82414.1 | NV | VP1 | ADF50088.1 | NV | VP1 | ADE06236.1 |
| NV | VP1 | BAI82413.1 | NV | VP1 | ADF50087.1 | NV | VP1 | ADE06235.1 |
| NV | VP1 | BAI82412.1 | NV | VP1 | ADF50086.1 | NV | VP1 | ADE06234.1 |
| NV | VP1 | BAI82411.1 | NV | VP1 | ADF47125.1 | NV | VP1 | ADE06233.1 |
| NV | VP1 | BAI82403.1 | NV | VP1 | ACV33077.1 | NV | VP1 | ADE06232.1 |
| NV | VP1 | BAI82402.1 | NV | VP1 | ACV33076.1 | NV | VP1 | ADE06231.1 |
| NV | VP1 | BAI82401.1 | NV | VP1 | ACV33075.1 | NV | VP1 | ADE06230.1 |
| NV | VP1 | BAI82400.1 | NV | VP1 | ACV33074.1 | NV | VP1 | ADE06229.1 |
| NV | VP1 | BAI40060.1 | NV | VP1 | ACV33073.1 | NV | VP1 | ADE06228.1 |
| NV | VP1 | BAI40048.1 | NV | VP1 | ACV33072.1 | NV | VP1 | ADE06227.1 |
| NV | VP1 | BAI40040.1 | NV | VP1 | ACV33071.1 | NV | VP1 | ADB27898.1 |
| NV | VP1 | BAI40028.1 | NV | VP1 | ACV33070.1 | NV | VP1 | ADB27897.1 |
| NV | VP1 | ACF40316.1 | NV | VP1 | ACV33069.1 | NV | VP1 | ADB27896.1 |
| NV | VP1 | ACF40314.1 | NV | VP1 | ADE28728.1 | NV | VP1 | ADB27895.1 |
| NV | VP1 | ACF40313.1 | NV | VP1 | ADE28726.1 | NV | VP1 | ADB27894.1 |
| NV | VP1 | ACF40312.1 | NV | VP1 | ADE28724.1 | NV | VP1 | ADB27893.1 |
| NV | VP1 | ACF40311.1 | NV | VP1 | ADE28723.1 | NV | VP1 | ADB27892.1 |
| NV | VP1 | ACF40310.1 | NV | VP1 | ADE28722.1 | NV | VP1 | ADB27891.1 |
| NV | VP1 | ACF40309.1 | NV | VP1 | ADE28721.1 | NV | VP1 | ADB27890.1 |
| NV | VP1 | ACF40308.1 | NV | VP1 | ADE28708.1 | NV | VP1 | ADB27889.1 |
| NV | VP1 | ACF40307.1 | NV | VP1 | ADE28706.1 | NV | VP1 | ADB27888.1 |
| NV | VP1 | ACF40306.1 | NV | VP1 | ADE28704.1 | NV | VP1 | ADB27887.1 |
| NV | VP1 | ACF40305.1 | NV | VP1 | ADE28701.1 | NV | VP1 | ADB27886.1 |
| NV | VP1 | ACF40304.1 | NV | VP1 | ACX81355.1 | NV | VP1 | ADB27885.1 |
| NV | VP1 | ACF40303.1 | NV | VP1 | ACX81351.1 | NV | VP1 | ADB27884.1 |
| NV | VP1 | ACF40302.1 | NV | VP1 | ACX81349.1 | NV | VP1 | ADB27883.1 |
| NV | VP1 | ACF40301.1 | NV | VP1 | ACX81347.1 | NV | VP1 | ADB27882.1 |
| NV | VP1 | ACF40300.1 | NV | VP1 | ACX81343.1 | NV | VP1 | ADB27881.1 |

FIG. 71-25

| Virus Protein Accession No. | Virus Protein Accession No. | Virus Protein Accession No. |
|---|---|---|
| NV VP1ADB27880.1 | NV VP1ACX30295.1 | NV VP1ACU82485.1 |
| NV VP1ADB27879.1 | NV VP1ACX30292.1 | NV VP1ACU82484.1 |
| NV VP1ADB27878.1 | NV VP1ACX30291.1 | NV VP1ACU82483.1 |
| NV VP1ADB27877.1 | NV VP1ACX30290.1 | NV VP1ACU82482.1 |
| NV VP1ADB27876.1 | NV VP1ACX30286.1 | NV VP1ACU82481.1 |
| NV VP1ADB27875.1 | NV VP1ACX30282.1 | NV VP1ACU82480.1 |
| NV VP1ADB27874.1 | NV VP1ACX30278.1 | NV VP1ACU82479.1 |
| NV VP1ADB27873.1 | NV VP1ACX30277.1 | NV VP1ACU82478.1 |
| NV VP1ADB27872.1 | NV VP1ACX30266.1 | NV VP1ACU82477.1 |
| NV VP1ACY30186.1 | NV VP1AAZ31398.2 | NV VP1ACU82476.1 |
| NV VP1ACY30174.1 | NV VP1AAZ31385.2 | NV VP1ACU82475.1 |
| NV VP1ACY30163.1 | NV VP1AAZ31396.2 | NV VP1ACU82474.1 |
| NV VP1ACY30159.1 | NV VP1AAZ31427.2 | NV VP1ACU82473.1 |
| NV VP1ACY30155.1 | NV VP1AAZ31428.2 | NV VP1ACU28808.1 |
| NV VP1ACY30145.1 | NV VP1ACV03477.1 | NV VP1ACL27300.1 |
| NV VP1ACX30397.1 | NV VP1ACV03472.1 | NV VP1ACL27299.1 |
| NV VP1ACX30395.1 | NV VP1ACV03471.1 | NV VP1ACL27298.1 |
| NV VP1ACX30393.1 | NV VP1ACV03470.1 | NV VP1ACL27297.1 |
| NV VP1ACX30391.1 | NV VP1ACV03469.1 | NV VP1ACL15073.1 |
| NV VP1ACX30387.1 | NV VP1AAZ31423.2 | NV VP1ACL15071.1 |
| NV VP1ACX30385.1 | NV VP1AAZ31402.2 | NV VP1ACL15069.1 |
| NV VP1ACX30383.1 | NV VP1ACU82512.1 | NV VP1ACL15067.1 |
| NV VP1ACX30371.1 | NV VP1ACU82511.1 | NV VP1ACL15065.1 |
| NV VP1ACX30367.1 | NV VP1ACU82510.1 | NV VP1ACL15063.1 |
| NV VP1ACX30363.1 | NV VP1ACU82509.1 | NV VP1ACL15061.1 |
| NV VP1ACX30357.1 | NV VP1ACU82508.1 | NV VP1ACL15059.1 |
| NV VP1ACX30355.1 | NV VP1ACU82507.1 | NV VP1ACL15057.1 |
| NV VP1ACX30349.1 | NV VP1ACU82506.1 | NV VP1ACL15055.1 |
| NV VP1ACX30346.1 | NV VP1ACU82505.1 | NV VP1ACL15053.1 |
| NV VP1ACX30345.1 | NV VP1ACU82504.1 | NV VP1ACL15051.1 |
| NV VP1ACX30338.1 | NV VP1ACU82503.1 | NV VP1ACL15049.1 |
| NV VP1ACX30332.1 | NV VP1ACU82502.1 | NV VP1ACL15047.1 |
| NV VP1ACX30330.1 | NV VP1ACU82501.1 | NV VP1ACL15045.1 |
| NV VP1ACX30328.1 | NV VP1ACU82500.1 | NV VP1ACL15043.1 |
| NV VP1ACX30326.1 | NV VP1ACU82499.1 | NV VP1ACL15041.1 |
| NV VP1ACX30324.1 | NV VP1ACU82498.1 | NV VP1ACL15039.1 |
| NV VP1ACX30323.1 | NV VP1ACU82497.1 | NV VP1ACL15037.1 |
| NV VP1ACX30322.1 | NV VP1ACU82496.1 | NV VP1ACL15035.1 |
| NV VP1ACX30321.1 | NV VP1ACU82495.1 | NV VP1ACL15033.1 |
| NV VP1ACX30320.1 | NV VP1ACU82494.1 | NV VP1ACL15031.1 |
| NV VP1ACX30317.1 | NV VP1ACU82493.1 | NV VP1ACL15029.1 |
| NV VP1ACX30316.1 | NV VP1ACU82492.1 | NV VP1ACL15027.1 |
| NV VP1ACX30315.1 | NV VP1ACU82491.1 | NV VP1ACL15025.1 |
| NV VP1ACX30314.1 | NV VP1ACU82490.1 | NV VP1ACL15023.1 |
| NV VP1ACX30311.1 | NV VP1ACU82489.1 | NV VP1ACL15021.1 |
| NV VP1ACX30309.1 | NV VP1ACU82488.1 | NV VP1ACL15019.1 |
| NV VP1ACX30307.1 | NV VP1ACU82487.1 | NV VP1ACL15017.1 |
| NV VP1ACX30303.1 | NV VP1ACU82486.1 | NV VP1ACL15015.1 |

FIG. 71-26

| Virus Protein Accession No. | Virus Protein Accession No. | Virus Protein Accession No. |
|---|---|---|
| NV VP1ACL15013.1 | NV VP1ACG58978.1 | NV VP1ACB71349.1 |
| NV VP1ACL15011.1 | NV VP1ACD92197.1 | NV VP1ACB71348.1 |
| NV VP1ACL15009.1 | NV VP1ACD92196.1 | NV VP1ACB71347.1 |
| NV VP1ACL15007.1 | NV VP1ACD92195.1 | NV VP1ACB71346.1 |
| NV VP1ACL15005.1 | NV VP1ACD92194.1 | NV VP1ACB71345.1 |
| NV VP1ACL15003.1 | NV VP1ACD92193.1 | NV VP1ACB71344.1 |
| NV VP1ACL15001.1 | NV VP1ACD92192.1 | NV VP1ACB71343.1 |
| NV VP1ACL14999.1 | NV VP1ACD92191.1 | NV VP1ACB71342.1 |
| NV VP1ACL14997.1 | NV VP1ACD92190.1 | NV VP1ACB71341.1 |
| NV VP1ACL14995.1 | NV VP1ACD92189.1 | NV VP1ACB71340.1 |
| NV VP1ACL14993.1 | NV VP1ACD92188.1 | NV VP1ACB71339.1 |
| NV VP1ACL14991.1 | NV VP1ACD92187.1 | NV VP1ACB71338.1 |
| NV VP1ACL14989.1 | NV VP1ACD92186.1 | NV VP1ACB71337.1 |
| NV VP1ACL14987.1 | NV VP1ACD92185.1 | NV VP1ACB71336.1 |
| NV VP1ACL14985.1 | NV VP1ACD92184.1 | NV VP1ACB71335.1 |
| NV VP1ACL14983.1 | NV VP1ACD92183.1 | NV VP1ACB71334.1 |
| NV VP1ACL14981.1 | NV VP1ACD92182.1 | NV VP1ACB71333.1 |
| NV VP1ACJ71963.1 | NV VP1ACD92181.1 | NV VP1ACB71332.1 |
| NV VP1ACJ71961.1 | NV VP1ACD92180.1 | NV VP1ACB71331.1 |
| NV VP1ACJ71960.1 | NV VP1ACD92179.1 | NV VP1ACB71330.1 |
| NV VP1ACJ71959.1 | NV VP1ACD92178.1 | NV VP1ACB71329.1 |
| NV VP1ACJ71958.1 | NV VP1ACD92177.1 | NV VP1ACB71328.1 |
| NV VP1ACJ71956.1 | NV VP1ACD92176.1 | NV VP1ACB71327.1 |
| NV VP1ACJ71955.1 | NV VP1ACD92175.1 | NV VP1ACB71326.1 |
| NV VP1ACJ71954.1 | NV VP1ACD92174.1 | NV VP1ACB71325.1 |
| NV VP1ACJ71953.1 | NV VP1ACD92173.1 | NV VP1ACB71324.1 |
| NV VP1ACJ66286.1 | NV VP1ACD92172.1 | NV VP1ACB71323.1 |
| NV VP1ACJ66285.1 | NV VP1ACD92171.1 | NV VP1ACB71322.1 |
| NV VP1ACJ66283.1 | NV VP1ACD92170.1 | NV VP1ACB71321.1 |
| NV VP1ACJ66281.1 | NV VP1ACD92169.1 | NV VP1ACB71320.1 |
| NV VP1ACJ66279.1 | NV VP1ACB71368.1 | NV VP1ACB71319.1 |
| NV VP1ACJ66277.1 | NV VP1ACB71367.1 | NV VP1ACB71318.1 |
| NV VP1ACJ66275.1 | NV VP1ACB71365.1 | NV VP1ACB71317.1 |
| NV VP1ACJ66273.1 | NV VP1ACB71364.1 | NV VP1ACB71315.1 |
| NV VP1ACJ66271.1 | NV VP1ACB71363.1 | NV VP1ACB71314.1 |
| NV VP1ACJ66269.1 | NV VP1ACB71362.1 | NV VP1ACB71312.1 |
| NV VP1ACJ66267.1 | NV VP1ACB71361.1 | NV VP1ACB71311.1 |
| NV VP1ACJ66265.1 | NV VP1ACB71360.1 | NV VP1ABV21827.2 |
| NV VP1ACJ66263.1 | NV VP1ACB71359.1 | NV VP1ACA23420.1 |
| NV VP1ACI96067.1 | NV VP1ACB71358.1 | NV VP1ACA23418.1 |
| NV VP1ACI96066.1 | NV VP1ACB71357.1 | NV VP1ACA23416.1 |
| NV VP1ACI96065.1 | NV VP1ACB71356.1 | NV VP1ACA23414.1 |
| NV VP1ACI96063.1 | NV VP1ACB71355.1 | NV VP1ACA23412.1 |
| NV VP1ACI96062.1 | NV VP1ACB71354.1 | NV VP1ACA23410.1 |
| NV VP1ACI96059.1 | NV VP1ACB71353.1 | NV VP1ACA23408.1 |
| NV VP1ACI96057.1 | NV VP1ACB71352.1 | NV VP1ACA23406.1 |
| NV VP1ACG59007.1 | NV VP1ACB71351.1 | NV VP1ACA23397.1 |
| NV VP1ACG58981.1 | NV VP1ACB71350.1 | NV VP1ACA23395.1 |

FIG. 71-27

| Virus Protein Accession No. | Virus Protein Accession No. | Virus Protein Accession No. |
|---|---|---|
| NV VP1ACA23393.1 | NV VP1ABW16777.1 | NV VP1ABW16683.1 |
| NV VP1ACA23389.1 | NV VP1ABW16776.1 | NV VP1ABW16677.1 |
| NV VP1ACA23387.1 | NV VP1ABW16773.1 | NV VP1ABW16675.1 |
| NV VP1ACA23385.1 | NV VP1ABW16769.1 | NV VP1ABW16673.1 |
| NV VP1ACA23383.1 | NV VP1ABW16766.1 | NV VP1ABW16667.1 |
| NV VP1ACA23381.1 | NV VP1ABW16765.1 | NV VP1ABP01907.1 |
| NV VP1ACA23379.1 | NV VP1ABW16763.1 | NV VP1ABP01906.1 |
| NV VP1ACA23377.1 | NV VP1ABW16762.1 | NV VP1ABP01905.1 |
| NV VP1ACA23375.1 | NV VP1ABW16761.1 | NV VP1ABP01904.1 |
| NV VP1ACA23371.1 | NV VP1ABW16760.1 | NV VP1ABP01902.1 |
| NV VP1ACA23369.1 | NV VP1ABW16759.1 | NV VP1ABP01901.1 |
| NV VP1ABY84706.1 | NV VP1ABW16758.1 | NV VP1ABP01900.1 |
| NV VP1ABY84705.1 | NV VP1ABW16756.1 | NV VP1ABP01899.1 |
| NV VP1ABY84704.1 | NV VP1ABW16755.1 | NV VP1ABP01897.1 |
| NV VP1ABY84703.1 | NV VP1ABW16754.1 | NV VP1ABP01895.1 |
| NV VP1ABY84702.1 | NV VP1ABW16753.1 | NV VP1ABP01893.1 |
| NV VP1ABY77754.1 | NV VP1ABW16749.1 | NV VP1ABP01892.1 |
| NV VP1ABV21819.2 | NV VP1ABW16748.1 | NV VP1ABP01890.1 |
| NV VP1ABV21813.2 | NV VP1ABW16746.1 | NV VP1ABP01889.1 |
| NV VP1ABV21811.2 | NV VP1ABW16745.1 | NV VP1ABP01888.1 |
| NV VP1ABV21825.2 | NV VP1ABW16744.1 | NV VP1ABP01887.1 |
| NV VP1ABV21823.2 | NV VP1ABW16743.1 | NV VP1ABP01884.1 |
| NV VP1ABW16846.1 | NV VP1ABW16742.1 | NV VP1ABP01883.1 |
| NV VP1ABW16841.1 | NV VP1ABW16737.1 | NV VP1ABP01882.1 |
| NV VP1ABW16840.1 | NV VP1ABW16736.1 | NV VP1ABP01881.1 |
| NV VP1ABW16836.1 | NV VP1ABW16735.1 | NV VP1ABP01879.1 |
| NV VP1ABW16835.1 | NV VP1ABW16734.1 | NV VP1ABP01878.1 |
| NV VP1ABW16833.1 | NV VP1ABW16733.1 | NV VP1ABP01877.1 |
| NV VP1ABW16832.1 | NV VP1ABW16732.1 | NV VP1ABP01876.1 |
| NV VP1ABW16829.1 | NV VP1ABW16726.1 | NV VP1ABP01875.1 |
| NV VP1ABW16827.1 | NV VP1ABW16725.1 | NV VP1ABP01874.1 |
| NV VP1ABW16825.1 | NV VP1ABW16722.1 | NV VP1ABP01873.1 |
| NV VP1ABW16824.1 | NV VP1ABW16721.1 | NV VP1ABP01839.1 |
| NV VP1ABW16818.1 | NV VP1ABW16718.1 | NV VP1ABP01838.1 |
| NV VP1ABW16815.1 | NV VP1ABW16715.1 | NV VP1ABP01836.1 |
| NV VP1ABW16814.1 | NV VP1ABW16714.1 | NV VP1ABK32790.1 |
| NV VP1ABW16808.1 | NV VP1ABW16712.1 | NV VP1ABK32789.1 |
| NV VP1ABW16807.1 | NV VP1ABW16711.1 | NV VP1ABK32788.1 |
| NV VP1ABW16804.1 | NV VP1ABW16710.1 | NV VP1ABK32786.1 |
| NV VP1ABW16799.1 | NV VP1ABW16709.1 | NV VP1ABK32785.1 |
| NV VP1ABW16797.1 | NV VP1ABW16708.1 | NV VP1ABK32784.1 |
| NV VP1ABW16792.1 | NV VP1ABW16706.1 | NV VP1ABK32783.1 |
| NV VP1ABW16787.1 | NV VP1ABW16702.1 | NV VP1ABI97981.1 |
| NV VP1ABW16786.1 | NV VP1ABW16701.1 | NV VP1ABI94096.1 |
| NV VP1ABW16785.1 | NV VP1ABW16697.1 | NV VP1ABI94095.1 |
| NV VP1ABW16784.1 | NV VP1ABW16696.1 | NV VP1ABI94094.1 |
| NV VP1ABW16783.1 | NV VP1ABW16685.1 | NV VP1ABI94093.1 |
| NV VP1ABW16781.1 | NV VP1ABW16684.1 | NV VP1ABI94092.1 |

FIG. 71-28

| Virus Protein Accession No. | Virus Protein Accession No. | Virus Protein Accession No. |
|---|---|---|
| NV VP1ABF71707.1 | NV VP1AAS86786.1 | NV VP1BAH23723.1 |
| NV VP1ABF71706.1 | NV VP1AAS86777.1 | NV VP1BAH23720.1 |
| NV VP1ABF71704.1 | NV VP1AAS86774.1 | NV VP1BAH23719.1 |
| NV VP1ABF71699.1 | NV VP1AAK96218.1 | NV VP1BAH23718.1 |
| NV VP1ABF71697.1 | NV VP1ADD10375.1 | NV VP1BAH23714.1 |
| NV VP1ABF71695.1 | NV VP1BAI70518.1 | NV VP1BAH23713.1 |
| NV VP1ABF71694.1 | NV VP1ADC53729.1 | NV VP1BAH23711.1 |
| NV VP1ABF71690.1 | NV VP1ADC53728.1 | NV VP1BAG68816.1 |
| NV VP1ABF71686.1 | NV VP1ADC53727.1 | NV VP1BAG68815.1 |
| NV VP1ABF71674.1 | NV VP1ADC53726.1 | NV VP1BAG68814.1 |
| NV VP1ABD95934.1 | NV VP1ADC53725.1 | NV VP1BAG68813.1 |
| NV VP1ABD24052.1 | NV VP1ADC53724.1 | NV VP1BAG68811.1 |
| NV VP1ABD24051.1 | NV VP1ADC53723.1 | NV VP1BAG68810.1 |
| NV VP1AAZ31411.2 | NV VP1ADC53722.1 | NV VP1BAG68809.1 |
| NV VP1AAZ31376.2 | NV VP1ADC53721.1 | NV VP1BAG68808.1 |
| NV VP1ABA43120.1 | NV VP1ADC53720.1 | NV VP1BAG68807.1 |
| NV VP1ABA43118.1 | NV VP1ADC53718.1 | NV VP1BAG68806.1 |
| NV VP1ABA43110.1 | NV VP1ADC53717.1 | NV VP1BAG68805.1 |
| NV VP1ABA43108.1 | NV VP1ADC53716.1 | NV VP1BAG68803.1 |
| NV VP1ABA42202.1 | NV VP1ADB27027.1 | NV VP1BAG68802.1 |
| NV VP1AAZ31435.1 | NV VP1ACN60151.1 | NV VP1BAG68801.1 |
| NV VP1AAZ31434.1 | NV VP1ACN60150.1 | NV VP1BAG68800.1 |
| NV VP1AAZ31433.1 | NV VP1ACN60149.1 | NV VP1BAG68799.1 |
| NV VP1AAZ31432.1 | NV VP1BAH23754.1 | NV VP1ACG59368.1 |
| NV VP1AAZ31431.1 | NV VP1BAH23753.1 | NV VP1ACX81353.1 |
| NV VP1AAZ31430.1 | NV VP1BAH23751.1 | NV VP1BAH23721.1 |
| NV VP1AAZ31429.1 | NV VP1BAH23750.1 | NV VP1BAH23717.1 |
| NV VP1AAZ31426.1 | NV VP1BAH23749.1 | NV VP1BAH23715.1 |
| NV VP1AAZ31425.1 | NV VP1BAH23748.1 | NV VP1BAH23712.1 |
| NV VP1AAZ31424.1 | NV VP1BAH23747.1 | NV VP1BAG68812.1 |
| NV VP1AAZ31422.1 | NV VP1BAH23736.1 | NV VP1BAG68804.1 |
| NV VP1AAZ31421.1 | NV VP1BAH23724.1 | NV VP1ADB27914.1 |
| NV VP1AAZ31420.1 | NV VP1BAH23722.1 | NV VP1BAI49928.1 |
| NV VP1AAZ31419.1 | NV VP1BAH23710.1 | NV VP1BAI49927.1 |
| NV VP1AAZ31418.1 | NV VP1ADB89935.1 | NV VP1BAI49926.1 |
| NV VP1AAZ31417.1 | NV VP1ADB89934.1 | NV VP1BAI49925.1 |
| NV VP1AAZ31416.1 | NV VP1ADB89933.1 | NV VP1BAI49924.1 |
| NV VP1AAZ31415.1 | NV VP1ADB89932.1 | NV VP1BAI49923.1 |
| NV VP1AAZ31414.1 | NV VP1ADB89928.1 | NV VP1BAI49922.1 |
| NV VP1AAZ31413.1 | NV VP1ADB89925.1 | NV VP1BAI49921.1 |
| NV VP1AAZ31412.1 | NV VP1ADB89924.1 | NV VP1BAI49920.1 |
| NV VP1AAW80297.1 | NV VP1ADB89923.1 | NV VP1BAI49919.1 |
| NV VP1AAS86804.1 | NV VP1ADB89922.1 | NV VP1BAI49918.1 |
| NV VP1AAS86801.1 | NV VP1ADB89921.1 | NV VP1BAI49917.1 |
| NV VP1AAS86798.1 | NV VP1ADB89920.1 | NV VP1BAI49916.1 |
| NV VP1AAS86795.1 | NV VP1ADB89919.1 | NV VP1BAI49915.1 |
| NV VP1AAS86792.1 | NV VP1ADB89918.1 | NV VP1BAI49914.1 |
| NV VP1AAS86789.1 | NV VP1BAH23755.1 | NV VP1BAI49913.1 |

FIG. 71-29

| Virus | Protein | Accession No. | Virus | Protein | Accession No. | Virus | Protein | Accession No. |
|---|---|---|---|---|---|---|---|---|
| NV | VP1 | BAI49912.1 | NV | VP1 | AAP82895.1 | NV | VP1 | ACZ52666.1 |
| NV | VP1 | BAI49911.1 | NV | VP1 | AAP82882.1 | NV | VP1 | ACZ52665.1 |
| NV | VP1 | BAI49910.1 | NV | VP1 | AAP82881.1 | NV | VP1 | ACZ52664.1 |
| NV | VP1 | BAI49909.1 | NV | VP1 | AAP82878.1 | NV | VP1 | ACZ52663.1 |
| NV | VP1 | BAI49908.1 | NV | VP1 | AAP82876.1 | NV | VP1 | ACZ52662.1 |
| NV | VP1 | BAI49907.1 | NV | VP1 | AAP82873.1 | NV | VP1 | ACZ52661.1 |
| NV | VP1 | BAI49906.1 | NV | VP1 | AAP82872.1 | NV | VP1 | ACZ52660.1 |
| NV | VP1 | BAI49905.1 | NV | VP1 | AAP82871.1 | NV | VP1 | ACZ52659.1 |
| NV | VP1 | BAI49904.1 | NV | VP1 | AAM81248.1 | NV | VP1 | ACZ52658.1 |
| NV | VP1 | ACV41093.1 | NV | VP1 | AAL12126.1 | NV | VP1 | ACZ52657.1 |
| NV | VP1 | ADB03712.1 | NV | VP1 | AAL12125.1 | NV | VP1 | ACZ52656.1 |
| NV | VP1 | ADB03711.1 | NV | VP1 | AAL12124.1 | NV | VP1 | ACZ52655.1 |
| NV | VP1 | ADB03710.1 | NV | VP1 | AAL12123.1 | NV | VP1 | ACZ52654.1 |
| NV | VP1 | ACY69849.1 | NV | VP1 | AAL12122.1 | NV | VP1 | ACZ52653.1 |
| NV | VP1 | ACX31821.1 | NV | VP1 | AAL12121.1 | NV | VP1 | ACZ52652.1 |
| NV | VP1 | ACT76151.1 | NV | VP1 | AAL12120.1 | NV | VP1 | ACZ52651.1 |
| NV | VP1 | ACT76148.1 | NV | VP1 | AAR97663.1 | NV | VP1 | ACZ52650.1 |
| NV | VP1 | ACT76145.1 | NV | VP1 | AAR97660.1 | NV | VP1 | ACZ52649.1 |
| NV | VP1 | ACT76142.1 | NV | VP1 | AAR97657.1 | NV | VP1 | ACZ52648.1 |
| NV | VP1 | ACT76139.1 | NV | VP1 | AAR97654.1 | NV | VP1 | ACZ52647.1 |
| NV | VP1 | ACO05039.1 | NV | VP1 | AAR97651.1 | NV | VP1 | ACZ52646.1 |
| NV | VP1 | ABQ12784.1 | NV | VP1 | AAR97648.1 | NV | VP1 | ACZ52645.1 |
| NV | VP1 | ABO15289.1 | NV | VP1 | AAR97645.1 | NV | VP1 | ACZ52644.1 |
| NV | VP1 | ADA77528.1 | NV | VP1 | ACZ52691.1 | NV | VP1 | ACZ52642.1 |
| NV | VP1 | ACU57478.1 | NV | VP1 | ACZ52690.1 | NV | VP1 | ACZ52641.1 |
| NV | VP1 | ACU57474.1 | NV | VP1 | ACZ52689.1 | NV | VP1 | ACZ52640.1 |
| NV | VP1 | ACU57472.1 | NV | VP1 | ACZ52688.1 | NV | VP1 | ACZ52639.1 |
| NV | VP1 | ACU57466.1 | NV | VP1 | ACZ52687.1 | NV | VP1 | ACZ52638.1 |
| NV | VP1 | ACU57464.1 | NV | VP1 | ACZ52686.1 | NV | VP1 | ACZ52637.1 |
| NV | VP1 | ACU57462.1 | NV | VP1 | ACZ52685.1 | NV | VP1 | ACZ52636.1 |
| NV | VP1 | ACU57458.1 | NV | VP1 | ACZ52684.1 | NV | VP1 | ACZ52635.1 |
| NV | VP1 | ACU57444.1 | NV | VP1 | ACZ52683.1 | NV | VP1 | ACZ52634.1 |
| NV | VP1 | ACU57442.1 | NV | VP1 | ACZ52682.1 | NV | VP1 | ACZ52633.1 |
| NV | VP1 | ACU57438.1 | NV | VP1 | ACZ52681.1 | NV | VP1 | ACZ52632.1 |
| NV | VP1 | ACU57430.1 | NV | VP1 | ACZ52680.1 | NV | VP1 | ACZ52631.1 |
| NV | VP1 | ACU57422.1 | NV | VP1 | ACZ52679.1 | NV | VP1 | ACZ52630.1 |
| NV | VP1 | ADA55138.1 | NV | VP1 | ACZ52678.1 | NV | VP1 | ACZ52629.1 |
| NV | VP1 | ADA55137.1 | NV | VP1 | ACZ52677.1 | NV | VP1 | ACZ52628.1 |
| NV | VP1 | ADA55136.1 | NV | VP1 | ACZ52676.1 | NV | VP1 | ACZ37232.1 |
| NV | VP1 | ADA55135.1 | NV | VP1 | ACZ52675.1 | NV | VP1 | ACX42263.1 |
| NV | VP1 | ADA55134.1 | NV | VP1 | ACZ52674.1 | NV | VP1 | ACK44476.1 |
| NV | VP1 | BAI52940.1 | NV | VP1 | ACZ52673.1 | NV | VP1 | ACK44474.1 |
| NV | VP1 | BAI52939.1 | NV | VP1 | ACZ52672.1 | NV | VP1 | ACO05066.1 |
| NV | VP1 | ABC96746.1 | NV | VP1 | ACZ52671.1 | NV | VP1 | ACO05065.1 |
| NV | VP1 | AAX32886.1 | NV | VP1 | ACZ52670.1 | NV | VP1 | ACO05064.1 |
| NV | VP1 | AAX32880.1 | NV | VP1 | ACZ52669.1 | NV | VP1 | ACO05058.1 |
| NV | VP1 | AAX32877.1 | NV | VP1 | ACZ52668.1 | NV | VP1 | ACO05056.1 |
| NV | VP1 | AAX32874.1 | NV | VP1 | ACZ52667.1 | NV | VP1 | ACO05049.1 |

FIG. 71-30

| Virus Protein Accession No. | Virus Protein Accession No. | Virus Protein Accession No. |
|---|---|---|
| NV VP1ACO05042.1 | NV VP1BAF46167.1 | NV VP1BAF81925.1 |
| NV VP1ACO05041.1 | NV VP1BAF46166.1 | NV VP1BAG70536.1 |
| NV VP1ACO05040.1 | NV VP1BAF46165.1 | NV VP1BAG70533.1 |
| NV VP1ACO05032.1 | NV VP1BAF46164.1 | NV VP1BAG70530.1 |
| NV VP1ACO05029.1 | NV VP1BAF46163.1 | NV VP1BAG70527.1 |
| NV VP1ACO05028.1 | NV VP1BAF46162.1 | NV VP1BAG70524.1 |
| NV VP1ACO05027.1 | NV VP1BAF46161.1 | NV VP1BAG70521.1 |
| NV VP1ACO05026.1 | NV VP1BAF46160.1 | NV VP1BAG70518.1 |
| NV VP1ACO05025.1 | NV VP1BAF46159.1 | NV VP1BAG70515.1 |
| NV VP1ACO05024.1 | NV VP1BAF46158.1 | NV VP1BAG70512.1 |
| NV VP1ACO05023.1 | NV VP1BAF46157.1 | NV VP1BAG70509.1 |
| NV VP1ACO05022.1 | NV VP1BAF46156.1 | NV VP1BAG70506.1 |
| NV VP1BAH56690.1 | NV VP1BAF46155.1 | NV VP1BAG70503.1 |
| NV VP1ACO55068.1 | NV VP1BAF46154.1 | NV VP1BAG70500.1 |
| NV VP1BAH30707.1 | NV VP1BAF46151.1 | NV VP1BAG70497.1 |
| NV VP1ACO07420.1 | NV VP1BAF46150.1 | NV VP1BAG70494.1 |
| NV VP1ACO07419.1 | NV VP1BAF46149.1 | NV VP1BAG70491.1 |
| NV VP1ACO07417.1 | NV VP1BAF46144.1 | NV VP1BAG70488.1 |
| NV VP1ACO07415.1 | NV VP1BAF46140.1 | NV VP1BAG70485.1 |
| NV VP1ACO07414.1 | NV VP1BAF46139.1 | NV VP1BAG70482.1 |
| NV VP1ACO07413.1 | NV VP1BAF46138.1 | NV VP1BAG70479.1 |
| NV VP1ACO07412.1 | NV VP1BAF46137.1 | NV VP1BAG70476.1 |
| NV VP1ACO07407.1 | NV VP1BAF46136.1 | NV VP1BAG70473.1 |
| NV VP1ACO07405.1 | NV VP1BAF46135.1 | NV VP1BAG70470.1 |
| NV VP1ACO07404.1 | NV VP1BAF46134.1 | NV VP1BAG70467.1 |
| NV VP1ACO07402.1 | NV VP1BAF46133.1 | NV VP1BAG70464.1 |
| NV VP1ACO07400.1 | NV VP1BAF46132.1 | NV VP1BAG70461.1 |
| NV VP1ACO07398.1 | NV VP1BAF46131.1 | NV VP1BAG70458.1 |
| NV VP1ACO07396.1 | NV VP1BAF46130.1 | NV VP1BAG70455.1 |
| NV VP1ACO07395.1 | NV VP1BAF46129.1 | NV VP1BAG70452.1 |
| NV VP1ACO07394.1 | NV VP1BAF46126.1 | NV VP1BAG70449.1 |
| NV VP1ACO07391.1 | NV VP1ACL36375.1 | NV VP1BAG70446.1 |
| NV VP1ACO07388.1 | NV VP1BAF46208.1 | NV VP1BAG70443.1 |
| NV VP1BAF46195.1 | NV VP1BAF46207.1 | NV VP1BAG70440.1 |
| NV VP1BAF46184.1 | NV VP1BAF46205.1 | NV VP1BAG70437.1 |
| NV VP1BAF46183.1 | NV VP1BAF46204.1 | NV VP1BAG70434.1 |
| NV VP1BAF46182.1 | NV VP1BAF46203.1 | NV VP1BAG70431.1 |
| NV VP1BAF46181.1 | NV VP1BAF46201.1 | NV VP1BAG70428.1 |
| NV VP1BAF46180.1 | NV VP1BAF81947.1 | NV VP1BAF45861.2 |
| NV VP1BAF46179.1 | NV VP1BAF81946.1 | NV VP1ACA60968.1 |
| NV VP1BAF46175.1 | NV VP1BAF81945.1 | NV VP1ACA60967.1 |
| NV VP1BAF46174.1 | NV VP1BAF81943.1 | NV VP1ACA60966.1 |
| NV VP1BAF46173.1 | NV VP1BAF81939.1 | NV VP1ACH86193.1 |
| NV VP1BAF46172.1 | NV VP1BAF81937.1 | NV VP1ACH86192.1 |
| NV VP1BAF46171.1 | NV VP1BAF81932.1 | NV VP1ACH86191.1 |
| NV VP1BAF46170.1 | NV VP1BAF81931.1 | NV VP1ACH86190.1 |
| NV VP1BAF46169.1 | NV VP1BAF81930.1 | NV VP1ACH86189.1 |
| NV VP1BAF46168.1 | NV VP1BAF81928.1 | NV VP1ACH86188.1 |

FIG. 71-31

| Virus | Protein Accession No. | Virus | Protein Accession No. | Virus | Protein Accession No. |
|---|---|---|---|---|---|
| NV | VP1ACH86187.1 | NV | VP1ABX38902.1 | NV | VP1BAF74518.1 |
| NV | VP1ACH86186.1 | NV | VP1ABX38901.1 | NV | VP1BAF74517.1 |
| NV | VP1ACH86185.1 | NV | VP1ABX38900.1 | NV | VP1BAF74516.1 |
| NV | VP1ACH86184.1 | NV | VP1ABX38899.1 | NV | VP1BAF74515.1 |
| NV | VP1ACH86183.1 | NV | VP1ABX38898.1 | NV | VP1BAF74514.1 |
| NV | VP1ACH86182.1 | NV | VP1ABX38897.1 | NV | VP1BAF74513.1 |
| NV | VP1ACH86181.1 | NV | VP1ABX38896.1 | NV | VP1BAF74512.1 |
| NV | VP1ACH86180.1 | NV | VP1ABX38895.1 | NV | VP1BAF74511.1 |
| NV | VP1ACH86179.1 | NV | VP1ABX38894.1 | NV | VP1BAF74510.1 |
| NV | VP1ACH86178.1 | NV | VP1ABX38893.1 | NV | VP1BAF74509.1 |
| NV | VP1ACH86177.1 | NV | VP1ABX38892.1 | NV | VP1BAF74508.1 |
| NV | VP1ACH86175.1 | NV | VP1ABX38891.1 | NV | VP1ABL74397.1 |
| NV | VP1ACH86174.1 | NV | VP1ABZ89549.1 | NV | VP1ABL74395.1 |
| NV | VP1ACE76879.1 | NV | VP1ABO27809.1 | NV | VP1ABL74393.1 |
| NV | VP1ACE76878.1 | NV | VP1ABW83030.1 | NV | VP1ABL74391.1 |
| NV | VP1BAG68716.1 | NV | VP1BAF95531.1 | NV | VP1ABL74389.1 |
| NV | VP1BAG68715.1 | NV | VP1BAF95529.1 | NV | VP1ABL74387.1 |
| NV | VP1BAG68714.1 | NV | VP1BAF95527.1 | NV | VP1ABG49509.1 |
| NV | VP1BAG68713.1 | NV | VP1BAF95525.1 | NV | VP1ABR92756.1 |
| NV | VP1BAG68712.1 | NV | VP1BAF95523.1 | NV | VP1ABR92755.1 |
| NV | VP1BAG68711.1 | NV | VP1BAF95521.1 | NV | VP1ABR92752.1 |
| NV | VP1BAG68710.1 | NV | VP1BAF95519.1 | NV | VP1ABR92749.1 |
| NV | VP1BAG68709.1 | NV | VP1BAF95517.1 | NV | VP1ABR92748.1 |
| NV | VP1BAG68708.1 | NV | VP1BAF95515.1 | NV | VP1ABR92746.1 |
| NV | VP1BAG68707.1 | NV | VP1BAF95513.1 | NV | VP1ABR92744.1 |
| NV | VP1ACF77117.1 | NV | VP1BAF95511.1 | NV | VP1ABR92743.1 |
| NV | VP1ACF77116.1 | NV | VP1BAF95509.1 | NV | VP1ABR92741.1 |
| NV | VP1ACF77115.1 | NV | VP1BAF95507.1 | NV | VP1ABM53193.1 |
| NV | VP1ACF77114.1 | NV | VP1BAF95505.1 | NV | VP1ABM53192.1 |
| NV | VP1ACF77113.1 | NV | VP1BAF95503.1 | NV | VP1ABD73936.1 |
| NV | VP1ACF77112.1 | NV | VP1BAF95501.1 | NV | VP1ABD36497.1 |
| NV | VP1ACF77111.1 | NV | VP1BAF95499.1 | NV | VP1ABD36494.1 |
| NV | VP1ACF77110.1 | NV | VP1BAF95476.1 | NV | VP1ABD36491.1 |
| NV | VP1ACF77109.1 | NV | VP1BAF95475.1 | NV | VP1ABQ08569.1 |
| NV | VP1ACF77108.1 | NV | VP1BAF95474.1 | NV | VP1ABQ08568.1 |
| NV | VP1ACF77107.1 | NV | VP1BAF95473.1 | NV | VP1BAD72798.1 |
| NV | VP1ACF77106.1 | NV | VP1BAF91308.1 | NV | VP1BAD72797.1 |
| NV | VP1BAG55289.1 | NV | VP1BAF91306.1 | NV | VP1ABD33822.1 |
| NV | VP1ABQ12781.1 | NV | VP1BAF81953.1 | NV | VP1ABD33820.1 |
| NV | VP1BAG31369.1 | NV | VP1BAF74527.1 | NV | VP1ABD33818.1 |
| NV | VP1BAG31367.1 | NV | VP1BAF74526.1 | NV | VP1ABD33816.1 |
| NV | VP1BAG31363.1 | NV | VP1BAF74525.1 | NV | VP1ABD33814.1 |
| NV | VP1BAG31359.1 | NV | VP1BAF74524.1 | NV | VP1ABD33812.1 |
| NV | VP1ACA49725.1 | NV | VP1BAF74523.1 | NV | VP1ABD33811.1 |
| NV | VP1ABX38906.1 | NV | VP1BAF74522.1 | NV | VP1ABD33810.1 |
| NV | VP1ABX38905.1 | NV | VP1BAF74521.1 | NV | VP1AAX32883.1 |
| NV | VP1ABX38904.1 | NV | VP1BAF74520.1 | NV | VP1AAY41806.1 |
| NV | VP1ABX38903.1 | NV | VP1BAF74519.1 | NV | VP1AAY41803.1 |

FIG. 71-32

| Virus | Protein Accession No. | Virus | Protein Accession No. | Virus | Protein Accession No. |
|---|---|---|---|---|---|
| NV | VP1 AAY41799.1 | NV | VP1 ACD13835.1 | NV | VP1 ACL31334.1 |
| NV | VP1 AAY41798.1 | NV | VP1 ACD13830.1 | NV | VP1 ACL31330.1 |
| NV | VP1 AAY41789.1 | NV | VP1 ACD13828.1 | NV | VP1 ACL31329.1 |
| NV | VP1 CAA60255.1 | NV | VP1 ACD13826.1 | NV | VP1 ACL31328.1 |
| NV | VP1 BAD88771.1 | NV | VP1 ACD13824.1 | NV | VP1 ACL31315.1 |
| NV | VP1 BAD88770.1 | NV | VP1 ACD13822.1 | NV | VP1 ACL31311.1 |
| NV | VP1 BAD72799.1 | NV | VP1 ACD13820.1 | NV | VP1 ACL31309.1 |
| NV | VP1 BAD72800.1 | NV | VP1 ABP88833.1 | NV | VP1 ACL31308.1 |
| NV | VP1 BAJ61472.1 | NV | VP1 ACF60297.1 | NV | VP1 ACL31307.1 |
| NV | VP1 BAJ61471.1 | NV | VP1 ACF60296.1 | NV | VP1 ACL31306.1 |
| NV | VP1 BAJ61470.1 | NV | VP1 ACF60295.1 | NV | VP1 ACL31305.1 |
| NV | VP1 BAJ61469.1 | NV | VP1 ACF60294.1 | NV | VP1 ACL31304.1 |
| NV | VP1 BAJ61468.1 | NV | VP1 ACF60293.1 | NV | VP1 ACL31303.1 |
| NV | VP1 BAJ61467.1 | NV | VP1 BAJ25076.1 | NV | VP1 ACL31302.1 |
| NV | VP1 BAJ61466.1 | NV | VP1 BAJ25074.1 | NV | VP1 ACL31361.2 |
| NV | VP1 BAJ61465.1 | NV | VP1 BAJ25072.1 | NV | VP1 ACL31360.2 |
| NV | VP1 BAJ61464.1 | NV | VP1 BAJ25070.1 | NV | VP1 ACL31316.2 |
| NV | VP1 BAJ61463.1 | NV | VP1 ADK48006.1 | NV | VP1 ADK47174.1 |
| NV | VP1 BAJ61462.1 | NV | VP1 ADK48005.1 | NV | VP1 ADK47173.1 |
| NV | VP1 BAJ61461.1 | NV | VP1 ADK48004.1 | NV | VP1 ADK47172.1 |
| NV | VP1 BAJ61460.1 | NV | VP1 ADK48003.1 | NV | VP1 ADK47171.1 |
| NV | VP1 BAJ61459.1 | NV | VP1 ADK48002.1 | NV | VP1 ADK47170.1 |
| NV | VP1 BAJ61458.1 | NV | VP1 ADK48001.1 | NV | VP1 ADK47168.1 |
| NV | VP1 BAJ61457.1 | NV | VP1 ACL31326.2 | NV | VP1 ADK47166.1 |
| NV | VP1 BAJ61456.1 | NV | VP1 ACL31325.2 | NV | VP1 ADK47164.1 |
| NV | VP1 BAJ61455.1 | NV | VP1 ACL31385.1 | NV | VP1 ADK47162.1 |
| NV | VP1 BAJ25069.1 | NV | VP1 ACL31384.1 | NV | VP1 ADF47131.1 |
| NV | VP1 BAJ25068.1 | NV | VP1 ACL31383.1 | NV | VP1 ADF47128.1 |
| NV | VP1 ADU77323.1 | NV | VP1 ACL31382.1 | NV | VP1 ACN61487.1 |
| NV | VP1 ADU77322.1 | NV | VP1 ACL31380.1 | NV | VP1 ADB22512.1 |
| NV | VP1 ADU77317.1 | NV | VP1 ACL31379.1 | NV | VP1 ACT78459.1 |
| NV | VP1 ADU77316.1 | NV | VP1 ACL31378.1 | NV | VP1 ACT68316.1 |
| NV | VP1 ADU77314.1 | NV | VP1 ACL31377.1 | NV | VP1 ACT68315.1 |
| NV | VP1 ADU77304.1 | NV | VP1 ACL31376.1 | NV | VP1 ACT68314.1 |
| NV | VP1 ADU77303.1 | NV | VP1 ACL31368.1 | NV | VP1 ACT68313.1 |
| NV | VP1 ADU77298.1 | NV | VP1 ACL31364.1 | NV | VP1 ACT68312.1 |
| NV | VP1 ADU77291.1 | NV | VP1 ACL31363.1 | NV | VP1 ACT68311.1 |
| NV | VP1 BAJ53285.1 | NV | VP1 ACL31362.1 | NV | VP1 ACT68310.1 |
| NV | VP1 BAJ53280.1 | NV | VP1 ACL31359.1 | NV | VP1 ACT68309.1 |
| NV | VP1 BAJ53279.1 | NV | VP1 ACL31352.1 | NV | VP1 ACT52409.1 |
| NV | VP1 ACH42098.1 | NV | VP1 ACL31351.1 | NV | VP1 ACT52407.1 |
| NV | VP1 ACH42097.1 | NV | VP1 ACL31350.1 | NV | VP1 ACT52405.1 |
| NV | VP1 ACH42096.1 | NV | VP1 ACL31348.1 | NV | VP1 ACT52403.1 |
| NV | VP1 ACH42095.1 | NV | VP1 ACL31347.1 | NV | VP1 ABY75838.1 |
| NV | VP1 ACH42094.1 | NV | VP1 ACL31344.1 | NV | VP1 ABY75837.1 |
| NV | VP1 ACH42093.1 | NV | VP1 ACL31343.1 | NV | VP1 ABY75836.1 |
| NV | VP1 ACH42092.1 | NV | VP1 ACL31342.1 | NV | VP1 ABY75835.1 |
| NV | VP1 ACD13837.1 | NV | VP1 ACL31339.1 | NV | VP1 ABY75834.1 |

FIG. 71-33

| Virus | Protein | Accession No. | Virus | Protein | Accession No. | Virus | Protein | Accession No. |
|---|---|---|---|---|---|---|---|---|
| NV | VP1 | ABY75833.1 | NV | VP1 | ABW16820.1 | NV | VP1 | ABQ63306.1 |
| NV | VP1 | ABY75832.1 | NV | VP1 | ABW16819.1 | NV | VP1 | ABQ63303.1 |
| NV | VP1 | ABY75831.1 | NV | VP1 | ABW16817.1 | NV | VP1 | ABQ63297.1 |
| NV | VP1 | ABY75830.1 | NV | VP1 | ABW16816.1 | NV | VP1 | ABQ63286.1 |
| NV | VP1 | ABY75828.1 | NV | VP1 | ABW16813.1 | NV | VP1 | ABQ63283.1 |
| NV | VP1 | ABY75827.1 | NV | VP1 | ABW16812.1 | NV | VP1 | ABQ44576.1 |
| NV | VP1 | ABY75826.1 | NV | VP1 | ABW16811.1 | NV | VP1 | ABQ44574.1 |
| NV | VP1 | ABY75825.1 | NV | VP1 | ABW16810.1 | NV | VP1 | ABQ44573.1 |
| NV | VP1 | ABY75824.1 | NV | VP1 | ABW16809.1 | NV | VP1 | ABQ44572.1 |
| NV | VP1 | ABY75823.1 | NV | VP1 | ABW16806.1 | NV | VP1 | ABQ44571.1 |
| NV | VP1 | ABY75822.1 | NV | VP1 | ABW16805.1 | NV | VP1 | ABQ44570.1 |
| NV | VP1 | ABY75821.1 | NV | VP1 | ABW16803.1 | NV | VP1 | ABQ44569.1 |
| NV | VP1 | ABY75820.1 | NV | VP1 | ABW16802.1 | NV | VP1 | ABQ44568.1 |
| NV | VP1 | ABY75819.1 | NV | VP1 | ABW16801.1 | NV | VP1 | ABQ44567.1 |
| NV | VP1 | ABY75818.1 | NV | VP1 | ABW16800.1 | NV | VP1 | ABO14912.1 |
| NV | VP1 | ABY75817.1 | NV | VP1 | ABW16798.1 | NV | VP1 | ABO14899.1 |
| NV | VP1 | ABY75816.1 | NV | VP1 | ABW16796.1 | NV | VP1 | ABO14898.1 |
| NV | VP1 | ABY75815.1 | NV | VP1 | ABW16795.1 | NV | VP1 | ABD77590.1 |
| NV | VP1 | ABW74546.1 | NV | VP1 | ABW16794.1 | NV | VP1 | ABD77589.1 |
| NV | VP1 | ABW74545.1 | NV | VP1 | ABW16793.1 | NV | VP1 | ABD77588.1 |
| NV | VP1 | ABW74544.1 | NV | VP1 | ABW16791.1 | NV | VP1 | AAT12692.1 |
| NV | VP1 | ABW74543.1 | NV | VP1 | ABW16789.1 | NV | VP1 | AAT12691.1 |
| NV | VP1 | ABW74542.1 | NV | VP1 | ABW16788.1 | NV | VP1 | AAT12690.1 |
| NV | VP1 | ABW74541.1 | NV | VP1 | ABW16782.1 | NV | VP1 | AAT12689.1 |
| NV | VP1 | ABW74540.1 | NV | VP1 | ABW16780.1 | NV | VP1 | AAT12688.1 |
| NV | VP1 | ABW74539.1 | NV | VP1 | ABW16779.1 | NV | VP1 | AAT12687.1 |
| NV | VP1 | ABW74538.1 | NV | VP1 | ABW16778.1 | NV | VP1 | AAT12686.1 |
| NV | VP1 | ABW74537.1 | NV | VP1 | ABW16775.1 | NV | VP1 | AAT12685.1 |
| NV | VP1 | ABW74536.1 | NV | VP1 | ABW16774.1 | NV | VP1 | AAF13920.1 |
| NV | VP1 | ABW74535.1 | NV | VP1 | ABW16772.1 | NV | VP1 | AAY40773.1 |
| NV | VP1 | ABW74534.1 | NV | VP1 | ABW16771.1 | NV | VP1 | AAY40772.1 |
| NV | VP1 | ABW74533.1 | NV | VP1 | ABW16770.1 | NV | VP1 | AAY40771.1 |
| NV | VP1 | ABW74532.1 | NV | VP1 | ABQ63387.1 | NV | VP1 | AAY40770.1 |
| NV | VP1 | ABW16845.1 | NV | VP1 | ABQ63385.1 | NV | VP1 | BAI70553.1 |
| NV | VP1 | ABW16844.1 | NV | VP1 | ABQ63384.1 | NV | VP1 | BAI70552.1 |
| NV | VP1 | ABW16843.1 | NV | VP1 | ABQ63383.1 | NV | VP1 | BAI70550.1 |
| NV | VP1 | ABW16842.1 | NV | VP1 | ABQ63372.1 | NV | VP1 | BAI70549.1 |
| NV | VP1 | ABW16839.1 | NV | VP1 | ABQ63362.1 | NV | VP1 | BAI70546.1 |
| NV | VP1 | ABW16838.1 | NV | VP1 | ABQ63344.1 | NV | VP1 | BAI70545.1 |
| NV | VP1 | ABW16837.1 | NV | VP1 | ABQ63333.1 | NV | VP1 | BAI70544.1 |
| NV | VP1 | ABW16834.1 | NV | VP1 | ABQ63330.1 | NV | VP1 | BAI70543.1 |
| NV | VP1 | ABW16831.1 | NV | VP1 | ABQ63327.1 | NV | VP1 | BAI70542.1 |
| NV | VP1 | ABW16830.1 | NV | VP1 | ABQ63316.1 | NV | VP1 | BAI70541.1 |
| NV | VP1 | ABW16828.1 | NV | VP1 | ABQ63315.1 | NV | VP1 | BAI70540.1 |
| NV | VP1 | ABW16826.1 | NV | VP1 | ABQ63314.1 | NV | VP1 | BAI70539.1 |
| NV | VP1 | ABW16823.1 | NV | VP1 | ABQ63313.1 | NV | VP1 | BAI70538.1 |
| NV | VP1 | ABW16822.1 | NV | VP1 | ABQ63311.1 | NV | VP1 | BAI70537.1 |
| NV | VP1 | ABW16821.1 | NV | VP1 | ABQ63310.1 | NV | VP1 | ACX81345.2 |

FIG. 71-34

| Virus | Protein | Accession No. | Virus | Protein | Accession No. | Virus | Protein | Accession No. |
|---|---|---|---|---|---|---|---|---|
| NV | VP1 | ABS12175.2 | NV | VP1 | ABV59412.1 | NV | VP1 | BAH85350.1 |
| NV | VP1 | ABV59571.1 | NV | VP1 | ABV59411.1 | NV | VP1 | BAH85348.1 |
| NV | VP1 | ABV59567.1 | NV | VP1 | ABV59410.1 | NV | VP1 | BAH85346.1 |
| NV | VP1 | ABV59565.1 | NV | VP1 | ABV59409.1 | NV | VP1 | BAH85344.1 |
| NV | VP1 | ABV59563.1 | NV | VP1 | ABV59408.1 | NV | VP1 | BAH85342.1 |
| NV | VP1 | ABV59561.1 | NV | VP1 | ABV59407.1 | NV | VP1 | BAH85340.1 |
| NV | VP1 | ABV59559.1 | NV | VP1 | ABV59406.1 | NV | VP1 | BAH85338.1 |
| NV | VP1 | ABV59553.1 | NV | VP1 | ABV59405.1 | NV | VP1 | BAH85336.1 |
| NV | VP1 | ABV59551.1 | NV | VP1 | ABV59404.1 | NV | VP1 | BAH85334.1 |
| NV | VP1 | ABV59549.1 | NV | VP1 | ABV59403.1 | NV | VP1 | BAH85331.1 |
| NV | VP1 | ABV59547.1 | NV | VP1 | ABE41641.1 | NV | VP1 | BAH85329.1 |
| NV | VP1 | ABV59545.1 | NV | VP1 | ABB81849.1 | NV | VP1 | BAH85327.1 |
| NV | VP1 | ABV59543.1 | NV | VP1 | ABB81848.1 | NV | VP1 | BAH85325.1 |
| NV | VP1 | ABV59541.1 | NV | VP1 | AAX92674.1 | NV | VP1 | BAH85323.1 |
| NV | VP1 | ABV59539.1 | NV | VP1 | AAP79905.1 | NV | VP1 | BAH85321.1 |
| NV | VP1 | ABV59537.1 | NV | VP1 | AAP79904.1 | NV | VP1 | BAH85315.1 |
| NV | VP1 | ABV59533.1 | NV | VP1 | AAP79903.1 | NV | VP1 | BAH85313.1 |
| NV | VP1 | ABV59531.1 | NV | VP1 | AAP79902.1 | NV | VP1 | BAD88556.2 |
| NV | VP1 | ABV59529.1 | NV | VP1 | AAP79901.1 | NV | VP1 | BAD88558.2 |
| NV | VP1 | ABV59523.1 | NV | VP1 | AAP79906.2 | NV | VP1 | BAG50550.1 |
| NV | VP1 | ABV59521.1 | NV | VP1 | ABS12173.2 | NV | VP1 | BAG50549.1 |
| NV | VP1 | ABV59519.1 | NV | VP1 | AAW30195.2 | NV | VP1 | BAG50548.1 |
| NV | VP1 | ABV59517.1 | NV | VP1 | ACK44475.1 | NV | VP1 | BAG50547.1 |
| NV | VP1 | ABV59515.1 | NV | VP1 | ACN62314.1 | NV | VP1 | BAG50546.1 |
| NV | VP1 | ABV59513.1 | NV | VP1 | ACN62313.1 | NV | VP1 | BAG50545.1 |
| NV | VP1 | ABV59511.1 | NV | VP1 | ACN62312.1 | NV | VP1 | BAG50539.1 |
| NV | VP1 | ABV59509.1 | NV | VP1 | ACN62311.1 | NV | VP1 | BAH29786.1 |
| NV | VP1 | ABV59507.1 | NV | VP1 | ACN62310.1 | NV | VP1 | BAG32428.1 |
| NV | VP1 | ABV59501.1 | NV | VP1 | ACN62309.1 | NV | VP1 | BAF35957.1 |
| NV | VP1 | ABV59495.1 | NV | VP1 | ACN62308.1 | NV | VP1 | BAG71034.1 |
| NV | VP1 | ABV59489.1 | NV | VP1 | ACN62307.1 | NV | VP1 | ACA60970.1 |
| NV | VP1 | ABV59487.1 | NV | VP1 | ACN62306.1 | NV | VP1 | ACA60969.1 |
| NV | VP1 | ABV59485.1 | NV | VP1 | ACN62305.1 | NV | VP1 | ABS12171.1 |
| NV | VP1 | ABV59481.1 | NV | VP1 | ACN62304.1 | NV | VP1 | ABS12170.1 |
| NV | VP1 | ABV59475.1 | NV | VP1 | ACN62302.1 | NV | VP1 | ABS12153.1 |
| NV | VP1 | ABV59425.1 | NV | VP1 | ACN62301.1 | NV | VP1 | ABS12146.1 |
| NV | VP1 | ABV59424.1 | NV | VP1 | ACN62300.1 | NV | VP1 | ABS12137.1 |
| NV | VP1 | ABV59423.1 | NV | VP1 | ACN62298.1 | NV | VP1 | ABS12134.1 |
| NV | VP1 | ABV59422.1 | NV | VP1 | ACN62297.1 | NV | VP1 | ABS12132.1 |
| NV | VP1 | ABV59421.1 | NV | VP1 | ACN62296.1 | NV | VP1 | ABS12131.1 |
| NV | VP1 | ABV59420.1 | NV | VP1 | ACN62295.1 | NV | VP1 | ABS12126.1 |
| NV | VP1 | ABV59419.1 | NV | VP1 | ACN62294.1 | NV | VP1 | ABS12125.1 |
| NV | VP1 | ABV59418.1 | NV | VP1 | ACN62293.1 | NV | VP1 | ABS12124.1 |
| NV | VP1 | ABV59417.1 | NV | VP1 | ACN62282.1 | NV | VP1 | ABS12123.1 |
| NV | VP1 | ABV59416.1 | NV | VP1 | ACN62281.1 | NV | VP1 | ABS12122.1 |
| NV | VP1 | ABV59415.1 | NV | VP1 | BAH85356.1 | NV | VP1 | ABS12121.1 |
| NV | VP1 | ABV59414.1 | NV | VP1 | BAH85354.1 | NV | VP1 | ABS12120.1 |
| NV | VP1 | ABV59413.1 | NV | VP1 | BAH85352.1 | NV | VP1 | ABS12119.1 |

FIG. 71-35

| Virus | Protein Accession No. | Virus | Protein Accession No. | Virus | Protein Accession No. |
|---|---|---|---|---|---|
| NV | VP1ABS12118.1 | NV | VP1BAG12909.1 | NV | VP1BAE48588.1 |
| NV | VP1ABS12117.1 | NV | VP1ABV55634.1 | NV | VP1BAE44331.1 |
| NV | VP1ABS12116.1 | NV | VP1ABY65350.1 | NV | VP1BAE44329.1 |
| NV | VP1ABS12114.1 | NV | VP1ABY27560.1 | NV | VP1BAE44327.1 |
| NV | VP1ABS12113.1 | NV | VP1BAF95714.1 | NV | VP1ABC96332.1 |
| NV | VP1BAG55914.1 | NV | VP1BAF95712.1 | NV | VP1BAE48590.1 |
| NV | VP1BAG55912.1 | NV | VP1BAF95710.1 | NV | VP1ABB52553.1 |
| NV | VP1BAG34642.1 | NV | VP1BAF95708.1 | NV | VP1CAI26407.1 |
| NV | VP1BAG34640.1 | NV | VP1BAF95706.1 | NV | VP1CAI26406.1 |
| NV | VP1BAG34638.1 | NV | VP1ABW69189.1 | NV | VP1BAE44393.1 |
| NV | VP1BAG34636.1 | NV | VP1ABV55528.1 | NV | VP1BAE17113.1 |
| NV | VP1BAG34634.1 | NV | VP1ABV55524.1 | NV | VP1BAE17111.1 |
| NV | VP1BAG34632.1 | NV | VP1ABR92751.1 | NV | VP1BAE17107.1 |
| NV | VP1BAG34630.1 | NV | VP1ABK33534.1 | NV | VP1BAE17105.1 |
| NV | VP1BAG34676.1 | NV | VP1ABK33532.1 | NV | VP1BAE17103.1 |
| NV | VP1BAG34674.1 | NV | VP1ABK33528.1 | NV | VP1BAE17101.1 |
| NV | VP1BAG34672.1 | NV | VP1ABP96740.1 | NV | VP1BAE17097.1 |
| NV | VP1BAG34670.1 | NV | VP1ABP96738.1 | NV | VP1BAE17095.1 |
| NV | VP1BAG34668.1 | NV | VP1ABP96736.1 | NV | VP1BAE17093.1 |
| NV | VP1BAG34666.1 | NV | VP1ABP96734.1 | NV | VP1BAE17091.1 |
| NV | VP1BAG34664.1 | NV | VP1ABP96732.1 | NV | VP1BAE17089.1 |
| NV | VP1BAG34662.1 | NV | VP1ABP96730.1 | NV | VP1BAE17087.1 |
| NV | VP1BAG34660.1 | NV | VP1ABP96728.1 | NV | VP1BAE17085.1 |
| NV | VP1BAG34658.1 | NV | VP1ABP96726.1 | NV | VP1BAE17083.1 |
| NV | VP1BAG34656.1 | NV | VP1ABO25863.1 | NV | VP1BAE17081.1 |
| NV | VP1BAG34654.1 | NV | VP1BAF02661.1 | NV | VP1BAE17079.1 |
| NV | VP1BAG34652.1 | NV | VP1BAF02659.1 | NV | VP1BAE17077.1 |
| NV | VP1BAG34650.1 | NV | VP1BAF02649.1 | NV | VP1BAE17075.1 |
| NV | VP1BAG34648.1 | NV | VP1BAF02647.1 | NV | VP1BAE17073.1 |
| NV | VP1BAG34646.1 | NV | VP1BAF02645.1 | NV | VP1BAE17071.1 |
| NV | VP1BAG34644.1 | NV | VP1BAF02643.1 | NV | VP1BAE17069.1 |
| NV | VP1BAF97883.1 | NV | VP1BAF02635.1 | NV | VP1BAE17067.1 |
| NV | VP1BAG39449.1 | NV | VP1BAF02633.1 | NV | VP1BAE17065.1 |
| NV | VP1BAG06969.1 | NV | VP1BAF02631.1 | NV | VP1BAE17061.1 |
| NV | VP1BAG06967.1 | NV | VP1BAF45353.1 | NV | VP1BAE17059.1 |
| NV | VP1BAG06965.1 | NV | VP1BAF45352.1 | NV | VP1BAE17057.1 |
| NV | VP1BAG06963.1 | NV | VP1BAF45351.1 | NV | VP1BAE17055.1 |
| NV | VP1BAG06985.1 | NV | VP1BAF45350.1 | NV | VP1BAD98240.1 |
| NV | VP1BAG06983.1 | NV | VP1BAA21546.1 | NV | VP1AAX14496.1 |
| NV | VP1BAG06981.1 | NV | VP1BAA21545.1 | NV | VP1AAY25356.1 |
| NV | VP1BAG06979.1 | NV | VP1BAA21544.1 | NV | VP1AAY25353.1 |
| NV | VP1BAG06977.1 | NV | VP1BAE98204.1 | NV | VP1CAA57462.1 |
| NV | VP1BAG06975.1 | NV | VP1BAE98202.1 | NV | VP1BAD14634.1 |
| NV | VP1BAG06971.1 | NV | VP1BAE98200.1 | NV | VP1BAD14632.1 |
| NV | VP1BAG30939.1 | NV | VP1BAE98197.1 | NV | VP1BAD14630.1 |
| NV | VP1BAG30923.1 | NV | VP1BAE98194.1 | NV | VP1BAD14628.1 |
| NV | VP1BAG16750.1 | NV | VP1BAE98191.1 | NV | VP1BAD14626.1 |
| NV | VP1BAG16174.1 | NV | VP1BAE48589.1 | NV | VP1BAD14624.1 |

FIG. 71-36

| Virus Protein Accession No. | Virus Protein Accession No. | Virus Protein Accession No. |
|---|---|---|
| NV VP1BAD14620.1 | NV VP1BAD14407.1 | NV VP1BAD14780.1 |
| NV VP1BAD14501.1 | NV VP1BAD14405.1 | NV VP1BAD14778.1 |
| NV VP1BAD14499.1 | NV VP1BAD14403.1 | NV VP1BAD14776.1 |
| NV VP1BAD14497.1 | NV VP1BAD14401.1 | NV VP1BAD14774.1 |
| NV VP1BAD14495.1 | NV VP1BAD14887.1 | NV VP1BAD14772.1 |
| NV VP1BAD14493.1 | NV VP1BAD14883.1 | NV VP1BAD14770.1 |
| NV VP1BAD14491.1 | NV VP1BAD14881.1 | NV VP1BAD14762.1 |
| NV VP1BAD14489.1 | NV VP1BAD14879.1 | NV VP1BAD14760.1 |
| NV VP1BAD14487.1 | NV VP1BAD14877.1 | NV VP1BAD14758.1 |
| NV VP1BAD14485.1 | NV VP1BAD14875.1 | NV VP1BAD14756.1 |
| NV VP1BAD14483.1 | NV VP1BAD14872.1 | NV VP1BAD14754.1 |
| NV VP1BAD14481.1 | NV VP1BAD14870.1 | NV VP1BAD14752.1 |
| NV VP1BAD14479.1 | NV VP1BAD14868.1 | NV VP1BAD14750.1 |
| NV VP1BAD14477.1 | NV VP1BAD14866.1 | NV VP1BAD14748.1 |
| NV VP1BAD14475.1 | NV VP1BAD14864.1 | NV VP1BAD14746.1 |
| NV VP1BAD14473.1 | NV VP1BAD14862.1 | NV VP1BAD14744.1 |
| NV VP1BAD14471.1 | NV VP1BAD14860.1 | NV VP1BAD14742.1 |
| NV VP1BAD14469.1 | NV VP1BAD14858.1 | NV VP1BAD14740.1 |
| NV VP1BAD14467.1 | NV VP1BAD14856.1 | NV VP1BAD14736.1 |
| NV VP1BAD14465.1 | NV VP1BAD14854.1 | NV VP1BAD14734.1 |
| NV VP1BAD14463.1 | NV VP1BAD14852.1 | NV VP1BAD14732.1 |
| NV VP1BAD14461.1 | NV VP1BAD14850.1 | NV VP1BAD14730.1 |
| NV VP1BAD14459.1 | NV VP1BAD14848.1 | NV VP1BAD14728.1 |
| NV VP1BAD14457.1 | NV VP1BAD14844.1 | NV VP1BAD14726.1 |
| NV VP1BAD14455.1 | NV VP1BAD14840.1 | NV VP1BAD14724.1 |
| NV VP1BAD14453.1 | NV VP1BAD14838.1 | NV VP1BAD14722.1 |
| NV VP1BAD14451.1 | NV VP1BAD14836.1 | NV VP1BAD14720.1 |
| NV VP1BAD14449.1 | NV VP1BAD14834.1 | NV VP1BAD14718.1 |
| NV VP1BAD14447.1 | NV VP1BAD14830.1 | NV VP1BAD14716.1 |
| NV VP1BAD14445.1 | NV VP1BAD14828.1 | NV VP1BAD14714.1 |
| NV VP1BAD14443.1 | NV VP1BAD14826.1 | NV VP1BAD14712.1 |
| NV VP1BAD14441.1 | NV VP1BAD14824.1 | NV VP1BAD14710.1 |
| NV VP1BAD14439.1 | NV VP1BAD14822.1 | NV VP1BAD14708.1 |
| NV VP1BAD14437.1 | NV VP1BAD14820.1 | NV VP1BAD14706.1 |
| NV VP1BAD14435.1 | NV VP1BAD14818.1 | NV VP1BAD14704.1 |
| NV VP1BAD14433.1 | NV VP1BAD14808.1 | NV VP1BAD14702.1 |
| NV VP1BAD14431.1 | NV VP1BAD14804.1 | NV VP1BAD14700.1 |
| NV VP1BAD14429.1 | NV VP1BAD14802.1 | NV VP1BAD14698.1 |
| NV VP1BAD14427.1 | NV VP1BAD14800.1 | NV VP1BAD14696.1 |
| NV VP1BAD14425.1 | NV VP1BAD14798.1 | NV VP1BAD14694.1 |
| NV VP1BAD14423.1 | NV VP1BAD14796.1 | NV VP1BAD14688.1 |
| NV VP1BAD14421.1 | NV VP1BAD14794.1 | NV VP1BAD14686.1 |
| NV VP1BAD14419.1 | NV VP1BAD14792.1 | NV VP1BAD14684.1 |
| NV VP1BAD14417.1 | NV VP1BAD14790.1 | NV VP1BAD14682.1 |
| NV VP1BAD14415.1 | NV VP1BAD14788.1 | NV VP1BAD14680.1 |
| NV VP1BAD14413.1 | NV VP1BAD14786.1 | NV VP1BAD14678.1 |
| NV VP1BAD14411.1 | NV VP1BAD14784.1 | NV VP1BAD14676.1 |
| NV VP1BAD14409.1 | NV VP1BAD14782.1 | NV VP1BAD14674.1 |

FIG. 71-37

| Virus | Protein | Accession No. | Virus | Protein | Accession No. | Virus | Protein | Accession No. |
|---|---|---|---|---|---|---|---|---|
| NV | VP1 | BAD14672.1 | NV | VP1 | BAD14529.1 | NV | POL | CAR82231.1 |
| NV | VP1 | BAD14670.1 | NV | VP1 | BAD14528.1 | NV | POL | CAR82230.1 |
| NV | VP1 | BAD14668.1 | NV | VP1 | BAD14526.1 | NV | POL | CAR82229.1 |
| NV | VP1 | BAD14664.1 | NV | VP1 | BAD14525.1 | NV | POL | CAR82228.1 |
| NV | VP1 | BAD14662.1 | NV | VP1 | BAD14524.1 | NV | POL | CAR82227.1 |
| NV | VP1 | BAD14656.1 | NV | VP1 | BAD14523.1 | NV | POL | CAR82226.1 |
| NV | VP1 | BAD14654.1 | NV | VP1 | BAD14521.1 | NV | POL | CAR82225.1 |
| NV | VP1 | BAD14652.1 | NV | VP1 | BAD14520.1 | NV | POL | CAR82224.1 |
| NV | VP1 | BAD14650.1 | NV | VP1 | BAD14518.1 | NV | POL | CAR82223.1 |
| NV | VP1 | BAD14646.1 | NV | VP1 | BAD14516.1 | NV | POL | CAR82222.1 |
| NV | VP1 | BAD14644.1 | NV | VP1 | BAD14515.1 | NV | POL | CAR82221.1 |
| NV | VP1 | BAD14642.1 | NV | VP1 | BAD14513.1 | NV | POL | CAR82220.1 |
| NV | VP1 | BAD14640.1 | NV | VP1 | BAD14511.1 | NV | POL | CAR82219.1 |
| NV | VP1 | BAD14638.1 | NV | VP1 | BAD14509.1 | NV | POL | CAR82218.1 |
| NV | VP1 | BAD14636.1 | NV | VP1 | BAD14507.1 | NV | POL | CAR82217.1 |
| NV | VP1 | BAD14614.1 | NV | VP1 | BAD14505.1 | NV | POL | CAR82216.1 |
| NV | VP1 | BAD14612.1 | NV | VP1 | BAD14503.1 | NV | POL | CAR82215.1 |
| NV | VP1 | BAD14610.1 | NV | POL | AEA02123.1 | NV | POL | CAR82214.1 |
| NV | VP1 | BAD14608.1 | NV | POL | ADY17222.1 | NV | POL | CAR82213.1 |
| NV | VP1 | BAD14606.1 | NV | POL | ADY17221.1 | NV | POL | CAR82212.1 |
| NV | VP1 | BAD14590.1 | NV | POL | CBW30472.1 | NV | POL | CAR82211.1 |
| NV | VP1 | BAD14588.1 | NV | POL | CBW30471.1 | NV | POL | CAR82210.1 |
| NV | VP1 | BAD14586.1 | NV | POL | CBW30470.1 | NV | POL | CAR82209.1 |
| NV | VP1 | BAD14584.1 | NV | POL | ACT82464.1 | NV | POL | CAR82208.1 |
| NV | VP1 | BAD14582.1 | NV | POL | ACT82463.1 | NV | POL | CAR82207.1 |
| NV | VP1 | BAD14580.1 | NV | POL | ACT82462.1 | NV | POL | CAR82206.1 |
| NV | VP1 | BAD14578.1 | NV | POL | ADO24356.1 | NV | POL | ACN32267.1 |
| NV | VP1 | BAD14576.1 | NV | POL | AAA59234.1 | NV | POL | ACN32266.1 |
| NV | VP1 | BAD14574.1 | NV | POL | AAA59226.1 | NV | POL | ACN32265.1 |
| NV | VP1 | BAD14572.1 | NV | POL | AAA96799.1 | NV | POL | ACL14978.1 |
| NV | VP1 | BAD14570.1 | NV | POL | AAA59232.1 | NV | POL | ACL14976.1 |
| NV | VP1 | BAD14568.1 | NV | POL | AAA59228.1 | NV | POL | ACL14974.1 |
| NV | VP1 | BAD14566.1 | NV | POL | BAI40055.1 | NV | POL | ACL14972.1 |
| NV | VP1 | BAD14564.1 | NV | POL | BAI40049.1 | NV | POL | ACL14971.1 |
| NV | VP1 | BAD14562.1 | NV | POL | BAI40043.1 | NV | POL | ACL14969.1 |
| NV | VP1 | BAD14560.1 | NV | POL | BAI40041.1 | NV | POL | ACL14967.1 |
| NV | VP1 | BAD14550.1 | NV | POL | BAI40035.1 | NV | POL | ACL14965.1 |
| NV | VP1 | BAD14548.1 | NV | POL | BAI40033.1 | NV | POL | ACL14963.1 |
| NV | VP1 | BAD14546.1 | NV | POL | BAI40029.1 | NV | POL | ACL14961.1 |
| NV | VP1 | BAD14544.1 | NV | POL | BAI40023.1 | NV | POL | ACL14959.1 |
| NV | VP1 | BAD14542.1 | NV | POL | BAI40015.1 | NV | POL | ACL14957.1 |
| NV | VP1 | BAD14540.1 | NV | POL | ADF45588.1 | NV | POL | ACL14956.1 |
| NV | VP1 | BAD14538.1 | NV | POL | CAR82237.1 | NV | POL | ACL14954.1 |
| NV | VP1 | BAD14536.1 | NV | POL | CAR82236.1 | NV | POL | ACL14952.1 |
| NV | VP1 | BAD14534.1 | NV | POL | CAR82235.1 | NV | POL | ACL14951.1 |
| NV | VP1 | BAD14532.1 | NV | POL | CAR82234.1 | NV | POL | ACL14950.1 |
| NV | VP1 | BAD14531.1 | NV | POL | CAR82233.1 | NV | POL | ABY47616.1 |
| NV | VP1 | BAD14530.1 | NV | POL | CAR82232.1 | NV | POL | ABY47612.1 |

FIG. 71-38

| Virus | Protein | Accession No. | Virus | Protein | Accession No. | Virus | Protein | Accession No. |
|---|---|---|---|---|---|---|---|---|
| NV | POL | ABY47611.1 | NV | POL | ABC86726.1 | NV | POL | ABO15284.1 |
| NV | POL | ABY47610.1 | NV | POL | ABC86725.1 | NV | POL | ABO15282.1 |
| NV | POL | ABW93744.1 | NV | POL | ABC86724.1 | NV | POL | ABO15274.1 |
| NV | POL | ABW74120.1 | NV | POL | ABC86723.1 | NV | POL | ABD98163.1 |
| NV | POL | ABW74119.1 | NV | POL | ABC86722.1 | NV | POL | ABD98161.1 |
| NV | POL | ABW74118.1 | NV | POL | AAS86806.1 | NV | POL | ACU56257.1 |
| NV | POL | ABW74117.1 | NV | POL | AAS86782.1 | NV | POL | ABF93209.1 |
| NV | POL | ABW74116.1 | NV | POL | AAS86779.1 | NV | POL | ACZ92129.1 |
| NV | POL | ABW74115.1 | NV | POL | AAQ56226.1 | NV | POL | AAB50465.1 |
| NV | POL | ABW74114.1 | NV | POL | AAL57343.1 | NV | POL | AAM81232.1 |
| NV | POL | ABW74113.1 | NV | POL | AAL01896.1 | NV | POL | AAM81231.1 |
| NV | POL | ABW74112.1 | NV | POL | AAL01895.1 | NV | POL | AAM81230.1 |
| NV | POL | ABW74111.1 | NV | POL | AAL01894.1 | NV | POL | AAM81229.1 |
| NV | POL | ABW74110.1 | NV | POL | AAL01893.1 | NV | POL | AAM81228.1 |
| NV | POL | ABW74109.1 | NV | POL | AAL01892.1 | NV | POL | AAM81227.1 |
| NV | POL | ABW74108.1 | NV | POL | AAL01891.1 | NV | POL | AAM81226.1 |
| NV | POL | ABW74107.1 | NV | POL | AAL01890.1 | NV | POL | AAM81225.1 |
| NV | POL | ABW74106.1 | NV | POL | AAK40232.1 | NV | POL | AAM81224.1 |
| NV | POL | ABW74105.1 | NV | POL | AAD31001.1 | NV | POL | AAM81223.1 |
| NV | POL | ABW74104.1 | NV | POL | AAC64602.1 | NV | POL | AAM81222.1 |
| NV | POL | ABW74103.1 | NV | POL | AAM95184.2 | NV | POL | AAM81221.1 |
| NV | POL | ABW74102.1 | NV | POL | AAM95178.2 | NV | POL | AAM81220.1 |
| NV | POL | ABW74101.1 | NV | POL | AAM95190.1 | NV | POL | AAM81219.1 |
| NV | POL | ABW74100.1 | NV | POL | AAM95187.1 | NV | POL | AAM81218.1 |
| NV | POL | ABW74099.1 | NV | POL | AAM95183.1 | NV | POL | AAM81217.1 |
| NV | POL | ABW74098.1 | NV | POL | AAM95182.1 | NV | POL | AAM81216.1 |
| NV | POL | ABW74097.1 | NV | POL | AAM95181.1 | NV | POL | AAM81215.1 |
| NV | POL | ABW74096.1 | NV | POL | AAM95180.1 | NV | POL | AAM81214.1 |
| NV | POL | ABW74087.1 | NV | POL | AAM95179.1 | NV | POL | AAM81212.1 |
| NV | POL | ABW74084.1 | NV | POL | AAL32427.1 | NV | POL | AAG34118.1 |
| NV | POL | ABW74083.1 | NV | POL | AAL32426.1 | NV | POL | AAG34110.1 |
| NV | POL | ABW74082.1 | NV | POL | AAL32425.1 | NV | POL | AAG22042.1 |
| NV | POL | ABU97688.1 | NV | POL | AAL32423.1 | NV | POL | AAG22041.1 |
| NV | POL | ABU97687.1 | NV | POL | AAL32422.1 | NV | POL | AAG22040.1 |
| NV | POL | ABN58849.1 | NV | POL | AAL32420.1 | NV | POL | AAG22039.1 |
| NV | POL | ABM66378.1 | NV | POL | AAL32419.1 | NV | POL | AAM81234.2 |
| NV | POL | ABF22494.1 | NV | POL | AAL32418.1 | NV | POL | AAF89995.1 |
| NV | POL | ABC86737.1 | NV | POL | AAL32417.1 | NV | POL | AAF86321.1 |
| NV | POL | ABC86736.1 | NV | POL | AAL32416.1 | NV | POL | AAF86319.1 |
| NV | POL | ABC86735.1 | NV | POL | AAL32415.1 | NV | POL | AAF86318.1 |
| NV | POL | ABC86734.1 | NV | POL | AAL32414.1 | NV | POL | AAF86316.1 |
| NV | POL | ABC86733.1 | NV | POL | AAL32413.1 | NV | POL | BAF38402.1 |
| NV | POL | ABC86732.1 | NV | POL | AAL32412.1 | NV | POL | BAF38399.1 |
| NV | POL | ABC86731.1 | NV | POL | AAF24507.1 | NV | POL | BAF38396.1 |
| NV | POL | ABC86730.1 | NV | POL | ADB54833.1 | NV | POL | BAF38393.1 |
| NV | POL | ABC86729.1 | NV | POL | ACZ92271.1 | NV | POL | BAC10244.2 |
| NV | POL | ABC86728.1 | NV | POL | ACN32269.1 | NV | POL | BAD99210.1 |
| NV | POL | ABC86727.1 | NV | POL | ABO15286.1 | NV | POL | BAC98439.1 |

FIG. 71-39

| Virus | Protein | Accession No. | Virus | Protein | Accession No. | Virus | Protein | Accession No. |
|---|---|---|---|---|---|---|---|---|
| NV | POL | BAC10254.1 | NV | POL | BAA35016.1 | NV | POL | BAA96527.1 |
| NV | POL | BAC10253.1 | NV | POL | CAN59627.1 | NV | POL | BAA96526.1 |
| NV | POL | BAC10252.1 | NV | POL | CAN59623.1 | NV | POL | BAA96525.1 |
| NV | POL | BAC10251.1 | NV | POL | CAN59619.1 | NV | POL | BAA96524.1 |
| NV | POL | BAC10250.1 | NV | POL | CAN59615.1 | NV | POL | BAA96523.1 |
| NV | POL | BAC10249.1 | NV | POL | CAN59611.1 | NV | POL | BAA96522.1 |
| NV | POL | BAC10248.1 | NV | POL | CAN59607.1 | NV | POL | BAA96521.1 |
| NV | POL | BAC10247.1 | NV | POL | BAA35194.1 | NV | POL | BAA86862.1 |
| NV | POL | BAC10245.1 | NV | POL | BAA35028.1 | NV | POL | BAA86861.1 |
| NV | POL | BAC10242.1 | NV | POL | BAA35027.1 | NV | POL | BAA86860.1 |
| NV | POL | BAC10241.1 | NV | POL | BAA35026.1 | NV | POL | BAA86859.1 |
| NV | POL | BAC10240.1 | NV | POL | BAA35025.1 | NV | POL | BAA86858.1 |
| NV | POL | BAC10236.1 | NV | POL | BAA35024.1 | NV | POL | BAA86857.1 |
| NV | POL | BAC10235.1 | NV | POL | BAA35023.1 | NV | POL | BAA86856.1 |
| NV | POL | BAC10233.1 | NV | POL | BAA35022.1 | NV | POL | BAD02481.1 |
| NV | POL | NP_786950.1 | NV | POL | BAA35021.1 | NV | POL | BAC11839.1 |
| NV | POL | NP_056820.1 | NV | POL | BAA35020.1 | NV | POL | BAC11836.1 |
| NV | POL | ACF33134.1 | NV | POL | BAA35019.1 | NV | POL | BAC11833.1 |
| NV | POL | BAB85831.1 | NV | POL | BAA35014.1 | NV | POL | BAC11830.1 |
| NV | POL | BAB85830.1 | NV | POL | BAA35012.1 | NV | POL | BAC11827.1 |
| NV | POL | BAB85829.1 | NV | POL | BAB84157.1 | NV | POL | BAC11824.1 |
| NV | POL | BAB85826.1 | NV | POL | BAB84154.1 | NV | POL | BAC11821.1 |
| NV | POL | BAB85825.1 | NV | POL | BAB84151.1 | NV | POL | BAC11818.1 |
| NV | POL | BAB85823.1 | NV | POL | BAB84148.1 | NV | POL | BAC11815.1 |
| NV | POL | BAB85822.1 | NV | POL | BAB84145.1 | NV | POL | BAC11812.1 |
| NV | POL | BAB85821.1 | NV | POL | BAB84142.1 | NV | POL | BAC05690.1 |
| NV | POL | BAB85820.1 | NV | POL | BAB84139.1 | NV | POL | BAB91560.1 |
| NV | POL | BAB85818.1 | NV | POL | BAB84136.1 | NV | POL | BAB85819.1 |
| NV | POL | BAB85817.1 | NV | POL | ABF14965.1 | NV | POL | BAB21555.1 |
| NV | POL | BAB85802.1 | NV | POL | ABC18326.1 | NV | POL | BAB21554.1 |
| NV | POL | BAB85800.1 | NV | POL | BAE43832.1 | NV | POL | BAB21553.1 |
| NV | POL | BAB85799.1 | NV | POL | CAA74036.1 | NV | POL | BAB21552.1 |
| NV | POL | BAB85797.1 | NV | POL | CAA74035.1 | NV | POL | BAB20620.1 |
| NV | POL | BAB85796.1 | NV | POL | CAE47528.2 | NV | POL | BAB20619.1 |
| NV | POL | BAB85795.1 | NV | POL | AAX63447.1 | NV | POL | BAB20618.1 |
| NV | POL | BAB85794.1 | NV | POL | AAX63446.1 | NV | POL | BAB20617.1 |
| NV | POL | BAB85793.1 | NV | POL | CAF24894.1 | NV | POL | BAB20616.1 |
| NV | POL | BAB85791.1 | NV | POL | CAF24854.1 | NV | POL | BAB20615.1 |
| NV | POL | BAB85782.1 | NV | POL | CAF24853.1 | NV | POL | BAB20614.1 |
| NV | POL | BAB85780.1 | NV | POL | BAD14492.1 | NV | POL | BAA34111.1 |
| NV | POL | BAB85778.1 | NV | POL | BAA96531.2 | NV | POL | BAA34110.1 |
| NV | POL | BAB85776.1 | NV | POL | BAA96535.1 | NV | POL | BAA34109.1 |
| NV | POL | BAB85774.1 | NV | POL | BAA96534.1 | NV | POL | BAA34108.1 |
| NV | POL | BAB85772.1 | NV | POL | BAA96533.1 | NV | POL | BAA34107.1 |
| NV | POL | BAB85770.1 | NV | POL | BAA96532.1 | NV | POL | BAA34106.1 |
| NV | POL | BAB85768.1 | NV | POL | BAA96530.1 | NV | POL | BAA34105.1 |
| NV | POL | BAB85766.1 | NV | POL | BAA96529.1 | NV | POL | BAA34104.1 |
| NV | POL | BAB85764.1 | NV | POL | BAA96528.1 | NV | POL | BAA34103.1 |

FIG. 71-40

| Virus Protein | Accession No. | Virus Protein | Accession No. | Virus Protein | Accession No. |
|---|---|---|---|---|---|
| NV POL | BAA34102.1 | NV POL | ADV37940.1 | NV POL | ADV37844.1 |
| NV POL | BAA34101.1 | NV POL | ADV37938.1 | NV POL | ADV37842.1 |
| NV POL | BAA34100.1 | NV POL | ADV37936.1 | NV POL | ADV37840.1 |
| NV POL | BAA34099.1 | NV POL | ADV37934.1 | NV POL | ADV37838.1 |
| NV POL | BAA34098.1 | NV POL | ADV37932.1 | NV POL | ADV37836.1 |
| NV POL | BAA34097.1 | NV POL | ADV37930.1 | NV POL | ADV37835.1 |
| NV POL | BAA34096.1 | NV POL | ADV37928.1 | NV POL | ADV37832.1 |
| NV POL | BAA34095.1 | NV POL | ADV37926.1 | NV POL | ADV37830.1 |
| NV POL | BAA34094.1 | NV POL | ADV37924.1 | NV POL | ADV37828.1 |
| NV POL | BAA34093.1 | NV POL | ADV37922.1 | NV POL | ADV37826.1 |
| NV POL | BAB03261.1 | NV POL | ADV37920.1 | NV POL | ADV37824.1 |
| NV POL | BAB03260.1 | NV POL | ADV37918.1 | NV POL | ADV37822.1 |
| NV POL | BAB03259.1 | NV POL | ADV37916.1 | NV POL | ADV37820.1 |
| NV POL | BAB03258.1 | NV POL | ADV37914.1 | NV POL | ADV37818.1 |
| NV POL | BAB03257.1 | NV POL | ADV37912.1 | NV POL | ADV37816.1 |
| NV POL | BAB03256.1 | NV POL | ADV37910.1 | NV POL | ADV37814.1 |
| NV POL | BAB03255.1 | NV POL | ADV37908.1 | NV POL | ADV37812.1 |
| NV POL | BAB03253.1 | NV POL | ADV37906.1 | NV POL | ADV37810.1 |
| NV POL | BAB03252.1 | NV POL | ADV37904.1 | NV POL | ADV37808.1 |
| NV POL | BAB03199.1 | NV POL | ADV37902.1 | NV POL | ADV37806.1 |
| NV POL | BAB03198.1 | NV POL | ADV37900.1 | NV POL | ADV37804.1 |
| NV POL | BAB03197.1 | NV POL | ADV37898.1 | NV POL | ADV37802.1 |
| NV POL | BAB03196.1 | NV POL | ADV37896.1 | NV POL | ADV37800.1 |
| NV POL | BAB03195.1 | NV POL | ADV37894.1 | NV POL | ADV37798.1 |
| NV POL | BAB03194.1 | NV POL | ADV37892.1 | NV POL | ADV37796.1 |
| NV POL | BAB03193.1 | NV POL | ADV37890.1 | NV POL | ADV37794.1 |
| NV POL | BAB03192.1 | NV POL | ADV37888.1 | NV POL | ADV37792.1 |
| NV POL | BAB03191.1 | NV POL | ADV37886.1 | NV POL | ADV37790.1 |
| NV POL | BAB03190.1 | NV POL | ADV37884.1 | NV POL | ADV37788.1 |
| NV POL | BAB03189.1 | NV POL | ADV37882.1 | NV POL | ADV37786.1 |
| NV POL | BAB03188.1 | NV POL | ADV37880.1 | NV POL | ADV37784.1 |
| NV POL | BAB03187.1 | NV POL | ADV37878.1 | NV POL | ADV37782.1 |
| NV POL | BAB02271.1 | NV POL | ADV37876.1 | NV POL | ADV37780.1 |
| NV POL | BAA95450.1 | NV POL | ADV37874.1 | NV POL | ADV37778.1 |
| NV POL | BAA87610.1 | NV POL | ADV37872.1 | NV POL | ADV37776.1 |
| NV POL | BAA87609.1 | NV POL | ADV37870.1 | NV POL | ADU56228.1 |
| NV POL | BAA87608.1 | NV POL | ADV37868.1 | NV POL | ADU56227.1 |
| NV POL | BAA87607.1 | NV POL | ADV37866.1 | NV POL | ADU56226.1 |
| NV POL | BAA87606.1 | NV POL | ADV37864.1 | NV POL | ACJ04893.1 |
| NV POL | BAA86863.1 | NV POL | ADV37862.1 | NV POL | ACJ04892.1 |
| NV POL | ADY17227.1 | NV POL | ADV37860.1 | NV POL | ACJ04891.1 |
| NV POL | ADY17226.1 | NV POL | ADV37858.1 | NV POL | ACJ04890.1 |
| NV POL | ADY17225.1 | NV POL | ADV37856.1 | NV POL | ACJ04889.1 |
| NV POL | ADY17224.1 | NV POL | ADV37854.1 | NV POL | ACJ04888.1 |
| NV POL | ADY17223.1 | NV POL | ADV37852.1 | NV POL | ACJ04887.1 |
| NV POL | CBX26417.1 | NV POL | ADV37850.1 | NV POL | ACJ04886.1 |
| NV POL | CBX26416.1 | NV POL | ADV37848.1 | NV POL | ACJ04885.1 |
| NV POL | ADV37942.1 | NV POL | ADV37846.1 | NV POL | ACJ04884.1 |

FIG. 71-41

| Virus | Protein | Accession No. | Virus | Protein | Accession No. | Virus | Protein | Accession No. |
|---|---|---|---|---|---|---|---|---|
| NV | POL | ACJ04883.1 | NV | POL | CBW30420.1 | NV | POL | CBW30359.1 |
| NV | POL | ACJ04882.1 | NV | POL | CBW30419.1 | NV | POL | CBW30360.1 |
| NV | POL | ACJ04881.1 | NV | POL | CBW30418.1 | NV | POL | CBW30361.1 |
| NV | POL | ACJ04880.1 | NV | POL | CBW30344.1 | NV | POL | CBW30362.1 |
| NV | POL | CBW30464.1 | NV | POL | CBW30343.1 | NV | POL | CBW30363.1 |
| NV | POL | CBW30463.1 | NV | POL | CBW30342.1 | NV | POL | CBW30364.1 |
| NV | POL | CBW30462.1 | NV | POL | CBW30341.1 | NV | POL | CBW30365.1 |
| NV | POL | CBW30461.1 | NV | POL | CBW30340.1 | NV | POL | CBW30366.1 |
| NV | POL | CBW30460.1 | NV | POL | CBW30339.1 | NV | POL | CBW30367.1 |
| NV | POL | CBW30459.1 | NV | POL | CBW30338.1 | NV | POL | CBW30368.1 |
| NV | POL | CBW30458.1 | NV | POL | CBW30337.1 | NV | POL | CBW30369.1 |
| NV | POL | CBW30457.1 | NV | POL | CBW30336.1 | NV | POL | CBW30370.1 |
| NV | POL | CBW30456.1 | NV | POL | CBW30335.1 | NV | POL | CBW30371.1 |
| NV | POL | CBW30455.1 | NV | POL | CBW30334.1 | NV | POL | CBW30372.1 |
| NV | POL | CBW30454.1 | NV | POL | CBW30333.1 | NV | POL | CBW30373.1 |
| NV | POL | CBW30453.1 | NV | POL | CBW30332.1 | NV | POL | CBW30374.1 |
| NV | POL | CBW30452.1 | NV | POL | CBW30331.1 | NV | POL | CBW30375.1 |
| NV | POL | CBW30451.1 | NV | POL | CBW30330.1 | NV | POL | CBW30408.1 |
| NV | POL | CBW30450.1 | NV | POL | CBW30329.1 | NV | POL | CBW30407.1 |
| NV | POL | CBW30449.1 | NV | POL | CBW30328.1 | NV | POL | CBW30406.1 |
| NV | POL | CBW30448.1 | NV | POL | CBW30327.1 | NV | POL | CBW30405.1 |
| NV | POL | CBW30447.1 | NV | POL | CBW30326.1 | NV | POL | CBW30404.1 |
| NV | POL | CBW30446.1 | NV | POL | CBW30325.1 | NV | POL | CBW30403.1 |
| NV | POL | CBW30445.1 | NV | POL | CBW30324.1 | NV | POL | CBW30402.1 |
| NV | POL | CBW30444.1 | NV | POL | CBW30323.1 | NV | POL | CBW30401.1 |
| NV | POL | CBW30443.1 | NV | POL | CBW30322.1 | NV | POL | CBW30400.1 |
| NV | POL | CBW30442.1 | NV | POL | CBW30321.1 | NV | POL | CBW30399.1 |
| NV | POL | CBW30441.1 | NV | POL | CBW30320.1 | NV | POL | CBW30398.1 |
| NV | POL | CBW30440.1 | NV | POL | CBW30319.1 | NV | POL | CBW30397.1 |
| NV | POL | CBW30439.1 | NV | POL | CBW30318.1 | NV | POL | CBW30396.1 |
| NV | POL | CBW30438.1 | NV | POL | CBW30317.1 | NV | POL | CBW30395.1 |
| NV | POL | CBW30437.1 | NV | POL | CBW30316.1 | NV | POL | CBW30394.1 |
| NV | POL | CBW30436.1 | NV | POL | CBW30417.1 | NV | POL | CBW30393.1 |
| NV | POL | CBW30435.1 | NV | POL | CBW30416.1 | NV | POL | CBW30392.1 |
| NV | POL | CBW30434.1 | NV | POL | CBW30415.1 | NV | POL | CBW30391.1 |
| NV | POL | CBW30433.1 | NV | POL | CBW30414.1 | NV | POL | CBW30390.1 |
| NV | POL | CBW30432.1 | NV | POL | CBW30413.1 | NV | POL | CBW30389.1 |
| NV | POL | CBW30431.1 | NV | POL | CBW30412.1 | NV | POL | CBW30388.1 |
| NV | POL | CBW30430.1 | NV | POL | CBW30411.1 | NV | POL | CBW30387.1 |
| NV | POL | CBW30429.1 | NV | POL | CBW30410.1 | NV | POL | CBW30386.1 |
| NV | POL | CBW30428.1 | NV | POL | CBW30409.1 | NV | POL | CBW30385.1 |
| NV | POL | CBW30427.1 | NV | POL | CBW30352.1 | NV | POL | CBW30384.1 |
| NV | POL | CBW30426.1 | NV | POL | CBW30353.1 | NV | POL | CBW30383.1 |
| NV | POL | CBW30425.1 | NV | POL | CBW30354.1 | NV | POL | CBW30382.1 |
| NV | POL | CBW30424.1 | NV | POL | CBW30355.1 | NV | POL | CBW30381.1 |
| NV | POL | CBW30423.1 | NV | POL | CBW30356.1 | NV | POL | CBW30380.1 |
| NV | POL | CBW30422.1 | NV | POL | CBW30357.1 | NV | POL | CBW30379.1 |
| NV | POL | CBW30421.1 | NV | POL | CBW30358.1 | NV | POL | CBW30378.1 |

FIG. 71-42

| Virus | Protein | Accession No. | Virus | Protein | Accession No. | Virus | Protein | Accession No. |
|---|---|---|---|---|---|---|---|---|
| NV | POL | CBW30377.1 | NV | POL | ADR78904.1 | NV | POL | ACV89798.1 |
| NV | POL | CBW30376.1 | NV | POL | ADR78901.1 | NV | POL | ACV89797.1 |
| NV | POL | CBW30351.1 | NV | POL | ADR78898.1 | NV | POL | ACV89796.1 |
| NV | POL | CBW30350.1 | NV | POL | ADR78895.1 | NV | POL | ACV89795.1 |
| NV | POL | CBW30349.1 | NV | POL | ADR78892.1 | NV | POL | ACV89794.1 |
| NV | POL | CBW30348.1 | NV | POL | ADR78889.1 | NV | POL | ACV89793.1 |
| NV | POL | CBW30315.1 | NV | POL | ADR78886.1 | NV | POL | ACV89792.1 |
| NV | POL | CBW30314.1 | NV | POL | ADR78883.1 | NV | POL | ACT91092.1 |
| NV | POL | CBW30313.1 | NV | POL | ADR78880.1 | NV | POL | ACT91091.1 |
| NV | POL | CBW30312.1 | NV | POL | ADR78877.1 | NV | POL | ACL01372.1 |
| NV | POL | CBW30311.1 | NV | POL | ADR78874.1 | NV | POL | ACF34348.1 |
| NV | POL | CBW30310.1 | NV | POL | ADR78871.1 | NV | POL | ACF34347.1 |
| NV | POL | CBW30309.1 | NV | POL | ADR78868.1 | NV | POL | ACF34346.1 |
| NV | POL | CBW30308.1 | NV | POL | ADR78865.1 | NV | POL | ACF34345.1 |
| NV | POL | CBW30307.1 | NV | POL | BAJ19465.1 | NV | POL | ACF34344.1 |
| NV | POL | CBW30306.1 | NV | POL | BAJ19461.1 | NV | POL | ACF34343.1 |
| NV | POL | CBW30305.1 | NV | POL | BAJ19455.1 | NV | POL | ACF34342.1 |
| NV | POL | CBW30304.1 | NV | POL | ACX31888.2 | NV | POL | ACF34341.1 |
| NV | POL | CBW30303.1 | NV | POL | ACX31892.2 | NV | POL | ACF34340.1 |
| NV | POL | CBW30302.1 | NV | POL | ADK12987.1 | NV | POL | ACF34339.1 |
| NV | POL | CBW30347.1 | NV | POL | ADK12920.1 | NV | POL | ACF34338.1 |
| NV | POL | CBW30346.1 | NV | POL | ACX31890.1 | NV | POL | ACF34337.1 |
| NV | POL | CBW30345.1 | NV | POL | ACX31886.1 | NV | POL | ACF34336.1 |
| NV | POL | ACN64873.1 | NV | POL | ACW19926.1 | NV | POL | ACF34335.1 |
| NV | POL | ACC69027.1 | NV | POL | ADJ67978.1 | NV | POL | ACF34334.1 |
| NV | POL | ACC69025.1 | NV | POL | ADJ67977.1 | NV | POL | ACF34333.1 |
| NV | POL | ACC69022.1 | NV | POL | BAJ13752.1 | NV | POL | ACF34332.1 |
| NV | POL | ACC69016.1 | NV | POL | BAJ13746.1 | NV | POL | ACF34331.1 |
| NV | POL | ACC69015.1 | NV | POL | ADI81050.1 | NV | POL | ACF34330.1 |
| NV | POL | ACC69014.1 | NV | POL | ACZ69373.1 | NV | POL | ACF34329.1 |
| NV | POL | ACC69013.1 | NV | POL | ACZ69372.1 | NV | POL | ACF34328.1 |
| NV | POL | ADR78955.1 | NV | POL | ACZ69371.1 | NV | POL | ACF34327.1 |
| NV | POL | ADR78952.1 | NV | POL | ACZ69370.1 | NV | POL | ABY19832.1 |
| NV | POL | ADR78949.1 | NV | POL | ACZ69369.1 | NV | POL | ABY19520.1 |
| NV | POL | ADR78946.1 | NV | POL | ACV89812.1 | NV | POL | ABN47455.1 |
| NV | POL | ADR78943.1 | NV | POL | ACV89811.1 | NV | POL | ABN47454.1 |
| NV | POL | ADR78940.1 | NV | POL | ACV89810.1 | NV | POL | ABN47453.1 |
| NV | POL | ADR78937.1 | NV | POL | ACV89809.1 | NV | POL | ABN47452.1 |
| NV | POL | ADR78934.1 | NV | POL | ACV89808.1 | NV | POL | ABN47451.1 |
| NV | POL | ADR78931.1 | NV | POL | ACV89807.1 | NV | POL | ABN47450.1 |
| NV | POL | ADR78928.1 | NV | POL | ACV89806.1 | NV | POL | ABN47449.1 |
| NV | POL | ADR78925.1 | NV | POL | ACV89805.1 | NV | POL | ABX26296.1 |
| NV | POL | ADR78922.1 | NV | POL | ACV89804.1 | NV | POL | ABX26295.1 |
| NV | POL | ADR78919.1 | NV | POL | ACV89803.1 | NV | POL | ABX26293.1 |
| NV | POL | ADR78916.1 | NV | POL | ACV89802.1 | NV | POL | ABX26292.1 |
| NV | POL | ADR78913.1 | NV | POL | ACV89801.1 | NV | POL | ABX26291.1 |
| NV | POL | ADR78910.1 | NV | POL | ACV89800.1 | NV | POL | ABX26290.1 |
| NV | POL | ADR78907.1 | NV | POL | ACV89799.1 | NV | POL | ABX26289.1 |

FIG. 71-43

| Virus Protein | Accession No. | Virus Protein | Accession No. | Virus Protein | Accession No. |
|---|---|---|---|---|---|
| NV POL | ABX26288.1 | NV POL | ACY54690.1 | NV POL | ACY00602.1 |
| NV POL | ABX26286.1 | NV POL | ACY54689.1 | NV POL | ACY00599.1 |
| NV POL | ABX26284.1 | NV POL | ACY54688.1 | NV POL | ACY00596.1 |
| NV POL | ABX26283.1 | NV POL | ACY54687.1 | NV POL | ACY00593.1 |
| NV POL | ABX26282.1 | NV POL | ACY54686.1 | NV POL | ACY00590.1 |
| NV POL | ABX26278.1 | NV POL | ADO85554.1 | NV POL | ACY00587.1 |
| NV POL | ADQ48138.1 | NV POL | ADO85551.1 | NV POL | ACY00584.1 |
| NV POL | ADQ48137.1 | NV POL | BAJ14004.1 | NV POL | ACY00581.1 |
| NV POL | ADQ48136.1 | NV POL | BAJ13980.1 | NV POL | ACY00578.1 |
| NV POL | ADQ48135.1 | NV POL | BAJ13962.1 | NV POL | ACY00575.1 |
| NV POL | ADQ48134.1 | NV POL | BAJ13959.1 | NV POL | ACY00570.1 |
| NV POL | ADQ43782.1 | NV POL | BAJ13938.1 | NV POL | ACY00567.1 |
| NV POL | ADQ43780.1 | NV POL | BAJ13929.1 | NV POL | ACY00564.1 |
| NV POL | ADQ43778.1 | NV POL | BAJ13878.1 | NV POL | ADO24375.1 |
| NV POL | ABZ02205.1 | NV POL | BAJ13848.1 | NV POL | ADO24374.1 |
| NV POL | ABX88974.1 | NV POL | BAJ13845.1 | NV POL | ADO24373.1 |
| NV POL | ABX00630.1 | NV POL | BAJ13842.1 | NV POL | ADO24372.1 |
| NV POL | ACY54755.1 | NV POL | BAJ13836.1 | NV POL | ADO24371.1 |
| NV POL | ACY54754.1 | NV POL | BAJ13830.1 | NV POL | ADO24370.1 |
| NV POL | ACY54753.1 | NV POL | BAJ13806.1 | NV POL | ADO24369.1 |
| NV POL | ACY54752.1 | NV POL | BAJ13785.1 | NV POL | ADO24368.1 |
| NV POL | ACY54747.1 | NV POL | BAJ13767.1 | NV POL | ADO24367.1 |
| NV POL | ACY54746.1 | NV POL | BAJ13764.1 | NV POL | ADO24366.1 |
| NV POL | ACY54743.1 | NV POL | BAJ13761.1 | NV POL | ADO24365.1 |
| NV POL | ACY54735.1 | NV POL | BAJ13749.1 | NV POL | ADO24364.1 |
| NV POL | ACY54733.1 | NV POL | BAJ13725.1 | NV POL | ADO24363.1 |
| NV POL | ACY54727.1 | NV POL | BAJ13665.1 | NV POL | ADO24362.1 |
| NV POL | ACY54726.1 | NV POL | BAJ13608.1 | NV POL | ADO24361.1 |
| NV POL | ACY54712.1 | NV POL | BAJ13584.1 | NV POL | ADO24360.1 |
| NV POL | ACY54711.1 | NV POL | BAJ13563.1 | NV POL | ADO24359.1 |
| NV POL | ACY54710.1 | NV POL | BAJ13542.1 | NV POL | ADO24358.1 |
| NV POL | ACY54709.1 | NV POL | ACY00655.1 | NV POL | ADO24357.1 |
| NV POL | ACY54708.1 | NV POL | ACY00652.1 | NV POL | ADO24355.1 |
| NV POL | ACY54707.1 | NV POL | ACY00649.1 | NV POL | ADO24354.1 |
| NV POL | ACY54706.1 | NV POL | ACY00646.1 | NV POL | ADO24353.1 |
| NV POL | ACY54705.1 | NV POL | ACY00643.1 | NV POL | ADO24352.1 |
| NV POL | ACY54704.1 | NV POL | ACY00640.1 | NV POL | ADO24351.1 |
| NV POL | ACY54703.1 | NV POL | ACY00637.1 | NV POL | ADO24350.1 |
| NV POL | ACY54702.1 | NV POL | ACY00634.1 | NV POL | ADO24349.1 |
| NV POL | ACY54701.1 | NV POL | ACY00631.1 | NV POL | ADO24348.1 |
| NV POL | ACY54700.1 | NV POL | ACY00628.1 | NV POL | ADO24347.1 |
| NV POL | ACY54698.1 | NV POL | ACY00625.1 | NV POL | ADO24346.1 |
| NV POL | ACY54696.1 | NV POL | ACY00620.1 | NV POL | ADM52742.1 |
| NV POL | ACY54695.1 | NV POL | ACY00617.1 | NV POL | ABX59558.1 |
| NV POL | ACY54694.1 | NV POL | ACY00614.1 | NV POL | ABX59555.1 |
| NV POL | ACY54693.1 | NV POL | ACY00611.1 | NV POL | ABX59554.1 |
| NV POL | ACY54692.1 | NV POL | ACY00608.1 | NV POL | ABX59553.1 |
| NV POL | ACY54691.1 | NV POL | ACY00605.1 | NV POL | ABX59552.1 |

FIG. 71-44

| Virus Protein | Accession No. | Virus Protein | Accession No. | Virus Protein | Accession No. |
|---|---|---|---|---|---|
| NV POL | ABX59551.1 | NV POL | BAJ13872.1 | NV POL | BAJ13686.1 |
| NV POL | ABX59548.1 | NV POL | BAJ13869.1 | NV POL | BAJ13683.1 |
| NV POL | ABX59546.1 | NV POL | BAJ13866.1 | NV POL | BAJ13680.1 |
| NV POL | ABX59537.1 | NV POL | BAJ13863.1 | NV POL | BAJ13677.1 |
| NV POL | ABX59536.1 | NV POL | BAJ13860.1 | NV POL | BAJ13674.1 |
| NV POL | ABX59535.1 | NV POL | BAJ13857.1 | NV POL | BAJ13671.1 |
| NV POL | ADK23786.1 | NV POL | BAJ13854.1 | NV POL | BAJ13668.1 |
| NV POL | BAJ14016.1 | NV POL | BAJ13851.1 | NV POL | BAJ13662.1 |
| NV POL | BAJ14013.1 | NV POL | BAJ13839.1 | NV POL | BAJ13659.1 |
| NV POL | BAJ14010.1 | NV POL | BAJ13833.1 | NV POL | BAJ13656.1 |
| NV POL | BAJ14007.1 | NV POL | BAJ13827.1 | NV POL | BAJ13653.1 |
| NV POL | BAJ14001.1 | NV POL | BAJ13824.1 | NV POL | BAJ13650.1 |
| NV POL | BAJ13998.1 | NV POL | BAJ13821.1 | NV POL | BAJ13647.1 |
| NV POL | BAJ13995.1 | NV POL | BAJ13818.1 | NV POL | BAJ13644.1 |
| NV POL | BAJ13992.1 | NV POL | BAJ13815.1 | NV POL | BAJ13641.1 |
| NV POL | BAJ13989.1 | NV POL | BAJ13812.1 | NV POL | BAJ13638.1 |
| NV POL | BAJ13986.1 | NV POL | BAJ13809.1 | NV POL | BAJ13635.1 |
| NV POL | BAJ13983.1 | NV POL | BAJ13803.1 | NV POL | BAJ13632.1 |
| NV POL | BAJ13977.1 | NV POL | BAJ13800.1 | NV POL | BAJ13629.1 |
| NV POL | BAJ13974.1 | NV POL | BAJ13797.1 | NV POL | BAJ13626.1 |
| NV POL | BAJ13971.1 | NV POL | BAJ13794.1 | NV POL | BAJ13623.1 |
| NV POL | BAJ13968.1 | NV POL | BAJ13791.1 | NV POL | BAJ13620.1 |
| NV POL | BAJ13965.1 | NV POL | BAJ13788.1 | NV POL | BAJ13617.1 |
| NV POL | BAJ13956.1 | NV POL | BAJ13782.1 | NV POL | BAJ13614.1 |
| NV POL | BAJ13953.1 | NV POL | BAJ13779.1 | NV POL | BAJ13611.1 |
| NV POL | BAJ13950.1 | NV POL | BAJ13776.1 | NV POL | BAJ13605.1 |
| NV POL | BAJ13947.1 | NV POL | BAJ13773.1 | NV POL | BAJ13602.1 |
| NV POL | BAJ13944.1 | NV POL | BAJ13770.1 | NV POL | BAJ13599.1 |
| NV POL | BAJ13941.1 | NV POL | BAJ13758.1 | NV POL | BAJ13596.1 |
| NV POL | BAJ13935.1 | NV POL | BAJ13755.1 | NV POL | BAJ13593.1 |
| NV POL | BAJ13932.1 | NV POL | BAJ13743.1 | NV POL | BAJ13590.1 |
| NV POL | BAJ13926.1 | NV POL | BAJ13740.1 | NV POL | BAJ13587.1 |
| NV POL | BAJ13923.1 | NV POL | BAJ13737.1 | NV POL | BAJ13581.1 |
| NV POL | BAJ13920.1 | NV POL | BAJ13734.1 | NV POL | BAJ13578.1 |
| NV POL | BAJ13917.1 | NV POL | BAJ13731.1 | NV POL | BAJ13575.1 |
| NV POL | BAJ13914.1 | NV POL | BAJ13728.1 | NV POL | BAJ13572.1 |
| NV POL | BAJ13911.1 | NV POL | BAJ13722.1 | NV POL | BAJ13569.1 |
| NV POL | BAJ13908.1 | NV POL | BAJ13719.1 | NV POL | BAJ13566.1 |
| NV POL | BAJ13905.1 | NV POL | BAJ13716.1 | NV POL | BAJ13560.1 |
| NV POL | BAJ13902.1 | NV POL | BAJ13713.1 | NV POL | BAJ13557.1 |
| NV POL | BAJ13899.1 | NV POL | BAJ13710.1 | NV POL | BAJ13554.1 |
| NV POL | BAJ13896.1 | NV POL | BAJ13707.1 | NV POL | BAJ13551.1 |
| NV POL | BAJ13893.1 | NV POL | BAJ13704.1 | NV POL | BAJ13548.1 |
| NV POL | BAJ13890.1 | NV POL | BAJ13701.1 | NV POL | BAJ13545.1 |
| NV POL | BAJ13887.1 | NV POL | BAJ13698.1 | NV POL | BAJ13539.1 |
| NV POL | BAJ13884.1 | NV POL | BAJ13695.1 | NV POL | BAJ13536.1 |
| NV POL | BAJ13881.1 | NV POL | BAJ13692.1 | NV POL | BAJ13533.1 |
| NV POL | BAJ13875.1 | NV POL | BAJ13689.1 | NV POL | BAJ13531.1 |

FIG. 71-45

| Virus Protein | Accession No. | Virus Protein | Accession No. | Virus Protein | Accession No. |
|---|---|---|---|---|---|
| NV POL | BAJ13529.1 | NV POL | ACA64498.1 | NV POL | BAI40031.1 |
| NV POL | BAJ13526.1 | NV POL | ACA64497.1 | NV POL | BAI40027.1 |
| NV POL | BAJ13524.1 | NV POL | ACA64496.1 | NV POL | BAI40025.1 |
| NV POL | BAJ13522.1 | NV POL | ACA64495.1 | NV POL | BAI40021.1 |
| NV POL | BAJ13519.1 | NV POL | ACA64494.1 | NV POL | BAI40019.1 |
| NV POL | BAJ13517.1 | NV POL | ACA64493.1 | NV POL | BAI40017.1 |
| NV POL | BAJ13515.1 | NV POL | ACA64492.1 | NV POL | ADF47124.1 |
| NV POL | BAJ13512.1 | NV POL | ACA64491.1 | NV POL | ADE28727.1 |
| NV POL | BAJ13510.1 | NV POL | ACA64490.1 | NV POL | ADE28725.1 |
| NV POL | BAJ13507.1 | NV POL | ACA64489.1 | NV POL | ADE28707.1 |
| NV POL | ACA64536.1 | NV POL | ACA64488.1 | NV POL | ADE28705.1 |
| NV POL | ACA64535.1 | NV POL | ACA64487.1 | NV POL | ADE28703.1 |
| NV POL | ACA64534.1 | NV POL | ACA64486.1 | NV POL | ADE28700.1 |
| NV POL | ACA64533.1 | NV POL | ACA64485.1 | NV POL | ACX81354.1 |
| NV POL | ACA64532.1 | NV POL | ACA64484.1 | NV POL | ACX81350.1 |
| NV POL | ACA64531.1 | NV POL | ACA64483.1 | NV POL | ACX81348.1 |
| NV POL | ACA64530.1 | NV POL | ACA64482.1 | NV POL | ACX81346.1 |
| NV POL | ACA64529.1 | NV POL | ACA64481.1 | NV POL | ACX81342.1 |
| NV POL | ACA64528.1 | NV POL | ACA64480.1 | NV POL | ACX81340.1 |
| NV POL | ACA64527.1 | NV POL | ACA64479.1 | NV POL | ACX81338.1 |
| NV POL | ACA64526.1 | NV POL | ACA64478.1 | NV POL | CAR82205.1 |
| NV POL | ACA64525.1 | NV POL | ACA64477.1 | NV POL | CAR82204.1 |
| NV POL | ACA64524.1 | NV POL | ACA64476.1 | NV POL | CAR82203.1 |
| NV POL | ACA64523.1 | NV POL | ACA64475.1 | NV POL | CAR82202.1 |
| NV POL | ACA64522.1 | NV POL | ACA64474.1 | NV POL | CAR82201.1 |
| NV POL | ACA64521.1 | NV POL | ACA64473.1 | NV POL | CAR82200.1 |
| NV POL | ACA64520.1 | NV POL | ACA64472.1 | NV POL | CAR82199.1 |
| NV POL | ACA64519.1 | NV POL | ACA64471.1 | NV POL | CAR82198.1 |
| NV POL | ACA64518.1 | NV POL | ACA64470.1 | NV POL | CAR82197.1 |
| NV POL | ACA64517.1 | NV POL | ACA64469.1 | NV POL | CAR82196.1 |
| NV POL | ACA64516.1 | NV POL | ACA64468.1 | NV POL | CAR82195.1 |
| NV POL | ACA64515.1 | NV POL | ACA64467.1 | NV POL | CAR82194.1 |
| NV POL | ACA64514.1 | NV POL | ACA64466.1 | NV POL | CAR82193.1 |
| NV POL | ACA64513.1 | NV POL | ACA64465.1 | NV POL | CAR82192.1 |
| NV POL | ACA64512.1 | NV POL | ACA64464.1 | NV POL | CAR82191.1 |
| NV POL | ACA64511.1 | NV POL | ACA64463.1 | NV POL | CAR82190.1 |
| NV POL | ACA64510.1 | NV POL | AAB97767.2 | NV POL | CAR82189.1 |
| NV POL | ACA64509.1 | NV POL | BAI40065.1 | NV POL | CAR82188.1 |
| NV POL | ACA64508.1 | NV POL | BAI40063.1 | NV POL | CAR82187.1 |
| NV POL | ACA64507.1 | NV POL | BAI40061.1 | NV POL | ADD17074.1 |
| NV POL | ACA64506.1 | NV POL | BAI40059.1 | NV POL | ADD17073.1 |
| NV POL | ACA64505.1 | NV POL | BAI40057.1 | NV POL | ACX30398.1 |
| NV POL | ACA64504.1 | NV POL | BAI40053.1 | NV POL | ACX30396.1 |
| NV POL | ACA64503.1 | NV POL | BAI40051.1 | NV POL | ACX30394.1 |
| NV POL | ACA64502.1 | NV POL | BAI40047.1 | NV POL | ACX30392.1 |
| NV POL | ACA64501.1 | NV POL | BAI40045.1 | NV POL | ACX30390.1 |
| NV POL | ACA64500.1 | NV POL | BAI40039.1 | NV POL | ACX30388.1 |
| NV POL | ACA64499.1 | NV POL | BAI40037.1 | NV POL | ACX30386.1 |

FIG. 71-46

| Virus Protein | Accession No. | Virus Protein | Accession No. | Virus Protein | Accession No. |
|---|---|---|---|---|---|
| NV POL | ACX30384.1 | NV POL | ACL15048.1 | NV POL | ACJ02447.1 |
| NV POL | ACX30382.1 | NV POL | ACL15046.1 | NV POL | ACJ02446.1 |
| NV POL | ACX30380.1 | NV POL | ACL15044.1 | NV POL | ACJ02445.1 |
| NV POL | ACX30378.1 | NV POL | ACL15042.1 | NV POL | ACJ02444.1 |
| NV POL | ACX30376.1 | NV POL | ACL15040.1 | NV POL | ACJ02443.1 |
| NV POL | ACX30374.1 | NV POL | ACL15038.1 | NV POL | ACJ02442.1 |
| NV POL | ACX30372.1 | NV POL | ACL15036.1 | NV POL | ACJ02441.1 |
| NV POL | ACX30370.1 | NV POL | ACL15034.1 | NV POL | ACJ02440.1 |
| NV POL | ACX30368.1 | NV POL | ACL15032.1 | NV POL | ACJ02439.1 |
| NV POL | ACX30366.1 | NV POL | ACL15030.1 | NV POL | ACJ02438.1 |
| NV POL | ACX30364.1 | NV POL | ACL15028.1 | NV POL | ACJ02437.1 |
| NV POL | ACX30362.1 | NV POL | ACL15026.1 | NV POL | ACJ02436.1 |
| NV POL | ACX30360.1 | NV POL | ACL15024.1 | NV POL | ACJ02435.1 |
| NV POL | ACX30358.1 | NV POL | ACL15022.1 | NV POL | ACJ02434.1 |
| NV POL | ACX30356.1 | NV POL | ACL15020.1 | NV POL | ACJ02433.1 |
| NV POL | ACX30354.1 | NV POL | ACL15018.1 | NV POL | ACJ02432.1 |
| NV POL | ACX30352.1 | NV POL | ACL15016.1 | NV POL | ACJ02431.1 |
| NV POL | ACX30350.1 | NV POL | ACL15014.1 | NV POL | ACJ02430.1 |
| NV POL | ACX30348.1 | NV POL | ACL15012.1 | NV POL | ACJ02429.1 |
| NV POL | ACV32668.1 | NV POL | ACL15010.1 | NV POL | ACJ02428.1 |
| NV POL | ACV32645.1 | NV POL | ACL15008.1 | NV POL | ACJ02427.1 |
| NV POL | ACS12912.1 | NV POL | ACL15006.1 | NV POL | ACJ02426.1 |
| NV POL | ACS12911.1 | NV POL | ACL15004.1 | NV POL | ACJ02425.1 |
| NV POL | ACS12910.1 | NV POL | ACL15002.1 | NV POL | ACJ02424.1 |
| NV POL | ACS12909.1 | NV POL | ACL15000.1 | NV POL | ACJ02423.1 |
| NV POL | ACS12908.1 | NV POL | ACL14998.1 | NV POL | ACJ02422.1 |
| NV POL | ACS12907.1 | NV POL | ACL14996.1 | NV POL | ACJ02421.1 |
| NV POL | ACS12906.1 | NV POL | ACL14994.1 | NV POL | ACF05230.1 |
| NV POL | ACS12905.1 | NV POL | ACL14992.1 | NV POL | ACF05229.1 |
| NV POL | ACS12904.1 | NV POL | ACL14990.1 | NV POL | ACF05228.1 |
| NV POL | ACS12903.1 | NV POL | ACL14988.1 | NV POL | ACD91932.1 |
| NV POL | ACN32268.1 | NV POL | ACL14986.1 | NV POL | ACD91931.1 |
| NV POL | ACL15094.1 | NV POL | ACL14984.1 | NV POL | ACD91930.1 |
| NV POL | ACL15090.1 | NV POL | ACL14982.1 | NV POL | ACD91929.1 |
| NV POL | ACL15087.1 | NV POL | ACL14980.1 | NV POL | ACD91928.1 |
| NV POL | ACL15086.1 | NV POL | ACJ02460.1 | NV POL | ACD91927.1 |
| NV POL | ACL15072.1 | NV POL | ACJ02459.1 | NV POL | ACD91926.1 |
| NV POL | ACL15070.1 | NV POL | ACJ02458.1 | NV POL | ACD91925.1 |
| NV POL | ACL15068.1 | NV POL | ACJ02457.1 | NV POL | ACD91924.1 |
| NV POL | ACL15066.1 | NV POL | ACJ02456.1 | NV POL | ACD91923.1 |
| NV POL | ACL15064.1 | NV POL | ACJ02455.1 | NV POL | ACD91922.1 |
| NV POL | ACL15062.1 | NV POL | ACJ02454.1 | NV POL | ACD91921.1 |
| NV POL | ACL15060.1 | NV POL | ACJ02453.1 | NV POL | ACD91920.1 |
| NV POL | ACL15058.1 | NV POL | ACJ02452.1 | NV POL | ACD91919.1 |
| NV POL | ACL15056.1 | NV POL | ACJ02451.1 | NV POL | ACD91918.1 |
| NV POL | ACL15054.1 | NV POL | ACJ02450.1 | NV POL | ACD91917.1 |
| NV POL | ACL15052.1 | NV POL | ACJ02449.1 | NV POL | ACD91916.1 |
| NV POL | ACL15050.1 | NV POL | ACJ02448.1 | NV POL | ACD91915.1 |

FIG. 71-47

| Virus Protein | Accession No. | Virus Protein | Accession No. | Virus Protein | Accession No. |
|---|---|---|---|---|---|
| NV POL | ACD91914.1 | NV POL | ACD91866.1 | NV POL | ABW74094.1 |
| NV POL | ACD91913.1 | NV POL | ACD91865.1 | NV POL | ABW74093.1 |
| NV POL | ACD91912.1 | NV POL | ACD91864.1 | NV POL | ABW74092.1 |
| NV POL | ACD91911.1 | NV POL | ACD91863.1 | NV POL | ABW74091.1 |
| NV POL | ACD91910.1 | NV POL | ACD91862.1 | NV POL | ABW74090.1 |
| NV POL | ACD91909.1 | NV POL | ACD91861.1 | NV POL | ABW74089.1 |
| NV POL | ACD91908.1 | NV POL | ACD91860.1 | NV POL | ABW74088.1 |
| NV POL | ACD91907.1 | NV POL | ACD91859.1 | NV POL | ABW74086.1 |
| NV POL | ACD91906.1 | NV POL | ACD91858.1 | NV POL | ABW74085.1 |
| NV POL | ACD91905.1 | NV POL | ACD91857.1 | NV POL | ABW74081.1 |
| NV POL | ACD91904.1 | NV POL | ACD91856.1 | NV POL | ABW74080.1 |
| NV POL | ACD91903.1 | NV POL | ACD91855.1 | NV POL | ABW74079.1 |
| NV POL | ACD91902.1 | NV POL | ACD91854.1 | NV POL | ABW74078.1 |
| NV POL | ACD91901.1 | NV POL | ACD91853.1 | NV POL | ABW74077.1 |
| NV POL | ACD91900.1 | NV POL | ACD91852.1 | NV POL | ABW74076.1 |
| NV POL | ACD91899.1 | NV POL | ACD91851.1 | NV POL | ABW74075.1 |
| NV POL | ACD91898.1 | NV POL | ACD91850.1 | NV POL | ABW74074.1 |
| NV POL | ACD91897.1 | NV POL | ACD91849.1 | NV POL | ABV21826.1 |
| NV POL | ACD91896.1 | NV POL | ACD91848.1 | NV POL | ABV21824.1 |
| NV POL | ACD91895.1 | NV POL | ACD91847.1 | NV POL | ABV21822.1 |
| NV POL | ACD91894.1 | NV POL | ACD91846.1 | NV POL | ABV21820.1 |
| NV POL | ACD91893.1 | NV POL | ACD91845.1 | NV POL | ABV21818.1 |
| NV POL | ACD91892.1 | NV POL | ACD91844.1 | NV POL | ABV21816.1 |
| NV POL | ACD91891.1 | NV POL | ACD91843.1 | NV POL | ABV21814.1 |
| NV POL | ACD91890.1 | NV POL | ACD91842.1 | NV POL | ABV21812.1 |
| NV POL | ACD91889.1 | NV POL | ACD91841.1 | NV POL | ABV21810.1 |
| NV POL | ACD91888.1 | NV POL | ACD91840.1 | NV POL | ABV21808.1 |
| NV POL | ACD91887.1 | NV POL | ACD91839.1 | NV POL | ABS87909.1 |
| NV POL | ACD91886.1 | NV POL | ACD91838.1 | NV POL | ABS87908.1 |
| NV POL | ACD91885.1 | NV POL | ACD91837.1 | NV POL | ABN58887.1 |
| NV POL | ACD91884.1 | NV POL | ACD91836.1 | NV POL | ABN58886.1 |
| NV POL | ACD91883.1 | NV POL | ACD91835.1 | NV POL | ABN58885.1 |
| NV POL | ACD91882.1 | NV POL | ACD91834.1 | NV POL | ABN58884.1 |
| NV POL | ACD91881.1 | NV POL | ACD91833.1 | NV POL | ABN58883.1 |
| NV POL | ACD91880.1 | NV POL | ACD81971.1 | NV POL | ABN58882.1 |
| NV POL | ACD91879.1 | NV POL | ABY47623.1 | NV POL | ABN58881.1 |
| NV POL | ACD91878.1 | NV POL | ABY47622.1 | NV POL | ABN58880.1 |
| NV POL | ACD91877.1 | NV POL | ABY47621.1 | NV POL | ABN58879.1 |
| NV POL | ACD91876.1 | NV POL | ABY47620.1 | NV POL | ABN58878.1 |
| NV POL | ACD91875.1 | NV POL | ABY47619.1 | NV POL | ABN58877.1 |
| NV POL | ACD91874.1 | NV POL | ABY47618.1 | NV POL | ABN58876.1 |
| NV POL | ACD91873.1 | NV POL | ABY47617.1 | NV POL | ABN58875.1 |
| NV POL | ACD91872.1 | NV POL | ABY47615.1 | NV POL | ABN58874.1 |
| NV POL | ACD91871.1 | NV POL | ABY47614.1 | NV POL | ABN58873.1 |
| NV POL | ACD91870.1 | NV POL | ABY47613.1 | NV POL | ABN58872.1 |
| NV POL | ACD91869.1 | NV POL | ABW93745.1 | NV POL | ABN58871.1 |
| NV POL | ACD91868.1 | NV POL | ABW93743.1 | NV POL | ABN58870.1 |
| NV POL | ACD91867.1 | NV POL | ABW74095.1 | NV POL | ABN58869.1 |

FIG. 71-48

| Virus Protein | Accession No. | Virus Protein | Accession No. | Virus Protein | Accession No. |
|---|---|---|---|---|---|
| NV POL | ABN58868.1 | NV POL | ABH01200.1 | NV POL | ABA12121.1 |
| NV POL | ABN58867.1 | NV POL | ABH01201.1 | NV POL | ABA12120.1 |
| NV POL | ABN58866.1 | NV POL | ABH01199.1 | NV POL | ABA12119.1 |
| NV POL | ABN58865.1 | NV POL | ABH01198.1 | NV POL | ABA12118.1 |
| NV POL | ABN58864.1 | NV POL | ABH01197.1 | NV POL | ABA12117.1 |
| NV POL | ABN58863.1 | NV POL | ABH01196.1 | NV POL | ABA12116.1 |
| NV POL | ABN58862.1 | NV POL | ABH01195.1 | NV POL | AAW82440.1 |
| NV POL | ABN58861.1 | NV POL | ABF93437.1 | NV POL | AAS86788.1 |
| NV POL | ABN58860.1 | NV POL | ABF22493.1 | NV POL | AAS86785.1 |
| NV POL | ABN58859.1 | NV POL | ABF22492.1 | NV POL | BAI70517.1 |
| NV POL | ABN58858.1 | NV POL | ABD36450.1 | NV POL | ACX81352.1 |
| NV POL | ABN58857.1 | NV POL | ABD36449.1 | NV POL | ACV41092.1 |
| NV POL | ABN58856.1 | NV POL | ABD36448.1 | NV POL | ACY69848.1 |
| NV POL | ABN58855.1 | NV POL | ABD36447.1 | NV POL | ACX85811.1 |
| NV POL | ABN58854.1 | NV POL | ABD36446.1 | NV POL | ACX31820.1 |
| NV POL | ABN58853.1 | NV POL | ABD36445.1 | NV POL | ACT76150.1 |
| NV POL | ABN58852.1 | NV POL | ABD36444.1 | NV POL | ACT76147.1 |
| NV POL | ABN58851.1 | NV POL | ABD36443.1 | NV POL | ACT76144.1 |
| NV POL | ABN58850.1 | NV POL | ABD36442.1 | NV POL | ACT76141.1 |
| NV POL | ABN58848.1 | NV POL | ABD36441.1 | NV POL | ACT76138.1 |
| NV POL | ABN58847.1 | NV POL | ABD36440.1 | NV POL | ACR26601.1 |
| NV POL | ABN58846.1 | NV POL | ABD36439.1 | NV POL | ACR26600.1 |
| NV POL | ABN58845.1 | NV POL | ABD36438.1 | NV POL | ACR26599.1 |
| NV POL | ABN58844.1 | NV POL | ABD36437.1 | NV POL | ACR26598.1 |
| NV POL | ABN58843.1 | NV POL | ABD36436.1 | NV POL | ACR26597.1 |
| NV POL | ABN58842.1 | NV POL | ABD36435.1 | NV POL | ACR26596.1 |
| NV POL | ABN58841.1 | NV POL | ABD36434.1 | NV POL | ACR26595.1 |
| NV POL | ABN58840.1 | NV POL | ABD36433.1 | NV POL | ACR26594.1 |
| NV POL | ABN58839.1 | NV POL | ABD36432.1 | NV POL | ACR26593.1 |
| NV POL | ABN58838.1 | NV POL | ABD36431.1 | NV POL | ACR26592.1 |
| NV POL | ABN58837.1 | NV POL | ABD36430.1 | NV POL | ACR26591.1 |
| NV POL | ABN58836.1 | NV POL | ABC59067.1 | NV POL | ACR26590.1 |
| NV POL | ABN58835.1 | NV POL | ABC59066.1 | NV POL | ACR26589.1 |
| NV POL | ABN58834.1 | NV POL | ABC41307.1 | NV POL | ACR26588.1 |
| NV POL | ABN58833.1 | NV POL | ABC41306.1 | NV POL | ACR26587.1 |
| NV POL | ABN58832.1 | NV POL | ABC41305.1 | NV POL | ACR26586.1 |
| NV POL | ABN58831.1 | NV POL | ABC41304.1 | NV POL | ACR26585.1 |
| NV POL | ABN58830.1 | NV POL | ABC41303.1 | NV POL | ABQ12783.1 |
| NV POL | ABN58829.1 | NV POL | ABC41302.1 | NV POL | ABO15298.1 |
| NV POL | ABN58828.1 | NV POL | ABC41301.1 | NV POL | ABO15296.1 |
| NV POL | ABN58827.1 | NV POL | ABC41300.1 | NV POL | ABO15294.1 |
| NV POL | ABN58826.1 | NV POL | ABA12128.1 | NV POL | ABO15292.1 |
| NV POL | ABN58825.1 | NV POL | ABA12127.1 | NV POL | ABO15290.1 |
| NV POL | ABN58824.1 | NV POL | ABA12126.1 | NV POL | ABO15288.1 |
| NV POL | ABN58823.1 | NV POL | ABA12125.1 | NV POL | ABO15280.1 |
| NV POL | ABN58822.1 | NV POL | ABA12124.1 | NV POL | ABO15278.1 |
| NV POL | ABH01203.1 | NV POL | ABA12123.1 | NV POL | ABO15276.1 |
| NV POL | ABH01202.1 | NV POL | ABA12122.1 | NV POL | ABO15272.1 |

FIG. 71-49

| Virus Protein | Accession No. | Virus Protein | Accession No. | Virus Protein | Accession No. |
|---|---|---|---|---|---|
| NV POL | ABD98164.1 | NV POL | AAZ99206.1 | NV POL | AAR97647.1 |
| NV POL | ABD98162.1 | NV POL | AAZ99205.1 | NV POL | AAR97644.1 |
| NV POL | ACU57489.1 | NV POL | AAZ99204.1 | NV POL | ACK44477.1 |
| NV POL | ACU57487.1 | NV POL | AAZ99203.1 | NV POL | CAR65340.1 |
| NV POL | ACU57485.1 | NV POL | AAZ99202.1 | NV POL | ACN78953.1 |
| NV POL | ACU57483.1 | NV POL | AAZ99201.1 | NV POL | ACN78951.1 |
| NV POL | ACU57481.1 | NV POL | AAZ99200.1 | NV POL | ACN78950.1 |
| NV POL | ACU57479.1 | NV POL | AAZ99199.1 | NV POL | ACL80200.1 |
| NV POL | ACU57477.1 | NV POL | AAZ99198.1 | NV POL | ACL36374.1 |
| NV POL | ACU57475.1 | NV POL | AAZ99197.1 | NV POL | ABX88977.1 |
| NV POL | ACU57473.1 | NV POL | AAZ99196.1 | NV POL | ABX88976.1 |
| NV POL | ACU57471.1 | NV POL | AAZ99195.1 | NV POL | ABX88975.1 |
| NV POL | ACU57469.1 | NV POL | AAZ99194.1 | NV POL | ABX00632.1 |
| NV POL | ACU57467.1 | NV POL | AAZ99193.1 | NV POL | ABX00631.1 |
| NV POL | ACU57465.1 | NV POL | AAZ99192.1 | NV POL | ABX00629.1 |
| NV POL | ACU57463.1 | NV POL | AAZ99191.1 | NV POL | BAG70535.1 |
| NV POL | ACU57461.1 | NV POL | AAZ99190.1 | NV POL | BAG70532.1 |
| NV POL | ACU57459.1 | NV POL | AAZ99189.1 | NV POL | BAG70529.1 |
| NV POL | ACU57457.1 | NV POL | AAZ99188.1 | NV POL | BAG70526.1 |
| NV POL | ACU57455.1 | NV POL | AAZ99187.1 | NV POL | BAG70523.1 |
| NV POL | ACU57453.1 | NV POL | AAZ99186.1 | NV POL | BAG70520.1 |
| NV POL | ACU57451.1 | NV POL | AAZ99185.1 | NV POL | BAG70517.1 |
| NV POL | ACU57449.1 | NV POL | AAZ99184.1 | NV POL | BAG70514.1 |
| NV POL | ACU57447.1 | NV POL | AAZ99183.1 | NV POL | BAG70511.1 |
| NV POL | ACU57445.1 | NV POL | AAZ99182.1 | NV POL | BAG70508.1 |
| NV POL | ACU57443.1 | NV POL | AAZ99181.1 | NV POL | BAG70505.1 |
| NV POL | ACU57441.1 | NV POL | AAZ99180.1 | NV POL | BAG70502.1 |
| NV POL | ACU57439.1 | NV POL | AAZ99179.1 | NV POL | BAG70499.1 |
| NV POL | ACU57437.1 | NV POL | AAZ99178.1 | NV POL | BAG70496.1 |
| NV POL | ACU57435.1 | NV POL | AAZ99177.1 | NV POL | BAG70493.1 |
| NV POL | ACU57433.1 | NV POL | AAZ99176.1 | NV POL | BAG70490.1 |
| NV POL | ACU57431.1 | NV POL | AAZ99175.1 | NV POL | BAG70487.1 |
| NV POL | ACU57429.1 | NV POL | AAZ99174.1 | NV POL | BAG70484.1 |
| NV POL | ACU57427.1 | NV POL | AAZ99173.1 | NV POL | BAG70481.1 |
| NV POL | ACU57425.1 | NV POL | AAZ99172.1 | NV POL | BAG70478.1 |
| NV POL | ACU57423.1 | NV POL | AAZ99171.1 | NV POL | BAG70475.1 |
| NV POL | ACU57421.1 | NV POL | ABC96745.1 | NV POL | BAG70472.1 |
| NV POL | ACU57419.1 | NV POL | AAZ05895.1 | NV POL | BAG70469.1 |
| NV POL | ACU57417.1 | NV POL | AAX32885.1 | NV POL | BAG70466.1 |
| NV POL | ABF93436.1 | NV POL | AAX32879.1 | NV POL | BAG70463.1 |
| NV POL | AAZ99215.1 | NV POL | AAX32876.1 | NV POL | BAG70460.1 |
| NV POL | AAZ99214.1 | NV POL | AAX32873.1 | NV POL | BAG70457.1 |
| NV POL | AAZ99213.1 | NV POL | AAT11918.1 | NV POL | BAG70454.1 |
| NV POL | AAZ99212.1 | NV POL | AAR97662.1 | NV POL | BAG70451.1 |
| NV POL | AAZ99211.1 | NV POL | AAR97659.1 | NV POL | BAG70448.1 |
| NV POL | AAZ99210.1 | NV POL | AAR97656.1 | NV POL | BAG70445.1 |
| NV POL | AAZ99208.1 | NV POL | AAR97653.1 | NV POL | BAG70442.1 |
| NV POL | AAZ99207.1 | NV POL | AAR97650.1 | NV POL | BAG70439.1 |

FIG. 71-50

| Virus Protein | Accession No. | Virus Protein | Accession No. | Virus Protein | Accession No. |
|---|---|---|---|---|---|
| NV POL | BAG70436.1 | NV POL | CAP19232.1 | NV POL | ABD73935.1 |
| NV POL | BAG70433.1 | NV POL | CAP19231.1 | NV POL | ABD36496.1 |
| NV POL | BAG70430.1 | NV POL | CAP19230.1 | NV POL | ABD36493.1 |
| NV POL | BAG70427.1 | NV POL | CAP19229.1 | NV POL | ABD36490.1 |
| NV POL | BAF45860.2 | NV POL | ABQ12780.1 | NV POL | ABO15011.1 |
| NV POL | ACH56542.1 | NV POL | ABZ89548.1 | NV POL | ABJ98768.1 |
| NV POL | CAP17598.2 | NV POL | ABY77756.1 | NV POL | ABD33821.1 |
| NV POL | CAP18805.1 | NV POL | BAF95530.1 | NV POL | ABD33819.1 |
| NV POL | CAP18803.1 | NV POL | BAF95528.1 | NV POL | ABD33817.1 |
| NV POL | CAP18799.1 | NV POL | BAF95526.1 | NV POL | ABD33815.1 |
| NV POL | CAP18797.1 | NV POL | BAF95524.1 | NV POL | ABD33813.1 |
| NV POL | CAP18795.1 | NV POL | BAF95522.1 | NV POL | ABD33809.1 |
| NV POL | CAP18792.1 | NV POL | BAF95520.1 | NV POL | ABD33808.1 |
| NV POL | CAP18791.1 | NV POL | BAF95518.1 | NV POL | ABD33807.1 |
| NV POL | CAP18788.1 | NV POL | BAF95516.1 | NV POL | AAX32882.1 |
| NV POL | CAP18787.1 | NV POL | BAF95514.1 | NV POL | AAZ05897.1 |
| NV POL | CAP18786.1 | NV POL | BAF95512.1 | NV POL | CAA60254.1 |
| NV POL | CAP18785.1 | NV POL | BAF95510.1 | NV POL | CAF24920.2 |
| NV POL | CAP18783.1 | NV POL | BAF95508.1 | NV POL | CAF24915.2 |
| NV POL | CAP18782.1 | NV POL | BAF95506.1 | NV POL | CAF24932.1 |
| NV POL | CAP18780.1 | NV POL | BAF95504.1 | NV POL | CAF24931.1 |
| NV POL | CAP18776.1 | NV POL | BAF95502.1 | NV POL | CAF24930.1 |
| NV POL | CAP17608.1 | NV POL | BAF95500.1 | NV POL | CAF24929.1 |
| NV POL | CAP17607.1 | NV POL | BAF95498.1 | NV POL | CAF24928.1 |
| NV POL | CAP17606.1 | NV POL | ABL74396.1 | NV POL | CAF24927.1 |
| NV POL | CAP17605.1 | NV POL | ABL74394.1 | NV POL | CAF24926.1 |
| NV POL | CAP17604.1 | NV POL | ABL74392.1 | NV POL | CAF24924.1 |
| NV POL | CAP17603.1 | NV POL | ABL74390.1 | NV POL | CAF24922.1 |
| NV POL | CAP17602.1 | NV POL | ABL74388.1 | NV POL | CAF24921.1 |
| NV POL | CAP17601.1 | NV POL | ABL74386.1 | NV POL | CAF24919.1 |
| NV POL | CAP17600.1 | NV POL | ABG49508.1 | NV POL | CAF24918.1 |
| NV POL | CAP17599.1 | NV POL | CAN59651.1 | NV POL | CAF24917.1 |
| NV POL | CAP17597.1 | NV POL | CAN59650.1 | NV POL | CAF24916.1 |
| NV POL | CAP17596.1 | NV POL | CAN59648.1 | NV POL | CAF24914.1 |
| NV POL | CAP17595.1 | NV POL | CAN59645.1 | NV POL | CAF24913.1 |
| NV POL | CAP17594.1 | NV POL | CAN59643.1 | NV POL | CAF24912.1 |
| NV POL | CAP17593.1 | NV POL | CAN59641.1 | NV POL | CAF24911.1 |
| NV POL | CAP17592.1 | NV POL | CAN59639.1 | NV POL | CAF24910.1 |
| NV POL | CAP17591.1 | NV POL | CAN59637.1 | NV POL | CAF24909.1 |
| NV POL | CAP17590.1 | NV POL | CAN59635.1 | NV POL | CAF24908.1 |
| NV POL | CAP17589.1 | NV POL | CAN59633.1 | NV POL | CAF24907.1 |
| NV POL | CAP19241.1 | NV POL | CAN59631.1 | NV POL | CAF24906.1 |
| NV POL | CAP19240.1 | NV POL | CAN59629.1 | NV POL | CAF24905.1 |
| NV POL | CAP19237.1 | NV POL | CAN59625.1 | NV POL | CAF24902.1 |
| NV POL | CAP19236.1 | NV POL | CAN59621.1 | NV POL | CAF24901.1 |
| NV POL | CAP19235.1 | NV POL | CAN59617.1 | NV POL | CAF24900.1 |
| NV POL | CAP19234.1 | NV POL | CAN59613.1 | NV POL | CAF24899.1 |
| NV POL | CAP19233.1 | NV POL | CAN59609.1 | NV POL | CAF24897.1 |

FIG. 71-51

| Virus | Protein | Accession No. | Virus | Protein | Accession No. | Virus | Protein | Accession No. |
|---|---|---|---|---|---|---|---|---|
| NV | POL | CAF24896.1 | NV | POL | CBW30467.1 | NV | POL | CBM13751.1 |
| NV | POL | CAF24895.1 | NV | POL | CBW30466.1 | NV | POL | CBM13749.1 |
| NV | POL | CAF24893.1 | NV | POL | CBW30465.1 | NV | POL | CBM13748.1 |
| NV | POL | CAF24892.1 | NV | POL | CBJ21303.1 | NV | POL | CBM13746.1 |
| NV | POL | CAF24891.1 | NV | POL | CBJ21301.1 | NV | POL | CBM13743.1 |
| NV | POL | CAF24890.1 | NV | POL | CBJ21299.1 | NV | POL | CBM13742.1 |
| NV | POL | CAF24889.1 | NV | POL | CBJ21297.1 | NV | POL | CBM13741.1 |
| NV | POL | CAF24887.1 | NV | POL | CBJ21295.1 | NV | POL | CBM13739.1 |
| NV | POL | CAF24886.1 | NV | POL | CBJ21293.1 | NV | POL | CBM13738.1 |
| NV | POL | CAF24885.1 | NV | POL | CBJ21291.1 | NV | POL | CBM13736.1 |
| NV | POL | CAF24884.1 | NV | POL | CBJ21289.1 | NV | POL | CBM13735.1 |
| NV | POL | CAF24883.1 | NV | POL | CBJ21287.1 | NV | POL | CBM13734.1 |
| NV | POL | CAF24881.1 | NV | POL | CBJ21285.1 | NV | POL | CBM13732.1 |
| NV | POL | CAF24880.1 | NV | POL | CBJ21283.1 | NV | POL | CBM13730.1 |
| NV | POL | CAF24878.1 | NV | POL | CBJ21281.1 | NV | POL | CBM13728.1 |
| NV | POL | CAF24877.1 | NV | POL | CBJ21279.1 | NV | POL | CBM13726.1 |
| NV | POL | CAF24876.1 | NV | POL | CBJ21277.1 | NV | POL | CBM13723.1 |
| NV | POL | CAF24875.1 | NV | POL | CBJ21275.1 | NV | POL | CBM13722.1 |
| NV | POL | CAF24874.1 | NV | POL | ACX69258.1 | NV | POL | CBM13720.1 |
| NV | POL | CAF24873.1 | NV | POL | CAR95869.1 | NV | POL | CBM13719.1 |
| NV | POL | CAF24872.1 | NV | POL | ABR15782.1 | NV | POL | CBM13718.1 |
| NV | POL | CAF24870.1 | NV | POL | CAF24898.1 | NV | POL | CBM13716.1 |
| NV | POL | CAF24869.1 | NV | POL | ADY17220.1 | NV | POL | CBM13715.1 |
| NV | POL | CAF24868.1 | NV | POL | ADY17219.1 | NV | POL | CBM13714.1 |
| NV | POL | CAF24867.1 | NV | POL | ADY17218.1 | NV | POL | CBM13712.1 |
| NV | POL | CAF24866.1 | NV | POL | ABC17638.1 | NV | POL | CBM13711.1 |
| NV | POL | CAF24865.1 | NV | POL | ADU77371.1 | NV | POL | CBM13710.1 |
| NV | POL | CAF24864.1 | NV | POL | ADU77369.1 | NV | POL | CBM13709.1 |
| NV | POL | CAF24863.1 | NV | POL | ADU77368.1 | NV | POL | CBM13707.1 |
| NV | POL | CAF24862.1 | NV | POL | ADU77367.1 | NV | POL | CBM13706.1 |
| NV | POL | CAF24861.1 | NV | POL | ADU77366.1 | NV | POL | CBM13705.1 |
| NV | POL | CAF24860.1 | NV | POL | ADU77364.1 | NV | POL | CBM13703.1 |
| NV | POL | CAF24859.1 | NV | POL | ADU77361.1 | NV | POL | CBM13702.1 |
| NV | POL | CAF24858.1 | NV | POL | ADU77360.1 | NV | POL | CBM13700.1 |
| NV | POL | CAF24857.1 | NV | POL | ADU77352.1 | NV | POL | CBM13699.1 |
| NV | POL | CAF24856.1 | NV | POL | ADU77339.1 | NV | POL | CBM13697.1 |
| NV | POL | CAF24855.1 | NV | POL | ADU77335.1 | NV | POL | CBM13696.1 |
| NV | POL | CAF24852.1 | NV | POL | ADU77334.1 | NV | POL | CBM13695.1 |
| NV | POL | CAF24851.1 | NV | POL | ADU77333.1 | NV | POL | CBM13694.1 |
| NV | POL | CAF24850.1 | NV | POL | ADU77332.1 | NV | POL | CBM13692.1 |
| NV | POL | CAF24849.1 | NV | POL | ADU77331.1 | NV | POL | CBM13690.1 |
| NV | POL | CAF24848.1 | NV | POL | ADU77330.1 | NV | POL | CBM13689.1 |
| NV | POL | CAF24847.1 | NV | POL | CBM13761.1 | NV | POL | CBM13687.1 |
| NV | POL | CAF24846.1 | NV | POL | CBM13759.1 | NV | POL | ACE62887.1 |
| NV | POL | CAF24845.1 | NV | POL | CBM13758.1 | NV | POL | ACD13831.1 |
| NV | POL | CAF24844.1 | NV | POL | CBM13756.1 | NV | POL | ACD13829.1 |
| NV | POL | CBW30469.1 | NV | POL | CBM13755.1 | NV | POL | ACD13810.1 |
| NV | POL | CBW30468.1 | NV | POL | CBM13752.1 | NV | POL | ACD13809.1 |

FIG. 71-52

| Virus | Protein | Accession No. | Virus | Protein | Accession No. | Virus | Protein | Accession No. |
|---|---|---|---|---|---|---|---|---|
| NV | POL | ACD13808.1 | NV | POL | ABU51258.1 | NV | POL | ABU51208.1 |
| NV | POL | ACD13807.1 | NV | POL | ABU51257.1 | NV | POL | ABU51207.1 |
| NV | POL | ACD13805.1 | NV | POL | ABU51256.1 | NV | POL | ABU51206.1 |
| NV | POL | BAJ25075.1 | NV | POL | ABU51255.1 | NV | POL | ABU51205.1 |
| NV | POL | BAJ25073.1 | NV | POL | ABU51254.1 | NV | POL | ABU51204.1 |
| NV | POL | BAJ25071.1 | NV | POL | ABU51253.1 | NV | POL | ABU51203.1 |
| NV | POL | ACY54759.1 | NV | POL | ABU51252.1 | NV | POL | ABU51202.1 |
| NV | POL | ACY54758.1 | NV | POL | ABU51251.1 | NV | POL | ABU51201.1 |
| NV | POL | ACY54757.1 | NV | POL | ABU51250.1 | NV | POL | ABU51200.1 |
| NV | POL | ABX59559.1 | NV | POL | ABU51249.1 | NV | POL | ABU51199.1 |
| NV | POL | ABX59541.1 | NV | POL | ABU51248.1 | NV | POL | ABU51198.1 |
| NV | POL | ADK94753.1 | NV | POL | ABU51247.1 | NV | POL | ABU51197.1 |
| NV | POL | ADK94751.1 | NV | POL | ABU51246.1 | NV | POL | ABU51196.1 |
| NV | POL | ADK94749.1 | NV | POL | ABU51245.1 | NV | POL | ABU51195.1 |
| NV | POL | ADB22511.1 | NV | POL | ABU51244.1 | NV | POL | ABU51194.1 |
| NV | POL | ADB22510.1 | NV | POL | ABU51243.1 | NV | POL | ABU51193.1 |
| NV | POL | ADK47169.1 | NV | POL | ABU51242.1 | NV | POL | ABU51192.1 |
| NV | POL | ADK47167.1 | NV | POL | ABU51241.1 | NV | POL | ABU51191.1 |
| NV | POL | ADK47165.1 | NV | POL | ABU51240.1 | NV | POL | ABU51190.1 |
| NV | POL | ADK47163.1 | NV | POL | ABU51239.1 | NV | POL | ABU51189.1 |
| NV | POL | ADK47161.1 | NV | POL | ABU51238.1 | NV | POL | ABU51188.1 |
| NV | POL | AAU10323.1 | NV | POL | ABU51237.1 | NV | POL | ABU51187.1 |
| NV | POL | AAU06140.1 | NV | POL | ABU51236.1 | NV | POL | ABU51186.1 |
| NV | POL | ADF47130.1 | NV | POL | ABU51235.1 | NV | POL | ABU51185.1 |
| NV | POL | ADF47127.1 | NV | POL | ABU51234.1 | NV | POL | ABU51184.1 |
| NV | POL | ACP28181.1 | NV | POL | ABU51233.1 | NV | POL | ABU51183.1 |
| NV | POL | ACP28180.1 | NV | POL | ABU51232.1 | NV | POL | ABU51182.1 |
| NV | POL | ABY67255.2 | NV | POL | ABU51231.1 | NV | POL | ABU51181.1 |
| NV | POL | ACD03282.1 | NV | POL | ABU51230.1 | NV | POL | ABU51180.1 |
| NV | POL | ABY67256.1 | NV | POL | ABU51228.1 | NV | POL | ABU51179.1 |
| NV | POL | ABV64756.2 | NV | POL | ABU51227.1 | NV | POL | ABU51178.1 |
| NV | POL | ACT78458.1 | NV | POL | ABU51226.1 | NV | POL | ABU51177.1 |
| NV | POL | ACT64676.1 | NV | POL | ABU51225.1 | NV | POL | ABU51176.1 |
| NV | POL | ACT64675.1 | NV | POL | ABU51223.1 | NV | POL | ABU51175.1 |
| NV | POL | ACT64674.1 | NV | POL | ABU51222.1 | NV | POL | ABU51174.1 |
| NV | POL | ACT64673.1 | NV | POL | ABU51221.1 | NV | POL | ABU51173.1 |
| NV | POL | ACT64672.1 | NV | POL | ABU51220.1 | NV | POL | ABU51172.1 |
| NV | POL | ACT64671.1 | NV | POL | ABU51219.1 | NV | POL | ABU51171.1 |
| NV | POL | ACT64670.1 | NV | POL | ABU51218.1 | NV | POL | ABU51170.1 |
| NV | POL | ACT64669.1 | NV | POL | ABU51217.1 | NV | POL | ABU51169.1 |
| NV | POL | ACT64668.1 | NV | POL | ABU51216.1 | NV | POL | ABU51168.1 |
| NV | POL | ACT64667.1 | NV | POL | ABU51215.1 | NV | POL | ABU51167.1 |
| NV | POL | ABU51165.2 | NV | POL | ABU51214.1 | NV | POL | ABU51166.1 |
| NV | POL | ABU51159.2 | NV | POL | ABU51213.1 | NV | POL | ABU51164.1 |
| NV | POL | ABU51157.2 | NV | POL | ABU51212.1 | NV | POL | ABU51163.1 |
| NV | POL | ABU51151.2 | NV | POL | ABU51211.1 | NV | POL | ABU51162.1 |
| NV | POL | ABU51265.1 | NV | POL | ABU51210.1 | NV | POL | ABU51161.1 |
| NV | POL | ABU51259.1 | NV | POL | ABU51209.1 | NV | POL | ABU51160.1 |

FIG. 71-53

| Virus | Protein | Accession No. | Virus | Protein | Accession No. | Virus | Protein | Accession No. |
|---|---|---|---|---|---|---|---|---|
| NV | POL | ABU51158.1 | NV | POL | ABK35659.1 | NV | POL | AAZ82378.1 |
| NV | POL | ABU51156.1 | NV | POL | ABK35658.1 | NV | POL | AAZ82377.1 |
| NV | POL | ABU51155.1 | NV | POL | ABK35657.1 | NV | POL | AAZ82376.1 |
| NV | POL | ABU51154.1 | NV | POL | ABK35656.1 | NV | POL | AAZ82375.1 |
| NV | POL | ABU51153.1 | NV | POL | ABK35655.1 | NV | POL | AAZ82374.1 |
| NV | POL | ABU51152.1 | NV | POL | ABK35654.1 | NV | POL | AAZ82373.1 |
| NV | POL | ABU51150.1 | NV | POL | ABK35653.1 | NV | POL | AAZ82372.1 |
| NV | POL | ABU51149.1 | NV | POL | ABF71450.1 | NV | POL | AAZ82371.1 |
| NV | POL | ABU51148.1 | NV | POL | ABF71449.1 | NV | POL | AAZ82370.1 |
| NV | POL | ABU51147.1 | NV | POL | ABF71448.1 | NV | POL | AAZ82369.1 |
| NV | POL | ABU51146.1 | NV | POL | ABF71447.1 | NV | POL | AAZ82368.1 |
| NV | POL | ABU51145.1 | NV | POL | ABF71446.1 | NV | POL | AAZ82367.1 |
| NV | POL | ABU51144.1 | NV | POL | ABF71445.1 | NV | POL | AAZ82366.1 |
| NV | POL | ABU51143.1 | NV | POL | ABF71444.1 | NV | POL | AAZ82365.1 |
| NV | POL | ABU51142.1 | NV | POL | ABF71443.1 | NV | POL | AAZ82364.1 |
| NV | POL | ABU51141.1 | NV | POL | ABF71442.1 | NV | POL | AAZ82363.1 |
| NV | POL | ABU51140.1 | NV | POL | ABF71441.1 | NV | POL | AAZ82362.1 |
| NV | POL | ABU51139.1 | NV | POL | ABF71440.1 | NV | POL | AAZ82361.1 |
| NV | POL | ABU51138.1 | NV | POL | ABF71439.1 | NV | POL | AAZ82360.1 |
| NV | POL | ABU51137.1 | NV | POL | AAZ82407.1 | NV | POL | AAZ82359.1 |
| NV | POL | ABU51136.1 | NV | POL | AAZ82406.1 | NV | POL | AAZ82358.1 |
| NV | POL | ABU51135.1 | NV | POL | AAZ82405.1 | NV | POL | AAZ82357.1 |
| NV | POL | ABU51134.1 | NV | POL | AAZ82404.1 | NV | POL | AAZ82356.1 |
| NV | POL | ABU51133.1 | NV | POL | AAZ82403.1 | NV | POL | AAZ82355.1 |
| NV | POL | ABU51132.1 | NV | POL | AAZ82402.1 | NV | POL | AAZ82354.1 |
| NV | POL | ABU51131.1 | NV | POL | AAZ82401.1 | NV | POL | AAZ82353.1 |
| NV | POL | ABU51130.1 | NV | POL | AAZ82400.1 | NV | POL | AAZ82352.1 |
| NV | POL | ABU51129.1 | NV | POL | AAZ82399.1 | NV | POL | AAZ82351.1 |
| NV | POL | ABU51128.1 | NV | POL | AAZ82398.1 | NV | POL | AAZ82350.1 |
| NV | POL | ABU51127.1 | NV | POL | AAZ82397.1 | NV | POL | AAZ82349.1 |
| NV | POL | ABU51126.1 | NV | POL | AAZ82396.1 | NV | POL | AAZ82348.1 |
| NV | POL | ABU51125.1 | NV | POL | AAZ82395.1 | NV | POL | AAZ82347.1 |
| NV | POL | ABU51124.1 | NV | POL | AAZ82394.1 | NV | POL | AAZ82346.1 |
| NV | POL | ABU51123.1 | NV | POL | AAZ82393.1 | NV | POL | AAZ82345.1 |
| NV | POL | ABU51122.1 | NV | POL | AAZ82392.1 | NV | POL | AAZ82344.1 |
| NV | POL | ABU51121.1 | NV | POL | AAZ82391.1 | NV | POL | AAZ82343.1 |
| NV | POL | ABU51120.1 | NV | POL | AAZ82390.1 | NV | POL | AAZ82342.1 |
| NV | POL | ABU51119.1 | NV | POL | AAZ82389.1 | NV | POL | AAZ82341.1 |
| NV | POL | ABQ81515.1 | NV | POL | AAZ82388.1 | NV | POL | AAZ82340.1 |
| NV | POL | ABK35668.1 | NV | POL | AAZ82387.1 | NV | POL | AAZ82339.1 |
| NV | POL | ABK35667.1 | NV | POL | AAZ82386.1 | NV | POL | AAZ82338.1 |
| NV | POL | ABK35666.1 | NV | POL | AAZ82385.1 | NV | POL | AAZ82337.1 |
| NV | POL | ABK35665.1 | NV | POL | AAZ82384.1 | NV | POL | AAZ82335.1 |
| NV | POL | ABK35664.1 | NV | POL | AAZ82383.1 | NV | POL | AAZ82334.1 |
| NV | POL | ABK35663.1 | NV | POL | AAZ82382.1 | NV | POL | AAZ82333.1 |
| NV | POL | ABK35662.1 | NV | POL | AAZ82381.1 | NV | POL | AAZ82332.1 |
| NV | POL | ABK35661.1 | NV | POL | AAZ82380.1 | NV | POL | AAZ82331.1 |
| NV | POL | ABK35660.1 | NV | POL | AAZ82379.1 | NV | POL | AAZ82330.1 |

FIG. 71-54

| Virus Protein | Accession No. | Virus Protein | Accession No. | Virus Protein | Accession No. |
|---|---|---|---|---|---|
| NV POL | AAZ82329.1 | NV POL | AAW21928.1 | NV POL | AAW21880.1 |
| NV POL | AAZ82328.1 | NV POL | AAW21927.1 | NV POL | AAW21879.1 |
| NV POL | AAZ82327.1 | NV POL | AAW21926.1 | NV POL | AAW21878.1 |
| NV POL | AAZ82326.1 | NV POL | AAW21925.1 | NV POL | AAW21877.1 |
| NV POL | AAZ82325.1 | NV POL | AAW21924.1 | NV POL | AAW21876.1 |
| NV POL | AAZ82324.1 | NV POL | AAW21923.1 | NV POL | AAW21875.1 |
| NV POL | AAZ82323.1 | NV POL | AAW21922.1 | NV POL | AAW21874.1 |
| NV POL | AAW50810.1 | NV POL | AAW21921.1 | NV POL | AAV84566.1 |
| NV POL | AAW21968.1 | NV POL | AAW21920.1 | NV POL | AAV84565.1 |
| NV POL | AAW21967.1 | NV POL | AAW21919.1 | NV POL | AAV84564.1 |
| NV POL | AAW21966.1 | NV POL | AAW21918.1 | NV POL | AAV84563.1 |
| NV POL | AAW21965.1 | NV POL | AAW21917.1 | NV POL | AAV84562.1 |
| NV POL | AAW21964.1 | NV POL | AAW21916.1 | NV POL | AAV84561.1 |
| NV POL | AAW21963.1 | NV POL | AAW21915.1 | NV POL | AAV84560.1 |
| NV POL | AAW21962.1 | NV POL | AAW21914.1 | NV POL | AAV84559.1 |
| NV POL | AAW21961.1 | NV POL | AAW21913.1 | NV POL | AAV84558.1 |
| NV POL | AAW21960.1 | NV POL | AAW21912.1 | NV POL | AAV84557.1 |
| NV POL | AAW21959.1 | NV POL | AAW21911.1 | NV POL | AAV84556.1 |
| NV POL | AAW21958.1 | NV POL | AAW21910.1 | NV POL | AAV84555.1 |
| NV POL | AAW21957.1 | NV POL | AAW21909.1 | NV POL | AAV84554.1 |
| NV POL | AAW21956.1 | NV POL | AAW21908.1 | NV POL | AAV84553.1 |
| NV POL | AAW21955.1 | NV POL | AAW21907.1 | NV POL | AAV84552.1 |
| NV POL | AAW21954.1 | NV POL | AAW21906.1 | NV POL | AAV84551.1 |
| NV POL | AAW21953.1 | NV POL | AAW21905.1 | NV POL | AAV84550.1 |
| NV POL | AAW21952.1 | NV POL | AAW21904.1 | NV POL | AAV84549.1 |
| NV POL | AAW21951.1 | NV POL | AAW21903.1 | NV POL | AAV84548.1 |
| NV POL | AAW21950.1 | NV POL | AAW21902.1 | NV POL | AAV84547.1 |
| NV POL | AAW21949.1 | NV POL | AAW21901.1 | NV POL | AAV84546.1 |
| NV POL | AAW21948.1 | NV POL | AAW21900.1 | NV POL | AAV84545.1 |
| NV POL | AAW21947.1 | NV POL | AAW21899.1 | NV POL | AAV84544.1 |
| NV POL | AAW21946.1 | NV POL | AAW21898.1 | NV POL | AAV84543.1 |
| NV POL | AAW21945.1 | NV POL | AAW21897.1 | NV POL | AAV84542.1 |
| NV POL | AAW21944.1 | NV POL | AAW21896.1 | NV POL | AAV84541.1 |
| NV POL | AAW21943.1 | NV POL | AAW21895.1 | NV POL | AAV84540.1 |
| NV POL | AAW21942.1 | NV POL | AAW21894.1 | NV POL | AAV84539.1 |
| NV POL | AAW21941.1 | NV POL | AAW21893.1 | NV POL | AAV84538.1 |
| NV POL | AAW21940.1 | NV POL | AAW21892.1 | NV POL | AAV84537.1 |
| NV POL | AAW21939.1 | NV POL | AAW21891.1 | NV POL | AAV84536.1 |
| NV POL | AAW21938.1 | NV POL | AAW21890.1 | NV POL | AAV84535.1 |
| NV POL | AAW21937.1 | NV POL | AAW21889.1 | NV POL | AAV84534.1 |
| NV POL | AAW21936.1 | NV POL | AAW21888.1 | NV POL | AAV84533.1 |
| NV POL | AAW21935.1 | NV POL | AAW21887.1 | NV POL | AAV84532.1 |
| NV POL | AAW21934.1 | NV POL | AAW21886.1 | NV POL | AAV84531.1 |
| NV POL | AAW21933.1 | NV POL | AAW21885.1 | NV POL | AAV84530.1 |
| NV POL | AAW21932.1 | NV POL | AAW21884.1 | NV POL | AAV84529.1 |
| NV POL | AAW21931.1 | NV POL | AAW21883.1 | NV POL | AAV84528.1 |
| NV POL | AAW21930.1 | NV POL | AAW21882.1 | NV POL | AAV84527.1 |
| NV POL | AAW21929.1 | NV POL | AAW21881.1 | NV POL | AAV84526.1 |

FIG. 71-55

| Virus | Protein | Accession No. | Virus | Protein | Accession No. | Virus | Protein | Accession No. |
|---|---|---|---|---|---|---|---|---|
| NV | POL | AAK15513.1 | NV | POL | ABV59432.1 | NV | POL | BAH85320.1 |
| NV | POL | AAK15512.1 | NV | POL | ABV59431.1 | NV | POL | BAH85318.1 |
| NV | POL | AAK15511.1 | NV | POL | ABV59430.1 | NV | POL | BAH85317.1 |
| NV | POL | AAK15510.1 | NV | POL | ABV59429.1 | NV | POL | BAH85316.1 |
| NV | POL | AAF13922.1 | NV | POL | ABV59428.1 | NV | POL | BAH85314.1 |
| NV | POL | AAF13919.1 | NV | POL | ABV59427.1 | NV | POL | BAH85312.1 |
| NV | POL | AAY44886.1 | NV | POL | ABI21836.1 | NV | POL | ACJ68878.1 |
| NV | POL | AAY44885.1 | NV | POL | ABE41640.1 | NV | POL | BAH36744.1 |
| NV | POL | AAY44884.1 | NV | POL | ABC96755.1 | NV | POL | BAH36745.1 |
| NV | POL | AAY44883.1 | NV | POL | AAX92672.1 | NV | POL | BAH29785.1 |
| NV | POL | ACX81344.2 | NV | POL | AAW50815.1 | NV | POL | ABX44771.1 |
| NV | POL | ABS12174.2 | NV | POL | AAW50814.1 | NV | POL | ABX44770.1 |
| NV | POL | ABV59471.1 | NV | POL | AAW50813.1 | NV | POL | ABX44769.1 |
| NV | POL | ABV59470.1 | NV | POL | AAW50812.1 | NV | POL | ABV64755.1 |
| NV | POL | ABV59469.1 | NV | POL | AAW50811.1 | NV | POL | ABV64754.1 |
| NV | POL | ABV59468.1 | NV | POL | AAW50809.1 | NV | POL | BAC10255.2 |
| NV | POL | ABV59467.1 | NV | POL | AAW50808.1 | NV | POL | BAG06987.1 |
| NV | POL | ABV59465.1 | NV | POL | AAW50807.1 | NV | POL | BAF35956.1 |
| NV | POL | ABV59462.1 | NV | POL | AAW50806.1 | NV | POL | BAE48197.1 |
| NV | POL | ABV59461.1 | NV | POL | AAW50805.1 | NV | POL | BAE48195.1 |
| NV | POL | ABV59460.1 | NV | POL | AAS47823.1 | NV | POL | BAE48193.1 |
| NV | POL | ABV59459.1 | NV | POL | AAR84375.1 | NV | POL | BAE48191.1 |
| NV | POL | ABV59458.1 | NV | POL | AAR84373.1 | NV | POL | BAE48189.1 |
| NV | POL | ABV59457.1 | NV | POL | AAR84372.1 | NV | POL | BAE48187.1 |
| NV | POL | ABV59456.1 | NV | POL | AAR84371.1 | NV | POL | BAE48185.1 |
| NV | POL | ABV59455.1 | NV | POL | AAR84370.1 | NV | POL | BAE48183.1 |
| NV | POL | ABV59454.1 | NV | POL | AAR84369.1 | NV | POL | BAE48181.1 |
| NV | POL | ABV59453.1 | NV | POL | AAR84368.1 | NV | POL | BAE48179.1 |
| NV | POL | ABV59452.1 | NV | POL | AAR84367.1 | NV | POL | BAE48177.1 |
| NV | POL | ABV59451.1 | NV | POL | ABS12172.2 | NV | POL | BAE48175.1 |
| NV | POL | ABV59450.1 | NV | POL | AAW30194.1 | NV | POL | BAE48173.1 |
| NV | POL | ABV59449.1 | NV | POL | BAH85355.1 | NV | POL | BAE48171.1 |
| NV | POL | ABV59448.1 | NV | POL | BAH85353.1 | NV | POL | BAE48169.1 |
| NV | POL | ABV59447.1 | NV | POL | BAH85351.1 | NV | POL | BAE48167.1 |
| NV | POL | ABV59446.1 | NV | POL | BAH85349.1 | NV | POL | BAE48165.1 |
| NV | POL | ABV59445.1 | NV | POL | BAH85347.1 | NV | POL | BAE48163.1 |
| NV | POL | ABV59444.1 | NV | POL | BAH85345.1 | NV | POL | BAE48161.1 |
| NV | POL | ABV59443.1 | NV | POL | BAH85343.1 | NV | POL | BAE48159.1 |
| NV | POL | ABV59442.1 | NV | POL | BAH85341.1 | NV | POL | ABW90336.1 |
| NV | POL | ABV59441.1 | NV | POL | BAH85339.1 | NV | POL | BAG34641.1 |
| NV | POL | ABV59440.1 | NV | POL | BAH85337.1 | NV | POL | BAG34639.1 |
| NV | POL | ABV59439.1 | NV | POL | BAH85335.1 | NV | POL | BAG34637.1 |
| NV | POL | ABV59438.1 | NV | POL | BAH85333.1 | NV | POL | BAG34635.1 |
| NV | POL | ABV59437.1 | NV | POL | BAH85330.1 | NV | POL | BAG34633.1 |
| NV | POL | ABV59436.1 | NV | POL | BAH85328.1 | NV | POL | BAG34631.1 |
| NV | POL | ABV59435.1 | NV | POL | BAH85326.1 | NV | POL | BAG34629.1 |
| NV | POL | ABV59434.1 | NV | POL | BAH85324.1 | NV | POL | BAG34671.1 |
| NV | POL | ABV59433.1 | NV | POL | BAH85322.1 | NV | POL | BAG34669.1 |

FIG. 71-56

| Virus | Protein | Accession No. | Virus | Protein | Accession No. | Virus | Protein | Accession No. |
|---|---|---|---|---|---|---|---|---|
| NV | POL | BAG34667.1 | NV | POL | BAF02630.1 | NV | POL | AAY25351.1 |
| NV | POL | BAG34665.1 | NV | POL | BAE98203.1 | NV | POL | CAA57461.1 |
| NV | POL | BAG34663.1 | NV | POL | BAE98201.1 | NV | POL | AAX28932.1 |
| NV | POL | BAG34661.1 | NV | POL | BAE98199.1 | NV | POL | AAX18167.1 |
| NV | POL | BAG34659.1 | NV | POL | BAE98196.1 | NV | POL | BAD14500.1 |
| NV | POL | BAG34657.1 | NV | POL | BAE98193.1 | NV | POL | BAD14498.1 |
| NV | POL | BAG34655.1 | NV | POL | BAE98190.1 | NV | POL | BAD14496.1 |
| NV | POL | BAG34653.1 | NV | POL | BAE79253.1 | NV | POL | BAD14494.1 |
| NV | POL | BAG34651.1 | NV | POL | ABF14964.1 | NV | POL | BAD14490.1 |
| NV | POL | BAG34649.1 | NV | POL | ABF14963.1 | NV | POL | BAD14488.1 |
| NV | POL | BAG34647.1 | NV | POL | BAE44330.1 | NV | POL | BAD14486.1 |
| NV | POL | BAG34645.1 | NV | POL | BAE44328.1 | NV | POL | BAD14484.1 |
| NV | POL | BAG34643.1 | NV | POL | BAE44326.1 | NV | POL | BAD14482.1 |
| NV | POL | BAF97882.1 | NV | POL | ABC96331.1 | NV | POL | BAD14480.1 |
| NV | POL | BAG06968.1 | NV | POL | BAE78965.1 | NV | POL | BAD14478.1 |
| NV | POL | BAG06966.1 | NV | POL | BAE17112.1 | NV | POL | BAD14476.1 |
| NV | POL | BAG06964.1 | NV | POL | BAE17110.1 | NV | POL | BAD14474.1 |
| NV | POL | BAG06962.1 | NV | POL | BAE17108.1 | NV | POL | BAD14472.1 |
| NV | POL | BAG06984.1 | NV | POL | BAE17106.1 | NV | POL | BAD14470.1 |
| NV | POL | BAG06982.1 | NV | POL | BAE17104.1 | NV | POL | BAD14468.1 |
| NV | POL | BAG06980.1 | NV | POL | BAE17102.1 | NV | POL | BAD14466.1 |
| NV | POL | BAG06978.1 | NV | POL | BAE17100.1 | NV | POL | BAD14464.1 |
| NV | POL | BAG06976.1 | NV | POL | BAE17098.1 | NV | POL | BAD14462.1 |
| NV | POL | BAG06974.1 | NV | POL | BAE17096.1 | NV | POL | BAD14460.1 |
| NV | POL | BAG06972.1 | NV | POL | BAE17094.1 | NV | POL | BAD14458.1 |
| NV | POL | BAG06970.1 | NV | POL | BAE17092.1 | NV | POL | BAD14456.1 |
| NV | POL | BAG30938.1 | NV | POL | BAE17090.1 | NV | POL | BAD14454.1 |
| NV | POL | BAG30922.1 | NV | POL | BAE17088.1 | NV | POL | BAD14452.1 |
| NV | POL | ABV55633.1 | NV | POL | BAE17086.1 | NV | POL | BAD14450.1 |
| NV | POL | ABY65349.1 | NV | POL | BAE17084.1 | NV | POL | BAD14448.1 |
| NV | POL | ABY27559.1 | NV | POL | BAE17082.1 | NV | POL | BAD14446.1 |
| NV | POL | BAF95707.1 | NV | POL | BAE17080.1 | NV | POL | BAD14444.1 |
| NV | POL | ABW69188.1 | NV | POL | BAE17078.1 | NV | POL | BAD14442.1 |
| NV | POL | ABU80520.1 | NV | POL | BAE17076.1 | NV | POL | BAD14440.1 |
| NV | POL | ABU80519.1 | NV | POL | BAE17074.1 | NV | POL | BAD14438.1 |
| NV | POL | ABU80518.1 | NV | POL | BAE17072.1 | NV | POL | BAD14436.1 |
| NV | POL | ABU80517.1 | NV | POL | BAE17070.1 | NV | POL | BAD14434.1 |
| NV | POL | ABP96739.1 | NV | POL | BAE17068.1 | NV | POL | BAD14432.1 |
| NV | POL | ABP96737.1 | NV | POL | BAE17066.1 | NV | POL | BAD14430.1 |
| NV | POL | ABP96735.1 | NV | POL | BAE17064.1 | NV | POL | BAD14428.1 |
| NV | POL | ABP96733.1 | NV | POL | BAE17062.1 | NV | POL | BAD14426.1 |
| NV | POL | ABP96731.1 | NV | POL | BAE17060.1 | NV | POL | BAD14424.1 |
| NV | POL | ABP96729.1 | NV | POL | BAE17058.1 | NV | POL | BAD14422.1 |
| NV | POL | ABP96727.1 | NV | POL | BAE17056.1 | NV | POL | BAD14420.1 |
| NV | POL | ABP96725.1 | NV | POL | BAE17054.1 | NV | POL | BAD14418.1 |
| NV | POL | CAJ87062.1 | NV | POL | BAD98239.1 | NV | POL | BAD14416.1 |
| NV | POL | BAF02634.1 | NV | POL | AAX14495.1 | NV | POL | BAD14414.1 |
| NV | POL | BAF02632.1 | NV | POL | AAY25354.1 | NV | POL | BAD14412.1 |

FIG. 71-57

| Virus | Protein | Accession No. | Virus | Protein | Accession No. | Virus | Protein | Accession No. |
|---|---|---|---|---|---|---|---|---|
| NV | POL | BAD14410.1 | NV | VP2 | ADB54835.1 | NV | VP2 | ADR78924.1 |
| NV | POL | BAD14408.1 | NV | VP2 | ACV41097.1 | NV | VP2 | ADR78921.1 |
| NV | POL | BAD14406.1 | NV | VP2 | ACN32271.1 | NV | VP2 | ADR78918.1 |
| NV | POL | BAD14404.1 | NV | VP2 | ACU56259.1 | NV | VP2 | ADR78915.1 |
| NV | POL | BAD14402.1 | NV | VP2 | AAB50467.1 | NV | VP2 | ADR78912.1 |
| NV | POL | BAD14400.1 | NV | VP2 | AAT12446.1 | NV | VP2 | ADR78909.1 |
| NV | POL | BAD14880.1 | NV | VP2 | BAF38404.1 | NV | VP2 | ADR78906.1 |
| NV | POL | BAD14878.1 | NV | VP2 | BAF38401.1 | NV | VP2 | ADR78903.1 |
| NV | POL | BAD14876.1 | NV | VP2 | BAF38398.1 | NV | VP2 | ADR78900.1 |
| NV | POL | BAD14874.1 | NV | VP2 | BAF38395.1 | NV | VP2 | ADR78897.1 |
| NV | POL | BAD14873.1 | NV | VP2 | BAD99212.1 | NV | VP2 | ADR78894.1 |
| NV | POL | BAD14871.1 | NV | VP2 | BAC98441.1 | NV | VP2 | ADR78891.1 |
| NV | POL | BAD14869.1 | NV | VP2 | NP_056822.1 | NV | VP2 | ADR78888.1 |
| NV | POL | BAD14867.1 | NV | VP2 | BAA34119.1 | NV | VP2 | ADR78885.1 |
| NV | POL | BAD14865.1 | NV | VP2 | BAA34117.1 | NV | VP2 | ADR78882.1 |
| NV | POL | BAD14863.1 | NV | VP2 | BAB84159.1 | NV | VP2 | ADR78879.1 |
| NV | POL | BAD14861.1 | NV | VP2 | BAB84156.1 | NV | VP2 | ADR78876.1 |
| NV | POL | BAD14859.1 | NV | VP2 | BAB84153.1 | NV | VP2 | ADR78873.1 |
| NV | POL | BAD14857.1 | NV | VP2 | BAB84150.1 | NV | VP2 | ADR78870.1 |
| NV | POL | BAD14855.1 | NV | VP2 | BAB84147.1 | NV | VP2 | ADR78867.1 |
| NV | POL | BAD14853.1 | NV | VP2 | BAB84144.1 | NV | VP2 | ADQ20512.1 |
| NV | POL | BAD14851.1 | NV | VP2 | BAB84141.1 | NV | VP2 | ADQ12921.1 |
| NV | POL | BAD14849.1 | NV | VP2 | BAB84138.1 | NV | VP2 | BAJ13754.1 |
| NV | POL | BAD14847.1 | NV | VP2 | CAH59619.1 | NV | VP2 | BAJ13748.1 |
| NV | POL | BAD14845.1 | NV | VP2 | BAE43834.1 | NV | VP2 | ADO85556.1 |
| NV | POL | BAD14843.1 | NV | VP2 | CAE47530.1 | NV | VP2 | ADO85553.1 |
| NV | POL | BAD14841.1 | NV | VP2 | BAD20209.1 | NV | VP2 | BAJ14006.1 |
| NV | POL | BAD14839.1 | NV | VP2 | BAC11841.1 | NV | VP2 | BAJ13982.1 |
| NV | POL | BAD14837.1 | NV | VP2 | BAC11838.1 | NV | VP2 | BAJ13964.1 |
| NV | POL | BAD14835.1 | NV | VP2 | BAC11835.1 | NV | VP2 | BAJ13961.1 |
| NV | POL | BAD14833.1 | NV | VP2 | BAC11832.1 | NV | VP2 | BAJ13940.1 |
| NV | POL | BAD14831.1 | NV | VP2 | BAC11829.1 | NV | VP2 | BAJ13931.1 |
| NV | POL | BAD14829.1 | NV | VP2 | BAC11826.1 | NV | VP2 | BAJ13880.1 |
| NV | POL | BAD14827.1 | NV | VP2 | BAC11823.1 | NV | VP2 | BAJ13850.1 |
| NV | POL | BAD14519.1 | NV | VP2 | BAC11820.1 | NV | VP2 | BAJ13847.1 |
| NV | POL | BAD14517.1 | NV | VP2 | BAC11817.1 | NV | VP2 | BAJ13844.1 |
| NV | POL | BAD14514.1 | NV | VP2 | ACC69024.1 | NV | VP2 | BAJ13838.1 |
| NV | POL | BAD14512.1 | NV | VP2 | ADR78957.1 | NV | VP2 | BAJ13808.1 |
| NV | POL | BAD14510.1 | NV | VP2 | ADR78954.1 | NV | VP2 | BAJ13769.1 |
| NV | POL | BAD14508.1 | NV | VP2 | ADR78951.1 | NV | VP2 | BAJ13766.1 |
| NV | POL | BAD14506.1 | NV | VP2 | ADR78948.1 | NV | VP2 | BAJ13763.1 |
| NV | POL | BAD14504.1 | NV | VP2 | ADR78945.1 | NV | VP2 | BAJ13751.1 |
| NV | POL | BAD14502.1 | NV | VP2 | ADR78942.1 | NV | VP2 | BAJ13727.1 |
| NV | VP2 | AEA02125.1 | NV | VP2 | ADR78939.1 | NV | VP2 | BAJ13667.1 |
| NV | VP2 | ADF45587.1 | NV | VP2 | ADR78936.1 | NV | VP2 | BAJ13610.1 |
| NV | VP2 | AAS86784.1 | NV | VP2 | ADR78933.1 | NV | VP2 | BAJ13586.1 |
| NV | VP2 | AAS86781.1 | NV | VP2 | ADR78930.1 | NV | VP2 | BAJ13565.1 |
| NV | VP2 | AAC64604.1 | NV | VP2 | ADR78927.1 | NV | VP2 | BAJ13544.1 |

FIG. 71-58

| Virus | Protein Accession No. | Virus | Protein Accession No. | Virus | Protein Accession No. |
|---|---|---|---|---|---|
| NV | VP2ACY00657.1 | NV | VP2BAJ13952.1 | NV | VP2BAJ13760.1 |
| NV | VP2ACY00654.1 | NV | VP2BAJ13949.1 | NV | VP2BAJ13757.1 |
| NV | VP2ACY00651.1 | NV | VP2BAJ13946.1 | NV | VP2BAJ13745.1 |
| NV | VP2ACY00648.1 | NV | VP2BAJ13943.1 | NV | VP2BAJ13742.1 |
| NV | VP2ACY00644.1 | NV | VP2BAJ13937.1 | NV | VP2BAJ13739.1 |
| NV | VP2ACY00642.1 | NV | VP2BAJ13934.1 | NV | VP2BAJ13736.1 |
| NV | VP2ACY00639.1 | NV | VP2BAJ13928.1 | NV | VP2BAJ13733.1 |
| NV | VP2ACY00636.1 | NV | VP2BAJ13925.1 | NV | VP2BAJ13730.1 |
| NV | VP2ACY00633.1 | NV | VP2BAJ13922.1 | NV | VP2BAJ13724.1 |
| NV | VP2ACY00630.1 | NV | VP2BAJ13919.1 | NV | VP2BAJ13721.1 |
| NV | VP2ACY00627.1 | NV | VP2BAJ13916.1 | NV | VP2BAJ13718.1 |
| NV | VP2ACY00624.1 | NV | VP2BAJ13913.1 | NV | VP2BAJ13715.1 |
| NV | VP2ACY00622.1 | NV | VP2BAJ13907.1 | NV | VP2BAJ13712.1 |
| NV | VP2ACY00619.1 | NV | VP2BAJ13904.1 | NV | VP2BAJ13709.1 |
| NV | VP2ACY00616.1 | NV | VP2BAJ13901.1 | NV | VP2BAJ13706.1 |
| NV | VP2ACY00613.1 | NV | VP2BAJ13898.1 | NV | VP2BAJ13703.1 |
| NV | VP2ACY00610.1 | NV | VP2BAJ13895.1 | NV | VP2BAJ13700.1 |
| NV | VP2ACY00607.1 | NV | VP2BAJ13892.1 | NV | VP2BAJ13697.1 |
| NV | VP2ACY00604.1 | NV | VP2BAJ13889.1 | NV | VP2BAJ13694.1 |
| NV | VP2ACY00601.1 | NV | VP2BAJ13886.1 | NV | VP2BAJ13691.1 |
| NV | VP2ACY00595.1 | NV | VP2BAJ13883.1 | NV | VP2BAJ13688.1 |
| NV | VP2ACY00592.1 | NV | VP2BAJ13877.1 | NV | VP2BAJ13685.1 |
| NV | VP2ACY00589.1 | NV | VP2BAJ13874.1 | NV | VP2BAJ13682.1 |
| NV | VP2ACY00586.1 | NV | VP2BAJ13871.1 | NV | VP2BAJ13679.1 |
| NV | VP2ACY00583.1 | NV | VP2BAJ13868.1 | NV | VP2BAJ13676.1 |
| NV | VP2ACY00580.1 | NV | VP2BAJ13865.1 | NV | VP2BAJ13673.1 |
| NV | VP2ACY00577.1 | NV | VP2BAJ13862.1 | NV | VP2BAJ13670.1 |
| NV | VP2ACY00574.1 | NV | VP2BAJ13859.1 | NV | VP2BAJ13664.1 |
| NV | VP2ACY00569.1 | NV | VP2BAJ13856.1 | NV | VP2BAJ13661.1 |
| NV | VP2ACY00566.1 | NV | VP2BAJ13853.1 | NV | VP2BAJ13658.1 |
| NV | VP2ADM52744.1 | NV | VP2BAJ13841.1 | NV | VP2BAJ13655.1 |
| NV | VP2ADK23788.1 | NV | VP2BAJ13835.1 | NV | VP2BAJ13652.1 |
| NV | VP2BAJ14018.1 | NV | VP2BAJ13826.1 | NV | VP2BAJ13649.1 |
| NV | VP2BAJ14015.1 | NV | VP2BAJ13823.1 | NV | VP2BAJ13646.1 |
| NV | VP2BAJ14012.1 | NV | VP2BAJ13820.1 | NV | VP2BAJ13643.1 |
| NV | VP2BAJ14009.1 | NV | VP2BAJ13817.1 | NV | VP2BAJ13640.1 |
| NV | VP2BAJ14003.1 | NV | VP2BAJ13814.1 | NV | VP2BAJ13637.1 |
| NV | VP2BAJ14000.1 | NV | VP2BAJ13811.1 | NV | VP2BAJ13634.1 |
| NV | VP2BAJ13997.1 | NV | VP2BAJ13805.1 | NV | VP2BAJ13631.1 |
| NV | VP2BAJ13994.1 | NV | VP2BAJ13802.1 | NV | VP2BAJ13628.1 |
| NV | VP2BAJ13991.1 | NV | VP2BAJ13799.1 | NV | VP2BAJ13625.1 |
| NV | VP2BAJ13988.1 | NV | VP2BAJ13796.1 | NV | VP2BAJ13622.1 |
| NV | VP2BAJ13985.1 | NV | VP2BAJ13793.1 | NV | VP2BAJ13619.1 |
| NV | VP2BAJ13979.1 | NV | VP2BAJ13790.1 | NV | VP2BAJ13616.1 |
| NV | VP2BAJ13970.1 | NV | VP2BAJ13781.1 | NV | VP2BAJ13613.1 |
| NV | VP2BAJ13967.1 | NV | VP2BAJ13778.1 | NV | VP2BAJ13607.1 |
| NV | VP2BAJ13958.1 | NV | VP2BAJ13775.1 | NV | VP2BAJ13604.1 |
| NV | VP2BAJ13955.1 | NV | VP2BAJ13772.1 | NV | VP2BAJ13601.1 |

FIG. 71-59

| Virus | Protein | Accession No. | Virus | Protein | Accession No. | Virus | Protein | Accession No. |
|---|---|---|---|---|---|---|---|---|
| NV | VP2 | BAJ13598.1 | NV | VP2 | ABC96747.1 | NV | VP2 | ABD73937.1 |
| NV | VP2 | BAJ13595.1 | NV | VP2 | AAX32887.1 | NV | VP2 | ABD36498.1 |
| NV | VP2 | BAJ13592.1 | NV | VP2 | AAX32875.1 | NV | VP2 | ABD36495.1 |
| NV | VP2 | BAJ13589.1 | NV | VP2 | AAR97664.1 | NV | VP2 | ABD36492.1 |
| NV | VP2 | BAJ13583.1 | NV | VP2 | AAR97655.1 | NV | VP2 | AAX32884.1 |
| NV | VP2 | BAJ13574.1 | NV | VP2 | AAD16950.1 | NV | VP2 | CAA60256.1 |
| NV | VP2 | BAJ13568.1 | NV | VP2 | ACZ37233.1 | NV | VP2 | ABR15784.1 |
| NV | VP2 | BAJ13562.1 | NV | VP2 | ACO55069.1 | NV | VP2 | ABR24136.1 |
| NV | VP2 | BAJ13559.1 | NV | VP2 | ACL36376.1 | NV | VP2 | ADK94752.1 |
| NV | VP2 | BAJ13556.1 | NV | VP2 | BAG70537.1 | NV | VP2 | ADK94750.1 |
| NV | VP2 | BAJ13553.1 | NV | VP2 | BAG70534.1 | NV | VP2 | ADK94748.1 |
| NV | VP2 | BAJ13550.1 | NV | VP2 | BAG70531.1 | NV | VP2 | ADF47129.1 |
| NV | VP2 | BAJ13547.1 | NV | VP2 | BAG70528.1 | NV | VP2 | ACT52410.1 |
| NV | VP2 | BAJ13541.1 | NV | VP2 | BAG70525.1 | NV | VP2 | ACT52408.1 |
| NV | VP2 | BAJ13535.1 | NV | VP2 | BAG70522.1 | NV | VP2 | ACT52406.1 |
| NV | VP2 | BAJ13521.1 | NV | VP2 | BAG70519.1 | NV | VP2 | ACT52404.1 |
| NV | VP2 | BAJ13514.1 | NV | VP2 | BAG70516.1 | NV | VP2 | AAF13921.1 |
| NV | VP2 | BAJ13509.1 | NV | VP2 | BAG70513.1 | NV | VP2 | ADC34935.1 |
| NV | VP2 | AAB97769.1 | NV | VP2 | BAG70510.1 | NV | VP2 | ACY82592.1 |
| NV | VP2 | ADF47126.1 | NV | VP2 | BAG70507.1 | NV | VP2 | ABE41642.1 |
| NV | VP2 | ACV32669.1 | NV | VP2 | BAG70504.1 | NV | VP2 | ACZ36481.1 |
| NV | VP2 | ACJ66284.1 | NV | VP2 | BAG70501.1 | NV | VP2 | BAG30940.1 |
| NV | VP2 | ACJ66282.1 | NV | VP2 | BAG70498.1 | NV | VP2 | ABY65351.1 |
| NV | VP2 | ACJ66280.1 | NV | VP2 | BAG70495.1 | NV | VP2 | ABY27561.1 |
| NV | VP2 | ACJ66278.1 | NV | VP2 | BAG70492.1 | NV | VP2 | BAE98198.1 |
| NV | VP2 | ACJ66276.1 | NV | VP2 | BAG70489.1 | NV | VP2 | BAE98195.1 |
| NV | VP2 | ACJ66274.1 | NV | VP2 | BAG70486.1 | NV | VP2 | BAE98192.1 |
| NV | VP2 | ACJ66272.1 | NV | VP2 | BAG70483.1 | NV | VP2 | ABC96333.1 |
| NV | VP2 | ACJ66270.1 | NV | VP2 | BAG70480.1 | NV | VP2 | CAA57463.1 |
| NV | VP2 | ACJ66268.1 | NV | VP2 | BAG70477.1 | | | |
| NV | VP2 | ACJ66266.1 | NV | VP2 | BAG70474.1 | | | |
| NV | VP2 | ACJ66264.1 | NV | VP2 | BAG70471.1 | | | |
| NV | VP2 | ABY77755.1 | NV | VP2 | BAG70468.1 | | | |
| NV | VP2 | ABD95935.1 | NV | VP2 | BAG70465.1 | | | |
| NV | VP2 | AAD16949.1 | NV | VP2 | BAG70462.1 | | | |
| NV | VP2 | AAD16948.1 | NV | VP2 | BAG70459.1 | | | |
| NV | VP2 | AAD16947.1 | NV | VP2 | BAG70456.1 | | | |
| NV | VP2 | ADD10376.1 | NV | VP2 | BAG70453.1 | | | |
| NV | VP2 | BAI70519.1 | NV | VP2 | BAG70450.1 | | | |
| NV | VP2 | ADB27028.1 | NV | VP2 | BAG70447.1 | | | |
| NV | VP2 | ADB27915.1 | NV | VP2 | BAG70444.1 | | | |
| NV | VP2 | ACV41094.1 | NV | VP2 | BAG70441.1 | | | |
| NV | VP2 | ACX31822.1 | NV | VP2 | BAG70438.1 | | | |
| NV | VP2 | ACT76152.1 | NV | VP2 | BAG70435.1 | | | |
| NV | VP2 | ACT76149.1 | NV | VP2 | BAG70432.1 | | | |
| NV | VP2 | ACT76146.1 | NV | VP2 | BAG70429.1 | | | |
| NV | VP2 | ACT76143.1 | NV | VP2 | ABZ89550.1 | | | |
| NV | VP2 | ACT76140.1 | NV | VP2 | ABG49510.1 | | | |

FIG. 72-1

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 1 | 0 | no | 1 | 99.98 | 100 | KQGKTKAT | 100 | | | | | | |
| HA | ALL | 2 | 0 | no | 1 | 99.98 | 100 | QGKTKATK | 100 | | |

FIG. 72-2

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 348 | 0 | no | 1 | 99.95 | 100 | YNGKSLGI | 100 | | | | | | |
| HA | ALL | 349 | 0 | no | 1 | 99.95 | 100 | NGKSLGIQ | 100 | | | | | | |
| HA | ALL | 359 | 0.57 | no | 3 | 99.71 | 100 | EDIPIGNC | 89.71 | EDIPIGSC | 7.35 | | | | | |
| HA | ALL | 370 | 0 | no | 1 | 100 | 100 | PSVKLPMG | 100 | | | | | | |
| HA | ALL | 377 | 0 | no | 1 | 100 | 100 | GAIGAIDS | 100 | | | | | | |
| HA | ALL | 378 | 0 | no | 1 | 99.99 | 100 | AIGAIDSS | 100 | | | | | | |
| HA | ALL | 379 | 1 | no | 2 | 100 | 100 | IGAIDSSM | 50 | YGGLNKSK | 50 | | | | | |
| HA | ALL | 384 | 0 | no | 1 | 100 | 100 | TSLTSLPF | 100 | | | | | | |
| HA | ALL | 385 | 0 | no | 1 | 100 | 100 | SLTSLPFQ | 100 | | | | | | |
| HA | ALL | 386 | 0 | no | 1 | 100 | 100 | LTSLPFQN | 100 | | | | | | |
| HA | ALL | 394 | 0 | no | 1 | 100 | 100 | GEHAKAIG | 100 | | | | | | |
| HA | ALL | 423 | 0 | no | 1 | 99.99 | 100 | IPIGERGL | 100 | | | | | | |
| HA | ALL | 425 | 0.37 | no | 2 | 99.94 | 100 | REREGGRR | 50 | PAKLLKER | 50 | | | | | |
| HA | ALL | 426 | 0.37 | no | 2 | 99.94 | 100 | EREGGRRR | 92.86 | KLLKERGF | 7.14 | | | | | |
| HA | ALL | 431 | 1.14 | no | 5 | 86.02 | 99.09 | RKKRGLF | 76.78 | LLKERGFF | 7.14 | | | | | |
| HA | ALL | 433 | 0 | no | 1 | 100 | 100 | KKIRGLFG | 100 | RRKRGLFG | 12.13 | | | | | |
| HA | ALL | 434 | 1.23 | no | 5 | 85.07 | 99.09 | KKRGLFGA | 73.31 | ETRGLFGA | 16.24 | RRKRGLF | 9.23 | | RRKRRGLF | 0.64 | |
| HA | ALL | 435 | 0 | no | 2 | 99.97 | 100 | TRRQKRGL | 50 | KRKKKRGL | 50 | KRKKRGLF | 8.65 | | KRRGLFGA | 0.6 | |
| HA | ALL | 436 | 0 | no | 2 | 99.97 | 100 | RKKKRGLF | 50 | RRQKRGLF | 50 | KTRGLFGA | | | | |
| HA | ALL | 437 | 0 | no | 2 | 99.91 | 100 | RQKRGLFG | 50 | RKKRGLFG | 50 | | | | | |
| HA | ALL | 438 | 0 | no | 2 | 99.91 | 100 | KKRGLFGA | 71.43 | QKRGLFGA | 23.81 | IHKQLTHH | 4.76 | | | | |
| HA | ALL | 441 | 1.05 | no | 3 | 99.91 | 100 | THKQLTHH | 100 | AHKQLTHH | | | | | | |
| HA | ALL | 442 | 0 | no | 1 | 99.91 | 100 | HKQLTHHM | 100 | | | | | | |
| HA | ALL | 443 | 0 | no | 1 | 99.91 | 100 | KQLTHHMR | 100 | | | | | | |
| HA | ALL | 444 | 0 | no | 1 | 99.91 | 100 | QLTHHMRK | 100 | | | | | | |
| HA | ALL | 445 | 0 | no | 1 | 99.91 | 100 | LTHHMRKK | 100 | | | | | | |
| HA | ALL | 446 | 0 | no | 1 | 99.91 | 100 | THHMRKKR | 100 | | | | | | |
| HA | ALL | 447 | 0 | no | 1 | 99.91 | 100 | HHMRKKKR | 100 | | | | | | |
| HA | ALL | 448 | 0 | no | 1 | 99.91 | 100 | HMRKKRRG | 100 | | | | | | |
| HA | ALL | 449 | 0 | no | 1 | 99.94 | 100 | MRKKRGL | 100 | | | | | | |
| HA | ALL | 450 | 0 | no | 1 | 99.94 | 100 | RKKRGLFG | 100 | | | | | | |
| HA | ALL | 460 | 1.81 | no | 4 | 97.29 | 99.69 | RMTRGLFG | 35.71 | RETRGLFG | 35.71 | RKTRGLFG | 21.43 | | QMTRGLFG | 7.14 | |
| HA | ALL | 461 | 1.53 | no | 3 | 100 | 100 | MTRGLFGA | 42.86 | ETRGLFGA | 35.71 | KTRGLFGA | 21.43 | | ARGLFGAI | 0.78 | |
| HA | ALL | 462 | 1.41 | no | 4 | 100 | 100 | TRGLFGAI | 53.38 | TRGLFGAI | 36.58 | KRGLFGAI | 8.95 | | | | |
| HA | ALL | 463 | 0 | no | 1 | 100 | 100 | PRGLFGAI | 100 | | | | | | |
| HA | ALL | 464 | 0 | no | 1 | 100 | 100 | TKPRPRRG | 100 | | | | | | |
| HA | ALL | 465 | 0 | no | 1 | 100 | 100 | KPRPRRGL | 100 | | | | | | |
| HA | ALL | 466 | 0 | no | 1 | 100 | 100 | PRPRRGLF | 100 | | | | | | |
| HA | ALL | 467 | 0 | no | 1 | 100 | 100 | RPRRGLFG | 100 | | | | | | |
| HA | ALL | 468 | 0 | no | 1 | 100 | 100 | PRRGLFGA | 100 | | | | | | |
| HA | ALL | 469 | 0.78 | yes | 2 | 0.08 | 99.04 | RGLFGAIA | 81.41 | RGIFGAIA | 17.62 | | | | | |
| HA | ALL | 470 | 0.74 | yes | 2 | 0.07 | 99.51 | GLFGAIAG | 81.88 | GIFGAIAG | 17.63 | | | | | |

FIG. 72-3

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 478 | 0.74 | yes | 2 | 0.06 | 99.51 | LFGAIAGF | 81.87 | IFGAIAGF | 17.63 | | | | |

| Protein | Sub-type | Start Pos | Block Entropy | Gaps >10% | # to 99% cover | Gap % | Coverage | Peptides included | freq | Peptides included | freq | Peptides included | freq | Peptides included | freq |
|---|---|---|---|---|---|---|---|---|---|---|---|---|---|---|---|
| NA | ALL | 687 | 0 | no | 1 | 99.99 | 100 | AVISFRNL | 100 | | | | | | |
| NA | N1 | 1 | 0.59 | no | 2 | 99.94 | 100 | IGLREQKQ | 85.71 | LVFREQKQ | 14.29 | | | | |
| NA | N1 | 2 | 0.77 | no | 3 | 99.89 | 100 | GLREQKQE | 84.62 | VREQKQE | 7.69 | FSGQKQE | 7.69 | | |
| NA | N1 | 3 | 0.73 | no | 3 | 99.88 | 100 | LREQKQEF | 85.71 | SGQKQEF | 7.14 | FREQKQEF | 7.14 | | |
| NA | N1 | 4 | 0.35 | no | 2 | 99.87 | 100 | REQKQEFK | 93.33 | GSQKQEFK | 6.67 | | | | |
| NA | N1 | 5 | 0.31 | no | 2 | 99.84 | 100 | EQKQEFKM | 94.44 | SQKQEFKM | 5.56 | | | | |
| NA | N1 | 6 | 0.3 | no | 2 | 99.67 | 100 | QKQEFKMN | 94.59 | QKQEFKMN | 5.41 | | | | |
| NA | N1 | 7 | 0.3 | no | 2 | 99.67 | 100 | KQEFKMNP | 94.59 | KQEIKMNP | 5.41 | | | | |
| NA | N1 | 8 | 0.3 | no | 2 | 99.67 | 100 | QEFKMNPN | 94.59 | QEIKMNPN | 5.41 | EIKMNPNQ | 5.41 | | |
| NA | N1 | 9 | 0.93 | no | 3 | 99.67 | 100 | EFKMNPNQ | 78.38 | FKMNPNQK | 16.22 | IKMNPNQK | 5.41 | | |
| NA | N1 | 10 | 0.93 | no | 3 | 99.67 | 100 | FKMNPNKK | 78.38 | KMNPNQKI | 16.22 | | | | |
| NA | N1 | 11 | 0.85 | no | 2 | 99.65 | 100 | KMNPNKKI | 72.5 | | 27.5 | | | | |
| NA | N1 | 19 | 0 | no | 1 | 99.99 | 100 | NRDITIGS | 100 | | | | | | |
| NA | N1 | 20 | 0 | no | 1 | 99.99 | 100 | RDITIGSI | 100 | | | | | | |
| NA | N1 | 21 | 0 | no | 1 | 99.99 | 100 | DITIGSIC | 100 | | | | | | |
| NA | N1 | 44 | 1 | no | 2 | 99.98 | 100 | ASQYGPSH | 50 | DLNMGQPF | 50 | | | | |
| NA | N1 | 111 | 1.66 | yes | 5 | 0.05 | 99.22 | GWAIYTKD | 60.75 | GWAIYSKD | 19.95 | GWAVYSKD | 10.31 | GWAVHSKD | 7.07 | GWAIHSKD | 1.14 |
| NA | N1 | 112 | 1.66 | yes | 5 | 0.04 | 99.22 | WAIYTKDN | 60.74 | WAIYSKDN | 19.95 | WAVYSKDN | 10.3 | WAVHSKDN | 7.07 | WAIHSKDN | 1.15 |
| NA | N1 | 116 | 1.64 | yes | 4 | 0.06 | 99.25 | TKDNSIRI | 61.5 | SKDNSIRI | 20.41 | SKDNSVRI | 8.63 | SKDNNIRI | 7.43 | SKDNNIRI | 1.28 |
| NA | N1 | 117 | 0.98 | yes | 4 | 0.07 | 99.29 | KDNSIRIG | 81.94 | KDNSVRIG | 8.64 | KDNGIRIG | 7.42 | | | |
| NA | N1 | 118 | 0.97 | yes | 5 | 0.08 | 99.31 | KDNSIRIG | 81.98 | DNSVRIGS | 8.62 | DNGIRIGS | 7.43 | KDNNIRIG | 1.28 | NNIRIGSK | 1.28 |
| NA | N1 | 119 | 1.26 | yes | 5 | 0.13 | 99.15 | DNSIRIGS | 76.85 | NSVRIGSK | 8.54 | NGIRIGSK | 7.34 | DNNIRIGS | 1.28 | NIRIGSKG | 1.15 |
| NA | N1 | 120 | 1.26 | yes | 5 | 0.14 | 99.15 | NSIRIGSK | 76.86 | SVRIGSKG | 8.55 | GIRIGSKG | 7.32 | NSIRIGSR | 5.15 | | |
| NA | N1 | 121 | 0.78 | yes | 3 | 0.18 | 99.58 | SIRIGSKG | 85.41 | VRIGSKGD | 8.9 | IRIGSKGD | 5.27 | SIRIGSRG | 5.14 | | |
| NA | N1 | 122 | 0.69 | yes | 3 | 0.17 | 99.54 | IRIGSKGD | 88.16 | RIGSKGDV | 6.08 | RIGSRGDV | 5.3 | | | |
| NA | N1 | 123 | 0.7 | yes | 3 | 0.18 | 99.42 | RIGSKGDV | 88.05 | IGSKGDVF | 6.07 | IGSRGDVF | 5.3 | | | |
| NA | N1 | 124 | 0.72 | yes | 3 | 0.18 | 99.22 | IGSKGDVF | 87.91 | GSKGDIFV | 6.07 | GSRGDVFV | 5.24 | | | |
| NA | N1 | 125 | 0.57 | yes | 3 | 0.23 | 99.08 | GSKGDIFV | 92.09 | GDIFVMRE | 4.99 | GDIFVMRE | 1.08 | GDVFVVRE | 0.55 | GDVFVVRE | 0.38 |
| NA | N1 | 127 | 0.56 | yes | 5 | 0.21 | 99.1 | GDIFVIRE | 92.12 | DIFVIRER | 4.98 | DVFVMREP | 1.08 | DVFVMREP | 0.55 | DVFVMREP | 0.38 |
| NA | N1 | 128 | 0.56 | yes | 3 | 0.12 | 99.13 | DVFVIREP | 92.14 | VIREPFI | 4.98 | IFVMREPF | 1.08 | VFVMREPF | 0.55 | VFVMREPF | 0.38 |
| NA | N1 | 129 | 0.27 | yes | 3 | 0.11 | 99.09 | FVIREPFI | 97.03 | VIREPFI | 4.99 | FVMREPFI | 1.61 | | | |
| NA | N1 | 130 | 0.26 | yes | 3 | 0.17 | 99.04 | VIREPFIS | 97.09 | IREPFISC | 4.98 | VMREPFIS | 1.61 | | | |
| NA | N1 | 131 | 0.24 | yes | 3 | 0.21 | 99.35 | IREPFISC | 97.35 | REPFISCS | 1.6 | MREPFISC | 1.61 | | | |
| NA | N1 | 132 | 0.07 | yes | 2 | 0.27 | 99.46 | REPFISCS | 99.46 | | | | | | |
| NA | N1 | 133 | 1.15 | yes | 3 | 0.1 | 99.14 | EPFISCSH | 54.59 | EPFISCSP | 43.79 | | | | |
| NA | N1 | 134 | 0.27 | yes | 2 | 0.04 | 99.01 | LECKTFFL | 97.1 | LECKTFFL | 1.16 | | | | |
| NA | N1 | 141 | 0.16 | yes | 2 | 0.1 | 99.47 | ECKTFFLT | 98.3 | ECKTFFLT | 1.16 | | | | |
| NA | N1 | 142 | 0.16 | yes | 2 | 0.11 | 99.33 | CKTFFLTQ | 98.16 | CKTFLTQG | 1.17 | | | | |
| NA | N1 | 143 | 0.17 | yes | 2 | 0.11 | 99.31 | KTFFLTQG | 98.14 | KTFFLTQG | 1.17 | | | | |
| NA | N1 | 145 | 0.18 | no | 2 | 0.11 | 99.09 | TFFLTQGA | 99.09 | | | | | | |
| NA | N1 | 146 | 0.11 | no | 1 | 0.11 | 99.3 | FFLTQGAL | 99.3 | | | | | | |
| NA | N1 | 147 | 0.08 | no | 1 | 0.11 | 99.25 | FLTQGALL | 99.25 | | | | | | |
| NA | N1 | 148 | 0.09 | no | 1 | 0.11 | 99.25 | FLTGALL | 99.25 | | | | | | |

FIG. 72-6

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N | 149 | 0.09 | yes | 1 | 0.11 | 99.22 | LTQGALLN | 99.22 | QGALLNDR | 4.47 | | | | |
| NA | N | 150 | 0.09 | yes | 1 | 0.11 | 99.22 | TQGALLND | 99.22 | GALLNDRH | 4.47 | | | | |
| NA | N | 151 | 0.36 | yes | 2 | 0.1 | 99.18 | QGALLNDK | 99.18 | ALLNDRHS | 4.47 | | | | |
| NA | N | 152 | 0.33 | yes | 2 | 0.04 | 99.43 | GALLNDKH | 99.43 | LLNDRHSN | 4.47 | | | | |
| NA | N | 153 | 0.33 | yes | 2 | 0.04 | 99.44 | ALLNDKHS | 99.44 | LNDRHSNG | 4.48 | | | | |
| NA | N | 154 | 0.32 | yes | 2 | 0.03 | 99.57 | LLNDKHSN | 99.57 | NDRHSNGT | 4.48 | | | | |
| NA | N | 155 | 0.36 | yes | 2 | 0.08 | 99.24 | LNDKHSNG | 99.24 | DRHSNGTV | 46.61 | DKHSNGTA | 4.27 | | |
| NA | N | 156 | 0.36 | yes | 2 | 0.08 | 99.21 | NDKHSNGT | 99.21 | DRHSNGTI | 21.07 | DKHSNGTV | 17.49 | | |
| NA | N | 157 | 1.36 | yes | 4 | 0.08 | 99.03 | DKHSNGTI | 99.03 | RSPHRTLM | 21.56 | DRSPHRAL | 17.49 | DRSPHRAL | 0.19 |
| NA | N | 166 | 1.49 | yes | 5 | 0.14 | 99.09 | DRSPYRTL | 99.09 | SPHRTLM | 21.56 | RSPHRTLM | 17.45 | | |
| NA | N | 167 | 1.45 | yes | 3 | 0.05 | 99.1 | RSPYRTLM | 99.1 | PHRTLMSC | 21.56 | SPHRTLM | 17.45 | | |
| NA | N | 168 | 1.45 | yes | 3 | 0.04 | 99.09 | SPYRTLMS | 99.09 | PYRALMS | 21.57 | PHRTLMSC | 17.42 | | |
| NA | N | 169 | 1.46 | yes | 3 | 0.04 | 99.05 | PYRTLMSC | 99.05 | YRALMSC | 24.06 | HRTLMSCP | 17.43 | | |
| NA | N | 170 | 1.46 | yes | 3 | 0.04 | 99.05 | YRTLMSCP | 99.05 | RTLMSCP | 24.06 | RALMSCPL | 20.39 | RALMSCPV | 0.99 | RALMSCPV | 0.61 |
| NA | N | 171 | 1.46 | yes | 3 | 0.03 | 99.05 | RTLMSCPI | 99.05 | TLMSCPI | 24.06 | ALMSCPL | 20.39 | ALMSCPIG | 0.99 | ALMSCPVG | 0.61 |
| NA | N | 172 | 1.66 | yes | 5 | 0.02 | 99.09 | TLMSCPIG | 99.09 | LMSCPIG | 24.65 | LMSCPLG | 20.5 | SCPIGEAP | 7.59 | SCPIGEVP | 0.36 |
| NA | N | 173 | 1.65 | yes | 3 | 0.04 | 99.16 | LMSCPIGE | 99.16 | SCPIGE | 24.27 | SCPLGEAP | 20.49 | PIGEAPSP | 7.58 | PMGEAPSP | 0.35 |
| NA | N | 174 | 1.53 | yes | 5 | 0.03 | 99.02 | SCPIGEVP | 99.02 | SCPIGEAP | 24.29 | PIGEAPSP | 20.5 | IGEAPSPY | 7.59 | VGEVPSPY | 0.47 |
| NA | N | 175 | 1.89 | yes | 3 | 0.02 | 99.14 | PIGEVPSP | 99.14 | PIGEAPSP | 46.8 | IGEAPSPY | 20.49 | | | |
| NA | N | 176 | 1.89 | yes | 3 | 0.04 | 99.47 | IGEVPSPY | 99.47 | GEAPSPY | 46.8 | | | | | |
| NA | N | 177 | 1.89 | yes | 3 | 0.05 | 99.46 | GEAPSPYN | 99.46 | VGEVPSPY | 32.86 | | | | | |
| NA | N | 178 | 1.06 | yes | 2 | 0.04 | 99.47 | EAPSPYNS | 99.47 | APSPYNSR | 46.74 | APSPYNSK | 19.87 | | |
| NA | N | 179 | 1.06 | yes | 2 | 0.05 | 99.67 | VPSPYNSR | 99.67 | PSPYNSKF | 19.97 | | | | |
| NA | N | 180 | 1.57 | yes | 3 | 0.04 | 99.67 | PSPYNSRF | 99.67 | SPYNSKFE | 19.97 | | | | |
| NA | N | 181 | 0.77 | yes | 2 | 0.03 | 99.68 | SPYNSRFE | 99.68 | PYNSKFES | 19.96 | | | | |
| NA | N | 182 | 0.77 | yes | 2 | 0.04 | 99.7 | PYNSRFES | 99.7 | YNSKFESV | 19.96 | | | | |
| NA | N | 183 | 0.76 | yes | 2 | 0.04 | 99.78 | YNSRFESV | 99.78 | NSKFESVA | 19.97 | | | | |
| NA | N | 184 | 0.76 | yes | 2 | 0.04 | 99.79 | NSRFESVA | 99.79 | SKFESVAW | 20 | | | | |
| NA | N | 185 | 0.75 | yes | 2 | 0.04 | 99.8 | SRFESVAW | 99.8 | KFESVAWS | 19.99 | | | | |
| NA | N | 186 | 0.75 | yes | 1 | 0.03 | 99.78 | RFESVAWS | 99.78 | | | | | | |
| NA | N | 187 | 0.75 | yes | 1 | 0.03 | 99.8 | FESVAWSA | 99.8 | | | | | | |
| NA | N | 188 | 0.03 | yes | 1 | 0.04 | 99.74 | ESVAWSAS | 99.74 | | | | | | |
| NA | N | 189 | 0.04 | yes | 1 | 0.04 | 99.73 | SVAWSASA | 99.73 | | | | | | |
| NA | N | 190 | 0.03 | yes | 1 | 0.04 | 99.77 | VAWSASAC | 99.77 | | | | | | |
| NA | N | 191 | 0.03 | yes | 1 | 0.03 | 99.76 | AWSASACH | 99.76 | | | | | | |
| NA | N | 192 | 0.03 | yes | 1 | 0.03 | 99.8 | WSASACHD | 99.8 | | | | | | |
| NA | N | 193 | 0.04 | yes | 1 | 0.03 | 99.78 | SASACHDG | 99.78 | ASACHDGM | 25.09 | ASACHDGT | 20.09 | ASACHDGL | 1.26 | ASACHDGV | 0.48 |
| NA | N | 194 | 0.03 | yes | 5 | 0.03 | 99.19 | ASACHDGI | 99.19 | SWLTIGIS | 26.67 | GWLTIGIS | 26.35 | GWLTIGIS | 1.77 | |
| NA | N | 195 | 1.65 | yes | 4 | 0.02 | 99.05 | NWLTIGIS | 99.05 | WITIGISG | 1.77 | | | | |
| NA | N | 196 | 1.74 | yes | 2 | 0.04 | 99.09 | WLTIGISG | 99.09 | ITIGISGP | 1.77 | | | | |
| NA | N | 204 | 0.23 | yes | 2 | 0.04 | 99.05 | LTIGISGP | 99.05 | | | | | | |
| NA | N | 205 | 0.23 | yes | 1 | 0.04 | 99.09 | TIGISGPD | 99.09 | | | | | | |
| NA | N | 206 | 0.1 | yes | 1 | 0.05 | 99.09 | | | | | | | | |
| NA | N | 207 | | yes | | | | | | | | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | NI | 312 | 0.4 | yes | 2 | 0.06 | 99.36 | RDNWHGSN | 93.48 | RDNWHASN | 5.88 | | | | |
| NA | NI | 313 | 0.39 | yes | 2 | 0.06 | 99.39 | DNWHGSNR | 93.5 | DNWHASNR | 5.89 | | | | |
| NA | NI | 314 | 0.39 | yes | 2 | 0.05 | 99.44 | NWHGSNRP | 93.53 | NWHASNRP | 5.91 | | | | |
| NA | NI | 315 | 0.38 | yes | 3 | 0.04 | 99.55 | WHGSNRPW | 93.64 | WHASNRPW | 5.91 | | | | |
| NA | NI | 316 | 0.43 | yes | 2 | 0.01 | 99.15 | HGSNRPWV | 93.24 | HASNRPWI | 5.61 | | | | |
| NA | NI | 317 | 0.45 | yes | 2 | 0.01 | 99.24 | GSNRPWVS | 93.15 | ASNRPWIS | 5.52 | HASNRPWVS | 0.28 | | | | |
| NA | NI | 318 | 0.14 | yes | 2 | 0.01 | 99.21 | SNRPWVSF | 98.68 | SNRPWISF | 0.53 | GANRPWVS | 0.3 | | | | |
| NA | NI | 319 | 0.46 | yes | 5 | 0.02 | 99.09 | NRPWVSFN | 92.99 | NRPWISFD | 5.83 | | 0.29 | | | | |
| NA | NI | 320 | 0.5 | yes | 5 | 0.01 | 99.09 | RPWVSFNQ | 92.66 | RPWISFDQ | 5.77 | RPWISFNQ | 0.27 | RPWVSFNH | 0.13 | | |
| NA | NI | 331 | 0.36 | yes | 5 | 0.02 | 99.38 | YQIGYICS | 95.82 | YKIGYICS | 1.25 | YQNGYICS | 0.27 | YRIGYICS | 0.56 | | |
| NA | NI | 332 | 0.36 | yes | 5 | 0.03 | 99.37 | QIGYICSG | 95.81 | KIGYICSG | 1.25 | QVGYICSG | 1.12 | RIGYICSG | 0.56 | | |
| NA | NI | 333 | 1.23 | yes | 2 | 0.03 | 99.28 | GYICSGV | 95.28 | MGYICSGI | 46.85 | VGYICSGV | 1.12 | MGYICSGV | 0.54 | | |
| NA | NI | 334 | 1.09 | yes | 2 | 0.03 | 99.12 | YICSGVF | 51.47 | YICSGIF | 47.65 | | 0.72 | | | | |
| NA | NI | 335 | 1.09 | yes | 4 | 0.03 | 99.11 | ICSGVFG | 51.47 | ICSGIFG | 47.65 | | | | | | |
| NA | NI | 336 | 1.16 | yes | 4 | 0.02 | 99.15 | CSGVFGD | 51.46 | ICSGIFGD | 47.65 | | | | | | |
| NA | NI | 337 | 1.09 | yes | 4 | 0.03 | 99.16 | CSGVFGDN | 50.62 | CSGVFGDS | 47.6 | CSGVLGDN | 0.49 | | | | |
| NA | NI | 338 | 1.15 | yes | 4 | 0.03 | 99.21 | SGVFGDNP | 50.63 | SGVFGDSP | 47.6 | SGVLGDNP | 0.49 | VFGDTPRP | 0.42 | | |
| NA | NI | 339 | 1.43 | yes | 5 | 0.04 | 99.06 | GVFGDNPR | 50.67 | GVFGDSPR | 47.61 | GVLGDNPR | 0.49 | GVKGFSYR | 2.59 | | |
| NA | NI | 340 | 1.45 | yes | 5 | 0.08 | 99.37 | VFGDNPRP | 47.5 | VFGDNPRS | 44.8 | VFGDSPRP | 5.85 | VKGFSYRY | 2.59 | | |
| NA | NI | 365 | 1.45 | yes | 5 | 0.09 | 99.06 | GVKGFSYK | 67.77 | GVKGFSFR | 19.77 | GIKGFSFK | 5.77 | KGFSYRYG | 2.6 | | |
| NA | NI | 366 | 1.4 | yes | 5 | 0.06 | 99.43 | VKGFSYKG | 67.77 | VKGFSFRY | 19.79 | IKGFSFKY | 5.79 | KYGDGVWI | 0.18 | | |
| NA | NI | 367 | 0.81 | yes | 4 | 0.06 | 99.06 | KGFSYKYG | 71.06 | KGFSRYG | 15.87 | KGFSYKYD | 4.18 | | | | |
| NA | NI | 372 | 0.4 | yes | 4 | 0.04 | 99.16 | KYGNGVWI | 86.3 | KYDNGVWI | 8.2 | KYGNGVWM | 0.23 | | | | |
| NA | NI | 373 | 0.4 | yes | 4 | 0.04 | 99.16 | YGNGVWIG | 94.53 | YDGWIGR | 4.2 | YGNGVWMG | 0.23 | | | | |
| NA | NI | 374 | 0.15 | yes | 3 | 0.04 | 99.15 | GNGVWIGR | 94.52 | GDGVWIGR | 4.2 | GNGVWMGR | 0.2 | | | | |
| NA | NI | 375 | 0.1 | yes | 3 | 0.04 | 99.17 | NGVWIGRT | 98.71 | NGVWIGRT | 0.24 | | | | | | |
| NA | NI | 376 | 0.14 | yes | 3 | 0.04 | 99.14 | GVWIGRTK | 99.17 | | 0.37 | | | | | | |
| NA | NI | 377 | 0.15 | yes | 1 | 0.04 | 99.45 | VWIGRTKS | 98.77 | VWIGRTKN | 1.14 | | | | | | |
| NA | NI | 390 | 0.26 | yes | 2 | 0.04 | 99.31 | GFEMIWDP | 98.3 | GFEMWWDP | 1.17 | | | | | | |
| NA | NI | 391 | 0.26 | yes | 3 | 0.02 | 99.35 | FEMIWDPN | 96.99 | FEMWDPD | 1.18 | | | | | | |
| NA | NI | 392 | 0.26 | yes | 3 | 0.03 | 99.35 | EMIWDPNG | 97.03 | EMWDPDG | 1.18 | | | | | | |
| NA | NI | 393 | 0.37 | yes | 3 | 0.03 | 99.28 | MIWDPDGW | 97.03 | MWDPNGW | 1.18 | | | | | | |
| NA | NI | 394 | 1.15 | yes | 5 | 0.02 | 99.08 | IWDPDGWT | 95.68 | IWDPNGWT | 1.18 | IWDPNGWS | 1.14 | IWDPNGWA | 0.4 | | |
| NA | NI | 417 | 1.07 | yes | 5 | 0.03 | 99.26 | TDWSGYSG | 54.6 | NEWSGYSG | 43.77 | TNWSGYSG | 1.15 | | | | |
| NA | NI | 418 | 1.04 | yes | 4 | 0.03 | 99.66 | DWSGYSGS | 55.16 | NDWSGYSG | 44.11 | IWDPNGWS | 0.86 | | | | |
| NA | NI | 419 | 0.12 | yes | 2 | 0.03 | 99.77 | WSGYSGSF | 99.66 | | 1.18 | IWDPNGWS | 0.3 | | | | |
| NA | NI | 420 | 0.11 | yes | 2 | 0.03 | 99.87 | SGYSGSFV | 98.59 | SGYSGSFI | 1.18 | | | | | | |
| NA | NI | 421 | 0.11 | yes | 2 | 0.03 | 99.85 | GYSGSFVQ | 98.69 | GYSGSFIQ | 1.18 | | | | | | |
| NA | NI | 422 | 0.11 | yes | 2 | 0.03 | 99.86 | YSGSFVQH | 98.67 | YSGSFIQH | 1.19 | | | | | | |
| NA | NI | 423 | 0.11 | yes | 2 | 0.03 | 99.83 | SGSFVQHP | 98.67 | SGSFIQHP | 1.19 | | | | | | |
| NA | NI | 424 | 0.12 | yes | 2 | 0.03 | 99.83 | GSFVQHPE | 98.65 | GSFIQHPE | 1.19 | | | | | | |
| NA | NI | 425 | 0.14 | yes | 2 | 0.03 | 99.6 | SFVQHPEL | 98.44 | SFIQHPEL | 1.6 | | | | | | |

FIG. 72-9

| Protein | Sub-type | Start Pos | Block Entropy | Gaps <10% | # to %99 cover | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N1 | 426 | 0.14 | yes | 2 | 0.03 | 99.63 | FIQHPELT | 98.48 | FIQHPELT | 1.15 | | | | |
| NA | N1 | 427 | 0.15 | yes | 2 | 0.03 | 99.53 | IQHPELTG | 98.38 | IQHPELTG | 1.15 | | | | |
| NA | N1 | 428 | 0.4 | yes | 4 | 0.02 | 99.41 | QHPELTGL | 93.23 | QHPELTGM | 6.18 | | | | |
| NA | N1 | 429 | 0.61 | yes | 4 | 0.01 | 99.17 | HPELTGLD | 90.75 | HPELTGMN | 5.7 | HPELTGLN | 1.15 | HPELTGMD | 0.48 | |
| NA | N1 | 430 | 0.61 | yes | 5 | 0.03 | 99.17 | PELTGLDC | 90.75 | PELTGMNC | 5.7 | PELTGLNC | 1.15 | PELTGMDC | 0.48 | |
| NA | N1 | 436 | 0.99 | yes | 3 | 0.03 | 99.28 | DCIRPCFW | 82.49 | DCMRPCFW | 8.75 | NCIRPCFW | 6.18 | NCMRPCFW | 1.56 | NCIKPCFW | 0.47 |
| NA | N1 | 437 | 0.59 | yes | 2 | 0.03 | 99.54 | CIRPCFWV | 88.48 | CMRPCFWV | 10.44 | | | | |
| NA | N1 | 438 | 0.59 | yes | 2 | 0.03 | 99.55 | IRPCFWVE | 88.48 | MRPCFWVE | 10.44 | | | | |
| NA | N1 | 439 | 0.11 | yes | 2 | 0.04 | 99.58 | RPCFWVEL | 98.95 | CIKPCFWV | 0.62 | | | | |
| NA | N1 | 440 | 0.77 | yes | 2 | 0.03 | 99.69 | PCFWVELI | 78.96 | PCFWVELV | 20.73 | | | | |
| NA | N1 | 441 | 0.77 | yes | 3 | 0.05 | 99.7 | CFWVELIR | 78.98 | CFWVELVR | 20.72 | | | | |
| NA | N1 | 442 | 0.77 | yes | 2 | 0.05 | 99.68 | FWVELIRG | 78.96 | FWVELVRG | 20.72 | | | | |
| NA | N1 | 443 | 1.19 | yes | 4 | 0.07 | 99.29 | WVELIRGQ | 71.85 | WVELVRGL | 20.05 | WVELIRGQ | 6.86 | WVELVRGR | 0.53 | |
| NA | N1 | 444 | 1.19 | yes | 4 | 0.07 | 99.3 | VELIRGRP | 71.84 | VELVRGLP | 20.07 | VELIRGQP | 6.86 | VELVRGRP | 0.53 | |
| NA | N1 | 455 | 0.2 | no | 2 | 78.55 | 99.22 | ATIWTSGS | 97.66 | TWASGSS | 1.56 | | | | |
| NA | N1 | 456 | 0.31 | yes | 4 | 0.09 | 99.22 | TIWTSGSS | 96.57 | TIWASGSS | 1.38 | TWTSGSS | 0.89 | TIWTSGSI | 0.38 | |
| NA | N1 | 457 | 0.33 | yes | 4 | 0.07 | 99.01 | IWTSGSIS | 96.3 | IWASGSIS | 1.38 | VWTSGSSI | 0.91 | IWTSGSII | 0.41 | |
| NA | N1 | 458 | 0.25 | yes | 3 | 0.09 | 99.1 | WTSGSSIS | 97.21 | WASGSSIS | 1.38 | WTSGSIIS | 0.51 | | | |
| NA | N1 | 459 | 0.25 | yes | 3 | 0.07 | 99.1 | TSGSSISF | 97.21 | ASGSSISF | 1.38 | TSGSIISF | 0.51 | | | |
| NA | N1 | 460 | 0.14 | yes | 2 | 0.15 | 99.12 | SGSISFC | 98.61 | SGSIISFC | 0.51 | | | | |
| NA | N1 | 461 | 0.14 | yes | 2 | 0.19 | 99.13 | GSISFCG | 98.64 | GSIISFCG | 0.49 | | | | |
| NA | N1 | 462 | 0.13 | yes | 2 | 0.19 | 99.24 | SSISFCGV | 98.76 | SIISFCGV | 0.48 | | | | |
| NA | N1 | 463 | 0.63 | yes | 4 | 0.21 | 99.17 | SISFCGVD | 89.47 | SISFCGV | 8.29 | SISFCGVN | 0.92 | IISFCGVN | 0.48 | |
| NA | N1 | 473 | 0 | no | 1 | 0.23 | 100 | IFLWCKIV | 100 | | | | | | |
| NA | N1 | 474 | 0 | no | 1 | 99.99 | 100 | FLWCKIVT | 100 | | | | | | |
| NA | N1 | 475 | 0 | no | 1 | 99.99 | 100 | LWCKIVTV | 100 | | | | | | |
| NA | N1 | 476 | 0 | no | 1 | 99.99 | 100 | WCKIVTTV | 100 | | | | | | |
| NA | N1 | 477 | 0 | no | 1 | 99.99 | 100 | CKIVTTVG | 100 | | | | | | |
| NA | N1 | 478 | 0 | no | 1 | 99.99 | 100 | KIVTTVGW | 100 | | | | | | |
| NA | N1 | 479 | 0 | no | 1 | 99.99 | 100 | IVTTVGWS | 100 | | | | | | |
| NA | N1 | 480 | 0 | no | 1 | 99.99 | 100 | VTTVGWSW | 100 | | | | | | |
| NA | N1 | 481 | 0 | no | 1 | 99.99 | 100 | TTVGWSWP | 100 | | | | | | |
| NA | N1 | 484 | 1.48 | yes | 4 | 2.43 | 99.14 | GWSWPDGA | 60.75 | NWSWPDGA | 20.33 | DWSWPDGA | 17.44 | SWSWPDGA | 0.62 | |
| NA | N1 | 485 | 0.46 | yes | 3 | 2.75 | 99.16 | WSWPDGAE | 92.88 | WSWPDGAD | 5.77 | SWPDDAEL | 0.52 | | | |
| NA | N1 | 486 | 0.53 | yes | 4 | 3.07 | 99.05 | SWPDGAEL | 92.02 | SWPDGADL | 5.78 | SWPDGAEV | 0.74 | WPDDAELP | 0.51 | |
| NA | N1 | 487 | 0.54 | yes | 5 | 3.47 | 99.04 | WPDGAELP | 91.99 | WPDGADLP | 5.8 | WPDGAEYP | 0.75 | PDDAELPF | 0.51 | PDDAELPF | 0.18 |
| NA | N1 | 488 | 0.54 | yes | 3 | 3.46 | 98.38 | PDGAELPF | 92.04 | PDGADLPF | 5.83 | PDGAEYPF | 0.73 | PDGAKLPF | 0.39 | |
| NA | N2 | — | 0 | no | 1 | 99.99 | 100 | AKAGVKMN | 100 | | | | | | |
| NA | N2 | 2 | 0 | no | 1 | 99.99 | 100 | KAGVKMNP | 100 | | | | | | |
| NA | N2 | 3 | 0 | no | 1 | 99.99 | 100 | AGVKMNPN | 100 | | | | | | |
| NA | N2 | 4 | 0 | no | 1 | 99.99 | 100 | GVKMNPNQ | 100 | | | | | | |
| NA | N2 | 5 | 0 | no | 1 | 99.99 | 100 | VKMNPNQK | 100 | | | | | | |

FIG. 72-10

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 6 | 0 | no | 1 | 99.99 | 100 | KMNPNQKI | 100 | | | | | | |
| NA | N2 | 13 | 0 | no | 1 | 99.99 | 100 | IIAGSV | 100 | | | | | | |
| NA | N2 | 54 | 0 | no | 1 | 99.9 | 100 | KNNQVILC | 100 | | | | | | |
| NA | N2 | 59 | 0 | no | 1 | 99.99 | 100 | VPLYPCEP | 100 | | | | | | |
| NA | N2 | 60 | 0 | no | 1 | 99.99 | 100 | PLYPCEPI | 100 | | | | | | |
| NA | N2 | 61 | 0 | no | 1 | 99.99 | 100 | LYPCEPII | 100 | | | | | | |
| NA | N2 | 72 | 0 | no | 1 | 99.92 | 100 | KTVWHLNS | 100 | | | | | | |
| NA | N2 | 86 | 0 | no | 1 | 99.99 | 100 | EKEKEICS | 100 | | | | | | |
| NA | N2 | 87 | 0 | no | 1 | 99.92 | 100 | KEKEICSV | 100 | | | | | | |
| NA | N2 | 110 | 0.35 | yes | 4 | 0.01 | 99.19 | GFAPFAKD | 95.89 | GFVPFSKD | 1.81 | GFAPFTKD | 0.94 | | |
| NA | N2 | 111 | 0.36 | yes | 4 | 0.01 | 99.08 | FAPFAKDN | 95.78 | FVPFSKDN | 1.81 | FAPFTKDN | 0.94 | | |
| NA | N2 | 112 | 0.36 | yes | 4 | 0 | 99.06 | APFAKDNS | 95.78 | VPFSKDNS | 1.81 | APFTKDNS | 0.92 | | |
| NA | N2 | 113 | 0.33 | yes | 5 | 0 | 99.02 | PFAKDNSI | 96.27 | PFTKDNSI | 1.81 | PLSKDNSI | 0.55 | | |
| NA | N2 | 114 | 0.35 | yes | 5 | 0.01 | 99.25 | FAKDNSIR | 96.14 | FTKDNSIR | 1.81 | LSKDNSIR | 0.55 | | |
| NA | N2 | 115 | 0.31 | yes | 4 | 0.03 | 99.24 | AKDNSIRL | 96.48 | TKDNSIRL | 1.81 | SKDNSVRL | 0.55 | FSKDNSVR | 0.37 |
| NA | N2 | 116 | 0.16 | yes | 3 | 0.04 | 99.21 | KDNSIRLS | 98.58 | KDNSIRLA | 0.37 | | | | |
| NA | N2 | 117 | 0.29 | yes | 4 | 0.06 | 99.23 | DNSIRLSA | 98.56 | DNSVRLSA | 0.37 | | | | |
| NA | N2 | 118 | 0.27 | yes | 3 | 0.06 | 99.17 | NSIRLSAS | 96.88 | NSVRLSAG | 1.7 | NSIRLAAG | 0.26 | | |
| NA | N2 | 128 | 0.52 | yes | 4 | 0.06 | 99.03 | SIRLSAGG | 96.98 | SVRLSAGG | 1.73 | | | | |
| NA | N2 | 129 | 0.51 | yes | 3 | 0.06 | 99.05 | IWVTREPY | 91.99 | IWITREPY | 6.41 | WVTREPY | 0.12 | | |
| NA | N2 | 130 | 0.5 | yes | 2 | 0.06 | 99.05 | WITREPYV | 92.1 | WVTREPYV | 6.42 | | | | |
| NA | N2 | 131 | 0.14 | yes | 5 | 0.03 | 99.25 | ITREPYVS | 92.16 | VTREPYVS | 6.42 | | | | |
| NA | N2 | 132 | 1.06 | yes | 2 | 0.06 | 99.21 | TREPYVSC | 98.73 | VTRELYVS | 0.52 | | | | |
| NA | N2 | 141 | 0.18 | yes | 1 | 0.03 | 99.17 | REPYVSCD | 80.01 | REPYVSCS | 10.99 | REPYYSCE | 6.92 | RELYVSCD | 0.77 |
| NA | N2 | 142 | 0.07 | yes | 1 | 0.06 | 99.42 | RCYQFALG | 98.15 | RCYQFALG | 1.02 | | | | |
| NA | N2 | 143 | 0.07 | yes | 1 | 0.06 | 99.43 | CYQFALGQ | 99.42 | | | | | | |
| NA | N2 | 144 | 0.07 | yes | 1 | 0.03 | 99.43 | YQFALGQG | 99.43 | | | | | | |
| NA | N2 | 145 | 0.08 | yes | 1 | 0.06 | 99.43 | QFALGQGT | 99.43 | | | | | | |
| NA | N2 | 146 | 1.2 | yes | 1 | 0.03 | 99.34 | FALGQGTT | 99.34 | | | | | | |
| NA | N2 | 147 | 1.14 | yes | 5 | 0.03 | 99.42 | ALGQGTTL | 99.42 | | | | | | |
| NA | N2 | 168 | 0.21 | yes | 4 | 0.03 | 99.74 | PYRTLLMN | 63.67 | PHRTLLMN | 32.64 | PHRTLLMS | 1.7 | PYRTLLMS | 0.99 |
| NA | N2 | 169 | 0.21 | yes | 2 | 0.03 | 99.77 | YRTLLMNE | 63.96 | HRTLLMNE | 33.14 | HRTLLMSE | 1.7 | YRTLLMSE | 0.99 | SHRTLLMN | 0.91 |
| NA | N2 | 170 | 0.22 | yes | 3 | 0.03 | 99.74 | RTLLMNEL | 97.09 | RTLLMSEL | 2.64 | | | | | | 0.94 |
| NA | N2 | 171 | 0.29 | yes | 3 | 0.03 | 99.74 | TLLMNELG | 96.14 | TLLMSELG | 2.64 | | | | |
| NA | N2 | 172 | 0.3 | yes | 2 | 0.01 | 99.67 | LLMNELGV | 96.07 | LLMSELGV | 2.61 | LLMNELGI | 0.99 | | |
| NA | N2 | 173 | 0.31 | yes | 3 | 0 | 99.6 | LMNELGVP | 96 | LMSELGVP | 2.61 | LMNELGIP | 0.99 | | |
| NA | N2 | 174 | 0.35 | yes | 3 | 0 | 99.21 | MNELGVPF | 95.64 | MSELGVPF | 2.58 | MNELGIPF | 0.99 | | |
| NA | N2 | 175 | 0.17 | yes | 2 | 0 | 99.27 | NELGVPFH | 98.25 | NELGIPFH | 0.99 | | | | |
| NA | N2 | 176 | 0.42 | yes | 3 | 0 | 99.19 | ELGVPFHL | 94.14 | ELGIPFHL | 4.03 | | | | |
| NA | N2 | 177 | 0.42 | yes | 3 | 0 | 99.19 | LGVPFHLA | 94.12 | LGIPFHLG | 4.04 | LGIPFHLG | 1.02 | | |
| NA | N2 | 178 | 0.42 | yes | 3 | 0 | 99.19 | GVPFHLAT | 94.12 | GIPFHLGT | 4.04 | IPFHLGTK | 1.02 | | |
| NA | N2 | 179 | 1.15 | yes | 5 | 0 | 99.16 | VPFHLGTR | 73.87 | VPFHLATK | 20.15 | VPFHLGTK | 4.02 | VPFYLGTK | 0.88 | VPFYLGTK | 0.25 |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 291 | 0.78 | yes | 2 | 0.03 | 99.75 | VEESCCYP | 78.62 | IEESCCYP | 21.13 | | | | |
| NA | N2 | 292 | 0.26 | yes | 2 | 0.03 | 99.03 | EESCCYPR | 96.78 | EESCCYPQ | 2.25 | ECSCYPRF | 1.23 | ECSCYPSY | 0.54 |
| NA | N2 | 293 | 0.43 | yes | 2 | 0.03 | 99.34 | ESCCYPRY | 94.81 | ECSCYPQY | 2.11 | ECSCYPRH | 0.65 | | |
| NA | N2 | 300 | – | no | 3 | 99.97 | 100 | SYLNVRCV | 50 | SYPNVRCV | 50 | | | | |
| NA | N2 | 304 | 0.51 | yes | 2 | 0 | 99.06 | VRCICRDN | 92.11 | VRCICRDN | 5.85 | IRCVCRDN | 1.1 | | |
| NA | N2 | 305 | 0.42 | yes | 2 | 0 | 99.1 | RCVCRDNW | 93.24 | RCICRDNW | 5.86 | | | | |
| NA | N2 | 306 | 0.56 | yes | 2 | 0 | 99.43 | CVRDNWKG | 91.13 | CICRDNWK | 5.71 | CVCRDNWR | 2.59 | | |
| NA | N2 | 307 | 0.56 | yes | 2 | 0 | 99.43 | CVRDNWKG | 91.11 | CICRDNWG | 5.71 | VCRDNWRG | 2.61 | | |
| NA | N2 | 308 | 0.24 | yes | 2 | 0 | 99.54 | CRDNWKGS | 96.8 | CRDNWRGS | 2.75 | | | | |
| NA | N2 | 309 | 0.24 | yes | 2 | 0 | 99.57 | RDNWKGSN | 96.83 | RDNWRGSN | 2.75 | | | | |
| NA | N2 | 310 | 0.24 | yes | 2 | 0 | 99.61 | DNWKGSNR | 96.85 | DNWRGSNR | 2.76 | | | | |
| NA | N2 | 311 | 0.23 | yes | 2 | 0 | 99.63 | NWKGSNRP | 96.85 | NWRGSNRP | 2.77 | | | | |
| NA | N2 | 312 | 1.13 | yes | 2 | 0 | 99.56 | WKGSNRPI | 66.58 | WKGSNRPV | 30.23 | WRGNRPI | 2.14 | WRGNRPV | |
| NA | N2 | 320 | 0 | yes | 1 | 99.97 | 100 | KLDINMAD | 100 | | | | | | |
| NA | N2 | 334 | 0.23 | yes | 3 | 0.03 | 99.13 | YVCSGLVG | 97.42 | YLCSGLVG | 0.99 | YMCSGLVG | 0.72 | | |
| NA | N2 | 335 | 0.23 | yes | 3 | 0.03 | 99.13 | VCSGLVGD | 97.39 | LCSGLVGD | 1.02 | MCSGLVGD | 0.72 | | |
| NA | N2 | 336 | 0.03 | yes | 1 | 0.04 | 99.78 | CSGLVGDT | 99.78 | | | | | | |
| NA | N2 | 337 | 0.03 | yes | 1 | 0.04 | 99.78 | SGLVGDTP | 99.78 | | | | | | |
| NA | N2 | 338 | 0.03 | yes | 1 | 0.04 | 99.78 | GLVGDTPR | 99.78 | | | | | | |
| NA | N2 | 339 | 1.16 | yes | 3 | 0 | 99.24 | LVGDTPRK | 62.71 | LVGDTPRN | 34.81 | LVGDTPRD | 0.87 | LVGDTPRE | 0.33 |
| NA | N2 | 365 | 1.1 | yes | 1 | 0.01 | 99.21 | HGVKGWAF | 65.81 | QGVKGWAF | 31.92 | LVGDTPRS | 1.49 | | |
| NA | N2 | 366 | 0.04 | yes | 1 | 0.01 | 99.68 | VKGWAFDD | 99.68 | VKGWAFDN | 14.66 | VKGWAFDY | 9.98 | VKGWAFDV | 0.43 |
| NA | N2 | 367 | 1.39 | yes | 5 | 0.06 | 99.42 | DWMGRTI | 70.05 | DIWMGRTI | 7.65 | DLWMGRTI | 1.08 | | |
| NA | N2 | 377 | 0.55 | yes | 2 | 0.06 | 99.41 | RSGYETFK | 90.68 | RSGYETFR | 26.23 | RLGYETFR | 22.39 | RAGYETFK | 0.61 |
| NA | N2 | 389 | 1.71 | yes | 5 | 0.06 | 99.36 | SGYETFK | 48.5 | SGYETFRV | 26.19 | LGYETFKV | 22.39 | AGYETFKV | 0.61 |
| NA | N2 | 390 | 1.72 | yes | 5 | 0.04 | 99.3 | SGYETFKV | 48.47 | GYETFRVI | 22.32 | GYETFKVV | 4.31 | GYETFKVT | 1.01 |
| NA | N2 | 391 | 1.26 | yes | 3 | 0.04 | 99.13 | GYETFKVI | 70.44 | SGYGVFS | 1.92 | | | | |
| NA | N2 | 422 | 0.25 | yes | 2 | 0.04 | 99.31 | SGYSIFS | 97.05 | GYSGVFS | 1.9 | GYSGIFSI | 0.48 | | |
| NA | N2 | 423 | 0.22 | yes | 2 | 0.04 | 99.43 | GYSGIFSV | 97.13 | YSGVFSVE | 1.89 | YSGIFSIE | 0.48 | | |
| NA | N2 | 424 | 0.26 | yes | 2 | 0.04 | 99.35 | YSGIFSVE | 96.98 | YSGIFSVE | 1.97 | | | | |
| NA | N2 | 435 | 0.19 | yes | 2 | 0.04 | 99.64 | CINRCFYV | 97.67 | CVNRCFYY | 1.97 | | | | |
| NA | N2 | 436 | 0.19 | yes | 3 | 0 | 99.61 | INRCFYVE | 97.64 | VNRCFYVE | | | | | |
| NA | N2 | 437 | 0.05 | yes | 1 | 0.03 | 99.63 | NRCFYVEL | 99.63 | | | | | | |
| NA | N2 | 438 | 0.07 | yes | 1 | 0.04 | 99.41 | RCFYVELI | 99.41 | | | | | | |
| NA | N2 | 439 | 0.18 | yes | 2 | 0.04 | 99.39 | CFYVELIR | 99.39 | | | | | | |
| NA | N2 | 440 | 0.18 | yes | 2 | 0.04 | 99.41 | FYVELIRG | 99.41 | | | | | | |
| NA | N2 | 441 | 1.08 | yes | 2 | 0.03 | 99.17 | YVELIRGR | 98.27 | YVELVRGR | 0.68 | | | | |
| NA | N2 | 454 | 1.48 | yes | 4 | 0.06 | 99.06 | VWWTSNSI | 59.63 | VLWTSNSI | 39.43 | WWTANSII | 9.83 | WTANSIIV | 0.15 |
| NA | N2 | 455 | 0.67 | yes | 5 | 0.06 | 99.14 | WWTSNSIV | 49.76 | LWTSNSIV | 39.36 | WTSNSIIA | 0.52 | TANSIIVF | 0.15 |
| NA | N2 | 456 | 0.67 | yes | 5 | 0.07 | 99.1 | WTSNSIIV | 88.57 | WTSNSIV | 9.39 | TSNSIIAF | 0.52 | ANSIIVFC | 0.15 |
| NA | N2 | 457 | 0.67 | yes | 5 | 0.07 | 99.1 | TSNSIVF | 88.57 | TSNSIVF | 9.35 | TSNSIIAF | 0.52 | | |
| NA | N2 | 458 | 0.1 | yes | 5 | 0.1 | 99.1 | SNSIVFC | 88.55 | SNSIVAFC | 9.36 | SNSIIAFC | 0.52 | | |

FIG. 72-13

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 459 | 0.66 | yes | 4 | 0.1 | 99.07 | NSIWFCG | 88.54 | NSIWFCG | 9.5 | NSIIAFCG | 0.52 | | |
| NA | N2 | 460 | 0.64 | yes | 4 | 0.25 | 99.21 | SIWFCGT | 88.78 | SIWAFCGT | 9.41 | SIIAFCGT | 0.53 | | |
| NA | N2 | 461 | 0.65 | yes | 4 | 0.28 | 99.16 | IWFCGTS | 88.81 | IWAFCGTS | 9.33 | IIAFCGTS | 0.53 | | |
| NA | N2 | 462 | 0.63 | yes | 2 | 0.26 | 99.31 | WFCGTSG | 88.84 | VAFCGTSG | 9.45 | IAFCGTSG | 0.53 | | |
| NA | N2 | 463 | 0.18 | yes | 1 | 0.26 | 99.23 | VFCGTSGT | 98.26 | AFCGTSG | 0.97 | | | | |
| NA | N2 | 464 | 0.1 | yes | 1 | 0.26 | 99.23 | FCGTSGT | 99.23 | | | | | | |
| NA | N2 | 465 | 0.09 | yes | 3 | 0.43 | 99.27 | CGTSGTY | 99.27 | | | | | | |
| NA | N2 | 466 | 0.19 | yes | 3 | 0.47 | 99.17 | GTSGTYG | 99.17 | GTSGTYGA | 0.75 | GTSGTYGS | 0.21 | | |
| NA | N2 | 467 | 0.19 | yes | 3 | 0.48 | 99.2 | TSGTYGT | 98.21 | TSGTYGAG | 0.76 | TSGTYGSG | 0.21 | | |
| NA | N2 | 468 | 0.2 | yes | 2 | 0.5 | 99.02 | SGTYGTG | 98.23 | SGTYGAGS | 0.75 | SGTYGSGS | 0.21 | | |
| NA | N2 | 469 | 0.2 | yes | 3 | 1.38 | 99.04 | GTYGTGS | 98.06 | GTYAGSW | 0.75 | GTYGSGSW | 0.21 | | |
| NA | N2 | 470 | 0.18 | yes | 4 | 0.83 | 99.05 | TYGTGSW | 98.08 | TYGAGSWP | 0.76 | | | | |
| NA | N2 | 471 | 0.2 | yes | 3 | 5.51 | 99.01 | YGTGSWP | 98.22 | YGSGSWPD | 0.79 | | | | |
| NA | N2 | 472 | 0.21 | yes | 5 | 5.81 | 99.19 | GTGSWPD | 98.32 | GAGWPDG | 0.66 | | | | |
| NA | N2 | 473 | 1.03 | yes | 5 | 6.04 | 99.16 | TGSWPDGA | 98.08 | AGSWPDGA | 0.66 | | | | |
| NA | N2 | 474 | 1.27 | yes | 4 | 6.04 | 99.02 | GSWPDGAD | 67.29 | GSWPDGAE | 31.57 | TGTWPDGA | 0.22 | TWPDGADI | 0.21 |
| NA | N2 | 475 | 0 | yes | 3 | 6.86 | 98.27 | SWPDGADI | 63.21 | SWPDGADL | 31.41 | SWPDGAEI | 0.27 | | |
| NA | N2 | 480 | 2.13 | no | 5 | 99.99 | 98.93 | RTSISCLY | 100 | | | | | | |
| NA | N2 | 482 | 2.13 | no | 5 | 99.9 | 100 | DINLHAYI | 42.86 | DIKSHAYI | 14.29 | NINFMPYI | 14.29 | DINLMPIY | 14.29 |
| NA | N2 | 483 | 2.13 | no | 5 | 99.9 | 100 | INLHAYIS | 42.86 | INFMPYIS | 14.29 | ISCLYKLS | 14.29 | INLMPIYS | 14.29 |
| NA | N2 | 484 | 1.79 | no | 4 | 99.92 | 100 | NLHAYISF | 42.86 | SCLYKLSQ | 14.29 | NFMPYISF | 14.29 | GLMGRTRI | 14.29 |
| NA | N2 | 485 | 0 | no | 1 | 99.96 | 100 | LHAYISFR | 50 | FMPYISFA | 16.67 | CLYKLSQF | 16.67 | | |
| NA | N2 | 486 | 0 | no | 5 | 99.96 | 100 | HAYISFRN | 100 | | | | | | |
| NA | N2 | 487 | 0 | no | 5 | 99.96 | 100 | AYISFRNL | 100 | | | | | |

FIG. 72-14

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N3 | 100 | 0.32 | yes | 3 | 0 | 99.8 | FHKDNAIR | 95.33 | FHKD

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N3 | 349 | 0.47 | yes | 5 | 0.81 | 99.39 | WVRINNET | 93.85 | WVRMNNET | 2.25 | WVRINNET | 1.64 | WVRINNET | 1.02 |
| NA | N3 | 350 | 0.49 | yes | 5 | 0.81 | 99.18 | MRINNETI | 93.65 | VRMNNETI | 2.25 | VRINNETI | 1.64 | VRINNETI | 1.02 |
| NA | N3 | 351 | 0.49 | yes | 5 | 0.81 | 99.39 | RINNETIL | 93.65 | RMNNETIL | 2.25 | RINNETIL | 1.64 | RINNETIL | 1.02 |
| NA | N3 | 352 | 0.46 | yes | 4 | 0.61 | 99.59 | INNETILE | 94.06 | MNNETILE | 2.05 | INNETIIE | 1.64 | INNETIVE | 0.61 |
| NA | N3 | 353 | 0.3 | yes | 3 | 0.61 | 99.18 | NNETILET | 96.31 | SNETILET | 1.64 | NNETIVET | 1.02 | | |
| NA | N3 | 354 | 0.22 | yes | 4 | 0.61 | 99.18 | NETILETG | 97.55 | NETIVETG | 1.02 | TIVETGY | 0.61 | | |
| NA | N3 | 355 | 0.22 | yes | 4 | 0.61 | 99.39 | ETILETGY | 97.55 | ETIVETGY | 1.02 | IVETGYC | 0.61 | | |
| NA | N3 | 356 | 0.34 | yes | 4 | 0.61 | 99.18 | TILETGYI | 95.71 | TIIETGYV | 2.04 | VETGYVCS | 0.61 | | |
| NA | N3 | 357 | 0.36 | yes | 3 | 0.61 | 99.39 | ILETGYIC | 95.5 | IIETGYVC | 2.04 | | | | |
| NA | N3 | 358 | 0.25 | yes | 2 | 0.61 | 99.18 | LETGYICS | 96.93 | IETGYVCS | 2.04 | | | | |
| NA | N3 | 359 | 0.24 | yes | 2 | 0.61 | 99.39 | ETGYICSK | 96.93 | ETGYVCGK | 2.25 | | | | |
| NA | N3 | 360 | 0.24 | yes | 2 | 0.61 | 99.18 | TGYICSKF | 96.93 | | | | | | |
| NA | N3 | 361 | 0.21 | yes | 2 | 0.81 | 99.18 | GYICSKFH | 97.14 | | | | | | |
| NA | N3 | 362 | 0.08 | yes | 1 | 0.61 | 99.39 | YICSKFHS | 99.18 | | | | | | |
| NA | N3 | 363 | 0.08 | yes | 1 | 0.61 | 99.18 | ICSKFHSD | 96.93 | | | | | | |
| NA | N3 | 364 | 0.04 | yes | 1 | 0.61 | 99.18 | CSKFHSDT | 99.18 | | | | | | |
| NA | N3 | 365 | 0.02 | yes | 1 | 0.61 | 99.18 | SKFHSDTP | 99.59 | | | | | | |
| NA | N3 | 366 | 0 | yes | 1 | 0.81 | 99.8 | KFHSDTPR | 99.8 | | | | | | |
| NA | N3 | 367 | 0 | yes | 1 | 0.61 | 99.39 | FHSDTPRP | 99.59 | | | | | | |
| NA | N3 | 368 | 1.16 | yes | 5 | 0.81 | 99.39 | HSDTPRPA | 79.51 | HSDTPRPY | 6.76 | HSDTPRPS | 5.53 | HSDTPRPT | 2.66 |
| NA | N3 | 369 | 1.16 | yes | 5 | 0.61 | 99.39 | SDTPRPAD | 79.51 | SDTPRPVD | 6.76 | SDTPRPSD | 5.53 | SDTPRPTD | 2.66 |
| NA | N3 | 370 | 1.14 | yes | 5 | 0.61 | 99.59 | DTPRPADP | 79.71 | DTPRPVDP | 6.76 | DTPRPSDP | 5.53 | DTPRPTDP | 2.66 |
| NA | N3 | 371 | 0.65 | yes | 3 | 0.61 | 99.18 | TPRPADPS | 90.8 | TPRPVDPS | 3.07 | TPRPSDPS | 5.53 | TPRPTDPS | 2.66 |
| NA | N3 | 391 | 0.47 | yes | 5 | 0.61 | 99.39 | PGPVKGFG | 93.05 | RRGVKGFG | 3.27 | EPGVKGFG | 3.07 | RPGVKGFG | 0.41 |
| NA | N3 | 392 | 0.23 | yes | 2 | 0.81 | 99.39 | GVKGFGF | 96.93 | LGVKGFGF | 2.45 | | | | |
| NA | N3 | 393 | 0.92 | yes | 5 | 0.81 | 99.8 | GVKGFK | 82.93 | QNDVWLGR | 10.77 | GSDYWLGR | 3.25 | SNDVWLGR | 1.02 |
| NA | N3 | 402 | 0.62 | yes | 3 | 0 | 100 | GNDYWLGR | 87.4 | SDYWLGRT | 10.77 | | | | |
| NA | N3 | 403 | 0.25 | yes | 2 | 0 | 99.59 | NDYWLGRT | 96.14 | DYWLGRTI | 3.46 | | | | |
| NA | N3 | 404 | 0.31 | yes | 2 | 0 | 99.39 | DYWLGRTV | 95.53 | YWLGRTIS | 3.46 | | | | |
| NA | N3 | 405 | 0.63 | yes | 4 | 0 | 99.39 | YWLGRTVS | 90.04 | YWLGRTMS | 5.49 | | | | |
| NA | N3 | 415 | 0.58 | yes | 3 | 0 | 99.19 | GRSGFEII | 89.84 | SRSGFEVI | 8.33 | WRSGFEII | 0.61 | | |
| NA | N3 | 416 | 0.57 | yes | 3 | 0 | 99.19 | RSGFEIIK | 89.84 | RSGFEVIR | 8.54 | RSGFEVIR | 0.41 | | |
| NA | N3 | 417 | 0.53 | yes | 3 | 0 | 99.39 | SGFEIIKV | 92.89 | SGFEIIRV | 3.05 | | | | |
| NA | N3 | 422 | 0.25 | yes | 3 | 0 | 99.19 | IKVTEGWI | 97.15 | IKVAEGWI | 1.63 | IKVSNGWI | 1.22 | IRVAEGWI | 0.81 |
| NA | N3 | 439 | 0.2 | yes | 2 | 0 | 99.39 | TQTLVSNN | 97.76 | IQTLVSNN | 1.22 | TQTLVANN | 0.41 | | |
| NA | N3 | 440 | 0.18 | yes | 2 | 0 | 99.19 | QTLVSND | 97.97 | QTLVANND | 1.22 | | | | |
| NA | N3 | 441 | 0.18 | yes | 3 | 0 | 99.19 | TLVSNDW | 97.97 | TLVANNDW | 1.22 | | | | |
| NA | N3 | 442 | 0.14 | yes | 2 | 0 | 99.19 | LVSNNDWS | 97.97 | | | | | | |
| NA | N3 | 443 | 0.18 | yes | 3 | 0 | 99.39 | VSNNDWSG | 97.97 | | | | | | |
| NA | N3 | 444 | 0.18 | yes | 3 | 0 | 99.19 | SNNDWSGY | 98.37 | | | | | | |
| NA | N3 | 445 | 0.14 | yes | 2 | 0 | 99.59 | NDWSGYS | 98.37 | | | | | | |
| NA | N3 | 446 | 0.14 | yes | 2 | 0 | 99.59 | NDWSGYSG | 98.37 | | | | | | |

FIG. 72-17

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N3 | 447 | 0.04 | yes | 1 | 0 | 99.59 | DWSGYSGS | 99.59 | | | | | | |
| NA | N3 | 448 | 0.02 | yes | 1 | 0 | 99.8 | WSGYSGSF | 99.8 | | | | | | |
| NA | N3 | 449 | 0.3 | yes | 2 | 0 | 99.19 | SGYSGSFI | 95.73 | | | | | | |
| NA | N3 | 450 | 0.58 | yes | 3 | 0 | 99.39 | GYSGSFIV | 91.26 | SGYSGSFV | 3.46 | GYSGSFV | 0.41 | | |
| NA | N3 | 461 | 0.58 | yes | 2 | 0 | 99.8 | GCFQPCFY | 49.59 | GYSGSFVI | 4.47 | | | | |
| NA | N3 | 462 | 1.12 | yes | 2 | 0 | 99.8 | CFQPCFYE | 58.54 | DCFQPCFY | 48.98 | | | | |
| NA | N3 | 463 | — | yes | 2 | 0 | 99.59 | FQPCFYYE | 58.54 | CFQPCFYI | 41.26 | | | | |
| NA | N3 | 464 | — | yes | 2 | 0 | 99.8 | QPCFYYEL | 58.54 | FQPCFYIE | 41.26 | | | | |
| NA | N3 | 465 | 1.02 | yes | 2 | 0 | 99.59 | PCFYYELI | 55.28 | QPCFYIEL | 41.06 | | | | |
| NA | N3 | 466 | 1.22 | yes | 3 | 0 | 99.59 | CFYYELIR | 55.49 | PCFYIELI | 40.85 | PCFYELT | 3.25 | | |
| NA | N3 | 467 | 1.2 | yes | 3 | 0 | 99.39 | FYYELIRG | 55.28 | CFYIELIR | 40.85 | CFYELTR | 3.25 | | |
| NA | N3 | 468 | 1.2 | yes | 3 | 0 | 99.39 | YYELIRGK | 55.28 | FYIELIRG | 40.85 | FYELTRG | 3.25 | | |
| NA | N3 | 470 | 1.56 | yes | 4 | 0 | 99.19 | ELIRGRPN | 29.67 | YIELIRGK | 40.85 | YIELIRG | 11.18 | ELIRGRLN | 0.41 |
| NA | N3 | 482 | 0.9 | yes | 3 | 0 | 99.19 | VSWTSNSI | 83.33 | ELTRGVPN | 11.38 | ELIRGRTN | 3.25 | | |
| NA | N3 | 483 | 0.19 | yes | 2 | 0 | 99.19 | SWTSNSIV | 97.97 | VSWASNSI | 0.61 | SWTSNSII | 0.81 | | |
| NA | N3 | 484 | 0.21 | yes | 2 | 0 | 99.19 | WTSNSIVT | 97.76 | SWASNSIV | 0.61 | SWTSNSMV | 0.2 | | |
| NA | N3 | 485 | 0.19 | yes | 2 | 0 | 99.19 | TSNSIVTF | 97.97 | WASNSIVT | 0.61 | WTSNSMVT | | | |
| NA | N3 | 486 | 0.19 | yes | 2 | 0 | 99.19 | SNSIVTFC | 97.97 | TSNSMVTF | 0.61 | | | | |
| NA | N3 | 487 | 0.14 | yes | 2 | 0 | 99.39 | NSIVTFCG | 97.97 | ASNSIVTF | 0.61 | | | | |
| NA | N3 | 488 | 0.12 | yes | 2 | 0 | 99.19 | SIVTFCGL | 98.58 | SMVTFCGL | 0.61 | | | | |
| NA | N3 | 489 | 0.12 | yes | 2 | 0 | 99.19 | IVTFCGLD | 98.78 | MVTFCGLD | 1.83 | MVTFCGLD | 0.61 | | |
| NA | N3 | 490 | 0.27 | yes | 2 | 0.2 | 99.39 | VTFCGLDN | 98.78 | VTFCGLN | 1.83 | | | | |
| NA | N3 | 491 | 0.17 | yes | 2 | 0.2 | 99.39 | TFCGLDNE | 96.74 | ITFCGLN | 1.84 | | | | |
| NA | N3 | 492 | 0.2 | yes | 2 | 0.41 | 99.59 | FCGLDNEP | 97.56 | FCGLNNE | 1.84 | | | | |
| NA | N3 | 493 | 0.17 | yes | 2 | 1.02 | 99.59 | CGLDNEPG | 97.76 | CGLNNEP | 1.85 | | | | |
| NA | N3 | 494 | 0.21 | yes | 2 | 1.22 | 99.18 | GLDNEPGS | 97.33 | GLNNEPG | 1.85 | | | | |
| NA | N3 | 495 | 0.24 | yes | 3 | 1.22 | 99.38 | LDNEPGSG | 97.53 | LNNEPGS | 1.85 | LDNEPGSE | 0.61 | | |
| NA | N3 | 497 | 0.22 | yes | 2 | 3.05 | 99.16 | NEPGSGDW | 97.12 | NEPGSGDW | 0.84 | NEPGSGNG | 1.85 | NEPGSGW | 0.21 |
| NA | N3 | 498 | 0.16 | yes | 3 | 3.46 | 98.95 | EPGSGDWP | 97.69 | EPGSGDWP | 0.84 | | | | |
| NA | N3 | 499 | 0.16 | yes | 3 | 3.86 | 99.16 | PGSGDWPD | 98.31 | PGSGDWPD | 0.85 | | | | |
| NA | N3 | 500 | 0.39 | yes | 4 | 4.67 | 99.15 | GSGDWPDG | 98.31 | GSGDWPDG | 0.85 | | | | |
| NA | N3 | 501 | 0.33 | yes | 4 | 5.28 | 98.93 | SGNWPDGA | 98.29 | SGDWPDGS | 3.01 | SGNWPDGP | 0.86 | | |
| NA | N3 | 504 | 0.33 | yes | 5 | 6.3 | 99.35 | WPDGANIG | 94.84 | WPDGSDIG | 2.39 | WPDGPKIIG | 0.65 | | |
| NA | N3 | 505 | 0.35 | yes | 5 | 7.72 | 99.12 | PDGANIGF | 95.88 | PDGSDIGF | 2.2 | PDGSNIKGF | 0.66 | | |
| NA | N3 | 506 | 0.35 | yes | 4 | 9.35 | 99.1 | DGANIGFM | 96.04 | DGSDIGFM | 2.24 | DGSNIKFM | 0.67 | DGSKIGFM | 0.22 |
| NA | N3 | 507 | 0.31 | yes | 4 | 9.35 | 99.1 | GANIGFMP | 95.74 | GSDIGFMP | 2.24 | GSNIKFMP | 0.67 | GSKIGFMP | 0.22 |
| NA | N3 | 508 | 0.31 | no | 5 | 11.99 | 98.93 | ANIGFMPK | 96.07 | SDIGFMPK | 2.31 | SNIKFMPK | 0.69 | | |
| NA | N4 | — | 0.24 | no | 3 | 16.26 | 99.08 | MNPNQKII | 97.09 | MNPNQSII | 0.97 | | | | |
| NA | N4 | 2 | 0.22 | no | 3 | 16.26 | 99.03 | NPNQKIIT | 97.09 | NPNQMIIT | 0.97 | | | | |
| NA | N4 | 3 | 0.24 | no | 3 | 16.26 | 99.03 | PNQKIITI | 97.09 | PNQMIIT | 0.97 | | | | |
| NA | N4 | 4 | 0.31 | no | 4 | 14.63 | 99.05 | NQKIITIG | 96.19 | NQMIITIG | 0.95 | | | NQKIVTIG | 0.95 |
| NA | N4 | 5 | 0.31 | no | 4 | 14.63 | 99.05 | QKIITIGS | 96.19 | QMIITIGS | 0.95 | | | QKIVTIGS | 0.95 |

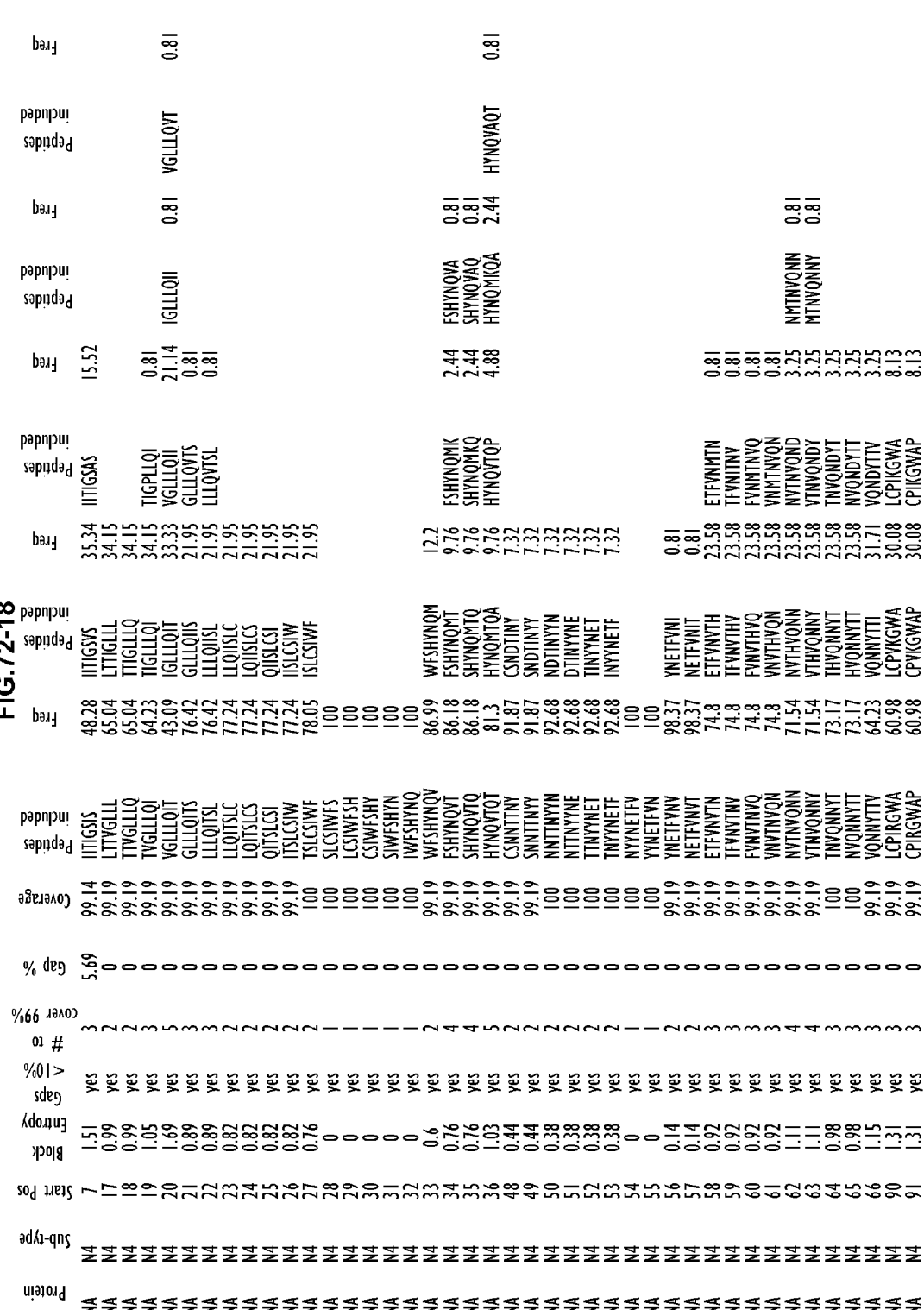

FIG. 72-19

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 92 | 1.31 | yes | 3 | 0 | 99.19 | PIKGWAPL | 60.98 | PIKGWAPL | 30.08 | | | | |
| NA | N4 | 93 | 1.31 | yes | 3 | 0 | 99.19 | IRGWAPLS | 60.98 | IRGWAPLS | 30.08 | | | | |
| NA | N4 | 94 | 0.96 | yes | 2 | 0 | 100 | RGWAPLSK | 61.79 | KGWAPLSK | 38.21 | | | | |
| NA | N4 | 95 | 0 | yes | 1 | 0 | 100 | GWAPLSKD | 100 | | | | | | |
| NA | N4 | 96 | 0 | yes | 1 | 0 | 100 | WAPLSKDN | 100 | | | | | | |
| NA | N4 | 97 | 0 | yes | 1 | 0 | 100 | APLSKDNG | 100 | | | | | | |
| NA | N4 | 98 | 0 | yes | 1 | 0 | 100 | PLSKDNGI | 100 | | | | | | |
| NA | N4 | 99 | 0 | yes | 1 | 0 | 100 | LSKDNGIR | 100 | | | | | | |
| NA | N4 | 100 | 0 | yes | 1 | 0 | 100 | SKDNGIRI | 100 | | | | | | |
| NA | N4 | 101 | 0 | yes | 1 | 0 | 100 | KDNGIRIG | 100 | | | | | | |
| NA | N4 | 102 | 0 | yes | 1 | 0 | 100 | DNGIRIGS | 100 | | | | | | |
| NA | N4 | 103 | 0 | yes | 1 | 0 | 100 | NGIRIGSR | 100 | | | | | | |
| NA | N4 | 104 | 0 | yes | 1 | 0 | 100 | GIRIGSRG | 100 | | | | | | |
| NA | N4 | 105 | 0 | yes | 1 | 0 | 100 | IRIGSRGE | 100 | | | | | | |
| NA | N4 | 106 | 0 | yes | 1 | 0 | 100 | RIGSRGEV | 100 | | | | | | |
| NA | N4 | 107 | 0 | yes | 1 | 0 | 99.19 | IGSRGEVF | 99.19 | | | | | | |
| NA | N4 | 108 | 0.07 | yes | 2 | 0 | 99.19 | GSRGEVFV | 99.19 | | | | | | |
| NA | N4 | 109 | 0.07 | yes | 2 | 0 | 99.19 | SRGEVFVI | 99.19 | | | | | | |
| NA | N4 | 110 | 0.07 | yes | 2 | 0 | 99.19 | RGEVFVIR | 99.19 | | | | | | |
| NA | N4 | 111 | 0.07 | yes | 2 | 0 | 99.19 | GEVFVIRE | 99.19 | | | | | | |
| NA | N4 | 112 | 0.07 | yes | 2 | 0 | 99.19 | EVFVIREP | 99.19 | | | | | | |
| NA | N4 | 113 | 0.07 | yes | 2 | 0 | 99.19 | VFVIREPF | 99.19 | VFVIREPC | 0.81 | | | | |
| NA | N4 | 114 | 0.14 | yes | 3 | 0 | 98.37 | FVIREPFI | 98.37 | FVIREPCI | 0.81 | | | | |
| NA | N4 | 115 | 0.14 | yes | 2 | 0 | 97.56 | VIREPFIS | 97.56 | VIREPFVS | 0.81 | FVIREPFV | 0.81 | | | |
| NA | N4 | 116 | 0.14 | yes | 3 | 0 | 98.37 | IREPFISC | 98.37 | IREPCISC | 0.81 | | | | |
| NA | N4 | 117 | 0.26 | yes | 2 | 0 | 98.37 | REPFISCS | 98.37 | REPCISCS | 0.81 | | | | |
| NA | N4 | 118 | 0.2 | yes | 3 | 0 | 96.75 | EPFISCSI | 96.75 | EPCISCSI | 0.81 | | | | |
| NA | N4 | 121 | 1.48 | yes | 5 | 0 | 46.34 | ISCSINEC | 46.34 | ISCSIDEC | 44.72 | ISCSVSEC | 0.81 | VSCSIHEC | 0.81 |
| NA | N4 | 122 | 1.46 | yes | 5 | 0 | 46.34 | SCSINECR | 46.34 | SCSIDECR | 44.72 | SCSVSECR | 5.69 | SCSIHECR | 1.63 |
| NA | N4 | 123 | 1.46 | yes | 5 | 0 | 46.34 | CSINECRT | 46.34 | CSIDECRT | 44.72 | CSVSECRT | 5.69 | CSIHECRT | 1.63 |
| NA | N4 | 124 | 1.46 | yes | 5 | 0 | 46.34 | SINECRTF | 46.34 | SIDECRTF | 44.72 | SVSECRTF | 5.69 | SIHECRTF | 1.63 |
| NA | N4 | 125 | 1.36 | yes | 4 | 0 | 47.97 | INECRTFF | 47.97 | IDECRTFF | 44.72 | VSECRTFF | 5.69 | IHECRTFF | 1.63 |
| NA | N4 | 126 | 0 | yes | 1 | 0 | 100 | NECRTFFL | 100 | DECRTFFL | 44.72 | HECRTFFL | 5.69 | | |
| NA | N4 | 127 | 0 | yes | 1 | 0 | 100 | ECRTFFLT | 100 | | | | | | |
| NA | N4 | 128 | 0 | yes | 1 | 0 | 100 | CRTFFLTQ | 100 | | | | | | |
| NA | N4 | 129 | 0 | yes | 1 | 0 | 100 | RTFFLTQG | 100 | | | | | | |
| NA | N4 | 130 | 0 | yes | 1 | 0 | 100 | TFFLTQGA | 100 | | | | | | |
| NA | N4 | 131 | 0 | yes | 1 | 0 | 100 | FFLTQGAL | 100 | | | | | | |
| NA | N4 | 132 | 0 | yes | 1 | 0 | 100 | FLTQGALL | 100 | | | | | | |
| NA | N4 | 133 | 0 | yes | 1 | 0 | 100 | LTQGALLN | 100 | | | | | | |
| NA | N4 | 134 | 0 | yes | 1 | 0 | 100 | TQGALLND | 100 | | | | | | |
| NA | N4 | 135 | 0 | yes | 1 | 0 | 100 | QGALLNDK | 100 | | | | | | |

FIG. 72-20

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 136 | 0 | yes | 1 | 0 | 100 | GALLNDKH | 100 | | | | | | |
| NA | N4 | 137 | 0 | yes | 1 | 0 | 100 | ALLNDKHS | 100 | | | | | | |
| NA | N4 | 138 | 0 | yes | 1 | 0 | 100 | LLNDKHSN | 100 | | | | | | |
| NA | N4 | 139 | 0 | yes | 1 | 0 | 100 | LNDKHSNG | 100 | | | | | | |
| NA | N4 | 140 | 0 | yes | 1 | 0 | 100 | NDKHSNGT | 100 | | | | | | |
| NA | N4 | 141 | 0 | yes | 1 | 0 | 100 | DKHSNGTV | 100 | | | | | | |
| NA | N4 | 142 | 0 | yes | 1 | 0 | 100 | KHSNGTVK | 100 | | | | | | |
| NA | N4 | 143 | 0 | yes | 1 | 0 | 100 | HSNGTVKD | 100 | | | | | | |
| NA | N4 | 144 | 0 | yes | 1 | 0 | 100 | SNGTVKDR | 100 | | | | | | |
| NA | N4 | 145 | 0 | yes | 1 | 0 | 100 | NGTVKDRS | 100 | | | | | | |
| NA | N4 | 146 | 0 | yes | 1 | 0 | 100 | GTVKDRSP | 100 | | | | | | |
| NA | N4 | 147 | 0 | yes | 1 | 0 | 100 | TVKDRSPF | 100 | | | | | | |
| NA | N4 | 148 | 0 | yes | 1 | 0 | 100 | VKDRSPFR | 100 | | | | | | |
| NA | N4 | 149 | 0 | yes | 1 | 0 | 100 | KDRSPFRT | 100 | | | | | | |
| NA | N4 | 150 | 0 | yes | 1 | 0 | 100 | DRSPFRTL | 100 | | | | | | |
| NA | N4 | 151 | 0 | yes | 1 | 0 | 100 | RSPFRTLM | 100 | | | | | | |
| NA | N4 | 152 | 0 | yes | 1 | 0 | 100 | SPFRTLMS | 100 | | | | | | |
| NA | N4 | 153 | 0 | yes | 1 | 0 | 100 | PFRTLMSC | 100 | | | | | | |
| NA | N4 | 154 | 0.07 | yes | 3 | 0 | 99.19 | FRTLMSCP | 99.19 | RTLMSCPM | 92.68 | RTLMSCPV | 4.88 | | |
| NA | N4 | 155 | 0.47 | yes | 3 | 0 | 99.19 | RTLMSCPI | 99.19 | TLMSCPMG | 92.68 | TLMSCPVG | 4.88 | | |
| NA | N4 | 156 | 0.47 | yes | 3 | 0 | 99.19 | TLMSCPIG | 99.19 | LMSCPMGV | 92.68 | LMSCPVGV | 4.88 | | |
| NA | N4 | 157 | 0.53 | yes | 4 | 0 | 91.87 | LMSCPIGV | 99.19 | MSCPMGVA | 91.87 | MSCPVGVA | 4.88 | MSCHIGVA | 0.81 |
| NA | N4 | 158 | 0.53 | yes | 4 | 0 | 91.87 | MSCPIGVA | 99.19 | SCPMGVAP | 91.87 | SCPVGVAP | 4.88 | SCHIGVAP | 0.81 |
| NA | N4 | 159 | 0.53 | yes | 4 | 0 | 91.87 | SCPIGVAP | 99.19 | CPMGVAPS | 91.87 | CPVGVAPS | 4.88 | CHIGVAPS | 0.81 |
| NA | N4 | 160 | 0.47 | yes | 4 | 0 | 92.68 | CPIGVAPS | 99.19 | PMGVAPSP | 92.68 | PVGVAPSP | 4.88 | PIGWPSP | 0.81 |
| NA | N4 | 161 | 0.07 | yes | 3 | 0 | 99.19 | PIGVAPSP | 99.19 | MGVAPSPS | 92.68 | VGVAPSPS | 4.88 | | |
| NA | N4 | 162 | 0.07 | yes | 1 | 0 | 99.19 | IGVAPSPS | 99.19 | | | | | | |
| NA | N4 | 163 | 0 | yes | 1 | 0 | 100 | GVAPSPSN | 100 | | | | | | |
| NA | N4 | 164 | 0 | yes | 1 | 0 | 100 | VAPSPSNS | 100 | | | | | | |
| NA | N4 | 165 | 0 | yes | 1 | 0 | 100 | APSPSNSR | 100 | | | | | | |
| NA | N4 | 166 | 0 | yes | 1 | 0 | 100 | PSPSNSRF | 100 | | | | | | |
| NA | N4 | 167 | 0 | yes | 1 | 0 | 100 | SPSNSRFE | 100 | | | | | | |
| NA | N4 | 168 | 0 | yes | 1 | 0 | 100 | PSNSRFES | 100 | | | | | | |
| NA | N4 | 169 | 0 | yes | 1 | 0 | 100 | SNSRFESV | 100 | | | | | | |
| NA | N4 | 170 | 0 | yes | 1 | 0 | 100 | NSRFESVA | 100 | | | | | | |
| NA | N4 | 171 | 0 | yes | 1 | 0 | 100 | SRFESVAW | 100 | | | | | | |
| NA | N4 | 172 | 0 | yes | 1 | 0 | 100 | RFESVAWS | 100 | | | | | | |
| NA | N4 | 173 | 0 | yes | 1 | 0 | 100 | FESVAWSA | 100 | | | | | | |
| NA | N4 | 174 | 0 | yes | 1 | 0 | 100 | ESVAWSAT | 100 | | | | | | |
| NA | N4 | 175 | 0 | yes | 1 | 0 | 100 | SVAWSATA | 100 | | | | | | |
| NA | N4 | 176 | 0 | yes | 1 | 0 | 100 | VAWSATAC | 100 | | | | | | |
| NA | N4 | 177 | 0 | yes | 1 | 0 | 100 | AWSATACS | 100 | | | | | | |

FIG.72-21

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 178 | 0 | yes | 1 | 0 | 100 | WSATACSD | 100 | | | | | | |
| NA | N4 | 179 | 0 | yes | 1 | 0 | 100 | SATACSDG | 100 | | | | | | |
| NA | N4 | 180 | 0.17 | yes | 2 | 0 | 100 | ATACSDGP | 97.56 | ATACSDGS | 2.44 | | | | |
| NA | N4 | 181 | 0.17 | yes | 2 | 0 | 100 | TACSDGPG | 97.56 | TACSDGSG | 2.44 | | | | |
| NA | N4 | 182 | 0.17 | yes | 2 | 0 | 100 | ACSDGPGW | 97.56 | ACSDGSGW | 2.44 | | | | |
| NA | N4 | 183 | 0.17 | yes | 2 | 0 | 100 | CSDGPGWL | 97.56 | CSDGSGWL | 2.44 | | | | |
| NA | N4 | 184 | 0.17 | yes | 2 | 0 | 100 | SDGPGWLT | 97.56 | SDGSGWLT | 2.44 | | | | |
| NA | N4 | 185 | 0.37 | yes | 3 | 0 | 100 | DGPGWLTI | 94.31 | DGSGWLTL | 3.25 | | | | |
| NA | N4 | 186 | 0.37 | yes | 3 | 0 | 100 | GPGWLTLG | 94.31 | GSGWLTLG | 3.25 | | | | |
| NA | N4 | 187 | 0.37 | yes | 3 | 0 | 100 | PGWLTLGI | 94.31 | SGWLTLGI | 3.25 | | | | |
| NA | N4 | 188 | 0.21 | yes | 3 | 0 | 100 | GWLTLGIT | 96.75 | | | | | | |
| NA | N4 | 189 | 0.21 | yes | 3 | 0 | 100 | WLTLGITG | 96.75 | | | | | | |
| NA | N4 | 190 | 0.21 | yes | 3 | 0 | 100 | LTLGITGP | 96.75 | | | | | | |
| NA | N4 | 191 | 1.21 | yes | 4 | 0 | 100 | TLGITGPD | 73.17 | LGITGPDT | 14.63 | | | | |
| NA | N4 | 192 | 1.01 | yes | 3 | 0 | 100 | LGITGPDA | 76.42 | GITGPDTT | 14.63 | IGITGPDA | 3.25 | | |
| NA | N4 | 193 | 1.01 | yes | 3 | 0 | 100 | GITGPDAT | 76.42 | ITGPDTTA | 14.63 | | | | |
| NA | N4 | 194 | 1.01 | yes | 3 | 0 | 100 | ITGPDATA | 76.42 | TGPDTTAV | 14.63 | | | | |
| NA | N4 | 195 | 1.08 | yes | 3 | 0 | 100 | TGPDATAV | 75.61 | GPDTTAVA | 14.63 | | | | |
| NA | N4 | 196 | 1.08 | yes | 3 | 0 | 100 | GPDATAVA | 75.61 | PDTTAVAV | 14.63 | | | | |
| NA | N4 | 197 | 1.14 | yes | 4 | 0 | 99.19 | PDATAVAV | 74.8 | DTTAVAVL | 14.63 | | | | |
| NA | N4 | 198 | 1.14 | yes | 4 | 0 | 99.19 | DATAVAVL | 74.8 | TTAVAVLK | 14.63 | DATAVAVI | 0.81 | | |
| NA | N4 | 199 | 0.69 | yes | 2 | 0 | 99.19 | ATAVAVLK | 83.74 | | | ATAVAVIK | 0.81 | | |
| NA | N4 | 200 | 0.69 | yes | 2 | 0 | 99.19 | TAVAVLKY | 83.74 | | | | | | |
| NA | N4 | 201 | 0.69 | yes | 2 | 0 | 99.19 | AVAVLKYN | 83.74 | | | | | | |
| NA | N4 | 202 | 0.85 | yes | 4 | 0 | 99.19 | VAVLKYNG | 81.3 | | | | | | |
| NA | N4 | 203 | 0.78 | yes | 3 | 0 | 99.19 | AVLKYNGI | 82.11 | AVLKYNGV | 2.44 | | | | |
| NA | N4 | 204 | 0.78 | yes | 3 | 0 | 100 | VLKYNGII | 82.11 | VLKYNGVI | 2.44 | | | | |
| NA | N4 | 205 | 0.17 | yes | 2 | 0 | 100 | LKYNGIIT | 97.56 | LKYNGVIT | 2.44 | | | | |
| NA | N4 | 206 | 0.17 | yes | 2 | 0 | 99.19 | KYNGIITD | 97.56 | | | | | | |
| NA | N4 | 207 | 0.28 | yes | 3 | 0 | 99.19 | YNGIITDT | 95.93 | | | | | | |
| NA | N4 | 208 | 0.28 | yes | 3 | 0 | 99.19 | NGIITDTL | 95.93 | NGIITDTF | 1.63 | | | | |
| NA | N4 | 209 | 0.12 | yes | 2 | 0 | 99.19 | GIITDTLK | 98.37 | GIITDTFK | 1.63 | | | | |
| NA | N4 | 210 | 0.19 | yes | 2 | 0 | 99.19 | IITDTLKS | 97.56 | IITDTFKS | 1.63 | | | | |
| NA | N4 | 211 | 0.19 | yes | 2 | 0 | 99.19 | ITDTLKSW | 97.56 | | | | | | |
| NA | N4 | 212 | 0.19 | yes | 3 | 0 | 99.19 | TDTLKSWK | 97.56 | | | | | | |
| NA | N4 | 213 | 0.19 | yes | 2 | 0 | 99.19 | DTLKSWKG | 97.56 | | | | | | |
| NA | N4 | 214 | 0.07 | yes | 2 | 0 | 99.19 | TLKSWKGN | 99.19 | | | | | | |
| NA | N4 | 215 | 0.07 | yes | 2 | 0 | 99.19 | LKSWKGNI | 99.19 | | | | | | |
| NA | N4 | 216 | 0.07 | yes | 2 | 0 | 99.19 | KSWKGNIM | 99.19 | | | | | | |
| NA | N4 | 217 | 0.07 | yes | 1 | 0 | 99.19 | SWKGNIMR | 99.19 | | | | | | |
| NA | N4 | 218 | 0.07 | yes | 1 | 0 | 99.19 | WKGNIMRT | 99.19 | | | | | | |
| NA | N4 | 219 | 0.07 | yes | 1 | 0 | 99.19 | KGNIMRTQ | 99.19 | | | | | | |

FIG. 72-22

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 220 | 0 | yes | 1 | 0 | 100 | GNIMRTQE | 100 | | | | | | |
| NA | N4 | 221 | 0 | yes | 1 | 0 | 100 | NIMRTQES | 100 | | | | | | |
| NA | N4 | 222 | 0 | yes | 1 | 0 | 100 | IMRTQESE | 100 | | | | | | |
| NA | N4 | 223 | 0 | yes | 1 | 0 | 100 | MRTQESEC | 100 | | | | | | |
| NA | N4 | 224 | 0 | yes | 1 | 0 | 100 | RTQESECV | 100 | | | | | | |
| NA | N4 | 225 | 0 | yes | 1 | 0 | 100 | TQESECVC | 100 | | | | | | |
| NA | N4 | 226 | 0.07 | yes | 1 | 0 | 99.19 | QESECVCQ | 99.19 | | | | | | |
| NA | N4 | 227 | 0.07 | yes | 1 | 0 | 99.19 | ESECVCQD | 99.19 | | | | | | |
| NA | N4 | 228 | 0.07 | yes | 1 | 0 | 99.19 | SECVCQDE | 99.19 | | | | | | |
| NA | N4 | 229 | 0.07 | yes | 1 | 0 | 99.19 | ECVCQDEF | 99.19 | | | | | | |
| NA | N4 | 230 | 0.07 | yes | 1 | 0 | 99.19 | CVCQDEFC | 99.19 | | | | | | |
| NA | N4 | 231 | 0.07 | yes | 1 | 0 | 99.19 | VCQDEFCY | 99.19 | | | | | | |
| NA | N4 | 232 | 0.07 | yes | 1 | 0 | 99.19 | CQDEFCYT | 99.19 | | | | | | |
| NA | N4 | 233 | 0.07 | yes | 1 | 0 | 99.19 | QDEFCYTL | 99.19 | | | | | | |
| NA | N4 | 234 | 0.98 | yes | 3 | 0 | 100 | DEFCYTLI | 75.61 | DEFCYTLM | 19.51 | | | | |
| NA | N4 | 235 | 0.98 | yes | 3 | 0 | 100 | EFCYTLIT | 75.61 | EFCYTLMT | 19.51 | | | | |
| NA | N4 | 236 | 0.98 | yes | 3 | 0 | 100 | FCYTLITD | 75.61 | FCYTLMTD | 19.51 | | | | |
| NA | N4 | 237 | 0.98 | yes | 3 | 0 | 100 | CYTLITDG | 75.61 | CYTLMTDG | 19.51 | | | | |
| NA | N4 | 238 | 1.24 | yes | 3 | 0 | 100 | YTLITDG | 75.61 | YTLMTDGP | 19.51 | | | | |
| NA | N4 | 239 | 1.27 | yes | 4 | 0 | 100 | TLITDGP | 75.61 | TLMTDGPS | 19.51 | | | | |
| NA | N4 | 240 | 0.98 | yes | 2 | 0 | 100 | LITDGPS | 70.73 | LMTDGPSD | 19.51 | LVTDGPSD | 4.88 | | |
| NA | N4 | 241 | 0.98 | yes | 2 | 0 | 100 | ITDGPSDA | 70.73 | MTDGPSDA | 19.51 | VTDGPSDA | 4.07 | | |
| NA | N4 | 242 | 0.35 | yes | 2 | 0 | 100 | TDGPSDAQ | 94.31 | TDGPSNAQ | 4.88 | | | | |
| NA | N4 | 243 | 0.35 | yes | 2 | 0 | 100 | DGPSDAQA | 94.31 | DGPSNAQA | 4.88 | | | | |
| NA | N4 | 244 | 0.35 | yes | 2 | 0 | 100 | GPSDAQAF | 94.31 | GPSNAQAF | 4.88 | | | | |
| NA | N4 | 245 | 0.35 | yes | 2 | 0 | 100 | PSDAQAFY | 94.31 | PSNAQAFY | 4.88 | | | | |
| NA | N4 | 246 | 0.42 | yes | 2 | 0 | 100 | SDAQAFYK | 93.5 | SNAQAFYK | 4.88 | | | | |
| NA | N4 | 247 | 0.14 | yes | 1 | 0 | 100 | DAQAFYKI | 98.37 | NAQAFYKI | 4.88 | DGQAFYKI | 0.81 | | |
| NA | N4 | 248 | 0.07 | yes | 1 | 0 | 99.19 | AQAFYKIL | 99.19 | AQAFYKLL | 0.81 | | | | |
| NA | N4 | 249 | 0.07 | yes | 1 | 0 | 99.19 | QAFYKILK | 99.19 | | | | | | |
| NA | N4 | 250 | 0.07 | yes | 1 | 0 | 99.19 | AFYKILKI | 99.19 | | | | | | |
| NA | N4 | 251 | 0.67 | yes | 2 | 0 | 99.19 | FYKILKIR | 84.55 | FYKILKIK | 14.63 | | | | |
| NA | N4 | 252 | 0.67 | yes | 2 | 0 | 99.19 | YKILKIRK | 84.55 | YKILKIKK | 14.63 | | | | |
| NA | N4 | 253 | 0.67 | yes | 2 | 0 | 99.19 | KILKIRKG | 84.55 | KILKIKKG | 14.63 | | | | |
| NA | N4 | 254 | 0.65 | yes | 2 | 0 | 99.19 | ILKIRKGK | 84.55 | ILKIKKGK | 14.63 | | | | |
| NA | N4 | 255 | 1.02 | yes | 3 | 0 | 99.19 | LKIRKGKI | 85.37 | LKIKKGKI | 13.82 | | | | |
| NA | N4 | 256 | 0.89 | yes | 1 | 0 | 99.19 | KIRKGKIV | 78.86 | KIKKGKIV | 13.01 | KIKKGKIM | 6.5 | KIKKGKLV | 0.81 |
| NA | N4 | 267 | 0.68 | yes | 2 | 0 | 99.19 | DVDATGFH | 85.37 | DVNATGFH | 5.69 | DVDAPGFH | 4.88 | DVDAIGFH | 0.81 |
| NA | N4 | 270 | 0.68 | yes | 2 | 0 | 99.19 | ATGFHEEC | 89.43 | APGFHEEC | 5.69 | ATGFHLEE | 2.44 | AIGFHEEC | 2.44 |
| NA | N4 | 271 | 0.38 | yes | 4 | 0 | 99.19 | TGFHEECS | 89.43 | PGFHEEEC | 5.69 | TGFHLEEC | 0.81 | TGFHLEEC | 0.81 |
| NA | N4 | 272 | 0.38 | yes | 5 | 0 | 99.19 | GFHEECSC | 93.5 | GFHEECS | 5.69 | | | | |
| NA | N4 | 273 | | yes | 5 | 0 | 99.19 | FHEECSC | 93.5 | | | | | | |

| Protein | Sub-type | Start Pos | Block Entropy | Gaps <1% | # to cover 99% | % gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | N4 | 322 | 0.84 | yes | 4 | 0 | 99.19 | GDNPRPVD | 83.74 | GDNPRPMD | 11.38 | GDSPRPVD | 3.25 | | | | |
| NA | N4 | 323 | 0.87 | yes | 5 | 0 | 99.19 | DNPRPVDG | 83.74 | DNPRPMDS | 11.38 | DNPRSVDG | 2.44 | | | DSPRPVDG | 0.81 |
| NA | N4 | 324 | 1.14 | yes | 5 | 0 | 99.19 | PRPVDGTG | 78.05 | PRPMDSTG | 11.38 | PRPMDSTG | 6.5 | | | PRSVDGTG | 0.81 |
| NA | N4 | 325 | 1.14 | yes | 5 | 0 | 99.19 | RPVDGTGS | 78.05 | RPVDGIG | 11.38 | RPMDSTGS | 6.5 | | | RSVDGTGS | 0.81 |
| NA | N4 | 326 | 1.14 | yes | 3 | 0 | 99.19 | PVDGTGSC | 78.05 | PVDGIGSC | 11.38 | PMDSTGSC | 6.5 | | | PMDGTGSC | 0.81 |
| NA | N4 | 327 | 0.94 | yes | 2 | 0 | 99.67 | SPVNNGKG | 79.67 | SPINNGKG | 14.63 | | | | | | |
| NA | N4 | 336 | 0.78 | yes | 2 | 0 | 99.67 | PVNNGKGR | 79.67 | PINNGKGR | 19.51 | | | | | | |
| NA | N4 | 337 | 0.78 | yes | 2 | 0 | 99.67 | VNNGKGRY | 79.67 | INNGKGRY | 19.51 | | | | | | |
| NA | N4 | 338 | 0 | yes | 1 | 0 | 100 | NNGKGRYG | 100 | | | | | | | | |
| NA | N4 | 339 | 0 | yes | 1 | 0 | 100 | NGKGRYGV | 100 | | | | | | | | |
| NA | N4 | 340 | 0 | yes | 1 | 0 | 100 | GKGRYGVK | 100 | | | | | | | | |
| NA | N4 | 341 | 0 | yes | 1 | 0 | 100 | KGRYGVKG | 100 | | | | | | | | |
| NA | N4 | 342 | 0 | yes | 1 | 0 | 100 | GRYGVKGF | 100 | | | | | | | | |
| NA | N4 | 343 | 0 | yes | 1 | 0 | 100 | RYGVKGFS | 100 | | | | | | | | |
| NA | N4 | 344 | 0 | yes | 1 | 0 | 100 | YGVKGFSF | 100 | | | | | | | | |
| NA | N4 | 345 | 0 | yes | 1 | 0 | 100 | GVKGFSFR | 100 | | | | | | | | |
| NA | N4 | 346 | 0 | yes | 1 | 0 | 100 | VKGFSFRY | 100 | | | | | | | | |
| NA | N4 | 347 | 0 | yes | 1 | 0 | 100 | KGFSFRYG | 100 | | | | | | | | |
| NA | N4 | 348 | 0 | yes | 1 | 0 | 100 | GFSFRYGD | 100 | | | | | | | | |
| NA | N4 | 349 | 0.07 | yes | 1 | 0 | 99.19 | FSFRYGDG | 99.19 | | | | | | | | |
| NA | N4 | 350 | 0.07 | yes | 1 | 0 | 99.19 | SFRYGDGV | 99.19 | | | | | | | | |
| NA | N4 | 351 | 0.07 | yes | 1 | 0 | 99.19 | FRYGDGVW | 99.19 | | | | | | | | |
| NA | N4 | 352 | 0.07 | yes | 1 | 0 | 99.19 | RYGDGVWI | 99.19 | | | | | | | | |
| NA | N4 | 353 | 0.07 | yes | 1 | 0 | 99.19 | YGDGVWIG | 99.19 | | | | | | | | |
| NA | N4 | 354 | 0.07 | yes | 1 | 0 | 99.19 | GDGVWIGR | 99.19 | | | | | | | | |
| NA | N4 | 355 | 0.07 | yes | 1 | 0 | 99.19 | DGVWIGRT | 99.19 | | | | | | | | |
| NA | N4 | 356 | 0.07 | yes | 1 | 0 | 99.19 | GVWIGRTK | 99.19 | | | | | | | | |
| NA | N4 | 357 | 0.07 | yes | 1 | 0 | 99.19 | VWIGRTKS | 99.19 | | | | | | | | |
| NA | N4 | 358 | 0.07 | yes | 1 | 0 | 99.19 | WIGRTKSL | 99.19 | | | | | | | | |
| NA | N4 | 359 | 0.07 | yes | 1 | 0 | 99.19 | IGRTKSLE | 99.19 | | | | | | | | |
| NA | N4 | 360 | 0.07 | yes | 1 | 0 | 99.19 | GRTKSLES | 99.19 | | | | | | | | |
| NA | N4 | 361 | 0.07 | yes | 1 | 0 | 99.19 | RTKSLESR | 99.19 | | | | | | | | |
| NA | N4 | 362 | 0.07 | yes | 1 | 0 | 99.19 | TKSLESRS | 99.19 | | | | | | | | |
| NA | N4 | 363 | 0.14 | yes | 2 | 0 | 98.37 | KSLESRSG | 98.37 | TKSLESRR | 0.81 | | | | | | |
| NA | N4 | 364 | 0.14 | yes | 2 | 0 | 98.37 | SLESRSGF | 98.37 | KNLESRSG | 0.81 | | | | | | |
| NA | N4 | 365 | 0.14 | yes | 2 | 0 | 98.37 | LESRSGFE | 98.37 | NLESRSGF | 0.81 | | | | | | |
| NA | N4 | 366 | 0.07 | yes | 1 | 0 | 99.19 | ESRSGFEM | 99.19 | | | | | | | | |
| NA | N4 | 367 | 0.44 | yes | 2 | 0 | 91.87 | SRSGFEMV | 91.87 | SRGFEMI | 7.32 | | | | | | |
| NA | N4 | 368 | 0.44 | yes | 2 | 0 | 91.87 | RSGFEMVW | 91.87 | RSGFEMIW | 7.32 | | | | | | |
| NA | N4 | 369 | 0.44 | yes | 2 | 0 | 91.87 | SGFEMVWD | 91.87 | SGFEMIWD | 7.32 | | | | | | |
| NA | N4 | 370 | 0.44 | yes | 2 | 0 | 91.87 | GFEMVWDA | 91.87 | GFEMIWDA | 7.32 | | | | | | |
| NA | N4 | 371 | 0.44 | yes | 2 | 0 | 91.87 | FEMVWDAN | 91.87 | FEMIWDAN | 7.32 | | | | | | |

FIG. 72-25

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 373 | 0.44 | yes | 2 | 0 | 99.19 | EMWDANG | 91.87 | EMIWDANG | 7.32 | | | | |
| NA | N4 | 374 | 0.44 | yes | 2 | 0 | 99.19 | MWDANGW | 91.87 | MIWDANGW | 7.32 | | | | |
| NA | N4 | 375 | 0.44 | yes | 2 | 0 | 99.19 | WDANGWV | 91.87 | IWDANGWV | 7.32 | | | | |
| NA | N4 | 376 | 0.14 | yes | 2 | 0 | 99.19 | DANGWVS | 98.37 | WDANGWVT | 0.81 | | | | |
| NA | N4 | 377 | 0.14 | yes | 2 | 0 | 99.19 | ANGWVST | 98.37 | DANGWVTA | 0.81 | | | | |
| NA | N4 | 378 | 0.14 | yes | 1 | 0 | 99.19 | NGWVSTD | 98.37 | DNGWVSTD | 0.81 | | | | |
| NA | N4 | 379 | 0.07 | yes | 3 | 0 | 99.19 | GWVSTDK | 99.19 | | | | | | |
| NA | N4 | 380 | 0.42 | yes | 3 | 0 | 99.19 | WVSTDKD | 93.5 | GWVSTDKN | 4.88 | GWVTADKD | 0.81 | | |
| NA | N4 | 381 | 0.42 | yes | 3 | 0 | 99.19 | VSTDKDS | 93.5 | WVSTDKNS | 4.88 | WVTADKDS | 0.81 | | |
| NA | N4 | 382 | 0.42 | yes | 3 | 0 | 99.19 | STDKDSN | 93.5 | VSTDKNSN | 4.88 | VSTDKSSN | 0.81 | | |
| NA | N4 | 383 | 0.42 | yes | 3 | 0 | 99.19 | TDKDSNG | 93.5 | STDKNSNG | 4.88 | STDKSSNG | 0.81 | | |
| NA | N4 | 384 | 0.35 | yes | 3 | 0 | 99.19 | DKDSNGV | 93.5 | TDKNSNGV | 4.88 | ADKDSNGV | 0.81 | | |
| NA | N4 | 385 | 0.35 | yes | 2 | 0 | 99.19 | KDSNGVQ | 94.31 | DKNSNGV | 4.88 | | | | |
| NA | N4 | 386 | 0.35 | yes | 2 | 0 | 99.19 | DSNGVQD | 94.31 | KNSNGVQ | 4.88 | | | | |
| NA | N4 | 387 | 0 | yes | 1 | 0 | 99.19 | SNGVQDI | 94.31 | NSNGVQD | 4.88 | | | | |
| NA | N4 | 388 | 0 | yes | 1 | 0 | 100 | NGVQDII | 100 | | | | | | |
| NA | N4 | 389 | 0 | yes | 1 | 0 | 100 | GVQDIID | 100 | | | | | | |
| NA | N4 | 390 | 0.28 | yes | 2 | 0 | 100 | VQDIIDN | 95.12 | VQDIIDNN | 4.88 | | | | |
| NA | N4 | 391 | 0.35 | yes | 2 | 0 | 100 | QDIIDND | 94.31 | QDIIDNNN | 4.88 | | | | |
| NA | N4 | 392 | 0.35 | yes | 2 | 0 | 100 | DIIDNDN | 94.31 | DIIDNNNW | 4.88 | | | | |
| NA | N4 | 393 | 0.35 | yes | 2 | 0 | 100 | IIDNDNW | 94.31 | IDNNNWS | 4.88 | | | | |
| NA | N4 | 394 | 0.35 | yes | 2 | 0 | 100 | IDNDNWS | 94.31 | DNNNWSG | 4.88 | | | | |
| NA | N4 | 395 | 0.35 | yes | 2 | 0 | 100 | DNDNWSG | 94.31 | DNNWSGY | 4.88 | | | | |
| NA | N4 | 396 | 0.35 | yes | 2 | 0 | 100 | NDNWSGY | 94.31 | NNWSGYS | 4.88 | | | | |
| NA | N4 | 397 | 0.07 | yes | 2 | 0 | 100 | DNWSGYS | 94.31 | NWSGYSG | 4.88 | | | | |
| NA | N4 | 398 | 0 | yes | 1 | 0 | 100 | NWSGYSG | 99.19 | | | | | | |
| NA | N4 | 399 | 0 | yes | 1 | 0 | 100 | WSGYSGSF | 100 | | | | | | |
| NA | N4 | 400 | 0 | yes | 1 | 0 | 100 | SGYSGSFS | 100 | | | | | | |
| NA | N4 | 401 | 0 | yes | 1 | 0 | 100 | GYSGSFSI | 100 | | | | | | |
| NA | N4 | 402 | 0 | yes | 1 | 0 | 100 | YSGSFSIR | 100 | | | | | | |
| NA | N4 | 403 | 0.28 | yes | 2 | 0 | 100 | SGSFSIRG | 95.12 | SGSFSIRW | 4.88 | | | | |
| NA | N4 | 404 | 0.28 | yes | 2 | 0 | 100 | GSFSIRGE | 95.12 | GSFSIRWE | 4.88 | | | | |
| NA | N4 | 405 | 0.28 | yes | 2 | 0 | 100 | SFSIRGET | 95.12 | SFSIRWET | 4.88 | | | | |
| NA | N4 | 406 | 0.28 | yes | 2 | 0 | 100 | FSIRGETT | 95.12 | FSIRWETT | 4.88 | | | | |
| NA | N4 | 407 | 0.28 | yes | 2 | 0 | 100 | SIRGETTG | 95.12 | SIRWETTG | 4.88 | | | | |
| NA | N4 | 408 | 0.28 | yes | 2 | 0 | 100 | IRGETTGR | 95.12 | IRWETTGR | 4.88 | | | | |
| NA | N4 | 409 | 0.28 | yes | 2 | 0 | 100 | RGETTGRN | 95.12 | RWETTGRN | 4.88 | | | | |
| NA | N4 | 410 | 0.28 | yes | 2 | 0 | 100 | GETTGRNC | 95.12 | WETTGRNC | 4.88 | | | | |
| NA | N4 | 411 | 0 | yes | 1 | 0 | 100 | ETTGRNCT | 100 | | | | | | |
| NA | N4 | 412 | 0 | yes | 1 | 0 | 100 | TTGRNCTV | 100 | | | | | | |
| NA | N4 | 413 | 0.28 | yes | 2 | 0 | 100 | TGRNCTV | 95.12 | TTGRNCTI | 4.88 | | | | |
| NA | N4 | 414 | 0.28 | yes | 2 | 0 | 100 | TGRNCTVP | 95.12 | TGRNCTIP | 4.88 | | | | |

FIG. 72-26

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 415 | 0.28 | yes | 2 | 0 | 100 | GRNCTVPC | 95.12 | GRNCTIPC | 4.88 | | | | |
| NA | N4 | 416 | 0.35 | yes | 2 | 0 | 99.19 | RNCTVPCF | 94.31 | RNCTIPCF | 4.88 | | | | |
| NA | N4 | 417 | 0.35 | yes | 2 | 0 | 99.19 | NCTVPCFW | 94.31 | NCTIPCFW | 4.88 | | | | |
| NA | N4 | 418 | 0.35 | yes | 2 | 0 | 99.19 | CTVPCFWV | 94.31 | CTIPCFWV | 4.88 | | | | |
| NA | N4 | 419 | 0.35 | yes | 2 | 0 | 99.19 | TVPCFWVE | 94.31 | TIPCFWVE | 4.88 | | | | |
| NA | N4 | 420 | 0.35 | yes | 2 | 0 | 99.19 | VPCFWVEM | 94.31 | IPCFWVEM | 4.88 | | | | |
| NA | N4 | 421 | 0.07 | yes | 1 | 0 | 99.19 | PCFWVEMI | 99.19 | | | | | | |
| NA | N4 | 422 | 0.07 | yes | 1 | 0 | 99.19 | CFWVEMIR | 99.19 | | | | | | |
| NA | N4 | 423 | 0 | yes | 1 | 0 | 99.19 | FWVEMIRG | 99.19 | | | | | | |
| NA | N4 | 424 | 0 | yes | 1 | 0 | 99.19 | WVEMIRGQ | 99.19 | | | | | | |
| NA | N4 | 425 | 0.07 | yes | 1 | 0 | 100 | VEMIRGQP | 100 | | | | | | |
| NA | N4 | 426 | 0.07 | yes | 1 | 0 | 100 | EMIRGQPK | 100 | | | | | | |
| NA | N4 | 427 | 0.14 | yes | 2 | 0 | 99.19 | MIRGQPKE | 99.19 | IRGQPKER | 0.81 | | | | |
| NA | N4 | 428 | 0.45 | yes | 3 | 0 | 99.19 | IRGQPKEK | 92.68 | RGQPKERT | 5.69 | RGQPKERT | 5.69 | | | |
| NA | N4 | 429 | 0.45 | yes | 3 | 0 | 92.68 | RGQPKEKT | 92.68 | GQPKEKA | 5.69 | GQPNERTI | 5.69 | | | |
| NA | N4 | 430 | 0.45 | yes | 3 | 0 | 92.68 | GQPKEKTI | 92.68 | QPKEKAIW | 5.69 | QPNERTIW | 5.69 | | | |
| NA | N4 | 431 | 0.45 | yes | 3 | 0 | 92.68 | QPKEKTIW | 92.68 | PKEKAIWT | 5.69 | PNERTIWT | 5.69 | | | |
| NA | N4 | 432 | 0.45 | yes | 3 | 0 | 92.68 | PKEKTIWT | 92.68 | KEKAIWTS | 5.69 | NERTIWTS | 5.69 | | | |
| NA | N4 | 433 | 0.43 | yes | 3 | 0 | 92.68 | KEKTIWTS | 92.68 | EKAIWTSG | 5.69 | ERTIWTSG | 5.69 | | | |
| NA | N4 | 434 | 0.43 | yes | 3 | 0 | 92.68 | EKTIWTSG | 92.68 | KAIWTSGS | 5.69 | RTIWTSGS | 5.69 | | | |
| NA | N4 | 435 | 0.32 | yes | 2 | 0 | 94.31 | KTIWTSGS | 94.31 | AIWTSGSS | 5.69 | | | | |
| NA | N4 | 436 | 0 | yes | 1 | 0 | 100 | TIWTSGSS | 100 | | | | | | |
| NA | N4 | 437 | 0 | yes | 1 | 0 | 100 | IWTSGSSI | 100 | | | | | | |
| NA | N4 | 438 | 0 | yes | 1 | 0 | 100 | WTSGSSIA | 100 | | | | | | |
| NA | N4 | 439 | 0 | yes | 1 | 0 | 100 | TSGSSIAF | 100 | | | | | | |
| NA | N4 | 440 | 0 | yes | 1 | 0 | 100 | SGSSIAFC | 100 | | | | | | |
| NA | N4 | 441 | 0 | yes | 1 | 0 | 100 | GSSIAFCG | 100 | | | | | | |
| NA | N4 | 442 | 0.51 | yes | 2 | 0 | 100 | SSIAFCGV | 100 | SIAFCGVD | 11.38 | | | | |
| NA | N4 | 443 | 0.58 | yes | 3 | 0.81 | 88.62 | SIAFCGVN | 88.62 | IAFCGVDS | 11.38 | AFCGVNFD | 0.81 | | | |
| NA | N4 | 444 | 0.64 | yes | 5 | 0.81 | 87.8 | IAFCGVNS | 87.8 | AFCGVDSD | 11.38 | FCGVNSNT | 0.81 | | | |
| NA | N4 | 445 | 0.64 | yes | 5 | 0.81 | 86.99 | AFCGVNSD | 86.99 | FCGVDSDT | 11.38 | | | | |
| NA | N4 | 446 | 0.58 | yes | 4 | 0.81 | 86.99 | FCGVNSDT | 86.99 | CGVDSDTT | 11.48 | | | | |
| NA | N4 | 447 | 0.58 | yes | 4 | 0.81 | 87.7 | CGVNSDTT | 87.7 | GVDSDTTG | 6.56 | GVDSDTTS | 6.56 | GVNSDTTS | 4.92 | GVNSNTTG | 0.82 |
| NA | N4 | 448 | 0.92 | yes | 5 | 0.81 | 84.43 | GVNSDTTG | 84.43 | VDSDTTGW | 6.56 | VDSDTTSW | 6.56 | VNSDTTSW | 4.92 | VNSDTTCW | 0.82 |
| NA | N4 | 449 | 0.92 | yes | 4 | 0.81 | 84.43 | VNSDTTGW | 84.43 | SDTTGWPW | 7.38 | SDTTSWSW | 6.56 | SNTTGWSW | 0.82 | |
| NA | N4 | 450 | 0.58 | yes | 3 | 0.81 | 90.16 | SDTTGWSW | 90.16 | DTTGWPWP | 7.38 | DTTCWSWP | 0.82 | | | |
| NA | N4 | 451 | 0.58 | yes | 3 | 0.81 | 90.98 | DTTGWSWP | 90.98 | TTGWPWPD | 7.38 | | | | |
| NA | N4 | 452 | 0.52 | yes | 3 | 0.81 | 90.98 | TTGWSWPD | 90.98 | TGWPWPDG | 7.38 | | | | |
| NA | N4 | 453 | 0.52 | yes | 3 | 0.81 | 90.98 | TGWSWPDG | 90.98 | GWPWPDGA | 7.38 | | | | |
| NA | N4 | 454 | 0.52 | yes | 3 | 0.81 | 99.18 | GWSWPDGA | 99.18 | | | | | | |
| NA | N4 | 455 | 0.07 | yes | 1 | 0.81 | 99.18 | WSWPDGAL | 99.18 | | | | | | |
| NA | N4 | 456 | 0.14 | yes | 2 | 0.81 | 98.36 | SWPDGALL | 98.36 | SWPDGALF | 0.82 | | | | |

FIG. 72-27

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | N4 | 458 | 0.07 | yes | 1 | 1.63 | 99.17 | WPD

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|
| NA | N5 | 137 | 0.06 | yes | 1 | 0 | 99.34 | LNDKHSNN | 99.34 | | | | | | | |
| NA | N5 | 138 | 0.06 | yes | 1 | 0 | 99.34 | NDKHSNNT | 99.34 | | | | | | | |
| NA | N5 | 139 | 0.06 | yes | 1 | 0 | 99.34 | DKHSNNTV | 99.34 | | | | | | | |
| NA | N5 | 140 | 0.11 | yes | 2 | 0 | 99.34 | KHSNNTVK | 98.68 | RHSNNTVK | 0.66 | | | | | | |
| NA | N5 | 141 | 0.06 | yes | 1 | 0 | 99.34 | HSNNTVKD | 99.34 | | | | | | | |
| NA | N5 | 142 | 0.06 | yes | 1 | 0 | 99.34 | SNNTVKDR | 99.34 | | | | | | | |
| NA | N5 | 143 | 0.06 | yes | 1 | 0 | 99.34 | NNTVKDRS | 99.34 | | | | | | | |
| NA | N5 | 144 | 0.06 | yes | 1 | 0 | 99.34 | NTVKDRSP | 99.34 | | | | | | | |
| NA | N5 | 145 | 0.06 | yes | 1 | 0 | 99.34 | TVKDRSPY | 99.34 | | | | | | | |
| NA | N5 | 146 | 0.06 | yes | 1 | 0 | 99.34 | VKDRSPYR | 99.34 | | | | | | | |
| NA | N5 | 147 | 0.06 | yes | 1 | 0 | 99.34 | KDRSPYRA | 99.34 | | | | | | | |
| NA | N5 | 148 | 0 | yes | 1 | 0 | 100 | DRSPYRAL | 100 | | | | | | | |
| NA | N5 | 149 | 0 | yes | 1 | 0 | 100 | RSPYRALM | 100 | | | | | | | |
| NA | N5 | 150 | 0 | yes | 1 | 0 | 100 | SPYRALMS | 100 | | | | | | | |
| NA | N5 | 151 | 0.06 | yes | 1 | 0 | 99.34 | PYRALMSV | 99.34 | | | | | | | |
| NA | N5 | 152 | 0.11 | yes | 2 | 0 | 99.34 | YRALMSVP | 99.34 | RALMSVPM | 0.66 | | | | | | |
| NA | N5 | 153 | 0.11 | yes | 2 | 0 | 98.68 | RALMSVPL | 98.68 | ALMSVPMG | 0.66 | | | | | | |
| NA | N5 | 154 | 0.11 | yes | 2 | 0 | 98.68 | ALMSVPLG | 98.68 | LMSVLLGS | 0.66 | | | | | | |
| NA | N5 | 155 | 0.17 | yes | 2 | 0 | 98.68 | LMSVPLGS | 98.68 | MSVPMGSS | 0.66 | | | | | | |
| NA | N5 | 156 | 0.11 | yes | 2 | 0 | 98.03 | MSVPLGSS | 98.03 | SVPMGSSP | 0.66 | | | | | | |
| NA | N5 | 157 | 0.11 | yes | 2 | 0 | 98.03 | SVPLGSSP | 98.03 | VPLGSSSN | 0.66 | | | | | | |
| NA | N5 | 158 | 0.11 | yes | 2 | 0 | 98.03 | VPLGSSPN | 98.03 | PMGSSPNA | 0.66 | | | | | | |
| NA | N5 | 159 | 0.06 | yes | 1 | 0 | 98.68 | PLGSSPNA | 98.68 | | | | | | | |
| NA | N5 | 160 | 0.06 | yes | 1 | 0 | 99.34 | LGSSPNAY | 99.34 | | | | | | | |
| NA | N5 | 161 | 0.06 | yes | 1 | 0 | 99.34 | GSSPNAYQ | 99.34 | | | | | | | |
| NA | N5 | 162 | 0.22 | yes | 2 | 0 | 99.34 | SSPNAYQA | 99.34 | | | SSNAYQAK | 1.32 | | | | | |
| NA | N5 | 163 | 0.22 | yes | 2 | 0 | 97.37 | SPNAYQAR | 97.37 | | | PNAYQAQF | 1.32 | | | | | |
| NA | N5 | 164 | 0.22 | yes | 2 | 0 | 97.37 | PNAYQAKF | 97.37 | | | | | | | | |
| NA | N5 | 165 | 0.16 | yes | 2 | 0 | 98.03 | NAYQAKFE | 98.03 | | | | | | | | |
| NA | N5 | 166 | 0.16 | yes | 2 | 0 | 98.03 | AYQAKFES | 98.03 | | | | | | | | |
| NA | N5 | 167 | 0.22 | yes | 2 | 0 | 97.37 | YQAKFESV | 97.37 | | | YQAKFESI | 1.32 | | | | | |
| NA | N5 | 171 | 0.94 | yes | 3 | 0 | 99.34 | FESVAWSA | 99.34 | | | FESVEWSA | 26.32 | | | | | |
| NA | N5 | 172 | 0.94 | yes | 3 | 0 | 72.37 | ESVAWSAT | 72.37 | | | ESVEWSAT | 26.32 | | | | | |
| NA | N5 | 173 | 0.94 | yes | 3 | 0 | 72.37 | SVAWSATA | 72.37 | | | SVEWSATA | 26.32 | | | | | |
| NA | N5 | 174 | 0.89 | yes | 3 | 0 | 73.03 | VAWSATAC | 73.03 | | | VEWSATAC | 26.32 | | | | | |
| NA | N5 | 175 | 0 | yes | 1 | 0 | 100 | AWSATACH | 100 | | | | | | | | |
| NA | N5 | 176 | 0 | yes | 1 | 0 | 100 | WSATACHD | 100 | | | | | | | | |
| NA | N5 | 177 | 0.06 | yes | 1 | 0 | 99.34 | SATACHDG | 99.34 | | | | | | | | |
| NA | N5 | 178 | 0.06 | yes | 1 | 0 | 99.34 | ATACHDGK | 99.34 | | | TACHDGKG | 30.92 | TACHDGKK | | | |
| NA | N5 | 179 | 1.19 | yes | 3 | 0 | 63.82 | TACHDGKE | 63.82 | | | ACHDGKGW | 30.92 | ACHDGKKW | | | |
| NA | N5 | 180 | 1.19 | yes | 3 | 0 | 63.82 | ACHDGKEW | 63.82 | | | CHDGKEWM | 26.97 | CHDGKKWL | 4.61 | CHDGKGWL | 4.61 | CHDGKKWM | 3.95 |
| NA | N5 | 181 | 1.96 | yes | 5 | 0 | 40.79 | CHDGKEWL | 40.79 | | | | 23.03 | | | | | |

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N5 | 311 | 0.06 | yes | 1 | 0 | 99.34 | VGYLCAGI | 99.34 | IPTDTPRI | 1.97 | | | | |
| NA | N5 | 312 | 0 | yes | 1 | 0 | 100 | GYLCAGIP | 100 | PTDTPRIQ | 1.97 | | | | |
| NA | N5 | 313 | 0 | yes | 1 | 0 | 100 | YLCAGIPT | 100 | TDTPRIQD | 1.97 | | | | |
| NA | N5 | 314 | 0 | yes | 1 | 0 | 100 | LCAGIPTD | 100 | DTPRIQDS | 15.13 | | | | |
| NA | N5 | 315 | 0 | yes | 1 | 0 | 100 | CAGIPTDT | 100 | DAVGGSGT | 5.92 | | | | |
| NA | N5 | 316 | 0 | yes | 1 | 0 | 100 | AGIPTDTP | 100 | AVGGSGTD | 5.26 | | | | |
| NA | N5 | 317 | 0 | yes | 1 | 0 | 100 | GIPTDTPR | 100 | VGGSGTDN | 5.26 | | | | |
| NA | N5 | 318 | 0.2 | yes | 2 | 0 | 99.34 | IPTDTPRV | 99.34 | AIGGSGTN | 3.29 | | | | |
| NA | N5 | 319 | 0.2 | yes | 2 | 0 | 99.34 | PTDTPRVQ | 99.34 | IGGSGTDN | 3.29 | | | | |
| NA | N5 | 320 | 0.2 | yes | 2 | 0 | 99.34 | TDTPRVQD | 99.34 | GGSGTDNY | 3.29 | | | | |
| NA | N5 | 321 | 0.96 | yes | 5 | 0 | 99.34 | DTPRVQDS | 99.34 | GSGTDNYG | 3.29 | DTPRIQDS | 1.32 | DTPRVQDD | 1.32 | DTPRFQDS | 0.66 |
| NA | N5 | 336 | 0.59 | yes | 4 | 0 | 99.34 | NAVGGSGT | 99.34 | SGTDNYGV | 3.29 | DAVGGSGT | 0.66 | NAVGRSGT | 0.66 | SAVGGSGT | 0.66 |
| NA | N5 | 337 | 0.58 | yes | 4 | 0 | 99.34 | AVGGSGTN | 99.34 | GTDNYGVK | 3.29 | AVGGSGTD | 0.66 | AIGGSGTD | 0.66 | | |
| NA | N5 | 338 | 0.58 | yes | 4 | 0 | 99.34 | VGGSGTNN | 99.34 | TDNYGVKG | 3.29 | VGGSGTDN | 0.66 | VGRSGTNN | 0.66 | | |
| NA | N5 | 339 | 0.27 | yes | 2 | 0 | 99.34 | GGSGTNNY | 99.34 | DNYGVKGF | 3.29 | | | | | | |
| NA | N5 | 340 | 0.27 | yes | 2 | 0 | 99.34 | GSGTNNYG | 99.34 | | | | | | | | |
| NA | N5 | 341 | 0.21 | yes | 2 | 0 | 100 | SGTNNYGV | 100 | | | | | | | | |
| NA | N5 | 342 | 0.21 | yes | 2 | 0 | 99.34 | GTNNYGVK | 99.34 | | | | | | | | |
| NA | N5 | 343 | 0.21 | yes | 2 | 0 | 99.34 | TNNYGVKG | 99.34 | | | | | | | | |
| NA | N5 | 344 | 0.06 | yes | 1 | 0 | 99.34 | NNYGVKGF | 99.34 | | | | | | | | |
| NA | N5 | 345 | 0.06 | yes | 1 | 0 | 100 | NYGVKGFG | 100 | | | | | | | | |
| NA | N5 | 346 | 0.06 | yes | 1 | 0 | 99.34 | YGVKGFGF | 99.34 | | | | | | | | |
| NA | N5 | 347 | 0.06 | yes | 1 | 0 | 99.34 | GVKGFGFR | 99.34 | | | | | | | | |
| NA | N5 | 348 | 0.06 | yes | 1 | 0 | 99.34 | VKGFGFRQ | 99.34 | | | | | | | | |
| NA | N5 | 349 | 0.06 | yes | 1 | 0 | 99.34 | KGFGFRQG | 99.34 | | | | | | | | |
| NA | N5 | 350 | 0.48 | yes | 3 | 0 | 99.34 | GFGFRQGN | 90.79 | GFGFRQGT | 8.55 | | | | | | |
| NA | N5 | 351 | 0.53 | yes | 3 | 0 | 99.34 | FGFRQGNS | 90.13 | FGFRQGTS | 8.55 | FAFKQGNS | 0.66 | | | | |
| NA | N5 | 352 | 0.53 | yes | 3 | 0 | 99.34 | GFRQGNSV | 90.13 | GFRQGTSV | 8.55 | AFKQGNSV | 0.66 | | | | |
| NA | N5 | 353 | 0.53 | yes | 3 | 0 | 99.34 | FRQGNSVW | 90.13 | FRQGTSVW | 8.55 | FKQGNSVW | 0.66 | | | | |
| NA | N5 | 354 | 0.48 | yes | 3 | 0 | 99.34 | RQGNSVWA | 90.79 | ROGTSVWA | 8.55 | RQGNNWWA | 0.66 | | | | |
| NA | N5 | 355 | 0.48 | yes | 3 | 0 | 99.34 | QGNSVWAG | 90.79 | QGTSVWAG | 8.55 | | | | | | |
| NA | N5 | 356 | 0.48 | yes | 3 | 0 | 99.34 | GNSVWAGR | 90.79 | GTSVWAGR | 8.55 | | | | | | |
| NA | N5 | 357 | 1.21 | yes | 5 | 0 | 99.34 | NSVWAGRT | 65.79 | TSVWAGRT | 26.97 | SYWAGRTM | 6.58 | SISSRNGF | 6.58 | NISSRSGF | 0.66 |
| NA | N5 | 358 | 1.21 | yes | 5 | 0 | 99.34 | SVWAGRTV | 65.79 | SVWAGRTI | 26.97 | VWAGRTMS | 6.58 | TASRSGFE | 3.97 | | |
| NA | N5 | 359 | 0.95 | yes | 3 | 0.66 | 99.34 | VWAGRTVS | 81.46 | VWAGRTIS | 12.58 | SYSSRSGF | 3.97 | | | | |
| NA | N5 | 366 | 0.89 | yes | 2 | 0.66 | 99.34 | SISSRSGF | 82.12 | STSSRSGF | 12.58 | VSSRSGFE | 0.66 | | | | |
| NA | N5 | 367 | 0.94 | yes | 3 | 0.66 | 99.34 | ISSRSGFE | 72.19 | TSSRSGFE | 26.49 | | | | | | |
| NA | N5 | 368 | 0.9 | yes | 2 | 0 | 99.34 | SSRSGFEI | 71.71 | SRSGFEVL | 27.63 | | | | | | |
| NA | N5 | 369 | 0.95 | yes | 3 | 0 | 99.34 | SRSGFEIL | 71.71 | RSGFEVLL | 26.97 | RSGFEVLF | 0.66 | | | | |
| NA | N5 | 370 | 0.95 | yes | 3 | 0 | 99.34 | RSGFEILL | 71.71 | SGFEVLLI | 26.97 | SGFEVLHI | 0.66 | | | | |
| NA | N5 | 371 | 0.9 | yes | 2 | 0 | 99.34 | SGFEILLI | 72.37 | GFEVLLIE | 26.97 | | | | | | |
| NA | N5 | 372 | | yes | 2 | 0 | 99.34 | GFEILLIE | | | | | | | | |

FIG. 72-33

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | NS | 373 | 1.03 | yes | 4 | 0 | 99.34 | FEILLIED | 71.05 | FEILLIEE | 26.32 | FEVLFIED | 1.32 | | |
| NA | NS | 374 | 1.03 | yes | 4 | 0 | 99.34 | EILLIEDG | 71.05 | EILLIEEG | 26.32 | EVLLIENG | 1.32 | | |
| NA | NS | 375 | 1.03 | yes | 4 | 0 | 99.34 | ILLIEDGW | 71.05 | ILLIEEGW | 26.32 | VLFIEDGW | 1.32 | | |
| NA | NS | 394 | 0.29 | yes | 5 | 0 | 99.34 | EVLNNKNW | 96.71 | EVLNNMNW | 0.66 | EVLNNKHW | 0.66 | EVLNNRNW | 0.66 |
| NA | NS | 395 | 0.29 | yes | 5 | 0 | 99.34 | VLNNKNWS | 96.71 | ILNNKNWS | 0.66 | VLDNKNWS | 0.66 | VLNMMNWS | 0.66 |
| NA | NS | 396 | 0.23 | yes | 4 | 0 | 99.34 | LNNKNWSG | 97.37 | LNNKNWS | 0.66 | LNNRNWSG | 0.66 | | |
| NA | NS | 397 | 0.23 | yes | 3 | 0 | 99.34 | NNKNWSGY | 98.03 | DNKNWSGY | 0.66 | NNRNWSGY | 0.66 | | |
| NA | NS | 398 | 0.17 | yes | 2 | 0 | 99.34 | NKNWSGYS | 98.03 | NKHWSGYS | 0.66 | NRNWSGYS | 0.66 | | |
| NA | NS | 399 | 0.17 | yes | 2 | 0 | 99.34 | KNWSGYSG | 98.03 | KHWSGYSG | 0.66 | RNWSGYSG | 0.66 | | |
| NA | NS | 400 | 0.82 | yes | 3 | 0 | 99.34 | NWSGYSGA | 76.97 | MNWSGYSG | 22.37 | NWSGYSGY | 0.66 | | |
| NA | NS | 401 | 0.78 | yes | 2 | 0 | 100 | WSGYSGAF | 76.97 | WSGYSGSF | 23.03 | | | | |
| NA | NS | 402 | 0.78 | yes | 2 | 0 | 100 | SGYSGAFT | 76.97 | SGYSGSFT | 23.03 | | | | |
| NA | NS | 403 | 1.06 | yes | 3 | 0 | 100 | GYSGAFTI | 71.71 | GYSGSFTI | 23.03 | GYSGAFTV | 5.26 | SGAFTVPI | 5.26 | SGAFTIPV | 1.97 |
| NA | NS | 404 | 1.06 | yes | 3 | 0 | 99.34 | YSGAFTIP | 71.71 | YSGSFTIP | 23.03 | YSGAFTVP | 5.26 | FTVPITMT | 5.26 | FTIPVTMT | 1.97 |
| NA | NS | 405 | 1.89 | yes | 5 | 0 | 99.34 | SGAFTIPT | 44.08 | SGSFTIPT | 25.66 | SGSFTIP | 23.03 | | | | |
| NA | NS | 408 | 1.89 | yes | 5 | 0 | 99.34 | FTIPTMT | 44.08 | FTIPTTMT | 26.32 | FTIPTIMT | 3.29 | | | | |
| NA | NS | 419 | 0.27 | yes | 2 | 0 | 99.34 | CLYPCFWL | 96.05 | CIVPCFWL | 3.29 | | | | |
| NA | NS | 420 | 0.27 | yes | 2 | 0 | 99.34 | LYPCFWLE | 96.05 | IVPCFWLE | 3.29 | | | | |
| NA | NS | 421 | 0.06 | yes | 1 | 0 | 99.34 | VPCFWLEM | 99.34 | | | | | | |
| NA | NS | 422 | 0 | yes | 1 | 0 | 100 | PCFWLEMI | 100 | | | | | | |
| NA | NS | 423 | 0 | yes | 1 | 0 | 100 | CFWLEMIR | 100 | | | | | | |
| NA | NS | 424 | 0.14 | yes | 2 | 0 | 100 | FWLEMIRG | 98.03 | WLEMIRGR | 1.97 | | | | |
| NA | NS | 425 | 0.14 | yes | 2 | 0 | 100 | WLEMIRGK | 98.03 | LEMIRGRP | 1.97 | | | | |
| NA | NS | 426 | 0.24 | yes | 3 | 0 | 99.34 | LEMIRGKP | 96.71 | EMIRGRPE | 1.97 | | | | |
| NA | NS | 427 | 0.24 | yes | 3 | 0 | 99.34 | EMIRGKPE | 96.71 | MIRGRPEE | 1.97 | | | | |
| NA | NS | 428 | 0.44 | yes | 4 | 0 | 99.34 | MIRGKPEE | 94.08 | IRGKPEEG | 1.97 | IRGKPKER | 1.32 | | |
| NA | NS | 429 | 0.41 | yes | 5 | 0 | 94.74 | IRGKPEER | 94.08 | PEEGTSIW | 1.97 | PEERNSIW | 1.32 | | |
| NA | NS | 433 | 0.41 | yes | 5 | 0 | 94.74 | PEERTSIW | 94.74 | EEGTSIWT | 1.97 | EEKTSIWT | 1.32 | PEEKTSIW | 0.66 |
| NA | NS | 434 | 0.31 | yes | 4 | 0 | 96.05 | EERTSIWT | 96.05 | EGTSIWTS | 1.97 | ERPSIWTS | 1.32 | EERNSIWT | 0.66 |
| NA | NS | 435 | 0.31 | yes | 4 | 0 | 96.05 | ERTSIWTS | 96.05 | GTSIWTSS | 1.97 | KTSIWTSS | 0.66 | | |
| NA | NS | 436 | 0.11 | yes | 2 | 0 | 98.68 | RTSIWTSS | 98.68 | NSIWTSSS | 1.97 | | | | |
| NA | NS | 437 | 0 | yes | 1 | 0 | 100 | TSIWTSSS | 100 | | | | | | |
| NA | NS | 438 | 0.06 | yes | 1 | 0 | 99.34 | SIWTSSST | 99.34 | | | | | | |
| NA | NS | 439 | 0.06 | yes | 1 | 0 | 99.34 | IWTSSSTV | 99.34 | | | | | | |
| NA | NS | 440 | 0.06 | yes | 1 | 0 | 99.34 | WTSSSTV | 99.34 | | | | | | |
| NA | NS | 441 | 0.06 | yes | 1 | 0 | 99.34 | TSSSSTVF | 99.34 | | | | | | |
| NA | NS | 442 | 0.06 | yes | 1 | 0 | 99.34 | SSSSTVFC | 99.34 | | | | | | |
| NA | NS | 443 | 0.06 | yes | 1 | 0 | 99.34 | SSSTVFCG | 99.34 | | | | | | |
| NA | NS | 444 | 0.06 | yes | 1 | 0 | 99.34 | SSTVFCGV | 99.34 | | | | | | |
| NA | NS | 445 | 0.06 | yes | 1 | 0 | 99.34 | STVFCGVS | 99.34 | | | | | | |
| NA | NS | 446 | 0.11 | yes | 2 | 0 | 98.68 | TVFCGVSS | 98.68 | TVFCGVSG | 0.66 | | | | |
| NA | NS | 447 | 0.1 | yes | 2 | 0 | 100 | VFCGVSSE | 98.68 | VFCGVSGE | 1.32 | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 90 | 0.31 | yes | 4 | 0.14 | 99.43 | KPLCEVNS | 96.28 | KPLCAVNS | 1.43 | KSLCEVNS | 1.15 | | |
| NA | N6 | 91 | 0.3 | yes | 4 | 0.14 | 99.57 | PLCEVNSW | 96.42 | PLCAVNSW | 1.43 | SLCEVNSW | 1.15 | | |
| NA | N6 | 92 | 0.26 | yes | 3 | 0 | 99.43 | LCEVSSWH | 96.85 | LCAVNSWH | 1.43 | | 1.14 | | |
| NA | N6 | 93 | 0.28 | yes | 4 | 0 | 99.28 | CEVSSWHI | 96.71 | CAVNSWHI | 1.43 | | 1.14 | | |
| NA | N6 | 94 | 0.26 | yes | 3 | 0 | 99.28 | EVSSWHIL | 95.99 | AVNSWHIL | 1.43 | | 1.14 | | |
| NA | N6 | 95 | 0.25 | yes | 3 | 0 | 99.14 | VSSWHILS | 97 | VNSWHIIS | 1.43 | EVNSWHIF | 0.72 | | |
| NA | N6 | 96 | 0.12 | yes | 2 | 0 | 99.28 | SSWHILSK | 97.14 | NSWHIFSK | 1.43 | | | | |
| NA | N6 | 97 | 0.12 | yes | 2 | 0 | 99.28 | SWHILSKD | 98.71 | | 0.72 | | | | |
| NA | N6 | 98 | 0.14 | yes | 2 | 0 | 99.43 | WHILSKDN | 98.71 | | 0.72 | | | | |
| NA | N6 | 99 | 0.15 | yes | 2 | 0 | 99.28 | HILSKDNA | 98.57 | | 0.72 | | | | |
| NA | N6 | 100 | 0.14 | yes | 2 | 0 | 99.14 | ILSKDNAI | 98.43 | | 0.72 | | | | |
| NA | N6 | 101 | 0.08 | yes | 1 | 0 | 99.28 | LSKDNAIR | 98.57 | | 0.72 | | | | |
| NA | N6 | 102 | 0.06 | yes | 1 | 0 | 99.43 | SKDNAIRI | 99.28 | | | | | | |
| NA | N6 | 103 | 0.08 | yes | 1 | 0 | 99.28 | KDNAIRIG | 99.43 | | | | | | |
| NA | N6 | 104 | 0.8 | yes | 4 | 0 | 99.14 | DNAIRIGE | 99.28 | | | | | | |
| NA | N6 | 105 | 0.81 | yes | 5 | 0 | 99.28 | NAIRIGEN | 85.26 | NAIRIGEE | 10.3 | NAIRIGEG | 3.29 | AIRIGEGA | 0.29 |
| NA | N6 | 106 | 0.82 | yes | 5 | 0 | 99.28 | AIRIGENA | 85.12 | AIRIGEEA | 10.3 | AVRIGEDA | 3.29 | IRIGEGAH | 0.29 |
| NA | N6 | 107 | 0.97 | yes | 5 | 0 | 99.14 | IRIGENAH | 84.98 | IRIGEEAH | 10.44 | VRIGEDAH | 3.29 | RIGEGAHI | 0.29 |
| NA | N6 | 108 | 0.97 | yes | 5 | 0 | 99.28 | RIGENAHI | 82.4 | RIGEDAHI | 10.44 | RIGEDAHV | 3.29 | IGEGAHIL | 2.86 |
| NA | N6 | 109 | 0.98 | yes | 5 | 0 | 99.28 | IGENAHIL | 82.4 | IGEEAHIL | 10.44 | IGEDAHVL | 3.29 | GAHILVTR | 2.86 |
| NA | N6 | 112 | 0.26 | yes | 3 | 0 | 99.14 | NAHILVTR | 82.4 | EAHILVTR | 10.3 | DAHVLVTR | 3.29 | | |
| NA | N6 | 113 | 0.24 | yes | 2 | 0 | 99.28 | AHVLVTRE | 96.42 | | 2.86 | | | | |
| NA | N6 | 114 | 0.05 | yes | 2 | 0 | 99.14 | HILVTREP | 96.42 | | 3 | | | | |
| NA | N6 | 115 | 0.02 | yes | 1 | 0 | 99.57 | ILVTREPY | 96.57 | | 3 | | | | |
| NA | N6 | 116 | 0.05 | yes | 1 | 0 | 99.57 | LVTREPYL | 99.57 | | | | | | |
| NA | N6 | 117 | 0.02 | yes | 1 | 0 | 99.57 | VTREPYLS | 99.57 | | | | | | |
| NA | N6 | 118 | 0.89 | yes | 4 | 0 | 99.86 | TREPYLSC | 99.86 | | | | | | |
| NA | N6 | 119 | 0.9 | yes | 5 | 0 | 99.43 | REPYLSCD | 73.68 | REPYLSCG | 25.75 | | | | |
| NA | N6 | 120 | 0.94 | yes | 5 | 0 | 99.14 | EPYLSCDP | 73.53 | EPYLSCGP | 25.61 | | | | |
| NA | N6 | 129 | 0.09 | yes | 2 | 0 | 99.14 | GCRMFALS | 72.68 | SCRMFALS | 26.18 | | 0.29 | | |
| NA | N6 | 130 | 0.09 | yes | 2 | 0 | 99.43 | ECRMFALS | 99.14 | | | | | | |
| NA | N6 | 131 | 0.06 | yes | 1 | 0 | 99.14 | CRMFALSQ | 99.14 | | | | | | |
| NA | N6 | 132 | 0.03 | yes | 1 | 0 | 99.71 | RMFALSQG | 99.43 | | | | | | |
| NA | N6 | 133 | 0.02 | yes | 1 | 0 | 99.14 | MFALSQGT | 99.71 | | | | | | |
| NA | N6 | 134 | 0.08 | yes | 1 | 0 | 99.57 | FALSQGTT | 99.86 | | | | | | |
| NA | N6 | 135 | 0.11 | yes | 2 | 0 | 99.57 | ALSQGTTL | 98.86 | SQGTTLKG | 0.72 | | | | |
| NA | N6 | 136 | 0.37 | yes | 2 | 0 | 99.57 | LSQGTTLR | 94.42 | QGTTLKGR | 4.43 | QGTTLKGQ | 0.72 | | |
| NA | N6 | 137 | 0.37 | yes | 3 | 0 | 99.57 | SQGTTLRG | 94.42 | GTTLKGRH | 4.43 | GTTLRGQH | 0.72 | | |
| NA | N6 | 138 | 0.38 | yes | 3 | 0 | 99.43 | QGTTLRGR | 94.28 | TTLKGRHA | 4.43 | TTLRGQHA | 0.72 | | |
| NA | N6 | 139 | 0.38 | yes | 3 | 0 | 99.43 | GTTLRGRH | 94.28 | TLKGRHAN | 4.43 | TLRGQHAN | 0.72 | | |
| NA | N6 | 140 | 0.38 | yes | 3 | 0 | 99.43 | TTLRGRHA | 94.28 | LKGRHANG | 4.43 | LRGQHANG | 0.72 | | |
| NA | N6 | 141 | 0.38 | yes | 3 | 0 | 99.43 | TLRGRHAN | 94.28 | | | | | | |
| NA | N6 | | | | | | | LRGRHANG | | | | | | | |

FIG. 72-36

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 142 | 0.38 | yes | 3 | 0 | 99.43 | RGRHANGT | 94.28 | RGQHANGT | 4.43 | KGRHANGT | | | |
| NA | N6 | 143 | 0.4 | yes | 3 | 0 | 99.43 | GRHANGTI | 93.99 | GQHANGTI | 4.43 | GRHANGTM | | | |
| NA | N6 | 144 | 0.44 | yes | 4 | 0 | 99.71 | RHANGTIH | 93.42 | QHANGTIH | 4.43 | RHANGTMH | | RHANGTIN | 0.86 |
| NA | N6 | 145 | 0.18 | yes | 3 | 0 | 99.71 | HANGTIHD | 97.85 | HANGTMHD | | HANGTIND | 0.86 | | |
| NA | N6 | 146 | 0.18 | yes | 3 | 0 | 99.71 | ANGTIHDR | 97.85 | ANGTMHDR | | ANGTIHDR | 0.86 | | |
| NA | N6 | 147 | 0.17 | yes | 3 | 0 | 99.86 | NGTIHDRS | 98 | NGTMHDRS | | NGTINDRS | 0.86 | | |
| NA | N6 | 148 | 0.37 | yes | 4 | 0 | 99.86 | GTIHDRSP | 94.85 | GTMHDRSP | 3.15 | GTIHDRSQ | | GTINDRSP | 0.86 |
| NA | N6 | 149 | 0.46 | yes | 5 | 0 | 99.86 | TIHDRSPF | 93.71 | TMHDRSPF | 3.15 | TIHDRSQF | | TMHDRSP | 1 |
| NA | N6 | 150 | 0.46 | yes | 5 | 0 | 99.86 | IHDRSPFR | 93.71 | MHDRSPFR | 3.15 | IHDRSQFR | | MHDRSPFR | 1 |
| NA | N6 | 151 | 0.41 | yes | 4 | 0 | 99.86 | HDRSPFRA | 94.42 | HDRSPFRA | 3.15 | HDRSQFRA | | NDRSPFRA | 0.86 |
| NA | N6 | 152 | 0.34 | yes | 3 | 0 | 99.57 | DRSPFRAL | 95.28 | DRSPFRAL | 3.15 | DRSQFRAL | | | |
| NA | N6 | 153 | 0.78 | yes | 4 | 0 | 99.57 | RSPFRALI | 85.69 | RSPFRALV | 9.59 | RSQFRALI | | RSPYRALI | 1.14 |
| NA | N6 | 154 | 0.78 | yes | 4 | 0 | 99.57 | SPFRALIS | 85.69 | SPFRALYS | 9.59 | SQFRALIS | | SPYRALIS | 1.14 |
| NA | N6 | 155 | 0.65 | yes | 4 | 0 | 99.57 | PFRALISW | 85.69 | PFRALVSW | 9.59 | QFRALISW | | PYRALISW | 1.14 |
| NA | N6 | 156 | 0.56 | yes | 3 | 0 | 99.57 | FRALISWE | 88.13 | FRALVSWE | 9.59 | YRALISWE | | FRALISWG | 0.72 |
| NA | N6 | 157 | 0.57 | yes | 3 | 0 | 99.57 | RALISWEM | 89.27 | RALVSWEM | 9.59 | RALISWGM | | | |
| NA | N6 | 158 | 0.78 | yes | 4 | 0 | 99.43 | ALISWEMG | 89.13 | ALVSWEMG | 9.59 | ALISWGMG | | | |
| NA | N6 | 159 | 0.59 | yes | 3 | 0 | 99.57 | LISWEMGQ | 88.98 | LVSWEMGQ | 9.59 | LISWGMGQ | | | |
| NA | N6 | 160 | 0.62 | yes | 3 | 0 | 99.28 | ISWEMGQA | 88.7 | VSWEMGQA | 9.59 | ISWGMGQA | | ISWEMGLA | 0.29 |
| NA | N6 | 161 | 0.17 | yes | 3 | 0 | 99.28 | SWEMGQAP | 98.28 | SWGMGQAP | 0.72 | SWEMGLAP | | | |
| NA | N6 | 162 | 0.17 | yes | 2 | 0 | 99.28 | WEMGQAPS | 98.28 | WGMGQAPS | 0.72 | WEMGLAPS | | | |
| NA | N6 | 163 | 0.11 | yes | 2 | 0 | 99.28 | EMGQAPSP | 98.28 | MGQAPSP | 0.72 | EMGLAPSP | | | |
| NA | N6 | 164 | 0.16 | yes | 1 | 0 | 99.28 | MGQAPSPY | 99 | MGLAPSPY | 0.29 | | | | |
| NA | N6 | 165 | 1.2 | yes | 1 | 0 | 99.14 | GQAPSPYN | 98.43 | GQAPSPYT | 0.43 | GLAPSPYN | 0.29 | | |
| NA | N6 | 175 | 0.96 | yes | 1 | 0 | 99.28 | VECIGWSS | 68.1 | VECIGWSS | 26.18 | IECIGWSS | 4.01 | | |
| NA | N6 | 176 | 0.96 | yes | — | 0.14 | 99.28 | ECIGWSST | 69.24 | ECIGWSS | 30.04 | | | | |
| NA | N6 | 177 | 0.96 | yes | — | 0.14 | 99.28 | CIGWSSTS | 69.24 | CIGWSST | 30.04 | | | | |
| NA | N6 | 178 | 0.06 | yes | — | 0.86 | 99.28 | IGWSSTSC | 69.24 | IGWSSTS | 30.04 | | | | |
| NA | N6 | 179 | 0.05 | yes | 1 | 0.86 | 99.43 | GWSSTSCH | 99.43 | GWSSTSC | | | | | |
| NA | N6 | 180 | 0.49 | yes | 5 | 0.72 | 99.57 | WSSTSCHD | 99.57 | WSSTSCH | | | | | |
| NA | N6 | 181 | 0.49 | yes | 5 | 0.86 | 99.28 | SSTSCHDG | 99.28 | SSTSCHD | 2.01 | STSCHDGM | 1.72 | STSCHDGR | | STSCHDGK |
| NA | N6 | 182 | 0.45 | yes | 5 | 0.86 | 99.28 | STSCHDGI | 99.28 | STSCHDG | 2.01 | TSCHDGMS | 1.72 | TSCHDGRS | | TSCHDGKS |
| NA | N6 | 183 | 0.43 | yes | 3 | 0.72 | 99.28 | TSCHDGIS | 99.28 | TSCHDGI | 2.02 | SCHDGMSR | 1.3 | SCHDGRSR | | SCHDGKSR |
| NA | N6 | 184 | 0.43 | yes | 3 | 0.86 | 99.52 | SCHDGISR | 99.28 | SCHDGIS | 2.02 | CHDGMSRM | 1.3 | CHDGRSRM | | CHDGKSRM |
| NA | N6 | 185 | 0.44 | yes | 5 | 0.72 | 99.42 | CHDGISRM | 99.28 | CHDGISR | 1.88 | HDGMSRMS | | HDGKSRMS | 1.01 | HDGKSRMS |
| NA | N6 | 186 | 0.46 | yes | 5 | | 99.42 | HDGISRMS | 99.28 | HDGISRM | 6.48 | SRMSVCMS | | | 1.01 | |
| NA | N6 | 190 | 0.47 | yes | 3 | 0.86 | 92.36 | SRMSICMS | 99.28 | SRMSICIS | 6.35 | RMSVCMSG | | | | |
| NA | N6 | 191 | 0.47 | yes | 3 | 0.72 | 92.64 | RMSICMSG | 99.42 | RMSICISG | 6.34 | MSVCMSGP | | | | |
| NA | N6 | 192 | 0.46 | yes | 3 | 0.72 | 92.51 | MSICMSGP | 99.28 | MSICISGP | 6.34 | SVCMSGPN | | | | |
| NA | N6 | 193 | 0.47 | yes | 3 | 0.72 | 92.36 | SICMSGPN | 99.14 | SICISGPN | 0.43 | VCMSGPND | 0.43 | | | |
| NA | N6 | 194 | 0.59 | yes | 4 | 0.72 | 90.63 | ICMSGPNN | 99.14 | ICISGPNN | 1.73 | CMSGPND | | | | |
| NA | N6 | 195 | 0.56 | yes | 3 | 0.72 | 91.07 | CMSGPNNN | 99.14 | CISGPNNN | 1.73 | CMSGPNDN | | | | |

FIG. 72-37

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 196 | 0.56 | yes | 3 | 0.72 | 99.14 | MSGPNNNA | 91.07 | MSGPNDNA | 6.34 | | | | |
| NA | N6 | 197 | 0.19 | yes | 2 | 0.72 | 99.42 | SGPNNNAS | 97.69 | SGPNDNAS | 1.73 | | | | |
| NA | N6 | 198 | 0.2 | yes | 2 | 0.86 | 99.28 | GPNNNASA | 97.55 | GPNDNASA | 1.73 | | | | |
| NA | N6 | 199 | 0.2 | yes | 3 | 0.86 | 99.28 | PNNNASAV | 97.55 | PNDNASAV | 1.73 | | | | |
| NA | N6 | 200 | 0.27 | yes | 2 | 0.86 | 99.42 | NNNASAVI | 96.68 | NDNASAVI | 1.73 | NNNASAVI | 1.01 | | |
| NA | N6 | 201 | 0.25 | yes | 4 | 0.86 | 99.28 | NNASAVV | 96.83 | DNASAVV | 1.73 | NNASAVIW | 1.01 | | |
| NA | N6 | 202 | 0.13 | yes | 3 | 0.86 | 99.57 | NASAVVY | 98.56 | NASAVIWY | 1.01 | | | | |
| NA | N6 | 215 | 0.98 | yes | 4 | 0.72 | 99.13 | TEIASWAG | 74.03 | TEIPSWEG | 23.81 | TEIPSWAG | 1.01 | | |
| NA | N6 | 216 | 0.96 | yes | 3 | 0.86 | 99.13 | EIASWAGN | 74.03 | EIPSWEGN | 24.1 | EIPSWAGN | 1.01 | | |
| NA | N6 | 217 | 0.99 | yes | 4 | 0.86 | 99.14 | IASWAGNI | 73.92 | IPSWEGNI | 23.92 | IPSWAGNI | 1.01 | | |
| NA | N6 | 218 | 0.99 | yes | 4 | 0.86 | 99.14 | ASWAGNIL | 73.92 | PSWEGNIL | 23.92 | PSWAGNIL | 1.01 | | |
| NA | N6 | 219 | 0.17 | yes | 2 | 0.72 | 99.42 | SWAGNILR | 98.13 | SWEGNILR | 1.01 | | | | |
| NA | N6 | 220 | 0.16 | yes | 2 | 0.72 | 99.28 | WAGNILRT | 98.41 | WEGNILRT | 1.01 | | | | |
| NA | N6 | 221 | 0.06 | yes | 1 | 0.72 | 99.42 | AGNILRTQ | 98.27 | | | | | | |
| NA | N6 | 222 | 0.06 | yes | 1 | 0.72 | 99.42 | GNILRTQE | 99.42 | | | | | | |
| NA | N6 | 223 | 0.03 | yes | 1 | 0.72 | 99.42 | NILRTQES | 99.42 | | | | | | |
| NA | N6 | 224 | 0.03 | yes | 1 | 0.72 | 99.42 | ILRTQESE | 99.42 | | | | | | |
| NA | N6 | 225 | 0.02 | yes | 1 | 0.72 | 99.42 | LRTQESEC | 99.71 | | | | | | |
| NA | N6 | 226 | 0.03 | yes | 1 | 0.72 | 99.71 | RTQESECV | 99.71 | | | | | | |
| NA | N6 | 227 | 0.03 | yes | 1 | 0.72 | 99.86 | TQESECVC | 99.86 | | | | | | |
| NA | N6 | 228 | 0.03 | yes | 1 | 0.72 | 99.71 | QESECVCH | 99.71 | | | | | | |
| NA | N6 | 229 | 0.87 | yes | 2 | 0.72 | 99.42 | ESECVCHK | 74.35 | ESECVCHK | 25.07 | ECVCHNGV | 2.59 | | |
| NA | N6 | 230 | 0.87 | yes | 2 | 0.72 | 99.71 | SECVCHKG | 74.35 | SECVCHNG | 25.07 | CVCHNGVC | 2.45 | | |
| NA | N6 | 231 | 1.07 | yes | 4 | 0.72 | 99.42 | ECVCHKGI | 73.34 | ECVCHNGI | 22.48 | VCHNGVCP | 2.45 | | |
| NA | N6 | 232 | 1.07 | yes | 4 | 0.72 | 99.14 | CVCHKGIC | 73.34 | CVCHNGIC | 22.48 | VCHKGVCP | 22.48 | CHNGVCPV | 2.45 |
| NA | N6 | 233 | 1.08 | yes | 4 | 0.72 | 99.13 | VCHKGICP | 73.34 | VCHNGICP | 22.48 | CHKGVCP | 22.51 | HNGVCPW | 2.31 |
| NA | N6 | 234 | 1.08 | yes | 4 | 0.72 | 99.13 | CHKGICPV | 73.3 | CHNGICPV | 22.51 | HKGICPV | 22.51 | HDGICPW | 0.14 |
| NA | N6 | 235 | 1.09 | yes | 5 | 0.72 | 99.13 | HKGICPVV | 73.3 | HNGICPV | 22.51 | GVCPVWT | 22.51 | | |
| NA | N6 | 237 | 0.3 | yes | 2 | 0.72 | 95.96 | GICPVVMT | 95.96 | GVCPVWMT | 3.17 | | | | |
| NA | N6 | 238 | 0.3 | yes | 2 | 0.72 | 95.96 | ICPVVMTD | 95.96 | VCPVWMTD | 3.17 | | | | |
| NA | N6 | 239 | 0.08 | yes | 1 | 0.72 | 99.42 | CPVVMTDG | 99.28 | | | | | | |
| NA | N6 | 240 | 0.08 | yes | 1 | 0.72 | 99.28 | PVVMTDGP | 99.28 | | | | | | |
| NA | N6 | 241 | 0.21 | yes | 4 | 0.86 | 99.28 | VVMTDGPA | 97.84 | VMTDGPAS | 0.87 | VMTDGPAD | 0.29 | MTDGPADN | 0.29 |
| NA | N6 | 242 | 0.28 | yes | 5 | 0.86 | 99.28 | VMTDGPAN | 96.97 | MTDGPASN | 0.87 | MTDGPANS | 0.72 | TDGPANSR | 0.43 |
| NA | N6 | 243 | 0.58 | yes | 5 | 0.86 | 99.28 | MTDGPANN | 91.05 | TDGPASNK | 6.2 | TDGPANDR | 0.87 | DGPANSRA | 0.43 |
| NA | N6 | 244 | 0.58 | yes | 5 | 0.86 | 99.28 | TDGPANNK | 91.05 | DGPASNKA | 6.2 | DGPANDRA | 0.87 | | |
| NA | N6 | 245 | 0.89 | yes | 4 | 0.86 | 77.06 | DGPANNRA | 77.06 | GTAQHIEE | 21.36 | GKAQHIEE | 0.43 | | |
| NA | N6 | 272 | 0.06 | yes | 1 | 0.86 | 99.42 | GKAQHIEE | 99.42 | SAEHIEEC | 21.36 | KAQHIEEC | 0.43 | | |
| NA | N6 | 273 | 0.04 | yes | 1 | 0.86 | 99.57 | SAQHIEEC | 99.57 | | | | | | |
| NA | N6 | 274 | 0 | yes | 1 | 0.86 | 100 | AQHIEECS | 100 | | | | | | |
| NA | N6 | 275 | | yes | | 0.86 | | QHIEECSC | | | | | | | |
| NA | N6 | 276 | | yes | | 0.86 | | HIEECSCY | | | | | | | |

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 366 | 0.37 | yes | 4 | 0 | 99.14 | RTISKDSR | 95.28 | RTISKDLR | 2.86 | RTISKDTR | 0.57 | | |
| NA | N6 | 367 | 0.37 | yes | 4 | 0 | 99.14 | TISKDSRS | 95.28 | TISKDLRS | 2.86 | TISKDTRS | 0.57 | | |
| NA | N6 | 368 | 0.37 | yes | 3 | 0 | 99.14 | ISKDSRSG | 95.28 | ISKDLRSG | 2.86 | ISKDTRSG | 0.43 | | |
| NA | N6 | 369 | 0.18 | yes | 4 | 0 | 99.43 | SKDSRSGY | 98.14 | SKDLRSGY | 0.57 | | | | |
| NA | N6 | 370 | 0.15 | yes | 3 | 0 | 99.14 | KDSRSGYE | 98.43 | KDLRSGYE | 0.43 | | | | |
| NA | N6 | 371 | 0.57 | yes | 5 | 0 | 99.28 | DSRSGYEM | 91.42 | DSRSGYEI | 4.86 | DLRSGYEM | 2.29 | | |
| NA | N6 | 372 | 0.6 | yes | 3 | 0 | 99.43 | SRSGYEML | 91.13 | SRSGYEIL | 4.86 | LRSGYEML | 2.29 | TRSGYEML | 0.43 |
| NA | N6 | 373 | 0.5 | yes | 3 | 0 | 99.43 | RSGYEMLK | 92.27 | RSGYEILK | 4.86 | | 2.29 | | |
| NA | N6 | 374 | 0.5 | yes | 5 | 0 | 99.43 | SGYEMLKV | 92.27 | SGYEILKV | 4.86 | | 2.29 | | |
| NA | N6 | 375 | 0.56 | yes | 5 | 0 | 99.43 | GYEMLKVP | 92.27 | GYEILKVP | 4.29 | YEVLKVPD | 2.29 | YEMLKVPD | 0.57 |
| NA | N6 | 376 | 0.56 | yes | 5 | 0 | 99.43 | YEMLKVPN | 91.85 | YEILKVPN | 4.29 | EVLKVPDA | 2.29 | EMLKVPDA | 0.57 |
| NA | N6 | 377 | 0.56 | yes | 4 | 0 | 99.43 | EMLKVPNA | 91.85 | EILKVPNA | 4.29 | VLKVPDAE | 2.29 | MLKVPDAE | 0.57 |
| NA | N6 | 378 | 0.32 | yes | 4 | 0 | 99.43 | MLKVPNAE | 91.85 | ILKVPNAE | 4.29 | LKVPNAEA | 2.29 | | |
| NA | N6 | 379 | 0.21 | yes | 2 | 0 | 99.43 | LKVPNAET | 96.14 | LKVPDAET | 1.72 | IVNNPNWS | — | | |
| NA | N6 | 398 | 0.17 | yes | 3 | 0 | 99.14 | IVNNQNWS | 97.85 | IVNNQDWS | 0.57 | INNQNWSG | — | | |
| NA | N6 | 399 | 0.14 | yes | 2 | 0 | 99.14 | VNNQNWSG | 97.85 | VNNQDWSG | 0.57 | NNQKWSGY | — | | |
| NA | N6 | 400 | 0.12 | yes | 3 | 0 | 99.14 | NNQNWSGY | 98.28 | NNQDWSGY | 0.43 | | — | | |
| NA | N6 | 401 | 0.2 | yes | 4 | 0 | 99.14 | NQNWSGYS | 98.71 | NQDWSGYS | 0.43 | DWSGYSGA | 0.57 | | |
| NA | N6 | 402 | 0.12 | yes | 4 | 0 | 99.28 | QNWSGYSG | 97.71 | QDWSGYSG | 0.29 | | | | |
| NA | N6 | 403 | 0.22 | yes | 2 | 0 | 99.28 | NWSGYSGA | 98.57 | NWSGYSGF | | | | | |
| NA | N6 | 404 | 0.24 | yes | 2 | 0 | 99.57 | WSGYSGAF | 97.57 | WSGYSGSF | | SGYSGAFM | 0.57 | | |
| NA | N6 | 405 | 0.26 | yes | 2 | 0 | 99.14 | SGYSGAFI | 97.28 | SGYSGFI | | GYSGAFMD | 0.57 | GYSGAFVD | 0.43 |
| NA | N6 | 406 | 0.26 | yes | 2 | 0 | 99.28 | GYSGAFID | 97.14 | GYSGSFID | | YSGAFMDY | 0.57 | YSGAFVDY | 0.43 |
| NA | N6 | 407 | 1.07 | yes | 2 | 0 | 99.28 | YSGAFIDY | 97.14 | YSGSFIDY | | SGAFMDYW | 0.57 | SGAFVDYW | 0.43 |
| NA | N6 | 408 | 0.09 | yes | 2 | 0 | 99.14 | SGAFIDYW | 54.79 | SGSFIDYW | | | 44.35 | | |
| NA | N6 | 418 | 0.05 | yes | 1 | 0.14 | 99.57 | RECFNPCF | 99.14 | RECFNPCF | — | | | | |
| NA | N6 | 419 | 0.05 | yes | 1 | 0.14 | 99.57 | ECFNPCFY | 99.57 | ECFNPCFY | — | | | | |
| NA | N6 | 420 | 0.02 | yes | 1 | 0.14 | 99.57 | CFNPCFYV | 99.86 | CFNPCFYV | — | | | | |
| NA | N6 | 421 | 0.03 | yes | 1 | 0.29 | 99.71 | FNPCFYVE | 99.86 | FNPCFYVE | — | | | | |
| NA | N6 | 422 | 0.05 | yes | 1 | 0.29 | 99.86 | NPCFYVEL | 99.57 | NPCFYVEL | | | | | |
| NA | N6 | 423 | 0.02 | yes | 1 | 0.29 | 99.57 | PCFYYEL | 99.57 | YELIRGM | 1.15 | YELIRGM | 0.86 | | |
| NA | N6 | 424 | 0.17 | yes | 2 | 0.29 | 99.57 | CFYYELI | 99.57 | VELIRGMP | 1.15 | VELIRGMP | 0.86 | | |
| NA | N6 | 425 | 0.26 | yes | 2 | 0.29 | 99.57 | FYYELIR | 98.13 | ELIRGMPK | 1.15 | ELIRGMPK | 1.43 | | |
| NA | N6 | 426 | 0.26 | yes | 3 | 0.29 | 99.28 | YYELIRG | 98.13 | LIRGMPKE | 1.43 | LIRGMPKE | 1.43 | | |
| NA | N6 | 427 | 0.38 | yes | 3 | 0.29 | 99.28 | VELIRGR | 97.13 | IRGMPKEN | 4.86 | IRGRPRE | 1.57 | IRGRPEES | 0.29 |
| NA | N6 | 428 | 0.62 | yes | 5 | 0 | 99.14 | ELIRGRP | 95.55 | IRGRPKE | 4.86 | IRGRPRE | 1.57 | ESSVWWTS | 0.14 |
| NA | N6 | 429 | 0.62 | yes | 5 | 0 | 99.28 | LIRGRPK | 90.99 | IRGRPKES | 4.87 | IRGMPKES | 1.57 | SGVLWTSN | 0.29 |
| NA | N6 | 430 | 0.5 | yes | 4 | 0 | 99.14 | IRGRPKE | 90.99 | ESSVFWTS | | ESNVLWTS | 1.57 | | |
| NA | N6 | 436 | 0.62 | yes | — | 0 | 99.14 | ESSVFWTS | 92.56 | SSVFWTSN | | NSVLWTSN | 0.29 | | |
| NA | N6 | 437 | 0.62 | yes | — | 0 | 99.28 | SSVLWTSN | 93.7 | SVLWTSNS | | GVLWTSNS | | | |
| NA | N6 | 438 | 0.5 | yes | — | 0 | 99.14 | SVLWTSNS | | VLWTSNSI | | VLWTSNSM | | | |
| NA | N6 | 439 | 0.43 | yes | 4 | 0.14 | 99.14 | VLWTSNSI | | | | | | | |

FIG. 72-40

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 440 | 0.41 | yes | 4 | 0.14 | 99.28 | LWTNSIV | 93.84 | FWTNSIV | 4.87 | WWTSNSIV | 0.29 | LWTSNSIV | 0.29 |
| NA | N6 | 441 | 0.09 | yes | 1 | 0.29 | 99.14 | WTSNSIVA | 99.14 | | | | | | |
| NA | N6 | 442 | 0.09 | yes | 1 | 0.29 | 99.14 | TSNSIVAL | 99.14 | | | | | | |
| NA | N6 | 443 | 0.09 | yes | 1 | 0.29 | 99.14 | SNSIVALC | 99.14 | | | | | | |
| NA | N6 | 444 | 0.09 | yes | 1 | 0.29 | 99.14 | NSIVALCG | 99.14 | | | | | | |
| NA | N6 | 445 | 0.09 | yes | 1 | 0.29 | 99.14 | SIVALCGS | 99.14 | | | | | | |
| NA | N6 | 446 | 0.43 | yes | 2 | 0.43 | 99.14 | IVALCGSK | 92.67 | IVALCGSR | 6.61 | | | | |
| NA | N6 | 447 | 0.55 | yes | 2 | 0.29 | 99.14 | VALCGSKE | 92.4 | VALCGSRE | 6.74 | ALCGSKEQ | 1.72 | | |
| NA | N6 | 448 | 0.57 | yes | 3 | 0.14 | 99.14 | ALCGSKER | 90.67 | ALCGSRER | 6.74 | LCGSKEQL | 1.72 | | |
| NA | N6 | 449 | 0.58 | yes | 3 | 0.14 | 99.14 | LCGSKERL | 90.69 | LCGSRERL | 6.73 | CGSKEQLG | 1.72 | CGSKKRLG | 0.86 |
| NA | N6 | 450 | 0.6 | yes | 3 | 0.14 | 99.86 | CGSKERLG | 90.54 | CGSRERLG | 6.73 | GSKEQLGS | 1.72 | GSKKRLGS | 0.86 |
| NA | N6 | 451 | 0.61 | yes | 3 | 0.14 | 99.71 | GSKERLGS | 90.4 | GSRERLGS | 6.73 | SKEQLGSW | 1.72 | SKKRLGSW | 0.86 |
| NA | N6 | 452 | 0.26 | yes | 2 | 0.14 | 99.57 | SKERLGSW | 90.26 | SRERLGSW | 6.73 | KEQLGSWS | 1.72 | KKRLGSWS | 0.86 |
| NA | N6 | 453 | 0.19 | yes | 2 | 0.14 | 99.43 | KERLGSWS | 90.11 | RERLGSWS | 6.73 | KRLGSWSW | 0.86 | | |
| NA | N6 | 454 | 0.09 | yes | 2 | 0.14 | 99.43 | ERLGSWSW | 96.85 | RLGSWSWH | 1.72 | | | | |
| NA | N6 | 455 | 0.08 | yes | 1 | 0.14 | 99.43 | RLGSWSWH | 97.71 | | | | | | |
| NA | N6 | 456 | 0.06 | yes | 1 | 0.14 | 99.14 | LGSWSWHD | 99.14 | | | | | | |
| NA | N6 | 457 | 0.05 | yes | 1 | 0.14 | 99.28 | GSWSWHDG | 99.28 | | | | | | |
| NA | N6 | 458 | 0.08 | yes | 1 | 0.43 | 99.41 | SWSWHDGA | 99.55 | | | | | | |
| NA | N6 | 459 | 0.06 | yes | 1 | 2.43 | 99.55 | WSWHDGAE | 99.24 | | | | | | |
| NA | N6 | 460 | 0.05 | yes | 1 | 4.43 | 99.24 | SWHDGAEI | 99.22 | | | | | | |
| NA | N6 | 461 | 0.44 | yes | 2 | 5.29 | 99.22 | WHDGAEII | 92.4 | WHDGAEIT | 6.82 | | | | |
| NA | N6 | 462 | 0.44 | yes | 2 | 7.73 | 99.22 | HDGAEIIY | 92.33 | HDGAEITY | 6.89 | | | | |
| NA | N6 | 463 | 0.6 | yes | 3 | 8.58 | 99.01 | DGAEIIYF | 92.01 | DGAEITYF | 7.48 | | | | |
| NA | N6 | 464 | 0.17 | yes | 4 | 15.88 | 99.49 | GAEIIYFK | 89.33 | GAEITYFK | 7.96 | GAEIIYFE | 6.82 | | |
| NA | N7 | 1 | 0.43 | no | 4 | 20.89 | 99.64 | MNPNQKLF | 97.99 | MNPQKLFT | 1.01 | MNPIYSKLF | 6.89 | | |
| NA | N7 | 2 | 0.75 | no | 4 | 19.11 | 99.5 | NPNQKLFA | 93.56 | NPQKLFTL | 4.46 | NPSQKLFA | 7.48 | | |
| NA | N7 | 3 | 0.75 | no | 4 | 17.89 | 99.01 | PNQKLFAS | 87.68 | PNQKLFTL | 5.91 | PSQKLFAL | 0.99 | PSQKLFTL | 0.99 |
| NA | N7 | 4 | 0.71 | no | 4 | 17.48 | 99.01 | NQKLFASS | 87.68 | NQKLFTLS | 5.88 | SQKLFALS | 0.99 | SQKLFALS | 0.99 |
| NA | N7 | 5 | 0.64 | no | 4 | 17.48 | 99.01 | QKLFASSG | 88.24 | QKLFTLSG | 5.29 | QKLFALSE | 0.49 | QKLFTLS | 0.49 |
| NA | N7 | 6 | 0.65 | yes | 4 | 17.07 | 99.02 | KLFASSGI | 89.43 | KLFTLSGV | 5.19 | | | | |
| NA | N7 | 7 | 0.7 | yes | 3 | 7.72 | 99.12 | LFASSGIA | 89.18 | LFTLSGVA | 5.02 | | | | |
| NA | N7 | 8 | 1.05 | yes | 3 | 6.1 | 99.13 | FASSGIAI | 88.7 | FTLSGVAI | 11.02 | FALSGVAI | 0.84 | FALSGVAV | 0.84 |
| NA | N7 | 20 | 0.59 | yes | 5 | 2.85 | 99.16 | NLLIGIS | 80.41 | INLLIGIS | 11.02 | MNLLIGIS | 1.63 | MNLLIGIS | 1.63 |
| NA | N7 | 21 | 0.9 | yes | 3 | 0.41 | 99.18 | NLLIGISN | 87.76 | NLLIGISN | 11.02 | LNLLIGVS | 1.22 | LNLLIGVS | 1.22 |
| NA | N7 | 22 | 0.97 | yes | 4 | 0.41 | 100 | LLIGISNV | 82.45 | LLIGISNM | 11.02 | LLIGISNV | 1.22 | LIGISNVV | 0.82 |
| NA | N7 | 23 | 0.48 | yes | 5 | 0.41 | 99.59 | LIGISNVG | 81.63 | LIGISNMS | 11.02 | LIGISNVG | 1.22 | LIGISNVV | 0.82 |
| NA | N7 | 24 | 0.52 | yes | 5 | 0.41 | 99.59 | IGISNVGL | 92.65 | IGISNVGL | 4.9 | IGISNVL | 1.22 | | |
| NA | N7 | 25 | 0.5 | yes | 4 | 0 | 99.59 | GISNVGLN | 92.28 | GISNVVGL | 4.88 | GISNVVLN | 0.81 | | |
| NA | N7 | 26 | 0.5 | yes | 5 | 0 | 99.19 | SNVGLNVS | 92.68 | SNMSLNIS | 4.88 | SNVGLNVS | 0.81 | SNIGLNVS | 0.41 |
| NA | N7 | 27 | 0.5 | yes | 5 | 0 | 99.19 | NVGLNVSL | 92.68 | NMSLNISL | 4.88 | NVYLNVSL | 0.81 | NIGLNVSL | 0.41 |
| NA | N7 | 29 | 0.5 | yes | 5 | 0 | 99.19 | VGLNVSLH | 92.68 | MSLNISLY | 4.88 | VVLNVSLH | 0.81 | VGLNVSLH | 0.41 |

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 190 | 0.99 | yes | 3 | 0 | 99.19 | MTICVQGN | 99.19 | MTICIQGN | 75.2 | MTICVQGD | 21.14 | | |
| NA | N7 | 191 | 0.99 | yes | 3 | 0 | 99.19 | TICVQGNN | 99.19 | TICIQGNN | 75.2 | TICVQGDN | 21.14 | | |
| NA | N7 | 192 | 0.94 | yes | 5 | 0 | 99.59 | QGNNDNAT | 99.59 | QGNNNNAT | 82.52 | QGDNENAT | 10.98 | QGNNEN

FIG. 72-44

| Protein | Sub-type | Start Pos | Block Entropy | Gaps <10% | # to 99% cover | Gap % | Coverage | Peptides included | freq | Peptides included | freq | Peptides included | freq | Peptides included | freq | Peptides included | freq |
|---|---|---|---|---|---|---|---|---|---|---|---|---|---|---|---|---|---|
| NA | N7 | 239 | 1.35 | yes | 4 | 0 | 99.19 | VIMTDGSA | 60.98 | VWMTDGPA | 30.89 | AVMTDGSA | 5.69 | | | | |
| NA | N7 | 240 | 1.33 | yes | 5 | 0 | 99.19 | IMTDGSAS | 60.57 | VWMTDGPAN | 32.52 | VMTDGPAS | 4.88 | IMTDGSAN | 0.41 | | |
| NA | N7 | 241 | 0.52 | yes | 4 | 0 | 99.19 | MTDGSASS | 92.28 | MTDGPASS | 4.88 | MTDGSASG | 1.22 | TDGPANSQ | 0.41 | | |
| NA | N7 | 242 | 0.56 | yes | 5 | 0 | 99.19 | TDGSASSQ | 91.87 | TDGPASSQ | 4.88 | DGSASGQA | 1.22 | DGSANSQA | 0.41 | | |
| NA | N7 | 243 | 0.56 | yes | 4 | 0 | 99.19 | DGSASSQA | 91.87 | DGPASSQA | 4.88 | ANSQAYTK | 1.22 | ASGQAYTK | 0.81 | | |
| NA | N7 | 246 | 1.14 | yes | 4 | 0 | 99.19 | ASSQAYTK | 73.98 | ANNQAFTK | 19.11 | ASGQAYTK | 4.88 | | | | |
| NA | N7 | 268 | 0.83 | yes | 2 | 0 | 99.19 | LKGSARHI | 84.96 | LRGSARHI | 9.35 | LQGSARHI | 4.07 | | | | |
| NA | N7 | 269 | 0.83 | yes | 4 | 0 | 99.19 | KGSAKHIE | 84.96 | RGSARHIE | 9.35 | QGSARHIE | 4.07 | | | | |
| NA | N7 | 270 | 0.52 | yes | 3 | 0 | 99.19 | GSAKHIEE | 89.84 | SARHIEEC | 9.35 | | | | | | |
| NA | N7 | 271 | 0.56 | yes | 4 | 0 | 99.19 | SAKHIEEC | 89.43 | AMHIEECS | 9.35 | ARHVEECS | 0.41 | | | | |
| NA | N7 | 272 | 0.6 | yes | 2 | 0 | 99.19 | ARHIEECS | 89.02 | MHIEECSC | 9.35 | RHIEEWSC | 0.41 | | | | |
| NA | N7 | 273 | 0.6 | yes | 2 | 0 | 99.19 | RHIEECSC | 89.02 | | | | | | | | |
| NA | N7 | 274 | 0.11 | yes | 2 | 0 | 99.19 | HIEECSCY | 98.78 | HIEEWSCY | 0.41 | | | | | | |
| NA | N7 | 275 | 0.11 | yes | 1 | 0 | 99.19 | IEECSCYG | 98.78 | IEECPCYG | 0.41 | | | | | | |
| NA | N7 | 276 | 0.08 | yes | 1 | 0 | 99.19 | EECSCYGH | 98.78 | ECSCYGHD | 0.41 | | | | | | |
| NA | N7 | 277 | 1.03 | yes | 3 | 0 | 99.19 | ECSCYGHN | 77.24 | ECSCYGHS | 15.45 | ESCCYGHD | 6.5 | | | | |
| NA | N7 | 286 | 0.88 | yes | 5 | 0 | 99.19 | RVTCVCRD | 85.77 | KATCVCRD | 5.69 | KITCVCRD | 3.25 | KVSCVCRD | 0.81 | | |
| NA | N7 | 287 | 0.57 | yes | 5 | 0 | 99.19 | ATCVCRDN | 91.46 | ITCVCRDN | 3.66 | VSCVCRDN | 3.25 | | | | |
| NA | N7 | 288 | 0.14 | yes | 2 | 0 | 99.19 | TCVCRDNW | 98.37 | SCYCRDNW | 0.81 | | | | | | |
| NA | N7 | 289 | 0.11 | yes | 2 | 0 | 99.59 | CVCRDNWQ | 98.78 | CGCRDNWQ | 0.41 | | | | | | |
| NA | N7 | 290 | 0.11 | yes | 1 | 0 | 99.59 | VCRDNWQG | 98.78 | ICRDNWQG | 0.41 | | | | | | |
| NA | N7 | 291 | 0.04 | yes | 1 | 0 | 99.59 | CRDNWQGA | 99.59 | | | | | | | | |
| NA | N7 | 292 | 0.04 | yes | 1 | 0 | 99.59 | RDNWQGAN | 99.59 | | | | | | | | |
| NA | N7 | 293 | 0.04 | yes | 1 | 0 | 99.59 | DNWQGANR | 99.59 | | | | | | | | |
| NA | N7 | 294 | 0.04 | yes | 1 | 0 | 99.59 | NWQGANRP | 99.59 | | | | | | | | |
| NA | N7 | 295 | 0.91 | yes | 2 | 0 | 99.59 | WQGANRPV | 72.36 | WQGANRPI | 26.83 | | | | | | |
| NA | N7 | 296 | 0.91 | yes | 2 | 0 | 99.59 | QGANRPVI | 72.36 | QGANRPII | 26.83 | | | | | | |
| NA | N7 | 297 | 1.08 | yes | 3 | 0 | 99.19 | GANRPVIE | 69.11 | GANRPIIE | 26.83 | NRPVIEIN | 2.03 | | | | |
| NA | N7 | 298 | 1.08 | yes | 4 | 0 | 99.19 | ANRPVIEI | 69.11 | ANRPIIEI | 26.83 | RPVIEINM | 2.03 | | | | |
| NA | N7 | 299 | 1.25 | yes | 4 | 0 | 99.19 | NRPVIEID | 67.07 | NRPIIEID | 26.42 | HTSRYMCT | 0.81 | | | | |
| NA | N7 | 300 | 1.25 | yes | 4 | 0 | 99.19 | RPVIEIDM | 67.07 | RPIIEIDM | 26.42 | TSRYMCTG | 0.81 | | | | |
| NA | N7 | 312 | 1.19 | yes | 2 | 0 | 100 | HTSQYLCT | 70.73 | HTSRYICT | 21.95 | HTSRYMCT | | | | | |
| NA | N7 | 313 | 1.19 | yes | 2 | 0 | 100 | TSQYLCTG | 70.73 | TSRYICTG | 21.95 | TSRYMCTG | | | | | |
| NA | N7 | 318 | 0.77 | yes | 3 | 0 | 99.59 | CTGILTDT | 77.24 | TGILTDTS | 22.76 | | | | | | |
| NA | N7 | 319 | 0.77 | yes | 4 | 0 | 99.59 | TGILTDTS | 76.83 | GILTDTSR | 22.76 | | | | | | |
| NA | N7 | 320 | 0.81 | yes | 4 | 0 | 99.19 | GVLTDTSR | 76.83 | ILTDTSRP | 22.76 | LTDTSRPK | 4.88 | LTDTSRPG | | | |
| NA | N7 | 321 | 1.13 | yes | 2 | 0 | 99.19 | VLTDTSRP | 70.33 | LTDTSRPS | 23.98 | TDTSRPKD | 4.88 | TDTSRPGD | | | |
| NA | N7 | 322 | 1.13 | yes | 3 | 0 | 99.19 | LTDTSRPS | 70.33 | TDTSRPSD | 23.98 | DTSRPKDK | 4.88 | DTSRPGDK | 4.88 | DTSRPGDR | 1.22 |
| NA | N7 | 323 | 1.23 | yes | 5 | 0 | 99.11 | TDTSRPSD | 69.92 | DTSRPGDK | 22.76 | GECFNPIT | 4.88 | | | DTSRPSDR | 0.41 |
| NA | N7 | 334 | 1.12 | yes | 3 | 0 | 99.11 | GDCNPIT | 69.11 | GDCNPIT | 25.61 | ECFNPITG | 4.88 | | | | |
| NA | N7 | 335 | 1.12 | yes | 3 | 0 | 99.59 | DCNNPITG | 69.11 | DCSNPITG | 25.61 | | | | | | |

FIG.72-45

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 336 | 1.12 | yes | 3 | 0 | 99.59 | CNNPITGS | 69.11 | CSNPITGS | 25.61 | | | | |
| NA | N7 | 337 | 1.12 | yes | 3 | 0 | 99.59 | NNPITGSP | 69.11 | SNPITGSP | 25.61 | | | | |
| NA | N7 | 338 | 0.2 | yes | 2 | 0 | 99.19 | PITGSPG | 97.56 | NPITGSPS | 1.63 | | | | |
| NA | N7 | 339 | 0.3 | yes | 4 | 0 | 99.19 | PITGSPGA | 96.34 | PITGSPSA | 1.63 | PITGSPEA | 0.81 | | |
| NA | N7 | 340 | 0.3 | yes | 4 | 0 | 99.19 | ITGSPGAP | 96.34 | ITGSPSAP | 1.63 | ITGSPCAP | 0.81 | | |
| NA | N7 | 341 | 0.3 | yes | 4 | 0 | 99.19 | TGSPGAPG | 96.34 | TGSPSAPG | 1.63 | TGSPCAPG | 0.81 | | |
| NA | N7 | 346 | 0.41 | yes | 3 | 0 | 99.59 | APGIKGFG | 93.9 | APGIKGFG | 4.47 | | | | |
| NA | N7 | 347 | 0.3 | yes | 2 | 0 | 99.19 | PGVKGFGF | 95.12 | PGIKGFGF | 4.47 | | | | |
| NA | N7 | 348 | 0.3 | yes | 2 | 0 | 99.19 | GVKGFGFL | 95.12 | GIKGFGFL | 4.47 | | | | |
| NA | N7 | 349 | 1.11 | yes | 3 | 0 | 99.19 | VKGFGFLD | 70.73 | IKGFGFLN | 23.98 | | | | |
| NA | N7 | 350 | 1.3 | yes | 3 | 0 | 99.19 | KGFGFLDS | 68.29 | KGFGFLNE | 23.58 | KGFGFLDG | 4.47 | KGFGFLDN | 0.81 |
| NA | N7 | 358 | 1.61 | yes | 4 | 0 | 99.19 | GNTWLGRT | 47.97 | SNTWLGRT | 35.37 | NNTWLGRT | 13.82 | | |
| NA | N7 | 359 | 0.11 | yes | 1 | 0 | 99.19 | NTWLGRTI | 98.78 | | 0.41 | | | | |
| NA | N7 | 360 | 0.08 | yes | 2 | 0 | 99.19 | TWLGRTIS | 99.19 | | | | | | |
| NA | N7 | 361 | 0.11 | yes | 2 | 0 | 99.19 | WLGRTISP | 98.78 | WLGGTISP | 0.41 | | | | |
| NA | N7 | 362 | 0.32 | yes | 4 | 0 | 99.19 | LGRTISPR | 95.93 | LGRTISPK | 2.44 | LGRTISPH | 0.41 | LGRTFSPR | 0.41 |
| NA | N7 | 363 | 0.48 | yes | 5 | 0 | 99.19 | GRTISPRS | 93.5 | GRTISPKL | 2.44 | GRTISPHL | 2.44 | GRTFSPRS | 0.41 |
| NA | N7 | 364 | 0.48 | yes | 5 | 0 | 99.19 | RTISPRSR | 93.5 | RTISPKLR | 2.44 | RTISPHSR | 2.44 | RTISPHSR | 0.41 |
| NA | N7 | 365 | 0.48 | yes | 5 | 0 | 99.19 | TISPRSRS | 93.5 | TISPKLRS | 2.44 | TISPHSRS | 2.44 | TISPHSR | 0.41 |
| NA | N7 | 366 | 0.48 | yes | 5 | 0 | 99.19 | ISPRSRSG | 93.5 | ISPKLRSG | 2.44 | ISTRSRSG | 2.44 | ISPHSRSG | 0.41 |
| NA | N7 | 367 | 0.44 | yes | 4 | 0 | 99.19 | SPRSRSGF | 93.9 | SPKLRSGF | 2.44 | SPRSRNGF | 2.44 | | |
| NA | N7 | 368 | 0.44 | yes | 4 | 0 | 99.19 | PRSRSGFE | 93.9 | PRLRSGFE | 2.44 | PRSRNGFE | 2.44 | | |
| NA | N7 | 369 | 0.44 | yes | 4 | 0 | 99.19 | RSRSGFEM | 93.9 | LRSGFEML | 2.44 | RSRNGFEM | 2.44 | | |
| NA | N7 | 370 | 0.36 | yes | 3 | 0 | 99.19 | SRSGFEML | 94.31 | LRSGFEML | 2.44 | | | | |
| NA | N7 | 371 | 0.11 | yes | 2 | 0 | 99.19 | RSGFEMLR | 98.78 | NGFEMLKI | 0.41 | | | | |
| NA | N7 | 372 | 0.28 | yes | 3 | 0 | 99.19 | SGFEMLKI | 96.34 | GEVLKVP | 2.44 | | | | |
| NA | N7 | 373 | 0.28 | yes | 3 | 0 | 99.19 | GFEMLKIP | 96.34 | FEMLKIHN | 2.44 | | | | |
| NA | N7 | 374 | 0.28 | yes | 3 | 0 | 99.19 | FEMLKIPN | 96.34 | EVLKVPNA | 2.44 | | | | |
| NA | N7 | 375 | 0.68 | yes | 5 | 0 | 89.02 | EMLKIPNA | 89.02 | MLKVPNAE | 4.88 | MLKIHNAG | 0.41 | MLKIHNAG | 0.41 |
| NA | N7 | 376 | 0.83 | yes | 5 | 0 | 86.59 | MLKIPNAG | 86.59 | LKIPNAET | 7.32 | LKVPNAEK | 2.44 | LKVPNAGT | 1.22 |
| NA | N7 | 377 | 0.81 | yes | 5 | 0 | 86.59 | LKIPNAGT | 86.59 | KIPNAETD | 7.32 | KVPNAEKD | 2.44 | KVPNAGTD | 1.22 |
| NA | N7 | 378 | 0.65 | yes | 4 | 0 | 86.59 | KIPNAGTD | 86.59 | IPNAGIDP | 7.32 | VPNAEKDP | 2.85 | VPNAGTDP | 1.22 |
| NA | N7 | 379 | 0.15 | yes | 3 | 0 | 90.2 | IPNAGTDP | 90.2 | GRQEIVDN | 3.67 | ERQEIVGN | 2.86 | | |
| NA | N7 | 392 | 0.08 | yes | 2 | 0 | 99.18 | ERQEIVDN | 98.37 | NRSGYSGS | 0.41 | | | | |
| NA | N7 | 401 | 0 | yes | 1 | 0 | 99.19 | NWSGYSGS | 99.19 | NLSGYSGS | | | | | |
| NA | N7 | 402 | 0 | yes | 1 | 0 | 100 | WSGYSGSF | 100 | | | | | | |
| NA | N7 | 403 | 0 | yes | 1 | 0 | 100 | SGYSGSFI | 100 | | | | | | |
| NA | N7 | 404 | 0 | yes | 1 | 0 | 100 | GYSGSFID | 100 | | | | | | |
| NA | N7 | 405 | 0 | yes | 1 | 0 | 100 | YSGSFIDY | 100 | | | | | | |
| NA | N7 | 406 | 0 | yes | 1 | 0 | 100 | SGSFIDYW | 100 | | | | | | |
| NA | N7 | 407 | 0.78 | yes | 2 | 0 | 76.83 | GSFIDYWN | 76.83 | GSFIDYWD | 23.17 | SFIDYWDD | 4.88 | | |
| NA | N7 | 408 | 1.08 | yes | 3 | 0 | 71.54 | SFIDYWND | 71.54 | SFIDYWDE | 23.17 | | | | |

FIG. 72-46

| Protein | Sub-type | Start Pos | Block Entropy | Gaps <10% | # to cover 99% | Gap % | Coverage | included Peptides | Freq | included Peptides | Freq | included Peptides | Freq | included Peptides | Freq | included Peptides | Freq |
|---|---|---|---|---|---|---|---|---|---|---|---|---|---|---|---|---|---|
| NA | N7 | 417 | 0.92 | yes | 5 | 0 | 99.59 | SECYNPCF | 82.11 | NECYNPCF | 12.2 | SVCYNPCF | 0.81 | | | | |
| NA | N7 | 418 | 0.38 | yes | 3 | 0 | 99.19 | ECYNPCFY | 94.31 | VCYNPCFY | 4.07 | ACYNPCFY | 0.81 | SKCYNPCF | 3.66 | SACYNPCF | 0.81 |
| NA | N7 | 419 | 0 | yes | 1 | 0 | 100 | CYNPCFYV | 100 | | | | | | 0.81 | | |
| NA | N7 | 420 | 0 | yes | 1 | 0 | 100 | YNPCFYVE | 100 | | | | | | | | |
| NA | N7 | 421 | 0 | yes | 1 | 0 | 100 | NPCFYVEL | 100 | | | | | | | | |
| NA | N7 | 422 | 0 | yes | 1 | 0 | 100 | PCFYVELI | 100 | | | | | | | | |
| NA | N7 | 423 | 0 | yes | 1 | 0 | 100 | CFYVELIR | 100 | | | | | | | | |
| NA | N7 | 424 | 0 | yes | 1 | 0 | 100 | FYVELIRG | 100 | | | | | | | | |
| NA | N7 | 425 | 0 | yes | 1 | 0 | 100 | YVELIRGR | 100 | | | | | | | | |
| NA | N7 | 426 | 0 | yes | 1 | 0 | 100 | VELIRGRP | 100 | | | | | | | | |
| NA | N7 | 427 | 0 | yes | 1 | 0 | 100 | ELIRGRPE | 100 | | | | | | | | |
| NA | N7 | 428 | 0 | yes | 1 | 0 | 100 | LIRGRPEE | 100 | | | | | | | | |
| NA | N7 | 429 | 0.07 | yes | 2 | 0 | 99.19 | IRGRPEEA | 99.19 | GRPEEVKY | 0.81 | | | | | | |
| NA | N7 | 430 | 0.07 | yes | 2 | 0 | 99.19 | RGRPEEAK | 99.19 | RPEEVKYW | 0.81 | | | | | | |
| NA | N7 | 431 | 0.11 | yes | 2 | 0 | 98.78 | GRPEEAKY | 98.78 | PEEVKYVW | 4.88 | | | | | | |
| NA | N7 | 432 | 0.11 | yes | 2 | 0 | 98.78 | RPEEAKYV | 98.78 | PEEVKYVW | 4.88 | | | | | | |
| NA | N7 | 433 | 0.39 | yes | 3 | 0 | 93.9 | PEEAKYVW | 93.9 | EEVKYVWW | 4.88 | EVKYVWWT | 0.81 | | | | |
| NA | N7 | 434 | 0.39 | yes | 3 | 0 | 93.9 | EEAKYVWW | 93.9 | EVKYVWWA | 4.88 | VKYVWWTS | 0.81 | | | | |
| NA | N7 | 435 | 0.48 | yes | 4 | 0 | 92.68 | EAKYVWWT | 92.68 | AKYVWWAS | 4.88 | | | | | | |
| NA | N7 | 436 | 0.48 | yes | 4 | 0 | 92.68 | AKYVWWTS | 92.68 | KYVWWASN | 4.88 | | | | | | |
| NA | N7 | 437 | 0.41 | yes | 3 | 0 | 93.5 | KYVWWTSN | 93.5 | YVWWASNS | 4.88 | | | | | | |
| NA | N7 | 438 | 0.38 | yes | 3 | 0 | 93.9 | YVWWTSNS | 93.9 | VWWASNSL | 4.88 | WWASNSLI | 1.22 | | | | |
| NA | N7 | 439 | 1.13 | yes | 4 | 0 | 93.9 | VWWTSNSL | 93.9 | WWASNSLI | 4.88 | | | | | | |
| NA | N7 | 440 | 0.94 | yes | 3 | 0 | 71.14 | WWTSNSLV | 71.14 | EWTSNSLI | 22.76 | | | | | | |
| NA | N7 | 441 | 0.94 | yes | 3 | 0 | 71.14 | WTSNSLVA | 71.14 | WASNSLIA | 27.64 | | | | | | |
| NA | N7 | 442 | 0.87 | yes | 2 | 0 | 71.02 | TSNSLVAL | 71.02 | ASNSLIAL | 27.76 | | | | | | |
| NA | N7 | 443 | 0.87 | yes | 2 | 0 | 71.02 | SNSLVALC | 71.02 | SNSLIALC | 28.98 | | | | | | |
| NA | N7 | 444 | 0.87 | yes | 2 | 0 | 71.02 | NSLVALCG | 71.02 | NSLIALCG | 28.98 | | | | | | |
| NA | N7 | 445 | 0.87 | yes | 2 | 0 | 71.02 | SLVALCGS | 71.02 | SLIALCGS | 28.98 | | | | | | |
| NA | N7 | 446 | 1.89 | yes | 5 | 0 | 35.92 | LVALCGSP | 35.92 | LIALCGSP | 34.69 | IALCGSPI | 22.45 | IALCGSPV | 5.31 | IALCGSPV | 0.82 |
| NA | N7 | 447 | 1.09 | yes | 3 | 0 | 63.37 | VALCGSPI | 63.37 | VALCGSPV | 34.57 | IALCGSPF | 1.23 | | | | |
| NA | N7 | 455 | 0.21 | yes | 3 | 0.41 | 97.51 | SVGGSFPD | 97.51 | PVGPGSFP | 1.24 | PVGPGSFP | 0.41 | | | | |
| NA | N7 | 456 | 0.21 | yes | 3 | 0.41 | 97.51 | VGSGSFPD | 97.51 | VGPGSFPD | 1.24 | VGSGLPD | 0.41 | | | | |
| NA | N7 | 457 | 0.2 | yes | 3 | 2.03 | 97.17 | GSGSFPDG | 97.47 | GPGSFPDG | 1.27 | GSGSLPDG | 0.42 | | | | |
| NA | N7 | 458 | 0.2 | yes | 4 | 2.03 | 97.85 | GSFPDGAQ | 97.85 | PGSFPDGA | 0.43 | GSFPNGA | 0.43 | GSFPDGAR | 0.43 | | |
| NA | N7 | 459 | 0.2 | yes | 4 | 3.66 | 97.81 | GSFPDGAQI | 97.81 | GFFPDGPQ | 0.44 | FFPDGPQI | 0.44 | SFPDGAKI | 0.44 | | |
| NA | N7 | 460 | 0.5 | yes | 4 | 5.28 | 92.51 | SFPDGAQI | 92.51 | SLPDGAQI | 0.44 | GSFPNGAQ | 5.29 | FPDGAKIQ | 0.44 | | |
| NA | N7 | 461 | 0.46 | yes | 5 | 7.32 | 91.12 | FPDGAQIQ | 91.12 | FPDGAQIK | 0.44 | FFPDGPQI | 5.33 | PNGAQIQY | 0.44 | LPDGAQIQ | 0.44 |
| NA | N7 | 462 | 0.48 | yes | 4 | 7.72 | 92.89 | PDGAQIQY | 92.89 | PDGAQIKY | 0.47 | PDGAKIQY | 5.58 | DGAKIQYF | 0.47 | | |
| NA | N7 | 463 | 0.48 | no | 4 | 8.54 | 92.56 | DGAQIQYF | 92.56 | DGAQIKYF | 0.49 | DGARIQYF | 5.85 | | | | |
| NA | N7 | 464 | 0.45 | no | 3 | 12.6 | 92.68 | GAQIQYFS | 92.68 | GAQIKYFS | | GARIQYFS | | | | | |
| NA | N8 | 51 | 0.39 | yes | 4 | 16.67 | 99.02 | REYNETIR | 99.07 | REYNETIR | 0.87 | REYNETVR | 0.54 | | | | |

FIG. 72-47

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 52 | 1.2 | yes | 4 | 0.22 | 99.02 | EYNETVRV | 49.62 | EYNETVRI | 47.99 | EYNETVKV | 0.54 | | |
| NA | N8 | 53 | 1.2 | yes | 4 | 0.22 | 99.02 | YNETVRVE | 49.62 | YNETVRIE | 47.99 | YNETVKVE | 0.54 | | |
| NA | N8 | 169 | 1.01 | yes | 4 | 0.11 | 99.02 | KGFAPFSK | 75.76 | QGFAPFSK | 21.2 | EGFAPFSK | 0.98 | | |
| NA | N8 | 170 | 0.09 | yes | 1 | 0.11 | 99.13 | GFAPFSKD | 99.13 | | | | | | |
| NA | N8 | 171 | 0.09 | yes | 1 | 0.11 | 99.13 | FAPFSKDN | 99.13 | | | | | | |
| NA | N8 | 172 | 0.07 | yes | 1 | 0.11 | 99.13 | APFSKDNG | 99.35 | | | | | | |
| NA | N8 | 173 | 0.08 | yes | 1 | 0.11 | 99.24 | PFSKDNGI | 99.24 | | | | | | |
| NA | N8 | 174 | 0.09 | yes | 1 | 0.11 | 99.13 | FSKDNGIR | 99.13 | | | | | | |
| NA | N8 | 175 | 0.07 | yes | 1 | 0.11 | 99.35 | SKDNGIRI | 99.35 | | | | | | |
| NA | N8 | 176 | 0.06 | yes | 1 | 0.11 | 99.13 | KDNGIRIG | 99.13 | | | | | | |
| NA | N8 | 177 | 0.03 | yes | 1 | 0.11 | 99.46 | DNGIRIGS | 99.46 | | | | | | |
| NA | N8 | 178 | 0.11 | yes | 2 | 0.11 | 99.67 | NGIRIGSK | 98.8 | NGIRIGSK | 0.87 | | | | |
| NA | N8 | 179 | 0.11 | yes | 2 | 0.11 | 99.67 | GIRIGSKG | 98.8 | GIRIGSKG | 0.87 | | | | |
| NA | N8 | 180 | 0.11 | yes | 2 | 0.11 | 99.67 | IRIGSKGH | 98.8 | IRIGSKGH | 0.87 | | | | |
| NA | N8 | 181 | 0.36 | yes | 3 | 0.11 | 99.02 | RIGSKGHV | 94.35 | RIGSRGHI | 4.67 | | | | |
| NA | N8 | 182 | 0.37 | yes | 3 | 0.11 | 99.78 | IGSKGHVF | 94.24 | IGSRGHIF | 4.67 | IGSKGHYF | 0.87 | | |
| NA | N8 | 183 | 0.42 | yes | 3 | 0.11 | 93.7 | GSKGHVFV | 93.7 | GSRGHIFV | 4.67 | GSKGHVFV | 0.87 | | |
| NA | N8 | 184 | 0.44 | yes | 3 | 0.11 | 93.59 | SRGHVFVI | 93.59 | SRGHIFVI | 4.67 | SKGHVFVI | 0.87 | | |
| NA | N8 | 185 | 0.44 | yes | 3 | 0.11 | 93.59 | RGHVFVIR | 93.59 | RGHIFVIR | 4.67 | KGHVFVIR | 0.87 | | |
| NA | N8 | 186 | 0.36 | yes | 2 | 0.11 | 99.02 | GHVFVIRE | 94.46 | GHIFVIRE | 4.67 | | | | |
| NA | N8 | 187 | 0.38 | yes | 2 | 0.11 | 99.13 | HVFVIREP | 94.35 | HIFVIREP | 4.67 | | | | |
| NA | N8 | 188 | 0.38 | yes | 2 | 0.11 | 99.02 | VFVIREPF | 94.35 | VFVIREPF | 4.67 | | | | |
| NA | N8 | 189 | 0.14 | yes | 2 | 0.11 | 99.13 | FVIREPFV | 98.7 | FIIREPFV | 0.33 | | | | |
| NA | N8 | 190 | 0.13 | yes | 2 | 0.11 | 99.02 | VIREPFVS | 98.8 | IIREPFVS | 0.33 | | | | |
| NA | N8 | 191 | 0.07 | yes | 1 | 0.33 | 99.13 | IREPFVSC | 99.35 | | | | | | |
| NA | N8 | 192 | 0.06 | yes | 1 | 0.33 | 99.35 | REPFVSCS | 99.46 | | | | | | |
| NA | N8 | 193 | 0.08 | yes | 1 | 0.33 | 99.46 | EPFVSCSP | 99.24 | | | | | | |
| NA | N8 | 202 | 0.2 | yes | 3 | 0.33 | 99.24 | ECRTFFLT | 97.93 | DCRTFFLT | 0.87 | | | | |
| NA | N8 | 203 | 0.14 | yes | 2 | 0.33 | 99.13 | CRTFFLTQ | 98.58 | CRTFFLTH | 0.54 | | | | |
| NA | N8 | 204 | 0.12 | yes | 2 | 0.33 | 99.13 | RTFFLTQG | 98.58 | RTFFLTHG | 0.54 | | | | |
| NA | N8 | 205 | 0.08 | yes | 1 | 0.33 | 99.35 | TFFLTQGS | 98.8 | TFFLTHGS | 0.54 | | | | |
| NA | N8 | 206 | 0.2 | yes | 3 | 0.11 | 99.13 | FFLTQGSL | 99.13 | | | | | | |
| NA | N8 | 207 | 0.15 | yes | 2 | 0.11 | 99.02 | FLTQGSLL | 98.47 | FLTHGSLL | 0.54 | ITQGSLLN | 0.22 | | |
| NA | N8 | 208 | 0.17 | yes | 3 | 0.11 | 99.13 | LTQGSLLN | 98.37 | LTHGSLLN | 0.54 | | | | |
| NA | N8 | 209 | 0.17 | yes | 2 | 0.11 | 99.13 | TQGSLLND | 98.58 | THGSLLND | 0.54 | HGSLLNDK | 0.54 | | |
| NA | N8 | 210 | 0.2 | yes | 3 | 0.11 | 99.35 | QGSLLNDR | 97.93 | QGSLLNDR | 0.65 | | | | |
| NA | N8 | 211 | 0.15 | yes | 2 | 0.11 | 99.13 | GSLLNDRH | 98.48 | GSLLNDKH | 0.65 | | | | |
| NA | N8 | 212 | 0.17 | yes | 3 | 0.11 | 99.13 | SLLNDRHS | 98.26 | SLLNDKHS | 0.65 | SLLNDKHF | 0.22 | LPNDKHSN | 0.22 |
| NA | N8 | 213 | 0.2 | yes | 4 | 0.11 | 99.13 | LLNDRHSN | 98.04 | LLNDKHSS | 0.65 | LLNDKHSS | 0.22 | LNDKHFNG | 0.22 |
| NA | N8 | 214 | 0.15 | yes | 3 | 0.11 | 99.13 | LNDRHSNG | 98.04 | LNDKHSSG | 0.65 | LNDKHSSG | 0.22 | | |
| NA | N8 | 215 | 0.2 | yes | 2 | 0.11 | 99.24 | NDRHSNGT | 98.59 | NDRHSNGT | 0.65 | | | | |
| NA | N8 | 216 | 0.58 | yes | 4 | 0.11 | 99.24 | DKHSNGTV | 90.11 | DRHSNGTV | 8.15 | DRHSNGTV | 0.54 | DKHSNGTM | 0.43 |

FIG. 72-48

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 217 | 0.59 | yes | 4 | 0.22 | 99.13 | KHSNG

FIG. 72-49

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 266 | 1.38 | yes | 5 | 0.11 | 99.13 | TNGYTGPD | 63.91 | TIGYTGPD | 26.41 | TIGYTGSD | 7.39 | ANGYTGPD | 0.33 |
| NA | N8 | 292 | 0.43 | yes | 5 | 0.11 | 99.02 | SWAGNILR | 94.67 | SWEGDILR | 2.5 | SWAGDIMR | 0.98 | WAGDTLRT | 0.11 |
| NA | N8 | 293 | 0.44 | yes | 3 | 0.22 | 99.02 | WAGNILRT | 94.56 | WEGDILRT | 2.5 | WAGDIMRT | 0.98 | AEDILRTQ | 0.11 |
| NA | N8 | 294 | 0.44 | yes | 3 | 0.22 | 99.02 | AGNILRTQ | 94.56 | EGDILRTQ | 2.5 | AGDIMRTQ | 0.98 | | |
| NA | N8 | 295 | 0.35 | yes | 2 | 0.22 | 99.13 | GNILRTQE | 95.65 | GDILRTQE | 2.5 | | | | |
| NA | N8 | 296 | 0.34 | yes | 2 | 0.22 | 99.13 | NILRTQES | 95.76 | DILRTQES | 2.5 | | | | |
| NA | N8 | 297 | 0.17 | yes | 1 | 0.22 | 99.13 | ILRTQESS | 98.26 | DIMRTQES | 0.87 | | | | |
| NA | N8 | 298 | 0.15 | yes | 1 | 0.22 | 99.35 | LRTQESSC | 98.48 | | | | | | |
| NA | N8 | 299 | 0.08 | yes | 1 | 0.22 | 99.24 | RTQESSCT | 99.13 | | | | | | |
| NA | N8 | 300 | 0.1 | yes | 1 | 0.22 | 99.13 | TQESSCTC | 99.24 | MRTQESS | 0.87 | | | | |
| NA | N8 | 301 | 0.08 | yes | 1 | 0.11 | 99.24 | QESSCTCI | 99.13 | | | | | | |
| NA | N8 | 302 | 0.92 | yes | 4 | 0.22 | 99.24 | ESSCTCIK | 76.74 | ESSCTCIR | 21.41 | ESSCTCIL | 0.65 | | |
| NA | N8 | 303 | 0.91 | yes | 4 | 0.22 | 99.35 | SSCTCIKG | 76.74 | SSCTCIRG | 21.52 | SSCTCILG | 0.65 | | |
| NA | N8 | 310 | 1.74 | yes | 4 | 0.11 | 99.46 | GDCYWMT | 48.97 | GECFWMT | 27.42 | GNCYWMT | 17.3 | | |
| NA | N8 | 311 | 1.74 | yes | 4 | 0.22 | 99.46 | DCYWMTD | 48.97 | ECFWMTD | 27.42 | NCYWMTD | 17.3 | | |
| NA | N8 | 312 | 0.69 | yes | 2 | 0.22 | 99.78 | CYWMTDG | 82.48 | CFWMTDG | 17.28 | | | | |
| NA | N8 | 313 | 0.69 | yes | 2 | 0.22 | 99.78 | YWMTDGP | 82.5 | | | | | | |
| NA | N8 | 314 | 0.04 | yes | 1 | 0.22 | 99.67 | WMTDGPA | 99.57 | | | | | | |
| NA | N8 | 315 | 0.05 | yes | 1 | 0.11 | 99.57 | YMTDGPAN | 99.67 | | | | | | |
| NA | N8 | 316 | 0.37 | yes | 2 | 0.11 | 99.89 | MTDGPAN | 95.54 | MTDGPANS | 1.63 | MTDGPANN | 1.09 | | |
| NA | N8 | 317 | 0.37 | yes | 2 | 0.11 | 99.89 | TDGPANK | 95.54 | TDGPANSQ | 1.63 | TDGPANNQ | 1.09 | | |
| NA | N8 | 318 | 0.44 | yes | 2 | 0.22 | 99.67 | DGPANRQ | 95.54 | DGPANSQA | 1.63 | DGPANNQA | 1.09 | | |
| NA | N8 | 345 | 0.43 | yes | 2 | 0.11 | 99.78 | FNGGHIEE | 94.46 | FDGGHIEE | 2.17 | FNEGHIEE | 1.63 | FTEGHIEE | 0.43 |
| NA | N8 | 346 | 0.1 | yes | 2 | 0.11 | 99.35 | SGGHIEEC | 98.8 | DGGHIEE | 2.17 | NEGHIEE | 1.74 | TEGHIEEC | 0.43 |
| NA | N8 | 347 | 0.01 | yes | 1 | 0 | 99.89 | EGHIEECS | 99.89 | DGGHIEEC | 0.98 | NEGHIEEC | 0.54 | | |
| NA | N8 | 348 | 0.01 | yes | 1 | 0 | 99.89 | GHIEECSC | 99.89 | | | | | | |
| NA | N8 | 349 | 0.02 | yes | 1 | 0 | 99.67 | HIEECSCY | 99.67 | | | | | | |
| NA | N8 | 350 | 0.04 | yes | 1 | 0 | 99.78 | IEECSCYP | 99.78 | | | | | | |
| NA | N8 | 351 | 0.02 | yes | 1 | 0 | 99.13 | EECSCYPN | 88.27 | | | | | | |
| NA | N8 | 352 | 0.58 | yes | 3 | 0 | 99.02 | ECSCYPNE | 88.17 | ECSCYPND | 10.86 | | | | |
| NA | N8 | 353 | 0.59 | yes | 3 | 0 | 99.02 | CSCYPNEG | 88.17 | CSCYPND | 10.86 | | | | |
| NA | N8 | 354 | 0.59 | yes | 3 | 0 | 99.35 | SCYPNEGK | 88.17 | SCYPNDGK | 10.86 | | | | |
| NA | N8 | 355 | 0.61 | yes | 3 | 0 | 99.35 | CYPNEGKV | 88.17 | CYPNDGKV | 10.64 | CYPNNGKV | 0.54 | | |
| NA | N8 | 356 | 0.61 | yes | 3 | 0 | 99.35 | YPNEGKVE | 88.17 | YPNDGKVE | 10.64 | YPNNGKVE | 0.54 | | |
| NA | N8 | 357 | 0.61 | yes | 3 | 0 | 99.02 | PNEGKVEC | 88.17 | PNDGKVEC | 10.64 | PNNGKVEC | 0.54 | | |
| NA | N8 | 358 | 1.2 | yes | 2 | 0 | 99.57 | NEGKVECI | 71.55 | NEGKVECV | 16.83 | NDGKVEC | 0.54 | | |
| NA | N8 | 359 | 1.2 | yes | 2 | 0 | 99.67 | EGKVECIC | 71.55 | EGKVECVC | 16.83 | DGKVECVC | 0.54 | | |
| NA | N8 | 360 | 0.71 | yes | 2 | 0 | 99.57 | GKVECICR | 82.3 | GKVECVCR | 17.26 | | | | |
| NA | N8 | 361 | 0.71 | yes | 2 | 0 | 99.67 | KVECICRD | 82.41 | KVECVCRD | 17.26 | | | | |
| NA | N8 | 362 | 0.71 | yes | 2 | 0 | 99.57 | VECICRDN | 82.3 | VECVCRDN | 17.26 | | | | |
| NA | N8 | 363 | 0.69 | yes | 2 | 0 | 99.78 | ECICRDNW | 82.52 | ECVCRDNW | 17.26 | | | | |
| NA | N8 | 364 | 0.71 | yes | 2 | 0 | 99.57 | CICRDNWT | 82.3 | CVCRDNWT | 17.26 | | | | |

FIG. 72-50

| Protein | Sub-type | Start Pos | Block Entropy | Gaps < 10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 365 | 0.71 | yes | 2 | 0 | 99.57 | VCRDNWTG | 82.3 | ICRDNWTG | 17.26 | | | | |
| NA | N8 | 366 | 0.06 | yes | 1 | 0 | 99.46 | CRDNWTGT | 99.46 | | | | | | |
| NA | N8 | 367 | 0.06 | yes | 1 | 0 | 99.57 | RDNWTGTN | 99.57 | | | | | | |
| NA | N8 | 368 | 0.05 | yes | 1 | 0 | 99.46 | DNWTGTNR | 99.46 | | | | | | |
| NA | N8 | 369 | 0.06 | yes | 1 | 0 | 99.46 | NWTGTNRP | 99.46 | | | | | | |
| NA | N8 | 370 | 0.84 | yes | 2 | 0 | 99.35 | WTGTNRPV | 99.35 | | | | | | |
| NA | N8 | 371 | 0.86 | yes | 2 | 0 | 99.24 | TGTNRPVL | 76.66 | WTGTNRPI | 22.69 | | | | |
| NA | N8 | 372 | 0.95 | yes | 2 | 0 | 99.13 | GTNRPVL | 76.55 | TGTNRPIL | 22.69 | GTNRPVLI | 1.09 | | |
| NA | N8 | 373 | — | yes | 3 | 0.33 | 99.13 | TNRPVLV | 75.46 | GTNRPILV | 22.58 | TNRPVLI | 1.09 | TNRPVLW | 0.65 | |
| NA | N8 | 374 | 1.05 | yes | 3 | 0.33 | 99.13 | NRPVLVI | 74.81 | TNRPILVI | 22.58 | NRPVLII | 1.09 | NRPVLVS | 0.65 | |
| NA | N8 | 378 | 1.04 | yes | 3 | 0.22 | 99.24 | LVISDLS | 75.27 | NRPILVIS | 22.58 | LIISPDLS | 1.09 | LVISTDLS | 0.98 | LWSPDLS | 0.65 |
| NA | N8 | 379 | 1.28 | yes | 3 | 0.33 | 99.13 | VISPDLS | 75.38 | LVISSDLS | 21.13 | IISPDLSY | 1.09 | VISTDLSY | 0.98 | WSPDLS | 0.65 |
| NA | N8 | 384 | 1.28 | yes | 3 | 0.22 | 99.24 | LSYRVGYL | 69.64 | VISSDLSY | 21.13 | LSYKVGYL | 6.09 | LSYQVGYL | 0.98 | LSYSVGYL | 0.87 |
| NA | N8 | 385 | 1.27 | yes | 3 | 0.11 | 99.13 | SYRVGYLC | 69.72 | LSYTVGYL | 21.55 | SYKVGYLC | 6.1 | SYQVGYLC | 0.98 | SYSVGYLCA | 0.87 |
| NA | N8 | 386 | 0.88 | yes | 5 | 0.22 | 99.13 | YRVGYLCA | 69.89 | SYTVGYLC | 21.46 | YKVGYLCA | 6.09 | YQVGYLCA | 0.98 | YSVGYLCA | 0.87 |
| NA | N8 | 387 | 0.82 | yes | 5 | 0.22 | 99.24 | RVGYLCAG | 69.86 | YTVGYLCAG | 21.44 | KVGYLCAG | 6.09 | QVGYLCAG | 0.98 | SVGYLCAG | 0.87 |
| NA | N8 | 388 | 0.96 | yes | 5 | 0.22 | 99.13 | VGYLCAGL | 74.43 | TVGYLCAG | 24.7 | | | | |
| NA | N8 | 389 | 0.96 | yes | 5 | 0.22 | 99.89 | GYLCAGLP | 75.19 | VGYLCAGI | 24.7 | | | | |
| NA | N8 | 390 | 0.96 | yes | 5 | 0.22 | 99.89 | YLCAGLPS | 75.19 | YLCAGIPT | 21.33 | YLCAGIPS | 3.37 | | |
| NA | N8 | 391 | 0.96 | yes | 5 | 0.22 | 99.89 | LCAGLPSD | 75.19 | LCAGIPTD | 21.33 | LCAGIPSD | 3.37 | | |
| NA | N8 | 392 | 0.97 | yes | 5 | 0.11 | 99.89 | CAGLPSDT | 75.11 | CAGIPTDT | 21.33 | CAGIPSDT | 3.37 | | |
| NA | N8 | 393 | 0.8 | yes | 4 | 0.11 | 99.78 | AGLPSDTP | 75.11 | AGIPTDTP | 21.41 | AGIPSDTP | 3.37 | | |
| NA | N8 | 394 | 0.88 | yes | 4 | 0 | 99.46 | GLPSDTPR | 75.03 | GIPTDTPR | 21.41 | GIPSDTPR | 3.37 | | |
| NA | N8 | 395 | 0.9 | yes | 4 | 0 | 99.24 | LPSDTPRG | 78.07 | IPTDTPRG | 21.39 | IPSDTPRG | 3.37 | | |
| NA | N8 | 396 | 0.9 | yes | 4 | 0 | 99.02 | PSDTPRGE | 78.07 | PTDTPRGE | 21.39 | | | | |
| NA | N8 | 397 | 0.89 | yes | 3 | 0 | 99.02 | SDTPRGED | 83.6 | TDTPRGED | 10.53 | DTPRGEDN | 4.13 | DTPRGEDG | 0.98 | |
| NA | N8 | 398 | 0.07 | yes | 1 | 0 | 99.13 | DTPRGEDS | 83.5 | DTPRGEDA | 10.42 | TPRGEDNQ | 4.13 | TPRGEDGQ | 0.98 | |
| NA | N8 | 400 | 0.01 | yes | 1 | 0 | 99.35 | TPRGEDSQ | 83.5 | TPRGEDAQ | 10.42 | PRGEDNQF | 4.13 | PRGEDGQF | 0.98 | |
| NA | N8 | 418 | 0.01 | yes | 1 | 0 | 99.89 | PRGEDSQF | 77.72 | PRGEDAQF | 20.54 | LGYGVKGF | 0.87 | | |
| NA | N8 | 419 | 0.01 | yes | 1 | 0 | 99.89 | QGYGVKGF | 99.35 | KGYGVKGF | 0.87 | | | | |
| NA | N8 | 420 | 0 | yes | 1 | 0 | 100 | GYGVKGFG | 99.89 | | | | | | |
| NA | N8 | 421 | 0.99 | yes | 3 | 0.11 | 99.13 | YGVKGFGF | 99.89 | | | | | | |
| NA | N8 | 422 | 0.01 | yes | 3 | 0 | 99.89 | GVKGFGFR | 100 | GFGFRQGT | 27.17 | GFGFRQGD | 0.87 | | |
| NA | N8 | 423 | 0.01 | yes | 4 | 0.11 | 99.89 | VKGFGFRQ | 71.09 | FGFRQGTD | 27.07 | FGFRQGDD | 0.87 | GFRQGSDV | 0.65 | |
| NA | N8 | 424 | 1.01 | yes | 4 | 0.11 | 99.57 | KGFGFRQG | 71.09 | GFRQGTDV | 26.96 | GFRQGDDY | 0.87 | FRQGSDYW | 0.65 | GFRQGSDV | 0.65 |
| NA | N8 | 425 | 1.01 | yes | 4 | 0.11 | 99.57 | GFGFRQGN | 71.09 | FRQGTDVW | 26.96 | FRQGDDYW | 0.87 | DVWMGRTL | 0.98 | FRQGSDYW | 0.65 |
| NA | N8 | 426 | 1.1 | yes | 5 | 0.11 | 99.46 | FGFRQGND | 71.09 | RQGTDVW | 26.96 | RQGDDYW | 0.87 | DVWMGRTIS | 0.98 | DVWMGRTL | 1.09 |
| NA | N8 | 432 | 1.14 | yes | 5 | 0.11 | 99.57 | FRQGNDVW | 74.38 | DVWAGRTI | 20.74 | DVWIGRTI | 2.28 | VWMGRTIS | 0.98 | VWMGRTIS | 0.98 |
| NA | N8 | 433 | 1.14 | yes | 5 | 0.11 | 99.57 | RQGNDVW | 74.27 | VWAGRTIS | 20.52 | VWIGRTIS | 2.28 | RTSRTGFE | 0.54 | RTSRTGFE | 0.33 |
| NA | N8 | 441 | 0.31 | yes | 5 | 0 | 99.13 | DVWMGRTI | 99.46 | | | | | | |
| NA | N8 | | | yes | | 0 | 99.13 | VWMGRTIS | 99.02 | | | | | | |
| NA | N8 | | | yes | | 0 | 99.13 | RTSRSGFE | 96.63 | QTSRSGFE | 0.87 | LTSRSGFE | 0.76 | | |

| Protein | Sub-type | Start Pos | Block Entropy | Gaps <10% | # of cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 541 | 1 | no | 2 | 99.78 | 100 | FDIDKIIT | 50 | FDFDKIISQ | 50 | | | | |
| NA | N9 | 1 | 0.09 | no | 2 | 13.57 | 99.48 | MNPNQKIL | 98.95 | MNPNQRIL | 0.52 | | | | |
| NA | N9 | 2 | 0.21 | no | 3 | 13.57 | 99.48 | NPNQKILC | 97.38 | NPNQKILF | 1.57 | | | | |
| NA | N9 | 3 | 0.36 | no | 4 | 13.12 | 99.48 | PNQKILCT | 95.31 | PNQKILCA | 2.08 | PNQKIQCT | 0.52 | | |
| NA | N9 | 4 | 0.38 | yes | 4 | 8.14 | 99.01 | NQKILCTS | 95.07 | NQKILCAS | 1.97 | SQKILCTS | 1.56 | | |
| NA | N9 | 5 | 0.34 | yes | 3 | 8.14 | 99.01 | QKILCTSA | 95.57 | QKILCASA | 1.97 | | | | |
| NA | N9 | 6 | 0.52 | yes | 5 | 7.24 | 99.01 | KILCTSAT | 93.17 | KILCTSAI | 1.95 | KILFASAT | 1.46 | RILCTSAT | 0.49 |
| NA | N9 | 7 | 0.47 | yes | 5 | 7.24 | 99.02 | ILCTSAT | 93.66 | ILCTSAIA | 1.95 | ILFASATA | 1.46 | LFASATAI | 1.44 |
| NA | N9 | 8 | 0.58 | yes | 5 | 5.88 | 99.02 | LCTSATAI | 92.31 | LCASATAI | 1.92 | LCTSATAI | 1.44 | GTANLGLN | 0.45 |
| NA | N9 | 25 | 0.83 | yes | 5 | 0 | 99.04 | GIANLGLN | 85.97 | GIVNLGLN | 6.33 | GITNLGLN | 0.9 | | |
| NA | N9 | 27 | 0.45 | yes | 3 | 0 | 99.1 | ANLGLGN | 92.76 | ANLGLNVG | 5.43 | | | | |
| NA | N9 | 28 | 0.12 | yes | 2 | 0 | 99.55 | NLGLNIGL | 98.64 | NLGLNVGL | 0.9 | | | | |
| NA | N9 | 29 | 0.12 | yes | 2 | 0 | 99.55 | LGLNIGLH | 98.64 | LGLNVGLH | 0.9 | | | | |
| NA | N9 | 30 | 0.12 | yes | 2 | 0 | 99.55 | GLNIGLHL | 98.64 | GLNVGLHL | 0.9 | | | | |
| NA | N9 | 31 | 0.32 | yes | 3 | 0 | 99.55 | LNIGLHLR | 95.48 | LNVGLHLR | 3.17 | | | | |
| NA | N9 | 32 | 0.36 | yes | 3 | 0 | 99.55 | NIGLHLRP | 95.02 | NVGLHLRP | 3.17 | | | | |
| NA | N9 | 54 | 0.35 | yes | 3 | 0 | 99.55 | SQTIINNY | 95.02 | SQIIINNY | 3.62 | | | | |
| NA | N9 | 55 | 0.44 | yes | 3 | 0 | 99.1 | QTVINNYY | 93.67 | QTIINNYY | 3.62 | | | | |
| NA | N9 | 56 | 0.4 | yes | 4 | 0 | 99.1 | TVINNYYN | 94.12 | TIINNYYN | 3.62 | | | | |
| NA | N9 | 57 | 0.61 | yes | 4 | 0 | 99.55 | VINNYYNE | 90.95 | IINNYYNE | 2.71 | IINNYHNE | 0.9 | | |
| NA | N9 | 58 | 0.43 | yes | 4 | 0 | 99.1 | INNYYNKT | 94.12 | INNYHNET | 1.81 | INNYYNDT | 0.9 | | |
| NA | N9 | 59 | 0.47 | yes | 4 | 0 | 99.55 | NNYYNETN | 93.67 | NNYHNETN | 1.81 | NNYYNDTN | 0.9 | | |
|

FIG. 72-53

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 103 | 0.42 | yes | 2 | 0 | 100 | KDNAVRIG | 91.4 | KDNAIRIG | 91.4 | | | | |
| NA | N9 | 104 | 0.45 | yes | 2 | 0 | 99.55 | DNAVRIGE | 91.4 | DNAIRIGE | 91.4 | | | | |
| NA | N9 | 105 | 1.45 | yes | 5 | 0 | 99.1 | NAVRIGED | 54.75 | NAVRIGEN | 35.75 | NAIRIGED | 7.24 | NAVRIGEK | 0.45 |
| NA | N9 | 106 | 1.45 | yes | 5 | 0 | 99.1 | AVRIGEDS | 54.75 | AIRIGENS | 35.75 | AIRIGEDS | 7.24 | AVRIGESS | 0.45 |
| NA | N9 | 107 | 1.49 | yes | 5 | 0 | 99.1 | RIGEDSDV | 46.61 | RIGEDSDI | 42.53 | RIGGNSDV | 9.05 | RIGENSGV | 0.45 |
| NA | N9 | 108 | 1.49 | yes | 5 | 0 | 99.1 | IGEDSDVL | 46.61 | IGEDSDIL | 42.53 | IGENSGVL | 9.05 | IGESSDVL | 0.45 |
| NA | N9 | 109 | 1.49 | yes | 5 | 0 | 99.1 | GEDSDVLV | 46.61 | GEDSDILV | 42.53 | GGNSDVLV | 9.05 | GENSGVLV | 0.45 |
| NA | N9 | 110 | 1.49 | yes | 5 | 0 | 99.1 | EDSDVLVT | 46.61 | EDSDILVT | 42.53 | ENSGVLVT | 9.05 | ESSDVLVT | 0.45 |
| NA | N9 | 111 | 1.46 | yes | 4 | 0 | 99.1 | DSDVLVTR | 46.61 | DSDILVTR | 42.99 | SSDVLVTR | 9.05 | | |
| NA | N9 | 112 | 0.48 | yes | 2 | 0 | 99.1 | SDVLVTRE | 90.5 | | | | | | |
| NA | N9 | 113 | 0.52 | yes | 2 | 0 | 99.55 | DVLVTREP | 90.05 | | | | | | |
| NA | N9 | 114 | 0.48 | yes | 2 | 0 | 99.55 | VLVTREPY | 90.5 | | | | | | |
| NA | N9 | 115 | 0.04 | yes | 1 | 0 | 99.55 | LVTREPYY | 99.55 | | | | | | |
| NA | N9 | 116 | 0.04 | yes | 1 | 0 | 99.55 | VTREPYYS | 99.55 | | | | | | |
| NA | N9 | 117 | 0.17 | yes | 2 | 0 | 99.55 | TREPYYSC | 97.74 | | | | | | |
| NA | N9 | 118 | 0.25 | yes | 3 | 0 | 99.1 | REPYYSCE | 97.74 | REPYYSCE | 1.81 | | | | |
| NA | N9 | 119 | 0.33 | yes | 3 | 0 | 99.55 | EPYYSCEP | 96.83 | EPYYSCEP | 1.81 | | | | |
| NA | N9 | 120 | 0.33 | yes | 4 | 0 | 99.55 | PYYSCEPD | 95.48 | PYYSCDPN | 1.81 | | | | |
| NA | N9 | 121 | 0.38 | yes | 4 | 0 | 99.55 | YYSCEPDE | 95.48 | YYSCEPDE | 1.81 | | | | |
| NA | N9 | 122 | 0.38 | yes | 4 | 0 | 99.55 | YSCEPDEC | 95.02 | YSCEPDEC | 1.81 | | | | |
| NA | N9 | 123 | 0.25 | yes | 3 | 0 | 99.55 | SCEPDECR | 95.02 | SCDPNECR | 1.81 | | | | |
| NA | N9 | 124 | 0.25 | yes | 3 | 0 | 99.55 | CEPDECRF | 95.02 | CDPNECRF | 1.81 | | | | |
| NA | N9 | 125 | 0.17 | yes | 2 | 0 | 99.55 | EPDECRFY | 96.83 | DPNECRFY | 1.81 | | | | |
| NA | N9 | 126 | 0.04 | yes | 2 | 0 | 99.1 | PDECRFYA | 97.74 | PNECRFYA | 1.81 | | | | |
| NA | N9 | 127 | 0.04 | yes | 1 | 0 | 99.55 | DECRFYAL | 99.55 | NECRFYAL | 1.81 | | | | |
| NA | N9 | 128 | 0 | yes | 1 | 0 | 99.55 | ECRFYALS | 99.55 | | | | | | |
| NA | N9 | 129 | 0.04 | yes | 2 | 0 | 100 | CRFYALSQ | 100 | | | | | | |
| NA | N9 | 130 | 0 | yes | 1 | 0 | 100 | RFYALSQG | 100 | | | | | | |
| NA | N9 | 131 | 0.04 | yes | 2 | 0 | 99.55 | FYALSQGT | 99.55 | | | | | | |
| NA | N9 | 132 | 0.04 | yes | 2 | 0 | 99.55 | YALSQGTT | 99.55 | | | | | | |
| NA | N9 | 133 | 0.04 | yes | 2 | 0 | 99.55 | ALSQGTTI | 99.55 | | | | | | |
| NA | N9 | 134 | 0.29 | yes | 2 | 0 | 99.55 | LSQGTTIR | 95.48 | QGTTIRGR | 4.07 | | | | |
| NA | N9 | 135 | 0.29 | yes | 2 | 0 | 99.55 | SQGTTIRG | 95.48 | GTTIRGRH | 4.07 | | | | |
| NA | N9 | 136 | 0.29 | yes | 2 | 0 | 99.55 | QGTTIRGK | 95.48 | TTIRGRHS | 4.07 | | | | |
| NA | N9 | 137 | 0.29 | yes | 2 | 0 | 99.55 | GTTIRGKH | 95.48 | TIRGRHSN | 4.07 | | | | |
| NA | N9 | 138 | 0.29 | yes | 2 | 0 | 99.55 | TTIRGKHS | 95.48 | IRGRHSNG | 4.07 | | | | |
| NA | N9 | 139 | 0.25 | yes | 2 | 0 | 100 | TIRGKHSN | 95.93 | RGRHSNGT | 4.07 | | | | |
| NA | N9 | 140 | 0.25 | yes | 2 | 0 | 100 | IRGKHSNG | 95.93 | GRHSNGTI | 4.07 | | | | |
| NA | N9 | 141 | 0.29 | yes | 2 | 0 | 100 | RGKHSNGT | 95.93 | RHSNGTIH | 4.07 | | | | |
| NA | N9 | 142 | 0.25 | yes | 2 | 0 | 100 | GKHSNGTI | 95.93 | | | | | | |
| NA | N9 | 143 | 0.25 | yes | 2 | 0 | 100 | KHSNGTIH | 95.93 | | | | | | |
| NA | N9 | 144 | 0.25 | yes | 2 | 0 | 100 | HSNGTIHD | 95.93 | | | | | | |
| NA | N9 | 145 | 0 | yes | 1 | 0 | 100 | SNGTIHD | 100 | | | | | | |

FIG. 72-54

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 146 | 0 | yes | 1 | 0 | 100 | SNGTIHDR | 100 |

FIG. 72-55

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 198 | 0.08 | yes | 1 | 0 | 99.1 | GPNNASA | 99.1 | PNNNASAI | 2.26 | | | | |
| NA | N9 | 199 | 0.24 | yes | 2 | 0 | 99.1 | PNNNASAV | 96.83 | NNNASAIV | 35.29 | NNNASTVI | 1.81 | | |
| NA | N9 | 200 | 1.17 | yes | 4 | 0 | 99.1 | NNNASAVI | 61.54 | NNASAVVW | 35.29 | NNASAIIW | 1.81 | | |
| NA | N9 | 201 | 1.17 | yes | 4 | 0 | 99.1 | NNASAVIW | 61.54 | NASAVVWY | 35.29 | NASTVIWY | 1.81 | | |
| NA | N9 | 202 | 1.17 | yes | 4 | 0 | 99.1 | NASAVIWY | 61.54 | ASAVVWYN | 35.29 | ASAVIWYK | 1.81 | | |
| NA | N9 | 203 | 1.29 | yes | 5 | 0 | 99.1 | ASAVIWYN | 59.73 | | | | | | |
| NA | N9 | 211 | 1.22 | yes | 4 | 0 | 99.1 | RRPVTEIN | 73.3 | RRPVAEIN | 18.55 | KRPVTEIN | 4.52 | ASPVIWYN | 0.45 |
| NA | N9 | 212 | 1.07 | yes | 4 | 0 | 99.1 | RPVTEINT | 75.11 | RPVAEINT | 18.55 | RPTTEINT | 4.98 | GRPTTEIN | 0.9 |
| NA | N9 | 213 | 1.1 | yes | 4 | 0 | 99.1 | PVTEINTW | 75.11 | PVAEINTW | 18.55 | PTTEINTW | 4.98 | | |
| NA | N9 | 214 | 0.76 | yes | 2 | 0 | 99.1 | VTEINTWA | 75.11 | VAEINTWA | 18.1 | TTEINTWA | 4.98 | | |
| NA | N9 | 215 | 0.08 | yes | 1 | 0 | 99.1 | TEINTWAR | 81 | AEINTWAR | 18.1 | | | | |
| NA | N9 | 216 | 0.08 | yes | 1 | 0 | 99.1 | EINTWARN | 99.1 | | | | | | |
| NA | N9 | 217 | 0.04 | yes | 1 | 0 | 99.55 | INTWARNI | 99.1 | | | | | | |
| NA | N9 | 218 | 0.04 | yes | 1 | 0 | 99.55 | NTWARNIL | 99.55 | | | | | | |
| NA | N9 | 219 | 0.04 | yes | 1 | 0 | 99.55 | TWARNILR | 99.55 | | | | | | |
| NA | N9 | 220 | 0.04 | yes | 1 | 0 | 99.55 | WARNILRT | 99.55 | | | | | | |
| NA | N9 | 221 | 0.04 | yes | 1 | 0 | 99.55 | ARNILRTQ | 99.55 | | | | | | |
| NA | N9 | 222 | 0.04 | yes | 1 | 0 | 99.55 | RNILRTQE | 99.55 | | | | | | |
| NA | N9 | 223 | 0.04 | yes | 1 | 0 | 99.55 | NILRTQES | 99.55 | | | | | | |
| NA | N9 | 224 | 0.04 | yes | 1 | 0 | 99.55 | ILRTQESE | 99.55 | | | | | | |
| NA | N9 | 225 | 0.04 | yes | 1 | 0 | 99.55 | LRTQESEC | 99.55 | | | | | | |
| NA | N9 | 226 | 0.04 | yes | 1 | 0 | 99.55 | RTQESECV | 99.55 | | | | | | |
| NA | N9 | 227 | 0.08 | yes | 1 | 0 | 99.1 | TQESECVC | 99.1 | | | | | | |
| NA | N9 | 228 | 0.19 | yes | 2 | 0 | 99.1 | QESECVCH | 97.74 | ESECVCHS | 1.36 | | | | |
| NA | N9 | 229 | 0.19 | yes | 2 | 0 | 99.55 | ESECVCHN | 97.74 | SECVCHSG | 1.36 | ECVCHSGI | 0.9 | | |
| NA | N9 | 230 | 0.44 | yes | 4 | 0 | 99.55 | SECVCHNG | 93.67 | ECVCHNGI | 4.07 | CVCHSGIC | 0.9 | ECVCQNGV | 0.45 |
| NA | N9 | 231 | 0.44 | yes | 4 | 0 | 99.55 | ECVCHNGV | 93.67 | CVCHNGIC | 4.07 | VCHSGICP | 0.9 | CVCHDGVC | 0.45 |
| NA | N9 | 232 | 0.44 | yes | 4 | 0 | 99.55 | CVCHNGVC | 93.67 | VCHNGICP | 4.07 | CHSGICPV | 0.9 | VCHDGVCP | 0.45 |
| NA | N9 | 233 | 0.46 | yes | 5 | 0 | 99.55 | VCHNGVCP | 93.67 | CHNGICPV | 3.62 | HSGICPVW | 0.9 | CQNGVCPV | 0.45 |
| NA | N9 | 234 | 0.42 | yes | 4 | 0 | 94.12 | CHNGVCPV | 94.12 | HNGICPVW | 3.62 | SGICPVWF | 0.9 | HNGICPVA | 0.45 |
| NA | N9 | 235 | 0.31 | yes | 2 | 0 | 95.02 | HNGVCPVW | 95.02 | NGICPVWF | 4.52 | | | SGVCPVWF | 0.45 |
| NA | N9 | 236 | 0.31 | yes | 2 | 0 | 95.02 | NGVCPVWF | 95.02 | GICPVWFT | 4.52 | | | HDGVCPVW | 0.45 |
| NA | N9 | 237 | 0.04 | yes | 1 | 0 | 99.55 | GVCPVWFT | 99.55 | ICPVWFTD | | | | | |
| NA | N9 | 238 | 0.04 | yes | 1 | 0 | 99.1 | VCPVWFTD | 99.1 | | | | | | |
| NA | N9 | 239 | 0.04 | yes | 1 | 0 | 99.55 | CPVWFTDG | 99.55 | | | | | | |
| NA | N9 | 240 | 0.04 | yes | 1 | 0 | 99.55 | PVWFTDGS | 99.55 | | | | | | |
| NA | N9 | 241 | 0.04 | yes | 1 | 0 | 99.55 | VWFTDGSA | 99.55 | | | | | | |
| NA | N9 | 242 | 0.04 | yes | 1 | 0 | 99.55 | WFTDGSAT | 99.55 | | | | | | |
| NA | N9 | 243 | 0.08 | yes | 1 | 0 | 99.1 | FTDGSATG | 99.1 | | | | | | |
| NA | N9 | 244 | 0.04 | yes | 1 | 0 | 99.55 | TDGSATGP | 99.55 | | | | | | |
| NA | N9 | 245 | 0.04 | yes | 1 | 0 | 99.55 | DGSATGPA | 99.55 | | | | | | |
| NA | N9 | 246 | 0.7 | yes | 2 | 0 | 99.55 | GSATGPAE | 82.35 | GSATGPAD | 17.19 | | | | |

FIG. 72-56

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 247 | 0.7 | yes | 2 | 0 | 99.55 | SATGPAET | 99.55 | SATGPADT | 17.19 | | | | |
| NA | N9 | 248 | 0.7 | yes | 2 | 0 | 99.55 | ATGPAETR | 99.55 | ATGPADTR | 17.19 | | | | |
| NA | N9 | 249 | 1.62 | yes | 4 | 0 | 99.55 | TGPAETRV | 99.55 | TGPADTRI | 27.6 | TGPADTRV | 10.86 | | |

FIG. 72-57

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | N9 | 317 | 0.08 | yes | 1 | 0 | 99.1 | QYICSPVL | 99.1 | | | | | | | | |
| NA | N9 | 318 | 0.08 | yes | 1 | 0 | 99.1 | YICSPVLT | 99.1 | | | | | | | | |
| NA | N9 | 319 | 0.08 | yes | 1 | 0 | 99.1 | ICSPVLTD | 99.1 | | | | | | | | |
| NA | N9 | 320 | 0.04 | yes | 1 | 0 | 99.55 | CSPVLTDN | 99.55 | | | | | | | | |
| NA | N9 | 321 | 0.04 | yes | 1 | 0 | 99.55 | SPVLTDNP | 99.55 | | | | | | | | |
| NA | N9 | 322 | 0.04 | yes | 1 | 0 | 99.55 | PVLTDNPR | 99.55 | | | | | | | | |
| NA | N9 | 323 | 0.04 | yes | 1 | 0 | 99.55 | VLTDNPRP | 99.55 | | | | | | | | |
| NA | N9 | 324 | 0 | yes | 1 | 0 | 100 | LTDNPRPN | 100 | | | | | | | | |
| NA | N9 | 325 | 0.04 | yes | 1 | 0 | 99.55 | TDNPRPND | 99.55 | | | | | | | | |
| NA | N9 | 326 | 0.04 | yes | 1 | 0 | 99.55 | DNPRPNDP | 99.55 | | | | | | | | |
| NA | N9 | 327 | 1.85 | yes | 3 | 0 | 99.1 | NPRPNDPA | 40.72 | NPRPNDPT | 33.03 | NPRPNDPV | 19.91 | NPRPNDPS | 4.52 | | 0.9 |
| NA | N9 | 335 | 0.67 | yes | 2 | 0 | 99.55 | VGKCNDPY | 85.52 | IGKCNDPY | 13.12 | | 0.9 | | | | |
| NA | N9 | 336 | 0.1 | yes | 2 | 0 | 100 | GKCNDPYP | 98.64 | GKCNEPYP | 1.36 | | | | | | |
| NA | N9 | 337 | 0.1 | yes | 2 | 0 | 100 | KCNDPYPG | 98.64 | KCNEPYPG | 1.36 | | | | | | |
| NA | N9 | 338 | 0.15 | yes | 2 | 0 | 99.55 | CNDPYPGN | 98.19 | CNEPYPGN | 1.36 | | | | | | |
| NA | N9 | 339 | 0.19 | yes | 3 | 0 | 99.1 | NDPYPGNN | 97.74 | NEPYPGNN | 1.36 | | | | | | |
| NA | N9 | 340 | 0.23 | yes | 4 | 0 | 99.1 | DPYPGNNN | 97.29 | EPYPGNNN | 1.36 | DPYPGNNN | 0.45 | | | | |
| NA | N9 | 341 | 0.21 | yes | 4 | 0 | 99.1 | PYPGNNNK | 97.74 | PYPGNNNK | 1.36 | PYPGNSNN | 0.45 | | | | |
| NA | N9 | 342 | 0.21 | yes | 4 | 0 | 99.1 | YPGNNNNG | 97.74 | YPGNNNNG | 1.36 | YPGNSNNG | 0.45 | | | | |
| NA | N9 | 343 | 0.21 | yes | 4 | 0 | 99.1 | PGNNNNGV | 97.74 | PGNNBNGV | 1.36 | PGNSNNGV | 0.45 | | | | |
| NA | N9 | 344 | 0.17 | yes | 3 | 0 | 99.1 | GNNNNGVK | 98.18 | GNNBNGVK | 1.36 | GNNNKGVK | 0.45 | | | | |
| NA | N9 | 345 | 0.13 | yes | 2 | 0 | 99.55 | NNNNGVKG | 98.64 | SNNNGVKG | 1.36 | | | | | | |
| NA | N9 | 346 | 0.15 | yes | 3 | 0 | 99.1 | NNNGVKGF | 97.74 | NBNGVKGF | 1.36 | | | | | | |
| NA | N9 | 347 | 0.1 | yes | 2 | 0 | 100 | NNGVKGFS | 98.19 | NNGWKGFA | 1.36 | | | | | | |
| NA | N9 | 348 | 0.41 | yes | 3 | 0.45 | 99.55 | NGVKGFSY | 98.64 | GVKGFAY | 1.36 | | | | | | |
| NA | N9 | 349 | 0.48 | yes | 5 | 0 | 100 | GVKGFSYL | 93.21 | VKGFAYL | 5.43 | | | | | | |
| NA | N9 | 350 | 1.61 | yes | 4 | 0 | 99.1 | VKGFSYLD | 92.31 | KGFAYLDG | 5.43 | VKGFAYLD | 1.36 | | | | |
| NA | N9 | 351 | 0.13 | yes | 3 | 0 | 99.1 | KGFSYLDG | 58.37 | DNTWLGRT | 24.89 | KGFAYLDG | 11.31 | FNTWLGRT | 3.62 | | 0.9 |
| NA | N9 | 359 | 0.32 | yes | 5 | 0.45 | 99.09 | NTWLGRTI | 98.64 | VNTWLGRT | 0.45 | SNTWLGRT | 1.36 | | | | |
| NA | N9 | 360 | 0.32 | yes | 4 | 0.45 | 99.09 | TWLGRTIS | 98.18 | TWLGRTIN | 0.45 | WVGRTISI | 0.45 | | | | |
| NA | N9 | 361 | 0.31 | yes | 3 | 0.45 | 99.09 | WLGRTISI | 95.91 | WLGRTIS | 2.27 | LGRTLNTA | 0.45 | | | | |
| NA | N9 | 362 | 0.31 | yes | 5 | 0.45 | 99.09 | LGRTISIA | 95.91 | LGRTISIA | 2.27 | VGRTISIA | 0.45 | | | | |
| NA | N9 | 363 | 0.31 | yes | 3 | 0.45 | 99.09 | GRTISIAS | 95.91 | GRTISIAS | 2.73 | GRTLNTAS | 0.45 | | | | |
| NA | N9 | 364 | 0.31 | yes | 3 | 0.45 | 99.09 | RTISIASR | 95.91 | RTIISIASR | 2.73 | RTLNTASR | 0.45 | | | | |
| NA | N9 | 365 | 0.39 | yes | 5 | 0.45 | 99.09 | TISIASRS | 95 | TISIASRA | 2.73 | TLNTASRS | 0.45 | TTSTASRS | 0.45 | | |
| NA | N9 | 366 | 0.39 | yes | 5 | 0.45 | 99.09 | ISIASRSG | 95 | ISIASRSG | 2.73 | LNTASRSG | 0.45 | LNTASRSG | 0.45 | | |
| NA | N9 | 367 | 0.39 | yes | 4 | 0.45 | 99.09 | SIASRSGY | 95.48 | SIASRSGY | 2.71 | NTASRSG | 0.45 | | | | |
| NA | N9 | 368 | 0.34 | yes | 3 | 0.45 | 99.09 | STASRSGY | 96.36 | IASRSGYE | 2.73 | NTASRGY | 0.45 | | | | |
| NA | N9 | 369 | 0.26 | yes | 2 | 0 | 99.1 | TASRSGYE | 98.18 | ASRSGYEV | 0.45 | ASRGYEV | 0.45 | | | | |
| NA | N9 | 370 | 0.17 | yes | 3 | 0.45 | 99.09 | ASRSGYEM | 98.18 | SRGYEML | 0.45 | SRYGYEML | 0.45 | | | | |
| NA | N9 | 371 | 0.17 | yes | 3 | 0.45 | 99.09 | SRSGYEML | 98.18 | SRGYEML | 0.45 | RYGYEMLK | 0.45 | | | | |
| NA | N9 | 372 | 0.17 | yes | 3 | 0.45 | 99.09 | RSGYEMLK | 98.18 | RSGYEILK | 0.45 | RYGYEMLK | 0.45 | | | | |

FIG. 72-58

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 373 | 0.17 | yes | 3 | 0.45 | 99.09 | SGYEMLKV

FIG. 72-59

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 421 | 0 | yes | 1 | 0.45 | 100 | RACFYVEL | 100 | | | | | | |
| NA | N9 | 422 | 0 | yes | 1 | 0.9 | 100 | ACFYVELI | 100 | | | | | | |
| NA | N9 | 423 | 0 | yes | 1 | 0.45 | 100 | CFYVELIR | 100 | | | | | | |
| NA | N9 | 424 | 0 | yes | 1 | 0.45 | 100 | FYVELIRG | 100 | | | | | | |
| NA | N9 | 425 | 0 | yes | 1 | 0.45 | 100 | YVELIRGR | 100 | | | | | | |
| NA | N9 | 426 | 0 | yes | 1 | 0.45 | 100 | VELIRGRP | 100 | | | | | | |
| NA | N9 | 427 | 0 | yes | 1 | 0.45 | 100 | ELIRGRPK | 100 | | | | | | |
| NA | N9 | 428 | 0 | yes | 1 | 0.45 | 100 | LIRGRPKE | 100 | | | | | | |
| NA | N9 | 429 | 0.13 | yes | 2 | 0 | 99.1 | IRGRPKED | 98.18 | IRGRPKEE | 1.82 | | | | |
| NA | N9 | 430 | 0.31 | yes | 3 | 0 | 99.55 | RGRPKEDK | 95.93 | RGRPKEEK | 1.81 | RGRPKEDR | 1.36 | | |
| NA | N9 | 431 | 0.35 | yes | 4 | 0 | 99.55 | GRPKEDKV | 95.48 | GRPKEEKV | 1.81 | GRPKEDRV | 1.36 | GRPKEDEV | 0.9 |
| NA | N9 | 432 | 0.35 | yes | 4 | 0 | 99.1 | RPKEDKVW | 95.48 | RPKEEKVW | 1.81 | RPKEDRVW | 1.36 | RPKEDEVW | 0.9 |
| NA | N9 | 433 | 0.39 | yes | 4 | 0 | 99.1 | PKEDKVWW | 95.02 | PKEEKVWW | 1.81 | PKEDRVWW | 1.36 | PKEDEVWW | 0.9 |
| NA | N9 | 434 | 0.39 | yes | 4 | 0 | 99.1 | KEDKVWWT | 95.02 | KEEKVWWT | 1.81 | KEDRVWWT | 1.36 | KEDEVWWT | 0.9 |
| NA | N9 | 435 | 0.39 | yes | 4 | 0 | 99.1 | EDKVWWTS | 95.02 | EEKVWWTS | 1.81 | EDRVWWTS | 1.36 | EDEVWWTS | 0.9 |
| NA | N9 | 436 | 0.26 | yes | 3 | 0 | 99.1 | DKVWWTSN | 95.02 | EKVWWTSN | 1.81 | DRVWWTSN | 1.36 | DEVWWTSN | 0.9 |
| NA | N9 | 437 | 0.08 | yes | 2 | 0 | 99.55 | KVWWTSNS | 96.83 | RVWWTSNS | 1.36 | | | | |
| NA | N9 | 438 | 0.12 | yes | 2 | 0.45 | 99.09 | VWWTSNSI | 99.1 | | | | | | |
| NA | N9 | 439 | 0.07 | yes | 1 | 0.45 | 99.09 | WWTSNSIV | 98.64 | WWTSNSII | 0.91 | | | | |
| NA | N9 | 440 | 0.07 | yes | 1 | 0.45 | 99.09 | WTSNSIVS | 98.64 | WTSNSIIS | 0.91 | | | | |
| NA | N9 | 441 | 0.07 | yes | 1 | 0.9 | 99.09 | TSNSIVSM | 99.09 | | | | | | |
| NA | N9 | 442 | 0.12 | yes | 2 | 0.9 | 99.09 | SNSIVSMC | 99.09 | | | | | | |
| NA | N9 | 443 | 0.08 | yes | 2 | 0.9 | 99.09 | NSIVSMCS | 99.09 | | | | | | |
| NA | N9 | 444 | 0.08 | yes | 2 | 0.9 | 99.09 | SIVSMCSS | 99.09 | | | | | | |
| NA | N9 | 445 | 0.09 | yes | 2 | 0.9 | 99.07 | IVSMCSST | 98.63 | IISMCSST | 0.91 | | | | |
| NA | N9 | 446 | 0.37 | yes | 2 | 2.71 | 93.98 | VSMCSSTE | 98.63 | ISMCSSTE | 0.91 | | | | |
| NA | N9 | 447 | 0.33 | yes | 2 | 2.26 | 94.42 | SMCSSTEF | 99.09 | | | | | | |
| NA | N9 | 448 | 0.33 | yes | 2 | 2.71 | 94.88 | MCSSTEFL | 99.09 | | | | | | |

FIG. 72-60

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 463 | 0.27 | no | 3 | 14.03 | 99.47 | GAKIEYFL | 96.32 | GAKIEYFL | 2.63 | |

FIG. 72-61

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H0 | 169 | 0.48 | yes | 4 | 0 | 99.19 | QNFPQTA

FIG. 72-62

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 234 | 0.34 | yes | 5 | 0 | 99.6 | NGQSGRID | 95.95 | NGQSGRIN | 1.21 | NGQRGRID | 0.81 | NGQSGRIV

FIG. 72-63

| Protein | Sub-type | Start Pos | Block Entropy | Gaps <10% | # to cover 99% | % Gap | Coverage | Included peptides | Freq | Included peptides | Freq | Included peptides | Freq | Included peptides | Freq | Included peptides | Freq |
|---|---|---|---|---|---|---|---|---|---|---|---|---|---|---|---|---|---|
| HA | H10 | 308 | 0.08 | yes | 1 | 0 | 99.19 | SPRTVGQC | 99.19 | | | | | | | | |
| HA | H10 | 309 | 0.08 | yes | 1 | 0 | 99.19 | PRTVGQCP | 99.19 |

FIG. 72-64

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 365 | 0.16 | yes | 2 | 0.4 | 99.59 | RHQNAQGT | 97.97 | RHQNAQGI | 1.63 | | | | |
| HA | H10 | 366 | 0.16 | yes | 2 | 0 | 99.6 | HQNAQGTG | 97.98 | HQNAQGIG | 1.62 | | | | |
| HA | H10 | 367 | 0.2 | yes | 2 | 0 | 99.19 | QNAQGTGQ |

FIG. 72-65

| Protein | Sub-type | Start Pos | Block Entropy | Gaps >10% | # to cover 99% | % Gap | Coverage | Peptides included | freq | Peptides included | freq | Peptides included | freq | Peptides included | freq | Peptides included | freq |
|---|---|---|---|---|---|---|---|---|---|---|---|---|---|---|---|---|---|
| HA | H10 | 412 | 0.29 | yes | 4 | 0 | 99.6 | EIEHQIGN | 96.36 | ETEHQIGN | 1.62 | EIEHQISN | 0.81 | | | | |
| HA | H10 | 413 | 0.25 | yes | 3 | 0 | 99.19 | IEHQIGNV | 96.76 | TEHQIGNV | 1.62 | IEYQIGNV | 0.81 | EIEYQIGN | 0.81 | | |
| HA | H10 | 414 | 0.14 | yes | 2 | 0 | 99.19 | EHQIGNVI | 98.38 | EYQIGNVI | 0.81 | | | | | | |
| HA | H10 | 415 | 0.14 | yes | 2 | 0 | 99.19 | HQIGNVIN | 98.38 | YQIGNVIN | 0.81 | | | | | | |
| HA | H10 | 416 | 0.07 | yes | 1 | 0 | 99.19 | QIGNVINW | 99.19 | | | | | | | | |
| HA | H10 | 417 | 0.07 | yes | 1 | 0 | 99.19 | IGNVINWT | 99.19 | | | | | | | | |
| HA | H10 | 418 | 0.07 | yes | 1 | 0 | 99.19 | GNVINWTK | 99.19 | | | | | | | | |
| HA | H10 | 419 | 0 | yes | 1 | 0 | 100 | NVINWTKD | 100 | | | | | | | | |
| HA | H10 | 420 | 0 | yes | 1 | 0 | 100 | VINWTKDS | 100 | | | | | | | | |
| HA | H10 | 421 | 0 | yes | 1 | 0 | 100 | INWTKDSI | 100 | | | | | | | | |
| HA | H10 | 422 | 0.07 | yes | 1 | 0 | 99.19 | NWTKDSIT | 99.19 | | | | | | | | |
| HA | H10 | 423 | 0.07 | yes | 1 | 0 | 99.19 | WTKDSITD | 99.19 | | | | | | | | |
| HA | H10 | 424 | 0.07 | yes | 1 | 0 | 99.19 | TKDSITDI | 99.19 | | | | | | | | |
| HA | H10 | 425 | 0.07 | yes | 1 | 0 | 99.19 | KDSITDIW | 99.19 | | | | | | | | |
| HA | H10 | 426 | 0.07 | yes | 1 | 0 | 99.19 | DSITDIWT | 99.19 | | | | | | | | |
| HA | H10 | 427 | 0.07 | yes | 1 | 0 | 99.19 | SITDIWTY | 99.19 | | | | | | | | |
| HA | H10 | 428 | 0.11 | yes | 2 | 0 | 99.19 | ITDIWTYQ | 98.79 | ITYIWTYQ | 0.81 | | | | | | |
| HA | H10 | 429 | 0.14 | yes | 2 | 0 | 99.19 | TDIWTYQA | 98.38 | TYIWTYQA | 0.81 | | | | | | |
| HA | H10 | 430 | 0.14 | yes | 2 | 0 | 99.19 | DIWTYQAE | 98.38 | YIWTYQAE | 0.81 | | | | | | |
| HA | H10 | 431 | 0.08 | yes | 1 | 0 | 99.19 | IWTYQAEL | 99.19 | | | | | | | | |
| HA | H10 | 432 | 0.08 | yes | 1 | 0 | 99.19 | WTYQAELL | 99.19 | | | | | | | | |
| HA | H10 | 433 | 0.11 | yes | 2 | 0 | 98.79 | TYQAELLY | 98.79 | TYNAELLY | 0.4 | | | | | | |
| HA | H10 | 434 | 0.11 | yes | 2 | 0 | 98.79 | YQAELLYA | 98.79 | YQAELLIA | 0.4 | | | | | | |
| HA | H10 | 435 | 0.11 | yes | 2 | 0 | 98.79 | QAELLVAM | 98.79 | QEELLVAM | 0.4 | | | | | | |
| HA | H10 | 436 | 0.08 | yes | 1 | 0 | 99.19 | AELLVAME | 99.19 | | | | | | | | |
| HA | H10 | 437 | 0.04 | yes | 1 | 0 | 99.6 | ELLVAMEN | 99.6 | | | | | | | | |
| HA | H10 | 438 | 0.04 | yes | 1 | 0 | 99.6 | LLVAMENQ | 99.6 | | | | | | | | |
| HA | H10 | 439 | 0.04 | yes | 1 | 0 | 99.6 | LVAMENQH | 99.6 | | | | | | | | |
| HA | H10 | 440 | 0 | yes | 1 | 0 | 100 | VAMENQHT | 100 | | | | | | | | |
| HA | H10 | 441 | 0.04 | yes | 1 | 0 | 99.6 | AMENQHTI | 99.6 | | | | | | | | |
| HA | H10 | 442 | 0.08 | yes | 1 | 0 | 99.19 | MENQHTID | 99.19 | | | | | | | | |
| HA | H10 | 443 | 0.11 | yes | 2 | 0 | 98.79 | ENQHTIDM | 98.79 | NQHTIDMG | 0.4 | | | | | | |
| HA | H10 | 444 | 0.11 | yes | 2 | 0 | 98.79 | NQHTIDMA | 98.79 | QHTIEMTD | 0.4 | | | | | | |
| HA | H10 | 445 | 0.11 | yes | 2 | 0 | 98.79 | QHTIDMAD | 98.79 | HTIDLADS | 0.4 | | | | | | |
| HA | H10 | 446 | 0.11 | yes | 2 | 0 | 98.79 | HTIDMADS | 98.79 | TIDLADSE | 0.4 | | | | | | |
| HA | H10 | 447 | 0.15 | yes | 3 | 0 | 98.38 | TIDMADSE | 98.38 | IEMTDSEM | 0.4 | TIDMGDSE | 0.4 | | | | |
| HA | H10 | 448 | 0.15 | yes | 3 | 0 | 98.38 | IDMADSEM | 98.38 | EMTDSEML | 0.4 | IDLADSEM | 0.4 | | | | |
| HA | H10 | 449 | 0.15 | yes | 3 | 0 | 98.38 | DMADSEML | 98.38 | MGDSEMLN | 0.4 | DMGDSEML | 0.4 | | | | |
| HA | H10 | 450 | 0.11 | yes | 3 | 0 | 98.79 | MADSEMLN | 98.79 | ADSTMLNL | 0.4 | MADSTMLN | 0.4 | | | | |
| HA | H10 | 451 | 0.04 | yes | 2 | 0 | 99.19 | ADSEMLNL | 99.19 | SEMLNLYD | 0.81 | | | | | | |
| HA | H10 | 452 | 0 | yes | 1 | 0 | 99.6 | DSEMLNLY | 99.6 | | | | | | | | |
| HA | H10 | 453 | 0.11 | yes | 2 | 0 | 98.79 | SEMLNLYE | 98.79 | | | | | | | | |

FIG. 72-66

| Protein | Sub-type | Start Pos | Block Entropy | Gaps <10% | # to cover 99% | % gap | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H10 | 454 | 0.14 | yes | 2 | 0 | 99.19 | EMLNLYER | 99.19 | EMLNLYDR | 0.81 | | | | |
| HA | H10 | 455 | 0.11 | yes | 2 | 0 | 99.19 | MLNLYERV | 99.19 | MLNLYDRV | 0.81 | | | | |
| HA | H10 | 456 | 0.14 | yes | 2 | 0 | 99.19 | LNLYERVR | 99.19 | LNLYDRVR | 0.81 | | | | |
| HA | H10 | 457 | 0.14 | yes | 2 | 0 | 99.19 | NLYERVRK | 99.19 | NLYDRVRK | 0.81 | | | | |
| HA | H10 | 458 | 0.14 | yes | 2 | 0 | 99.19 | LYERVRKQ | 99.19 | LYDRVRKQ | 0.81 | | | | |
| HA | H10 | 459 | 0.14 | yes | 2 | 0 | 99.19 | YERVRKQL | 99.19 | YDRVRKQL | 0.81 | | | | |
| HA | H10 | 460 | 0.14 | yes | 2 | 0 | 99.19 | ERVRKQLR | 99.19 | DRVRKQLR | 0.81 | | | | |
| HA | H10 | 461 | 0.08 | yes | 1 | 0 | 99.6 | RVRKQLRQ | 99.6 | | | | | | |
| HA | H10 | 462 | 0.04 | yes | 1 | 0 | 99.6 | VRKQLRQN | 99.6 | | | | | | |
| HA | H10 | 463 | 0 | yes | 1 | 0 | 100 | RKQLRQNA | 100 | | | | | | |
| HA | H10 | 464 | 0 | yes | 1 | 0 | 100 | KQLRQNAE | 100 | | | | | | |
| HA | H10 | 465 | 0 | yes | 1 | 0 | 100 | QLRQNAEE | 100 | | | | | | |
| HA | H10 | 466 | 0.04 | yes | 1 | 0 | 99.6 | LRQNAEED | 99.6 | | | | | | |
| HA | H10 | 467 | 0.11 | yes | 2 | 0 | 99.19 | RQNAEEDG | 98.79 | QNAEEDGR | 0.81 | | | | |
| HA | H10 | 468 | 0.14 | yes | 2 | 0 | 99.19 | QNAEEDGK | 98.79 | NAEEDGRG | 0.81 | | | | |
| HA | H10 | 469 | 0.14 | yes | 2 | 0 | 99.19 | NAEEDGKG | 98.38 | AEEDGRGC | 0.81 | | | | |
| HA | H10 | 470 | 0.14 | yes | 2 | 0 | 99.19 | AEEDGKGC | 98.38 | EEDGRGCF | 0.81 | | | | |
| HA | H10 | 471 | 0.14 | yes | 2 | 0 | 99.19 | EEDGKGCF | 98.38 | EDGRGCFE | 0.81 | | | | |
| HA | H10 | 472 | 0.14 | yes | 2 | 0 | 99.19 | EDGKGCFE | 98.38 | DGRGCFEI | 0.81 | | | | |
| HA | H10 | 473 | 0.14 | yes | 2 | 0 | 99.19 | DGKGCFEI | 98.38 | GRGCFEIY | 0.81 | | | | |

FIG. 72-67

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 504 | 0.18 | yes | 3 | 0 | 99.19 | EALLNRL | 97.98 | EESLNRL | 0.81

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 89 | 0.17 | yes | 3 | 0 | 99.35 | GTWDTLIE | 98.05 | GMWDTLIE | 0.65 | | | | |
| HA | H10N7 | 90 | 0.17 | yes | 3 | 0 | 99.35 | TW

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H10N7 | 214 | 0.42 | yes | 4 | 0 | 99.35 | VGSSTYQN | 99.35 | V

FIG. 72-72

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 263 | 0.26 | yes | 2 | 0.65 | 99.35 | APSRVTKL | 96.08 | APSRVTKLK | 3.27 | | | | |
| HA | H10N7 | 264 |

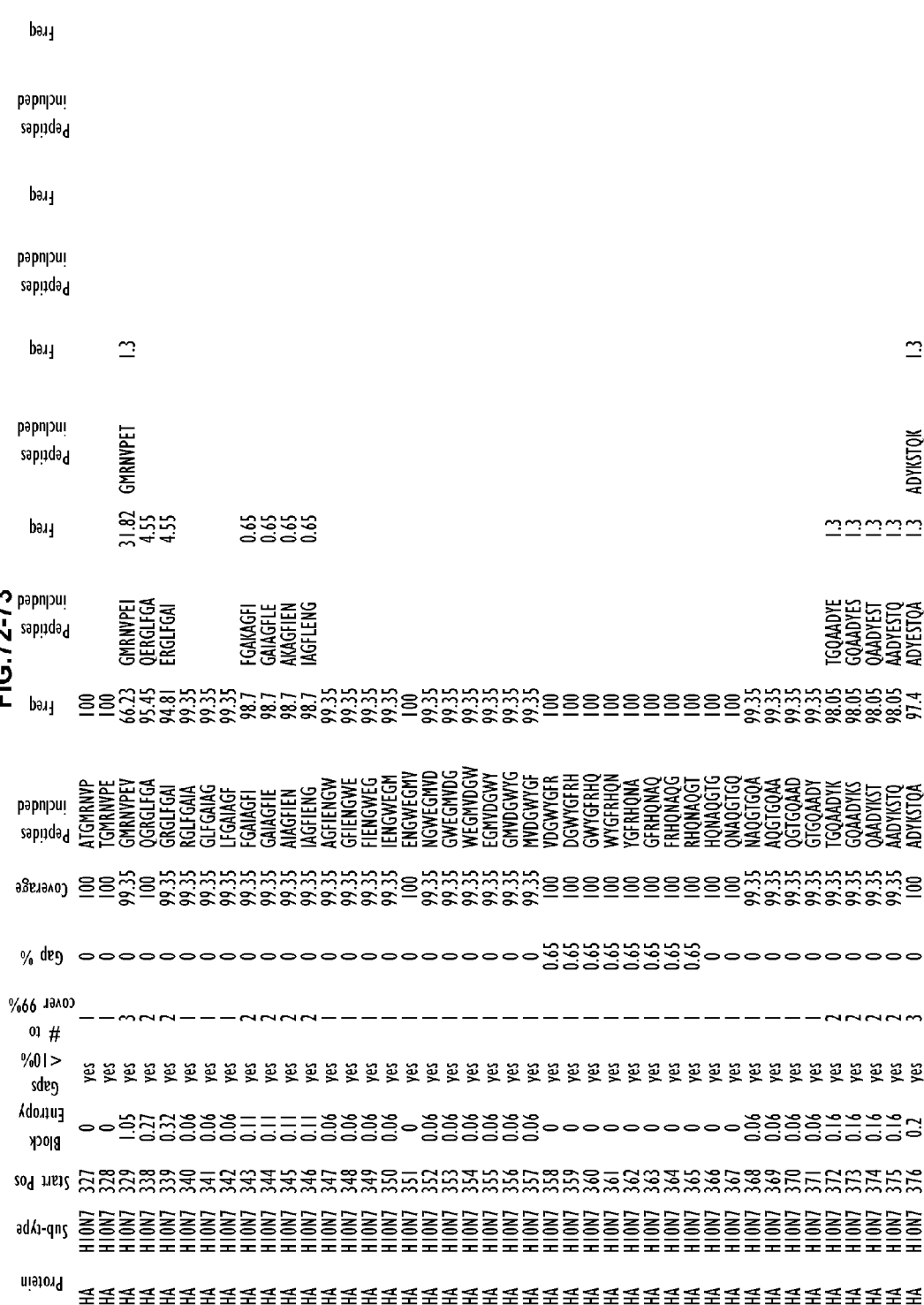

FIG. 72-74

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 377 | 0.26 | yes | 3 | 0 | 99.35 | DYK

FIG. 72-76

| Protein | Sub-type | Start Pos | Block Entropy | Gaps <10% | # to cover 99% | % Gap | coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H10N7 | 461 | 0.06 | yes | 1 | 0 | 99.35 | RVKQLRQ | 99.35 | | | | | | | | |
| HA | H10N7 | 462 |

FIG. 72-78

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 1 | 0.15 | no | 2 | 25.33 | 99.11 | MPNPNQKLF | 98.21 | NPNQNLFT | 0.89 | | | | |
| NA | H10N7 | 2 | 0.37 | no | 3 | 24.67 | 99.12 | MNPNQKLFA | 94.69 | NPNQNLFT | 3.54 | | | | |
| NA | H10N7 | 3 | 0.37 | no | 3 | 24.67 | 99.12 | NPNQKLFA | 94.69 | PKSKLFTL | 3.54 | | | | |
| NA | H10N7 | 4 | 0.37 | no | 3 | 24.67 | 99.12 | NQKLFALS | 94.69 | NQNLFTLS | 3.54 | | | | |
| NA | H10N7 | 5 | 0.36 | no | 3 | 24 | 99.12 | QKLFALSG | 94.74 | QNLFTLSG | 3.51 | | | | |
| NA | H10N7 | 6 | 0.29 | yes | 5 | 10.67 | 99.25 | KLFALSGV | 95.52 | KLFTLSG | 3.73 | | | | |
| NA | H10N7 | 7 | 0.32 | yes | 4 | 8.67 | 99.27 | LFALSGVA | 95.27 | LFTLSGVA | 4.38 | | | | |
| NA | H10N7 | 8 | 0.42 | yes | 4 | 4.67 | 99.3 | FALSGVAI | 94.89 | FTLSGVAI | 4.2 | ALSGMAIA | 1.4 | | |
| NA | H10N7 | 9 | 0.53 | yes | 5 | 4 | 99.31 | ALSGVAIA | 93.71 | TLSGVAV | 4.17 | ALSGMAIA | 1.39 | ALSGVAIT | 0.69 |
| NA | H10N7 | 10 | 0.28 | yes | 4 | 2 | 92.36 | LSGVAIAL | 96.6 | LSGVAVAL | 1.36 | LSGMAIAL | 0.68 | SGVAITLS | 0.68 |
| NA | H10N7 | 11 | 0.34 | yes | 2 | 0.67 | 95.92 | SGVAIALS | 80.54 | SGVA

FIG. 72-79

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 87 | 0.54 | yes | 4 | 0 | 99.33 | NKSLCWVE | 92 | NKSLCSVE | 3.33 | | | S

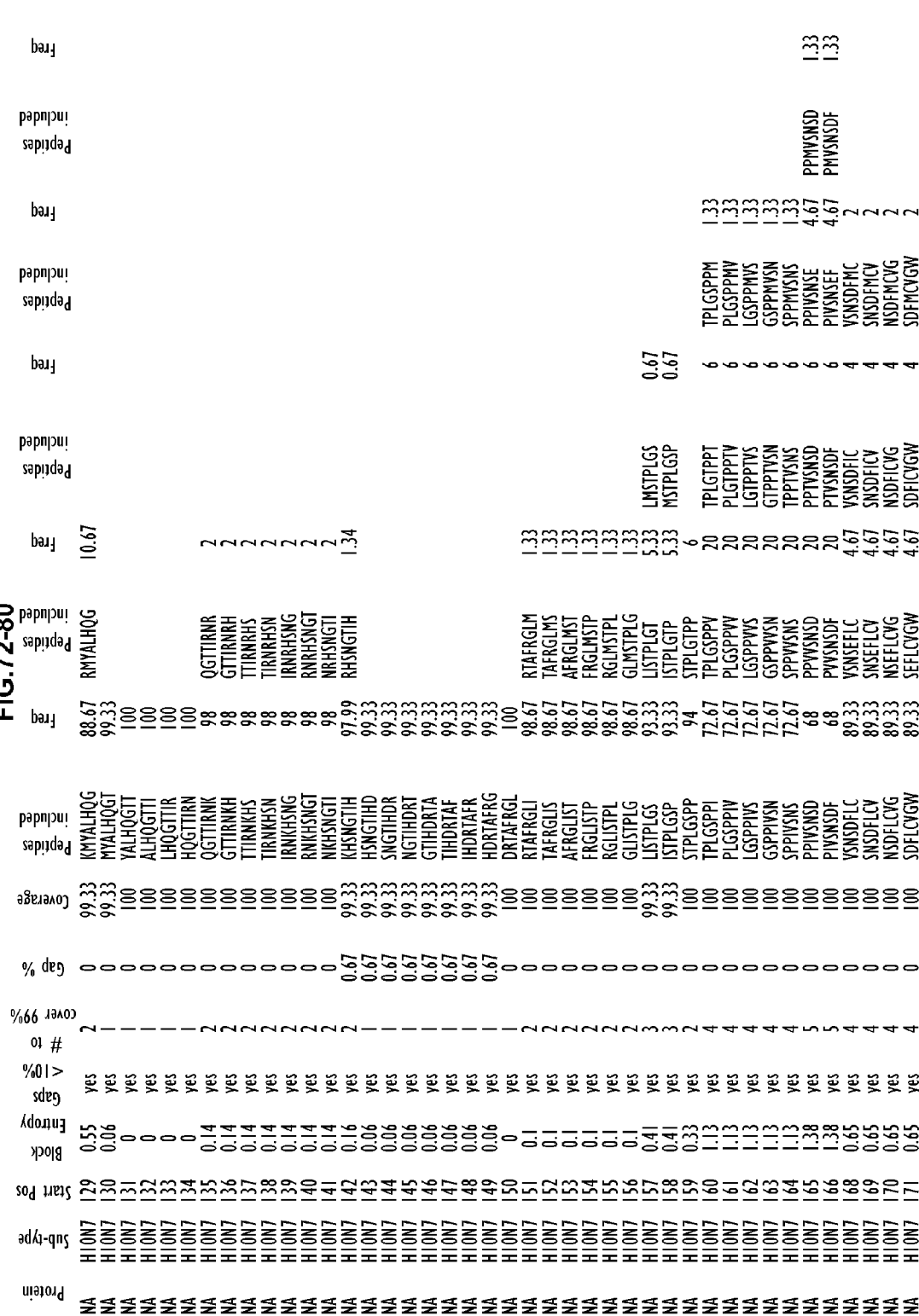

FIG. 72-81

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 172 | 0.65 | yes |

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 313 | 0.38 | yes | 2 | 0 | 99.33 | TSQYLCTG | 93.33 | TSRYVCTG | 6 | SQYLCTGI | 1.33 |

FIG. 72-85

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H10N7 | 371 | 0 | yes | 1 | 0 | 100 | RSGFEMLK | 100 | |

FIG. 72-86

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 434 | 0.16 | yes | 2 | 0 | 99.33 | EEAKYVWW | 98 | EEVKYVWW | 1.33 | | | | |
| NA | H10N7 | 435 |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 75 | 0.16 | yes | 2 | 0 | 99.

FIG. 72-89

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H1 | 207 | 1.43 | yes | 5 | 0 | 99.48 | YKKDSSYV | 66.84 | YKKDSSYI | | Y

FIG. 72-90

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 316 | 0.16 | yes | 2 | 0 | 99.48 | GDCPKYYN | 97.93 | GDCPKYMN | 1.55 | DCPKYYNI | 1.55 |

FIG.72-91

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 365 | 0.09 | yes | 2 | 0 | 99.48 | GFQHRNEE | 98.96 | | | | | | |
| HA | H1 | 366 | 0.09 | yes | 2 | 0 | 99.48 | FQHRNEEG | 98.96 | | | | | | |
| HA | H1 | 367 | 0.09 | yes | 2 | 0 | 99.48 | QHRNEEGT | 98.96 | |

FIG. 72-92

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H1 | 455 | 0.18 | yes | 3 | 0.52 | 99.48 | SNVRNLHE | 97.92 | SNVKNLHE | 1.04 | | | | | | |
| HA | H1 | 456 | 0.32 | yes | 4 | 0 | 99.48 | NVRNLHEK | 95.85 | NVRSLHEK | 2.07 | | | | | | |
| HA | H1 | 457 | 0.4 | yes | 5 | 0 | 99.48 | NLHEKVRR | 94.82 | NLHEKVRR | 2.07 | NLHEKVRQ | 0.52 | | | | |
| HA | H1 | 459 | 0.44 | yes | 5 | 0 | 99.48 | LHEKVRRM | 94.3 | LHEKIRR | 2.07 | LHEKVRQM | 0.52 | | | | |
| HA | H1 | 460 | 0.44 | yes | 5 | 0 | 99.48 | HEKVRRML | 94.3 | HEKIRRML | 2.07 | HEKVRQML | 0.52 | | | |

FIG. 72-93

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 510 | 0.99 | yes | 3 | 0 | 99.48 | LNRQHEG | 70.98 | LNRQEIEG | 26.94 | LNRQEIGG | 1.55 | | |
| HA | H1 | 511 | 0.21 | yes | 3 | 0 | 99.48 | NRQEIEGV | 97.41 | NRQEIGGV | 1.55 | NRQEVEGV | 0.52 | | |
| HA | H1 | 512 | 0.35 | yes | 4 | 0 | 99.48 | RQEIEGVK | 95.34 | RQEIGGVK | 2.07 | ROEVEGVK | 1.55 | | |
| HA | H1 | 513 | 0.35 | yes | 4 | 0 | 99.48 | QEIEGVKL | 95.34 | QEIGGVKL | 2.07 | QEVEGVKL | 1.55 | | |
| HA | H1 | 514 | 0.5 | yes | 5 | 0 | 99.48 | EIEGVKLD | 93.26 | EIEGVRLD | 2.07 | EIGGVKLD | 2.07 | EIE

FIG. 72-94

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 24 | 0.59 | yes | 2 | 0 | 100 | YQTNNST

FIG. 72-95

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 77 | 0.34 | yes | 4 | 0 | 100 | LILGNPKC | 95

FIG. 72-96

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 119 | 0.31 | yes | 3 | 0 | 100 | RSLFSSIK | 95.29 | RFLFSSIK | 5.29 | RS

FIG. 72-97

| Protein | Sub-type | Start Pos | block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 166 | 0.77 | yes | 3 | 0 | 100 | LITLK

FIG. 72-98

| Protein | Sub-type | Start Pos | Block Entropy | Gaps <10% | # to 99% cover | % gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H2 | 238 | 0 | yes | 1 | 0 | 100 | QQGRMDYY | 100 | RMDYYWAI | 1.18 | | | | | | |
| HA | H2 | 239 | 0 | yes | 1 | 0 | 100 | QGRMDYYW | 100 | MDYYWAIL | 1.18 | | | | | | |
| HA | H2 | 240 | 0 | yes | 1 | 0 | 100 | GRMDYYWA | 100 | DYYWAILK | 1.18 | | | | | | |
| HA | H2 | 241 | 0.09 | yes | 2 | 0 | 100 | RMDYYWAV | 98.82 | YYWAILKP | 1.18 | | | | | | |
| HA | H2 | 242 | 0.09 | yes | 2 | 0 | 100 | MDYYWAVL | 98.82 | YWAILKPG | 1.18 | | | | | | |
| HA | H2 | 243 | 0.09 | yes | 2 | 0 | 100 | DYYWAVLK | 98.82 | WAILKPGQ | 1.18 | | | | | | |
| HA | H2 | 244 | 0.09 | yes | 2 | 0 | 100 | YYWAVLKP | 98.82 | AILKPGQT | 1.18 | | | | | | |
| HA | H2 | 245 | 0.09 | yes | 2 | 0 | 100 | YWAVLKPG | 98.82 | ILKPGQTV | 1.18 | | | | | | |
| HA | H2 | 246 | 0 | yes | 1 | 0 | 100 | WAVLKPGQ | 98.82 | | | | | | | | |
| HA | H2 | 247 | 0 | yes | 1 | 0 | 100 | AVLKPGQT | 100 | | | | | | | | |
| HA | H2 | 248 | 0 | yes | 1 | 0 | 100 | VLKPGQTV | 100 | | | | | | | | |
| HA | H2 | 249 | 0.09 | yes | 2 | 0 | 100 | LKPGQTVK | 98.82 | PGQTVKIK

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 333 | 1.23 | yes | 5 | 0 | 100 | LRNVPQAQ

FIG.72-101

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 375 | 0.98 | yes | 4 | 0 | 100 | GIAADRDS | 72

FIG. 72-102

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 432 | 0 | yes | 1 | 0 | 100 | DIWAYNAE | 100 | | | | | | |
| HA | H12 | 433 | 0 | yes | 1 | 0 | 100 | IWA

| Protein | Sub-type | Start Pos | Block Entropy | Gaps < 10% | # to 99% cover | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H12 | 542 | 0.09 | yes | 2 | 0 | 100 | LLMIIGGF | 98.82 | LFMIIGGF | 1.18 | | | | | | |
| HA | H12 | 543 | 0.09 | yes | 2 | 0 | 100 | LMIIGGFI | 98.82 | FMIIGGFI | 1.18 | | | | | | |
| HA | H12 | 544 | 0 | yes | 1 | 0 | 100 | MIIGGFIF | 100 | | | | | | |

FIG. 72-105

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 45 | 1.88 | yes | 5 | 0 | 100 | TSSVDLVE | 47.69 | TSSVDL

FIG. 72-106

| Protein | Sub-type | Start Pos | Block Entropy | Gaps <10% | # to 99% cover | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H3 | 106 | 0.11 | yes | 2 | 0 | 100 | GLCYPGEL | 98.46 | RLCYPGEL | 1.54 | | | | |
| HA | H3 | 107 | 0.96 | yes | 2 | 0 | 100 | LCYPGELD | 61.54 | LCYPGEL | 38.46 | | | | |
| HA | H3 | 108 | 0.96 | yes | 2 | 0 | 100 | CYPGELDN | 61.54 | CYPGELNN | 38.46 | | | | |
| HA | H3 | 109 | 0.96 | yes | 2 | 0 | 100 | YPGELDNN | 61.54 | YPGELNNN | 38.46 | | | | |
| HA | H3 | 110 | 0.96 | yes | 2 | 0 | 100 | PGELDNNG | 61.54 | PGELNNNG | 38.46 | | | |

FIG. 72-107

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 190 | 1.65 | yes | 4 | 0 | 100 | VLVLWGIH | 41.54 | VLVLWGIH | 30.77 | YLVM

FIG. 72-108

| Protein | Sub-type | Start Pos | Block Entropy | Gaps >10% | # to cover 99% | Gap % | Coverage | Peptides included | freq | Peptides included | freq | Peptides included | freq | Peptides included | freq |
|---|---|---|---|---|---|---|---|---|---|---|---|---|---|---|---|
| HA | H3 | 278 | 0.33 | yes | 2 | 0 | 100 | GKGRIFQS | 93.85 | GKGRIFQSH | 6.15 | | | | |
| HA | H3 | 279 | 1.28 | yes | 4 | 0 | 100 | KGRIFQSR | 72.31 | KGRIFQSH | 12.31 | RGRIFQSR | 9.23 | | |
| HA | H3 | 280 | 0.96 | yes | 3 | 0 | 100 | GRIFQSPI | 78.46 | GRIFQSHI | 12.31 | | | | |
| HA | H3 | 281 | 1.07 | yes | 4 | 0 | 100 | RIFQSRIR | 76.92 | RIFQSHIR | 12.31 | RIFQSRII | 1.54 | | |
| HA | H3 | 291 | 1.11 | yes | 3 | 0 | 100 | KCNTKCQT | 70.77 | RCNTKCQT | 21.54 | | | | |
| HA | H3 | 292 | 0.39 | yes | 2 | 0 | 100 | CNTKCQTS | 92.31 | RCNTRCQT | 7.69 | | | | |
| HA | H3 | 293 | 0.39 | yes | 2 | 0 | 100 | NTRCQTSV | 92.31 | NTKCQTS | 7.69 | | | | |
| HA | H3 | 294 | 0.39 | yes | 2 | 0 | 100 | TKCQTSVG | 92.31 | TRCQTSVG | 7.69 | | | | |
| HA | H3 | 295 | 0.39 | yes | 2 | 0 | 100 | KCQTSVGG | 92.31 | RCQTSVGG | 7.69 | | | | |
| HA | H3 | 296 | 0 | yes | 1 | 0 | 100 | CQTSVGGI | 100 | | | | | | |
| HA | H3 | 297 | 0.11 | yes | 2 | 0 | 100 | QTSVGGIN | 98.46 | QTSVGGID | 1.54 | | | | |
| HA | H3 | 298 | 0.11 | yes | 2 | 0 | 100 | TSVGGINT | 98.46 | TSVGGIDT | 1.54 | | | | |
| HA | H3 | 299 | 0.11 | yes | 2 | 0 | 100 | SVGGINTN | 98.46 | SVGGIDTN | 1.54 | | | | |
| HA | H3 | 300 | 1.07 | yes | 3 | 0 | 100 | VGGINTNK | 60 | VGGIDTNK | 38.46 | | | | |
| HA | H3 | 301 | 1.07 | yes | 3 | 0 | 100 | GGINTNKT | 60 | GGIDTNKT | 38.46 | | | | |
| HA | H3 | 302 | 1.07 | yes | 3 | 0 | 100 | GINTNKTF | 60 | GIDTNKTF | 38.46 | | | | |
| HA | H3 | 303 | 1.07 | yes | 3 | 0 | 100 | INTNKTFQ | 60 | IDTNKTFQ | 38.46 | | | | |
| HA | H3 | 304 | 0.96 | yes | 3 | 0 | 100 | NTNKTFQN | 60 | DTNKTFQN | 38.46 | | | | |
| HA | H3 | 305 | 1.16 | yes | 3 | 0 | 100 | TNKTFQNI | 61.54 | NKTFQNID | 38.46 | | | | |
| HA | H3 | 306 | 1.07 | yes | 3 | 0 | 100 | NKTFQNID | 60 | KTFQNIDK | 38.46 | | | | |
| HA | H3 | 307 | 1.07 | yes | 3 | 0 | 100 | KTFQNIE | 60 | TFQNIDKN | 38.46 | | | | |
| HA | H3 | 308 | 1.07 | yes | 3 | 0 | 100 | TFQNIERN | 60 | FQNIDKNA | 38.46 | | | | |
| HA | H3 | 309 | 1.07 | yes | 3 | 0 | 100 | FQNIERNA | 60 | QNIDKNAL | 38.46 | | | | |
| HA | H3 | 310 | 0.96 | yes | 3 | 0 | 100 | QNIERNAL | 60 | NIDRNAL | 38.46 | RTFQNIDR | 1.54 | | |
| HA | H3 | 311 | 1.6 | yes | 4 | 0 | 100 | NIERNALG | 47.69 | IERNALGN | 38.46 | | | | |
| HA | H3 | 312 | 1.6 | yes | 3 | 0 | 100 | IERNALGD | 47.69 | DKNALGDC | 36.92 | IDKNALGE | 1.54 | IDRNALGD | 1.54 |
| HA | H3 | 313 | 1.5 | yes | 5 | 0 | 100 | ERNALGDC | 49.23 | DKNALGDC | 36.92 | DRNALGDC | 1.54 | DKNALGEC | 1.54 |
| HA | H3 | 314 | 0.65 | yes | 4 | 0 | 100 | RNALGDCP | 86.15 | NALGNCP | 36.92 | KNALGECP | 1.54 | | |
| HA | H3 | 315 | 0.65 | yes | 3 | 0 | 100 | NALGDCPK | 86.15 | NALGNCPK | 12.31 | | | | |
| HA | H3 | 316 | 0.65 | yes | 3 | 0 | 100 | ALGDCPKY | 86.15 | ALGECPKY | 12.31 | | | | |
| HA | H3 | 317 | 0.65 | yes | 3 | 0 | 100 | LGDCPKYI | 86.15 | LGECPKYI | 12.31 | | | | |
| HA | H3 | 318 | 0.65 | yes | 3 | 0 | 100 | GDCPKYIK | 86.15 | GECPKYI | 12.31 | | | | |
| HA | H3 | 319 | 0.11 | yes | 2 | 0 | 100 | DCPKYIK | 98.46 | ECPKYIIKS | 1.54 | | | | |
| HA | H3 | 320 | 0.11 | yes | 2 | 0 | 100 | CPKYIKSG | 98.46 | PKYIIKSD | 1.54 | | | | |
| HA | H3 | 321 | 0.11 | yes | 2 | 0 | 100 | PKYIIKSGQ | 98.46 | KYIIKSDQ | 1.54 | | | | |
| HA | H3 | 322 | 0.11 | yes | 2 | 0 | 100 | KYIIKSGQL | 98.46 | YIIKSDQL | 1.54 | | | | |
| HA | H3 | 323 | 0.11 | yes | 2 | 0 | 100 | YIIKSGQLK | 98.46 | IKSDQLK | 1.54 | | | | |
| HA | H3 | 324 | 0.11 | yes | 2 | 0 | 100 | IKSGQLKL | 98.46 | KSDQLKL | 1.54 | | | | |
| HA | H3 | 325 | 0.11 | yes | 2 | 0 | 100 | KSGQLKLA | 98.46 | SDQLKLA | 1.54 | | | | |
| HA | H3 | 326 | 0.11 | yes | 2 | 0 | 100 | SGQLKLAT | 98.46 | DQLKLAT | 1.54 | | | | |
| HA | H3 | 327 | 0.11 | yes | 2 | 0 | 100 | GQLKLATG | 98.46 | DQLKLATG | 1.54 | | | | |
| HA | H3 | 328 | 0 | yes | 1 | 0 | 100 | QLKLATGL | 100 | | | | | | |

FIG. 72-109

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 329 | 0.11 | yes | 2 | 0 | 100 | LKLATGLR | 98.46 | LKLATGLK | 98.46 | | | | |
| HA | H3 | 330 | 0.11 | yes | 2 | 0 | 100 | KLATGLRN | 98.46 | KLATGLKN | 98.46 | | | | |
| HA | H3 | 331 | 0.38 | yes | 3 | 0 | 100 | LATGLRNV | 93.85 | LATGLRNI | 4.62 | | | | |
| HA | H3 | 332 | 0.38 | yes | 3 | 0 | 100 | ATGLRNVP | 93.85 | ATGLKNVP | 4.62 | | | | |
| HA | H3 | 333 | 1.01 | yes | 5 | 0 | 100 | TGLRNVPA | 81.54 | TGLRNIPA | 9.23 | TGLRNVPS | 4.62 | TGLKNVPA | 1.54 |
| HA | H3 | 344 | 0.34 | yes | 4 | 0 | 100 | RGLFGAIA | 95.38 | RAVDGTIA | 1.54 | RGFFGAIA | 1.54 | | |
| HA | H3 | 345 | 0.34 | yes | 4 | 0 | 100 | GLFGAIAG | 95.38 | GLLGAIAG | 1.54 | AV

FIG. 72-110

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| HA | H13 | 381 | 0.2 | yes | 2 | 0 | 100 | DKESTQKA | 96.92 | EKESTQKA | 3.08 | | | | | | |
| HA | H13 | 382 | 0 | yes | 1 | 0 | 100 | KESTQKAI | 100 | | | | | | | | |
| HA | H13 | 383 | 0 | yes | 1 | 0 | 100 | ESTQKAID | 100 | | | | | | | | |
| HA | H13 | 384 | 0.11 | yes | 2 | 0 | 100 | STQKAIDQ | 98.46 | STQKAIDR | 1.54 | | | | | | |
| HA | H13 | 385 | 0.11 | yes | 2 | 0 | 100 | TQKAIDQI | 98.46 | TQKAIDRI | 1.54 | | | | | | |
| HA | H13 | 386 | 0.11 | yes | 2 | 0 | 100 | QKAIDQIT | 98.46 | QKAIDRIT | 1.54 | | | | | | |
| HA | H13 | 387 | 0.11 | yes | 2 | 0 | 100 | KAIDQITT | 98.46 | KAIDRITT | 1.54 | | | | | | |
| HA | H13 | 388 | 0.11 | yes | 2 | 0 | 100 | AIDQITTK | 98.46 | AIDRITTK | 1.54 | | | | | | |
| HA | H13 | 389 | 0.11 | yes | 2 | 0 | 100 | IDQITTKI | 98.46 | IDRITTKI | 1.54 | | | | | | |
| HA | H13 | 390 | 0.11 | yes | 2 | 0 | 100 | DQITTKIN | 98.46 | DRITTKIN | 1.54 | | | | | | |
| HA | H13 | 391 | 0.11 | yes | 2 | 0 | 100 | QITTKINN | 98.46 | RITTKINN | 1.54 | | | | | | |
| HA | H13 | 392 | 0 | yes | 1 | 0 | 100 | ITTKINNI | 100 | | | | | | | | |
| HA | H13 | 393 | 0 | yes | 1 | 0 | 100 | TTKINNII | 100 | | | | | | | | |
| HA | H13 | 394 | 1 | yes | 2 | 0 | 100 | TKINNIID | 50.77 | TKINNIIE | 49.23 | | | | | | |
| HA | H13 | 395 | 1 | yes | 2 | 0 | 100 | KINNIIDK | 50.77 | KINNIIEK | 49.23 | | | | | | |
| HA | H13 | 396 | 1 | yes | 2 | 0 | 100 | INNIIDKM | 50.77 | INNIIEKM | 49.23 | | | | | | |
| HA | H13 | 397 | 1 | yes | 2 | 0 | 100 | NNIIDKMN | 50.77 | NNIIEKMN | 49.23 | | | | | | |
| HA | H13 | 398 | 1 | yes | 2 | 0 | 100 | NIIDKMNG | 50.77 | NIIEKMNG | 49.23 | | | | | | |
| HA | H13 | 399 | 1 | yes | 2 | 0 | 100 | IIDKMNGN | 50.77 | IIEKMNGN | 49.23 | | | | | | |
| HA | H13 | 400 | 1 | yes | 2 | 0 | 100 | IDKMNGNY | 50.77 | IEKMNGNY | 49.23 | | | | | | |
| HA | H13 | 401 | 0 | yes | 1 | 0 | 100 | DKMNGNYD | 100 | | | | | | | | |
| HA | H13 | 402 | 0 | yes | 1 | 0 | 100 | KMNGNYDS | 100 | | | | | | | | |
| HA | H13 | 403 | 0 | yes | 1 | 0 | 100 | MNGNYDSI | 100 | | | | | | | | |
| HA | H13 | 404 | 0 | yes | 1 | 0 | 100 | NGNYDSIR | 100 | | | | | | | | |
| HA | H13 | 405 | 0 | yes | 1 | 0 | 100 | GNYDSIRG | 100 | | | | | | | | |
| HA | H13 | 406 | 0 | yes | 1 | 0 | 100 | NYDSIRGE | 100 | | | | | | | | |
| HA | H13 | 407 | 0 | yes | 1 | 0 | 100 | YDSIRGEF | 100 | | | | | | | | |
| HA | H13 | 408 | 0.99 | yes | 2 | 0 | 100 | DSIRGEFN | 55.38 | DSIRGEFS | 44.62 | | | | | | |
| HA | H13 | 409 | 0.99 | yes | 2 | 0 | 100 | SIRGEFNQ | 55.38 | SIRGEFSQ | 44.62 | | | | | | |
| HA | H13 | 410 | 0.99 | yes | 2 | 0 | 100 | IRGEFNQV | 55.38 | IRGEFSQV | 44.62 | | | | | | |
| HA | H13 | 411 | 0.99 | yes | 2 | 0 | 100 | RGEFNQVE | 55.38 | RGEFSQVE | 44.62 | | | | | | |
| HA | H13 | 412 | 1.9 | yes | 3 | 0 | 100 | GEFNQVEK | 40 | GEFNQVEN | 36.92 | GEFSQVER | 10.77 | GEFNQVEQ | 4.62 | | |
| HA | H13 | 413 | 1.9 | yes | 3 | 0 | 100 | EFNQVEKR | 40 | EFNQVENR | 36.92 | EFSQVERR | 10.77 | EFNQVEQR | 4.62 | | |
| HA | H13 | 414 | 1.9 | yes | 3 | 0 | 100 | FNQVEKRI | 40 | FNQVENRI | 36.92 | FSQVERRI | 10.77 | FNQVEQRI | 4.62 | | |
| HA | H13 | 415 | 1.9 | yes | 3 | 0 | 100 | NQVEKRIN | 40 | NQVENRIN | 36.92 | QVERRIN | 10.77 | NQVEQRIN | 4.62 | | |
| HA | H13 | 416 | 1.69 | yes | 4 | 0 | 100 | QVEKRINM | 41.54 | QVENRINM | 36.92 | QVERRINM | 10.77 | | | | |
| HA | H13 | 417 | 1.69 | yes | 4 | 0 | 100 | VEKRINML | 41.54 | VENRINML | 36.92 | VERRINML | 10.77 | | | | |
| HA | H13 | 418 | 1.69 | yes | 4 | 0 | 100 | EKRINMLA | 41.54 | ENRINMLA | 36.92 | ERRINMLA | 10.77 | | | | |
| HA | H13 | 419 | 1.69 | yes | 5 | 0 | 100 | KRINMLAD | 41.54 | NRINMLAD | 36.92 | RRINMLAD | 10.77 | | | | |
| HA | H13 | 420 | 0 | yes | 1 | 0 | 100 | RINMLADR | 100 | | | | | | | | |
| HA | H13 | 421 | 0 | yes | 1 | 0 | 100 | INMLADRI | 100 | | | | | | | | |
| HA | H13 | 422 | 0 | yes | 1 | 0 | 100 | NMLADRID | 100 | | | | | | | | |

FIG. 72-111

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 423 | 0 | yes | 1 | 0 | 100 | MLADRIDD | 100 | | | | | | |
| HA | H3 | 424 | 0 | yes | 1 | 0 | 100 | LADRIDDA | 100 | | | | | | |
| HA | H3 | 425 | 0 | yes | 1 | 0 | 100 | ADRIDDAV | 100 | | | | | | |
| HA | H3 | 426 | 0 | yes | 1 | 0 | 100 | DRIDDAVT | 100 | | | | | | |
| HA | H3 | 427 | 0 | yes | 1 | 0 | 100 | RIDDAVTD | 100 | | | | | | |
| HA | H3 | 428 | 0.97 | yes | 2 | 0 | 100 | IDDAVTDI | 60 | | | | | | |
| HA | H3 | 429 | 0.97 | yes | 2 | 0 | 100 | DDAVTDIW | 60 | | | | | | |
| HA | H3 | 430 | 0.97 | yes | 2 | 0 | 100 | DAVTDVWS | 60 | | | | | | |
| HA | H3 | 431 | 0.97 | yes | 2 | 0 | 100 | AVTDIWSY | 60 | | | | | | |
| HA | H3 | 432 | 0.97 | yes | 2 | 0 | 100 | VTDIWSYN | 60 | | | | | | |
| HA | H3 | 433 | 0.97 | yes | 2 | 0 | 100 | TDIWSYNA | 60 | | | | | | |
| HA | H3 | 434 | 1.07 | yes | 3 | 0 | 100 | DIWSYNAK | 60 | DIWSYNAR | 1.54 | | | | |
| HA | H3 | 435 | 1.07 | yes | 2 | 0 | 100 | IWSYNAKL | 60 | IWSYNARL | 1.54 | | | | |
| HA | H3 | 436 | 0.11 | yes | 2 | 0 | 100 | WSYNAKLL | 98.46 | | | | | | |
| HA | H3 | 437 | 0.11 | yes | 2 | 0 | 100 | SYNAKLLV | 98.46 | | | | | | |
| HA | H3 | 438 | 0.11 | yes | 2 | 0 | 100 | YNAKLLVL | 98.46 | | | | | | |
| HA | H3 | 439 | 0.11 | yes | 2 | 0 | 100 | NAKLLVIL | 98.46 | | | | | | |
| HA | H3 | 440 | 0.11 | yes | 2 | 0 | 100 | AKLLVLLE | 98.46 | | | | | | |
| HA | H3 | 441 | 0.11 | yes | 2 | 0 | 100 | KLLVLLEN | 98.46 | | | | | | |
| HA | H3 | 442 | 0 | yes | 1 | 0 | 100 | LLVLLEND | 100 | | | | | | |
| HA | H3 | 443 | 0 | yes | 1 | 0 | 100 | LVLLENDK | 100 | | | | | | |
| HA | H3 | 444 | 0 | yes | 1 | 0 | 100 | VLLENDKT | 100 | | | | | | |
| HA | H3 | 445 | 0 | yes | 1 | 0 | 100 | LLENDKTL | 100 | | | | | | |
| HA | H3 | 446 | 0.11 | yes | 2 | 0 | 100 | LENDKTLD | 98.46 | ENDKTLN | 1.54 | | | | |
| HA | H3 | 447 | 0.23 | yes | 2 | 0 | 100 | ENDKTLDM | 96.92 | NDKTLDLH | 1.54 | | | | |
| HA | H3 | 448 | 0.23 | yes | 2 | 0 | 100 | NDKTLDMH | 96.92 | DKTLNMHD | 1.54 | | | | |
| HA | H3 | 449 | 0.23 | yes | 2 | 0 | 100 | DKTLDMHD | 96.92 | KTLDLHDA | 1.54 | | | | |
| HA | H3 | 450 | 0.23 | yes | 2 | 0 | 100 | KTLDMHDA | 96.92 | TLDLHDAN | 1.54 | | | | |
| HA | H3 | 451 | 0.23 | yes | 2 | 0 | 100 | TLDMHDAN | 96.92 | LNMHDANV | 1.54 | | | | |
| HA | H3 | 452 | 0.62 | yes | 3 | 0 | 100 | LDMHDANV | 96.92 | NMHDANYR | 1.54 | | | | |
| HA | H3 | 453 | 0.5 | yes | 2 | 0 | 100 | DMHDANVR | 89.23 | LHDANVRN | 1.54 | | | | |
| HA | H3 | 454 | 0.39 | yes | 3 | 0 | 100 | MHDANVKN | 90.77 | | | | | | |
| HA | H3 | 455 | 0.39 | yes | 3 | 0 | 100 | HDANVRNL | 92.31 | | | | | | |
| HA | H3 | 456 | 0.39 | yes | 3 | 0 | 100 | DANVRNLH | 92.31 | | | | | | |
| HA | H3 | 457 | 1.31 | yes | 4 | 0 | 100 | ANVRNLHE | 49.23 | ANVKNLHE | 43.08 | | | | |
| HA | H3 | 458 | 1.31 | yes | 3 | 0 | 100 | NVRNLHEQ | 49.23 | NVKNLHEQ | 43.08 | | | | |
| HA | H3 | 459 | 1.51 | yes | 3 | 0 | 100 | VRNLHEQV | 47.69 | VKNLHEQV | 41.54 | | | | |
| HA | H3 | 460 | 1.51 | yes | 5 | 0 | 100 | RNLHEQVR | 47.69 | KNLHEQVR | 41.54 | DLHDANVR | 1.54 | | |
| HA | H3 | 461 | 1.3 | yes | 5 | 0 | 100 | NLHEQVRR | 47.69 | NLHDQVRR | 47.69 | | | VRNLHEQI | 1.54 |
| HA | H3 | 473 | 0.97 | yes | 3 | 0 | 100 | NAIDEGNG | 73.85 | NAINEGNG | 23.08 | VRNLHDQI | 1.54 | RNLHEQIK | 1.54 |
| HA | H3 | 474 | 0.97 | yes | 3 | 0 | 100 | AIDEGNGC | 73.85 | AINEGNGC | 23.08 | RNLHDQIR | 1.54 | NLHEQIKR | 1.54 |
| HA | H3 | 475 | 0.97 | yes | 3 | 0 | 100 | IDEGNGCF | 73.85 | INEGNGCF | 23.08 | NLHEQVRK | 1.54 | | |

FIG. 72-112

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 476 | 0.2 | yes | 2 | 0 | 100 | DEGNGCFE | 96.92 | NEGNGCFE | 3.08 | | | | |
| HA | H3 | 477 | 0 | yes | 1 | 0 | 100 | EGNG

| Protein | Sub-type | Start Pos | Block | Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|---|
| HA | H14 | 15 | 0 | 0 | yes | – | 0 | 100 | AYSQITNG | 100 | | | | | | |
| HA | H14 | 16 | 0 |

FIG.72-115

| Protein | Sub-type | Start Pos | Block | Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|---|
| HA | H14 | 57 | 0 | | yes | — | 0 | 100 | ELVETNH

FIG. 72-116

| Protein | Sub-type | Start Pos | Block | Entropy | Gaps <10% | # to cover 99% | Gap % | Coverage | Peptides included | Freq |
|---|---|---|---|---|---|---|---|---|---|---|
| HA | H14 | 99 | 0 | 0 | yes | —

FIG. 72-117

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 141 | 0 | yes | 1 | 0 | 100 | FTWNGWKV | 100 | | | | | | |
| HA | H14 | 142 | 0 | yes | 1 | 0 | 100 | TWNGWKVD | 100 | | | | | | |
| HA | H14 | 143 | 0 | yes | 1 | 0 | 100 | WNGWKVDG | 100 | | | | | | |
| HA | H14 | 144 | 0 | yes | 1 | 0 | 100 | NGWKVDGS | 100 | | | | | | |
| HA | H14 | 145 | 0 | yes | 1 | 0 | 100 | GWKVDGSS | 100 | | | | | | |
| HA | H14 | 146 | 0 | yes | 1 | 0 | 100 | WKVDGSSS | 100 | | | | | | |
| HA | H14 | 147 | 0 | yes | 1 | 0 | 100 | KVDGSSSA | 100 | | | | | | |
| HA | H14 | 148 | 0 | yes | 1 | 0 | 100 | VDGSSSAC | 100 | | | | | | |
| HA | H14 | 149 | 0 | yes | 1 | 0 | 100 | DGSSSACL | 100 | | | | | | |
| HA | H14 | 150 | 0 | yes | 1 | 0 | 100 | GSSSACLR | 100 | | | | | | |
| HA | H14 | 151 | 0 | yes | 1 | 0 | 100 | SSSACLRG | 100 | | | | | | |
| HA | H14 | 152 | 0 | yes | 1 | 0 | 100 | SSACLRGG | 100 | | | | | | |
| HA | H14 | 153 | 0 | yes | 1 | 0 | 100 | SACLRGGR | 100 | | | | | | |
| HA | H14 | 154 | 0 | yes | 1 | 0 | 100 | ACLRGGRN | 100 | | | | | | |
| HA | H14 | 155 | 0 | yes | 1 | 0 | 100 | CLRGGRNS | 100 | | | | | | |
| HA | H14 | 156 | 0 | yes | 1 | 0 | 100 | LRGGRNSF | 100 | | | | | | |
| HA | H14 | 157 | 0 | yes | 1 | 0 | 100 | RGGRNSFF | 100 | | | | | | |
| HA | H14 | 158 | 0 | yes | 1 | 0 | 100 | GGRNSFFS | 100 | | | | | | |
| HA | H14 | 159 | 0 | yes | 1 | 0 | 100 | GRNSFFSR | 100 | | | | | | |
| HA | H14 | 160 | 0 | yes | 1 | 0 | 100 | RNSFFSRL | 100 | | | | | | |
| HA | H14 | 161 | 0 | yes | 1 | 0 | 100 | NSFFSRLN | 100 | | | | | | |
| HA | H14 | 162 | 0 | yes | 1 | 0 | 100 | SFFSRLNW | 100 | | | | | | |
| HA | H14 | 163 | 0 | yes | 1 | 0 | 100 | FFSRLNWL | 100 | | | | | | |
| HA | H14 | 164 | 0 | yes | 1 | 0 | 100 | FSRLNWLT | 100 | | | | | | |
| HA | H14 | 165 | 0 | yes | 1 | 0 | 100 | SRLNWLTK | 100 | | | | | | |
| HA | H14 | 166 | 0.81 | yes | 2 | 0 | 100 | RLNWLTKA | 75 | RLNWLTKE | 25 | | | | |
| HA | H14 | 167 | 0.81 | yes | 2 | 0 | 100 | LNWLTKAT | 75 | LNWLTKET | 25 | | | | |
| HA | H14 | 168 | 0.81 | yes | 2 | 0 | 100 | NWLTKATN | 75 | NWLTKETN | 25 | | | | |
| HA | H14 | 169 | 0.81 | yes | 2 | 0 | 100 | WLTKATNG | 75 | WLTKETNG | 25 | | | | |
| HA | H14 | 170 | 0.81 | yes | 2 | 0 | 100 | LTKATNGN | 75 | LTKETNGN | 25 | | | | |
| HA | H14 | 171 | 0.81 | yes | 2 | 0 | 100 | TKATNGNY | 75 | TKETNGNY | 25 | | | | |
| HA | H14 | 172 | 0.81 | yes | 2 | 0 | 100 | KATNGNYG | 75 | KETNGNYG | 25 | | | | |
| HA | H14 | 173 | 0.81 | yes | 2 | 0 | 100 | ATNGNYGP | 75 | ETNGNYGP | 25 | | | | |
| HA | H14 | 174 | 0 | yes | 1 | 0 | 100 | TNGNYGPI | 100 | | | | | | |
| HA | H14 | 175 | 0 | yes | 1 | 0 | 100 | NGNYGPIN | 100 | | | | | | |
| HA | H14 | 176 | 0 | yes | 1 | 0 | 100 | GNYGPINV | 100 | | | | | | |
| HA | H14 | 177 | 0 | yes | 1 | 0 | 100 | NYGPINVT | 100 | | | | | | |
| HA | H14 | 178 | 0 | yes | 1 | 0 | 100 | YGPINVTK | 100 | | | | | | |
| HA | H14 | 179 | 0 | yes | 1 | 0 | 100 | GPINVTKE | 100 | | | | | | |
| HA | H14 | 180 | 0 | yes | 1 | 0 | 100 | PINVTKEN | 100 | | | | | | |
| HA | H14 | 181 | 0 | yes | 1 | 0 | 100 | INVTKENT | 100 | | | | | | |
| HA | H14 | 182 | 0 | yes | 1 | 0 | 100 | NVTKENTG | 100 | | | | | | |

FIG. 72-118

| Protein | Sub-type | Start Pos | Block Entropy | Gaps <10% | # to cover 99% | Gap % | Coverage | Peptides included | Freq |
|---|---|---|---|---|---|---|---|---|---|
| HA | H14 | 183 | 0 | yes | – | 0 | 100 | VTKENTGS | 100 |
| HA | H14 | 184 | 0 | yes | – | 0 | 100 | TKENTGSY | 100 |
| HA | H14 | 185 | 0 | yes | – | 0 | 100 | KENTGSYY | 100 |
| HA | H14 | 186 | 0 | yes | – | 0 | 100 | ENTGSYYR | 100 |
| HA | H14 | 187 | 0 | yes | – | 0 | 100 | NTGSYYRL | 100 |
| HA | H14 | 188 | 0 | yes | – | 0 | 100 | TGSYYRLY | 100 |
|

FIG. 72-119

| Protein | Sub-type | Start Pos | Block | Entropy | Gaps <10% | # to 99% cover | Gap % | Coverage | Peptides included | Freq |
|---|---|---|---|---|---|---|---|---|---|---|
| HA | H14 | 225 | 0 | 0 | yes | 1 | 0 | 100 | SDQISIVP | 100 |
| HA | H14 | 226 | 0 | 0 | yes | 1 | 0 | 100 | DQISIVPN | 100 |
| HA | H14 | 227 | 0 | 0 | yes | 1 | 0 | 100 | QISIVPNI | 100 |
| HA | H14 | 228 | 0 | 0 | yes | 1 | 0 | 100 | ISIVPNIG | 100 |
| HA | H14 | 229 | 0 | 0 | yes | 1 | 0 | 100 | SIVPNIGS | 100 |
| HA | H14 | 230 | 0 | 0 | yes | 1 | 0 | 100 | IVPNIGSR | 100 |
| HA | H14 | 231 | 0 | 0 | yes | 1 | 0 | 100 | VPNIGSRP | 100 |
| HA | H14 | 232 | 0 | 0 | yes | 1 | 0 | 100 | PNIGSRPR | 100 |
| HA | H14 | 233 | 0 | 0 | yes | 1 | 0 | 100 | NIGSRPRV | 100 |
| HA | H14 | 234 | 0 | 0 | yes | 1 | 0 | 100 | IGSRPRVR | 100 |
| HA | H14 | 235 | 0 | 0 | yes | 1 | 0 | 100 | GSRPRVRN | 100 |
| HA | H14 | 236 | 0 | 0 | yes | 1 | 0 | 100 | SRPRVRNQ | 100 |
| HA | H14 | 237 | 0 | 0 | yes | 1 | 0 | 100 | RPRVRNQS | 100 |
| HA | H14 | 238 | 0 | 0 | yes | 1 | 0 | 100 | PRVRNQSG | 100 |
| HA | H14 | 239 | 0 | 0 | yes | 1 | 0 | 100 | RVRNQSGR | 100 |
| HA | H14 | 240 | 0 | 0 | yes | 1 | 0 | 100 | VRNQSGRI | 100 |
| HA | H14 | 241 | 0 | 0 | yes | 1 | 0 | 100 | RNQSGRIS | 100 |
| HA | H14 | 242 | 0 | 0 | yes | 1 | 0 | 100 | NQSGRISI | 100 |
| HA | H14 | 243 | 0 | 0 | yes | 1 | 0 | 100 | QSGRISIY | 100 |
| HA | H14 | 244 | 0 | 0 | yes | 1 | 0 | 100 | SGRISIYW | 100 |
| HA | H14 | 245 | 0 | 0 | yes | 1 | 0 | 100 | GRISIYWT | 100 |
| HA | H14 | 246 | 0 | 0 | yes | 1 | 0 | 100 | RISIYWTL | 100 |
| HA | H14 | 247 | 0 | 0 | yes | 1 | 0 | 100 | ISIYWTLV | 100 |
| HA | H14 | 248 | 0 | 0 | yes | 1 | 0 | 100 | SIYWTLVN | 100 |
| HA | H14 | 249 | 0 | 0 | yes | 1 | 0 | 100 | IYWTLVNP | 100 |
| HA | H14 | 250 | 0 | 0 | yes | 1 | 0 | 100 | YWTLVNPG | 100 |
| HA | H14 | 251 | 0 | 0 | yes | 1 | 0 | 100 | WTLVNPGD | 100 |
| HA | H14 | 252 | 0 | 0 | yes | 1 | 0 | 100 | TLVNPGDS | 100 |
| HA | H14 | 253 | 0 | 0 | yes | 1 | 0 | 100 | LVNPGDSI | 100 |
| HA | H14 | 254 | 0 | 0 | yes | 1 | 0 | 100 | VNPGDSII | 100 |
| HA | H14 | 255 | 0 | 0 | yes | 1 | 0 | 100 | NPGDSIIF | 100 |
| HA | H14 | 256 | 0 | 0 | yes | 1 | 0 | 100 | PGDSIIFN | 100 |
| HA | H14 | 257 | 0 | 0 | yes | 1 | 0 | 100 | GDSIIFNS | 100 |
| HA | H14 | 258 | 0 | 0 | yes | 1 | 0 | 100 | DSIIFNSI | 100 |
| HA | H14 | 259 | 0 | 0 | yes | 1 | 0 | 100 | SIIFNSIG | 100 |
| HA | H14 | 260 | 0 | 0 | yes | 1 | 0 | 100 | IIFNSIGN | 100 |
| HA | H14 | 261 | 0 | 0 | yes | 1 | 0 | 100 | IFNSIGNL | 100 |
| HA | H14 | 262 | 0 | 0 | yes | 1 | 0 | 100 | FNSIGNLI | 100 |
| HA | H14 | 263 | 0 | 0 | yes | 1 | 0 | 100 | NSIGNLIA | 100 |
| HA | H14 | 264 | 0 | 0 | yes | 1 | 0 | 100 | SIGNLIAP | 100 |
| HA | H14 | 265 | 0 | 0 | yes | 1 | 0 | 100 | IGNLIAPR | 100 |
| HA | H14 | 266 | 0 | 0 | yes | 1 | 0 | 100 | GNLIAPRG | 100 |

FIG. 72-120

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 267 | 0 | yes | — | 0 | 100 | NLIAPRGH | 100 | | | | | | |
| HA | H14 | 268 | 0 | yes | — | 0 | 100 | LIAPRGHY | 100 | | | | | | |
| HA | H14 | 269 | 0 | yes | — | 0 | 100 | IAPRGH

FIG. 72-121

| Protein | Sub-type | Start Pos | Block | Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|---|
| HA | H4 | 309 | 0 | 0 | yes | — | 0 | 100 | DKPFQNVS | 100 | | | | | | |
| HA | H4 | 310 | 0 | 0 | yes | — | 0 | 100 | KPFQNVSR | 100 | | | | | | |
| HA | H4 | 311 | 0 | 0 | yes | — | 0 | 100 | PFQNVSRI | 100 | | | | | | |
| HA | H4 | 312 | 0 | 0 | yes | — | 0 | 100 | FQNVSRIA | 100 | | | | | | |
| HA | H4 | 313 | 0 | 0 | yes | — | 0 | 100 | QNVSRIAI | 100 | | | | | | |
| HA | H4 | 314 | 0 | 0 | yes | — | 0 | 100 | NVSRIAIG | 100 | | | | | | |
| HA | H4 | 315 | 0 | 0 | yes | — | 0 | 100 | VSRIAIGN | 100 | | | | | | |
| HA | H4 | 316 | 0 | 0 | yes | — | 0 | 100 | SRIAIGNC | 100 | | | | | | |
| HA | H4 | 317 | 0 | 0 | yes | — | 0 | 100 | RIAIGNCP | 100 | | | | | | |
| HA | H4 | 318 | 0 | 0 | yes | — | 0 | 100 | IAIGNCPK | 100 | | | | | | |
| HA | H4 | 319 | 0 | 0 | yes | — | 0 | 100 | AIGNCPKY | 100 | | | | | | |
| HA | H4 | 320 | 0 | 0 | yes | — | 0 | 100 | IGNCPKYV | 100 | | | | | | |
| HA | H4 | 321 | 0 | 0 | yes | — | 0 | 100 | GNCPKYVK | 100 | | | | | | |
| HA | H4 | 322 | 0 | 0 | yes | — | 0 | 100 | NCPKYVKQ | 100 | | | | | | |
| HA | H4 | 323 | 0 | 0 | yes | — | 0 | 100 | CPKYVKQG | 100 | | | | | | |
| HA | H4 | 324 | 0 | 0 | yes | — | 0 | 100 | PKYVKQGS | 100 | | | | | | |
| HA | H4 | 325 | 0 | 0 | yes | — | 0 | 100 | KYVKQGSL | 100 | | | | | | |
| HA | H4 | 326 | 0 | 0 | yes | — | 0 | 100 | YVKQGSLM | 100 | | | | | | |
| HA | H4 | 327 | 0 | 0 | yes | — | 0 | 100 | VKQGSLML | 100 | | | | | | |
| HA | H4 | 328 | 0 | 0 | yes | — | 0 | 100 | KQGSLMLA | 100 | | | | | | |
| HA | H4 | 329 | 0 | 0 | yes | — | 0 | 100 | QGSLMLAT | 100 | | | | | | |
| HA | H4 | 330 | 0 | 0 | yes | — | 0 | 100 | GSLMLATG | 100 | | | | | | |
| HA | H4 | 331 | 0 | 0 | yes | — | 0 | 100 | SLMLATGM | 100 | | | | | | |
| HA | H4 | 332 | 0 | 0 | yes | — | 0 | 100 | LMLATGMR | 100 | | | | | | |
| HA | H4 | 333 | 0 | 0 | yes | — | 0 | 100 | MLATGMRN | 100 | | | | | | |
| HA | H4 | 334 | 0 | 0 | yes | — | 0 | 100 | LATGMRNI | 100 | | | | | | |
| HA | H4 | 335 | 0 | 0 | yes | — | 0 | 100 | ATGMRNIP | 100 | | | | | | |
| HA | H4 | 336 | 0 | 0 | yes | — | 0 | 100 | TGMRNIPG | 100 | | | | | | |
| HA | H4 | 337 | 0 | 0 | yes | — | 0 | 100 | GMRNIPGK | 100 | | | | | | |
| HA | H4 | 338 | 0 | 0 | yes | — | 0 | 100 | MRNIPGKQ | 100 | | | | | | |
| HA | H4 | 339 | 0 | 0 | yes | — | 0 | 100 | RNIPGKQA | 100 | | | | | | |
| HA | H4 | 340 | 0 | 0 | yes | — | 0 | 100 | NIPGKQAK | 100 | | | | | | |
| HA | H4 | 341 | 0 | 0 | yes | — | 0 | 100 | IPGKQAKG | 100 | | | | | | |
| HA | H4 | 342 | 0 | 0 | yes | — | 0 | 100 | PGKQAKGL | 100 | | | | | | |
| HA | H4 | 343 | 0 | 0 | yes | — | 0 | 100 | GKQAKGLF | 100 | | | | | | |
| HA | H4 | 344 | 0 | 0 | yes | — | 0 | 100 | KQAKGLFG | 100 | | | | | | |
| HA | H4 | 345 | 0 | 0 | yes | — | 0 | 100 | QAKGLFGA | 100 | | | | | | |
| HA | H4 | 346 | 0 | 0 | yes | — | 0 | 100 | AKGLFGAI | 100 | | | | | | |
| HA | H4 | 347 | 0 | 0 | yes | — | 0 | 100 | KGLFGAIA | 100 | | | | | | |
| HA | H4 | 348 | 0 | 0 | yes | — | 0 | 100 | GLFGAIAG | 100 | | | | | | |
| HA | H4 | 349 | 0 | 0 | yes | — | 0 | 100 | LFGAIAGF | 100 | | | | | | |
| HA | H4 | 350 | 0 | 0 | yes | — | 0 | 100 | FGAIAGFI | 100 | | | | | | |

FIG.72-122

| Protein | Sub-type | Start Pos | Block | Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|---|
| HA | H14 | 351 | 0 | 0 | yes | — | 0 | 100 | GAIAGFIE | 100 | | | | | | |
| HA | H14 | 352 | 0 | 0 | yes | — | 0 | 100 | AIAGFIEN | 100 | | |

FIG. 72-124

| Protein | Sub-type | Start Pos | Block Entropy | Gaps <10% | # to cover 99% | Gap % | Coverage | Peptides included | Freq |
|---|---|---|---|---|---|---|---|---|---|
| HA | H14 | 435 | 0 | yes | — | 0 | 100 | KIDLWSYN | 100 |
| HA | H14 | 436 | 0 | yes | — | 0 | 100 | IDLWSYNA | 100 |
| HA | H14 | 437 | 0 | yes | — | 0 | 100 | DLWSYNAE | 100 |
| HA | H14 | 438 | 0 | yes | — | 0 | 100 | LWSYNAEL | 100 |
| HA | H14 | 439 | 0 | yes | — | 0 | 100 | WSYNAELL | 100 |
| HA | H14 | 440 | 0 | yes | — | 0 | 100 | SYNAELLV | 100 |
| HA | H14 | 441 | 0 | yes | — | 0 | 100 | YNAELLVA | 100 |
| HA | H14 | 442 | 0 | yes | — | 0 | 100 | NAELLVAL | 100 |
| HA | H14 | 443 | 0 | yes | — | 0 | 100 | AELLVALE | 100 |
| HA | H14 | 444 | 0 | yes | — | 0 | 100 | ELLVALEN | 100 |
| HA | H14 | 445 | 0 | yes | — | 0 | 100 | LLVALENQ | 100 |
| HA | H14 | 446 | 0 | yes | — | 0 | 100 | LVALENQH | 100 |
| HA | H14 | 447 | 0 | yes | — | 0 | 100 | VALENQHT | 100 |
| HA | H14 | 448 | 0 | yes | — | 0 | 100 | ALENQHTI | 100 |
| HA | H14 | 449 | 0 | yes | — | 0 | 100 | LENQHTID | 100 |
| HA | H14 | 450 | 0 | yes | — | 0 | 100 | ENQHTIDV | 100 |
| HA | H14 | 451 | 0 | yes | — | 0 | 100 | NQHTI

FIG.72-125

| Protein | Sub-type | Start Pos | Block | Entropy | Gaps >10% | # to cover 99% | % Gap | Coverage | Peptides included | Freq |
|---|---|---|---|---|---|---|---|---|---|---|
| HA | H14 | 477 | 0 | 0 | yes | - | 0 | 100 | AEDQGNGC | 100 |
| HA | H14 | 478 | 0 | 0 | yes | - | 0 | 100 | EDQGNGCF | 100 |
| HA | H14 | 479 | 0 | 0 | yes | - | 0 | 100 | D

FIG.72-126

| Protein | Sub-type | Start Pos | Block Entropy | Gaps <10% | # to cover 99% | Gap % | Coverage | Peptides included | Freq |
|---|---|---|---|---|---|---|---|---|---|
| HA | H4 | 519 | 0 | yes | | 0 | 100 | KINPVTLT | 100 |
| HA | H4 | 520 | 0 | yes | | 0 | 100 | INPVTLTM | 100 |
| HA | H4 | 521 | 0 | yes | | 0 | 100 | NPVTLTMG | 100 |
| HA | H4 | 522 | 0 | yes | | 0 | 100 | PVTLTMGY | 100 |
| HA | H4 | 523 | 0 | yes | | 0 | 100 | VTLTMGYK | 100 |
| HA | H4 | 524 | 0 | yes | | 0 | 100 | TLTMGYKD | 100 |
| HA | H4 | 525 | 0 | yes | | 0 | 100 | LTMGYKDI | 100 |
| HA | H4 | 526 | 0 | yes | | 0 | 100 | TMGYKDII | 100 |
| HA | H4 | 527 | 0 | yes | | 0 | 100 | MGYKDIIL | 100 |
| HA | H4 | 528 | 0 | yes | | 0 | 100 | GYKDIILW | 100 |
| HA | H4 | 529 | 0 | yes | | 0 | 100 | YKDIILWI | 100 |
| HA | H4 | 530 | 0 | yes | | 0 | 100 | KDIILWIS | 100 |
| HA | H4 | 531 | 0 | yes | | 0 | 100 | DIILWISF | 100 |
| HA | H4 | 532 | 0 | yes | | 0 | 100 | IILWISFS | 100 |
| HA | H4 | 533 | 0 | yes | | 0 | 100 | ILWISFSM | 100 |
| HA | H4 | 534 | 0 | yes | | 0 | 100 | LWISFSMS | 100 |
| HA | H4 | 535 | 0 | yes | | 0 | 100 | WISFSMSC | 100 |
| HA | H4 | 536 | 0 | yes | | 0 | 100 | ISFSMSCF | 100 |
| HA | H4 | 537 | 0 | yes | | 0 | 100 | SFSMSCFV | 100 |
| HA | H4 | 538 | 0 | yes | | 0 | 100 | FSMSCFVF | 100 |
| HA | H4 | 539 | 0 | yes | | 0 | 100 | SMSCFVFV | 100 |
| HA | H4 | 540 | 0 | yes | | 0 | 100 | MSCFVFVA | 100 |
| HA | H4 | 541 | 0 | yes | | 0 | 100 | SCFVFVAL | 100 |
| HA | H4 | 542 | 0 | yes | | 0 | 100 | CFVFVALI | 100 |
| HA | H4 | 543 | 0 | yes | | 0 | 100 | FVFVALIL | 100 |
| HA | H4 | 544 | 0 | yes | | 0 | 100 | VFVALILG | 100 |
| HA | H4 | 545 | 0 | yes | | 0 | 100 | FVALILGF | 100 |
| HA | H4 | 546 | 0 | yes | | 0 | 100 | VALILGFV | 100 |
| HA | H4 | 547 | 0 | yes | | 0 | 100 | ALILGFVL | 100 |
| HA | H4 | 548 | 0 | yes | | 0 | 100 | LILGFVLW | 100 |
| HA | H4 | 549 | 0 | yes | | 0 | 100 | ILGFVLWA | 100 |
| HA | H4 | 550 | 0 | yes | | 0 | 100 | LGFVLWAC | 100 |
| HA | H4 | 551 | 0 | yes | | 0 | 100 | GFVLWACQ | 100 |
| HA | H4 | 552 | 0 | yes | | 0 | 100 | FVLWACQN | 100 |
| HA | H4 | 553 | 0 | yes | | 0 | 100 | VLWACQNG | 100 |
| HA | H4 | 554 | 0 | no | | 25 | 100 | LWACQNGN | 100 |
| HA | H4 | 555 | 0 | no | | 25 | 100 | WACQNGNI | 100 |
| HA | H4 | 556 | 0 | no | | 25 | 100 | ACQNGNIR | 100 |
| HA | H4 | 557 | 0 | no | | 25 | 100 | CQNGNIRC | 100 |
| HA | H4 | 558 | 0 | no | | 25 | 100 | QNGNIRCQ | 100 |
| HA | H4 | 559 | 0 | no | | 25 | 100 | NGNIRCQI | 100 |
| HA | H4 | 560 | 0 | no | | 25 | 100 | GNIRCQIC | 100 |

FIG. 72-127

| Protein | Sub-type | Start Pos | Block Entropy | Gaps <10% | # to cover 99% | % Gap | Coverage | Peptides included | Freq | Peptides included | Freq |
|---|---|---|---|---|---|---|---|---|---|---|---|
| HA | H15 | 561 | 0 | no | 1 | 25 | 100 | NIRCQICI | | | |
| HA | H15 | 1 | 0 | no | 1 | 18.18 | 100 | MNTQIIVI | | | |
| HA | H15 | 2 | 0 | no | 1 | 18.18 | 100 | NTQIIVIL | | | |
| HA | H15 | 3 | 0 | no | 1 | 18.18 | 100 | TQIIVILV | | | |
| HA | H15 | 4 | 0 | no | 1 | 18.18 | 100 | QIIVILVL | | | |
| HA | H15 | 5 | 0 | no | 1 | 18.18 | 100 | IIVILVLG | | | |
| HA | H15 | 6 | 0 | no | 1 | 18.18 | 100 | IVILVLGL | | | |
| HA | H15 | 7 | 0 | no | 1 | 18.18 | 100 | VILVLGLS | | | |
| HA | H15 | 8 | 0 | no | 1 | 9.09 | 100 | ILVLGLSM | | | |
| HA | H15 | 9 | 0.88 | yes | 1 | 9.09 | 100 | LVLGLSMV | | | |
| HA | H15 | 10 | 0.85 | yes | 2 | 0 | 100 | VLGLSMVK | 70 | VLGLSMVR | 30 |
| HA | H15 | 11 | 0.85 | yes | 2 | 0 | 100 | LGLSMVKS | 72.73 | LGLSMVRS | 27.27 |
| HA | H15 | 12 | 0.85 | yes | 2 | 0 | 100 | GLSMVKSD | 72.73 | GLSMVRSD | 27.27 |
| HA | H15 | 13 | 0.85 | yes | 2 | 0 | 100 | LSMVKSDK | 72.73 | LSMVRSDK | 27.27 |
| HA | H15 | 14 | 0.85 | yes | 2 | 0 | 100 | SMVKSDKI | 72.73 | SMVRSDKI | 27.27 |
| HA | H15 | 15 | 0.85 | yes | 2 | 0 | 100 | MVKSDKIC | 72.73 | MVRSDKIC | 27.27 |
| HA | H15 | 16 | 0 | yes | 1 | 0 | 100 | VKSDKICL

FIG. 72-128

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 42 | 0 | yes | 1 | 0 | 100 | VEVWNATE | 100 | | | | | | |
| HA | H15 | 43 | 0 | yes | 1 | 0 | 100 | EVWNATET | 100 | | | | | | |
| HA | H15 | 44 | 0 | yes | 1 | 0 | 100 | VWNATETV | 100 | | | | | | |
| HA | H15 | 45 | 0 | yes | 1 | 0 | 100 | WNATETVE | 100 | | | | | | |
| HA | H15 | 46 | 0 | yes | 1 | 0 | 100 | NATETVEI | 100 | | | | | | |
| HA | H15 | 47 | 0 | yes | 1 | 0 | 100 | ATETVEIT | 100 | | | | | | |
| HA | H15 | 48 | 0 | yes | 1 | 0 | 100 | TETVEITG | 100 | | | |

FIG.72-129

| Protein | Sub-type | Start Pos | Block Entropy | Gaps >10% | # to cover 99% | gap % | Coverage | Peptides included | Freq | Peptides included | Freq |
|---|---|---|---|---|---|---|---|---|---|---|---|
| HA | H5 | 84 | 0.85 | yes | 2 | 0 | 100 | CDLHLEFK | 72.73 | CDSHLEFK | 27.27 |
| HA | H5 | 85 | 0.85 | yes | 2 | 0 | 100 | DLHLEFKA | 72.73 | D

FIG. 72-130

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|
| HA | H5 | 126 | 0.85 | yes | 2 | 0 | 100 | IDKESMGF | 72.73 | IDKEPMGF | 27.27 | | | | |
| HA | H5 | 127 | 0.85 | yes | 2 | 0 | 100 | DKESMGFR | 72.73 | DKEPMGFR | 27.27 | | | | |
| HA | H5 | 128 | 0.85 | yes | 2 | 0 | 100 | KESMGFRY | 72.73 | KEPMGFRY | 27.27 | | | | |
| HA | H5 | 129 | 0.85 | yes | 2 | 0 | 100 | ESMGFRYS | 72.73 | EPMGFRYS | 27.27 | | | | |
| HA | H5 | 130 | 0.85 | yes | 2 | 0 | 100 | SMGFRYSG | 72.73 | PMGFRYSG | 27.27 | | | | |
| HA | H5 | 131 | 0 | yes | 1 | 0 | 100 | MGFRYSGI | 100 | | | | | | |
| HA | H5 | 132 | 0.85 | yes | 2 | 0 | 100 | GFRYSGIR | 72.73 | GFRYSGIK | 27.27 | | | | |
| HA | H5 | 133 | 0.85 | yes | 2 | 0 | 100 | FRYSGIRT | 72.73 | FRYSGIKT | 27.27 | | | | |
| HA | H5 | 134 | 0.85 | yes | 2 | 0 | 100 | RYSGIRTD | 72.73 | RYSGIKTD | 27.27 | | | | |
| HA | H5 | 135 | 0.85 | yes | 2 | 0 | 100 | YSGIRTDG | 72.73 | YSGIKTDG | 27.27 | | | | |
| HA | H5 | 136 | 0.85 | yes | 2 | 0 | 100 | SGIRTDGA | 72.73 | SGIKTDGA | 27.27 | | | | |
| HA | H5 | 137 | 0.85 | yes | 2 | 0 | 100 | GIRTDGAI | 72.73 | GIKTDGAI | 27.27 | | | | |
| HA | H5 | 138 | 0.85 | yes | 2 | 0 | 100 | IRTDGATS | 72.73 | IKTDGATS | 27.27 | | | | |
| HA | H5 | 139 | 0.85 | yes | 2 | 0 | 100 | RTDGATSA | 72.73 | KTDGATSA | 27.27 | | | | |
| HA | H5 | 140 | 0 | yes | 1 | 0 | 100 | TDGATSAC | 100 | | | | | | |
| HA | H5 | 141 | 0 | yes | 1 | 0 | 100 | DGATSACK | 100 | | | | | | |
| HA | H5 | 142 | 0 | yes | 1 | 0 | 100 | GATSACKR | 100 | | | | | | |
| HA | H5 | 143 | 0 | yes | 1 | 0 | 100 | ATSACKRT | 100 | | | | | | |
| HA | H5 | 144 | 0 | yes | 1 | 0 | 100 | TSACKRTV | 100 | | | | | | |
| HA | H5 | 145 | 0 | yes | 1 | 0 | 100 | SACKRTVS | 100 | | | | | | |
| HA | H5 | 146 | 0 | yes | 1 | 0 | 100 | ACKRTVSS | 100 | | | | | | |
| HA | H5 | 147 | 0 | yes | 1 | 0 | 100 | CKRTVSSF | 100 | | | | | | |
| HA | H5 | 148 | 0 | yes | 1 | 0 | 100 | KRTVSSFY | 100 | | | | | | |
| HA | H5 | 149 | 0 | yes | 1 | 0 | 100 | RTVSSFYS | 100 | | | | | | |
| HA | H5 | 150 | 0 | yes | 1 | 0 | 100 | TVSSFYSE | 100 | | | | | | |
| HA | H5 | 151 | 0 | yes | 1 | 0 | 100 | VSSFYSEM | 100 | | | | | | |
| HA | H5 | 152 | 0 | yes | 1 | 0 | 100 | SSFYSEMK | 100 | | | | | | |
| HA | H5 | 153 | 0 | yes | 1 | 0 | 100 | SFYSEMKW | 100 | | | | | | |
| HA | H5 | 154 | 0 | yes | 1 | 0 | 100 | FYSEMKWL | 100 | | | | | | |
| HA | H5 | 155 | 0.85 | yes | 2 | 0 | 100 | YSEMKWLL | 72.73 | YSEMKWIL | 27.27 | | | | |
| HA | H5 | 156 | 0.85 | yes | 2 | 0 | 100 | SEMKWLLS | 72.73 | SEMKWILS | 27.27 | | | | |
| HA | H5 | 157 | 0.85 | yes | 2 | 0 | 100 | EMKWLLSS | 72.73 | EMKWLLSS | 27.27 | | | | |
| HA | H5 | 158 | 1.24 | yes | 3 | 0 | 100 | MKWLLSSS | 63.64 | MKWLLSSK | 18.18 | MKWLSSSG | 9.09 | KWLLSSKD | 9.09 |
| HA | H5 | 159 | 1.49 | yes | 4 | 0 | 100 | KWLLSSSM | 63.64 | KWLLSSKA | 18.18 | KWLSSSGN | 9.09 | WLLSSKDN | 9.09 |
| HA | H5 | 160 | 1.49 | yes | 4 | 0 | 100 | WLLSSSMN | 63.64 | WLLSSKAN | 18.18 | WLSSSGNN | 9.09 | LSSKDNQ | 9.09 |
| HA | H5 | 161 | 1.49 | yes | 4 | 0 | 100 | LLSSSMNN | 63.64 | LLSSKANQ | 18.18 | LSSSGNNQ | 9.09 | LSSKDNQV | 9.09 |
| HA | H5 | 162 | 1.49 | yes | 4 | 0 | 100 | LSSSMNNQ | 63.64 | LSSKANQV | 18.18 | SSSGNNQV | 9.09 | SSGNNQVF | 9.09 |
| HA | H5 | 163 | 1.49 | yes | 4 | 0 | 100 | SSSMNNQV | 63.64 | SSKANQVF | 18.18 | SSGNNQVF | 9.09 | SGNNQVFP | 9.09 |
| HA | H5 | 164 | 1.49 | yes | 4 | 0 | 100 | SSMNNQVF | 63.64 | SKANQVFP | 18.18 | SGNNQVFP | 9.09 | KDNQVFPQ | 9.09 |
| HA | H5 | 165 | 1.49 | yes | 4 | 0 | 100 | SMNNQVFP | 63.64 | KANQVFPQ | 18.18 | GNNQVFPQ | 9.09 | | |
| HA | H5 | 166 | 1.1 | yes | 3 | 0 | 100 | MNNQVFPQ | 63.64 | ANQVFPQL | 18.18 | DNQVFPQL | 9.09 | | |
| HA | H5 | 167 | 0 | yes | 1 | 0 | 100 | NQVFPQLN | 72.73 | | | | | | |

FIG. 72-131

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 168 | 0 | yes | 1 | 0 | 100 | QVFPQLNQ | 100 | | | | | | |
| HA | H15 | 169 | 0 | yes | 1 | 0 | 100 | VFPQLNQT | 100 | | | | | | |
| HA | H15 | 170 | 0 | yes | 1 | 0 | 100 | FPQLNQTY | 100 | | | | | | |
| HA | H15 | 171 | 0 | yes | 1 | 0 | 100 | PQLNQTYR | 100 | | | | | | |
| HA | H15 | 172 | 0 | yes | 1 | 0 | 100 | QLNQTYRN | 100 | | | | | | |
| HA | H15 | 173 | 0.85 | yes | 2 | 0 | 100 | LNQTYRNT | 72.73 | LNQTYRNN | 27.27 | | | | | |
| HA | H15 | 174 | 0.85 | yes | 2 | 0 | 100 | NQTYRNTR | 72.73 | NQTYRNNR | 27.27 | | | | | |
| HA | H15 | 175 | 0.85 | yes | 2 | 0 | 100 | QTYRNTRK | 72.73 | QTYRNNRK | 27.27 | | | | | |
| HA | H15 | 176 | 0.85 | yes | 2 | 0 | 100 | TYRNTRKE | 72.73 | TYRNNRKE | 27.27 | | | | | |
| HA | H15 | 177 | 0.85 | yes | 2 | 0 | 100 | YRNTRKEP | 72.73 | YRNNRKEP | 27.27 | | | | | |
| HA | H15 | 178 | 0.85 | yes | 2 | 0 | 100 | RNTRKEPA | 72.73 | RNNRKEPA | 27.27 | | | | | |
| HA | H15 | 179 | 0.85 | yes | 2 | 0 | 100 | NTRKEPAL | 72.73 | NRKEPAL | 27.27 | | | | | |
| HA | H15 | 180 | 0 | yes | 1 | 0 | 100 | TRKEPALI | 100 | | | | | | |
| HA | H15 | 181 | 0 | yes | 1 | 0 | 100 | RKEPALIV | 100 | | | | | | |
| HA | H15 | 182 | 0 | yes | 1 | 0 | 100 | KEPALIVW | 100 | | | | | | |
| HA | H15 | 183 | 0 | yes | 1 | 0 | 100 | EPALIVWG | 100 | | | | | | |
| HA | H15 | 184 | 0 | yes | 1 | 0 | 100 | PALIVWGV | 100 | | | | | | |
| HA | H15 | 185 | 0 | yes | 1 | 0 | 100 | ALIVWGVH | 100 | | | | | | |
| HA | H15 | 186 | 0 | yes | 1 | 0 | 100 | LIVWGVHH | 100 | | | | | | |
| HA | H15 | 187 | 0 | yes | 1 | 0 | 100 | IVWGVHHS | 100 | | | | | | |
| HA | H15 | 188 | 0 | yes | 1 | 0 | 100 | VWGVHHSS | 100 | | | | | | |
| HA | H15 | 189 | 0 | yes | 1 | 0 | 100 | WGVHHSSS | 100 | | | | | | |
| HA | H15 | 190 | 0 | yes | 1 | 0 | 100 | GVHHSSSL | 100 | | | | | | |
| HA | H15 | 191 | 0 | yes | 1 | 0 | 100 | VHHSSSLD | 100 | | | | | | |
| HA | H15 | 192 | 0 | yes | 1 | 0 | 100 | HHSSSLDE | 100 | | | | | | |
| HA | H15 | 193 | 0 | yes | 1 | 0 | 100 | HSSSLDEQ | 100 | | | | | | |
| HA | H15 | 194 | 0 | yes | 1 | 0 | 100 | SSSLDEQN | 100 | | | | | | |
| HA | H15 | 195 | 0 | yes | 1 | 0 | 100 | SSLDEQNK | 100 | | | | | | |
| HA | H15 | 196 | 0 | yes | 1 | 0 | 100 | SLDEQNKL | 100 | | | | | | |
| HA | H15 | 197 | 0 | yes | 1 | 0 | 100 | LDEQNKLY | 100 | | | | | | |
| HA | H15 | 198 | 0 | yes | 1 | 0 | 100 | DEQNKLYG | 100 | | | | | | |
| HA | H15 | 199 | 0.85 | yes | 2 | 0 | 100 | EQNKLYGT | 72.73 | EQNKLYGA | 27.27 | | | | | |
| HA | H15 | 200 | 0.85 | yes | 2 | 0 | 100 | QNKLYGTG | 72.73 | QNKLYGAG | 27.27 | | | | | |
| HA | H15 | 201 | 0.85 | yes | 2 | 0 | 100 | NKLYGTGN | 72.73 | NKLYGAGN | 27.27 | | | | | |
| HA | H15 | 202 | 0.85 | yes | 2 | 0 | 100 | KLYGTGNK | 72.73 | KLYGAGNK | 27.27 | | | | | |
| HA | H15 | 203 | 0.85 | yes | 2 | 0 | 100 | LYGTGNKL | 72.73 | LYGAGNKL | 27.27 | | | | | |
| HA | H15 | 204 | 0.85 | yes | 2 | 0 | 100 | YGTGNKLI | 72.73 | YGAGNKLI | 27.27 | | | | | |
| HA | H15 | 205 | 0.85 | yes | 2 | 0 | 100 | GTGNKLIT | 72.73 | GAGNKLIT | 27.27 | | | | | |
| HA | H15 | 206 | 0.85 | yes | 2 | 0 | 100 | TGNKLITV | 72.73 | AGNKLITV | 27.27 | | | | | |
| HA | H15 | 207 | 0 | yes | 1 | 0 | 100 | GNKLITVG | 100 | | | | | | |
| HA | H15 | 208 | 0 | yes | 1 | 0 | 100 | NKLITVGS | 100 | | | | | | |
| HA | H15 | 209 | 0 | yes | 1 | 0 | 100 | KLITVGSS | 100 | | | | | | |

FIG. 72-132

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 210 | 0 | yes | 1 | 0 | 100 | LITVGSSK | 100 | | | | | | |
| HA | H15 | 211 | 0.44 | yes | 1 | 0 | 100 | ITVGSSK

FIG. 72-133

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 252 | 0 | yes | 1 | 0 | 100 | VTF

FIG. 72-134

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 294 | 0 | yes | 1 | 0 | 100 | ESCEGECF | 100 | | | | | | |
| HA | H15 | 295 | 0 | yes | 1 | 0 | 100 | SCEGECF

FIG. 72-135

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 336 | 0 | yes | 1 | 0 | 100 | ALGMKNVP | 100 | | | | | | |
| HA | H15 | 337 | 0 | yes | 1 | 0 | 100 | LGMKNVPE | 100 | | | | | | |
| HA | H15 | 338 | 0 | yes | 1 | 0 | 100 | GMKNVPEK | 100 | | | | | | |
| HA | H15 | 339 | 0 | yes | 1 | 0 | 100 | MKNVPEKI | 100 | | | | | | |
| HA | H15 | 340 | 0.85 | yes | 1 | 0 | 100 | KNVPEKIR | 72.73 | KNVPEKIH | 27.27 | | | | |
| HA | H15 | 341 | 1.24 | yes | 2 | 0 | 100 | NVPEKIRT | 63.64 | NVPEKIHT | 27.27 | NVPEKIRV | 9.09 | | |
| HA | H15 | 342 | 1.24 | yes | 2 | 0 | 100 | VPEKIRTR | 63.64 | VPEKIHTR | 27.27 | VPEKIRVK | 9.09 | | |
| HA | H15 | 343 | 1.24 | yes | 2 | 0 | 100 | PEKIRTRG | 63.64 | PEKIHTRG | 27.27 | PEKIRVKR | 9.09 | | |
| HA | H15 | 344 | 1.24 | yes | 2 | 0 | 100 | EKIRTRGL | 63.64 | EKIHTRGL | 27.27 | EKIRVKRR | 9.09 | | |
| HA | H15 | 345 | 1.24 | yes | 2 | 0 | 100 | KIRTRGLF | 63.64 | KIHTRGLF | 27.27 | KIRVKRRP | 9.09 | | |
| HA | H15 | 346 | 1.24 | yes | 2 | 0 | 100 | IRTRGLFG | 63.64 | IHTRGLFG | 27.27 | IRVKRRPV | 9.09 | | |
| HA | H15 | 347 | 1.24 | yes | 2 | 0 | 100 | RTRGLFGA | 63.64 | HTRGLFGA | 27.27 | RVKRRPVA | 9.09 | | |
| HA | H15 | 348 | 0.44 | yes | 2 | 0 | 100 | TRGLFGAI | 90.91 | VKRRPVAK | 9.09 | | | | |
| HA | H15 | 349 | 0.44 | yes | 2 | 0 | 100 | RGLFGAIA | 90.91 | KRRPVAKA | 9.09 | | | | |
| HA | H15 | 350 | 0.44 | yes | 2 | 0 | 100 | GLFGAIAG | 90.91 | RRPVAKAG | 9.09 | | | | |
| HA | H15 | 351 | 0.44 | yes | 2 | 0 | 100 | LFGAIAGF | 90.91 | RPVAKAGF | 9.09 | | | | |
| HA | H15 | 352 | 0.44 | yes | 2 | 0 | 100 | FGAIAGFI | 90.91 | PVAKAGFI | 9.09 | | | | |
| HA | H15 | 353 | 0.44 | yes | 2 | 0 | 100 | GAIAGFIE | 90.91 | VAKAGFIE | 9.09 | | | | |
| HA | H15 | 354 | 0.44 | yes | 2 | 0 | 100 | AIAGFIEN | 90.91 | AKAGFIEN | 9.09 | | | | |
| HA | H15 | 355 | 0.44 | yes | 2 | 0 | 100 | IAGFIENG | 90.91 | KAGFIENG | 9.09 | | | | |
| HA | H15 | 356 | 0 | yes | 1 | 0 | 100 | AGFIENGW | 100 | | | | | | |
| HA | H15 | 357 | 0 | yes | 1 | 0 | 100 | GFIENGWE | 100 | | | | | | |
| HA | H15 | 358 | 0 | yes | 1 | 0 | 100 | FIENGWEG | 100 | | | | | | |
| HA | H15 | 359 | 0 | yes | 1 | 0 | 100 | IENGWEGL | 100 | | | | | | |
| HA | H15 | 360 | 0 | yes | 1 | 0 | 100 | ENGWEGLI | 100 | | | | | | |
| HA | H15 | 361 | 0 | yes | 1 | 0 | 100 | NGWEGLID | 100 | | | | | | |
| HA | H15 | 362 | 0 | yes | 1 | 0 | 100 | GWEGLIDG | 100 | | | | | | |
| HA | H15 | 363 | 0 | yes | 1 | 0 | 100 | WEGLIDGW | 100 | | | | | | |
| HA | H15 | 364 | 0 | yes | 1 | 0 | 100 | EGLIDGWY | 100 | | | | | | |
| HA | H15 | 365 | 0 | yes | 1 | 0 | 100 | GLIDGWYG | 100 | | | | | | |
| HA | H15 | 366 | 0 | yes | 1 | 0 | 100 | LIDGWYGF | 100 | | | | | | |
| HA | H15 | 367 | 0 | yes | 1 | 0 | 100 | IDGWYGFR | 100 | | | | | | |
| HA | H15 | 368 | 0 | yes | 1 | 0 | 100 | DGWYGFRH | 100 | | | | | | |
| HA | H15 | 369 | 0 | yes | 1 | 0 | 100 | GWYGFRHQ | 100 | | | | | | |
| HA | H15 | 370 | 0 | yes | 1 | 0 | 100 | WYGFRHQN | 100 | | | | | | |
| HA | H15 | 371 | 0 | yes | 1 | 0 | 100 | YGFRHQNA | 100 | | | | | | |
| HA | H15 | 372 | 0 | yes | 1 | 0 | 100 | GFRHQNAQ | 100 | | | | | | |
| HA | H15 | 373 | 0 | yes | 1 | 0 | 100 | FRHQNAQG | 100 | | | | | | |
| HA | H15 | 374 | 0 | yes | 1 | 0 | 100 | RHQNAQGQ | 100 | | | | | | |
| HA | H15 | 375 | 0 | yes | 1 | 0 | 100 | HQNAQGQG | 100 | | | | | | |
| HA | H15 | 376 | 0 | yes | 1 | 0 | 100 | QNAQGQGT | 100 | | | | | | |
| HA | H15 | 377 | 0 | yes | 1 | 0 | 100 | NAQGQGTA | 100 | | | | | | |

FIG. 72-136

| Protein | Sub-type | Start Pos | Block Entropy | Gaps <10% | # to cover 99% | Gap % | Coverage | Peptides included | Freq | Peptides included | Freq |
|---|---|---|---|---|---|---|---|---|---|---|---|
| HA | H5 | 378 | 0 | yes | 1 |

FIG. 72-137

| Protein | Sub-type | Start Pos | Block Entropy | Gaps >10% | # to cover 99% | Gap % | Coverage | Peptides included | Freq |
|---|---|---|---|---|---|---|---|---|---|
| HA | H5 | 420 | 0 | yes | — | 0 | 100 | TEVEQQIG | 100 |
| H

FIG.72-138

| Protein | Sub-type | Start Pos | Block Entropy | Gaps <10% | # to 99% cover | Gap % | Coverage | Peptides included | Freq |
|---|---|---|---|---|---|---|---|---|---|
| HA | H5 | 462 | 0 | yes | — | 0 | 100 | SEMNKLYE | 100 |
| HA | H5 | 463 | 0 | yes | — | 0 | 100 | EMNKLYER | 100 |
| HA | H5 | 464 | 0 | yes | — | 0 | 100 | MNKLYERV | 100 |
| HA | H5 | 465 | 0 | yes | — | 0 | 100 | NKLYERVR | 100 |
| HA | H5 | 466 | 0 | yes | — | 0 | 100 | KLYERVRR | 100 |
| HA | H5 | 467 | 0 | yes | — | 0 | 100 | LYERVRRQ | 100 |
| HA | H5 | 468 | 0 | yes | — | 0 | 100 | YERVRRQL | 100 |
| HA | H5 | 469 | 0 | yes | — | 0 | 100 | ERVRRQLR | 100 |
| HA | H5 | 470 | 0 | yes | — | 0 | 100 | RVRRQLRE | 100 |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H15 | 546 | 0 | yes | 1 | 9.09 | 100 | MLLAIAMG | 100 | | | | | | | | |
| HA | H15 | 547 | 0 | yes | 1 | 9.09 | 100 | LLAIAMGL | 100 | | | | | | | | |
| HA | H15 | 548 | 0 | yes | 1 | 9.09 | 100 | LAIAMGLI | 100 | | | | | | | | |
| HA | H15 | 549 | 0 | yes | 1 | 9.09 | 100 | AIAMGLIF | 100 | | | | | | | | |
| HA | H15 | 550 | 0 | yes | 1 | 9.09 | 100 | IAMGLIFM | 100 | | | | | | | | |
| HA | H15 | 551 | 0 | yes | 1 | 9.09 | 100 | AMGLIFMC | 100 | | | | | | | | |
| HA | H15 | 552 | 0 | yes | 1 | 9.09 | 100 | MGLIFMCV | 100 | | | | | | | | |
| HA | H15 | 553 | 0 | yes | 1 | 9.09 | 100 | GLIFMCVK | 100 | | | | | | | | |
| HA | H15 | 554 | 0 | yes | 1 | 0 | 100 | LIFMCVKN | 100 | | | | | | | | |
| HA | H15 | 555 | 0 | yes | 1 | 0 | 100 | IFMCVKNG | 100 | | | | | | | | |
| HA | H15 | 556 | 0 | yes | 1 | 0 | 100 | FMCVKNGN | 100 | | | | | | | | |
| HA | H15 | 557 | 0 | yes | 1 | 0 | 100 | MCVKNGNL | 100 | | | | | | | | |
| HA | H15 | 558 | 0 | yes | 1 | 0 | 100 | CVKNGNLR | 100 | | | | | | | | |
| HA | H15 | 559 | 0 | yes | 1 | 0 | 100 | VKNGNLRC | 100 | | | | | | | | |
| HA | H15 | 560 | 0 | yes | 1 | 0 | 100 | KNGNLRCT | 100 | | | | | | | | |
| HA | H15 | 561 | 0 | yes | 1 | 0 | 100 | NGNLRCTI | 100 | | | | | | | | |
| HA | H15 | 562 | 0 | yes | 1 | 0 | 100 | GNLRCTIC | 100 | | | | | | | | |
| HA | H15 | 563 | 0 | yes | 1 | 0 | 100 | NLRCTIC | 100 | | | | | | | | |
| HA | H16 | – | 1.88 | no | 5 | 9.09 | 100 | QPNDGQVL | 47.62 | | | | | | | | |
| HA | H16 | – | 1.65 | no | 4 | 9.09 | 100 | PNDGQVLY | 52.38 | | | | | | | | |
| HA | H16 | 16 | 1.46 | yes | 3 | 95.24 | 100 | GRYSKADK | 52.38 | GRYSIADK | 23.81 | GRYSRADK | 19.05 | | | SRYSKADK | 4.76 |
| HA | H16 | 17 | 1.46 | yes | 3 | 95.24 | 100 | RYSKADKI | 52.38 | RYSIADKI | 23.81 | RYSRADKI | 19.05 | | | | |
| HA | H16 | 18 | 1.46 | yes | 3 | 0 | 100 | YSKADKIC | 52.38 | YSIADKIC | 28.57 | YSRADKI | 19.05 | | | | |
| HA | H16 | 19 | 0 | yes | 1 | 0 | 100 | SKADKICI | 52.38 | SIADKIC | 28.57 | SRADKI | 19.05 | | | | |
| HA | H16 | 20 | 0 | yes | 1 | 0 | 100 | KADKICIG | 52.38 | IADKICIG | 28.57 | RADKICIG | 19.05 | | | | |
| HA | H16 | 21 | 0 | yes | 1 | 0 | 100 | ADKICIGY | 100 | | | | | | | | |
| HA | H16 | 22 | 0 | yes | 1 | 0 | 100 | DKICIGYL | 100 | | | | | | | | |
| HA | H16 | 23 | 0 | yes | 1 | 0 | 100 | KICIGYLS | 100 | | | | | | | | |
| HA | H16 | 24 | 0 | yes | 1 | 0 | 100 | ICIGYLSN | 100 | | | | | | | | |
| HA | H16 | 25 | 0.28 | yes | 2 | 0 | 100 | CIGYLSNN | 95.24 | IGYLSNNA | 4.76 | | | IGYLSNNA | 4.76 | | |

FIG.72-141

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 38 | 0.59 | yes | 2 | 0 | 100 | DTLTENGV | 85.71 | DTLTETGV | 14.29 | | | | |
| HA | H16 | 39 | 0.59 | yes | 2 | 0 | 100 | TLTENGVP | 85.71 | TLTETGVP | 14.29 | | | | |
| HA | H16 | 40 | 0.59 | yes | 2 | 0 | 100 | LTENGVPV | 85.71 | LTETGVPV | 14.29 | | | | |
| HA | H16 | 41 | 0.59 | yes | 2 | 0 | 100 | TENGVPVT | 85.71 | TETGVPVT | 14.29 | | | | |
| HA | H16 | 42 | 0.59 | yes | 2 | 0 | 100 | ENGVPVTS | 85.71 | ETGVPVTS | 14.29 | | | | |
| HA | H16 | 43 | — | yes | 2 | 0 | 100 | NGVPVTSS | 85.71 | TGVPVTSS | 14.29 | | | | |
| HA | H16 | 44 | — | yes | 2 | 0 | 100 | GVPVTSSV | 52.38 | GVPVTSSI | 47.62 | | | | |
| HA | H16 | 45 | — | yes | 2 | 0 | 100 | VPVTSSVD | 52.38 | VPVTSSID | 47.62 | | | | |
| HA | H16 | 46 | — | yes | 2 | 0 | 100 | PVTSSVDL | 52.38 | PVTSSIDL | 47.62 | | | | |
| HA | H16 | 47 | — | yes | 2 | 0 | 100 | VTSSVDLV | 52.38 | VTSSIDLV | 47.62 | | | | |
| HA | H16 | 48 | — | yes | 2 | 0 | 100 | TSSVDLVE | 52.38 | TSSIDLVE | 47.62 | | | | |
| HA | H16 | 49 | — | yes | 2 | 0 | 100 | SSVDLVET | 52.38 | SSIDLVET | 47.62 | | | | |
| HA | H16 | 50 | 0 | yes | 1 | 0 | 100 | SVDLVETN | 100 | | | | | | |
| HA | H16 | 51 | 0 | yes | 1 | 0 | 100 | VDLVETNH | 100 | | | | | | |
| HA | H16 | 52 | 0 | yes | 1 | 0 | 100 | DLVETNHT | 100 | | | | | | |
| HA | H16 | 53 | 0 | yes | 1 | 0 | 100 | LVETNHTG | 100 | | | | | | |
| HA | H16 | 54 | 0 | yes | 1 | 0 | 100 | VETNHTGT | 100 | | | | | | |
| HA | H16 | 55 | 0 | yes | 1 | 0 | 100 | ETNHTGTY | 100 | | | | | | |
| HA | H16 | 56 | 0 | yes | 1 | 0 | 100 | TNHTGTYC | 100 | | | | | | |
| HA | H16 | 57 | 0 | yes | 1 | 0 | 100 | NHTGTYCS | 100 | | | | | | |
| HA | H16 | 58 | 0 | yes | 1 | 0 | 100 | HTGTYCSL | 100 | | | | | | |
| HA | H16 | 59 | 0 | yes | 1 | 0 | 100 | TGTYCSLN | 100 | | | | | | |
| HA | H16 | 60 | 0 | yes | 1 | 0 | 100 | GTYCSLNG | 100 | | | | | | |
| HA | H16 | 61 | 0.99 | yes | 2 | 0 | 100 | TYCSLNGV | 57.14 | TYCSLNGI | 42.86 | | | | |
| HA | H16 | 62 | 0.99 | yes | 2 | 0 | 100 | YCSLNGVS | 57.14 | YCSLNGIS | 42.86 | | | | |
| HA | H16 | 63 | 0.99 | yes | 2 | 0 | 100 | CSLNGVSP | 57.14 | CSLNGISP | 42.86 | | | | |
| HA | H16 | 64 | 1.78 | yes | 4 | 0 | 100 | SLNGVSPI | 42.86 | SLNGISPI | 33.33 | SLNGVSPV | 14.29 | SLNGISPV | 9.52 |
| HA | H16 | 65 | 1.78 | yes | 4 | 0 | 100 | LNGVSPIH | 42.86 | LNGISPIH | 33.33 | LNGVSPVH | 14.29 | LNGISPVH | 9.52 |
| HA | H16 | 66 | 1.78 | yes | 4 | 0 | 100 | NGVSPIHL | 42.86 | NGISPIHL | 33.33 | NGVSPVHL | 14.29 | NGISPVHL | 9.52 |
| HA | H16 | 67 | 1.78 | yes | 4 | 0 | 100 | GVSPIHLG | 42.86 | GISPIHLG | 33.33 | GVSPVHLG | 14.29 | GISPVHLG | 9.52 |
| HA | H16 | 68 | 1.78 | yes | 4 | 0 | 100 | VSPIHLGD | 42.86 | ISPIHLGD | 33.33 | VSPVHLGD | 14.29 | ISPVHLGD | 9.52 |
| HA | H16 | 69 | 0.79 | yes | 2 | 0 | 100 | SPIHLGDC | 76.19 | SPVHLGDC | 23.81 | | | | |
| HA | H16 | 70 | 0.79 | yes | 2 | 0 | 100 | PIHLGDCS | 76.19 | PVHLGDCS | 23.81 | | | | |
| HA | H16 | 71 | 0.79 | yes | 2 | 0 | 100 | IHLGDCSF | 76.19 | VHLGDCSF | 23.81 | | | | |
| HA | H16 | 72 | 0 | yes | 1 | 0 | 100 | HLGDCSFE | 100 | | | | | | |
| HA | H16 | 73 | 0 | yes | 1 | 0 | 100 | LGDCSFEG | 100 | | | | | | |
| HA | H16 | 74 | 0 | yes | 1 | 0 | 100 | GDCSFEGW | 100 | | | | | | |
| HA | H16 | 75 | 0 | yes | 1 | 0 | 100 | DCSFEGWI | 100 | | | | | | |
| HA | H16 | 76 | 0 | yes | 1 | 0 | 100 | CSFEGWIV | 100 | | | | | | |
| HA | H16 | 77 | 0 | yes | 1 | 0 | 100 | SFEGWIVG | 100 | | | | | | |
| HA | H16 | 78 | 0 | yes | 1 | 0 | 100 | FEGWIVGN | 100 | | | | | | |
| HA | H16 | 79 | 0 | yes | 1 | 0 | 100 | EGWIVGNP | 100 | | | | | | |

FIG. 72-142

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 80 | 0 | yes | 1 | 0 | 100 | GWIVGNPS | 100 | | | | | | |
| HA | H16 | 81 | 0 | yes | 1 | 0 | 100 | WIVGNPSC | 100 | | | | | | |
| HA | H16 | 82 | 0 | yes | 1 | 0 | 100 | IVGNPSCA | 100 | | | | | | |
| HA | H16 | 83 | 0.79 | yes | 2 | 0 | 100 | VGNPSCAT | 76.19 | VGNPSCAS | 23.81 | | | | | |
| HA | H16 | 84 | 0.79 | yes | 2 | 0 | 100 | GNPSCATN | 76.19 | GNPSCASN | 23.81 | | | | | |
| HA | H16 | 85 | 0.79 | yes | 2 | 0 | 100 | NPSCATNI | 76.19 | NPSCASNI | 23.81 | | | | | |
| HA | H16 | 86 | 0.79 | yes | 2 | 0 | 100 | PSCATNIN | 76.19 | PSCASNIN | 23.81 | | | | | |
| HA | H16 | 87 | 0.79 | yes | 2 | 0 | 100 | SCATNINI | 76.19 | SCASNINI | 23.81 | | | | | |
| HA | H16 | 88 | 0.79 | yes | 2 | 0 | 100 | CATNINIR | 76.19 | CASNINIR | 23.81 | | | | | |
| HA | H16 | 89 | 0.79 | yes | 2 | 0 | 100 | ATNINIRE | 76.19 | ASNINIRE | 23.81 | | | | | |
| HA | H16 | 90 | 0.79 | yes | 2 | 0 | 100 | TNINIREW | 76.19 | SNINIREW | 23.81 | | | | | |
| HA | H16 | 91 | 0 | yes | 1 | 0 | 100 | NINIREWS | 100 | | | | | | |
| HA | H16 | 92 | 0 | yes | 1 | 0 | 100 | INIREWSY | 100 | | | | | | |
| HA | H16 | 93 | 0 | yes | 1 | 0 | 100 | NIREWSYL | 100 | | | | | | |
| HA | H16 | 94 | 0 | yes | 1 | 0 | 100 | IREWSYLI | 100 | | | | | | |
| HA | H16 | 95 | 0 | yes | 1 | 0 | 100 | REWSYLIE | 100 | | | | | | |
| HA | H16 | 96 | 0 | yes | 1 | 0 | 100 | EWSYLIED | 100 | | | | | | |
| HA | H16 | 97 | 0 | yes | 1 | 0 | 100 | WSYLIEDP | 100 | | | | | | |
| HA | H16 | 98 | 0 | yes | 1 | 0 | 100 | SYLIEDPN | 100 | | | | | | |
| HA | H16 | 99 | 0 | yes | 1 | 0 | 100 | YLIEDPNA | 100 | |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 185 | 0 | yes | 1 | 0 | 100 | NNTGRDV | 100 | | | | | | |
| HA | H6 | 186 | 0 | yes | 1 | 0 | 100 | NTGRDVL | 100 | | | | | | |
| HA | H6 | 187 | 0 | yes | 1 | 0 | 100 | TGRDVLV | 100 | | | | | | |
| HA | H6 | 188 | 0 | yes | 1 | 0 | 100 | GRDVLVL | 100 | | | | | | |
| HA | H6 | 189 | 0 | yes | 1 | 0 | 100 | RDVLVLW | 100 | | | | | | |
| HA | H6 | 190 | 0 | yes | 1 | 0 | 100 | DVLVLWG | 100 | | | | | | |
| HA | H6 | 191 | 0 | yes | 1 | 0 | 100 | VLVLWGI | 100 | | | | | | |
| HA | H6 | 192 | 0 | yes | 1 | 0 | 100 | LVLWGIH | 100 | | | | | | |
| HA | H6 | 193 | 0 | yes | 1 | 0 | 100 | VLWGIHH | 100 | | | | | | |
| HA | H6 | 194 | 0 | yes | 1 | 0 | 100 | LWGIHHP | 100 | | | | | | |
| HA | H6 | 195 | 0 | yes | 1 | 0 | 100 | WGIHHPD | 100 | | | | | | |
| HA | H6 | 196 | 0.86 | yes | 2 | 0 | 100 | GIHHPDT | 71.43 | WGIHHPDS | 28.57 | | | | | |
| HA | H6 | 197 | 0.86 | yes | 2 | 0 | 100 | IHHPDTE | 71.43 | GIHHPDSE | 28.57 | | | | | |
| HA | H6 | 198 | 1.78 | yes | 4 | 0 | 100 | HHPDTEA | 33.33 | IHHPDSET | 33.33 | IHHPDTEE | 28.57 | HHPDTEAV | 4.76 |
| HA | H6 | 199 | 1.98 | yes | 5 | 0 | 100 | HPDTETT | 33.33 | HHPDTEAT | 28.57 | HHPDTEEV | 28.57 | HPDTEAVA | 4.76 |
| HA | H6 | 200 | 1.98 | yes | 5 | 0 | 100 | HPDTETTA | 33.33 | HPDSETTA | 28.57 | HPDTEEVA | 28.57 | AINLYASK | 4.76 |
| HA | H6 | 207 | 1.87 | yes | 5 | 0 | 100 | ATNLYNK | 33.33 | ANKLYYNK | 28.57 | ATRLYYNK | 14.29 | INLYASKN | 4.76 |
| HA | H6 | 208 | 1.87 | yes | 5 | 0 | 100 | TNLYNKN | 33.33 | NKLYYNKN | 28.57 | TRLYYNKN | 14.29 | | |
| HA | H6 | 209 | 1.45 | yes | 4 | 0 | 100 | NLYNKNP | 42.86 | NLYASKNP | 4.76 | RLYYNKNP | 4.76 | | |
| HA | H6 | 210 | 0.28 | yes | 2 | 0 | 100 | LYYNKPY | 42.86 | LYASKNPY | 4.76 | | | | |
| HA | H6 | 211 | 0.28 | yes | 2 | 0 | 100 | YYNKPPY | 95.24 | YASKNPYT | 4.76 | | | | |
| HA | H6 | 212 | 0.28 | yes | 2 | 0 | 100 | YNKNPYT | 95.24 | ASKNPYTL | 4.76 | | | | |
| HA | H6 | 213 | 0.28 | yes | 2 | 0 | 100 | NKNPYTL | 95.24 | SKNPYTLV | 4.76 | | | | |
| HA | H6 | 214 | 0 | yes | 1 | 0 | 100 | KNPYTLV | 95.24 | | | | | | |
| HA | H6 | 215 | 0 | yes | 1 | 0 | 100 | NPYTLVS | 100 | | | | | | |
| HA | H6 | 216 | 0 | yes | 1 | 0 | 100 | PYTLVST | 100 | | | | | | |
| HA | H6 | 217 | 0 | yes | 1 | 0 | 100 | YTLVSTK | 100 | | | | | | |
| HA | H6 | 218 | 0 | yes | 1 | 0 | 100 | TLVSTKE | 100 | | | | | | |
| HA | H6 | 219 | 0 | yes | 1 | 0 | 100 | LVSTKEW | 100 | | | | | | |
| HA | H6 | 220 | 0.92 | yes | 2 | 0 | 100 | VSTKEWS | 66.67 | VSTKEWSR | 33.33 | | | | |
| HA | H6 | 221 | 0.92 | yes | 2 | 0 | 100 | STKEWSK | 66.67 | STKEWSRR | 33.33 | | | | |
| HA | H6 | 222 | 0.92 | yes | 2 | 0 | 100 | TKEWSKR | 66.67 | TKEWSRRY | 33.33 | | | | |
| HA | H6 | 223 | 0.92 | yes | 2 | 0 | 100 | KEWSKRY | 66.67 | KEWSRRYE | 33.33 | | | | |
| HA | H6 | 224 | 0.92 | yes | 2 | 0 | 100 | EWSKRYE | 66.67 | EWSRRYEL | 33.33 | | | | |
| HA | H6 | 225 | 0.92 | yes | 2 | 0 | 100 | WSKRYEL | 66.67 | WSRRYELE | 33.33 | | |

FIG. 72-145

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 233 | 0.29 | yes | 2 | 4.76 | 100 | IGTRIGDG | 95 | IGARIGEG | 5 | | | | |

FIG. 72-146

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H16 | 277 | 0.86 | yes | 2 | 0 | 100 | KYGTGRIF | 71.43 | KYGTGRIF | 71.43 | |

FIG.72-147

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|
| HA | H16 | 327 | 0 | yes | 1 | 0 | 100 | SGQLKLAT | 100 | | | | | | | | |
| HA | H16 | 328 | 0 | yes | 1 | 0 | 100 | GQLKLATG

FIG. 72-148

| Protein | Sub-type | Start Pos | Block Entropy | Gaps > 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 376 | 0 | yes | 1 | 0 | 100 | QGTGIAAD | 100 | | | | | | |
| HA | H16 | 377 | 0 | yes | 1 | 0 | 100 | GTGIAADK | 100 | | | | | | |
| HA | H16 | 378 | 1.32 | yes | 3 | 0 | 100 | TGIAADKA | 61.9 | TGIAADKT | 23.81 | TGIAADKV | 14.29 | | | |
| HA | H16 | 379 | 1.32 | yes | 3 | 0 | 100 | GIAADKAS | 61.9 | GIAADKTS | 23.81 | GIAADKVS | 14.29 | | | |
| HA | H16 | 380 | 1.32 | yes | 3 | 0 | 100 | IAADKAST | 61.9 | IAADKTST | 23.81 | IAADKVST | 14.29 | | | |
| HA | H16 | 381 | 1.32 | yes | 3 | 0 | 100 | AADKASTQ | 61.9 | AADKTSTQ | 23.81 | AADKVSTQ | 14.29 | | | |
| HA | H16 | 382 | 1.32 | yes | 3 | 0 | 100 | ADKASTQK | 61.9 | ADKTSTQK | 23.81 | ADKVSTQK | 14.29 | | | |
| HA | H16 | 383 | 1.45 | yes | 4 | 0 | 100 | DKASTQKA | 61.9 | DKTSTQKA | 23.81 | DKVSTQKA | 9.52 | | | |
| HA | H16 | 384 | 2.07 | yes | 5 | 0 | 100 | KASTQKAI | 33.33 | KTSTQKAI | 23.81 | KVSTQKAI | 28.57 | KVSTQKAL | 4.76 | |
| HA | H16 | 385 | 1.17 | yes | 3 | 0 | 100 | ASTQKAID | 61.9 | ASTQKAIN | 33.33 | | | VSTQKAIN | 9.52 | VSTQKALN | 4.76 |
| HA | H16 | 386 | 1.17 | yes | 3 | 0 | 100 | STQKAIDE | 61.9 | STQKAINE | 33.33 | | | | | |
| HA | H16 | 387 | 1.17 | yes | 3 | 0 | 100 | TQKAIDEI | 61.9 | TQKAINEI | 33.33 | | | | | |
| HA | H16 | 388 | 1.17 | yes | 3 | 0 | 100 | QKAIDEIT | 61.9 | QKAINEIT | 33.33 | | | | | |
| HA | H16 | 389 | 1.17 | yes | 3 | 0 | 100 | KAIDEITT | 61.9 | KAINEITT | 33.33 | | | | | |
| HA | H16 | 390 | 1.17 | yes | 3 | 0 | 100 | AIDEITTK | 61.9 | AINEITTK | 33.33 | | | | | |
| HA | H16 | 391 | 1.17 | yes | 3 | 0 | 100 | IDEITTKI | 61.9 | INEITTKI | 33.33 | | |

FIG. 72-149

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 418 | 0 | yes | 1 | 0 | 100 | QVEKRINM | 100 | | | | | | |
| HA | H16 | 419 | 0.79 | yes | 2 | 0 | 100 | VEKRINML | 76.19 | VEKRINMI | 23.81 | | | | |
| HA | H16 | 420 | 0.79 | yes | 2 | 0 | 100 | EKRINMLA | 76.19 | EKRINMIA | 23.81 | | | | |
| HA | H16 | 421 | 0.79 | yes | 2 | 0 | 100 | KRINMLAD | 76.19 | KRINMIAD | 23.81 | | | | |
| HA | H16 | 422 | 1.05 | yes | 3 | 0 | 100 | RINMLADR | 71.43 | RINMIADR | 23.81 | RINMLADW | 4.76 | | |
| HA | H16 | 423 | 1.05 | yes | 3 | 0 | 100 | INMLADRV | 71.43 | INMIADRV | 23.81 | INMLADWV | 4.76 | | |
| HA | H16 | 424 | 1.05 | yes | 3 | 0 | 100 | NMLADRVD | 71.43 | NMIADRVD | 23.81 | NMLADWVD | 4.76 | | |
| HA | H16 | 425 | 1.05 | yes | 3 | 0 | 100 | MLADRVDD | 71.43 | MIADRVDD | 23.81 | MLADWVDD | 4.76 | | |
| HA | H16 | 426 | 1.05 | yes | 3 | 0 | 100 | LADRVDDA | 71.43 | IADRVDDA | 23.81 | LADWVDDA | 4.76 | | |
| HA | H16 | 427 | 0.28 | yes | 2 | 0 | 100 | ADRVDDAV | 95.24 | ADWVDDAV | 4.76 | | | | |
| HA | H16 | 428 | 0.28 | yes | 2 | 0 | 100 | DRVDDAVT | 95.24 | DWVDDAVT | 4.76 | | | | |
| HA | H16 | 429 | 0.28 | yes | 2 | 0 | 100 | RVDDAVTD | 95.24 | WVDDAVTD | 4.76 | | | | |
| HA | H16 | 430 | 0.79 | yes | 2 | 0 | 100 | VDDAVTDI | 76.19 | VDDAVTDV | 23.81 | | | | |
| HA | H16 | 431 | 0.79 | yes | 2 | 0 | 100 | DDAVTDIW | 76.19 | DDAVTDVW | 23.81 | | | | |
| HA | H16 | 432 | 0.79 | yes | 2 | 0 | 100 | DAVTDIWS | 76.19 | DAVTDVWS | 23.81 | | | | |

FIG. 72-150

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 460 | 1.71 | yes | 4 | 0 | 100 | NVRNLHDQ | 52.38 | NVRNLHEQ | 23.81 | NVRNLHDQ | 14.29 | | |
| HA | H16 | 461 | 2.15 | yes | 5 | 0 | 100 | VRNLHDQV | 38.1 | VRNLHEQI | 23.81 | VRNLHEQV | 14.29 | VKNLHDQI | 9.52 |
| HA | H16 | 462 | 2.15 | yes | 5 | 0 | 100 | RNLHDQVK | 38.1 | RNLHEQIK | 23.81 | KNLHEQVK | 14.29 | KNLHDQIK | 9.52 |
| HA | H16 | 463 | 1.92 | yes | 4 | 0 | 100 | NLHDQVKR | 47.62 | NLHEQIKR | 23.81 | NLHEQVKR | 14.29 | | |
| HA | H16 | 472 | 1.7 | yes | 3 | 0 | 100 | LKNNAIDE | 47.62 | LKSNAIDE | 23.81 | LQNNA

FIG.72-151

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 510 | 0.28 | yes | 2 | 0 | 100 | EESQLKRQ | 95.24 | EESQLKQ | 4.76 | | | | |

FIG. 72-152

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 552 | 0.59 | yes | 2 | 0 | 100 | AFIMWACS | 85.71 | AFILWACS | 14.29 | | | | |
| HA | H6 | 553 | 1.32 | yes | 3 | 0 | 100 | FIMWACSN | 61.9 | FIMWACSS | 23.81 | | | | |
| HA | H6 | 554 | 1.35 | yes | 4 | 4.76 | 100 | IMWACSNG | 60 | ILWACSSG | 25 | | | | |
| HA | H6 | 555 | 1.53 | yes | 3 | 4.76 | 100 | MWACSNGN | 60 | LWACSSGN | 20 | MWACSNGN | 15 | | |
| HA | H6 | 556 | 0.99 | yes | 4 | 4.76 | 100 | WACSNGSC | 75 | WACSNGNC | 20 | | | | |
| HA | H6 | 557 | 0.99 | yes | 4 | 4.76 | 100 | ACSNGSCR | 75 | ACSNGNCR | 20 | | | | |
| HA | H6 | 558 | 1.26 | yes | 3 | 4.76 | 100 | CSNGSCRF | 75 | CSNGNCRF | 20 | | | | |
| HA | H6 | 559 | 1.26 | yes | 4 | 4.76 | 100 | SNGSCRFN | 70 | SNGNCRFN | 20 | SSGNCRFS | 5 | | |
| HA | H6 | 560 | 0.99 | yes | 3 | 4.76 | 100 | NGSCRFNV | 70 | NGNCRFNV | 20 | SGNCRFSV | 5 | | |
| HA | H6 | 561 | 0.99 | yes | - | 4.76 | 100 | GSCRFNVC | 75 | GNCRFNVC | 20 | | | | |
| HA | H1 | 562 | 0.99 | yes | - | 4.76 | 100 | SCRFNVCI | 75 | NCRFNVCI | 20 | | | | |
| HA | H1 | 1 | 0 | no | 1 | 99.95 | 100 | KQGKTK

FIG. 72-153

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H | 345 | 0 | no | 1 | 99.99 | 100 | LTSLPFQN | 100 | | | | | | |
| HA | H | 386 | 0.06 | yes | 1 | 0.09 | 99.52 | RGLFGA

| Protein | Sub-type | Start Pos | Block Entropy | Gaps <10% | # to cover 99% | % gap | coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 271 | 1.12 | yes | 4 | 0.06 | 99.26 | EATGNLV

FIG.72-157

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 366 | 0.04 | yes | 1 | 0.06 | 99.72 | AGFIEGGW | 99.72 | | | | | | |
| HA | H1N1 | 367 | 0.04 | yes | 1 | 0.11 | 99.67 | GFIEGGWT | 99.67 | | | | | | |
| HA | H1N1 | 368 | 0.04 | yes | 1 | 0.1 | 99.68 | FIEGGWTG | 99.68 | | | | | | |
| HA | H1N1 | 369 | 0.05 | yes | 1 | 0.08 |

FIG. 72-158

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 417 | 0.26 | yes | 3 | 0.07 | 99.15 | KMNTQFTA | 97.18 | KMNIQFTA | 1.5 | |

FIG. 72-159

| Protein | Sub-type | Start Pos | Block Entropy | Gaps <10% | # to cover 99% | Gap % | coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 489 | 0.29 | yes | 3 | 0.03 | 99.33 | AKEIGNGC | 96.63 | AKELGNGC | 1.55 | | | | |
| HA | H1N1 | 490 | 0.29 | yes | 3 | 0.02 | 99.35 | KEIGNGCF | 96.65 | KELGNGCF | 1.55 | | | | |
| HA | H1N1 | 491 | 0.26 | yes | 3 | 0.02 | 99.54 | EIGNGCFE | 96.84 | ELGNGCFE | 1.55 | | | | |
| HA | H1N1 | 492 | 0.27 | yes | 3 | 0.02 | 99.52 | IGNGCFEF | 96.83 | LGNGCFEF | 1.55 | | | | |
| HA | H1N1 | 493

FIG. 72-160

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|
| HA | H1N1 | 560 | 0.13 | yes | 2 | 0.31 | 99.16 | VSLGAISF | 98.8 | VSLGAVSF | 0.35 | | | | |
| HA | H1N1 | 561 | 0.11 |

FIG. 72-161

| Protein | Sub-type | Start Pos | Block Entropy | Gaps >10% | # to cover 99% | Gap % | Coverage | Included peptides | Freq | Included peptides | Freq | Included peptides | Freq | Included peptides | Freq |
|---|---|---|---|---|---|---|---|---|---|---|---|---|---|---|---|
| NA | H1N1 | 109 | 1.13 | yes | 4 | 0.06 | 99.3 | AIYTKDNS | 69.92 | AIYSKDNG | 25.87 | AIHTKDNS | 2.95 | | 0.55 |
| NA | H1N1 | 110 | 1.58 | yes | 5 | 0.07 | 99.04 | YTKDNSIR | 58.75 | YSKDNSVR | 25.86 | YSKDNG

FIG.72-162

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 154 | 1.33 | yes | 5 | 0.09 | 99.2 | KHSNG

FIG.72-163

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 205 | 0.3 | yes | 2 | 0.05 | 99.19 | GISGPDNG | 95.92 | GISGPDDG | 3.27 | | | | | |
| NA | H1N1 | 206 | 0.31 | yes | 2 | 0.05 | 99.18 | ISGPDNGA | 95.91 | ISGPDDGA | 3.27 | | | | | |
| NA | H1N1 | 207 | 0.32 | yes | 2 | 0.03 | 99.02 | SGPDNGAV | 95.75 | SGPDDGAV | 3.27 | | | | | |
| NA | H1N1 | 208 | 0.33 | yes | 2 | 0.03 | 99.02 | GPDNGAVA | 95.75 | PDDGAVA | 3.27 | | | | | |
| NA | H1N1 | 209 | 0.32 | yes | 2 | 0.06 | 99.01 | PDNGAVAV | 95.74 | PDDGAVAV | 3.27 | | |

FIG. 72-164

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 289 | 0.22 | yes | 2 | 0.09 | 99.77 | EEC

FIG. 72-165

| Protein | Sub-type | Start Pos | Block Entropy | Gaps <10% | # of to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 368 | 0.12 | yes | 2 | 0.03 | 99.17 | NGVWIGRT | 98.91 | NGVWMGRT | 0.26 | | | | |
| NA | H1N1 | 369 | 0.09 | yes | 1 | 0.03 | 99.23 | GVWIGRTK | 99.23 | | | | | | |
| NA | H1N1 | 370 | 0.1 | yes | 1 | 0.03 | 99.08 | VWIGRTKS | 99.08 | | | | | | |
| NA | H1N1 | 371 | 1.31 | yes | 4 | 0.07 | 99.15 | WIGRTKSI | 64.03 | WIGRTKST | 27.6 | WIGRTKSN | 7.28 | WMGRTKSN | 0.23 |
| NA | H1N1 | 383 | 0.09 | yes | 1 | 0.02 | 99.18 | GFEMIWDP | 99.18 | | | | | | |
| NA | H1N1 | 384 | 0.21 | yes | 2 | 0.02 | 99.18 | FEMIWDPD | 97.59 | FEMIWDPN | 1.39 | | | | |
| NA | H1N1 | 385 | 0.21 | yes | 2 | 0.02 | 99.04 | EMIWDPNG | 97.64 | FEMWDPN | 0.33 | | | | |
| NA | H1N1 | 386 | 0.2 | yes | 2 | 0.03 | 99.07 | MIWDPNGW | 97.66 | | | | | | |
| NA | H1N1 | 387 | 1.14 | yes | 4 | 0.02 | 99.09 | IWDPDGWT | 97.68 | MIWDPDGW | 1.41 | | | | |
| NA | H1N1 | 410 | 1.06 | yes | 2 | 0.03 | 99.11 | NEWSGYSG | 57.33 | TDWSGYSG | 57.68 | NDWSGYSG | 41 | TNWSGYSG | 0.32 |
| NA | H1N1 | 411 | 0.04 | yes | 1 | 0.03 | 99.63 | EWSGYGS | 99.63 | DWSGYSGS | 41.54 | | | | |
| NA | H1N1 | 412 | 0.05 | yes | 1 | 0.02 | 99.62 | WSGYSGSF | 99.62 | | | | | | |
| NA | H1N1 | 413 | 0.03 | yes | 1 | 0.03 | 99.76 | SGYSGSFV | 99.76 | | | | | | |
| NA | H1N1 | 414 | 0.03 | yes | 1 | 0.05 | 99.73 | GYSGSFVQ | 99.73 | | | | | | |
| NA | H1N1 | 415 | 0.03 | yes | 1 | 0.05 | 99.73 | YSGSFVQH | 99.73 | | | | | | |
| NA | H1N1 | 416 | 0.04 | yes | 1 | 0.03 | 99.72 | SGSFVQHP | 99.72 | | | | | | |
| NA | H1N1 | 417 | 0.04 | yes | 1 | 0.03 | 99.71 | GSFVQHPE | 99.71 | | | | | | |
| NA | H1N1 | 418 | 0.04 | yes | 1 | 0.03 | 99.76 | SFVQHPEL | 99.76 | | | | | | |
| NA | H1N1 | 419 | 0.03 | yes | 1 | 0.03 | 99.63 | FVQHPELT | 99.63 | | | | | | |
| NA | H1N1 | 420 | 0.43 | yes | 2 | 0.01 | 99.54 | VQHPELTG | 91.74 | QHPELTGM | 8.01 | | | | |
| NA | H1N1 | 421 | 0.56 | yes | 4 | 0.01 | 99.56 | QHPELTGL | 90.75 | HPELTGLN | 7.39 | HPELTGLN | 0.78 | HPELTGMD | 0.61 |
| NA | H1N1 | 422 | 0.55 | yes | 5 | 0 | 99.15 | HPELTGLD | 90.77 | PELTGLNC | 7.39 | PELTGLNC | 0.78 | PELTGMDC | 0.61 |
| NA | H1N1 | 423 | 0.95 | yes | 3 | 0.02 | 99.12 | PELTGLDC | 83.15 | ELTGLNCI | 7.61 | ELTGMNCI | 7.29 | ELTGLNCI | 0.62 |
| NA | H1N1 | 424 | 0.92 | yes | 2 | 0.02 | 99.61 | ELTGLDCI | 83.39 | ELTGMNCI | 7.73 | NCIRPCFW | 7.43 | NCIKPCFW | 0.58 |
| NA | H1N1 | 429 | 0.51 | yes | 3 | 0.02 | 99.63 | DCIRPCFW | 90.83 | CIRPCFWV | 8.1 | CIKPCFWV | 0.68 | | |
| NA | H1N1 | 430 | 0.51 | yes | 2 | 0.03 | 99.77 | CIRPCFWV | 90.83 | IRPCFWVE | 8.1 | IKPCFWVE | 0.68 | | |
| NA | H1N1 | 431 | 0.1 | yes | 2 | 0.06 | 99.78 | IRPCFWVE | 73.37 | | | | | | |
| NA | H1N1 | 432 | 0.86 | yes | 2 | 0.06 | 99.78 | RPCFWVEL | 73.38 | PCFWVEL | 26.4 | | | | |
| NA | H1N1 | 433 | 0.86 | yes | 2 | 0.07 | 99.22 | PCFWVELI | 73.38 | CFWVELV | 26.4 | WVELIRGQ | 7.86 | | |
| NA | H1N1 | 434 | 1.27 | yes | 3 | 0.07 | 99.23 | CFWVELIR | 65.36 | FWVELVR | 26.4 | WVELIRGQ | 7.86 | | |
| NA | H1N1 | 435 | 1.27 | yes | 3 | 72.16 | 99.21 | FWVELIRG | 65.35 | WVELVRG | 26 | VELIRGQP | 7.86 | | |
| NA | H1N1 | 436 | 0.2 | no | 4 | 0.07 | 99.37 | WVELIRGR | 97.64 | WVELVRGL | 26.02 | | | | |
| NA | H1N1 | 437 | 0.28 | yes | 4 | 0.06 | 99.33 | VELIRGRP | 97.64 | ATIWTSGS | 1.57 | TIWTSGSI | 0.44 | | |
| NA | H1N1 | 448 | 0.28 | yes | 3 | 0.08 | 99.34 | TIWTSGS | 96.76 | TIWASGSS | 1.73 | IWTSASS | 0.45 | | |
| NA | H1N1 | 449 | 0.28 | yes | 4 | 0.16 | 99.35 | TIWTSGSS | 96.72 | IWASGSSI | 1.73 | IWTSGII | 0.47 | | |
| NA | H1N1 | 450 | 0.24 | yes | 2 | 0.22 | 99.34 | WTSGSSIS | 97.12 | WASGSSIS | 1.73 | WTSGSIIS | 0.48 | | |
| NA | H1N1 | 451 | 0.24 | yes | 4 | 0.21 | 99.34 | TSGSSISF | 97.13 | ASGSSISF | 1.73 | TSGSIISF | 0.48 | | |
| NA | H1N1 | 452 | 0.11 | yes | 2 | 0.24 | 99.34 | SGSSISFC | 98.87 | SGSIISFC | 0.48 | | | | |
| NA | H1N1 | 453 | 0.1 | yes | 1 | 0.24 | 99.35 | GSSISFCG | 98.88 | ASSISFCG | 0.46 | | | | |
| NA | H1N1 | 454 | 0.1 | yes | 2 | 0.28 | 99.08 | SSISFCGV | 99.08 | | | | | | |
| NA | H1N1 | 455 | 0.61 | yes | 3 | 0.28 | 99.12 | SISFCGVD | 88.47 | SISFCGVN | 10.19 | IISFCGVN | 0.46 | ELTGMDCI | 0.47 |

FIG.72-166

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | H1N1 | 457 | 0.7 | yes | 4 | 0.31 | 99.18 | ISFCGVNS | 87.51 | ISFCGVDS | 10.03 | ISFCGVNG | 1.31 | ISFCGVSS | 0.34 | | |
| NA | H1N1 | 468 | 1.3 | yes | 4 | 2.96 | 99.63 | GWSWPDGA | 64.48 | NWSWPDGA | 26.56 | SWSWPDGA | 7.89 | DWSWPDGA | 0.7 | | |
| NA | H1N1 | 469 | 0.49 | yes | 3 | 3.33 | 99.45 | WSWPDGAE | 91.45 | WSWPDGAD | 7.51 | WSWPDGAK | 0.5 | | | | |
| NA | H1N1 | 470 | 0.5 | yes | 3 | 3.63 | 99.35 | SWPDGAEL | 91.34 | SWPDGADL | 7.52 | SWPDGAKL | 0.5 | | | | |
| NA | H1N1 | 471 | 0.51 | yes | 3 | 4.16 | 99.35 | WPDGAELP | 91.29 | WPDGADLP | 7.56 | WPDGAKLP | 0.5 | | | | |
| NA | H1N1 | 472 | 0.51 | yes | 3 | 4.58 | 99.34 | PDGAELPF | 91.26 | PDGADLPF | 7.57 | PDGAKLPF | 0.51 | | | | |
| NA | H1N1 | 473 | 0.59 | yes | 5 | 4.95 | 99.07 | DGAELPFT | 90.61 | DGADLPFT | 7.4 | DGAKLPFT | 0.51 | DGAELPFA | 0.33 | DGAELPFI | 0.22 |
| NA | H1N1 | 474 | 0.59 | yes | 5 | 6.2 | 99.05 | GAELPFTI | 90.89 | GADLPFTI | 7.1 | GAKLPFTI | 0.52 | GAELPFAI | 0.33 | GAELPFII | 0.22 |
| NA | H1N1 | 477 | 0 | no | 1 | 99.99 | 100 | LPFTQEQK | 100 | | | | | | | | |
| HA | H1N2 | 18 | 1.42 | yes | 4 | 0.29 | 99.12 | DTICIGYH | 56.3 | DTLCIGYH | 32.84 | DTICVGYH | 9.68 | DTLCVGYH | 0.29 | | |
| HA | H1N2 | 19 | 1.42 | yes | 4 | 0.29 | 99.12 | TICIGYHA | 56.3 | TLCIGYHA | 32.84 | TICVGYHA | 9.68 | TLCIDYHA | 0.29 | | |
| HA | H1N2 | 20 | 1.39 | yes | 3 | 0.29 | 99.12 | ICIGYHAN | 56.6 | LCIGYHAN | 32.84 | ICVGYHAN | 9.68 | | | | |
| HA | H1N2 | 21 | 0.52 | yes | 2 | 0.29 | 99.41 | CIGYHANN | 89.44 | CVGYHANN | 9.97 | | | | | | |
| HA | H1N2 | 22 | 0.52 | yes | 2 | 0.29 | 99.41 | IGYHANNS | 89.44 | VGYHANNS | 9.97 | | | | | | |
| HA | H1N2 | 23 | 0.09 | yes | 1 | 0.29 | 99.12 | GYHANNST | 99.12 | | | | | | | | |
| HA | H1N2 | 24 | 0.2 | yes | 2 | 0.29 | 99.41 | YHANNSTD | 97.36 | YHANNSTE | 2.05 | | | | | | |
| HA | H1N2 | 25 | 0.2 | yes | 2 | 0.29 | 99.41 | HANNSTDT | 97.36 | HANNSTET | 2.05 | | | | | | |
| HA | H1N2 | 26 | 0.3 | yes | 3 | 0 | 99.12 | ANNSTDTV | 96.2 | ANNSTETV | 2.05 | ANNSTDTI | 0.88 | | | | |
| HA | H1N2 | 27 | 0.3 | yes | 3 | 0 | 99.12 | NNSTDTVD | 96.2 | NNSTETVD | 2.05 | NNSTDTID | 0.88 | | | | |
| HA | H1N2 | 28 | 0.3 | yes | 3 | 0 | 99.12 | NSTDTVDT | 96.2 | NSTETVDT | 2.05 | NSTDTIDT | 0.88 | | | | |
| HA | H1N2 | 38 | 0.25 | yes | 5 | 0 | 99.12 | EKNVTVTH | 97.37 | KKNVTVTH | 0.58 | EKNITVTH | 0.58 | DKNVTVTH | 0.29 | EKNVAVTH | 0.29 |
| HA | H1N2 | 39 | 0.2 | yes | 4 | 0 | 99.12 | KNVTVTHS | 97.95 | KNITVTHS | 0.58 | KKLTVTHS | 0.29 | KNVAVTHS | 0.29 | | |
| HA | H1N2 | 40 | 0.24 | yes | 4 | 0 | 99.12 | NVTVTHSV | 97.37 | NITVTHSV | 0.88 | NVTVTHSI | 0.58 | KLTVTHSV | 0.29 | | |
| HA | H1N2 | 41 | 0.24 | yes | 4 | 0 | 99.12 | VTVTHSVN | 97.37 | ITVTHSVN | 0.88 | VTVTHSIN | 0.58 | LTVTHSVN | 0.29 | | |
| HA | H1N2 | 42 | 0.14 | yes | 2 | 0 | 99.12 | TVTHSVNL | 98.54 | TVTHSINL | 0.58 | | | | | | |
| HA | H1N2 | 43 | 0.14 | yes | 2 | 0 | 99.12 | VTHSVNLL | 98.54 | VTHSINLL | 0.58 | | | | | | |
| HA | H1N2 | 44 | 0.14 | yes | 2 | 0 | 99.12 | THSVNLLE | 98.54 | THSINLLE | 0.58 | | | | | | |
| HA | H1N2 | 54 | 1.67 | yes | 5 | 0 | 99.42 | HNGKLCLL | 45.61 | HNGKLCKL | 40.06 | HNGKLCSL | 6.43 | HNGKLCRL | 6.14 | HNGKLCNL | 1.17 |
| HA | H1N2 | 74 | 1.71 | yes | 5 | 0 | 99.12 | VAGWILGN | 49.12 | IAGWLLGN | 32.75 | IAGWILGN | 11.99 | VAGWLLGN | 4.97 | VVGWISGN | 0.29 |
| HA | H1N2 | 75 | 1.06 | yes | 3 | 0 | 99.12 | AGWILGNP | 61.11 | AGWLLGNP | 37.72 | AGWVLGNP | 0.29 | | | | |
| HA | H1N2 | 76 | 1.22 | yes | 5 | 0 | 99.12 | GWILGNPE | 59.94 | GWLLGNPE | 36.55 | GWILGNPK | 1.46 | GWLLGNPA | 0.88 | GWVLGNPE | 0.29 |
| HA | H1N2 | 77 | 1.22 | yes | 5 | 0 | 99.12 | WILGNPEC | 59.94 | WLLGNPEC | 36.55 | WILGNPKC | 1.46 | WLLGNPAC | 0.88 | WISGNPEC | 0.29 |
| HA | H1N2 | 114 | 1.08 | yes | 4 | 0 | 99.12 | DYEELREQ | 72.22 | NYEELREQ | 23.68 | NYEELREH | 2.92 | DYEELKEQ | 0.29 | | |
| HA | H1N2 | 115 | 0.33 | yes | 3 | 0 | 99.12 | YEELREQL | 95.61 | YEELREHL | 2.92 | YEELKEQL | 0.58 | | | | |
| HA | H1N2 | 116 | 0.45 | yes | 5 | 0 | 99.12 | EELREQLS | 94.15 | EELREHLS | 2.92 | EELREQLN | 1.17 | EELKEQLS | 0.58 | EELREQIS | 0.29 |
| HA | H1N2 | 242 | 1.34 | yes | 5 | 0 | 99.42 | GRINYYWT | 61.11 | GRMNYYWT | 31.29 | GRMDYYWT | 5.56 | GRMDYYWA | 0.88 | GRMSYYWT | 0.58 |
| HA | H1N2 | 307 | 1.02 | yes | 3 | 0 | 99.12 | LPFQNVHP | 68.71 | LPFQNIHP | 29.53 | HPFQNIHP | 0.88 | | | | |
| HA | H1N2 | 308 | 1.46 | yes | 5 | 0 | 99.71 | PFQNVHPV | 62.28 | PFQNIHPV | 26.02 | PFQNVHPI | 7.02 | PFQNIHPI | 2.92 | PFQNIHPA | 1.46 |
| HA | H1N2 | 309 | 1.46 | yes | 5 | 0.29 | 99.71 | FQNVHPVT | 62.46 | FQNIHPVT | 25.81 | FQNVHPIT | 7.04 | FQNIHPIT | 2.93 | FQNIHPAT | 1.47 |
| HA | H1N2 | 310 | 1.46 | yes | 5 | 0.29 | 99.71 | QNVHPVTI | 62.46 | QNIHPVTI | 25.81 | QNVHPITI | 7.04 | QNIHPITI | 2.93 | QNIHPATI | 1.47 |
| HA | H1N2 | 311 | 1.46 | yes | 5 | 0.29 | 99.71 | NVHPVTIG | 62.46 | NIHPVTIG | 25.81 | NVHPITIG | 7.04 | NIHPITIG | 2.93 | NIHPATIG | 1.47 |
| HA | H1N2 | 313 | 0.69 | yes | 4 | 0.29 | 99.41 | HPVTIGEC | 87.39 | HPITIGEC | 9.68 | HPATIGEC | 1.47 | HPVTIGKC | 0.88 | | |

FIG. 72-167

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H1N2 | 314 | 0.67 | yes | 4 | 0.29 | 99.71 | PITIGECP | 87.68 | PITIGECP | 9.68 | |

FIG.72-168

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H1N2 | 434 | 0.96 | yes | 3 | 0 |

FIG. 72-169

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N2 | 553 | 0.08 | yes | 1 | 0.88 | 99.12 | WMCS

FIG. 72-170

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 136 | 0.91 | yes | 4 | 0 | 99.15 | GQGTTLNN | 77.4 | GQGTTLDN | 20.62 | GQGTTLSN | 0.56 | | |
| NA | H1N2 | 152 | 0.97 | yes | 5 | 0 | 99.44 | DRTPYRTL | 81.36 | DRTPHRTL | 11.3 | DRTSYRTL | 5.37 | DRSPYRTL | 0.56 |
| NA

FIG. 72-171

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 224 | 0.11 | yes | 2 | 0 | 99.44 | LRTQESEC | 98.87 | LRT

FIG.72-172

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 349 | 0.06 | yes | 1 | 0 | 99.44 | GVKGWAFD | 99.44 | VKGWAFDN | 5.08 | VKGWAFDY | 1.98 | VKGWAFDS | 0.85 | VKGWAF

FIG. 72-173

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 466 | 0 | no | 1 | 99.72 | 100 | ISCLYKLS | 100

FIG. 72-174

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 65 | 1.4 | yes | 5 | 0 | 99.58 | GKLCKLNG | 49.79 | GKLCRLSG | 43.51

FIG. 72-175

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 246 | 0.81 | yes | 3 | 0 | 99.16 | RMEFSWTL | 80.75 | RMEFFWTL | 17.57 | | | | |
| HA | H2 | 247 | 0.81 | yes | 3 | 0 | 99

FIG. 72-176

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 313 | 1.13 | yes | 3 | 0 |

FIG. 72-177

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 372 | 0.21 | yes | 2 | 0 | 99.58 | HHSNDQGS | 97.07 | HHSNDQGA | 2.51 | | | | |
| HA | H2 | 373 | 0.21 | yes | 2 | 0 | 99.58 | HSNDQGSG | 97.07 | HSNDQGAG | 2.51 | | | | |
| HA | H2 | 374 | 0.21 | yes | 2 | 0 | 99.58 | SNDQGSGY | 97.07 | SNDQGAGY | 2.51 | | |

FIG. 72-178

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 449 | 0.19 | yes | 3 | 0.42 | 99.16 | MENERTLD | 97.9 | MENEMTLD | 0.84 | MENERTLE | 0.42 | ENERILDF

FIG. 72-179

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 501 | 0.58 | yes | 5 | 0 | 99.16 | NGTYDYPK

FIG. 72-180

| Protein | Sub-type | Start Pos | Block Entropy | Gaps <10% | # to cover 99% | Gap % | Coverage | Included Peptides | Freq | Included peptides | Freq | Included peptides | Freq | Included peptides | Freq |
|---|---|---|---|---|---|---|---|---|---|---|---|---|---|---|---|
| HA | H2 | 556 | 0 | yes | 1 | 0.42 | 100 | WMCSNGSL | 100 | | | | | | |
| HA | H2 | 557 | 0 | yes | 1 | 0.42 | 100 | MCSNGSLQ | 100 | | | | | | |
| HA | H2 | 558 | 0.04 |

FIG.72-181

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H2N2 | 52 | 0.81 | yes | 2 | 0

FIG. 72-182

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 107 | 0.71 | yes | 4 | 0 | 99.12 | PGSFNDYE | 88.6 | PGSFNNYE | 5.26 | PGLNDYE | 2.63 | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 298 | 0.3

FIG. 72-185

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 340 | 0 | yes | 1 | 0 | 100 | RGLFGAIA | 100 | | | | | | |
| HA | H2N2 | 341 | 0 | yes | 1 | 0 | 100 | GLFGAIAG | 100 | | | | | | |
| HA | H2N2 |

FIG. 72-186

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H2N2 | 395 | 0.45 | yes | 4 | 0 | 99.12 | VIEKMNTQ | 93.86

FIG.72-187

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 446 | 0.27 | yes | 3 | 0 | 99.12 | RTLDFHDS | 96.49

FIG.72-188

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 494 | 0.34 | yes | 4 | 0 | 99.12 | NGTD

FIG. 72-189

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 536 | 1.19 | yes | 3 | 0 | 99.12 | SLSLAIMM

FIG. 72-190

| Protein | Sub-type | Start Pos | Block Entropy | Gaps <10% | # to cover 99% | % Gap | Coverage | Peptides included | freq | Peptides included | freq | Peptides included | freq | Peptides included | freq |
|---|---|---|---|---|---|---|---|---|---|---|---|---|---|---|---|
| NA | H2N2 | 64 | 0.73 | yes | 4 | 2.76 | 99.29 | EIWYLNNT | 87.94 | EIWYLND

FIG. 72-191

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 131 | 0.06 | yes | 1 | 0 | 99.31 | QFALGQGT | 99.31 | LGQGTTLE | 1.38 |

FIG. 72-192

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 175 | 1.09 | yes | 3 | 0 | 100 | CVAWSSSS | 50.34 | CIAWSSSS | 48.28 | | | | |
| NA | H2N2 | 176 |

FIG. 72-193

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 228 | 0.2 | yes | 2 | 0 | 99.31 | SECVCING | 97.24 | SECVCIS

FIG. 72-194

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H2N2 | 274 | 0.99 | yes | 2 | 0 | 100 | HIEESCCY | 54.48 | HVEECSCY | 45.52 | | | | |
| NA | H2N2 | 275 | 1.05 | yes | 2 | 0 |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 394 | 1.65 | yes | 5 | 0 | 99.31 | RQII

FIG.72-197

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 451 | 0.06 | yes | 1 | 0.69 | 99.31 | GTYGTGSW | 99.31 | | | | | | |
| NA | H2N2 | 452 | 0.06 | yes | 1 | 0.69 | 99.31 | TYGTGSWP | 99.31 | | | | | | |
| NA | H2N2 | 453 | 0.06 | yes | 1 | 0.69 | 99.31 | YGTGSWPD | 99.31 | | | | | | |
| NA | H2N2 | 454

FIG. 72-198

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 95 | 1.28 | yes | 3 | 0.04 | 99.11 | DALLGDPH | 47.66 | DALLGDPQ | 47.66 | DAMLGDPH | 47.64 | |

FIG. 72-199

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 317 | 0.5 | yes | 5 | 0.06 | 99.13 | PNDIKPFQN | 93.67 | SNDIKPFQN | 2.93 | PNNKPFQN | 0.81 | PNG

FIG. 72-200

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H3 | 379 | 0 | no | 1 | 99.98 | 100 | RLVRFRHQ | 100 | | | | | | |
| HA | H3 | 380 | 0.34 | yes | 2 | 0 | 99.07 | WYGFRHQN | 95.26 | WYGFRYQN | 3.8 | | | | |
| HA | H3 | 381 | 0.38 | yes | 4 | 0.02 | 99.17 | YGFRHQNS | 94.89 | YGFRYQNS | 3.81 | YGFRHHNS | 0.24 | | |
| HA | H3 | 382 | 0.37 | yes | 4 | 0.02 | 99.19 | GFRHQNSE | 94.91 | GFRYQNSE | 3.81 | GFRHHNSE | 0.24 | | |
| HA | H3 | 383 | 0.37 | yes | 4 | 0.02 | 99.23 | FRHQNSEG | 94.95 | FRYQNSEG | 3.81 | FRHHNSEG | 0.24 | | |
| HA | H3 | 386 | 1.46 | yes | 5 | 0.02 | 99.05 | QNSEGTGQ | 62.14 | QNSEGRGQ | 19.5 | HNSEGTGQ | 16.97 | QNSEGMGQ | 0.2 |
| HA | H3 | 387 | 1.41 | yes | 3 | 0.02 | 99.05 | NSEGTGQA | 62.52 | NSEGRGQA | 19.5 | SEGMGQAA | 17.03 | | |
| HA | H3 | 388 | 1.43 | yes | 4 | 0.04 | 99.19 | SEGTGQAA | 62.33 | SEGRGQAA | 19.51 | SEGMGQAA | 17.03 | | 0.32 |
| HA | H3 | 389 | 1.39 | yes | 3 | 0.04 | 99.27 | EGTGQAAD | 62.69 | EGRGQAAD | 19.53 | GMGQAADL | 17.05 | | |
| HA | H3 | 390 | 1.42 | yes | 4 | 0.04 | 99.29 | GTGQAADL | 62.51 | GRGQAADL | 19.45 | MGQAADLK | 16.99 | GMGQAADL | 0.32 |
| HA | H3 | 391 | 1.43 | yes | 4 | 0.04 | 99.23 | TGQAADLK | 62.47 | RGQAADLK | 19.45 | | | MGQAADLK | 0.32 |
| HA | H3 | 392 | 0.08 | yes | 1 | 0.06 | 99.31 | GQAADLKS | 99.31 | | | | | | |
| HA | H3 | 393 | 0.08 | yes | 1 | 0.04 | 99.31 | QAADLKST | 99.31 | | | | | | |
| HA | H3 | 394 | 0.13 | yes | 2 | 0.04 | 99.29 | AADLKSTQ | 98.77 | ADLKSTQT | 0.52 | | | | |
| HA | H3 | 395 | 0.13 | yes | 3 | 0.04 | 99.17 | ADLKSTQA | 98.77 | DLKSTQTA | 0.52 | | | | |
| HA | H3 | 396 | 0.13 | yes | 3 | 0.06 | 99.03 | DLKSTQAA | 98.39 | LKSTQTAI | 0.52 | | | | |
| HA | H3 | 397 | 0.17 | yes | 4 | 0.04 | 99.01 | LKSTQAAI | 56.59 | KSTQTAID | 41.92 | FKSTQAAI | 0.52 | | |
| HA | H3 | 398 | 1.13 | yes | 5 | 0.06 | 99.03 | KSTQAAID | 56.59 | STQTAIDQ | 41.9 | KSTQTAID | 0.52 | | |
| HA | H3 | 399 | 1.13 | yes | 5 | 0.04 | 99.03 | STQAAIDQ | 56.36 | TQTAIDQI | 41.9 | STQTAIDQ | 0.52 | | |
| HA | H3 | 400 | 1.15 | yes | 4 | 0.06 | 99.01 | TQAAIDQI | 56.12 | | | TQTAIDQI | 2.64 | TQAAIDQV | 0.24 |
| HA | H3 | 406 | 0.41 | yes | 5 | 0 | 99.35 | QINGKLNR | 48.97 | QINEKLNR | 42.98 | | | QINGKLNR | 0.48 |
| HA | H3 | 415 | 1.48 | yes | 5 | 0.04 | 99.39 | IGKTNEKF | 48.97 | IERTNEKF | 43.74 | | | IKKTNEKF | 2.72 |
| HA | H3 | 416 | 1.42 | yes | 4 | 0.06 | 99.44 | GKTNEKFH | 95.48 | ERTNEKFH | 3.97 | | | KKTNEKFH | 2.72 |
| HA | H3 | 417 | 0.31 | yes | 2 | 0.08 | 99.48 | KTNEKFHQ | 95.48 | | | | | | |
| HA | H3 | 418 | 0.07 | yes | 1 | 0.06 | 99.64 | TNEKFHQI | 99.64 | | | | | | |
| HA | H3 | 419 | 0.05 | yes | 1 | 0.06 | 99.62 | NEKFHQIE | 99.62 | | | | | | |
| HA | H3 | 420 | 0.04 | yes | 1 | 0 | 99.7 | EKFHQIEK | 99.7 | | | | | | |
| HA | H3 | 421 | 0.07 | yes | 1 | 0.04 | 99.68 | KFHQIEKE | 99.68 | | | | | | |
| HA | H3 | 422 | 0.09 | yes | 1 | 0.06 | 99.37 | FHQIEKEF | 99.37 | | | | | | |
| HA | H3 | 423 | 0.16 | yes | 2 | 0.06 | 99.23 | HQIEKEFS | 98.35 | IEKEFSEI | 0.83 | | | | |
| HA | H3 | 424 | 0.16 | yes | 2 | 0.04 | 99.19 | QIEKEFSE | 98.35 | EKEFSEIE | 0.83 | | | | |
| HA | H3 | 425 | 0.17 | yes | 2 | 0.06 | 99.11 | IEKEFSEV | 98.28 | KEFSEIEG | 0.83 | | | | |
| HA | H3 | 426 | 0.18 | yes | 2 | 0.06 | 99.15 | EKEFSEVE | 98.32 | EFSEIEGR | 0.83 | | | | |
| HA | H3 | 427 | 0.18 | yes | 2 | 0.04 | 99.01 | KEFSEVEG | 98.2 | FSEIEGRI | 0.81 | | | | |
| HA | H3 | 428 | 0.16 | yes | 2 | 0.04 | 99.03 | EFSEVEGR | 98.22 | SEIEGRIQ | 0.81 | | | | |
| HA | H3 | 429 | 0.16 | yes | 2 | 0.04 | 99.25 | FSEVEGRI | 98.43 | EIEGRIQD | 0.81 | | | | |
| HA | H3 | 430 | 0.18 | yes | 2 | 0.02 | 99.33 | SEVEGRIQ | 98.51 | IEGRIQDL | 0.81 | | | | |
| HA | H3 | 431 | 0.15 | yes | 1 | 0.02 | 99.31 | EVEGRIQD | 98.51 | | | | | | |
| HA | H3 | 432 | 0.09 | yes | 1 | 0.02 | 99.31 | VEGRIQDL | 99.31 | | | | | | |
| HA | H3 | 433 | 0.16 | yes | 2 | 0.02 | 99.25 | EGRIQDLE | 98.51 | GRIQDLER | 0.73 | | | | |
| HA | H3 | 434 | 0.15 | yes | 2 | 0.02 | 99.29 | GRIQDLEK | 98.55 | RIQDLERY | 0.73 | | | | |
| HA | H3 | 435 | 0.15 | yes | 2 | 0.02 | 99.29 | RIQDLEKY | 98.55 | | | | | | |

FIG. 72-201

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 436 | 0.17 | yes | 2 | 0 | 99.07 | IQDLEKYV | 98.34 | IQDLERYV | 0.73 | | | | |
| HA | H3 | 437 | 0.16 | yes | 2 | 0 | 99.17 | QDLEKYVE | 98.43 | QDLERYVE | 0.73 | | | | |
| HA | H3 | 438 | 0.16 | yes | 2 | 0 | 99.19 | DLEKYVED | 98.45 | DLERYVED | 0.73 | | | | |
| HA | H3 | 439 | 0.15 | yes | 2 | 0.02 | 99.19 | LEKYVEDT | 98.57 | LERYVEDT | 0.75 | | | | |
| HA | H3 | 440 | 0.15 | yes | 2 | 0 | 99.33 | EKYVEDTK | 98.57 | ERYVEDTK | 0.75 | | | | |
| HA | H3 | 441 | 0.24 | yes | 3 | 0 | 99.21 | KYVEDTKI | 97.38 | RYVEDTKI | 1.15 | RYVEDTKI | 0.67 | | |
| HA | H3 | 442 | 0.18 | yes | 2 | 0 | 99.31 | YVEDTKID | 98.08 | YVEDTKID | 1.23 | | | | |
| HA | H3 | 443 | 0.18 | yes | 2 | 0 | 99.31 | VEDTKIDL | 98.06 | VEDTKVD | 1.25 | | | | |
| HA | H3 | 444 | 0.15 | yes | 2 | 0 | 99.58 | EDTKIDLW | 98.34 | EDTKVDLW | 1.25 | | | | |
| HA | H3 | 445 | 0.15 | yes | 2 | 0 | 99.6 | DTKIDLWS | 98.36 | DTKVDLWS | 1.25 | | | | |
| HA | H3 | 446 | 0.15 | yes | 2 | 0 | 99.54 | TKIDLWSY | 98.3 | TKVDLWSY | 1.25 | | | | |
| HA | H3 | 447 | 0.15 | yes | 2 | 0 | 99.62 | KIDLWSYN | 98.37 | KVDLWSYN | 1.25 | | | | |
| HA | H3 | 448 | 0.14 | yes | 2 | 0 | 99.66 | IDLWSYNA | 98.41 | VDLWSYNA | 1.25 | | | | |
| HA | H3 | 449 | 0.14 | yes | 2 | 0 | 99.45 | DLWSYNAE | 98.39 | DLWSYNAG | 1.05 | | | | |
| HA | H3 | 450 | 0.18 | yes | 3 | 0.02 | 99.13 | LWSYNAEL | 98.1 | LWSYNAGL | 1.03 | | | | |
| HA | H3 | 451 | 0.2 | yes | 4 | 0.02 | 99.27 | WSYNAELL | 98.14 | WSYNAGLL | 1.03 | SYNADVLV | 0.3 | | |
| HA | H3 | 452 | 0.23 | yes | 4 | 0.04 | 99.01 | SYNAELLV | 97.68 | SYNAGLLV | 1.03 | YNADVLVA | 0.3 | | |
| HA | H3 | 453 | 0.24 | yes | 4 | 0.04 | 99.09 | YNAELLVA | 97.6 | YNAGLLVA | 1.03 | NADVLVAL | 0.3 | | |
| HA | H3 | 454 | 0.24 | yes | 4 | 0.04 | 99.07 | NAELLVAL | 97.58 | NAGLLVAL | 1.03 | ADVLVALE | 0.3 | NAEFLVAL | 0.16 |
| HA | H3 | 455 | 0.24 | yes | 4 | 0.04 | 99.15 | AELLVALE | 97.58 | AGLLVALE | 1.03 | DVLVALEN | 0.3 | AEFLVALE | 0.16 |
| HA | H3 | 456 | 0.15 | yes | 3 | 0.04 | 99.01 | ELLVALEN | 98.65 | GLLVALEN | 1.03 | FLVALENQ | 0.18 | EFLVALEN | 0.16 |
| HA | H3 | 457 | 0.11 | yes | 2 | 0.04 | 99.01 | LLVALENQ | 99.01 | VLVALENQ | 0.32 | | | | |
| HA | H3 | 458 | 0.12 | yes | 2 | 0.04 | 99.17 | LVALENQH | 99.17 | | | | | | |
| HA | H3 | 459 | 0.13 | yes | 2 | 0.04 | 99.17 | VALENQHT | 98.95 | ALENQHTI | 0.22 | | | | |
| HA | H3 | 460 | 0.11 | yes | 2 | 0.04 | 99.17 | ALENQHTI | 98.81 | LENQHTIH | 0.36 | | | | |
| HA | H3 | 461 | 0.16 | yes | 2 | 0.04 | 99.17 | LENQHTID | 98.81 | ENQHTIHL | 0.36 | | | | |
| HA | H3 | 462 | 0.16 | yes | 2 | 0.02 | 99.17 | ENQHTIDL | 98.53 | NQHTIHLT | 0.36 | | | | |
| HA | H3 | 463 | 0.16 | yes | 3 | 0.02 | 99.09 | NQHTIDLT | 98.53 | QHTIHLTD | 0.36 | NQHTIDLA | 0.28 | | |
| HA | H3 | 464 | 0.16 | yes | 3 | 0.02 | 99.01 | QHTIDLTD | 3.9 | HTIHLTDA | 0.36 | QHTIDLAD | 0.28 | | |
| HA | H3 | 465 | 0.38 | yes | 3 | 0.06 | 99.25 | HTIDLTDS | 3.85 | TIHLTDAE | 3.9 | HTIHLTDS | 0.36 | HTIDLADS | 0.28 |
| HA | H3 | 466 | 0.39 | yes | 4 | 0.06 | 99.27 | TIDLTDSE | 3.79 | IDLTDAEM | 3.85 | TIHLTDSE | 0.36 | IDLADSEM | 0.28 |
| HA | H3 | 467 | 0.44 | yes | 5 | 0.06 | 99.07 | IDLTDSEM | 3.79 | DLTDAEMN | 3.79 | IHLTDSEM | 0.36 | DLADSEMN | 0.28 | DLADSEMN | 0.28 |
| HA | H3 | 468 | 0.43 | yes | 4 | 0.06 | 99.21 | DLTDSEMN | 3.79 | LTDAEMNK | 3.79 | HLTDSEMN | 0.67 | | |
| HA | H3 | 469 | 0.41 | yes | 4 | 0.08 | 99.19 | LTDSEMNK | 3.79 | TDAEMNKL | 3.75 | LTDSEMNK | 0.67 | | |
| HA | H3 | 470 | 0.4 | yes | 3 | 0.08 | 99.03 | TDSEMNKL | 3.75 | DAEMNKLF | 3.73 | ADSEMNKL | 0.67 | | |
| HA | H3 | 471 | 0.39 | yes | 3 | 0.1 | 99.05 | DSEMNKLF | 3.73 | AEMNKLFE | 94.63 | SEMSKLFE | 0.67 | | |
| HA | H3 | 472 | 1.16 | yes | 4 | 0.1 | 99.15 | SEMNKLFE | 46.32 | EMNKLFEK | 52.05 | EMSKLFEK | 0.4 | EMSKLFER | 0.28 |
| HA | H3 | 473 | 1.15 | yes | 4 | 0.04 | 99.09 | EMNKLFEK | 46.35 | MNKLFEKT | 52.12 | MSKLFEKT | 0.4 | MSKLFERT | 0.28 |
| HA | H3 | 481 | 1.48 | yes | 3 | 0.06 | 99.09 | TKKQLREN | 24.64 | TRKQLREN | 57.26 | TRKQLREN | 17.19 | | |
| HA | H3 | 482 | 1.49 | yes | 3 | 0.06 | 99.09 | KKQLRENA | 24.63 | RKQLRENA | 57.25 | RKQLRENA | 17.17 | | |
| HA | H3 | 483 | 0.87 | yes | 2 | 0.1 | 99.52 | KQLRENAE | 74.43 | RQLRENAE | 25.09 | | | | |

FIG. 72-202

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 484 | 0.08 | yes | 1 | 0.08 | 99.37 | QLRENAED | 99.37 | | | | | | |
| HA | H3 | 485 | 0.14 | yes | 2 | 0.08 | 99.05 | LRENAEDM | 98.75 | LRENAEDI | 0.3 | | | | |
| HA | H3 | 486 | 0.14 | yes | 2 | 0.08 | 99.05 | RENAEDMG | 98.75 | RENAEDIG | 0.3 | | | | |
| HA | H3 | 487 | 0.37 | yes | 4 | 0.08 | 99.13 | ENAEDMGN | 95.3 | ENAEDMGD | 3.05 | ENAEDIGN | 0.3 | EDIGNGCF | 0.3 |
| HA | H3 | 488 | 0.37 | yes | 4 | 0.08 | 99.13 | NAEDMGNG | 95.28 | NAEDMGDG | 3.05 | NAEDIGNC | 0.3 | GNGCLKIY | 0.48 |
| HA | H3 | 489 | 0.36 | yes | 4 | 0.08 | 99.17 | AEDMGNGC | 95.32 | AEDMGDGC | 3.05 | AEDIGNGC | 0.3 | NGCLKIYH | 0.48 |
| HA | H3 | 490 | 0.41 | yes | 5 | 0.06 | 99.21 | EDMGNGCF | 94.82 | EDMGDGCL | 3.05 | EDMGDGCF | 0.5 | | |
| HA | H3 | 493 | 0.47 | yes | 5 | 0 | 99.35 | GNGCFKIY | 93.9 | GNGCFTIY | 2.97 | GDGCFKIY | 1.45 | | |
| HA | H3 | 494 | 0.47 | yes | 5 | 0 | 99.33 | NGCFKIYH | 93.88 | NGCFTIYH | 2.97 | DGCFKIYH | 1.45 | FKIYHRCD | 0.36 |
| HA | H3 | 495 | 0.26 | yes | 4 | 0 | 99.31 | GCFKIYHK | 97.03 | GCLKIYHK | 1.45 | GCFKIYHK | 0.48 | | |
| HA | H3 | 496 | 0.27 | yes | 4 | 0 | 99.29 | CFKIYHKC | 97.01 | CLKIYHKC | 1.45 | CFRIYHKC | 0.48 | | |
| HA | H3 | 497 | 0.3 | yes | 4 | 0 | 99.31 | FKIYHKCD | 96.67 | LKIYHKCD | 1.45 | FRIYHKCD | 0.48 | | |
| HA | H3 | 498 | 0.26 | yes | 4 | 0 | 99.31 | KIYHKCDN | 97.11 | RIYHKCDN | 1.45 | KIYHKCDV | 0.42 | IYHKCNNA | 0.3 |
| HA | H3 | 499 | 0.39 | yes | 5 | 0.1 | 99.19 | IYHKCDNA | 95.54 | IYHKCDNT | 1.74 | YHKCDNV | 1.29 | YHKCNNAC | 0.3 |
| HA | H3 | 500 | 0.38 | yes | 5 | 0.08 | 99.23 | YHKCDNAC | 95.58 | YHKCDNTC | 1.74 | YHKCDNYC | 1.29 | GSIRNETY | 0.79 |
| HA | H3 | 510 | 0.99 | yes | 4 | 0 | 99.5 | GSIRNGTY | 76.39 | DSIRNGTY | 20.63 | ESIRTGTY | 0.85 | | |
| HA | H3 | 511 | 0.29 | yes | 5 | 0.1 | 99.5 | SIRNGTYD | 96.79 | SIRTGTY D | 1.05 | SIRNETYD | 0.87 | | |
| HA | H3 | 521 | 0.28 | yes | 2 | 0.08 | 99.52 | IRNGTYDH | 96.81 | IRTGTYDH | 1.05 | | | | |
| HA | H3 | 522 | 0.3 | yes | 2 | 0.04 | 99.15 | YRDEALNR | 96.67 | YRNEALNR | 1.67 | YRDEALSN | 0.61 | DEALNNRL | 0.2 |
| HA | H3 | 523 | 0.3 | yes | 2 | 0.04 | 99.15 | RDEALNNR | 96.67 | RNEALNNR | 1.67 | RDEALSNR | 0.61 | EALSNRFQ | 0.22 |
| HA | H3 | 524 | 0.34 | yes | 4 | 0.02 | 99.07 | DEALNNRF | 96.27 | NEALNNRF | 1.67 | DEALNNRS | 0.61 | GYKNWILW | 0.22 |
| HA | H3 | 540 | 0.32 | yes | 3 | 0 | 99.17 | EALNNRFQ | 96.37 | EALNNRFH | 1.7 | EALNNRSQ | 0.55 | | |
| HA | H3 | 541 | 0.28 | yes | 3 | 0 | 99.21 | GYKDWVLW | 96.95 | EYKDWVLW | 1.49 | GYKDWFLW | 0.34 | | |
| HA | H3 | 542 | 0.22 | yes | 3 | 0.04 | 99.48 | YKDWVLWI | 97.48 | YKNWVLWI | 1.49 | | | | |
| HA | H3 | 543 | 0.22 | yes | 3 | 0.04 | 99.03 | KDWVLWIS | 97.54 | KDWVLWI | 1.49 | | | | |
| HA | H3 | 544 | 0.22 | yes | 2 | 0.02 | 99.01 | DWVLWISF | 97.52 | DWILWISF | 1.49 | | | | |
| HA | H3 | 545 | 0.2 | yes | 2 | 0.04 | 99.33 | WVLWISFA | 97.68 | WILWISFA | 1.65 | | | | |
| HA | H3 | 546 | 0.32 | yes | 4 | 0.04 | 99.31 | VLWISFAI | 96.31 | ILWISFAT | 1.61 | ILWISFAM | 0.73 | | |
| HA | H3 | 547 | 0.18 | yes | 3 | 0.08 | 99.54 | LWISFAIS | 98.12 | LWISFAMS | 0.75 | | | | |
| HA | H3 | 548 | 0.17 | yes | 3 | 0.1 | 99.66 | WISFAISC | 98.23 | WISFAMSC | 0.75 | | | | |
| HA | H3 | 549 | 0.2 | yes | 2 | 0.12 | 99.27 | ISFAISCF | 97.84 | ISFAMSCF | 0.75 | | | | |
| HA | H3 | 550 | 0.22 | yes | 2 | 0.12 | 99.09 | SFAISCFL | 97.64 | SFAMSCFL | 0.75 | | | | |
| HA | H3 | 551 | 0.49 | yes | 5 | 0.12 | 99.03 | FAISCFLI | 93.63 | FATSCFLI | 3.61 | FAMSCFLL | 0.67 | FAISCLLL | 0.38 |
| HA | H3 | 563 | 0.49 | yes | 5 | 0.12 | 99.03 | AISCFLLC | 93.63 | ATSCFLLC | 3.61 | AMSCFLLC | 0.67 | AISCLLLC | 0.38 |
| HA | H3 | 564 | 0.18 | yes | 3 | 0.69 | 99.04 | GFIMWTCQ | 98.32 | GFIMWTC | 0.54 | | | | |
| HA | H3 | 565 | 0.18 | yes | 3 | 0.73 | 99.12 | GFIMWACQ | 98.4 | GFIMWACQ | 0.54 | FIMWTCQK | 0.18 | | |
| HA | H3 | 566 | 0.86 | yes | 4 | 0.81 | 99 | FIMWACQK | 80.7 | FIVWACQR | 17.64 | FIMWTCQKG | 0.18 | | |
| HA | H3 | 567 | 0.84 | yes | 4 | 0.91 | 99.12 | IMWACQKG | 80.78 | IMWACQR | 17.68 | IWWTCQKG | 0.18 | | |
| HA | H3 | 568 | 0.82 | yes | 3 | 1.01 | 99.14 | MWACQKGN | 80.96 | MWACQRGN | 17.7 | IMWACQR | 0.48 | | |
| HA | H3 | 569 | 0.77 | yes | 4 | 1.13 | 99.32 | WACQKGNI | 81.1 | WACQRGNI | 18.22 | IWWACQR | 0.48 | | |
| HA | H3 | | 0.84 | yes | 2 | 1.29 | 99.34 | ACQKGNIR | 80.24 | ACQRGNIR | 18.21 | VWACQRGN | 0.48 | | |
| HA | H3 | | 0.81 | yes | 3 | 1.57 | 99.6 | CQKGNIRC | 80.53 | CQRGNIRC | 18.12 | ACQKGNIK | 0.88 | | |
| HA | H3 | | | | | | | | | | | CQKGNIKC | 0.95 | | |

FIG. 72-203

| Protein | Sub-type | Start Pos | Block Entropy | Gaps >10% | # to cover 99% | Gap % | Coverage | Included peptides | Freq | Included peptides | Freq | Included peptides | Freq | Included peptides | Freq |
|---|---|---|---|---|---|---|---|---|---|---|---|---|---|---|---|
| HA | H3 | 570 | 0.88 | yes | 4 | 1.88 | 99.41 | QKGNIRCN | 79.72 | QRGNIRCN | 18.14 | QKGNIRCD

| Protein | Sub-type | Start Pos | Block Entropy | Gaps <10% | # to >99% cover | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H3N2 | 311 | 0.3 | yes | 5 | 0.07 | 99.32 | PNDKPFQN | 96.78 | PNEKPFQN | 1

FIG. 72-206

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 358 | 0.03 | yes | 1 | 0 | 99.81 | AGFIENGW | 99.81 | | | | | | |
| HA | H3N2 | 359 | 0.03 | yes | 1 | 0 | 99.78 | GFIENGWE | 99.78 | | | | | | |
| HA | H3N2 | 360 | 0.03 | yes | 1 | 0 | 99.81 | FIENGWEG | 99.81 | | | | | | |
| HA | H3N2 | 361 | 0.02 | yes | 1 | 0 | 99.83 | IENGWEGM | 99.83 | | | | | | |
| HA | H3N2 | 362 | 0.78 | yes | 3 | 0.02 | 99.71 | ENGWEGMV | 85.23 | ENGWEGMM | 8.02 | ENGWEGMI | 6.46 | | |
| HA | H3N2 | 363 | 0.83 | yes | 4 | 0.05 | 99.76 | NGWEGMVD | 84.5 | NGWEGMMD | 8.02 | NGWEGMID | 6.44 | NGWEGMVN | 0.8 |
| HA | H3N2 | 364 | 0.83 | yes | 4 | 0.05 | 99.78 | GWEGMVDG | 84.52 | GWEGMMDG | 8.02 | GWEGMIDG | 6.44 | GWEGMYNG | 0.8 |
| HA | H3N2 | 365 | 0.84 | yes | 4 | 0.05 | 99.73 | WEGMVDGW | 84.47 | WEGMMDGW | 8.02 | WEGMIDGW | 6.44 | WEGMYNGW | 0.8 |
| HA | H3N2 | 366 | 0.84 | yes | 4 | 0.05 | 99.71 | EGMVDGWY | 84.45 | EGMMDGWY | 8.02 | EGMIDGWY | 6.44 | EGMYNGWY | 0.8 |
| HA | H3N2 | 367 | 0.84 | yes | 4 | 0.05 | 99.68 | GMVDGWYG | 84.42 | GMMDGWYG | 8.02 | GM

FIG. 72-207

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 412 | 0.07 | yes | 1 | 0.07 | 99.44 | TNEKFHQI | 99.44 | | | | | | |
| HA | H3N2 | 413 | 0.05 | yes | 1 | 0.07 | 99.61 | NEKFHQI

FIG. 72-208

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 454 | 0.1 | yes | 1 | 0.05 | 99.1 | ALENQHTI | 99.1 | | | | | | |
| HA | H3N2 | 455 | 0.12 | yes | 2 | 0.05 | 99.27 | LENQHTID | 98.83 | | | | | | |
| HA | H3N2 | 456 | 0.13 | yes | 2 | 0.02 | 99.24 | ENQHTIDL | 98.81 | | | | | | |
| HA | H3N2 | 457 | 0.15 | yes | 2 | 0.02 | 99.07 | NQH

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 11 | 0.27 | yes | 5 | 3.53 | 99.05 | QKIITIGS | 97.38 | QKIIAIGS | 0.62 | KKIITIGS | 0

FIG. 72-211

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 160 | 0.51 | yes | 3 | 0.04 | 99.55 | RTPYRTLL | 91.75 | RIPHRTLL | 5.76 | |

FIG. 72-212

| Protein | Sub-type | Start Pos | Block Entropy | Gaps <10% | # to cover 99% | Gap % | coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 210 | 0.97 | yes | 4 | 0.04 | 99.25 | TAS

| Protein | Sub-type | Start Pos | Block Entropy | Gaps >10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 427 | 0.26 | yes | 3 | 0 | 99.34 | SCINRCFY | 97.04 | SCINRCFY | 1.61 | | | | |
| NA | H3N2 | 428 | 0.16 | yes | 2 | 0 | 99.7 | CINRCFYV | 98.07 | CINRCFYV | 1.63 | | | | |
| NA | H3N2 | 429 | 0.16 | yes | 2 | 0 | 99.7 | INRCFYVE | 98.07 | INRCFYVE | 1.63 | | | | |
| NA | H3N2 | 430 | 0.03 | yes | 1 | 0.02 | 99.74 | NRCFYVEL | 99.74 | | | | | | |
| NA | H3N2 | 431 | 0.04 | yes | 1 | 0.04 | 99.74 | RCFYVELI | 99.7 | | | | | | |
| NA | H3N2 | 432 | 0.04 | yes | 1 | 0.04 | 99.72 | CFYVELIR | 99.72 | | | | | | |
| NA | H3N2 | 433 | 0.03 | yes | 1 | 0.04 | 99.72 | FYVELIRG | 99.72 | | | | | | |
| NA | H3N2 | 434 | 0.16 | yes | 2 | 0.04 | 99.72 | YVELIRGS | 98.33 | YVELIRGS | 1.01 | | | | |
| NA | H3N2 | 446 | 1.54 | yes | 5 | 0.02 | 99.34 | EVLWTSNS | 58.62 | EVLWTSNS | 27.46 | KVWWTSNS | 9.92 | DVLWTSNS | 0.34 |
| NA | H3N2 | 447 | 1.03 | yes | 2 | 0 | 99.49 | VLWTSNSI | 59.16 | VLWTSNSI | 40.32 | | 3 | | |
| NA | H3N2 | 448 | 1.05 | yes | 2 | 0.04 | 99.38 | LWTSNSIV | 59.15 | LWTSNSIV | 40.23 | | | | |
| NA | H3N2 | 449 | 0.11 | yes | 1 | 0.06 | 99.06 | WTSNSIVV | 99.06 | | | | | | |
| NA | H3N2 | 450 | 0.11 | yes | 1 | 0.09 | 99.06 | TSNSIVVF | 99.06 | | | | | | |
| NA | H3N2 | 451 | 0.11 | yes | 1 | 0.15 | 99.06 | SNSIVVFC | 99.06 | | | | | | |
| NA | H3N2 | 452 | 0.1 | yes | 1 | 0.15 | 99.03 | NSIVVFCG | 99.03 | | | | | | |
| NA | H3N2 | 453 | 0.11 | yes | 1 | 0.15 | 99.19 | SIVVFCGT | 99.19 | | | | | | |
| NA | H3N2 | 454 | 0.09 | yes | 1 | 0.15 | 99.19 | IVVFCGTS | 99.19 | | | | | | |
| NA | H3N2 | 455 | 0.09 | yes | 1 | 0.13 | 99.19 | VVFCGTSG | 99.19 | | | | | | |
| NA | H3N2 | 456 | 0.08 | yes | 1 | 0.11 | 99.29 | VFCGTSGT | 99.29 | | | | | | |
| NA | H3N2 | 457 | 0.05 | yes | 1 | 0.34 | 99.59 | FCGTSGTY | 99.59 | | | | | | |
| NA | H3N2 | 458 | 0.05 | yes | 2 | 0.36 | 99.63 | CGTSGTYG | 99.63 | GTSGTYGS | 0.97 | | | | |
| NA | H3N2 | 459 | 0.16 | yes | 2 | 0.39 | 99.29 | GTSGTYGT | 98.32 | TSGTYGSG | 0.97 | | | | |
| NA | H3N2 | 460 | 0.16 | yes | 2 | 0.41 | 99.27 | TSGTYGTG | 98.3 | SGTYGSGS | 0.95 | | | | |
| NA | H3N2 | 461 | 0.17 | yes | 2 | 0.69 | 99.29 | SGTYGTGS | 98.34 | GTYGSGSW | 0.95 | | | | |
| NA | H3N2 | 462 | 0.16 | yes | 2 | 1.48 | 99.2 | GTYGTGSW | 98.25 | TYGSGSWP | 0.96 | | | | |
| NA | H3N2 | 463 | 0.17 | yes | 2 | 1.99 | 99.24 | TYGTGSWP | 98.28 | YGSGSWPD | 0.96 | | | | |
| NA | H3N2 | 464 | 0.16 | yes | 2 | 2.44 | 99.32 | YGTGSWPD | 98.36 | GSGSWPDG | 0.77 | | | | |
| NA | H3N2 | 465 | 0.14 | yes | 2 | 2.7 | 99.36 | GTGSWPDG | 98.6 | SGSWPDGA | 0.77 | | | | |
| NA | H3N2 | 466 | 0.17 | yes | 2 | 3.64 | 99.08 | TGSWPDGA | 98.31 | GSWPDGAN | 7.02 | | | | |
| NA | H3N2 | 467 | 0.47 | yes | 4 | 3.79 | 99.07 | GSWPDGAD | 92.04 | SWPDGANI | 7.01 | SWPDGADL | 6.12 | | |
| NA | H3N2 | 468 | 0.81 | yes | 3 | 99.89 | 99.33 | SWPDGADI | 85.82 | DIKSHAYI | 20 | DINLMPIY | 20 | | |
| NA | H3N2 | 474 | 1.37 | no | 3 | 99.89 | 100 | DIKSHAYI | 60 | IKSHAYIS | 20 | INLMPIYS | 20 | | |
| NA | H3N2 | 475 | 1.37 | no | 3 | 99.91 | 100 | IKSHAYIS | 60 | KSHAYISF | 20 | GLMGRTRI | 20 | | |
| NA | H3N2 | 476 | 0.81 | no | 3 | 99.94 | 100 | KSHAYISF | 60 | LHAYISFR | 20 | | | | |
| NA | H3N2 | 477 | 0 | no | 4 | 99.94 | 100 | LHAYISFR | 75 | HAYISFRN | 25 | | | | |
| NA | H3N2 | 478 | 0 | no | 4 | 99.94 | 100 | HAYISFRN | 100 | AYISFRNL | 100 | | | | |
|

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H4 | 115 | 0.3 | yes | 5 | 0 | 99.2 | VPDYQSLR | 96.63 | VPEYQSLR | 1

FIG. 72-217

| Protein | Sub-type | Start Pos | Block Entropy | Gaps <10% | # to cover 99% | % Gap | Coverage | included Peptides | Freq | included Peptides | Freq | included Peptides | Freq | included Peptides | Freq |
|---|---|---|---|---|---|---|---|---|---|---|---|---|---|---|---|
| HA | H4 | 186 | 0.21 | yes | 3 | 0 | 99.2 | GDYARLYI | 97.76 | GDYTRLYI | 0.96 | GNYARLYI | 0.48 | | |
| HA | H4 | 187 | 0.21 | yes | 3 | 0 | 99.2 | DYARLYIW | 97.76 | DYTRLYIW | 0.96 | NYARLYIW | 0.48 | | |
| HA | H4 | 188 | 0.16 | yes | 2 | 0 | 99.2 | YARLYIWG | 98.24 | YTRLYIWG | 0.96 | | | | |
| HA | H4 | 189 | 0.16 | yes | 2 | 0 | 99.2 | ARLYIWGV | 98.24 | TRLYIWGV | 0.96 | | | | |
| HA | H4 | 190 | 0.09 | yes | 1 | 0 | 99.2 | RLYIWGVH | 99.2 | | | | | | |
| HA | H4 | 191 | 0.05 | yes | 1 | 0 | 99.52 | LYIWGVHH | 99.52 | | | | | | |
| HA | H4 | 192 | 0.03 | yes | 1 | 0 | 99.68 | YIWGVHHP | 99.68 | | | | | | |
| HA | H4 | 193 | 0.03 | yes | 1 | 0 | 99.68 | IWGVHHPS | 99.68 | | | | | | |
| HA | H4 | 194 | 0 | yes | 1 | 0 | 100 | WGVHHPST | 100 | | | | | | |
| HA | H4 | 195 | 0.05 | yes | 1 | 0 | 99.52 | GVHHPSTD | 99.52 | | | | | | |
| HA | H4 | 196 | 0.28 | yes | 3 | 0 | 99.04 | VHHPSTDK | 96.79 | VHHPSTDA | 1.28 | VHHPSTDA | 0.48 | | |
| HA | H4 | 197 | 0.28 | yes | 3 | 0 | 99.04 | HHPSTDKE | 96.79 | HHPSTDAE | 1.28 | HHPSTDAE | 0.48 | | |
| HA | H4 | 198 | 0.28 | yes | 3 | 0 | 99.04 | HPSTDKEQ | 96.79 | HPSTDAEQ | 1.28 | HPSTDAEQ | 0.8 | | |
| HA | H4 | 208 | 0.29 | yes | 3 | 0 | 99.04 | LYKNNPGR | 96.79 | LYENNPGR | 0.96 | LYKNPGR | 0.48 | | |
| HA | H4 | 209 | 0.27 | yes | 3 | 0 | 99.2 | YKNNPGRV | 96.96 | ENNPGRV | 0.96 | YKSNPGRV | 0.48 | | |
| HA | H4 | 210 | 0.34 | yes | 4 | 0 | 99.04 | KNNPGRVT | 96.15 | NNPGRVT | 0.96 | KNNPGRVS | 0.8 | KSNPGRVT | 0.48 |
| HA | H4 | 211 | 0.27 | yes | 3 | 0.16 | 99.04 | NNPGRVTV | 96.95 | NPGRVSY | 1.12 | SNPGRVTV | 0.48 | | |
| HA | H4 | 212 | 0.22 | yes | 3 | 0.16 | 99.36 | NPGRVTVS | 97.43 | PGRVSYS | 1.13 | | | | |
| HA | H4 | 213 | 0.13 | yes | 2 | 0.32 | 99.36 | PGRVTVST | 98.55 | | | | | | |
| HA | H4 | 214 | 1.09 | yes | 5 | 0.32 | 99.36 | GRVTVSTK | 66.72 | GRVSVSTK | 31.03 | GRVTVSTR | 0.64 | TSVPNIG | 0.64 |
| HA | H4 | 224 | 0.27 | yes | 2 | 0 | 99.04 | QTSVPNI | 97.76 | QTSVPDI | 0.64 | QTSVPNI | 0.48 | SVPNIGS | 0.32 |
| HA | H4 | 225 | 0.3 | yes | 4 | 0 | 99.2 | TSVPNID | 96.79 | TSVPNIG | 0.8 | TSVPDIG | 0.64 | | |
| HA | H4 | 226 | 0.29 | yes | 3 | 0 | 99.04 | SVPNIGS | 96.96 | SVPNIDS | 0.8 | SVPNIGI | 0.48 | | |
| HA | H4 | 234 | 0.46 | yes | 4 | 0 | 99.04 | RPWRGQS | 93.91 | RPLVRGQS | 3.37 | RPLVRSQS | 1.12 | | |
| HA | H4 | 235 | 0.41 | yes | 5 | 0 | 99.04 | PWRGQSG | 94.39 | PLVRGQSG | 3.53 | PLVRSQSG | 1.12 | GPWVRGQS | 0.32 |
| HA | H4 | 236 | 0.41 | yes | 3 | 0 | 99.04 | WVRGQSGR | 94.39 | LVRGQSGR | 3.53 | LVRSQSGR | 1.13 | | |
| HA | H4 | 237 | 0.38 | yes | 4 | 0.32 | 99.2 | VRGQSGRI | 95.18 | RGQSGRV | 2.57 | VRSQSGRI | 1.13 | VRGLSSRI | 0.16 |
| HA | H4 | 238 | 0.37 | yes | 4 | 0.32 | 99.19 | RGQSGRIS | 95.18 | RGQSGRYS | 2.73 | RSQSGRIS | 1.13 | | |
| HA | H4 | 239 | 0.3 | yes | 3 | 0.48 | 99.19 | GQSGRISF | 95.01 | GQSGRVSF | 2.74 | SQSGRISF | 1.13 | GLSSRISF | 0.32 |
| HA | H4 | 240 | 0.29 | yes | 3 | 0.64 | 99.35 | QSGRISFY | 96.14 | QSGRVSFY | 2.74 | LSSRISFY | 0.32 | | |
| HA | H4 | 241 | 0.28 | yes | 3 | 0.64 | 99.03 | SGRISFYW | 96.13 | SGRVSFYW | 2.74 | SSRISFYW | 0.48 | | |
| HA | H4 | 242 | 0.25 | yes | 2 | 0.64 | 99.35 | GRISFYWT | 96.29 | GRVSFYWT | 2.74 | | | | |
| HA | H4 | 243 | 0.27 | yes | 2 | 0.64 | 99.03 | RISFYWTI | 96.45 | RVSFYWTI | 2.74 | | | | |
| HA | H4 | 244 | 0.18 | yes | 2 | 0.64 | 99.19 | ISFYWTIV | 96.61 | VSFYWTIV | 2.74 | SLYWTIVE | 0.32 | | |
| HA | H4 | 245 | 0.16 | yes | 3 | 0.64 | 99.03 | SFYWTIVE | 98.23 | | | | | | |
| HA | H4 | 246 | 0.16 | yes | 2 | 0.64 | 99.03 | FYWTIVEP | 98.39 | | | SLYWTIVE | 0.65 | | |
| HA | H4 | 247 | 0.19 | yes | 2 | 0.64 | 99.03 | YWTIVEPG | 98.39 | | | | 0.65 | | |
| HA | H4 | 248 | 0.45 | yes | 3 | 0.64 | 99.03 | WTIVEPGD | 98.06 | | | | 0.65 | WTIVEPGN | 0.32 |
| HA | H4 | 253 | 0.46 | yes | 4 | 0.16 | 99.19 | PGDIIVFN | 93.23 | PGDLIVFN | 5.16 | | | PGDVIVFN | 0.48 |
| HA | H4 | 254 | 0.45 | yes | 4 | 0.16 | 99.2 | GDIIVFNT | 93.26 | GDLIVFNT | 5.14 | | | GNLIVFNT | 0.48 |
| HA | H4 | 255 | 0.45 | yes | 3 | 0.16 | 99.2 | DIIVFNTI | 93.26 | DLIVFNTI | 5.14 | | | DVIVFNTI | 0.48 |
| HA | H4 | 256 | 0.44 | yes | 3 | 0.16 | 99.04 | IIVFNTIG | 93.42 | LIVFNTIG | 5.14 | | | | |

FIG. 72-218

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 257 | 0.11 | yes | 2 | 0.16 | 99.36 | IVFNTIGN | 98.88 | | | | | | |
| HA | H4 | 258 | 0.11 | yes | 2 | 0.16 | 99.36 | VFNTIGNL | 98.88 | ILFNTIGN | 0.48 | | | | |
| HA | H4 | 259 | 0.16 | yes | 2 | 0.16 | 99.36 | FNTIGNLI | 98.23 | LFNTIGNL | 0.48 | | | | |
| HA | H4 | 260 | 0.16 | yes | 2 | 0.16 | 99.52 | NTIGNLIA | 98.23 | FNTIGNLV | 1.12 | | | | |
| HA | H4 | 261 | 0.16 | yes | 2 | 0.16 | 99.52 | TIGNLIAP | 98.23 | NTIGNLVA | 1.12 | | | | |
| HA | H4 | 262 | 0.14 | yes | 2 | 0.16 | 99.52 | IGNLIAPR | 98.39 | TIGNLVAP | 1.12 | | | | |
| HA | H4 | 263 | 0.12 | yes | 2 | 0 | 99.68 | GNLIAPRG | 98.39 | IGNLVAPR | 1.12 | | | | |
| HA | H4 | 264 | 0.14 | yes | 2 | 0 | 99.52 | NLIAPRGH | 98.56 | GNLVAPRG | 1.12 | | | | |
| HA | H4 | 265 | 0.14 | yes | 2 | 0 | 99.52 | LIAPRGHY | 98.4 | NLVAPRGH | 1.12 | | | | |
| HA | H4 | 266 | 0.22 | yes | 3 | 0 | 99.52 | IAPRGHYK | 98.4 | LVAPRGHY | 1.12 | IAPRGHYR | 0.48 | | | |
| HA | H4 | 267 | 0.16 | yes | 2 | 0 | 99.52 | APRGHYKL | 97.44 | VAPRGHYK | 1.12 | | | | |
| HA | H4 | 289 | 0.55 | yes | 5 | 0 | 99.84 | IGSCASKC | 98.24 | APRGHYRL | 0.96 | | | | |
| HA | H4 | 290 | 0.57 | yes | 5 | 0 | 99.68 | GSCASKCH | 92.31 | IGSCESKC | 2.4 | IGSCISKC | 1.92 | IGSCVSRC | 1.6 |
| HA | H4 | 291 | 0.57 | yes | 5 | 0 | 99.68 | SCASKCHT | 92.15 | GSCESKCH | 2.4 | GSCISKCH | 1.92 | GSCVSRCH | 1.6 |
| HA | H4 | 294 | 1.2 | yes | 3 | 0 | 99.04 | SKCHTDRG | 62.66 | SCESKCHT | 2.4 | SCVSRCHT | 1.92 | SCISKCHT | 1.6 |
| HA | H4 | 295 | 1.2 | yes | 4 | 0 | 99.04 | KCHTDRGS | 62.66 | SRCHTDKG | 33.97 | SKCHTDKG | 1.28 | SKCHTNRG | 0.48 |
| HA | H4 | 307 | 0.2 | yes | 3 | 0 | 99.2 | KPFQNISR | 97.76 | RCHTDKGS | 33.97 | KCHTDKGS | 1.28 | KCHTNRGS | 0.48 |
| HA | H4 | 308 | 0.24 | yes | 3 | 0 | 99.36 | PFQNISRV | 97.28 | RPFQNISR | 1.12 | SKCHTEKG | 0.64 | | |
| HA | H4 | 309 | 1.02 | yes | 5 | 0 | 99.04 | FQNISRIS | 75.32 | PFQNVSRI | 0.96 | KCHTEKGS | 0.64 | | |
| HA | H4 | 318 | 0.4 | yes | 3 | 0 | 99.04 | GDCPKYIK | 95.19 | FQNISRYS | 21.63 | PFQNVSRT | 0.48 | FQNVSRTA | 0.48 |
| HA | H4 | 319 | 0.38 | yes | 3 | 0 | 99.04 | DCPKYVKQ | 95.35 | GECPKYIK | 1.28 | FQNVSRT | 0.64 | | |
| HA | H4 | 320 | 0.25 | yes | 3 | 0 | 99.04 | CPKYVKQG | 96.96 | DCPKYYVK | 1.28 | GDCPRYVK | 1.28 | GNCPKYVK | 0.48 |
| HA | H4 | 321 | 0.25 | yes | 3 | 0 | 99.04 | PKYVKQGS | 96.96 | CPRYVKQG | 1.28 | DCPRYYKQ | 1.12 | | |
| HA | H4 | 322 | 0.21 | yes | 2 | 0 | 99.36 | KYVKQGSL | 97.6 | PKYIKQGS | 1.28 | | | | |
| HA | H4 | 323 | 0.25 | yes | 3 | 0 | 99.36 | YVKQGSLK | 97.6 | KYIKQGSL | 1.28 | | | | |
| HA | H4 | 324 | 0.25 | yes | 3 | 0 | 99.36 | VKQGSLKL | 98.88 | YIKQGSLK | 1.28 | | | | |
| HA | H4 | 325 | 0.21 | yes | 2 | 0 | 99.36 | KQGSLKLA | 98.88 | IKQGSLKL | 1.28 | | | | |
| HA | H4 | 326 | 0.11 | yes | 2 | 0 | 99.36 | QGSLKLAT | 98.88 | KQGSLRLA | 0.48 | | | | |
| HA | H4 | 327 | 0.11 | yes | 2 | 0 | 99.2 | GSLKLATG | 99.2 | QGSLRLAT | 0.48 | | | | |

FIG.72-219

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 350 | 0.08 | yes | 1 | 0 | 99.2 | IAGFIENG | 99.2 | | | | | | |
| HA | H4 | 351 | 0.05 | yes | 1 | 0 | 99.52 | AGFIENGW | 99.52 | | | | | | |
| HA | H4 | 352 | 0.03 | yes | 1 | 0 | 99.68 | GFIENGWQ | 99.68 | | | | | | |
| HA | H4 | 353 | 0.03 | yes | 1 | 0 | 99.68 | FIENGWQG | 99.68 | | | | | | |
| HA | H4 | 354 | 0.03 | yes | 1 | 0 | 99.68 | IENGWQGL | 99.68 | | | | | | |
| HA | H4 | 355 | 0.07 | yes | 1 | 0 | 99.36 | ENGWQGLI | 99.36 | | | | | | |
| HA | H4 | 356 | 0.07 | yes | 1 | 0 | 99.36 | NGWQGLID | 99.36 | | | | | | |
| HA | H4 | 357 | 0.03 | yes | 1 | 0 | 99.68 | GWQGLIDG | 99.68 | | | | | | |
| HA | H4 | 358 | 0.05 | yes | 1 | 0 | 99.52 | WQGLIDGW | 99.52 | | | | | | |
| HA | H4 | 359 | 0.05 | yes | 1 | 0 | 99.52 | QGLIDGWY | 99.52 | | | | | | |
| HA | H4 | 360 | 0.05 | yes | 1 | 0 | 99.52 | GLIDGWYG | 99.52 | | | | | | |
| HA | H4 | 361 | 0.07 | yes | 1 | 0 | 99.36 | LIDGWYGF | 99.36 | | | | | | |
| HA | H4 | 362 | 0.08 | yes | 1 | 0 | 99.2 | IDGWYGFR | 99.2 | | | | | | |
| HA | H4 | 363 | 0.05 | yes | 1 | 0 | 99.52 | DGWYGFRH | 99.52 | | | | | | |
| HA | H4 | 364 | 0.07 | yes | 1 | 0 | 99.36 | GWYGFRHQ | 99.36 | | | | | | |
| HA | H4 | 365 | 0.07 | yes | 1 | 0 | 99.36 | WYGFRHQN | 99.36 | | | | | | |
| HA | H4 | 366 | 0.12 | yes | 1 | 0 | 98.72 | YGFRHQNA | 98.72 | YGFRHQNS | 0.64 | | | | | |
| HA | H4 | 367 | 0.12 | yes | 1 | 0 | 98.72 | GFRHQNAE | 98.72 | GFRHQNSE | 0.64 | | | | | |
| HA | H4 | 368 | 0.12 | yes | 1 | 0 | 98.72 | FRHQNAEG | 98.72 | FRHQNSEG | 0.64 | | | | | |
| HA | H4 | 369 | 0.11 | yes | 1 | 0 | 98.88 | RHQNAEGT | 98.88 | RHQNSEGT | 0.64 | | | | | |
| HA | H4 | 370 | 0.09 | yes | 1 | 0 | 99.04 | HQNAEGTG | 99.04 | | | | | | |
| HA | H4 | 371 | 0.09 | yes | 1 | 0 | 99.04 | QNAEGTGT | 99.04 | | | | | | |
| HA | H4 | 372 | 0.09 | yes | 1 | 0 | 99.04 | NAEGTGTA | 99.04 | | | | | | |
| HA | H4 | 373 | 0.03 | yes | 1 | 0 | 99.68 | AEGTGTAA | 99.68 | | | | | | |
| HA | H4 | 374 | 0.03 | yes | 1 | 0 | 99.68 | EGTGTAAD | 99.68 | | | | | | |
| HA | H4 | 375 | 0.05 | yes | 1 | 0 | 99.52 | GTGTAADL | 99.52 | | | | | | |
| HA | H4 | 376 | 0.07 | yes | 1 | 0 | 99.36 | TGTAADLK | 99.36 | | | | | | |
| HA | H4 | 377 | 0.07 | yes | 1 | 0 | 99.36 | GTAADLKS | 99.36 | | | | | | |
| HA | H4 | 378 | 0.09 | yes | 2 | 0 | 99.52 | TAADLKST | 99.36 | ADLKSTQT | 1.12 | | | | | |
| HA | H4 | 379 | 0.14 | yes | 2 | 0 | 99.52 | AADLKSTQ | 98.4 | DLKSTQTA | 1.12 | | | | | |
| HA | H4 | 380 | 0.14 | yes | 2 | 0 | 99.52 | ADLKSTQA | 98.4 | LKSTQTAI | 1.12 | | | | | |
| HA | H4 | 381 | 0.14 | yes | 2 | 0 | 99.52 | DLKSTQAA | 98.4 | KSTQTAID | 1.12 | | | | | |
| HA | H4 | 382 | 0.17 | yes | 2 | 0 | 99.2 | LKSTQAAI | 98.08 | STQTAIDQ | 1.12 | | | | | |
| HA | H4 | 383 | 0.19 | yes | 2 | 0 | 99.04 | KSTQAAID | 97.92 | TQTAIDQI | 1.12 | | | | | |
| HA | H4 | 384 | 0.22 | yes | 3 | 0 | 99.04 | STQAAIDQ | 97.6 | QTAIDQIN | 1.12 | QAAIDQIS | 0.32 | | | |
| HA | H4 | 385 | 0.26 | yes | 5 | 0 | 99.04 | TQAAIDQI | 97.28 | TAIDQING | 1.12 | AAIDKING | 0.48 | QAAINQIN | 0.32 | |
| HA | H4 | 386 | 0.26 | yes | 5 | 0 | 99.04 | QAAIDQIN | 97.28 | AIDQINGK | 0.64 | AIDKINGK | 0.48 | AAINQING | 0.32 | |
| HA | H4 | 387 | 0.2 | yes | 4 | 0 | 99.04 | AAIDQING | 97.92 | IDQYNGKL | 0.48 | INQINGKL | 0.32 | | | |
| HA | H4 | 388 | 0.19 | yes | 4 | 0 | 99.2 | AIDQINGK | 98.08 | DQYNGKLN | 0.48 | DQISGKLN | 0.32 | | | |
| HA | H4 | 389 | 0.15 | yes | 3 | 0 | 99.04 | IDQINGKL | 98.4 | QISGKLNR | 0.48 | | | | | |
| HA | H4 | 390 | | yes | | 0 | 99.2 | DQINGKLN | | | | | | | | |
| HA | H4 | 391 | | yes | | 0 | 99.2 | QINGKLNR | | | | | | | | |

FIG. 72-220

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 392 | 0.12 | yes | 2 | 0 | 99.2 | INGKLNRL | 98.72 | ITGKLNRL | 0.48 | | | | |
| HA | H4 | 393 | 0.08 | yes | 1 | 0 | 99.2 | NGKLNRLI | 99.2 | | | | | |

FIG. 72-221

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 437 | 0.05 | yes | 1 | 0 | 99.52 | SYNAELLV | 99.52 |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 529 | 0.16 | yes | 3 | 0 | 99.2 | I

FIG. 72-224

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H5 | 27 | 0.11 | yes | 1 | 0.33 | 99.16 | GYHANNST | 99.16 | YHANNS

FIG. 72-225

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 164 | 1.38 | no | 3 | 99.82 | 100 | NGRSSFFR | 57.14 | TGRSSFFR | 28.57 | SGRSSFFR | 14.29 | | |
| HA | H5

FIG.72-226

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 331 | 0.19 | yes | 3 | 0.1 | 99.23 | ECPKYVKS | 99.23 | ECPKYVKS | 0.74 | KCPKYVKS | 0.41 | | | |
| HA | H5 | 341 | 0.32 | yes | 3 | 0.08 | 99.13 | LVLATGLR | 99.13 | LVLATGLR | 1.84 | LILATGLR | 1.07 | | | |
| HA | H5 | 342 | 0.32 | yes | 3 | 0.08 |

FIG. 72-227

| Protein | Sub-type | Start Pos | Block Entropy | Gaps <10% | # to %99 cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 403 | 0.24 | yes | 4 | 0.03 | 99.06 | YAADKEST | 97.76 | YAADQEST | 0.56 | YAADK

FIG. 72-228

| Protein | Sub-type | Start Pos | Block Entropy | Gaps <10% | # to cover 99% | % gap | Coverage | Included peptides | Freq | Included peptides | Freq | Included peptides | Freq | Included peptides | Freq |
|---|---|---|---|---|---|---|---|---|---|---|---|---|---|---|---|
| HA | H5 | 475 | 0.19 | yes | 2 | 0.03 | 99.52 | RTLDFHDS | 97.65 | RTLDLHDS | 1.86 | | | | |
| HA | H5 | 476 | 0.2 | yes | 2 | 0.03 | 99.46 | TLDFHDSN | 97.6 | TLDLHDSN | 1.86 | | | | |
| HA | H5 | 477 | 0.2 | yes | 3 | 0.03 | 99.44 | LDFHDSNV | 97.58 | LDLHDSNV | 1.86 | DF

FIG. 72-229

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H5 | 558 | 0.33 | yes |

FIG. 72-230

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 32 | 0.36 | yes | 5 | 0.12 | 99.1 | NSTEQVDT | 95.96 | NSTKQVDT | 1.87 | NSTVQVDT | 0.54 | NSTEHVDT | 0.36 | NSTERVDT | 0.36 |
| HA | H5N1 | 33 | 0.33 | yes | 4 | 0.12 | 99.06 | STEQVDTI | 96.14 | STKQVDTI | 1.99 | STVQVDTI | 0.54 | STERVDTI | 0.39 | | |
| HA | H5N1 | 34 | 0.33 | yes | 4 | 0.12 | 99.06 | TEQVDTIM | 96.17 | TKQVDTIM | 1.99 | TVQVDTIM | 0.54 | TERVDTIM | 0.36 | | |
| HA | H5N1 | 35 | 0.33 | yes | 4 | 0.12 | 99.06 | EQVDTIME | 96.17 | KQVDTIME | 1.99 | VQVDTIME | 0.54 | ERVDTIME | 0.36 | | |
| HA | H5N1 | 36 | 0.18 | yes | 3 | 0.12 | 99.1 | QVDTIMEK | 98.31 | QVDTIMER | 0.42 | RVDTIMEK | 0.36 | | | | |
| HA | H5N1 | 37 | 0.1 | yes | 1 | 0.12 | 99.1 | VDTIMEKN | 99.1 | | | | | | | | |
| HA | H5N1 | 38 | 0.1 | yes | 1 | 0 | 99.03 | DTIMEKNV | 99.03 | | | | | | | | |
| HA | H5N1 | 39 | 0.12 | yes | 2 | 0 | 99.25 | TIMEKNVT | 98.85 | TIMERNVT | 0.42 | | | | | | |
| HA | H5N1 | 40 | 0.13 | yes | 2 | 0 | 99.19 | IMEKNVTV | 98.82 | IMERNVT | 0.42 | | | | | | |
| HA | H5N1 | 41 | 0.13 | yes | 2 | 0 | 99.19 | MEKNVTVT | 98.76 | MERNVTVT | 0.42 | | | | | | |
| HA | H5N1 | 42 | 0.15 | yes | 2 | 0 | 99.04 | EKNVTVTH | 98.67 | ERNVTVTH | 0.42 | | | | | | |
| HA | H5N1 | 43 | 0.15 | yes | 2 | 0 | 99.04 | KNVTVTHA | 98.61 | RNVTVTH | 0.42 | | | | | | |
| HA | H5N1 | 44 | 0.14 | yes | 2 | 0 | 99.07 | NVTVTHAQ | 98.73 | VTVTHAK | 0.3 | | | | | | |
| HA | H5N1 | 45 | 0.18 | yes | 3 | 0 | 99.01 | VTVTHAQD | 98.37 | VTVTHAQN | 0.39 | VTVTHAKD | 0.3 | | | | |
| HA | H5N1 | 46 | 0.15 | yes | 2 | 0 | 99.07 | TVTHAQDI | 98.61 | TVTHAQNI | 0.39 | | | | | | |
| HA | H5N1 | 47 | 0.14 | yes | 2 | 0 | 99.16 | VTHAQDIL | 98.76 | VTHAQNIL | 0.39 | | | | | | |
| HA | H5N1 | 48 | 0.14 | yes | 2 | 0 | 99.1 | THAQDILE | 98.7 | THAQNILE | 0.39 | | | | | | |
| HA | H5N1 | 49 | 0.29 | yes | 3 | 0 | 99.16 | HAQDILEK | 96.41 | HAQNILEK | 2.35 | HAQDILER | 0.39 | | | | |
| HA | H5N1 | 52 | 0.54 | yes | 5 | 0 | 99.19 | DILEKTHN | 93.04 | DILEKAHN | 2.35 | DILEKEHN | 1.66 | DILEKEHN | 1.18 | DILEKKHN | 0.99 |
| HA | H5N1 | 53 | 0.51 | yes | 5 | 0 | 99.55 | ILEKTHNG | 93.4 | ILEKAHNG | 2.32 | ILEKEHNG | 1.66 | ILEKEHNG | 1.18 | ILEKKHNG | 0.99 |
| HA | H5N1 | 58 | 0.73 | yes | 4 | 0 | 99.07 | HNGKLCDL | 87.71 | HNGKLCSL | 8.41 | HNGRLCDL | 2.05 | HNGRLCDL | 1.66 | | |
| HA | H5N1 | 65 | 0.71 | yes | 5 | 0 | 99.1 | LDGWKPLI | 88.37 | LKGVRPLI | 8.32 | LKGYRPLI | 1.18 | LDGVRPLI | 0.9 | | |
| HA | H5N1 | 66 | 0.71 | yes | 5 | 0 | 99.16 | DGWKPLIL | 88.43 | KGVRPLIL | 8.32 | KGYRPLIL | 1.18 | DGVRPLIL | 1.05 | LEGVKPLI | 0.18 |
| HA | H5N1 | 67 | 0.67 | yes | 4 | 0 | 99.1 | GWKPLILR | 88.76 | GVRPLILR | 8.04 | GVKPLILK | 1.18 | GVRPLILR | 1.05 | EGVKPLIL | 0.18 |
| HA | H5N1 | 68 | 0.7 | yes | 5 | 0.03 | 99.19 | WKPLILRD | 88.91 | VKPLILKD | 8.14 | VRPLILKD | 1.12 | VRPLILRD | 1.05 | VKPLILRN | 0.15 |
| HA | H5N1 | 69 | 0.66 | yes | 4 | 0.03 | 99.31 | KPLILRDC | 88.91 | KPLILKDC | 9.25 | RPLILKDC | 1.15 | RPLILKDC | 1.12 | | |
| HA | H5N1 | 70 | 0.53 | yes | 2 | 0.03 | 99.28 | PLILRDCS | 90.02 | PLILKDCS | 9.04 | | | | | | |
| HA | H5N1 | 71 | 0.55 | yes | 2 | 0.03 | 99.01 | LILRDCSV | 89.96 | LILKDCSV | 9.04 | | | | | | |
| HA | H5N1 | 72 | 0.54 | yes | 2 | 0.03 | 99.1 | ILRDCSVA | 90.02 | ILKDCSVA | 9.07 | | | | | | |
| HA | H5N1 | 73 | 0.54 | yes | 2 | 0.06 | 99.07 | LRDCSYAG | 89.19 | LKDCSYAG | 9.07 | | | | | | |
| HA | H5N1 | 74 | 0.09 | yes | 1 | 0.03 | 99.19 | RDCSYAGW | 99.99 | | | | | | | | |
| HA | H5N1 | 75 | 0.09 | yes | 1 | 0.06 | 99.46 | CSYAGWLL | 99.46 | | | | | | | | |
| HA | H5N1 | 76 | 0.06 | yes | 1 | 0.03 | 99.46 | SYAGWLLG | 99.52 | | | | | | | | |
| HA | H5N1 | 77 | 0.05 | yes | 1 | 0 | 99.52 | VAGWLLGN | 99.85 | | | | | | | | |
| HA | H5N1 | 78 | 0.02 | yes | 1 | 0 | 99.85 | AGWLLGNP | 99.52 | | | | | | | | |
| HA | H5N1 | 79 | 0.22 | yes | 2 | 0 | 99.52 | WLLGNPMC | 97.17 | GWLLGNPL | 2.35 | | | | | | |
| HA | H5N1 | 80 | 0.21 | yes | 2 | 0.03 | 99.55 | LLGNPMCD | 97.2 | WLLGNPLC | 2.35 | | | | | | |
| HA | H5N1 | 81 | 0.21 | yes | 2 | 0 | 99.55 | LGNPMCDE | 97.2 | LLGNPLCD | 2.35 | | | | | | |
| HA | H5N1 | 82 | 0.27 | yes | 2 | 0.03 | 99.01 | GNPMCDEF | 96.65 | LGNPLCDE | 2.35 | | | | | | |
| HA | H5N1 | 83 | 0.27 | yes | 2 | 0.03 | 99.01 | GNPLCDEF | 96.65 | GNPLCDEF | 2.35 | | | | | | |
| HA | H5N1 | 93 | 0.46 | yes | 3 | 0.09 | 99.03 | NVSEWSYI | 93.37 | NVPEWSYI | 4.89 | DVPEWSYI | 0.78 | | | | |

FIG. 72-231

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 94

FIG. 72-232

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 275 | 0.23 | yes | 4 | 0.06 | 99.01

FIG. 72-233

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H5N1 | 359 | 0.25 | no | 2 | 19.07 | 99.22 | KRGLFGAI | 96.84 | TRGLFGAI | 2.38 | | | | |
| HA | H5N1 | 360 | 0.04 | yes | 1 | 0.06 | 99.67 | RGLFGAIA | 99.67 | | | | | | |
| HA | H5N1 | 361 | 0.06 | yes | 1 | 0.06 | 99.52 | GLFGAIAG | 99.52 | | | | | | |
| HA | H5N1 | 362 | 0.07 | yes | 1 | 0.03 | 99.43 | LFGAIAGF | 99.43 | | | | | | |
| HA | H5N1 | 363 | 0.08 | yes | 1 | 0.06 | 99.43 | FGAIAGFI | 99.43 | | | | | | |
| HA | H5N1 | 364 | 0.08 | yes | 1 | 0.06 | 99.4 | GAIAGFIE | 99.4 | | | | | | |
| HA | H5N1 | 365 | 0.08 | yes | 1 | 0.06 | 99.4 | AIAGFIEG | 99.4 | | | | | | |
| HA | H5N1 | 366 | 0.07 | yes | 1 | 0.06 | 99.4 | IAGFIEGG | 99.4 | | | | | | |
| HA | H5N1 | 367 | 0.07 | yes | 1 | 0.09 | 99.49 | AGFIEGGW | 99.49 | | | | | | |
| HA | H5N1 | 368 | 0.06 | yes | 1 | 0.09 | 99.43 | GFIEGGWQ | 99.43 | | | | | | |
| HA | H5N1 | 369 | 0.05 | yes | 1 | 0.09 | 99.52 | FIEGGWQG | 99.52 | | | | | | |
| HA | H5N1 | 370 | 0.06 | yes | 1 | 0.09 | 99.55 | IEGGWQGM | 99.55 | | | | | | |
| HA | H5N1 | 371 | 0.11 | yes | 2 | 0.06 | 99.37 | EGGWQGM | 98.91 | EGGWQGMI | 0.63 | | | | |
| HA | H5N1 | 372 | 0.13 | yes | 2 | 0.06 | 99.4 | GGWQGMD | 98.73 | GGWQGMID | 0.63 | | | | |
| HA | H5N1 | 373 | 0.13 | yes | 2 | 0.09 | 99.49 | GWQGMDG | 98.76 | GWQGMIDGW | 0.63 | | | | |
| HA | H5N1 | 374 | 0.12 | yes | 2 | 0.09 | 99.49 | WQGMDGW | 98.85 | WQGMIDGW | 0.63 | | | | |
| HA | H5N1 | 375 | 0.12 | yes | 2 | 0.06 | 99.55 | QGMDGWY | 98.82 | QGMIDGWY | 0.63 | | | | |
| HA | H5N1 | 376 | 0.11 | yes | 2 | 0.03 | 99.52 | GMDGWYG | 98.92 | GMIDGWYG | 0.63 | | | | |
| HA | H5N1 | 377 | 0.26 | yes | 3 | 0 | 99.25 | MVDGWYGY | 96.78 | MIDGWYGY | 2.11 | | | | |
| HA | H5N1 | 378 | 0.29 | yes | 3 | 0 | 99.22 | VDGWYGYH | 96.5 | IDGWYGYH | 2.11 | | | | |
| HA | H5N1 | 379 | 0.24 | yes | 3 | 0 | 99.16 | DGWYGYHH | 97.11 | | 2.11 | | | | |
| HA | H5N1 | 380 | 0.27 | yes | 3 | 0.03 | 99.22 | GWYGYHH | 97.05 | WYGYHHHN | 2.11 | WYGYHHNE | 0.24 | | |
| HA | H5N1 | 381 | 0.36 | yes | 5 | 0.03 | 99.16 | WYGYHHS | 96.81 | YGYHHSNG | 2.11 | YGYHHNNE | 0.75 | YGYHHSKE | 0.21 |
| HA | H5N1 | 382 | 0.37 | yes | 5 | 0.06 | 99.1 | YGHHSNE | 95.78 | GYHHSNGQ | 2.11 | GYHHNNEQ | 0.75 | GYHHSKEQ | 0.18 |
| HA | H5N1 | 383 | 0.37 | yes | 5 | 0.06 | 99.01 | GYHHSNEQ | 95.72 | YHHSNGQG | 2.11 | YHHNNEQG | 0.75 | YHHSKEQG | 0.18 |
| HA | H5N1 | 384 | 0.37 | yes | 5 | 0.06 | 99.01 | YHHSNEQG | 95.72 | HHSNGQGS | 2.11 | HHSKEQGS | 0.24 | RHSNEQGS | 0.15 |
| HA | H5N1 | 385 | 0.24 | yes | 3 | 0.06 | 99.04 | HHSNEQGS | 97.71 | HSNGQGSG | 0.75 | | | | |
| HA | H5N1 | 386 | 0.21 | yes | 3 | 0.06 | 99.04 | HSNEQGSG | 98.01 | SNGQGSGY | 0.75 | | | | |
| HA | H5N1 | 387 | 0.2 | yes | 3 | 0.06 | 99.04 | SNEQGSGY | 98.04 | NGQGSGYA | 0.75 | | | | |
| HA | H5N1 | 388 | 0.18 | yes | 3 | 0.06 | 99.07 | NEQGSGYA | 98.31 | GQGSGYAA | 0.75 | | | | |
| HA | H5N1 | 389 | 0.16 | yes | 2 | 0.03 | 99.04 | EQGSGYAA | 98.46 | | | | | | |
| HA | H5N1 | 390 | 0.17 | yes | 2 | 0.03 | 99.07 | QGSGYAAD | 99.34 | | | | | | |
| HA | H5N1 | 391 | 0.2 | yes | 3 | 0.03 | 99.22 | GSGYAADQ | 98.37 | GSGYAADRE | 0.66 | SGYAADRE | 0.36 | | |
| HA | H5N1 | 392 | 0.18 | yes | 3 | 0.03 | 99.34 | SGYAADQE | 98.13 | SGYAADKE | 0.66 | GYAADRES | 0.36 | ADRESTQK | 0.36 |
| HA | H5N1 | 393 | 0.2 | yes | 3 | 0 | 99.04 | GYAADQES | 98.25 | GYAADKES | 0.66 | YAADREST | 0.36 | DRESTQKA | 0.36 |
| HA | H5N1 | 394 | 0.2 | yes | 4 | 0 | 99.28 | YAADKEST | 98.07 | YAADQEST | 0.66 | AADREST | 0.36 | RESTQKAI | 0.36 |
| HA | H5N1 | 395 | 0.27 | yes | 4 | 0.03 | 99.1 | AADQESTQ | 98.1 | AADKESTQ | 1.18 | ADREST | 0.66 | ESTQKAMD | 0.21 |
| HA | H5N1 | 396 | 0.27 | yes | 4 | 0.03 | 99.13 | ADQESTQK | 97.05 | ADKESTQK | 1.18 | DQESTQK | 0.66 | KESTQKAM | 0.21 |
| HA | H5N1 | 397 | 0.27 | yes | 4 | 0.06 | 99.25 | DQESTQKA | 97.05 | DKESTQKA | 1.18 | QESTQKA | 0.66 | | |
| HA | H5N1 | 398 | 0.31 | yes | 5 | 0.06 | 99.25 | QESTQKAI | 96.68 | KESTQKAI | 1.18 | ESTQRAI | 0.51 | | |
| HA | H5N1 | 399 | 0.27 | yes | 4 | 0.06 | 99.1 | ESTQKAID | 97.14 | ESTQRAID | 1.15 | QKAING | | | |
| HA | H5N1 | 400 | 0.25 | yes | 3 | 0.06 | 99.07 | STQKAIDG | 97.32 | STQRAIDG | 1.18 | | | | |

FIG. 72-234

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 401 | 0.45 | yes | 4 | 0.06 | 99.13 | TQKAIDGV | 94.12 | TQKAIDGI | 3.29 | TQKAINGV | 1.18 | | |
| HA | H5N1 | 402 | 0.43 | yes | 4 | 0.06 | 99.28 | QKAIDGVT | 94.27 | QKAIDGIT | 3.29 | QKAINGVT | 1.18 | | |
| HA | H5N1 | 403 | 0.43 | yes | 4 | 0.03 | 99.28 | KAIDGVTN | 94.27 | KAIDGITN | 3.29 | KAINGVTN | 1.18 | | |
| HA | H5N1 | 404 | 0.35 | yes | 3 | 0.03 | 99.13 | AIDGVTNK | 95.39 | AIDGITNK | 3.16 | AINGVTNK | 1.18 | | |
| HA | H5N1 | 405 | 0.38 | yes | 3 | 0 | 99.01 | IDGVTNKV | 95.3 | IDGITNKV | 2.92 | INGVTNKV | 0.57 | IDGITNKI | 0.24 |
| HA | H5N1 | 406 | 0.33 | yes | 2 | 0 | 99.22 | DGVTNKVN | 95.75 | DGITNKV | 2.89 | NGVTNKV | 0.54 | | |
| HA | H5N1 | 407 | 0.28 | yes | 1 | 0.03 | 99.22 | GVTNKVNS | 96.38 | GITNKVNS | 2.83 | | | | |
| HA | H5N1 | 408 | 0.28 | yes | 1 | 0.03 | 99.19 | VTNKVNSI | 96.35 | ITNKVNSI | 2.83 | | | | |
| HA | H5N1 | 409 | 0.1 | yes | 1 | 0 | 99.1 | TNKVNSII | 99.1 | | | | | | |
| HA | H5N1 | 410 | 0.39 | yes | 3 | 0.03 | 99.07 | NKVNSIID | 94.45 | NKVNSIIG | 4.28 | | | | |
| HA | H5N1 | 411 | 0.39 | yes | 3 | 0 | 99.1 | KVNSIIDK | 94.48 | KVNSIIGK | 4.28 | | | | |
| HA | H5N1 | 412 | 0.37 | yes | 3 | 0.06 | 99.07 | VNSIIDKM | 94.66 | VNSIIGKM | 4.28 | | | | |
| HA | H5N1 | 413 | 0.34 | yes | 3 | 0.06 | 99.25 | NSIIDKMN | 94.94 | NSIINKMN | 4.31 | | | | |
| HA | H5N1 | 414 | 0.37 | yes | 2 | 0.06 | 99.04 | SIIDKMNT | 94.75 | SIINKMNT | 4.28 | | | | |
| HA | H5N1 | 415 | 0.38 | yes | 3 | 0.12 | 99.19 | IIDKMNTQ | 94.6 | IINKMNTQ | 4.25 | IIGKMNTQ | 0.33 | | |
| HA | H5N1 | 416 | 0.4 | yes | 3 | 0.06 | 99.22 | IDKMNTQF | 94.63 | INKMNTQF | 4.25 | IGKMNTQF | 0.33 | | |
| HA | H5N1 | 417 | 0.4 | yes | 3 | 0.09 | 99.03 | DKMNTQFE | 94.45 | NKMNTQFE | 4.25 | GKMNTQFE | 0.33 | | |
| HA | H5N1 | 418 | 0.13 | yes | 2 | 0.09 | 99.07 | KMNTRFEA | 98.88 | MNTQFETV | 0.18 | | | | |
| HA | H5N1 | 419 | 0.18 | yes | 2 | 0.09 | 99.1 | MNTQFEAV | 98.34 | NTQFEAIG | 0.57 | | | | |
| HA | H5N1 | 420 | 0.18 | yes | 3 | 0.06 | 99.04 | NTQFEAVG | 98.28 | NTRFEAVG | 0.57 | IQFEAVGR | 0.18 | | |
| HA | H5N1 | 421 | 0.31 | yes | 2 | 0.06 | 99.07 | TQFEAVGR | 96.5 | TQFEAIGR | 1.81 | | | | |
| HA | H5N1 | 422 | 0.29 | yes | 3 | 0.03 | 99.13 | QFEAVGRE | 96.71 | QFEAIGRE | 1.84 | EAIGREFN | 0.57 | | |
| HA | H5N1 | 423 | 0.27 | yes | 3 | 0.06 | 99.01 | FEAVGREF | 96.87 | FEAIGREF | 1.9 | EFNSLERR | 0.97 | | |
| HA | H5N1 | 424 | 0.37 | yes | 4 | 0.03 | 99.34 | EAVGREFN | 95.63 | EAVGREF | 1.9 | | 0.3 | | |
| HA | H5N1 | 429 | 0.44 | yes | 3 | 0.06 | 99.28 | EFNNLERR | 94.81 | EFNSLERR | 1.45 | RRIENLNR | 0.42 | | |
| HA | H5N1 | 433 | 0.21 | yes | 4 | 0.15 | 99.03 | LERRIENL | 97.65 | LEKRIENL | 1.45 | | 0.3 | | |
| HA | H5N1 | 434 | 0.29 | yes | 2 | 0.06 | 99.1 | ERRIENLN | 97.56 | EKRIENLN | 1.45 | | 0.3 | | |
| HA | H5N1 | 435 | 0.27 | yes | 4 | 0 | 99.01 | RRIENLNK | 97.02 | RRIESLNK | 0.42 | RRIESLNK | 0.42 | | |
| HA | H5N1 | 436 | 0.18 | yes | 3 | 0.06 | 99.16 | RIENLNKK | 98.28 | RIESLNKK | 0.42 | RIENLNKR | 0.3 | | |
| HA | H5N1 | 437 | 0.17 | yes | 2 | 0.06 | 99.01 | IENLNKKM | 98.43 | IESLNKKM | 0.42 | IENLNRKM | 0.3 | | |
| HA | H5N1 | 438 | 0.18 | yes | 2 | 0.03 | 99.16 | ENLNKKME | 98.28 | ESLNKKME | 0.42 | ENLNRKME | 0.3 | | |
| HA | H5N1 | 439 | 0.16 | yes | 2 | 0.06 | 99.25 | NLNKKMED | 98.52 | SLNKKMED | 0.42 | NLNRKMED | 0.3 | | |
| HA | H5N1 | 440 | 0.17 | yes | 2 | 0.06 | 99.25 | LNKKMEDG | 98.95 | LNRKMEDG | 0.3 | | | | |
| HA | H5N1 | 441 | 0.12 | yes | 2 | 0.03 | 99.25 | NKKMEDGF | 98.95 | NRKMEDGF | 0.3 | | | | |
| HA | H5N1 | 442 | 0.12 | yes | 2 | 0.06 | 99.31 | KKMEDGFL | 98.94 | RKMEDGFL | 0.3 | | | | |
| HA | H5N1 | 443 | 0.12 | yes | 2 | 0.06 | 99.22 | KMEDGFLD | 99.31 | | | | | | |
| HA | H5N1 | 444 | 0.08 | yes | 1 | 0.06 | 99.34 | MEDGFLDV | 99.22 | | | | | | |
| HA | H5N1 | 445 | 0.09 | yes | 1 | 0.06 | 99.31 | EDGFLDVW | 99.34 | | | | | | |
| HA | H5N1 | 446 | 0.08 | yes | 1 | 0.06 | 99.31 | DGFLDVWT | 99.31 | | | | | | |
| HA | H5N1 | 447 | 0.08 | yes | 1 | 0.03 | 99.34 | GFLDVWTY | 99.34 | | | | | | |
| HA | H5N1 | 448 | 0.08 | yes | 1 | 0.03 | 99.34 | FLDVWTYN | 99.34 | | | | | | |
| HA | H5N1 | 449 | 0.09 | yes | 1 | 0.03 | 99.25 | LDVWTYNA | 99.25 | | | | | | |

FIG. 72-235

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 450 | 0.07 | yes | 1 | 0 | 99.34 | DVWTYNAE | 99.34 | | | | | | |
| HA | H5N1 | 451 | 0.08 | yes | 1 | 0 | 99.34 | VWTYNAEL | 99.34 | | | | | | |
| HA | H5N1 | 452 | 0.06 | yes | 1 | 0 | 99.46 | WTYNAELL | 99.46 | | | | | | |
| HA | H5N1 | 453 | 0.07 | yes | 1 | 0 | 99.37 | TYNAELLV | 99.37 | | | | | | |
| HA | H5N1 | 454 | 0.09 | yes | 1 | 0 | 99.28 | YNAELLVL | 99.28 | | | | | | |
| HA | H5N1 | 455 | 0.09 | yes | 1 | 0 | 99.25 | NAELLVLM | 99.25 | | | | | | |
| HA | H5N1 | 456 | 0.1 | yes | 1 | 0 | 99.16 | AELLVLME | 99.16 | | | | | | |
| HA | H5N1 | 457 | 0.09 | yes | 1 | 0 | 99.28 | ELLVLMEN | 99.28 | | | | | | |
| HA | H5N1 | 458 | 0.08 | yes | 1 | 0 | 99.31 | LLVLMENE | 99.31 | | | | | | |
| HA | H5N1 | 459 | 0.06 | yes | 1 | 0 | 99.52 | LVLMENER | 99.52 | | | | | | |
| HA | H5N1 | 460 | 0.05 | yes | 1 | 0 | 99.58 | VLMENERT | 99.58 | | | | | | |
| HA | H5N1 | 461 | 0.04 | yes | 1 | 0 | 99.67 | LMENERTL | 99.67 | | | | | | |
| HA | H5N1 | 462 | 0.04 | yes | 1 | 0 | 99.7 | MENERTLD | 99.7 | | | | | | |
| HA | H5N1 | 463 | 0.04 | yes | 1 | 0 | 99.67 | ENERTLDF | 99.67 | | | | | | |
| HA | H5N1 | 464 | 0.03 | yes | 1 | 0 | 99.67 | NERTLDFH | 99.67 | | | | | | |
| HA | H5N1 | 465 | 0.03 | yes | 1 | 0 | 99.79 | ERTLDFHD | 99.79 | | | | | | |
| HA | H5N1 | 466 | 0.03 | yes | 1 | 0 | 99.79 | RTLDFHDS | 99.79 | | | | | | |
| HA | H5N1 | 467 | 0.03 | yes | 1 | 0 | 99.76 | TLDFHDSN | 99.76 | | | | | | |
| HA | H5N1 | 468 | 0.04 | yes | 1 | 0 | 99.73 | LDFHDSNV | 99.73 | | | | | | |
| HA | H5N1 | 469 | 0.04 | yes | 1 | 0 | 99.7 | DFHDSNVK | 99.7 | DFHDSNVR | 1.05 | | | | |
| HA | H5N1 | 470 | 0.04 | yes | 2 | 0 | 99.64 | FHDSNVKN | 98.58 | FHDSNVRN | 1.05 | | | | |
| HA | H5N1 | 471 | 0.13 | yes | 2 | 0 | 99.55 | HDSNVKNL | 98.49 | HDSNVRNL | 1.05 | | | | |
| HA | H5N1 | 472 | 0.13 | yes | 2 | 0 | 99.61 | DSNVKNLY | 98.55 | DSNVRNLY | 1.05 | | | | |
| HA | H5N1 | 473 | 0.13 | yes | 3 | 0 | 99.46 | SNVKNLYE | 96.5 | SNVRNLYE | 1.9 | SNVRNLYD | 1.05 | | |
| HA | H5N1 | 474 | 0.29 | yes | 4 | 0 | 99.46 | NVKNLYEK | 95.93 | NVKNLYEK | 1.9 | NVRNLYDK | 1.05 | NVKNLYDR | 0.57 |
| HA | H5N1 | 475 | 0.34 | yes | 4 | 0 | 99.25 | VKNLYDK | 95.72 | VRNLYDKV | 1.9 | VRNLYDKV | 1.05 | VKNLYDRV | 0.57 |
| HA | H5N1 | 476 | 0.36 | yes | 3 | 0 | 99.31 | KNLYDKV | 95.78 | KNLYEKVR | 1.9 | RNLYDKVR | 1.05 | KNLYDRVR | 0.57 |
| HA | H5N1 | 477 | 0.35 | yes | 3 | 0 | 99.34 | NLYDKVR | 96.87 | NLYEKVRL | 1.9 | NLYDKVR | 1.05 | | |
| HA | H5N1 | 478 | 0.27 | yes | 3 | 0 | 99.28 | LYDKVRL | 96.81 | LYEKVRLQ | 1.9 | LYDRVRL | 1.05 | | |
| HA | H5N1 | 479 | 0.26 | yes | 2 | 0 | 99.19 | YDKVRLQ | 93.01 | YEKVRLQL | 1.9 | YDRVRLQL | 0.57 | | |
| HA | H5N1 | 480 | 0.27 | yes | 3 | 0 | 99.25 | DKVRLQL | 94.91 | DKVRLQLK | 3.74 | EKVRLQLR | 0.57 | DRVRLQLR | 0.57 |
| HA | H5N1 | 481 | 0.51 | yes | 3 | 0 | 99.55 | KVRLQLR | 95.54 | KVRLQLKD | 3.77 | RVRLQLRD | 1.87 | | |
| HA | H5N1 | 482 | 0.37 | yes | 2 | 0 | 99.78 | VRLQLRD | 95.78 | VRLQLKDN | 3.77 | | | | |
| HA | H5N1 | 483 | 0.31 | yes | 2 | 0 | 99.66 | RLQLRDN | 95.66 | RLQLKDNA | 3.59 | | | | |
| HA | H5N1 | 484 | 0.29 | yes | 2 | 0 | 99.25 | LQLRDNA | 95.66 | LQLKDNAK | 3.59 | | | | |
| HA | H5N1 | 485 | 0.31 | yes | 2 | 0 | 99.25 | QLRDNAK | 95.66 | QLKDNAKE | 3.59 | | | | |
| HA | H5N1 | 486 | 0.31 | yes | 2 | 0 | 99.25 | LRDNAKE | 95.66 | LKDNAKEL | 3.59 | | | | |
| HA | H5N1 | 487 | 0.31 | yes | 2 | 0 | 99.28 | RDNAKEL | 95.69 | KDNAKELG | 3.59 | | | | |
| HA | H5N1 | 488 | 0.08 | yes | 1 | 0.06 | 99.43 | DNAKELGN | 99.43 | | | | | | |
| HA | H5N1 | 489 | 0.06 | yes | 1 | 0.06 | 99.28 | NAKELGNG | 99.28 | | | | | | |
| HA | H5N1 | 490 | 0.07 | yes | 1 | 0.06 | 99.37 | AKELGNGC | 99.37 | | | | | | |
| HA | H5N1 | 491 | 0.07 | yes | 1 | 0.06 | 99.37 | KELGNGCF | 99.37 | | | | | | |

FIG.72-236

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 492 | 0.04 | yes | 1 | 0

FIG.72-237

| Protein | Sub-type | Start Pos | Block Entropy | Gaps <10% | # to cover 99% | % Gap | Coverage | Peptides included | freq | Peptides included | freq | Peptides included | freq | Peptides included | freq |
|---|---|---|---|---|---|---|---|---|---|---|---|---|---|---|---|
| HA | H5N1 | 575 | 0.88 | yes | 3 | 5.88 | 99.07 | SLWM

FIG. 72-238

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 121 | 0.86 | y

FIG. 72-239

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 165 | 0.43 | yes | 5 | 0.05 | 99.22 | NGTVKDRS | 94.56 | NGTVNDRS | 2.86

FIG. 72-240

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | H5N1 | 213 | 0.65 | yes | 4 | 0.05 | 99

FIG. 72-241

| Protein | Sub-type | Start Pos | Block Entropy | Gaps <10% | # to 10 cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 301 | 0.47 | yes | 4 | 0

FIG. 72-242

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 377 | 0.13 | yes | 2 | 0 | 99.12 | NGVWIGRT | | DGVWIGRT | 0.32 | | | | |
| NA | H5N1 | 378 | 0.09 | yes | 1 | 0 | 99.22 |

FIG. 72-243

| Protein | Sub-type | Start Pos | Block Entropy | Gaps >10% | # to cover 99% | % Gap | coverage | included Peptides | Freq | included Peptides | Freq | included Peptides | Freq | included Peptides | Freq |
|---|---|---|---|---|---|---|---|---|---|---|---|---|---|---|---|
| NA | H5N1 | 458 | 0.38 | yes | 4 | 0.14 | 99.12 | IWTSGSSI | 95.15 | VWTSGSII | 3.23 | IWASGSS

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N2 | 370 | 0.05 | yes | 1 | 0 | 99.54 | DGWYGYHH | 99.54 | GWYGYHHT | 1.85 | | | | |
| HA | H5N2 | 371 | 0.3 | yes | 3 | 0 | 99.07 | GWYGYHHS | 96.3 | GWYGYHHN | 1.85 | WYGYHHNN | 0.46 | | |
| HA | H5N2 | 372 | 0.32 | yes | 4 | 0 | 99.31 | WYGYHHSN | 96.06 | WYGYHHHN | 2.78 | NAQGSGYA | 0.46 | | |
| HA | H5N2 | 379 | 0.39 | yes | 4 | 0 | 99.07 | NEQGSGYA | 94.91 | NDQGSGYA | 2.78 | AQGSGYAA | 0.46 | | |
| HA | H5N2 | 380 | 0.39 | yes | 4 | 0 | 99.07 | EQGSGYAA | 94.91 | DQGSGYAA | 2.78 | | | | |
| HA | H5N2 | 381 | 0.12 | yes | 2 | 0 | 99.07 | QGSGYAAD | 98.84 | QGSGYGED | 0.23 | | | | |
| HA | H5N2 | 382 | 0.15 | yes | 2 | 0 | 99.07 | GSGYAADK | 98.38 | GSGYAADR | 0.7 | | | | |
| HA | H5N2 | 383 | 0.4 | yes | 5 | 0.23 | 99.07 | SGYAADKE | 94.9 | SGYAADKK | 3.02 | SGYAADRK | 0.7 | SGYAADKA | 0.23 |
| HA | H5N2 | 384 | 0.37 | yes | 4 | 0.23 | 99.07 | GYAADKES | 95.13 | GYAADKKS | 3.02 | GYAADRKS | 0.7 | GYAANKES | 0.23 |
| HA | H5N2 | 385 | 0.37 | yes | 4 | 0.23 | 99.07 | YAADKEST | 95.13 | YAADKKST | 3.02 | YAADRKST | 0.7 | YAADKAST | 0.23 |
| HA | H5N2 | 386 | 0.37 | yes | 4 | 0.23 | 99.07 | AADKESTQ | 95.13 | AADKKSTQ | 3.02 | AADRKSTQ | 0.7 | AADKDSTQ | 0.23 |
| HA | H5N2 | 387 | 0.5 | yes | 5 | 0.23 | 99.07 | ADKESTQK | 93.27 | ADKKSTQK | 1.86 | ADRKSTQK | 0.7 | ADKESTOR | 0.23 |
| HA | H5N2 | 388 | 0.5 | yes | 5 | 0.23 | 99.07 | DKESTQKA | 92.58 | DKKSTQKA | 1.86 | DRKSTQKA | 1.86 | DKESTQRA | 0.23 |
| HA | H5N2 | 389 | 0.56 | yes | 5 | 0.23 | 99.54 | KESTQKAI | 87.96 | KKSTQKAI | 1.86 | KESTQKAV | 0.93 | KESTQRAI | 0.23 |
| HA | H5N2 | 390 | 0.79 | yes | 5 | 0.23 | 99.31 | ESTQKAID | 92.13 | ESTQKAID | 3.7 | ESTQKAVD | 0.93 | ESTQRAID | 0.23 |
| HA | H5N2 | 391 | 0.52 | yes | 5 | 0.23 | 99.31 | STQKAIDG | 90.28 | STQKAIDG | 4.63 | STQKAVDG | 1.85 | STQKAVDG | 0.23 |
| HA | H5N2 | 392 | 0.66 | yes | 5 | 0.23 | 99.07 | TQKAIDGI | 90.28 | TQRAIDGI | 4.63 | TQKAIDGV | 0.93 | TQKAVDGI | 0.23 |
| HA | H5N2 | 393 | 0.68 | yes | 5 | 0.23 | 99.07 | QKAIDGIT | 90.05 | QRAIDGIT | 4.63 | QKAIDGVT | 1.62 | QKAVDGIT | 0.23 |
| HA | H5N2 | 394 | 0.57 | yes | 5 | 0 | 99.07 | KAIDGITN | 91.67 | RAIDGITN | 4.63 | KAIDGVTN | 1.62 | KAVDGITN | 0.7 |
| HA | H5N2 | 404 | 0.17 | yes | 3 | 0 | 99.31 | NSIIDKMN | 91.67 | NSIIDRMN | 4.86 | NSIINKMN | 1.16 | NSIIEKMN | 0.93 |
| HA | H5N2 | 441 | 0.13 | yes | 3 | 0 | 99.07 | DVWTYNAE | 98.61 | GVWTYNAE | 4.63 | EVWTYNAE | 2.08 | DVWTYNTE | 0.46 |
| HA | H5N2 | 442 | 0.18 | yes | 3 | 0 | 99.07 | VWTYNTEL | 98.15 | WTYNAELF | 0.46 | | | | |
| HA | H5N2 | 443 | 0.18 | yes | 3 | 0 | 99.31 | WTYNTELL | 98.38 | TYNTELLV | 0.46 | | | | |
| HA | H5N2 | 444 | 0.18 | yes | 3 | 0 | 99.07 | TYNAELLY | 97.92 | YNTELLVL | 0.46 | | | | |
| HA | H5N2 | 445 | 0.16 | yes | 3 | 0 | 99.07 | YNAELLVL | 97.69 | NAELLVLI | 0.46 | NAELFVLM | 0.46 | | |
| HA | H5N2 | 446 | 0.2 | yes | 4 | 0 | 99.31 | NAELLVLM | 98.15 | AELLVLIE | 0.46 | AELFVLME | 0.46 | | |
| HA | H5N2 | 447 | 0.22 | yes | 4 | 0 | 99.07 | AELLVLME | 98.15 | ELFVLMEN | 0.46 | | | | |
| HA | H5N2 | 448 | 0.18 | yes | 3 | 0 | 99.07 | ELLVLMEN | 98.15 | LLVLIENE | 0.46 | | | | |
| HA | H5N2 | 449 | 0.18 | yes | 3 | 0 | 99.07 | LLVLMENE | 98.61 | LVLMENER | 0.46 | | | | |
| HA | H5N2 | 450 | 0.17 | yes | 3 | 0 | 99.07 | LVLMENER | 98.61 | VLIENERT | 0.46 | | | | |
| HA | H5N2 | 451 | 0.14 | yes | 2 | 0 | 99.07 | VLMENERT | 98.61 | LIENERTL | 0.69 | | | | |
| HA | H5N2 | 452 | 0.2 | yes | 4 | 0.23 | 99.07 | LMENERTL | 97.92 | IENERTLD | 0.69 | | | | |
| HA | H5N2 | 453 | 0.78 | yes | 4 | 0.23 | 82.6 | MENERTLY | 82.6 | ENERTLD | 15.78 | ENERTLDI | 0.46 | | |
| HA | H5N2 | 454 | 0.76 | yes | 3 | 0.23 | 82.83 | ENERTLDF | 82.83 | NERTLDLH | 15.78 | NERTLYFH | 0.7 | | |
| HA | H5N2 | 455 | 0.73 | yes | 3 | 0.23 | 83.06 | NERTLDFH | 83.06 | ERTLDLHD | 15.78 | ERTLYFHD | 0.7 | | |
| HA | H5N2 | 456 | 0.76 | yes | 3 | 0.23 | 82.83 | ERTLDFHD | 82.83 | RTLDLHDS | 15.78 | RTLYFHDS | 0.7 | | |
| HA | H5N2 | 457 | 0.73 | yes | 3 | 0.23 | 83.06 | RTLDFHDS | 83.06 | TLDLHDSN | 15.78 | TLYFHDSN | 0.7 | | |
| HA | H5N2 | 458 | 0.71 | yes | 3 | 0.23 | 83.29 | TLDFHDSN | 83.29 | LDLHDSNV | 15.78 | | | | |
| HA | H5N2 | 459 | 0.89 | yes | 3 | 0.23 | 80.51 | LDFHDSNV | 80.51 | DLHDSNVK | 15.31 | DFHDSNVR | 2.78 | | |
| HA | H5N2 | 460 | 0.86 | yes | 3 | 0.23 | 81.21 | DFHDSNVK | 81.21 | LHDSNVKN | 15.31 | FHDSNVRN | 2.78 | | |
| HA | H5N2 | 461 | 0.86 | yes | 3 | 0.23 | 81.21 | FHDSNVKN | 81.21 | HDSNVKNL | | | | | |
| HA | H5N2 | 462 | 0.25 | yes | 2 | 0 | 96.53 | HDSNVKNL | 96.53 | | | | | | |

FIG. 72-247

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N2 | 463 | 0.25 | yes | 2 | 0 | 99.31 | DSNVKNLY | 96.53 | DSNVRNLY | 2.78 | | | | |
| HA | H5N

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H5N2 | 182 | 1.1 | yes | 4 | 0 | 99.28 | SCHDGKAW | 75 | SCHDGNAW | 17.79 | | | SCYDGKAW | 0.48 | | |
| NA | H5N2 | 183 | 1.07 | yes | 3 | 0 | 99.04 | CHDGKAWL | 75.24 | CHDGNAWL | 17.79 | | | | | | |
| NA | H5N2 | 184 | 1.07 | yes | 3 | 0 | 99.04 | HDGKAWLH | 75.24 | HDGNAWLH | 17.79 | | | | | | |
| NA | H5N2 | 185 | 1.26 | yes | 5 | 0 | 99.52 | DGKAWLHV | 72.6 | DGRAWLHV | 17.07 | DGKAWLHI | 6.01 | DGRAWLHI | 0.72 | |
| NA | H5N2 | 186 | 1.24 | yes | 4 | 0 | 99.04 | GKAWLHVC | 72.84 | GRAWLHVC | 17.07 | GKAWLHIC | 6.01 | | |
| NA | H5N2 | 187 | 1.4 | yes | 5 | 0 | 99.52 | KAWLHVCV | 70.19 | RAWLHVCV | 17.07 | KAWLHVCI | 6.01 | KAWLHICV | 3.12 | KAWLHVCI | 2.64 |
| NA | H5N2 | 188 | 0.46 | yes | 3 | 0 | 99.04 | AWLHVCIT | 93.03 | AWLHVCIT | 3.85 | | | | | | |
| NA | H5N2 | 189 | 0.43 | yes | 3 | 0 | 99.76 | WLHVCITG | 93.27 | WLHVCVTG | 3.85 | | | | | | |
| NA | H5N2 | 190 | 0.51 | yes | 3 | 0 | 99.04 | LHVCITGD | 92.55 | LHVCVTGD | 3.85 | | | | | | |
| NA | H5N2 | 191 | 0.51 | yes | 3 | 0 | 99.04 | HVCITGDD | 92.55 | HICVTGDD | 3.85 | | | | | | |
| NA | H5N2 | 195 | 0.41 | yes | 4 | 0 | 99.04 | TGDDRNAT | 94.71 | TGDDGNAT | 3.12 | TGDDSNAT | 0.24 | TGHDKNAT | 0.24 | |
| NA | H5N2 | 196 | 0.38 | yes | 5 | 0 | 99.04 | GDDRNATA | 94.71 | GDDGNATA | 3.12 | GNDRNATA | 0.24 | DDRNATAN | 0.24 | |
| NA | H5N2 | 197 | 0.41 | yes | 4 | 0 | 99.04 | DDRNATAS | 94.95 | DDGNATAS | 3.12 | HDKNATAS | 0.24 | | |
| NA | H5N2 | 200 | 0.41 | yes | 2 | 0 | 99.28 | NATASFIY | 94.47 | NATASIIY | 3.12 | NATASLIY | 0.48 | | |
| NA | H5N2 | 217 | 0.14 | yes | 2 | 0 | 99.04 | SWSQNILR | 98.08 | SWSKNILR | 0.48 | SCSQNILR | 0.24 | | |
| NA | H5N2 | 218 | 0.14 | yes | 2 | 0 | 99.04 | WSQNILRT | 98.56 | WSKNILRT | 0.48 | | | | | | |
| NA | H5N2 | 219 | 0.12 | yes | 1 | 0 | 99.04 | SQNILRTQ | 98.8 | SKNILRTQ | 0.48 | | | | | | |
| NA | H5N2 | 220 | 0.07 | yes | 1 | 0 | 99.28 | QNILRTQE | 99.28 | KMILRTQE | 0.48 | | | | | | |
| NA | H5N2 | 221 | 0.12 | yes | 2 | 0.24 | 99.28 | NILRTQES | 99.28 | | | | | | | | |
| NA | H5N2 | 222 | 0.12 | yes | 2 | 0.24 | 99.04 | ILRTQESE | 99.28 | | | | | | | | |
| NA | H5N2 | 223 | 0.07 | yes | 2 | 0.24 | 99.28 | LRTQESEC | 99.28 | | | | | | | | |
| NA | H5N2 | 224 | 0.14 | yes | 3 | 0 | 99.28 | RTQESECI | 98.8 | RTQESECI | 0.48 | | | | | | |
| NA | H5N2 | 225 | 0.12 | yes | 4 | 0 | 99.04 | TQESECIC | 98.8 | TQESECIC | 0.48 | | | | | | |
| NA | H5N2 | 226 | 0.99 | yes | 4 | 0 | 99.28 | QESECVCV | 98.55 | QESECVCV | 0.48 | ESECVCVN | 0.48 | | |
| NA | H5N2 | 227 | 1.07 | yes | 3 | 0 | 99.28 | ESECVCIN | 73.25 | ESECVCID | 24.58 | | | | | | |
| NA | H5N2 | 237 | 1.08 | yes | 3 | 0 | 99.28 | CTWMTDG | 63.22 | CTWMTDG | 35.34 | TWMTDGS | 0.48 | | |
| NA | H5N2 | 238 | 0.16 | yes | 5 | 0 | 99.04 | TWMTDGS | 63.46 | AWMTDGN | 34.86 | TWMTDGS | 0.48 | | |
| NA | H5N2 | 239 | 0.16 | yes | 4 | 0 | 99.28 | WMTDGSA | 98.32 | WMTDGNA | 0.48 | | | | | | |
| NA | H5N2 | 240 | 0.19 | yes | 4 | 0 | 99.04 | MTDGSAS | 98.08 | MTDGNAS | 0.48 | | | | | | |
| NA | H5N2 | 241 | 1.17 | yes | 3 | 0 | 99.04 | MTDGSAG | 50.48 | TDGNASG | 47.6 | | | | | | |
| NA | H5N2 | 242 | 1.17 | yes | 3 | 0 | 99.28 | TDGSASR | 50.48 | DGNASGR | 47.6 | TDGSASRR | 0.24 | TDGSASER | 0.24 | |
| NA | H5N2 | 243 | 0.51 | yes | 5 | 0 | 99.04 | DGSASGR | 92.31 | DGNASGRA | 0.48 | DGSATGKA | 0.24 | DGSASGEA | 0.24 | |
| NA | H5N2 | 266 | 0.48 | yes | 4 | 0 | 99.28 | SPLTGSAQ | 92.55 | SSLSGSAQ | 5.77 | SPLSGNAQ | 0.48 | SPLLGSAQ | 0.24 | |
| NA | H5N2 | 267 | 0.66 | yes | 4 | 0 | 99.04 | PLTGSAQH | 89.42 | SLSGSAQH | 5.77 | PLSGGAQH | 0.48 | PLSGSAQH | 0.24 | |
| NA | H5N2 | 268 | 0.68 | yes | 4 | 0 | 99.04 | LTGSAQHI | 89.18 | LSGSAQHI | 5.77 | PLGSAQAT | 0.24 | | |
| NA | H5N2 | 269 | 0.36 | yes | 3 | 0 | 99.28 | TGSAQHIE | 94.95 | SGSAQHVE | 3.85 | SGSAQHIQ | 0.24 | SGNAQHIE | 0.24 |
| NA | H5N2 | 270 | 0.36 | yes | 2 | 0 | 99.04 | GSAQHIEE | 94.95 | GGAQHVEE | 3.85 | | | | | | |
| NA | H5N2 | 271 | 0.31 | yes | 2 | 0 | 99.28 | SAQHIEEC | 95.43 | GAQHIEEC | 3.85 | | | | | | |
| NA | H5N2 | 272 | 0.33 | yes | 2 | 0 | 99.04 | AQHIEECS | 95.19 | AQHVEECS | 3.61 | | | | | | |
| NA | H5N2 | 273 | 0.33 | yes | 2 | 0 | 99.04 | QHIEECSC | 95.19 | QHVEECSC | 3.61 | | | | | | |
| NA | H5N2 | 274 | 0.33 | yes | 2 | 0 | 99.04 | HIEECSCY | 95.19 | HVEECSCY | 3.61 | | | | | | |
| NA | H5N2 | 275 | 0.33 | yes | 2 | 0 | 99.04 | IEECSCYP | 95.19 | VEECSCYP | 3.85 | | | | | | |

FIG. 72-251

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H5N2 | 276 | 0.28 | yes | 4 | 0 | 99.04 | EECSCYPR | 96.88 | EECSCYPH | 0.96 | EECSCYPK | 0.72 | | |
| NA | H5N2 | 284 | 1 | no | 2 | 99.52 | 100 | SYPNVRCV | 50 | | 50 | | | | |
| NA | H5N2 | 288 | 0.6 | yes | 4 | 0 | 99.28 | VRCICRDN | 90.14 | VRCICRDN | 7.21 | VTCVCRDN | 1.44 | | |
| NA | H5N2 | 289 | 0.2 | yes | 2 | 0 | 99.52 | RCVCRDNW | 97.6 | | | | | | |
| NA | H5N2 | 290 | 0.24 | yes | 3 | 0 | 99.04 | RCVCRDNWK | 97.12 | CVCRDNWM | 1.44 | | | | |
| NA | H5N2 | 291 | 0.25 | yes | 2 | 0 | 99.52 | CVCRDNWKG | 96.88 | VCRDNWMG | 1.44 | | | | |
| NA | H5N2 | 292 | 0.17 | yes | 2 | 0 | 99.04 | CRDNWKGS | 98.08 | | | | | | |
| NA | H5N2 | 293 | 0.17 | yes | 2 | 0 | 99.04 | RDNWKGSN | 98.08 | | | | | | |
| NA | H5N2 | 294 | 0.17 | yes | 2 | 0 | 99.04 | DNWKGSNR | 98.08 | | | | | | |
| NA | H5N2 | 295 | 0.17 | yes | 2 | 0 | 99.04 | NWKGSNRP | 98.08 | | | | | | |
| NA | H5N2 | 296 | 0.69 | yes | 4 | 0 | 99.28 | WKGSNRPV | 87.02 | WMGSNRPV | 10.82 | WKSSNRPV | 0.96 | | |
| NA | H5N2 | 304 | 0 | no | 1 | 99.52 | 100 | KLDINMAD | 100 | | | | | | |
| NA | H5N2 | 316 | 0.54 | yes | 4 | 0 | 99.04 | SSYICSGL | 92.31 | SRYICSGL | 3.61 | SHYVCSGL | 0.72 | | |
| NA | H5N2 | 317 | 0.51 | yes | 4 | 0 | 99.28 | SYICSGLV | 92.55 | RYICSGLV | 3.61 | HYVCSGLV | 0.72 | | |
| NA | H5N2 | 318 | 0.37 | yes | 2 | 0 | 99.52 | YICSGLVG | 93.51 | YICSGLVG | 6.01 | | | | |
| NA | H5N2 | 319 | 0.37 | yes | 2 | 0 | 99.52 | VCSGLVGD | 93.51 | ICSGLVGD | 6.01 | | | | |
| NA | H5N2 | 320 | 0 | yes | 1 | 0 | 100 | CSGLVGDT | 100 | | | | | | |
| NA | H5N2 | 321 | 0 | yes | 1 | 0 | 100 | SGLVGDTP | 100 | | | | | | |
| NA | H5N2 | 322 | 0.04 | yes | 1 | 0 | 100 | GLVGDTPR | 100 | | | | | | |
| NA | H5N2 | 323 | 0.2 | yes | 2 | 0 | 99.52 | LVGDTPRN | 99.52 | VGDTPRNN | 1.68 | | | | |
| NA | H5N2 | 324 | 0.2 | yes | 2 | 0 | 99.28 | VGDTPRND | 97.6 | GDTPRNND | 1.68 | | | | |
| NA | H5N2 | 325 | 0.6 | yes | 4 | 0 | 99.28 | GDTPRNDD | 97.6 | DTPRNDDG | 6.73 | DTPRNNDS | 1.44 | DTPRNDDI | 0.48 |
| NA | H5N2 | 326 | 1.08 | yes | 5 | 0 | 99.04 | DTPRNDDS | 90.38 | SMSNCRDP | 18.51 | SSSNCKDP | 2.16 | SSSNCRDS | 0.48 |
| NA | H5N2 | 335 | 1.08 | yes | 5 | 0 | 99.28 | SSSNCRDP | 76.2 | NSNCRDPN | 18.51 | SSNCKDPN | 2.16 | SSNCRDSN | 1.92 |
| NA | H5N2 | 336 | 0.84 | yes | 5 | 0 | 99.28 | SSNCRDPN | 76.2 | SNCRDSNN | 20.43 | SSNCKDPN | 2.16 | | |
| NA | H5N2 | 337 | 1.1 | yes | 5 | 0 | 99.28 | SNCRDPNN | 78.37 | NCRDSNNE | 20.43 | SNCKDPNN | 0.48 | CRDSNNER | 1.92 |
| NA | H5N2 | 338 | 1.12 | yes | 5 | 0 | 99.28 | NCRDPNNE | 78.37 | CRDSNNES | 20.19 | NCKDPNNE | 0.48 | RDSNNERG | 1.92 |
| NA | H5N2 | 339 | 0 | yes | 3 | 0 | 99.28 | CRDPNNER | 74.52 | RDPNNESG | 20.19 | CKDPNNEK | 1.92 | CRDPNNEK | 1.92 |
| NA | H5N2 | 340 | 1.63 | yes | 5 | 0 | 99.28 | RDPNNERG | 74.52 | GSQVKGW | 1.44 | RDPNNEKG | 1.92 | GNHGVKGW | 0.48 |
| NA | H5N2 | 347 | 1.62 | yes | 4 | 0 | 99.28 | GNPGVKGW | 96.15 | GSQVKGWA | 1.44 | GSPGVKGW | 0.72 | | |
| NA | H5N2 | 348 | 0.34 | yes | 2 | 0 | 99.04 | NPGVKGWA | 96.63 | SGVKGWAF | 1.44 | SPGVKGWA | 0.72 | | |
| NA | H5N2 | 349 | 0.29 | yes | 5 | 0 | 99.28 | PGVKGWAF | 97.6 | VKGWAFDY | 23.56 | VKGWAFDI | 12.02 | VKGWAFDS | 2.64 |
| NA | H5N2 | 350 | 0.19 | yes | 5 | 0 | 99.28 | GVKGWAFD | 100 | SDVWMGRT | 33.17 | DDIWMGRT | 15.62 | NDIWMGRT | 0.48 |
| NA | H5N2 | 351 | 0 | yes | 3 | 0 | 99.04 | VKGWAFDN | 57.93 | DVWMGRTV | 1.2 | DIWMGRT | 0.72 | | |
| NA | H5N2 | 360 | 1.63 | yes | 5 | 0 | 99.04 | DDVWMGRT | 49.04 | VWMGRTVS | 0.96 | DIWMGRTV | 0.72 | WMGRTINK | 0.24 |
| NA | H5N2 | 361 | 1.62 | yes | 5 | 0 | 99.04 | DVWMGRTI | 97.36 | WMGRTISR | 0.72 | IWMGRTIS | 0.24 | GRTIKEDS | 0.24 |
| NA | H5N2 | 362 | 0.23 | yes | 4 | 0 | 99.04 | VWMGRTIS | 97.12 | WMGRTISE | 0.72 | WMGRTIS | 0.24 | RTISQDSR | 0.24 |
| NA | H5N2 | 363 | 0.23 | yes | 5 | 0 | 99.04 | WMGRTISK | 97.36 | GRTVSKDS | 0.72 | GRTISRDS | 0.48 | | |
| NA | H5N2 | 365 | 0.29 | yes | 4 | 0 | 99.04 | GRTISKDS | 96.88 | RTYSKDSR | 0.72 | RTISRDS | 0.48 | | |
| NA | H5N2 | 366 | 0.29 | yes | 5 | 0 | 99.04 | RTISKDSR | 96.88 | SRDSRSGY | 0.72 | SKDSRLGY | 0.48 | | |
| NA | H5N2 | 369 | 0.23 | yes | 4 | 0 | 97.6 | SKDSRSGY | 97.6 | SRDSRSGY | 0.72 | | | | |
| NA | H5N2 | 370 | 0.2 | yes | 3 | 0 | 99.04 | KDSRSGYE | 97.84 | EDSRSGYE | 0.72 | | | | |

FIG. 72-252

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H5N2 | 371 | 0.09 | yes | 1 | 0 | 99.04 | DSRGYET | 99.04 | RSGYETFK | 9.38 | | | | |
| NA | H5N2 | 372 | 0.02 | yes | 1 | 0 | 99.76 | SRSGYETF | 99.76 | SGYETFKV | 9.38 | | | | |
| NA | H5N2 | 373 | 0.47 | yes | 2 | 0 | 99.76 | RSGYETFR | 99.76 | SGYETFRV | 9.38 | GYETFRVT | | | |
| NA | H5N2 | 374 | 0.53 | yes | 5 | 0 | 99.04 | SGYETFRV | 99.04 | GYETFRVI | 2.4 | NNRSGYSG | | | |
| NA | H5N2 | 375 | 1.1 | yes | 5 | 0 | 99.52 | GYETFRVI | 99.52 | SNWSGYSG | 4.81 | NRSGYSGI | | GYETFRVT | 7.93 | GYETFRVL | 2.4 |
| NA | H5N2 | 403 | 0.43 | yes | 3 | 0 | 99.04 | NNWSGYSG | 99.04 | NWSGYSGV | 4.81 | RSGYSGIF | | NNRSGYSG | 0.96 | KNWSGYSG | 0.48 |
| NA | H5N2 | 404 | 0.47 | yes | 3 | 0 | 99.04 | NWSGYSGI | 99.04 | WSGYSGVF | 4.81 | | | | 1.2 | | |
| NA | H5N2 | 405 | 0.42 | yes | 3 | 0 | 99.52 | WSGYSGIF | 99.52 | SGYSGVFS | 4.81 | | | | 1.2 | | |
| NA | H5N2 | 406 | 0.33 | yes | 2 | 0 | 99.52 | SGYSGIFS | 99.52 | YSGVFSV | | GYSGIFSI | 2.88 | | | | |
| NA | H5N2 | 407 | 0.51 | yes | 2 | 0 | 99.52 | YSGIFSV | 91.83 | YSGVFSVE | | YSGIFSIE | 2.88 | | | | |
| NA | H5N2 | 408 | 0.51 | yes | 3 | 0 | 99.52 | YSGIFSVE | 91.83 | GCINRCFY | 2.4 | SCVNRCFY | 2.4 | | | | |
| NA | H5N2 | 418 | 0.5 | yes | 2 | 0 | 99.76 | SCINRCFY | 93.27 | CVNRCFYV | | | | | | | |
| NA | H5N2 | 419 | 0.19 | yes | 2 | 0 | 99.76 | CINRCFYV | 97.36 | VNRCFYVE | | | | NCINRCFY | 0.72 | HCINRCFY | 0.72 |
| NA | H5N2 | 420 | 0.19 | yes | 2 | 0 | 99.52 | INRCFYVE | 97.36 | | | | | | | | |
| NA | H5N2 | 421 | 0.05 | yes | 1 | 0 | 99.52 | NRCFYVEL | 99.52 | | | | | | | | |
| NA | H5N2 | 422 | 0.1 | yes | 1 | 0 | 99.04 | RCFYVELI | 99.04 | | | | | | | | |
| NA | H5N2 | 423 | 0.1 | yes | 1 | 0 | 99.04 | CFYVELIR | 99.04 | | | | | | | | |
| NA | H5N2 | 424 | 0.1 | yes | 1 | 0 | 99.04 | FYVELIRG | 99.04 | | | | | | | | |
| NA | H5N2 | 425 | 0.12 | yes | 2 | 0 | 99.04 | YVELIRGR | 99.04 | VEMIRGRP | 0.24 | | | | | | |
| NA | H5N2 | 426 | 0.43 | yes | 3 | 0 | 98.8 | VELIRGRP | 98.8 | ELIRGRPK | 6.25 | | | | | | |
| NA | H5N2 | 427 | 0.43 | yes | 3 | 0 | 92.79 | ELIRGRPQ | 92.79 | LIRGRPKE | 6.25 | | | | | | |
| NA | H5N2 | 428 | 0.12 | yes | 2 | 0 | 98.8 | LIRGRPOE | 92.79 | RVWWTTNS | 0.48 | | | | | | |
| NA | H5N2 | 437 | 0.09 | yes | 1 | 0 | 99.04 | RVWWTSMS | 99.04 | WWTSNSII | 0.48 | | | WTTNSIVV | 0.48 | | |
| NA | H5N2 | 438 | 0.14 | yes | 2 | 0 | 98.56 | VWWTSNSI | 98.56 | WTSNSIVA | 3.12 | | | TTNSIVYF | 0.48 | | |
| NA | H5N2 | 439 | 0.34 | yes | 2 | 0 | 95.43 | WWTSNSIV | 95.43 | TSNSIVAF | 3.12 | | | TNSIVFC | 0.48 | | |
| NA | H5N2 | 440 | 0.32 | yes | 2 | 0 | 95.67 | WTSNSIVW | 95.67 | SNSIVAFC | 3.12 | | | | | | |
| NA | H5N2 | 441 | 0.3 | yes | 2 | 0 | 95.91 | TSNSIVWC | 95.91 | NSIVAFCG | 3.12 | | | | | | |
| NA | H5N2 | 442 | 0.3 | yes | 2 | 0 | 95.91 | SNSIVWFC | 95.91 | SIVAFCGT | 3.12 | | | | | | |
| NA | H5N2 | 443 | 0.3 | yes | 2 | 0 | 96.15 | NSIVWFCG | 96.39 | IVAFCGTS | 3.12 | | | | | | |
| NA | H5N2 | 444 | 0.27 | yes | 2 | 0 | 96.39 | SIVWFCGT | 99.52 | VAFCGTSG | 3.12 | | | | | | |
| NA | H5N2 | 445 | 0.25 | yes | 2 | 0 | 99.52 | IVWFCGTS | 99.76 | AFCGTSGT | 3.12 | | | | | | |
| NA | H5N2 | 446 | 0.05 | yes | 1 | 0 | 99.76 | VFCGTSTY | 99.52 | | | | | | | | |
| NA | H5N2 | 447 | 0.02 | yes | 1 | 0 | 99.52 | FCGTSGTY | 99.52 | | | | | | | | |
| NA | H5N2 | 448 | 0.05 | yes | 1 | 0 | 99.52 | CGTSGTYG | 99.52 | | | | | | | | |
| NA | H5N2 | 449 | 0.05 | yes | 1 | 0 | 99.52 | GTSGTYGT | 99.52 | | | | | | | | |
| NA | H5N2 | 450 | 0.02 | yes | 1 | 0 | 99.52 | TSGTYGTG | 99.52 | | | | | | | | |
| NA | H5N2 | 451 | 0.05 | yes | 1 | 0 | 99.52 | SGTYGTGS | 99.52 | | | | | | | | |
| NA | H5N2 | 452 | 0.05 | yes | 1 | 0 | 99.52 | GTYGTGSW | 99.52 | | | | | | | | |
| NA | H5N2 | 453 | 0.05 | yes | 1 | 0 | 99.52 | TYGTGSWP | 99.52 | | | | | | | | |
| NA | H5N2 | 454 | 0.05 | yes | 1 | 0 | 99.51 | YGTGSWPD | 99.51 | | | | | | | | |
| NA | H5N2 | 455 | 0.05 | yes | 1 | 1.92 | 99.51 | GTGSWPDG | 99.51 | | | | | | | | |
| NA | H5N2 | 456 | 0.05 | yes | 1 | 1.92 | 99.51 | | | | | | | | | | |

FIG. 72-253

| Protein | Sub-type | Start Pos | Block Entropy | Gaps <10% | # to cover 99% | Gap % | Coverage | Included peptides | Freq | Included peptides | Freq | Included peptides | Freq | Included peptides | Freq |
|---|---|---|---|---|---|---|---|---|---|---|---|---|---|---|---|
| NA | H5N2 | 457 | 0.1 | yes | 1 | 1.92 | 99.02 | TGWPDGA | 99.02 | | | | | | |
| NA | H5N2 | 458 | 0.11 | yes | 2 | 2.16 | 99.51 | GSWPDGAN | 98.77 | | | | | | |
| NA | H5N2 | 459 | 0.11 | yes | 2 | 2.16 | 99.51 | SWPDGANI | 98.77 | | | | | | |
| NA | H5N2 | 460 | 0.16 | yes

FIG. 72-254

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 92 | 0.24 | yes | 3 | 0 | 99.22 | WSYIWERP | 97.29 | WSYIWERP | 1.03 | WSYIVERL | 0.9 | AKNGICYP | 1.81 | AQYGICYP | 0.65 |
| HA | H6 | 101 | 1.35 | yes | 5 | 0 | 99.48 | AQ

FIG. 72-255

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 308 | 0.4 | yes | 3 | 0 | 99.1 | NKTFQNIS | 94.44 | NKTFQNVS | 3.49 |

FIG. 72-256

| Protein | Sub-type | Start Pos | Block Entropy | Gaps <10% | # to cover 99% | Gap % | coverage | included Peptides | Freq | included Peptides | Freq | included Peptides | Freq | included Peptides | Freq | included Peptides | Freq |
|---|---|---|---|---|---|---|---|---|---|---|---|---|---|---|---|---|---|
| HA | H6 | 371 | 0 | yes | 1 | 0 | 100 | HHENSQGS | 100 | |

FIG. 72-257

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 444 | 0.26 | yes | 3 | 0 | 99.1 | LLVLLEN

FIG. 72-258

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H6 | 530 | 0.07 | yes | 1 | 0.13 | 99.22 | YQILAIYS | 99.22 | | | | | | | | |
| HA | H6 | 531 | 0.07 | yes | 1

FIG. 72-259

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 51 | 1.65 | yes | 3 | 0 | 99.07 | TERGIEVV | 41.12 | TERGIEVV | 32.13 | ERGVEVWD | 25.83 | | |
| HA | H7 | 52 | 1.69 | yes | 4 | 0 | 99.28 | ERGIEVVN | 41.12 | ERGIEVVN | 31.4 | RGVEVWDA | 25.83 | | |
| HA | H7 | 53 | 1.66 | yes | 3 | 0.1 | 99.59 | RGIEVVNA | 41.26 | KGIEVVNA | 31.54 | | 25.85 | | |
| HA | H7 | 54 | 1.01 | yes | 3 | 0.1 | 99.59 | GIEVVNAT | 67.11 | GVEVWDAT | 31.54 | | 0.93 | | |
| HA | H7 | 55 | | yes | 2 | 0.1 | 99.69 | IEVVNATE | 67.11 | VEVWDATE | 31.64 | | 0.93 | | |
| HA | H7 | 56 | 0.13 | yes | 2 | 0.1 | 99.48 | EVVNATET | 98.55 | VVNATETV | 0.93 | | | | |
| HA | H7 | 57 | 0.12 | yes | 2 | 0.1 | 99.59 | VVNATETV | 98.66 | VDATETVE | 0.93 | | | | |
| HA | H7 | 58 | 0.12 | yes | 2 | 0.1 | 99.59 | VNATETVE | 98.66 | NATETVER | 30.92 | | 3.41

FIG.72-260

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|
| HA | H7 | 333 | 0.84 | yes | 4 | 0.21 | 99.07 | KCPRYVKQ | 84.37 | RCPRYVKQ | 11.7 | KCPRYVKQ | 1.55 | KCPK

FIG. 72-261

| Protein | Sub-type | Start Pos | Block Entropy | Gaps < 10% | # to 99% cover | % Gap | coverage | Peptides included | Freq | Peptides included | Freq | Peptides included | Freq | Peptides included | Freq |
|---|---|---|---|---|---|---|---|---|---|---|---|---|---|---|---|
| HA | H7 | 408 | 1.29 | yes | 3 | 0 | 99.59 | GLIDGWYG | 54.03 | GLINGWYG | 39.57 | | | | |
| HA | H7 | 409 | 1.42 |

FIG. 72-262

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 470 | 0.38 | yes | 2 | 0 | 99.17 | GNVINWTR | 94.01 | GNVINWTQ | 5.17 | | | | |
| HA | H7 | 471 | 0.38 | yes | 2 | 0 | 99.17 | NVINWTRD | 94.01 | NVINWTQD | 5.17 | | | | |
| HA | H7 | 472 | 1.27 | yes | 3 | 0 | 99.28 | VINWTRDS | 58.37 | VINWTQDA | 35.74 | V

FIG. 72-263

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 530 | 0.21 | yes | 2 | 0 | 99.38 | FEIFHKC

FIG. 72-264

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 6 | 0 | no | 1 | 99.54 | 100 | YKMNTQI

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H7N2 | 161 | 0.04 | yes | 1 | 0 | 99.54 | FYAEMKWL | 99.54 | | | | | | | | |
| HA | H7N

FIG. 72-267

| Protein | Sub-type | Start Pos | Block Entropy | Gaps <10% | # to cover 99% | % Gap | Coverage

FIG.72-268

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 347 | 0.02 | yes | 1 | 0.23 | 99.77 | GLFGAIAG | 99.77 | | | | | | |
| HA | H7N2 | 348 | 0.02 | yes | 1 | 0.23 | 99.77 | LFGAIAGF | 99.77 | | | | | | |
| HA | H7N2 | 349 | 0.02 | yes | 1 | 0.23 | 99.77 | FGAIAGFI | 99.77 | | | | | | |
| HA | H7N2 | 350 | 0.02 | yes | 1 | 0.23 | 99.77 | GAIAGFIE | 99.77 | | | | | | |
| HA | H7N2 | 351 | 0.02 | yes | 1 | 0.23 | 99.77 | AIAGFIEN | 99.77 | | | | | | |
| HA | H7N2 | 352 | 0.02 | yes | 1 | 0.23 | 99.77 | IAGFIENG | 99.77 | | | | | | |
| HA | H7N2 | 353 | 0.02 | yes | 1 | 0.23 | 99.77 | AGFIENGW | 99.77 | | | | | | |
| HA | H7N2 | 354 | 0 | yes | 1 | 0 | 100 | GFIENGWE | 100 | | | | | | |
| HA | H7N2 | 355 | 0 | yes | 1 | 0 | 100 | FIENGWEG | 100 | | | | | | |
| HA | H7N2 | 356 | 0.11 | yes | 1 | 0 | 100 | IENGWEGL | 100 | | | | | | |
| HA | H7N2 | 357 | 0.61 | yes | 2 | 0 | 98.61 | ENGWEGLI | 87.24 | ENGWEGLV | 1.39 | | | | | |
| HA | H7N2 | 358 | 0.61 | yes | 3 | 0 | 87.24 | NGWEGLIN | 87.24 | NGWEGLID | 11.37 | NGWEGLVD | 1.39 | | | |
| HA | H7N2 | 359 | 0.61 | yes | 3 | 0 | 87.24 | GWEGLING | 87.24 | GWEGLIDG | 11.37 | GWEGLVDG | 1.39 | | | |
| HA | H7N2 | 360 | 0.64 | yes | 3 | 0 | 87.24 | WEGLINGW | 87.24 | WEGLIDGW | 11.37 | WEGLVDGW | 1.39 | | | |
| HA | H7N2 | 361 | 0.64 | yes | 3 | 0 | 87.24 | EGLINGWY | 87.24 | EGLIDGWY | 11.37 | EGLVDGWY | 1.39 | | | |
| HA | H7N2 | 362 | 0.64 | yes | 3 | 0 | 87.01 | GLINGWYG | 87.01 | GLIDGWYG | 11.37 | GLVDGWYG | 1.39 | | | |
| HA | H7N2 | 363 | 0.57 | yes | 3 | 0 | 87.01 | LINGWYGF | 87.01 | LIDGWYGF | 11.37 | LVDGWYGF | 1.39 | | | |
| HA | H7N2 | 364 | 0.02 | yes | 2 | 0 | 87.01 | INGWYGFR | 87.01 | IDGWYGFR | 11.37 | VDGWYGFR | 1.39 | | | |
| HA | H7N2 | 365 | 0.11 | yes | 2 | 0 | 99.77 | NGWYGFRH | 99.77 | DGWYGFRH | 12.76 | | | | | |
| HA | H7N2 | 366 | 0.08 | yes | 2 | 0 | 98.84 | GWYGFRHQ | 98.84 | YGFRHQNT | 0.7 | | | | | |
| HA | H7N2 | 367 | 0.08 | yes | 2 | 0 | 98.84 | WYGFRHQN | 98.84 | GFRHQNTQ | 0.7 | | | | | |
| HA | H7N2 | 368 | 0.08 | yes | 2 | 0 | 99.07 | YGFRHQNA | 99.07 | | | | | | |
| HA | H7N2 | 369 | 0.11 | yes | 2 | 0 | 99.07 | GFRHQNAQ | 99.07 | | | | | | |
| HA | H7N2 | 370 | 0.11 | yes | 2 | 0 | 99.07 | FRHQNAQG | 99.07 | | | | | | |
| HA | H7N2 | 371 | 0.11 | yes | 2 | 0 | 99.07 | RHQNAQGE | 99.07 | QNTQGEGT | 0.7 | | | | | |
| HA | H7N2 | 372 | 0.02 | yes | 2 | 0 | 98.84 | HQNAQGEG | 98.84 | NTQGEGTA | 0.7 | | | | | |
| HA | H7N2 | 373 | 0.05 | yes | 2 | 0.23 | 98.84 | QNAQGEGT | 98.84 | TQGEGTAA | 0.7 | | | | | |
| HA | H7N2 | 374 | 0.05 | yes | 2 | 0.23 | 99.53 | NAQGEGTA | 99.53 | | | | | | |
| HA | H7N2 | 375 | 0.05 | yes | 2 | 0.23 | 99.53 | AQGEGTAA | 99.53 | | | | | | |
| HA | H7N2 | 376 | 0.05 | yes | 2 | 0.23 | 99.53 | QGEGTAAD | 99.53 | | | | | | |
| HA | H7N2 | 377 | 0.05 | yes | 2 | 0.23 | 99.53 | GEGTAADY | 99.53 | | | | | | |
| HA | H7N2 | 378 | 0.05 | yes | 2 | 0.23 | 99.53 | EGTAADYI | 99.53 | | | | | | |
| HA | H7N2 | 379 | 0.05 | yes | 2 | 0.23 | 99.53 | GTAADYIK | 99.53 | | | | | | |
| HA | H7N2 | 380 | 0.02 | yes | 1 | 0 | 99.77 | TAADYKST | 99.77 | | | | | | |
| HA | H7N2 | 381 | 0.02 | yes | 1 | 0 | 99.77 | AADYKSTQ | 99.77 | | | | | | |
| HA | H7N2 | 382 | 0.02 | yes | 1 | 0 | 99.77 | ADYKSTQS | 99.77 | | | | | | |
| HA | H7N2 | 383 | 0.02 | yes | 1 | 0 | 99.77 | DYKSTQSA | 99.77 | | | | | | |
| HA | H7N2 | 384 | 0.02 | yes | 1 | 0 | 99.77 | YKSTQSAI | 99.77 | | | | | | |
| HA | H7N2 | 385 | 0.02 | yes | 1 | 0 | 99.77 | KSTQSAID | 99.77 | | | | | | |
| HA | H7N2 | 386 | 0.02 | yes | 1 | 0 | 99.77 | STQSAIDQ | 99.77 | | | | | | |
| HA | H7N2 | 387 | 0.02 | yes | 1 | 0 | 99.77 | TQSAIDQI | 99.77 | | | | | | |
| HA | H7N2 | 388 | 0.02 | yes | 1 | 0 | 99.77 | QSAIDQIT | 99.77 | | | | | | |

FIG.72-269

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 389 | 0.02 | yes | 1 | 0 | 99.77 | SAIDQITG | 99.77 | | | | | | |
| HA | H7N2 | 390 | 0.02 | yes | 1 | 0 | 99.

FIG. 72-270

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 433 | 1.17 | yes | 4 | 0 | 99.54 | AMTEIWSY | 74.01 | AMTEVWSY | 17.17 | SMTEVWSY | 6

FIG. 72-271

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| HA | H7N2 | 475 | 0.02 | yes | 1 | 0 | 99.77 | NAEEDGTG | 99.77 | | | | | | | | |
| HA | H7N2 | 476 |

FIG. 72-272

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H7N2 | 518 | 0.44 | yes | 3 | 0 | 99.07 | QIDPVKLS | 93.74 | QIDQVKLS | 3.48 | | | | |
| HA | H7N2 | 519

FIG. 72-273

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H7N2 | 564 | 0 | no | 1 | 99.77 | 100 | SALFVYSL | 100 | | | | | | | | |
| HA | H7N2 | 565 | 0 | no | 1 | 99.77 | 100 | ALFVYSLR | 100 | | | | | | | | |
| HA | H7N2 | 566 | 0 | no | 1 | 99.77 | 100 | LFVYSLRK | 100 | | | | | | | | |
| NA | H7N2 | 1 | 0.03 | no | 1 | 31.2 | 99.64 | MNPNQKII | 99.64 | | | | | | | | |
| NA | H7N2 | 2 | 0.07 | no | 1 | 30.22 | 99.3 | NPNQKIIT | 99.3 | | | | | | | | |
| NA | H7N2 | 3 | 0.03 | no | 1 | 28.26 | 99.32 | PNQKIITI | 99.32 | | | | | | | | |
| NA | H7N2 | 4 | 0.03 | no | 1 | 13.27 | 99.72 | NQKIITIG | 99.72 | | | | | | | | |
| NA | H7N2 | 5 | 0.03 | no | 1 | 11.06 | 99.72 | QKIITIGS | 99.72 | | | | | | | | |
| NA | H7N2 | 6 | 0.1 | no | 2 | 9.83 | 99.73 | KIITIGSV | 98.91 | KIITIGSI | 0.82 | | | | | | |
| NA | H7N2 | 7 | 0.06 | yes | 1 | 0.25 | 99.26 | IITIGSVS | 99.26 | | | | | | | | |
| NA | H7N2 | 8 | 0.06 | yes | 1 | 0.25 | 99.26 | ITIGSVSL | 99.26 | | | | | | | | |
| NA | H7N2 | 9 | 0.06 | yes | 1 | 0.25 | 99.26 | TIGSVSLT | 99.26 | TIGSVSLI | 0.74 | | | | | | |
| NA | H7N2 | 10 | 0.13 | yes | 2 | 0.25 | 99.26 | IGSVSLTI | 98.52 | IGSVSLII | 0.74 | | | | | | |
| NA | H7N2 | 11 | 0.13 | yes | 2 | 0 | 99.26 | GSVSLTIA | 98.52 | GVSLIIA | 1.23 | GVSLIIA | 1.23 | | | | |
| NA | H7N2 | 12 | 0.22 | yes | 3 | 0 | 99.26 | SVSLTIAT | 97.3 | SVSLTIAI | 1.23 | SVSLTIAI | 1.23 | SISLTIAA | 0.49 | | |
| NA | H7N2 | 19 | 0.33 | yes | 3 | 0 | 99.26 | VSLTIATV | 96.07 | AVCFLMQI | 1.23 | SVSLTIAI | 0.98 | IVCFLMQI | 0.74 | | |
| NA | H7N2 | 20 | 0.37 | yes | 4 | 0 | 99.02 | TVCFLMQI | 95.58 | VCFLMQIA | 0.98 | TICFLMQI | 0.74 | CFLMQITI | 0.49 | | |
| NA | H7N2 | 21 | 0.27 | yes | 4 | 0 | 99.26 | VCFLMQIA | 96.81 | CFLMQIAT | 1.72 | ACFLMQIA | 0.74 | FLMQITIL | 0.49 | | |
| NA | H7N2 | 22 | 0.39 | yes | 5 | 0 | 99.02 | CFLMQIAI | 95.33 | FLMQIAVL | 1.72 | CFFMQIA | 0.74 | EKNITKIV | 2.7 | | |
| NA | H7N2 | 59 | 0.39 | yes | 5 | 0 | 99.26 | FLMQIAIL | 95.33 | EKNITEIV | 5.41 | FFMQIAIL | 0.98 | | | | |
| NA | H7N2 | 60 | 0.95 | yes | 5 | 0 | 99.26 | ERNITEIV | 83.78 | RNVTETLY | 5.41 | ERNVTETL | 2.7 | | | | |
| NA | H7N2 | 61 | 0.66 | yes | 4 | 90.91 | 100 | RNITEIVY | 89.19 | NITKIVYL | 2.7 | KNITKIVY | 2.7 | | | | |
| NA | H7N2 | 62 | 0.36 | no | 3 | 90.91 | 100 | NITEIVYL | 94.59 | ITKIVYLN | 2.7 | | | | | | |
| NA | H7N2 | 63 | 0.36 | no | 3 | 90.91 | 100 | ITEIVYLN | 89.19 | VTETLVLN | 2.7 | TEIVYLNH | 2.7 | TEIVYLNH | 2.7 | | |
| NA | H7N2 | 84 | 0.71 | yes | 5 | 90.91 | 100 | TEIVYLNN | 89.19 | TKIVYLNS | 2.7 | EIVYLNHT | 1.23 | ETLYLNHT | 2.7 | | |
| NA | H7N2 | 85 | 0.71 | yes | 5 | 0 | 99.26 | EIVYLNNT | 88.21 | EIVYLNST | 2.7 | YRIWSKPQ | 1.23 | | | | |
| NA | H7N2 | 86 | 0.65 | yes | 5 | 0 | 99.26 | YRSWSKPQ | 88.21 | YRDWSKPQ | 9.34 | RIWSKPQC | 0.49 | | | | |
| NA | H7N2 | 87 | 0.65 | yes | 4 | 0 | 99.26 | RSWSKPQC | 88.7 | RDWSKPQC | 9.34 | IWSKPQCQ | 0.49 | | | | |
| NA | H7N2 | 88 | 0.64 | yes | 4 | 0 | 99.01 | SWSKPQCQ | 88.21 | DWSKPQCQ | 9.09 | | | | | | |
| NA | H7N2 | 91 | 0.07 | no | 1 | 0 | 99.01 | WSKPQCQI | 99.26 | | | | | | | | |
| NA | H7N2 | 92 | 0.52 | yes | 5 | 0 | 99.01 | SKPQCQIT | 92.84 | SKPQCQIS | 3.46 | SKPQCQIT | 2.22 | SKPQCQIA | 0.25 | SKPQCRIT | 0.25 |
| NA | H7N2 | 96 | 0.52 | yes | 5 | 0 | 99.01 | KPQCQITG | 92.84 | KPQCQISG | 3.46 | KPQCQIIG | 2.22 | KPQCQIKG | 0.25 | KQQCQITG | 0.25 |
| NA | H7N2 | 97 | 0.52 | yes | 5 | 0 | 99.01 | QCQITGFA | 92.84 | QCQISGFA | 3.46 | QCQIIGFA | 2.22 | QCQIIGLA | 0.25 | QCQIKGFA | 0.25 |
| NA | H7N2 | 98 | 0.52 | yes | 5 | 0 | 99.02 | CQITGFAP | 92.84 | CQISGFAP | 3.46 | CQIIGFAP | 2.22 | CQIIGLAP | 0.25 | CQIAGFAP | 0.25 |
| NA | H7N2 | 99 | 0.99 | no | 3 | 0 | 67.08 | GFAPFAKD | 67.08 | GFAPFAKD | 31.94 | | | | | | |
| NA | H7N2 | 100 | 0.97 | no | 3 | 0 | 67.08 | FAPFAKDN | 67.08 | FAPFAKDN | 31.94 | | | | | | |
| NA | H7N2 | 101 | 1.07 | no | 3 | 0 | 67.32 | APFAKDNS | 67.32 | APFAKDNS | 31.94 | | | | | | |
| NA | H7N2 | 102 | 1.07 | yes | 3 | 0.49 | 65.85 | PFAKDNSI | 65.85 | PFAKDNSI | 31.94 | PFSKDNSV | 1.47 | | | | |
| NA | H7N2 | 103 | 1.03 | yes | 3 | 0.49 | 65.85 | FAKDNSIR | 65.85 | FSKDNSIR | 31.94 | FSKDNSYR | 1.47 | | | | |
| NA | H7N2 | 101 | 0.14 | yes | 2 | 0.49 | 66.34 | AKDNSIRL | 66.34 | SKDNSVRL | 1.47 | SKDNSVRL | 1.47 | | | | |
| NA | H7N2 | 102 | 0.11 | yes | 2 | 0.49 | 98.28 | KDNSIRLS | 98.28 | | | | | | | | |
| NA | H7N2 | 103 | 0.11 | yes | 2 | 0 | 99.75 | DNSIRLSA | 98.53 | | | | | | | | |
| NA | H7N2 | 104 | 0.13 | yes | 2 | 0 | 99.26 | NSIRLSAG | 98.53 | | | | | | | | |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 157 | 0.04 | yes | 1 | 0 | 99.51 | TLLMNELG | 99.51 | | | | | | |
| NA | H7N2 | 158 | 0.04 | yes | 1 | 0 | 99.51 | LLMNELGV | 99.51 | | | | | | |

FIG. 72-276

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 199 | 0.24 | yes | 3 | 0 | 99.26 | RNATASFI | 97.05 | RNATASLI | 1.23 | | | | |
| NA | H7N2 | 200 | 0.08 | yes | 1 | 0 | 99.02 | NATASFIY | 99.02 | | | | | | |
| NA | H7N2 | 201 | 0.54 | yes | 3 | 0 | 99.02 | ATASFIYN | 90.42 | ATASLIYD | 8.11 | | | | |
| NA | H7N2 | 202 | 0.58 | yes | 4 | 0 | 99.26 | TASFIYNG | 89.93 | TASFIYGG | 8.11 | TASFIYNE | 0.49 | | |
| NA | H7N2 | 211 | 0.21 | yes | 3 | 0 | 99.26 | LVDSIGSW | 97.54 | LIDSIGSW | 0.98 | | | | |
| NA | H7N2 | 212 | 0.15 | yes | 2 | 0 | 99.26 | VDSIGSWS | 97.54 | IDSIGSWS | 0.98 | | | | |
| NA | H7N2 | 213 | 0.15 | yes | 2 | 0 | 99.02 | DSIWSQN | 98.28 | | | | | | |
| NA | H7N2 | 214 | 0.17 | yes | 2 | 0 | 99.02 | SIGWSQN | 98.28 | SIWSQNI | 0.98 | | | | |
| NA | H7N2 | 215 | 0.1 | yes | 1 | 0 | 99.02 | IGSWSQNI | 98.03 | | | | | | |
| NA | H7N2 | 216 | 0.02 | yes | 1 | 0 | 99.75 | GSWSQNIL | 98.77 | VSWSQNI | 0.98 | | | | |
| NA | H7N2 | 217 | 0.02 | yes | 1 | 0 | 99.75 | SWSQNILR | 99.75 | | | | | | |
| NA | H7N2 | 218 | 0.02 | yes | 1 | 0 | 99.75 | WSQNILRT | 99.75 | | | | | | |
| NA | H7N2 | 219 | 0.02 | yes | 1 | 0 | 99.75 | SQNILRTQ | 99.75 | | | | | | |
| NA | H7N2 | 220 | 0.02 | yes | 1 | 0 | 99.75 | QNILRTQE | 99.75 | | | | | | |
| NA | H7N2 | 221 | 0 | yes | 1 | 0 | 99.75 | NILRTQES | 99.75 | | | | | | |
| NA | H7N2 | 222 | 0 | yes | 1 | 0 | 99.75 | ILRTQESE | 99.75 | | | | | | |
| NA | H7N2 | 223 | 0 | yes | 1 | 0 | 100 | LRTQESEC | 100 | | | | | | |
| NA | H7N2 | 224 | 0.02 | yes | 1 | 0 | 99.75 | RTQESECV | 99.75 | | | | | | |
| NA | H7N2 | 225 | 0.02 | yes | 1 | 0 | 99.75 | TQESECVC | 99.75 | | | | | | |
| NA | H7N2 | 226 | 0.02 | yes | 1 | 0 | 99.51 | QESECVCI | 99.51 | | | | | | |
| NA | H7N2 | 227 | 0.05 | yes | 1 | 0 | 99.26 | ESECVCIN | 99.26 | | | | | | |
| NA | H7N2 | 228 | 0.07 | yes | 1 | 0 | 99.26 | SECVCING | 99.26 | | | | | | |
| NA | H7N2 | 229 | 0.07 | yes | 2 | 0 | 99.26 | ECVCINGS | 99.26 | | | | | | |
| NA | H7N2 | 230 | 0.5 | yes | 2 | 0 | 90.66 | CVCINGSC | 90.66 | | | | | | |
| NA | H7N2 | 231 | 0.5 | yes | 2 | 0 | 90.66 | VCINGSCT | 90.66 | | | | ECVCINGT | 8.6 | VCINGSCI | 1.23 | VCINGTCA | 1.47 |
| NA | H7N2 | 232 | 0.72 | yes | 5 | 0 | 88.45 | CINGSCTV | 88.45 | | | | CVCINGTC | 8.6 | CINGSCIV | 1.23 | CINGTCAV | 1.47 |
| NA | H7N2 | 233 | 0.69 | yes | 5 | 0 | 88.7 | INGSCTVW | 88.7 | | | | VCINGTCT | 7.37 | INGSCIV | 1.23 | INGTCAVV | 1.47 |
| NA | H7N2 | 234 | 0.69 | yes | 5 | 0 | 88.7 | NGSCTVWM | 88.7 | | | | CINGTCTV | 7.37 | | | NGTCAVVM | 1.47 |
| NA | H7N2 | 235 | 0.68 | yes | 4 | 0 | 88.7 | GSCTVWMT | 88.7 | | | | INGTCTVW | 7.37 | | | GSCAVVMT | 1.47 |
| NA | H7N2 | 236 | 0.67 | yes | 4 | 0 | 88.7 | SCTVWMTD | 88.7 | | | | NGTCTVWM | 7.62 | | | GTCAVVMT | 1.47 |
| NA | H7N2 | 237 | 0.67 | yes | 3 | 0 | 88.7 | CTVWMTDG | 88.7 | | | | GTCTVWMT | 7.62 | | | TCAVVMTD | 1.47 |
| NA | H7N2 | 238 | 0.25 | yes | 2 | 0 | 96.31 | TVWMTDGN | 96.31 | | | | CTVWMTD | 7.62 | | | | |
| NA | H7N2 | 239 | 0.42 | yes | 2 | 0 | 88.21 | VWMTDGNA | 88.21 | | | | AVVMTDGS | 2.95 | | | | |
| NA | H7N2 | 240 | 0.45 | yes | 4 | 0 | 91.89 | WMTDGAS | 91.65 | | | | TWMTDG | 7.86 | | | | |
| NA | H7N2 | 241 | 0.49 | yes | 4 | 0 | 91.15 | MTDGNASG | 91.15 | | | | VVMTDGS | 7.86 | | | | |
| NA | H7N2 | 242 | 0.68 | yes | 4 | 0 | 88.45 | TDGNASGK | 88.45 | | | | VMTDGNAS | 7.86 | | | TDGSASRK | 0.49 | TDGSASRK | 2.46 |
| NA | H7N2 | 243 | 0.68 | yes | 5 | 0 | 88.45 | DGNASGKA | 88.45 | | | | MTDGNASG | 7.86 | | | DGSASRKA | 0.49 | DGSASRKA | 2.46 |
| NA | H7N2 | 244 | - | yes | 4 | 0 | 82.31 | GNASGKAD | 82.31 | | | | TDGSASGR | 7.86 | | | GSASGRAD | 2.46 | GSASRKAD | 6.14 |
| NA | H7N2 | 245 | - | yes | 5 | 0 | 82.31 | NASGKADT | 82.31 | | | | DGSASGRA | 7.86 | | | SASGKAE | 2.46 | SASRKADT | 6.14 |
| NA | H7N2 | 246 | 0.63 | yes | 4 | 0 | 90.17 | ASGKADTR | 90.17 | | | | GSASGKAE | 6.14 | | | ASGKAET | 0.49 | | |
| NA | H7N2 | 247 | 0.63 | yes | 5 | 0 | 90.17 | SGKADTRI | 90.17 | | | | ASGKAETR | 6.14 | | | SRKADTRI | 2.21 | | |
| NA | H7N2 | 250 | 0.9 | yes | 5 | 0 | 83.78 | ADTRILFV | 83.78 | | | | AETRILFV | 6.14 | | | ADTRIIFV | 6.14 | ADTKYLFI | 0.25 |

FIG. 72-277

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 254 | 0.62 | yes | 5 | 0 | 99.02 | ILFIKEGK

FIG. 72-278

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 299 | 0.37 | yes | 3 | 0 | 99.02 | NRPVIDIN | 94.84 | NRPVIDYN | 2.95 | NRPIIDIN | 1

FIG.72-279

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H7N2 | 358 | 0.2 | yes | 2 | 0.25 | 99.26 | DDWMGRT | 97.54 | NDVWMGRT | 1.72 | | | | |

FIG. 72-280

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 416 | 0.34 | yes | 3 | 0.74 | 99.01 | SCINRCFY | 95.54 | SCINRCFY | 2

FIG. 72-281

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 461 |

FIG. 72-282

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 83 | 1.54 | yes | 5 | 0 | 99.62 | LGTLI

FIG. 72-283

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 214 | 0.68 | yes | 4 | 0 | 99.62 | QTRLYGSG | 87.02 | QTRLYG

FIG.72-284

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 304 | 1.21 | yes | 5 | 0 | 99.24 | CHSGGTI | 64.12 | CHSGGTI | 31.68 | CF

FIG. 72-285

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 |

FIG. 72-286

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 422 | 0.47 | yes | 2 | 0 | 100 | DQITGKLN | 90.08 | NQITGKLN | 9.92 | | | | |
| HA | H7N3 | 423 | 0 | yes | 1 | 0 | 100 | QITGKLN

FIG. 72-287

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 467 | 0.9 | yes | 3 | 0 | 99.24 | VWSYNAEL | 99.24 | IWSYNAEL | 80.53 | | | | |
| HA | H7N

FIG. 72-288

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H7N3 | 510 | 0.04 | yes | 1 | 0 | 99.62 | GTGCFEIF | 99.62 | | | | | | |
| HA | H7N3 | 511 | 0.04 | yes | 1 | 0 | 99.62 | TGCFEIFH | 99.62 | | | | | | |
| HA | H7N3 | 512 | 0.04 | yes | 1 | 0 | 99.62 | GCFEIFHK | 99.62 | | | | | | |
| HA | H7N3 | 513 | 0.04 | yes | 1 | 0 | 99.62 | CFEIFHKC | 99.62 | | | | | | |
| HA | H7N3 | 514 | 0.04 | yes | 1 | 0 | 99.62 | FEIFHKCD | 99.62 | | | | | | |
| HA | H7N3 | 515 | 0.15 | yes | 2 | 0 | 99.24 | EIFHKCDD | 98.09 | EIFHKCDN | 1.53 | | | | |
| HA | H7N3 | 523 | 1.44 | yes | 5 | 0 | 100 | DCMASIRN | 64.12 | NCMASIRN | 22.52 | QCMASIRN | 10.31 | GCMASIRN | 0.76 |
| HA | H7N3 | 524 | 1.06 | yes | 3 | 0 | 100 | CMASIRNN | 64.89 | CMASIRNS | 32.82 | | | | |
| HA | H7N3 | 525 | 1.06 | yes | 3 | 0 | 100 | MASIRNNT | 64.89 | MASIRNST | 32.82 | | | | |
| HA | H7N3 | 526 | 1.06 | yes | 3 | 0 | 100 | ASIRNNTY | 64.89 | ASIRNSTY | 32.82 | | | | |
| HA | H7N3 | 527 | 0.16 | yes | 2 | 0 | 100 | SIRNNTYD | 97.71 | SIRNSTYD | 2.29 | | | | |
| HA | H7N3 | 528 | 0.16 | yes | 2 | 0 | 100 | IRNNTYDH | 97.71 | IRNSTYDH | 2.29 | | | | |
| HA | H7N3 | 529 | 1.15 | yes | 4 | 0 | 99.62 | RNNTYDHS | 66.03 | RNSTYDHS | 30.15 | RNNTYDHN | 1.15 | | |
| HA | H7N3 | 532 | 1.41 | yes | 5 | 0 | 100 | TYDHSKYR | 66.03 | TYDHSRYR | 19.47 | TYDHSTYR | 1.53 | TYDHNKYR | 1.15 |
| HA | H7N3 | 537 | 1.72 | yes | 3 | 0 | 100 | KYREEAMQ | 56.49 | RYREEAMQ | 20.61 | | | TYREEAMQ | 1.53 |
| HA | H7N3 | 538 | 1.32 | yes | 3 | 0 | 100 | YREEAMQN | 56.49 | YRAESLQN | 33.59 | QYRAESLQ | 9.92 | | |
| HA | H7N3 | 539 | 1.32 | yes | 3 | 0 | 100 | REEAMQNR | 56.49 | RAESLQNR | 33.59 | | | | |
| HA | H7N3 | 540 | 1.52 | yes | 5 | 0 | 99.62 | EEAMQNRI | 62.21 | AESLQNRI | 30.15 | EEAMQNRV | 1.91 | EEAMQNRM | 1.91 |
| HA | H7N3 | 541 | 1.34 | yes | 4 | 0 | 99.62 | EAMQNRIQ | 61.83 | ESLQNRIQ | 30.15 | EAMQNRVK | 1.91 | EAMQNRMQ | 1.91 |
| HA | H7N3 | 542 | 1.37 | yes | 5 | 0 | 99.62 | AMQNRIQI | 69.47 | SLQNRIQI | 22.52 | AMQNRVKI | 1.91 | AMQNRMQI | 1.91 |
| HA | H7N3 | 543 | 1.27 | yes | 4 | 0 | 99.62 | QNRIQIQI | 69.47 | QNRIRIDP | 4.2 | QNRVKIDP | 1.91 | QNRMQINP | 1.91 |
| HA | H7N3 | 544 | 1.27 | yes | 4 | 0 | 99.62 | NRIQIQIP | 69.47 | NRIRIDPV | 4.2 | NRVKIDPV | 1.91 | NRMQINPV | 1.91 |
| HA | H7N3 | 545 | 1.27 | yes | 4 | 0 | 99.62 | RIQIDPVK | 70.61 | RIRIDPVK | 4.2 | RVKIDPVK | 1.91 | RMQINPVK | 1.91 |
| HA | H7N3 | 546 | 1.3 | yes | 5 | 0 | 99.24 | IQIDPVKL | 94.27 | IRIDPVKL | 4.2 | VKIDPVKL | 1.91 | MQINPVKL | 1.91 |
| HA | H7N3 | 547 | 1.17 | yes | 4 | 0 | 99.62 | DPVKLSSG | 88.93 | DPVKLSGG | 23.66 | | | NPVKLSGG | 0.38 |
| HA | H7N3 | 550 | 0.4 | yes | 3 | 0 | 99.62 | PVKLSSGY | 94.27 | PVKLSNGY | 3.82 | | | | |
| HA | H7N3 | 551 | 0.4 | yes | 3 | 0 | 99.62 | VKLSSGYK | 61.83 | VKLSNGYK | 3.82 | VKLNSGYK | 0.76 | KLNSGYKD | 0.76 |
| HA | H7N3 | 552 | 0.69 | yes | 4 | 0 | 62.6 | KLSSGGYK | 62.6 | KLSGGYK | 3.82 | KLSNGYKD | 0.76 | NSGYKDII | 0.76 |
| HA | H7N3 | 553 | 1.46 | yes | 5 | 0 | 66.41 | SSGYKDVI | 66.41 | SSGYKEVI | 27.1 | SGGYKDII | 0.76 | | |
| HA | H7N3 | 555 | 1.4 | yes | 4 | 0 | 66.03 | SGYKDVIL | 66.41 | SGYKEVIL | 27.1 | GGYKDII | 5.73 | | |
| HA | H7N3 | 556 | 1.14 | yes | 3 | 0 | 66.03 | GYKDVILW | 66.03 | GYKEVILW | 27.86 | | | | |
| HA | H7N3 | 557 | 1.18 | yes | 3 | 0 | 66.03 | YKDVILWF | 66.03 | YKEVILWF | 27.86 | | | | |
| HA | H7N3 | 558 | 1.18 | yes | 3 | 0 | 66.03 | KDVILWFS | 66.03 | KEVILWFS | 27.86 | | | | |
| HA | H7N3 | 559 | 1.18 | yes | 3 | 0 | 66.03 | DVILWFSF | 66.03 | EVILWFSF | 27.86 | | | | |
| HA | H7N3 | 560 | 0.95 | yes | 2 | 0 | 66.03 | VILWFSFG | 33.59 | | | | | | |
| HA | H7N3 | 561 | 1.4 | yes | 1 | 0 | 99.62 | ILWFSFGA | | | | | | | |
| HA | H7N3 | 562 | 0.04 | yes | 1 | 0 | 99.62 | LWFSFGAS | | | | | | | |
| HA | H7N3 | 563 | 0.04 | yes | 1 | 0 | 99.62 | WFSFGASC | | | | | | | |
| HA | H7N3 | 564 | 0.04 | yes | 1 | 0 | 99.62 | FSFGASCF | | | | | | | |
| HA | H7N3 | 565 | 0.04 | yes | 2 | 0.38 | 99.62 | SFGASCFI | 33.33 | FGASCFLF | 1.53 | | | | |
| HA | H7N3 | 566 | 0.99 | yes | 3 | 0.38 | 99.23 | FGASCFIL | 32.95 | GASCFLFL | 21.84 | GASCFLFL | 1.53 | | |
| HA | H7N3 | 567 | 1.09 | yes | 3 | 0.38 | 99.23 | GASCFILL | 32.95 | GASCFLLI | | | | | |
| HA | H7N3 | 568 | 1.68 | yes | 4 | 0.38 | 99.23 | GASCFLLI | 42.91 | | | | | | |

FIG. 72-289

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 569 | 1.68 | yes | 4 | 0.38 | 99.23 | ASCFLLL

FIG. 72-290

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 87 | 1.8 | yes | 5 | 0

FIG. 72-291

| Protein | Sub-type | Start Pos | Block Entropy | Gaps < 10% | # to cover 99% | Gap % | coverage | Peptides included | freq | Peptides included | freq | Peptides included | freq | Peptides included | freq |
|---|---|---|---|---|---|---|---|---|---|---|---|---|---|---|---|
| NA | H7N3 | 150 | 0.27 | yes | 5 | 0 | 99.49 | KDRTP

FIG. 72-292

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 256 | 1.15 | yes | 5 | 2.03 | 99.48 | GRMTDSIK | 55.96 | GRMSDSIK | 41.97 | GRMDSIK | 0.52 | GRMAD

FIG. 72-293

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 321 | 0.75 | yes | 3 | 0.51 | 99.49 | QHLEECSC | 82.65 | RHLEECSC | 15.82 | | | | |
| NA | H7N3 | 322 |

FIG. 72-294

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|

FIG. 72-295

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 428 | 1.09 | yes | 4 | 0 | 99.49 | WINSPNHV | 75.13 | WINSPNHV | 18.27 | | | WIDSPNHA | 4.57 | | |
| NA | H7N3 | 429 | 1.09 | yes | 4 | 0 | 99.49 | INSPNHVK | 75.13 | INSPNHVK | 18.27 | | | IDSPNHAK | 4.57 | | |
| NA | H7N3 | 430 | 1.09 | yes | 5 | 0 | 99.49 | NSPNHVKS | 75.13 | NSPNHAKS | 18.27 | | | DSPNHAKS | 4.57 | | |
| NA | H7N3 | 435 | 1.61 | yes | 3 | 0 | 99.49 | AKSVTQTL | 42.13 | VKSITQTL | 38.58 | | | AKAATQTL | 17.77 | AKSLTQTL | 0.51 |
| NA | H7N3 | 436 | 1.07 | yes | 3 | 0 | 99.49 | KSVTQTLV | 56.35 | KSITQTLV | 42.64 | | | KAATQTLV | 0.51 | | |
| NA | H7N3 | 437 | 1.07 | yes | 3 | 0 | 99.49 | SITQTLVS | 56.35 | SVTQTLVS | 42.64 | | | SLTQTLVS | 0.51 | | |
| NA | H7N3 | 438 | 1.07 | yes | 3 | 0 | 99.49 | ITQTLVSN | 56.35 | VTQTLVSN | 42.64 | | | ATQTLVSN | 0.51 | | |
| NA | H7N3 | 439 | 0.09 | yes | 2 | 0 | 99.49 | TQTLVSND | 98.98 | TQTLVSNS | 0.51 | | | | | | |
| NA | H7N3 | 440 | 0.09 | yes | 2 | 0 | 99.49 | QTLVSNDW | 98.98 | QTLVSNSD | 0.51 | | | | | | |
| NA | H7N3 | 441 | 0.09 | yes | 2 | 0 | 99.49 | TLVSNDWS | 98.98 | TLVSNSDW | 0.51 | | | | | | |
| NA | H7N3 | 442 | 0.09 | yes | 2 | 0 | 99.49 | LVSNDWSG | 98.98 | LVSNNDWS | 0.51 | | | | | | |
| NA | H7N3 | 443 | 0.09 | yes | 2 | 0 | 99.49 | VSNDDWSG | 98.98 | VSNNDDWS | 0.51 | | | | | | |
| NA | H7N3 | 444 | 0.09 | yes | 2 | 0 | 99.49 | SNDDWSGY | 98.98 | SNNDDWSG | 0.51 | | | | | | |
| NA | H7N3 | 445 | 0.09 | yes | 2 | 0 | 99.49 | NDDWSGYS | 98.98 | NDDWSGYS | 0.51 | | | | | | |
| NA | H7N3 | 446 | 0.09 | yes | 2 | 0 | 99.49 | DDWSGYSG | 98.98 | SDWSGYSG | 0.51 | | | | | | |
| NA | H7N3 | 447 | 0 | yes | 1 | 0 | 100 | DWSGYSGS | 100 | | | | | | | | |
| NA | H7N3 | 448 | 0 | yes | 1 | 0 | 100 | WSGYSGSF | 100 | | | | | | | | |
| NA | H7N3 | 449 | 0.09 | yes | 2 | 0 | 99.49 | SGYSGSFI | 98.98 | SGTYGSFV | 0.51 | | | | | | |
| NA | H7N3 | 450 | 0.17 | yes | 3 | 0 | 99.49 | GYSGSFIV | 97.97 | GYSGSFTV | 1.02 | | | | | | |
| NA | H7N3 | 460 | 1.38 | yes | 2 | 0 | 99.49 | KDCFQPCF | 54.82 | NGCFQPCF | 38.07 | | | KGCFQPCF | 1.52 | KDCFQSCF | 0.51 |
| NA | H7N3 | 461 | 1.03 | yes | 2 | 0 | 99.49 | DCFQPCFY | 55.33 | GCFQPCFY | 44.16 | | | GGCFQPCF | 1.02 | | |
| NA | H7N3 | 462 | 0.98 | yes | 2 | 0 | 99.49 | CFQPCFYI | 64.47 | CFQPCFYE | 35.03 | | | | | | |
| NA | H7N3 | 463 | 0.98 | yes | 2 | 0 | 99.49 | FQPCFYIE | 64.47 | FQPCFYEL | 35.03 | | | | | | |
| NA | H7N3 | 464 | 0.98 | yes | 2 | 0 | 99.49 | QPCFYIEL | 64.47 | QPCFYELI | 35.03 | | | | | | |
| NA | H7N3 | 465 | 1.02 | yes | 2 | 0 | 99.49 | PCFYIELI | 63.96 | PCFYELIR | 35.03 | SCFYVELI | 0.51 | | | | |
| NA | H7N3 | 466 | 0.98 | yes | 2 | 0 | 99.49 | CFYIELIR | 64.47 | CFYELIRG | 35.03 | | | | | | |
| NA | H7N3 | 467 | 1.32 | yes | 3 | 0 | 99.49 | FYELIRGR | 63.45 | FYIELIRG | 19.29 | YIELIRGK | 15.74 | VELIRGRL | 1.02 | | |
| NA | H7N3 | 468 | 1.4 | yes | 4 | 0 | 99.49 | YELIRGRP | 82.23 | YIELIRGR | 19.29 | IELIRGKP | 15.74 | ELIRGRPI | 0.51 | | |
| NA | H7N3 | 469 | 0.8 | yes | 4 | 0 | 99.49 | ELIRGRPN | 78.17 | IELIRGRP | 15.74 | ELIRGRLN | 1.02 | NDDVSWAS | 1.02 | | |
| NA | H7N3 | 470 | 1.03 | yes | 5 | 0 | 99.49 | LIRGRPNN | 78.68 | ELIRGKPN | 15.74 | NDDVSWTS | 4.06 | DDVSWASN | 1.02 | DDDVSWTS | 0.51 |
| NA | H7N3 | 479 | 0.98 | yes | 4 | 0 | 99.49 | DVSWTSNS | 79.19 | NDVSWTSN | 15.74 | DDYSWTSN | 4.06 | DYSWASNS | 1.02 | | |
| NA | H7N3 | 480 | 0.94 | yes | 4 | 0 | 99.49 | VSWTSNSI | 98.48 | NVSWTSNS | 15.74 | DVSWTSN | 4.06 | | | | |
| NA | H7N3 | 481 | 0.13 | yes | 2 | 0 | 99.49 | SWTSNSIV | 98.48 | VSWASNSI | 1.02 | | | | | | |
| NA | H7N3 | 482 | 0.13 | yes | 2 | 0 | 99.49 | WTSNSIVT | 98.48 | SWASNSIV | 1.02 | | | | | | |
| NA | H7N3 | 483 | 0.13 | yes | 2 | 0 | 99.49 | TSNSIVTF | 98.48 | WASNSIVT | 1.02 | | | | | | |
| NA | H7N3 | 484 | 0.13 | yes | 2 | 0 | 99.49 | SNSIVTFC | 98.48 | ASNSIVTF | 1.02 | | | | | | |
| NA | H7N3 | 485 | 0.05 | yes | 2 | 0 | 99.49 | NSIVTFCG | 99.49 | | | | | | | | |
| NA | H7N3 | 486 | 0.05 | yes | 1 | 0 | 99.49 | SIVTFCGL | 99.49 | | | | | | | | |
| NA | H7N3 | 487 | 0.05 | yes | 1 | 0 | 99.49 | IVTFCGLD | 99.49 | | | | | | | | |
| NA | H7N3 | 488 | 0.31 | yes | 2 | 0 | 99.49 | VTFCGLDN | 94.92 | IVTFCGLN | 4.57 | | | | | | |
| NA | H7N3 | 489 | 0.27 | yes | 2 | 0 | 100 | TFCGLDNN | 95.43 | VTFCGLNN | 4.57 | | | | | | |

FIG. 72-296

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 491 | 0.27 | yes | 2 | 0.51 | 100 | TFCGLDNE | 95.41 | TFCGLNNE | 4.59 | | | | |
| NA | H7N3 | 492 |

FIG. 72-297

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 49 | 1.31 | yes | 4 | 0 | 100 | TLT

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 314 | 0.73 | yes | 3 | 0 | 99.22 | LPFQNINS | 86.72 | LPFQNINP | 7.03 | LPFQNYNS | 7.03 | | |
| HA | H7N7 | 315 | 0.73 | yes | 3 | 0 | 99.22 | PFQNINSR | 86.72 | PFQNINPR | 7.03 | PFQNVNSR | 7.03 | | |
| HA | H7N7 | 316 | 1.14 | yes | 4 | 0 | 99.22 | FQNINSRA | 78.12 | FQNINSRT | 8.59 | FQNINPRT | 8.59 | FQNVNSRA | 7.03 |
| HA | H7N7 | 324 | 0.58 | yes | 5 | 0 | 100 | VGKCPRYV | 75.78 | IGKCPRYV | 16.41 | VGICPRYV | 3.91 | VGRCPRYV | 2.34 |
| HA | H7N7 | 325 | 0.58 | yes | 4 | 0 | 99.22 | GKCPRYVK | 91.41 | GKCPKYVK | 3.91 | GRCPRYVK | 2.34 | GECPRYVK | 1.56 |
| HA | H7N7 | 326 | 0.86 | yes | 4 | 0 | 99.22 | KCPRYVKQ | 91.41 | KCPKYVKQ | 3.91 | RCPRYVKQ | 2.34 | ECPRYVKQ | 1.56 |
| HA | H7N7 | 335 | 1.25 | yes | 2 | 0 | 75 | SLLATGM | 24.22 | SIMLATGM | 24.22 | | | | |
| HA | H7N7 | 336 | 1.25 | yes | 3 | 0 | 66.41 | LLATGMK | 24.22 | LMLATGMK | 24.22 | LLATGMR | 8.59 | | |
| HA | H7N7 | 337 | 0.49 | yes | 2 | 0 | 66.41 | LATGMKN | 24.22 | MLATGMKN | 24.22 | LATGMRN | 8.59 | | |
| HA | H7N7 | 338 | 0.45 | yes | 2 | 0 | 90.62 | ATGMRNV | 90.62 | LATGMRNV | 8.59 | | | | |
| HA | H7N7 | 339 | 0.45 | yes | 2 | 0 | 90.62 | ATGMKNVP | 90.62 | ATGMRNVP | 9.38 | | | | |
| HA | H7N7 | 340 | 1.22 | yes | 4 | 0 | 90.62 | TGMKNVPE | 90.62 | TGMRNVPE | 9.38 | | | | |
| HA | H7N7 | 350 | 0.53 | yes | 3 | 0 | 71.43 | THKQLTHH | 71.43 | AHKQLTHH | 19.05 | IHKQLTHH | 4.76 | | |
| HA | H7N7 | 351 | 0.82 | yes | 1 | 83.59 | 90.91 | HKQLTHHM | | | | | | | |
| HA | H7N7 | 352 | 0 | no | 1 | 82.81 | 83.33 | KQLTHHMR | | | | | | | |
| HA | H7N7 | 353 | 0 | no | 1 | 81.25 | 100 | QLTHHMRK | | | | | | | |
| HA | H7N7 | 354 | 0 | no | 1 | 84.38 | 100 | LTHHMRKK | | | | | | | |
| HA | H7N7 | 355 | 0 | no | 1 | 84.38 | 100 | THHMRKKR | | | | | | | |
| HA | H7N7 | 356 | 0 | no | 1 | 84.38 | 100 | HHMRKKRG | | | | | | | |
| HA | H7N7 | 357 | 0 | no | 1 | 84.38 | 100 | HMRKKRGL | | | | | | | |
| HA | H7N7 | 358 | 1.54 | no | 5 | 71.88 | 100 | MRKKRGLF | 61.11 | KKRERKRG | 25 | KKKKKKRG | 19.05 | KKRGL | 4.55 |
| HA | H7N7 | 359 | 1.61 | no | 4 | 85.16 | 100 | RKKRGLFG | 47.37 | KKRERKRGL | 36.84 | KKRKKRGL | 4.55 | KKKKKRGL | 4.55 |
| HA | H7N7 | 362 | 0.23 | yes | 2 | 0 | 100 | EKRGLFGA | 96.88 | RRRGLFGA | 2.34 | KKKKRGLF | 8.33 | KKRGLFGA | 8.33 |
| HA | H7N7 | 364 | 0.07 | yes | 1 | 0 | 99.22 | RGLFGAIA | 99.22 | KGLFGAIA | | | | | |
| HA | H7N7 | 365 | 0.07 | yes | 1 | 0 | 99.22 | GLFGAIAG | 99.22 | | | | | | |
| HA | H7N7 | 366 | 0.07 | yes | 1 | 0 | 99.22 | LFGAIAGF | 99.22 | | | | | | |
| HA | H7N7 | 367 | 0.07 | yes | 1 | 0 | 99.22 | FGAIAGFI | 99.22 | | | | | | |
| HA | H7N7 | 368 | 0.07 | yes | 1 | 0 | 99.22 | GAIAGFIE | 99.22 | | | | | | |
| HA | H7N7 | 369 | 0 | yes | 1 | 0 | 100 | AIAGFIEN | | | | | | | |
| HA | H7N7 | 370 | 0 | yes | 1 | 0 | 100 | IAGFIENG | | | | | | | |
| HA | H7N7 | 371 | 0 | yes | 1 | 0 | 100 | AGFIENGW | | | | | | | |
| HA | H7N7 | 372 | 0 | yes | 1 | 0 | 100 | GFIENGWE | | | | | | | |
| HA | H7N7 | 373 | 0 | yes | 1 | 0 | 100 | FIENGWEG | | | | | | | |
| HA | H7N7 | 374 | 0 | yes | 1 | 0 | 100 | IENGWEGL | | | | | | | |
| HA | H7N7 | 375 | 0.74 | yes | 2 | 0 | 78.91 | ENGWEGLI | 78.91 | ENGWEGLV | 21.09 | | | | |
| HA | H7N7 | 376 | 0.74 | yes | 2 | 0 | 78.91 | NGWEGLID | 78.91 | NGWEGLVD | 21.09 | | | | |
| HA | H7N7 | 377 | 0.74 | yes | 2 | 0 | 78.91 | GWEGLIDG | 78.91 | GWEGLVDG | 21.09 | | | | |
| HA | H7N7 | 378 | 0.74 | yes | 2 | 0 | 78.91 | WEGLIDGW | 78.91 | WEGLVDGW | 21.09 | | | | |
| HA | H7N7 | 379 | 0.74 | yes | 2 | 0 | 78.91 | EGLIDGWY | 78.91 | EGLVDGWY | 21.09 | | | | |
| HA | H7N7 | 380 | 0.74 | yes | 2 | 0 | 78.91 | GLIDGWYG | 78.91 | GLVDGWYG | 21.09 | | | | |
| HA | H7N7 | 381 | 1.31 | yes | 3 | 0 | 63.28 | LIDGWYGF | 63.28 | LVDGWYGF | 21.09 | LIDGWYGY | 15.62 | | |
| HA | H7N7 | 382 | 1.48 | yes | 4 | 0 | 62.5 | IDGWYGFR | 62.5 | VDGWYGFR | 21.09 | IDGWYGYR | 12.5 | IDGWYGYK | 3.12 |

FIG.72-300

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 383 | 0.8 | yes | 3 | 0 | 99.22

FIG. 72-301

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 425 | 0.23 | yes | 2 | 0 | 99.22 | QQFELI

FIG.72-302

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 476 | 0.13 | yes | 2 | 0 | 99.22 | DSEMNKLY | 98.44 | ESEMNKLY | 0.78 | | | | |
| H

FIG. 72-303

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 533 | 1.27 | yes | 5 | 0 | 99.22 | NRIQIDPV | 73

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 97 | 1.01 | yes | 4 | 0 | 100 | VVIAKDNA | 72.46 | VVIAKDNA | 24.64

| Protein | Sub-type | Start Pos | Block Entropy | Gaps <10% | # to cover 99% | Gap % | Coverage | Peptides included | Peptides included | Freq | Peptides included | Freq | Peptides included | Freq | Peptides included | Freq |
|---|---|---|---|---|---|---|---|---|---|---|---|---|---|---|---|---|
| NA | H7N7 | 206 | 1.61 | yes | 4 | 0 | 100 | YNRRLTT | YDRRLIT | 57.97 | YNKRLI

FIG. 72-308

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 271 | 0.91 | yes | 3 | 0 | 100 | SARHIEEC | 73.91 | SARHIEE

FIG. 72-309

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 341 | 0.41 | yes | 4 | 0 | 100 | TGSPGAPG | 94.2 | TGSPGVPG | 2.9 | TGSPCAPG | 1.45 | APGTKGFG | 1.45 |
| NA | H7N7 | 346 | 0.99 | yes | 3 | 0 | 100 | APGVKGFG | 79.71 | APGIKGFG | 14.49 | SPGVKGFG | 2.9 | | |
| NA | H7N7 | 347 | 0.7 | yes | 3 | 0 | 100 | PGVKGFGF | 84.06 | PGIKGFGF | 14.49 | | | | |
| NA | H7N7 | 348 | 0.7 | yes | 4 | 0 | 100 | GVKGFGFL | 84.06 | GIKGFGFL | 14.49 | | | | |
| NA | H7N7 | 349 | 1.45 | yes | 2 | 0 | 100 | VKGFGFLN | 63.77 | IKGFGFLN | 18.84 | VKGFGFLS | 1.45 | TKGFGFLN | 1.45 |
| NA | H7N7 | 350 | 1.38 | yes | 1 | 0 | 100 | KGFGFLNG | 63.77 | KGFGFLD | 18.84 | KGFGFLSG | 1.45 | DSTWLGRT | 5.8 |
| NA | H7N7 | 358 | 1.2 | yes | 1 | 0 | 100 | DNTWLGRT | 76.81 | SNTWLGRT | 8.7 | NNTWLGRT | 5.8 | | |
| NA | H7N7 | 359 | 0.11 | yes | 2 | 0 | 100 | NTWLGRTI | 98.55 | STWLGRTI | 1.45 | | | | |
| NA | H7N7 | 360 | 0 | yes | 1 | 0 | 100 | TWLGRTIS | 100 | | | | | | |
| NA | H7N7 | 361 | 0 | yes | 1 | 0 | 100 | WLGRTISP | 100 | | | | | | |
| NA | H7N7 | 362 | 0.38 | yes | 2 | 0 | 100 | LGRTISPK | 92.75 | GRTISPKL | 7.25 | TISPRSRN | 7.25 | | |
| NA | H7N7 | 363 | 0.79 | yes | 3 | 0 | 100 | GRTISPR | 84.06 | RTISPKLR | 8.7 | ISPRSRNG | 7.25 | | |
| NA | H7N7 | 364 | 0.79 | yes | 3 | 0 | 100 | RTISPRS | 84.06 | TISPKLRS | 8.7 | SPRSRNGF | 7.25 | | |
| NA | H7N7 | 365 | 0.9 | yes | 4 | 0 | 100 | TISPRSR | 82.61 | ISPKLRSG | 8.7 | PRSRNGFE | 7.25 | | |
| NA | H7N7 | 366 | 0.9 | yes | 4 | 0 | 100 | ISPRSRS | 82.61 | SPKLRSGF | 8.7 | RSRNGFEM | 7.25 | | |
| NA | H7N7 | 367 | 0.9 | yes | 4 | 0 | 100 | SPRSRSG | 82.61 | PKLRSGFE | 8.7 | | | | |
| NA | H7N7 | 368 | 0.9 | yes | 4 | 0 | 100 | PRSRSGF | 82.61 | KLRSGFEM | 8.7 | | | | |
| NA | H7N7 | 369 | 0.74 | yes | 3 | 0 | 100 | PRSRSGFE | 82.61 | SRNGFEML | 15.94 | | | | |
| NA | H7N7 | 370 | 0.22 | yes | 3 | 0 | 100 | RSGFEML | 97.1 | RNGFEMLK | 1.45 | | | | |
| NA | H7N7 | 371 | 0.22 | yes | 3 | 0 | 100 | SGFEMLKI | 97.1 | NGFEMLKI | 1.45 | | | | |
| NA | H7N7 | 372 | 0.22 | yes | 3 | 0 | 100 | GFEMLKIH | 97.1 | GFEMLRIP | 1.45 | | | | |
| NA | H7N7 | 373 | 0.22 | yes | 3 | 0 | 100 | FEMLKIPN | 97.1 | FEMLRIPN | 1.45 | | | | |
| NA | H7N7 | 374 | 0.54 | yes | 4 | 0 | 100 | EMLKIPNA | 91.3 | EMLRIPNA | 1.45 | | | | |
| NA | H7N7 | 375 | 0.79 | yes | 5 | 0 | 100 | MLKIPNAG | 86.96 | MLKIHNA | 1.45 | MLRIPNAG | 1.45 | LRIPNAGI | 1.45 |
| NA | H7N7 | 376 | 0.79 | yes | 5 | 0 | 100 | LKIPNAGT | 86.96 | LKIHNAG | 1.45 | LKIHNAGT | 4.35 | RIPNAGID | 1.45 |
| NA | H7N7 | 377 | 0.74 | yes | 4 | 0 | 100 | KIPNAGTD | 86.96 | KIHNAGTD | 4.35 | | | NAGTDPDS | 5.8 |
| NA | H7N7 | 378 | 1.39 | yes | 5 | 0 | 100 | IPNAGTDP | 72.46 | IPNAETDP | 5.8 | IHNAGTDP | 5.8 | | |
| NA | H7N7 | 379 | 0.98 | yes | 4 | 0 | 100 | NAGTDPNS | 80.88 | NAETDPNS | 10.14 | NAGIDPNS | 5.8 | | |
| NA | H7N7 | 381 | — | yes | 5 | 1.45 | 100 | ERQEIVDN | 80.88 | ERQEIVGN | 10.29 | GRQEIVDN | 5.88 | RQEIVDNK | 1.47 |
| NA | H7N7 | 392 | — | yes | 5 | 1.45 | 100 | RQEIVDNN | 80.88 | RQEIVGND | 10.29 | RQEIVDNS | 5.88 | QEIVDNSM | 1.47 |
| NA | H7N7 | 393 | — | yes | 4 | 1.45 | 100 | QEIVDNNW | 80.88 | QEIVGNDN | 10.29 | QEIVDNKN | 5.88 | EIVDNKNW | 1.47 |
| NA | H7N7 | 394 | — | yes | 4 | 1.45 | 100 | EIVDNNNW | 80.88 | EIVGNDNW | 10.29 | EIVDNKNW | 5.88 | DNSNWS | 1.47 |
| NA | H7N7 | 395 | — | yes | 5 | 1.45 | 100 | IVDNNNWS | 80.88 | IVGNDNWS | 10.29 | IVSNDNWS | 5.88 | VDNSNWSG | 1.47 |
| NA | H7N7 | 396 | — | yes | 5 | 1.45 | 100 | VDNNNWS | 80.88 | VGNDNWSG | 10.29 | VSNDNWSG | 5.88 | DNSNWSGY | 1.47 |
| NA | H7N7 | 397 | — | yes | 5 | 1.45 | 100 | DNNNWSGS | 80.88 | GNDNWSGY | 10.29 | SNDNWSGY | 5.88 | | |
| NA | H7N7 | 398 | 0.85 | yes | 4 | 0 | 100 | NNNWSGYS | 16.18 | NDNWSGYS | 5.88 | DNKWSGY | 1.45 | SNRSGYSG | 1.45 |
| NA | H7N7 | 399 | 0.95 | yes | 5 | 0 | 100 | NNWSGYSG | 79.71 | NKWSGYSG | 1.45 | NSNWSGYS | 1.47 | | |
| NA | H7N7 | 400 | 0.11 | yes | 2 | 0 | 100 | NWSGYSGS | 98.55 | NWSGYSG | 1.45 | SNWSGYSG | 1.45 | | |
| NA | H7N7 | 401 | — | yes | 2 | 0 | 100 | WSGYSGSF | 98.55 | | | | | | |
| NA | H7N7 | 402 | 0 | yes | 1 | 0 | 100 | SGYSGSFI | 100 | | | | | | |
| NA | H7N7 | 403 | — | yes | 1 | 0 | 100 | GYSGSFID | 100 | | | | | | |

FIG. 72-310

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 405 | 0 | yes | 1 | 0 | 100 | YSGSFIDY | 100 | | | | | | |
| NA | H7N7 | 406 | 0 | yes | 1 | 0 | 100 | S

FIG. 72-311

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 463 | 0.75 | yes | 3 | 2.9 | 100 | DGAQIQYF | 82.09 | DGAQIQYF | 16.42

FIG.72-312

| Protein | Sub-type | Start Pos | Block Entropy | Gaps >10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 54 | 0.55 | yes | 4 | 0 | 100 | KHPAY

FIG. 72-313

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 98 | 0 | yes | 1 | 0 | 100 | ERPSAPEG | 100 | | | | | | |
| HA | H8 | 99 | 0 | yes | 1 | 0 | 100 | RPSAPEGM | 100 | | | | | | |
| HA | H8 | 100 | 0 | yes | 1 | 0 | 100 | PSAPEGMC | 100 | | | | | | |
| HA | H8 | 101 | 0 | yes | 1 | 0 | 100 | SAPEGMCY | 100 | | | | | | |
| HA | H8 | 102 | 0 | yes | 1 | 0 | 100 | APEGMCYP | 100 | | | | | | |
|

FIG. 72-314

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 143 | 0.96 | yes | 2 | 0 | 100 | SSGTSKAC | 61.19 | RSGTSKAC | 38.81 | | | | |
| HA | H8 | 144 | 0.38 | yes | 2 | 0 | 100 | SGTSKACN | 92.54 | SGTSKACS | 7.46 | | | | |
| HA | H8 | 145 | 0.38 | yes | 2 | 0 | 100 | GTSKACNA | 92.54 | GTSKACSA | 7.46 | | | | |
| HA | H8 | 146 | 0.7 | yes | 3 | 0 | 100 | TSKACNAS | 86.57 | TSKACSAS | 7.46 | TSKACNAL | 5.97 | | |
| HA | H8 | 147 | 0.7 | yes | 3 | 0 | 100 | SKACNAST | 86.57 | SKACSAST | 7.46 | SKACNAL

FIG. 72-315

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 191 | 0 | yes | 1 | 0 | 100 | IFLWGIHH | 100 | | | | | | |
| HA | H8 | 192 | 0 | yes | 1 | 0 | 100 | FLWGIHHP | 100 | | | | | | |
| HA | H8 | 193 | 0 | yes | 2 | 0 | 100 | LWGIHHPP | 100 | | | | | | |
| HA | H8 | 194 | 0.48 | yes | 4 | 0 | 100 | WGIHHPPD | 89.55 | WGIHHPPN | 10.45 | | | | |
| HA | H8 | 195 | 1.54 | yes | 4 | 0 | 100 | GIHHPPDT | 44.78 | GIHHPPDA | 41.79 | GIHHPPNT | 10.45 | GIHHPPDE | 2.99 |
| HA | H8 | 196 | 1.54 | yes | 4 | 0 | 100 | IHHPPDTK | 44.78 | IHHPPDAK | 41.79 | IHHPPNTK | 10.45 | IHHPPDET | 2.99 |
| HA | H8 | 197 | 1.54 | yes | 4 | 0 | 100 | HHPPDTKE | 44.78 | HHPPDAKE | 41.79 | HHPPNTKE | 10.45 | HHPPDETE | 2.99 |
| HA | H8 | 198 | 1.54 | yes | 4 | 0 | 100 | HPPDTKEQ | 44.78 | HPPDAKEQ | 41.79 | HPPNTKEQ | 10.45 | HPPDETEQ | 2.99 |
| HA | H8 | 199 | 1.5 | yes | 4 | 0 | 100 | PPDTKEQT | 44.78 | PPDAKEQT | 35.82 | PPNTKEQT | 10.45 | PPDETEQT | 2.99 |
| HA | H8 | 202 | 0.57 | yes | 3 | 0 | 100 | TKEQTTLY | 53.73 | AKEQTALY | 5.97 | ETEQTKLY | 2.99 | | |
| HA | H8 | 203 | 0.57 | yes | 3 | 0 | 100 | KEQTTLYK | 89.55 | AKEQTLYK | 7.46 | TKEQTALY | 1.49 | | |
| HA | H8 | 204 | 0.57 | yes | 3 | 0 | 100 | EQTTLYKN | 89.55 | EQTALYKN | 7.46 | | | | |
| HA | H8 | 205 | 0.57 | yes | 3 | 0 | 100 | QTTLYKNA | 89.55 | QTALYKNA | 7.46 | | | | |
| HA | H8 | 206 | 0.57 | yes | 3 | 0 | 100 | TTLYKNAN | 89.55 | TALYKNAN | 7.46 | | | | |
| HA | H8 | 207 | 0.57 | yes | 3 | 0 | 100 | TLYKNANT | 89.55 | ALYKNANT | 7.46 | | | | |
| HA | H8 | 208 | 0.19 | yes | 2 | 0 | 100 | LYKNANTL | 97.01 | | | | | | |
| HA | H8 | 209 | 0.3 | yes | 3 | 0 | 100 | YKNANTLS | 95.52 | YKNANTLT | 2.99 | | | | |
| HA | H8 | 210 | 0.3 | yes | 3 | 0 | 100 | KNANTLSS | 95.52 | KNANTLTS | 1.49 | | | | |
| HA | H8 | 211 | 0.3 | yes | 3 | 0 | 100 | NANTLSSV | 92.54 | NANTLTSV | 1.49 | | | | |
| HA | H8 | 212 | 0.5 | yes | 4 | 0 | 100 | ANTLSSVN | 95.52 | ANTLSYT | 2.99 | | | | |
| HA | H8 | 213 | 0.3 | yes | 3 | 0 | 100 | NTLSSVNT | 95.52 | NTLSVYT | 2.99 | | | | |
| HA | H8 | 214 | 0.3 | yes | 3 | 0 | 100 | TLSSVNTN | 95.52 | TLSVYTN | 2.99 | | | | |
| HA | H8 | 215 | 0.3 | yes | 3 | 0 | 100 | LSSVNTNT | 95.52 | LTSVYTNT | 2.99 | | | | |
| HA | H8 | 216 | 0.3 | yes | 3 | 0 | 100 | SSVNTNTI | 95.52 | TSVYTNTI | 2.99 | | | | |
| HA | H8 | 217 | 0.19 | yes | 2 | 0 | 100 | SVNTNTIN | 97.01 | | | | | | |
| HA | H8 | 218 | 0.19 | yes | 2 | 0 | 100 | VNTNTINR | 97.01 | | | | | | |

FIG.72-316

| Protein | Sub-type | Start Pos | Block Entropy | Gaps <10% | # to cover 99% | Gap % | Coverage | included Peptides | Freq | included Peptides | Freq | included Peptides | Freq | included Peptides | Freq |
|---|---|---|---|---|---|---|---|---|---|---|---|---|---|---|---|
| HA | H8 | 235 | 0.22 | yes | 3 | 0 | 100 | PLVRGQQG | 97.01 | ALVRGQQG | 1.49 | PLVREQQG | 1.49 | LVREQQGR | 1.49 |
| HA | H8 | 236 | 0.33 | yes | 4 | 0 | 100 | LVRGQQGR | 95.52 | LVRGQQGT | 1.49 | LVRGQQGW | 1.49 | VRGQQGTM | 1.49 |
| HA | H8 | 237 | 0.33 | yes | 4 | 0 | 100 | VRGQQGRM | 95.52 | VREQQGRM | 1.49 | VRGQQGWM | 1.49 | RGQQGTMD | 1.49 |
| HA | H8 | 238 | 0.33 | yes | 4 | 0 | 100 | RGQQGRMD | 95.52 | REQQGRMD | 1.49 | RGQQGWMD | 1.49 | GQQGTMDY | 1.49 |
| HA | H8 | 239 | 0.22 | yes | 3 | 0 | 100 | GQQGRMDY | 97.01 | EQQGRMDY | 1.49 | GQQGWMDY | 1.49 | | |
| HA | H8 | 240 | 0.22 | yes | 3 | 0 | 100 | QQGRMDYY | 97.01 | QQGWMDYY | 1.49 | QGTMDYY | 1.49 | | |
| HA | H8 | 241 | 0.22 | yes | 3 | 0 | 100 | QGRMDYYW | 97.01 | QGWMDYYW | 1.49 | GTMDYYW | 1.49 | | |
| HA | H8 | 242 | 0.22 | yes | 1 | 0 | 100 | GRMDYYWG | 100 | GWMDYYWG | 1.49 | TMDYYWGI | 1.49 | | |
| HA | H8 | 243 | 0 | yes | 1 | 0 | 100 | RMDYYWGI | 100 | | | | | | |
| HA | H8 | 244 | 0 | yes | 1 | 0 | 100 | MDYYWGIL | 100 | | | | | | |
| HA | H8 | 245 | 0 | yes | 1 | 0 | 100 | DYYWGILK | 100 | | | | | | |
| HA | H8 | 246 | 0 | yes | 1 | 0 | 100 | YYWGILKR | 100 | | | | | | |
| HA | H8 | 247 | 0 | yes | 1 | 0 | 100 | YWGILKRG | 100 | | | | | | |
| HA | H8 | 248 | 0 | yes | 1 | 0 | 100 | WGILKRGE | 100 | | | | | | |
| HA | H8 | 249 | 0 | yes | 1 | 0 | 100 | GILKRGET | 100 | | | | | | |
| HA | H8 | 250 | 0 | yes | 1 | 0 | 100 | ILKRGETL | 100 | | | | | | |
| HA | H8 | 251 | 0 | yes | 1 | 0 | 100 | LKRGETLK | 100 | | | | | | |
| HA | H8 | 252 | 0 | yes | 1 | 0 | 100 | KRGETLKI | 100 | | | | | | |
| HA | H8 | 253 | 0 | yes | 1 | 0 | 100 | RGETLKIR | 100 | | | | | | |
| HA | H8 | 254 | 0 | yes | 1 | 0 | 100 | GETLKIRT | 100 | | | | | | |
| HA | H8 | 255 | 0 | yes | 1 | 0 | 100 | ETLKIRTN | 100 | | | | | | |
| HA | H8 | 256 | 0 | yes | 1 | 0 | 100 | TLKIRTNG | 100 | | | | | | |
| HA | H8 | 257 | 0 | yes | 1 | 0 | 100 | LKIRTNGN | 100 | | | | | | |
| HA | H8 | 258 | 0 | yes | 1 | 0 | 100 | KIRTNGNL | 100 | | | | | | |
| HA | H8 | 259 | 0 | yes | 1 | 0 | 100 | IRTNGNLI | 100 | | | | | | |
| HA | H8 | 260 | 0 | yes | 1 | 0 | 100 | RTNGNLIA | 100 | | | | | | |
| HA | H8 | 261 | 0 | yes | 1 | 0 | 100 | TNGNLIAP | 100 | | | | | | |
| HA | H8 | 262 | 0 | yes | 1 | 0 | 100 | NGNLIAPE | 100 | | | | | | |
| HA | H8 | 263 | 0 | yes | 1 | 0 | 100 | GNLIAPEF | 100 | | | | | | |
| HA | H8 | 264 | 0 | yes | 1 | 0 | 100 | NLIAPEFG | 100 | | | | | | |
| HA | H8 | 265 | 0 | yes | 1 | 0 | 100 | LIAPEFGY | 100 | | | | | | |
| HA | H8 | 266 | 0 | yes | 1 | 0 | 100 | IAPEFGYL | 100 | | | | | | |
| HA | H8 | 267 | 0 | yes | 1 | 0 | 100 | APEFGYLL | 100 | | | | | | |
| HA | H8 | 268 | 0 | yes | 1 | 0 | 100 | PEFGYLLR | 100 | | | | | | |
| HA | H8 | 269 | 0.26 | yes | 2 | 0 | 100 | EFGYLLRG | 95.52 | PEFGYLLR | 4.48 | | | | |
| HA | H8 | 270 | 0.26 | yes | 2 | 0 | 100 | FGYLLRGE | 95.52 | EFGYLLRG | 4.48 | | | | |
| HA | H8 | 271 | 0.26 | yes | 2 | 0 | 100 | GYLLRGES | 95.52 | FGYLLRGE | 4.48 | | | | |
| HA | H8 | 272 | 0.64 | yes | 2 | 0 | 100 | YLLRGESY | 88.06 | GYLLRGES | 4.48 | YLLRGESH | 7.46 | | |
| HA | H8 | 273 | 0.75 | yes | 3 | 0 | 100 | LLRGESYG | 86.57 | LLRGESH | 7.46 | LLKGESHC | 1.49 | | |
| HA | H8 | 274 | 0.86 | yes | 4 | 0 | 100 | LRGESYGR | 85.07 | LRGESHG | 7.46 | LKGESHGR | 1.49 | LKGESHCR | 1.49 |
| HA | H8 | 275 | 0.71 | yes | 5 | 0 | 100 | GESYGRII | 88.06 | GESHGKII | 7.46 | GESHGRTI | 1.49 | GESHCRII | 1.49 |
| HA | H8 | 276 | 0.71 | yes | 5 | 0 | 100 | ESYGRIIQ | 88.06 | ESHGRIIQ | 7.46 | ESHGKIIQ | 1.49 | ESHCRIIQ | 1.49 |

FIG. 72-317

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 278 | 0.71 | yes | 5 | 0 | 100 | SHGRTI

FIG. 72-318

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 328 | 0.86 | yes | 4 | 0 | 100 | ASLRLAVG | 82.09 | ESLRLAVG | 13.43 | | | ESLRLAIG | 1.49 | |

FIG. 72-319

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 370 | 0.19 | yes | 2 | 0 | 100 | HHSNSEGT | 97.01 | HHSNAEGT | 2.99 | | | | |
| HA | H8 | 371 | 0.19 | yes | 2 | 0 | 100 | HSNSEGTG | 97.01 | HSNAEGTG | 2.99 | | | | |
| HA | H8 | 372 | 0.19 | yes | 2 | 0 | 100 | SNSEGTGM | 97.01 | SNAEGTGM | 2.99 | | | | |
| HA | H8 | 373 | 0.19 | yes | 2 | 0 | 100 | NSEGTGMA | 97.01 | NAEGTGMA | 2.99 | | | | |
| HA | H8 | 374 | 0.19 | yes | 1 | 0 | 100 | SEGTGMAA | 97.01 | AEGTGMAA | 2.99 | | | | |
| HA | H8 | 375 | 0 | yes | 1 | 0 | 100 | EGTGMAAD | 100 | | | | | | |
| HA | H8 | 376 | 0 | yes | 1 | 0 | 100 | GTGMAADQ | 100 | | | | | | |
| HA | H8 | 377 | 0 | yes | 1 | 0 | 100 | TGMAADQK | 100 | | | | | | |
| HA | H8 | 378 | 0 | yes | 1 | 0 | 100 | GMAADQKS | 100 | | | | | | |
| HA | H8 | 379 | 0 | yes | 1 | 0 | 100 | MAADQKST | 100 | | | | | |

FIG. 72-320

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 419 | 0.45 | yes | 5 | 0 | 100 | EKRIN

FIG. 72-321

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 461 | 0.72 | yes | 3 | 0 | 100 | KNLFDEVK | 83.58 | ENLFDEVR | 1.49 | | | | |
| HA | H8 | 462 | 0.64 | yes | 2 | 0 | 100 | NLFDEVKR | 83.58 | | | | | | |
| HA | H8 | 463 | 0.64 | yes | 2 | 0 | 100 | LFDEVKRR | 83.58 | | | | | | |
| HA | H8 | 464 | 0.64 | yes | 2 | 0 | 100 | FDEVKRRL | 83.58 | | | | | | |
| HA | H8 | 465 | 0.64 | yes | 2 | 0 | 100 | DEVKRRLS | 83.58 | | | | | | |
| HA | H8 | 466 | 1.65 | yes | 5 | 0 | 100 | EVKRRLSA | 47.76 | EVRRRLSA | 35.82 | EVRRRLST | 2.99 | EVRRRLSV | 1.49 |
| HA | H8 | 467 | 1.65 | yes | 5 | 0 | 100 | VKRRLSAN | 47.76 | VRRRLSAN | 35.82 | VRRRLSTN | 2.99 | VRRRLSYN | 1.49 |
| HA | H8 | 468 | 1.65 | yes | 5 | 0 | 100 | KRRLSANA | 47.76 | RRRLSANA | 35.82 | RRRLSTNA | 2.99 | RRRLSYNA | 1.49 |
| HA | H8 | 469 | 1.32 | yes | 5 | 0 | 100 | RRLSANAI | 58.21 | RRLSTNAM | 35.82 | RRLSANAV | 2.99 | RLSYNAI | 1.49 |
| HA | H8 | 470 | 1.32 | yes | 5 | 0 | 100 | RLSANAID | 58.21 | RLSTNAID | 35.82 | RLSANAYD | 2.99 | RLSYNAID | 1.49 |
| HA | H8 | 474 | 0.79 | yes | 3 | 0 | 100 | NAIDTGNG | 86.57 | NAMDAGNG | 7.46 | NAIDTGKG | 1.49 | NAVDTGNG | 1.49 |
| HA | H8 | 475 | 0.79 | yes | 3 | 0 | 100 | AIDTGNGC | 86.57 | AMDAGNGC | 7.46 | AIDTGKGC | 1.49 | AVDTGNGC | 1.49 |
| HA | H8 | 476 | 0.79 | yes | 3 | 0 | 100 | IDTGNGCF | 86.57 | MDAGNGCF | 7.46 | IDTGKGCF | 1.49 | VDTGNGCF | 1.49 |
| HA | H8 | 477 | 0.54 | yes | 3 | 0 | 100 | DTGNGCFD | 89.55 | DAGNGCFD | 8.96 | | | | |
| HA | H8 | 478 | 0.54 | yes | 3 | 0 | 100 | TGNGCFDI | 89.55 | AGNGCFD | 8.96 | | | | |
| HA | H8 | 479 | 0.54 | yes | 3 | 0 | 100 | GNGCFDIL | 89.55 | NGCFDIL | 8.96 | | | | |
| HA | H8 | 480 | 0.11 | yes | 2 | 0 | 100 | NGCFDILH | 98.51 | | | | | | |
| HA | H8 | 481 | 0.11 | yes | 1 | 0 | 100 | GCFDILHK | 98.51 | | | | | | |
| HA | H8 | 482 | 0 | yes | 1 | 0 | 100 | CFDILHKC | 100 | | | | | | |
| HA | H8 | 483 | 0 | yes | 1 | 0 | 100 | FDILHKCD | 100 | FDILHKCD | 1.49 | | | | |
| HA | H8 | 484 | 0.93 | yes | 3 | 0 | 100 | DILHKCDN | 65.67 | DILHKCDN | 1.49 | | | | |
| HA | H8 | 485 | 0.93 | yes | 3 | 0 | 100 | ILHKCDNE | 65.67 | ILHKCDNK | 1.49 | | | | |
| HA | H8 | 486 | 1.02 | yes | 3 | 0 | 100 | LHKCDNEC | 65.67 | LHKCDNE | 1.49 | | | | |
| HA | H8 | 487 | 1.02 | yes | 3 | 0 | 100 | HKCDNECM | 65.67 | HKCDNKCM | 1.49 | | | | |
| HA | H8 | 488 | 1.02 | yes | 3 | 0 | 100 | KCDNECME | 65.67 | KCDNKCME | 1.49 | | | | |
| HA | H8 | 489 | 1.02 | yes | 3 | 0 | 100 | CDNECMET | 65.67 | CDNKCMET | 1.49 | | | | |
| HA | H8 | 490 | 0.11 | yes | 2 | 0 | 100 | DNECMETI | 65.67 | DNKCMETI | 1.49 | | | | |
| HA | H8 | 491 | 0.11 | yes | 2 | 0 | 100 | NECMETIK | 98.51 | | | | | | |
| HA | H8 | 492 | 0.11 | yes | 2 | 0 | 100 | ECMETIKN | 98.51 | | | | | | |
| HA | H8 | 493 | 0 | yes | 1 | 0 | 100 | CMETIKNG | 100 | | | | | | |
| HA | H8 | 494 | 0 | yes | 1 | 0 | 100 | METIKNGT | 100 | | | | | | |
| HA | H8 | 495 | 0 | yes | 1 | 0 | 100 | ETIKNGTY | 100 | | | | | | |
| HA | H8 | 496 | 1.1 | yes | 2 | 0 | 100 | TIKNGTYN | 50.75 | TIKNGTYD | 49.25 | | | | |
| HA | H8 | 497 | 1.29 | yes | 3 | 0 | 100 | IKNGTYNH | 49.25 | IKNGTYND | 49.25 | IKNGTYNR | 1.49 | NGTYDHKD | 1.49 |
| HA | H8 | 498 | 1.29 | yes | 3 | 0 | 100 | KNGTYNHK | 49.25 | KNGTYDHK | 47.76 | KNGTYNRK | 1.49 | GTYNRKEY | 1.49 |
| HA | H8 | 499 | 1.29 | yes | 5 | 0 | 100 | NGTYNHKE | 47.76 | NGTYDHKE | 47.76 | NGTYNRKE | 1.49 | NGTYNHKD | 1.49 | TYDHKDY | 1.49 | TYNRKEY | 1.49 |
| HA | H8 | 500 | 1.29 | yes | 5 | 0 | 100 | GTYNHKEY | 47.76 | GTYDHKEY | 47.76 | GTYNHKDY | 1.49 | GTYDHKDY | 1.49 | YNHKDYEE | 1.49 | YNHKDYEE | 1.49 |
| HA | H8 | 501 | 1.29 | yes | 5 | 0 | 100 | TYNHKEYE | 47.76 | TYDHKEYE | 47.76 | TYNHKDYE | 1.49 | TYDHKDYE | 1.49 | YNHKDYEE | 1.49 | YNRKEYEE | 1.49 |
| HA | H8 | 502 | 1.29 | yes | 5 | 0 | 100 | YNHKEYEE | 47.76 | YDHKEYEE | 47.76 | YNHKDYEE | 1.49 | YNRKEYEE | 1.49 | YNHKDYEE | 1.49 | NRKEYEEE | 1.49 |
| HA | H8 | 503 | 1.29 | yes | 5 | 0 | 100 | NHKEYEEE | 47.76 | DHKEYEEE | 47.76 | NHKDYEEE | 1.49 | DHKDYEE | 1.49 | | | | |
| HA | H8 | 504 | 0.3 | yes | 3 | 0 | 100 | HKEYEEEA | 95.52 | HKDYEEEA | 2.99 | | | | | | |
| HA | H8 | 505 | 0.19 | yes | 2 | 0 | 100 | KEYEEEAK | 97.01 | KDYEEEAK | 2.99 | | | | | | |

FIG.72-322

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 506 | 0.19 | yes | 2 | 0 | 100 | EYEEEAKL | 97.01 | DYEEEAKL | 2.99 | | | | |
| HA | H8 | 507 | 0 | yes | 1 | 0 | 100 | YEEEAKLE | 100 | EEEAKLEK | 1.49 | | | | |
| HA | H8 | 508 | 0.11 | yes | 2 | 0 | 100 | EEEAKLER | 98.51 | EEEAKLEKS | 1.49 | | | | |
| HA | H8 | 509 | 0.11 | yes | 2 | 0 | 100 | EEAKLERS | 98.51 | EAKLEKSR | 1.49 | | | | |
| HA | H8 | 510 | 0.11 | yes | 2 | 0 | 100 | EAKLERSK | 98.51 | AKLEKSRI | 1.49 | | | | |
| HA | H8 | 511 | 0.11 | yes | 2 | 0 | 100 | AKLERSKI | 98.51 | KLEKSRIN | 1.49 | | | | |
| HA | H8 | 512 | 0.22 | yes | 3 | 0 | 100 | KLERSKIN | 97.01 | LERSKINE | 1.49 | LERSKINE | 1.49 | | |
| HA | H8 | 513 | 0.22 | yes | 3 | 0 | 100 | LERSKING | 97.01 | ERSKINE

FIG. 72-323

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 548 | 0.11 | yes | 2 | 0 | 100 | IAGGLILG | 98.51 | VAG

FIG. 72-324

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H9 | 251 | 1.22 | yes | 4 | 0 | 99.17 | QTLRIRSN | 54.39 | Q

FIG. 72-325

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H9 | 352 | 0.93 | yes | 3 | 0 | 99.3 | GGWSGL

FIG. 72-326

| Protein | Sub-type | Start Pos | Block | Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|---|
| HA | H9 | 472 | 1 | 0.71 | yes | 3 | 0 | 99.04 | EDGKGCFE | 88.03 | EDGNGCFE | 7.77 | EDGKGCFD | 3

FIG. 72-327

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H9N2 | 96 | 0.65 | yes | 2 | 0 | 99.08 | WSYIVERP | 86.58 | WSYIVERS | 12

FIG. 72-328

| Protein | Sub-type | Start Pos | Block Entropy | Gaps <10% | # to 99% cover | % Gap | Coverage | Included Peptides | Freq | Included peptides | Freq | Included peptides | Freq | Included peptides | Freq | Included peptides | Freq |
|---|---|---|---|---|---|---|---|---|---|---|---|---|---|---|---|---|---|
| HA | H9N2 | 325 | 0.66 | yes | 4 | 0 | 99.08 | LKLAVGLR | 89.34 | LKLAIGLR | 7.17 | LKLAVG

FIG. 72-329

| Protein | Sub-type | Start Pos | Block Entropy | Gaps <10% | # to cover 99% | % gap | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| HA | H9N2 | 435 | 0.08 | yes | 1 | 0 | 99.28 | NAELLVIL | 99.28 | AELLVLLG | 0.86 | | | | | | |
| HA | H9N2 | 436 | 0

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H9N2 | 182 | 0.25 | yes | 3 | 0 | 99.64 | WSSSSCYD | 96.88 | WSSASCHD | 1

FIG. 72-332

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H9N2 | 299 | 1.08 | yes | 4 | 0 | 99.04 | WKGSNRPV | 76.98 | WRGSNRPV | 14.15 | WKGSNRPI | 7.79

FIG. 72-333

| Protein | Sub-type | Start Pos | Block Entropy | Gaps <10% | # to cover 99% | Gap % | coverage | Peptides included | Freq | Peptides included | Freq | Peptides included | Freq | Peptides included | Freq |
|---|---|---|---|---|---|---|---|---|---|---|---|---|---|---|---|
| M1 | N/A | 13 | 1.11 | yes | 2 | 1.25 | 99.02 | YVLSIIPS | 51.22 | YVLSIIPS | 47.8 | | | | |
| M1 | N/A | 14 | 1.11 | yes | 2 | 0.82 | 99.05 | VLSIIPSG | 51.2 | VLSIIPSG | 47.85 | | | | |
| M1 | N/A | 15 | 1.11 | yes | 2 | 0.37 | 99.04 | LSIIPSGP | 51.14 | LSIIPSGP | 47.9 | | | | |
| M1 | N/A | 16 | 1.11 | yes | 2 | 0.18 | 99.06 | SIIPSGPL | 51.13 | SIIPSGPL | 47.92 | | | | |
| M1 | N/A | 17 | 1.07 | yes | 2 | 0.03 | 99.08 | IIPSGPLK | 51.15 | IIPSGPLK | 47.92 | | | | |
| M1 | N/A | 18 | 0.07 | yes | 1 | 0.02 | 99.49 | IPSGPLKA | 51.22 | IPSGPLKA | 48.26 | | | | |
| M1 | N/A | 19 | 0.07 | yes | 1 | 0.02 | 99.5 | PSGPLKAE | 99.5 | | | | | | |
| M1 | N/A | 20 | 0.06 | yes | 1 | 0.02 | 99.53 | SGPLKAEI | 99.53 | | | | | | |
| M1 | N/A | 21 | 0.07 | yes | 1 | 0.02 | 99.53 | GPLKAEIA | 99.6 | | | | | | |
| M1 | N/A | 22 | 0.06 | yes | 1 | 0.02 | 99.57 | PLKAEIAQ | 99.57 | | | | | | |
| M1 | N/A | 23 | 0.51 | yes | 2 | 0.01 | 99.59 | LKAEIAQK | 89.83 | LKAEIAQK | 9.59 | | | | |
| M1 | N/A | 24 | 0.53 | yes | 2 | 0.02 | 99.43 | KAEIAQKL | 89.85 | KAEIAQKL | 9.6 | | | | |
| M1 | N/A | 25 | 0.53 | yes | 2 | 0.02 | 99.44 | AEIAQKLE | 65.93 | AEIAQKLE | 9.59 | | | | |
| M1 | N/A | 26 | 1.37 | yes | 5 | 0.02 | 99.52 | EIAQRLES | 66 | EIAQKLED | 22.41 | EIAQRLEG | 9.59 | EIAQRLEN | 1.06 |
| M1 | N/A | 27 | 1.37 | yes | 5 | 0.02 | 99.52 | IAQRLESV | 66.01 | IAQKLEDV | 22.41 | IAQRLEGV | 9.58 | IAQRLENV | 1.01 |
| M1 | N/A | 28 | 1.37 | yes | 5 | 0.02 | 99.21 | AQRLESVF | 65.75 | AQKLEDVF | 22.37 | AQRLEGVF | 9.57 | AQRLENVF | 1.01 |
| M1 | N/A | 29 | 1.4 | yes | 5 | 0.02 | 99.25 | QRLESVFA | 65.79 | QKLEDVFA | 22.37 | QRLEGVFA | 9.56 | QRLENVFA | 1 |
| M1 | N/A | 30 | 1.39 | yes | 5 | 0.01 | 99.21 | RLESVFAG | 75.28 | KLEDVFAG | 22.37 | RLEGVFAG | 9.56 | RLENVFAG | 0.54 |
| M1 | N/A | 31 | 0.99 | yes | 4 | 0.01 | 99.16 | ESVFAGKN | 75.24 | LEDVFAGK | 22.38 | LENVFAGK | 1 | | |
| M1 | N/A | 32 | 0.23 | yes | 3 | 0.01 | 99.1 | VFAGKNTD | 97.64 | EDVFAGKN | 0.85 | ENVFAGKN | 0.99 | | |
| M1 | N/A | 33 | 0.23 | yes | 4 | 0.01 | 99.15 | FAGKNTDL | 97.69 | VFAGKNSD | 0.85 | | 0.6 | | |
| M1 | N/A | 34 | 0.24 | yes | 4 | 0.01 | 99.11 | AGKNTDLE | 97.65 | FAGKNSDL | 0.85 | | 0.6 | | |
| M1 | N/A | 35 | 0.26 | yes | 4 | 0 | 99.4 | GKNTDLEA | 97.49 | AGKNSDLE | 0.85 | GKNTDLEV | 0.6 | | |
| M1 | N/A | 36 | 0.25 | yes | 4 | 0.01 | 99.28 | KNTDLEAL | 97.4 | GKNADLEA | 0.85 | KNTDLEVL | 0.57 | | |
| M1 | N/A | 37 | 0.23 | yes | 3 | 0.01 | 99.13 | NTDLEALM | 97.44 | KNADLEAL | 0.85 | NTDLEVLM | 0.57 | | |
| M1 | N/A | 38 | 0.1 | yes | 2 | 0.02 | 99.06 | TDLEALME | 99.13 | NADLEAL | 0.85 | | | | |
| M1 | N/A | 39 | 0.18 | yes | 2 | 0.02 | 99.11 | DLEALMEW | 98.16 | ADLEALME | 0.85 | | | | |
| M1 | N/A | 40 | 0.17 | yes | 2 | 0.02 | 99.13 | LEALMEWL | 98.18 | LEALMEWI | 0.96 | | | | |
| M1 | N/A | 41 | 0.13 | yes | 2 | 0.03 | 99.15 | EALMEWLK | 98.19 | EALMEWIK | 0.96 | | | | |
| M1 | N/A | 42 | 0.13 | yes | 2 | 0.04 | 99.6 | ALMEWLKT | 98.64 | ALMEWIKT | 0.96 | | | | |
| M1 | N/A | 43 | 0.17 | yes | 2 | 0.03 | 99.7 | LMEWLKTR | 98.73 | LMEWIKTR | 0.96 | | | | |
| M1 | N/A | 44 | 0.12 | yes | 2 | 0.02 | 99.71 | MEWLKTRP | 98.77 | MEWIKTRP | 0.96 | | | | |
| M1 | N/A | 45 | 0.12 | yes | 2 | 0.02 | 99.72 | EWLKTRPI | 98.77 | EWIKTRPI | 0.95 | | | | |
| M1 | N/A | 46 | 0.12 | yes | 2 | 0.03 | 99.74 | WLKTRPIL | 98.79 | WIKTRPIL | 0.95 | | | | |
| M1 | N/A | 47 | 0.12 | yes | 2 | 0.03 | 99.44 | LKTRPILS | 99.43 | IKTRPILS | 0.95 | | | | |
| M1 | N/A | 48 | 0.07 | yes | 1 | 0.04 | 99.37 | KTRPILSP | 99.37 | | | | | | |
| M1 | N/A | 49 | 0.07 | yes | 1 | 0.04 | 99.31 | TRPILSPL | 99.31 | | | | | | |
| M1 | N/A | 50 | 0.07 | yes | 1 | 0.03 | 99.32 | RPILSPLT | 99.32 | | | | | | |
| M1 | N/A | 51 | 0.08 | yes | 1 | 0.04 | 99.29 | PILSPLTK | | | | | | | |
| M1 | N/A | 52 | 0.08 | yes | 1 | 0.04 | | ILSPLTKG | | | | | | | |
| M1 | N/A | 53 | 0.08 | yes | 1 | 0.04 | | LSPLTKGI | | | | | | | |
| M1 | N/A | 54 | 0.3 | yes | 2 | 0.06 | | LSPLTKGM | 3.45 | | | | | | |

FIG. 72-334

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 56 | 0.3 | yes | 2 | 0.06 | 99.31 | SPLTKGIL | 95.87 | SPLTKGML | 3.45 | | | | |
| M1 | N/A | 57 | 0.3 | yes | 2 | 0.06 | 99.31 | PLTKGILG | 95.87 | PLTKGMLG | 3.45 | | | | |
| M1 | N/A | 58 | 0.31 | yes | 2 | 0.05 | 99.18 | LTKGILGF | 95.73 | LTKGMLGF | 3.45 | | | | |
| M1 | N/A | 59 | 0.33 | yes | 2 | 0.04 | 99.36 | TKGILGFV | 95.52 | TKGMLGFV | 3.45 | TKGVLGFV | 0.38 | | |
| M1 | N/A | 60 | 0.32 | yes | 2 | 0.02 | 99.05 | KGILGFVF | 95.57 | KGMLGFVF | 3.48 | | | | |
| M1 | N/A | 61 | 0.31 | yes | 2 | 0.02 | 99.13 | GILGFVFT | 95.65 | GMLGFVFT | 3.48 | | | | |
| M1 | N/A | 62 | 0.31 | yes | 2 | 0.02 | 99.14 | ILGFVFTL | 95.66 | MLGFVFTL | 3.48 | | | | |
| M1 | N/A | 63 | 0.06 | yes | 1 | 0 | 99.52 | LGFVFTLT | 99.52 | | | | | | |
| M1 | N/A | 64 | 0.06 | yes | 1 | 0 | 99.5 | GFVFTLTV | 99.5 | | | | | | |
| M1 | N/A | 65 | 0.06 | yes | 1 | 0.01 | 99.46 | FVFTLTVP | 99.46 | | | | | | |
| M1 | N/A | 66 | 0.05 | yes | 1 | 0.01 | 99.57 | VFTLTVPS | 99.57 | | | | | | |
| M1 | N/A | 67 | 0.03 | yes | 1 | 0.01 | 99.77 | FTLTVPSE | 99.77 | | | | | | |
| M1 | N/A | 68 | 0.04 | yes | 1 | 0.01 | 99.74 | TLTVPSER | 99.74 | | | | | | |
| M1 | N/A | 69 | 0.04 | yes | 1 | 0.01 | 99.74 | LTVPSERG | 99.74 | | | | | | |
| M1 | N/A | 70 | 0.04 | yes | 1 | 0.01 | 99.7 | TVPSERGL | 99.7 | | | | | | |
| M1 | N/A | 71 | 0.04 | yes | 1 | 0.01 | 99.7 | VPSERGLQ | 99.7 | | | | | | |
| M1 | N/A | 72 | 0.05 | yes | 1 | 0.01 | 99.71 | PSERGLQR | 99.71 | | | | | | |
| M1 | N/A | 73 | 0.05 | yes | 1 | 0.01 | 99.61 | SERGLQRR | 99.61 | | | | | | |
| M1 | N/A | 74 | 0.05 | yes | 1 | 0.03 | 99.65 | ERGLQRRF | 99.63 | | | | | | |
| M1 | N/A | 75 | 0.05 | yes | 1 | 0.03 | 99.63 | RGLQRRFI | 99.69 | GLQRRFI | 98.82 | | | | |
| M1 | N/A | 76 | 0.11 | yes | 2 | 0.03 | 99.69 | GLQRRFIQ | 99.68 | LQRRFIQ | 98.81 | | | | |
| M1 | N/A | 77 | 0.12 | yes | 2 | 0.03 | 99.68 | LQRRFIQN | 99.54 | QRRFIQN | 98.67 | | | | |
| M1 | N/A | 78 | 0.13 | yes | 2 | 0.03 | 99.54 | QRRFIQNA | 99.44 | RRFIQNA | 98.58 | | | | |
| M1 | N/A | 79 | 0.14 | yes | 2 | 0.03 | 99.44 | RRFIQNAL | 99.43 | RFIQNAL | 98.56 | | | | |
| M1 | N/A | 80 | 0.15 | yes | 2 | 0.03 | 99.43 | RFIQNALN | 99.41 | RFIQNALN | 97.03 | RFIQNALN | 1.6 | | |
| M1 | N/A | 81 | 0.26 | yes | 3 | 0.01 | 99.41 | FIQNALNG | 99.43 | FVQNALS | 97.05 | FIQNALNG | 1.6 | | |
| M1 | N/A | 82 | 0.26 | yes | 3 | 0.03 | 99.43 | IQNALNGN | 99.45 | VQNALSG | 97.07 | IQNALNGN | 1.6 | | |
| M1 | N/A | 83 | 0.25 | yes | 3 | 0.02 | 99.45 | QNALNGNG | 99.52 | QNALSGN | 97.83 | | | | |
| M1 | N/A | 84 | 0.19 | yes | 2 | 0.02 | 99.52 | NALNGNGD | 99.66 | NALSGND | 97.83 | | | | |
| M1 | N/A | 85 | 0.19 | yes | 2 | 0.02 | 99.66 | ALNGNGDP | 99.64 | ALSGNGD | 97.97 | | | | |
| M1 | N/A | 86 | 0.17 | yes | 2 | 0.01 | 99.33 | LNGNGDPN | 99.33 | LSGNGDP | 97.64 | | | | |
| M1 | N/A | 87 | 0.2 | yes | 2 | 0.01 | 99.35 | NGNGDPNN | 99.35 | SGNGDPN | 97.66 | | | | |
| M1 | N/A | 88 | 0.2 | yes | 2 | 0.01 | 99.28 | GNGDPNNM | 99.28 | | 99.28 | | | | |
| M1 | N/A | 89 | 0.08 | yes | 1 | 0.02 | 99.1 | NGDPNNMD | 99.1 | | | | | | |
| M1 | N/A | 90 | 0.11 | yes | 2 | 0.02 | 99.11 | GDPNNMDR | 99.11 | GDPNNMDK | 77.19 | GDPNNMDR | 21.92 | DPSNMDRA | 0.28 |
| M1 | N/A | 91 | 0.86 | yes | 3 | 0.02 | 99.25 | DPNNMDRA | 99.25 | DPNNMDIA | 77.16 | DPNNMDIA | 21.81 | PSNMDRAV | 0.28 |
| M1 | N/A | 92 | 0.87 | yes | 2 | 0.02 | 99.12 | PNNMDRAV | 99.12 | PNNMDIAV | 77.11 | PNNMDIAV | 21.73 | SNMDRAVK | 0.28 | NNMARAVK | 0.13 |
| M1 | N/A | 93 | 0.89 | yes | 3 | 0.02 | 99.1 | NNMDRAVK | 99.1 | NNMDIAVK | 77.06 | NNMDIAVK | 21.63 | | | |
| M1 | N/A | 94 | 0.9 | yes | 4 | 0.03 | 99.02 | NMDRAVKL | 99.02 | NMDIAVKL | 77.38 | NMDIAVKL | 21.63 | | | |
| M1 | N/A | 95 | 0.87 | yes | 2 | 0.03 | 99.02 | MDRAVKLY | 99.02 | MDIAVKLY | 77.4 | MDIAVKLY | 21.62 | | | |
| M1 | N/A | 96 | 0.87 | yes | 2 | 0.02 | 99.02 | DRAVKLYR | 99.02 | DKAVKLYR | 77.4 | DKAVKLYR | 21.62 | DKAVKLYR | 20.7 | DKAVKLYK | 0.93 |
| M1 | N/A | 97 | 1.69 | yes | 4 | 0.02 | 99.12 | DRAVKLYR | 38.88 | DKAVKLYR | 38.62 | DKAVKLYR | 38.62 | DKAVKLYR | 20.7 | DKAVKLYK | 0.93 |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M | N/A | 150 | 0.47 | yes | 2 | 0.04 | 99.73 | VCATCEQI | 90.97 | ICATCEQI | 8.76 | | | | |
| M | N/A | 151 | 0.03 | yes | 1 | 0.04 | 99.81 | CATCEQIA | 99.81 | | | | | | |
| M | N/A | 152 | 0.03 | yes | 1 | 0.03 | 99.77 | ATCEQIAD | 99.77 | | | | | | |
| M | N/A | 153 | 0.22 | yes | 2 | 0.03 | 99.75 | TCEQIADS | 97 | TCEQIADA | 2.75 | | | | |
| M | N/A | 154 | 0.35 | yes | 3 | 0.03 | 99.79 | CEQIADSQ | 95.18 | CEQIADAQ | 2.75 | | | | |
| M | N/A | 155 | 0.35 | yes | 3 | 0.04 | 99.78 | EQIADSQH | 95.16 | EQIADAQH | 2.75 | | | | |
| M | N/A | 156 | 0.77 | yes | 4 | 0.03 | 99.72 | QIADSQHK | 86.61 | QIADAQHR | 8.54 | QIADSHHR | 1.82 | | |
| M | N/A | 157 | 0.78 | yes | 4 | 0.04 | 99.57 | IADSQHRS | 86.47 | IADAQHRS | 8.54 | IADSHHRS | 1.81 | | |
| M | N/A | 158 | 0.79 | yes | 4 | 0.04 | 99.5 | ADSQHRSH | 86.4 | ADAQHRSH | 8.53 | ADSHHRSH | 1.81 | | |
| M | N/A | 159 | 0.79 | yes | 4 | 0.03 | 99.49 | DSQHRSHR | 86.4 | DAQHRSHR | 8.53 | DSHHRSHR | 1.81 | | |
| M | N/A | 160 | 0.79 | yes | 4 | 0.04 | 99.5 | SQHRSHRQ | 86.4 | AQHRSHRQ | 8.53 | SHHRSHRQ | 1.8 | | |
| M | N/A | 161 | 0.62 | yes | 3 | 0.06 | 99.42 | QHRSHRQM | 89.1 | HHRSHRQM | 8.52 | | | | |
| M | N/A | 162 | 1.42 | yes | 2 | 0.06 | 99.11 | HRSHRQMA | 51.44 | HKSHRQMV | 39.11 | | | | |
| M | N/A | 170 | 1.46 | yes | 4 | 0.02 | 99.23 | TTTNPLIR | 68.88 | TITNPLIR | 11.86 | ATTNPLIR | 8.59 | | |
| M | N/A | 171 | 1.04 | yes | 3 | 0.03 | 99.52 | TTNPLIRH | 77.64 | TTNPLIKH | 11.97 | ATTNPLIR | 8.59 | | |
| M | N/A | 172 | 0.57 | yes | 2 | 0.03 | 99.66 | TNPLIRHE | 87.68 | TNPLIKHE | 11.98 | | | | |
| M | N/A | 173 | 0.57 | yes | 2 | 0.03 | 99.72 | NPLIRHEN | 87.68 | NPLIKHEN | 11.98 | | | | |
| M | N/A | 174 | 0.56 | yes | 2 | 0.03 | 99.81 | PLIRHENR | 87.74 | PLIKHENR | 11.98 | | | | |
| M | N/A | 175 | 0.56 | yes | 2 | 0.03 | 99.79 | LIRHENRM | 87.82 | LIKHENRM | 11.99 | | | | |
| M | N/A | 176 | 0.55 | yes | 2 | 0.03 | 99.82 | IRHENRMV | 87.8 | IKHENRMV | 11.98 | | | | |
| M | N/A | 177 | 0.72 | yes | 3 | 0.03 | 99.67 | RHENRMVL | 87.84 | KHENRMVL | 11.98 | RHENRMVI | 2.13 | | |
| M | N/A | 178 | 0.19 | yes | 1 | 0.03 | 99.68 | HENRMVLA | 85.56 | | | | | | |
| M | N/A | 179 | 0.2 | yes | 2 | 0.03 | 99.68 | ENRMVLAS | 97.54 | ENRMVIAS | 2.14 | | | | |
| M | N/A | 180 | 0.19 | yes | 2 | 0.01 | 99.65 | NRMVLAST | 97.53 | NRMVIAST | 2.15 | | | | |
| M | N/A | 181 | 0.2 | yes | 2 | 0.01 | 99.63 | RMVLASTT | 97.46 | RMVIASTT | 2.15 | | | | |
| M | N/A | 182 | 0.21 | yes | 2 | 0.01 | 99.59 | MVLASTTA | 97.5 | MVIASTTA | 2.15 | | | | |
| M | N/A | 183 | 0.21 | yes | 2 | 0.01 | 99.57 | VLASTTAK | 97.49 | VIASTTAK | 2.15 | | | | |
| M | N/A | 184 | 0.04 | yes | 1 | 0.02 | 99.71 | LASTTAKA | 97.45 | IASTTAKA | 2.15 | | | | |
| M | N/A | 185 | 0.05 | yes | 1 | 0.02 | 99.69 | ASTTAKAM | 97.43 | | | | | | |
| M | N/A | 186 | 0.21 | yes | 2 | 0.03 | 99.66 | STTAKAME | 99.71 | | | | | | |
| M | N/A | 187 | 0.21 | yes | 2 | 0.05 | 99.49 | TTAKAMEQ | 97.41 | TAKAMEQV | 2.07 | | | | |
| M | N/A | 188 | 0.22 | yes | 2 | 0.05 | 99.48 | TAKAMEQM | 97.39 | AKAMEQVA | 2.08 | | | | |
| M | N/A | 189 | 0.22 | yes | 2 | 0.06 | 99.48 | AKAMEQMA | 97.39 | KAMEQVAG | 2.09 | | | | |
| M | N/A | 190 | 0.22 | yes | 2 | 0.05 | 99.39 | KAMEQMAG | 97.31 | AMEQVAGS | 2.09 | | | | |
| M | N/A | 191 | 0.24 | yes | 2 | 0.05 | 99.17 | AMEQMAGS | 97.17 | MEQVAGSS | 2.01 | | | | |
| M | N/A | 192 | 0.24 | yes | 2 | 0.04 | 99.07 | MEQMAGSS | 97.17 | EQVAGSSE | 2.01 | | | | |
| M | N/A | 193 | 0.25 | yes | 2 | 0.05 | 99.12 | EQMAGSSE | 97.07 | QVAGSSEQ | 2 | | | | |
| M | N/A | 194 | 0.25 | yes | 2 | 0.04 | 99.1 | QMAGSSEQ | 97.12 | VAGSSEQA | 2.01 | | | | |
| M | N/A | 195 | 0.11 | yes | 1 | 0.02 | 99.1 | MAGSSEQA | 99.1 | | | | | | |
| M | N/A | 196 | 0.11 | yes | 1 | 0.03 | 99.06 | AGSSEQAA | 99.06 | | | | | | |
| M | N/A | 197 | 0.11 | yes | 1 | 0.03 | 99.06 | GSSEQAAE | 99.06 | | | | | | |
| M | N/A | 198 | 0.12 | yes | 1 | 0.03 | 99.05 | SSEQAAEA | 99.05 | | | | | | |

FIG.72-337

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 199 | 0.13 | yes | 2 | 0.03 | 99.15 | SEQAAEAM | 98.9 | SEQAAEAI | 0.24 | | | | |
| M1 | N/A | 200 | 0.14 | yes | 2 | 0.03 | 99.11 | EQAAEAME | 98.82 | EQAAEAMD | 0.29 | | | | |
| M1 | N/A | 201 | 0.88 | yes | 3 | 0.05 | 99.04 | QAAEAMEV | 77.53 | QAAEAIEV | 21.27 | | | | |
| M1 | N/A | 202 | 0.87 | yes | 3 | 0.04 | 99.13 | AAEAMEVA | 77.62 | AAEAIEVA | 21.28 | | | | |
| M1 | N/A | 212 | 1.02 | yes | 4 | 0.02 | 99.23 | ARQMVQAM | 73.74 | ARRMYQAM | 23.77 | AROMVHAM | 0.23 | | |
| M1 | N/A | 213 | 0.95 | yes | 5 | 0.02 | 99.22 | RQMVQAMR | 74.05 | RRMYQAMR | 24.36 | | | | |
| M1 | N/A | 214 | 1.63 | yes | 5 | 0.02 | 99.11 | QMVQAMRT | 50.86 | QMYQAMRA | 24.36 | ARQMVHAM | 0.81 | TRQMYQAM | 0.31 |
| M1 | N/A | 215 | 2 | yes | 5 | 0.02 | 99.37 | MVQAMRTI | 44.21 | MYQAMRAI | 24.34 | RMYQAMRA | 0.81 | MYQAMRAV | 4.03 |
| M1 | N/A | 216 | 2 | yes | 5 | 0.02 | 99.36 | VQAMRTIG | 44.21 | VQAMRAIG | 24.34 | MYQAMRTV | 23.1 | VQAMRAVG | 4.03 |
| M1 | N/A | 217 | 1.98 | yes | 5 | 0.02 | 99.64 | QAMRTIGT | 44.49 | QAMRAIGT | 24.34 | MYQAMRTI | 19.9 | QAMRAVGT | 4.03 |
| M1 | N/A | 218 | 1.47 | yes | 5 | 0.02 | 99.41 | AMRTIGTH | 66.84 | AMRTVGTH | 19.86 | VQAMRTV | 19.9 | AMRTIGTQ | 1.8 |
| M1 | N/A | 219 | 1.48 | yes | 4 | 0.02 | 99.33 | MRTIGTHP | 66.91 | MRTVGTHP | 19.86 | QAMRTVGT | 19.9 | MRTIGTQP | 1.8 |
| M1 | N/A | 234 | 1.27 | yes | 4 | 0.02 | 99.39 | DDLLENLQ | 75.14 | NDLLENLQ | 10.72 | AMRAVGTH | 6.8 | NDLLDNLQ | 0.61 |
| M1 | N/A | 235 | 1.51 | yes | 3 | 0.01 | 99.44 | DLLENLQA | 65.26 | NLLENLQA | 18.31 | DDLIENLQ | 6.8 | DLLDNLQA | 0.69 |
| M1 | N/A | 236 | 1.07 | yes | 2 | 0.02 | 99.45 | LLENLQAY | 75.85 | LIENLQAY | 18.35 | DLIENLQA | 8.38 | | |
| M1 | N/A | 237 | 1.07 | yes | 2 | 0.05 | 99.39 | LENLQAYQ | 75.87 | IENLQAYQ | 18.35 | LLDNLQA | 10.65 | | |
| M1 | N/A | 238 | 0.86 | yes | 2 | 0.06 | 99.44 | ENLQTYQK | 80.01 | DNLQAYQK | 18.34 | LDNLQAYQ | 4.53 | | |
| M1 | N/A | 239 | 0.78 | yes | 3 | 0.07 | 99.06 | NLQTYQKR | 80.89 | | | DNLQAYQK | 4.52 | | |
| M1 | N/A | 240 | 0.77 | yes | 3 | 0.08 | 99.27 | LQTYQKRM | 80.93 | | | | 0.71 | | |
| M1 | N/A | 241 | 0.77 | yes | 3 | 0.08 | 99.3 | QTYQKRMG | 80.22 | | | | | | |
| M1 | N/A | 242 | 0.84 | yes | 4 | 0.07 | 99.18 | TYQKRMGV | 98.68 | AYQKRMGL | 0.6 | AYQKRMGV | 0.6 | | |
| M1 | N/A | 243 | 0.14 | yes | 4 | 0.08 | 99.28 | YQKRMGVQ | 94.91 | | | QKRMGLQM | 1.69 | QKRMGLQM | 0.61 | KRMGVQMH | 0.36 |
| M1 | N/A | 244 | 0.41 | yes | 5 | 0.07 | 99.28 | QKRMGVQM | 94.53 | QKRMGVQI | 2.08 | KRMGLQMQ | 1.68 | KRMGLQMQ | 0.61 | |
| M1 | N/A | 245 | 0.45 | yes | 4 | 0.06 | 99.3 | KRMGVQMQ | 94.88 | KRMGVQIQ | 2.08 | RMGLQMQR | 1.68 | RMGLQMQR | 0.61 | |
| M1 | N/A | 246 | 0.4 | yes | 5 | 0.05 | 99.04 | RMGVQMQR | 94.88 | RMGVQIQR | 2.13 | MGLQMQRF | 1.68 | MGLQMQRF | 0.61 | |
| M1 | N/A | 247 | 0.41 | yes | | 0.06 | 99.2 | MGVQMQRF | 94.68 | MGVQLQRF | 1.88 | GLQMQRF | 1.67 | GLQMQRFK | 0.61 | GVQMHRFK | 0.37 |
| M1 | N/A | 248 | 0.43 | yes | | 0.08 | 100 | GVQMQRFK | 94.68 | GVQLQRFK | 1.88 | | | | | |
| M1 | N/A | 249 | 0 | no | | 99.99 | 100 | VQMQRFRR | 100 | | | | | | | |
| M1 | N/A | 250 | 0 | no | | 99.99 | 100 | QMQRFRRP | 100 | | | | | | | |
| M1 | N/A | 251 | 0 | no | | 99.99 | 100 | MQRFRRPD | 100 | | | | | | | |
| M1 | N/A | 252 | 0 | no | | 99.99 | 100 | QRFRRPDS | 100 | | | | | | | |
| M1 | N/A | 253 | 0 | no | | 99.99 | 100 | RFRRPDSS | 100 | | | | | | | |
| M1 | N/A | 254 | 0 | no | | 99.99 | 100 | FRRPDSSW | 100 | | | | | | | |
| M1 | N/A | 255 | 0 | no | | 99.99 | 100 | RRPDSSWL | 100 | | | | | | | |
| M1 | N/A | 256 | 0 | no | 1 | 99.99 | 100 | RPDSSWLF | 100 | PDSSWLFG | 50 | | | | | |
| M1 | N/A | 257 | 1 | no | 1 | 99.99 | 50 | SSRHCSKY | 50 | SRHCSKYH | 50 | | | | | |
| M1 | N/A | 258 | 1 | no | 2 | 99.99 | 50 | DSSWLFGG | 50 | | | | | | | |
| M1 | N/A | 259 | 0 | no | 2 | 99.99 | 100 | RHCSKYHW | 100 | | | | | | | |
| M1 | N/A | 260 | 0 | no | | 99.99 | 100 | HCSKYHWN | 100 | | | | | | | |
| M1 | N/A | 261 | 0 | no | | 99.99 | 100 | CSKYHWNL | 100 | | | | | | | |
| M1 | N/A | 262 | 0 | no | | 99.99 | 100 | SKYHWNLA | 100 | | | | | | | |
| M1 | N/A | 263 | 0 | no | | 99.99 | 100 | KYHWNLAL | 100 | | | | | | | |

FIG. 72-338

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 264 | 0 | no | 1 | 99.99 | 100 | YHWNLALD | 100 | | | | | | |
| M1 | N/A | 265 | 0 | no | 1 | 99.99 | 100 | HWNLALDI | 100 | | | | | | |
| M1 | N/A | 266 | 0 | no | 1 | 99.99 | 100 | WNLALDIV | 100 | | | | | | |
| M1 | N/A | 267 | 0 | no | 1 | 99.99 | 100 | NLALDIVD | 100 | | | | | | |
| M1 | N/A | 268 | 0 | no | 1 | 99.99 | 100 | LALDIVDS | 100 | | | | | | |
| M2 | N/A | 1 | 0.1 | yes | 1 | 1.49 | 99.19 | MSLLTEVE | 99.19 | | | | | | |
| M2 | N/A | 2 | 0.11 | yes | 1 | 1.1 | 99.09 | SLLTEVET | 99.09 | | | | | | |
| M2 | N/A | 3 | 0.47 | yes | 1 | 0.74 | 99.06 | LLTEVETP | 93.92 | LLTEVETL | 2.64 | LLTEVETL | | QLTEVETP | 2.27 |
| M2 | N/A | 4 | 1.36 | yes | 1 | 0.52 | 99.06 | LTEVETPI | 56.22 | LTEVETLI | 38.04 | LTEVETLT | | LTEVETHT | 2.61 |
| M2 | N/A | 10 | 0 | no | 1 | 99.99 | 100 | RPTRNGWG | 100 | | | | | | |
| M2 | N/A | 35 | 0.55 | yes | 4 | 0.02 | 99.07 | GIHLILW | 90.24 | GVLHLILW | 8.58 | GVLHLILW | | VLHLILWI | 0.25 |
| M2 | N/A | 36 | 0.58 | yes | 4 | 0.03 | 99.09 | ILHLILWI | 90.01 | IHLHLVLWI | 8.59 | IHLHLVLWI | | GMPESMRE | 0.25 |
| M2 | N/A | 68 | 0.31 | yes | 3 | 0.07 | 99.13 | GVPESMRE | 96.7 | GIPESMRE | 1.42 | GIPESMRE | 0.25 | MPESMREE | 0.43 |
| M2 | N/A | 69 | 0.3 | yes | 4 | 0.07 | 99.16 | VPESMREE | 96.7 | IPESMREE | 1.42 | IPESMREE | 0.57 | | 0.43 |
| M2 | N/A | 70 | 0.19 | yes | 4 | 0.07 | 99.39 | PKSMREEY | 97.96 | | 1.43 | | 0.6 | | |
| M2 | N/A | 71 | 1.01 | yes | 2 | 0.07 | 99.16 | ESMREEYQ | 72.41 | KSMREEYR | 25.55 | KSMREEYR | 1.2 | SMREEYRE | 9.05 |
| M2 | N/A | 72 | 1.93 | yes | 3 | 0.06 | 99.18 | SMREEYRQ | 41.46 | SMREEYRK | 25.76 | SMREEYRK | 22.91 | MREEYREE | 9.05 |
| M2 | N/A | 73 | 2.11 | yes | 5 | 0.05 | 99.2 | MREEYRQE | 37.62 | MREEYRKE | 25.77 | MREEYRKE | 22.9 | REEYREEQ | 9.07 |
| M2 | N/A | 74 | 2.12 | yes | 5 | 0.05 | 99.06 | REEYRQEQ | 37.59 | REEYRKEQ | 25.58 | REEYRKEQ | 22.95 | | |
| M2 | N/A | 92 | 0.92 | yes | 2 | 99.98 | 100 | FVNIELED | 66.67 | | 33.33 | | | | |
| NP | N/A | 1 | 0 | no | 1 | 99.99 | 100 | SKSRVDNH | 100 | | | | | | |
| NP | N/A | 2 | 0 | no | 1 | 99.99 | 100 | KSRVDNHS | 100 | | | | | | |
| NP | N/A | 3 | 0 | no | 1 | 99.99 | 100 | SRVDNHSM | 100 | | | | | | |
| NP | N/A | 4 | 0 | no | 1 | 99.99 | 100 | RVDNHSMS | 100 | | | | | | |
| NP | N/A | 5 | 0 | no | 1 | 99.99 | 100 | VDNHSMSD | 100 | | | | | | |
| NP | N/A | 6 | 0 | no | 1 | 99.99 | 100 | DNHSMSDI | 100 | | | | | | |
| NP | N/A | 7 | 0 | no | 1 | 99.99 | 100 | NHSMSDIE | 100 | | | | | | |
| NP | N/A | 8 | 0 | no | 1 | 99.99 | 100 | HSMSDIEA | 100 | | | | | | |
| NP | N/A | 9 | 0 | no | 1 | 99.99 | 100 | SMSDIEAM | 100 | | | | | | |
| NP | N/A | 10 | 0.44 | no | 3 | 99.32 | 99.02 | MSDIEAMA | 93.14 | MSDINIMA | 4.9 | MSDINIMA | 0.98 | SDIEIMAS | 0.98 |
| NP | N/A | 11 | 0.52 | no | 4 | 99.32 | 99.02 | SDIEAMAS | 92.16 | SDINIMAS | 4.9 | SDINIMAS | 0.98 | DIGAMASQ | 0.98 |
| NP | N/A | 12 | 0.52 | no | 4 | 99.32 | 99.02 | DIEAMASQ | 92.16 | DINIMASQ | 4.9 | DIEAMATQ | 0.98 | IEIMASQG | 0.97 |
| NP | N/A | 13 | 0.55 | no | 4 | 99.31 | 99.03 | IEAMASQG | 91.26 | INIMASQG | 5.83 | IGAMASQG | 0.97 | GAMASQGT | 0.97 |
| NP | N/A | 14 | 0.55 | no | 4 | 99.31 | 99.03 | EAMASQGT | 91.26 | NIMASQGT | 5.83 | EIMASQGT | 0.97 | | |
| NP | N/A | 15 | 0.44 | no | 2 | 99.31 | 99.03 | AMASQGTK | 92.23 | IMASQGTK | 6.8 | | | | |
| NP | N/A | 16 | 0.15 | no | 3 | 99.24 | 99.24 | MASQGTKR | 98.61 | MALQGTKR | 0.63 | | | | |
| NP | N/A | 17 | 0.19 | no | 4 | 1.02 | 99.14 | ASQGTKRS | 98.24 | ALQGTKRS | 0.63 | ASQGTKRP | 0.28 | SQGTKRPY | 0.28 |
| NP | N/A | 18 | 0.26 | no | 2 | 0.74 | 99.21 | SQGTKRSY | 97.4 | LQGTKRSY | 0.9 | LQGTKRSY | 0.63 | | |
| NP | N/A | 19 | 0.16 | yes | 3 | 0.7 | 99.3 | QGTKRSYE | 98.4 | | 0.9 | | | | |
| NP | N/A | 20 | 0.14 | yes | 2 | 0.64 | 99.21 | GTKRSYEQ | 98.55 | GTKRSHEQ | 0.82 | GTKRSH | 0.82 | | |
| NP | N/A | 21 | 0.15 | yes | 2 | 0.51 | 99.35 | TKRSYEQM | 98.54 | TKRSHEQM | 0.82 | TKRSHEQ | 0.82 | | |
| NP | N/A | 22 | 0.15 | yes | 2 | 0.47 | 99.35 | KRSYEQME | 98.54 | KRSHEQME | 0.82 | KRSHEQ | 0.82 | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 88 | 0.84 | yes | 2 | 0.01 | 99.84 | DERRNKYL | 74.44 | DERRNRYL | 25.4 | | | | |
| NP | N/A | 89 | 0.84 | yes | 2 | 0.01 | 99.84 | ERRNKYLE | 74.44 | ERRNRYLE | 25.4 | | | | |
| NP | N/A | 90 | 0.86 | yes | 2 | 0.02 | 99.65 | RNKYLEE | 74.33 | RNRYLEEH | 25.32 | | | | |
| NP | N/A | 91 | 0.9 | yes | 2 | 0.02 | 99.12 | NKYLEEH | 74.33 | NRYLEEH | 24.79 | | | | |
| NP | N/A | 92 | 0.9 | yes | 2 | 0.02 | 99.12 | KYLEEHP | 74.34 | RYLEEHP | 24.78 | | | | |
| NP | N/A | 93 | 0.96 | yes | 4 | 0.03 | 99.49 | YLEEHPS | 73.75 | KYLEEHPN | 24.66 | RYLEEHPS | 0.59 | | |
| NP | N/A | 94 | 0.24 | yes | 4 | 0.03 | 99.39 | YLEEHPST | 97.55 | YLEEHPNA | 0.68 | YLEEHPNS | 0.67 | | |
| NP | N/A | 95 | 0.24 | yes | 5 | 0.03 | 99.35 | LEEHPSTG | 97.51 | LEEHPNAG | 0.68 | LEENPSA | 0.67 | | |
| NP | N/A | 96 | 0.28 | yes | 5 | 0.03 | 99.28 | EEHPSAG | 97.12 | EEHPNAGK | 0.66 | LEENPSAG | 0.62 | EEHPSAGR | 0.39 |
| NP | N/A | 97 | 0.28 | yes | 4 | 0.03 | 99.28 | EHPSAGK | 97.12 | EHPNAGKD | 0.66 | EENPSAGK | 0.62 | EHPSAGRD | 0.39 |
| NP | N/A | 98 | 0.26 | yes | 3 | 0.01 | 99.11 | HPSAGKD | 97.33 | HPNAGKDP | 0.67 | ENPSAGKD | 0.62 | | |
| NP | N/A | 99 | 0.22 | yes | 3 | 0.03 | 99.03 | PSAGKDP | 97.72 | PNAGKDPK | 0.7 | NPSAGKDP | 0.62 | | |
| NP | N/A | 100 | 0.16 | yes | 2 | 0.03 | 99.38 | SAGKDPKK | 97.69 | NAGKDPKK | 0.7 | SAGRDPKK | 0.39 | | |
| NP | N/A | 101 | 0.08 | yes | 2 | 0.03 | 99.05 | AGKDPKKT | 98.41 | TGKDPKKT | 0.64 | | | | |
| NP | N/A | 102 | 0.07 | yes | 1 | 0.02 | 99.25 | GKDPKKTG | 99.25 | | | | | | |
| NP | N/A | 103 | 0.03 | yes | 1 | 0.03 | 99.3 | KDPKKTGG | 99.3 | | | | | | |
| NP | N/A | 104 | 0.06 | yes | 1 | 0.03 | 99.74 | DPKKTGP | 99.74 | | | | | | |
| NP | N/A | 105 | 0.05 | yes | 1 | 0.03 | 99.56 | PKKTGGPI | 99.56 | | | | | | |
| NP | N/A | 106 | 0.04 | yes | 1 | 0.04 | 99.57 | KKTGGPI | 99.57 | | | | | | |
| NP | N/A | 107 | 0.73 | yes | 2 | 0.05 | 99.54 | KTGGPIY | 81.43 | KTGGPIYK | 18.25 | | | | |
| NP | N/A | 108 | 1.08 | yes | 3 | 0.06 | 99.22 | TGGPIYR | 81.29 | TGGPIYK | 16.96 | TGGPIYKK | 0.73 | | |
| NP | N/A | 122 | 1.2 | yes | 4 | 0.07 | 99.01 | RELILYDK | 69.9 | RELVLYDK | 27.46 | RELILHDK | 1.13 | RELTLYDK | 1.13 |
| NP | N/A | 123 | 1.2 | yes | 5 | 0.05 | 99.06 | ELILYDKE | 68.36 | ELVLYDKE | 27.38 | ELILHDKE | 1.55 | LTLYDKEE | 1.13 |
| NP | N/A | 124 | 1.18 | yes | 5 | 0.07 | 99.05 | LILYDKEE | 68.39 | LVLYDKEE | 27.41 | LILYDKDE | 1.55 | | |
| NP | N/A | 129 | 1.08 | yes | 4 | 0.05 | 99.2 | EEIRRYW | 68.14 | LVLYDKEE | 27.94 | KDEIRRIW | 1.68 | KEEVRRIW | 0.26 |
| NP | N/A | 131 | 1.07 | yes | 3 | 0.05 | 99 | EIRRYWW | 69.7 | KEEIRRYW | 28 | EIMRIWQ | 1.03 | KEEVRRIW | 0.26 |
| NP | N/A | 132 | 1.04 | yes | 3 | 0.05 | 99.12 | IRRYWRQA | 69.7 | EIRRYWRQ | 28.01 | IMRIWRQA | 1.03 | ELRRIWRQ | 0.21 |
| NP | N/A | 133 | 0.97 | yes | 4 | 0.05 | 99.07 | RRIWRQAN | 70.07 | IRRYWRQA | 28.03 | MRIWRQAN | 1.03 | | |
| NP | N/A | 134 | 0.98 | yes | 3 | 0.04 | 99.16 | RIWRQANN | 71.01 | RRIWRQAN | 28.06 | | | | |
| NP | N/A | 135 | 0.63 | yes | 2 | 0.03 | 99.18 | IWRQANNG | 70.98 | RIWRQANN | 28 | NWRQANNG | 0.18 | | |
| NP | N/A | 136 | 0.67 | yes | 3 | 0.02 | 99.03 | WRQANNGD | 87.21 | WRQANNGE | 11.97 | RQANNGEE | 0.22 | | |
| NP | N/A | 137 | 0.7 | yes | 3 | 0.01 | 99.01 | RQANNGED | 86.85 | RQANNGDD | 11.96 | QANNGEDS | 0.27 | QANNGEEA | 0.23 |
| NP | N/A | 138 | 1.78 | yes | 4 | 0.01 | 99.12 | QANNGEDA | 86.57 | QANNGDDA | 11.94 | AGLTHMI | 15.29 | SGLTHMI | 4.89 |
| NP | N/A | 147 | 1.52 | yes | 3 | 0.01 | 99.46 | AGLTHIMI | 39.67 | AGLTHMI | 39.27 | GLTHMMW | 15.58 | | |
| NP | N/A | 148 | 1.53 | yes | 3 | 0.01 | 99.46 | GLTHIMIW | 44.58 | GLTHMMW | 39.32 | LTHMIWH | 15.6 | | |
| NP | N/A | 149 | 1.5 | yes | 3 | 0.01 | 99.77 | LTHIMIWH | 44.57 | LTHIMMW | 39.3 | THMIWHS | 15.6 | | |
| NP | N/A | 150 | 1.49 | yes | 3 | 0.03 | 99.83 | THIMIWH | 44.69 | THMIWH | 39.48 | HMIWHSN | 15.61 | | |
| NP | N/A | 151 | 1.49 | yes | 3 | 0.01 | 99.81 | HIMIWHS | 44.71 | HMIWHS | 39.51 | | | | |
| NP | N/A | 152 | 0.03 | yes | 1 | 0.02 | 99.79 | IMIWHSN | 44.72 | MIWHSNL | 39.49 | | | | |
| NP | N/A | 153 | 0.03 | yes | 1 | 0.02 | 99.79 | MIWHSNL | 99.81 | | | | | | |
| NP | N/A | 154 | 0.03 | yes | 1 | 0.02 | 99.79 | IWHSNLN | 99.79 | | | | | | |
| NP | N/A | 155 | 0.69 | yes | 2 | 0.02 | 99.49 | WHSNLNDA | 83.46 | WHSNLNDT | 16.03 | | | | |

FIG. 72-341

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 156 | 0.7 | yes | 2 | 0.02 | 99.46 | HSNLNDAT | 83.44 | HSNLNDIT | 16.03 | | | | |
| NP | N/A | 157 | 0.69 | yes | 2 | 0.02 | 99.5 | SNLNDATY | 83.47 | SNLNDTTY | 16.03 | | | | |
| NP | N/A | 158 | 0.7 | yes | 2 | 0.03 | 99.46 | NLNDATYQ | 83.43 | NLNDTTYQ | 16.03 | | | | |
| NP | N/A | 159 | 0.7 | yes | 2 | 0.03 | 99.46 | LNDATYQR | 83.44 | LNDTTYQR | 16.03 | | | | |
| NP | N/A | 160 | 0.7 | yes | 2 | 0.01 | 99.46 | NDATYQRT | 83.44 | NDTTYQRT | 16.03 | | | | |
| NP | N/A | 161 | 0.7 | yes | 2 | 0.01 | 99.47 | DATYQRTR | 83.45 | DTTYQRTR | 16.03 | | | | |
| NP | N/A | 162 | 0.69 | yes | 2 | 0.02 | 99.49 | ATYQRTRA | 83.47 | TTYQRTRA | 16.03 | | | | |
| NP | N/A | 163 | 0.03 | yes | 1 | 0.01 | 99.79 | TYQRTRAL | 99.77 | | | | | | |
| NP | N/A | 164 | 0.03 | yes | 1 | 0.01 | 99.79 | YQRTRALV | 99.77 | | | | | | |
| NP | N/A | 165 | 0.03 | yes | 1 | 0.01 | 99.8 | QRTRALVR | 99.8 | | | | | | |
| NP | N/A | 166 | 0.18 | yes | 2 | 0.02 | 99.41 | RTRALVRT | 99.83 | RTRALVRS | 1.58 | | | | |
| NP | N/A | 167 | 0.18 | yes | 2 | 0.01 | 99.42 | TRALVRTG | 97.84 | TRALVRSG | 1.58 | | | | |
| NP | N/A | 168 | 0.2 | yes | 2 | 0.02 | 99.23 | RALVRTGM | 97.65 | RALVRSGM | 1.58 | | | | |
| NP | N/A | 169 | 0.2 | yes | 2 | 0.01 | 99.24 | ALVRTGMD | 97.66 | ALVRSGMD | 1.58 | | | | |
| NP | N/A | 170 | 0.2 | yes | 2 | 0.02 | 99.24 | LVRTGMDP | 97.66 | LVRSGMDP | 1.58 | | | | |
| NP | N/A | 171 | 0.2 | yes | 2 | 0.01 | 99.22 | VRTGMDPR | 97.64 | VRSGMDPR | 1.58 | | | | |
| NP | N/A | 172 | 0.2 | yes | 2 | 0.01 | 99.2 | RTGMDPRM | 97.63 | RSGMDPRM | 1.58 | | | | |
| NP | N/A | 173 | 0.2 | yes | 2 | 0.02 | 99.2 | TGMDPRMC | 97.63 | SGMDPRMC | 1.58 | | | | |
| NP | N/A | 174 | 0.04 | yes | 1 | 0.01 | 99.63 | GMDPRMCS | 99.61 | | | | | | |
| NP | N/A | 175 | 0.05 | yes | 1 | 0.02 | 99.61 | MDPRMCSL | 99.79 | | | | | | |
| NP | N/A | 176 | 0.03 | yes | 1 | 0.01 | 99.79 | DPRMCSLM | 99.79 | | | | | | |
| NP | N/A | 177 | 0.03 | yes | 1 | 0.01 | 99.79 | PRMCSLMQ | 99.8 | | | | | | |
| NP | N/A | 178 | 0.03 | yes | 1 | 0.01 | 99.8 | RMCSLMQG | 99.84 | | | | | | |
| NP | N/A | 179 | 0.02 | yes | 1 | 0.01 | 99.85 | MCSLMQGS | 99.84 | | | | | | |
| NP | N/A | 180 | 0.02 | yes | 1 | 0.01 | 99.84 | CSLMQGST | 99.85 | | | | | | |
| NP | N/A | 181 | 0.02 | yes | 1 | 0.01 | 99.85 | SLMQGSTL | 99.84 | | | | | | |
| NP | N/A | 182 | 0.02 | yes | 1 | 0.01 | 99.84 | LMQGSTLP | 99.85 | | | | | | |
| NP | N/A | 183 | 0.02 | yes | 1 | 0.01 | 99.85 | MQGSTLPR | 99.87 | | | | | | |
| NP | N/A | 184 | 0.03 | yes | 1 | 0.02 | 99.87 | QGSTLPRR | 99.77 | | | | | | |
| NP | N/A | 185 | 0.03 | yes | 1 | 0.03 | 99.77 | GSTLPRRS | 99.75 | | | | | | |
| NP | N/A | 186 | 0.03 | yes | 1 | 0.03 | 99.75 | STLPRRSG | 99.71 | | | | | | |
| NP | N/A | 187 | 0.04 | yes | 1 | 0.03 | 99.71 | TLPRRSGA | 99.72 | | | | | | |
| NP | N/A | 188 | 0.04 | yes | 1 | 0.03 | 99.72 | LPRRSGAA | 99.7 | | | | | | |
| NP | N/A | 189 | 0.04 | yes | 1 | 0.01 | 99.7 | PRRSGAAG | 99.62 | | | | | | |
| NP | N/A | 190 | 0.05 | yes | 1 | 0.03 | 99.62 | RRSGAAGA | 99.56 | | | | | | |
| NP | N/A | 191 | 0.06 | yes | 1 | 0.03 | 99.56 | RSGAAGAA | 99.6 | | | | | | |
| NP | N/A | 192 | 0.17 | yes | 2 | 0.03 | 99.63 | SGAAGAAV | 98.05 | SGAAGAAI | 1.55 | | | | |
| NP | N/A | 193 | 0.17 | yes | 2 | 0.01 | 99.65 | GAAGAAVK | 98.08 | GAAGAAIK | 1.55 | | | | |
| NP | N/A | 194 | 0.16 | yes | 2 | 0.02 | 99.48 | AAGAAVKG | 98.11 | AAGAAIKG | 1.55 | AGAAIKGV | 1.35 | | |
| NP | N/A | 195 | 0.87 | yes | 3 | 0.02 | 99.46 | AGAAVKGI | 78.76 | AGAAVKGV | 19.36 | GAAIKGVG | 1.35 | | |
| NP | N/A | 196 | 0.87 | yes | 3 | 0.02 | 99.46 | GAAVKGVG | 78.75 | GAAVKGIG | 19.36 | AAIKGVGT | 1.35 | | |
| NP | N/A | 197 | | yes | 3 | | | AAVKGVGT | 78.74 | AAVKGIGT | 19.36 | | | | |

FIG. 72-342

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 198 | 1.65 | yes | 4 | 0.03 | 99.02 | AVKGVGTM | 50.6 | AVKGVGTI | 27.85 | AVKGVGTM | 19.25 | VMELVRMI | 2.02 |
| NP | N/A | 206 | 1.87 | yes | 5 | 0.03 | 99.3 | VMELIRMI | 49.31 | AMELIRMI | 27.81 | VLELIRMI | 12.64 | | |
| NP | N/A | 207 | 1.11 | yes | 4 | 0.02 | 99.63 | MELIRMIK | 77.38 | MELIRMVK | 12.69 | MELVRMIK | 7.52 | | |
| NP | N/A | 208 | 1.74 | yes | 3 | 0.01 | 99.63 | ELIRMIKR | 84.88 | ELIRMVKR | 12.7 | | 2.05 | | |
| NP | N/A | 209 | 0.73 | yes | 4 | 0.01 | 99.65 | LIRMIKRG | 84.92 | LVRMIKRG | 12.69 | | 2.05 | | |
| NP | N/A | 210 | 0.87 | yes | 3 | 0.01 | 99.6 | IRMIKRGI | 82.93 | IRMVKRGI | 12.69 | | 2.05 | | |
| NP | N/A | 211 | 0.74 | yes | 3 | 0.01 | 99.6 | RMIKRGIN | 84.92 | RMVKRGIN | 12.69 | | 1.99 | IRMIKRGV | 1.99 |
| NP | N/A | 212 | 0.74 | yes | 3 | 0.01 | 99.58 | MIKRGIND | 84.92 | MVKRGIND | 12.69 | | 1.99 | | |
| NP | N/A | 213 | 0.74 | yes | 3 | 0.01 | 99.59 | IKRGINDR | 84.88 | VKRGINDR | 12.69 | | 2 | | |
| NP | N/A | 214 | 0.2 | yes | 2 | 0.01 | 99.65 | KRGINDRN | 97.57 | KRGVNDRN | 2.03 | | | | |
| NP | N/A | 215 | 0.19 | yes | 2 | 0.01 | 99.66 | RGINDRNF | 97.61 | RGVNDRNF | 2.03 | | | | |
| NP | N/A | 216 | 0.19 | yes | 2 | 0.01 | 99.71 | GINDRNFW | 97.63 | GVNDRNFW | 2.03 | | | | |
| NP | N/A | 217 | 0.19 | yes | 2 | 0.01 | 99.77 | INDRNFWR | 97.63 | VNDRNFWR | 2.03 | | | | |
| NP | N/A | 218 | 0.04 | yes | 1 | 0.01 | 99.58 | NDRNFWRG | 99.71 | | | | | | |
| NP | N/A | 219 | 0.11 | yes | 2 | 0.01 | 99.63 | DRNFWRGE | 98.78 | DRNFWRGD | 0.99 | | | | |
| NP | N/A | 220 | 0.13 | yes | 2 | 0.01 | 99.66 | RNFWRGEN | 98.58 | RNFWRGDN | 1 | | | | |
| NP | N/A | 221 | 0.13 | yes | 2 | 0.01 | 99.65 | NFWRGENG | 98.64 | NFWRGDNG | 1 | | | | |
| NP | N/A | 222 | 0.12 | yes | 2 | 0.01 | 99.46 | FWRGENGR | 98.66 | FWRGDNGR | 1 | | | | |
| NP | N/A | 223 | 0.98 | yes | 3 | 0.02 | 99.41 | WRGENGRK | 70.91 | WRGENGRR | 27.74 | WRGDNGRR | 0.8 | | |
| NP | N/A | 224 | 0.98 | yes | 3 | 0.05 | 99.26 | RGENGRKT | 70.87 | RGENGRRT | 27.75 | RGDNGRRT | 0.8 | | |
| NP | N/A | 225 | 1 | yes | 3 | 0.05 | 99.2 | GENGRKTR | 70.73 | GENGRRTR | 27.74 | GDNGRRTR | 0.8 | | |
| NP | N/A | 231 | 1.64 | yes | 3 | 0.05 | 99.2 | TRIAYERM | 53.77 | TRSAYERM | 24.79 | TRIAYERM | 18.75 | TRGAYERM | 1.53 |
| NP | N/A | 232 | 1.63 | yes | 3 | 0.05 | 99.34 | RIAYERMC | 53.83 | RSAYERMC | 24.78 | RTAYERMC | 18.75 | RGAYERMC | 1.53 |
| NP | N/A | 233 | 1.63 | yes | 3 | 0.05 | 99.54 | IAYERMCN | 53.93 | SAYERMCN | 24.79 | TAYERMCN | 18.74 | GAYERMCN | 1.53 |
| NP | N/A | 234 | 0.06 | yes | 1 | 0.03 | 99.54 | AYERMCNI | 99.54 | | | | | | |
| NP | N/A | 235 | 0.06 | yes | 1 | 0.05 | 99.54 | YERMCNIL | 99.54 | | | | | | |
| NP | N/A | 236 | 0.04 | yes | 1 | 0.01 | 99.56 | ERMCNILK | 99.56 | | | | | | |
| NP | N/A | 237 | 0.04 | yes | 1 | 0.01 | 99.68 | RMCNILKG | 99.68 | | | | | | |
| NP | N/A | 238 | 0.05 | yes | 1 | 0.02 | 99.68 | MCNILKGK | 99.68 | | | | | | |
| NP | N/A | 239 | 0.06 | yes | 1 | 0.03 | 99.61 | CNILKGKF | 99.61 | | | | | | |
| NP | N/A | 240 | 0.06 | yes | 1 | 0.03 | 99.67 | NILKGKFQ | 99.57 | | | | | | |
| NP | N/A | 241 | 0 | no | 1 | 0.03 | 99.56 | ILKGKFQT | 99.5 | | | | | | |
| NP | N/A | 242 | 0.08 | yes | 1 | 0.03 | 99.5 | LKGKFQTA | 99.56 | | | | | | |
| NP | N/A | 243 | 0.08 | yes | 1 | 99.99 | 100 | KGSSKQQ | 100 | | | | | | |
| NP | N/A | 244 | 0.44 | yes | 1 | 0.05 | 99.35 | SKGKFQTA | 99.35 | | | | | | |
| NP | N/A | 245 | 0.45 | yes | 2 | 0.07 | 99.35 | KGKFQTAA | 99.35 | KFQTAAQK | 6.81 | | | | |
| NP | N/A | 246 | 0.43 | yes | 2 | 0.09 | 99.36 | GKFQTAAQ | 99.36 | FQTAAQKA | 6.81 | | | | |
| NP | N/A | 247 | 1.07 | yes | 3 | 0.09 | 99.28 | KFQTAAQR | 92.55 | QTAAQKAM | 6.81 | TAAQKAMM | 6.75 | | |
| NP | N/A | 248 | 1.06 | yes | 3 | 0.07 | 99.39 | FQTAAQRA | 92.47 | TAAQKAMM | 16.54 | TAAQKAMM | 6.75 | | |
| NP | N/A | 249 | 1.06 | yes | 3 | 0.07 | 99.32 | QTAAQRAM | 92.58 | AAQKAMMD | 16.54 | AAQKAMMD | 6.75 | | |
| NP | N/A | 250 | 1.07 | yes | 3 | 0.07 | 99.4 | TAAQRAM | 76.03 | TAAQRAMM | 16.54 | AAQKAMMD | | | |
| NP | N/A | 251 | 1.06 | yes | 3 | 0.07 | 99.4 | AAQRAMMD | 76.11 | AAQRAMMD | 16.54 | AQRAMMDQ | | | |

FIG. 72-343

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 252 | 1.04 | yes | 3 | 0.07 | 99.57 | QRAMMDQV | 76.29 | QRAMMDQV | 16.54 | | | | |
| NP | N/A | 253 | 1.05 | yes | 3 | 0.05 | 99.54 | RAMMDQVR | 76.25 | RAMMDQVR | 16.55 | | | | |
| NP | N/A | 254 | 0.7 | yes | 2 | 0.02 | 99.59 | AMMDQVRE | 82.99 | AMVDQVRE | 16.6 | | | | |
| NP | N/A | 255 | 0.78 | yes | 3 | 0.02 | 99.68 | MMDQVRES | 81.93 | MMDQVRES | 16.63 | MMDQVREG | 1.12 | | | |
| NP | N/A | 256 | 0.78 | yes | 2 | 0.02 | 99.67 | MDQVRESR | 81.92 | MDQVRES | 16.62 | MDQVREGR | 1.12 | | | |
| NP | N/A | 257 | 0.17 | yes | 2 | 0.02 | 99.24 | DQVRESRN | 98.12 | VDQVRESR | 1.12 | | | | |
| NP | N/A | 258 | 0.17 | yes | 2 | 0.02 | 99.24 | QVRESRNP | 98.12 | DQVRESRN | 1.12 | | | | |
| NP | N/A | 259 | 0.17 | yes | 2 | 0.01 | 99.26 | VRESRNPG | 98.13 | QVRESRNP | 1.13 | | | | |
| NP | N/A | 260 | 0.17 | yes | 2 | 0.01 | 99.28 | RESRNPGN | 98.15 | VRESRNP | 1.13 | | | | |
| NP | N/A | 261 | 0.18 | yes | 2 | 0.01 | 99.28 | ESRNPGNA | 98.05 | RESRNPGN | 1.13 | | | | |
| NP | N/A | 262 | 0.18 | yes | 2 | 0.01 | 99.18 | SRNPGNAE | 98.07 | EGRNPGNA | 1.13 | | | | |
| NP | N/A | 263 | 0.14 | yes | 2 | 0.02 | 99.2 | RNPGNAEI | 98.76 | GRNPGNA | 1.13 | | | | |
| NP | N/A | 264 | 0.13 | yes | 2 | 0.01 | 99.18 | NPGNAEIE | 98.8 | RSPGNAEI | 0.42 | | | | |
| NP | N/A | 265 | 0.09 | yes | 2 | 0.01 | 99.23 | PGNAEIED | 99.22 | SPGNAEIE | 0.43 | | | | |
| NP | N/A | 266 | 0.1 | yes | 2 | 0.02 | 99.22 | GNAEIEDL | 99.19 | | | | | | |
| NP | N/A | 267 | 0.49 | yes | 2 | 0.02 | 99.19 | NAEIEDLI | 91.55 | NAEIEDLT | 7.59 | | | | |
| NP | N/A | 268 | 0.49 | yes | 4 | 0.02 | 99.14 | AEIEDLIF | 91.57 | AEIEDLTF | 7.59 | | | | |
| NP | N/A | 269 | 0.65 | yes | 5 | 0.02 | 99.16 | EIEDLIFL | 89.49 | EIEDLTFL | 7.61 | EIEDLIFS | 1.53 | EIEDLIFM | 0.6 |
| NP | N/A | 270 | 0.67 | yes | 4 | 0.02 | 99.23 | EDLIFLA | 89.22 | EDLTFLA | 7.61 | EDLIFSA | 1.53 | EDLIFMA | 0.6 |
| NP | N/A | 271 | 0.63 | yes | 4 | 0.03 | 99.22 | EDLIFLAR | 89.46 | EDLTFLAR | 7.83 | EDLIFSAR | 1.53 | EDLIFMAR | 0.6 |
| NP | N/A | 272 | 0.63 | yes | 4 | 0.03 | 99.42 | DLIFLARS | 89.45 | DLTFLARS | 7.83 | DLIFSARS | 1.53 | DLIFMARS | 0.6 |
| NP | N/A | 273 | 0.63 | yes | 4 | 0.03 | 99.4 | LIFLARSA | 89.47 | LTFLARSA | 7.83 | LIFSARSA | 1.53 | LIFMARSA | 0.6 |
| NP | N/A | 274 | 0.62 | yes | 4 | 0.03 | 99.47 | IFLARSAL | 89.51 | TFLARSAL | 7.83 | IFSARSALI | 1.53 | IFMARSAL | 0.6 |
| NP | N/A | 275 | 0.25 | yes | 3 | 0.03 | 99.18 | FLARSALI | 97.06 | FSARSALI | 1.53 | | | | |
| NP | N/A | 276 | 0.26 | yes | 3 | 0.03 | 99.15 | LARSALIL | 97.02 | MARSALIL | 1.53 | | | | |
| NP | N/A | 277 | 0.08 | yes | 1 | 0.03 | 99.22 | ARSALILR | 99.22 | | | | | | |
| NP | N/A | 278 | 0.06 | yes | 1 | 0.03 | 99.46 | RSALILRG | 99.46 | | | | | | |
| NP | N/A | 279 | 0 | no | 1 | 99.99 | 100 | ASALILR | 100 | | | | | | |
| NP | N/A | 280 | 0 | no | 1 | 99.99 | 100 | ASALILRG | 100 | | | | | | |
| NP | N/A | 281 | 0.1 | yes | 3 | 0.03 | 99.01 | SALILRGS | 99.01 | ALILRGSI | 1.15 | ALILRGAV | 0.45 | | |
| NP | N/A | 282 | 0.21 | yes | 3 | 0.02 | 99.32 | ALILRGSV | 97.72 | LILRGSIA | 1.15 | LILRGAVA | 0.45 | | |
| NP | N/A | 283 | 0.21 | yes | 2 | 0.01 | 99.32 | LILRGSVA | 97.73 | ILRGSIAH | 1.15 | ILRGAVAH | 0.45 | | |
| NP | N/A | 284 | 0.18 | yes | 2 | 0.01 | 99.29 | ILRGSVAH | 97.69 | LRGSIAHK | 1.15 | | | | |
| NP | N/A | 285 | 0.17 | yes | 2 | 0.01 | 99.2 | LRGSVAHK | 98.05 | RGSIAHKS | 1.14 | | | | |
| NP | N/A | 286 | 0.18 | yes | 2 | 0.01 | 99.24 | RGSVAHKS | 98.09 | GSIAHKSC | 1.15 | | | | |
| NP | N/A | 287 | 0.18 | yes | 2 | 0.01 | 99.18 | GSVAHKSC | 98.03 | SIAHKSCL | 1.15 | | | | |
| NP | N/A | 288 | 0.17 | yes | 2 | 0.01 | 99.18 | SVAHKSCL | 98.03 | IAHKSCLP | 1.15 | | | | |
| NP | N/A | 289 | 0.14 | yes | 2 | 0.01 | 99.65 | VAHKSCLP | 98.5 | | | | | | |
| NP | N/A | 290 | 0.04 | yes | 1 | 0 | 99.73 | AHKSCLPA | 99.73 | | | | | | |
| NP | N/A | 291 | 0.04 | yes | 1 | 0 | 99.75 | HKSCLPAC | 99.75 | | | | | | |
| NP | N/A | 292 | 0.5 | yes | 3 | 0.01 | 99.75 | KSCLPACV | 91.16 | KSCLPACI | 7.65 | KSCLPACI | 0.94 | | |
| NP | N/A | 293 | 0.5 | yes | 3 | 0.01 | 99.75 | SCLPACVY | 91.15 | SCLPACIY | 7.65 | SCLPACIY | 0.94 | | |

FIG. 72-344

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 294 | 0.5 | yes | 3 | 0.01 | 99.73 | CLPACYG

FIG. 72-345

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 353 | 0.53 | yes | 2 | 0.05 | 99.3 | MACHSAAF | 90.16 | MACNSAAF | 9.15 | | | | |
| NP | N/A | 354 | 0.51 | yes | 2 | 0.05 | 99.5 | ACHSAAFE | 90.36 | ACNSAAFE | 9.14 | | | | |
| NP | N/A | 355 | 0.51 | yes | 2 | 0.05 | 99.5 | CHSAAFED | 90.36 | CNSAAFED | 9.14 | | | | |
| NP | N/A | 356 | 0.51 | yes | 1 | 0.05 | 99.45 | HSAAFEDL | 90.32 | NSAAFEDL | 9.13 | | | | |
| NP | N/A | 357 | 0.07 | yes | 3 | 0.02 | 99.44 | SAAFEDLR | 99.44 | | | | | | |
| NP | N/A | 358 | 0.8 | yes | 4 | 0.02 | 99.63 | AAFEDLRV | 78.01 | AAFEDLRI | 18.23 | | | | |
| NP | N/A | 359 | 0.97 | yes | 5 | 0.02 | 99.57 | AFEDLRVS | 78.01 | AFEDLRLL | 18.18 | AFEDLRIS | 0.77 | | |
| NP | N/A | 376 | 1.2 | yes | 4 | 0.02 | 99.53 | PRGKLSTR | 55.16 | PRGQLSTR | 42.43 | PRGRLSTR | 2.62 | PRGQLTR | 0.55 |
| NP | N/A | 377 | 1.19 | yes | 4 | 0.02 | 99.04 | RGKLSTRG | 55.22 | RGQLSTRG | 42.43 | RGRLSTRG | 0.79 | LTTRGVQI | 0.59 |
| NP | N/A | 380 | 0.4 | yes | 5 | 0.02 | 99.05 | LSTRGVQI | 95.21 | LSTRGIQI | 1.69 | LATRGVQI | 0.79 | | |
| NP | N/A | 381 | 0.39 | yes | 4 | 0.02 | 99.03 | STRGVQIA | 95.26 | STRGIQIA | 1.69 | ATRGVQIA | 1.28 | | |
| NP | N/A | 382 | 0.27 | yes | 3 | 0.01 | 99.7 | TRGVQIAS | 96.73 | TRGIQIAS | 1.69 | | 1.28 | | |
| NP | N/A | 383 | 0.28 | yes | 3 | 0.01 | 99.52 | RGVQIASN | 96.58 | RGIQIASN | 1.69 | | 1.28 | | |
| NP | N/A | 384 | 0.28 | yes | 3 | 0.01 | 99.51 | GVQIASNE | 96.57 | GIQIASNE | 1.69 | | 1.28 | | |
| NP | N/A | 385 | 0.32 | yes | 5 | 0.01 | 99.18 | VQIASNEN | 96.25 | QIASNENV | 28.84 | | 1.25 | QIASNENI | 0.45 |
| NP | N/A | 386 | 1.17 | yes | 4 | 0.02 | 99.22 | QIASNENM | 67.57 | QIASNENV | 28.84 | QIASNENT | 1.7 | QIASNENI | |
| NP | N/A | 398 | 0.86 | yes | 3 | 0.04 | 99.52 | SSTLELRS | 59.22 | SNTLELRS | 37.88 | SGTLELRS | 1.25 | | |
| NP | N/A | 400 | 0.86 | yes | 4 | 0.05 | 99.71 | TLELRSKY | 80.49 | TLELRSGY | 16.35 | | | | |
| NP | N/A | 401 | 0.86 | yes | 4 | 0.05 | 99.7 | LELRSKYW | 80.48 | LELRSGYW | 16.35 | | | | |
| NP | N/A | 402 | 0.86 | yes | 4 | 0.04 | 99.73 | ELRSRYWA | 80.51 | ELRSKYWA | 16.34 | | | | |
| NP | N/A | 403 | 0.87 | yes | 4 | 0.04 | 99.76 | LRSRYWAI | 80.54 | LRSKYWAI | 16.34 | | | | |
| NP | N/A | 404 | 0.87 | yes | 4 | 0.04 | 99.63 | RSRYWAIR | 80.41 | RSKYWAIR | 16.34 | | | | |
| NP | N/A | 405 | 0.9 | yes | 4 | 0.03 | 99.61 | SRYWAIRT | 80.39 | SKYWAIRT | 16.34 | | | | |
| NP | N/A | 406 | 0.07 | yes | 3 | 0.03 | 99.36 | RYWAIRTR | 80.19 | KYWAIRTR | 16.33 | | | | |
| NP | N/A | 407 | 0.06 | yes | 1 | 0.01 | 99.4 | YWAIRTRS | 99.4 | | | | | | |
| NP | N/A | 408 | 0.06 | yes | 1 | 0.01 | 99.46 | WAIRTRSG | 99.46 | | | | | | |
| NP | N/A | 409 | 0.06 | yes | 1 | 0.01 | 99.49 | AIRTRSGG | 99.49 | | | | | | |
| NP | N/A | 410 | 0.09 | yes | 1 | 0.01 | 99.49 | IRTRSGGN | 99.49 | | | | | | |
| NP | N/A | 411 | 0.13 | yes | 2 | 0.01 | 99.18 | RTRSGGNT | 98.84 | RTISGGNT | 0.23 | | | | |
| NP | N/A | 412 | 0.29 | yes | 3 | 0.03 | 99.07 | TRSGGNTS | 96.39 | TRSGGNTN | 2.54 | | | TRSGGNNN | 0.21 |
| NP | N/A | 413 | 0.33 | yes | 4 | 0.02 | 99.15 | RSGGNTSQ | 96.09 | RSGGNTQQ | 2.54 | RSGGNTNH | 0.21 | | |
| NP | N/A | 414 | 0.36 | yes | 4 | 0.05 | 99.02 | SGGNTSQQ | 95.67 | SGGNTNQH | 2.58 | SGGNNNQQ | 0.21 | | |
| NP | N/A | 420 | 1.06 | yes | 5 | 0.06 | 99.02 | QQRASAGQ | 68.34 | QHRASAGQ | 30.04 | QQRSSAGQ | 0.56 | | |
| NP | N/A | 422 | 1.44 | yes | 5 | 0.06 | 99.06 | RASAGQIS | 59.37 | RASAGQTS | 29.9 | RASAGQYS | 0.53 | | |
| NP | N/A | 423 | 1.22 | yes | 5 | 0.05 | 99.16 | ASAGQISV | 77.72 | ASAGQIST | 9.15 | ASAGQYS | 9.01 | ASAGQYSV | 0.17 |
| NP | N/A | 424 | 1.17 | yes | 5 | 0.05 | 99.44 | SAGQISVQ | 78.14 | SAGQTSVQ | 9.15 | SAGQISI | 6.44 | SAGQYSVQ | 0.21 |
| NP | N/A | 425 | 1.17 | yes | 4 | 0.01 | 99.59 | AGQISVQP | 78.14 | AGQTSVQP | 9.16 | AGQISIQ | 6.44 | AGQYSVQP | 0.11 |
| NP | N/A | 429 | 0.79 | yes | 2 | 0 | 99.79 | SVQPTFSV | 86.34 | SIQPTFSV | 6.44 | SVQPAFSV | 0.78 | | |
| NP | N/A | 430 | 0.79 | yes | 2 | 0.01 | 99.78 | VQPTFSVQ | 86.33 | IQPTFSVQ | 6.44 | VQPAFSVQ | 5.09 | | |
| NP | N/A | 431 | 0.15 | yes | 2 | 0.01 | 99.13 | QPTFSVQR | 98.13 | QPAFSVQR | 5.1 | | | | |
| NP | N/A | 432 | 0.28 | yes | 2 | 0.01 | 99.69 | PTFSVQRN | 96.51 | PTFSVQRS | 1.65 | | | | |
| NP | N/A | 433 | 0.3 | yes | 3 | 0.01 | 99.53 | TFSVQRNL | 96.34 | TFSVQRSL | 1.65 | | 1.54 | | |

FIG. 72-346

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 434 | 0.17 | yes | 2 | 0.01 | 99.57 | FSVQRNLP | 98 | FSVQRSLP | 1.57 | |

FIG. 72-347

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 510 | 0.2 | yes | 2 | 2.06 | 99.32 | NEGSYFFG | 97.8 | KEGSYFFG | 1.52 | | | | |
| NP | N/A | 511 | 0.08 | yes | 1 | 2.63 | 99.35 | EGSYFFGD | 99.35 | | | | | | |
| NP | N/A | 512 | 0.1 | yes | 1 | 3.02 | 99.18 | GSYFFGDN | 99.18 | | | | | | |
| NP | N/A | 513 | 0.09 | yes | 1 | 3.25 | 99.27 | SYFFGDNA | 99.27 | | | | | | |
| NP | N/A | 514 | 0.13 | yes | 2 | 3.85 | 99.12 | YFFGDNAE | 98.94 | YFFGDNAK | 0.18 | | | | |
| NP | N/A | 515 | 0.15 | yes | 3 | 4.91 | 99.11 | FFGDNAEE | 98.74 | FFGDNAKE | 0.18 | FFGDSAEE | 0.18 | | |
| NP | N/A | 516 | 0.27 | yes | 3 | 5.88 | 99.06 | FGDNAEEY | 97.14 | FGDNAEEF | 1.73 | FGDSAEEY | 0.18 | | |
| NP | N/A | 520 | 0 | no | 1 | 99.99 | 100 | AEEYRRLR | 100 | | | | | | |
| NSI | N/A | 1 | 0 | no | 1 | 99.96 | 100 | MLFVQSYF | 100 | | | | | | |
| NSI | N/A | 2 | 0 | no | 1 | 99.96 | 100 | LFVQSYFQ | 100 | | | | | | |
| NSI | N/A | 3 | 0 | no | 1 | 99.96 | 100 | FVQSYFQL | 100 | | | | | | |
| NSI | N/A | 4 | 0 | no | 1 | 99.96 | 100 | VQSYFQLF | 100 | | | | | | |
| NSI | N/A | 5 | 0 | no | 1 | 99.96 | 100 | QSYFQLFL | 100 | | | | | | |
| NSI | N/A | 6 | 0 | no | 1 | 99.96 | 100 | SYFQLFLV | 100 | | | | | | |
| NSI | N/A | 7 | 0 | no | 1 | 99.96 | 100 | YFQLFLVC | 100 | | | | | | |
| NSI | N/A | 8 | 0 | no | 1 | 99.96 | 100 | FQLFLVCY | 100 | | | | | | |
| NSI | N/A | 9 | 0 | no | 1 | 99.96 | 100 | QLFLVCYS | 100 | | | | | | |
| NSI | N/A | 10 | 0 | no | 1 | 99.96 | 100 | LFLVCYSL | 100 | | | | | | |
| NSI | N/A | 11 | 0 | no | 1 | 99.96 | 100 | FLVCYSLL | 100 | | | | | | |
| NSI | N/A | 12 | 0 | no | 1 | 99.96 | 100 | LVCYSLLQ | 100 | | | | | | |
| NSI | N/A | 13 | 0 | no | 1 | 99.96 | 100 | VCYSLLQS | 100 | | | | | | |
| NSI | N/A | 14 | 0 | no | 1 | 99.96 | 100 | CYSLLQSA | 100 | | | | | | |
| NSI | N/A | 15 | 0 | no | 1 | 99.96 | 100 | YSLLQSAI | 100 | | | | | | |
| NSI | N/A | 16 | 0 | no | 1 | 99.96 | 100 | SLLQSAIL | 100 | | | | | | |
| NSI | N/A | 17 | 0 | no | 1 | 99.96 | 100 | LLQSAILS | 100 | | | | | | |
| NSI | N/A | 24 | 0.65 | yes | 3 | 2.15 | 99.25 | SSFQVDCF | 88.36 | TSFQVDCY | 9.61 | | | | |
| NSI | N/A | 25 | 0.56 | yes | 2 | 1.98 | 99.21 | SFQVDCFL | 89.57 | SFQVDCYL | 9.64 | | | | |
| NSI | N/A | 26 | 0.56 | yes | 2 | 0.82 | 99.25 | FQVDCFLW | 89.31 | FQVDCYLW | 9.94 | | | | |
| NSI | N/A | 27 | 0.59 | yes | 3 | 0.66 | 99.2 | QVDCFLWH | 89.05 | QVDCYLWH | 9.9 | VDCFIWHI | 0.17 | | |
| NSI | N/A | 28 | 1.5 | yes | 4 | 0.48 | 99.02 | VDCFLWHI | 46.94 | VDCYLWHI | 42.09 | DCFIWHIR | 0.17 | | |
| NSI | N/A | 29 | 1.5 | yes | 4 | 0.35 | 99.01 | DCFLWHVR | 46.98 | DCYLWHIR | 42.04 | | | | |
| NSI | N/A | 45 | 1.17 | yes | 3 | 0.01 | 99.2 | GDAPFLDR | 73.57 | CDAPFDDR | 15.77 | | | | |
| NSI | N/A | 46 | 0.6 | yes | 3 | 0.01 | 99.07 | DAPFLDRL | 89.01 | DAPFDDRL | 9.84 | | | | |
| NSI | N/A | 47 | 0.61 | yes | 3 | 0.05 | 99.02 | APFLDRLR | 88.95 | APFDDRLR | 9.83 | | | | |
| NSI | N/A | 48 | 0.6 | yes | 3 | 0.07 | 99.09 | PFLDRLRR | 89.01 | PFDDRLRR | 9.82 | | | | |
| NSI | N/A | 49 | 0.61 | yes | 3 | 0.07 | 99.03 | FLDRLRRD | 88.94 | FDDRLRRD | 9.83 | | | | |
| NSI | N/A | 50 | 0.92 | yes | 2 | 99.96 | 100 | SLLLQAN | 66.67 | SLLLQANL | 33.33 | | | | |
| NSI | N/A | 51 | 0.92 | yes | 2 | 99.96 | 100 | LLLQANLC | 66.67 | LLLQANL | 33.33 | | | | |
| NSI | N/A | 52 | 0 | no | 1 | 99.96 | 100 | LLQANLCR | 100 | | | | | | |
| NSI | N/A | 53 | 0 | no | 1 | 99.96 | 100 | LQANLCRF | 100 | | | | | | |
| NSI | N/A | 54 | 0 | no | 1 | 99.96 | 100 | QANLCRFL | 100 | | | | | | |

FIG. 72-348

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| NS1 | N/A | 56 | 0 | no | — | 99.96 | 100 | ANLCRFLE | 100 | | | | | | |
| NS1 | N/A | 57 | 0 | no | — | 99.96 | 100 | NLCRFLET | 100 | | | |

FIG. 72-349

| Protein | Sub-type | Start Pos | Block | Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|---|
| NS1 | N/A | 294 | | 0 | no | 1 | 99.99 | 100 | ENSFEQIT | 100 | | | | | | |
| NS1 | N/A | 295 | | 0 | no | 1 | 99.99 | 100 | NSFEQITF | 100 | | | | | | |
| NS1 | N/A | 296 | | 0 | no | 1 | 99.99 | 100 | SFEQITFM | 100 | | | | | | |
| NS1 | N/A | 297 | | 0 | no | 1 | 99.99 | 100 | FEQITFMQ | 100 | | | | | | |
| NS1 | N/A | 298 | | 0 | no | 1 | 99.99 | 100 | EQITFMQA | 100 | | | | | | |
| NS1 | N/A | 299 | | 0 | no | 1 | 99.99 | 100 | QITFMQAL | 100 | | | | | | |
| NS1 | N/A | 300 | | 0 | no | 1 | 99.99 | 100 | ITFMQALQ | 100 | | | | | | |
| NS1 | N/A | 301 | | 0 | no | 1 | 99.99 | 100 | TFMQALQL | 100 | | | | | | |
| NS2 | N/A | 1 | | 0 | no | 1 | 99.99 | 100 | TAFSGMSA | 100 | | | | | | |
| NS2 | N/A | 2 | | 0 | no | 1 | 99.99 | 100 | AFSGMSAN | 100 | | | | | | |
| NS2 | N/A | 3 | | 0 | no | 1 | 99.99 | 100 | FSGMSANG | 100 | | | | | | |
| NS2 | N/A | 4 | | 0 | no | 1 | 99.99 | 100 | SGMSANGD | 100 | | | | | | |
| NS2 | N/A | 5 | | 0 | no | 1 | 99.99 | 100 | GMSANGDI | 100 | | | | | | |
| NS2 | N/A | 14 | | 0 | no | 1 | 99.95 | 100 | FQYLLFQD | 100 | | | | | | |
| NS2 | N/A | 15 | | 0.86 | no | 2 | 99.95 | 100 | QYLLFQDI | 71.43 | FQVDCFLW | 28.57 | | | | | |
| NS2 | N/A | 16 | | 0.86 | no | 2 | 99.95 | 100 | YLLFQDIL | 71.43 | QVDCFLWH | 28.57 | | | | | |
| NS2 | N/A | 17 | | 0.86 | no | 2 | 99.95 | 100 | LLFQDILM | 71.43 | VDCFLWHV | 28.57 | | | | | |
| NS2 | N/A | 18 | | 0.86 | no | 2 | 99.95 | 100 | LFQDILMR | 71.43 | DCFLWHVR | 28.57 | | | | | |
| NS2 | N/A | 20 | | 0.86 | no | 2 | 99.95 | 100 | LWHYRKRF | 71.43 | CFLWHVRK | 28.57 | | | | | |
| NS2 | N/A | 21 | | 0 | no | 1 | 99.99 | 100 | WHYRKRFA | 100 | | | | | | |
| NS2 | N/A | 22 | | 0 | no | 1 | 99.99 | 100 | HYRKRFAD | 100 | | | | | | |
| NS2 | N/A | 23 | | 0 | no | 1 | 99.99 | 100 | YRKRFADQ | 100 | | | | | | |
| NS2 | N/A | 24 | | 0 | no | 1 | 99.99 | 100 | RKRFADQE | 100 | | | | | | |
| NS2 | N/A | 25 | | 0 | no | 1 | 99.99 | 100 | KRFADQEL | 100 | | | | | | |
| NS2 | N/A | 26 | | 0 | no | 1 | 99.99 | 100 | RFADQELG | 100 | | | | | | |
| NS2 | N/A | 27 | | 0 | no | 1 | 99.99 | 100 | FADQELGD | 100 | | | | | | |
| NS2 | N/A | 28 | | 0 | no | 1 | 99.99 | 100 | ADQELGDA | 100 | | | | | | |
| NS2 | N/A | 29 | | 0 | no | 1 | 99.99 | 100 | DQELGDAP | 100 | | | | | | |
| NS2 | N/A | 30 | | 0 | no | 1 | 99.99 | 100 | QELGDAPF | 100 | | | | | | |
| NS2 | N/A | 31 | | 0 | no | 1 | 99.99 | 100 | ELGDAPFL | 100 | | | | | | |
| NS2 | N/A | 32 | | 0 | no | 1 | 99.99 | 100 | LGDAPFLD | 100 | | | | | | |
| NS2 | N/A | 33 | | 0 | no | 1 | 99.99 | 100 | GDAPFLDR | 100 | | | | | | |
| NS2 | N/A | 34 | | 0 | no | 1 | 99.99 | 100 | DAPFLDRL | 100 | | | | | | |
| NS2 | N/A | 35 | | 0 | no | 1 | 99.99 | 100 | APFLDRLR | 100 | | | | | | |
| NS2 | N/A | 36 | | 0 | no | 1 | 99.99 | 100 | PFLDRLRR | 100 | | | | | | |
| NS2 | N/A | 37 | | 0 | no | 1 | 99.99 | 100 | FLDRLRRD | 100 | | | | | | |
| NS2 | N/A | 38 | | 0 | no | 1 | 99.99 | 100 | LDRLRRDQ | 100 | | | | | | |
| NS2 | N/A | 39 | | 0 | no | 1 | 99.99 | 100 | DRLRRDQK | 100 | | | | | | |
| NS2 | N/A | 40 | | 0 | no | 1 | 99.99 | 100 | RLRRDQKS | 100 | | | | | | |
| NS2 | N/A | 41 | | 0 | no | 1 | 99.99 | 100 | LRRDQKSL | 100 | | | | | | |
| NS2 | N/A | 42 | | 0 | no | 1 | 99.99 | 100 | RRDQKSLR | 100 | | | | | | |
| NS2 | N/A | 43 | | 0 | no | 1 | 99.99 | 100 | RDQKSLRG | 100 | | | | | | |

FIG. 72-350

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NS2 | N/A | 44 | 0 | no | - | 99.99 | 100 | DQKSLRGR | 100 | | | | | | |
| NS2 | N/A | 45 | 0 | no | - | 99.99 | 100 | QKSLRGRG | 100 | | | | | | |
| NS2 | N/A | 46 | 0 | no | - | 99.99 | 100 | KSLRGRGS | 100 | | | | | | |
| NS2 | N/A | 47 | 0 | no | - | 99.99 | 100 | SLRGRGST | 100 | | | | | | |
| NS2 | N/A | 48 | 0 | no | - | 99.99 | 100 | LRGRGSTL | 100 | | | | | | |
| NS2 | N/A | 49 | 0 | no | - | 99.99 | 100 | RGRGSTLG | 100 | | | | | | |
| NS2 | N/A | 50 | 0 | no | - | 99.99 | 100 | GRGSTLGL | 100 | | | | | | |
| NS2 | N/A | 51 | 0 | no | - | 99.99 | 100 | RGSTLGLD | 100 | | | | | | |
| NS2 | N/A | 52 | 0 | no | - | 99.99 | 100 | GSTLGLDI | 100 | | | | | | |
| NS2 | N/A | 53 | 0 | no | - | 99.99 | 100 | STLGLDIR | 100 | | | | | | |
| NS2 | N/A | 54 | 0 | no | - | 99.99 | 100 | TLGLDIRT | 100 | | | | | | |
| NS2 | N/A | 55 | 0 | no | - | 99.99 | 100 | LGLDIRTA | 100 | | | | | | |
| NS2 | N/A | 56 | 0 | no | - | 99.99 | 100 | GLDIRTAT | 100 | | | | | | |
| NS2 | N/A | 57 | 0 | no | - | 99.99 | 100 | LDIRTATR | 100 | | | | | | |
| NS2 | N/A | 58 | 0 | no | - | 99.99 | 100 | DIRTATRE | 100 | | | | | | |
| NS2 | N/A | 59 | 0 | no | - | 99.99 | 100 | IRTATREG | 100 | | | | | | |
| NS2 | N/A | 60 | 0 | no | - | 99.99 | 100 | RTATREGK | 100 | | | | | | |
| NS2 | N/A | 61 | 0 | no | - | 99.99 | 100 | TATREGKH | 100 | | | | | | |
| NS2 | N/A | 62 | 0 | no | - | 99.99 | 100 | ATREGKHI | 100 | | | | | | |
| NS2 | N/A | 63 | 0 | no | - | 99.99 | 100 | TREGKHIV | 100 | | | | | | |
| NS2 | N/A | 64 | 0 | no | - | 99.99 | 100 | REGKHIVE | 100 | | | | | | |
| NS2 | N/A | 65 | 0 | no | - | 99.99 | 100 | EGKHIVER | 100 | | | | | | |
| NS2 | N/A | 66 | 0 | no | - | 99.99 | 100 | GKHIVERI | 100 | | | | | | |
| NS2 | N/A | 67 | 0 | no | - | 99.99 | 100 | KHIVERIL | 100 | | | | | | |
| NS2 | N/A | 68 | 0 | no | - | 99.99 | 100 | HIVERILE | 100 | | | | | | |
| NS2 | N/A | 69 | 0 | no | - | 99.99 | 100 | IVERILEE | 100 | | | | | | |
| NS2 | N/A | 70 | 0 | no | - | 99.99 | 100 | VERILEEE | 100 | | |

FIG. 72-351

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NS2 | N/A | 86 | — | no | 2 | 99.99 | 100 | IASDILTR | 50 | IASDILKR | 50 | | | | |
| NS2 | N/A | 87 | — | no | 2 | 99.99 | 100 | ASDILTRM | 50 | ASDILKRM | 50 | | | | |
| NS2 | N/A | 101 | 0 | no | 1 | 99.99 | 100 | RPHPEDLN | 100 | | | | | | |
| NS2 | N/A | 147 | 1.42 | yes | 4 | 0.01 | 99.26 | QLGQKFEE | 57.21 | QLSQKFEE | 32.45 | QLSHKFEE | 9.26 | | |
| NS2 | N/A | 148 | 1.26 | yes | 4 | 0.01 | 99.02 | LGQKFEEI | 55.04 | LSQKFEEI | 41.39 | LSQKFEEM | 2.24 | | |
| NS2 | N/A | 150 | 0.39 | yes | 2 | 0.01 | 99.06 | QKFEEIRW | 95.28 | QKFEEIKW | 2.29 | QKFEEMRW | 1.12 | | |
| NS2 | N/A | 151 | 0.38 | yes | 2 | 0.01 | 99.17 | KFEEIRWL | 95.34 | KFEEIKWL | 2.35 | KFEEMRWL | 1.13 | | |
| NS2 | N/A | 152 | 0.4 | yes | 2 | 0.01 | 99.01 | FEEIRWLI | 95.17 | FEEIKWLI | 2.35 | FEEMRWLI | 1.13 | | |
| NS2 | N/A | 169 | 0.15 | yes | 2 | 0.01 | 99.38 | TENSFEQI | 98.53 | TESSFEQI | 0.85 | | | | |
| NS2 | N/A | 170 | 0.14 | yes | 2 | 0.01 | 99.44 | ENSFEQIT | 98.59 | ESSFEQIT | 0.85 | | | | |
| NS2 | N/A | 171 | 0.14 | yes | 2 | 0.02 | 99.46 | NSFEQITF | 98.61 | SSFEQITF | 0.85 | | | | |
| NS2 | N/A | 172 | 0.56 | yes | 3 | 0.01 | 99.02 | SFEQITFL | 89.49 | SFEQITFM | 9.53 | | | | |
| NS2 | N/A | 173 | 0.57 | yes | 3 | 0.01 | 99.01 | FEQITFLQ | 89.47 | FEQITFMQ | 9.54 | | | | |
| NS2 | N/A | 174 | 0.55 | yes | 3 | 0 | 99.17 | EQITFLQA | 89.63 | EQITFMQA | 9.54 | | | | |
| NS2 | N/A | 175 | 0.54 | yes | 3 | 0 | 99.23 | QITFLQAL | 89.7 | QITFMQAL | 9.53 | | | | |
| NS2 | N/A | 176 | 0.56 | yes | 3 | 0 | 99.09 | ITFLQALQ | 89.55 | ITFMQALQ | 9.51 | | | | |
| NS2 | N/A | 177 | 0.57 | yes | 3 | 0.01 | 99.27 | TFLQALQL | 89.4 | TFMQALQL | 9.53 | THIQALQL | 0.34 | | |
| NS2 | N/A | 178 | 0.58 | yes | 3 | 0.01 | 99.24 | FLQALQLL | 89.39 | FMQALQLL | 9.54 | FIQALQLL | 0.34 | | |
| NS2 | N/A | 179 | 1.35 | yes | 4 | 0.02 | 99.09 | MQALQLLL | 64.04 | LQALQLLL | 25.36 | IQALQ

FIG. 72-352

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 7 | 0.41 | yes | 4 | 3.77 | 99.07 | QCFN

FIG. 72-353

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 76 | 0.06 | yes | 1 | 0.01 | 99.5 | FEIIEGRD | 99.5 | | | | | | |
| PA | N/A | 77 | 0.06 | yes | 1 | 0.01 | 99.5 | EIIEGRDR | 99.5 | | | | | | |
| PA | N/A | 78 | 1.08 | yes | 4 | 0.01 | 99.39 | IIEGRDRI | 72.81 | IIEGRDRN | 23.42 | IIEGRDRA | 2.21 | IIEGRDRA | 0.86 |
| PA | N/A | 79 | 1.18 | yes | 5 | 0.02 | 99 | EGRDRIMA | 71.65 | EGRDRNMA | 23.38 | EGRDRAMA | 2.19 | GRDRTIA | 0.86 |
| PA | N/A | 80 | 1.18 | yes | 5 | 0.02 | 99.02 | GRDRIMAW | 71.66 | GRDRNMAW | 23.38 | GRDRAMAW | 2.19 | AWTAVNSI | 0.28 |
| PA | N/A | 81 | 0.25 | yes | 5 | 0.05 | 99.21 | AWTVNSLC | 97.58 | AWTVNSI | 0.64 | AWTVNSI | 0.37 | WTAVNSI | 0.28 |
| PA | N/A | 87 | 0.25 | yes | 5 | 0.05 | 99.16 | WTVVNSLC | 97.52 | WTVVNSI | 0.65 | WTVVNSI | 0.37 | KPKSLPDL | 0.45 |
| PA | N/A | 88 | 0.35 | yes | 5 | 0.04 | 99.37 | KPRFLPDL | 95.96 | KPRYLPDL | 1.67 | KPRYLPDL | 0.79 | PKSLPDLY | 0.45 |
| PA | N/A | 102 | 0.35 | yes | 5 | 0.03 | 99.37 | PKFLPDLY | 95.96 | PRYLPDLY | 1.67 | PKYLPDLY | 0.79 | KSLPDLYD | 0.45 |
| PA | N/A | 103 | 0.35 | yes | 3 | 0.03 | 99.37 | KFLPDLYD | 95.96 | RYLPDLYD | 1.67 | KYLPDLYD | 0.79 | | |
| PA | N/A | 104 | 0.21 | yes | 3 | 0.03 | 99.45 | LPDLYDYK | 97.7 | SLPDLYDY | 1.29 | | 0.46 | | |
| PA | N/A | 105 | 0.04 | yes | 1 | 0.03 | 99.68 | PDLYDYKE | 99.68 | | | | | | |
| PA | N/A | 106 | 0.08 | yes | 4 | 0.03 | 99.35 | DLYDYKED | 96.24 | DLYDYKES | 2.32 | DLYDYKKN | 0.34 | | |
| PA | N/A | 107 | 0.32 | yes | 4 | 0.02 | 99.19 | LYDYKEDR | 96.22 | LYDYKESR | 2.32 | LYDYKKNR | 0.34 | | |
| PA | N/A | 108 | 0.32 | yes | 4 | 0.03 | 99.17 | YDYKEDRF | 96.25 | YDYKESRF | 2.32 | YDYKKNRF | 0.34 | | |
| PA | N/A | 109 | 0.37 | yes | 4 | 0.02 | 99.2 | DYKENRF | 95.08 | RFLEIGVT | 3.17 | RFTEIGVT | 0.65 | | |
| PA | N/A | 110 | 0.36 | yes | 4 | 0.03 | 99.41 | RHEIGVT | 95.14 | FLEIGVTR | 3.17 | FTEIGVTR | 0.65 | | |
| PA | N/A | 116 | 0.36 | yes | 4 | 0.03 | 99.47 | FLEIGVTR | 95.12 | LEIGVTRR | 3.17 | TEIGVTRR | 0.65 | | |
| PA | N/A | 117 | 0.08 | yes | 1 | 0.02 | 99.46 | IEIGVTRR | 99.31 | | | | | | |
| PA | N/A | 118 | 0.14 | yes | 2 | 0.03 | 99.24 | EIGVTRRE | 98.6 | IGVTRREI | 0.64 | | | | |
| PA | N/A | 119 | 0.12 | yes | 2 | 0.05 | 99.52 | IGVTRREV | 98.86 | GVTRREIH | 0.65 | | | | |
| PA | N/A | 120 | 0.62 | yes | 4 | 0.05 | 99 | GVTRREVH | 89.95 | VTRREVHV | 7.74 | VTRREIHI | 0.67 | VTRREHV | 0.44 |
| PA | N/A | 121 | 0.61 | yes | 4 | 0.05 | 99.04 | VTRREVHI | 89.99 | TRREVHVY | 7.74 | TRREIHIY | 0.67 | EVHMYYLE | 0.44 |
| PA | N/A | 122 | 0.61 | yes | 4 | 0.05 | 99.03 | TRREVHI | 89.99 | RREVHVYY | 7.73 | RREIHIYY | 0.66 | VHMYYLEK | 0.44 |
| PA | N/A | 123 | 0.64 | yes | 4 | 0.06 | 99.23 | REVHIYY | 89.9 | REVHVYYL | 7.58 | REVHIIY | 0.66 | | |
| PA | N/A | 124 | 0.65 | yes | 4 | 0.06 | 99.25 | EVHTYYL | 89.99 | EVHVYYLE | 7.5 | EIHIYYLE | 0.66 | | |
| PA | N/A | 125 | 0.63 | yes | 4 | 0.07 | 99.14 | VHIYYLEK | 89.99 | IHIYYLEK | 7.5 | VHMYYLEK | 0.66 | IYYLEKAS | 0.27 |
| PA | N/A | 126 | 0.59 | yes | 4 | 0.05 | 99.02 | HIYYLEKA | 90.54 | HYYLEKA | 7.49 | HMYYLEKA | 0.66 | | |
| PA | N/A | 127 | 0.62 | yes | 5 | 0.03 | 99.21 | IYYLEKAN | 90.3 | YYLEKAN | 7.43 | MYYLEKAN | 0.58 | | |
| PA | N/A | 128 | 0.13 | yes | 2 | 0.05 | 99.11 | YYLEKANK | 98.78 | YLEKASK | 0.43 | | | | |
| PA | N/A | 129 | 0.15 | yes | 2 | 0.05 | 99.08 | YLEKANKI | 98.67 | LEKASKI | 0.43 | | | | |
| PA | N/A | 130 | 0.2 | yes | 3 | 0.07 | 99.1 | LEKANKIK | 98.65 | EKANKIIKT | 0.63 | EKASKIKS | 0.43 | | |
| PA | N/A | 131 | 0.22 | yes | 4 | 0.05 | 99.19 | EKANKIKS | 98.05 | KANKIIKTE | 0.51 | KASKIKSE | 0.43 | KSNKIKSE | 0.43 |
| PA | N/A | 132 | 0.99 | yes | 2 | 0.07 | 99.41 | KANKIKSE | 97.99 | ANKIIKTEN | 18.35 | ASKIKSE | 0.63 | KSNKIKSE | 0.43 |
| PA | N/A | 133 | 0.97 | yes | 1 | 0.05 | 99.65 | EKTHIHIF | 78.22 | EETHIHIF | 18.38 | | | | |
| PA | N/A | 134 | 0.05 | yes | 1 | 0.07 | 99.23 | KTHIHIFS | 78.41 | ETHIHIFS | | ERTHIHIF | 1.21 | EDTHIHIF | 0.17 |
| PA | N/A | 141 | 0.15 | yes | 2 | 0.05 | 99.32 | THIHIFSF | 99.65 | | | RTHIHIFS | 1.21 | DTHIHIFS | 0.95 |
| PA | N/A | 142 | 0.14 | yes | 1 | 0.05 | 99.19 | HIHIFSFN | 98.5 | HIHIFSFN | 0.73 | | | | 0.95 |
| PA | N/A | 143 | 0.14 | yes | 2 | 0.05 | 99.11 | IHIFSFT | 98.59 | IHIFSFNG | 0.73 | | | | |
| PA | N/A | 144 | 0.14 | yes | 2 | 0.05 | 99.08 | IHIFSFT | 98.59 | | 0.73 | | | | |
| PA | N/A | 145 | 0.14 | yes | 2 | 0.05 | 99.41 | HIFSFTG | 98.63 | HIFSFNGE | 0.73 | | | | |
| PA | N/A | 146 | 0.14 | yes | 2 | 0.05 | 99.36 | HIFSFTGE | 98.63 | HIFSFNGE | 0.73 | | | | |
| PA | N/A | 147 | 0.14 | yes | 2 | 0.05 | 99.36 | IFSFTGEE | 98.63 | IFSFNGEE | | | | | |

FIG. 72-354

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 148 | 0.14 | yes | 2 | 0.04 | 99.32 | FSFTGEEM | 98.59 | FSFNGEEM | 0.73 | | | | |
| PA | N/A | 149 | 0.15 | yes | 2 | 0.03 | 99.21 | SFTGEEMA | 98.47 | SFNGEEMA | 0.74 | | | | |
| PA | N/A | 150 | 0.21 | yes | 5 | 0.05 | 99.01 | FTGEEMAT | 97.89 | FNGEEMAT | 0.75 | | | | |
| PA | N/A | 151 | 0.31 | yes | 4 | 0.06 | 99.2 | TGEEMATK | 96.75 | TGEEMAS | 1.01 | FTGEEMAS | | IGEEMATK | 0.32 |
| PA | N/A | 152 | 0.25 | yes | 4 | 0.04 | 99.08 | GEEMATKA | 97.5 | GEEMATRA | 0.99 | TGEEMASK | 0.36 | | |
| PA | N/A | 160 | 0.21 | yes | 2 | 0.04 | 99.09 | DYTLDEES | 97.97 | DYTIDEES | 0.69 | GEEMAAKA | 0.23 | | |
| PA | N/A | 161 | 0.16 | yes | 2 | 0.04 | 99.11 | YTLDEESR | 98.42 | YTIDEESR | 0.69 | DYILDEES | 0.2 | | |
| PA | N/A | 162 | 0.13 | yes | 2 | 0.03 | 99.38 | TLDEESRA | 98.69 | TIDEESRA | 0.69 | | | | |
| PA | N/A | 163 | 0.11 | yes | 2 | 0.04 | 99.62 | LDEESRAR | 98.92 | IDEESRAR | 0.69 | | | | |
| PA | N/A | 164 | 0 | yes | 1 | 99.99 | 100 | ASKSRAR | 100 | | | | | | |
| PA | N/A | 165 | 0.07 | yes | 1 | 0.03 | 99.41 | DEESRARI | 99.41 | | | | | | |
| PA | N/A | 166 | 0.07 | yes | 1 | 0.03 | 99.43 | EESRARIIK | 99.43 | | | | | | |
| PA | N/A | 167 | 0.05 | yes | 1 | 0.03 | 99.6 | ESRARIKT | 99.61 | | | | | | |
| PA | N/A | 168 | 0.05 | yes | 1 | 0.03 | 99.61 | SRARIIKTR | 99.6 | | | | | | |
| PA | N/A | 169 | 0.05 | yes | 1 | 0.04 | 99.6 | RARIIKTRL | 99.6 | | | | | | |
| PA | N/A | 170 | 0.08 | yes | 1 | 0.03 | 99.28 | ARIIKTRLF | 99.28 | | | | | | |
| PA | N/A | 171 | 0.05 | no | 1 | 0.03 | 99.21 | RIKTRLFT | 99.21 | | | | | | |
| PA | N/A | 172 | 0.05 | yes | 1 | 0.03 | 99.13 | IKTRLFTI | 99.13 | | | | | | |
| PA | N/A | 173 | 0.05 | yes | 1 | 0.03 | 99.33 | KTRLFTIR | 99.33 | | | | | | |
| PA | N/A | 174 | 0.09 | yes | 1 | 0.03 | 99.32 | TRLFTIRQ | 99.32 | | | | | | |
| PA | N/A | 175 | 0.09 | yes | 1 | 0.05 | 99.24 | RLFTIRQE | 99.24 | LFTIRQEL | 0.42 | | | | |
| PA | N/A | 176 | 0.1 | yes | 2 | 0.05 | 99.26 | LFTIRQEM | 98.84 | FTIRQELA | 0.42 | | | | |
| PA | N/A | 177 | 0.08 | yes | 2 | 0.06 | 99.21 | FTIRQEMA | 98.8 | TIRQEMAI | 18.59 | TIRQELAS | 1.32 | IRQEMASK | 0.34 |
| PA | N/A | 178 | 0.13 | yes | 4 | 0.07 | 99.19 | TIRQEMAS | 78.89 | IRQEMAIR | 18.58 | IRQELASR | 1.31 | | |
| PA | N/A | 179 | 0.13 | yes | 5 | 0.07 | 99.2 | IRQEMASK | 78.61 | KGLWDSFR | 23.68 | | 0.35 | | |
| PA | N/A | 186 | 0.92 | yes | 3 | 0.07 | 99 | RGLWDSFR | 74.98 | GLWDPFRQ | 23.65 | | 0.29 | | |
| PA | N/A | 187 | 0.95 | yes | 3 | 0.05 | 99.24 | GLWDSFRQ | 75.3 | | | | | | |
| PA | N/A | 188 | 0.93 | yes | 3 | 0.07 | 99.06 | LWDSFRQS | 99.06 | | | | | | |
| PA | N/A | 189 | 0.91 | yes | 3 | 0.07 | 99.26 | WDSFRQSE | 99.26 | | | | | | |
| PA | N/A | 190 | 0.11 | yes | 1 | 0.05 | 99.13 | DSFRQSER | 99.13 | | | | | | |
| PA | N/A | 191 | 0.1 | yes | 1 | 0.05 | 99.2 | SFRQSERG | 99.2 | | | | | | |
| PA | N/A | 192 | 0.09 | yes | 2 | 0.06 | 99.5 | FRQSERGE | 99.5 | RQSERGED | 2.08 | SERGEETV | 2.08 | GEETVEER | 0.69 |
| PA | N/A | 193 | 0.06 | yes | 2 | 0.06 | 99.46 | RQSERGEE | 97.38 | QSERGEDT | 2.08 | ERGEETYE | 2.08 | EETVEERF | 0.69 |
| PA | N/A | 194 | 0.21 | yes | 4 | 0.06 | 99.45 | QSERGEET | 97.52 | SERGEDTI | 2.08 | RGEETYEE | 2.08 | ETVEERFE | 0.68 |
| PA | N/A | 195 | 0.2 | yes | 5 | 0.06 | 99.47 | SERGEETI | 96.7 | ERGEDTIE | 2.09 | GEDTIEER | 2.06 | | |
| PA | N/A | 196 | 0.27 | yes | 3 | 0.07 | 99.45 | ERGEETIE | 96.7 | RGEDTIEE | 47.72 | EDTIEERF | 2.06 | | |
| PA | N/A | 197 | 0.27 | yes | 3 | 0.07 | 99.51 | RGEETIEE | 96.69 | GEDTIEEK | 47.72 | DTIEERFE | 2.05 | | |
| PA | N/A | 198 | 0.27 | yes | 3 | 0.07 | 99.54 | GEETIEER | 49.04 | EETIEEKF | 47.61 | | | | |
| PA | N/A | 199 | 1.23 | yes | 4 | 0.09 | 99.51 | EETIEERF | 49.07 | ETIEERFE | | | | | |
| PA | N/A | 200 | 1.23 | yes | 4 | 0.09 | 99.2 | ETIEERFE | 48.86 | | | | | | |
| PA | N/A | 201 | 0 | no | 1 | 99.99 | 100 | RSIEEKFE | 100 | | | | | | |
| PA | N/A | 202 | 1.15 | yes | 3 | 0.09 | 99.15 | TIEEKFEI | 50.9 | TVEERFEI | 47.57 | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 295 | 0.55 | yes | 5 | 0.11 | 99.1 | SIEDPSHE | 92 | SIEDPNHE | 5.37 | SIEDPHE | 1.34 | SIENPSHE | 0.23 | SIEEPSHE | 0.15 |
| PA | N/A | 296 | 0.53 | yes | 4 | 0.11 | 99.12 | IEDPSHEG | 92.16 | IEDPNHEG | 5.39 | IEDPDHEG | 1.34 | IENPSHEG | 0.23 | | |
| PA | N/A | 297 | 0.53 | yes | 4 | 0.1 | 99.22 | EDPSHEGE | 92.27 | EDPNHEGE | 5.38 | EDPDHEGE | 1.34 | ENPSHEGE | 0.23 | | |
| PA | N/A | 298 | 0.52 | yes | 4 | 0.1 | 99.2 | DPSHEGEG | 92.25 | DPNHEGEG | 5.38 | DPDHEGEG | 1.34 | NPSHEGEG | 0.23 | | |
| PA | N/A | 299 | 0.49 | yes | 3 | 0.1 | 99.3 | PSHEGEGI | 92.57 | PNHEGEGI | 5.39 | PDHEGEGI | 1.35 | | | | |
| PA | N/A | 300 | 0.49 | yes | 3 | 0.1 | 99.31 | SHEGEGIP | 92.57 | NHEGEGIP | 5.39 | DHEGEGIP | 1.35 | | | | |
| PA | N/A | 301 | 0.07 | yes | 2 | 0.09 | 99.43 | HEGEGIPL | 99.43 | | | | | | | | |
| PA | N/A | 302 | 0.12 | yes | 1 | 0.07 | 99.33 | EGEGIPLY | 98.9 | EGEGIPLH | 0.44 | | | | | | |
| PA | N/A | 303 | 0.1 | yes | 1 | 0.08 | 99.06 | GEGIPLYD | 99.06 | | | | | | | | |
| PA | N/A | 304 | 0.11 | yes | 1 | 0.08 | 99.06 | EGIPLYDA | 99.02 | | | | | | | | |
| PA | N/A | 305 | 0.27 | yes | 3 | 0.08 | 99.31 | GIPLYDAI | 96.84 | GIPLHDAI | 2.06 | GIPLYDAV | 0.42 | IPLYDAVK | 0.28 | | |
| PA | N/A | 306 | 0.3 | yes | 4 | 0.07 | 99.14 | IPLYDAIK | 96.66 | IPLHDAIK | 1.78 | IPLYDAVR | 0.42 | PLYDAVKC | 0.28 | | |
| PA | N/A | 307 | 0.29 | yes | 4 | 0.05 | 99.21 | PLYDAIKC | 96.72 | PLHDAIKC | 1.79 | PLYDAVRC | 0.42 | PLYDAVKC | 1.83 | | |
| PA | N/A | 313 | 1.34 | yes | 5 | 0.05 | 99.24 | KCIKTFFG | 72.25 | KCMRTFFG | 14.02 | KCMRTFFG | 9.61 | RCMKTFFG | 1.53 | KCIRTFFG | |
| PA | N/A | 314 | 1.2 | yes | 5 | 0.04 | 99.39 | CMKTFFGW | 74.14 | CMRTFFGW | 14.09 | CMRTFFGW | 9.62 | CIRTFFGW | 1.53 | MKTFFGWR | 0.46 |
| PA | N/A | 315 | 1.25 | yes | 5 | 0.04 | 99.35 | MKTFFGWK | 73.66 | MRTFFGWK | 14.08 | RCMTFFGW | 9.62 | IRTFFGWK | 1.53 | | |
| PA | N/A | 316 | 0.65 | yes | 2 | 0.05 | 99.14 | KTFFGWKE | 87.54 | KTFFGWRE | 11.13 | KTFFGWKE | 0.47 | | | | |
| PA | N/A | 317 | 0.13 | yes | 1 | 0.05 | 99.27 | TFFGWKEP | 98.8 | | | | | | | | |
| PA | N/A | 353 | 0 | no | 1 | 99.99 | 100 | LKDEEKIP | 100 | | | | | | | | |
| PA | N/A | 371 | 0.41 | yes | 4 | 0.04 | 99.11 | LKWALGEN | 94.82 | LRWALGEN | 2.93 | LKWVLGEN | 2.93 | LKWTLGEN | 0.61 | MWALGENM | 0.46 |
| PA | N/A | 372 | 0.44 | yes | 5 | 0.04 | 99.28 | KWALGENM | 94.52 | RWALGENM | 2.93 | KWVLGENM | 2.93 | KWTLGENM | 0.61 | | |
| PA | N/A | 373 | 0.2 | yes | 3 | 0.04 | 99.32 | WALGENMA | 97.93 | WVLGENMA | 0.77 | WTLGENMA | 0.77 | | | | |
| PA | N/A | 374 | 0.2 | yes | 2 | 0.05 | 99.3 | ALGENMAP | 97.91 | VLGENMAP | 0.77 | TLGENMAP | 0.77 | | | | |
| PA | N/A | 375 | 0.08 | yes | 1 | 0.05 | 99.31 | LGENMAPE | 99.31 | | | | | | | | |
| PA | N/A | 376 | 0.09 | yes | 1 | 0.05 | 99.26 | GENMAPEK | 99.26 | | | | | | | | |
| PA | N/A | 377 | 0.22 | yes | 3 | 0.04 | 99.04 | ENMAPEKV | 97.97 | ENMAPEKM | 0.65 | ENMAPEKI | 0.43 | | | | |
| PA | N/A | 378 | 0.2 | yes | 4 | 0.04 | 99.21 | NMAPEKVD | 97.91 | NMAPEKMD | 0.65 | NMAPEKID | 0.43 | NIAPEKVD | 0.23 | | |
| PA | N/A | 379 | 0.16 | yes | 3 | 0.04 | 99.14 | MAPEKVDF | 98.06 | MAPEKMDF | 0.65 | MAPEKIDF | 0.43 | | | | |
| PA | N/A | 380 | 1.67 | yes | 4 | 0.03 | 99.19 | APEKVDFD | 49.48 | APEKMDFE | 48.85 | APEKIDFE | 0.5 | APEKIDFE | 0.36 | | |
| PA | N/A | 411 | 1.03 | yes | 2 | 0.04 | 99.48 | WIQSEFNK | 42.61 | WVQNEFNK | 30.61 | WVQNEFNK | 25.26 | WVQSEFNK | — | | |
| PA | N/A | 412 | 1.03 | yes | 2 | 0.04 | 99.68 | IQSEFNKA | 42.62 | IQNEFNKA | 30.6 | IQSEFNKA | 25.26 | VQSEFNKA | — | | |
| PA | N/A | 413 | 0.03 | yes | 1 | 0.04 | 99.68 | QSEFNKAC | 55.87 | QNEFNKAC | 43.81 | | | | | | |
| PA | N/A | 414 | 0.04 | yes | 1 | 0.04 | 99.8 | SEFNKACE | 55.87 | SEFNKACE | 43.81 | | | | | | |
| PA | N/A | 415 | 0.09 | yes | 1 | 0.03 | 99.75 | EFNKACEL | 99.8 | | | | | | | | |
| PA | N/A | 416 | 0.09 | yes | 1 | 0.03 | 99.19 | FNKACELT | 99.75 | | | | | | | | |
| PA | N/A | 417 | 0 | no | 1 | 99.99 | 100 | NKACELTD | 99.19 | | | | | | | | |
| PA | N/A | 418 | 0 | no | 1 | 99.99 | 100 | KACELTDS | 100 | | | | | | | | |
| PA | N/A | 419 | 1.22 | yes | 5 | 0.03 | 99.23 | KTAYELTD | 73 | ACELTDS | 16.33 | ACELTDSI | 9.18 | ACELTDST | 0.48 | ACELTGSS | 0.25 |
| PA | N/A | 420 | 1.21 | yes | 4 | 0.03 | 99 | TAYELTDS | 73.01 | CELTDSW | 16.33 | CELTDSIW | 9.18 | CELTDSTW | 0.48 | | |
| PA | N/A | 421 | 0.34 | yes | 4 | 0.03 | 99.31 | ACELTDSS | 95.93 | WMELDEIG | 1.98 | WLELDEIG | 0.85 | WVELDEIG | 0.54 | | |
| PA | N/A | 422 | | yes | | | | CELTDSSW | | | | | | | | |
| PA | N/A | 429 | | yes | | | | WLELDEIG | | | | | | | | |

FIG. 72-357

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 430 | 0.38 | yes | 4 | 0.04 | 99.01 | IELDEIGE | 95.63 | MELDEIGE | 0.85 | VELDEIGE | 0.54 | | |
| PA | N/A | 431 | 0.12 | yes | 2 | 0.04 | 99.19 | ELDEIGED | 98.97 | LDEIGEDL | 0.56 | | | | |
| PA | N/A | 432 | 0.54 | yes | 3 | 0.05 | 99.04 | LDEIGEDV | 91.14 | DEIGEDLA | 0.56 | | | | |
| PA | N/A | 433 | 0.52 | yes | 3 | 0.05 | 99.3 | DEIGEDVA | 91.35 | EIGEDLAP | 0.56 | | | | |
| PA | N/A | 434 | 0.51 | yes | 3 | 0.05 | 99.3 | EIGEDVAP | 91.38 | IGEDLAPI | 0.56 | | | | |
| PA | N/A | 435 | 0.52 | yes | 3 | 0.05 | 99.39 | IGEDVAPI | 91.37 | GEDLAPIE | 0.56 | | | | |
| PA | N/A | 436 | 0.51 | yes | 5 | 0.06 | 99.39 | GEDVAPIE | 91.46 | EDIAPIEH | 5.44 | EDLAPIEY | 0.42 | | |
| PA | N/A | 437 | 1.08 | yes | 5 | 0.07 | 99.2 | EDVAPIEH | 79.63 | APIEVYAS | 0.46 | | | | |
| PA | N/A | 440 | 0.69 | yes | 5 | 0.09 | 99.39 | APIEHIAS | 85.28 | PIEYASM | 0.46 | | | | |
| PA | N/A | 441 | 0.77 | yes | 5 | 0.1 | 99.08 | PIEHIASM | 13.65 | IEYASMR | 0.46 | PIEHIASI | 0.18 | | |
| PA | N/A | 442 | 0.78 | yes | 5 | 0.12 | 99.02 | IEHIASMR | 13.55 | EYIASMRR | 0.46 | IEHIASIR | 0.18 | | |
| PA | N/A | 443 | 0.77 | yes | 5 | 0.12 | 99.1 | EHIASMRR | 13.55 | IASMRRNY | 0.3 | EHIASIRR | 0.18 | | |
| PA | N/A | 445 | 0.24 | yes | 3 | 0.11 | 99.17 | IASMRRNY | 84.64 | VASMRRNY | 0.3 | IASMRRSY | 0.2 | | |
| PA | N/A | 446 | 0.17 | yes | 4 | 0.1 | 99.02 | ASMRRNYF | 97.69 | ASMRRDYF | 0.25 | | | | |
| PA | N/A | 447 | 0.18 | yes | 3 | 0.11 | 99.14 | SMRRNYFT | 98.48 | SMRRDYFT | 0.25 | SMRRSYFT | 0.2 | | |
| PA | N/A | 450 | 0.15 | yes | 4 | 0.09 | 99.15 | RNYFTAEI | 98.39 | RRDYFTAE | 0.2 | RDYFTAEV | 0.2 | | |
| PA | N/A | 451 | 0.22 | yes | 4 | 0.09 | 99.05 | NYFTAEIS | 98.65 | RNYFTAEV | 0.2 | DYFTAEVS | 0.2 | | |
| PA | N/A | 452 | 0.23 | yes | 4 | 0.07 | 99.08 | YFTAEISH | 97.94 | NYFTAEVS | 0.2 | YFTTEVSH | 0.3 | | |
| PA | N/A | 453 | 0.23 | yes | 4 | 0.07 | 99.11 | FTAEISHC | 97.8 | YFTAEVSH | 0.73 | FTTEVSHC | 0.3 | | |
| PA | N/A | 454 | 0.23 | yes | 4 | 0.09 | 99.1 | TAEISHCR | 97.77 | FTAEVSYC | 0.73 | TTEVSHCR | 0.3 | | |
| PA | N/A | 455 | 0.23 | yes | 2 | 0.1 | 99.13 | AEISHCRA | 97.81 | TAEVSYCR | 0.73 | TEVSHCRA | 0.3 | | |
| PA | N/A | 456 | 0.18 | yes | 2 | 0.09 | 99.1 | EISHCRAT | 97.78 | AEVSYCRA | 0.84 | | | | |
| PA | N/A | 457 | 0.17 | yes | 1 | 0.09 | 99.1 | ISHCRATE | 98.26 | | 0.84 | | | | |
| PA | N/A | 458 | 0 | no | 1 | 99.99 | 100 | ISKSRATE | 98.31 | | 0.84 | | | | |
| PA | N/A | 459 | 0.1 | yes | 1 | 0.09 | 100 | SHCRATEY | 100 | | 0.85 | | | | |
| PA | N/A | 460 | 0.13 | yes | 2 | 0.09 | 99.19 | HCRATEYI | 99.19 | YCRATEYI | 0.3 | | | | |
| PA | N/A | 461 | 0.13 | yes | 2 | 0.07 | 99.17 | CRATEYIM | 98.86 | | | | | | |
| PA | N/A | 462 | 0.11 | yes | 2 | 0.06 | 99.02 | RATEYIMK | 99.02 | RATEYMMK | 0.26 | | | | |
| PA | N/A | 463 | 0.12 | yes | 2 | 0.05 | 99.17 | ATEYIMKG | 98.92 | ATEYMMKG | 0.26 | | | | |
| PA | N/A | 464 | 0.23 | yes | 2 | 0.05 | 99.21 | TEYIMKGV | 98.96 | TEYMMKGV | 0.26 | | | | |
| PA | N/A | 465 | 0.2 | yes | 2 | 0.04 | 99.18 | EYIMKGVY | 98.92 | EYMMKGVY | 0.26 | | | | |
| PA | N/A | 468 | 0.23 | yes | 3 | 0.03 | 99.04 | MKGVYINT | 98.75 | MKGVYYNT | 0.57 | IKGVYINT | 0.21 | | |
| PA | N/A | 469 | 0.22 | yes | 4 | 0.02 | 99.1 | KGVYINTA | 97.75 | KGVYYNTA | 0.57 | GVYINTAM | 0.42 | | |
| PA | N/A | 470 | 0.23 | yes | 4 | 0.02 | 99.24 | GVYINTAL | 98.02 | GVYYNTAL | 0.57 | VYINTAML | 0.42 | | |
| PA | N/A | 471 | 0.23 | yes | 4 | 0.02 | 99.22 | VYINTALL | 97.75 | VYYNTALL | 0.57 | YINTAMLN | 0.42 | | |
| PA | N/A | 472 | 0.22 | yes | 4 | 0.01 | 99.29 | YINTALLN | 97.73 | YMNTALLN | 0.57 | INTAMLNA | 0.42 | | |
| PA | N/A | 473 | 0.11 | yes | 1 | 0.01 | 99.29 | INTALLNA | 97.8 | YMNTALLNA | 0.57 | | | | |
| PA | N/A | 474 | 0.22 | yes | 4 | 0.02 | 99.04 | NTALLNAS | 97.8 | MNTALLNA | 0.57 | | | | |
| PA | N/A | 475 | 0.09 | yes | 1 | 0.03 | 99.14 | TALLNASC | 97.8 | | | | | | |
| PA | N/A | 476 | 0.11 | yes | 1 | 0.03 | 99 | ALLNASCA | 99.04 | MLNASCAA | 0.42 | | | | |
| PA | N/A | 477 | 0.14 | yes | 2 | 0.03 | 99.19 | LLNASCAA | 99.14 | | | | | | |

FIG.72-358

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 478 | 0.1 | yes | 1 | 0.04 | 99.17 | LNASCAAM | 99.17 | | | | | | |
| PA | N/A | 479 | 0.13 | yes | 2 | 0.05 | 99.11 | NASCAAMD | 98.87 | NASCAAME | 0.24 | | | | |
| PA | N/A | 480 | 0.23 | yes | 3 | 0.05 | 99 | ASCAAMDD | 97.68 | ASCAAMDE | 1.08 | | | | |
| PA | N/A | 481 | 0.22 | yes | 3 | 0.05 | 99.08 | SCAAMDDF | 97.77 | SCAAMDEF | 1.06 | | | | |
| PA | N/A | 482 | 0.22 | yes | 3 | 0.04 | 99.1 | CAAMDDFQ | 97.79 | CAAMDEFQ | 1.06 | | | | |
| PA | N/A | 483 | 0.21 | yes | 3 | 0.03 | 99.06 | AAMDDFQL | 97.75 | AAMDEFQL | 1.06 | | | | |
| PA | N/A | 484 | 0.19 | yes | 2 | 0.03 | 99.19 | AMDDFQLI | 97.87 | AMDEFQLI | 1.06 | | | | |
| PA | N/A | 485 | 0.2 | yes | 2 | 0.03 | 99.17 | MDDFQLIP | 98.04 | MDEFQLIP | 1.13 | | | | |
| PA | N/A | 486 | 0.19 | yes | 2 | 0.03 | 99.05 | DDFQLIPM | 97.92 | DEFQLIPM | 1.13 | | | | |
| PA | N/A | 487 | 0.19 | yes | 2 | 0.04 | 99.24 | DFQLIPMI | 98.11 | EFQLIPMI | 1.13 | | | | |
| PA | N/A | 488 | 0.1 | yes | 1 | 0.04 | 99.25 | FQLIPMIS | 99.25 | | | | | | |
| PA | N/A | 489 | 0.1 | yes | 1 | 0.05 | 99.23 | QLIPMISK | 99.23 | | | | | | |
| PA | N/A | 490 | 0.11 | yes | 2 | 0.05 | 99.1 | LIPMISKC | 99.1 | | | | | | |
| PA | N/A | 491 | 0.13 | yes | 2 | 0.05 | 99.11 | IPMISKCK | 98.92 | IPMISKCR | 0.2 | | | | |
| PA | N/A | 492 | 0.14 | yes | 2 | 0.05 | 99.15 | PMISKCKT | 98.8 | PMISKCRT | 0.2 | | | | |
| PA | N/A | 493 | 0.26 | yes | 4 | 0.05 | 99.09 | MISKCKTR | 97.25 | MISKCRTR | 1.5 | MISKSRT | 0.14 | | |
| PA | N/A | 494 | 0.25 | yes | 3 | 0.05 | 99.16 | ISKCKTRE | 97.36 | ISKCRTRE | 1.5 | | | | |
| PA | N/A | 495 | 0.24 | yes | 3 | 0.03 | 99.03 | SKCKTREG | 97.48 | SKCRTREG | 1.5 | | | | |
| PA | N/A | 496 | 0.22 | yes | 3 | 0.03 | 99.18 | KCKTREGR | 97.52 | KCRTREGR | 1.51 | | | | |
| PA | N/A | 497 | 0.22 | yes | 3 | 0.03 | 99.25 | CRTREGRR | 97.67 | CRTREGRR | 1.51 | | | | |
| PA | N/A | 498 | 0.26 | yes | 3 | 0.03 | 99.35 | RTKEGRRK | 97.21 | RTKEGRRR | 1.51 | | | | |
| PA | N/A | 499 | 0.24 | yes | 3 | 0.01 | 99.48 | TKEGRRKT | 97.33 | TKEGRRRT | 1.5 | | | | |
| PA | N/A | 500 | 0.23 | yes | 3 | 0.01 | 99.01 | KEGRRKTN | 97.46 | KEGRRRTN | 1.49 | | | | |
| PA | N/A | 501 | 0.11 | yes | 1 | 0.01 | 99.01 | EGRRKTNL | 99.01 | | | | | | |
| PA | N/A | 502 | 0.11 | yes | 1 | 0.01 | 99.03 | GRRKTNLY | 99.03 | | | | | | |
| PA | N/A | 503 | 0.11 | yes | 1 | 0.01 | 99.02 | RRKTNLYG | 99.02 | | | | | | |
| PA | N/A | 504 | 0.14 | yes | 2 | 0.02 | 99.23 | RKTNLYGF | 98.7 | RTNLYGFI | 0.54 | | | | |
| PA | N/A | 505 | 0.4 | yes | 2 | 0.02 | 99.22 | KTNLYGFI | 93.85 | TNLYGFIV | 5.37 | | | | |
| PA | N/A | 506 | 0.37 | yes | 2 | 0.02 | 99.39 | TNLYGFII | 94.01 | NLYGFIVK | 5.38 | | | | |
| PA | N/A | 507 | 0.37 | yes | 2 | 0.03 | 99.22 | NLYGFIIK | 94.04 | LYGFIVKG | 5.38 | | | | |
| PA | N/A | 508 | 0.39 | yes | 2 | 0.03 | 99.27 | LYGFIIKG | 93.9 | YG

FIG. 72-359

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 520 | 0.05 | yes | 1 | 0.02 | 99.6 | RNDTDVVN | 99.6 | | | | | | |
| PA | N/A | 521 | 0.14 | yes | 2 | 0.02 | 99.6 | NDTDVVNF | 98.44 | NDTDVVNY | 1.16 | | | | |
| PA | N/A | 522 | 0.22 | yes | 3 | 0.02 | 99.57 | DTDVVNFV | 97.48 | DTDVVNYV | 1.16 | DTDVVNFL | 0.93 | | |
| PA | N/A | 523 | 0.22 | yes | 3 | 0.02 | 99.58 | TDVVNFVS | 97.49 | TDVVNYVS | 1.16 | TDVVNFLS | 0.93 | | |
| PA | N/A | 524 | 0.22 | no | 3 | 0.02 | 99.6 | DVVNFVSM | 97.5 | DVVNYVSM | 1.16 | DVVNFLSM | 0.93 | | |
| PA | N/A | 525 | 0 | yes | 1 | 99.99 | 100 | GSLNFVSM | 100 | | | | | | |
| PA | N/A | 526 | 0.22 | yes | 3 | 0.02 | 99.63 | VVNFVSME | 97.54 | VVNYVSME | 1.16 | VVNFLSME | 0.93 | | |
| PA | N/A | 527 | 0.22 | yes | 3 | 0.01 | 99.63 | VNFVSMEF | 97.54 | VNYVSMEF | 1.16 | VNFLSMEF | 0.93 | | |
| PA | N/A | 528 | 0.21 | yes | 3 | 0.01 | 99.74 | NFVSMEFS | 97.59 | NYVSMEFS | 1.16 | NFLSMEFS | 0.93 | | |
| PA | N/A | 529 | 0.2 | yes | 2 | 0.02 | 99.8 | FVSMEFSL | 97.64 | YVSMEFSL | 1.16 | FLSMEFSL | — | | |
| PA | N/A | 530 | 0.14 | yes | 2 | 0.03 | 99.5 | VSMEFSLT | 98.51 | LSMEFSLT | 0.99 | | | | |
| PA | N/A | 531 | 0.07 | yes | 1 | 0.03 | 99.44 | SMEFSLTD | 99.44 | | | | | | |
| PA | N/A | 532 | 0.07 | yes | 1 | 0.03 | 99.46 | MEFSLTDP | 99.46 | | | | | | |
| PA | N/A | 533 | 0.11 | yes | 2 | 0.03 | 99.33 | EFSLTDPR | 98.99 | EFSLTDPK | 0.34 | | | | |
| PA | N/A | 534 | 0.19 | yes | 3 | 0.03 | 99.15 | FSLTDPRF | 98.12 | FSLTDPRL | 0.7 | FSLTDPKL | 0.34 | | |
| PA | N/A | 535 | 0.22 | yes | 3 | 0.03 | 99.11 | SLTDPRLE | 97.9 | SLTDPRFE | 0.7 | SLTDPKLE | 0.33 | SLVDPRLE | 0.34 |
| PA | N/A | 543 | 0.44 | yes | 4 | 0.03 | 99.01 | PHKWERYC | 94.77 | LHKWEKYC | 1.92 | PHKWERYC | — | PYKWEKYC | 0.33 |
| PA | N/A | 544 | 0.41 | yes | 4 | 0.03 | 99.1 | HKWERYCI | 95.08 | HKWEKYCI | 1.97 | HKWERYCV | 1.74 | YKWEKYCV | 1.74 |
| PA | N/A | 545 | 0.46 | yes | 4 | 0.03 | 99.26 | KWERYCIL | 94.11 | KWEKYCIL | 2.11 | KWERYCVL | 1.76 | KWEKYCVI | 1.74 |
| PA | N/A | 546 | 0.48 | yes | 4 | 0.03 | 99.12 | WEKYCILE | 93.97 | WEKYCIL | 2.11 | WERYCVLE | 1.76 | WEKYCVLE | 1.76 |
| PA | N/A | 569 | 0.38 | yes | 4 | 0.04 | 99.05 | PMFLYIRT | 95.48 | PMFLYIRT | 2.44 | PIFLYVRT | 0.55 | PLFLYVRT | 0.55 |
| PA | N/A | 570 | 0.34 | yes | 4 | 0.04 | 99.23 | MFLYIRT | 95.93 | MFLYIRTN | 2.55 | IFLYVRTN | 0.55 | LFLYVRTN | 0.55 |
| PA | N/A | 571 | 0.24 | yes | 2 | 0.03 | 99.4 | FLYIRTNG | 96.85 | FLYVRTNG | 2.55 | | | | |
| PA | N/A | 572 | 0.25 | yes | 2 | 0.03 | 99.31 | LYIRTNGT | 96.76 | LYVRTNGT | 2.55 | | | | |
| PA | N/A | 573 | 0.25 | yes | 2 | 0.03 | 99.31 | YIRTNGTS | 96.76 | YVRTNGTS | 2.55 | | | | |
| PA | N/A | 574 | 0.25 | yes | 2 | 0.03 | 99.33 | IRTNGTSK | 96.78 | VRTNGTSK | 2.55 | | | | |
| PA | N/A | 575 | 0.63 | yes | 2 | 0.03 | 99.66 | RTNGTSKI | 85.43 | RTNGTSKV | 14.18 | | | | |
| PA | N/A | 576 | 0.64 | yes | 2 | 0.03 | 99.63 | TNGTSKIK | 85.48 | TNGTSKVK | 14.18 | | | | |
| PA | N/A | 577 | 0.63 | yes | 2 | 0.04 | 99.65 | NGTSKIKM | 85.45 | NGTSKVKM | 14.18 | | | | |
| PA | N/A | 578 | 0.64 | yes | 2 | 0.02 | 99.66 | GTSKIKMK | 85.47 | GTSKVKMK | 14.18 | | | | |
| PA | N/A | 579 | 0.62 | yes | 2 | 0.03 | 99.75 | TSKIKMKW | 85.48 | TSKVKMKW | 14.2 | | | | |
| PA | N/A | 580 | 0.63 | yes | 2 | 0.02 | 99.65 | SKIKMKWG | 85.55 | SRVKMKWG | 14.19 | | | | |
| PA | N/A | 581 | 0.64 | yes | 2 | 0.02 | 99.61 | KIKMKWGM | 85.46 | KVKMKWGM | 14.19 | | | | |
| PA | N/A | 582 | 0.18 | yes | 2 | 0.01 | 99.36 | IKMKWGME | 85.42 | VKMKWGME | 14.19 | | | | |
| PA | N/A | 583 | 0.18 | yes | 2 | 0.02 | 99.34 | KMKWGMEM | 98 | KMKWGMEL | 1.37 | | | | |
| PA | N/A | 584 | 0.18 | yes | 2 | 0.02 | 99.35 | MKWGMEMR | 97.98 | MKWGMELR | 1.37 | | | | |
| PA | N/A | 585 | 0.18 | yes | 2 | 0.02 | 99.36 | KWGMEMRR | 97.98 | KWGMELRR | 1.37 | | | | |
| PA | N/A | 586 | 0.2 | yes | 2 | 0.01 | 99.23 | WGMEMRRC | 98 | WGMELRRC | 1.37 | | | | |
| PA | N/A | 587 | 0.19 | yes | 2 | 0.02 | 99.31 | GMEMRRCL | 97.87 | GMELRRCL | 1.37 | | | | |
| PA | N/A | 588 | 0.18 | yes | 2 | 0.02 | 99.41 | MEMRRCLL | 97.94 | MELRRCLL | 1.37 | | | | |
| PA | N/A | 589 | 0.18 | yes | 2 | 0.02 | 99.4 | EMRRCLLQ | 98.04 | ELRRCLLQ | 1.37 | | | | |
| PA | N/A | 590 | 0.17 | yes | 2 | 0.02 | 99.45 | MRRCLLQS | 98.08 | LRRCLLQS | 1.37 | | | | |

FIG. 72-360

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|
| PA | N/A | 591 | 0.05 | yes | 1 | 0.01 | 99.62 | RCLLQSL | 99.62 | SLQQIESI | 0.28 | | | | |
| PA | N/A | 592 | 0.05 | yes | 1 | 0.02 | 99.62 | RCLLQSLQ | 99.62 | LQQIESIW | 0.66 | | | | |
| PA | N/A | 593 | 0.05 | yes | 1 | 0.02 | 99.66 | CLLQSLQQ | 99.66 | QQIESMWE | 0.66 | | | | |
| PA | N/A | 594 | 0.07 | yes | 1 | 0.02 | 99.4 | LLQSLQQI | 99.4 | QIESMWEA | 0.66 | | | | |
| PA | N/A | 595 | 0.06 | yes | 1 | 0.02 | 99.49 | LQSLQQIE | 99.49 | IESMWEAE | 0.67 | | | | |
| PA | N/A | 596 | 0.08 | yes | 1 | 0.01 | 99.33 | QSLQQIES | 99.33 | ESMWEAES | 0.69 | | | | |
| PA | N/A | 597 | 0.12 | yes | 1 | 0.03 | 98.95 | SLQQIESM | 98.95 | SMWEAESS | 0.69 | | | | |
| PA | N/A | 598 | 0.18 | yes | 2 | 0.03 | 99.22 | LQQIESMI | 99.22 | MWEAESSV | 0.69 | VESMIEAE | 0.22 | | |
| PA | N/A | 599 | 0.17 | yes | 2 | 0.03 | 98.28 | QQIESMIE | 99.03 | WEAESSVK | 8.17 | | | | |
| PA | N/A | 600 | 0.2 | yes | 3 | 0.04 | 98.37 | QIESMIEA | 99.04 | EAESSVRE | 8.18 | | | | |
| PA | N/A | 601 | 0.21 | yes | 2 | 0.03 | 98.1 | IESMIEAE | 99.18 | AESSVREK | 8.19 | | | | |
| PA | N/A | 602 | 0.19 | yes | 3 | 0.03 | 98 | ESMIEAES | 99.19 | ESSVREKD | 8.24 | | | | |
| PA | N/A | 603 | 0.19 | yes | 3 | 0.03 | 98.22 | SMIEAESS | 99.18 | SSVREKDM | 8.18 | | IEAESSVR | 0.64 | |
| PA | N/A | 604 | 0.58 | yes | 4 | 0.03 | 98.2 | MIEAESSV | 99.02 | SVREKDMT | 8.18 | | | | |
| PA | N/A | 605 | 0.6 | yes | 3 | 0.03 | 90.16 | IEAESSVK | 99.37 | VREKDMTK | 8.15 | | | | |
| PA | N/A | 606 | 0.54 | yes | 4 | 0.03 | 89.85 | EAESSVKE | 99.39 | REKDMTKE | 0.75 | | SSVKEKDL | 0.54 | VKEKDLTK | 0.54 |
| PA | N/A | 607 | 0.55 | yes | 3 | 0.03 | 90.56 | AESSVKEK | 99.31 | EKDMTKEF | 0.75 | | SVKEKDLT | 0.54 | | |
| PA | N/A | 608 | 0.52 | yes | 4 | 0.03 | 90.49 | ESSVKEKD | 99.58 | KDMTKEFF | 0.75 | | VKEKDMTK | 0.63 | | |
| PA | N/A | 609 | 0.59 | yes | 3 | 0.03 | 90.07 | SSVKEKDM | 99.42 | DMTKEFFE | 0.75 | | KEKDLTKE | 0.57 | | |
| PA | N/A | 610 | 0.59 | yes | 4 | 0.03 | 90.06 | SVKEKDMT | 99.42 | DLTKEFFE | 0.75 | | | | |
| PA | N/A | 611 | 0.65 | yes | 5 | 0.03 | 89.36 | VKEKDMTK | 99.39 | KDLTKEFF | 18.39 | | DMTKDFFE | 0.33 | ETWPVGES | 0.47 |
| PA | N/A | 612 | 0.27 | yes | 4 | 0.03 | 97.19 | KEKDMTKE | 99.16 | DLTKEFFE | 18.4 | | EMWPIGES | 0.64 | TWPVGESP | 0.47 |
| PA | N/A | 613 | 1 | yes | 3 | 0.03 | 97.85 | EKDMTKEF | 97.85 | EKWPIGES | 32.05 | | MWPIGESP | 0.64 | | |
| PA | N/A | 614 | 1.16 | yes | 4 | 0.04 | 97.87 | KDMTKEFF | 97.87 | KWPIGESP | 32.05 | | WPIGESPK | 0.64 | | |
| PA | N/A | 615 | 1.2 | yes | 5 | 0.04 | 97.4 | DMTKEFFE | 97.4 | WPIGESPE | 32.18 | | PYGESPKG | 0.53 | PIGESPKR | 0.29 |
| PA | N/A | 626 | 1.17 | yes | 4 | 0.03 | 78.14 | ETWPIGES | 78.14 | PIGESPRG | 2.83 | | GESPKVE | 0.29 | | |
| PA | N/A | 627 | 0.42 | yes | 3 | 0.04 | 78.22 | TWPIGESP | 78.22 | GESPEGVE | 2.83 | | RVEEGSIG | 0.29 | GMEEGSIG | 0.2 |
| PA | N/A | 628 | 0.38 | yes | 5 | 0.04 | 64.81 | WPIGESPR | 64.81 | GVEDGSIG | 2.83 | | MEEGSIGK | 0.2 | | |
| PA | N/A | 629 | 0.36 | yes | 4 | 0.04 | 64.45 | PIGESPKG | 64.45 | VEDGSIGK | 2.82 | | | | |
| PA | N/A | 631 | 0.35 | yes | 5 | 0.04 | 64.75 | GESPKGVE | 64.75 | EDGSIGKV | 2.83 | | | | |
| PA | N/A | 636 | 0.26 | yes | 4 | 0.03 | 94.93 | GVEEGSIG | 95.05 | DGSIGKVC | | | | | |
| PA | N/A | 637 | 0.11 | yes | 3 | 0.03 | 95.32 | VEEGSIGK | 99.02 | | | | | | |
| PA | N/A | 638 | 0.09 | yes | 2 | 0.03 | 95.53 | EEGSIGKV | 99.12 | | | | | | |
| PA | N/A | 639 | 0.08 | yes | 1 | 0.03 | 95.55 | EGSIGKVC | 99.13 | | | | | | |
| PA | N/A | 640 | 0.09 | yes | 1 | 0.03 | 96.56 | GSIGKVCR | 99.15 | | | | | | |
| PA | N/A | 641 | 0.11 | yes | 1 | 0.03 | 99.04 | SIGKVCRT | 99.39 | | | | | | |
| PA | N/A | 642 | 0.1 | yes | 1 | 0.02 | 99.17 | IGKVCRTL | 99.04 | | | | | | |
| PA | N/A | 643 | 0.09 | yes | 1 | 0.03 | 99.22 | GKVCRTLL | 99.17 | VCRALLAK | 0.41 | | | | |
| PA | N/A | 644 | 0.09 | yes | 1 | 0.02 | 98.96 | KVCRTLLA | 99.22 | | | | | | |
| PA | N/A | 645 | 0.11 | yes | 2 | 0.03 | 99.37 | VCRTLLAK | 99.37 | | | | | | |
| PA | N/A | 646 | 0.09 | yes | 1 | 0.01 | 99.18 | CRTLLAKS | 99.18 | | | | | | |
| PA | N/A | 647 | 0.1 | yes | 1 | 0.01 | 99.07 | RTLLAKSV | 99.07 | | | | | | |

FIG. 72-361

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 648 | 0.1 | yes | 1 | 0.01 | 99.07 | TLLAKSVF | 99.07 | LAKSVFNC | 1.88 | | | | |
| PA | N/A | 649 | 0.07 | yes | 1 | 0.01 | 99.46 | LLAKSVFN | 99.46 | A

FIG. 72-362

| Protein | Sub-type | Start Pos | Block Entropy | Gaps > 10% | # to cover 99% | Gap % | Coverage | Included peptides | Freq | Included peptides | Freq | Included peptides | Freq | Included peptides | Freq |
|---|---|---|---|---|---|---|---|---|---|---|---|---|---|---|---|
| PA | N/A | 696 | 0.42 | yes | 4 | 0.07 | 99.37 | YEAIEECL | 94

FIG. 72-363

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 14 | 1.4 | yes | 4 | 1.23 | 99.15 | VPAQNAIS | 63.28 | VPVQNAIS | 23.48 | IPVQNAIS | 12.16 | IPVQNAIS | 0.23 |
| PBI | N/A | 15 | 0.67 | yes | 3 | 1.09 | 99.3 | PAQNAIST | 86.52 | PQQNAIST | 12.41 | | 0.38 | | |
| PBI | N/A | 16 | 0.66 | yes | 3 | 0.74 | 99.35 | AQNAISTT | 86.59 | AQNAIST | 12.38 | | 0.37 | | |
| PBI | N/A | 17 | 0.1 | yes | 1 | 0.7 | 99.04 | QNAISTTF | 99.04 | | | | | | |
| PBI | N/A | 18 | 0.08 | yes | 1 | 0.63 | 99.08 | NAISTTFP | 99.08 | | | | | | |
| PBI | N/A | 19 | 0.08 | yes | 1 | 0.61 | 99.31 | AISTTFPY | 99.31 | | | | | | |
| PBI | N/A | 20 | 0.07 | yes | 1 | 0.23 | 99.32 | ISTTFPYT | 99.32 | | | | | | |
| PBI | N/A | 21 | 0.08 | yes | 1 | 0.22 | 99.38 | STTFPYTG | 99.38 | | | | | | |
| PBI | N/A | 22 | 0.07 | yes | 1 | 0.2 | 99.32 | TTFPYTGD | 99.32 | | | | | | |
| PBI | N/A | 23 | 0.02 | yes | 1 | 0.2 | 99.82 | TFPYTGDP | 99.82 | | | | | | |
| PBI | N/A | 24 | 0.03 | yes | 1 | 0.18 | 99.84 | FPYTGDPP | 99.84 | | | | | | |
| PBI | N/A | 25 | 0.03 | yes | 1 | 0.16 | 99.83 | PYTGDPPY | 99.83 | | | | | | |
| PBI | N/A | 26 | 0.03 | yes | 1 | 0.14 | 99.8 | YTGDPPYS | 99.8 | | | | | | |
| PBI | N/A | 27 | 0.03 | yes | 1 | 0.13 | 99.78 | TGDPPYSH | 99.78 | | | | | | |
| PBI | N/A | 28 | 0.03 | yes | 1 | 0.12 | 99.78 | GDPPYSHG | 99.79 | | | | | | |
| PBI | N/A | 29 | 0.03 | yes | 1 | 0.12 | 99.78 | DPPYSHGT | 99.78 | | | | | | |
| PBI | N/A | 30 | 0.02 | yes | 1 | 0.12 | 99.84 | PPYSHGTG | 99.84 | | | | | | |
| PBI | N/A | 31 | 0.04 | yes | 1 | 0.1 | 99.85 | PYSHGTGT | 99.85 | | | | | | |
| PBI | N/A | 32 | 0.04 | yes | 1 | 0.1 | 99.83 | YSHGTGTG | 99.83 | | | | | | |
| PBI | N/A | 33 | 0.04 | yes | 1 | 0.11 | 99.77 | SHGTGTGY | 99.77 | | | | | | |
| PBI | N/A | 34 | 0.04 | yes | 1 | 0.11 | 99.72 | HGTGTGYT | 99.72 | | | | | | |
| PBI | N/A | 35 | 0.03 | yes | 1 | 0.03 | 99.41 | GTGTGYTM | 99.41 | | | | | | |
| PBI | N/A | 36 | 0.03 | yes | 1 | 0.03 | 99.39 | TGTGYTMD | 99.39 | | | | | | |
| PBI | N/A | 37 | 0.07 | yes | 2 | 0.03 | 99.4 | GTGYTMDT | 99.4 | GYTMDTVS | 0.3 | | | | |
| PBI | N/A | 38 | 0.07 | yes | 2 | 0.04 | 99.39 | TGYTMDTV | 99.39 | YTMDTVSR | 0.3 | | | | |
| PBI | N/A | 39 | 0.04 | yes | 1 | 0.04 | 99.28 | GYTMDTVN | 98.98 | | | | | | |
| PBI | N/A | 40 | 0.04 | yes | 1 | 0.04 | 99.29 | YTMDTVNR | 98.99 | | | | | | |
| PBI | N/A | 41 | 0.03 | yes | 1 | 0.03 | 99.07 | TMDTVNRT | 99.07 | | | | | | |
| PBI | N/A | 42 | 0.11 | yes | 1 | 0.02 | 99.14 | MDTVNRTH | 99.14 | | | | | | |
| PBI | N/A | 43 | 0.07 | yes | 1 | 0.02 | 99.27 | DTVNRTHQ | 99.27 | | | | | | |
| PBI | N/A | 44 | 0.07 | yes | 1 | 0.02 | 99.26 | TVNRTHQY | 99.26 | | | | | | |
| PBI | N/A | 45 | 0.11 | yes | 1 | 0.02 | 99.21 | VNRTHQYS | 99.21 | | | | | | |
| PBI | N/A | 46 | 0.1 | yes | 1 | 0.02 | 99.15 | NRTHQYSE | 99.15 | | | | | | |
| PBI | N/A | 47 | 0.69 | yes | 2 | 0.02 | 99.39 | RTHQYSEK | 84.17 | RTHQYSER | 15.23 | | | | |
| PBI | N/A | 48 | 0.69 | yes | 2 | 0.01 | 99.13 | THQYSEKG | 84.16 | THQYSERG | 15.23 | HQYSEKGR | 6.64 | HQYSEKGR | 2.77 |
| PBI | N/A | 49 | 1.05 | yes | 4 | 0.02 | 99.15 | HQYSEKGK | 81.17 | HQYSERGK | 8.55 | QYSEKGRW | 6.64 | QYSEKGRW | 2.77 |
| PBI | N/A | 50 | 1.05 | yes | 4 | 0.01 | 99.08 | QYSEIGKW | 81.19 | QYSERGRW | 8.55 | NTEIGAPQ | 0.91 | NTEIGAPQ | 0.54 |
| PBI | N/A | 60 | 0.66 | yes | 5 | 0.01 | 99.67 | NTEIGAPQ | 89.67 | NSETGAPQ | 7.55 | TEIGAPQL | 0.91 | TEIGAPQL | 0.54 |
| PBI | N/A | 61 | 0.66 | yes | 4 | 0.01 | 99.66 | TETGAPQL | 89.66 | SETGAPQL | 7.56 | ETGALQLN | 0.54 | ETGALQLN | 0.41 |
| PBI | N/A | 62 | 0.27 | yes | 4 | 0.01 | 99.26 | ETGAPQLN | 97.26 | EIGAPQLN | 0.94 | TGALQLNP | 0.54 | TGALQLNP | 0.4 |
| PBI | N/A | 63 | 0.26 | yes | 4 | 0 | 97.3 | TGAPQLNP | 97.3 | IGAPQLNP | 0.94 | GAPQLNPV | 0.4 | | 0.27 |
| PBI | N/A | 64 | 0.21 | yes | 4 | 0.01 | 99.18 | GAPQLNPI | 97.95 | KAPQLNPI | 0.55 | | | | |

FIG. 72-364

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| PB1 | N/A | 65 | 0.12 | yes | 2 | 0.01 | 99.3 | APQLNPID | 98.9 | ALQLNPID | 0.4 | | | | |
| PB1 | N/A | 66 | 0.12 | yes | 2 | 0.01 | 99.34 | PQLNPIDG | 98.93 | LQLNPIDG | 0.4 | | | | |
| PB1 | N/A | 67 | 0.06 | yes | 1 | 0.01 | 99.49 | QLNPIDGP | 99.49 | | | | | | |
| PB1 | N/A | 68 | 0.06 | yes | 1 | 0.01 | 99.49 | LNPIDGPL | 99.49 | | | | | | |
| PB1 | N/A | 69 | 0.06 | yes | 1 | 0.02 | 99.45 | NPIDGPLP | 99.45 | | | | | | |
| PB1 | N/A | 70 | 0.06 | yes | 1 | 0.02 | 99.02 | PIDGPLPE | 99.02 | | | | | | |
| PB1 | N/A | 78 | 0.35 | yes | 3 | 0.03 | 99.18 | PIDGPLPK | 95.64 | PIDGPLPD | 2.4 | | | | |
| PB1 | N/A | 79 | 0.37 | yes | 3 | 0.04 | 99.12 | DNEPTGYA | 95.75 | NNEPSGYA | 1.8 | DNEPSGYA | 0.98 | DNEPNGYA | 0.24 |
| PB1 | N/A | 80 | 0.27 | yes | 2 | 0.03 | 99.05 | NEPSGYAQ | 96.91 | NDPSGYAQ | 1.86 | DNDPSGYA | 1.03 | | |
| PB1 | N/A | 81 | 0.24 | yes | 2 | 0.03 | 99.31 | EPSGYAQT | 97.2 | | 1.86 | DNDPSGYA | 0.36 | | |
| PB1 | N/A | 82 | 0.22 | yes | 2 | 0.03 | 99.3 | PSGYAQTD | 97.46 | | 1.85 | | | | |
| PB1 | N/A | 83 | 0.22 | yes | 1 | 0.04 | 99.31 | SGYAQTDC | 97.46 | | 1.84 | | | | |
| PB1 | N/A | 84 | 0.04 | yes | 1 | 0.04 | 99.69 | GYAQTDCV | 99.69 | | | | | | |
| PB1 | N/A | 85 | 0.05 | yes | 1 | 0.03 | 99.59 | YAQTDCVL | 99.59 | | | | | | |
| PB1 | N/A | 86 | 0.05 | yes | 1 | 0.03 | 99.59 | AQTDCVLE | 99.59 | | | | | | |
| PB1 | N/A | 87 | 0.06 | yes | 1 | 0.04 | 99.59 | QTDCVLEA | 99.59 | | | | | | |
| PB1 | N/A | 88 | 0.06 | yes | 1 | 0.04 | 99.55 | TDCVLEAM | 99.55 | | | | | | |
| PB1 | N/A | 89 | 0.06 | yes | 1 | 0.04 | 99.55 | DCVLEAMA | 99.55 | | | | | | |
| PB1 | N/A | 90 | 0.1 | yes | 1 | 0.03 | 99.14 | CVLEAMAF | 99.14 | | | | | | |
| PB1 | N/A | 91 | 0.1 | yes | 2 | 0.04 | 99.14 | VLEAMAFL | 99.14 | | | | | | |
| PB1 | N/A | 92 | 0.13 | yes | 4 | 0.03 | 99.21 | LEAMAFLE | 98.88 | LEAMALLE | 0.33 | EAMALLEE | 0.43 | AMAFLEDS | 0.18 |
| PB1 | N/A | 93 | 0.35 | yes | 5 | 0.06 | 99.03 | EAMAFLEK | 95.81 | EAMAFLEN | 2.46 | AMALLEES | 0.43 | MAFLEDSH | 0.18 |
| PB1 | N/A | 94 | 0.36 | yes | 5 | 0.07 | 99.13 | AMAFLEKS | 95.73 | AMAFLENS | 2.46 | MALLEESH | 0.43 | AFLEDSHP | 0.18 |
| PB1 | N/A | 95 | 0.36 | yes | 5 | 0.09 | 99.14 | MAFLEKSH | 95.74 | MAFLENSH | 2.46 | ALLEESHP | 0.43 | FLEDSHPG | 0.18 |
| PB1 | N/A | 96 | 0.36 | yes | 5 | 0.08 | 99.16 | AFLEKSHP | 95.76 | AFLENSHP | 2.46 | LLEESHPG | 0.43 | | |
| PB1 | N/A | 97 | 0.36 | yes | 4 | 0.08 | 99.14 | FLEKSHPG | 95.74 | FLENSHPG | 2.47 | LEESHPGI | 0.43 | | |
| PB1 | N/A | 98 | 0.36 | yes | 4 | 0.08 | 99.16 | LEKSHPGI | 95.68 | LEESHPGL | 2.47 | EESHPGIF | 0.58 | ESHPGIFG | 0.39 |
| PB1 | N/A | 99 | 0.38 | yes | 4 | 0.07 | 99.15 | EKSHPGIF | 95.67 | EESHPGLF | 2.47 | ESHPGIFE | 0.57 | | |
| PB1 | N/A | 100 | 0.21 | yes | 3 | 0.08 | 99.32 | KSHPGIFE | 95.47 | ESHPGLFE | 2.46 | NSHPGIFE | 0.38 | | |
| PB1 | N/A | 101 | 0.2 | yes | 5 | 0.05 | 99.28 | SHPGIFEN | 98.01 | SHPGLFEN | 0.57 | SHPGIFES | 0.38 | | |
| PB1 | N/A | 102 | 0.19 | yes | 3 | 0.02 | 99.04 | HPGIFENS | 98.09 | HPGLFENS | 0.57 | PGIFGNSC | 0.38 | | |
| PB1 | N/A | 103 | 0.61 | yes | 5 | 0.02 | 99.1 | PGIFENSC | 98.14 | PGLFENSC | 0.57 | GIFGNSCL | 0.56 | GIFESSCL | 0.3 |
| PB1 | N/A | 104 | 0.61 | yes | 4 | 0.03 | 99.28 | GIFENSCL | 98.85 | GLFENSCL | 0.57 | IFGNSCLE | 0.56 | | |
| PB1 | N/A | 105 | 0.58 | yes | 4 | 0.02 | 99 | IFENSCLE | 89.88 | FENSCIET | 8.17 | FGNSCLET | 0.38 | | |
| PB1 | N/A | 107 | 0.63 | yes | 4 | 0.02 | 99.11 | FENSCLET | 89.85 | IFENSCIE | 8.17 | FESSCLET | 0.3 | | |
| PB1 | N/A | 116 | 0.31 | yes | 3 | 0.05 | 99.05 | NSCLETME | 90.25 | FENSCIET | 8.17 | NSCLETIE | 0.38 | SSCLETME | 0.32 |
| PB1 | N/A | 117 | 0.16 | yes | 5 | 0.04 | 99.2 | VQQTRVDK | 89.63 | NSCIETME | 8.14 | IFGNSCLE | 0.97 | | |
| PB1 | N/A | 118 | 0.17 | yes | 4 | 0.04 | 99.26 | QQTRVDKL | 96.36 | IQQTRVDK | 1.93 | VQQTRVDR | 0.9 | | |
| PB1 | N/A | 119 | 0.17 | yes | 3 | 0.07 | 99.35 | QTRVDKLT | 98.35 | QQTRVDRL | 0.9 | | | | |
| PB1 | N/A | 120 | 0.17 | yes | 2 | 0.08 | 98.2 | TRVDKLTQ | 98.2 | QTRVDRLT | 0.89 | | | | |
| PB1 | N/A | 121 | 0.17 | yes | 2 | 0.04 | 99.13 | RVDKLTQG | 98.24 | TRVDRLTQ | 0.89 | | | | |
| PB1 | N/A | 122 | 0.12 | yes | 2 | 0.04 | 99.17 | VDKLTQGR | 98.28 | RVDRLTQG | 0.89 | | | | |
| PB1 | N/A | | | yes | 2 | 0.04 | 99.14 | DKLTQGRQ | 98.25 | VDRLTQGR | 0.88 | | | | |
| PB1 | N/A | | | yes | 2 | 0.04 | 99.64 | | 98.75 | DRLTQGRQ | | | | | |

FIG.72-365

| Protein | Sub-type | Start Pos | Block Entropy | Gaps <10% | # to cover 99% | % gap | Coverage | Peptides included | Freq | Peptides induced | Freq | Peptides induced | Freq | Peptides induced | Freq |
|---|---|---|---|---|---|---|---|---|---|---|---|---|---|---|---|
| PB1 | N/A | 123 | 0.12 | yes | 2 | 0.04 | 99.65 | KLTQGRQT | 98.76 | | | | | | |
| PB1 | N/A | 124 | 0.18 | yes | 2 | 0.05 | 99.67 | LTQGRQTY | 97.73 | | | | | | |
| PB1 | N/A | 125 | 0.18 | yes | 2 | 0.06 | 99.7 | TQGRQTYD | 97.76 | RLTQGRQT | 1.94 | | | | |
| PB1 | N/A | 126 | 0.16 | yes | 2 | 0.05 | 99.83 | QGRQTYDW | 97.89 | LTQGRQTF | 1.94 | | | | |
| PB1 | N/A | 127 | 0.16 | yes | 2 | 0.05 | 99.86 | GRQTYDWT | 97.92 | TQGRQTFD | 1.94 | | | | |
| PB1 | N/A | 128 | 0.16 | yes | 2 | 0.05 | 99.82 | RQTYDWTL | 97.89 | QGRQTFDW | 1.94 | | | | |
| PB1 | N/A | 129 | 0.17 | yes | 2 | 0.06 | 99.72 | QTYDWTLN | 97.79 | GRQTFDWT | 1.94 | | | | |
| PB1 | N/A | 130 | 0.18 | yes | 2 | 0.06 | 99.66 | TYDWTLNR | 97.72 | RQTFDWTL | 1.94 | | | | |
| PB1 | N/A | 131 | 0.18 | yes | 2 | 0.06 | 99.65 | YDWTLNRN | 97.7 | QTFDWTLN | 1.94 | | | | |
| PB1 | N/A | 132 | 0.05 | yes | 1 | 0.07 | 99.64 | DWTLNRNQ | 99.64 | TFDWTLN | 1.94 | | | | |
| PB1 | N/A | 133 | 0.05 | yes | 1 | 0.07 | 99.64 | WTLNRNQP | 99.64 | FDWTLNRN | 1.94 | | | | |
| PB1 | N/A | 134 | 0.06 | yes | 1 | 0.07 | 99.62 | TLNRNQPA | 99.62 | | | | | | |
| PB1 | N/A | 135 | 0.06 | yes | 1 | 0.06 | 99.57 | LNRNQPAA | 99.57 | | | | | | |
| PB1 | N/A | 136 | 0.05 | yes | 1 | 0.06 | 99.56 | NRNQPAAT | 99.56 | | | | | | |
| PB1 | N/A | 137 | 0.04 | yes | 1 | 0.05 | 99.66 | RNQPAATA | 99.66 | | | | | | |
| PB1 | N/A | 138 | 0.05 | yes | 1 | 0.05 | 99.7 | NQPAATAL | 99.7 | | | | | | |
| PB1 | N/A | 139 | 0.05 | yes | 1 | 0.04 | 99.64 | QPAATALA | 99.64 | | | | | | |
| PB1 | N/A | 140 | 0.05 | yes | 1 | 0.04 | 99.62 | PAATALAN | 99.62 | | | | | | |
| PB1 | N/A | 141 | 0.04 | yes | 1 | 0.03 | 99.62 | AATALANT | 99.62 | | | | | | |
| PB1 | N/A | 142 | 0.03 | yes | 1 | 0.03 | 99.61 | ATALANTI | 99.61 | | | | | | |
| PB1 | N/A | 143 | 0.05 | yes | 1 | 0.04 | 99.59 | TALANTIE | 99.59 | | | | | | |
| PB1 | N/A | 144 | 0.06 | yes | 2 | 0.04 | 99.6 | ALANTIEV | 89.04 | ALANTIEI | 10.57 | | | | |
| PB1 | N/A | 145 | 0.54 | yes | 4 | 0.04 | 99.62 | LANTIEVF | 89.05 | LANTIEIF | 10.57 | | | | |
| PB1 | N/A | 146 | 0.56 | yes | 4 | 0.05 | 99.38 | ANTIEVFR | 88.85 | ANTIEIFR | 10.53 | | | | |
| PB1 | N/A | 147 | 0.83 | yes | 3 | 0.04 | 99.13 | NTIEVFRS | 84.89 | NTIEIFRS | 10.36 | NTIEVFRL | 3.69 | NTIEVFKS | 0.2 |
| PB1 | N/A | 148 | 0.83 | yes | 3 | 0.05 | 99.13 | TIEVFRSN | 84.89 | TIEIFRSN | 10.35 | TIEVFRLN | 3.69 | TIEVFKSN | 0.2 |
| PB1 | N/A | 160 | 0.37 | yes | 2 | 0.06 | 99.41 | SESGRLID | 94.93 | SESGRLMD | 3.48 | NESGRLMD | 1 | | |
| PB1 | N/A | 161 | 0.16 | yes | 2 | 0.05 | 99.33 | ESGRLIDF | 98.32 | ESGRLMDF | 1.01 | | | | |
| PB1 | N/A | 162 | 0.14 | yes | 2 | 0.05 | 99.55 | SGRLIDFL | 98.53 | SGRLMDFL | 1.02 | | | | |
| PB1 | N/A | 163 | 0.15 | yes | 2 | 0.05 | 99.43 | GRLIDFLK | 98.41 | GRLMDFLK | 1.02 | | | | |
| PB1 | N/A | 164 | 0.16 | yes | 2 | 0.05 | 99.43 | RLIDFLKD | 98.41 | RLMDFLKD | 1.02 | | | | |
| PB1 | N/A | 165 | 0.4 | yes | 4 | 0.06 | 99.34 | LIDFLKDV | 98.32 | LMDFLKDV | 1.34 | IDFLKDVV | 1.32 | IDFLKDVT | 1.01 |
| PB1 | N/A | 166 | 0.71 | yes | 5 | 0.08 | 99.28 | IDFLKDVM | 95.29 | IDFLKDVI | 5.55 | EIVTHFQR | 1.87 | EIITHFQR | 1.79 |
| PB1 | N/A | 182 | 0.66 | yes | 5 | 0.08 | 99.08 | DFLKDVM | 89.48 | EVTHFQR | 5.55 | VTHFQRK | 1.87 | IITHFQR | 1.8 |
| PB1 | N/A | 183 | 0.36 | yes | 4 | 0.08 | 99.2 | ITTHFQR | 89.98 | VTHFQRK | 1.88 | ITHFQRK | 1.81 | | |
| PB1 | N/A | 184 | 0.1 | yes | 3 | 0.07 | 99.14 | TTHFQRKR | 95.45 | | | | | | |
| PB1 | N/A | 185 | 0.24 | yes | 1 | 0.09 | 99.13 | THFQRKRV | 99.13 | | | | | | |
| PB1 | N/A | 186 | 0.25 | yes | 2 | 0.09 | 99.16 | HFQRKRRI | 97.22 | HRKRRVRD | 1.94 | | | | |
| PB1 | N/A | 187 | 0.26 | yes | 2 | 0.1 | 99.04 | FQRKRRIR | 97.11 | FQRKRRVR | 1.93 | KRRVRD | 0.31 | KRRVRDNI | 0.75 | KRRVRDSM | 0.19 |
| PB1 | N/A | 188 | 0.26 | yes | 2 | 0.09 | 99.3 | QRKRRIRD | 97.05 | QRKRRVRD | 1.93 | | | | |
| PB1 | N/A | 189 | 0.26 | yes | 3 | 0.09 | 99.04 | RKRRIRDN | 97.1 | RKRRVRDN | 1.94 | | | | |
| PB1 | N/A | 190 | 0.72 | yes | 5 | 0.09 | 99.18 | KRRIRDNM | 88.46 | KRRVRDNM | 7.84 | KRRIRDNM | 1.95 | | |

FIG. 72-366

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 191 | 0.73 | yes | 5 | 0.08 | 99.14 | RVRDNMT | 88.41 | RVRDNVT | 7.85 | RVRDNIT | 1.95 | RVRDSMT | 0.19 |
| PB1 | N/A | 192 | 0.75 | yes | 5 | 0.09 | 99 | RVRDNMTK | 88.15 | RVRDNVTK | 7.84 | RVRDNITK | 1.95 | RVRDNMTR | 0.3 |
| PB1 | N/A | 194 | 0.69 | yes | 4 | 0.07 | 99.09 | RDNMTKKM | 89.09 | RDNVTKKM | 7.83 | RDNITKKM | 1.07 | RDNMTRKM | 0.3 |
| PB1 | N/A | 198 | 0.38 | yes | 4 | 0.09 | 99.14 | TKKMVTQR | 95.38 | TKKMITQR | 2.59 | TKMVTQR | 0.86 | | |
| PB1 | N/A | 199 | 0.39 | yes | 5 | 0.09 | 99.09 | KKMVTQRT | 95.32 | KKMITQRT | 2.59 | KMVTQRT | 0.86 | | |
| PB1 | N/A | 200 | 0.41 | yes | 3 | 0.1 | 99.16 | KMVTQRTI | 95.1 | KMITQRTI | 2.53 | KMVTQRTI | 0.43 | RMITQRTI | 0.26 |
| PB1 | N/A | 201 | 0.34 | yes | 3 | 0.1 | 99.11 | MVTQRTIG | 95.91 | MVTQRTVG | 2.78 | KMVTQRTV | 0.43 | | |
| PB1 | N/A | 202 | 0.34 | yes | 3 | 0.11 | 99.07 | VTQRTIGK | 95.87 | VTQRTVGK | 2.78 | | | | |
| PB1 | N/A | 203 | 0.19 | yes | 2 | 0.1 | 99.11 | TQRTIGKK | 98.26 | TQRTIGKR | 0.43 | | | | |
| PB1 | N/A | 204 | 0.2 | yes | 2 | 0.09 | 99.05 | QRTIGKKK | 98.19 | QRTIGKRK | 0.43 | | | | |
| PB1 | N/A | 205 | 0.57 | yes | 4 | 0.09 | 99.03 | RTIGKKKQ | 90.92 | RTVGKKKQ | 7.27 | RTIGKRKQ | 0.74 | | |
| PB1 | N/A | 218 | 1.22 | yes | 5 | 0.08 | 99.11 | SYLIRALT | 55.76 | NYLIRALT | 41.7 | SYLIRLTL | 0.43 | SYIIRALT | 0.41 |
| PB1 | N/A | 219 | 0.17 | yes | 3 | 0.08 | 99.3 | YLIRALTL | 98.37 | YIIRALTL | 0.5 | SYLIRLTL | 0.41 | | |
| PB1 | N/A | 220 | 0.17 | yes | 2 | 0.07 | 99.33 | LIRALTLN | 98.4 | IIRALTLN | 0.5 | | | | |
| PB1 | N/A | 221 | 0.12 | yes | 2 | 0.07 | 99.39 | IRALTLNT | 98.89 | | | | | | |
| PB1 | N/A | 222 | 0.11 | yes | 1 | 0.06 | 99.49 | RALTLNTM | 98.99 | | | | | | |
| PB1 | N/A | 223 | 0.1 | yes | 1 | 0.07 | 99.03 | ALTLNTMT | 99.03 | | | | | | |
| PB1 | N/A | 224 | 0.05 | yes | 1 | 0.06 | 99.57 | LTLNTMTK | 99.57 | | | | | | |
| PB1 | N/A | 225 | 0.05 | yes | 1 | 0.06 | 99.58 | TLNTMTKD | 99.58 | | | | | | |
| PB1 | N/A | 226 | 0.03 | yes | 1 | 0.06 | 99.82 | LNTMTKDA | 99.82 | | | | | | |
| PB1 | N/A | 227 | 0.03 | yes | 1 | 0.09 | 99.8 | NTMTKDAE | 99.8 | | | | | | |
| PB1 | N/A | 228 | 0.03 | yes | 1 | 0.08 | 99.8 | TMTKDAER | 99.8 | | | | | | |
| PB1 | N/A | 229 | 0.03 | yes | 1 | 0.09 | 99.81 | MTKDAERG | 99.81 | | | | | | |
| PB1 | N/A | 230 | 0.03 | yes | 1 | 0.08 | 99.78 | TKDAERGK | 99.78 | | | | | | |
| PB1 | N/A | 231 | 0.08 | yes | 1 | 0.08 | 99.8 | KDAERGKL | 99.8 | | | | | | |
| PB1 | N/A | 232 | 0.08 | yes | 1 | 0.1 | 99.3 | DAERGKLK | 99.3 | | | | | | |
| PB1 | N/A | 233 | 0.08 | yes | 1 | 0.09 | 99.29 | AERGKLKR | 99.29 | | | | | | |
| PB1 | N/A | 234 | 0.08 | yes | 1 | 0.09 | 99.3 | ERGKLKRR | 99.3 | | | | | | |
| PB1 | N/A | 235 | 0.08 | yes | 1 | 0.09 | 99.29 | RGKLKRRA | 99.29 | | | | | | |
| PB1 | N/A | 236 | 0.08 | yes | 1 | 0.08 | 99.28 | GKLKRRAI | 99.28 | | | | | | |
| PB1 | N/A | 237 | 0.07 | yes | 1 | 0.09 | 99.29 | KLKRRAIA | 99.29 | | | | | | |
| PB1 | N/A | 238 | 0.03 | yes | 1 | 0.1 | 99.33 | LKRRAIAT | 99.33 | | | | | | |
| PB1 | N/A | 239 | 0.03 | yes | 1 | 0.1 | 99.33 | KRRAIATP | 99.33 | | | | | | |
| PB1 | N/A | 240 | 0.02 | yes | 1 | 0.09 | 99.84 | RRAIATPG | 99.84 | | | | | | |
| PB1 | N/A | 241 | 0.03 | yes | 1 | 0.15 | 99.76 | RAIATPGM | 99.76 | | | | | | |
| PB1 | N/A | 242 | 0.03 | yes | 1 | 0.15 | 99.75 | AIATPGMQ | 99.75 | | | | | | |
| PB1 | N/A | 243 | 0.03 | yes | 1 | 0.16 | 99.74 | IATPGMQI | 99.74 | | | | | | |
| PB1 | N/A | 244 | 0.03 | yes | 1 | 0.16 | 99.75 | ATPGMQIR | 99.75 | | | | | | |
| PB1 | N/A | 245 | 0.03 | yes | 1 | 0.16 | 99.75 | TPGMQIRG | 99.75 | | | | | | |
| PB1 | N/A | 246 | 0.06 | yes | 1 | 0.16 | 99.53 | PGMQIRGF | 99.53 | | | | | | |
| PB1 | N/A | 247 | 0.06 | yes | 1 | 0.16 | 99.53 | GMQIRGFV | 99.53 | | | | | | |
| PB1 | N/A | 248 | 0.13 | yes | 2 | 0.16 | 99.45 | MQIRGFVY | 98.71 | | | MQIRGFVH | 0.74 | | |

FIG. 72-367

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 249 | 0.15 | yes | 2 | 0.16 | 99.3 | QIRGFVHF | 98.57 | QIRGFVHF | 0.74 | | | | |
| PBI | N/A | 250 | 0.15 | yes | 2 | 0.16 | 99.25 | IRGFVHFV | 98.51 | IRGFVHFV | 0.74 | | | | |
| PBI | N/A | 251 | 0.15 | yes | 4 | 0.17 | 99.27 | RGFVHFVE | 98.53 | RGFVHFVE | 0.74 | | | | |
| PBI | N/A | 252 | 0.3 | yes | 4 | 0.14 | 99.07 | GFVYFVET | 96.84 | GFVHFVEA | 1.38 | GFVYFVEI | 0.58 | | |
| PBI | N/A | 253 | 0.28 | yes | 4 | 0.14 | 99.05 | FVYFVETL | 97.01 | FVHFVEAL | 1.38 | FVYFVEIL | 0.58 | | |
| PBI | N/A | 254 | 0.3 | yes | 4 | 0.13 | 99.24 | VYFVETLA | 96.82 | VHFVEALA | 1.38 | VYFVEILA | 0.58 | | |
| PBI | N/A | 255 | 0.43 | yes | 5 | 0.13 | 99.01 | YFVETLAR | 96.82 | HFVEALAR | 1.34 | YFVEILAR | 0.58 | | |
| PBI | N/A | 256 | 0.42 | yes | 4 | 0.15 | 99.01 | VETLARSI | 94.94 | VETLARRI | 1.93 | VETLARCI | 0.27 | | |
| PBI | N/A | 257 | 0.27 | yes | 4 | 0.11 | 99.08 | ETLARSIC | 95.01 | ETLARRIC | 1.93 | ETLARCIC | 0.27 | | |
| PBI | N/A | 258 | 0.27 | yes | 4 | 0.11 | 99.24 | LARSICEK | 97.1 | LARRIC | 0.98 | LARCIC | 0.27 | | |
| PBI | N/A | 259 | 0.27 | yes | 4 | 0.11 | 99.25 | ARSICEKL | 97.11 | ARRICEK | 0.98 | ARCICEK | 0.27 | | |
| PBI | N/A | 260 | 0.25 | yes | 4 | 0.11 | 99.26 | RSICEKLE | 97.12 | RRICEKL | 0.98 | RCICEKL | | | |
| PBI | N/A | 261 | 0.05 | yes | 1 | 0.1 | 99.47 | SICEKLEQ | 97.32 | RICEKLE | 0.98 | CICEKLEQ | 0.98 | | |
| PBI | N/A | 262 | 0.04 | yes | 1 | 0.12 | 99.61 | ICEKLEQS | 99.61 | | | | | | |
| PBI | N/A | 263 | 0.04 | yes | 1 | 0.13 | 99.66 | CEKLEQSG | 99.66 | | | | | | |
| PBI | N/A | 264 | 0.05 | yes | 1 | 0.16 | 99.64 | EKLEQSGL | 99.64 | | | | | | |
| PBI | N/A | 265 | 0.04 | yes | 1 | 0.16 | 99.81 | KLEQSGLP | 99.81 | | | | | | |
| PBI | N/A | 266 | 0.03 | yes | 1 | 0.17 | 99.71 | LEQSGLPV | 99.71 | | | | | | |
| PBI | N/A | 267 | 0.03 | yes | 1 | 0.18 | 99.71 | EQSGLPVG | 99.71 | | | | | | |
| PBI | N/A | 268 | 0.03 | yes | 1 | 0.16 | 99.74 | QSGLPVGG | 99.74 | | | | | | |
| PBI | N/A | 269 | 0.03 | yes | 1 | 0.16 | 99.78 | SGLPVGGN | 99.78 | | | | | | |
| PBI | N/A | 270 | 0.03 | yes | 1 | 0.15 | 99.78 | GLPVGGNE | 99.78 | | | | | | |
| PBI | N/A | 271 | 0.03 | yes | 1 | 0.13 | 99.77 | LPVGGNEK | 99.77 | | | | | | |
| PBI | N/A | 272 | 0.03 | yes | 1 | 0.13 | 99.77 | PVGGNEKK | 99.77 | | | | | | |
| PBI | N/A | 273 | 0.02 | yes | 1 | 0.13 | 99.89 | VGGNEKKA | 99.89 | | | | | | |
| PBI | N/A | 274 | 0.02 | yes | 1 | 0.13 | 99.9 | GGNEKKAK | 99.9 | | | | | | |
| PBI | N/A | 275 | 0.02 | yes | 1 | 0.13 | 99.9 | GNEKKAKL | 99.9 | | | | | | |
| PBI | N/A | 276 | 0.02 | yes | 1 | 0.13 | 99.89 | NEKKAKLA | 99.89 | | | | | | |
| PBI | N/A | 277 | 0.03 | yes | 1 | 0.12 | 99.89 | EKKAKLAN | 99.89 | | | | | | |
| PBI | N/A | 278 | 0.03 | yes | 1 | 0.12 | 99.89 | KKAKLANV | 99.89 | | | | | | |
| PBI | N/A | 279 | 0.04 | yes | 1 | 0.12 | 99.75 | KAKLANVV | 99.75 | | | | | | |
| PBI | N/A | 280 | 0.04 | yes | 1 | 0.13 | 99.66 | AKLANVVR | 99.66 | | | | | | |
| PBI | N/A | 281 | 0.04 | yes | 1 | 0.13 | 99.66 | KLANVVRK | 99.66 | | | | | | |
| PBI | N/A | 282 | 0.05 | yes | 1 | 0.13 | 99.66 | LANVVRKM | 99.66 | | | | | | |
| PBI | N/A | 283 | 0.04 | yes | 1 | 0.13 | 99.61 | ANVVRKMM | 99.61 | | | | | | |
| PBI | N/A | 284 | 0.07 | yes | 1 | 0.14 | 99.41 | NVVRKMMT | 99.41 | | | | | | |
| PBI | N/A | 285 | 0.07 | yes | 1 | 0.16 | 99.38 | VVRKMMTN | 99 | VVRKMMTS | 0.38 | | | | |
| PBI | N/A | 286 | 0.11 | yes | 2 | 0.13 | 99.11 | VRKMMTNS | 98.99 | VRKMMTSS | 0.38 | | | | |
| PBI | N/A | 287 | 0.11 | yes | 2 | 0.12 | 99.21 | RKMMTNSQ | 98.74 | RKMMTSSQ | 0.38 | | | | |
| PBI | N/A | 288 | 0.14 | yes | 2 | 0.13 | 99.09 | KMMTNSQD | 98.83 | KMMTSSQD | 0.38 | | | | |
| PBI | N/A | 289 | 0.13 | yes | 2 | 0.13 | 99.09 | MMTNSQDT | 98.72 | MMTSSQDT | 0.38 | | | | |
| PBI | N/A | 290 | 0.15 | yes | 2 | 0.13 | 99.03 | MTNSQDTE | 98.65 | MTSSQDTE | 0.38 | | | | |
| PBI | N/A | 291 | | yes | | | | | | | | | | | |
| PBI | N/A | 292 | | yes | | | | | | | | | | | |

FIG. 72-368

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 293 | 1.07 | yes | 5 | 0.13 | 99.04 | TNSQDTEL | 67.25 | TNSQDTEL | 31.2 | TNSQDTEV | 0.22 | TSSQDTEI | 0.16 |
| PB1 | N/A | 294 | 1.05 | yes | 4 | 0.12 | 99.07 | NSQDTELS | 67.34 | SSQDTELS | 31.3 | NSQDTEVS | 0.22 | | |
| PB1 | N/A | 295 | 1.01 | yes | 2 | 0.13 | 99.03 | SQDTELSF | 67.56 | | | | | | |
| PB1 | N/A | 296 | 1.02 | yes | 3 | 0.13 | 99.04 | QDTELSFT | 67.57 | | | | | | |
| PB1 | N/A | 297 | 1.01 | yes | 3 | 0.13 | 99.4 | DTELSFTI | 67.38 | DTELSFTV | 0.55 | | | | |
| PB1 | N/A | 298 | 1 | yes | 3 | 0.14 | 99.41 | TELSFTIT | 67.38 | TELSFTVT | 0.55 | | | | |
| PB1 | N/A | 299 | 0.99 | yes | 2 | 0.15 | 99.52 | ELSFTITG | 67.5 | ELSFTVTG | 0.55 | | | | |
| PB1 | N/A | 300 | 0.08 | yes | 1 | 0.15 | 99.03 | LSFTITGD | 67.57 | | | | | | |
| PB1 | N/A | 301 | 0.07 | yes | 1 | 0.13 | 99.24 | SFTITGDN | 99.24 | | | | | | |
| PB1 | N/A | 302 | 0.08 | yes | 1 | 0.15 | 99.24 | FTITGDNT | 99.24 | | | | | | |
| PB1 | N/A | 303 | 0.08 | yes | 1 | 0.16 | 99.25 | TITGDNTK | 99.25 | | | | | | |
| PB1 | N/A | 304 | 0.03 | yes | 1 | 0.15 | 99.82 | ITGDNTKW | 99.82 | | | | | | |
| PB1 | N/A | 305 | 0.03 | yes | 1 | 0.13 | 99.84 | TGDNTKWN | 99.84 | | | | | | |
| PB1 | N/A | 306 | 0.02 | yes | 1 | 0.13 | 99.83 | GDNTKWNE | 99.84 | | | | | | |
| PB1 | N/A | 307 | 0.02 | yes | 1 | 0.13 | 99.85 | DNTKWNEN | 99.86 | | | | | | |
| PB1 | N/A | 308 | 0.06 | yes | 1 | 0.13 | 99.45 | NTKWNENQ | 99.47 | | | | | | |
| PB1 | N/A | 309 | 0.06 | yes | 1 | 0.13 | 99.45 | TKWNENQN | 99.45 | | | | | | |
| PB1 | N/A | 310 | 0.38 | yes | 3 | 0.13 | 99.21 | KWNENQNP | 94.97 | NENQNPRI | 2.31 | | | | |
| PB1 | N/A | 311 | 0.38 | yes | 1 | 0.13 | 99.22 | WNENQNPR | 94.99 | ENQNPRIF | 2.3 | | | | |
| PB1 | N/A | 312 | 0 | no | 1 | 99.99 | 100 | NENQNPRM | 100 | | | | | | |
| PB1 | N/A | 313 | 0 | no | 1 | 99.99 | 100 | ENQNPRMF | 100 | | | | | | |
| PB1 | N/A | 314 | 0.38 | yes | 3 | 0.13 | 99.16 | NQNPRMFL | 94.92 | NQNPRIFL | 2.3 | QNPRVFLT | 0.9 | | |
| PB1 | N/A | 315 | 0.42 | yes | 4 | 0.13 | 99.01 | QNPRMFLA | 94.88 | QNPRIFLA | 1.83 | NPRVFLTM | 0.89 | | |
| PB1 | N/A | 316 | 0.42 | yes | 4 | 0.13 | 99.01 | NPRMFLAM | 94.88 | NPRVFLAM | 1.83 | PRVFLTMI | 0.89 | | |
| PB1 | N/A | 317 | 0.4 | yes | 4 | 0.13 | 99.22 | PRMFLAMI | 95.09 | PRVFLAMI | 1.84 | RVFLTMIT | 0.89 | | |
| PB1 | N/A | 318 | 0.41 | yes | 4 | 0.13 | 99.11 | RMFLAMIT | 95.02 | RVFLAMIT | 1.84 | VFLTMITY | 0.89 | | |
| PB1 | N/A | 319 | 0.41 | yes | 4 | 0.13 | 99.22 | MFLAMITY | 95.03 | VFLAMITY | 1.79 | | | | |
| PB1 | N/A | 320 | 0.17 | yes | 2 | 0.16 | 99.22 | FLAMITYI | 98.22 | FLTMITYI | 1.01 | | | | |
| PB1 | N/A | 321 | 0.17 | yes | 2 | 0.19 | 99.22 | LAMITYIT | 98.22 | LTMITYIT | 1.01 | | | | |
| PB1 | N/A | 322 | 0.97 | yes | 3 | 0.2 | 99.22 | AMITYITR | 73.45 | TMITYITR | 24.8 | TYITRSQP | 0.97 | | |
| PB1 | N/A | 323 | 1 | yes | 3 | 0.2 | 99.13 | MITYITRK | 73.27 | TYITRKQP | 24.58 | TYITRKQP | 0.6 | TYMTRNQP | 0.22 |
| PB1 | N/A | 333 | 1.16 | yes | 4 | 0.17 | 99.18 | TYITRKQP | 49.99 | TYITRKQP | 48.28 | QPKWFRNV | 0.49 | | |
| PB1 | N/A | 334 | 1.16 | yes | 4 | 0.16 | 99.21 | QPEWFRNI | 49.97 | QPGWFRNV | 48.34 | PKWFRNVL | 0.49 | | |
| PB1 | N/A | 335 | 1.18 | yes | 4 | 0.19 | 99.04 | PEWFRNIL | 49.98 | PGWFRNVL | 48.1 | KWFRNVLS | 0.49 | | |
| PB1 | N/A | 336 | 1.72 | yes | 5 | 0.2 | 99.03 | EWFRNILS | 47.25 | GWFRNVLS | 25.01 | WFRNVLSV | 0.38 | DWFRNVLS | 0.26 |
| PB1 | N/A | 337 | 1.72 | yes | 4 | 0.2 | 99.13 | WFRNILSM | 47.24 | WFRNVLSM | 25.02 | WFRNVLSA | 1.94 | | |
| PB1 | N/A | 338 | 1.71 | yes | 5 | 0.2 | 99.19 | FRNILSIA | 47.31 | FRNVLSIA | 25.02 | RNVLSVA | 1.94 | NALSIAPI | 0.2 |
| PB1 | N/A | 339 | 1.73 | yes | 4 | 0.2 | 99.03 | RNILSIAP | 47.24 | RNVLSIAP | 25.01 | RNVLSYAP | 1.94 | ALSIAPIM | 0.2 |
| PB1 | N/A | 340 | 1.73 | yes | 5 | 0.2 | 99.2 | NILSIAPIM | 47.19 | NVLSIAPI | 25 | NVLSIAPI | 1.93 | | |
| PB1 | N/A | 341 | 1.02 | yes | 3 | 0.2 | 99.4 | ILSMAPIM | 47.21 | ILSIAPIM | 25.05 | VLSIAPIM | 1.93 | | |
| PB1 | N/A | | | yes | | | | LSMAPIMF | 72.24 | LSVAPIMF | 2.11 | | | | |

FIG. 72-369

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 342 | 1.02 | yes | 3 | 0.18 | 99.45 | SMAPIMFS | 99.45 | SMAPIMFS | 72.28 | SVAPIMFS | 25.06 | | | | |
| PB1 | N/A | 343 | 1 | yes | 3 | 0.15 | 99.62 | SAPIMFSN | 99.62 | MAPIMFSN | 72.46 | VAPIMFSN | 25.06 | | | | |
| PB1 | N/A | 344 | 0.04 | yes | 1 | 0.16 | 99.66 | APIMFSNK | 99.66 | | 99.66 | | | | | | |
| PB1 | N/A | 345 | 0.09 | yes | 1 | 0.15 | 99.24 | PIMFSNKM | 99.24 | | 99.24 | | | | | | |
| PB1 | N/A | 346 | 0.11 | yes | 1 | 0.14 | 99.04 | IMFSNKMA | 99.04 | | 99.04 | | | | | | |
| PB1 | N/A | 347 | 0.13 | yes | 2 | 0.16 | 99.18 | MFSNKMAR | 98.86 | MFSNKVAR | 98.86 | | | | | | |
| PB1 | N/A | 348 | 0.12 | yes | 2 | 0.16 | 99.2 | FSNKMARL | 98.84 | FSNKVARL | 98.84 | | | | | | |
| PB1 | N/A | 349 | 0.13 | yes | 2 | 0.2 | 99.2 | SNKMARLG | 98.88 | SNKVARLG | 98.88 | | | | | | |
| PB1 | N/A | 350 | 0.38 | yes | 2 | 0.2 | 99.27 | NKMARLGK | 94.61 | NKVARLGK | 4.27 | | 0.32 | | | | |
| PB1 | N/A | 351 | 0.37 | yes | 2 | 0.2 | 99.26 | KMARLGKG | 94.68 | KVARLGKG | 4.27 | | 0.32 | | | | |
| PB1 | N/A | 352 | 0.33 | yes | 2 | 0.2 | 99.51 | MARLGKGY | 94.67 | VARLGKGY | 4.27 | | 0.32 | | | | |
| PB1 | N/A | 353 | 0.31 | yes | 2 | 0.2 | 99.75 | ARLGKGYM | 95.05 | | 4.27 | | | | | | |
| PB1 | N/A | 354 | 0.29 | yes | 2 | 0.19 | 99.78 | RLGKGYMF | 95.24 | | 4.27 | | | | | | |
| PB1 | N/A | 355 | 0.28 | yes | 2 | 0.16 | 99.42 | LGKGYMFE | 95.48 | | 4.27 | | | | | | |
| PB1 | N/A | 356 | 0.32 | yes | 4 | 0.16 | 99.11 | GKGYMFES | 95.52 | | 4.25 | | | | | | |
| PB1 | N/A | 357 | 1.26 | yes | 5 | 0.13 | 99.03 | KGYMFESK | 95.17 | GYMFESKN | 41.93 | GYMFESKN | 2.16 | GYMFESKK | 0.59 | |
| PB1 | N/A | 358 | 1.27 | yes | 5 | 0.16 | 99.1 | GYMFESKS | 54.44 | YMFESKNM | 41.9 | YMFESKNM | 2.16 | YMFESKKM | 0.59 | |
| PB1 | N/A | 359 | 1.03 | yes | 5 | 0.13 | 99.01 | YMFESKSM | 54.39 | MKLRTQIP | 23.27 | MKLRTQIP | 0.85 | MKLRTQIS | | 0.36 |
| PB1 | N/A | 366 | 1.04 | yes | 4 | 0.14 | 99.29 | MKLRTQIP | 74.12 | KLRTQIPA | 23.26 | KLRTQIPA | 0.85 | KLRTQISA | | 0.36 |
| PB1 | N/A | 367 | 1 | yes | 4 | 0.15 | 99.03 | KLRTQIPA | 74.04 | LRTQIPAE | 23.28 | LRTQIPAE | 0.84 | LRTQVSAE | | 0.3 |
| PB1 | N/A | 368 | 0.76 | yes | 5 | 0.13 | 99.22 | LRTQIPAE | 74.49 | IDLKYFND | 9.29 | IDLKYFNK | 0.32 | IDLRYFNE | | 0.26 |
| PB1 | N/A | 380 | 0 | no | 1 | 99.99 | 100 | IDLKYFNE | 87.03 | | | | | | | | |
| PB1 | N/A | 392 | 0 | no | 1 | 99.99 | 100 | KIEKIEKI | 100 | | | | | | | | |
| PB1 | N/A | 393 | 0 | no | 1 | 99.99 | 100 | IEKIEKIR | 100 | | | | | | | | |
| PB1 | N/A | 394 | 0.29 | yes | 5 | 0.18 | 99.05 | EKIEKIRP | 100 | | | | | | | | |
| PB1 | N/A | 395 | 0.28 | yes | 5 | 0.16 | 99.13 | KIEKIRPL | 97.05 | KIEKIRPL | 1.24 | KIEKVRPL | 0.32 | KIKKIRPL | 0.18 |
| PB1 | N/A | 396 | 0.37 | yes | 5 | 0.13 | 99.11 | IEKIRPLL | 97.13 | IEKIRPLL | 1.24 | IEKVRPLL | 0.32 | IKKIRPLL | 0.19 |
| PB1 | N/A | 406 | 0.33 | yes | 3 | 0.13 | 99.03 | GTASLSPG | 95.11 | GTVSLSPG | 3.18 | | 0.73 | | | |
| PB1 | N/A | 407 | 0.12 | yes | 2 | 0.12 | 99.37 | TASLSPGM | 95.46 | TVSLSPGM | 3.18 | | 0.73 | | | |
| PB1 | N/A | 408 | 0.12 | yes | 1 | 0.11 | 99.45 | ASLSPGMM | 98.72 | | 0.74 | | | | | |
| PB1 | N/A | 409 | 0.06 | yes | 1 | 0.13 | 99.43 | SLSPGMMM | 99.43 | | | | | | | |
| PB1 | N/A | 410 | 0.02 | yes | 1 | 0.11 | 99.86 | LSPGMMMG | 99.86 | | | | | | | |
| PB1 | N/A | 411 | 0.02 | yes | 1 | 0.11 | 99.84 | SPGMMMGM | 99.84 | | | | | | | |
| PB1 | N/A | 412 | 0.03 | yes | 1 | 0.11 | 99.83 | PGMMMGMF | 99.83 | | | | | | | |
| PB1 | N/A | 413 | 0.02 | yes | 1 | 0.11 | 99.8 | GMMMGMFN | 99.8 | | | | | | | |
| PB1 | N/A | 414 | 0.03 | yes | 1 | 0.13 | 99.77 | MMMGMFNM | 99.77 | | | | | | | |
| PB1 | N/A | 415 | 0.03 | yes | 1 | 0.14 | 99.81 | MMGMFNML | 99.81 | | | | | | | |
| PB1 | N/A | 416 | 0.03 | yes | 1 | 0.14 | 99.81 | MGMFNMLS | 99.81 | | | | | | | |
| PB1 | N/A | 417 | 0.03 | yes | 1 | 0.14 | 99.83 | GMFNMLST | 99.83 | | | | | | | |
| PB1 | N/A | 418 | 0.02 | yes | 1 | 0.14 | 99.78 | MFNMLSTV | 99.78 | | | | | | | |
| PB1 | N/A | 419 | 0.03 | yes | 1 | 0.14 | 99.8 | FNMLSTVL | 99.8 | | | | | | | |
| PB1 | N/A | 420 | 0.03 | yes | 1 | 0.14 | 99.82 | NMLSTVLG | 99.82 | | | | | | | |

FIG. 72-370

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 421 | 0.02 | yes | 1 | 0.14 | 99.85 | MLSTVLGV | 99.85 | | | | | | |
| PB1 | N/A | 422 | 0.05 | yes | 1 | 0.13 | 99.64 | LSTVLGVS | 99.64 | | | | | | |
| PB1 | N/A | 423 | 0.1 | yes | 1 | 0.1 | 99.03 | STVLGVSI | 99.03 | | | | | | |
| PB1 | N/A | 424 | 0.1 | yes | 1 | 0.1 | 99.03 | TVLGVSIL | 99.03 | | | | | | |
| PB1 | N/A | 425 | 0.11 | yes | 2 | 0.11 | 99 | VLGVSILN | 99 | | | | | | |
| PB1 | N/A | 426 | 0.11 | yes | 2 | 0.11 | 99.54 | LGVSILNL | 98.96 | LGVSVLNL | 0.58 | | | | |
| PB1 | N/A | 427 | 0.12 | yes | 3 | 0.12 | 99.54 | GVSILNLG | 98.96 | GVSVLNLG | 0.58 | | | | |
| PB1 | N/A | 428 | 0.22 | yes | 3 | 0.14 | 99.44 | VSILNLGQ | 98.86 | VSVLNLGQ | 0.58 | | | | |
| PB1 | N/A | 429 | 1.3 | yes | 5 | 0.14 | 99.39 | SILNLGQK | 97.58 | SILNLGQR | 1.24 | SVLNLGQK | 0.58 | VLNLGQKR | 0.47 | |
| PB1 | N/A | 430 | 1.29 | yes | 5 | 0.14 | 99.24 | ILNLGQKR | 48.76 | IINLGQKR | 47.36 | IINLGQRK | 1.66 | LNLGQKRH | 0.22 | |
| PB1 | N/A | 431 | 1.29 | yes | 5 | 0.14 | 99.18 | LNLGQKRY | 49 | LNLGQKEY | 47.37 | LNLGQRKY | 1.61 | NLGQKRHT | 0.22 | |
| PB1 | N/A | 432 | 1.01 | yes | 5 | 0.12 | 99.17 | NLGQKRYT | 48.98 | NLGQKEYT | 47.38 | NLGQRKYT | 1.61 | TAYWWDGL | 0.82 | |
| PB1 | N/A | 441 | 1.01 | yes | 1 | 0.14 | 99.68 | TYWWDGL | 75.07 | TYWWDGL | 22 | TYWWDGL | 0.91 | AYWWDGLQ | 0.83 | |
| PB1 | N/A | 442 | 1.01 | yes | 1 | 0.14 | 99.69 | TYWWDGLQ | 75.09 | SYWWDGLQ | 21.99 | VYWWDGLQ | 0.91 | | | |
| PB1 | N/A | 443 | 0.03 | yes | 2 | 0.12 | 99.78 | YWWDGLQS | 99.84 | | | | | | |
| PB1 | N/A | 444 | 0.02 | yes | 2 | 0.11 | 99.84 | WWDGLQSS | 99.85 | | | | | | |
| PB1 | N/A | 445 | 0.02 | yes | 2 | 0.11 | 99.85 | WDGLQSSD | 99.86 | | | | | | |
| PB1 | N/A | 446 | 0.03 | yes | 3 | 0.16 | 99.86 | DGLQSSDD | 99.86 | | | | | | |
| PB1 | N/A | 447 | 0.03 | yes | 3 | 0.16 | 99.86 | GLQSSDDF | 99.8 | | | | | | |
| PB1 | N/A | 448 | 0.03 | yes | 3 | 0.14 | 99.8 | LQSSDDFA | 99.79 | | | | | | |
| PB1 | N/A | 449 | 0.1 | yes | 3 | 0.15 | 99.8 | QSSDDFAL | 99.8 | | | | | | |
| PB1 | N/A | 450 | 0.1 | yes | 3 | 0.15 | 99.8 | SSDDFALI | 99.01 | | | | | | |
| PB1 | N/A | 451 | 0.11 | yes | 3 | 0.15 | 99.01 | SDDFALIV | 98.99 | | | | | | |
| PB1 | N/A | 452 | 0.26 | yes | 4 | 0.09 | 99.57 | DDFALILN | 0.58 | DDFALIIN | | FALIWNAL | 0.58 | | | |
| PB1 | N/A | 453 | 0.63 | yes | 5 | 0.09 | 99.54 | DFALILNA | 0.58 | DFALIINA | | EGIQAGVN | 0.58 | | | |
| PB1 | N/A | 454 | 0.2 | yes | 2 | 0.16 | 99.13 | FALIVNAS | 0.94 | FALIVNAS | | | | | |
| PB1 | N/A | 464 | 0.19 | yes | 2 | 0.16 | 99.01 | AGIQAGVD | 7.5 | AGIQAGVN | 1.16 | FALILNAP | 0.59 | GGIQAGVD | 0.22 | |
| PB1 | N/A | 465 | 0.17 | yes | 2 | 0.16 | 99.08 | GIQAGVNR | 1.16 | IQAGVNRF | 1.16 | EGVQAGVD | 1.15 | | | |
| PB1 | N/A | 466 | 0.17 | yes | 2 | 0.16 | 99.33 | IQAGVNRF | 1.16 | QAGVNRFY | 1.16 | | | | |
| PB1 | N/A | 467 | 0.4 | yes | 3 | 0.08 | 99.34 | QAGVNRFY | 1.16 | AGVNRFYR | 1.16 | | | | |
| PB1 | N/A | 468 | 0.4 | yes | 3 | 0.08 | 99.66 | AGVNRFYR | 3.45 | GVNRFYRT | 1.12 | | | | |
| PB1 | N/A | 469 | 0.38 | yes | 3 | 0.09 | 99.23 | GVNRFYRT | 3.45 | VNRFYRTC | 1.12 | | | | |
| PB1 | N/A | 470 | 0.29 | yes | 3 | 0.1 | 99.2 | VDRFYRTC | 3.45 | NRFYRTCK | 1.12 | | | | |
| PB1 | N/A | 471 | 0.29 | yes | 3 | 0.1 | 99.36 | DRFYRTCK | 3.47 | | | | | | |
| PB1 | N/A | 472 | 0.75 | yes | 3 | 0.12 | 99.36 | RFYRTCKL | 9.7 | FYRICKLV | 3.45 | | | | |
| PB1 | N/A | 473 | 0.75 | yes | 3 | 0.12 | 99.36 | FYRTCKLL | 9.7 | YRICKLVG | 3.45 | | | | |
| PB1 | N/A | 474 | 0.75 | yes | 3 | 0.12 | 99.35 | YRTCKLLG | 9.7 | RICKLVGI | 3.45 | | | | |
| PB1 | N/A | 475 | 0.75 | yes | 3 | 0.12 | 99.36 | RTCKLLGI | 9.74 | ICKLVGIN | 3.45 | | | | |
| PB1 | N/A | 476 | 0.52 | yes | 3 | 0.11 | 99.56 | TCKLLGIN | 9.74 | | | | | | |
| PB1 | N/A | 477 | 0.52 | yes | 2 | 0.11 | 99.51 | CKLLGINM | 9.82 | | | | | | |
| PB1 | N/A | 478 | 0.52 | yes | 2 | 0.11 | 99.51 | KLLGINMS | 9.76 | | | | | | |
| PB1 | N/A | 479 | 0.53 | yes | 2 | 0.11 | 99.49 | LLGINMSK | 9.75 | | | | | | |

FIG. 72-372

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 522 | 0.97 | yes | 2 | 0.05 | 99.44 | SGINESAD | 67.92 | SGVNESAD | 31.52 | | | | |
| PB1 | N/A | 523 | 0.95 | yes | 2 | 0.05 | 99.6 | GINESADM | 68.04 | GVNESADM | 31.56 | | | | |
| PB1 | N/A | 524 | 0.96 | yes | 2 | 0.05 | 99.54 | INESADMS | 68.01 | VNESADMS | 31.53 | | | | |

FIG. 72-373

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 564 | 0.11 | yes | 2 | 0.1 | 99.72 | YTYRCHRG | 98.84 | YTYRCHKG | 0.88 | | | | |
| PBI | N/A | 565 | 0.12 | yes | 2 | 0.1 | 99.66 | TYRCHRGD | 98.78 | TYRCHKGD | 0.88 | | | | |
| PBI | N/A | 566 | 0.21 | yes | 5 | 0.11 | 99.18 | YRCHRGDT | 97.82 | YRCHKGDT | 0.88 | RCHRGDAQ | 0.47 | RCHRGDTH | 0.42 |
| PBI | N/A | 567 | 0.28 | yes | 5 | 0.11 | 99.26 | RCHRGDTQ | 97.18 | RCHKGDTQ | 0.88 | CHRGDAQI | 0.47 | CHRGDTH | 0.42 | RCHRGDAQ | 0.31 |
| PBI | N/A | 568 | 0.31 | yes | 4 | 0.11 | 99.03 | CHRGDTQI | 96.96 | CHKGDTQI | 0.87 | | 0.47 | HIQTRRSF | 0.39 | CHRGDAQI | 0.31 |
| PBI | N/A | 574 | 0.29 | yes | 4 | 0.08 | 99.09 | CHRGDTQI | 97 | QIQTRRAF | 1.22 | | 0.48 | | | |
| PBI | N/A | 575 | 0.22 | yes | 2 | 0.08 | 99.34 | QIQTRSF | 97.61 | IQTRRAFE | 1.24 | | 0.49 | | | |
| PBI | N/A | 576 | 0.78 | yes | 2 | 0.08 | 99.45 | IQTRRSFE | 84.16 | QTRRAFEL | 13.55 | | 1.24 | QTRRAFEL | 0.49 | TRRAFELK | 0.49 |
| PBI | N/A | 577 | 0.85 | yes | 2 | 0.07 | 99.37 | QTRRSFEL | 83.49 | TKRSFELK | 13.4 | | 1.23 | TRRSFELK | 0.76 | |
| PBI | N/A | 595 | 0.21 | yes | 3 | 0.07 | 99.15 | TRRSFELK | 97.46 | LLVADGGP | 1.69 | | 0.61 | | | |
| PBI | N/A | 596 | 0.25 | yes | 3 | 0.06 | 99.4 | GLLVSDGG | 97.1 | LVADGGPN | 1.69 | | 0.61 | | | |
| PBI | N/A | 597 | 0.24 | yes | 2 | 0.05 | 99.41 | LLVSDGGP | 97.11 | VADGGPNL | 1.69 | | 0.61 | | | |
| PBI | N/A | 598 | 0.25 | yes | 3 | 0.05 | 99.34 | LVSDGGPN | 97.04 | | 0.64 | | | | |
| PBI | N/A | 599 | 0.13 | yes | 2 | 0.06 | 99.32 | VSDGGPNL | 98.68 | | | | | | |
| PBI | N/A | 600 | 0.08 | yes | 1 | 0.05 | 99.31 | SDGGPNLY | 99.31 | | | | | | |
| PBI | N/A | 601 | 0.08 | yes | 1 | 0.06 | 99.21 | DGGPNLYN | 99.21 | | | | | | |
| PBI | N/A | 602 | 0.09 | yes | 1 | 0.05 | 99.2 | GGPNLYNI | 99.2 | | | | | | |
| PBI | N/A | 603 | 0.09 | yes | 1 | 0.04 | 99.22 | GPNLYNIR | 99.22 | | | | | | |
| PBI | N/A | 604 | 0.06 | yes | 1 | 0.04 | 99.53 | PNLYNIRN | 99.53 | | | | | | |
| PBI | N/A | 605 | 0.06 | yes | 1 | 0.05 | 99.51 | NLYNIRNL | 99.51 | | | | | | |
| PBI | N/A | 606 | 0.07 | yes | 1 | 0.04 | 99.41 | LYNIRNLH | 99.51 | | | | | | |
| PBI | N/A | 607 | 0.08 | yes | 1 | 0.05 | 99.43 | YNIRNLHI | 99.43 | | | | | | |
| PBI | N/A | 608 | 0.09 | yes | 1 | 0.04 | 99.31 | NIRNLHIP | 99.31 | | | | | | |
| PBI | N/A | 609 | 0.12 | yes | 1 | 0.04 | 99.07 | IRNLHIPE | 99.07 | | | | | | |
| PBI | N/A | 610 | 0.13 | yes | 1 | 0.04 | 99.03 | RNLHIPEV | 99.03 | | | | | | |
| PBI | N/A | 611 | 0.11 | yes | 2 | 0.05 | 99.15 | NLHIPEVC | 98.97 | LHIPEAGL | 0.18 | | | LHIPEAGL | 0.18 | |
| PBI | N/A | 612 | 0.12 | yes | 3 | 0.04 | 99.02 | LHIPEVCL | 99.02 | PEAGLKWE | 0.53 | | | | | |
| PBI | N/A | 613 | 0.12 | yes | 2 | 0.06 | 99.03 | HIPEVCLK | 99.03 | EAGLKWEL | 0.53 | | | | | |
| PBI | N/A | 614 | 0.17 | yes | 3 | 0.06 | 99.18 | IPEVCLKW | 98.46 | PEVCLKWD | 0.53 | PEVCLKWD | 0.53 | | | |
| PBI | N/A | 615 | 0.17 | yes | 2 | 0.06 | 99.18 | PEVCLKWE | 98.46 | EVCLIKWDL | 0.53 | EVCLKWDL | 0.53 | | | |
| PBI | N/A | 616 | 0.14 | yes | 3 | 0.05 | 99.02 | EVCLKWEL | 98.49 | VCLIKWDLM | 0.53 | VCLKWDLM | 0.53 | | | |
| PBI | N/A | 617 | 1.15 | yes | 2 | 0.07 | 99.26 | VCLKWELM | 98.73 | CLIKWELMD | 0.53 | CLKWELMD | 0.53 | | | |
| PBI | N/A | 627 | 1.22 | yes | 3 | 0.07 | 99.59 | CLKWELMD | 55.07 | YKGRLCNP | 42.76 | YKGRLCNP | 0.24 | QGRLCNPM | 0.24 | |
| PBI | N/A | 628 | 0.17 | yes | 2 | 0.07 | 99.17 | QGRLCNPL | 54.62 | KGRLCNPL | 42.6 | | 1.76 | | 1.7 | |
| PBI | N/A | 629 | 0.14 | yes | 3 | 0.05 | 99.34 | GRLCNPLN | 98.92 | GRLCNPMN | 0.42 | | | | | |
| PBI | N/A | 630 | 0.11 | yes | 4 | 0.07 | 99.05 | RLCNPLNP | 99.06 | | | | | | |
| PBI | N/A | 631 | 0.1 | yes | 2 | 0.06 | 99.07 | LCNPLNPF | 99.07 | CNPMNPFV | 0.43 | | | | | |
| PBI | N/A | 632 | 0.12 | yes | 2 | 0.07 | 99.34 | CNPLNPFV | 98.91 | NPLNPFVN | 1.52 | NPLNPFVT | 0.6 | NPMNPFVS | 0.41 | |
| PBI | N/A | 633 | 0.31 | yes | 4 | 0.06 | 99.1 | NPLNPFVS | 96.57 | PLNPFVNH | 1.51 | PLNPFVSH | 0.6 | PMNPFVSH | 0.41 | PLNPFVGH | 0.2 |
| PBI | N/A | 634 | 0.33 | yes | 5 | 0.04 | 99.13 | PLNPFVSH | 96.41 | | | | | | |
| PBI | N/A | 635 | 0 | no | 1 | 99.99 | 100 | HPRGLLEV | 100 | | | | | | |
| PBI | N/A | 636 | 0 | no | 1 | 99.99 | 100 | PRGLLEVG | 100 | | | | | | |

FIG.72-374

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 637 | 0 | no | - | 99.99 | 100 | RGLLEVGT | 100 | | | | | | |
| PB1 | N/A | 638 | 0 | no | - | 99.99 | 100 | GLLEVGTR | 100 | | | | | | |
| PB1 | N/A | 639 | 0 | no | - | 99.99 | 100 | LLEVGTRW | 100 | | | | | | |
| PB1 | N/A | 640 | 0 | no | - | 99.99 | 100 | LEVGTRWM | 100 | | | | | | |
| PB1 | N/A | 641 | 0 | no | - | 99.99 | 100 | EVGTRWMK | 100 | | | | | | |
| PB1 | N/A | 642 | 0 | no | - | 99.99 | 100 | VGTRWMKII | 100 | | | | | | |
| PB1 | N/A | 643 | 0 | no | - | 99.99 | 100 | GTRWMKII | 100 | | | | | | |
| PB1 | N/A | 644 | 0 | no | - | 99.99 | 100 | TRWMKIIR | 100 | | | | | | |
| PB1 | N/A | 645 | 0 | no | - | 99.99 | 100 | RWMKIIRV | 100 | | | | | | |
| PB1 | N/A | 646 | 0 | no | - | 99.99 | 100 | WMKIIRVG | 100 | | | | | | |
| PB1 | N/A | 647 | 0 | no | - | 99.99 | 100 | MKIIRVGC | 100 | | | | | | |
| PB1 | N/A | 648 | 0 | no | - | 99.99 | 100 | KIIRVGCV | 100 | | | | | | |
| PB1 | N/A | 649 | 0 | no | - | 99.99 | 100 | IIRVGCVI | 100 | | | | | | |
| PB1 | N/A | 650 | 0 | no | - | 99.99 | 100 | IRVGCVIL | 100 | | | | | | |
| PB1 | N/A | 651 | 0 | no | - | 99.99 | 100 | RVGCVILL | 100 | | | | | | |
| PB1 | N/A | 652 | 0 | no | - | 99.99 | 100 | VGCVILLN | 100 | | | | | | |
| PB1 | N/A | 653 | 0 | no | - | 99.99 | 100 | GCVILLNP | 100 | | | | | | |
| PB1 | N/A | 654 | 0 | no | - | 99.99 | 100 | CVILLNPF | 100 | | | | | | |
| PB1 | N/A | 655 | 0 | no | - | 99.99 | 100 | VILLNPFV | 100 | | | | | | |
| PB1 | N/A | 656 | 0 | no | - | 99.99 | 100 | ILLNPFVS | 100 | | | | | | |
| PB1 | N/A | 657 | 0 | no | - | 99.99 | 100 | LLNPFVSH | 100 | | | | | | |
| PB1 | N/A | 658 | 0.31 | yes | 5 | 0.06 | 99.09 | NPFVSHKE | 96.76 | NPFVNHKG | 0.8 | NPFVNHKE | 0.69 | NPFVTHKE | | NPFVSHRE | 0.26 |
| PB1 | N/A | 659 | 0.16 | yes | 3 | 0.01 | 99.33 | MEYDAVAT | 98.42 | IEYDAVAT | 0.56 | VEYDAVAT | 0.35 | | | | |
| PB1 | N/A | 685 | 0.07 | yes | 3 | 0.01 | 99.43 | EYDAVATT | 99.43 | | | | | | | | |
| PB1 | N/A | 686 | 0.07 | yes | 3 | 0.01 | 99.45 | YDAVATTH | 99.45 | | | | | | | | |
| PB1 | N/A | 687 | 0.06 | yes | 3 | 0.01 | 99.45 | DAVATTHS | 99.45 | | | | | | | | |
| PB1 | N/A | 688 | 0.06 | yes | 3 | 0.02 | 99.37 | AVATTHSW | 99.49 | | | | | | | | |
| PB1 | N/A | 689 | 0.65 | yes | 3 | 0.03 | 99.41 | VATTHSWI | 87.61 | VATTHSWV | 10.74 | VATTHSWT | 1.02 | | | | |
| PB1 | N/A | 690 | 0.64 | yes | 3 | 0.06 | 99.5 | ATTHSWIP | 87.69 | ATTHSWVP | 10.71 | ATTHSWTP | 1.02 | | | | |
| PB1 | N/A | 691 | 0.63 | yes | 3 | 0.08 | 99.49 | TTHSWIPK | 87.76 | THSWVPK | 10.72 | THSWTPK | 1.02 | | | | |
| PB1 | N/A | 692 | 0.63 | yes | 3 | 0.08 | 99.5 | THSWIPKR | 87.76 | HSWVPKR | 10.72 | HSWTPKR | 1.02 | | | | |
| PB1 | N/A | 693 | 0.64 | yes | 3 | 0.07 | 99.49 | HSWIPKRN | 87.75 | SWWPKRN | 10.71 | SWTPKRN | 1.02 | | | | |
| PB1 | N/A | 694 | 0.64 | yes | 3 | 0.07 | 99.49 | SWIPKRNR | 87.75 | WVPKRNR | 10.72 | WTPKRNR | 1.02 | | | | |
| PB1 | N/A | 695 | 0.65 | yes | 3 | 0.07 | 99.39 | WIPKRNRS | 87.75 | VPKRNRS | 10.72 | TPKRNRS | 1.02 | | | | |
| PB1 | N/A | 696 | 0.05 | yes | 3 | 0.07 | 99.54 | IPKRNRSI | 87.65 | VPKRNRSI | 10.72 | TPKRNRSI | | | | | |
| PB1 | N/A | 697 | 0.04 | yes | 1 | 0.08 | 99.68 | PKRNRSIL | 99.55 | | | | | | | | |
| PB1 | N/A | 698 | 0.03 | yes | 1 | 0.09 | 99.72 | KRNRSILN | 99.68 | | | | | | | | |
| PB1 | N/A | 699 | 0.03 | yes | 1 | 0.09 | 99.35 | RNRSILNT | 99.74 | | | | | | | | |
| PB1 | N/A | 700 | 0.07 | yes | 1 | 0.04 | 99.39 | NRSILNTS | 99.39 | | | | | | | | |
| PB1 | N/A | 701 | 0.1 | yes | 1 | 0.05 | 99.12 | RSILNTSQ | 99.36 | | | | | | | | |
| PB1 | N/A | 702 | 0 | no | - | 99.99 | 100 | SILNTSQR | 99.12 | | | | | | | | |
| PB1 | N/A | 703 | 0 | no | - | 99.99 | 100 | ILNTSQRI | 100 | | | | | | | | |
| PB1 | N/A | 704 | 0 | no | - | 99.99 | 100 | ICNSNAIT | 100 | | | | | | | | |

FIG.72-376

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 747 | 0.69 | yes | 4 | 0.05 | 99.44 | QKCCNLFE | 88.46 | QKCCNLFE | 2.48 | QKCCTLFE | 0.62 | | |
| PB1 | N/A | 748 | 0.72 | yes | 3 | 0.05 | 99.16 | RCCNLFEK | 88.22 | KCCNLFEK | 2.48 | KCCTLFEK | 0.62 | | |
| PB1 | N/A | 749 | 0.32 | yes | 3 | 0.04 | 99.18 | CCSLFEKF | 96.06 | CCTLFEKF | 0.62 | | | | |
| PB1 | N/A | 750 | 0.32 | yes | 1 | 0.04 | 99.16 | CSLFEKFF | 96.05 | CTLFEKFF | 0.62 | | | | |
| PB1 | N/A | 751 | 0.33 | yes | 1 | 0.04 | 99.15 | SLFEKFFP | 96.04 | TLFEKFFP | 0.62 | | | | |
| PB1 | N/A | 752 | 0.08 | yes | 1 | 0.05 | 99.32 | LFEKFFPS | 99.32 | | | | | | |
| PB1 | N/A | 753 | 0.08 | yes | 1 | 0.05 | 99.34 | FEKFFPSS | 99.34 | | | | | | |
| PB1 | N/A | 754 | 0.08 | yes | 1 | 0.04 | 99.32 | EKFFPSSY | 99.32 | | | | | | |
| PB1 | N/A | 755 | 0.04 | yes | 1 | 0.03 | 99.41 | KFFPSSYR | 99.41 | | | | | | |
| PB1 | N/A | 756 | 0.07 | yes | 1 | 0.02 | 99.73 | FFPSSYRR | 99.73 | | | | | | |
| PB1 | N/A | 757 | 0.04 | yes | 1 | 0.03 | 99.68 | FPSSYRRP | 99.68 | | | | | | |
| PB1 | N/A | 758 | 0.04 | yes | 1 | 0.03 | 99.68 | PSSYRRPI | 99.68 | | | | | | |
| PB1 | N/A | 759 | 0.48 | yes | 2 | 0.03 | 99.7 | SSYRRPI | 9.02 | SSSYRRPI | 9.02 | | | | |
| PB1 | N/A | 760 | 0.47 | yes | 2 | 0.03 | 99.73 | SYRRPIG | 9.02 | SSYRRPIG | 9.02 | | | | |
| PB1 | N/A | 761 | 0.48 | yes | 2 | 0.03 | 99.7 | SYRRPVGI | 9.02 | SYRRPIGI | 9.02 | | | | |
| PB1 | N/A | 762 | 0.48 | yes | 2 | 0.03 | 99.71 | YRRPVGI | 9.02 | YRRPIGIS | 9.02 | | | | |
| PB1 | N/A | 763 | 0.49 | yes | 2 | 0.04 | 99.63 | RRPVGIS | 9.01 | RRPIGISS | 9.02 | | | | |
| PB1 | N/A | 764 | 0.49 | yes | 2 | 0.04 | 99.65 | RPVGISS | 9.00 | RPIGISSM | 8.94 | | | | |
| PB1 | N/A | 765 | 0.61 | yes | 2 | 0.04 | 99.52 | PVGISSM | 8.94 | PIGISSMV | 8.94 | PVGISSMG | 0.76 | PVGISSMM | 0.68 |
| PB1 | N/A | 766 | 0.62 | yes | 2 | 0.04 | 99.47 | VGISSMV | 8.94 | IGISSMVE | 8.94 | VGISSMGE | 0.76 | VGISSMME | 0.68 |
| PB1 | N/A | 767 | 0.18 | yes | 2 | 0.04 | 99.55 | GISSMVE | 98.08 | GISSMEA | 0.76 | | | | |
| PB1 | N/A | 768 | 0.19 | yes | 2 | 0.03 | 99.5 | ISSMVEA | 98.03 | ISSMGEAM | 0.76 | | | | |
| PB1 | N/A | 769 | 0.28 | yes | 4 | 0.03 | 99.04 | SSMMEAM | 97.01 | SSMGEAMV | 0.76 | SSMVEAMI | 0.57 | | |
| PB1 | N/A | 770 | 0.29 | yes | 4 | 0.04 | 99.01 | SMMEAMY | 96.97 | SMGEAMYS | 0.76 | SMVEAMIS | 0.57 | | |
| PB1 | N/A | 771 | 0.3 | yes | 4 | 0.07 | 99.03 | MMEAMYSR | 96.99 | MGEAMYSR | 0.76 | MVEAMISR | 0.57 | | |
| PB1 | N/A | 772 | 0.18 | yes | 3 | 0.09 | 99.36 | MEAMYSRA | 96.89 | GEAMYSRA | 0.76 | VEAMISRA | 0.57 | VEAMMSRA | 0.46 |
| PB1 | N/A | 773 | 0.18 | yes | 3 | 0.11 | 99.33 | EAMYSRAR | 98.32 | EAMMSRAR | 0.59 | | | | |
| PB1 | N/A | 774 | 0.18 | yes | 3 | 0.11 | 99.31 | AMYSRARI | 98.29 | AMMSRARI | 0.59 | | | | |
| PB1 | N/A | 775 | 0.08 | yes | 3 | 0.13 | 99.34 | MYSRARID | 98.26 | MMSRARID | 0.59 | | | | |
| PB1 | N/A | 776 | 0.08 | yes | 3 | 0.16 | 99.28 | YSRARIDA | 99.34 | | | | | | |
| PB1 | N/A | 777 | 0.87 | yes | 2 | 0.18 | 99.22 | SRARIDAR | 76.08 | RARIDARV | 23.2 | RARIDARV | 0.45 | | |
| PB1 | N/A | 778 | 0.88 | yes | 2 | 0.18 | 99.1 | RARIDARI | 76.03 | ARIDARVD | 23.2 | ARIDARVD | 0.45 | | |
| PB1 | N/A | 779 | 0.88 | yes | 2 | 0.18 | 99.26 | ARIDARID | 76.11 | RIDARVDF | 22.99 | RIDARVDF | 0.45 | | |
| PB1 | N/A | 780 | 0.87 | yes | 2 | 0.21 | 99.2 | RIDARIDF | 76.25 | IDARVDFE | 23.01 | IDARVDFE | 0.46 | | |
| PB1 | N/A | 781 | 0.88 | yes | 2 | 0.18 | 99.14 | IDARIDFE | 76.18 | DARVDFES | 23.02 | DARVDFES | | | |
| PB1 | N/A | 782 | 0.88 | yes | 2 | 0.21 | 99.2 | DARIDFES | 76.15 | ARVDFESG | 22.99 | ARVDFESG | | | |
| PB1 | N/A | 783 | 0.88 | yes | 2 | 0.21 | 99.13 | ARIDFESG | 76.13 | RVDFESGR | 22.86 | RVDFESGR | | | |
| PB1 | N/A | 784 | 0.95 | yes | 2 | 0.22 | 99.12 | RIDFESGR | 75.55 | VDFESGRI | 4.17 | VDFESGRI | 0.28 | IDFESGRV | 0.21 |
| PB1 | N/A | 785 | 0.25 | yes | 5 | 99.84 | 100 | IDFESGRI | 95.83 | IDFESGRM | | IDFESGRI | 0.21 | IDFESGRV | 0.21 |
| PB1 | N/A | 793 | — | no | 2 | 99.99 | 100 | GKKEFSEI | 50 | GKKEFSE | 50 | | | | |
| PB1 | N/A | 810 | — | no | 2 | 99.99 | 100 | ELRRQKWW | 50 | ELRRQKSL | 50 | | | | |
| PB1 | N/A | 811 | — | no | 2 | 99.99 | 100 | LRRQKWWV | 50 | LRRQKSLI | 50 | | | | |

FIG. 72-377

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| PB1 | N/A | 812 | — | no | 2 | 99.99 | 100 | RRQKWWW | 50 | RRQKSLIW | 50 | | | | | | |
| PB1 | N/A | 813 | — | no | 2 | 99.99 | 100 | RQKWWWL | 50 | RQKSLIWL | 50 | | | | | | |
| PB1 | N/A | 814 | — | no | 2 | 99.99 | 100 | QKWWWLW | 50 | QKSLIWLW | 50 | | | | | |

FIG. 72-378

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 39 | 0.17 | yes | 2 | 0.05 | 99.14 | IIKKYTSG | 98.28 | IIKKYTSA | 0.86 | | | | |
| PB2 | N/A | 40 | 0.15 | yes | 2 | 0.05 | 99.35 | IKKYTSGR | 98.49 | IKKYTSAR | 0.86 | | | | |
| PB2 | N/A | 41 | 0 | no | 1 | 99.99 | 100 | GHNQEYTS | 100 | | | | | | |
| PB2 | N/A | 42 | 0 | no | 1 | 99.99 | 100 | HNQEYTSG | 100 | | | | | | |
| PB2 | N/A | 43 | 0 | no | 1 | 99.99 | 100 | NQEYTSGR | 100 | | | | | | |
| PB2 | N/A | 44 | 0.14 | yes | 2 | 0.04 | 99.43 | KKYTSGRQ | 98.56 | KKYTSARQ | 0.86 | | | | |
| PB2 | N/A | 45 | 0.12 | yes | 2 | 0.04 | 99.58 | KYTSGRQE | 98.71 | KYTSARQE | 0.86 | | | | |
| PB2 | N/A | 46 | 0.11 | yes | 2 | 0.03 | 99.73 | YTSGRQEK | 98.87 | YTSARQEK | 0.86 | | | | |
| PB2 | N/A | 47 | 0.11 | yes | 2 | 0.03 | 99.75 | TSGRQEKN | 98.88 | TSARQEKN | 0.86 | | | | |
| PB2 | N/A | 48 | 0.11 | yes | 2 | 0.03 | 99.73 | SGRQEKNP | 98.87 | SARQEKNP | 0.86 | | | | |
| PB2 | N/A | 49 | 0.94 | yes | 3 | 0.03 | 99.78 | GRQEKNPA | 72.08 | ARQEKNPA | 26.83 | | | | |
| PB2 | N/A | 50 | 0.87 | yes | 2 | 0.03 | 99.77 | RQEKNPAL | 72.94 | RQEKNPSL | 26.83 | | | | |
| PB2 | N/A | 51 | 0.88 | yes | 2 | 0.03 | 99.75 | QEKNPALR | 72.93 | QEKNPSLR | 26.83 | | | | |
| PB2 | N/A | 52 | 0.88 | yes | 2 | 0.03 | 99.73 | EKNPALRM | 72.92 | EKNPSLRM | 26.8 | | | | |
| PB2 | N/A | 53 | 0.88 | yes | 2 | 0.01 | 99.7 | KNPALRMK | 72.89 | KNPSLRMK | 26.81 | | | | |
| PB2 | N/A | 54 | 0.88 | yes | 2 | 0.01 | 99.74 | NPALRMKW | 72.91 | NPSLRMKW | 26.83 | | | | |
| PB2 | N/A | 55 | 0.88 | yes | 2 | 0.01 | 99.69 | PALRMKWM | 72.86 | PSLRMKWM | 26.83 | | | | |
| PB2 | N/A | 56 | 0.04 | yes | 2 | 0.01 | 99.71 | ALRMKWMM | 72.88 | SLRMKWMM | 26.83 | | | | |
| PB2 | N/A | 57 | 0.04 | yes | 1 | 0.01 | 99.71 | LRMKWMMA | 99.71 | | | | | | |
| PB2 | N/A | 58 | 0.05 | yes | 1 | 0 | 99.66 | RMKWMMAM | 99.66 | | | | | | |
| PB2 | N/A | 59 | 0.83 | yes | 2 | 0.01 | 99.69 | MKWMMAMK | 75.97 | MKWMMAMR | 23.72 | | | | |
| PB2 | N/A | 60 | 0.84 | yes | 2 | 0.01 | 99.66 | KWMMAMKY | 75.95 | KWMMAMRY | 23.72 | | | | |
| PB2 | N/A | 61 | 0.84 | yes | 2 | 0.01 | 99.65 | WMMAMKYP | 75.95 | WMMAMRYP | 23.7 | | | | |
| PB2 | N/A | 62 | 0.84 | yes | 2 | 0.02 | 99.6 | MMAMKYPI | 75.91 | MMAMRYPI | 23.69 | | | | |
| PB2 | N/A | 63 | 0.85 | yes | 2 | 0.02 | 99.53 | MAMKYPIT | 75.84 | MAMRYPIT | 23.69 | | | | |
| PB2 | N/A | 64 | 0.86 | yes | 2 | 0.03 | 99.19 | AMKYPITA | 75.86 | AMRYPITA | 23.62 | MKYPITAE | 0.85 | MKYPITAN | 0.21 |
| PB2 | N/A | 65 | 0.97 | yes | 4 | 0.03 | 99.04 | MKYPITAD | 74.64 | MRYPITAD | 23.49 | KYPITADR | 0.89 | KYPITAER | 0.57 |
| PB2 | N/A | 66 | 1.04 | yes | 5 | 0.03 | 99.21 | KYPITADK | 73.84 | RYPITADK | 23.46 | IPERNEHG | 2.46 | | |
| PB2 | N/A | 79 | 0.95 | yes | 3 | 0.02 | 99.21 | IPERNEOG | 77.94 | VPERNEOG | 18.81 | PERNEHG | | | |
| PB2 | N/A | 80 | 0.26 | yes | 2 | 0.03 | 99.04 | PERNEOGQ | 96.74 | PERNEHGQ | 2.46 | | | | |
| PB2 | N/A | 82 | 0.38 | yes | 5 | 0.03 | 99.04 | RNEOGQTL | 95.51 | RNEHGQTL | 2.45 | RNEOGQIL | | RNEOGQAL | 0.25 |
| PB2 | N/A | 83 | 0.37 | yes | 5 | 0.03 | 99.19 | NEOGQTLW | 95.66 | NEHGQTLW | 2.45 | NEOGQILW | | NEOGQALW | 0.25 |
| PB2 | N/A | 95 | 0.25 | yes | 4 | 0.02 | 99 | DAGSDRLW | 97.59 | DAGSDRVI | 0.5 | DAGSDRVM | | DAGSNRVM | 0.45 |
| PB2 | N/A | 97 | 0.54 | yes | 5 | 0.03 | 99.15 | GSDRVMVS | 92.47 | GSDRLMVS | 5.09 | GSDRVI | 0.49 | GSDRVIVS | 0.49 |
| PB2 | N/A | 102 | 0.46 | yes | 4 | 0.02 | 99.06 | MVSPLAVT | 93.26 | IVSPLAVT | 5.08 | MVSPLAIT | 0.5 | | 0.31 |
| PB2 | N/A | 103 | 0.4 | yes | 5 | 0.02 | 99.11 | VSPLAVTW | 93.96 | VSPLAVTW | 5.1 | | | | |
| PB2 | N/A | 104 | 0.1 | yes | 4 | 0.02 | 99.1 | SPLAVTWW | 99.11 | | | | | | |
| PB2 | N/A | 105 | 0.1 | yes | 2 | 0.02 | 99.11 | PLAVTWWN | 99.1 | AVTWWNRS | 0.48 | | | | |
| PB2 | N/A | 106 | 0.06 | yes | 1 | 0.02 | 99.46 | LAVTWWNR | 99.47 | | | | | | |
| PB2 | N/A | 107 | 0.18 | yes | 3 | 0.02 | 99.01 | AVTWWNRK | 98.06 | AVTWWNRK | 0.92 | | | | |
| PB2 | N/A | 108 | 0.18 | yes | 2 | 0.02 | 99.17 | VTWWNRNG | 98.09 | VTWWNRKG | 0.92 | | | | |
| PB2 | N/A | 109 | 0.17 | yes | 2 | 0.03 | | TWWNRNGP | 98.25 | TWWNRKGP | 0.92 | | | | |

FIG. 72-379

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 122 | 0.78 | yes | 5 | 0.05 | 99.17 | HYPKIYKT | 86.45 | HYPKIYKT | 9.69 | HYSKVYKT | 2.57 | HYPK

FIG. 72-380

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 182 | 0.16 | yes | 2 | 0.05 | 99.31 | PNEVGARI | 98.33 | | | | | | |
| PB2 | N/A | 183 | 0.18 | yes | 2 | 0.05 | 99.12 | NEVGARIL | 98.14 | | | | | | |
| PB2 | N/A | 184 | 0.2 | yes | 3 | 0.04 | 99.16 | EVGARILT | 97.97 | EVGARIIT | 0.98 | | | | |
| PB2 | N/A | 185 | 0.21 | yes | 3 | 0.04 | 99.08 | VGARILTS | 97.9 | VGARIITS | 0.99 | | | | |
| PB2 | N/A | 186 | 0.21 | yes | 3 | 0.04 | 99.08 | GARILTSE | 97.89 | GARIITSE | 0.99 | | | | |
| PB2 | N/A | 187 | 0.22 | yes | 3 | 0.04 | 99.01 | ARILTSES | 97.79 | ARIITSES | 0.99 | | | | |
| PB2 | N/A | 188 | 0.23 | yes | 4 | 0.06 | 99.13 | RILTSESQ | 97.75 | RIITSES | 0.99 | RILASESQ | 0.2 | | |
| PB2 | N/A | 189 | 0.18 | yes | 3 | 0.06 | 99 | ILTSESQL | 98.43 | IITSESQL | 1.02 | | | | |
| PB2 | N/A | 199 | 0.44 | yes | 5 | 0.07 | 99.07 | LTSESQM | 94.97 | IITSESQM | 1.02 | | | | |
| PB2 | N/A | 211 | 0.98 | yes | 3 | 0.03 | 99.19 | TKEKKEEL | 70.39 | TKEKKKEL | 0.37 | TKEKRE

FIG. 72-381

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 246 | 0.18 | yes | 2 | 0.12 | 99.73 | HLTQ

FIG. 72-382

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 290 | 0.12 | yes | 2 | 0.13 | 99.31 | LASLLEMC | 98.92 | LSLLEMCH | 0.38 | | | | |
| PB2 | N/A | 291 | 0.14 | yes | 2 | 0.12 | 99.08 | ASLLEMCH | 98.76 | LSLLEMCH | 0.32 | | | | |
| PB2 | N/A | 292 | 0.11 | yes | 1 | 0.14 | 99.09 | SLLEMCHS | 99.09 | | | | | | |
| PB2 | N/A | 293 | 0.1 | yes | 1 | 0.14 | 99.12 | LLEMCHST | 99.12 | | | | | | |
| PB2 | N/A | 294 | 0.2 | yes | 3 | 0.12 | 99.23 | LEMCHSTQ | 98.08 | LEMCHSTR | 0.84 | LEMCHG

FIG. 72-383

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 343 | 0.18 | yes | 4 | 0.13 | 99.18 | FKRTGSS | 98.34 | FKRTKGFS | 0.34 | | | FKRTSGTS | 0.21 | | |
| PB2 | N/A | 354 | 0.4 | yes | 3 | 0.14 | 99.13 | EEEMLTGN | 94.54 | EEELLTGN | 4.04 | | | | |
| PB2 | N/A | 355 | 0.36 | yes | 2 | 0.14 | 99.46 | EEMLTGNL | 94.87 | EELLTGNL | 4.04 | | | | |
| PB2 | N/A | 356 | 0.35 | yes | 3 | 0.14 | 99.04 | EMLTGNLQ | 95 | | | | | | |
| PB2 | N/A | 357 | 0.39 | yes | 3 | 0.14 |

FIG. 72-384

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 424 | 0.37 | yes | 2 | 0.08 | 99.16 | IKAVRGDL | 94.41 | VKAVRGDL | 4.75 | | | | |
| PB2 | N/A | 425 | 0.07 | yes | 1 | 0.08 | 99.38 | KAVRGDLN | 99.38 | | | | | | |
| PB2 | N/A | 426 | 0.06 | yes | 1 | 0.08 | 99.47 | AVRGDLNF | 99.47 | | | | | | |
| PB2 | N/A | 427 | 0.07 | yes | 1 | 0.06 | 99.4 | VRGDLNFV | 99.4 | | | | | | |
| PB2 | N/A | 428 | 0.06 | yes | 1 | 0.06 | 99.55 | RGDLNFYN | 99.55 | | | | | | |
| PB2 | N/A | 429 | 0.06 | yes | 1 | 0.06 | 99.56 | GDLNFYNR | 99.56 | | | | | | |
| PB2 | N/A | 430 | 0.05 | yes | 1 | 0.06 | 99.63 | DLNFYNRA | 99.63 | | | | | | |
| PB2 | N/A | 431 | 0.05 | yes | 1 | 0.07 | 99.61 | LNFYNRAN | 99.61 | | | | | | |
| PB2 | N/A | 432 | 0.05 | yes | 1 | 0.06 | 99.63 | NFYNRANQ | 99.63 | | | | | | |
| PB2 | N/A | 433 | 0.05 | yes | 1 | 0.06 | 99.61 | FYNRANQR | 99.61 | | | | | | |
| PB2 | N/A | 434 | 0.05 | yes | 1 | 0.06 | 99.63 | YNRANQRL | 99.63 | | | | | | |
| PB2 | N/A | 435 | 0.03 | yes | 1 | 0.06 | 99.79 | NRANQRLN | 99.79 | | | | | | |
| PB2 | N/A | 436 | 0.1 | yes | 2 | 0.06 | 99.82 | RANQRLNP | 99.79 | RANQRLNT | 0.89 | | | | |
| PB2 | N/A | 437 | 0.1 | yes | 2 | 0.06 | 99.79 | ANQRLNPM | 98.93 | ANQRLNTM | 0.89 | | | | |
| PB2 | N/A | 438 | 0.11 | yes | 2 | 0.06 | 99.75 | NQRLNPMH | 98.9 | NQRLNTMH | 0.89 | | | | |
| PB2 | N/A | 439 | 0.11 | yes | 2 | 0.07 | 99.75 | QRLNPMHQ | 98.86 | QRLNTMHQ | 0.89 | | | | |
| PB2 | N/A | 440 | 0.11 | yes | 2 | 0.06 | 99.74 | RLNPMHQL | 98.86 | RLNTMHQL | 0.89 | | | | |
| PB2 | N/A | 441 | 0.11 | yes | 2 | 0.06 | 99.75 | LNPMHQLL | 98.85 | LNTMHQLL | 0.89 | | | | |
| PB2 | N/A | 442 | 0.11 | yes | 2 | 0.06 | 99.73 | NPMHQLLR | 98.86 | NTMHQLLR | 0.89 | | | | |
| PB2 | N/A | 443 | 0.04 | yes | 1 | 0.06 | 99.73 | PMHQLLRH | 98.84 | TMHQLLRH | 0.89 | | | | |
| PB2 | N/A | 444 | 0.04 | yes | 1 | 0.06 | 99.73 | MHQLLRHF | 98.84 | | | | | | |
| PB2 | N/A | 445 | 0.04 | yes | 1 | 0.06 | 99.69 | HQLLRHFQ | 99.73 | | | | | | |
| PB2 | N/A | 446 | 0.05 | yes | 1 | 0.07 | 99.69 | QLLRHFQK | 99.69 | | | | | | |
| PB2 | N/A | 447 | 0.11 | yes | 2 | 0.07 | 99.6 | LLRHFQKD | 99.6 | | | | | | |
| PB2 | N/A | 448 | 0.12 | yes | 3 | 0.07 | 99.01 | LRHFQKDA | 99.01 | LRHFQKNA | 0.38 | RHFQKNAK | 0.38 | | |
| PB2 | N/A | 449 | 0.17 | yes | 5 | 0.08 | 99.34 | RHFQKDAK | 98.96 | RHFQKDAR | 0.67 | HFQKNAKV | 0.53 | HFQKDAKM | 0.22 |
| PB2 | N/A | 450 | 0.32 | yes | 5 | 0.08 | 99.36 | HFQKDAKV | 98.31 | HFQKDAKI | 1.38 | FQKNAKVL | 0.53 | FQKDAKML | 0.22 |
| PB2 | N/A | 451 | 0.32 | yes | 5 | 0.08 | 99.12 | FQKDAKVL | 96.62 | FQKDAKIL | 1.38 | VMGMVGIL | 6.51 | IMGMGIL | 0.4 |
| PB2 | N/A | 470 | 1.15 | yes | 4 | 0.1 | 99.13 | VMGMGIL | 96.62 | VMGMVGVL | 1.83 | MGMVGILP | 6.52 | MGMIGILS | 0.68 |
| PB2 | N/A | 471 | 1.18 | yes | 5 | 0.09 | 99.13 | MGMIGILP | 78.03 | MGMVGVL | 11.83 | GMVGILPD | 6.52 | GMIGILSD | 0.68 |
| PB2 | N/A | 472 | 1.19 | yes | 5 | 0.1 | 99.09 | GMIGILPD | 77.71 | MGMIGVL | 11.83 | GILSDMTP | 0.71 | | |
| PB2 | N/A | 475 | 1.02 | yes | 4 | 0.09 | 99 | GILPDMTP | 77.62 | GMVGVLP | 11.83 | GILPDLTP | 18.29 | | |
| PB2 | N/A | 492 | 0.56 | yes | 3 | 0.08 | 99.01 | GILPDMTP | 77.6 | GMYGVLPD | 11.83 | RVSKTGVD | 1.25 | RVSRMGVD | 0.3 |
| PB2 | N/A | 493 | 0.55 | yes | 5 | 0.1 | 99.1 | RVSKMGVD | 92.67 | GVLPDLTP | 11.83 | VSKTGVDE | 1.26 | VSRMGVDE | 0.3 |
| PB2 | N/A | 494 | 0.33 | yes | 5 | 0.09 | 99.17 | VSKMGVDE | 92.74 | GVLPDMTP | 18.29 | | | | |
| PB2 | N/A | 495 | 0.35 | yes | 4 | 0.08 | 99.21 | SKMGVDEY | 95.96 | RISKMGVD | 3.16 | | | | |
| PB2 | N/A | 496 | 0.71 | yes | 5 | 0.09 | 99.36 | KMGVDEYS | 95.74 | ISKMGVDE | 3.16 | RMGVDEYS | 0.37 | | |
| PB2 | N/A | 497 | 0.54 | yes | 3 | 0.1 | 99.23 | MGVDEYSS | 88.35 | SKVGVDEY | 1.76 | TGVDEYSS | 1.57 | | |
| PB2 | N/A | 498 | 0.55 | yes | 4 | 0.09 | 99.2 | GVDEYSST | 90.97 | KTGVDEYS | 1.76 | | | | |
| PB2 | N/A | 499 | 0.62 | yes | 4 | 0.1 | 99.25 | VDEYSSTE | 90.56 | KGVDEYSN | 7.67 | DEYSSAER | 0.73 | DEYSSTEK | 0.49 |
| PB2 | N/A | 508 | 0.42 | yes | 3 | 0.08 | 99.27 | DEYSSTER | 95.15 | GVDEYSNA | 7.56 | AVSIDRFL | 0.87 | TVSIDRFL | 0.45 |
| PB2 | N/A | 509 | 0.16 | yes | 2 | 0.07 | 99.37 | VVSIDRFL | 98.45 | VDEYSNAE | 6.83 | | | | |

FIG. 72-385

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| PB2 | N/A | 510 | 0.16 | yes | 2 | 0.07 | 99.37 | SIDRFLRV | 98.45 | NIDRFLRV | 0.92 | | | | | | |
| PB2 | N/A | 511 | 0.15 | yes | 2 | 0.07 | 99.38 | IDRFLRVR | 98.59 | IDRFLRV | 0.79 | | | | | | |
| PB2 | N/A | 512 | 0.14 | yes | 2 | 0.08 | 99.44 | DRFLRVRD | 98.65 | DRFLRVKD | 0.79 | | | | | | |
| PB2 | N/A | 513 | 0.16 | yes | 2 | 0.08 | 99.31 | RFLRVRDQ | 98.52 | RFLRVKDQ | 0.79 | | | | | | |
| PB2 | N/A | 514 | 0.45 | yes | 5 | 0.08 | 99.14 | FLRVRDQR | 94.17 | FLRVRDQQ | 3.62 | FLRVRDQM | 0.2 | FLRVRDQL | 0.76 | FLRVRDQQ | 3.62 |
| PB2 | N/A | 515 | 0.45 | yes | 5 | 0.08 | 99.19 | LRVRDQRG | 94.23 | LRVKDQQG | 3.62 | LRVRD

FIG. 72-386

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| PB2 | N/A | 560 | 0.57 | yes | 3 | 0.08 | 99.69 | VNTYQWII | 89.89 | VNTYQWI | 7.94 | | | | | | |
| PB2 | N/A | 561 | 0.24 | yes | 3 | 0.1 | 99.75 | NTYQWIIR | 97.05 | NTYQWIIK | 1.93 | | | | | | |
| PB2 | N/A | 562 | 0.29 | yes | 3 | 0.1 | 99.15 | TYQWIIRN | 96.46 | TYQWIIKN | 1.93 | | | | | | |
| PB2 | N/A | 563 | 0.29 | yes | 3 | 0.1 | 99.16 | YQWIIRNW | 96.47 | YQWIIKNW | 1.93 | | | | | | |
| PB2 | N/A | 564 | 0.97 | yes | 4 | 0.08 | 99.14 | QWIIRNWE | 96.46 | QWIIKNWE | 1.93 | | | | | | |
| PB2 | N/A | 574 | 1.28 | yes | 4 | 0.06 | 99.32 | KIQWSQDP | 72.35 | KIQWSQEP | 26.33 | IQWSQEPT | 0.64 | | | | |
| PB2 | N/A | 575 | 0.32 | yes | 4 | 0.06 | 99.22 | IQWSQDPT | 72.25 | IQWSQNPT | 15.72 | IQWSQNPS | 9.88 | | | | |
| PB2 | N/A | 584 | 0.34 | yes | 3 | 0.06 | 99.17 | LYNKMEFE | 96.21 | LYNKVEFE | 2.01 | LYNKLEFE | 0.64 | | | | |
| PB2 | N/A | 585 | 0.33 | yes | 3 | 0.06 | 99.18 | YNKMEFEP | 96.08 | YNKVEFEP | 2.01 | YNKLEFEP | 0.64 | | | | |
| PB2 | N/A | 586 | 0.32 | yes | 3 | 0.06 | 99.27 | NKMEFEPF | 96.08 | NKVEFEPF | 2.02 | NKLEFEPF | 0.64 | | | | |
| PB2 | N/A | 587 | 0.3 | yes | 3 | 0.06 | 99.09 | KMEFEPFQ | 96.17 | KVEFEPFQ | 2.02 | KLEFEPFQ | 0.64 | | | | |
| PB2 | N/A | 588 | 0.05 | yes | 2 | 0.08 | 99.6 | MEFEPFQS | 96.42 | VEFEPFQS | 2.03 | | | | | | |
| PB2 | N/A | 589 | 0.14 | yes | 1 | 0.07 | 99.57 | EFEPFQSL | 99.6 | | | | | | | | |
| PB2 | N/A | 590 | 0.14 | yes | 1 | 0.08 | 99.56 | EPFQSLV | 98.45 | F

FIG. 72-387

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 629 | 0.13 | yes | 2 | 0.05 | 99.1 | IKLLPFAA | 98.72 | IKLLPFAS | 0.38 | | | | |
| PB2 | N/A | 630 | 0.12 | yes | 2 | 0.05 | 99.26 | KLLPFAAA | 98.88 | KLLPFASA | 0.38 | | | | |
| PB2 | N/A | 631 | 0.11 | yes | 2 | 0.05 | 99.27 | LLPFAAAP | 98.9 | LPFASAP | 0.38 | | | | |
| PB2 | N/A | 632 | 0.09 | yes | 1 | 0.04 | 99.18 | LPFAAAPP | 99.18 | | | | | | |
| PB2 | N/A | 633 | 1.03 | yes | 3 | 0.03 | 99.08 | PFAAAPPE | 67.23 | PFAAAPPY | 31.41 | PFAAAPPK | 0.44 | | |
| PB2 | N/A | 634 | 1.04 | yes | 4 | 0.03 | 99.01 | FAAAPPEQ | 67.19 | FAAAPPY | 31.38 | FAAAPPKQ | 0.44 | | |
| PB2 | N/A | 635 | 1.07 | yes | 5 | 0.03 | 99.1 | AAAPPEQS | 66.98 | AAAPPVQ | 31.31 | AAAPPKQS | 0.44 | ASAPPEQS | 0.37 |
| PB2 | N/A | 636 | 1.08 | yes | 4 | 0.04 | 99.12 | AAPPEQSR | 66.98 | SAPPEQSR | 31.33 | AAPPKQSR | 0.37 | AAPPVQSR | 0.22 |
| PB2 | N/A | 637 | 1.05 | yes | 4 | 0.03 | 99.03 | APPEQSRM | 66.98 | APPVQSRM | 31.33 | APPKQSRM | 0.22 | APPVQSR | 0.22 | AAPPVQSK | 0.22 |
| PB2 | N/A | 638 | 1.05 | yes | 5 | 0.04 | 99.08 | PPEQSRMQ | 67.27 | PPVQSKMQ | 31.33 | PKQSRMQ | 0.22 | PPVQSKM | 0.22 |
| PB2 | N/A | 639 | 1.05 | yes | 4 | 0.05 | 99.03 | PEQSRMQF | 67.31 | PVQSKMQF | 31.33 | PKQSRMQF | 0.22 | PVQSKMQF | 0.22 | PEQSKMQF | 0.22 |
| PB2 | N/A | 640 | 1.07 | yes | 5 | 0.04 | 99.15 | EQSRMQFS | 67.24 | VQSKMQFS | 31.31 | KQSRMQFS | 0.22 | VQSRMQFS | 0.22 | EQSKMQFS | 0.16 |
| PB2 | N/A | 641 | 0.14 | yes | 2 | 0.1 | 99.16 | QSRMQFSSL | 98.75 | QSKMQFSS | 0.42 | | | | |
| PB2 | N/A | 642 | 0.15 | yes | 2 | 0.11 | 99.03 | SRMQFSSLT | 98.64 | SKMQFSSL | 0.38 | | | | |
| PB2 | N/A | 643 | 0.16 | yes | 2 | 0.11 | 99.06 | RMQFSSLT | 98.61 | KMQFSSLT | 0.45 | | | | |
| PB2 | N/A | 644 | 0.12 | yes | 1 | 0.1 | 99.02 | MQFSSLT | 99.02 | | | | | | |
| PB2 | N/A | 645 | 0.15 | yes | 3 | 0.1 | 99 | QFSSLTVN | 98.69 | QFSSLTVS | 0.32 | | | | |
| PB2 | N/A | 646 | 0.16 | yes | 3 | 0.1 | 99.12 | FSSLTVNV | 98.59 | FSSLTVSV | 0.32 | FSSLAVNV | 0.32 | | |
| PB2 | N/A | 647 | 0.15 | yes | 3 | 0.1 | 99.15 | SSLTVNVR | 98.62 | SSLTVSVR | 0.32 | SSLAVNVR | 0.32 | | |
| PB2 | N/A | 648 | 0.18 | yes | 4 | 0.1 | 99.03 | SLTVNVRG | 98.71 | SLTVSVRG | 0.31 | | | | |
| PB2 | N/A | 649 | 0.16 | yes | 3 | 0.04 | 99.01 | LTVNVRGS | 98.32 | LTVSYRGS | 0.38 | LTVSYRGG | 0.31 | | |
| PB2 | N/A | 650 | 0.18 | yes | 3 | 0.03 | 99.19 | TVNVRGSG | 98.49 | TVSYRGSG | 0.38 | TVSYRGG | 0.38 | | |
| PB2 | N/A | 651 | 0.95 | yes | 5 | 0.02 | 99.12 | VNVRGSGM | 73.28 | VNVRGTGM | 25.47 | | | | |
| PB2 | N/A | 652 | 0.94 | yes | 5 | 0.03 | 99.2 | NVRGSGMR | 73.35 | NVRGTGMR | 25.48 | | | | |
| PB2 | N/A | 653 | 0.93 | yes | 5 | 0.01 | 99.31 | VRGSGMRI | 73.45 | VRGTGMRI | 25.48 | | | | |
| PB2 | N/A | 654 | 0.95 | yes | 5 | 0.01 | 99.12 | RGSGMRIL | 73.3 | RGTGMRIL | 25.45 | GTGMRILV | 0.21 | | |
| PB2 | N/A | 655 | 1.31 | yes | 5 | 0.01 | 99.12 | GSGMRILV | 66.31 | GGMRILI | 25.22 | TGMRILVR | 0.21 | | |
| PB2 | N/A | 656 | 1.31 | yes | 5 | 0.01 | 99.13 | SGMRILVR | 66.31 | GMRILIRG | 25.21 | GLRILIRG | 0.31 | GGLRILI | 0.23 | | |
| PB2 | N/A | 657 | 1.27 | yes | 4 | 0.01 | 99.08 | GMRILVRG | 66.69 | MRILIRGN | 25.2 | LRILIRGN | 0.31 | SGLRILIR | 0.23 | | |
| PB2 | N/A | 658 | 1.28 | yes | 4 | 0.02 | 99.06 | MRILVRGN | 66.64 | RILIRGNS | 25.2 | RILIRGN | 0.38 | | |
| PB2 | N/A | 659 | 0.49 | yes | 2 | 0.03 | 99.01 | RILVRGNS | 91.82 | ILIRGNSP | 7.23 | ILIRGNS | 0.38 | | |
| PB2 | N/A | 660 | 0.49 | yes | 2 | 0.03 | 99.16 | ILVRGNSP | 91.79 | LIRGNSPI | 7.21 | LIRGNSP | 0.38 | | |
| PB2 | N/A | 661 | 0.58 | yes | 3 | 0.03 | 99.38 | LVRGNSPV | 90.99 | IRGNSPIF | 6.68 | LVRGNSPA | 0.79 | LIRGNSPI | 0.79 | LIRGNSPA | 0.79 |
| PB2 | N/A | 662 | 0.56 | yes | 3 | 0.03 | 99.2 | VRGNSPVF | 91.2 | RGNSPIFN | 6.69 | VRGNSPAF | 0.79 | IRGNSPI | 0.79 | VRGNSPAF | 0.79 |
| PB2 | N/A | 663 | 0.2 | yes | 3 | 0.03 | 99.48 | RGNSPVFN | 97.89 | GNSPIFNY | 0.81 | RGNSPAFN | 0.78 | | RGNSPAFN | 0.78 |
| PB2 | N/A | 664 | 0.22 | yes | 4 | 0.03 | 99.28 | GNSPYFNY | 97.69 | NSPIFNYN | 0.81 | GNSPAFNY | 0.78 | | GNSPAFNY | 0.78 |
| PB2 | N/A | 665 | 0.25 | yes | 4 | 0.03 | 99.08 | NSPYFNYN | 97.48 | SPIFNYNK | 0.81 | NSPAFNYN | 0.78 | | |
| PB2 | N/A | 666 | 0.41 | yes | 5 | 0.03 | 99.12 | SPVFNYNK | 94.97 | SPIFNYN | 2.55 | SPAFNYNK | 0.81 | | |
| PB2 | N/A | 675 | 0.92 | yes | 3 | 0.08 | 99.14 | SPVFNYNR | 76.63 | TKRLTILG | 21.93 | TRRLTVLG | 0.21 | TKRLAVLG | 0.15 |
| PB2 | N/A | 676 | 0.9 | yes | 3 | 0.04 | 99.1 | TKRLTVLG | 76.8 | KRLTILGK | 21.94 | RRLTVLGK | 0.21 | | |
| PB2 | N/A | 677 | 0.89 | yes | 3 | 0.05 | 99.1 | KRLTVLGK | 76.92 | RLTILGKD | 21.98 | | | | |
| PB2 | N/A | 678 | 0.87 | yes | 2 | 0.02 | 99.03 | RLTVLGKDA | 77.04 | LTILGKDA | 22 | | | | |

FIG. 72-388

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 679 | 0.87 | yes | 2 | 0.03 | 99.06 | TVLGKDAG | 77.07 | TILGKDAG | | | | | |
| PB2 | N/A | 681 | 1.04 | yes | 5 | 0.03 | 99.11 | LGKDAGAL | 71.47 | LGKDAGTL | 22 | LGKDAGSL | 0.51 | LGKDAGEL | 0.34 | IGKDAGAL | 0.23 |
| PB2 | N/A | 685 | 0 | no | 1 | 99.99 | 100 | AGAGALAE | | | 26.56 | | | | | |
| PB2 | N/A | 686 | 0 | no | 1 | 99.99 | 100 | GAGALAED | | | | | | | | |
| PB2 | N/A | 699 | 1.21 | yes | 4 | 0.09 | 99.06 | AGVESAVL | 54.9 | SGVESAVL | 42.47 | TGVESAVL | 1.09 | GGVESAVL | 0.6 | |
| PB2 | N/A | 700 | 0.1 | yes | 1 | 0.09 | 99.14 | GVESAVLR | 99.14 | | | | | | | |
| PB2 | N/A | 701 | 0.09 | yes | 1 | 0.09 | 99.18 | VESAVLRG | 99.18 | | | | | | | |
| PB2 | N/A | 702 | 0.09 | yes | 1 | 0.08 | 99.5 | ESAVLRGF | 99.5 | | | | | | | |
| PB2 | N/A | 703 | 0.06 | yes | 1 | 0.08 | 99.51 | SAVLRGFL | 99.51 | | | | | | | |
| PB2 | N/A | 704 | 0.06 | yes | 1 | 0.08 | 99.51 | AVLRGFLI | 99.51 | | | | | | | |
| PB2 | N/A | 705 | 0.04 | yes | 1 | 0.01 | 99.69 | VLRGFLII | 99.71 | | | | | | |

FIG.72-389

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 746 | 0.15 | yes | 2 | 0.16 | 99.57 | DWVLVMKR | 99.57 | | | | | | |
| PB2 | N/A | 747 | 0.15 | yes | 2 | 0.17 | 99.56 | WLVMKRK | 99.56 | |

FIG. 73-2

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 347 | 0 | no | 1 | 99.95 | 100 | EYNG

FIG. 73-4

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | ALL | 5 | 0.31 | no | 2 | 99.92 | 100 | EQKQEFKMN | 94.44 | SQKQEFKMN | 5.56 | | | | |
| NA | ALL | 6 | 0.47 | no | 3 | 99.82 | 100 | OKQEFKMNP | 92.11 | QKQEIKMNP | 5.26 | AKAGVKMNP | 2.63 | | |
| NA | ALL | 7 | 0.47 | no | 3 | 99.82 | 100 | KQEFKMNPN | 92.11 | KQEIKMNPN | 5.26 | KAGVKMNPN | 2.63 | | |
| NA | ALL | 8 | 1.08 | no | 4 | 99.82 | 100 | QEFKMNPNQ | 76.32 | QEIKMNPNQ | 15.79 | AGVKMNPNQ | 5.26 | AGVKMNPNQ | 2.63 |
| NA | ALL | 9 | 1.08 | no | 4 | 99.82 | 100 | EFKMNPNKK | 76.32 | EIKMNPNQK | 15.79 | GVKMNPNQK | 5.26 | GVKMNPNQK | 2.63 |
| NA | ALL | 10 | 1.08 | no | 4 | 99.82 | 100 | FKMNPNKKI | 76.32 | IKMNPNQKI | 15.79 | VKMNPNQKI | 5.26 | VKMNPNQKI | 2.63 |
| NA | ALL | 11 | 0.99 | no | 3 | 99.81 | 100 | KMNPNKKII | 70.73 | KMNPNQKII | 26.83 | KMNPNQKIM | 2.44 | | |
| NA | ALL | 18 | 0 | no | 1 | 100 | 100 | IIAIGSYS | 100 | | | | | | |
| NA | ALL | 20 | 0 | no | 1 | 100 | 100 | NRDTIGSI | 100 | | | | | | |
| NA | ALL | 21 | 0 | no | 1 | 100 | 100 | RDITIGSIC | 100 | | | | | | |
| NA | ALL | 22 | 0 | no | 1 | 100 | 100 | DITIGSICM | 100 | | | | | | |
| NA | ALL | 77 | 0 | no | 1 | 100 | 100 | VPLVPCEPI | 100 | | | | | | |
| NA | ALL | 78 | 0 | no | 1 | 100 | 100 | PLVPCEPII | 100 | | | | | | |
| NA | ALL | 79 | 0 | no | 1 | 100 | 100 | LVPCEPIII | 100 | | | | | | |
| NA | ALL | 386 | 0.47 | yes | 3 | 0.1 | 99.25 | ILRTQESSC | 93.17 | ILRTQESSC | 5.13 | IMRTQESEC | 0.95 | RTQESECQC | 2.27 |
| NA | ALL | 388 | 1.46 | yes | 5 | 0.1 | 99.36 | RTQESECVC | 53.98 | RTQESECAC | 37.95 | RTQESSCTC | 4.44 | RTQESECQC | |
| NA | ALL | 411 | 0 | no | 2 | 99.99 | 100 | IRKGLILEY | 50 | IRKGLILEY | 50 | RKGLILEYY | 33.33 | | |
| NA | ALL | 412 | -1.58 | no | 3 | 99.99 | 100 | IREGLILEY | 33.33 | VMGQASYKI | 33.33 | | | | |
| NA | ALL | 418 | 0 | no | 1 | 100 | 100 | YKYKIFKNG | 100 | | | | | | |
| NA | ALL | 419 | 0 | no | 1 | 100 | 100 | KYKIFKNGK | 100 | | | | | | |
| NA | ALL | 426 | 1.37 | no | 3 | 100 | 99.8 | GKKRGKWLNQ | 60 | GKRGKWWKS | 20 | EKGKVYKSV | 20 | | |
| NA | ALL | 442 | 0.53 | no | 4 | 97.7 | 99.8 | IQHLEESC | 91.37 | IKHLEESC | 6.22 | VQHLEESC | 1.41 | IRHLEESC | 0.8 |
| NA | ALL | 454 | -1 | no | 2 | 99.99 | 100 | SYLNVRCVC | 50 | SYPNVRCVC | 50 | | | | |
| NA | ALL | 474 | 0 | no | 1 | 100 | 100 | KLDINMADY | 100 | | | | | | |
| NA | ALL | 547 | 0.26 | no | 3 | 99.98 | 99.37 | NNYGVKGFG | 96.2 | DNYGVKGFG | 3.16 | | | | |
| NA | ALL | 548 | 0.06 | no | 2 | 99.27 | 99.37 | NYGVKGFGF | 99.37 | | | | | | |
| NA | ALL | 660 | 0 | no | 1 | 99.99 | 100 | IFLWCKIVT | 100 | | | | | | |
| NA | ALL | 661 | 0 | no | 1 | 99.99 | 100 | FLWCKIVTT | 100 | | | | | | |
| NA | ALL | 662 | 0 | no | 1 | 99.99 | 100 | LWCKIVTTV | 100 | | | | | | |
| NA | ALL | 663 | 0 | no | 1 | 99.27 | 100 | WCKIVTTVG | 100 | | | | | | |
| NA | ALL | 664 | 0 | no | 1 | 99.27 | 100 | CKIVTTVGW | 100 | | | | | | |
| NA | ALL | 665 | 0 | no | 1 | 100 | 100 | KIVTTVGWS | 100 | | | | | | |
| NA | ALL | 666 | 0 | no | 1 | 100 | 100 | IVTTVGWSW | 100 | | | | | | |
| NA | ALL | 667 | 0 | no | 1 | 100 | 100 | VTTVGWSWP | 100 | | | | | | |
| NA | ALL | 668 | 0 | no | 1 | 100 | 100 | TTVGWSWPD | 100 | | | | | | |
| NA | ALL | 678 | 0 | no | 1 | 100 | 100 | RTSISCLYK | 100 | | | | | | |
| NA | ALL | 685 | 0 | no | 1 | 99.99 | 100 | LHAYISFRNL | 100 | | | | | | |
| NA | ALL | 686 | 0 | no | 1 | 99.94 | 100 | HAYISFRNL | 100 | | | | | | |
| NA | N1 | 1 | 0.59 | no | 2 | 99.99 | 100 | IGLREQKQE | 85.71 | LVFREQKQE | 14.29 | VFREQKQEF | 7.69 | | |
| NA | N1 | 2 | 0.77 | no | 3 | 99.89 | 100 | GLREQKQEF | 84.62 | FSGSQKQEF | 7.69 | FREQKQEF | 7.69 | | |
| NA | N1 | 3 | 0.73 | no | 3 | 99.88 | 100 | LREQKQEFK | 85.71 | SGSQKQEFK | 7.14 | FREQKQEFK | 7.14 | | |

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | N1 | 156 | 1.37 | yes | 5 | 0.08 | 99.16 | NDKHSNGTI | 47.66 | NDKHSNGTV | 46.56 | NDKHSNGTA | 4.27 | NDRHSNGTI | 0.19 |
| NA | N1 | 165 | 1.49 | yes | 5 | 0.14 | 99.07 | DRSPYRTLM | 60.11 | DRSPYRALM | 21.07 | DKSPHRALM | 17.47 | DRSPFRALM | 0.19 |
| NA | N1 | 166 |

| Protein | Sub-type | Start Pos | Block Entropy | Gaps >10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | N1 | 375 | 0.15 | yes | 3 | 0.04 | 99.13 | NGVWIGRTK | 98.69 | DGVWIGRTK | 0.24 | NGVWMGRTK | 0.2 | | |
| NA | N1 | 376 | 0.14 | yes | 3 | 0.04 | 99.12 | GVWIGRTKS | 98.75 | GVWIGRTKN | 0.37 | | | | |
| NA | N1 | 390 | 0.26 | yes | 3 | 0.03 | 99.28 | GFEMIWDPN | 96.97 | GFEMIWDPD | 1.17 | | | | |
| NA | N1 | 391 | 0.26 | yes | 4 | 0.02 | 99.31 | FEMIWDPNG | 96.99 | FEMIWDPDG | 1.17 | | | | |
| NA | N1 | 392 | 0.26 | yes | 2 | 0.03 | 99.33 | EMIWDPNGW | 97.01 | EMIWDPDGW | 1.18 | FEMVWDPN | 1.14 | | |
| NA | N1 | 417 | 1.16 | yes | 2 | 0.02 | 99.04 | TDWSGYSGS | 54.57 | NEWSGYSGS | 43.76 | EMVWDPNGW | 1.14 | | |
| NA | N1 | 418 | 1.07 | yes | 2 | 0.03 | 99.25 | DWSGYSGSF | 55.15 | EWSGYSGSF | 44.11 | NDWSGYSGS | 0.41 | TNWSGYSGS | 0.3 |
| NA | N1 | 419 | 0.14 | yes | 2 | 0.02 | 99.66 | WSGYSGSFI | 98.48 | WSGYSGSFV | 1.18 | | | | |
| NA | N1 | 420 | 0.13 | yes | 2 | 0.03 | 99.75 | SGYSGSFVQ | 98.57 | SGYSGSFIQ | 1.18 | | | | |
| NA | N1 | 421 | 0.11 | yes | 2 | 0.04 | 99.85 | GYSGSFVQH | 98.67 | GYSGSFIQH | 1.18 | | | | |
| NA | N1 | 422 | 0.12 | yes | 2 | 0.04 | 99.84 | YSGSFVQHP | 98.66 | YSGSFIQHP | 1.18 | | | | |
| NA | N1 | 423 | 0.12 | yes | 2 | 0.04 | 99.82 | SGSFVQHPE | 98.65 | SGSFIQHPE | 1.16 | | | | |
| NA | N1 | 424 | 0.14 | yes | 2 | 0.04 | 99.6 | GSFVQHPEL | 98.44 | GSFIQHPEL | 1.15 | | | | |
| NA | N1 | 425 | 0.15 | yes | 2 | 0.03 | 99.59 | SFVQHPELT | 98.44 | SFIQHPELT | 1.15 | | | | |
| NA | N1 | 426 | 0.49 | yes | 3 | 0.03 | 99.51 | FVQHPELTG | 98.36 | FIQHPELTG | 6.18 | IQHPELTG

FIG. 73-9

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N1 | 480 | 0 | no | 1 | 99.99 | 100 | VITVGWSWP | 100 | | | | | | |
| NA | N1 | 481 | 0 | no | 1 | 99.99 | 100 | TTVGWSWPD | 100 | | | | | | |
| NA | N1 | 485 | 0.53 | yes | 4 | 3.07 | 99.05 | WSWPDGAEL | 99.05 | WSWPDGADL | 5.78 | WSWPDGAEV | 0.74 | WSWPDDAEL | 0.51 | |
| NA | N1 | 486 | 0.54 | yes | 4 | 3.47 | 99.03 | SWPDGAELP | 99.03 | SWPDGADLP | 5.8 | SWPDGAEVP | 0.75 | SWPDDAELP | 0.51 | WPDDAELPF | 0.18 |
| NA | N1 | 487 | 0.55 | yes | 5 | 3.47 | 98.35 | WPDGAELPF | 98.35 | WPDGADLPF | 5.83 | WPDGAEVPF | 0.73 | WPDGAKLPF | 0.39 | |
| NA | N2 | 1 | 0 | no | 1 | 99.99 | 100 | AKAGVKMNP | 100 | | | | | | |
| NA | N2 | 2 | 0 | no | 1 | 99.99 | 100 | KAGVKMNPN | 100 | | | | | | |
| NA | N2 | 3 | 0 | no | 1 | 99.99 | 100 | AGVKMNPNQ | 100 | | | | | | |
| NA | N2 | 4 | 0 | no | 1 | 99.99 | 100 | GVKMNPNQK | 100 | | | | | | |
| NA | N2 | 5 | 0 | no | 1 | 99.99 | 100 | VKMNPNQKI | 100 | | | | | | |
| NA | N2 | 6 | 0 | no | 1 | 99.99 | 100 | KMNPNQKII | 100 | | | | | | |
| NA | N2 | 13 | 0 | no | 1 | 99.99 | 100 | IIAIGSVS | 100 | | | | | | |
| NA | N2 | 54 | 0.59 | yes | 2 | 99.9 | 100 | KNNQVILCE | 85.71 | KNNQVILCG | 14.29 | | | | |
| NA | N2 | 59 | 0 | no | 1 | 99.99 | 100 | VPLVPCEPI | 100 | | | | | | |
| NA | N2 | 60 | 0 | no | 1 | 99.99 | 100 | PLVPCEPII | 100 | | | | | | |
| NA | N2 | 61 | 0 | no | 1 | 99.99 | 100 | LVPCEPIII | 100 | | | | | | |
| NA | N2 | 72 | 0 | no | 1 | 99.99 | 100 | KTVHLNST | 100 | | | | | | |
| NA | N2 | 86 | 0 | no | 1 | 99.92 | 100 | EKEKEICSV | 100 | | | | | | |
| NA | N2 | 87 | 0 | no | 1 | 99.92 | 100 | KEKEICSVV | 100 | | | | | | |
| NA | N2 | 110 | 0.37 | yes | 4 | 0.01 | 99.05 | GFAPFSKDN | 95.75 | GFAPFAKDN | 1.81 | GFVPFSKDN | 1.81 | GFAPFTKDN | 0.94 | FAPLSKDNS | 0.55 |
| NA | N2 | 111 | 0.37 | yes | 5 | 0.01 | 99.38 | FAPFSKDNS | 95.71 | FAPFAKDNS | 1.81 | FVPFSKDNS | 1.81 | FAPFTKDNS | 0.92 | APLSKDNSI | 0.55 |
| NA | N2 | 112 | 0.41 | yes | 5 | 0 | 99.02 | APFSKDNSI | 95.36 | APFAKDNSI | 1.81 | VPFSKDNSI | 1.81 | APFTKDNSI | 0.91 | PFSKDNSVR | 0.39 |
| NA | N2 | 113 | 0.35 | yes | 5 | 0.01 | 99.23 | PFSKDNSIR | 96.11 | PFAKDNSIR | 1.81 | PFTKDNSIR | 0.55 | PLSKDNSIR | 0.55 | FSKDNSVRL | 0.39 |
| NA | N2 | 114 | 0.36 | yes | 3 | 0.01 | 99.16 | FSKDNSIRL | 96.04 | FAKDNSIRL | 1.81 | FTKDNSIR L | 0.55 | LSKDNSIRL | 0.55 | SKDNSIRLA | 0.37 |
| NA | N2 | 115 | 0.34 | yes | 3 | 0.03 | 99.21 | SKDNSIRLS | 96.19 | AKDNSIRLS | 1.81 | TKDNSIRLS | 0.55 | SKDNSVRLS | 0.37 | |
| NA | N2 | 116 | 0.18 | yes | 4 | 0.04 | 99.09 | KDNSIRLSA | 98.43 | KDNSIRLSA | 0.37 | KDNSIRLAA | 0.29 | | | |
| NA | N2 | 117 | 0.3 | yes | 3 | 0.06 | 99.1 | DNSIRLSAG | 96.81 | DNSIRLSAS | 1.7 | DNSIRLAAG | 0.33 | DNSIRLAAG | 0.26 | |
| NA | N2 | 128 | 0.29 | yes | 4 | 0.06 | 99.16 | NSIRLSAGG | 96.87 | NSIRLSASG | 1.7 | NSIRLAAGG | 0.33 | NSIRLAAGG | 0.26 | |
| NA | N2 | 129 | 0.53 | yes | 4 | 0.06 | 99.02 | IWTREPYV | 91.96 | IWTRELYV | 6.41 | IWTRELYV | 0.52 | VWVTREPYV | 0.12 | |
| NA | N2 | 130 | 0.51 | yes | 3 | 0.06 | 99.05 | WVTREPYYS | 92.1 | WVTRELYS | 6.42 | WVTRELYYS | 0.52 | | | |
| NA | N2 | 131 | 0.51 | yes | 3 | 0.06 | 99.09 | ITREPYYSC | 92.14 | VTRELYYSC | 6.42 | VTREPYYSC | 0.52 | | | |
| NA | N2 | 142 | 1.07 | yes | 5 | 0.01 | 99.34 | TREPYYSCG | 79.96 | TREPYYSCG | 10.89 | TREPYVSCE | 6.9 | TREPYVSCD | 0.77 | TRELYVSCD | 0.52 |
| NA | N2 | 143 | 0.21 | yes | 3 | 0.06 | 99.41 | KCYQFALGQ | 97.87 | NCYQFALGQ | 1.02 | | | | | |
| NA | N2 | 144 | 0.08 | yes | 1 | 0.06 | 99.38 | CYQFALGQG | 99.41 | | | | | | |
| NA | N2 | 145 | 0.08 | yes | 1 | 0 | 99.41 | YQFALGQGT | 99.38 | | | | | | |
| NA | N2 | 146 | 0.08 | yes | 1 | 0 | 99.38 | QFALGQGTT | 99.39 | | | | | | |
| NA | N2 | 168 | 0.09 | yes | 1 | 0.03 | 99.39 | FALGQGTTL | 99.32 | | | | | | |
| NA | N2 | 169 | 1.21 | yes | 5 | 0.03 | 99.32 | PYRTLMNE | 63.67 | PHRTLMNE | 32.63 | PYRTLMSE | 1.7 | PHRTLMSE | 0.91 | |
| NA | N2 | 169 | 1.14 | yes | 4 | 0.03 | 99.68 | YRTLLMNEL | 63.93 | HRTLLMNEL | 33.11 | YRTLLMSEL | 1.7 | YRTLLMSEL | 0.94 | |
| NA | N2 | 170 | 0.21 | yes | 2 | 0.03 | 99.72 | RTLLMSELG | 97.09 | RTLLMSELG | 2.64 | | | | | |
| NA | N2 | 171 | 0.29 | yes | 3 | 0.03 | 99.71 | TLLMNELGV | 96.11 | TLLMSELGV | 2.61 | TLLMNELGI | 0.99 | | | |

FIG. 73-10

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 172 | 0.3 | yes | 3 | 0.03 | 99.67 | LLMNELGVP | 96.07 | LLMNELGIP | 2.61 | | | | |
| NA | N2 | 173 | 0.31 | yes | 3 | 0.03 | 99.57 | LMNELGVPF | 95.97 | LMNELGIPF | 2.61 | | | | |
| NA | N2 | 174 | 0.35 | yes | 3 | 0.01 | 99.21 | MNELGVPFH | 95.64 | MNELGIPFH | 2.58 | | | | |
| NA | N2 | 175 | 0.35 | yes | 3 | 0 | 99.16 | NELGVPFHL | 95.58 | NELGIPFHL | 2.58 | | | | |
| NA | N2 | 176 | 0.42 | yes | 3 | 0 | 99.17 | ELGVPFHLG | 94.12 | ELGIPFHLG | 4.03 | | | | |
| NA | N2 | 177 | 0.43 | yes | 3 | 0 | 99.13 | LGVPFHLGT | 94.08 | LGIPFHLGT | 4.03 | | | | |
| NA | N2 | 178 | 1.16 | yes | 5 | 0 | 99.12 | GVPFHLGTK | 73.87 | GVPFHLATK | 20.15 | GIPFHLGTK | 0.88 | GVPFYLGTK | 0.25 |
| NA | N2 | 179 | 1.08 | yes | 5 | 0 | 99.12 | VPFHLGTKQ | 73.82 | VPFHLATKQ | 20.15 | IPFHLGTKQ | 0.88 | VPFYLGTKQ | 0.25 |
| NA | N2 | 180 | 1.07 | yes | 3 | 0 | 99.01 | PFHLGTKQV | 74.71 | PFHLATKQV | 20.28 | | | | |
| NA | N2 | 181 | — | yes | 3 | 0 | 99.03 | FHLGTRQV | 74.75 | FHLATKQV | 20.28 | | | | |
| NA | N2 | 185 | — | yes | 4 | 0.01 | 99.24 | TKQVCIAWS | 77.42 | TKQVCMAWS | 19.11 | TROVCMAWS | 0.92 | TKQVCIAWSS | 0.83 |
| NA | N2 | 186 | 0.29 | yes | 4 | 0.01 | 99.25 | RQVCIAWSS | 77.48 | KQVCMAWSS | 19.07 | RQVCMAWSS | 0.92 | KQVCIAWSS | 0.83 |
| NA | N2 | 187 | 0.29 | yes | 2 | 0.01 | 99.52 | QVCIAWSSS | 96.47 | QVCMAWSSS | 1.88 | | | | |
| NA | N2 | 188 | 0.29 | yes | 2 | 0.01 | 99.52 | VCIAWSSSS | 96.47 | VCMAWSSSS | 1.88 | | | | |
| NA | N2 | 189 | 0.35 | yes | 3 | 0.01 | 99.52 | CIAWSSSSC | 96.47 | CMAWSSSSC | 1.88 | | | | |
| NA | N2 | 190 | 0.13 | yes | 2 | 0.01 | 99.53 | IAWSSSSCH | 95.69 | MAWSSSSCH | 1.88 | IAWSSSSCY | 0.79 | | |
| NA | N2 | 191 | 0.13 | yes | 1 | 0 | 99.49 | AWSSSSCHD | 98.7 | WSSSSCYD | 0.79 | | | | |
| NA | N2 | 192 | 0.42 | yes | 2 | 0 | 99.53 | WSSSSCHDG | 98.74 | SSSSCYDG | 0.79 | | | | |
| NA | N2 | 193 | 0.45 | yes | 3 | 0.01 | 99.12 | SSSSCHDGK | 94.18 | SSSSCYDGK | 4.15 | SSSCHDGMA | 0.79 | | |
| NA | N2 | 194 | 0.45 | yes | 4 | 0.01 | 99.16 | SSSCHDGKA | 93.96 | SSSCYDGKA | 4.04 | SSCHDGNAW | 0.79 | | |
| NA | N2 | 195 | 0.44 | yes | 4 | 0.01 | 99.32 | SSCHDGKAW | 93.96 | SSCYDGKAW | 4.04 | SCHDGNAWL | 0.79 | | |
| NA | N2 | 196 | 0.44 | yes | 4 | 0.01 | 99.35 | SCHDGKAWL | 93.96 | SCYDGKAWL | 4.19 | CHDGNAWLH | 0.8 | | |
| NA | N2 | 197 | 0.55 | yes | 4 | 0.03 | 99.16 | CHDGKAWLH | 93.98 | CYDGKAWLH | 4.19 | DGNAWLHVC | 0.8 | | |
| NA | N2 | 198 | 1.07 | yes | 3 | 0.04 | 99.16 | DGKAWLHVC | 92.23 | DGRAWLHVC | 4.03 | AWLHVCVTG | 2.53 | | |
| NA | N2 | 199 | 1.79 | yes | 5 | 0 | 99.28 | AWLHVCVTG | 71.23 | AWLHVCITG | 25.39 | EILRTQESE | 2.66 | SILRTQESE | 0.5 |
| NA | N2 | 202 | 0.09 | yes | 1 | 0.04 | 99.09 | KILRTQESE | 43.65 | KILRTQESE | 26.88 | DILRTQESE | 26.17 | | |
| NA | N2 | 235 | 0.11 | yes | 2 | 0 | 99.24 | NILRTQESE | 99.24 | LRTQESECI | 0.47 | | | | |
| NA | N2 | 236 | 0.11 | yes | 1 | 0 | 99.45 | ILRTQESECV | 98.98 | | | | | | |
| NA | N2 | 237 | 0.12 | no | 1 | 0.01 | 99.02 | LRTQESECV | 99.02 | | | | | | |
| NA | N2 | 238 | 0.32 | yes | 2 | 0.01 | 99.34 | RTQESECVC | 98.87 | TQESECICI | 0.47 | | | | |
| NA | N2 | 239 | 0.35 | yes | 3 | 0.01 | 99.05 | TQESECVCI | 96.12 | QESECVCIS | 2.47 | ESECVCICG | 0.26 | ESECVCINE | 0.26 |
| NA | N2 | 240 | 0.51 | yes | 4 | 0.03 | 99.25 | QESECVCIN | 95.82 | ESECVCISG | 2.47 | ESECVCIDG | 0.46 | | |
| NA | N2 | 241 | 0.51 | yes | 3 | 0.04 | 99.24 | ESECVCING | 92.3 | CAYVMTDGS | 5.92 | CTVMTDGS | 0.4 | | |
| NA | N2 | 251 | 0.19 | yes | 2 | 0.01 | 99.19 | CTVMTDGS | 92.27 | AVVMTDGSA | 5.94 | TVMTDGSA | 0.77 | | |
| NA | N2 | 252 | 0.46 | yes | 3 | 0.04 | 99.1 | TVVMTDGSA | 98.15 | VMTDGSASE | 0.8 | VMTDGSA | 0.77 | | |
| NA | N2 | 253 | — | yes | 3 | 0.04 | 99.1 | VMTDGSAS | 94.19 | VMTDGSASG | 3.4 | VMTDGSASD | 0.26 | IMTDGSASG | 0.26 |
| NA | N2 | 254 | — | no | 1 | 99.97 | 100 | IRKGLILEY | 50 | IREGLILEY | 50 | | | | |
| NA | N2 | 261 | 0.88 | no | 1 | 99.97 | 100 | RKGLILEYY | 50 | RKGLILEYY | 50 | | | | |
| NA | N2 | 262 | 0.87 | yes | 3 | 0.04 | 99.03 | GSAQHVEEC | 77.91 | GNAQHVEEC | 20.89 | | | | |
| NA | N2 | 286 | 0.8 | yes | 3 | 0.04 | 99.09 | SAQHVEECS | 77.94 | NAQHVEECS | 20.91 | | | | |
| NA | N2 | 287 | | yes | 2 | 0.03 | 99.54 | AQHIEECSC | 78.4 | AQHIEECSC | 21.15 | | | | |

FIG. 73-11

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | N2 | 289 | 0.8 | yes | 2 | 0.03 | 99.57 | QHIEECSCY | 78.45 | QHIEECSCY | 21.12 | | | | |
| NA | N2 | 290 | 0.78 | yes | 2 | 0.03 | 99.72 | HIEECSCYP | 78.61 | HIEECSCYP | 21.12 | | | | |
| NA | N2 | 291 | — | yes | 4 | 0.04 | 99.02 | EECSCYPR | 76.67 | EECSCYPR | 20.1 | | | | |
| NA | N2 | 292 | 0.43 | yes | 2 | 0.03 | 99.32 | EECSCYPQY | 94.8 | EECSCYPQY | 2.11 | IEECSCYPQ | 1.46 | IEECSCYPQ | 0.79 | |
| NA | N2 | 300 | — | no | 3 | 99.97 | 100 | SYPNVRCVC | 50 | | | EECSCYPRH | 1.23 | EECSCYPSY | 0.65 | EECSCYPSY | 0.54 |
| NA | N2 | 304 | 0.52 | yes | 4 | 0 | 99.03 | VRCVCRDNW | 92.11 | VEECSCYPQ | 5.85 | IEECSCYPQ | 1.08 | | | | |
| NA | N2 | 305 | 0.61 | yes | 3 | 0 | 99.34 | RCVCRDNWK | 90.58 | EECSCYPRF | 5.71 | | | | | | |
| NA | N2 | 306 | 0.56 | yes | 4 | 0 | 99.41 | CVCRDNWKG | 91.1 | IRCVCRDNW | 5.71 | KCVCRDNWK | 2.59 | KCVCRDNWK | 0.46 | |
| NA | N2 | 307 | 0.57 | yes | 3 | 0 | 99.52 | VCRDNWKGS | 91.03 | RCVCRDNWK | 5.71 | | 2.59 | | | |
| NA | N2 | 308 | 0.25 | yes | 2 | 0 | 99.54 | CRDNWKGSN | 96.77 | CVCRDNWRG | 2.75 | | 2.59 | | | |
| NA | N2 | 309 | 0.25 | yes | 2 | 0 | 99.6 | RDNWKGSNR | 96.8 | VCRDNWRGS | 2.75 | | | | | | |
| NA | N2 | 310 | 0.24 | yes | 4 | 0 | 99.53 | DNWKGSNRP | 96.84 | CRDNWRGSN | 2.76 | | | | | | |
| NA | N2 | 311 | 1.13 | yes | — | 0 | 99.6 | NWKGSNRPI | 66.55 | RDNWRGSNR | 30.23 | NWRGSNRPI | 2.14 | | NWRGSNRPI | 0.61 | |
| NA | N2 | 320 | 0 | yes | — | 99.97 | 100 | KLDINMADY | 100 | NWRGSNRPV | | | | | | |
| NA | N2 | 334 | 0.23 | no | 1 | 0.03 | 99.1 | YLCSGLVGD | 97.39 | YMCSGLVGD | 0.99 | YMCSGLVGD | 0.72 | | | |
| NA | N2 | 335 | 0.24 | yes | — | 0.04 | 99.09 | LCSGLVGDT | 97.35 | MCSGLVGDT | 1.02 | MCSGLVGDT | 0.72 | | | |
| NA | N2 | 336 | 0.03 | yes | 1 | 0.04 | 99.77 | VCSGLVGDT | 99.77 | | | | | | | |
| NA | N2 | 337 | 0.03 | yes | — | 0.04 | 99.77 | CSGLVGDTP | 99.77 | | | | | | | |
| NA | N2 | 338 | 1.16 | yes | 5 | 0.04 | 99.24 | SGLVGDTPR | 62.7 | GLVGDTPRN | 34.82 | GLVGDTPRD | 0.87 | GLVGDTPRE | 0.52 | GLVGDTPRE | 0.33 |
| NA | N2 | 365 | 1.1 | yes | 5 | 0.01 | 99.14 | GLVGDTPRK | 65.78 | PGVKGWAFD | 31.88 | GVKGWAFDY | 1.49 | GVKGWAFDY | 4.31 | GVKGWAFDV | 0.43 |
| NA | N2 | 366 | 1.39 | yes | 5 | 0.06 | 99.41 | GVKGWAFDD | 70.05 | GVKGWAFD | 14.64 | RAGYETFRV | 9.98 | RAGYETFRV | 1.63 | RAGYETFRV | 0.61 |
| NA | N2 | 389 | 1.72 | yes | 3 | 0.04 | 99.27 | HGVKGWAFD | 48.46 | RSGYETFKV | 26.18 | | 22.39 | | | |
| NA | N2 | 422 | 0.27 | yes | 2 | 0.04 | 99.28 | RSGYETFKV | 96.89 | SGYSGIFSI | 1.91 | | 0.48 | | | |
| NA | N2 | 423 | 0.26 | yes | 2 | 0 | 99.35 | SGYSGIFSV | 96.98 | GYSGIFSJE | 1.89 | | 0.48 | | | |
| NA | N2 | 435 | 0.19 | yes | 2 | 0.01 | 99.61 | GYSGIFSVE | 97.64 | CVNRCFYVE | 1.97 | | | | | |
| NA | N2 | 436 | 0.2 | yes | 1 | 0.03 | 99.56 | CINRCFYVE | 97.58 | VNRCFYEL | 1.97 | | | | | |
| NA | N2 | 437 | 0.09 | yes | — | 0.04 | 99.3 | INRCFYELI | 99.3 | | | | | | | |
| NA | N2 | 438 | 0.09 | yes | — | 0.04 | 99.36 | NRCFYELJ | 99.36 | | | | | | | |
| NA | N2 | 439 | 0.08 | yes | 1 | 0.04 | 99.36 | RCFYELIR | 99.36 | | | | | | | |
| NA | N2 | 440 | 0.18 | yes | 3 | 0.06 | 99.16 | CFYELIRG | 98.26 | FYVELIRGS | 0.68 | FYVELIRGR | 0.22 | | | |
| NA | N2 | 454 | 1.48 | yes | 5 | 0.07 | 99.03 | FYELIRGR | 49.76 | VLWTSNSIV | 39.31 | VWWTSNSII | 9.82 | WWTANSII | 0.15 | WTANSIIVF | 0.15 |
| NA | N2 | 455 | 0.67 | yes | 5 | 0.11 | 99.07 | WWTSNSIV | 88.54 | WTSNSIIVF | 9.35 | WTSNSIIAF | 0.52 | WTSNSIIAF | 0.51 | TANSIIVFC | 0.15 |
| NA | N2 | 456 | 0.68 | yes | 4 | 0.1 | 99.07 | TSNSIWFC | 88.53 | TSNSIVAFC | 9.35 | TSNSIVAFC | 0.52 | TSNSIVAFC | 0.51 | ANSIIVFCG | 0.15 |
| NA | N2 | 457 | 0.66 | yes | 4 | 0.25 | 99.05 | SNSIWFCG | 88.51 | SNSIVAFCG | 9.39 | SNSIIAFCG | 0.52 | SNSIIAFCG | 0.51 | |
| NA | N2 | 458 | 0.66 | yes | 4 | 0.25 | 99.06 | NSIIWFCGT | 88.64 | NSIVAFCGT | 9.31 | NSIIAFCGT | 0.53 | NSIIAFCGT | 0.5 | |
| NA | N2 | 459 | 0.66 | yes | 4 | 0.29 | 99.06 | SIIWFCGTS | 88.73 | SIVAFCGTS | 9.33 | SIIAFCGTS | 0.53 | | 0.5 | |
| NA | N2 | 460 | 0.65 | yes | 4 | 0.28 | 99.06 | IIWFCGTSG | 88.71 | IVAFCGTSG | 9.42 | IIAFCGTSG | 0.53 | | 0.5 | |
| NA | N2 | 461 | 0.19 | yes | 2 | 0.43 | 99.11 | IWFCGTSGT | 88.78 | VFCGTSGT | 0.97 | VAFCGTSGT | 0.5 | | 0.47 | |
| NA | N2 | 462 | 0.1 | yes | 1 | 0.48 | 99.21 | WFCGTSGTY | 98.15 | | | | | | | |
| NA | N2 | 463 | 0.19 | yes | 3 | — | 99.13 | FCGTSGTYG | 99.21 | CGTSGTYGA | 0.75 | CGTSGTVGA | 0.21 | | | |
| NA | N2 | 464 | | yes | | | | CGTSGTYGT | 98.17 | | | | | | | |

FIG. 73-12

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 466 | 0.19 | yes | 3 | 0.48 | 99.14 | GTSGTYGTG | 98.18 | GTSGTYGAG | 0.75 | | | | |
| NA | N2 | 467 | 0.21 | yes | 4 | 0.5 | 99.17 | TSGTYGTGS | 98.02 | TSGTYGAGS | 0.75 | TSGTYGTGT | 0.21 | | |
| NA | N2 | 468 | 0.22 | yes | 4 | 0.83 | 99.07 | SGTYGTGSW | 97.91 | SGTYGAGSW | 0.75 | SGTYGTGTW | 0.21 | | |
| NA | N2 | 469 | 0.22 | yes | 3 | 1.38 | 99.13 | GTYGTGSWP | 97.97 | GTYGAGSWP | 0.76 | GTYGTGTWP | 0.2 | | |
| NA | N2 | 470 | 0.2 | yes | 3 | 5.51 | 99.09 | TYGTGSWPD | 98.09 | TYGAGSWPD | 0.79 | | | | |
| NA | N2 | 471 | 0.19 | yes | 3 | 5.81 | 99.12 | YGTGSWPDG | 98.24 | YGAGSWPDG | 0.66 | | | | |
| NA | N2 | 472 | 0.21 | yes | 4 | 6.04 | 99.15 | GTGSWPDGA | 98.06 | GAGSWPDGA | 0.66 | GTGTWPDGA | 0.22 | GTWPDGADI | 0.21 |
| NA | N2 | 474 | 1.27 | no | 5 | 6.86 | 98.93 | GSWPDGANI | 63.28 | GSWPDGADL | 31.41 | GSWPDGAEI | 0.22 | | |
| NA | N2 | 480 | 0 | no | 1 | 99.99 | 100 | RTSISCLYK | 100 | | | | | | |
| NA | N2 | 481 | 2.13 | no | 5 | 99.9 | 100 | ADINLHAYI | 42.86 | TSISCLYKL | 14.29 | ADINLMPIY | 14.29 | ANINFMPYI | 14.29 |
| NA | N2 | 482 | 2.13 | no | 4 | 99.9 | 100 | DINLHAYIS | 42.86 | DIKSHAYIS | 14.29 | NINFMPYIS | 14.29 | DINLMPIYS | 14.29 |
| NA | N2 | 483 | 1.79 | no | 4 | 99.92 | 100 | INLHAYISF | 50 | IKSHAYISF | 16.67 | INFMPYISF | 16.67 | | |
| NA | N2 | 484 | 1.79 | no | 4 | 99.96 | 100 | NLHAYISFR | 50 | GLMGRTRIS | 16.67 | SCLYKLSQF | 16.67 | | |
| NA | N2 | 485 | 1.79 | no | 1 | 99.92 | 100 | LHAYISFRN | 50 | | | | | | |
| NA | N2 | 486 | 0 | no | 1 | 99.96 | 100 | HAYISFRNL | 100 | | | | | | |
| NA | N3 | 21 | 0.97 | yes | 5 | 0 | 99.8 | ALIGVGNL | 77.24 | ALFIGVGNL | 19.51 | ALIIGVGNL | 1.42 | ALLVGIGNL | 0.81 |
| NA | N3 | 27 | 1.27 | yes | 4 | 0 | 99.19 | GNLVFNTVI | 56.71 | GNLAFNAVI | 38.82 | GNLIFNAVI | 3.05 | | |
| NA | N3 | 28 | 1.25 | yes | 3 | 0 | 99.39 | NLVFNTVIH | 56.71 | NLAFNAVIH | 38.82 | NLIFNAVIH | 3.25 | | |
| NA | N3 | 29 | 0.47 | yes | 3 | 0.2 | 99.19 | LVFNTVIH | 93.08 | LPLCPFQGF | 3.26 | LPLCPFQGF | 2.85 | | |
| NA | N3 | 88 | 0.47 | yes | 3 | 0.2 | 99.19 | LPLCPFGFF | 93.08 | LCPFQGFF | 3.26 | LCPFQGFF | 2.85 | | |
| NA | N3 | 89 | 0.45 | yes | 3 | 0.2 | 99.39 | LCPRGFFP | 93.08 | LCPFQGFFP | 3.26 | CPFQGFFP | 2.85 | | |
| NA | N3 | 90 | 0.45 | yes | 3 | 0.2 | 99.39 | CPRGFFPF | 93.28 | CPFQGFFPF | 3.26 | CPFQGFFPF | 2.85 | | |
| NA | N3 | 91 | 0.45 | yes | 3 | 0.2 | 99.59 | CPRGFFPF | 93.28 | PFQGFFPH | 3.26 | PFQGFFPH | 2.85 | | |
| NA | N3 | 92 | 0.43 | yes | 3 | 0.2 | 99.39 | PRGFFPFH | 93.28 | FQGFFPHK | 3.26 | FQGFFPHK | 2.85 | | |
| NA | N3 | 93 | 0.43 | yes | 3 | 0.2 | 99.59 | RGFFPFHK | 93.48 | QGFFPHKD | 3.26 | | | | |
| NA | N3 | 94 | 0.02 | yes | 3 | 0 | 99.8 | GFFPHKDN | 99.8 | | | | | | |
| NA | N3 | 95 | 0.32 | yes | 1 | 0 | 99.8 | FPHKDNA | 99.8 | | | | | | |
| NA | N3 | 96 | 0.32 | yes | 3 | 0.2 | 95.33 | FPHKDNAL | 95.33 | FPHKDNAV | 3.25 | FPHKDNAY | 0.61 | | |
| NA | N3 | 97 | 0.32 | yes | 3 | 0.2 | 95.33 | PHKDNALR | 95.33 | PHKDNAVR | 3.25 | PHKDNAVR | 0.61 | | |
| NA | N3 | 98 | 0.34 | yes | 3 | 0.2 | 95.12 | FHKDNAIR | 95.12 | FHKDNAYR | 3.25 | FHKDNAYRL | 0.61 | | |
| NA | N3 | 99 | 0.34 | yes | 3 | 0.2 | 95.12 | HKDNAIRL | 95.12 | HKDNALRL | 3.25 | HKDNAVRL | 0.61 | | |
| NA | N3 | 100 | 0.4 | yes | 3 | 0.2 | 95.59 | KDNAIRLG | 95.12 | KDNALRLA | 3.25 | KDNAVRLG | 0.61 | | |
| NA | N3 | 101 | 0.4 | yes | 3 | 0.2 | 94.51 | DNAIRLGE | 94.51 | DNALRLAE | 3.25 | DNAVRLGE | 1.22 | | |
| NA | N3 | 102 | 0.69 | yes | 4 | 0 | 99.59 | IVTREPYVS | 89.43 | LVTREPYVS | 5.08 | DNAIRLGET | 1.22 | IATREPYVS | 0.61 |
| NA | N3 | 103 | 0.59 | yes | 4 | 0 | 99.59 | VTREPYVSC | 89.63 | ITREPYVS | 8.33 | IITREPYVS | 1.22 | | |
| NA | N3 | 115 | 0.48 | yes | 5 | 0 | 99.19 | TREPYVSCD | 91.06 | TREPYISC | 8.33 | TREPYVSC | 1.22 | | |
| NA | N3 | 116 | 0.92 | yes | 2 | 0 | 99.39 | REPYVSCDN | 83.13 | REPYVSCD | 6.3 | REPYVSCDY | 1.22 | VCWSFALAQ | 0.41 |
| NA | N3 | 117 | 1.32 | yes | 4 | 0 | 99.39 | NCWSFALAQ | 63.41 | DCWSFALAQ | 29.88 | GCWSFALAQ | 3.66 | REPYVSCDS | 0.2 |
| NA | N3 | 118 | 0.06 | yes | 5 | 0 | 99.39 | CWSFALAQG | 99.39 | WSFALSQGA | 0.81 | HCWSFALAQ | 0.41 | | |
| NA | N3 | 128 | 0.17 | yes | 3 | 0 | 98.17 | WSFALAQGT | 98.17 | WSFALAQGT | 0.81 | | | | |
| NA | N3 | 129 | 0.17 | yes | 3 | 0 | 98.17 | SFALAQGTL | 98.17 | SFALAQGVL | 0.81 | | | | |
| NA | N3 | 130 | | yes | | | | SFALAQGAL | | | | | | | |
| NA | N3 | 131 | | yes | | | | | | | | | | | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | N3 | 334 | — | yes | 4 | 0.81 | 99.59 | VYCICRDNW | 80.94 | | | | | | | | |
| NA | N3 | 335 | 0.59 | yes | 2 | 0.81 | 99.39 | YCICRDNWK | 87.5 | | | | | | | | |
| NA | N3 | 336 | 0.59 | yes | 2 | 0.81 | 99.39 | CICRDNWKG | 87.5 | | | | | | | | |
| NA | N3 | 337 | 0.57 | yes | 2 | 0.81 | 99.59 | ICRDNWKGS | 87.5 | | | | | | | | |
| NA | N3 | 338 | 0.04 | yes | 1 | 0.81 | 99.59 | CRDNWKGSN | 99.59 | | | | | | | | |
| NA | N3 | 339 | 0.04 | yes | 1 | 0.81 | 99.59 | RDNWKGSNR | 99.59 | | | | | | | | |
| NA | N3 | 340 | 0.04 | yes | 1 | 0.81 | 99.59 | DNWKGSNRP | 99.59 | | | | | | | | |
| NA | N3 | 341 | 0.04 | yes | 1 | 0.81 | 99.59 | NWKGSNRPW | 99.59 | | | IYCICRDNW | 6.76 | IYCVCRDNW | 2.46 | | | | |
| NA | N3 | 342 | 0.3 | yes | 3 | 0.81 | 99.18 | WKGSNRPWM | 95.7 | | | | | | | | |
| NA | N3 | 343 | 0.34 | yes | 3 | 0.81 | 99.59 | KGSNRPWMR | 95.29 | WKGSNRPWI | 3.28 | | | | | | |
| NA | N3 | 344 | 0.37 | yes | 4 | 0.81 | 99.59 | GSNRPWMRI | 95.29 | KGSNRPWIR | 3.28 | | | | | | |
| NA | N3 | 345 | 0.49 | yes | 5 | 0.81 | 99.18 | SNRPWMRIN | 93.65 | GSNRPWVRI | 2.25 | GSNRPWIRI | 0.61 | SNRPWIRIN | 0.61 | | |
| NA | N3 | 346 | 0.47 | yes | 5 | 0.81 | 99.18 | NRPWMRINN | 93.85 | SNRPWVRIN | 2.25 | SNRPWVRIN | 1.02 | NRPWIRINN | 0.61 | | |
| NA | N3 | 347 | 0.47 | yes | 5 | 0.81 | 99.18 | RPWMRINNE | 93.85 | NRPWVRINN | 2.25 | NRPWVRINN | 1.64 | RPWVRINNE | 1.02 | | |
| NA | N3 | 348 | 0.49 | yes | 5 | 0.81 | 99.18 | PWMRINNET | 93.85 | RPWVMRINN | 2.25 | RPWVMRINN | 1.64 | PWVRINNET | 1.02 | | |
| NA | N3 | 349 | 0.46 | yes | 4 | 0.81 | 99.39 | WMRINNETI | 93.65 | PWVRINNE | 2.25 | PWVRINNE | 1.64 | WVRINNETI | 1.02 | | |
| NA | N3 | 352 | 0.32 | yes | 3 | 0.81 | 99.18 | MRINNETIE | 94.06 | WVRINNETI | 2.25 | WVRINNETI | 1.64 | INNETIVET | 0.61 | | |
| NA | N3 | 353 | 0.22 | yes | 2 | 0.61 | 99.39 | INNETILET | 96.11 | ISNETIIETG | 2.05 | INNETIIETG | 1.64 | | | | |
| NA | N3 | 354 | 0.36 | yes | 4 | 0.61 | 99.18 | NNETIIETG | 97.55 | SNETIIETG | 1.02 | NNETIIETG | 1.02 | | | | |
| NA | N3 | 355 | 0.34 | yes | 4 | 0.81 | 99.18 | NETIIETGY | 95.71 | NETIVETGY | 2.04 | ETIIVETGY | 1.02 | ILETGYVCG | 0.61 | | |
| NA | N3 | 356 | 0.38 | yes | 5 | 0.81 | 99.18 | ETIIETGYV | 95.3 | ETIILETGY | 2.04 | TIVETGYVC | 1.02 | LETGYVCGK | 0.61 | | |
| NA | N3 | 357 | 0.47 | yes | 5 | 0.81 | 99.59 | TIILETGYV | 95.3 | TIILETGYIC | 2.04 | IVETGYVCS | 1.02 | | | | |
| NA | N3 | 358 | 0.25 | yes | 3 | 0.81 | 99.39 | ILETGYVCS | 95.3 | ILETGYICS | 2.04 | VETGYVCSK | 1.02 | | | | |
| NA | N3 | 359 | 0.25 | yes | 3 | 0.81 | 99.39 | LETGYVCSK | 96.93 | LETGYICSK | 2.04 | | | | | | |
| NA | N3 | 360 | 0.25 | yes | 3 | 0.81 | 99.18 | ETGYVCSKF | 96.93 | ETGYICSKF | 2.04 | | | | | | |
| NA | N3 | 361 | 0.24 | yes | 2 | 0.81 | 99.18 | TGYVCSKFH | 96.93 | TGYICSKFH | 2.25 | | | | | | |
| NA | N3 | 362 | 0.24 | yes | 2 | 0.81 | 99.18 | GYVCSKFHS | 96.93 | GYICSKFHS | 2.25 | | | | | | |
| NA | N3 | 363 | 0.24 | yes | 2 | 0.81 | 99.18 | YVCSKFHSD | 96.93 | YICSKFHSD | 2.25 | | | | | | |
| NA | N3 | 364 | 0.24 | yes | 2 | 0.81 | 99.18 | VCSKFHSDT | 96.93 | ICSKFHSDT | 2.25 | | | | | | |
| NA | N3 | 365 | 0.24 | yes | 2 | 0.61 | 99.59 | CSKFHSDTP | 99.18 | | | | | | | | |
| NA | N3 | 366 | 0.08 | yes | 1 | 0.81 | 99.18 | SKFHSDTPR | 99.59 | | | | | | | | |
| NA | N3 | 367 | 0.04 | yes | 1 | 0.81 | 99.39 | KFHSDTPRP | 99.18 | | | | | | | | |
| NA | N3 | 368 | 1.16 | yes | 5 | 0.81 | 99.39 | FHSDTPRPA | 79.51 | FHSDTPRPD | 6.76 | FHSDTPRPS | 5.53 | FHSDTPRPT | 4.92 | FHSDTPRPV | 3.07 |
| NA | N3 | 369 | 1.16 | yes | 5 | 0.81 | 99.39 | HSDTPRPAD | 79.51 | HSDTPRPDD | 6.76 | HSDTPRPSD | 5.53 | HSDTPRPTD | 4.92 | HSDTPRPVD | 3.07 |
| NA | N3 | 370 | 1.16 | yes | 5 | 0.81 | 99.39 | SDTPRPADP | 79.51 | SDTPRPDDP | 6.76 | SDTPRPSDP | 5.53 | SDTPRPTDP | 4.92 | SDTPRPVDP | 3.07 |
| NA | N3 | 391 | 0.65 | yes | 4 | 0.81 | 99.39 | DTPRPADPS | 79.51 | DTPRPDDPS | 6.76 | DTPRPSDPS | 5.53 | DTPRPTDPS | 4.92 | DTPRPVDPS | 3.07 |
| NA | N3 | 392 | 0.63 | yes | 5 | 0.81 | 99.59 | RGPKGFGKF | 90.8 | GLGVKGFGF | 3.07 | EPGVKGFGF | 3.07 | RPGVKGFGF | 1.84 | RGVYKGFGF | 3.25 |
| NA | N3 | 402 | 0.92 | yes | 5 | 0 | 99.8 | PGVKGFGFK | 90.59 | RGVYKGFGF | 3.27 | PGVYKGFGF | 3.25 | SNDVWLGRT | 1.02 | GSDVWLGRT | 1.83 |
| NA | N3 | 403 | 0.87 | yes | 3 | 0 | 99.39 | GNDVWLGRT | 82.93 | LGVKGFGFK | 10.77 | GSDVWLGRT | 3.25 | | | | |
| NA | N3 | 404 | 0.31 | yes | 2 | 0 | 99.39 | NDVWLGRTV | 83.74 | GNDVWLGRT | 10.57 | SDVWLGRTV | 3.25 | | | | |
| NA | N3 | 416 | 0.58 | yes | 4 | 0 | 99.39 | DVWLGRTVS | 95.53 | DVWLGRTMS | 3.46 | | | | | | |
| NA | N3 | | | yes | | | 89.84 | RSGFEIIKV | 89.84 | RSGFEIIRV | 8.33 | RSGFEIIRV | 0.81 | | | | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | N4 | 3 | 0.24 | no | 3 | 16.26 | 99.03 | PNQKIITIG | 97.09 | PNQSIITIG | 0.97 | | | | | | |
| NA | N4 | 4 | 0.31 | no | 4 | 14.63 | 99.05 | NQKIITIGS | 96.19 | RSKIITIGS | 0.95 | | | | | | |
| NA | N4 | 7 | 1.72 | yes | 5 | 5.69 | 99.14 | IITIGSISI | 45.69 | IITIGSASI | 34.48 | NQMIITIGS | 0.97 | | | | |
| NA | N4 | 17 | 0.99 | yes | 3 | 0 | 99.19 | LTTIGLLLQ | 65.04 | | | IITIGSISV | 15.52 | IVTIGSVSI | 0.95 | | |
| NA | N4 | 18 | 1.05 | yes | 5 | 0 | 99.19 | TTVGLLLQI | 64.23 | TTVGLLLQV | 34.15 | | | | | | |
| NA | N4 | 19 | 1.69 | yes | 5 | 0 | 99.19 | TVGLLLQIT | 43.09 | TVGLLLQII | 34.15 | NQMIITIGS | 0.81 | IVTIGSVSI | 0.86 | | |
| NA | N4 | 20 | 1.69 | yes | 3 | 0 | 99.19 | VGLLLQITS | 43.09 | VGLLLQIIS | 33.33 | TIGLLLQII | 21.14 | TVGLLLQVT | 0.81 | | |
| NA | N4 | 21 | 0.89 | yes | 2 | 0 | 99.19 | GLLLQITSL | 76.42 | GLLLQIISL | 21.95 | IGLLLQIIS | 21.14 | IGPLLQITS | 0.81 | | |
| NA | N4 | 22 | 0.82 | yes | 2 | 0 | 99.19 | LLLQITSLC | 77.24 | LLLQIISLC | 21.95 | TIGLLLQII | 0.81 | | | | |
| NA | N4 | 23 | 0.82 | yes | 2 | 0 | 99.19 | LLQITSLCS | 77.24 | LLQIISLCS | 21.95 | GLLLQVTSL | 0.81 | | | | |
| NA | N4 | 24 | 0.82 | yes | 2 | 0 | 99.19 | LQITSLCSI | 77.24 | LQIISLCSI | 21.95 | LLLQVTSLC | 0.81 | | | | |
| NA | N4 | 25 | 0.82 | yes | 2 | 0 | 99.19 | QITSLCSIW | 77.24 | QIISLCSIW | 21.95 | | | | | | |
| NA | N4 | 26 | 0.82 | yes | 2 | 0 | 99.19 | ITSLCSIWF | 78.05 | IISLCSIWF | 21.95 | | | | | | |
| NA | N4 | 27 | 0.76 | yes | 2 | 0 | 99.19 | TSLCSIWFS | 78.05 | ISLCSIWFS | 21.95 | | | | | | |
| NA | N4 | 28 | 0 | yes | 1 | 0 | 100 | SLCSIWFSH | 100 | | | | | | | | |
| NA | N4 | 29 | 0 | yes | 1 | 0 | 100 | LCSIWFSHY | 100 | | | | | | | | |
| NA | N4 | 30 | 0 | yes | 1 | 0 | 100 | CSIWFSHYN | 100 | | | | | | | | |
| NA | N4 | 31 | 0.6 | yes | 2 | 0 | 99.19 | SIWFSHYNQ | 86.99 | | | | | | | | |
| NA | N4 | 32 | 0.76 | yes | 4 | 0 | 99.19 | IWFSHYNQM | 86.18 | WFSHYNQMK | 12.2 | WFSHYNQMK | 2.44 | WFSHYNQVA | 2.44 | SHYNQITQT | 0.81 |
| NA | N4 | 33 | 0.76 | yes | 4 | 0 | 99.19 | WFSHYNQMT | 86.18 | FSHYNQMKQ | 9.76 | FSHYNQMKO | 2.44 | FSHYNQVAQ | 2.44 | | |
| NA | N4 | 34 | 1.03 | yes | 5 | 0 | 100 | FSHYNQMTO | 81.3 | SHYNQMTQA | 9.76 | SHYNQMKQA | 4.88 | SHYNQMKOA | 4.88 | | |
| NA | N4 | 35 | 0.44 | yes | 2 | 0 | 99.19 | SHYNQVTQT | 91.87 | SHYNQVTQP | 9.76 | | | | | | |
| NA | N4 | 48 | 0.44 | yes | 2 | 0 | 99.19 | CSNDTINYY | 91.87 | CSNDTINY | 7.32 | | | | | | |
| NA | N4 | 49 | 0.38 | yes | 2 | 0 | 99.19 | SNDTINYYN | 92.68 | SNDTINYY | 7.32 | | | | | | |
| NA | N4 | 50 | 0.38 | yes | 2 | 0 | 99.19 | NDTINYYNE | 92.68 | NDTINYYNE | 7.32 | | | | | | |
| NA | N4 | 51 | 0.38 | yes | 2 | 0 | 99.19 | DTINYYNET | 92.68 | DTINYYNET | 7.32 | | | | | | |
| NA | N4 | 52 | 0.38 | yes | 2 | 0 | 99.19 | TINYYNETF | 92.68 | TINYYNETF | 7.32 | | | | | | |
| NA | N4 | 53 | 0 | yes | 1 | 0 | 100 | INYYNETFV | 100 | | | | | | | | |
| NA | N4 | 54 | 0.14 | yes | 2 | 0 | 99.19 | NYYNETFVN | 98.37 | YYNETFVNI | 0.81 | | | | | | |
| NA | N4 | 55 | 0.14 | yes | 2 | 0 | 99.19 | YYNETFVNW | 98.37 | YNETFVNIT | 0.81 | | | | | | |
| NA | N4 | 56 | 0.92 | yes | 3 | 0 | 99.19 | YNETFVNWT | 74.8 | NETFVNWTN | 23.58 | NETFVMTN | 0.81 | VNMTNVQNN | 0.81 | | |
| NA | N4 | 57 | 0.92 | yes | 3 | 0 | 99.19 | NETFVNWTN | 74.8 | ETFVNWTNV | 23.58 | ETFVNITNV | 0.81 | NMTNVQNNY | 0.81 | | |
| NA | N4 | 58 | 0.92 | yes | 3 | 0 | 99.19 | ETFVNWTNV | 74.8 | TFVNWTNVQ | 23.58 | TFVNITNVO | 0.81 | MTNVQNNYT | 0.81 | | |
| NA | N4 | 59 | 1.11 | yes | 4 | 0 | 99.19 | TFVNWTNVQ | 71.54 | FVNWTNVON | 23.58 | FVNMTNVQN | 3.25 | VNMTNVQNN | 3.25 | | |
| NA | N4 | 60 | 1.11 | yes | 4 | 0 | 99.19 | FVNWTNVQN | 71.54 | VNWTNVQNN | 23.58 | VNMTNVQND | 3.25 | NMTNVQNNY | 3.25 | | |
| NA | N4 | 61 | 1.11 | yes | 4 | 0 | 99.19 | VNWTNVQNN | 71.54 | NWTNVQNNY | 23.58 | NVTNVQNDY | 3.25 | MTNVQNNYT | 3.25 | | |
| NA | N4 | 62 | 0.98 | yes | 3 | 0 | 100 | VTNVQNNYT | 73.17 | VTNVQNDYT | 23.58 | VTNVQNDYT | 3.25 | NVQNDYTTV | 3.25 | | |
| NA | N4 | 63 | 1.84 | yes | 4 | 0 | 99.19 | TNVQNNYTI | 42.28 | TNVQNDYTT | 30.08 | TNVQNDYTT | 21.95 | NVQNDYTTV | 21.95 | HVQNNYTTI | 1.63 |
| NA | N4 | 64 | 1.31 | yes | 5 | 0 | 99.19 | NVQNNYTTV | 60.98 | HVQNNYTTI | 30.08 | HVQNNYTTI | 8.13 | | | | |
| NA | N4 | 65 | | yes | | 0 | | LCPIRGWAP | | LCPIKGWAP | | LCPYKGWAP | | | | | |
| NA | N4 | 90 | | yes | | 0 | | | | | | | | | | | |

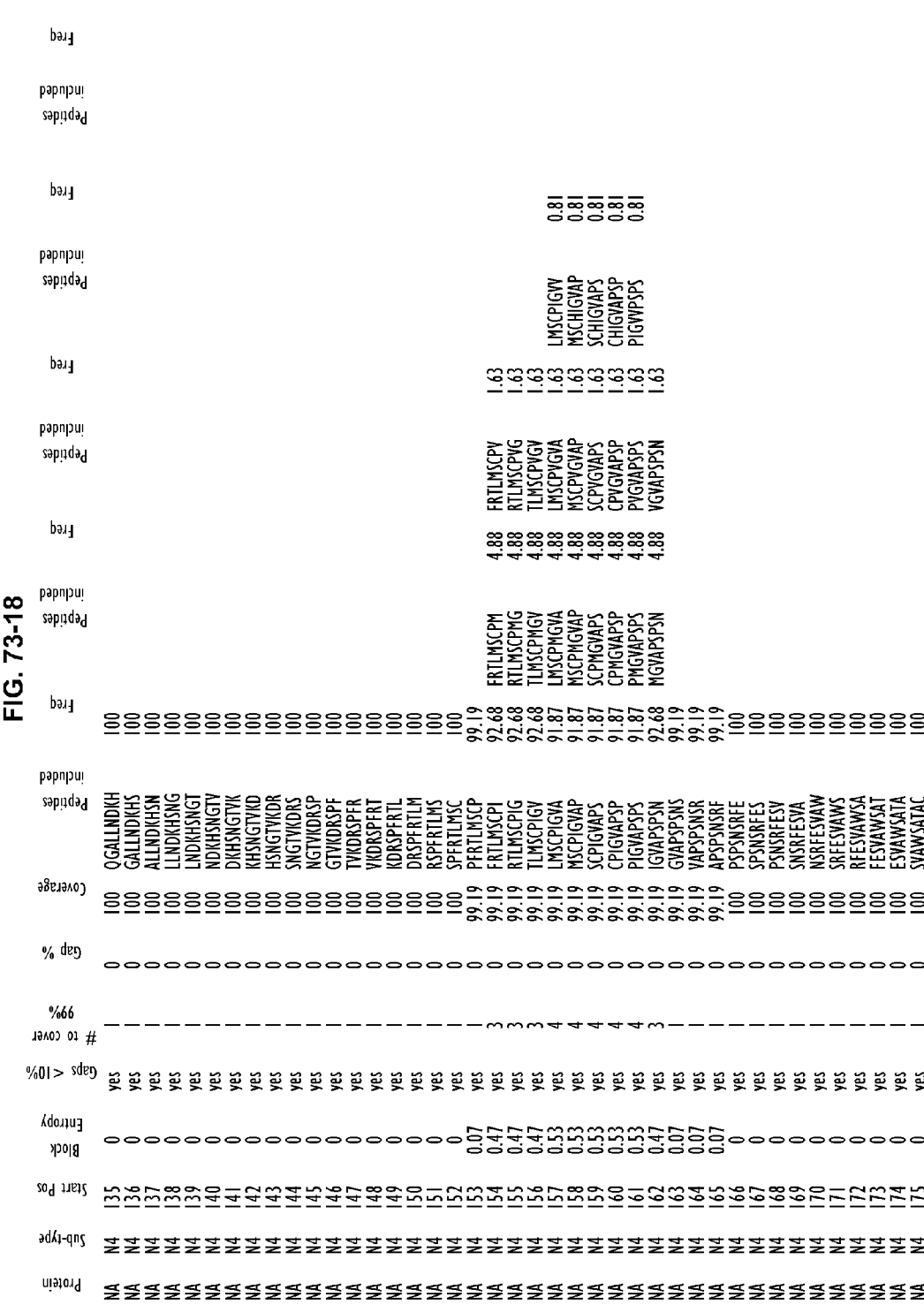

FIG. 73-19

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 176 | 0 | yes | 1 | 0 | 100 | VAWSATACS | 100 | | | | | | |
| NA | N4 | 177 | 0 | yes | 1 | 0 | 100 | AWSATACSD | 100 | | | | | | |
| NA | N4 | 178 | 0 | yes | 1 | 0 | 100 | WSATACSDG | 100 | | | | | | |
| NA | N4 | 179 | 0.17 | yes | 2 | 0 | 100 | SATACSDGP | 97.56 | SATACSDGS | 2.44 | | | | |
| NA | N4 | 180 | 0.17 | yes | 2 | 0 | 100 | ATACSDGPG | 97.56 | ATACSDGSG | 2.44 | | | | |
| NA | N4 | 181 | 0.17 | yes | 2 | 0 | 100 | TACSDGPGW | 97.56 | TACSDGSGW | 2.44 | | | | |
| NA | N4 | 182 | 0.17 | yes | 2 | 0 | 100 | ACSDGPGWL | 97.56 | ACSDGSGWL | 2.44 | | | | |
| NA | N4 | 183 | 0.17 | yes | 2 | 0 | 100 | CSDGPGWLT | 97.56 | CSDGSGWLT | 2.44 | | | | |
| NA | N4 | 184 | 0.37 | yes | 2 | 0 | 100 | SDGPGWLTL | 94.31 | SDGSGWLTL | 2.44 | | | | |
| NA | N4 | 185 | 0.37 | yes | 2 | 0 | 100 | DGPGWLTLG | 94.31 | DGSGWLTLG | 2.44 | | | | |
| NA | N4 | 186 | 0.37 | yes | 2 | 0 | 100 | GPGWLTLGI | 94.31 | GSGWLTLGI | 2.44 | | | | |
| NA | N4 | 187 | 0.37 | yes | 2 | 0 | 100 | PGWLTLGIT | 94.31 | SGWLTLGIT | 2.44 | | | | |
| NA | N4 | 188 | 0.21 | yes | 2 | 0 | 100 | GWLTLGITG | 96.75 | | | | | | |
| NA | N4 | 189 | 0.21 | yes | 2 | 0 | 100 | WLTLGITGP | 96.75 | | | | | | |
| NA | N4 | 190 | 0.21 | yes | 2 | 0 | 100 | LTLGITGPD | 96.75 | | | | | | |
| NA | N4 | 191 | 1.21 | yes | 4 | 0 | 100 | TLGITGPDA | 73.17 | TLGITGPDT | 3.25 | | | | |
| NA | N4 | 192 | 1.21 | yes | 4 | 0 | 100 | LGITGPDAT | 73.17 | LGITGPDST | 3.25 | TIGITGPDA | 3.25 | | | |
| NA | N4 | 193 | 1.01 | yes | 4 | 0 | 100 | GITGPDATA | 76.42 | GITGPDSTA | 3.25 | IGITGPDAT | 3.25 | | | |
| NA | N4 | 194 | 1.01 | yes | 3 | 0 | 100 | ITGPDATAN | 76.42 | ITGPDSTAV | 3.25 | | | | |
| NA | N4 | 195 | 1.08 | yes | 3 | 0 | 100 | TGPDATANA | 75.61 | TGPDSTAVA | 3.25 | | | | |
| NA | N4 | 196 | 1.08 | yes | 3 | 0 | 99.19 | GPDATAVAV | 75.61 | GPDSTAVAV | 3.25 | | | | |
| NA | N4 | 197 | 1.14 | yes | 4 | 0 | 99.19 | PDATAVAVL | 74.8 | PDSTAVAVL | 3.25 | PDATAVVYL | 0.81 | | | |
| NA | N4 | 198 | 1.14 | yes | 4 | 0 | 99.19 | DATAVAVLK | 74.8 | DSTAVAVLK | 3.25 | DATAVAVIK | 0.81 | | | |
| NA | N4 | 199 | 0.69 | yes | 3 | 0 | 99.19 | ATAVAVLKY | 83.74 | STAVAVIKY | 3.25 | ATAVAVIKY | 0.81 | | | |
| NA | N4 | 200 | 0.69 | yes | 3 | 0 | 99.19 | TAVAVLKYN | 83.74 | | | | | | |
| NA | N4 | 201 | 0.85 | yes | 3 | 0 | 99.19 | AVAVLKYNG | 81.3 | | | | | | |
| NA | N4 | 202 | 0.85 | yes | 3 | 0 | 99.19 | VAVLKYNGI | 81.3 | VAVLKYNGV | 2.44 | | | | |
| NA | N4 | 203 | 0.78 | yes | 4 | 0 | 99.19 | AVLKYNGII | 82.11 | AVLKYNGVI | 2.44 | | | | |
| NA | N4 | 204 | 0.78 | yes | 3 | 0 | 99.19 | VLKYNGIIT | 82.11 | VLKYNGVIT | 2.44 | | | | |
| NA | N4 | 205 | 0.17 | yes | 2 | 0 | 100 | LKYNGIITD | 97.56 | LKYNGVITD | 2.44 | | | | |
| NA | N4 | 206 | 0.28 | yes | 3 | 0 | 99.19 | KYNGIITDT | 95.93 | | | | | | |
| NA | N4 | 207 | 0.28 | yes | 3 | 0 | 99.19 | YNGIITDTL | 95.93 | YNGIITDTF | 1.63 | | | | |
| NA | N4 | 208 | 0.28 | yes | 3 | 0 | 99.19 | NGIITDTLK | 95.93 | NGIITDTFK | 1.63 | | | | |
| NA | N4 | 209 | 0.19 | yes | 2 | 0 | 100 | GIITDTLKS | 97.56 | GIITDTFKS | 1.63 | | | | |
| NA | N4 | 210 | 0.19 | yes | 2 | 0 | 99.19 | IITDTLKSW | 97.56 | IITDTFKSW | 1.63 | | | | |
| NA | N4 | 211 | 0.28 | yes | 3 | 0 | 99.19 | ITDTLKSWK | 97.56 | | | | | | |
| NA | N4 | 212 | 0.28 | yes | 3 | 0 | 99.19 | TDTLKSWKG | 97.56 | | | | | | |
| NA | N4 | 213 | 0.28 | yes | 3 | 0 | 99.19 | DTLKSWKGN | 97.56 | | | | | | |
| NA | N4 | 214 | 0.19 | yes | 2 | 0 | 99.19 | TLKSWKGNI | 97.56 | | | | | | |
| NA | N4 | 215 | 0.19 | yes | 2 | 0 | 99.19 | LKSWKGNIM | 97.56 | | | | | | |
| NA | N4 | 216 | 0.07 | yes | 1 | 0 | 99.19 | KSWKGNIMR | 99.19 | | | | | | |

FIG. 73-20

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 217 | 0.07 | yes | 1 | 0 | 99.19 | SWKGNIMRT | 99.19 | | | | | | |
| NA | N4 | 218 | 0.07 | yes | 1 | 0 | 99.19 | WKGNIMRTQ | 99.19 | | | | | | |
| NA | N4 | 219 | 0.07 | yes | 1 | 0 | 99.19 | KGNIMRTQE | 99.19 | | | | | | |
| NA | N4 | 220 | 0 | yes | 1 | 0 | 100 | GNIMRTQES | 100 | | | | | | |
| NA | N4 | 221 | 0 | yes | 1 | 0 | 100 | NIMRTQESE | 100 | | | | | | |
| NA | N4 | 222 | 0 | yes | 1 | 0 | 100 | IMRTQESEC | 100 | | | | | | |
| NA | N4 | 223 | 0 | yes | 1 | 0 | 100 | MRTQESECV | 100 | | | | | | |
| NA | N4 | 224 | 0.07 | yes | 1 | 0 | 99.19 | RTQESECVC | 99.19 | | | | | | |
| NA | N4 | 225 | 0.07 | yes | 1 | 0 | 99.19 | TQESECVCQ | 99.19 | | | | | | |
| NA | N4 | 226 | 0.07 | yes | 1 | 0 | 99.19 | QESECVCQD | 99.19 | | | | | | |
| NA | N4 | 227 | 0.07 | yes | 1 | 0 | 99.19 | ESECVCQDE | 99.19 | | | | | | |
| NA | N4 | 228 | 0.07 | yes | 1 | 0 | 99.19 | SECVCQDEF | 99.19 | | | | | | |
| NA | N4 | 229 | 0.07 | yes | 1 | 0 | 99.19 | ECVCQDEFC | 99.19 | | | | | | |
| NA | N4 | 230 | 0.07 | yes | 1 | 0 | 99.19 | CVCQDEFCY | 99.19 | | | | | | |
| NA | N4 | 231 | 0.07 | yes | 1 | 0 | 99.19 | VCQDEFCYT | 99.19 | | | | | | |
| NA | N4 | 232 | 0.07 | yes | 1 | 0 | 99.19 | CQDEFCYTL | 99.19 | | | | | | |
| NA | N4 | 233 | 1.04 | yes | 3 | 0 | 74.8 | QDEFCYTLI | 100 | QDEFCYTLM | 74.8 | QDEFCYTLV | 19.51 | | |
| NA | N4 | 234 | 0.98 | yes | 3 | 0 | 75.61 | DEFCYTLIT | 100 | DEFCYTLMT | 75.61 | DEFCYTLVT | 19.51 | | |
| NA | N4 | 235 | 0.98 | yes | 3 | 0 | 75.61 | EFCYTLITD | 100 | EFCYTLMTD | 75.61 | EFCYTLVTD | 19.51 | | |
| NA | N4 | 236 | 0.98 | yes | 3 | 0 | 75.61 | FCYTLITDG | 100 | FCYTLMTDG | 75.61 | FCYTLVTDG | 19.51 | | |
| NA | N4 | 237 | 0.98 | yes | 3 | 0 | 75.61 | CYTLITDGP | 100 | CYTLMTDGP | 75.61 | CYTLVTDGP | 19.51 | | |
| NA | N4 | 238 | 1.24 | yes | 4 | 0 | 70.73 | YTLITDGPS | 100 | YTLMTDGPS | 70.73 | YTLVTDGPS | 19.51 | TLVTDGPSD | 4.88 |
| NA | N4 | 239 | 1.27 | yes | 4 | 0 | 70.73 | TLITDGPSD | 100 | TLMTDGPSD | 70.73 | TLITDGPSN | 19.51 | LVTDGPSDA | 4.07 |
| NA | N4 | 240 | 1.27 | yes | 4 | 0 | 70.73 | LITDGPSDA | 100 | LMTDGPSDA | 70.73 | LITDGPSNA | 19.51 | VTDGPSDAQ | 4.07 |
| NA | N4 | 241 | 0.35 | yes | 2 | 0 | 94.31 | ITDGPSDAQ | 100 | MTDGPSDAQ | 94.31 | ITDGPSNAQ | 4.88 | | |
| NA | N4 | 242 | 0.35 | yes | 2 | 0 | 94.31 | TDGPSDAQA | 100 | TDGPSNAQA | 94.31 | | 4.88 | | |
| NA | N4 | 243 | 0.35 | yes | 2 | 0 | 94.31 | DGPSDAQAF | 100 | DGPSNAQAF | 94.31 | | 4.88 | | |
| NA | N4 | 244 | 0.42 | yes | 2 | 0 | 93.5 | GPSDAQAFY | 100 | GPSNAQAFY | 93.5 | | 4.88 | | |
| NA | N4 | 245 | 0.42 | yes | 2 | 0 | 93.5 | PDAQAFYK | 99.19 | PSNAQAFYK | 93.5 | SDAQAFYKI | 0.81 | | |
| NA | N4 | 246 | 0.14 | yes | 1 | 0 | 98.37 | SDAQAFYKI | 99.19 | SNAQAFYKI | 98.37 | DAQAFYKIL | 0.81 | | |
| NA | N4 | 247 | 0.07 | yes | 1 | 0 | 99.19 | DAQAFYKIL | 99.19 | NAQAFYKIL | 19.51 | | | | |
| NA | N4 | 248 | 0.67 | yes | 2 | 0 | 99.19 | AQAFYKILK | 99.19 | GQAFYKILK | 14.63 | | | | |
| NA | N4 | 249 | 0.67 | yes | 2 | 0 | 99.19 | QAFYKILKI | 99.19 | AFYKILKIR | 14.63 | | | | |
| NA | N4 | 250 | 0.67 | yes | 2 | 0 | 99.19 | AFYKILKIR | 99.19 | FYKILKIRK | 14.63 | | | | |
| NA | N4 | 251 | 0.67 | yes | 2 | 0 | 99.19 | FYKILKIRK | 99.19 | YKILKIRKG | 14.63 | | | | |
| NA | N4 | 252 | 1.02 | yes | 3 | 0 | 99.19 | YKILKIRKG | 99.19 | KILKIRKGK | 13.82 | | | | |
| NA | N4 | 253 | 1.02 | yes | 3 | 0 | 78.86 | KILKIRKGK | 99.19 | ILKIRKGKI | 13.01 | ILKIKKGKI | 6.5 | LKIKKGKIM | 0.81 | |
| NA | N4 | 254 | 0.71 | yes | 4 | 0 | 89.43 | ILKIRKGKI | 99.19 | LKIRKGKIM | 13.01 | LKIKKGKL | 0.81 | LKIKKGKIM | 0.81 | |
| NA | N4 | 255 | 1.02 | yes | 4 | 0 | 89.43 | LKIRKGKIV | 99.19 | ATGFHLEEC | 5.69 | LKIRKGKIM | 2.44 | AAGFHLEEC | 0.81 | ATGHLEEC 0.81 |
| NA | N4 | 270 | 0.68 | yes | 5 | 0 | 89.43 | ATGFHLEEC | 99.19 | TGYHFEECS | 5.69 | APGFHLEEC | 2.44 | AGFHFEECS | 0.81 | AGFHFEECS 0.81 |
| NA | N4 | 271 | 0.68 | yes | 5 | 0 | 89.43 | TGFHFEECS | 99.19 | | | PGFHFEECS | 2.44 | IGFHFEECS | 0.81 | |

FIG. 73-21

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 272 | 0.38 | yes | 2 | 0 | 99.19 | GFHFEECSC | 5.69 | | | | | | |
| NA | N4 | 273 | 0.38 | yes | 2 | 0 | 99.19 | HFEECSCY | 5.69 | GYHFEECSC | 5.69 | | | | |
| NA | N4 | 274 | 0.07 | yes | 1 | 0 | 99.19 | HFEECSCYP | 99.19 | YHFEECSCY | 5.69 | | | | |
| NA | N4 | 275 | 0.07 | yes | 1 | 0 | 99.19 | FEECSCYPS | 99.19 | | | | | | |
| NA | N4 | 276 | 0.07 | yes | 1 | 0 | 99.19 | EECSCYPSG | 99.19 | | | | | | |
| NA | N4 | 277 | 0.89 | yes | 2 | 0 | 99.19 | ECSCYPSGT | 73.17 | ECSCYPSGE | 26.02 | | | | |
| NA | N4 | 278 | 1.03 | yes | 4 | 0 | 99.19 | CSCYPSGTD | 73.17 | CSCYPSGEN | 23.58 | CSCYPSGED | 1.63 | | | |
| NA | N4 | 279 | 1.5 | yes | 5 | 0 | 99.19 | DIECVCRDN | 60.16 | NVECVCRDN | 23.58 | NIECVCRDN | 13.82 | | | |
| NA | N4 | 286 | 0.96 | yes | 2 | 0 | 100 | IECVCRDNW | 61.79 | VECVCRDNW | 38.21 | | | | |
| NA | N4 | 287 | 0.07 | yes | 1 | 0 | 99.19 | ECVCRDNWR | 99.19 | | | | | | |
| NA | N4 | 288 | 0.07 | yes | 1 | 0 | 99.19 | CVCRDNWRG | 99.19 | | | | | | |
| NA | N4 | 289 | 0.07 | yes | 1 | 0 | 99.19 | VCRDNWRGS | 99.19 | | | | | | |
| NA | N4 | 290 | 0.07 | yes | 1 | 0 | 99.19 | CRDNWRGSN | 99.19 | | | | | | |
| NA | N4 | 291 | 0.07 | yes | 1 | 0 | 99.19 | RDNWRGSNR | 99.19 | | | | | | |
| NA | N4 | 292 | 0.07 | yes | 1 | 0 | 99.19 | DNWRGSNRP | 99.19 | | | | | | |
| NA | N4 | 293 | 0.07 | yes | 1 | 0 | 99.19 | NWRGSNRPW | 99.19 | | | | | | |
| NA | N4 | 294 | 0.07 | yes | 2 | 0 | 99.19 | WRGSNRPWI | 98.37 | WRGSNRPWV | 0.81 | | | | |
| NA | N4 | 295 | 0.14 | yes | 2 | 0 | 99.19 | RGSNRPWIR | 98.37 | QGSNRPWIR | 0.81 | | | | |
| NA | N4 | 296 | 0.14 | yes | 1 | 0 | 99.19 | GSNRPWIRF | 99.19 | | | | | | |
| NA | N4 | 297 | 0.07 | yes | 1 | 0 | 99.19 | SNRPWIRFN | 99.19 | | | | | | |
| NA | N4 | 298 | 0.07 | yes | 1 | 0 | 99.19 | NRPWIRFNS | 99.19 | | | | | | |
| NA | N4 | 299 | 0.07 | yes | 2 | 0 | 99.19 | RPWIRFNSD | 93.5 | PWIRFNSDP | 5.69 | | | | |
| NA | N4 | 300 | 0.38 | yes | 3 | 0 | 99.19 | PWIRFNSDL | 92.68 | WWIRFNSDLD | 5.69 | WIRFNSDPD | 0.81 | | | |
| NA | N4 | 301 | 0.45 | yes | 4 | 0 | 99.19 | WIRFNSDLD | 91.87 | WIRFNSNLD | 5.69 | IRFNSDLNY | 0.81 | | | |
| NA | N4 | 302 | 0.52 | yes | 3 | 0 | 99.19 | IRFNSDLDY | 91.87 | IRFNSNLDY | 5.69 | | | | |
| NA | N4 | 303 | 0.52 | yes | 3 | 0 | 99.19 | RFNSDLDYQ | 92.68 | RFNSNLDYQ | 5.69 | FNSDPDYQ | 0.81 | | | |
| NA | N4 | 304 | 0.45 | yes | 3 | 0 | 99.19 | FNSDLDYQI | 92.68 | FNSNLDYQI | 5.69 | FNSDLNYQI | 0.81 | | | |
| NA | N4 | 305 | 0.45 | yes | 3 | 0 | 99.19 | NSDLDYQIG | 92.68 | NSNLDYQIG | 5.69 | NSDPDYQIG | 0.81 | | | |
| NA | N4 | 306 | 0.45 | yes | 3 | 0 | 99.19 | SDLDYQIGY | 92.68 | SNLDYQIGY | 5.69 | SDLNYQIGY | 0.81 | | | |
| NA | N4 | 307 | 0.45 | yes | 3 | 0 | 99.19 | DLDYQIGYI | 85.37 | NLDYQIGYI | 5.69 | NLDYQIGYV | 0.81 | | | |
| NA | N4 | 308 | 0.82 | yes | 3 | 0 | 99.19 | LDYQIGYIC | 91.06 | LDYQIGYV | 7.32 | | | | |
| NA | N4 | 309 | 0.51 | yes | 2 | 0 | 99.19 | DYQIGYICS | 91.87 | DYQIGYVC | 7.32 | PDYQIGYV | 0.81 | | | |
| NA | N4 | 310 | 0.44 | yes | 2 | 0 | 99.19 | YQIGYICSG | 91.87 | YQIGYVCS | 7.32 | | | | |
| NA | N4 | 311 | 0.41 | yes | 2 | 0 | 99.19 | QIGYICSGI | 72.36 | QIGYICSGV | 19.51 | QIGYICSGV | 8.13 | | | |
| NA | N4 | 312 | 1.13 | yes | 3 | 0 | 99.19 | IGYICSGIF | 72.36 | IGYICSGVF | 19.51 | | | | |
| NA | N4 | 313 | 1.13 | yes | 3 | 0 | 99.19 | GYICSGIFG | 72.36 | GYICSGVFG | 19.51 | | | | |
| NA | N4 | 314 | 1.13 | yes | 3 | 0 | 99.19 | YICSGIFGD | 72.36 | YICSGVFGD | 19.51 | | | | |
| NA | N4 | 315 | 1.19 | yes | 3 | 0 | 99.19 | ICSGIFGDN | 71.54 | VCSGVFGDN | 19.51 | ICSGIFGDN | 0.81 | | | |
| NA | N4 | 316 | 0.9 | yes | 2 | 0 | 99.19 | CSGIFGDNP | 72.36 | CSGVFGDNP | 26.83 | | | | |
| NA | N4 | 317 | 0.9 | yes | 2 | 0 | 99.19 | SGIFGDNPR | 72.36 | SGVFGDNPR | 26.83 | | | | |
| NA | N4 | 318 | 0.97 | yes | 3 | 0 | 99.19 | GIFGDNPRP | 71.54 | GVFGDNPRP | 26.83 | GIFGDSPRP | 0.81 | | | |

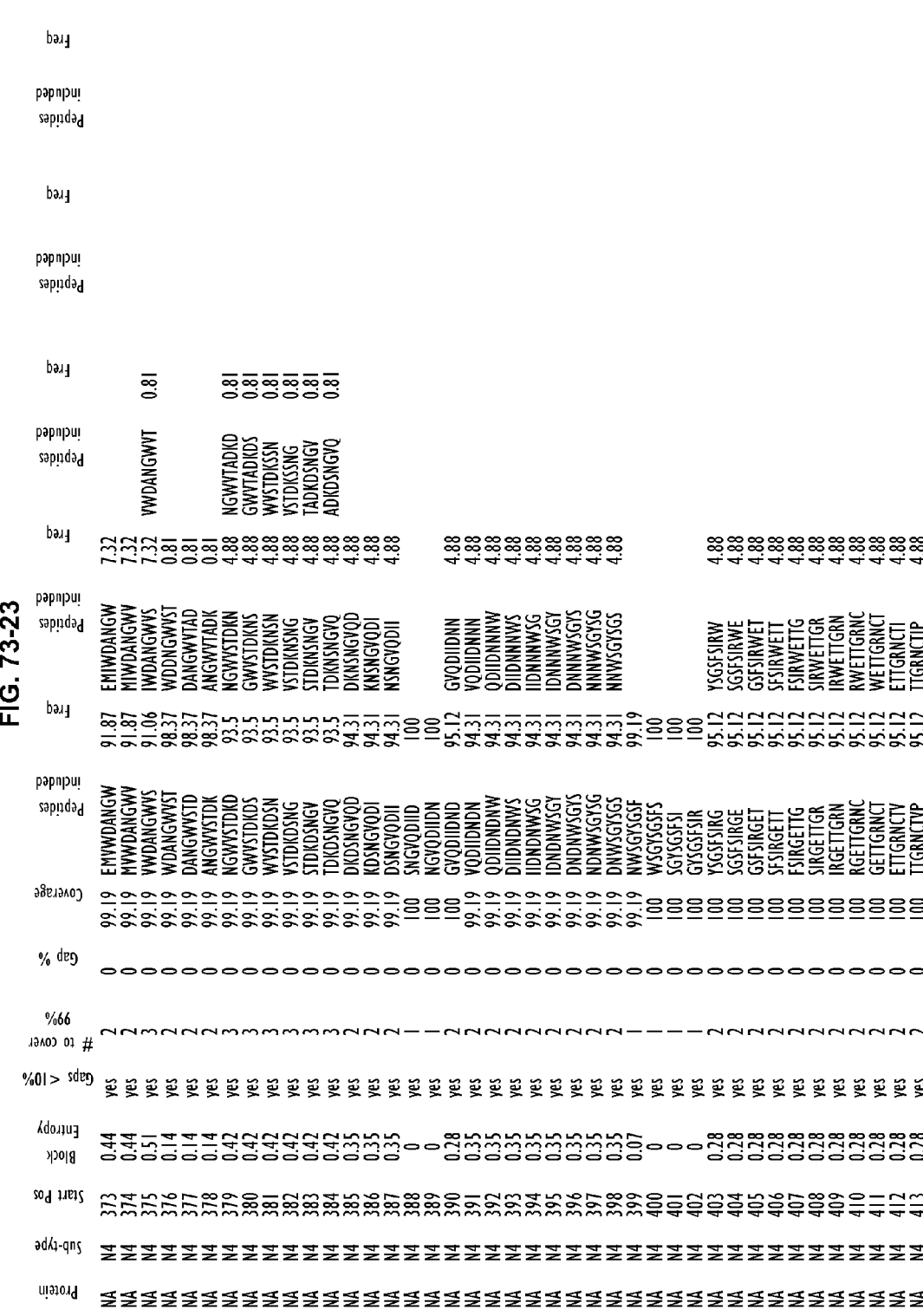

FIG. 73-24

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 414 | 0.28 | yes | 2 | 0 | 100 | TGRNCTYPC | 95.12 | TGRNCTIPC | 4.88 | | | | |
| NA | N4 | 415 | 0.35 | yes | 2 | 0 | 99.19 | GRNCTYPCF | 94.31 | GRNCTIPCF | 4.88 | | | | |
| NA | N4 | 416 | 0.35 | yes | 2 | 0 | 99.19 | RNCTYPCFW | 94.31 | RNCTIPCFW | 4.88 | | | | |
| NA | N4 | 417 | 0.35 | yes | 2 | 0 | 99.19 | NCTYPCFWV | 94.31 | NCTIPCFWV | 4.88 | | | | |
| NA | N4 | 418 | 0.35 | yes | 2 | 0 | 99.19 | CTYPCFWVE | 94.31 | CTIPCFWVE | 4.88 | | | | |
| NA | N4 | 419 | 0.35 | yes | 2 | 0 | 99.19 | TYPCFWVEM | 94.31 | TIPCFWVEM | 4.88 | | | | |
| NA | N4 | 420 | 0.07 | yes | 1 | 0 | 99.19 | YPCFWVEMI | 94.31 | IPCFWVEMI | 4.88 | | | | |
| NA | N4 | 421 | 0.07 | yes | 1 | 0 | 99.19 | PCFWVEMI | 99.19 | | | | | | |
| NA | N4 | 422 | 0.07 | yes | 1 | 0 | 99.19 | CFWVEMIR | 99.19 | | | | | | |
| NA | N4 | 423 | 0 | yes | 1 | 0 | 100 | FWVEMIRGQ | 99.19 | | | | | | |
| NA | N4 | 424 | 0.07 | yes | 1 | 0 | 99.19 | WVEMIRGQP | 99.19 | | | | | | |
| NA | N4 | 425 | 0.07 | yes | 1 | 0 | 99.19 | VEMIRGQPK | 99.19 | | | | | | |
| NA | N4 | 426 | 0.14 | yes | 2 | 0 | 99.19 | EMIRGQPKE | 98.37 | | | MIRGQPNER | 0.81 | | | |
| NA | N4 | 427 | 0.45 | yes | 3 | 0 | 99.19 | MIRGQPKEK | 92.68 | | | IRGQPKERT | 5.69 | | | |
| NA | N4 | 428 | 0.45 | yes | 3 | 0 | 99.19 | IRGQPKEKI | 92.68 | | | RGQPKERTI | 5.69 | | | |
| NA | N4 | 429 | 0.45 | yes | 3 | 0 | 99.19 | RGQPKEKTI | 92.68 | | | GQPNERTIW | 5.69 | | | |
| NA | N4 | 430 | 0.45 | yes | 3 | 0 | 99.19 | GQPKEKTIW | 92.68 | | | QPNERTIWT | 5.69 | | | |
| NA | N4 | 431 | 0.45 | yes | 3 | 0 | 99.19 | QPKEKTIWT | 92.68 | | | PKERTIWTS | 5.69 | | | |
| NA | N4 | 432 | 0.43 | yes | 3 | 0 | 99.19 | PKEKTIWTS | 92.68 | | | KERTIWTSG | 5.69 | | | |
| NA | N4 | 433 | 0.43 | yes | 3 | 0 | 99.19 | KEKTIWTSG | 92.68 | | | EKAIWTSGS | 1.63 | | | |
| NA | N4 | 434 | 0.43 | yes | 3 | 0 | 99.19 | EKTIWTSGS | 92.68 | | | KAIWTSGSS | 1.63 | | | |
| NA | N4 | 435 | 0.32 | yes | 2 | 0 | 94.31 | KTIWTSGSS | 92.68 | | | AIWTSGSSI | 5.69 | | | |
| NA | N4 | 436 | 0 | yes | 1 | 0 | 100 | TIWTSGSSI | 100 | | | | | | | |
| NA | N4 | 437 | 0 | yes | 1 | 0 | 100 | IWTSGSSIA | 100 | | | | | | | |
| NA | N4 | 438 | 0 | yes | 1 | 0 | 100 | WTSGSSIAF | 100 | | | | | | | |
| NA | N4 | 439 | 0 | yes | 1 | 0 | 100 | TSGSSIAFC | 100 | | | | | | | |
| NA | N4 | 440 | 0.51 | yes | 2 | 0 | 100 | SGSSIAFCG | 100 | | | | | | | |
| NA | N4 | 441 | 0.58 | yes | 2 | 0.81 | 88.62 | GSSIAFCGV | 88.62 | SSIAFCGVD | 11.38 | | | | |
| NA | N4 | 442 | 0.64 | yes | 3 | 0.81 | 87.8 | SSIAFCGVN | 87.8 | SIAFCGVDS | 11.38 | IAFCGVNFD | 0.81 | | | |
| NA | N4 | 443 | 0.64 | yes | 3 | 0.81 | 86.99 | SIAFCGVNS | 86.99 | IAFCGVDSD | 11.38 | AFCGVNFDL | 0.81 | | | |
| NA | N4 | 444 | 0.58 | yes | 3 | 0.81 | 86.99 | IAFCGVNSD | 86.99 | AFCGVDSDT | 11.38 | | | | | |
| NA | N4 | 445 | 0.58 | yes | 4 | 0.81 | 87.7 | AFCGVNSDT | 87.7 | FCGVDSDTT | 11.48 | | | | | |
| NA | N4 | 446 | 0.92 | yes | 5 | 0.81 | 84.43 | FCGVNSDTT | 84.43 | CGVDSDTTG | 6.56 | CGVDSDTTS | 4.92 | CGVNSDTTS | 2.46 |
| NA | N4 | 447 | 0.92 | yes | 5 | 0.81 | 84.43 | CGVNSDTTG | 84.43 | GVDSDTTGW | 6.56 | GVDSDTTSW | 4.92 | GVNSDTTGW | 2.46 |
| NA | N4 | 448 | 0.58 | yes | 4 | 0.81 | 90.16 | GVNSDTTGW | 90.16 | SDTTGWSWP | 7.38 | SDTTCWSWP | 0.82 | CGVNSNTTG | 0.82 |
| NA | N4 | 451 | 0.58 | yes | 4 | 0.81 | 90.16 | SDTTGWSWP | 90.16 | DTTGWSWPD | 7.38 | DTTCWSWPD | 0.82 | GVNSNTTGW | 0.82 |
| NA | N4 | 452 | 0.52 | yes | 3 | 0.81 | 90.98 | DTTGWSWPD | 90.98 | TTGWSWPDG | 7.38 | TTCWSWPDG | 0.82 | | |
| NA | N4 | 453 | 0.52 | yes | 3 | 0.81 | 90.98 | TTGWSWPDG | 90.98 | TGWSWPDGA | 7.38 | TCWSWPDGA | 0.82 | | |
| NA | N4 | 454 | 0.52 | yes | 3 | 0.81 | 90.98 | TGWSWPDGA | 90.98 | GWSWPDGAL | 7.38 | GWPWPDGAL | 0.82 | | |
| NA | N4 | 455 | 0.52 | yes | 3 | 0.81 | 90.98 | GWSWPDGAL | 90.98 | WSWPDGALL | 7.38 | | | | | |
| NA | N4 | 456 | 0.14 | yes | 2 | 0.81 | 98.36 | WSWPDGALL | 98.36 | WPWPDGALL | 0.82 | | | | | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N5 | 103 | 0.4 | yes | 3 | 0 | 99.34 | IRIGSRGHV | 94.08 | IRIGSRGHI | 3.29 | | | | |
| NA | N5 | 104 | 0.4 | yes | 3 | 0 | 99.34 | RIGSRGHVF | 94.08 | RIGSRGHI | 3.29 | | | | |
| NA | N5 | 105 | 0.4 | yes | 2 | 0 | 99.34 | IGSRGHVFV | 94.08 | IGSRGHIF | 3.29 | | | | |
| NA | N5 | 106 | 0.27 | yes | 2 | 0 | 96.05 | GSRGHVFVI | 96.05 | GSRGHIFV | 3.29 | | | | |
| NA | N5 | 107 | 0.27 | yes | 2 | 0 | 99.34 | SRGHVFVIR | 96.05 | SRGHIFVI | 3.29 | | | | |
| NA | N5 | 108 | 0.27 | yes | 2 | 0 | 100 | RGHVFVIRE | 96.05 | RGHIFVIR | 3.29 | | | | |
| NA | N5 | 109 | 0.21 | yes | 2 | 0 | 100 | GHVFVIREP | 96.71 | GHIFVIRE | 3.29 | | | | |
| NA | N5 | 110 | 0.21 | yes | 2 | 0 | 100 | HVFVIREPF | 96.71 | HIFVIREP | 3.29 | | | | |
| NA | N5 | 111 | 0.21 | yes | 2 | 0 | 100 | VFVIREPFV | 96.71 | IFVIREPF | 3.29 | | | | |
| NA | N5 | 112 | 0.24 | yes | 2 | 0 | 99.34 | FVIREPFVA | 96.05 | FVIREPFV | 3.29 | | | | |
| NA | N5 | 113 | 0.24 | yes | 2 | 0 | 99.34 | VIREPFVAC | 96.05 | VIREPFVS | 3.95 | | | | |
| NA | N5 | 114 | 0.38 | yes | 3 | 0 | 99.34 | IREPFVACG | 94.08 | IREPFVSCG | 3.95 | IREPFVACS | 1.97 | | |
| NA | N5 | 115 | 0.4 | yes | 3 | 0 | 99.34 | REPFVACGP | 94.08 | REPFVSCGP | 3.95 | REPFVACSP | 1.32 | | |
| NA | N5 | 116 | 1.26 | yes | 5 | 0 | 70.39 | EPFVACGPT | 70.39 | EPFVSCGPS | 21.71 | EPFVACGPS | 3.95 | EPFVACGPA | 1.97 | EPFVACSPS | 1.32 |
| NA | N5 | 117 | 1.26 | yes | 5 | 0 | 70.39 | PFVACGPTE | 70.39 | PFVSCGPSE | 21.71 | PFVACGPSE | 3.95 | PFVACGPAE | 1.32 | PFVACSPSE | 1.32 |
| NA | N5 | 118 | 1.26 | yes | 5 | 0 | 70.39 | FVACGPTEC | 70.39 | FVSCGPSEC | 21.71 | FVACGPSEC | 3.95 | FVACGPAEC | 1.97 | FVACSPSEC | 1.32 |
| NA | N5 | 119 | 1.26 | yes | 5 | 0 | 70.39 | VACGPTECR | 70.39 | VSCGPSECR | 21.71 | VACGPSECR | 3.95 | VACGPAECR | 1.97 | VACSPSECR | 1.32 |
| NA | N5 | 120 | 1.1 | yes | 4 | 0 | 70.39 | ACGPTECRT | 70.39 | SCGPSECRT | 25.66 | ACGPSECRT | 3.95 | ACGPAECRT | 1.97 | ACSPSECRT | 1.32 |
| NA | N5 | 121 | 1.03 | yes | 4 | 0 | 100 | CGPTECRTF | 70.39 | CGPSECRTF | 25.66 | | | CGPAECRTF | 1.97 | | |
| NA | N5 | 122 | 0.97 | yes | 3 | 0 | 99.34 | GPTECRTFF | 70.39 | GPSECRTFF | 26.97 | | | GPAECRTF | 1.97 | | |
| NA | N5 | 123 | 0.06 | yes | 1 | 0 | 99.34 | PTECRTFLT | 70.39 | PSECRTFFL | 26.97 | | | PAECRTFFL | 1.97 | | |
| NA | N5 | 124 | 0.06 | yes | 1 | 0 | 99.34 | TECRTFLTQ | 71.05 | SECRTFFLT | | | | AECRTFFLT | 1.97 | | |
| NA | N5 | 125 | 0.06 | yes | 1 | 0 | 99.34 | ECRTFLTQG | 99.34 | | | | | | | |
| NA | N5 | 126 | 0.06 | yes | 1 | 0 | 99.34 | CRTFFLTQG | 99.34 | | | | | | | |
| NA | N5 | 127 | 0.06 | yes | 1 | 0 | 99.34 | RTFFLTQGA | 99.34 | | | | | | | |
| NA | N5 | 128 | 0.11 | yes | 1 | 0 | 99.34 | TFFLTQGAL | 99.34 | | | | | | | |
| NA | N5 | 129 | 0.11 | yes | 1 | 0 | 99.34 | FFLTQGALL | 99.34 | | | | | | | |
| NA | N5 | 130 | 0.11 | yes | 1 | 0 | 99.34 | FLTQGALLN | 99.34 | | | | | | | |
| NA | N5 | 131 | 0.06 | yes | 1 | 0 | 99.34 | LTQGALLND | 99.34 | | | | | | | |
| NA | N5 | 132 | 0.06 | yes | 2 | 0 | 98.68 | TQGALLNDK | 98.68 | TPCVLLNDK | 0.66 | | | | | |
| NA | N5 | 133 | 0.11 | yes | 2 | 0 | 98.68 | QGALLNDKH | 98.68 | QGALLNDRH | 0.66 | | | | | |
| NA | N5 | 134 | 0.11 | yes | 2 | 0 | 98.68 | GALLNDKHS | 98.68 | GALLNDRHS | 0.66 | | | | | |
| NA | N5 | 135 | 0.11 | yes | 2 | 0 | 98.68 | ALLNDKHSN | 98.68 | ALLNDRHSN | 0.66 | | | | | |
| NA | N5 | 136 | 0.06 | yes | 1 | 0 | 99.34 | LLNDKHSNN | 99.34 | | | | | | | |
| NA | N5 | 137 | 0.06 | yes | 1 | 0 | 99.34 | LNDKHSNNT | 99.34 | | | | | | | |
| NA | N5 | 138 | 0.11 | yes | 1 | 0 | 99.34 | NDKHSNNTV | 99.34 | | | | | | | |
| NA | N5 | 139 | 0.11 | yes | 2 | 0 | 98.68 | DKHSNNTVK | 98.68 | DKHSNNTVR | 0.66 | | | | | |
| NA | N5 | 140 | 0.11 | yes | 2 | 0 | 98.68 | KHSNNTVKD | 98.68 | KHSNNTVRD | 0.66 | | | | | |
| NA | N5 | 141 | 0.06 | yes | 1 | 0 | 99.34 | HSNNTVKDR | 99.34 | | | | | | | |
| NA | N5 | 142 | 0.06 | yes | 1 | 0 | 99.34 | SNNTVKDRS | 99.34 | | | | | | | |
| NA | N5 | 143 | 0.06 | yes | 1 | 0 | 99.34 | NNTVKDRSP | 99.34 | | | | | | | |

FIG. 73-28

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N5 | 199 | 0 | yes | 1 | 0 | 100 | AYAVIHYGG | 100 | YAVIHYGGI | 34.21 | | | | |
| NA | N5 | 200 | 1.31 | yes | 3 | 0 | 100 | YAVIHYGGM | 56.58 | AVIHYGGIP | 34.21 | | | | |
| NA | N5 | 201 | 1.31 | yes | 3 | 0 | 100 | AVIHYGGMP | 56.58 | VIHYGGIPT | 34.21 | | | | |
| NA | N5 | 202 | 1.31 | yes | 3 | 0 | 100 | VIHYGGMPT | 56.58 | IHYGGIPTD | 34.21 | | | | |
| NA | N5 | 203 | 1.31 | yes | 3 | 0 | 100 | IHYGGMPTD | 56.58 | HYGGIPTDV | 34.21 | | | | |
| NA | N5 | 204 | 1.55 | yes | 5 | 0 | 100 | HYGGMPTDV | 56.58 | YGGIPTDVI | 34.21 | YGGIPTDVI | 9.21 | | |
| NA | N5 | 205 | 1.55 | yes | 5 | 0 | 100 | YGGMPTDVW | 56.58 | GGIPTDVIR | 30.26 | GGIPTDVIR | 9.21 | YGGIPTDVI | 3.29 |
| NA | N5 | 206 | 1.55 | yes | 5 | 0 | 100 | GGMPTDVWR | 56.58 | GIPTDVIRS | 30.26 | GVPTDVIRS | 9.21 | GGIPTDVIR | 3.29 |
| NA | N5 | 207 | 1.55 | yes | 5 | 0 | 100 | GMPTDVWRS | 56.58 | IPTDVIRSW | 30.26 | GVPTDVIRS | 9.21 | GVPTDVMRS | 3.29 |
| NA | N5 | 208 | 0.87 | yes | 3 | 0 | 100 | MPTDVWRSW | 56.58 | PTDVIRSWR | 30.26 | VPTDVIRSW | 9.21 | VPTDVMRSW | 3.29 |
| NA | N5 | 209 | 0.96 | yes | 4 | 0 | 99.34 | PTDVWRSWR | 81.58 | TDVIRSWRK | 13.82 | TDVVRSWRR | 8.55 | | |
| NA | N5 | 211 | 1.13 | yes | 5 | 0 | 99.34 | TDVWRSWRK | 80.26 | DVIRSWRKK | 13.82 | DVVRSWRRK | 8.55 | DVVRSWRRQ | 1.32 |
| NA | N5 | 212 | 1.13 | yes | 5 | 0 | 99.34 | DVWRSWRKK | 77.63 | VIRSWRKKI | 13.82 | VVRSWRKKI | 8.55 | VVRSWRRQI | 2.63 |
| NA | N5 | 213 | 1.13 | yes | 5 | 0 | 99.34 | VWRSWRKKQ | 77.63 | IRSWRKKIL | 13.82 | VRSWRKKIL | 8.55 | VRSWRRQIL | 2.63 |
| NA | N5 | 214 | 0.85 | yes | 4 | 0 | 99.34 | VRSWRKKQI | 77.63 | RSWRKKILR | 13.82 | RSWRKQILR | 3.95 | | |
| NA | N5 | 215 | 0.85 | yes | 4 | 0 | 99.34 | RSWRKKQIL | 82.24 | SWRKKILRT | 13.82 | SWRKQILRT | 3.95 | | |
| NA | N5 | 216 | 0.85 | yes | 4 | 0 | 99.34 | SWRKKQILR | 82.24 | WRKKILRTQ | 13.82 | WRKQILRTQ | 3.95 | | |
| NA | N5 | 217 | 0.28 | yes | 3 | 0 | 99.34 | WRKKQILRT | 82.24 | RKKILRTQE | 13.82 | RRQILRTQE | 1.32 | | |
| NA | N5 | 218 | 0.18 | yes | 2 | 0 | 100 | RKQILRTQE | 96.05 | KKILRTQES | 2.63 | | | | |
| NA | N5 | 219 | 0 | yes | 1 | 0 | 100 | KQILRTQES | 97.37 | KILRTQESS | 2.63 | | | | |
| NA | N5 | 220 | 0 | yes | 1 | 0 | 100 | QILRTQESS | 100 | | | | | | |
| NA | N5 | 221 | 0 | yes | 1 | 0 | 100 | ILRTQESSC | 100 | | | | | | |
| NA | N5 | 222 | 0.59 | yes | 3 | 0 | 100 | LRTQESSCV | 100 | | | | | | |
| NA | N5 | 223 | 1.14 | yes | 4 | 0 | 89.47 | RTQESSCVC | 100 | TQESSCVCI | 6.58 | TQESSCVCV | 3.95 | | |
| NA | N5 | 224 | 1.14 | yes | 4 | 0 | 75.66 | TQESSCVCM | 100 | QESSCVCIK | 13.82 | QESSCVCIK | 6.58 | | |
| NA | N5 | 225 | 0.06 | yes | 1 | 0 | 75.66 | QESSCVCMK | 100 | ESSCVCIKG | 13.82 | ESSCVCIKG | 6.58 | | |
| NA | N5 | 235 | 0.06 | yes | 3 | 0 | 99.34 | ESSCVCMKG | 100 | | | | | | |
| NA | N5 | 236 | 0 | yes | 4 | 0 | 99.34 | CVWMTDGP | 100 | | | | | | |
| NA | N5 | 237 | 0 | yes | 4 | 0 | 99.34 | YWWMTDGPA | 99.34 | | | | | | |
| NA | N5 | 238 | 0.41 | yes | 2 | 0 | 92.76 | WWMTDGPAN | 99.34 | WWMTDGPAS | 6.58 | | | | |
| NA | N5 | 239 | 1.17 | yes | 4 | 0 | 76.97 | VMTDGPANN | 76.97 | VMTDGPANS | 8.55 | VMTDGPASN | 7.24 | | |
| NA | N5 | 240 | 1.17 | yes | 4 | 0 | 76.97 | MTDGPANNQ | 76.97 | MTDGPANSQ | 8.55 | MTDGPASNQ | 7.24 | | |
| NA | N5 | 241 | 1.17 | yes | 4 | 0 | 76.97 | TDGPANNQA | 76.97 | TDGPANSQA | 8.55 | TDGPASNQA | 7.24 | | |
| NA | N5 | 242 | 1.14 | yes | 4 | 0 | 76.97 | DGPANNQAS | 76.97 | DGPANSQAS | 8.55 | DGPASNQAS | 7.24 | | |
| NA | N5 | 243 | 1.14 | yes | 4 | 0 | 76.97 | GPANNQASY | 76.97 | GPANSQASY | 8.55 | GPANKQASY | 7.24 | | |
| NA | N5 | 244 | 1.24 | yes | 5 | 0 | 75.66 | PANNQASYK | 75.66 | PASNQASYK | 8.55 | PANKQASYK | 7.24 | PANNQASYR | 1.32 |
| NA | N5 | 245 | 1.24 | yes | 5 | 0 | 75.66 | ANNQASYKI | 75.66 | ASNQASYKI | 8.55 | ANKQASYKI | 7.24 | ANNQASYRI | 1.32 |
| NA | N5 | 246 | 0.88 | yes | 4 | 0 | 82.89 | NNQASYKIF | 75.66 | NKQASYKIF | 8.55 | SNQASYKIF | 7.24 | NNQASYRIF | 1.32 |
| NA | N5 | 247 | 0.1 | yes | 2 | 0 | 98.68 | NQASYKIFK | 82.89 | KQASYKIFK | 8.55 | NQASYKIFK | 1.32 | | |
| NA | N5 | 248 | 1.75 | yes | 5 | 0 | 51.32 | ASYKIFKSH | 51.32 | ASYKIFKSQ | 26.97 | ASYKIFKSY | 12.5 | ASYKIFKSR | 7.89 | ASYRIFKSH | 1.32 |

FIG. 73-29

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | N5 | 265 | 1.41 | yes | 4 | 0 | 99.34 | EVSFQGGHI | 60.53 | EISFQGGHI | 25.66 | EVLFQGGHI | 0.66 | EVSFRGGHI | |
| NA | N5 | 266 | 1.41 | yes | 4 | 0 | 99.34 | VSFQGGHIE | 60.53 | ISFQGGHIE | 25.66 | VLFQGGHIE | 0.66 | ISFQSGHIE | |
| NA | N5 | 267 | 0.66 | yes | 3 | 0 | 99.34 | SFQGGHIEE | 86.18 | LFQGGHIEE | 12.5 | SFQSGHIEE | | | |
| NA | N5 | 268 | 0.11 | yes | 2 | 0 | 99.34 | FQGGHIEEC | 98.68 | FRGGHIEEC | 0.66 | | | | |
| NA | N5 | 269 | 0.11 | yes | 2 | 0 | 99.34 | QGGHIEECS | 98.68 | QSGHIEECS | 0.66 | | | | |
| NA | N5 | 270 | 0.06 | yes | 1 | 0 | 99.34 | GGHIEECSC | 99.34 | | | | | | |
| NA | N5 | 271 | 0 | yes | 1 | 0 | 100 | GHIEECSCY | | | | | | | |
| NA | N5 | 272 | 0 | yes | 1 | 0 | 100 | HIEECSCYP | | | | | | | |
| NA | N5 | 273 | 0 | yes | 1 | 0 | 100 | IEECSCYPN | | | | | | | |
| NA | N5 | 274 | 1.37 | yes | 3 | 0 | 100 | EECSCYPNL | 58.55 | EECSCYPNM | 26.97 | EECSCYPNS | 14.47 | | |
| NA | N5 | 275 | 1.42 | yes | 3 | 0 | 100 | ECSCYPNLG | 57.89 | ECSCYPNMG | 26.97 | ECSCYPNSG | 14.47 | | |
| NA | N5 | 276 | 1.8 | yes | 5 | 0 | 100 | CSCYPNLGK | 49.34 | CSCYPNMGK | 26.97 | CSCYPNSGK | 14.47 | CSCYPNLGQ | 7.89 |
| NA | N5 | 277 | 1.8 | yes | 5 | 0 | 100 | SCYPNLGKV | 49.34 | SCYPNMGKV | 26.97 | SCYPNSGKV | 14.47 | SCYPNLGIV | 7.89 |
| NA | N5 | 278 | 1.8 | yes | 5 | 0 | 100 | CYPNLGKVE | 49.34 | CYPNMGKVE | 26.97 | CYPNSGKVE | 14.47 | CYPNLCQYE | 7.89 |
| NA | N5 | 279 | 1.8 | yes | 5 | 0 | 100 | YPNLGKVEC | 49.34 | YPNMGKVEC | 26.97 | YPNSGKVEC | 14.47 | YPNLCQVEC | 7.89 |
| NA | N5 | 280 | 1.8 | yes | 5 | 0 | 100 | PNLGKVECV | 49.34 | PNMGKVECV | 26.97 | PNSGKVECV | 14.47 | PNLGIVECV | 7.89 |
| NA | N5 | 281 | 1.8 | yes | 5 | 0 | 100 | NLGKVECVC | 49.34 | NMGKVECVC | 26.97 | NSGKVECVC | 14.47 | NLCQVECVC | 7.89 |
| NA | N5 | 282 | 0.51 | yes | 3 | 0 | 100 | GKVECVCR | 49.34 | MGKVECVCR | 26.97 | SGKVECVCR | 14.47 | LGQVECVCR | 7.89 |
| NA | N5 | 283 | 0.48 | yes | 2 | 0 | 100 | KVECVCRD | 90.79 | GIVECVCR | 8.55 | | | | |
| NA | N5 | 284 | 0 | yes | 1 | 0 | 100 | VECVCRDN | 90.79 | QVECVCRD | | | | | |
| NA | N5 | 285 | 0 | yes | 1 | 0 | 100 | ECVCRDNW | | | | | | | |
| NA | N5 | 286 | 0 | yes | 1 | 0 | 100 | CVCRDNWN | | | | | | | |
| NA | N5 | 287 | 0 | yes | 1 | 0 | 100 | VCRDNWNG | | | | | | | |
| NA | N5 | 288 | 0 | yes | 1 | 0 | 100 | CRDNWNGM | | | | | | | |
| NA | N5 | 289 | 0 | yes | 1 | 0 | 100 | RDNWNGMN | | | | | | | |
| NA | N5 | 290 | 0 | yes | 1 | 0 | 100 | DNWNGMNR | | | | | | | |
| NA | N5 | 291 | 0 | yes | 1 | 0 | 100 | NWNGMNRP | | | | | | | |
| NA | N5 | 292 | 0.3 | yes | 2 | 0 | 95.39 | WNGMNRPI | 95.39 | NWNGMNRPV | 3.95 | | | | |
| NA | N5 | 293 | 0.3 | yes | 2 | 0 | 95.39 | WNGMNRPI | 95.39 | WNGMNRPV | 3.95 | | | | |
| NA | N5 | 309 | 0.4 | yes | 2 | 0 | 94.74 | YNGMNRPIL | 94.74 | YNVGYLCAG | 1.97 | YNVGYLCAG | 1.32 | | |
| NA | N5 | 310 | 0.4 | yes | 2 | 0 | 94.74 | NVGYLCAGI | 94.74 | NVGYLCAGI | 1.97 | KVGYLCAGI | 1.32 | | |
| NA | N5 | 311 | 0.06 | yes | 1 | 0 | 99.34 | VGYLCAGIP | 99.34 | | | | | | |
| NA | N5 | 312 | 0 | yes | 1 | 0 | 100 | GYLCAGIPT | | | | | | | |
| NA | N5 | 313 | 0 | yes | 1 | 0 | 100 | YLCAGIPTD | | | | | | | |
| NA | N5 | 314 | 0 | yes | 1 | 0 | 100 | LCAGIPTDT | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 116 | 0.05 | yes | 1 | 0 | 99.57 | LVTREPYLS | 99.57 | | | | | | |
| NA | N6 | 117 | 0.05 | yes | 1 | 0 | 99.57 | VTREPYLSC | 99.57 | | | | | | |
| NA | N6 | 118 | 0.88 | yes | 2 | 0 | 99.43 | TREPYLSCG | 73.68 | TREPYLSCD | 25.75 | | | | | |
| NA | N6 | 119 | 0.9 | yes | 2 | 0 | 99.14 | REPYLSCGP | 73.53 | REPYLSCDP | 25.61 | | | | | |
| NA | N6 | 129 | 0.94 | yes | 3 | 0 | 99.14 | ECRMFALSQ | 72.68 | GCRMFALSQ | 26.18 | ECKMFALSQ | 0.29 | | | |
| NA | N6 | 130 | 0.09 | yes | 1 | 0 | 99.14 | CRMFALSQG | 99.14 | | | | | | |
| NA | N6 | 131 | 0.09 | yes | 1 | 0 | 99.14 | RMFALSQGT | 99.14 | | | | | | |
| NA | N6 | 132 | 0.06 | yes | 1 | 0 | 99.43 | MFALSQGTT | 99.43 | | | | | | |
| NA | N6 | 133 | 0.03 | yes | 1 | 0 | 99.71 | FALSQGTTL | 99.71 | | | | | | |
| NA | N6 | 134 | 0.08 | yes | 1 | 0 | 99.14 | ALSQGTTLR | 99.14 | | | | | | |
| NA | N6 | 135 | 0.11 | yes | 1 | 0 | 99.57 | LSQGTTLRG | 98.86 | LSQGTTLKG | 0.72 | | | | | |
| NA | N6 | 136 | 0.37 | yes | 2 | 0 | 99.57 | SQGTTLRGR | 94.42 | SQGTTLRGQ | 4.43 | SQGTTLKGR | 0.72 | | | |
| NA | N6 | 137 | 0.37 | yes | 2 | 0 | 99.57 | QGTTLRGRH | 94.42 | QGTTLRGQH | 4.43 | QGTTLKGRH | 0.72 | | | |
| NA | N6 | 138 | 0.38 | yes | 2 | 0 | 99.43 | GTTLRGRHA | 94.28 | GTTLRGQHA | 4.43 | GTTLKGRHA | 0.72 | | | |
| NA | N6 | 139 | 0.38 | yes | 2 | 0 | 99.14 | TTLRGRHAN | 94.28 | TTLRGQHAN | 4.43 | TTLKGRHAN | 0.72 | | | |
| NA | N6 | 140 | 0.38 | yes | 2 | 0 | 99.43 | TLRGRHANG | 94.43 | TLRGQHANG | 4.43 | TLKGRHANG | 0.72 | | | |
| NA | N6 | 141 | 0.38 | yes | 2 | 0 | 99.43 | LRGRHANGT | 94.28 | LRGQHANGT | 4.43 | LKGRHANGT | 0.72 | | | |
| NA | N6 | 142 | 0.45 | yes | 3 | 0 | 99.43 | RGRHANGTI | 93.56 | RGQHANGTM | 4.43 | KGRHANGTI | 0.72 | KGRHANGTI | 0.43 | |
| NA | N6 | 143 | 0.47 | yes | 3 | 0 | 99.14 | GRHANGTIH | 93.13 | GQHANGTIH | 4.43 | GRHANGTM | 0.72 | GRHANGTIN | 0.86 | |
| NA | N6 | 144 | 0.44 | yes | 3 | 0 | 99.43 | RHANGTIHD | 93.42 | QHANGTMH | 4.43 | RHANGTMHD | — | RHANGTIND | 0.86 | |
| NA | N6 | 145 | 0.44 | yes | 3 | 0 | 99.71 | HANGTIHDR | 97.85 | HANGTMHDR | — | HANGTINDR | 0.86 | | | |
| NA | N6 | 146 | 0.18 | yes | 3 | 0 | 99.71 | ANGTIHDRS | 97.85 | ANGTMHDRS | — | ANGTINDRS | 0.86 | | | |
| NA | N6 | 147 | 0.18 | yes | 3 | 0 | 99.86 | NGTIHDRSP | 94.85 | NGTMHDRSP | 3.15 | NGTINDRSP | — | NGTINDRSP | 0.86 | |
| NA | N6 | 148 | 0.37 | yes | 4 | 0 | 99.86 | GTIHDRSPF | 93.71 | GTIHDRSPY | 3.15 | GTIHDRSQF | — | GTMHDRSPF | 1.14 | GTINDRSPF | 0.86 |
| NA | N6 | 149 | 0.46 | yes | 5 | 0 | 99.86 | TIHDRSPFR | 93.71 | TIHDRSPYR | 3.15 | TIHDRSQFR | — | TMHDRSPFR | 1.14 | TINDRSPFR | 0.86 |
| NA | N6 | 150 | 0.46 | yes | 5 | 0 | 99.57 | IHDRSPFRA | 93.42 | IHDRSPYRA | 3.15 | IHDRSQFRA | — | MHDRSPFRA | 1.14 | INDRSPFRA | 0.86 |
| NA | N6 | 151 | 0.49 | yes | 4 | 0 | 99.57 | HDRSPFRAL | 94.42 | HDRSPYRAL | 3.15 | HDRSQFRAL | — | NDRSPFRAL | 1.14 | |
| NA | N6 | 152 | 0.41 | yes | 4 | 0 | 99.57 | DRSPFRALV | 85.69 | DRSPYRALV | 3.15 | DRSQFRALV | — | DRSPFRALI | 1.14 | |
| NA | N6 | 153 | 0.78 | yes | 5 | 0 | 99.57 | RSPFRALYS | 85.69 | RSPYRALIS | 9.59 | RSQFRALIS | 0.72 | RSPFRALIS | 3.15 | |
| NA | N6 | 154 | 0.78 | yes | 5 | 0 | 99.57 | SPFRALYSW | 84.98 | SPYRALISW | 9.59 | SQFRALISW | 0.72 | SPFRALISW | 3.15 | |
| NA | N6 | 155 | 0.78 | yes | 4 | 0 | 99.57 | PFRALYSWE | 88.13 | PYRALISWE | 9.59 | QFRALISWE | 0.72 | PFRALISWE | 3.15 | PFRALISWG | 0.72 |
| NA | N6 | 156 | 0.84 | yes | 3 | 0 | 99.43 | FRALYSWEM | 89.13 | YRALISWEM | 9.59 | FRALISWEM | 1.14 | | | |
| NA | N6 | 157 | 0.65 | yes | 3 | 0 | 99.28 | RALYSWEMG | 88.7 | RALISWEMG | 9.59 | RALYSWEMG | 0.72 | | | |
| NA | N6 | 158 | 0.57 | yes | 3 | 0 | 99.28 | ALYSWEMGQ | 88.7 | ALISWEMGQ | 9.59 | ALISWEMGL | 0.29 | ALISWEMGL | 0.29 | |
| NA | N6 | 159 | 0.62 | yes | 3 | 0 | 99.28 | LYSWEMGQA | 88.7 | LISWEMGQA | 9.59 | LISWEMGLA | 0.29 | LISWEMGLA | 0.29 | |
| NA | N6 | 160 | 0.62 | yes | 3 | 0 | 99.28 | YSWEMGQAP | 88.28 | ISWEMGQAP | 9.59 | ISWEMGLAP | 0.29 | ISWEMGLAP | 0.29 | |
| NA | N6 | 161 | 0.62 | yes | 3 | 0 | 99.28 | SWEMGQAPS | 88.28 | SWEMGQAPS | 9.59 | SWEMGLAPS | 0.29 | | | |
| NA | N6 | 162 | 0.17 | yes | 3 | 0 | 99.28 | WEMGQAPSP | 98.28 | VSWEMGQAP | 0.72 | WEMGLAPSP | 0.72 | | | |
| NA | N6 | 163 | 0.19 | yes | 3 | 0 | 99.28 | EMGQAPSPY | 98.14 | WGMGQAPS | 0.72 | WEMGLAPSP | — | | | |
| NA | N6 | 164 | 0.17 | yes | 3 | 0 | 99.14 | MGQAPSPYN | 98.43 | GMGQAPSPY | 0.72 | EMGLAPSPY | — | | | |
| NA | N6 | 175 | 1.22 | yes | 4 | 0 | 99.14 | VECIGWSST | 68.1 | MGQAPSPYT | 0.43 | MGLAPSPYN | — | IECIGWSST | — | |

FIG. 73-34

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 176 | 0.96 | yes | 2 | 0 | 99.28 | ECVGWSSTS | 69.24 | ECIGWSSTS | 30.04 | | | | |
| NA | N6 | 177 | 0.96 | yes | 2 | 0 | 99.28 | CVGWSSTSC | 69.24 | CIGWSSTSC | 30.04 | | | | |
| NA | N6 | 178 | 0.96 | yes | 2 | 0 | 99.28 | VGWSSTSCH | 69.24 | IGWSSTSCH | 30.04 | | | | |
| NA | N6 | 179 | 0.06 | yes | 1 | 0 | 99.43 | GWSSTSCHD | 99.43 | | | | | | |
| NA | N6 | 180 | 0.06 | yes | 1 | 0 | 99.43 | WSSTSCHDG | 99.43 | | | | | | |
| NA | N6 | 181 | 0.49 | yes | 5 | 0.14 | 99.14 | SSTSCHDGI | 93.84 | SSTSCHDGM | 2.01 | SSTSCHDGV | 1.72 | SSTSCHDGK | 0.72 |
| NA | N6 | 182 | 0.5 | yes | 5 | 0.14 | 99.14 | STSCHDGIS | 93.7 | STSCHDGMS | 2.01 | STSCHDGYS | 1.72 | STSCHDGKS | 0.72 |
| NA | N6 | 183 | 0.46 | yes | 5 | 0.86 | 99.28 | TSCHDGISR | 94.23 | TSCHDGMSR | 2.02 | TCHDGYSR | 1.3 | TSCHDGKSR | 0.72 |
| NA | N6 | 184 | 0.45 | yes | 5 | 0.86 | 99.42 | SCHDGISRM | 94.37 | SCHDGMSRM | 2.02 | SCHDGYSRM | 1.3 | SCHDGKSRM | 0.72 |
| NA | N6 | 185 | 0.44 | yes | 5 | 0.86 | 99.42 | CHDGISRMS | 94.52 | CHDGMSRMS | 1.88 | CHDGYSRMS | 1.3 | CHDGKSRMS | 0.72 |
| NA | N6 | 190 | 0.46 | yes | 3 | 0.86 | 99.28 | CHDGISRMS | 92.5 | SRMSVCMSG | 6.35 | CHDGYSRMS | 0.43 | | |
| NA | N6 | 191 | 0.46 | yes | 3 | 0.86 | 99.14 | RMSICMSGP | 92.36 | RMSVCMSGP | 6.35 | | | | |
| NA | N6 | 192 | 0.47 | yes | 3 | 0.72 | 99.28 | MSICMSGPN | 90.63 | MSVCMSGP | 6.34 | SVCMSGPNN | 0.43 | | |
| NA | N6 | 193 | 0.6 | yes | 5 | 0.72 | 99.28 | SICMSGPNN | 90.63 | SICMSGPND | 6.2 | VCMSGPNNN | 0.43 | | |
| NA | N6 | 194 | 0.59 | yes | 4 | 0.72 | 99.14 | ICMSGPNNN | 91.07 | ICMSGPNDN | 6.34 | | | | |
| NA | N6 | 195 | 0.56 | yes | 3 | 0.72 | 99.14 | CMSGPNNNA | 91.07 | CMSGPNDNA | 6.34 | | | | |
| NA | N6 | 196 | 0.56 | yes | 3 | 0.86 | 99.28 | MSGPNNNAS | 97.55 | MSGPNDNAS | 6.34 | | | | |
| NA | N6 | 197 | 0.2 | yes | 2 | 0.86 | 99.28 | SGPNNNASA | 97.55 | PNNNASAVI | 1.73 | | | | |
| NA | N6 | 198 | 0.2 | yes | 2 | 0.86 | 99.28 | GPNNNASAV | 96.54 | NNNASAVIW | 1.73 | | | | |
| NA | N6 | 199 | 0.29 | yes | 3 | 0.86 | 99.28 | PNNNASAVW | 96.68 | NNASAVIWV | 1.73 | | | | |
| NA | N6 | 200 | 0.27 | yes | 2 | 0.86 | 99.42 | NNNASAVWY | 96.68 | NASAVIWVY | 1.73 | | | | |
| NA | N6 | 201 | 0.27 | yes | 2 | 0.86 | 99.13 | NNASAVWVY | 74.03 | TEIPSWEGN | 23.81 | | | | |
| NA | N6 | 216 | 0.98 | yes | 4 | 0.72 | 99.14 | EIASWAGNI | 74.03 | EIPSWEGNI | 23.92 | IEIPSWAGN | 1.01 | | |
| NA | N6 | 217 | 0.98 | yes | 4 | 0.72 | 99.14 | IASWAGNIL | 73.92 | IPSWEGNIL | 23.92 | EIPTWAGNI | 1.01 | | |
| NA | N6 | 218 | 0.99 | yes | 4 | 0.72 | 99.13 | ASWAGNILR | 73.92 | PSWEGNILR | 23.92 | IPSWAGNVL | 1.01 | | |
| NA | N6 | 219 | 0.17 | yes | 2 | 0.72 | 98.13 | SWAGNILRT | 98.13 | SWEGNILRT | 1.01 | PSWAGNVLR | 1.01 | | |
| NA | N6 | 220 | 0.16 | yes | 2 | 0.72 | 98.27 | WAGNILRTQ | 98.27 | WEGNILRTQ | 1.01 | | | | |
| NA | N6 | 221 | 0.06 | yes | 1 | 0.72 | 98.27 | AGNILRTQE | 98.27 | EGNILRTQE | 1.01 | | | | |
| NA | N6 | 222 | 0.06 | yes | 1 | 0.72 | 99.42 | GNILRTQES | 99.42 | | | | | | |
| NA | N6 | 223 | 0.06 | yes | 1 | 0.72 | 99.42 | NILRTQESE | 99.42 | | | | | | |
| NA | N6 | 224 | 0.06 | yes | 1 | 0.72 | 99.71 | ILRTQESEC | 99.71 | | | | | | |
| NA | N6 | 225 | 0.03 | yes | 1 | 0.72 | 99.71 | LRTQESECV | 99.71 | | | | | | |
| NA | N6 | 226 | 0.03 | yes | 1 | 0.72 | 99.71 | RTQESECVC | 99.71 | | | | | | |
| NA | N6 | 227 | 0.03 | yes | 1 | 0.72 | 99.71 | TQESECVCH | 99.71 | | | | | | |
| NA | N6 | 228 | 0.88 | yes | 2 | 0.72 | 99.28 | QESECVCHN | 74.35 | QESECVCHK | 24.93 | SECVCHNGV | 2.59 | SECVCHNGV | 0.86 |
| NA | N6 | 229 | 0.87 | yes | 2 | 0.72 | 99.42 | ESECVCHNG | 74.35 | ESECVCHKG | 25.07 | ECVCHNGVC | 2.45 | ECVCHNGVC | 0.86 |
| NA | N6 | 230 | 1.07 | yes | 4 | 0.72 | 99.14 | SECVCHNGI | 73.34 | SECVCHKGI | 22.48 | CVCHNGVCP | 2.45 | CVCHNGVCP | 0.86 |
| NA | N6 | 231 | 1.08 | yes | 4 | 0.72 | 99.14 | ECVCHNGIC | 73.34 | ECVCHKGIC | 22.48 | VCHNGVCPV | 2.45 | VCHNGVCPV | 0.87 |
| NA | N6 | 232 | 1.08 | yes | 4 | 0.72 | 99.13 | CVCHNGICP | 73.34 | CVCHKGICP | 22.48 | | | | |
| NA | N6 | 233 | 1.08 | yes | 4 | 0.86 | 99.13 | VCHNGICPV | 73.3 | VCHKGICPV | 22.51 | | | | |

FIG. 73-35

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | N6 | 234 | 1.09 | yes | 5 | 0.86 | 99.13 | CHNGICPW | 73.3 | CHNGICPW | 22.51 | CHNGVCPW | 2.31 | CHNGVCPW | 0.87 | CHNGTCPW | 0.14 |
| NA | N6 | 237 | 0.3 | yes | 2 | 0.86 | 99.13 | GICPVWMTD | 95.96 | GVCPVWMTD | 3.17 | | | | | | |
| NA | N6 | 238 | 0.08 | yes | 1 | 0.86 | 99.13 | ICPVWMTDG | 95.96 | VCPVWMTDG | 3.17 | | | | | | |
| NA | N6 | 239 | 0.08 | yes | 1 | 0.86 | 99.28 | CPVWMTDGP | 99.28 | | | | | | | | |
| NA | N6 | 240 | 0.08 | yes | 1 | 0.86 | 99.28 | PVWMTDGPA | 99.28 | | | | | | | | |
| NA | N6 | 241 | 0.21 | yes | 4 | 0.86 | 99.28 | VWMTDGPAN | 97.84 | WMTDGPAD | 0.87 | VWMTDGPAN | 0.29 | VIMTDGPAN | 0.29 | | |
| NA | N6 | 244 | 0.58 | yes | 5 | 0.86 | 99.28 | TDGPANNRA | 91.05 | TDGPASNKA | 6.2 | TDGPAS | 0.87 | TDGPAN | 0.87 | TDGPANSRA | 0.43 |
| NA | N6 | 272 | 0.89 | yes | 4 | 0.86 | 99.28 | GSAQHIEEC | 77.06 | GNAQHIEEC | 21.36 | GKAQHIEEC | 0.43 | | | | |
| NA | N6 | 273 | 0.89 | yes | 4 | 0.86 | 99.28 | SAQHIEECS | 77.06 | NAQHIEECS | 21.36 | SAEHIEECS | 0.43 | TAQHIEECS | 0.43 | | |
| NA | N6 | 274 | 0.06 | yes | 1 | 0.86 | 99.42 | AQHIEECSC | 99.42 | | | | | | | | |
| NA | N6 | 275 | 0.04 | yes | 1 | 0.86 | 99.57 | QHIEECSCY | 99.57 | | | | | | | | |
| NA | N6 | 276 | 0 | yes | 1 | 0.86 | 100 | HIEECSCYG | 100 | | | | | | | | |
| NA | N6 | 277 | 0.1 | yes | 2 | 0.86 | 99.86 | IEECSCYGS | 98.85 | IEECSCYGS | 1.01 | | | | | | |
| NA | N6 | 289 | 0.6 | yes | 3 | 0.29 | 99.71 | VKICRDNWK | 89.1 | VKICRDNW | 8.03 | | | | | | |
| NA | N6 | 290 | 0.3 | yes | 3 | 0.29 | 96.13 | KCICRDNWK | 96.13 | KCICRDNWR | 2.44 | | | | | | |
| NA | N6 | 291 | 0.3 | yes | 3 | 0.29 | 96.13 | CICRDNWKG | 96.13 | CICRDNWRG | 2.44 | | | | | | |
| NA | N6 | 292 | 0.3 | yes | 3 | 0.29 | 96.13 | ICRDNWKGA | 96.13 | ICRDNWRGA | 2.44 | | | | | | |
| NA | N6 | 293 | 0.1 | yes | 2 | 0.29 | 99.86 | CRDNWKGAN | 98.85 | | | | | | | | |
| NA | N6 | 294 | 0.1 | yes | 2 | 0.29 | 99.86 | RDNWKGANR | 98.85 | | | | | | | | |
| NA | N6 | 295 | 0.24 | yes | 3 | 0.29 | 99.86 | DNWKGANRP | 98.85 | NWRGANRPV | 2.01 | | | | | | |
| NA | N6 | 296 | 0.25 | yes | 2 | 0.29 | 96.84 | NWKGANRPV | 96.84 | WRGANRPV | 2.01 | | | | | | |
| NA | N6 | 297 | 0.4 | yes | 3 | 0.29 | 96.7 | WKGANRPVI | 96.7 | KGANRPII | 2.01 | | | | | | |
| NA | N6 | 298 | 0.32 | yes | 4 | 0.29 | 99.71 | KGANRPVIT | 94.69 | GANRPIIT | 2.44 | | | | | RGANRPVIT | 0.57 |
| NA | N6 | 299 | 1.06 | yes | 5 | 0.14 | 99.86 | GANRPVIII | 95.41 | ANRPVIIID | 18.94 | ANRPVIIT | 2.01 | ANRPVIIT | 1.43 | ANRPIITID | 0.57 |
| NA | N6 | 300 | 0.32 | yes | 5 | 0.14 | 99.41 | ANRPVITIN | 76.33 | MTHTSRYLC | 3.01 | ANRPVIIID | 1.87 | | | MTHSKYLC | 0.57 |
| NA | N6 | 312 | 0.5 | yes | 5 | 0.14 | 99.57 | MTHTSKYLC | 93.12 | THSRYLCS | 3.01 | MTHSKYLC | 1.86 | | | THISKYLCS | 0.57 |
| NA | N6 | 313 | 0.52 | yes | 5 | 0.14 | 99.43 | THTSKYLCS | 92.98 | THSRYLCS | 3.01 | THSSKYLC | 1.86 | | | | |
| NA | N6 | 318 | 1.01 | yes | 5 | 0.14 | 99.71 | YLCSKLTD | 77.79 | YLCSRILTD | 17.77 | YLCSRLTD | 2.01 | YLCSRLTD | 1.15 | YLCSKLTDT | 1.15 |
| NA | N6 | 319 | 1.02 | yes | 5 | 0.14 | 99.57 | LCSKILTDT | 77.65 | LCSRILTDT | 17.77 | LCSRLTDT | 2.01 | LCSRLTDT | 1.15 | LCSKLTDT | 1.15 |
| NA | N6 | 320 | 1.04 | yes | 5 | 0.14 | 99.71 | CSKILTDTS | 77.51 | CSRILTDTS | 17.77 | CSRLTDTS | 1.86 | CSRLTDTS | 1.15 | CSKLTDTS | 1.15 |
| NA | N6 | 321 | 1.04 | yes | 5 | 0.14 | 99.57 | SKILTDTSR | 77.51 | SRILTDTSR | 17.77 | SRVLTDTSR | 1.86 | SRVLTDTSR | 1.15 | SKTLTDTSR | 1.15 |
| NA | N6 | 322 | 1.03 | yes | 5 | 0.14 | 99.28 | KILTDTSRP | 77.65 | RILTDTSRP | 17.77 | RVLTDTSRP | 1.86 | RVLTDTSRP | 1.15 | KTLTDTSRP | 1.15 |
| NA | N6 | 324 | 0.32 | yes | 5 | 0 | 99.43 | LTDTSRPND | 95.56 | LTDTSRPSD | 3.15 | LTDTSRPTD | 0.72 | | | | |
| NA | N6 | 325 | 0.31 | yes | 4 | 0 | 99.43 | TDTSRPNDP | 95.56 | TDTSRPSDP | 3.15 | TDTSRPTDP | 0.72 | | | | |
| NA | N6 | 344 | 0.33 | yes | 4 | 0 | 99.43 | GSPDPGVK | 96.14 | GGNPDPGVK | 1.86 | GGTPDPGVK | 0.72 | GGTPDPGVK | 0.72 | | |
| NA | N6 | 345 | 0.31 | yes | 4 | 0 | 99.28 | SPDPGVKG | 96.14 | GNPDPGVKG | 1.86 | GNPDPGVKG | 0.72 | GNPDPGVKG | 0.72 | | |
| NA | N6 | 346 | 0.33 | yes | 4 | 0 | 99.43 | PDPGVKGFA | 95.99 | NPDPGVKGF | 1.86 | NPDPGVKGF | 0.72 | NPDPGVKGF | 0.72 | | |
| NA | N6 | 347 | 0.06 | yes | 1 | 0 | 99.43 | DPGVKGFAF | 99.43 | | | | | | | | |
| NA | N6 | 348 | 0.08 | yes | 1 | 0 | 99.28 | PGVKGFAFL | 99.28 | | | | | | | | |
| NA | N6 | 349 | 0.08 | yes | 1 | 0 | 99.28 | GVKGFAFLN | 99.28 | GVKGFAFLN | 1.43 | GIKGFAFLD | 0.29 | | | | |
| NA | N6 | 350 | 0.21 | yes | 3 | 0 | 97.57 | GVKGFAFLD | 97.57 | GIKGFAFLD | 1.43 | | | | | | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 439 | 0.43 | yes | 4 | 0.14 | 99.14 | VLWTSNSIV | 93.7 | VFWTSNSIV | 4.87 | VLWTSNSIV | 0.29 | VLWTSNSIV | 0.29 | |
| NA | N6 | 440 | 0.41 | yes | 4 | 0.29 | 99.28 | LWTSNSIVA | 93.83 | FWTSNSIVA | 4.88 | LWTSNSIVA | 0.29 | LWTSNSIVA | 0.29 | |
| NA | N6 | 441 | 0.09 | yes | 1 | 0.14 | 99.14 | WTSNSIVAL | 99.14 | | | | | | |
| NA | N6 | 442 | 0.09 | yes | 1 | 0.29 | 99.14 | TSNSIVALC | 99.14 | | | | | | |
| NA | N6 | 443 | 0.09 | yes | 1 | 0.29 | 99.14 | SNSIVALCG | 99.14 | | | | | | |
| NA | N6 | 444 | 0.09 | yes | 1 | 0.29 | 99.14 | NSIVALCGS | 99.14 | | | | | | |
| NA | N6 | 445 | 0.44 | yes | 2 | 0.43 | 99.14 | SIVALCGSK | 92.67 | SIVALCGSR | 6.47 | | | | |
| NA | N6 | 446 | 0.5 | yes | 3 | 0.29 | 99.14 | IVALCGSKE | 91.81 | IVALCGSRE | 6.61 | IVALCGSKK | 0.86 | | |
| NA | N6 | 447 | 0.55 | yes | 3 | 0.29 | 99.28 | VALCGSKER | 90.67 | VALCGSRER | 6.74 | VALCGSKEQ | 1.72 | | |
| NA | N6 | 448 | 0.55 | yes | 3 | 0.14 | 99.14 | ALCGSKERL | 90.67 | ALCGSRERL | 6.74 | ALCGSKEQL | 1.72 | | |
| NA | N6 | 449 | 0.57 | yes | 4 | 0.14 | 99.14 | LCGSKERLG | 90.54 | LCGSRERLG | 6.73 | LCGSKEQLG | 1.72 | LCGSKKRLG | 0.86 |
| NA | N6 | 450 | 0.58 | yes | 4 | 0.14 | 99.86 | CGSKERLGS | 90.4 | CGSRERLGS | 6.73 | CGSKEQLGS | 1.72 | CGSKKRLGS | 0.86 |
| NA | N6 | 451 | 0.6 | yes | 4 | 0.14 | 99.71 | GSKERLGSW | 90.26 | GSRERLGSW | 6.73 | GSKEQLGSW | 1.72 | GSKKRLGSW | 0.86 |
| NA | N6 | 452 | 0.61 | yes | 4 | 0.14 | 99.57 | SKERLGSWS | 90.11 | SRERLGSWS | 6.73 | SKEQLGSWS | 1.72 | SKKRLGSWS | 0.86 |
| NA | N6 | 453 | 0.61 | yes | 4 | 0.14 | 99.43 | KERLGSWSH | 90.11 | RERLGSWSH | 6.85 | KEQLGSWSH | 1.72 | KKRLGSWSW | 0.86 |
| NA | N6 | 454 | 0.26 | yes | 3 | 0.14 | 99.43 | ERLGSWSHD | 96.85 | EQLGSWSHD | 1.72 | | | | |
| NA | N6 | 455 | 0.22 | yes | 2 | 0.43 | 99.14 | RLGSWSHDG | 97.42 | QLGSWSHD | 1.72 | | | | |
| NA | N6 | 456 | 0.08 | yes | 1 | 2.43 | 99.28 | LGSWSHDGA | 99.28 | | | | | | |
| NA | N6 | 457 | 0.08 | yes | 1 | 4.43 | 99.27 | GSWSHDGAE | 99.27 | | | | | | |
| NA | N6 | 458 | 0.08 | yes | 1 | 5.29 | 99.4 | SWSHDGAEI | 99.4 | | | | | | |
| NA | N6 | 459 | 0.44 | yes | 2 | 7.73 | 99.24 | WSHDGAEII | 99.24 | SWHDGAEIT | 6.82 | | | | |
| NA | N6 | 460 | 0.44 | no | 3 | 8.58 | 99.22 | SHDGAEIIY | 92.33 | WHDGAEITY | 6.89 | | | | |
| NA | N6 | 461 | 0.44 | no | 3 | 15.88 | 99.22 | HDGAEIIYF | 92.01 | HDGAEITYF | 7.48 | | | | |
| NA | N6 | 462 | 0.6 | no | 4 | 20.89 | 99.49 | DGAEIIYFK | 89.33 | DGAEITYFK | 7.96 | DGAEIIYFE | 2.35 | | |
| NA | N6 | 463 | 0.44 | no | 3 | 19.11 | 99.64 | MNPNQKLFT | 93.47 | MNPNQKLFA | 4.52 | MNPSQKLFA | 1.01 | MNPSKLFT | 0.5 |
| NA | N7 | 1 | 0.75 | no | 5 | 17.89 | 99.5 | NPNQKLFAL | 87.62 | NPNQKLFAS | 5.94 | NPSQKLFAL | 4.46 | NPSQKLFTL | 0.99 |
| NA | N7 | 2 | 0.75 | no | 4 | 17.48 | 99.01 | PNQKLFALS | 87.68 | PNQKLFASS | 5.91 | PSQKLFTLS | 4.43 | PSQKLFTLSG | 0.99 |
| NA | N7 | 3 | 0.79 | no | 4 | 17.48 | 99.01 | NQKLFALSG | 87.19 | NQKLFASSG | 5.91 | QKLFTLSG | 4.43 | QNLFTLSG | 0.99 |
| NA | N7 | 4 | 0.71 | no | 4 | 17.07 | 99.01 | QKLFALSGV | 88.24 | QKLFASSGI | 5.88 | QKLFTLSGY | 4.41 | QNLFTLSGY | 0.49 |
| NA | N7 | 5 | 0.64 | no | 3 | 7.72 | 99.02 | KLFALSGVA | 89.43 | KLFASSGIA | 5.29 | KLFTLSGVA | 4.41 | | |
| NA | N7 | 6 | 0.72 | no | 3 | 6.1 | 99.12 | LFALSGVA | 88.31 | LFASSGIA | 5.19 | LFTLSGVAI | 4.76 | LFALSGVAV | 0.87 |
| NA | N7 | 7 | 1.05 | yes | 5 | 0.41 | 99.13 | LNLLIGISN | 80.41 | LNLLIGISN | 11.02 | INLLIGISN | 4.9 | MNLLIGISN | 1.63 |
| NA | N7 | 20 | 0.9 | yes | 4 | 0.41 | 99.18 | NLLIGISNV | 82.45 | NLLIGISNM | 11.02 | NLLIGISNM | 4.9 | NLLIGISNV | 1.22 |
| NA | N7 | 21 | 0.97 | yes | 5 | 0.41 | 99.59 | LLIGISNVG | 81.63 | LLIGISNMS | 11.02 | LLIGISNMS | 4.9 | LLIGISNVV | 1.22 | LLIGISNVY | 0.82 |
| NA | N7 | 22 | 0.97 | yes | 5 | 0.41 | 99.59 | LIGISNVGL | 81.63 | LIGISNMSL | 11.02 | LIGISNVGL | 4.9 | LIGYSNVGL | 1.22 | LIGISNVYL | 0.82 |
| NA | N7 | 23 | 0.52 | yes | 4 | 0.41 | 99.18 | IGISNVGLN | 92.24 | IGVSNVGLN | 4.9 | IGISNVGLN | 1.22 | IGISNWY | 0.41 |
| NA | N7 | 24 | 0.5 | yes | 5 | 0 | 92.68 | SNVGLNYSL | 92.68 | SNMSLNISL | 4.88 | SNVLNVSL | 0.81 | SNVGLNVSL | 0.41 | SNVGLNMSL | 0.41 |
| NA | N7 | 27 | 0.5 | yes | 5 | 0 | 99.19 | NVGLNYSLH | 92.68 | NMSLNISLY | 4.88 | NVLNVSLH | 0.81 | NVGLNVSLH | 0.41 | NIGLNVSLH | 0.41 |
| NA | N7 | 28 | 0.5 | yes | 5 | 0 | 99.19 | VGLNYSLHL | 92.68 | MSLNISLYS | 4.88 | VLNVSLHL | 0.81 | VGLNVSLHL | 0.41 | IGLNVSLHL | 0.41 |
| NA | N7 | 29 | 0.53 | yes | 5 | 0 | 99.19 | GLNYSLHLK | 92.28 | SLNISLYSK | 4.88 | LNVSLHLR | 0.81 | GLNVSLHLK | 0.81 | GLKVSLHLK | 0.41 |

FIG. 73-38

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 62 | 0.26 | yes | 4 | 6.1 | 99.13 | ENTY

| Protein | Sub-type | Start Pos | Block Entropy | Gaps < 10% | # to cover 99% | Gap % | Coverage | Included peptides | Freq | Included peptides | Freq | Included peptides | Freq | Included peptides | Freq | Included peptides | Freq |
|---|---|---|---|---|---|---|---|---|---|---|---|---|---|---|---|---|---|
| NA | N7 | 203 | 1.26 | yes | 4 | 0 | 99.19 | ATVYYDRRL | 70.33 | ATVYYNRRL | 20.73 | ATVYYNRRL | 20.73 | ATVYYNGRL | 5.28 | | |
| NA | N7 | 204 | 1.26 | yes | 4 | 0 | 99.19 | TVYYDRRLT | 70.33 | TVYYNRRLT | 20.73 | TVYYNKRLT | 20.73 | TVYYNGRLT | 5.28 | | |
| NA | N7 | 205 | 1.26 | y

FIG. 73-41

| Protein | Sub-type | Start Pos | Block Entropy | Gaps <10% | # to cover 99% | Gap % | Coverage | Included Peptides | Included Peptides | Freq | Included Peptides | Freq | Included Peptides | Freq | Included Peptides | Freq |
|---|---|---|---|---|---|---|---|---|---|---|---|---|---|---|---|---|
| NA | N7 | 287 | 0.57 | yes | 4 | 0 | 99.19 | YTCVCRDNW | ATCVCRDNW | 91.46 | ITCVCRDNW | 3.66 | VSCVCRDNW | 3.25 | | 0.81 |
| NA | N7 | 288 | 0.18 | yes | 3 | 0 | 99.19 | TCVCRDNWQ | SCVCRDNWQ | 97.97 | TCICRDNWQ | 0.81 | | 0.41 | | |
| NA | N7 | 289 | 0.11 | yes | 2 | 0 | 99.19 | CVCRDNWQG | CICRDNWQG | 98.78 | CICRDNWQG | 0.41 | | | | |
| NA | N7 | 290 | 0.11 | yes | 2 | 0 | 99.19 | VCRDNWQGA | GCRDNWQGA | 98.78 | | 0.41 | | | | |
| NA | N7 | 291 | 0.04 | yes | 1 | 0 | 99.59 | CRDNWQGAN | | 99.59 | | | | | | |
| NA | N7 | 292 | 0.04 | yes | 1 | 0 | 99.59 | RDNWQGANR | | 99.59 | | | | | | |
| NA | N7 | 293 | 0.04 | yes | 1 | 0 | 99.59 | DNWQGANRP | | 99.59 | | | | | | |
| NA | N7 | 294 | 0.91 | yes | 2 | 0 | 99.19 | NWQGANRPV | NWQGANRPI | 72.36 | | 26.83 | | | | |
| NA | N7 | 295 | 1.12 | yes | 3 | 0 | 99.19 | WQGANRPVI | WQGANRPII | 72.36 | | 26.83 | | | | |
| NA | N7 | 296 | 1.08 | yes | 3 | 0 | 99.19 | QGANRPVIE | QGANRPIIE | 68.7 | QGANRPVIK | 26.83 | | | | |
| NA | N7 | 297 | 1.25 | yes | 4 | 0 | 99.19 | GANRPVIEI | GANRPIIEI | 69.11 | GANRPVIKI | 26.83 | | | | |
| NA | N7 | 298 | 1.25 | yes | 4 | 0 | 99.19 | ANRPVIEID | ANRPIIEID | 67.07 | ANRPVIKID | 26.42 | ANRPVIEIN | 3.66 | | |
| NA | N7 | 299 | 1.19 | yes | 4 | 0 | 99.19 | NRPVIEIDM | NRPIIEIDM | 67.07 | NRPVIKIDM | 26.42 | NRPVIEINM | 3.66 | | |
| NA | N7 | 312 | 0.77 | yes | 2 | 0 | 99.59 | HTSQYLCTG | HTSRYICTG | 70.73 | HTSRYICTG | 21.95 | HTSRYMCTG | 3.66 | | |
| NA | N7 | 318 | 0.81 | yes | 2 | 0 | 100 | CTGILDTS | CTGILDTS | 77.24 | | 22.76 | | 5.69 | | |
| NA | N7 | 319 | 0.81 | yes | 2 | 0 | 99.59 | TGVLIDTS | TGILDTS | 76.83 | | 22.76 | | | | |
| NA | N7 | 320 | 1.29 | yes | 4 | 0 | 99.59 | GVLIDTSR | GILDTSR | 76.83 | | 22.76 | | | | |
| NA | N7 | 321 | 1.13 | yes | 3 | 0 | 99.19 | VLIDTSRP | ILIDTSRP | 69.51 | VLIDTSRPK | 21.95 | VLIDTSRPG | 4.88 | ILIDTSRPS | 0.81 |
| NA | N7 | 322 | 1.23 | yes | 3 | 0 | 99.19 | LIDTSRPS | LIDTSRPG | 70.33 | LIDTSRPKD | 23.98 | | 4.88 | | |
| NA | N7 | 323 | 1.12 | yes | 3 | 0 | 99.19 | IDTSRPSD | TDTSRPGD | 69.92 | TDTSRPKDK | 22.76 | TDTSRPGDR | 4.88 | TDTSKPSDK | 0.41 |
| NA | N7 | 334 | 1.12 | yes | 4 | 0 | 99.19 | TDTSRPDK | GDCSNPITG | 69.11 | GECFNPITG | 25.61 | | 4.88 | | |
| NA | N7 | 335 | 1.12 | yes | 4 | 0 | 99.19 | GDCNPITG | DCSNPITG | 69.11 | ECFNPITG | 25.61 | | 4.88 | | |
| NA | N7 | 336 | 1.27 | yes | 4 | 0 | 99.19 | DCNNPITGS | CSNPITGS | 68.7 | CFNPITGSP | 25.61 | | 4.88 | SNPITGSPC | 0.41 |
| NA | N7 | 337 | 1.12 | yes | 3 | 0 | 99.59 | CNNPITGSP | SNPITGSPG | 70.73 | FNPITGSPG | 23.58 | SNPITGSPS | 4.88 | SNPITGSPC | 0.41 |
| NA | N7 | 338 | 0.3 | yes | 5 | 0 | 99.59 | NNPITGSPG | NPITGSPA | 96.34 | NPITGSPGV | 1.63 | NPITGSPEA | 4.88 | | |
| NA | N7 | 339 | 0.3 | yes | 5 | 0 | 99.59 | NPITGSPGA | PITGSPGA | 96.34 | PITGSPGVP | 1.63 | PITGSPEAP | 4.88 | | |
| NA | N7 | 340 | 0.3 | yes | 3 | 0 | 99.59 | PITGSPGAP | ITGSPGAPG | 93.9 | ITGSPGVPG | 1.63 | ITGSPEAPG | 4.88 | | |
| NA | N7 | 346 | 0.41 | yes | 2 | 0 | 99.19 | ITGSPGAPG | APGIKGFGF | 95.12 | VPGVKGFGF | 4.47 | | 0.81 | | |
| NA | N7 | 347 | 0.3 | yes | 4 | 0 | 99.59 | APGYKGFGF | PGIKGFGFL | 70.73 | GVKGFGFLN | 23.98 | | 4.47 | | |
| NA | N7 | 348 | 1.11 | yes | 3 | 0 | 99.19 | PGVKGFGFL | GVKGFGFLD | 47.97 | GIKGFGFLN | 34.96 | | 13.82 | DNTWLGGTI | 0.41 |
| NA | N7 | 358 | 1.64 | yes | 5 | 0 | 99.59 | GVKGFGFLD | DNTWLGRTI | 98.78 | SNTWLGRTI | 0.41 | NNTWLGRTI | 2.03 | | |
| NA | N7 | 359 | 0.11 | yes | 2 | 0 | 99.19 | GNTWLGFLD | STWLGRTIS | 98.78 | | 0.41 | | | | |
| NA | N7 | 360 | 0.11 | yes | 2 | 0 | 99.19 | NTWLGRTIS | TWLGRTISP | 95.93 | TWLGRTFSP | 2.44 | WLGRTFSPR | 0.41 | LGGTISPRS | 0.41 |
| NA | N7 | 361 | 0.32 | yes | 5 | 0 | 99.19 | TWLGRTISP | WLGRTISPR | 93.5 | WLGRTISPK | 2.44 | WLGRTISPR | 2.44 | LGGTISPHS | 0.41 |
| NA | N7 | 362 | 0.48 | yes | 5 | 0 | 99.19 | WLGRTISPR | LGRTISPRS | 93.5 | LGRTISPKL | 2.44 | LGRTISPHS | 2.44 | GRTISPHSR | 0.41 |
| NA | N7 | 363 | 0.48 | yes | 5 | 0 | 99.19 | LGRTISPRS | GRTISPRSG | 93.5 | GRTISPKLR | 2.44 | GRTISRSGF | 2.44 | TISPHSRSG | 0.41 |
| NA | N7 | 364 | 0.48 | yes | 5 | 0 | 99.19 | GRTISPRSG | TISPRSGF | 93.5 | TISPKLRSG | 2.44 | TISPRSRNG | 2.44 | FSPRSRSGF | 0.41 |
| NA | N7 | 365 | 0.48 | yes | 4 | 0 | 99.19 | TISPRSRSG | ISPRLRSG | 93.5 | ISPKLRSGF | 2.44 | ISTRSRSGF | 2.44 | | |
| NA | N7 | 366 | 0.44 | yes | 5 | 0 | 99.19 | ISPRSRSGF | SPRSRSGFE | 93.9 | SPKLRSGFE | 2.44 | STRSRSGFE | 2.44 | | |
| NA | N7 | 367 | 0.48 | yes | 5 | 0 | 99.19 | SPRSRSGFE | PRLRSGFEM | 93.5 | PKLRSGFEM | 2.44 | PRSRNGFEM | 2.44 | TRSRSGFEM | 0.41 |
| NA | N7 | 368 | 0.48 | yes | 5 | 0 | 99.19 | PRSRSGFEM | RLRSGFEML | 93.9 | KLRSGFEML | 2.44 | RSRSGFEVL | 2.44 | | |
| NA | N7 | 369 | 0.44 | yes | 4 | 0 | 99.19 | RSRSGFEML | | | | | | | | |

FIG. 73-42

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 370 | 0.39 | yes | 3 | 0 | 99.19 | SRSGFEMLK | 93.9 | SRSGFEMLK | 4.88 | | | | |
| NA | N7 | 371 | 0.28 | yes | 3 | 0 | 99.19 | RSGFEMLKI | 96.34 | RSGFEVLKV | 2.44 | | | | |
| NA | N7 | 372 | 0.32 | yes | 4 | 0 | 99.19 | SGFEMLKIP | 95.93 | SGFEVLKYP | 2.44 | | | | |
| NA | N7 | 373 | 0.28 | yes | 3 | 0 | 99.19 | GFEMLKIPN | 96.34 | GFEMLKIHN | 2.44 | | | | |
| NA | N7 | 374 | 0.28 | yes | 3 | 0 | 99.19 | FEMLKIPNA | 96.34 | FEMLRIPNA | 2.44 | | | | |
| NA | N7 | 375 | 0.68 | yes | 5 | 0 | 99.19 | EMLKIPNAG | 89.02 | EMLKVPNAE | 7.32 | SGFEMLRIP | 0.41 | | |
| NA | N7 | 377 | 0.83 | yes | 5 | 0 | 99.19 | LKIPNAGTD | 86.59 | LKIPNAETD | 7.32 | EMLKVPNAG | 1.22 | EMLRIPNAG | 0.41 |
| NA | N7 | 378 | 0.83 | yes | 5 | 0 | 99.19 | KIPNAGTDP | 86.59 | KIPNAGIDP | 7.32 | LKVPNAEKD | 2.44 | LKVPNAGTD | 1.22 |
| NA | N7 | 401 | 0.15 | yes | 3 | 0 | 99.19 | NWSGYSGSF | 98.37 | NRSGYSGSF | 0.41 | KVPNAEKDP | 2.44 | KVPNAGTDP | 1.63 |
| NA | N7 | 402 | 0.08 | yes | 1 | 0 | 99.19 | WSGYSGSF | 99.19 | | | | | | |
| NA | N7 | 403 | 0 | yes | 1 | 0 | 100 | SGYSGSFID | 100 | | | | | | |
| NA | N7 | 404 | 0 | yes | 1 | 0 | 100 | GYSGSFIDY | 100 | | | | | | |
| NA | N7 | 405 | 0 | yes | 1 | 0 | 100 | YSGSFIDYW | 100 | | | | | | |
| NA | N7 | 406 | 0.78 | yes | 2 | 0 | 100 | SGSFIDYWD | 76.83 | SGSFIDYWN | 23.17 | | | | |
| NA | N7 | 407 | 1.08 | yes | 3 | 0 | 100 | GSFIDYWDE | 71.54 | GSFIDYWND | 23.17 | GSFIDYWDD | 4.88 | | |
| NA | N7 | 417 | 0.92 | yes | 5 | 0 | 99.59 | SECYNPCFY | 82.11 | NECYNPCFY | 12.2 | SVCYNPCFY | 3.66 | SKCYNPCFY | 0.81 |
| NA | N7 | 418 | 0.38 | yes | 3 | 0 | 99.19 | ECYNPCFYV | 94.31 | VCYNPCFYV | 4.07 | ACYNPCFYV | 0.81 | SACYNPCFY | 0.81 |
| NA | N7 | 419 | 0 | yes | 1 | 0 | 100 | CYNPCFYVE | 100 | | | | | | |
| NA | N7 | 420 | 0 | yes | 1 | 0 | 100 | YNPCFYVEL | 100 | | | | | | |
| NA | N7 | 421 | 0 | yes | 1 | 0 | 100 | NPCFYVELI | 100 | | | | | | |
| NA | N7 | 422 | 0 | yes | 1 | 0 | 100 | PCFYVELIR | 100 | | | | | | |
| NA | N7 | 423 | 0 | yes | 1 | 0 | 100 | CFYVELIRG | 100 | | | | | | |
| NA | N7 | 424 | 0 | yes | 1 | 0 | 100 | FYVELIRGR | 100 | | | | | | |
| NA | N7 | 425 | 0 | yes | 1 | 0 | 100 | YVELIRGRP | 100 | | | | | | |
| NA | N7 | 426 | 0 | yes | 1 | 0 | 100 | VELIRGRPE | 100 | | | | | | |
| NA | N7 | 427 | 0 | yes | 1 | 0 | 100 | ELIRGRPEE | 100 | | | | | | |
| NA | N7 | 428 | 0.07 | yes | 2 | 0 | 99.19 | LIRGRPEEA | 99.19 | RPEEVKYYW | 0.81 | | | | |
| NA | N7 | 429 | 0.07 | yes | 2 | 0 | 99.19 | IRGRPEEAK | 99.19 | GRPEEVKYV | 0.81 | RPEEVKYYW | 0.81 | EEVKYVWWT | 0.81 |
| NA | N7 | 430 | 0.11 | yes | 3 | 0 | 99.59 | RGRPEEAKY | 98.78 | RPEEVKYVW | 4.88 | PEEVKYVWW | 1.22 | EVKYVWWTS | 0.81 |
| NA | N7 | 431 | 0.11 | yes | 3 | 0 | 99.59 | GRPEEAKYV | 98.78 | PEEAKYVEW | 4.88 | EEAKYVWWA | 1.22 | VKYVWWTSN | 0.81 |
| NA | N7 | 432 | 0.39 | yes | 3 | 0 | 93.9 | RPEEAKYVW | 93.9 | EEAKYVEWT | 4.88 | EAKYVWWAS | 1.22 | | |
| NA | N7 | 433 | 0.39 | yes | 3 | 0 | 93.9 | PEEAKYVWW | 93.9 | EAKYVEWTS | 4.88 | AKYVWWASN | 1.22 | | |
| NA | N7 | 434 | 0.48 | yes | 4 | 0 | 99.59 | EEAKYVWWT | 92.68 | AKYVEWTSN | 4.88 | KYVWWASNL | 1.22 | | |
| NA | N7 | 435 | 0.48 | yes | 4 | 0 | 99.59 | EAKYVWWTS | 92.68 | KYVEWTSNL | 4.88 | YVWWASNLI | 1.22 | | |
| NA | N7 | 436 | 0.48 | yes | 4 | 0 | 99.59 | AKYVWWTSN | 92.68 | YVEWTSNLI | 4.88 | VWWASNSLI | 4.88 | | |
| NA | N7 | 437 | 0.41 | yes | 3 | 0 | 99.59 | KYVWWTSNS | 93.5 | VEWTSNSLI | 22.76 | WWASNSLIA | 4.88 | | |
| NA | N7 | 438 | 0.41 | yes | 3 | 0 | 99.59 | YVWWTSNSL | 93.5 | EWTSNSLIA | 22.76 | VWWASNSLI | 1.22 | | |
| NA | N7 | 439 | 1.13 | yes | 4 | 0 | 71.14 | VWWTSNSLV | 71.14 | VWWTSNSLI | 22.76 | WWASNSLIA | 4.88 | | |
| NA | N7 | 440 | 1.13 | yes | 4 | 0 | 71.14 | WWTSNSLVA | 71.14 | WWTSNSLIA | 22.76 | | | | |
| NA | N7 | 441 | 0.94 | yes | 3 | 0.41 | 71.02 | WTSNSLVAL | 71.02 | WTSNSLIAL | 27.76 | WASNSLIAL | 1.22 | | |
| NA | N7 | 442 | 0.94 | yes | 3 | 0.41 | 71.02 | TSNSLVALC | 71.02 | TSNSLIALC | 27.76 | ASNSLIALC | 1.22 | | |

FIG. 73-43

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 443 | 0.87 | yes | 2 | 0.41 | 100 | SNSLVALCG | 71.02 | | | | | | |
| NA | N7 | 444 | 0.87 | yes | 2 | 0.41 | 100 | NSLVALCGS | 71.02 | | | | | | |
| NA | N7 | 445 | 0.87 | yes | 2 | 0.41 | 100 | SLVALCGSP | 71.02 | | | | | | |
| NA | N7 | 446 | 1.89 | yes | 4 | 0.41 | 99.18 | LVALCGSPI | 35.92 | SNSLIALCG | 28.98 | LIALCGSPI | 5.31 | LIALCGSPV | 0.82 |
| NA | N7 | 455 | 1.13 | yes | 3 | 2.03 | 99.17 | SVGGSFPD | 63.07 | NSLIALCGS | 28.98 | PIGSGFPD | 0.41 | | |
| NA | N7 | 456 | 0.21 | yes | 3 | 2.03 | 99.17 | VGSGSFPDG | 97.47 | SLIALCGSP | 28.98 | | | | |
| NA | N7 | 457 | 0.22 | yes | 5 | 3.66 | 99.14 | GSGSFPDGA | 97.47 | LIALCGSPF | 34.69 | | | | |
| NA | N7 | 458 | 0.3 | yes | 4 | 5.28 | 99.12 | SGSFPDGAQ | 96.57 | PVGPGSFPD | 34.44 | | | | |
| NA | N7 | 459 | 0.2 | yes | 5 | 7.32 | 99.12 | GSFPNGAQI | 97.81 | VGSGSFPNG | 34.69 | | | | |
| NA | N7 | 460 | 0.5 | yes | 5 | 7.72 | 99.11 | SFPDGAQIK | 92.51 | GSGSFPNGA | 34.44 | SGSLPDGAQ | 0.43 | SGSFPDGAK | 0.43 |
| NA | N7 | 461 | 0.5 | yes | 4 | 8.54 | 99.12 | FPDGAQIKY | 92.44 | PGSFPDGAQ | 1.24 | GSFPDGAKI | 0.44 | FFPDGPQIQ | 0.44 |
| NA | N7 | 462 | 0.48 | yes | 4 | 12.6 | 99.07 | PDGAQIKYF | 92.56 | SGFFPDGPQ | 1.27 | SFPDGAKIQ | 0.44 | FPDGPQIQY | 0.44 |
| NA | N7 | 463 | 0.5 | no | 5 | 16.67 | 99.07 | DGAQIKYFS | 92.2 | GFFPDGPQI | 1.29 | LPDGAQIQY | 0.44 | | |
| NA | N8 | 52 | 1.21 | no | 4 | 0.22 | 99.13 | EYNETVRIE | 49.51 | SLPDGAQIQ | 0.44 | PDGPQIQYF | 0.47 | | |
| NA | N8 | 169 | 1.01 | yes | 1 | 0.11 | 99.02 | QGFAPFSKD | 75.76 | FPDGAQIQY | 5.29 | DGAKIQYFS | 0.47 | | |
| NA | N8 | 170 | 0.09 | yes | 1 | 0.11 | 99.13 | KGFAPFSKD | 21.2 | PDGAQIQYF | 5.33 | EYNETYKVE | 0.49 | EYNETVRTE | 0.22 |
| NA | N8 | 171 | 0.09 | yes | 1 | 0.11 | 99.13 | GFAPFSKDN | | DGAQIQYFS | 5.58 | EYNETVRIE | 0.54 | | |
| NA | N8 | 172 | 0.09 | yes | 1 | 0.11 | 99.13 | FAPFSKDNG | | EYNETVRIE | 5.85 | EGFAPFSKD | 0.98 | | |
| NA | N8 | 173 | 0.09 | yes | 1 | 0.11 | 99.13 | APFSKDNGI | | RGFAPFSKD | 47.99 | | | | |
| NA | N8 | 174 | 0.07 | yes | 1 | 0.11 | 99.13 | PFSKDNGIR | | | | | | | |
| NA | N8 | 175 | 0.06 | yes | 1 | 0.11 | 99.13 | FSKDNGIRI | | | | | | | |
| NA | N8 | 176 | 0.07 | yes | 2 | 0.11 | 99.35 | SKDNGIRIG | | | | | | | |
| NA | N8 | 177 | 0.11 | yes | 3 | 0.11 | 99.46 | KDNGIRIGS | | | | | | | |
| NA | N8 | 178 | 0.11 | yes | 3 | 0.11 | 98.8 | DNGIRIGSR | 98.8 | DNGIRIGSK | 0.87 | | | | |
| NA | N8 | 179 | 0.11 | yes | 3 | 0.11 | 98.8 | NGIRIGSRG | 98.8 | NGIRIGSKG | 0.87 | | | | |
| NA | N8 | 180 | 0.38 | yes | 3 | 0.11 | 98.8 | GIRIGSRGH | 98.8 | GIRIGSKGH | 0.87 | | | | |
| NA | N8 | 181 | 0.38 | yes | 2 | 0.11 | 99.67 | IRIGSRGHI | 94.13 | IRIGSRGHV | 4.67 | IRIGSKGHV | 0.87 | | |
| NA | N8 | 182 | 0.42 | yes | 3 | 0.11 | 99.67 | RIGSRGHIF | 94.13 | RIGSRGHVF | 4.67 | RIGSKGHVF | 0.87 | | |
| NA | N8 | 183 | 0.44 | yes | 3 | 0.11 | 99.24 | IGSRGHVFI | 93.7 | IGSRGHVFV | 4.67 | IGSKGHVFV | 0.87 | | |
| NA | N8 | 184 | 0.44 | yes | 3 | 0.11 | 99.13 | GSRGHVFI | 93.59 | GSRGHYFVI | 4.67 | GSKGHYFVI | 0.87 | | |
| NA | N8 | 185 | 0.44 | yes | 3 | 0.11 | 99.13 | SRGHYFVIR | 93.59 | SRGHYFYIR | 4.67 | SKGHYFYIR | 0.87 | | |
| NA | N8 | 186 | 0.38 | yes | 3 | 0.11 | 99.13 | RGHWFVIRE | 93.59 | RGHIFVIRE | 4.35 | KGHVFVIRE | 0.87 | | |
| NA | N8 | 187 | 0.41 | yes | 2 | 0.11 | 99.02 | GHVFVIREP | 94.02 | GHIFVIREP | 4.67 | | | | |
| NA | N8 | 188 | 0.15 | yes | 3 | 0.11 | 99.02 | HVFVIREPF | 98.59 | HIFVIREPF | 0.33 | VFIIREPFV | 0.33 | | |
| NA | N8 | 189 | 0.13 | yes | 1 | 0.11 | 99.13 | VFVIREPFV | 98.8 | IFVIREPFV | 0.33 | FVIREPFIS | 0.22 | | |
| NA | N8 | 190 | 0.07 | yes | 3 | 0.11 | 99.35 | FVIREPFVS | 99.35 | | | | | | |
| NA | N8 | 191 | 0.08 | yes | 4 | 0.11 | 99.24 | VIREPFVSC | 99.24 | | | | | | |
| NA | N8 | 192 | 0.25 | yes | 2 | 0.11 | 97.39 | REPFVSCSP | 97.39 | ECRTFFLTQ | 0.87 | GCRTFFLTQ | 0.54 | DCRTFFLTQ | 0.33 |
| NA | N8 | 202 | 0.14 | yes | 2 | 0.33 | 98.58 | ECRTFFLTQ | 98.58 | CRTFFLTHG | 0.54 | | | | |
| NA | N8 | 203 | 0.14 | yes | 2 | 0.33 | 99.13 | CRTFFLTQG | 98.58 | RTFFLTHGS | 0.54 | | | | |
| NA | N8 | 204 | 0.14 | yes | 2 | 0.33 | 99.13 | RTFFLTQGS | 98.58 | | | | | | |

FIG. 73-44

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 205 | 0.12 | yes | 2 | 0.33 | 99.35 | TFFLTQGSL | 98.8 | TFFLTHGSL | 0.54 | | | | |
| NA | N8 | 206 | 0.15 | yes | 3 | 0.33 | 99.02 | FFLTQGSLL | 98.47 | FFLTHGSLL | 0.54 | | | | |
| NA | N8 | 207 | 0.17 | yes | 3 | 0.33 | 99.13 | FLTQGSLLN | 98.37 | FLTHGSLLN | 0.54 | | | | |
| NA | N8 | 208 | 0.17 | yes | 3 | 0.33 | 99.13 | LTQGSLLND | 98.37 | LTHGSLLND | 0.54 | | | | |
| NA | N8 | 209 | 0.2 | yes | 3 | 0.33 | 99.13 | TQGSLLNDK | 97.93 | THGSLLNDK | 0.65 | | | | |
| NA | N8 | 210 | 0.2 | yes | 3 | 0.33 | 99.13 | QGSLLNDKH | 97.93 | HGSLLNDKH | 0.65 | | | | |
| NA | N8 | 211 | 0.17 | yes | 3 | 0.11 | 99.13 | GSLLNDKHS | 98.26 | GSLLNDRH | 0.65 | | | | |
| NA | N8 | 212 | 0.2 | yes | 3 | 0.11 | 99.02 | SLLNDKHSN | 98.04 | SLLNDRHS | 0.65 | SLPNDKHSN | 0.22 | | |
| NA | N8 | 213 | 0.21 | yes | 4 | 0.11 | 99.13 | LLNDKHSNG | 97.93 | LLNDRHSNG | 0.65 | LLNDKHSSG | 0.22 | | |
| NA | N8 | 214 | 0.2 | yes | 3 | 0.11 | 98.04 | LNDKHSNGT | 98.04 | LNDRHSNGT | 0.65 | LNDKHFNGT | 0.22 | | |
| NA | N8 | 215 | 0.59 | yes | 4 | 0.22 | 99.13 | NDKHSNGTV | 90 | PNDKHSNGT | 0.65 | NDKHFNGTM | 0.43 | | |
| NA | N8 | 216 | 0.59 | yes | 4 | 0.22 | 99.13 | DKHSNGTVK | 89.99 | NDRHSNGTV | 8.16 | DKHSNGTMK | 0.54 | | |
| NA | N8 | 217 | 0.59 | yes | 4 | 0.22 | 99.13 | KHSNGTVKD | 89.99 | DRHSNGTV | 8.16 | KHSNGTMKD | 0.54 | | |
| NA | N8 | 218 | 0.56 | yes | 3 | 0.22 | 99.13 | HSNGTVKDR | 90.32 | RHSNGTVK | 8.27 | | | | |
| NA | N8 | 219 | 0.59 | yes | 4 | 0.22 | 99.02 | SNGTVKDRS | 89.99 | SNGTMKDRS | 8.27 | SSGTVKDRS | 0.44 | | |
| NA | N8 | 220 | 0.57 | yes | 3 | 0.22 | 99.13 | NGTVKDRSP | 90.21 | NGTMKDRSP | 8.38 | | | | |
| NA | N8 | 221 | 1.02 | yes | 4 | 0.22 | 99.24 | GTVKDRSPF | 79.54 | GTIKDRSPF | 10.99 | GTMKDRSPY | 0.44 | | |
| NA | N8 | 222 | 1.02 | yes | 4 | 0.22 | 99.24 | TVKDRSPFR | 79.65 | TIKDRSPY | 10.88 | TMKDRSPYR | 0.44 | | |
| NA | N8 | 223 | 1.02 | yes | 4 | 0.22 | 99.24 | VKDRSPFRT | 79.65 | IKDRSPYRT | 10.88 | MKDRSPYRT | 0.44 | | |
| NA | N8 | 224 | 0.59 | yes | 2 | 0.11 | 99.13 | KDRSPYRTL | 88.25 | DRSPFRTLM | 10.88 | | | | |
| NA | N8 | 225 | 0.58 | yes | 2 | 0.22 | 99.13 | DRSPYRTLM | 88.26 | RSPFRTLMS | 10.98 | | | | |
| NA | N8 | 226 | 0.55 | yes | 2 | 0.11 | 99.35 | RSPYRTLMS | 88.37 | SPFRTLMSV | 11.09 | | | | |
| NA | N8 | 227 | 1.3 | yes | 5 | 0.11 | 99.57 | SPYRTLMSV | 88.48 | PFRTLMSYE | 19.89 | PFRTLMSYK | 0.76 | PRTLMSYK | 0.33 |
| NA | N8 | 228 | 1.45 | yes | 4 | 0 | 99.02 | PYRTLMSVE | 68.04 | PRTLMSVEVG | 17.07 | RTLMSVKVG | 12.17 | RTLMSVKG | 3.26 |
| NA | N8 | 230 | 1.47 | yes | 4 | 0 | 99.02 | RTLMSVEIG | 66.52 | TLMSVEVGO | 17.07 | TLMSVKVGO | 12.17 | TLMSVGIGO | 3.26 |
| NA | N8 | 231 | 0.76 | yes | 3 | 0 | 99.13 | TLMSVEIGQ | 66.3 | LMSVKIGQ | 15.33 | IGLSPNYYQ | 0.22 | TLMSVGIGQ | 0.33 |
| NA | N8 | 237 | 0.21 | yes | 2 | 0.22 | 99.02 | IGQSPNYYQ | 83.37 | VGQSPNYYQ | 0.98 | LSPNYYQAR | 0.33 | | |
| NA | N8 | 238 | 0.54 | yes | 2 | 0.11 | 99.02 | GQSPNYYQS | 97.72 | GQSPNYYQA | 0.33 | | | | |
| NA | N8 | 239 | 0.51 | yes | 2 | 0.11 | 99.02 | QSPNYYQSR | 91.75 | OSPNYYQAK | 5.97 | | | | |
| NA | N8 | 240 | 0.48 | yes | 2 | 0.11 | 99.02 | SPNYYQSRF | 92.07 | SPNYYQAKF | 5.97 | | | | |
| NA | N8 | 241 | 1.05 | yes | 5 | 0.22 | 99.46 | PNYYQSRFE | 92.28 | PNYYQAKFE | 6.09 | NYYQSRFEA | 0.98 | NYYQAKFEA | 0.54 |
| NA | N8 | 242 | 1.07 | yes | 5 | 0.22 | 99.24 | NYYQARFES | 78.45 | NYYQARFEV | 13.82 | NYYQSRFEA | 0.98 | VYQAKFEAV | 0.54 |
| NA | N8 | 243 | 1.06 | yes | 5 | 0.22 | 99.35 | YYQARFESV | 78.56 | YYQARFEVA | 13.82 | VYQSRFEAV | 0.98 | YQAKFEAVA | 0.54 |
| NA | N8 | 244 | 1.06 | yes | 5 | 0.22 | 99.35 | YQARFESVA | 78.56 | YQARFEVAW | 13.82 | YQSRFEAVA | 0.98 | QAKFEAVAW | 0.54 |
| NA | N8 | 245 | 1.06 | yes | 5 | 0.22 | 99.35 | QARFESVAW | 78.56 | QARFEAVAW | 13.82 | QSRFEAVAW | 0.98 | AKFEAVAWS | 0.54 |
| NA | N8 | 246 | 0.98 | yes | 4 | 0.22 | 99.35 | ARFESVAWS | 78.56 | ARFEAVAWS | 13.82 | RFEAVAWSA | 0.98 | | |
| NA | N8 | 247 | 0.79 | yes | 2 | 0.11 | 99.13 | RFESVAWSA | 79.98 | REAVAWSA | 13.82 | | | | |
| NA | N8 | 248 | 0.8 | yes | 2 | 0.22 | 99.02 | FESVAWSAT | 79.87 | FEAVAWSAT | 13.82 | | | | |
| NA | N8 | 249 | 0.8 | yes | 2 | 0.22 | 99.02 | ESVAWSATA | 79.87 | EAVAWSATA | 13.82 | | | | |
| NA | N8 | 250 | 0.8 | yes | 2 | 0.22 | 99.02 | SVAWSATAC | 79.87 | AVAWSATAC | 13.82 | | | | |
| NA | N8 | 251 | 0.09 | yes | 1 | 0.11 | 99.13 | VAWSATACH | 99.13 | | | | | | |

FIG. 73-45

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | N8 | 252 | 0.06 | yes | 1 | 0.11 | 99.46 | AWSATACHD | 99.46 | | | | | | |
| NA | N8 | 253 | 0.06 | yes | 1 | 0.11 | 99.46 | WSATACHDG | 99.46 | | | | | | |
| NA | N8 | 254 | 0.15 | yes | 2 | 0.11 | 99.24 | SATACHDGK | 98.48 | SATACHDGR | 0.76 | | | | |
| NA | N8 | 255 | 0.16 | yes | 2 | 0.11 | 99.13 | ATACHDGKK | 98.37 | ATACHDGRK | 0.76 | | | | |
| NA | N8 | 256 | 0.16 | yes | 2 | 0.11 | 99.13 | TACHDGKKW | 98.37 | TACHDGRKW | 0.76 | | | | |
| NA | N8 | 257 | 0.18 | yes | 3 | 0.11 | 99.13 | ACHDGKKWM | 98.15 | ACHDGRKWM | 0.76 | | | | |
| NA | N8 | 258 | 0.22 | yes | 3 | 0.22 | 99.02 | CHDGKKWMT | 97.72 | CHDGRKWMT | 0.76 | CHDGNKWMT | 0.22 | | |
| NA | N8 | 292 | 0.44 | yes | 5 | 0.22 | 99.02 | SWAGDILRT | 94.56 | SWAGNILRT | 2.5 | SWEGDILRT | 0.98 | SWAGDIMRT | 0.87 |
| NA | N8 | 295 | 0.37 | yes | 5 | 0.22 | 99.02 | GDILRTQES | 95.43 | GNILRTQES | 2.5 | GDIMRTQES | 0.87 | | |
| NA | N8 | 296 | 0.34 | yes | 3 | 0.22 | 99.13 | DILRTQESS | 95.76 | NILRTQESS | 2.5 | DIMRTQESS | 0.87 | WDILRTQES | 0.11 |
| NA | N8 | 297 | 0.17 | yes | 2 | 0.22 | 98.26 | ILRTQESSC | 98.26 | IMRTQESSC | 0.87 | | | | |
| NA | N8 | 298 | 0.17 | yes | 2 | 0.22 | 99.13 | LRTQESSCT | 99.13 | MRTQESSCT | 0.87 | | | | |
| NA | N8 | 299 | 0.1 | yes | 1 | 0.22 | 99.13 | RTQESSCTC | 99.13 | | | | | | |
| NA | N8 | 300 | 0.1 | yes | 1 | 0.22 | 99.13 | TQESSCTCIQ | 99.13 | | | | | | |
| NA | N8 | 301 | 0.93 | yes | 4 | 0.22 | 99.24 | ESSCTCIQ | 76.63 | QESSCTCIR | 21.41 | QESSCTCIK | 0.65 | QESSCTCIL | 0.65 |
| NA | N8 | 302 | 0.92 | yes | 4 | 0.22 | 99.13 | ESSCTCIQG | 76.74 | ESSCTCIRG | 21.41 | ESSCTCIKG | 0.65 | ESSCTCILG | 0.65 |
| NA | N8 | 310 | 1.74 | yes | 4 | 0.22 | 99.46 | GECYWWMTD | 48.97 | GDCYWWMTD | 27.42 | GECFWWMTD | 17.3 | GNCYWWMTD | 5.77 |
| NA | N8 | 311 | 1.75 | yes | 4 | 0.22 | 99.35 | ECYWWMTDG | 48.97 | DCYWWMTDG | 27.42 | ECFWWMTDG | 17.3 | NCYWWMTDG | 5.66 |
| NA | N8 | 312 | 0.69 | yes | 2 | 0.22 | 99.78 | CYWWMTDGP | 82.48 | CFWWMTDGP | 17.3 | | | | |
| NA | N8 | 313 | 0.7 | yes | 2 | 0.22 | 99.67 | YWWMTDGPA | 82.39 | FWWMTDGPA | 17.28 | | | | |
| NA | N8 | 314 | 0.06 | yes | 1 | 0.11 | 99.46 | WWMTDGPAN | 99.46 | | | | | | |
| NA | N8 | 315 | 0.37 | yes | 4 | 0.11 | 99.24 | VMTDGPANR | 95.54 | VMTDGPANK | 1.63 | VMTDGPANS | 1.09 | VMTDGPANN | 0.98 |
| NA | N8 | 316 | 0.37 | yes | 4 | 0.11 | 99.24 | MTDGPANRQ | 95.54 | MTDGPANKQ | 1.63 | MTDGPANSQ | 1.09 | MTDGPANNQ | 0.98 |
| NA | N8 | 317 | 0.37 | yes | 4 | 0.11 | 99.24 | TDGPANRQA | 95.54 | TDGPANKQA | 1.63 | TDGPANSQA | 1.09 | TDGPANNQA | 0.98 |
| NA | N8 | 345 | 0.44 | yes | 2 | 0.11 | 99.35 | NGGHIEEC | 94.46 | FSGGHIEEC | 2.17 | FDGGHIEEC | 2.17 | FNEGHIEEC | 1.63 |
| NA | N8 | 346 | 0.43 | yes | 2 | 0.11 | 99.35 | GGHIEECS | 98.8 | SGGHIEECS | 2.17 | DGGHIEECS | 2.17 | NEGHIEECS | 1.63 |
| NA | N8 | 347 | 0.1 | yes | 1 | 0 | 99.89 | GHIEECSC | 99.89 | EGHIEECSC | 0.98 | | | FTEGHIEEC | 0.43 |
| NA | N8 | 348 | 0.01 | yes | 1 | 0 | 99.67 | HIEECSCYP | 99.67 | | | | | TEGHIEECS | 0.43 |
| NA | N8 | 349 | 0.04 | yes | 1 | 0 | 99.67 | IEECSCYPN | 99.67 | | | | | | |
| NA | N8 | 350 | 0.04 | yes | 2 | 0 | 99.13 | EECSCYPN | 88.26 | EECSCYPND | 10.87 | | | | |
| NA | N8 | 351 | 0.58 | yes | 2 | 0 | 99.02 | ECSCYPNE | 88.17 | ECSCYPNDG | 10.86 | | | | |
| NA | N8 | 352 | 0.59 | yes | 3 | 0 | 99.02 | CSCYPNEG | 88.17 | CSCYPNDGK | 10.86 | | | | |
| NA | N8 | 353 | 0.59 | yes | 3 | 0 | 99.35 | SCYPNEGK | 88.17 | SCYPNDGKV | 10.64 | SCYPNNGKV | 0.54 | | |
| NA | N8 | 354 | 0.61 | yes | 4 | 0 | 99.35 | CYPNEGKV | 88.17 | CYPNDGKVE | 10.64 | CYPNNGKVE | 0.54 | | |
| NA | N8 | 355 | 0.61 | yes | 4 | 0 | 99.35 | YPNEGKVEC | 88.17 | YPNDGKVEC | 10.64 | YPNNGKVEC | 0.54 | | |
| NA | N8 | 356 | 0.61 | yes | 4 | 0 | 99.35 | PNEGKVECI | 71.44 | PNDGKVECI | 16.83 | PNDGKVECV | 10.64 | PNNGKVECI | 0.54 |
| NA | N8 | 357 | 1.22 | yes | 4 | 0 | 99.46 | NEGKVECV | 71.55 | NEGKVECIC | 16.72 | NDGKVECVC | 10.64 | NGKVECICR | 0.54 |
| NA | N8 | 358 | 1.2 | yes | 3 | 0 | 99.46 | EGKVECVCR | 71.55 | EGKVECICR | 16.72 | DGKVECVCR | 10.64 | | |
| NA | N8 | 359 | 1.21 | yes | 3 | 0 | 99.57 | GKVECVCRD | 82.3 | GKVECICRD | 17.26 | | | | |
| NA | N8 | 360 | 0.71 | yes | 2 | 0 | 99.57 | KVECVCRDN | 82.3 | KVECICRDN | 17.26 | | | | |
| NA | N8 | 361 | 0.71 | yes | 2 | 0 | 99.57 | VECVCRDN | 82.3 | VECICRDN | 17.26 | | | | |

FIG. 73-46

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 362 | 0.71 | yes | 2 | 0 | 99.57 | VECVCRDNW | 82.3 | | | | | | |
| NA | N8 | 363 | 0.71 | yes | 2 | 0 | 99.57 | ECVCRDNWT | 82.3 | VECICRDNW | 17.26 | | | | |
| NA | N8 | 364 | 0.71 | yes | 2 | 0 | 99.57 | CVCRDNWTG | 82.3 | ECICRDNWT | 17.26 | | | | |
| NA | N8 | 365 | 0.72 | yes | 1 | 0 | 99.46 | VCRDNWTGT | 82.19 | CICRDNWTG | 17.26 | | | | |
| NA | N8 | 366 | 0.06 | yes | 1 | 0 | 99.46 | CRDNWTGTN | 99.46 | ICRDNWTGT | 17.26 | | | | |
| NA | N8 | 367 | 0.06 | yes | 1 | 0 | 99.46 | RDNWTGTNR | 99.46 | | | | | |

FIG. 73-47

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | N8 | 475 | 0.02 | yes | 1 | 0 | 99.78 | WGYGSFT | 99.78 | YGSFTLPI | 2.82 | | | | | | |
| NA | N8 | 476 | 0.02 | yes | 1 | 0 | 99.78 | SGYSGSFTL | 99.78 | SGSFTLPIE | 2.61 | | | | | | |
| NA | N8 | 477 | 0.02 | yes | 1 | 0 | 99.78 | GYSGSFTLP | 99.78 | GSFTLPIEL | 2.61 | | | | | | |
| NA | N8 | 478 | 0.22 | yes | 2 | 0 | 99.67 | YSGSFTLPV | 96.85 | DCLYPCFWV | 24.57 | SGSFTLPVG | 2.82 | YGSFTLPI | | | |
| NA | N8 | 479 | 0.3 | yes | 3 | 0 | 99.24 | SGSFTLPVE | 96.2 | NCLYPCFWV | 96.2 | GSFTLPVEM | 2.61 | SGSFTLPIE | | | |
| NA | N8 | 480 | 0.34 | yes | 4 | 0.11 | 99.24 | GSFTLPVEL | 95.77 | CLYPCFWV | 95.77 | GCLYPCFWV | 24.57 | GSFTLPIEL | | ECLYPCFWV | 0.54 |
| NA | N8 | 492 | 1.68 | yes | 5 | 0 | 99.35 | CLYPCFWVE | 50.98 | | | | | | | | |
| NA | N8 | 493 | 0.01 | yes | 1 | 0 | 99.89 | NCLYPCFWV | 99.89 | | | | | | | | |
| NA | N8 | 494 | 0.06 | yes | 1 | 0 | 99.46 | LVPCFWVEM | 99.46 | | | | | | | | |
| NA | N8 | 495 | 0.08 | yes | 2 | 0 | 99.24 | VPCFWVEMI | 99.24 | | | | | | | | |
| NA | N8 | 496 | 0.08 | yes | 2 | 0 | 99.24 | PCFWVEMIR | 99.24 | | | | | | | | |
| NA | N8 | 497 | 0.09 | yes | 3 | 0 | 99.13 | CFWVEMIRG | 99.13 | | | | | | | | |
| NA | N8 | 498 | 0.19 | yes | 3 | 0 | 99.02 | FWVEMIRGK | 98.15 | FWVEMIRGR | 0.43 | | | | | | |
| NA | N8 | 499 | 0.19 | yes | 3 | 0 | 99.02 | WVEMIRGKP | 98.15 | WVEMIRGEP | 0.43 | | | | | | |
| NA | N8 | 500 | 0.19 | yes | 3 | 0 | 99.02 | VEMIRGKPE | 98.15 | VEMIRGRPE | 0.43 | | | | | | |
| NA | N8 | 501 | 0.19 | yes | 3 | 0 | 99.02 | EMIRGKPEE | 98.15 | EMIRGRPEE | 0.43 | | | | | | |
| NA | N8 | 511 | 0.45 | yes | 4 | 0 | 99.46 | TIWTSSSI | 93.05 | AIWTSSSI | 5.32 | TWTSSSI | 0.54 | | | | |
| NA | N8 | 512 | 0.38 | yes | 2 | 0 | 99.13 | IWTSSSIV | 93.81 | IWTSSSSV | 5.32 | | | | | | |
| NA | N8 | 513 | 0.32 | yes | 2 | 0 | 99.78 | WTSSSIVM | 94.46 | WTSSSSVM | 5.32 | | | | | | |
| NA | N8 | 514 | 0.32 | yes | 2 | 0 | 99.78 | TSSSIVMC | 94.46 | TSSSSVVMC | 5.32 | | | | | | |
| NA | N8 | 515 | 0.32 | yes | 2 | 0 | 99.78 | SSSIVMCG | 94.46 | SSSSVMCG | 5.32 | | | | | | |
| NA | N8 | 516 | 0.32 | yes | 2 | 0 | 99.78 | SSSIVMCGV | 94.46 | SSSVMCGV | 5.32 | | | | | | |
| NA | N8 | 517 | 0.47 | yes | 3 | 0 | 99.35 | SSIVMCGVD | 92.62 | SSVMCGVD | 5.32 | SIVMCGVNY | 1.41 | SSIVMCGVN | SIVMCGVNY | SIVMCGVEH | 0.43 |
| NA | N8 | 518 | 1.01 | yes | 4 | 0 | 99.13 | SIVMCGVDH | 80.98 | SVMCGVDY | 11.3 | SVMCGVN | 5.33 | SVMCGVDH | ADWSWQDGA | | |
| NA | N8 | 529 | 0.91 | no | 5 | 0.11 | 99.1 | ADWSWHDGA | 77.16 | ANWSWHDGA | 21.16 | ANWSWHDGA | 0.56 | ANWSWHDGA | SWSWHDGAV | NWSWHDGAI | 0.57 |
| NA | N8 | 530 | 1.01 | no | 5 | 3.04 | 99.2 | DWSWHDGAI | 76.25 | DWSWHDGAV | 20.45 | DWSWHDGAV | 1.25 | DWSWHDGA | | | |
| NA | N8 | 531 | 0.24 | no | 2 | 4.45 | 99.09 | WSWHDGAIL | 77.15 | | | WSWHDGAVL | 1.94 | WSWHDGAVL | | | |
| NA | N8 | 532 | 0.24 | yes | 2 | 4.78 | 99.08 | WHDGAILPF | 97.12 | | | WHDGAVLPF | 1.96 | WHDGAVLPF | | | |
| NA | N8 | 533 | 0.28 | yes | 3 | 5.65 | 99.04 | WHDGAILPF | 96.64 | WHDGAILPL | 1.92 | DGAILPFGI | 0.24 | WHDGAILPL | DGAILPLTS | 0.24 |
| NA | N8 | 535 | 0.32 | yes | 2 | 9.55 | 99.03 | DGAILPFDI | 96.36 | DGAILPFDF | 1.94 | DGAILPFGI | 0.24 | DGAILPFDF | | | |
| NA | N8 | 539 | — | yes | 2 | 10.53 | 100 | LPFDIDKIS | 50 | LPFDFDKIS | 50 | | | | | | |
| NA | N8 | 540 | — | yes | 2 | 99.78 | 100 | PFDIDKIIT | 50 | PFDFDKISQ | 50 | | | | | | |
| NA | N9 | 1 | 0.21 | yes | 3 | 99.78 | 99.48 | MNPNQKILC | 97.38 | MNPNQKILF | 1.57 | MNPNQKIQC | 0.52 | MNPNQKIQC | NPNQKIQCT | 0.52 |
| NA | N9 | 2 | 0.36 | no | 4 | 13.57 | 99.48 | NPNQKILCT | 95.29 | NPNQKILCA | 2.09 | NPNQKILFA | 1.57 | NPNQKILCA | PNQKILCTS | 0.52 |
| NA | N9 | 3 | 0.36 | no | 4 | 13.57 | 99.48 | PNQKILCTS | 95.31 | PNQKILCAS | 2.08 | PNQKILFAS | 1.56 | PNQKILCAS | SQKILCTSA | 0.49 |
| NA | N9 | 4 | 0.38 | no | 5 | 13.12 | 99.01 | NQKILCTSA | 95.07 | NQKILCASA | 1.97 | NQKILFASA | 1.48 | NQKILCASA | QKILFASAT | 1.48 |
| NA | N9 | 5 | 0.48 | yes | 4 | 8.14 | 99.01 | QKILCTSAT | 93.6 | QKILCASAT | 1.95 | QKILFASAT | 1.46 | QKILCASAT | KILFASATA | 1.46 |
| NA | N9 | 6 | 0.52 | yes | 5 | 8.14 | 99.01 | KILCTSATA | 93.17 | KILCASATA | 1.95 | KILFASATA | 1.46 | KILCASATA | ILCTSATAI | 1.46 |
| NA | N9 | 7 | 0.58 | yes | 5 | 7.24 | 99.02 | ILCTSATAI | 92.2 | ILCASATAI | 1.95 | ILCTSATA | 1.46 | ILCASATAI | RILCTSATA | 1.46 |
| NA | N9 | 27 | 0.49 | yes | 4 | 7.24 | 99.55 | ANLGLNIGL | 92.31 | TNLGLNIGL | 5.43 | ANLGLNVGL | 0.9 | | | | |
| NA | N9 | 28 | 0.12 | yes | 2 | 0 | 99.55 | NLGLNIGLH | 98.64 | NLGLNVGLH | 0.9 | | | | | | |

FIG. 73-48

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 29 | 0.12 | yes | 2 | 0 | 99.55 | LGLNIGLHL | 98

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 277 | 1.12 | yes | 3 | 0 | 99.1 | IEECSCYGE | 74.66 | IEECSCYGK | 14.93 | | | | |
| NA | N9 | 289 | 0.45 | yes | 3 | 0 | 100 | IICTCRDNW | 92.76 | VTCTCRDNW | 3.62 | | | | |
| NA | N9 | 290 | 0.27 | yes | 2 | 0 | 99.55 | TCTCRDNWQ | 95.93 | ICTCRDNWQ | 3.62 | | | | |
| NA | N9 | 291 | 0.04 | yes | 1 | 0 | 99.55 | CTCRDNWQG | 99.55 | | | | | | |
| NA | N9 | 292 | 0.08 | yes | 1 | 0 | 99.1 | TCRDNWQGS | 99.1 | | | | | | |
| NA | N9 | 293 | 0.08 | yes | 1 | 0 | 99.1 | CRDNWQGSN | 99.1 | | | | | | |
| NA | N9 | 294 | 0.08 | yes | 1 | 0 | 99.1 | RDNWQGSNR | 99.1 | | | | | | |
| NA | N9 | 295 | 0.08 | yes | 1 | 0 | 99.1 | DNWQGSNRP | 99.1 | | | | | | |
| NA | N9 | 296 | 0.08 | yes | 1 | 0 | 99.1 | NWQGSNRPV | 99.1 | | | | | | |
| NA | N9 | 297 | 0.08 | yes | 1 | 0 | 99.1 | WQGSNRPVI | 99.1 | | | | | | |
| NA | N9 | 298 | 0.39 | yes | 2 | 0 | 99.1 | QGSNRPVIR | 93.67 | QGSNRPVIR | 5.43 | | | | |
| NA | N9 | 299 | 0.35 | yes | 2 | 0 | 99.55 | GSNRPVIRI | 94.12 | GSNRPVIRI | 5.43 | | | | |
| NA | N9 | 300 | 0.71 | yes | 3 | 0 | 99.1 | SNRPVIQIN | 86.88 | SNRPVIQIN | 7.24 | SNRPVIRID | 5.43 | | |
| NA | N9 | 301 | 0.71 | yes | 3 | 0 | 99.55 | NRPVIQIDP | 86.88 | NRPVIQINP | 7.24 | NRPVIRIDP | 5.43 | | |
| NA | N9 | 311 | 1.12 | yes | 5 | 0 | 99.1 | AMTHTSQYI | 80.09 | MTHTSQYI | 8.6 | MMTHTSQYI | 4.98 | TMTHTSQYI | 4.07 | AMKHTSQYI | 1.36 |
| NA | N9 | 312 | 0.19 | yes | 2 | 0 | 97.74 | MTHTSQYIC | 97.74 | MKHTSQYIC | 1.36 | | | | |
| NA | N9 | 313 | 0.19 | yes | 2 | 0 | 97.74 | THTSQYICS | 97.74 | KHTSQYICS | 1.36 | | | | |
| NA | N9 | 314 | 0.04 | yes | 1 | 0 | 99.55 | HTSQYICSP | 99.55 | | | | | | |
| NA | N9 | 315 | 0.08 | yes | 1 | 0 | 99.1 | TSQYICSPV | 99.1 | | | | | | |
| NA | N9 | 316 | 0.08 | yes | 1 | 0 | 99.1 | SQYICSPVL | 99.1 | | | | | | |
| NA | N9 | 317 | 0.08 | yes | 1 | 0 | 99.1 | QYICSPVLT | 99.1 | | | | | | |
| NA | N9 | 318 | 0.08 | yes | 1 | 0 | 99.1 | YICSPVLTD | 99.1 | | | | | | |
| NA | N9 | 319 | 0.08 | yes | 1 | 0 | 99.1 | ICSPVLTDN | 99.1 | | | | | | |
| NA | N9 | 320 | 0.04 | yes | 1 | 0 | 99.55 | CSPVLTDNP | 99.55 | | | | | | |
| NA | N9 | 321 | 0.04 | yes | 1 | 0 | 99.55 | SPVLTDNPR | 99.55 | | | | | | |
| NA | N9 | 322 | 0.04 | yes | 1 | 0 | 99.55 | PVLTDNPRP | 99.55 | | | | | | |
| NA | N9 | 323 | 0.04 | yes | 1 | 0 | 99.55 | VLTDNPRPN | 99.55 | | | | | | |
| NA | N9 | 324 | 0.04 | yes | 1 | 0 | 99.55 | LTDNPRPND | 99.55 | | | | | | |
| NA | N9 | 325 | 0.04 | yes | 1 | 0 | 99.55 | TDNPRPNDP | 99.55 | | | | | | |
| NA | N9 | 326 | 1.85 | yes | 5 | 0 | 99.1 | DNPRPNDPA | 40.72 | DNPRPNDPT | 33.03 | DNPRPNDPN | 19.91 | DNPRPNDPS | 0.9 | |
| NA | N9 | 335 | 0.67 | yes | 2 | 0 | 95.55 | VGKCNDPYP | 85.52 | IGKCNDPYP | 13.12 | VGKCNEPYP | 0.9 | | |
| NA | N9 | 336 | 0.1 | yes | 2 | 0 | 100 | GKCNDPYPG | 98.64 | GKCNEPYPG | 1.36 | | | | |
| NA | N9 | 337 | 0.15 | yes | 2 | 0 | 99.1 | KCNDPYPGN | 98.19 | KCNEPYPG | 1.36 | | | | |
| NA | N9 | 338 | 0.19 | yes | 2 | 0 | 97.74 | CNDPYPGN | 97.29 | CNEPYPGN | 1.36 | | | | |
| NA | N9 | 339 | 0.23 | yes | 2 | 0 | 99.1 | NDPYPGNNN | 96.38 | NEPYPGNN | 1.36 | | | | |
| NA | N9 | 340 | 0.31 | yes | 3 | 0 | 99.1 | DPYPGNNNN | 97.74 | DPYPGNNN | 1.36 | DPYPGSNNN | 0.45 | DPYPGNNBN | 0.45 |
| NA | N9 | 341 | 0.21 | yes | 4 | 0 | 99.1 | PYPGNNNNG | 97.74 | PYPGNNBNG | 0.45 | PYPGSNNNG | 0.45 | | |
| NA | N9 | 342 | 0.21 | yes | 4 | 0 | 99.1 | YPGNNNNGV | 97.74 | YPGNNBNGV | 0.45 | YPGNSNNGV | 0.45 | | |
| NA | N9 | 343 | 0.21 | yes | 4 | 0 | 97.74 | PGNNNNGVK | 97.74 | PGNNBNGVK | 0.45 | PGSNNNGVK | 0.45 | | |
| NA | N9 | 344 | 0.21 | yes | 4 | 0 | 99.1 | GNNNNGVKG | 97.74 | GNNBNGVKG | 0.45 | GNSNNGVKG | 0.45 | | |
| NA | N9 | 345 | 0.17 | yes | 3 | 0.45 | 99.09 | NNNNGVKGF | 98.18 | NNBNGVKGF | 0.45 | NSNNGVKGF | 0.45 | | |

FIG. 73-53

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 346 | 0.23 | yes | 3 | 0 | 99.1 | NNNG

FIG. 73-54

| Protein | Sub-type | Start Pos | Block Entropy | Gaps >10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | N9 | 405 | 0.66 | yes | 3 | 0 | 100 | GYSGS

FIG. 73-55

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 448 | 0.08 | yes | 1 | 0.9 | 99.09 | MCSSTEFLG | 99.09 | | | | | | |
| NA | N9 | 449 | 0.08 | yes | 1 | 0.9 | 99.09 | CSSTEFLGQ | 99.09 | | | | | | |
|

FIG. 73-56

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 154 | 0.67 | yes | 5 | 0

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 325 | 0.73 | yes | 2 | 0 | 100 | LLATGMRNV | 79.76 | | | | | | |
| HA | H10 | 326 | 0 | yes | 1 | 0 | 100 | LATGMRNVP | 100 | ML

FIG. 73-59

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 375 | 0.32 | yes | 4 | 0.4 | 99.59 | AADYKSTQA | 95.93 | AADYKSTQA | 2.03 | AADYKSTQK | 0.81 | D

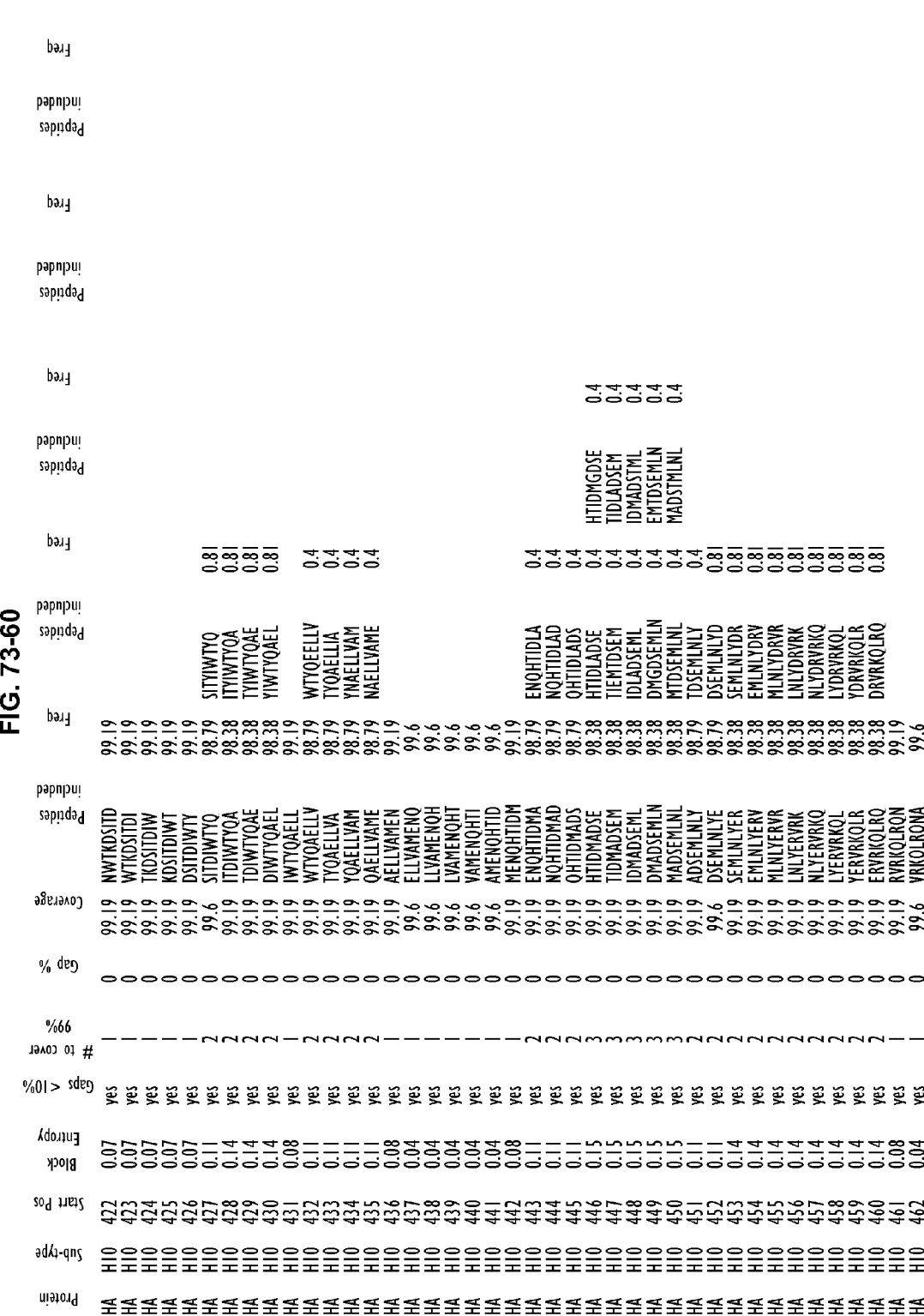

FIG. 73-61

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 463 | 0.04 | yes | 1 | 0 | 99.6 | RKQLRQ

FIG. 73-62

| Protein | Sub-type | Start Pos | Block Entropy | Gaps > 10% | # to cover 99% | Gap % | Coverage | Included peptides | Freq | Included peptides | Freq | Included peptides | Freq | Included peptides | Freq |
|---|---|---|---|---|---|---|---|---|---|---|---|---|---|---|---|
| HA | H10 | 521 | 0.9 | yes | 2 | 0 | 99.19 | GYK

FIG. 73-63

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 42 | 0.11 | yes | 2 | 0 | 99.35 | EVT

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 203 | 0.31 | yes | 4 | 0 | 99.35 |

FIG. 73-66

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 253 | 0.17 | yes | 3 | 0 | 99.35 | ITFLHNGGL | 98.05 | ITFLHNGGL | 0.65 | | | | |
| HA | H10N7 | 254 | 0.23 | yes | 4 | 0 | 99.35 | TFSHNGGLI | 97.4 | IFSHNGGLI | 0.65 | | | | |
| HA | H10N7 | 255 | 0.17 | yes | 3 | 0 | 99.35 | FSHNG

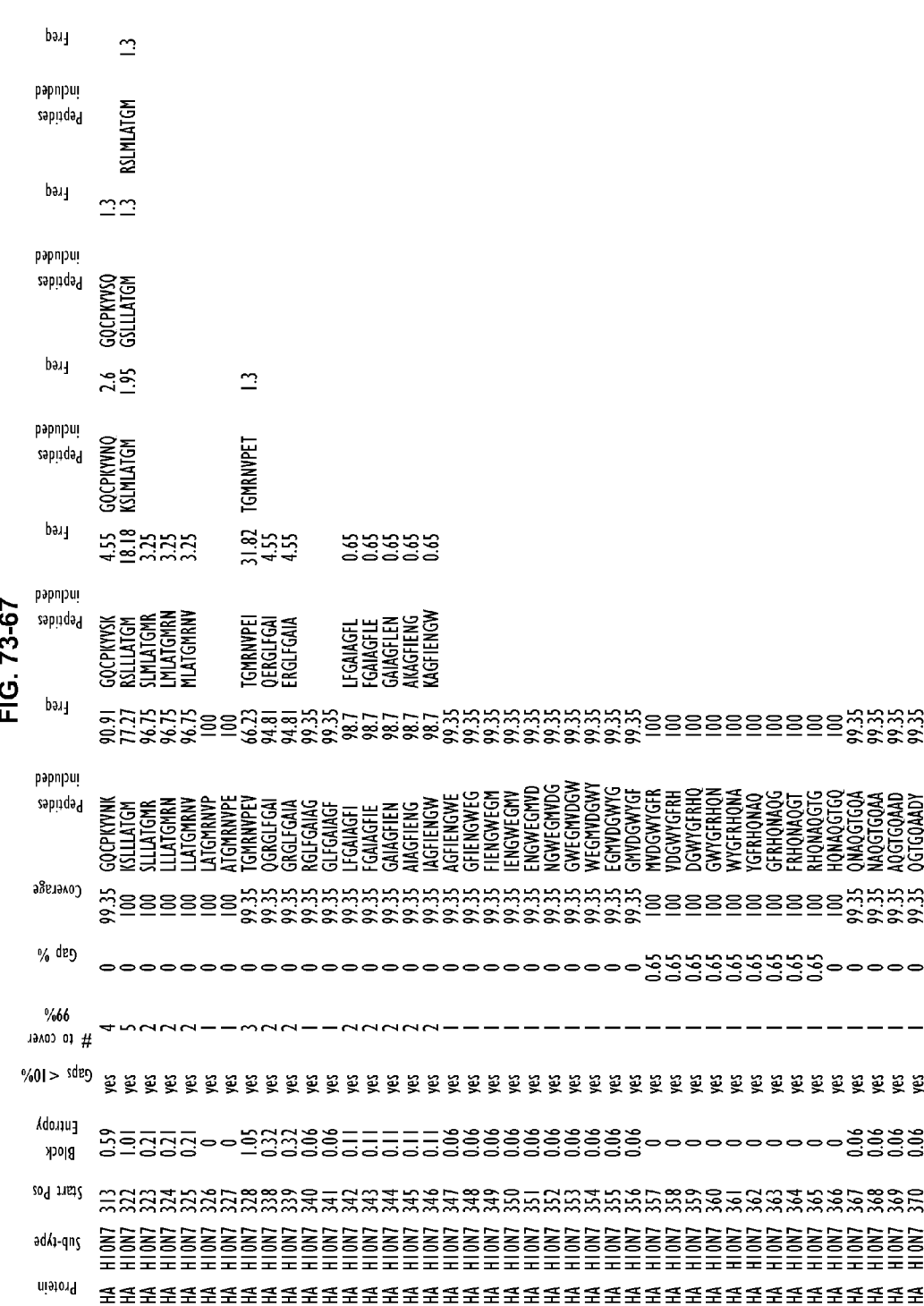

FIG. 73-70

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 453 | 0.21 | yes | 3 | 0 | 99.35 | SEMLNLYER | 97.4 | SEMLNLYD

FIG. 73-72

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H10N7 | 548 | 0.2 | yes | 2 | 4.55 | 99.32 | FCLKNGNMR | 97.28 | FCLRNGNMR | 2.04 | | | | |
| HA | H10N

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 372 | 0.14 | yes | 2 | 0 | 100 | SGFEMLKI

FIG. 73-80

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 438 | 0.06 | yes | 1 | 0 | 99.33 | YVWWTSNSL | 99.33 | VWWTSNSL

FIG. 73-81

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H1 | 30 | 1.37 | yes | 5 | 0.52 | 99.48 | ERVD

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 293 | 1.31 | yes | 5 | 0 | 99.48 | KCQSEIGGI | 68.39 | KCQTEV

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| HA | III | 447 | 0 | yes | 1 | 0.52 | 100 | EKTLDLHDS | 100 | | | | | | | | |
| HA | III | 448 | 0 | yes | 1 | 0.52 | 100 | KTLDLHDSN | 100 | | | | | | | | |
| HA | III | 449 | 0 | yes | 1 | 0.52 | 100 | TLDLHDSNV | 100 | | | | | | | | |
| HA | III | 450 | 0.09 | yes | 2 | 0.52 | 99.48 | LDLHDSNVK | 98.96 | LDLHDSNVK | 0.52 | | | | | | |
| HA | III | 451 | 0.18 | yes | 3 | 0.52 | 99.48 | DLHDSNVR | 97.92 | DLHDSNVRS | 1.04 | DLHDSNVKN | 0.52 | | | | |
| HA | III | 452 | 0.18 | yes | 3 | 0.52 | 99.48 | LHDSNVRN | 97.92 | LHDSNVRSL | 1.04 | LHDSNVKNL | 0.52 | | | | |
| HA | III | 453 | 0.18 | yes | 3 | 0.52 | 99.48 | HDSNVRNL | 97.92 | HDSNVRSLH | 1.04 | HDSNVKNLH | 0.52 | | | | |
| HA | III | 454 | 0.18 | yes | 3 | 0.52 | 99.48 | DSNVRNLH | 97.92 | DSNVRSLHE | 1.04 | DSNVKNLHE | 0.52 | | | | |
| HA | III | 455 | 0.32 | yes | 4 | 0.52 | 99.48 | SNVRNLHE | 95.83 | SNVRSLHEK | 2.08 | SNVKNLHEK | 1.04 | SNVKNLHEK | 0.52 | | |
| HA | III | 460 | 0.44 | yes | 5 | 0 | 99.48 | LHEKVRRML | 94.3 | LHEKVRRML | 2.07 | LHEKVRRML | 1.55 | LHEKVRQML | 0.52 | | |
| HA | III | 468 | 0.59 | yes | 5 | 0 | 99.48 | LRDNAKDEG | 91.71 | LKGNAKDEG | 2.59 | LKNNAKDEG | 2.07 | LQDNAKDEG | 1.04 | | |
| HA | III | 469 | 0.59 | yes | 5 | 0 | 99.48 | RDNAKDEGN | 91.71 | KGNAKDEGN | 2.59 | KNNAKDEGN | 2.07 | KNNAKDEGN | 1.55 | | |
| HA | III | 470 | 0.31 | yes | 3 | 0 | 99.48 | GNAKDEGNG | 95.85 | NNAKDEGNG | 2.07 | QDNAKDEGN | 1.55 | | | | |
| HA | III | 471 | 0.05 | yes | 2 | 0 | 99.48 | RDEGNGCFT | 0.52 | | | | | | | | |
| HA | III | 472 | 0.09 | yes | 1 | 0 | 99.48 | NAKDEGNGC | 99.48 | | | | | | | | |
| HA | III | 473 | 0.05 | yes | 1 | 0 | 99.48 | AKDEGNGCF | 98.96 | | | | | | | | |
| HA | III | 474 | 0.05 | yes | 1 | 0 | 99.48 | KDEGNGCFT | 99.48 | | | | | | | | |
| HA | III | 475 | 0.05 | yes | 1 | 0 | 99.48 | DEGNGCFTF | 99.48 | | | | | | | | |
| HA | III | 476 | 0.09 | yes | 2 | 0 | 99.48 | EGNGCFTFY | 98.96 | | | | | | | | |
| HA | III | 477 | 0.09 | yes | 2 | 0 | 99.48 | GNGCFPYHK | 98.96 | NGCFPYHK | 0.52 | | | | | | |
| HA | III | 478 | 0.21 | yes | 3 | 0 | 99.48 | GCFTFYHK | 97.41 | GCFPFYHK | 1.55 | CFPFYHKCD | 0.52 | FYHKCDNEC | 0.52 | | |
| HA | III | 479 | 0.35 | yes | 4 | 0 | 99.48 | CFTFYHKC | 95.34 | CFTFYHKCD | 2.07 | FTFYHKCNN | 1.55 | FTFYHKCDN | 1.55 | FYHKCDNEC | 0.52 |
| HA | III | 480 | 0.58 | yes | 5 | 0 | 99.48 | FTFYHKCDN | 91.71 | FYHKCDDEC | 3.63 | FYHKCNNEC | 1.55 | YHKCDNGCI | 1.55 | | |
| HA | III | 482 | 0.58 | yes | 5 | 0 | 99.48 | FYHKCDNEC | 91.71 | YHKCDDECI | 3.63 | YHKCNNECI | 1.55 | HRCDNGCI | 1.55 | | |
| HA | III | 483 | 0.58 | yes | 5 | 0 | 99.48 | YHKCDNECI | 91.71 | HKCDDECIE | 3.63 | HKCNNECIE | 1.55 | NECIEKIRN | 2.07 | | |
| HA | III | 484 | 1.15 | yes | 5 | 0 | 99.48 | HKCDNKCIE | 75.13 | NKCIERVRN | 17.62 | DECIEKVRN | 2.07 | NECIEKIRN | 1.04 | | |
| HA | III | 488 | 1.01 | yes | 5 | 0 | 100 | NECIERVRNG | 77.2 | KCIERVRNG | 17.72 | ECIEKVRNG | 3.63 | ECIEKIRNG | 1.04 | | |
| HA | III | 489 | 0.83 | yes | 4 | 0 | 100 | ECIEKVRNGT | 77.72 | CIEKVRNGT | 17.72 | CIERYRNGT | 1.04 | | | | |
| HA | III | 490 | 0.83 | yes | 4 | 0 | 100 | CIEKVRNGT | 77.72 | IEKVRNGTY | 17.72 | IEKVRNGTY | 1.04 | | | | |
| HA | III | 491 | 0.83 | yes | 4 | 0 | 99.48 | IEKVRNGTY | 77.72 | ERVRNGTYD | 17.72 | EKIRNGTYD | 1.04 | | | | |
| HA | III | 492 | 0.83 | yes | 4 | 0 | 99.48 | KVRNGTYDH | 77.72 | RVRNGTYDH | 17.72 | KIRNGTYD | 1.04 | | | | |
| HA | III | 493 | 0.08 | yes | 2 | 0 | 99.48 | VRNGTYDHK | 77.72 | IRNGTYDH | 1.04 | | | | | | |
| HA | III | 494 | 0.05 | yes | 2 | 0 | 99.48 | RNGTYDHKE | 98.96 | | | | | | | | |
| HA | III | 495 | 0.09 | yes | 2 | 0 | 100 | NGTYDHKEF | 99.48 | GTYDHKEFK | 0.52 | | | | | | |
| HA | III | 496 | 0.05 | yes | 1 | 0 | 100 | GTYDHKEFE | 98.96 | TYDHKEFEK | 1.04 | TYDHKEFEE | 0.52 | | | | |
| HA | III | 497 | 0.09 | yes | 3 | 0 | 100 | TYDHKEFEK | 97.93 | YDHKEFEKE | 1.04 | YDHKEFEE | 1.04 | | | | |
| HA | III | 498 | 0.18 | yes | 3 | 0 | 99.48 | YDHKEFEES | 97.93 | DHKDFEEES | 1.04 | DHKDFEEES | 1.04 | | | | |
| HA | III | 499 | 0.18 | yes | 3 | 0 | 99.48 | DHKEFEEES | 97.93 | HKEFEKESR | 1.04 | HKEFEKESK | 0.52 | HKEFEKESK | 0.52 | | |
| HA | III | 500 | 0.18 | yes | 3 | 0 | 99.48 | HKEFEEESR | 84.46 | HKEFEKESR | 13.47 | HKEFEKESK | 0.52 | HKEFEKESK | 0.52 | | |
| HA | III | 501 | 0.75 | yes | 4 | 0 | 99.48 | EESLNRQE | 62.18 | EESRLNRQE | 23.32 | EESRLNRQE | 9.84 | KESRLNRQE | 3.63 | KESRLNRQE | 0.52 |
| HA | III | 506 | 1.5 | yes | 5 | 0 | 99.48 | | | | | | | | | | |

FIG. 73-86

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 507 | 1.47 | yes | 4 | 0 | 99.48 | ESKLNRQEI | 62.18 | ESKLNRQEI | 23.32 | ESRLNRQEI | 10.36 | ESRIN

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 168 | 0.77 | yes | 3 | 0 | 100 | LKSGQFPVQ | 82.35 | LKSEQFPVQ | 15.29 | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 295 | 0.18 | yes | 3 | 0 | 100 | QLNEGV

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 378 | 0.67 | yes | 4 | 0 | 100 | ADRDSTQ

FIG. 73-95

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 437 | 0.09 | yes | 2 | 0 | 100 | NAELIVLLE | 98.82 | NAELIVLLE | | | | | |
| HA | H12 | 438 | 0.09 | yes | 2 | 0 | 100 | AELIVLLEN | 98.82 | AELIVLLE

FIG. 73-97

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 552 | 0.1 | yes | 2 | 4.71 | 100 | GCQNGNVRC | 98.77 | G

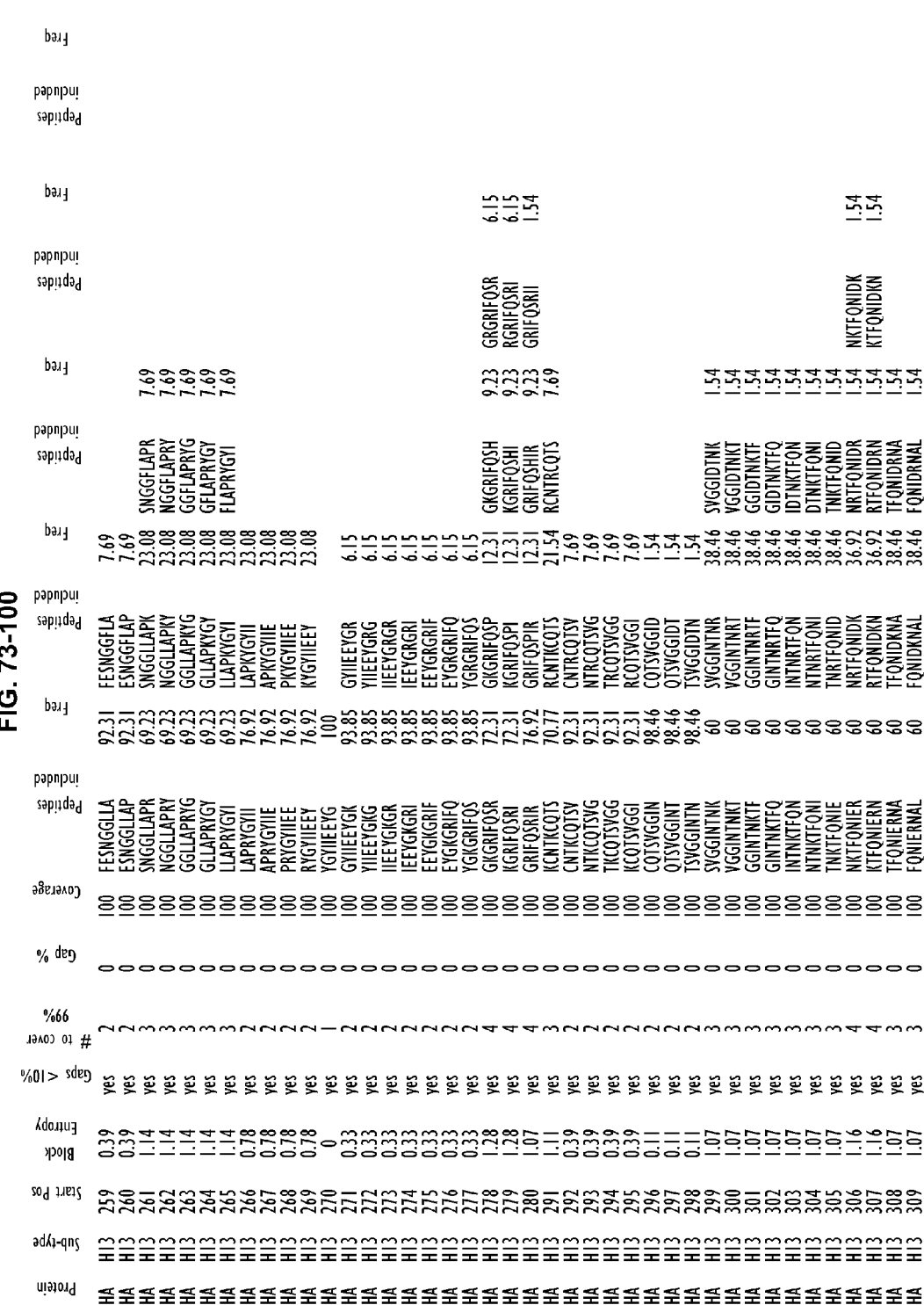

FIG. 73-101

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 310 | 1.07 | yes | 3 | 0 | 100 | QNIERNALG | 60 | Q

FIG. 73-102

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 362 | 0 | yes | 1 | 0 | 100 | INGWYGFQH | 100 | | | | | | |
| HA | H3 | 363 | 0 | yes | 1 | 0 | 100 | NGWYGFQHQ | 100 | | | | | | |
| HA | H3 | 364 | 0 | yes | 1 | 0 | 100 | GWYGFQHQN | 100 | | | | | | |
| HA | H3 | 365 | 0 | yes | 1 | 0 | 100 | WYGFQHQNE | 100 | | | | | | |
| HA | H3 | 366 | 0 | yes | 1 | 0 | 100 | YGFQHQNEQ | 100 | | | | | | |
| HA | H3 | 367 | 0 | yes | 1 | 0 | 100 | GFQHQNEQG | 100 | | | | | | |
| HA | H3 | 368 | 1.07 | yes | 3 | 0 | 100 | FQHQNEQGV | 58.46 | FQHQNEQGT | 40 | | | | |
| HA | H3 | 369 | 1.07 | yes | 3 | 0 | 100 | QHQNEQGVG | 58.46 | QHQNEQGTG | 40 | | | | |
| HA | H3 | 370 | 1.64 | yes | 4 | 0 | 100 | HQNEQGVGI | 40 | HQNEQGTGI | 35.38 | HQNEQGMGM | 1.54 | | |
| HA | H3 | 371 | 1.64 | yes | 4 | 0 | 100 | QNEQGVGIA | 40 | QNEQGTGIA | 35.38 | QNEQGMGMG | 1.54 | | |
| HA | H3 | 372 | 1.64 | yes | 4 | 0 | 100 | NEQGVGIAA | 40 | NEQGTGIAA | 35.38 | NEQGMGMAA | 1.54 | | |
| HA | H3 | 373 | 1.8 | yes | 5 | 0 | 100 | EQGVGIAAD | 36.92 | EQGVGIAAD | 35.38 | EQGTGIAAE | 1.54 | EQGMGMAAD | 1.54 |
| HA | H3 | 374 | 1.8 | yes | 5 | 0 | 100 | QGVGIAADK | 36.92 | QGVGMAADK | 35.38 | QGTGIAAEK | 1.54 | QGMGMAADK | 1.54 |
| HA | H3 | 375 | 1.8 | yes | 5 | 0 | 100 | GVGIAADKE | 36.92 | GVGMAADKE | 35.38 | GTGIAAEKE | 1.54 | GMGMAADKE | 1.54 |
| HA | H3 | 376 | 1.13 | yes | 3 | 0 | 100 | VGIAADKES | 36.92 | VGMAADKES | 35.38 | TGIAAEKES | 3.08 | MGMAADKES | 1.54 |
| HA | H3 | 377 | 1.13 | yes | 3 | 0 | 100 | GIAADKEST | 60 | GMAADKEST | 36.92 | GIAAEKEST | 3.08 | | |
| HA | H3 | 378 | 0.2 | yes | 2 | 0 | 100 | IAADKESTQ | 60 | MAADKESTQ | 36.92 | IAAEKESTQ | 3.08 | | |
| HA | H3 | 379 | 0.2 | yes | 2 | 0 | 100 | AADKESTQK | 96.92 | AAEKESTQK | 3.08 | | | | |
| HA | H3 | 380 | 0.11 | yes | 1 | 0 | 100 | ADKESTQKA | 96.92 | AEKESTQKA | 3.08 | | | | |
| HA | H3 | 381 | 0.11 | yes | 1 | 0 | 100 | DKESTQKAI | 96.92 | EKESTQKAI | 3.08 | | | | |
| HA | H3 | 382 | 0.11 | yes | 1 | 0 | 100 | KESTQKAID | 100 | | | | | | |
| HA | H3 | 383 | 0.11 | yes | 1 | 0 | 100 | ESTQKAIDQ | 98.46 | ESTQKAIDR | 1.54 | | | | |
| HA | H3 | 384 | 0.11 | yes | 1 | 0 | 100 | STQKAIDQI | 98.46 | STQKAIDRI | 1.54 | | | | |
| HA | H3 | 385 | 0.11 | yes | 1 | 0 | 100 | TQKAIDQIT | 98.46 | TQKAIDRIT | 1.54 | | | | |
| HA | H3 | 386 | 0.11 | yes | 1 | 0 | 100 | QKAIDQITT | 98.46 | QKAIDRITT | 1.54 | | | | |
| HA | H3 | 387 | 0.11 | yes | 1 | 0 | 100 | KAIDQITTK | 98.46 | KAIDRITTK | 1.54 | | | | |
| HA | H3 | 388 | 0.11 | yes | 1 | 0 | 100 | AIDQITTKI | 98.46 | AIDRITTKI | 1.54 | | | | |
| HA | H3 | 389 | 0.11 | yes | 1 | 0 | 100 | IDQITTKIN | 98.46 | IDRITTKIN | 1.54 | | | | |
| HA | H3 | 390 | 0.11 | yes | 1 | 0 | 100 | DQITTKINN | 98.46 | DRITTKINN | 1.54 | | | | |
| HA | H3 | 391 | 0 | yes | 1 | 0 | 100 | QITTKINNI | 98.46 | RITTKINNI | 1.54 | | | | |
| HA | H3 | 392 | — | yes | 1 | 0 | 100 | ITTKINNII | 100 | | | | | | |
| HA | H3 | 393 | — | yes | 2 | 0 | 100 | TTKINNIID | 50.77 | TTKINNIIE | 49.23 | | | | |
| HA | H3 | 394 | — | yes | 2 | 0 | 100 | TKINNIIDK | 50.77 | TKINNIIEK | 49.23 | | | | |
| HA | H3 | 395 | — | yes | 2 | 0 | 100 | KINNIIDKM | 50.77 | KINNIIEKM | 49.23 | | | | |
| HA | H3 | 396 | — | yes | 2 | 0 | 100 | INNIIDKMN | 50.77 | INNIIEKMN | 49.23 | | | | |
| HA | H3 | 397 | — | yes | 2 | 0 | 100 | NNIIDKMNG | 50.77 | NNIIEKMNG | 49.23 | | | | |
| HA | H3 | 398 | — | yes | 2 | 0 | 100 | NIIDKMNGN | 50.77 | NIIEKMNGN | 49.23 | | | | |
| HA | H3 | 399 | — | yes | 2 | 0 | 100 | IIDKMNGNY | 50.77 | IIEKMNGNY | 49.23 | | | | |
| HA | H3 | 400 | — | yes | 2 | 0 | 100 | IDKMNGNYD | 50.77 | IEKMNGNYD | 49.23 | | | | |
| HA | H3 | 401 | — | yes | 2 | 0 | 100 | DKMNGNYDS | 50.77 | EKMNGNYDS | 49.23 | | | | |
| HA | H3 | 402 | 0 | yes | 1 | 0 | 100 | KMNGNYDSI | 100 | | | | | | |

FIG. 73-103

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 403 | 0 | yes | 1 | 0 | 100 | MNGNYDSIR | 100 | | | | | | |
| HA | H13 | 404 | 0 | yes | 1 | 0 | 100 | NGNYDSIR

FIG. 73-104

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 444 | 0 | yes | 1 | 0 | 100 | VLLENDK

FIG. 73-105

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 506 | - | yes | 2 | 0 | 100 | YAEESKLKR | 52.31

FIG. 73-106

| Protein | Sub-type | Start Pos | Block Entropy | Gaps <10% | # to cover 99% | Gap % | Coverage | Peptides included | Freq | Peptides included | Freq |
|---|---|---|---|---|---|---|---|---|---|---|---|
| HA | H4 | 1 | 0 | no | – | 25 | 100 | MIAILVAL | 100 | | |
| HA | H4 | 2 | 0 | no | – | 25 | 100 | IAILVALA | 100 | | |
| HA | H4 | 3 | 0 | no | – | 25 | 100 | AILVALAL | 100 | | |
| HA | H4 | 4 | 0 | no | – | 25 | 100 | ILVALALS | 100 | | |
| HA | H4 | 5 | 0 | no | – | 25 | 100 | LVALALSH | 100 | | |
| HA | H4 | 6 | 0 | no | – | 25 | 100 | VALALSHT | 100 | | |
| HA | H4 | 7 | 0 | no | – | 25 | 100 | ALALSHTA | 100 | | |
| HA | H4 | 8 | 0 | no | – | 25 | 100 | LALSHTAY | 100 | | |
| HA | H4 | 9 | 0.81 | yes | 2 | 0 | 100 | ALSHTAYS | 75 | GSEHTAYSQ | 25 |
| HA | H4 | 10 | 0.81 | yes | 2 | 0 | 100 | LSHTAYSQ | 75 | SEHTAYSQI | 25 |
| HA | H4 | 11 | 0.81 | yes | 2 | 0 | 100 | SHTAYSQI | 75 | EHTAYSQIT | 25 |
| HA | H4 | 12 | 0 | yes | – | 0 | 100 | HTAYSQIT | 100 | | |
| HA | H4 | 13 | 0 | yes | – | 0 | 100 | TAYSQITN | 100 | | |
| HA | H4 | 14 | 0 | yes | – | 0 | 100 | AYSQITNG | 100 | | |
| HA | H4 | 15 | 0 | yes | – | 0 | 100 | YSQITNGT | 100 | | |
| HA | H4 | 16 | 0 | yes | – | 0 | 100 | SQITNGTT | 100 | | |
| HA | H4 | 17 | 0 | yes | – | 0 | 100 | QITNGTTG | 100 | | |
| HA | H4 | 18 | 0 | yes | – | 0 | 100 | ITNGTTGN | 100 | | |
| HA | H4 | 19 | 0 | yes | – | 0 | 100 | TNGTTGNP | 100 | | |
| HA | H4 | 20 | 0 | yes | – | 0 | 100 | NGTTGNPI | 100 | | |
| HA | H4 | 21 | 0 | yes | – | 0 | 100 | GTTGNPII | 100 | | |
| HA | H4 | 22 | 0 | yes | – | 0 | 100 | TTGNPIIC | 100 | | |
| HA | H4 | 23 | 0 | yes | – | 0 | 100 | TGNPIICL | 100 | | |
| HA | H4 | 24 | 0 | yes | – | 0 | 100 | GNPIICLG | 100 | | |
| HA | H4 | 25 | 0 | yes | – | 0 | 100 | NPIICLGH | 100 | | |
| HA | H4 | 26 | 0 | yes | – | 0 | 100 | PIICLGHH | 100 | | |
| HA | H4 | 27 | 0 | yes | – | 0 | 100 | IICLGHHA | 100 | | |
| HA | H4 | 28 | 0 | yes | – | 0 | 100 | ICLGHHAV | 100 | | |
| HA | H4 | 29 | 0 | yes | – | 0 | 100 | CLGHHAVE | 100 | | |
| HA | H4 | 30 | 0 | yes | – | 0 | 100 | LGHHAVEN | 100 | | |
| HA | H4 | 31 | 0 | yes | – | 0 | 100 | GHHAVENG | 100 | | |
| HA | H4 | 32 | 0 | yes | – | 0 | 100 | HHAVENGT | 100 | | |
| HA | H4 | 33 | 0 | yes | – | 0 | 100 | HAVENGTS | 100 | | |
| HA | H4 | 34 | 0 | yes | – | 0 | 100 | AVENGTSY | 100 | | |
| HA | H4 | 35 | 0 | yes | – | 0 | 100 | VENGTSVK | 100 | | |
| HA | H4 | 36 | 0 | yes | – | 0 | 100 | ENGTSVKT | 100 | | |
| HA | H4 | 37 | 0 | yes | – | 0 | 100 | NGTSVKTL | 100 | | |
| HA | H4 | 38 | 0 | yes | – | 0 | 100 | GTSVKTLT | 100 | | |
| HA | H4 | 39 | 0 | yes | – | 0 | 100 | TSVKTLTD | 100 | | |
| HA | H4 | 40 | 0 | yes | – | 0 | 100 | SVKTLTDN | 100 | | |
| HA | H4 | 41 | 0 | yes | – | 0 | 100 | VKTLTDNH | 100 | | |

FIG. 73-107

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H14 | 42 | 0 | yes | - | 0 | 100 | VKTLTDNHV | 100 |
| HA | H14 | 43

FIG. 73-108

| Protein | Sub-type | Start Pos | Block Entropy | Gaps > 10% | # to cover 99% | Gap % | Coverage | Peptides included | Freq |
|---|---|---|---|---|---|---|---|---|---|
| HA | H14 | 83 | 0 | yes | — | 0 | 100 | INGALG

FIG. 73-109

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 124 | 0 | yes | 1 | 0 | 100 | LRSILASSG | 100 | | | | | | |
| HA | H4 | 125 | 0 | yes | 1 | 0 | 100 | RSILASSGS | 100 | | | | | | |
| HA | H4 | 126 | 0 | yes | 1 | 0 | 100 | SILASSGSL | 100 | | | | | | |
| HA | H4 | 127 | 0 | yes | 1 | 0 | 100 | ILASSGSLE | 100 | | | | | | |
| HA | H4 | 128 | 0 | yes | 1 | 0 | 100 | LASSGSLEF | 100 | | | | | | |
| HA | H4 | 129 | 0 | yes | 1 | 0 | 100 | ASSGSLEFI | 100 | | | | | | |
| HA | H4 | 130 | 0 | yes | 1 | 0 | 100 | SSGSLEFIA | 100 | | | | | | |
| HA | H4 | 131 | 0 | yes | 1 | 0 | 100 | SGSLEFIAE | 100 | | | | | | |
| HA | H4 | 132 | 0 | yes | 1 | 0 | 100 | GSLEFIAEQ | 100 | | | | | | |
| HA | H4 | 133 | 0 | yes | 1 | 0 | 100 | SLEFIAEQF | 100 | | | | | | |
| HA | H4 | 134 | 0 | yes | 1 | 0 | 100 | LEFIAEQFT | 100 | | | | | | |
| HA | H4 | 135 | 0 | yes | 1 | 0 | 100 | EFIAEQFTW | 100 | | | | | | |
| HA | H4 | 136 | 0 | yes | 1 | 0 | 100 | FIAEQFTWN | 100 | | | | | | |
| HA | H4 | 137 | 0 | yes | 1 | 0 | 100 | IAEQFTWNG | 100 | | | | | | |
| HA | H4 | 138 | 0 | yes | 1 | 0 | 100 | AEQFTWNGV | 100 | | | | | | |
| HA | H4 | 139 | 0 | yes | 1 | 0 | 100 | EQFTWNGVK | 100 | | | | | | |
| HA | H4 | 140 | 0 | yes | 1 | 0 | 100 | QFTWNGVKV | 100 | | | | | | |
| HA | H4 | 141 | 0 | yes | 1 | 0 | 100 | FTWNGVKVD | 100 | | | | | | |
| HA | H4 | 142 | 0 | yes | 1 | 0 | 100 | TWNGVKVDG | 100 | | | | | | |
| HA | H4 | 143 | 0 | yes | 1 | 0 | 100 | WNGVKVDGS | 100 | | | | | | |
| HA | H4 | 144 | 0 | yes | 1 | 0 | 100 | NGVKVDGSS | 100 | | | | | | |
| HA | H4 | 145 | 0 | yes | 1 | 0 | 100 | GVKVDGSSS | 100 | | | | | | |
| HA | H4 | 146 | 0 | yes | 1 | 0 | 100 | VKVDGSSSA | 100 | | | | | | |
| HA | H4 | 147 | 0 | yes | 1 | 0 | 100 | KVDGSSSAC | 100 | | | | | | |
| HA | H4 | 148 | 0 | yes | 1 | 0 | 100 | VDGSSSACL | 100 | | | | | | |
| HA | H4 | 149 | 0 | yes | 1 | 0 | 100 | DGSSSACLR | 100 | | | | | | |
| HA | H4 | 150 | 0 | yes | 1 | 0 | 100 | GSSSACLRG | 100 | | | | | | |
| HA | H4 | 151 | 0 | yes | 1 | 0 | 100 | SSSACLRGG | 100 | | | | | | |
| HA | H4 | 152 | 0 | yes | 1 | 0 | 100 | SSACLRGGR | 100 | | | | | | |
| HA | H4 | 153 | 0 | yes | 1 | 0 | 100 | SACLRGGRN | 100 | | | | | | |
| HA | H4 | 154 | 0 | yes | 1 | 0 | 100 | ACLRGGRNS | 100 | | | | | | |
| HA | H4 | 155 | 0 | yes | 1 | 0 | 100 | CLRGGRNSF | 100 | | | | | | |
| HA | H4 | 156 | 0 | yes | 1 | 0 | 100 | LRGGRNSFF | 100 | | | | | | |
| HA | H4 | 157 | 0 | yes | 1 | 0 | 100 | RGGRNSFFS | 100 | | | | | | |
| HA | H4 | 158 | 0 | yes | 1 | 0 | 100 | GGRNSFFSR | 100 | | | | | | |
| HA | H4 | 159 | 0 | yes | 1 | 0 | 100 | GRNSFFSRL | 100 | | | | | | |
| HA | H4 | 160 | 0 | yes | 1 | 0 | 100 | RNSFFSRLN | 100 | | | | | | |
| HA | H4 | 161 | 0 | yes | 1 | 0 | 100 | NSFFSRLNW | 100 | | | | | | |
| HA | H4 | 162 | 0 | yes | 1 | 0 | 100 | SFFSRLNWL | 100 | | | | | | |
| HA | H4 | 163 | 0 | yes | 1 | 0 | 100 | FFSRLNWLT | 100 | | | | | | |
| HA | H4 | 164 | 0 | yes | 1 | 0 | 100 | FSRLNWLTK | 100 | | | | | | |

FIG. 73-110

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|
| HA | H14 | 165 | 0.81 | yes | 2 | 0 | 100 | SRLNWLTKA | 75 | SRLNWLTKE | 25 | | | | |
| HA | H14 | 166 | 0.81 | yes | 2 | 0 | 100 | RLNWLTKAT | 75 | RLNWLTKET | 25 | | | | |
| HA | H14 | 167 | 0.81 | yes | 2 | 0 | 100 | LNWLTKATN | 75 | LNWLTKETN | 25 | | | | |
| HA | H14 | 168 | 0.81 | yes | 2 | 0 | 100 | NWLTKATNG | 75 | NWLTKETNG | 25 | | | | |
| HA | H14 | 169 | 0.81 | yes | 2 | 0 | 100 | WLTKATNGN | 75 | WLTKETNGN | 25 | | | | |
| HA | H14 | 170 | 0.81 | yes | 2 | 0 | 100 | LTKATNGNY | 75 | LTKETNGNY | 25 | | | | |
| HA | H14 | 171 | 0.81 | yes | 2 | 0 | 100 | TKATNGNYG | 75 | TKETNGNYG | 25 | | | | |
| HA | H14 | 172 | 0.81 | yes | 2 | 0 | 100 | KATNGNYGP | 75 | KETNGNYGP | 25 | | | | |
| HA | H14 | 173 | 0.81 | yes | 2 | 0 | 100 | ATNGNYGPI | 75 | ETNGNYGPI | 25 | | | | |
| HA | H14 | 174 | 0 | yes | 1 | 0 | 100 | TNGNYGPIN | 100 | | | | | | |
| HA | H14 | 175 | 0 | yes | 1 | 0 | 100 | NGNYGPINV | 100 | | | | | | |
| HA | H14 | 176 | 0 | yes | 1 | 0 | 100 | GNYGPINVT | 100 | | | | | | |
| HA | H14 | 177 | 0 | yes | 1 | 0 | 100 | NYGPINVTK | 100 | | | | | | |
| HA | H14 | 178 | 0 | yes | 1 | 0 | 100 | YGPINVTKE | 100 | | | | | | |
| HA | H14 | 179 | 0 | yes | 1 | 0 | 100 | GPINVTKEN | 100 | | | | | | |
| HA | H14 | 180 | 0 | yes | 1 | 0 | 100 | PINVTKENT | 100 | | | | | | |
| HA | H14 | 181 | 0 | yes | 1 | 0 | 100 | INVTKENTG | 100 | | | | | | |
| HA | H14 | 182 | 0 | yes | 1 | 0 | 100 | NVTKENTGS | 100 | | | | | | |
| HA | H14 | 183 | 0 | yes | 1 | 0 | 100 | VTKENTGSY | 100 | | | | | | |
| HA | H14 | 184 | 0 | yes | 1 | 0 | 100 | TKENTGSYY | 100 | | | | | | |
| HA | H14 | 185 | 0 | yes | 1 | 0 | 100 | KENTGSYYR | 100 | | | | | | |
| HA | H14 | 186 | 0 | yes | 1 | 0 | 100 | ENTGSYYRL | 100 | | | | | | |
| HA | H14 | 187 | 0 | yes | 1 | 0 | 100 | NTGSYYRLY | 100 | | | | | | |
| HA | H14 | 188 | 0 | yes | 1 | 0 | 100 | TGSYYRLYL | 100 | | | | | | |
| HA | H14 | 189 | 0 | yes | 1 | 0 | 100 | GSYYRLYLW | 100 | | | | | | |
| HA | H14 | 190 | 0 | yes | 1 | 0 | 100 | SYYRLYLWG | 100 | | | | | | |
| HA | H14 | 191 | 0 | yes | 1 | 0 | 100 | YYRLYLWGV | 100 | | | | | | |
| HA | H14 | 192 | 0 | yes | 1 | 0 | 100 | YRLYLWGVH | 100 | | | | | | |
| HA | H14 | 193 | 0 | yes | 1 | 0 | 100 | RLYLWGVHH | 100 | | | | | | |
| HA | H14 | 194 | 0 | yes | 1 | 0 | 100 | LYLWGVHHP | 100 | | | | | | |
| HA | H14 | 195 | 0 | yes | 1 | 0 | 100 | YLWGVHHPS | 100 | | | | | | |
| HA | H14 | 196 | 0 | yes | 1 | 0 | 100 | LWGVHHPSS | 100 | | | | | | |
| HA | H14 | 197 | 0 | yes | 1 | 0 | 100 | WGVHHPSSD | 100 | | | | | | |
| HA | H14 | 198 | 0 | yes | 1 | 0 | 100 | GVHHPSSDN | 100 | | | | | | |
| HA | H14 | 199 | 0 | yes | 1 | 0 | 100 | VHHPSSDNE | 100 | | | | | | |
| HA | H14 | 200 | 0 | yes | 1 | 0 | 100 | HHPSSDNEQ | 100 | | | | | | |
| HA | H14 | 201 | 0 | yes | 1 | 0 | 100 | HPSSDNEQT | 100 | | | | | | |
| HA | H14 | 202 | 0 | yes | 1 | 0 | 100 | PSSDNEQTD | 100 | | | | | | |
| HA | H14 | 203 | 0 | yes | 1 | 0 | 100 | SSDNEQTDL | 100 | | | | | | |
| HA | H14 | 204 | 0 | yes | 1 | 0 | 100 | SDNEQTDLY | 100 | | | | | | |
| HA | H14 | 205 | 0 | yes | 1 | 0 | 100 | DNEQTDLYK | 100 | | | | | | |

FIG. 73-111

| Protein | Sub-type | Start Pos | Block Entropy | Gaps < 10% | # to cover 99% | Gap % | Coverage | Peptides induced | Freq |
|---|---|---|---|---|---|---|---|---|---|
| HA | H14 | 206 | 0 | yes | - | 0 | 100 | NEQTDLYK

FIG. 73-112

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 247 | 0 | yes | - | 0 | 100 | ISIYWTLVN | 100 | | | | | | |

FIG. 73-114

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H14 | 329 | 0 | yes | 1 | 0 | 100 | QGS

FIG. 73-115

| Protein | Sub-type | Start Pos | Block Entropy | Gaps < 10% | # to cover 99% | % Gap | Coverage | Peptides included | Freq |
|---|---|---|---|---|---|---|---|---|---|
| HA | H14 | 370 | 0 | yes | — | 0 | 100 | GFRHQNAEG | 100 |
| HA | H14 | 371 | 0 | yes | — | 0 | 100 | FRHQNAEGT

FIG. 73-116

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H1 | 411 | 0 | yes | – | 0 | 100 | HQIEKEFFEQ

FIG. 73-117

| Protein | Sub-type | Start Pos | Block Entropy | Gaps <10% | # to cover 99% | Gap % | Coverage | Peptides included | Freq |
|---|---|---|---|---|---|---|---|---|---|
| HA | H14 | 452 | 0 | yes | - | 0 | 100 | QHTIDVTDS | 100 |

FIG. 73-118

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 493 | 0 | yes | - | 0 | 100 | NNCIESIRN | 100 | |

FIG. 73-120

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 15 | 0.85 | yes | 2 | 0 | 100 | MVKSDKICL | 72.73 | MVKSDKICL | 27.27 | | | | |
| HA | H15 | 16 | 0.85 | yes | 2 | 0 | 100 | VKSDKICLG | 72.73 | VRSDKICLG | 27.27 | | | | |
| HA | H15 | 17 | 0.85 | yes | 2 | 0 | 100 | KSDKICLGH | 72.73 | RSDKICLGH | 27.27 | | | | |
| HA | H15 | 18 | 0 | yes | 1 | 0 | 100 | SDKICLGHH | 100 | | | | | | |
| HA | H15 | 19 | 0 | yes | 1 | 0 | 100 | DKICLGHHA | 100 | | | | | | |
| HA | H15 | 20 | 0.44 | yes | 2 | 0 | 100 | KICLGHHAV | 100 | | | | | | |
| HA | H15 | 21 | 0.44 | yes | 2 | 0 | 100 | ICLGHHAVA | 90.91 | ICLGHHAVP | 9.09 | | | | |
| HA | H15 | 22 | 0.44 | yes | 2 | 0 | 100 | CLGHHAVAN | 90.91 | CLGHHAVPN | 9.09 | | | | |
| HA | H15 | 23 | 0.44 | yes | 2 | 0 | 100 | LGHHAVANG | 90.91 | LGHHAVPNG | 9.09 | | | | |
| HA | H15 | 24 | 0.44 | yes | 2 | 0 | 100 | GHHAVANGT | 90.91 | GHHAVPNGT | 9.09 | | | | |
| HA | H15 | 25 | 0.44 | yes | 2 | 0 | 100 | HHAVANGTK | 90.91 | HHAVPNGTK | 9.09 | | | | |
| HA | H15 | 26 | 0.44 | yes | 2 | 0 | 100 | HAVANGTKV | 90.91 | HAVPNGTKV | 9.09 | | | | |
| HA | H15 | 27 | 0.44 | yes | 2 | 0 | 100 | AVANGTKVN | 90.91 | AVPNGTKVN | 9.09 | | | | |
| HA | H15 | 28 | 0.44 | yes | 2 | 0 | 100 | VANGTKVNT | 90.91 | VPNGTKVNT | 9.09 | | | | |
| HA | H15 | 29 | 0.44 | yes | 2 | 0 | 100 | ANGTKVNTL | 90.91 | PNGTKVNTL | 9.09 | | | | |
| HA | H15 | 30 | 0 | yes | 1 | 0 | 100 | NGTKVNTLT | 100 | | | | | | |
| HA | H15 | 31 | 0 | yes | 1 | 0 | 100 | GTKVNTLTE | 100 | | | | | | |
| HA | H15 | 32 | 0.85 | yes | 2 | 0 | 100 | TKVNTLTER | 72.73 | TKVNTLTEK | 27.27 | | | | |
| HA | H15 | 33 | 0.85 | yes | 2 | 0 | 100 | KVNTLTERG | 72.73 | KVNTLTEKG | 27.27 | | | | |
| HA | H15 | 34 | 0.85 | yes | 2 | 0 | 100 | VNTLTERGV | 72.73 | VNTLTEKGV | 27.27 | | | | |
| HA | H15 | 35 | 0.85 | yes | 2 | 0 | 100 | NTLTERGVE | 72.73 | NTLTEKGVE | 27.27 | | | | |
| HA | H15 | 36 | 0.85 | yes | 2 | 0 | 100 | TLTERGVEV | 72.73 | TLTEKGVEV | 27.27 | | | | |
| HA | H15 | 37 | 0.85 | yes | 2 | 0 | 100 | LTERGVEVV | 72.73 | LTEKGVEVV | 27.27 | | | | |
| HA | H15 | 38 | 0.85 | yes | 2 | 0 | 100 | TERGVEVVN | 72.73 | TEKGVEVVN | 27.27 | | | | |
| HA | H15 | 39 | 0.85 | yes | 2 | 0 | 100 | ERGVEVVNA | 72.73 | EKGVEVVNA | 27.27 | | | | |
| HA | H15 | 40 | 0.85 | yes | 2 | 0 | 100 | RGVEVVNAT | 72.73 | KGVEVVNAT | 27.27 | | | | |
| HA | H15 | 41 | 0 | yes | 1 | 0 | 100 | GVEVVNATE | 100 | | | | | | |
| HA | H15 | 42 | 0 | yes | 1 | 0 | 100 | VEVVNATET | 100 | | | | | | |
| HA | H15 | 43 | 0 | yes | 1 | 0 | 100 | EVVNATETV | 100 | | | | | | |
| HA | H15 | 44 | 0 | yes | 1 | 0 | 100 | VVNATETVE | 100 | | | | | | |
| HA | H15 | 45 | 0 | yes | 1 | 0 | 100 | VNATETVEI | 100 | | | | | | |
| HA | H15 | 46 | 0 | yes | 1 | 0 | 100 | NATETVEIT | 100 | | | | | | |
| HA | H15 | 47 | 0 | yes | 1 | 0 | 100 | ATETVEITG | 100 | | | | | | |
| HA | H15 | 48 | 0 | yes | 1 | 0 | 100 | TETVEITGI | 100 | | | | | | |
| HA | H15 | 49 | 0.85 | yes | 2 | 0 | 100 | ETVEITGID | 72.73 | ETVEITGIN | 27.27 | | | | |
| HA | H15 | 50 | 0.85 | yes | 2 | 0 | 100 | TVEITGIDK | 72.73 | TVEITGINK | 27.27 | | | | |
| HA | H15 | 51 | 0.85 | yes | 2 | 0 | 100 | VEITGIDKV | 72.73 | VEITGINKV | 27.27 | | | | |
| HA | H15 | 52 | 0.85 | yes | 2 | 0 | 100 | EITGIDKVC | 72.73 | EITGINKVC | 27.27 | | | | |
| HA | H15 | 53 | 0.85 | yes | 2 | 0 | 100 | ITGIDKVCT | 72.73 | ITGINKVCT | 27.27 | | | | |
| HA | H15 | 54 | 0.85 | yes | 2 | 0 | 100 | TGIDKVCTK | 72.73 | TGINKVCTK | 27.27 | | | | |
| HA | H15 | 55 | 0 | yes | 2 | 0 | 100 | GIDKVCTKG | 100 | GINKVCTKG | 27.27 | | | | |

FIG. 73-121

| Protein | Sub-type | Start Pos | Block Entropy | Gaps <10% | # to cover 99% | Gap % | Coverage | Peptides included | Freq | Peptides included | Freq |
|---|---|---|---|---|---|---|---|---|---|---|---|
| HA | H15 | 56 | 0.85 | yes | 2 | 0 | 100 | IDKVCTKGK | 72.73 | INKVCTKGK | 27.27 |
| HA | H15 | 57 | 0.85 | yes | 2 | 0 | 100 | DKVCTKGKK | 72.73 | NKVCTKGKK | 27.27 |
| HA

FIG. 73-122

| Protein | Sub-type | Start Pos | Block Entropy | Gaps < 10% | # to cover 99% | Gap % | Coverage | Induced Peptides | Freq | Induced Peptides | Freq |
|---|---|---|---|---|---|---|---|---|---|---|---|
| HA | H15 | 97 | 0 | yes | 1 | 0 | 100 | ERRNSSDIC | 100 | | |
| HA | H15 | 98 | 0 | yes | 1 | 0 | 100 | RRNSSDICY | 100 | | |
| HA | H15 | 99 | 0 | yes | 1 | 0 | 100 | RNSSDICYP | 100 | | |
| HA | H15 | 100 | 0 | yes | 2 | 0 | 100 | NSSDICYPG | 100 | | |
| HA | H15 | 101 | 0.85 | yes | 2 | 0 | 100 | SSDICYPGR | 72.73 | SSDICYPGK | 27.27 |
| HA | H15 | 102 | 0.85 | yes | 2 | 0 | 100 | SDICYPGRF | 72.73 | SDICYPGKF | 27.27 |
| HA | H15 | 103 | 0.85 | yes | 2 | 0 | 100 | DICYPGRFT | 72.73 | DICYPGKFT | 27.27 |
| HA | H15 | 104 | 0.85 | yes | 2 | 0 | 100 | ICYPGRFTN | 72.73 | ICYPGKFTN | 27.27 |
| HA | H15 | 105 | 0.85 | yes | 2 | 0 | 100 | CYPGRFTNE | 72.73 | CYPGKFTN

FIG. 73-124

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 179 | 0.85 | yes | 2 | 0

FIG. 73-125

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 220 | 0.85 | yes | 2 | 0 |

FIG. 73-126

| Protein | Sub-type | Start Pos | Block | Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|---|
| HA | H15 | 261 | 0 | 0 | yes | 1 | 0 | 100 | IAPDRATFL | 100 | | | | | | |
| HA | H15 | 262 | 0 | 0 | yes | 1 | 0 | 100 | APDRAT

FIG. 73-128

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 343 | 1.24 | yes | 3 | 0 | 100 | PEKIRTRGL | 63.64 | PEKIHTRGL | 27.27 | PEKIRVKRR | 9.09 | | |
| HA | H5 | 344 | 1.24 | yes | 3 | 0 | 100 | EKIRTRGLF | 63.64 | EKIHTRGLF | 27.27 | EKIRVKRR

FIG. 73-129

| Protein | Sub-type | Start Pos | Block Entropy | Gaps <10% | # to cover 99% | Gap % | Coverage | Peptides included | Freq | Peptides included | Freq |
|---|---|---|---|---|---|---|---|---|---|---|---|
| HA | H5 | 384 | 0 | yes | 1 | 0 | 100 | AADYKSTQA | 100 | | |
| HA | H5 | 385 | 0 | yes | 1 | 0 | 100 | ADYKSTQAA | 100 | | |
| HA | H5 | 386 | 0

FIG. 73-130

| Protein | Sub-type | Start Pos | Block Entropy | Gaps <10% | # to cover 99% | Gap % | Coverage | Peptides included | Freq |
|---|---|---|---|---|---|---|---|---|---|
| HA | H15 | 425 | 0 | yes | - | 0 | 100 | QIGNVINWT | 100 |
| HA | H15 | 426 | 0 | yes | - | 0 | 100 | IGNVINWTR | 100 |
| HA | H15 | 427 | 0 | yes | - | 0 | 100 | GNVINWTRD | 100 |
| HA | H15 | 428 | 0 | yes | - | 0 | 100 | NVINWTRDS | 100 |
| HA | H15 | 429 | 0 | yes | - | 0 | 100 | VINWTRDSL | 100 |
| HA | H15 | 430 | 0 | yes | - | 0 | 100 | INWTRDSLT | 100 |
| HA | H15 | 431 | 0 | yes | - | 0 | 100 | NWTRDSLTE | 100 |
| HA | H15 | 432 | 0 | yes | - | 0 | 100 | WTRDSLTEI | 100 |
| HA | H15 | 433 | 0 | yes | - | 0 | 100 | TRDSLTEIW | 100 |
| HA | H15 | 434 | 0 | yes | - | 0 | 100 | RDSLTEIWS | 100 |
| HA | H15 | 435 | 0 | yes | - | 0 | 100 | DSLTEIWSY | 100 |
| HA | H15 | 436 | 0 | yes | - | 0 | 100 | SLTEIWSYN | 100 |
|

FIG. 73-131

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H15 | 466 | 0 | yes | — | 0 | 100 | KLY

FIG. 73-132

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 507 | 0 | yes | 1 | 0 | 100 | NHTEYRQEA | 100 | | | | | | |
| HA | H5 | 508 | 0 | yes | 1 | 0 | 100 | HTEYRQEAL | 100 | | | | | | |
| HA | H5 | 509 | 0 | yes | 1 | 0 | 100 | TEYRQEALQ | 100 | | | | | | |
| HA | H5 | 510 | 0 | yes | 1 | 0 | 100 | EYRQEALQ

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 40 | 0.59 | yes | 2 | 0 | 100 | LTENGVPVT | 85.71 | LTETGVPVT | 14.29 | | | | |
| HA | H16 | 41 | 0.59 | yes | 2 | 0 | 100 | TENGVPVTS | 85.71 | TETGVPVTS | 14.29 | | | | |
| HA | H16 | 42 | 0.59 | yes | 3 | 0 | 100 | ENGVPVTSS | 85.71 | ETGVPVTSS | 14.29 | | | | |
| HA | H16 | 43 | 1.44 | yes | 3 | 0 | 100 | NGVPVTSSI | 47.62 | NGVPVTSSV | 38.1 | | | | |
| HA | H16 | 44 | — | yes | 2 | 0 | 100 | GVPVTSSVD | 52.38 | GVPVTSSI | 47.62 | TGVPVTSSV | 14.29 | | |
| HA | H16 | 45 | — | yes | 2 | 0 | 100 | VPVTSSVDL | 52.38 | VPVTSSID | 47.62 | | | | |
| HA | H16 | 46 | — | yes | 2 | 0 | 100 | PVTSSVDLY | 52.38 | PVTSSIDL | 47.62 | | | | |
| HA | H16 | 47 | — | yes | 2 | 0 | 100 | VTSSVDLVE | 52.38 | VTSSIDLY | 47.62 | | | | |
| HA | H16 | 48 | — | yes | 2 | 0 | 100 | TSSVDLVET | 52.38 | TSSIDLVE | 47.62 | | | | |
| HA | H16 | 49 | — | yes | 2 | 0 | 100 | SSVDLVETN | 52.38 | SSIDLVET | 47.62 | | | | |
| HA | H16 | 50 | — | yes | 2 | 0 | 100 | SVDLVETNH | 52.38 | SIDLVETN | 47.62 | | | | |
| HA | H16 | 51 | — | yes | 2 | 0 | 100 | VDLVETNHTG | 52.38 | IDLVETNH | 47.62 | | | | |
| HA | H16 | 52 | 0 | yes | 1 | 0 | 100 | DLVETNHTG | 100 | | | | | | |
| HA | H16 | 53 | 0 | yes | 1 | 0 | 100 | LVETNHTGT | 100 | | | | | | |
| HA | H16 | 54 | 0 | yes | 1 | 0 | 100 | VETNHTGTY | 100 | | | | | | |

FIG. 73-135

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 81 | 0 | yes | 1 | 0 | 100 | WIVGNPSCA | 100 | | | | | | |
| HA | H16 | 82 | 0.79 | yes | 2 | 0 | 100 | IVGNPSCAT | 76.19 | IVGNPSCAS | 23.81 | | | | |
| HA | H16 | 83 | 0.79 | yes | 2 | 0 | 100 | VGNPSCATN | 76.19 | VGNPSCASN | 23.81 | | | | |
| HA | H16 | 84 | 0.79 | yes | 2 | 0 | 100 | GNPSCATNI | 76.19 | GNPSCASNI | 23.81 | | | | |
| HA | H16 | 85 | 0.79 | yes | 2 | 0 | 100 | NPSCATNIN | 76.19 | NPSCASNIN | 23.81 | | | | |
| HA | H16 | 86 | 0.79 | yes | 2 | 0 | 100 | PSCATNINI | 76.19 | PSCASNINI | 23.81 | | | | |
| HA | H16 | 87 | 0.79 | yes | 2 | 0 | 100 | SCATNINIR | 76.19 | SCASNINIR | 23.81 | | | | |
| HA | H16 | 88 | 0.79 | yes | 2 | 0 | 100 | CATNINIRE | 76.19 | CASNINIRE | 23.81 | | | | |
| HA | H16 | 89 | 0.79 | yes | 2 | 0 | 100 | ATNINIREW | 76.19 | ASNINIREW | 23.81 | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 237 | 0.29 | yes | 2 | 4.76

FIG. 73-139

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 281 | 0.96 | yes | 3 | 0 | 100 | GRIFQSGVR | 76.19 | GRIFQSGIR | 19.05 | | | | |
| HA | H16 | 282 | 1.88 | yes | 5 | 0 | 100 | RIFQSGVRM | 47.62 | RIFQSGVRL | 23.81 | RIFQSRIRM | 4.76 | RIFQSGVRV | 4.76 |
| HA | H16 | 283 | 1.88 | yes | 5 | 0 | 100 | IFQSGVRMA | 47.62 | IFQSGVRLA | 23.81 | IFQSGIRMA | 23.81 | IFQSRIRMG | 4.76 |
| HA | H16 | 289 | 1.7 | yes | 3 | 0 | 100 | RMAKCNTKC | 57.14 | RLAKCNTKC | 23.81 | RMARCNTKC | 23.81 | RVARCNTKC | 4.76 |
| HA | H16 | 290 | 1.7 | yes | 3 | 0 | 100 | MAKCNTKCQ | 57.14 | LAKCNTKCQ | 14.29 | MARCNTKCQ | 23.81 | VARCNTKCQ | 4.76 |
| HA | H16 | 291 | 0.86 | yes | 2 | 0 | 100 | AKCNTKCQT | 80.95 | ARCNTKCQT | 14.29 | | | | |
| HA | H16 | 292 | 0.59 | yes | 2 | 0 | 100 | KCNTKCQTS | 85.71 | RCNTKCQTS | 28.57 | | | | |
| HA | H16 | 293 | 1.56 | yes | 3 | 0 | 100 | CNTKCQTSM | 42.86 | CNTKCQTSL | 28.57 | CNTKCQTSV | 28.57 | | |
| HA | H16 | 294 | 1.56 | yes | 3 | 0 | 100 | NTKCQTSMG | 42.86 | NTKCQTSLG | 28.57 | NTKCQTSVG | 28.57 | | |
| HA | H16 | 295 | 1.56 | yes | 3 | 0 | 100 | TKCQTSMGG | 28.57 | TKCQTSLGG | 28.57 | TKCQTSVGG | 28.57 | | |
| HA | H16 | 296 | 2.17 | yes | 4 | 0 | 100 | KCQTSMGGI | 23.81 | KCQTSLGGI | 23.81 | KCQTSVGGI | 28.57 | KCQTSMGGV | 19.05 | KCQTSLGGV | 4.76 |
| HA | H16 | 302 | 1.05 | yes | 3 | 0 | 100 | GGIDTNKTF | 71.43 | GGIDTNKTF | 23.81 | | | | |
| HA | H16 | 303 | 1.05 | yes | 3 | 0 | 100 | GIDTNKTFQ | 71.43 | GIDTNKTFQ | 23.81 | | | | |
| HA | H16 | 304 | 1.05 | yes | 3 | 0 | 100 | IDTNKTFQN | 71.43 | IDTNKTFQN | 23.81 | | | | |
| HA | H16 | 305 | 0.28 | yes | 1 | 0 | 100 | DTNKTFQNI | 95.24 | | | | | |
| HA | H16 | 306 | 0.86 | yes | 2 | 0 | 100 | TNKTFQNID | 71.43 | | | | | |
| HA | H16 | 307 | 1.27 | yes | 3 | 0 | 100 | NKTFQNIDR | 61.9 | NKTFQNIEK | 9.52 | | | | |
| HA | H16 | 308 | 1.27 | yes | 3 | 0 | 100 | KTFQNIDRN | 61.9 | KTFQNIEKN | 9.52 | | | | |
| HA | H16 | 309 | 1.27 | yes | 3 | 0 | 100 | TFQNIDRNA | 61.9 | TFQNIEKNA | 9.52 | | | | |
| HA | H16 | 310 | 1.27 | yes | 3 | 0 | 100 | FQNIDRNAI | 61.9 | FQNIEKNAL | 9.52 | | | | |
| HA | H16 | 311 | 1.27 | yes | 3 | 0 | 100 | QNIDRNAIG | 61.9 | QNIEKNALG | 9.52 | | | | |
| HA | H16 | 312 | 1.27 | yes | 3 | 0 | 100 | NIDRNAIGD | 61.9 | NIEKNALGD | 9.52 | | | | |
| HA | H16 | 313 | 1.27 | yes | 3 | 0 | 100 | IDRNAIGDC | 61.9 | IEKNALGDC | 9.52 | | | | |
| HA | H16 | 314 | 1.27 | yes | 3 | 0 | 100 | DRNAIGDCP | 61.9 | EKNALGDCP | 9.52 | | | | |
| HA | H16 | 315 | 1.27 | yes | 3 | 0 | 100 | RNAIGDCPK | 61.9 | KNALGDCPK | 9.52 | | | | |
| HA | H16 | 316 | 0.86 | yes | 2 | 0 | 100 | NAIGDCPKY | 71.43 | | | | | |
| HA | H16 | 317 | 0.86 | yes | 2 | 0 | 100 | AIGDCPKYI | 71.43 | | | | | |
| HA | H16 | 318 | 0.86 | yes | 2 | 0 | 100 | IGDCPKYIK | 71.43 | | | | | |
| HA | H16 | 319 | 0 | yes | 1 | 0 | 100 | GDCPKYIKS | 100 | | | | | |
| HA | H16 | 320 | 0 | yes | 1 | 0 | 100 | DCPKYIKSG | 100 | | | | | |
| HA | H16 | 321 | 0 | yes | 1 | 0 | 100 | CPKYIKSGQ | 100 | | | | | |
| HA | H16 | 322 | 0 | yes | 1 | 0 | 100 | PKYIKSGQL | 100 | | | | | |
| HA | H16 | 323 | 0 | yes | 1 | 0 | 100 | KYIKSGQLK | 100 | | | | | |
| HA | H16 | 324 | 0 | yes | 1 | 0 | 100 | YIKSGQLKL | 100 | | | | | |
| HA | H16 | 325 | 0 | yes | 1 | 0 | 100 | IKSGQLKLA | 100 | | | | | |
| HA | H16 | 326 | 0 | yes | 1 | 0 | 100 | KSGQLKLAT | 100 | | | | | |
| HA | H16 | 327 | 0 | yes | 1 | 0 | 100 | SGQLKLATG | 100 | | | | | |
| HA | H16 | 328 | 0 | yes | 1 | 0 | 100 | GQLKLATGL | 100 | | | | | |
| HA | H16 | 329 | 0 | yes | 1 | 0 | 100 | QLKLATGLR | 100 | | | | | |
| HA | H16 | 330 | 0 | yes | 1 | 0 | 100 | LKLATGLRN | 100 | | | | | |
| HA | H16 | 331 | 0 | yes | 1 | 0 | 100 | KLATGLRNV | 100 | | | | | |

FIG. 73-140

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 332 | 0 | yes | 1 | 0 | 100 | LATGLRNVP | 100 | | | | | | |
| HA | H16 | 333 | 0.28 | yes | 2 | 0 | 100 | ATGLRNVPS | 95.24 | ATGLRNVPI | 4.76 | | | | |
| HA | H16 | 334 | 0.55 | yes | 3 | 0 | 100 | TGLRNVPSI | 90.48 | TGLRNVPIP

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 472 | 1.7 | yes | 4 | 0 | 100 | LKNNA

FIG. 73-144

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 513 | 0.28 | yes | 2 | 0 | 100 | QLKKQEIEG | 95.24 | QLKKQEIEG | 95.24 | | | | |
| HA | H16 | 514 | 0.28 | yes | 2 | 0 | 100 | LKRQEIEGI | 95.24 | LKKQEIEGI | 95.24 | | | | |
| HA | H16 | 515 | 0.28 | yes | 2 | 0 | 100 | KRQEIEGIK | 95.24 | KKQEIEGIK | 95.24 | | | | |
| HA | H16 | 516 | 0.28 | yes | 2 | 0 | 100 | RQEIEGIKL | 95.24 | KQEIEGIKL | 95.24 | | | | |
| HA | H16 | 517 | 0 | yes | 1 | 0 | 100 | QEIEGIKLK | 100 | | | | | | |
| HA | H16 | 518 | 0.28 | yes | 2 | 0 | 100 | EIEGIKLKT | 95.24 | EIEGIKLKS | 4.76 | | | | |
| HA | H16 | 519 | 0.28 | yes | 2 | 0 | 100 | IEGIKLKTE | 95.24 | IEGIKLKSE | 4.76 | | | | |
| HA | H16 | 520 | 0.28 | yes | 2 | 0 | 100 | EGIKLKTED | 95.24 | EGIKLKSED | 4.76 | | | | |
| HA | H16 | 521 | 0.28 | yes | 2 | 0 | 100 | GIKLKTEDN | 95.24 | GIKLKSEDN | 4.76 | | | | |
| HA | H16 | 522 | 0.72 | yes | 3 | 0 | 100 | IKLKTEDNY | 85.71 | IKLKSEDNV | 9.52 | KSEDNVYKV | 4.76 | | | |
| HA | H16 | 523 | 0.72 | yes | 3 | 0 | 100 | KLKTEDNYY | 85.71 | KLKSEDNYY | 9.52 | SEDNVYKVL | 4.76 | | | |
| HA | H16 | 524 | 0.72 | yes | 3 | 0 | 100 | LKTEDNYYK | 85.71 | LKSEDNYYK | 9.52 | EDNVYKVLA | 9.52 | | | |
| HA | H16 | 525 | 1.57 | yes | 4 | 0 | 100 | KTEDNYYKI | 47.62 | KTEDNIYKI | 38.1 | DNVYKVLAI | 9.52 | | | |
| HA | H16 | 526 | 1.57 | yes | 4 | 0 | 100 | TEDNYYKIL | 47.62 | TEDNIYKIL | 38.1 | NVYKVLAIY | 9.52 | | | |
| HA | H16 | 527 | 1.7 | yes | 4 | 0 | 100 | EDNYYKILS | 42.86 | EDNIYKILS | 38.1 | IYKILSIYS | 9.52 | | | |
| HA | H16 | 528 | 1.7 | yes | 4 | 0 | 100 | DNYYKVLSI | 42.86 | DNIYKILSI | 38.1 | | | | |
| HA | H16 | 529 | 1.7 | yes | 4 | 0 | 100 | NYYKVLSIY | 42.86 | NIYKILSIY | 38.1 | | | | |
| HA | H16 | 530 | 1.36 | yes | 3 | 0 | 100 | YYKVLSIYS | 42.86 | YKVLAIYS | 42.86 | | | | |
| HA | H16 | 531 | 1.36 | yes | 3 | 0 | 100 | YKVLSIYSC | 47.62 | YKVLAIYSC | 42.86 | | | | |
| HA | H16 | 532 | 1.36 | yes | 3 | 0 | 100 | KVLSIYSCI | 47.62 | KVLAIYSCI | 42.86 | | | | |
| HA | H16 | 533 | 0.45 | yes | 3 | 0 | 100 | VLSIYSCIA | 47.62 | VLAIYSCIA | 42.86 | | | | |
| HA | H16 | 534 | 0.45 | yes | 3 | 0 | 100 | LSIYSCIAS | 90.48 | LAIYSCIAS | 9.52 | | | | |
| HA | H16 | 535 | 1.52 | yes | 3 | 0 | 100 | SIYSCIASS | 90.48 | AIYSCIASS | 9.52 | | | | |
| HA | H16 | 536 | 1.52 | yes | 3 | 0 | 100 | IYSCIASSI | 47.62 | IYSCIASST | 28.57 | IYSCIASSV | 23.81 | | | |
| HA | H16 | 537 | 2.26 | yes | 5 | 0 | 100 | YSCIASSIV | 23.81 | YSCIASSTV | 28.57 | YSCIASSVW | 23.81 | YSCIASSVL | 23.81 | |
| HA | H16 | 538 | 2.26 | yes | 5 | 0 | 100 | SCIASSIVL | 23.81 | SCIASSTVL | 23.81 | SCIASSVWL | 23.81 | SCIASSVL | 23.81 | SCIASSTVM | 19.05 |
| HA | H16 | 539 | 2.26 | yes | 5 | 0 | 100 | CIASSIVLV | 23.81 | CIASSTVLV | 23.81 | CIASSVWLV | 23.81 | CIASSVLV | 23.81 | CIASSTVMV | 19.05 |
| HA | H16 | 540 | 2.26 | yes | 5 | 0 | 100 | IASSIVLVG | 23.81 | IASSTVLVG | 23.81 | IASSVWLVG | 23.81 | IASSVLVG | 23.81 | IASSTVMVG | 19.05 |
| HA | H16 | 541 | 0.92 | yes | 5 | 0 | 100 | ASSIVMVGL | 23.81 | ASSTVLVGL | 23.81 | ASSIWMVGL | 23.81 | ASSVLVGL | 23.81 | ASSTVMVGL | 19.05 |
| HA | H16 | 542 | 0.92 | yes | 5 | 0 | 100 | SSIVMVGLI | 23.81 | SSTVLVGLI | 23.81 | SSIWMVGLI | 23.81 | SSVLVGLI | 23.81 | SSTVMVGLI | 19.05 |
| HA | H16 | 543 | 0.59 | yes | 5 | 0 | 100 | SIWMVGLII | 66.67 | STVLVGLII | 23.81 | | | STVLVGLII | 23.81 | STVMVGLII | 19.05 |
| HA | H16 | 544 | 0.59 | yes | 5 | 0 | 100 | IWMVGLILA | 66.67 | TVLVGLILA | 23.81 | | | TVLVGLILA | 23.81 | TVMVGLILA | 19.05 |
| HA | H16 | 545 | 0.59 | yes | 5 | 0 | 100 | VLVGLILAF | 85.71 | | | | | | |
| HA | H16 | 546 | 0.59 | yes | 2 | 0 | 100 | LVGLILAFI | 85.71 | | | | | | |
| HA | H16 | 547 | 0.59 | yes | 2 | 0 | 100 | VGLILAFIM | 85.71 | | | | | | |

FIG. 73-145

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 554 | 1.53 | yes | 4 | 4.76 | 100 | IMWACSNGS | 60 | IMWACSSGN | 20 | IMWACSNGN | 15 | | |
| HA | H16 | 555 | 1.53 | yes | 4 | 4.76 | 100 | MWACSNGSC | 60 | LWACSSGNC | 20 | MWACSNGNC | 15 | | |
| HA | H16 | 556 | 0.99 | yes | 3 | 4.76 | 100 | WACSNGSCR | 75 | WACSNGNCR | 20 | |

FIG. 73-146

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H | 387 | 0.05 | yes | 1 | 0.09 | 99.59 | GLFGAIAG

FIG. 73-147

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 2 | 0 | no | 1

FIG. 73-148

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H1N1 | 126 | 0.23 | yes | 4 | 0.13 | 99.4 | EELREQLS

FIG. 73-149

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 351 | 1.02 | yes | 3 | 0.15 | 99.04 | RNVPSIQSR | 69 | RNIPSIQSR | 29.75 | RNIPSV

FIG. 73-150

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 392 | 1.02 | yes | 3 | 0.02 | 99.27 | GYAADLKST | 70.75 | GYAADLKST | 27.08 | | | | |
| HA | H1N1 | 393 | 1.02 | yes | 3 | 0.02 | 99.28 | YAADLKSTQ | 70.76 | YAADLKSTQ | 27.08 | | | | |
| HA | H1N1 | 407 | 0.37 | yes | 5 | 0.07 | 99.11 | ITNKVNSVI | 95.84 | ITNKVNSII | 1.52 | ITNKVNSVV | 1.44 | ITNKVNTVI | 0.18 |
| HA | H1N1 | 408 | 0.37 | yes | 5 | 0.07 | 99.05 | TNKVNSVIE | 95.8 | TNKVNSIIE | 1.52 | TNKVNSVVE | 1.44 | TNKVNTVIE | 0.18 |
| HA | H1N1 | 409 | 0.26 | yes | 3 | 0.06 | 99.02 | NKVNSVIEK | 97.27 | NKVNSIIE | 1.45 | | | | |
| HA | H1N1 | 410 | 0.25 | yes | 3 | 0.04 | 99.12 | KVNSVIEKM | 97.37 | KVNSIIEK

FIG. 73-151

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 460 | 0.06 | yes | 1 | 0.03 | 99.51 | LLENERTLD | 99.51 | | | | | | |
| HA | H1N1 | 461 | 0.91 | yes | 2 | 0.07 | 99.41 | LENERTLDY | 72.62

FIG. 73-152

| Protein | Sub-type | Start Pos | Block | Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|---|
| HA | H1N1 | 556 | 1.04 | yes | 4 | 0.18 | 99.13 | LVLVSLGA | 70.09 | LVLLVSLGA | 28.14 | SVLLVSLGA | 0.62 | LVLIVSLGA | 0.28 | | |
| HA | H1N1 | 557 | 1.03 | yes | 4 | 0.2 | 99.03 | VLVSLGAI | 70.01 | VLLV

FIG. 73-153

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 10 | 0 | no | 1 | 99.93 | 100 | FKMNPNQKI | 100 | | | | | | |
| NA | H1N1 | 11 | 0 | no | 1 | 99.93 | 100 | KMNPNQKII | 100 | | | | | | |
| NA | H1N1 | 107 | 0.94 | yes | 3 | 0.07 | 99.44 | GWAIYTKDN | 25.88 | GWAIHTKDN | 0.55 | WAIHTKDNS | 0.55 | HTKDNSIRI | 0.55 |
| NA | H1N1 | 108 | 1.13 | yes | 4 | 0.07 | 99.3 | WAIYTKDNS | 25.87 | WAIYSKDNS | 2.95 | WAIHTKDNS | 2.57 | | |
| NA | H1N1 | 111 | 1.59 | yes | 5 | 0.08 | 99.01 | YTKDNSIRI | 25.86 | YSKDNSVRI | 11.28 | YSKDNGIRI | 2.67 | | |
| NA | H1N1 | 112 | 1.54 | yes | 4 | 0.09 | 99.19 | TKDNSIRIG | 26.49 | SKDNSVRIG | 11.3 | SKDNGIRIG | | | |
| NA | H1N1 | 113 | 0.77 | yes | 3 | 0.13 | 99.23 | KDNSIRIGS | 11.29 | KDNSVRIGS | 2.68 | | | | |
| NA | H1N1 | 114 | 0.79 | yes | 3 | 0.17 | 99.37 | DNSIRIGSK | 11.18 | DNSVRIGSK | 2.65 | DNGVRIGSK | 0.37 | | |
| NA | H1N1 | 115 | 0.78 | yes | 3 | 0.18 | 99.01 | NSIRIGSKG | 11.18 | NSVRIGSKG | 2.66 | | | | |
| NA | H1N1 | 116 | 0.79 | yes | 2 | 0.25 | 99.43 | SIRIGSKGD | 11.2 | SVRIGSKGD | 2.66 | | | | |
| NA | H1N1 | 117 | 0.97 | yes | 4 | 0.24 | 99.3 | IRIGSKGDV | 11.63 | VRIGSKGDV | 7.9 | | | | |
| NA | H1N1 | 118 | 0.48 | yes | 4 | 0.23 | 99.16 | RIGSKGDVF | 7.87 | RIGSKGDIF | | | | | |
| NA | H1N1 | 119 | 0.5 | yes | 4 | 0.23 | 99.12 | IGSKGDIFV | 7.87 | IGSKGDVFV | | | | | |
| NA | H1N1 | 120 | 0.58 | yes | 3 | 0.24 | 99.12 | GSKGDVFVI | 6.44 | GSKGDIFVI | 1.36 | GSKGDIFVM | 1.36 | | |
| NA | H1N1 | 121 | 0.58 | yes | 4 | 0.25 | 99.15 | SKGDIFVIR | 6.47 | SKGDVFVIR | 1.36 | SKGDIFVMR | 1.36 | | |
| NA | H1N1 | 122 | 0.57 | yes | 3 | 0.3 | 99.12 | KGDVFVIRE | 6.46 | KGDIFVIRE | 1.36 | KGDVFVMRE | 0.22 | | |
| NA | H1N1 | 123 | 0.58 | yes | 2 | 0.29 | 99.15 | GDVFVIREP | 6.46 | GDIFVIREP | 1.42 | GDIFVMREP | 0.22 | | |
| NA | H1N1 | 124 | 0.55 | yes | 2 | 0.26 | 99.15 | DVFVIREPF | 6.46 | DIFVIREPF | 1.42 | DIFVMREPF | 0.22 | | |
| NA | H1N1 | 125 | 0.55 | yes | 2 | 0.14 | 99.15 | VFVIREPFI | 6.45 | VFVIREPFI | 1.41 | IFVMREPFI | | | |
| NA | H1N1 | 126 | 0.19 | yes | 2 | 0.14 | 99.41 | FVIREPFIS | 6.46 | FVMREPFIS | | | | | |
| NA | H1N1 | 127 | 0.17 | yes | 2 | 0.2 | 99.15 | VIREPFISC | 1.63 | VMREPFISC | | | | | |
| NA | H1N1 | 128 | 1.11 | yes | 3 | 0.26 | 99.65 | IREPFISCS | 1.63 | MREPFISCS | | | | | |
| NA | H1N1 | 129 | 1.16 | yes | 4 | 0.35 | 99.42 | REPFISCSP | 1.63 | REPFISCSQ | 41.1 | REPFISCSH | 0.92 | | |
| NA | H1N1 | 130 | 1.17 | yes | 4 | 0.37 | 99.17 | EPFISCSPL | 57.22 | EPFISCSQL | 40.83 | EPFISCSHF | 0.91 | EPFISCSHF | |
| NA | H1N1 | 131 | 1.17 | yes | 4 | 0.31 | 99.08 | PFISCSPLE | 57.14 | PFISCSQLE | 40.82 | PFISCSHLE | 0.91 | PFISCSHFE | |
| NA | H1N1 | 132 | 1.22 | yes | 5 | 0.31 | 99.09 | FISCSPLEC | 57.15 | FISCSQLEC | 40.82 | FISCSHLEC | 0.91 | FISCSHFEC | |
| NA | H1N1 | 133 | 1.27 | yes | 2 | 0.32 | 99.01 | ISCSPLECR | 57.11 | ISCSQLECR | 39.33 | ISCSHLECR | 1.46 | ISCSHFECR | 0.2 |
| NA | H1N1 | 138 | 1.11 | yes | 2 | 0.13 | 99.05 | LECRTFFLT | 97.57 | LECKTFFLT | 1.49 | | | | |
| NA | H1N1 | 139 | 0.18 | yes | 1 | 0.14 | 99.31 | ECRTFFLTQ | 97.81 | ECKTFFLTQ | 1.5 | | | | |
| NA | H1N1 | 140 | 0.19 | yes | 1 | 0.14 | 99.42 | CRTFFLTQG | 97.92 | CKTFFLTQG | 1.5 | | | | |
| NA | H1N1 | 141 | 0.19 | yes | 1 | 0.15 | 99.35 | RTFFLTQGA | 97.85 | KTFFLTQGA | 1.5 | | | | |
| NA | H1N1 | 142 | 0.19 | yes | 1 | 0.14 | 99.42 | TFFLTQGAL | 99.42 | | | | | | |
| NA | H1N1 | 143 | 0.07 | yes | 1 | 0.14 | 99.57 | FFLTQGALL | 99.57 | | | | | | |
| NA | H1N1 | 144 | 0.05 | yes | 1 | 0.14 | 99.55 | FLTQGALLN | 99.55 | | | | | | |
| NA | H1N1 | 145 | 0.05 | yes | 1 | 0.14 | 99.54 | LTQGALLND | 99.54 | | | | | | |
| NA | H1N1 | 146 | 0.06 | yes | 1 | 0.14 | 99.52 | TQGALLNDR | 93.68 | TQGALLNDK | 5.84 | | | | |
| NA | H1N1 | 147 | 0.38 | yes | 2 | 0.14 | 99.53 | QGALLNDRH | 93.69 | QGALLNDKH | 5.84 | | | | |
| NA | H1N1 | 148 | 0.38 | yes | 2 | 0.06 | 99.72 | GALLNDRHS | 93.89 | GALLNDKHS | 5.83 | | | | |
| NA | H1N1 | 149 | 0.36 | yes | 2 | 0.05 | 99.59 | ALLNDRHSN | 93.74 | ALLNDKHSN | 5.84 | | | | |
| NA | H1N1 | 150 | 0.37 | yes | 2 | 0.1 | 99.42 | LLNDRHSNG | 93.58 | LLNDKHSNG | 5.85 | | | | |
| NA | H1N1 | 151 | 0.4 | yes | 2 | 0.1 | 99.37 | LNDRHSNGT | 93.52 | LNDKHSNGT | 5.85 | | | | |

| Protein | Sub-type | Start Pos | Block Entropy | Gaps <10% | # to cover 99% | Gap % | Coverage | Included Peptides | Included Peptides | Freq | Included Peptides | Freq | Included Peptides | Freq | Included Peptides | Freq |
|---|---|---|---|---|---|---|---|---|---|---|---|---|---|---|---|---|
| NA | H1N1 | 305 | 0.45 | yes | 2 | 0.07 | 99.42 | RDNWHGSNR | RDNWHASNR | 91.78 | | | | | | |
| NA | H1N1 | 306 | 0.45 | yes | 2 | 0.06 | 99.46 | DNWHGSNRP | DNWHASNRP | 91.81 | | | | | | |
| NA | H1N1 | 307 | 0.45 | yes | 2 | 0.06 | 99.48 | NWHGSNRPW | NWHASNRPW |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N2 | 26 | 0.3 | yes | 3 | 0 | 99.12 | ANNSTDTVD | 96.2 | ANNSTDTID | 2.05 | | | | |
| HA | H1N2 | 27 | 0.3 | yes | 3 | 0 | 99.12 | NNSTDTVDT | 96.2 | NNSTDTIDT | 2.05 | | | | |
| HA | H1N2 | 39 | 0.25 | yes | 4 | 0 | 99.12 | KNVTVTHSV | 97.37 | K

FIG. 73-159

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H1N2 | 372 | 0.3 | yes | 3 | 0 | 99.12 | NEQGSGYAA | 96.2 | NDQGSGYAA | 1.75 | | | | |

| Protein | Sub-type | Start Pos | Block Entropy | Gaps < 10% | # to cover 99% | Gap % | Coverage | included Peptides | Freq | included Peptides | Freq | included Peptides | Freq | included Peptides | Freq |
|---|---|---|---|---|---|---|---|---|---|---|---|---|---|---|---|
| NA | H1N2 | 157 | 0.1 | yes | 2 | 0 | 99.72 | RTLMNELG | 98.87 | RTLMNELG | | | | | |
| NA | H1N2 | 158 | 0.49 | yes | 2 | 0 | 99.15 | TL

FIG. 73-162

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 273 | 0.33 | yes | 2 | 0 | 99.44 | AQHVEESC | 94.63 | AQHIEECSC | 4

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 44 | 0.82 | yes | 4 | 0 | 99.16 | RNVTVTHAK | 83.26 | RNVTVTHAQ | 1.26 | | | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 313 | 1.13 | yes | 3 | 0 | 99.16 | HNIHPLTIG | 63.18 | HNIHPLAIG | 33.89

FIG. 73-167

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 373 | 0.21 | yes | 2 | 0 | 99.58 | HSNDQGSGY | 97.07 | HSNDQGAGY | 2.51 | | | | |
| HA | H2 | 374 | 0.21 | yes | 2 | 0 | 99.58 | SNDQGSGYA | 97.07 | SNDQGAGYA | 2.51 | | | | |
| HA | H2 | 375 | 0.21 | yes | 2 | 0 | 99.58 | NDQGSGYAA | 97.07 | NDQGAGYAA | 2.51 | | | | |
| HA | H2 | 376 | 0.17 | yes | 2 | 0 | 99.58 | DQGSGYAAD | 97.07 | DQGAGYAAD | 2.51 | | | | |
| HA | H2 | 377 | 0.35 | yes | 3 | 0 | 100 | QGSGYAADK | 97.49 | QGAGYAADK | 2.51 | | | | |
| HA | H2 | 378 | 0.35 | yes | 2 | 0 | 99.58 | GSGYAADKE | 94.98 | GAGYAADKE | 2.51 | GSGYAADKA | 2.51 | | | |
| HA | H2 | 379 | 0.19 | yes | 2 | 0 | 99.58 | SGYAADKES | 94.98 | AGYAADKES | 2.51 | SGYAADKAS | 2.51 | | | |
| HA | H2 | 380 | 0.19 | yes | 2 | 0 | 99.58 | GYAADKEST | 97.49 | GYAADKAST | 2.09 | | | | |
| HA | H2 | 381 | 0.47 | yes | 3 | 0 | 99.58 | YAADKESTQ | 97.49 | YAADKASTQ | 2.09 | | | | |
| HA | H2 | 382 | 0.47 | yes | 3 | 0 | 99.58 | AADKESTQK | 92.47 | AADKASTQK | 2.09 | | | | |
| HA | H2 | 383 | 0.56 | yes | 4 | 0 | 99.58 | ADKESTQRA | 92.47 | ADKASTQKA | 2.09 |

FIG. 73-168

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 457 | 0.98 | yes | 4 | 0.42 | 99.58 | FHDSNVKNL | 80.67 | FHDSNVRNL | 12.18 | YHDSNVKNL

FIG. 73-169

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 512 | 0.99 | yes | 5 | 0

FIG. 73-170

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H2N2 | 21 | 0.58 | y

FIG. 73-171

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 68 | 0.14 | yes | 2 | 0 | 99.12 | GDCSIAGWL | 98.25 | GNCSIAGW

FIG. 73-172

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 179 | 0.32 | yes | 3 | 0 | 99.12 | NNTSGEO

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H2N2 | 332 | 0.71 | yes | 5 | 0 | 99.12 | RNVPQIESR | 88.6 | RNVPQMESR | 7

FIG. 73-175

| Protein | Sub-type | Start Pos | Block Entropy | Gaps < 10% | # to cover 99% | Gap % | Coverage | Induced Peptides | Freq | Induced Peptides | Freq | Induced Peptides | Freq | Induced Peptides | Freq |
|---|---|---|---|---|---|---|---|---|---|---|---|---|---|---|---|
| HA | H2N2 | 373 | 0.33 | yes | 2 | 0 | 99.12 | GVAADKEST | 94.74 | GVAADKAST | 4.39 | | | | |
| HA | H2N2 | 374 | 0.33 | yes | 2 | 0 | 99.12 | VAADKESTQ | 94.74 | YAADKASTQ | 4.39 | | | | |
| HA | H2N2 | 375 | 0.51 | yes | 3 | 0 | 99.12 | AADKESTQK | 92.11 | AADKASTQK | 4.39 | | | | |
| HA | H2N2 | 376 | 0.51 | yes | 3 | 0 | 99.12 | ADKESTQKA | 92.11 | ADKASTOKA | 4.39 | | | | |
| HA | H2N2 | 377 | 1.48 | yes | 5 | 0 | 99.12 | DKESTQKAF | 61.4 | DKASTQKAI | 28.07 | AADKESTQR | 2.63 | DKESTQRAF | 2.63 |
| HA | H2N2 | 392 | 0.52 | yes | 5 | 0 | 99.12 | VNSVIEKMN | 92.98 | VNFVIEKMN | 2.63 | ADKESTORA | 2.63 | VNSVIEKIN | 0.88 |
| HA | H2N2 | 393 | 0.57 | yes | 5 | 0 | 99.12 | NSVIEKMNT | 92.11 | NFVIEKMNT | 2.63 | DKASTQKAI | 4.39 | NSVIEKINT | 0.88 |
| HA | H2N2 | 394 | 0.57 | yes | 5 | 0 | 99.12 | SVIEKMNTQ | 92.11 | SIIEKMNT | 2.63 | VNFVIEKMN | 1.75 | SVIEKINTQ | 1.75 |
| HA | H2N2 | 395 | 0.42 | yes | 4 | 0 | 99.12 | IEKMNTQFE | 94.74 | IEKMNTQ | 1.75 | NFVIEKMNT | 1.75 | IEKMNTQSE | 1.75 |
| HA | H2N2 | 396 | 1.33 | yes | 5 | 0 | 99.12 | AVGKEFSNL | 60.53 | AVGKEFGNL | 33.33 | FVIEKMNTQ | 0.88 | SVGKEFSNL | 1.75 |
| HA | H2N2 | 405 | 1.16 | yes | 4 | 0 | 100 | VGKEFSNLE | 62.28 | VGKEFGNLE | 34.21 | AVGKEFGNL | 1.75 | | |
| HA | H2N2 | 406 | 1.98 | yes | 5 | 0 | 100 | KEFSNLERR | 36.84 | KEFNNLERR | 27.19 | VGKEFGNLE | 33.68 | KEFGNLERR | 1.75 |
| HA | H2N2 | 408 | 1.98 | yes | 5 | 0 | 99.12 | EFSNLERRL | 36.84 | EFNNLERRL | 27.19 | KEFNNLERR | 23.68 | EFGNLERRL | 1.75 |
| HA | H2N2 | 409 | 1.98 | yes | 5 | 0 | 99.12 | FSNLERRLE | 36.84 | FNNLERRLE | 26.32 | EFNNLERRL | 23.68 | FGNLERRLE | 1.75 |
| HA | H2N2 | 410 | 2.03 | yes | 5 | 0 | 99.12 | SNLERRLEN | 36.84 | NNLERRLEN | 26.32 | NNLERRLEN | 23.68 | GNLERRLEN | 1.75 |
| HA | H2N2 | 411 | 1.02 | yes | 4 | 0 | 99.12 | NLERRLENL | 62.28 | NLERRLENL | 36.84 | | | | |
| HA | H2N2 | 412 | 1.14 | yes | 4 | 0 | 99.12 | LERRLENLN | 61.4 | LEKRLENLN | 35.96 | LEKRLENLD | 0.88 | LERRLENLS | 0.88 |
| HA | H2N2 | 413 | 1.14 | yes | 4 | 0 | 99.12 | ERRLENLNK | 61.4 | EKRLENLNK | 35.96 | EKRLENLDK | 0.88 | EKRLGNLNK | 0.88 |
| HA | H2N2 | 414 | 1.21 | yes | 5 | 0 | 99.12 | RRLENLNKK | 60.53 | RLENLNKK | 35.96 | RLENLNIKR | 0.88 | RLENLNKM | 0.88 |
| HA | H2N2 | 415 | 0.46 | yes | 4 | 0 | 99.12 | RLENLNKKM | 93.86 | RLENLNKKV | 2.63 | RLGNLNKKM | 0.88 | KRLENLDKK | 0.88 |
| HA | H2N2 | 416 | 0.46 | yes | 5 | 0 | 99.12 | LENLNKKME | 93.86 | LENLNKKVE | 2.63 | LENLNKRM | 0.88 | RLENLDKKM | 0.88 |
| HA | H2N2 | 417 | 0.46 | yes | 5 | 0 | 99.12 | ENLNKKMED | 93.86 | ENLNKKYED | 2.63 | ENLDKKMED | 0.88 | LGNLNKKME | 0.88 |
| HA | H2N2 | 418 | 0.39 | yes | 5 | 0 | 99.12 | NLNKKMEDG | 94.74 | NLNKKVEDG | 2.63 | NLSKRMEDG | 0.88 | ENLNKRMED | 0.88 |
| HA | H2N2 | 419 | 0.46 | yes | 5 | 0 | 99.12 | LNKKMEDGF | 93.86 | LNKKVEDGF | 2.63 | LSKRMEDGF | 0.88 | | |
| HA | H2N2 | 420 | 0.81 | yes | 4 | 0 | 99.12 | MEDGFLDYW | 85.96 | MEDGFLDYW | 2.63 | LNKRMEDGF | 2.63 | LDKKMEDGF | 0.88 |
| HA | H2N2 | 424 | 0.64 | yes | 5 | 0 | 99.12 | EDGFLDVWT | 88.6 | VEDGFLDYW | 8.77 | MEDGFLDYW | 2.63 | MEDGFRDYW | 0.88 |
| HA | H2N2 | 425 | 0.64 | yes | 4 | 0 | 99.12 | DGFLDVWTY | 88.6 | DGLLDYWTY | 8.77 | EDGLLDYWT | 0.88 | | |
| HA | H2N2 | 426 | 0.64 | yes | 4 | 0 | 99.12 | GFLDVWTYN | 88.6 | GFLGVWTYN | 8.77 | DGFLGVWTY | 0.88 | | |
| HA | H2N2 | 427 | 0.71 | yes | 5 | 0 | 87.72 | FLDVWTYNA | 87.72 | FLGVWTYNA | 8.77 | GFRDVWTYN | 0.88 | | |
| HA | H2N2 | 428 | 0.64 | yes | 4 | 0 | 88.6 | LDVWTYNAE | 88.6 | LGVWTYNAE | 8.77 | FLGWTYNT | 0.88 | LDVWTYNA | 0.88 |
| HA | H2N2 | 429 | 0.64 | yes | 4 | 0 | 98.25 | DVWTYNAEL | 98.25 | DVWTYNTEL | 0.88 | LDVWTYNTE | 0.88 | | |
| HA | H2N2 | 430 | 0.07 | yes | 2 | 0 | 99.12 | VWTYNAELL | 99.12 | | | | | | |
| HA | H2N2 | 431 | 0.07 | yes | 1 | 0 | 99.12 | WTYNAELLV | 99.12 | | | | | | |
| HA | H2N2 | 432 | 0.07 | yes | 1 | 0 | 99.12 | TYNAELLVL | 99.12 | | | | | | |
| HA | H2N2 | 433 | 0.07 | yes | 1 | 0 | 99.12 | YNAELLVLM | 99.12 | | | | | | |
| HA | H2N2 | 434 | 0.14 | yes | 1 | 0 | 99.12 | NAELLVLME | 99.12 | | | | | | |
| HA | H2N2 | 435 | 0.14 | yes | 1 | 0 | 99.12 | AELLVLMEN | 99.12 | | | | | | |
| HA | H2N2 | 436 | 0.07 | yes | 1 | 0 | 99.12 | ELLVLMENE | 99.12 | | | | | | |
| HA | H2N2 | 437 | 0 | yes | 1 | 0 | 100 | LLVLMENER | 100 | | | | | | |
| HA | H2N2 | 438 | 0.13 | yes | 2 | 0 | 100 | LVLMENERT | 100 | LVLMENEM | 1.75 | | | | |
| HA | H2N2 | 439 | 0.2 | yes | 2 | 0 | 99.12 | VLMENERTL | 97.37 | LVLMENEMT | 1.75 | | | | |
| HA | H2N2 | 440 | 0.2 | yes | 2 | 0 | 99.12 | VLMENERTL | 97.37 | VLMENEMTL | 1.75 | | | | |

FIG. 73-176

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 441 | 0.27 | yes | 3 | 0 | 99.12 | LMENERTLD | 96.49 | LMENEMTLD | 1.75 | | | | |
| HA | H2N2 | 442 | 0.27 |

FIG. 73-177

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 491 |

FIG. 73-178

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 533 | 0 | yes | 1 | 0 | 100 | VAGSLSLA

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 135 | 0.27 | yes | 3 | 0 |

FIG. 73-181

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 179 | 0.25 | yes | 2 | 0 | 100 | SSSSCHDGK | 95.86 | SSSSCHDGR | 4.14 | | | | |
| NA | H2N2 | 180 | 0.31 | yes | 2 | 0 |

FIG. 73-182

| Protein | Sub-type | Start Pos | Entropy Block | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 233 | 0.72 | yes | 4 | 0 | 99.31 | INGT

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 340 | 1.18 | yes | 5 | 0 | 99.31 | PNNERGNPG | 75.86 | PNNERGN

FIG. 73-185

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 425 | 1.71 | yes | 5 | 0 | 99.31 | ELIRGRPQE | 51.72

FIG. 73-186

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| HA | H3 | 33 | 0 | no | 1 | 99.94 | 100 | NNSTATLCL | 100 | | | | | | | | |
| HA | H3 | 36 | 0.35 | yes | 4 | 0.16 | 99.19 | TATLCLGHHA | 95.51 | MATLCLGHH | 3.16 | AATLCLGHH | 0.28 | TAMLCLGHH | 0.24 | | |
| HA | H3 | 37 | 0.1 | yes | 1 | 0.14 | 99.19 | ATLCLGHHA | 99.19 | | | | | | | | |
| HA | H3 | 38 | 0.11 | yes | 1 | 0.14 | 99.09 | TLCLGHHAV | 99.09 | | | | | | | | |
| HA | H3 | 39 | 0.41 | yes | 4 | 0.14 | 99.36 | LCLGHHAVP | 94.36 | LCLGHHAVA | 3.89 | LCLGHHAVQ | 0.67 | LCLGHHA

FIG. 73-187

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 309 | 0.28 | yes | 2 | 0 | 99.31 | CITPNGSIP | 99

FIG. 73-188

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 379 | 0 | no | 1 | 99.98 | 100 | RLVRFRHQN

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| HA | H3 | 488 | 0.37 | yes | 4 | 0.08 | 99.11 | NAEDMGNGC | 99.11 | NAEDMGGGC | 95.28 | NAEDMGDGC | 3.05 | NAEDIGNGC | 0.48 | AEDIGNGCF | 0.3 |
| HA | H3 | 489 | 0.41 | yes | 5 | 0.08 | 99.17 | AEDMGNGCF | 99.17 | AEDMGGGCF | 94.78 | AEDMGNGCL | 3.05 | AEDMGDGCF | 0.54 | GNGCLKIYH | 0.48 |
|

FIG. 73-191

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 36 | 0.06 | yes | 1 | 0.07 | 99.49 | GHHAVPNGT | 99.49 | | | | | | |
| HA | H3N2 | 37 | 1.1 | yes | 3 | 0.07 | 99.1 | HHAVPNGT

FIG. 73-192

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 273 | 0.59 | yes | 4 | 0.02 | 99.05 | IAPRGYFKI | 90.59 | IAPRGYFKM | 6.95 | IAPRGYFKM | 1.02 | | 0.49 |
| HA | H3N2 | 286 | 0 | no | 1 | 99.98 | 100 | LNNEIRWPP | 100 | | | | | | |
| HA | H3N2 | 301 | 0.26 | yes | 4 | 0.07 | 99.15 | SECITPNGS | 97.27 | SGCITPNGS | 1.05 | FECITPNGS | 0.56 | | 0.27 |
| HA | H3N2 | 302 | 0.24 | yes | 3 | 0.07 | 99.1 | ECITPNGSI | 97.49 | GCITPNGSI | 1.05 | | 0.56 | | |
| HA | H3N2 | 303 | 0.14 | yes | 2 | 0 | 99.29 | CITPNGSIP | 98.71 | CITPNGSIS | 0.58 | | | | |
| HA | H3N2 | 304 | 0.15 | yes | 2 | 0.05 | 99.2 | ITPNGSIPN | 98.61 | ITPNGSISN | 0.58 | | | | |
| HA | H3N2 | 305 | 0.32 | yes | 5 | 0.05 | 99.2 | TPNGSIPNE | 98.63 | TPNGSISND | 1.07 | TPNGSIPN

FIG. 73-193

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H3N2 | 348 | 0.58 | yes | 5 | 0

FIG. 73-194

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 391 | 1.15 | yes | 5 | 0.05 | 99.12 | LKSTQAAIN | 99.12 | LKSTQAAID | 51.01 | LKSTQAAVN | 47.5 | FKSTQAAIN | 0.22 | |

FIG. 73-195

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 447 | 0.25 | yes | 4 | 0.05 | 99 |

FIG. 73-196

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 503 | 0.64 | yes | 4 | 0.07 | 99.24 | GSIRNGTYD | 89.32 | GSIRNETYD | 7.98 | GSIRNGTYN | 0

FIG. 73-197

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 103 | 0.1 | yes | 1 | 0.02 | 99.12 | TGFAPFSKD | 99.12 | | | | | | |
| NA | H3N2 | 104 | 0.06 | yes | 1 | 0.02 | 99.49 | GFAPFSKDN | 99.49 | | | | | | |
| NA | H3N2 | 105 | 0.07 | yes | 1 | 0.02 | 99.44 | FAPFSKDNS | 99.44 | | | | | | |
| NA | H3N2 | 106 | 0.08 | yes | 1 | 0 | 99.38 | APFSKDNSI | 99.38 | | | | | | |
| NA | H3N2 | 107 | 0.08 | yes | 1 | 0 | 99.36 | PFSKDNSIR | 99.36 | | | | | | |
| NA | H3N2 | 108 | 0.09 | yes | 1 | 0 | 99.25 | FSKDNSIRL | 99.25 | | | | | | |
| NA | H3N2 | 109 | 0.11 | yes | 1 | 0.02 | 99.38 | SKDNSIRLA | 99.38 | SKDNSIRLA | 0.41 | | | | |
| NA | H3N2 | 110 | 0.14 | yes | 1 | 0.04 | 99.19 | KDNSIRLAA | 99.19 | KDNSIRLAA | 0.41 | | | | |
| NA | H3N2 | 111 | 0.12 | yes | 2 | 0.04 | 99.31 | DNSIRLAAG | 99.31 | DNSIRLAAG | 0.41 | | | | |
| NA | H3N2 | 112 | 0.2 | yes | 2 | 0.04 | 98.91 | NSIRLAAGG | 98.91 | NSIRLAAGG | 0.41 | | | | |
| NA | H3N2 | 113 | 0.2 | yes | 2 | 0.04 | 98.09 | SIRLAAGGA | 98.09 | SIRLAAGGD | 0.73 | | | | |
| NA | H3N2 | 114 | 0.18 | yes | 3 | 0.04 | 98.16 | IRLSAGGDI | 98.16 | IRLSAGGDI | 0.62 | | | | |
| NA | H3N2 | 115 | 0.19 | yes | 3 | 0.09 | 98.26 | RLSAGGDIW | 98.26 | RLSAGGDIW | 0.62 | | | | |
| NA | H3N2 | 116 | 0.19 | yes | 3 | 0.04 | 98.2 | LSAGGDIWW | 98.2 | LSAGGDIWW | 0.58 | | | | |
| NA | H3N2 | 117 | 0.16 | yes | 3 | 0.04 | 98.22 | SAGGAIWWT | 98.22 | SAGGAIWWT | 0.58 | | | | |
| NA | H3N2 | 118 | 0.19 | yes | 2 | 0.09 | 98.46 | AGGAIWWTR | 98.46 | AGGAIWWT | 0.77 | | | | |
| NA | H3N2 | 119 | 0.17 | yes | 3 | 0.09 | 98.39 | GGAIWWTRE | 98.39 | GGAIWWTRE | 0.75 | GAIWVTREP | 0.75 | | | |
| NA | H3N2 | 120 | 0.25 | yes | 4 | 0.06 | 97.45 | GDIWWTREP | 97.45 | GDIWWTREL | 0.81 | AIWVTREPY | 0.75 | | | |
| NA | H3N2 | 121 | 0.25 | yes | 2 | 0.09 | 97.43 | DIWWTREPY | 97.43 | DIWWTRELY | 0.81 | | | DIWVTRVPY | 0.15 | |
| NA | H3N2 | 122 | 0.17 | yes | 2 | 0.09 | 98.31 | IWVTREPYV | 98.31 | IWVTRELYV | 0.81 | | | | |
| NA | H3N2 | 123 | 0.16 | yes | 2 | 0.09 | 98.23 | WVTREPYVS | 98.23 | WVTRELYVS | 0.81 | | | | |
| NA | H3N2 | 124 | 0.16 | yes | 4 | 0.09 | 98.41 | VTREPYVSC | 98.41 | VTRELYVSC | 0.81 | | | | |
| NA | H3N2 | 125 | 0.3 | yes | 4 | 0.04 | 96.72 | TREPYVSCG | 96.72 | TREPYVSCG | 0.88 | TRELYVSCD | 0.81 | TRELYVSCD | 0.81 |
| NA | H3N2 | 135 | 0.96 | yes | 4 | 0.02 | 82.44 | DKCYQFALG | 82.44 | GKCYQFALG | 11.35 | SKCYQFALG | 3.19 | NKCYQFALG | 2.06 |
| NA | H3N2 | 136 | 0.1 | yes | 1 | 0.02 | 99.04 | KCYQFALGQ | 99.04 | | | | | | |
| NA | H3N2 | 137 | 0.05 | yes | 1 | 0 | 99.61 | CYQFALGQG | 99.61 | | | | | | |
| NA | H3N2 | 138 | 0.04 | yes | 1 | 0 | 99.66 | YQFALGQGT | 99.66 | | | | | | |
| NA | H3N2 | 139 | 0.04 | yes | 1 | 0 | 99.64 | QFALGQGTT | 99.64 | | | | | | |
| NA | H3N2 | 140 | 0.07 | yes | 1 | 0 | 99.46 | FALGQGTTL | 99.46 | | | | | | |
| NA | H3N2 | 141 | 0.52 | yes | 3 | 0.06 | 90.96 | ALGQGTTLN | 90.96 | ALGQGTTLD | 7.99 | ALGQGTTLS | 0.26 | | |
| NA | H3N2 | 142 | 0.52 | yes | 3 | 0.04 | 90.96 | LGQGTTLNN | 90.96 | LGQGTTLDN | 8.01 | LGQGTTLSN | 0.26 | | |
| NA | H3N2 | 160 | 0.51 | yes | 3 | 0.04 | 91.75 | RTPYRTLLM | 91.75 | RTPHRTLLM | 5.76 | RTPHRTLLM | 2.04 | | |
| NA | H3N2 | 161 | 0.55 | yes | 3 | 0.04 | 91.54 | TPYRTLLMN | 91.54 | TPHRTLLMN | 5.48 | TPHRTLLMN | 2.04 | | |
| NA | H3N2 | 162 | 0.48 | yes | 2 | 0.04 | 91.6 | PYRTLLMNE | 91.6 | PHRTLLMNE | 7.56 | | | | |
| NA | H3N2 | 163 | 0.46 | yes | 2 | 0.04 | 91.58 | YRTLLMNEL | 91.58 | HRTLLMNEL | 7.84 | | | | |
| NA | H3N2 | 164 | 0.06 | yes | 1 | 0.04 | 99.42 | RTLLMNELG | 99.42 | | | | | | |
| NA | H3N2 | 165 | 0.1 | yes | 1 | 0.04 | 99.06 | TLLMNELGV | 99.06 | | | | | | |
| NA | H3N2 | 166 | 0.11 | yes | 2 | 0.04 | 99.06 | LLMNELGVP | 99.06 | LMSELGVPF | 0.36 | | | | |
| NA | H3N2 | 167 | 0.11 | yes | 2 | 0.04 | 99.06 | LMNELGVPF | 99.06 | MSELGVPFH | 0.36 | NELGIPHL | 0.34 | | |
| NA | H3N2 | 168 | 0.14 | yes | 2 | 0.02 | 98.65 | MNELGVPFH | 99.36 | SELGVPFHL | 0.36 | | | | |
| NA | H3N2 | 169 | 0.14 | yes | 3 | 0 | 98.63 | NELGVPFHL | 99.34 | | | NELGIPFHL | | | |

FIG. 73-198

| Protein | Sub-type | Start Pos | Block Entropy | Gaps <10% | # to cover 99% | Gap % | Coverage | Peptides included | Freq | Peptides included | Freq | Peptides included | Freq | Peptides induced | Freq |
|---|---|---|---|---|---|---|---|---|---|---|---|---|---|---|---|
| NA | H3N2 | 170 | 0.1 | yes | 1 | 0 | 99.04 | ELGVPHLG | 99.04 | | | | | | |
| NA | H3N2 | 171 | 0.1 | yes | 1 | 0 | 99.04 | LGVPPHLGT | 99.04 | | | | | | |
| NA | H3N2 | 172 | 0.85 | yes | 3 | 0 | 99.29 | GVPPHLGTK | 78.09 | GVPPHLGTR | 20.9 | GVPFYLGTK | 0.3 | | |
| NA | H3N2 | 173 | 0.85 | yes | 3 | 0 | 99.27 | VPFHLGTKQ | 78.07 | VPFHLGTRQ | 20.9 | VPFYLGTKQ | 0.3 | | |
| NA | H3N2 | 174 | 0.81 | yes | 2 | 0 | 99.38 | PFHLGTKQV | 78.37 | PFHLGTRQV | 21.01 | | | | |
| NA | H3N2 | 175 | 0.81 | yes | 2 | 0 | 99.36 | FHLGTKQVC | 78.35 | FHLGTRQVC | 21.01 | | | | |
| NA | H3N2 | 176 | 0.9 | yes | 4 | 0 | 99.25 | HLGTKQVCI | 77.86 | HLGTRQVCI | 20.39 | HLGTRQVCM | 0.62 | H

FIG. 73-199

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 240 | 0.25 | yes | 4 | 0.04 | 99.12 | CINGTCTVI | 97.34 | CISGTCAVV | 1.33 | CINGTCTVI | 0.26 | INGICTVWM | 0.17 |
| NA | H3N2 | 241 | 0.27 | yes | 5 | 0.04 | 99.08 | INGTCTVWM | 97.15 | ISGTCAVVM | 1.31 | INGTCTVWM | 0.26 | | |
| NA | H3N2 | 242 | 0.26 | yes | 4 | 0.04 | 99.01 | NGTCTVWMT | 97.26 | SGTCAVVMT | 1.31 | NGTCTVWMT | 0.26 | | |
| NA | H3N2 | 243 | 0.23 | yes | 2 | 0.04 | 99.04 | GTCTVWMTD | 97.47 | GTCAVVMTD | 1.56 | | | | |
| NA | H3N2 | 244 | 0.22 | yes | 3 | 0.04 | 99.08 | TCTVWMTDG | 97.51 | TCAVVMTDG | 1.56 | | | | |
| NA | H3N2 | 245 | 0.24 | yes | 3 | 0.06 | 99.08 | CTVWMTDGS | 97.22 | CAVVMTDGS | 1.61 | CTVWMTDGN | 0.47 | | |
| NA | H3N2 | 246 | 0.25 | yes | 2 | 0.06 | 99.25 | TVWMTDGSA | 97.17 | AVVMTDGSA | 1.61 | TVWMTDGNA | 0.47 | | |
| NA | H3N2 | 247 | 0.12 | yes | 4 | 0.06 | 99.31 | VWMTDGSAS | 98.84 | VVMTDGNAS | 0.47 | | | | |
| NA | H3N2 | 248 | 0.48 | yes | 1 | 0.06 | 99.29 | VMTDGSASG | 92.91 | VMTDGSASD | 5.21 | VMTDGNASG | 0.71 | | |
| NA | H3N2 | 264 | 0 | no | - | 99.98 | 100 | EYFVKEGK | 100 | | | | | | |
| NA | H3N2 | 265 | 0 | no | - | 99.98 | 100 | YFVKEGKI | 100 | | | | | | |
| NA | H3N2 | 266 | 0 | no | - | 99.98 | 100 | YFVKEGKIV | 100 | | | | | | |
| NA | H3N2 | 279 | 0.48 | yes | 5 | 0.02 | 99.14 | LSGSAQHIE | 93.68 | LSGAQHVE | 3.73 | LSGNAQHVE | 0.19 | LSGGAQHVE | 0.15 |
| NA | H3N2 | 280 | 0.47 | yes | 4 | 0.02 | 99.06 | SGSAQHIEE | 93.75 | SGAQHVEE | 3.73 | SGNAQHVEE | 0.19 | | |
| NA | H3N2 | 281 | 0.33 | yes | 2 | 0.04 | 99.16 | GSAQHIEEC | 95.31 | GSAQHVEEC | 3.86 | | | | |
| NA | H3N2 | 282 | 0.33 | yes | 2 | 0.04 | 99.23 | SAQHIEECS | 95.35 | SAQHVEECS | 3.88 | | | | |
| NA | H3N2 | 283 | 0.28 | yes | 2 | 0.04 | 99.68 | AQHIEECSC | 95.78 | AQHVEECSC | 3.9 | | | | |
| NA | H3N2 | 284 | 0.27 | yes | 2 | 0.04 | 99.72 | QHIEECSCY | 95.84 | QHVEECSCY | 3.88 | | | | |
| NA | H3N2 | 285 | 0.26 | yes | 2 | 0.06 | 99.83 | HIEECSCYP | 95.97 | HVEECSCYP | 3.88 | | | | |
| NA | H3N2 | 286 | 0.12 | yes | 3 | 0.04 | 99.61 | IEECSCYPR | 95.95 | EECSCYPRF | 3.66 | | | | |
| NA | H3N2 | 287 | 0.17 | yes | 5 | 0.04 | 99.36 | EECSCYPRY | 98.82 | EECSCYPRF | 0.54 | | | | |
| NA | H3N2 | 288 | 0.18 | yes | 3 | 0.04 | 99.27 | ECSCYPRYP | 98.24 | ECSCYPRFP | 2.12 | | | | |
| NA | H3N2 | 289 | 0.48 | yes | 3 | 0.04 | 99.12 | CSCYPRYPG | 98.04 | CSCYPRFPG | 4.86 | CSCYPRYSG | 0.49 | CSCYPRYSG | 0.49 |
| NA | H3N2 | 298 | 0.38 | yes | 3 | 0 | 99.76 | VRCICRDNW | 94.11 | IRCICRDNW | 4.67 | | | | |
| NA | H3N2 | 299 | 0.38 | yes | 3 | 0 | 99.59 | RCICRDNWK | 94.26 | RCVCRDNWK | 4.67 | | | | |
| NA | H3N2 | 300 | 0.37 | yes | 3 | 0 | 99.66 | CICRDNWKG | 94.33 | CVCRDNWKG | 4.67 | | | | |
| NA | H3N2 | 301 | 0.37 | yes | 3 | 0 | 99.66 | ICRDNWKGS | 94.33 | VCRDNWKGS | 4.67 | | | | |
| NA | H3N2 | 302 | 0.09 | yes | 3 | 0 | 99.83 | CRDNWRGSN | 98.97 | CRDNWRGS | 0.86 | | | | |
| NA | H3N2 | 303 | 0.09 | yes | 2 | 0 | 99.83 | RDNWRGSNR | 98.97 | RDNWRGSN | 0.86 | | | | |
| NA | H3N2 | 304 | 0.09 | yes | 2 | 0 | 99.04 | DNWKGSNRP | 99.04 | | | | | | |
| NA | H3N2 | 305 | 0.5 | yes | 1 | 0 | 99.01 | NWKGSNRPI | 90.99 | NWKGSNRPV | 8.03 | WKGSNRPI | 2.87 | WRGSNRPIV | 0.64 |
| NA | H3N2 | 306 | 0.68 | yes | 2 | 0 | 99.59 | WKGSNRPIV | 89.7 | WKGSNRPV | 5.12 | WKGSNRPW | 2.87 | RGSNRPIVD | 0.64 |
| NA | H3N2 | 307 | 0.68 | yes | 5 | 0 | 99.53 | KGSNRPIVD | 89.68 | KGSNRPVD | 5.07 | KGSNRPIID | 2.7 | | |
| NA | H3N2 | 308 | 0.63 | yes | 4 | 0 | 99.53 | GSNRPVVDI | 90.28 | GSNRPVIDI | 5.27 | GSNRPIIDI | 2.68 | SNRPVVDIR | 0.26 |
| NA | H3N2 | 309 | 0.67 | yes | 5 | 0 | 99.23 | SNRPVVDIN | 90.19 | SNRPVIDI | 4.82 | SNRPIIDIN | 2.68 | | |
| NA | H3N2 | 325 | 0.28 | yes | 4 | 0 | 99.38 | SSYLCSGLV | 96.81 | SRYCSGLV | 1.14 | SSYLCSGLV | 0.73 | | |
| NA | H3N2 | 326 | 0.28 | yes | 4 | 0 | 99.38 | SYLCSGLVG | 96.81 | RYCSGLVG | 1.14 | SYLCSGLVG | 0.73 | | |
| NA | H3N2 | 327 | 0.16 | yes | 4 | 0 | 99.64 | YLCSGLVGD | 98.2 | YMCSGLVGD | 0.73 | YLCSGLVGD | 0.71 | | |
| NA | H3N2 | 328 | 0.17 | yes | 3 | 0.06 | 99.57 | VCSGLVGDT | 98.14 | MCSGLVGDT | 0.73 | | | | |
| NA | H3N2 | 329 | 0.02 | yes | 1 | 0.06 | 99.85 | CSGLVGDTP | 99.85 | | | | | | |
| NA | H3N2 | 330 | 0.02 | yes | - | 0.06 | 99.83 | SGLVGDTPR | 99.83 | | | | | | |

FIG. 73-200

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 331 | 0.51 | yes | 2 | 0.06 | 99.12 | GLVG

FIG. 73-201

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 465 | 0.17 | yes | 2 | 2.7 | 99.08 | GTGSWPDGA | 98.31 | GGSWPDGA | 0.77 | SGSWPDGAD | | TGSWPDGAE | 0.38 | | |
| NA | H3N2 | 466 | 0.57 | yes | 4 | 3.64 | 99.07 | TGSWPDGAD | 91.02 | TGSWPDGAN | 6.91 | GSWPDGADL | 6.12 | GSWPDGAEI | 0.38 | | |
| NA | H3N2 | 467 | 0.81 | yes | 3 | 3.79 | 99.33 | GSWPDGADI | 85.82 | GSWPDGANI | 7.01 | ADIKSHAYI | 20 | | | | |
| NA | H3N2 | 473 | 1.37 | no | 2 | 99.89 | 100 | ADINLHAYI | 60 | ADINLMPIY | 20 | DINLMPIYS | 20 | | | | |
| NA | H3N2 | 474 | 1.37 | no | 3 | 99.89 | 100 | DINLHAYIS | 60 | DIKSHAYIS | 20 | | | | | | |
| NA | H3N2 | 475 | 0.81 | no | 2 | 99.91 | 100 | INLHAYISF | 75 | IKSHAYISF | 25 | | | | | | |
| NA | H3N2 | 476 | 0.81 | no | 1 | 99.91 | 100 | NLHAYISFR | 75 | | | | | | | | |
| NA | H3N2 | 477 | 0.81 | no | 1 | 99.91 | 100 | LHAYISFRN | 75 | GLMGRTRIS | 25 | | | | | | |
| NA | H3N2 | 478 | 0 | no | 1 | 99.94 | 100 | HAYISFRNL | 100 | | | | | | | | |
| HA | H4 | 19 | 0.93 | yes | 5 | 0.16 | 99.04 | YTGNPVICL | 76.08 | YTGNPVICM | 22.31 | YTENPVICL | 0.32 | YTGN

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 191 | 0.05 | yes | 1 | 0 | 99.52 | LYIWGVHHP | 99.52 | | | | | | |
| HA | H4 | 192 | 0.03 | yes | 1 | 0 | 99.68 | YIWGVHHPS | 99.68 | | | | | | |
| HA | H4 | 193 | 0.03 | yes | 1 | 0 | 99.52 | IWGVHHPST | 99.68 | | | | | | |
| HA | H4 | 194 | 0.05 | yes | 1 | 0 | 99.52 | WGVHHPSTD | 99.52 | | | | | | |
| HA | H4 | 195 | 0.28 | yes | 3 | 0 | 99.04 | GVHHPSTDT | 96.79 | GVHHPSTDA | 1.28 | | | | |
| HA | H4 | 196 | 0.28 | yes | 3 | 0 | 99.04 | VHHPSTDTE | 96.79 | VHHPSTDAE | 1.28 | | | | |
| HA | H4 | 197 | 0.28 | yes | 3 | 0 | 99.04 | HHPSTDTEQ | 96.79 | HHPSTDAEQ | 1.28 | | | | |
| HA | H4 | 208 | 0.29 | yes | 3 | 0 | 99.04 | LYKNNPGRV | 96.15 | LYENNPGRV | 0.96 | | | | |
| HA | H4 | 209 | 0.34 | yes | 4 | 0.16 | 99.04 | YKNNPGRVT | 96.95 | YENNPGRVT | 0.96 | YKSNPGRVT | 0.48 | | |
| HA | H4 | 211 | 0.27 | yes | 3 | 0.32 | 99.36 | NSPGRVTYS | 97.43 | SNPGRVTYS | 0.8 | | | | |
| HA | H4 | 212 | 0.22 | yes | 3 | 0.32 | 99.36 | NPGRVTYST | 1.13 | | | | | | |
| HA | H4 | 213 | 1.09 | yes | 4 | 0.32 | 99.04 | PGRVTVSTK | 31.03 | PGRVSYSTK | 0.8 | | | | |
| HA | H4 | 224 | 0.3 | yes | 3 | 0 | 99.2 | QTSVVPNIG | 66.72 | QTSVVPDIG | 0.64 | QTSVIPNIG | 0.32 | | |
| HA | H4 | 234 | 0.47 | yes | 5 | 0.32 | 99.04 | RPLVRGQSG | 93.75 | RPLVRSQSG | 0.64 | RPWVRGLSS | 0.32 | | |
| HA | H4 | 235 | 0.41 | yes | 4 | 0.48 | 99.2 | PWVRGQSGR | 94.39 | PLVRSQSGR | 1.12 | | | | |
| HA | H4 | 237 | 0.38 | yes | 4 | 0.64 | 99.2 | VRGQSGRVS | 95.18 | VRSQSGRIS | 1.13 | VRGLSSRIS | 0.32 | | |
| HA | H4 | 238 | 0.4 | yes | 4 | 0.64 | 99.03 | RGQSGRVSF | 94.85 | RSQSGRISF | 1.13 | RGLSSRISF | 0.32 | | |
| HA | H4 | 239 | 0.39 | yes | 4 | 0.64 | 99.19 | GQSGRVSFY | 95.01 | SQSGRISFY | 1.13 | GLSSRISFY | 0.32 | | |
| HA | H4 | 240 | 0.3 | yes | 4 | 0.64 | 99.19 | QSGRVSFYW | 96.13 | SSRISFYW | 1.13 | | | | |
| HA | H4 | 241 | 0.29 | yes | 4 | 0.64 | 99.35 | SGRVSFYWT | 96.13 | SRISFYWT | 1.13 | | | | |
| HA | H4 | 242 | 0.27 | yes | 4 | 0.64 | 99.19 | GRVSFYWTI | 96.45 | SRISFYWTI | 0.32 | | | | |
| HA | H4 | 243 | 0.29 | yes | 2 | 0.64 | 99.03 | RVSFYWTIV | 95.48 | | | | | | |
| HA | H4 | 244 | 0.36 | yes | 5 | 0.64 | 99.03 | VSFYWTIVE | 98.23 | ISFYWTIVE | 0.65 | ISFYWTIW | 0.16 | | |
| HA | H4 | 245 | 0.18 | yes | 3 | 0.64 | 99.03 | SFYWTIVEP | 98.23 | SLYWTIVEP | 0.16 | | | | |
| HA | H4 | 246 | 0.19 | yes | 3 | 0.64 | 99.03 | FYWTIVEPG | 98.06 | FYWTIVEPE | 0.32 | | | | |
| HA | H4 | 247 | 0.19 | yes | 3 | 0.64 | 99.03 | YWTIVEPGD | 98.06 | YWTIVDPG | 0.65 | | | | |
| HA | H4 | 253 | 0.46 | yes | 5 | 0.16 | 99.03 | PGDLIVFNT | 93.06 | PGDIIVFNT | 5.16 | PEDLIVFNT | 0.48 | | |
| HA | H4 | 254 | 0.48 | yes | 4 | 0.16 | 99.19 | GDLIVFNTI | 92.9 | GDIIVFNTI | 5.16 | GDVIVFNTI | 0.48 | | |
| HA | H4 | 255 | 0.47 | yes | 4 | 0.16 | 99.04 | DLIVFNTIG | 93.1 | DIIVFNTIG | 5.14 | NLIVFNTIG | 0.48 | | |
| HA | H4 | 256 | 0.44 | yes | 3 | 0.16 | 99.04 | LIVFNTIGN | 93.42 | IIVFNTIGN | 5.14 | | | | |
| HA | H4 | 257 | 0.11 | yes | 1 | 0.16 | 99.04 | IVFNTIGNL | 98.88 | | | | | | |
| HA | H4 | 258 | 0.2 | yes | 2 | 0.16 | 99.36 | VFNTIGNLI | 97.75 | LFNTIGNLI | 0.48 | | | | |
| HA | H4 | 259 | 0.16 | yes | 2 | 0.16 | 99.36 | FNTIGNLIA | 98.23 | FNTIGNLV | 1.12 | | | | |
| HA | H4 | 260 | 0.16 | yes | 2 | 0.16 | 99.36 | NTIGNLIAP | 98.23 | NTIGNLVA | 1.12 | | | | |
| HA | H4 | 261 | 0.14 | yes | 2 | 0.16 | 99.36 | TIGNLIAPR | 98.23 | TIGNLVAPR | 1.12 | | | | |
| HA | H4 | 262 | 0.16 | yes | 2 | 0.16 | 99.52 | IGNLIAPRG | 98.39 | IGNLVAPRG | 1.12 | | | | |
| HA | H4 | 263 | 0.16 | yes | 2 | 0.16 | 99.36 | GNLIAPRGH | 98.24 | GNLVAPRGH | 1.12 | GNLIVFNTI | 0.32 | | |
| HA | H4 | 264 | 0.14 | yes | 2 | 0 | 99.52 | NLIAPRGHY | 98.4 | NLVAPRGHY | 1.12 | | | | |
| HA | H4 | 265 | 0.22 | yes | 3 | 0 | 99.52 | LIAPRGHYK | 97.44 | LIAPRGHYR | 0.96 | | | | |
| HA | H4 | 266 | 0.25 | yes | 3 | 0 | 99.2 | IAPRGHYKL | 97.12 | IAPRGHYRL | 0.96 | | | | |
| HA | H4 | 289 | 0.57 | yes | 5 | 0 | 99.68 | IGSCVSKCH | 92.15 | IGSCESKCH | 2.4 | IGSCISKCH | 1.92 | IGSCVSRCH | 1.6 |

FIG. 73-204

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 290 | 0.57 | yes | 5 | 0 | 99.68 | GSCVSKCHT | 92.15 | GSCASKCHT | 2.4 | GSCESKCHT | 1

FIG. 73-205

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 365 | 0.14 | yes | 2 | 0 | 99.2 | WYGFRHQNA | 98.56 | WYGFRHQNS | 0.64 | | | | |
| HA | H4 | 366 | 0.12 | yes | 2 | 0 | 99.36 | YGFRHQNAE | 98.72 | YGFRHQNSE | 0.64 | | | | |
| HA | H4 | 367 | 0.12 | yes | 2 | 0 | 99.36 | GFRHQNAEG | 98.72 | GFRHQNSEG | 0.64 | | | | |
| HA | H4 | 368 | 0.12 | yes | 2 | 0 | 99.36 | FRHQNAEGT | 98.72 | FRHQNSEGT | 0.64 | | | | |
| HA | H4 | 369 | 0.11 | yes | 2 | 0 | 99.52 | RHQNAEGTG | 98.88 | RHQNSEGTG | 0.64 | | | | |
| HA | H4 | 370 | 0.09 | yes | 1 | 0 | 99.04 | HQNAEGTGT | 99.04 | | | | | | |
| HA | H4 | 371 | 0.11 | yes | 2 | 0 | 99.52 | QNAEGTGTA | 98.88 | QNSEGTGTA | 0.64 | | | | |
| HA | H4 | 372 | 0.09 | yes | 1 | 0 | 99.04 | NAEGTGTAA | 99.04 | | | | | | |
| HA | H4 | 373 | 0.11 | yes | 2 | 0 | 99.52 | AEGTGTAAD | 98.88 | SEGTGTAAD | 0.64 | | | | |
| HA | H4 | 374 | 0.03 | yes | 1 | 0 | 99.68 | EGTGTAADL | 99.68 | | | | | | |
| HA | H4 | 375 | 0.05 | yes | 1 | 0 | 99.52 | GTGTAADLK | 99.52 | | | | | | |
| HA | H4 | 376 | 0.07 | yes | 1 | 0 | 99.36 | TGTAADLKS | 99.36 | | | | | | |
| HA | H4 | 377 | 0.07 | yes | 1 | 0 | 99.36 | GTAADLKST | 99.36 | | | | | | |
| HA | H4 | 378 | 0.07 | yes | 1 | 0 | 99.36 | TAADLKSTQ | 99.36 | | | | | | |
| HA | H4 | 379 | 0.16 | yes | 2 | 0 | 99.36 | AADLKSTQA | 98.24 | AADLKSTQT | 1.12 | | | | |
| HA | H4 | 380 | 0.14 | yes | 2 | 0 | 99.2 | ADLKSTQAA | 98.4 | ADLKSTQTA | 1.12 | | | | |
| HA | H4 | 381 | 0.16 | yes | 2 | 0 | 99.36 | DLKSTQAAI | 98.24 | DLKSTQTAI | 1.12 | | | | |
| HA | H4 | 382 | 0.17 | yes | 2 | 0 | 99.2 | LKSTQAAID | 98.08 | LKSTQTAID | 1.12 | | | | |
| HA | H4 | 383 | 0.2 | yes | 3 | 0 | 99.04 | KSTQAAIDQ | 97.44 | KSTQTAIDQ | 1.12 | KSTQAAIDK | 0.32 | | |
| HA | H4 | 384 | 0.23 | yes | 4 | 0 | 99.04 | STQAAIDQI | 97.28 | STQTAIDQI | 1.12 | STQAAIDQV | 0.32 | STQAAIDKI | 0.32 |
| HA | H4 | 385 | 0.26 | yes | 5 | 0 | 99.04 | TQAAIDQIN | 97.28 | TQTAIDQIT | 1.12 | TQAAIDQIT | 0.32 | TQAAIDKIN | 0.32 |
| HA | H4 | 386 | 0.26 | yes | 4 | 0 | 99.04 | QAAIDQING | 97.28 | QTAIDQITG | 1.12 | QAAIDQITG | 0.48 | QAAIDKING | 0.32 |
| HA | H4 | 387 | 0.26 | yes | 4 | 0 | 99.04 | AAIDQINGK | 97.92 | AAIDQITGK | 0.64 | TAIDQITGK | 0.48 | AAINQINGK | 0.48 |
| HA | H4 | 388 | 0.2 | yes | 4 | 0 | 99.2 | AIDQINGKL | 97.92 | AIDQITGKL | 0.64 | AIDQVNGKL | 0.48 | AINQINGKL | 0.48 |
| HA | H4 | 389 | 0.19 | yes | 3 | 0 | 99.04 | IDQINGKLN | 99.04 | IDQITGKLN | 0.64 | IDKINGKLN | 0.32 | | |
| HA | H4 | 390 | 0.15 | yes | 2 | 0 | 99.2 | DQINGKLNR | 98.08 | DQITGKLNR | 0.64 | NQINGKLNR | 0.32 | DQISGKLNR | 0.32 |
| HA | H4 | 391 | 0.12 | yes | 2 | 0 | 99.2 | QINGKLNRL | 98.4 | QITGKLNRL | 0.48 | INQINGKL | 0.32 | | |
| HA | H4 | 392 | 0.11 | yes | 2 | 0 | 99.36 | INGKLNRLI | 98.72 | ITGKLNRLI | 0.48 | KINGKLN | 0.32 | | |
| HA | H4 | 393 | 0.15 | yes | 3 | 0 | 99.68 | NGKLNRLIE | 98.88 | TGKLNRLIE | 0.48 | | | | |
| HA | H4 | 394 | 0.19 | yes | 3 | 0 | 99.36 | GKLNRLIEK | 98.08 | GKLNRLIER | 0.48 | | | | |
| HA | H4 | 395 | 0.19 | yes | 3 | 0 | 99.36 | KLNRLIEKT | 97.76 | KLNRLIERT | 0.48 | | | | |
| HA | H4 | 396 | 0.31 | yes | 3 | 0 | 99.36 | LNRLIEKTN | 96.15 | LNRLIERTN | 1.6 | NRLIEKTND | 1.6 | | |
| HA | H4 | 397 | 0.31 | yes | 3 | 0 | 99.36 | NRLIEKTNE | 96.15 | NRLIERTNE | 1.6 | RLIERTNEK | 1.6 | | |
| HA | H4 | 398 | 0.32 | yes | 3 | 0 | 99.2 | RLIEKTNEK | 95.99 | RLIERTNEK | 1.6 | LIEKTNDKY | 1.6 | | |
| HA | H4 | 399 | 0.34 | yes | 3 | 0 | 99.04 | LIEKTNEKY | 95.99 | LIEKTNDKY | 1.6 | IEKTNDKYH | 1.6 | | |
| HA | H4 | 400 | 0.32 | yes | 3 | 0 | 99.2 | IEKTNEKYH | 95.83 | IEKTNDKYH | 1.6 | ERTNEKYHQ | 1.6 | | |
| HA | H4 | 401 | 0.2 | yes | 2 | 0 | 99.04 | EKTNEKYHQ | 95.99 | ERTNEKYHQ | 1.6 | KTNDKYHQI | 1.6 | | |
| HA | H4 | 402 | 0.15 | yes | 2 | 0 | 99.2 | KTNEKYHQI | 97.6 | KTNDKYHQI | 1.6 | | | | |
| HA | H4 | 403 | 0.12 | yes | 2 | 0 | 99.2 | TNEKYHQIE | 98.08 | TNDKYHQIE | 1.6 | | | | |
| HA | H4 | 404 | 0.15 | yes | 2 | 0 | 99.68 | NEKYHQIEK | 98.08 | NDKYHQIEK | 1.6 | | | | |
| HA | H4 | 405 | 0.15 | yes | 2 | 0 | 99.68 | EKYHQIEKE | 98.08 | DKYHQIEKE | 1.6 | | | | |

FIG. 73-207

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 451 | 0.18 | yes | 3 | 0.16 | 99.04 | TIDMT

FIG. 73-208

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 506 | 0.41 | yes | 4 | 0 | 99.04 | YRDEAIN

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 75 | 0.21 | yes | 3 | 0.05 | 99.16 | DCSVAGWLL

FIG. 73-211

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 328 | 0.2 | yes | 3 | 0.08 | 99.11 | TIGECPK

FIG. 73-212

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 403 | 0.24 | yes | 4 | 0.05 | 99.01 | YAADKESTQ | 97.71 | YAADQESTQ | 0.56 | YAADRESTQ | 0.41 | A

FIG. 73-213

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 483 | 0.43 | yes | 5 | 0 | 99.03 | NVKNLYDKV | 95

FIG. 73-214

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 583 | 1.31 | yes | 4 | 5.61 | 99.14 | LSLWMCSNG | 16.9 | LSFWMCSNG | 13.61 | LLLWMCSNG | 0.24 | | |
| HA | H5 | 584 | 1.33 | yes | 4 | 6.7 | 99.02 | SLWMCSNGS | 17.04 | SFWMCSNGS | 13.77 | LLWMCSNGS | 0.25 | | |
| HA | H5 | 585 | 0.8 | yes | 4 | 8.08 | 99.14 | LWMCSNGSL | 17.3 | FWMCSNGSL | 0.17 | LWMCSNGSY | 0.17 | | |
| HA | H5 | 586 | 0.13 | no | 3 | 8.77 | 99.11 | WMCSNGSLQ | 98.83 | WMCFNGSLQ | 0.17 | | | | |
| HA | H5 | 587 | 0.15 | no | 2 | 9.25 | 99.07 | MCSNGSLQC | 98.9 | MCFNGSLQC | 0.17 | | | | |
| HA | H5 | 588 | 0.23 | no | 2 | 10.27 | 99.09 | CSNGSLQCR | 98.72 | CSNGSLQCK | 0.37 | | | | |
| HA | H5 | 589 | 0.26 | no | 3 | 15.01 | 99.04 | SNGSLQCRI | 97.69 | SNGSLQCRV | 1.08 | SNGSLQCKI | 0.27 | | |
| HA | H5 | 590 | 0.2 | no | 4 | 21.18 | 99.13 | NGSLQCRIC | 97.41 | NGSLQCRV | 0.97 | NGSLQCRIA | 0.45 | NGSLQCKIC | 0.29 |
| HA | H5 | 591 | 1.79 | yes | 3 | 22.68 | 99.18 | GSLQCRICI | 97.99 | GSLQCRVCI | 0.92 | GSLQCKICI | 0.3 | | |
| HA | H5 | 599 | 0 | no | 1 | 99.85 | 100 | FKFVSSDCS | 50 | IKFVSSDCS | 16.67 | IKICESRLR | 16.67 | | |
| HA | H5 | 600 | — | no | 2 | 99.97 | 100 | RFVNSDCSK | 100 | | | IRFVNSDCS | 16.67 | | |
| HA | H5N1 | 1 | 0.59 | no | 2 | 99.94 | 100 | SVKMEKIVL | 50 | ICQMEKIVL | 85.71 | | | | |
| HA | H5N1 | 2 | 0.59 | no | 4 | 99.79 | 100 | VKMEKIVLL | 14.29 | CQMEKIVLL | 85.71 | | | | |
| HA | H5N1 | 3 | 0.64 | no | 2 | 99.79 | 100 | KMEKIVLLF | 14.29 | QMEKIVLLF | 85.71 | | | | |
| HA | H5N1 | 19 | 0.42 | yes | 3 | 7.29 | 99.25 | SDQICIGYH | 5.52 | SDHICIGYH | 90.09 | | | SDQICVGYH | 0.52 |
| HA | H5N1 | 22 | 0.42 | yes | 4 | 1.42 | 99.36 | DQICIGYHA | 5.2 | DHICIGYHA | 93.61 | DQICVGYHA | 3.12 | | |
| HA | H5N1 | 23 | 0.15 | no | 2 | 1.27 | 99.21 | QICIGYHAN | 5.19 | HICIGYHAN | 93.62 | QICVGYHAN | 0.55 | | |
| HA | H5N1 | 24 | 0.15 | no | 2 | 0.48 | 99.18 | ICIGYHANN | 0.54 | ICVGYHANN | 98.67 | | | | |
| HA | H5N1 | 25 | 0.15 | no | 2 | 0.48 | 99.21 | CIGYHANNS | 0.51 | CVGYHANNS | 98.67 | | | | |
| HA | H5N1 | 26 | 0.28 | yes | 3 | 0.42 | 99.24 | IGYHANNST | 98.7 | VGYHANNST | 1.84 | | | | |
| HA | H5N1 | 27 | 0.36 | yes | 3 | 0.33 | 99.12 | GYHANNSTK | 96.86 | GYHANNSTV | 1.84 | | | | |
| HA | H5N1 | 28 | 0.36 | yes | 5 | 0.3 | 99 | YHANNSTEQ | 96.01 | YHANNSTEH | 1.87 | YHANNSTEH | 0.36 | YHANNSTER | 0.36 |
| HA | H5N1 | 29 | 0.36 | yes | 5 | 0.21 | 99.06 | HANNSTEQV | 95.86 | HANNSTIQV | 1.87 | HANNSTEHV | 0.36 | HANNSTERV | 0.36 |
| HA | H5N1 | 30 | 0.37 | yes | 5 | 0.18 | 99.06 | ANNSTEQVD | 95.93 | ANNSTKQVD | 1.87 | ANNSTEHVD | 0.36 | ANNSTERVD | 0.36 |
| HA | H5N1 | 31 | 0.36 | yes | 4 | 0.12 | 99.1 | NNSTEQVDT | 95.93 | NNSTKQVDT | 1.99 | NNSTEHVDT | 0.36 | NNSTERVDT | 0.36 |
| HA | H5N1 | 32 | 0.36 | yes | 4 | 0.12 | 99 | NSTEQVDTI | 95.96 | NSTKQVDTI | 1.99 | NSTEHVDTI | 0.36 | NSTERVDTI | 0.36 |
| HA | H5N1 | 33 | 0.36 | yes | 5 | 0.12 | 99 | STEQVDTIM | 96.11 | STKQVDTIM | 1.99 | | | STERVDTIM | 0.36 |
| HA | H5N1 | 34 | 0.34 | yes | 4 | 0.12 | 99.06 | TEQVDTIME | 96.11 | TKQVDTIME | 1.99 | | | TERVDTIME | 0.36 |
| HA | H5N1 | 35 | 0.37 | yes | 5 | 0.12 | 99.03 | EQVDTIMEK | 95.75 | KQVDTIMEK | 1.99 | ERVDTIMEK | 0.36 | EQVDTIMER | 0.42 |
| HA | H5N1 | 36 | 0.18 | yes | 3 | 0.12 | 99.22 | QVDTIMEKN | 98.25 | QVDTIMERN | 0.36 | | | | |
| HA | H5N1 | 37 | 0.13 | yes | 2 | 0.12 | 99.28 | VDTIMEKNV | 98.79 | VDTIMERNV | 0.42 | | | | |
| HA | H5N1 | 38 | 0.12 | yes | 2 | 0.12 | 99.25 | DTIMEKNVT | 98.85 | DTIMERNVT | 0.42 | | | | |
| HA | H5N1 | 39 | 0.13 | yes | 2 | 0.12 | 99.25 | TIMEKNVTV | 98.82 | TIMERNVTV | 0.42 | | | | |
| HA | H5N1 | 40 | 0.13 | yes | 2 | 0.12 | 99.19 | IMEKNVTVT | 98.76 | IMERNVTVT | 0.42 | | | | |
| HA | H5N1 | 41 | 0.16 | yes | 3 | 0 | 99.25 | MEKNVTVTH | 98.55 | MERNVTVTH | 0.42 | MEKNITVTH | 0.27 | | |
| HA | H5N1 | 42 | 0.16 | yes | 2 | 0 | 99.25 | EKNVTVTHA | 98.55 | ERNVTVTHA | 0.42 | EKNITVTHA | 0.27 | | |
| HA | H5N1 | 43 | 0.18 | yes | 3 | 0 | 99.04 | KNVTVTHAQ | 98.31 | RNVTVTHAQ | 0.42 | KNVTVTHAK | 0.3 | | |
| HA | H5N1 | 44 | 0.19 | yes | 3 | 0 | 99.04 | NVTVTHAQD | 98.34 | NVTVTHAQN | 0.39 | NVTVTHAKD | 0.3 | | |
| HA | H5N1 | 45 | 0.16 | yes | 3 | 0 | 99.01 | VTVTHAQDI | 98.31 | VTVTHAQNI | 0.39 | VTVTHAKDI | 0.3 | | |
| HA | H5N1 | 46 | 0.16 | yes | 3 | 0 | 99.28 | TVTHAQDIL | 98.58 | TVTHAQNIL | 0.39 | TVTHAKDIL | 0.3 | | |
| HA | H5N1 | 47 | 0.15 | yes | 2 | 0 | 99.07 | VTHAQDILE | 98.67 | VTHAQNILE | 0.39 | | | | |

FIG. 73-215

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 48 | 0.3 | yes | 3 | 0 | 99.1 | THAQDILEK | 96.35 | THAQDILEK | 2.35 | | | | |
| HA | H5N1 | 52 | 0.55 | yes | 5 | 0 | 99.16 | DILEKTHNG | 93.01 | DILEKAHNG | 2.32 | DILEKEHNG | 0.39 | DILEKKHNG | 0.99 |
| HA | H5N1 | 65 | 0.71 | yes | 5 | 0 | 99.1 | LDGVKPLIL | 88.37 | LKGVRPLIL | 8.32 | LDGVRPLIL | 1.66 | LEGVKPLIL | 0.18 |
| HA | H5N1 | 67 | 0.7 | yes | 5 | 0.03 | 99.04 | GVKPLILRD | 88.7 | GVRPLILKD | 8.02 | GVRPLILRD | 1.18 | GVKPLILRN | 0.15 |
| HA | H5N1 | 68 | 0.7 | yes | 4 | 0.03 | 99.07 | VKPLILRDC | 88.73 | VRPLILKDC | 8.02 | VRPLILRDC | 1.12 | VKPLILRNC | 0.15 |
| HA | H5N1 | 69 | 0.67 | yes | 3 | 0.03 | 99.25 | KPLILRDCS | 88.85 | RPLILKDCS | 8.14 | RPLILRDCS | 1.12 | | |
| HA | H5N1 | 70 | 0.56 | yes | 3 | 0.03 | 99.04 | PLILRDCSV | 89.9 | PLILKDCSV | 9.04 | PLILKDCSI | 1.15 | | |
| HA | H5N1 | 71 | 0.55 | yes | 3 | 0.03 | 99.19 | LILRDCSVA | 89.93 | LILKDCSVA | 9.04 | LILKDCSIA | 0.21 | | |
| HA | H5N1 | 72 | 0.55 | yes | 2 | 0.03 | 99.19 | ILRDCSVAG | 89.96 | ILKDCSVAG | 9.01 | ILKDCSIAG | 0.21 | | |
| HA | H5N1 | 73 | 0.54 | yes | 1 | 0.03 | 99.07 | LRDCSVAGW | 89.99 | LKDCSVAGW | 9.07 | | | | |
| HA | H5N1 | 74 | 0.55 | yes | 1 | 0.06 | 99.07 | RDCSVAGWL | 89.99 | KDCSVAGWL | 9.07 | | | | |
| HA | H5N1 | 75 | 0.09 | yes | 1 | 0.03 | 99.16 | DCSVAGWLL | 99.16 | | | | | | |
| HA | H5N1 | 76 | 0.06 | yes | 1 | 0.03 | 99.43 | CSVAGWLLG | 99.43 | | | | | | |
| HA | H5N1 | 77 | 0.06 | yes | 1 | 0.03 | 99.46 | SVAGWLLGN | 99.46 | | | | | | |
| HA | H5N1 | 78 | 0.05 | yes | 1 | 0.03 | 99.52 | VAGWLLGNP | 99.52 | | | | | | |
| HA | H5N1 | 79 | 0.22 | yes | 2 | 0.03 | 99.49 | AGWLLGNPM | 97.14 | AGWLLGNPL | 2.35 | | | | |
| HA | H5N1 | 80 | 0.22 | yes | 2 | 0.03 | 99.52 | GWLLGNPMC | 97.17 | GWLLGNPLC | 2.35 | | | | |
| HA | H5N1 | 81 | 0.22 | yes | 2 | 0.03 | 99.52 | WLLGNPMCD | 97.17 | WLLGNPLCD | 2.35 | | | | |
| HA | H5N1 | 82 | 0.27 | yes | 2 | 0.06 | 99.01 | LLGNPMCDE | 96.62 | LLGNPLCDE | 2.35 | | | | |
| HA | H5N1 | 83 | 0.27 | yes | 2 | 0.03 | 99.04 | LGNPMCDEF | 96.65 | LGNPMCDKF | 2.35 | LGNPLCDEF | 2.35 | | |
| HA | H5N1 | 93 | 0.48 | yes | 3 | 0.09 | 99.16 | NVPEWSYIV | 93.24 | NVSEWSYIV | 4.89 | KVPEWSYIV | 0.42 | | |
| HA | H5N1 | 94 | 0.38 | yes | 2 | 0.09 | 99.22 | VPEWSYIVE | 94.3 | VSEWSYIVE | 4.92 | DVPEWSYIV | 0.78 | | |
| HA | H5N1 | 95 | 0.39 | yes | 2 | 0.03 | 99.1 | PEWSYIVEK | 94.21 | SEWSYIVEK | 4.89 | | | | |
| HA | H5N1 | 116 | 0.58 | yes | 4 | 0.09 | 99.04 | FNDYEELKH | 92.07 | FNNYEELKH | 4.55 | LNDYEELKH | 1.42 | FRDYEELKH | 0.12 |
| HA | H5N1 | 117 | 0.46 | yes | 3 | 0.09 | 99.22 | NDYEELKHL | 93.61 | NNYEELKHL | 4.55 | SDYEELKHL | 0.87 | FSDYEELKH | 0.87 |
| HA | H5N1 | 118 | 0.46 | yes | 3 | 0.03 | 99.13 | DYEELKHLL | 93.43 | NYEELKHLL | 4.58 | DYEELKHLM | 1.12 | | |
| HA | H5N1 | 119 | 0.46 | yes | 3 | 0.06 | 99.37 | YEELKHLLS | 97.86 | YEELKHLLM | 1.12 | | | | |
| HA | H5N1 | 120 | 0.21 | yes | 3 | 0.09 | 99.22 | EELKHLLSR | 97.23 | EELKHLLSS | 1.09 | EELKHLLNR | 0.39 | ELKHLLSRT | 0.36 |
| HA | H5N1 | 121 | 0.27 | yes | 5 | 0.06 | 99.22 | ELKHLLSRI | 96.86 | ELKHLMSST | 1.09 | ELKHLLNRI | 0.39 | | |
| HA | H5N1 | 136 | 0.3 | no | 1 | 99.97 | 100 | ADHPPKVAW | 100 | | | | | | |
| HA | H5N1 | 164 | 0 | yes | 1 | 0.03 | 99.07 | SFRNVVWL | 94.33 | SFRNVVWL | 3.74 | SFFRNVVWL | 0.63 | | |
| HA | H5N1 | 194 | 0.43 | yes | 4 | 0.03 | 99.07 | LLVLWGIHH | 78.81 | LLVLWGIHH | 13.29 | LLIIWGIHH | 5.91 | | |
| HA | H5N1 | 218 | 1.06 | yes | 5 | 0.15 | 99.28 | TYISIGTST | 82.05 | TVYSIGTST | 13.25 | TVYSIGTST | 2.96 | THISVGTST | 0.33 |
| HA | H5N1 | 219 | 0.93 | yes | 4 | 0.12 | 99.03 | YISIGTSTL | 82.14 | YVSIGTSTL | 13.24 | YYSIGTSTL | 2.96 | | |
| HA | H5N1 | 220 | 0.92 | yes | 5 | 0.12 | 99.4 | ISVGTSTLN | 82.47 | ISIGTSTLN | 13.24 | VSVGTSTLN | 2.99 | | |
| HA | H5N1 | 221 | 0.88 | yes | 4 | 0.06 | 99.55 | SGTSTLNQ | 82.54 | SIGTSTLNQ | 13.93 | SVGTSTLNL | 3.08 | | |
| HA | H5N1 | 222 | 0.83 | yes | 4 | 0.06 | 99.43 | VGTSTLNQR | 82.45 | IGTSTLNQR | 13.9 | SVGTSTLNL | 3.08 | | |
| HA | H5N1 | 223 | 0.84 | yes | 5 | 0.06 | 99.03 | GTSTLNQRL | 93.12 | GTSTLNQRS | 3.11 | VGTSTLNLR | 0.51 | | |
| HA | H5N1 | 261 | 0.49 | yes | 3 | 0.06 | 99.01 | IHFESNGNFI | 92.85 | ISFESNGNF | 2.89 | INFDSNGNF | 1.99 | | |
| HA | H5N1 | 262 | 0.54 | yes | 3 | 0.06 | 99.19 | HFESNGNFI | 93.04 | SFESNGNFI | 2.89 | NFDSNGNFI | 1.99 | | |
| HA | H5N1 | 263 | 0.22 | yes | 3 | 0.06 | 99.28 | FESNGNFIA | 97.65 | FESNGNFIT | 1.33 | | 0.3 | | |

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 356 | 0.89 | yes | 3 | 2.74 | 99.16 | RKKRGLF

FIG. 73-220

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 492 | 0.05 | yes | 1 | 0.03 | 99.61 | ELGNGCFEF | 99.61 | | | | | | |
| HA | H5N1 | 493 | 0.05 | yes | 1 | 0.06 | 99.58 | LGNGCFEFY | 99.58 | | | | | | |
| HA | H5N1 | 494 | 0.04 | yes | 1 | 0.06 | 99.67 | GNGCFEFYH | 99.67 | | | | | | |
| HA | H5N1 | 495 | — | yes | 2 | 0.06 | 99.64 | NGCFEFYHR | 99.61 | NGCFEFYHR | | | | | |
| HA | H5N1 | 496 | — | yes | 2 | 0.06 | 99.7 | GCFEFYHRC | 99.58 | GCFEFYHRC | | | | | |
| HA | H5N1 | 497 | 1.19 | yes | 3 | 0.06 | 99.61 | CFEFYHKC | 61.2 | CFEFYHRCD | | | | | |
| HA | H5N1 | 498 | 1.39 | yes | 3 | 0.06 | 99.4 | FEFYHKCD | 61.23 | FEFYHKCDD | | FEFYHKCNN | 3.26 | | |
| HA | H5N1 | 508 | 1.08 | yes | 4 | 0.06 | 99.31 | CFEFYHKCDN | 57.88 | CMESVKNGT | 38.44 | CIESVRNGT | 1.15 | CMDSVRNGT | 0.39 |
| HA | H5N1 | 509 | 1.08 | yes | 5 | 0.06 | 99.31 | FEFYHKCDN | 54.63 | FEFYHKCDN | 38.47 | IESVRNGT | 1.15 | MDSVRNGT | 0.39 |
| HA | H5N1 | 511 | 1.07 | yes | 5 | 0.09 | 99.4 | MESIRNGTY | 79.32 | MESVKNGT | 38.41 | SVRNGTYNY | 1.12 | SIRNGTYSY | 0.69 |
| HA | H5N1 | 514 | 0.78 | yes | 4 | 0.06 | 99.31 | SIRNGTYNY | 79.32 | CMESVKNGT | 38.26 | NGTYDYPHY | 0.66 | NGTYDYPRY | 0.66 |
| HA | H5N1 | 542 | 1.05 | yes | 5 | 0.09 | 99.4 | NGTYDYPQY | 79.73 | MESIRNGTY | 10.16 | GWQILSIY | 0.84 | | |
| HA | H5N1 | 543 | 0.96 | yes | 4 | 0.06 | 99.01 | GTYQILSIY | 86.31 | SIRNGTYNY | 10.16 | | | | |
| HA | H5N1 | 544 | 0.09 | yes | 3 | 0.06 | 99.04 | TYQILSIY | 73.47 | NGTYNYPQY | 9.56 | | | | |
| HA | H5N1 | 545 | — | yes | 2 | 0.03 | 99.13 | QILSIYS | 74.68 | GIYQILSIY | 10.67 | | | | |
| HA | H5N1 | 546 | 0.29 | yes | 2 | 0.12 | 99.25 | QILSIYST | 99.25 | IYQILSIY | 23.61 | | | | |
| HA | H5N1 | 547 | 0.29 | yes | 2 | 0.12 | 99.25 | ILSIYSTV | 97.22 | VYQILSIY | 23.61 | | | | |
| HA | H5N1 | 548 | 0.29 | yes | 2 | 0.12 | 99.25 | LSIYSTVA | 96.65 | ILSIYSTA | 2.05 | ILSIYSTV | 0.27 | | |
| HA | H5N1 | 549 | 0.29 | yes | 2 | 0.12 | 99.22 | SIYSTVAS | 96.65 | ILSIYSTAA | 2.05 | LSIYSTVTS | 0.27 | | |
| HA | H5N1 | 550 | 0.77 | yes | 4 | 0.12 | 99.22 | IYSTVASS | 96.68 | LSIYSTVA | 2.02 | SIYSTVTS | 0.27 | | |
| HA | H5N1 | 551 | 0.78 | yes | 5 | 0.13 | 99.13 | YSTVASSL | 87.59 | SIYSTVAS | 2.02 | IYSTVTSS | 0.27 | YSTVYSSLA | 0.27 |
| HA | H5N1 | 552 | 0.79 | yes | 5 | 0.21 | 99.21 | STVASSLA | 87.54 | IYSTVASS | 2.02 | YSTVASSLT | 2.05 | STVYSSLAL | 0.27 |
| HA | H5N1 | 553 | 0.78 | yes | 5 | 0.24 | 98.91 | TVASSLAL | 87.42 | YSTVASSL | 7.43 | STVASSLTL | 2.06 | TVYSSLALA | 0.27 |
| HA | H5N1 | 554 | 0.74 | yes | 5 | 0.36 | 98.7 | VASSLALA | 87.43 | STAASSLAL | 7.44 | TVASSLTLA | 2.07 | VYSSLALAI | 0.27 |
| HA | H5N1 | 555 | 0 | yes | 1 | 0.54 | 99.06 | ASSLALAIM | 88.3 | TAASSLALA | 7.42 | VASSLTLAI | 1.89 | YSSLALAIM | 1.22 |
| HA | H5N1 | 556 | 0 | no | 1 | 1.02 | 100 | EFPSTGNHG | 100 | AASSLALAI | 7.46 | ASSLTLAIM | 1.9 | | |
| HA | H5N1 | 557 | 0 | no | 1 | 99.97 | 100 | FPSTGNHGS | 100 | ASSLTLAIM | 7.43 | | | | |
| HA | H5N1 | 558 | 0 | no | 1 | 99.97 | 100 | PSTGNHGSL | 100 | | | | | | |
| HA | H5N1 | 559 | 0 | no | 1 | 99.97 | 100 | STGNHGSLV | 100 | | | | | | |
| HA | H5N1 | 560 | 0 | no | 1 | 99.97 | 100 | TGNHGSLVL | 100 | | | | | | |
| HA | H5N1 | 561 | 0 | no | 1 | 99.97 | 100 | GNHGSLVLS | 100 | | | | | | |
| HA | H5N1 | 572 | 0.92 | yes | 5 | 4.46 | 99.15 | AGLSLWMCS | 80.83 | AGLFLWMCS | 15.74 | AGLLLWMCS | 2.08 | AGLLWMCF | 0.22 |
| HA | H5N1 | 573 | 0.91 | yes | 4 | 5.27 | 99.05 | GLSLWMCSN | 80.82 | GLFLWMCSN | 15.84 | GLLLWMCSN | 2.1 | AGLSLWMCF | 0.28 |
| HA | H5N1 | 574 | 0.89 | yes | 3 | 5.91 | 99.01 | LSLWMCSNG | 80.79 | LFLWMCSNG | 16.14 | LLWMCSNGS | 2.08 | GLLWMCSN | 0.29 |
| HA | H5N1 | 575 | 0.9 | yes | 4 | 7.17 | 99.19 | SLWMCSNGS | 80.43 | FLWMCSNGS | 16.36 | SFWMCSNGS | 2.11 | LLWMCSNGS | 0.29 |
| HA | H5N1 | 576 | 0.28 | yes | 3 | 8.71 | 99.01 | LWMCSNGSL | 96.7 | FWMCSNGSL | 2.11 | LWMCSNGSY | 0.2 | | |
| HA | H5N1 | 577 | 0.14 | yes | 2 | 9.46 | 99.1 | WMCSNGSLQ | 98.77 | WMCSNGSLQ | 0.2 | WMCSNGALQ | 0.13 | | |
| HA | H5N1 | 578 | 0.15 | no | 2 | 10.03 | 99.03 | MCSNGSLQC | 98.83 | MCFNGSLQC | 0.41 | | | | |
| HA | H5N1 | 579 | 0.15 | no | 2 | 11.24 | 99.05 | CSNGSLQCR | 98.64 | CSNGSLQCK | 1.23 | SNGLQCKI | 0.29 | | |
| HA | H5N1 | 580 | 0.24 | no | 3 | 16.69 | 99.02 | SNGSLQCRI | 97.5 | | | | | | |

FIG. 73-221

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 581 | 0.27 | no | 4 | 23.98 | 99.17 | NGSLQCRIC | 97.23 | NGSLQCRIA | 1.11 | NGSLQCRIC | 0.52 | NGSLQCKIC | 0.32 |
| HA | H5N1 | 582 | 0.19 | no | 2 | 25.52 | 98.99 | GSLQCRICI | 97.98 | GSLQCRVCI | 1.05 | | | | |
| HA | H5N1 | 590 | 1.79 | no | 4 | 99.82 | 100 | FKFVSSDCSK | 50 | IKICESRLR | 16.67 | IRFVNSDCS | 16.67 | IKFVSSDCS | 16.67 |
| HA | H5N1 | 591 | 0 | no | 1 | 99.97 | 100 | RFVNSDCS | 100 | | | | | | |
| NA | H5N1 | 1 | 1.15 | no | 3 | 99.95 | 100 | LVFREQKQE | 71.43 | VFREQKQEF | 14.29 | | | | |
| NA | H5N1 | 2 | 1.06 | no | 2 | 99.68 | 100 | GLREQKQEFK | 75 | FREQIQEFK | 12.5 | | | | |
| NA | H5N1 | 3 | 0.5 | no | 2 | 99.63 | 100 | LREQKQEFK | 88.89 | | | | | | |
| NA | H5N1 | 4 | 0.41 | no | 2 | 99.59 | 100 | REQKQEFKM | 91.67 | | | | | | |
| NA | H5N1 | 5 | 0.35 | no | 2 | 99.45 | 100 | EQKQEFKMN | 93.55 | SQKQEFKMN | 6.45 | | | | |
| NA | H5N1 | 6 | 0.35 | no | 2 | 98.57 | 100 | QKQEFKMNP | 93.55 | QIKQEFKMNP | 6.45 | | | | |
| NA | H5N1 | 7 | 0.35 | no | 2 | 98.57 | 100 | KQEFKMNPN | 93.55 | KQEIKMNP | 6.45 | | | | |
| NA | H5N1 | 8 | 0.35 | no | 2 | 98.57 | 100 | QEFKMNPNK | 93.55 | QEIKMNPNQ | 6.45 | | | | |
| NA | H5N1 | 9 | 0.35 | no | 2 | 98.57 | 100 | EFKMNPNKI | 93.55 | EIKMNPNQK | 6.45 | | | | |
| NA | H5N1 | 10 | 0.35 | no | 2 | 98.57 | 100 | FKMNPNKKI | 85.29 | IKMNPNQKI | 11.76 | | | | |
| NA | H5N1 | 11 | 0.71 | no | 2 | 98.43 | 100 | KMNPNKKII | | KMNPNQKII | 50 | KMNPNQKIM | 2.94 | | |
| NA | H5N1 | 19 | - | no | 1 | 99.91 | 100 | NRDITIGSI | 50 | IEIITIGSI | 50 | | | | |
| NA | H5N1 | 20 | - | no | 1 | 99.91 | 100 | EIITIGSIC | 50 | RDITIGSIC | 50 | | | | |
| NA | H5N1 | 21 | - | no | 1 | 99.91 | 100 | IITIGSICM | 50 | DITIGSICM | 50 | | | | |
| NA | H5N1 | 42 | 0 | no | 1 | 99.95 | 100 | NLDLNMGQP | | | | | | | |
| NA | H5N1 | 43 | 0 | no | 1 | 99.95 | 100 | LDLNMGQPF | | | | | | | |
| NA | H5N1 | 44 | 0 | no | 1 | 99.95 | 100 | DLNMGQPFY | | | | | | | |
| NA | H5N1 | 45 | 0 | no | 1 | 99.95 | 100 | LNMGQPFYS | | | | | | | |
| NA | H5N1 | 52 | 0 | no | 1 | 99.95 | 100 | GPSHSIHTG | | | | | | | |
| NA | H5N1 | 75 | 0.21 | yes | 4 | 92.16 | 99.41 | YENNTWVNQ | 97.65 | YENTTWVNQ | 0.59 | NQNSTWVSQ | 0.59 | | |
| NA | H5N1 | 76 | 0.21 | yes | 4 | 92.16 | 99.41 | NNTWVNQT | 97.65 | ENNTWGNQT | 0.59 | ENTTWVNQT | 0.59 | | |
| NA | H5N1 | 77 | 0.25 | yes | 4 | 92.16 | 99.41 | NNTWVNQTY | 97.06 | NNTWGNQTF | 1.18 | NSTWVSQTY | 0.59 | | |
| NA | H5N1 | 115 | 1.48 | yes | 5 | 0 | 99.54 | GWAYSKDN | 52.97 | GWAIHSKDN | 37.07 | GWAIYSKDN | 5.39 | | |
| NA | H5N1 | 119 | 1.76 | yes | 3 | 0 | 99.26 | YSKDNSIRI | 49.42 | HSKDNGIRI | 33.79 | HSKDNNIRI | 7.56 | HSKDNGIRI | 4.1 |
| NA | H5N1 | 120 | 0.86 | yes | 3 | 0 | 99.49 | SKDNSIRIG | 83.22 | SKDNGIRIG | 9.91 | | | | 6.18 |
| NA | H5N1 | 121 | 0.86 | yes | 3 | 0 | 99.45 | KDNSIRIGS | 83.17 | KDNNIRIGS | 9.91 | | | | |
| NA | H5N1 | 122 | 1.63 | yes | 4 | 0 | 99.31 | DNSIRIGSK | 56.52 | DNGIRIGSK | 26.6 | DNNIRIGSK | 6.32 | | |
| NA | H5N1 | 123 | 1.64 | yes | 4 | 0 | 99.26 | NSIRIGSKG | 56.48 | NGIRIGSKG | 26.56 | NNIRIGSKG | 6.32 | | |
| NA | H5N1 | 124 | 1.63 | yes | 4 | 0 | 99.4 | SIRIGSKGD | 56.52 | GIRIGSKGD | 26.56 | NIRIGSKGD | 6.32 | | |
| NA | H5N1 | 125 | 0.91 | yes | 2 | 0 | 99.49 | IRIGSKGDV | 72.71 | IRIGSRGDV | 26.69 | | | | |
| NA | H5N1 | 126 | 0.96 | yes | 2 | 0 | 99.08 | RIGSKGDVF | 72.8 | RIGSRGDVF | 26.37 | | | | |
| NA | H5N1 | 127 | 0.34 | yes | 2 | 0.05 | 99.03 | IGSKGDVFV | 72.38 | IGSRGDVFI | 1.89 | GDVFIIREP | 0.32 | | |
| NA | H5N1 | 132 | 0.34 | yes | 4 | 0.05 | 99.17 | GDVFIREP | 96.13 | GDVFVTREP | 1.89 | DVFIIREP | 0.51 | DVFAIREPF | 0.18 |
| NA | H5N1 | 134 | 0.39 | yes | 5 | 0.09 | 99.03 | DVFIREPF | 96.08 | DVFVTREPF | 1.89 | FIIREPFIS | 0.6 | FVTREPFIS | 0.51 |
| NA | H5N1 | 136 | 0.33 | yes | 4 | 0.09 | 99.12 | FVIREPFIS | 95.52 | FVIREPFYS | 1.85 | TREPFISCS | 0.6 | | |
| NA | H5N1 | 137 | 0.17 | yes | 3 | 0.05 | 99.12 | IREPFISCS | 96.17 | VREPFISCS | 0.6 | | | | |
| NA | H5N1 | | | | | | | REPFISCSH | 98.34 | REPFISCSQ | | | | | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 190 | 0.12 | yes | 2 | 0 | 99.4 | NSRF

FIG. 73-224

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 255 | 0.39 | yes | 4 | 0 | 99.03 | GSCFTIMTD | 95.39 | GSCFTIMTD | 2.03 | GFCFTVMTD | 0.83 | GYCFTVMTD |

FIG. 73-225

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H5N1 | 370 | 0.28 | yes | 5 | 0.05 | 99.12 | GFSFRYGNG | 97.19 | GFSFRYGNG | 0.83 | GFSFKYGDG | 0.51 | GFSY

| Protein | Sub-type | Start Pos | Block Entropy | Gaps <10% | # to cover 99% | Gap % | Coverage | Included peptides | Freq | Included peptides | Freq | Included peptides | Freq | Included peptides | Freq |
|---|---|---|---|---|---|---|---|---|---|---|---|---|---|---|---|
| HA | H5N2 | 89 |

FIG. 73-228

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N2 | 355 | 0 | yes | 1 | 0 | 100 | GAIAGFIE

FIG. 73-229

| Protein | Sub-type | Start Pos | Block Entropy | Gaps < 10% | # to cover 99% | Gap % | Coverage | Peptides included | Freq | Pe

FIG. 73-230

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H5N2 | 555 | 0.19 | yes | 2 | 1.62 | 99.06 | AGLSFWMCS | 97.88 | AGLFWMCS | 1.18 | | | | | | |
| HA | H5N2 | 556 | 0.19 | yes | 2 | 1.85 | 99.06 | GLSFWMCSN | 97.88 | GLFWMCSN | 1.18 | | | | | | |
| HA | H5N2 | 557 | 0.19 | yes | 3 | 1.85 | 99.06 | LSFWMCSNG | 97.88 | LFWMCSNG | 1.18 | | | | | | |
| HA | H5N2 | 558 | 0.21 | yes | 1 | 1.85 | 99.06 | SFWMCSNGS | 97.64 | FFWMCSNGS | 1.18 | SLCMCSNGS | 0.24 | | | | |
| HA | H5N2 | 559 | 0.14 | yes | 1 | 2.08 | 99.05 | FWMCSNGSL | 98.58 | YWMCSNGSL | 0.24 | LCMCSNGSL | 0.24 | | | | |
| HA | H5N2 | 560 | 0.07 | yes | 1 | 2.55 | 99.05 | WMCSNGSLQ | 99.29 | | | | | | | | |
| HA | H5N2 | 561 | 0.05 | yes | 1 | 2.55 | 99.52 | MCSNGSLQC | 99.52 | | | | | | | | |
| HA | H5N2 | 562 | 0.09 | yes | 3 | 2.55 | 99.05 | CSNGSLQCR | 99.05 | | | | | | | | |
| HA | H5N2 | 563 | 0.16 | yes | 3 | 3.24 | 99.28 | SNGSLQCRI | 98.33 | SNGSLQCRV | 0.48 | SNGSLQCTI | 0.48 | | | | |
| HA | H5N2 | 564 | 0.16 | yes | 5 | 3.24 | 99.28 | NGSLQCRIC | 98.33 | NGSLQCTIC | 0.48 | NGSLQCRVC | 0.48 | | | | |
| HA | H5N2 | 565 | 0.16 | yes | 5 | 3.7 | 99.28 | GSLQCRICI | 98.32 | GSLQCTICI | 0.48 | GSLQCRVCI | 0.48 | | | | |
| HA | H5N2 | 7 | 0.68 | yes | 5 | 4.09 | 99.25 | IITIGSISL | 89.22 | IITIGSJSL | 6.02 | IITIGSASL | 3.01 | IITVGSVSL | 0.5 | IIAIGSVSL | 0.5 |
| NA | H5N2 | 84 | 0.98 | yes | 5 | 0 | 99.04 | YRDWSKPQC | 75.24 | YRNWSKPQC | 22.36 | YWNWSKPQC | 0.48 | YKNWSKPQC | 0.48 | YRSWSKPQC | 0.48 |
| NA | H5N2 | 89 | 0.51 | yes | 5 | 0 | 99.04 | KPQCCQTGF | 93.27 | KPQCCQTGF | 3.12 | KPQCQIAGF | 1.44 | KPQCKITGF | 0.72 | KPQCEITGF | 0.72 |
| NA | H5N2 | 90 | 0.51 | yes | 5 | 0 | 99.04 | PQCQITGFA | 93.27 | PQCQVTGFA | 3.12 | PQCQIAGFA | 1.44 | PQCKITGFA | 0.72 | PQCEITGFA | 0.72 |
| NA | H5N2 | 91 | 0.51 | yes | 5 | 0 | 99.04 | QCQITGFAP | 93.27 | QCQVTGFAP | 3.12 | QCQIAGFAP | 1.44 | QCKITGFAP | 0.72 | QCEITGFAP | 0.72 |
| NA | H5N2 | 92 | 0.49 | yes | 5 | 0 | 99.28 | CQITGFAPF | 93.51 | CQVTGFAPF | 3.12 | CQIAGFAPF | 1.44 | CKITGFAPF | 0.72 | CEITGFAPF | 0.72 |
| NA | H5N2 | 94 | 0.39 | yes | 3 | 0 | 99.28 | ITGFAPFSK | 94.47 | VTGFAPFSK | 3.37 | IAGFAPFSK | 1.44 | | | | |
| NA | H5N2 | 95 | 0.18 | yes | 2 | 0 | 99.52 | TGFAPFSKD | 97.84 | AGFAPFSKD | 1.44 | | | | | | |
| NA | H5N2 | 96 | 0.05 | yes | 1 | 0 | 99.52 | GFAPFSKDN | 99.52 | | | | | | | | |
| NA | H5N2 | 97 | 0.05 | yes | 1 | 0 | 99.04 | FAPFSKDNS | 99.52 | | | | | | | | |
| NA | H5N2 | 98 | 0.23 | yes | 2 | 0 | 99.04 | APFSKDNSI | 99.04 | PFSKDNSIQ | 1.92 | | | | | | |
| NA | H5N2 | 100 | 0.23 | yes | 2 | 0 | 99.04 | PFSKDNSIR | 97.12 | FSKDNSIQL | 1.92 | | | | | | |
| NA | H5N2 | 101 | 0.23 | yes | 2 | 0 | 99.04 | FSKDNSIRL | 97.12 | SKDNSIQLS | 1.92 | | | | | | |
| NA | H5N2 | 102 | 0.21 | yes | 2 | 0 | 99.28 | SKDNSIRLS | 97.36 | KDNSIQLSA | 1.92 | | | | | | |
| NA | H5N2 | 103 | 0.21 | yes | 2 | 0 | 99.28 | KDNSIRLSA | 97.36 | DNSIQLSAG | 1.92 | | | | | | |
| NA | H5N2 | 104 | 0.21 | yes | 2 | 0 | 99.28 | DNSIRLSAG | 97.36 | NSIQLSAGG | 1.92 | | | | | | |
| NA | H5N2 | 107 | 1.2 | yes | 5 | 0 | 99.04 | NSIRLSAGG | 77.64 | RLSAGGDIW | 10.82 | RLSAGGIW | 4.81 | RLSAGGGIW | 4.09 | QLSAGGDIW | 1.92 |
| NA | H5N2 | 114 | 0.7 | yes | 2 | 0.24 | 99.04 | IWVTREPYV | 83.89 | IWITREPYV | 15.14 | | | | | | |
| NA | H5N2 | 115 | 0.7 | yes | 2 | 0.24 | 99.04 | WVTREPYVS | 83.89 | WITREPYVS | 15.14 | | | | | | |
| NA | H5N2 | 116 | 1.47 | yes | 3 | 0.24 | 99.28 | VTREPYVSC | 84.13 | TREPYVSC | 15.14 | TREPYVSCG | 14.9 | | | | |
| NA | H5N2 | 117 | 0.67 | yes | 2 | 0 | 99.04 | TREPYVSCD | 53.85 | TREPYVSCS | 30.53 | | | | | | |
| NA | H5N2 | 128 | 0.16 | yes | 1 | 0 | 99.28 | RCYQFALGQ | 98.31 | RCYQFALGQ | 0.72 | | | | | | |
| NA | H5N2 | 129 | 0.05 | yes | 1 | 0 | 99.52 | KCYQFALGQ | 99.52 | | | | | | | | |
| NA | H5N2 | 130 | 0.05 | yes | 1 | 0 | 99.04 | CYQFALGQG | 99.04 | | | | | | | | |
| NA | H5N2 | 131 | 0.1 | yes | 1 | 0 | 99.04 | YQFALGQGT | 99.04 | | | | | | | | |
| NA | H5N2 | 132 | 0.1 | yes | 3 | 0 | 99.04 | QFALGQGTT | 99.04 | | | | | | | | |
| NA | H5N2 | 133 | 0.92 | yes | 5 | 0 | 99.04 | FALGQGTTL | 74.28 | ALGQGTTLN | 24.52 | ALGQGTTLK | 24.52 | ALGQGTTLD | 0.24 | | |
| NA | H5N2 | 134 | 0.99 | yes | 3 | 0 | 99.04 | ALGQGTTLD | 73.56 | LGQGTTLNN | 24.52 | LGQGTTLDH | 24.52 | LGQGTPLNN | 0.48 | LGQGTTLDS | 0.24 |
| NA | H5N2 | 143 | 0.43 | yes | 3 | 0 | 99.04 | KHSNGTIHD | 93.75 | NHSNGTIHD | 4.57 | RHSNGTIHD | 0.72 | | | | |

FIG. 73-231

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N2 | 144 | 0.1 | yes | 1 | 0 | 99.04 | HSNGTIHDR | 99.04 | SNGTIHDRS | 6.97 | SNDTIHDRT | 1.68 | | |
| NA | H5

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N2 | 325 | 0.6 | yes | 4 | 0 | 99.04 | GDTPRNDDS | 90.38 | GDTPRNDDG | 6.73 | GDTPRNDDS | 1.44 | GDTP

FIG. 73-234

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H

| Protein | Sub-type | Start Pos | Block Entropy | Gaps <10% | # to cover 99% | Gap % | Coverage | Peptides included | Freq | Peptides included | Freq | Peptides included | Freq |
|---|---|---|---|---|---|---|---|---|---|---|---|---|---|
| HA | H6 | 330 | 0.54 | yes | 3 | 0.13 | 99.35 | SLKLATGLR | 90.17 | SLKLATGLR | 8.54 | NLKLATGLR | 0.65 | |

FIG. 73-237

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H6 | 381 | 1.51 | yes | 4 | 0.26 | 99.48 | AADKESTOK | 50.26 | AADKESTOK | 38.21 | AADKESTOR | 8.81 | | |
| HA | H6 | 382 | 1.51 | yes | 4 | 0.26 | 99.48 | ADKESTOKA | 50.26 | ADKESTORA | 38.21 | ADKESTORA | 8.81 |

FIG. 73-238

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 478 | 0.09 | yes | 1 | 0 | 99.1 | DLGNGCF

FIG. 73-239

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 26 | 0 | no | 1 | 99.9 | 100 | DHSDNADKI | 100 | | | | | | |
| HA | H7 | 27 | 0 | no | 1 | 99.9 | 100 | HSDNADKIC | 100 | | | | | | |
| HA |

FIG. 73-240

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|
| HA | H7 | 344 | 1.39 | yes | 4 | 0 | 99.07 | LLATGMRNV | 62.81 | LLATGMKNV | 26.14 | MLATGMKNV | 9.3 | |

FIG. 73-241

| Protein | Sub-type | Start Pos | Block Entropy | Gaps <10% | # to cover 99% | Gap % | Coverage | Peptides included | Peptides included | Freq | Peptides included | Freq | Peptides included | Freq | Peptides included | Freq |
|---|---|---|---|---|---|---|---|---|---|---|---|---|---|---|---|---|
| HA | H7 | 411 | 1.21 | yes | 4 | 0.1 | 99.28 | DGWYGFRHQ | NGWYGFRHQ | 57.19 | DGWYGFRHQ | 39.61

FIG. 73-242

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 490 | 0.37 | yes | 5 | 0 | 99.28 | LLVAMENQH | 95.45 | LLVAMENQH | 2.17 | | | FLVAMENQH | 0.31 |
| HA | H7 | 491

FIG. 73-243

| Protein | Sub-type | Start Pos | Entropy Block | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 579 | 0.04 | yes | 1 | 0 | 99.59 | LWFSFGASC | 99.59 | | | | | | |
| HA | H7 | 580 | 0.07 | yes | 1 | 0 | 99.28 | WFSFGASCF | 99.28 | | | | | | |
| HA | H7 | 581 | 1.03 | yes | 3 | 0.1 | 99.07 | FSFGASCFI | 66.7 | FSFGASCFI | 31.95 | | | | |
| HA | H7 | 582 | 1.2 | yes | 5 | 0.1 | 99.28 | SFGASCFIL | 64.12 | SFGASCFLF | 31.85 | SFGASCLIL | 2.59 | SFGASCFTL | 0.41 |
| HA | H7 | 583 | 1.5 | yes | 5 | 0.1 | 99.07 | FGASCFILL | 57.6 | FGASCFLLA | 31.85 | FGASCFLFL | 6.62 | FGASCLIII | 0.41 |
| HA | H7 | 584 | 1.49 | yes | 4 | 0.1 | 99.07 | GASCFILLA | 57.7 | GASCFLLIA | 31.85 | GASCFLFLA | 6.62 | GASCLIILA | 0.41 |
| HA | H7 | 599 | 1.36 | yes | 3 | 0.41 | 99.17 | FICVKNGNM | 66.39 | FMCVKNGNM | 23.96 | FICVRNGNM | 5.6 | | |
| HA | H7 | 603 | 1.22 | yes | 2 | 2.48 | 99.07 | KNGNMRCTI | 60.49 | KNGNMRCTI | 35.38 | | | | |
| HA | H7 | 604 | 1.04 | yes | 2 | 3.72 | 99.05 | NGNMRCTIC | 63.52 | NGNMRCTI | 35.52 | | | | |
| HA | H7 | 605 | 1.02 | yes | 1 | 4.03 | 99.03 | GNMRCTICI | 63.83 | GNMQCTICI | 35.31 | | | | |
| HA | H7 | 606 | 0 | no | 1 | 99.9 | 99.14 | TCSALFVYS | 100 | | | | | | |
| HA | H7 | 609 | 0 | no | 1 | 99.9 | 100 | CSALFVYSL | 100 | | | | | | |
| HA | H7 | 610 | 0 | no | 1 | 99.9 | 100 | SALFVYSLR | 100 | | | | | | |
| HA | H7 | 611 | 0 | no | 1 | 99.54 | 100 | ALFVYSLRK | 100 | | | | | | |
| HA | H7N2 | 1 | 0 | no | 1 | 99.54 | 100 | SKSRGYKMN | 100 | | | | | | |
| HA | H7N2 | 2 | 0 | no | 1 | 99.54 | 100 | KSRGYKMNT | 100 | | | | | | |
| HA | H7N2 | 3 | 0 | no | 1 | 99.54 | 100 | SRGYKMNTQ | 100 | | | | | | |
| HA | H7N2 | 4 | 0 | no | 1 | 99.54 | 100 | RGYKMNTQI | 100 | | | | | | |
| HA | H7N2 | 5 | 0 | no | 1 | 99.54 | 100 | GYKMNTQIL | 100 | | | | | | |
| HA | H7N2 | 6 | 0 | no | 1 | 99.54 | 100 | YKMNTQILI | 100 | | | | | | |
| HA | H7N2 | 7 | 0 | no | 1 | 99.54 | 100 | KMNTQILLI | 100 | | | | | | |
| HA | H7N2 | 23 | 0.94 | yes | 3 | 0.7 | 99.07 | AKGDKICLG | 84.81 | VKGDKICLG | 7.01 | TNADKICLG | 3.5 | TKGDKICLG | 2.1 |
| HA | H7N2 | 24 | 0.41 | yes | 2 | 0.23 | 99.3 | KGDKICLGH | 94.19 | NADKICLGH | 3.49 | RGDKICLGH | 1.63 | ARGDKICLG | 1.64 |
| HA | H7N2 | 25 | 0.28 | yes | 1 | 0.23 | 99.53 | GDKICLGHH | 95.81 | ADKICLGHH | 3.72 | | | | |
| HA | H7N2 | 26 | 0.05 | yes | 1 | 0.23 | 99.53 | DKICLGHHA | 99.53 | | | | | | |
| HA | H7N2 | 27 | 0.28 | yes | 1 | 0.23 | 99.53 | KICLGHHAV | 95.81 | ICLGHHAVS | 3.72 | | | | |
| HA | H7N2 | 28 | 0.28 | yes | 1 | 0.23 | 99.53 | ICLGHHAVA | 95.81 | CLGHHAVSN | 3.72 | | | | |
| HA | H7N2 | 29 | 0.28 | yes | 1 | 0.23 | 99.53 | CLGHHAVAN | 95.81 | LGHHAVSNG | 3.71 | | | | |
| HA | H7N2 | 30 | 0.23 | yes | 1 | 0 | 100 | LGHHAVANG | 96.29 | GHHAVSNGT | 3.72 | | | | |
| HA | H7N2 | 31 | 0.26 | yes | 1 | 0 | 99.07 | GHHAVANGT | 96.29 | HHAVSNGTK | 2.78 | | | | |
| HA | H7N2 | 32 | 0.3 | yes | 2 | 0 | 99.54 | HHAVANGTK | 96.82 | HAVSNGTKV | 2.78 | AVSNGTKIN | 0.93 | | |
| HA | H7N2 | 33 | 0.32 | yes | 2 | 0 | 99.3 | AVANGTKVN | 95.59 | AVSNGTKVN | 2.78 | VSNGTKINT | 0.93 | | |
| HA | H7N2 | 34 | 0.32 | yes | 2 | 0 | 99.3 | VANGTKVNT | 95.59 | VSNGTKVNT | 2.78 | SNGTKINTL | 0.93 | | |
| HA | H7N2 | 35 | 0.14 | yes | 1 | 0 | 99.3 | ANGTKVNTL | 98.38 | SNGTKVNTL | 0.93 | | | | |
| HA | H7N2 | 36 | 0.14 | yes | 1 | 0 | 99.3 | NGTKVNTLT | 98.38 | NGTKINTLT | 0.93 | | | | |
| HA | H7N2 | 37 | 1.08 | yes | 4 | 0 | 99.3 | GTKINTLTE | 61.48 | TKVNTLTEK | 36.89 | TKINTLTER | 0.93 | | |
| HA | H7N2 | 38 | 1.08 | yes | 4 | 0 | 99.3 | TKVNTLTER | 61.48 | KVNTLTEKG | 36.89 | KINTLTERG | 0.93 | | |
| HA | H7N2 | 40 | 1.27 | yes | 4 | 0 | 99.3 | VNTLTERGI | 58 | VNTLTEKGI | 36.89 | VNTLTERGV | 3.48 | INTLTERGV | 0.93 |
| HA | H7N2 | 42 | 1.26 | yes | 3 | 0 | 99.07 | NTLTERGIE | 57.77 | NTLTEKGIE | 36.89 | NTLTERGVE | 4.41 | | |

FIG. 73-244

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 43

FIG. 73-245

| Protein | Sub-type | Start Pos | Block Entropy | Gaps < 10% | # to cover 99% | Gap % | Coverage | Included Peptides | Freq | Included Peptides | Freq

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| HA | H7N2 | 397 | 1.21 | yes | 4 | 0.23 | 99.07 | KLNRLIGKT | 72.79 | KLNRLISKT | 19.07 | | | | | | |
| HA | H7N2 | 398 | 1.21 | yes | 4 | 0.46 | 99.07 | LNRLIGKTN | 72.73 | LNRLISKTN | 19.11 | | | | | | |
| HA | H7N2 | 399 | 1.24 | yes | 5 | 0.23 | 99.3 | NRLIGKTNQ | 72.56 | NRLIEKTNQ | 18.84 | KLNRLIEKT | 3.72 | NHLIGKTNQ | 0.47 | | |
| HA | H7N2 | 400 | 1.26 | yes | 5 | 0.23 | 99.07 | RLIGKTNQQ | 72.33 | RLISKTNQQ | 18.84 | LNRLIEKTN | 3.73 | HLIGKTNQQ | 0.47 | | |
| HA | H7N2 | 401 | 1.22 | yes | 5 | 0.23 | 99.07 | LIGKTNQQF | 72.79 | LISKTNQQF | 18.84 | NRLIEKTNQ | 3.72 | | | | |
| HA | H7N2 | 402 | 1.24 | yes | 5 | 0.23 | 99.07 | IGKTNQQFE | 72.79 | ISKTNQQFE | 18.84 | RLIEKTNQQ | 3.72 | IGRTNQQFE | 0.47 | | |
| HA | H7N2 | 403 | 1.26 | yes | 5 | 0.23 | 99.3 | GKTNQQFEL | 72.56 | EKTNQQFEL | 18.6 | LIEKTNQQF | 3.72 | GRTNQQFEL | 0.47 | | |
| HA | H7N2 | 404 | 0.14 | yes | 2 | 0.23 | 99.07 | KTNQQFELI | 98.6 | DKTNQQFEL | 0.47 | IEKTNQQFE | 3.72 | | | | |
| HA | H7N2 | 405 | 0.62 | yes | 3 | 0.23 | 99.07 | TNQQFELID | 87.67 | DKTNQQFEL | 11.16 | SKTNQQFEL | 3.72 | | | | |
| HA | H7N2 | 406 | 0.67 | yes | 5 | 0.23 | 99.07 | NQQFELIDN | 87.21 | TNQQFGLID | 11.16 | | | NQQFEMIDN | 0.23 | NQQFELIDH | 0.23 |
| HA | H7N2 | 407 | 0.64 | yes | 5 | 0 | 99.07 | QQFELIDNE | 87.24 | NIQFELIDN | 11.14 | | | QQFEMIDNE | 0.23 | QQFELIDSE | 0.23 |
| HA | H7N2 | 408 | 0.94 | yes | 5 | 0 | 99.07 | QFELIDNEF | 87.47 | KQFELIDNE | 11.14 | | | QFGLIDNEF | 0.23 | | |
| HA | H7N2 | 409 | 0.94 | yes | 4 | 0 | 99.07 | FELIDNEFN | 82.6 | QFELIDNEF | 11.14 | | | FELIDNEFS | 3.94 | FGLIDNEFN | 0.23 |
| HA | H7N2 | 410 | 0.94 | yes | 3 | 0 | 99.07 | ELIDNEFNE | 82.6 | FELIDNEFT | 11.14 | | | ELIDNEFTE | 3.94 | ELIDSEFNE | 0.23 |
| HA | H7N2 | 415 | 0.89 | yes | 3 | 0 | 99.07 | NEFNEVEQQ | 82.6 | ELIDNEFTE | 11.6 | | | NEFTEVEKQ | 3.25 | NEFTEIEQQ | 0.46 |
| HA | H7N2 | 416 | 0.89 | yes | 3 | 0 | 99.07 | EFNEIEQQI | 83.06 | EFNEVEQQI | 11.6 | | | EFTEVEKQI | 3.25 | | |
| HA | H7N2 | 417 | 0.89 | yes | 3 | 0 | 99.07 | FNEIEQQIG | 83.06 | FNEVEQQIG | 11.6 | | | FTEVEKQIG | 3.25 | | |
| HA | H7N2 | 418 | 0.75 | yes | 2 | 0 | 99.07 | NEIEQQIGN | 83.06 | NEVEQQIGN | 11.6 | | | TEVEKQIGN | 3.48 | | |
| HA | H7N2 | 419 | 0.78 | yes | 2 | 0 | 99.07 | EIEQQIGNV | 84.69 | EVEQQIGNV | 11.6 | | | EVEKQIGNV | 3.48 | | |
| HA | H7N2 | 420 | 0.26 | yes | 1 | 0 | 99.77 | IEQQIGNVI | 96.06 | | | VEKQIGNVI | 3.48 | | | | |
| HA | H7N2 | 421 | 0.26 | yes | 1 | 0 | 99.54 | EQQIGNVIN | 96.06 | | | | | | | | |
| HA | H7N2 | 422 | 0.02 | yes | 1 | 0 | 99.77 | QQIGNVINW | 99.77 | | | | | | | | |
| HA | H7N2 | 423 | 0.54 | yes | 2 | 0 | 99.77 | QIGNVINWT | 88.17 | IGNVINWTQ | 11.6 | | | | | | |
| HA | H7N2 | 424 | 0.54 | yes | 2 | 0 | 99.77 | IGNVINWTR | 88.17 | GNVINWTQD | 11.6 | | | | | | |
| HA | H7N2 | 425 | 0.95 | yes | 3 | 0 | 99.77 | GNVINWTRD | 79.58 | NVINWTQDA | 11.6 | | | NVINWTRDS | 8.58 | | |
| HA | H7N2 | 426 | 1.02 | yes | 4 | 0 | 99.77 | NVINWTRDA | 79.58 | INWTQDAMT | 11.6 | | | VINWTRDSM | 6.5 | VINWTRDSI | 2.09 |
| HA | H7N2 | 427 | 0.99 | yes | 4 | 0 | 99.77 | VINWTRDAM | 79.58 | NWTQDAMTE | 11.6 | | | INWTRDSMT | 6.5 | INWTRDSIT | 2.09 |
| HA | H7N2 | 428 | 1.32 | yes | 5 | 0 | 99.77 | INWTRDAMT | 79.81 | WTQDAMTEV | 11.37 | | | NWTRDSMTE | 6.26 | NWTRDSITE | 2.09 |
| HA | H7N2 | 429 | 1.32 | yes | 5 | 0 | 100 | NWTRDAMTE | 79.77 | TQDAMTEVW | 11.37 | | | WTRDSMTEV | 6.26 | WTRDSITEV | 2.09 |
| HA | H7N2 | 430 | 1.35 | yes | 4 | 0 | 99.54 | WTRDAMTEI | 73.78 | QDAMTEVWS | 11.37 | | | TRDSMTEVW | 6.26 | TRDSITEVW | 2.09 |
| HA | H7N2 | 431 | 1.17 | yes | 3 | 0 | 99.54 | TRDAMTEIW | 74.01 | DAMTEVWSY | 17.17 | | | RDSMTEVWS | 6.26 | RDSITEVWS | 2.09 |
| HA | H7N2 | 432 | 1.17 | yes | 3 | 0 | 99.54 | RDAMTEIWS | 74.01 | AMTEVWSYN | 17.17 | | | DSMTEVWSY | 6.26 | | |
| HA | H7N2 | 433 | 0.97 | yes | 4 | 0 | 99.3 | DAMTEIWSY | 74.01 | MTEVWSYNA | 23.43 | | | SMTEVWSYN | 6.26 | | |
| HA | H7N2 | 434 | 0.86 | yes | 3 | 0 | 99.54 | AMTEIWSYN | 74.01 | TEVWSYNAE | 25.52 | | | ITEVWSYNA | 2.09 | | |
| HA | H7N2 | 435 | 0.86 | yes | 2 | 0 | 99.54 | MTEIWSYNA | 74.01 | EVWSYNAEL | 25.52 | | | | | | |
| HA | H7N2 | 436 | 0.86 | yes | 2 | 0 | 99.54 | TEIWSYNAE | 74.01 | VWSYNAELL | 25.52 | | | | | | |
| HA | H7N2 | 437 | 0.05 | yes | 1 | 0 | 99.54 | EIWSYNAEL | 74.01 | | | | | | | | |
| HA | H7N2 | 438 | 0.07 | yes | 1 | 0 | 99.3 | IWSYNAELL | 99.54 | | | | | | | | |
| HA | H7N2 | 439 | 0.05 | yes | 1 | 0 | 99.3 | WSYNAELLV | 99.3 | | | | | | | | |
| HA | H7N2 | 440 | 0.18 | yes | 2 | 0 | 99.07 | SYNAELLVA | 99.07 | YNAELLVAL | 1.16 | YNAELLVAM | 97.91 | | | | |

FIG. 73-249

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 441 | 0.18 | y

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 528 | 0.27 | yes | 2 | 0 | 99.77 | YKDIILWFS | 95.59 | | | | | | |
| HA | H7N2 | 529

FIG. 73-252

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 9 | 0.13 | yes | 2 | 0.25 | 99.26 | TIGSVSLTI | 98.52 | TIGSVSLII | 0.74 | | | | |

FIG. 73-253

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H7N2 | 130 | 0.05 | yes | 1 | 0 | 99.51 | YQFALGQGT | 99.51 | | | | | | |
| NA | H7N2 | 131 | 0.05 | yes | 1 | 0 | 99.51 | QFALGQGTT | 99.51 | | | | | | |
| NA | H7N2 | 132 | 0.02 | yes | 1 | 0 | 99.75 | FALGQGTTL | 99.75 | | | | | | |
| NA | H7N2 | 133 | 0.42 | yes | 4 | 0 | 99.75 | ALGQGTTLD | 99.75 | ALGQGTLY | 2.46 | ALGQGTTLE | 1.97 | | |
| NA | H7N2 | 134 | 0.42 | yes | 4 | 0 | 94.1 | LGQGTTLDN | 94.1 | LGQGTTLYN | 2.46 | LGQGTTLEN | 1.97 | | |
| NA | H7N2 | 135 | 1.11 | yes | 5 | 0 | 99.75 | GQGTTLDNK | 99.75 | GQGTTLDNE | 18.67 | GQGTTLYNK | 2.46 | GQGTTLENK | 1.97 | GQGTTLNNK | 0.98 |
| NA | H7N2 | 136 | 1.11 | yes | 5 | 0 | 99.51 | QGTTLDNKH | 99.51 | QGTTLDNEH | 18.67 | QGTTLYNKH | 2.46 | QGTTLENKH | 1.97 | QGTTLNNKH | 0.98 |
| NA | H7N2 | 137 | 1.11 | yes | 5 | 0 | 99.51 | GTTLDNKHS | 99.51 | GTTLDNEHS | 18.67 | GTTLYNKHS | 2.46 | GTTLENKHS | 1.97 | GTTLNNKHS | 0.98 |
| NA | H7N2 | 138 | 1.11 | yes | 5 | 0 | 99.51 | TTLDNKHSN | 99.51 | TTLDNEHSN | 18.67 | TTLYNKHSN | 2.46 | TTLENKHSN | 1.97 | TLNNKHSN | 0.98 |
| NA | H7N2 | 139 | 1.11 | yes | 5 | 0 | 99.51 | TLDNKHSNG | 99.51 | TLDNEHSNG | 18.67 | TLYNKHSNG | 2.46 | TLENKHSNG | 1.97 | TLNNKHSNG | 0.98 |
| NA | H7N2 | 140 | 1.11 | yes | 5 | 0 | 99.51 | LDNKHSNGT | 99.51 | LDNEHSNGT | 17.44 | LYNKHSNGT | 2.46 | LENKHSNGT | 1.97 | LNNKHSNGT | 0.98 |
| NA | H7N2 | 141 | 0.87 | yes | 3 | 0 | 99.02 | NKHSNGTIH | 99.02 | NEHSNGTIH | 17.44 | | | | | |
| NA | H7N2 | 142 | 0.87 | yes | 3 | 0 | 99.02 | KHSNGTIHD | 99.02 | EHSNGTIHD | 17.44 | | | | | |
| NA | H7N2 | 143 | 0.16 | yes | 2 | 0 | 99.75 | HSNGTIHDR | 99.75 | HSNGTTHDR | 1.97 | | | | | |
| NA | H7N2 | 144 | 0.56 | yes | 4 | 0 | 99.26 | SNGTIHDRI | 99.26 | SNGTTHDRT | 6.14 | SNGTTHDRI | 1.47 | SNGTTHDRT | 1.47 | | |
| NA | H7N2 | 145 | 0.6 | yes | 4 | 0 | 99.02 | HDRIPHRTL | 99.02 | HDRTPHRTL | 3.44 | HDRTSHRTL | 3.19 | HDRISHRTL | 0.98 | | |
| NA | H7N2 | 150 | 0.57 | yes | 4 | 0 | 99.26 | DRIPHRTLL | 99.26 | DRTPHRTLL | 3.44 | DRTSHRTLL | 3.19 | DRISHRTLL | 0.98 | | |
| NA | H7N2 | 151 | 0.57 | yes | 4 | 0 | 99.26 | RIPHRTLLM | 99.26 | RTPHRTLLM | 3.44 | RTSHRTLLM | 3.19 | RISHRTLLM | 0.98 | | |
| NA | H7N2 | 152 | 0.61 | yes | 5 | 0 | 99.26 | IPHRTLLMN | 99.26 | TPHRTLLMN | 3.44 | TSHRTLLMN | 3.19 | ISHRTLLMN | 0.98 | IPHRTLLMS | 0.49 |
| NA | H7N2 | 153 | 0.32 | yes | 2 | 0 | 95.09 | PHRTLLMNE | 95.09 | SHRTLLMNE | 4.18 | | | | | |
| NA | H7N2 | 154 | 0.07 | yes | 1 | 0 | 99.26 | HRTLLMNEL | 99.26 | | | | | | | |
| NA | H7N2 | 155 | 0.04 | yes | 1 | 0 | 99.51 | RTLLMNELG | 99.51 | | | | | | | |
| NA | H7N2 | 156 | 0.04 | yes | 1 | 0 | 99.51 | TLLMNELGV | 99.51 | | | | | | | |
| NA | H7N2 | 157 | 0.04 | yes | 1 | 0 | 99.51 | LLMNELGVP | 99.51 | | | | | | | |
| NA | H7N2 | 158 | 0.04 | yes | 1 | 0 | 99.51 | LMNELGVPF | 99.51 | | | | | | | |
| NA | H7N2 | 159 | 0.04 | yes | 1 | 0 | 99.51 | MNELGVPFH | 99.51 | | | | | | | |
| NA | H7N2 | 160 | 0 | yes | 1 | 0 | 99.51 | NELGVPFHL | 99.51 | | | | | | | |
| NA | H7N2 | 161 | 0.02 | yes | 1 | 0 | 100 | ELGVPFHLG | 100 | | | | | | | |
| NA | H7N2 | 162 | 1.02 | yes | 2 | 0.25 | 99.75 | GVPFHLGT | 99.75 | GVPFHLGTR | 51.84 | | | | | |
| NA | H7N2 | 163 | 1.02 | yes | 2 | 0.25 | 99.75 | VPFHLGTK | 99.75 | VPFHLGTRQ | 51.84 | | | | | |
| NA | H7N2 | 164 | 1.02 | yes | 2 | 0.25 | 99.75 | PFHLGTKQ | 99.75 | PFHLGTRQV | 51.84 | | | | | |
| NA | H7N2 | 165 | 1.02 | yes | 2 | 0.25 | 99.75 | FHLGTKQV | 99.75 | FHLGTRQVC | 51.84 | | | | | |
| NA | H7N2 | 166 | 1.08 | yes | 3 | 0.25 | 99.02 | HLGTKQVC | 99.02 | HLGTRQVCI | 51.11 | | | | | |
| NA | H7N2 | 167 | 1.1 | yes | 3 | 0.25 | 99.51 | LGTKQVCIA | 99.51 | LGTRQVCIA | 50.86 | LGTKQVCMA | 0.74 | | | |
| NA | H7N2 | 168 | 1.11 | yes | 3 | 0.25 | 99.51 | GTKQVCIAW | 99.51 | GTRQVCIAW | 50.74 | GTKQVCMAW | 0.74 | | | |
| NA | H7N2 | 169 | 1.08 | yes | 3 | 0.25 | 99.51 | TKQVCIAWS | 99.51 | TRQVCIAWS | 50.74 | TKQVCMAWS | 0.74 | | | |
| NA | H7N2 | 170 | 0.11 | yes | 2 | 0.25 | 99.01 | KQVCIAWSS | 99.01 | RQVCIAWSS | 50.99 | | | | | |
| NA | H7N2 | 171 | 0.11 | yes | 2 | 0.25 | 98.77 | QVCIAWSSS | 98.77 | QVCMAWSSS | 0.74 | | | | | |
| NA | H7N2 | 172 | 0.11 | yes | 2 | 0.25 | 99.51 | VCIAWSSSS | 99.51 | VCMAWSSSS | 0.74 | | | | | |
| NA | H7N2 | 173 | 0.11 | yes | 2 | 0.25 | 98.77 | CIAWSSSSC | 98.77 | CMAWSSSSC | 0.74 | | | | | |

FIG. 73-255

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 226 | 0.07 | yes | 1 | 0 | 99.26 | QESECVCIN | 99.26 | SECVCINGT | 99.26 | | | | | | |
| NA | H7N2 | 227

FIG. 73-256

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 280 | 0.57 | yes | 3 | 0 | 99.26 | CYPRYPNVR | 90.66 | CYPQYPNVR | 6.14 | | | | |
| NA | H7N2 | 281 | 0.57 | yes | 3 | 0 | 99.26 | YPRYPNVRC | 90.66 | YPQYPNVRC | 6.14 | | | | |
| NA | H7N2 | 282 | 0.58 | yes | 3 | 0 | 99.02 | PRYPNVRCY | 90.66 | PQYPNVRCY | 6.14 | | | | |
| NA | H7N2 | 283 | 0.58 | yes | 2 | 0 | 99.02 | RYPNVRCYC | 90.66 | QYPNVRCYC | 6.14 | | | | |
| NA | H7N2 | 284 | 0.25 | yes | 2 | 0 | 99.02 | YPNVRCYCR | 96.81 | YPDVRCYCR | 2.21 | | | | |
| NA | H7N2 | 285 | 0.22 | yes | 2 | 0 | 99.26 | PNVRCYCRD | 97.05 | PDVRCYCRD | 2.21 | | | | |
| NA | H7N2 | 286 | 0.22 | yes | 1 | 0 | 99.26 | NVRCYCRDN | 97.05 | PDVRCYCRD | 2.21 | | | | |
| NA | H7N2 | 287 | 0.07 | yes | 1 | 0 | 99.26 | VRCYCRDNW | 99.26 | | | | | | |
| NA | H7N2 | 288 | 0.09 | yes | 1 | 0 | 99.02 | RCYCRDNWK | 99.02 | | | | | | |
| NA | H7N2 | 289 | 0.05 | yes | 1 | 0 | 99.51 | CYCRDNWKG | 99.51 | | | | | | |
| NA | H7N2 | 290 | 0.07 | yes | 1 | 0 | 99.26 | YCRDNWKGS | 99.26 | | | | | | |
| NA | H7N2 | 291 | 0.05 | yes | 1 | 0 | 99.51 | CRDNWKGSN | 99.51 | | | | | | |
| NA | H7N2 | 292 | 0.05 | yes | 1 | 0 | 99.51 | RDNWKGSNR | 99.51 | | | | | | |
| NA | H7N2 | 293 | 0.05 | yes | 1 | 0 | 99.51 | DNWKGSNRP | 99.51 | | | | | | |
| NA | H7N2 | 294 | 0.17 | yes | 2 | 0 | 99.26 | NWKGSNRPV | 99.26 | | | | | | |
| NA | H7N2 | 295 | 0.23 | yes | 3 | 0 | 99.51 | WKGSNRPVI | 98.03 | NWKGSNRPI | 1.23 | WKGSNRPVV | 0.74 | | |
| NA | H7N2 | 296 | 0.23 | yes | 4 | 0.49 | 99.51 | KGSNRPVID | 97.3 | WKGSNRPII | 1.23 | KGSNRPVYD | 0.74 | | |
| NA | H7N2 | 297 | 0.4 | yes | 4 | 0.49 | 99.26 | GSNRPVIDI | 97.3 | KGSNRPIID | 1.23 | GSNRPVVDI | 0.74 | | |
| NA | H7N2 | 298 | 0.4 | yes | 4 | 0.25 | 99.51 | SNRPVIDIN | 94.59 | GSNRPIIDI | 2.95 | SNRPVVDIN | 0.74 | | |
| NA | H7N2 | 299 | 0.37 | yes | 3 | 0.25 | 99.26 | NRPVIDINM | 94.59 | SNRPIIDIN | 2.95 | | | | |
| NA | H7N2 | 312 | 0.24 | yes | 4 | 0 | 99.01 | INSSYYCSG | 94.84 | NRPIIDINM | 2.95 | | | | |
| NA | H7N2 | 313 | 0.13 | yes | 2 | 0 | 99.01 | NSSYYCSGL | 97.28 | IDSSYYCSG | 1.23 | IDSSYMCSG | 0.49 | | |
| NA | H7N2 | 314 | 0.13 | yes | 2 | 0 | 99.01 | SSYYCSGLV | 97.28 | DSSYYCSGL | 1.23 | GSSYYCSGL | 0.49 | | |
| NA | H7N2 | 315 | 0.09 | yes | 2 | 0 | 99.01 | SYYCSGLVG | 98.52 | SSYLCSGLV | 0.49 | | | | |
| NA | H7N2 | 316 | 0.09 | yes | 2 | 0 | 99.01 | YYCSGLVGD | 98.52 | SYLCSGLVG | 0.49 | | | | |
| NA | H7N2 | 317 | 0 | yes | 1 | 0 | 99.02 | YCSGLVGDT | 99.02 | | | | | | |
| NA | H7N2 | 318 | 0 | yes | 1 | 0 | 99.02 | CSGLVGDTP | 99.02 | | | | | | |
| NA | H7N2 | 319 | 0.88 | yes | 2 | 0 | 100 | SGLVGDTPR | 100 | | | | | | |
| NA | H7N2 | 320 | 0.88 | yes | 2 | 0 | 100 | GLVGDTPRN | 100 | | | | | | |
| NA | H7N2 | 321 | 1.58 | yes | 3 | 0 | 100 | LVGDTPRNE | 69.78 | LVGDTPRND | 30.22 | | | | |
| NA | H7N2 | 322 | 1.64 | yes | 3 | 0 | 99.26 | VGDTPRNED | 69.78 | VGDTPRNDD | 30.22 | | | | |
| NA | H7N2 | 323 | 1.64 | yes | 5 | 0 | 99.26 | GDTPRNEDG | 34.89 | GDTPRNDDS | 34.89 | GDTPRNDDS | 30.22 | | |
| NA | H7N2 | 324 | 1.75 | yes | 5 | 0 | 99.02 | DTPRNEDGS | 34.89 | DTPRNDDSS | 34.4 | DTPRNDDSS | 29.98 | | |
| NA | H7N2 | 325 | 1.75 | yes | 5 | 0 | 99.02 | TPRNEDGSS | 34.89 | TPRNDDSSS | 34.4 | TPRNDDSSS | 29.98 | PRNDSSSN | 0.74 | PRNDDSSSN | 0.74 |
| NA | H7N2 | 326 | 1.77 | yes | 5 | 0 | 99.26 | PRNEDGSSS | 34.89 | PRNDDSSSS | 33.66 | PRNEDSSSS | 29.24 | PRNEDSSSN | 0.74 | RNEDSSSNS | 0.74 |
| NA | H7N2 | 327 | 1.77 | yes | 5 | 0 | 99.26 | RNEDGSSSN | 34.89 | RNDDSSSSS | 33.66 | RNDDSSSSN | 29.24 | RNDDSSSNS | 0.74 | NDDSSSNSN | 0.74 |
| NA | H7N2 | 328 | 1.77 | yes | 4 | 0 | 99.02 | NEDGSSSNC | 34.89 | NDDSSSSSN | 33.66 | NEDSSSNSN | 28.99 | NEDSSSNSN | 0.74 | DDSSSNSNC | 0.74 |
| NA | H7N2 | 329 | 0.32 | yes | 5 | 0 | 99.02 | EDGSSSNCR | 34.89 | DDSSSSSNC | 33.66 | EDSSSNSNC | 28.99 | EDSSSNSNC | 0.74 | | |
| NA | H7N2 | 333 | 0.32 | yes | 4 | 0 | 99.02 | SSSNCRDPN | 96.07 | SSSNCKDPN | 1.72 | SNSNCRDPN | 0.74 | | | |
| NA | H7N2 | 335 | 1.14 | yes | 5 | 0 | 99.02 | SNCRDPNEE | 78.38 | SNCRDPNDE | 10.32 | SNCKDPNEE | 8.11 | SNCKDPNEE | 1.23 | SNCKDPNEE | 0.98 |
| NA | H7N2 | 339 | 1.17 | yes | 5 | 0 | 99.26 | DPNEERGNP | 78.38 | DPNNERGNP | 8.6 | DPNEKGNP | 6.63 | DPNNEERGSP | 4.91 | DPNEERGSP | 0.74 |

FIG. 73-257

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H7N2 | 340 | 1.15 | yes | 5 | 0 | 99.51 | PNEERGNPG | 78.62 | PNDERGNPG | 8

FIG. 73-258

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 398 | 0.27 | yes | 4 | 0.25 | 99.01 | VDNSNWSGY | 97.04 | VDNNWFGY | 0.74 | VDNNSWSGY | 0.74 | | |
| NA | H7

FIG. 73-259

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 452 | 0.05 | yes | 1 | 0 | 99.51 | TYGTGSWPD | 99.51 | | | | | | |
| NA | H7N2 | 453 | 0.02 | yes | 1 | 0 | 99.75 | YGTGSWPDG | 99.75 | | | | | | |
| NA | H7

FIG. 73-260

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 77 | 0.48 | yes | 4 | 0 | 99.24

FIG. 73-261

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 233 | 1.19 | yes | 4 | 0 | 99.24 | Q

FIG. 73-262

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 343 | 1.59 | yes | 5 | 0.38 | 99.23 | MRNVPENPK | 61.3 | MKNV

FIG. 73-263

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 401 | 0.11 | yes | 2 | 0.38 | 100 | RHQNAQGEG | 98.47 | RHQNAQGEG | | | | | |
| HA | H7N

FIG. 73-264

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H7N3 | 448 | 1.01 | yes | 3 | 0 | 99.62 | EIEQQIGNV | 66.03 | EVEKQIGNV | 32

FIG. 73-265

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 489 | 0.4 | yes | 4 | 0.38 | 99.23 | SEMNKLYER | 94.25 | SEMDKLYER | 4.21 | SEMDKLYT

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 67 | 1.42 | no | 5 | 16.24 | 99.39 | NTVINNIIT | 67.88 | NTVINNIIT | 18.18 | | | NTVINNMT

FIG. 73-268

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H7N3 | 139 | 1.36 | yes | 4 | 0 | 99.49 | LLGTKHSNG | 66.5 | LLGTKHSNG | 15.74 | LLGTRHSNG | 15.74 |

FIG. 73-269

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | H7N3 | 189 |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | H7N3 | 364 | 0 | yes | 1 | 0.51 |

FIG. 73-272

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 441 | 0.09 | yes | 2 | 0 | 99.49 | TLVSNNDWS | 98.98 | TLVSNDWS | 0.51 | | |

FIG. 73-273

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 501 | 0.14 | yes | 3 | 2.03 | 99.48 | SGNWPD

FIG. 73-274

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H7N7 | 92 | 1.17 | yes | 4 | 0 | 100 | TGPPQCDQF | 65.62 | TGPPQCDLF | 29.69 | IGPPQCDLF | 2.34

FIG. 73-275

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 268 | 0.83 | yes | 4 | 0 | 100 | SFNGAF

FIG. 73-276

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 378 | 0.74 | yes | 2 | 0 | 100 | WEGLI

FIG. 73-277

| Protein | Sub-type | Start Pos | Block Entropy | Gaps > 10% | # to cover 99% | Gap % | Coverage | Peptides included | Fre

FIG. 73-278

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 472 | 0.82 | yes | 4 | 0 | 99.22 | IDLADSEMN | 82.03

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 102 | — | yes | 2 | 0 | 100 | DNAVRFGES | 52.17 | DNAIRFGES | 47.83 | | | | |
| NA | H7N

FIG. 73-282

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | H7N7 | 151 | 0.44 | yes | 5 | 0 | 100 | RTAFRGLIS | 94.2 | RTTFRGLIS | 1.45 | RTTFRGLLS | 1.45 | | | RAAFRG

FIG. 73-283

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 216 | 1.4 | yes | 4 | 0 | 100 | KTWARN

| Protein | Sub-type | Start Pos | Block Entropy | Gaps < 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H7N7 | 370 | 0.84 | yes | 4 | 0 | 100 | SRSGFEMLK | 81.16 | SRSGFEMLK | 15.94 | | | | |
| NA | H7N7 | 371 | 0.22 | yes |

FIG. 73-286

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 434 | 0.88 | yes | 3 | 0 | 100 | EEAKYVWW

FIG. 73-287

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 30 | 0.45 | yes | 5 | 0 | 100 | TDTVNTLIE | 94.03 | TDTVNTLIE | 1.49 | TDTVDTLIE | 1.49 | TDTVNTLME | 1.49 |
| HA | H8 | 31 | 0.45 | yes | 5 | 0 | 100 | DTVNTLIEQ | 94.03 | DTVNTLIEQ | 1.49 | DTVNTLMEQ | 1.49 | NTVNTLIEQ | 1.49 |

FIG. 73-288

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 78 | 0.46 | yes | 3 | 0 | 100 | IYGNPKCDI | 92.54 | IYGNPKCDV | 4.48 | IYGNPKCDT | 4.48 | | |
| HA | H8 | 79 | 0.46 | yes | 3 | 0 | 100 | YGNPKCDIH | 92.54 | YGNPKCDVH | 4.48 | YGNPKCDTH | 4.48 | | |
| HA | H8 | 80 | 0.46 | yes | 3 | 0 | 100 | GNPK

FIG. 73-289

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 122 | 0.96 | yes | 3 | 0 | 100 | FSNAAS

FIG. 73-290

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|
| HA | H8 | 167 | 0.42 | yes | 4 | 0 | 100 | TKKKPDTYD | 94.03 | TKKNPEA

FIG. 73-291

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 219 | 0.57 | yes | 4 | 0 | 100 | TNTINR

FIG. 73-292

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H8 | 260 | 0 | yes | 1 | 0 | 100 | RTNGNLIAP | 100 | | | | | | | | |
| HA | H8 | 261 | 0 | yes | 1 | 0 | 100 | TNGNLIAPE | 100 | | | | | | | | |
| HA | H8 | 262 | 0 | yes | 1 | 0 | 100 | NGNLIAPEF | 100 | | | | | | | | |
| HA | H8 | 263 | 0 | yes | 1 | 0 | 100 | GNLIAPEFG | 100 | | | | | | | | |
| HA | H8 | 264 | 0 | yes | 1 | 0 | 100 | NLIAPEFGY | 100 | | | | | | | | |
| HA | H8 | 265 | 0 | yes | 1 | 0 | 100 | LIAPEFGYL | 100 | | | | | | | | |
| HA | H8 | 266 | 0 | yes | 1 | 0 | 100 | IAPEFGYLL | 100 | | | | | | | | |
| HA | H8 | 267 | 0.26 | yes | 2 | 0 | 100 | APEFGYLLR | 95.52 | | | | | | | | |
| HA | H8 | 268 | 0.26 | yes | 2 | 0 | 100 | PEFGYLLRG | 95.52 | | | | | | | | |
| HA | H8 | 269 | 0.26 | yes | 2 | 0 | 100 | EFGYLLRGE | 95.52 | | | | | | | | |
| HA | H8 | 270 | 0.26 | yes | 2 | 0 | 100 | FGYLLRGES | 95.52 | | | | | | | | |
| HA | H8 | 271 | 0.64 | yes | 3 | 0 | 100 | GYLLRGESY | 88.06 | GYLLRGESH | 4.48 | | | | | | |
| HA | H8 | 272 | 0.75 | yes | 3 | 0 | 100 | YLLRGESYG | 86.57 | YLLRGESHG | 4.48 | YLLKGESHC | 4.48 | YLLKGESHG | 1.49 | | |
| HA | H8 | 273 | 0.86 | yes | 3 | 0 | 100 | LLKGESYGR | 85.07 | LLRGESHGR | 4.48 | LLKGESHCR | 1.49 | LLKGESHGK | 1.49 | | |
| HA | H8 | 276 | 0.71 | yes | 5 | 0 | 100 | GESYGRIIQ | 88.06 | GESHCRIIQ | 1.49 | GESHGRIIQ | 1.49 | GESHGRTIQ | 1.49 | | |
| HA | H8 | 277 | 0.71 | yes | 5 | 0 | 100 | ESYGRIIQN | 88.06 | ESHCRIIQN | 1.49 | ESHGRIIQN | 1.49 | ESHGRTIQN | 1.49 | | |
| HA | H8 | 278 | 0.71 | yes | 5 | 0 | 100 | SYGRIIQNE | 88.06 | SHCRIIQNE | 1.49 | SHGRIIQNE | 1.49 | SHGRTIQNE | 1.49 | | |
| HA | H8 | 279 | 0.71 | yes | 5 | 0 | 100 | YGRIIQNED | 88.06 | HCRIIQNED | 1.49 | HCRIIQNE | 1.49 | HGKIIQNED | 1.49 | | |
| HA | H8 | 280 | 0.33 | yes | 3 | 0 | 100 | GRIIQNEDI | 95.52 | HGRTIQNED | 1.49 | GRTIQNEDI | 1.49 | | | | |
| HA | H8 | 281 | 0.22 | yes | 2 | 0 | 100 | RIIQNEDIP | 97.01 | GKIIQNEDI | 1.49 | | | | | | |
| HA | H8 | 282 | 0.11 | yes | 2 | 0 | 100 | IIQNEDIPI | 98.51 | RTIQNEDIP | 1.49 | | | | | | |
| HA | H8 | 283 | 0.19 | yes | 3 | 0 | 100 | IQNEDIPIE | 97.01 | ONEDIPIEN | 2.99 | | | | | | |
| HA | H8 | 284 | 0.57 | yes | 5 | 0 | 100 | QNEDIPIGS | 89.55 | NEDIPIENC | 2.99 | | | | | | |
| HA | H8 | 285 | 0.57 | yes | 5 | 0 | 100 | NEDIPIGNC | 89.55 | SCHTKCQTY | 7.46 | | | | | | |
| HA | H8 | 292 | 1.3 | yes | 3 | 0 | 100 | NCHTKCQTY | 73.13 | CYTIKCQTY | 2.99 | NCYTIKCQTY | 2.99 | NCKTKCQTY | 2.99 | | |
| HA | H8 | 293 | 1.13 | yes | 4 | 0 | 100 | CHTKCQTYA | 77.61 | HTKCQTYTG | 13.43 | CKTKCQTYA | 2.99 | CHTKCQTYT | 2.99 | | |
| HA | H8 | 294 | 1.13 | yes | 4 | 0 | 100 | HTKCQTYAG | 77.61 | | 13.43 | KTKCQTYAG | 2.99 | YTKCQTYAG | 2.99 | | |
| HA | H8 | 295 | 0.19 | yes | 2 | 0 | 100 | TKCQTYAGA | 97.01 | KCQTYTGA | 13.43 | | | | | | |
| HA | H8 | 296 | 0.3 | yes | 3 | 0 | 100 | KCQTYAGAI | 95.52 | KCQTYTGAI | 2.99 | KCQTYAGAV | 1.49 | | | | |
| HA | H8 | 297 | 0.3 | yes | 3 | 0 | 100 | CQTYAGAIN | 95.52 | CQTYTGAIN | 2.99 | CQTYAGAVN | 1.49 | | | | |
| HA | H8 | 298 | 0.3 | yes | 3 | 0 | 100 | QTYAGAINS | 95.52 | QTYTGAINS | 2.99 | QTYAGAVNS | 1.49 | | | | |
| HA | H8 | 299 | 0.45 | yes | 4 | 0 | 100 | TYAGAINSS | 95.52 | TYTGAINSS | 2.99 | TYAGAVNSS | 1.49 | | | | |
| HA | H8 | 300 | 0.45 | yes | 4 | 0 | 100 | YAGAINSSK | 94.03 | YTGAINSSK | 2.99 | YAGAVNSSK | 1.49 | YTGAINSSR | 1.49 | YTGAINSSK | 1.49 |
| HA | H8 | 301 | 0.42 | yes | 4 | 0 | 100 | AGAINSSKP | 94.03 | TGAINSSKP | 2.99 | AGAVNSSKP | 1.49 | AGAVNSSKP | 1.49 | TGAINSSRP | 1.49 |
| HA | H8 | 302 | 0.42 | yes | 4 | 0 | 100 | GAINSSKPF | 94.03 | GAINSSRPF | 2.99 | GAVNSSKPF | 1.49 | | | | |
| HA | H8 | 303 | 0.42 | yes | 4 | 0 | 100 | AINSSKPFQ | 94.03 | AINSSRPFQ | 2.99 | AVNSSKPFQ | 1.49 | | | | |
| HA | H8 | 304 | 0.42 | yes | 4 | 0 | 100 | INSSKPFQN | 94.03 | INSSRPFQN | 2.99 | AINSSKPLQ | 1.49 | | | | |
| HA | H8 | 305 | 0.42 | yes | 4 | 1.49 | 100 | NSSKPFQNA | 93.94 | NSSRPFQNA | 3.03 | NSSKPLQN | 1.49 | | | | |
| HA | H8 | 306 | 0.42 | yes | 4 | 1.49 | 100 | SSKPFQNAS | 93.94 | SSRPFQNAS | 3.03 | NSSKPLQNA | 1.52 | | | | |
| HA | H8 | 307 | 0.42 | yes | 4 | 1.49 | 100 | SKPFQNASR | 93.94 | SRPFQNASR | 3.03 | SSKPFQNTS | 1.52 | SKPLQNASR | 1.52 | | |
| HA | H8 | 308 | 0.53 | yes | 5 | 1.49 | 100 | KPFQNASRH | 92.42 | RPFQNASRH | 3.03 | SKPFQNTSR | 1.52 | KPLQNASRH | 1.52 | KPFQNASRY | 1.52 |

FIG. 73-293

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H8 | 309 | 0.45 | yes | 5 | 1.49 | 100 | PFQNASRHY

FIG. 73-294

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|
| HA | H8 | 354 | 0.11 | yes | 2 | 0 | 100 | FIEGGWSGM | 98.51 | FIEGGWCGM | 1.49 | | | | | | |
| HA | H8 | 355 | 0.11 | yes | 2 | 0 | 100 | IEGGWSGMI | 98.51 | IEGGWCGMI | 1.49 | | | | | | |
| HA | H8 | 356 | 0.11 | yes | 2 | 0 | 100 | EGGWSGMID | 98.51 | EGGWCGMID | 1.49 | | | | | | |
| HA | H8 | 357 | 0.11 | yes | 2 | 0 | 100 | GGWSGMIDG | 98.51 | GGWCGMIDG | 1.49 | | | | | | |
| HA | H8 | 358 | 0.11 | yes | 2 | 0 | 100 | GWSGMIDGW | 98.51 | GWCGMIDGW | 1.49 | |

FIG. 73-295

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H8 | 395 | 0.19 | yes | 2 | 0 | 100 | NKVNNIVDK | 97.01 | NKINNIVDK | 2.99 | | | | | | |
| HA | H8 | 396 | 0.19 | yes | 2 | 0 | 100 | KVNNIVDKM | 97.01 | KINNIVDKM | 2.99 | | | | | | |
| HA | H8 | 397 | 0.19 | yes | 2 | 0 | 100 | VNNIVDKMN | 97.01 | INNIVDKMN | 2.99 | | | | | | |
| HA

FIG. 73-296

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 446 | 0.11 | yes | 2 | 0 | 100 | LLENQKTLD | 98.51 | LLENQKILD | 1

FIG. 73-297

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H8 | 492 | 0.11 | yes | 2 | 0 | 100 | ECMETIKN

FIG. 73-298

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H8 | 533 | 0 | yes | 1 | 0 | 100 | SIYSTVAAS | 100 | | | | | | | | |
| HA | H8 | 534 | 0 | yes | 1 | 0 | 100 | IYSTVAASL | 100 | | | | | | | | |
| HA | H8 | 535 | 0 | yes | 1 | 0 | 100 | YSTVAASLC | 100 | | | | | | | | |
| HA | H8 | 536 | 0 | yes | 1 | 0 | 100 | STVAASLCL | 100 | | | | | | | | |
| HA | H8 | 537 | 0 | yes | 1 | 0 | 100 | TVAASLCLA | 100 | | | | | | | | |
| HA | H8 | 538 | 0.11 | yes | 2 | 0 | 100 | VAASLCLAV | 98.51 | VAASLCLAY | 1.49 | | | | | | |
| HA | H8 | 539 | 0.11 | yes | 2 | 0 | 100 | AASLCLAVL | 98.51 | AASLCLAVI | 1.49 | | | | | | |
| HA | H8 | 540 | 0.22 | yes | 3 | 0 | 100 | ASLCLAVLI | 97.01 | ASLCLAILI | 1.49 | ASLCLAILV | 1.49 | | | | |
| HA | H8 | 541 | 0.22 | yes | 3 | 0 | 100 | SLCLAVLIA | 97.01 | SLCLAILIA | 1.49 | SLCLAVLIA | 1.49 | | | | |
| HA | H8 | 542 | 0.22 | yes | 3 | 0 | 100 | LCLAVLIAG | 97.01 | LCLAILIAG | 1.49 | LCLAILVAG | 1.49 | | | | |
| HA | H8 | 543 | 0.22 | yes | 3 | 0 | 100 | CLAVLIAGG | 97.01 | CLAILIAGG | 1.49 | CLAVLIAGG | 1.49 | | | | |
| HA | H8 | 544 | 0.22 | yes | 3 | 0 | 100 | LAVLIAGGL | 97.01 | LAILIAGGL | 1.49 | LAVLIAGGL | 1.49 | | | | |
| HA | H8 | 545 | 0.22 | yes | 3 | 0 | 100 | AVLIAGGLI | 97.01 | AILIAGGLI | 1.49 | AVLIAGGLI | 1.49 | | | | |
| HA | H8 | 546 | 0.11 | yes | 2 | 0 | 100 | VLIAGGLIL | 98.51 | ILIAGGLIL | 1.49 | | | | | | |
| HA | H8 | 547 | 0.11 | yes | 2 | 0 | 100 | LIAGGLILG | 98.51 | | | | | | | | |
| HA | H8 | 548 | 0 | yes | 1 | 0 | 100 | IAGGLILGM | 100 | | | | | | | | |
| HA | H8 | 549 | 0 | yes | 1 | 0 | 100 | AGGLILGMQ | 100 | | | | | | | | |
| HA | H8 | 550 | 0 | yes | 1 | 0 | 100 | GGLILGMQN | 100 | | | | | | | | |
| HA | H8 | 551 | 0.11 | yes | 2 | 1.49 | 100 | GLILGMQNG | 98.48 | ILGMONGSY | 1.52 | | | | | | |
| HA | H8 | 552 | 0.11 | yes | 2 | 1.49 | 100 | LILGMQNGS | 98.48 | LGMONGSYR | 1.52 | | | | | | |
| HA | H8 | 553 | 0.11 | yes | 2 | 1.49 | 100 | ILGMONGSC | 98.48 | GMONGSYRC | 1.52 | | | | | | |
| HA | H8 | 554 | 0.11 | yes | 2 | 1.49 | 100 | LGMONGSCR | 98.48 | MONGSYRCM | 1.52 | | | | | | |
| HA | H8 | 555 | 0.11 | yes | 2 | 1.49 | 100 | GMONGSCRC | 98.48 | ONGSYRCMF | 1.52 | | | | | | |
| HA | H8 | 556 | 0.11 | yes | 2 | 1.49 | 100 | MONGSCRCM | 98.48 | NGSYRCMFC | 1.54 | | | | | | |
| HA | H8 | 557 | 0.11 | yes | 2 | 1.49 | 100 | ONGSCRCMF | 98.46 | GSYRCMFCI | 1.54 | | | | | | |
| HA | H8 | 558 | 0.1 | yes | 2 | 2.99 | 100 | NGSCRCMFC | 98.46 | | | | | | | | |
| HA | H8 | 559 | 0 | yes | 1 | 2.99 | 100 | GSCRCMFCI | 100 | | | | | | | | |
| HA | H9 | 1 | 0 | no | 1 | 99.94 | 100 | RWKHVTNTI | 100 | |

FIG. 73-299

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H9 | 246 | 0.55 | yes | 4 | 0.06 | 99.04 | VLKPGQTLR | 7.9 | VLRPGQTLR | 0.19 | LLKPGQTLR |

FIG. 73-300

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H9 | 362 | 0.21 | yes | 4 | 0 |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H9N2 | 475 | 0.71 | yes | 4 | 0 | 99.08 | KGCFELYHK | 89.21 | KGCFDLYHK | 5.2 | KGCFELYHR | 3.36 | | |
| HA | H9N2 | 476 | 0.43 | yes | 3 | 0 | 99.01 | GCFELYHKC | 94.34 | KGCFDLYHKC | 3.36 | | 1.32 | | |
| HA | H9N2 | 477 | 0.49 | yes | 4 | 0 | 99.01 | CFELYHKCD | 93.62 | CFDLYHKCD | 3.36 | | 1.32 | | |
| HA | H9N2 | 488 | 0.22 | yes | 5 | 0.13 | 99.08 | CMETIRNGT | 97.96 | CMATIRNGT | 0.53 | CFELYHICN | 0.72 | CMETTRNGT | 0.13 |
| HA | H9N2 | 489 | 0.22 | yes | 5 | 0 | 99.08 | METIRNGTY | 97.96 | MATIRNGTY | 0.53 | CMEAIRNGT | 0.2 | METTRNGTY | 0.13 |
| HA | H9N2 | 521 | 0.26 | yes | 4 | 0 | 99.08 | EGTYKILTI | 97.5 | EETYKILTI | 0.79 | MEAIRNGT | 0.2 | | |
| HA | H9N2 | 522 | 0.24 | yes | 3 | 0 | 99.21 | GTYKILTIY | 98.03 | ETYKILTIY | 0.79 | EGAYKILTI | 0.33 | | |
| HA | H9N2 | 523 | 0.2 | yes | 2 | 0 | 99.08 | TYKILTIYS | 98.95 | AYKILTIYS | 0.72 | GAYKILTIY | 0.33 | | |
| HA | H9N2 | 524 | 0.12 | yes | 2 | 0 | 99.14 | YKILSIYST | 98.42 | | | | | | |
| HA | H9N2 | 525 | 0.17 | yes | 3 | 0 | 99.01 | KILTIYSTA | 98.29 | ILSIYSTA | 0.2 | | | | |
| HA | H9N2 | 526 | 0.18 | yes | 3 | 0 | 99.08 | ILTIYSTAA | 98.48 | | | | | | |
| HA | H9N2 | 527 | 0.16 | yes | 3 | 0 | 99.08 | LTIYSTAAS | 98.35 | SIYSTVASS | 0.59 | IYSTVASSF | 0.2 | | |
| HA | H9N2 | 528 | 0.18 | yes | 3 | 0 | 99.14 | TIYSTAASS | 98.48 | SIYSTVASS | 0.59 | | | | |
| HA | H9N2 | 529 | 0.21 | yes | 3 | 0 | 99.08 | IYSTAASSL | 97.96 | IYSTVASSI | 0.59 | | 0.33 | | |
| NA | H9N2 | 9 | 0 | no | 1 | 99.88 | 100 | IAIGVSRT | 100 | | | | | | |
| NA | H9N2 | 52 | 0 | no | 1 | 99.88 | 100 | VPLVPCEPI | 100 | | | | | | |
| NA | H9N2 | 53 | 0 | no | 1 | 99.88 | 100 | PLVPCEPII | 100 | | | | | | |
| NA | H9N2 | 54 | 0 | no | 1 | 99.88 | 100 | LVPCEPIII | 100 | | | | | | |
| NA | H9N2 | 91 | 0.41 | yes | 5 | 0 | 99.16 | WSKPQCQIT | 94.96 | WLIKPQCQIT | 2.52 | WSKPQCQIA | 0.72 | WSKPQCHIT | 0.24 |
| NA | H9N2 | 92 | 0.4 | yes | 4 | 0 | 99.04 | LIKPQCQITG | 95.08 | WSKPQCQIT | 2.52 | SKPQCLITG | 0.72 | | |
| NA | H9N2 | 93 | 0.27 | yes | 5 | 0 | 99.04 | KPQCLITGF | 97.12 | KPQCQIAGF | 0.72 | KPQCQITGS | 0.48 | PQCQITGSA | 0.48 |
| NA | H9N2 | 94 | 0.66 | yes | 5 | 0 | 99.04 | PQCQITGFA | 89.33 | PQCLITGFA | 7.79 | PQCQIAGFA | 0.72 | QCQITGSAP | 0.48 |
| NA | H9N2 | 95 | 0.66 | yes | 5 | 0 | 99.16 | QCQITGFAP | 89.33 | QCQIAGFAP | 7.79 | QCLITGFAP | 0.72 | RLAAGDIW | 0.24 |
| NA | H9N2 | 111 | 0.92 | yes | 4 | 0 | 99.04 | RLSAGGDIW | 81.25 | RLSAGGIW | 14.42 | RLSAGGIW | 2.88 | VAREPYVSC | 0.36 |
| NA | H9N2 | 120 | 0.27 | yes | 5 | 0 | 99.16 | VTREPYVSC | 97.12 | ITREPYVSC | 0.72 | VNREPYVSC | 0.48 | KCNQFALGQ | 0.24 |
| NA | H9N2 | 132 | 0.53 | yes | 5 | 0 | 99.16 | KCYQFALGQ | 92.93 | NCYQFALGQ | 3.48 | KCYQFALGH | 1.68 | | |
| NA | H9N2 | 133 | 0.17 | yes | 4 | 0 | 99.04 | CYQFALGQG | 98.32 | CYQFALGHG | 0.72 | | | | |
| NA | H9N2 | 134 | 0.2 | yes | 4 | 0.24 | 99.16 | YQFALGQGT | 97.96 | NQFALGQGT | 0.72 | YQFALGQGA | 0.24 | | |
| NA | H9N2 | 135 | 0.18 | yes | 3 | 0 | 99.16 | QFALGQGTL | 98.2 | QFALGQGAT | 0.72 | | | | |
| NA | H9N2 | 136 | 0.18 | yes | 3 | 0 | 99.16 | FALGQGTTL | 98.2 | FALGQGATL | 0.72 | | | | |
| NA | H9N2 | 158 | 0.76 | yes | 4 | 0 | 99.16 | PHRTLLMSE | 87.05 | PHRTLLMSE | 7.07 | SYRTLLMSE | 0.24 | | |
| NA | H9N2 | 159 | 0.75 | yes | 5 | 0 | 99.28 | HRTLLMNE | 86.93 | HRTLLMSEL | 7.31 | SYRTLLMSE | 0.24 | | |
| NA | H9N2 | 160 | 0.61 | yes | 5 | 0 | 99.28 | RTLLMSELG | 87.17 | YRTLLMSEL | 12.11 | | 4.8 | | |
| NA | H9N2 | 161 | 0.62 | yes | 4 | 0 | 99.16 | TLLMNELG | 87.05 | RTLLMSELG | 12.11 | | 4.8 | | |
| NA | H9N2 | 162 | 0.61 | yes | 4 | 0 | 99.28 | LLMNELGVP | 86.81 | TLLMSELGV | 12.11 | | | | |
| NA | H9N2 | 163 | 0.65 | yes | 4 | 0 | 99.28 | LMNELGVPF | 86.57 | LMSELGVP | 11.87 | MSELGVPFN | 0.36 | MNELGVPFN | 0.12 |
| NA | H9N2 | 164 | 0.69 | yes | 4 | 0 | 99.04 | MNELGVPFH | 86.45 | MSELGVPFH | 11.87 | NELGVPFNL | 0.36 | NELGVPFHL | 0.12 |
| NA | H9N2 | 165 | 0.7 | yes | 4 | 0 | 99.04 | NELGVPFHL | 94.12 | SELGVPFH | 11.87 | NELGVPFHL | 0.36 | TKQLCIAWS | 0.12 |
| NA | H9N2 | 175 | 0.42 | yes | 5 | 0 | 99.04 | TKQVCMAWS | 94.12 | TRQVCIAWS | 4.32 | TQQVCIAWS | 0.24 | KQVCIAYSS | 0.12 |
| NA | H9N2 | 176 | 0.42 | yes | 5 | 0 | 99.04 | KQVCIAWSS | 94.12 | RQVCIAWSS | 4.32 | QQVCIAWSS | 0.24 | | |
| NA | H9N2 | 177 | 0.46 | yes | 3 | 0 | 99.04 | QVCMAWSSS | 93.41 | QVCIAWSSA | 4.32 | QQVCIAWSS | 1.32 | | |

FIG. 73-304

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H9N2 | 178 | 0.45 | yes | 3 | 0 | 99.16 | VCIAWSSSS | 93.53 | VCIAWSSAS | 4.32 | VCMAWSSSC

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M | N/A | 77 | 0.14 | yes | 2 | 0.03 | 99.51 | LORRFVQN | 98.64 | | | | | | |
| M | N/A | 78 | 0.15 | yes | 2 | 0.03 | 99.43 | QRRFVQNA | 98.57 | | | | | | |
| M | N/A | 79 | 0.15 | yes | 2 | 0.03 | 99.41 | RRRFIQNAL | 98.55 | | | | | | |
| M | N/A | 80 | 0.28 | yes | 3 | 0.02 | 99.26 | RFVQNALN | 96.88 | RRFIQNALN | 0.87 | | | | | |
| M | N/A | 81 | 0.26 | yes | 3 | 0.02 | 99.38 | FVQNALNG | 97.01 | RFIQNALNG | 0.87 | | | | | |
| M | N/A | 82 | 0.26 | yes | 3 | 0.02 | 99.41 | VQNALNGN | 97.03 | FIQNALNGN | 0.87 | | | | | |
| M | N/A | 83 | 0.26 | yes | 3 | 0.02 | 99.43 | QNALNGNG | 97.06 | IQNALNGNG | 0.87 | | | | | |
| M | N/A | 84 | 0.19 | yes | 2 | 0.02 | 99.5 | NALNGNGD | 97.82 | RFVQNALS | 1.6 | | | | | |
| M | N/A | 85 | 0.19 | yes | 2 | 0.02 | 99.49 | ALNGNGDP | 97.8 | FVQNALSG | 1.6 | | | | | |
| M | N/A | 86 | 0.19 | yes | 2 | 0.01 | 99.23 | LNGNGDPN | 97.55 | VQNALSGN | 1.6 | | | | | |
| M | N/A | 87 | 0.22 | yes | 2 | 0.02 | 99.32 | NGNGDPNN | 97.63 | QNALSGNG | 1.6 | | | | | |
| M | N/A | 88 | 0.21 | yes | 2 | 0.02 | 99.06 | GNGDPNNM | 97.54 | NALSGNGD | 1.69 | | | | | |
| M | N/A | 89 | 0.11 | yes | 1 | 0.03 | 99.09 | NGDPNNMD | 99.06 | ALSGNGDP | 1.69 | | | | | |
| M | N/A | 90 | 0.86 | yes | 4 | 0.02 | 99.24 | NGDPNNMDK | 77.18 | GDPNNMDR | 21.91 | LSGNGDPN | 1.69 | | | | |
| M | N/A | 91 | 0.88 | yes | 4 | 0.02 | 99.1 | GDPNNMDKA | 77.16 | DPSNMDRA | 21.81 | SGNGDPNM | 1.67 | | | | |
| M | N/A | 92 | 0.89 | yes | 4 | 0.03 | 99.07 | DPNNMDKAV | 77.09 | PSNMDRAV | 21.73 | | | | | |
| M | N/A | 93 | 0.91 | yes | 4 | 0.02 | 99.02 | PNNMDKAVK | 77.04 | SNMDRAVKL | 21.63 | | | | | |
| M | N/A | 94 | 0.87 | yes | 3 | 0.02 | 99.12 | NNMDKAVKL | 77.01 | NMDRAVKL | 21.61 | | | | | |
| M | N/A | 95 | 1.71 | yes | 5 | 0.02 | 99.11 | NMDKAVKLY | 77.37 | MDRAVKLY | 21.62 | PNNMARAVK | 0.28 | | | | |
| M | N/A | 96 | 1.69 | yes | 4 | 0.02 | 99.12 | MDKAVKLYR | 38.8 | DRAVKLYR | 38.58 | DPSNMDRA | 0.28 | | | | |
| M | N/A | 97 | 1.68 | yes | 4 | 0.02 | 99.28 | DKAVKLYRK | 38.88 | RAVKLYRK | 38.62 | PSNMDRAV | 0.28 | | | | |
| M | N/A | 98 | 1.06 | yes | 2 | 0.01 | 99.26 | RAVKLYRKL | 38.86 | AVKLYRKL | 38.79 | SNMDRAVKL | 0.28 | | | | |
| M | N/A | 99 | 1.04 | yes | 2 | 0.01 | 99.39 | AVKLYRKLK | 59.53 | VKLYRKLK | 39.73 | NMARAVKL | 0.13 | | | | |
| M | N/A | 100 | 1.04 | yes | 2 | 0.01 | 99.45 | VKLYRKLKR | 59.63 | KLYRKLKR | 39.76 | MDKAVKLY | 20.67 | MARAVKLYK | 0.12 | | | |
| M | N/A | 101 | 1.24 | yes | 3 | 0.02 | 99.39 | KLYRKLKRE | 59.66 | LYKKLKREM | 39.8 | DKAVKLYRK | 20.7 | | | | |
| M | N/A | 102 | 1.25 | yes | 3 | 0.02 | 99.43 | LYRKLKREI | 59.57 | YKKLKREMT | 35.35 | KAVKLYKKL | 20.69 | | | | |
| M | N/A | 103 | 1.25 | yes | 3 | 0.02 | 99.32 | YRKLKREIT | 59.57 | KKLKREMTF | 35.37 | | | | | |
| M | N/A | 104 | 0.35 | yes | 2 | 0.03 | 99.36 | RKLKREITF | 59.48 | KLKREMTFH | 35.35 | | | | | |
| M | N/A | 105 | 0.37 | yes | 2 | 0.03 | 99.19 | KLKREITFH | 94.68 | LKREMTFHG | 4.68 | LYKKLKREM | 4.48 | | | | |
| M | N/A | 106 | 0.38 | yes | 2 | 0.03 | 99.12 | LKREITFHG | 94.5 | KREMTFHGA | 4.68 | YKKLKREMT | 4.5 | | | | |
| M | N/A | 107 | 0.39 | yes | 2 | 0.02 | 99.02 | KREITFHGA | 94.44 | REMTFHGAK | 4.68 | KKLKREMTF | 4.5 | | | | |
| M | N/A | 108 | 0.4 | yes | 3 | 0.04 | 99.15 | REITFHGAK | 94.33 | EMTFHGAKE | 4.67 | EITTYGAKE | 0.16 | ITFHRAKEV | 0.11 |
| M | N/A | 109 | 1.25 | yes | 3 | 0.04 | 99.09 | EITFHGAKE | 65.49 | ITHGAKEV | 28.77 | MTFHGAKEI | 4.6 | FHRAKEVAL | 0.11 |
| M | N/A | 110 | 1.66 | yes | 5 | 0.04 | 99.04 | ITHGAKEV | 45.21 | THGAKEVA | 28.68 | TFHGAKEYS | 24.99 | GAKEISLY | 0.16 |
| M | N/A | 112 | 1.68 | yes | 5 | 0.04 | 99.01 | THGAKEVA | 45.09 | FHGAKEVAL | 28.66 | FHGAKEVSL | 24.99 | | |
| M | N/A | 114 | 1.72 | yes | 5 | 0.05 | 99.13 | FHGAKEVAL | 44.23 | GAKEVALGY | 28.81 | GAKEVSLY | 25 | | |
| M | N/A | 115 | 1.71 | yes | 4 | 0.04 | 99.07 | GAKEIALSY | 44.38 | AKEVALSYS | 28.77 | AKEVSLYS | 24.99 | AKEVALGYS | 0.94 |
| M | N/A | 117 | 1.92 | yes | 5 | 0.05 | 99.03 | EIALSYSAG | 40.04 | EVALSYSAG | 28.69 | EVSLYSTG | 24.86 | EVALGYS | 0.93 |
| M | N/A | 118 | 1.92 | yes | 5 | 0.05 | 99.03 | IALSYSAGA | 40.05 | VALSYSAGA | 28.7 | VSLYSTGA | 24.86 | EVALGYSTG | 4.52 |
| M | N/A | 119 | 1.7 | yes | 4 | 0.03 | 99.22 | ALSYSAGAL | 40.22 | ALSYSTGAL | 33.19 | SLSYSTGAL | 24.88 | VALGYSTGA | 4.48 |

FIG. 73-308

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 120 | 1.07 | yes | 3 | 0.03 | 99.31 | LSYTGALA | 64.87 | LSYSTGALA | 33.51 | | | | |
| M1 | N/A | 121 | 1.07 | yes | 3 | 0.02 | 99.31 | SYSTGALAS | 64.89 | SYSTGALAS | 33.49 | | | | |
| M1 | N/A | 122 | 0.99 | yes | 2 | 0.01 | 99.36 | YSTGALASC | 65.88 | YSTGALAS | 33.49 | | | | |
| M1 | N/A | 123 | 0.99 | yes | 2 | 0.01 | 99.35 | STGALASCM | 65.88 | SAGALASCM | 33.47 | | | | |
| M1 | N/A | 124 | 0.99 | yes | 2 | 0.01 | 99.39 | TGALASCMG | 65.89 | AGALASCMG | 33.5 | | | | |
| M1 | N/A | 125 | 0.07 | yes | 1 | 0.01 | 99.36 | GALASCMGL | 99.36 | | | | | | |
| M1 | N/A | 126 | 0.08 | yes | 1 | 0.01 | 99.36 | ALASCMGLI | 99.28 | | | | | | |
| M1 | N/A | 127 | 0.08 | yes | 1 | 0.01 | 99.31 | LASCMGLIY | 99.31 | | | | | | |
| M1 | N/A | 128 | 0.09 | yes | 1 | 0.01 | 99.24 | ASCMGLIYN | 99.24 | | | | | | |
| M1 | N/A | 129 | 0.08 | yes | 1 | 0.01 | 99.38 | SCMGLIYNR | 99.38 | | | | | | |
| M1 | N/A | 130 | 0.06 | yes | 1 | 0.01 | 99.55 | CMGLIYNRM | 99.55 | | | | | | |
| M1 | N/A | 131 | 0.06 | yes | 1 | 0.01 | 99.55 | MGLIYNRMG | 99.55 | | | | | | |
| M1 | N/A | 132 | 0.93 | yes | 2 | 0.01 | 99.58 | GLIYNRMGT | 70.3 | GLIYNRMGA | 29.28 | | | | |
| M1 | N/A | 133 | 1.14 | yes | 3 | 0.02 | 99.45 | LIYNRMGTV | 69.42 | LIYNRMGAV | 29.27 | IYNRMGTI | 0.76 | IYNRMGTIT | 0.76 |
| M1 | N/A | 134 | 0.78 | yes | 3 | 0.05 | 99.06 | IYNRMGTVT | 67.55 | IYNRMGAVT | 29.21 | IYNRMGTVA | 1.54 | | |
| M1 | N/A | 46 | 0.77 | yes | 2 | 0.05 | 99.65 | AFGLICATC | 85.3 | AFGLICATC | 8.75 | ALGLVCATC | 5.6 | | |
| M1 | N/A | 47 | 0.47 | yes | 2 | 0.05 | 99.71 | FGLVCATCE | 85.36 | FGLICATCE | 8.75 | LGLVCATCE | 5.6 | | |
| M1 | N/A | 48 | 0.47 | yes | 2 | 0.04 | 99.7 | GLVCATCEQ | 90.95 | GLICATCEQ | 8.76 | | | | |
| M1 | N/A | 49 | 0.47 | yes | 2 | 0.04 | 99.7 | LVCATCEQI | 90.94 | LICATCEQI | 8.76 | | | | |
| M1 | N/A | 150 | 0.03 | yes | 1 | 0.04 | 99.69 | VCATCEQIA | 90.93 | ICATCEQIA | 8.76 | | | | |
| M1 | N/A | 151 | 0.22 | yes | 2 | 0.04 | 99.76 | CATCEQIAD | 99.76 | | | | | | |
| M1 | N/A | 152 | 0.35 | yes | 3 | 0.04 | 99.73 | ATCEQIADS | 96.98 | ATCEQIADA | 2.75 | | | | |
| M1 | N/A | 153 | 0.37 | yes | 3 | 0.04 | 99.72 | TCEQIADSQ | 95.12 | TCEQIADAQ | 2.75 | TCEQIADSH | 2.75 | | |
| M1 | N/A | 154 | 0.77 | yes | 4 | 0.04 | 99.77 | CEQIADSQH | 95.16 | CEQIADAQH | 2.75 | CEQIADSHH | 2.75 | | |
| M1 | N/A | 155 | 0.79 | yes | 4 | 0.04 | 99.71 | EQIADSQHR | 86.6 | EQIADAQHR | 8.54 | EQIADSHH | 1.86 | EQIADSHHR | 1.82 |
| M1 | N/A | 156 | 0.79 | yes | 4 | 0.04 | 99.54 | QIADSQHRS | 86.45 | QIADAQHRS | 8.53 | QIADSHH | 1.86 | QIADSHHRS | 1.8 |
| M1 | N/A | 157 | 0.8 | yes | 4 | 0.04 | 99.49 | IADSQHRSH | 86.4 | IADAQHRSH | 8.53 | IADSHHRSH | 2.75 | IADSHHRS | 1.81 |
| M1 | N/A | 158 | 0.8 | yes | 4 | 0.04 | 99.45 | ADSQHKSHR | 86.36 | ADAQHRSHR | 8.53 | ADSHHRSHR | 2.76 | ADSHHRSH | 1.81 |
| M1 | N/A | 159 | 0.81 | yes | 4 | 0.06 | 99.45 | DSQHRSHRQ | 86.36 | DAQHRSHRQ | 8.53 | DSHHRSHRQ | 2.76 | DSHHRSHR | 1.8 |
| M1 | N/A | 160 | 1.54 | yes | 4 | 0.06 | 99.37 | SQHRSHRQM | 86.31 | QHRSHRQMA | 51.41 | SHHRSHRQM | 2.75 | SHHRSHRQ | 1.79 |
| M1 | N/A | 61 | 1.46 | yes | 4 | 0.06 | 99.02 | QHRSHRQMV | 37.32 | ATTNPLIKH | 68.87 | HHRSHRQMV | 8.51 | HHRSHRQMA | 1.78 |
| M1 | N/A | 170 | 1.04 | yes | 3 | 0.03 | 99.2 | ATTNPLIKH | 11.86 | TTNPLIKH | 9.89 | ATTNPLIRH | 1.78 | | |
| M1 | N/A | 171 | 0.58 | yes | 2 | 0.03 | 99.51 | TTNPLIKHE | 68.87 | TTNPLIRHE | 11.97 | ITNPLIRHE | 9.9 | | |
| M1 | N/A | 172 | 0.57 | yes | 2 | 0.03 | 99.62 | TNPLIKHEN | 77.64 | TNPLIRHEN | 11.98 | | | | |
| M1 | N/A | 173 | 0.56 | yes | 2 | 0.03 | 99.72 | NPLIKHENR | 87.63 | NPLIRHENR | 11.98 | | | | |
| M1 | N/A | 174 | 0.56 | yes | 2 | 0.03 | 99.77 | PLIKHENRM | 87.73 | PLIRHENRM | 11.99 | | | | |
| M1 | N/A | 175 | 0.72 | yes | 2 | 0.03 | 99.77 | LIKHENRMY | 87.8 | LIRHENRMY | 11.98 | | | | |
| M1 | N/A | 176 | 0.72 | yes | 3 | 0.03 | 99.79 | IKHENRMYL | 87.79 | IRHENRMYL | 11.99 | IRHENRMVI | 2.13 | | |
| M1 | N/A | 177 | 0.2 | yes | 2 | 0.03 | 99.65 | KHENRMYLA | 85.54 | RHENRMYLA | 11.98 | RHENRMVIA | 2.13 | | |
| M1 | N/A | 178 | 0.2 | yes | 2 | 0.03 | 99.65 | HENRMYLAS | 97.51 | HENRMYLAS | 2.14 | | | | |
| M1 | N/A | 179 | | yes | 2 | 0.02 | 99.6 | ENRMYLAST | 97.45 | ENRMYLAST | 2.15 | | | | |

FIG. 73-309

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 180 | 0.2 | yes | 2 | 0.01 | 99.58 | NRMVLASTT | 97.44 | NRMVIASTT | 2.14 | | | | |
| M1 | N/A | 181 | 0.2 | yes | 2 | 0.01 | 99.63 | RMVLASTTA | 97.48 | RMVIASTTA | 2.15 | | | | |
| M1 | N/A | 182 | 0.21 | yes | 2 | 0.02 | 99.58 | MVLASTTAK | 97.43 | MVIASTTAK | 2.15 | | | | |
| M1 | N/A | 183 | 0.21 | yes | 2 | 0.02 | 99.56 | VLASTTAKA | 97.41 | VIASTTAKA | 2.15 | | | | |
| M1 | N/A | 184 | 0.21 | yes | 2 | 0.02 | 99.55 | LASTTAKAM | 97.4 | IASTTAKAM | 2.15 | | | | |
| M1 | N/A | 185 | 0.05 | yes | 1 | 0.02 | 99.68 | ASTTAKAME | 99.68 | | | | | | |
| M1 | N/A | 186 | 0.05 | yes | 1 | 0.03 | 99.64 | STTAKAMEQ | 99.64 | | | | | | |
| M1 | N/A | 187 | 0.22 | yes | 2 | 0.05 | 99.4 | TTAKAMEQM | 97.33 | TTAKAMEQV | 2.07 | | | | |
| M1 | N/A | 188 | 0.21 | yes | 2 | 0.05 | 99.44 | TAKAMEQMA | 97.37 | TAKAMEQVA | 2.07 | | | | |
| M1 | N/A | 189 | 0.21 | yes | 2 | 0.05 | 99.46 | AKAMEQMAG | 97.38 | AKAMEQVAG | 2.08 | | | | |
| M1 | N/A | 190 | 0.23 | yes | 2 | 0.06 | 99.34 | KAMEQMAGS | 97.25 | KAMEQVAGS | 2.09 | | | | |
| M1 | N/A | 191 | 0.24 | yes | 2 | 0.06 | 99.15 | AMEQMAGSS | 97.15 | AMEQVAGSS | 2 | | | | |
| M1 | N/A | 192 | 0.24 | yes | 2 | 0.05 | 99.15 | MEQMAGSSE | 97.14 | MEQVAGSSE | 2.01 | | | | |
| M1 | N/A | 193 | 0.26 | yes | 2 | 0.06 | 99.05 | EQMAGSSEQ | 97.05 | EQVAGSSEQ | 2 | | | | |
| M1 | N/A | 194 | 0.25 | yes | 2 | 0.05 | 99.07 | QMAGSSEQA | 97.07 | QVAGSSEQA | 2 | | | | |
| M1 | N/A | 195 | 0.28 | yes | 3 | 0.05 | 99.1 | MAGSSEQAA | 96.87 | VAGSSEQAA | 1.99 | IAGSSEQAA | 0.24 | | |
| M1 | N/A | 196 | 0.12 | yes | 1 | 0.04 | 99.02 | AGSSEQAAE | 99.02 | | | | | | |
| M1 | N/A | 197 | 0.12 | yes | 1 | 0.03 | 99.04 | GSSEQAAEA | 99.04 | | | | | | |
| M1 | N/A | 198 | 0.14 | yes | 1 | 0.05 | 99.11 | SSEQAAEAI | 98.77 | SSEQAAEAM | 0.24 | SSEQAAEAI | 0.24 | | |
| M1 | N/A | 199 | 0.16 | yes | 1 | 0.05 | 99.18 | SEQAAEAME | 98.57 | SEQAAEAMD | 0.29 | SEQAAEAMD | 0.29 | | |
| M1 | N/A | 200 | 0.89 | yes | 3 | 0.02 | 99.01 | EQAAEAMEV | 77.49 | EQAAEAMEI | 21.26 | EQAAEAMEI | 21.26 | EQAAEAMDI | 0.24 |
| M1 | N/A | 201 | 0.89 | yes | 3 | 0.02 | 99.21 | QAAEAMEVA | 77.51 | QAAEAMEIA | 21.26 | QAAEAMEIA | 21.26 | | 0.23 |
| M1 | N/A | 212 | 1.03 | yes | 4 | 0.02 | 99 | AROMVQAMR | 73.72 | TRQMVHAMR | 23.77 | ARRMVQAMR | 21.26 | AROMVHAMR | 0.23 |
| M1 | N/A | 213 | 1.64 | yes | 4 | 0.02 | 99.36 | RQMVQAMRT | 50.82 | RQMVHAMRT | 24.31 | ROMVQAMRA | 23.77 | RRMVQAMRA | 0.81 |
| M1 | N/A | 214 | 2 | yes | 5 | 0.02 | 99.36 | MVQAMRTIG | 44.2 | MVHAMRTIG | 24.34 | MVQAMRAIG | 24.31 | MVQAMRA | 23.1 | TRQMVQAMR | 0.31 |
| M1 | N/A | 215 | 1.48 | yes | 5 | 0.02 | 99.36 | VQAMRTIGT | 44.21 | VHAMRTIGT | 24.33 | VQAMRAIGT | 24.33 | VQAMRTVG | 19.9 | MVQAMRAVG | 4.03 |
| M1 | N/A | 216 | 1.52 | yes | 4 | 0.05 | 99.42 | AMRTIGTHP | 66.82 | AMRAIGTHP | 19.86 | AMRTVGTHP | 19.86 | VQAMRTVGT | 19.9 | VQAMRAVGT | 4.03 |
| M1 | N/A | 218 | 1.07 | yes | 3 | 0.06 | 99.31 | DLLENLQAY | 65.2 | DLLENLQTY | 18.3 | DLLENLQTY | 18.3 | AMRAVGTHP | 6.8 | AMRTIGTQP | 1.8 |
| M1 | N/A | 235 | 1.11 | yes | 3 | 0.07 | 99.36 | LLENLQAYO | 75.84 | LLENLQTYQ | 18.35 | LIENLQAYQ | 10.65 | DLIENLQAY | 4.52 | DLLDNLQAY | 0.69 |
| M1 | N/A | 236 | 0.86 | yes | 3 | 0.07 | 99.42 | LENLQAYOK | 75.53 | LENLQTYQK | 18.34 | IENLQAYQK | 4.47 | LDNLQAYQ | 4.47 | | |
| M1 | N/A | 237 | 0.79 | yes | 2 | 0.08 | 99.05 | ENLQAYOKR | 80 | ENLQTYQKR | 18.35 | DNLQAYQKR | 0.71 | LDNLQAYOK | 0.71 | | |
| M1 | N/A | 238 | 0.77 | yes | 2 | 0.08 | 99.05 | NLQAYQKRM | 80.84 | NLQTYQKRM | 18.37 | | | | | | |
| M1 | N/A | 239 | 0.84 | yes | 3 | 0.08 | 99.19 | LQAYQKRMG | 80.9 | LQTYQKRMG | 18.36 | QAYQKRMGL | 0.6 | QAYQKRMGL | 0.6 | QKRMGVQMH | 0.36 |
| M1 | N/A | 240 | 0.84 | yes | 3 | 0.08 | 99.27 | QAYQKRMGV | 80.22 | QTYQKRMGV | 18.36 | AYQKRMGVQ | 0.6 | AYQKRMGVQ | 0.6 | KRMGVQMHR | 0.36 |
| M1 | N/A | 241 | 0.42 | yes | 2 | 0.08 | 99.18 | AYQKRMGVQ | 80.21 | TYQKRMGVQ | 18.36 | YQKRMGVQL | 1.69 | YQKRMGLQM | 0.6 | | |
| M1 | N/A | 242 | 0.45 | yes | 3 | 0.08 | 99.2 | YQKRMGVQM | 80.22 | YQKRMGVQL | 18.36 | QKRMGVQIQ | 1.68 | QKRMGLQMQ | 0.61 | | |
| M1 | N/A | 243 | 0.45 | yes | 5 | 0.08 | 99.25 | QKRMGVQMQ | 94.83 | QKRMGVQIQ | 1.68 | KRMGVQIQR | 1.68 | KRMGLQMQR | 0.61 | | |
| M1 | N/A | 244 | 0.45 | yes | 5 | 0.08 | 99.26 | KRMGVQMQR | 94.52 | KRMGVQIQR | 1.68 | RMGVQIQRF | 1.68 | RMGLQMQRF | 0.61 | | |
| M1 | N/A | 245 | 0.42 | yes | 4 | 0.06 | 99.03 | RMGVQMQRF | 94.53 | RMGVQIQRF | 1.68 | MGVQIQRFK | 1.67 | MGLQMQRFK | 0.61 | | |
| M1 | N/A | 246 | 0.44 | yes | 5 | 0.08 | 99.16 | MGVQMQRFK | 94.86 | MGVQIQRFK | 1.88 | | | | | MGVQMHRFK | 0.37 |
| M1 | N/A | 247 | 0 | no | 1 | 99.99 | 100 | GVQMQRFRR | 100 | | | | | | | | |

FIG. 73-310

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 249 | 0 | no | — | 99.99 | 100 | VQMQRFRRP | 100 | | | | | | |
| M1 | N/A | 250 | 0 | no | — | 99.99 | 100 | QMQRFRRPD | 100 | | | | | | |
| M1 | N/A | 251 | 0 | no | — | 99.99 | 100 | MQRFRRPDS | 100 | | | | | | |
| M1 | N/A | 252 | 0 | no | — | 99.99 | 100 | QRFRRPDSS | 100 | | | | | | |
| M1 | N/A | 253 | 0 | no | — | 99.99 | 100 | RFRRPDSSW | 100 | | | | | | |
| M1 | N/A | 254 | 0 | no | — | 99.99 | 100 | FRRPDSSWL | 100 | | | | | | |
| M1 | N/A | 255 | 0 | no | — | 99.99 | 100 | RRPDSSWLF | 100 | | | | | | |
| M1 | N/A | 256 | 0 | no | — | 99.99 | 100 | RPDSSWLFG | 100 | | | | | | |
| M1 | N/A | 257 | 0 | no | — | 99.99 | 100 | PDSSWLFGG | 100 | | | | | | |
| M1 | N/A | 258 | 0 | no | 2 | 99.99 | 50 | SRHCSKYHW | 50 | SSRHCSKYH | 50 | | | | | |
| M1 | N/A | 259 | 0 | no | — | 99.99 | 100 | RHCSKYHWN | 100 | | | | | | |
| M1 | N/A | 260 | 0 | no | — | 99.99 | 100 | HCSKYHWNL | 100 | | | | | | |
| M1 | N/A | 261 | 0 | no | — | 99.99 | 100 | CSKYHWNLA | 100 | | | | | | |
| M1 | N/A | 262 | 0 | no | — | 99.99 | 100 | SKYHWNLAL | 100 | | | | | | |
| M1 | N/A | 263 | 0 | no | — | 99.99 | 100 | KYHWNLALD | 100 | | | | | | |
| M1 | N/A | 264 | 0 | no | — | 99.99 | 100 | YHWNLALDI | 100 | | | | | | |
| M1 | N/A | 265 | 0 | no | — | 99.99 | 100 | HWNLALDIV | 100 | | | | | | |
| M1 | N/A | 266 | 0 | no | — | 99.99 | 100 | WNLALDIVD | 100 | | | | | | |
| M1 | N/A | 267 | 0 | no | — | 99.99 | 100 | NLALDIVDS | 100 | | | | | | |
| M2 | N/A | 1 | 0.11 | yes | 4 | 1.49 | 99.13 | MSLLTEVET | 99.13 | | | | | | |
| M2 | N/A | 2 | 0.48 | yes | 4 | 1.1 | 93.87 | SLLTEVETL | 93.87 | SLLTEVETH | 2.64 | SLLTEVETP | 2.27 | SQLTEVETP | 0.24 |
| M2 | N/A | 10 | 0 | no | 3 | 99.99 | 100 | RPTRNGWGC | 100 | | | | | | |
| M2 | N/A | 35 | 0.58 | yes | 5 | 0.03 | 99.07 | GILHLLWI | 90 | GIVHLILWI | 8.58 | GVLHLLWI | 0.25 | GILHVLWI | 0.25 |
| M2 | N/A | 68 | 0.31 | yes | 2 | 0.07 | 99.08 | GVPESMREE | 96.66 | GVPIKSMREE | 1.42 | GIPESMREE | 0.57 | GMPESMREE | 0.43 |
| M2 | N/A | 69 | 0.31 | yes | — | 0.07 | 99.11 | VPESMREEY | 96.66 | VPIKSMREEY | 1.42 | IPESMREEY | 0.6 | MPESMREEY | 0.42 |
| M2 | N/A | 70 | 1.02 | yes | — | 0.07 | 99.07 | PESMREEYR | 72.32 | PKSMREEYR | 25.55 | | | | |
| M2 | N/A | 72 | 2.12 | yes | — | 0.07 | 99.17 | SMREEYRQE | 37.6 | SMREEYQQE | 25.76 | SMREEYRE | 22.9 | SMREEYRQK | 9.06 | SMREEYRQK | 3.86 |
| M2 | N/A | 91 | 0.92 | yes | — | 99.98 | 100 | HFVSIELEG | 66.67 | HFVNIELED | 33.33 | | | | |
| NP | N/A | 1 | 0 | no | — | 99.99 | 100 | SKSRVDNHS | 100 | | | | | | |
| NP | N/A | 2 | 0 | no | — | 99.99 | 100 | KSRVDNHSM | 100 | | | | | | |
| NP | N/A | 3 | 0 | no | — | 99.99 | 100 | SRVDNHSMS | 100 | | | | | | |
| NP | N/A | 4 | 0 | no | — | 99.99 | 100 | RVDNHSMSD | 100 | | | | | | |
| NP | N/A | 5 | 0 | no | — | 99.99 | 100 | VDNHSMSDI | 100 | | | | | | |
| NP | N/A | 6 | 0 | no | — | 99.99 | 100 | DNHSMSDIE | 100 | | | | | | |
| NP | N/A | 7 | 0 | no | — | 99.99 | 100 | NHSMSDIEA | 100 | | | | | | |
| NP | N/A | 8 | 0 | no | — | 99.99 | 100 | HSMSDIEAM | 100 | | | | | | |
| NP | N/A | 9 | 0 | no | — | 99.99 | 100 | SMSDIEAMA | 100 | | | | | | |
| NP | N/A | 10 | 0.52 | no | 4 | 99.32 | 92.16 | MSDIEAMAS | 92.16 | MSDINIMAS | 4.9 | MSDIEAMAT | 0.98 | MSDIGAMAS | 0.98 |
| NP | N/A | 11 | 0.52 | no | 4 | 99.32 | 92.16 | SDIEAMASQ | 92.16 | SDINIMASQ | 4.9 | SDIEAMATQ | 0.98 | SDIGAMASQ | 0.98 |
| NP | N/A | 12 | 0.52 | no | 4 | 99.32 | 92.02 | DIEAMASQG | 92.02 | DINIMASQG | 4.9 | DIEAMATQG | 0.98 | DIEIMASQG | 0.98 |
| NP | N/A | 13 | 0.55 | no | 4 | 99.31 | 91.26 | IEAMASQGT | 91.26 | INIMASQGT | 5.83 | IEAMATQGT | 0.97 | IEIMASQGT | 0.97 |

FIG. 73-311

| Protein | Sub-type | Start Pos | Block Entropy | Gaps < 10% | # to cover 99% | Gap % | Coverage | Induded Peptides | Freq | Induded Peptides | Freq | Induded Peptides | Freq | Induded Peptides | Freq |
|---|---|---|---|---|---|---|---|---|---|---|---|---|---|---|---|
| NP | N/A | 14 | 0.55 | no | 4 | 99.31 | 99.03 | EAMASQGTK | 5.83 | NIMASQGTK | 91.26 | EAMATQGTK | 5.83 | GAMASQGTK | 0.97 | | |
| NP | N/A | 15 | 0.44 | no | 2 | 99.31 | 99.03 | AMASQGTKR | 6.8 | IMASQGTKR | 92.23 | | | | |
| NP | N/A | 16 | 0.19 | yes | 3 | 1.02 | 99.15 | MASQGTKRS | 0.63 | MALQGTKRS | 98.24 | MASQGTKRP | 0.28 | | |
| NP | N/A | 17 | 0.27 | yes | 4 | 0.74 | 99.13 | ASQGTKRSY | 0.9 | ASQGTKRSH | 97.33 | ALQGTKRSY | 0.28 | ASQGTKRPY | 0.28 |
| NP | N/A | 18 | 0.26 | yes | 4 | 0.7 | 99.2 | SQGTKRSYE | 0.9 | SQGTKRSHE | 97.39 | LQGTKRSYE | 0.63 | SQGTKRPYE | 0.63 |
| NP | N/A | 19 | 0.17 | yes | 2 | 0.64 | 99.15 | QGTKRSYEQ | 0.81 | QGTKRSHEQ | 98.34 | | | | |
| NP | N/A | 20 | 0.15 | yes | 2 | 0.51 | 99.35 | GTKRSYEQM | 0.82 | GTKRSHEQM | 98.53 | | | | |
| NP | N/A | 21 | 0.15 | yes | 2 | 0.47 | 99.33 | TKRSYEQME | 0.82 | TKRSHEQME | 98.51 | | | | |
| NP | N/A | 22 | 0.16 | yes | 2 | 0.42 | 99.23 | KRSYEQMET | 0.82 | KRSHEQMET | 98.41 | | | | |
| NP | N/A | 23 | 1.11 | yes | 4 | 0.33 | 99.2 | RSYEQMETG | 28.28 | RSYEQMETD | 68.86 | RSYEQMETS | 1.26 | RSHEQMETG | 0.82 |
| NP | N/A | 24 | 1.14 | yes | 4 | 0.33 | 99.22 | SYEQMETGG | 28.28 | SYEQMETDG | 68.53 | SYEQMETSG | 1.26 | SHEQMETGG | 0.81 |
| NP | N/A | 25 | 1.39 | yes | 5 | 0.29 | 99.15 | YEQMETGGE | 15.64 | YEQMETDGD | 68.77 | YEQMETSGE | 12.66 | HEQMETSGE | 1.26 |
| NP | N/A | 26 | 0 | no | 1 | 99.99 | 100 | SEQMETGGE | | | | | | | |
| NP | N/A | 27 | 1.33 | yes | 4 | 0.26 | 99.11 | EQMETGGER | 15.64 | EQMETDGDR | 69.55 | EQMETSGER | 12.65 | QMETGERQN | 0.33 |
| NP | N/A | 28 | 1.35 | yes | 5 | 0.23 | 99.32 | QMETGGERQ | 15.65 | QMETDGDRQ | 69.46 | QMETSGERQ | 12.62 | ATEIRTSVG | 0.28 |
| NP | N/A | 38 | 0.41 | yes | 3 | 0.03 | 99.17 | ATEIRASVG | 3.39 | ATEIRSSVG | 94.8 | ANEIRASVG | 0.41 | NEIRASVGR | 0.28 |
| NP | N/A | 39 | 1.01 | yes | 3 | 0.03 | 99.19 | TEIRASVGR | 17.2 | TEIRSSVGK | 78.15 | TEIRTSVGR | 3.3 | | |
| NP | N/A | 40 | 0.96 | yes | 3 | 0.03 | 99.17 | EIRASVGKM | 17.22 | EIRSSVGKM | 78.65 | IRSSVGKMI | 3.3 | IRTSVGRMV | 0.28 |
| NP | N/A | 41 | 1.76 | yes | 5 | 0.01 | 99.28 | IRASVGKMI | 37.99 | IRASVGKMI | 40.69 | IRSSVGKMI | 17.01 | GGIGKFYIQ | 1.57 |
| NP | N/A | 50 | 1.54 | yes | 3 | 0.01 | 99.06 | GGIGRFYIQ | 19.7 | DGIGRFYIQ | 64.29 | GGIGRFYIQ | 11.36 | | |
| NP | N/A | 51 | 0.32 | yes | 3 | 0.01 | 99.65 | GIGRFYIQM | 2.27 | GIGRFYIQM | 95.83 | SGIGRFYIQ | 1.58 | | |
| NP | N/A | 52 | 0.32 | yes | 3 | 0.01 | 99.69 | IGRFYIQMC | 2.27 | IGKFYIQMC | 95.9 | GIGKFYIQ | 1.58 | | |
| NP | N/A | 53 | 0.31 | yes | 3 | 0.01 | 99.75 | GRFYIQMCT | 2.27 | GRFYIQMCT | 95.9 | IGKFYIQMC | 1.58 | | |
| NP | N/A | 54 | 0.21 | yes | 2 | 0 | 99.75 | RFYIQMCTE | 2.3 | RFYIQMCTE | 97.29 | KFYIQMCTE | 1.58 | | |
| NP | N/A | 55 | 0.32 | yes | 3 | 0 | 99.59 | FYIQMCTEL | 2.3 | FYIQMCTEL | 95.85 | YIQMCTELQ | 1.38 | | |
| NP | N/A | 56 | 0.33 | yes | 3 | 0 | 99.54 | YIQMCTELK | 2.3 | YIQMCTELK | 95.79 | IQMCTELQL | 1.38 | | |
| NP | N/A | 57 | 0.33 | yes | 3 | 0 | 99.47 | IQMCTELKL | 9.3 | IQMCTELKL | 88.4 | QMCTELQLS | 1.37 | | |
| NP | N/A | 58 | 0.66 | yes | 3 | 0.02 | 99.04 | QMCTELKLS | 9.29 | QMCTELKLS | 88.07 | MCTELQLSD | 1.37 | NEGRLIQNS | 0.8 |
| NP | N/A | 59 | 0.69 | yes | 4 | 0.04 | 99.31 | MCTELKLSD | 23.8 | MCTELKLND | 62.7 | HEGRLIQNS | 11.21 | | |
| NP | N/A | 68 | 1.45 | yes | 5 | 0.03 | 99.06 | YEGRLIQNS | 27.45 | YDGRLIQNS | 47.45 | DGRLIQNSI | 23.59 | | |
| NP | N/A | 69 | 1.65 | yes | 5 | 0.03 | 99.23 | EGRLIQNSL | 27.48 | EGRLIQNSL | 71.03 | GRLIQNSM | 0.72 | | |
| NP | N/A | 70 | 0.99 | yes | 4 | 0.03 | 99.06 | GRLIQNSIT | 27.48 | GRLIQNSIT | 70.63 | RLIQNSIT | 0.72 | RLVQNSITI | 0.31 |
| NP | N/A | 71 | 1.04 | yes | 4 | 0.03 | 99.06 | RLIQNSITI | 27.37 | RLIQNSITI | 70.63 | LIQNSTIE | 0.72 | LVQNSITIE | 0.8 |
| NP | N/A | 72 | 1.28 | yes | 3 | 0.01 | 99 | LIQNSITIE | 27.36 | LIQNSTIE | 70.89 | LIONSITIE | 0.97 | QNSMTIERM | 0.54 |
| NP | N/A | 74 | 0.79 | yes | 2 | 0.01 | 99.06 | QNSLTIERM | 16.42 | QNSLTIERM | 82.16 | | | | |
| NP | N/A | 78 | 0.79 | yes | 2 | 0.01 | 99.08 | TIERMVLSA | 16.49 | TIERMVLSA | 82.17 | | | | |
| NP | N/A | 79 | 0.72 | yes | 3 | 0.01 | 99.31 | IERMVLSAF | 16.5 | IEKMVLSAF | 82.8 | | | | |
| NP | N/A | 80 | 0.73 | yes | 2 | 0.01 | 99.28 | ERMVLSAFD | 16.51 | EKMVLSAFD | 82.78 | | | | |
| NP | N/A | 81 | 0.08 | yes | 2 | 0.01 | 99.26 | RMVLSAFDE | 16.5 | KMVLSAFDE | 99.26 | | | | |
| NP | N/A | 82 | 0.08 | yes | 1 | 0.01 | 99.26 | MVLSAFDER | | | 99.26 | | | | |
| NP | N/A | 83 | | yes | | 0.01 | | VLSAFDERR | | | | | | | |

FIG. 73-312

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 84 | 0.03 | yes | 1 | 0.01 | 99.76 | LSAFDERRN | 99.76 | SAFDERRNR | 25.38 | | | | |
| NP | N/A | 85 | 0.85 | yes | 2 | 0.01 | 99.78 | SAFDERRNK | 74.4 | AFDERRNRY | 25.39 | | | | |
| NP | N/A | 86 | 0.85 | yes | 2 | 0.01 | 99.79 | AFDERRNKY | 74.4 | FDERRNRYL | 25.4 | | | | |
| NP | N/A | 87 | 0.84 | yes | 2 | 0.01 | 99.83 | FDERRNKYL | 74.42 | DERRNRYLE | 25.39 | | | | |
| NP | N/A | 88 | 0.87 | yes | 2 | 0.02 | 99.82 | DERRNKYLE | 74.43 | ERRNRYLEE | 25.32 | | | | |
| NP | N/A | 89 | 0.9 | yes | 2 | 0.02 | 99.59 | ERRNKYLEE | 74.27 | RRNRYLEEH | 25.32 | | | | |
| NP | N/A | 90 | 0.9 | yes | 2 | 0.02 | 99.1 | RRNKYLEEH | 74.31 | RNRYLEEHP | 24.79 | | | | |
| NP | N/A | 91 | 0.96 | yes | 4 | 0.03 | 99.11 | RNKYLEEHP | 74.33 | NRYLEEHPN | 24.78 | NRYLEENPS | 0.59 | | |
| NP | N/A | 92 | 1.05 | yes | 5 | 0.03 | 99.48 | NKYLEEHPS | 73.74 | KYLEEHPNA | 24.66 | RYLEENPSA | 0.56 | KYLEEHPST | 0.49 |
| NP | N/A | 93 | 0.24 | yes | 5 | 0.03 | 99.07 | KYLEEHPSA | 73.11 | YLEEHPNAG | 24.42 | YLEENPSAG | 0.49 | LEEHPSAGR | 0.39 |
| NP | N/A | 94 | 0.29 | yes | 5 | 0.03 | 99.35 | YLEEHPSAG | 97.51 | LEEHPSTG | 0.68 | LEENPSAGK | 0.49 | EEHPSAGRD | 0.39 |
| NP | N/A | 95 | 0.29 | yes | 5 | 0.03 | 99.26 | LEEHPSAGK | 97.1 | EEHPNAGKD | 0.66 | EENPSAGKD | 0.62 | EHPSAGRDP | 0.39 |
| NP | N/A | 96 | 0.28 | yes | 4 | 0.03 | 99.28 | EEHPSAGKD | 97.11 | EHPNAGKDP | 0.66 | ENPSAGKDP | 0.62 | HPSAGRDPK | 0.39 |
| NP | N/A | 97 | 0.27 | yes | 4 | 0.03 | 99.37 | EHPSAGKDP | 97.12 | HPNAGKDPK | 0.66 | NPSAGKDPK | 0.62 | | |
| NP | N/A | 98 | 0.23 | yes | 2 | 0.03 | 99.28 | HPSAGKDPK | 97.2 | PNAGKDPKK | 0.67 | PSAGKDPKK | 0.62 | | |
| NP | N/A | 99 | 0.23 | yes | 2 | 0.03 | 99.38 | PSAGKDPKK | 97.68 | NAGKDPKKT | 0.7 | SAGKDPKKT | 0.62 | | |
| NP | N/A | 100 | 0.16 | yes | 1 | 0.02 | 99.38 | SAGKDPKKT | 97.69 | TGKDPKKTG | 0.64 | | | | |
| NP | N/A | 101 | 0.08 | yes | 1 | 0.03 | 99.04 | AGKDPKKTG | 98.4 | | | | | | |
| NP | N/A | 102 | 0.08 | yes | 1 | 0.02 | 99.24 | GKDPKKTGG | 99.24 | | | | | | |
| NP | N/A | 103 | 0.06 | yes | 1 | 0.02 | 99.26 | KDPKKTGGP | 99.55 | | | | | | |
| NP | N/A | 104 | 0.06 | yes | 1 | 0.04 | 99.55 | DPKKTGGPI | 99.55 | | | | | | |
| NP | N/A | 105 | 0.74 | yes | 2 | 0.05 | 99.55 | PKKTGGPIY | 99.55 | KKTGGPIYK | 18.24 | | | | |
| NP | N/A | 106 | 0.81 | yes | 3 | 0.05 | 99.51 | KKTGGPIYR | 81.31 | KTGGPIYKR | 16.96 | KTGGPIYKK | 1.28 | | |
| NP | N/A | 107 | 1.08 | yes | 5 | 0.05 | 99.18 | KTGGPIYRR | 81.26 | EIMRIWRQA | 28 | EIRRIWRQA | 1.03 | ELRRIWRQA | 0.26 |
| NP | N/A | 131 | 1.09 | yes | 4 | 0.05 | 99.08 | EIRRIWRQA | 69.68 | IMRIWRQAN | 27.98 | IRRIWRQAN | 1.03 | LRRIWRQAN | 0.26 |
| NP | N/A | 132 | 1.07 | yes | 3 | 0.04 | 99.04 | IRRIWRQAN | 69.58 | MRIWRQANN | 27.97 | RRIWRQANN | 1.03 | | |
| NP | N/A | 133 | 0.98 | yes | 3 | 0.04 | 99.11 | RRIWRQANN | 69.85 | RIWRQANNG | 27.96 | | | | |
| NP | N/A | 134 | 1.45 | yes | 4 | 0.03 | 99.07 | RIWRQANNG | 70.96 | IWRQANNGD | 11.96 | NWRQANNGE | 0.18 | EVRRIWRQA | 0.18 |
| NP | N/A | 135 | 0.67 | yes | 3 | 0.02 | 99.03 | IWRQANNGE | 58.99 | WRQANNGED | 11.94 | | | VRRIWRQAN | |
| NP | N/A | 136 | 0.71 | yes | 4 | 0.01 | 99.07 | WRQANNGED | 86.85 | WRQANNGDD | 0.22 | RQANNGEEA | 0.22 | RNWRQANN | |
| NP | N/A | 137 | 1.78 | yes | 3 | 0.03 | 99.12 | RQANNGEDA | 86.51 | RQANNGEDS | 0.27 | SGLTHMIMW | | ROANSGEDA | 0.13 |
| NP | N/A | 147 | 1.53 | yes | 3 | 0.02 | 99.42 | AGLTHMIMW | 39.66 | AGLTHMIMW | 15.29 | | | | |
| NP | N/A | 148 | 1.5 | yes | 3 | 0.02 | 99.44 | GLTHMIMWH | 39.3 | GLTHMIMWH | 15.57 | | | | |
| NP | N/A | 149 | 1.49 | yes | 3 | 0.03 | 99.76 | LTHIMIWHS | 44.56 | LTHMIWHS | 15.58 | | | | |
| NP | N/A | 150 | 1.5 | yes | 3 | 0.03 | 99.81 | THIMIWHSN | 44.57 | THMIWHSN | 15.6 | | | | |
| NP | N/A | 151 | 0.03 | yes | 1 | 0.03 | 99.77 | HIMIWHSNL | 44.69 | HMMIWHSNL | 15.6 | | | | |
| NP | N/A | 152 | 0.7 | yes | 2 | 0.02 | 99.78 | IMIWHSNLN | 44.72 | MMIWHSNLN | 15.6 | | | | |
| NP | N/A | 153 | 0.7 | yes | 2 | 0.02 | 99.46 | MIWHSNLND | 44.71 | IWHSNLNDT | 16.03 | | | | |
| NP | N/A | 154 | | yes | 2 | 0.02 | 99.78 | WHSNLNDAT | 99.78 | WHSNLNDTT | 16.03 | | | | |
| NP | N/A | 155 | | yes | 2 | 0.02 | 99.46 | WHSNLNDAT | 83.44 | HSNLNDTTY | 16.03 | | | | |
| NP | N/A | 156 | | yes | 2 | 0.02 | 99.45 | HSNLNDATY | 83.42 | | | | | | |

FIG. 73-314

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NP | N/A | 206 | 1.88 | yes | 5 | 0.03 | 99.24 | VMELIRMIK | 49.25 | VMELIRMIK | 27.81 | VLELIRMIK | 12.64 | VMELVRMIK | 2.02 |
| NP | N/A | 207 | 1.11 | yes | 4 | 0.02 | 99.61 | MELIRMIKR | 77.35 | LELIRMIKR | 12.69 | MELIRMIKR | 7.52 | | |
| NP | N/A | 208 | 0.74 | yes | 3 | 0.01 | 99.62 | ELIRMIKRG | 84.87 | ELVRMIKRG | 12.7 | | | | |
| NP | N/A | 209 | 0.88 | yes | 4 | 0.01 | 99.59 | LIRMIKRGI | 82.88 | LVRMIKRGI | 12.68 | | | | |
| NP | N/A | 210 | 0.88 | yes | 3 | 0.02 | 99.55 | IRMIKRGIN | 82.83 | VRMIKRGIN | 12.69 | LIRMIKRGV | 1.99 | | |
| NP | N/A | 211 | 0.74 | yes | 3 | 0.01 | 99.57 | RMIKRGIND | 84.89 | RMIKRGIND | 12.69 | IRMIKRGVN | 1.99 | | |
| NP | N/A | 212 | 0.75 | yes | 2 | 0.01 | 99.55 | MIKRGINDR | 84.86 | MVKRGINDR | 12.69 | | | | |
| NP | N/A | 213 | 0.75 | yes | 2 | 0.01 | 99.57 | IKRGINDRN | 84.84 | VKRGINDRN | 12.69 | | | | |
| NP | N/A | 214 | 0.2 | yes | 2 | 0.01 | 99.63 | KRGINDRNF | 97.6 | IKRGVNDRN | 12.69 | | | | |
| NP | N/A | 215 | 0.2 | yes | 2 | 0.01 | 99.57 | RGINDRNFW | 97.61 | RGVNDRNFW | 2.03 | | | | |
| NP | N/A | 216 | 0.19 | yes | 2 | 0.01 | 99.64 | GINDRNFWR | 97.61 | GVNDRNFWR | 2.03 | | | | |
| NP | N/A | 217 | 0.19 | yes | 2 | 0.01 | 99.66 | INDRNFWRG | 97.63 | VNDRNFWRG | 2.03 | | | | |
| NP | N/A | 218 | 0.13 | yes | 2 | 0.01 | 99.67 | NDRNFWRGE | 98.68 | NDRNFWRGD | 0.99 | | | | |
| NP | N/A | 219 | 0.14 | yes | 2 | 0.01 | 99.55 | DRNFWRGEN | 98.56 | DRNFWRGD | 0.99 | | | | |
| NP | N/A | 220 | 0.13 | yes | 2 | 0.01 | 99.57 | RNFWRGENG | 98.57 | RNFWRGDNG | 1 | | | | |
| NP | N/A | 221 | 0.14 | yes | 2 | 0.01 | 99.61 | NFWRGENGR | 98.61 | NFWRGDNGR | | | | | |
| NP | N/A | 222 | 0.98 | yes | 3 | 0.01 | 99.44 | FWRGENGRR | 70.89 | FWRGDNGRR | 27.74 | | | | |
| NP | N/A | 223 | 0.98 | yes | 3 | 0.02 | 99.4 | WRGENGRRT | 70.86 | WRGDNGRRT | 27.75 | | | | |
| NP | N/A | 224 | 1 | yes | 3 | 0.03 | 99.26 | RGENGRKTR | 70.73 | RGDNGRRTR | 27.74 | | | | |
| NP | N/A | 231 | 1.64 | yes | 5 | 0.05 | 99.19 | TRIAYERMC | 53.77 | TRSAYERMC | 24.78 | TRTAYERMC | 18.75 | TRGAYERMC | 1.53 |
| NP | N/A | 232 | 1.64 | yes | 5 | 0.05 | 99.25 | RIAYERMCN | 53.81 | RSAYERMCN | 24.77 | RTAYERMCN | 18.74 | RGAYERMCN | 1.53 |
| NP | N/A | 233 | 1.64 | yes | 5 | 0.03 | 99.51 | IAYERMCNI | 53.85 | SAYERMCNI | 24.78 | TAYERMCNI | 18.74 | GAYERMCNI | 1.53 |
| NP | N/A | 234 | 0.06 | yes | 1 | 0.03 | 99.53 | AYERMCNIL | 99.51 | | | | | | |
| NP | N/A | 235 | 0.06 | yes | 1 | 0.03 | 99.55 | YERMCNILK | 99.53 | | | | | | |
| NP | N/A | 236 | 0.04 | yes | 1 | 0.01 | 99.66 | ERMCNILKG | 99.55 | | | | | | |
| NP | N/A | 237 | 0.06 | yes | 1 | 0.03 | 99.53 | RMCNILKGK | 99.67 | | | | | | |
| NP | N/A | 238 | 0.06 | yes | 1 | 0.02 | 99.56 | MCNILKGKF | 99.53 | | | | | | |
| NP | N/A | 239 | 0.07 | yes | 1 | 0.03 | 99.46 | CNILKGKFQ | 99.46 | | | | | | |
| NP | N/A | 240 | 0.07 | yes | 1 | 0.02 | 99.46 | NILKGKFQT | 99.46 | | | | | | |
| NP | N/A | 241 | 0.08 | yes | 1 | 0.03 | 99.45 | ILKGKFQTA | 99.32 | | | | | | |
| NP | N/A | 242 | 0 | yes | 1 | 0.04 | 99.32 | LKGKFQTAA | 100 | | | | | | |
| NP | N/A | 243 | | no | 1 | 99.99 | 100 | SKGSSKQQH | | | | | | | |
| NP | N/A | 244 | 0.08 | yes | 2 | 0.07 | 99.34 | KGKFQTAAQ | 99.34 | GKFQTAAQK | 6.81 | | | | |
| NP | N/A | 245 | 0.44 | yes | 2 | 0.09 | 99.35 | GKFQTAAQR | 92.46 | KFQTAAQKA | 6.81 | | | | |
| NP | N/A | 246 | 0.45 | yes | 2 | 0.09 | 99.27 | KFQTAAQRA | 92.42 | FQTAAQKAM | 6.81 | | | | |
| NP | N/A | 247 | 1.08 | yes | 3 | 0.09 | 99.24 | FQTAAQRAM | 75.98 | QTAAQRAMV | 16.54 | QTAAQKAMM | 6.75 | | |
| NP | N/A | 248 | 1.07 | yes | 3 | 0.09 | 99.27 | QTAAQRAMM | 76 | TAAQRAMVD | 16.54 | TAAQKAMMD | 6.75 | | |
| NP | N/A | 249 | 1.07 | yes | 3 | 0.09 | 99.29 | TAAQRAMMD | 76.06 | AAQRAMMDQ | 16.54 | AAQKAMMDQ | 6.75 | | |
| NP | N/A | 250 | 1.07 | yes | 3 | 0.07 | 99.35 | AAQRAMMDQ | 76.06 | AQRAMMDQV | 16.53 | AQKAMMDQV | 6.75 | | |
| NP | N/A | 251 | 1.05 | yes | 3 | 0.07 | 99.34 | AQRAMMDQV | 76.06 | QRAMMDQVR | 16.54 | QKAMMDQVR | 6.75 | | |
| NP | N/A | 252 | 1.05 | yes | 3 | 0.07 | 99.52 | QRAMMDQVR | 76.24 | | | | | | |

FIG. 73-315

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 253 | 1.05 | yes | 3 | 0.06 | 99.52 | RAMMDQVRE | 76.23 | RAMMDQVRE | 16.55 | IKAMMDQVRE | 6.75 | | |
| NP | N/A | 254 | 0.79 | yes | 3 | 0.02 | 99.59 | AMVDQVRES | 81.87 | AMVDQVRES | 16.6 | AMMDQVREG | 1.11 | | |
| NP | N/A | 255 | 0.79 | yes | 2 | 0.02 | 99.62 | MVDQVRESR | 81.87 | MVDQVRESR | 16.62 | MMDQVREGR | 1.12 | | |
| NP | N/A | 256 | 0.83 | yes | 2 | 0.02 | 99.19 | VDQVRESRN | 81.44 | VDQVRESRN | 16.62 | MDQVREGRN | 1.12 | | |
| NP | N/A | 257 | 0.18 | yes | 2 | 0.02 | 99.21 | DQVRESRNP | 98.09 | DQVRESRNP | 1.12 | | | | |
| NP | N/A | 258 | 0.18 | yes | 2 | 0.02 | 99.21 | QVRESRNPG | 98.09 | QVRESRNPG | 1.12 | | | | |
| NP | N/A | 259 | 0.18 | yes | 2 | 0.02 | 99.22 | VRESRNPGN | 98.09 | VRESRNPGN | 1.13 | | | | |
| NP | N/A | 260 | 0.19 | yes | 2 | 0.02 | 99.18 | RESRNPGNA | 98.01 | RESRNPGNA | 1.13 | | | | |
| NP | N/A | 261 | 0.18 | yes | 2 | 0.01 | 99.17 | ESRNPGNAE | 98.05 | ESRNPGNAE | 1.13 | | | | |
| NP | N/A | 262 | 0.23 | yes | 3 | 0.01 | 99.17 | SRNPGNAEI | 97.62 | SRNPGNAEI | 1.13 | SRSPGNAEI | 0.42 | | |
| NP | N/A | 263 | 0.14 | yes | 2 | 0.01 | 99.17 | RNPGNAEIE | 98.75 | RNPGNAEIE | 0.42 | | | | |
| NP | N/A | 264 | 0.14 | yes | 2 | 0.01 | 99.17 | NPGNAEIED | 98.74 | NPGNAEIED | 0.43 | | | | |
| NP | N/A | 265 | 0.1 | yes | 2 | 0.02 | 99.11 | PGNAEIEDL | 99.16 | | | | | | |
| NP | N/A | 266 | 0.5 | yes | 4 | 0.01 | 99.13 | GNAEIEDLI | 91.52 | GNAEIEDLT | 7.59 | AEIEDLIFS | 1.53 | | |
| NP | N/A | 267 | 0.49 | yes | 4 | 0.01 | 99.09 | NAEIEDLIF | 91.54 | NAEIEDLTF | 7.59 | EIEDLIFSA | 1.53 | AEIEDLIFM | 0.6 |
| NP | N/A | 268 | 0.66 | yes | 5 | 0.02 | 99.22 | AEIEDLIFL | 89.37 | AEIEDLTFL | 7.59 | IEDLIFSAR | 1.53 | EIEDLIFMA | 0.6 |
| NP | N/A | 269 | 0.67 | yes | 4 | 0.03 | 99.21 | EIEDLIFLA | 89.22 | EIEDLTFLA | 7.61 | EDLIFSARS | 1.53 | IEDLIFMAR | 0.6 |
| NP | N/A | 270 | 0.67 | yes | 4 | 0.03 | 99.39 | IEDLIFLAR | 89.22 | IEDLTFLAR | 7.61 | DLIFSARSA | 1.53 | EDLIFMARS | 0.6 |
| NP | N/A | 271 | 0.63 | yes | 4 | 0.03 | 99.37 | EDLIFLARS | 89.44 | EDLTFLARS | 7.83 | LIFSARSAL | 1.53 | DLIFMARSA | 0.6 |
| NP | N/A | 272 | 0.64 | yes | 4 | 0.04 | 99.4 | DLIFLARSA | 89.44 | DLTFLARSA | 7.82 | IFSARSALI | 1.53 | LIFMARSAL | 0.6 |
| NP | N/A | 273 | 0.63 | yes | 4 | 0.03 | 99.09 | LIFLARSAL | 89.16 | LTFLARSAL | 7.83 | FSARSALIL | 1.53 | IFMARSALI | 0.6 |
| NP | N/A | 274 | 0.66 | yes | 3 | 0.03 | 99.14 | IFLARSALI | 97.01 | TFLARSALI | 1.53 | | | FMARSALIL | 0.6 |
| NP | N/A | 275 | 0.26 | yes | 2 | 0.04 | 99.14 | FLARSALIL | 97.02 | FSARSALIL | 1.53 | | | MARSALILR | 0.6 |
| NP | N/A | 276 | 0.26 | yes | 2 | 0.03 | 99.2 | LARSALILR | 99.2 | | | | | | |
| NP | N/A | 277 | 0.09 | yes | 1 | 0.03 | 99.44 | ARSALILRG | 98.99 | RSALILRGA | 0.45 | | | | |
| NP | N/A | 278 | 0.11 | no | 2 | 0.03 | 99.4 | RSALILRGA | 100 | | | | | | |
| NP | N/A | 279 | 0 | no | 1 | 99.99 | 100 | SASALILRGS | 100 | | | | | | |
| NP | N/A | 280 | 0 | no | 1 | 99.99 | 100 | ASALILRGS | 100 | | | | | | |
| NP | N/A | 281 | 0.21 | yes | 3 | 0.03 | 99.3 | SALILRGSV | 97.7 | SALILRGSI | 1.15 | SALILRGAV | 0.45 | | |
| NP | N/A | 282 | 0.21 | yes | 3 | 0.02 | 99.3 | ALILRGSVA | 97.7 | ALILRGSIA | 1.15 | ALILRGAVA | 0.45 | | |
| NP | N/A | 283 | 0.21 | yes | 3 | 0.03 | 99.28 | LILRGSVAH | 97.68 | LILRGSIAH | 1.15 | LILRGAVAH | 0.45 | | |
| NP | N/A | 284 | 0.18 | yes | 3 | 0.03 | 99.28 | ILRGSVAHK | 97.69 | ILRGSIAHK | 1.15 | ILRGAVAHK | 0.45 | | |
| NP | N/A | 285 | 0.18 | yes | 2 | 0.03 | 99.18 | LRGSVAHKS | 98.04 | LRGSIAHKS | 1.15 | | | | |
| NP | N/A | 286 | 0.18 | yes | 2 | 0.04 | 99.16 | RGSVAHKSC | 98.03 | RGSIAHKSC | 1.14 | | | | |
| NP | N/A | 287 | 0.18 | yes | 2 | 0.03 | 99.16 | GSVAHKSCL | 98.01 | GSIAHKSCL | 1.14 | | | | |
| NP | N/A | 288 | 0.15 | yes | 2 | 0.02 | 99.57 | SVAHKSCLP | 98.01 | SIAHKSCLP | 1.14 | | | | |
| NP | N/A | 289 | 0.04 | yes | 2 | 0.02 | 99.72 | VAHKSCLPA | 98.42 | IAHKSCLPA | 1.14 | | | | |
| NP | N/A | 290 | 0.51 | yes | 3 | 0 | 99.72 | AHKSCLPAC | 99.72 | | | | | | |
| NP | N/A | 291 | 0.5 | yes | 3 | 0.01 | 99.71 | HKSCLPACV | 91.11 | HKSCLPACA | 7.65 | HKSCLPACI | 0.94 | | |
| NP | N/A | 292 | 0.5 | yes | 3 | 0.01 | 99.74 | KSCLPACVY | 91.14 | KSCLPACAY | 7.65 | KSCLPACIY | 0.94 | | |
| NP | N/A | 293 | 0.5 | yes | 3 | 0.01 | 99.73 | SCLPACVYG | 91.13 | SCLPACAYG | 7.65 | SCLPACIYG | 0.94 | | |

FIG. 73-316

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 294 | 1.21 | yes | 4 | 0.01 | 99.59 | CLPACIYGL | 71.15 | CLPACIYGP | 19.87 | CLPACIYGL | 7.63 | LPACYGLV | 0.61 |
| NP | N/A | 295 | 1.29 | yes | 5 | 0.01 | 99.14 | LPACIYGLA | 70.33 | LPACAYGPA | 19.88 | LPACIYGLV | 7.63 | PACVYGLVW | 0.6 |
| NP | N/A | 296 | 1.3 | yes | 5 | 0.01 | 99 | PACVYGLAN | 70.27 | PACAYGPAV | 19.82 | PACIYGLVW | 7.62 | GGYDFEREG | 0.39 |
| NP | N/A | 306 | 1.73 | yes | 4 | 0.03 | 99.05 | SGYDFEREG | 42.22 | S

FIG. 73-317

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 356 | 0.52 | yes | 2 | 0.05 | 99.42 | HSAAFEDLR | 90.3 | NSAAFEDLR | 9.13 | | | | |
| NP | N/A | 357 | 0.82 | yes | 3 | 0.06 | 99.42 | SAAFEDLRV | 80.43 | SAAFEDLRI | 18.23 | SAAFEDLRL | 0.75 | | |
| NP | N/A | 358 | 0.98 | yes | 4 | 0.02 | 99.5 | AAFEDLRVS | 77.95 | AAFEDLRLI | 18.18 | AAFEDLRVL | 2.61 | AAFEDLRIS | 0.55 |
| NP | N/A | 376 | 1.2 | yes | 5 | 0.02 | 99.52 | PRGKLSTRG | 55.15 | PRGQLSTRG | 42.43 | PRGQLATRG | 0.79 | PRGQLTRG | 0.59 |
| NP | N/A | 380 | 0.4 | yes | 4 | 0.02 | 99.55 | LSTRGVQIA | 95.19 | LSTRGIQIA | 1.69 | LSTRGVQAS | 1.28 | LTRGVQIA | |
| NP | N/A | 381 | 0.4 | yes | 3 | 0.02 | 99.01 | STRGVQIAS | 95.24 | STRGIQIAS | 1.69 | STRGVQVAS | 1.28 | | |
| NP | N/A | 382 | 0.29 | yes | 3 | 0.01 | 99.47 | TRGVQIASN | 96.54 | TRGIQIASN | 1.69 | TRGVQVASN | 1.25 | | |
| NP | N/A | 383 | 0.29 | yes | 3 | 0.01 | 99.49 | RGVQIASNE | 96.56 | RGIQIASNE | 1.69 | RGVQVASNE | 1.25 | | |
| NP | N/A | 384 | 0.32 | yes | 3 | 0.05 | 99.17 | GVQIASNEN | 96.23 | GIQIASNEN | 1.69 | GVQASNEN | 1.25 | | |
| NP | N/A | 400 | 0.87 | yes | 3 | 0.01 | 99.69 | TLELRSGYW | 80.47 | TLELRSKYW | 16.35 | | | | |
| NP | N/A | 401 | 0.86 | yes | 3 | 0.05 | 99.69 | LELRSGYWA | 80.47 | LELRSKYWA | 16.35 | | | | |
| NP | N/A | 402 | 0.87 | yes | 3 | 0.04 | 99.73 | ELRSGYWAI | 80.51 | ELRSKYWAI | 16.34 | | | | |
| NP | N/A | 403 | 0.87 | yes | 3 | 0.04 | 99.59 | LRSGYWAIR | 80.38 | LRSKYWAIR | 16.34 | | | | |
| NP | N/A | 404 | 0.9 | yes | 3 | 0.04 | 99.34 | RSGYWAIRT | 80.18 | RSKYWAIRT | 16.32 | | | | |
| NP | N/A | 405 | 0.9 | yes | 3 | 0.03 | 99.35 | SGYWAIRTR | 80.18 | SKYWAIRTR | 16.33 | | | | |
| NP | N/A | 406 | 0.07 | yes | 1 | 0.02 | 99.4 | GYWAIRTRS | 99.4 | KYWAIRTRS | | | | | |
| NP | N/A | 407 | 0.09 | yes | 1 | 0.03 | 99.46 | YWAIRTRSG | 99.46 | | | | | | |
| NP | N/A | 408 | 0.08 | yes | 1 | 0.01 | 99.18 | WAIRTRSGG | 99.18 | | | | | | |
| NP | N/A | 409 | 0.13 | yes | 2 | 0.01 | 99.07 | AIRTRSGGN | 98.84 | | | | | | |
| NP | N/A | 410 | 0.31 | yes | 4 | 0.03 | 99.16 | IRTRSGGNT | 96.23 | IRTKSGGNT | 0.23 | RTKSGGNTN | 0.21 | RTKSGGNTN | 0.21 |
| NP | N/A | 411 | 0.33 | yes | 5 | 0.05 | 99.02 | RTRSGGNTN | 96.09 | RTRSGGNNN | 2.54 | RTRSGGNTS | 2.54 | TRSGGNTNH | 0.21 |
| NP | N/A | 412 | 1.22 | yes | 4 | 0.05 | 99.16 | TRSGGNTNQ | 77.72 | TRSGGNNNQ | 2.54 | TRSGGNTSQ | 2.54 | | |
| NP | N/A | 423 | 1.19 | yes | 4 | 0.01 | 99.44 | ASAGQISVQ | 78 | ASAGQTSVQ | 9.15 | ASAGQISTQ | 9.15 | ASAGQVSVQ | 5.08 |
| NP | N/A | 424 | 0.79 | yes | 3 | 0.01 | 99.76 | SAGQISVQP | 86.31 | SAGQTSVQP | 9.15 | SAGQISTQP | 6.44 | SAGQVSVQP | 5.09 |
| NP | N/A | 429 | 0.28 | yes | 2 | 0.01 | 99.69 | SVQPTFSVQ | 86.32 | SIQPTFSVQ | 6.44 | SVQPAFSVQ | 1.7 | SVQPAFSVQ | |
| NP | N/A | 430 | 0.3 | yes | 4 | 0.01 | 99.77 | VQPTFSVQR | 96.51 | IQPTFSVQR | 6.44 | VQPAFSVQR | 1.69 | VQPAFSVQR | |
| NP | N/A | 431 | 0.3 | yes | 3 | 0.01 | 99.53 | QPTFSVQRN | 96.44 | QPAFSVQRN | 1.65 | | | | |
| NP | N/A | 432 | 0.17 | yes | 2 | 0.01 | 99.53 | PTFSVQRNL | 96.34 | PAFSVQRNL | 1.65 | | | | |
| NP | N/A | 433 | 0.64 | yes | 4 | 0.01 | 99.55 | TFSVQRNLP | 97.98 | AFSVQRNLP | 1.65 | | | | |
| NP | N/A | 434 | 1.3 | yes | 4 | 0.03 | 99.53 | FSVQRNLPF | 88.01 | FSVQRNLP | 1.57 | | | | |
| NP | N/A | 435 | 1.16 | yes | 3 | 0.01 | 99.06 | SVQRNLPFE | 70.61 | SVQRNLPFD | 9.96 | SVQRSLPFE | 1.56 | VQRSLPFER | 1.4 |
| NP | N/A | 436 | 1.13 | yes | 2 | 0.05 | 99.02 | VQRNLPFEK | 68.03 | VQRNLPFDK | 17.41 | VQRSLPFE | | VQRSLPFER | |
| NP | N/A | 453 | 0.93 | yes | 3 | 0.04 | 99.2 | GNTEGRTSD | 68.12 | GNNEGRTSD | 28.43 | GNSEGRTSD | 9.63 | GNPEGRTSD | 0.15 |
| NP | N/A | 455 | 0.92 | yes | 3 | 0.01 | 99.32 | TEGRTSDMR | 72.13 | NEGRTSDMR | 28.43 | SEGRTSDMR | 2.36 | | |
| NP | N/A | 456 | 1.61 | yes | 5 | 0.05 | 99.33 | EGRTSDMRT | 72.13 | EGRTSDMRA | 27.2 | AEGRTSDMR | 2.44 | | |
| NP | N/A | 457 | 1.61 | yes | 2 | 0.05 | 99.36 | GRTSDMRTE | 45.54 | GRTSDMRAE | 27.2 | | | | |
| NP | N/A | 458 | 2.01 | yes | 3 | 0.05 | 99.3 | RTSDMRTEI | 45.5 | RTSDMRTEV | 26.62 | RTSDMRAEI | 1.54 | | |
| NP | N/A | 459 | 2.01 | yes | 5 | 0.05 | 99.03 | TSDMRTEII | 42.76 | TSDMRTEVI | 26.61 | TSDMRAEII | 1.54 | | |
| NP | N/A | 460 | 0 | no | 1 | 99.99 | 100 | SDMRTEIIR | 100 | SDMRTEVIR | | SDMRAEIIR | | SDMRTEIIK | 2.84 |
| NP | N/A | 463 | 0 | no | 1 | 99.99 | 100 | RAEIIRME | | | | | | | |
| NP | N/A | 467 | | | | | | TEIIRMME | | | | | | | |

FIG. 73-318

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 468 | 0 | no | 1 | 99.99 | 100 | EIIIRMMEN | 100 | | | | | | |
| NP | N/A | 469 | 0 | no | 1 | 99.99 | 100 | IIIRMMENA | 100 | | | | | | |
| NP | N/A | 481 | 1.91 | yes | 5 | 0.01 | 99.36 | DVSFQGRGV | 44.23 | DLSFQGRGV | | | | | |
| NP | N/A | 482 | 1.57 | yes | 4 | 0.01 | 99.57 | VSFQGRGVF | 52.16 | LSFQGRGVF | | EVSFRGRGV | 28.19 | EVSFQGRGV | 18.09 | EVSFQGRGV | 7.91 |
| NP | N/A | 483 | 0.72 | yes | 2 | 0.01 | 99.75 | SFQGRGVFE | 81.5 | SFRGRGVFE | | VSFRGRGVF | 28.22 | MSFQGRGVF | 18.1 | EMSFQGRGV | 0.94 |
| NP | N/A | 484 | 0.8 | yes | 3 | 0.01 | 99.57 | FQGRGVFEL | 80.62 | FRGRGVFEL | | FQGRGVFEF | 18.25 | | | | |
| NP | N/A | 485 | 0.8 | yes | 3 | 0.01 | 99.5 | QGRGVFELS | 80.56 | RGRGVFELS | | QGRGVFEFS | 18.25 | | | | |
| NP | N/A | 486 | 0.12 | yes | 2 | 0.01 | 99.55 | GRGVFELSD | 98.86 | GRGVFELSD | | | 0.7 | | | | |
| NP | N/A | 487 | 0 | no | 1 | 0.02 | 99.5 | RGCGHLDE | 100 | | | | | | |
| NP | N/A | 488 | 0.12 | yes | 2 | 99.99 | 99.5 | RGVFELSDE | 98.8 | RGVFELSDE | | RGVFEFSDE | 0.7 | | | | |
| NP | N/A | 489 | 0 | no | 1 | 0.03 | 99.17 | GVFELSDEK | 91.6 | GVFELSDER | | GVFEFSDER | 7.21 | GVFEFSDER | 0.36 | | |
| NP | N/A | 490 | 0.5 | yes | 3 | 0.03 | 99.17 | VFELSDEKA | 91.6 | VFELSDERA | | VFELSDERA | 7.21 | VFELSDERA | 0.36 | FEFSDERAA | 0.35 |
| NP | N/A | 491 | 0.5 | yes | 3 | 0.02 | 99.16 | FELSDEKAT | 89.57 | FELSDERAT | | FELSDEKAA | 6.84 | FELSDEKAA | 2.02 | FELSDERAA | |
| NP | N/A | 498 | 0.66 | yes | 4 | 0.25 | 99.13 | ATNPWPSF | 94.39 | AANPIVPSF | | ATSPIVPSF | 2.5 | ATSPIVPSF | 1.92 | | |
| NP | N/A | 499 | 0.44 | yes | 3 | 0.29 | 99.03 | TNPIVPSFD | 89.93 | ANPIVPSFE | | ANPIVPSFD | 4.37 | ANPIVPSFD | 2.5 | TNPWPSFD | 0.32 |
| NP | N/A | 500 | 0.71 | yes | 4 | 0.33 | 99.07 | NPIVPSFDM | 92.2 | NPIVPSFEM | | SPIVPSFDM | 4.28 | NPWPSFDM | 2.17 | TPIVPSFDM | 0.11 |
| NP | N/A | 501 | 0.56 | yes | 4 | 0.47 | 99.05 | PIVPSFDMS | 80.1 | PIWPSFDMN | | PIWPSFDMS | 4.41 | PWPSFDMS | 4.27 | VPSFDMSN | 0.27 |
| NP | N/A | 502 | 0.99 | yes | 5 | 0.55 | 99.06 | IVPSFDMSN | 78.56 | IVPSFDMNN | | IVPSFDMSN | 14.37 | IVPSFEMSN | 4.28 | VPSFDMSND | 0.11 |
| NP | N/A | 503 | 1.1 | yes | 5 | 0.56 | 99.07 | VPSFDMSNE | 78.67 | VPSFDMNNE | | VPSFDMSNE | 14.43 | VPSFDMSKE | 4.28 | PSFDMSNDG | 0.11 |
| NP | N/A | 504 | 1.08 | yes | 5 | 0.58 | 99.02 | PSFDMSNEG | 78.64 | PSFDMNNEG | | PSFEMSNEG | 14.4 | PSFDMSKEG | 4.31 | FDMSNDGSY | 0.11 |
| NP | N/A | 506 | 1.09 | yes | 5 | 1.54 | 99.02 | FDMSNEGSY | 78.9 | FDMNNEGSY | | FEMSNEGSY | 14.14 | FDMSKEGSY | 1.51 | | |
| NP | N/A | 508 | 1.08 | yes | 4 | 1.92 | 99.03 | MSNEGSYFF | 83.47 | MNNEGSYFF | | MSKEGSYFF | 13.98 | ISNEGSYFF | 1.5 | | |
| NP | N/A | 509 | 0.83 | yes | 3 | 2.07 | 99.24 | SNEGSYFFG | 83.75 | NNEGSYFFG | | SKEGSYFFG | 13.99 | | | | |
| NP | N/A | 510 | 0.79 | yes | 2 | 2.63 | 99.3 | NEGSYFFGD | 97.79 | KEGSYFFGD | | | 1.51 | | | | |
| NP | N/A | 511 | 0.21 | yes | 2 | 3.03 | 99.02 | EGSYFFGDN | 99.02 | | | | | | |
| NP | N/A | 512 | 0.12 | yes | 2 | 3.25 | 99.16 | GSYFFGDNA | 99.16 | | | | | | |
| NP | N/A | 513 | 0.11 | yes | 2 | 3.85 | 99.01 | SYFFGDNAE | 98.83 | SYFFGDNAK | 0.18 | YFFGDNAKE | 0.18 | | | |
| NP | N/A | 514 | 0.14 | yes | 3 | 4.92 | 99.01 | YFFGDNAEE | 98.73 | YFFGDSAEE | 0.18 | FFGDNAKEY | 0.18 | | | |
| NP | N/A | 515 | 0.16 | yes | 3 | 5.88 | 99.01 | FFGDNAEEY | 97.09 | FFGDNAEEF | 1.73 | | | | |
| NP | N/A | 519 | 0.27 | no | 1 | 99.99 | 100 | NAEEYRLR | | | | | | | |
| NS1 | N/A | 1 | 0 | no | 1 | 99.96 | 100 | MLFVQSYFQ | | | | | | | |
| NS1 | N/A | 2 | 0 | no | 1 | 99.96 | 100 | LFVQSYFQL | | | | | | | |
| NS1 | N/A | 3 | 0 | no | 1 | 99.96 | 100 | FVQSYFQLF | | | | | | | |
| NS1 | N/A | 4 | 0 | no | 1 | 99.96 | 100 | VQSYFQLFL | | | | | | | |
| NS1 | N/A | 5 | 0 | no | 1 | 99.96 | 100 | QSYFQLFLV | | | | | | | |
| NS1 | N/A | 6 | 0 | no | 1 | 99.96 | 100 | SYFQLFLVC | | | | | | | |
| NS1 | N/A | 7 | 0 | no | 1 | 99.96 | 100 | YFQLFLVCY | | | | | | | |
| NS1 | N/A | 8 | 0 | no | 1 | 99.96 | 100 | FQLFLVCVS | | | | | | | |
| NS1 | N/A | 9 | 0 | no | 1 | 99.96 | 100 | QLFLVCVSL | | | | | | | |
| NS1 | N/A | 10 | 0 | no | 1 | 99.96 | 100 | LFLVCVSLL | | | | | | | |
| NS1 | N/A | 11 | 0 | no | 1 | 99.96 | 100 | FLVCVSLLQ | | | | | | | |

FIG. 73-319

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NS1 | N/A | 12 | 0 | no | 1 | 99.96 | 100 | LVCVSLLQS | 100 | | | | | | |
| NS1 | N/A | 13 | 0 | no | 1 | 99.96 | 100 | VCVSLLQSA | 100 | | | | | | |
| NS1 | N/A | 14 | 0 | no | 1 | 99.96 | 100 | CVSLLQSAI | 100 | | | | | | |
| NS1 | N/A | 15 | 0 | no | 1 | 99.96 | 100 | VSLLQSAIL | 100 | | | | | | |
| NS1 | N/A | 16 | 0 | no | 1 | 99.96 | 100 | SLLQSAILS | 100 | | | | | | |
| NS1 | N/A | 17 | 0 | no | 1 | 99.96 | 100 | LLQSAILSL | 100 | | | | | | |
| NS1 | N/A | 24 | 0.69 | yes | 4 | 2.15 | 99.16 | SSFQVDCFL | 88.09 | TSFQVDCYL | 9.56 | | | | | |
| NS1 | N/A | 25 | 0.56 | yes | 2 | 1.98 | 99.17 | SFQVDCFLW | 89.53 | SFQVDCYLW | 9.64 | | | | | |
| NS1 | N/A | 26 | 0.6 | yes | 3 | 0.82 | 99.16 | FQVDCFLWH | 89.02 | FQVDCYLWH | 9.89 | | | | | |
| NS1 | N/A | 27 | 1.5 | yes | 5 | 0.66 | 99.11 | QVDCFLWHI | 46.9 | QVDCYLWHI | 9.82 | SSFQVDCFI | 0.24 | | | |
| NS1 | N/A | 28 | 1.5 | yes | 5 | 0.48 | 99.11 | VDCFLWHIR | 46.92 | VDCYLWHIR | 42.11 | QVDCFIWHI | 0.17 | QVDCFLWYV | 0.14 |
| NS1 | N/A | 45 | 1.21 | yes | 3 | 0.02 | 99.18 | GDAPFLDRL | 73.26 | GDAPFLDRI | 15.64 | VDCFIWHIR | 0.17 | VDCFLWYYR | 0.14 |
| NS1 | N/A | 46 | 0.61 | yes | 2 | 0.05 | 99 | DAPFLDRLR | 88.93 | SDAPFDDRL | 9.83 | GDAPFLDRI | 0.25 | GDAPFLDRL | 0.22 |
| NS1 | N/A | 47 | 0.61 | yes | 2 | 0.07 | 99.01 | APFLDRLRR | 88.94 | DAPFDDRLR | 9.81 | | | | | |
| NS1 | N/A | 48 | 0.61 | yes | 2 | 0.07 | 99.02 | PFLDRLRRD | 88.71 | APFDDRLRR | 9.82 | | | | | |
| NS1 | N/A | 49 | 0.64 | yes | 3 | 0.07 | 99 | FLDRLRRDQ | 66.67 | PFLDRIRRR | 9.81 | FIDRLRRDQ | 0.23 | | | |
| NS1 | N/A | 50 | 0.92 | yes | 4 | 99.96 | 100 | SSLLQANL | 66.67 | FLDRIRRDQ | 33.33 | | | | | |
| NS1 | N/A | 51 | 0.92 | yes | 2 | 99.96 | 100 | LLLQANLC | | FLDRIRRDQ | 33.33 | | | | | |
| NS1 | N/A | 52 | 0 | no | 1 | 99.96 | 100 | LLQANLCR | 100 | | | | | | |
| NS1 | N/A | 53 | 0 | no | 1 | 99.96 | 100 | LLQANLCRF | 100 | | | | | | |
| NS1 | N/A | 54 | 0 | no | 1 | 99.96 | 100 | LQANLCRFL | 100 | | | | | | |
| NS1 | N/A | 55 | 0 | no | 1 | 99.96 | 100 | QANLCRFLE | 100 | | | | | | |
| NS1 | N/A | 56 | 0 | no | 1 | 99.96 | 100 | ANLCRFLET | 100 | | | | | | |
| NS1 | N/A | 57 | 0 | no | 1 | 99.96 | 100 | NLCRFLETR | 100 | | | | | | |
| NS1 | N/A | 58 | 1.22 | yes | 5 | 0.08 | 99.22 | DRLRRDQKS | 73.14 | DRLRRDQKA | 15.85 | DRLRRDQRA | 9.65 | DRIRRDQKS | 0.33 |
| NS1 | N/A | 59 | 1.22 | yes | 5 | 0.08 | 99.16 | RLRRDQKSL | 73.09 | RLRRDQKAL | 15.84 | RLRRDQKAL | 9.65 | RIRRDQKSL | 0.33 |
| NS1 | N/A | 60 | 1.95 | yes | 5 | 0.05 | 99.04 | RRDQKSLRG | 38.15 | RRDQKSLRG | 34.63 | RRDQKALKG | 9.64 | RRDQRALIKG | 9.64 |
| NS1 | N/A | 62 | 1.94 | yes | 5 | 0.03 | 99.12 | RDQKSLRGR | 38.6 | RDQKSLRGR | 34.62 | RDQKALKGR | 9.65 | RDQRALKGR | 9.65 |
| NS1 | N/A | 63 | 0 | no | 1 | 99.96 | 100 | PMRTPIAFL | 100 | | | | | | |
| NS1 | N/A | 75 | 0 | no | 1 | 99.96 | 100 | MRTPIAFLT | 100 | | | | | | |
| NS1 | N/A | 76 | 0 | no | 1 | 99.96 | 100 | RTPIAFLTS | 100 | | | | | | |
| NS1 | N/A | 77 | 0 | no | 1 | 99.96 | 100 | TPIAFLTSS | 100 | | | | | | |
| NS1 | N/A | 78 | 0 | no | 1 | 99.96 | 100 | PIAFLTSSI | 100 | | | | | | |
| NS1 | N/A | 79 | 0 | no | 1 | 99.96 | 100 | IAFLTSSIV | 100 | | | | | | |
| NS1 | N/A | 80 | 0 | no | 1 | 99.96 | 100 | AFLTSSIVC | 100 | | | | | | |
| NS1 | N/A | 81 | 0 | no | 1 | 99.98 | 100 | FLTSSIVCP | 100 | | | | | | |
| NS1 | N/A | 82 | 0 | no | 1 | 99.98 | 100 | IASVPASRY | 100 | | | | | | |
| NS1 | N/A | 124 | 0.81 | no | 2 | 99.94 | 100 | ASVPASRYL | 75 | LIKMPASRYL | 25 | KMPASRYLI | 10 | | |
| NS1 | N/A | 125 | 1.57 | no | 4 | 99.94 | 100 | SKITLKFAF | 60 | SVPASRYLI | 20 | MPASRYLID | 10 | SVPASRYLT | 10 |
| NS1 | N/A | 126 | 1.57 | no | 4 | 99.94 | 100 | KITLKFAFN | 60 | VPASRYLID | 20 | PASRYLTID | 20 | VPASRYLTD | 10 |
| NS1 | N/A | 127 | 1.57 | no | 3 | 99.94 | 100 | ITLKFAFNM | 60 | PASRYLIDM | 20 | | | | |

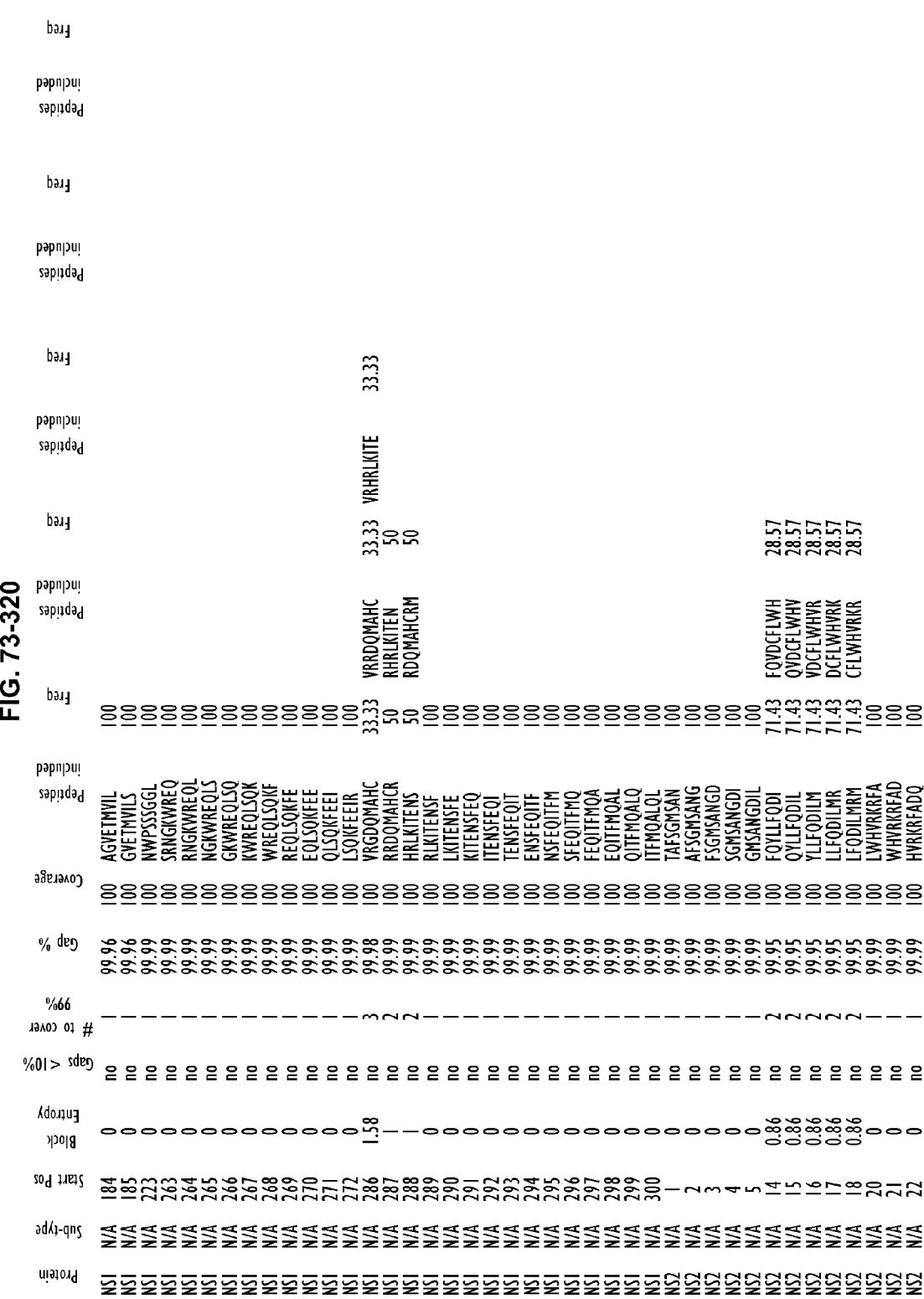

FIG. 73-321

| Protein | Sub-type | Start Pos | Block Entropy | Gaps > 10% | # to cover 99% | Gap % | Coverage | Peptides included | Freq |
|---|---|---|---|---|---|---|---|---|---|
| NS2 | N/A | 23 | 0 | no | - | 99.99 | 100 | VRKRFADQE | 100 |
| NS2 | N/A | 24 | 0 | no | - | 99.99 | 100 | RKRFADQEL | 100 |
| NS2 | N/A | 25 | 0 | no | - | 99.99 | 100 | KRFADQELG | 100 |
| NS2 | N/A | 26 | 0 | no | - | 99.99 | 100 | RFADQELGD | 100 |
| NS2 | N/A | 27 | 0 | no | - | 99.99 | 100 | FADQELGDA | 100 |
| NS2 | N/A | 28 | 0 | no | - | 99.99 | 100 | ADQELGDAP | 100 |
| NS2 | N/A | 29 | 0 | no | - | 99.99 | 100 | DQELGDAPF | 100 |
| NS2 | N/A | 30 | 0 | no | - | 99.99 | 100 | QELGDAPFL | 100 |
| NS2 | N/A | 31 | 0 | no | - | 99.99 | 100 | ELGDAPFLD | 100 |
| NS2 | N/A | 32 | 0 | no | - | 99.99 | 100 | LGDAPFLDR | 100 |
| NS2 | N/A | 33 | 0 | no | - | 99.99 | 100 | GDAPFLDRL | 100 |
| NS2 | N/A | 34 | 0 | no | - | 99.99 | 100 | DAPFLDRLR | 100 |
| NS2 | N/A | 35 | 0 | no | - | 99.99 | 100 | APFLDRLRR | 100 |
| NS2 | N/A | 36 | 0 | no | - | 99.99 | 100 | PFLDRLRRD | 100 |
| NS2 | N/A | 37 | 0 | no | - | 99.99 | 100 | FLDRLRRDQ | 100 |
| NS2 | N/A | 38 | 0 | no | - | 99.99 | 100 | LDRLRRDQK | 100 |
| NS2 | N/A | 39 | 0 | no | - | 99.99 | 100 | DRLRRD

FIG. 73-322

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NS2 | N/A | 64 | 0 | no | 1 | 99.99 | 100 | REGKHIVER | | | | | | | |
| NS2 | N/A | 65 | 0 | no | 1 | 99.99 | 100 | EGKHIVERI | | | | | | | |
| NS2 | N/A | 66 | 0 | no | 1 | 99.99 | 100 | GKHIVERIL | | | | | | | |
| NS2 | N/A | 67 | 0 | no | 1 | 99.99 | 100 | KHIVERILE | | | | | | | |
| NS2 | N/A | 68 | 0 | no | 1 | 99.99 | 100 | HIVERILEE | | | | | | | |
| NS2 | N/A | 69 | 0 | no | 1 | 99.99 | 100 | IVERILEES | | | | | | | |
| NS2 | N/A | 70 | 0 | no | 1 | 99.99 | 100 | VERILEEES | | | | | | | |
| NS2 | N/A | 71 | 0 | no | 1 | 99.99 | 100 | ERILEEESD | | | | | | | |
| NS2 | N/A | 72 | 0 | no | 1 | 99.99 | 100 | RILEEESDE | | | | | | | |
| NS2 | N/A | 73 | 0 | no | 1 | 99.99 | 100 | ILEEESDEA | | | | | | | |
| NS2 | N/A | 74 | 0 | no | 1 | 99.99 | 100 | LEEESDEAL | | | | | | | |
| NS2 | N/A | 75 | 0 | no | 1 | 99.99 | 100 | EEESDEALK | | | | | | | |
| NS2 | N/A | 76 | 0 | no | 1 | 99.99 | 100 | EESDEALKM | | | | | | | |
| NS2 | N/A | 77 | 0 | no | 1 | 99.99 | 100 | ESDEALKMT | | | | | | | |
| NS2 | N/A | 78 | 0 | no | 1 | 99.99 | 100 | SDEALKMTI | | | | | | | |
| NS2 | N/A | 79 | 0 | no | 1 | 99.99 | 100 | DEALKMTIA | | | | | | | |
| NS2 | N/A | 80 | 0 | no | 1 | 99.99 | 100 | EALKMTIAS | | | | | | | |
| NS2 | N/A | 81 | 0 | no | 1 | 99.99 | 100 | ALKMTIASD | | | | | | | |
| NS2 | N/A | 82 | 0 | no | 1 | 99.99 | 100 | LKMTIASDI | | | | | | | |
| NS2 | N/A | 83 | 0 | no | 2 | 99.99 | 100 | KMTIASDIL | 50 | MTIASDILK | | | | | |
| NS2 | N/A | 84 | 0 | no | 2 | 99.99 | 100 | MTIASDILT | 50 | TIASDILKR | | | | | |
| NS2 | N/A | 85 | 0 | no | 2 | 99.99 | 100 | TIASDILTR | 50 | IASDILKRM | | | | | |
| NS2 | N/A | 86 | 0 | no | 2 | 99.99 | 100 | IASDILTRM | 50 | ASDILTRMS | | | | | |
| NS2 | N/A | 87 | 0 | no | 1 | 99.99 | 100 | ASDILKRMS | | | | | | | |
| NS2 | N/A | 101 | 0 | no | 1 | 99.99 | 100 | RPHPEDLNG | | | | | | | |
| NS2 | N/A | 150 | 0.43 | yes | 5 | 0.01 | 99.02 | QKFEEIRWL | 94.94 | QKFEEVRWL | 2.29 | QKFEEMRWL | 1.11 | QKFEEIRWM | 0.36 | QKFEEIRWM | 0.31 |
| NS2 | N/A | 151 | 0.42 | yes | 5 | 0.01 | 99.18 | KFEEIRWLI | 95.03 | KFEEVRWLI | 2.35 | KFEEMRWLI | 1.13 | KFEEIRWMI | 0.36 | KFEEIRWMI | 0.31 |
| NS2 | N/A | 169 | 0.15 | yes | 2 | 0.02 | 99.35 | TENSFEQIT | 98.5 | TESSFEQIT | 0.85 | | | | | |
| NS2 | N/A | 170 | 0.15 | yes | 2 | 0.01 | 99.39 | ENSFEQITF | 98.55 | ESSFEQITF | 0.85 | | | | | |
| NS2 | N/A | 171 | 0.64 | yes | 4 | 0.01 | 99.28 | NSFEQITFL | 88.63 | NSFEQITFM | 9.5 | NSFEQITFI | 0.33 | | | |
| NS2 | N/A | 172 | 0.57 | yes | 3 | 0 | 99.3 | SFEQITFLQ | 89.43 | SFEQITFMQ | 9.53 | | | | | |
| NS2 | N/A | 173 | 0.55 | yes | 3 | 0.01 | 99.17 | FEQITFLQA | 89.41 | FEQITFMQA | 9.54 | | | | | |
| NS2 | N/A | 174 | 0.56 | yes | 2 | 0.01 | 99.04 | EQITFLQAL | 89.63 | EQITFMQAL | 9.53 | | | | | |
| NS2 | N/A | 175 | 0.58 | yes | 3 | 0.01 | 99.26 | QITFLQALQ | 89.51 | QITFMQALQ | 9.53 | | | | | |
| NS2 | N/A | 176 | 0.58 | yes | 2 | 0.02 | 99.39 | ITFLQALQL | 89.39 | ITFMQALQL | 9.51 | ITFIQALQL | 0.34 | | | |
| NS2 | N/A | 177 | 0.58 | yes | 2 | 0.02 | 99.22 | TFLQALQLL | 89.37 | TFMQALQLL | 9.52 | TFIQALQLL | 0.34 | | | |
| NS2 | N/A | 178 | 1.35 | yes | 3 | 0.02 | 99.19 | FLQALQLLF | 64.03 | FMQALQLLF | 25.33 | FLQALQLLL | 9.51 | FIQALQLL | 0.34 | | |
| NS2 | N/A | 179 | 1.36 | yes | 4 | 0.02 | 99.17 | LQALQLLFE | 63.98 | MQALQLLFE | 25.35 | LQALQLLLE | 9.52 | IQALQLLLE | 0.34 | | |
| NS2 | N/A | 180 | 0.91 | yes | 2 | 0.02 | 99.27 | QALQLLFEV | 73.9 | QALQLLLEV | 25.37 | | | | | |
| NS2 | N/A | 181 | 0.91 | yes | 2 | 0.02 | 99.24 | ALQLLLEVE | 73.87 | ALQLLFEVE | 25.37 | | | | | |
| NS2 | N/A | 182 | 1.36 | yes | 4 | 0.03 | 99.09 | LQLLFEVEQ | 64.4 | LQLLLEVEQ | 25.36 | LQLLEVEN | 8.97 | LQLLEVES | 36 | |

FIG. 73-323

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NS2 | N/A | 183 | 1.36 | yes | 4 | 0.03 | 99.03 | QLLLEVEQE | 64.33 | QLLLEVESE | 25.36 | QLLLEVENE | 8.98 | | |
| NS2 | N/A | 187 | 1.54 | yes | 5 | 1.52 | 99.08 | EVEQEIRTF | 58.04 | EVESEIRTF | 29.78 | EVEQEMRTF | 9 | EVENEIRTF | 0.35 |
| NS2 | N/A | 188 | 1.54 | yes | 5 | 1.7 | 99.11 | VEQEIRTFS | 58.06 | VESEIRTFS | 29.77 | VEQEMRTFS | 9.01 | VENEIRTFS | 0.35 |
| NS2 | N/A | 191 | 1.19 | yes | 4 | 3.97 | 99 | EIRTFSFQL | 66.72 | EIRAFSFQL | 29.68 | EIRTSFQF | 1.89 | | |
| NS2 | N/A | 192 | 1.18 | yes | 4 | 4.74 | 99.1 | IRTFSFQLI | 66.93 | IRAFSFQLI | 29.6 | IRTSFQLI | 1.86 | | |
| NS2 | N/A | 193 | - | no | 2 | 99.97 | 100 | RTFSFQLI | 50 | RTSFQLI | 50 | | | | |
| NS2 | N/A | 194 | 1.58 | no | 3 | 99.98 | 100 | RTFSFQLIL | 33.33 | TSFQLILL | 33.33 | TSFQLILL | 33.33 | | |
| NS2 | N/A | 195 | 0 | no | 1 | 99.99 | 100 | FSFQLINNK | | | | | | | |
| NS2 | N/A | 196 | 0 | no | 1 | 99.99 | 100 | SFQLINNKK | | | | | | | |
| NS2 | N/A | 197 | 0 | no | 1 | 99.99 | 100 | FQLINNKKP | | | | | | | |
| PA | N/A | 1 | 0.26 | yes | 4 | 6.28 | 99 | MEDFVRQCF | 97.37 | MENFVRQCF | 1.01 | MEGFVRQCF | 1.01 | | |
| PA | N/A | 2 | 0.29 | yes | 5 | 6.07 | 99 | EDFVRQCFN | 97.14 | ENFVRQCFN | 1.01 | EGFVRQCFN | 1.01 | GDFVRQCFN | 0.24 |
| PA | N/A | 3 | 0.26 | yes | 4 | 5.6 | 99.07 | DFVRQCFNP | 97.44 | NFVRQCFNP | 1.01 | GFVRQCFNP | 1.01 | | |
| PA | N/A | 4 | 0.12 | yes | 3 | 4.2 | 99.02 | VRQCFNPM | 99.02 | | | VRQCFNPMV | 0.62 | | |
| PA | N/A | 5 | 0.22 | yes | 4 | 4.05 | 99.11 | ROCFNPMI | 97.93 | VRQCFNPMV | 3.15 | RQCFNPMTV | 0.57 | QCFNPMIAE | 0.31 |
| PA | N/A | 6 | 0.41 | yes | 5 | 3.87 | 99.06 | OCFNPMIIE | 94.75 | ROCFNPMIV | 3.15 | QCFNPMTVE | 0.57 | CFNPMIAEL | 0.31 |
| PA | N/A | 7 | 0.44 | yes | 5 | 3.77 | 99.17 | CFNPMIVEL | 94.56 | OCFNPMIIE | 3.11 | CFNPMTVEL | 0.58 | FNPMIAELA | 0.31 |
| PA | N/A | 8 | 0.43 | yes | 5 | 2.66 | 99.22 | FNPMIVELA | 94.62 | CFNPMIIEL | 3.1 | FNPMTVELA | 0.58 | PMIAELAE | 0.31 |
| PA | N/A | 9 | 0.45 | yes | 5 | 2.36 | 99.28 | NPMIVELAE | 94.67 | FNPMIIELA | 3.09 | NPMTVELA | 0.58 | MIAELAEK | 0.32 |
| PA | N/A | 10 | 0.44 | yes | 5 | 2.17 | 99.07 | PMIVELAEK | 94.47 | PMIIELAE | 3.04 | PMTVELAE | 0.58 | VELAERAMK | 0.22 |
| PA | N/A | 11 | 0.57 | yes | 5 | 1.84 | 99.1 | VELAEKAMK | 92.34 | VELAEKTMK | 3.2 | AELAEKAMK | 0.31 | | |
| PA | N/A | 12 | 0.34 | yes | 3 | 0.91 | 99.03 | ELAEKAMKE | 95.6 | ELAEKTMKE | 3.25 | | | | |
| PA | N/A | 13 | 0.42 | yes | 4 | 0.79 | 99.11 | LAEKAMKEY | 94.52 | LAEKTMKEY | 3.21 | LAERAMKEY | 0.26 | | |
| PA | N/A | 14 | 0.42 | yes | 3 | 0.75 | 99.25 | AEKAMKEYG | 94.54 | AEKTMKEYG | 3.21 | | | | |
| PA | N/A | 15 | 0.19 | yes | 3 | 0.71 | 99.01 | EKAMKEYGE | 94.52 | EKTMKEYGE | 3.22 | | | | |
| PA | N/A | 16 | 0.17 | yes | 4 | 0.67 | 99 | ETNKFAAIC | 98.31 | ETNKLAAIC | 0.37 | | | | |
| PA | N/A | 17 | 0.32 | yes | 4 | 0.06 | 99.04 | TNKFAAICT | 98.26 | TNKLAAICT | 0.37 | TNKFAAVCT | 0.23 | | |
| PA | N/A | 31 | 0.19 | yes | 3 | 0.04 | 99.21 | NKFAAICTH | 98.43 | NKLAAICTH | 0.38 | | | | |
| PA | N/A | 32 | 0.32 | yes | 4 | 0.04 | 99.14 | KFAAICTHL | 96.33 | FAAICTHLE | 0.38 | KFASICTHL | 0.36 | | |
| PA | N/A | 33 | 0.35 | yes | 4 | 0.04 | 99.15 | FAAICTHLE | 96.33 | AAICTHME | 2.08 | FASICTHLE | 0.36 | | |
| PA | N/A | 34 | 0.38 | yes | 4 | 0.04 | 99.02 | AAICTHLEV | 95.46 | AICTHMEV | 2.06 | ASICTHLEV | 0.36 | | |
| PA | N/A | 35 | 0.32 | yes | 4 | 0.03 | 99.31 | AICTHLEVC | 95.76 | AICTHMEVC | 2.05 | SICTHLEVC | 0.36 | | |
| PA | N/A | 36 | 0.35 | yes | 4 | 0.05 | 99.28 | ICTHLEVCF | 96.09 | ICTHMEVCF | 2.05 | | | | |
| PA | N/A | 37 | 0.32 | yes | 4 | 0.05 | 99.54 | CTHLEVCFM | 96.35 | CTHMEVCFM | 2.05 | | | | |
| PA | N/A | 38 | 0.29 | yes | 3 | 0.03 | 99.54 | THLEVCFMY | 96.35 | THMEVCFMY | 2.05 | | | | |
| PA | N/A | 39 | 0.29 | yes | 3 | 0.04 | 99.61 | HLEVCFMYS | 96.41 | HMEVCFMYS | 2.07 | | | | |
| PA | N/A | 40 | 0.29 | yes | 3 | 0.03 | 99.62 | LEVCFMYSD | 96.43 | MEVCFMYSD | 2.06 | | | | |
| PA | N/A | 41 | 0.28 | yes | 3 | 0.04 | 99.64 | EVCFMYSDF | 98.49 | | | | | | |
| PA | N/A | 42 | 0.14 | yes | 2 | 0.05 | 99.65 | VCFMYSDFH | 98.51 | | | | | | |
| PA | N/A | 43 | 0.03 | yes | 1 | 0.04 | 99.76 | CFMYSDFHF | 99.76 | | | | | | |

FIG. 73-324

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| PA | N/A | 46 | 0.05 | yes | 1 | 0.04 | 99.61 | FMYSDFH

FIG. 73-325

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 142 | 0.97 | yes | 5 | 0.05 | 99.41 | KTHIHIFSF | 78.41 | NTHIHIFSF | 18.38 | ETHIHIFSF | 1.21 | RTHIHIFSF | 0.95 | DTHIHIFSF | 0.46 |
| PA

FIG. 73-326

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| PA | N/A | 199 | 1.27 | yes | 4 | 0.09 | 99.18 | EETIEERFE | 48.85 | EETIEERFE | 47.6 | EDTIEERFE | 2.05 | EETVEERFE | 0.68 | | |
| PA | N/A | 200 | 1.28 | yes | 4 | 0.09 | 99.06 | ETIEEKFEI | 48.83 | ETIEERFEI | 47.51 | DTIEERFEI | 2.05 | ETVEERFEI | 0.68 | | |
| PA | N/A | 201 | 0 | no | 1 | 99.99 | 100 | RSIEEKFEI | 100 | | | | | | | | |
| PA | N/A | 216 | 0.39 | yes | 3 | 0.05 | 99.16 | LADQSLPPN | 95.03 | LANQSLPPN | 3.3 | LANYSLPPN | 0.83 | DQSLPPNFP | 0.28 | | |
| PA | N/A | 217 | 0.38 | yes | 3 | 0.05 | 99.24 | ADQSLPPNF | 95.11 | ANQSLPPNF | 3.3 | ANYSLPPNF | 0.83 | QSLPPNFPS | 0.28 | | |
| PA | N/A | 218 | 0.42 | yes | 4 | 0.05 | 99.13 | DQSLPPNFS | 94.72 | NQSLPPNFS | 3.3 | NYSLPPNFS | 0.83 | SFRAYDGF | 0.22 | | |
| PA | N/A | 219 | 1.03 | yes | 4 | 0.05 | 99.05 | QSLPPNFSC | 71.98 | QSLPPNFSC | 25.95 | YSLPPNFSS | 0.88 | FRTYDGFE | 0.36 | | |
| PA | N/A | 219 | 0.22 | yes | 4 | 0.09 | 99.15 | NFRAYDGF | 97.98 | NFRTYDGF | 0.55 | NRTYYDGF | 0.49 | RTYYDGFEP | 0.36 | RTYYDGFKP | 0.13 |
| PA | N/A | 230 | 0.31 | yes | 4 | 0.09 | 99.1 | FRAYDGFE | 96.62 | FRAYDGFE | 1.6 | FRYYDGFE | 0.53 | TYYDGFEP | 0.37 | | |
| PA | N/A | 231 | 0.32 | yes | 4 | 0.09 | 99.12 | RAYDGFEP | 96.53 | RAYDGFKP | 1.58 | RYYDGFEP | 0.53 | | | | |
| PA | N/A | 232 | 0.32 | yes | 5 | 0.07 | 99.07 | AYDGFEPN | 96.56 | AYDGFKPN | 1.62 | YYDGFEPN | 0.52 | | | | |
| PA | N/A | 233 | 0.23 | yes | 4 | 0.05 | 99.25 | YDGFEPNG | 97.42 | YDGFKPNG | 1.82 | | | | | | |
| PA | N/A | 234 | 0.76 | yes | 3 | 0.05 | 99.03 | VDGFEPNGY | 86.18 | VDGFKPNGC | 1.7 | IDGFEPNGC | 0.14 | | | | |
| PA | N/A | 235 | 0.74 | yes | 2 | 0.05 | 99.04 | DGFEPNGCI | 86.33 | DGFKPNGCI | 11 | | | | | | |
| PA | N/A | 236 | 0.74 | yes | 3 | 0.05 | 99.04 | GFEPNGYI | 86.33 | GFKPNGCIE | 11 | | | | | | |
| PA | N/A | 237 | 0.81 | yes | 3 | 0.05 | 99.07 | FEPNGYIEG | 85.57 | FKPNGCIEG | 10.99 | FEPNGCIES | 1.59 | FEPNGCIEG | 0.14 | | |
| PA | N/A | 238 | 0.81 | yes | 3 | 0.06 | 99.05 | EPNGYIEGK | 85.55 | KPNGCIEGK | 11 | EPNGCIESK | 1.59 | EPNGSIEGK | 0.14 | | |
| PA | N/A | 239 | 0.67 | yes | 3 | 0.06 | 99.27 | PNGCIEGKL | 87.25 | PNGCIESKL | 11.12 | | | | | | |
| PA | N/A | 240 | 0.67 | yes | 3 | 0.07 | 99.25 | NGCIEGKLS | 87.21 | NGCIESKLS | 11.13 | | | | | | |
| PA | N/A | 241 | 0.67 | yes | 3 | 0.07 | 99.25 | GCIEGKLSQ | 87.21 | GCIESKLSQ | 11.13 | | | | | | |
| PA | N/A | 242 | 0.67 | yes | 3 | 0.07 | 99.19 | CIEGKLSQM | 87.21 | CIESKLSQM | 11.12 | | | | | | |
| PA | N/A | 243 | 0.18 | yes | 2 | 0.06 | 99.19 | IEGKLSQMS | 98.26 | | | | | | | | |
| PA | N/A | 244 | 0.32 | yes | 3 | 0.07 | 99.17 | EGKLSQMSK | 96.31 | ESKLSQMSK | 0.92 | | | | | | |
| PA | N/A | 245 | 0.37 | yes | 4 | 0.05 | 99.06 | KLSQMSKEV | 95.75 | KLSQMSKRV | 1.95 | KLSOMPKEV | 0.92 | KLSQMSKNV | 0.21 | KLSOMSKNV | 0.2 |
| PA | N/A | 247 | 1.88 | yes | 3 | 0.07 | 99.43 | CKSQRSKFL | 47.63 | CHQRSKFLL | 1.97 | CFQRSKFLL | 1.06 | | | | |
| PA | N/A | 278 | 1.88 | yes | 3 | 0.07 | 99.45 | SQRSKFLLM | 47.6 | HQRSKFLLM | 24.15 | FQRSKFLLM | 16.59 | | | | |
| PA | N/A | 279 | 0.07 | yes | 2 | 0.07 | 99.61 | QRSKFLLMD | 99.43 | HQRSKFLLM | 24.14 | | | 16.6 | | | |
| PA | N/A | 280 | 0.44 | yes | 2 | 0.07 | 99.64 | RSKFLLMDA | 92.17 | RSKFLLMDS | 7.28 | | | | | | |
| PA | N/A | 281 | 0.43 | yes | 2 | 0.07 | 99.64 | SKFLLMDAL | 92.33 | SKFLLMDSL | 7.28 | | | | | | |
| PA | N/A | 282 | 0.42 | yes | 2 | 0.08 | 99.45 | KFLLMDALK | 92.37 | KFLLMDSLK | 7.27 | | | | | | |
| PA | N/A | 283 | 0.42 | yes | 2 | 0.09 | 99.31 | FLLMDALKL | 92.37 | FLLMDSLKL | 7.27 | | | | | | |
| PA | N/A | 284 | 0.45 | yes | 2 | 0.09 | 99.42 | LLMDALKLS | 92.2 | LLMDSLKLS | 7.26 | | | | | | |
| PA | N/A | 285 | 0.46 | yes | 2 | 0.09 | 99.06 | LMDALKLSI | 92.06 | LMDSLKLSI | 7.26 | | | | | | |
| PA | N/A | 286 | 0.45 | yes | 2 | 0.09 | 99.05 | MDALKLSIE | 92.17 | MDSLKLSIE | 7.24 | | | | | | |
| PA | N/A | 287 | 0.48 | yes | 2 | 0.09 | 99.07 | DALKLSIED | 91.82 | DSLKLSIED | 7.24 | | | | | | |
| PA | N/A | 288 | 0.49 | yes | 2 | 0.1 | 99.07 | ALKLSIEDP | 91.81 | SLKLSIEDP | 7.28 | LKLSIEDPD | 1.35 | LKLSIENPS | 0.23 | | |
| PA | N/A | 289 | 0.54 | yes | 4 | 0.09 | 99.09 | LKLSIEDPS | 92.1 | LKLSIEDPN | 5.41 | KLSIEDPDH | 1.34 | KLSIENPSH | 0.23 | | |
| PA | N/A | 290 | 0.54 | yes | 4 | 0.09 | 99 | KLSIEDPSH | 92.13 | LKLSIEDPN | 5.37 | LSIEDPDHE | 1.34 | LSIENPSHE | 0.23 | LSIEEPSHE | 0.15 |
| PA | N/A | 291 | 0.56 | yes | 5 | 0.11 | 100 | LSIEDPSHE | 91.99 | LSIEDPNHE | 5.37 | | | | | | |
| PA | N/A | 293 | 0 | no | 1 | 99.99 | 100 | KASKEPEVH | 100 | | | | | | | | |
| PA | N/A | 294 | 0 | no | 1 | 99.99 | 100 | ASKEPEVHE | 100 | | | | | | | | |

FIG. 73-327

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 295 | 0.56 | yes | 5 | 0.11 | 99.07 | SIEDPSHEG | 91.97 | SIEDPNHEG | 5.37 | SIEDPDHEG | 1.34 | SIENPSHEG | 0.23 | SIEEPSHEG | 0.15 |
| PA | N/A | 296 | 0.54 | yes | 4 | 0.11 | 99.08 | IEDPSHEGE | 92.13 | IEDPNHEGE | 5.38 | IEDPDHEGE | 1.34 | IENPSHEGE | 0.23 | | |
| PA | N/A | 297 | 0.53 | yes | 4 | 0.11 | 99.2 | EDPSHEGEG | 92.18 | EDPNHEGEG | 5.38 | EDPDHEGEG | 1.34 | ENPSHEGEG | 0.23 | | |
| PA | N/A | 298 | 0.54 | yes | 4 | 0.11 | 99.12 | DPSHEGEGI | 92.18 | DPNHEGEGI | 5.38 | DPDHEGEGI | 1.34 | NPSHEGEGI | 0.23 | | |
| PA | N/A | 299 | 0.49 | yes | 3 | 0.1 | 99.29 | PSHEGEGIP | 92.56 | PNHEGEGIP | 5.39 | PDHEGEGIP | 1.35 | | | | |
| PA | N/A | 300 | 0.5 | yes | 3 | 0.09 | 99.21 | SHEGEGIPL | 92.48 | NHEGEGIPL | 5.39 | DHEGEGIPL | 1.35 | | | | |
| PA | N/A | 301 | 0.14 | yes | 2 | 0.08 | 99.21 | HEGEGIPLY | 98.77 | HEGEGIPLH | 0.44 | | | | | | |
| PA | N/A | 302 | 0.12 | yes | 2 | 0.08 | 99.33 | EGEGIPLYD | 98.89 | EGEGIPLHD | 0.44 | | | | | | |
| PA | N/A | 303 | 0.11 | yes | 2 | 0.08 | 99.43 | GEGIPLYDA | 98.99 | GEGIPLHDA | 0.44 | | | | | | |
| PA | N/A | 304 | 0.28 | yes | 3 | 0.08 | 99.27 | EGIPLYDAV | 96.79 | EGIPLHDAI | 2.06 | EGIPLHDAI | 0.42 | | | | |
| PA | N/A | 305 | 0.3 | yes | 4 | 0.07 | 99.12 | GIPLYDAVR | 96.64 | GIPLHDAIK | 1.78 | GIPLHDAIK | 0.42 | GIPLYDAVK | 0.28 | | |
| PA | N/A | 306 | 0.3 | yes | 4 | 0.04 | 99.13 | IPLYDAVRC | 96.65 | IPLHDAIKC | 1.78 | IPLHDAIKC | 0.42 | IPLYDAVKC | 0.28 | | |
| PA | N/A | 313 | 1.35 | yes | 5 | 0.04 | 99.22 | KCMKTFFGW | 72.24 | KCMRTFFGW | 14.02 | KCMRTFFGW | 9.61 | RCMKTFFGW | 1.82 | KCIRTFGW | 1.53 |
| PA | N/A | 314 | 1.25 | yes | 5 | 0.05 | 99.34 | CMKTFFGWK | 73.66 | CMRTFFGWK | 14.08 | CMRTFFGWK | 9.62 | CIRTFFGWK | 1.53 | CMKTFFGWR | 0.46 |
| PA | N/A | 315 | 0.65 | yes | 3 | 0.05 | 99.1 | KTFFGWKEP | 87.5 | KTFFGWREP | 11.13 | KTFFGWKEP | 0.47 | | | | |
| PA | N/A | 316 | 0 | no | - | 99.99 | 100 | LKDEEKIPK | 100 | | | | | | | | |
| PA | N/A | 353 | 0.44 | yes | 5 | 0.04 | 99.23 | LKWALGENM | 94.48 | LRWALGENM | 2.93 | LKWTLGENM | 0.75 | LKWTLGENM | 0.61 | LMWALGENM | 0.46 |
| PA | N/A | 371 | 0.44 | yes | 5 | 0.05 | 99.28 | KWALGENMA | 94.52 | RWALGENMA | 2.93 | KWLGENMA | 0.75 | KWTLGENMA | 0.61 | MWALGENMA | 0.46 |
| PA | N/A | 372 | 0.21 | yes | 3 | 0.05 | 99.29 | WALGENMAP | 97.91 | WVLGENMAP | 0.77 | WTLGENMAP | 0.61 | | | | |
| PA | N/A | 373 | 0.21 | yes | 3 | 0.05 | 99.26 | ALGENMAPE | 97.88 | VLGENMAPE | 0.77 | TLGENMAPE | 0.61 | | | | |
| PA | N/A | 374 | 0.09 | no | - | 0.05 | 99.23 | LGENMAPEK | 100 | | | | | | | | |
| PA | N/A | 375 | 0.21 | yes | 4 | 0.05 | 99.02 | GENMAPEKV | 97.95 | GENMAPEKM | 0.65 | GENMAPEKI | 0.43 | | | | |
| PA | N/A | 376 | 0.22 | yes | 4 | 0.05 | 99.15 | ENMAPEKVD | 97.84 | ENMAPEKMD | 0.65 | ENMAPEKID | 0.43 | ENIAPEKVD | 0.23 | IAPEKVDFE | 0.19 |
| PA | N/A | 377 | 0.22 | yes | 4 | 0.05 | 99.21 | NMAPEKVDF | 97.9 | NMAPEKMDF | 0.65 | NMAPEKIDF | 0.43 | NIAPEKVDF | 0.23 | | |
| PA | N/A | 378 | 1.2 | yes | 4 | 0.05 | 99.05 | MAPEKVDFD | 49.39 | MAPEKMDFE | 48.61 | MAPEKIDFE | 0.5 | MAPEKIDFE | 0.36 | | |
| PA | N/A | 379 | 1.67 | yes | 5 | 0.04 | 99.46 | WIQSEFNKA | 42.61 | WVQNEFNKA | 30.6 | WVQSEFNKA | 25.26 | WVQSEFNKA | - | | |
| PA | N/A | 411 | 1.67 | yes | 4 | 0.04 | 99.45 | IQNEFNKAC | 42.61 | VQNEFNKAC | 30.6 | VQSEFNKAC | 25.25 | VQSEFNKAC | - | | |
| PA | N/A | 412 | 1.03 | yes | 2 | 0.03 | 99.68 | QSEFNKACE | 55.87 | QSEFNKACE | 43.81 | | | | | | |
| PA | N/A | 413 | 1.03 | yes | 2 | 0.03 | 99.66 | SEFNKACEL | 55.85 | SEFNKACEL | 43.81 | | | | | | |
| PA | N/A | 414 | 0.04 | yes | 1 | 0.04 | 99.72 | EFNKACELT | 99.72 | | | | | | | | |
| PA | N/A | 415 | 0 | no | - | 0.04 | 99.16 | FNKACELTD | 99.16 | | | | | | | | |
| PA | N/A | 416 | 0.1 | yes | 1 | 0.03 | 99.15 | NKACELTDS | 99.15 | | | | | | | | |
| PA | N/A | 417 | 0.1 | yes | 1 | 0.03 | 99.19 | KACELTDSS | 72.97 | KACELTDSI | 16.34 | KACELTDSV | 9.17 | KACELTDST | 0.48 | KACELTGSS | 0.25 |
| PA | N/A | 418 | 1.22 | yes | 5 | 0.03 | 99.23 | KTAYELTDS | 100 | | | | | | | | |
| PA | N/A | 419 | 0 | no | - | 99.99 | 100 | TAYELTDSS | 100 | | | | | | | | |
| PA | N/A | 420 | 0 | no | - | 99.99 | 73 | ACELTDSSW | 73 | ACELTDSIW | 16.33 | ACELTDSVW | 9.18 | ACELTDSTW | 9.18 | ACELTGSSW | 0.24 |
| PA | N/A | 421 | 1.22 | yes | 5 | 0.03 | 99 | WIELDEIGE | 95.63 | WMELDEIGE | 1.98 | WELDEIGE | 0.85 | WELDEIGE | 0.85 | | |
| PA | N/A | 429 | 0.38 | yes | 4 | 0.04 | 99.13 | IELDEIGED | 95.57 | MELDEIGED | 1.98 | VELDEIGED | 0.85 | VELDEIGED | 0.85 | IEFDEIGED | 0.19 |
| PA | N/A | 430 | 0.39 | yes | 4 | 0.04 | 99.11 | ELDEIGEDI | 91.02 | ELDEIGEDL | 7.31 | EFDEIGEDV | 0.56 | | | | |
| PA | N/A | 431 | 0.56 | yes | 5 | 0.05 | 99.03 | LDEIGEDIA | 91.12 | LDEIGEDLA | 7.35 | EFDEIGEDW | 0.56 | | | | |
| PA | N/A | 432 | 0.55 | yes | 4 | 0.05 | 99.11 | DEIGEDIAP | 91.34 | DEIGEDLAP | 7.4 | | | | | | |
| PA | N/A | 433 | 0.52 | yes | 3 | 0.05 | 99.29 | DEIGEDVAP | 91.34 | DEIGEDLAP | 7.4 | | | | | | |

FIG. 73-328

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 434 | 0.52 | yes | 3 | 0.05 | 99.27 | EIGEDVAPI | 91.34 | EIGEDLAPI | 7.37 | | | | |
| PA | N/A | 435 | 0.52 | yes | 3 | 0.07 | 99.3 | IGEDVAPIE | 91.38 | IGEDLAPIE | 7.36 | | | | |
| PA | N/A | 436 | 1.09 | yes | 5 | 0.07 | 99.18 | GEDVAPIEH | 79.62 | GEDLAPIE | 11.81 | GEDLAPIEY | 1.9 | GEDLAPIEY | 0.42 |
| PA | N/A | 440 | 0.77 | yes | 5 | 0.1 | 99.07 | APIEHIASM | 84.62 | APIEYIASM | 13.55 | APIEHVASM | 0.27 | APIEHIASI | 0.18 |
| PA | N/A | 441 | 0.78 | yes | 5 | 0.12 | 99.01 | PIEHIASMR | 84.55 | PIEYIASMR | 13.55 | PIEHVASMR | 0.27 | PIEHIASIR | 0.18 |
| PA | N/A | 442 | 0.78 | yes | 5 | 0.12 | 99.02 | IEHIASMRR | 84.56 | IEYIASMRR | 13.55 | IEHVASMRR | 0.27 | IEHIASIRR | 0.18 |
| PA | N/A | 445 | 0.24 | yes | 4 | 0.11 | 99.17 | IASMRRYFT | 97.68 | IASMRRYFT | 0.73 | IASIRRNYF | 0.25 | IASMRRSYF | 0.2 |
| PA | N/A | 446 | 0.18 | yes | 4 | 0.1 | 99.02 | ASMRRNYF | 98.39 | ASMRRDYF | 0.3 | ASIRRNYF | 0.2 | | |
| PA | N/A | 449 | 0.22 | yes | 5 | 0.09 | 99.15 | RRNYFTAEV | 97.87 | RRDYFTAEV | 0.73 | RSYFTAEV | 0.25 | RNYFTTEV | 0.17 |
| PA | N/A | 450 | 0.18 | yes | 4 | 0.09 | 99.08 | RNYFTAEVS | 97.79 | RDYFTAEVS | 0.73 | RSYFTAEVS | 0.2 | RNYFTTEVS | 0.18 |
| PA | N/A | 452 | 0.23 | yes | 5 | 0.1 | 99.07 | YFTAEVSHC | 97.76 | YFTAEISHC | 0.84 | YFTTEVSHC | 0.3 | | |
| PA | N/A | 453 | 0.23 | yes | 4 | 0.09 | 99.09 | FTAEVSHCR | 97.77 | FTAEISHCR | 0.84 | FTAEVSYCR | 0.3 | | |
| PA | N/A | 454 | 0.22 | yes | 4 | 0.1 | 99.06 | TAEVSHCRA | 97.72 | TAEISHCRA | 0.84 | TAEVSYCRA | 0.3 | | |
| PA | N/A | 455 | 0.18 | yes | 4 | 0.09 | 99.06 | AEVSHCRAT | 97.75 | AEISHCRAT | 0.84 | AEVSYCRAT | 0.3 | | |
| PA | N/A | 456 | 0.18 | yes | 2 | 0.09 | 99.1 | EVSHCRATE | 98.25 | EISHCRATE | 0.85 | | | | |
| PA | N/A | 457 | 0.17 | yes | 2 | 0.1 | 99.14 | VSHCRATEY | 98.29 | ISHCRATEY | 0.85 | | | | |
| PA | N/A | 458 | 0 | no | 1 | 99.99 | 100 | ISKSRATEY | 100 | | | | | | |
| PA | N/A | 459 | 0.15 | yes | 2 | 0.09 | 99.04 | SHCRATEYI | 98.73 | SYCRATEYI | 0.3 | | | | |
| PA | N/A | 460 | 0.16 | yes | 3 | 0.07 | 99.15 | HCRATEYIM | 98.57 | YCRATEYIM | 0.3 | HCRATEYMM | 0.27 | | |
| PA | N/A | 461 | 0.13 | yes | 2 | 0.06 | 99.15 | CRATEYIMK | 98.89 | CRATEYMMK | 0.26 | | | | |
| PA | N/A | 462 | 0.13 | yes | 2 | 0.05 | 99.17 | RATEYIMKG | 98.91 | RATEYMMKG | 0.26 | | | | |
| PA | N/A | 463 | 0.13 | yes | 2 | 0.04 | 99.13 | ATEYIMKGV | 98.87 | ATEYMMKGV | 0.26 | | | | |
| PA | N/A | 464 | 0.15 | yes | 2 | 0.02 | 99.15 | TEYIMKGVY | 98.69 | TEYMMKGVY | 0.26 | | | | |
| PA | N/A | 468 | 0.23 | yes | 3 | 0.02 | 99.02 | MKGVYINTA | 97.73 | MKGVYYNTA | 0.57 | TEYIIKGVY | 0.21 | IIKGVYINTA | 0.21 |
| PA | N/A | 469 | 0.24 | yes | 4 | 0.03 | 99.04 | KGVYINTAL | 97.6 | GVYMNTAL | 0.57 | KGVYINTAM | 0.42 | KGVYINTAM | 0.42 |
| PA | N/A | 470 | 0.24 | yes | 4 | 0.02 | 99.21 | GVYINTALL | 97.72 | GVYMNTALL | 0.57 | GVYINTAML | 0.42 | GVYINTAML | 0.42 |
| PA | N/A | 471 | 0.23 | yes | 4 | 0.01 | 99.2 | VYINTALLN | 97.71 | VYMNTALLN | 0.57 | VYINTAMLN | 0.42 | VYINTAMLN | 0.42 |
| PA | N/A | 472 | 0.23 | yes | 4 | 0.03 | 99.06 | YINTALLNA | 97.56 | YMNTALLNA | 0.57 | YINTAMLNA | 0.42 | YINTAMLNA | 0.42 |
| PA | N/A | 473 | 0.22 | yes | 4 | 0.01 | 99.24 | INTALLNAS | 97.75 | MNTALLNAS | 0.56 | INTAMLNAS | 0.24 | | |
| PA | N/A | 474 | 0.11 | yes | 1 | 0.03 | 99.01 | NTALLNASC | 99.01 | | | | | | |
| PA | N/A | 475 | 0.12 | yes | 2 | 0.03 | 99.38 | TALLNASCA | 98.96 | TAMLNASCA | 0.42 | | | | |
| PA | N/A | 476 | 0.12 | yes | 2 | 0.04 | 99.18 | ALLNASCAA | 98.76 | AMLNASCAA | 0.42 | | | | |
| PA | N/A | 477 | 0.14 | yes | 2 | 0.04 | 99.17 | LLNASCAAM | 98.75 | MLNASCAAM | 0.42 | | | | |
| PA | N/A | 478 | 0.14 | yes | 2 | 0.05 | 99.08 | LNASCAAMD | 98.84 | LNASCAAME | 0.24 | | | | |
| PA | N/A | 479 | 0.23 | yes | 4 | 0.05 | 99.2 | NASCAAMDD | 97.65 | NASCAAMDE | 1.08 | NASCAAMED | 0.42 | NSSCAAMDD | 0.22 |
| PA | N/A | 480 | 0.25 | yes | 4 | 0.05 | 99.07 | ASCAAMDDF | 97.54 | ASCAAMDEF | 1.06 | ASCAAMEDF | 0.42 | SSCAAMDDF | 0.22 |
| PA | N/A | 481 | 0.24 | yes | 3 | 0.04 | 99.06 | SCAAMDDFQ | 97.76 | SCAAMDEFQ | 1.06 | SCAAMEDFQ | 0.42 | | |
| PA | N/A | 482 | 0.23 | yes | 3 | 0.05 | 99.04 | CAAMDDFQL | 97.73 | CAAMDEFQL | 1.06 | CAAMEDFQL | 0.42 | | |
| PA | N/A | 483 | 0.23 | yes | 3 | 0.03 | 99.01 | AAMDDFQLI | 97.7 | AAMDEFQLI | 1.06 | AAMEDFQLI | 0.24 | | |
| PA | N/A | 484 | 0.22 | yes | 3 | 0.03 | 99.16 | AMDDFQLIP | 97.85 | AMDEFQLIP | 1.06 | AMEDFQLIP | 0.25 | | |
| PA | N/A | 485 | 0.21 | yes | 2 | 0.03 | 99.03 | MDDFQLIPM | 97.9 | MDEFQLIPM | 1.13 | | | | |

FIG. 73-329

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 486 | 0.22 | yes | 3 | 0.03 | 99.15 | DDFQLIPMI | 97.77 | | | | | | |
| PA | N/A | 487 | 0.2 | yes | 2 | 0.04 | 99.12 | DFQLIPMIS | 97.99 | EDFQLIPMI | 0.25 | | | | |
| PA | N/A | 488 | 0.11 | yes | 1 | 0.04 | 99.08 | FQLIPMISK | 99.08 | EFQLIPMIS | 1.13 | | | | |
| PA | N/A | 489 | 0.12 | yes | 1 | 0.05 | 99.06 | QLIPMISKC | 99.06 | | | | | | |
| PA | N/A | 490 | 0.14 | yes | 2 | 0.05 | 99.06 | LIPMISKCK | 98.86 | LIPMISKCK | 0.2 | | | | |
| PA | N/A | 491 | 0.15 | yes | 2 | 0.05 | 99.1 | IPMISKCKT | 98.77 | IPMISKCKT | 0.2 | | | | |
| PA | N/A | 492 | 0.27 | yes | 4 | 0.05 | 99.06 | PMISKCKTR | 97.23 | PMISKCKTR | 1.5 | IPMISKCRT | 0.13 | | | |
| PA | N/A | 493 | 0.27 | yes | 4 | 0.05 | 99.04 | MISKCKTRE | 97.22 | MISKCKTR | 1.5 | PMISKCKTK | 0.2 | PMISKSRTK | 0.14 | |
| PA | N/A | 494 | 0.25 | yes | 3 | 0.05 | 99.01 | ISKCKTREG | 97.21 | MISKCRTRE | 1.5 | MISKCKTKE | 0.17 | MISKSRTKE | 0.14 | |
| PA | N/A | 495 | 0.25 | yes | 3 | 0.03 | 99.09 | SKCKTREGR | 97.34 | ISKCRTREG | 1.5 | ISKCCKTKE | 0.17 | | | |
| PA | N/A | 496 | 0.24 | yes | 3 | 0.05 | 99.18 | KCKTREGRR | 97.42 | SKCRTKEGR | 1.5 | SKCCKTKEG | 0.17 | | | |
| PA | N/A | 497 | 0.27 | yes | 3 | 0.03 | 99.08 | CKTREGRRK | 97.49 | KCKTREGRR | 1.51 | KCKTKEGRR | 0.18 | | | |
| PA | N/A | 498 | 0.27 | yes | 3 | 0.03 | 99.14 | RTREGRRKT | 97.05 | CRTREGRRR | 1.5 | CRTKEGRRR | 0.52 | | | |
| PA | N/A | 499 | 0.25 | yes | 3 | 0.01 | 99.31 | TREGRRKTN | 97.11 | TREGRRKTN | 1.5 | RTKEGRRRT | 0.52 | | | |
| PA | N/A | 500 | 0.23 | yes | 2 | 0.01 | 99.47 | REGRRKTNL | 97.3 | REGRRKTNL | 1.49 | TKEGRRRTN | 0.52 | | | |
| PA | N/A | 501 | 0.11 | yes | 1 | 0.01 | 99.52 | EGRRKTNLY | 97.46 | EGRRRTNL | 1.49 | KEGRRRTNL | 0.52 | | | |
| PA | N/A | 502 | 0.11 | yes | 1 | 0.01 | 99 | GRRKTNLYG | 98.98 | | 0.54 | | | | | |
| PA | N/A | 503 | 0.12 | yes | 1 | 0.01 | 99.46 | RRKTNLYGF | 98.92 | RRTNLYGF | 0.54 | | | | |
| PA | N/A | 504 | 0.14 | yes | 1 | 0.01 | 99.21 | RKTNLYGFI | 98.67 | RTNLYGFI | 0.54 | RTNLYGFII | 0.38 | | | |
| PA | N/A | 505 | 0.44 | yes | 2 | 0.01 | 99.04 | KTNLYGFII | 93.46 | KTNLYGFII | 5.21 | | | | |
| PA | N/A | 506 | 0.4 | yes | 2 | 0.02 | 99.21 | TNLYGFIIK | 93.85 | TNLYGFIVK | 5.36 | | | | |
| PA | N/A | 507 | 0.38 | yes | 2 | 0.03 | 99.38 | NLYGFIIKG | 94 | NLYGFIVKG | 5.38 | | | | |
| PA | N/A | 508 | 0.39 | yes | 2 | 0.02 | 99.27 | LYGFIIKGR | 93.89 | LYGFIVKGR | 5.38 | | | | |
| PA | N/A | 509 | 0.39 | yes | 2 | 0.02 | 99.27 | YGFIIKGRS | 93.89 | YGFIVKGRS | 5.38 | | | | |
| PA | N/A | 510 | 0.39 | yes | 2 | 0.03 | 99.29 | GFIIKGRSH | 93.91 | GFIVKGRS | 5.38 | | | | |
| PA | N/A | 511 | 0.38 | yes | 2 | 0.03 | 99.37 | FIIKGRSHL | 93.9 | FIVKGRSHL | 5.37 | | | | |
| PA | N/A | 512 | 0.34 | yes | 2 | 0.03 | 99.7 | IIKGRSHLR | 94.33 | IWKGRSHLR | 5.37 | | | | |
| PA | N/A | 513 | 0.04 | yes | 1 | 0.03 | 99.7 | IKGRSHLRN | 99.7 | VKGRSHLRN | | | | | |
| PA | N/A | 514 | 0.04 | yes | 1 | 0.03 | 99.68 | KGRSHLRND | 99.68 | | | | | | |
| PA | N/A | 515 | 0.04 | yes | 1 | 0.02 | 99.64 | GRSHLRNDT | 99.64 | | | | | | |
| PA | N/A | 516 | 0.05 | yes | 1 | 0.02 | 99.77 | RSHLRNDTD | 99.77 | | | | | | |
| PA | N/A | 517 | 0.05 | yes | 1 | 0.02 | 99.67 | SHLRNDTDV | 99.67 | | | | | | |
| PA | N/A | 518 | 0.05 | yes | 1 | 0.02 | 99.58 | HLRNDTDVV | 99.58 | | | | | | |
| PA | N/A | 519 | 0.15 | yes | 2 | 0.02 | 99.58 | LRNDTDVVN | 98.42 | RNDTDVVNY | 1.16 | NDTDVVNFL | 0.93 | | | |
| PA | N/A | 520 | 0.23 | yes | 3 | 0.02 | 99.54 | RNDTDVVNF | 97.45 | NDTDVVNYV | 1.16 | DTDVVNFLS | 0.93 | | | |
| PA | N/A | 521 | 0.23 | yes | 3 | 0.02 | 99.46 | NDTDVVNFV | 97.46 | DTDVVNYYS | 1.16 | TDVVNFLSM | 0.93 | | | |
| PA | N/A | 522 | 0.22 | yes | 3 | 0.02 | 99.57 | DTDVVNFVS | 97.48 | TDVVNYYSM | 1.16 | DVVNFLSME | 0.93 | | | |
| PA | N/A | 523 | 0.22 | yes | 3 | 0.02 | 99.58 | TDVVNFVSM | 97.48 | DVVNYYSME | 1.16 | | | | |
| PA | N/A | 524 | 0 | no | 1 | 99.99 | 100 | DVVNFVSME | 100 | | | | | | |
| PA | N/A | 525 | 0.22 | yes | 3 | 0.02 | 99.62 | GSLNFVSME | | | | | | | |
| PA | N/A | 526 | 0.22 | yes | 3 | 0.02 | 99.62 | VVNFVSMEF | 97.53 | VVNFLSMEF | 1.16 | VVNYVSMEF | 0.93 | | | |

FIG. 73-330

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 527 | 0.22 | yes | 3 | 0.01 | 99.62 | VNFVSMEFS | 1

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 661 | 0.31 | yes | 2 | 0 | 99.54 | SPQLEGF

FIG. 73-333

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 712 | 0.08 | yes | 1 | 0.93 | 99.32 | NASWFNSFL | 99.32 | | | | | | |
| PA | N/A | 713 | 0.65 | yes | 5 | 0.97 | 99.12 | ASWFNSFLT | 98.96 | ASWFNSFLA | 7.08 | ASWFNSFLV | 1.11 | ASWFNSFLI | 0.62 | ASWFNSFLK | 0.36 |
| PA | N/A | 714 | 0.66 | yes | 5 | 1.02 | 99.07 | SWFNSFLTH | 89.92 | SWFNSFLAH | 7.07 | SWFNSFLVH | 1.11 | SWFNSFLIH | 0.62 | SWFNSFLKH | 0.36 |
| PA | N/A | 718 | 1.92 | no | 4 | 99.97 | 100 | SSLTHALRE | 40 | SFLAHALKL | 20 | SFLVHALKS | 20 | SFLTHALRF | 20 | | |
| PA | N/A | 719 | 1.5 | no | 3 | 99.97 | 100 | SLTHALREL | 50 | FLAHALKLV | 33.33 | FLTHALRFL | 25 | | | | |
| PA | N/A | 720 | 0.92 | no | 2 | 99.98 | 100 | LTHALRELW | 66.67 | LAHALKLV | 33.33 | | | | | | |
| PA | N/A | 721 | 0.92 | no | 2 | 99.98 | 100 | THALRELWQ | 66.67 | AHALKLVA | 33.33 | | | | | | |
| PA | N/A | 722 | 0.92 | no | 2 | 99.98 | 100 | HALRELWQC | 66.67 | HALKLVAM | 33.33 | | | | | | |
| PA | N/A | 723 | 0.92 | no | 2 | 99.98 | 100 | ALRELWQCY | 66.67 | ALKLVWAM | 33.33 | |

FIG. 73-334

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 34 | 0.07 | yes | 1 | 0.11 | 99.37 | HGTGTGYTM | 99.37 | | | | | | |
| PBI | N/A | 35 | 0.07 | yes | 1 | 0.03 | 99.39 | GTGTGYTMD | 99.39 | | | | | | |
| PBI | N/A | 36 | 0.07 | yes | 1 | 0.04 | 99.39 | TGTGYTMDT | 99.39 | | | | | | |
| PBI | N/A | 37 | 0.08 | yes | 1 | 0.04 | 99.36 | GTGYTMDTV | 99.36 | | | | | | |
| PBI | N/A | 38 | 0.12 | yes | 2 | 0.04 | 99.28 | TGYTMDTVN | 98.97 | TGYTMDTYS | 0.3 | | | | |
| PBI | N/A | 39 | 0.12 | yes | 2 | 0.04 | 99.27 | GYTMDTVNR | 98.97 | GYTMDTYSR | 0.3 | | | | |
| PBI | N/A | 40 | 0.11 | yes | 2 | 0.04 | 99.29 | YTMDTVNRT | 98.99 | YTMDTYSRT | 0.3 | | | | |
| PBI | N/A | 41 | 0.1 | yes | 1 | 0.04 | 99.06 | TMDTVNRTH | 99.06 | | | | | | |
| PBI | N/A | 42 | 0.12 | yes | 2 | 0.03 | 99.24 | MDTVNRTHQ | 98.93 | MDTYSRTHQ | 0.3 | | | | |
| PBI | N/A | 43 | 0.09 | yes | 1 | 0.02 | 99.24 | DTVNRTHQY | 99.24 | | | | | | |
| PBI | N/A | 44 | 0.09 | yes | 1 | 0.02 | 99.21 | TVNRTHQYS | 99.21 | | | | | | |
| PBI | N/A | 45 | 0.11 | yes | 1 | 0.01 | 99.1 | VNRTHQYSE | 99.1 | | | | | | |
| PBI | N/A | 46 | 0.73 | yes | 2 | 0.02 | 99.29 | NRTHQYSEK | 99.29 | SRTHQYSEK | 0.3 | | | | |
| PBI | N/A | 47 | 0.7 | yes | 3 | 0.02 | 99.38 | RTHQYSERG | 83.76 | NRTHQYSER | 84.15 | | | | |
| PBI | N/A | 48 | 1.05 | yes | 4 | 0.02 | 99.13 | THQYSERGR | 84.15 | RTHQYSERG | 81.17 | THQYSERGR | 6.64 | THQYSEKGR | 6.64 |
| PBI | N/A | 49 | 1.05 | yes | 4 | 0.01 | 99.13 | HQYSERGRW | 81.17 | HQYSERGKW | 81.17 | HQYSERGKW | 6.64 | HQYSEKGRW | 6.64 |
| PBI | N/A | 60 | 0.66 | yes | 4 | 0.01 | 99.04 | NTETGAPQL | 89.63 | NTEIGAPQL | 8.55 | NTETKAPQL | 0.91 | NTETGALQL | 0.41 |
| PBI | N/A | 61 | 0.67 | yes | 5 | 0.01 | 99.03 | TETGAPQLN | 89.63 | ETGAPQLN | 8.55 | TETIKAPQLN | 0.91 | TETGALQLN | 0.4 |
| PBI | N/A | 62 | 0.27 | yes | 4 | 0.01 | 99.14 | ETGAPQLNP | 97.26 | ETKAPQLNP | 7.55 | ETGALQLNP | 0.54 | | |
| PBI | N/A | 63 | 0.29 | yes | 5 | 0.01 | 99.03 | TGAPQLNPI | 97 | TKAPQLNPI | 7.55 | TGALQLNPI | 0.54 | TGAPQLNPV | 0.27 |
| PBI | N/A | 64 | 0.22 | yes | 4 | 0.01 | 99.14 | GAPQLNPID | 97.93 | KAPQLNPID | 0.94 | GALQLNPID | 0.54 | | |
| PBI | N/A | 65 | 0.12 | yes | 4 | 0.01 | 99.14 | APQLNPIDG | 98.9 | ALQLNPIDG | 0.94 | | | | |
| PBI | N/A | 66 | 0.07 | yes | 2 | 0.01 | 99.3 | PQLNPIDGP | 98.91 | LQLNPIDGP | 0.55 | | | | |
| PBI | N/A | 67 | 0.07 | yes | 1 | 0.01 | 99.32 | QLNPIDGPL | 99.43 | | | | | | |
| PBI | N/A | 68 | 0.07 | yes | 1 | 0.01 | 99.43 | LNPIDGPLP | 99.42 | | | | | | |
| PBI | N/A | 69 | 0.36 | yes | 4 | 0.02 | 99.42 | NPIDGPLPE | 95.58 | NPIDGPLPK | 2.4 | NPIDGPLPD | 0.98 | | |
| PBI | N/A | 78 | 0.37 | yes | 5 | 0.04 | 99.28 | DNEPSGYAQ | 95.73 | DNEPTGYAQ | 1.8 | NNEPSGYAQ | 1.03 | DNEPNGYAQ | 0.24 |
| PBI | N/A | 79 | 0.27 | yes | 3 | 0.04 | 99.16 | NEPSGYAQT | 96.88 | NEPTGYAQT | 1.86 | NDPSGYAQT | 0.36 | | |
| PBI | N/A | 80 | 0.26 | yes | 3 | 0.03 | 99.1 | EPSGYAQTD | 97.05 | EPTGYAQTD | 1.85 | DPSGYAQTD | 0.36 | | |
| PBI | N/A | 81 | 0.22 | yes | 2 | 0.04 | 99.26 | PSGYAQTDC | 97.45 | PTGYAQTDC | 1.84 | | | | |
| PBI | N/A | 82 | 0.22 | yes | 2 | 0.04 | 99.29 | SGYAQTDCV | 97.46 | TGYAQTDCV | 1.84 | | | | |
| PBI | N/A | 83 | 0.22 | yes | 1 | 0.03 | 99.3 | GYAQTDCVL | 99.59 | | | | | | |
| PBI | N/A | 84 | 0.05 | yes | 1 | 0.04 | 99.59 | YAQTDCVLE | 99.58 | | | | | | |
| PBI | N/A | 85 | 0.06 | yes | 1 | 0.04 | 99.54 | AQTDCVLEA | 99.54 | | | | | | |
| PBI | N/A | 86 | 0.06 | yes | 1 | 0.04 | 99.53 | QTDCVLEAM | 99.53 | | | | | | |
| PBI | N/A | 87 | 0.06 | yes | 1 | 0.05 | 99.51 | TDCVLEAMA | 99.51 | | | | | | |
| PBI | N/A | 88 | 0.12 | yes | 1 | 0.04 | 99.3 | DCVLEAMAF | 98.97 | DCVLEAMAL | 0.33 | | | | |
| PBI | N/A | 89 | 0.1 | yes | 2 | 0.04 | 99.13 | CVLEAMAFL | 99.13 | VLEAMALLE | 0.33 | LEAMAFLEN | 0.43 | LEAMAFLED | 0.18 |
| PBI | N/A | 90 | 0.13 | yes | 2 | 0.05 | 99.21 | VLEAMAFLE | 98.88 | LEAMALLE | 2.45 | LEAMAFLEN | 0.43 | | |
| PBI | N/A | 91 | 0.37 | yes | 5 | 0.06 | 99.1 | LEAMAFLEE | 95.71 | LEAMAFLEK | 2.45 | LEAMALLEE | 0.43 | LEAMAFLED | 0.18 |
| PBI | N/A | 92 | 0.37 | yes | 5 | 0.07 | 99.12 | EAMAFLEES | 95.72 | EAMAFLEKS | 2.46 | EAMAFLENS | 0.43 | EAMALLEES | 0.43 | EAMAFLEDS | 0.18 |

FIG. 73-335

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 93 | 0.37 | yes | 5 | 0.09 | 99.09 | AMAFLEESH | 95.69 | AMAFLEKSH | 95.69 | AMAFLENSH | 2.46 | AMALLE

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 237 | 0.08 | yes | 1 | 0.08 | 99.28 | KLKRRAIAT | 99.28 | | | | | | |
| PB1 | N/A | 238 | 0.07 | yes | 1 | 0.08 | 99.32 | LKRRAIATP | 99.32 | | | | | | |
| PB1 | N/A | 239 | 0.07 | yes | 1 | 0.1 | 99.32 | KRRAIATPG | 99.32 | | | | | | |
| PB1 | N/A | 240 | 0.04 | yes | 1 | 0.1 | 99.71 | RRAIATPGM | 99.71 | | | | | | |
| PB1 | N/A | 241 | 0.04 | yes | 1 | 0.1 | 99.74 | RAIATPGMQ | 99.74 | | | | | | |
| PB1 | N/A | 242 | 0.04 | yes | 1 | 0.1 | 99.72 | AIATPGMQI | 99.72 | | | | | | |
| PB1 | N/A | 243 | 0.03 | yes | 1 | 0.15 | 99.72 | IATPGMQIR | 99.72 | | | | | | |
| PB1 | N/A | 244 | 0.06 | yes | 1 | 0.15 | 99.75 | ATPGMQIRG | 99.75 | | | | | | |
| PB1 | N/A | 245 | 0.06 | yes | 1 | 0.16 | 99.52 | TPGMQIRGF | 99.52 | | | | | | |
| PB1 | N/A | 246 | 0.13 | yes | 1 | 0.16 | 99.51 | PGMQIRGFV | 99.51 | | | | | | |
| PB1 | N/A | 247 | 0.16 | yes | 2 | 0.16 | 99.45 | GMQIRGFVY | 98.7 | GMQIRGFVH | 0.74 | | | | |
| PB1 | N/A | 248 | 0.16 | yes | 2 | 0.16 | 99.17 | MQIRGFYYF | 98.43 | MQIRGFVHF | 0.74 | | | | |
| PB1 | N/A | 249 | 0.16 | yes | 2 | 0.16 | 99.24 | QIRGFYYFV | 98.5 | QIRGFVHFV | 0.74 | | | | |
| PB1 | N/A | 250 | 0.16 | yes | 2 | 0.17 | 99.23 | IRGFYYFVE | 98.49 | IRGFVHFVE | 0.74 | | | | |
| PB1 | N/A | 251 | 0.2 | yes | 2 | 0.2 | 99.04 | RGFVYFVET | 96.81 | RGFVHFVEA | 1.38 | RGFVYFVEI | 0.58 | | |
| PB1 | N/A | 252 | 0.3 | yes | 4 | 0.14 | 99.05 | GFVYFVETL | 96.82 | GFVHFVEAL | 1.38 | GFVYFVEIL | 0.58 | | |
| PB1 | N/A | 253 | 0.3 | yes | 4 | 0.14 | 99.03 | FVYFVETLA | 96.8 | FVHFVEALA | 1.38 | FVYFVEILA | 0.58 | | |
| PB1 | N/A | 254 | 0.3 | yes | 4 | 0.15 | 99.18 | VYFVETLAR | 96.8 | VHFVEALAR | 1.33 | VYFVEILAR | 0.58 | VYFVETLAK | 0.19 |
| PB1 | N/A | 257 | 0.43 | yes | 5 | 0.11 | 99.01 | VETLARSIC | 94.94 | VETLARRIC | 1.93 | VETLARCIC | 0.98 | VETLARNIC | 0.48 |
| PB1 | N/A | 260 | 0.27 | yes | 4 | 0.11 | 99.24 | LARSICEKL | 97.09 | LARCICEKL | 0.98 | LARNICEKL | 0.68 | | |
| PB1 | N/A | 261 | 0.27 | yes | 4 | 0.12 | 99.22 | ARSICEKLE | 97.07 | ARCICEKLE | 0.98 | ARNICEKLE | 0.68 | | |
| PB1 | N/A | 262 | 0.26 | yes | 4 | 0.11 | 99.41 | RSICEKLEQ | 97.26 | RCICEKLEQ | 0.98 | RNICEKLEQ | 0.68 | | |
| PB1 | N/A | 263 | 0.05 | yes | 1 | 0.12 | 99.61 | SICEKLEQS | 99.61 | CICEKLEQS | 0.98 | NICEKLEQS | 0.68 | | |
| PB1 | N/A | 264 | 0.05 | yes | 1 | 0.11 | 99.64 | ICEKLEQSG | 99.64 | | | | | | |
| PB1 | N/A | 265 | 0.05 | yes | 1 | 0.12 | 99.68 | CEKLEQSGL | 99.68 | | | | | | |
| PB1 | N/A | 266 | 0.04 | yes | 1 | 0.12 | 99.7 | EKLEQSGLP | 99.7 | | | | | | |
| PB1 | N/A | 267 | 0.04 | yes | 1 | 0.13 | 99.7 | KLEQSGLPV | 99.7 | | | | | | |
| PB1 | N/A | 268 | 0.04 | yes | 1 | 0.16 | 99.72 | LEQSGLPVG | 99.72 | | | | | | |
| PB1 | N/A | 269 | 0.04 | yes | 1 | 0.17 | 99.76 | EQSGLPVGG | 99.76 | | | | | | |
| PB1 | N/A | 270 | 0.04 | yes | 1 | 0.18 | 99.76 | QSGLPVGGN | 99.76 | | | | | | |
| PB1 | N/A | 271 | 0.03 | yes | 1 | 0.18 | 99.76 | SGLPVGGNE | 99.76 | | | | | | |
| PB1 | N/A | 272 | 0.03 | yes | 1 | 0.18 | 99.76 | GLPVGGNEK | 99.76 | | | | | | |
| PB1 | N/A | 273 | 0.03 | yes | 1 | 0.16 | 99.76 | LPVGGNEKR | 99.76 | | | | | | |
| PB1 | N/A | 274 | 0.03 | yes | 1 | 0.15 | 99.76 | PVGGNEKKA | 99.76 | | | | | | |
| PB1 | N/A | 275 | 0.03 | yes | 1 | 0.13 | 99.89 | VGGNEKKAK | 99.89 | | | | | | |
| PB1 | N/A | 276 | 0.02 | yes | 1 | 0.13 | 99.89 | GGNEKKAKL | 99.89 | | | | | | |
| PB1 | N/A | 277 | 0.02 | yes | 1 | 0.13 | 99.89 | GNEKKAKLA | 99.89 | | | | | | |
| PB1 | N/A | 278 | 0.02 | yes | 1 | 0.13 | 99.89 | NEKKAKLAN | 99.89 | | | | | | |
| PB1 | N/A | 279 | 0.04 | yes | 1 | 0.13 | 99.72 | EKKAKLANV | 99.72 | | | | | | |
| PB1 | N/A | 280 | 0.04 | yes | 1 | 0.13 | 99.72 | KKAKLANVV | 99.72 | | | | | | |
| PB1 | N/A | 281 | 0.05 | yes | 1 | 0.12 | 99.64 | KAKLANVVR | 99.64 | | | | | | |

FIG. 73-338

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 282 | 0.04 | yes | 1 | 0.12 | 99.65 | AKLANVRK | 99.65 | | | | | | |
| PB1 | N/A | 283 | 0.05 | yes | 1 | 0.12 | 99.64 | KLANVRKM | 99.64 | | | | | | |
| PB1 | N/A | 284 | 0.05 | yes | 1 | 0.12 | 99.61 | LANVRKMM | 99.61 | | | | | | |
| PB1 | N/A | 285 | 0.07 | yes | 1 | 0.13 | 99.39 | ANVRKMMT | 99.39 | | | | | | |
| PB1 | N/A | 286 | 0.12 | yes | 2 | 0.14 | 99.36 | NVRKMMTN | 99.36 | NVRKMMTS | 0.38 | | | | | |
| PB1 | N/A | 287 | 0.12 | yes | 2 | 0.14 | 99.36 | VRKMMTNS | 98.98 | VVRKMMTSS | 0.38 | | | | | |
| PB1 | N/A | 288 | 0.16 | yes | 3 | 0.16 | 99.11 | VRKMMTNS | 98.98 | VRKMMTSSQ | 0.38 | VRKMMTNSH | 0.14 | | | | |
| PB1 | N/A | 289 | 0.13 | yes | 2 | 0.13 | 99.1 | RKMMTNSQ | 98.72 | RKMMTSSQD | 0.38 | | | | | |
| PB1 | N/A | 290 | 0.14 | yes | 2 | 0.13 | 99.09 | KMMTNSQD | 98.72 | KMMTSSQDT | 0.38 | | | | | |
| PB1 | N/A | 291 | 0.15 | yes | 2 | 0.13 | 99.01 | MMTNSQDT | 98.63 | MMTSSQDTE | 0.38 | | | | | |
| PB1 | N/A | 293 | 0.16 | yes | 5 | 0.13 | 99.02 | TNSQDTEI | 67.23 | TSSQDTEIS | 31.2 | TSSQDTELS | 0.22 | TNSQDTEVS | 0.22 | | |
| PB1 | N/A | 294 | 1.07 | yes | 4 | 0.13 | 99.04 | NSQDTEIS | 67.31 | SSQDTEISF | 31.3 | SSQDTELSF | 0.22 | NSQDTEVSF | 0.22 | TSSQDTEIS | 0.16 |
| PB1 | N/A | 295 | 1.05 | yes | 4 | 0.13 | 99.02 | SQDTEISF | 67.55 | SQDTELSF | 31.47 | QDTELSFTV | 0.55 | QDTEVSFTI | 0.21 | | |
| PB1 | N/A | 296 | 1.01 | yes | 4 | 0.14 | 99.18 | QDTEISFT | 67 | QDTELSFT | 31.41 | DTELSFTVT | 0.55 | | | |
| PB1 | N/A | 297 | 1.06 | yes | 3 | 0.14 | 99.37 | DTEISFTI | 67.37 | DTELSFTI | 31.41 | TELSFTVTG | 0.55 | | | |
| PB1 | N/A | 298 | 1.02 | yes | 3 | 0.15 | 99.39 | TEISFTIT | 67.39 | TELSFTITG | 31.46 | ELSFTVTGD | 0.55 | | | |
| PB1 | N/A | 299 | 1.01 | yes | 3 | 0.15 | 99.41 | EISFTITG | 67.49 | ELSFTITG | 31.46 | LSFTVTGDN | 0.55 | | | |
| PB1 | N/A | 300 | — | — | — | 0.15 | 99.5 | ISFTITGD | 67.54 | LSFTITGDN | 31.45 | | | | | |
| PB1 | N/A | 301 | — | — | — | 0.16 | 99.54 | SFTITGDNT | 99.22 | | | | | | | |
| PB1 | N/A | 302 | 0.08 | yes | 1 | 0.16 | 99.22 | FTITGDNTK | 99.22 | | | | | | | |
| PB1 | N/A | 303 | 0.08 | yes | 1 | 0.16 | 99.22 | TITGDNTKW | 99.22 | | | | | | | |
| PB1 | N/A | 304 | 0.08 | yes | 1 | 0.15 | 99.21 | ITGDNTKWN | 99.21 | | | | | | | |
| PB1 | N/A | 305 | 0.03 | yes | 1 | 0.14 | 99.82 | TGDNTKWNE | 99.82 | | | | | | | |
| PB1 | N/A | 306 | 0.02 | yes | 1 | 0.14 | 99.83 | GDNTKWNEN | 99.84 | | | | | | | |
| PB1 | N/A | 307 | 0.02 | yes | 1 | 0.14 | 99.83 | DNTKWNENQ | 99.84 | | | | | | | |
| PB1 | N/A | 308 | 0.06 | yes | 1 | 0.14 | 99.43 | NTKWNENQN | 99.43 | | | | | | | |
| PB1 | N/A | 309 | 0.06 | yes | 1 | 0.14 | 99.44 | TKWNENQNP | 99.44 | | | | | | | |
| PB1 | N/A | 310 | 0.06 | yes | 1 | 0.13 | 99.42 | KWNENQNPR | 99.43 | | | | | | | |
| PB1 | N/A | 311 | 0.38 | no | 3 | 99.99 | 99.19 | WNENQNPRM | 94.95 | WNENQNPRV | 2.31 | | | | | |
| PB1 | N/A | 312 | 0.38 | no | 3 | 99.99 | 99.2 | NENQNPRMF | 94.96 | NENQNPRF | 2.3 | | | | | |
| PB1 | N/A | 313 | 0.39 | yes | 1 | 0.13 | 99.13 | ENQNPRMF | 94.9 | ENQNPRIF | 2.3 | | | | | |
| PB1 | N/A | 314 | 0 | yes | — | 99.99 | 100 | NQNPRMFL | 100 | | | | | | | |
| PB1 | N/A | 315 | — | yes | — | 99.99 | 100 | QNPRMFL | 100 | | | | | | | |
| PB1 | N/A | 316 | 0.42 | yes | 4 | 0.13 | 99.01 | NPRMFLA | 94.88 | NQNPRIFLA | 1.83 | NQNPRVFLA | 1.41 | NQNPRVFLT | 0.9 | | |
| PB1 | N/A | 317 | 0.42 | yes | 5 | 0.14 | 99.41 | QNPRMFLAM | 94.87 | QNPRIFLAM | 1.83 | QNPRVFLAM | 1.41 | QNPRVFLTM | 0.89 | QSPRMFLAM | 0.41 |
| PB1 | N/A | 318 | 0.44 | yes | 5 | 0.14 | 99.11 | NPRMFLAMI | 94.67 | NPRIFLAMI | 1.83 | NPRVFLAMI | 1.4 | NPRVFLTMI | 0.89 | SPRMFLAMI | 0.41 |
| PB1 | N/A | 319 | 0.42 | yes | 5 | 0.14 | 99.2 | PRMFLAMIT | 94.99 | PRIFLAMIT | 1.84 | PRVFLAMIT | 1.4 | PRVFLTMIT | 0.89 | | |
| PB1 | N/A | 320 | 0.42 | yes | 4 | 0.13 | 99.41 | RMFLAMITY | 95.01 | RIFLAMITY | 1.79 | RVFLAMITY | 1.4 | RVFLTMITY | 0.89 | | |
| PB1 | N/A | 321 | 0.44 | yes | 4 | 0.13 | 99.11 | MFLAMITYI | 94.78 | IFLAMITYI | 1.78 | VFLAMITYI | 1.41 | VFLTMITYI | 0.89 | TFLAMITYI | 0.24 |
| PB1 | N/A | 322 | 0.17 | yes | 2 | 0.13 | 99.2 | FLAMITYIT | 98.2 | FLTMITYIT | 1.01 | | | | | |
| PB1 | N/A | 323 | 0.98 | yes | 3 | 0.14 | 99.13 | LAMITYITR | 73.36 | LTMITYITR | 24.8 | LTMITYITR | 0.97 | | | | |

FIG. 73-339

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 333 | 1.17 | yes | 4 | 0.18 | 99.07 | QPEWFRNIL | 49.96 | QPEWFRNVL | 48.25 | QPGWFRNVL | 0.49 | QPKWFRNVL | 0.37 | | |
| PB1 | N/A | 334 | 1.18 | yes | 4 | 0.19 | 99.2 | PEWFRNILS | 49.98 | PEWFRNVLS | 48.08 | PGWFRNVLS | 0.49 | PKWFRNVLS | 0.38 | PDWFRNVLS | 0.26 |
| PB1 | N/A | 335 | 1.72 | yes | 4 | 0.2 | 99.03 | WFRNVLSIA | 47.24 | WFRNILSIA | 25.02 | WFRNVLSVA | 1.94 | | | | |
| PB1 | N/A | 336 | 1.72 | yes | 4 | 0.21 | 99.02 | FRNVLSIAP | 47.22 | FRNILSIAP | 25.02 | FRNVLSVAP | 1.94 | | | | |
| PB1 | N/A | 337 | 1.73 | yes | 5 | 0.21 | 99.17 | RNVLSIAPI | 47.18 | RNILSIAPI | 25 | RNVLSVAPI | 1.93 | | | RNALSIAPI | 0.2 |
| PB1 | N/A | 338 | 1.73 | yes | 5 | 0.2 | 99.18 | NVLSIAPIM | 47.18 | NILSIAPIM | 25 | NVLSVAPIM | 1.93 | | | NALSIAPIM | 0.2 |
| PB1 | N/A | 339 | 1.73 | yes | 5 | 0.2 | 99.16 | VLSIAPIMF | 47.17 | ILSIAPIMF | 24.99 | VLSVAPIMF | 1.93 | | | ALSIAPIMF | 0.2 |
| PB1 | N/A | 340 | 1.03 | yes | 3 | 0.18 | 99.38 | LSIAPIMFS | 72.23 | LSVAPIMFS | 25.05 | | | | | | |
| PB1 | N/A | 341 | 1.03 | yes | 3 | 0.16 | 99.37 | SIAPIMFSN | 72.2 | SVAPIMFSN | 25.06 | | | | | | |
| PB1 | N/A | 342 | 1 | yes | 3 | 0.16 | 99.61 | IAPIMFSNK | 72.47 | VAPIMFSNK | 25.05 | | | | | | |
| PB1 | N/A | 343 | 0.09 | yes | 1 | 0.16 | 99.24 | APIMFSNKM | 99.24 | | | | | | | | |
| PB1 | N/A | 344 | — | yes | 1 | 0.15 | 99.02 | PIMFSNKMA | 99.02 | | | | | | | | |
| PB1 | N/A | 345 | 0.11 | yes | 2 | 0.16 | 99.02 | IMFSNKMAR | 98.7 | IMFSNKVAR | 0.32 | | | | | | |
| PB1 | N/A | 346 | 0.14 | yes | 2 | 0.16 | 99.14 | MFSNKMARL | 98.82 | MFSNKVARL | 0.32 | | | | | | |
| PB1 | N/A | 347 | 0.13 | yes | 2 | 0.16 | 99.16 | FSNKMARLG | 98.84 | FSNKVARLG | 0.32 | | | | | | |
| PB1 | N/A | 348 | 0.13 | yes | 2 | 0.16 | 99.18 | SNKMARLGK | 94.59 | SNKVARLGK | 4.27 | | | | | | |
| PB1 | N/A | 349 | 0.38 | yes | 3 | 0.2 | 99.2 | NKMARLGKG | 94.6 | NKVARLGKG | 4.27 | | | | | | |
| PB1 | N/A | 350 | 0.38 | yes | 3 | 0.22 | 99.26 | KMARLGKGY | 94.66 | KVARLGKGY | 4.27 | | | | | | |
| PB1 | N/A | 351 | 0.37 | yes | 2 | 0.2 | 99.24 | MARLGKGYM | 94.66 | VARLGKGYM | 4.27 | | | | | | |
| PB1 | N/A | 352 | 0.37 | yes | 2 | 0.2 | 99.3 | ARLGKGYMF | 95.03 | | | | | | | | |
| PB1 | N/A | 353 | 0.33 | yes | 2 | 0.2 | 99.39 | RLGKGYMFE | 95.12 | | | | | | | | |
| PB1 | N/A | 354 | 0.32 | yes | 2 | 0.2 | 99.74 | LGKGYMFES | 95.16 | | | | | | | | |
| PB1 | N/A | 355 | 0.29 | yes | 2 | 0.16 | 99.41 | GKGYMFESK | 95.16 | GRGYMFESK | 4.25 | | | | | | |
| PB1 | N/A | 356 | 1.27 | yes | 4 | 0.16 | 99.03 | GYMFESKSM | 54.39 | GYMFESKRM | 41.89 | | | GYMFESKKM | 2.16 | | |
| PB1 | N/A | 358 | 0 | — | 1 | 99.99 | 100 | KIEIEKIR | 100 | | | | | | | | |
| PB1 | N/A | 392 | — | — | 1 | 99.99 | 100 | IEKIEKIRP | 100 | | | | | | | | |
| PB1 | N/A | 393 | 0 | no | 1 | 99.99 | 100 | EKIEKIRPL | 100 | | | | | | | | |
| PB1 | N/A | 394 | 0.37 | no | 4 | 0.16 | 99.41 | GTASLSPGM | 95.07 | GAASLSPGM | 3.18 | GTAALSPGM | 0.73 | GTVSLSPGM | 0.43 | | |
| PB1 | N/A | 406 | 0.34 | no | 3 | 0.14 | 99.35 | TASLSPGMM | 95.44 | AASLSPGMM | 3.18 | | | TVSLSPGMM | 0.73 | | |
| PB1 | N/A | 407 | 0.13 | yes | 2 | 0.14 | 99.42 | ASLSPGMMM | 98.68 | VSLSPGMMM | 0.74 | | | | | | |
| PB1 | N/A | 408 | 0.06 | yes | 1 | 0.13 | 99.43 | SLSPGMMMG | 99.43 | | | | | | | | |
| PB1 | N/A | 409 | 0.02 | yes | 1 | 0.13 | 99.84 | LSPGMMMGM | 99.84 | | | | | | | | |
| PB1 | N/A | 410 | 0.03 | yes | 1 | 0.13 | 99.83 | SPGMMMGMF | 99.83 | | | | | | | | |
| PB1 | N/A | 411 | 0.02 | yes | 1 | 0.12 | 99.78 | PGMMMGMFN | 99.78 | | | | | | | | |
| PB1 | N/A | 412 | 0.03 | yes | 1 | 0.11 | 99.76 | GMMMGMFNM | 99.76 | | | | | | | | |
| PB1 | N/A | 413 | 0.03 | yes | 1 | 0.14 | 99.77 | MMMGMFNML | 99.77 | | | | | | | | |
| PB1 | N/A | 414 | 0.03 | yes | 1 | 0.14 | 99.8 | MMGMFNMLS | 99.8 | | | | | | | | |
| PB1 | N/A | 415 | 0.03 | yes | 1 | 0.15 | 99.78 | MGMFNMLST | 99.78 | | | | | | | | |
| PB1 | N/A | 416 | 0.03 | yes | 1 | 0.14 | 99.77 | GMFNMLSTV | 99.77 | | | | | | | | |
| PB1 | N/A | 417 | 0.03 | yes | 1 | 0.14 | 99.8 | MFNMLSTVL | 99.8 | | | | | | | | |
| PB1 | N/A | 418 | 0.03 | yes | 1 | 0.14 | 99.8 | FNMLSTVLG | 99.8 | | | | | | | | |

FIG. 73-340

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 420 | 0.03 | yes | 1 | 0.14 | 99.79 | NMLSTVLGV | 99.79 | | | | | | |
| PB1 | N/A | 421 | 0.05 | yes | 1 | 0.14 | 99.61 | MLSTVLGVS | 99.61 | | | | | | |
| PB1 | N/A | 422 | 0.1 | yes | 1 | 0.13 | 99.03 | LSTVLGVSI | 99.03 | | | | | | |
| PB1 | N/A | 423 | 0.1 | yes | 1 | 0.1 | 99.01 | STVLGVSIL | 99.01 | | | | | | |
| PB1 | N/A | 424 | 0.11 | yes | 1 | 0.1 | 99 | TVLGVSILN | 99 | | | | | | |
| PB1 | N/A | 425 | 0.12 | yes | 2 | 0.11 | 99.49 | VLGVSILNL | 98.91 | VLGVSVLNL | 0.58 | | | | |
| PB1 | N/A | 426 | 0.12 | yes | 2 | 0.12 | 99.53 | LGVSILNLG | 98.95 | LGVSVLNLG | 0.58 | | | | |
| PB1 | N/A | 427 | 0.12 | yes | 2 | 0.11 | 99.44 | GVSILNLGQ | 98.86 | GVSVLNLGQ | 0.58 | | | | |
| PB1 | N/A | 428 | 0.23 | yes | 3 | 0.14 | 99.37 | VSILNLGQK | 97.56 | VSILNLGQK | 1.24 | VSVLNLGQK | 0.57 | | | |
| PB1 | N/A | 431 | 1.29 | yes | 5 | 0.12 | 99.13 | LNLGQKYT | 48.95 | LNLGQKYT | 47.37 | LNLGQKYT | 1.61 | LNLGQKRHT | 0.22 | |
| PB1 | N/A | 441 | 1.01 | yes | 5 | 0.13 | 99.64 | TYWWDGLQ | 75.04 | TYWWDGLQ | 21.99 | TYWWDGLQ | 0.91 | TAYWWDGLQ | 0.82 |
| PB1 | N/A | 442 | 1.01 | yes | 5 | 0.16 | 99.67 | YWWDGLQS | 75.07 | YWWDGLQS | 22 | SYWWDGLQS | 0.91 | AYWWDGLQS | 0.83 |
| PB1 | N/A | 443 | 0.03 | yes | 1 | 0.16 | 99.78 | WWDGLQSS | 99.78 | | | | | | |
| PB1 | N/A | 444 | 0.02 | yes | 1 | 0.16 | 99.83 | WDGLQSSD | 99.83 | | | | | | |
| PB1 | N/A | 445 | 0.02 | yes | 1 | 0.15 | 99.84 | DGLQSSDD | 99.84 | | | | | | |
| PB1 | N/A | 446 | 0.03 | yes | 1 | 0.16 | 99.79 | GLQSSDDF | 99.79 | | | | | | |
| PB1 | N/A | 447 | 0.03 | yes | 1 | 0.15 | 99.78 | LQSSDDFA | 99.78 | | | | | | |
| PB1 | N/A | 448 | 0.03 | yes | 1 | 0.15 | 99.77 | QSSDDFAL | 99.77 | | | | | | |
| PB1 | N/A | 449 | 0.11 | yes | 2 | 0.15 | 99.57 | SSDDFALI | 98.99 | SSDDFALIL | 0.58 | | | | |
| PB1 | N/A | 450 | 0.11 | yes | 2 | 0.15 | 99.57 | SDDFALIV | 98.99 | SDDFALILN | 0.58 | | | | |
| PB1 | N/A | 451 | 0.11 | yes | 2 | 0.15 | 99.53 | DDFALIVN | 98.95 | DDFALILNA | 0.58 | | | | |
| PB1 | N/A | 452 | 0.09 | yes | 2 | 0.09 | 99.33 | DFALIVNA | 97.22 | DFALIVNAS | 0.94 | DFALILNAP | 0.58 | | | |
| PB1 | N/A | 453 | 0.17 | yes | 4 | 0.17 | 99.24 | DFALIVNAP | 97.81 | GIQAGVNRF | 1.16 | | | | |
| PB1 | N/A | 465 | 0.16 | yes | 3 | 0.16 | 99.06 | GIQAGVNRF | 97.9 | IQAGVNRFY | 1.16 | | | | |
| PB1 | N/A | 466 | 0.16 | yes | 2 | 0.16 | 99.29 | IQAGVNRFY | 98.13 | QAGVNRFYR | 1.16 | | | | |
| PB1 | N/A | 467 | 0.26 | yes | 3 | 0.16 | 99.13 | QAGVNRFYR | 94.56 | AGVNRFYRT | 3.45 | AGVNRFYRT | 1.12 | | | |
| PB1 | N/A | 468 | 0.21 | yes | 3 | 0.09 | 99.2 | AGVDRFYRT | 94.63 | GVNRFYRTC | 3.45 | GVNRFYRTC | 1.12 | | | |
| PB1 | N/A | 469 | 0.2 | yes | 3 | 0.09 | 99.19 | GVDRFYRTC | 94.62 | VNRFYRTCK | 3.45 | VNRFYRTCK | 1.12 | | | |
| PB1 | N/A | 470 | 0.18 | yes | 3 | 0.1 | 99.34 | VDRFYRTCK | 94.76 | NRFYRTCKL | 3.45 | NRFYRTCKL | 1.12 | | | |
| PB1 | N/A | 471 | 0.41 | yes | 3 | 0.1 | 99.08 | DRFYRTCKL | 85.97 | RFYRTCKLL | 9.68 | RFYRICKLV | 3.43 | | | |
| PB1 | N/A | 472 | 0.4 | yes | 3 | 0.12 | 99.32 | RFYRTCKLV | 86.17 | FYRTCKLLG | 9.7 | FYRICKLVG | 3.45 | | | |
| PB1 | N/A | 473 | 0.39 | yes | 3 | 0.12 | 99.33 | FYRTCKLVG | 86.18 | YRTCKLLGI | 9.7 | YRICKLVGI | 3.45 | | | |
| PB1 | N/A | 474 | 0.78 | yes | 3 | 0.12 | 99.3 | YRTCKLLGI | 86.15 | RTCKLLGIN | 9.7 | RICKLVGIN | 3.45 | | | |
| PB1 | N/A | 475 | 0.75 | yes | 3 | 0.12 | 99.32 | RTCKLVGI | 86.18 | TCKLLGINM | 9.69 | ICKLVGINM | 3.45 | | | |
| PB1 | N/A | 476 | 0.76 | yes | 3 | 0.11 | 99.49 | TCKLVGINM | 89.74 | CKLLGINMS | 9.74 | | | | |
| PB1 | N/A | 477 | 0.75 | yes | 3 | 0.11 | 99.48 | CKLVGINMS | 89.74 | KLLGINMSK | 9.74 | | | | |
| PB1 | N/A | 478 | 0.53 | yes | 3 | 0.11 | 99.4 | KLVGINMSK | 89.23 | LLGINMSKK | 9.65 | LVGINMSKR | 0.52 | | | |
| PB1 | N/A | 479 | 0.58 | yes | 3 | 0.11 | 99.4 | LVGINMSKK | 89.24 | LGINMSKKK | 9.64 | VGINMSKRK | 0.52 | | | |
| PB1 | N/A | 480 | 0.58 | yes | 2 | 0.09 | 99.11 | VGINMSKKK | 89.11 | GINMSKKKS | 9.65 | | | | |
| PB1 | N/A | 481 | 0.09 | yes | 1 | 0.09 | 99.11 | GINMSKKKS | 99.11 | | | | | | |
| PB1 | N/A | 482 | 0.09 | yes | 1 | 0.09 | 99.09 | INMSKKKSY | 99.09 | | | | | | |

FIG. 73-341

| Protein | Sub-type | Start Pos | Block Entropy | Gaps > 10% | # to cover 99% | Gap % | Coverage | Peptides included | Freq | Peptides included | Freq |
|---|---|---|---|---|---|---|---|---|---|---|---|
| PB1 | N/A | 483 | 0.11 | yes | 2 | 0.09 | 99.59 | NMSKKKSYI | 98.97 | NMSKRKSYI | 0.63 |
| PB1 | N/A | 484 | 0.11 | yes | 2 | 0.09 | 99.62 | MSKKKSYIN | 98.99 | MSKRKSYIN

FIG. 73-343

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 565 | 0.22 | yes | 3 | 0.11 | 99.14 | TYRCHRGDT | 97.78 | TYRCHRGDM | 0.88 | YRCHRGDT

| Protein | Sub-type | Start Pos | Block Entropy | Gaps > 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| PB2 | N/A | 43 | 0 | no | 2 | 99.99 |

FIG. 73-349

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 148 | 0.24 | yes | 3 | 0.02 | 99.14 | RNQKIRRR | 97.55 | RNQIKIRRR | 0.95 | | | | |
| PB2 | N/A | 149 | 0.18 | yes | 2 | 0.02 | 99.16 | NQVKIRRV | 98.21 | NQIKIRRV | 0.94 | | | | |
| PB2 | N/A | 150 | 0.16 | yes | 5 | 0.02 | 99.42 | QVKIRRVD | 98.47 | QIKIRRVD | 0.95 | | | | |
| PB2 | N/A | 151 | 1.25 | yes | 4 | 0.02 | 99.29 | VKIRRVDI | 64.18 | VKIRRRVD | 31.26 | VKIRRRVDI | 2.29 | | |
| PB2 | N/A | 152 | 1.2 | yes | 4 | 0.02 | 99.24 | KIRRVDIN | 64.78 | KIRRRVDV | 31.36 | KIRRRVDMN | 2.32 | VKIRRRVDM | 0.77 |
| PB2 | N/A | 153 | 1.2 | yes | 4 | 0.03 | 99.25 | IRRVDINP | 64.8 | IRRRVDVN | 31.36 | IRRRVDVNP | 2.31 | | |
| PB2 | N/A | 154 | 1.19 | yes | 4 | 0.03 | 99.34 | RRVDINPG | 64.88 | RRRVDVNP | 31.38 | RRVDVNPG | 2.31 | | |
| PB2 | N/A | 155 | 1.19 | yes | 4 | 0.03 | 99.35 | RVDINPGH | 64.89 | RVDVNPGH | 31.37 | RVDVNPGH | 2.31 | | |
| PB2 | N/A | 156 | 1.23 | yes | 5 | 0.04 | 99.11 | RVDINPGHA | 64.5 | RVDVNPGHA | 31.31 | RVDVNPGHA | 2.29 | RVDINPGHS | 0.23 |
| PB2 | N/A | 157 | 1.23 | yes | 4 | 0.04 | 99.14 | VDINPGHAD | 64.51 | VDVNPGHAD | 31.34 | VDMNPGHAD | 2.29 | VDINPGHSD | 0.23 |
| PB2 | N/A | 169 | 0.29 | yes | 2 | 0.03 | 99.23 | AKEAQDVIM | 96.84 | SKEAQDVIM | 1.97 | VKEAQDVIM | 0.16 | | |
| PB2 | N/A | 170 | 0.1 | yes | 1 | 0.03 | 99.24 | KEAQDVIME | 99.23 | TKEAQDVIM | | | | | |
| PB2 | N/A | 171 | 0.1 | yes | 1 | 0.03 | 99.21 | EAQDVIMEV | 99.24 | | | | | | |
| PB2 | N/A | 172 | 0.1 | yes | 1 | 0.03 | 99.04 | AQDVIMEW | 99.21 | | | | | | |
| PB2 | N/A | 173 | 0.12 | yes | 1 | 0.03 | 99.04 | QDVIMEWF | 99.04 | | | | | | |
| PB2 | N/A | 174 | 0.11 | yes | 1 | 0.03 | 99.1 | DVIMEWFP | 99.04 | | | | | | |
| PB2 | N/A | 175 | 0.09 | yes | 1 | 0.03 | 99.13 | VIMEWFPN | 99.1 | | | | | | |
| PB2 | N/A | 176 | 0.09 | yes | 1 | 0.03 | 99.13 | IMEWFPNE | 99.13 | | | | | | |
| PB2 | N/A | 177 | 0.09 | yes | 1 | 0.03 | 99.29 | MEWFPNEV | 99.13 | | | | | | |
| PB2 | N/A | 178 | 0.09 | yes | 1 | 0.04 | 99.27 | EWFPNEVG | 99.29 | | | | | | |
| PB2 | N/A | 179 | 0.1 | yes | 1 | 0.05 | 99.28 | WFPNEVGA | 99.27 | | | | | | |
| PB2 | N/A | 180 | 0.15 | yes | 2 | 0.05 | 99.29 | FPNEVGAR | 98.45 | VFPNEVGAK | 0.97 | | | | |
| PB2 | N/A | 181 | 0.19 | yes | 2 | 0.04 | 99.42 | PNEVGARI | 98.21 | FPNEVGAKI | 0.98 | | | | |
| PB2 | N/A | 182 | 0.21 | yes | 3 | 0.04 | 99.19 | NEVGARIL | 98.12 | PNEVGAKIL | 0.98 | NEVGARIIT | 0.2 | | |
| PB2 | N/A | 183 | 0.22 | yes | 4 | 0.06 | 99.1 | EVGARILT | 97.94 | NEVGAKILT | 0.99 | EVGARIITS | 0.2 | | |
| PB2 | N/A | 184 | 0.23 | yes | 4 | 0.04 | 99.12 | VGARILTS | 97.89 | EVGAKILTS | 0.99 | VGARIITSE | 0.2 | | |
| PB2 | N/A | 185 | 0.23 | yes | 4 | 0.04 | 99.07 | GARILTSE | 97.81 | VGAKILTSE | 0.99 | GARIITSES | 0.2 | | |
| PB2 | N/A | 186 | 0.27 | yes | 5 | 0.06 | 99.15 | ARILTSES | 97.78 | GAKILTSES | 0.99 | ARIITSESQ | 0.2 | VGARILASE | 0.16 |
| PB2 | N/A | 187 | 0.99 | yes | 3 | 0.05 | 99.13 | RILTSESQ | 97.75 | AKILTSESQ | 0.99 | RIITSESQM | 0.37 | GARILASES | 0.16 |
| PB2 | N/A | 188 | 0.98 | yes | 3 | 0.06 | 99.12 | ILTSESQL | 97.36 | KILTSESQL | 1.02 | IITSESQM | 0.23 | ARILASESQ | 0.16 |
| PB2 | N/A | 211 | 0.11 | yes | 3 | 0.05 | 99.1 | IAPLMVAYM | 70.32 | ISPLMVAYM | 28.56 | IAPLMMAYM | 1.02 | RILASESQL | 0.2 |
| PB2 | N/A | 212 | 0.11 | yes | 3 | 0.05 | 99.07 | APLMVAYML | 70.41 | SPLMVAYML | 28.56 | APLMMAYML | 0.23 | | |
| PB2 | N/A | 213 | 0.11 | yes | 1 | 0.06 | 99.07 | PLMVAYMLE | 99.1 | | | | | | |
| PB2 | N/A | 214 | 0.1 | yes | 1 | 0.06 | 99.18 | LMVAYMLER | 99.07 | | | | | | |
| PB2 | N/A | 215 | 0.07 | yes | 1 | 0.06 | 99.48 | MVAYMLERE | 99.07 | | | | | | |
| PB2 | N/A | 216 | 0.07 | yes | 1 | 0.06 | 99.48 | VAYMLEREL | 99.18 | | | | | | |
| PB2 | N/A | 217 | 0.08 | yes | 1 | 0.07 | 99.36 | AYMLERELV | 99.48 | | | | | | |
| PB2 | N/A | 218 | 0.08 | yes | 1 | 0.07 | 99.34 | YMLERELVR | 99.48 | | | | | | |
| PB2 | N/A | 219 | 0.09 | yes | 1 | 0.08 | 99.36 | MLERELVRK | 99.36 | | | | | | |
| PB2 | N/A | 220 | 0.09 | yes | 1 | 0.08 | 99.34 | LERELVRKT | 99.34 | | | | | | |
| PB2 | N/A | 221 | 0.09 | yes | 1 | 0.07 | 99.32 | ERELVRKTR | 99.32 | | | | | | |

FIG. 73-350

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 222 | 0.09 | yes | 1 | 0.06 | 99.33 | RELVRKTRF | 99

FIG. 73-351

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 271 | 0.29 | yes | 3 | 0.12 | 99.5 | SLIIARNI | 96.39 | SLIIAARSI | 2.19 | SLIIAARNI | 0.92 | | |
| PB2 | N/A | 272 | 0.3 | yes | 3 | 0.11 | 99.4 | LIIARNIV | 96.29 | LIIAARSIV | 2.18 | LIIAARNIV | 0.92 | | |
| PB2 | N/A | 273 | 0.3 | yes | 2 | 0.11 | 99.38 | IIARNIVR | 96.27 | IIAARSIVR | 2.19 | VIAARNIVR | 0.92 | | |
| PB2 | N/A | 274 | 0.23 | yes | 2 | 0.11 | 99.38 | IARNIVRR | 97.19 | IAARSIVRR | 2.19 | | | | |
| PB2 | N/A | 275 | 1.25 | yes | 4 | 0.12 | 99.53 | AARNIVRRA | 97.34 | AARSIVRRA | 2.19 | | | | |
| PB2 | N/A | 276 | 1.25 | yes | 4 | 0.11 | 99.37 | ARNIVRRAA | 44.61 | ARSIVRRAT | 44.54 | ARNIVRRAI | 2.16 | | |
| PB2 | N/A | 277 | 1.25 | yes | 3 | 0.12 | 99.32 | RNIVRRAAV | 44.54 | RSIVRRATV | 44.56 | RNIVRRAIV | 2.16 | | |
| PB2 | N/A | 278 | 1.15 | yes | 3 | 0.12 | 99.33 | NIVRRAAYS | 44.56 | SIVRRATVS | 46.52 | NIVRRAIVS | 2.16 | | |
| PB2 | N/A | 279 | 1.15 | yes | 3 | 0.12 | 99.06 | IVRRAAVSA | 46.52 | IVRRATYS | 46.55 | | | | |
| PB2 | N/A | 280 | 1.14 | yes | 3 | 0.12 | 99.09 | VRRAAVSAD | 46.55 | VRRATYSAD | 51.89 | | | | |
| PB2 | N/A | 281 | 1.21 | yes | 5 | 0.12 | 99.06 | RRAAVSADP | 46.56 | RRATYSADP | 51.89 | | | | |
| PB2 | N/A | 282 | 1.2 | yes | 5 | 0.12 | 99.19 | RAAVSADPL | 46.57 | RATYSADPL | 51.98 | | | | |
| PB2 | N/A | 283 | 0.15 | yes | 2 | 0.12 | 99.2 | AAVSADPLA | 45.85 | ATYSADPLA | 45.86 | ATYSADPLL | 0.64 | ATYSADPLV | 0.26 |
| PB2 | N/A | 284 | 0.15 | yes | 2 | 0.13 | 99.07 | AVSADPLAS | 45.86 | TYSADPLAS | | TYSADPLLS | 0.64 | TYSADPLVS | 0.26 |
| PB2 | N/A | 285 | 0.16 | yes | 2 | 0.12 | 99.14 | VSADPLASL | 98.66 | VSADPLLSL | 0.38 | | | | |
| PB2 | N/A | 286 | 0.13 | yes | 2 | 0.13 | 99.03 | SADPLASLL | 98.64 | SADPLLSLL | 0.38 | | | | |
| PB2 | N/A | 287 | 0.12 | yes | 2 | 0.13 | 99.01 | ADPLASLLE | 98.61 | ADPLLSLLE | 0.38 | ADPLVSLLE | 0.25 | | |
| PB2 | N/A | 288 | 0.15 | yes | 2 | 0.13 | 99.24 | DPLASLLEM | 98.89 | DPLLSLLEM | 0.39 | | | | |
| PB2 | N/A | 289 | 0.18 | yes | 2 | 0.13 | 99.28 | PLASLLEMC | 98.92 | PLLSLLEMC | 0.38 | | | | |
| PB2 | N/A | 290 | 0.11 | yes | 3 | 0.14 | 99.3 | LASLLEMCH | 98.73 | LLSLLEMCH | 0.32 | LSLLEMCHS | 0.32 | | |
| PB2 | N/A | 291 | 0.2 | yes | 1 | 0.14 | 99.05 | ASLLEMCHS | 98.4 | | | | | | |
| PB2 | N/A | 292 | 0.21 | yes | 3 | 0.14 | 99.04 | SLLEMCHST | 99.08 | | | LLEMCHSTQ | 0.32 | | |
| PB2 | N/A | 293 | 0.21 | yes | 3 | 0.14 | 99.08 | LLEMCHSTR | 98.07 | LLEMCHSTR | 0.84 | LLEMCHGTQ | 0.32 | | |
| PB2 | N/A | 294 | 0.44 | yes | 4 | 0.14 | 99.23 | LEMCHSTRI | 97.92 | LEMCHSTRI | 0.84 | LEMCHGTQI | 0.32 | | |
| PB2 | N/A | 295 | 0.43 | yes | 3 | 0.19 | 99.08 | EMCHSTRIG | 97.97 | EMCHSTRIG | 0.84 | EMCHGTQIG | 0.32 | | |
| PB2 | N/A | 296 | 0.41 | yes | 3 | 0.18 | 99.11 | MCHSTRIGG | 97.95 | MCHSTRIGG | 0.84 | MCHGTQIGG | 0.32 | | |
| PB2 | N/A | 309 | 0.4 | yes | 2 | 0.16 | 99.04 | DILKQNPTE | 93.86 | DILKQNPTE | 4.87 | DILRQNPTE | 0.19 | DILRQNPSE | 0.12 |
| PB2 | N/A | 310 | 0.11 | yes | 1 | 0.13 | 99.01 | ILKHNPTEE | 93.94 | ILKHNPTEE | 4.88 | ILKHNPTEE | 0.19 | | |
| PB2 | N/A | 311 | 0.34 | yes | 3 | 0.13 | 99.13 | LKHNPTEEQ | 94.06 | LKHNPTEEQ | 4.88 | LKHNPTEEQ | 0.19 | | |
| PB2 | N/A | 312 | 0.34 | yes | 3 | 0.16 | 99.02 | KQNPTEEQA | 94.13 | KQNPTEEQA | 4.89 | | | | |
| PB2 | N/A | 313 | 0.33 | yes | 2 | 0.13 | 99.08 | QNPTEEQAV | 99.08 | | | | | NPTEEQAVE | 0.39 |
| PB2 | N/A | 314 | 0.31 | yes | 4 | 0.14 | 99.37 | NPTEEQAVG | 95.7 | NPTEEQAVG | 2.84 | NPTEEQAVN | 0.44 | | |
| PB2 | N/A | 315 | 0.31 | yes | 3 | 0.14 | 99.02 | PTEEQAVDI | 95.75 | PTEEQAVGI | 2.84 | PTEEQAVNI | 0.44 | | |
| PB2 | N/A | 316 | 0.32 | yes | 3 | 0.14 | 99.14 | TEEQAVDIC | 95.86 | TEEQAVGIC | 2.84 | TEEQAVNIC | 0.44 | | |
| PB2 | N/A | 317 | 1.23 | yes | 5 | 0.24 | 99.24 | EEQAVDICK | 95.96 | EEQAVGICK | 2.85 | EEQAVNICK | 0.43 | | |
| PB2 | N/A | 318 | 1.23 | yes | 5 | 0.19 | 99.26 | EQAVDICKA | 95.98 | EQAVGICKA | 2.85 | EQAVNICKA | 0.43 | | |
| PB2 | N/A | 319 | 1.1 | yes | 3 | 0.11 | 99.11 | QAVDICKAA | 95.83 | QAVGICKAA | 2.85 | QAVNICKA | 0.43 | | |
| PB2 | N/A | 320 | 1.1 | yes | 3 | 0.12 | 99.07 | AVDICKAAI | 69.91 | AVGICKAAM | 24.24 | AVDICKAAL | 2.84 | AVNICKAAM | 1.64 |
| PB2 | N/A | 321 | 1.23 | yes | 5 | 0.12 | 99.11 | VDICKAAIG | 69.91 | VGICKAAMG | 24.24 | VDICKAALG | 2.84 | VNICKAAMG | 1.64 |
| PB2 | N/A | 323 | 1.1 | yes | 5 | 0.12 | 99.31 | ICKAAIGLR | 72.21 | ICKAAMGLR | 24.18 | ICKAAMGLK | 1.6 | ICKAAMGMR | 0.99 |
| PB2 | N/A | 324 | 1.11 | yes | 5 | 0.12 | 99.25 | CKAAIGLRI | 72.11 | CKAAMGLRI | 24.19 | CKAALGLRI | 1.61 | CKAAMGMRI | 0.34 |

FIG. 73-352

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 325 | 1.12 | yes | 5 | 0.12

FIG. 73-353

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 419 | 0.48 | yes | 5 | 0.09 | 99.03 | QEDCMIKAV | 93.45 | QEDCMIKAV | 4

FIG. 73-354

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 510 | 0.23 | yes | 3 | 0.07 | 99.29 | SIDRFLRVR | 97.58 | SIDRFLRVK | 0.92 | | | | |
| PB2 | N/A | 511 | 0.15 | yes | 2 | 0.08 | 99.36 | IDRFLRVRD | 98.57 | | 0.79 | | | | |
| PB2 | N/A | 512 | 0.16 | yes | 2 | 0.08 | 99.27 | DRFLRVRDQ | 98.49 | DRFLRVKD | 0.79 | | | | |
| PB2 | N/A | 513 | 0.46 | yes | 5 | 0.08 | 99.07 | RFLRVRDQR | 94.11 | RFLRVKDQQ | 3.61 | RFLRVRDQL | 0.76 | RFLRVRDQM | 0.39 | 0.2 |
| PB2 | N/A | 514 | 0.46 | yes | 5 | 0.08 | 99.12 | FLRVRDQRG | 94.16 | FLRVKDQQG | 3.62 | FLRVRDQLG | 0.76 | FLRVRDQMG | 0.39 | 0.2 |
| PB2 | N/A | 515 | 0.46 | yes | 5 | 0.08 | 99.12 | LRVRDQRGN | 94.17 | LRVKDQQGN | 3.61 | LRVRDQLGN | 0.76 | LRVRDQMGN | 0.39 | 0.2 |
| PB2 | N/A | 521 | 0.58 | yes | 2 | 0.1 | 99.11 | RGNVLLSPE | 92.01 | RGNILLSPE | 3.99 | QGNILLSPE | 2.48 | LGNILLSPE | 0.4 | 0.23 |
| PB2 | N/A | 522 | 0.25 | yes | 2 | 0.1 | 99.64 | GNVLLSPEE | 96.53 | GNILLSPEE | 3.11 | | | | |
| PB2 | N/A | 523 | 0.27 | yes | 1 | 0.1 | 99.44 | NVLLSPEEV | 96.33 | NILLSPEEV | 3.11 | | | | |
| PB2 | N/A | 524 | 0.27 | yes | 1 | 0.1 | 99.47 | VLLSPEEVS | 96.36 | ILLSPEEVS | 3.11 | | | | |
| PB2 | N/A | 525 | 0.07 | yes | 1 | 0.1 | 99.47 | LLSPEEVSE | 99.47 | | | | | | |
| PB2 | N/A | 526 | 0.11 | yes | 2 | 0.1 | 99.04 | LSPEEVSET | 99.04 | | | | | | |
| PB2 | N/A | 527 | 0.14 | yes | 2 | 0.11 | 99.09 | SPEEVSETQ | 98.8 | SPEEVSEAQ | 0.29 | | | | |
| PB2 | N/A | 528 | 0.13 | yes | 2 | 0.11 | 99.1 | PEEVSETQG | 98.81 | PEEVSEAQG | 0.29 | | | | |
| PB2 | N/A | 529 | 0.3 | yes | 2 | 0.12 | 99.08 | EEVSETQGT | 96.94 | EEVSETQGM | 0.95 | EEVSEAQGT | 0.68 | EEISETQGT | 0.27 | 0.23 |
| PB2 | N/A | 530 | 0.3 | yes | 3 | 0.13 | 99.08 | EVSETQGTE | 96.94 | EVSETQGME | 0.95 | EVSEAQGTE | 0.69 | EISETQGTE | 0.27 | 0.23 |
| PB2 | N/A | 538 | 0.85 | yes | 4 | 0.1 | 99.47 | EKLTITYSS | 79.43 | EKLTIIYSS | 19.04 | | | | |
| PB2 | N/A | 539 | 0.9 | yes | 4 | 0.08 | 99.43 | KLTITYSSS | 78.79 | KLTIIYSS | 18.99 | KLTITYSSP | 0.64 | | | |
| PB2 | N/A | 540 | 0.37 | yes | 4 | 0.08 | 99.52 | LTITYSSSL | 95.3 | LTIIYSSS | 2.53 | LTITYSSPM | 0.68 | | | |
| PB2 | N/A | 541 | 0.37 | yes | 4 | 0.09 | 99.55 | TITYSSSLM | 95.33 | TITYSSSM | 2.53 | TITYSSPMM | 0.68 | | | |
| PB2 | N/A | 542 | 0.36 | yes | 4 | 0.1 | 99.61 | ITYSSSLMW | 95.39 | ITYSSSMW | 2.53 | ITYSSPMMW | 0.68 | | | |
| PB2 | N/A | 543 | 0.36 | yes | 4 | 0.1 | 99.62 | TYSSSLMWE | 95.39 | TYSSSMMW | 2.53 | TYSSPMMWE | 0.68 | | | |
| PB2 | N/A | 544 | 0.4 | yes | 4 | 0.1 | 99.51 | YSSSLMWEI | 95.39 | YSSSMMWE | 2.52 | YSSPMMWEI | 0.68 | | | |
| PB2 | N/A | 545 | 0.41 | yes | 4 | 0.1 | 99.34 | SSSLMWEIN | 94.83 | SSSMMWEV | 2.52 | SSPMMWEIN | 1.48 | | | |
| PB2 | N/A | 546 | 0.39 | yes | 4 | 0.1 | 99.53 | SSLMWEING | 94.79 | SSMMWEVN | 2.52 | SPMMWEING | 1.36 | | | |
| PB2 | N/A | 547 | 0.41 | yes | 4 | 0.1 | 99.34 | SLMWEINGP | 94.97 | SMMWEVNG | 2.52 | PMMWEINGP | 1.36 | | | |
| PB2 | N/A | 548 | 0.4 | yes | 4 | 0.1 | 99.32 | LMWEINGPE | 94.93 | MMWEVNGP | 2.52 | MMWEINGPD | 1.36 | | | |
| PB2 | N/A | 549 | 0.23 | yes | 3 | 0.09 | 99.32 | MWEINGPES | 97.45 | MWEINGPE | 1.36 | | | | |
| PB2 | N/A | 550 | 0.25 | yes | 3 | 0.09 | 99.12 | WEINGPESV | 97.27 | WEINGPDS | 1.34 | | | | |
| PB2 | N/A | 551 | 0.25 | yes | 3 | 0.1 | 99.14 | EINGPESVL | 97.29 | EINGPDSV | 1.34 | | | | |
| PB2 | N/A | 552 | 0.65 | yes | 3 | 0.1 | 99.14 | INGPESVLI | 89.28 | INGPESVLI | 8.03 | INGPDSVLV | 0.49 | | | |
| PB2 | N/A | 553 | 0.53 | yes | 3 | 0.1 | 99.26 | NGPESVLIN | 90.73 | NGPESVLV | 8.03 | | | | |
| PB2 | N/A | 554 | 0.52 | yes | 2 | 0.1 | 99.39 | GPESVLVNT | 90.86 | GPDSVLVNT | 8.03 | | | | |
| PB2 | N/A | 555 | 0.51 | yes | 2 | 0.1 | 99.01 | PESVLVNTY | 90.86 | PDSVLVNTY | 8.03 | | | | |
| PB2 | N/A | 556 | 0.46 | yes | 2 | 0.09 | 99.57 | ESVLVNTYQ | 90.98 | ESVLINTYQ | 8.04 | | | | |
| PB2 | N/A | 557 | 0.59 | yes | 3 | 0.09 | 99.48 | SVLVNTYQW | 91.53 | SVLINTYQW | 7.95 | VLNTYQWV | 1.83 | | | |
| PB2 | N/A | 558 | 0.58 | yes | 3 | 0.09 | 99.67 | VLVNTYQWI | 89.7 | VLINTYQWI | 7.94 | LVNTYQWII | 1.86 | | | |
| PB2 | N/A | 559 | 0.58 | yes | 3 | 0.08 | 99.65 | LVNTYQWII | 89.87 | LINTYQWII | 7.94 | VNTYQWIIR | 1.85 | VNTYQWIIK | 0.77 | |
| PB2 | N/A | 560 | 0.64 | yes | 4 | 0.1 | 99.14 | VNTYQWIIR | 89.1 | INTYQWIIR | 7.94 | NTYQWIIRN | 0.76 | | | |
| PB2 | N/A | 561 | 0.3 | yes | 3 | 0.1 | 99.13 | NTYQWIIRN | 96.45 | NTYQWIIKN | 1.93 | | | | |
| PB2 | N/A | 562 | 0.3 | yes | 3 | 0.1 | 99.13 | TYQWIIRNW | 96.45 | TYQWIIKNW | 1.93 | | | | |

FIG. 73-355

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 563 | 0.3 | yes | 3 | 0.1 | 99.14 | YQWII

FIG. 73-356

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 639 | 1.07 | yes | 5 | 0.11 | 99.04 | PEQSR

FIG. 73-357

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 708 | 0.99 | yes | 4 | 0.01 | 99.43 | GFLILGKED | 79.77 | GFLILGKEN | 15.21 | GFLILGRED | 2.42 | GFLILGRED | 2.03 | FLILGREDK | 1.95 |
| PB2 | N/A | 709 | 1.51 | yes | 5 | 0.01 | 99.1 | FLILGKEDK | 67.41 | FLILGKEDR | 15.12 | FLILGKENK | 1.23 | FLILGKEDK | 2.33 | GKENKKYGP | 0.67 |
| PB2 | N/A | 713 | 1.25 | yes | 1 | 0.03 | 99.17 | GKEDKRYGP | 67.48 | GREDKRYGP | 27.4 | GKENKRYGP | 1.95 | GKENKRYGP | 1.66 | | |
| PB2 | N/A | 714 | 0 | no | 5 | 99.99 | 100 | QKDDKRYGP | 100 | | | | | | | | |
| PB2 | N/A | 715 | 1.25 | yes | 4 | 0.03 | 99.17 | KEDKRYGPA | 67.51 | REDKRYGPA | 27.39 | KEDIKRYGPA | 1.95 | KENKRYGPA | 1.65 | KENKKYGPA | 0.67 |
| PB2 | N/A | 716 | 1.11 | yes | 4 | 0.03 | 99.27 | EDKRYGPAL | 69.42 | EDRRYGPAL | 27.49 | ENKRYGPAL | 1.68 | ENKIYGPAL | 0.67 | | |
| PB2 | N/A | 717 | 1.11 | yes | 3 | 0.03 | 99.27 | DKRYGPALS | 69.45 | DRRYGPALS | 27.47 | NKRYGPALS | 1.68 | NKKYGPALS | 0.67 | | |
| PB2 | N/A | 718 | 0.98 | yes | 3 | 0.03 | 99.41 | KRYGPALSI | 71.15 | RRYGPALSI | 27.55 | KKYGPALSI | 0.7 | | | | |
| PB2 | N/A | 719 | 0.21 | yes | 2 | 0.05 | 99.42 | RYGPALSIN | 97.8 | RYGPALSI | 0.88 | KYGPALSIN | 0.74 | | | | |
| PB2 | N/A | 720 | 0.14 | yes | 2 | 0.04 | 99.45 | YGPALSINE | 98.54 | | 0.9 | | | | | | |
| PB2 | N/A | 721 | 0.22 | yes | 2 | 0.03 | 99.45 | GPALSINEL | 98.56 | | 0.9 | | | | | | |
| PB2 | N/A | 722 | 0.48 | yes | 3 | 0.04 | 99.21 | PALSINELS | 97.76 | PALSINELG | 0.88 | ALSISELSN | 0.57 | ALSISELSN | 0.86 | ALSINELGN | 0.57 |
| PB2 | N/A | 723 | 0.27 | yes | 2 | 0.04 | 99.03 | ALSINELSN | 94.37 | ALSINELSK | 2.31 | IAKGEKANV | 0.91 | IAKGEKANV | 0.26 | | |
| PB2 | N/A | 732 | 0.25 | yes | 3 | 0.09 | 99.22 | LAKGEKANV | 97.02 | LARGEKANV | 1.66 | | 0.27 | | | | |
| PB2 | N/A | 733 | 0.2 | yes | 2 | 0.08 | 99.19 | AKGEKANVL | 97.25 | ARGEKANVL | 1.66 | | 0.27 | | | | |
| PB2 | N/A | 734 | 0.11 | yes | 1 | 0.09 | 99.03 | KGEKANVLI | 99.03 | | | | | | | | |
| PB2 | N/A | 735 | 0.11 | yes | 1 | 0.08 | 99.13 | GEKANVLIG | 99.13 | | | | | | | | |
| PB2 | N/A | 736 | 0.11 | yes | 1 | 0.06 | 99.11 | EKANVLIGQ | 99.11 | | | | | | | | |
| PB2 | N/A | 737 | 0.1 | yes | 1 | 0.07 | 99.12 | KANVLIGQG | 99.12 | | | | | | | | |
| PB2 | N/A | 738 | 0.17 | yes | 2 | 0.05 | 99.27 | ANVLIGQGD | 99.21 | NVLIGQGDI | 1.12 | | | | | | |
| PB2 | N/A | 739 | 0.17 | yes | 2 | 0.06 | 99.34 | NVLIGQGDV | 98.25 | VLIGQGDIV | 1.12 | | | | | | |
| PB2 | N/A | 740 | 0.17 | yes | 2 | 0.06 | 99.34 | VLIGQGDVV | 98.22 | LIGQGDIVL | 1.12 | | | | | | |
| PB2 | N/A | 741 | 0.18 | yes | 2 | 0.06 | 99.3 | LIGQGDVVL | 98.23 | IGQGDIVLV | 1.12 | | | | | | |
| PB2 | N/A | 742 | 0.6 | yes | 2 | 0.08 | 99.41 | IGQGDVVLV | 98.19 | GQGDIVLVM | 1.12 | | | | | | |
| PB2 | N/A | 743 | 0.15 | yes | 2 | 0.15 | 99.58 | GQGDVVLVM | 98.3 | QGDIVLVMK | 1.12 | | | | | | |
| PB2 | N/A | 744 | 0.15 | yes | 2 | 0.16 | 99.55 | QGDVVLVMK | 98.47 | GDIVLVMKR | 1.12 | | | | | | |
| PB2 | N/A | 745 | 0.15 | yes | 2 | 0.17 | 99.53 | GDVVLVMKR | 98.43 | DIVLVMKRK | 1.12 | | | | | | |
| PB2 | N/A | 746 | 0.14 | yes | 2 | 0.19 | 99.53 | DVVLVMKRK | 98.41 | IVLVMKRKR | 1.12 | | | | | | |
| PB2 | N/A | 747 | 0.15 | yes | 2 | 0.22 | 99.61 | VVLVMKRKR | 98.41 | VLVMKRKRN | 1.12 | | | | | | |
| PB2 | N/A | 748 | 0.16 | yes | 2 | 0.23 | 99.5 | VLVMKRKRD | 98.51 | LVMKRKRNS | 1.12 | | | | | | |
| PB2 | N/A | 749 | 0.15 | yes | 2 | 0.27 | 99.47 | LVMKRKRDS | 98.4 | VMKRKRNSS | 1.09 | | | | | | |
| PB2 | N/A | 750 | 0.15 | yes | 2 | 0.47 | 99.49 | VMKRKRDSS | 98.37 | MKRKRNSSI | 1.09 | | | | | | |
| PB2 | N/A | 751 | 0.15 | yes | 2 | 0.6 | 99.48 | MKRKRDSSI | 98.4 | KRKRNSSIL | 1.11 | | | | | | |
| PB2 | N/A | 752 | 0.17 | yes | 2 | 0.77 | 99.41 | KRKRDSSIL | 98.38 | RKRNSSILT | 1.11 | | | | | | |
| PB2 | N/A | 753 | 0.16 | yes | 2 | 0.84 | 99.46 | RKRDSSILT | 98.32 | KRNSSILTD | 1.11 | | | | | | |
| PB2 | N/A | 754 | 0.15 | yes | 2 | 0.94 | 99.45 | KRDSSILTD | 98.36 | RNSSILTDS | 1.11 | | | | | | |
| PB2 | N/A | 755 | 0.16 | yes | 2 | 1.15 | 99.44 | RDSSILTDS | 98.34 | NSSILTDSQ | 1.11 | | | | | | |
| PB2 | N/A | 756 | 0.16 | yes | 1 | 1.34 | 99.45 | DSSILTDSQ | 98.33 | | | | | | | | |
| PB2 | N/A | 757 | 0.07 | yes | 1 | 1.39 | 99.61 | SSILTDSQT | 99.45 | | | | | | | | |
| PB2 | N/A | 758 | 0.05 | yes | 1 | 1.44 | 99.63 | SILTDSQTA | 99.61 | | | | | | | | |
| PB2 | N/A | 759 | 0.05 | yes | 1 | | | ILTDSQTAT | 99.63 | | | | | | | | |

FIG. 73-358

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 760 | 0.04 | yes | 1 | 1.7 | 99.69 | LTDSQTATK | 99.69 | | | | | | |
| PB2 | N/A | 761 | 0.05 | yes | 1 | 2.07 | 99.68 | TDSQTATKR | 99.68 | | | | | | |
| PB2 | N/A | 762 | 0.11 | yes | 2 | 2.49 | 99.63 | DSQTATKRI | 98.99 | DSQTATKRL | 0.64 | | | | | |
| PB2 | N/A | 763 | 0.12 | yes | 2 | 2.63 | 99.52 | SQTATKRIR | 98.88 | SQTATKRLR | 0.64 | | | | | |
| PB2 | N/A | 764 | 0.17 | yes | 2 | 4.35 | 99.09 | QTATKRIRM | 98.44 | QTATKRLRM | 0.65 | | | | | |
| PB2 | N/A | 765 | 0.18 | yes | 2 | 4.53 | 99.06 | TATKRIRMA | 98.41 | TATKRLRMA | 0.65 | | | | | |
| PB2 | N/A | 766 | 0.22 | yes | 4 | 5.14 | 99.13 | ATKRIRMAI | 97.97 | ATKRLRMAI | 0.66 | ATKRIRMAT | 0.37 | ATKRIRLAI | | |
| PB2 | N/A | 769 | 2.13 | yes | 5 | 99.95 | 100 | RIRMAINQC | 42.86 | RIRMATNEC | 14.29 | RIRMAINYS | 14.29 | RIRMAINLV | 14.29 | RIRMAINWG | 14.29 |
| PB2 | N/A | 770 | — | no | 2 | 99.99 | 100 | IRMAINWGR | 50 | IRMATNECR | 50 | | | | | |
| PB2 | N/A | 771 | — | no | 2 | 99.99 | 100 | RMAINWGRI | 50 | RMATNECRI | 50 | | | | | |
| PB2 | N/A | 772 | — | no | 2 | 99.99 | 100 | MATNECRII | 50 | MAINWGRIV | 50 | | | | | |

FIG. 74-1

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 1 | 0 | no | 1 | 99.98 | 100 | KQGKTKATKM | 100 | QGKTKATKME | 20 | | | | |
| HA | ALL | 2 | 0.72 | no | 2 | 99.98 | 100 | QGKTKATKMK | 80 | IFIFLLLTHW | 10 | IFNFILLTHW | 10 | | |
| HA | ALL | 15 | 0.92 | no | 3 | 99.96 | 100 | IFIFLLLTHW | 80 | FIFLLLTHWA | 10 | FNFILLTHWA | 10 | | |
| HA | ALL | 16 | 0.92 | no | 2 | 99.96 | 100 | FIFLLLTHWA | 80 | VLSCIFCLAF | 50 | | | | |
| HA | ALL | 18 | — | no | 1 | 99.99 | 100 | RFSYVFCLAL | 50 | | | | | | |
| HA | ALL | 32 | 0 | no | 1 | 99.98 | 100 | SQTNGTTGNP | 100 | | | | | | |
| HA | ALL | 33 | 0 | no | 1 | 99.98 | 100 | QTNGTTGNPI | 100 | | | | | | |
| HA | ALL | 34 | 0 | no | 1 | 99.98 | 100 | TNGTTGNPII | 100 | | | | | | |
| HA | ALL | 35 | 0 | no | 1 | 99.98 | 100 | NGTTGNPIIC | 100 | | | | | | |
| HA | ALL | 36 | 0 | no | 1 | 99.98 | 100 | GTTGNPIICL | 100 | | | | | | |
| HA | ALL | 37 | 0 | no | 1 | 99.98 | 100 | TTGNPIICLG | 100 | | | | | | |
| HA | ALL | 38 | 0 | no | 1 | 99.98 | 100 | NNNNTATLCLG | 75 | SDNADKICLG | 25 | | | | |
| HA | ALL | 41 | 0.81 | no | 2 | 99.98 | 100 | NNSTATLCLG | 100 | | | | | | |
| HA | ALL | 44 | 0 | no | 1 | 100 | 100 | GVIPLTTTPT | 100 | | | | | | |
| HA | ALL | 75 | 0 | no | 1 | 100 | 100 | VIPLTTTPTK | 100 | | | | | | |
| HA | ALL | 76 | 0 | no | 1 | 100 | 100 | IPLTTTPTKS | 100 | | | | | | |
| HA | ALL | 77 | 0 | no | 1 | 100 | 100 | PLTTTPTKSY | 100 | | | | | | |
| HA | ALL | 78 | 0 | no | 1 | 100 | 100 | LTTTPTKSYF | 100 | | | | | | |
| HA | ALL | 79 | 0 | no | 1 | 100 | 100 | TTTPTKSYFA | 100 | | | | | | |
| HA | ALL | 80 | 0 | no | 1 | 100 | 100 | TTPTKSYFAN | 100 | | | | | | |
| HA | ALL | 81 | 0 | no | 1 | 100 | 100 | TPTKSYFANL | 100 | | | | | | |
| HA | ALL | 82 | 0 | no | 1 | 100 | 100 | PTKSYFANLK | 100 | | | | | | |
| HA | ALL | 83 | 0 | no | 1 | 100 | 100 | TKSYFANLKG | 100 | | | | | | |
| HA | ALL | 85 | 0 | no | 1 | 100 | 100 | KSYFANLKGT | 100 | | | | | | |
| HA | ALL | 86 | 0 | no | 1 | 100 | 100 | SYFANLKGTR | 100 | | | | | | |
| HA | ALL | 155 | 0 | no | 1 | 100 | 100 | IMHDRTKIRQ | 100 | | | | | | |
| HA | ALL | 156 | 0 | no | 1 | 100 | 100 | MHDRTKIRQL | 100 | | | | | | |
| HA | ALL | 224 | 1.41 | no | 2 | 99.97 | 50 | EKENSYPMIN | 100 | EKENSYPKIN | 37.5 | DNNKNATNPL | 12.5 | | |
| HA | ALL | 234 | 0 | no | 1 | 100 | 100 | LTVEVPYYCT | 100 | | | | | | |
| HA | ALL | 281 | 0 | no | 1 | 100 | 100 | GVTHYVSQI | 100 | | | | | | |
| HA | ALL | 299 | 0 | no | 1 | 100 | 100 | DEGLPQSGRI | 100 | | | | | | |
| HA | ALL | 300 | 0 | no | 1 | 100 | 100 | EGLPQSGRIV | 100 | | | | | | |
| HA | ALL | 301 | 0 | no | 1 | 100 | 100 | GLPQSGRIVW | 100 | | | | | | |
| HA | ALL | 302 | 0 | no | 1 | 100 | 100 | LPQSGRIVWD | 100 | | | | | | |
| HA | ALL | 303 | 0 | no | 1 | 100 | 100 | PQSGRIVWDY | 100 | | | | | | |
| HA | ALL | 342 | 1.33 | no | 3 | 99.94 | 61.54 | APSGIEYNGK | 100 | APSGVEYNGK | 23.1 | NNNIGAVFKS | 15.38 | | |
| HA | ALL | 343 | 0.85 | no | 2 | 99.95 | 72.73 | SGIEYNGKSL | 100 | SGVEYNGKSL | 27.3 | | | | |
| HA | ALL | 344 | 0.85 | no | 2 | 99.95 | 72.73 | GIEYNGKSLG | 100 | GVEYNGKSLG | 27.3 | | | | |
| HA | ALL | 345 | 0.85 | no | 2 | 99.95 | 72.73 | IEYNGKSLGI | 100 | VEYNGKSLGI | 27.3 | | | | |
| HA | ALL | 346 | 0 | no | 1 | 99.95 | 100 | EYNGKSLGIQ | 100 | | | | | | |
| HA | ALL | 347 | 0 | no | 1 | 99.95 | 100 | YNGKSLGIQS | 100 | | | | | | |

FIG. 74-2

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 349 | 0 | no | 1 | 99.95 | 100 | NGKSLGIQSD | 100 | | | | | | |
| HA | ALL | 370 | 0 | no | 1 | 100 | 100 | PSWKLPMGAI | 100 | | | | | | |
| HA | ALL | 377 | 0 | no | 1 | 100 | 100 | GAIGAIDSSM | 100 | | | | | | |
| HA | ALL | 378 | 0 | no | 1 | 99.99 | 100 | AIGAIDSSMP | 100 | | | IGAIDSSMPF | 50 | | | |
| HA | ALL | 379 | 0 | no | 1 | 100 | 100 | YGGLNKSKPY | 50 | | | | | | |
| HA | ALL | 384 | 0 | no | 1 | 100 | 100 | TSLTSLPFQN | 100 | | | | | | |
| HA | ALL | 385 | 0 | no | 1 | 100 | 100 | SLTSLPFQNI | 100 | | | | | | |
| HA | ALL | 386 | 0 | no | 1 | 100 | 100 | LTSLPFQNIH | 100 | | | | | | |
| HA | ALL | 394 | 0 | no | 1 | 100 | 100 | GEHAKAIGNC | 100 | | | | | | |
| HA | ALL | 423 | 0.37 | no | 2 | 99.99 | 100 | PAKLLKERGF | 50 | IPIGERGLFG | 50 | |

FIG. 74-3

| Protein | Sub-type | Start Pos | Block Entropy | Gaps > 10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 481 | 0.95 | yes | 2 | 0.04 | 99.47 | AIAGFIEGGW | 69.74 | AIAGFIENGW | 29.7 | | | | |
| HA | ALL | 497 | 0 | no | 1 | 100 | 100 | GRLVRFRHQN | 100 | | | | | | |
| HA | ALL | 498 | 0 | no | 1 | 100 | 100 | RLVRFRHQNS | 100 | | | | | | |
| HA | ALL | 642 | 0 | no | 1 | 100 | 100 | LPTFDSLNIT | 100 | | | | | | |
| HA | ALL | 643 | 0 | no | 1 | 100 | 100 | PTFDSLNITA | 100 | | | | | | |
| HA | ALL | 644 | 0 | no | 1 | 100 | 100 | TFDSLNITAA | 100 | | | | | | |
| HA | ALL | 645 | 0 | no | 1 | 100 | 100 | FDSLNITAAS | 100 | | | | | | |
| HA | ALL | 646 | 0 | no | 1 | 100 | 100 | DSLNITAASL | 100 | | | | | | |
| HA | ALL | 647 | 0 | no | 1 | 100 | 100 | SLNITAASLN | 100 | | | | | | |
| HA | ALL | 648 | 0 | no | 1 | 100 | 100 | LNITAASLND | 100 | | | | | | |
| HA | ALL | 649 | 0 | no | 1 | 100 | 100 | NITAASLNDD | 100 | | | | | | |
| HA | ALL | 650 | 0 | no | 1 | 100 | 100 | ITAASLNDDG | 100 | | | | | | |
| HA | ALL | 682 | 0 | no | 1 | 100 | 100 | VTTRQASPSC | 100 | | | | | | |
| HA | ALL | 683 | 0 | no | 1 | 100 | 100 | TTRQASPSCL | 100 | | | | | | |
| HA | ALL | 684 | 0 | no | 1 | 100 | 100 | TRQASPSCLV | 100 | | | | | | |
| HA | ALL | 685 | 0 | no | 1 | 100 | 100 | RQASPSCLVV | 100 | | | | | | |
| HA | ALL | 686 | 0 | no | 1 | 100 | 100 | QASPSCLVVR | 100 | | | | | | |
| HA | ALL | 687 | 0 | no | 1 | 100 | 100 | ASPSCLVVRK | 100 | | | | | | |
| HA | ALL | 689 | 0 | no | 1 | 100 | 100 | EFPSTGNHGS | 100 | | | | | | |
| HA | ALL | 690 | 0 | no | 1 | 100 | 100 | FPSTGNHGSL | 100 | | | | | | |
| HA | ALL | 691 | 0 | no | 1 | 100 | 100 | PSTGNHGSLY | 100 | | | | | | |
| HA | ALL | 692 | 0 | no | 1 | 100 | 100 | STGNHGSLVL | 100 | | | | | | |
| HA | ALL | 693 | 0 | no | 1 | 100 | 100 | TGNHGSLVLS | 100 | | | | | | |
| HA | ALL | 694 | 0 | no | 1 | 100 | 100 | GNHGSLVLSL | 100 | | | | | | |
| HA | ALL | 695 | 0 | no | 1 | 100 | 100 | NHGSLVLSLW | 100 | | | | | | |
| HA | ALL | 717 | 2 | no | 4 | 99.98 | 100 | SGSLQCRICI | 25 | HSCLQCRICI | 25 | HGSLQCRICI | 25 | MVLLQCRICI | 25 |
| HA | ALL | 719 | 0 | no | 1 | 100 | 100 | LCSVEYASKT | 100 | | | | | | |
| HA | ALL | 720 | 0 | no | 1 | 100 | 100 | CSVEYASKTR | 100 | | | | | | |
| HA | ALL | 721 | 0 | no | 1 | 100 | 100 | SVEYASKTRI | 100 | | | | | | |
| HA | ALL | 722 | 0 | no | 1 | 100 | 100 | VEYASKTRIS | 100 | | | | | | |
| HA | ALL | 723 | 0 | no | 1 | 100 | 100 | EYASKTRISE | 100 | | | | | | |
| HA | ALL | 724 | 0 | no | 1 | 100 | 100 | YASKTRISEI | 100 | | | | | | |
| NA | ALL | 732 | 1.58 | no | 3 | 99.99 | 100 | ILDQNFRNIR | 33.33 | IDFRDMRKNT | 33.33 | IRFVNSDCSK | 33.33 | | |
| NA | ALL | 733 | 1 | no | 2 | 99.99 | 100 | DFRDMRKNTL | 50 | LDQNFRNIRK | 50 | | | | |
| NA | ALL | 1 | 0.59 | no | 3 | 99.97 | 100 | IGLREQKQEF | 85.71 | LVFREQKQEF | 14.3 | | | | |
| NA | ALL | 2 | 0.77 | no | 2 | 99.94 | 100 | GLREQKQEFK | 84.62 | FSGSQKQEFK | 7.69 | VFREQKQEFK | 7.69 | | |
| NA | ALL | 3 | 0.73 | no | 3 | 99.94 | 100 | LREQKQEFKM | 85.71 | SGSQKQEFKM | 7.14 | FREQKQEFKM | 7.14 | | |
| NA | ALL | 4 | 0.35 | no | 2 | 99.93 | 100 | REQKQEFKMN | 93.33 | GSQKQEFKMN | 6.67 | | | | |
| NA | ALL | 5 | 0.31 | no | 1 | 99.92 | 100 | EQKQEFKMNP | 94.44 | SQKQEFKMNP | 5.56 | | | | |
| NA | ALL | 6 | 0.47 | no | 3 | 99.82 | 100 | QKQEFKMNPN | 92.11 | QKQEFKMNPN | 2.63 | AKAGVKMNPN | 2.63 | AKAGVKMNPN | 2.63 |
| NA | ALL | 7 | 1.08 | no | 4 | 99.82 | 100 | KQEFKMNPNK | 76.32 | KQEFKMNPNQ | 5.26 | KQEIKMNPNQ | 5.26 | KAGVKMNPNQ | 2.63 |
| NA | ALL | 8 | 1.08 | no | 4 | 99.82 | 100 | QEFKMNPNKK | 76.32 | QEFKMNPNQK | 5.26 | QEIKMNPNQK | 15.8 | AGVKMNPNQK | 2.63 |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N1 | 11 | 1.21 | no | 4 | 99.65 | 100 | KMNPNKKIIT | 72.5 | KMNPNQKIIT | 15 | KMNPNQKIII | 10 | KMNPNQKIMT | 2.5 | | |
| NA | N1 | 19 | — | no | 1 | 99.99 | 100 | NRDITIGSIC | 100 | | | | | | |
| NA | N1 | 20 | — | no | 1 | 99.99 | 100 | RDITIGSIC | 100 | | | | | | |
| NA | N1 | 21 | — | no | 1 | 99.98 | 100 | DITIGSICMV | 100 | | | | | | |
| NA | N1 | 44 | 1 | no | 2 | 0.1 | 99.21 | DLNMGQPFYS | 50 | ASQYGPSHSI | 50 | | | | |
| NA | N1 | 116 | 1.65 | yes | 5 | 0.15 | 99.21 | SKDNSRIGS | 61.48 | TKDNSIRIGS | 20.4 | SKDNSYRIGS | 8.6 | SKDNNIRIGS | 1.28 |
| NA | N1 | 117 | 1.28 | yes | 5 | 0.14 | 99.01 | KDNSIRIGSK | 76.75 | KDNSYRIGSK | 8.54 | KDNGIRIGSK | 7.31 | KDNNIRIGSK | 1.28 |
| NA | N1 | 118 | 1.28 | yes | 5 | 0.19 | 99.02 | DNSIRIGSKG | 76.78 | DNSYRIGSKG | 8.54 | DNGIRIGSKG | 7.3 | DNSIRIGSRG | 1.28 |
| NA | N1 | 119 | 1.28 | yes | 4 | 0.19 | 99.02 | NSIRIGSKGD | 79.12 | NSVRIGSKGD | 8.54 | NGIRIGSKGD | 7.3 | NSIRIGSRGD | 1.28 |
| NA | N1 | 121 | 1.13 | yes | 3 | 0.18 | 99.3 | IRIGSKGDVF | 87.84 | VRIGSKGDVF | 8.89 | IRIGSKGDIF | 6.07 | IRIGSRGDVF | |
| NA | N1 | 122 | 0.73 | yes | 3 | 0.23 | 99.15 | RIGSKGDVFV | 92.03 | RIGSKGDIFV | 6.07 | RIGSRGDVFV | | | |
| NA | N1 | 127 | 0.58 | yes | 3 | 0.18 | 99.01 | GDVFVREPF | 96.97 | GDIFVREPF | 5.24 | GDVFVMREPF | 0.55 | GDVFVWREPF | 0.38 |
| NA | N1 | 130 | 0.28 | yes | 2 | 0.22 | 99.18 | FVIREPFISC | 97.04 | FVWREPFISC | 1.08 | FIIREPFISC | 0.22 | | |
| NA | N1 | 131 | 0.27 | yes | 2 | 0.18 | 99.03 | VIREPFISCS | | VMREPFISCS | 1.6 | | | | |
| NA | N1 | 142 | 0.31 | yes | 3 | 0.22 | 99.12 | LECKTFFLTQ | 96.8 | LECRTFFLTQ | 1.6 | | | | |
| NA | N1 | 143 | 0.19 | yes | 2 | 0.16 | 99.2 | ECKTFFLTQG | 98.03 | ECRTFFLTQG | 1.16 | MECRTFFLTQ | 1.17 | FECRTFFLTQ | 0.18 |
| NA | N1 | 144 | 0.21 | yes | 3 | 0.11 | 99.01 | CKTFFLTQGA | 97.84 | CRTFFLTQGA | 1.17 | SECRTFFLTQ | 0.21 | | |
| NA | N1 | 145 | 0.21 | yes | 2 | 0.11 | 99.01 | KTFFLTQGAL | 97.84 | RTFFLTQGAL | 1.17 | | | | |
| NA | N1 | 146 | 0.12 | yes | 1 | 0.11 | 99.01 | TFFLTQGALL | 99.01 | | | | | | |
| NA | N1 | 147 | — | yes | 1 | 0.11 | 99.16 | FFLTQGALLN | 99.16 | | | | | | |
| NA | N1 | 148 | 0.1 | yes | 2 | 0.11 | 99.16 | FLTQGALLND | | | | | | | |
| NA | N1 | 149 | 0.37 | yes | 3 | 0.04 | 99.14 | LTQGALLNDK | 94.67 | LTQGALLNDR | 4.47 | SLLNDKHSNG | 0.23 | | |
| NA | N1 | 150 | 0.37 | yes | 3 | 0.09 | 99.16 | TQGALLNDKH | 94.69 | TQGALLNDRH | 4.47 | | | | |
| NA | N1 | 151 | 0.36 | yes | 2 | 0.09 | 99.25 | QGALLNDKHS | 94.7 | QGALLNDRHS | 4.47 | | | | |
| NA | N1 | 152 | 0.36 | yes | 2 | 0.09 | 99.18 | GALLNDKHSN | 94.79 | GALLNDRHSN | 4.47 | | | | |
| NA | N1 | 153 | 0.39 | yes | 3 | 0.04 | 99.14 | ALLNDKHSNG | 94.48 | ALLNDRHSNG | 4.48 | | | | |
| NA | N1 | 154 | 0.37 | yes | 2 | 0.09 | 99.09 | LLNDKHSNGT | 94.66 | LLNDRHSNGT | 4.48 | | | | |
| NA | N1 | 155 | 1.49 | yes | 5 | 0.09 | 99.05 | LNDKHSNGTI | 47.61 | LNDRHSNGTV | 46.5 | LNDKHSNGTV | | LNDRHSNGTI | 0.19 |
| NA | N1 | 166 | 1.46 | yes | 3 | 0.01 | 99.01 | NDKHSNGTIT | 60.1 | NDRHSNGTII | | NDRHSNGTIT | | | |
| NA | N1 | 167 | 1.48 | yes | 5 | 0.14 | 99.09 | DRSPYRTLMS | 60.05 | DRSPYRALMS | 21.1 | DRSPHRTLMS | 17.47 | DRSPHRALMS | 0.19 |
| NA | N1 | 168 | — | yes | 3 | 0.05 | 99.09 | RSPYRTLMSC | 59.92 | RSPYRALMSC | 21.5 | RSPHRTLMSC | 17.42 | | |
| NA | N1 | 178 | 1.58 | yes | 4 | 0.04 | 99.03 | SPYRTLMSCP | 46.31 | SPYRALMSCP | 21.5 | SPHRTLMSCP | 17.4 | SPHRALMSCP | 0.23 |
| NA | N1 | 179 | 1.58 | yes | 2 | 0.05 | 99.35 | IGEAPSYNSR | 46.72 | LGEAPSYNSR | 24.2 | VGEAPSYNSR | 20.47 | VGEAPSYNS | 0.23 |
| NA | N1 | 180 | 1.57 | yes | 3 | 0.06 | 99.33 | GEVPSYNSRF | 46.75 | GEAPSYNSRF | 32.8 | GEAPSYNSR | 19.85 | IGEAPSYNS | 7.59 |
| NA | N1 | 181 | 1.56 | yes | 2 | 0.04 | 99.45 | EVPSYNSRFE | 46.75 | EAPSYNSRFE | 32.8 | EAPSYNSRFE | 19.85 | | |
| NA | N1 | 182 | — | yes | 2 | 0.04 | 99.61 | VPSYNSRFES | 46.72 | APSYNSRFES | 32.8 | APSYNSRFE | 19.87 | | |
| NA | N1 | 183 | 0.77 | yes | 2 | 0.04 | 99.6 | PSYNSRFESV | 79.66 | PSYNSRFES | 20 | | | | |
| NA | N1 | 184 | 0.78 | yes | 2 | 0.04 | 99.64 | SYNSREFSV | 79.64 | SYNSRFESV | 20 | | | | |
| NA | N1 | 185 | 0.78 | yes | 2 | 0.04 | 99.68 | PYNSRFESVA | 79.67 | PYNSRFESVA | 20 | | | | |
| NA | N1 | 186 | 0.78 | yes | 2 | 0.04 | 99.64 | YNSRFESVAW | 79.72 | YNSKFESVAW | 20 | | | | |
| NA | N1 | 187 | 0.77 | yes | 2 | 0.04 | 99.75 | NSRFESVAWS | 79.75 | NSKFESVAWS | 20 | | | | |
| NA | N1 | 188 | 0.76 | yes | 2 | 0.04 | 99.69 | SRFESVAWSA | 79.75 | SKFESVAWSA | 20 | | | | |
| NA | N1 | 189 | 0.76 | yes | 2 | 0.04 | 99.69 | RFESVAWSAS | 79.73 | KFESVAWSAS | 20 | | | | |

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N1 | 334 | 1.09 | yes | 2 | 0.03 | 99.09 | GYICSGVFGD | 51.44 | GYICSGIFGD | 47.7 | YICSGVFGDS | 0.49 | YICSGVLGDN | 0.43 |

FIG. 74-8

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N1 | 480 | 0 | no | 1 | 99.99 | 100 | VTTVGWSWPD | 100 | | | | | | |
| NA | N1 | 481 | 0 | no | 1 | 99.99 | 100 | TTVGWSWPDG | 100 | | | | | | |
| NA | N1 | 485 | 0.54 | yes | 4 | 3.47 | 99.03 | WSWPDGAELP | 91.98 | WSWPDGADLP | 5.8 | WSWPDGAEVP | 0.75 | WSWPDDAELP | 0.51 |
| NA | N1 | 486 | 0.55 | yes | 5 | 3.47 | 98.34 | SWPDGAELPF | 92.01 | SWPDGADLPF | 5.83 | SWPDGAEVPF | 0.73 | SWPDGAKLPF | 0.39 | SWPDDAELPF | 0.18 |
| NA | N2 | 1 | 0 | no | 1 | 99.99 | 100 | AKAGVKMNPN | 100 | | | | | | |
| NA | N2 | 2 | 0 | no | 1 | 99.99 | 100 | KAGVKMNPNQ | 100 | | | | | | |
| NA | N2 | 3 | 0 | no | 1 | 99.99 | 100 | AGVKMNPNQK | 100 | | | | | | |
| NA | N2 | 4 | 0 | no | 1 | 99.99 | 100 | GVKMNPNQKI | 100 | | | | | | |
| NA | N2 | 5 | 0 | no | 1 | 99.99 | 100 | VKMNPNQKII | 100 | | | | | | |
| NA | N2 | 6 | 0 | no | 1 | 99.99 | 100 | KMNPNQKIIT | 100 | | | | | | |
| NA | N2 | 13 | 0 | no | 1 | 99.99 | 100 | IIAIGYSR | 100 | | | | | | |
| NA | N2 | 54 | 1.15 | yes | 3 | 99.9 | 100 | KNNQVILCEP | 71.43 | KNNQVILCGP | 14.3 | KNNQVILCEQ | 14.29 | | |
| NA | N2 | 59 | 0 | no | 1 | 99.99 | 100 | VPLVPCEPII | 100 | | | | | | |
| NA | N2 | 60 | 0 | no | 1 | 99.99 | 100 | PLVPCEPIIE | 100 | | | | | | |
| NA | N2 | 61 | 0 | no | 1 | 99.99 | 100 | LVPCEPIIE | 100 | | | | | | |
| NA | N2 | 72 | 0 | no | 1 | 99.99 | 100 | KTVVHLNSTT | 100 | | | | | | |
| NA | N2 | 86 | 0 | no | 1 | 99.92 | 100 | EKEKEICSVV | 100 | | | | | | |
| NA | N2 | 87 | 0 | no | 1 | 99.92 | 100 | KEKEICSWL | 100 | | | | | | |
| NA | N2 | 110 | 0.38 | yes | 5 | 0.01 | 99.35 | GFAPFSKDNS | 95.68 | GFVPFSKDNS | 1.81 | GFAPFTKDNS | 0.92 | GFAPLSKDNS | 0.39 |
| NA | N2 | 113 | 0.36 | yes | 5 | 0.01 | 99.13 | PFSKDNSIRL | 96.01 | PFTKDNSIRL | 1.81 | PLSKDNSIRL | 0.55 | PFSKDNSVRL | 0.37 |
| NA | N2 | 115 | 0.36 | yes | 4 | 0.04 | 99.06 | SKDNSIRLAG | 96.04 | TKDNSIRLSA | 1.81 | SKDNSVRLSA | 0.55 | SKDNSIRLAA | 0.37 |
| NA | N2 | 116 | 0.31 | yes | 3 | 0.06 | 99.09 | KDNSIRLSAG | 96.67 | KDNSVRLSAG | 1.7 | KDNSIRLAAG | 0.33 | KDNSIQLSAG | 0.26 |
| NA | N2 | 117 | 0.3 | yes | 3 | 0.06 | 99.09 | DNSIRLSASG | 96.8 | DNSVRLSAGG | 1.7 | DNSIRLAAGG | 0.33 | | |
| NA | N2 | 128 | 0.53 | yes | 4 | 0.06 | 99.02 | IWTREPYVS | 91.96 | IWTREPYYS | 6.41 | IWTRELYYS | 0.52 | WVTREPYVS | 0.26 |
| NA | N2 | 129 | 0.51 | yes | 4 | 0.06 | 99.19 | WVTREPYVS | 92.09 | WVTRELYVS | 6.42 | WVTRELYSC | 0.52 | WVTREPYYS | 0.26 |
| NA | N2 | 142 | 0.21 | yes | 3 | 0.01 | 99.32 | KCYQFALGQG | 97.86 | NCYQFALGQG | 1.02 | | | | |
| NA | N2 | 143 | 0.08 | yes | 1 | 0.01 | 99.35 | CYQFALGQGT | 99.35 | | | | | | |
| NA | N2 | 144 | 0.09 | yes | 1 | 0 | 99.34 | YQFALGQGTT | 99.34 | | | | | | |
| NA | N2 | 145 | 0 | yes | 1 | 0 | 99.28 | QFALGQGTTL | 99.28 | | | | | | |
| NA | N2 | 168 | 1.21 | yes | 5 | 0.03 | 99.35 | PYRTLLMNEL | 63.64 | PHRTLLMSEL | 32.6 | PHRTLLMSEL | 0.91 | | |
| NA | N2 | 169 | 1.14 | yes | 4 | 0.03 | 99.68 | YRTLLMNELG | 63.93 | HRTLLMSELG | 33.1 | YRTLLMSEL | 0.94 | SHRTLLMNEL | 0.5 |
| NA | N2 | 170 | 0.3 | yes | 3 | 0.03 | 99.67 | RTLLMNELGV | 96.07 | RTLLMSELGV | 2.61 | RTLLMSEL | 0.99 | | |
| NA | N2 | 171 | 0.3 | yes | 3 | 0.03 | 99.64 | TLLMNELGVP | 96.04 | TLLMSELGVP | 2.61 | TLLMNELGIP | 0.99 | | |
| NA | N2 | 172 | 0.31 | yes | 3 | 0.03 | 99.57 | LLMNELGVPF | 95.97 | LMSELGVPF | 2.61 | LMNELGIPF | 0.99 | | |
| NA | N2 | 173 | 0.31 | yes | 3 | 0.03 | 99.19 | LMNELGVPFH | 95.61 | MSELGVPFH | 2.58 | LMNELGIPF | 0.99 | | |
| NA | N2 | 174 | 0.35 | yes | 3 | 0.03 | 99.16 | MNELGVPFHL | 95.58 | NELGVPFHL | 2.58 | MNELGIPHL | 0.99 | NELGIPHLG | 0.99 |
| NA | N2 | 175 | 0.61 | yes | 5 | 0.01 | 99.06 | NELGVPFHLG | 91.46 | SELGVPFHLG | 4.03 | NELGIPHLG | 2.58 | | |
| NA | N2 | 177 | 0.43 | yes | 3 | 0 | 94.07 | ELGVPFHLAT | 73.85 | ELGIPFHLGT | 20.1 | ELGIPFHLGT | 1.02 | | |
| NA | N2 | 178 | 1.16 | yes | 5 | 0 | 99.12 | LGVPFHLGTR | 73.82 | LGVPFHLATK | 20.2 | LGVPFHLGT | 4 | LGVPFYLGTK | 0.88 | LGVPFYLGTK | 0.25 |
| NA | N2 | 179 | 1.16 | yes | 4 | 0 | 99.09 | GVPFHLGTKQ | 73.8 | GVPFHLATKQ | 20.2 | GVPFHLGT | 4.02 | GVPFHLGTKQ | 0.88 | GVPFYLGTKQ | 0.25 |
| NA | N2 | 180 | 1.08 | yes | 4 | 0 | 99.21 | VPFHLGTRQVC | 74.68 | VPFHLATKQV | 20.3 | VPFHLATKQV | 4.02 | VPFHLGTKQV | 0.88 | VPFYLGTKQV | 0.25 |
| NA | N2 | | | yes | | | | PFHLGTKQVC | | PFHLATKQV | 4 | PFYLGTKQV | 0.25 | | |

FIG. 74-9

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 185 | 1.01 | yes | 5 | 0.01 | 99.2 | TKQVCIAWSS | 77.42 | TKQVCIAWSS | 19.1 | TKQVCMAWSS | 0.95 | TKQ

FIG. 74-10

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 437 | 0.09 | yes | 1 | 0.04 | 99.25 | NRCFYELIR | 99.25 | | | | | | |
| NA | N2 | 438 | 0.08 | yes | 1 | 0.04 | 99.34 | RCFYELIRGR | 99.34 | | | | | | |
| NA | N2 | 439 | 0.19 | yes | 3 | 0.04 | 99.12 | CFYELIRGRE | 98.22 | CFYVELIRGR | 0.68 | CFYVELRGR | | | |
| NA | N2 | 456 | 0.68 | yes | 5 | 0.11 | 99.05 | WTSNSIWFC | 98.51 | WTSNSIWFC | 9.35 | WTSNSIAFC | 0.52 | WTANSIIVFC | 0.15 |
| NA | N2 | 457 | 0.68 | yes | 5 | 0.11 | 99.02 | TSNSIWFCG | 88.49 | TSNSIWFCG | 9.34 | TSNSIAFCG | 0.52 | TANSIIVFCG | 0.15 |
| NA | N2 | 458 | 0.68 | yes | 5 | 0.25 | 99.03 | SNSIWFCGT | 88.62 | SNSIWFCGT | 9.24 | SNSIAFCGT | 0.53 | ANSIIVFCGT | 0.15 |
| NA | N2 | 459 | 0.68 | yes | 5 | 0.25 | 99 | NSIWFCGTS | 88.59 | NSIWFCGTS | 9.3 | NSIAFCGTS | 0.53 | SSIWFCGTS | 0.1 |
| NA | N2 | 460 | 0.67 | yes | 5 | 0.25 | 99.06 | SIWFCGTSG | 88.63 | SIWFCGTSG | 9.3 | SIAFCGTS | 0.53 | SWVFCGTSG | 0.1 |
| NA | N2 | 461 | 0.67 | yes | 4 | 0.26 | 99.02 | IWFCGTSGT | 88.65 | IWFCGTSGT | 9.31 | IAFCGTSGT | 0.5 | WVFCGTSGT | 0.1 |
| NA | N2 | 462 | 0.66 | yes | 2 | 0.3 | 99.06 | WFCGTSGTY | 88.72 | WFCGTSGT | 9.37 | IAFCGTSGTY | 0.5 | | |
| NA | N2 | 463 | 0.19 | yes | 3 | 0.29 | 99.1 | VFCGTSGTYG | 98.13 | AFCGTSGTYG | 0.97 | | | | |
| NA | N2 | 464 | 0.2 | yes | 4 | 0.44 | 99.07 | FCGTSGTYGT | 98.13 | FCGTSGTYGA | 0.73 | FCGTSGTYGT | 0.21 | | |
| NA | N2 | 465 | 0.2 | yes | 2 | 0.48 | 99.1 | CGTSGTYGTG | 98.14 | CGTSGTYGAG | 0.75 | CGTSGTYGTG | 0.21 | | |
| NA | N2 | 466 | 0.22 | yes | 4 | 0.5 | 99.11 | GTSGTYGTGS | 97.98 | GTSGTYGAGS | 0.75 | GTSGTYGTG | 0.21 | | |
| NA | N2 | 467 | 0.23 | yes | 4 | 0.5 | 99.1 | TSGTYGTGSW | 97.87 | TSGTYGAGSW | 0.75 | TSGTYGTGTW | 0.21 | | |
| NA | N2 | 468 | 0.24 | yes | 5 | 0.83 | 99.03 | SGTYGTGSWP | 97.8 | SGTYGAGSWP | 0.76 | SGTYGTGTWP | 0.22 | SGTYGKGSWP | 0.14 |
| NA | N2 | 469 | 0.21 | yes | 4 | 1.38 | 99.1 | GTYGTGSWPD | 97.98 | GTYGAGSWPD | 0.79 | GTYGTGTWPD | 0.22 | | |
| NA | N2 | 470 | 0.2 | yes | 4 | 5.51 | 99.2 | TYGTGSWPDG | 98.11 | TYGAGSWPDG | 0.66 | TYGTGTWPDG | 0.22 | | |
| NA | N2 | 471 | 0.22 | yes | 4 | 5.81 | 99.19 | YGTGSWPDGA | 97.99 | YGAGSWPDGA | 0.66 | YGTGTWPDGA | 0.22 | | |
| NA | N2 | 480 | 0 | yes | 1 | 6.04 | 99.07 | RTSSCLYKL | 100 | | | | | | |
| NA | N2 | 481 | 2.13 | no | 5 | 99.99 | 100 | ADINLHAYIS | 42.86 | TSISCLYKLS | 14.3 | ADIKSHAYIS | 14.29 | ANINFMPYIS | 14.29 |
| NA | N2 | 482 | 1.79 | no | 4 | 99.9 | 100 | DINLHAYISF | 50 | NINFMPYISF | 16.7 | SISCLYKLSQ | 16.67 | | |
| NA | N2 | 483 | 1.37 | no | 3 | 99.92 | 100 | INLHAYISFR | 60 | INFMPYISFA | 20 | ISCLYKLSQF | 20 | | |
| NA | N2 | 484 | 0 | no | 1 | 99.93 | 100 | NLHAYISFRN | 100 | | | | | | |
| NA | N2 | 485 | 0 | yes | 1 | 99.96 | 100 | LHAYISFRNL | 100 | | | | | | |
| NA | N3 | 27 | 1.27 | yes | 4 | 0 | 99.19 | GNLVFNTVIH | 56.71 | GNLIFNTVIH | 38.8 | GNLAFMAVIH | 3.05 | GNLIFNAVIH | 0.61 |
| NA | N3 | 89 | 0.47 | yes | 3 | 0.2 | 99.19 | LPLCPFRGFF | 93.08 | LPLCPFKGFF | 3.26 | LPLCPFQGFF | 2.85 | | |
| NA | N3 | 90 | 0.47 | yes | 3 | 0.2 | 99.19 | PLCPFRGFFP | 93.08 | PLCPFKGFFP | 3.26 | PLCPFQGFFP | 2.85 | | |
| NA | N3 | 91 | 0.47 | yes | 3 | 0.2 | 99.19 | LCPFRGFFPF | 93.08 | LCPFKGFFPF | 3.26 | LCPFQGFFPF | 2.85 | | |
| NA | N3 | 92 | 0.45 | yes | 3 | 0.2 | 99.39 | CPFRGFFPF | 93.28 | CPFKGFFPF | 3.26 | CPFQGFFPF | 2.85 | | |
| NA | N3 | 93 | 0.45 | yes | 3 | 0.2 | 99.39 | PFRGFFPFH | 93.28 | PFKGFFPFH | 3.26 | PFQGFFPFH | 2.85 | | |
| NA | N3 | 94 | 0.45 | yes | 3 | 0.2 | 99.39 | FRGFFPFHK | 93.28 | FKGFFPFHK | 3.26 | FQGFFPFHK | 2.85 | | |
| NA | N3 | 95 | 0.43 | yes | 3 | 0.2 | 99.39 | RGFFPFHKD | 93.28 | KGFFPFHKD | 3.26 | QGFFPFHKD | 3.26 | | |
| NA | N3 | 96 | 0.02 | yes | 1 | 0 | 99.8 | GFFPFHKDNA | 99.8 | | | | | | |
| NA | N3 | 97 | 0.32 | yes | 3 | 0 | 99.8 | FFPFHKDNAI | 95.33 | FFPFHKDNAL | 3.25 | FFPFHKDNAV | 1.22 | | |
| NA | N3 | 98 | 0.32 | yes | 3 | 0 | 99.59 | FPFHKDNAIR | 95.33 | FPFHKDNALR | 3.25 | FPFHKDNAVR | 1.22 | | |
| NA | N3 | 99 | 0.34 | yes | 3 | 0 | 99.59 | PFHKDNAIRL | 95.12 | PFHKDNALRL | 3.25 | PFHKDNAVRL | 1.22 | | |
| NA | N3 | 100 | 0.34 | yes | 3 | 0 | 99.59 | FHKDNAIRLG | 95.12 | FHKDNALRLA | 3.25 | FHKDNAVRLG | 1.22 | | |
| NA | N3 | 101 | 0.4 | yes | 4 | 0 | 94.51 | HKDNAIRLGE | 94.51 | HKDNALRLAE | 3.25 | HKDNAVRLGE | 1.22 | | |
| NA | N3 | 102 | 0.69 | yes | 5 | 0 | 89.43 | KDNAIRLGEN | 89.43 | KDNALRLAEN | 5.08 | KDNAVRLGEN | 3.25 | KDNAIRLGET | 0.61 |
| NA | N3 | 115 | 0.59 | yes | 3 | 0 | 89.63 | IVTREPYISC | 89.63 | IVTREPYISCD | 8.33 | IITREPYISC | 1.22 | IVTREPCVSC | 0.2 |
| NA | N3 | 116 | | yes | | | | VTREPYISCD | | VTREPYYSCD | | | | | |

FIG. 74-11

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N3 | 117 | 0.92 | yes | 4 | 0 | 99.39 | TREPYYSCDN | 83.13 | TREPYYSCDN | 8.33 | TREPYYSCDY | 6.3 | | |
| NA | N3 | 128 | 1.32 | yes | 5 | 0 | 99.19 | NCWSFALAQG | 63.41 | DCWSFALAQG | 29.9 | GCWSFALAQG | 3.66 | | |
| NA | N3 | 129 | 0.17 | yes | 3 | 0 | 99.39 | CWSFALAQGA | 98.17 | CWSFALAQGT | 0.81 | CWSFALAQGV | 0.41 | VCWSFALAQG | 0.41 |
| NA | N3 | 130 | 0.17 | yes | 4 | 0 | 99.39 | WSFALAQGAL | 98.17 | WSFALAQGTL | 0.81 | WSFALAQGAL | 0.41 | | |
| NA | N3 | 131 | 0.5 | yes | 4 | 0 | 99.39 | SFALAQGALL | 91.87 | SFALAQGTLL | 6.3 | SFALAQGVLL | 0.81 | SFALAQGVLL | 0.41 |
| NA | N3 | 132 | 0.5 | yes | 4 | 0 | 99.39 | FALAQGALLG | 91.87 | FALAQGTLLG | 6.3 | FALAQGVLLG | 0.81 | FALAQGVLLG | 0.41 |
| NA | N3 | 133 | 0.52 | yes | 4 | 0 | 99.39 | ALAQGALLGT | 91.67 | ALAQGTLLGT | 6.3 | ALAQGALVGT | 0.81 | ALSQGALLGT | 0.41 |
| NA | N3 | 139 | 0.99 | yes | 5 | 0.2 | 99.19 | LLGTKHSNGT | 82.52 | LVGTKHSNGT | 6.3 | LVGTRHSNGT | 0.81 | LLGTRHSNGT | 4.07 |
| NA | N3 | 144 | 0.46 | yes | 5 | 0 | 99.19 | HSNGTIKDRT | 93.89 | HSNGTIKDRT | 3.26 | HSNGTIKDRT | 1.02 | HSNGTIKDRA | 0.61 |
| NA | N3 | 150 | 0.33 | yes | 5 | 0 | 99.19 | KDRTPYRSLI | 96.14 | EDRTPYRSLI | 1.63 | KDRAPYRSLI | 0.61 | RDRTPYRSLI | 0.41 |
| NA | N3 | 151 | 0.44 | yes | 5 | 0 | 99.19 | DRTPYRSLIR | 94.31 | DRTSYRSLIR | 2.44 | DRTPYRSLI | 1.63 | DRAPYRSLIR | 0.41 |
| NA | N3 | 152 | 0.44 | yes | 5 | 0 | 99.19 | RTPYRSLIRF | 94.31 | RTSYRSLIRF | 2.44 | RTPYRSLIK | 1.63 | RAPYRSLIRF | 0.41 |
| NA | N3 | 153 | 0.42 | yes | 5 | 0 | 99.19 | TPYRSLIRFP | 94.31 | TSYRSLIRFP | 2.44 | TPYRSLIK | 1.83 | TPYRSLIKFP | 0.41 |
| NA | N3 | 155 | 0.45 | yes | 3 | 0 | 99.39 | YRSLIRFPIG | 94.51 | YRSLIRFPVG | 2.03 | YRSLIQFPMG | 2.03 | YRSLIKFPIG | 0.41 |
| NA | N3 | 176 | 1.19 | yes | 1 | 0 | 99.19 | CIAWSSSSCF | 54.27 | CAAWSSSSCF | 42.9 | | | | |
| NA | N3 | 177 | 1.17 | yes | 1 | 0 | 99.39 | IAWSSSSCFD | 54.47 | AAWSSSSCFD | 42.9 | | | | |
| NA | N3 | 178 | 0.06 | yes | 2 | 0 | 99.39 | AWSSSSCFDG | 99.39 | WSSSSCFDGR | 2.85 | | | | |
| NA | N3 | 179 | 0.25 | yes | 2 | 0 | 99.19 | WSSSSCFDGK | 96.54 | SSSSCFDGRE | 2.85 | | | | |
| NA | N3 | 180 | 0.27 | yes | 2 | 0 | 99.19 | SSSSCFDGKE | 96.34 | SSSCFDGREW | 2.85 | | | | |
| NA | N3 | 181 | 0.27 | yes | 3 | 0 | 99.18 | SSSCFDGKEW | 93.27 | SSCFDGREWM | 3.06 | SSCFDGREWM | 2.86 | | |
| NA | N3 | 182 | 0.46 | yes | 3 | 0 | 99.39 | SSCFDGKEWM | 93.67 | SCFDGREWMH | 3.06 | SCFDGREWMH | 2.86 | | |
| NA | N3 | 183 | 0.43 | yes | 3 | 0 | 99.18 | SCFDGKEWMH | 87.14 | CFDGKEWLHV | 6.53 | CFDGREWMHV | 2.86 | CFDGREWMHV | 2.86 |
| NA | N3 | 184 | 0.78 | yes | 4 | 0.41 | 98.18 | CFDGKEWMHV | 86.94 | FDGKEWMHIC | 6.53 | FDGKEWLHV | 6.53 | FDGREWMHVC | 2.86 |
| NA | N3 | 185 | 0.8 | yes | 5 | 0.41 | 86.6 | FDGKEWMHVC | 86.6 | KDILRTQESE | 9.28 | NNILRTQESE | 2.86 | KNILRTQESE | 1.65 |
| NA | N3 | 267 | 0.78 | yes | 2 | 0.41 | 96.49 | KDILRTQESE | 96.49 | NIILRTQESE | 3.3 | RNILRTQESE | 0.41 | | |
| NA | N3 | 268 | 0.23 | yes | 1 | 0.41 | 99.59 | DILRTQESEC | 99.59 | | | | | | |
| NA | N3 | 269 | 0.25 | yes | 2 | 1.42 | 99.38 | ILRTQESECQ | 99.38 | RTQESECQCL | 3.3 | | | | |
| NA | N3 | 270 | 0.04 | yes | 1 | 1.42 | 99.18 | LRTQESECQC | 99.18 | RTQESECQCL | 3.3 | | | | |
| NA | N3 | 271 | 0.06 | yes | 1 | 1.42 | 99.8 | RTQESECQCI | 95.88 | KIIKHLEECSC | 6.35 | RIQHLEECSC | 3.3 | | |
| NA | N3 | 319 | 0.29 | yes | 2 | 0.81 | 99.8 | KIQHLEECSC | 86.48 | KIIKHLEECSC | 6.35 | KVQHLEECSC | 1.43 | KIRHLEECSC | 0.82 |
| NA | N3 | 320 | 0.8 | yes | 5 | 0.81 | 91.19 | IQHLEECSCY | 88.73 | IKHLEECSCY | 6.35 | IRHLEECSCY | 0.82 | | |
| NA | N3 | 321 | 0.54 | yes | 4 | 0.81 | 95.7 | QHLEECSCYV | 95.7 | KHLEECSCYV | 6.35 | RHLEECSCYV | 0.82 | | |
| NA | N3 | 322 | 0.69 | yes | 4 | 0.81 | 99.59 | HLEECSCYVD | 88.73 | KHLEECSCYV | 3.28 | HLEECSCYMD | 0.61 | | |
| NA | N3 | 333 | 1 | yes | 2 | 0.81 | 99.18 | DYYCICRDNW | 80.94 | DYYCVCRDNW | 9.43 | DIYCVCRDNW | 2.46 | | |
| NA | N3 | 334 | 1.02 | yes | 2 | 0.81 | 99.18 | YYCICRDNWK | 80.74 | YYCVCRDNWK | 9.43 | IYCVCRDNWK | 2.46 | | |
| NA | N3 | 335 | 0.59 | yes | 4 | 0.81 | 99.39 | YCICRDNWKG | 87.5 | YCVCRDNWKG | 11.9 | | | | |
| NA | N3 | 336 | 0.61 | yes | 2 | 0.81 | 99.18 | CICRDNWKGS | 87.3 | CVCRDNWKGS | 11.9 | | | | |
| NA | N3 | 337 | 0.57 | yes | 2 | 0.81 | 99.59 | ICRDNWKGSN | 87.5 | VCRDNWKGSN | 12.1 | | | | |
| NA | N3 | 338 | 0.04 | yes | 1 | 0.81 | 99.59 | CRDNWKGSNR | 99.59 | | | | | | |
| NA | N3 | 339 | 0.04 | yes | 1 | 0.81 | 99.59 | RDNWKGSNRP | 99.59 | | | | | | |
| NA | N3 | 340 | 0.04 | yes | 1 | 0.81 | 99.59 | DNWKGSNRPW | 99.59 | | | | | | |
| NA | N3 | 341 | 0.3 | yes | 3 | 0.81 | 95.7 | NWKGSNRPWM | 95.7 | NWKGSNRPWV | 3.28 | NWKGSNRPWI | 0.61 | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N3 | 466 | 1.56 | yes | 4 | 0 | 99.39 | CFYIELIRGR | 55.28 | CFYIELIRGK | 11.18 | CFYIELTRGV | 3.25 | | |
| NA | N3 | 482 | 0.21 | yes | 4 | 0 | 99.19 | VSWTSNSIWT | 97.76 | VSWASNSIVT | 0.61 | VSWTGNSIVT | 0.2 | | |
| NA | N3 | 483 | 0.21 | yes | 4 | 0 | 99.19 | SWTSNSMYTF | 97.76 | SWASNSIWTF | 0.61 | SWTSNSIITF | 0.2 | | |
| NA | N3 | 484 | 0.19 | yes | 3 | 0 | 99.19 | WTSNSMVTFC | 97.97 | WTSNSMVTFC | 0.61 | | | | |
| NA | N3 | 485 | 0.19 | yes | 3 | 0 | 99.19 | TSNSIVTFCG | 97.97 | ASNSIVTFCG | 0.61 | | | | |
| NA | N3 | 486 | 0.14 | yes | 2 | 0 | 99.19 | SNSMVTFCGL | 98.58 | | | | | | |
| NA | N3 | 487 | 0.27 | yes | 3 | 0.2 | 99.19 | NSIVTFCGLD | 96.74 | NSMVTFCGLD | 1.83 | SIITFCGLDN | 0.2 | | |
| NA | N3 | 488 | 0.29 | yes | 3 | 0.2 | 99.19 | SIVTFCGLDN | 96.54 | SMVTFCGLDN | 1.83 | IVTFCGLDBE | 0.2 | | |
| NA | N3 | 489 | 0.29 | yes | 3 | 0.41 | 99.18 | IVTFCGLDNE | 96.53 | MVTFCGLDNE | 1.84 | | | | |
| NA | N3 | 490 | 0.2 | yes | 2 | 0.41 | 99.19 | VTFCGLDNEP | 97.55 | VTFCGLDNEP | 1.84 | | | | |
| NA | N3 | 491 | 0.21 | yes | 2 | 1.02 | 99.39 | TFCGLNNEPG | 97.33 | TFCGLNNEPG | 1.85 | | | | |
| NA | N3 | 492 | 0.2 | yes | 2 | 1.22 | 99.18 | FCGLNNEPGS | 97.53 | FCGLNNEPGS | 1.85 | | | | |
| NA | N3 | 493 | 0.24 | yes | 3 | 3.46 | 99.38 | CGLNNEPGSG | 97.12 | CGLDNEPGSE | 0.41 | DNEPGSGSWP | 0.21 | | |
| NA | N3 | 496 | 0.16 | yes | 2 | 3.86 | 98.95 | NNEPGSGNWP | 96.2 | DNEPGSGDWP | 0.84 | | | | |
| NA | N3 | 497 | 0.39 | yes | 4 | 4.67 | 98.31 | NEPGSGDWPD | 0.85 | | | | | | |
| NA | N3 | 498 | 0.35 | yes | 5 | 5.28 | 99.15 | EPGSGDWPDG | 0.85 | | | | | | |
| NA | N3 | 499 | 0.35 | yes | 5 | 9.35 | 98.93 | PGSGNWPDGA | 3.01 | PGSGDWPDGS | 0.86 | PGSGNWPDGP | 0.43 | | |
| NA | N3 | 504 | 0.31 | yes | 3 | 9.35 | 99.1 | WPDGANIGFM | 2.24 | WPDGSDIGFM | 0.67 | WPDGYNIGFM | 0.22 | WPDGANIGLC | 0.22 |
| NA | N3 | 505 | 0.31 | no | 3 | 11.99 | 99.1 | PDGANIGFMP | 2.24 | PDGSDIGFMP | 0.67 | PDGSKIGFMP | 0.22 | PDGANIGLCP | 0.22 |
| NA | N3 | 506 | 0.24 | no | 3 | 16.26 | 99.08 | DGANIGFMPK | 2.31 | DGSDIGFMPK | 0.69 | | | | |
| NA | N4 | 1 | 0.24 | no | 3 | 16.26 | 99.03 | MNPNQKIITI | 0.97 | MNPNQSIITI | 0.97 | | | | |
| NA | N4 | 2 | 1.05 | yes | 1 | 16.26 | 99.03 | NPNQKIITIG | 0.97 | NPNQMIITIG | 0.97 | | | | |
| NA | N4 | 3 | 1.69 | yes | 1 | 0 | 99.03 | PNQKIITIGS | 0.97 | PNQSIITIGS | 0.97 | | | | |
| NA | N4 | 17 | 1.69 | yes | 2 | 0 | 99.19 | LTTVGLLLQI | 64.23 | LTTIGPLLQI | 34.2 | | | | |
| NA | N4 | 18 | 0.89 | yes | 2 | 0 | 99.19 | TTVGLLLQIT | 43.09 | TTIGLLLQIT | 33.3 | TTIGLLLQII | 0.81 | TTIGPLLQIT | 0.81 |
| NA | N4 | 19 | 0.89 | yes | 2 | 0 | 99.19 | TVGLLLQITS | 43.09 | TIGLLLQITS | 33.3 | TIGPLLQITS | 0.81 | TIGLLLQIIS | 0.81 |
| NA | N4 | 20 | 0.82 | yes | 2 | 0 | 99.19 | VGLLLQITSL | 43.09 | IGLLLQIISL | 33.3 | VGLLLQVTSL | 0.81 | IGLLLQIISL | 0.81 |
| NA | N4 | 21 | 0.82 | yes | 2 | 0 | 76.42 | GLLLQITSLC | 76.42 | GLLLQIISLC | 22 | | | | |
| NA | N4 | 22 | 0.82 | yes | 2 | 0 | 76.42 | LLLQITSLCS | 77.24 | LLQIISLCSI | 22 | | | | |
| NA | N4 | 23 | 0.82 | yes | 2 | 0 | 77.24 | LLQITSLCSI | 77.24 | LLQIISLCSI | 22 | | | | |
| NA | N4 | 24 | 0.82 | yes | 2 | 0 | 77.24 | LQITSLCSIW | 77.24 | LQIISLCSIW | 22 | | | | |
| NA | N4 | 25 | 0.76 | yes | 2 | 0 | 77.24 | QITSLCSIWF | 77.24 | QIISLCSIWF | 22 | | | | |
| NA | N4 | 26 | 0 | yes | 1 | 0 | 78.05 | ITSLCSIWFS | 78.05 | IISLCSIWFS | 22 | | | | |
| NA | N4 | 27 | 0 | yes | 1 | 0 | 100 | TSLCSIWFSH | 100 | ISLCSIWFSH | | | | | |
| NA | N4 | 28 | 0 | yes | 1 | 0 | 100 | SLCSIWFSHY | 100 | | | | | | |
| NA | N4 | 29 | 0.6 | yes | 2 | 0 | 100 | LCSIWFSHYN | 100 | | | | | | |
| NA | N4 | 30 | 0.76 | yes | 4 | 0 | 99.19 | CSIWFSHYNQ | 86.99 | | | | | | |
| NA | N4 | 31 | 0.76 | yes | 4 | 0 | 99.19 | SIWFSHYNQM | 86.18 | SIWFSHYNQM | 12.2 | IWFSHYNQIT | 2.44 | IWFSHYNQIT | 0.81 |
| NA | N4 | 32 | 1.03 | yes | 5 | 0 | 99.19 | IWFSHYNQMT | 86.18 | IWFSHYNQMT | 9.76 | IWFSHYNQIT | 2.44 | WFSHYNOVAQ | 0.81 |
| NA | N4 | 33 | 1.03 | yes | 5 | 0 | 99.19 | WFSHYNQMTQ | 86.18 | WFSHYNQVT | 9.76 | WFSHYNOVTQ | 2.44 | FSHYNQMKQA | 2.44 |
| NA | N4 | 34 | 1.03 | yes | 5 | 0 | 81.3 | FSHYNQMTQA | 81.3 | FSHYNQVTQP | 9.76 | FSHYNQVTQT | 4.88 | FSHYNQITQT | 0.81 |
| NA | N4 | 48 | 0.44 | yes | 2 | 0 | 91.87 | CSNDTINYYN | 91.87 | CSNDTINYYN | 7.32 | | | | |

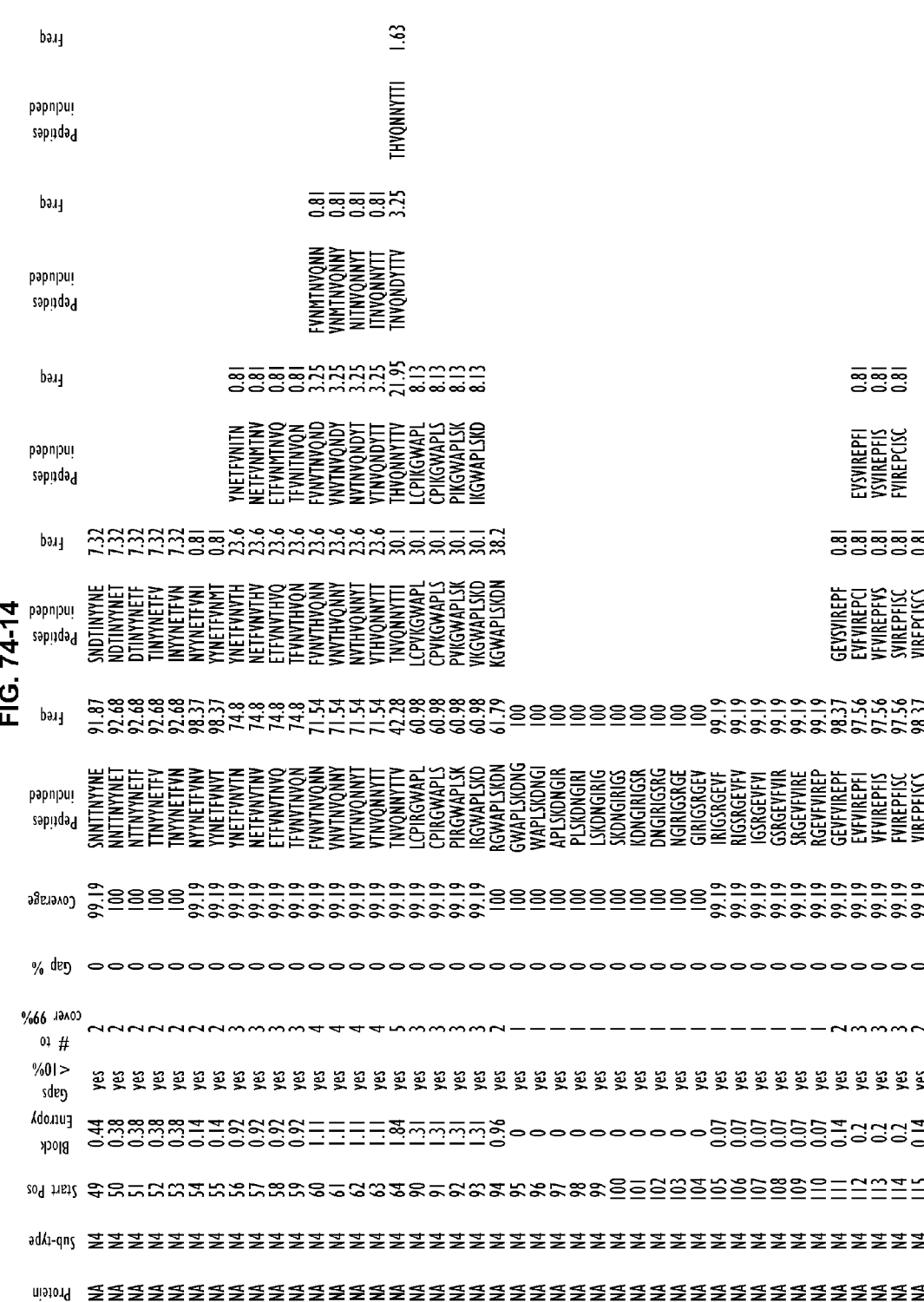

FIG. 74-15

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 116 | 0.26 | yes | 3 | 0 | 99.19 | IREPFISCSI | 96.75 | IREPFVSCSI | 1.63 | | | | |
| NA | N4 | 121 | 1.48 | yes | 5 | 0 | 99.19 | ISCSISECRT | 46.34 | ISCSIDECRT | 44.7 | ISCVSECRT | 1.63 | ISCSIHECRT | 0.81 |
| NA | N4 | 122 | 1.46 | yes | 5 | 0 | 100 | SCSISECRTF | 46.34 | SCSIDECRTF | 44.7 | SCVSECRTF | 1.63 | SCSIHECRTF | 1.63 |
| NA | N4 | 123 | 1.46 | yes | 5 | 0 | 100 | CSISECRTF | 46.34 | CSIDECRTF | 44.7 | CVSECRTF | 1.63 | CSIHECRTF | 1.63 |
| NA | N4 | 124 | 1.46 | yes | 5 | 0 | 100 | SISECRTFFL | 46.34 | SIDECRTFFL | 44.7 | SVSECRTFFL | 1.63 | SIHECRTFFL | 1.63 |
| NA | N4 | 125 | 1.46 | yes | 5 | 0 | 100 | ISECRTFFLT | 46.34 | IDECRTFFLT | 44.7 | IHECRTFFLT | 1.63 | VSECRTFFLT | 1.63 |
| NA | N4 | 126 | 1.36 | yes | 4 | 0 | 100 | SECRTFFLTQ | 47.97 | DECRTFFLTQ | 44.7 | HECRTFFLTQ | 1.63 | | |
| NA | N4 | 127 | 0 | yes | 1 | 0 | 100 | ECRTFFLTQG | 100 | | | | | | |
| NA | N4 | 128 | 0 | yes | 1 | 0 | 100 | CRTFFLTQGA | 100 | | | | | | |
| NA | N4 | 129 | 0 | yes | 1 | 0 | 100 | RTFFLTQGAL | 100 | | | | | | |
| NA | N4 | 130 | 0 | yes | 1 | 0 | 100 | TFFLTQGALL | 100 | | | | | | |
| NA | N4 | 131 | 0 | yes | 1 | 0 | 100 | FFLTQGALLN | 100 | | | | | | |
| NA | N4 | 132 | 0 | yes | 1 | 0 | 100 | FLTQGALLND | 100 | | | | | | |
| NA | N4 | 133 | 0 | yes | 1 | 0 | 100 | LTQGALLNDK | 100 | | | | | | |
| NA | N4 | 134 | 0 | yes | 1 | 0 | 100 | TQGALLNDKH | 100 | | | | | | |
| NA | N4 | 135 | 0 | yes | 1 | 0 | 100 | QGALLNDKHS | 100 | | | | | | |
| NA | N4 | 136 | 0 | yes | 1 | 0 | 100 | GALLNDKHSN | 100 | | | | | | |
| NA | N4 | 137 | 0 | yes | 1 | 0 | 100 | ALLNDKHSNG | 100 | | | | | | |
| NA | N4 | 138 | 0 | yes | 1 | 0 | 100 | LLNDKHSNGT | 100 | | | | | | |
| NA | N4 | 139 | 0 | yes | 1 | 0 | 100 | LNDKHSNGTV | 100 | | | | | | |
| NA | N4 | 140 | 0 | yes | 1 | 0 | 100 | NDKHSNGTVK | 100 | | | | | | |
| NA | N4 | 141 | 0 | yes | 1 | 0 | 100 | DKHSNGTVKD | 100 | | | | | | |
| NA | N4 | 142 | 0 | yes | 1 | 0 | 100 | KHSNGTVKDR | 100 | | | | | | |
| NA | N4 | 143 | 0 | yes | 1 | 0 | 100 | HSNGTVKDRS | 100 | | | | | | |
| NA | N4 | 144 | 0 | yes | 1 | 0 | 100 | SNGTVKDRSP | 100 | | | | | | |
| NA | N4 | 145 | 0 | yes | 1 | 0 | 100 | NGTVKDRSPF | 100 | | | | | | |
| NA | N4 | 146 | 0 | yes | 1 | 0 | 100 | GTVKDRSPFR | 100 | | | | | | |
| NA | N4 | 147 | 0 | yes | 1 | 0 | 100 | TVKDRSPFRT | 100 | | | | | | |
| NA | N4 | 148 | 0 | yes | 1 | 0 | 100 | VKDRSPFRTL | 100 | | | | | | |
| NA | N4 | 149 | 0 | yes | 1 | 0 | 100 | KDRSPFRTLM | 100 | | | | | | |
| NA | N4 | 150 | 0 | yes | 1 | 0 | 100 | DRSPFRTLMS | 100 | | | | | | |
| NA | N4 | 151 | 0 | yes | 1 | 0 | 100 | RSPFRTLMSC | 100 | | | | | | |
| NA | N4 | 152 | 0.07 | yes | 1 | 0 | 99.19 | SPFRTLMSCP | 99.19 | | | | | | |
| NA | N4 | 153 | 0.47 | yes | 3 | 0 | 92.68 | PFRTLMSCPI | 92.68 | PRTLMSCPM | 4.88 | PRTLMSCPV | 1.63 | | |
| NA | N4 | 154 | 0.47 | yes | 3 | 0 | 92.68 | FRTLMSCPIG | 92.68 | FRTLMSCPMG | 4.88 | FRTLMSCPVG | 1.63 | | |
| NA | N4 | 155 | 0.47 | yes | 3 | 0 | 92.68 | RTLMSCPIGV | 92.68 | RTLMSCPMGV | 4.88 | RTLMSCPVGV | 1.63 | | |
| NA | N4 | 156 | 0.53 | yes | 4 | 0 | 91.87 | TLMSCPIGVA | 91.87 | TLMSCPMGVA | 4.88 | TLMSCPVGVA | 1.63 | TLMSCPIGV | 0.81 |
| NA | N4 | 157 | 0.53 | yes | 4 | 0 | 91.87 | LMSCPIGVAP | 91.87 | LMSCPMGVAP | 4.88 | LMSCPVGVAP | 1.63 | LMSCHIGVAP | 0.81 |
| NA | N4 | 158 | 0.53 | yes | 4 | 0 | 91.87 | MSCPIGVAPS | 91.87 | MSCPMGVAPS | 4.88 | MSCPVGVAPS | 1.63 | MSCPIGWPS | 0.81 |
| NA | N4 | 159 | 0.53 | yes | 4 | 0 | 91.87 | SCPIGVAPSP | 91.87 | SCPMGVAPSP | 4.88 | SCPVGVAPSP | 1.63 | SCPIGWPSP | 0.81 |
| NA | N4 | 160 | 0.53 | yes | 4 | 0 | 91.87 | CPIGVAPSPS | 91.87 | CPMGVAPSPS | 4.88 | CPVGVAPSPS | 1.63 | CHIGVAPSPS | 0.81 |
| NA | N4 | 161 | 0.53 | yes | 4 | 0 | 91.87 | PIGVAPSPSN | 91.87 | PMGVAPSPSN | 4.88 | PVGVAPSPSN | 1.63 | HIGVAPSPSN | 0.81 |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 246 | 0.42 | yes | 3 | 0 | 99.19 | SDAQAFYKIL | 93.5 | SNAQAFYKIL | 4.88 | | | | |
| NA | N4 | 247 | 0.42 | yes | 3 | 0 | 99.19 | DAQAFYKILK | 93.5 | NAQAFYKILK | 4.88 | | | | |
| NA | N4 | 248 | 0.14 | yes | 2 | 0 | 99.19 | AQAFYKILKI | 98.37 | GQAFYKILKI | 0.81 | | | | |
| NA | N4 | 249 | 0.67 | yes | 2 | 0 | 99.19 | QAFYKILKIR | 84.55 | QAFYKILKIR | 14.6 | | | | |
| NA | N4 | 250 | 0.67 | yes | 2 | 0 | 99.19 | AFYKILKIRK | 84.55 | AFYKILKIRK | 14.6 | | | | |
| NA | N4 | 251 | 0.67 | yes | 2 | 0 | 99.19 | FYKILKIRKG | 84.55 | FYKILKIRKG | 14.6 | | | | |
| NA | N4 | 252 | 0.67 | yes | 3 | 0 | 99.19 | YKILKIRKGK | 84.55 | YKILKIRKG | 14.6 | | | | |
| NA | N4 | 253 | 0.71 | yes | 3 | 0 | 99.19 | KILKIRKGKI | 84.55 | KILKIKKGKI | 13.8 | | | | |
| NA | N4 | 254 | 1.09 | yes | 5 | 0 | 99.19 | ILKIRKGKIV | 78.05 | ILKIKKGKI | 13 | KILKIKKGKL | 0.81 | ILKIKKGKIM | 0.81 | |
| NA | N4 | 270 | 0.68 | yes | 2 | 0 | 99.19 | LKIRKGKIV | 89.43 | ATGFHEECS | 5.69 | ILKIRKGKIV | 0.81 | LKIRKGKIV | 0.81 |
| NA | N4 | 271 | 0.68 | yes | 2 | 0 | 99.19 | ATGFHEECS | 89.43 | APGFHEECS | 5.69 | ATGFHLEECS | 2.44 | AAGFHEECSC | 0.81 |
| NA | N4 | 272 | 0.38 | yes | 3 | 0 | 99.19 | TGFHEECSCY | 93.5 | PGFHEECSC | 5.69 | AGFHEECSC | 2.44 | IGFHEECSC | 0.81 |
| NA | N4 | 273 | 0.07 | yes | 2 | 0 | 99.19 | GFHEECSCYP | 93.5 | GYHFEECSCY | 5.69 | | | | |
| NA | N4 | 274 | 0.14 | yes | 2 | 0 | 99.19 | FHEECSCYPS | 99.19 | YHFEECSCYP | 5.69 | | | | |
| NA | N4 | 275 | 0.89 | yes | 4 | 0 | 99.19 | HEECSCYPSG | 73.17 | FEECSCYPSR | 0.81 | | | | |
| NA | N4 | 276 | 1.03 | yes | 5 | 0 | 99.19 | EECSCYPSGT | 73.17 | EECSCYPSGE | 26 | ECSCYPSGES | 1.63 | ECSCYPSREN | 0.81 | |
| NA | N4 | 277 | 1.5 | yes | 5 | 0 | 99.19 | ECSCYPSGTD | 60.16 | ECSCYPSGE | 23.6 | DVECVCRDNW | 13.82 | NIECVCRDNW | 0.81 | SVECVCRDNW | 0.81 |
| NA | N4 | 286 | 1.02 | yes | 4 | 0 | 99.19 | DIECVCRDNW | 61.79 | NVECVCRDNW | 23.6 | | | | |
| NA | N4 | 287 | 0.07 | yes | 2 | 0 | 99.19 | IECVCRDNWR | 99.19 | VECVCRDNWR | 37.4 | | | | |
| NA | N4 | 288 | 0.07 | yes | 2 | 0 | 99.19 | ECVCRDNWRG | 99.19 | | | | | | |
| NA | N4 | 289 | 0.07 | yes | 2 | 0 | 99.19 | CVCRDNWRGS | 99.19 | | | | | | |
| NA | N4 | 290 | 0.07 | yes | 2 | 0 | 99.19 | VCRDNWRGSN | 99.19 | | | | | | |
| NA | N4 | 291 | 0.07 | yes | 2 | 0 | 99.19 | CRDNWRGSNR | 99.19 | | | | | | |
| NA | N4 | 292 | 0.07 | yes | 2 | 0 | 99.19 | RDNWRGSNRP | 99.19 | | | | | | |
| NA | N4 | 293 | 0.07 | yes | 2 | 0 | 99.19 | DNWRGSNRPW | 99.19 | NWRGSNRPWV | 0.81 | | | | |
| NA | N4 | 294 | 0.14 | yes | 3 | 0 | 99.19 | NWRGSNRPWI | 98.37 | WQGSNRPWIR | 0.81 | | | | |
| NA | N4 | 295 | 0.14 | yes | 3 | 0 | 99.19 | WRGSNRPWIR | 98.37 | RGSNRPWVRF | 0.81 | | | | |
| NA | N4 | 296 | 0.14 | yes | 3 | 0 | 99.19 | RGSNRPWIRF | 98.37 | | | | | | |
| NA | N4 | 297 | 0.07 | yes | 2 | 0 | 99.19 | GSNRPWIRFN | 99.19 | | | | | | |
| NA | N4 | 298 | 0.07 | yes | 2 | 0 | 99.19 | SNRPWIRFNS | 99.19 | | | | | | |
| NA | N4 | 299 | 0.38 | yes | 3 | 0 | 99.19 | NRPWIRFNSD | 93.5 | NRPWIRFNSN | 5.69 | RPWIRFNSDP | 0.81 | PWIRFNSDLN | 0.81 | |
| NA | N4 | 300 | 0.45 | yes | 4 | 0 | 99.19 | RPWIRFNSDL | 92.68 | RPWIRFNSML | 5.69 | PWIRFNSDLD | 0.81 | WIRFNSDLNY | 0.81 | |
| NA | N4 | 301 | 0.52 | yes | 4 | 0 | 99.19 | PWIRFNSDLD | 91.87 | PWIRFNSNLD | 5.69 | WWRFNSDLDY | 0.81 | IRFNSDLNYQ | 0.81 | |
| NA | N4 | 302 | 0.52 | yes | 4 | 0 | 99.19 | WIRFNSDLDY | 91.87 | WIRFNSNLDY | 5.69 | IRFNSDPDYQ | 0.81 | | | |
| NA | N4 | 303 | 0.52 | yes | 4 | 0 | 99.19 | IRFNSDLDYQ | 91.87 | IRFNSNLDYQ | 5.69 | RFNSDPDYQI | 0.81 | | | |
| NA | N4 | 304 | 0.45 | yes | 3 | 0 | 99.19 | RFNSDLDYQI | 92.68 | RFNSNLDYQI | 5.69 | FNSDPDYQIG | 0.81 | | | |
| NA | N4 | 305 | 0.45 | yes | 3 | 0 | 99.19 | FNSDLDYQIG | 92.68 | FNSNLDYQIG | 5.69 | NSDPDYQIGY | 0.81 | | | |
| NA | N4 | 306 | 0.82 | yes | 4 | 0 | 99.19 | NSDLDYQIGY | 85.37 | NSNLDYQIGY | 7.32 | SDLDYQIGYI | 5.69 | SDPDYQIGYV | 0.81 | |
| NA | N4 | 307 | 0.82 | yes | 4 | 0 | 99.19 | SDLDYQIGYV | 85.37 | SNLDYQIGYI | 7.32 | DLDYQIGYIC | 5.69 | DLNYQIGYIC | 0.81 | |
| NA | N4 | 308 | 0.51 | yes | 3 | 0 | 99.19 | DLDYQIGYVC | 91.06 | NLDYQIGYIC | 7.32 | LDYQIGYVCS | 5.69 | | | |
| NA | N4 | 309 | 0.44 | yes | 2 | 0 | 99.19 | LDYQIGYVCS | 91.87 | DYQIGYVCSG | 7.32 | PDYQIGYVCS | 0.81 | | | |
| NA | N4 | 310 | | yes | | 0 | 99.19 | DYQIGYVCSG | 91.87 | | | | | | |

FIG. 74-19

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 311 | 1.13 | yes | 3 | 0 | 99.19 | YQIGYVCSGI | 72.36 | YQIGYVCSGV | 19.5 | | | | |
| NA | N4 | 312 | 1.13 | yes | 3 | 0 | 99.19 | QIGYVCSGIF | 72.36 | QIGYVCSGVF | 19.5 | | | | |
| NA | N4 | 313 | 1.13 | yes | 3 | 0 | 99.19 | IGYVCSGIFG | 72.36 | IGYVCSGVFG | 19.5 | | | | |
| NA | N4 | 314 | 1.19 | yes | 4 | 0 | 99.19 | GYVCSGIFGD | 72.36 | GYVCSGVFGD | 19.5 | | | | |
| NA | N4 | 315 | 1.19 | yes | 4 | 0 | 99.19 | YVCSGIFGDN | 71.54 | YVCSGVFGDN | 19.5 | | | | |
| NA | N4 | 316 | 1.19 | yes | 2 | 0 | 99.19 | VCSGIFGDNP | 71.54 | VCSGVFGDNP | 19.5 | | | YICSGIFGDN | 0.81 | | |
| NA | N4 | 317 | 0.9 | yes | 3 | 0 | 99.19 | CSGIFGDNPR | 72.36 | CSGVFGDNPR | 26.8 | | | VCSGIFGDSP | 0.81 | | |
| NA | N4 | 318 | 0.97 | yes | 5 | 0 | 99.19 | SGIFGDNPRP | 71.54 | SGVFGDNPRP | 26.8 | SGIFGDSPRP | 0.81 | | | | |
| NA | N4 | 321 | 0.87 | yes | 5 | 0 | 99.19 | FGDNPRPADG | 83.74 | | | FGDNPRPMDS | 2.44 | FGDNPRPMDG | 0.81 | FGDNPRSVDG | 0.81 |
| NA | N4 | 325 | 1.14 | yes | 3 | 0 | 99.19 | PRPADGTGSC | 78.05 | | | PRPVDGIGSC | 6.5 | PRPMDSTGSC | 2.44 | PRSVDGTGSC | 0.81 |
| NA | N4 | 336 | 0.94 | yes | 2 | 0 | 99.19 | SPVNNGKGRY | 79.67 | | | SPINNGKGRY | 14.6 | | | | |
| NA | N4 | 337 | 0.78 | yes | 1 | 0 | 99.19 | PVNNGKGRYG | 79.67 | | | PINNGKGRYG | 19.5 | | | | |
| NA | N4 | 338 | 0.78 | yes | 1 | 0 | 99.19 | VNNGKGRYGV | 79.67 | | | INNGKGRYGV | 19.5 | | | | |
| NA | N4 | 339 | 0 | yes | 1 | 0 | 100 | NNGKGRYGVK | 100 | | | | | | | | |
| NA | N4 | 340 | 0 | yes | 1 | 0 | 100 | NGKGRYGVKG | 100 | | | | | | | | |
| NA | N4 | 341 | 0 | yes | 1 | 0 | 100 | GKGRYGVKGF | 100 | | | | | | | | |
| NA | N4 | 342 | 0 | yes | 1 | 0 | 100 | KGRYGVKGFS | 100 | | | | | | | | |
| NA | N4 | 343 | 0 | yes | 1 | 0 | 100 | GRYGVKGFSF | 100 | | | | | | | | |
| NA | N4 | 344 | 0 | yes | 1 | 0 | 100 | RYGVKGFSFR | 100 | | | | | | | | |
| NA | N4 | 345 | 0 | yes | 1 | 0 | 100 | YGVKGFSFRY | 100 | | | | | | | | |
| NA | N4 | 346 | 0.07 | yes | 1 | 0 | 99.19 | GVKGFSFRYG | 99.19 | | | | | | | | |
| NA | N4 | 347 | 0.07 | yes | 1 | 0 | 99.19 | VKGFSFRYGD | 99.19 | | | | | | | | |
| NA | N4 | 348 | 0.07 | yes | 1 | 0 | 99.19 | KGFSFRYGDG | 99.19 | | | | | | | | |
| NA | N4 | 349 | 0.07 | yes | 1 | 0 | 99.19 | GFSFRYGDGV | 99.19 | | | | | | | | |
| NA | N4 | 350 | 0.07 | yes | 1 | 0 | 99.19 | FSFRYGDGVW | 99.19 | | | | | | | | |
| NA | N4 | 351 | 0.07 | yes | 1 | 0 | 99.19 | SFRYGDGVWI | 99.19 | | | | | | | | |
| NA | N4 | 352 | 0.07 | yes | 1 | 0 | 99.19 | FRYGDGVWIG | 99.19 | | | | | | | | |
| NA | N4 | 353 | 0.07 | yes | 1 | 0 | 99.19 | RYGDGVWIGR | 99.19 | | | | | | | | |
| NA | N4 | 354 | 0.07 | yes | 1 | 0 | 99.19 | YGDGVWIGRT | 99.19 | | | | | | | | |
| NA | N4 | 355 | 0.14 | yes | 2 | 0 | 99.19 | GDGVWIGRTK | 99.19 | DGVWIGRTKN | 0.81 | | | | | | |
| NA | N4 | 356 | 0.14 | yes | 2 | 0 | 98.37 | DGVWIGRTKS | 98.37 | GVWIGRTKSL | 0.81 | | | | | | |
| NA | N4 | 357 | 0.07 | yes | 1 | 0 | 99.19 | GVWIGRTKSL | 99.19 | | | | | | | | |
| NA | N4 | 358 | 0.07 | yes | 1 | 0 | 99.19 | VWIGRTKSLE | 99.19 | | | | | | | | |
| NA | N4 | 359 | 0.07 | yes | 1 | 0 | 99.19 | WIGRTKSLES | 99.19 | | | | | | | | |
| NA | N4 | 360 | 0.14 | yes | 2 | 0 | 98.37 | IGRTKSLESR | 98.37 | GRTKSLESRR | 0.81 | | | | | | |
| NA | N4 | 361 | 0.14 | yes | 2 | 0 | 98.37 | GRTKSLESRS | 98.37 | RTKNLESRSG | 0.81 | | | | | | |
| NA | N4 | 362 | 0.14 | yes | 2 | 0 | 98.37 | RTKSLESRSG | 98.37 | TKSLESRGF | 0.81 | | | | | | |
| NA | N4 | 363 | 0.07 | yes | 1 | 0 | 98.37 | TKSLESRSGF | 98.37 | KNLESRSGFE | 0.81 | | | | | | |
| NA | N4 | 364 | 0.14 | yes | 2 | 0 | 98.37 | KSLESRSGFE | 98.37 | SLESRSGFEMI | 0.81 | | | | | | |
| NA | N4 | 365 | 0.14 | yes | 2 | 0 | 98.37 | SLESRSGFEM | 98.37 | LESRSGFEMV | 0.81 | | | | | | |
| NA | N4 | 366 | 0.44 | yes | 2 | 0 | 91.87 | LESRSGFEMY | 91.87 | ESRSGFEMIW | 7.32 | | | | | | |
| NA | N4 | 367 | 0.44 | yes | 2 | 0 | 91.87 | ESRSGFEMYW | 91.87 | | | | | | | | |

FIG. 74-21

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 410 | 0.28 | yes | 2 | 0 | 100 | RGETTGRNCT | 95.12 | | | | | | |
| NA | N4 | 411 | 0.56 | yes | 3 | 0 | 100 | GETTGRNCTV | 90.24 | | | | | | |
| NA | N4 | 412 | 0.28 | yes | 2 | 0 | 100 | ETTGRNCTVP | 95.12 | WETTGRNCTV | 4.88 | | | | |
| NA | N4 | 413 | 0.28 | yes | 2 | 0 | 100 | TTGRNCTVPC | 95.12 | | | | | | |
| NA | N4 | 414 | 0.35 | yes | 2 | 0 | 99.19 | TGRNCTVPCF | 94.31 | | | | | | |
| NA | N4 | 415 | 0.35 | yes | 2 | 0 | 99.19 | GRNCTVPCFW | 94.31 | | | | | | |
| NA | N4 | 416 | 0.35 | yes | 2 | 0 | 99.19 | RNCTVPCFWV | 94.31 | | | | | | |
| NA | N4 | 417 | 0.35 | yes | 2 | 0 | 99.19 | NCTVPCFWVE | 94.31 | | | | | | |
| NA | N4 | 418 | 0.35 | yes | 2 | 0 | 99.19 | CTVPCFWVEM | 94.31 | | | | | | |
| NA | N4 | 419 | 0.35 | yes | 2 | 0 | 99.19 | TVPCFWVEMI | 94.31 | | | | | | |
| NA | N4 | 420 | 0.35 | yes | 2 | 0 | 99.19 | VPCFWVEMIR | 94.31 | | | | | | |
| NA | N4 | 421 | 0.07 | yes | 1 | 0 | 99.19 | PCFWVEMIRG | 99.19 | | | | | | |
| NA | N4 | 422 | 0.07 | yes | 1 | 0 | 99.19 | CFWVEMIRGQ | 99.19 | | | | | | |
| NA | N4 | 423 | 0.07 | yes | 1 | 0 | 99.19 | FWVEMIRGQP | 99.19 | | | | | | |
| NA | N4 | 424 | 0.07 | yes | 1 | 0 | 99.19 | WVEMIRGQPK | 99.19 | | | | | | |
| NA | N4 | 425 | 0.07 | yes | 1 | 0 | 99.19 | VEMIRGQPKE | 99.19 | | | | | | |
| NA | N4 | 426 | 0.14 | yes | 2 | 0 | 99.19 | EMIRGQPKER | 98.37 | EMIRGQPKER | 0.81 | | | | |
| NA | N4 | 427 | 0.45 | yes | 3 | 0 | 99.19 | MIRGQPKEKT | 92.68 | MIRGQPNERT | 0.81 | | | | |
| NA | N4 | 428 | 0.45 | yes | 3 | 0 | 99.19 | IRGQPKEKTI | 92.68 | IRGQPKERTI | 0.81 | | | | |
| NA | N4 | 429 | 0.45 | yes | 3 | 0 | 99.19 | RGQPKEKTIW | 92.68 | RGQPKERTIW | 0.81 | | | | |
| NA | N4 | 430 | 0.45 | yes | 3 | 0 | 99.19 | GQPKEKAIWT | 92.68 | GQPKERTIWT | 0.81 | | | | |
| NA | N4 | 431 | 0.45 | yes | 3 | 0 | 99.19 | QPKEKAIWTS | 92.68 | QPKERTIWTS | 0.81 | | | | |
| NA | N4 | 432 | 0.45 | yes | 3 | 0 | 99.19 | PKEKAIWTSG | 92.68 | PKERTIWTSG | 0.81 | | | | |
| NA | N4 | 433 | 0.43 | yes | 3 | 0 | 99.19 | KEKAIWTSGS | 92.68 | NERTIWTSGS | 0.81 | | | | |
| NA | N4 | 434 | 0.43 | yes | 3 | 0 | 99.19 | EKAIWTSGSS | 92.68 | ERTIWTSGSS | 1.63 | | | | |
| NA | N4 | 435 | 0.32 | yes | 2 | 0 | 99.19 | KAIWTSGSSI | 92.68 | RTIWTSGSSI | 1.63 | | | | |
| NA | N4 | 436 | 0 | yes | 1 | 0 | 100 | AIWTSGSSIA | 94.31 | | | | | | |
| NA | N4 | 437 | 0 | yes | 1 | 0 | 100 | IWTSGSSIAF | 100 | | | | | | |
| NA | N4 | 438 | 0 | yes | 1 | 0 | 100 | WTSGSSIAFC | 100 | | | | | | |
| NA | N4 | 439 | 0.51 | yes | 3 | 0 | 100 | TSGSSIAFCG | 100 | | | | | | |
| NA | N4 | 440 | 0.58 | yes | 3 | 0 | 99.19 | SGSSIAFCGV | 88.62 | SIAFCGVNSN | 0.81 | | | | |
| NA | N4 | 441 | 0.64 | yes | 3 | 0.81 | 99.19 | GSSIAFCGVN | 87.8 | SSIAFCGVDS | 0.81 | SIAFCGVNSN | 0.81 | | |
| NA | N4 | 442 | 0.58 | yes | 3 | 0.81 | 99.18 | SSIAFCGVNS | 86.99 | SIAFCGVDSD | 0.81 | IAFCGVNSNT | 0.81 | | |
| NA | N4 | 443 | 0.92 | yes | 5 | 0.81 | 99.18 | SIAFCGVNSD | 86.99 | IAFCGVDSDT | 0.81 | | | | |
| NA | N4 | 444 | 0.92 | yes | 5 | 0.81 | 99.18 | IAFCGVNSDT | 87.7 | AFCGVDSDTT | 0.81 | | | | |
| NA | N4 | 445 | 0.58 | yes | 4 | 0.81 | 99.18 | AFCGVNSDTT | 87.7 | FCGVDSDTTG | 6.56 | FCGVNSDTTS | 4.92 | FCGVNSNTTG | 0.82 |
| NA | N4 | 446 | 0.52 | yes | 4 | 0.81 | 99.18 | FCGVNSDTTG | 84.43 | CGVDSDTTSW | 6.56 | CGVNSDTTSW | 4.92 | CGVNSDTTCW | 0.82 |
| NA | N4 | 447 | 0.52 | yes | 4 | 0.81 | 99.18 | CGVNSDTTGW | 84.43 | SDTTCWSWPD | 7.38 | SDTTGWPWPD | 0.82 | | |
| NA | N4 | 451 | 0.58 | yes | 5 | 0.81 | 90.16 | SDTTGWSWPD | 90.16 | DTTCWSWPDG | 7.38 | DTTGWPWPDG | 0.82 | | |
| NA | N4 | 452 | 0.52 | yes | 4 | 0.81 | 90.98 | DTTSWSWPDG | 90.98 | TTCWSWPDGA | 7.38 | | | | |
| NA | N4 | 453 | 0.52 | yes | 3 | 0.81 | 90.98 | TTGWSWPDGA | 90.98 | TGWPWPDGAL | 7.38 | | | | |
| NA | N4 | 454 | 0.52 | yes | 3 | 0.81 | 90.98 | TGWSWPDGAL | 90.98 | | | | | | |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N5 | 110 | 0.21 | yes | 2 | 0 | 100 | HYFVIREPFV | 96.71 | HIFVIREPFV | 3.29 | | | | |
| NA | N5 | 111 | 0.44 | yes | 3 | 0 | 99.34 | VFVIREPFVA | 93.42 | IFVIREPFVA | 2.63 | | | | |
| NA | N5 | 112 | 0.24 | yes | 2 | 0 | 100 | FVIREPFVAC | 96.05 | | | | | | |
| NA | N5 | 113 | 0.24 | yes | 3 | 0 | 100 | VIREPFVACG | 94.08 | VIREPFVACS | 1.97 | | | | |
| NA | N5 | 114 | 0.38 | yes | 3 | 0 | 99.34 | IREPFVACGP | 94.08 | IREPFVACSP | 1.32 | | | | |
| NA | N5 | 115 | 0.4 | yes | 5 | 0 | 99.34 | REPFVACGPS | 70.39 | REPFVACSGP | 3.95 | REPFVACGPA | 1.97 | REPFVACSPS | 1.32 |
| NA | N5 | 116 | 1.26 | yes | 5 | 0 | 99.34 | EPFVACGPSE | 70.39 | EPFVSCGPSE | 21.7 | EPFVACGPAE | 1.97 | EPFVACSPSE | 1.32 |
| NA | N5 | 117 | 1.26 | yes | 5 | 0 | 99.34 | PFVACGPSEC | 70.39 | PFVSCGPSEC | 21.7 | PFVACGPAEC | 1.97 | PFVACSPSEC | 1.32 |
| NA | N5 | 118 | 1.26 | yes | 5 | 0 | 99.34 | FVACGPSECR | 70.39 | FVSCGPSECR | 21.7 | FVACGPAECR | 1.97 | FVACSPSECR | 1.32 |
| NA | N5 | 119 | 1.26 | yes | 4 | 0 | 99.34 | VACGPSECRT | 70.39 | VSCGPSECRT | 21.7 | VACGPAECRT | 1.97 | VACSPSECRT | 1.32 |
| NA | N5 | 120 | 1.26 | yes | 4 | 0 | 99.34 | ACGPSECRTF | 70.39 | SCGPSECRTF | 21.7 | ACGPAECRTF | 1.97 | ACSPSECRTF | 1.32 |
| NA | N5 | 121 | 1.1 | yes | 3 | 0 | 99.34 | CGPSECRTFF | 70.39 | CGPAECRTFF | 1.97 | | | | |
| NA | N5 | 122 | 1.03 | yes | 3 | 0 | 99.34 | GPSECRTFFL | 70.39 | GPAECRTFFL | 1.97 | | | | |
| NA | N5 | 123 | 1.02 | yes | 3 | 0 | 99.34 | PSECRTFFLT | 70.39 | PAECRTFFLT | 1.97 | | | | |
| NA | N5 | 124 | 0.06 | yes | 1 | 0 | 99.34 | SECRTFFLTQ | 71.05 | AECRTFFLTQ | 26.3 | | | | |
| NA | N5 | 125 | 0.06 | yes | 1 | 0 | 99.34 | ECRTFFLTQG | 99.34 | | | | | | |
| NA | N5 | 126 | 0.06 | yes | 1 | 0 | 99.34 | CRTFFLTQGA | 99.34 | | | | | | |
| NA | N5 | 127 | 0.06 | yes | 1 | 0 | 99.34 | RTFFLTQGAL | 99.34 | | | | | | |
| NA | N5 | 128 | 0.06 | yes | 1 | 0 | 99.34 | TFFLTQGALL | 99.34 | | | | | | |
| NA | N5 | 129 | 0.06 | yes | 1 | 0 | 99.34 | FFLTQGALLN | 99.34 | | | | | | |
| NA | N5 | 130 | 0.06 | yes | 1 | 0 | 99.34 | FLTQGALLND | 99.34 | | | | | | |
| NA | N5 | 131 | 0.11 | yes | 2 | 0 | 99.34 | LTQGALLNDK | 98.68 | LTQGALLNDR | 0.66 | | | | |
| NA | N5 | 132 | 0.11 | yes | 2 | 0 | 99.34 | TQGALLNDKH | 98.68 | TPCVLLNDKH | 0.66 | | | | |
| NA | N5 | 133 | 0.11 | yes | 2 | 0 | 99.34 | QGALLNDKHS | 98.68 | QGALLNDRHS | 0.66 | | | | |
| NA | N5 | 134 | 0.11 | yes | 2 | 0 | 99.34 | GALLNDKHSN | 98.68 | GALLNDRHSN | 0.66 | | | | |
| NA | N5 | 135 | 0.11 | yes | 2 | 0 | 99.34 | ALLNDKHSNN | 98.68 | VLLNDIKHSNN | 0.66 | | | | |
| NA | N5 | 136 | 0.06 | yes | 1 | 0 | 99.34 | LLNDKHSNNT | 99.34 | | | | | | |
| NA | N5 | 137 | 0.06 | yes | 1 | 0 | 99.34 | LNDKHSNNTV | 99.34 | | | | | | |
| NA | N5 | 138 | 0.11 | yes | 2 | 0 | 98.68 | NDKHSNNTVK | 98.68 | NDKHSNNTYR | 0.66 | | | | |
| NA | N5 | 139 | 0.11 | yes | 2 | 0 | 98.68 | DKHSNNTVKD | 98.68 | DRHSNNTYKD | 0.66 | | | | |
| NA | N5 | 140 | 0.11 | yes | 2 | 0 | 99.34 | KHSNNTVKDR | 99.34 | KHSNNTYKDR | 0.66 | | | | |
| NA | N5 | 141 | 0.06 | yes | 1 | 0 | 99.34 | HSNNTVKDRS | 99.34 | | | | | | |
| NA | N5 | 142 | 0.06 | yes | 1 | 0 | 99.34 | SNNTVKDRSP | 99.34 | | | | | | |
| NA | N5 | 143 | 0.06 | yes | 1 | 0 | 99.34 | NNTVKDRSPY | 99.34 | | | | | | |
| NA | N5 | 144 | 0.06 | yes | 1 | 0 | 99.34 | NTVKDRSPYR | 99.34 | | | | | | |
| NA | N5 | 145 | 0.06 | yes | 1 | 0 | 99.34 | TVKDRSPYRA | 99.34 | | | | | | |
| NA | N5 | 146 | 0.06 | yes | 1 | 0 | 99.34 | VKDRSPYRAL | 99.34 | | | | | | |
| NA | N5 | 147 | 0.06 | yes | 1 | 0 | 99.34 | KDRSPYRALM | 99.34 | | | | | | |
| NA | N5 | 148 | 0 | yes | 1 | 0 | 100 | DRSPYRALMS | 100 | | | | | | |
| NA | N5 | 149 | 0 | yes | 1 | 0 | 100 | RSPYRALMSV | 100 | | | | | | |
| NA | N5 | 150 | 0.06 | yes | 1 | 0 | 99.34 | SPYRALMSVP | 99.34 | PYRALMSVPM | 0.66 | | | | |
| NA | N5 | 151 | 0.11 | yes | 2 | 0 | 98.68 | PYRALMSVPL | 98.68 | | | | | | |

FIG. 74-24

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| NA | NS | 152 | 0.11 | yes | 2 | 0 | 99.34 | YRALMSVPLG | 98.68 | YRALMSVPMG | 0.66 | | | | |
| NA | NS | 153 | 0.11 | yes | 2 | 0 | 99.34 | RALMSVPLGS | 98.68 | RALMSVLLGS | 0.66 | LMSVPLGSSS | 0.66 | | |
| NA | NS | 154 | 0.11 | yes | 2 | 0 | 99.34 | ALMSVPLGSS | 98.68 | ALMSVLLGSS | 0.66 | MSVPLGSSPN | 0.66 | | |
| NA | NS | 155 | 0.17 | yes | 3 | 0 | 99.34 | LMSVPLGSSP | 98.03 | LMSVPGSSP | 0.66 | SVPLGSSSNA | 0.66 | | |
| NA | NS | 156 | 0.17 | yes | 3 | 0 | 99.34 | MSVPLGSSPN | 98.03 | MSVPLGSSSN | 0.66 | VPLGSSSNAY | 0.66 | | |
| NA | NS | 157 | 0.17 | yes | 3 | 0 | 99.34 | SVPLGSSPNA | 98.03 | SVPMGSSPNA | 0.66 | PLGSSSNAYQ | 0.66 | | |
| NA | NS | 158 | 0.17 | yes | 3 | 0 | 99.34 | VPLGSSPNAY | 98.03 | VLLGSSPNAY | 0.66 | | | | |
| NA | NS | 159 | 0.11 | yes | 2 | 0 | 99.34 | PLGSSPNAYQ | 98.03 | LLGSSPNAYQ | 0.66 | | | | |
| NA | NS | 160 | 0.11 | yes | 2 | 0 | 98.68 | LGSSPNAYQA | 98.68 | | | GSSPNAYQAQ | 0.66 | | |
| NA | NS | 161 | 0.22 | yes | 3 | 0 | 99.34 | GSSPNAYQAR | 97.37 | | | SSSNAYQAKF | 0.66 | | |
| NA | NS | 162 | 0.22 | yes | 3 | 0 | 99.34 | SSPNAYQARF | 97.37 | | | SPNAYQAQFE | 0.66 | | |
| NA | NS | 163 | 0.22 | yes | 3 | 0 | 99.34 | SPNAYQARFE | 97.37 | | | SNAYQAKFES | 0.66 | | |
| NA | NS | 164 | 0.22 | yes | 3 | 0 | 99.34 | PNAYQARFES | 97.37 | | | NAYQAKFESV | 0.66 | | |
| NA | NS | 165 | 0.22 | yes | 3 | 0 | 99.34 | NAYQARFESV | 97.37 | | | NAYQAOFESV | 0.66 | | |
| NA | NS | 171 | 0.94 | yes | 4 | 0 | 99.34 | FESVAWSATA | 72.37 | | | FESIAWSATA | 26.3 | | |
| NA | NS | 172 | 0.94 | yes | 4 | 0 | 99.34 | ESVAWSATAC | 72.37 | | | ESIAWSATAC | 26.3 | | |
| NA | NS | 173 | 0.94 | yes | 4 | 0 | 99.34 | SVAWSATACH | 72.37 | | | SIAWSATACH | 26.3 | | |
| NA | NS | 174 | 0.94 | yes | 4 | 0 | 99.34 | VAWSATACHD | 72.37 | | | VEWSATACHD | 26.3 | | |
| NA | NS | 175 | 0.89 | yes | 3 | 0 | 73.03 | AWSATACHDG | 73.03 | | | | | | |
| NA | NS | 176 | 0.06 | yes | 2 | 0 | 99.34 | WSATACHDGK | 99.34 | | | SATACHDGKG | 30.9 | SATACHDGKG | 4.61 | | |
| NA | NS | 177 | 1.19 | yes | 3 | 0 | 63.82 | SATACHDGKE | 63.82 | | | ATACHDGKGW | 30.9 | ATACHDGKGW | 4.61 | | |
| NA | NS | 178 | 1.96 | yes | 4 | 0 | 63.82 | ATACHDGKEW | 63.82 | | | TACHDGKGKW | 27 | TACHDGKGWL | 23.03 | TACHDGKKWM | 3.95 |
| NA | NS | 179 | 1.16 | yes | 4 | 0 | 40.79 | TACHDGKEWL | 40.79 | | | GVSGADNDAY | 39.5 | GVSGTDDDAY | 1.32 | | |
| NA | NS | 191 | 1.16 | yes | 3 | 0 | 57.89 | GISGADDDAY | 57.89 | | | VSGADNDAYA | 39.5 | VSGTDDDAYA | 1.32 | | |
| NA | NS | 192 | 0.22 | yes | 3 | 0 | 57.89 | ISGADDDAYA | 57.89 | | | SGADNDAYAV | 1.32 | | | | |
| NA | NS | 193 | 0.22 | yes | 2 | 0 | 97.37 | SGADDDAYAV | 97.37 | | | GADNDAYAVI | 0.66 | | | | |
| NA | NS | 194 | 0.22 | yes | 2 | 0 | 97.37 | GADDDAYAVI | 97.37 | | | GADDEAYAV | 0.66 | | | | |
| NA | NS | 195 | 0.22 | yes | 2 | 0 | 97.37 | ADDDAYAVIH | 97.37 | | | ADNDAYAVIH | 0.66 | | | | |
| NA | NS | 196 | 0.16 | yes | 2 | 0 | 98.03 | DDDAYAVIHY | 98.03 | | | DNDAYAVIHY | 0.66 | | | | |
| NA | NS | 197 | 0.16 | yes | 2 | 0 | 98.03 | DDAYAVIHYG | 98.03 | | | NDAYAVIHYG | 0.66 | | | | |
| NA | NS | 198 | 0.06 | yes | 1 | 0 | 99.34 | DAYAVIHYGG | 99.34 | | | | | | | | |
| NA | NS | 199 | 1.31 | yes | 3 | 0 | 56.58 | AYAVIHYGGM | 56.58 | | | AYAVIHYGGV | 34.2 | AYAVIHYGGI | 9.21 | | |
| NA | NS | 200 | 1.31 | yes | 3 | 0 | 56.58 | YAVIHYGGMP | 56.58 | | | YAVIHYGGVP | 34.2 | YAVIHYGGIP | 9.21 | | |
| NA | NS | 201 | 1.31 | yes | 3 | 0 | 56.58 | AVIHYGGMPT | 56.58 | | | AVIHYGGVPT | 34.2 | AVIHYGGIPT | 9.21 | | |
| NA | NS | 202 | 1.31 | yes | 3 | 0 | 56.58 | VIHYGGMPTD | 56.58 | | | VIHYGGVPTD | 34.2 | VIHYGGIPTD | 9.21 | | |
| NA | NS | 203 | 1.31 | yes | 3 | 0 | 56.58 | IHYGGMPTDV | 56.58 | | | IHYGGVPTDV | 34.2 | IHYGGIPTDV | 9.21 | HYGGIPTDVI | 3.29 | HYGGIPTDVI | 0.66 |
| NA | NS | 204 | 1.55 | yes | 5 | 0 | 56.58 | HYGGMPTDVW | 56.58 | | | HYGGVPTDVW | 30.3 | HYGGIPTDVW | 8.55 | YGGIPTDVIR | 3.29 | YGGVPTDVMR | 0.66 |
| NA | NS | 205 | 1.55 | yes | 5 | 0 | 56.58 | YGGMPTDVWR | 56.58 | | | YGGVPTDVWR | 30.3 | YGGIPTDVWR | 8.55 | GGVPTDVIRS | 3.29 | GGVPTDVMRS | 0.66 |
| NA | NS | 206 | 1.55 | yes | 5 | 0 | 56.58 | GGMPTDVWRS | 56.58 | | | GGVPTDVWRS | 30.3 | GGIPTDVWRS | 8.55 | GVPTDVIRSW | 3.29 | GIPTDVIRSW | 0.66 |
| NA | NS | 207 | 1.55 | yes | 4 | 0 | 56.58 | GMPTDVWRSW | 56.58 | | | GVPTDVWRSW | 30.3 | GIPTDVWRSW | 8.55 | GVPTDVIRSW | 1.32 | | |
| NA | NS | 209 | 0.96 | yes | 4 | 0 | 80.26 | PTDVWRSWRK | 80.26 | | | PTDVIRSWRR | 13.8 | PTDVWRSWRK | 3.95 | PTDVIRSWRR | 2.63 | | |
| NA | NS | 210 | 1.13 | yes | 5 | 0 | 77.63 | TDVWRSWRKQ | 77.63 | | | TDVIRSWRKQ | 13.8 | TDVWRSWRKK | 3.95 | TDVWRSWRRQ | 1.32 | | |

FIG. 74-25

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | NS | 211 | 1.13 | yes | 5 | 0 | 99.34 | DVVRSWRKQI | 77.63 | DVVRSWRKQI | 13.8 | DVVRSWRKKI | 3.95 | DVVRSWRKKI | 2.63 | DVVRSWRRQI | 1.32 |
| NA | NS | 212 | 1.13 | yes | 5 | 0 | 99.34 | VRSWRKQIL | 77.63 | VRSWRKKIL | 13.8 | VRSWRKKIL | 3.95 | VRSWRKKIL | 2.63 | VRSWRRQIL | 1.32 |
| NA | NS | 213 | 1.13 | yes | 5 | 0 | 99.34 | VRSWRKQILR | 77.63 | IRSWRKQILR | 13.8 | VRSWRKKILR | 3.95 | VRSWRKKILR | 2.63 | VRSWRRQILR | 1.32 |
| NA | NS | 214 | 0.85 | yes | 4 | 0 | 100 | RSWRKQILRT | 82.24 | RSWRKQILRT | 13.8 | RSWRKKILRT | 3.95 | RSWRKQILRT | 1.32 | | |
| NA | NS | 215 | 0.85 | yes | 4 | 0 | 100 | SWRKQILRTQ | 82.24 | SWRKKILRTQ | 13.8 | SWRKQILRTQ | 2.63 | SWRRQILRTQ | 1.32 | | |
| NA | NS | 216 | 0.85 | yes | 4 | 0 | 100 | WRKQILRTQE | 82.24 | WRKKILRTQE | 13.8 | WRKQILRTQE | 2.63 | WRRQILRTQE | 1.32 | | |
| NA | NS | 217 | 0.28 | yes | 3 | 0 | 100 | RKQILRTQES | 96.05 | RKILRTQES | 2.63 | RKQILRTQES | 1.32 | | | | |
| NA | NS | 218 | 0.18 | yes | 2 | 0 | 100 | KQILRTQESS | 97.37 | KQILRTQES | 2.63 | | | | | | |
| NA | NS | 219 | 0 | yes | 1 | 0 | 100 | QILRTQESSC | 100 | | | | | | | | |
| NA | NS | 220 | 0 | yes | 1 | 0 | 100 | ILRTQESSCV | 100 | | | | | | | | |
| NA | NS | 221 | 0.59 | yes | 3 | 0 | 100 | LRTQESSCVC | 89.47 | RTQESSCVCI | 6.58 | | | | | | |
| NA | NS | 222 | 1.14 | yes | 4 | 0 | 100 | RTQESSCVCM | 75.66 | TQESSCVCIK | 13.8 | TQESSCVIK | 3.95 | | | | |
| NA | NS | 223 | 1.14 | yes | 4 | 0 | 100 | TQESSCVCMK | 75.66 | QESSCVCIKG | 13.8 | QESSCVCIKG | 3.95 | | | | |
| NA | NS | 224 | 0.06 | yes | 2 | 0 | 100 | QESSCVCMNG | 99.34 | | | | | | | | |
| NA | NS | 235 | 0.41 | yes | 2 | 0 | 99.34 | CYWMTDGPA | 92.76 | YWMTDGPAS | 6.58 | | | | | | |
| NA | NS | 236 | 1.17 | yes | 4 | 0 | 99.34 | YWMTDGPAN | 76.97 | WWMTDGPANK | 8.55 | WWMTDGPAS | 7.24 | WWMTDGPASN | 6.58 | | |
| NA | NS | 237 | 1.17 | yes | 4 | 0 | 99.34 | WWMTDGPANS | 76.97 | VMTDGPANKQ | 8.55 | VMTDGPANS | 7.24 | VMTDGPASNQ | 6.58 | | |
| NA | NS | 238 | 1.17 | yes | 4 | 0 | 99.34 | VMTDGPANSQ | 76.97 | MTDGPANKQA | 8.55 | MTDGPANQA | 7.24 | MTDGPASNQA | 6.58 | | |
| NA | NS | 239 | 1.14 | yes | 5 | 0 | 99.34 | MTDGPANSQA | 75.66 | TDGPANKQAS | 8.55 | TDGPANQAS | 7.24 | TDGPASNQAS | 6.58 | | |
| NA | NS | 240 | 1.24 | yes | 5 | 0 | 99.34 | TDGPANSQAS | 75.66 | DGPANKIQASY | 8.55 | DGPANQASY | 7.24 | DGPASNQASY | 6.58 | | |
| NA | NS | 241 | 1.24 | yes | 4 | 0 | 99.34 | DGPANSQASY | 75.66 | GPANKQASYK | 8.55 | GPANNQASY | 7.24 | GPANNQASYR | 1.32 | | |
| NA | NS | 242 | 1.24 | yes | 4 | 0 | 99.34 | GPANSQASYK | 75.66 | PANKQASYKI | 8.55 | PANNQASYK | 7.24 | PANNQASYRI | 1.32 | | |
| NA | NS | 243 | 1.24 | yes | 4 | 0 | 99.34 | PANSQASYKI | 75.66 | ANKQASYKIF | 8.55 | ANNQASYKI | 7.24 | ANNQASYRIF | 1.32 | | |
| NA | NS | 244 | 1.24 | yes | 4 | 0 | 99.34 | ANSQASYKIF | 75.66 | NKQASYKIFK | 8.55 | NNQASYKIF | 7.24 | NNQASYRIFK | 1.32 | | |
| NA | NS | 245 | 0

FIG. 74-26

| Protein | Sub-type | Start Pos | Block Entropy | Gaps <10% | # to %cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N5 | 280 | 1.8 | yes | 5 | 0 | 99.34 | PNLGKVEC

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 104 | 0.81 | yes | 5 | 0 | 99.28 | DNAIRIGEDA | 85.12 | DNAIRIGENA | 10.3 | DNAIRIGEEA | 3.29 | DNAIRIGEGA | 0.29 | DNAVRIGEDA | 0.29 |
| NA | N6 | 105 | 0.83 | yes | 5 | 0 | 99.14 | NAIRIGEDAH | 84.98 | NAIRIGENAH | 10.3 | NAIRIGEEAH | 3.29 | NAVRIGEDAH | 0.29 | NAIRIGEGAH | 0.29 |
| NA | N6 | 112 | 0.98 | yes | 2 | 0 | 99.14 | DAHILVTREP | 82.4 | NAHILVTREP | 10.3 | EAHILVTREP | 3.29 | DAHVLTREP | 2.86 | GAHIL

FIG. 74-30

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 162 | 0.18 | yes | 3 | 0 | 99.14 | WEMGQAP

FIG. 74-31

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 237 | 0.3 | yes | 2 | 0.86 | 99.13 | GIC

FIG. 74-32

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | N6 | 372 | 0.61 | yes | 5 | 0 | 99.14 | SRSGYEVLKV | 90.99 | SRSGYEVLKV | 4.86 | SRSGYEILKV | 2.29 | LRSGYEMLKV | 0.57 | TRSGYEMLKV | 0.43 |
| NA | N6 | 373 | 0.5 | yes | 3 | 0 | 99.43 | RSGYEVLKVP | 92.27 | RSGYEVLKVP | 4.86 | RSGYEILKVP | 2.29 | SGYEVLKVPD | 0.57 | SGYEMLKVPD | 0.43 |
| NA | N6 | 374 | 0.56 | yes | 5 | 0 | 99.43 | SGYEVLKVPN | 91.85 | SGYEVLKVPN | 4.29 | SGYEILKVPN | 2.29 | GYEVLKVPDA | 0.57 | GYEMLKVPDA | 0.43 |
| NA | N6 | 375 | 0.56 | yes | 5 | 0 | 99.43 | GYEMLKVPNA | 91.85 | GYEVLKVPNA | 4.29 | GYEILKVPNA | 2.29 | YEVLKVPDAE | 0.57 | YEMLKVPDAE | 0.43 |
| NA | N6 | 376 | 0.56 | yes | 4 | 0 | 99.43 | YEMLKVPNAE | 91.85 | YEMLKVPNAE | 4.29 | YEILKVPNAE | 2.29 | IVDNQNWSGY | 0.29 | | |
| NA | N6 | 398 | 0.21 | yes | 3 | 0 | 99.43 | IVNNQNWSGY | 97.85 | IVNNQNWSGY | 4.29 | IINNQNWSGY | 2.29 | VDNQNWSGYS | 0.29 | | |
| NA | N6 | 399 | 0.21 | yes | 4 | 0 | 99.14 | VNNQNWSGYS | 97.85 | VNNQNWSGYS | 4.29 | INNQNWSGYS | 2.29 | | | | |
| NA | N6 | 400 | 0.17 | yes | 4 | 0 | 99.14 | NNQNWSGYSG | 98.28 | NNQNWSGYSG | 0.57 | DNQNWSGYSG | 0.43 | | | | |
| NA | N6 | 401 | 0.25 | yes | 4 | 0 | 99.14 | NQNWSGYSGA | 97.28 | NQNWSGYSGS | 0.57 | NODWSGYSGA | 0.57 | NONWSGYSGV | 0.29 | | |
| NA | N6 | 402 | 0.23 | yes | 3 | 0 | 99.28 | QNWSGYSGAF | 97.42 | QWSGYSGAF | 0.57 | DWSGYSGAF | 0.57 | QKWSGYSGAF | 0.57 | | |
| NA | N6 | 403 | 0.31 | yes | 4 | 0 | 99.14 | NWSGYSGAFI | 96.57 | NWSGYSGFI | 0.57 | NWSGYSGAFI | 0.57 | NWSGYSGAF | 0.57 | NWSGYSGAFV | 0.43 |
| NA | N6 | 404 | 0.26 | yes | 4 | 0 | 99.14 | WSGYSGAFID | 97.14 | WSGYSGFID | 0.57 | WSGYSGAFID | 0.57 | WSGYSGAFVD | 0.43 | | |
| NA | N6 | 405 | 0.26 | yes | 4 | 0 | 99.14 | SGYSGAFIDY | 97.14 | SGYSGFIDY | 0.57 | SGYSGAFMDY | 0.57 | SGYSGAFVDY | 0.43 | | |
| NA | N6 | 406 | 0.26 | yes | 3 | 0 | 99.14 | GYSGAFIDYW | 97.14 | GYSGFIDYW | 0.57 | GYSGAFMDYW | 0.57 | GYSGAFVDYW | 0.43 | | |
| NA | N6 | 418 | 1.09 | yes | 2 | 0 | 99.28 | RECFNPCFYV | 54.79 | KECFNPCFYV | 44.2 | KKCFNPCFYV | 0.57 | | | | |
| NA | N6 | 419 | 0.11 | yes | 1 | 0 | 99.28 | ECFNPCFYVE | 99 | KCFNPCFYVE | 0.29 | | | | | | |
| NA | N6 | 420 | 0.05 | yes | 1 | 0.14 | 99.43 | CFNPCFYVEL | 99.57 | | | | | | | | |
| NA | N6 | 421 | 0.06 | yes | 1 | 0.14 | 99.57 | FNPCFYVELI | 99.43 | | | | | | | | |
| NA | N6 | 422 | 0.05 | yes | 1 | 0.29 | 99.57 | NPCFYVELIR | 99.57 | | | | | | | | |
| NA | N6 | 423 | 0.06 | yes | 2 | 0.29 | 99.28 | PCFYVELIRG | 99.57 | CFYVELIRGM | 1.15 | | | | | | |
| NA | N6 | 424 | 0.17 | yes | 2 | 0.29 | 99.28 | CFYVELIRGR | 98.13 | FYYELIRGMP | 1.15 | | | | | | |
| NA | N6 | 425 | 0.17 | yes | 2 | 0.29 | 99.28 | FYVELIRGRP | 98.13 | YYELIRGMPK | 1.15 | YVELIRGRPE | 0.86 | YVELIRGRPR | 0.86 | | |
| NA | N6 | 426 | 0.27 | yes | 4 | 0.29 | 99.14 | YVELIRGPKE | 96.99 | VELIRGMPKE | 1.15 | VELIRGRPRE | 0.86 | AELIRGRPKE | 0.86 | | |
| NA | N6 | 427 | 0.27 | yes | 5 | 0.29 | 99.14 | VELIRGRPKE | 96.99 | ELIRGMPKES | 1.43 | ELIRGRPRES | 1.15 | ELIRGRPKES | 1.15 | ELVRGRPKES | 0.14 |
| NA | N6 | 428 | 0.38 | yes | 4 | 0.29 | 99.28 | ELIRGRPKES | 95.55 | VLWTSNSIVA | 4.88 | VWWTSNSIVA | 0.29 | | | | |
| NA | N6 | 439 | 0.43 | yes | 5 | 0.29 | 99.14 | VLWTSNSIVA | 93.69 | LWTSNSIVAL | 4.88 | VWWTSNSIVAL | 0.29 | | | | |
| NA | N6 | 440 | 0.41 | yes | 4 | 0.29 | 99.14 | LWTSNSIVAL | 93.83 | WTSNSIVAL | 4.88 | WTSNSIVAL | 0.29 | | | | |
| NA | N6 | 441 | 0.09 | yes | 1 | 0.29 | 99.14 | WTSNSIVALC | 99.14 | | | | | | | | |
| NA | N6 | 442 | 0.09 | yes | 1 | 0.29 | 99.14 | TSNSIVALCG | 99.14 | | | | | | | | |
| NA | N6 | 443 | 0.44 | yes | 2 | 0.43 | 99.28 | NSIVALCGS | 92.67 | NSIVALCGSR | 6.47 | | | | | | |
| NA | N6 | 444 | 0.51 | yes | 3 | 0.43 | 99.14 | SIVALCGSK | 91.81 | SIVALCGSRE | 6.47 | SIVALCGSKK | 0.86 | IWALCGSKKR | 0.86 | | |
| NA | N6 | 445 | 0.61 | yes | 4 | 0.43 | 99.28 | IVALCGSKE | 90.23 | IVALCGSRER | 6.61 | IVALCGSKEQ | 1.58 | IWALCGSKKR | 0.86 | | |
| NA | N6 | 446 | 0.55 | yes | 4 | 0.29 | 99.28 | VALCGSKER | 90.67 | VALCGSRERL | 6.74 | VALCGSKEQL | 1.72 | ALCGSKKRLG | 0.86 | | |
| NA | N6 | 447 | 0.57 | yes | 4 | 0.29 | 99.14 | ALCGSKERL | 90.53 | ALCGSRERLG | 6.74 | ALCGSKEQLG | 1.72 | LCGSKKRLGS | 0.86 | | |
| NA | N6 | 448 | 0.58 | yes | 4 | 0.29 | 99.86 | LCGSKERLG | 90.4 | LCGSRERLGS | 6.73 | LCGSKEQLGS | 1.72 | CGSKKRLGSW | 0.86 | | |
| NA | N6 | 449 | 0.6 | yes | 5 | 0.43 | 99.71 | CGSKERLGS | 90.26 | CGSRERLGSW | 6.73 | CGSKEQLGSW | 1.72 | GSKKRLGSWS | 0.86 | | |
| NA | N6 | 450 | 0.61 | yes | 4 | 0.29 | 99.57 | GSKERLGSW | 90.11 | GSRERLGSWS | 6.73 | GSKEQLGSWS | 1.72 | SKKRLGSWSW | 0.86 | | |
| NA | N6 | 451 | 0.61 | yes | 4 | 0.29 | 99.43 | SKERLGSWS | 90.11 | SRERLGSWSW | 6.73 | SKEQLGSWSW | 1.72 | KKRLGSWSWH | 0.86 | | |
| NA | N6 | 452 | 0.61 | yes | 4 | 0.14 | 99.43 | KERLGSWSW | 90.11 | RERLGSWSWH | 6.73 | KEQLGSWSWH | 1.72 | | | | |
| NA | N6 | 453 | 0.29 | yes | 3 | 0.14 | 99.14 | ERLGSWSWH | 96.56 | ERLGSWSWH | 1.72 | EQLGSWSWHD | 1.72 | | | | |
| NA | N6 | 454 | 0.2 | yes | 2 | 0.14 | 99.28 | RLGSWSWHD | 97.56 | RLGSWSWHD | 1.72 | QLGSWSWHDG | 1.72 | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 115 | 0.04 | yes | 1 | 0 | 99.59 | VTREPYVSCD | 99.59 | | | | | | |
| NA | N7 | 116 | 0.04 | yes | 1 | 0 | 99.59 | TREPYVSCDP | 99.59 | | | | | | |
| NA | N7 | 117 | 1.15 | yes | 4 | 0 | 99.19 | REPYVSCDPL | 73.98 | REPYVSCDPS | 17.5 | REPYVSCDPI | 1.22 | | |
| NA | N7 | 127 | 0.87 | yes | 4 | 0 | 99.19 | GCKMYALHQG | 83.33 | SCKMYALHQG | 10.6 | ECKMYALHQG | 0.41 | | |
| NA | N7 | 128 | 0.56 | yes | 2 | 0 | 99.19 | CKMYALHQGT | 88.62 | CRMYALHQGT | 10.6 | | | | |
| NA | N7 | 129 | 0.56 | yes | 2 | 0 | 99.19 | KMYALHQGT | 88.62 | RMYALHQGTT | 10.6 | | | | |
| NA | N7 | 130 | 0.08 | yes | 1 | 0 | 99.19 | MYALHQGTTI | 99.19 | | | | | | |
| NA | N7 | 131 | 0.04 | yes | 1 | 0 | 99.59 | YALHQGTTIR | 99.59 | | | | | | |
| NA | N7 | 132 | 0 | yes | 1 | 0 | 100 | ALHQGTTIRN | 100 | | | | | | |
| NA | N7 | 133 | 0.1 | yes | 2 | 0 | 100 | LHQGTTIRNK | 98.78 | LHQGTTIRNR | 1.22 | | | | |
| NA | N7 | 134 | 0.1 | yes | 2 | 0 | 100 | HQGTTIRNKH | 98.78 | HQGTTIRNRH | 1.22 | | | | |
| NA | N7 | 135 | 0.1 | yes | 2 | 0 | 100 | QGTTIRNKHS | 98.78 | QGTTIRNRHS | 1.22 | | | | |
| NA | N7 | 136 | 0.1 | yes | 2 | 0 | 99.59 | GTTIRNKHSN | 98.78 | GTTIRNRHSN | 1.22 | | | | |
| NA | N7 | 137 | 0.28 | yes | 2 | 0.41 | 99.18 | TTIRNKHSNS | 95.93 | TTIRNRHSNG | 2.85 | IRNRHSNGTI | 1.22 | | |
| NA | N7 | 138 | 0.28 | yes | 2 | 0.41 | 99.18 | TIRNKHSNST | 93.9 | TIRNRHSNGT | 2.85 | RNRHSNGTIH | 1.22 | | |
| NA | N7 | 139 | 0.42 | yes | 3 | 0.41 | 99.18 | IRNKHSNSTT | 93.88 | IRNKHSNGTT | 2.85 | NRHSNGTIHD | 2.03 | | |
| NA | N7 | 140 | 0.44 | yes | 3 | 0.41 | 99.18 | RNKHSNSTTH | 93.88 | RNKHSNGTTH | 2.86 | RHSNGTIHDR | 2.04 | HSNGTIHDRA | 0.41 |
| NA | N7 | 141 | 0.47 | yes | 3 | 0.41 | 99.18 | NKHSNSTTHD | 93.47 | NKHSNGTTHD | 2.86 | HSNGTIHDRT | 2.04 | TINDRTAFRG | 0.41 |
| NA | N7 | 142 | 0.48 | yes | 3 | 0.41 | 99.19 | KHSNSTTHDR | 93.47 | KHSNGTTHDR | 2.86 | TIHDRTAFRG | 2.04 | INDRTAFRGL | 0.41 |
| NA | N7 | 143 | 0.5 | yes | 4 | 0 | 99.19 | HSNGTIHDRT | 92.65 | HSNGTTHDRT | 2.86 | IHDGTAFRGL | 2.04 | DGTAFRGLIS | 0.41 |
| NA | N7 | 147 | 0.5 | yes | 4 | 0 | 99.19 | TIHDRTAFRG | 92.65 | TIHDGTAFRG | 4.9 | DRTTFRGLIS | 0.82 | GTAFRGLIST | 0.41 |
| NA | N7 | 148 | 0.29 | yes | 2 | 0 | 99.19 | IHDRTTFRGL | 96.75 | IHDGTAFRGL | 4.9 | RTTFRGLIST | 0.82 | TFRGLISTPL | 0.41 |
| NA | N7 | 150 | 0.29 | yes | 2 | 0 | 99.19 | DRTAFRGLIS | 96.75 | DRNAFRGLIS | 1.22 | | | | |
| NA | N7 | 151 | 0.37 | yes | 2 | 0 | 99.19 | RTAFRGLMS | 95.53 | RNAFRGLIST | 1.22 | | | | |
| NA | N7 | 153 | 0.33 | yes | 2 | 0 | 99.19 | AFRGLISTPL | 95.93 | AFRGLMSTPL | 1.22 | | | | |
| NA | N7 | 154 | 1.48 | yes | 5 | 0 | 99.19 | FRGLISTPLG | 68.29 | FRGLMSTHLG | 1.22 | | | | |
| NA | N7 | 169 | 1.48 | yes | 5 | 0 | 99.19 | SNSDFLCVGW | 68.29 | SNSDFICVGW | 15 | SNSEFICVGW | 8.54 | SNSEFLCVGW | 4.88 |
| NA | N7 | 170 | 1.48 | yes | 5 | 0 | 99.59 | SDFLCVGWSS | 68.29 | SDFICVGWSS | 15 | NSEFICVGWS | 8.54 | NSEFLCVGWS | 4.88 |
| NA | N7 | 171 | 1.48 | yes | 5 | 0 | 99.19 | DFLCVGWSST | 68.29 | DFICVGWSST | 15 | SEFICVGWSS | 8.54 | SEFLCVGWSS | 4.88 |
| NA | N7 | 172 | 1.34 | yes | 5 | 0 | 99.19 | FLCVGWSSTS | 70.73 | FICVGWSSTC | 15 | EFICVGWSST | 8.54 | EFLCVGWSST | 4.88 |
| NA | N7 | 173 | 0.72 | yes | 4 | 0 | 99.19 | LCVGWSSTSC | 70.73 | ICVGWSSTTC | 9.35 | FICVGWSST | 9.35 | | 4.07 |
| NA | N7 | 175 | 0.76 | yes | 4 | 0 | 100 | CVGWSSTTCH | 80.08 | CVGWSSTTC | | ICVGWSSTTC | 9.35 | | 4.07 |
| NA | N7 | 176 | 0.76 | yes | 4 | 0 | 100 | VGWSSTTCHD | 80.08 | | | | | | |
| NA | N7 | 177 | 1.38 | yes | 4 | 0 | 99.59 | GWSSTTCHDG | 79.67 | WSSTTCHDGV | 19.9 | WSSTTCHDGV | 10.98 | WSSTTCHDGV | 5.28 |
| NA | N7 | 178 | 1.05 | yes | 5 | 0 | 68.7 | WSSTTCHDGI | 68.7 | CHDGVNRMTI | 19.9 | CHDGYSRMTI | 2.44 | CHDGIARMTI | 2.44 |
| NA | N7 | 183 | 1.05 | yes | 4 | 0 | 99.19 | CHDGIGRMTI | 80.89 | CHDGVNRMTI | 19.9 | HDGVSRMTIC | 2.44 | HDGVNRMTIC | 2.44 |
| NA | N7 | 184 | 1.05 | yes | 2 | 0 | 99.19 | HDGIGRMTIC | 80.89 | HDGVGRMTIC | 14.6 | | | | |
| NA | N7 | 189 | 0.99 | yes | 2 | 0 | 99.59 | RMTICVQGNN | 75.2 | RMTICVQGDN | 21.1 | | | | |
| NA | N7 | 195 | 0.94 | yes | 5 | 0 | 99.59 | QGNNDNATAT | 82.52 | QGDNENATAT | 11 | QGNNENATAT | 2.44 | QGNNKNATAT | 0.81 |
| NA | N7 | 196 | 0.94 | yes | 5 | 0 | 99.59 | GNNDNATATV | 82.52 | GDNENATATV | 11 | GNNENATATV | 2.44 | GNNKNATATV | 0.81 |
| NA | N7 | 197 | 0.94 | yes | 5 | 0 | 99.59 | NNDNATATYV | 82.52 | DNENATATYV | 11 | NNENATATYV | 2.44 | NNKNATATYV | 0.81 |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 288 | 0.18 | yes | 3 | 0 | 99.19 | TCVCRDNWQG | 97.97 | TCICRDNWQG | 0.41 | | | | |
| NA | N7 | 289 | 0.11 | yes | 2 | 0 | 99.19 | CVCRDNWQGA | 98.78 | SCVCRDNWQG | 0.81 | | | | |
| NA | N7 | 290 | 0.11 | yes | 2 | 0 | 99.19 | VCRDNWQGAN | 98.78 | CGCRDNWQGA | 0.41 | | | | |
| NA | N7 | 291 | 0.04 | yes | 1 | 0 | 99.59 | CRDNWQGANR | 99.59 | ICRDNWQGAN | 0.41 | | | | |
| NA | N7 | 292 | 0.04 | yes | 1 | 0 | 99.59 | RDNWQGANRP | 99.59 | | | | | | |
| NA | N7 | 293 | 0.91 | yes | 2 | 0 | 99.19 | DNWQGANRPY | 72.36 | DNWQGANRPI | 26.8 | | | | |
| NA | N7 | 294 | 0.91 | yes | 2 | 0 | 99.19 | NWQGANRPYI | 72.36 | NWQGANRPII | 26.8 | | | | |
| NA | N7 | 295 | 1.12 | yes | 3 | 0 | 99.19 | WQGANRPIE | 68.7 | WQGANRPIIK | 26.8 | | | | |
| NA | N7 | 296 | 1.12 | yes | 3 | 0 | 99.19 | QGANRPVIEI | 68.7 | QGANRPVIKI | 26.8 | GANRPVIEIN | 2.03 | | |
| NA | N7 | 297 | 1.25 | yes | 3 | 0 | 99.19 | GANRPVIEID | 67.07 | GANRPVIKID | 26.4 | ANRPVIEINM | 2.03 | | |
| NA | N7 | 298 | 1.25 | yes | 3 | 0 | 99.19 | ANRPVIEIDM | 67.07 | ANRPVIKIDM | 26.4 | | | | |
| NA | N7 | 318 | 0.81 | yes | 4 | 0 | 99.19 | CTGVLTDTSR | 76.83 | CTGILTDTSR | 22.8 | | | | |
| NA | N7 | 319 | 1.29 | yes | 2 | 0 | 99.59 | TGVLTDTSRP | 76.83 | TGILTDTSR | 22 | | | | |
| NA | N7 | 320 | 1.29 | yes | 5 | 0 | 99.19 | GVLTDTSRPS | 69.51 | GILTDTSRPK | 22 | GVLTDTSRPG | 2.03 | GILTDTSRPS | 0.81 |
| NA | N7 | 321 | 1.23 | yes | 5 | 0 | 99.19 | VLTDTSRPSD | 68.7 | VLTDTSRPKD | 22.8 | VLTDTSRPGD | 2.03 | ILTDTSRPSD | 0.81 |
| NA | N7 | 322 | 1.12 | yes | 3 | 0 | 99.59 | LTDTSRPSDK | 67.07 | LTDTSRPKDK | 22.8 | LTDTSRPGDR | 1.22 | LTDTSRPSDR | 0.41 |
| NA | N7 | 334 | 1.27 | yes | 4 | 0 | 99.59 | GDCNPITGS | 76.83 | GECNPITGS | 25.6 | | | | |
| NA | N7 | 335 | 0.3 | yes | 4 | 0 | 99.19 | DCNPITGSP | 23.6 | ECNPITGSP | 25.6 | | | | |
| NA | N7 | 336 | 0.3 | yes | 4 | 0 | 99.59 | CNPITGSPG | 69.51 | CNPITGSP | 69.11 | CSNPITGSPG | 0.81 | CSNPITGSPC | 0.41 |
| NA | N7 | 338 | 0.41 | yes | 3 | 0 | 99.19 | NPITGSPGAP | 96.34 | NPITGSPG | 0.81 | NPITGSPGSP | 0.41 | | |
| NA | N7 | 339 | 0.41 | yes | 3 | 0 | 99.19 | PITGSPGAPG | 96.34 | PITGSPAPG | 0.81 | PITGSPCAPG | 0.41 | | |
| NA | N7 | 346 | 1.11 | yes | 4 | 0 | 99.19 | APGVKGFGFL | 93.9 | APGIKGFGFL | 4.47 | | | | |
| NA | N7 | 347 | 1.64 | yes | 4 | 0 | 99.19 | PGVKGFGFLD | 70.73 | PGIKGFGFLN | 13.82 | | | | |
| NA | N7 | 358 | 0.15 | yes | 3 | 0 | 99.19 | GNTWLGRTIS | 47.97 | DNTWLGRTIS | 0.41 | NNTWLGRTIS | 2.03 | DNTWLGGTIS | 0.41 |
| NA | N7 | 359 | 0.32 | yes | 5 | 0 | 99.19 | NTWLGRTISP | 98.37 | SNTWLGRTIS | 24 | TWLGRTISPH | 0.41 | WLGRTISPHS | 0.41 |
| NA | N7 | 360 | 0.48 | yes | 4 | 0 | 99.19 | TWLGRTISPR | 95.93 | STWLGRTISP | 35 | WLGRTFSPRS | 0.41 | LGRTISTRSR | 0.41 |
| NA | N7 | 361 | 0.48 | yes | 4 | 0 | 99.19 | WLGRTISPRS | 93.5 | TWLGRTFSPR | 2.44 | LGGTISPRSR | 0.41 | TISPHSRSGF | 0.41 |
| NA | N7 | 362 | 0.48 | yes | 4 | 0 | 99.19 | LGRTISPRSR | 93.5 | WLGRTISPKI | 2.44 | LGGTISPRS | 2.44 | FSPRSRSGF | 0.41 |
| NA | N7 | 365 | 0.48 | yes | 4 | 0 | 99.19 | TISPRSRSGF | 93.5 | LGRTISPRLR | 2.44 | TFSPRSRSGF | 2.44 | SPRSRSGFEM | 0.41 |
| NA | N7 | 366 | 0.48 | yes | 4 | 0 | 99.19 | ISPRSRSGFE | 93.5 | TISPRLRSGF | 2.44 | ISPHSRSGF | 2.44 | PRSRNGFEML | 0.41 |
| NA | N7 | 367 | 0.48 | yes | 4 | 0 | 99.19 | SPRSRSGFEM | 93.5 | ISPKLRSGFE | 2.44 | SPRSRSGFEV | 2.44 | HSRSGFEMLK | 0.41 |
| NA | N7 | 368 | 0.48 | yes | 5 | 0 | 99.19 | PRSRSGFEMLK | 93.5 | SPKLRSGFEM | 2.44 | PRSRSGFEVL | 2.44 | | |
| NA | N7 | 369 | 0.56 | yes | 4 | 0 | 99.19 | RSRSGFEMLK | 4.88 | PKLRSGFEML | 2.44 | RSRNGFEMLK | 2.44 | | |
| NA | N7 | 370 | 0.48 | yes | 5 | 0 | 99.19 | SRSGFEMLKI | 95.93 | KLRSGFEMLK | 2.44 | SRNGFEMLKI | 2.44 | | |
| NA | N7 | 371 | 0.32 | yes | 5 | 0 | 99.19 | RSGFEMLKIP | 95.93 | LRSGFEMLKI | 2.44 | RNGFEMLKIP | 2.44 | | |
| NA | N7 | 372 | 0.28 | yes | 4 | 0 | 99.19 | SGFEMLKIPN | 96.34 | RSGFEMLKV | 4.88 | SGFEMLKIP | 0.41 | | |
| NA | N7 | 373 | 0.68 | yes | 5 | 0 | 99.19 | GFEMLKIPNA | 89.02 | SGFEMLKV | 2.44 | GFEMLKVPNA | 0.41 | FEMLKIHNAG | 0.41 |
| NA | N7 | 374 | 0.83 | yes | 5 | 0 | 99.19 | FEMLKIPNAG | 86.59 | GFEMLKIPN | 2.44 | FEMLKVPNA | 1.22 | LKVPNAGTDP | 1.22 |
| NA | N7 | 377 | 0.15 | yes | 4 | 0 | 99.19 | LKIPNAGTDP | 98.37 | FEMLKIPNAE | 7.32 | LKVPNAEKDP | 1.63 | | |
| NA | N7 | 401 | 0.08 | yes | 3 | 0 | 99.19 | NWSGYSGSFI | 99.19 | LKIPNAGIDP | 7.32 | | | | |
| NA | N7 | 402 | 0 | yes | 1 | 0 | 100 | WSGYSGSFID | 100 | NRSGYSGSFI | 0.41 | | | | |
| NA | N7 | 403 | 0 | yes | 1 | 0 | 100 | SGYSGSFIDY | 99.19 | DWSGYSGSFI | 0.41 | | | | |

FIG. 74-37

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 404 | 0 | yes | - | 0 | 100 | GYSGSFIDYW | 100 | | | | | | |
| NA | N7 | 405 | 0.78 | yes | 2 | 0 | 100 | YSGSFIDYWD | 76.83 | YSGSFIDYWN | 23.2 | | | | |
| NA | N7 | 406 | 1.08 | yes | 3 | 0 | 99.59 | SGSFIDYWDE | 71.54 | SGSFIDYWND | 23.2 | SGSFIDYWDD | 4.88 | | |
| NA | N7 | 417 | 0.92 | yes | 5 | 0 | 99.59 | SECYNPCFYV | 82.11 | NECYNPCFYV | 12.2 | SVCYNPCFYV | 3.66 | SACYNPCFYV | 0.81 | SKCYNPCFYV | 0.81 |
| NA | N7 | 418 | 0.38 | yes | 3 | 0 | 99.19 | ECYNPCFYVE | 94.31 | VCYNPCFYVE | 4.07 | ACYNPCFYVE | 0.81 | | |
| NA | N7 | 419 | 0 | yes | 1 | 0 | 99.19 | CYNPCFYVEL | 100 | | | | | | |
| NA | N7 | 420 | 0 | yes | 1 | 0 | 99.19 | YNPCFYVELI | 100 | | | | | | |
| NA | N7 | 421 | 0 | yes | 1 | 0 | 100 | NPCFYVELIR | 100 | | | | | | |
| NA | N7 | 422 | 0 | yes | 1 | 0 | 100 | PCFYVELIRG | 100 | | | | | | |
| NA | N7 | 423 | 0 | yes | 1 | 0 | 100 | CFYVELIRGR | 100 | | | | | | |
| NA | N7 | 424 | 0 | yes | 1 | 0 | 100 | FYVELIRGRP | 100 | | | | | | |
| NA | N7 | 425 | 0 | yes | 1 | 0 | 100 | YVELIRGRPE | 100 | | | | | | |
| NA | N7 | 426 | 0 | yes | 1 | 0 | 100 | VELIRGRPEE | 100 | | | | | | |
| NA | N7 | 427 | 0 | yes | 1 | 0 | 100 | ELIRGRPEEA | 100 | | | | | | |
| NA | N7 | 428 | 0.07 | yes | 2 | 0 | 100 | LIRGRPEEAK | 99.19 | IRGRPEEVKY | 0.81 | | | | |
| NA | N7 | 429 | 0.07 | yes | 2 | 0 | 100 | IRGRPEEAKY | 99.19 | RGRPEEVKYW | 0.81 | | | | |
| NA | N7 | 430 | 0.11 | yes | 3 | 0 | 100 | RGRPEEAKYV | 98.78 | GRPEEAKYVE | 4.88 | GRPEEVKYVW | 0.81 | | |
| NA | N7 | 431 | 0.39 | yes | 3 | 0 | 99.59 | GRPEEAKYVW | 93.9 | RPEEAKYVEW | 4.88 | RPEEVKYVWW | 0.81 | | |
| NA | N7 | 432 | 0.39 | yes | 3 | 0 | 99.59 | RPEEAKYVWW | 93.9 | PEEAKYVEWT | 4.88 | PEEVKYVWWT | 4.88 | | |
| NA | N7 | 433 | 0.48 | yes | 4 | 0 | 99.59 | PEEAKYVWWT | 92.68 | EEAKYVEWTS | 4.88 | EEVKYVWWTS | 4.88 | | |
| NA | N7 | 434 | 0.48 | yes | 4 | 0 | 99.59 | EEAKYVWWTS | 92.68 | EAKYVEWTSN | 4.88 | EVKYVWWTSN | 4.88 | | |
| NA | N7 | 435 | 0.48 | yes | 4 | 0 | 99.59 | EAKYVWWTSN | 92.68 | AKYVEWTSNS | 4.88 | VKYVWWTSNS | 4.88 | | |
| NA | N7 | 436 | 0.48 | yes | 4 | 0 | 99.59 | AKYVWWTSNS | 92.68 | KYVEWTSNSL | 4.88 | | | | |
| NA | N7 | 437 | 0.41 | yes | 4 | 0 | 99.59 | KYVWWTSNSL | 93.5 | YVEWTSNSLI | 4.88 | YVWWASNSLI | 1.22 | | |
| NA | N7 | 438 | 1.16 | yes | 3 | 0 | 100 | YVWWTSNSLV | 70.73 | YVWWTSNSLI | 22.8 | VWWASNSLIA | 1.22 | | |
| NA | N7 | 439 | 1.13 | yes | 5 | 0 | 99.59 | VWWTSNSLVA | 71.14 | VWWTSNSLIA | 22.8 | WWASNSLIAL | 1.22 | | |
| NA | N7 | 440 | 1.13 | yes | 5 | 0 | 99.59 | WWTSNSLVAL | 71.02 | WWTSNSLIAL | 22.9 | | | | |
| NA | N7 | 441 | 0.94 | yes | 3 | 0 | 99.59 | WTSNSLVALC | 71.02 | WTSNSLIALC | 27.8 | | | | |
| NA | N7 | 442 | 0.94 | yes | 3 | 0 | 99.59 | TSNSLVALCG | 71.02 | TSNSLIALCG | 27.8 | | | | |
| NA | N7 | 443 | 0.87 | yes | 2 | 0 | 99.59 | SNSLVALCGS | 71.02 | SNSLIALCGS | 29 | | | | |
| NA | N7 | 444 | 0.87 | yes | 2 | 0 | 100 | NSLVALCGSP | 71.02 | NSLIALCGSP | 29 | | | | |
| NA | N7 | 445 | 1.89 | yes | 5 | 0.41 | 99.18 | SLVALCGSPV | 35.92 | SLIALCGSPV | 34.7 | SLIALCGSPF | 22.45 | SLIALCGSPY | 5.31 | SLIALCGSPV | 0.82 |
| NA | N7 | 455 | 1.13 | yes | 3 | 0.41 | 99.17 | SVGGSFPDG | 63.07 | PVGGSFPDG | 34.4 | PVGPGSFPDG | 1.24 | PIGGGFFPDG | 0.41 | |
| NA | N7 | 456 | 0.22 | yes | 5 | 0.41 | 99.16 | VGGSFPDGA | 97.47 | VGPGSFPDGA | 1.27 | GSGSFPDGAR | 0.42 | GSGSFPDGAR | 0.43 | GSGLPDGAQ | 0.43 |
| NA | N7 | 457 | 0.3 | yes | 3 | 2.03 | 99.14 | GGSFPDGA | 96.57 | GPGSFPDGA | 1.29 | GSGSFPDGA | 1.32 | SGSFPDGAQI | 0.44 | SGSLPDGAQI | 0.44 |
| NA | N7 | 458 | 0.3 | yes | 5 | 3.66 | 99.12 | GSFPDGAQI | 96.49 | PGSFPDGAQI | 1.32 | GSFPDGAQI | 5.29 | GSFPDGPQI | 0.44 | GSFPDGAKIQ | 0.44 |
| NA | N7 | 459 | 0.5 | yes | 5 | 5.28 | 99.12 | SFPDGAQIY | 92.51 | GSFPDGAQIY | 5.29 | SFPDGPQIQ | 5.33 | GFPDGPQIQY | 0.47 | GSFPDGAQIY | 0.47 |
| NA | N7 | 460 | 0.5 | yes | 5 | 7.32 | 99.11 | FPDGAQIYF | 92.44 | SFPDGAQIYF | 5.33 | FPNGAQIQY | 5.58 | SFPNGAQIQY | 0.47 | FFPDGPQIQY | 0.47 |
| NA | N7 | 461 | 0.52 | yes | 5 | 7.72 | 99.07 | PDGAQIYFS | 92.09 | FPDGAQIYFS | 5.58 | SFPNGAQIKY | 5.85 | FPNGAQIKYF | 0.49 | LPDGAQIQYF | 0.47 |
| NA | N7 | 462 | 0.5 | yes | 5 | 8.54 | 99.02 | PDGAQIKYFS | 92.2 | PDGAQIKYFS | 5.85 | PDGARIQYFS | 21.2 | PDGARIQYFS | 0.49 | |
| NA | N8 | 169 | 1.01 | no | 4 | 12.6 | 99.02 | KGFAPFSKDN | 75.76 | PDGAKIQYFS | 21.2 | EGFAPFSKDN | 1.09 | EGFAPFSKDN | 0.98 | |
| NA | N8 | 170 | 0.09 | yes | 1 | 0.11 | 99.13 | GFAPFSKDNG | 99.13 | RGFAPFSKDN | 21.2 | | | | |

FIG. 74-38

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 171 | 0.12 | yes | 2 | 0.11 | 99.13 | FAPSKDNGI | 98.91 | | | | | | |
| NA | N8 | 172 | 0.11 | yes | 1 | 0.11 | 99.02 | APSKDNGIR | 99.02 | | | | | | |
| NA | N8 | 173 | 0.09 | yes | 1 | 0.11 | 99.13 | PSKDNGIRI | 99.13 | | | | | | |
| NA | N8 | 174 | 0.09 | yes | 1 | 0.11 | 99.13 | SKDNGIRIG | 99.13 | | | | | | |
| NA | N8 | 175 | 0.07 | yes | 1 | 0.11 | 99.35 | KDNGIRIGS | 99.35 | | | | | | |
| NA | N8 | 176 | 0.13 | yes | 2 | 0.11 | 99.46 | DNGIRIGSR | 98.8 | KDNGIRIGSK | 0.87 | | | | | |
| NA | N8 | 177 | 0.11 | yes | 2 | 0.11 | 99.67 | NGIRIGSRG | 98.8 | DNGIRIGSKG | 0.87 | | | | | |
| NA | N8 | 178 | 0.11 | yes | 2 | 0.11 | 99.67 | GIRIGSRGH | 98.8 | NGIRIGSKGH | 0.87 | | | | | |
| NA | N8 | 179 | 0.38 | yes | 3 | 0.11 | 99.67 | IRIGSRGHV | 94.13 | GIRIGSRGHI | 4.67 | GIRIGSKGHV | 0.87 | | | |
| NA | N8 | 180 | 0.4 | yes | 3 | 0.11 | 99.46 | RIGSRGHVF | 93.91 | IRIGSRGHIF | 4.67 | IRIGSKGHVF | 0.87 | | | |
| NA | N8 | 181 | 0.44 | yes | 3 | 0.11 | 99.13 | IGSRGHVFV | 93.59 | RIGSRGHIFV | 4.67 | RIGSKGHVFV | 0.87 | | | |
| NA | N8 | 182 | 0.44 | yes | 3 | 0.11 | 99.13 | GSRGHVFVI | 93.59 | IGSRGHIFVI | 4.67 | IGSKGHVFVI | 0.87 | | | |
| NA | N8 | 183 | 0.44 | yes | 3 | 0.11 | 99.13 | SRGHVFVIR | 93.59 | GSRGHIFVIR | 4.67 | GSKGHVFVIR | 0.87 | | | |
| NA | N8 | 184 | 0.45 | yes | 3 | 0.11 | 99.13 | RGHVFVIRE | 93.48 | SRGHIFVIRE | 4.67 | SKGHVFVIRE | 0.87 | | | |
| NA | N8 | 185 | 0.38 | yes | 3 | 0.11 | 99.02 | GHVFVIREP | 94.02 | RGHIFVIREP | 4.67 | KGHVFVIREP | 0.87 | | | |
| NA | N8 | 186 | 0.41 | yes | 3 | 0.11 | 99.02 | HVFVIREPF | 93.91 | GHIFVIREPF | 4.67 | | | | | |
| NA | N8 | 187 | 0.42 | yes | 4 | 0.11 | 99.13 | VFVIREPFV | 98.59 | HIFVIREPFV | 4.67 | HVFIIREPFV | 0.33 | | | |
| NA | N8 | 188 | 0.15 | yes | 4 | 0.11 | 99.13 | FVIREPFVS | 98.8 | IFVIREPFVS | 4.67 | VFIIREPFVS | 0.33 | | | |
| NA | N8 | 189 | 0.13 | yes | 2 | 0.11 | 99.13 | VIREPFVSC | 99.13 | FVIREPFISC | 0.33 | FVIREPFIS | 0.22 | | | |
| NA | N8 | 190 | 0.1 | yes | 2 | 0.11 | 99.13 | IREPFVSCS | 98.8 | | | | | | |
| NA | N8 | 191 | 0.25 | yes | 4 | 0.33 | 99.13 | REPFVSCSP | 97.39 | ECRTFLTHG | 0.87 | ECRTFLTLTQG | 0.54 | DCRTFFLTQG | 0.33 |
| NA | N8 | 202 | 0.14 | yes | 2 | 0.33 | 98.58 | ECRTFLTQGS | 98.58 | CRTFLTHGS | 0.54 | | | | |
| NA | N8 | 203 | 0.14 | yes | 2 | 0.33 | 98.58 | CRTFFLTQGS | 98.58 | RTFFLTHGSL | 0.54 | | | | |
| NA | N8 | 204 | 0.19 | yes | 3 | 0.33 | 98.15 | RTFFLTQGSL | 98.15 | TFFLTHGSLL | 0.54 | TFFLTQGSLP | 0.22 | | | |
| NA | N8 | 205 | 0.17 | yes | 3 | 0.33 | 98.37 | TFFLTQGSLL | 98.37 | FFLTHGSLLN | 0.54 | | | | |
| NA | N8 | 206 | 0.17 | yes | 3 | 0.33 | 98.37 | FFLTQGSLLN | 98.37 | FLTHGSLLND | 0.54 | | | | |
| NA | N8 | 207 | 0.22 | yes | 4 | 0.33 | 97.93 | FLTQGSLLND | 97.71 | LTHGSLLNDR | 0.54 | LTQGSLPNDK | 0.22 | | | |
| NA | N8 | 208 | 0.2 | yes | 4 | 0.33 | 97.93 | LTQGSLLNDR | 97.71 | THGSLLNDRH | 0.54 | | | | |
| NA | N8 | 209 | 0.22 | yes | 4 | 0.11 | 98.04 | TQGSLLNDRH | 97.93 | HGSLLNDRHS | 0.65 | QGSLLNDKHF | 0.22 | | | |
| NA | N8 | 210 | 0.21 | yes | 4 | 0.22 | 97.71 | QGSLLNDRHS | 97.71 | GSLLNDRHSN | 0.65 | GSLLNDKHSS | 0.22 | | | |
| NA | N8 | 211 | 0.21 | yes | 4 | 0.22 | 98.04 | GSLLNDRHSN | 97.93 | SLLNDRHSNG | 0.65 | SLLNDKHSSG | 0.22 | | | |
| NA | N8 | 212 | 0.21 | yes | 4 | 0.22 | 97.93 | SLLNDRHSNG | 97.93 | LLNDRHSNGT | 0.65 | LLNDKHSNGT | 0.22 | | | |
| NA | N8 | 213 | 0.6 | yes | 4 | 0.22 | 89.88 | LLNDKHSNG | 8.16 | SLPNDKHSNG | 0.65 | NDKHSNGTMK | 0.44 | | | |
| NA | N8 | 215 | 0.59 | yes | 4 | 0.22 | 89.99 | NDKHSNGTIK | 8.16 | LPNDKHSNGT | 0.65 | DKHSNGTMKD | 0.44 | | | |
| NA | N8 | 216 | 0.61 | yes | 4 | 0.22 | 89.77 | DKHSNGTIKD | 8.27 | NDKHSNGTIK | 0.65 | KHSNGTMKD | 0.44 | KHSSGTVKDR | 0.22 |
| NA | N8 | 217 | 0.57 | yes | 4 | 0.22 | 90.21 | KHSNGTIKDR | 8.27 | DKHSNGTIKD | 0.65 | HSSGTVKDRS | 0.44 | | | |
| NA | N8 | 218 | 0.57 | yes | 4 | 0.22 | 90.21 | HSNGTIKDRS | 8.27 | KHSNGTIKDR | 0.65 | SSGTVKDRSP | 0.22 | | | |
| NA | N8 | 219 | 0.57 | yes | 5 | 0.22 | 90.21 | SNGTIKDRSP | 8.27 | HSNGTIKDRS | 0.44 | NGTMKDRSPY | 0.22 | | | |
| NA | N8 | 220 | 1.03 | yes | 4 | 0.22 | 79.54 | NGTVKDRSPF | 10.8 | SNGTIKDRSP | 0.44 | GTMKDRSPYR | 0.44 | | | |
| NA | N8 | 221 | 1.03 | yes | 4 | 0.22 | 79.54 | GTVKDRSPYR | 10.9 | NGTVKDRSPY | 0.44 | TMKDRSPYRT | 0.44 | | | |
| NA | N8 | 222 | 1.02 | yes | 4 | 0.22 | 79.65 | TVKDRSPYRT | 10.9 | GTVKDRSPYR | 0.44 | MKDRSPYRTL | 0.44 | | | |
| NA | N8 | 223 | 1.03 | yes | 4 | 0.22 | 79.54 | VKDRSPYRTL | 10.9 | TVKDRSPYRT | 0.44 | | | | |

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 123 | 0.38 | yes | 4 | 0 | 99.55 | VSCDPDECRF | 95.02 | VSCEPDECRF | 1.81 | VSCDPNECRF | 0.9 | | |
| NA | N9 | 124 | 0.38 | yes | 4 | 0 | 99.55 | SCDPDECRFY | 95.02 | SCDPDGCRFY | 1.81 | SCDPNECRFY | 0.9 | | |
| NA | N9 | 125 | 0.38 | yes | 4 | 0 | 99.55 | CDPDECRFYA | 95.02 | CEPDECRFYA | 1.81 | CDPNECRFYA | 0.9 | | |
| NA | N9 | 126 | 0.38 | yes | 4 | 0 | 99.55 | DPDECRFYAL | 95.02 | DPDGCRFYAL | 1.81 | DPNECRFYAL | 0.9 | | |
| NA | N9 | 127 | 0.25 | yes | 3 | 0 | 99.55 | PDECRFYALS | 96.83 | PDGCRFYALS | 1.81 | | | | |
| NA | N9 | 128 | 0.25 | yes | 2 | 0 | 99.55 | DECRFYALSQ | 96.83 | DGCRFYALSQ | 1.81 | | | | |
| NA | N9 | 129 | 0.17 | yes | 1 | 0 | 99.55 | ECRFYALSQG | 97.74 | GCRFYALSQG | 0.9 | | | | |
| NA | N9 | 130 | 0.04 | yes | 1 | 0 | 99.55 | CRFYALSQGT | 99.55 | | | | | | |
| NA | N9 | 131 | 0.04 | yes | 1 | 0 | 99.55 | RFYALSQGTT | 99.55 | | | | | | |
| NA | N9 | 132 | 0.04 | yes | 1 | 0 | 99.55 | FYALSQGTTI | 99.55 | | | | | | |
| NA | N9 | 133 | 0.04 | yes | 1 | 0 | 99.55 | YALSQGTTIR | 99.55 | | | | | | |
| NA | N9 | 134 | 0.04 | yes | 1 | 0 | 99.55 | ALSQGTTIRG | 99.55 | | | | | | |
| NA | N9 | 135 | 0.29 | yes | 2 | 0 | 99.55 | LSQGTTIRGK | 95.48 | LSQGTTIRGR | 4.07 | | | | |
| NA | N9 | 136 | 0.29 | yes | 2 | 0 | 99.55 | SQGTTIRGKH | 95.48 | SQGTTIRGRH | 4.07 | | | | |
| NA | N9 | 137 | 0.29 | yes | 2 | 0 | 99.55 | QGTTIRGKHS | 95.48 | QGTTIRGRHS | 4.07 | | | | |
| NA | N9 | 138 | 0.29 | yes | 2 | 0 | 99.55 | GTTIRGKHSN | 95.48 | GTTIRGRHSN | 4.07 | | | | |
| NA | N9 | 139 | 0.29 | yes | 2 | 0 | 99.55 | TTIRGKHSNG | 95.48 | TTIRGRHSNG | 4.07 | | | | |
| NA | N9 | 140 | 0.29 | yes | 2 | 0 | 99.55 | TIRGKHSNGT | 95.48 | TIRGRHSNGT | 4.07 | | | | |
| NA | N9 | 141 | 0.29 | yes | 2 | 0 | 99.55 | IRGKHSNGTI | 95.48 | IRGRHSNGTI | 4.07 | | | | |
| NA | N9 | 142 | 0.25 | yes | 2 | 0 | 99.55 | RGKHSNGTIH | 95.93 | RGRHSNGTIH | 4.07 | | | | |
| NA | N9 | 143 | 0.25 | yes | 2 | 0 | 99.55 | GKHSNGTIHD | 95.93 | GRHSNGTIHD | 4.07 | | | | |
| NA | N9 | 144 | 0.25 | yes | 2 | 0 | 99.55 | KHSNGTIHDR | 95.93 | RHSNGTIHDR | 4.07 | | | | |
| NA | N9 | 145 | 0 | yes | 1 | 0 | 100 | HSNGTIHDRS | 100 | | | | | | |
| NA | N9 | 146 | 0 | yes | 1 | 0 | 100 | SNGTIHDRSQ | 100 | | | | | | |
| NA | N9 | 147 | 0 | yes | 1 | 0 | 100 | NGTIHDRSQY | 100 | | | | | | |
| NA | N9 | 148 | 0.25 | yes | 2 | 0 | 99.1 | GTIHDRSQYR | 99.1 | TIHDRSQYRA | 85.52 | TIHDRSQYRS | 13.6 | | |
| NA | N9 | 149 | 0.65 | yes | 2 | 0 | 99.1 | TIHDRSQYRA | 85.52 | IHDRSQYRAL | 85.52 | IHDRSQYRSL | 13.6 | | |
| NA | N9 | 150 | 0.65 | yes | 2 | 0 | 99.1 | IHDRSQYRAL | 85.52 | HDRSQYRALI | 80.09 | HDRSQYRSLI | 13.6 | HDRSQYRALV | 5.43 |
| NA | N9 | 151 | 0.95 | yes | 3 | 0 | 99.1 | HDRSQYRALI | 80.09 | DRSQYRALIS | 80.09 | DRSQYRSLIS | 13.6 | DRSQYRALVS | 5.43 |
| NA | N9 | 152 | 0.95 | yes | 3 | 0 | 99.1 | DRSQYRALIS | 80.09 | RSQYRALISW | 80.09 | RSQYRSLISW | 13.6 | RSQYRALVSW | 5.43 |
| NA | N9 | 153 | 0.95 | yes | 3 | 0 | 99.1 | RSQYRALISW | 80.09 | SQYRALISWP | 78.73 | SQYRSLISWP | 13.6 | SQYRALVSWP | 5.43 |
| NA | N9 | 154 | 1.05 | yes | 4 | 0 | 99.1 | SQYRALISWP | 78.73 | QYRALISWPL | 78.73 | QYRSLISWPL | 13.6 | QYRALVSWPL | 5.43 | QYRALISWPQ | 1.36 |
| NA | N9 | 155 | 1.05 | yes | 4 | 0 | 99.1 | QYRALISWPL | 78.73 | YRALISWPLS | 78.73 | YRSLISWPLS | 13.6 | YRALVSWPLS | 5.43 | YRALISWPQS | 1.36 |
| NA | N9 | 156 | 1.05 | yes | 4 | 0 | 99.1 | YRALISWPLS | 78.73 | RALISWPLSS | 78.73 | RSLISWPLSS | 13.6 | RALVSWPLSS | 5.43 | RALISWPQSS | 1.36 |
| NA | N9 | 157 | 1.05 | yes | 4 | 0 | 99.1 | RALISWPLSS | 78.73 | ALISWPLSSP | 78.73 | SLISWPLSSP | 13.6 | ALVSWPLSSP | 5.43 | ALISWPQSSP | 1.36 |
| NA | N9 | 158 | 0.41 | yes | 3 | 0 | 99.1 | ALISWPLSSP | 93.21 | LISWPLSSPP | 93.21 | LVSWPLSSPP | 5.43 | | |
| NA | N9 | 159 | 0.41 | yes | 3 | 0 | 99.1 | LISWPLSSPP | 93.21 | ISWPLSSPPT | 93.21 | VSWPLSSPPT | 5.43 | | |
| NA | N9 | 160 | 0.1 | yes | 2 | 0 | 100 | ISWPLSSPPT | 98.64 | SWPLSSPPTV | 1.36 | | | | |
| NA | N9 | 161 | 0.1 | yes | 2 | 0 | 100 | SWPLSSPPTV | 98.64 | WPQSSPPTVY | 1.36 | | | | |
| NA | N9 | 162 | 0.1 | yes | 2 | 0 | 99.1 | WPLSSPPTVY | 97.74 | PQSSPPTVYN | 1.36 | | | | |
| NA | N9 | 163 | 0.18 | yes | 2 | 0 | 99.1 | PLSSPPTVYN | 97.74 | QSSPPTVYNS | 1.36 | QSSPPTVYNS | 1.36 | | |
| NA | N9 | 164 | 0.74 | yes | 4 | 0 | 99.1 | LSSPPTVYNS | 87.78 | LSSPPTVYNN | 5.88 | LSSPPTVYNN | 4.07 | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 374 | 0.08 | yes | 1 | 0.45 | 99.09 | GYEMLKVPNA | 99.09 | | | | | | |
| NA | N9 | 375 | 0.08 | yes | 1 | 0.45 | 99.09 | YEMLKVPNAL | 99.09 | | | | | | |
| NA | N9 | 376 | 0.13 | yes | 2 | 0.45 | 99.09 | EMLK

FIG. 74-48

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 429 | 0.35 | yes | 4 | 0.45 | 99.55 | IRGRPKE

FIG. 74-49

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 42 | 0.08 | yes | 1 | 0 | 99.19 | EVT

FIG. 74-50

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 233 | 0.34 | yes | 5 | 0 | 99.6 | VNGQSGRIDF | 95.95 | VNGQSGRINEF | 1.21 | VNGQRGRIDF | 0.81 | VNGQS

FIG. 74-51

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H0 | 340 | 0.12 | yes | 2 | 0 | 100 | RGLFGAIAGF | 98.38 | RGLFGAKAGF | 1.62 | | | | |
| HA | H0 | 341 | 0.16 | yes | 2 | 0 | 99.6 | GLFGAIAGFI | 97.98 | GLFGAKAGFI | 1.62 | | | | |
| HA | H0 | 342 | 0.16 | yes | 2 | 0 | 99.6 | LFGAIAGFIE | 97.98 | LFGAKAGFIE | 1.62 | | | | |

FIG. 74-52

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 389 | 0.04 | yes | 1 | 0 | 99.6 | TGKLNRLIEK | 99.6 | | | | | | |
| HA | H10 | 390 | 0.04 | yes | 1 | 0 | 99.6 | GKLN

FIG. 74-53

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 431 | 0.11 | yes | 2 | 0 | 99.19

FIG. 74-54

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 473 | 0.14 | yes | 2 | 0 | 99.19 | DGKGCFEIYH | 98.38 | DGRGCFEIYH | 0.81 | | | | |
| HA | H10 | 487 | 1.01 | yes | 5 | 0 | 99.19 | NCMESIRNNT | 71.66 | SCMESIRDNT | 26.3 | NCMERIRNNT | | P

FIG. 74-55

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 17 | 0.47 | yes | 3 | 0 | 100 | LDKICLGHHA | 5.19 | LDKICLGHHA | 2.6 | LDR

| Protein | Sub-type | Start Pos | Block Entropy | Gaps > 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 203 | 0.31 | y

FIG. 74-58

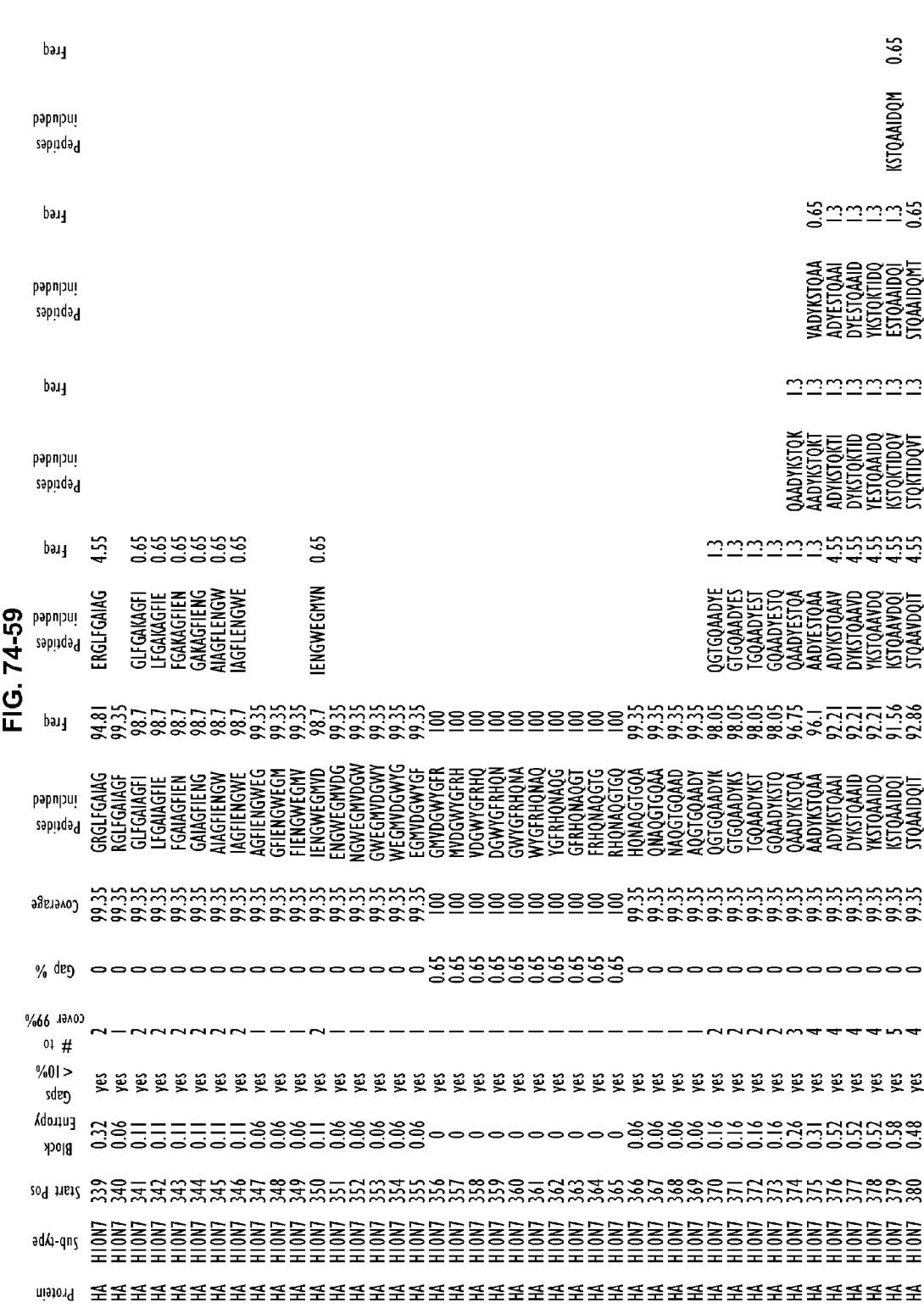

FIG. 74-60

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 381 | 0.48 | yes | 4 | 0 | 99.35 | TQAAIDQITG | 92.86 | TQKTIDQVTG | 4

FIG. 74-62

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 465 | 0 | yes | 1 | 0 | 100 | QLRQNAEEDG | 100 | | | | | | |
| HA | H10N7 | 466 | 0.1 | yes | 2 | 0 |

FIG. 74-63

| Protein | Sub-type | Start Pos | Block Entropy | Gaps > 10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H10N7 | 515 | 0.85 | yes | 4 | 0 | 99.35 | PVKLSSGYKD | 81.17 | SVKLSSGYKD | 16.2

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 237 | 0.82 | yes | 4 | 0 | 100 | CVVIMTDGSA | 84.67 | CAVVM

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 443 | 0.36 | yes | 2 | 0.67

FIG. 74-72

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 37 | 1.05 | yes | 4 | 0 | 99.48 | ESNV

FIG. 74-73

| Protein | Sub-type | Start Pos | Block Entropy | Gaps >10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H1 | 100 | 1.58 | yes | 4 | 0 | 100 | NPTNGICYPG | 58

FIG. 74-74

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 346 | 0.08 | yes | 2 | 0 | 100 | GAIAGFIEGG | 98.96 | GAIAGFIEGG | 1.04 | | | | | |
| HA | H1 | 347 | 0.08 | yes | 2 | 0 | 100 | AIAGFIEGGW | 98.96 | AIAGFIEGGW | 1.04 | | | | | |
| HA | H1 | 348 | 0.08 | yes | 2 | 0 | 100 | IAGFIEGGWP | 98.96 | IAGFIEGGWP | 1.04 | | | | | |
| HA | H1 | 349 | 0 | yes | 1 | 0 | 100 | AGFIEGGWPG | 100 | | | | | | | |
| HA | H1 | 350 | 0 | yes | 1 | 0 | 100 | GFIEGGWPGL | 100 | | | | | | | |
| HA | H1 | 351 | 0.05 | yes | 1 | 0 | 99.48 | FIEGGWPGLI | 99.48 | | | | | | | |
| HA | H1 | 352 | 0.05 | yes | 1 | 0 | 99.48 | IEGGWPGLIN | 99.48 | | | | | | | |
| HA | H1 | 353 | 0.05 | yes | 1 | 0 | 99.48 | EGGWPGLING | 99.48 | | | | | | | |
| HA | H1 | 354 | 0.05 | yes | 1 | 0 | 99.48 | GGWPGLINGW | 99.48 | | | | | | | |
| HA | H1 | 355 | 0.05 | yes | 1 | 0 | 99.48 | GWPGLINGWY | 99.48 | | | | | | | |
| HA | H1 | 356 | 0.05 | yes | 1 | 0 | 99.48 | WPGLINGWYG | 99.48 | | | | | | | |
| HA | H1 | 357 | 0.05 | yes | 1 | 0 | 99.48 | PGLINGWYGF | 99.48 | | | | | | | |
| HA | H1 | 358 | 0.05 | yes | 1 | 0 | 99.48 | GLINGWYGFQ | 99.48 | | | | | | | |
| HA | H1 | 359 | 0.05 | yes | 1 | 0 | 99.48 | LINGWYGFQH | 99.48 | | | | | | | |
| HA | H1 | 360 | 0.05 | yes | 1 | 0 | 99.48 | INGWYGFQHR | 99.48 | | | | | | | |
| HA | H1 | 361 | 0.09 | yes | 2 | 0 | 99.48 | NGWYGFQHRN | 98.96 | GWYGFQHRND | 0.52 | | | | | |
| HA | H1 | 362 | 0.09 | yes | 2 | 0 | 99.48 | GWYGFQHRNE | 98.96 | WYGFQHRNDE | 0.52 | | | | | |
| HA | H1 | 363 | 0.09 | yes | 2 | 0 | 99.48 | WYGFQHRNEE | 98.96 | YGFQHRDEEG | 0.52 | | | | | |
| HA | H1 | 364 | 0.09 | yes | 2 | 0 | 99.48 | YGFQHRNEEG | 98.96 | GFQHRDEEGT | 0.52 | | | | | |
| HA | H1 | 365 | 0.09 | yes | 2 | 0 | 99.48 | GFQHRNEEGT | 98.96 | FQHRNDEFGTG | 0.52 | | | | | |
| HA | H1 | 366 | 0.14 | yes | 2 | 0 | 98.45 | FQHRNEEGTG | 98.45 | QHRNEEGTGV | 0.52 | QHRDEEGTGI | 0.52 | | | | |
| HA | H1 | 367 | 0.14 | yes | 2 | 0 | 98.45 | QHRNEEGTGI | 98.45 | HRDEEGTGIA | 0.52 | HRNDEGTGIA | 0.52 | | | | |
| HA | H1 | 368 | 0.14 | yes | 2 | 0 | 98.45 | HRNEEGTGIA | 98.45 | RNEEGTGVAA | 0.52 | RDEEGTGIAA | 0.52 | | | | |
| HA | H1 | 369 | 0.45 | yes | 3 | 0 | 92.23 | RNEEGTGIAA | 98.45 | NDEGTGIAAD | 0.52 | NEEGTGVAAD | 0.52 | | | | |
| HA | H1 | 370 | 0.4 | yes | 3 | 0 | 92.75 | NEEGTGIAAD | 92.23 | EEGTGIAADR | 0.52 | DEGTGIAADK | 0.52 | | | | |
| HA | H1 | 371 | 0.4 | yes | 3 | 0 | 92.75 | EEGTGIAADK | 92.75 | EGTGIAADRE | 0.52 | | | | | |
| HA | H1 | 372 | 0.4 | yes | 3 | 0 | 92.75 | GTGIAADKES | 92.75 | GTGI

FIG. 74-75

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 442 | 0.15 | yes | 2 | 0 | 100 | VLLENEKTLD | 97

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H12 | 315 | 0.26 | yes | 3 | 1.18 | 100 | IGKCP

FIG. 74-83

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H12 | 360 | 0 | yes | 1 | 0 | 100 | VAGWYGF

FIG. 74-84

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|
| HA | H12 | 426 | 0.49 | yes | 5 | 0 | 100 | IDDQIT

FIG. 74-85

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 493 | 1.52 | yes | 5 | 0 | 100 | TIRNGTY

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 128 | 1.15 | yes | 3 | 0 | 100 | SFSRTELIAP | 56.92 | SFSRTELIPP | 40 | SFSRTQLIAP | 3.08 | | |
| HA | H3 | 155 | 1.82 | no | 5 | 47.69 | 100 | KGTNSFYRNL | 41.18 | KGTNSFYRNL | 32.4 | TGTNSFYRNL | 20.59 | RGTNSFYRNL | 2.94 | KGF

FIG. 74-89

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 275 | 0.33 | yes | 2 | 0 | 100 | EEY

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 382 | 0.11 | yes | 2 | 0 | 100 | KESTQKAIDQ | 98.46 | KESTQKAIDR | 1.54 | | | | | |

FIG. 74-92

| Protein | Sub-type | Start Pos | Block Entropy | Gaps <10% | # to cover 99% | % Gap | Coverage | Included peptides | Freq | Included peptides | Freq | Included peptides | Freq | Included peptides | Freq |
|---|---|---|---|---|---|---|---|---|---|---|---|---|---|---|---|
| HA | H13 | 424 | 0 | yes | 1 | 0 | 100 | LADRIDDAVT | 100 | | | | | | |
| HA | H13 | 425 | 0 | yes | 1 | 0 | 100 | ADRIDDAVTD | 100 | | | | | | |
| HA | H13 | 426 | 0.97 | yes | 2 | 0 | 100 | DRIDDAVTDV | 60 | DRIDDAVTDI | 40 | | | | |
| HA | H13 | 427 | 0.97 | yes | 2 | 0 | 100 | RIDDAVTDVW | 60 | RIDDAVTDIW | 40 | | | | |
| HA | H13 | 428 | 0.97 | yes | 2 | 0 | 100 | IDDAVTDVWS | 60 | IDDAVTDIWS | 40 | | | | |
| HA | H13 | 429 | 0.97 | yes | 2 | 0 | 100 | DDAVTDVWSY | 60 | DDAVTDIWSY | 40 | | | | |
| HA | H13 | 430 | 0.97 | yes | 2 | 0 | 100 | DAVTDVWSYN | 60 | DAVTDIWSYN | 40 | | | | |
| HA | H13 | 431 | 1.07 | yes | 3 | 0 | 100 | AVTDVWSYNA | 60 | AVTDIWSYNA | 38.5 | VTDIWSYNAR | 1.54 | | |
| HA | H13 | 432 | 1.07 | yes | 3 | 0 | 100 | VTDVWSYNAK | 60 | VTDIWSYNAK | 38.5 | TDIWSYNARL | 1.54 | | |
| HA | H13 | 433 | 1.07 | yes | 3 | 0 | 100 | TDVWSYNAKL | 60 | TDIWSYNAKL | 38.5 | DIWSYNARLL | 1.54 | | |
| HA | H13 | 434 | 1.07 | yes | 3 | 0 | 100 | DVWSYNAKLL | 60 | DIWSYNAKLL | 38.5 | IWSYNARLLY | 1.54 | | |
| HA | H13 | 435 | 0.11 | yes | 2 | 0 | 100 | VWSYNAKLLV | 98.46 | WSYNARLLVL | 1.54 | | | | |
| HA | H13 | 436 | 0.11 | yes | 2 | 0 | 100 | WSYNAKLLVL | 98.46 | SYNARLLVLL | 1.54 | | | | |
| HA | H13 | 437 | 0.11 | yes | 2 | 0 | 100 | SYNAKLLVLL | 98.46 | YNARLLVLLE | 1.54 | | | | |
| HA | H13 | 438 | 0.11 | yes | 2 | 0 | 100 | YNAKLLVLLE | 98.46 | NARLLVLLEN | 1.54 | | | | |
| HA | H13 | 439 | 0.11 | yes | 2 | 0 | 100 | NAKLLVLLEN | 98.46 | ARLLVLLEND | 1.54 | | | | |
| HA | H13 | 440 | 0 | yes | 1 | 0 | 100 | AKLLVLLEND | 100 | RLLVLLENDK | 1.54 | | | | |
| HA | H13 | 441 | 0 | yes | 1 | 0 | 100 | KLLVLLENDK | 100 | | | | | | |
| HA | H13 | 442 | 0.11 | yes | 2 | 0 | 100 | LLVLLENDKT | 98.46 | | | | | | |
| HA | H13 | 443 | 0.11 | yes | 2 | 0 | 100 | LVLLENDKTL | 98.46 | VLLENDKTLN | 1.54 | | | | |
| HA | H13 | 444 | 0.23 | yes | 3 | 0 | 96.92 | VLLENDKTLD | 96.92 | LLENDKTLNM | 1.54 | | | | |
| HA | H13 | 445 | 0.23 | yes | 3 | 0 | 96.92 | LLENDKTLDM | 96.92 | LENDKTLNMH | 1.54 | | | | |
| HA | H13 | 446 | 0.23 | yes | 3 | 0 | 96.92 | LENDKTLDMH | 96.92 | ENDKTLNMHD | 1.54 | | | | |
| HA | H13 | 447 | 0.23 | yes | 3 | 0 | 96.92 | ENDKTLDMHD | 96.92 | NDKTLNMHDA | 1.54 | | | | |
| HA | H13 | 448 | 0.23 | yes | 3 | 0 | 96.92 | NDKTLDMHDA | 96.92 | DKTLNMHDAN | 1.54 | | | | |
| HA | H13 | 449 | 0.23 | yes | 3 | 0 | 96.92 | DKTLDMHDAN | 96.92 | KTLNMHDANV | 1.54 | | | | |
| HA | H13 | 450 | 0.62 | yes | 4 | 0 | 89.23 | KTLDMHDANV | 89.23 | TLNMHDANVR | 1.54 | TLDLHDANVR | 1.54 | | |
| HA | H13 | 451 | 0.62 | yes | 4 | 0 | 89.23 | TLDMHDANVR | 89.23 | LDMHDANVRN | 1.54 | LNMHDANVRN | 1.54 | | |
| HA | H13 | 452 | 0.5 | yes | 4 | 0 | 90.77 | LDMHDANVRN | 89.23 | DMHDANVRNL | 1.54 | NMHDANVRNL | 1.54 | | |
| HA | H13 | 453 | 1.31 | yes | 4 | 0 | 49.23 | DMHDANVRNL | 49.23 | MHDANVRNLH | 1.54 | | | | |
| HA | H13 | 454 | 1.31 | yes | 5 | 0 | 49.23 | MHDANVRNLH | 49.23 | HDANVRNLHE | 7.69 | | | | |
| HA | H13 | 455 | 1.51 | yes | 5 | 0 | 47.69 | HDANVRNLHD | 47.69 | DANVRNLHEQ | 7.69 | | | | |
| HA | H13 | 456 | 1.51 | yes | 5 | 0 | 47.69 | DANVRNLHDQ | 47.69 | ANVRNLHEQV | 7.69 | ANVRNLHEQI | 1.54 | ANVRNLHEQI | 1.54 |
| HA | H13 | 457 | 0.97 | yes | 3 | 0 | 73.85 | ANVRNLHDQV | 43.1 | NVRNLHEQVR | 7.69 | NVRNLHEQIK | 1.54 | NVRNLHDQIR | 1.54 |
| HA | H13 | 458 | 0.97 | yes | 3 | 0 | 73.85 | NVRNLHDQVR | 43.1 | NAVDEGNGCF | 23.1 | | | | |
| HA | H13 | 473 | 0.2 | yes | 2 | 0 | 96.92 | NAIDEGNGCF | 41.5 | AVDEGNGCFE | 23.1 | | | | |
| HA | H13 | 474 | 0.97 | yes | 3 | 0 | 73.85 | AIDEGNGCFE | 41.5 | VDEGNGCFEL | 23.1 | | | | |
| HA | H13 | 475 | 0.97 | yes | 3 | 0 | 73.85 | IDEGNGCFEL | 47.69 | NEGNGCFELL | 3.08 | AINEGNGCFE | 3.08 | | |
| HA | H13 | 476 | 0 | yes | 2 | 0 | 100 | DEGNGCFELL | 73.85 | | | INEGNGCFEL | 3.08 | | |
| HA | H13 | 477 | 0 | yes | 1 | 0 | 100 | EGNGCFELLH | 96.92 | | | | | | |
| HA | H13 | 478 | 0 | yes | 1 | 0 | 100 | GNGCFELLHK | 100 | | | | | | |
| HA | H13 | 479 | 0 | yes | 1 | 0 | 100 | NGCFELLHKC | 100 | | | | | | |

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 539 | 1.37 | yes | 4 | 3.08 | 100 | ASSVLVGL

FIG. 74-95

| Protein | Sub-type | Start Pos | Block | Entropy | Gaps <10% | # to cover 99% | % Gap | Coverage | Peptides included | Freq |
|---|---|---|---|---|---|---|---|---|---|---|
| HA | H14 | 32 | 0 | 0 | yes | — | 0 | 100 | GI

FIG. 74-96

| Protein | Sub-type | Start Pos | Block Entropy | Gaps <10% | # to cover 99% | Gap % | Coverage | Peptides included | Freq |
|---|---|---|---|---|---|---|---|---|---|
| HA | H14 | 74 | 0 | yes | — | 0 | 100 | LVDGQDCDLI | 100 |
| HA | H14 | 75 | 0 | yes | — | 0 |

FIG. 74-97

| Protein | Sub-type | Start Pos | Block Entropy | Gaps <10% | # to 99% cover | Gap % | Coverage | Peptides included | Freq |
|---|---|---|---|---|---|---|---|---|---|
| HA | H14 | 116 | 0 | yes | – | 0 | 100 | FDVPDYQSLR | 100 |
| HA | H14 | 117 | 0 | yes | – | 0 | 100 | DVPDYQSLRS | 100 |
| HA | H14 | 118 | 0 | yes | – | 0 | 100 | VPDYQSLRSI | 100 |
| HA | H14 | 119 | 0 | yes | – | 0 | 100 | PDYQSLRSIL | 100 |
| HA | H14 | 120 | 0 | yes | – | 0 | 100 | DYQSLRSILA | 100 |
| HA | H14 | 121 | 0 | yes | – | 0 | 100 | YQSLRSILAS | 100 |
| HA | H14 | 122 | 0 | yes | – | 0 | 100 | QSLRSILASS | 100 |
| HA | H14 | 123 | 0 | yes | – | 0 | 100 | SLRSILASSG | 100 |
| HA | H14 | 124 | 0 | yes | – | 0 | 100 | LRSILASSGS | 100 |
| HA | H14 | 125 | 0 | yes | – | 0 | 100 | RSILASSGSL | 100 |
| HA | H14 | 126 | 0 | yes | – | 0 | 100 | SILASSGSLE | 100 |
| HA | H14 | 127 | 0 | yes | – | 0 | 100 | ILASSGSLEF | 100 |
| HA | H14 | 128 | 0 | yes | – | 0 | 100 | LASSGSLEFI | 100 |
| HA | H14 | 129 | 0 | yes | – | 0 | 100 | ASSGSLEFIA | 100 |
| HA | H14 | 130 | 0 | yes | – | 0 | 100 | SSGSLEFIAE | 100 |
| HA | H14 | 131 | 0 | yes | – | 0 | 100 | SGSLEFIAEQ | 100 |
| HA | H14 | 132 | 0 | yes | – | 0 | 100 | GSLEFIAEQF | 100 |
| HA | H14 | 133 | 0 | yes | – | 0 | 100 | SLEFIAEQFT | 100 |
| HA | H14 | 134 | 0 | yes | – | 0 | 100 | LEFIAEQFTW | 100 |
| HA | H14 | 135 | 0 | yes | – | 0 | 100 | EFIAEQFTWN | 100 |
| HA | H14 | 136 | 0 | yes | – | 0 | 100 | FIAEQFTWNG | 100 |
| HA | H14 | 137 | 0 | yes | – | 0 | 100 | IAEQFTWNGV | 100 |
| HA | H14 | 138 | 0 | yes | – | 0 | 100 | AEQFTWNGVK | 100 |
| HA | H14 | 139 | 0 | yes | – | 0 | 100 | EQFTWNGVKV | 100 |
| HA | H14 | 140 | 0 | yes | – | 0 | 100 | QFTWNGVKVD | 100 |
| HA | H14 | 141 | 0 | yes | – | 0 | 100 | FTWNGVKVDG | 100 |
| HA | H14 | 142 | 0 | yes | – | 0 | 100 | TWNGVKVDGS | 100 |
| HA | H14 | 143 | 0 | yes | – | 0 | 100 | WNGVKVDGSS | 100 |
| HA | H14 | 144 | 0 | yes | – | 0 | 100 | NGVKVDGSSS | 100 |
| HA | H14 | 145 | 0 | yes | – | 0 | 100 | GVKVDGSSSA | 100 |
| HA | H14 | 146 | 0 | yes | – | 0 | 100 | VKVDGSSSAC | 100 |
| HA | H14 | 147 | 0 | yes | – | 0 | 100 | KVDGSSSACL | 100 |
| HA | H14 | 148 | 0 | yes | – | 0 | 100 | VDGSSSACLR | 100 |
| HA | H14 | 149 | 0 | yes | – | 0 | 100 | DGSSSACLRG | 100 |
| HA | H14 | 150 | 0 | yes | – | 0 | 100 | GSSSACLRGG | 100 |
| HA | H14 | 151 | 0 | yes | – | 0 | 100 | SSSACLRGGR | 100 |
| HA | H14 | 152 | 0 | yes | – | 0 | 100 | SSACLRGGRN | 100 |
| HA | H14 | 153 | 0 | yes | – | 0 | 100 | SACLRGGRNS | 100 |
| HA | H14 | 154 | 0 | yes | – | 0 | 100 | ACLRGGRNSF | 100 |
| HA | H14 | 155 | 0 | yes | – | 0 | 100 | CLRGGRNSFF | 100 |
| HA | H14 | 156 | 0 | yes | – | 0 | 100 | LRGGRNSFFS | 100 |
| HA | H14 | 157 | 0 | yes | – | 0 | 100 | RGGRNSFFSR | 100 |

FIG. 74-98

| Protein | Sub-type | Start Pos | Block Entropy | Gaps <10% | # to 99% cover | % Gap | Coverage | Peptides included | Freq | Peptides induced | Freq |
|---|---|---|---|---|---|---|---|---|---|---|---|
| HA | H14 | 158 | 0 | yes | 1 | 0 | 100 | GGRNSFFSRL | 100 | | |
| HA | H14 | 159 | 0 | yes | 1 | 0 | 100 | GRNSFFSRLN | 100 | | |
| HA | H14 | 160 | 0 | yes | 1 | 0 | 100 | RNSFFSRLNW | 100 | | |
| HA | H14 | 161 | 0 | yes | 1 | 0 | 100 | NSFFSRLNWL | 100 | | |
| HA | H14 | 162 | 0 | yes | 1 | 0 | 100 | SFFSRLNWLT | 100 | | |
| HA | H14 | 163 | 0 | yes | 1 | 0 | 100 | FFSRLNWLTK | 100 | | |
| HA | H14 | 164 | 0.81 | yes | 2 | 0 | 100 | FSRLNWLTKA | 75 | FSRLNWLTKE | 25 |
| HA | H14 | 165 | 0.81 | yes | 2 | 0 | 100 | SRLNWLTKAT | 75 | SRLNWLTKET | 25 |
| HA | H14 | 166 | 0.81 | yes | 2 | 0 | 100 | RLNWLTKATN | 75 | RLNWLTKETN | 25 |
| HA | H14 | 167 | 0.81 | yes | 2 | 0 | 100 | LNWLTKATNG | 75 | LNWLTKETNG | 25 |
| HA | H14 | 168 | 0.81 | yes | 2 | 0 | 100 | NWLTKATNGN | 75 | NWLTKETNGN | 25 |
| HA | H14 | 169 | 0.81 | yes | 2 | 0 | 100 | WLTKATNGNY | 75 | WLTKETNGNY | 25 |
| HA | H14 | 170 | 0.81 | yes | 2 | 0 | 100 | LTKATNGNYG | 75 | LTKETNGNYG | 25 |
| HA | H14 | 171 | 0.81 | yes | 2 | 0 | 100 | TKATNGNYGP | 75 | TKETNGNYGP | 25 |
| HA | H14 | 172 | 0.81 | yes | 2 | 0 | 100 | KATNGNYGPI | 75 | KETNGNYGPI | 25 |
| HA | H14 | 173 | 0.81 | yes | 2 | 0 | 100 | ATNGNYGPIN | 75 | ETNGNYGPIN | 25 |
| HA | H14 | 174 | 0 | yes | 1 | 0 | 100 | TNGNYGPINV | 100 | | |
| HA | H14 | 175 | 0 | yes | 1 | 0 | 100 | NGNYGPINVT | 100 | | |
| HA | H14 | 176 | 0 | yes | 1 | 0 | 100 | GNYGPINVTK | 100 | | |
| HA | H14 | 177 | 0 | yes | 1 | 0 | 100 | NYGPINVTKE | 100 | | |
| HA | H14 | 178 | 0 | yes | 1 | 0 | 100 | YGPINVTKEN | 100 | | |
| HA | H14 | 179 | 0 | yes | 1 | 0 | 100 | GPINVTKENT | 100 | | |
| HA | H14 | 180 | 0 | yes | 1 | 0 | 100 | PINVTKENTG | 100 | | |
| HA | H14 | 181 | 0 | yes | 1 | 0 | 100 | INVTKENTGS | 100 | | |
| HA | H14 | 182 | 0 | yes | 1 | 0 | 100 | NVTKENTGSY | 100 | | |
| HA | H14 | 183 | 0 | yes | 1 | 0 | 100 | VTKENTGSYV | 100 | | |
| HA | H14 | 184 | 0 | yes | 1 | 0 | 100 | TKENTGSYVR | 100 | | |
| HA | H14 | 185 | 0 | yes | 1 | 0 | 100 | KENTGSYVRL | 100 | | |
| HA | H14 | 186 | 0 | yes | 1 | 0 | 100 | ENTGSYVRLY | 100 | | |
| HA | H14 | 187 | 0 | yes | 1 | 0 | 100 | NTGSYVRLYL | 100 | | |
| HA | H14 | 188 | 0 | yes | 1 | 0 | 100 | TGSYVRLYLW | 100 | | |
| HA | H14 | 189 | 0 | yes | 1 | 0 | 100 | GSYVRLYLWG | 100 | | |
| HA | H14 | 190 | 0 | yes | 1 | 0 | 100 | SYVRLYLWGV | 100 | | |
| HA | H14 | 191 | 0 | yes | 1 | 0 | 100 | YVRLYLWGVH | 100 | | |
| HA | H14 | 192 | 0 | yes | 1 | 0 | 100 | VRLYLWGVHH | 100 | | |
| HA | H14 | 193 | 0 | yes | 1 | 0 | 100 | RLYLWGVHHP | 100 | | |
| HA | H14 | 194 | 0 | yes | 1 | 0 | 100 | LYLWGVHHPS | 100 | | |
| HA | H14 | 195 | 0 | yes | 1 | 0 | 100 | YLWGVHHPSS | 100 | | |
| HA | H14 | 196 | 0 | yes | 1 | 0 | 100 | LWGVHHPSSD | 100 | | |
| HA | H14 | 197 | 0 | yes | 1 | 0 | 100 | WGVHHPSSDN | 100 | | |
| HA | H14 | 198 | 0 | yes | 1 | 0 | 100 | GVHHPSSDNE | 100 | | |
| HA | H14 | 199 | 0 | yes | 1 | 0 | 100 | VHHPSSDNEQ | 100 | | |

FIG. 74-99

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 200 | 0 | yes | — | 0 | 100 | HHPSSDNEQT | 100 | | | | | | |
| HA | H14 | 201 | 0 | yes | — | 0 | 100 | HPSSDNEQTD | 100 | | | | | | |
| HA | H14 | 202 | 0 | yes | — | 0 | 100 | PSSDNEQTDL | 100 | | | | | | |
| HA | H14 | 203 | 0 | yes | — | 0 | 100 | SSDNEQTDLY | 100 | | | | | | |
| HA | H14 | 204 | 0 | yes | — | 0 | 100 | SDNEQTDLYK | 100 | | | | | | |
| HA | H14 | 205 | 0 | yes | — | 0 | 100 | DNEQTDLYKV | 100 | | | | | | |
| HA | H14 | 206 | 0 | yes | — | 0 | 100 | NEQTDLYKVA | 100 | | | | | | |
| HA | H14 | 207 | 0 | yes | — | 0 | 100 | EQTDLYKVAT | 100 | | | | | | |
| HA | H14 | 208 | 0 | yes | — | 0 | 100 | QTDLYKVATG | 100 | | | | | | |
| HA | H14 | 209 | 0 | yes | — | 0 | 100 | TDLYKVATGR | 100 | | | | | | |
| HA | H14 | 210 | 0 | yes | — | 0 | 100 | DLYKVATGRV | 100 | | | | | | |
| HA | H14 | 211 | 0 | yes | — | 0 | 100 | LYKVATGRVT | 100 | | | | | | |
| HA | H14 | 212 | 0 | yes | — | 0 | 100 | YKVATGRVTY | 100 | | | | | | |
| HA | H14 | 213 | 0 | yes | — | 0 | 100 | KVATGRVTYS | 100 | | | | | | |
| HA | H14 | 214 | 0 | yes | — | 0 | 100 | VATGRVTYST | 100 | | | | | | |
| HA | H14 | 215 | 0 | yes | — | 0 | 100 | ATGRVTYSTR | 100 | | | | | | |
| HA | H14 | 216 | 0 | yes | — | 0 | 100 | TGRVTYSTRS | 100 | | | | | | |
| HA | H14 | 217 | 0 | yes | — | 0 | 100 | GRVTYSTRSD | 100 | | | | | | |
| HA | H14 | 218 | 0 | yes | — | 0 | 100 | RVTYSTRSDQ | 100 | | | | | | |
| HA | H14 | 219 | 0 | yes | — | 0 | 100 | VTYSTRSDQI | 100 | | | | | | |
| HA | H14 | 220 | 0 | yes | — | 0 | 100 | TYSTRSDQIS | 100 | | | | | | |
| HA | H14 | 221 | 0 | yes | — | 0 | 100 | YSTRSDQISI | 100 | | | | | | |
| HA | H14 | 222 | 0 | yes | — | 0 | 100 | STRSDQISIV | 100 | | | | | | |
| HA | H14 | 223 | 0 | yes | — | 0 | 100 | TRSDQISIVP | 100 | | | | | | |
| HA | H14 | 224 | 0 | yes | — | 0 | 100 | RSDQISIVPN | 100 | | | | | | |
| HA | H14 | 225 | 0 | yes | — | 0 | 100 | SDQISIVPNI | 100 | | | | | | |
| HA | H14 | 226 | 0 | yes | — | 0 | 100 | DQISIVPNIG | 100 | | | | | | |
| HA | H14 | 227 | 0 | yes | — | 0 | 100 | QISIVPNIGS | 100 | | | | | | |
| HA | H14 | 228 | 0 | yes | — | 0 | 100 | ISIVPNIGSR | 100 | | | | | | |
| HA | H14 | 229 | 0 | yes | — | 0 | 100 | SIVPNIGSRP | 100 | | | | | | |
| HA | H14 | 230 | 0 | yes | — | 0 | 100 | IVPNIGSRPR | 100 | | | | | | |
| HA | H14 | 231 | 0 | yes | — | 0 | 100 | VPNIGSRPRV | 100 | | | | | | |
| HA | H14 | 232 | 0 | yes | — | 0 | 100 | PNIGSRPRVR | 100 | | | | | | |
| HA | H14 | 233 | 0 | yes | — | 0 | 100 | NIGSRPRVRN | 100 | | | | | | |
| HA | H14 | 234 | 0 | yes | — | 0 | 100 | IGSRPRVRNQ | 100 | | | | | | |
| HA | H14 | 235 | 0 | yes | — | 0 | 100 | GSRPRVRNQS | 100 | | | | | | |
| HA | H14 | 236 | 0 | yes | — | 0 | 100 | SRPRVRNQSG | 100 | | | | | | |
| HA | H14 | 237 | 0 | yes | — | 0 | 100 | RPRVRNQSGR | 100 | | | | | | |
| HA | H14 | 238 | 0 | yes | — | 0 | 100 | PRVRNQSGRI | 100 | | | | | | |
| HA | H14 | 239 | 0 | yes | — | 0 | 100 | RVRNQSGRIS | 100 | | | | | | |
| HA | H14 | 240 | 0 | yes | — | 0 | 100 | VRNQSGRISY | 100 | | | | | | |
| HA | H14 | 241 | 0 | yes | — | 0 | 100 | RNQSGRISIY | 100 | | | | | | |

FIG. 74-100

| Protein | Sub-type | Start Pos | Block Entropy | Gaps <10% | # to cover 99% | Gap % | Coverage | Peptides included | Freq |
|---|---|---|---|---|---|---|---|---|---|
| HA | H4 | 242 | 0 | yes | - | 0 | 100 | NQSGRISIYW | 100 |
| HA | H4 | 243 | 0 | yes | - | 0 | 100 | QSGRISIYWT | 100 |
| HA | H4 | 244 | 0 | yes | - | 0 | 100 | SGRISIYWTL | 100 |
| HA | H4 | 245 | 0 | yes | - | 0 | 100 | GRISIYWTLV | 100 |
| HA | H4 | 246 | 0 | yes | - | 0 | 100 | RISIYWTLVN | 100 |
| HA | H4 | 247 | 0 | yes | - | 0 | 100 | ISIYWTLVNP | 100 |
| HA | H4 | 248 | 0 | yes | - | 0 | 100 | SIYWTLVNPG | 100 |
| HA | H4 | 249 | 0 | yes | - | 0 | 100 | IYWTLVNPGD | 100 |
| HA | H4 | 250 | 0 | yes | - | 0 | 100 | YWTLVNPGDS | 100 |
| HA | H4 | 251 | 0 | yes | - | 0 | 100 | WTLVNPGDSI | 100 |
| HA | H4 | 252 | 0 | yes | - | 0 | 100 | TLVNPGDSII | 100 |
| HA | H4 | 253 | 0 | yes | - | 0 | 100 | LVNPGDSIIF | 100 |
| HA | H4 | 254 | 0 | yes | - | 0 | 100 | VNPGDSIIFN | 100 |
| HA | H4 | 255 | 0 | yes | - | 0 | 100 | NPGDSIIFNS | 100 |
| HA | H4 | 256 | 0 | yes | - | 0 | 100 | PGDSIIFNSI | 100 |
| HA | H4 | 257 | 0 | yes | - | 0 | 100 | GDSIIFNSIG | 100 |
| HA | H4 | 258 | 0 | yes | - | 0 | 100 | DSIIFNSIGN | 100 |
| HA | H4 | 259 | 0 | yes | - | 0 | 100 | SIIFNSIGNL | 100 |
| HA | H4 | 260 | 0 | yes | - | 0 | 100 | IIFNSIGNLI | 100 |
| HA | H4 | 261 | 0 | yes | - | 0 | 100 | IFNSIGNLIA | 100 |
| HA | H4 | 262 | 0 | yes | - | 0 | 100 | FNSIGNLIAP | 100 |
| HA | H4 | 263 | 0 | yes | - | 0 | 100 | NSIGNLIAPR | 100 |
| HA | H4 | 264 | 0 | yes | - | 0 | 100 | SIGNLIAPRG | 100 |
| HA | H4 | 265 | 0 | yes | - | 0 | 100 | IGNLIAPRGH | 100 |
| HA | H4 | 266 | 0 | yes | - | 0 | 100 | GNLIAPRGHY | 100 |
| HA | H4 | 267 | 0 | yes | - | 0 | 100 | NLIAPRGHYK | 100 |
| HA | H4 | 268 | 0 | yes | - | 0 | 100 | LIAPRGHYKI | 100 |
| HA | H4 | 269 | 0 | yes | - | 0 | 100 | IAPRGHYKIS | 100 |
| HA | H4 | 270 | 0 | yes | - | 0 | 100 | APRGHYKISK | 100 |
| HA | H4 | 271 | 0 | yes | - | 0 | 100 | PRGHYKISKS | 100 |
| HA | H4 | 272 | 0 | yes | - | 0 | 100 | RGHYKISKST | 100 |
| HA | H4 | 273 | 0 | yes | - | 0 | 100 | GHYKISKSTK | 100 |
| HA | H4 | 274 | 0 | yes | - | 0 | 100 | HYKISKSTKS | 100 |
| HA | H4 | 275 | 0 | yes | - | 0 | 100 | YKISKSTKST | 100 |
| HA | H4 | 276 | 0 | yes | - | 0 | 100 | KISKSTKSTV | 100 |
| HA | H4 | 277 | 0 | yes | - | 0 | 100 | ISKSTKSTVL | 100 |
| HA | H4 | 278 | 0 | yes | - | 0 | 100 | SKSTKSTVLK | 100 |
| HA | H4 | 279 | 0 | yes | - | 0 | 100 | KSTKSTVLKS | 100 |
| HA | H4 | 280 | 0 | yes | - | 0 | 100 | STKSTVLKSD | 100 |
| HA | H4 | 281 | 0 | yes | - | 0 | 100 | TKSTVLKSDK | 100 |
| HA | H4 | 282 | 0 | yes | - | 0 | 100 | KSTVLKSDKR | 100 |
| HA | H4 | 283 | 0 | yes | - | 0 | 100 | STVLKSDKRI | 100 |

FIG. 74-101

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 284 | 0 | yes | 1 | 0 | 100 | TVLKSDKRIG | 100 | | | | | | |
| HA | H14 | 285 | 0 | yes | 1 | 0 | 100 | VLKSDKRIGS | 100 | | | | | | |
| HA | H14 | 286 | 0 | yes | 1 | 0 | 100 | LKSDKRIGSC | 100 | | | | | | |
| HA | H14 | 287 | 0 | yes | 1 | 0 | 100 | KSDKRIGSCT | 100 | | | | | | |
| HA | H14 | 288 | 0 | yes | 1 | 0 | 100 | SDKRIGSCTS | 100 | | | | | | |
| HA | H14 | 289 | 0 | yes | 1 | 0 | 100 | DKRIGSCTSP | 100 | | | | | | |
| HA | H14 | 290 | 0 | yes | 1 | 0 | 100 | KRIGSCTSPC | 100 | |

FIG. 74-102

| Protein | Sub-type | Start Pos | Block | Entropy | Gaps < 10% | # to cover 99% | Gap % | Coverage | Peptides included | Freq |
|---|---|---|---|---|---|---|---|---|---|---|
| HA | H14 | 326 | 0 | 0 | yes | - | 0 | 100 | YVKQGSLMLA | 100 |
| HA | H14 | 327 | 0 | 0 | yes | - | 0 | 100

FIG. 74-103

| Protein | Sub-type | Start Pos | Block Entropy | Gaps < 10% | # to cover 99% | Gap % | Coverage | Peptides induced | Freq | Peptides induced | Freq | Peptides induced | Freq | Peptides induced | Freq |
|---|---|---|---|---|---|---|---|---|---|---|---|---|---|---|---|
| HA | H14 | 368 | 0 | yes | — | 0 | 100 | WYGFRHQNAE | 100 | | | | | | |
| HA | H14 | 369 | 0 | yes | — | 0 | 100 | YGFRHQNAEG | 100 | | | | | | |
| HA | H14 | 370 | 0 | yes | —

FIG. 74-105

| Protein | Sub-type | Start Pos | Block Entropy | Gaps < 10% | # to cover 99% | Gap % | Coverage | Peptides induced | Freq |
|---|---|---|---|---|---|---|---|---|---|
| HA | H14 | 452 | 0 | yes | — | 0 | 100 | QHTIDV

FIG. 74-106

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H14 | 494 | 0 | yes | | 0 | 100 | NCIESIRNGT | 100 |
| H

FIG. 74-107

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 536 | 0 | yes | — | 0 | 100 | ISFSMSCFVF | 100 | | | | | | |
| HA | H14 | 537 | 0 | yes | — | 0 | 100 | SFSMSCFVFV | 100 | | | | | | |
| HA | H14 | 538 | 0 | yes | — | 0 | 100 | FSMSCFVFVA | 100 | | | | | | |
| HA | H14 | 539 | 0 | yes | — | 0 | 100 | SMSCFVFVAL | 100 | | | | | | |
| HA | H14 | 540 | 0 | yes | — | 0 | 100 | MSCFVFVALI | 100 | | | | | | |
| HA | H14 | 541 | 0 | yes | — | 0 | 100 | SCFVFVALIL | 100 | | | | | | |
| HA | H14 | 542 | 0 | yes | — | 0 | 100 | CFVFVALILG | 100 | | | | | | |
| HA | H14 | 543 | 0 | yes | — | 0 | 100 | FVFVALILGF | 100 | | | | | | |
| HA | H14 | 544 | 0 | yes | — | 0 | 100 | VFVALILGFV | 100 | | | | | | |
| HA | H14 | 545 | 0 | yes | — | 0 | 100 | FVALILGFVL | 100 | | | | | | |
| HA | H14 | 546 | 0 | yes | — | 0 | 100 | VALILGFVLW | 100 | | | | | | |
| HA | H14 | 547 | 0 | yes | — | 0 | 100 | ALILGFVLWA | 100 | | | | | | |
| HA | H14 | 548 | 0 | yes | — | 0 | 100 | LILGFVLWAC | 100 | | | | | | |
| HA | H14 | 549 | 0 | yes | — | 0 | 100 | ILGFVLWACQ | 100 | | | | | | |
| HA | H14 | 550 | 0 | yes | — | 0 | 100 | LGFVLWACQN | 100 | | | | | | |
| HA | H14 | 551 | 0 | yes | — | 0 | 100 | GFVLWACQNG | 100 | | | | | | |
| HA | H14 | 552 | 0 | no | — | 25 | 100 | FVLWACQNGN | 100 | | | | | | |
| HA | H14 | 553 | 0 | no | — | 25 | 100 | VLWACQNGNI | 100 | | | | | | |
| HA | H14 | 554 | 0 | no | — | 25 | 100 | LWACQNGNIR | 100 | | | | | | |
| HA | H14 | 555 | 0 | no | — | 25 | 100 | WACQNGNIRC | 100 | | | | | | |
| HA | H14 | 556 | 0 | no | — | 25 | 100 | ACQNGNIRCQ | 100 | | | | | | |
| HA | H14 | 557 | 0 | no | — | 25 | 100 | CQNGNIRCQI | 100 | | | | | | |
| HA | H14 | 558 | 0 | no | — | 25 | 100 | QNGNIRCQIC | 100 | | | | | | |
| HA | H14 | 559 | 0 | no | — | 25 | 100 | NGNIRCQICI | 100 | | | | | | |
| HA | H15 | 1 | 0 | no | — | 18.18 | 100 | MNTQIIVILV | 100 | | | | | | |
| HA | H15 | 2 | 0 | no | — | 18.18 | 100 | NTQIIVILVL | 100 | | | | | | |
| HA | H15 | 3 | 0 | no | — | 18.18 | 100 | TQIIVILVLG | 100 | | | | | | |
| HA | H15 | 4 | 0 | no | — | 18.18 | 100 | QIIVILVLGL | 100 | | | | | | |
| HA | H15 | 5 | 0 | no | — | 18.18 | 100 | IIVILVLGLS | 100 | | | | | | |
| HA | H15 | 6 | 0 | no | — | 18.18 | 100 | IVILVLGLSM | 100 | | | | | | |
| HA | H15 | 7 | 0 | yes | — | 9.09 | 100 | VILVLGLSMV | 100 | | | | | | |
| HA | H15 | 8 | 0.92 | yes | 2 | 9.09 | 100 | ILVLGLSMVK | 66.67 | ILVLGLSMVR | 33.3 | | | | |
| HA | H15 | 9 | 0.88 | yes | 2 | 0 | 100 | LVLGLSMVKS | 70 | LVLGLSMVRS | 30 | | | | |
| HA | H15 | 10 | 0.88 | yes | 2 | 0 | 100 | VLGLSMVKSD | 70 | VLGLSMVRSD | 30 | | | | |
| HA | H15 | 11 | 0.85 | yes | 2 | 0 | 100 | LGLSMVKSDK | 72.73 | LGLSMVRSDK | 27.3 | | | | |
| HA | H15 | 12 | 0.85 | yes | 2 | 0 | 100 | GLSMVKSDKI | 72.73 | GLSMVRSDKI | 27.3 | | | | |
| HA | H15 | 13 | 0.85 | yes | 2 | 0 | 100 | LSMVKSDKIC | 72.73 | LSMVRSDKIC | 27.3 | | | | |
| HA | H15 | 14 | 0.85 | yes | 2 | 0 | 100 | SMVKSDKICL | 72.73 | SMVRSDKICL | 27.3 | | | | |
| HA | H15 | 15 | 0.85 | yes | 2 | 0 | 100 | MVKSDKICLG | 72.73 | MVRSDKICLG | 27.3 | | | | |
| HA | H15 | 16 | 0.85 | yes | 2 | 0 | 100 | VKSDKICLGH | 72.73 | VRSDKICLGH | 27.3 | | | | |
| HA | H15 | 17 | 0.85 | yes | 2 | 0 | 100 | KSDKICLGHH | 72.73 | RSDKICLGHH | 27.3 | | | | |
| HA | H15 | 18 | 0 | yes | 1 | 0 | 100 | SDKICLGHHA | 100 | | | | | | |

FIG. 74-108

| Protein | Sub-type | Start Pos | Block Entropy | Gaps > 10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 19 | 0 | yes | 1 | 0 | 100

FIG. 74-109

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 61 |

FIG. 74-110

| Protein | Sub-type | Start Pos | Block Entropy | Gaps >10% | # to 99% cover | Gap % | Coverage | Peptides included | Freq | Peptides included | Freq |
|---|---|---|---|---|---|---|---|---|---|---|---|
| HA | H15 | 103 | 0.85 | yes | 2 | 0 |

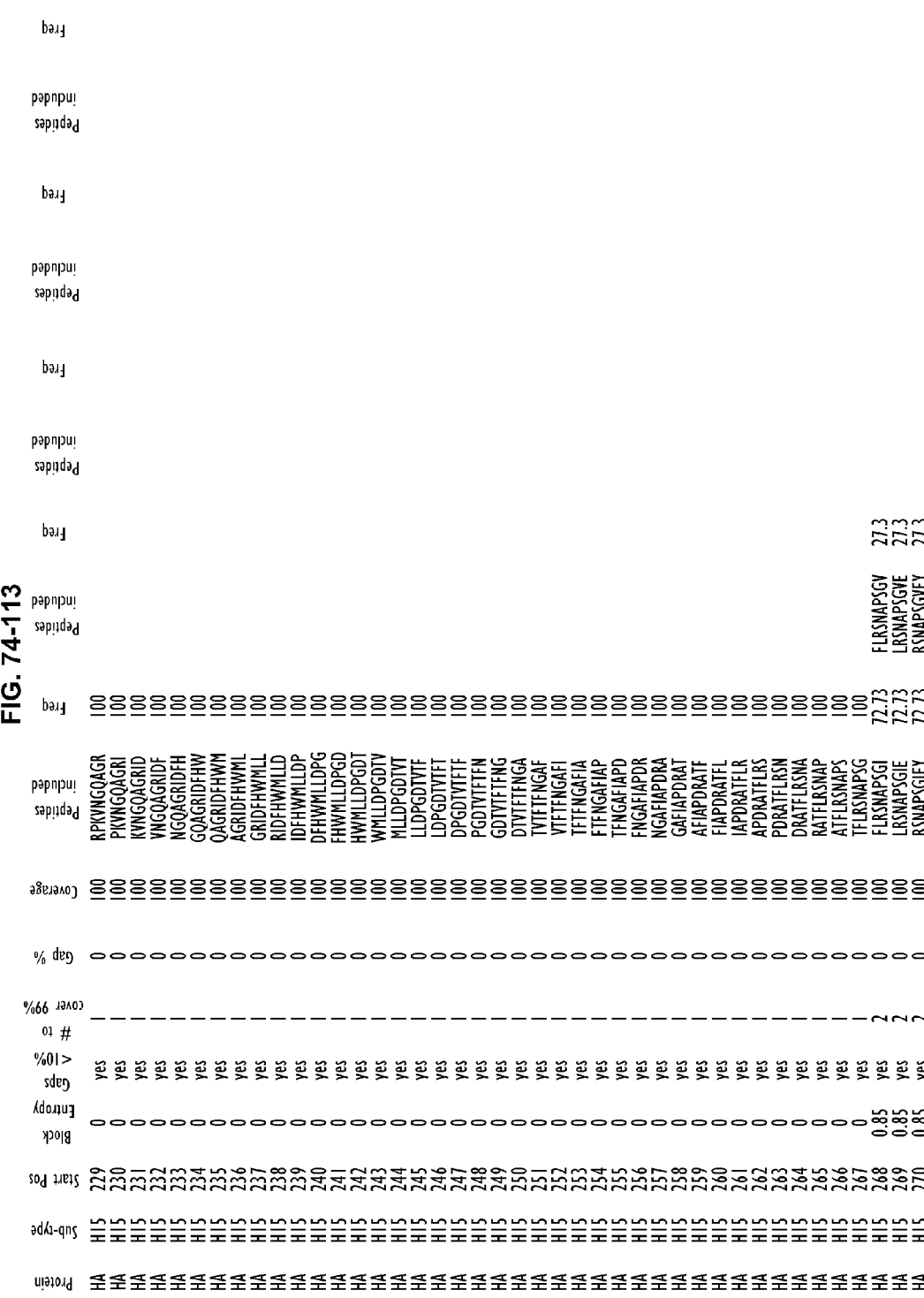

FIG. 74-114

| Protein | Sub-type | Start Pos | Block Entropy | Gaps < 10% | # of to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 271 | 0.85 | yes | 2 | 0 | 100 | SNAPSGIEYN | 72.73 | SNAPSGVEYN | 27.3 | | | | |
| HA | H15 | 272 | 0.85 | yes | 2 | 0 | 100 | NAPSGIEYNG | 72.73 | NAPSGVEYNG | 27.3 | | | | |
| HA | H15 | 273 | 0.85 | yes | 2 | 0 | 100 | APSGIEYNGK | 72.73 | APSGVEYNGK | 27.3 | | | | |
| HA | H15 | 274 | 0.85 | yes | 2 | 0 | 100 | PSGIEYNGKS | 72.73 | PSGVEYNGKS | 27.3 | | | | |
| HA | H15 | 275 | 0.85 | yes | 2 | 0 | 100 | SGIEYNGKSL | 72.73 | SGVEYNGKSL | 27.3 | |

| Protein | Sub-type | Start Pos | Block Entropy | Gaps <10% | # to 99% cover | % Gap | Coverage | Peptides included | Freq | Peptides included | Freq |
|---|---|---|---|---|---|---|---|---|---|---|---|
| HA | H5 | 355 | 0.44 | yes | 2 | 0 | 100 | IAGFIENGWE | 90.91 | IAGFIENGWE | 9.09 |
| HA | H5 | 356 | 0 | yes | 1 | 0 | 100 | AGFIENGWEG | 100 | | |
| HA | H5 | 357 | 0 | yes | 1 | 0 | 100 | GFIENGWEGL | 100 | | |
| HA | H5 | 358 | 0 | yes | 1 | 0 | 100 | FIENGWEGLI | 100 | | |
| HA | H5 | 359 | 0 | yes | 1 | 0 | 100 | IENGWEGLID | 100 | | |
| HA | H5 | 360 | 0 | yes | 1 | 0 | 100 | ENGWEGLIDG | 100 | | |
| HA | H5 | 361 | 0 | yes | 1 | 0 | 100 | NGWEGLIDGW | 100 | | |
| HA | H5 | 362 | 0 | yes | 1 | 0 | 100 | GWEGLIDGWY | 100 | | |
| HA | H5 | 363 | 0 | yes | 1 | 0 | 100 | WEGLIDGWYG | 100 | | |
| HA | H5 | 364 | 0 | yes | 1 | 0 | 100 | EGLIDGWYGF | 100 | | |
| HA | H5 | 365 | 0 | yes | 1 | 0 | 100 | GLIDGWYGFR | 100 | | |
| HA | H5 | 366 | 0 | yes | 1 | 0 | 100 | LIDGWYGFRH | 100 | | |
| HA | H5 | 367 | 0 | yes | 1 | 0 | 100 | IDGWYGFRHQ | 100 | | |
| HA | H5 | 368 | 0 | yes | 1 | 0 | 100 | DGWYGFRHQN | 100 | | |
| HA | H5 | 369 | 0 | yes | 1 | 0 | 100 | GWYGFRHQN

FIG. 74-117

| Protein | Sub-type | Start Pos | Block Entropy | Gaps >10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 397 | 0 | yes | 1 | 0 | 100 | ITGKLNRLIE | 100 | | | | | | |
| HA | H15 | 398 | 0 | yes | 1 | 0 | 100 | TGKLNRLIEK | 100 | | | | | | |
| HA | H15 | 399 | 0 | yes | 1 | 0 | 100 | GKLNRLIEKT | 100 | | | | | | |
| HA | H15 | 400 | 0 | yes | 1 | 0 | 100 | KLNRLIEKTN | 100 | | | | | | |
| HA | H15 | 401 | 0.85 | yes | 2 | 0 | 100 | LNRLIEKTNK | 72.73 | LNRLIEKTNT | 27.3 | | | | |
| HA | H15 | 402 | 0.85 | yes | 2 | 0 | 100 | NRLIEKTNKQ | 72.73 | NRLIEKTNTQ | 27.3 | | | | |
| HA | H15 | 403 | 0.85 | yes | 2 | 0 | 100 | RLIEKTNKQF | 72.73 | RLIEKTNTQF | 27.3 | | | | |
| HA | H15 | 404 | 0.85 | yes | 2 | 0 | 100 | LIEKTNKQFE | 72.73 | LIEKTNTQFE | 27.3 | | | | |
| HA | H15 | 405 | 0.85 | yes | 2 | 0 | 100 | IEKTNKQFEL | 72.73 | IEKTNTQFEL | 27.3 | | | | |
| HA | H15 | 406 | 0.85 | yes | 2 | 0 | 100 | EKTNKQFELI | 72.73 | EKTNTQFELI | 27.3 | | | | |
| HA | H15 | 407 | 0.85 | yes | 2 | 0 | 100 | KTNKQFELID | 72.73 | KTNTQFELID | 27.3 | | | | |
| HA | H15 | 408 | 0.85 | yes | 2 | 0 | 100 | TNKQFELIDN | 72.73 | TNTQFELIDN | 27.3 | | | | |
| HA | H15 | 409 | 0.85 | yes | 2 | 0 | 100 | NKQFELIDNE | 72.73 | NTQFELIDNE | 27.3 | | | | |
| HA | H15 | 410 | 0.85 | yes | 2 | 0 | 100 | KQFELIDNEF | 72.73 | TQFELIDNEF | 27.3 | | | | |
| HA | H15 | 411 | 0 | yes | 1 | 0 | 100 | QFELIDNEFT | 100 | | | | | | |
| HA | H15 | 412 | 0 | yes | 1 | 0 | 100 | FELIDNEFTE | 100 | | | | | | |
| HA | H15 | 413 | 0 | yes | 1 | 0 | 100 | ELIDNEFTEV | 100 | | | | | | |
| HA | H15 | 414 | 0 | yes | 1 | 0 | 100 | LIDNEFTEVE | 100 | | | | | | |
| HA | H15 | 415 | 0 | yes | 1 | 0 | 100 | IDNEFTEVEQ | 100 | | | | | | |
| HA | H15 | 416 | 0 | yes | 1 | 0 | 100 | DNEFTEVEQQ | 100 | | | |

FIG. 74-118

| Protein | Sub-type | Start Pos | Block Entropy | Gaps <10% | # to cover 99% | Gap % | Coverage | Peptides included | Freq |
|---|---|---|---|---|---|---|---|---|---|
| HA | H5 | 439 | 0 | yes | – | 0 | 100 | EIWSYNAELL | 100 |
| HA | H5 | 440 | 0 | yes | – | 0 | 100 | IWSYNAELLV | 100 |
| HA | H5 | 441 | 0 | yes | – | 0 | 100 | WSYNAELLVA | 100 |
| HA | H5 | 442 | 0 | yes | – | 0 | 100 | SYNAELLVAM | 100 |
| HA | H5 | 443 | 0 | yes | – | 0 | 100 | YNAELLVAME | 100 |
| HA | H5 | 444 | 0 | yes | – | 0 | 100 | NAELLVAMEN | 100 |
| HA | H5 | 445 | 0 | yes | – | 0 | 100 | AELLVAMENQ | 100 |
| HA | H5 | 446 | 0 | yes | – | 0 | 100 | ELLVAMENQH | 100 |
| HA | H5 | 447 | 0 | yes | – | 0 | 100 | LLVAMENQHT | 100 |
| HA | H5 | 448 | 0 | yes | – | 0 | 100 | LVAMENQHTI | 100 |
| HA | H5 | 449 | 0 | yes | – | 0 | 100 | VAMENQHTID | 100 |
| HA | H5 | 450 | 0 | yes | – | 0 | 100 | AMENQHTIDL | 100 |
| HA | H5 | 451 | 0 | yes | – | 0 | 100 | MENQHTIDLA | 100 |
| HA | H5 | 452 | 0 | yes | – | 0 | 100 | ENQHTIDLAD | 100 |
| HA | H5 | 453 | 0 | yes | – | 0 | 100 | NQHTIDLADS | 100 |
| HA | H5 | 454 | 0 | yes | – | 0 | 100 | QHTIDLADSE | 100 |
| HA | H5 | 455 | 0 | yes | – | 0 | 100 | HTIDLADSEM | 100 |
|

| Protein | Sub-type | Start Pos | Block Entropy | Gaps <10% | # to 99% cover | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 59 | 0.99 | yes | 2 | 0 | 100 | TGTYCSLNGV | 57.14 | TGTYCSLNGI | 42.9 | | | | |
| HA | H16 | 60 | 0.99 | yes | 2 | 0 | 100 | GTYCSLNGYS | 57.14 | GTYCSLNGIS | 42.9 | | | | |
| HA | H16 | 61 | 1.78 | yes | 4 | 0 | 100 | TYCSLNGVSP | 42.86 | TYCSLNGISP | 42.9 | | | | |
| HA | H16 | 62 | 1.78 | yes | 4 | 0 | 100 | YCSLNGVSPI | 42.86 | YCSLNGISPI | 33.3 | YCSLNGVSPV | 14.29 | YCSLNGISPV | 9.52 |
| HA | H16 | 63 | 1.78 | yes | 4 | 0 | 100 | CSLNGVSPIH | 42.86 | CSLNGISPIH | 33.3 | CSLNGVSPVH | 14.29 | CSLNGISPVH | 9.52 |
| HA | H16 | 64 | 1.78 | yes | 4 | 0 | 100 | SLNGVSPIHL | 42.86 | SLNGISPIHL | 33.3 | SLNGVSPYHL | 14.29 | SLNGISPYHL | 9.52 |
| HA | H16 | 65 | 1.78 | yes | 4 | 0 | 100 | LNGVSPIHLG | 42.86 | LNGISPIHLG | 33.3 | LNGVSPYHLG | 14.29 | LNGISPYHLG | 9.52 |
| HA | H16 | 66 | 1.78 | yes | 4 | 0 | 100 | NGVSPIHLGD | 42.86 | NGISPIHLGD | 33.3 | NGVSPYHLGD | 14.29 | NGISPYHLGD | 9.52 |
| HA | H16 | 67 | 1.78 | yes | 4 | 0 | 100 | GVSPIHLGDC | 42.86 | GISPIHLGDC | 33.3 | GVSPYHLGDC | 14.29 | GISPYHLGDC | 9.52 |
| HA | H16 | 68 | 1.78 | yes | 4 | 0 | 100 | VSPIHLGDCS | 23.8 | ISPIHLGDCS | 33.3 | VSPYHLGDCS | 14.29 | ISPYHLGDCS | 9.52 |
| HA | H16 | 69 | 0.79 | yes | 2 | 0 | 100 | SPIHLGDCSF | 76.19 | SPYHLGDCSF | 23.8 | | | | |
| HA | H16 | 70 | 0.79 | yes | 2 | 0 | 100 | PIHLGDCSFE | 76.19 | PYHLGDCSFE | 23.8 | | | | |
| HA | H16 | 71 | 0.79 | yes | 2 | 0 | 100 | IHLGDCSFEG | 76.19 | YHLGDCSFEG | 23.8 | | | | |
| HA | H16 | 72 | 0 | yes | 1 | 0 | 100 | HLGDCSFEGW | 100 | | | | | | |
| HA | H16 | 73 | 0 | yes | 1 | 0 | 100 | LGDCSFEGWI | 100 | | | | | | |
| HA | H16 | 74 | 0 | yes | 1 | 0 | 100 | GDCSFEGWIV | 100 | | | | | | |
| HA | H16 | 75 | 0 | yes | 1 | 0 | 100 | DCSFEGWIVG | 100 | | | | | | |
| HA | H16 | 76 | 0 | yes | 1 | 0 | 100 | CSFEGWIVGN | 100 | | | | | | |
| HA | H16 | 77 | 0 | yes | 1 | 0 | 100 | SFEGWIVGNP | 100 | | | | | | |
| HA | H16 | 78 | 0 | yes | 1 | 0 | 100 | FEGWIVGNPS | 100 | | | | | | |
| HA | H16 | 79 | 0 | yes | 1 | 0 | 100 | EGWIVGNPSC | 100 | | | | | | |
| HA | H16 | 80 | 0 | yes | 1 | 0 | 100 | GWIVGNPSCA | 100 | | | | | | |
| HA | H16 | 81 | 0.79 | yes | 2 | 0 | 100 | WIVGNPSCAT | 76.19 | WIVGNPSCAS | 23.8 | | | | |
| HA | H16 | 82 | 0.79 | yes | 2 | 0 | 100 | IVGNPSCATN | 76.19 | IVGNPSCASN | 23.8 | | | | |
| HA | H16 | 83 | 0.79 | yes | 2 | 0 | 100 | VGNPSCATNI | 76.19 | VGNPSCASNI | 23.8 | | | | |
| HA | H16 | 84 | 0.79 | yes | 2 | 0 | 100 | GNPSCATNIN | 76.19 | GNPSCASNIN | 23.8 | | | | |
| HA | H16 | 85 | 0.79 | yes | 2 | 0 | 100 | NPSCATNINI | 76.19 | NPSCASNINI | 23.8 | | | | |
| HA | H16 | 86 | 0.79 | yes | 2 | 0 | 100 | PSCATNINIR | 76.19 | PSCASNINIR | 23.8 | | | | |
| HA | H16 | 87 | 0.79 | yes | 2 | 0 | 100 | SCATNINIRE | 76.19 | SCASNINIRE | 23.8 | | | | |
| HA | H16 | 88 | 0.79 | yes | 2 | 0 | 100 | CATNINIREW | 76.19 | CASNINIREW | 23.8 | | | | |
| HA | H16 | 89 | 0.79 | yes | 2 | 0 | 100 | ATNINIREWS | 76.19 | ASNINIREWS | 23.8 | | | | |
| HA | H16 | 90 | 0.79 | yes | 2 | 0 | 100 | TNINIREWSY | 76.19 | SNINIREWSY | 23.8 | | | | |
| HA | H16 | 91 | 0 | yes | 1 | 0 | 100 | NINIREWSYL | 100 | | | | | | |
| HA | H16 | 92 | 0 | yes | 1 | 0 | 100 | INIREWSYLI | 100 | | | | | | |
| HA | H16 | 93 | 0 | yes | 1 | 0 | 100 | NIREWSYLIE | 100 | | | | | | |
| HA | H16 | 94 | 0 | yes | 1 | 0 | 100 | IREWSYLIED | 100 | | | | | | |
| HA | H16 | 95 | 0 | yes | 1 | 0 | 100 | REWSYLIEDP | 100 | | | | | | |
| HA | H16 | 96 | 0 | yes | 1 | 0 | 100 | EWSYLIEDPN | 100 | | | | | | |
| HA | H16 | 97 | 0 | yes | 1 | 0 | 100 | WSYLIEDPNA | 100 | | | | | | |
| HA | H16 | 98 | 0 | yes | 1 | 0 | 100 | SYLIEDPNAP | 100 | | | | | | |
| HA | H16 | 99 | 0.99 | yes | 2 | 0 | 100 | YLIEDPNAPN | 57.14 | YLIEDPNAPH | 42.9 | | | | |
| HA | H16 | 100 | 0.99 | yes | 2 | 0 | 100 | LIEDPNAPNK | 57.14 | LIEDPNAPHK | 42.9 | | | | |

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 149 | 1.45 | yes | 4 | 0 | 100 | GVTASCLDRG | 61.9 | GVTASCQNRG | 23.8 | GVTASCLDKG | 9.52 | GVTASCRDNG | 4.76 | V

FIG. 74-125

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 225 | 0.92 | yes | 2 | 0 | 100 | WSKRYELEIG | 66.67 | WSRRYELEIG | 33.3 | | | | |
| HA | H16 | 226 | 1.17 | yes | 3 | 0 | 100 | SKRYELEIGT | 61.9 | SRRYELEIGT | 33.3 | SKRYELEIGA | 4.76 | | |
| HA | H16 | 227 | 1.17 | yes | 3 | 0 | 100 | KRYELEIGTR | 61.9 | RRYELEIGTR | 33.3 | KRYELEIGAR | 4.76 | | |
| HA | H16 | 228 | 0.28 | yes | 2 | 0 | 100 | RYELEIGTRI | 95.24 | RYELEIGARI | 4.76 | | | | |
| HA | H16 | 229 | 0.28 | yes | 2 | 0 | 100 | YELEIGTRIG | 95.24 | YELEIGARIG | 4.76 | | | | |
| HA | H16 | 230 | 0.55 | yes | 3 | 0 | 100 | ELEIGTRIGD | 90.48 | ELEIGARIGE | 4.76 | ELEIGTRIGE | 4.76 | | |
| HA | H16 | 231 | 0.29 | yes | 2 | 4.76 | 100 | LEIGTRIGDG | 95 | LEIGARIGEG | 5 | | | | |
| HA | H16 | 232 | 0.29 | yes | 2 | 4.76 | 100 | EIGTRIGDGQ | 95 | EIGARIGEGQ | 5 | | | | |
| HA | H16 | 233 | 0.29 | yes | 2 | 4.76 | 100 | IGTRIGDGQR | 95 | IGARIGEGQR | 5 | | | | |
| HA | H16 | 234 | 0.29 | yes | 2 | 4.76 | 100 | GTRIGDGQRS | 95 | GARIGEGQRS | 5 | | | | |
| HA | H16 | 235 | 0.29 | yes | 2 | 4.76 | 100 | TRIGDGQRSW | 95 | ARIGEGQRSW | 5 | | | | |
| HA | H16 | 236 | 0.29 | yes | 2 | 4.76 | 100 | RIGDGQRSWM | 95 | RIGEGQRSWM | 5 | | | | |
| HA | H16 | 237 | 1.22 | yes | 3 | 4.76 | 100 | IGDGQRSWMK | 55 | IGEGQRSWMK | 40 | GEGQRSWMKI | 5 | | |
| HA | H16 | 238 | 1.22 | yes | 3 | 4.76 | 100 | GDGQRSWMKI | 55 | GEGQRSWMKL | 40 | EGQRSWMKIY | 5 | | |
| HA | H16 | 239 | 0.99 | yes | 3 | 4.76 | 100 | DGQRSWMKLY | 55 | DGQRSWMKIY | 45 | | | | |
| HA | H16 | 240 | 1 | yes | 3 | 0 | 100 | GQRSWMKLYW | 52.38 | GQRSWMKIYW | 47.6 | | | | |
| HA | H16 | 241 | 1 | yes | 3 | 0 | 100 | QRSWMKLYWH | 52.38 | QRSWMKIYWH | 47.6 | | | | |
| HA | H16 | 242 | 1 | yes | 3 | 0 | 100 | RSWMKLYWHL | 52.38 | RSWMKIYWHL | 47.6 | | | | |
| HA | H16 | 243 | 1.78 | yes | 4 | 0 | 100 | SWMKLYWHLM | 47.62 | SWMKIYWHLM | 23.8 | | | | |
| HA | H16 | 244 | 1.78 | yes | 4 | 0 | 100 | WMKLYWHLMR | 47.62 | WMKIYWHLM | 23.8 | WMKLYWHLMH | 23.8 | | |
| HA | H16 | 245 | 1.78 | yes | 4 | 0 | 100 | MKLYWHLMRP | 47.62 | MKIYWHLMHP | 23.8 | MKLYWHLMH | 23.8 | | |
| HA | H16 | 246 | 1.21 | yes | 3 | 0 | 100 | KLYWHLMRPG | 47.62 | KLYWHLMHPG | 23.8 | KLYWHLMSP | 9.52 | | |
| HA | H16 | 247 | 1.38 | yes | 4 | 0 | 100 | LYWHLMRPGE | 66.67 | LYWHLMHPGE | 23.8 | LYWHLMSPGE | 9.52 | | |
| HA | H16 | 248 | 1.66 | yes | 4 | 0 | 100 | YWHLMHPGER | 42.86 | YWHLMRPGER | 19.1 | YWHLMSPGER | 9.52 | | |
| HA | H16 | 249 | 1.66 | yes | 4 | 0 | 100 | WHLMHPGERI | 42.86 | WHLMRPGERI | 38.1 | WHLMRPGERT | 4.76 | | |
| HA | H16 | 254 | 1.66 | yes | 4 | 0 | 100 | PGERIMFESN | 42.86 | PGERITFESS | 38.1 | PGERITFESN | 4.76 | | |
| HA | H16 | 255 | 2.15 | yes | 5 | 0 | 100 | GERIMFESNG | 38.1 | GERITFESSG | 38.1 | GERITFESN | 4.76 | | |
| HA | H16 | 256 | 1.42 | yes | 3 | 0 | 100 | ERIMFESNGG | 52.38 | ERITFESSGG | 38.1 | ERITFESNGG | 4.76 | | |
| HA | H16 | 257 | 1.42 | yes | 3 | 0 | 100 | RIMFESNGGL | 52.38 | RITFESSGGL | 38.1 | RITFESNGGL | 4.76 | | |
| HA | H16 | 259 | 1.42 | yes | 3 | 0 | 100 | TFESNGGLLA | 52.38 | MFESNGGLLA | 23.8 | TFESSGGLLA | 14.29 | TFESNGGLIA | 9.52 |
| HA | H16 | 260 | 0.92 | yes | 2 | 0 | 100 | FESNGGLLAP | 66.67 | FESSGGLLAP | 33.3 | | | | |
| HA | H16 | 261 | 0.92 | yes | 2 | 0 | 100 | ESNGGLLAPR | 66.67 | ESSGGLLAPR | 33.3 | | | | |
| HA | H16 | 262 | 0.92 | yes | 2 | 0 | 100 | SNGGLLAPRY | 66.67 | SSGGLLAPRY | 33.3 | | | | |
| HA | H16 | 263 | 0.92 | yes | 2 | 0 | 100 | NGGLLAPRYG | 66.67 | SGGLLAPRYG | 33.3 | | | | |
| HA | H16 | 264 | 0 | yes | 1 | 0 | 100 | GGLLAPRYGY | 100 | | | | | | |
| HA | H16 | 265 | 0 | yes | 1 | 0 | 100 | GLLAPRYGYI | 100 | | | | | | |
| HA | H16 | 266 | 0 | yes | 1 | 0 | 100 | LLAPRYGYII | 100 | | | | | | |
| HA | H16 | 267 | 0 | yes | 1 | 0 | 100 | LAPRYGYIIE | 100 | | | | | | |
| HA | H16 | 268 | 0 | yes | 1 | 0 | 100 | APRYGYIIEK | 100 | | | | | | |
| HA | H16 | 269 | 0 | yes | 1 | 0 | 100 | PRYGYIIEKY | 100 | | | | | | |
| HA | H16 | 270 | 0 | yes | 1 | 0 | 100 | RYGYIIEKYG | 100 | | | | | | |
| HA | H16 | 271 | 0.86 | yes | 2 | 0 | 100 | YGYIIEKYGT | 71.43 | YGYIIEKYGS | 28.6 | | | | |

FIG. 74-126

| Protein | Sub-type | Start Pos | Block Entropy | Gaps <10% | # to cov 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 272 | 0.86 | yes | 2 | 0 | 100 | GVIEKY

FIG. 74-127

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H16 | 326 | 0 | yes | 1 | 0 | 100 | KSGQLKLATG | 100 | | | | | | | | |
| HA | H16 | 327 | 0 | yes | 1 | 0 | 100 | SGQLKLATGL | 100 | | | | | | | | |
| HA | H16 | 328 | 0 | yes | 1 | 0 | 100 | GQLKLATGLR | 100 | | | | | | | | |
| HA | H16 | 329 | 0 | yes | 1 | 0 | 100 | QLK

FIG. 74-128

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 377 | 1.32 | yes | 3 | 0 | 100 | GTGIAADKAS | 61.9 | GTGIAADKTS | 23.8 | |

FIG. 74-129

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 419 | 0.79 | yes | 2 | 0 | 100 | VE

FIG. 74-130

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 461 | 2.15 | yes | 5 | 0 | 100 | VRNLHDQVKR | 38.1 | VRNLHEQIKR | 23.8 | | | | |
| HA | H16 | 462 | 1.7 | yes | 4 | 0 | 100 | LKNNAIDEGD | 47.62 | LKDNAIDEGD | 23.8 | | | | |
| HA | H16 | 463 | 1.7 | yes | 4 | 0 | 100 | KNNAIDEGDG | 47.62 | KDNAIDEGDG | 23.8 | | | | |
| HA | H16 | 464 | 1.47 | yes | 3 | 0 | 100 | NNAIDEGDGC | 52.38 | SNAIDEGDGC | 23.8 | | | | |
| HA | H16 | 465 | 0 | yes | 1 | 0 | 100 | NAIDEGDGCF | 100 | | | | | | |
| HA | H16 | 466 | 0.79 | yes | 2 | 0 | 100 | AIDEGDGCFN | 76.19 | AIDEGDGCFS | 23.8 | | | | |
| HA | H16 | 467 | 1.28 | yes | 4 | 0 | 100 | IDEGDGCFNL | 71.43 | IDEGDGCFSI | 14.3 | IDEGDGCFNF | 9.52 | | |
| HA | H16 | 468 | 1.28 | yes | 4 | 0 | 100 | DEGDGCFNLL | 71.43 | DEGDGCFSIL | 14.3 | DEGDGCFNFF | 9.52 | | |
| HA | H16 | 469 | 1.28 | yes | 4 | 0 | 100 | EGDGCFNLLH | 71.43 | EGDGCFSLLH | 14.3 | EGDGCFNFFH | 9.52 | | |
| HA | H16 | 470 | 1.28 | yes | 4 | 0 | 100 | GDGCFNLLHK | 71.43 | GDGCFSLLHK | 14.3 | GDGCFNFFHK | 9.52 | | |
| HA | H16 | 471 | 1.28 | yes | 4 | 0 | 100 | DGCFNLLHKC | 71.43 | DGCFSLLHKC | 14.3 | DGCFNFFHKC | 9.52 | | |
| HA | H16 | 472 | 1.28 | yes | 4 | 0 | 100 | GCFNLLHKCN | 71.43 | GCFSLLHKCN | 14.3 | GCFNFFHKCN | 9.52 | | |
| HA | H16 | 473 | 1.28 | yes | 4 | 0 | 100 | CFNLLHKCND | 71.43 | CFSLLHKCND | 14.3 | CFNFFHKCND | 9.52 | | |
| HA | H16 | 474 | 1.28 | yes | 4 | 0 | 100 | FNLLHKCNDS | 71.43 | FSLLHKCNDS | 14.3 | FNFFHKCNDS | 9.52 | | |
| HA | H16 | 475 | 1.28 | yes | 4 | 0 | 100 | NLLHKCNDSC | 71.43 | SLLHKCNDSC | 14.3 | NFFHKCNDSC | 9.52 | | |
| HA | H16 | 476 | 0.86 | yes | 3 | 0 | 100 | LLHKCNDSCM | 80.95 | LHKCNDSCME | 14.3 | | | | |
| HA | H16 | 477 | 0.28 | yes | 2 | 0 | 100 | LHKCNDSCME | 90.48 | FHKCNDSCME | 4.76 | | | | |
| HA | H16 | 478 | 0.45 | yes | 2 | 0 | 100 | HKCNDSCMET | 90.48 | HKCNDSCMEA | 9.52 | | | | |
| HA | H16 | 479 | 0.45 | yes | 2 | 0 | 100 | KCNDSCMETI | 90.48 | KCNDSCMEAI | 9.52 | | | | |
| HA | H16 | 480 | 0.45 | yes | 2 | 0 | 100 | CNDSCMETIR | 90.48 | CNDSCMEAIR | 9.52 | | | | |
| HA | H16 | 481 | 0.45 | yes | 2 | 0 | 100 | NDSCMETIRN | 90.48 | NDSCMEAIRN | 9.52 | | | | |
| HA | H16 | 482 | 0.45 | yes | 2 | 0 | 100 | DSCMETIRNG | 90.48 | DSCMEAIRNG | 9.52 | | | | |
| HA | H16 | 483 | 0.45 | yes | 2 | 0 | 100 | SCMETIRNGT | 90.48 | SCMEAIRNGT | 9.52 | | | | |
| HA | H16 | 484 | 0.45 | yes | 2 | 0 | 100 | CMETIRNGTY | 90.48 | CMEAIRNGTY | 9.52 | | | | |
| HA | H16 | 485 | 0.45 | yes | 2 | 0 | 100 | METIRNGTYN | 90.48 | MEAIRNGTYN | 9.52 | | | | |
| HA | H16 | 486 | 0.45 | yes | 2 | 0 | 100 | ETIRNGTYNH | 90.48 | EAIRNGTYNH | 9.52 | | | | |
| HA | H16 | 487 | 0.45 | yes | 2 | 0 | 100 | TIRNGTYNHE | 90.48 | AIRNGTYNHE | 9.52 | | | | |
| HA | H16 | 488 | 0 | yes | 1 | 0 | 100 | IRNGTYNHED | 100 | | | | | | |
| HA | H16 | 489 | 0 | yes | 1 | 0 | 100 | RNGTYNHEDY | 100 | | | | | | |
| HA | H16 | 490 | - | yes | 2 | 0 | 100 | NGTYNHEDYK | 52.38 | NGTYNHEDYR | 47.6 | | | | |
| HA | H16 | 491 | - | yes | 2 | 0 | 100 | GTYNHEDYKE | 52.38 | GTYNHEDYRE | 47.6 | | | | |
| HA | H16 | 492 | - | yes | 2 | 0 | 100 | TYNHEDYKEE | 52.38 | TYNHEDYREE | 47.6 | | | | |
| HA | H16 | 493 | - | yes | 2 | 0 | 100 | YNHEDYKEES | 52.38 | YNHEDYREES | 47.6 | | | | |
| HA | H16 | 494 | - | yes | 2 | 0 | 100 | NHEDYKEESQ | 52.38 | NHEDYREESQ | 47.6 | | | | |
| HA | H16 | 495 | - | yes | 2 | 0 | 100 | HEDYKEESQL | 52.38 | HEDYREESQL | 47.6 | | | | |
| HA | H16 | 496 | - | yes | 2 | 0 | 100 | EDYKEESQLK | 52.38 | EDYREESQLK | 47.6 | | | | |
| HA | H16 | 497 | - | yes | 1 | 0 | 100 | DYKEESQLKR | 52.38 | DYREESQLKR | 47.6 | DYREESQLKK | 4.76 | | |
| HA | H16 | 498 | - | yes | 1 | 0 | 100 | YKEESQLKRQ | 52.38 | YREESQLKRQ | 42.9 | YREESQLKKQ | 4.76 | | |
| HA | H16 | 499 | - | yes | 2 | 0 | 100 | KEESQLKRQE | 52.38 | REESQLKRQE | 42.9 | REESQLKKQE | 4.76 | | |
| HA | H16 | 500 | 1.22 | yes | 3 | 0 | 100 | EESQLKRQEI | 95.24 | | | | | | |
| HA | H16 | 501 | 1.22 | yes | 3 | 0 | 100 | ESQLKRQEIE | 95.24 | | | | | | |
| HA | H16 | 502 | 0.28 | yes | 2 | 0 | 100 | SQLKRQEIEG | 95.24 | | | | | | |

FIG. 74-131

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 513 | 0.28 | yes | 2 | 0 | 100 | QLKRQEI

FIG. 74-132

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 555 | 1.53 | yes | 4 | 4.76 | 100 | MWACSSGNCR | 60 | MWACSNGSCR | 20 | LWACSS

FIG. 74-133

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 390 | 0.23 | yes | 2 | 0

FIG. 74-134

| Protein | Sub-type | Start Pos | Block Entropy | Gaps >10% | # to cov 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H1N1 | 27 | 1.05 | yes | 3 | 1.86 | 99.13 | ADTLCIGYHA | 74.63 | ADTICIGYHA | 3.3 | | | | |
| HA | H1N1 | 28 | 1.03 | yes | 3 | 0.54 | 99.29 | DTLCIGYHAN | 74.69

FIG. 74-135

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N

FIG. 74-136

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 373 | 0.56 | yes | 2 | 0.1 | 99.51 | WTGMVDGWYG | 1.11 | WTGMI

FIG. 74-137

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H1N1 | 448 | 0.95 | yes | 4 | 0.01 | 99.51 | LDWTYNAEL | 81.79 | IDIWTYNAEL | 9.73 | L

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 7 | 0 | no | 1 | 99.93 | 100 | IQEFKMNPNQ | 100 | | | | | | |
| NA | H1N1 | 8 | 0 | no | 1 | 99.93 | 100 | QEFKMNPNQK | 100 | | | | | | |
| NA | H1N1 | 9 | 0 | no | 1 | 99.93 | 100 | EFKMNPNQKI | 100 | | | | | | |
| NA | H1N1 | 10 | 0 | no | 1 | 99.93 | 100 | FKMNPNQKII | 100 | | | | | | |
| NA | H1N1 | 11 | 0.92 | no | 2 | 0.07 | 99.26 | KMNPNQKIIT | 66.67 | KMNPNQKIIT | 33.3 | | | | | |
| NA | H1N1 | 107 | 1.54 | yes | 4 | 0.13 | 99.17 | GWAIYSKDNS | 69.89 | GWAIYSKDNG | 25.9 | GWAIHTKDNS | 2.95 | | | |

FIG. 74-140

| Protein | Sub-type | Start Pos | Block Entropy | Gaps >10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H1N1 | 161 | 1.03 | yes | 5 | 0.18 | 99.08 | KDRSPYRTLM | 70.9 | KDRSPYRALM | 27.3 | KDRSPHRTLM | 0.38 | KNRSPYRALM | 0

FIG. 74-141

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| NA | H1N1 | 215 | 0.16 | yes | 3 | 0.02 | 99.39 | AVLKYNGIIT | 98.5 | AVLKYNGIIT | 0.5 | | | | | | |
| NA | H1N1 | 216 | 1.28 | yes | 5 | 0.01 | 99.3 | VLKYNGIITD

FIG. 74-142

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 331 | 1.35 | yes | 4 | 0.03 | 99.3 | SGIFGDNPRP | 60.91 | SGVFGDNPRS | 7.57 | SGVFGDNPRP | 0.39 | SGVLG

FIG. 74-143

| Protein | Sub-type | Start Pos | Entropy Block | Gaps >10% | # to 99% cover | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H1N1 | 469 | 0.51 | yes | 3 | 4.16 | 99.34 | WSWPDGAELP | 91.28 | WSWPDGADLP | 7.56 | WSWPDGAK

FIG. 74-144

| Protein | Sub-type | Start Pos | Block Entropy | Gaps >10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H1N2 | 357 | 1.12 | yes | 3 | 0 | 99.12 | GWTGMI

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 175 | 0.55 | yes | 2 | 0 | 99.72 | VCIAWSSSSC | 87.85 | VCIAWSSSSC | 11.9 | | | | |
| NA | H1N2 | 176 | 1.04 | yes | 3 | 0 | 99.72 | CIAWSSSSCH | 76.55 | CMAWSSSSCH | 11.9 | CIAWSSSSCY | 11.3 | | |
| NA | H1N2 | 177 | 1.07 | yes | 2 | 0 | 99.44 | IAWSSSSCHD | 76.27 | MAWSSSSCHD | 11.3 | IAWSSSSCYD | 11.3 | | |
| NA | H1N2 | 178 | 0.54 | yes | 3 | 0 | 99.72 | AWSSSSCHDG | 88.42 | AWSSSSCYDG | 11.3 | | | | |
| NA | H1N2 | 179 | 0.69 | yes | 4 | 0 | 99.72 | WSSSSCHDGK | 86.16 | WSSSSCYDGK | 11.3 | | | | |
| NA | H1N2 | 180 | 0.82 | yes | 4 | 0 | 99.72 | SSSSCHDGKA | 84.18 | SSSSCYDGKA | 11.3 | SSSSCHD

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 42 | 0.21 | yes | 3 | 0 | 99.58 | LERNVTVTHA | 97.49 | LEQNVTVTHA | 1.26 | | | | |
| HA | H2 | 43 | 0.82 | yes | 4 | 0 | 99.16 | ERNVTVTHAK | 83.26 | ERNVTVTHAQ | 13.8 | | | | |
| HA | H2 | 44 | — | yes | 4 | 0 | 99.16 | NVTVTHAKDI | 79.08 | NVTVTHAQDI | 14.2 | | | | |
| HA | H2 | 45 | — | yes | 4 | 0 | 99.16 | VTVTHAKDIL | 79.08 | VTVTHAQDIL | 14.2 | | | | |
| HA | H2 | 46 | 0.96 | yes | 3 | 0 | 99.16 | TVTHAKDILE | 79.5 | TVTHAKNIL | 14.2 | | | | |
| HA | H2 | 47 | 1.04 | yes | 5 | 0 | 99.16 | VTHAKDILEK | 79.08 | VTHAKNILEK | 13.4 | | | | |
| HA | H2 | 48 | 0.68 | yes | 4 | 0 | 99.16 | VTHAKDILE | 89.54 | VTHAQDILER | 5.44 | EKNVTVTHAQ

FIG. 74-149

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 268 | 0.64 | yes | 3 | 0 | 99.58 | LIAPEY

FIG. 74-150

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 346 | 0.23 | yes | 3 | 0 | 99.58 | SRGLFGAIAG | 97.07 | PRGLFGAIAG | 1.67 | ARGLFGAIAG | 0.84

| Protein | Sub-type | Start Pos | Block Entropy | Gaps <10% | # to cover 99% | % Gap | Coverage | Peptides included | Freq | Peptides included | Freq | Peptides included | Freq | Peptides induced | Freq |
|---|---|---|---|---|---|---|---|---|---|---|---|---|---|---|---|
| HA | H2 | 558 | 0.08 | yes |

FIG. 74-154

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 60 | 1 | yes | 3 | 0 | 99.12 | NGIPPLELGD | 78.07 | SGIPP

FIG. 74-155

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 189 | 1.65 | yes | 5 | 0 | 99.12 | IWGVHHPNDE | 61.4 | IWGIHHPNDD | 21.1 | IWGV

FIG. 74-156

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 302 | 0.91 | yes | 2 | 0 | 100 | TLPFHNVHPL | 67

FIG. 74-157

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 346 | 0 | yes | 1 | 0 | 100 | IAGFIEGGWQ | 100 | | | | | | |
| HA | H2N2 | 347 | 0 | yes | 1 | 0 | 100 | AGFIEGGWQG | 100 | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 467 | 1.45 | yes | 4 | 0 | 99.12 | RDNVKELGNG | 60.53

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 180 | 0.31 | yes | 2 | 0 | 99.31 | SSSC

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 293 | 0.6 | yes | 3 | 0 | 100 | DNWKG

FIG. 74-166

| Protein | Sub-type | Start Pos | Block Entropy | Gaps >10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H2N2 | 376 | 1.01 | yes | 5 | 0 | 99.31 | TFRVIGGWST | 82.76 | TFKVIGGWTT | 6.21 | TFRVIGGWAT | 5

FIG. 74-167

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 455 | 0.27 | yes | 3 | 0.69 | 99.31 | TGSW

FIG. 74-168

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 292 | 0 | no | 1 | 99.98 | 100 | LNNEIRWPPH | 100 | | | | | | |
| HA | H3 | 307 | 0.26 | yes | 4 | 0.06 | 99.03 | SECITPNGSI | 97.42 | SACITPNGSI | 0.85 | SGCITPNGSI | 0.5 | FECITPNGSI | 0.26 |
| HA | H3 | 308 | 0.43 | yes | 5 | 0.06 | 99.15 | ECITPN

FIG. 74-169

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 391 | 1.43 | yes | 4 | 0.06 | 99.19 | TGQAADLKST | 62.42 | IGQAADLKST | 19.5 | | | | |
| HA | H3 | 392 | 0.08 | yes | 1 | 0.06 | 99.31 | GQAADLKSTQ | 99.31 | | | | | | |
| HA | H3 | 393 | 0.14 | yes | 2 | 0.06 | 99.21 | QAADLKSTQA | 98.69 | QAADLKSTQT | 0.52 | | | | |
| HA | H3 | 394 | 0.16 | yes | 2 | 0.06 | 99.01 | AADLKSTQAA | 98.49 | AADLKSTQTA | 0.52 | | | | |
| HA | H3 | 395 | 0.19 | yes | 4 | 0.08 | 99.17 | ADLKSTQAAI | 98.18 | ADLKSTQTAI | 0.52 | ADLKSTQAAI | 0.26 | DFKSTQAAIN | 0.16 |
| HA | H3 | 396 | 1.16 | yes | 5 | 0.06 | 99.05 | DLKSTQAAID | 56.47 | DLKSTQAAIN | 41.7 | DLKSTQAAV | 0.52 | LKSTQAAITQ | 0.16 |
| HA | H3 | 397 | 1.17 | yes | 5 | 0.06 | 99.03 | LKSTQAAIDQ | 56.47 | LKSTQTAIDQ | 41.7 | LKSTQAAINQ | 0.52 | KSTQAAVNQI | 0.18 |
| HA | H3 | 398 | 1.16 | yes | 5 | 0.06 | 99.15 | KSTQAAIDQI | 48.97 | KSTQTAIDQI | 41.9 | KSTQAAINQ | 0.52 | VEKTNEKFHQ | 0.73 |
| HA | H3 | 415 | 1.49 | yes | 5 | 0.04 | 99.31 | IGKTNEKFHQ | 48.98 | IEKTNEKFHQ | 42.9 | IKKTNEKFHQ | 0.52 | | |
| HA | H3 | 416 | 1.42 | yes | 4 | 0.06 | 99.15 | GKTNEKFHQI | 95.46 | ERTNEKFHQI | 43.7 | KKTNEKFHQI | 3.95 | | |
| HA | H3 | 417 | 0.31 | yes | 2 | 0.06 | 99.37 | KTNEKFHQIE | 99.37 | ERTNEKFHQI | 3.97 | | 3.97 | | |
| HA | H3 | 418 | 0.08 | yes | 1 | 0.06 | 99.37 | TNEKFHQIEK | 99.54 | | | | | | |
| HA | H3 | 419 | 0.05 | yes | 1 | 0.06 | 99.54 | NEKFHQIEKE | 99.58 | | | | | | |
| HA | H3 | 420 | 0.09 | yes | 1 | 0.06 | 99.58 | EKFHQIEKEF | 99.25 | | | | | | |
| HA | H3 | 421 | 0.1 | yes | 2 | 0.1 | 99.25 | KFHQIEKEFS | 99.11 | | | | | | |
| HA | H3 | 422 | 0.17 | yes | 2 | 0.1 | 99.11 | FHQIEKEFSE | 98.31 | HQIEKEFSEI

FIG. 74-170

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 449 | 0.19 | yes | 2 | 0.02 | 99.07 | DLWSYNAELL | 98.04 | DLWSYNAGLL | 1.03 | | | | |
| HA | H3 | 450 | 0.2 | yes | 3 | 0.02 | 99.21 | LWSYNAELLV | 97.88 | LWSYNAGLLV | 1.03 | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 351 | 0.35 | yes | 2 | 0.02 | 99.61 | RGIFGAIAGF | 94.22 | RGIFGAIAGF | 5.39 | | | | |
| HA | H3N2 | 352 | 0.35 | yes | 2 | 0.02 | 99.66 | GIFGAIAGF

FIG. 74-174

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 413 | 0.06 | yes | 1 | 0.1 | 99.51 | NEKFHQIEKE | 99.51 | | | | | | |
| HA | H3N2 | 414 | 0.06 | yes | 1 | 0.07 | 99.56 | EKFHQIEKEF | 99.56 | | | | | | |
| HA | H3N2 | 415 | 0.1 | yes | 1 | 0.05 | 99.12 | KFHQIEKEFS | 99.12 | | | | | | |
| HA | H3N2 | 416 | 0.11 | yes | 1 | 0.05 | 99 | FHQIEKEFSE | 99 | | | | | | |
| HA | H3N2 | 417 | 0.11 | yes | 1 | 0.05 | 99.34 | HQIEKEFSEV | 98.98 | HQIEKEFTEV | 0.37 | | | | |
| HA | H3N2 | 418 | 0.11 | yes | 1 | 0.05 | 99 | QIEKEFSEVE | 99 | | | | | | |
| HA | H3N2 | 419 | 0.11 | yes | 1 | 0.05 | 99 | IEKEFSEVEG | 99 | | | | | | |
| HA | H3N2 | 420 | 0.13 | yes | 2 | 0.02 | 99.34 | EKEFSEVEG | 98.98 | EKEFTEVEGR | 0.37 | | | | |
| HA | H3N2 | 421 | 0.14 | yes | 2 | 0.05 | 99.24 | KEFSEVEGRI | 98.88 | KEFTEVEGRI | 0.37 | | | | |
| HA | H3N2 | 422 | 0.14 | yes | 2 | 0.02 | 99.34 | EFSEVEGRIQ | 98.98 | EFTEVEGRIQ | 0.37 | | | | |
| HA | H3N2 | 423 | 0.1 | yes | 2 | 0.02 | 99.15 | FSEVEGRIQD | 98.78 | FTEVEGRIQD | 0.37 | | | | |
| HA | H3N2 | 424 | 0.16 | yes | 2 | 0.02 | 99.1 | SEVEGRIQDL | 98.73 | TEVEGRIQDL | 0.37 | | | | |
| HA | H3N2 | 425 | 0.15 | yes | 2 | 0.02 | 99.24 | EVEGRIQDLE | 98.46 | VEGRIQDLER | 0.78 | | | | |
| HA | H3N2 | 426 | 0.18 | yes | 2 | 0.02 | 99.32 | VEGRIQDLEK | 98.54 | EGRIQDLERY | 0.78 | | | | |
| HA | H3N2 | 427 | 0.19 | yes | 2 | 0.02 | 99 | EGRIQDLEKY | 98.22 | GRIQDLERYE | 0.78 | | | | |
| HA | H3N2 | 428 | 0.18 | yes | 2 | 0.02 | 99.03 | GRIQDLEKYV | 98.25 | RIQDLERYVE | 0.78 | RIQDLEKYIE | 0.24 | | | |
| HA | H3N2 | 429 | 0.18 | yes | 2 | 0 | 99 | RIQDLEKYE | 98.2 | IQDLERYED | 0.78 | | | | |
| HA | H3N2 | 430 | 0.18 | yes | 2 | 0 | 99.22 | IQDLEKYED | 98.27 | QDLERYVEDT | 0.78 | DLEKYIEDTK | 0.24 | | | |
| HA | H3N2 | 431 | 0.18 | yes | 2 | 0 | 99 | QDLEKYVEDT | 98.2 | DLERYVEDTK | 0.78 | | | | |
| HA | H3N2 | 432 | 0.27 | yes | 3 | 0 | 99.05 | DLEKYVEDTK | 97.12 | LERYVEDTKI | 0.78 | LERYVEDTKI | 0.73 | | | |
| HA | H3N2 | 433 | 0.27 | yes | 3 | 0 | 99.12 | LEKYVEDTKI | 97.17 | EKYVEDTKID | 1.15 | ERYVEDTKID | 0.73 | | | |
| HA | H3N2 | 434 | 0.26 | yes | 3 | 0 | 99.24 | EKYVEDTKID | 97.25 | KYVEDTKIDL | 1.15 | RYVEDTKIDL | 0.73 | | | |
| HA | H3N2 | 435 | 0.18 | yes | 2 | 0 | 99.32 | KYVEDTKIDL | 98.03 | YVEDTKIDLW | 1.22 | | | | |
| HA | H3N2 | 436 | 0.18 | yes | 2 | 0 | 99.56 | YVEDTKIDLW | 98.07 | VEDTKIDLWS | 1.24 | | | | |
| HA | H3N2 | 437 | 0.15 | yes | 2 | 0 | 99.56 | VEDTKIDLWS | 98.32 | EDTKIDLWSY | 1.24 | | | | |
| HA | H3N2 | 438 | 0.16 | yes | 2 | 0 | 99.51 | EDTKIDLWSY | 98.32 | DTKIDLWSYN | 1.22 | | | | |
| HA | H3N2 | 439 | 0.26 | yes | 2 | 0 | 99.44 | DTKIDLWSYN | 98.27 | TKIDLWSYNA | 1.22 | KVDLWSYNAE | 1.24 | KYDLWSYNAE | 1.24 | | |
| HA | H3N2 | 440 | 0.3 | yes | 3 | 0 | 99.1 | TKIDLWSYNA | 96.93 | KIDLWSYNAG | 1.24 | VDLWSYNAEL | 1.22 | | | |
| HA | H3N2 | 441 | 0.19 | yes | 2 | 0 | 99.2 | KIDLWSYNAE | 96.61 | IDLWSYNAGL | 1.24 | | | | |
| HA | H3N2 | 442 | 0.21 | yes | 2 | 0.02 | 99.22 | IDLWSYNAEL | 97.93 | DLWSYNAGLL | 1.27 | LWSYNAELLI | 0.24 | | | |
| HA | H3N2 | 443 | 0.23 | yes | 2 | 0 | 99 | DLWSYNAELL | 97.71 | LWSYNAGLLV | 1.27 | WSYNAELLIA | 0.24 | | | |
| HA | H3N2 | 444 | 0.22 | yes | 2 | 0 | 99.05 | LWSYNAELLV | 97.54 | WSYNAGLLVA | 1.27 | SYNAEFLVAL | 0.17 | | | |
| HA | H3N2 | 445 | 0.25 | yes | 2 | 0 | 99 | WSYNAELLVA | 97.42 | SYNAGLLVAL | 1.27 | YNAEFLVALE | 0.17 | | | |
| HA | H3N2 | 446 | 0.26 | yes | 3 | 0 | 99.07 | SYNAELLVAL | 97.37 | YNAGLLVALE | 1.27 | NAEFLVALEN | 0.17 | SYNAEILVAL | 0.15 | |
| HA | H3N2 | 447 | 0.25 | yes | 3 | 0 | 99.1 | YNAELLVALE | 97.39 | NAGLLVALEN | 1.27 | AEFLVALENQ | 0.17 | YNAEILVALE | 0.15 | YNAELLVAME | 0.12 |
| HA | H3N2 | 448 | 0.25 | yes | 4 | 0 | 99.22 | NAELLVALEN | 97.42 | AGLLVALENQ | 1.27 | EFLVALENQH | 0.17 | NAEILVALEN | 0.15 | NAELLIALEN | 0.12 |
| HA | H3N2 | 449 | 0.25 | yes | 5 | 0.02 | 98.49 | AELLVALENQ | 98.49 | LLVALENQHT | 0.22 | FLVALENQHT | 0.2 | AEILVALENQ | 0.15 | |
| HA | H3N2 | 452 | 0.12 | yes | 4 | 0.02 | 99.05 | LLVALENQHT | 98.98 | LVALENQHTI | 0.22 | | | ILVALENQHT | 0.15 | |
| HA | H3N2 | 453 | 0.16 | yes | 2 | 0.05 | 99.2 | VALENQHTID | 98.54 | VALENQHTID | 0.44 | VALENQHTID | 0.22 | | | |
| HA | H3N2 | 454 | 0.18 | yes | 3 | 0.05 | 99.05 | ALENQHTIDL | 98.37 | AMENQHTIDL | 0.44 | AMENQHTIDL | 0.24 | | | |
| HA | H3N2 | 455 | 0.16 | yes | 3 | 0.05 | 99.17 | LENQHTIDLT | 98.51 | LENQHTIDLT | 0.44 | LENQHTIDLT | 0.22 | | | |

FIG. 74-175

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 456 | 0.15 | yes | 2 | 0.02 | 99.02 | ENQHT

FIG. 74-176

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 542 | 0.23 | yes | 3 | 0.12 | 99.02 | ISFAISCFLL | 97.63 | ISFATSCFLL | 0.85 | ISFAMSCFLL | 0.54 | | |
| HA | H3N2 | 543 | 0.24 | yes | 3 | 0.12 | 99.02 | SFAISCFLL | 97.61 | SFATSCFLL | 0.85 | SFAMSCFLL | 0.56 | | |
| HA | H3N2 | 556 | 0.45 | yes | 5 | 0.88 | 99.07 | LGFIWACQK | 93.71 | LGFIWACQR | 4.84 | LGFIWTCQK | 0.22 | LGFVMW

FIG. 74-177

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| NA | H3N2 | 124 | 0.32 | yes | 4 | 0.09 | 99.08 | VTREPYVSCD | 96.59 | VTREPYVSCS | 0.86 | VTREPYVSCG | 0.81 | | |
| NA | H3N2 | 135 | 0.98 | yes | 5 | 0.02 | 99.04 | DKCYQFALGQ | 82.27 | GKCYQFALGQ | 11.3 | NKCYQFALGQ | 2.06 | DRCYQFALGQ | 0.24 |
| NA | H3N2 | 136 | 0.1 | yes | 1 | 0.02 | 99.04 | KCYQFALGQG | 99.04 | | | | | | |
| NA | H3N2 | 137 | 0.05 | yes | 1 | 0 | 99.61 | CYQFALGQGT | 99.61 | | | | | | |
| NA | H3N2 | 138 | 0.04 | yes | 1 | 0 | 99.64 | YQFALGQGTT | 99.64 | | | | | | |
| NA | H3N2 | 139 | 0.07 | yes | 1 | 0 | 99.46 | QFALGQGTTL | 99.46 | | | | | | |
| NA | H3N2 | 140 | 0.52 | yes | 3 | 0.06 | 99.21 | FALGQGTTLD | 90.96 | FALGQGTTLS | 7.99 | | | | |
| NA | H3N2 | 141 | 0.52 | yes | 3 | 0.04 | 99.21 | ALGQGTTLDN | 90.96 | ALGQGTTLSN | 7.99 | | | | |
| NA | H3N2 | 160 | 0.55 | yes | 3 | 0.04 | 99.06 | RIPHRTLLMN | 91.54 | RTPHRTLLMN | 5.49 | | | | |
| NA | H3N2 | 161 | 0.55 | yes | 2 | 0.04 | 99.06 | IPHRTLLMNE | 91.54 | TPHRTLLMNE | 5.48 | | | | |
| NA | H3N2 | 162 | 0.48 | yes | 2 | 0.04 | 99.12 | PHRTLLMNEL | 91.56 | | | | | | |
| NA | H3N2 | 163 | 0.46 | yes | 2 | 0.04 | 99.42 | HRTLLMNELG | 91.58 | | | | | | |
| NA | H3N2 | 164 | 0.1 | yes | 1 | 0.04 | 99.06 | RTLLMNELGV | 99.06 | | | | | | |
| NA | H3N2 | 165 | 0.1 | yes | 1 | 0.04 | 99.36 | TLLMNELGVP | 99.36 | | | | | | |
| NA | H3N2 | 166 | 0.11 | yes | 1 | 0.04 | 99.31 | LLMNELGVPF | 98.99 | LIMSELGVPF | 0.36 | | | | |
| NA | H3N2 | 167 | 0.15 | yes | 2 | 0.04 | 99.34 | LMNELGVPFH | 98.61 | LMSELGVPFH | 0.36 | | | | |
| NA | H3N2 | 168 | 0.14 | yes | 2 | 0.04 | 99.29 | MNELGVPFHL | 98.63 | MSELGVPFHL | 0.36 | LMNELGIPFH | 0.34 | | |
| NA | H3N2 | 169 | 0.15 | yes | 2 | 0.02 | 99.04 | NELGVPFHLG | 98.59 | SELGVPFHLG | 0.36 | MNELGIPFHL | 0.34 | | |
| NA | H3N2 | 170 | 0.1 | yes | 1 | 0 | 99.25 | ELGVPFHLGT | 99.04 | | | NELGIPHLG | 0.34 | | |
| NA | H3N2 | 171 | 0.85 | yes | 3 | 0 | 99.27 | LGVPFHLGTK | 78.09 | LGVPFHLGTR | 20.9 | LGVPFYLGTK | 0.3 | | |
| NA | H3N2 | 172 | 0.85 | yes | 3 | 0 | 99.27 | GVPFHLGTKQ | 78.07 | GVPFHLGTRQ | 20.9 | GVPFYLGTKQ | 0.3 | | |
| NA | H3N2 | 173 | 0.85 | yes | 2 | 0 | 99.36 | VPFHLGTKQV | 78.07 | VPFHLGTRQV | 20.9 | VPFYLGTKQV | 0.3 | | |
| NA | H3N2 | 174 | 0.81 | yes | 2 | 0 | 99.19 | PFHLGTKQVC | 78.35 | PFHLGTRQVC | 21 | | | | |
| NA | H3N2 | 175 | 0.9 | yes | 4 | 0 | 99.21 | FHLGTKQVCI | 77.82 | FHLGTRQVCI | 20.4 | FHLGTKQVCM | 0.62 | FHLGTKQVCM | 0.39 |
| NA | H3N2 | 176 | 0.91 | yes | 4 | 0 | 99.23 | HLGTKQVCIA | 77.84 | HLGTRQVCIA | 20.4 | HLGTRQVCMA | 0.62 | HLGTKQVCMA | 0.39 |
| NA | H3N2 | 177 | 0.87 | yes | 3 | 0 | 99.25 | LGTKQVCIAW | 78.18 | LGTRQVCIAW | 20.4 | LGTRQVCMAW | 0.62 | | |
| NA | H3N2 | 178 | 0.86 | yes | 3 | 0 | 99.23 | GTKQVCIAWS | 78.2 | GTRQVCIAWS | 20.4 | GTRQVCMAWS | 0.62 | | |
| NA | H3N2 | 179 | 0.86 | yes | 3 | 0 | 99.66 | TKQVCIAWSS | 78.22 | TRQVCIAWSS | 20.4 | TROVCMAWSS | 0.62 | | |
| NA | H3N2 | 180 | 0.86 | yes | 2 | 0 | 99.64 | KQVCIAWSSS | 78.2 | RQVCIAWSSS | 20.4 | RQVCMAWSSS | 0.62 | | |
| NA | H3N2 | 181 | 0.12 | yes | 2 | 0 | 99.53 | QVCIAWSSSS | 98.65 | QVCMAWSSSS | 1.01 | | | | |
| NA | H3N2 | 182 | 0.13 | yes | 2 | 0 | 99.49 | VCIAWSSSSC | 98.63 | VCMAWSSSSC | 1.01 | | | | |
| NA | H3N2 | 183 | 0.12 | yes | 2 | 0 | 99.66 | CIAWSSSSCH | 98.52 | CMAWSSSSCH | 1.01 | | | | |
| NA | H3N2 | 184 | 0.13 | yes | 2 | 0 | 99.23 | IAWSSSSCHD | 98.48 | MAWSSSSCHD | 1.01 | | | | |
| NA | H3N2 | 185 | 0.1 | yes | 1 | 0 | 99.14 | AWSSSSCHDG | 99.66 | | | | | | |
| NA | H3N2 | 186 | 0.11 | yes | 1 | 0 | 99.08 | WSSSSCHDGK | 99.23 | | | | | | |
| NA | H3N2 | 187 | 0.11 | yes | 1 | 0 | 99.08 | SSSSCHDGKA | 99.14 | | | | | | |
| NA | H3N2 | 188 | 0.04 | yes | 1 | 0 | 99.08 | SSSCHDGKAW | 99.08 | | | | | | |
| NA | H3N2 | 189 | 0.09 | yes | 1 | 0 | 99.38 | SSCHDGKAWL | 99.08 | | | | | | |
| NA | H3N2 | 190 | 0.1 | yes | 1 | 0 | 99.4 | SCHDGKAWLH | 98.97 | CHDGRAWLHV | 0.41 | | | | |
| NA | H3N2 | 191 | 0.11 | yes | 2 | 0 | 99.08 | CHDGKAWLHV | 98.99 | HDGRAWLHVC | 0.41 | | | | |
| NA | H3N2 | 192 | 0.12 | yes | 2 | 0 | 99.08 | HDGKAWLHVC | 98.99 | DGKAWLHVCI | 33.4 | | | | |
| NA | H3N2 | 193 | 1.02 | yes | 2 | 0 | 99.08 | DGKAWLHVCV | 65.67 | DGKAWLHVCI | 33.4 | | | | |

FIG. 74-178

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 194 | 1.02 | yes | 2 | 0 | 99.08 | GKAWLHVCVT | 65.7 | GKAWLHVCIT | 33.4 | | | | |
| NA | H3N2 | 195 | 1.02 | yes | 2 | 0 | 99.08 | KAWLHVCVTG | 65.7 | KAWLHVCITG | 33.4 | | | | |
| NA | H3N2 | 208 | 0.98 | yes | 4 | 0.04 | 99.21 | NATASFIYNG | 76.46 | NATASFIYGG | 20.6 | NATASFYDG | 0.36 | | |
| NA | H3N2 | 229 | 1.73 | yes | 4 | 0.06 | 99.27 | EILRTQESEC | 40.54 | NILRTQESEC | 37.7 | DILRTQESEC | 2.89 | | |
| NA | H3N2 | 230 | 0.11 | yes | 1 | 0 | 99.04 | ILRTQESECV | 99.04 | | | | | | |
| NA | H3N2 | 231 | 0.08 | yes | 1 | 0 | 99.29 | LRTQESECVC | 99.29 | | | | | | |
| NA | H3N2 | 232 | 0.08 | yes | 1 | 0 | 99.27 | RTQESECVCI | 99.27 | | | | | | |
| NA | H3N2 | 233 | 0.13 | yes | 2 | 0 | 99.1 | TQESECVCIN | 98.8 | TQESECICIN | 0.32 | | | | |
| NA | H3N2 | 234 | 0.13 | yes | 2 | 0 | 99.12 | QESECVCING | 98.78 | QESECICING | 0.32 | | | | |
| NA | H3N2 | 235 | 0.14 | yes | 2 | 0 | 99.01 | ESECVCINGT | 98.69 | ESECICINGT | 0.32 | | | | |
| NA | H3N2 | 236 | 0.14 | yes | 2 | 0 | 99.06 | SECVCINGTC | 98.74 | SECICINGTC | 0.32 | | | | |
| NA | H3N2 | 237 | 0.25 | yes | 4 | 0.04 | 99.25 | ECVCINGTCT | 97.34 | ECICINGTCT | 1.33 | ECVCISGTCA | 0.32 | | |
| NA | H3N2 | 238 | 0.26 | yes | 5 | 0.04 | 99.14 | CVCINGTCTV | 97.24 | CICINGTCTV | 1.33 | CVCISGTCAV | 0.32 | | |
| NA | H3N2 | 239 | 0.28 | yes | 5 | 0.04 | 99.12 | VCINGTCTVW | 97.02 | ICINGTCTV | 1.33 | VCISGTCAVV | 0.32 | VCINGTCTVI | 0.19 |
| NA | H3N2 | 240 | 0.28 | yes | 4 | 0.04 | 99.06 | CINGTCTVWM | 97.13 | CISGTCAVVM | 1.31 | CINGTCTVIM | 0.26 | CINGICTVWM | 0.17 |
| NA | H3N2 | 241 | 0.28 | yes | 3 | 0.04 | 99.06 | INGTCTVWMT | 97.24 | ISGTCAVVMT | 1.31 | INGTCTVIMT | 0.26 | IDGTCTVWMT | 0.17 |
| NA | H3N2 | 242 | 0.26 | yes | 3 | 0.04 | 99.01 | NGTCTVWMTD | 97.13 | SGTCAVVMTD | 1.31 | NGTCTVIMTD | 0.19 | | |
| NA | H3N2 | 243 | 0.23 | yes | 3 | 0.04 | 99.04 | GTCVWMTDG | 97.26 | GTCAVVMTDG | 1.56 | | | | |
| NA | H3N2 | 244 | 0.27 | yes | 3 | 0.06 | 99.04 | TCTVWMTDGS | 97.47 | TCAVVMTDGS | 1.56 | TCTVWMTDGN | 0.47 | | |
| NA | H3N2 | 245 | 0.25 | yes | 4 | 0.11 | 99.23 | CTVWMTDGSA | 97 | CAVVMTDGSA | 1.61 | CTVWMTDGNA | 0.47 | | |
| NA | H3N2 | 246 | 0.25 | yes | 3 | 0.06 | 99.19 | TVWMTDGSAS | 97.17 | AVVMTDGSAS | 1.61 | TVWMTDGNAS | 0.47 | VVMTDGNASG | 0.47 |
| NA | H3N2 | 247 | 0.49 | yes | 4 | 0.06 | 100 | VVMTDGSASE | 92.8 | VVMTDGSASD | 5.21 | VVMTDGNASD | 0.71 | | |
| NA | H3N2 | 264 | 0 | no | 1 | 99.98 | 100 | EYFVKEGKII | 100 | | | | | | |
| NA | H3N2 | 265 | 0 | no | 1 | 99.98 | 100 | YFVKEGKIV | 100 | | | | | | |
| NA | H3N2 | 266 | 0.48 | no | 1 | 99.98 | 100 | FVKEGKIVH | 100 | | | | | | |
| NA | H3N2 | 279 | 0.48 | yes | 5 | 0.02 | 99.14 | LSGAQHVEE | 93.68 | LLGSAQHVEE | 3.73 | LSGNAQHVEE | 0.19 | LSGGAQHVEE | 0.15 |
| NA | H3N2 | 280 | 0.47 | yes | 4 | 0.04 | 99.06 | SGSAQHVEEC | 93.77 | SGSAQHVEEC | 3.71 | SGNAQHVEEC | 0.19 | | |
| NA | H3N2 | 281 | 0.33 | yes | 2 | 0.04 | 99.16 | GSAQHVEECS | 95.31 | GAQHVEECS | 3.86 | | | | |
| NA | H3N2 | 282 | 0.28 | yes | 2 | 0.04 | 99.21 | SAQHVEECSC | 95.33 | SAQHIEECSC | 3.88 | | | | |
| NA | H3N2 | 283 | 0.28 | yes | 2 | 0.04 | 99.61 | AQHVEECSCY | 95.74 | AQHIEECSCY | 3.88 | | | | |
| NA | H3N2 | 284 | 0.28 | yes | 2 | 0.04 | 99.68 | QHVEECSCYP | 95.82 | QHIEECSCYP | 3.86 | | | | |
| NA | H3N2 | 285 | 0.34 | yes | 2 | 0.06 | 99.59 | HVEECSCYPR | 95.93 | HIEECSCYPR | 3.66 | | | | |
| NA | H3N2 | 286 | 0.18 | yes | 3 | 0.04 | 99.27 | VEECSCYPRF | 95.41 | IEECSCYPR | 3.41 | VEECSCYPRF | 0.47 | | |
| NA | H3N2 | 287 | 0.48 | yes | 5 | 0.06 | 99.12 | EECSCYPRFP | 98.24 | EECSCYPRFP | 0.54 | EECSCYPRYS | 0.49 | ECSCYPRYSG | 0.49 |
| NA | H3N2 | 288 | 0.45 | yes | 4 | 0.04 | 99.57 | ECSCYPRYPG | 94.04 | ECSCYPRYPN | 2.12 | ECSCYPRYPD | 1.95 | | |
| NA | H3N2 | 298 | 0.38 | yes | 3 | 0.04 | 99.59 | VRCVCRDNWK | 93.45 | IRCVCRDNWK | 4.67 | ECSCYPRFPG | 0.79 | | |
| NA | H3N2 | 299 | 0.37 | yes | 3 | 0.04 | 99.66 | RCVCRDNWKG | 94.26 | RCICRDNWKG | 4.67 | VRCVCRDNWR | 0.66 | | |
| NA | H3N2 | 300 | 0.37 | yes | 3 | 0.06 | 99.59 | CVCRDNWKGS | 94.33 | CICRDNWKGS | 4.67 | | | | |
| NA | H3N2 | 301 | 0.09 | yes | 2 | 0.04 | 99.83 | VCRDNWKGSN | 94.28 | ICRDNWKGSN | 4.67 | | | | |
| NA | H3N2 | 302 | 0.09 | yes | 3 | 0 | 99.83 | CRDNWKGSNR | 98.97 | CRDNWRGSNR | 0.86 | | | | |
| NA | H3N2 | 303 | 0.5 | yes | 3 | 0 | 99.66 | RDNWKGSNRP | 98.97 | RDNWRGSNRP | 0.86 | | | | |
| NA | H3N2 | 304 | | yes | 3 | 0 | 99.66 | DNWKGSNRPY | 90.99 | DNWRGSNRPI | 8.01 | DNWRGSNRPI | 0.66 | | |

FIG. 74-179

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 305 | 0.68 | yes | 5 | 0 | 99.57 | NWKGSNRPIV | 89.68 | NWKGSNRPVI | 5.12 | NWKGSNRPII | 1.26 | NWR

| Protein | Sub-type | Start Pos | Block Entropy | Gaps <10% | # to cover 99% | Gap % | coverage | Peptides included | Freq | Peptides included | Freq | Peptides included | Freq | Peptides included | Freq |
|---|---|---|---|---|---|---|---|---|---|---|---|---|---|---|---|
| HA | H4 | 125 | 0.16 | yes | 2 | 0 | 99.2 | LANNGKFEFI | 98.24 | LANNGRFEFI | 0.96 | | | | |
| HA | H4 | 126 | 0.24 | yes | 4 | 0 | 99.2 | ANNGKFEFIA | 97.44 | ANNGRFEFIA | 0.96 | ANNGKLEFIA | 0.48 | | |
| HA | H4 | 127 | 0.24 | yes | 4 | 0 | 99.2 | NNGKFEFIAE | 97.44 | NNGRFEFIA | 0.96 | NNGKLEFIAE | 0.48 |

FIG. 74-182

| Protein | Sub-type | Start Pos | Block Entropy | Gaps <10% | # to cover 99% | Gap % | coverage | included peptides | Freq | included peptides | Freq | included peptides | Freq | included peptides | Freq |
|---|---|---|---|---|---|---|---|---|---|---|---|---|---|---|---|
| HA | H4 | 253 | 0.48 | yes | 5 | 0.64 | 99.19 | PGDIIVFNTI | 92.9 | PGDLILFNTI | 5.16 | P

FIG. 74-183

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H4 | 357 | 0.05 | yes | 1 | 0 | 99.52 | GWQGLIDGWY | 99.52 | | | | | | |
| HA | H4 | 358 | 0.05 | yes | 1 | 0 | 99.52 | WQGLIDGWYG | 99.52 | | | | | | |
| HA | H4 | 359 | 0.07 | yes | 1 | 0 | 99.36 | QGLIDGWYGF | 99.36 | | | | | | |
| HA | H4 | 360 | 0.08 | yes | 1 | 0 | 99.2 | GLIDGWYGFR | 99.2 | | | | | | |
| HA | H4 | 361 | 0.08 | yes | 1 | 0 | 99.2 | LIDGWYGFRH | 99.2 | | | | | | |
| HA | H4 | 362 | 0.1 | yes | 1 | 0 | 99.04 | IDGWYGFRHQ | 99.04 | | | | | | |
| HA | H4 | 363 | 0.07 | yes | 1 | 0 | 99.36 | DGWYGFRHQN | 99.36 | | | | | | |
| HA | H4 | 364 | 0.14 | yes | 2 | 0 | 99.2 | GWYGFRHQNA | 98.56 | GWYGFRHQNS | 0.64 | | | | |
| HA | H4 | 365 | 0.14 | yes | 2 | 0 | 99.2 | WYGFRHQNAE | 98.56 | WYGFRHQNSE | 0.64 | | | | |
| HA | H4 | 366 | 0.12 | yes | 2 | 0 | 99.36 | YGFRHQNAEG | 98.72 | YGFRHQNSEG | 0.64 | | | | |
| HA | H4 | 367 | 0.12 | yes | 2 | 0 | 99.36 | GFRHQNAEGT | 98.72 | GFRHQNSEGT | 0.64 | | | | |
| HA | H4 | 368 | 0.12 | yes | 2 | 0 | 99.36 | FRHQNAEGTG | 98.72 | FRHQNSEGTG | 0.64 | | | | |
| HA | H4 | 369 | 0.11 | yes | 2 | 0 | 99.52 | RHQNAEGTGT | 98.88 | RHQNSEGTGT | 0.64 | | | | |
| HA | H4 | 370 | 0.11 | yes | 2 | 0 | 99.52 | HQNAEGTGTA | 98.88 | HQNSEGTGTA | 0.64 | | | | |
| HA | H4 | 371 | 0.11 | yes | 2 | 0 | 99.52 | QNAEGTGTAA | 98.88 | QNSEGTGTAA | 0.64 | | | | |
| HA | H4 | 372 | 0.11 | yes | 2 | 0 | 99.52 | NAEGTGTAAD | 98.88 | NSEGTGTAAD | 0.64 | | | | |
| HA | H4 | 373 | 0.05 | yes | 1 | 0 | 99.52 | AEGTGTAADL | 99.52 | SEGTGTAADL | 0.64 | | | | |
| HA | H4 | 374 | 0.07 | yes | 1 | 0 | 99.36 | EGTGTAADLK | 99.36 | | | | | | |
| HA | H4 | 375 | 0.07 | yes | 1 | 0 | 99.36 | GTGTAADLKS | 99.36 | | | | | | |
| HA | H4 | 376 | 0.07 | yes | 1 | 0 | 99.36 | TGTAADLKST | 99.36 | | | | | | |

FIG. 74-184

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 400 | 0.34 | yes | 3 | 0 | 99.04 | IEKTNE

FIG. 74-185

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 447 | 0.14 | yes | 2 | 0 | 99.04 | ENQHTIDV

| Protein | Sub-type | Start Pos | Block Entropy | Gaps <10% | # to cover 99% | Gap % | Coverage | Induced Peptides | Freq | Induced Peptides | Freq | Induced Peptides | Freq | Induced Peptides | Freq |
|---|---|---|---|---|---|---|---|---|---|---|---|---|---|---|---|
| HA | H5 | 269 | 1.13 | yes | 4 | 0.1 | 99.08 | SNGNFIAPEY | 66.12 | SNGNFIAPEY | 31.3 | ST

FIG. 74-189

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 386 | 0.32 | yes | 3 | 0 | 99.03 | MVDG

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 93 | 0.48 | yes | 4 | 0.09 | 99.1 | NVPEWSYIVE | 93.18 | N

FIG. 74-193

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 323 | 0.12 | yes | 2 | 0.09 | 99.22 | LTIGECPKYV | 98.91 | LTIGKCPKYV | 0.3 | | | | |
| HA | H5N1 | 324 | 0.1 | yes | 1 | 0.12 | 99.1 | TIGECPKYVK | 99.1 | | | | | | |
| HA | H5N1 | 325 | 0.1 | yes | 1 | 0.12 | 99.13 | IGECPKYVKS | 99.13 | | | | | | |
| HA | H5N1 | 326 | 0.44 | yes | 4 | 0.12 | 99 | GECPKYVKSN | 94.51 | GECPKYVKSD | 1.99 | GECPKYVKSS | 1.87 | GECPKYVKST | 0.63 |
| HA | H5N1 | 336 | 0.92 | no | 4 | 0.06 | 99.28 | RLVATGLRN | 77.12 | KLVATGLRN | 21 | | | KLILATGLRN | 0.36 |
| HA | H5N1 | 349 | 0 | yes | 1 | 99.61 | 100 | REREGGRRRK | 100 | | | | | | |
| HA | H5N1 | 350 | 0 | no | 1 | 99.61 | 100 | EREGGRRRKR | 100 | | | | | | |
| HA | H5N1 | 356 | 0.89 | yes | 3 | 2.74 | 99.13 | RKKRGLFGAI | 77.97 | RRKRGLFGAI | 20.2 | | | | |
| HA | H5N1 | 357 | 0 | no | 1 | 99.94 | 100 | KKRGLFGAIA | 100 | | | | | | |
| HA | H5N1 | 358 | 0.89 | yes | 3 | 3.28 | 99.28 | KKRGLFGAIA | 78.41 | KRGLFGAIA | 19.5 | RKRGLFGAIA | 1.37 | | |
| HA | H5N1 | 359 | 0.27 | yes | 2 | 19.07 | 99.34 | KRGLFGAIAG | 96.61 | TRGLFGAIAG | 2.38 | RRGLFGAIAG | 0.41 | | |
| HA | H5N1 | 360 | 0.08 | yes | 1 | 0.06 | 99.37 | RGLFGAIAGF | 99.37 | | | | | | |
| HA | H5N1 | 361 | 0.08 | yes | 1 | 0.06 | 99.4 | GLFGAIAGFI | 99.4 | | | | | | |
| HA | H5N1 | 362 | 0.08 | yes | 1 | 0.06 | 99.37 | LFGAIAGFIE | 99.37 | | | | | | |
| HA | H5N1 | 363 | 0.08 | yes | 1 | 0.06 | 99.37 | FGAIAGFIEG | 99.37 | | | | | | |
| HA | H5N1 | 364 | 0.09 | yes | 1 | 0.06 | 99.37 | GAIAGFIEGG | 99.37 | | | | | | |
| HA | H5N1 | 365 | 0.09 | yes | 1 | 0.06 | 99.37 | AIAGFIEGGW | 99.37 | | | | | | |
| HA | H5N1 | 366 | 0.08 | yes | 1 | 0.09 | 99.28 | IAGFIEGGWQ | 99.28 | | | | | | |
| HA | H5N1 | 367 | 0.08 | yes | 1 | 0.09 | 99.37 | AGFIEGGWQG | 99.37 | | | | | | |
| HA | H5N1 | 368 | 0.12 | yes | 1 | 0.09 | 99.4 | GFIEGGWQGM | 99.4 | | | | | | |
| HA | H5N1 | 369 | 0.14 | yes | 2 | 0.09 | 99.46 | HEGGWQGMI | 98.82 | FIEGGWQGMI | 0.63 | | | | |
| HA | H5N1 | 370 | 0.14 | yes | 2 | 0.09 | 99.31 | IEGGWQGMID | 98.67 | IEGGWQGMID | 0.63 | | | | |
| HA | H5N1 | 371 | 0.14 | yes | 2 | 0.06 | 99.34 | EGGWQGMVD | 98.7 | EGGWQGMIDG | 0.63 | | | | |
| HA | H5N1 | 372 | 0.12 | yes | 2 | 0.06 | 99.34 | GGWQGMVDG | 98.7 | GGWQGMIDGW | 0.63 | | | | |
| HA | H5N1 | 373 | 0.14 | yes | 2 | 0.06 | 99.34 | GWQGMVDGW | 98.82 | GWQGMIDGWY | 0.63 | | | | |
| HA | H5N1 | 374 | 0.27 | yes | 3 | 0.06 | 99.46 | WQGMVDGWY | 98.43 | WQGMIDGWYG | 0.63 | QGMIDGWYGY | 0.63 | | |
| HA | H5N1 | 375 | 0.3 | yes | 3 | 0.06 | 99.22 | QGMVDGWYGY | 96.71 | QGMIDGWYGY | 2.08 | GMIDGWYGYH | 0.63 | | |
| HA | H5N1 | 376 | 0.3 | yes | 3 | 0.03 | 99.16 | GMVDGWYGYH | 96.47 | GMIDGWYGYH | 2.11 | MIDGWYGYHH | 0.63 | | |
| HA | H5N1 | 377 | 0.34 | yes | 4 | 0 | 99.07 | MVDGWYGYHH | 96.41 | MIDGWYGYHH | 2.11 | IDGWYGYHHS | 0.63 | | |
| HA | H5N1 | 378 | 0.31 | yes | 4 | 0 | 99.07 | VDGWYGYHHS | 96.08 | DGWYGYHHSN | 2.11 | DGWYGYHHSN | 0.75 | VDGWYGYHHN | 0.24 |
| HA | H5N1 | 379 | 0.37 | yes | 5 | 0.03 | 99.07 | DGWYGYHHSN | 96.5 | GWYGYHHSNE | 0.75 | | | DGWYGYHHSK | 0.21 |
| HA | H5N1 | 380 | 0.22 | yes | 4 | 0.03 | 99.07 | GWYGFHHSNE | 95.75 | HSNEQGSGYA | 0.75 | | | GWYGYHHNE | 0.24 |
| HA | H5N1 | 386 | 0.19 | yes | 3 | 0.06 | 99.07 | HSNEQGSGYA | 97.89 | HNNEQGSGYA | 0.75 | | | HSKEQGSGYA | 0.18 |
| HA | H5N1 | 387 | 0.29 | yes | 3 | 0.06 | 99.13 | SNEQGSGYAA | 97.95 | NNEQGSGYAA | 0.75 | | | SNEQGSGYAA | 0.18 |
| HA | H5N1 | 388 | 0.19 | yes | 3 | 0.06 | 99.13 | NEQGSGYAAD | 98.19 | NEQGSGYAAD | 0.75 | | | | |
| HA | H5N1 | 389 | 0.27 | yes | 3 | 0.06 | 99.07 | EQGSGYAADK | 97.32 | GQGSGYAAD | 0.63 | EQGSGYAADR | 0.36 | EQGSGYAADR | 0.36 |
| HA | H5N1 | 390 | 0.21 | yes | 3 | 0.03 | 99.1 | QGSGYAADKE | 98.07 | QGSGYAADQE | 0.66 | | | | |
| HA | H5N1 | 391 | 0.2 | yes | 4 | 0.06 | 99.1 | GSGYAADKES | 98.07 | GSGYAADRES | 0.66 | | | | |
| HA | H5N1 | 392 | 0.22 | yes | 3 | 0.03 | 99.07 | SGYAADKEST | 97.89 | SGYAADREST | 0.66 | SGYAADKESS | 0.18 | | |
| HA | H5N1 | 393 | 0.3 | yes | 3 | 0.03 | 99.07 | GYAADKESTQ | 98.04 | GYAADRESTQ | 0.66 | | | | |
| HA | H5N1 | 394 | 0.3 | yes | 4 | 0.03 | 99.07 | YAADKESTQK | 96.87 | YAADQESTQK | 1.18 | YAADRESTQK | 0.36 | | |
| HA | H5N1 | 395 | 0.29 | yes | 4 | 0.03 | 99.13 | AADKESTQKA | 96.93 | AADQESTQKA | 1.18 | AADRESTQKA | 0.36 | | |

FIG. 74-194

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 399 | 0.48 | yes | 5 | 0.06 | 99.01 | ESTQKAIDGV | 3.23 | ESTQRAIDGV | 1.15 | ESTQKAINGV | 0.51 | ESTQKAMDGV | 0.21 |
| HA | H5N1 | 400 | 0.46 | yes | 4 | 0.06 | 99.01 | STQKAIDGIT | 3.23 | STQRAIDGVT | 1.18 | STQKAINGVT | 0.54 | | |
| HA | H5N1 | 401 | 0.45 | yes | 4 | 0.06 | 99.07 | TQKAIDGITN | 3.29 | TQRAIDGVTN | 1.18 | TQKAINGVTN | 0.54 | | |
| HA | H5N1 | 402 | 0.45 | yes | 4 | 0.03 | 99.07 | QKAIDGITNK | 3.17 | QRAIDGVTNK | 1.18 | QKAINGVTNK | 0.54 | | |
| HA | H5N1 | 403 | 0.38 | yes | 5 | 0.03 | 99.19 | AIDGITNKVN | 2.89 | AINGVTNKVN | 0.54 | AIDGITNKIN | 0.24 | AMDGVTNKVN | 0.21 |
| HA | H5N1 | 404 | 0.39 | yes | 3 | 0.03 | 99.13 | IDGITNKVNS | 2.83 | INGVTNKVNS | 0.54 | IDGITNKINS | 0.24 | MDGVTNKVNS | 0.21 |
| HA | H5N1 | 405 | 0.34 | yes | 2 | 0.03 | 99.13 | DGYTNKVNSI | 2.83 | NGVTNKVNSI | 0.57 | | | | |
| HA | H5N1 | 406 | 0.29 | yes | 5 | 0.03 | 99.1 | GVTNKVNSII | 2.8 | | | | | | |
| HA | H5N1 | 407 | 0.59 | yes | 2 | 0.03 | 99.1 | VTNKVNSIID | 4.1 | ITNKVNSIID | 2.62 | VTNKVNSIIG | 0.33 | ITNKINSIID | 0.24 |
| HA | H5N1 | 408 | 0.4 | yes | 5 | 0.06 | 99.01 | TNKVNSIIDK | 4.25 | TNKINSIIDK | 0.33 | | | | |
| HA | H5N1 | 409 | 0.4 | yes | 3 | 0.03 | 99.01 | NKVNSIIDKM | 4.25 | NKINSIIDKM | 0.33 | | | | |
| HA | H5N1 | 410 | 0.4 | yes | 3 | 0.06 | 99.01 | KVNSIIDKMN | 4.28 | KINSIIDKMN | 0.33 | | | | |
| HA | H5N1 | 411 | 0.4 | yes | 4 | 0.06 | 99.01 | VNSIIDKMNT | 4.25 | INSIIDKMNT | 0.33 | VNSIIGKMNT | 0.33 | | |
| HA | H5N1 | 412 | 0.4 | yes | 3 | 0.09 | 99.31 | NSIIDKMNTQ | 4.25 | NSIIGKMNTQ | 0.33 | | | | |
| HA | H5N1 | 413 | 0.39 | yes | 3 | 0.07 | 99.07 | SIIDKMNTQF | 4.25 | SIIGKMNTQF | 0.33 | | | | |
| HA | H5N1 | 414 | 0.41 | yes | 4 | 0.15 | 99.12 | IIDKMNTQFE | 4.36 | IIGKMNTQFE | 0.33 | IDKMNTQFE | 0.18 | IDKMNTRFEA | 0.18 |
| HA | H5N1 | 415 | 0.44 | yes | 5 | 0.09 | 99.1 | IDKMNTQFEA | 4.15 | IGKMNTQFEA | 0.33 | IDKMNTQFET | 0.18 | | |
| HA | H5N1 | 416 | 0.19 | yes | 4 | 0.09 | 99.16 | KMNTQFEAVG | 98.22 | KMNIQFEAVG | 0.18 | KMNTQFETVG | 0.18 | MNIQFEAVGR | 0.18 |
| HA | H5N1 | 417 | 0.32 | yes | 4 | 0.09 | 99.01 | MNTQFEAVGR | 96.44 | MNTQFEAIGR | 0.57 | MNTQFETVGK | 0.18 | | |
| HA | H5N1 | 418 | 0.32 | yes | 5 | 0.06 | 99.04 | NTQFEAVGRE | 96.47 | NTQFEAIGRE | 0.57 | NTQFEAVGKE | 0.57 | | |
| HA | H5N1 | 419 | 0.39 | yes | 4 | 0.06 | 99.04 | TQFEAVGREF | 95.45 | TQFEAIGREF | 0.57 | IQFEAVGREF | 0.57 | | |
| HA | H5N1 | 420 | 0.27 | yes | 4 | 0.03 | 99.19 | QFEAVGREFN | 97.02 | QFEAIGREFN | 1.18 | QFEAIGREFS | 0.3 | | |
| HA | H5N1 | 421 | 0.29 | yes | 5 | 0.06 | 99.07 | LERRIENLNK | 96.89 | LERRIENLNR | 0.42 | LERRIENLNR | 0.3 | | |
| HA | H5N1 | 422 | 0.31 | yes | 4 | 0.06 | 99.01 | ERRIENLNKK | 96.75 | ERRIENLNRK | 0.42 | ERRIENLNRK | 0.3 | | |
| HA | H5N1 | 423 | 0.19 | yes | 3 | 0.06 | 99.13 | RRIENLNKKM | 98.28 | RRIENLNRKM | 0.42 | RRIENLNRKM | 0.3 | RRVENLNKKM | 0.15 |
| HA | H5N1 | 424 | 0.18 | yes | 3 | 0.03 | 99.16 | RIENLNKKME | 98.25 | RIESLNKKME | 0.42 | | | | |
| HA | H5N1 | 425 | 0.17 | yes | 2 | 0.06 | 99.13 | IENLNKKMED | 98.37 | IESLNKKMED | 0.3 | VENLNKKMED | 0.15 | | |
| HA | H5N1 | 426 | 0.18 | yes | 2 | 0.06 | 99.07 | ENLNKKMEDG | 98.43 | ESLNKKMEDG | 0.3 | | | | |
| HA | H5N1 | 427 | 0.14 | yes | 3 | 0.06 | 99.1 | NLNKKMEDGF | 98.82 | SLNKKMEDGF | 0.3 | | | | |
| HA | H5N1 | 428 | 0.15 | yes | 3 | 0.06 | 99.16 | LNKKMEDGFL | 98.67 | | | | | | |
| HA | H5N1 | 429 | 0.16 | yes | 3 | 0.06 | 99.31 | NKKMEDGFLD | 98.58 | NKKMEDGFLN | 0.18 | | | | |
| HA | H5N1 | 430 | 0.11 | yes | 1 | 0.03 | 99.28 | KKMEDGFLDV | 99.1 | KKMEDGFLDI | 0.18 | | | | |
| HA | H5N1 | 431 | 0.1 | yes | 1 | 0 | 99.16 | KMEDGFLDVW | 99.16 | | | | | | |
| HA | H5N1 | 432 | 0.08 | yes | 1 | 0 | 99.31 | MEDGFLDVWT | 99.31 | | | | | | |
| HA | H5N1 | 433 | 0.09 | yes | 1 | 0 | 99.28 | EDGFLDVWTY | 99.28 | | | | | | |
| HA | H5N1 | 434 | 0.11 | yes | 1 | 0.06 | 99.16 | DGFLDVWTYN | 99.16 | | | | | | |
| HA | H5N1 | 435 | 0.1 | yes | 1 | 0.06 | 99.04 | GFLDVWTYNA | 99.04 | | | | | | |
| HA | H5N1 | 436 | 0.09 | yes | 1 | 0.03 | 99.07 | FLDVWTYNAE | 99.07 | | | | | | |
| HA | H5N1 | 437 | 0.11 | yes | 1 | 0.03 | 99.19 | LDVWTYNAEL | 99.19 | | | | | | |
| HA | H5N1 | 438 | 0.1 | yes | 1 | 0 | 99.19 | DVWTYNAELL | 99.19 | | | | | | |
| HA | H5N1 | 439 | 0.09 | yes | 1 | 0 | 99.25 | VWTYNAELLY | 99.25 | | | | | | |
| HA | H5N1 | 440 | 0.09 | yes | 1 | 0 | 99.25 | WTYNAELLVL | 99.25 | | | | | | |

FIG. 74-195

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 453 | 0.09 | yes | 1 | 0 | 99.22 | TYNAELLVLM | 99.22 | | | | | | |
| HA | H5N1 | 454 | 0.1 | yes | 1 | 0 | 99

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | H5N1 | 9 | 0.35 | no | 2 | 98.57

FIG. 74-198

| Protein | Sub-type | Start Pos | Block Entropy | Gaps < 10% | # to % cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 156 | 0.19 | yes | 2 | 0 | 99.22 | GALLNDKHSN | 98.11 | | | | | | |
| NA | H5N1 | 157 | 0.24 | yes | 3 | 0 | 99

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 374 | 0.23 | yes | 4 | 0.05 | 99.17 | K

FIG. 74-201

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|

FIG. 74-202

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N2 | 342 | 0 | no | 1 | 98.61 | 100 | RKRKTRGLFG | 100 | | | | | | |
| HA | H5N2 | 343 | 0 | no | 1 | 98.61 | 100 | RK

FIG. 74-203

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H5N2 | 450 | 0.2 | yes | 3 | 0 | 99.07 | LVLMENERTL | 0.69 | LVLMENERTL | 0.46 | | | | |
| HA | H5N2 | 451

FIG. 74-204

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N2 | 562 | 0.16 | yes | 3 | 3.24 | 99.28 | CSNGSLQCRI | 98.33 | CSNGSL

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 251 | 0.53 | yes | 4 | 0.26 | 99.09 | LRPGETLNVE | 92.49 | LRPGETLNVE | 4.4 | | | LKPGETLNIE | 1.04 |

FIG. 74-209

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 364 | 0.43 | yes | 2 | 0 | 99.87 | IDGW

FIG. 74-210

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 475 | 0.79 | yes | 2 | 0 | 99.22 | NANDLGNGCF

FIG. 74-211

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 32 | 0.09 | yes | 1 | 0.1 | 99.17 | DKICLG

FIG. 74-212

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 381 | 0 | no | 1 | 99.9 | 100 | PRPRRGLFGA | 100 | | | | | | |
| HA | H7 | 382 | 0 | no | 1 | 99.9 | 100 | RPRGLFG

FIG. 74-213

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 430 | 0.45 | yes | 3 | 0.1 | 99.17 | YKSTQSAIDQ | 4.76 | YKSTQSAIDQ | 4.76 | YKSTQSAVDQ | 1.03 | | |
| HA | H7 | 431 | 0.

FIG. 74-214

| Protein | Sub-type | Start Pos | Block Entropy | Gaps <10% | # to cover 99% | Gap % | Coverage | Peptides induced | Freq | Peptides induced | Freq | Peptides induced | Freq | Peptides induced | Freq |
|---|---|---|---|---|---|---|---|---|---|---|---|---|---|---|---|
| HA | H7 | 528 | 0.22 | yes | 2 | 0 | 99.28 | GCFEIFHQCD | 97.11 | GCFEIFHQCD | 2.17 | CFEIFHKCDN | 2.17 | | | | |
| HA | H7 | 529 | 0.33 | yes | 3 | 0 | 99.38 | CFEIFHKCDD | 95.56 | CFEIFHQCDN | 2.17 | CMASIRNSTY | 2.17 | | | | |
| HA | H7 | 540 | 1.05 | yes | 3 | 0 | 99.38 | CMESIRNNTY | 64.15 | CMASIRNNTY | 34.6 | MESIRNSTY | | MASIRNNTYN | 0.62 | MASIRNSTYD | 0.62 |
| HA | H7 | 541 | 1.17 | yes | 5 | 0 | 99.28 | MESIRNNTYD | 63.22 | MASIRNNTYD | 34 | MESIRNSTYD | | ASIRNNTYNH | 0.62 | ASIRNSTYDH | 0.62 |
| HA | H7 | 542 | 1.17 | yes | 5 | 0 | 99.28 | ESIRNNTYDH | 63.22 | ASIRNNTYDH | 34 | ESIRNSTYDH | | NGYKDVILWF | 0.31 | GGYKDIILWF | 1.34 |
| HA | H7 | 572 | 1.21 | yes | 3 | 0 | 99.28 | SGYKDIILWF | 64.67 | SGYKEVILWFS | 31.2 | SGYKDVILWF | 1.76 | | | | |
| HA | H7 | 573 | 1.09 | yes | 3 | 0 | 99.38 | GYKDIILWFS | 65.91 | GYKEVILWFS | 31.7 | GYKDVILWFS | 1.76 | | | | |
| HA | H7 | 574 | 1.09 | yes | 3 | 0 | 99.28 | YKDIILWFSF | 66.01 | YKEVILWFSF | 31.5 | YKDVILWFSF | 1.76 | | | | |
| HA | H7 | 575 | 1.09 | yes | 3 | 0 | 99.28 | KDIILWFSFG | 66.01 | KEVILWFSFG | 31.5 | KDVILWFSFG | 1.76 | | | | |
| HA | H7 | 576 | 1.08 | yes | 3 | 0 | 99.28 | DIILWFSFGA | 66.01 | DVILWFSFGA | 31.6 | DIILWFSFGA | | | | | |
| HA | H7 | 577 | 0.96 | yes | 3 | 0 | 99.38 | IILWFSFGAS | 66.22 | EVILWFSFGA | 33.4 | IILWFSFGA | | | | | |
| HA | H7 | 578 | 0.04 | yes | 2 | 0 | 99.59 | ILWFSFGASC | 99.59 | VILWFSFGAS | | | | | | | |
| HA | H7 | 579 | 0.08 | yes | 1 | 0 | 99.17 | LWFSFGASCF | 99.17 | WFSFGASCFI | | | | | | | |
| HA | H7 | 580 | 1.03 | yes | 3 | 0.1 | 99.07 | WFSFGASCFL | 66.7 | WFSFGASCFI | 32 | WFSFGASCLI | 0.41 | FSFGASCFTL | 0.31 | FSFGASCLII | 0.41 |
| HA | H7 | 581 | 1.2 | yes | 5 | 0.1 | 99.28 | FSFGASCFIL | 64.12 | FSFGASCFIL | 31.9 | FSFGASCFLF | 2.59 | | | FSFGASCLII | |
| HA | H7 | 603 | 1.22 | yes | 3 | 3.72 | 99.03 | KNGNMRCTIC | 60.3 | KNGNMQCTIC | 35.5 | RNGNMRCTIC | 3.22 | | | | |
| HA | H7 | 604 | 1.04 | yes | 2 | 4.03 | 99.03 | NGNMRCTICI | 63.72 | NGNMQCTICI | 35.3 | | | | | | |
| HA | H7 | 605 | 0 | no | 1 | 99.9 | 100 | ETCSALFYYS | 100 | | | | | | | | |
| HA | H7 | 606 | 0 | no | 1 | 99.9 | 100 | TCSALFYYSL | 100 | | | | | | | | |
| HA | H7 | 609 | 0 | no | 1 | 99.9 | 100 | CSALFYYSLR | 100 | | | | | | | | |
| HA | H7 | 610 | 0 | no | 1 | 99.54 | 100 | SALFYYSLRK | 100 | | | | | | | | |
| H7N2 | | 1 | 0 | no | 1 | 99.54 | 100 | SKSRGYKMNT | 100 | | | | | | | | |
| H7N2 | | 2 | 0 | no | 1 | 99.54 | 100 | KSRGYKMNTQ | 100 | | | | | | | | |
| H7N2 | | 3 | 0 | no | 1 | 99.54 | 100 | SRGYKMNTQI | 100 | | | | | | | | |
| H7N2 | | 4 | 0 | no | 1 | 99.54 | 100 | RGYKMNTQIL | 100 | | | | | | | | |
| H7N2 | | 5 | 0 | no | 1 | 99.54 | 100 | GYKMNTQILI | 100 | | | | | | | | |
| H7N2 | | 6 | 0 | no | 1 | 99.54 | 100 | YKMNTQILIL | 100 | | | | | | | | |
| H7N2 | | 7 | 0 | no | 1 | 0.7 | 100 | KMNTQILILA | 100 | | | | | | | | |
| H7N2 | | 23 | 0.94 | yes | 5 | 0.23 | 99.07 | AKGDKICLGH | 84.81 | VIKGDKICLGH | 7.01 | TNADKICLGH | 3.5 | ARGDKICLGH | 1.64 | TKGDKICLGH | 2.1 |
| H7N2 | | 24 | 0.41 | yes | 3 | 0.23 | 99.3 | KGDKICLGHH | 94.19 | NADKICLGHH | 3.49 | RGDKICLGHH | 1.63 | | | | |
| H7N2 | | 25 | 0.28 | yes | 2 | 0.23 | 99.53 | GDKICLGHHA | 95.81 | ADKICLGHHA | 3.72 | | | | | | |
| H7N2 | | 26 | 0.05 | yes | 1 | 0.23 | 99.53 | DKICLGHHAV | 95.81 | | | | | | | | |
| H7N2 | | 27 | 0.28 | yes | 2 | 0.23 | 99.53 | KICLGHHAVA | 95.81 | KICLGHHAYS | 3.72 | | | | | | |
| H7N2 | | 28 | 0.28 | yes | 2 | 0.23 | 99.53 | ICLGHHAVAN | 95.81 | ICLGHHAYSN | 3.72 | | | | | | |
| H7N2 | | 29 | 0.28 | yes | 2 | 0.23 | 99.53 | CLGHHAVANG | 95.81 | CLGHHAYSNG | 3.72 | | | | | | |
| H7N2 | | 30 | 0.23 | yes | 2 | 0 | 99.07 | LGHHAVANGT | 96.29 | LGHHAYSNGT | 3.72 | | | | | | |
| H7N2 | | 31 | 0.26 | yes | 2 | 0 | 99.54 | GHHAVANGTK | 96.29 | GHHAYSNGTK | 3.71 | | | | | | |
| H7N2 | | 32 | 0.3 | yes | 3 | 0 | 99.3 | HHAVANGTKV | 95.82 | HHAYSNGTKV | 2.78 | HAVSNGTKIN | 0.93 | | | | |
| H7N2 | | 33 | 0.32 | yes | 3 | 0 | 99.3 | HAVANGTKVN | 95.59 | HAYSNGTKVN | 2.78 | AVSNGTKINT | 0.93 | | | | |
| H7N2 | | 34 | 0.32 | yes | 3 | 0 | 99.3 | AVANGTKVNT | 95.59 | AVSNGTKVNT | 2.78 | VSNGTKINTL | 0.93 | | | | |
| H7N2 | | 35 | 0.32 | yes | 3 | 0 | 99.3 | VANGTKVNTL | 95.59 | VSNGTKVNTL | 2.78 | SNGTKINTLT | 0.93 | | | | |
| H7N2 | | 36 | 0.32 | yes | 3 | 0 | 99.3 | ANGTKVNTLT | 95.59 | SNGTKVNTLT | 2.78 | | | | | | |

FIG. 74-215

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 37 | 0.14 | yes | 2 | 0 | 99.3 | NGTK

FIG. 74-216

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 165 | 0.55 | yes | 4 | 0 | 99.07 | MKW

FIG. 74-217

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| HA | H7N2 | 327 | 0.98 | yes | 4 | 0 | 99.3 | QKSLLLATGM | 77.73 | QTSLLLATGM |

FIG. 74-218

| Protein | Sub-type | Start Pos | Entropy Block | Gaps >10% | # to cover 99% | Gap % | Coverage | Peptides induced | Freq | Peptides induced | Freq | Peptides induced | Freq | Peptides induced | Freq |
|---|---|---|---|---|---|---|---|---|---|---|---|---|---|---|---|
| HA | H7N2 | 376 |

FIG. 74-219

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H7N2 | 423 | 0.54 | yes | 2 | 0 | 99.77 | IGNVINWTRD | 88.17 | IGNVINWTQD | 11.6 | | | | | | |
| HA | H7N2 | 424 | 0.95 | yes | 3 | 0 | 99.77 | GNVINWTRDA | 79.58 | GNVINWTQDA | 11.6 | GNVINWTRDS | 8.58 | | | | |
| HA | H7N2 | 425 | 1.02 | yes | 4 | 0 | 99.77 | NVINWTRDAM | 79.58 | NVINWTQDAM | 11.6 | NVINWTRDSM | 6.5 | NVINWTRDSI | 2.09 | | |
| HA | H7N2 | 426 | 1.02 | yes | 4 | 0 | 99.77 | VINWTRDAMT | 79.58 | VINWTQDAMT | 11.6 | VINWTRDSMT | 6.5 | VINWTRDSIT | 2.09 | | |
| HA | H7N2 | 427 | 1.02 | yes | 4 | 0 | 99.77 | INWTRDAMTE | 79.58 | INWTQDAMTE | 11.6 | INWTRDSMTE | 6.5 | INWTRDSITE | 2.09 | | |
| HA | H7N2 | 428 | 1.32 | yes | 5 | 0 | 99.54 | NWTRDAMTEV | 74.01 | NWTQDAMTEV | 11.4 | NWTRDSMTEV | 6.26 | NWTRDSITEV | 2.09 | | |
| HA | H7N2 | 429 | 1.32 | yes | 5 | 0 | 99.54 | WTRDAMTEVW | 74.01 | WTQDAMTEVW | 11.4 | WTRDSMTEVW | 6.26 | WTRDSITEVW | 2.09 | | |
| HA | H7N2 | 430 | 1.35 | yes | 4 | 0 | 99.3 | TRDAMTEVWS | 73.78 | TQDAMTEVWS | 11.4 | TRDSMTEVWS | 6.26 | TRDSITEVWS | 2.09 | | |
| HA | H7N2 | 431 | 1.35 | yes | 4 | 0 | 99.3 | RDAMTEVWSY | 73.78 | QDAMTEVWSY | 11.4 | RDSMTEVWSY | 6.26 | RDSITEVWSY | 2.09 | | |
| HA | H7N2 | 432 | 1.17 | yes | 4 | 0 | 99.3 | DAMTEVWSYN | 74.01 | DAMTEVWSYN | 11.4 | DSMTEVWSYN | 6.26 | DSITEVWSY | 2.09 | | |
| HA | H7N2 | 433 | 1.19 | yes | 3 | 0 | 99.54 | AMTEVWSYNA | 73.78 | AMTEIWSYN | 17.2 | SMTEVWSYNA | 6.26 | SITEVWSYNA | 2.09 | | |
| HA | H7N2 | 434 | 0.97 | yes | 2 | 0 | 99.54 | MTEVWSYNAE | 74.01 | MTEIWSYNA | 17.2 | ITEVWSYNA | 2.09 | | | | |
| HA | H7N2 | 435 | 0.86 | yes | 2 | 0 | 99.54 | TEVWSYNAEL | 74.01 | TEIWSYNAEL | 23.4 | | | | | | |
| HA | H7N2 | 436 | 0.86 | yes | 2 | 0 | 99.54 | EVWSYNAELL | 74.01 | EIWSYNAELL | 25.5 | | | | | | |
| HA | H7N2 | 437 | 0.86 | yes | 2 | 0 | 99.3 | VWSYNAELLV | 74.01 | IWSYNAELLV | 25.5 | | | | | | |
| HA | H7N2 | 438 | 0.07 | yes | 1 | 0 | 99.3 | WSYNAELLVA | 99.3 | | | | | | | | |
| HA | H7N2 | 439 | 0.2 | yes | 3 | 0 | 99.07 | SYNAELLVAM | 97.68 | SYNAELLVAI | 1.16 | SYNAELLVAI | 0.46 | | | | |
| HA | H7N2 | 440 | 0.18 | yes | 2 | 0 | 99.07 | YNAELLVAME | 97.91 | YNAELLVALE | 1.16 | | | | | | |
| HA | H7N2 | 441 | 0.18 | yes | 2 | 0 | 99.07 | NAELLVAMEN | 97.91 | NAELLVALEN | 1.16 | | | | | | |
| HA | H7N2 | 442 | 0.18 | yes | 2 | 0 | 99.07 | AELLVAMENQ | 97.91 | AELLVALENQ | 1.16 | | | | | | |
| HA | H7N2 | 443 | 0.2 | yes | 2 | 0 | 99.3 | ELLVAMENQH | 97.91 | ELLVALENQH | 1.16 | | | | | | |
| HA | H7N2 | 444 | 0.18 | yes | 3 | 0 | 99.3 | LLVAMENQHT | 97.68 | LLVALENQHT | 1.16 | LLVAIENQHT | 0.46 | | | | |
| HA | H7N2 | 445 | 0.18 | yes | 3 | 0 | 99.3 | LVAMENQHTI | 97.68 | LVALENQHTI | 1.16 | LVAIENQHTI | 0.46 | | | | |
| HA | H7N2 | 446 | 0.18 | yes | 3 | 0 | 99.3 | VAMENQHTID | 97.68 | VALENQHTID | 1.16 | VAIENQHTID | 0.46 | | | | |
| HA | H7N2 | 447 | 0.2 | yes | 3 | 0 | 99.07 | AMENQHTIDL | 97.68 | ALENQHTIDL | 1.16 | AIENQHTIDL | 0.46 | | | | |
| HA | H7N2 | 448 | 0.84 | yes | 3 | 0 | 99.07 | MENQHTIDLT | 97.68 | MENQHTIDLA | 17.4 | LENQHTIDLA | 1.16 | | | | |
| HA | H7N2 | 449 | 0.74 | yes | 2 | 0 | 99.3 | ENQHTIDLTD | 80.51 | ENQHTIDLT | 17.4 | | | | | | |
| HA | H7N2 | 450 | 0.76 | yes | 2 | 0 | 99.3 | NQHTIDLTDS | 81.9 | NOHTIDLTDS | 17.4 | | | | | | |
| HA | H7N2 | 451 | 0.78 | yes | 2 | 0 | 99.3 | QHTIDLTDSE | 81.9 | QHTIDLTDSE | 17.4 | | | | | | |
| HA | H7N2 | 452 | 1.5 | yes | 3 | 0 | 99.07 | HTIDLADSEM | 81.67 | HTIDLTDSEM | 20.7 | HTIDLADSEI | 0.23 | | | | |
| HA | H7N2 | 453 | 1.5 | yes | 5 | 0 | 99.07 | IDLADSEMSK | 81.44 | IDLTDSEMNK | 20.7 | IDLADSEI | 16.94 | IDLTDSEMNK | 0.46 | IDLTDSEMNK | 0.46 |
| HA | H7N2 | 454 | 1.5 | yes | 5 | 0 | 99.07 | DLADSEMSKL | 60.56 | DLTDSEMNKL | 20.7 | DLTDSEMSKL | 16.94 | DLADSEMKKL | 0.46 | DLADSEMKKL | 0.46 |
| HA | H7N2 | 455 | 0.9 | yes | 3 | 0 | 99.07 | LADSEMSKLY | 60.56 | LTDSEMNKLY | 21.1 | LTDSEMSKLY | 16.94 | LADSEMKKLY | 0.46 | LTDSEMNKLY | 0.46 |
| HA | H7N2 | 456 | 0.88 | yes | 5 | 0 | 99.07 | ADSEMSKLY | 60.56 | DSEMNKLYER | 21.1 | DSEMSKLY | 0.46 | DSEMDKLYER | 0.23 | | |
| HA | H7N2 | 457 | 1.69 | yes | 4 | 0 | 99.07 | DSEMSKLYER | 77.26 | SEMNKLYER | 25.3 | SEMKKLYER | 0.46 | | | | |
| HA | H7N2 | 458 | 1.69 | yes | 5 | 0 | 99.07 | SEMSKLYERV | 77.49 | EMNKLYERV | 25.3 | EMNKLYERVK | 18.79 | EMNKLYERVK | 2.32 | EMKKLYERVR | 0.46 |
| HA | H7N2 | 459 | 1.28 | yes | 4 | 0 | 99.54 | EMSKLYERVK | 52.2 | KLYERVRQL | 42 | KLYERVRQL | 3.02 | KLYERVRQL | 1.16 | | |
| HA | H7N2 | 460 | 1.28 | yes | 4 | 0 | 99.54 | KLYERVKKQL | 53.36 | LYERVRQLR | 42 | LYERVRQLR | 3.02 | LYERVRQLR | 1.16 | | |
| HA | H7N2 | 463 | 1.28 | yes | 4 | 0 | 99.54 | LYERVKKQLR | 53.36 | YERVRRQLRE | 42 | YERVRRQLRE | 3.02 | YERVRRQLRE | 1.16 | | |
| HA | H7N2 | 464 | 1.28 | yes | 4 | 0 | 99.54 | YERVKKQLRE | 53.36 | ERVRKQLREN | 42 | ERVRRQLREN | 3.02 | ERVKRQLREN | 1.16 | | |
| HA | H7N2 | 465 | 1.28 | yes | 4 | 0 | 99.54 | ERVKKQLREN | 53.36 | RVKKQLRENA | 42 | RVRRQLRENA | 3.02 | RVKRQLRENA | 1.16 | | |
| HA | H7N2 | 466 | 1.26 | yes | 4 | 0 | 99.77 | RVKKQLRENA | 53.6 | VKKQLRENAE | 42 | VRRQLRENAE | 3.02 | VKRQLRENAE | 1.16 | | |
| HA | H7N2 | 467 | 1.26 | yes | 4 | 0 | 99.77 | VKKQLRENAE | 53.6 | | | | | | | | |
| HA | H7N2 | 468 | 1.26 | yes | 4 | 0 | 99.77 | KKQLRENAE | 53.6 | | | | | | | | |

FIG. 74-220

| Protein | Sub-type | Start Pos | Block Entropy | Gaps <10% | # to cover 99% | % Gap | Coverage | Pe

FIG. 74-221

| Protein | Sub-type | Start Pos | Block Entropy | Gaps <10% | # of to %99 cover | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 517 | 0.5 | yes | 4 | 0 | 99.07 | IQIDPVKLSS | 93.04 | IQIDSVKLSS | 3

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 181 | 0.05 | yes | 1 | 0 | 99.51 | SSC

FIG. 74-225

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| NA | H7N2 | 234 | 0.68 | yes | 4 | 0 | 99.02 | NGCTVWMTD | 88.7 | NGCTVW

FIG. 74-226

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 291 | 0.05 | yes | 1 | 0 | 99.51 | CRDNWKGSNR | 99.51 | | | | | | |
| NA | H7N2 | 292 | 0.05 | yes | 1 | 0 | 99.51 | RDNWKGSNRP | 99.51 | | | | | | |
| NA | H7N2 | 293 | 0.17 | yes | 2 | 0 | 99.26 | DNWKGSNRPV | 98.03 | DNWKGSNRPI | 1.23 | | | | |
| NA | H7N2 | 294 | 0.23 | yes | 3 | 0 | 99.26 | NWKGSNRPVI | 97.3 | NWKGSNRPII | 1.23 | NWKGSNRPV | 0.74 | | |
| NA | H7N2 | 295 | 0.23 | yes | 3 | 0 | 99.26 | WKGSNRPVID | 97.3 | WKGSNRPIID | 1.23 | WKGSNRPVI | 0.74 | | |
| NA | H7N2 | 296 | 0.42 | yes | 4 | 0 | 99.51 | KGSNRPVIDV | 94.35 | KGSNRPIIDI | 2.95 | KGSNRPVIDI | 1.23 | KGSNRPVVDI | 0.74 | |
| NA | H7N2 | 297 | 0.4 | yes | 4 | 0.49 | 99.51 | GSNRPVIDIN | 94.59 | GSNRPIIDIN | 2.95 | GSNRPVIDI | 1.23 | GSNRPVWDIN | 0.74 | |
| NA | H7N2 | 298 | 0.4 | yes | 4 | 0.49 | 99.51 | SNRPVIDINM | 94.59 | SNRPIIDINM | 2.95 | SNRPVIDINM | 1.23 | SNRPWDINM | 0.74 | |
| NA | H7N2 | 312 | 0.24 | yes | 2 | 0.25 | 99.01 | IDSSYVCSGL | 97.28 | IGSSYVCSGL | 0.74 | IDSSYLCSGL | 0.49 | | |
| NA | H7N2 | 313 | 0.24 | yes | 2 | 0.25 | 99.01 | DSSYVCSGLV | 97.28 | NSSYVCSGLV | 0.74 | GSSYLCSGLV | 0.49 | | |
| NA | H7N2 | 314 | 0.13 | yes | 2 | 0 | 99.01 | SSYVCSGLVG | 98.52 | SGYVCSGLVG | 0.49 | | | | |
| NA | H7N2 | 315 | 0.13 | yes | 2 | 0 | 99.01 | SYVCSGLVGD | 98.52 | SYLCSGLVGD | 0.49 | | | | |
| NA | H7N2 | 316 | 0.09 | yes | 1 | 0 | 99.02 | YVCSGLVGDT | 99.02 | | | | | | |
| NA | H7N2 | 317 | 0.09 | yes | 1 | 0 | 99.02 | VCSGLVGDTP | 99.02 | | | | | | |
| NA | H7N2 | 318 | 0 | yes | 1 | 0 | 100 | CSGLVGDTPR | 100 | | | | | | |
| NA | H7N2 | 319 | 0 | yes | 1 | 0 | 100 | SGLVGDTPRN | 100 | | | | | | |
| NA | H7N2 | 320 | 0.88 | yes | 2 | 0 | 100 | GLVGDTPRNE | 69.78 | GLVGDTPRND | 30.2 | VGDTPRND | 30.22 | | |
| NA | H7N2 | 321 | 0.88 | yes | 2 | 0 | 100 | LVGDTPRNED | 69.78 | LVGDTPRNDD | 30.2 | GDTPRNDDS | 29.98 | | |
| NA | H7N2 | 322 | 1.58 | yes | 3 | 0 | 100 | VGDTPRNEDG | 34.89 | VGDTPRNDDS | 34.9 | DTPRNDDSS | 29.98 | | |
| NA | H7N2 | 323 | 1.64 | yes | 5 | 0 | 99.26 | GDTPRNEDGS | 34.89 | GDTPRNDDSS | 34.4 | TPRNDDSSS | 29.24 | TPRNDDSSSN | 0.74 | TPRNEDSSSN | 0.74 |
| NA | H7N2 | 324 | 1.64 | yes | 5 | 0 | 99.26 | DTPRNEDGSS | 34.89 | DTPRNDDSSS | 34.4 | PRNDDSSSS | 29.24 | PRNDDSSSNS | 0.74 | PRNDDSSSNS | 0.74 |
| NA | H7N2 | 325 | 1.75 | yes | 5 | 0 | 99.26 | TPRNEDGSSS | 34.89 | TPRNDDSSSS | 33.7 | RNDDSSSSN | 28.99 | RNDDSSSSNS | 0.74 | RNEDSSSNSN | 0.74 |
| NA | H7N2 | 326 | 1.77 | yes | 5 | 0 | 99.02 | PRNEDGSSSS | 34.89 | PRNDDSSSSS | 33.7 | NDDSSSSSN | 28.99 | NDDSSSSNSN | 0.74 | NDDSSSNSNC | 0.74 |
| NA | H7N2 | 327 | 1.77 | yes | 5 | 0 | 99.02 | RNEDGSSSSN | 34.89 | RNDDSSSSSN | 33.7 | NDDSSSSNC | 28.99 | | | |
| NA | H7N2 | 328 | 1.15 | yes | 5 | 0 | 99.02 | NEDGSSSSNC | 34.89 | NDDSSSSSNC | 33.7 | DPNNERGNPG | 6.63 | DPNNEKGNPG | 4.91 | DPNEERGPG | 4.91 |
| NA | H7N2 | 339 | 1.15 | yes | 3 | 0 | 99.02 | DPNEERGNPG | 78.38 | DPNDERGNPG | 8.6 | PNNERGNPGV | 6.63 | PNNEKGNPGV | 4.91 | PNEERGPGV | 4.91 |
| NA | H7N2 | 340 | 1.15 | yes | 3 | 0 | 99.51 | PNEERGNPGV | 78.62 | PNDERGNPGV | 8.6 | NNERGNPGVK | 6.63 | NNEKGNPGVK | 4.91 | NEERGPGVK | 4.91 |
| NA | H7N2 | 341 | 1.15 | yes | 5 | 0 | 99.51 | NEERGNPGVK | 78.62 | NDERGNPGVK | 8.6 | NERGNPGVKG | 6.63 | NEKGNPGVKG | 4.91 | EERGPGVKG | 4.91 |
| NA | H7N2 | 342 | 0.39 | yes | 3 | 0 | 99.75 | EERGNPGVKG | 78.62 | DERGNPGVKG | 8.6 | ERGNPGVKGW | 4.91 | | | |
| NA | H7N2 | 343 | 0.39 | yes | 3 | 0 | 99.75 | ERGNPGVKGW | 93.86 | EKGNPGVKGW | 4.91 | | | | |
| NA | H7N2 | 344 | 0.1 | yes | 2 | 0 | 99.51 | RGNPGVKGWA | 93.86 | KGNPGVKGWA | 4.91 | RGSPGVKGWA | 0.98 | | |
| NA | H7N2 | 345 | 0.13 | yes | 3 | 0 | 99.02 | GNPGVKGWAF | 98.77 | GSPGVKGWAF | 0.98 | | | | |
| NA | H7N2 | 346 | 0.57 | yes | 3 | 0 | 99.26 | NPGVKGWAFD | 98.53 | SPGVKGWAFD | 0.98 | PGVKGWAFDY | 1.97 | PGVKGWAFDY | 0.49 | |
| NA | H7N2 | 347 | 0.58 | yes | 3 | 0 | 99.26 | PGVKGWAFDS | 90.17 | PGVKGWAFDN | 7.37 | GVKGWAFDYG | 1.97 | GVKGWAFDYG | 0.49 | |
| NA | H7N2 | 348 | 0.63 | yes | 5 | 0 | 99.02 | GVKGWAFDSG | 90.17 | GVKGWAFDNG | 7.13 | VKGWAFDYGS | 1.23 | VKGWAFDYGS | 0.49 | VKGWAFDNGN | 0.49 |
| NA | H7N2 | 349 | 0.63 | yes | 5 | 0 | 99.02 | VKGWAFDSGD | 90.17 | VKGWAFDNGD | 6.63 | KGWAFDYGSD | 1.23 | KGWAFDNGND | 0.49 | KGWAFDYGSD | 0.49 |
| NA | H7N2 | 350 | 0.63 | yes | 5 | 0 | 99.01 | KGWAFDSGDD | 90.17 | KGWAFDNGDD | 6.63 | YGSDVWMGRT | 0.49 | YGSDVWMGRT | 0.49 | NGNDVWMGRT | 0.49 |
| NA | H7N2 | 356 | 0.24 | yes | 2 | 0 | 99.26 | SGDDVWMGRT | 90.15 | NGDDVWMGRT | 6.65 | GSDVWMGRTI | 0.49 | | | |
| NA | H7N2 | 357 | 0.2 | yes | 3 | 0.25 | 99.01 | GDDVWMGRTI | 97.04 | GNDVWMGRTI | 1.72 | | | | |
| NA | H7N2 | 358 | 0.65 | yes | 3 | 0.25 | 99.26 | DDVWMGRTIS | 97.54 | NDVWMGRTIS | 1.72 | DVWMGRTISM | 1.48 | | |
| NA | H7N2 | 359 | 0.65 | yes | 3 | 0.25 | 99.51 | DVWMGRTISR | 87.19 | DVWMGRTISK | 10.8 | VWMGRTISMD | 1.48 | | |
| NA | H7N2 | 360 | 0.65 | yes | 3 | 0.25 | 99.51 | VWMGRTISRD | 87.19 | VWMGRTISKD | 10.8 | | | | |

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 420 | 0.56 | yes | 3 | 0 |

FIG. 74-233

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 472 | 0.07 | yes | 1 | 0 | 99.24 | AELLVAMENQ | 99.24 | | | | | | |
| HA | H7N3 | 473 | 0.07 | yes |

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 337 | 0.27 | yes | 2 | 0.51 | 100 | ICRDNWKGSN | 95.41 | VCRDNWKGSN | 4.59 | | | | |
| NA | H7N3 | 338 | 0 | yes | 1 | 0.51 |

FIG. 74-239

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 402 | 0.68 | yes | 3 | 0 | 99.49 | GNDVWL

FIG. 74-240

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 489 | 0.31 | yes | 2 | 0.51 | 99.49 | IVTF

FIG. 74-241

| Protein | Sub-type | Start Pos | Block Entropy | Gaps >10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 53 | 1.31 | yes | 4 | 0 | 100 | RGE

FIG. 74-242

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 336 | 1.25 | yes | 3 | 0 | 99.22 | LLLATGMKNV | 66.41 | LLLATGMKNV | 24.2 | LLATGMKNV | 8.59 | | |
| HA | H

FIG. 74-243

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 393 | 0.27 | yes | 2 | 0 | 99.22 | AQGE

FIG. 74-244

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 443 | 1.12 | yes | 3 | 0 | 100 | NVINWTRDSM | 61.72 | NVINWTRDSL | 3.12 | VIN

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 96 | 1.65 | yes | 5 | 0 | 100 | WVVIAKDNAV | 50.72 | WVVIAKDNAI | 24.6 | WVVIAKDNAV | 21

FIG. 74-248

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 147 | 0.92 | yes | 4 | 0 | 100 | TIHDRTAFRG | 79.71 | TIHDRTAFRG | 15.9 | TIHDRTTFRG | 2

FIG. 74-249

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 220 | 1.43 | yes | 4 | 0 | 100 | RNILRTQESE | 60.87 | RNILRTQESE | 21.7 | GNILRTQESE |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 402 | 0.11 | yes | 2 | 0 | 100 | WSGYSGSFID | 98.55 | RSGYSGSFID | 1.45 | | | | |
| NA | H7N7 | 403 |

FIG. 74-252

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 11 | 1.14 | yes | 4 | 1.49 | 100 | LASTNAY

FIG. 74-253

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 64 | 1.57 | yes | 3 | 0 | 100 | GAPLELRDCK | 37.31 | GTPLELRDCK | 35.8 | GSPLELRDCK | 26.87 | | |
| HA | H8 | 65 | 1.66 | yes | 4 | 0 | 100 | APLELRDCKI | 35.82 | TPLELRDCKI | 35.8 | SPLELRDCKI | 26.87 | APLELRDCKV | 1.49 |
| HA

FIG. 74-254

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 110 | 0.37 | yes | 3 | 0 | 100 | GSVENLEELR | 94.03 | GSVENLEELR | 4.48 | | | | |
| HA | H8 | 111 | 0.37 | yes | 3 | 0 | 100 | SVENLEELRF | 94.03 | SVENLEELRF | 4.48 | | | | |
| HA | H8 | 112 | 0.26 | yes | 2 | 0 | 100 | VENLEELRFV | 95.52 | VENLEELRFV | 4.48 | | | | |
| HA | H8 | 113 | 0 | yes | 1 | 0 | 100 | ENLEELRFVF | 100 | | | | | | |
| HA | H8 | 114 | 0 | yes | 1 | 0 | 100 | NLEELRFVFS | 100 | | | | | | |
| HA | H8 | 115 | 0.96 | yes | 3 | 0 | 100 | LEELRFVFSS | 70.15 | LEELRFVFSI | 28.4 | | | | |
| HA | H8 | 116 | 0.96 | yes | 3 | 0 | 100 | EELRFVFSNA | 70.15 | EELRFVFSIA | 28.4 | | | | |
| HA | H8 | 117 | 0.96 | yes | 3 | 0 | 100 | ELRFVFSNAA | 70.15 | ELRFVFSIAA | 28.4 | | | | |
| HA | H8 | 118 | 0.96 | yes | 3 | 0 | 100 | LRFVFSNAAS | 70.15 | LRFVFSIAAS | 28.4 | | | | |
| HA | H8 | 119 | 0.96 | yes | 3 | 0 | 100 | RFVFSNAASY | 70.15 | RFVFSIAASY | 28.4 | | | | |
| HA | H8 | 120 | 0.96 | yes | 3 | 0 | 100 | FVFSNAASYK | 70.15 | FVFSIAASYK | 28.4 | | | | |
| HA | H8 | 121 | 0.96 | yes | 3 | 0 | 100 | VFSNAASYKR | 70.15 | VFSIAASYKR | 28.4 | | | | |
| HA | H8 | 122 | 1.05 | yes | 4 | 0 | 100 | FSNAASYKRI | 70.15 | FSSAASYKRV | 26.9 | FSIAASYKRI | 1.49 | | |
| HA | H8 | 123 | 1.05 | yes | 4 | 0 | 100 | SNAASYKRIR | 70.15 | SSAASYKRVR | 26.9 | SIAASYKRIR | 1.49 | | |
| HA | H8 | 124 | 1.05 | yes | 4 | 0 | 100 | NAASYKRIRL | 70.15 | SAASYKRVRL | 26.9 | IAASYKRIRL | 1.49 | | |
| HA | H8 | 125 | 0.11 | yes | 2 | 0 | 100 | AASYKRIRLF | 98.51 | | | | | | |
| HA | H8 | 126 | 0.11 | yes | 2 | 0 | 100 | ASYKRIRLFD | 98.51 | | | | | | |
| HA | H8 | 127 | 0.11 | yes | 2 | 0 | 100 | SYKRIRLFDY | 98.51 | | | | | | |
| HA | H8 | 128 | 0.11 | yes | 2 | 0 | 100 | YKRIRLFDYS | 98.51 | | | | | | |
| HA | H8 | 129 | 1.19 | yes | 4 | 0 | 100 | KRIRLFDYSR | 50.75 | KRIRLFDYSG | 46.3 | KRVRLFDYSR | 1.49 | | |
| HA | H8 | 130 | 1.19 | yes | 4 | 0 | 100 | RIRLFDYSRW | 50.75 | RIRLFDYSGW | 46.3 | RIRLFDYSGW | 1.49 | | |
| HA | H8 | 131 | 1.19 | yes | 4 | 0 | 100 | IRLFDYSRWN | 50.75 | IRLFDYSGWN | 46.3 | IRLFDYSGWN | 1.49 | | |
| HA | H8 | 132 | 1.09 | yes | 2 | 0 | 100 | RLFDYSRWMV | 52.24 | RLFDYSGWNV | 43.3 | LFDYSGWNVT | 1.49 | | |
| HA | H8 | 133 | 1.25 | yes | 4 | 0 | 100 | LFDYSRWNVT | 52.24 | LFDYSGWNVS | 38.8 | | | | |
| HA | H8 | 139 | 1.14 | yes | 4 | 0 | 100 | WNVTSSGTSK | 58.21 | WNVSSGTSK | 38.8 | | | | |
| HA | H8 | 140 | 1.46 | yes | 4 | 0 | 100 | NVTSSGTSKA | 58.21 | NVSSGTSKAC | 38.8 | SSSGTSKACN | 2.99 | | |
| HA | H8 | 141 | 1.29 | yes | 3 | 0 | 100 | VTRSGTSKAC | 50.75 | TSSGTSKACS | 38.8 | | | | |
| HA | H8 | 142 | 0.7 | yes | 2 | 0 | 100 | TRSGTSKACN | 53.73 | SSGTSKACSA | 38.8 | | | | |
| HA | H8 | 143 | 0.7 | yes | 2 | 0 | 100 | RSGTSKACNA | 86.57 | SGTSKACSAS | 7.46 | | | | |
| HA | H8 | 144 | 0.89 | yes | 3 | 0 | 100 | SGTSKACNAS | 86.57 | GTSKACSAST | 7.46 | SKACNASTGA | 2.99 | | |
| HA | H8 | 145 | 1.38 | yes | 4 | 0 | 100 | GTSKACNAST | 86.57 | TSKACNALTG | 7.46 | KACNASTGAQ | 2.99 | ACNASTGAQS | 2.99 |
| HA | H8 | 146 | 1.38 | yes | 4 | 0 | 100 | TSKACNASTG | 83.58 | SKACNALTGG | 7.46 | ACNALTGGQS | 5.97 | CNASTGAQSF | 2.99 |
| HA | H8 | 147 | 1.38 | yes | 4 | 0 | 100 | SKACNASTGG | 83.58 | KACNALTGGQ | 7.46 | CNALTGGQSF | 5.97 | NASTGAQSFY | 2.99 |
| HA | H8 | 148 | 1.03 | yes | 5 | 0 | 100 | KACNASTGGQ | 71.64 | ACSASTGGQA | 7.46 | NALTGGQSFY | 5.97 | | |
| HA | H8 | 149 | 1.03 | yes | 5 | 0 | 100 | ACNASTGGQA | 71.64 | CSASTGGQAF | 7.46 | ALTGGQSFYR | 5.97 | | |
| HA | H8 | 150 | 1.03 | yes | 5 | 0 | 100 | CNASTGGQAF | 71.64 | SASTGGQSFY | 7.46 | LTGGQSFYRS | 5.97 | | |
| HA | H8 | 151 | 0.7 | yes | 4 | 0 | 100 | NASTGGQAFY | 79.1 | ASTGGQSFYR | 5.97 | TGGQSFYRSI | 2.99 | | |
| HA | H8 | 152 | 0.7 | yes | 4 | 0 | 100 | ASTGGQAFYR | 79.1 | STGGQSFYRS | 5.97 | GGQSFYRSIN | 2.99 | | |
| HA | H8 | 153 | 0.72 | yes | 3 | 0 | 100 | STGGQAFYRS | 85.07 | TGGQSFYRSI | 2.99 | | | | |
| HA | H8 | 154 | 0.72 | yes | 3 | 0 | 100 | TGGQAFYRSI | 85.07 | GAQSFYRSIN | 2.99 | | | | |
| HA | H8 | 155 | 0.72 | yes | 3 | 0 | 100 | GGQAFYRSIN | 85.07 | AQSFYRSINW | 2.99 | | | | |
| HA | H8 | 156 | 0.72 | yes | 3 | 0 | 100 | GQAFYRSINW | 85.07 | | | | | | |

FIG. 74-255

| Protein | Sub-type | Start Pos | Block Entropy | Gaps <10% | # to cover 99% | % Gap | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| HA | H8 | 157 | 0.53 | yes | 2 | 0 | 100 | QSFYRSINWL | 88.06 | Q

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H8 | 255 | 0 | yes | 1 | 0 |

| Protein | Sub-type | Start Pos | Block Entropy | Gaps <10% | # to cover 99% | % Gap | Coverage | Induced Peptides | Freq | Induced Peptides | Freq | Induced Peptides | Freq | Induced Peptides | Freq |
|---|---|---|---|---|---|---|---|---|---|---|---|---|---|---|---|
| HA | H8 | 360 | 0.11 | yes | 2 | 0 | 100

FIG. 74-260

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 402 | 0.52 | yes | 3 | 0 | 100 | DKMNREFFEVW | 91.04 | DKMNREF

FIG. 74-261

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 457 | 0.11 | yes | 2 | 0 | 100 | DSNVKNLF

| Protein | Sub-type | Start Pos | Block Entropy | Gaps <10% | # to 99% cover | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 548 | 0.11 | yes | 2 | 0 | 100 | IAGGLILGMQ | 98.51

FIG. 74-264

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H9 | 359 | 0.13 | yes | 2 | 0 | 99.11 | AGWYGFQHSN | 98

FIG. 74-265

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H9N2 | 249 | 1.23 | yes | 5 | 0 | 99.08 | PGQTLRIRSN

FIG. 74-266

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H9N2 | 439 | 0.22 | yes | 4 | 0 | 99.01 | LVLLENQKTL | 97.83 | LVLLENQKTL | 0.86 | LVL

FIG. 74-267

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H9N2 | 183 | 0.68 | yes | 4 | 0 | 99.04 | SSSCHDGRA | 89.09 | SSSCYDGKA | 1.44 | SSASCHDGRA | 1.32 | SSCHDGKEWL | 0.24 |
| NA | H9N2 | 184 | 0.68 | yes | 4 | 0 | 99.04 | SSSCHDGRAW | 89.09 | SSSCYDGKAW | 1.44 | SASCHDGRAW | 1.32

FIG. 74-268

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M | N/A | 16 | 1.12 | yes | 3 | 0.18 | 99.24 | SWPSGPLIKA | 51.1 | SWPSGPLIKA | 47.9 | | | | |
| M | N/A | 17 | 1.13 | yes | 3 | 0.03 | 99.17 | IIPSGPLIKAE | 51.05 | IIPSGPLIKAE | 47.9 | | | | |
| M | N/A | 18 | 1.09 | yes | 2 | 0.03 | 99.34 | VPSGPLIKAEI | 51.14 | VIPSGPLIKAE | 48.2 | | | | |
| M | N/A | 19 | 0.07 | yes | 1 | 0.02 | 99.48 | PSGPLIKAEIA | 99.48 | | | | | | |
| M | N/A | 20 | 0.07 | yes | 1 | 0.03 | 99.48 | SGPLIKAEIAQ | 99.48 | | | | | | |
| M | N/A | 21 | 0.52 | yes | 2 | 0.03 | 99.52 | GPLIKAEIAQR | 99.95 | GPLIKAEIAQK | 9.58 | | | | |
| M | N/A | 22 | 0.54 | yes | 2 | 0.02 | 99.36 | PLIKAEIAQRL | 89.76 | PLIKAEIAQKL | 9.58 | | | | |
| M | N/A | 23 | 0.54 | yes | 2 | 0.03 | 99.4 | LIKAEIAQRLE | 89.78 | LIKAEIAQKLE | 9.58 | | | | |
| M | N/A | 24 | 1.39 | yes | 5 | 0.02 | 99.33 | IKAEIAQRLED | 65.87 | KAEIAQKLED | 22.4 | KAEIAQRLED | 9.59 | KAEIAQRLEN | 0.54 |
| M | N/A | 25 | 1.39 | yes | 5 | 0.03 | 99.38 | KAEIAQRLES | 65.85 | AEIAQKLEDV | 22.4 | AEIAQRLEGV | 9.58 | AEIAQRLENV | 0.54 |
| M | N/A | 26 | 1.38 | yes | 5 | 0.02 | 99.17 | AEIAQRLESV | 65.88 | EIAQKLEDVF | 22.4 | EIAQRLEGVF | 9.57 | EIAQRLENVF | 0.54 |
| M | N/A | 27 | 1.4 | yes | 5 | 0.02 | 99.33 | EIAQRLESVF | 65.72 | IAQKLEDVFA | 22.4 | IAQRLEGVFA | 9.56 | IAQRLENVFA | 0.54 |
| M | N/A | 28 | 1.41 | yes | 5 | 0.02 | 99.19 | IAQRLESVFA | 65.73 | AQKLEDVFAG | 22.4 | AQRLEGVFAG | 9.56 | AQRLENVFAG | 0.54 |
| M | N/A | 29 | 1.41 | yes | 4 | 0.02 | 99.09 | AQRLESVFAG | 65.65 | QKLEDVFAGK | 22.4 | QRLEGVFAGK | 9.56 | QRLENVFAGK | 0.53 |
| M | N/A | 30 | 0.25 | yes | 2 | 0.02 | 99.19 | QRLESVFAGK | 97.52 | VFAGKNSDLE | 0.85 | VFSGKNTDLE | 0.6 | | |
| M | N/A | 31 | 0.28 | yes | 2 | 0.02 | 99.04 | VFAGKNADLE | 97.13 | FAGKNSDLEA | 0.85 | FAGKNTDLEV | 0.6 | | |
| M | N/A | 32 | 0.29 | yes | 2 | 0.02 | 99.17 | FAGKNADLEA | 97.07 | AGKNSDLEAL | 0.85 | AGKNTDLEVL | 0.57 | | |
| M | N/A | 33 | 0.27 | yes | 3 | 0.02 | 99.19 | AGKNADLEAL | 97.34 | GKNSDLEALM | 0.85 | GKNTDLEVLM | 0.57 | SGKNTDLEAL | 0.22 |
| M | N/A | 34 | 0.27 | yes | 2 | 0.02 | 99.21 | GKNADLEALM | 97.07 | KNSDLEALME | 0.85 | KNTDLEVLME | 0.57 | | |
| M | N/A | 35 | 0.26 | yes | 2 | 0.02 | 99.25 | KNADLEALME | 97.39 | NSDLEALMEW | 0.85 | NTDLEVLMEW | 0.57 | | |
| M | N/A | 36 | 0.32 | yes | 3 | 0.02 | 99.42 | NADLEALMEW | 96.66 | ADLEALMEWL | 0.93 | SDLEALMEWL | 0.81 | TDLEVLMEWL | 0.44 |
| M | N/A | 37 | 0.19 | yes | 1 | 0.04 | 99.08 | TDLEALMEWL | 98.12 | | | | | | |
| M | N/A | 38 | 0.19 | yes | 1 | 0.04 | 99.04 | DLEALMEWLK | 98.09 | | | | | | |
| M | N/A | 39 | 0.19 | yes | 1 | 0.04 | 99.25 | LEALMEWLKT | 98.1 | | | | | | |
| M | N/A | 40 | 0.18 | yes | 1 | 0.03 | 99.06 | EALMEWLKTR | 98.14 | | | | | | |
| M | N/A | 41 | 0.14 | yes | 2 | 0.02 | 99.53 | ALMEWLKTRP | 98.58 | ALMEWIKTRP | 0.96 | | | | |
| M | N/A | 42 | 0.13 | yes | 2 | 0.02 | 99.63 | LMEWLKTRPI | 98.68 | LMEWIKTRPI | 0.96 | | | | |
| M | N/A | 43 | 0.12 | yes | 2 | 0.02 | 99.68 | MEWLKTRPIL | 98.73 | MEWIKTRPIL | 0.96 | | | | |
| M | N/A | 44 | 0.15 | yes | 2 | 0.02 | 99.36 | EWLKTRPILS | 98.42 | EWIKTRPILS | 0.96 | | | | |
| M | N/A | 45 | 0.15 | yes | 2 | 0.02 | 99.37 | WLKTRPILSP | 98.42 | WIKTRPILSP | 0.95 | | | | |
| M | N/A | 46 | 0.15 | yes | 2 | 0.02 | 99.26 | LKTRPILSPL | 98.31 | IKTRPILSPL | 0.95 | | | | |
| M | N/A | 47 | 0.08 | yes | 1 | 0.04 | 99.28 | KTRPILSPLT | 99.31 | | | | | | |
| M | N/A | 48 | 0.09 | yes | 1 | 0.05 | 99.23 | TRPILSPLTK | 99.26 | | | | | | |
| M | N/A | 49 | 0.09 | yes | 1 | 0.04 | 99.24 | RPILSPLTKG | 99.28 | | | | | | |
| M | N/A | 50 | 0.31 | yes | 2 | 0.06 | 99.26 | PILSPLTKGI | 95.79 | PILSPLTIGM | 3.45 | | | | |
| M | N/A | 51 | 0.31 | yes | 2 | 0.06 | 95.8 | ILSPLTKGIL | 95.8 | ILSPLTKGML | 3.45 | | | | |
| M | N/A | 52 | 0.3 | yes | 2 | 0.06 | 95.82 | LSPLTKGILG | 95.82 | LSPLTKGMLG | 3.45 | | | | |
| M | N/A | 53 | 0.32 | yes | 2 | 0.06 | 95.66 | SPLTKGILGF | 95.66 | SPLTKGMLGF | 3.45 | | | | |
| M | N/A | 54 | 0.33 | yes | 2 | 0.05 | 95.45 | PLTKGILGFV | 95.45 | PLTKGMLGFV | 3.45 | SLTKGVLGFV | 0.32 |
| M | N/A | 55 | 0.34 | yes | 3 | 0.04 | 95.48 | LTKGILGFVF | 95.48 | LTKGMLGFVF | 3.45 | LTKGVLGFVF | 0.38 |
| M | N/A | 56 | 0.33 | yes | 3 | 0.04 | 95.49 | TKGILGFVFT | 95.49 | TKGMLGFVFT | 3.45 | TKGVLGFVFT | 0.38 |
| M | N/A | 57 | 0.33 | yes | 2 | 0.05 | 95.56 | KGILGFVFTL | 95.56 | KGMLGFVFTL | 3.45 | | | | |
| M | N/A | 58 | 0.32 | yes | 2 | 0.04 | 99.04 | GILGFVFTLT | 95.64 | GMLGFVFTLT | 3.48 | | | | |
| M | N/A | 59 | 0.31 | yes | 2 | 0.02 | 99.12 | GILGFVFTLT | 95.64 | GMLGFVFTLT | 3.48 | | | | |

FIG. 74-269

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 62 | 0.31 | yes | 2 | 0.02 | 99.1 | ILGVFTLTV | 95.62 | MLGVFTLTV | 3.48 | | | | |
| M1 | N/A | 63 | 0.07 | yes | 1 | 0.01 | 99.43 | LGFVFTLTVP | 99.43 | | | | | | |
| M1 | N/A | 64 | 0.08 | yes | 1 | 0.01 | 99.36 | GFVFTLTVPS | 99.36 | | | | | | |
| M1 | N/A | 65 | 0.08 | yes | 1 | 0.01 | 99.36 | FVFTLTVPSE | 99.36 | | | | | | |
| M1 | N/A | 66 | 0.06 | yes | 1 | 0.01 | 99.49 | VFTLTVPSER | 99.49 | | | | | | |
| M1 | N/A | 67 | 0.04 | yes | 1 | 0.01 | 99.7 | FTLTVPSERG | 99.7 | | | | | | |
| M1 | N/A | 68 | 0.04 | yes | 1 | 0.01 | 99.7 | TLTVPSERGL | 99.7 | | | | | | |
| M1 | N/A | 69 | 0.04 | yes | 1 | 0.01 | 99.69 | LTVPSERGLQ | 99.69 | | | | | | |
| M1 | N/A | 70 | 0.05 | yes | 1 | 0.03 | 99.67 | TVPSERGLQR | 99.69 | | | | | | |
| M1 | N/A | 71 | 0.06 | yes | 1 | 0.03 | 99.52 | VPSERGLQRR | 99.52 | | | | | | |
| M1 | N/A | 72 | 0.07 | yes | 1 | 0.03 | 99.52 | PSERGLQRRF | 99.53 | | | | | | |
| M1 | N/A | 73 | 0.06 | yes | 1 | 0.03 | 99.53 | SERGLQRRFI | 99.53 | | | | | | |
| M1 | N/A | 74 | 0.12 | yes | 2 | 0.03 | 99.61 | ERGLQRRFIQ | 98.74 | ERGLQRRFI | 0.87 | | | | |
| M1 | N/A | 75 | 0.12 | yes | 2 | 0.03 | 99.61 | RGLQRRFIQN | 98.74 | RGLQRRFIQ | 0.87 | | | | |
| M1 | N/A | 76 | 0.12 | yes | 2 | 0.03 | 99.5 | GLQRRFIQNA | 98.63 | GLQRRFION | 0.87 | | | | |
| M1 | N/A | 77 | 0.14 | yes | 2 | 0.03 | 99.4 | LQRRFIQNAL | 98.53 | LQRRFIQNA | 0.87 | | | | |
| M1 | N/A | 78 | 0.15 | yes | 2 | 0.03 | 99.4 | QRRFIQNALS | 98.53 | QRRFIQNAL | 0.87 | | | | |
| M1 | N/A | 79 | 0.15 | yes | 2 | 0.04 | 99.24 | RRFIQNALSG | 96.87 | RRFVQNALS | 1.6 | RRRFIQNALN | 0.77 | | |
| M1 | N/A | 80 | 0.28 | yes | 3 | 0.04 | 99.24 | RFIQNALSGN | 96.86 | RFVQNALSGN | 1.6 | RRFIQNALNG | 0.77 | | |
| M1 | N/A | 81 | 0.27 | yes | 3 | 0.02 | 99.39 | FIQNALSGNG | 96.99 | FVQNALSGNG | 1.6 | RFIQNALNGN | 0.77 | | |
| M1 | N/A | 82 | 0.27 | yes | 3 | 0.02 | 99.41 | IQNALSGNGD | 97.01 | VQNALSGNGD | 1.6 | FIQNALNGNG | 0.77 | | |
| M1 | N/A | 83 | 0.26 | yes | 3 | 0.03 | 99.48 | QNALSGNGDP | 97.04 | ONALSGNGDP | 1.69 | IQNALNGNGD | 0.77 | | |
| M1 | N/A | 84 | 0.26 | yes | 3 | 0.02 | 99.07 | NALSGNGDPN | 97.79 | NALSGNGDPN | 1.69 | | | | |
| M1 | N/A | 85 | 0.19 | yes | 3 | 0.02 | 99.22 | ALSGNGDPNN | 97.38 | ALNGNGDPNN | 1.69 | | | | |
| M1 | N/A | 86 | 0.24 | yes | 3 | 0.03 | 99.28 | LSGNGDPNNM | 97.53 | LNGNGDPNNM | 1.67 | | | | |
| M1 | N/A | 87 | 0.22 | yes | 3 | 0.02 | 99.06 | SGNGDPNNMD | 97.32 | NGNGDPNNMD | 1.69 | NGNGDPSNMD | 0.29 | | |
| M1 | N/A | 88 | 0.24 | yes | 4 | 0.03 | 99.22 | GNGDPNNMDK | 97.15 | GNGDPNNMDK | 21.9 | NGDPSNMDRA | 0.28 | DPNNMARAVK | 0.13 |
| M1 | N/A | 89 | 0.87 | yes | 5 | 0.02 | 99.09 | NGDPNNMDRA | 77.14 | NGDPNNMDKA | 21.8 | NGDPSNMDRAV | 0.28 | PNNMARAVKL | 0.13 |
| M1 | N/A | 90 | 0.88 | yes | 5 | 0.03 | 99.05 | GDPNNMDRAV | 77.08 | GDPNNMDKAV | 21.7 | GDPSMDRAVK | 0.28 | NNMARAVKLY | 0.13 |
| M1 | N/A | 91 | 0.89 | yes | 5 | 0.02 | 99.12 | DPNNMDRAVK | 77.02 | DPNNMDKAVK | 21.6 | PSNMDRAVKL | 0.28 | NMDKAVKLYK | 0.93 |
| M1 | N/A | 92 | 0.91 | yes | 5 | 0.03 | 99.08 | PNNMDRAVKL | 76.98 | PNNMDKAVKL | 21.6 | SNMDRAVKLY | 0.28 | MDKAVKLYKK | 0.93 |
| M1 | N/A | 93 | 0.92 | yes | 4 | 0.02 | 99.11 | NNMDRAVKLY | 77 | NNMDKAVKLY | 21.6 | NMDRAVKLYR | 20.68 | DKAVKLYKKL | 0.93 |
| M1 | N/A | 94 | 0.92 | yes | 4 | 0.01 | 99.04 | NMDRAVKLYR | 38.78 | NMDKAVKLYR | 38.6 | MDKAVKLYRK | 20.67 | KAVKLYKKLK | 0.94 |
| M1 | N/A | 95 | 1.71 | yes | 5 | 0.03 | 99.25 | MDRAVKLYRK | 38.8 | MDKAVKLYRK | 38.6 | DKAVKLYRKL | 20.69 | | |
| M1 | N/A | 96 | 1.71 | yes | 5 | 0.02 | 99.24 | DRAVKLYRKL | 38.81 | DKAVKLYRKL | 38.6 | KAVKLYRKLK | 20.68 | | |
| M1 | N/A | 97 | 1.7 | yes | 4 | 0.01 | 99.38 | RAVKLYRKLK | 38.85 | KAVKLYRKLK | 38.8 | | | | |
| M1 | N/A | 98 | 1.68 | yes | 4 | 0.01 | 99.38 | AVKLYRKLKR | 59.51 | AVKLYRKLKR | 39.7 | KLYKKLKREM | 4.45 | | |
| M1 | N/A | 99 | 1.06 | yes | 2 | 0.01 | 99.11 | VKLYRKLKRE | 59.62 | | | KLYKKLKREM | 4.45 | | |
| M1 | N/A | 100 | 1.05 | yes | 5 | 0.02 | 99.38 | KLYRKLKREI | 59.46 | KLYKKLKREI | 35.3 | LYKKLKREMT | 4.48 | | |
| M1 | N/A | 101 | 1.27 | yes | 3 | 0.02 | 99.21 | LYRKLKREIT | 59.53 | LYKKLKREIT | 35.3 | YKKLKREMTF | 4.5 | | |
| M1 | N/A | 102 | 1.25 | yes | 3 | 0.02 | 99.35 | YRKLKREITF | 59.47 | YKKLKREITF | 35.3 | | | | |
| M1 | N/A | 103 | 1.26 | yes | 3 | 0.02 | 99.31 | YRKLKREITF | 59.47 | YKKLKREITF | 35.3 | | | | |

| Protein | Sub-type | Start Pos | Block Entropy | Gaps >10% | # to cover 99% | % Gap | Coverage | Included Peptides | Freq | Included Peptides | Freq | Included Peptides | Freq | Included Peptides | Freq |
|---|---|---|---|---|---|---|---|---|---|---|---|---|---|---|---|
| M1 | N/A | 175 | 0.72 | yes | 3 | 0.03 | 99.61 | LIRHENRMVL | 85.5 | LIRHENRMVL | 12 | LIRHENRMVI | 2.13 | | |
| M1 | N/A | 176 | 0.72 | yes | 3 | 0.03 | 99.64 | IRHENRMVLA | 85.53 | IKHENRMVLA | 12 | IRHENRMVIA | 2.13 | | |
| M1 | N/A | 177 | 0.71 | yes | 2 | 0.03 | 99.63 | RHENRMVLAS | 85.52 | KHENRMVIAS | 12 | RHENRMVIAS | 2.13 | | |
| M1 | N/A | 178 | 0.21 | yes | 2 | 0.02 | 99.57 | HENRMVLAST | 97.43 | HENRMVIAST | 2.14 | | | | |
| M1 | N/A | 179 | 0.21 | yes | 2 | 0.02 | 99.57 | ENRMVLASTT | 97.43 | ENRMVIASTT | 2.14 | | | | |
| M1 | N/A | 180 | 0.21 | yes | 2 | 0.01 | 99.56 | NRMVLASTTA | 97.43 | NRMVIASTTA | 2.14 | | | | |
| M1 | N/A | 181 | 0.21 | yes | 2 | 0.01 | 99.57 | RMVLASTTAK | 97.43 | RMVIASTTAK | 2.15 | | | | |
| M1 | N/A | 182 | 0.21 | yes | 2 | 0.02 | 99.55 | MVLASTTAKA | 97.4 | MVIASTTAKA | 2.15 | | | | |
| M1 | N/A | 183 | 0.21 | yes | 2 | 0.03 | 99.53 | VLASTTAKAM | 97.39 | VIASTTAKAM | 2.15 | | | | |
| M1 | N/A | 184 | 0.21 | yes | 2 | 0.02 | 99.51 | LASTTAKAME | 97.38 | IASTTAKAME | 2.14 | | | | |
| M1 | N/A | 185 | 0.05 | yes | 2 | 0.03 | 99.62 | ASTTAKAMEQ | 99.62 | | | | | | |
| M1 | N/A | 186 | 0.22 | yes | 2 | 0.03 | 99.38 | STTAKAMEQM | 97.31 | STTAKAMEQV | 2.07 | | | | |
| M1 | N/A | 187 | 0.22 | yes | 2 | 0.05 | 99.36 | TTAKAMEQMA | 97.29 | TTAKAMEQVA | 2.07 | | | | |
| M1 | N/A | 188 | 0.23 | yes | 2 | 0.05 | 99.43 | TAKAMEQMAG | 97.35 | TAKAMEQVAG | 2.07 | | | | |
| M1 | N/A | 189 | 0.23 | yes | 2 | 0.06 | 99.32 | AKAMEQMAGS | 97.24 | AKAMEQVAGS | 2.08 | | | | |
| M1 | N/A | 190 | 0.25 | yes | 2 | 0.06 | 99.1 | KAMEQMAGSS | 97.09 | KAMEQVAGSS | 2 | | | | |
| M1 | N/A | 191 | 0.25 | yes | 2 | 0.05 | 99.11 | AMEQMAGSSE | 97.12 | AMEQVAGSSE | 2 | | | | |
| M1 | N/A | 192 | 0.26 | yes | 2 | 0.05 | 99.03 | MEQMAGSSEQ | 97.02 | MEQVAGSSEQ | 2 | | | | |
| M1 | N/A | 193 | 0.26 | yes | 2 | 0.05 | 99.05 | EQMAGSSEQA | 97.05 | EQVAGSSEQA | 1.98 | QIAGSSEQAA | 0.24 | | |
| M1 | N/A | 194 | 0.26 | yes | 2 | 0.05 | 99.05 | QMAGSSEQAA | 96.82 | QVAGSSEQAA | 1.99 | IAGSSEQAAE | 0.24 | | |
| M1 | N/A | 195 | 0.12 | yes | 3 | 0.05 | 99.02 | MAGSSEQAAE | 96.79 | VAGSSEQAAE | 0.23 | | | | |
| M1 | N/A | 196 | 0.15 | yes | 4 | 0.05 | 99.23 | AGSSEQAAEA | 99 | AGSNEQAAEA | 0.24 | GSNEQAAEAM | 0.23 | SNEQAAEAME | 0.23 |
| M1 | N/A | 197 | 0.18 | yes | 4 | 0.04 | 99.2 | GSSEQAAEAI | 98.76 | GSNEQAAEAI | 0.29 | SSEQAAEAIE | 0.24 | SEQAAEAMDI | 0.2 |
| M1 | N/A | 198 | 0.92 | yes | 4 | 0.04 | 99.08 | SSEQAAEAM | 98.44 | SEQAAEAIE | 0.23 | SEQAAEAIEV | 0.23 | EQAAEAMDIA | 0.2 |
| M1 | N/A | 199 | 0.89 | yes | 5 | 0.04 | 99.16 | SEQAAEAMEV | 77.33 | SEQAAEAMEI | 0.24 | EQAAEAIEVA | 0.23 | MVQAMRTVGT | 6.88 |
| M1 | N/A | 200 | 2 | yes | 4 | 0.05 | 99.35 | EQAAEAMEVA | 77.46 | EQAAEAMEIA | 0.29 | MVQAMRAIGT | 21.2 | DLLENLQAYQ | 4.52 |
| M1 | N/A | 215 | 1.53 | yes | 5 | 0.02 | 99.33 | MVQAMRTIGT | 44.2 | MVHAMRTIGT | 21.3 | NLLENLQAYQ | 21.3 | LLDNLQAYQ | 0.71 |
| M1 | N/A | 235 | 1.12 | yes | 4 | 0.05 | 99.03 | DLLENLQAYQ | 65.18 | DLLENLQTYQ | 18.3 | LLENLQAYQK | 24.3 | LDNLQAYQK | 0.71 |
| M1 | N/A | 236 | 1.11 | yes | 4 | 0.07 | 99.04 | LLENLQAYQK | 75.5 | LLENLQTYQK | 18.3 | LENLQAYQKR | 18.3 | ENLQAYQNRM | 0.24 |
| M1 | N/A | 237 | 0.87 | yes | 4 | 0.07 | 99.19 | LENLQAYQKR | 75.52 | LENLQTYQKR | 18.3 | ENLQAYQKRM | 18.3 | | |
| M1 | N/A | 238 | 0.79 | yes | 5 | 0.08 | 99.24 | ENLQAYQKRM | 79.96 | ENLQTYQKRM | 18.4 | DNLQAYQKRM | 0.71 | | |
| M1 | N/A | 239 | 0.84 | yes | 4 | 0.08 | 99.14 | NLQAYQKRMG | 80.84 | NLQTYQKRMG | 18.3 | LQAYQKRMGL | 0.6 | AYQKRMGLQM | 1.66 |
| M1 | N/A | 240 | 0.84 | yes | 4 | 0.08 | 99.16 | LQAYQKRMGV | 80.19 | LQTYQKRMGV | 18.4 | QAYQKRMGLQ | 0.6 | AYQKRMGLQM | 0.6 |
| M1 | N/A | 241 | 1.11 | yes | 5 | 0.08 | 99.06 | QAYQKRMGVQ | 80.21 | QTYQKRMGVQ | 18.3 | AYQKRMGVQL | 2.08 | AYQKRMGVQI | 2.08 | YQKRMGVQMH | 0.61 |
| M1 | N/A | 242 | 0.46 | yes | 5 | 0.09 | 99.17 | AYQKRMGVQM | 76.39 | TYQKRMGVQM | 18.4 | YQKRMGVQIQ | 1.68 | YQKRMGVQI | 1.68 | QKRMGVQMHR | 0.61 |
| M1 | N/A | 243 | 0.45 | yes | 5 | 0.08 | 99.25 | YQKRMGVQMQ | 94.44 | | | QKRMGVQIQR | 1.68 | QKRMGLQMQR | 1.68 | RMGVQMHRFK | 0.37 |
| M1 | N/A | 244 | 0.44 | yes | 5 | 0.08 | 99.14 | QKRMGVQMQR | 94.52 | | | KRMGVQIQR | 1.67 | RMGLQMQRFK | 1.67 | | |
| M1 | N/A | 245 | 0 | no | 1 | 0.09 | 100 | KRMGVQMQRF | 94.62 | | | RMGVQIQRFK | 1.88 | | | | |
| M1 | N/A | 246 | 0 | no | 1 | 0.08 | 100 | RMGVQMQRFR | 100 | | | | | | | | |
| M1 | N/A | 247 | 0 | no | 1 | 99.99 | 100 | MGVQMQRFRR | 100 | | | | | | | | |
| M1 | N/A | 248 | 0 | no | 1 | 99.99 | 100 | GVQMQRFRRP | 100 | | | | | | | | |
| M1 | N/A | 249 | 0 | no | 1 | 99.99 | 100 | VQMQRFRRPD | 100 | | | | | | | | |
| M1 | N/A | 250 | 0 | no | 1 | 99.99 | 100 | QMQRFRRPDS | 100 | | | | | | | | |

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 102 | 0.09 | yes | 1 | 0.03 | 99.21 | GKDPKKTGGP | 99.21 | | | | | | |
| NP | N/A | 103 | 0.1 | yes | 1 | 0.03 | 99.08 | KDPKKTGGPI | 99.08 | | | | | | |
| NP | N/A | 104 | 0.06 | yes | 1 | 0.04 | 99.54 | DPKKTGGPIY | 99.54 | | | | | | |
| NP | N/A | 105 | 0.75 | yes | 2 | 0.05 | 99.53 | PKKTGGPIYK | 99.53 | PKKTGGPIYK | 18.2 | | | | |
| NP | N/A | 106 | 0.83 | yes | 3 | 0.07 | 99.38 | KKTGGPIYKR | 99.38 | KKTGGPIYKK | 17 | KKTGGPIYKK | 1.28 | | |
| NP | N/A | 131 | 1.1 | yes | 5 | 0.05 | 99.05 | EIRRYWRQAN | 99.05 | EIRRYWRQAN | 28 | EIMRIWRQAN | 1.03 | EVRRIWRQAN | 0.26 | ELRRIWRQAN | 0.21 |
| NP | N/A | 133 | 1.09 | yes | 5 | 0.04 | 99.01 | RRYWRQANNG | 99.01 | RRYWRQANNG | 27.9 | MRIWRQANNG | 1.03 | RRNWRQANNG | 0.18 | RRIWRQANSG | 0.11 |
| NP | N/A | 134 | 1.46 | yes | 5 | 0.03 | 99.07 | RYWRQANNGE | 99.07 | RYWRQANNGE | 27.9 | RIWRQANNGD | 11.93 | RNWRQANNGE | 0.18 | WRQANSGEDA | 0.13 |
| NP | N/A | 136 | 0.71 | yes | 4 | 0.02 | 99.08 | WRQANNGEDA | 99.08 | WRQANNGDDA | 11.9 | WRQANNGEDS | 0.27 | WRQANNGEEA | 0.22 | |
| NP | N/A | 147 | 1.78 | yes | 4 | 0.01 | 99.41 | AGLTHIMIWH | 99.41 | AGLTHMIWH | 39.3 | SGLTHIMIWH | 4.89 | | |
| NP | N/A | 148 | 1.53 | yes | 5 | 0.03 | 99.43 | GLTHIMIWHS | 99.43 | GLTHMMIWHS | 39.3 | | | | |
| NP | N/A | 149 | 1.53 | yes | 4 | 0.03 | 99.75 | LTHIMIWHSN | 99.75 | LTHMMIWHSN | 39.3 | | | | |
| NP | N/A | 150 | 1.5 | yes | 3 | 0.03 | 99.77 | THIMIWHSNL | 99.77 | THMMIWHSNL | 39.5 | | | | |
| NP | N/A | 151 | 1.5 | yes | 3 | 0.02 | 99.45 | HIMIWHSNLN | 99.45 | HLMIWHSNLN | 39.5 | | | | |
| NP | N/A | 152 | 1.5 | yes | 3 | 0.02 | 99.4 | IMIWHSNLND | 99.4 | LMIWHSNLND | 39.5 | | | | |
| NP | N/A | 153 | 0.7 | yes | 2 | 0.02 | 99.44 | MIWHSNLNDA | 99.44 | MIWHSNLNDT | 15.6 | | | | |
| NP | N/A | 154 | 0.7 | yes | 2 | 0.02 | 99.45 | IWHSNLNDAT | 99.45 | IWHSNLNDTT | 16 | | | | |
| NP | N/A | 155 | 0.7 | yes | 2 | 0.03 | 99.44 | WHSNLNDATY | 99.44 | WHSNLNDTTY | 16 | | | | |
| NP | N/A | 156 | 0.71 | yes | 2 | 0.02 | 99.44 | HSNLNDATYQ | 99.44 | HSNLNDTTYQ | 16 | | | | |
| NP | N/A | 157 | 0.7 | yes | 2 | 0.02 | 99.42 | SNLNDATYQR | 99.42 | SNLNDTTYQR | 16 | | | | |
| NP | N/A | 158 | 0.7 | yes | 2 | 0.02 | 99.42 | NLNDATYQRT | 99.42 | NLNDTTYQRT | 16 | | | | |
| NP | N/A | 159 | 0.7 | yes | 2 | 0.02 | 99.41 | LNDATYQRTR | 99.41 | LNDTTYQRTR | 16 | | | | |
| NP | N/A | 160 | 0.7 | yes | 2 | 0.01 | 99.43 | NDATYQRTRA | 99.43 | NDTTYQRTRA | 16 | | | | |
| NP | N/A | 161 | 0.7 | yes | 2 | 0.01 | 99.75 | DATYQRTRAL | 99.75 | DTTYQRTRAL | 16 | | | | |
| NP | N/A | 162 | 0.03 | yes | 1 | 0.03 | 99.75 | ATYQRTRALV | 99.75 | TTYQRTRALV | 16 | | | | |
| NP | N/A | 163 | 0.19 | yes | 2 | 0.02 | 99.33 | TYQRTRALVR | 99.33 | YQRTRALVRS | 1.58 | | | | |
| NP | N/A | 164 | 0.19 | yes | 2 | 0.02 | 99.35 | YQRTRALVRT | 99.35 | QRTRALVRSG | 1.58 | | | | |
| NP | N/A | 165 | 0.2 | yes | 2 | 0.02 | 99.21 | QRTRALVRTG | 99.21 | RTRALVRSGM | 1.58 | | | | |
| NP | N/A | 166 | 0.2 | yes | 2 | 0.02 | 99.19 | RTRALVRTGM | 99.19 | TRALVRSGMD | 1.58 | | | | |
| NP | N/A | 167 | 0.21 | yes | 2 | 0.01 | 99.19 | TRALVRTGMD | 99.19 | RALVRSGMDP | 1.58 | | | | |
| NP | N/A | 168 | 0.21 | yes | 2 | 0.01 | 99.16 | RALVRTGMDP | 99.16 | ALVRSGMDPR | 1.58 | | | | |
| NP | N/A | 169 | 0.21 | yes | 2 | 0.02 | 99.14 | ALVRTGMDPR | 99.14 | LVRSGMDPRM | 1.58 | | | | |
| NP | N/A | 170 | 0.2 | yes | 2 | 0.02 | 99.18 | LVRTGMDPRM | 99.18 | VRSGMDPRMC | 1.58 | | | | |
| NP | N/A | 171 | 0.21 | yes | 2 | 0.02 | 99.18 | VRTGMDPRMC | 99.18 | RSGMDPRMCS | 1.58 | | | | |
| NP | N/A | 172 | 0.2 | yes | 2 | 0.02 | 99.16 | RTGMDPRMCS | 99.16 | SGMDPRMCSL | 1.58 | | | | |
| NP | N/A | 173 | 0.06 | yes | 1 | 0.02 | 99.59 | TGMDPRMCSL | 99.59 | | | | | | |
| NP | N/A | 174 | 0.05 | yes | 1 | 0.02 | 99.55 | GMDPRMCSLM | 99.55 | | | | | | |
| NP | N/A | 175 | 0.04 | yes | 1 | 0.02 | 99.75 | MDPRMCSLMQ | 99.75 | | | | | | |
| NP | N/A | 176 | 0.03 | yes | 1 | 0.02 | 99.79 | DPRMCSLMQG | 99.79 | | | | | | |
| NP | N/A | 177 | 0.03 | yes | 1 | 0.02 | 99.79 | PRMCSLMQGS | 99.79 | | | | | | |
| NP | N/A | 178 | 0.03 | yes | 1 | 0.02 | 99.79 | RMCSLMQGST | 99.79 | | | | | | |
| NP | N/A | 179 | 0.03 | yes | 1 | 0.01 | 99.81 | MCSLMQGSTL | 99.81 | | | | | | |

FIG. 74-275

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| NP | N/A | 180 | 0.02 | yes | 1 | 0.02 | 99.83 | CSLMQGSTLP | 99.83 | | | | | | | | |
| NP | N/A | 181 | 0.03 | yes | 1 | 0.03 | 99.81 | SLMQGSTLPR | 99.81 | |

FIG. 74-276

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 238 | 0.07 | yes | 1 | 0.02 | 99.46 | MCNILKGKFQ | 99.48 | | | | | | |
| NP | N/A | 239 | 0.07 | yes | 1 | 0.02 | 99.45 | CNILKGKFQT | 99.45 | | | | | | |
| NP | N/A | 240 | 0.07 | yes | 1 | 0.03 | 99.41 | NILKGKFQTA | 99.42 | | | | | | |
| NP | N/A | 241 | 0.1 | yes | 1 | 0.03 | 99.22 | ILKGKFQTAA | 99.22 | | | | | | |
| NP | N/A | 242 | 0.09 | no | 1 | 0.04 | 99.28 | LKGKFQTAAQ | 99.31 | | | | | | |
| NP | N/A | 243 | 0 | yes | 1 | 0.05 | 100 | SKGSSKQQHK | 100 | | | | | | |
| NP | N/A | 244 | 0.44 | yes | 2 | 99.99 | 99.34 | KGKFQTAAQR | 92.52 | IGKFQTAAQK | 6.81 | | | | |
| NP | N/A | 245 | 0.45 | yes | 2 | 0.09 | 99.26 | GKFQTAAQRA | 92.44 | GKFQTAAQKA | 6.81 | | | | |
| NP | N/A | 246 | 0.45 | yes | 2 | 0.09 | 99.22 | KFQTAAQRAM | 92.41 | KFQTAAQKAM | 6.81 | | | | |
| NP | N/A | 247 | 1.09 | yes | 3 | 0.09 | 99.12 | FQTAAQRAMM | 75.87 | FQTAAQKAMM | 16.5 | | | | |
| NP | N/A | 248 | 1.08 | yes | 3 | 0.09 | 99.24 | QTAAQRAMMD | 75.96 | QTAAQKAMMD | 16.5 | | | | |
| NP | N/A | 249 | 1.08 | yes | 3 | 0.09 | 99.29 | TAAQRAMVDQ | 75.95 | TAAQKAMMDQ | 16.5 | | | | |
| NP | N/A | 250 | 1.07 | yes | 3 | 0.07 | 99.24 | AAQRAMMDQV | 76.01 | AAQKAMMDQV | 16.5 | | | | |
| NP | N/A | 251 | 1.07 | yes | 3 | 0.08 | 99.29 | AQRAMVDQVR | 76.01 | AQKAMMDQVR | 16.5 | | | | |
| NP | N/A | 252 | 1.05 | yes | 3 | 0.08 | 99.51 | QRAMVDQVRE | 76.23 | QKAMMDQVRE | 16.6 | | | | |
| NP | N/A | 253 | 1.13 | yes | 3 | 0.08 | 99.52 | RAMMDQVRES | 75.11 | KAMMDQVREG | 16.6 | RAMMDQVREG | 1.11 | | | |
| NP | N/A | 254 | 0.8 | yes | 2 | 0.06 | 99.53 | AMMDQVRESR | 81.82 | AMMDQVREGR | 16.6 | | | | |
| NP | N/A | 255 | 0.83 | yes | 2 | 0.02 | 99.14 | MMDQVRESRN | 81.4 | MMDQVREGRN | 16.6 | | | | |
| NP | N/A | 256 | 0.83 | yes | 2 | 0.02 | 99.16 | MDQVRESRNP | 81.42 | MDQVREGRNP | 16.6 | | | | |
| NP | N/A | 257 | 0.18 | yes | 3 | 0.02 | 99.16 | DQVRESRNPG | 98.05 | DQVREGRNPG | 1.12 | | | | |
| NP | N/A | 258 | 0.18 | yes | 2 | 0.02 | 99.18 | QVRESRNPGN | 98.06 | QVREGRNPGN | 1.12 | | | | |
| NP | N/A | 259 | 0.19 | yes | 2 | 0.02 | 99.08 | VRESRNPGNA | 97.95 | VREGRNPGNA | 1.13 | | | | |
| NP | N/A | 260 | 0.19 | yes | 2 | 0.02 | 99.14 | RESRNPGNAE | 98.01 | REGRNPGNAE | 1.13 | | | | |
| NP | N/A | 261 | 0.23 | yes | 3 | 0.01 | 99.16 | ESRNPGNAEI | 97.61 | EGRNPGNAEI | 1.13 | ESRSPGNAEI | 0.42 | | | |
| NP | N/A | 262 | 0.23 | yes | 3 | 0.01 | 99.16 | SRNPGNAEIE | 97.61 | GRNPGNAEIE | 1.13 | SRSPGNAEIE | 0.42 | | | |
| NP | N/A | 263 | 0.15 | yes | 2 | 0.02 | 99.11 | RNPGNAEIED | 98.69 | RSPGNAEIED | 0.42 | | | | |
| NP | N/A | 264 | 0.5 | yes | 2 | 0.02 | 99.11 | NPGNAEIEDL | 98.68 | SPGNAEIEDL | 0.43 | | | | |
| NP | N/A | 265 | 0.5 | yes | 4 | 0.02 | 99.08 | PGNAEIEDLT | 91.48 | PGNAEIEDLT | 7.59 | | | | |
| NP | N/A | 266 | 0.67 | yes | 5 | 0.02 | 99.1 | GNAEIEDLTF | 91.51 | GNAEIEDLTF | 7.59 | | | | |
| NP | N/A | 267 | 0.69 | yes | 5 | 0.02 | 99.06 | NAEIEDLIFL | 89.34 | NAEIEDLIFS | 7.59 | NAEIEDLIFM | 1.53 | | | |
| NP | N/A | 268 | 0.69 | yes | 5 | 0.03 | 99.08 | AEIEDLIFLA | 89.22 | AEIEDLIFSA | 7.59 | AEIEDLIFMA | 1.53 | AEIEDLIFLT | 0.25 |
| NP | N/A | 269 | 0.67 | yes | 4 | 0.03 | 99.21 | EIEDLIFLAR | 89.2 | EIEDLIFSAR | 7.61 | EIEDLIFMAR | 1.53 | EIEDLIFLTR | 0.25 |
| NP | N/A | 270 | 0.68 | yes | 4 | 0.03 | 99.18 | IEDLIFLARS | 89.42 | EDLIFSARS | 7.82 | IEDLIFMARS | 1.53 | IEDLIFLTRS | 0.25 |
| NP | N/A | 271 | 0.64 | yes | 4 | 0.03 | 99.36 | EDLIFLARSA | 89.4 | EDLIFSARSA | 7.82 | EDLIFMARSA | 1.53 | | |
| NP | N/A | 272 | 0.64 | yes | 4 | 0.04 | 99.35 | DLIFLARSAL | 89.35 | DLIFSARSAL | 7.8 | DLIFMARSAL | 1.53 | | |
| NP | N/A | 273 | 0.67 | yes | 4 | 0.04 | 99.02 | LIFLARSALI | 89.02 | LIFSARSALI | 7.81 | LIFMARSALI | 1.53 | | |
| NP | N/A | 274 | 0.67 | yes | 4 | 0.04 | 99.05 | IFLARSALIL | 89.09 | IFSARSALIL | 1.53 | IFMARSALIL | 0.6 | | |
| NP | N/A | 275 | 0.26 | yes | 3 | 0.03 | 99.13 | FLARSALILR | 89.11 | FMARSALILR | 0.6 | | | | |
| NP | N/A | 276 | 0.13 | yes | 3 | 0.03 | 99.12 | LARSALILRG | 97 | MARSALILRG | 0.6 | | | | |
| NP | N/A | 277 | 0.21 | yes | 2 | 0.03 | 99.18 | ARSALILRGS | 97 | | | | | | |
| NP | N/A | 278 | 0 | yes | 1 | 0.03 | 99.28 | RSALILRGSV | 98.72 | RSALILRGAV | 1.15 | | | | |
| NP | N/A | 279 | 0 | no | 1 | 99.99 | 100 | SASALILRGS | 97.68 | | | | | | |

FIG. 74-277

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 280 | 0 | no | 1 | 99.99 | 100 | ASALILRGSV | 100 | | | | | | |
| NP | N/A | 281 | 0.21 | yes | 3 | 0.03 | 99.28 | SALILRGSVA | 97.68 | SALILRGSIA | 1.15 | SALILRGAVA | 0.45 | | |
| NP | N/A | 282 | 0.22 | yes | 3 | 0.02 | 99.25 | ALILRGSVAH | 97.65 | ALILRGSIAH | 1.15 | ALILRGAVAH | 0.45 | | |
| NP | N/A | 283 | 0.22 | yes | 3 | 0.01 | 99.27 | LILRGSVAHK | 97.67 | LILRGSIAHK | 1.15 | LILRGAVAHK | 0.45 | | |
| NP | N/A | 284 | 0.21 | yes | 3 | 0.01 | 99.28 | ILRGSVAHKS | 97.68 | ILRGSIAHKS | 1.15 | ILRGAVAHKS | 0.45 | | |
| NP | N/A | 285 | 0.19 | yes | 2 | 0.01 | 99.12 | LRGSVAHKSC | 97.97 | LRGSIAHKSC | 1.15 | | | | |
| NP | N/A | 286 | 0.18 | yes | 2 | 0.01 | 99.16 | RGSVAHKSCL | 98.01 | RGSIAHKSCL | 1.15 | | | | |
| NP | N/A | 287 | 0.19 | yes | 2 | 0.01 | 99.14 | GSVAHKSCLP | 98 | GSIAHKSCLP | 1.14 | | | | |
| NP | N/A | 288 | 0.19 | yes | 2 | 0.01 | 99.08 | SVAHKSCLPA | 97.93 | SIAHKSCLPA | 1.14 | | | | |
| NP | N/A | 289 | 0.15 | yes | 2 | 0.01 | 99.56 | VAHKSCLPAC | 98.41 | IAHKSCLPAC | 1.14 | | | | |
| NP | N/A | 290 | 0.51 | yes | 3 | 0.01 | 99.68 | AHKSCLPACV | 91.08 | AHKSCLPACA | 7.65 | AHKSCLPACI | 0.94 | | |
| NP | N/A | 291 | 0.51 | yes | 3 | 0.01 | 99.69 | HKSCLPACVY | 91.1 | HKSCLPACAY | 7.65 | HKSCLPACIY | 0.94 | | |
| NP | N/A | 292 | 0.51 | yes | 3 | 0.01 | 99.72 | KSCLPACVYG | 91.12 | KSCLPACAYG | 7.65 | KSCLPACIYG | 0.94 | | |
| NP | N/A | 293 | 1.21 | yes | 4 | 0.01 | 99.59 | SCLPACVYGL | 71.14 | SCLPACAYGP | 19.9 | SCLPACIYGL | 7.63 | SCLPACIYGL | 0.57 |
| NP | N/A | 294 | 1.3 | yes | 4 | 0.03 | 99.09 | CLPACVYGLA | 70.29 | CLPACAYGPA | 19.9 | CLPACIYGLV | 7.63 | CLPACVYGLV | 0.7 | CLPACVYGLV | 0.61 |
| NP | N/A | 307 | 1.69 | yes | 4 | 0.03 | 99.09 | GYDFEREGYS | 42.54 | GHDFEREGYS | 28.1 | GYNFEKEGYS | 27.88 | GYNFEKEGYS | 0.57 | | |
| NP | N/A | 308 | 1.7 | yes | 4 | 0.03 | 99.06 | YDFEREGYSL | 42.55 | HDFEREGYSL | 28.1 | YNFEKEGYSL | 27.87 | YNFEKEGYSL | 0.57 | | |
| NP | N/A | 309 | 1.01 | yes | 3 | 0.01 | 99.06 | DFEREGYSLV | 70.29 | DFEKEGYSL | 27.9 | NFEKEGYSL | 0.57 | | | |
| NP | N/A | 310 | 0.92 | yes | 2 | 0.01 | 99.58 | FEREGYSLVG | 71 | FEKEGYSLVG | 28.6 | | | | |
| NP | N/A | 311 | 1.2 | yes | 4 | 0.02 | 99.43 | EREGYSLVGI | 70.45 | EKEGYSLVGI | 21.9 | EREGYSLVGV | 6.64 | EREGYSLVGV | 0.43 | | |
| NP | N/A | 312 | 1.19 | yes | 4 | 0.01 | 99.06 | REGYSLVGID | 70.49 | KEGYSLVGID | 21.9 | KEGYSLVGVD | 6.66 | | |
| NP | N/A | 313 | 0.44 | yes | 3 | 0.01 | 99.48 | EGYSLVGVDP | 92.39 | EGYSLVGIDP | 7.09 | | | | |
| NP | N/A | 314 | 0.44 | yes | 2 | 0.01 | 99.48 | GYSLVGVDPF | 92.39 | GYSLVGIDPF | 7.09 | | | | |
| NP | N/A | 315 | 1.38 | yes | 4 | 0.01 | 99.07 | YSLVGIDPFR | 49.9 | YSLVGVDPFR | 42.5 | YSLVGVDPFK | 6.68 | SLVGVDPFRL | 0.41 | | |
| NP | N/A | 316 | 1.39 | yes | 4 | 0.02 | 99.38 | SLVGIDPFKL | 49.73 | SLVGVDPFRL | 42.6 | SLVGVDPFKL | 6.67 | SLVGVDPFRL | 0.41 | | |
| NP | N/A | 317 | 1.4 | yes | 4 | 0.02 | 99.35 | LVGIDPFKLL | 49.73 | LVGVDPFRLL | 42.6 | LVGVDPFKLL | 6.67 | LVGVDPFRLL | 0.28 | | |
| NP | N/A | 318 | 0 | yes | 3 | 0.02 | 99.25 | VGIDPFKLLQ | 49.73 | VGVDPFRLLQ | 42.6 | VGVDPFKLLQ | 6.68 | | |
| NP | N/A | 321 | 0 | no | 1 | 99.99 | 100 | DPDPFRLLQN | 100 | | | | | | |
| NP | N/A | 322 | 1.43 | yes | 4 | 0.03 | 99.23 | DPFRLLQNSQ | 48.89 | DPFKLLQTSQ | 42.5 | DPFRLLQSQ | 7.43 | DPFRLLQSSQ | 0.39 | DPFRLLQSSQV | 0.39 |
| NP | N/A | 323 | 1.77 | yes | 5 | 0.02 | 99.13 | PFRLLQNSQV | 42.45 | PFKLLQNSQI | 40.1 | PFKLLQTSQV | 8.8 | PFKLLQTSQV | 7.41 | PFRLLQSQV | 0.39 | PFRLLQSQV | 0.39 |
| NP | N/A | 324 | 0 | no | 1 | 99.99 | 100 | PRLLQNSQVF | 100 | | | | | | |
| NP | N/A | 326 | 0.4 | yes | 4 | 0.02 | 99.06 | RPNENPAHKS | 95.43 | RSNENPAHKS | 1.22 | RPKENPAHKS | 1.21 | RPNENPVHKS | 1.2 | | |
| NP | N/A | 339 | 0.3 | yes | 4 | 0.01 | 99.04 | PNENPAHKSQ | 95.43 | SNENPAHKSQ | 1.22 | PKENPAHKSQ | 1.21 | PNENPVHKSQ | 1.2 | | |
| NP | N/A | 340 | 0.27 | yes | 3 | 0.02 | 99.11 | NENPAHKSQL | 96.7 | NENPVHKSQL | 1.21 | KENPAHKSQL | 1.09 | | | |
| NP | N/A | 341 | 0.27 | yes | 3 | 0.01 | 99.02 | ENPAHKSQLI | 97.18 | ENPVHKSQLI | 1.09 | ENPAHKSQLI | 1.09 | | | |
| NP | N/A | 342 | 0.28 | yes | 3 | 0.01 | 99.16 | NPAHKSQLIW | 97.18 | NPVHKSQLIW | 1.08 | NPAHKSQLI | 1.08 | | | |
| NP | N/A | 343 | 0.27 | yes | 4 | 0.01 | 99.26 | PAHKSQLIWM | 97.07 | PVHKSQLVWM | 1.08 | PAHKSQLVWM | 0.74 | PVHKSQLVWM | 0.27 | | |
| NP | N/A | 344 | 0.2 | yes | 3 | 0.01 | 99.52 | AHKSQLIWMA | 97.18 | AHKSQLVWMA | 1.81 | VHKSQLVWMA | 0.74 | VHKSQLVWMA | 0.27 | | |
| NP | N/A | 345 | 0.64 | yes | 2 | 0.01 | 99.52 | HKSQLVWMAC | 97.71 | HKSQLVWMAC | 0.72 | | | | |
| NP | N/A | 347 | 0.64 | yes | 3 | 0.01 | 88.53 | KSQLVWMACH | 88.53 | KSQLVWMACH | 9.18 | KSQLWMACN | 1.81 | | | |
| NP | N/A | 348 | 0.66 | yes | 3 | 0.04 | 99.33 | SQLVWMACHS | 88.39 | SQLVWMACHS | 9.15 | SQLVWMACNS | 1.79 | | | |

FIG. 74-278

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 349 | 0.66 | yes | 3 | 0.04 | 99.31 | QLWMACHSA | 88.37 | QLVWMACNSA | 9.15 | | | | |
| NP | N/A | 350 | 0.67 | yes | 3 | 0.05 | 99.27 | LVWMACHSAA | 88.32 | LVWMACNSA

FIG. 74-279

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 483 | 0.8 | yes | 3 | 0.01 | 99.55 | SFQR

FIG. 74-280

| Protein | Sub-type | Start Pos | Block Entropy | Gaps >10% | # to cover 99% | % Gap | Coverage | Included Peptides | Freq | Included Peptides | Freq | Included Peptides | Freq | Included Peptides | Freq | Included Peptides | Freq |
|---|---|---|---|---|---|---|---|---|---|---|---|---|---|---|---|---|---|
| NS1 | N/A | 48 | 0.64 | yes | 5 | 0.07 | 99.12 | PFLDRRRDQ | 88.71 | PF

FIG. 74-281

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NS1 | N/A | 290 | 0 | no | 1 | 99.99 | 100 | LKITENSFEQ | 100 | | | | | | |
| NS1 | N/A | 291 | 0 | no | 1 | 99.99 | 100 | KITENSFEQI | 100 | | | | | | |
| NS1 | N/A | 292 | 0 | no | 1 | 99.99 | 100 | ITENSFEQIT | 100 | | | | | | |
| NS1 | N/A | 293 | 0 | no | 1 | 99.99 | 100 | TENSFEQITF | 100 | | | | | | |
| NS1 | N/A | 294 | 0 | no | 1 | 99.99 | 100 | ENSFEQITFM | 100 | | | | | | |
| NS1 | N/A | 295 | 0 | no | 1 | 99.99 | 100 | NSFEQITFMQ | 100 | | | | | | |
| NS1 | N/A | 296 | 0 | no | 1 | 99.99 | 100 | SFEQITFMQA | 100 | | | | | | |
| NS1 | N/A | 297 | 0 | no | 1 | 99.99 | 100 | FEQITFMQAL | 100 | | | | | | |
| NS1 | N/A | 298 | 0 | no | 1 | 99.99 | 100 | EQITFMQALQ | 100 | | | | | | |
| NS1 | N/A | 299 | 0 | no | 1 | 99.99 | 100 | QITFMQALQL | 100 | | | | | | |
| NS2 | N/A | 1 | 0 | no | 1 | 99.99 | 100 | TAFSGMSANG | 100 | | | | | | |
| NS2 | N/A | 2 | 0 | no | 1 | 99.99 | 100 | AFSGMSANGD | 100 | | | | | | |
| NS2 | N/A | 3 | 0 | no | 1 | 99.99 | 100 | FSGMSANGDI | 100 | | | | | | |
| NS2 | N/A | 4 | 0 | no | 1 | 99.99 | 100 | SGMSANGDIL | 100 | | | | | | |
| NS2 | N/A | 5 | 0 | no | 1 | 99.95 | 100 | GMSANGDILM | 100 | | | | | | |
| NS2 | N/A | 14 | 0.86 | no | 2 | 99.95 | 100 | FQYLLFQDIL | 71.43 | FQVDCFLWHV | 28.6 | | | | |
| NS2 | N/A | 15 | 0.86 | no | 2 | 99.95 | 100 | QYLLFQDILM | 71.43 | QVDCFLWHVR | 28.6 | | | | |
| NS2 | N/A | 16 | 0.86 | no | 2 | 99.95 | 100 | YLLFQDILMR | 71.43 | VDCFLWHVRK | 28.6 | | | | |
| NS2 | N/A | 17 | 0.86 | no | 2 | 99.95 | 100 | LLFQDILMRM | 71.43 | DCFLWHVRKR | 28.6 | | | | |
| NS2 | N/A | 18 | 0.86 | no | 2 | 99.95 | 100 | LFQDILMRMS | 71.43 | CFLWHVRKRF | 28.6 | | | | |
| NS2 | N/A | 20 | 0 | no | 1 | 99.99 | 100 | LWHVRKRFAD | 100 | | | | | | |
| NS2 | N/A | 21 | 0 | no | 1 | 99.99 | 100 | WHVRKRFADQ | 100 | | | | | | |
| NS2 | N/A | 22 | 0 | no | 1 | 99.99 | 100 | HVRKRFADQE | 100 | | | | | | |
| NS2 | N/A | 23 | 0 | no | 1 | 99.99 | 100 | VRKRFADQEL | 100 | | | | | | |
| NS2 | N/A | 24 | 0 | no | 1 | 99.99 | 100 | RKRFADQELG | 100 | | | | | | |
| NS2 | N/A | 25 | 0 | no | 1 | 99.99 | 100 | KRFADQELGD | 100 | | | | | | |
| NS2 | N/A | 26 | 0 | no | 1 | 99.99 | 100 | RFADQELGDA | 100 | | | | | | |
| NS2 | N/A | 27 | 0 | no | 1 | 99.99 | 100 | FADQELGDAP | 100 | | | | | | |
| NS2 | N/A | 28 | 0 | no | 1 | 99.99 | 100 | ADQELGDAPF | 100 | | | | | | |
| NS2 | N/A | 29 | 0 | no | 1 | 99.99 | 100 | DQELGDAPFL | 100 | | | | | | |
| NS2 | N/A | 30 | 0 | no | 1 | 99.99 | 100 | QELGDAPFLD | 100 | | | | | | |
| NS2 | N/A | 31 | 0 | no | 1 | 99.99 | 100 | ELGDAPFLDR | 100 | | | | | | |
| NS2 | N/A | 32 | 0 | no | 1 | 99.99 | 100 | LGDAPFLDRL | 100 | | | | | | |
| NS2 | N/A | 33 | 0 | no | 1 | 99.99 | 100 | GDAPFLDRLR | 100 | | | | | | |
| NS2 | N/A | 34 | 0 | no | 1 | 99.99 | 100 | DAPFLDRLRR | 100 | | | | | | |
| NS2 | N/A | 35 | 0 | no | 1 | 99.99 | 100 | APFLDRLRRD | 100 | | | | | | |
| NS2 | N/A | 36 | 0 | no | 1 | 99.99 | 100 | PFLDRLRRDQ | 100 | | | | | | |
| NS2 | N/A | 37 | 0 | no | 1 | 99.99 | 100 | FLDRLRRDQK | 100 | | | | | | |
| NS2 | N/A | 38 | 0 | no | 1 | 99.99 | 100 | LDRLRRDQKS | 100 | | | | | | |
| NS2 | N/A | 39 | 0 | no | 1 | 99.99 | 100 | DRLRRDQKSL | 100 | | | | | | |
| NS2 | N/A | 40 | 0 | no | 1 | 99.99 | 100 | RLRRDQKSLR | 100 | | | | | | |
| NS2 | N/A | 41 | 0 | no | 1 | 99.99 | 100 | LRRDQKSLRG | 100 | | | | | | |

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 36 | 0.39 | yes | 4 | 0.05 | 99 | AAICTHLEVC | 95.45 | AAICTHLEIC | 1.14 | | | ASICTHLEVC | 0

FIG. 74-285

| Protein | Sub-type | Start Pos | Entropy Block | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 143 | 0.16 | yes | 2 | 0.05 | 99.18 | THIHIFSFTG | 98.45 | | | | | | |
| PA | N/A | 144 | 0.16 | yes | 2 | 0.05 | 99.17 | HIHIFSFTGE | 98.43 | | | | | | |
| PA | N/A | 145 | 0.15 | yes | 2 | 0.05 | 99.27 | IHIFSFTGEE | 98.53 | | | | | | |
| PA | N/A | 146 | 0.15 | yes | 2 | 0.05 | 99.27 | HIFSFTGEEM | 98.54 | | | | | | |
| PA | N/A | 147 | 0.16 | yes | 2 | 0.05 | 99.15 | IFSFTGEEMA | 98.41 | | | | | | |
| PA | N/A | 148 | 0.22 | yes | 4 | 0.06 | 99.27 | FSFTGEEMAT | 97.85 | FSFTGEEMAS | 0.36 | FSFIGEEMAT | 0.32 | SFIGEEMATIK | 0.32 |
| PA | N/A | 149 | 0.31 | yes | 5 | 0.04 | 99.16 | SFTGEEMATK | 96.72 | SFNGEEMATK | 0.74 | SFTGEEMASK | 0.36 | | |
| PA | N/A | 160 | 0.22 | yes | 2 | 0.04 | 99.04 | DYTLDEESRA | 97.91 | EYTLDEESRA | 0.24 | DYILDEESRA | 0.2 | | |
| PA | N/A | 161 | 0.17 | yes | 2 | 0.05 | 99.15 | YTIDEESRAR | 98.35 | | | | | | |
| PA | N/A | 162 | 0.16 | yes | 2 | 0.04 | 99.37 | TIDEESRARI | 98.46 | | | | | | |
| PA | N/A | 163 | 0.14 | yes | 1 | 0.03 | 100 | IDEESRARIK | 98.68 | | | | | | |
| PA | N/A | 164 | 0 | no | 1 | 99.99 | 100 | ASSKSRARIK | 100 | | | | | | |
| PA | N/A | 165 | 0.08 | yes | 1 | 0.03 | 99.37 | DEESRARIKT | 99.37 | | | | | | |
| PA | N/A | 166 | 0.08 | yes | 1 | 0.03 | 99.37 | EESRARIKTR | 99.37 | | | | | | |
| PA | N/A | 167 | 0.08 | yes | 1 | 0.03 | 99.55 | ESRARIKTRL | 99.55 | | | | | | |
| PA | N/A | 168 | 0.06 | yes | 1 | 0.03 | 99.26 | SRARIKTRLF | 99.26 | | | | | | |
| PA | N/A | 169 | 0.09 | yes | 1 | 0.04 | 99.19 | RARIKTRLFT | 99.19 | | | | | | |
| PA | N/A | 170 | 0.1 | yes | 1 | 0.03 | 99.11 | ARIKTRLFTI | 99.11 | | | | | | |
| PA | N/A | 171 | 0.11 | yes | 1 | 0.04 | 99.11 | RIKTRLFTIR | 99.11 | | | | | | |
| PA | N/A | 172 | 0.11 | yes | 1 | 0.04 | 99.07 | IKTRLFTIRQ | 99.07 | | | | | | |
| PA | N/A | 173 | 0.1 | yes | 1 | 0.04 | 99.17 | KTRLFTIRQE | 99.17 | | | | | | |
| PA | N/A | 174 | 0.14 | yes | 2 | 0.06 | 99.21 | TRLFTIRQEM | 98.79 | TRLFTIRQEL | 0.42 | | | | |
| PA | N/A | 175 | 0.14 | yes | 2 | 0.06 | 99.17 | RLFTIRQEMA | 98.75 | RLFTIRQELA | 0.42 | | | | |
| PA | N/A | 176 | 0.96 | yes | 3 | 0.07 | 99.1 | LFTIRQEMAS | 78.65 | LFTIRQEMAN | 18.6 | LFTIRQEMAI | 1.26 | LFTIRQEMAG | 0.24 |
| PA | N/A | 186 | 0.95 | yes | 3 | 0.06 | 99.19 | RGLWDSFRQS | 74.91 | RSLWDSFRQS | 23.7 | KGLWDSFRQS | 0.34 | RGLWDPFRQS | 0.38 |
| PA | N/A | 187 | 0.91 | yes | 3 | 0.06 | 99.21 | GLWDSFRQSE | 75.27 | SLWDSFRQSE | 23.7 | GLWDPFRQSE | 0.29 | | |
| PA | N/A | 188 | 0.13 | yes | 2 | 0.07 | 99.08 | LWDSFRQSER | 98.92 | LWDPFRQSER | 0.29 | | | | |
| PA | N/A | 189 | 0.11 | yes | 1 | 0.06 | 99.08 | WDSFRQSERG | 99.08 | | | | | | |
| PA | N/A | 190 | 0.11 | yes | 1 | 0.06 | 99.13 | DSFRQSERGE | 99.08 | | | | | | |
| PA | N/A | 191 | 0.25 | yes | 2 | 0.06 | 99.42 | SFRQSERGED | 97.05 | RQSERGEETV | 0.69 | ERGEETVEER | 0.68 | | |
| PA | N/A | 192 | 0.22 | yes | 3 | 0.06 | 99.21 | FRQSERGEDT | 97.34 | QSERGEETVE | 0.69 | RGEETVEERF | 0.68 | | |
| PA | N/A | 193 | 0.3 | yes | 3 | 0.06 | 99.37 | RQSERGEDTI | 96.46 | SERGEETIEE | 0.69 | GEETVEERFE | 0.68 | | |
| PA | N/A | 194 | 0.29 | yes | 3 | 0.07 | 99.21 | QSERGEDTIE | 96.61 | ERGEDTIEEK | 2.03 | EETVEERFEI | 0.68 | | |
| PA | N/A | 195 | 0.28 | yes | 3 | 0.06 | 99.41 | SERGEDTIEE | 96.67 | RGEDTIEERF | 2.04 | | | | |
| PA | N/A | 196 | 1.25 | yes | 4 | 0.06 | 99.36 | ERGEETIEEK | 48.93 | ERGEDTIEER | 47.7 | | | | |
| PA | N/A | 197 | 1.25 | yes | 4 | 0.07 | 99.35 | RGEETIEERF | 48.92 | RGEDTIEERF | 47.7 | | | | |
| PA | N/A | 198 | 1.28 | yes | 4 | 0.09 | 99.13 | GEETIEERFE | 48.81 | GEDTIEERFE | 47.6 | | | | |
| PA | N/A | 199 | 1.29 | yes | 4 | 0.1 | 99.04 | EETIEERFEI | 48.8 | EDTIEERFEI | 47.5 | | | | |
| PA | N/A | 201 | 0 | no | 1 | 99.99 | 100 | RSJEEKFEIT | 100 | | | | | | |
| PA | N/A | 216 | 0.39 | yes | 3 | 0.05 | 99.15 | LADQSLPPNF | 95.03 | LANQSLPPNF | 3.3 | LANYSLPPNF | 0.83 | | |
| PA | N/A | 217 | 0.42 | yes | 4 | 0.05 | 99.1 | ADQSLPPNFS | 94.7 | ANQSLPPNFS | 3.29 | ANYSLPPNFS | 0.83 | ADQSLPPNFP | 0.28 |
| PA | N/A | 231 | 0.33 | yes | 5 | 0.09 | 99.09 | FRAYVDGFEP | 96.49 | FRVYVDGFEP | 1.58 | FRWYVDGFEP | 0.53 | FRTYVDGFEP | 0.36 | FRTYVDGFKP | 0.13 |

FIG. 74-286

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 232 | 0.33 | yes | 5 | 0.09 | 99.08 | RAYVDGFEPN | 96.49 | RVYVDGFEPN | 1.58 | | | RTYVDGFKPN | 0.13 |
| PA | N/A | 233 | 0.33 | yes | 5 | 0.07 | 99.12 | AYVDGFEPNG | 96.48 | VYVDGFEPNG | 1.62 | | | TYVDGFKPNG | 0.13 |
| PA | N/A | 234 | 0.76 | yes | 4 | 0.05 | 99.02 | YVDGFEPNGC | 86.18 | YVDGFKPNGC | 1.1 | | | | |
| PA | N/A | 235 | 0.76 | yes | 4 | 0.06 | 99.03 | VDGFEPNGCI | 86.28 | VDGFKPNGCI | 1.1 | | | | |
| PA | N/A | 236 | 0.75 | yes | 5 | 0.05 | 99.13 | DGFEPNGCIE | 86.28 | DGFKPNGCIE | 1.1 | | | | |
| PA | N/A | 237 | 0.82 | yes | 5 | 0.05 | 99 | GFEPNGCIEG | 85.52 | GFKPNGCIEG | 1.1 | | | GFEPNGYIEG | 0.14 |
| PA | N/A | 238 | 0.82 | yes | 5 | 0.06 | 99.01 | FEPNGCIEGK | 85.52 | FKPNGCIEGK | 1.1 | | | FEPNGCIESK | 0.14 |
| PA | N/A | 239 | 0.81 | yes | 5 | 0.06 | 99.05 | EPNGCIEGKL | 85.55 | KPNGCIEGKL | 1.1 | | | EPNGCIEGKL | 0.14 |
| PA | N/A | 240 | 0.69 | yes | 3 | 0.06 | 99.1 | PNGCIEGKLS | 87.09 | PNGCIESKLS | 0.9 | | | | |
| PA | N/A | 241 | 0.68 | yes | 4 | 0.07 | 99.21 | NGCIEGKLSQ | 87.17 | NGCIESKLSQ | 0.91 | | | | |
| PA | N/A | 242 | 0.67 | yes | 3 | 0.07 | 99.21 | GCIEGKLSQM | 87.13 | GCIESKLSQM | 0.92 | | | | |
| PA | N/A | 243 | 0.71 | yes | 4 | 0.07 | 99.16 | CIEGKLSQMS | 86.92 | CIESKLSQMS | 0.92 | CIEGKLSQMP | 0.2 | | |
| PA | N/A | 244 | 0.32 | yes | 3 | 0.07 | 99.13 | IEGKLSQMSR | 96.31 | IESKLSQMSR | 1.95 | | | | |
| PA | N/A | 278 | 1.89 | yes | 4 | 0.07 | 99.18 | CSQRSKFLLM | 47.6 | CHQRSKFLLM | 24.1 | CFQRSKFLLM | 10.69 | | |
| PA | N/A | 279 | 1.89 | yes | 3 | 0.07 | 99.02 | SQRSKFLLMD | 47.59 | YQRSKFLLMD | 24.1 | FQRSKFLLMD | 10.69 | | |
| PA | N/A | 280 | 0.45 | yes | 2 | 0.07 | 99.02 | QRSKFLLMDA | 92.14 | QRSKFLLMD | 7.28 | | | | |
| PA | N/A | 281 | 0.46 | yes | 2 | 0.08 | 99.41 | RSKFLLMDAL | 92.07 | RSKFLLMDS | 7.28 | | | | |
| PA | N/A | 282 | 0.43 | yes | 2 | 0.08 | 99.35 | SKFLLMDALK | 92.32 | SKFLLMDSLK | 7.27 | | | | |
| PA | N/A | 283 | 0.43 | yes | 2 | 0.08 | 99.59 | KFLLMDALKL | 92.35 | KFLLMDSLKL | 7.27 | | | | |
| PA | N/A | 284 | 0.45 | yes | 2 | 0.08 | 99.62 | FLLMDALKLS | 92.18 | FLLMDSLKLS | 7.26 | | | | |
| PA | N/A | 285 | 0.46 | yes | 2 | 0.09 | 99.44 | LLMDALKLSI | 92.04 | LLMDSLKLSI | 7.26 | | | | |
| PA | N/A | 286 | 0.46 | yes | 2 | 0.09 | 99.29 | LMDALKLSIE | 92.06 | LMDSLKLSIE | 7.24 | | | | |
| PA | N/A | 287 | 0.49 | yes | 2 | 0.09 | 99.31 | MDALKLSIED | 91.79 | MDSLKLSIED | 7.24 | | | | |
| PA | N/A | 288 | 0.55 | yes | 5 | 0.1 | 99.03 | DALKLSIEDP | 91.79 | DSLKLSIEDP | 5.37 | | | | |
| PA | N/A | 290 | 0.56 | yes | 5 | 0.09 | 99.04 | LKLSIEDPSH | 92.02 | LKLSIEDPNH | 5.37 | LKLSIEDPDH | 1.34 | LKLSIEPSH | 0.23 | LKLSIEEPSH | 0.15 |
| PA | N/A | 291 | 0.56 | yes | 5 | 0.12 | 99.12 | KLSIEDPSHE | 91.97 | KLSIEDPNHE | 5.38 | KLSIEDPDHE | 1.34 | KLSIEPSHE | 0.23 | KLSIEEPSHE | 0.15 |
| PA | N/A | 292 | 0.56 | yes | 5 | 0.11 | 99.06 | LSIEDPSHEG | 91.97 | LSIEDPNHEG | 5.37 | LSIEDPDHEG | 1.34 | LSIENPSHEG | 0.23 | LSIEEPSHEG | 0.15 |
| PA | N/A | 293 | 0 | no | 1 | 99.99 | 100 | KASKEPEVHE | 100 | | | | | | | |
| PA | N/A | 294 | 0 | no | 1 | 99.99 | 100 | ASKEPEVHEG | 100 | | | | | | | |
| PA | N/A | 295 | 0.56 | yes | 5 | 0.11 | 99.03 | SIEDPSHEGE | 91.94 | SIEDPNHEGE | 5.37 | SIEDPDHEGE | 1.34 | SIENPSHEGE | 0.23 | SIEEPSHEGE | 0.15 |
| PA | N/A | 296 | 0.54 | yes | 5 | 0.11 | 99.06 | IEDPSHEGEG | 92.11 | IEDPNHEGEG | 5.38 | IEDPDHEGEG | 1.34 | IENPSHEGEG | 0.23 | |
| PA | N/A | 297 | 0.54 | yes | 5 | 0.12 | 99.12 | EDPSHEGEGI | 92.18 | EDPNHEGEGI | 5.38 | EDPDHEGEGI | 1.34 | ENPSHEGEGI | 0.23 | |
| PA | N/A | 298 | 0.54 | yes | 3 | 0.1 | 99.2 | DPSHEGEGIP | 92.16 | DPNHEGEGIP | 5.39 | DPDHEGEGIP | 1.34 | NPSHEGEGIP | 0.23 | |
| PA | N/A | 299 | 0.51 | yes | 5 | 0.1 | 99.11 | PSHEGEGIPL | 92.47 | PNHEGEGIPL | 5.37 | PDHEGEGIPL | 1.35 | | | SIEEPSHEGE | 0.15 |
| PA | N/A | 300 | 0.57 | yes | 4 | 0.08 | 99.17 | SHEGEGIPLY | 91.83 | NHEGEGIPLY | 5.38 | DHEGEGIPLY | 1.35 | SHEGEGIPLH | 0.43 | SHEGEGIPLC | 0.18 |
| PA | N/A | 301 | 0.14 | yes | 3 | 0.08 | 99.2 | HEGEGIPLYD | 98.76 | HEGEGIPLY | 0.44 | | | | | |
| PA | N/A | 302 | 0.13 | yes | 5 | 0.08 | 99.26 | EGEGIPLYDA | 98.82 | EGEGIPLYDA | 0.44 | GEGIPLHDAI | 0.42 | EGIPLYDAVK | 0.28 | |
| PA | N/A | 303 | 0.28 | yes | 2 | 0.08 | 99.24 | GEGIPLYDAI | 96.76 | GEGIPLYDAV | 2.06 | EGIPLHDAIK | 0.42 | GIPLYDAVKC | 0.28 | |
| PA | N/A | 304 | 0.31 | yes | 4 | 0.08 | 99.07 | EGIPLYDAIK | 96.59 | EGIPLYDAVR | 1.78 | GIPLHDAIKC | 0.42 | | | |
| PA | N/A | 305 | 0.3 | yes | 4 | 0.08 | 99.11 | GIPLYDAIKC | 96.63 | GIPLYDAVRC | 1.78 | | | | | |
| PA | N/A | 353 | 0 | no | 1 | 99.99 | 100 | LKDEEKIPKT | 100 | | | | | | | |
| PA | N/A | 371 | 0.44 | yes | 5 | 0.05 | 99.23 | LKWALGENMA | 94.48 | LRWALGENMA | 2.93 | LKWVLGENMA | 0.75 | LKWTLGENMA | 0.61 | LMWALGENMA | 0.46 |

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 472 | 0.25 | yes | 4 | 0.02 | 99 | YINTALLNAS | 97.52 | YMNTALLNAS | 0.51 | YINTAMLNAS | 0.42 | | |
| PA | N/A | 473 | 0.23 | yes | 4 | 0.03 | 99.21 | INTALLNASC | 97.73 | MNTALLNASC | 0.51 | INTAMLNASC | 0.42 | | |
| PA | N/A | 474 | 0.13 | yes | 2 | 0.03 | 99.25 | NTALLNASCA | 98.84 | | | | | | |
| PA | N/A | 475 | 0.15 | yes | 2 | 0.03 | 99.13 | TALLNASCAA | 98.71 | | | | | | |
| PA | N/A | 476 | 0.14 | yes | 2 | 0.04 | 99.16 | ALLNASCAAM | 98.74 | | | | | | |
| PA | N/A | 477 | 0.18 | yes | 3 | 0.05 | 99.08 | LLNASCAAMD | 98.41 | LLNASCAAME | 0.24 | | | | |
| PA | N/A | 478 | 0.24 | yes | 4 | 0.05 | 99.17 | LNASCAAMDD | 97.62 | LNASCAAMED | 0.24 | LNSSCAAMDD | 0.22 | | |
| PA | N/A | 479 | 0.25 | yes | 4 | 0.05 | 99.04 | NASCAAMDDF | 97.52 | NASCAAMEDF | 0.24 | NSSCAAMDDF | 0.22 | | |
| PA | N/A | 480 | 0.24 | yes | 4 | 0.05 | 99.06 | ASCAAMDDFQ | 97.53 | ASCAAMEDFQ | 0.24 | SSCAAMDDFQ | 0.22 | | |
| PA | N/A | 481 | 0.23 | yes | 3 | 0.05 | 99.01 | SCAAMDDFQL | 97.68 | SCAAMEDFQL | 0.25 | | | | |
| PA | N/A | 482 | 0.24 | yes | 4 | 0.04 | 99.06 | CAAMDDFQLI | 97.67 | CAAMEDFQLI | 0.25 | CTAMDDFQLI | 0.12 | | |
| PA | N/A | 483 | 0.24 | yes | 4 | 0.03 | 99.11 | AAMDDFQLIP | 97.71 | AAMEDFQLIP | 0.25 | TAMDDFQLIP | 0.13 | | |
| PA | N/A | 484 | 0.22 | yes | 3 | 0.05 | 99.11 | AMDDFQLIPM | 97.75 | AMEDFQLIPM | 0.25 | | | | |
| PA | N/A | 485 | 0.23 | yes | 3 | 0.04 | 99.02 | MDDFQLIPMI | 97.65 | MEDFQLIPMI | 0.25 | | | | |
| PA | N/A | 486 | 0.24 | yes | 3 | 0.03 | 99.13 | DDFQLIPMIS | 98.91 | EDFQLIPMIS | 0.25 | | | | |
| PA | N/A | 487 | 0.22 | yes | 3 | 0.04 | 99.08 | DFQLIPMISK | 98.84 | DYQLIPMISK | 0.12 | | | | |
| PA | N/A | 488 | 0.13 | yes | 2 | 0.05 | 99.06 | FQLIPMISKC | 98.71 | | | | | | |
| PA | N/A | 489 | 0.14 | yes | 2 | 0.05 | 99.03 | QLIPMISKCR | 97.19 | | | | | | |
| PA | N/A | 490 | 0.16 | yes | 3 | 0.05 | 99.04 | LIPMISKCRT | 97.2 | LIPMISKSRT | 0.2 | | | | |
| PA | N/A | 491 | 0.27 | yes | 4 | 0.05 | 99.02 | IPMISKCRTK | 97.27 | IPMISKCKTK | 0.2 | IPMISNCRTK | 0.13 | | |
| PA | N/A | 492 | 0.27 | yes | 4 | 0.05 | 99.02 | PMISKCRTRE | 97.38 | PMISKCRTKE | 1.5 | PMISKCKTKE | 0.17 | PMISKCRTKE | 0.14 |
| PA | N/A | 493 | 0.27 | yes | 4 | 0.05 | 99.08 | MISKCRTREG | 96.87 | MISKCRTKEG | 1.5 | MISKCKTKEG | 0.17 | MISKSRTKEG | 0.14 |
| PA | N/A | 494 | 0.26 | yes | 4 | 0.05 | 99.06 | ISKCRTREGR | 96.95 | ISKCRTKEGR | 1.5 | ISKCKTKEGR | 0.17 | ISKSRTKEGR | 0.14 |
| PA | N/A | 495 | 0.25 | yes | 3 | 0.03 | 99.08 | SKCRTREGRR | 97.08 | SKCRTKEGRR | 1.5 | | | | |
| PA | N/A | 496 | 0.3 | yes | 4 | 0.03 | 99.15 | KCRTREGRRK | 97.29 | KCRTKEGRRK | 1.49 | KCKTKEGRRK | 0.18 | | |
| PA | N/A | 497 | 0.29 | yes | 4 | 0.01 | 99.09 | CRTREGRRKT | 97.43 | CRTKEGRRKT | 1.49 | CKTKEGRRKT | 0.18 | | |
| PA | N/A | 498 | 0.27 | yes | 3 | 0.01 | 99.3 | RTREGRRKTN | 98.98 | RTKEGRRKTN | 1.49 | | | | |
| PA | N/A | 499 | 0.25 | yes | 3 | 0.01 | 99.44 | TREGRRKTNL | 98.89 | TKEGRRKTNL | 1.49 | | | | |
| PA | N/A | 500 | 0.23 | yes | 3 | 0.01 | 99.52 | REGRRKTNLY | 98.57 | KEGRRKTNLY | 0.54 | | | | |
| PA | N/A | 501 | 0.11 | yes | 2 | 0.01 | 99.43 | EGRRKTNLYG | 98.57 | | | | | | |
| PA | N/A | 502 | 0.12 | yes | 2 | 0.01 | 99.11 | GRRKTNLYGF | 93.43 | | | | | | |
| PA | N/A | 503 | 0.16 | yes | 3 | 0.02 | 99.02 | RRKTNLYGFI | 5.21 | RRTNLYGFII | 0.38 | | | | |
| PA | N/A | 504 | 0.45 | yes | 3 | 0.03 | 99.04 | RKTNLYGFIV | 5.2 | RTNLYGFIIK | 0.38 | | | | |
| PA | N/A | 505 | 0.44 | yes | 2 | 0.03 | 99.2 | KTNLYGFIIK | 5.36 | | | | | | |
| PA | N/A | 506 | 0.4 | yes | 2 | 0.02 | 99.23 | TNLYGFIIKG | 5.38 | | | | | | |
| PA | N/A | 507 | 0.39 | yes | 2 | 0.03 | 99.26 | NLYGFIIKGR | 5.38 | | | | | | |
| PA | N/A | 508 | 0.39 | yes | 2 | 0.03 | 99.26 | LYGFIIKGRS | 5.38 | | | | | | |
| PA | N/A | 509 | 0.39 | yes | 2 | 0.03 | 99.27 | YGFIIKGRSH | 5.37 | | | | | | |
| PA | N/A | 510 | 0.39 | yes | 2 | 0.04 | 93.9 | GFIIKGRSHL | 5.37 | | | | | | |
| PA | N/A | 511 | 0.39 | yes | 2 | 0.04 | 93.88 | FIIKGRSHLR | | | | | | | |
| PA | N/A | 512 | 0.38 | yes | 2 | 0.04 | 93.97 | IIKGRSHLRN | | | | | | | |
| PA | N/A | 513 | 0.35 | yes | 2 | 0.03 | 94.29 | IKGRSHLRND | | | | | | | |

FIG. 74-289

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 514 | 0.04 | yes | 1 | 0.03 | 99.68 | KGRSHLRNDT | 99.68 | | | | | | |
| PA | N/A | 515 | 0.05 | yes | 1 | 0.03 | 99.62 | GRSHLRNDTD | 99.62 | | | | | | |
| PA | N/A | 516 | 0.05 | yes | 1 | 0.03 | 99.63 | RSHLRNDTDV | 99.63 | | | | | | |
| PA | N/A | 517 | 0.05 | yes | 1 | 0.02 | 99.66 | SHLRNDTDVW | 99.66 | | | | | | |
| PA | N/A | 518 | 0.06 | yes | 1 | 0.02 | 99.58 | HLRNDTDVWN | 99.58 | | | | | | |
| PA | N/A | 519 | 0.15 | yes | 2 | 0.02 | 99.57 | LRNDTDVWNF | 98.41 | LRNDTDVWNY | 1.16 | | | | |
| PA | N/A | 520 | 0.23 | yes | 3 | 0.02 | 99.52 | RNDTDVWNFV | 97.43 | RNDTDVWNYV | 1.16 | RNDTDVWNFL | 0.93 | | |
| PA | N/A | 521 | 0.23 | yes | 3 | 0.02 | 99.53 | NDTDVWNFVS | 97.43 | NDTDVWNYVS | 1.16 | NDTDVWNFLS | 0.93 | | |
| PA | N/A | 522 | 0.23 | yes | 3 | 0.02 | 99.54 | DTDVWNFVSM | 97.44 | DTDVWNYVSM | 1.16 | DTDVWNFLSM | 0.93 | | |
| PA | N/A | 523 | 0.23 | yes | 3 | 0.02 | 99.55 | TDVWNFVSME | 97.46 | TDVWNYVSME | 1.16 | TDVWNFLSME | 0.93 | | |
| PA | N/A | 524 | 0.23 | yes | 3 | 0.02 | 99.57 | DVWNFVSMEF | 97.48 | DVWNYVSMEF | 1.16 | DVWNFLSMEF | 0.93 | | |
| PA | N/A | 525 | 0 | no | 1 | 99.99 | 100 | GSLNFVSMEF | 100 | | | | | | |
| PA | N/A | 526 | 0.22 | yes | 3 | 0.02 | 99.62 | VVNFVSMEFS | 97.52 | VVNYVSMEFS | 1.16 | VVNFLSMEFS | 0.93 | | |
| PA | N/A | 527 | 0.22 | yes | 3 | 0.01 | 99.58 | VNFVSMEFSL | 97.49 | VNYVSMEFSL | 1.16 | VNFLSMEFSL | 0.93 | | |
| PA | N/A | 528 | 0.25 | yes | 3 | 0.03 | 99.4 | NFVSMEFSLT | 97.25 | NYVSMEFSLT | 1.16 | NFLSMEFSLT | 0.99 | | |
| PA | N/A | 529 | 0.25 | yes | 3 | 0.03 | 99.37 | FVSMEFSLTD | 97.22 | YVSMEFSLTD | 1.16 | FLSMEFSLTD | 0.99 | | |
| PA | N/A | 530 | 0.16 | yes | 2 | 0.03 | 99.38 | VSMEFSLTDP | 98.39 | LSMEFSLTDP | 0.99 | | | | |
| PA | N/A | 531 | 0.12 | yes | 2 | 0.03 | 99.29 | SMEFSLTDPR | 98.94 | SMEFSLTDPK | 0.34 | | | | |
| PA | N/A | 532 | 0.2 | yes | 3 | 0.03 | 99.11 | MEFSLTDPRL | 98.07 | MEFSLTDPRF | 0.7 | MEFSLTDPKL | 0.34 | | EFSLVDPRLE |
| PA | N/A | 533 | 0.22 | yes | 3 | 0.05 | 99.08 | EFSLTDPRLE | 97.87 | EFSLTDPRFE | 0.7 | EFSLTDPKLE | 0.33 | | PLFLYVRTNG | 0.18 |
| PA | N/A | 569 | 0.22 | yes | 3 | 0.04 | 99.01 | PMFLYVRTNG | 95.44 | PMFLYRTNG | 2.44 | PIFLYVRTNG | 0.55 | | LFLYVRTNGT | 0.32 |
| PA | N/A | 570 | 0.39 | yes | 4 | 0.05 | 99.18 | MFLYIRTNGT | 95.71 | MFLYVRTNGT | 2.44 | IFLYVRTNGT | 0.55 | | | 0.32 |
| PA | N/A | 571 | 0.36 | yes | 5 | 0.04 | 99.27 | FLYIRTNGTS | 96.63 | | | | | | |
| PA | N/A | 572 | 0.27 | yes | 2 | 0.03 | 99.26 | LYIRTNGTSK | 96.72 | | | | | | |
| PA | N/A | 573 | 0.84 | yes | 4 | 0.03 | 99.31 | YIRTNGTSKI | 82.6 | YIRTNGTSKV | 14.1 | YIRTNGTSKI | 2.53 | | SMFLYVRTNG | 0.27 |
| PA | N/A | 574 | 0.83 | yes | 4 | 0.05 | 99.58 | VRTNGTSKIK | 82.65 | VRTNGTSKVK | 14.1 | IRTNGTSKIK | 2.53 | | | |
| PA | N/A | 575 | 0.65 | yes | 2 | 0.03 | 99.61 | RTNGTSKIKM | 85.37 | RTNGTSKVKM | 14.2 | | | | |
| PA | N/A | 576 | 0.64 | yes | 2 | 0.04 | 99.52 | TNGTSKIKMK | 85.41 | TNGTSKVKMK | 14.2 | | | | |
| PA | N/A | 577 | 0.64 | yes | 2 | 0.03 | 99.42 | NGTSKIKMKW | 85.43 | NGTSKVKMKW | 14.2 | | | | |
| PA | N/A | 578 | 0.65 | yes | 2 | 0.03 | 99.57 | GTSKIKMKWG | 85.34 | GTSKVKMKWG | 14.2 | | | | |
| PA | N/A | 579 | 0.66 | yes | 2 | 0.03 | 99.31 | TSKIKMKWGM | 85.25 | TSKVKMKWGM | 14.2 | | | | |
| PA | N/A | 580 | 0.64 | yes | 2 | 0.02 | 99.29 | SKIKMKWGME | 85.38 | SKVKMKWGME | 14.2 | | | | |
| PA | N/A | 581 | 0.77 | yes | 3 | 0.02 | 99.29 | KIKMKWGMEM | 83.8 | KVKMKWGMEM | 14.2 | KIKMKWGMEL | 1.34 | | | |
| PA | N/A | 582 | 0.77 | yes | 3 | 0.02 | 99.21 | IKMKWGMEMR | 83.81 | VKMKWGMEMR | 14.2 | IKMKWGMELR | 1.34 | | | |
| PA | N/A | 583 | 0.19 | yes | 2 | 0.02 | 99.18 | KMKWGMEMRR | 97.92 | KMKWGMELRR | 1.37 | | | | |
| PA | N/A | 584 | 0.2 | yes | 2 | 0.02 | 99.27 | MKWGMEMRRC | 97.92 | MKWGMELRRC | 1.37 | | | | |
| PA | N/A | 585 | 0.21 | yes | 2 | 0.02 | 99.3 | KWGMEMRRCL | 97.85 | KWGMELRRCL | 1.37 | | | | |
| PA | N/A | 586 | 0.21 | yes | 2 | 0.02 | 99.17 | WGMEMRRCLL | 97.81 | WGMELRRCLL | 1.37 | | | | |
| PA | N/A | 587 | 0.2 | yes | 2 | 0.02 | 99.27 | GMEMRRCLLQ | 97.81 | GMELRRCLLQ | 1.37 | | | | |
| PA | N/A | 588 | 0.19 | yes | 2 | 0.02 | 99.3 | MEMRRCLLQS | 97.9 | MELRRCLLQS | 1.37 | | | | |
| PA | N/A | 589 | 0.19 | yes | 2 | 0.02 | 93.3 | EMRRCLLQSL | 97.93 | ELRRCLLQSL | 1.37 | | | | |
| PA | N/A | 590 | 0.19 | yes | 2 | 0.03 | 99.35 | MRRCLLQSLQ | 97.98 | LRRCLLQSLQ | 1.37 | | | | |

| Protein | Sub-type | Start Pos | Block Entropy | Gaps > 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 718 | 1.5 | no | 3 | 99.97 | 100 | SSLTHALREL | 50 | | | | | | |
| PA | N/A | 719 | 0.92 | no | 2 | 99.98 | 100 | SLTHALRELW | 66.67 | SFLAHALKLV | 25 | SFLTHALRFL | 25 | | | |
| PA | N/A | 720 | 0.92 | no | 2 | 99.98 | 100 | LTHALRELWQ | 66.67 | FLAHALKLVV | 33.3 | | | | | |
| PA | N/A | 721 | 0.92 | no | 2 | 99.98 | 100 | THALRELWQC | 66.67 | LAHALKLVVA | 33.3 | | | | | |
| PA | N/A | 722 | 0.92 | no | 2 | 99.98 | 100 | HALRELWQCY | 66.67 | AHALKLVVAM | 33.3 | | | | | |
| PA | N/A | 723 | 0 | no | 1 | 99.99 | 100 | ALRELWQCYL | 100 | HALKLVVAML | 33.3 | | | | | |
| PA | N/A | 724 | 0 | no | 1 | 99.99 | 100 | LRELWQCYLL | 100 | | | | | | | |
| PA | N/A | 725 | 0 | no | 1 | 99.99 | 100 | RELWQCYLLL | 100 | | | | | | | |
| PB1 | N/A | 1 | 0.11 | yes | 3 | 6.57 | 99.14 | MDVNPTLLFL | 99.15 | | | | | | | |
| PB1 | N/A | 2 | 0.15 | yes | 5 | 6.34 | 99.09 | DVNPTLLFLK | 98.83 | DVNPTLLFLE | 0.16 | DVNPTLLFLR | 0.1 | VNPTLLFLKM | 0.16 | VNPTLLFLRV | 0.1 |
| PB1 | N/A | 3 | 0.97 | yes | 5 | 5.85 | 99.01 | VNPTLLFLKV | 74.31 | VNPTLLFLKI | 24.3 | VNPTLLFLEV | 0.16 | NPTLLFLKMP | 0.16 |
| PB1 | N/A | 4 | 0 | no | 1 | 100 | 100 | INPTLLFLKV | 100 | | | | | | | |
| PB1 | N/A | 5 | 0.98 | yes | 3 | 5.58 | 99.01 | NPTLLFLKVP | 74.22 | NPTLLFLKIP | 24.3 | HPTLLFLKVP | 0.21 | | |
| PB1 | N/A | 9 | 0 | no | 1 | 99.98 | 100 | YFFLKVPVQN | 100 | | | | | | | |
| PB1 | N/A | 15 | 0.67 | yes | 3 | 1.09 | 99.27 | PAQNAISTFP | 86.48 | PAQNAISTF | 12.4 | | | | | |
| PB1 | N/A | 16 | 0.66 | yes | 3 | 0.74 | 99.31 | AQNAISTFPY | 86.56 | AQNAISITFP | 12.4 | | | | | |
| PB1 | N/A | 17 | 0.11 | yes | 2 | 0.72 | 99.01 | QNAISTFPYT | 99.01 | | | | | | | |
| PB1 | N/A | 18 | 0.08 | yes | 2 | 0.65 | 99.06 | NAISTFPYTG | 99.06 | | | | | | | |
| PB1 | N/A | 19 | 0.09 | yes | 2 | 0.61 | 99.24 | AISTFPYTG | 99.24 | | | | | | | |
| PB1 | N/A | 20 | 0.03 | yes | 2 | 0.23 | 99.29 | ISTTFPYTGD | 99.29 | | | | | | | |
| PB1 | N/A | 21 | 0.04 | yes | 2 | 0.22 | 99.3 | STTFPYTGDP | 99.3 | | | | | | | |
| PB1 | N/A | 22 | 0.04 | yes | 2 | 0.2 | 99.32 | TTFPYTGDPP | 99.32 | | | | | | | |
| PB1 | N/A | 23 | 0.03 | yes | 2 | 0.2 | 99.8 | TFPYTGDPPY | 99.8 | | | | | | | |
| PB1 | N/A | 24 | 0.03 | yes | 2 | 0.18 | 99.76 | FPYTGDPPYS | 99.76 | | | | | | | |
| PB1 | N/A | 25 | 0.03 | yes | 2 | 0.16 | 99.75 | PYTGDPPYSH | 99.75 | | | | | | | |
| PB1 | N/A | 26 | 0.04 | yes | 2 | 0.14 | 99.77 | YTGDPPYSHG | 99.77 | | | | | | | |
| PB1 | N/A | 27 | 0.03 | yes | 2 | 0.13 | 99.76 | TGDPPYSHGT | 99.76 | | | | | | | |
| PB1 | N/A | 28 | 0.03 | yes | 2 | 0.12 | 99.76 | GDPPYSHGTG | 99.76 | | | | | | | |
| PB1 | N/A | 29 | 0.03 | yes | 2 | 0.12 | 99.76 | DPPYSHGTGT | 99.76 | | | | | | | |
| PB1 | N/A | 30 | 0.04 | yes | 2 | 0.12 | 99.81 | PPYSHGTGTG | 99.81 | | | | | | | |
| PB1 | N/A | 31 | 0.08 | yes | 2 | 0.11 | 99.74 | PYSHGTGTGY | 99.74 | | | | | | | |
| PB1 | N/A | 32 | 0.07 | yes | 2 | 0.11 | 99.67 | YSHGTGTGYT | 99.67 | | | | | | | |
| PB1 | N/A | 33 | 0.11 | yes | 2 | 0.11 | 99.34 | SHGTGTGYTM | 99.34 | | | | | | | |
| PB1 | N/A | 34 | 0.08 | yes | 2 | 0.12 | 99.35 | HGTGTGYTMD | 99.35 | | | | | | | |
| PB1 | N/A | 35 | 0.08 | yes | 2 | 0.12 | 99.39 | GTGTGYTMDT | 99.39 | | | | | | | |
| PB1 | N/A | 36 | 0.07 | yes | 2 | 0.11 | 99.35 | TGTGYTMDTV | 99.35 | GTGYTMDTVS | 0.3 | | | | | |
| PB1 | N/A | 37 | 0.12 | yes | 2 | 0.04 | 99.25 | GTGYTMDTVN | 98.95 | TGYTMDTVSR | 0.3 | | | | | |
| PB1 | N/A | 38 | 0.11 | yes | 2 | 0.05 | 99.26 | TGYTMDTVNR | 98.96 | GYTMDTVSRT | 0.3 | | | | | |
| PB1 | N/A | 39 | 0.12 | yes | 2 | 0.04 | 99.27 | GYTMDTVNRT | 98.97 | YTMDTVSRTH | 0.3 | | | | | |
| PB1 | N/A | 40 | 0.08 | yes | 2 | 0.04 | 99.28 | YTMDTVNRTH | 98.98 | TMDTVSRTHQ | 0.3 | | | | | |
| PB1 | N/A | 41 | 0.11 | yes | 2 | 0.03 | 99.16 | TMDTVNRTHQ | 98.86 | MDTVSRTHQY | 0.3 | | | | | |
| PB1 | N/A | 42 | 0.12 | yes | 2 | 0.02 | 99.21 | MDTVNRTHQY | 98.91 | | | | | | | |

FIG. 74-293

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 43 | 0.1 | yes | 1 | 0.02 | 99.19 | DTVNRTHQYS | 99.19 | | | | | | |
| PBI | N/A | 44 | 0.11 | yes | 1 | 0.03 | 99.1 | TVNRTHQYSE | 99.1 | | | | | | |
| PBI | N/A | 45 | 0.74 | yes | 3 | 0.02 | 99.24 | VNRTHQYSEK | 83.73 | VSRTHQYSEK | 15.2 | VNRTHQYSER | 0.3 | | |
| PBI | N/A | 46 | 0.74 | yes | 3 | 0.02 | 99.27 | NRTHQYSEKG | 83.74 | SRTHQYSEKG | 15.2 | NRTHQYSERG | 0.3 | | |
| PBI | N/A | 47 | 1.05 | yes | 4 | 0.02 | 99.12 | RTHQYSEKGK | 81.16 | RTHQYSERGK | 8.55 | RTHQYSEKGR | 2.77 | | |
| PBI | N/A | 48 | 1.05 | yes | 5 | 0.01 | 99.13 | THQYSEKGKW | 81.17 | THQYSERGKW | 8.55 | THQYSEKGRW | 2.77 | | |
| PBI | N/A | 61 | 0.67 | yes | 5 | 0.01 | 99.03 | SETGAPQLNP | 89.63 | THQYSERGK | 8.55 | TETKAPQLNP | 0.54 | TETGALQLNP | 0.4 |
| PBI | N/A | 62 | 0.3 | yes | 4 | 0.01 | 99.12 | EIGAPQLNPI | 96.96 | TEIGAPQLNP | 7.55 | ETIKAPQLNP | 0.54 | ETGAPQLNPV | 0.27 |
| PBI | N/A | 63 | 0.3 | yes | 2 | 0.01 | 99.12 | ETGAPQLNPI | 96.98 | ETIKAPQLNP | 0.94 | ETGALQLNPI | 0.4 | TGAPQLNPVD | 0.27 |
| PBI | N/A | 64 | 0.22 | yes | 2 | 0.01 | 99.15 | TGAPQLNPID | 97.93 | TKAPQLNPID | 0.94 | TGALQLNP | 0.4 | | |
| PBI | N/A | 65 | 0.12 | yes | 1 | 0.01 | 99.28 | GAPQLNPIDG | 98.88 | GALQLNPIDG | 0.55 | GAPQLNPVDG | 0.27 | | |
| PBI | N/A | 66 | 0.13 | yes | 1 | 0.01 | 99.26 | APQLNPIDGP | 98.85 | ALQLNPIDGP | 0.4 | | | | |
| PBI | N/A | 67 | 0.08 | yes | 1 | 0.01 | 99.36 | PQLNPIDGPL | 99.36 | LQLNPIDGPL | 0.4 | | | | |
| PBI | N/A | 68 | 0.36 | yes | 4 | 0.02 | 99.25 | QLNPIDGPLP | 99.54 | LNPIDGPLPK | 2.4 | LNPIDGPLPV | 0.98 | DNEPNGYAQT | 0.24 |
| PBI | N/A | 78 | 0.38 | yes | 5 | 0.04 | 99.14 | LNPIDGPLPE | 95.71 | DNEPTGYAQT | 1.8 | NNEPSGYAQT | 1.03 | | |
| PBI | N/A | 79 | 0.29 | yes | 2 | 0.05 | 99.24 | DNEPSGYAQT | 96.73 | NEPTGYAQTD | 1.85 | NDPSGYAQTD | 0.36 | | |
| PBI | N/A | 80 | 0.29 | yes | 2 | 0.04 | 99.29 | NEPSGYAQTD | 97.04 | EPTGYAQTDC | 1.84 | DPSGYAQTDC | 0.36 | | |
| PBI | N/A | 81 | 0.22 | yes | 1 | 0.04 | 99.2 | EPSGYAQTDC | 97.45 | PTGYAQTDCV | 1.84 | | | | |
| PBI | N/A | 82 | 0.23 | yes | 1 | 0.05 | 99.2 | PGYAQTDCVL | 97.37 | TGYAQTDCVL | 1.84 | | | | |
| PBI | N/A | 83 | 0.06 | yes | 1 | 0.04 | 99.57 | SGYAQTDCVL | 97.57 | | | | | | |
| PBI | N/A | 84 | 0.06 | yes | 1 | 0.05 | 99.53 | YAQTDCVLEA | 99.53 | | | | | | |
| PBI | N/A | 85 | 0.07 | yes | 2 | 0.04 | 99.48 | AQTDCVLEAM | 99.48 | TDCVLEAMAL | 0.33 | | | | |
| PBI | N/A | 86 | 0.07 | yes | 2 | 0.05 | 99.5 | QTDCVLEAMA | 99.5 | DCVLEAMALL | 0.33 | VLEAMAFLED | 0.18 | |
| PBI | N/A | 87 | 0.12 | yes | 5 | 0.07 | 99.26 | TDCVLEAMAF | 98.93 | CVLEAMALLE | 0.33 | VLEAMALLEE | 0.33 | LEAMAFLEDS | 0.18 |
| PBI | N/A | 88 | 0.12 | yes | 5 | 0.07 | 99.29 | DCVLEAMAFL | 98.96 | VLEAMAFLEK | 2.45 | LEAMALLEES | 0.33 | EAMAFLEDSH | 0.18 |
| PBI | N/A | 89 | 0.37 | yes | 5 | 0.09 | 99.2 | CVLEAMAFLE | 98.87 | LEAMAFLEES | 2.45 | EAMALLEESH | 0.33 | AMAFLEDSHP | 0.18 |
| PBI | N/A | 90 | 0.38 | yes | 5 | 0.09 | 99.1 | VLEAMAFLEE | 95.62 | EAMAFLEKSH | 2.46 | AMALLEESHP | 0.33 | MAFLEDSHPG | 0.18 |
| PBI | N/A | 91 | 0.37 | yes | 4 | 0.05 | 99.01 | LEAMAFLEEK | 95.68 | AMAFLEKSHP | 2.46 | MALLEESHPG | 0.33 | LEESHPGIFG | 0.39 |
| PBI | N/A | 92 | 0.38 | yes | 4 | 0.09 | 99.07 | EAMAFLEESH | 95.65 | MAFLEKSHPG | 2.45 | LEESHPGIFE | 0.43 | | |
| PBI | N/A | 93 | 0.38 | yes | 5 | 0.05 | 99.05 | AMAFLEESHP | 95.66 | MAFLEKSHPG | 2.46 | LENSHPGIFE | 0.31 | | |
| PBI | N/A | 94 | 0.41 | yes | 5 | 0.09 | 99.05 | MAFLEESHPG | 95.2 | LEKSHPGIFE | 0.57 | SHPGIFESSC | 0.38 | HPGIFESSCL | 0.3 |
| PBI | N/A | 97 | 0.21 | yes | 2 | 0.08 | 99.06 | LEESHPGIFE | 98 | SHPGLFENSC | 0.38 | HPGIFESSCL | 0.38 | PGIFESSCLE | 0.3 |
| PBI | N/A | 100 | 0.62 | yes | 5 | 0.09 | 99.18 | SHPGIFENSC | 89.76 | HPGLFENSCL | 8.18 | PGIFGNSCLE | 0.56 | | |
| PBI | N/A | 101 | 0.62 | yes | 5 | 0.08 | 99.26 | HPGIFENSCL | 89.79 | PGLFENSCLE | 8.17 | VQQTRMDKLT | 0.32 | | |
| PBI | N/A | 102 | 0.33 | yes | 4 | 0.05 | 99.21 | PGIFENSCLE | 96.16 | IQQTRVDKLT | 1.92 | VQQTRMDKLT | 0.32 | | |
| PBI | N/A | 116 | 0.18 | yes | 2 | 0.07 | 99.3 | VQQTRVDKLT | 98.18 | QQTRVDKLTQ | 0.89 | | | | |
| PBI | N/A | 117 | 0.18 | yes | 2 | 0.05 | 99.07 | QQTRVDKLTQ | 98.18 | QTRVDKLTQG | 0.89 | | | | |
| PBI | N/A | 118 | 0.18 | yes | 2 | 0.07 | 99.07 | QTRVDKLTQG | 98.17 | TRVDKLTQGR | 0.88 | | | | |
| PBI | N/A | 119 | 0.18 | yes | 2 | 0.09 | 99.06 | TRVDKLTQGR | 98.21 | RVDKLTQGRQ | 0.88 | | | | |
| PBI | N/A | 120 | 0.17 | yes | 2 | 0.04 | 99.1 | RVDKLTQGRQ | 98.22 | VDKLTQGRQT | 0.88 | | | | |
| PBI | N/A | 121 | 0.17 | yes | 2 | 0.04 | 99.11 | VDKLTQGRQT | 98.21 | DKLTQGRQTY | 0.88 | | | | |
| PBI | N/A | 122 | 0.26 | yes | 3 | 0.05 | 99.62 | DKLTQGRQTY | 96.8 | DRLTQGRQTY | 1.94 | | | | |

FIG. 74-294

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 123 | 0.26 | yes | 3 | 0.06 | 99.64 | KLTQGRQTYD | 96.81 | KLTQGRQTFD | 1.94 | RLTQGRQTYD | 0.88 | | |
| PB1 | N/A | 124 | 0.18 | yes | 2 | 0.06 | 99.65 | LTQGRQ

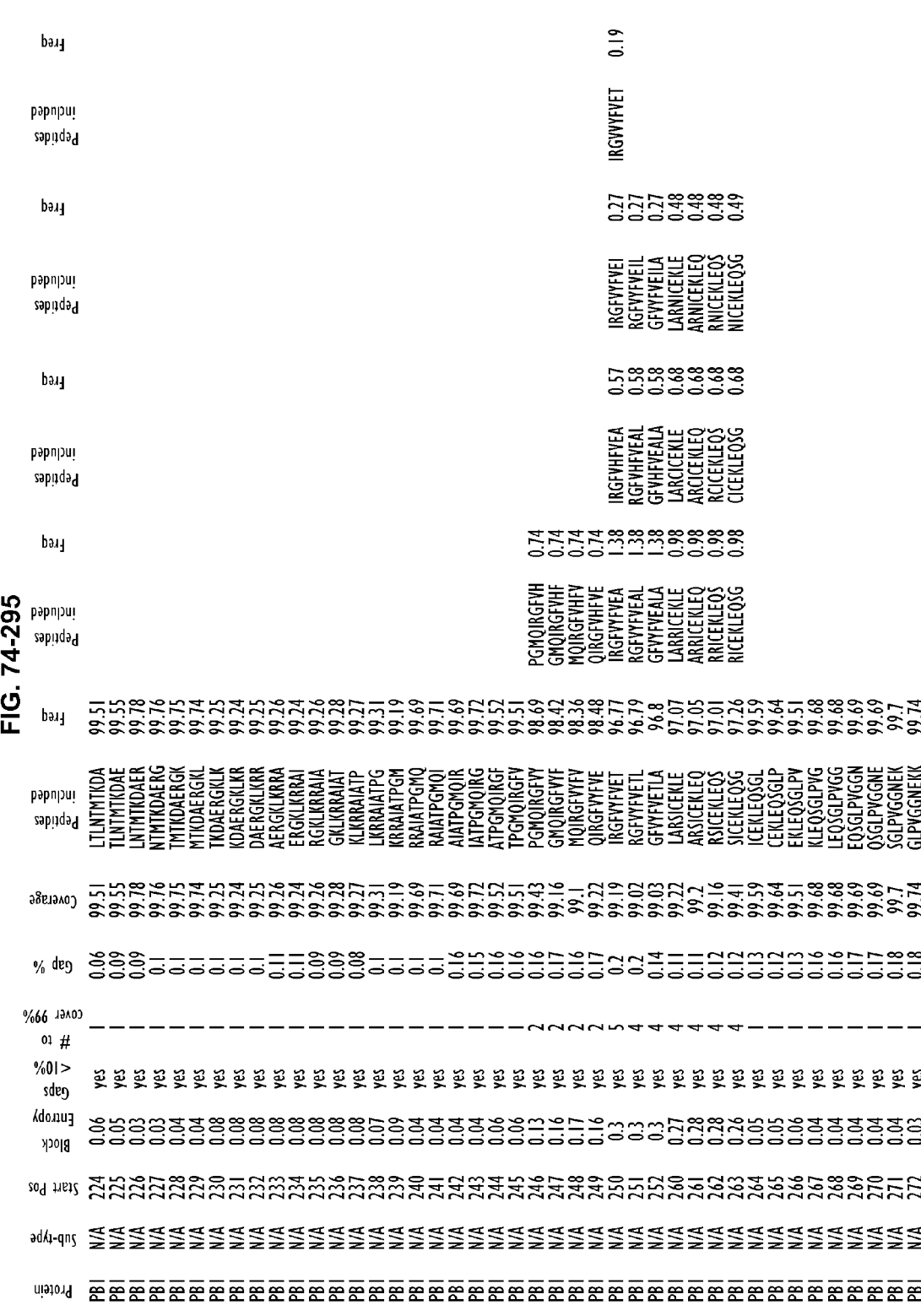

FIG. 74-296

| Protein | Sub-type | Start Pos | Block Entropy | Gaps <10% | # to cover 99% | Gap % | Coverage | Peptides included | Freq | Peptides included | Freq | Peptides included | Freq | Peptides induced | Freq |
|---|---|---|---|---|---|---|---|---|---|---|---|---|---|---|---|
| PB1 | N/A | 273 | 0.03 | yes | — | 0.18 | 99.74 | LPVGGNEKKA | 99.74 | | | | | | |
| PB1 | N/A | 274 | 0.03 | yes | — | 0.16 | 99.76 | PVGGNEKKAK | 99.76 | | | | | | |
| PB1 | N/A | 275 | 0.03 | yes | — | 0.16 | 99.76 | VGGNEKKAKL | 99.76 | | | | | | |
| PB1 | N/A | 276 | 0.02 | yes | — | 0.14 | 99.87 | GGNEKKAKLA | 99.87 | | | | | | |
| PB1 | N/A | 277 | 0.02 | yes | — | 0.13 | 99.87 | GNEKKAKLAN | 99.87 | | | | | | |
| PB1 | N/A | 278 | 0.04 | yes | — | 0.13 | 99.89 | NEKKAKLANV | 99.89 | | | | | | |
| PB1 | N/A | 279 | 0.05 | yes | — | 0.13 | 99.72 | EKKAKLANVV | 99.72 | | | | | | |
| PB1 | N/A | 280 | 0.05 | yes | — | 0.13 | 99.61 | KKAKLANVVR | 99.61 | | | | | | |
| PB1 | N/A | 281 | 0.05 | yes | — | 0.12 | 99.63 | KAKLANVVRK | 99.63 | | | | | | |
| PB1 | N/A | 282 | 0.05 | yes | — | 0.12 | 99.64 | AKLANVVRKM | 99.64 | | | | | | |
| PB1 | N/A | 283 | 0.08 | yes | — | 0.14 | 99.59 | KLANVVRKMM | 99.59 | | | | | | |
| PB1 | N/A | 284 | 0.08 | yes | — | 0.14 | 99.38 | LANVVRKMMT | 99.38 | | | | | | |
| PB1 | N/A | 285 | 0.12 | yes | — | 0.14 | 99.34 | ANVVRKMMTS | 99.34 | | | | | | | ANVVRKMMTS | 0.38 | | | | |
| PB1 | N/A | 286 | 0.12 | yes | — | 0.16 | 99.34 | NVVRKMMTSS | 98.97 | | | | | | NVVRKMMTSS | 0.38 | | | | |
| PB1 | N/A | 287 | 0.16 | yes | — | 0.13 | 99.1 | VVRKMMTSSQ | 98.96 | | | | | | VRKMMTSSQD | 0.38 | VRKMMTNSR | 0.14 | | |
| PB1 | N/A | 288 | 0.16 | yes | — | 0.13 | 99.1 | VRKMMTSSQD | 98.59 | | | | | | RKMMTSSQDT | 0.38 | VRKMMTNSRD | 0.14 | | |
| PB1 | N/A | 289 | 0.16 | yes | — | 0.14 | 99.14 | RKMMTSSQDT | 98.59 | | | | | | KMMTSSQDTE | 0.38 | RKMMTNSRDT | 0.15 | | |
| PB1 | N/A | 290 | 0.16 | yes | — | 0.13 | 99.01 | KMMTSSQDTE | 98.61 | | | | | | NSQDTEISFT | 0.38 | | | | |
| PB1 | N/A | 294 | 1.05 | yes | 2 | 0.13 | 99.03 | NSQDTEISFT | 98.63 | | | | | | SQDTEISFTI | 31.3 | SSQDTELSFT | 0.22 | NSQDTEVSFT | 0.21 |
| PB1 | N/A | 295 | 1.07 | yes | 2 | 0.13 | 99.16 | SQDTEISFTI | 67.3 | | | | | | QDTEISFTIT | 31.4 | SQDTELSFTV | 0.55 | SQDTEVSFTI | 0.21 |
| PB1 | N/A | 296 | 1.06 | yes | 3 | 0.15 | 99.17 | QDTEISFTIT | 66.98 | | | | | | DTEISFTITG | 31.4 | QDTELSFTVT | 0.55 | QDTEVSFTIT | 0.21 |
| PB1 | N/A | 297 | 1.02 | yes | 4 | 0.15 | 99.38 | DTEISFTITG | 67 | | | | | | TEISFTITGD | 31.5 | DTELSFTVTG | 0.55 | | |
| PB1 | N/A | 298 | 1.02 | yes | 4 | 0.15 | 99.38 | TEISFTITGD | 67.38 | | | | | | EISFTITGDN | 31.5 | TELSFTVTGD | 0.55 | | |
| PB1 | N/A | 299 | 1.01 | yes | 4 | 0.16 | 99.46 | EISFTITGDN | 67.37 | | | | | | ISFTITGDNT | 31.5 | ELSFTVTGDN | 0.55 | | |
| PB1 | N/A | 300 | 1 | yes | 3 | 0.16 | 99.53 | ISFTITGDNT | 67.46 | | | | | | SFTITGDNTK | 31.5 | LSFTVTGDNT | 0.55 | | |
| PB1 | N/A | 301 | 0.08 | yes | — | 0.16 | 99.2 | SFTITGDNTK | 67.52 | | | | | | | | | | | |
| PB1 | N/A | 302 | 0.08 | yes | — | 0.16 | 99.2 | FTITGDNTKW | 99.2 | | | | | | | | | | | |
| PB1 | N/A | 303 | 0.08 | yes | — | 0.16 | 99.2 | TITGDNTKWN | 99.2 | | | | | | | | | | | |
| PB1 | N/A | 304 | 0.08 | yes | — | 0.15 | 99.2 | ITGDNTKWNE | 99.2 | | | | | | | | | | | |
| PB1 | N/A | 305 | 0.03 | yes | — | 0.15 | 99.82 | TGDNTKWNEN | 99.82 | | | | | | | | | | | |
| PB1 | N/A | 306 | 0.03 | yes | — | 0.14 | 99.81 | GDNTKWNENQ | 99.84 | | | | | | | | | | | |
| PB1 | N/A | 307 | 0.02 | yes | — | 0.15 | 99.83 | DNTKWNENQN | 99.41 | | | | | | | | | | | |
| PB1 | N/A | 308 | 0.06 | yes | 3 | 0.14 | 99.41 | NTKWNENQNP | 99.4 | | | | | | | | | | | |
| PB1 | N/A | 309 | 0.07 | yes | 3 | 0.14 | 99.4 | TKWNENQNPR | 99.41 | | | | | | KWNENQNPRV | 2.31 | KWNENQNPRI | 1.93 | | | ENQSPRMFLA | 0.41 |
| PB1 | N/A | 310 | 0.06 | yes | 3 | 0.16 | 99.41 | KWNENQNPRM | 99.16 | | | | | | WNENQNPRVF | 2.3 | WNENQNPRIF | 1.93 | ENQNPRVFLT | 0.9 | ENQSPRMFLA | 0.41 |
| PB1 | N/A | 311 | 0.06 | yes | 3 | 0.16 | 99.18 | WNENQNPRMF | 99.18 | | | | | | NENQNPRVFL | 2.3 | NENQNPRIFL | 1.93 | | | | |
| PB1 | N/A | 312 | 0.38 | yes | 5 | 0.14 | 99.11 | NENQNPRMFL | 99.11 | | | | | | ENQNPRVFLA | 1.83 | ENQNPRIFLA | 1.41 | | | | |
| PB1 | N/A | 313 | 0.38 | yes | 5 | 0.14 | 99.39 | ENQNPRMFLA | 99.39 | | | | | | | | | | | |
| PB1 | N/A | 314 | 0.42 | no | — | 99.99 | 100 | NQNQNPRMFLA | 100 | | | | | | | | | | | |
| PB1 | N/A | 315 | 0 | no | — | 99.99 | 100 | QNQNPRMFLAM | 100 | | | | | | | | | | | |
| PB1 | N/A | 316 | 0.42 | yes | 5 | 0.14 | 99.41 | NQNPRMFLAM | 94.87 | | | | | | NQNPRVFLAM | 1.83 | NQNPRVFLTM | 0.89 | NQSPRMFLAM | 0.41 |
| PB1 | N/A | 317 | 0.44 | yes | 5 | 0.13 | 99.2 | QNPRMFLAMI | 94.67 | | | | | | QNPRVFLAMI | 1.4 | QNPRVFLTMI | 0.89 | QSPRMFLAMI | 0.41 |

FIG. 74-297

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 318 | 0.46 | yes | 5 | 0.13 | 99.09 | NPRMFLAMIT | 94.58 | NPRIFLAMIT | 1.82 | NPRVFLAMIT | 1.4 | NPRVFLTMIT | 0.89 | SPRMFLAMIT | 0.41 |
| PB1 | N/A | 319 | 0.42 | yes | 4 | 0.14 | 99.05 | PRMFLAMITY | 94.98 | PRIFLAMITY | 1.79 | PRVFLAMITY | 1.4 | PRVFLTMITY | 0.89 | | |
| PB1 | N/A | 320 | 0.44 | yes | 5 | 0.15 | 99.07 | RMFLAMITYI | 94.76 | RIFLAMITYI | 1.78 | RVFLAMITYI | 1.4 | RVFLTMITYI | 0.89 | RTFLAMITYI | 0.24 |
| PB1 | N/A | 321 | 0.44 | yes | 5 | 0.13 | 99.07 | MFLAMITYIT | 94.78 | IFLAMITYIT | 1.78 | VFLAMITYIT | 1.41 | VFLTMITYIT | 0.89 | TFLAMITYIT | 0.24 |
| PB1 | N/A | 322 | 0.99 | yes | 3 | 0.15 | 99.11 | FLAMITYIT | 73.34 | FLAMITYITR | 24.8 | FLTMITYITR | 0.97 | | | | |
| PB1 | N/A | 333 | 1.2 | yes | 5 | 0.21 | 99.09 | QPEWFRNILS | 49.97 | QPEWFRNILS | 48 | QPGWFRNVLS | 0.49 | QPKWFRNVLS | 0.37 | QPDWFRNVLS | 0.26 |
| PB1 | N/A | 336 | 1.72 | yes | 5 | 0.21 | 99.02 | WFRNVLSIAP | 47.22 | WFRNILSMAP | 25 | WFRNILSIAP | 24.84 | WFRNVLSYAP | 1.94 | FRNALSIAPI | 0.2 |
| PB1 | N/A | 337 | 1.74 | yes | 4 | 0.22 | 99.08 | FRNVLSIAPI | 47.12 | FRNILSIAPI | 25 | FRNILSIAPI | 24.84 | FRNVLSYAPI | 1.93 | RNALSIAPIM | 0.2 |
| PB1 | N/A | 338 | 1.73 | yes | 4 | 0.21 | 99.15 | RNVLSIAPIM | 47.17 | RNILSIAPIM | 25 | RNILSIAPIM | 24.85 | RNVLSYAPIM | 1.93 | NALSIAPIMF | 0.2 |
| PB1 | N/A | 339 | 1.73 | yes | 4 | 0.2 | 99.13 | NVLSIAPIMF | 47.15 | NILSIAPIMF | 25 | NILSIAPIMF | 24.86 | NVLSYAPIMF | 1.93 | ALSIAPIMFS | 0.2 |
| PB1 | N/A | 340 | 1.73 | yes | 3 | 0.2 | 99.13 | VLSIAPIMFS | 47.17 | ILSIAPIMFS | 25 | ILSVAPIMFS | 24.85 | VLSVAPIMFS | 1.93 | | |
| PB1 | N/A | 341 | 1.04 | yes | 3 | 0.2 | 99.14 | LSIAPIMFSN | 72.15 | LSMAPIMFSN | 25.1 | LSVAPIMFSN | 2.1 | | | | |
| PB1 | N/A | 342 | 1.03 | yes | 3 | 0.2 | 99.3 | SIAPIMFSNK | 72.21 | SMAPIMFSNK | 25.1 | SVAPIMFSNK | 2.1 | | | | |
| PB1 | N/A | 343 | 1.04 | yes | 3 | 0.2 | 99.36 | IAPIMFSNKM | 72.07 | MAPIMFSNKM | 25.1 | VAPIMFSNKM | 2.08 | | | | |
| PB1 | N/A | 344 | 0.11 | yes | 3 | 0.16 | 99.2 | APIMFSNKMA | 99.02 | | | | | | | | |
| PB1 | N/A | 345 | 0.15 | yes | 3 | 0.16 | 99.02 | PIMFSNKMAR | 99.02 | PIMFSNKVAR | 0.32 | PIMFSNKMAK | 0.3 | | | | |
| PB1 | N/A | 346 | 0.13 | yes | 3 | 0.16 | 99.3 | IMFSNKMARL | 98.68 | IMFSNKVARL | 0.32 | IMFSNKMAKL | 0.3 | | | | |
| PB1 | N/A | 347 | 0.15 | yes | 3 | 0.16 | 99.28 | MFSNKMARLG | 98.66 | MFSNKVARLG | 0.32 | | | | | | |
| PB1 | N/A | 348 | 0.39 | yes | 3 | 0.2 | 99.14 | FSNKMARLGK | 94.55 | FSNKMARLGR | 4.27 | FSNKVARLGK | 0.32 | | | | |
| PB1 | N/A | 349 | 0.38 | yes | 3 | 0.2 | 99.14 | SNKMARLGKG | 94.58 | SNKMARLGRG | 4.27 | SNKVARLGKG | 0.32 | | | | |
| PB1 | N/A | 350 | 0.38 | yes | 2 | 0.22 | 99.18 | NKMARLGKGY | 94.6 | NKMARLGRGY | 4.27 | NKVARLGKGY | 0.32 | | | | |
| PB1 | N/A | 351 | 0.37 | yes | 3 | 0.2 | 99.19 | KMARLGKGYM | 94.65 | KMARLGRGYM | 4.27 | KVARLGKGYM | 0.32 | | | | |
| PB1 | N/A | 352 | 0.38 | yes | 2 | 0.21 | 99.24 | MARLGKGYMF | 94.64 | MARLGRGYMF | 4.27 | VARLGKGYMF | 0.32 | | | | |
| PB1 | N/A | 353 | 0.35 | yes | 2 | 0.2 | 99.22 | ARLGKGYMFE | 94.91 | ARLGRGYMFE | 4.27 | | | | | | |
| PB1 | N/A | 354 | 0.32 | yes | 2 | 0.2 | 99.18 | RLGKGYMFES | 95.12 | RLGRGYMFES | 4.27 | | | | | | |
| PB1 | N/A | 355 | 0.33 | yes | 2 | 0.2 | 99.38 | LGKGYMFESK | 95.12 | LGRGYMFESK | 4.25 | | | | | | |
| PB1 | N/A | 392 | 0 | no | 1 | 99.99 | 99.37 | KIEKIEKIRP | 100 | | | | | | | | |
| PB1 | N/A | 393 | 0 | no | 1 | 99.99 | 100 | IEKIEKIRPL | 100 | | | | | | | | |
| PB1 | N/A | 394 | 0 | no | 1 | 99.99 | 100 | EKIEKIRPLL | 100 | | | | | | | | |
| PB1 | N/A | 406 | 0.38 | yes | 4 | 0.16 | 99.39 | GTASLSPGMM | 95.05 | GAASLSPGMM | 3.18 | GTVSLSPGMM | 0.73 | GTAALSPGMM | 0.43 | | |
| PB1 | N/A | 407 | 0.34 | yes | 3 | 0.13 | 99.32 | TASLSPGMMM | 95.4 | AASLSPGMMM | 3.18 | TVSLSPGMMM | 0.73 | | | | |
| PB1 | N/A | 408 | 0.13 | yes | 2 | 0.13 | 99.42 | ASLSPGMMMG | 98.68 | VSLSPGMMMG | 0.74 | | | | | | |
| PB1 | N/A | 409 | 0.06 | yes | 1 | 0.13 | 99.41 | SLSPGMMMGM | 99.41 | | | | | | | | |
| PB1 | N/A | 410 | 0.03 | yes | 1 | 0.13 | 99.82 | LSPGMMMGMF | 99.82 | | | | | | | | |
| PB1 | N/A | 411 | 0.03 | yes | 1 | 0.12 | 99.78 | SPGMMMGMFN | 99.78 | | | | | | | | |
| PB1 | N/A | 412 | 0.04 | yes | 1 | 0.13 | 99.75 | PGMMMGMFNM | 99.75 | | | | | | | | |
| PB1 | N/A | 413 | 0.03 | yes | 1 | 0.14 | 99.76 | GMMMGMFNML | 99.76 | | | | | | | | |
| PB1 | N/A | 414 | 0.04 | yes | 1 | 0.14 | 99.76 | MMMGMFNMLS | 99.76 | | | | | | | | |
| PB1 | N/A | 415 | 0.03 | yes | 1 | 0.14 | 99.79 | MMGMFNMLST | 99.79 | | | | | | | | |
| PB1 | N/A | 416 | 0.04 | yes | 1 | 0.15 | 99.75 | MGMFNMLSTV | 99.75 | | | | | | | | |
| PB1 | N/A | 417 | 0.03 | yes | 1 | 0.15 | 99.76 | GMFNMLSTVL | 99.76 | | | | | | | | |
| PB1 | N/A | 418 | 0.04 | yes | 1 | 0.14 | 99.77 | MFNMLSTVLG | 99.77 | | | | | | | | |

FIG. 74-298

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PB | N/A | 419 | 0.03 | yes | 1 | 0.14 | 99.77 | FNMLSTVLGV | 99.77 | | | | | | |
| PB | N/A | 420 | 0.06 | yes | 1 | 0.14 | 99.55 | NMLSTVLGVS | 99.55 | | | | | | |
| PB | N/A | 421 | 0.1 | yes | 1 | 0.14 | 99.01 | MLSTVLGVSI | 99.01 | | | | | | |
| PB | N/A | 422 | 0.11 | yes | 1 | 0.13 | 99.01 | LSTVLGVSIL | 99.01 | | | | | | |
| PB | N/A | 423 | 0.11 | yes | 1 | 0.1 | 99.56 | STVLGVSILN | 98.98 | STVLGVSILN | 0.58 | | | | |
| PB | N/A | 424 | 0.12 | yes | 1 | 0.11 | 99.49 | TVLGVSILNL | 98.91 | TVLGVSILNL | 0.58 | | | | |
| PB | N/A | 425 | 0.12 | yes | 1 | 0.11 | 99.47 | VLGVSILNLG | 98.89 | VLGVSILNLG | 0.58 | | | | |
| PB | N/A | 426 | 0.12 | yes | 1 | 0.12 | 99.43 | LGVSILNLGQ | 98.84 | LGVSILNLGQ | 0.58 | | | | |
| PB | N/A | 427 | 0.23 | yes | 2 | 0.14 | 99.8 | GVSILNLGQR | 97.56 | GVSILNLGQR | 1.24 | GVSILNLGQK | 0.57 | | | |
| PB | N/A | 441 | 1.02 | yes | 2 | 0.13 | 99.61 | TTYWWDGLQS | 75.02 | TTYWWDGLQS | 22 | TSYWWDGLQS | 0.91 | TYWWDGLQS | 0.86 | TAYWWDGLQS | 0.82 |
| PB | N/A | 442 | 1.01 | yes | 2 | 0.18 | 99.66 | TYWWDGLQSS | 75.05 | TYWWDGLQSS | 22 | SYWWDGLQSS | 0.91 | YWWDGLQSS | 0.87 | AYWWDGLQSS | 0.83 |
| PB | N/A | 443 | 0.03 | yes | 1 | 0.16 | 99.76 | YWWDGLQSSD | 99.76 | | | | | | |
| PB | N/A | 444 | 0.03 | yes | 1 | 0.16 | 99.81 | WWDGLQSSDD | 99.81 | | | | | | |
| PB | N/A | 445 | 0.03 | yes | 1 | 0.16 | 99.82 | WDGLQSSDDF | 99.82 | | | | | | |
| PB | N/A | 446 | 0.03 | yes | 1 | 0.17 | 99.77 | DGLQSSDDFA | 99.77 | | | | | | |
| PB | N/A | 447 | 0.03 | yes | 1 | 0.15 | 99.77 | GLQSSDDFAL | 99.77 | | | | | | |
| PB | N/A | 448 | 0.03 | yes | 1 | 0.15 | 99.76 | LQSSDDFALI | 99.76 | | | | | | |
| PB | N/A | 449 | 0.11 | yes | 1 | 0.15 | 99.55 | QSSDDFALIV | 98.97 | QSSDDFALIL | 0.58 | | | | |
| PB | N/A | 450 | 0.11 | yes | 1 | 0.15 | 99.55 | SSDDFALIVN | 98.97 | SSDDFALILN | 0.58 | | | | |
| PB | N/A | 451 | 0.15 | yes | 1 | 0.15 | 99.53 | SDDFALIVNA | 98.95 | SDDFALILNA | 0.58 | | | | |
| PB | N/A | 452 | 0.17 | yes | 2 | 0.17 | 99.22 | DDFALIVNAP | 97.21 | DDFALILNAP | 0.94 | DDFALIVNAL | 0.59 | DDFALILNAP | 0.58 | | |
| PB | N/A | 465 | 0.11 | yes | 1 | 0.16 | 99.02 | GIQAGVNRFY | 97.86 | GIQAGVNRFY | 1.16 | GVQAGVDRFY | 0.26 | | | |
| PB | N/A | 466 | 0.26 | yes | 2 | 0.16 | 99.07 | IQAGVNRFYR | 97.79 | IQAGVNRFYR | 1.16 | QAGVNRFYRT | 1.12 | | | |
| PB | N/A | 467 | 0.21 | yes | 3 | 0.16 | 99.1 | QAGVNRFYRT | 94.5 | QAGVNRFYRT | 3.45 | AGVNRFYRTC | 1.12 | | | |
| PB | N/A | 468 | 0.2 | yes | 3 | 0.16 | 99.19 | AGVNRFYRTC | 94.53 | AGVNRFYRTC | 3.45 | GVNRFYRTCK | 1.12 | | | |
| PB | N/A | 469 | 0.42 | yes | 4 | 0.09 | 99.07 | GVNRFYRTCK | 94.62 | GVNRFYRTCK | 3.45 | VNRFYRTCKL | 1.12 | | | |
| PB | N/A | 470 | 0.41 | yes | 3 | 0.1 | 99.1 | VDRFYRTCKL | 94.6 | VDRFYRTCKL | 3.41 | DRFYRTCKLL | 3.41 | NRFYRTCKLV | 0.89 | NRFYRTCKLL | 0.22 |
| PB | N/A | 471 | 0.4 | yes | 3 | 0.1 | 99.05 | DRFYRTCKLL | 85.07 | DRFYRTCKLL | 3.43 | RFYRICKLLG | 3.43 | | | |
| PB | N/A | 472 | 0.87 | yes | 3 | 0.12 | 99.07 | REYRTCKLLG | 85.96 | REYRICKLVG | 3.45 | FYRICKLVGI | 3.45 | | | |
| PB | N/A | 473 | 0.78 | yes | 5 | 0.13 | 99.3 | FYRTCKLLGI | 86.15 | FYRICKLVGI | 3.45 | YRICKLVGIN | 3.45 | | | |
| PB | N/A | 474 | 0.76 | yes | 3 | 0.12 | 99.28 | YRTCKLLGIN | 86.13 | YRTCKLLGIN | 3.45 | RICKLVGINM | 3.45 | | | |
| PB | N/A | 475 | 0.76 | yes | 3 | 0.12 | 99.26 | RTCKLVGINM | 86.12 | RTCKLLGINM | 3.45 | ICKLVGINMS | 3.45 | | | |
| PB | N/A | 476 | 0.76 | yes | 3 | 0.13 | 99.25 | TCKLVGINMS | 86.11 | TCKLLGINMS | 3.45 | CKLVGINMSK | 3.45 | | | |
| PB | N/A | 477 | 0.53 | yes | 3 | 0.13 | 99.46 | CKLVGINMSK | 89.72 | CKLLGINMSK | 3.45 | KLVGINMSKR | 0.52 | | | |
| PB | N/A | 478 | 0.58 | yes | 3 | 0.11 | 99.39 | KLVGINMSKK | 89.22 | KLLGINMSKK | 3.45 | LVGINMSKRK | 0.52 | | | |
| PB | N/A | 479 | 0.58 | yes | 3 | 0.11 | 99.38 | LVGINMSKKK | 89.22 | LGINMSKKK | 3.45 | VGINMSKRKS | 0.52 | | | |
| PB | N/A | 480 | 0.58 | yes | 3 | 0.09 | 99.4 | VGINMSKKKS | 89.24 | LGINMSKKKS | 3.45 | | | | |
| PB | N/A | 481 | 0.1 | yes | 1 | 0.09 | 99 | GINMSKKKSY | 99.09 | | | | | | |
| PB | N/A | 482 | 0.11 | yes | 2 | 0.09 | 99.59 | INMSKKKSYI | 98.94 | INMSKRKSYI | 0.63 | | | | |
| PB | N/A | 483 | 0.11 | yes | 2 | 0.09 | 99.59 | NMSKKKSYIN | 98.96 | NMSKRKSYIN | 0.63 | | | | |
| PB | N/A | 484 | 1.09 | yes | 3 | 0.1 | 99.3 | MSKKKSYINR | 56.91 | MSKKKSYIN | 42 | MSKRKSYINK | 0.35 | | | |
| PB | N/A | 485 | 1.09 | yes | 3 | 0 | 99.31 | SKKKSYINRT | 56.91 | SKKKSYINKT | 42.1 | SKRKSYINKT | 0.35 | | | |

FIG. 74-300

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 528 | 0.28 | yes | 3 | 0.04 | 99.11 | ADMSIGVTVI | 2.07 | ADMSIGVAVI | 0.2 | | | | |
| PB1 | N/A | 529 | 0.31 | yes | 4 | 0.05 | 99.16 | DMSIGVTVIK | 2.07 | DMSIGVAVIK | 0.47 | DMSIGVAVIK | 0.2 | | |
| PB1 | N/A | 530 | 0.32 | yes | 4 | 0.05 | 99.12 | MSIGVTVIKN | 2.08 | MSIGVTVIRN | 0.47 | MSIGVAVIKN | 0.2 | | |
| PB1 | N/A | 531 | 0.33 | yes | 4 | 0.05 | 99.07 | SIGVTVIKNN | 2.07 | SIGVTVIRNN | 0.47 | SIGVAVIKNN | 0.21 | | |
| PB1 | N/A | 532 | 0.32 | yes | 4 | 0.05 | 99.15 | IGVTVIKNNM | 2.07 | IGVTVIRNNM | 0.47 | IGVAVIKNNM | 0.3 | | |
| PB1 | N/A | 533 | 0.34 | yes | 4 | 0.05 | 99.06 | GVTVIKNNMI | 2.05 | GVTVIRNNMI | 0.47 | GVTVIKNNMV | 0.3 | | |
| PB1 | N/A | 534 | 0.19 | yes | 3 | 0.05 | 99.03 | VTVIKNNMIN | 2.05 | VTVIRNNMIN | 0.47 | VTVIKNNMYN | | | |
| PB1 | N/A | 535 | 0.17 | yes | 3 | 0.05 | 99.04 | TVIKNNMINN | 2.48 | TVIKNNMYNN | 0.31 | | | | |
| PB1 | N/A | 536 | 0.16 | yes | 3 | 0.05 | 99.21 | VIKNNMINNN | 2.48 | VIKNNMYNND | 0.31 | | | | |
| PB1 | N/A | 537 | 0.12 | yes | 2 | 0.05 | 99.28 | IKNNMINNDL | 0.48 | IKNNMYNNDL | 0.31 | | | | |
| PB1 | N/A | 538 | 0.11 | yes | 1 | 0.03 | 99.02 | KNNMINNDLG | 0.48 | | | | | | |
| PB1 | N/A | 539 | 0.1 | yes | 1 | 0.04 | 99.01 | NNMINNDLGP | 0.49 | | | | | | |
| PB1 | N/A | 540 | 0.1 | yes | 1 | 0.05 | 99.06 | NMINNDLGPA | 0.54 | | | | | | |
| PB1 | N/A | 541 | 0.07 | yes | 1 | 0.05 | 99.16 | MINNDLGPAT | 0.16 | | | | | | |
| PB1 | N/A | 542 | 0.06 | yes | 1 | 0.05 | 99.16 | INNDLGPATA | 0.16 | | | | | | |
| PB1 | N/A | 543 | 0.04 | yes | 1 | 0.05 | 99.47 | NNDLGPATAQ | 0.47 | | | | | | |
| PB1 | N/A | 544 | 0.04 | yes | 1 | 0.05 | 99.5 | NDLGPATAQM | 0.5 | | | | | | |
| PB1 | N/A | 545 | 0.04 | yes | 1 | 0.05 | 99.7 | DLGPATAQMA | 0.7 | | | | | | |
| PB1 | N/A | 546 | 0.04 | yes | 1 | 0.05 | 99.7 | LGPATAQMAL | 0.7 | | | | | | |
| PB1 | N/A | 547 | 0.04 | yes | 1 | 0.05 | 99.72 | GPATAQMALQ | 0.72 | | | | | | |
| PB1 | N/A | 548 | 0.04 | yes | 1 | 0.05 | 99.7 | PATAQMALQL | 0.7 | | | | | | |
| PB1 | N/A | 549 | 0.04 | yes | 1 | 0.06 | 99.15 | ATAQMALQLF | 0.15 | | | | | | |
| PB1 | N/A | 550 | 0.1 | yes | 1 | 0.06 | 99.14 | TAQMALQLFI | 0.14 | | | | | | |
| PB1 | N/A | 551 | 0.1 | yes | 1 | 0.06 | 99.1 | AQMALQLFIK | 0.1 | | | | | | |
| PB1 | N/A | 552 | 0.1 | yes | 1 | 0.06 | 99.1 | QMALQLFIKD | 0.1 | | | | | | |
| PB1 | N/A | 553 | 0.1 | yes | 1 | 0.06 | 99.1 | MALQLFIKDY | 0.1 | | | | | | |
| PB1 | N/A | 554 | 0.1 | yes | 1 | 0.07 | 99.15 | ALQLFIKDYR | 0.15 | | | | | | |
| PB1 | N/A | 555 | 0.1 | yes | 1 | 0.07 | 99.14 | LQLFIKDYRY | 0.14 | | | | | | |
| PB1 | N/A | 556 | 0.09 | yes | 1 | 0.07 | 99.16 | QLFIKDYRYT | 0.16 | | | | | | |
| PB1 | N/A | 557 | 0.09 | yes | 2 | 0.08 | 99.18 | LFIKDYRYTY | 0.18 | | | | | | |
| PB1 | N/A | 558 | 0.09 | yes | 2 | 0.08 | 99.17 | FIKDYRYTYR | 0.17 | | | | | | |
| PB1 | N/A | 559 | 0.04 | yes | 2 | 0.08 | 99.76 | IKDYRYTYRC | 0.76 | | | | | | |
| PB1 | N/A | 560 | 0.11 | yes | 3 | 0.08 | 99.68 | KDYRYTYRCH | 0.84 | | | | | | |
| PB1 | N/A | 561 | 0.12 | yes | 5 | 0.11 | 99.64 | DYRYTYRCHR | 0.8 | DYRYTYRCHK | 0.88 | | | | |
| PB1 | N/A | 562 | 0.12 | yes | 5 | 0.11 | 99.13 | YRYTYRCHRG | 0.76 | YRYTYRCHKG | 0.88 | | | | |
| PB1 | N/A | 563 | 0.11 | yes | 5 | 0.1 | 99.22 | RYTYRCHRGD | 0.78 | RYTYRCHKGD | 0.88 | | | | |
| PB1 | N/A | 564 | 0.11 | yes | 3 | 0.11 | 99.22 | YTYRCHRGDT | 0.13 | YTYRCHKGDT | 0.88 | YTYRCHRGDM | 0.47 | | |
| PB1 | N/A | 565 | 0.12 | yes | 3 | 0.12 | 99.38 | TYRCHRGDTQ | 0.95 | TYRCHKGDTQ | 0.87 | TYRCHRGDMQ | 0.47 | TYRCHRGDTH | 0.42 | TYRCHRGDAQ | 0.31 |
| PB1 | N/A | 566 | 0.29 | yes | 5 | 0.11 | 99.28 | YRCHRGDTQI | 0.08 | | | YRCHRGDMQI | 0.47 | YRCHRGDTHI | 0.42 | YRCHRGDAQI | 0.31 |
| PB1 | N/A | 595 | 0.31 | yes | 3 | 0.07 | 99.22 | GLLVSDGGPN | 1.69 | | | GLLVADGGPN | 0.61 | | | | |
| PB1 | N/A | 596 | 0.25 | yes | 3 | 0.06 | 99.28 | LLVSDGGPNL | 1.69 | | | LLVADGGPNL | 0.61 | | | | |
| PB1 | N/A | 597 | 0.27 | yes | 3 | 0.06 | 99.22 | LVSDGGPNLY | 1.69 | | | LVADGGPNLY | 0.61 | | | | |

FIG. 74-301

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| PB1 | N/A | 598 | 0.27 | yes | 3 | 0.07 | 99.22 | VSDGGPNLYN | 96.93 | ISDGGPNLYN | 1.69 | VADGGPNLYN | 0.61 | | |
| PB1 | N/A | 599 | 0.15 | yes | 2 | 0.06 | 99.16 | SDGGPNLYNI | 98.51 | ADGGPNLYNI | 0.64 | | | | |
| PB1 | N/A | 600 | 0.1 | yes | 1 | 0.06 | 99.18 | DGGPNLYNIR | 99.18 | | | | | | |
| PB1 | N/A | 601 | 0.09 | yes | 1 | 0.05 | 99.2 | GGPNLYNIRN | 99.2 | | | | | | |
| PB1 | N/A | 602 | 0.1 | yes | 1 | 0.04 | 99.13 | GPNLYNIRNL | 99.13 | | | | | | |
| PB1 | N/A | 603 | 0.09 | yes | 1 | 0.04 | 99.12 | PNLYNIRNLH | 99.12 | | | | | | |
| PB1 | N/A | 604 | 0.09 | yes | 1 | 0.05 | 99.3 | NLYNIRNLHI | 99.3 | | | | | | |
| PB1 | N/A | 605 | 0.09 | yes | 1 | 0.05 | 99.26 | LYNIRNLHIP | 99.26 | | | | | | |
| PB1 | N/A | 606 | 0.1 | yes | 1 | 0.05 | 99.19 | YNIRNLHIPE | 99.19 | | | | | | |
| PB1 | N/A | 607 | 0.13 | yes | 2 | 0.05 | 99.19 | NIRNLHIPEV | 98.91 | NIRNLHIPEA | 0.28 | | | | |
| PB1 | N/A | 608 | 0.14 | yes | 2 | 0.05 | 99.07 | IRNLHIPEVC | 98.9 | IRNLHIPEAG | 0.18 | | | | |
| PB1 | N/A | 609 | 0.13 | yes | 2 | 0.05 | 99.19 | RNLHIPEVCL | 98.95 | RNLHIPEAGL | 0.18 | | | | |
| PB1 | N/A | 610 | 0.13 | yes | 2 | 0.07 | 99.14 | NLHIPEVCLK | 98.94 | NLHIPEAGLK | 0.18 | | | | |
| PB1 | N/A | 611 | 0.13 | yes | 2 | 0.06 | 99.12 | LHIPEVCLKW | 98.93 | LHIPEAGLKW | 0.18 | | | | |
| PB1 | N/A | 612 | 0.19 | yes | 4 | 0.05 | 99.11 | HIPEVCLKWE | 98.28 | HIPEAGLKWE | 0.53 | HIPEVCLKWG

FIG. 74-302

| Protein | Sub-type | Start Pos | Block Entropy | Gaps <10% | # to 99% cover | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 653 | 0 | no | 1 | 99.99 | 100 | GCVILLNPFV | 100 | | | | | | |
| PB1 | N/A | 654 | 0 | no | 1 | 99.99 | 100 | CVILLNPFVS | 100 | | | | | | |
| PB1 | N/A | 655 | 0 | no | 1 | 99.99 | 100 | VILLNPFVSH | 100 | | | | | | |
| PB1 | N/A | 656 | 0 | no | 1 | 99.99 | 100 | ILLNPFVSHK | 100 | | | | | | |
| PB1 | N/A | 657 | 0 | no | 1 | 99.99 | 100 | LLNPFVSHKE | 100 | | | | | | |
| PB1 | N/A | 685 | 0.17 | yes | 1 | 0.01 | 99.29 | MEYDAVATTH | 98.38 | IEYDAVATTH | 0.56 | VEYDAVATTH | 0.35 | | |
| PB1 | N/A | 686 | 0.07 | yes | 1 | 0.01 | 99.41 | EYDAVATTHS | 99.41 | | | | | | |
| PB1 | N/A | 687 | 0.07 | yes | 1 | 0.01 | 99.43 | YDAVATTHSW | 99.43 | | | | | | |
| PB1 | N/A | 688 | 0.66 | yes | 3 | 0.02 | 99.31 | DAVATTHSWI | 87.55 | DAVATTHSWV | | DAVATTHSWT | 1.02 | | |
| PB1 | N/A | 689 | 0.67 | yes | 3 | 0.03 | 99.23 | AVATTHSWIP | 87.51 | AVATTHSWVP | | AVATTHSWTP | 1.02 | | |
| PB1 | N/A | 690 | 0.67 | yes | 3 | 0.06 | 99.16 | VATTHSWIPK | 87.45 | VATTHSWVPK | | VATTHSWTPK | 1.02 | | |
| PB1 | N/A | 691 | 0.66 | yes | 3 | 0.08 | 99.29 | ATTHSWIPKR | 87.57 | ATTHSWVPKR | | ATTHSWTPKR | 1.02 | | |
| PB1 | N/A | 692 | 0.65 | yes | 3 | 0.08 | 99.42 | TTHSWIPKRN | 87.69 | TTHSWVPKRN | | TTHSWTPKRN | 1.02 | | |
| PB1 | N/A | 693 | 0.64 | yes | 3 | 0.08 | 99.45 | THSWIPKRNR | 87.72 | THSWVPKRNR | | THSWTPKRN | 1.02 | | |
| PB1 | N/A | 694 | 0.65 | yes | 3 | 0.07 | 99.47 | HSWIPKRNRS | 87.74 | HSWVPKRNRS | | HSWTPKRNRS | 1.02 | | |
| PB1 | N/A | 695 | 0.65 | yes | 3 | 0.07 | 99.37 | SWIPKRNRSI | 87.63 | SWVPKRNRSI | | SWTPKRNRS | 1.02 | | |
| PB1 | N/A | 696 | 0.65 | yes | 3 | 0.07 | 99.34 | WIPKRNRSIL | 87.61 | WVPKRNRSIL | | WTPKRNRSIL | 1.02 | | |
| PB1 | N/A | 697 | 0.06 | yes | 3 | 0.09 | 99.35 | IPKRNRSILN | 87.61 | VPKRNRSILN | | TPKRNRSILN | 1.02 | | |
| PB1 | N/A | 698 | 0.08 | yes | 1 | 0.08 | 99.53 | PKRNRSILNT | 99.54 | | | | | | |
| PB1 | N/A | 699 | 0.1 | yes | 1 | 0.09 | 99.28 | KRNRSILNTS | 99.28 | | | | | | |
| PB1 | N/A | 700 | 0.1 | yes | 1 | 0.09 | 99.29 | RNRSILNTSQ | 99.29 | | | | | | |
| PB1 | N/A | 701 | 0.13 | yes | 2 | 0.05 | 99.08 | NRSILNTSQR | 99.08 | | | | | | |
| PB1 | N/A | 702 | 0 | no | 1 | 0.05 | 99.11 | RSILNTSQRG | 99.11 | SILNTSQRGV | 0.34 | | | | |
| PB1 | N/A | 703 | 0 | no | 1 | 99.99 | 99.08 | SILNTSQRGI | 98.75 | | | | | | |
| PB1 | N/A | 704 | 0 | no | 1 | 99.99 | 100 | ICNSNAITRS | 100 | | | | | | |
| PB1 | N/A | 705 | 0 | no | 1 | 99.99 | 100 | CNSNAITRSG | 100 | | | | | | |
| PB1 | N/A | 706 | 0 | no | 1 | 99.99 | 100 | NSNAITRSGQ | 100 | | | | | | |
| PB1 | N/A | 707 | 0 | no | 1 | 99.99 | 100 | SNAITRSGQN | 100 | | | | | | |
| PB1 | N/A | 708 | 0 | no | 1 | 99.99 | 100 | NAITRSGQNH | 100 | | | | | | |
| PB1 | N/A | 709 | 0 | no | 1 | 99.99 | 100 | AITRSGQNHG | 100 | | | | | | |
| PB1 | N/A | 710 | 0 | no | 1 | 99.99 | 100 | ITRSGQNHGI | 100 | | | | | | |
| PB1 | N/A | 711 | 0 | no | 1 | 99.99 | 100 | TRSGQNHGIC | 100 | | | | | | |
| PB1 | N/A | 712 | 0 | no | 1 | 99.99 | 100 | RSGQNHGICA | 100 | | | | | | |
| PB1 | N/A | 713 | 0 | no | 1 | 99.99 | 100 | SGQNHGICAV | 100 | | | | | | |
| PB1 | N/A | 714 | 0 | no | 1 | 99.99 | 100 | GQNHGICAVA | 100 | | | | | | |
| PB1 | N/A | 715 | 0 | no | 1 | 99.99 | 100 | QNHGICAVAT | 100 | | | | | | |
| PB1 | N/A | 716 | 0 | no | 1 | 99.99 | 100 | NHGICAVATT | 100 | | | | | | |
| PB1 | N/A | 717 | 0 | no | 1 | 99.99 | 100 | HGICAVATTH | 100 | | | | | | |
| PB1 | N/A | 718 | 0 | no | 1 | 99.99 | 100 | GICAVATTHS | 100 | | | | | | |
| PB1 | N/A | 719 | 0 | no | 1 | 99.99 | 100 | ICAVATTHSW | 100 | | | | | | |
| PB1 | N/A | 720 | 0 | no | 1 | 99.99 | 100 | CAVATTHSWV | 100 | | | | | | |
| PB1 | N/A | 721 | 0 | no | 1 | 99.99 | 100 | AVATTHSWVP | 100 | | | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 9 | 0.52 | no | 2 | 99.88 | 100 | NMERIKELRD | 88.24 | NMERIKELRY | 11.8 | | | | |

FIG. 74-306

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 60 | 0.85 | yes |

FIG. 74-307

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 183 | 0.22 | yes | 3 | 0.05 | 99.03 | NEVGARILTS | 97.85 | NEVGAKILTS | 0.99 | | | | |
| PB2 | N/A | 184 | 0.23 | yes | 4 | 0.04 | 99.14 | EVGARILTSE | 97.8 | EVGAKILTSE | 0.99 | | | | |
| PB2 | N/A | 185 | 0.24 | yes | 4 | 0.04 | 99.04 | VGARILTSES | 97.7 | VGAKILTSES | 0.99 | | | | |
| PB2 | N/A | 186 | 0.23 | yes | 5 | 0.06 | 99.09 | GARILTSESQ | 97.74 | GAKILTSESQ | 0.99 | | | | |
| PB2 | N/A | 187 | 0.27 | yes | 3 | 0.07 | 99.1 | ARILTSESQL | 97.35 | AKILTSESQL | 1.02 | ARILASESQL | 0.16 | | |
| PB2 | N/A | 211 | — | yes | — | 0.05 | 99.08 | IAPLMVAYML | 70.28 | ISPLMVAYML | 28.6 | | | | |
| PB2 | N/A | 212 | 0.99 | yes | — | 0.06 | 99.17 | APLMVAYMLE | 70.38 | SPLMVAYMLE | 28.6 | | | | |
| PB2 | N/A | 213 | 0.11 | yes | 2 | 0.06 | 99.05 | PLMVAYMLER | 99.05 | | | | | | |
| PB2 | N/A | 214 | 0.12 | yes | 1 | 0.06 | 99.05 | LMVAYMLERE | 99.05 | | | | | | |
| PB2 | N/A | 215 | 0.12 | yes | 1 | 0.06 | 99.29 | MVAYMLEREL | 98.97 | MMAYMLEREL | 0.32 | | | | |
| PB2 | N/A | 216 | 0.12 | yes | 2 | 0.06 | 99.47 | VAYMLERELV | 99.03 | | | | | | |
| PB2 | N/A | 217 | 0.07 | yes | — | 0.07 | 99.32 | AYMLERELVR | 99.47 | | | | | | |
| PB2 | N/A | 218 | 0.08 | yes | 1 | 0.08 | 99.26 | YMLERELVRK | 99.32 | | | | | | |
| PB2 | N/A | 219 | 0.08 | yes | — | 0.08 | 99.27 | MLERELVRKT | 99.26 | | | | | | |
| PB2 | N/A | 220 | 0.09 | yes | — | 0.07 | 99.31 | LERELVRKTR | 99.27 | | | | | | |
| PB2 | N/A | 221 | 0.09 | yes | — | 0.06 | 99.33 | ERELVRKTRF | 99.31 | | | | | | |
| PB2 | N/A | 222 | 0.08 | yes | — | 0.06 | 99.36 | RELVRKTRFL | 99.33 | | | | | | |
| PB2 | N/A | 223 | 0.1 | yes | — | 0.06 | 99.18 | ELVRKTRFLP | 99.36 | | | | | | |
| PB2 | N/A | 224 | 0.27 | yes | 4 | 0.1 | 99.27 | LVRKTRFLPV | 99.18 | VRKTRFLPVS | 1.25 | VRKTRFLPWS | 0.57 | VRKTRFLPW | 0.38 |
| PB2 | N/A | 225 | 0.26 | yes | — | 0.09 | 99.36 | VRKTRFLPVA | 97.08 | RKTRFLPVSG | 1.25 | RKTRFLPVWG | 0.57 | RKTRFLPVWG | 0.38 |
| PB2 | N/A | 226 | 0.25 | yes | 3 | 0.1 | 99 | RKTRFLPVAG | 97.17 | KTRFLPVSGG | 1.25 | KTRFLPVSGG | 0.57 | | |
| PB2 | N/A | 227 | 1.05 | yes | 4 | 0.1 | 99.08 | KTRFLPVAGG | 97.19 | TRFLPVSGGT | 1.25 | TRFLPVTGGT | 0.57 | | |
| PB2 | N/A | 228 | 1.56 | yes | 5 | 0.1 | 99.09 | TRFLPVAGGT | 97.26 | RFLPVAGGTG | 25.2 | RFLPVSGGTS | 1.21 | RFLPVTGGTS | 0.55 |
| PB2 | N/A | 229 | 1.55 | yes | 5 | 0.1 | 99.11 | RFLPVAGGTS | 72.09 | FLPVAGGTGS | 25.3 | FLPVSGGTSS | 1.21 | FLPVTGGTSS | 0.55 |
| PB2 | N/A | 235 | 1.56 | yes | 5 | 0.1 | 99.09 | FLPVAGGTSS | 72.09 | GGTGSVYIEV | 25 | GGTSSVYIEV | 1.92 | GGTSSMYIEV | 0.55 |
| PB2 | N/A | 236 | 0.81 | yes | 5 | 0.1 | 99.14 | GGTSVYIEVL | 56.41 | GTGSVYIEVL | 25 | GTSSVYIEVL | 1.92 | GTGSMYIEVL | 0.55 |
| PB2 | N/A | 237 | 0.8 | yes | 5 | 0.1 | 99.13 | GTSVYIEVLH | 56.45 | TGSVYIEVLH | 25 | TSSVYIEVLH | 1.92 | TGSIYIEVLH | 0.55 |
| PB2 | N/A | 238 | 0.11 | yes | 5 | 0.1 | 99.16 | TSVYIEVLHL | 56.43 | GSVYIEVLHL | 25 | SSVYIEVLHL | 1.93 | GSIYIEVLHL | 0.55 |
| PB2 | N/A | 239 | 0.26 | yes | 3 | 0.1 | 99.2 | SVYIEVLHLT | 81.46 | SYIEVLHLT | 17.2 | SVYVEVLHLT | 1.91 | | |
| PB2 | N/A | 240 | 0.2 | yes | 4 | 0.1 | 99.5 | VYIEVLHLTQ | 81.49 | IYIEVLHLTQ | 17.2 | VYVEVLHLTQ | 1.91 | | |
| PB2 | N/A | 241 | 0.21 | yes | 5 | 0.11 | 99.42 | YIEVLHLTQG | 98.94 | YEVLHLTQG | 0.56 | | | | |
| PB2 | N/A | 242 | 0.18 | yes | 5 | 0.12 | 99.46 | IEVLHLTQGT | 96.96 | EVLHLTQGT | 1.92 | VEVLHLTQGT | 0.54 | | |
| PB2 | N/A | 243 | 0.19 | yes | 4 | 0.12 | 99.43 | EVLHLTQGTC | 97.53 | EVLHLTQGA | 1.92 | | | | |
| PB2 | N/A | 244 | 0.28 | yes | 5 | 0.12 | 99.68 | VLHLTQGTCW | 97.51 | VLHLTQGAC | 1.93 | | | | |
| PB2 | N/A | 245 | 0.29 | yes | 3 | 0.12 | 99.65 | LHLTQGTCWE | 97.75 | LHLTQGACW | 1.93 | | | | |
| PB2 | N/A | 246 | 0.29 | yes | 3 | 0.12 | 99.45 | HLTQGTCWEQ | 97.72 | HLTQGACWE | 1.91 | LTQGTCWEQL | 0.84 | | |
| PB2 | N/A | 247 | 0.28 | yes | 2 | 0.12 | 99.49 | LTQGTCWEQM | 96.7 | LTQGACWEQ | 1.91 | TQGTCWEQLY | 0.84 | | |
| PB2 | N/A | 248 | 0.29 | yes | 3 | 0.12 | 99.34 | TQGTCWEQMY | 96.74 | TQGACWEQL | 1.91 | QGTCWEQLYT | 0.84 | | |
| PB2 | N/A | 249 | 0.29 | yes | 3 | 0.12 | 99.23 | QGTCWEQMYT | 96.59 | QGACWEQLY | 1.91 | GTCWEQLYTP | 0.84 | | |
| PB2 | N/A | 250 | 0.31 | yes | 3 | 0.12 | 99.23 | GTCWEQMYTP | 96.48 | GACWEQLYT | 1.91 | TCWEQLYTPG | 0.84 | | |

FIG. 74-308

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 252 | 0.28 | yes | 2 | 0.12 | 99.24 | CWEQMTPGG | 96.48 | CWEQMTPGG | 2.76 | WEQL

FIG. 74-309

| Protein | Sub-type | Start Pos | Block Entropy | Gaps <10% | # to cover 99% | Gap % | Coverage | Included Peptides | Freq | Included Peptides | Freq | Included Peptides | Freq | Included Peptides | Freq |
|---|---|---|---|---|---|---|---|---|---|---|---|---|---|---|---|
| PB2 | N/A | 315 | 0.34 | yes | 3 | 0.12 | 99.01 | PTEEQAV

FIG. 74-310

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 425 | 0.1 | yes | 1 | 0.09 | 99.14 | KAVRGDLNFV | 99.14 | | | | | | |
| PB2 | N/A | 426 | 0.1 | yes | 1 | 0.08 | 99.21 | AVRGDLNFVN | 99.21 | | | | | | |
| PB2 | N/A | 427 | 0.08 | yes | 1 | 0.08 | 99.35 | VRGDLNFVNR | 99.35 | | | | | | |
| PB2 | N/A | 428 | 0.06 | yes | 1 | 0.06 | 99.53 | RGDLNFVNRA | 99.53 | | | | | | |
| PB2 | N/A | 429 | 0.06 | yes | 1 | 0.06 | 99.52 | GDLNFVNRAN | 99.52 | | | | | | |
| PB2 | N/A | 430 | 0.05 | yes | 1 | 0.07 | 99.6 | DLNFVNRANQ | 99.6 | | | | | | |
| PB2 | N/A | 431 | 0.06 | yes | 1 | 0.07 | 99.56 | LNFVNRANQR | 99.56 | | | | | | |
| PB2 | N/A | 432 | 0.06 | yes | 1 | 0.07 | 99.58 | NFVNRANQRL | 99.58 | | | | | | |
| PB2 | N/A | 433 | 0.06 | yes | 1 | 0.07 | 99.55 | FVNRANQRLN | 99.55 | VNRANQRLNT | 0.89 | | | | | |
| PB2 | N/A | 434 | 0.13 | yes | 1 | 0.06 | 99.57 | VNRANQRLNP | 99.68 | NRANQRLNTM | 0.89 | | | | | |
| PB2 | N/A | 435 | 0.11 | yes | 1 | 0.06 | 99.75 | NRANQRLNPM | 98.86 | RANQRLNTMH | 0.89 | | | | | |
| PB2 | N/A | 436 | 0.11 | yes | 1 | 0.06 | 99.73 | RANQRLNPMH | 98.84 | ANQRLNTMHQ | 0.89 | | | | | |
| PB2 | N/A | 437 | 0.11 | yes | 1 | 0.06 | 99.72 | ANQRLNPMHQ | 98.83 | NQRLNTMHQL | 0.89 | | | | | |
| PB2 | N/A | 438 | 0.12 | yes | 1 | 0.07 | 99.7 | NQRLNPMHQL | 98.81 | QRLNTMHQLL | 0.89 | | | | | |
| PB2 | N/A | 439 | 0.12 | yes | 1 | 0.06 | 99.7 | QRLNPMHQLL | 98.81 | RLNTMHQLLR | 0.89 | | | | | |
| PB2 | N/A | 440 | 0.12 | yes | 1 | 0.07 | 99.69 | RLNPMHQLLR | 98.8 | LNTMHQLLRH | 0.89 | | | | | |
| PB2 | N/A | 441 | 0.12 | yes | 1 | 0.06 | 99.69 | LNPMHQLLRH | 98.8 | NTMHQLLRHF | 0.89 | | | | | |
| PB2 | N/A | 442 | 0.12 | yes | 1 | 0.06 | 99.66 | NPMHQLLRHF | 98.77 | TMHQLLRHFQ | 0.89 | | | | | |
| PB2 | N/A | 443 | 0.06 | yes | 1 | 0.07 | 99.65 | PMHQLLRHFQ | 98.76 | | | | | | | |
| PB2 | N/A | 444 | 0.12 | yes | 1 | 0.07 | 99.51 | MHQLLRHFQK | 98.51 | HQLLRHFQKN | 0.38 | | | | | |
| PB2 | N/A | 445 | 0.13 | yes | 2 | 0.07 | 99.29 | HQLLRHFQKD | 98.92 | QLLRHFQKNA | 0.38 | | | | | |
| PB2 | N/A | 446 | 0.18 | yes | 2 | 0.07 | 99.29 | QLLRHFQKDA | 98.91 | LLRHFQKDAR | 0.67 | LLRHFQKNAK | 0.38 | | | | |
| PB2 | N/A | 447 | 0.25 | yes | 2 | 0.07 | 99.29 | LLRHFQKDAK | 98.25 | LRHFQKDARV | 1.37 | LRHFQKDARY | 0.53 | LRHFQKNAKV | 0.38 | LRHFQKDAKM | 0.22 |
| PB2 | N/A | 448 | 0.33 | yes | 3 | 0.08 | 99.06 | RHFQKDAKV | 96.56 | RHFQKDAKI | 1.38 | RHFQKDARVL | 0.53 | RHFQKNAKVL | 0.38 | RHFQKDAKML | 0.22 |
| PB2 | N/A | 449 | 0.33 | yes | 3 | 0.08 | 99.03 | RVSKMGVDEY | 96.56 | RISKMGVDEY | 3.16 | RVSKGVGDEY | 1.71 | RVSKITGVDEY | 1.25 | RVSRMGVDEY | 0.3 |
| PB2 | N/A | 492 | 0.57 | yes | 5 | 0.1 | 99.21 | SKMGVDEYSS | 92.6 | SKMGVDEYSN | 7.67 | SKVGVDEYSS | 1.75 | SKTGVDEYSS | 1.49 | SRMGVDEYSS | 0.37 |
| PB2 | N/A | 494 | 0.76 | yes | 5 | 0.1 | 99.11 | MGVDEYSS | 87.93 | MGVDEYSNAE | 7.55 | VGVDEYSS | 1.75 | TGVDEYSS | 1.55 | MGVDEYSS | 0.66 |
| PB2 | N/A | 496 | 0.79 | yes | 5 | 0.14 | 99.14 | GVDEYSSTER | 87.6 | GVDEYSNAER | 6.83 | GVDEYSMAEK | 0.73 | GVDEYSSAER | 0.64 | GVDEYSSTEK | 0.49 |
| PB2 | N/A | 497 | 0.63 | yes | 5 | 0.09 | 99.04 | VYSIDRFLRV | 90.45 | IVSIDRFLRV | 1.98 | VVNIDRFLRV | 0.87 | AVSIDRFLRV | 0.83 | TVSIDRFLRV | 0.45 |
| PB2 | N/A | 508 | 0.45 | yes | 3 | 0.08 | 99.04 | VSIDRFLRVR | 94.92 | VNIDRFLRVR | 0.92 | VSIDRFLRVK | 0.79 | | | | |
| PB2 | N/A | 509 | 0.25 | yes | 3 | 0.07 | 97.56 | SIDRFLRVRD | 97.44 | NIDRFLRVRD | 0.92 | SIDRFLRVKD | 0.79 | | | | |
| PB2 | N/A | 510 | 0.24 | yes | 3 | 0.08 | 99.03 | IDRFLRVRDQ | 97.56 | IDRFLRVKD | | | | | | |
| PB2 | N/A | 511 | 0.17 | yes | 5 | 0.08 | 99.19 | DRFLRVRDQ | 98.4 | DRFLRVKDQQ | 3.58 | DRFLRVRDQL | 0.76 | DRFLRVRDQM | 0.39 | |
| PB2 | N/A | 512 | 0.47 | yes | 5 | 0.08 | 99.03 | RFLRVRDQR | 94.1 | RFLRVKDQQG | 3.6 | RFLRVRDQLG | 0.76 | RFLRVRDQMG | 0.39 | |
| PB2 | N/A | 513 | 0.47 | yes | 5 | 0.08 | 99.05 | FLRVRDQRG | 94.1 | FLRVKDQQGN | 3.61 | FLRVRDQLGN | 0.76 | FLRVRDQMGN | 0.39 | |
| PB2 | N/A | 514 | 0.47 | yes | 5 | 0.09 | 99.05 | LRVRDQRGN | 94.1 | | | | | | | |
| PB2 | N/A | 521 | 0.58 | yes | 2 | 0.11 | 99.07 | RGNVLLSPEE | 91.97 | RGNILLSPEE | 3.99 | LGNILLSPEE | 2.48 | QGNILLSPEE | 0.4 | LGMILLSPEE | 0.23 |
| PB2 | N/A | 522 | 0.27 | yes | 1 | 0.11 | 99.41 | GNVLLSPEEV | 96.3 | GNILLSPEEV | 3.11 | | | | | |
| PB2 | N/A | 523 | 0.28 | yes | 2 | 0.12 | 99.39 | NVLLSPEEVS | 96.28 | NILLSPEEVS | 3.11 | | | | | |
| PB2 | N/A | 524 | 0.27 | yes | 2 | 0.11 | 99.46 | VLLSPEEVSE | 96.35 | ILLSPEEVSE | 3.11 | | | | | |
| PB2 | N/A | 525 | 0.12 | yes | 1 | 0.1 | 99.01 | LLSPEEVSET | 99.01 | | | | | | | |
| PB2 | N/A | 526 | 0.14 | yes | 2 | 0.11 | 99.02 | LSPEEVSETQ | 98.74 | LSPEEVSEAQ | 0.28 | | | | | |

FIG. 74-311

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 527 | 0.14 | yes | 2 | 0.11 | 99.06

FIG. 74-312

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 610 | 0.13 | yes | 2 | 0.05 | 99.31 | RTLFQQMRDV

FIG. 74-313

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 685 | 0 | no | 1 | 99.99 | 100 | AGAGALAEDP | 100 | |

FIG. 74-314

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 753 | 0.17 | yes | 2 | 0.84 | 99.41 | RKRDSSILTD | 98.32 | | | | | | |
| PB2 | N/A | 754 | 0.17 | yes | 2 | 0.94 | 99.41 | KRDSSILTDS | 98.3 | | | | | | |
| PB2 | N/A | 755 | 0.17 | yes | 2 | 1.15 | 99.4 | RDSSILTDSQ | 98.29 | | | | | | |
| PB2 | N/A | 756 | 0.16 | yes | 2 | 1.35 | 99.43 | DSSILTDSQT | 98.32 | | | | | | |
| PB2 | N/A | 757 | 0.07 | yes | 1 | 1.4 | 99.45 | SSILTDSQTA | 99.45 | | | | | | |
| PB2 | N/A | 758 | 0.06 | yes | 1 | 1.44 | 99.58 | SILTDSQTAT | 99.58 | | | | | | |
| PB2 | N/A | 759 | 0.05 | yes | 1 | 1.7 | 99.62 | ILTDSQTATK | 99.62 | | | | | | |
| PB2 | N/A | 760 | 0.05 | yes | 1 | 2.07 | 99.66 | LTDSQTATKR | 99.66 | | | | | | |
| PB2 | N/A | 761 | 0.11 | yes | 2 | 2.49 | 99.57 | TDSQTATKRI | 98.93 | TDSQTATKRL | 0.64 | | | | |
| PB2 | N/A | 762 | 0.12 | yes | 2 | 2.63 | 99.52 | DSQTATKRIR | 98.88 | DSQTATKRLR | 0.64 | | | | |
| PB2 | N/A | 763 | 0.18 | yes | 2 | 4.35 | 99.05 | SQTATKRIRM | 98.4 | SQTATKRLRM | 0.65 | | | | |
| PB2 | N/A | 764 | 0.18 | yes | 2 | 4.53 | 99.03 | QTATKRIRMA | 98.37 | QTATKRLRMA | 0.65 | | | | |
| PB2 | N/A | 765 | 0.22 | yes | 4 | 5.14 | 99.11 | TATKRIRMA | 97.94 | TATKRLRMAI | 0.66 | TATKRIRMAT | 0.37 | TATKRIRLAI | |
| PB2 | N/A | 766 | | yes | 5 | | | KRIRMAI | 42.86 | KRIRMAINLV | 14.3 | KRIRMATNEC | 14.29 | KRIRMAINWG | 14.29 | KRIRMAINYS | 14.29 |
| PB2 | N/A | 768 | 2.13 | no | 2 | 99.95 | 100 | KRIRMAINQC | 50 | | | | | | |
| PB2 | N/A | 769 | — | no | 2 | 99.99 | 100 | RIRMAINWGR | 50 | | | | | | |
| PB2 | N/A | 770 | — | no | 2 | 99.99 | 100 | IRMAINWGRI | 50 | | | | | | |
| PB2 | N/A | 771 | — | no | 2 | 99.99 | 100 | RMAINWGRIV | 50 | | | | | | |

Fig. 75-1

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 1 | 0.72 | no | 2 | 99.98 | 100 | KQGKTKATKMK | 80 | KQGKTKATKME | 80 | | | | |
| HA | ALL | 2 | 0.72 | no | 2 | 99.98 | 100 | QGKTKATKMKA | 80 | QGKTKATKMEA | 80 | | | | |
| HA | ALL | 15 | 0.92 | no | 3 | 99.96 | 100 | IFIFLLLTHWA | 80 | IFIFLLLTHWA | 20 | IFN

Fig. 75-2

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | ALL | 346 | 0.85 | no | 2 | 99.95 | 100 | IEYNGKSLGIQ | 72.73 | VEYNGKSLGIQ | 27.27 | | | | |
| HA | ALL | 347 | 0 | no | 1 | 99.95 | 100 | EYNGKSLGIQS | 100 | | | | | | |
| HA | ALL | 348 | 0 | no | 1 | 99.95 | 100 | YNGKSLGIQSD | 100 | | | | | | |
| HA | ALL | 349 | 0 | no | 1 | 99.95 | 100 | NGKSLGIQSDA | 100 | | | | | | |
| HA | ALL | 370 | 0 | no | 1 | 100 | 100 | PSYKLPMGAIN | 100 | | | | | | |
| HA | ALL | 377 | 0 | no | 1 | 100 | 100 | GAIGAIDSSMP | 100 | | | | | | |
| HA | ALL | 378 | 0 | no | 1 | 100 | 100 | AIGAIDSSMPF | 100 | | | | | | |
| HA | ALL | 379 | 0 | no | 2 | 99.99 | 100 | IGAIDSSMPFH | 50 | YGGLNKSKPYY | 50 | | | | |
| HA | ALL | 384 | 0 | no | 1 | 100 | 100 | TSLTSLPFQNI | 100 | | | | | | |
| HA | ALL | 385 | 0 | no | 1 | 100 | 100 | SLTSLPFQNIH | 100 | | | | | | |
| HA | ALL | 386 | 0 | no | 1 | 100 | 100 | LTSLPFQNIHP | 100 | | | | | | |
| HA | ALL | 394 | 0 | no | 1 | 100 | 100 | GEHAKAIGNCP | 100 | | | | | | |
| HA | ALL | 423 | 0.37 | no | 2 | 99.99 | 100 | PAKLLKERGFF | 50 | IPIGERGLFGA | 50 | | | | |
| HA | ALL | 425 | 0.37 | no | 2 | 99.94 | 100 | REREGGRRRKR | 92.86 | KLLKERGFFGA | 7.14 | | | | |
| HA | ALL | 426 | 0 | no | 2 | 99.94 | 100 | EREGGRRRKRG | 92.86 | LLKERGFFGAI | 7.14 | | | | |
| HA | ALL | 433 | 0 | no | 1 | 100 | 100 | KKKRGLFGAIA | 100 | | | | | | |
| HA | ALL | 435 | 0 | no | 2 | 99.97 | 100 | TRRQKRGLFGA | 50 | KRKKRGLFGA | 50 | | | | |
| HA | ALL | 436 | 0 | no | 2 | 99.97 | 100 | RROKRGLFGAI | 50 | RKKKRGLFGAI | 50 | | | | |
| HA | ALL | 437 | 0 | no | 2 | 99.97 | 100 | ROKRGLFGAIA | 50 | RKKRGLFGAIA | 50 | | | | |
| HA | ALL | 438 | 0 | no | 2 | 99.97 | 100 | KKRGLFGAIAG | 50 | RKRGLFGAIAG | 50 | | | | |
| HA | ALL | 441 | 1.05 | no | 3 | 99.91 | 100 | THKQLTHHMRK | 71.43 | AHKQLTHHMRK | 23.81 | IHKQLTHHMRK | 4.76 | | |
| HA | ALL | 442 | 0 | no | 1 | 99.91 | 100 | HKQLTHHMRKK | 100 | | | | | | |
| HA | ALL | 443 | 0 | no | 1 | 99.91 | 100 | KQLTHHMRKKR | 100 | | | | | | |
| HA | ALL | 444 | 0 | no | 1 | 99.91 | 100 | QLTHHMRKKRG | 100 | | | | | | |
| HA | ALL | 445 | 0 | no | 1 | 99.91 | 100 | LTHHMRKKRGL | 100 | | | | | | |
| HA | ALL | 446 | 0 | no | 1 | 99.91 | 100 | THHMRKKRGLF | 100 | | | | | | |
| HA | ALL | 447 | 0 | no | 1 | 99.91 | 100 | HHMRKKRGLFG | 100 | | | | | | |
| HA | ALL | 448 | 0 | no | 1 | 99.91 | 100 | HMRKKRGLFGA | 100 | | | | | | |
| HA | ALL | 449 | 0.28 | no | 2 | 99.91 | 100 | MRKKRGLFGAI | 95.24 | MRKKRGLFGAK | 4.76 | | | | |

Fig. 75-3

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|
| HA | ALL | 470 | 0.75 | yes | 2 | 0.07 | 99.37 | GLFGAIAGFIE | 81.76 | GIFGAIAGFIE | 17.61 | | | | |

Fig. 75-4

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | ALL | 6 | 1.08 | no | 4 | 99.82 | 100 | QKQEFKMNPNK | 76.32 | QKQEFKMNPNQ | 15.79 | QKQEFKMNPNQ | 5.26 | | |
| NA | ALL | 7 | 1.08 | no | 4 | 99.82 | 100 | KQEFKMNPNKK | 76.32 | KQEFKMNPNQK | 15.79 | KQEIKMNPNQK | 5.26 | | |
| NA | ALL | 8 | 1.08 | no | 4 | 99.82 | 100 | QEFKMNPNKKI | 76.32 | QEFKMNPNQKI | 15.79 | AGVKMNPNQKI | 5.26 | | |
| NA | ALL | 9 | 1.13 | no | 5 | 99.82 | 100 | EFKMNPNKKII | 76.32 | EFKMNPNQKII | 15.79 | EIKMNPNQKII | 2.63 | EIKMNPNQKIM | 2.63 |
| NA | ALL | 11 | 1.25 | no | 4 | 99.81 | 100 | KMNPNKKIITI | 70.73 | KMNPNQKIITI | 17.07 | KMNPNQKIMTI | 9.76 | | |
| NA | ALL | 18 | 0 | no | 1 | 100 | 100 | IIAIGVSRT | 100 | | | | | | |
| NA | ALL | 20 | 0 | no | 1 | 100 | 100 | NRDITIGSICM | 100 | | | | | | |
| NA | ALL | 21 | 0 | no | 1 | 100 | 100 | RDITIGSICMV | 100 | | | | | | |
| NA | ALL | 22 | 0 | no | 1 | 100 | 100 | DITIGSICMVT | 100 | | | | | | |
| NA | ALL | 77 | 0 | no | 1 | 100 | 100 | VPLVPCEPIIE | 100 | | | | | | |
| NA | ALL | 78 | 0 | no | 1 | 100 | 100 | PLVPCEPIIE | 100 | | | | | | |
| NA | ALL | 79 | 0 | no | 1 | 100 | 100 | LVPCEPIIIE | 100 | | | | | | |
| NA | ALL | 411 | 1.58 | no | 2 | 100 | 100 | IRKGLILEYYS | 50 | IREGLILEYYF | 50 | | | | |
| NA | ALL | 412 | 0 | no | 3 | 100 | 100 | REGLILEYYFV | 33.33 | RKGLILEYYSL | 33.33 | VMGQASYKIFK | 33.3 | | |
| NA | ALL | 418 | 0 | no | 1 | 100 | 100 | YKYKIFKNGKK | 100 | | | | | | |
| NA | ALL | 419 | 0 | no | 1 | 100 | 100 | KYKIFKNGKKG | 100 | | | | | | |
| NA | ALL | 426 | 1.37 | no | 2 | 99.98 | 100 | GKKGKWLNQSK | 60 | EKGKVWKSVEL | 20 | GKRGKWWKSVQ | 20 | | |
| NA | ALL | 442 | 0.78 | no | 3 | 97.7 | 99.2 | IQHLEECSCYV | 87.55 | IKHLEECSCYV | 6.22 | IQHLEECSCYT | 3.21 | IRHLEECSCYV | 1.41 |
| NA | ALL | 454 | 0 | no | 1 | 99.99 | 100 | SYLNRCVCRD | 50 | SYPNVRCVCRD | 50 | | | | |
| NA | ALL | 474 | 0 | no | 1 | 100 | 100 | KLDINMADYSI | 100 | | | | | | |
| NA | ALL | 547 | 0.26 | no | 2 | 99.27 | 100 | NNYGVKGFGFR | 96.2 | DNYGVKGFGFR | 3.16 | | | | |
| NA | ALL | 548 | 0.06 | no | 2 | 99.27 | 99.37 | NYGVKGFGFRQ | 99.37 | | | | | | |
| NA | ALL | 660 | 0 | no | 1 | 100 | 100 | IFLWCKIVTTV | 100 | | | | | | |
| NA | ALL | 661 | 0 | no | 1 | 100 | 100 | FLWCKIVTTVG | 100 | | | | | | |
| NA | ALL | 662 | 0 | no | 1 | 100 | 100 | LWCKIVTTVGW | 100 | | | | | | |
| NA | ALL | 663 | 0 | no | 1 | 100 | 100 | WCKIVTTVGWS | 100 | | | | | | |
| NA | ALL | 664 | 0 | no | 1 | 100 | 100 | CKIVTTVGWSW | 100 | | | | | | |
| NA | ALL | 665 | 0 | no | 1 | 100 | 100 | KIVTTVGWSWP | 100 | | | | | | |
| NA | ALL | 666 | 0 | no | 1 | 100 | 100 | IVTTVGWSWPD | 100 | | | | | | |
| NA | ALL | 667 | 0 | no | 1 | 100 | 100 | VTTVGWSWPDG | 100 | | | | | | |
| NA | ALL | 668 | 0 | no | 1 | 100 | 100 | TTVGWSWPDGA | 100 | | | | | | |
| NA | ALL | 678 | 0 | no | 1 | 100 | 100 | RTSISCLYKLS | 100 | | | | | | |
| NA | ALL | 684 | 0 | no | 1 | 100 | 100 | NLHAYISFRNL | 100 | | | | | | |
| NA | NI | 1 | 0.59 | no | 2 | 99.99 | 100 | IGLREQIQEFK | 85.71 | LVFREQKQEFK | 14.29 | | | | |
| NA | NI | 2 | 0.77 | no | 3 | 99.94 | 100 | GLREQKQEFKM | 84.62 | FSGSQKQEFKM | 7.69 | VFREQKQEFKM | 7.69 | | |
| NA | NI | 3 | 0.73 | no | 3 | 99.89 | 100 | LREQKQEFKMN | 85.71 | FREQKQEFKMN | 7.14 | SGSQKQEFKMN | 7.14 | | |
| NA | NI | 4 | 0.35 | no | 2 | 99.88 | 100 | REQKQEFKMNP | 93.33 | GSQKQEFKMNP | 6.67 | | | | |
| NA | NI | 5 | 0.31 | no | 2 | 99.87 | 100 | EQKQEFKMNPN | 94.44 | SQKQEFKMNPN | 5.56 | | | | |
| NA | NI | 6 | 0.93 | no | 3 | 99.84 | 100 | EQKQEFKMNPNK | 85.71 | QKQEFKMNPNQ | 16.22 | QKQEIKMNPNQ | 5.41 | | |
| NA | NI | 7 | 0.93 | no | 3 | 99.67 | 100 | QKQEFKMNPNK | 78.38 | SGSQKQEFKMN | 16.22 | QKQEIKMNPNQ | 5.41 | | |
| NA | NI | 7 | 0.93 | no | 3 | 99.67 | 100 | KQEFKMNPNKK | 78.38 | KQEIKMNPNQK | 16.22 | KQEIKMNPNQK | 5.41 | | |

Fig. 75-5

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N1 | 8 | 0.93 | no | 3 | 99.67 | 100 | QEFKMNPNKKI | 78.38 | QEFKMNPNQKI | 16.22 | | | | |
| NA | N1 | 9 | 0.98 | no | 4 | 99.67 | 100 | EFKMNPNKKII | 78.38 | EIKMNPNQKII | 16.22 | EIKMNPNQKII | 5.41 | IKMNPNQKIIT | 2.7 |
| NA | N1 | 10 | 1.13 | no | 5 | 99.67 | 100 | FKMNPNKKIIT | 78.38 | FKMNPNQKIIT | 10.81 | IKMNPNQKIMT | 2.7 | | |
| NA | N1 | 11 | 1.21 | no | 4 | 99.65 | 100 | KMNPNKKIITI | 72.5 | KMNPNQKIITI | 15 | KMNPNQKIMTI | 5.41 | | |
| NA | N1 | 19 | 0 | no | 1 | 99.99 | 100 | NRDITIGSICM | 100 | | | KMNPNQKIMTI | 10 | | |
| NA | N1 | 20 | 0 | no | 1 | 99.99 | 100 | RDITIGSICMV | 100 | | | | | | |
| NA | N1 | 21 | 0 | no | 1 | 99.99 | 100 | DITIGSICMVT | 100 | | | | | | |
| NA | N1 | 44 | 1 | no | 2 | 99.98 | 100 | DLNMGQPFYSH | 50 | ASQYGPSHSIH | 50 | | | | |
| NA | N1 | 121 | 1.16 | yes | 4 | 0.19 | 99.03 | IRIGSKGDIFV | 78.95 | IRIGSKGDIFV | 8.86 | IRIGSRGDVFV | 6.07 | | |
| NA | N1 | 130 | 0.29 | yes | 4 | 0.23 | 99.15 | VRIGKGDVFV | 96.93 | FWREPFISCS | 1.6 | FIIREPFISCS | 0.39 | | |
| NA | N1 | 142 | 0.31 | yes | 5 | 0.16 | 99.1 | FWREPFISCS | 96.79 | LECKTFFLTQG | 1.16 | SECRTFFLTQG | 0.76 | FECRTFFLTQG | 5.16 |
| NA | N1 | 143 | 0.22 | yes | 3 | 0.12 | 99.14 | LECRTFFLTQG | 97.73 | ECKTFFLTQGA | 1.17 | MECRTFFLTQG | 0.24 | | 0.22 |
| NA | N1 | 144 | 0.21 | yes | 2 | 0.11 | 99.01 | ECRTFFLTQGA | 97.84 | CKTFFLTQGAL | 1.17 | ECRTFFLTQGS | 1.17 | | 0.21 |
| NA | N1 | 145 | 0.22 | yes | 2 | 0.11 | 99.14 | CRTFFLTQGAL | 97.77 | KTFFLTQGALL | 1.17 | | | | |
| NA | N1 | 146 | 0.13 | yes | 2 | 0.11 | 99.18 | RTFFLTQGALL | 98.94 | TFFLTQGALLN | 0.24 | RTFFLTQGSLL | 0.24 | | |
| NA | N1 | 147 | 0.1 | yes | 1 | 0.11 | 99.14 | TFFLTQGALLN | 99.14 | | | | | | |
| NA | N1 | 148 | 0.37 | yes | 3 | 0.11 | 99.14 | FFLTQGALLND | 94.63 | FLTQGALLNDR | 4.47 | | | | |
| NA | N1 | 149 | 0.37 | yes | 2 | 0.1 | 99.14 | FLTQGALLNDK | 94.67 | LTQGALLNDRH | 4.47 | | | | |
| NA | N1 | 150 | 0.37 | yes | 2 | 0.09 | 99.01 | LTQGALLNDKH | 94.67 | TQGALLNDRHS | 4.47 | | | | |
| NA | N1 | 151 | 0.38 | yes | 2 | 0.06 | 99.08 | TQGALLNDKHS | 94.54 | QGALLNDRHSN | 4.47 | | | | |
| NA | N1 | 152 | 0.39 | yes | 2 | 0.05 | 99.09 | QGALLNDKHSN | 94.46 | GALLNDRHSNG | 4.48 | GLLNDKHSNG | 4.47 | | |
| NA | N1 | 153 | 0.4 | yes | 3 | 0.06 | 99.16 | GALLNDKHSNG | 94.37 | ALLNDRHSNGT | 4.47 | SLLNDKHSNGT | 4.47 | | |
| NA | N1 | 154 | 1.37 | yes | 5 | 0.06 | 99.09 | ALLNDKHSNGT | 47.61 | LLNDKHSNGTV | 46.54 | LLNDKHSNGTA | 4.27 | LLNDKHSNGTI | 0.47 |
| NA | N1 | 167 | 1.48 | yes | 4 | 0.06 | 99.31 | LLNDKHSNGTI | 59.92 | LLNDKHSNGTV | 21.54 | RSPHRALMSCP | 17.4 | LLNDKHSNGTI | 0.23 |
| NA | N1 | 179 | 1.59 | yes | 3 | 0.06 | 99.34 | RSPYRTLMSCP | 32.74 | GEAPSPYNSKF | 32.76 | RSPHRALMSCP | 19.9 | | |
| NA | N1 | 180 | 1.58 | yes | 3 | 0.04 | 99.38 | GEVPSPYNSRF | 46.72 | EAPSPYNSRFE | 32.8 | GEAPSPYNSKF | 19.9 | | |
| NA | N1 | 181 | 1.58 | yes | 3 | 0.04 | 99.59 | EVPSPYNSRFE | 46.73 | APSPYNSKFES | 19.96 | EAPSPYNSKFE | 19.9 | | |
| NA | N1 | 182 | 0.78 | yes | 2 | 0.04 | 99.55 | VPSPYNSRFES | 46.73 | PSPYNSKFESV | 19.96 | APSPYNSKFES | 19.9 | | |
| NA | N1 | 183 | 0.78 | yes | 2 | 0.04 | 99.63 | PSPYNSRFESV | 79.63 | SPYNSKFESVA | 19.96 | | | | |
| NA | N1 | 184 | 0.78 | yes | 2 | 0.04 | 99.59 | SPYNSRFESVA | 79.59 | PYNSKFESVAW | 19.96 | | | | |
| NA | N1 | 185 | 0.78 | yes | 2 | 0.04 | 99.62 | PYNSRFESVAW | 79.64 | YNSKFESVAWS | 19.97 | | | | |
| NA | N1 | 186 | 0.77 | yes | 2 | 0.05 | 99.67 | YNSRFESVAWS | 79.66 | NSKFESVAWSA | 19.97 | | | | |
| NA | N1 | 187 | 0.77 | yes | 2 | 0.04 | 99.67 | NSRFESVAWSA | 79.7 | SKFESVAWSAS | 19.97 | | | | |
| NA | N1 | 188 | 0.77 | yes | 2 | 0.04 | 99.68 | SRFESVAWSAS | 79.67 | KFESVAWSASA | 19.97 | | | | |
| NA | N1 | 189 | 0.77 | yes | 2 | 0.04 | 99.69 | RFESVAWSASA | 79.72 | FESVAWSASAC | 19.97 | | | | |
| NA | N1 | 190 | 0.04 | yes | 1 | 0.04 | 99.68 | FESVAWSASAC | 99.69 | | | | | | |
| NA | N1 | 191 | 0.04 | yes | 1 | 0.04 | 99.72 | ESVAWSASACH | 99.68 | | | | | | |
| NA | N1 | 192 | 0.05 | yes | 1 | 0.03 | 99.13 | SVAWSASACHD | 99.72 | | | | | | |
| NA | N1 | 193 | 1.66 | yes | 5 | 0.04 | 99.13 | VAWSASACHDG | 52.23 | AWSASACHDGT | 25.1 | AWSASACHDGL | 20.1 | AWSASACHDGV | 1.26 |
| NA | N1 | 204 | 1.76 | yes | 5 | 0.06 | 99.15 | AWSASACHDGI | 44.15 | AWSASACHDGM | 26.59 | GWLTIGISGPD | 26.3 | SWLTIGISGPD | 1.77 |

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 169 | 1.23 | yes | 5 | 0.03 | 99.2 | YRTLLMN

Fig. 75-9

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N2 | 335 | 0.24 | yes | 3 | 0.04 | 99.06 | VCSGLVGDTPR | 97.32 | LCSGLVGDTPR | 1.02 | MCSGLVGDTPR | 0.72 | | |
| NA | N2 | 336 | 1.16 | yes | 5 | 0.04 | 99.21 | CSGLVGDTPRK | 62.7 | CSGLVGDTPRN | 34.79 | CSGLVGDTPRS | 0.87 | CSGLVGDTPRD | 0.52 | CSGLVGDTPRE | 0.33 |
| NA | N2 | 435 | 0.24 | yes | 2 | 0.03 | 99.23 | CINRCFYELI | 97.25 | CVNRCFYELI | 1.97 | | | | |
| NA | N2 | 436 | 0.24 | yes | 1 | 0.04 | 99.19 | INRCFYELIR | 97.21 | | | | | | |
| NA | N2 | 437 | 0.09 | yes | 1 | 0.04 | 99.24 | NRCFYELIRG | 99.24 | | | | | | |
| NA | N2 | 438 | 0.19 | yes | 3 | 0.26 | 99 | RCFYELIRGR | 98.19 | RCFYELIRGS | 0.68 | RCFYELVRGR | | | |
| NA | N2 | 457 | 0.68 | yes | 5 | 0.46 | 99.04 | TNSIIVFCGT | 88.6 | TNSIIVFCGT | 9.23 | TSNIIAFCGT | 0.53 | TSNIIVFCGT | 0.5 | TANSIIVFCGT | 0.5 |
| NA | N2 | 462 | 0.66 | yes | 4 | 0.5 | 99.1 | VFCGTSGTYG | 88.72 | IVFCGTSGTYG | 9.36 | IAFCGTSGTYG | 0.74 | VAFCGTSGTYG | | | 0.47 |
| NA | N2 | 463 | 0.29 | yes | 3 | 0.5 | 99.04 | AFCGTSGTYGT | 97.07 | AFCGTSGTYGT | 0.97 | VFCGTSGTYG | 0.71 | VFCGTSGTYGK | 0.21 |
| NA | N2 | 464 | 0.2 | yes | 2 | 0.51 | 99.07 | FCGTSGTYGT | 98.1 | FCGTSGTYGT | 0.73 | CGTSGTYGT | 0.21 | | |
| NA | N2 | 465 | 0.22 | yes | 3 | 0.83 | 99.11 | CGTSGTYGSG | 97.93 | CGTSGTYGSG | 0.74 | CGTSGTYGTGT | 0.21 | | |
| NA | N2 | 466 | 0.24 | yes | 3 | 1.38 | 99.06 | GTSGTYGSGW | 97.83 | GTSGTYGSGS | 0.76 | GTSGTYGAGS | 0.21 | GTSGTYGTGTW | 0.19 | GTSGTYGKGSW | 0.19 |
| NA | N2 | 467 | 0.23 | yes | 3 | 5.51 | 99.06 | TSGTYGSGWP | 97.76 | TSGTYGSGWP | 0.79 | TSGTYGAGSWP | 0.21 | TSGTYGTGTWP | 0.19 | TSGTYGKGSWP | 0.2 |
| NA | N2 | 468 | 0.22 | yes | 5 | 5.81 | 99.02 | SGTYGSGWPD | 97.81 | SGTYGSGWPD | 0.66 | SGTYGAGSWPD | 0.21 | GTYGTGTWPD | 0.22 | | |
| NA | N2 | 469 | 0.23 | yes | 4 | 6.04 | 99.09 | GTYGSGWPDG | 98.01 | GTYGSGWPDG | 0.66 | GTYGAGSWPDG | 0.22 | GTYGTGTWPDG | 0.22 | | |
| NA | N2 | 470 | 0 | yes | 5 | 99.99 | 99.13 | TYGTGSWPDGA | 97.86 | TYGSGWPDGA | 14.29 | TYGAGSWPDGA | 0.22 | TYGTGTWPDGA | 0.22 | TYGTGSWPDGG | 0.2 |
| NA | N2 | 479 | 2.13 | no | 1 | 99.92 | 100 | GADINLHAYIS | 42.86 | GANINFMPYIS | 14.29 | GRTSISCLYKL | 14.3 | GADIKSHAYIS | 14.29 | |
| NA | N2 | 480 | 0 | no | 4 | 99.93 | 100 | RTSISCLYKLS | 50 | TSISCLYKLSQ | 16.67 | ADIKSHAYISF | 16.67 | ANINFMPYISF | 16.67 | |
| NA | N2 | 481 | 1.79 | no | 3 | 99.96 | 100 | ADINLHAYISF | 60 | NINFMPYISFA | 20 | SISCLYKLSQF | 20 | | |
| NA | N2 | 482 | 1.37 | no | 1 | 99.96 | 100 | DINLHAYISFR | 100 | | | | | | |
| NA | N2 | 483 | 0 | no | 1 | 99.96 | 100 | INLHAYISFRN | 100 | | | | | | |
| NA | N2 | 484 | 0 | no | 1 | 99.96 | 100 | NLHAYISFRNL | 100 | | | | | | |
| NA | N3 | 89 | 0.47 | yes | 3 | 0.2 | 99.19 | LPLCPFRGFFP | 93.08 | LPLCPFQGFFP | 3.26 | LPLCPFQGFFP | 3.26 | | |
| NA | N3 | 90 | 0.47 | yes | 3 | 0.2 | 99.19 | PLCPRGFFPF | 93.08 | PLCPFKGFFPF | 3.26 | PLCPFQGFFPF | 3.26 | | |
| NA | N3 | 91 | 0.47 | yes | 3 | 0.2 | 99.19 | LCPRGFFPFH | 93.08 | LCPFKGFFPH | 3.26 | LCPFQGFFPH | 3.26 | | |
| NA | N3 | 92 | 0.45 | yes | 3 | 0.39 | 99.39 | CPRGFFPFHH | 93.28 | CPFKGFFPFHH | 3.26 | CPFQGFFPHHK | 3.26 | | |
| NA | N3 | 93 | 0.47 | yes | 3 | 0.2 | 99.19 | PRGFFPFHHK | 93.08 | PFKGFFPFHHK | 3.26 | PFQGFFPHHK | 3.26 | | |
| NA | N3 | 94 | 0.45 | yes | 3 | 0.39 | 99.39 | RGFFPFHHKDNA | 93.28 | FKGFFPFHHKDNA | 3.26 | FQGFFPFHHKDNA | 3.26 | | |
| NA | N3 | 95 | 0.43 | yes | 3 | 0 | 99.8 | QGFFPFHHKDNA | 93.28 | KGFFPFHHKDNA | 3.26 | | | | |
| NA | N3 | 96 | 0.33 | yes | 3 | 0 | 99.8 | GFFPHHKDNAL | 95.33 | GFFPHHKDNAL | 1.22 | FFPHHKDNAV | 1.22 | | |
| NA | N3 | 97 | 0.32 | yes | 3 | 0.2 | 99.59 | FFPHHKDNAIR | 95.33 | FFPHHKDNALR | 1.22 | FFPHHKDNAVR | 1.22 | | |
| NA | N3 | 98 | 0.34 | yes | 4 | 0.2 | 99.59 | FPHHKDNAIRL | 95.12 | FPHHKDNALRL | 1.22 | FPHHKDNAVRL | 1.22 | | |
| NA | N3 | 99 | 0.34 | yes | 4 | 0.2 | 99.59 | PHHKDNAIRLG | 95.12 | PHHKDNALRLA | 1.22 | PHHKDNAVRLG | 1.22 | | |
| NA | N3 | 100 | 0.34 | yes | 4 | 0.2 | 99.59 | FHHKDNAIRLGE | 95.12 | HHKDNALRLAE | 1.22 | HHKDNAVRLGE | 1.22 | HKDNAIRLGET | 1.22 |
| NA | N3 | 101 | 0.4 | yes | 4 | 0.2 | 99.19 | HKDNAIRLGEN | 94.51 | HKDNALRLAEN | 1.22 | HKDNAVRLGEN | 1.22 | | |
| NA | N3 | 115 | 0.69 | yes | 5 | 0 | 99.19 | IVTREPYISCD | 89.43 | LVTREPYISCD | 3.25 | IVTREPYISCD | 3.25 | IVTREPCVSCD | 0.61 | |
| NA | N3 | 116 | 1.04 | yes | 5 | 0 | 99.39 | VTREPYISCDN | 81.71 | VTREPYISCDY | 8.33 | ITREPYISCD | 6.3 | ITREPYISCDN | 1.22 | |
| NA | N3 | 129 | 0.17 | yes | 3 | 0 | 99.19 | CWSFALAQGAL | 98.17 | CWSFALAQGTL | 0.81 | VTREPYISCDS | 6.3 | ITREPYISCDN | 1.63 | |
| NA | N3 | 130 | 0.5 | yes | 4 | 0 | 99.39 | WSFALAQGALL | 91.87 | WSFALAQGTLL | 0.81 | WSFALAQGVIL | 0.81 | WSFALAQGVLL | 0.41 | |
| NA | N3 | 131 | 0.5 | yes | 4 | 0 | 99.39 | SFALAQGALLG | 91.87 | SFALAQGTLLG | 0.81 | SFALAQGVLL | 0.81 | SFALSQGALLG | 0.41 | |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N3 | 359 | 0.25 | yes | 3 | 0.61 | 99.39 | ETGYVCSKFHS | 96.93 | ETGYVCGKFHS | 2.04 | ETGYVCGKFHS | 0.41 | | |
| NA | N3 | 360 | 0.26 | yes | 3 | 0.61 | 99.39 | TGYVCSKFHSD | 96.73 | TGYICSKFHSD | 2.25 | TGYVCGKFHSD | 0.41 | | |
| NA | N3 | 361 | 0.24 | yes | 3 | 0.61 | 99.39 | GYVCSKFHSDT | 96.73 | GYICSKFHSDT | 2.25 | GYVCGKFHSDT | 0.41 | | |
| NA | N3 | 362 | 0.24 | yes | 2 | 0.61 | 99.18 | YVCSKFHSDTP | 96.93 | YICSKFHSDTP | 2.25 | | | | |
| NA | N3 | 363 | 0.24 | yes | 1 | 0.61 | 99.18 | VCSKFHSDTPR | 96.93 | VCSKFHSDTP | 2.25 | | | | |
| NA | N3 | 364 | 0.08 | yes | 1 | 0.61 | 99.18 | CSKFHSDTPRP | 99.18 | ICSKFHSDTPR | 2.25 | | | | |
| NA | N3 | 366 | 1.18 | yes | 5 | 0.81 | 99.39 | KFHSDTPRPAD | 79.51 | KFHSDTPRPDD | 6.76 | KFHSDTPRPSD | 5.53 | KFHSDTPRPTD | 2.66 |
| NA | N3 | 367 | 1.16 | yes | 5 | 0.81 | 99.39 | FHSDTPRPADP | 79.51 | FHSDTPRPDDP | 6.76 | FHSDTPRPSDP | 5.53 | FHSDTPRPTDP | 2.66 |
| NA | N3 | 368 | 1.16 | yes | 5 | 0.81 | 99.39 | HSDTPRPADPS | 79.51 | HSDTPRPDDPS | 6.76 | HSDTPRPSDPS | 5.53 | HSDTPRPTDPS | 2.66 |
| NA | N3 | 439 | 0.27 | yes | 3 | 0 | 99.39 | TDTLVSNNDWS | 96.95 | TDTLVSNNDWS | 1.22 | TDTLVANNDWS | 0.41 | NQTLVSNNDWS | 0.41 |
| NA | N3 | 440 | 0.2 | yes | 3 | 0 | 99.39 | QTLVSNNDWSG | 97.76 | QTLVSNDWSG | 1.22 | QTLVANNDWSG | 0.41 | | |
| NA | N3 | 441 | 0.18 | yes | 3 | 0 | 99.39 | TLYSNDWSGY | 97.76 | TLYSNDWSGY | 1.22 | TLVANNDWSGY | 0.41 | | |
| NA | N3 | 442 | 0.18 | yes | 3 | 0 | 99.39 | LVSNDWSGYS | 97.97 | LVSNDWSGYS | 1.22 | | | | |
| NA | N3 | 443 | 0.2 | yes | 3 | 0 | 99.39 | VSNNDWSGYSG | 97.97 | VSNDWSGYSG | 1.22 | | | | |
| NA | N3 | 444 | 0.16 | yes | 2 | 0 | 99.39 | SNNDWSGYSGS | 97.97 | SNDWSGYSGS | 1.22 | ANNDWSGYSGS | 0.41 | | |
| NA | N3 | 445 | 0.43 | yes | 4 | 0 | 99.39 | NNDWSGYSGSF | 98.17 | NSDWSGYSGSF | 1.22 | | | | |
| NA | N3 | 446 | 0.6 | yes | 3 | 0 | 99.19 | NDWSGYSGSFI | 94.11 | SDWSGYSGSFI | 3.46 | NDWSGYSGSFS | 1.22 | | |
| NA | N3 | 447 | 1.46 | yes | 3 | 0 | 99.19 | DWSGYSGSFV | 91.06 | DWSGYSGSFVI | 4.47 | DWSGYSGSFV | 3.05 | DWSGYSGSFW | 0.2 |
| NA | N3 | 461 | 1.22 | yes | 4 | 0 | 99.19 | DCFQPCFYVEL | 48.98 | GCFQPCFYIEL | 41.06 | GCFQPCFYVEL | 8.33 | | |
| NA | N3 | 462 | 1.22 | yes | 3 | 0 | 99.19 | CFQPCFYIELI | 55.28 | CFQPCFYELT | 40.85 | CFQPCFYVELT | 3.25 | | |
| NA | N3 | 463 | 1.22 | yes | 3 | 0 | 99.19 | FQPCFYIELIR | 55.28 | FQPCFYELTR | 40.85 | FQPCFYVELTR | 3.25 | | |
| NA | N3 | 464 | 1.58 | yes | 4 | 0 | 99.39 | QPCFYIELIRG | 55.08 | QPCFYVELTRG | 40.85 | ACFQPCFYVEL | 3.25 | | |
| NA | N3 | 465 | 0.21 | yes | 3 | 0 | 99.19 | PCFYIELIRGR | 29.67 | PCFYIELIRGK | 0.61 | PCFYVELTRGV | 11.2 | | |
| NA | N3 | 482 | 0.21 | yes | 4 | 0 | 99.19 | VSWTSNSIVTF | 97.76 | VSWAASNSIVTF | 0.61 | VSWTSNSIITF | 0.61 | | |
| NA | N3 | 483 | 0.21 | yes | 4 | 0 | 99.19 | SWTSNSIVTFC | 97.76 | SWTSNSMVTFC | 0.61 | SWTSNSIITFC | 0.61 | | |
| NA | N3 | 484 | 0.19 | yes | 4 | 0 | 99.19 | WTSNSIVTFCG | 97.97 | WASNSIVTFCG | 0.61 | | | | |
| NA | N3 | 485 | 0.19 | yes | 3 | 0 | 99.19 | TSNSIVTFCGL | 97.97 | ASNSIVTFCGL | 0.61 | | | | |
| NA | N3 | 486 | 0.29 | yes | 4 | 0.2 | 99.18 | SNSIVTFCGLD | 96.54 | SNSMVTFCGLD | 1.83 | SNSIVTFCGLD | 0.61 | | |
| NA | N3 | 487 | 0.29 | yes | 4 | 0.2 | 99.18 | NSIVTFCGLDN | 96.54 | NSMVTFCGLDN | 1.83 | NSIVTFCGLBN | 0.61 | | |
| NA | N3 | 488 | 0.29 | yes | 4 | 0.41 | 99.18 | SIVTFCGLDNE | 96.53 | SMVTFCGLDNE | 1.84 | SIVTFCGLBNE | 0.61 | | |
| NA | N3 | 489 | 0.29 | yes | 4 | 0.41 | 99.38 | IVTFCGLDNEP | 96.53 | MVTFCGLDNEP | 1.84 | IVTFCGLBNEP | 0.61 | | |
| NA | N3 | 490 | 0.23 | yes | 4 | 1.02 | 99.38 | VTFCGLDNEPG | 97.13 | VTFCGLDNEPD | 1.85 | | | | |
| NA | N3 | 491 | 0.2 | yes | 3 | 1.22 | 99.38 | TFCGLNNEPG | 97.53 | | | | | | |
| NA | N3 | 492 | 0.24 | yes | 2 | 1.22 | 98.95 | FCGLNNEPGSG | 97.12 | FCGLDNEPGSE | 0.41 | | | | |
| NA | N3 | 495 | 0.31 | yes | 4 | 3.46 | 99.38 | LDNEPGSGNWP | 96.2 | LNNEPGSGNWP | 1.9 | LBNEPGSGNWP | 0.41 | | |
| NA | N3 | 496 | 0.29 | yes | 3 | 3.86 | 99.15 | DNEPGSGNWPD | 96.19 | NEPGSGNGLM | 0.85 | DNEPGSGNGLM | 0.84 | | |
| NA | N3 | 497 | 0.16 | yes | 2 | 4.67 | 98.93 | NEPGSGNWPDG | 98.29 | NEPGSGDWPD | 0.85 | | | | |
| NA | N3 | 498 | 0.39 | yes | 5 | 5.28 | 99.1 | EPGSGNWPDGS | 94.84 | EPGSGNWPDGA | 0.85 | EPGSGNWPDGP | 0.86 | WPDGANIGLCP | 0.43 |
| NA | N3 | 504 | 0.35 | yes | 4 | 9.35 | 99.1 | WPDGNIGFMP | 95.74 | WPDGSDIGFMP | 3.01 | WPDGSNIGLCP | 0.67 | WPDGANIGLCP | 0.22 |
| NA | N3 | 505 | 0.31 | no | 3 | 11.99 | 99.08 | PDGSNIGFMPK | 96.07 | PDGSDIGFMPK | 2.31 | PDGSNIGFMPK | 0.69 | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| NA | N4 | 95 | 0 | yes | 1 | 0 | 100 | GWAPLSKDNGI | 100 | | | | | | | | |
| NA | N4 | 96 | 0 | yes | 1 | 0 | 100 | WAPLSKDNGIR | 100 | | | | | | | | |
| NA | N4 | 97 | 0 | yes | 1 | 0 | 100 | APLSKDNGIRI | 100 | | | | | | | | |
| NA | N4 | 98 | 0 | yes | 1 | 0 | 100 | PLSKDNGIRIG | 100 | | | | | | | | |
| NA | N4 | 99 | 0 | yes | 1 | 0 | 100 | LSKDNGIRIGS | 100 | | | | | | | | |
| NA | N4 | 100 | 0 | yes | 1 | 0 | 100 | SKDNGIRIGSR | 100 | | | | | | | | |
| NA | N4 | 101 | 0 | yes | 1 | 0 | 100 | KDNGIRIGSRG | 100 | | | | | | | | |
| NA | N4 | 102 | 0 | yes | 1 | 0 | 100 | DNGIRIGSRGE | 100 | | | | | | | | |
| NA | N4 | 103 | 0.07 | yes | 1 | 0 | 99.19 | NGIRIGSRGEV | 99.19 | | | | | | | | |
| NA | N4 | 104 | 0.07 | yes | 1 | 0 | 99.19 | GIRIGSRGEVF | 99.19 | | | | | | | | |
| NA | N4 | 105 | 0.07 | yes | 1 | 0 | 99.19 | IRIGSRGEVFV | 99.19 | | | | | | | | |
| NA | N4 | 106 | 0.07 | yes | 1 | 0 | 99.19 | RIGSRGEVFVI | 99.19 | | | | | | | | |
| NA | N4 | 107 | 0.07 | yes | 1 | 0 | 99.19 | IGSRGEVFVIR | 99.19 | | | | | | | | |
| NA | N4 | 108 | 0.07 | yes | 1 | 0 | 99.19 | GSRGEVFVIRE | 99.19 | | | | | | | | |
| NA | N4 | 109 | 0.14 | yes | 1 | 0 | 99.19 | SRGEVFVIREP | 99.19 | | | | | | | | |
| NA | N4 | 110 | 0.2 | yes | 2 | 0 | 99.19 | RGEVFVIREPF | 98.37 | RGEVSVIREPF | 0.81 | | | | | | |
| NA | N4 | 111 | 0.2 | yes | 3 | 0 | 99.19 | GEVFVIREPFV | 97.56 | GEVFVIREPFVS | 0.81 | | | | | | |
| NA | N4 | 112 | 0.2 | yes | 3 | 0 | 99.19 | EVFVIREPFVS | 97.56 | EVFVIREPCIS | 0.81 | | | | | | |
| NA | N4 | 113 | 0.26 | yes | 3 | 0 | 99.19 | VFVIREPFVSC | 97.56 | VFVIREPCISC | 0.81 | | | | | | |
| NA | N4 | 114 | 1.48 | yes | 5 | 0 | 96.75 | FVIREPFVSCS | 1.63 | FVIREPFISCS | 0.81 | | | | | | |
| NA | N4 | 115 | 2 | yes | 5 | 0 | 46.34 | VIREPFISCSI | 44.72 | VIREPFISCS | 0.81 | ISCSVSECRTF | 0.81 | | | | | |
| NA | N4 | 121 | 2 | yes | 5 | 0 | 46.34 | ISCSISECRTF | 44.72 | ISCSIDECRTF | 1.63 | SCSIHECRTF | 5.69 | VSCSIHECRTF | 0.81 | | |
| NA | N4 | 122 | 2 | yes | 5 | 0 | 46.34 | SCSISECRTFF | 44.72 | SCSIDECRTFF | 1.63 | SCSIHECRTF | 5.69 | SCSVSECRTFF | 1.63 | | |
| NA | N4 | 123 | 2 | yes | 5 | 0 | 46.34 | CSISECRTFFL | 44.72 | CSIDECRTFFL | 1.63 | CSIHECRTFFL | 5.69 | CVSECRTFFL | 1.63 | | |
| NA | N4 | 124 | 1.46 | yes | 5 | 0 | 46.34 | SISECRTFFLT | 44.72 | SIDECRTFFLT | 1.63 | SVSECRTFFLT | 5.69 | SIHECRTFFLT | 1.63 | | |
| NA | N4 | 125 | 1.46 | yes | 5 | 0 | 46.34 | ISECRTFFLTQ | 44.72 | IDECRTFFLTQ | 1.63 | VSECRTFFLTQ | 5.69 | IHECRTFFLTQ | 1.63 | | |
| NA | N4 | 126 | 1.46 | yes | 4 | 0 | 47.97 | SECRTFFLTQG | | DECRTFFLTQG | | HECRTFFLTQG | 5.69 | | | | |
| NA | N4 | 127 | 1.36 | yes | 1 | 0 | 100 | ECRTFFLTQGA | 100 | | | | | | | | |
| NA | N4 | 128 | 0 | yes | 1 | 0 | 100 | CRTFFLTQGAL | 100 | | | | | | | | |
| NA | N4 | 129 | 0 | yes | 1 | 0 | 100 | RTFFLTQGALL | 100 | | | | | | | | |
| NA | N4 | 130 | 0 | yes | 1 | 0 | 100 | TFFLTQGALLN | 100 | | | | | | | | |
| NA | N4 | 131 | 0 | yes | 1 | 0 | 100 | FFLTQGALLND | 100 | | | | | | | | |
| NA | N4 | 132 | 0 | yes | 1 | 0 | 100 | FLTQGALLNDK | 100 | | | | | | | | |
| NA | N4 | 133 | 0 | yes | 1 | 0 | 100 | LTQGALLNDKH | 100 | | | | | | | | |
| NA | N4 | 134 | 0 | yes | 1 | 0 | 100 | TQGALLNDKHS | 100 | | | | | | | | |
| NA | N4 | 135 | 0 | yes | 1 | 0 | 100 | QGALLNDKHSN | 100 | | | | | | | | |
| NA | N4 | 136 | 0 | yes | 1 | 0 | 100 | GALLNDKHSNG | 100 | | | | | | | | |
| NA | N4 | 137 | 0 | yes | 1 | 0 | 100 | ALLNDKHSNGT | 100 | | | | | | | | |
| NA | N4 | 138 | 0 | yes | 1 | 0 | 100 | LLNDKHSNGTV | 100 | | | | | | | | |
| NA | N4 | 139 | 0 | yes | 1 | 0 | 100 | LNDKHSNGTVK | 100 | | | | | | | | |

Fig. 75-14

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 140 | 0 | yes | 1 | 0 | 100 | NDKHSNGTVKD | 100 | | | | | | |
| NA | N4 | 141 | 0 | yes | 1 | 0 | 100 | DKHSNGTVKDR | 100 | | | | | | |
| NA | N4 | 142 | 0 | yes | 1 | 0 | 100 | KHSNGTVKDRS | 100 | | | | | | |
| NA | N4 | 143 | 0 | yes | 1 | 0 | 100 | HSNGTVKDRSP | 100 | | | | | | |
| NA | N4 | 144 | 0 | yes | 1 | 0 | 100 | SNGTVKDRSPF | 100 | | | | | | |
| NA | N4 | 145 | 0 | yes | 1 | 0 | 100 | NGTVKDRSPFR | 100 | | | | | | |
| NA | N4 | 146 | 0 | yes | 1 | 0 | 100 | GTVKDRSPFRT | 100 | | | | | | |
| NA | N4 | 147 | 0 | yes | 1 | 0 | 100 | TVKDRSPFRTL | 100 | | | | | | |
| NA | N4 | 148 | 0 | yes | 1 | 0 | 100 | VKDRSPFRTLM | 100 | | | | | | |
| NA | N4 | 149 | 0 | yes | 1 | 0 | 100 | KDRSPFRTLMS | 100 | | | | | | |
| NA | N4 | 150 | 0 | yes | 1 | 0 | 100 | DRSPFRTLMSC | 100 | | | | | | |
| NA | N4 | 151 | 0.07 | yes | 3 | 0 | 99.19 | RSPFRTLMSCP | 99.19 | SPFRTLMSCPV | 4.88 | SPFRTLMSCPM | 92.68 | | | |
| NA | N4 | 152 | 0.47 | yes | 3 | 0 | 99.19 | SPFRTLMSCPI | 99.19 | PFRTLMSCPVG | 4.88 | PFRTLMSCPMG | 92.68 | | | |
| NA | N4 | 153 | 0.47 | yes | 4 | 0 | 99.19 | PFRTLMSCPIG | 99.19 | FRTLMSCPVGV | 4.88 | FRTLMSCPMGV | 92.68 | RTLMSCHIGVA | 1.63 | |
| NA | N4 | 154 | 0.47 | yes | 4 | 0 | 99.19 | FRTLMSCPIGV | 99.19 | RTLMSCPVGVA | 4.88 | RTLMSCPMGVA | 91.87 | TLMSCHIGVAP | 1.63 | |
| NA | N4 | 155 | 0.53 | yes | 4 | 0 | 99.19 | RTLMSCPIGVA | 99.19 | TLMSCPVGVAP | 4.88 | TLMSCPMGVAP | 91.87 | LMSCHIGVAPS | 1.63 | |
| NA | N4 | 156 | 0.53 | yes | 4 | 0 | 99.19 | TLMSCPIGVAP | 99.19 | LMSCPVGVAPS | 4.88 | LMSCPMGVAPS | 91.87 | MSCHIGVAPSP | 1.63 | |
| NA | N4 | 157 | 0.53 | yes | 4 | 0 | 99.19 | LMSCPIGVAPS | 99.19 | MSCPVGVAPSP | 4.88 | MSCPMGVAPSP | 91.87 | SCHIGVAPSPS | 1.63 | |
| NA | N4 | 158 | 0.53 | yes | 4 | 0 | 99.19 | MSCPIGVAPSP | 99.19 | SCPVGVAPSPS | 4.88 | SCPMGVAPSPS | 91.87 | CPIGVWPSPSN | 1.63 | |
| NA | N4 | 159 | 0.53 | yes | 4 | 0 | 99.19 | SCPIGVAPSPS | 99.19 | CPVGVAPSPSN | 4.88 | CPMGVAPSPSN | 91.87 | HIGVAPSPSNS | 1.63 | |
| NA | N4 | 160 | 0.53 | yes | 4 | 0 | 99.19 | CPIGVAPSPSN | 99.19 | PVGVAPSPSNS | 4.88 | PMGVAPSPSNS | 91.87 | | | |
| NA | N4 | 161 | 0.47 | yes | 3 | 0 | 99.19 | PIGVAPSPSNS | 99.19 | VGVAPSPSNSR | 4.88 | MGVAPSPSNSR | 92.68 | | | |
| NA | N4 | 162 | 0.47 | yes | 3 | 0 | 99.19 | IGVAPSPSNSR | 99.19 | | | | | | | |
| NA | N4 | 163 | 0.07 | yes | 3 | 0 | 99.19 | GVAPSPSNSRF | 99.19 | | | | | | | |
| NA | N4 | 164 | 0.07 | yes | 1 | 0 | 100 | VAPSPSNSRFE | 100 | | | | | | | |
| NA | N4 | 165 | 0 | yes | 1 | 0 | 100 | APSPSNSRFES | 100 | | | | | | | |
| NA | N4 | 166 | 0 | yes | 1 | 0 | 100 | PSPSNSRFESV | 100 | | | | | | | |
| NA | N4 | 167 | 0 | yes | 1 | 0 | 100 | SPSNSRFESVA | 100 | | | | | | | |
| NA | N4 | 168 | 0 | yes | 1 | 0 | 100 | PSNSRFESVAW | 100 | | | | | | | |
| NA | N4 | 169 | 0 | yes | 1 | 0 | 100 | SNSRFESVAWS | 100 | | | | | | | |
| NA | N4 | 170 | 0 | yes | 1 | 0 | 100 | NSRFESVAWSA | 100 | | | | | | | |
| NA | N4 | 171 | 0 | yes | 1 | 0 | 100 | SRFESVAWSAT | 100 | | | | | | | |
| NA | N4 | 172 | 0 | yes | 1 | 0 | 100 | RFESVAWSATA | 100 | | | | | | | |
| NA | N4 | 173 | 0 | yes | 1 | 0 | 100 | FESVAWSATAC | 100 | | | | | | | |
| NA | N4 | 174 | 0 | yes | 1 | 0 | 100 | ESVAWSATACS | 100 | | | | | | | |
| NA | N4 | 175 | 0 | yes | 1 | 0 | 100 | SVAWSATACSD | 100 | | | | | | | |
| NA | N4 | 176 | 0 | yes | 1 | 0 | 100 | VAWSATACSDG | 100 | | | | | | | |
| NA | N4 | 177 | 0.17 | yes | 2 | 0 | 100 | AWSATACSDGP | 100 | AWSATACSDGS | 2.44 | | | | | |
| NA | N4 | 178 | 0.17 | yes | 2 | 0 | 100 | WSATACSDGPG | 100 | WSATACSDGSG | 2.44 | | | | | |
| NA | N4 | 179 | 0.17 | yes | 2 | 0 | 100 | SATACSDGPGW | 100 | SATACSDGSGW | 2.44 | | | | | |

Fig. 75-15

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 180 | 0.17 | yes | 2 | 0 | 100 | ATACSDGPGWL | 97.56 | ATACSDGSGWL | 2.44 | | | | |
| NA | N4 | 181 | 0.17 | yes | 2 | 0 | 100 | TACSDGPGWLT | 97.56 | TACSDGSGWLT | 2.44 | | | | |
| NA | N4 | 182 | 0.37 | yes | 3 | 0 | 100 | ACSDGPGWLTL | 94.31 | ACSDGSGWLTL | 3.25 | | | | |
| NA | N4 | 183 | 0.37 | yes | 3 | 0 | 100 | CSDGPGWLTLG | 94.31 | CSDGSGWLTLI | 3.25 | | | | |
| NA | N4 | 184 | 0.37 | yes | 3 | 0 | 100 | SDGPGWLTLGI | 94.31 | SDGSGWLTLGI | 3.25 | | | | |
| NA | N4 | 185 | 0.37 | yes | 3 | 0 | 100 | DGPGWLTLGIT | 94.31 | DGSGWLTLGIT | 3.25 | | | | |
| NA | N4 | 186 | 0.37 | yes | 3 | 0 | 100 | GPGWLTLGITG | 94.31 | GSGWLTLGITG | 3.25 | | | | |
| NA | N4 | 187 | 0.21 | yes | 2 | 0 | 100 | PGWLTLGITGP | 94.31 | SGWLTLGITGP | 3.25 | | | | |
| NA | N4 | 188 | 0 | yes | 2 | 0 | 100 | GWLTLGITGPD | 96.75 | | | | | | |
| NA | N4 | 189 | 1.21 | yes | 4 | 0 | 99.19 | WLTLGITGPDA | 73.17 | WLTLGITGPDT | 14.63 | WLTIGITGPDA | 8.94 | | |
| NA | N4 | 190 | 1.21 | yes | 4 | 0 | 99.19 | LTLGITGPDAT | 73.17 | LTLGITGPDTT | 14.63 | LTIGITGPDAT | 8.94 | | |
| NA | N4 | 191 | 1.21 | yes | 4 | 0 | 99.19 | TLGITGPDATA | 73.17 | TLGITGPDTTA | 14.63 | TIGITGPDATA | 8.94 | | |
| NA | N4 | 192 | 1.08 | yes | 3 | 0 | 99.19 | LGITGPDATAV | 73.17 | LGITGPDTAV | 14.63 | IGITGPDATAV | 8.94 | | |
| NA | N4 | 193 | 1.08 | yes | 3 | 0 | 100 | GITGPDATAVA | 75.61 | GITGPDSTAVA | 14.63 | | | | |
| NA | N4 | 194 | 1.08 | yes | 3 | 0 | 99.19 | ITGPDATAVAV | 75.61 | ITGPDSTAVAV | 14.63 | | | | |
| NA | N4 | 195 | 1.14 | yes | 4 | 0 | 99.19 | TGPDATAVAVI | 74.8 | TGPDSTAVAVI | 14.63 | TGPDATAVAVI | 8.94 | | |
| NA | N4 | 196 | 1.14 | yes | 4 | 0 | 99.19 | GPDATAVAVLK | 74.8 | GPDSTAVAVIK | 14.63 | GPDATAVAVLK | 8.94 | | |
| NA | N4 | 197 | 1.14 | yes | 4 | 0 | 99.19 | PDATAVAVLKY | 74.8 | PDSTAVAVIKY | 14.63 | PDATAVVLKY | 8.94 | | |
| NA | N4 | 198 | 1.14 | yes | 4 | 0 | 99.19 | DATAVAVLKYN | 74.8 | DSTAVAVIKYN | 14.63 | DATAVVIKYN | 8.94 | | |
| NA | N4 | 199 | 0.85 | yes | 3 | 0 | 99.19 | ATAVAVLKYNG | 81.3 | STAVAVIKYNG | 14.63 | ATAVVLKYNG | 2.44 | | |
| NA | N4 | 200 | 0.85 | yes | 3 | 0 | 99.19 | TAVAVLKYNGI | 81.3 | TAVAVIKYNGI | 15.45 | | | | |
| NA | N4 | 201 | 0.85 | yes | 3 | 0 | 99.19 | AVAVLKYNGII | 81.3 | AVAVIKYNGII | 15.45 | | | | |
| NA | N4 | 202 | 0.78 | yes | 3 | 0 | 99.19 | VAVLKYNGIIT | 81.3 | VAVIKYNGIIT | 15.45 | | | | |
| NA | N4 | 203 | 0.86 | yes | 4 | 0 | 100 | AVLKYNGIITD | 82.11 | AVIKYNGIITD | 15.45 | | | | |
| NA | N4 | 204 | 0.28 | yes | 3 | 0 | 100 | VLKYNGIITDT | 82.11 | VIKYNGVITDT | 13.82 | | | | |
| NA | N4 | 205 | 0.28 | yes | 3 | 0 | 99.19 | LKYNGIITDTL | 95.93 | IKYNGIITDTF | 2.44 | | | | |
| NA | N4 | 206 | 0.28 | yes | 3 | 0 | 99.19 | KYNGIITDTLK | 95.93 | KYNGVITDTLK | 2.44 | IKYNGIITDTF | 1.63 | | |
| NA | N4 | 207 | 0.35 | yes | 3 | 0 | 100 | YNGIITDTLKS | 95.12 | YNGVITDTLKS | 2.44 | | | | |
| NA | N4 | 208 | 0.28 | yes | 3 | 0 | 99.19 | NGIITDTLKSW | 95.12 | NGVITDTLKSW | 2.44 | | | | |
| NA | N4 | 209 | 0.35 | yes | 3 | 0 | 99.19 | GIITDTLKSWK | 95.12 | GVITDTLKSWK | 2.44 | | | | |
| NA | N4 | 210 | 0.19 | yes | 2 | 0 | 100 | IITDTLKSWKG | 97.56 | | | | | | |
| NA | N4 | 211 | 0.19 | yes | 2 | 0 | 99.19 | ITDTLKSWKGN | 97.56 | | | | | | |
| NA | N4 | 212 | 0.19 | yes | 2 | 0 | 99.19 | TDTLKSWKGNI | 97.56 | | | | | | |
| NA | N4 | 213 | 0.19 | yes | 2 | 0 | 99.19 | DTLKSWKGNIM | 97.56 | | | | | | |
| NA | N4 | 214 | 0.19 | yes | 2 | 0 | 99.19 | TLKSWKGNIMR | 97.56 | | | | | | |
| NA | N4 | 215 | 0.19 | yes | 2 | 0 | 99.19 | LKSWKGNIMRT | 97.56 | | | | | | |
| NA | N4 | 216 | 0.07 | yes | 1 | 0 | 99.19 | KSWKGNIMRTQ | 99.19 | | | | | | |
| NA | N4 | 217 | 0.07 | yes | 1 | 0 | 99.19 | SWKGNIMRTQE | 99.19 | | | | | | |
| NA | N4 | 218 | 0.07 | yes | 1 | 0 | 99.19 | WKGNIMRTQES | 99.19 | | | | | | |
| NA | N4 | 219 | 0.07 | yes | 1 | 0 | 99.19 | KGNIMRTQESE | 99.19 | | | | | | |

Fig. 75-16

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 220 | 0 | yes | 1 | 0 | 100 | GNIMRTQESEC | 100 | | | | | | |
| NA | N4 | 221 | 0 | yes | 1 | 0 | 100 | NIMRTQESECV | 100 | | | | | | |
| NA | N4 | 222 | 0 | yes | 1 | 0 | 100 | IMRTQESECVC | 100 | | | | | | |
| NA | N4 | 223 | 0.07 | yes | 1 | 0 | 99.19 | MRTQESECVCQ | 99.19 | | | | | | |
| NA | N4 | 224 | 0.07 | yes | 1 | 0 | 99.19 | RTQESECVCQD | 99.19 | | | | | | |
| NA | N4 | 225 | 0.07 | yes | 1 | 0 | 99.19 | TQESECVCQDE | 99.19 | | | | | | |
| NA | N4 | 226 | 0.07 | yes | 1 | 0 | 99.19 | QESECVCQDEF | 99.19 | | | | | | |
| NA | N4 | 227 | 0.07 | yes | 1 | 0 | 99.19 | ESECVCQDEFC | 99.19 | | | | | | |
| NA | N4 | 228 | 0.07 | yes | 1 | 0 | 99.19 | SECVCQDEFCY | 99.19 | | | | | | |
| NA | N4 | 229 | 0.07 | yes | 1 | 0 | 99.19 | ECVCQDEFCYT | 99.19 | | | | | | |
| NA | N4 | 230 | 0.07 | yes | 1 | 0 | 99.19 | CVCQDEFCYTL | 99.19 | | | | | | |
| NA | N4 | 231 | 1.04 | yes | 3 | 0 | 74.8 | CQDEFCYTLM | 74.8 | VCQDEFCYTLM | 19.51 | | | | |
| NA | N4 | 232 | 1.04 | yes | 3 | 0 | 74.8 | QDEFCYTLMT | 74.8 | CQDEFCYTLMT | 19.51 | | | | |
| NA | N4 | 233 | 1.04 | yes | 3 | 0 | 74.8 | DEFCYTLMTD | 74.8 | QDEFCYTLVTD | 19.51 | | | | |
| NA | N4 | 234 | 0.98 | yes | 3 | 0 | 75.61 | EFCYTLMTDG | 75.61 | DEFCYTLVTDG | 19.51 | | | | |
| NA | N4 | 235 | 0.98 | yes | 3 | 0 | 75.61 | FCYTLMTDGP | 75.61 | EFCYTLVTDGP | 19.51 | | | | |
| NA | N4 | 236 | 0.98 | yes | 3 | 0 | 75.61 | CYTLMTDGPS | 75.61 | FCYTLVTDGP | 19.51 | | | | |
| NA | N4 | 237 | 1.24 | yes | 3 | 0 | 70.73 | YTLMTDGPSD | 70.73 | CYTLVTDGPS | 19.51 | CYTLVTDGPSD | 4.88 | | |
| NA | N4 | 238 | 1.27 | yes | 3 | 0 | 70.73 | TLMTDGPSDA | 70.73 | YTLVTDGPSA | 19.51 | YTLVTDGPSDA | 4.07 | | |
| NA | N4 | 239 | 1.27 | yes | 3 | 0 | 70.73 | LMTDGPSDAQ | 70.73 | LTDGPSNAQ | 19.51 | TLVTDGPSDAQ | 4.07 | | |
| NA | N4 | 240 | 1.27 | yes | 3 | 0 | 70.73 | MTDGPSDAQA | 70.73 | LTDGPSNAQA | 19.51 | LVTDGPSDAQA | 4.07 | | |
| NA | N4 | 241 | 1.27 | yes | 3 | 0 | 70.73 | TDGPSDAQAF | 70.73 | ITDGPSNAQAF | 19.51 | VTDGPSDAQAF | 4.07 | | |
| NA | N4 | 242 | 0.35 | yes | 2 | 0 | 94.31 | DGPSDAQAFY | 94.31 | TDGPSNAQAFY | 4.88 | | | | |
| NA | N4 | 243 | 0.35 | yes | 2 | 0 | 94.31 | GPSDAQAFYK | 94.31 | DGPSNAQAFYK | 4.88 | | | | |
| NA | N4 | 244 | 0.42 | yes | 3 | 0 | 93.5 | PSDAQAFYKI | 93.5 | GPSDGQAFYKI | 4.88 | | | | |
| NA | N4 | 245 | 0.42 | yes | 3 | 0 | 93.5 | SDAQAFYKIL | 93.5 | PSDAQAFYKLL | 4.88 | | | | |
| NA | N4 | 246 | 0.42 | yes | 3 | 0 | 93.5 | DAQAFYKILK | 93.5 | SDAQAFYKLLK | 4.88 | | | | |
| NA | N4 | 247 | 0.42 | yes | 3 | 0 | 93.5 | AQAFYKILKI | 93.5 | DAQAFYKLLKI | 4.88 | | | | |
| NA | N4 | 248 | 0.71 | yes | 2 | 0 | 84.55 | QAFYKILKIK | 84.55 | GQAFYKILKIK | 13.82 | | | | |
| NA | N4 | 249 | 0.67 | yes | 2 | 0 | 84.55 | AFYKILKIKG | 84.55 | | 14.63 | | | | |
| NA | N4 | 250 | 0.67 | yes | 2 | 0 | 84.55 | FYKILKIRKG | 84.55 | | 14.63 | | | | |
| NA | N4 | 251 | 0.67 | yes | 2 | 0 | 84.55 | YKILKIRKGK | 84.55 | | 14.63 | | | | |
| NA | N4 | 252 | 0.71 | yes | 2 | 0 | 84.55 | KILKIRKGKI | 84.55 | YKILKIKKGKL | 13.82 | YKILKIKKGKL | 0.81 | | |
| NA | N4 | 253 | 1.09 | yes | 5 | 0 | 78.05 | KILKIRKGKI | 78.05 | KILKIKKGKIM | 13.01 | KILKIRKGKIV | 0.81 | KILKIKKGKIM | 0.81 |
| NA | N4 | 270 | 0.68 | yes | 2 | 0 | 89.43 | ATGFHFEECSC | 89.43 | ATGYHFEECSC | 5.69 | AAGFHFEECSC | 6.5 | ATGFHLEECSC | 0.81 |
| NA | N4 | 271 | 0.68 | yes | 2 | 0 | 89.43 | TGFHFEECSCY | 89.43 | TGYHFEECSCY | 5.69 | TGFHLEECSCY | 2.44 | IGFHFEECSCY | 0.81 |
| NA | N4 | 272 | 0.38 | yes | 2 | 0 | 93.5 | GFHFEECSCYP | 93.5 | GYHFEECSCYP | 5.69 | APGFHFEECSC | 2.44 | | |
| NA | N4 | 273 | 0.38 | yes | 2 | 0 | 93.5 | FHFEECSCYPS | 93.5 | YHFEECSCYPS | 5.69 | PGFHFEECSCY | | | |
| NA | N4 | 274 | 0.14 | yes | 2 | 0 | 98.37 | HFEECSCYPSG | 98.37 | HLEECSCYPSG | 0.81 | | | | |
| NA | N4 | 275 | 0.96 | yes | 3 | 0 | 72.36 | FEECSCYPSGT | 72.36 | FEECSCYPSGE | 26.02 | FEECSCYPRE | 0.81 | | |

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 344 | 0 | yes | 1 | 0 | 100 | RYGVKGFSFRY | 100 | | | | | | |
| NA | N4 | 345 | 0 | yes | 1 | 0 | 100 | YGVKGFSFRYG | 100 | | | | | | |
| NA | N4 | 346 | 0.07 | yes | 1 | 0 | 99.19 | GVKGFSFRYGD | 99.19 | | | | | | |
| NA | N4 | 347 | 0.07 | yes | 1 | 0 | 99.19 | VKGFSFRYGDG | 99.19 | | | | | | |
| NA | N4 | 348 | 0.07 | yes | 1 | 0 | 99.19 | KGFSFRYGDGV | 99.19 | | | | | | |
| NA | N4 | 349 | 0.07 | yes | 1 | 0 | 99.19 | GFSFRYGDGVW | 99.19 | | | | | | |
| NA | N4 | 350 | 0.07 | yes | 1 | 0 | 99.19 | FSFRYGDGVWI | 99.19 | | | | | | |
| NA | N4 | 351 | 0.07 | yes | 1 | 0 | 99.19 | SFRYGDGVWIG | 99.19 | | | | | | |
| NA | N4 | 352 | 0.07 | yes | 1 | 0 | 99.19 | FRYGDGVWIGR | 99.19 | | | | | | |
| NA | N4 | 353 | 0.07 | yes | 1 | 0 | 99.19 | RYGDGVWIGRT | 99.19 | | | | | | |
| NA | N4 | 354 | 0.07 | yes | 1 | 0 | 99.19 | YGDGVWIGRTK | 99.19 | | | | | | |
| NA | N4 | 355 | 0.14 | yes | 2 | 0 | 99.19 | GDGVWIGRTKS | 99.19 | GDGVWIGRTKN | 0.81 | | | | | |
| NA | N4 | 356 | 0.14 | yes | 2 | 0 | 98.37 | DGVWIGRTKSL | 98.37 | EEVWIGRTKSL | 0.81 | | | | | |
| NA | N4 | 357 | 0.14 | yes | 2 | 0 | 98.37 | GVWIGRTKSLE | 98.37 | EVWIGRTKSLE | 0.81 | | | | | |
| NA | N4 | 358 | 0.07 | yes | 1 | 0 | 99.19 | VWIGRTKSLES | 99.19 | | | | | | |
| NA | N4 | 359 | 0.07 | yes | 1 | 0 | 99.19 | WIGRTKSLESR | 99.19 | | | | | | |
| NA | N4 | 360 | 0.14 | yes | 2 | 0 | 98.37 | IGRTKSLESRS | 98.37 | IGRTKNLESRS | 0.81 | | | | | |
| NA | N4 | 361 | 0.14 | yes | 2 | 0 | 98.37 | GRTKSLESRSG | 98.37 | GRTKSLESRRG | 0.81 | | | | | |
| NA | N4 | 362 | 0.14 | yes | 2 | 0 | 98.37 | RTKSLESRSGF | 98.37 | RTKSLESRRGF | 0.81 | | | | | |
| NA | N4 | 363 | 0.14 | yes | 2 | 0 | 98.37 | TKSLESRSGFE | 98.37 | TKNLESRSGFE | 0.81 | | | | | |
| NA | N4 | 364 | 0.07 | yes | 1 | 0 | 99.19 | KSLESRSGFEM | 99.19 | | | | | | |
| NA | N4 | 365 | 0.14 | yes | 2 | 0 | 98.37 | SLESRSGFEMV | 98.37 | SLESRSGFEMI | 0.81 | | | | | |
| NA | N4 | 366 | 0.51 | yes | 2 | 0 | 91.06 | LESRSGFEMIW | 91.87 | LESRSGFEMIW | 7.32 | NLESRSGFEMV | 0.81 | | | |
| NA | N4 | 367 | 0.44 | yes | 3 | 0 | 91.87 | ESRSGFEMVWD | 91.87 | ESRSGFEMIWD | 7.32 | | | | | |
| NA | N4 | 368 | 0.51 | yes | 2 | 0 | 91.06 | SRSGFEMVWDA | 91.06 | SRSGFEMIWDA | 7.32 | SRSGFEMVWDD | 0.81 | | | |
| NA | N4 | 369 | 0.44 | yes | 3 | 0 | 91.06 | RSGFEMVWDAN | 91.06 | RSGFEMIWDAN | 7.32 | RSGFEMVWDDN | 0.81 | | | |
| NA | N4 | 370 | 0.51 | yes | 3 | 0 | 91.87 | SGFEMVWDANG | 91.87 | SGFEMIWDANG | 7.32 | SGFEMVWDDNG | 0.81 | | | |
| NA | N4 | 371 | 0.44 | yes | 3 | 0 | 91.06 | GFEMVWDANGW | 91.06 | GFEMIWDANGW | 7.32 | | | | | |
| NA | N4 | 372 | 0.51 | yes | 3 | 0 | 91.06 | FEMVWDANGWY | 91.06 | FEMIWDANGWY | 7.32 | | | | | |
| NA | N4 | 373 | 0.51 | yes | 3 | 0 | 91.06 | EMVWDANGWYS | 91.06 | EMIWDANGWYS | 7.32 | EMVWDDNGWYS | 0.81 | | | |
| NA | N4 | 374 | 0.51 | yes | 3 | 0 | 91.06 | MVWDANGWYST | 91.06 | MIWDANGWYST | 7.32 | MVWDANGWYTA | 0.81 | | | |
| NA | N4 | 375 | 0.51 | yes | 3 | 0 | 91.06 | VWDANGWYSTD | 91.06 | IWDANGWYSTD | 7.32 | VWDDNGWYSTD | 0.81 | | | |
| NA | N4 | 376 | 0.14 | yes | 2 | 0 | 98.37 | WDANGWYSTDK | 98.37 | WDANGWYTADK | 0.81 | | | | | |
| NA | N4 | 377 | 0.48 | yes | 4 | 0 | 92.68 | DANGWYSTDKN | 92.68 | DANGWYSTDKD | 4.88 | DANGWYTADKD | 0.81 | DDNGWYSTDKD | 0.81 |
| NA | N4 | 378 | 0.48 | yes | 4 | 0 | 92.68 | ANGWYSTDKNS | 92.68 | ANGWYSTDKDS | 4.88 | ANGWYTADKDS | 0.81 | DNGWYSTDKDS | 0.81 |
| NA | N4 | 379 | 0.42 | yes | 3 | 0 | 93.5 | NGWYSTDKNSN | 93.5 | NGWYSTDKDSN | 4.88 | NGWYTADKDSN | 0.81 | | |
| NA | N4 | 380 | 0.42 | yes | 3 | 0 | 93.5 | GWYSTDKNSNG | 93.5 | GWYSTDKDSNG | 4.88 | GWYTADKDSNG | 0.81 | | |
| NA | N4 | 381 | 0.42 | yes | 3 | 0 | 93.5 | WYSTDKNSNGV | 93.5 | WYSTDKDSNGV | 4.88 | WVTADKDSNGV | 0.81 | | |
| NA | N4 | 382 | 0.42 | yes | 3 | 0 | 93.5 | YSTDKNSNGVQ | 93.5 | YSTDKDSNGVQ | 4.88 | VTADKDSNGVQ | 0.81 | | |
| NA | N4 | 383 | 0.42 | yes | 3 | 0 | 93.5 | STDKNSNGVQD | 93.5 | STDKDSNGVQD | 4.88 | TADKDSNGVQD | 0.81 | | |

Fig. 75-19

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 384 | 0.42 | yes | 3 | 0 | 99.19 | TDKDSNGVQDI | 93.5 | TDKNGVQDI | 4.88 | ADKDSNGVQDI | 0.81 | | |
| NA | N4 | 385 | 0.35 | yes | 2 | 0 | 99.19 | DKDSNGVQDII | 94.31 | DKNSNGVQDII | 4.88 | | | | |
| NA | N4 | 386 | 0.35 | yes | 2 | 0 | 99.19 | KDSNGVQDIID | 94.31 | KNSNGVQDIID | 4.88 | | | | |
| NA | N4 | 387 | 0.28 | yes | 2 | 0 | 99.19 | DSNGVQDIIDN | 94.31 | NSNGVQDIIDN | 4.88 | | | | |
| NA | N4 | 388 | 0.35 | yes | 2 | 0 | 100 | SNGVQDIIDNN | 95.12 | SNGVQDIIDNN | 4.88 | | | | |
| NA | N4 | 389 | 0.35 | yes | 2 | 0 | 99.19 | NGVQDIIDNND | 94.31 | NGVQDIIDNNN | 4.88 | | | | |
| NA | N4 | 390 | 0.35 | yes | 2 | 0 | 99.19 | GVQDIIDNDNW | 94.31 | GVQDIIDNNNW | 4.88 | | | | |
| NA | N4 | 391 | 0.35 | yes | 2 | 0 | 99.19 | VQDIIDNDNWS | 94.31 | VQDIIDNNNWS | 4.88 | | | | |
| NA | N4 | 392 | 0.35 | yes | 2 | 0 | 99.19 | QDIIDNDNWSG | 94.31 | QDIIDNNNWSG | 4.88 | | | | |
| NA | N4 | 393 | 0.35 | yes | 2 | 0 | 99.19 | DIIDNDNWSGY | 94.31 | DIIDNNWSGY | 4.88 | | | | |
| NA | N4 | 394 | 0.35 | yes | 2 | 0 | 99.19 | IIDNDNWSGYS | 94.31 | IIDNNWSGYS | 4.88 | | | | |
| NA | N4 | 395 | 0.35 | yes | 2 | 0 | 99.19 | IDNDNWSGYSG | 94.31 | IDNNWSGYSG | 4.88 | | | | |
| NA | N4 | 396 | 0.35 | yes | 2 | 0 | 99.19 | DNDNWSGYSGS | 94.31 | DNNWSGYSGS | 4.88 | | | | |
| NA | N4 | 397 | 0.35 | yes | 2 | 0 | 99.19 | NDNWSGYSGSF | 94.31 | NNWSGYSGSF | 4.88 | | | | |
| NA | N4 | 398 | 0.35 | yes | 2 | 0 | 99.19 | DNWSGYSGSFS | 94.31 | NWSGYSGSFS | 4.88 | | | | |
| NA | N4 | 399 | 0.07 | yes | 1 | 0 | 99.19 | NWSGYSGSFSI | 99.19 | | | | | | |
| NA | N4 | 400 | 0 | yes | 1 | 0 | 100 | WSGYSGSFSIR | 100 | | | | | | |
| NA | N4 | 401 | 0.28 | yes | 2 | 0 | 100 | SGYSGSFSIRG | 95.12 | SGYSGSFSIRW | 4.88 | | | | |
| NA | N4 | 402 | 0.28 | yes | 2 | 0 | 100 | GYSGSFSIRGE | 95.12 | GYSGSFSIRWE | 4.88 | | | | |
| NA | N4 | 403 | 0.28 | yes | 2 | 0 | 100 | YSGSFSIRGET | 95.12 | YSGSFSIRWET | 4.88 | | | | |
| NA | N4 | 404 | 0.28 | yes | 2 | 0 | 100 | SGSFSIRGETT | 95.12 | SGSFSIRWETT | 4.88 | | | | |
| NA | N4 | 405 | 0.28 | yes | 2 | 0 | 100 | GSFSIRGETTG | 95.12 | GSFSIRWETTG | 4.88 | | | | |
| NA | N4 | 406 | 0.28 | yes | 2 | 0 | 100 | SFSIRGETTGR | 95.12 | SFSIRWETTGR | 4.88 | | | | |
| NA | N4 | 407 | 0.28 | yes | 2 | 0 | 100 | FSIRGETTGRN | 95.12 | FSIRWETTGRN | 4.88 | | | | |
| NA | N4 | 408 | 0.28 | yes | 2 | 0 | 100 | SIRGETTGRNC | 95.12 | SIRWETTGRNC | 4.88 | | | | |
| NA | N4 | 409 | 0.56 | yes | 3 | 0 | 100 | IRGETTGRNCT | 95.12 | IRWETTGRNCT | 4.88 | RGETTGRNCTI | 4.88 | | |
| NA | N4 | 410 | 0.56 | yes | 3 | 0 | 100 | RGETTGRNCTV | 90.24 | RWETTGRNCTV | 4.88 | GETTGRNCTIP | 4.88 | | |
| NA | N4 | 411 | 0.56 | yes | 3 | 0 | 100 | GETTGRNCTVP | 90.24 | WETTGRNCTVP | 4.88 | | | | |
| NA | N4 | 412 | 0.35 | yes | 2 | 0 | 100 | ETTGRNCTVPC | 95.12 | ETTGRNCTIPC | 4.88 | | | | |
| NA | N4 | 413 | 0.35 | yes | 2 | 0 | 99.19 | TTGRNCTVPCF | 94.31 | TTGRNCTIPCF | 4.88 | | | | |
| NA | N4 | 414 | 0.35 | yes | 2 | 0 | 99.19 | TGRNCTVPCFW | 94.31 | TGRNCTIPCFW | 4.88 | | | | |
| NA | N4 | 415 | 0.35 | yes | 2 | 0 | 99.19 | GRNCTVPCFWV | 94.31 | GRNCTIPCFWV | 4.88 | | | | |
| NA | N4 | 416 | 0.35 | yes | 2 | 0 | 99.19 | RNCTVPCFWVE | 94.31 | RNCTIPCFWV | 4.88 | | | | |
| NA | N4 | 417 | 0.35 | yes | 2 | 0 | 99.19 | NCTVPCFWVEM | 94.31 | NCTIPCFWVEM | 4.88 | | | | |
| NA | N4 | 418 | 0.35 | yes | 2 | 0 | 99.19 | CTVPCFWVEMI | 94.31 | CTIPCFWVEMI | 4.88 | | | | |
| NA | N4 | 419 | 0.35 | yes | 2 | 0 | 99.19 | TVPCFWVEMIR | 94.31 | TIPCFWVEMIR | 4.88 | | | | |
| NA | N4 | 420 | 0.35 | yes | 2 | 0 | 99.19 | VPCFWVEMIRG | 94.31 | IPCFWVEMIRG | 4.88 | | | | |
| NA | N4 | 421 | 0.07 | yes | 1 | 0 | 99.19 | PCFWVEMIRGQ | 99.19 | | | | | | |
| NA | N4 | 422 | 0.07 | yes | 1 | 0 | 99.19 | CFWVEMIRGQP | 99.19 | | | | | | |
| NA | N4 | 423 | 0.14 | yes | 2 | 0 | 99.19 | FWVEMIRGQPK | 98.37 | LWVEMIRGQPK | 0.81 | | | | |

Fig. 75-20

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N4 | 424 | 0.07 | yes | 1 | 0 | 99.19 | WVEMIRGQPKE | 99.19 | | | | | | |
| NA | N4 | 425 | 0.14 | yes | 2 | 0 | 99.19 | VEMIRGQPKEK | 98.37 | VEMIRGQPNER | 0.81 | | | | |
| NA | N4 | 426 | 0.45 | yes | 3 | 0 | 99.19 | EMIRGQPKEKT | 92.68 | EMIRGQPKEKA | 5.69 | EMIRGQPNERT | 0.81 | | |
| NA | N4 | 427 | 0.45 | yes | 3 | 0 | 99.19 | MIRGQPKEKTI | 92.68 | MIRGQPKEKAI | 5.69 | MIRGQPNERTI | 0.81 | | |
| NA | N4 | 428 | 0.45 | yes | 3 | 0 | 99.19 | IRGQPKEKTIW | 92.68 | IRGQPKEKAIW | 5.69 | IRGQPKERTIW | 0.81 | | |
| NA | N4 | 429 | 0.45 | yes | 3 | 0 | 99.19 | RGQPKEKTIWT | 92.68 | RGQPKEKAIWT | 5.69 | RGQPKERTIWT | 0.81 | | |
| NA | N4 | 430 | 0.45 | yes | 3 | 0 | 99.19 | GQPKEKTIWTS | 92.68 | GQPKEKAIWTS | 5.69 | GQPNERTIWTS | 0.81 | | |
| NA | N4 | 431 | 0.45 | yes | 3 | 0 | 99.19 | QPKEKTIWTSG | 92.68 | QPKEKAIWTSG | 5.69 | QPNERTIWTSG | 0.81 | | |
| NA | N4 | 432 | 0.45 | yes | 3 | 0 | 99.19 | PKEKTIWTSGS | 92.68 | PKEKAIWTSGS | 5.69 | PKERTIWTSGS | 0.81 | | |
| NA | N4 | 433 | 0.45 | yes | 3 | 0 | 99.19 | KEKTIWTSGSS | 92.68 | KEKAIWTSGSS | 5.69 | NERTIWTSGSS | 0.81 | | |
| NA | N4 | 434 | 0.43 | yes | 2 | 0 | 99.19 | EKTIWTSGSSI | 92.68 | EKAIWTSGSSI | 5.69 | ERTIWTSGSSI | 1.63 | | |
| NA | N4 | 435 | 0.43 | yes | 2 | 0 | 99.19 | KTIWTSGSSIA | 92.68 | KAIWTSGSSIA | 5.69 | RTIWTSGSSIA | 1.63 | | |
| NA | N4 | 436 | 0.32 | yes | 2 | 0 | 99.19 | TIWTSGSSIAF | 94.31 | AIWTSGSSIAF | 5.69 | | | | |
| NA | N4 | 437 | 0 | yes | 1 | 0 | 100 | IWTSGSSIAFC | 100 | | | | | | |
| NA | N4 | 438 | 0 | yes | 1 | 0 | 100 | WTSGSSIAFCG | 100 | | | | | | |
| NA | N4 | 439 | 0 | yes | 1 | 0 | 100 | TSGSSIAFCGV | 100 | | | | | | |
| NA | N4 | 440 | 0.51 | yes | 2 | 0 | 99.19 | SGSSIAFCGVN | 88.62 | SGSSIAFCGVD | 11.38 | | | | |
| NA | N4 | 441 | 0.58 | yes | 3 | 0 | 99.19 | GSSIAFCGVNS | 87.8 | GSSIAFCGVDS | 11.38 | SSIAFCGVNSN | 0.81 | SSIAFCGVNSD | 0.81 |
| NA | N4 | 442 | 0.64 | yes | 3 | 0 | 99.19 | SSIAFCGVNSD | 86.99 | SSIAFCGVDSD | 11.38 | SIAFCGVNFDL | 0.81 | | |
| NA | N4 | 443 | 0.64 | yes | 3 | 0 | 99.19 | SIAFCGVNSDT | 86.99 | SIAFCGVDSDT | 11.38 | | | | |
| NA | N4 | 444 | 0.58 | yes | 2 | 0 | 99.18 | IAFCGVNSDTT | 87.7 | IAFCGVDSDTT | 11.48 | | | | |
| NA | N4 | 445 | 0.92 | yes | 5 | 0.81 | 99.18 | AFCGVNSDTTG | 84.43 | AFCGVNSDTTS | 6.56 | AFCGVDSDTTS | 4.92 | AFCGVNSDTTG | 2.46 |
| NA | N4 | 446 | 0.92 | yes | 5 | 0.81 | 99.18 | FCGVNSDTTGW | 84.43 | FCGVNSDTTSW | 6.56 | FCGVDSDTTSW | 4.92 | FCGVNSNTTGW | 2.46 |
| NA | N4 | 451 | 0.58 | yes | 4 | 0.81 | 99.18 | SDTTGWSWPDG | 90.16 | SDTTCWSWPDG | 7.38 | SDTTCWSWPDG | 0.82 | | |
| NA | N4 | 452 | 0.58 | yes | 4 | 0.81 | 99.18 | DTTGWSWPDGA | 90.16 | DTTGWPWPDGA | 7.38 | DTTGWPWPDGA | 0.82 | | |
| NA | N4 | 453 | 0.52 | yes | 3 | 0.81 | 99.18 | TTGWSWPDGAL | 90.98 | TCWSWPDGALL | 7.38 | | | | |
| NA | N4 | 454 | 0.58 | yes | 4 | 0.81 | 99.17 | TGWSWPDGALL | 90.16 | TGWPWPDGALF | 7.38 | TGWPWPDGALL | 0.82 | | |
| NA | N4 | 455 | 0.59 | yes | 4 | 0.81 | 99.17 | GWSWPDGALLP | 90.08 | GWSWPDGALLP | 7.44 | GWSWPDGALLP | 0.83 | CWSWPDGALLP | 0.82 |
| NA | N4 | 456 | 0.4 | yes | 3 | 1.63 | 99.15 | WSWPDGALLPF | 94.02 | WSWPDGALLPL | 4.27 | WSWPDGALLPL | 0.85 | | |
| NA | N4 | 457 | 0.4 | yes | 3 | 4.88 | 99.14 | SWPDGALLPFD | 93.97 | SWPDGALLPLT | 4.31 | SWPDGALLPLT | 0.86 | | |
| NA | N4 | 458 | 0 | no | 1 | 5.69 | 100 | WPDGALLPFDI | 100 | | | | | | |
| NA | N4 | 459 | 0 | no | 1 | 10.57 | 100 | PDGALLPFDID | 100 | | | | | | |
| NA | N4 | 460 | 0.31 | no | 2 | 10.57 | 94.55 | DGALLPFDIDK | 94.55 | DGALLPFDIDR | 5.45 | | | | |
| NA | N5 | 1 | 0.07 | no | 1 | 10.57 | 99.19 | MNPNQKIITIG | 99.19 | | | | | | |
| NA | N5 | 2 | 1.22 | no | 4 | 18.42 | 99.19 | NPNQKIITIGS | 99.19 | | | | | | |
| NA | N5 | 3 | 1.22 | no | 4 | 18.42 | 99.19 | PNQKIITIGSV | 66.94 | PNQKIITIGSI | 26.61 | PNQKIITIGSA | 4.84 | PNQKIITIGSM | 0.81 |
| NA | N5 | 4 | 1.22 | no | 4 | 18.42 | 99.19 | NQKIITIGSVS | 66.94 | NQKIITIGSIS | 26.61 | NQKIITIGSAL | 4.84 | NQKIMTIGSVS | 0.81 |
| NA | N5 | 5 | 1.2 | no | 4 | 16.45 | 99.21 | QKIITIGSVSL | 67.72 | QKIITIGSISL | 25.98 | QKIITIGSASL | 4.72 | QKIMTIGSVSL | 0.79 |
| NA | N5 | 6 | 1.2 | no | 5 | 11.18 | 99.26 | KIITIGSVSLA | 68.89 | KIITIGSISLG | 24.44 | KIITIGSASLG | 4.44 | KIMTIGSVSLA | 0.74 | KIITIGSVSLT | 0.74 |
| NA | N5 | 7 | 1.2 | yes | 5 | 7.89 | 99.29 | IITIGSVSLAL | 70 | IITIGSISLGL | 23.57 | IITIGSASLGL | 4.29 | IMTIGSVSLTL | 0.71 | IMTIGSVSLAL | 0.71 |

Fig. 75-21

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | NS | 81 | 1.18 | yes | 4 | 0 | 99.34 | FLNNTEPLCNV | 99.34 | FLNNTEPLCEV | 73.03 | FLNNTEPLCDV | 19.08 | | | FNNTEPLCEV | 3.29 |
| NA | NS | 82 | 1.18 | yes | 4 | 0 | 99.34 | LNNTEPLCNVS | 99.34 | LNNTEPLCEVS | 73.03 | LNNTEPLCDVS | 19.08 | | | FNNTEPLCEVS | 3.29 |
| NA | NS | 83 | 1.05 | yes | 3 | 0 | 99.34 | NNTEPLCNVSG | 99.34 | NNTEPLCEVSG | 73.03 | NNTEPLCDVSG | 22.37 | | | | |
| NA | NS | 84 | 1.05 | yes | 3 | 0 | 99.34 | NTEPLCNVSGF | 99.34 | NTEPLCEVSGF | 73.03 | NTEPLCDVSGF | 22.37 | | | | |
| NA | NS | 85 | 1.09 | yes | 4 | 0 | 99.34 | TEPLCNVSGFA | 99.34 | TEPLCEVSGFA | 73.03 | TEPLCDVSGFA | 21.71 | TEPLCEVSGFV | 0.66 | | |
| NA | NS | 86 | 1.13 | yes | 5 | 0 | 99.34 | EPLCNVSGFAI | 99.34 | EPLCEVSGFAI | 73.03 | EPLCDVSGFAI | 21.05 | EPLCEVSGFAV | 0.66 | EPLCEVSGFVI | 0.66 |
| NA | NS | 87 | 0.37 | yes | 5 | 0 | 99.34 | SGFAIVSKDNG | 99.34 | SGFAIISKDNG | 95.39 | SGFAIFSKDNG | 1.32 | SGFAVVSKDNG | 0.66 | SGFVIVSKDNG | 0.66 |
| NA | NS | 92 | 0.37 | yes | 5 | 0 | 99.34 | GFAIVSKDNGI | 99.34 | GFAIISKDNGI | 95.39 | GFAIFSKDNGI | 1.32 | GFAIVSKDNGI | 0.66 | GFVIVSKDNGI | 0.66 |
| NA | NS | 93 | 0.37 | yes | 5 | 0 | 99.34 | FAIVSKDNGIR | 99.34 | FAIISKDNGIR | 95.39 | FAIFSKDNGIR | 1.32 | FAVVSKDNGIR | 0.66 | FAIASKDNGIR | 0.66 |
| NA | NS | 94 | 0.45 | yes | 5 | 0 | 99.34 | IVSKDNGIRIG | 99.34 | IISKDNGIRIG | 94.08 | IFSKDNGIRIG | 1.97 | IVSKDNGIRIG | 1.32 | IASKDNGIRIG | 0.66 |
| NA | NS | 95 | 0.2 | yes | 2 | 0 | 99.34 | VSKDNGIRIGS | 99.34 | ISKDNGIRIGS | 94.74 | ISKDNGIRIGS | 1.97 | | | | |
| NA | NS | 96 | 0.4 | yes | 2 | 0 | 99.34 | SKDNGIRIGSR | 99.34 | | | | | | | | |
| NA | NS | 97 | 0.4 | yes | 2 | 0 | 99.34 | KDNGIRIGSRG | 97.37 | | | | | | | | |
| NA | NS | 98 | 0.4 | yes | 2 | 0 | 99.34 | DNGIRIGSRGH | 97.37 | | | | | | | | |
| NA | NS | 99 | 0.4 | yes | 3 | 0 | 99.34 | NGIRIGSRGHV | 94.08 | NGIRVGSRGHV | 3.29 | | | | | | |
| NA | NS | 100 | 0.27 | yes | 3 | 0 | 99.34 | GIRIGSRGHVF | 94.08 | GIRVGSRGHVF | 3.29 | | | | | | |
| NA | NS | 101 | 0.27 | yes | 3 | 0 | 99.34 | IRIGSRGHVFV | 94.08 | IRVGSRGHVFV | 3.29 | | | | | | |
| NA | NS | 102 | 0.27 | yes | 3 | 0 | 99.34 | RIGSRGHVFVI | 94.08 | RVGSRGHVFVI | 3.29 | | | | | | |
| NA | NS | 103 | 0.27 | yes | 3 | 0 | 99.34 | IGSRGHVFVIR | 96.05 | VGSRGHVFVIR | 3.29 | | | | | | |
| NA | NS | 104 | 0.21 | yes | 2 | 0 | 99.34 | GSRGHVFVIRE | 96.05 | | | | | | | | |
| NA | NS | 105 | 0.21 | yes | 2 | 0 | 99.34 | SRGHVFVIREP | 96.05 | | | | | | | | |
| NA | NS | 106 | 0.21 | yes | 2 | 0 | 99.34 | RGHVFVIREPF | 96.71 | | | | | | | | |
| NA | NS | 107 | 0.44 | yes | 3 | 0 | 100 | GHVFVIREPFV | 100 | | | | | | | | |
| NA | NS | 108 | 0.44 | yes | 3 | 0 | 100 | HVFVIREPFVA | 100 | HIFVIREPFVA | 2.63 | IREPFVACGPA | 1.97 | | | | |
| NA | NS | 109 | 0.38 | yes | 2 | 0 | 99.34 | VFVIREPFVAC | 93.42 | IFVIREPFVAC | 2.63 | | | | | | |
| NA | NS | 110 | 0.4 | yes | 3 | 0 | 99.34 | FVIREPFVACG | 93.42 | FVIREPFVACS | 1.97 | | | | | | |
| NA | NS | 111 | 0.4 | yes | 3 | 0 | 99.34 | VIREPFVACGP | 94.08 | VIREPFVACSP | 1.32 | IREPFVACSPS | 1.97 | | | | |
| NA | NS | 112 | 1.26 | yes | 5 | 0 | 99.34 | IREPFVACGPT | 70.39 | IREPFVACGPS | 21.71 | IREPFVACGPA | 3.95 | REPFYACSPSE | 1.97 | | |
| NA | NS | 113 | 1.26 | yes | 5 | 0 | 99.34 | REPFVACGPTE | 70.39 | REPFYSCGPSE | 21.71 | REPFYACGPAE | 3.95 | REPFYACSPSE | 1.97 | | |
| NA | NS | 114 | 1.26 | yes | 5 | 0 | 99.34 | EPFVACGPTEC | 70.39 | EPFYSCGPSEC | 21.71 | EPFYACGPAEC | 3.95 | EPFYACSPSEC | 1.97 | | |
| NA | NS | 115 | 1.26 | yes | 5 | 0 | 99.34 | PFVACGPTECR | 70.39 | PFYSCGPSECR | 21.71 | PFYACGPAECR | 3.95 | PFYACSPSECR | 1.97 | | |
| NA | NS | 116 | 1.1 | yes | 5 | 0 | 99.34 | FVACGPTECRT | 70.39 | FYSCGPSECRT | 21.71 | FYACGPAECRT | 3.95 | FYACSPSECRT | 1.97 | | |
| NA | NS | 117 | 1.07 | yes | 5 | 0 | 99.34 | VACGPTECRTF | 70.39 | VSCGPSECRTF | 21.71 | VACGPAECRTF | 3.95 | VACSPSECRTF | 1.97 | | |
| NA | NS | 118 | 1.02 | yes | 5 | 0 | 99.34 | ACGPTECRTFF | 70.39 | SCGPSECRTFF | 21.71 | ACGPAECRTFF | 3.95 | ACSPSECRTFF | 1.32 | | |
| NA | NS | 119 | 1.26 | yes | 5 | 0 | 99.34 | CGPTECRTFFL | 70.39 | CGPSECRTFFL | 25.66 | CGPAECRTFFL | 3.95 | CSPSECRTFFL | 1.97 | | |
| NA | NS | 120 | 1.26 | yes | 5 | 0 | 99.34 | GPTECRTFFLT | 70.39 | GPSECRTFFLT | 25.66 | GPAECRTFFLT | 3.95 | SPSECRTFFLT | 1.97 | | |
| NA | NS | 121 | 1.11 | yes | 4 | 0 | 99.34 | PTECRTFFLTQ | 70.39 | PSECRTFFLTQ | 26.32 | PAECRTFFLTQ | 3.95 | STECRTFFLTQ | 1.97 | | |
| NA | NS | 122 | 1.11 | yes | 4 | 0 | 99.34 | TECRTFFLTQG | 71.05 | SECRTFFLTQG | 26.32 | AECRTFFLTQG | 3.95 | | | | |
| NA | NS | 125 | 0.06 | yes | 3 | 0 | 99.34 | ECRTFFLTQGA | 99.34 | | | | | | | | |
| NA | NS | 126 | 0.06 | yes | 1 | 0 | 99.34 | CRTFFLTQGAL | 99.34 | | | | | | | | |

Fig. 75-22

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N5 | 127 | 0.06 | yes | 1 | 0 | 99.34 | RTFFLTQGALL | 99.34 | | | | | | |
| NA | N5 | 128 | 0.06 | yes | 1 | 0 | 99.34 | TFFLTQGALLN | 99.34 | | | | | | |
| NA | N5 | 129 | 0.06 | yes | 1 | 0 | 99.34 | FFLTQGALLND | 99.34 | | | | | | |
| NA | N5 | 130 | 0.11 | yes | 2 | 0 | 99.34 | FLTQGALLNDK | 99.34 | FLTQGALLNDR | 0.66 | | | | |
| NA | N5 | 131 | 0.11 | yes | 2 | 0 | 99.34 | LTQGALLNDKH | 98.68 | LTQGALLNDRH | 0.66 | | | | |
| NA | N5 | 132 | 0.11 | yes | 2 | 0 | 99.34 | TQGALLNDKHS | 98.68 | TQGALLNDRHS | 0.66 | | | | |
| NA | N5 | 133 | 0.11 | yes | 2 | 0 | 99.34 | QGALLNDKHSN | 98.68 | QGALLNDKHS | 0.66 | | | | |
| NA | N5 | 134 | 0.11 | yes | 2 | 0 | 99.34 | GALLNDKHSNN | 98.68 | GALLNDRHSN | 0.66 | | | | |
| NA | N5 | 135 | 0.06 | yes | 1 | 0 | 99.34 | ALLNDKHSNNT | 98.68 | | | | | | |
| NA | N5 | 136 | 0.11 | yes | 2 | 0 | 99.34 | LLNDKHSNNTV | 99.34 | CVLLNDKHSNN | 0.66 | | | | |
| NA | N5 | 137 | 0.11 | yes | 2 | 0 | 99.34 | LNDKHSNNTVK | 98.68 | VLNDKHSNNT | 0.66 | | | | |
| NA | N5 | 138 | 0.11 | yes | 2 | 0 | 99.34 | NDKHSNNTVKD | 98.68 | LNDKHSNNTVR | 0.66 | | | | |
| NA | N5 | 139 | 0.11 | yes | 2 | 0 | 99.34 | DKHSNNTVKDR | 98.68 | NDRHSNNTVKD | 0.66 | | | | |
| NA | N5 | 140 | 0.06 | yes | 1 | 0 | 99.34 | KHSNNTVKDRS | 98.68 | DRHSNNTVKDR | 0.66 | | | | |
| NA | N5 | 141 | 0.06 | yes | 1 | 0 | 99.34 | HSNNTVKDRSP | 99.34 | RHSNNTVKDRS | 0.66 | | | | |
| NA | N5 | 142 | 0.06 | yes | 1 | 0 | 99.34 | SNNTVKDRSPY | 99.34 | | | | | | |
| NA | N5 | 143 | 0.06 | yes | 1 | 0 | 99.34 | NNTVKDRSPYR | 99.34 | | | | | | |
| NA | N5 | 144 | 0.06 | yes | 1 | 0 | 99.34 | NTVKDRSPYRA | 99.34 | | | | | | |
| NA | N5 | 145 | 0.06 | yes | 1 | 0 | 99.34 | TVKDRSPYRAL | 99.34 | | | | | | |
| NA | N5 | 146 | 0.06 | yes | 1 | 0 | 99.34 | VKDRSPYRALM | 99.34 | | | | | | |
| NA | N5 | 147 | 0 | yes | 1 | 0 | 100 | KDRSPYRALMS | 100 | | | | | | |
| NA | N5 | 148 | 0.06 | yes | 1 | 0 | 99.34 | DRSPYRALMSV | 99.34 | | | | | | |
| NA | N5 | 149 | 0.11 | yes | 2 | 0 | 99.34 | RSPYRALMSVP | 98.68 | SPYRALMSVPM | 0.66 | | | | |
| NA | N5 | 150 | 0.11 | yes | 2 | 0 | 99.34 | SPYRALMSVPL | 98.68 | PYRALMSVPMG | 0.66 | | | | |
| NA | N5 | 151 | 0.11 | yes | 2 | 0 | 99.34 | PYRALMSVPLG | 98.68 | YRALMSVPMGS | 0.66 | | | | |
| NA | N5 | 152 | 0.11 | yes | 2 | 0 | 99.34 | YRALMSVPLGS | 98.68 | RALMSVPLGSS | 0.66 | | | | |
| NA | N5 | 153 | 0.11 | yes | 2 | 0 | 99.34 | RALMSVPLGSS | 98.68 | ALMSVPLGSSS | 0.66 | | | | |
| NA | N5 | 154 | 0.17 | yes | 3 | 0 | 99.34 | ALMSVPLGSSP | 98.03 | LMSVPLGSSPN | 0.66 | ALMSVPLGSSS | 0.66 | | |
| NA | N5 | 155 | 0.17 | yes | 3 | 0 | 99.34 | LMSVPLGSSPN | 98.03 | MSVPPGSSPNA | 0.66 | LMSVPLGSSSN | 0.66 | | |
| NA | N5 | 156 | 0.17 | yes | 3 | 0 | 99.34 | MSVPLGSSPNA | 98.03 | SVPLGSSSNAY | 0.66 | MSVLLGSSPNA | 0.66 | | |
| NA | N5 | 157 | 0.17 | yes | 3 | 0 | 99.34 | SVPLGSSPNAY | 98.03 | VLLGSSPNAYQ | 0.66 | SVPMGSSPNAY | 0.66 | | |
| NA | N5 | 158 | 0.17 | yes | 3 | 0 | 99.34 | VPLGSSPNAYQ | 98.03 | PMGSSPNAYQA | 0.66 | VPMGSSPNAYQ | 0.66 | | |
| NA | N5 | 159 | 0.17 | yes | 3 | 0 | 99.34 | PLGSSPNAYQA | 98.03 | LGSSPNAYQAR | 0.66 | LLGSSPNAYQA | 0.66 | | |
| NA | N5 | 160 | 0.17 | yes | 4 | 0 | 99.34 | LGSSPNAYQAK | 96.71 | GSSPNAYQARF | 1.32 | LGSSPNAYQAR | 0.66 | LGSSPNAYQAQ | 0.66 |
| NA | N5 | 161 | 0.22 | yes | 3 | 0 | 99.34 | GSSPNAYQAKF | 97.37 | SSPNAYQARFE | 1.32 | GSSSNAYQAKF | 0.66 | | |
| NA | N5 | 162 | 0.22 | yes | 3 | 0 | 99.34 | SSPNAYQAKFE | 97.37 | SPNAYQARFES | 1.32 | SSSNAYQAKFE | 0.66 | | |
| NA | N5 | 163 | 0.27 | yes | 4 | 0 | 99.34 | SPNAYQAKFES | 96.71 | PNAYQARFESV | 1.32 | SNAYQAKFESV | 0.66 | PNAYQAQFESV | 0.66 |
| NA | N5 | 164 | 0.27 | yes | 3 | 0 | 99.34 | PNAYQAKFESV | 96.71 | FESYEWSATAC | 26.32 | FESYEWSATAC | 26.32 | | |
| NA | N5 | 171 | 0.94 | yes | 3 | 0 | 99.34 | FESYAWSATAC | 72.37 | | | | | | |
| NA | N5 | 172 | 0.94 | yes | 3 | 0 | 99.34 | ESVGWSATACH | 72.37 | ESVGWSATACH | 26.32 | ESIAWSATACH | | | |

Fig. 75-23

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N5 | 173 | 0.94 | yes | 3 | 0 | 99.34 | SVAWSATACHD | 72.37 | SVGWSATACHD | 26.32 | SVEWSATACHD | 0.66 | | |
| NA | N5 | 174 | 0.94 | yes | 3 | 0 | 99.34 | VAWSATACHDG | 72.37 | VGWSATACHDG | 26.32 | VEWSATACHDG | 0.66 | | |
| NA | N5 | 175 | 0.94 | yes | 3 | 0 | 99.34 | AWSATACHDGK | 72.37 | GWSATACHDGK | 26.32 | AWSATACHDGR | 0.66 | | |
| NA | N5 | 176 | 1.19 | yes | 3 | 0 | 99.34 | WSATACHDGKE | 63.82 | WSATACHDGKK | 30.92 | WSATACHDGKG | 4.61 | | |
| NA | N5 | 177 | 1.19 | yes | 5 | 0 | 99.34 | SATACHDGKEW | 63.82 | SATACHDGKKW | 30.92 | SATACHDGKGW | 4.61 | | |
| NA | N5 | 178 | 1.96 | yes | 4 | 0 | 99.34 | ATACHDGKEWL | 40.79 | ATACHDGKKWL | 26.97 | ATACHDGKWL | 23 | ATACHDGKKWM | 3.95 |
| NA | N5 | 191 | 1.16 | yes | 4 | 0 | 99.34 | GISGADDDAYA | 57.89 | GVSGADDDAYA | 39.47 | GYSGTDDDAYA | 1.32 | | |
| NA | N5 | 192 | 1.16 | yes | 3 | 0 | 99.34 | ISGADDDAYAV | 57.89 | VSGADDDAYAV | 39.47 | VSGTDDDAYAV | 1.32 | | |
| NA | N5 | 193 | 0.22 | yes | 3 | 0 | 99.34 | SGADDDAYAVI | 97.37 | SGADNDAYAVI | 1.32 | SGADDEAYAVI | 0.66 | | |
| NA | N5 | 194 | 0.22 | yes | 2 | 0 | 99.34 | GADDDAYAVIH | 97.37 | GADNDAYAVIH | 1.32 | GTDDDAYAVIH | 0.66 | | |
| NA | N5 | 195 | 0.16 | yes | 2 | 0 | 99.34 | ADDDAYAVIHY | 98.03 | ADNDAYAVIHY | 1.32 | ADDEAYAVIHY | 0.66 | | |
| NA | N5 | 196 | 0.16 | yes | 3 | 0 | 99.34 | DDDAYAVIHYG | 98.03 | DNDAYAVIHYG | 1.32 | | | | |
| NA | N5 | 197 | 1.36 | yes | 3 | 0 | 99.34 | DDAYAVIHYGG | 55.92 | NDAYAVIHYGG | 34.21 | DAYAVIHYGGI | 9.21 | | |
| NA | N5 | 198 | 1.31 | yes | 3 | 0 | 100 | DAYAVIHYGGV | 56.58 | AYAVIHYGGIP | 34.21 | ATAVIHYGGIP | 9.21 | | |
| NA | N5 | 199 | 1.31 | yes | 3 | 0 | 100 | AYAVIHYGGMP | 56.58 | YAVIHYGGIPT | 34.21 | YAVIHYGGIPT | 9.21 | | |
| NA | N5 | 200 | 1.31 | yes | 3 | 0 | 100 | YAVIHYGGMPT | 56.58 | AVIHYGGIPTD | 34.21 | AVIHYGGIPTD | 9.21 | | |
| NA | N5 | 201 | 1.31 | yes | 3 | 0 | 100 | AVIHYGGMPTD | 56.58 | VIHYGGIPTDV | 34.21 | VIHYGGIPTDV | 9.21 | | |
| NA | N5 | 202 | 1.55 | yes | 5 | 0 | 99.34 | VIHYGGMPTDV | 56.58 | IHYGGIPTDVW | 30.26 | IHYGGIPTDVI | 8.55 | IHYGGVPTDVI | 3.29 |
| NA | N5 | 203 | 1.55 | yes | 5 | 0 | 99.34 | IHYGGMPTDVW | 56.58 | HYGGIPTDVWR | 30.26 | HYGGIPTDVIR | 8.55 | HYGGVPTDVMR | 3.29 |
| NA | N5 | 204 | 1.55 | yes | 5 | 0 | 99.34 | HYGGMPTDVWR | 56.58 | YGGIPTDVWRS | 30.26 | YGGIPTDVIRS | 8.55 | YGGVPTDVMRS | 3.29 |
| NA | N5 | 205 | 1.55 | yes | 5 | 0 | 99.34 | YGGMPTDVWRS | 56.58 | GGIPTDVWRSW | 30.26 | GGIPTDVIRSW | 8.55 | GGIPTDVIRSW | 3.29 |
| NA | N5 | 206 | 1.13 | yes | 5 | 0 | 99.34 | GGMPTDVWRSW | 56.58 | PTDVWRSWKKQ | 13.82 | PTDVWRSWRKK | 3.95 | PTDVWRSWRRQ | 2.63 |
| NA | N5 | 209 | 1.13 | yes | 5 | 0 | 99.34 | PTDVWRSWKKQ | 77.63 | TDVIRSWRKIQI | 13.82 | TDVWRSWRKKI | 3.95 | TDVWRSWRRQI | 2.63 |
| NA | N5 | 210 | 1.13 | yes | 5 | 0 | 99.34 | TDVWRSWRKQI | 77.63 | DVWRSWKKQIL | 13.82 | DVWRSWRKKIL | 3.95 | DVWRSWRRQIL | 2.63 |
| NA | N5 | 211 | 1.13 | yes | 5 | 0 | 99.34 | DVWRSWRKQIL | 77.63 | VRSWKKQILRT | 13.82 | VRSWRKKILRT | 3.95 | VRSWRRQILR | 2.63 |
| NA | N5 | 212 | 1.13 | yes | 5 | 0 | 99.34 | VRSWRKQILRT | 77.63 | RSWKKQILRTQ | 13.82 | IRSWRKKILRTQ | 3.95 | VRSWRRQILRT | 2.63 |
| NA | N5 | 213 | 1.13 | yes | 5 | 0 | 99.34 | RSWRKQILRTQ | 77.63 | SWKKQILRTQE | 13.82 | RSWRKKILRTQE | 3.95 | SWRRQILRTQE | 2.63 |
| NA | N5 | 214 | 0.85 | yes | 4 | 0 | 99.34 | SWRKQILRTOE | 82.24 | WKKQILRTQES | 13.82 | SWRKKILRTQE | 3.95 | WRRQILRTQES | 2.63 |
| NA | N5 | 215 | 0.85 | yes | 4 | 0 | 99.34 | WRKQILRTQES | 82.24 | KKQILRTQESS | 13.82 | WRKKILRTQES | 3.95 | RRQILRTQESS | 2.63 |
| NA | N5 | 216 | 0.85 | yes | 4 | 0 | 99.34 | RKQILRTQESS | 82.24 | KQILRTQESSC | 13.82 | RKKILRTQESS | 3.95 | | |
| NA | N5 | 217 | 0.28 | yes | 3 | 0 | 100 | KQILRTQESSC | 96.05 | QILRTQESSCV | 2.63 | RQILRTQESS | 2.63 | | |
| NA | N5 | 218 | 0.18 | yes | 2 | 0 | 100 | QILRTQESSCV | 97.37 | ILRTQESSCVC | 2.63 | | | | |
| NA | N5 | 219 | 0 | yes | 1 | 0 | 100 | ILRTQESSCVC | 100 | | | | | | |
| NA | N5 | 220 | 0.59 | yes | 3 | 0 | 100 | LRTQESSCVCI | 89.47 | LRTQESSCVCM | 6.58 | LRTQESSCVCI | 3.95 | | |
| NA | N5 | 221 | 1.14 | yes | 4 | 0 | 100 | RTQESSCVCMN | 75.66 | RTQESSCVCMK | 13.82 | RTQESSCVCIK | 6.58 | RTQESSCVCK | 3.95 |
| NA | N5 | 222 | 1.14 | yes | 4 | 0 | 100 | TQESSCVCMNG | 75.66 | TQESSCVCMKG | 13.82 | TQESSCVCIKG | 6.58 | TQESSCVCIKG | 3.95 |
| NA | N5 | 223 | 0.41 | yes | 2 | 0 | 99.34 | CYWMTDGPANN | 92.76 | CYWMTDGPAS | 6.58 | | | | |
| NA | N5 | 235 | 1.17 | yes | 4 | 0 | 99.34 | YWMTDGPANN | 76.97 | YWMTDGPANS | 8.55 | YWMTDGPANK | 7.24 | | |
| NA | N5 | 236 | 1.17 | yes | 4 | 0 | 99.34 | YWMTDGPANN | 76.97 | YWMTDGPANS | 8.55 | YWMTDGPANK | 7.24 | | |
| NA | N5 | 237 | 1.17 | yes | 4 | 0 | 99.34 | WVMTDGPANNQ | 76.97 | WVMTDGPANSQ | 8.55 | WVMTDGPANKQ | 7.24 | WVMTDGPASNQ | 6.58 |

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N5 | 421 | 0.06 | yes | 1 | 0 | 99.34 | VPCFWLEMIRG | 99.34 | PCFWLEMIRGR | 1.97 | | | | |
| NA | N5 | 422 | 0.14 | yes | 2 | 0 | 100 | PCFWLEMIRGK | 98.03 | CFWLEMIRGRP | 1.97 | | | | |
| NA | N5 | 423 | 0.14 | yes | 2 | 0 | 100 | CFWLEMIRGKP | 98.03 | FWLEMIRGRPE | 1.97 | FWLEMIRGKPK | 1.97 | | | |
| NA | N5 | 424 | 0.24 | yes | 3 | 0 | 100 | FWLEMIRGKPE | 96.71 | WLEMIRGRPEE | 1.97 | WLEMIRGKPKE | 1.97 | | | |
| NA | N5 | 425 | 0.24 | yes | 3 | 0 | 99.34 | WLEMIRGKPEE | 96.71 | LEMIRGRPEEG | 1.97 | LEMIRGKPEER | 1.97 | LEMIRGPKER | 1.32 | | |
| NA | N5 | 426 | 0.44 | yes | 5 | 0 | 99.34 | LEMIRGKPEEG | 94.08 | PEEGTSIWTSS | 1.97 | LEMIRGRPEER | 1.97 | PEEKTSIWTSS | 1.32 | PEERNSIWTSS | 0.66 |
| NA | N5 | 433 | 0.41 | yes | 4 | 0 | 99.34 | PEERTSIWTSS | 94.74 | EEGTSIWTSSS | 1.97 | PKERTSIWTSS | 1.97 | PEEKTSIWTSS | 1.32 | EERPSIWTSSS | 0.66 |
| NA | N5 | 434 | 0.41 | yes | 4 | 0 | 99.34 | EERTSIWTSSS | 94.74 | EGTSIWTSSST | 1.97 | KERTSIWTSSS | 1.97 | EERNSIWTSSS | 1.32 | RPSIWTSSSST | 0.66 |
| NA | N5 | 435 | 0.31 | yes | 3 | 0 | 99.34 | ERTSIWTSSSS | 96.05 | GTSIWTSSSST | 1.97 | EKTSIWTSSSS | 1.97 | ERNSIWTSSSS | 0.66 | | |
| NA | N5 | 436 | 0.37 | yes | 5 | 0 | 99.34 | RTSIWTSSSST | 95.39 | TSIWTSSSSTV | 1.97 | RNSIWTSSSST | 1.97 | RTSIWTSSSSM | 0.66 | | |
| NA | N5 | 437 | 0.17 | yes | 1 | 0 | 99.34 | TSIWTSSSSTV | 98.03 | NSIWTSSSSTV | 0.66 | | | | |
| NA | N5 | 438 | 0.06 | yes | 1 | 0 | 99.34 | SIWTSSSSTVF | 99.34 | | | | | | |
| NA | N5 | 439 | 0.06 | yes | 1 | 0 | 99.34 | IWTSSSSTVFC | 99.34 | | | | | | |
| NA | N5 | 440 | 0.06 | yes | 1 | 0 | 99.34 | WTSSSSTVFCG | 99.34 | | | | | | |
| NA | N5 | 441 | 0.06 | yes | 1 | 0 | 99.34 | TSSSSTVFCGV | 99.34 | | | | | | |
| NA | N5 | 442 | 0.11 | yes | 2 | 0 | 99.34 | SSSSTVFCGVS | 98.68 | SSSTVFCGVSG | 0.66 | | | | |
| NA | N5 | 443 | 0.11 | yes | 2 | 0 | 99.34 | SSSTVFCGVSS | 98.68 | SSMFCGVSGE | 0.66 | | | | |
| NA | N5 | 444 | 0.06 | yes | 1 | 0 | 99.34 | SSTVFCGVSSE | 98.03 | STVFCGVSGEV | 0.66 | | | | |
| NA | N5 | 445 | 0.11 | yes | 2 | 0 | 99.34 | STVFCGVSSEV | 98.03 | TVFCGVSGEVP | 0.66 | SMVFCGVSGEV | 0.66 | | | |
| NA | N5 | 446 | 0.17 | yes | 2 | 0 | 99.34 | TVFCGVSSEVP | 98.03 | VFCGVSGEVPG | 1.32 | MVFCGVSGEVP | 0.66 | | | |
| NA | N5 | 447 | 0.22 | yes | 3 | 0 | 99.34 | VFCGVSSEVPG | 97.37 | FCGVSGEVPGW | 1.32 | VFCGVSSEAPG | 0.66 | FCGVSSEVPEW | 0.66 | | |
| NA | N5 | 448 | 0.27 | yes | 4 | 0 | 99.34 | FCGVSEVPGW | 96.71 | CGVSGEVPGWS | 1.32 | FCGVSSEAPGW | 0.66 | CGVSSEVPEWS | 0.66 | VSSEVPEWSWD | 0.66 |
| NA | N5 | 449 | 0.27 | yes | 4 | 0 | 99.34 | CGVSEVPGWS | 96.71 | GVSEVPGWSW | 1.32 | CGVSSEAPGWS | 0.66 | GVSSEVPEWSW | 0.66 | | |
| NA | N5 | 450 | 0.33 | yes | 5 | 0 | 99.34 | GVSSEVPGWSW | 96.71 | VSEVPGWSWD | 1.32 | GVSSEAPGWS | 0.66 | VSSEVPEWSWG | 0.66 | | |
| NA | N5 | 451 | 0.27 | yes | 4 | 0 | 99.34 | VSSEVPGWSWD | 96.69 | SEVPGWSWDD | 1.32 | VSSEAPGWSW | 0.66 | SSEVPEWSWGD | 0.66 | | |
| NA | N5 | 452 | 0.27 | yes | 4 | 0 | 99.34 | SSEVPGWSWDD | 96.69 | EVPGWSWDDG | 1.32 | SSEVPEWSWGD | 0.66 | SEVPGWSWGDG | 0.66 | | |
| NA | N5 | 453 | 0.33 | yes | 4 | 0 | 99.34 | SEVPGWSWDDG | 96.69 | VPGWSWDDGA | 1.32 | SEVPEWSWDDG | 0.66 | SEVPGWSWGDG | 0.66 | | |
| NA | N5 | 454 | 0.17 | yes | 3 | 0.66 | 99.34 | EVPGWSWDDGA | 98.01 | EAPGWSWDDGA | 0.66 | SEVPEWSWDDGA | 0.67 | | | |
| NA | N5 | 455 | 0.12 | yes | 2 | 0.66 | 99.33 | VPGWSWDDGAI | 98 | APGWSWDDGAI | 0.67 | | | | |
| NA | N5 | 456 | 0.12 | yes | 2 | 0.66 | 99.33 | PGWSWDDGAIL | 98.67 | PGWSWGDDGAIL | 0.67 | | | | |
| NA | N5 | 457 | 0.12 | yes | 2 | 0.66 | 99.33 | GWSWDDGAILP | 98.67 | EWSWDDGAILP | 0.67 | | | | |
| NA | N5 | 458 | 0.12 | yes | 2 | 1.32 | 99.33 | WSWDDGAILPF | 98.56 | WSWDDGAILPL | 0.72 | | | | |
| NA | N5 | 459 | 0.19 | yes | 2 | 8.55 | 99.28 | SWDDGAILPFD | 97.81 | SWDDGAILPLT | 0.73 | SWDDGAILPLT | 0.73 | | | |
| NA | N5 | 460 | 0.19 | yes | 2 | 9.87 | 99.27 | WDDGAILPFDI | 97.79 | WDDGAILPFGI | 0.74 | WDDGAILPFGI | 0.74 | | | |
| NA | N5 | 461 | 0.19 | no | 3 | 10.53 | 99.26 | DDGAILPFDID | 97.79 | DDGAILPFGID | 0.74 | DDGAILPFGID | 0.74 | | | |
| NA | N5 | 462 | 0.13 | no | 2 | 10.53 | 99.26 | DGAILPFDIDK | 98.53 | DGAILPFGIDK | 0.74 | | | | |
| NA | N5 | 463 | 0.07 | no | 1 | 16.45 | 99.21 | GAILPFDIDKM | 99.21 | | | | | | |
| NA | N6 | 1 | 0.34 | no | 3 | 29.04 | 99.6 | MNPNQKIICIS | 94.96 | MNPNQKITCIS | 3.83 | MNPNQKIMCIS | 0.81 | NPNQKIMCIST | 0.77 | | |
| NA | N6 | 2 | 0.39 | no | 4 | 25.46 | 99.62 | NPNQKIICISA | 94.43 | NPNQKITCISA | 3.65 | NPNQKIMCISA | 0.77 | PNQKIICISAA | 0.77 | | |
| NA | N6 | 3 | 0.47 | no | 5 | 25.18 | 99.24 | PNQKIICISAT | 93.69 | PNQKITCISAT | 3.63 | PNQKIMCISAT | 0.76 | PNQKIICISAA | 0.76 | PNQKIICISAA | 0.38 |

Fig. 75-27

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 9 | 0.33 | yes | 5 | 9.59 | 99.05 | CISATGMTLSV | 96.36 | CISATGMTLSV | 1.11 | CISATGMALSV | 0.63 | CISATGMILSV | 0.47 |
| NA | N6 | 56 | 0 | no | 1 | 99.14 | 100 | TTTIINNNTQ | 100 | | | | | | |
| NA | N6 | 90 | 0.34 | yes | 4 | 0.14 | 99.14 | KPLCEVNSWHI | 95.99 | KPLCEVSSWHI | 1.43 | KSLCEVNSWHI | 1.15 | SLCEVNSWHIL | 0.57 |
| NA | N6 | 91 | 0.39 | yes | 5 | 0.14 | 99.14 | PLCEVNSWHIL | 95.42 | PLCEVSSWHIL | 1.43 | PLCEVNSWHIF | 1.15 | | |
| NA | N6 | 92 | 0.35 | yes | 4 | 0 | 99.28 | LCEVNSWHILS | 95.85 | LCEVSSWHILS | 1.43 | LCEVNSWHIFS | 1.14 | | |
| NA | N6 | 93 | 0.35 | yes | 4 | 0 | 99.14 | CEVNSWHILSK | 95.85 | CEVSSWHILSK | 1.43 | CEVNSWHIFSK | 1.14 | | |
| NA | N6 | 94 | 0.35 | yes | 4 | 0 | 99.14 | EVNSWHILSKD | 95.85 | EVSSWHILSKD | 1.43 | EVNSWHIFSKD | 1.14 | | |
| NA | N6 | 95 | 0.26 | yes | 3 | 0 | 99.14 | VNSWHILSKDN | 97 | VSSWHILSKDN | 1.43 | | | | |
| NA | N6 | 96 | 0.26 | yes | 3 | 0 | 99.28 | NSWHILSKDNA | 97 | SSWHILSKDNA | 1.43 | | | | |
| NA | N6 | 97 | 0.17 | yes | 2 | 0 | 99.28 | SWHILSKDNAI | 98.28 | SWHIFSKDNAV | 0.72 | | | | |
| NA | N6 | 98 | 0.17 | yes | 2 | 0 | 99.28 | WHILSKDNAIR | 98.28 | WHIFSKDNAVR | 0.72 | | | | |
| NA | N6 | 99 | 0.17 | yes | 2 | 0 | 99.28 | HILSKDNAIRI | 98.28 | HIFSKDNAVRI | 0.72 | | | | |
| NA | N6 | 100 | 0.15 | yes | 2 | 0 | 99.14 | ILSKDNAIRIG | 98.43 | IFSKDNAIRIG | 0.72 | | | | |
| NA | N6 | 101 | 0.15 | yes | 2 | 0 | 99.14 | LSKDNAIRIGE | 98.43 | FSKDNAIRIGE | 0.72 | | | | |
| NA | N6 | 102 | 0.81 | yes | 5 | 0 | 99.28 | SKDNAIRIGED | 85.26 | SKDNAIRIGEN | 10.3 | SKDNAVRIGED | 3.15 | SKDNAIRIGEG | 0.29 |
| NA | N6 | 103 | 0.81 | yes | 5 | 0 | 99.28 | KDNAIRIGEDA | 85.12 | KDNAIRIGENA | 10.3 | KDNAVRIGEDA | 3.29 | KDNAIRIGEGA | 0.29 |
| NA | N6 | 104 | 0.83 | yes | 5 | 0 | 99.28 | DNAIRIGEDAH | 84.98 | DNAIRIGENAH | 10.3 | DNAIRIGEGAH | 3.29 | DNAVRIGEDAH | 0.29 |
| NA | N6 | 105 | 0.98 | yes | 5 | 0 | 99.28 | DAHILVTREPY | 82.4 | NAHILVTREPY | 10.3 | DAHILVTREPY | 3.29 | GAHILVTREPY | 0.29 |
| NA | N6 | 112 | 0.26 | yes | 2 | 0 | 99.43 | AHILVTREPYL | 96.42 | AHVLVTREPYL | 2.86 | | | | |
| NA | N6 | 113 | 0.26 | yes | 2 | 0 | 99.57 | HILVTREPYLS | 96.42 | HVLVTREPYLS | 3 | | | | |
| NA | N6 | 114 | 0.24 | yes | 2 | 0 | 99.14 | ILVTREPYLSC | 96.57 | VLVTREPYLSC | 3 | | | | |
| NA | N6 | 115 | 0.9 | yes | 2 | 0 | 99.14 | LVTREPYLSCG | 73.53 | LVTREPYLSCD | 25.61 | | | | |
| NA | N6 | 116 | 0.93 | yes | 3 | 0 | 99.28 | VTREPYLSCGP | 73.39 | VTREPYLSCDP | 25.46 | VTREPYLSCEP | 0.43 | | |
| NA | N6 | 129 | 0.94 | yes | 3 | 0 | 99.28 | ECRMFALSQGT | 72.68 | GCRMFALSQGT | 26.18 | ECRIFALSQGT | 0.29 | | |
| NA | N6 | 130 | 0.09 | yes | 1 | 0 | 99.14 | CRMFALSQGTT | 99.14 | | | | | | |
| NA | N6 | 131 | 0.09 | yes | 1 | 0 | 99.14 | RMFALSQGTTL | 99.14 | | | | | | |
| NA | N6 | 132 | 0.12 | yes | 2 | 0 | 99.43 | MFALSQGTTLR | 98.71 | MFALSQGTTLK | 0.72 | | | | |
| NA | N6 | 133 | 0.37 | yes | 3 | 0 | 99.43 | FALSQGTTLRG | 98.71 | FALSQGTTLKG | 0.72 | FALSQGTTLR | 0.72 | | |
| NA | N6 | 134 | 0.37 | yes | 3 | 0 | 99.57 | ALSQGTTLRGR | 94.42 | ALSQGTTLRGQ | 4.43 | ALSQGTTLKGR | 0.72 | | |
| NA | N6 | 135 | 0.37 | yes | 3 | 0 | 99.14 | LSQGTTLRGRH | 94.42 | LSQGTTLRGQH | 4.43 | LSQGTTLKGRH | 0.72 | | |
| NA | N6 | 136 | 0.37 | yes | 3 | 0 | 99.28 | SQGTTLRGRHA | 94.57 | SQGTTLRGQHA | 4.43 | SQGTTLKGRHA | 0.72 | | |
| NA | N6 | 137 | 0.38 | yes | 3 | 0 | 99.43 | QGTTLRGRHAN | 94.28 | QGTTLRGQHAN | 4.43 | QGTTLKGRHA | 0.72 | | |
| NA | N6 | 138 | 0.38 | yes | 3 | 0 | 99.43 | GTTLRGRHANG | 94.28 | GTTLRGQHANG | 4.43 | GTTLKGRHAN | 0.72 | | |
| NA | N6 | 139 | 0.38 | yes | 3 | 0 | 99.43 | TTLRGRHANGT | 94.28 | TTLRGQHANGT | 4.43 | TLKGRHANGT | 0.72 | TLKGRHANGTI | 0.43 |
| NA | N6 | 140 | 0.45 | yes | 4 | 0 | 99.14 | TLRGRHANGTI | 93.56 | TLRGQHANGTI | 4.43 | TLRGRHANGTM | 0.72 | LRGRHANGTIH | 0.72 |
| NA | N6 | 141 | 0.52 | yes | 5 | 0 | 99.14 | LRGRHANGTIH | 92.7 | LRGQHANGTIH | 4.43 | LRGRHANGTMH | 0.72 | KGRHANGTIHD | 0.72 |
| NA | N6 | 142 | 0.52 | yes | 5 | 0 | 99.14 | RGRHANGTIHD | 92.7 | RGQHANGTIHD | 4.43 | RGRHANGTMHD | 0.86 | KGRHANGTIHD | 0.86 |
| NA | N6 | 143 | 0.47 | yes | 4 | 0 | 99.43 | GRHANGTIHDR | 93.13 | GQHANGTIHDR | 4.43 | GRHANGTMHDR | 0.86 | | |
| NA | N6 | 144 | 0.44 | yes | 4 | 0 | 99.71 | RHANGTIHDRS | 93.42 | QHANGTIHDRS | 4.43 | RHANGTMHDRS | 1 | | |
| NA | N6 | 145 | 0.38 | yes | 4 | 0 | 99.71 | HANGTIHDRSP | 94.71 | HANGTIHDRSQ | 3.15 | HANGTMHDRSP | 1 | | |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 221 | 0.16 | yes | 2 | 0.72 | 99.28 | AGNILRTQESE | 98.27 | EGNILRTQESE | 1.01 | | | | |
| NA | N6 | 222 | 0.06 | yes | 1 | 0.72 | 99.28 | GNILRTQESEC | 99.42 | | | | | | |
| NA | N6 | 223 | 0.06 | yes | 1 | 0.72 | 99.42 | NILRTQESECV | 99.42 | | | | | | |
| NA | N6 | 224 | 0.06 | yes | 1 | 0.72 | 99.42 | ILRTQESECVC | 99.42 | | | | | | |
| NA | N6 | 225 | 0.06 | yes | 1 | 0.72 | 99.42 | LRTQESECVCH | 99.57 | | | | | | |
| NA | N6 | 226 | 0.05 | yes | 1 | 0.72 | 99.57 | RTQESECVCHN | 99.57 | | | | | | |
| NA | N6 | 227 | 0.9 | yes | 2 | 0.72 | 99.14 | TQESECVCHNG | 74.35 | RTOESECVCHK | 24.78 | | | | |
| NA | N6 | 228 | 0.88 | yes | 2 | 0.72 | 99.28 | QESECVCHNGI | 74.35 | TQESECVCHKG | 24.93 | | | | |
| NA | N6 | 229 | 1.08 | yes | 2 | 0.72 | 99.14 | ESECVCHNGIC | 73.34 | QESECVCHKGI | 22.33 | QESECVCHNGV | 2.59 | | |
| NA | N6 | 230 | 1.08 | yes | 2 | 0.72 | 99.14 | SECVCHNGICP | 73.34 | ESECVCHKGIC | 22.48 | ESECVCHNGVC | 2.45 | | |
| NA | N6 | 231 | 1.08 | yes | 2 | 0.72 | 99.14 | ECVCHNGICPV | 73.34 | SECVCHKGICP | 22.48 | SECVCHNGVCP | 2.45 | | |
| NA | N6 | 232 | 1.09 | yes | 2 | 0.72 | 99.13 | CVCHNGICPW | 73.3 | ECVCHKGICPV | 22.51 | ECVCHNGVCPV | 2.45 | | |
| NA | N6 | 237 | 0.3 | yes | 4 | 0.86 | 99.13 | GVCPVMTDGP | 95.96 | CVCHKGICPW | 22.51 | CVCHKGVCPW | 2.31 | CVCHNGTCPW | 0.87 |
| NA | N6 | 238 | 0.31 | yes | 3 | 0.86 | 99.13 | VCPVMTDGPA | 95.82 | GYCPVMTDGP | 3.17 | VCPVMTDGPA | 0.14 | | |
| NA | N6 | 239 | 0.31 | yes | 3 | 0.86 | 99.13 | CPVMTDGPAN | 97.69 | VCPVMTDGPA | 3.17 | CPVMTDGPAD | 0.29 | | |
| NA | N6 | 272 | 0.22 | yes | 3 | 0.86 | 99.13 | GNAQHIEECSC | 77.06 | CPVMTDGPAS | 0.87 | GNAQHIEECSC | 0.43 | | |
| NA | N6 | 273 | 0.89 | yes | 3 | 0.86 | 99.13 | GSAQHIEECSC | 77.06 | GNAQHIEECSC | 21.36 | SAEHIEECSCY | 0.43 | | |
| NA | N6 | 274 | 0.89 | yes | 3 | 0.86 | 99.28 | SAQHIEECSCY | 99.42 | NAQHIEECSCY | 21.36 | | | | |
| NA | N6 | 275 | 0.06 | yes | 1 | 0.86 | 99.42 | AQHIEECSCYG | 99.42 | | | | | | |
| NA | N6 | 289 | 0.14 | yes | 2 | 0.86 | 99.42 | QHIEECSCYGA | 98.41 | QHIEECSCYGS | 1.01 | | | | |
| NA | N6 | 290 | 0.69 | yes | 2 | 0.29 | 99.42 | IKCIRDNWKG | 88.09 | VKCIRDNWWKG | 8.03 | IKCICRDNWRG | 0.86 | | |
| NA | N6 | 291 | 0.3 | yes | 4 | 0.29 | 99.43 | KCIRDNWKGA | 96.13 | KCIRDNWIKGA | 2.44 | KCIRDNWWRGA | 0.86 | | |
| NA | N6 | 292 | 0.3 | yes | 3 | 0.29 | 99.43 | CIRDNWKGAN | 96.13 | CVRDNWKGAN | 2.44 | CICRDNWRGAN | 0.86 | | |
| NA | N6 | 293 | 0.3 | yes | 3 | 0.29 | 99.43 | IRDNWKGANR | 96.13 | VCRDNWKGANR | 2.44 | ICRDNWRGANR | 0.86 | | |
| NA | N6 | 294 | 0.1 | yes | 2 | 0.29 | 99.86 | CRDNWKGANRP | 98.85 | CRDNWRGANRP | - | | | | |
| NA | N6 | 295 | 0.24 | yes | 3 | 0.29 | 99.86 | RDNWKGANRPV | 96.84 | RDNWRGANRPV | - | RDNWRGANRPV | 2.01 | | |
| NA | N6 | 296 | 0.25 | yes | 3 | 0.29 | 99.71 | DNWKGANRPVI | 96.7 | DNWRGANRPVI | 2.01 | NWRGANRPVII | 2.01 | | |
| NA | N6 | 297 | 0.4 | yes | 4 | 0.14 | 99.28 | NWKGANRPVII | 94.69 | NWKGANRPVII | 2.01 | WRGANRPVIIT | 1.86 | | |
| NA | N6 | 318 | 0.4 | yes | 4 | 0.14 | 99.28 | WKGANRPVIIT | 94.69 | WKGANRPVIIT | 2.01 | YLCSRVLTDTS | 1.86 | YLCSKTLTDTS | 0.57 |
| NA | N6 | 319 | 1.04 | yes | 5 | 0.14 | 99.28 | YLCSKVLTDTS | 77.51 | YLCSRVLTDTS | 17.77 | LCSRVLTDTSR | 1.86 | LCSKTLTDTSR | 0.57 |
| NA | N6 | 320 | 1.04 | yes | 5 | 0 | 99.28 | LCSKVLTDTSR | 77.51 | LCSRVLTDTSR | 17.77 | CSRVLTDTSRP | 1.86 | CSKTLTDTSRP | 1.15 |
| NA | N6 | 344 | 0.33 | yes | 4 | 0 | 99.28 | CSKVLTDTSRP | 77.51 | CSRILTDTSRP | 17.77 | GGNPDPGVKGF | 0.72 | | |
| NA | N6 | 345 | 0.33 | yes | 4 | 0 | 99.28 | GGSPDPGVKGF | 95.99 | GGTPDPGVKGF | 1.86 | GTPDPGVKGFA | 0.72 | | |
| NA | N6 | 346 | 0.35 | yes | 4 | 0 | 99.28 | GSPDPGVKGFA | 95.85 | GGPDPGVKGFA | 1.86 | GNPDPGVKGFA | 0.72 | | |
| NA | N6 | 347 | 0.08 | yes | 1 | 0 | 99.28 | SPDPGVKGFAF | 99.28 | GPDPGVKGFAF | 1.86 | TPDPGVKGFAF | 0.72 | | |
| NA | N6 | 348 | 0.21 | yes | 3 | 0 | 99.28 | PDPGVKGFAFL | 97.57 | DPGVKGFAFLN | 1.43 | DPGIKGFAFLD | 0.29 | | |
| NA | N6 | 349 | 0.37 | yes | 5 | 0 | 99.28 | DPGVKGFAFLD | 95.71 | PGVKGFAFLNG | 1.43 | PGVKGFAFLDE | 1 | PGIKGFAFLDG | 0.86 |
| NA | N6 | 361 | 0.25 | yes | 2 | 0 | 99.43 | PGVKGFAFLDG | 96.57 | NSWLGRTTSKD | 2.86 | | | PGIKGFAFLDG | 0.29 |
| NA | N6 | 362 | 0.37 | yes | 4 | 0 | 99.14 | NSWLGRTISKD | 95.28 | SWLGRTISKDS | 2.86 | SWLGRTISKDT | 0.57 | SWLGRTISKDL | 0.43 |
| NA | N6 | 363 | 0.37 | yes | 4 | 0 | 99.14 | SWLGRTISKDS | 95.28 | WLGRTISKDSR | | WLGRTISKDTR | 0.57 | WLGRTISKDLR | 0.43 |

Fig. 75-30

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 364 | 0.37 | yes | 4 | 0 | 99.14 | LGRTISKDSRS | 95.28 | LGRTISKDLRS | 2.86 | LGRTISKDLRS | 0.57 | | |
| NA | N6 | 365 | 0.37 | yes | 4 | 0 | 99.14 | GRTISKDSRSG | 95.28 | GRTISKDLRSG | 2.86 | GRTISKDTRSG | 0.57 | | |
| NA | N6 | 366 | 0.37 | yes | 4 | 0 | 99.14 | RTISKDSRSGY | 95.28 | RTISKDLRSGY | 2.86 | RTISKDTRSGY | 0.57 | | |
| NA | N6 | 367 | 0.37 | yes | 4 | 0 | 99.14 | TISKDSRSGYE | 95.28 | TISKDLRSGYE | 2.86 | TISKDTRSGYE | 0.57 | | |
| NA | N6 | 371 | 0.61 | yes | 5 | 0 | 99.14 | DSRSGYEMLKV | 90.99 | DLRSGYEILKV | 4.86 | DLRSGYEMLKV | 0.57 | DTRSGYEMLKV | 0.43 |
| NA | N6 | 372 | 0.61 | yes | 5 | 0 | 99.14 | SRSGYEMLKVP | 90.99 | LRSGYEILKVP | 4.86 | LRSGYEMLKVP | 2.29 | TRSGYEMLKVP | 0.43 |
| NA | N6 | 373 | 0.56 | yes | 4 | 0 | 99.43 | RSGYEMLKVPN | 91.85 | RSGYEILKVPN | 4.29 | RSGYEVLKVPD | 2.29 | RSGYEMLKVPD | 0.43 |
| NA | N6 | 374 | 0.56 | yes | 4 | 0 | 99.43 | SGYEMLKVPNA | 91.85 | SGYEILKVPNA | 4.29 | SGYEVLKVPDA | 2.29 | SGYEMLKVPDA | 0.43 |
| NA | N6 | 375 | 0.56 | yes | 4 | 0 | 99.43 | GYEMLKVPNAE | 91.85 | GYEILKVPNAE | 4.29 | GYEVLKVPDAE | 2.29 | GYEMLKVPDAE | 0.43 |
| NA | N6 | 398 | 0.21 | yes | 5 | 0 | 99.14 | IWNNQNWSGYS | 97.85 | IWNQDWSGYS | 0.57 | IDNQNWSGYS | 0.43 | | |
| NA | N6 | 399 | 0.27 | yes | 5 | 0 | 99.28 | NNQNWSGYSG | 97.85 | NNQDWSGYSG | 0.57 | NNPNWSGYSGA | 0.29 | NNPNWSGYSGA | 0.29 |
| NA | N6 | 400 | 0.25 | yes | 5 | 0 | 99.28 | NQNWSGYSGA | 97.14 | NQDWSGYSGAF | 0.57 | WSGYSGAFINY | 0.29 | WSGYSGAFINY | 0.29 |
| NA | N6 | 401 | 0.26 | yes | 3 | 0 | 99.14 | WSGYSGSFIDY | 97.14 | WSGYSGAFMDY | 0.57 | | | | |
| NA | N6 | 404 | 1.09 | yes | 2 | 0 | 99.28 | SGYSGAFIDYW | 97.14 | SGYSGAFMDYW | 0.57 | | | | |
| NA | N6 | 405 | 0.11 | yes | 1 | 0 | 99.28 | RECFNPCFYVE | 54.87 | KECFNPCFYVE | 44.13 | | | | |
| NA | N6 | 418 | 0.06 | yes | 1 | 0.14 | 99.28 | ECFNPCFYVEL | 99 | KKCFNPCFYVE | 0.29 | | | | |
| NA | N6 | 419 | 0.08 | yes | 1 | 0.14 | 99.43 | CFNPCFYVELI | 99.43 | | | | | | |
| NA | N6 | 420 | 0.05 | yes | 1 | 0.29 | 99.28 | FNPCFYVELIR | 99.28 | | | | | | |
| NA | N6 | 421 | 0.05 | yes | 1 | 0.29 | 99.57 | NPCFYVELIRG | 99.57 | | | | | | |
| NA | N6 | 422 | 0.17 | yes | 2 | 0.29 | 99.28 | PCFYVELIRGM | 98.13 | PCFYVELIRGM | 1.15 | | | | |
| NA | N6 | 423 | 0.17 | yes | 2 | 0.29 | 99.28 | CFYVELIRGMP | 98.13 | CFYVELIRGMP | 1.15 | | | | |
| NA | N6 | 424 | 0.27 | yes | 4 | 0.29 | 99.14 | FYVELIRGMPK | 96.99 | FYVELIRGRPR | 1.15 | FYVELIRGKPK | 0.86 | | |
| NA | N6 | 425 | 0.27 | yes | 4 | 0.29 | 99.11 | YVELIRGMPKE | 96.99 | YVELIRGRPRE | 1.15 | YAELIRGRPKE | 0.86 | | |
| NA | N6 | 426 | 0.43 | yes | 4 | 0.29 | 99.11 | VELIRGMPKEN | 93.69 | VWWTSNSIVAL | 4.88 | VLWTSNSIVAL | 0.29 | | |
| NA | N6 | 439 | 0.09 | yes | 1 | 0.43 | 99.14 | LWTSNSIVALC | 93.83 | WWTSNSIVALC | 4.88 | LWTSNSIVALC | 0.29 | | |
| NA | N6 | 440 | 0.09 | yes | 2 | 0.43 | 99.14 | WTSNSIVALCG | 99.14 | | | | | | |
| NA | N6 | 441 | 0.44 | yes | 3 | 0.43 | 99.14 | TSNSIVALCGS | 92.67 | SNSIVALCGSR | 6.47 | SNSIVALCGKK | 0.86 | SIVALCGSKKR | 0.86 |
| NA | N6 | 442 | 0.51 | yes | 4 | 0.43 | 99.14 | SNSIVALCGSK | 91.81 | NSIVALCGSRE | 6.47 | SIVALCGSKEQ | 1.58 | IVALCGSKKRL | 1.58 |
| NA | N6 | 443 | 0.62 | yes | 4 | 0.29 | 99.28 | NSIVALCGSKE | 90.23 | IVALCGSRERL | 6.61 | IVALCGSKEQL | 1.72 | VALCGSKKRLG | 1.72 |
| NA | N6 | 444 | 0.61 | yes | 4 | 0.43 | 99.14 | SIVALCGSKER | 90.23 | VALCGSRERLG | 6.74 | VALCGSKEQLG | 1.72 | ALCGSKKRLGS | 1.72 |
| NA | N6 | 445 | 0.57 | yes | 4 | 0.43 | 99.86 | IVALCGSKERL | 90.53 | ALCGSRERLGS | 6.74 | ALCGSKEQLGS | 1.72 | LCGSKKRLGSW | 1.72 |
| NA | N6 | 446 | 0.58 | yes | 4 | 0.29 | 99.71 | VALCGSKERLG | 90.39 | LCGSRERLGSW | 6.73 | LCGSKEQLGSW | 1.72 | CGSKKRLGSWS | 1.72 |
| NA | N6 | 447 | 0.6 | yes | 4 | 0.14 | 99.57 | ALCGSKERLGS | 90.26 | CGSRERLGSWS | 6.73 | CGSKEQLGSWS | 1.72 | GSKKRLGSWSW | 1.72 |
| NA | N6 | 448 | 0.61 | yes | 4 | 0.14 | 99.43 | LCGSKERLGSW | 90.11 | GSRERLGSWSW | 6.73 | GSKEQLGSWSW | 1.72 | SKKRLGSWSWH | 1.72 |
| NA | N6 | 449 | 0.61 | yes | 4 | 0.14 | 99.43 | CGSKERLGSWS | 90.11 | SRERLGSWSWH | 6.73 | SKEQLGSWSWH | 1.72 | KKRLGSWSWHD | 1.72 |
| NA | N6 | 450 | 0.61 | yes | 3 | 0.43 | 99.14 | GSKERLGSWSW | 89.83 | RERLGSWSWHD | 6.73 | KEQLGSWSWHD | 1.72 | | |
| NA | N6 | 451 | 0.64 | yes | 4 | 0.14 | 99.43 | SKERLGSWSWH | 89.83 | ERLGSWSWHDG | 1.72 | | | | |
| NA | N6 | 452 | 0.27 | yes | 3 | 0.43 | 99.28 | KERLGSWSWHD | 96.7 | EQLGSWSWHDG | 0.86 | | | | |
| NA | N6 | 453 | | yes | | | | ERLGSWSWHDG | | KRLGSWSWHDG | | | | | |

Fig. 75-31

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N6 | 455 | 0.18 | yes | 2 | 2.43 | 99.27 | RLGSWSWHDGA | 97.95 | QLGSWSWHDGA | 1.32 | | | | |
| NA | N6 | 456 | 0.08 | yes | 1 | 4.43 | 99.25 | LGSWSWHDGAE | 99.25 | | | | | | |
| NA | N6 | 457 | 0.09 | yes | 1 | 5.29 | 99.09 | GSWSWHDGAEI | 99.09 | | | | | | |
| NA | N6 | 458 | 0.46 | yes | 2 | 7.73 | 99.07 | SWSWHDGAEIT | 92.25 | SWSWHDGAEII | 6.82 | | | | |
| NA | N6 | 459 | 0.44 | no | 2 | 8.58 | 99.22 | WSWHDGAEIIY | 92.33 | WSWHDGAEITY | 6.89 | | | | |
| NA | N6 | 460 | 0.44 | no | 2 | 15.88 | 99.22 | SWHDGAEIIYF | 92.01 | SWHDGAEIIYY | 7.48 | | | | |
| NA | N6 | 461 | 0.6 | no | 3 | 20.89 | 99.64 | WHDGAEIIYFK | 92.01 | WHDGAEIIYFE | 7.96 | | | | |
| NA | N7 | 1 | 0.76 | no | 2 | 19.11 | 99.5 | MNPNQKLFTLS | 89.33 | MNPNQKLFTLS | 6.03 | MNPSQKLFALS | 2.35 | MNPNQKLFTLS | 0.5 |
| NA | N7 | 2 | 0.79 | yes | 2 | 17.89 | 99.01 | NPNQKLFASS | 87.44 | NPNQKLFTLSG | 5.94 | NPSQKLFALSG | 4.52 | NPSQKLFALSE | 0.5 |
| NA | N7 | 3 | 0.79 | yes | 2 | 17.48 | 99.01 | PNQKLFASSG | 87.13 | PNQKLFTLSGV | 5.91 | PSQKLFALSGV | 4.46 | PKSKLFTLSGV | 0.49 |
| NA | N7 | 4 | 0.79 | yes | 2 | 17.48 | 99.01 | NQKLFASSGI | 87.19 | NQKLFTLSGVA | 5.91 | SQKLFALSGVA | 4.43 | KSKLFTLSGVA | 0.49 |
| NA | N7 | 5 | 0.79 | yes | 2 | 17.07 | 99.02 | QKLFASSGIAI | 87.25 | QKLFTLSGVAI | 5.88 | QKLFALSGVAI | 4.43 | QKLFALSEVAI | 0.49 |
| NA | N7 | 21 | 0.97 | yes | 3 | 0.41 | 99.59 | NLLIGISNVGL | 81.63 | NLLIGISNMSL | 11.02 | NLLIGISNVGL | 4.41 | NLLIGISNVVL | 0.82 |
| NA | N7 | 22 | 1.01 | yes | 5 | 0.41 | 99.18 | LLIGISNVGLN | 81.22 | LLIGISNMSLN | 11.02 | LLIGISNVGLN | 4.9 | LLIGISNVWLN | 0.82 |
| NA | N7 | 27 | 0.5 | yes | 3 | 0 | 99.19 | SNVGLNVSLHL | 92.68 | SNVGLNVSLHL | 4.88 | SNIGLNVSLHL | 0.81 | SNVGLNMSLHL | 0.41 |
| NA | N7 | 62 | 1.04 | no | 5 | 6.1 | 99.13 | ENTYYNNTTVI | 73.16 | KNTYYNNTTII | 23.81 | ENKYYNNTTII | 0.87 | ENTYYNKTTVI | 0.43 |
| NA | N7 | 83 | 1.33 | yes | 5 | 0 | 99.19 | YLMLNKSLCKV | 65.85 | YLVLNKSLCKV | 26.42 | YLLLNKSLCKV | 3.66 | YLMLSKSLCKV | 0.81 |
| NA | N7 | 96 | 1.23 | yes | 5 | 0.41 | 99.18 | WVYAKDNAVR | 71.95 | WVYAKDNAIR | 17.89 | WVAVAKDNAIR | 8.13 | WVYAQDNAIR | 0.41 |
| NA | N7 | 97 | 1.24 | yes | 4 | 0.41 | 99.18 | VVAKDNAVRF | 71.84 | VVAKDNAIRF | 17.96 | VVAVAKDNAIR | 8.16 | VVIEKDNAVRF | 0.41 |
| NA | N7 | 98 | 1.24 | yes | 4 | 0.41 | 99.18 | VAKDNAVRFG | 71.84 | VAKDNAIRFG | 17.96 | VAVAKDNAIRF | 8.16 | VIEKDNAVRFG | 0.41 |
| NA | N7 | 99 | 1.17 | yes | 4 | 0.41 | 99.18 | AKDNAVRFGE | 72.65 | AKDNAIRFGE | 17.96 | AVAKDNAIRFG | 8.16 | | |
| NA | N7 | 100 | 0.83 | yes | 3 | 0.41 | 99.59 | KDNAVRFGES | 80 | AKDNAIRFGEG | 18.37 | IAQDNAIRFGE | 0.82 | | |
| NA | N7 | 101 | 0.8 | yes | 2 | 0.41 | 99.59 | DNAIRFGESE | 80.41 | KDNAIRFGESE | 18.78 | | | | |
| NA | N7 | 102 | 0.76 | yes | 4 | 0.41 | 99.59 | NAIRFGESEQ | 77.55 | DNAVRFGESEQ | 18.78 | | | | |
| NA | N7 | 103 | 0.97 | yes | 4 | 0.41 | 99.59 | AIRFGESEQI | 77.14 | NAVRFGESEQI | 18.37 | NAIRFGEGEQI | 2.86 | | |
| NA | N7 | 104 | 1.01 | yes | 4 | 0.41 | 99.18 | IRFGESEQII | 77.14 | AVRFGESEQII | 18.37 | AIRFGEGEQII | 2.86 | | |
| NA | N7 | 105 | 0.8 | yes | 3 | 0.41 | 99.18 | RFGESEQIIV | 95.51 | VRFGESEQIIV | 18.37 | IRFGEGEQIIV | 2.86 | | |
| NA | N7 | 106 | 0.31 | yes | 2 | 0.41 | 99.18 | FGESEQIIVT | 95.51 | RFGESEQIIVT | 3.27 | | | | |
| NA | N7 | 107 | 0.31 | yes | 2 | 0.41 | 99.59 | GESEQIIVTR | 95.51 | FGESEQIIVTR | 3.27 | | | | |
| NA | N7 | 108 | 0.35 | yes | 2 | 0 | 99.59 | ESEQIIVTRE | 95.12 | GESEQIIVTRE | 3.25 | | | | |
| NA | N7 | 109 | 0.35 | yes | 2 | 0 | 99.19 | SEQIIVTREP | 95.12 | ESEQIIVTREP | 3.25 | | | | |
| NA | N7 | 110 | 0.35 | yes | 2 | 0 | 99.19 | EQIIVTREPY | 95.12 | SEQIIVTREP | 3.25 | | | | |
| NA | N7 | 111 | 0.28 | yes | 1 | 0 | 99.19 | QIIVTREPYV | 95.93 | EQIVTREPYY | 3.25 | | | | |
| NA | N7 | 112 | 0.28 | yes | 1 | 0 | 99.19 | IIVTREPYVS | 95.93 | QIIVTREPYY | 3.25 | | | | |
| NA | N7 | 113 | 0.28 | yes | 1 | 0 | 99.19 | IVTREPYVSC | 95.93 | IVTREPYYS | 3.25 | | | | |
| NA | N7 | 114 | 0.04 | yes | 1 | 0 | 99.59 | VTREPYVSCD | 99.19 | | | | | | |
| NA | N7 | 115 | 0.08 | yes | 1 | 0 | 99.59 | TREPYVSCDP | 99.59 | | | | | | |
| NA | N7 | 116 | 1.19 | yes | 5 | 0 | 99.59 | TREPYVSCDPL | 73.58 | TREPYVSCDPT | 17.48 | TREPYVSCDPI | 6.5 | TREPYVSCDPK | 1.22 |
| NA | N7 | 127 | 0.87 | yes | 4 | 0 | 99.19 | GCKMYALHQGT | 83.33 | GCKMYALHQGTT | 10.57 | GCKMFALHQGT | 4.88 | | 0.41 |
| NA | N7 | 128 | 0.56 | yes | 2 | 0 | 99.19 | CRMYALHQGTT | 88.62 | CRMYALHQGTT | 10.57 | | | | |

Fig. 75-32

| Protein | Sub-type | Start Pos | Block Entropy | Gaps > 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 129 | 0.56 | yes | 2 | 0 | 99.19 | KMYALHQGTTI | 88.62 | RMYALHQGTTI | 10.57 | | | | |
| NA | N7 | 130 | 0.08 | yes | 1 | 0 | 99.19 | MYALHQGTTIR | 99.19 | | | | | | |
| NA | N7 | 131 | 0.04 | yes | 1 | 0 | 100 | YALHQGTTIRN | 99.59 | | | | | | |
| NA | N7 | 132 | 0.1 | yes | 2 | 0 | 100 | ALHQGTTIRNK | 98.78 | ALHQGTTIRNR | 1.22 | | | | |
| NA | N7 | 133 | 0.1 | yes | 2 | 0 | 100 | LHQGTTIRNKH | 98.78 | LHQGTTIRNRH | 1.22 | | | | |
| NA | N7 | 134 | 0.1 | yes | 2 | 0 | 100 | HQGTTIRNKHS | 98.78 | HQGTTIRNRHS | 1.22 | | | | |
| NA | N7 | 135 | 0.1 | yes | 2 | 0 | 100 | QGTTIRNKHSN | 98.78 | QGTTIRNRHSN | 1.22 | | | | |
| NA | N7 | 136 | 0.1 | yes | 2 | 0 | 99.59 | GTTIRNKHSNG | 95.93 | GTTIRNRHSNG | 2.85 | TIRNRHSNGTI | 1.22 | | |
| NA | N7 | 137 | 0.28 | yes | 3 | 0 | 99.59 | TIRNKHSNGTI | 95.93 | TIRNRHSNGT | 2.85 | TIRNRHSNGTI | 1.22 | | |
| NA | N7 | 138 | 0.28 | yes | 3 | 0 | 99.19 | TIRNKHSNGTT | 93.9 | TIRNRHSNGTT | 2.85 | IRNRHSNGTIH | 1.22 | | |
| NA | N7 | 139 | 0.28 | yes | 3 | 0 | 99.19 | IRNKHSNGTTH | 93.88 | IRNRHSNGTTH | 2.86 | RNRHSNGTIHD | 2.03 | | |
| NA | N7 | 140 | 0.42 | yes | 4 | 0 | 99.18 | RNKHSNGTTHD | 93.88 | RNRHSNGTTHD | 2.86 | NRHSNGTIHDR | 2.04 | | |
| NA | N7 | 141 | 0.44 | yes | 4 | 0.41 | 99.18 | NKHSNGTTHDR | 93.47 | NRHSNGTIHDR | 2.86 | NRHSNGTTHDR | 2.04 | TIHDRNAFRGL | 0.41 |
| NA | N7 | 147 | 0.44 | yes | 4 | 0.41 | 99.19 | THDRTAFRGL | 92.65 | THDRTAFRGL | 4.9 | TINDRTAFRGL | 2.04 | DRAAFRGLIST | 0.41 |
| NA | N7 | 150 | 0.47 | yes | 4 | 0.41 | 99.19 | DRTAFRGLMST | 96.75 | DRTAFRGLLST | 1.22 | DGTAFRGLIST | 0.82 | TFRGLISTPLG | 0.82 |
| NA | N7 | 153 | 0.5 | yes | 4 | 0.41 | 99.19 | AFRGLISTPLG | 95.53 | AFRGLMSTPLG | 1.22 | AFRGLISTQLG | 0.41 | | |
| NA | N7 | 169 | 0.29 | yes | 5 | 0 | 99.59 | SNSDFLCVGWS | 68.29 | SNSDFMCVGWS | 8.54 | SNSEFICVGWS | 8.54 | SNSEFLCVGWSS | 4.88 |
| NA | N7 | 170 | 0.37 | yes | 5 | 0 | 99.59 | NSDFLCVGWSS | 68.29 | NSDFMCVGWSS | 8.54 | NSEFICVGWSS | 8.54 | NSEFLCVGWSS | 4.88 |
| NA | N7 | 171 | 1.48 | yes | 5 | 0 | 99.18 | SDFLCVGWSST | 68.29 | SDFMCVGWSST | 8.54 | SEFICVGWSST | 4.88 | SEFLCVGWSST | 4.07 |
| NA | N7 | 173 | 1.48 | yes | 5 | 0 | 99.18 | FLCVGWSSTSC | 70.73 | FMCVGWSSTC | 15.04 | FICVGWSSTTC | 9.35 | | |
| NA | N7 | 174 | 1.48 | yes | 5 | 0 | 99.59 | LCVGWSSTSCH | 70.73 | MCVGWSSTTCH | 15.04 | ICVGWSSTTCH | 9.35 | | |
| NA | N7 | 175 | 1.34 | yes | 4 | 0 | 100 | CVGWSSTSCHD | 70.73 | CVGWSSTTCHD | 19.92 | | | | |
| NA | N7 | 176 | 0.72 | yes | 2 | 0 | 99.59 | VGWSSTSCHDG | 79.67 | VGWSSTTCHDG | 19.92 | | | | |
| NA | N7 | 177 | 0.76 | yes | 2 | 0 | 99.59 | GWSSTCHDGI | 68.7 | GWSSTTCHDGV | 14.63 | GWSSTTCHDGV | 11 | | |
| NA | N7 | 183 | 1.38 | yes | 4 | 0 | 99.19 | CHDGIGRMTIC | 80.89 | CHDGVRMTIC | 10.98 | CHDGVSRMTIC | 2.44 | CHDGVRMTIC | 5.28 |
| NA | N7 | 195 | 1.05 | yes | 4 | 0 | 99.59 | QGNNDATIC | 82.52 | QGNNENATATV | 10.98 | QGNNENATATV | 2.85 | QGNNKNATATV | 2.44 |
| NA | N7 | 196 | 0.94 | yes | 4 | 0 | 99.59 | GNNNDATATY | 82.52 | GNNENATATYY | 10.98 | GDNENATATYY | 2.85 | GNNKNATATV | 2.44 |
| NA | N7 | 197 | 0.94 | yes | 4 | 0 | 99.19 | NNNNATATYY | 59.35 | NNNATATYYY | 23.58 | DNENATATYYY | 2.85 | NNKNATATYY | 2.44 |
| NA | N7 | 198 | 1.62 | yes | 4 | 0 | 99.59 | NDNATATYYN | 70.33 | NDNATATYYN | 21.14 | NNNATATYYN | 10.2 | NKNATATYYD | 5.28 |
| NA | N7 | 200 | 1.23 | yes | 4 | 0 | 99.59 | NATATYYDRR | 70.33 | NATATYYDRR | 20.73 | NATATYYNKR | 5.28 | | |
| NA | N7 | 201 | 1.26 | yes | 4 | 0 | 99.59 | ATATYYDRRL | 70.33 | ATATYYDRRL | 20.73 | ATATYYNKRL | 5.28 | | |
| NA | N7 | 202 | 1.26 | yes | 4 | 0 | 99.59 | TATYYDRRLT | 70.33 | TATYYDRRLT | 20.73 | TATYYNKRLT | 5.28 | | |
| NA | N7 | 203 | 1.26 | yes | 4 | 0 | 99.59 | ATYYDRRLLT | 70.33 | ATYYDRRLLT | 20.73 | ATYYNKRLIT | 5.28 | | |
| NA | N7 | 204 | 1.3 | yes | 5 | 0 | 99.59 | TYYDRRLTT | 69.92 | TYYNRRLTT | 20.73 | TYYNGRLTT | 5.28 | VYYNRRPTTI | 2.85 |
| NA | N7 | 205 | 0.71 | yes | 2 | 0 | 99.19 | YYDRRLTTT | 89.02 | YYNRRLTTT | 5.28 | VYYNRRPTTI | 1.63 | | |
| NA | N7 | 209 | 1.29 | yes | 4 | 0 | 99.19 | RLTTIKTWA | 69.11 | RLTTIKTWA | 21.95 | RLTTIKTWA | 1.63 | RPTTIKTWAR | 0.41 |
| NA | N7 | 210 | 1.29 | yes | 4 | 0 | 99.19 | TTTIKTWAG | 67.07 | TTTIKTWA | 6.1 | TTTIKTWARNI | 2.03 | TTTIKPWARNI | 0.41 |
| NA | N7 | 212 | 1.39 | yes | 5 | 0 | 99.19 | TTIKTWAGNI | 67.07 | TTIKTWAKNI | 22.36 | TTIKTWAGKI | 6.1 | TTIKTWARNI | 2.03 | TTIKPWARNI | 0.41 |
| NA | N7 | 213 | 1.39 | yes | 5 | 0 | 99.19 | TIKTWAGNIL | 67.07 | TIKTWAKNIL | 22.36 | TIKTWAGKIL | 6.1 | TIKTWARNIL | 2.03 | TIKPWARNIL | 1.63 |
| NA | N7 | 214 | 1.39 | yes | 5 | 0 | 99.19 | IKTWAGNILR | 67.07 | IKTWAKNILR | 22.36 | IKTWAGKILR | 6.1 | IKTWARNILR | 2.03 | IKPWARNILR | 1.63 |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 361 | 0.48 | yes | 5 | 0 | 99.19 | WLGRTISPSR | 93.5 | WLGRTISPKLR | 2.44 | WLGRTISPHSR | 2.44 | WLGRTFSPRSR | 0.41 |
| NA | N7 | 365 | 0.48 | yes | 5 | 0 | 99.19 | TISPRSRGFE | 93.5 | TISPKLRSGFE | 2.44 | TSPRSRSGFE | 2.44 | TISPHSRSGFE | 0.41 |
| NA | N7 | 367 | 0.48 | yes | 5 | 0 | 99.19 | SPRSRSGFEML | 93.5 | SPKLRSGFEML | 2.44 | STRSRSGFEML | 2.44 | SPHSRSGFEML | 0.41 |
| NA | N7 | 370 | 0.6 | yes | 4 | 0 | 99.19 | SRSGFEMLKIP | 91.06 | LRSGFEMLKIP | 4.88 | SRSGFEMLKVP | 2.44 | SRSGFEMLKIH | 0.41 |
| NA | N7 | 371 | 0.32 | yes | 4 | 0 | 99.19 | RSGFEMLKIPN | 95.93 | RSGFEMLKVPN | 2.44 | RSGFEVLKVP | 0.41 | | |
| NA | N7 | 372 | 0.32 | yes | 5 | 0 | 99.19 | SGFEMLKIPNA | 95.93 | SGFEMLKVPNA | 2.44 | SGFEVLKVPN | 0.41 | | |
| NA | N7 | 373 | 0.68 | yes | 3 | 0 | 99.19 | GFEMLKIPNAG | 89.02 | GFEMLKVPNAE | 7.32 | GFEMLKVPNAG | 1.22 | GFEMLRIPNAG | 0.41 |
| NA | N7 | 401 | 0.15 | yes | 1 | 0 | 99.19 | NWSGYSGSFID | 98.37 | NLSGYSGSFID | 0.41 | | | | |
| NA | N7 | 402 | 0.08 | yes | 1 | 0 | 99.19 | WSGYSGSFIDY | 99.19 | | | | | | |
| NA | N7 | 403 | 0 | yes | 1 | 0 | 100 | SGYSGSFIDYW | 100 | | | | | | |
| NA | N7 | 404 | 0.78 | yes | 2 | 0 | 100 | GYSGSFIDYWN | 76.83 | GYSGSFIDYWN | 23.17 | | | | |
| NA | N7 | 405 | 1.08 | yes | 3 | 0 | 99.59 | YSGSFIDYWDE | 71.54 | YSGSFIDYWND | 23.17 | YSGSFIDYWDD | 23.17 | | |
| NA | N7 | 417 | 0.92 | yes | 3 | 0 | 99.59 | SECNPCFYVE | 82.11 | SVCNPCFYVE | 12.2 | SKCYNPCFYVE | 4.88 | SACYNPCFYVE | 0.81 |
| NA | N7 | 418 | 0.38 | yes | 3 | 0 | 99.59 | ECYNPCFYVEL | 94.31 | KCYNPCFYVEL | 4.07 | SKCYNPCFYVE | 3.66 | | |
| NA | N7 | 419 | 0 | yes | 1 | 0 | 100 | CYNPCFYVELI | 100 | | | | | | |
| NA | N7 | 420 | 0 | yes | 1 | 0 | 100 | YNPCFYVELIR | 100 | | | | | | |
| NA | N7 | 421 | 0 | yes | 1 | 0 | 100 | NPCFYVELIRG | 100 | | | | | | |
| NA | N7 | 422 | 0 | yes | 1 | 0 | 100 | PCFYVELIRGR | 100 | | | | | | |
| NA | N7 | 423 | 0 | yes | 1 | 0 | 100 | CFYVELIRGRP | 100 | | | | | | |
| NA | N7 | 424 | 0 | yes | 1 | 0 | 100 | FYVELIRGRPE | 100 | | | | | | |
| NA | N7 | 425 | 0 | yes | 1 | 0 | 100 | YVELIRGRPEE | 100 | | | | | | |
| NA | N7 | 426 | 0.07 | yes | 2 | 0 | 99.19 | VELIRGRPEEA | 99.19 | LIRGRPEEVKY | 0.81 | | | | |
| NA | N7 | 427 | 0.07 | yes | 2 | 0 | 99.19 | ELIRGRPEEAK | 99.19 | IRGRPEEVKY | 0.81 | | | | |
| NA | N7 | 428 | 0.11 | yes | 3 | 0 | 98.78 | LIRGRPEEAKY | 98.78 | RGRPEEAKYE | 4.88 | RGRPEEVKYYW | 1.22 | | |
| NA | N7 | 429 | 0.11 | yes | 3 | 0 | 98.78 | IRGRPEEAKYV | 98.78 | GRPEEAKYVEW | 4.88 | GRPEEVKYYWW | 1.22 | | |
| NA | N7 | 430 | 0.39 | yes | 3 | 0 | 93.9 | RGRPEEAKYVW | 93.9 | RPEEAKYVEWT | 4.88 | RPEEAKYYWWA | 1.22 | RPEEVKYYWWT | 0.81 |
| NA | N7 | 431 | 0.39 | yes | 3 | 0 | 93.9 | GRPEEAKYVWW | 93.9 | PEEAKYVEWTS | 4.88 | PEEAKYYWWAS | 1.22 | PEEVKYYWWTS | 0.81 |
| NA | N7 | 432 | 0.48 | yes | 4 | 0 | 99.59 | RPEEAKYVWWT | 92.68 | EEAKYVEWTSN | 4.88 | EEAKYYWWASN | 1.22 | EEVKYYWWTSN | 0.81 |
| NA | N7 | 433 | 0.48 | yes | 4 | 0 | 99.59 | PEEAKYVWWTS | 92.68 | EAKYVEWTSNS | 4.88 | EAKYYWWASNS | 1.22 | EVKYYWWTSNS | 0.81 |
| NA | N7 | 434 | 0.48 | yes | 4 | 0 | 99.59 | EEAKYVWWTSN | 92.68 | AKYVEWTSNSL | 4.88 | AKYYWWASNSL | 1.22 | VKYYWWTSNSL | 0.81 |
| NA | N7 | 435 | 0.48 | yes | 4 | 0 | 99.59 | EAKYVWWTSNS | 92.68 | KYVEWTSNSLI | 22.76 | KYYWWASNSLI | 1.22 | KYYWWTSNSLI | 1.22 |
| NA | N7 | 436 | 1.16 | yes | 4 | 0 | 99.59 | AKYVWWTSNSL | 70.73 | YVEWTSNSLIA | 22.76 | YYWWASNSLIA | 4.88 | YYWWTSNSLI | 4.88 |
| NA | N7 | 437 | 1.16 | yes | 4 | 0 | 99.59 | KYVWWTSNSLV | 70.73 | VEWTSNSLIAL | 22.86 | YWWASNSLIA | 4.88 | VWWASNSLIA | 4.9 |
| NA | N7 | 438 | 1.13 | yes | 4 | 0 | 99.59 | YVWWTSNSLVA | 71.02 | EWTSNSLIALC | 22.86 | WWASNSLIAL | 4.9 | WWASNSLIALC | 1.22 |
| NA | N7 | 439 | 1.13 | yes | 4 | 0 | 100 | VWWTSNSLIAL | 71.02 | WTSNSLIALCG | 27.76 | WASNSLIALCG | 4.9 | | |
| NA | N7 | 440 | 0.94 | yes | 3 | 0.41 | 100 | WWTSNSLIALC | 71.02 | TSNSLIALCGS | 27.76 | ASNSLIALCGS | 1.22 | | |
| NA | N7 | 441 | 0.94 | yes | 3 | 0.41 | 100 | WTSNSLVALC | 71.02 | SNSLIALCGSP | 28.98 | | | | |
| NA | N7 | 442 | 0.87 | yes | 2 | 0.41 | 100 | TSNSLVALCG | 71.02 | NSLIALCGSPI | 34.69 | NSLIALCGSPF | 22.5 | NSLIALCGSPI | 5.31 | NSLIALCGSPV | 0.82 |
| NA | N7 | 443 | 0.87 | yes | 3 | 0.41 | 100 | SNSLVALCGSP | 71.02 | | | | | | |
| NA | N7 | 444 | 1.89 | yes | 5 | 0.41 | 99.18 | NSLVALCGSPI | 35.92 | | | | | | |

Fig. 75-35

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N7 | 455 | 1.13 | yes | 4 | 3.66 | 99.16 | SVGGSFPDGA

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 348 | 0.04 | yes | 1 | 0.11 | 99.67 | GHIEECCSCYPN | 99.67 | HIEECCSCYPND | 10.87 | | | | |
| NA | N8 | 349 | 0.59 | yes | 2 | 0.11 | 99.02 | HIEECCSCYPNE | 88.15 | IEECCSCYPNDG | 10.87 | | | | |
| NA | N8 | 350 | 0.6 | yes | 2 | 0.11 | 99.46 | IEECCSCYPNEG | 88.04 | EECCSCYPNDGK | 10.87 | | | | |
| NA | N8 | 351 | 0.59 | yes | 2 | 0.11 | 99.02 | EECCSCYPNEGK | 88.15 | ECCSCYPNDGKV | 10.64 | | | | |
| NA | N8 | 352 | 0.61 | yes | 3 | 0 | 99.35 | ECCSCYPNEGKV | 88.17 | CCSCYPNDGKVE | 10.64 | ECSCYPNNGKV | 0.54 | | |
| NA | N8 | 353 | 0.61 | yes | 3 | 0 | 99.35 | CCSCYPNEGKVE | 88.17 | SCYPNDGKVEC | 10.64 | CSCYPNNGKVE | 0.54 | | |
| NA | N8 | 354 | 0.61 | yes | 3 | 0 | 99.35 | SCYPNEGKVEC | 88.17 | CYPNDGKVECV | 10.64 | SCYPNNGKVEC | 0.54 | | |
| NA | N8 | 355 | 1.22 | yes | 4 | 0 | 99.35 | CYPNEGKVECV | 71.44 | YPNDGKVECVC | 16.72 | CYPNNGKVECI | 10.6 | CYPNNGKVECI | 0.54 |
| NA | N8 | 356 | 1.22 | yes | 4 | 0 | 99.24 | YPNEGKVECVC | 71.44 | PNDGKVECVCR | 16.72 | YPNNGKVECIC | 10.6 | YPNNGKVECIC | 0.54 |
| NA | N8 | 357 | 1.23 | yes | 4 | 0 | 99.35 | PNEGKVECVCR | 71.44 | NDGKVECVCRD | 16.61 | PNNGKVECICR | 10.6 | PNNGKVECICR | 0.54 |
| NA | N8 | 358 | 1.21 | yes | 4 | 0 | 99.46 | NEGKVECVCRD | 71.55 | DGKVECVCRDN | 16.72 | NNGKVECICRD | 10.6 | NNGKVECICRD | 0.54 |
| NA | N8 | 359 | 1.22 | yes | 4 | 0 | 99.35 | EGKVECVCRDN | 82.19 | GKVECICRDNW | 17.26 | NGKVECICRDN | 10.5 | NGKVECICRDN | 0.54 |
| NA | N8 | 360 | 0.72 | yes | 2 | 0 | 99.46 | GKVECVCRDNW | 82.08 | KVECICRDNWT | 17.26 | | | | |
| NA | N8 | 361 | 0.73 | yes | 2 | 0 | 99.35 | KVECVCRDNWT | 82.08 | VECICRDNWTG | 17.26 | | | | |
| NA | N8 | 362 | 0.72 | yes | 2 | 0 | 99.46 | VECVCRDNWTG | 82.19 | ECICRDNWTGT | 17.26 | | | | |
| NA | N8 | 363 | 0.72 | yes | 2 | 0 | 99.46 | ECVCRDNWTGT | 82.19 | CICRDNWTGTN | 17.26 | | | | |
| NA | N8 | 364 | 0.72 | yes | 2 | 0 | 99.46 | CVCRDNWTGTN | 82.19 | ICRDNWTGTNR | 17.26 | | | | |
| NA | N8 | 365 | 0.07 | yes | 1 | 0 | 99.13 | VCRDNWTGTNR | 99.35 | | | | | | |
| NA | N8 | 366 | 0.87 | yes | 2 | 0 | 99.13 | CRDNWTGTNRP | 76.55 | RDNWTGTNRPI | 22.58 | | | | |
| NA | N8 | 367 | 0.87 | yes | 2 | 0 | 99.13 | RDNWTGTNRPV | 76.44 | DNWTGTNRPIL | 22.69 | | | | |
| NA | N8 | 368 | 0.98 | yes | 3 | 0 | 99.02 | DNWTGTNRPVL | 75.14 | NWTGTNRPILV | 22.58 | NWTGTNRPILA | 1.09 | NWTGTNRPILA | 0.11 |
| NA | N8 | 369 | 1.03 | yes | 3 | 0 | 99.02 | NWTGTNRPVLV | 74.59 | WTGTNRPILVI | 22.58 | WTGTNRPVLVW | 1.09 | WTGTNRPVLMI | 0.65 |
| NA | N8 | 370 | 1.28 | yes | 3 | 0.43 | 99.13 | WTGTNRPVLVI | 69.68 | TGTNRPVLMI | 21.48 | LSYQVGYLCAG | 6.11 | LSYSVGYLCAG | 0.98 |
| NA | N8 | 384 | 0.96 | yes | 3 | 0.22 | 99.13 | LSYRVGYLCAG | 74.43 | VGYLCAGIPSD | 21.33 | GYLCAGIPSDT | 3.37 | | |
| NA | N8 | 388 | 1.03 | yes | 3 | 0.22 | 99.89 | VGYLCAGIPSD | 75.19 | GYLCAGIPSDT | 21.33 | YLCAGIPSDTP | 3.37 | | |
| NA | N8 | 389 | 0.96 | yes | 3 | 0.22 | 99.89 | GYLCAGIPSDT | 75.19 | YLCAGIPSDTP | 21.33 | LCAGIPSDTPR | 3.37 | | |
| NA | N8 | 390 | 0.96 | yes | 3 | 0.22 | 99.89 | YLCAGIPSDTP | 75.19 | LCAGIPSDTPR | 21.33 | CAGIPSDTPRG | 3.37 | | |
| NA | N8 | 391 | 0.97 | yes | 3 | 0.11 | 99.78 | LCAGIPSDTPR | 75.19 | CAGIPSDTPRG | 21.33 | AGIPSDTPRGE | 3.37 | | |
| NA | N8 | 392 | 1.01 | yes | 3 | 0 | 99.35 | CAGIPSDTPRG | 74.57 | AGIPSDTPRGE | 21.41 | GIPSDTPRGED | 3.37 | | |
| NA | N8 | 393 | 1.01 | yes | 3 | 0.22 | 99.02 | AGIPSDTPRGE | 74.57 | GIPSDTPRGED | 21.39 | PSDTPRGEDAQ | 10.4 | PSDTPRGEDGQ | 0.98 |
| NA | N8 | 394 | 1.59 | yes | 5 | 0.11 | 99.02 | GIPSDTPRGED | 62.11 | PTDTPRGEDSQ | 21.39 | SDTPRGEDNQF | 10.4 | SDTPRGEDGQF | 0.98 |
| NA | N8 | 396 | 1.59 | yes | 5 | 0 | 99.13 | PSDTPRGEDSQ | 62.19 | TDTPRGEDSQF | 21.39 | LGYGVKGFGFR | 0.87 | | |
| NA | N8 | 397 | 0.89 | yes | 3 | 0.22 | 99.35 | SDTPRGEDSQF | 77.8 | KGFGVKGFGFR | 20.46 | | | | |
| NA | N8 | 418 | 0.07 | yes | 1 | 0.11 | 99.13 | GYGVKGFGFR | 93.35 | | | | | | |
| NA | N8 | 419 | 0.01 | yes | 1 | 0 | 99.89 | GYGVKGFGFRQ | 99.89 | | | | | | |
| NA | N8 | 420 | — | yes | 1 | 0.11 | 99.89 | YGVKGFGFRQG | 99.89 | | | | | | |
| NA | N8 | 421 | 1.01 | yes | 3 | 0.11 | 99.02 | GVKGFGFRQGN | 70.98 | GVKGFGFRQGT | 27.17 | VKGFGFRQGSD | 0.87 | VKGFGFRQGSD | 0.65 |
| NA | N8 | 422 | 1.01 | yes | 4 | 0.11 | 99.02 | VKGFGFRQGND | 70.98 | VKGFGFRQGTD | 27.07 | KGFGFRQGSDV | 0.87 | KGFGFRQGSDV | 0.65 |
| NA | N8 | 423 | 1.01 | yes | 3 | 0.11 | 99.57 | KGFGFRQGNDV | 71.09 | KGFGFRQGTDV | 26.96 | GFGFRQGSDVW | 0.87 | GFGFRQGSDVW | 0.65 |
| NA | N8 | 424 | 1.01 | yes | 4 | 0.11 | 99.57 | GFGFRQGNDVW | 71.09 | GFGFRQGTDVW | 26.96 | GFGFRQGSDDW | 0.87 | | |

Fig. 75-38

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N8 | 471 | 0.91 | yes | 4 | 0 | 99.02 | DNLNWGYSGS | 82.63 | DDPNWSGYSGS | 12.49 | DNSNWSGYSGS | 2.93 | DNPNWSGYSGS | 0.98 |
| NA | N8 | 472 | 0.89 | yes | 4 | 0 | 99.24 | NLNWGYSGSF | 82.74 | DPNWSGYSGSF | 12.49 | NSNWSGYSGSF | 2.93 | NPNWSGYSGSF | 1.09 |
| NA | N8 | 473 | 0.81 | yes | 3 | 0 | 99.57 | LNWSGYSGSFT | 82.84 | PNWSGYSGSFT | 13.79 | SNWSGYSGSFT | 2.93 | | |
| NA | N8 | 474 | 0.05 | yes | 1 | 0 | 99.57 | NWSGYSGSFTL | 99.57 | | | | | | |
| NA | N8 | 475 | 0.02 | yes | 1 | 0 | 99.78 | WSGYSGSFTLP | 99.78 | | | | | | |
| NA | N8 | 476 | 0.22 | yes | 2 | 0 | 99.67 | SGYSGSFTLPI | 96.85 | SGYSGSFTLPV | 2.82 | | | | |
| NA | N8 | 477 | 0.3 | yes | 3 | 0 | 99.24 | GYSGSFTLPIE | 96.2 | GYSGSFTLPVE | 2.61 | GYSGSFTLPVG | 0.43 | | |
| NA | N8 | 478 | 0.34 | yes | 3 | 0 | 99.24 | YSGSFTLPIEL | 95.77 | YSGSFTLPVEM | 2.61 | YSGSFTLPVGL | 0.43 | | |
| NA | N8 | 493 | 0.08 | yes | 1 | 0 | 99.24 | CLVPCFWVEMI | 99.24 | | | | | | |
| NA | N8 | 494 | 0.08 | yes | 1 | 0 | 99.24 | LVPCFWVEMIR | 99.24 | | | | | | |
| NA | N8 | 495 | 0.09 | yes | 2 | 0 | 99.13 | PCFWVEMIRGK | 99.13 | PCFWVEMIRGE | 0.43 | PCFWVEMIRGR | 0.43 | | |
| NA | N8 | 496 | 0.19 | yes | 3 | 0 | 99.02 | CFWVEMIRGKP | 98.15 | CFWVEMIRGEP | 0.43 | CFWVEMIRGRP | 0.43 | | |
| NA | N8 | 497 | 0.19 | yes | 3 | 0 | 99.02 | FWVEMIRGKPE | 98.15 | FWVEMIRGRPE | 0.43 | FWVEMIRGEPE | 0.43 | | |
| NA | N8 | 498 | 0.19 | yes | 3 | 0 | 99.24 | WVEMIRGKPEE | 98.05 | WVEMIRGRPEE | 0.43 | WVEMIRGEPEE | 0.43 | WVETIRGKPEE | 0.33 |
| NA | N8 | 499 | 0.2 | yes | 4 | 0 | 99.24 | TIWTSSSIVM | 92.94 | TIWTSSSSVVM | 5.32 | TIWTSSSSVVM | 0.43 | AIWTSSSIVM | 0.54 |
| NA | N8 | 511 | 0.46 | yes | 2 | 0 | 99.35 | IWTSSSIVMC | 93.7 | IWTSSSSVVMC | 5.32 | WTSSSSVVMCG | 0.43 | | |
| NA | N8 | 512 | 0.39 | yes | 2 | 0 | 99.02 | WTSSSIVMCG | 94.46 | WTSSSSVVMCG | 5.32 | | | | |
| NA | N8 | 513 | 0.38 | yes | 2 | 0 | 99.78 | TSSSIVMCGV | 94.46 | TSSSSVVMCG | 5.32 | | | | |
| NA | N8 | 514 | 0.32 | yes | 3 | 0 | 99.35 | SSSIVMCGVD | 92.62 | SSSSVVMCGVD | 5.32 | SSSIVMCGVN | 1.41 | SSSIVMCGVEH | 1.09 |
| NA | N8 | 515 | 0.32 | yes | 3 | 0 | 99.13 | SSIVMCGVDH | 80.98 | SSIVMCGVDY | 11.3 | SWSWHDGAVLP | 5.33 | NWSWHDGAILP | 0.58 |
| NA | N8 | 516 | 0.47 | yes | 5 | 0.11 | 99.08 | SWSHDGAILP | 75.95 | SWSWHDGAVLP | 20.6 | DWSWHDGAVLP | 1.27 | | |
| NA | N8 | 530 | 1.01 | yes | 4 | 5.65 | 99.16 | WSWHDGAILPF | 96.52 | WSWHDGAVLPF | 1.92 | WSWQDGAILPF | 0.48 | | |
| NA | N8 | 531 | 1.03 | no | 2 | 9.55 | 100 | AILPFDIKIS | 50 | AILPFDIDKII | 50 | | | | |
| NA | N8 | 537 | 0.3 | no | 2 | 99.78 | | 100 | ILPFDFKISQ | 50 | ILPFDIDKIIT | 50 | | | | |
| NA | N9 | 1 | — | no | 3 | 13.57 | 99.48 | MNPNQKILCTS | 95.29 | MNPNQKILCAS | 2.09 | MNPNQKILFAS | 1.57 | MNPNQRILCTS | 0.52 |
| NA | N9 | 2 | 0.36 | yes | 3 | 13.57 | 99.48 | NPNQKILCTSA | 95.29 | NPNQKILCASA | 2.09 | NPNQKILFASA | 1.57 | NPNQRILCTSA | 0.52 |
| NA | N9 | 3 | 0.36 | yes | 3 | 13.12 | 99.48 | PNQKILCTSAT | 93.75 | PNQKILCASAT | 2.08 | PNQKILFASAT | 1.56 | PNQRILCTSAT | 1.56 |
| NA | N9 | 4 | 0.47 | yes | 4 | 8.14 | 99.01 | NQKILCTSATA | 93.1 | NQKILCASATA | 1.97 | NQKILFASATA | 1.97 | SQKILCTSATA | 1.48 |
| NA | N9 | 5 | 0.52 | yes | 5 | 8.14 | 99.01 | QKILCTSATAI | 92.12 | QKILCASATAI | 1.97 | QKILFASATAI | 1.97 | QKILFASATAI | 1.48 |
| NA | N9 | 27 | 0.59 | yes | 4 | 0 | 99.55 | ANLGLNVGLHL | 92.31 | ANLGLNVGLHL | 5.43 | TNLGLNIGLHL | 0.9 | | |
| NA | N9 | 28 | 0.49 | yes | 3 | 0 | 99.55 | NLGLNIGLHLK | 95.48 | NLGLNIGLHLR | 3.17 | | | | |
| NA | N9 | 29 | 0.32 | yes | 3 | 0 | 99.1 | LGLNIGLHLRP | 95.02 | LGLNIGLHLKP | 3.17 | | | | |
| NA | N9 | 85 | 0.36 | yes | 3 | 0 | 99.1 | FNNLTRELCTI | 89.59 | FNNLTRGLCTI | 4.07 | FNNLTKRLCTI | 2.71 | FNNLTKGLCII | 2.26 |
| NA | N9 | 86 | 0.7 | yes | 5 | 0 | 99.1 | NNLTRELCTIN | 89.59 | NNLTRGLCTIN | 4.07 | NNLTKRLCTIN | 2.71 | NNLTRGLCKIN | 2.26 |
| NA | N9 | 87 | 0.7 | yes | 5 | 0 | 99.1 | NLTRELCTINS | 89.59 | NLTRGLCTINS | 4.07 | NLTKRLCTINS | 2.71 | NLTRELCTINS | 2.26 |
| NA | N9 | 88 | 0.7 | yes | 5 | 0 | 99.1 | LTRELCTINSW | 89.59 | LTRGLCTINSW | 4.07 | LTKRLCTINSW | 2.71 | LTRGLCIINSW | 2.26 |
| NA | N9 | 89 | 0.7 | yes | 5 | 0 | 99.1 | TRELCTINSWH | 89.59 | TRGLCTINSWH | 4.07 | TKRLCTINSWH | 2.71 | TKGLCTINSWH | 2.26 |
| NA | N9 | 90 | 0.7 | yes | 5 | 0 | 99.1 | RELCTINSWHI | 89.59 | RGLCTINSWHI | 4.07 | KRLCTINSWHI | 2.71 | RGLCKINSWHI | 2.26 |
| NA | N9 | 91 | 0.94 | yes | 5 | 0 | 99.1 | GLCTINSWHIY | 83.71 | ELCTINSWHIY | 8.14 | RLCTINSWHIY | 4.52 | GLCKINSWHIF | 2.26 |

Fig. 75-39

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 92 | 0.53 | yes | 3 | 0 | 99.1 | LCTINSWHIYG | 90.5 | LCTINSWHIYG | 8.14 | | | | |
| NA | N9 | 93 | 0.53 | yes | 3 | 0 | 99.1 | CTINSWHIYGK | 90.5 | CTINSWHIFGK | 8.14 | | | | |
| NA | N9 | 94 | 0.53 | yes | 3 | 0 | 99.1 | TINSWHIYGKD | 90.5 | TINSWHIFGKD | 8.14 | | | | |
| NA | N9 | 95 | 0.46 | yes | 2 | 0 | 99.55 | INSWHIYGKDN | 90.95 | NSWHIFGKDN | 8.6 | | | | |
| NA | N9 | 96 | 0.46 | yes | 4 | 0 | 99.55 | NSWHIYGKDNA | 90.95 | NSWHIFGKDNA | 8.6 | | | | |
| NA | N9 | 97 | 0.72 | yes | 4 | 0 | 99.55 | SWHIYGKDNAV | 88.24 | SWHIFGKDNAV | 5.43 | SWHIYGKDNAI | 3.17 | | |
| NA | N9 | 98 | 0.72 | yes | 4 | 0 | 99.55 | WHIYGKDNAVR | 88.24 | WHIFGKDNAVR | 5.43 | WHIYGKDNAIR | 3.17 | | |
| NA | N9 | 99 | 0.72 | yes | 4 | 0 | 99.55 | HIYGKDNAVRI | 88.24 | HIFGKDNAIRI | 5.43 | HIYGKDNAIRI | 3.17 | | |
| NA | N9 | 100 | 0.74 | yes | 4 | 0 | 99.1 | IYGKDNAVRIG | 88.24 | IFGKDNAIRIG | 5.43 | IYGKDNAIRIG | 3.17 | | |
| NA | N9 | 101 | 1.45 | yes | 5 | 0 | 99.1 | YGKDNAVRIGE | 88.24 | FGKDNAIRIGE | 4.98 | YGKDNAIRIGE | 3.17 | | |
| NA | N9 | 102 | 1.45 | yes | 5 | 0 | 99.1 | GKDNAVRIGEN | 54.75 | GKDNAIRIGEN | 35.75 | GKDNAIRIGED | 7.24 | GKDNAIRIGGN | 0.45 |
| NA | N9 | 103 | 1.49 | yes | 5 | 0 | 99.1 | KDNAVRIGENS | 54.75 | KDNAIRIGENS | 35.75 | KDNAIRIGEDS | 7.24 | KDNAIRIGGNS | 0.45 |
| NA | N9 | 108 | 1.49 | yes | 5 | 0 | 99.1 | RIGEDSDVLVT | 46.61 | RIGENSDVLVT | 42.53 | RIGESSDVLVT | 9.05 | RIGENSGVLVT | 0.45 |
| NA | N9 | 109 | 1.49 | yes | 5 | 0 | 99.1 | IGEDSDVLVTR | 46.61 | IGENSDVLVTR | 42.53 | IGGNSDVLVTR | 9.05 | IGEKSDVLVTR | 0.45 |
| NA | N9 | 110 | 1.49 | yes | 5 | 0 | 99.1 | GEDSDVLVTRE | 46.15 | GENSDVLVTRE | 42.53 | GEKSDVLVTRE | 9.05 | GENSGVLVTRE | 0.45 |
| NA | N9 | 112 | 0.52 | yes | 2 | 0 | 99.1 | DSDVLVTREPY | 90.05 | DSDILVTREPY | 42.99 | DSDVLVTRESY | 9.05 | KSDVLVTREPY | 0.45 |
| NA | N9 | 113 | 0.48 | yes | 2 | 0 | 99.1 | SDVLVTREPYY | 90.05 | SDILVTREPYY | 9.05 | | | | |
| NA | N9 | 114 | 0.17 | yes | 2 | 0 | 99.1 | DVLVTREPYYS | 90.5 | DILVTREPYYS | 9.05 | | | | |
| NA | N9 | 115 | 0.25 | yes | 3 | 0 | 99.55 | VLVTREPYYSC | 97.74 | ILVTREPYYSC | 1.81 | | | | |
| NA | N9 | 116 | 0.17 | yes | 2 | 0 | 99.55 | LVTREPYYSCD | 97.74 | VTREPYYSCEP | 1.81 | | | | |
| NA | N9 | 117 | 0.25 | yes | 3 | 0 | 99.55 | VTREPYYSCDP | 97.74 | TREPYYSCEPD | 1.81 | TREPYYSCDPN | 0.9 | | |
| NA | N9 | 118 | 0.38 | yes | 4 | 0 | 99.55 | TREPYYSCDPD | 96.83 | REPYYSCEPDE | 1.81 | REPYYSCDPNE | 0.9 | | |
| NA | N9 | 119 | 0.38 | yes | 4 | 0 | 99.55 | REPYYSCDPDG | 95.02 | EPYYSCEPDEC | 1.81 | EPYYSCDPNEC | 0.9 | | |
| NA | N9 | 120 | 0.42 | yes | 4 | 0 | 94.57 | EPYYSCDPDGC | 95.02 | PYYSCEPDECR | 1.81 | PYYSCDPNECR | 0.9 | | |
| NA | N9 | 121 | 0.38 | yes | 4 | 0 | 95.02 | PYYSCDPDGCR | 95.02 | YYSCEPDECRF | 1.81 | YYSCDPNECRF | 0.9 | | |
| NA | N9 | 122 | 0.38 | yes | 4 | 0 | 95.02 | YYSCDPDECRF | 95.02 | YSCEPDECRFY | 1.81 | YSCDPNECRFY | 0.9 | | |
| NA | N9 | 123 | 0.38 | yes | 4 | 0 | 95.02 | YSCDPDECRFY | 95.02 | SCEPDECRFYA | 1.81 | SCDPNECRFYA | 0.9 | | |
| NA | N9 | 124 | 0.38 | yes | 4 | 0 | 95.02 | SCDPDECRFYA | 95.02 | CEPDECRFYAL | 1.81 | CDPNECRFYAL | 0.9 | | |
| NA | N9 | 125 | 0.38 | yes | 4 | 0 | 95.02 | CDPDECRFYAL | 95.02 | EPDECRFYALS | 1.81 | DPNECRFYALS | 0.9 | | |
| NA | N9 | 126 | 0.25 | yes | 3 | 0 | 96.83 | DPDECRFYALS | 95.02 | PDECRFYALSQ | 1.81 | | | | |
| NA | N9 | 127 | 0.17 | yes | 2 | 0 | 97.74 | PDECRFYALSQ | 96.83 | PNECRFYALSQ | 1.81 | | | | |
| NA | N9 | 128 | 0.17 | yes | 1 | 0 | 97.74 | DECRFYALSQG | 97.74 | NECRFYALSQG | 1.81 | | | | |
| NA | N9 | 129 | 0.04 | yes | 1 | 0 | 99.55 | ECRFYALSQGT | 99.55 | | | | | | |
| NA | N9 | 130 | 0.08 | yes | 1 | 0 | 99.55 | CRFYALSQGTT | 99.55 | | | | | | |
| NA | N9 | 131 | 0.04 | yes | 1 | 0 | 99.55 | RFYALSQGTTI | 99.55 | | | | | | |
| NA | N9 | 132 | 0.04 | yes | 2 | 0 | 99.1 | FYALSQGTTIR | 99.1 | | | | | | |
| NA | N9 | 133 | 0.29 | yes | 2 | 0 | 99.55 | YALSQGTTIRG | 95.48 | ALSQGTTIRGR | 4.07 | | | | |
| NA | N9 | 134 | 0.29 | yes | 2 | 0 | 99.55 | ALSQGTTIRGK | 95.48 | LSQGTTIRGRH | 4.07 | | | | |
| NA | N9 | 135 | 0.29 | yes | 2 | 0 | 99.55 | LSQGTTIRGKH | 95.48 | SQGTTIRGRHS | 4.07 | | | | |
| NA | N9 | 136 | 0.29 | yes | 2 | 0 | 99.55 | SQGTTIRGKHS | 95.48 | | | | | | |

Fig. 75-40

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 137 | 0.29 | yes | 2 | 0 | 99.55 | QGTTIRGKHSN | 95.48 | | | | | | |
| NA | N9 | 138 | 0.29 | yes | 2 | 0 | 99.55 | GTTIRGKHSNG | 95.48 | | | | | | |
| NA | N9 | 139 | 0.29 | yes | 2 | 0 | 99.55 | TTIRGKHSNGT | 95.48 | | | | | | |
| NA | N9 | 140 | 0.29 | yes | 2 | 0 | 99.55 | TIRGKHSNGTI | 95.48 | | | | | | |
| NA | N9 | 141 | 0.25 | yes | 2 | 0 | 99.55 | IRGKHSNGTIH | 95.93 | | | | | | |
| NA | N9 | 142 | 0.25 | yes | 2 | 0 | 99.55 | RGKHSNGTIHD | 95.93 | | | | | | |
| NA | N9 | 143 | 0.25 | yes | 2 | 0 | 99.55 | GKHSNGTIHDR | 95.93 | | | | | | |
| NA | N9 | 144 | 0 | yes | 1 | 0 | 100 | KHSNGTIHDRS | 100 | | | | | | |
| NA | N9 | 145 | 0 | yes | 1 | 0 | 100 | HSNGTIHDRSQ | 100 | | | | | | |
| NA | N9 | 146 | 0 | yes | 1 | 0 | 100 | SNGTIHDRSQY | 100 | | | | | | |
| NA | N9 | 147 | 0 | yes | 1 | 0 | 100 | NGTIHDRSQYR | 100 | | | | | | |
| NA | N9 | 148 | 0.65 | yes | 2 | 0 | 99.1 | GTIHDRSQYRA | 85.52 | GTIHDRSQYRS | 13.57 | | | | |
| NA | N9 | 149 | 0.65 | yes | 2 | 0 | 99.1 | TIHDRSQYRAL | 85.52 | TIHDRSQYRSL | 13.57 | | | | |
| NA | N9 | 150 | 0.95 | yes | 3 | 0 | 99.1 | IHDRSQYRALI | 80.09 | HDRSQYRSLI | 13.57 | HDRSQYRALV | | | |
| NA | N9 | 151 | 0.95 | yes | 3 | 0 | 99.1 | HDRSQYRALIS | 80.09 | HDRSQYRSLIS | 13.57 | HDRSQYRALVS | | | |
| NA | N9 | 152 | 0.95 | yes | 3 | 0 | 99.1 | DRSQYRALISW | 80.09 | DRSQYRSLISW | 13.57 | DRSQYRALVSW | | | |
| NA | N9 | 153 | 0.95 | yes | 3 | 0 | 99.1 | RSQYRALISWP | 80.09 | RSQYRSLISWP | 13.57 | RSQYRALVSWP | | | |
| NA | N9 | 154 | 1.05 | yes | 4 | 0 | 99.1 | SQYRALISWPL | 78.73 | SQYRSLISWPL | 13.57 | SQYRALVSWPL | 5.43 | SQYRALISWPQ | 5.43 |
| NA | N9 | 155 | 1.05 | yes | 4 | 0 | 99.1 | QYRALISWPLS | 78.73 | QYRSLISWPLS | 13.57 | QYRALVSWPLS | 5.43 | QYRALISWPQS | 5.43 |
| NA | N9 | 156 | 1.05 | yes | 4 | 0 | 99.1 | YRALISWPLSS | 78.73 | YRSLISWPLSS | 13.57 | YRALVSWPLSS | 5.43 | YRALISWPQSS | 5.43 |
| NA | N9 | 157 | 1.05 | yes | 4 | 0 | 99.1 | RALISWPLSSP | 78.73 | RSLISWPLSSP | 13.57 | RALVSWPLSSP | 5.43 | RALISWPQSSP | 5.43 |
| NA | N9 | 158 | 1.05 | yes | 4 | 0 | 99.1 | ALISWPLSSPP | 78.73 | SLISWPLSSPP | 13.57 | ALVSWPLSSPP | 5.43 | ALISWPQSSPP | 5.43 |
| NA | N9 | 159 | 0.41 | yes | 3 | 0 | 99.1 | LISWPLSSPPT | 93.21 | LVSWPLSSPPT | 5.43 | ISWPQSSPPT | 1.36 | | |
| NA | N9 | 160 | 0.41 | yes | 3 | 0 | 99.1 | ISWPLSSPPTV | 93.21 | VSWPLSSPPTV | 5.43 | SWPQSSPPTV | 1.36 | | |
| NA | N9 | 161 | 0.18 | yes | 2 | 0 | 100 | SWPLSSPPTVY | 98.64 | | | | | | |
| NA | N9 | 162 | 0.74 | yes | 3 | 0 | 99.1 | WPLSSPPTVYN | 97.74 | WPQSSPPTVYN | 1.36 | | | | |
| NA | N9 | 163 | 0.39 | yes | 2 | 0 | 100 | PLSSPPTVYNT | 87.78 | PLSSPPTVYNS | 5.88 | PQSSPPTVYNS | 4.07 | | |
| NA | N9 | 174 | 0.27 | yes | 2 | 0 | 99.1 | RVECIGWSSTS | 94.57 | RIECIGWSSTS | 3.17 | | | | |
| NA | N9 | 175 | 0.04 | yes | 2 | 0 | 99.55 | VECIGWSSTSC | 95.93 | IECIGWSSTSC | 3.62 | | | | |
| NA | N9 | 176 | 0.04 | yes | 1 | 0 | 99.55 | ECIGWSSTSCH | 99.55 | | | | | | |
| NA | N9 | 177 | — | yes | 1 | 0 | 99.55 | CIGWSSTSCHD | 99.55 | | | | | | |
| NA | N9 | 178 | — | yes | 1 | 0 | 99.55 | IGWSSTSCHDG | 99.55 | | | | | | |
| NA | N9 | 179 | 0.98 | yes | 2 | 0 | 99.55 | GWSSTSCHDGK | 64.25 | WSSTSCHDGKA | 14.5 | WSSTSCHDGKF | 14.5 | WSSTSCHDGKT | 0.9 |
| NA | N9 | 180 | 1.45 | yes | 5 | 0 | 99.55 | WSSTSCHDGKS | 35.29 | SSTSCHDGKAR | 18.55 | SSTSCHDGKFR | 14.5 | SSTSCHDGKTR | 0.9 |
| NA | N9 | 181 | 1.45 | yes | 5 | 0 | 99.55 | SSTSCHDGKSR | 18.55 | STSCHDGKARM | 18.55 | STSCHDGKFRM | 14.5 | STSCHDGKTRM | 0.9 |
| NA | N9 | 182 | 1.45 | yes | 5 | 0 | 99.55 | STSCHDGKSRM | 18.55 | TSCHDGKARMS | 18.55 | TSCHDGKFRMS | 14.5 | TSCHDGKTRMS | 0.9 |
| NA | N9 | 183 | 1.45 | yes | 5 | 0 | 99.55 | TSCHDGKSRMS | 18.55 | TSCHDGRARMS | 13.12 | TSCHDGKFRMS | 1.36 | | |
| NA | N9 | 191 | 0.66 | yes | 3 | 0 | 100 | RMSICISGPNN | 85.52 | RMSVCISGPNN | 13.12 | | | | |
| NA | N9 | 192 | 0.66 | yes | 3 | 0 | 100 | MSICISGPNNN | 85.52 | MSVCISGPNNN | 13.12 | | | | |
| NA | N9 | 193 | 0.66 | yes | 3 | 0 | 100 | SICISGPNNNA | 85.52 | SVCISGPNNNA | 13.12 | | | | |

Fig. 75-41

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 194 | 0.66 | yes | 3 | 0 | 100 | ICISGPNNNAS | 85.52 | ICVSGPNNNAS

Fig. 75-42

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 245 | 0.7 | yes | 2 | 0 | 99.55 | DGSATGPAETR | 82.35 | DGSATGPADTR | 17.19 | | | | |
| NA | N9 | 246 | 1.62 | yes | 4 | 0 | 99.55 | GSATGPAETRV | 54.75 | GSATGPADTRI | 27.6 | GSATGPADTRV | 10.9 | | |
| NA | N9 | 247 | 1.62 | yes | 4 | 0 | 99.55 | SATGPAETRVY | 54.75 | SATGPADTRIY | 27.6 | SATGPADTRVY | 10.9 | | |
| NA | N9 | 248 | 1.62 | yes | 4 | 0 | 99.55 | ATGPAETRVYY | 54.75 | ATGPADTRIYY | 27.6 | ATGPADTRVYY | 10.9 | | |
| NA | N9 | 249 | 1.65 | yes | 4 | 0 | 99.55 | TGPAETRVYYF | 54.75 | TGPADTRIYYF | 27.6 | TGPADTRVYYF | 10.4 | | |
| NA | N9 | 269 | 0.74 | yes | 3 | 0 | 99.1 | LGTAKHIEEC | 84.16 | LAGTAKHIEEC | 14.03 | | 0.9 | | |
| NA | N9 | 270 | 0.74 | yes | 3 | 0 | 99.1 | TGTAKHIEECS | 84.16 | AGTAKHIEECS | 14.03 | | 0.9 | | |
| NA | N9 | 271 | 0.13 | yes | 2 | 0 | 99.1 | GTAKHIEECSC | 98.64 | NGTAKHIEECS | 0.45 | | | | |
| NA | N9 | 272 | 0.13 | yes | 2 | 0 | 99.1 | TAKHIEECSCY | 98.64 | GTATHIEECSC | 0.45 | | | | |
| NA | N9 | 273 | 0.13 | yes | 2 | 0 | 99.1 | AKHIEECSCYG | 98.64 | TAKHIEECSSY | 0.45 | | | | |
| NA | N9 | 274 | 1.16 | yes | 4 | 0 | 99.1 | KHIEECSCYGE | 74.21 | ARHIEECSCYG | 0.45 | | | | |
| NA | N9 | 275 | 0.49 | yes | 3 | 0 | 99.1 | ICTCRDNWQG | 92.31 | KHIEECSCYGK | 14.93 | KHIEECSCYGD | 9.5 | RHIEECSCYGD | |
| NA | N9 | 289 | 0.31 | yes | 2 | 0 | 99.55 | CTCRDNWQGS | 95.48 | VTCTCRDNWQG | 3.62 | | 3.62 | | |
| NA | N9 | 290 | 0.08 | yes | 1 | 0 | 99.1 | TCRDNWQGSN | 99.1 | ICTCRDNWQGS | 3.62 | | | | |
| NA | N9 | 291 | 0.08 | yes | 1 | 0 | 99.1 | CRDNWQGSNR | 99.1 | | | | | | |
| NA | N9 | 292 | 0.08 | yes | 1 | 0 | 99.1 | RDNWQGSNRP | 99.1 | | | | | | |
| NA | N9 | 293 | 0.08 | yes | 1 | 0 | 99.1 | DNWQGSNRPV | 99.1 | | | | | | |
| NA | N9 | 294 | 0.39 | yes | 3 | 0 | 99.1 | NWQGSNRPVI | 93.67 | NWQGSNRPVIR | 5.43 | | 5.43 | | |
| NA | N9 | 295 | 0.39 | yes | 3 | 0 | 99.1 | WQGSNRPVIQ | 93.67 | WQGSNRPVIRI | 5.43 | | 5.43 | | |
| NA | N9 | 296 | 0.75 | yes | 3 | 0 | 99.1 | QGSNRPVIQI | 86.43 | QGSNRPVIQID | 7.24 | OGSNRPVIRID | 5.43 | | |
| NA | N9 | 297 | 0.75 | yes | 3 | 0 | 99.1 | GSNRPVIQIDP | 86.43 | GSNRPVIQINP | 7.24 | GSNRPVIRIDP | 5.43 | | |
| NA | N9 | 298 | 1.12 | yes | 5 | 0 | 80.09 | AMTHTSQYICS | 8.6 | MMTHTSQYICS | 4.98 | | | | |
| NA | N9 | 299 | 0.19 | yes | 2 | 0 | 97.74 | MTHTSQYICSP | 97.74 | MKHTSQYICSP | 1.36 | | 1.36 | AMKHTSQYICS | 4.07 |
| NA | N9 | 311 | 0.23 | yes | 3 | 0 | 97.29 | HTSQYICSPV | 97.29 | KHTSQYICSPV | 1.36 | THTSQYICSPI | 0.45 | TMTHTSQYICS | 4.98 |
| NA | N9 | 312 | 0.08 | yes | 1 | 0 | 99.1 | TSQYICSPVL | 99.1 | | | THTSQYICSPI | | | |
| NA | N9 | 313 | 0.08 | yes | 1 | 0 | 99.1 | SQYICSPVLT | 99.1 | | | | | | |
| NA | N9 | 314 | 0.08 | yes | 1 | 0 | 99.1 | QYICSPVLTD | 99.1 | | | | | | |
| NA | N9 | 315 | 0.08 | yes | 1 | 0 | 99.1 | YICSPVLTDN | 99.1 | | | | | | |
| NA | N9 | 316 | 0.08 | yes | 1 | 0 | 99.1 | ICSPVLTDNP | 99.1 | | | | | | |
| NA | N9 | 317 | 0.08 | yes | 1 | 0 | 99.55 | CSPVLTDNPR | 99.55 | | | | | | |
| NA | N9 | 318 | 0.04 | yes | 1 | 0 | 99.55 | SPVLTDNPRP | 99.55 | | | | | | |
| NA | N9 | 319 | 0.04 | yes | 1 | 0 | 99.55 | PVLTDNPRPN | 99.55 | | | | | | |
| NA | N9 | 320 | 0.08 | yes | 1 | 0 | 99.1 | VLTDNPRPND | 99.1 | | | | | | |
| NA | N9 | 321 | 1.85 | yes | 5 | 0 | 99.1 | LTDNPRPNDPA | 40.72 | LTDNPRPNDPT | 33.03 | LTDNPRPNDPN | 19.9 | LTDNPRPNDPV | LTDNPRPNDPS 4.52 |
| NA | N9 | 322 | 0.7 | yes | 3 | 0 | 99.1 | TDNPRPNDPA | 85.52 | IGKCNDPYPGN | 12.67 | VGKCNEPYPGN | 0.9 | | 0.9 |
| NA | N9 | 335 | 0.19 | yes | 2 | 0 | 99.1 | GKCNDPYPGN | 97.74 | GKCNEPYPGNN | 1.36 | | 0.45 | | |
| NA | N9 | 336 | 0.23 | yes | 3 | 0 | 99.1 | KCNDPYPGNN | 97.29 | KCNEPYPGNNN | 1.36 | IKCNDPYPGNN | 0.45 | | |
| NA | N9 | 337 | 0.23 | yes | 3 | 0 | 99.1 | CNDPYPGNNN | 97.29 | CNEPYPGNNNN | 1.36 | CNDPYPGNNNK | 0.45 | CNDPYPGNNNG 0.45 | |
| NA | N9 | 338 | 0.31 | yes | 5 | 0 | 96.38 | CNDPYPGNNNN | 96.38 | CNEPYPGNNBN | 1.36 | CNDPYPGNNNK | 0.45 | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | N9 | 403 | 0.66 | yes | 3 | 0 | 100 | WSGYSGSFMDY | 87.33 | WSGYSGSFVDY | 9.05 | | | | |
| NA | N9 | 404 | 0.66 | yes | 3 | 0 | 100 | SGYSGSFMDYW | 87.33 | SGYSGSFVDYW | 9.05 | | | | |
| NA | N9 | 405 | 0.66 | yes | 3 | 0 | 100 | GYSGSFMDYWA | 87.33 | GYSGSFVDYWA | 9.05 | | | | |
| NA | N9 | 406 | 0.79 | yes | 4 | 0 | 100 | YSGSFMDYWAE | 86.88 | YSGSFVDYWAE | 5.43 | | | | |
| NA | N9 | 407 | 0.87 | yes | 5 | 0.45 | 99.55 | SGSFMDYWAEG | 86.43 | SGSFIDYWAEG | 4.07 | SGSFIDYWAKE | 3.62 | SGSFIDYWAKE | 3.62 |
| NA | N9 | 412 | 1.21 | yes | 5 | 0.45 | 99.09 | DYWAEGECYRA | 71.36 | DYWAEG

Fig. 75-45

| Protein | Sub-type | Start Pos | Block Entropy | Gaps <10% | # to cover 99% | Gap % | coverage | Peptides included | Freq | Peptides included | Freq | Peptides included | Freq | Peptides included | Freq |
|---|---|---|---|---|---|---|---|---|---|---|---|---|---|---|---|
| NA | N9 | 447 | 0.08 | yes | 1 | 0.9 | 99.09 | SMCSSTEFLGQ | 99.09 | | | | | | |
| NA | N9 | 448 | 0.09 | yes | 1 | 2.71 | 99.07 | MCSSTEFLGQW | 99.07 | | | | | | |
| NA | N9 | 449 | 0.36 | yes | 2 | 2.71 | 99.07 | CSSTEFLGQWN | 99.07 | CSSTEFLGQWD | 4.65 | | | | |
| NA | N9 | 450 | 0.36 | yes | 2 | 3.17 | 99.07 | SSTEFLGQWNW | 99.07 | SSTEFLGQWDW | 4.67 | | | | |
| NA | N9 | 451 | 0.36 | yes | 2 | 3.17 | 99.07 | STEFLGQWNWP | 99.07 | STEFLGQWDWP | 4.67 | | | | |
| NA | N9 | 452 | 0.38 | yes | 2 | 3.17 | 99.07 | TEFLGQWNWPD | 99.07 | TEFLGQWDWPD | 5.14 | | | | |
| NA | N9 | 453 | 0.33 | yes | 2 | 3.17 | 99.53 | EFLGQWNWPDG | 99.07 | EFLGQWDWPDG | 5.14 | | | | |
| NA | N9 | 454 | 0.29 | no | 3 | 4.07 | 100 | FLGQWNWPDGA | 94.81 | FLGQWDWPDGA | 5.19 | LGQWNWPDGAE | 5.24 | | |
| NA | N9 | 455 | 0.46 | no | 3 | 4.98 | 100 | LGQWNWPDGAK | 92.38 | LGQWDWPDGAK | 3.54 | GQWNWPDGAEI | 5.24 | | |
| NA | N9 | 456 | 0.39 | no | 3 | 10.41 | 100 | GQWNWPDGAKI | 93.94 | GQWDWPDGAKI | 3.09 | QWNWPDGAEIE | 3.54 | | |
| NA | N9 | 457 | 0.42 | no | 4 | 12.22 | 99.48 | QWNWPDGAKIE | 93.81 | QWDWPDGAKIE | 3.11 | WNWPDGAEIEY | 3.14 | WNWPDGAKIETL | 0.52 |
| NA | N9 | 458 | 0.46 | no | 4 | 12.67 | 99.48 | WNWPDGAKIEY | 93.26 | WDWPDGAKIEY | 3.14 | NWPDGAEIEYF | 2.63 | DWPDGAKIIKYF | 0.52 |
| NA | N9 | 459 | 0.52 | no | 4 | 13.57 | 99.47 | NWPDGAKIEYF | 92.67 | DWPDGAKIEYF | 3.24 | WPDGAEIEYFL | 3.24 | NWPDGAKIETL | 0.52 |
| NA | N9 | 460 | 0.27 | yes | 3 | 14.03 | 99.19 | WPDGAKIEYFL | 96.32 | WPDGAEIEYFL | | GLDRICLGHHA | | | |
| HA | H10 | 16 | 0.49 | yes | 3 | 0 | 99.6 | GLDKICLGHHA | 93.12 | GIDKICLGHHA | 3.24 | SLDKICLGHHA | 1.21 | | |
| HA | H10 | 17 | 0.36 | yes | 3 | 0 | 99.6 | LDKICLGHHAV | 94.74 | IDKICLGHHAV | 3.24 | | | | |
| HA | H10 | 18 | 1.71 | yes | 5 | 0 | 99.6 | DKICLGHHAVS | 43.32 | DKICLGHHAY | 32.79 | DRICLGHHAV | 2.11 | DKICLGHHAVT | 0.81 |
| HA | H10 | 19 | 1.71 | yes | 5 | 0 | 99.6 | KICLGHHAVSN | 43.32 | KICLGHHAVP | 32.79 | RICLGHHAVA | 2.11 | KICLGHHAVTN | 0.81 |
| HA | H10 | 20 | 1.62 | yes | 4 | 0 | 99.6 | ICLGHHAVSNG | 43.32 | ICLGHHAVPN | 32.79 | ICLGHHAVAN | 22.7 | | |
| HA | H10 | 21 | 1.62 | yes | 4 | 0 | 99.6 | CLGHHAVSNGT | 43.32 | CLGHHAVPNG | 32.79 | CLGHHAVTNG | 22.7 | | |
| HA | H10 | 40 | — | yes | 3 | 0 | 74.9 | KEEVTNATETV | 22.27 | QEEVTNATETV | 1.21 | KEKVTNATETV | | MEEVTNATETV | 0.4 |
| HA | H10 | 41 | 0.08 | yes | 2 | 0 | 99.19 | EEVTNATETVE | 96.36 | EVTNATETVEN | 2.43 | EVTNATETVET | 0.4 | | |
| HA | H10 | 42 | 0.28 | yes | 3 | 0 | 96.76 | EVTNATETVES | 96.76 | NEGALRQKIME | 1.62 | SEEALRQKIME | 0.81 | | |
| HA | H10 | 111 | 0.2 | yes | 2 | 0.81 | 97.57 | NEEALRQKIME | 97.57 | EGALRQKIMES | 1.62 | | | | |
| HA | H10 | 112 | 0.11 | yes | 2 | 0.81 | 97.57 | EEALRQKIMES | 97.57 | GALRQKIMESG | 1.62 | | | | |
| HA | H10 | 113 | 0.18 | yes | 2 | 0.81 | 98.79 | EALRQKIMESG | 98.79 | ALRQKIMESGE | 0.4 | LRQKMESGGI | 0.81 | | |
| HA | H10 | 114 | 0.52 | yes | 3 | 0.81 | 97.98 | ALRQKIMESGG | 97.98 | LRQKIMESGGV | 0.81 | | | | |
| HA | H10 | 115 | 0.45 | yes | 3 | 0.4 | 99.59 | LRQKIMESGGI | 92.65 | ONFPQTANTYR | 3.67 | ONFPRTNTYR | 1.22 | RNFPQTTNTYR | 0.82 |
| HA | H10 | 169 | 0.36 | yes | 3 | 0.4 | 99.59 | NFPQTTNTYRN | 93.47 | NFPQTANTYRN | 3.67 | SFPQTNTYRN | 1.22 | | |
| HA | H10 | 170 | 0.55 | yes | 3 | 0.4 | 99.59 | FPQTTNTYRNT | 94.69 | FPQTANTYRNT | 3.67 | FPRTNTYRNT | 1.22 | | |
| HA | H10 | 171 | 1.19 | yes | 3 | 0.4 | 99.59 | PQTTNTYRNTD | 70.61 | PQTANTYRNTD | 23.27 | PRTNTYRNTD | 1.22 | | |
| HA | H10 | 172 | 0.41 | yes | 5 | 0.4 | 99.19 | QTTNTYRNTDS | 94.72 | QTANTYRNTDT | 2.03 | QTNTYRNTDS | 3.67 | QTTNTYRNTDP | 1.22 |
| HA | H10 | 173 | 0.55 | yes | 4 | 0.4 | 99.19 | YGTQSLSISIV | 92.68 | YGTQSLSISIG | 2.03 | YGTQPLSISV | 1.22 | YGAQSLSISVG | 1.22 |
| HA | H10 | 204 | 0.55 | yes | 5 | 0.4 | 99.19 | YGTQSLSISVG | 92.68 | YGTQSLSISIG | 2.03 | YGTQPLSISVG | 2.03 | GAQSLSISVGS | 1.22 |
| HA | H10 | 205 | 0.55 | yes | 5 | 0.4 | 99.19 | GTQSLSISVGS | 92.68 | GTQSLSISVES | 2.03 | GTQPLSISVGS | 2.03 | AQSLSISVGSS | 1.22 |
| HA | H10 | 206 | 0.49 | yes | 5 | 0.4 | 99.19 | TQSLSISVGSS | 93.5 | TQSLSISVGSS | 2.03 | TQPLSISVGSS | 2.03 | ESLSISVGSST | 1.22 |
| HA | H10 | 207 | 0.46 | yes | 5 | 0.4 | 99.19 | QSLSISVGSST | 93.9 | QSLSISVESST | 2.03 | QPLSISVGSST | 2.03 | | |
| HA | H10 | 208 | 0.4 | yes | 4 | 0 | 99.19 | SLSISVGSSTY | 94.74 | SLSISIGSSTY | 2.02 | PLSISVGSSTY | 2.03 | | |
| HA | H10 | 209 | | yes | 4 | | | LSISVGSSTYQ | | LSISIGSSTYQ | 2.02 | LSISVGSSIYQ | | | |
| HA | H10 | 210 | | yes | 4 | | | | | | | | | | |

Fig. 75-46

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 211 | 0.44 | yes | 5 | 0 | 99.19

Fig. 75-47

| Protein | Sub-type | Start Pos | Block Entropy | Gaps < 10% | # to cover 99% | Gap % | Coverage | Peptides included | Peptides included | Freq | Peptides included | Freq | Peptides included | Freq | Peptides included | Freq | Peptides included | Freq |
|---|---|---|---|---|---|---|---|---|---|---|---|---|---|---|---|---|---|---|
| HA | H10 | 322 | 1.61 | yes | 5 | 0 | 99.6 | KSLLLATGMRN | KSLLLATGMRN | 61.94 | KSLMLATGMRN | 16.6 | RSLMLATGMRN | 11.7 | RSLMLATGMRN | | GSLLLATGMRN | | | 0.81 |
| HA | H10 | 323 | 0

Fig. 75-48

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 373 | 0.35 | yes | 4 | 0.4 | 99.19 | GQAADYKSTQ

Fig. 75-49

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 421 | 0.07 | yes | 1 | 0 | 99.19 | INWTKD

Fig. 75-50

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10 | 461 | 0.08 | yes | 1 | 0 | 99.19 | RVKKQLRQNAE | 99.19 | | | | | | |

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 113 | 0.1 | yes | 2 | 0 | 100 | EALRQKIMESG | 98.7 | GALRQKIMESG | 1.3 | | | | |

Fig. 75-53

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 208 | 0.46 | yes | 4 | 0 | 99.35 | QSLSISVGSST | 93.51 | QSLSISIGSST | 3.25 | | | | |

Fig. 75-54

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 259 | 0.32 | yes | 3 | 0.65 | 99.35 | GGLIAPSRVSK | 95.42 | GGLIAPSRVTK | 3.27 | GGLI

Fig. 75-55

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 346 | 0.11 | yes | 2 | 0 | 99.35 | IAGFIENGWEG | 98.7 | KAGFIENGWEG | 0.65 | | | | |
| HA | H10N7 | 347 | 0.06 | yes | 1 | 0 | 99.35

Fig. 75-56

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 386 | 0.16 | yes | 2 | 0 | 99.35 | DQITGKLNRLI | 98.05 | DQVTGKLNRLI | 1.3

Fig. 75-57

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 426 | 0.06 | yes | 1 | 0 | 99.35 | DSITDIWTYQA | 99.35 | | | | | | |
| HA | H10N7 | 427 | 0.06 | yes | 1 | 0 | 99.35 | SIT

Fig. 75-58

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H10N7 | 466 | 0.1 | yes | 2 | 0 | 100 | LRQNAEEDGKG | 98.7 | LRQNAEEDGRG | 1

Fig. 75-59

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N7 | 518 | 0.52 | yes | 2 | 0 | 99.35 | LSSGYKDVILW | 89.61 | LSSGYK

Fig. 75-60

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 39 | 2.06 | no | 5 | 94 | 100 | EKGTKQEENLT | 44.44 | EKGAMQEENLT | 22.22 | EKGTKQEENLT | 11.1 | EKGPKQEENST | 11.11 |
| NA | H10N7 | 54 | 0.57 | yes | 5 | 0.67 | 99.33 | TQNNTTLIENT | 91.95 | TQNNTTWENT | 3.36 | NQNNTTWENT | 2.01 | NQNNTTWENK | 0.67 |
| NA | H10N7 | 55 | 0.42 | yes | 3 | 2 | 99.32 | QNNTTLIENTY | 93.2 | QNNTTWENTY | 5.44 | QNTNTTLIENTY | 0.68 | | |
| NA | H10N7 | 56 | 0.42 | yes | 3 | 2 | 99.32 | NNTTLIENTYV | 93.2 | NNTTWENTYV | 5.44 | TNTTLIENTYV | 0.68 | | |
| NA | H10N7 | 57 | 0.36 | yes | 2 | 2 | 99.32 | NTTLIENTYVN | 93.88 | NTTWENTYVN | 5.44 | | | | |
| NA | H10N7 | 58 | 0.42 | yes | 3 | 2 | 99.32 | TTLIENTYVNN | 93.2 | TTWENTYVNN | 5.44 | TLIENTYVNK | 0.68 | | |
| NA | H10N7 | 59 | 0.42 | yes | 3 | 2 | 99.32 | TLIENTYVNNT | 93.2 | TWENTYVNNT | 5.44 | TWENKYVNNT | 0.68 | | |
| NA | H10N7 | 60 | 0.42 | yes | 3 | 2 | 99.32 | LIENTYVNNTT | 93.2 | WENTYVNNTT | 5.44 | WENKYVNNT | 0.68 | | |
| NA | H10N7 | 61 | 0.48 | yes | 4 | 2 | 99.32 | IENTYVNNTTV | 92.52 | VENTYVNNTT | 5.44 | IENTYVNNTTI | 0.68 | | |
| NA | H10N7 | 62 | 0.45 | yes | 3 | 2 | 99.32 | ENTYVNNTTVI | 92.52 | ENTYVNNTTI | 6.12 | ENTYVNNTI | 0.68 | | |
| NA | H10N7 | 83 | 0.86 | yes | 5 | 0 | 99.32 | YLMNKSLCKV | 86 | YLNKSLCKV | 6 | YLLNKSLCSV | 3.33 | YLMLSKSLCKV | 2.67 |
| NA | H10N7 | 84 | 0.86 | yes | 5 | 0 | 99.32 | LMLNKSLCKVE | 86 | LNKSLCNVE | 6 | LLNKSLCNE | 3.33 | LMLSKSLCKVE | 2.67 |
| NA | H10N7 | 85 | 0.6 | yes | 4 | 0 | 99.32 | LNKSLCKVEGW | 91.33 | LNKSLCNVEGW | 3.36 | LNKSLCSVEGW | 2.67 | LNKSLCKVEEW | 1.33 |
| NA | H10N7 | 86 | 0.6 | yes | 4 | 0 | 99.32 | NKSLCVEGWW | 91.33 | NKSLCNVEGWV | 3.36 | SKSLCKVEGWV | 2.67 | NKRLCKVEGWV | 0.67 |
| NA | H10N7 | 87 | 0.5 | yes | 3 | 0 | 99.32 | KSLCKVEGWWV | 92.67 | KSLCNVEGWVV | 3.36 | KSLCKVEEWVV | 2.67 | | 0.67 |
| NA | H10N7 | 88 | 0.5 | yes | 3 | 0 | 99.32 | SLCVEGWVVV | 92.67 | SLCNVEGWVVI | 3.36 | SLCKVEEWVVV | 2.67 | | |
| NA | H10N7 | 89 | 0.44 | yes | 3 | 0 | 99.32 | LCVEGWVVVA | 93.33 | LCNVEGWVVIA | 3.33 | LCSVEGWVVIA | 2.67 | | |
| NA | H10N7 | 90 | 0.44 | yes | 3 | 0 | 99.33 | CKVEGWVVIAK | 93.33 | CNVEGWVVIAK | 3.33 | CSVEGWVVIA | 2.67 | | |
| NA | H10N7 | 91 | 0.44 | yes | 3 | 0 | 99.33 | KVEGWVVIAKD | 93.33 | KVEGWVVIAKD | 3.33 | SVEGWVVIAKD | 2.67 | | |
| NA | H10N7 | 92 | 0.38 | yes | 2 | 0 | 99.33 | VEGWVVIAKDN | 93.33 | VEGWVVIAKDNA | 3.33 | | | | |
| NA | H10N7 | 93 | 0.38 | yes | 2 | 0 | 99.33 | EGWVVIAKDNA | 93.33 | EGWVVIAKDNAI | 3.33 | | | | |
| NA | H10N7 | 94 | 0.38 | yes | 2 | 0 | 99.33 | GWVVIAKDNAI | 93.33 | GWVVIAKDNAI | 3.33 | | | | |
| NA | H10N7 | 95 | 0.39 | yes | 3 | 0 | 100 | WVVAKDNAIR | 94 | WVVIAKDNAIR | 3.36 | NAIRFGEGEQI | 2.67 | | |
| NA | H10N7 | 96 | 0.39 | yes | 3 | 0.67 | 100 | VVAKDNAIRF | 93.96 | VVIAKDNAIR | 3.36 | AIRFGEGEQII | 2.68 | | |
| NA | H10N7 | 97 | 0.39 | yes | 3 | 0.67 | 100 | VAKDNAIRFG | 93.96 | VIAKDNAIRF | 3.36 | IRFGEGEQIIV | 2.68 | | |
| NA | H10N7 | 98 | 0.39 | yes | 3 | 0.67 | 100 | VAKDNAIRFGE | 93.96 | IAKDNAIRFG | 3.36 | | 2.68 | | |
| NA | H10N7 | 99 | 0.31 | yes | 2 | 0.67 | 100 | AKDNAIRFGES | 95.3 | AKDNAIRFGE | 3.36 | | | | |
| NA | H10N7 | 100 | 0.31 | yes | 2 | 0.67 | 100 | KDNAIRFGESE | 95.3 | KDNAIRFGESE | 3.36 | | | | |
| NA | H10N7 | 101 | 0.31 | yes | 2 | 0.67 | 100 | DNAIRFGESEQ | 95.3 | DNAIRFGESEQ | 3.36 | | | | |
| NA | H10N7 | 102 | 0.52 | yes | 4 | 0.67 | 100 | NAIRFGESEQI | 91.95 | NAVRFGESEQI | 3.36 | NAIRFGEGEQI | 3.36 | NAIRFGEGEGE | 1.34 |
| NA | H10N7 | 103 | 0.52 | yes | 4 | 0.67 | 100 | AIRFGESEQII | 91.95 | AVRFGESEQII | 3.36 | AIRFGEGEQII | 3.36 | AIRFGEGEGEQ | 1.34 |
| NA | H10N7 | 104 | 0.52 | yes | 4 | 0.67 | 100 | IRFGESEQIIV | 91.95 | VRFGESEQIIV | 3.36 | IRFGEGEQIIV | 3.36 | IRFGEGEGEQII | 1.34 |
| NA | H10N7 | 105 | 0.31 | yes | 2 | 0.67 | 100 | RFGESEQIIVT | 95.3 | RFGESEQIIVT | 3.36 | | | | |
| NA | H10N7 | 106 | 0.31 | yes | 2 | 0 | 99.33 | FGESEQIIVTR | 95.3 | FGESEQIIVTR | 3.36 | | | | |
| NA | H10N7 | 107 | 0.31 | yes | 2 | 0 | 99.33 | GESEQIIVTRE | 94.67 | GESEQIVTRE | 3.36 | | | | |
| NA | H10N7 | 108 | 0.37 | yes | 3 | 0 | 99.33 | ESEQIIVTREP | 94.67 | ESEQIVTREP | 3.36 | | | | |
| NA | H10N7 | 109 | 0.37 | yes | 3 | 0 | 99.33 | SEQIIVTREPY | 94.67 | SEQIVTREPY | 3.36 | | | | |
| NA | H10N7 | 110 | 0.27 | yes | 3 | 0 | 99.33 | EQIIVTREPYY | 96 | EQIVTREPYY | 3.33 | | | | |
| NA | H10N7 | 112 | 0.27 | yes | 3 | 0 | 99.33 | QIIVTREPYYS | 96 | QIVTREPYYS | 3.33 | | | | |
| NA | H10N7 | 113 | 0.27 | yes | 2 | 0 | 99.33 | IIVTREPYYSC | 96 | VIVTREPYYSC | 3.33 | | | | |

Fig. 75-61

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 114 | 0.06 | yes | 1 | 0 | 99.33 | IVTREPYVSCD | 99.33 | TREPYVSCD

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 239 | 0.79 | yes | 5 | 0 | 99.33 | VIMTDGPASSQ | 84 | VIMTDGPANSQ | 13.33 | VIMT

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 400 | 1.11 | yes | 5 | 0 | 99.33 | NNWSGYSGSFI | 66 | SNWSGYSGSFI | 31.33 | NK

Fig. 75-67

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H10N7 | 451 | 1.7 | yes | 4 | 2 | 99.32 | GSPISVGSGSF | 47.62 | GSPVSVGSGSF | 33.33 | GSPPVGSGSF | 12.9 | |

Fig. 75-68

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 61 | 1.33 | yes | 5 | 0 | 99.48 | DGKAPISLGDC | 63.21 | NGKQPISLGDC | 27.46 | NGKAPISLGDC | 7.77 | NGR

Fig. 75-69

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 314 | 0.34 | yes | 5 | 0 | 99.48 | TIGDCPKYVNV | 95.85 | TIGDCPKYVNI | 1.55 | AIGDCPKYVNV

Fig. 75-70

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1 | 370 | 0.49 | yes | 4 | 0 | 99.48 | NEEGTGIAADK

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 77 | 0.61 | yes | 5 | 0 | 100 | LILGNPKCDLY | 90.59 | LILGNPKCDLY | 4.71 | LILSNPKCDLY | 2.35 | LVLGNPKCDLY | 1.18 |
| HA | H12 | 78 | 0.46 | yes | 4 | 0 | 100 | ILGNPKCDLYL | 92.94 | ILGNPKCDLYL | 4

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 171 | 0.62 | yes | 2 | 0 | 100 | GQFPVQTDEYK | 84.71 | EQFPVQTDEYK | 15.29 | | | | |

Fig. 75-76

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 248 | 0.18 | yes | 3 | 0 | 100 | VLKPGQTVKIQ | 97.65 | VLKPGQTVKIK | 1.18 | | | | |
| HA | H12 | 249 | 0.09 | yes | 2 | 0 | 100 | LKPGQTVKIQT | 98.82 | KPGQTVKIKTN | 1.18 | | | | |
| HA | H12 | 250 | 0.18 | yes | 3 | 0 | 100 | KPGQTVKIQTN | 97.65 | PGQTVKIKTSG | 1.18 | | | | |
| HA | H12 | 251 | 0.18 | yes | 3 | 0 | 100 | PGQTVKIQTNG | 97.65 | GQTVKIKTNGN | 1.18 | | | | |
| HA | H12 | 252 | 0.18 | yes | 3 | 0 | 100 | GQTVKIQTNGN | 97.65 | QTVKIKTNGNL | 1.18 | | | | |
| HA | H12 | 253 | 0.18 | yes | 3 | 0 | 100 | QTVKIQTNGNL | 97.65 | TVKIKTNGNLI | 1.18 | | | | |
| HA | H12 | 254 | 0.18 | yes | 3 | 0 | 100 | TVKIQTNGNLI | 97.65 | VKIKTNGNLIA | 1.18 | | | | |
| HA | H12 | 255 | 0.18 | yes | 3 | 0 | 100 | VKIQTNGNLIA | 97.65 | KIQTSGNLIAP | 1.18 | | | | |
| HA | H12 | 256 | 0.18 | yes | 3 | 0 | 100 | KIQTNGNLIAP | 97.65 | IQTSGNLIAPE | 1.18 | | | | |
| HA | H12 | 257 | 0.18 | yes | 3 | 0 | 100 | IQTNGNLIAPE | 97.65 | QTSGNLIAPEY | 1.18 | | | | |
| HA | H12 | 258 | 0.18 | yes | 3 | 0 | 100 | QTNGNLIAPEY | 97.65 | TSGNLIAPEYG | 1.18 | | | | |
| HA | H12 | 259 | 0.09 | yes | 2 | 0 | 100 | TNGNLIAPEYG | 98.82 | SGNLIAPEYGH | 1.18 | | | | |
| HA | H12 | 260 | 0.18 | yes | 3 | 0 | 100 | NGNLIAPEYGH | 97.65 | NGNLIAPEYGY | 1.18 | | | | |
| HA | H12 | 261 | 0.09 | yes | 2 | 0 | 100 | GNLIAPEYGHL | 98.82 | | | | | | |
| HA | H12 | 262 | 0.18 | yes | 3 | 0 | 100 | NLIAPEYGHLI | 98.82 | NLIAPEYGHLT | 1.18 | | | | |
| HA | H12 | 263 | 0.34 | yes | 4 | 0 | 100 | LIAPEYGHLIT | 95.29 | LIAPEYGHLIT | 1.18 | | | | |
| HA | H12 | 264 | 0.34 | yes | 4 | 0 | 100 | IAPEYGHLITG | 95.29 | IAPEYGHLVTG | 1.18 | | | | |
| HA | H12 | 265 | 0.34 | yes | 4 | 0 | 100 | APEYGHLITGK | 95.29 | APEYGYLITGK | 1.18 | | | | |
| HA | H12 | 266 | 0.34 | yes | 4 | 0 | 100 | PEYGHLITGKS | 95.29 | PEYGYLITGKS | 1.18 | | | | |
| HA | H12 | 267 | 0.34 | yes | 4 | 0 | 100 | EYGHLITGKSH | 95.29 | EYGYLITGKSH | 1.18 | | | | |
| HA | H12 | 268 | 0.34 | yes | 4 | 0 | 100 | YGHLITGKSHG | 95.29 | YGYLITGKSHG | 1.18 | | | | |
| HA | H12 | 269 | 0.34 | yes | 4 | 0 | 100 | GHLITGKSHGR | 95.29 | GHLVTGKSHGR | 1.18 | | | | |
| HA | H12 | 270 | 0.5 | yes | 5 | 0 | 100 | HLITGKSHGRV | 92.94 | HLVTGKSHGRV | 2.35 | YLITGKSHGRI | 1.18 | | |
| HA | H12 | 271 | 0.41 | yes | 4 | 0 | 100 | LITGKSHGRIL | 94.12 | LVTGKSHGRVL | 2.35 | | | | |
| HA | H12 | 272 | 0.41 | yes | 4 | 0 | 100 | ITGKSHGRILK | 94.12 | VTGKSHGRVLK | 2.35 | | | | |
| HA | H12 | 273 | 0.16 | yes | 3 | 0 | 100 | TGKSHGRILKN | 97.65 | GKSHGRVLKNN | 1.18 | | | | |
| HA | H12 | 274 | 0.68 | yes | 5 | 0 | 100 | GKSHGRILKNN | 85.88 | KSHGRVLKNND | 11.76 | | | | |
| HA | H12 | 275 | 0.68 | yes | 5 | 0 | 100 | KSHGRILKNNL | 85.88 | SHGRVLKNNLP | 11.76 | | | | |
| HA | H12 | 276 | 0.68 | yes | 5 | 0 | 100 | SHGRILKNNLP | 85.88 | TGCQLNEGVMN | 2.35 | | | | |
| HA | H12 | 292 | 0.5 | yes | 3 | 0 | 100 | TECQLNEGVMN | 92.94 | KCQLNEGVMNT | 2.35 | TECQLNEGIMN | 1.18 | | |
| HA | H12 | 293 | 0.5 | yes | 3 | 0 | 100 | ECQLNEGVMNT | 92.94 | CQLNEGIMNTS | 2.35 | ECQLNEGIMNT | 1.18 | | |
| HA | H12 | 294 | 0.16 | yes | 3 | 0 | 100 | CQLNEGVMNTS | 97.65 | QLNEGIMNTSK | 1.18 | | | | |
| HA | H12 | 295 | 0.18 | yes | 3 | 0 | 100 | QLNEGVMNTSK | 97.65 | LNEGIMNTSKP | 1.18 | | | | |
| HA | H12 | 296 | 0.18 | yes | 3 | 0 | 100 | LNEGVMNTSKP | 97.65 | NEGIMNTSKPF | 1.18 | NEGIMNTSKPF | 1.18 | | |
| HA | H12 | 297 | 0.28 | yes | 4 | 0 | 100 | NEGVMNTSKPF | 96.47 | EGVMNTSKPLQ | 1.18 | EGVMNTSKPLQ | 1.18 | | |
| HA | H12 | 298 | 0.28 | yes | 4 | 0 | 100 | EGVMNTSKPFQ | 96.47 | GVMNTSKPLQN | 1.18 | GVMNTSKPFQN | 1.18 | | |
| HA | H12 | 299 | 0.5 | yes | 5 | 0 | 100 | GVMNTSKPFQN | 95.29 | GIMNTSKPLQN | 1.18 | GIMNTSKPFQN | 1.18 | VINTSKPFQNT | 1.18 |
| HA | H12 | 300 | 0.37 | yes | 4 | 0 | 100 | VMNTSKPFQNT | 96.47 | IMNTSKPFQNI | 1.18 | | | | |
| HA | H12 | 301 | 0.28 | yes | 4 | 0 | 100 | MNTSKPFQNTS | 96.47 | MNTSKPFQNIC | 1.18 | | | | |
| HA | H12 | 302 | 0.28 | yes | 4 | 0 | 100 | NTSKPFQNTSK | 96.47 | NTSKPFQNICK | 1.18 | | | | |

Fig. 75-77

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 303 | 0.28 | yes | 4 | 0 | 100 | TSKPFQNT

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 391 | 0.09 | yes | 2 | 0 | 100 | QNKLN

Fig. 75-80

| Protein | Sub-type | Start Pos | Block Entropy | Gaps <10% | # to cover 99% | % Gap | coverage | Peptides included | Freq | Peptides included | Freq | Peptides included | Freq | Peptides included | Freq |
|---|---|---|---|---|---|---|---|---|---|---|---|---|---|---|---|
| HA | H12 | 472 | 0.57 | yes | 5 | 0 | 100 | AIDTGDGCFEI | 91.76 | AVDTGDGCFEI | 2.35 | ALDTGDGCFEI | 2.35 | AIDAGDGCFEI | 2.35 | AIDNGDGCFEI | 1.18 |
| HA | H12 | 473 | 0.57 | yes | 5 | 0 | 100 | IDTGDGCFEIL | 91.76 | LDTGDGCFEIL | 2.35 | VDTGDGCFEIL | 2.35 | IDAGDGCFEIL | 2.35 | IDNGDGCFEIL | 1.18 |
| HA | H12 | 474 | 0.25 | yes | 3 | 0 | 100 | DTGDGCFEILH | 96.47 | DAGDGCFEILH | 2.35 | DNGDGCFEILH | 2.35 | | | | |
| HA | H12 | 475 | 0.89 | yes | 4 | 0 | 100 | TGDGCFEILHR | 80 | TGDGCFEILHK | 16.47 | NGDGCFEILHK | 1.18 | AGDGCFEILHK | 2.35 | | |
| HA | H12 | 476 | 0.65 | yes | 2 | 0 | 100 | GDGCFEILHRC | 83.53 | GDGCFEILHK | 16.47 | | | | | | |
| HA | H12 | 477 | 0.9 | yes | 4 | 0 | 100 | DGCFEILHRCD | 82.35 | DGCFEILHRCN | 9.41 | DGCFEILHKCN | 7.06 | GCFEILHKCND | 1.18 | | |
| HA | H12 | 478 | 1.62 | yes | 5 | 0 | 100 | GCFEILHRCDD | 57.65 | GCFEILHRCN | 24.71 | GCFEILHKCN | 9.41 | GCFEILHRCND | 3.53 | | |
| HA | H12 | 504 | 1.14 | yes | 4 | 0 | 100 | YEEESKLERQK | 78.82 | YEEESKLERQR | 9.41 | YEDESRIERQK | 4.71 | YEEESRIERQK | 3.53 | | |
| HA | H12 | 511 | 0.76 | yes | 4 | 0 | 100 | ERQRINGVKLE | 87.06 | ERQKINGVKLE | 4.71 | ERQKISGVKLE | 4.71 | | | | |
| HA | H12 | 512 | 0.76 | yes | 4 | 0 | 100 | RQKVNGVKLEE | 87.06 | RQRINGVKLEE | 4.71 | RQKISGVKLEE | 4.71 | | | | |
|

Fig. 75-81

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H12 | 543 | 0.09 | yes | 2 | 0 | 100 | LMIIGGFHFGC | 98.82 | FMIIGGFHFGC | 1.18 | | | | |
| HA | H12 | 544 | 0 | yes | 1 | 0 | 100 | MIIGGFHFGCQ | 100 | | | | | | |
| HA | H12 | 545 | 0 | yes | 1 | 0 | 100 | IIGGFHFGCQN | 100 | | | | | | |
| HA | H12 | 546 | 0 | yes | 1 | 0 | 100 | IGGFHFGCQNG | 100 | | | | | | |
| HA | H12 | 547 | 0.09 | yes | 2 | 1.18 | 100 | GGFHFGCQNGN | 98.81 | GFHFGCQNGNI | 1.19 | | | | |
| HA | H12 | 548 | 0.09 | yes | 2 | 1.18 | 100 | GFHFGCQNGNV | 98.8 | FHFGCQNGNIR | 1.2 | | | | |
| HA | H12 | 549 | 0.1 | no | 2 | 2.35 | 100 | FHFGCQNGNVR | 98.77 | HFGCQNGNIRC | 1.23 | | | | |
| HA | H12 | 550 | 0.11 | no | 2 | 4.71 | 100 | HFGCQNGNVRC | 98.51 | FGCQNGNIRCT | 1.49 | | | | |
| HA | H12 | 551 | 0.11 | no | 2 | 21.18 | 100 | FGCQNGNVRCT | 98.46 | GCQNGNIRCTF | 1.54 | | | | |
| HA | H12 | 552 | 0.11 | no | 2 | 23.53 | 100 | GCQNGNVRCTF | 98.46 | CQNGNIRCTFC | 1.54 | | | | |
| HA | H12 | 553 | 0.11 | no | 2 | 23.53 | 100 | CQNGNVRCTFC | 98.46 | QNGNIRCTFCI | 1.54 | | | | |
| HA | H12 | 554 | 0.24 | yes | 2 | 6.15 | 100 | QNGNVRCTFCI | 96.72 | AD

Fig. 75-82

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 70 | 0.62 | yes | 4 | 0 | 100 | LGDCSFEGWIV | 89.23 | LGDCNFEGWIV | 7.69 | | | | |
| HA | H3 | 71 | 0.62 | yes | 4 | 0 | 100 | GDCSFEGWIVG | 89.23 | GDCNFEGWIVG | 7.69 | | | | |
| HA | H3 | 72 | 0.62 | yes | 4 | 0 | 100 | DCSFEGWIVGN | 89.23 | DCNFEGWIVGN | 7.69 | | | | |
| HA | H3 | 73 | 0.62 | yes | 4 | 0 | 100 | CSFEGWIVGNP | 89.23 | CNFEGWIVGNP | 7.69 | | | | |
| HA | H3 | 74 | 1.09 | yes | 5 | 0 | 100 | SFEGWIVGNPA | 78.46 | RFEGWIVGNP | 10.77 | SFEGWIGGNP | 7.69 | NFEGWIVGNPA | 1.54 |
| HA | H3 | 75 | 0.61 | yes | 3 | 0 | 100 | FEGWIVGNPAC | 87.69 | FEGWIVGNPS | 10.77 | FEGWIGGNPA | 1.54 | | |
| HA | H3 | 90 | 0.4 | yes | 3 | 0 | 100 | GIREWSYLIED | 93.85 | GIREWSYLIED | 3.08 | | | | |
| HA | H3 | 91 | 0.4 | yes | 3 | 0 | 100 | IREWSYLIEDP | 93.85 | TREWSYLIEDP | 3.08 | | | | |
| HA | H3 | 92 | 1.51 | yes | 4 | 0 | 100 | REWSYLIEDPS | 60 | VREWSYLIEDP | 24.62 | REWSYLIEDPT | 7.69 | | |
| HA | H3 | 93 | 1.51 | yes | 4 | 0 | 100 | EWSYLIEDPSA | 60 | EWSYLIEDPG | 24.62 | EWSYLIEDPAA | 7.69 | | |
| HA | H3 | 94 | 1.51 | yes | 4 | 0 | 100 | WSYLIEDPSAP | 60 | WSYLIEDPGA | 24.62 | WSYLIEDPAAP | 7.69 | | |
| HA | H3 | 95 | 1.51 | yes | 4 | 0 | 100 | SYLIEDPSAPH | 60 | WSYLIEDPGAP | 24.62 | SYLIEDPAAPH | 7.69 | | |
| HA | H3 | 96 | 1.61 | yes | 5 | 0 | 100 | YLIEDPSAPHG | 58.46 | SYLIEDPGAPH | 24.62 | YLIEDPAAPHG | 7.69 | YLIEDPSAPHR | 7.69 |
| HA | H3 | 97 | 1.61 | yes | 5 | 0 | 100 | LIEDPSAPHGL | 58.46 | YLIEDPGAPHGL | 24.62 | LIEDPTAPHGL | 7.69 | LIEDPSAPHRL | 7.69 |
| HA | H3 | 98 | 1.61 | yes | 5 | 0 | 100 | IEDPSAPHGLC | 58.46 | LIEDPGAPHGLC | 24.62 | IEDPAAPHGLC | 7.69 | IEDPSAPHRLC | 7.69 |
| HA | H3 | 99 | 1.61 | yes | 5 | 0 | 100 | EDPSAPHGLCY | 58.46 | IEDPAPHGLCY | 24.62 | EDPAAPHGLCY | 7.69 | EDPSAPHRLCY | 7.69 |
| HA | H3 | 100 | 1.61 | yes | 5 | 0 | 100 | DPSAPHGLCYP | 58.46 | EDPTAPHGLCY | 24.62 | DPTAPHGLCYP | 7.69 | DPSAPHRLCYP | 7.69 |
| HA | H3 | 101 | 1.61 | yes | 5 | 0 | 100 | PSAPHGLCYPG | 58.46 | DPGAPHGLCYP | 24.62 | PAAPHGLCYPG | 7.69 | PSAPHRLCYPG | 7.69 |
| HA | H3 | 102 | 1.61 | yes | 5 | 0 | 100 | SAPHGLCYPGE | 58.46 | PGAPHGLCYPG | 24.62 | TAPHGLCYPGE | 7.69 | SAPHRLCYPGE | 7.69 |
| HA | H3 | 103 | 0.11 | yes | 2 | 0 | 100 | APHGLCYPGEL | 98.46 | GAPHGLCYPGE | 24.62 | | | | |
| HA | H3 | 104 | 1.07 | yes | 3 | 0 | 100 | PHGLCYPGELD | 60 | APHRLCYPGEL | 1.54 | PHRLCYPGELD | 1.54 | | |
| HA | H3 | 105 | 1.07 | yes | 3 | 0 | 100 | HGLCYPGELNN | 60 | PHGLCYPGELD | 38.46 | HRLCYPGELDN | 1.54 | | |
| HA | H3 | 106 | 1.07 | yes | 3 | 0 | 100 | GLCYPGELNNN | 60 | HGLCYPGELNN | 38.46 | RLCYPGELDNN | 1.54 | | |

Fig. 75-83

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 124 | 0.85 | yes | 3 | 0 | 100 | SGIKSFSRTEL | 80 | SGIKSFSRTEL | 16.92 | SGIKSFSRTQL | 16.92 | | | | |
| HA | H3 | 125 | 0.85 | yes | 3 | 0 | 100 | GIKSFSRTELI | 80 | GIKSFSRTELI | 16.92 | GIKSFSRTQLI | 16.92 | | | | |
| HA | H3 | 126 | 1.65 | yes | 4 | 0 | 100 | IKSFSRTELIA | 40 | IKSFSRTELIA | 40 | IKSFSRTQLIA | 16.9 | IKSFSRTQLIA | 3.08 | | |
| HA | H3 | 127 | 1.65 | no | 1 | 0 | 100 | RSFSRTELIPP | 40 | RSFSRTELIAP | 40 | KSFSRTQLIAP | 16.9 | KSFSRTQLIAP | 3.08 | | |
| HA | H3 | 173 | 0 | yes | 5 | 98.46 | 100 | GGYPNKKTYN | 100 | | | | | | | | |
| HA | H3 | 180 | 1.81 | yes | 3 | 0 | 100 | KTYNNTTGRDV | 40 | GTYNNTTGRDV | 12.3 | GAYNNTTGRDV | 7.69 | GVYNNTTGRDV | 1.54 |
| HA | H3 | 181 | 0.5 | yes | 1 | 0 | 100 | TYNNTTGRDVL | 90.77 | AYNNTTGRDVL | 7.69 | | 1.54 | | | | |
| HA | H3 | 182 | 0 | yes | 1 | 0 | 100 | YNNTTGRDVLV | 100 | | | | | | | | |
| HA | H3 | 183 | 1.56 | yes | 3 | 0 | 100 | NNTTGRDVLVM | 41.54 | NNTTGRDVLVI | 32.31 | NNTTGRDVLVI | 26.2 | | | | |
| HA | H3 | 184 | 1.56 | yes | 3 | 0 | 100 | NTTGRDVLVMW | 41.54 | NTTGRDVLVIW | 32.31 | NTTGRDVLVIW | 26.2 | | | | |
| HA | H3 | 185 | 1.56 | yes | 3 | 0 | 100 | TTGRDVLVMWG | 41.54 | TTGRDVLVIWG | 32.31 | TGRDVLVIWG | 26.2 | | | | |
| HA | H3 | 186 | 1.56 | yes | 3 | 0 | 100 | TGRDVLVLWG | 41.54 | TGRDVLVIWGI | 30.77 | TGRDVLVMWGL | 26.2 | | | | |
| HA | H3 | 187 | 1.56 | yes | 4 | 0 | 100 | GRDVLVLWGI | 41.54 | GRDVLVIWGIH | 30.77 | GRDVLVMWGLH | 26.2 | | | | |
| HA | H3 | 188 | 1.65 | yes | 4 | 0 | 100 | RDVLVLWGIH | 41.54 | RDVLVIWGIHH | 30.77 | RDVLVMWGLHH | 26.2 | | | | |
| HA | H3 | 189 | 1.65 | yes | 4 | 0 | 100 | DVLVLWGIHH | 41.54 | DVLVIWGIHHP | 30.77 | DVLVMWGLHHP | 26.2 | | | | |
| HA | H3 | 214 | 1.66 | yes | 4 | 0 | 100 | PYTLVSTSWS | 41.54 | PYTLVSTSWS | 40 | PYTLVTSSWS | 15.4 | PYTLVTSSWS | 1.54 | | |
| HA | H3 | 232 | 1.65 | yes | 5 | 0 | 100 | GIRPGYNGQRS | 49.23 | GIRPGYNGQKS | 33.85 | GTRPGYNGQKS | 12.3 | | | | |
| HA | H3 | 233 | 1.65 | yes | 5 | 0 | 100 | VRPGYNGQRSW | 49.23 | VRPGYNGQKSW | 33.85 | TRPGYNGQKSW | 12.3 | | | | |
| HA | H3 | 234 | 1.2 | yes | 4 | 0 | 100 | RPGYNGQRSWM | 49.23 | RPGYNGQKSWT | 47.69 | RPRYNGQRSW | 1.54 | GVRPRYNGQRS | 1.54 | | |
| HA | H3 | 235 | 1.2 | yes | 4 | 0 | 100 | PGYNGQRSWMK | 49.23 | PGYNGQKSWMK | 47.69 | PRYNGQRSWM | 1.54 | VRPRYNGQRSW | 1.54 | | |
| HA | H3 | 236 | 1.1 | yes | 3 | 0 | 100 | GYNGQRSWMKI | 49.23 | GYNGQKSWMKI | 47.69 | RYNGQRSWM | 1.54 | | | | |
| HA | H3 | 237 | 1.1 | yes | 3 | 0 | 100 | YNGQRSWMKIY | 50.77 | NGQKSWMKIY | 47.69 | GYNGQKSWTK | 1.54 | | | | |
| HA | H3 | 238 | 1.41 | yes | 3 | 0 | 100 | NGQRSWMKIYW | 46.15 | NGQKSWMKIYW | 47.69 | GYNGQKSWTKI | 1.54 | | | | |
| HA | H3 | 257 | 1.31 | yes | 4 | 0 | 100 | ISFESNGGLLA | 47.69 | ITFESNGGLLA | 44.62 | VSFESNGGLLA | 7.69 | VSFESNGGLLA | 1.54 | | |
| HA | H3 | 258 | 1.14 | yes | 3 | 0 | 100 | SFESNGGLLAP | 69.23 | TFESNGGLLAP | 44.62 | TFESNGGFLA | 7.69 | | | | |
| HA | H3 | 259 | 1.14 | yes | 3 | 0 | 100 | FESNGGLLAPK | 69.23 | FESNGGLLAP | 23.08 | TFESNGFLAP | 7.69 | | | | |
| HA | H3 | 260 | 1.14 | yes | 3 | 0 | 100 | ESNGGLLAPR | 69.23 | ESNGGLLAPR | 23.08 | FESNGFLAPR | 7.69 | | | | |
| HA | H3 | 261 | 1.14 | yes | 3 | 0 | 100 | SNGGLLAPRY | 69.23 | SNGGFLAPRY | 23.08 | ESNGGFLAPR | 7.69 | | | | |
| HA | H3 | 262 | 1.14 | yes | 3 | 0 | 100 | NGGLLAPRYG | 69.23 | NGGFLAPRYG | 23.08 | SNGGFLAPRY | 7.69 | | | | |
| HA | H3 | 263 | 1.14 | yes | 3 | 0 | 100 | GGLLAPRYGY | 69.23 | GGFLAPRYGY | 23.08 | NGGFLAPRYG | 7.69 | | | | |
| HA | H3 | 264 | 0.78 | yes | 2 | 0 | 100 | GLLAPRYGII | 69.23 | GFLAPRYGII | 23.08 | GGFLAPRYGY | 7.69 | | | | |
| HA | H3 | 265 | 0.78 | yes | 2 | 0 | 100 | LLAPRYGIIE | 69.23 | FLAPRYGIIE | 23.08 | GFLAPRYGII | 7.69 | | | | |
| HA | H3 | 266 | 1.09 | yes | 3 | 0 | 100 | LAPRYGIIEE | 76.92 | LAPRYGIIEE | 23.08 | FLAPRYGIIE | 7.69 | | | | |
| HA | H3 | 267 | 1.09 | yes | 3 | 0 | 100 | APRYGIIEEY | 76.92 | APRYGIIEEY | 23.08 | | | | | | |
| HA | H3 | 268 | 0.78 | yes | 2 | 0 | 100 | PRYGIIEEYG | 76.92 | PRYGIIEEYG | 23.08 | | | | | | |
| HA | H3 | 269 | 0.78 | yes | 2 | 0 | 100 | RYGIIEEYGK | 70.77 | KYGIIEEYGK | 23.08 | RYGIIEEYGR | 6.15 | | | | |
| HA | H3 | 270 | 0.33 | yes | 2 | 0 | 100 | YGIIEEYGKG | 93.85 | YGYIIEEYGRG | 6.15 | | | | | | |
| HA | H3 | 271 | 0.33 | yes | 2 | 0 | 100 | GIIEEYGKGR | 93.85 | GYIIEEYGRGR | 6.15 | | | | | | |
| HA | H3 | 272 | 0.33 | yes | 2 | 0 | 100 | IIEEYGKGRI | 93.85 | YIIEEYGRGRI | 6.15 | | | | | | |
| HA | H3 | 273 | 0.33 | yes | 2 | 0 | 100 | IEEYGKGRIF | 93.85 | IIEEYGRGRIF | 6.15 | | | | | | |

Fig. 75-84

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 274 | 0.33 | yes | 2 | 0 | 100 | IEEYGKGRIFQ | 93.85 | IEEYGKGRIFQ | 6.15 | |

Fig. 75-85

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 326 | 0.23 | yes | 3 | 0 | 100 | SGQLKLATGLR | 96.92 | SGQLKLATGLK | 1.54 | | | | |
| HA | H13 | 327 | 0.23 | yes | 3 | 0 | 100 | GQLKLATGLRN | 96.92 | GQLKLATGLKN | 1.54 | | | | |
| HA | H13 | 328 | 0.38 | yes | 3 | 0 | 100 | QLKLATGLRNV | 93.85 | QLKLATGLKNV | 4.62 | | | | |
| HA | H13 | 329 | 0.38 | yes | 3 | 0 | 100 | LKLATGLRNVP | 93.85 | LKLATGLKNVP | 4.62 | KLATGLKNVPS | 1.54 | | |
| HA | H13 | 330 | 1.01 | yes | 4 | 0 | 100 | KLATGLRNVPA | 81.54 | KLATGLKNVPA | 9.23 | KLATGLRNIPA | 1.54 | KLATGLKNVPA | 1.54 |
| HA | H13 | 344 | 0.34 | yes | 4 | 0 | 100 | RGLFGAIAGFI | 95.38 | RGLLGAIAGFI | 1.54 | RAVDGTIAGFI | 1.54 | | |
| HA | H13 | 345 | 0.34 | yes | 3 | 0 | 100 | GLFGAIAGFIE | 95.38 | GLLGAIAGFIE | 1.54 | | | | |
| HA | H13 | 346 | 0.34 | yes | 3 | 0 | 100 | LFGAIAGFIEG | 95.38 | LLGAIAGFIEG | 1.54 | | | | |
| HA | H13 | 347 | 0.23 | yes | 2 | 0 | 100 | FGAIAGFIEGG | 96.92 | | | | | | |
| HA | H13 | 348 | 0.11 | yes | 2 | 0 | 100 | GAIAGFIEGGW | 98.46 | | | | | | |
| HA | H13 | 349 | 0.11 | yes | 2 | 0 | 100 | AIAGFIEGGWP | 98.46 | | | | | | |
| HA | H13 | 350 | 0 | yes | 1 | 0 | 100 | IAGFIEGGWPG | 100 | | | | | | |
| HA | H13 | 351 | 0 | yes | 1 | 0 | 100 | AGFIEGGWPGL | 100 | | | | | | |
| HA | H13 | 352 | 0 | yes | 1 | 0 | 100 | GFIEGGWPGLI | 100 | | | | | | |
| HA | H13 | 353 | 0 | yes | 1 | 0 | 100 | FIEGGWPGLIN | 100 | | | | | | |
| HA | H13 | 354 | 0 | yes | 1 | 0 | 100 | IEGGWPGLING | 100 | | | | | | |
| HA | H13 | 355 | 0 | yes | 1 | 0 | 100 | EGGWPGLINGW | 100 | | | | | | |
| HA | H13 | 356 | 0 | yes | 1 | 0 | 100 | GGWPGLINGWY | 100 | | | | | | |
| HA | H13 | 357 | 0 | yes | 1 | 0 | 100 | GWPGLINGWYG | 100 | | | | | | |
| HA | H13 | 358 | 0 | yes | 1 | 0 | 100 | WPGLINGWYGF | 100 | | | | | | |
| HA | H13 | 359 | 0 | yes | 1 | 0 | 100 | PGLINGWYGFQ | 100 | | | | | | |
| HA | H13 | 360 | 0 | yes | 1 | 0 | 100 | GLINGWYGFQH | 100 | | | | | | |
| HA | H13 | 361 | 0 | yes | 1 | 0 | 100 | LINGWYGFQHQ | 100 | | | | | | |
| HA | H13 | 362 | 0 | yes | 1 | 0 | 100 | INGWYGFQHQN | 100 | | | | | | |
| HA | H13 | 363 | 0 | yes | 1 | 0 | 100 | NGWYGFQHQNE | 100 | | | | | | |
| HA | H13 | 364 | 0 | yes | 1 | 0 | 100 | GWYGFQHQNEQ | 100 | | | | | | |
| HA | H13 | 365 | 0 | yes | 1 | 0 | 100 | WYGFQHQNEQG | 100 | | | | | | |
| HA | H13 | 366 | 1.07 | yes | 3 | 0 | 100 | YGFQHQNEQGV | 58.46 | YGFQHONEQGM | 40 | | | | |
| HA | H13 | 367 | 1.07 | yes | 3 | 0 | 100 | GFQHQNEQGVG | 58.46 | GFQHONEQGMG | 40 | | | | |
| HA | H13 | 368 | 1.64 | yes | 4 | 0 | 100 | FQHONEQGVGM | 40 | FQHONEQGMGI | 35.38 | FQHONEQGMGM | 1.54 | FQHONEQGMGMA | 1.54 |
| HA | H13 | 369 | 1.64 | yes | 4 | 0 | 100 | QHONEQGVGMA | 40 | QHONEQGMGIA | 35.38 | QHONEQGMGMA | 1.54 | | |
| HA | H13 | 370 | 1.64 | yes | 4 | 0 | 100 | HONEQGVGMAA | 40 | HONEQGMGIAA | 35.38 | HONEQGMGMAA | 1.54 | | |
| HA | H13 | 371 | 1.8 | yes | 5 | 0 | 100 | QNEQGTGIAAD | 36.92 | QNEQGVGMAAD | 35.38 | QNEQGIAAEK | 23.1 | QNEQGMGMAAD | 1.54 |
| HA | H13 | 372 | 1.8 | yes | 5 | 0 | 100 | NEQGTGIAADK | 36.92 | NEQGVGMAADK | 35.38 | NEQGTGIAAEK | 23.1 | NEQGMGMAADK | 1.54 |
| HA | H13 | 373 | 1.8 | yes | 5 | 0 | 100 | EQGTGIAADKE | 36.92 | EQGVGMAADKE | 35.38 | EQGTGIAAEKE | 23.1 | EQGMGMAADKE | 3.08 |
| HA | H13 | 374 | 1.8 | yes | 5 | 0 | 100 | QGTGIAADKES | 36.92 | QGVGMAADKES | 35.38 | QGTGIAAEKES | 23.1 | QGMGMAADKES | 3.08 |
| HA | H13 | 375 | 1.8 | yes | 5 | 0 | 100 | GTGIAADKEST | 36.92 | GVGMAADKEST | 35.38 | GTGIAAEKEST | 23.1 | GMGMAADKEST | 3.08 |
| HA | H13 | 376 | 1.13 | yes | 3 | 0 | 100 | TGIAADKESTQ | 36.92 | VGMAADKESTQ | 35.38 | TGIAAEKESTQ | 23.1 | MGMAADKESTQ | 3.08 |
| HA | H13 | 377 | 1.13 | yes | 3 | 0 | 100 | GIAADKESTQK | 60 | GMAADKESTQK | 36.92 | GIAAEKESTQK | 3.08 | | |
| HA | H13 | 378 | 1.13 | yes | 3 | 0 | 100 | IAADKESTQKA | 60 | MAADKESTQKA | 36.92 | IAAEKESTQKA | 3.08 | | |

Fig. 75-86

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 379 | 0.2 | yes | 2 | 0 | 100 | AADKESTQ

Fig. 75-87

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 418 | 1.69 | yes | 4 | 0 | 100 | QRINMLADRID | 41.54 | | | | | | |
| HA | H13 | 419 | 0 | yes | 1 | 0 | 100 | RINMLADRIDD | 100 | KRINMLADRID | 40 | NRINMLADRID | 10.8 | RRINMLADRID | 7.69 |
| H

Fig. 75-88

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 474 | 0.97 | yes | 3 | 0 | 100 | AIDEGNGCFEL | 73.85 | AVDEGNG

Fig. 75-89

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H13 | 534 | 1.3 | yes | 3 | 1.54 | 100 | IYSCIASSVYL | 60.94 | IYSCIASSVYM | 28.12 | | | | |
| HA | H13 | 535 | 1.3 | yes | 3 | 1.54 | 100 | YSCIASSVYLV | 60.94 | YSCIASSVYMV | 28.12 | | | | |
| HA | H13 | 536 | 1.3 | yes | 3 | 1.54 | 100 | SCIASSVYLVG | 60.94 | SCIASSVYMVG | 28.12 | | | | |
| HA | H13 | 537 | 1.4 | yes | 4 | 1.54 | 100 | CIASSVYLVGL | 59.38 | CIASSVYMVGL | 28.12 | CIASSVYLVGP | 10.9 | | |
|

Fig. 75-90

| Protein | Sub-type | Start Pos | Block | Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|---|
| HA | H14 | 28 | 0 | 0 | yes | — | 0 | 100 | IICLG

Fig. 75-91

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H14 | 68 | 0 | yes | — | 0 | 100 | CPSPLKLVDGQ | 100 |
| HA | H14 | 69 | 0 | yes | — | 0 | 100 | PSPLKLVDGQD | 100 |
| HA | H14 | 70 | 0 | yes | — | 0 | 100 | SPLKLVDGQDC | 100 |
| HA | H14 | 71 | 0 | yes | — | 0 | 100 | PLKLVDGQDCD | 100 |
| HA | H14 | 72 | 0 | yes | — | 0 | 100 | LKLVDGQDCDL | 100 |
| HA | H14 | 73 | 0 | yes | — | 0 | 100 | KLVDGQDCDLI | 100 |
| HA | H14 | 74 | 0 | yes | — | 0 | 100 | LVDGQDCDLIN | 100 |
| HA | H14 | 75 | 0 | yes | — | 0 | 100 | VDGQDCDLING | 100 |
| HA | H14 | 76 | 0 | yes | — | 0 | 100 | DGQDCDLINGA | 100 |
| HA | H14 | 77 | 0 | yes | — | 0 | 100 | GQDCDLINGAL | 100 |
| HA | H14 | 78 | 0 | yes | — | 0 | 100 | QDCDLINGALG | 100 |
| HA | H14 | 79 | 0 | yes | — | 0 | 100 | DCDLINGALGS | 100 |
| HA | H14 | 80 | 0 | yes | — | 0 | 100 | CDLINGALGSP | 100 |
| HA | H14 | 81 | 0 | yes | — | 0 | 100 | DLINGALGSPG | 100 |
| HA | H14 | 82 | 0 | yes | — | 0 | 100 | LINGALGSPGC | 100 |
| HA | H14 | 83 | 0 | yes | — | 0 | 100 | INGALGSPGCD | 100 |
| HA | H14 | 84 | 0 | yes | — | 0 | 100 | NGALGSPGCDR | 100 |
| HA | H14 | 85 | 0 | yes | — | 0 | 100 | GALGSPGCDRL | 100 |
| HA | H14 | 86 | 0 | yes | — | 0 | 100 | ALGSPGCDRLQ | 100 |
| HA | H14 | 87 | 0 | yes | — | 0 | 100 | LGSPGCDRLQD | 100 |
| HA | H14 | 88 | 0 | yes | — | 0 | 100 | GSPGCDRLQDT | 100 |
| HA | H14 | 89 | 0 | yes | — | 0 | 100 | SPGCDRLQDTT | 100 |
| HA | H14 | 90 | 0 | yes | — | 0 | 100 | PGCDRLQDTTW | 100 |
| HA | H14 | 91 | 0 | yes | — | 0 | 100 | GCDRLQDTTWD | 100 |
| HA | H14 | 92 | 0 | yes | — | 0 | 100 | CDRLQDTTWDV | 100 |
| HA | H14 | 93 | 0 | yes | — | 0 | 100 | DRLQDTTWDVF | 100 |
| HA | H14 | 94 | 0 | yes | — | 0 | 100 | RLQDTTWDVFH | 100 |
| HA | H14 | 95 | 0 | yes | — | 0 | 100 | LQDTTWDVFIE | 100 |
| HA | H14 | 96 | 0 | yes | — | 0 | 100 | QDTTWDVFIER | 100 |
| HA | H14 | 97 | 0 | yes | — | 0 | 100 | DTTWDVFIERP | 100 |
| HA | H14 | 98 | 0 | yes | — | 0 | 100 | TTWDVFIERPT | 100 |
| HA | H14 | 99 | 0 | yes | — | 0 | 100 | TWDVFIERPTA | 100 |
| HA | H14 | 100 | 0 | yes | — | 0 | 100 | WDVFIERP

Fig. 75-92

| Protein | Sub-type | Start Pos | Block Entropy | Gaps <10% | # to cover 99% | Gap % | Coverage | Peptides included | Freq |
|---|---|---|---|---|---|---|---|---|---|
| HA | H14 | 108 | 0 | yes | — | 0 | 100 | TA

Fig. 75-93

| Protein | Sub-type | Start Pos | Block Entropy | Gaps <10% | # to cover 99% | % Gap | Coverage | Peptides included | Freq | Peptides included | Freq |
|---|---|---|---|---|---|---|---|---|---|---|---|
| HA | H14 | 148 | 0 | yes | 1 | 0 | 100 | VDGS

Fig. 75-94

| Protein | Sub-type | Start Pos | Block | Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|---|
| HA | H14 | 188 | 0 | 0 | yes | – | 0 | 100 | TGSYRLYLWG | 100 | | | | | | |
| HA | H14 | 189 | 0 | 0 | yes | – | 0 | 100 | GSYRLYLWGV | 100 | | | | | | |
| HA | H14 | 190 | 0 | 0 | yes | – | 0 | 100 | SYRLYLWGVH | 100 | | | | | | |
| HA | H14 | 191 | 0 | 0 | yes | – | 0 | 100 | YRLYLWGVHH | 100 | | | | | | |
| HA | H14 | 192 | 0 | 0 | yes | – | 0 | 100 | RLYLWGVHHP | 100 | | | | | | |
| HA | H14 | 193 | 0 | 0 | yes | – | 0 | 100 | LYLWGVHHPS | 100 | | | | | | |
| HA | H14 | 194 | 0 | 0 | yes | – | 0 | 100 | YLWGVHHPSS | 100 | | | | | | |
| HA | H14 | 195 | 0 | 0 | yes | – | 0 | 100 | LWGVHHPSSD | 100 | | | | | | |
| HA | H14 | 196 | 0 | 0 | yes | – | 0 | 100 | WGVHHPSSDN | 100 | | | | | | |
| HA | H14 | 197 | 0 | 0 | yes | – | 0 | 100 | GVHHPSSDNE | 100 | | | | | | |
| HA | H14 | 198 | 0 | 0 | yes | – | 0 | 100 | VHHPSSDNEQ | 100 | | | | | | |
| HA | H14 | 199 | 0 | 0 | yes | – | 0 | 100 | HHPSSDNEQT | 100 | | | | | | |
| HA | H14 | 200 | 0 | 0 | yes | – | 0 | 100 | HPSSDNEQTD | 100 | | | | | | |
| HA | H14 | 201 | 0 | 0 | yes | – | 0 | 100 | PSSDNEQTDL | 100 | | | | | | |
| HA | H14 | 202 | 0 | 0 | yes | – | 0 | 100 | SSDNEQTDLY | 100 | | | | | | |
| HA | H14 | 203 | 0 | 0 | yes | – | 0 | 100 | SDNEQTDLYK | 100 | | | | | | |
| HA | H14 | 204 | 0 | 0 | yes | – | 0 | 100 | DNEQTDLYKV | 100 | | | | | | |
| HA | H14 | 205 | 0 | 0 | yes | – | 0 | 100 | NEQTDLYKVA | 100 | | | | | | |
| HA | H14 | 206 | 0 | 0 | yes | – | 0 | 100 | EQTDLYKVAT | 100 | | | | | | |
| HA | H14 | 207 | 0 | 0 | yes | – | 0 | 100 | QTDLYKVATG | 100 | | | | | | |
| HA | H14 | 208 | 0 | 0 | yes | – | 0 | 100 | TDLYKVATGR | 100 | | | | | | |
| HA | H14 | 209 | 0 | 0 | yes | – | 0 | 100 | DLYKVATGRV | 100 | | | | | | |
| HA | H14 | 210 | 0 | 0 | yes | – | 0 | 100 | LYKVATGRVT | 100 | | | | | | |
| HA | H14 | 211 | 0 | 0 | yes | – | 0 | 100 | YKVATGRVTV | 100 | | | | | | |
| HA | H14 | 212 | 0 | 0 | yes | – | 0 | 100 | KVATGRVTVS | 100 | | | | | | |
| HA | H14 | 213 | 0 | 0 | yes | – | 0 | 100 | VATGRVTVST | 100 | | | | | | |
| HA | H14 | 214 | 0 | 0 | yes | – | 0 | 100 | ATGRVTVSTR | 100 | | | | | | |
| HA | H14 | 215 | 0 | 0 | yes | – | 0 | 100 | TGRVTVSTRS | 100 | | | | | | |
| HA | H14 | 216 | 0 | 0 | yes | – | 0 | 100 | GRVTVSTRSD | 100 | | | | | | |
| HA | H14 | 217 | 0 | 0 | yes | – | 0 | 100 | RVTVSTRSDQ | 100 | | | | | | |
| HA | H14 | 218 | 0 | 0 | yes | – | 0 | 100 | VTVSTRSDQI | 100 | | | | | | |
| HA | H14 | 219 | 0 | 0 | yes | – | 0 | 100 | TVSTRSDQIS | 100 | | | | | | |
| HA | H14 | 220 | 0 | 0 | yes | – | 0 | 100 | VSTRSDQISI | 100 | | | | | | |
| HA | H14 | 221 | 0 | 0 | yes | – | 0 | 100 | STRSDQISIV | 100 | | | | | | |
| HA | H14 | 222 | 0 | 0 | yes | – | 0 | 100 | TRSDQISIVP | 100 | | | | | | |
| HA | H14 | 223 | 0 | 0 | yes | – | 0 | 100 | RSDQISIVPN | 100 | | | | | | |
| HA | H14 | 224 | 0 | 0 | yes | – | 0 | 100 | SDQISIVPNI | 100 | | | | | | |
| HA | H14 | 225 | 0 | 0 | yes | – | 0 | 100 | DQISIVPNIG | 100 | | | | | | |
| HA | H14 | 226 | 0 | 0 | yes | – | 0 | 100 | QISIVPNIGS | 100 | | | | | | |
| HA | H14 | 227 | 0 | 0 | yes | – | 0 | 100 | ISIVPNIGSR | 100 | | | | | | |

Fig. 75-95

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H14 | 228 | 0 | yes | — | 0 | 100 | ISI

Fig. 75-96

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 268 | 0 | yes | — | 0 | 100 | LIAPRGHYK

Fig. 75-97

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 308 | 0 | yes | 1 | 0 | 100 | SDKPFQNVSRI | 100 | | | | | | |
| HA | H14 | 309 | 0 | yes | 1 | 0 | 100 | DKPFQNVSRIA | 100 | | | | | | |
| HA | H14 | 310 | 0 | yes | 1 | 0 | 100 | KPFQNVSRIAI | 100 | | | | | | |
| HA | H14 | 311 | 0 | yes | 1 | 0 | 100 | PFQNVSRIAIG | 100 | | | | | | |
| HA | H14 | 312 | 0 | yes | 1 | 0 | 100 | FQNVSRIAIGN | 100 | | | | | | |
| HA | H14 | 313 | 0 | yes | 1 | 0 | 100 | QNVSRIAIGNC | 100 | | | | | | |
| HA | H14 | 314 | 0 | yes | 1 | 0 | 100 | NVSRIAIGNCP | 100 | | | | | | |
| HA | H14 | 315 | 0 | yes | 1 | 0 | 100 | VSRIAIGNCPK | 100 | | | | | | |
| HA | H14 | 316 | 0 | yes | 1 | 0 | 100 | SRIAIGNCPKY | 100 | | | | | | |
| HA | H14 | 317 | 0 | yes | 1 | 0 | 100 | RIAIGNCPKYV | 100 | | | | | | |
| HA | H14 | 318 | 0 | yes | 1 | 0 | 100 | IAIGNCPKYVK | 100 | | | | | | |
| HA | H14 | 319 | 0 | yes | 1 | 0 | 100 | AIGNCPKYVKQ | 100 | | | | | | |
| HA | H14 | 320 | 0 | yes | 1 | 0 | 100 | IGNCPKYVKQG | 100 | | | | | | |
| HA | H14 | 321 | 0 | yes | 1 | 0 | 100 | GNCPKYVKQGS | 100 | | | | | | |
| HA | H14 | 322 | 0 | yes | 1 | 0 | 100 | NCPKYVKQGSL | 100 | | | | | | |
| HA | H14 | 323 | 0 | yes | 1 | 0 | 100 | CPKYVKQGSLM | 100 | | | | | | |
| HA | H14 | 324 | 0 | yes | 1 | 0 | 100 | PKYVKQGSLML | 100 | | | | | | |
| HA | H14 | 325 | 0 | yes | 1 | 0 | 100 | KYVKQGSLMLA | 100 | | | | | | |
| HA | H14 | 326 | 0 | yes | 1 | 0 | 100 | YVKQGSLMLAT | 100 | | | | | | |
| HA | H14 | 327 | 0 | yes | 1 | 0 | 100 | VKQGSLMLATG | 100 | | | | | | |
| HA | H14 | 328 | 0 | yes | 1 | 0 | 100 | KQGSLMLATGM | 100 | | | | | | |
| HA | H14 | 329 | 0 | yes | 1 | 0 | 100 | QGSLMLATGMR | 100 | | | | | | |
| HA | H14 | 330 | 0 | yes | 1 | 0 | 100 | GSLMLATGMRN | 100 | | | | | | |
| HA | H14 | 331 | 0 | yes | 1 | 0 | 100 | SLMLATGMRNI | 100 | | | | | | |
| HA | H14 | 332 | 0 | yes | 1 | 0 | 100 | LMLATGMRNIP | 100 | | | | | | |
| HA | H14 | 333 | 0 | yes | 1 | 0 | 100 | MLATGMRNIPG | 100 | | | | | | |
| HA | H14 | 334 | 0 | yes | 1 | 0 | 100 | LATGMRNIPGK | 100 | | | | | | |
| HA | H14 | 335 | 0 | yes | 1 | 0 | 100 | ATGMRNIPGKQ | 100 | | | | | | |
| HA | H14 | 336 | 0 | yes | 1 | 0 | 100 | TGMRNIPGKQA | 100 | | | | | | |
| HA | H14 | 337 | 0 | yes | 1 | 0 | 100 | GMRNIPGKQAK | 100 | | | | | | |
| HA | H14 | 338 | 0 | yes | 1 | 0 | 100 | MRNIPGKQAKG | 100 | | | | | | |
| HA | H14 | 339 | 0 | yes | 1 | 0 | 100 | RNIPGKQAKGL | 100 | | | | | | |
| HA | H14 | 340 | 0 | yes | 1 | 0 | 100 | NIPGKQAKGLF | 100 | | | | | | |
| HA | H14 | 341 | 0 | yes | 1 | 0 | 100 | IPGKQAKGLFG | 100 | | | | | | |
| HA | H14 | 342 | 0 | yes | 1 | 0 | 100 | PGKQAKGLFGA | 100 | | | | | | |
| HA | H14 | 343 | 0 | yes | 1 | 0 | 100 | GKQAKGLFGAI | 100 | | | | | | |
| HA | H14 | 344 | 0 | yes | 1 | 0 | 100 | KQAKGLFGAIA | 100 | | | | | | |
| HA | H14 | 345 | 0 | yes | 1 | 0 | 100 | QAKGLFGAIAG | 100 | | | | | | |
|

Fig. 75-98

| Protein | Sub-type | Start Pos | Block | Entropy | Gaps <10% | # to cover 99% | % Gap | Coverage | Peptides included | Freq |
|---|---|---|---|---|---|---|---|---|---|---|
| HA | H14 | 348 | 0 | 0 | yes | 1 | 0 | 100 | GLFGAIAGFIE | 100 |
| HA | H14 | 349 | 0 | 0 | yes |

Fig. 75-99

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H14 | 388 | 0 | yes | - | 0 | 100 | TQAAIDQINGK | 100 | | | | | | |
| HA | H14 | 389 | 0 | yes | - | 0 | 100 | QAAIDQINGKL | 100 | | | |

Fig. 75-100

| Protein | Sub-type | Start Pos | Block Entropy | Gaps <10% | # to cover 99% | % Gap | Coverage | Peptides included | Freq |
|---|---|---|---|---|---|---|---|---|---|
| HA | H4 | 428 | 0 | yes | — | 0 | 100 | EKYVEDTKIDL | 100 |
| H

Fig. 75-101

| Protein | Sub-type | Start Pos | Block | Entropy | Gaps < 10% | # to cover 99% | % Gap | Coverage | Peptides included | Freq |
|---|---|---|---|---|---|---|---|---|---|---|
| HA | H14 | 468 | 0 | 0 | yes | - | 0 | 100 | RVRRQLRENAE | 100 |
| HA | H14 | 469 | 0 | 0 | yes | - |

Fig. 75-102

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H14 | 508 | 0 | yes | – | 0 | 100 | IYRDEAINNRI | 100 |
| HA | H14 | 509 | 0 | yes | – | 0 | 100 | YRDEAINNRIK | 100 |
| HA | H14 | 510 | 0 | yes | – | 0 | 100 | RDEAINNRIKI | 100 |
| HA | H14 | 511 | 0 | yes | – | 0 | 100 | DEAINNRIKIN | 100 |
| HA | H14 | 512 | 0 | yes | – | 0 | 100 | EAINNRIKINP | 100 |
| HA | H14 | 513 | 0 | yes | – | 0 | 100 | AINNRIKINPV | 100 |
| HA | H14 | 514 | 0 | yes | – | 0 | 100 | INNRIKINPVT | 100 |
| HA | H14 | 515 | 0 | yes | – | 0 | 100 | NNRIKINPVTL | 100 |
| HA | H14 | 516 | 0 | yes | – | 0 | 100 | NRIKINPVTLT | 100 |
| HA | H14 | 517 | 0 | yes | – | 0 | 100 | RIKINPVTLTM | 100 |
| HA | H14 | 518 | 0 | yes | – | 0 | 100 | IKINPVTLTMG | 100 |
| HA | H14 | 519 | 0 | yes | – | 0 | 100 | KINPVTLTMGY | 100 |
| HA | H14 | 520 | 0 | yes | – | 0 | 100 | INPVTLTMGYK | 100 |
| HA | H14 | 521 | 0 | yes | – | 0 | 100 | NPVTLTMGYKD | 100 |
|

Fig. 75-103

| Protein | Sub-type | Start Pos | Block Entropy | Gaps < 10% | # to cover 99% | Gap % | Coverage | Peptides included | Freq | Peptides included | Freq |
|---|---|---|---|---|---|---|---|---|---|---|---|
| HA | H14 | 548 | 0 | no | 1 | 0 | 100 | LLGFVL

Fig. 75-104

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 30 | 0.85 | yes | 2 | 0 | 100 | NGTKVNTLTER | 72.73 | NGTKVNTLTEK | 27.27 | | | | |
| HA | H5 | 31 | 0.85 | yes | 2 | 0 | 100

Fig. 75-105

| Protein | Sub-type | Start Pos | Block Entropy | Gaps <10% | # to cover 99% | % Gap | Coverage | Peptides included | Freq | Peptides included | Freq |
|---|---|---|---|---|---|---|---|---|---|---|---|
| HA | H15 | 70 | 0 | yes | 1 | 0 | 100 | GSCGILGTIIG | 100 | | |
| HA | H15 | 71 | 0 | yes | 1 | 0 | 100 | SCGILGTIIGP | 100 | | |
| HA | H15 | 72 | 0 | yes | 1 | 0 | 100 | CGILGTIIGPP | 100 | | |
| HA | H15 | 73 | 0 | yes | 1 | 0 | 100 | GILGTIIGPPQ | 100 | | |
| HA | H15 | 74 | 0 | yes | 1 | 0 | 100 | ILGTIIGPPQC | 100 | | |
| HA | H15 | 75 | 0.85 | yes | 2 | 0 | 100 | LGTIIGPPQCD | 100 | | |
| HA | H15 | 76 | 0.85 | yes | 2 | 0 | 100 | GTIIGPPQCDL | 100 | GTIIGPPQCDS | 27.27 |
| HA | H15 | 77 | 0.85 | yes | 2 | 0 | 100 | TIIGPPQCDLH | 100 | TIIGPPQCDSH | 27.27 |
| HA | H15 | 78 | 0.85 | yes | 2 | 0 | 100 | IIGPPQCDLHL | 100 | IIGPPQCDSHL | 27.27 |
| HA | H15 | 79 | 0.85 | yes | 2 | 0 | 100 | IGPPQCDLHLE | 100 | IGPPQCDSHLK | 27.27 |
| HA | H15 | 80 | 0.85 | yes | 2 | 0 | 100 | GPPQCDLHLEF | 100 | GPPQCDSHLKF | 27.27 |
| HA | H15 | 81 | 0.85 | yes | 2 | 0 | 100 | PPQCDLHLEFK | 100 | PPQCDSHLKFK | 27.27 |
| HA | H15 | 82 | 0.85 | yes | 2 | 0 | 100 | PQCDLHLEFKA | 72.73 | PQCDSHLKFKA | 27.27 |
| HA | H15 | 83 | 0.85 | yes | 2 | 0 | 100 | QCDLHLEFKAD | 72.73 | QCDSHLKFKAD | 27.27 |
| HA | H15 | 84 | 0.85 | yes | 2 | 0 | 100 | CDLHLEFKADL | 72.73 | CDSHLKFKADL | 27.27 |
| HA | H15 | 85 | 0.85 | yes | 2 | 0 | 100 | DLHLEFKADLI | 72.73 | DSHLKFKADLI | 27.27 |
| HA | H15 | 86 | 0.85 | yes | 2 | 0 | 100 | LHLEFKADLII | 72.73 | SHLKFKADLII | 27.27 |
| HA | H15 | 87 | 0.85 | yes | 2 | 0 | 100 | HLEFKADLIIE | 72.73 | HLKFKADLIIE | 27.27 |
| HA | H15 | 88 | 0.85 | yes | 2 | 0 | 100 | LEFKADLIIER | 72.73 | LKFKADLIIER | 27.27 |
| HA | H15 | 89 | 0.85 | yes | 2 | 0 | 100 | EFKADLIIERR | 72.73 | KFKADLIIERR | 27.27 |
| HA | H15 | 90 | 0 | yes | 1 | 0 | 100 | FKADLIIERRN | 100 | | |
| HA | H15 | 91 | 0 | yes | 1 | 0 | 100 | KADLIIERRNS | 100 | | |
| HA | H15 | 92 | 0 | yes | 1 | 0 | 100 | ADLIIERRNSS | 100 | | |
| HA | H15 | 93 | 0 | yes | 1 | 0 | 100 | DLIIERRNSSD | 100 | | |
| HA | H15 | 94 | 0 | yes | 1 | 0 | 100 | LIIERRNSSDI | 100 | | |
| HA | H15 | 95 | 0 | yes | 1 | 0 | 100 | IIERRNSSDIC | 100 | | |
| HA | H15 | 96 | 0 | yes | 1 | 0 | 100 | IERRNSSDICY | 100 | | |
| HA | H15 | 97 | 0 | yes | 1 | 0 | 100 | ERRNSSDICYP | 100 | | |
| HA | H15 | 98 | 0 | yes | 1 | 0 | 100 | RRNSSDICYPG | 100 | | |
| HA | H15 | 99 | 0.85 | yes | 2 | 0 | 100 | RNSSDICYPGR | 72.73 | RNSSDICYPGK | 27.27 |
| HA | H15 | 100 | 0.85 | yes | 2 | 0 | 100 | NSSDICYPGRF | 72.73 | NSSDICYPGKF | 27.27 |
| HA | H15 | 101 | 0.85 | yes | 2 | 0 | 100 | SSDICYPGRFT | 72.73 | SSDICYPGKFT | 27.27 |
| HA | H15 | 102 | 0.85 | yes | 2 | 0 | 100 | SDICYPGRFTN | 72.73 | SDICYPGKFTN | 27.27 |
| HA | H15 | 103 | 0.85 | yes | 2 | 0 | 100 | DICYPGRFTNE | 72.73 | DICYPGKFTNE | 27.27 |
| HA | H15 | 104 | 0.85 | yes | 2 | 0 | 100 | ICYPGRFTNEE | 72.73 | ICYPGKFTNEE | 27.27 |
| HA | H15 | 105 | 0.85 | yes | 2 | 0 | 100 | CYPGRFTNEEA | 72.73 | CYPGKFTNEEA | 27.27 |
| HA | H15 | 106 | 0.85 | yes | 2 | 0 | 100 | YPGRFTNEEAL | 72.73 | YPGKFTNEEAL | 27.27 |
| HA | H15 | 107 | 0.85 | yes | 2 | 0 | 100 | PGRFTNEEALR | 72.73 | PGKFTNEEALR | 27.27 |
| HA | H15 | 108 | 0.85 | yes | 2 | 0 | 100 | GRFTNEEALRQ | 72.73 | GKFTNEEALRQ | 27.27 |
| HA | H15 | 109 | 0.85 | yes | 2 | 0 | 100 | RFTNEEALRQI | 72.73 | KFTNEEALRQI | 27.27 |

Fig. 75-106

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 110 | 0 | yes | 1 | 0 | 100 | FTNEEALRQII | 100 | | | | | | |
| HA | H15 | 111 | 0 | yes | 1 | 0 | 100 |

Fig. 75-107

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H15 | 150 | 0 | yes | 1 | 0 | 100 | TVSSFYSEMKW | 100 | | | | | | | | |
| HA | H15 | 151 | 0 | yes | 1 | 0 | 100 | VSSFYSEMKWL | 100 | | | | | | | | |
| HA | H15 | 152 | 0.85 | yes | 2 | 0 | 100 | SSFYSEMKWLS | 72.73 | SSFYSE

Fig. 75-108

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 190 | 0 | yes | 1 | 0 | 100 | GWHHSSSLDEQ | 100 | | | | | | |
| HA | H15 | 191 | 0 | yes | 1 | 0 | 100 | VHHSSSLDEQN | 100 | | | | | | |
| HA | H15 | 192 | 0 | yes | 1 | 0 | 100 | HSSSLDEQNK | 100 | | | | | | |
| HA | H15 | 193 | 0 | yes | 1 | 0 | 100 | SSSLDEQNKL | 100 | | | | | | |
| HA | H15 | 194 | 0 | yes | 1 | 0 | 100 | SSLDEQNKLY | 100 | | | | | | |
| HA | H15 | 195 | 0 | yes | 1 | 0 | 100 | SLDEQNKLYG | 100 | | | | | | |
| HA | H15 | 196 | 0.85 | yes | 2 | 0 | 100 | LDEQNKLYGT | 72.73 | SLDEQNKLYGA | 27.27 | | | | | |
| HA | H15 | 197 | 0.85 | yes | 2 | 0 | 100 | DEQNKLYGTG | 72.73 | LDEQNKLYGAG | 27.27 | | | | | |
| HA | H15 | 198 | 0.85 | yes | 2 | 0 | 100 | EQNKLYGTGN | 72.73 | DEQNKLYGAGN | 27.27 | | | | | |
| HA | H15 | 199 | 0.85 | yes | 2 | 0 | 100 | QNKLYGTGNK | 72.73 | EQNKLYGAGNK | 27.27 | | | | | |
| HA | H15 | 200 | 0.85 | yes | 2 | 0 | 100 | NKLYGTGNKL | 72.73 | QNKLYGAGNKL | 27.27 | | | | | |
| HA | H15 | 201 | 0.85 | yes | 2 | 0 | 100 | KLYGTGNKLI | 72.73 | NKLYGAGNKLI | 27.27 | | | | | |
| HA | H15 | 202 | 0.85 | yes | 2 | 0 | 100 | LYGTGNKLIT | 72.73 | KLYGAGNKLIT | 27.27 | | | | | |
| HA | H15 | 203 | 0.85 | yes | 2 | 0 | 100 | YGTGNKLITV | 72.73 | LYGAGNKLITV | 27.27 | | | | | |
| HA | H15 | 204 | 0.85 | yes | 2 | 0 | 100 | GTGNKLITVG | 72.73 | YGAGNKLITVG | 27.27 | | | | | |
| HA | H15 | 205 | 0.85 | yes | 2 | 0 | 100 | TGNKLITVGS | 72.73 | GAGNKLITVGS | 27.27 | | | | | |
| HA | H15 | 206 | 0.85 | yes | 2 | 0 | 100 | GNKLITVGSS | 72.73 | AGNKLITVGSS | 27.27 | | | | | |
| HA | H15 | 207 | 0 | yes | 1 | 0 | 100 | NKLITVGSSK | 100 | | | | | | |
| HA | H15 | 208 | 0 | yes | 1 | 0 | 100 | KLITVGSSKY | 100 | | | | | | |
| HA | H15 | 209 | 0.44 | yes | 2 | 0 | 100 | LITVGSSKYQ | 90.91 | KLITVGSSKYR | 9.09 | | | | | |
|

Fig. 75-109

| Protein | Sub-type | Start Pos | Block Entropy | Gaps < 10% | # to cover 99% | % Gap | Coverage | Peptides included | Freq |
|---|---|---|---|---|---|---|---|---|---|
| HA | H5 | 230 | 0 | yes | 1 | 0 | 100 | PKVNGQAGRID | 100 |
| HA | H5 | 231 | 0 | yes | — | 0 | 100 | KVNGQAGRIDF | 100 |
| HA | H5 | 232 | 0 | yes | — | 0 | 100 | V

Fig. 75-110

| Protein | Sub-type | Start Pos | Block | Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|---|
| HA | H15 | 270 | | 0.85 | yes | 2 | 0 | 100 | RSNAPSGIEYN | 72.73 | RSNAPSGVEYN | 27.27 |

Fig. 75-111

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 310 | 0.85 | yes | 2 | 0 |

Fig. 75-112

| Protein | Sub-type | Start Pos | Block Entropy | Gaps <10% | # to cover 99% | Gap % | Coverage | Peptides included | Freq | Peptides included | Freq |
|---|---|---|---|---|---|---|---|---|---|---|---|
| HA | H5 | 350 | 0.44 | yes | 2 | 0 | 100 | GLFG

Fig. 75-113

| Protein | Sub-type | Start Pos | Block Entropy | Gaps < 10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 390 | 0 | yes | 1 | 0 | 100 | TQAAIDQITG

Fig. 75-114

| Protein | Sub-type | Start Pos | Block Entropy | Gaps < 10% | # to cover 99% | Gap % | Coverage | Peptides included | Freq |
|---|---|---|---|---|---|---|---|---|---|
| HA | H5 | 430 | 0 | yes | - | 0 | 100 | INWTRDSLTEI | 100 |
| HA | H5 | 431 | 0 | yes | - | 0 | 100 | NWTRDSLTEIW | 100 |
| HA | H5 | 432 | 0 | yes | - | 0 | 100 | WTRDSLTEIWS | 100 |
| HA | H5 | 433 | 0 | yes | - | 0 | 100 | TRDSLTEIWSY | 100 |
| HA | H

Fig. 75-115

| Protein | Sub-type | Start Pos | Block Entropy | Gaps < 10% | # to cover 99% | % Gap | Coverage | Peptides included | Freq |
|---|---|---|---|---|---|---|---|---|---|
| HA | H5 | 470 | 0 | yes | — | 0 | 100 | RVRRQLRENAE | 100 |
| HA | H5 |

Fig. 75-116

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 510 | 0 | yes | 1 | 0 | 100 | EYRQEALQNRI | 100 | | | | | | |
| HA | H15 | 511 | 0 | yes | 1 | 0 | 100 | YRQEALQNRIM | 100 | | | | | | |
| HA | H15 | 512 | 0 | yes | 1 | 0 | 100 | RQEALQNRIMI | 100 | | | | | | |
| HA | H15 | 513 | 0 | yes | 1 | 0 | 100 | QEALQNRIMIN | 100 | | | | | | |
| HA | H15 | 514 | 0 | yes | 1 | 0 | 100 | EALQNRIMINP | 100 | | | | | | |
| HA | H15 | 515 | 0 | yes | 1 | 0 | 100 | ALQNRIMINPV | 100 | | | | | | |
| HA | H15 | 516 | 0 | yes | 1 | 0 | 100 | LQNRIMINPVK | 100 | | | | | | |
| HA | H15 | 517 | 0 | yes | 1 | 0 | 100 | QNRIMINPVKL | 100 | | | | | | |
| HA | H15 | 518 | 0 | yes | 1 | 0 | 100 | NRIMINPVKLS | 100 | | | | | | |
| HA | H15 | 519 | 0.85 | yes | 2 | 0 | 100 | RIMINPVKLSS | 72.73 | RIMINPVKLSG | 27.27 | | | | |
| HA | H15 | 520 | 0.85 | yes | 2 | 0 | 100 | IMINPVKLSSG | 72.73 | IMINPVKLSGG | 27.27 | | | | |
| HA | H15 | 521 | 0.85 | yes | 2 | 0 | 100 | MINPVKLSSGY | 72.73 | MINPVKLSGGY | 27.27 | | | | |
| HA | H15 | 522 | 0.85 | yes | 2 | 0 | 100 | INPVKLSSGYK | 72.73 | INPVKLSGGYK | 27.27 | | | | |
| HA | H15 | 523 | 0.85 | yes | 2 | 0 | 100 | NPVKLSSGYKD | 72.73 | NPVKLSGGYKD | 27.27 | | | | |
| HA | H15 | 524 | 0.85 | yes | 2 | 0 | 100 | PVKLSSGYKDV | 72.73 | PVKLSGGYKDV | 27.27 | | | | |
| HA | H15 | 525 | 0.85 | yes | 2 | 0 | 100 | VKLSSGYKDVI | 72.73 | VKLSGGYKDVI | 27.27 | | | | |
| HA | H15 | 526 | 0.85 | yes | 2 | 0 | 100 | KLSSGYKDVIL | 72.73 | KLSGGYKDVIL | 27.27 | | | | |
| HA | H15 | 527 | 0.85 | yes | 2 | 0 | 100 | LSSGYKDVILW | 72.73 | LSGGYKDVILW | 27.27 | | | | |
| HA | H15 | 528 | 0.85 | yes | 2 | 0 | 100 | SSGYKDVILWF | 72.73 | SGGYKDVILWF | 27.27 | | | | |
| HA | H15 | 529 | 0.85 | yes | 2 | 0 | 100 | SGYKDVILWFS | 72.73 | GGYKDVILWFS | 27.27 | | | | |
| HA | H15 | 530 | 0 | yes | 1 | 0 | 100 | GYKDVILWFSF | 100 | | | | | | |
| HA | H15 | 531 | 0 | yes | 1 | 0 | 100 | YKDVILWFSFG | 100 | | | | | | |
| HA | H15 | 532 | 0 | yes | 1 | 0 | 100 | KDVILWFSFGA | 100 | | | | | | |
| HA | H15 | 533 | 0 | yes | 1 | 0 | 100 | DVILWFSFGAS | 100 | | | | | | |
| HA | H15 | 534 | 0 | yes | 1 | 0 | 100 | VILWFSFGASC | 100 | | | | | | |
| HA | H15 | 535 | 0 | yes | 1 | 0 | 100 | ILWFSFGASCV | 100 | | | | | | |
| HA | H15 | 536 | 0 | yes | 1 | 0 | 100 | LWFSFGASCVM | 100 | | | | | | |
| HA | H15 | 537 | 0 | yes | 1 | 0 | 100 | WFSFGASCVML | 100 | | | | | | |
| HA | H15 | 538 | 0 | yes | 1 | 0 | 100 | FSFGASCVMLL | 100 | | | | | | |
| HA | H15 | 539 | 0 | yes | 1 | 0 | 100 | SFGASCVMLLA | 100 | | | | | | |
| HA | H15 | 540 | 0 | yes | 1 | 0 | 100 | FGASCVMLLAI | 100 | | | | | | |
| HA | H15 | 541 | 0 | yes | 1 | 0 | 100 | GASCVMLLAIA | 100 | | | | | | |
| HA | H15 | 542 | 0 | yes | 1 | 0 | 100 | ASCVMLLAIAM | 100 | | | | | | |
| HA | H15 | 543 | 0 | yes | 1 | 0 | 100 | SCVMLLAIAMG | 100 | | | | | | |
| HA | H15 | 544 | 0 | yes | 1 | 9.09 | 100 | CVMLLAIAMGL | 100 | | | | | | |
| HA | H15 | 545 | 0 | yes | 1 | 9.09 | 100 | VMLLAIAMGLI | 100 | | | | | | |
| HA | H15 | 546 | 0 | yes | 1 | 9.09 | 100 | MLLAIAMGLIF | 100 | | | | | | |
| HA | H15 | 547 | 0 | yes | 1 | 9.09 | 100 | LLAIAMGLIFM | 100 | | | | | | |
| HA | H15 | 548 | 0 | yes | 1 | 9.09 | 100 | LAIAMGLIFMC | 100 | | | | | | |
| HA | H15 | 549 | 0 | yes | 1 | 9.09 | 100 | AIAMGLIFMCV | 100 | | | | | | |

Fig. 75-117

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H15 | 550 | 0 | yes | 1 | 9.09 | 100 | IAMGLIFMCVK | 100 | | | | | | |
| HA | H15 | 551 | 0 | yes | 1 | 9.09 | 100 | AMGLIFMCVKN | 100 | | | | | | |
| HA | H15 | 552 | 0 | yes | 1 | 9.09 | 100 | MGLIFMCVKNG | 100 | | | | | | |
| HA | H15 | 553 | 0 | yes | 1 | 0 | 100 | GLIFMCVKNGN | 100 | | | | | | |
| HA | H15 | 554 | 0 | yes | 1 | 0 | 100 | LIFMCVKNGNL | 100 | | | | | | |
| HA | H15 | 555 | 0 | yes | 1 | 0 | 100 | IFMCVKNGNLR | 100 | | | | | | |
| HA | H15 | 556 | 0 | yes | 1 | 0 | 100 | FMCVKNGNLRC | 100 | | | | | | |
| HA | H15 | 557 | 0 | yes | 1 | 0 | 100 | MCVKNGNLRCT | 100 | | | | | | |
| HA | H15 | 558 | 0 | yes | 1 | 9.09 | 100 | CVKNGNLRCTI | 100 | | | | | | |
| HA | H15 | 559 | 0 | yes | 1 | 9.09 | 100 | VKNGNLRCTIC | 100 | | | | | | |
| HA | H15 | 560 | 0 | yes | 1 | 95.24 | 100 | KNGNLRCTICI | 100 | | | | | | |
| HA | H16 | 1 | 0 | no | 1 | 95.24 | 100 | QPNDGQVLYFL | 100 | | | | | | |
| HA | H16 | 2 | 0 | no | 1 | 0 | 100 | PNDGQVLYFLI | 100 | | | | | | |
| HA | H16 | 16 | 1.88 | yes | 5 | 0 | 100 | GRYSKADKICI | 47.62 | GRYSIADKICI | 23.81 | GRYSRADKICI | 19.1 | | |

Fig. 75-118

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 44 | — | yes | 2 | 0 | 100 | GVPTSSIDLV | 52.38 | | | | | | |
| HA | H16 | 45 | — | yes | 2 | 0 | 100 | VPTSSIDLVE | 52.38 | | | | | | |
| HA | H16 | 46 | — | yes | 2 | 0 | 100 | PTSSIDLVET | 52.38 | | | | | | |
| HA | H16 | 47 | — | yes | 2 | 0 | 100 | VTSSIDLVETN | 52.38 | | | | | | |
| HA | H16 | 48 | — | yes | 2 | 0 | 100 | TSSIDLVETNH | 52.38 | | | | | | |
| HA | H16 | 49 | — | yes | 2 | 0 | 100 | SSIDLVETNHT | 52.38 | | | | | | |
| HA | H16 | 50 | — | yes | 2 | 0 | 100 | SIDLVETNHTG | 52.38 | | | | | | |
| HA | H16 | 51 | — | yes | 2 | 0 | 100 | IDLVETNHTGT | 52.38 | | | | | | |
| HA | H16 | 52 | — | yes | 1 | 0 | 100 | DLVETNHTGTY | 100 | | | | | | |
| HA | H16 | 53 | — | yes | 1 | 0 | 100 | LVETNHTGTYC | 100 | | | | | | |
| HA | H16 | 54 | — | yes | 1 | 0 | 100 | VETNHTGTYCS | 100 | | | | | | |
| HA | H16 | 55 | — | yes | 1 | 0 | 100 | ETNHTGTYCSL | 100 | | | | | | |
| HA | H16 | 56 | — | yes | 1 | 0 | 100 | TNHTGTYCSLN | 100 | | | | | | |
| HA | H16 | 57 | — | yes | 1 | 0 | 100 | NHTGTYCSLNG | 100 | | | | | | |
| HA | H16 | 58 | 0.99 | yes | 2 | 0 | 100 | HTGTYCSLNGV | 57.14 | HTGTYCSLNGI | 42.86 | | | | | |
| HA | H16 | 59 | 0.99 | yes | 2 | 0 | 100 | TGTYCSLNGVS | 57.14 | TGTYCSLNGIS | 42.86 | | | | | |
| HA | H16 | 60 | 0.99 | yes | 2 | 0 | 100 | GTYCSLNGVSP | 57.14 | GTYCSLNGISP | 42.86 | | | | | |
| HA | H16 | 61 | 1.78 | yes | 4 | 0 | 100 | TYCSLNGVSPV | 42.86 | TYCSLNGISPV | 42.86 | TYCSLNGISPV | 14.3 | | |
| HA | H16 | 62 | 1.78 | yes | 4 | 0 | 100 | YCSLNGVSPVH | 42.86 | YCSLNGISPVH | 42.86 | YCSLNGISPVH | 14.3 | | |
| HA | H16 | 63 | 1.78 | yes | 4 | 0 | 100 | CSLNGVSPVHL | 42.86 | CSLNGISPVHL | 42.86 | CSLNGISPVHL | 14.3 | | |
| HA | H16 | 64 | 1.78 | yes | 4 | 0 | 100 | SLNGVSPVHLG | 33.33 | SLNGISPVHLG | 42.86 | SLNGISPVHLG | 14.3 | | |
| HA | H16 | 65 | 1.78 | yes | 4 | 0 | 100 | LNGVSPVHLGD | 33.33 | LNGISPVHLGD | 42.86 | LNGISPVHLGD | 14.3 | | |
| HA | H16 | 66 | 1.78 | yes | 4 | 0 | 100 | NGVSPVHLGDC | 33.33 | NGISPVHLGDC | 42.86 | NGISPVHLGDC | 14.3 | | |
| HA | H16 | 67 | 1.78 | yes | 4 | 0 | 100 | GVSPVHLGDCS | 33.33 | GISPVHLGDCS | 42.86 | GISPVHLGDCS | 14.3 | | |
| HA | H16 | 68 | 1.78 | yes | 4 | 0 | 100 | VSPVHLGDCSF | 33.33 | ISPVHLGDCSF | 42.86 | ISPVHLGDCSF | 14.3 | | |
| HA | H16 | 69 | 0.79 | yes | 2 | 0 | 100 | SPVHLGDCSFE | 23.81 | | | | | | |
| HA | H16 | 70 | 0.79 | yes | 2 | 0 | 100 | PVHLGDCSFEG | 23.81 | | | | | | |
| HA | H16 | 71 | 0.79 | yes | 2 | 0 | 100 | VHLGDCSFEGW | 23.81 | | | | | | |
| HA | H16 | 72 | 0 | yes | 1 | 0 | 100 | HLGDCSFEGWI | 100 | | | | | | |
| HA | H16 | 73 | 0 | yes | 1 | 0 | 100 | LGDCSFEGWIV | 100 | | | | | | |
| HA | H16 | 74 | 0 | yes | 1 | 0 | 100 | GDCSFEGWIVG | 100 | | | | | | |
| HA | H16 | 75 | 0 | yes | 1 | 0 | 100 | DCSFEGWIVGN | 100 | | | | | | |
| HA | H16 | 76 | 0 | yes | 1 | 0 | 100 | CSFEGWIVGNP | 100 | | | | | | |
| HA | H16 | 77 | 0 | yes | 1 | 0 | 100 | SFEGWIVGNPS | 100 | | | | | | |
| HA | H16 | 78 | 0 | yes | 1 | 0 | 100 | FEGWIVGNPSC | 100 | | | | | | |
| HA | H16 | 79 | 0 | yes | 1 | 0 | 100 | EGWIVGNPSCA | 100 | | | | | | |
| HA | H16 | 80 | 0.79 | yes | 2 | 0 | 100 | GWIVGNPSCAT | 76.19 | GWIVGNPSCAS | 23.81 | | | | | |
| HA | H16 | 81 | 0.79 | yes | 2 | 0 | 100 | WIVGNPSCATN | 76.19 | WIVGNPSCASN | 23.81 | | | | | |
| HA | H16 | 82 | 0.79 | yes | 2 | 0 | 100 | IVGNPSCATNI | 76.19 | IVGNPSCASNI | 23.81 | | | | | |
| HA | H16 | 83 | 0.79 | yes | 2 | 0 | 100 | VGNPSCATNIN | 76.19 | VGNPSCASNII | 23.81 | | | | | |

Fig. 75-119

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H16 | 84 | 0.79 | yes | 2 | 0 | 100 | GNPSCATN

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 209 | 1.45 | yes | 4 | 0 | 100 | KLYVNKNPYTL | 47.62 | N

Fig. 75-122

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 254 | 1.66 | yes | 4 | 0 | 100 | PGERITFESNG | 42.86 | PGERITFESNG | 38.1 | | | PGERITFESNG | 4.76 | | |
| HA | H16 | 255 | 1.66 | yes | 4 | 0 | 100 | GERITFESNGG | 42.86 | GERIMFESNGG | 38.1 | | | GERITFESNGG | 4.76 | | |
| HA | H16 | 256 | 1.66 | yes | 4 | 0 | 100 | ERITFESNGGL | 42.86 | ERIMFESNGGL | 38.1 | | | ERITFESNGGL | 4.76 | | |
| HA | H16 | 259 | 2.15 | yes | 5 | 0 | 100 | TFESNGGLLAP | 38.1 | MFESNGGLLAP | 23.81 | | | TFESNGGLLAP | 14.29 | TFESGGLLAP | 9.52 |
| HA | H16 | 260 | 1.42 | yes | 3 | 0 | 100 | FESNGGLLAPR | 52.38 | FESSGGLLAPR | 33.33 | | | | | | |
| HA | H16 | 261 | 1.42 | yes | 3 | 0 | 100 | ESNGGLLAPRY | 52.38 | ESSGGLLAPRY | 33.33 | | | | | | |
| HA | H16 | 262 | 1.42 | yes | 3 | 0 | 100 | SNGGLLAPRYG | 52.38 | SSGGLLAPRYG | 33.33 | | | | | | |
| HA | H16 | 263 | 0.92 | yes | 2 | 0 | 100 | NGGLLAPRYGY | 66.67 | SGGLLAPRYGY | 33.33 | | | | | | |
| HA | H16 | 264 | 0.92 | yes | 2 | 0 | 100 | GGLLAPRYGYI | 66.67 | GGLLAPRYGYI | 33.33 | | | | | | |
| HA | H16 | 265 | 0.92 | yes | 2 | 0 | 100 | GLLAPRYGYII | 66.67 | GLLAPRYGYII | 33.33 | | | | | | |
| HA | H16 | 266 | 0.92 | yes | 2 | 0 | 100 | LLAPRYGYIIE | 66.67 | LLAPRYGYIIE | 33.33 | | | | | | |
| HA | H16 | 267 | 0.92 | yes | 2 | 0 | 100 | LAPRYGYIIEK | 66.67 | LAPRYGYIIE | 33.33 | | | | | | |
| HA | H16 | 268 | 0 | yes | 1 | 0 | 100 | APRYGYIIEKY | 100 | IAPRYGYIIEK | 33.33 | | | | | | |
| HA | H16 | 269 | 0 | yes | 1 | 0 | 100 | PRYGYIIEKYG | 100 | | | | | | | | |
| HA | H16 | 270 | 0.86 | yes | 2 | 0 | 100 | RYGYIIEKYGT | 71.43 | RYGYIIEKYGS | 28.57 | | | | | | |
| HA | H16 | 271 | 0.86 | yes | 2 | 0 | 100 | YGYIIEKYGTG | 71.43 | YGYIIEKYGSG

Fig. 75-123

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 312 | 1.27 | yes | 3 | 0 | 100 | NIERNALGDCP | 61.9 | NIEKNALGDCP | 28.57 | NIDRNAIGDCP | 9.52 | | |
| HA | H16 | 313 | 1.27 | yes | 3 | 0 | 100 | IERNALGDCPK | 61.9 | IEKNALGDCPK | 28.57 | IDRNAIGDCPK | 9.52 | | |
| HA | H16 | 314 | 1.27 | yes | 3 | 0 | 100 | ERNALGDCPKY | 61.9 | EKNALGDCPKY | 28.57 | DRNAIGDCPKY | 9.52 | | |
| HA | H16 | 315 | 1.27 | yes | 2 | 0 | 100 | RNALGDCPKYI | 61.9 | KNALGDCPKYI | 28.57 | RNAIGDCPKYI | 9.52 | | |
| HA | H16 | 316 | 0.86 | yes | 2 | 0 | 100 | NALGDCPKYIK | 71.43 | NAIGDCPKYIK | 28.57 | | | | |
| HA | H16 | 317 | 0.86 | yes | 2 | 0 | 100 | ALGDCPKYIKS | 71.43 | AIGDCPKYIKS | 28.57 | | | | |
| HA | H16 | 318 | 0.86 | yes | 1 | 0 | 100 | LGDCPKYIKSG | 71.43 | IGDCPKYIKSG | 28.57 | | | | |
| HA | H16 | 319 | 0 | yes | 1 | 0 | 100 | GDCPKYIKSGQ | 100 | | | | | | |
| HA | H16 | 320 | 0 | yes | 1 | 0 | 100 | DCPKYIKSGQL | 100 | | | | | | |
| HA | H16 | 321 | 0 | yes | 1 | 0 | 100 | CPKYIKSGQLK | 100 | | | | | | |
| HA | H16 | 322 | 0 | yes | 1 | 0 | 100 | PKYIKSGQLKL | 100 | | | | | | |
| HA | H16 | 323 | 0 | yes | 1 | 0 | 100 | KYIKSGQLKLA | 100 | | | | | | |
| HA | H16 | 324 | 0 | yes | 1 | 0 | 100 | YIKSGQLKLAT | 100 | | | | | | |
| HA | H16 | 325 | 0 | yes | 1 | 0 | 100 | IKSGQLKLATG | 100 | | | | | | |
| HA | H16 | 326 | 0 | yes | 1 | 0 | 100 | KSGQLKLATGL | 100 | | | | | | |
| HA | H16 | 327 | 0 | yes | 1 | 0 | 100 | SGQLKLATGLR | 100 | | | | | | |
| HA | H16 | 328 | 0 | yes | 1 | 0 | 100 | GQLKLATGLRN | 100 | | | | | | |
| HA | H16 | 329 | 0 | yes | 1 | 0 | 100 | QLKLATGLRNV | 100 | | | | | | |
| HA | H16 | 330 | 0 | yes | 1 | 0 | 100 | LKLATGLRNVP | 100 | | | | | | |
| HA | H16 | 331 | 0.28 | yes | 2 | 0 | 100 | KLATGLRNVPS | 95.24 | KLATGLRNVPI | 4.76 | | | | |
| HA | H16 | 332 | 0.55 | no | 3 | 95.24 | 100 | LATGLRNVPSI | 90.48 | LATGLRNVPIP | 4.76 | LATGLRNVPSV | 4.76 | | |
| HA | H16 | 341 | 2.05 | yes | 5 | 0 | 100 | IPIGERGLFGA | 100 | | | | | | |
| HA | H16 | 344 | 0 | yes | 1 | 0 | 100 | GERGLFGAIAG | 38.1 | VERGLFGAIAG | 23.81 | NERGLFGAIAG | 23.81 | SERGLFGAIAG | 23.8 |
| HA | H16 | 345 | 0 | yes | 1 | 0 | 100 | ERGLFGAIAGF | 100 | | | | | | |
| HA | H16 | 346 | 0 | yes | 1 | 0 | 100 | RGLFGAIAGFI | 100 | | | | | | |
| HA | H16 | 347 | 0 | yes | 1 | 0 | 100 | GLFGAIAGFIE | 100 | | | | | | |
| HA | H16 | 348 | 0 | yes | 1 | 0 | 100 | LFGAIAGFIEG | 100 | | | | | | |
| HA | H16 | 349 | 0 | yes | 1 | 0 | 100 | FGAIAGFIEGG | 100 | | | | | | |
| HA | H16 | 350 | 0 | yes | 1 | 0 | 100 | GAIAGFIEGGW | 100 | | | | | | |
| HA | H16 | 351 | 0 | yes | 1 | 0 | 100 | AIAGFIEGGWP | 100 | | | | | | |
| HA | H16 | 352 | 0 | yes | 1 | 0 | 100 | IAGFIEGGWPG | 100 | | | | | | |
| HA | H16 | 353 | 0 | yes | 1 | 0 | 100 | AGFIEGGWPGL | 100 | | | | | | |
| HA | H16 | 354 | 0 | yes | 1 | 0 | 100 | GFIEGGWPGLI | 100 | | | | | | |
| HA | H16 | 355 | 0 | yes | 1 | 0 | 100 | FIEGGWPGLIN | 100 | | | | | | |
| HA | H16 | 356 | 0 | yes | 1 | 0 | 100 | IEGGWPGLING | 100 | | | | | | |
| HA | H16 | 357 | 0 | yes | 1 | 0 | 100 | EGGWPGLINGW | 100 | | | | | | |
| HA | H16 | 358 | 0 | yes | 1 | 0 | 100 | GGWPGLINGWY | 100 | | | | | | |
| HA | H16 | 359 | 0 | yes | 1 | 0 | 100 | GWPGLINGWYG | 100 | | | | | | |
| HA | H16 | 360 | 0 | yes | 1 | 0 | 100 | WPGLINGWYGF | 100 | | | | | | |
| HA | H16 | 361 | 0 | yes | 1 | 0 | 100 | PGLINGWYGFQ | 100 | | | | | | |

Fig. 75-125

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 402 | 0 | yes | 1 | 0 | 100 | IEKMNGNYDSI | 100 | | | | | | |
| HA | H16 | 403 | 0 | yes | 1 | 0 | 100 | EKMNGNYDSIR | 100 | | | | | | |
| HA | H16 | 404 | 0 | yes | 1 | 0 | 100 | KMNGNYDSIRG | 100 | | | | | | |
| HA | H16 | 405 | 0 | yes | 1 | 0 | 100 | MNGNYDSIRGE | 100 | | | | | | |
| HA | H16 | 406 | 0 | yes | 1 | 0 | 100 | NGNYDSIRGEF | 100 | | | | | | |
| HA | H16 | 407 | 0 | yes | 1 | 0 | 100 | GNYDSIRGEFN | 100 | | | | | | |
| HA | H16 | 408 | 0 | yes | 1 | 0 | 100 | NYDSIRGEFNQ | 100 | | | | | | |
| HA | H16 | 409 | 0 | yes | 1 | 0 | 100 | YDSIRGEFNQV | 100 | | | | | | |
| HA | H16 | 410 | 0 | yes | 1 | 0 | 100 | DSIRGEFNQVE | 100 | | | | | | |
| HA | H16 | 411 | 0 | yes | 1 | 0 | 100 | SIRGEFNQVEK | 100 | | | | | | |
| HA | H16 | 412 | 0 | yes | 1 | 0 | 100 | IRGEFNQVEKR | 100 | | | | | | |
| HA | H16 | 413 | 0 | yes | 1 | 0 | 100 | RGEFNQVEKRI | 100 | | | | | | |
| HA | H16 | 414 | 0 | yes | 1 | 0 | 100 | GEFNQVEKRIN | 100 | | | | | | |
| HA | H16 | 415 | 0 | yes | 1 | 0 | 100 | EFNQVEKRINM | 100 | | | | | | |
| HA | H16 | 416 | 0.79 | yes | 2 | 0 | 100 | FNQVEKRINMI | 76.19 | FNQVEKRINML | 23.81 | | | | |
| HA | H16 | 417 | 0.79 | yes | 2 | 0 | 100 | NQVEKRINMIA | 76.19 | NQVEKRINMLA | 23.81 | | | | |
| HA | H16 | 418 | 0.79 | yes | 2 | 0 | 100 | QVEKRINMIAD | 76.19 | QVEKRINMLAD | 23.81 | | | | |
| HA | H16 | 419 | 1.05 | yes | 3 | 0 | 100 | VEKRINMIADR | 71.43 | VEKRINMLADR | 23.81 | VEKRINMLADW | 4.76 | | |
| HA | H16 | 420 | 1.05 | yes | 3 | 0 | 100 | EKRINMIADRV | 71.43 | EKRINMLADRV | 23.81 | EKRINMLADWV | 4.76 | | |
| HA | H16 | 421 | 1.05 | yes | 3 | 0 | 100 | KRINMIADRVD | 71.43 | KRINMLADRVD | 23.81 | KRINMLADWVD | 4.76 | | |
| HA | H16 | 422 | 1.05 | yes | 3 | 0 | 100 | RINMIADRVDD | 71.43 | RINMLADRVDD | 23.81 | RINMLADWVDD | 4.76 | | |
| HA | H16 | 423 | 1.05 | yes | 3 | 0 | 100 | INMIADRVDDA | 71.43 | INMLADRVDDA | 23.81 | INMLADWVDDA | 4.76 | | |
| HA | H16 | 424 | 1.05 | yes | 3 | 0 | 100 | NMIADRVDDAV | 71.43 | NMLADRVDDAV | 23.81 | NMLADWVDDAV | 4.76 | | |
| HA | H16 | 425 | 1.05 | yes | 3 | 0 | 100 | MIADRVDDAVT | 71.43 | MLADRVDDAVT | 23.81 | MLADWVDDAVT | 4.76 | | |
| HA | H16 | 426 | 1.05 | yes | 3 | 0 | 100 | IADRVDDAVTD | 71.43 | LADRVDDAVTD | 23.81 | LADWVDDAVTD | 4.76 | | |
| HA | H16 | 427 | 1.05 | yes | 3 | 0 | 100 | ADRVDDAVTDI | 71.43 | ADRVDDAVTDI | 23.81 | ADWVDDAVTDI | 4.76 | | |
| HA | H16 | 428 | 1.05 | yes | 3 | 0 | 100 | DRVDDAVTDIW | 71.43 | DRVDDAVTDVW | 23.81 | DWVDDAVTDIW | 4.76 | | |
| HA | H16 | 429 | 1.05 | yes | 3 | 0 | 100 | RVDDAVTDIWS | 71.43 | RVDDAVTDVWS | 23.81 | VVDDAVTDIWS | 4.76 | | |
| HA | H16 | 430 | 0.79 | yes | 2 | 0 | 100 | VDDAVTDIWSY | 76.19 | VDDAVTDVWSY | 23.81 | | | | |
| HA | H16 | 431 | 0.79 | yes | 2 | 0 | 100 | DDAVTDIWSYN | 76.19 | DDAVTDVWSYN | 23.81 | | | | |
| HA | H16 | 432 | 0.79 | yes | 2 | 0 | 100 | DAVTDIWSYNA | 76.19 | DAVTDVWSYNA | 23.81 | | | | |
| HA | H16 | 433 | 0.79 | yes | 2 | 0 | 100 | AVTDIWSYNAK | 76.19 | AVTDVWSYNAK | 23.81 | | | | |
| HA | H16 | 434 | 0.79 | yes | 2 | 0 | 100 | VTDIWSYNAKL | 76.19 | VTDVWSYNAKL | 23.81 | | | | |
| HA | H16 | 435 | 0.79 | yes | 2 | 0 | 100 | TDIWSYNAKLL | 76.19 | TDVWSYNAKLL | 23.81 | | | | |
| HA | H16 | 436 | 0.79 | yes | 2 | 0 | 100 | DIWSYNAKLLV | 76.19 | DVWSYNAKLLV | 23.81 | | | | |
| HA | H16 | 437 | 0.79 | yes | 2 | 0 | 100 | IWSYNAKLLVL | 76.19 | VWSYNAKLLVL | 23.81 | | | | |
| HA | H16 | 438 | 0.99 | yes | 2 | 0 | 100 | WSYNAKLLVLL | 57.14 | WSYNAKLLVLE | 42.86 | | | | |
| HA | H16 | 439 | 0.99 | yes | 2 | 0 | 100 | SYNAKLLVLLE | 57.14 | SYNAKLLVLLE | 42.86 | | | | |
| HA | H16 | 440 | 0.99 | yes | 2 | 0 | 100 | YNAKLLVLIEN | 57.14 | YNAKLLVLLEN | 42.86 | | | | |
| HA | H16 | 441 | 1.31 | yes | 3 | 0 | 100 | NAKLLVLIEND | 57.14 | NAKLLVLENG | 33.33 | NAKLLVLEND | 9.52 | | |

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H16 | 493 | 0.45 | yes | 2 | 0 | 100 | SCMETIRNGTY | 90.48 | SCMEAIRNGTY | 9.52 | | | | |
| HA | H16 | 494 | 0.45 | yes | 2 | 0 | 100 | CMETIRNGTYN | 90.48 | CMEAIRNGTYN | 9.52 | | | | |
| HA | H16 | 495 | 0.45 | yes | 2 | 0 | 100 | METIRNGTYNH | 90.48 | MEAIRNGTYNH | 9.52 | | | | |
| HA | H16 | 496 | 0.45 | yes | 2 | 0 | 100 | ETIRNGTYNHE | 90.48 | EAIRNGTYNHE | 9.52 | | | | |
| HA | H16 | 497 | 0.45 | yes | 2 | 0 | 100 | TIRNGTYNHED | 90.48 | AIRNGTYNHED | 9.52 | | | | |
| HA | H16 | 498 | 0 | yes | 1 | 0 | 100 | IRNGTYNHEDY | 100 | | | | | | |
| HA | H16 | 499 | — | yes | — | 0 | 100 | RNGTYNHEDYK | 52.38 | RNGTYNHEDYR | 47.62 | | | | |
| HA | H16 | 500 | — | yes | — | 0 | 100 | NGTYNHEDYKE | 52.38 | NGTYNHEDYRE | 47.62 | | | | |
| HA | H16 | 501 | — | yes | — | 0 | 100 | GTYNHEDYKEE | 52.38 | GTYNHEDYREE | 47.62 | | | | |
| HA | H16 | 502 | — | yes | — | 0 | 100 | TYNHEDYKEES | 52.38 | TYNHEDYREES | 47.62 | | | | |
| HA | H16 | 503 | — | yes | — | 0 | 100 | YNHEDYKEESQ | 52.38 | YNHEDYREESQ | 47.62 | | | | |
| HA | H16 | 504 | — | yes | — | 0 | 100 | NHEDYKEESQL | 52.38 | NHEDYREESQL | 47.62 | | | | |
| HA | H16 | 505 | — | yes | — | 0 | 100 | HEDYKEESQLK | 52.38 | HEDYREESQLK | 47.62 | | | | |
| HA | H16 | 506 | 1.22 | yes | 3 | 0 | 100 | EDYKEESQLKR | 52.38 | EDYREESQLKR | 42.86 | EDYREESQLKK | 4.76 | | |
| HA | H16 | 507 | 1.22 | yes | 3 | 0 | 100 | DYKEESQLKRQ | 52.38 | DYREESQLKRQ | 42.86 | DYREESQLKKQ | 4.76 | | |
| HA | H16 | 508 | 1.22 | yes | 3 | 0 | 100 | YKEESQLKRQE | 52.38 | YREESQLKRQE | 42.86 | YREESQLKKQE | 4.76 | | |
| HA | H16 | 509 | 1.22 | yes | 3 | 0 | 100 | KEESQLKRQEI | 52.38 | REESQLKRQEI | 42.86 | REESQLKKQEI | 4.76 | | |
| HA | H16 | 510 | 0.28 | yes | 2 | 0 | 100 | EESQLKRQEIE | 95.24 | EESQLKKQEIE | 4.76 | | | | |
| HA | H16 | 511 | 0.28 | yes | 2 | 0 | 100 | ESQLKRQEIEG | 95.24 | ESQLKKQEIEG | 4.76 | | | | |
| HA | H16 | 512 | 0.28 | yes | 2 | 0 | 100 | SQLKRQEIEGI | 95.24 | SQLKKQEIEGI | 4.76 | | | | |
| HA | H16 | 513 | 0.28 | yes | 2 | 0 | 100 | QLKRQEIEGIK | 95.24 | QLKKQEIEGIK | 4.76 | | | | |
| HA | H16 | 514 | 0.28 | yes | 2 | 0 | 100 | LKRQEIEGIKL | 95.24 | LKKQEIEGIKL | 4.76 | | | | |
| HA | H16 | 515 | 0.28 | yes | 2 | 0 | 100 | KRQEIEGIKLK | 95.24 | KKQEIEGIKLK | 4.76 | | | | |
| HA | H16 | 516 | 0.55 | yes | 2 | 0 | 100 | RQEIEGIKLKT | 90.48 | RQEIEGIKLKS | 4.76 | ROEIEGIKLKS | 4.76 | | |
| HA | H16 | 517 | 0.28 | yes | 2 | 0 | 100 | QEIEGIKLKTE | 95.24 | QEIEGIKLKSE | 4.76 | | | | |
| HA | H16 | 518 | 0.28 | yes | 2 | 0 | 100 | EIEGIKLKTED | 95.24 | EIEGIKLKSED | 4.76 | | | | |
| HA | H16 | 519 | 0.28 | yes | 2 | 0 | 100 | IEGIKLKTEDN | 95.24 | IEGIKLKSEDN | 4.76 | | | | |
| HA | H16 | 520 | 0.72 | yes | 3 | 0 | 100 | EGIKLKTEDNY | 85.71 | EGIKLKSEDNY | 9.52 | EGIKLKSEDNV | 4.76 | | |
| HA | H16 | 521 | 0.72 | yes | 3 | 0 | 100 | GIKLKTEDNYY | 85.71 | GIKLKSEDNYY | 9.52 | GIKLKSEDNVY | 4.76 | | |
| HA | H16 | 522 | 0.72 | yes | 3 | 0 | 100 | IKLKTEDNYYK | 85.71 | IKLKSEDNYYK | 9.52 | IKLKSEDNVYK | 4.76 | | |
| HA | H16 | 523 | 1.57 | yes | 4 | 0 | 100 | KLKTEDNYYKI | 47.62 | KLKTEDNYYKV | 38.1 | KLKSEDNYYKV | 9.52 | KLKSEDNVYKV | 4.76 |
| HA | H16 | 524 | 1.57 | yes | 5 | 0 | 100 | LKTEDNYYKIL | 47.62 | LKTEDNYYKVL | 38.1 | LKSEDNYYKVL | 9.52 | LKSEDNVYKVL | 4.76 |
| HA | H16 | 525 | 1.92 | yes | 4 | 0 | 100 | KTEDNYYKILS | 38.1 | KTEDNYYKVLS | 38.1 | KTEDNVYKVLS | 9.52 | KTEDNVYKVLA | 4.76 |
| HA | H16 | 526 | 1.92 | yes | 4 | 0 | 100 | TEDNYYKILSI | 38.1 | TEDNYYKVLSI | 38.1 | TEDNVYKVLSI | 9.52 | TEDNYYKVLAI | 4.76 |
| HA | H16 | 527 | 1.7 | yes | 4 | 0 | 100 | EDNYYKILSIY | 38.1 | EDNYYKVLSIY | 38.1 | EDNVYKILSIY | 9.52 | EDNIYKILSIY | 9.52 |
| HA | H16 | 528 | 1.7 | yes | 4 | 0 | 100 | DNYYKILSIYS | 38.1 | DNYYKVLSIYS | 38.1 | DNVYKVLSIYS | 9.52 | DNIYKILSIYS | 9.52 |
| HA | H16 | 529 | 1.7 | yes | 4 | 0 | 100 | NYYKILSIYSC | 38.1 | NYYKVLSIYSC | 38.1 | NVYKVLSIYSC | 9.52 | NIYKILSIYSC | 9.52 |
| HA | H16 | 530 | 1.7 | yes | 4 | 0 | 100 | YYKILSIYSCI | 38.1 | YYKVLSIYSCI | 38.1 | VYKVLSIYSCI | 9.52 | IYKILSIYSCI | 9.52 |
| HA | H16 | 531 | 1.36 | yes | 3 | 0 | 100 | YKILSIYSCIA | 42.86 | YKVLSIYSCIA | 42.86 | YKVLAIYSCIA | 9.52 | | |
| HA | H16 | 532 | 1.36 | yes | 3 | 0 | 100 | KILSIYSCIAS | 47.62 | KVLSIYSCIAS | 47.62 | KVLAIYSCIAS | 9.52 | | |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H | 32 | 0 | no | 1 | 99.96 | 100 | ITNGTTGNPII | 100 | | | | | | |
| HA | H | 33 | 0 | no | 1 | 99.96 | 100 | TNGTTGNPIIC | 100 | | | | | | |
| HA | H | 34 | 0 | no | 1 | 99.96 | 100 | NGTTGNPIICL | 100 | | | | | | |
| HA | H | 35 | 0 | no | 1 | 99.96 | 100 | GTTGNPIICLG | 100 | | | | | | |
| HA | H | 36 | 0 | no | 1 | 99.96 | 100 | TTGNPIICLGH | 100 | | | | | | |
| HA | H | 37 | 0 | no | 1 | 99.96 | 100 | TGNPIICLGHH | 100 | | | | | | |
| HA | H | 305 | 0.85 | no | 2 | 99.89 | 100 | SNAPSGIEYNG | 72.73 | SNAPSGVEYNG | 27.27 | | | | |
| HA | H | 306 | 0.85 | no | 2 | 99.89 | 100 | NAPSGIEYNGK | 72.73 | NAPSGVEYNGK | 27.27 | | | | |
| HA | H | 307 | 0.85 | no | 2 | 99.89 | 100 | APSGIEYNGKS | 72.73 | APSGVEYNGKS | 27.27 | | | | |
| HA | H | 308 | 0.85 | no | 2 | 99.89 | 100 | PSGIEYNGKSL | 72.73 | PSGVEYNGKSL | 27.27 | | | | |
| HA | H | 309 | 0.85 | no | 2 | 99.89 | 100 | SGIEYNGKSLG | 72.73 | SGVEYNGKSLG | 27.27 | | | | |
| HA | H | 310 | 0 | no | 1 | 99.89 | 100 | GIEYNGKSLGI | 100 | | | | | | |
| HA | H | 311 | 0 | no | 1 | 99.89 | 100 | IEYNGKSLGIQ | 100 | | | | | | |
| HA | H | 312 | 0 | no | 1 | 99.89 | 100 | EYNGKSLGIQS | 100 | | | | | | |
| HA | H | 313 | 0 | no | 1 | 99.89 | 100 | YNGKSLGIQSD | 100 | | | | | | |
| HA | H | 314 | 0 | no | 1 | 99.89 | 100 | NGKSLGIQSDA | 100 | | | | | | |
| HA | H | 343 | 0 | no | 1 | 99.99 | 100 | TSLTSLPFQNI | 100 | | | | | | |
| HA | H | 344 | 0 | no | 1 | 99.99 | 100 | SLTSLPFQNIH | 100 | | | | | | |
| HA | H | 345 | 0 | no | 1 | 99.99 | 100 | LTSLPFQNIHP | 100 | | | | | | |
| HA | H | 386 | 0.08 | yes | 2 | 0.1 | 99.37 | RGLFGAIAGFI | 99.37 | LFGAIAGFIEN | 2.54 | | | | |
| HA | H | 387 | 0.07 | yes | 2 | 0.09 | 99.43 | GLFGAIAGFIE | 99.43 | FGAIAGFIENG | 2.54 | | | | |
| HA | H | 388 | 0.25 | yes | 3 | 0.09 | 99.41 | LFGAIAGFIEG | 96.87 | GAIAGFIENGW | 2.54 | AIAGFIENGWE | 2.5 | | |
| HA | H | 389 | 0.24 | yes | 3 | 0.08 | 99.44 | FGAIAGFIEGG | 96.9 | AIAGFIENGWP | 3.53 | IAGFIENGWEG | 2.5 | | |
| HA | H | 390 | 0.23 | yes | 3 | 0.06 | 99.53 | GAIAGFIEGGW | 96.99 | IAGFIEGGWPG | 3.54 | AGFIENGWEGM | 2.44 | | |
| HA | H | 391 | 0.47 | yes | 5 | 0.11 | 99.39 | AIAGFIEGGWT | 93.36 | AGFIEGGWPGL | 3.6 | GFIENGWEGMV | 2.76 | GFIEGGWPGLV | 2.42 |
| HA | H | 392 | 0.46 | yes | 5 | 0.11 | 99.41 | IAGFIEGGWTG | 93.37 | GFIEGGWPGLI | 12.13 | FIENGWEGMVD | 2.76 | FIEGGWPGLVA | 2.4 |
| HA | H | 393 | 0.47 | yes | 5 | 0.1 | 99.35 | AGFIEGGWTGM | 93.31 | FIEGGWPGLIN | 12.11 | IENGWEGMVDG | 2.76 | IEGGWPGLVAG | 2.4 |
| HA | H | 394 | 1.03 | yes | 5 | 0.1 | 99.21 | GFIEGGWTGMI | 81.06 | IEGGWPGLING | 12.21 | ENGWEGMVDGW | 2.76 | EGGWPGLVAGW | 2.41 |
| HA | H | 395 | 1.04 | yes | 5 | 0.1 | 99.14 | FIEGGWTGMID | 81.03 | EGGWPGLINGW | 12.21 | NGWEGMVDGWY | 2.76 | GGWPGLVAGWY | 2.41 |
| HA | H | 396 | 1.03 | yes | 5 | 0.11 | 99.14 | IEGGWTGMIDG | 81.03 | GGWPGLINGWY | 12.22 | GWEGMVDGWYG | 2.76 | GWPGLVAGWYG | 2.41 |
| HA | H | 397 | 1.03 | yes | 5 | 0.09 | 99.25 | EGGWTGMVDGW | 81.03 | GWPGLINGWYG | 12.22 | WEGMVDGWYGF | 2.76 | WPGLVAGWYGF | 2.41 |
| HA | H | 398 | 1.03 | yes | 5 | 0.09 | 99.25 | GGWTGMVDGWY | 81.05 | WPGLINGWYGY | 12.22 | EGMVDGWYGFQ | 2.76 | PGLVAGWYGFQ | 2.41 |
| HA | H | 399 | 1.04 | yes | 5 | 0.09 | 99.28 | GWTGMVDGWYG | 81.01 | PGLINGWYGYH | 12.2 | GMVDGWYGFRH | 2.76 | GLVAGWYGFQH | 2.41 |
| HA | H | 400 | 1.03 | yes | 5 | 0.05 | 99.2 | WTGMVDGWYGY | 80.98 | GLINGWYGYHH | 12.26 | | | | |
| HA | H | 401 | 0.59 | yes | 5 | 0.02 | 99.3 | TGMVDGWYGYH | 81.02 | YQAELLYAMEN | 2.42 | YNAQLLVLLEN | 1.88 | YNAKLLVLLEN | 1.87 |
| HA | H | 402 | 0 | no | 1 | 99.99 | 100 | GMVDGWYGYHH | 92.29 | | | | | | |
| HA | H | 480 | 0 | no | 1 | 99.99 | 100 | YNAELLVLLEN | 100 | | | | | | |
| HA | H | 604 | 0 | no | 1 | 99.99 | 100 | LCSVEYASKTR | 100 | | | | | | |
| HA | H | 605 | 0 | no | 1 | 99.99 | 100 | CSVEYASKTRI | 100 | | | | | | |
| HA | H | 606 | 0 | no | 1 | 99.99 | 100 | SVEYASKTRIS | 100 | | | | | | |

Fig. 75-130

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H | 607 | 0 | no | 1 | 99.99 | 100 | VEYASKTRISE | 100 | | | | | | |
| HA | H | 608 | 0 | no | 1 | 99.99 | 100 | EYASKTRISEI | 100 | | | | | | |
| HA | H | 610 | 1.92 | no | 4 | 99.95 | 100 | SLQCRICIRAD | 40 | SLQCRICIL

Fig. 75-131

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 48 | 0.2 | yes | 3 | 0.09 | 99.11 | EKNVTVTHSVN | 98.04 | ERNVTV

Fig. 75-132

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 360 | 0.05 | yes | 1 | 0.1 | 99.58 | GLFGAIAGFIE | 99.58 | | | | | | |
| HA | H1N1 | 361 | 0.06 | yes | 1 | 0.1 | 99.56 | LFGAIAGFIEG | 99.56 | | | | | | |
| HA | H1N1 | 362 | 0.05 | yes | 1 | 0.09 | 99.59 | FGAIAGFIEGG | 99.59 | | | | | | |
| HA | H1N1 | 363 | 0.04 | yes | 1 | 0.07 | 99.67 | GAIAGFIEGGW | 99.67 | | | | | | |
| HA | H1N1 | 364 | 0.06 | yes | 1 | 0.12 | 99.58 | AIAGFIEGGWT | 99.57 | | | | | | |
| HA | H1N1 | 365 | 0.06 | yes | 1 | 0.11 | 99.58 | IAGFIEGGWTG | 99.57 | | | | | | |
| HA | H1N1 | 366 | 0.06 | yes | 1 | 0.12 | 99.51 | AGFIEGGWTGM | 99.51 | | | | | | |
| HA | H1N1 | 367 | 0.57 | yes | 2 | 0.1 | 99.38 | GFIEGGWTGMV | 99.38 | GFIEGGWTGMI | 10.84 | | | | |
| HA | H1N1 | 368 | 0.57 | yes | 2 | 0.1 | 99.39 | FIEGGWTGMVD | 99.39 | FIEGGWTGMID | 10.85 | | | | |
| HA | H1N1 | 369 | 0.57 | yes | 2 | 0.12 | 99.39 | IEGGWTGMVDG | 99.39 | IEGGWTGMIDG | 10.85 | | | | |
| HA | H1N1 | 370 | 0.56 | yes | 2 | 0.1 | 99.48 | EGGWTGMVDGW | 99.48 | EGGWTGMIDGW | 10.93 | | | | |
| HA | H1N1 | 371 | 0.56 | yes | 2 | 0.1 | 99.51 | GGWTGMVDGWY | 99.51 | GGWTGMIDGWY | 10.93 | | | | |
| HA | H1N1 | 372 | 0.57 | yes | 2 | 0.1 | 99.48 | GWTGMVDGWYG | 99.48 | GWTGMIDGWYG | 10.95 | | | | |
| HA | H1N1 | 373 | 0.56 | yes | 2 | 0.09 | 99.47 | WTGMVDGWYGY | 99.47 | WTGMIDGWYGY | 10.93 | | | | |
| HA | H1N1 | 374 | 0.56 | yes | 2 | 0.1 | 99.45 | TGMVDGWYGYH | 99.45 | TGMIDGWYGYH | 10.97 | | | | |
| HA | H1N1 | 375 | 0.56 | yes | 2 | 0.04 | 99.55 | GMVDGWYGYHH | 99.55 | GMIDGWYGYHH | 11.02 | | | | |
| HA | H1N1 | 376 | 0.58 | yes | 2 | 0.04 | 99.34 | MVDGWYGYHHQ | 99.34 | MIDGWYGYHHQ | 10.87 | | | | |
| HA | H1N1 | 377 | 0.57 | yes | 2 | 0.04 | 99.44 | VDGWYGYHHQN | 99.44 | IDGWYGYHHQN | 10.95 | | | | |
| HA | H1N1 | 378 | 0.27 | yes | 2 | 0.04 | 99.03 | DGWYGYHHQNE | 99.03 | DGWYGYHHQNE | 2.39 | | | | |
| HA | H1N1 | 379 | 0.27 | yes | 2 | 0.01 | 99 | GWYGYHHQNEQ | 99 | GWYGYHHQNEQ | 2.39 | | | | |
| HA | H1N1 | 380 | 0.28 | yes | 3 | 0.01 | 99.56 | WYGYHHQNEQG | 99.56 | WYGYHHQNAQG | 2.39 | WYGYHHQNAQG | 0.56 | | |
| HA | H1N1 | 381 | 0.28 | yes | 3 | 0.01 | 99.5 | YGYHHQNEQGS | 99.5 | YGYHHQNAQGS | 2.39 | YGHHQNAQGSG | 0.56 | | |
| HA | H1N1 | 382 | 0.28 | yes | 3 | 0.01 | 99.5 | GYHHQNEQGSG | 99.5 | GYHHQNAQGSG | 2.39 | GYHHQNAQGSG | 0.56 | | |
| HA | H1N1 | 383 | 0.28 | yes | 3 | 0.02 | 99.45 | YHHQNEQGSGY | 99.45 | YHHQNAQGSGY | 2.39 | HHQNAQGSGYA | 0.56 | | |
| HA | H1N1 | 384 | 0.28 | yes | 3 | 0.02 | 99.47 | HHQNEQGSGYA | 99.47 | HHQNAQGSGYA | 2.39 | HQNAQGSGYAA | 0.56 | | |
| HA | H1N1 | 385 | 0.28 | yes | 3 | 0.02 | 99.48 | HQNEQGSGYAA | 99.48 | HQNAQGSGYAA | 2.39 | ONAQGSGYAAD | 0.56 | | |
| HA | H1N1 | 386 | 0.28 | yes | 3 | 0.02 | 99.49 | QNEQGSGYAAD | 99.48 | ONAQGSGYAAD | 2.38 | NEQGSGYAADR | 2.27 | NAQGSGYAADL | 1.38 |
| HA | H1N1 | 387 | 1.19 | yes | 3 | 0.02 | 99.21 | NEQGSGYAADL | 99.21 | NGQGSGYAADQ | 2.39 | EQGSGYAADRK | 2.27 | AQGSGYAADLK | 1.37 |
| HA | H1N1 | 388 | 1.21 | yes | 3 | 0.02 | 99.06 | EQGSGYAADLK | 99.06 | GQGSGYAADQK | 24.89 | QGSGYAADRKS | 1.4 | | |
| HA | H1N1 | 389 | 1.03 | yes | 3 | 0.02 | 99.18 | QGSGYAADLKS | 99.18 | QGSGYAADQKS | 24.75 | GSGYAADRKST | 1.4 | | |
| HA | H1N1 | 390 | 1.03 | yes | 5 | 0.02 | 99.19 | GSGYAADLKST | 99.19 | GSGYAADQKST | 27.03 | SGYAADRKSTQ | 1.4 | | |
| HA | H1N1 | 391 | 1.03 | yes | 5 | 0.02 | 99.19 | SGYAADLKSTQ | 99.19 | SGYAADQKSTQ | 27.04 | | | | |
| HA | H1N1 | 409 | 0.26 | yes | 3 | 0.07 | 99.1 | NKVNSIEKMN | 99.1 | NKVNSIEKMN | 1.57 | NKVNTVIEKMN | 0.18 | NSIEKMNIQF | 0.13 |
| HA | H1N1 | 412 | 0.37 | yes | 5 | 0.07 | 99.14 | NSVIEKMNIQF | 95.76 | NSVIEKMN | 1.65 | NSVVEKMNTQF | 1.41 | SIIEKMNIQFT | 0.18 |
| HA | H1N1 | 413 | 0.38 | yes | 5 | 0.07 | 99.13 | SVIEKMNIQFT | 95.7 | SIIEKMNIQF | 1.7 | SVVEKMNTQFT | 1.41 | MNTQFTSVGKE | 0.18 |
| HA | H1N1 | 418 | 0.3 | yes | 5 | 0.12 | 99.03 | MNTQFTAVGKE | 96.94 | MNIQFTSVGKE | 1.35 | MNIQFTAVGKE | 0.46 | NTQFTVWGKEF | 0.13 |
| HA | H1N1 | 419 | 0.3 | yes | 5 | 0.12 | 99.05 | NTQFTAVGKEF | 96.96 | NIQFTSVGKEF | 1.36 | NIQFTAVGKEF | 0.46 | RIESLNKKVDD | 0.13 |
| HA | H1N1 | 435 | 1.01 | yes | 4 | 0.17 | 99.41 | RIENLNKKVDD | 75.25 | RMENLNKKVDD | 21.84 | RIENLNRKVDD | 1.33 | | |
| HA | H1N1 | 436 | 1.01 | yes | 5 | 0.17 | 99 | IENLNKKVDDG | 75.28 | MENLNKKVDDG | 21.83 | IENLNRKVDDG | 1.33 | | |
| HA | H1N1 | 437 | 0.32 | yes | 4 | 0.13 | 99.18 | ENLNKKVDDGF | 96.34 | ENLNKKVDDGL | 1.31 | ENLNRKVDDGF | 0.96 | RIESLNKKVDD | 0.43 |

Fig. 75-133

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 438 | 0.79 | yes | 5 | 0.13 | 99.25 | NLNKKVD

Fig. 75-134

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 544 | 0.24 | yes | 2 | 0.1 | 99.29 | QIL

Fig. 75-135

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 7 | 0 | no | 1 | 99.93 | 100 | KQEFKMNPNQK | 100 | | | | | | |
| NA | H1N1 | 8 | 0 | no | 1

Fig. 75-136

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 163 | 0.98 | yes | 3 | 0.08 | 99.2 | RSPYRTLMSCP | 70.87 | RSPYRTLMSCP | 27.96 | | | | |
| NA | H1N1 | 169 | 1.5 | yes | 4

Fig. 75-137

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N1 | 238 | 1.71 | yes | 5 | 0.03 | 99.01 | QESECVCNGS | 61.19 | QESECVCNGS | 18.35 | QESECVCN

Fig. 75-138

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N1 | 421 | 0.96 | yes | 5 | 0.02 | 99.09 | QHPELTGLDCI | 83.1 | QHPELTGLDCM | 7.61 | QHPEL

Fig. 75-139

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H1N2 | 349 | 0.03 | yes | 1 | 0 | 99.71 | AIAGFIEGGWT | 99.71 | | | | | | |
| HA | H1N2 | 350 | 0.03 | yes | 1 | 0 | 99.71 | IAGFIEGGWTG | 99.71 | | | | | | |
| HA | H1N2 | 351 | 0.03 | yes | 1 | 0 | 99.71 | AGFIEGGWTGM | 99.71 | | | | | | |
| HA | H1N2 | 352 | 1.03 | yes |

Fig. 75-140

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 96 | 0.3 | yes | 4 | 0 | 99.15 | TGF

Fig. 75-141

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 177 | 1.07 | yes | 3 | 0 | 99.44 | IAWSSSCHDG | 76.27 | MAWSSSCHDG | 11.86 | IAWSSSCHDG | 11.3 | |

Fig. 75-142

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H1N2 | 439 | 0.14 | yes |

Fig. 75-143

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 77 | 0.04 | yes | 1 | 0 | 99.58 | CSIAGWLLGNP | 99.58 | SIAGWLLGNPK | 99.58 | | | | |

Fig. 75-144

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 308 | 0.96 | yes | 2 | 0 | 99.58 | TTLPFHNIHPL | 65.69 | TTLPFHNIHPL | 33.89 | | | | |
| HA

Fig. 75-145

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 370 | 0.21 | yes | 2 | 0 | 99.58 | GYHHSNDQGSG | 97.07 | GYHHSNDQGAG | 2.51 | | | | |
| HA | H2 | 371 | 0.21 | yes | 2 | 0 | 99.58 | YHHSNDQGSGY | 97.07 | YHHSNDQGAGY | 2.51 | | | | |
| HA | H2 | 372 | 0.21 | yes | 2 | 0 | 99.58 | HHSNDQGSGYA | 97.07 | HHSNDQGAGYA | 2.51 | | | | |
| HA | H2 | 373 | 0.21 | yes | 2 | 0 | 99.58 | HSNDQGSGYAA | 97.07 | HSNDQGAGYAA | 2.51 | | | | |
| HA | H2 | 374 | 0.21 | yes | 2 | 0 | 99.58 | SNDQGSGYAAD | 97.07 | SNDQGAGYAAD | 2.51 | | | | |
| HA | H2 | 375 | 0.21 | yes | 2 | 0 | 99.58 | NDQGSGYAADK | 97.07 | NDQGAGYAADK | 2.51 | | | | |
| HA | H2 | 376 | 0.39 | yes | 3 | 0 | 99.16 | DQGSGYAADKE | 94.56 | DQGAGYAADKE | 2.51 | DQGSGYAADKA | 2.51 | | |
| HA | H2 | 377 | 0.35 | yes | 3 | 0 | 99.58 | QGSGYAADKES | 94.98 | QGAGYAADKES | 2.51 | QGSGYAADKAS | 2.09 | | |
| HA | H2 | 378 | 0.35 | yes | 3 | 0 | 99.58 | GSGYAADKEST | 94.98 | GAGYAADKEST | 2.51 | GGYAADKAST | 2.09 | | |
| HA | H2 | 379 | 0.47 | yes | 3 | 0 | 99.58 | SGYAADKESTQ | 92.47 | AGYAADKESTQ | 5.02 | SGYAADKASTQ | 2.09 | | |
| HA | H2 | 380 | 0.47 | yes | 3 | 0 | 99.58 | GYAADKESTQK | 92.47 | GYAADKESTOR | 5.02 | GYAADKASTQK | 2.09 | | |
| HA | H2 | 381 | 1.1 | yes | 4 | 0 | 99.16 | YAADKESTQKA | 71.55 | YAADIKESTQKA | 24.27 | SLERRLENLNK | 2.51 | | |
| HA | H2 | 419 | 0.98 | yes | 4 | 0 | 99.16 | NLERRLENLNK | 73.64 | NLEKRLGNLNK | 24.27 | NLEKRLGNLNK | 0.84 | | |
| HA | H2 | 420 | 0.28 | yes | 4 | 0 | 99.16 | LERRLENLNKK | 96.65 | LEKRLGNLNKK | 1.26 | LERRLENLSKR | 0.84 | | |
| HA | H2 | 423 | 0.28 | yes | 4 | 0 | 99.16 | RLENLNKKMED | 96.65 | RLGNLNKKMED | 1.26 | RLENLDKKMED | 0.84 | | |
| HA | H2 | 424 | 0.32 | yes | 4 | 0 | 99.16 | LENLNKKMEDG | 96.23 | LGNLNKKMEDG | 1.26 | ENLNKRMEDG | 0.84 | ENLNKRMEDGF | 0.42 |
| HA | H2 | 425 | 0.26 | yes | 3 | 0 | 99.16 | ENLNKKMEDGF | 96.23 | ENLNKKVEDGF | 0.84 | ENLNKKMEDGL | 0.84 | | |
| HA | H2 | 438 | 0.22 | yes | 3 | 0 | 97.07 | VWTYNAELLVL | 97.07 | VWTYNELLVL | 0.84 | MWTYNAELLVL | 0.84 | | |
| HA | H2 | 439 | 0.18 | yes | 3 | 0 | 97.49 | WTYNAELLVLM | 97.49 | WTYNELLVLM | 0.84 | | | | |
| HA | H2 | 440 | 0.18 | yes | 3 | 0 | 97.49 | TYNAELLVLME | 97.49 | TYNVELLVLME | 0.84 | | | | |
| HA | H2 | 441 | 0.25 | yes | 3 | 0 | 97.91 | YNAELLVLMEN | 97.91 | YNVELLVLMEN | 0.84 | | | | |
| HA | H2 | 442 | 0.18 | yes | 3 | 0 | 97.91 | NAELLVLMENE | 97.91 | NVELLVLMENE | 0.84 | AELLVLMENEM | 0.84 | | |
| HA | H2 | 443 | 0.19 | yes | 3 | 0 | 97.06 | AELLVLMENER | 97.06 | AEVLVLMENER | 0.84 | | | | |
| HA | H2 | 444 | 0.38 | yes | 4 | 0 | 97.9 | ELLVLMENERT | 97.9 | ELLVLMENEMT | 0.84 | | | | |
| HA | H2 | 445 | 0.38 | yes | 4 | 0 | 97.9 | LLVLMENERTL | 97.9 | LVLMENEMTL | 0.84 | | | | |
| HA | H2 | 446 | 0.38 | yes | 4 | 0 | 97.9 | LVLMENERTLD | 97.9 | LVLMENEMTLD | 0.84 | VLMENERTLGF | 0.42 | VLMENERTLGF | 0.42 |
| HA | H2 | 447 | 0.38 | yes | 4 | 0 | 94.96 | VLMENERTLDF | 94.96 | VLMENEMTLDF | 0.84 | LMENERTLFH | 0.42 | LMENERTLFH | 0.42 |
| HA | H2 | 448 | 0.38 | yes | 4 | 0 | 94.96 | LMENERTLDFH | 94.96 | LMENEMTLDFH | 0.84 | MENERTLDFHD | 0.42 | MENERTLDFH | 0.42 |
| HA | H2 | 449 | 0.38 | yes | 4 | 0 | 94.96 | MENERTLDFHD | 94.96 | MENEMTLDFHD | 0.84 | ENERTLDFHDS | 0.42 | ENERTLDFHDS | 0.42 |
| HA | H2 | 450 | 0.42 | yes | 4 | 0.42 | 94.94 | ENERTLDFHDS | 94.94 | ENEMTLDFHDS | 0.84 | NERTLDFHDSN | 0.42 | NERILDFHDSN | 0.42 |
| HA | H2 | 451 | 0.42 | yes | 4 | 0.42 | 94.51 | NERTLDFHDSN | 94.51 | ERILDFHDSNV | 0.84 | ERT

Fig. 75-146

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2 | 476 | 1.68 | yes | 5 | 0 | 99.16 | NAKEIGNGCFE | 50.21 | NAKELGNGCFE | 28.87 | NAKEVGNGCFE | 17.6 | NAKETGNGCFE | 1.26 |
| HA | H2 | 477 | 1.68 | yes | 5 | 0 | 99.16 | AKEIGNGCFEF | 50.21 | AKELGNGCF

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 56 | 0.93 | yes | 3 | 0 | 100 | LCKLNGIPPLE | 78.95 | LCRLSGIPPLE | 78.95 | LCRLRGIPPLE | 14.91 | | |
| HA | H

Fig. 75-149

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 251 | 1.23 | yes | 4 | 0 | 100 | DTINFES

Fig. 75-150

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 305 | 1.03 | yes |

Fig. 75-151

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 349 | 0.56 | yes | 2 | 0 | 100 | FIEGGWQGMYD | 86.84 | FIEGGWQGMID | 13

Fig. 75-152

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H2N2 | 430 | 0.14 | yes | 2 | 0 | 99.12 | DWT

Fig. 75-153

| Protein | Sub-type | Start Pos | Block Entropy | Gaps >10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 474 | 0.07 | yes |

Fig. 75-154

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H2N2 | 527 | 0.07 | yes | 1 | 0 | 99.12 | LAIYAT

Fig. 75-155

| Protein | Sub-type | Start Pos | Block Entropy | Gaps > 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 96 | 0.06 | yes | 1 | 0 | 99.31 | GFAPFSKDNSI | 99.31 | | | | | | |

Fig. 75-156

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 152 | 0.25 | yes | 3 | 0 | 100 | RIPHRTLLMNE | 96.55 | RTPHRTLLMNE | 2.07 | RSPHRTLLMNE | 2.07 | | |
| NA | H2N2 | 153

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 265 | 1.48 | yes | 5 | 0 | 99.31 | ISPLSGSAQHI | 48.28 | IGPLSGSAQHI | 43.45 | ISPLA

| Protein | Sub-type | Start Pos | Block Entropy | Gaps < 10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| NA | H2N2 | 441 | 0.17 | yes | 2 | 0.69 | 99.31 | NSIWFCGTSG | 97.92 | NSIAVFCGTSG | 1.39 | | | | |
| NA | H2N2 | 442 | 0.11 | yes | 2 | 0.69 | 100 | SIWFCGTSGT | 98.61 | SIAVFCGTSGT | 1.39 | | | | |
| NA | H2N2 | 443 | 0.11 | yes | 2 | 0.69 | 100 | IWFCGTSGTY | 98.61 | IAVFCGTSGTY | 1.39 | | | | |
| NA | H2N2 | 444 | 0.11 | yes | 2 | 0.69 | 100 | WFCGTSGTYG | 98.61 | AVFCGTSGTYG | 1.39 | | | | |
| NA | H2N2 | 445 | 0.06 | yes | 1 | 0.69 | 99.31 | FCGTSGTYGT | 99.31 | | | | | | |
| NA | H2N2 | 446 | 0.06 | yes | 1 | 0.69 | 99.31 | CGTSGTYGTG | 99.31 | | | | | | |
| NA | H2N2 | 447 | 0.06 | yes | 1 | 0.69 | 99.31 | GTSGTYGTGS | 99.31 | | | | | | |
| NA | H2N2 | 448 | 0.06 | yes | 1 | 0.69 | 99.31 | TSGTYGTGSW | 99.31 | | | | | | |
| NA | H2N2 | 449 | 0.06 | yes | 1 | 0.69 | 99.31 | SGTYGTGSWP | 99.31 | | | | | | |
| NA | H2N2 | 450 | 0.06 | yes | 1 | 0.69 | 99.31 | GTYGTGSWPD | 99.31 | | | | | | |
| NA | H2N2 | 451 | 0.06 | yes | 1 | 0.69 | 99.31 | TYGTGSWPDG | 99.31 | | | | | | |
| NA | H2N2 | 452 | 0.06 | yes | 1 | 0.69 | 99.31 | YGTGSWPDGA | 99.31 | | | | | | |
| NA | H2N2 | 453 | 0.21 | yes | 2 | 0.69 | 99.31 | GTGSWPDGAN | 97.22 | YGTGSWPDGAD | 2.08 | GKGSWPDGANI | 0.69 | | |
| NA | H2N2 | 454 | 0.27 | yes | 3 | 0.69 | 99.31 | TGSWPDGANI | 96.53 | GTGSWPDGADI | 2.08 | TGSWPDGANID | 1.39 | KGSWPDGANIN | 0.69 | TGSWPDGANTN | 0.69 |
| NA | H2N2 | 455 | 0.43 | yes | 5 | 0.69 | 99.31 | GSWPDGANIN | 94.44 | TGSWPDGANID | 2.08 | GSWPDGANIDF | 2.08 | GSWPDGANINF | 1.39 | GSWPDGANTNF | 0.69 |
| NA | H2N2 | 456 | 0.73 | yes | 5 | 0.69 | 99.31 | SWPDGANINF | 88.19 | GSWPDGANINL | 6.94 | SWPDGANIDF | 2.08 | SWPDGANIDFM | 2.08 | SWPDGANTNFM | 0.69 |
| NA | H2N2 | 457 | 0.73 | yes | 5 | 0.69 | 99.31 | WPDGANINFM | 88.19 | SWPDGANINLM | 6.94 | WPDGANIDFM | 2.08 | WPDGANIDFMP | 2.08 | WPDGANTNFMP | 0.69 |
| NA | H2N2 | 458 | 0.73 | yes | 5 | 0.69 | 99.31 | PDGANINFMP | 88.19 | WPDGANINLMP | 6.94 | PDGANINFMPI | 2.11 | PDGANIDFMPV | 0.7 | PDGANTNFMPI | 0.7 |
| NA | H2N2 | 459 | 0.69 | yes | 5 | 0.69 | 99.31 | PDGANINFMPI | 88.73 | PDGANINLMPI | 7.04 | | | | | |
| HA | H3 | 1 | 0 | no | 1 | 2.07 | 99.3 | MLSLIMRTVIA | 100 | | | | | | |
| HA | H3 | 2 | 0 | no | 1 | 99.98 | 100 | LSLIMRTVIAL | 100 | | | | | | |
| HA | H3 | 3 | 0 | no | 1 | 99.98 | 100 | SLIMRTVIALS | 100 | | | | | | |
| HA | H3 | 4 | 0 | no | 1 | 99.98 | 100 | LIMRTVIALSY | 50 | LIMRTVIALSY | 50 | | | | |
| HA | H3 | 5 | 0 | no | 1 | 99.96 | 100 | IMRTVIALSYI | 50 | SMSGFRSNLPG | 50 | | | | |
| HA | H3 | 11 | 0.92 | no | 2 | 99.8 | 100 | IFIFLLLTHWA | 80 | IFIFLLLTHWA | 10 | IFNFILLLTHWA | 10 | | |
| HA | H3 | 12 | 0.92 | no | 2 | 99.8 | 100 | FIFLLLTHWAY | 80 | FIFLLLTHWAY | 10 | FIFLLLTHWAY | 10 | | |
| HA | H3 | 14 | 0 | no | 1 | 99.96 | 100 | VLSCIFCLAFG | 50 | RFSYFCLALG | 50 | | | | |
| HA | H3 | 30 | 0 | no | 1 | 99.92 | 100 | NNNNTATLCL | 100 | | | | | | |
| HA | H3 | 33 | 0 | no | 1 | 99.94 | 100 | NNSTATLCLGH | 100 | | | | | | |
| HA | H3 | 36 | 0.38 | yes | 5 | 0.16 | 99.15 | TATLCLGHHAV | 95.32 | MATLCLGHHAV | 3.14 | TAMLCLGHHAV | 0.28 | DATLCLGHHAV | 0.24 | |
| HA | H3 | 37 | 0.46 | yes | 5 | 0.14 | 99.19 | ATLCLGHHAVP | 93.95 | ATLCLGHHAVA | 3.89 | ATLCLGHHAVQ | 0.67 | ATLCLGHHAVS | 0.44 | AMLCLGHHAVP | 0.44 |
| HA | H3 | 38 | 0.46 | yes | 5 | 0.14 | 99.17 | TLCLGHHAVPN | 93.93 | TLCLGHHAVAN | 3.89 | TLCLGHHAVQN | 0.67 | TLCLGHHAVSN | 0.44 | MLCLGHHAVPN | 0.44 |
| HA | H3 | 39 | 0.42 | yes | 5 | 0.14 | 99.33 | LCLGHHAVPNG | 94.32 | LCLGHHAVANG | 3.89 | LCLGHHAVQNG | 0.67 | CLGHHAVSNG | 0.44 | |
| HA | H3 | 40 | 0.41 | yes | 4 | 0.14 | 99.38 | CLGHHAVPNGT | 94.38 | CLGHHAVANGT | 2.68 | CLGHHAVQNGT | 0.67 | CLGHHAVSNGT | 0.44 | |
| HA | H3 | 58 | 0.39 | yes | 4 | 0 | 99.05 | DQIEVTNATEL | 95.36 | DHIEVTNATEL | 2.68 | DRIEVTNATEL | 0.57 | DNIEVTNATEL | | |
| HA | H3 | 59 | 0.42 | yes | 5 | 0.02 | 99.07 | QIEVTNATELV | 95.56 | HIEVTNATELV | 2.68 | RIEVTNATELV | 0.57 | | | |
| HA | H3 | 60 | 0.36 | yes | 4 | 0 | 99.27 | IEVTNATELVQ | 98.63 | VEVTNATELVQ | 0.63 | EVTNATELV | | | | |
| HA | H3 | 61 | 0.14 | yes | 2 | 0 | 99.01 | EVTNATELVQS | 92.77 | EVTNATELVQN | 3.39 | EVTNATELVQI | 2.06 | EVTNATELVQG | 0.79 | |
| HA | H3 | 87 | 0.53 | no | 4 | 99.98 | 100 | WEKNCTLIDAL | 100 | | | | | | |
| HA | H3 | 91 | 0.7 | yes | 4 | 0.04 | 99.05 | CTLIDALLGDP | 89.53 | CTLMDALLGDP | 4.4 | CTLVDALLGDP | 3.83 | CTLIDAMLGDP | 1.29 | |

Fig. 75-161

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 134 | 0.7 | yes | 5 | 0.06 | 99.11 | SLRSLVASSGT | 89.25 | SLRSLVASSGT | 5.25 | SLRSLVASSGT | 4.12 | SLRSLVGSSGT | 0.3 | SLRSLVGSSGT | 0.18 |
| HA | H3 | 135 | 0.72 | yes | 5 | 0.06 | 99.09 | LRSLVASSGTL | 89.29 | LRSIVASSGTL | 5.25 | LRSIVASSGTL | 3.39 | LRSLVASSGNL | 0.83 | LRSLVASSGNL | 0.32 |
| HA | H3 | 201 | 0.96 | yes | 5 | 0.06 | 99.19 | FDKLYWGVHH

Fig. 75-162

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3 | 389 | 1.43 | yes | 4 | 0.04 | 99.19 | EGTGQAADLKS | 62.43 | EGIGQAADLKS | 19.45 | EGMGQAADLKS | 17 | |

Fig. 75-163

| Protein | Sub-type | Start Pos | Block | Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|---|
| HA | H3 | 448 | | 0.3 | yes | 4 | 0.02 | 99.25 | DLWSYNAELL | 96.69 | VDLWSYNAELL | 1.23 | IDLWSYNAGLL | 1.03 | IDLWSYNADVL

Fig. 75-164

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 31 | 0.13 | yes | 2 | 0.1 | 99.15 | ATLCLGHHAVP

Fig. 75-165

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 318 | 0.77 | yes | 5 | 0.05 | 99.02 | NVNRITYGACP | 86.32 | NVNRITYGPCP | 10.19 | NVNRITYGV

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 436 | 0.18 | yes | 2 | 0 | 99.24 | YVEDTKIDLWS | 98.03 | YVEDTKIDLWSY | 1.22 | | | | |
| HA | H3N2 | 437 | 0.18 | yes | 2 | 0 | 99.24 | VEDTKIDLWSY | 98 | VEDTKIDLWSY | 1.24 | | | | |
| HA | H3N2 | 438 | 0.15 | yes | 2 | 0 | 99.54 | EDTKIDLWSYN | 98.29 | EDTKIDLWSYN | 1.24 | | | | |
| HA | H3N2 | 439 | 0.27 | yes | 2 | 0 | 99.51 | DTKIDLWSYNA | 98.27 | DTKIDLWSYNA | 1.24 | | | | |
| HA | H3N2 | 440 | 0.31 | yes | 3 | 0.02 | 99.34 | TKIDLWSYNAE | 96.83 | TKIDLWSYNAE | 1.27 | | | | |
| HA | H3N2 | 441 | 0.3 | yes | 3 | 0.02 | 99.02 | KIDLWSYNAEL | 96.56 | KIDLWSYNAEL | 1.24 | | | | |
| HA | H3N2 | 442 | 0.22 | yes | 3 | 0.02 | 99.07 | IDLWSYNAGLL | 96.59 | VDLWSYNAGLL | 1.22 | | | | |
| HA | H3N2 | 443 | 0.29 | yes | 3 | 0.05 | 99.2 | DLWSYNAELLV | 97.68 | DLWSYNAGLLV | 1.24 | | | | |
| HA | H3N2 | 444 | 0.24 | yes | 4 | 0.05 | 99.02 | LWSYNAELLVA | 97.51 | LWSYNAGLLVA | 1.24 | | | | |
| HA | H3N2 | 445 | 0.25 | yes | 4 | 0.05 | 99.02 | WSYNAEFLVAL | 97.42 | WSYNAEFLVAL | 1.27 | WSYNAEILVAL | 0.24 | | |
| HA | H3N2 | 446 | 0.26 | yes | 5 | 0.05 | 99.07 | SYNAELLVALE | 97.37 | SYNAEFLVALE | 1.27 | SYNAEILVALE | 0.17 | SYNAELLIALE | 0.12 |
| HA | H3N2 | 447 | 0.26 | yes | 5 | 0.05 | 99.02 | YNAEFLVALEN | 97.32 | YNAEFLVALEN | 1.27 | YNAEILVALEN | 0.17 | YNAELLIALEN | 0.12 |
| HA | H3N2 | 448 | 0.23 | yes | 5 | 0.05 | 99.1 | NAEILVALENQ | 97.39 | NAEFLVALENQ | 1.27 | NAEILVALENQ | 0.17 | NAELLIAMENQ | 0.12 |
| HA | H3N2 | 451 | 0.18 | yes | 3 | 0.07 | 99.15 | LLVALENQHTI | 98.44 | FLVALENQHTI | 0.22 | VLVALENQHTI | 0.2 | ILVALENQHTI | 0.15 |
| HA | H3N2 | 452 | 0.16 | yes | 3 | 0.05 | 99.17 | LVALENQHTID | 98.51 | LVALENQHTID | 0.22 | | | | |
| HA | H3N2 | 453 | 0.19 | yes | 3 | 0.05 | 99.1 | VALENQHTIDL | 98.27 | VALENQHTIDM | 0.22 | | | | |
| HA | H3N2 | 454 | 0.17 | yes | 3 | 0.05 | 99.15 | ALENQHTIDLT | 98.32 | ALENQHTIDMT | 0.22 | | | | |
| HA | H3N2 | 455 | 0.17 | yes | 3 | 0.05 | 99.15 | LENQHTIDLTD | 98.49 | | | | |

Fig. 75-168

| Protein | Sub-type | Start Pos | Block Entropy | Gaps < 10% | # to cover 99% | gap % | Coverage | Peptides included | Freq | Peptides included | Freq | Peptides included | Freq | Peptides included | Freq |
|---|---|---|---|---|---|---|---|---|---|---|---|---|---|---|---|
| HA | H3N2 | 489 | 0.3 | yes | 4 | 0 | 99.22 | GCKIY

Fig. 75-169

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 114 | 0.21 | yes | 4 | 0.09 | 99.01 | IRLSAGGDIWV | 98.03 | IRLAAGGDIWV | 0.58 | IRL

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 298 | 0.45 | yes | 4 | 0 | 99.57 | VRCVCRDNWKG | 93.45 | V

Fig. 75-172

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H3N2 | 464 | 0.57 | yes | 4 | 3.64 | 99.02 | YGTGSWPDGAD | 90.98 | YGSGWPDGAD | 6.91 | YGTGSWPDGAE

Fig. 75-173

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 178 | 1.11 | yes | 5 | 0 | 99.2 | QNLTKVNNGDY | 64.9

Fig. 75-174

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 324 | 0.24 | yes | 3 | 0 | 99.04 | VKQGSLKLATG | | VKQGSLRLATG | 0

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 425 | 0.26 | yes | 4 | 0 | 99.2 | EKYVEDTKIDL | 97.12 | E

Fig. 75-177

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 473 | 0.12 | yes | 2 | 0 | 99.68 | NAEDKGNGCFE | | NAEDRGNGCFE | 98.56 | | | | |
| HA | H4 | 474 | 0.14 | yes | 2 | 0 | 99.52 | AEDKGNGCFEI | | AEDRGNGCFEI | 98.4 | | | | |
| HA | H4 | 475 | 0.14 | yes | 2 | 0 | 99.52 | EDKGNGCFEIF | | EDRGNGCFEIF | 98.4 | | | | |
| HA | H4 | 476 | 0.12 | yes | 2 | 0 | 99.68 | DKGNGCFEIFH | | DRGNGCFEIFH | 98.56 | | | | |
| HA | H4 | 477 | 0.98 | yes | 3 | 0 | 99.52 | KGNGCFEIFHQ | | KGNGCFEIFHK | 77.4 | RGNGCFEIFHK | 2.4 | | |
| HA | H4 | 478 | 0.91 | yes | 4 | 0 | 99.04 | GNGCFEIFHQC | | GNGCFEIFHRC | 77.4 | | 2.4 | | |
| HA | H4 | 479 | 0.97 | yes | 3 | 0 | 99.04 | NGCFEIFHQCD | | NGCFEIFHRCD | 76.76 | | 2.4 | | |
| HA | H4 | 480 | 1 | yes | 5 | 0 | 99.04 | GCFEIFHQCDN | | GCFEIFHRCDN | 76.6 | GCFEIFHQCNN | 0.32 | | |
| HA | H4 | 488 | 0.81 | yes | 4 | 0 | 99.04 | CDNNCIESIRN | | CDNKCIESIRN | 84.13 | CDNTCIESIRN | 0.32 | CGNNCIESIRN | 0.32 |
| HA | H4 | 490 | 0.79 | yes | 2 | 0 | 99.04 | NCIESIRNGT | | NKCIESIRNGT | 84.46 | NTCIESIRNGT | 0.32 | NNCIESIRNGK | 0.16 |
| HA | H4 | 491 | 0.76 | yes | 4 | 0 | 99.04 | CIESIRNGTY | | KCIESIRNGTY | 84.78 | TCIESIRNGTY | 0.32 | | |
| HA | H4 | 492 | 0.28 | yes | 2 | 0 | 99.2 | IESIRNGTYN | | IESIRNGTYN | 95.99 | | | | |
| HA | H4 | 493 | 0.29 | yes | 2 | 0 | 99.2 | ESIRNGTYD | | ESIRNGTYNH | 95.83 | ESIRNGTYNHN | 0.96 | | |
| HA | H4 | 494 | 0.41 | yes | 3 | 0 | 99.04 | ESIRNGTYDH | | ESIRNGTYDHD | 94.71 | YRDEAINSRFQ | 1.6 | YRDDAINNRFQ | 0.32 |
| HA | H4 | 506 | 0.45 | yes | 5 | 0 | 99.04 | YRDEAINNRFQ | | YRDEAINNRFQ | 94.55 | YRNEAINNRFQI | 1.6 | RDDAINNRFQI | 0.32 |
| HA | H4 | 507 | 0.45 | yes | 5 | 0 | 99.04 | RDEAINNRFQI | | RDEAINSRFQI | 94.55 | RDEAINSRFQI | 1.6 | | |
| HA | H4 | 509 | 0.33 | yes | 4 | 0 | 99.04 | EAINNRFQIQG | | EAISNRFQIQG | 96.15 | DAINNRFQIQG | 0.8 | | |
| HA | H4 | 510 | 0.34 | yes | 4 | 0 | 99.04 | AINNRFQIQGV | | AISNRFQIQGV | 95.99 | AINNRFQIQGI | 0.8 | | |
| HA | H4 | 514 | 0.38 | yes | 5 | 0 | 99.04 | RFQIQGVKLTQ | | RFQIQGVRLTQ | 95.67 | RFQIQGVKLIQ | 0.96 | RFQIQGIKLTQ | 0.32 |
| HA | H4 | 515 | 0.38 | yes | 5 | 0 | 99.04 | FQIQGVKLTQG | | FQIQGVKLTQG | 95.67 | FQIQGVKLAQG | 0.96 | FQIQGIKLTQG | 0.32 |
| HA | H4 | 516 | 0.36 | yes | 4 | 0 | 99.04 | QIQGVKLTQGY | | QIQGVRLTQGY | 95.83 | QIQGVKLIQGY | 0.96 | QIQGIKLTQGY | 0.32 |
| HA | H4 | 517 | 0.36 | yes | 5 | 0 | 99.04 | IQGVKLTQGYK | | IQGVRLTQGYK | 95.83 | IQGVKLAQGYK | 0.96 | IQGIKLTQGYK | 0.32 |
| HA | H4 | 518 | 0.26 | yes | 3 | 0 | 99.04 | QGVKLTQGYKD | | QGVRLTQGYKD | 95.83 | QGVKLAQGYKD | 0.96 | QGIKLTQGYKD | 0.32 |
| HA | H4 | 521 | 0.17 | yes | 3 | 0 | 99.04 | KLTQGYKDIIL | | KLAQGYKDIIL | 97.12 | KLIQGYKDIIL | 0.8 | | |
| HA | H4 | 522 | 0.17 | yes | 2 | 0.16 | 99.04 | LTQGYKDIILW | | LAQGYKDIILW | 96.99 | LTQGYKDVILW | 0.32 | | |
| HA | H4 | 524 | 0.21 | yes | 3 | 0 | 99.04 | QGYKDIILWYS | | QGYKDIILWYS | 98.24 | OGYKDIILWFS | 0.48 | | |
| HA | H4 | 526 | 0.19 | yes | 3 | 0 | 99.04 | YKDIILWYSF | | GYKDIILWYSF | 98.24 | GYKDVILWYSF | 0.48 | | |
| HA | H4 | 527 | 0.14 | yes | 2 | 0 | 99.04 | YKDIILWYSFS | | YKDIILWYSFS | 97.92 | YKDVILWYSFS | 0.48 | | |
| HA | H4 | 528 | 0.19 | yes | 2 | 0 | 99.04 | KDIILWYSFSI | | KDIILWYSFSI | 98.08 | KDVILWYSFSI | 0.48 | IDVILWYSFSI | 0.32 |
| HA | H4 | 529 | 0.14 | yes | 2 | 0 | 99.04 | DIILWYSFSIS | | DIILWYSFSIS | 98.08 | DIILWYSFSMS | 0.32 | DIILWYSFSMS | 0.32 |
| HA | H4 | 530 | 0.12 | yes | 2 | 0 | 99.04 | IILWYSFSISC | | IILWYSFSISC | 98.56 | ILWYSFSMSC | 0.32 | ILWYSFSMSC | 0.32 |
| HA | H4 | 532 | 0.14 | yes | 2 | 0 | 99.04 | LWYSFSISCF | | LWYSFSISCF | 98.72 | | | | |
| HA | H4 | 533 | 0.38 | yes | 5 | 0 | 99.2 | ISFSISCFLLA | | ISFSISCFLLI | 95.19 | ISFSISCFLLI | 2.72 | VSFSISCFLLV | 0.48 | FSFSISCFLLV | 0.32 |
| HA | H4 | 534 | 0.3 | yes | 3 | 99.84 | 99.2 | SFSISCFLLVA | | SFSISCFLLIA | 95.99 | SFSISCFLLIA | 2.72 | | |
| HA | H4 | 535 | 0.3 | yes | 1 | 99.84 | 99.2 | FSISCFLLVAL | | FSISCFLLIAL | 95.99 | FSISCFLLIAL | 2.72 | | |
| HA | H4 | 536 | 0 | no | 1 | 99.84 | 100 | VTTRQASPSCL | | | 100 | | | | |
| HA | H4 | 537 | 0 | no | 1 | 99.84 | 100 | TTRQASPSCLV | | | 100 | | | | |
| HA | H4 | 538 | 0 | no | 1 | 99.84 | 100 | TRQASPSCLVW | | | 100 | | | | |

Fig. 75-178

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H4 | 539 | 0 | no | 1 | 99.84 | 100 | RQASPCLVVR | 100 | | | | | | |
| HA | H4 | 540 | 0 | no | 1 | 99.84 | 100 | QASPCLVVRK | 100 | | | | | | |
| HA | H4 | 541 | 0 | no | 1 | 99.84 | 100 | ASPCLVVRKS | 100 | | | | | | |
| HA | H4 | 542 | 0.36 | y

Fig. 75-179

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 303 | 0 | no | 1 | 99.97 | 100 | PSVKLPMGAIN | 100 | | | | | | |
| HA | H5 | 310 | 0 | no | 1 | 99.97 | 100 | G

Fig. 75-180

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 462 | 0.13 | yes | 2 | 0 | 99.06 | TYNAELLVLME | 98.88 | TYNAELLVLME | | | | | |
| HA | H5 | 463 | 0

Fig. 75-181

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5 | 569 | 0 | no | 1 | 99.97 | 100 | GNHGSLVLSLW | 100 | | | | | | |
| HA | H5 | 570 | 0 | no | 1 | 99.97 | 100 | NHGSLVLSLWM | 100 | | | | | | |
| HA | H5 | 571 | 0 | no | 1 | 99.97 | 100 | HGSLVLSLWMC | 100 | | | | | | |
| HA | H5 | 585 | 0.82 | no | 5 | 9.28 | 99.07 | LWMCNGSLQC | 81.21 | FWMCSNGSLQC | 17.5 | LWMCFNGSLQC | 0.11 | LWMCSHGSLQC | 0.08 |
| HA | H5 | 586 | 0.17 | no | 3 | 10.3 | 99.09 | WMCNGSLQCR | 98.55 | WMCSNGSLQCK | 0.37 | WMCFNGSLQCR | 0.18 | | |
| HA | H5 | 587 | 0.25 | no | 4 | 15.01 | 99.07 | MCSNGSLQCRI | 97.54 | MCSNGSLQCK | 1.08 | MCFNGSLQCRI | 0.2 | | |
| HA | H5 | 589 | 0.24 | no | 4 | 22.68 | 99.01 | SNGSLQCRVCI | 97.63 | SNGSLQCKICI | 0.92 | FNGSLQCRICI | 16.67 | | |
| HA | H5 | 597 | 1.79 | no | 1 | 99.85 | 100 | FAFKFVSSDCS | 50 | VCIKFVSSDCS | 16.67 | ICIKICESRLR | 16.7 | | |
| HA | H5 | 598 | 0 | no | 2 | 99.97 | 100 | CIRFVNSDCSK | 100 | | | | | | |
| HA | H5N1 | 1 | — | no | 2 | 99.94 | 100 | ICQMEKIVLLF | 50 | | | | | | |
| HA | H5N1 | 2 | 0.59 | yes | 3 | 99.79 | 100 | VKMEKIVLLA | 85.71 | SVKMEKIVLL | 50 | | | | |
| HA | H5N1 | 3 | 1.15 | yes | 2 | 99.79 | 100 | KMEKIVLLAT | 71.43 | CQMEKIVLLFA | 14.29 | KMEKIVLLAI | 50 | | |
| HA | H5N1 | 19 | 0.65 | yes | 3 | 7.29 | 100 | SDQICIGYHAN | 90.02 | OMEKIVLLFAI | 14.29 | GDQICIGYHAN | 14.3 | | |
| HA | H5N1 | 22 | 0.46 | yes | 2 | 1.45 | 99.16 | DQICIGYHANN | 93.34 | SDHICIGYHAN | 5.53 | DQICVGYHANN | 3.12 | SDQICVGYHAN | 14.3 |
| HA | H5N1 | 23 | 0.46 | yes | 3 | 1.27 | 99.08 | QICIGYHANNS | 93.35 | DHICIGYHANN | 5.2 | QICVGYHANNS | 0.55 | | |
| HA | H5N1 | 24 | 0.16 | yes | 2 | 0.48 | 99.05 | ICIGYHANNST | 98.58 | HICIGYHANNS | 5.19 | | 0.52 | | |
| HA | H5N1 | 25 | 0.34 | yes | 4 | 0.48 | 99.09 | CIGYHANNSTE | 96.19 | ICVGYHANNST | 0.51 | CIGYHANNSTV | | | |
| HA | H5N1 | 30 | 0.37 | yes | 5 | 0.18 | 99.09 | ANNSTEQVDTI | 95.89 | CIGYHANNSTK | 1.85 | ANNSTVQVDTI | 0.54 | CVGYHANNSTE | 0.51 |
| HA | H5N1 | 31 | 0.37 | yes | 5 | 0.18 | 99.03 | NNSTEQVDTIM | 95.9 | ANNSTKQVDTI | 1.87 | NNSTVQVDTIM | 0.54 | ANNSTERVDTI | 0.54 |
| HA | H5N1 | 36 | 0.37 | yes | 5 | 0.12 | 99.16 | QVDTIMEKNVT | 97.77 | NNSTEQVDTIM | 1.87 | QVDTIMEKNYT | 0.54 | NNSTERVDTIM | 0.36 |
| HA | H5N1 | 37 | 0.37 | yes | 5 | 0.12 | 99 | VDTIMEKNVTV | 98.58 | QVDTIMERNVT | 0.42 | RVDTIMEKNVT | 0.42 | HVDTIMEKNVT | 0.36 |
| HA | H5N1 | 38 | 0.14 | yes | 2 | 0.12 | 99.25 | DTIMEKNVTVT | 98.76 | VDTIMERNVTV | 0.42 | | 0.42 | | |
| HA | H5N1 | 39 | 0.14 | yes | 3 | 0.12 | 99.13 | TIMEKNVTVTH | 98.55 | DTIMERNVTVT | 0.42 | TIMERNVTVTH | 0.42 | | |
| HA | H5N1 | 40 | 0.16 | yes | 3 | 0.12 | 99.25 | IMEKNVTVTHA | 98.43 | TIMERNVTVT | 0.42 | IMEKNVTVTHA | 0.42 | | |
| HA | H5N1 | 41 | 0.18 | yes | 4 | 0.12 | 99.13 | MEKNVTVTHAQ | 98.13 | IMERNVTVTH | 0.42 | MEKNVTVTHAQ | 0.3 | MEKNITVTHAQ | 0.27 |
| HA | H5N1 | 42 | 0.21 | yes | 5 | 0 | 99.25 | EKNVTVTHAQD | 97.86 | MERNVTVTHA | 0.42 | EKNVTVTHAK | 0.39 | EKNITVTHAQD | 0.27 |
| HA | H5N1 | 43 | 0.21 | yes | 4 | 0 | 99.22 | KNVTVTHAQDI | 97.86 | ERNVTVTHAQD | 0.42 | KNVTVTHAQN | 0.39 | KNITVTHAQDI | 0.3 |
| HA | H5N1 | 44 | 0.23 | yes | 4 | 0 | 99.16 | NVTVTHAQDIL | 98.25 | RNVTVTHAQD | 0.39 | NITVTHAQDIL | 0.3 | | |
| HA | H5N1 | 45 | 0.19 | yes | 3 | 0 | 99.16 | VTVTHAQNILE | 98.19 | NVTVTHAQDIL | 0.39 | IVTHAQDILE | 0.3 | | |
| HA | H5N1 | 46 | 0.2 | yes | 3 | 0 | 99.19 | VTHAQDILEK | 96.14 | VTVTHAQNILE | 2.35 | TVTHAKDILEK | 0.39 | | |
| HA | H5N1 | 69 | 0.33 | yes | 2 | 0.03 | 99.1 | TVTHAQDILER | 88.75 | TVTHAQDILEK | 8.14 | TVTHAKDILE | 1.15 | | |
| HA | H5N1 | 70 | 0.7 | yes | 2 | 0.03 | 99.13 | KPLILRDCSYA | 89.9 | PLILRDCSYAG | 9.01 | RPLILRDCSYA | 0.21 | RPLILKDCSIA | 0.21 |
| HA | H5N1 | 71 | 0.57 | yes | 3 | 0.03 | 99.16 | PLILRDCSYAG | 89.93 | LILRDCSYAGW | 9.01 | PLILKDCSYAG | 0.21 | RPLILKDCSYA | 0.9 |
| HA | H5N1 | 72 | 0.57 | yes | 3 | 0.06 | 99.04 | LILRDCSYAGW | 89.96 | ILKDCSYAGWL | 9.07 | LILKDCSIAGW | 0.21 | RPLILKDCSIA | |
| HA | H5N1 | 73 | 0.55 | yes | 2 | 0.06 | 99.01 | LRDCSYAGWLL | 89.93 | RDCSYAGWLLL | 9.07 | ILKDCSIAGWL | 0.21 | | |
| HA | H5N1 | 74 | 0.55 | yes | 2 | 0.06 | 99.13 | DCSYAGWLLG | 89.93 | LKDCSYAGWLL | | | | | |
| HA | H5N1 | 75 | 0.1 | yes | 3 | 0.03 | 99.16 | CSYAGWLLGN | 99.13 | KDCSYAGWLLG | | | | | |
| HA | H5N1 | 76 | 0.06 | yes | 1 | 0.03 | 99.43 | SVAGWLLGNP | 99.43 | | | | | | |
| HA | H5N1 | 77 | 0.26 | yes | 2 | 0.03 | 99.1 | VAGWLLGNPM | 96.75 | SVAGWLLGNPL | 2.35 | | | | |
| HA | H5N1 | 78 | 0.25 | yes | 2 | 0.03 | 99.16 | VAGWLLGNPMC | 96.81 | VAGWLLGNPLC | 2.35 | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 357 | 0 | no | 1 | 99.94 | 100 | KKRGLFGAIAG | 100 | | | | | | |
| HA | H5N1 | 358 | 0.91 | yes | 3 | 3.28 | 99.16 | K

Fig. 75-184

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 412

Fig. 75-185

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H5N1 | 466 | 0.13 | yes | 2 | 0 | 99.64 | RTLDFHDSNVK | 98.58

| Protein | Sub-type | Start Pos | Block Entropy | Gaps <10% | # to cover 99% | % gap | Coverage | Peptides included | freq | Peptides included | freq | Peptides included | freq | Peptides included | freq |
|---|---|---|---|---|---|---|---|---|---|---|---|---|---|---|---|
| NA | H5N1 | 198 | 0.65 | yes | 5 | 0 | 99.26 | WSAS

Fig. 75-189

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H5N1 | 375 | 0.18 | yes | 3 | 0 | 99.03 | YGNGVWIGRTK | 98.39 | YGNGVWIGRTK | 0.32 | YGNGAWIGRTK | 0.32 | | |
| NA | H5N1 | 376 | 0.19 | yes | 4 | 0 | 99.08 | GNGVWIGRTKS | 98.29 | GDGVWIGRTKS | 0.32 | GNGAWIGRTKS | 0.32 | GKGVWIGRTKS | 0.14 |
| NA | H5N1 | 389 | 0.25 | yes | 5 | 0 | 99.08 | SRSGFEMWDP | 97.46 | SRSGFEMWDP | 1.11 | SRSGFEMWDP | 0.28 | SRSGFEMIWDS | 0.14 |
| NA | H5N1 | 390 | 0.28 | yes | 4 | 0 | 99.03 | RSGFEMWDPN | 97.1 | RSGFEMWDPD | 1.11 | RSGFEMWDPN | 0.55 | | |
| NA | H5N1 | 391 | 0.27 | yes | 4 | 0 | 99.12 | SGFEMWDPNG | 97.19 | SGFEMWDPDG | 1.11 | SGFEMWDPNG | 0.55 | | |
| NA | H5N1 | 392 | 0.25 | yes | 3 | 0 | 99.03 | GFEMWDPNGW | 97.37 | GFEMWDPDGW | 1.11 | GFEMIWDPNG | 0.55 | | |
| NA | H5N1 | 418 | 0.25 | yes | 3 | 0.05 | 99.08 | ITDWSGYSGSF | 97.46 | LTDWSGYSGSF | 0.46 | ITEWSGYSGSF | 0.46 | ITNWSGYSGSF | 0.28 |
| NA | H5N1 | 419 | 0.22 | yes | 2 | 0.05 | 99.17 | TDWSGYSGSFV | 97.05 | TDWSGYSGSFI | 1.71 | | | | |
| NA | H5N1 | 420 | 0.22 | yes | 2 | 0 | 99.03 | DWSGYSGSFVQ | 97.33 | DWSGYSGSFIQ | 1.71 | | | | |
| NA | H5N1 | 421 | 0.22 | yes | 2 | 0 | 99.86 | WSGYSGSFVQH | 98.16 | WSGYSGSFIQH | 1.71 | | | | |
| NA | H5N1 | 422 | 0.14 | yes | 1 | 0 | 99.91 | SGYSGSFVQHP | 98.2 | | | | | | |
| NA | H5N1 | 423 | 0.15 | yes | 1 | 0 | 99.82 | GYSGSFVQHPE | 98.11 | | | | | | |
| NA | H5N1 | 424 | 0.24 | yes | 2 | 0 | 99.68 | YSGSFVQHPEL | 97.1 | YSGSFVQHPEM | 1.57 | SFVQHPELTGV | 0.55 | FVQHPELTGVD | 0.46 |
| NA | H5N1 | 425 | 0.25 | yes | 2 | 0 | 99.63 | SGSFVQHPELT | 97.05 | SGSFVQHPEMT | 1.57 | FVQHPEMTGLD | 1.01 | VQHPELTGVDC | 0.46 |
| NA | H5N1 | 426 | 0.25 | yes | 2 | 0 | 99.59 | GSFVQHPELTG | 97 | GSFVQHPEMTG | 1.57 | VQHPEMTGLDC | 1.01 | DCIKPCFWVEL | 0.23 |
| NA | H5N1 | 427 | 0.3 | yes | 3 | 0 | 99.54 | SFVQHPELTGL | 96.4 | SFVQHPEMTGL | 1.57 | NCMRPCFWVEL | 1.52 | | |
| NA | H5N1 | 428 | 0.46 | yes | 4 | 0 | 99.22 | FVQHPELTGLN | 94.51 | FIQHPELTGLN | 1.71 | IKPCFWVELI | 0.46 | | |
| NA | H5N1 | 429 | 0.46 | yes | 5 | 0 | 99.22 | VQHPELTGLNC | 94.51 | IQHPELTGLNC | 1.71 | IRPCFWVELIR | 0.46 | | |
| NA | H5N1 | 438 | 0.56 | yes | 5 | 0.09 | 99.03 | DCIRPCFWVEL | 92.66 | NCIRPCFWVEL | 2.77 | | | | |
| NA | H5N1 | 439 | 0.52 | yes | 4 | 0.09 | 99.22 | CIRPCFWVELI | 92.52 | CIRPCFWVELV | 4.29 | | | | |
| NA | H5N1 | 440 | 0.51 | yes | 3 | 0.09 | 99.03 | IRPCFWVELIR | 92.57 | IRPCFWVELVR | 4.29 | CIKPCFWVELI | 0.42 | FWIELIRGRPK | 0.46 |
| NA | H5N1 | 441 | 0.27 | yes | 4 | 0.09 | 99.17 | RPCFWVELIRG | 96.77 | RPCFWVELVRG | 1.94 | IKPCFWVELIR | 0.42 | WIELIRGRPKE | 0.46 |
| NA | H5N1 | 442 | 0.46 | yes | 5 | 0.09 | 99.03 | PCFWVELIRGQ | 94.09 | PCFWVELVRGQ | 2.86 | PCFWIELIRGR | 1.48 | IWTSGSIISFC | 0.23 |
| NA | H5N1 | 443 | 0.46 | yes | 5 | 0.09 | 99.03 | CFWVELIRGRP | 94.09 | CFWVELVRGRP | 2.86 | CFWIELIRGRP | 1.48 | | |
| NA | H5N1 | 444 | 0.57 | yes | 5 | 0.09 | 99.08 | FWVELIRGRPK | 92.62 | FWVELVRGRPK | 2.86 | FWIELIRGRPE | 1.66 | | |
| NA | H5N1 | 445 | 0.57 | yes | 5 | 0.09 | 99.08 | WVELIRGRPKE | 92.62 | WVELVRGRPKE | 2.86 | WIELIRGRPEE | 1.66 | | |
| NA | H5N1 | 458 | 0.41 | yes | 4 | 0.18 | 99.08 | IWTSGSIISFC | 94.92 | VWTSGSIISFC | 0.46 | IWTSGSIISFC | 0.46 | | |
| NA | H5N1 | 459 | 0.18 | yes | 3 | 0.23 | 99.12 | WTSGSIISFCG | 98.2 | WASGSIISFCG | 0.28 | WTSGSIISFCG | 0.28 | | |
| NA | H5N1 | 460 | 0.19 | yes | 3 | 0.23 | 99.21 | TSGSIISFCGV | 98.2 | ASGSIISFC | 0.65 | | | | |
| NA | H5N1 | 461 | 0.43 | yes | 3 | 0.23 | 99.12 | SGSIISFCGVN | 94.64 | SGSIISFCGVD | 2.54 | SGSIISFCGVN | 1.29 | | |
| NA | H5N1 | 473 | 0 | no | 1 | 99.95 | 100 | IFLWCKIVTTV | 100 | | | | | | |
| NA | H5N1 | 474 | 0 | no | 1 | 99.95 | 100 | FLWCKIVTTVG | 100 | | | | | | |
| NA | H5N1 | 475 | 0 | no | 1 | 99.95 | 100 | LWCKIVTTVGW | 100 | | | | | | |
| NA | H5N1 | 476 | 0 | no | 1 | 99.95 | 100 | WCKIVTTVGWS | 100 | | | | | | |
| NA | H5N1 | 477 | 0 | no | 1 | 99.95 | 100 | CKIVTTVGWSW | 100 | | | | | | |
| NA | H5N1 | 478 | 0 | no | 1 | 99.95 | 100 | KIVTTVGWSWP | 100 | | | | | | |
| NA | H5N1 | 479 | 0 | no | 1 | 99.95 | 100 | IVTTVGWSWPD | 100 | | | | | | |
| NA | H5N1 | 480 | 0 | no | 1 | 99.95 | 100 | VTTVGWSWPDG | 100 | | | | | | |
| NA | H5N1 | 485 | 0.24 | yes | 5 | 3.04 | 99 | WSWPDGAELPF | 97.62 | WSWPDAELPF | 0.95 | WSWPDGAEVPF | 0.24 | WSWPDDAELPL | 0.1 |
| NA | H5N1 | 490 | — | no | 2 | 99.91 | 100 | GAELPFTIDKS | 50 | GAELPFTIDKY | 50 | | | | |

Fig. 75-190

| Protein | Sub-type | Start Pos | Block Entropy | Gaps < 10% | # to cover 99% | Gap % | Coverage | Peptides included | Fre

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H

Fig. 75-193

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H5N2 | 160 | 0.

Fig. 75-194

| Protein | Sub-type | Start Pos | Block Entropy | Gaps < 10% | # to cov 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H5N2 | 291 | 0.28 | yes | 3 | 0 | 99.04 | VCRDNWKGS

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H6 | 258 | 0.38 | yes | 4 | 0.52

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 358 | 0 | no | 1 | 97.83 | 100 | HQLTHHMRKK | 100 |

Fig. 75-200

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H7 | 415 | 0.41 | yes | 5 | 0.1 | 99.28 | GF

Fig. 75-201

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7 | 522 |

Fig. 75-202

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 33 | 0.32 | yes | 3 | 0 | 99.3 | HAVANGTKVNT | 95.59 | HAVSNGTKVNT | 2.78 | | | | |
| HA | H7N2 | 34 | 0.32 | yes | 3 | 0 | 99.3 | AVANGTKVNTL | 95.59 | AVSNGTKVNTL | 2.78 | | | | |
| HA | H7N2 | 35 | 0.32 | yes | 3 | 0 | 99.3 | VANGTKVNTLT | 95.59 | VSNGTKVNTLT | 2.78 | | | | |
| HA | H7N2 | 36 | 0.32 | yes | 3 | 0 | 99.3 | ANGTKVNTLTE | 95.59 | SNGTKVNTLTE | 2.78 | | | | |
| HA | H7N2 | 37 | 1.08 | yes | 4 | 0 | 99.3 | NGTKVNTLTER | 61.48 | NGTKVNTLIE | 36.89 | | | | |
| HA | H7N2 | 38 | 1.08 | yes | 4 | 0 | 99.3 | GTKVNTLTERG | 61.48 | GTKVNTLTEKG | 36.89 | | | | |
| HA | H7N2 | 39 | 1.27 | yes | 4 | 0 | 99.3 | TKVNTLTERGI | 58 | TKVNTLTERGV | 36.89 | TKINTLTERGV | 3.48 | TKINTLERGI | 0.93 | |
| HA | H7N2 | 40 | 1.3 | yes | 4 | 0 | 99.07 | KVNTLTEKGIE | 57.77 | KVNTLTERGVE | 36.89 | KINTLTEKGIE | 3.48 | KINTLERGVE | 0.93 | |
| HA | H7N2 | 41 | 1.3 | yes | 4 | 0 | 99.07 | VNTLTERGIEV | 57.77 | VNTLTERGVEV | 36.89 | INTLTERGVEV | 3.48 | INTLERGVEV | 0.93 | |
| HA | H7N2 | 42 | 1.26 | yes | 4 | 0 | 99.07 | NTLTEKGIEVV | 57.77 | NTLTERGVEVV | 36.89 | NTLTERGVEV | 4.41 | | | |
| HA | H7N2 | 43 | 1.22 | yes | 4 | 0 | 99.54 | TLTERGIEVVN | 58.24 | TLTEKGIEVN | 36.89 | TLTERGIEVN | 4.41 | | | |
| HA | H7N2 | 44 | 1.2 | yes | 4 | 0 | 99.54 | LTERGIEVVNA | 58.47 | LTEKGIEVVNA | 36.89 | LTERGIEVNA | 4.41 | | | |
| HA | H7N2 | 45 | 1.22 | yes | 4 | 0 | 99.77 | TEKGIEVVNAT | 58.47 | TERGIEVVNAT | 36.89 | TERGIEVNAT | 4.41 | | | |
| HA | H7N2 | 46 | 1.2 | yes | 4 | 0 | 99.77 | EKGIEVVNATE | 58.47 | ERGIEVVNATE | 36.89 | ERGIEVNATE | 4.41 | | | |
| HA | H7N2 | 47 | 1.22 | yes | 4 | 0 | 99.54 | KGIEVVNATET | 58.24 | RGIEVVNATET | 36.89 | RGVEVVNATET | 4.41 | | | |
| HA | H7N2 | 48 | 0.31 | yes | 2 | 0 | 99.54 | GIEVVNATETV | 95.13 | GVEVVNATETV | 4.41 | | | | |
| HA | H7N2 | 49 | 0.31 | yes | 2 | 0 | 99.54 | IEVVNATETVE | 95.13 | VEVVNATETVE | 4.41 | | | | |
| HA | H7N2 | 50 | 0.33 | yes | 3 | 0 | 99.3 | EVVNATETVEN | 95.36 | EVVNATETVER | 3.48 | VVNATETVEN | 0.46 | | | |
| HA | H7N2 | 51 | 0.73 | yes | 4 | 0 | 99.07 | VVNATETVETA | 88.17 | VVNATETVETT | 6.26 | VVNATETVERT | 3.48 | | | |
| HA | H7N2 | 79 | 0.59 | yes | 5 | 0.23 | 93 | CGLLGTLGPP | 91.88 | CGLLGTLGPP | 2.78 | CGLLGTILGPP | 2.55 | CGLLGTVTGPP | 0.93 | |
| HA | H7N2 | 86 | 0.59 | yes | 4 | 0.23 | 99.07 | IGPPQCDQFLE | 90.72 | IGPPQCDKFLE | 6.5 | IGPPHCDQFLE | 1.39 | | | |
| HA | H7N2 | 87 | 0.22 | yes | 3 | 0.23 | 99.07 | GPPQCDQFLEF | 97.45 | GPPHCDQFLEF | 1.39 | | | | |
| HA | H7N2 | 100 | 0.66 | yes | 5 | 0 | 99.3 | DLIERREGND | 90.95 | DLIERREGTD | 2.32 | DLIERREGAD | 2.09 | DLIERREGSD | 0.46 | DLIERREGTD | 2.09 |
| HA | H7N2 | 123 | 0.85 | yes | 5 | 0 | 99.3 | LRQILRSGGI | 84.88 | LRQILRESGGI | 9.3 | LRQILRKSGGI | 3.72 | LRQVLRSGGI | 0.93 | LRQILRSGGI | 0.93 |
| HA | H7N2 | 139 | 0.48 | yes | 3 | 0 | 99.3 | GFTYSGIRTNG | 92.34 | GFTYNGIRTNG | 6.03 | GFTYSGIRTNG | 0.46 | | | |
| HA | H7N2 | 156 | 0.26 | yes | 1 | 0 | 99.07 | RGSSFYAEMK | 97.21 | RLGSSFYAEMK | 0.7 | RSGSSFYAELK | 0.47 | RLGPSFYAEMK | 0.47 | |
| HA | H7N2 | 157 | 0.26 | yes | 1 | 0 | 99.07 | GSSFYAEMKW | 97.21 | LGSSFYAEMKW | 0.7 | SGSSFYAELKW | 0.47 | SDSSFYAEMKW | 0.23 | |
| HA | H7N2 | 158 | 0.15 | yes | 2 | 0 | 99.3 | SSSFYAEMKWL | 98.38 | GPSFYAEMKWL | 0.7 | SSSFYAEMKWL | 0.46 | | | |
| HA | H7N2 | 159 | 0.09 | yes | 1 | 0 | 99.07 | SFYAEMKWLL | 99.07 | | | | | | | |
| HA | H7N2 | 160 | 0.07 | yes | 1 | 0 | 99.07 | FYAEMKWLLS | 99.3 | | | | | | | |
| HA | H7N2 | 161 | 0.31 | yes | 2 | 0 | 99.07 | FYAEMKWLLSN | 95.59 | FYAEMKWLLSS | 3.48 | YAEMKWLLSST | 2.78 | YAEMKWLLSS | 1.86 | |
| HA | H7N2 | 162 | 0.55 | yes | 4 | 0 | 99.07 | YAEMKWLLSNT | 92.11 | YAEMKWLLSNI | 3.48 | AEMKWLLSSTD | 2.78 | AEMKWLLSSSD | 0.93 | |
| HA | H7N2 | 163 | 0.55 | yes | 4 | 0 | 99.07 | AEMKWLLSNTD | 92.11 | AEMKWLLSNMS | 3.48 | EMKWLLSSTDN | 2.78 | EMKWLLSSTDN | 0.93 | |
| HA | H7N2 | 164 | 0.45 | yes | 3 | 0 | 99.07 | EMKWLLSNTDN | 92.11 | EMKWLLSNSDN | 3.48 | | | | |
| HA | H7N2 | 206 | 0.43 | yes | 5 | 0 | 99.3 | EQTKLYGNGNK | 93.04 | EOTKLYGSGNK | 5.1 | | | | |
| HA | H7N2 | 207 | 0.7 | yes | 5 | 0 | 99.54 | OTKLYGSGNKL | 93.27 | OTKLYGNGNK | 5.1 | OTKLYGSGNKL | 1.16 | | | |
| HA | H7N2 | 208 | 0.99 | yes | 5 | 0 | 99.54 | TKLYGSGNKLY | 89.56 | TKLYGNGNKLV | 3.71 | TKLYGNGNKLI | 3.25 | TKLYGSGSKL | 1.86 | TKLYGSGSKLI | 1.16 |
| HA | H7N2 | 235 | 0.83 | yes | 5 | 0 | 99.07 | ARRIDFHWLLD | 81.44 | ARPQYNGQSGR | 12.3 | ARRIDFHWLLL | 3.48 | ARRIDFHWLFL | 0.93 | ARRIDFNWLLL | 0.93 |
| HA | H7N2 | 236 | 0.88 | yes | 5 | 0 | 99.54 | RRIDFHWLLLD | 83.99 | RPQWNGQSGRI | 12.53 | RRIDFHWLLLE | 1.16 | RRIDFHWLFLD | 0.93 | RRIDFNWLFLD | 0.93 |
| HA | H7N2 | 237 | 0.13 | no | 2 | 87.24 | 100 | PQVNGQSGRID | 98.18 | PQVNGQFGRID | 1.82 | | | | |

Fig. 75-203

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 238 | 0.13 | no | 2 | 87.24 | 100 | QVNGQSGRIDF | 98.18 | QVNGQFGRIDF | 1.82 | | | | |
| HA | H7N2 | 239 | 0.13 | no | 2 | 87.24 | 100 | VNGQSGRIDFH | 98.18 | VNGQFGRIDFH | 1.82 | | | | |
| HA | H7N2 | 240 | 0.13 | no | 2 | 87.24 | 100 | NGQSGRIDFHW | 98.18 | NGQFGRIDFHW | 1.82 | | | | |
| HA | H7N2 | 241 | 0.13 | no | 2 | 87.24 | 100 | GQSGRIDFHWL | 98.18 | GQFGRIDFHWL | 1.82 | | | | |
| HA | H7N2 | 242 | 1.3 | no | 5 | 87.24 | 100 | QSGRIDFHWLL | 70.91 | QSGRIDFHWLM | 16.36 | QFGRIDFHWLM | 9.09 | QSGRIDFHWLV | 1.82 |
| HA | H7N2 | 243 | 1.3 | no | 5 | 87.24 | 100 | SGRIDFHWLLL | 70.91 | SGRIDFHWLML | 16.36 | FGRIDFHWLML | 9.09 | SGRIDFHWLVL | 1.82 |
| HA | H7N2 | 244 | 1.28 | no | 5 | 87.24 | 100 | GRIDFHWLLLD | 18.18 | GRIDFHWLLLS | 7.27 | GRIDFHWLLN | | | |
| HA | H7N2 | 256 | 0.4 | yes | 4 | 0 | 99.07 | NDTVTFSNGA | 94.66 | NDTVTFIFNGA | 3.25 | NDTVTFNGA | 0.7 | | |
| HA | H7N2 | 257 | 0.39 | yes | 4 | 0 | 99.07 | DTVTFSNGAF | 94.66 | DTITFSNGAF | 3.25 | DTITFNGAF | 0.7 | | |
| HA | H7N2 | 258 | 0.36 | yes | 4 | 0 | 99.07 | TVTFSNGAFI | 94.9 | TVTFIFNGAFI | 3.02 | TVTFNGAFI | 0.7 | | |
| HA | H7N2 | 259 | 0.34 | yes | 3 | 0 | 99.3 | VTFSNGAFIA | 95.13 | VTFIFNGAFIA | 3.02 | ITFSNGAFIA | 0.7 | | |
| HA | H7N2 | 260 | 0.52 | yes | 4 | 0 | 99.3 | TFSNGAFIAP | 95.13 | TFIFNGAFIAP | 3.48 | | | | |
| HA | H7N2 | 261 | 0.52 | yes | 4 | 0 | 99.3 | FSNGAFIAPD | 92.34 | FIFNGAFIAPD | 3.48 | FIFNGAFIAPD | 2.78 | | |
| HA | H7N2 | 262 | 0.23 | yes | 3 | 0 | 99.54 | SNGAFIAPDR | 92.34 | FNGAFIAPNR | 3.48 | FNGAFIAPDR | 2.78 | | |
| HA | H7N2 | 263 | 0.23 | yes | 4 | 0 | 99.54 | NGAFIAPDRA | 96.75 | NGAFIAPNRA | 3.48 | | | | |
| HA | H7N2 | 264 | 0.23 | yes | 3 | 0 | 99.54 | GAFIAPDRAS | 96.75 | GAFIAPNRAS | 3.48 | | | | |
| HA | H7N2 | 265 | 0.46 | yes | 4 | 0 | 99.54 | AFIAPDRASF | 93.04 | AFIAPNRASFF | 3.71 | FIAPDRASFF | 2.78 | | |
| HA | H7N2 | 266 | 0.53 | yes | 5 | 0 | 99.54 | FIAPDRASFF | 92.11 | FIAPNRASFLR | 3.71 | FIAPDRASFFK | 2.78 | IAPDRASFFKG | 2.78 |
| HA | H7N2 | 267 | 0.53 | yes | 5 | 0 | 99.07 | IAPDRASFFR | 92.11 | IAPNRASFLRG | 3.71 | IAPDRASFFRG | 2.78 | WGTIVSSLPFQ | 2.78 |
| HA | H7N2 | 268 | 0.4 | yes | 5 | 0 | 99.3 | APDRASFFRG | 94.65 | APNRASFLRG | 3.49 | | | | |
| HA | H7N2 | 301 | 0.37 | yes | 4 | 0 | 99.3 | GGTIVSSLPFQ | 94.88 | GGTIISNLPFQ | 3.49 | GTIISLPFQS | 0.47 | GTIVSSLPFQ | 0.47 |
| HA | H7N2 | 302 | 0.43 | yes | 4 | 0 | 99.07 | GTIVSSLPFQN | 94.88 | GTIISNLPFQN | 3.49 | TIISSLPFQN | 0.47 | TIVSSLPFQN | 0.47 |
| HA | H7N2 | 303 | 1.12 | yes | 5 | 0 | 99.3 | TIVSSLPFQNI | 94.19 | TIISNLPFQNI | 3.49 | IISNLPFQNI | 0.7 | IISSLPFQNIS | 0.47 |
| HA | H7N2 | 304 | 1.05 | yes | 4 | 0 | 99.3 | IVSSLPFQNIN | 73.32 | IISNLPFQNIN | 21.58 | TVGKCPRYVKQ | 3.25 | IVSSLPFQSIN | 0.47 |
| HA | H7N2 | 317 | 0.98 | yes | 4 | 0.23 | 99.07 | TVGKCPRYVKQ | 77.03 | VKQKSLLLATG | 18.1 | VKQESLMLATG | 2.55 | AVGKCPRYVKQ | 0.46 |
| HA | H7N2 | 325 | 1.01 | yes | 4 | 0.23 | 99.07 | VKQKSLLLATG | 77.73 | KQKSLLLATGM | 18.1 | KQESLMLATGM | 2.55 | VKQKSLLATG | 0.93 |
| HA | H7N2 | 326 | 1.03 | yes | 4 | 0.23 | 93 | KQKSLLLATGM | 77.49 | QKSLLLATGMR | 18.1 | QESLMLATGMK | 2.55 | | |
| HA | H7N2 | 327 | 0.48 | yes | 5 | 0 | 99.07 | KSLLLATGMR | 77.26 | KSLLLATGMRN | 2.78 | ESLMLATGMRN | 2.55 | SLMLATGMRN | 1.86 |
| HA | H7N2 | 328 | 0.48 | yes | 4 | 0 | 99.07 | SLLLATGMRNV | 93.5 | SLLATGMRNV | 2.78 | LMLATGMRNV | 1.86 | KSILLATGMRN | 0.46 |
| HA | H7N2 | 329 | 0.48 | yes | 5 | 0 | 93 | LLLATGMRNVP | 93.5 | LLATGMKNVP | 2.55 | LMLATGMKNVP | 1.86 | | |
| HA | H7N2 | 330 | 1.07 | yes | 4 | 0 | 99.07 | LLATGMRNVPE | 93.97 | LATGMKNVPE | 1.86 | MLATGMKNVPE | 1.86 | | |
| HA | H7N2 | 331 | 1.07 | yes | 4 | 0 | 99.07 | LATGMRNVPEN | 78.19 | ATGMRNVPENP | 3.48 | LATGMRNIPEN | 1.86 | LATGMRNIPEK | 0.7 |
| HA | H7N2 | 332 | 1.06 | yes | 4 | 0 | 99.07 | ATGMRNVPENP | 78.19 | TGMRNVPENPK | 3.48 | ATGMRNIPENP | 1.86 | ATGMRNIPEKP | 0.7 |
| HA | H7N2 | 333 | 1.08 | yes | 5 | 0 | 99.07 | TGMRNVPENPK | 78.19 | TGMRNIPEIPK | 3.48 | TGMRNIPENPK | 3.48 | TGMRNIPEKPK | 0.7 |
| HA | H7N2 | 334 | 0.48 | yes | 4 | 0 | 99.07 | PKKRGLFGAIA | 78.37 | PKRGLFGAIA | 3.48 | PKGRGLFGAIA | 3.48 | | |
| HA | H7N2 | 343 | 1.07 | yes | 4 | 0.23 | 99.77 | KKRGLFGAIAG | 78.14 | KRGLFGAIAG | 4.88 | KGRGLFGAIAG | 4.88 | | |
| HA | H7N2 | 344 | 1.06 | yes | 4 | 0.23 | 99.53 | KRGLFGAIAG | 78.14 | KTRGLFGAIAG | 4.88 | KGRGLFGAIAG | 4.88 | | |
| HA | H7N2 | 345 | 1.08 | yes | 5 | 0.23 | 99.77 | PRGLFGAIAGF | 78.14 | TRGLFGAIAGF | 13.49 | GRGLFGAIAGF | 4.88 | | |
| HA | H7N2 | 346 | 0.02 | yes | 1 | 0.23 | 99.77 | RGLFGAIAGFI | 99.77 | | | | | | |
| HA | H7N2 | 347 | 0.02 | yes | 1 | 0.23 | 99.77 | GLFGAIAGFIE | 99.77 | | | | | | |

Fig. 75-204

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 348 | 0.02 | yes | 1 | 0.23 | 99.77 | LFGAIAGFIEN | 99.77 | | | | | | |
| HA | H7N2 | 349 | 0.02 | yes | 1 | 0.23 | 99.77 |

Fig. 75-205

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 388 | 0.02 | yes | 1 | 0.23 | 99.77 | QSAIDQITGKL | 99.77 | | | | | | |
| HA | H7N2 | 389 | 0.02 | yes | 1 | 0.23 | 99.

Fig. 75-206

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N2 | 438 | 0.2 | yes | 3 | 0 | 99.3 | WSYNAELLVAM | 97.68 | WSYNAELLVAL | 1.16 | WSYNAELLVAI | 0.46 | | |
| HA | H7N2 | 439 | 0.2 | yes | 3 | 0 | 99.3 | SYNAELLVAME | 97.68 | SYNAELLVALE | 1.16 | SYNAELLVAIE | 0.46 | | |
| HA | H7N2 | 440 | 0.18 | yes | 2 | 0 | 99.07 | YNAELLVAMEN | 97.91 | YNAELLVALEN | 1.16 | | | | |
| HA | H7N2 | 441 | 0.18 | yes | 2 | 0 | 99.07 | NAELLVAMENQ | 97.91 | NAELLVALENQ | 1.16 | | | | |
| HA | H7N2 | 442 | 0.2 | yes | 3 | 0 | 99.3 | AELLVAMENQH | 97.68 | AELLVALENQH | 1.16 | AELLVAIENQH | 0.46 | | |
| HA | H7N2 | 443 | 0.2 | yes | 3 | 0 | 99.3 | ELLVAMENQHT | 97.68 | ELLVALENQHT | 1.16 | ELLVAIENQHT | 0.46 | | |
| HA | H7N2 | 444 | 0.2 | yes | 3 | 0 | 99.3 | LLVAMENQHTI | 97.68 | LLVALENQHTI | 1.16 | LLVAIENQHTI | 0.46 | | |
| HA | H7N2 | 445 | 0.2 | yes | 3 | 0 | 99.3 | LVAMENQHTID | 97.68 | LVALENQHTID | 1.16 | LVAIENQHTID | 0.46 | | |
| HA | H7N2 | 446 | 0.2 | yes | 3 | 0 | 99.3 | VAMENQHTIDL | 97.68 | VALENQHTIDL | 1.16 | VAIENQHTIDL | 0.46 | | |
| HA | H7N2 | 447 | 0.86 | yes | 4 | 0 | 99.3 | AMENQHTIDLA | 80.28 | AMENQHTIDLT | 17.4 | AIENQHTIDLA | 1.16 | | |
| HA | H7N2 | 448 | 0.86 | yes | 4 | 0 | 99.3 | MENQHTIDLAD | 80.28 | MENQHTIDLTD | 17.4 | IENQHTIDLAD | 1.16 | | |
| HA | H7N2 | 449 | 0.74 | yes | 2 | 0 | 99.3 | ENQHTIDLADS | 81.9 | ENQHTIDLTDS | 17.4 | | | | |
| HA | H7N2 | 450 | 0.76 | yes | 2 | 0 | 99.07 | NQHTIDLTDSE | 81.67 | NQHTIDLTDSE | 17.4 | | | | |
| HA | H7N2 | 451 | 0.78 | yes | 3 | 0 | 99.07 | QHTIDLADSEM | 81.44 | QHTIDLDTSE | 17.4 | QHIIDLADSEM | 0.23 | | |
| HA | H7N2 | 454 | 1.5 | yes | 5 | 0 | 99.07 | IDLADSEMKL | 60.56 | IDLTDSEMKL | 20.65 | IDLADSEMKKL | 0.46 | IDLADSEMKKL | 0.46 |
| HA | H7N2 | 455 | 1.5 | yes | 5 | 0 | 99.07 | DLADSEMSKLY | 60.56 | DLTDSEMSKLY | 20.65 | DLADSEMNKKL | 0.46 | DLADSEMKKLY | 0.46 |
| HA | H7N2 | 458 | 0.9 | yes | 4 | 0 | 99.07 | DSEMSKLYERV | 77.26 | DSEMKKLYERV | 21.11 | DSEMKKLYGRV | 0.46 | SEMKKLYERVR | 0.46 |
| HA | H7N2 | 459 | 1.69 | yes | 5 | 0 | 99.07 | SEMSKLYERVK | 52.2 | SEMKKLYERVK | 25.29 | SEMKKLYERVK | 18.8 | | |
| HA | H7N2 | 463 | 1.28 | yes | 4 | 0 | 99.54 | KLYERVKKQLR | 53.36 | KLYERVRQLR | 42 | KLYERVRKQLR | 3.02 | | |
| HA | H7N2 | 464 | 1.28 | yes | 4 | 0 | 99.54 | LYERVKKQLRE | 53.36 | LYERVRQLRE | 42 | LYERVRKQLRE | 3.02 | | |
| HA | H7N2 | 465 | 1.28 | yes | 4 | 0 | 99.54 | YERVKKQLREN | 53.36 | YERVRQLREN | 42 | YERVRKQLREN | 3.02 | | |
| HA | H7N2 | 466 | 1.28 | yes | 4 | 0 | 99.54 | ERVKKQLRENA | 53.36 | ERVRQLRENA | 42 | ERVRKQLRENA | 3.02 | | |
| HA | H7N2 | 467 | 1.26 | yes | 4 | 0 | 99.54 | RVKKQLRENAE | 53.6 | RVRQLRENAE | 42 | RVKRQLRENAE | 3.02 | | |
| HA | H7N2 | 468 | 1.26 | yes | 4 | 0 | 99.54 | VKKQLRENAEE | 53.6 | VRQLRENAEE | 42 | VKRQLRENAEE | 3.02 | | |
| HA | H7N2 | 469 | 1.26 | yes | 4 | 0 | 99.54 | KKQLRENAEED | 95.59 | RQLRENAEED | 4.18 | KRQLRENAEED | 3.02 | | |
| HA | H7N2 | 470 | 0.27 | yes | 2 | 0 | 99.54 | KQLRENAEEDG | 99.54 | | | | | | |
| HA | H7N2 | 471 | 0.05 | yes | 1 | 0 | 99.77 | QLRENAEEDGT | 99.77 | | | | | | |
| HA | H7N2 | 472 | 0.05 | yes | 1 | 0 | 99.77 | LRENAEEDGTG | 99.77 | | | | | | |
| HA | H7N2 | 473 | 0.05 | yes | 1 | 0 | 99.77 | RENAEEDGTGC | 99.77 | | | | | | |
| HA | H7N2 | 474 | 0.05 | yes | 1 | 0 | 99.77 | ENAEEDGTGCF | 99.77 | | | | | | |
| HA | H7N2 | 475 | 0.02 | yes | 1 | 0 | 99.77 | NAEEDGTGCFE | 99.77 | | | | | | |
| HA | H7N2 | 476 | 0.02 | yes | 1 | 0 | 99.77 | AEEDGTGCFEI | 99.77 | | | | | | |
| HA | H7N2 | 477 | 0.02 | yes | 1 | 0 | 99.77 | EEDGTGCFEIF | 99.77 | | | | | | |
| HA | H7N2 | 478 | 0.02 | yes | 1 | 0 | 99.77 | EDGTGCFEIFH | 99.77 | | | | | | |
| HA | H7N2 | 479 | 0.02 | yes | 1 | 0 | 99.77 | DGTGCFEIFHK | 99.77 | | | | | | |
| HA | H7N2 | 480 | 0.02 | yes | 1 | 0 | 99.77 | GTGCFEIFHKC | 99.77 | | | | | | |
| HA | H7N2 | 481 | 0.02 | yes | 1 | 0 | 100 | TGCFEIFHKCD | 99.77 | | | | | | |
| HA | H7N2 | 482 | 0.18 | yes | 2 | 0 | 99.54 | GCFEIFHKCDD | 97.22 | GCFEIFHKCDN | 2.78 | | | CFEIFHKCDNQ | 2.78 |
| HA | H7N2 | 483 | 1.11 | yes | 4 | 0 | 99.54 | CFEIFHKCDDH | 74.94 | CFEIFHKCDDD | 18.1 | CFEIFHKCDDD | 3.71 | FEIFHKCDNQC | 2.78 |
| HA | H7N2 | 484 | 1.11 | yes | 4 | 0 | 99.54 | FEIFHKCDDHC | 74.94 | FEIFHKCDDDC | 18.1 | FEIFHKCDNQC | 3.71 | | |

| Protein | Sub-type | Start Pos | Block Entropy | Gaps <10% | # to cover 99% | Gap % | Co

Fig. 75-209

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 103 | 0.52 | yes | 4 | 0 | 99.26 | DNSIRLSAGGD | 91.89 | DNSIRLSAGGH | 5.65 | D

Fig. 75-210

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 164 | 1.02 | yes | 2 | 0 | 99.75 | GVPP

Fig. 75-211

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 217 |

Fig. 75-212

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 274 | 0.

Fig. 75-213

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 339 | 1.17 | yes | 5 | 0 | 99.26 | DPNEERGNPGV | 78.38 | DPNDERGNPGV | 8.6 | DPNNERG

Fig. 75-214

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N2 | 418 | 0.24 | yes | 2 | 0 | 99.26 | INRCFYELIR

Fig. 75-215

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 26 | 1.29 | yes | 4 | 0 | 99.62 | DKICLGHHAV

Fig. 75-216

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 270 | 0.66 | yes | 3 | 0 | 99.24 | FNGAFIAPDRA | 87.4 | FNGAFIAPDRV | 10.31 | | | | |
| HA | H7N3 | 271 | 0.89 | yes |

Fig. 75-217

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 388 | 0.45 | yes | 3 | 0 | 100 | NGWEGLIDGWY | 92.75 | NGWEGLIDGWY | 4.2 | | | | |
| HA | H7N3 | 389 | 0.45 | yes | 3 | 0 | 100 | GWEGLIDGWYG | 92.75 | GWEGLVDGWYG | 4.2 | | | | |
| HA | H7N3 | 390 | 0.45 | yes | 3 | 0 | 100 | WEGLIDGWYGF | 92.75 | WEGLVDGWYGF | 4.2 | | | | |
| HA | H7N3 | 391 | 0.56 | yes | 4 | 0.38 | 100 | EGLIDGWYGFR | 91.22 | EGLVDGWYGFR | 4.2 | EGLIDGWYGFK | 3.05 | | |
| HA | H7N3 | 392 | 0.56 | yes | 4 | 0.38 | 100 | GLIDGWYGFRH | 91.19 | GLVDGWYGFRH | 4.21 | GLIDGWYGFKH | 3.05 | | |
| HA | H7N3 | 393 | 0.56 | yes | 4 | 0.38 | 100 | LIDGWYGFRHQ | 91.19 | LVDGWYGFRHQ | 4.21 | LIDGWYGFKHQ | 3.05 | | |
| HA | H7N3 | 394 | 0.31 | yes | 3 | 0.38 | 100 | IDGWYGFRHQN | 91.19 | VDGWYGFRHQN | 4.21 | IDGWYGFKHQN | 3.05 | | |
| HA | H7N3 | 395 | 0.11 | yes | 2 | 0.38 | 100 | DGWYGFRHQNA | 95.4 | NGWYGFRHQNA | 3.07 | | | | |
| HA | H7N3 | 396 | 0.11 | yes | 2 | 0.38 | 100 | GWYGFRHQNAQ | 98.47 | WYGFKHQNAQ | 1.53 | | | | |
| HA | H7N3 | 397 | 0.11 | yes | 2 | 0.38 | 100 | WYGFRHQNAQG | 98.47 | WYGFKHQNAQG | 1.53 | | | | |
| HA | H7N3 | 398 | 0.46 | yes | 3 | 0.38 | 100 | YGFRHQNAQGE | 98.47 | YGFKHQNAQGE | 1.53 | | | | |
| HA | H7N3 | 399 | 0.46 | yes | 3 | 0.38 | 100 | GFRHQNAQGEG | 98.47 | GFKHQNAQGEG | 1.53 | | | | |
| HA | H7N3 | 400 | 0.35 | yes | 2 | 0.38 | 100 | FRHQNAQGEGT | 91.95 | FKHQNAQGEGT | 1.53 | | | | |
| HA | H7N3 | 401 | 0.35 | yes | 2 | 0.38 | 100 | RHQNAQGEGTA | 91.95 | KHQNAQGEGTA | 1.53 | | | | |
| HA | H7N3 | 402 | 0.38 | yes | 2 | 0 | 100 | HQNAQGEGTAA | 93.49 | | | | | | |
| HA | H7N3 | 403 | 0.38 | yes | 2 | 0 | 100 | QNAQGEGTAAD | 93.51 | | | | | | |
| HA | H7N3 | 404 | 0.38 | yes | 2 | 0 | 100 | NAQGEGTAADY | 93.13 | | | | | | |
| HA | H7N3 | 405 | 0.45 | yes | 2 | 0 | 100 | AQGEGTAADYK | 93.13 | | | | | | |
| HA | H7N3 | 406 | 0.48 | yes | 2 | 0 | 100 | QGEGTAADYKS | 93.13 | | | | | | |
| HA | H7N3 | 407 | 0.23 | yes | 2 | 0 | 100 | GEGTAADYKST | 93.13 | | | | | | |
| HA | H7N3 | 408 | 0.69 | yes | 4 | 0.38 | 99.62 | EGTAADYKSTQ | 92.37 | EGTAADYKSTP | 6.51 | | | ADYKSTPSAID | 0.76 |
| HA | H7N3 | 409 | 0.69 | yes | 4 | 0.38 | 99.62 | GTAADYKSTQS | 91.95 | GTAADYKSTPS | 6.51 | | | DYKSTPSAIDQ | 0.77 |
| HA | H7N3 | 410 | 0.69 | yes | 4 | 0.38 | 99.62 | TAADYKSTQSA | 91.95 | TAADYKSTPSA | 6.51 | | | YKSTPSAIDQI | 0.77 |
| HA | H7N3 | 411 | 0.69 | yes | 4 | 0.38 | 99.62 | AADYKSTQSAI | 97.32 | AADYKSTPSAI | 1.15 | | | KSTPSAIDQIT | 0.77 |
| HA | H7N3 | 412 | 0.66 | yes | 4 | 0.38 | 99.23 | ADYKSTQSAID | 87.36 | ADYKSTQSAVD | 9.96 | | | STPSAIDQITG | 1.15 |
| HA | H7N3 | 413 | 0.66 | yes | 4 | 0.38 | 99.23 | DYKSTQSAIDQ | 87.36 | DYKSTQSAVDQ | 9.96 | | | TPSAIDQITGK | 1.15 |
| HA | H7N3 | 414 | 0.66 | yes | 4 | 0.38 | 99.23 | YKSTQSAIDQI | 87.36 | YKSTQSAVDQI | 9.96 | | | PSAIDQITGKL | 1.15 |
| HA | H7N3 | 415 | 0.66 | yes | 4 | 0.38 | 99.23 | KSTQSAIDQIT | 87.74 | KSTQSAVDQIT | 9.96 | | | | |
| HA | H7N3 | 416 | 0.59 | yes | 4 | 0.38 | 99.23 | STQSAIDQITG | 87.74 | STQSAVDQITG | 9.96 | | | | |
| HA | H7N3 | 417 | 0.56 | yes | 4 | 0.38 | 99.23 | TQSAIDQITGK | 87.74 | TQSAVDQITGK | 9.96 | | | | |
| HA | H7N3 | 418 | 0.62 | yes | 4 | 0.38 | 99.23 | QSAIDQITGKL | 87.74 | QSAVDQITGKL | 9.96 | VDQITGKLNRL | 1.15 | | |
| HA | H7N3 | 419 | 0.71 | yes | 4 | 0.38 | 99.23 | SAIDQITGKLN | 88.51 | SAVDQITGKLN | 9.92 | | | | |
| HA | H7N3 | 420 | 0.71 | yes | 4 | 0.38 | 99.23 | AIDQITGKLNR | 88.93 | AVDQITGKLNR | 9.92 | | | | |
| HA | H7N3 | 421 | 0.71 | yes | 3 | 0 | 100 | IDQITGKLNRI | 88.17 | NQITGKLNRII | 6.87 | | | | |
| HA | H7N3 | 422 | 0.62 | yes | 3 | 0 | 100 | DQITGKLNRLI | 89.31 | NQITGKLNRLI | 6.87 | | | | |
| HA | H7N3 | 423 | 1.15 | yes | 5 | 0 | 100 | QITGKLNRLIE | 66.03 | QITGKLNRIIE | 29.77 | QITGKLNRFIE | 3.05 | QITGKLNRL | 1.15 | |
| HA | H7N3 | 424 | 1.21 | yes | 5 | 0 | 99.62 | ITGKLNRLIEK | 65.27 | ITGKLNRIIEK | 29.77 | ITGKLNRFIEK | 3.05 | | ITGKLNRLIDR | 0.76 |
| HA | H7N3 | 425 | 1.21 | yes | 5 | 0 | 99.62 | TGKLNRLIDKT | 65.27 | TGKLNRIIEKT | 29.77 | TGKLNRFIEKT | 3.05 | | TGKLNRFIEKT | 0.76 |
| HA | H7N3 | 426 | 1.21 | yes | 5 | 0 | 99.62 | GKLNRLIDKTN | 65.27 | GKLNRIIEKTN | 29.77 | GKLNRFIEKTN | 3.05 | | GKLNRFIEKTN | 0.76 |
| HA | H7N3 | 427 | 1.21 | yes | 5 | 0.38 | 99.62 | KLNRLIDKTNQ | 65.52 | KLNRIIEKTNQ | 29.5 | KLNRFIEKTNQ | 3.07 | | KLNRLIDRTNH | 0.77 |

Fig. 75-218

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 428 | 1.21 | yes | 5 | 0.38 | 99.62 | LNRLIDKTNQQ | 65.52 | LNRLIEKTNQQ | 29.5 | LNRFIEKTNQQ | 3.07 | LNRLIDRTNHQ | 0.77 |
| HA | H7N3 | 429 | 1.21 | yes | 5 | 0.38 | 99.62 | NRLIDKTNQQF | 65.52 | NRIIEKTNQQF | 29.5 | NRLIDRTNHQF | 3.07 | NRFIEKTNQQF | 0.77 |
| HA | H7N3 | 432 | 1.7 | yes | 5 | 0.38 | 99.62 | IDKTNQQFELI | 43.68 | IDKTNQQFEMI | 31.8 | IEKTNQQFELI | 21.8 | IDRTNHQFELI | 1.53 |
| HA | H7N3 | 433 | 1.73 | yes | 4 | 0.38 | 99.23 | DKTNQQFELID | 43.68 | DKTNQQFEMID | 31.42 | EKTNQQFELID | 21.8 | DRTNHQFELID | 1.53 |
| HA | H7N3 | 434 | 0.96 | yes | 4 | 0.38 | 99.62 | KTNQQFELIDN | 75.48 | KTNQQFEMIDN | 21.84 | EKTNQQFKLID | 1.53 | | |
| HA | H7N3 | 435 | — | yes | 3 | 0.38 | 99.62 | TNQQFELIDNE | 75.1 | TNQQFEMIDNE | 21.84 | RTNHQFELIDN | 0.77 | | |
| HA | H7N3 | 436 | — | yes | 3 | 0.38 | 99.23 | NQQFELIDNEF | 75.1 | NQQFEMIDNEF | 21.84 | TNHQFELIDNE | 0.77 | | |
| HA | H7N3 | 448 | 1.04 | yes | 3 | 0 | 99.23 | EIEQQIGNVIN | 65.65 | EVEKQIGNVIN | 32.82 | NHQFELIDNEF | 0.77 | | |
| HA | H7N3 | 449 | 1.04 | yes | 3 | 0 | 99.24 | IEQQIGNVINW | 65.65 | VEKQIGNVINW | 32.82 | EVERQIGNVIN | 0.76 | | |
| HA | H7N3 | 450 | 1.04 | yes | 3 | 0 | 99.23 | EQQIGNVINWT | 65.65 | EKQIGNVINWT | 32.82 | VERQIGNVINW | 0.76 | | |
| HA | H7N3 | 451 | 1.04 | yes | 3 | 0 | 99.24 | QQIGNVINWTR | 65.65 | KQIGNVINWTR | 32.82 | ERQIGNVINWT | 0.76 | | |
| HA | H7N3 | 452 | 0.07 | yes | 1 | 0 | 99.24 | QIGNVINWTRD | 99.23 | | | RQIGNVINWTR | 0.76 | | |
| HA | H7N3 | 453 | 0.11 | yes | 2 | 0 | 99.24 | IGNVINWTRDS | 98.85 | IGNVINWTRDA | 0.38 | GNVINWTRDSV | 3.05 | | |
| HA | H7N3 | 454 | 0.59 | yes | 4 | 0 | 99.24 | GNVINWTRDSM | 90.84 | GNVINWTRDSI | 4.96 | NVINWTRDSVT | 3.05 | IDWTRDSVTEL | 0.38 |
| HA | H7N3 | 455 | 0.59 | yes | 4 | 0 | 99.24 | NVINWTRDSMT | 90.84 | NVINWTRDSIT | 4.96 | VIDWTRDSVTE | 3.05 | WTRDAMTEIWS | 0.38 |
| HA | H7N3 | 456 | 0.59 | yes | 4 | 0 | 99.24 | VINWTRDSMTE | 90.84 | VINWTRDSITE | 4.96 | INWTRDSVTEL | 3.05 | TRDAMTEIWSY | 0.38 |
| HA | H7N3 | 457 | 1.15 | yes | 5 | 0 | 99.24 | INWTRDSMTEV | 76.72 | INWTRDSITEV | 14.5 | WTRDSVTELWS | 4.58 | RDAMTEIWSYN | 0.38 |
| HA | H7N3 | 458 | 1.16 | yes | 5 | 0 | 99.24 | WTRDSMTEIWS | 76.34 | WTRDSITEVWS | 14.5 | WTRDSVTELWS | 4.58 | DAMTEIWSYNA | 0.38 |
| HA | H7N3 | 459 | 1.16 | yes | 5 | 0 | 99.24 | TRDSMTEIWSY | 76.34 | TRDSITEVWSY | 14.5 | TRDSVTELWSY | 4.58 | SITELWSYNAE | 0.38 |
| HA | H7N3 | 460 | 1.16 | yes | 5 | 0 | 99.24 | RDSMTEIWSYN | 76.34 | RDSITEVWSYN | 14.5 | RDSVTELWSYN | 4.58 | MTEWSYNAEF | 0.38 |
| HA | H7N3 | 461 | 1.16 | yes | 5 | 0 | 99.24 | DSMTEIWSYNA | 76.34 | DSITEVWSYNA | 14.5 | DSVTELWSYNA | 4.58 | | |
| HA | H7N3 | 462 | 1.17 | yes | 5 | 0 | 99.24 | SMTEIWSYNAE | 76.34 | SITEVWSYNAE | 14.5 | SVTELWSYNAE | 4.58 | | |
| HA | H7N3 | 463 | 0.9 | yes | 3 | 0 | 99.24 | MTEIWSYNAEL | 75.95 | ITEVWSYNAEL | 14.89 | VTELWSYNAEL | 4.58 | | |
| HA | H7N3 | 464 | 0.94 | yes | 4 | 0 | 99.24 | TEIWSYNAELL | 80.53 | TEVWSYNAELL | 14.89 | ELWSYNAELLV | 3.82 | | |
| HA | H7N3 | 465 | 0.94 | yes | 4 | 0 | 99.24 | EIWSYNAELLV | 80.15 | EVWSYNAELLV | 14.89 | LWSYNAELLVA | 3.82 | EVWSYNAEFLV | 0.38 |
| HA | H7N3 | 466 | 0.11 | yes | 2 | 0 | 99.24 | IWSYNAELLVA | 80.15 | VWSYNAELLVA | 14.89 | | | VMVYTAELLVA | 0.38 |
| HA | H7N3 | 467 | 0.11 | yes | 2 | 0 | 99.24 | WSYNAEFLVAM | 98.85 | WSYNAEFLVAM | 0.38 | | | | |
| HA | H7N3 | 468 | 0.11 | yes | 2 | 0 | 99.24 | SYNAEFLVAME | 98.85 | SYNAEFLVAME | 0.38 | | | | |
| HA | H7N3 | 469 | 0.11 | yes | 2 | 0 | 99.24 | YNAEFLVAMEN | 98.85 | YNAEFLVAMEN | 0.38 | | | | |
| HA | H7N3 | 470 | 0.11 | yes | 2 | 0 | 99.24 | NAEFLVAMENQ | 98.85 | NAEFLVAMENQ | 0.38 | | | | |
| HA | H7N3 | 471 | 0.07 | yes | 1 | 0 | 99.24 | AELLVAMENQH | 99.24 | | | | | | |
| HA | H7N3 | 472 | 0.07 | yes | 1 | 0 | 99.62 | ELLVAMENQHT | 99.24 | | | | | | |
| HA | H7N3 | 473 | 0.04 | yes | 1 | 0 | 99.24 | LLVAMENQHTI | 99.24 | | | | | | |
| HA | H7N3 | 474 | 0.04 | yes | 1 | 0 | 99.62 | LVAMENQHTID | 99.62 | | | | | | |
| HA | H7N3 | 475 | 0.04 | yes | 1 | 0 | 99.24 | VAMENQHTIDL | 99.24 | | | | | | |
| HA | H7N3 | 476 | 0.04 | yes | 1 | 0 | 99.24 | AMENQHTIDLA | 99.24 | | | | | | |
| HA | H7N3 | 477 | 0.07 | yes | 1 | 0 | 99.24 | MENQHTIDLAD | 99.24 | | | | | | |
| HA | H7N3 | 478 | 0.07 | yes | 1 | 0 | 99.24 | ENQHTIDLADS | 99.24 | | | | | | |
| HA | H7N3 | 479 | 0.07 | yes | 1 | 0 | 99.24 | NQHTIDLADSE | 99.24 | | | | | | |
| HA | H7N3 | 480 | 0.07 | yes | 1 | 0 | 99.24 | QHTIDLADSEM | 99.23 | | | | | | |
| HA | H7N3 | 481 | 0.07 | yes | 1 | 0.38 | 99.23 | | | | | | | | |

Fig. 75-219

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 482 | 0.38 | yes | 3 | 0.38 | 99.23 | HTIDLADSEMN | 94.25 | HTIDLADSEMS | 4.6 | | | TIDQADSEMNK | 0.38 | DLANSEMNKLY | 0.38 |
| HA | H7N3 | 483 | 0.41 | yes | 4 | 0.38 | 99.23 | TIDLADSEMNK | 93.87 | TIDLADSEMNN | 4.6 | | | IDLADSEMNNL | 0.38 | ANSEMNKLYER | 0.38 |
| HA | H7N3 | 484 | 0.41 | yes | 4 | 0.38 | 99.23 | IDLADSEMNKL | 93.87 | IDLANSEMNKL | 4.6 | | | DLADSEMNNLY | 0.38 | DSEMNKLHERV | 0.38 |
| HA | H7N3 | 485 | 0.45 | yes | 5 | 0.38 | 99.23 | DLADSEMNKLY | 93.49 | DLADSEMSKLY | 4.6 | | | ADSEMDKLYTR | 0.38 | KLYTRVKRQLR | 0.38 |
| HA | H7N3 | 487 | 0.43 | yes | 5 | 0.38 | 99.23 | ADSEMNKLYER | 93.87 | ADSEMNKLYER | 4.21 | | | DSEMDKLYTRV | 0.38 | LHERVKRQLRE | 0.38 |
| HA | H7N3 | 488 | 0.42 | yes | 5 | 0.38 | 99.23 | DSEMNKLYERV | 93.87 | NSEMNKLYERV | 4.21 | | | NLYERVRKQLR | 0.38 | HERVRKQLREN | 0.38 |
| HA | H7N3 | 493 | 1.42 | yes | 5 | 0 | 99.23 | KLYERVRKQLR | 63.36 | KLYERVRKQLR | 18.32 | | | LYTRVKRQLRE | 16.8 | | |
| HA | H7N3 | 494 | 1.42 | yes | 5 | 0 | 99.23 | LYERVRKQLRE | 63.36 | LYERVRKQLRE | 18.32 | | | YERVKKQLREN | 16.8 | | |
| HA | H7N3 | 495 | 1.42 | yes | 5 | 0 | 99.23 | YERVRKQLREN | 63.36 | YERVRRQLREN | 18.32 | | | ERVKRQLRENA | 16.8 | | |
| HA | H7N3 | 496 | 1.39 | yes | 4 | 0 | 99.23 | ERVRKQLRENA | 63.74 | ERVRRQLRENA | 18.32 | | | RVKRQLRENAE | 17.2 | | |
| HA | H7N3 | 497 | 1.36 | yes | 3 | 0 | 99.23 | RVRKQLRENAE | 63.74 | RVRRQLRENAE | 18.32 | | | VKKQLRENAEE | 16.8 | | |
| HA | H7N3 | 498 | 1.39 | yes | 4 | 0 | 99.23 | VRKQLRENAEE | 63.74 | VRRQLRENAEE | 18.32 | | | KRQLRENAEKD | 16.8 | | |
| HA | H7N3 | 499 | 1.39 | yes | 4 | 0 | 99.23 | RKQLRENAEED | 63.74 | RRQLRENAEED | 18.32 | | | | | | |
| HA | H7N3 | 500 | 1 | yes | 2 | 0 | 99.24 | KQLRENAEEDG | 64.12 | RQLRENAEEDG | 35.11 | | | | | | |
| HA | H7N3 | 501 | 0.07 | yes | 1 | 0 | 99.24 | QLRENAEEDGT | 99.24 | | | | | | | | |
| HA | H7N3 | 502 | 0.07 | yes | 1 | 0 | 99.24 | LRENAEEDGTG | 99.24 | | | | | | | | |
| HA | H7N3 | 503 | 0.07 | yes | 1 | 0 | 99.24 | RENAEEDGTGC | 99.24 | | | | | | | | |
| HA | H7N3 | 504 | 0.07 | yes | 1 | 0 | 99.24 | ENAEEDGTGCF | 99.24 | | | | | | | | |
| HA | H7N3 | 505 | 0.04 | yes | 1 | 0 | 99.24 | NAEEDGTGCFE | 99.24 | | | | | | | | |
| HA | H7N3 | 506 | 0.04 | yes | 1 | 0 | 99.24 | AEEDGTGCFEI | 99.24 | | | | | | | | |
| HA | H7N3 | 507 | 0.07 | yes | 1 | 0 | 99.24 | EEDGTGCFEIF | 99.24 | | | | | | | | |
| HA | H7N3 | 508 | 0.04 | yes | 1 | 0 | 99.24 | EDGTGCFEIFH | 99.24 | | | | | | | | |
| HA | H7N3 | 509 | 0.04 | yes | 1 | 0 | 99.24 | DGTGCFEIFHK | 99.24 | | | | | | | | |
| HA | H7N3 | 510 | 0.04 | yes | 1 | 0 | 99.62 | GTGCFEIFHKC | 99.62 | | | | | | | | |
| HA | H7N3 | 511 | 0.04 | yes | 1 | 0 | 99.62 | TGCFEIFHKCD | 99.62 | | | | | | | | |
| HA | H7N3 | 512 | 0.15 | yes | 2 | 0 | 99.62 | GCFEIFHKCDD | 98.09 | GCFEIFHKCDN | 1.53 | | | | | | |
| HA | H7N3 | 524 | 1.06 | yes | 3 | 0 | 100 | CMESIRNSTYD | 64.89 | CMASIRNSTYD | 32.82 | | | ASIRNNTYDHT | 2.29 | ASIRNNTYDHN | 1.53 |
| HA | H7N3 | 525 | 1.06 | yes | 3 | 0 | 100 | MESIRNSTYDH | 64.89 | MASIRNSTYDH | 32.82 | | | ASIRNNTYDHT | 2.29 | | |
| HA | H7N3 | 526 | 1.25 | yes | 5 | 0 | 99.62 | ESIRNTYDHT | 64.5 | ASIRNSTYDHS | 30.15 | | | ASIRNNTYDHS | 2.29 | | |
| HA | H7N3 | 544 | 1.3 | yes | 3 | 0 | 99.62 | QNRIQINPVKL | 69.47 | QNRIQINPVKL | 22.14 | | | QNRMQINPVKL | 4.2 | QNRVKIDPVKL | 1.91 |
| HA | H7N3 | 555 | 1.46 | yes | 5 | 0 | 99.62 | SSGYKDIILWF | 61.83 | SSGYKEVILWF | 27.1 | | | SGGYKDIILWF | 5.73 | NSGYKDIILWF | 3.82 |
| HA | H7N3 | 556 | 1.44 | yes | 5 | 0 | 99.62 | SGYKDIILWFS | 62.21 | SGYKEVILWFS | 27.1 | | | GGYKDIILWFS | 5.73 | NGYKDIILWFS | 3.82 |
| HA | H7N3 | 557 | 1.18 | yes | 3 | 0 | 99.62 | GYKDIILWFSF | 66.03 | GYKEVILWFSF | 27.86 | | | SGYKEVILWFS | 5.73 | | |
| HA | H7N3 | 558 | 1.18 | yes | 3 | 0 | 99.62 | YKDIILWFSFG | 66.03 | YKEVILWFSFG | 27.86 | | | GYKEVILWFSF | 5.73 | | |
| HA | H7N3 | 559 | 1.18 | yes | 3 | 0 | 99.62 | KDIILWFSFGA | 66.03 | KEVILWFSFGA | 27.86 | | | YKEVILWFSFG | 5.73 | | |
| HA | H7N3 | 560 | 1.18 | yes | 3 | 0 | 99.62 | DIILWFSFGAS | 66.03 | EVILWFSFGAS | 27.86 | | | KEVILWFSFGA | 5.73 | | |
| HA | H7N3 | 561 | 0.95 | yes | 2 | 0 | 99.62 | IILWFSFGASC | 66.03 | VILWFSFGASC | 33.59 | | | EVILWFSFGAS | 5.73 | | |
| HA | H7N3 | 562 | 0.04 | yes | 1 | 0 | 99.23 | ILWFSFGASCF | 99.62 | | | | | | | | |
| HA | H7N3 | 563 | 0.99 | yes | 2 | 0.38 | 99.23 | LWFSFGASCFL | 65.9 | LWFSFGASCFI | 33.33 | | | WFSFGASCFIF | 1.53 | | |
| HA | H7N3 | 564 | 1.12 | yes | 4 | 0.38 | 99.23 | WFSFGASCFLL | 64.37 | WFSFGASCFIL | 32.95 | | | WFSFGASCFIF | | | |

Fig. 75-220

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N3 | 565 | 1.72 | yes | 5 | 0.38 | 99.23 | FSFGASCFLLL | 42.53

Fig. 75-221

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 114 | 0.57 | yes | 4 | 0 | 99.49 | VIVTREPYYSC

Fig. 75-222

| Protein | Sub-type | Start Pos | Block Entropy | Gaps < 10% | # to cover 99% | Gap % | coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 186 | 0.27 | yes | 5 | 0 | 99.49 | DGKE

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N3 | 487 | 0.31 | yes | 2 | 0 | 99.49 | NSIVTFCGLDN | 94.92

Fig. 75-226

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 52

Fig. 75-227

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 365 | 0.07 | yes | 1 | 0 | 99.22 | GLFG

Fig. 75-228

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 406 | 0.86 | yes | 5 | 0 | 99.22 | QSAI

Fig. 75-229

| Protein | Sub-type | Start Pos | Block Entropy | Gaps < 10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H7N7 | 465 | 0.85 | yes | 4 | 0 | 99.22 | AMENQHTIDLA | 82.03 | AMENQHTIDLT | 14.84 | AVENQHTIDST | 1.56 | | |
| HA | H7N7 | 466 | 0.88 | yes | 5 | 0 | 99.22 | ENQHTIDLADS | 81.25 | ENQHTIDLTDS | 15.62 | ENQHTIDLADS | 0.78 | ENQHTIDLTNS | 0.78 |
| HA | H7N7 | 467 | 0.88 | yes | 5 | 0 | 99.22 | NQHTIDLADSE | 81.25 | NQHTIDLTDSE | 15.62 | NQHIIDLADSE | 0.78 | NQHTIDSTDSE | 0.78 |
| HA | H7N7 | 468 | 0.88 | yes | 5 | 0 | 99.22 | QHTIDLADSEM | 81.25 | QHTIDLTDSEM | 15.62 | QHIIDLADSEM | 0.78 | QHTIDSTDSEM | 0.78 |
| HA | H7N7 | 469 | 0.88 | yes | 5 | 0 | 99.22 | HTIDLADSEMN | 81.25 | HTIDLTDSEMN | 15.62 | HIIDLADSEMN | 0.78 | HTIDSTDSEMN | 0.78 |
| HA | H7N7 | 470 | 0.88 | yes | 5 | 0 | 99.22 | TIDLADSEMNK | 81.25 | TIDLTDSEMNK | 15.62 | HIDLADSEMN | 0.78 | IIDLADSEMNK | 0.78 |
| HA | H7N7 | 471 | 0.82 | yes | 4 | 0 | 99.22 | IDLADSEMNKL | 82.03 | IDLTDSEMNKL | 15.62 | TIDSTDSEMNK | 0.78 | | |
| HA | H7N7 | 472 | 0.82 | yes | 4 | 0 | 99.22 | DLADSEMNKLY | 82.03 | DLTDSEMNKLY | 15.62 | IDLAESEMNKL | 0.78 | | |
| HA | H7N7 | 473 | 0.82 | yes | 4 | 0 | 99.22 | LADSEMNKLYE | 82.03 | LTDSEMNKLYE | 15.62 | DLTNSEMNKLY | 0.78 | | |
| HA | H7N7 | 474 | 0.85 | yes | 4 | 0 | 99.22 | ADSEMNKLYER | 82.03 | TDSEMNKLYER | 14.84 | LTNSEMNKLYE | 0.78 | | |
| HA | H7N7 | 475 | 0.73 | yes | 3 | 0 | 99.22 | DSEMNKLYERV | 83.59 | DSEMNKLYEKV | 14.84 | AESEMNKLYER | 0.78 | | |
| HA | H7N7 | 476 | 1.46 | yes | 4 | 0 | 100 | SEMNKLYERVK | 46.09 | SEMNKLYEKVR | 38.28 | ESEMNKLYERV | 0.78 | | |
| HA | H7N7 | 477 | 1.85 | yes | 4 | 0 | 100 | EMNKLYERVKR | 38.28 | EMNKLYEKVRR | 33.59 | EMNKLYERVRK | 15.6 | | |
| HA | H7N7 | 478 | 1.85 | yes | 4 | 0 | 100 | MNKLYERVKRQ | 38.28 | MNKLYEKVRRQ | 33.59 | MNKLYERVRRQ | 15.6 | | |
| HA | H7N7 | 479 | 1.85 | yes | 4 | 0 | 99.22 | NKLYERVKRQL | 38.28 | NKLYEKVRRQL | 33.59 | NKLYERVRRQL | 15.6 | | |
| HA | H7N7 | 480 | 1.91 | yes | 4 | 0 | 99.22 | KLYERVKRQLR | 38.28 | KLYEKVRRQLR | 32.81 | KLYERVRRQLR | 15.6 | | |
| HA | H7N7 | 481 | 1.91 | yes | 4 | 0 | 99.22 | LYERVKRQLRE | 38.28 | LYEKVRRQLRE | 32.81 | LYERVRRQLRE | 15.6 | | |
| HA | H7N7 | 482 | 1.91 | yes | 4 | 0 | 99.22 | YERVKRQLREN | 38.28 | YEKVRRQLREN | 32.81 | YERVRRQLREN | 15.6 | | |
| HA | H7N7 | 483 | 1.91 | yes | 4 | 0 | 99.22 | ERVKRQLRENA | 38.28 | EKVRRQLRENA | 32.81 | ERVRRQLRENA | 15.6 | | |
| HA | H7N7 | 484 | 1.47 | yes | 3 | 0 | 99.22 | RVKRQLRENAE | 38.28 | KVRRQLRENAE | 32.81 | RVRRQLRENAE | 15.6 | | |
| HA | H7N7 | 485 | 1.47 | yes | 3 | 0 | 99.22 | VKRQLRENAEE | 38.28 | VRRQLRENAEE | 32.81 | | | | |
| HA | H7N7 | 486 | 0.72 | yes | 3 | 0 | 99.22 | KRQLRENAEED | 48.44 | RRQLRENAEED | 38.28 | | | | |
| HA | H7N7 | 487 | 0.86 | yes | 3 | 0 | 99.22 | RQLRENAEEDC | 48.44 | KQLRENAEEDC | 12.5 | | | | |
| HA | H7N7 | 488 | 0.8 | yes | 3 | 0 | 99.22 | QLRENAEEDGT | 85.16 | KQLRENAEEDG | 12.5 | | | | |
| HA | H7N7 | 489 | 0.86 | yes | 3 | 0 | 99.22 | LRENAEEDGTG | 82.03 | LRENAEEDCTG | 15.62 | LRENAEEDGTA | 1.56 | | |
| HA | H7N7 | 490 | 0.86 | yes | 3 | 0 | 99.22 | RENAEEDGTGC | 81.25 | RENAEEDCTGC | 15.62 | RENAEEDGTAC | 1.56 | | |
| HA | H7N7 | 491 | 0.86 | yes | 3 | 0 | 99.22 | ENAEEDGTGCF | 82.03 | ENAEEDCTGCF | 15.62 | | | | |
| HA | H7N7 | 492 | 0.86 | yes | 3 | 0 | 99.22 | NAEEDGTGCFE | 81.25 | NAEEDCTGCFE | 15.62 | | | | |
| HA | H7N7 | 493 | 0.86 | yes | 3 | 0 | 99.22 | AEEDGTGCFEI | 82.03 | AEEDCTGCFEI | 15.62 | AEDGTGCFEL | 1.56 | | |
| HA | H7N7 | 494 | 0.75 | yes | 3 | 0 | 99.22 | EEDGTGCFEIF | 82.03 | EEDCTGCFEIF | 15.62 | EEDGTACFEIF | 1.56 | | |
| HA | H7N7 | 495 | 0.75 | yes | 3 | 0 | 99.22 | EDGTGCFEIFH | 81.25 | EDCTGCFEIFH | 15.62 | EDGTACFEIFH | 1.56 | | |
| HA | H7N7 | 496 | 0.75 | yes | 3 | 0 | 99.22 | DGTGCFEIFHK | 81.25 | DCTGCFEIFHK | 15.62 | DGTACFEIFHK | 1.56 | | |
| HA | H7N7 | 497 | 0.75 | yes | 3 | 0 | 99.22 | GTGCFEIFHKC | 81.25 | CTGCFEIFHKC | 15.62 | GTACFEIFHKC | 1.56 | | |
| HA | H7N7 | 498 | 0.75 | yes | 3 | 0 | 99.22 | TGCFEIFHKCD | 82.81 | TGCFELFHKCD | 15.62 | | | | |
| HA | H7N7 | 499 | 0.75 | yes | 3 | 0 | 99.22 | GCFEIFHKCDD | 82.81 | GCFELFHKCDD | 15.62 | | | | |
| HA | H7N7 | 500 | 1.21 | yes | 5 | 0 | 99.22 | CFEIFHKCDDC | 73.44 | CFEIFHKCDDN | 15.62 | CFEIFHKCDDD | 8.59 | CFEIFHKCDDQ | 0.78 | CFEIFHKCDDN | 0.78 |
| HA | H7N7 | 501 | 1.21 | yes | 5 | 0 | 99.22 | FEIFHKCDDDC | 73.44 | FEIFHKCDDNC | 15.62 | FEIFHKCDDDC | 8.59 | FEIFHQCDNDC | 0.78 | FEIFHKCDDRC | 0.78 |
| HA | H7N7 | 502 | 1.21 | yes | 5 | 0 | 99.22 | EIFHKCDDDCM | 73.44 | EIFHKCDDNCM | 15.62 | ELFHKCDDDCM | 8.59 | EIFHQCDNDCM | 0.78 | EIFHKCDDNCM | 0.78 |
| HA | H7N7 | 503 | 0.71 | yes | 3 | 0 | 99.22 | CMASIRNNTYD | 87.5 | CMANIRNNTYD | 9.38 | CMESIRNNTYD | 0.78 | CMGSIRNNTYD | 0.78 | |
| HA | H7N7 | 512 | 0.71 | yes | 3 | 0 | 99.22 | MASIRNNTYDH | 87.5 | MASIRNNSYDH | 9.38 | MESIRNNTYDH | 0.78 | MTSIRNNTYDH | 0.78 | |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 130 | 0 | yes | 1 | 0 | 100 | MYALHQGTT

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H7N7 | 401 | 0.11 | yes | 2 | 0 | 100 | NWSGYSGSFID | 98.55 | NRSGYSGSFID | 1.45

Fig. 75-236

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 11 | 1.14 | yes | 4 | 1.49 | 100 | LASTNAYDRIC | 62.12 | LVSTNAYDRIC | 34.85 | LMSTNAYDRIC | 1.52 | LASTNAHDRIC | 1.52 | | |
| HA | H8 | 12 | 1.14 | yes | 4 | 1.49 | 100 | ASTNAYDRIC

Fig. 75-237

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H8 | 66 | 0.11 | yes | 2 | 0 | 100 | PLELRDCKIEA | 98.51 | PLELRDCKVEA | 1.49 | | | | | | |
| HA | H8 | 67 | 0.11 | yes | 2 | 0 | 100 | LELRDCKIEAV | 98.51 | LELRDCKVEAV | 1.49 | | | | | | |
| HA | H8 | 68 | 0.11 | yes | 2 | 0 | 100 | ELRDCKIEAVI | 98.51 | ELRDCKVEAVI | 1.49 | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 157 | 0.53 | yes | 2 | 0 | 100 | QSFYRSINWLT | 88.06 | QAFYRSIN

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 254 | 0 | yes | 1 | 0 | 100 | GETLKIRTNGN | 100 | | | | | | |
| HA | H8 | 255 | 0 | yes | 1 | 0 | 100 | ETLKIRTNGNL | 100 | | | | | | |
| HA

Fig. 75-242

| Protein | Sub-type | Start Pos | Block Entropy | Gaps < 10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 312 | 0.34 | yes | 4 | 1.49 | 100 | NASRHYMGECP | 95.45 | NASRYYMGECP | 1.52 | NT

Fig. 75-243

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 364 | 0.19 | yes | 2 | 0 | 100 | DGWYGFHH

Fig. 75-244

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 404 | 0.63 | yes | 4 | 0 | 100 | MNREFEVVNHE | 89.55

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq | Peptides included | Freq |
|---|---|---|---|---|---|---|---|---|---|---|---|---|---|---|---|---|---|
| HA | H8 | 508 | 0.11 | yes | 2 | 0 | 100 | EEEAKLERS

Fig. 75-247

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| HA | H8 | 549 | 0 | yes | 1

Fig. 75-248

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| HA | H9 | 432 | 0.12 | yes | 2 | 0 | 99.11 | WAYNAELLVLI | 98.92 | WAYNAELLVLIE | 0.19 | | | | |
| HA | H9 | 433 | 0.

Fig. 75-249

| Protein | Sub-type | Start Pos | Block Entropy | Gaps < 10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| HA | H9N2 | 426 | 0.79 | yes | 5 | 0 | 99.14 | DQIQ

Fig. 75-250

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NA | H9N2 | 182 | 0.68 | yes | 4 | 0 |

Fig. 75-251

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 23 | 1.39 | yes | 5 | 0.02 | 99.35 | LKAEIAQRLED | 65.83 | LKAEIAQRLES | 22.36 | LKAEIAQRLEG | 9.58 | LKAEIAQRLEN | 1.04 | LKAEIAQRLEN | 0.54 |
| M1 | N/A | 24 | 1.4 | yes | 5 | 0.03 | 99.3 | KAEIAQRLEDV | 65.84 | KAEIAQRLESV | 22.37 | KAEIAQRLEGV | 9.58 | KAEIAQRLENV | 0.98 | KAEIAQRLENV | 0.54 |
| M1 | N/A | 25 | 1.4 | yes | 5 | 0.03 | 99.3 | AEIAQRLEDVF | 65.83 | AEIAQRLESVF | 22.37 | AEIAQRLEGVF | 9.57 | AEIAQRLENVF | 1 | AEIAQRLENVF | 0.54 |
| M1 | N/A | 26 | 1.42 | yes | 5 | 0.03 | 99.06 | EIAQRLEDVFA | 65.62 | EIAQRLESVFA | 22.36 | EIAQRLEGVFA | 9.56 | EIAQRLENVFA | 0.99 | EIAQRLENVFA | 0.54 |
| M1 | N/A | 27 | 1.41 | yes | 5 | 0.02 | 99.16 | IAQRLEDVFAG | 65.71 | IAQRLESVFAG | 22.37 | IAQRLEGVFAG | 9.56 | IAQRLENVFAG | 1 | IAQRLENVFAG | 0.54 |
| M1 | N/A | 28 | 1.41 | yes | 5 | 0.03 | 99.16 | AQRLEDVFAGK | 65.65 | AQRLESVFAGK | 22.36 | AQRLEGVFAGK | 9.56 | AQRLENVFAGK | 1 | AQRLENVFAGK | 0.54 |
| M1 | N/A | 34 | 0.3 | yes | 4 | 0.03 | 99.16 | VFAGKNTDLEA | 97.04 | VFAGKNADLEA | 0.85 | VFAGKNTDLEV | 0.6 | VFSGKNTDLEA | 0.46 | | |
| M1 | N/A | 35 | 0.3 | yes | 4 | 0.03 | 99.13 | FAGKNTDLEAL | 97.04 | FAGKNADLEAL | 0.85 | FAGKNTDLEVL | 0.57 | FSGKNTDLEAL | 0.46 | | |
| M1 | N/A | 36 | 0.3 | yes | 4 | 0.03 | 99.11 | AGKNTDLEALM | 97.04 | AGKNADLEALM | 0.85 | AGKNTDLEVLM | 0.57 | SGKNTDLEALM | 0.45 | | |
| M1 | N/A | 37 | 0.27 | yes | 4 | 0.02 | 99.18 | GKNTDLEALME | 97.32 | GKNADLEALME | 0.85 | GKNTDLEVLME | 0.57 | | | | |
| M1 | N/A | 38 | 0.27 | yes | 4 | 0.02 | 99.16 | KNTDLEALMEW | 97.3 | KNADLEALMEW | 0.85 | KNTDLEVLMEW | 0.57 | | | | |
| M1 | N/A | 39 | 0.34 | yes | 5 | 0.02 | 99.39 | NTDLEALMEWL | 96.45 | NADLEALMEWI | 0.92 | NSDLEALMEW | 0.81 | NTDLEVLMEWL | 0.44 | | |
| M1 | N/A | 40 | 0.32 | yes | 5 | 0.04 | 99.03 | TDLEALMEWLK | 96.64 | NTDLEALMEWI | 0.93 | KNSDLEALMEW | 0.81 | TDLEVLMEWLK | 0.44 | | |
| M1 | N/A | 41 | 0.19 | yes | 2 | 0.04 | 99.02 | DLEALMEWLKT | 98.07 | DLEALMEWIKT | 0.96 | NSDLEALMEWI | 0.81 | | | | |
| M1 | N/A | 42 | 0.19 | yes | 2 | 0.04 | 99.04 | LEALMEWLKTR | 98.06 | LEALMEWIKTR | 0.96 | SDLEALMEWLK | 0.81 | | | | |
| M1 | N/A | 43 | 0.19 | yes | 2 | 0.04 | 99.06 | EALMEWLKTRP | 98.09 | EALMEWIKTRP | 0.95 | | | | | | |
| M1 | N/A | 44 | 0.15 | yes | 2 | 0.03 | 99.06 | ALMEWLKTRPI | 98.12 | ALMEWIKTRPI | 0.95 | | | | | | |
| M1 | N/A | 45 | 0.13 | yes | 2 | 0.02 | 99.51 | LMEWLKTRPIL | 98.56 | LMEWIKTRPIL | 0.95 | | | | | | |
| M1 | N/A | 46 | 0.13 | yes | 2 | 0.02 | 99.62 | MEWLKTRPILS | 98.67 | MEWIKTRPILS | 0.95 | | | | | | |
| M1 | N/A | 47 | 0.16 | yes | 2 | 0.02 | 99.33 | EWLKTRPILSP | 98.39 | EWIKTRPILSP | 0.95 | | | | | | |
| M1 | N/A | 48 | 0.16 | yes | 2 | 0.02 | 99.34 | WLKTRPILSPL | 98.39 | WIKTRPILSPL | 0.95 | | | | | | |
| M1 | N/A | 49 | 0.17 | yes | 2 | 0.04 | 99.28 | LKTRPILSPLT | 98.33 | IKTRPILSPLT | 0.95 | | | | | | |
| M1 | N/A | 50 | 0.09 | yes | 1 | 0.05 | 99.23 | KTRPILSPLTK | 99.23 | | | | | | | | |
| M1 | N/A | 51 | 0.09 | yes | 1 | 0.05 | 99.25 | TRPILSPLTKG | 99.25 | | | | | | | | |
| M1 | N/A | 52 | 0.31 | yes | 2 | 0.06 | 99.2 | RPILSPLTKGI | 95.76 | RPILSPLTKGM | 3.45 | | | SSLTKGVLGFV | 0.32 | | |
| M1 | N/A | 53 | 0.31 | yes | 2 | 0.06 | 99.23 | PILSPLTKGIL | 95.78 | PILSPLTKGML | 3.45 | | | SLTKGVLGFVF | 0.32 | | |
| M1 | N/A | 54 | 0.33 | yes | 3 | 0.06 | 99.23 | ILSPLTKGILG | 95.78 | ILSPLTKGMLG | 3.45 | | | LTKGVLGFVFT | 0.38 | | |
| M1 | N/A | 55 | 0.33 | yes | 3 | 0.06 | 99.07 | LSPLTKGILGF | 95.63 | LSPLTKGMLGF | 3.45 | | | TKGVLGFVFTL | 0.38 | | |
| M1 | N/A | 56 | 0.34 | yes | 3 | 0.06 | 99.2 | SPLTKGILGFV | 95.43 | SPLTKGMLGFV | 3.45 | | | | | | |
| M1 | N/A | 57 | 0.33 | yes | 3 | 0.06 | 99.19 | PLTKGILGFVF | 95.43 | PLTKGMLGFVF | 3.45 | | | | | | |
| M1 | N/A | 58 | 0.31 | yes | 2 | 0.05 | 99.31 | LTKGILGFVFT | 95.48 | LTKGMLGFVFT | 3.45 | | | | | | |
| M1 | N/A | 59 | 0.32 | yes | 3 | 0.04 | 99.33 | TKGILGFVFTL | 95.49 | TKGMLGFVFTL | 3.45 | | | | | | |
| M1 | N/A | 60 | 0.32 | yes | 2 | 0.02 | 99.03 | KGILGFVFTLT | 95.55 | KGMLGFVFTLT | 3.45 | | | | | | |
| M1 | N/A | 61 | 0.32 | yes | 2 | 0.02 | 99.09 | GILGFVFTLTV | 95.61 | GMLGFVFTLTV | 3.48 | | | | | | |
| M1 | N/A | 62 | 0.32 | yes | 2 | 0.04 | 99.04 | ILGFVFTLTVP | 95.57 | MLGFVFTLTVP | 3.48 | | | | | | |
| M1 | N/A | 63 | 0.08 | yes | 1 | 0.02 | 99.35 | LGFVFTLTVPS | 99.35 | | | | | | | | |
| M1 | N/A | 64 | 0.08 | yes | 1 | 0.01 | 99.3 | GFVFTLTVPSE | 99.3 | | | | | | | | |
| M1 | N/A | 65 | 0.06 | yes | 1 | 0.01 | 99.48 | FVFTLTVPSER | 99.48 | | | | | | | | |
| M1 | N/A | 66 | 0.05 | yes | 1 | 0.01 | 99.48 | VFTLTVPSERG | 99.48 | | | | | | | | |
| M1 | N/A | 67 | 0.05 | yes | 1 | 0.01 | 99.66 | FTLTVPSERGL | 99.66 | | | | | | | | |

Fig. 75-252

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 68 | 0.04 | yes | 1 | 0.01 | 99.69 | TLTVPSERGLQ | 99.69 | | | | | | |
| M1 | N/A | 69 | 0.05 | yes | 1 | 0.01 | 99.67 | LTVPSERGLQR | 99.67 | | | | | | |
| M1 | N/A | 70 | 0.07 | yes | 2 | 0.03 | 99.51 | TVPSERGLQRR | 99.51 | | | | | | |
| M1 | N/A | 71 | 0.07 | yes | 2 | 0.03 | 99.49 | VPSERGLQRRR | 99.49 | | | | | | |
| M1 | N/A | 72 | 0.07 | yes | 2 | 0.03 | 99.48 | PSERGLQRRRF | 99.48 | | | | | | |
| M1 | N/A | 73 | 0.13 | yes | 2 | 0.03 | 99.53 | SERGLQRRRFV | 99.59 | SERGLQRRRFI | 0.87 | | | | | |
| M1 | N/A | 74 | 0.13 | yes | 2 | 0.03 | 99.44 | ERGLQRRRFVQ | 98.57 | ERGLQRRRFIQ | 0.87 | | | | | |
| M1 | N/A | 75 | 0.15 | yes | 2 | 0.03 | 99.39 | RGLQRRRFVQN | 98.57 | RGLQRRRFIQN | 0.87 | | | | | |
| M1 | N/A | 76 | 0.15 | yes | 2 | 0.04 | 99.37 | GLQRRRFVQNA | 98.52 | GLQRRRFIQNA | 0.87 | | | | | |
| M1 | N/A | 77 | 0.15 | yes | 2 | 0.04 | 99.37 | LQRRRFVQNAL | 98.5 | LQRRRFIQNAL | 0.87 | | | | | |
| M1 | N/A | 78 | 0.28 | yes | 2 | 0.03 | 99.22 | QRRRFVQNALN | 96.87 | QRRRFIQNALN | 1.59 | | | | | |
| M1 | N/A | 79 | 0.28 | yes | 2 | 0.04 | 99.22 | RRRFVQNALNG | 96.85 | RRRFIQNALNG | 1.6 | | | | | |
| M1 | N/A | 80 | 0.27 | yes | 2 | 0.02 | 99.35 | RRFVQNALNGN | 96.85 | RRFIQNALNGN | 1.6 | | | | | |
| M1 | N/A | 81 | 0.26 | yes | 2 | 0.02 | 99.37 | RFVQNALNGNG | 96.98 | RFIQNALNGNG | 1.6 | | | | | |
| M1 | N/A | 82 | 0.26 | yes | 2 | 0.02 | 99.38 | FVQNALNGNGD | 97 | FIQNALNGNGD | 1.6 | | | | | |
| M1 | N/A | 83 | 0.24 | yes | 2 | 0.02 | 99.05 | VQNALSGNGDP | 97.01 | IQNALNGNGDP | 1.6 | | | | | |
| M1 | N/A | 84 | 0.24 | yes | 2 | 0.02 | 99.06 | QNALSGNGDPN | 97.37 | | | | | | | |
| M1 | N/A | 85 | 0.23 | yes | 2 | 0.02 | 99.1 | NALSGNGDPNN | 97.37 | | | | | | | |
| M1 | N/A | 86 | 0.25 | yes | 3 | 0.03 | 99.25 | ALSGNGDPNNM | 97.43 | | | | | | | |
| M1 | N/A | 87 | 1 | yes | 3 | 0.02 | 99.16 | LNGNGDPNNMD | 97.29 | LNGNGDPSNMD | 1.67 | NGNGDPSNMDR | 0.29 | | |
| M1 | N/A | 88 | 0.88 | yes | 4 | 0.03 | 99.18 | NGNGDPNNMDR | 75.52 | SGNGDPNNMDR | 21.8 | GDPNNMARAVK | 1.56 | NGNGDPSNMDR | 0.28 | |
| M1 | N/A | 89 | 0.9 | yes | 3 | 0.02 | 99.06 | GNGDPNNMDKA | 77.11 | GNGDPNNMDRA | 21.8 | GDPSNMDRAVK | 0.28 | GDPNNMARAVK | 0.13 | DPNNIDRAVKL | 0.12 |
| M1 | N/A | 90 | 0.91 | yes | 3 | 0.03 | 99.04 | NGDPNNMDKAV | 77.06 | NGDPNNMDRAV | 21.72 | DPSNMDRAVKL | 0.28 | DPNNMARAVKL | 0.13 | PNNIDRAVKLY | 0.12 |
| M1 | N/A | 91 | 0.92 | yes | 3 | 0.03 | 99.09 | GDPNNMDRAVK | 77.01 | GDPSNMDRAVK | 2.62 | PSNMDRAVKL | 0.28 | PNNMARAVKLY | 0.13 | NMARAVIKLYK | 0.12 |
| M1 | N/A | 92 | 0.92 | yes | 3 | 0.03 | 99.04 | DPNNMDKAVKL | 77.01 | DPSNMDRAVKL | 21.6 | PNNMARAVKL | 0.28 | NMDKAVKLYKK | 0.93 | MARAVIKLYKKL | 0.12 |
| M1 | N/A | 93 | 1.72 | yes | 3 | 0.02 | 99.09 | PNNMDRAVKLY | 76.96 | DPSNMDRAVKL | 21.59 | PNNMARAVKLY | 0.28 | NMDKAVKLYKK | 0.93 | |
| M1 | N/A | 94 | 1.71 | yes | 5 | 0.03 | 99.08 | NMDRAVKLYRK | 38.57 | PNNMDKAVKLY | 21.59 | NMDRAVIKLY | 0.28 | MDKAVKLYKKL | 0.93 | |
| M1 | N/A | 95 | 1.68 | yes | 5 | 0.02 | 99.03 | MDRAVKLYRKL | 38.58 | PNNMDRAVKLY | 38.73 | MDKAVKLYKKL | 20.7 | DKAVKLYKKLK | 0.93 | |
| M1 | N/A | 96 | 1.06 | yes | 5 | 0.02 | 99.02 | DRAVKLYRKLK | 38.61 | MDRAVKLYKKL | 38.79 | DKAVKLYKKLK | 20.7 | KAVKLYKKLKR | 0.94 | |
| M1 | N/A | 97 | 1.27 | yes | 4 | 0.01 | 99.23 | RAVKLYRKLKR | 38.78 | DRAVKLYKKLK | 38.84 | KAVKLYKKLKR | 20.7 | | | |
| M1 | N/A | 98 | 1.27 | yes | 2 | 0.03 | 99.23 | AVKLYRKLKRE | 39.73 | RAVKLYKKLKR | 59.5 | AVKLYKKLKRE | 20.7 | | | |
| M1 | N/A | 99 | 1.27 | yes | 3 | 0.03 | 99.13 | VKLYRKLKREI | 35.28 | VKLYKKLKREI | 59.42 | VKLYKKLKREM | 4.43 | RKLKREMTFHG | 0.18 | |
| M1 | N/A | 100 | 1.28 | yes | 3 | 0.03 | 99.18 | KLYRKLKREIT | 35.31 | KLYKKLKREIT | 59.43 | KLYKKLKREMT | 4.44 | | | |
| M1 | N/A | 101 | 1.29 | yes | 3 | 0.03 | 99.23 | LYRKLKREITF | 35.31 | LYKKLKREITF | 59.44 | LYKKLKREMTF | 4.48 | | | |
| M1 | N/A | 102 | 1.29 | yes | 4 | 0.03 | 99.12 | YRKLKREITFH | 35.31 | YKKLKREITFH | 59.31 | YKKLKREMTFH | 4.5 | | | |
| M1 | N/A | 103 | 1.29 | yes | 3 | 0.03 | 99.15 | RKLKREITFHG | 35.2 | KKLKREITFHG | 59.26 | KKLKREMTFHG | 4.5 | RKLKREMTFHG | 0.16 | |
| M1 | N/A | 104 | 0.39 | yes | 3 | 0.03 | 99.06 | KLKREITFHGA | 94.36 | KLKREMTFHGA | 4.68 | LKREITFYGAK | 0.16 | | | |
| M1 | N/A | 105 | 0.41 | yes | 4 | 0.04 | 99.04 | LKREITFHGAK | 94.25 | LKREMTFHGAK | 4.66 | KREITFYGAK | 0.16 | | | |
| M1 | N/A | 106 | 0.4 | yes | 3 | 0.03 | 99.09 | KREITFHGAKE | 94.27 | KREMTFHGAKE | 4.66 | REITFYGAKE | 0.16 | | | |
| M1 | N/A | 107 | 1.26 | yes | 5 | 0.05 | 99.04 | REITFHGAKEV | 65.45 | REMTFHGAKEV | 28.77 | REITFHRAKEV | 4.59 | REITFYGAKEI | 0.11 | REITFYGAKEI | 0.11 |

Fig. 75-253

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M | N/A | 119 | 1.75 | yes | 5 | 0.03 | 99.1 | ALSYSTGALAS | 39.95 | ALSYSTGALAS | 33.05 | ALGYSTGALAS | 24.9 | SLYSTGALAS | 0.93 | SLYSAAGALAS | 0.32 |
| M | N/A | 120 | 1.09 | yes | 3 | 0.03 | 99.12 | LSYSTGALASC | 64.81 | LGYSTGALASC | 33.37 | | 0.94 | | | | |
| M | N/A | 121 | 1.08 | yes | 3 | 0.03 | 99.26 | SYSTGALASCM | 64.87 | GYSTGALASCM | 33.46 | | 0.94 | | | | |
| M | N/A | 122 | | yes | 2 | 0.01 | 99.31 | YSTGALASCMG | 65.85 | | 33.46 | | | | | | |
| M | N/A | 123 | | yes | 2 | 0.01 | 99.28 | STGALASCMGL | 65.82 | | 33.45 | | | | | | |
| M | N/A | 124 | 1.01 | yes | 2 | 0.01 | 99.25 | TGALASCMGLI | 65.84 | | 33.41 | | | | | | |
| M | N/A | 125 | 0.09 | yes | 1 | 0.01 | 99.23 | GALASCMGLI | 99.25 | | | | | | | | |
| M | N/A | 126 | 0.1 | yes | 1 | 0.01 | 99.18 | ALASCMGLIYN | 99.18 | | | | | | | | |
| M | N/A | 127 | 0.11 | yes | 1 | 0.01 | 99.11 | LASCMGLIYNR | 99.11 | | | | | | | | |
| M | N/A | 128 | 0.11 | yes | 1 | 0.01 | 99.09 | ASCMGLIYNRM | 99.09 | | | | | | | | |
| M | N/A | 129 | 0.08 | yes | 1 | 0.01 | 99.35 | SCMGLIYNRMG | 99.35 | | | | | | | | |
| M | N/A | 130 | 0.93 | yes | 2 | 0.02 | 99.53 | CMGLIYNRMGT | 70.28 | CMGLIYNRMGA | 29.25 | | | | | | |
| M | N/A | 131 | 1.15 | yes | 3 | 0.05 | 99.32 | MGLIYNRMGTV | 69.4 | MGLIYNRMGAV | 29.24 | MGLIYNRMGTI | 0.76 | | | | |
| M | N/A | 132 | 1.01 | yes | 3 | 0.06 | 99.61 | GLIYNRMGTVT | 67.51 | GLIYNRMGAVT | 29.19 | GLIYNRMGTVA | 1.54 | GLIYNRMGTVN | 0.76 | | |
| M | N/A | 146 | 0.79 | yes | 2 | 0.04 | 99.68 | AFGLVCATCEQ | 85.28 | ALGLVCATCEQ | 8.75 | | 5.58 | | | | |
| M | N/A | 147 | 0.78 | yes | 2 | 0.04 | 99.66 | FGLICATCEQI | 85.34 | LGLVCATCEQI | 8.75 | | 5.58 | | | | |
| M | N/A | 148 | 0.48 | yes | 2 | 0.04 | 99.62 | GLICATCEQIA | 90.9 | VCATCEQIADA | 8.76 | | | | | | |
| M | N/A | 149 | 0.48 | yes | 2 | 0.04 | 99.58 | LVCATCEQIAD | 90.86 | CATCEQIADSH | 8.74 | | | | | | |
| M | N/A | 150 | 0.66 | yes | 3 | 0.05 | 99.69 | VCATCEQIADS | 88.13 | ATCEQIADSHH | 2.74 | ATCEQIADAQ | 1.85 | | | | |
| M | N/A | 151 | 0.36 | yes | 2 | 0.05 | 99.64 | CATCEQIADSQ | 95.1 | ATCEQIADAQH | 2.74 | | 1.86 | | | | |
| M | N/A | 152 | 0.78 | yes | 3 | 0.04 | 99.52 | ATCEQIADSQH | 95.09 | TCEQIADSQHK | 8.54 | TCEQIADSHHR | 2.75 | | | | |
| M | N/A | 153 | 0.79 | yes | 3 | 0.05 | 99.45 | TCEQIADSQHR | 86.54 | CEQIADSQHKS | 8.53 | CEQIADSHHRS | 2.75 | | | | |
| M | N/A | 154 | 0.8 | yes | 4 | 0.04 | 99.42 | CEQIADSQHRS | 86.43 | EQIADSQHKSH | 8.53 | EQIADSHHRSH | 2.75 | | | | |
| M | N/A | 155 | 0.8 | yes | 4 | 0.05 | 99.4 | EQIADSQHRSH | 86.36 | QIADSQHKSHR | 8.53 | QIADSHHRSHR | 2.76 | | | | |
| M | N/A | 156 | 0.81 | yes | 4 | 0.04 | 99.29 | QIADSQHRSHR | 86.33 | IADSQHKSHRQ | 8.53 | IADSHHRSHRQ | 2.76 | | | | |
| M | N/A | 157 | 0.82 | yes | 4 | 0.05 | 99.15 | IADSQHRSHRQ | 86.32 | ADSQHKSHRQM | 8.52 | ADSHHRSHRQM | 2.75 | | | | |
| M | N/A | 158 | 1.47 | yes | 3 | 0.07 | 99.45 | ADSQHRSHRQM | 86.22 | TTNPLIKHEN | 11.86 | ATTNPLIRHEN | 9.87 | | | | |
| M | N/A | 170 | 1.05 | yes | 2 | 0.03 | 99.59 | TTTNPLIRHEN | 68.82 | TTNPLIRHENR | 11.97 | ITTNPLIRHEN | 9.89 | | | | |
| M | N/A | 171 | 0.58 | yes | 3 | 0.03 | 99.69 | TTNPLIRHENR | 77.59 | TNPLIKHENRM | 11.98 | | | | | | |
| M | N/A | 172 | 0.57 | yes | 3 | 0.03 | 99.61 | TNPLIRHENRM | 87.61 | NPLIKHENRMV | 11.99 | PLIRHENRMVI | 2.13 | | | | |
| M | N/A | 173 | 0.72 | yes | 3 | 0.03 | 99.61 | NPLIRHENRMV | 87.7 | PLIKHENRMVL | 11.98 | LIRHENRMVIA | 2.13 | | | | |
| M | N/A | 174 | 0.81 | yes | 3 | 0.03 | 99.59 | PLIRHENRMVL | 85.5 | LIKHENRMVLA | 11.98 | IRHENRMVIAS | 2.13 | | | | |
| M | N/A | 175 | 0.73 | yes | 3 | 0.03 | 99.61 | LIRHENRMVLA | 85.48 | IKHENRMVLAS | 11.98 | RHENRMVIAST | 2.13 | | | | |
| M | N/A | 176 | 0.73 | yes | 3 | 0.03 | 99.55 | IRHENRMVLAS | 85.5 | KHENRMVLAST | 11.96 | | | | | | |
| M | N/A | 177 | 0.73 | yes | 2 | 0.02 | 99.55 | RHENRMVLAST | 85.45 | | 2.13 | | | | | | |
| M | N/A | 178 | 0.21 | yes | 2 | 0.03 | 99.51 | HENRMVLASTTA | 97.41 | ENRMVIASTTA | 2.14 | | | | | | |
| M | N/A | 180 | 0.21 | yes | 2 | 0.02 | 99.54 | ENRMVLASTTAK | 97.42 | NRMVIASTTAK | 2.13 | | | | | | |
| M | N/A | 181 | 0.21 | yes | 2 | 0.01 | 99.54 | NRMVLASTTAKA | 97.37 | RMVIASTTAKA | 2.14 | | | | | | |
| M | N/A | 182 | 0.21 | yes | 2 | 0.02 | 99.52 | RMVLASTTAKAM | 97.39 | MVIASTTAKAM | 2.15 | | | | | | |
| M | N/A | | | | | | | MVLASTTAKAM | 97.37 | | | | | | | | |

Fig. 75-254

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M | N/A | 183 | 0.22 | yes | 2 | 0.02 | 99.5 | VLASTTAKAME | 97.37 | VLASTTAKAME | 2.14 | | | | |
| M | N/A | 184 | 0.22 | yes | 2 | 0.03 | 99.46 | LASTTAKAMEQ | 97.32 | LASTTAKAMEQ | 2.14 | | | | |
| M | N/A | 185 | 0.23 | yes | 2 | 0.05 | 99.36 | ASTTAKAMEQM | 97.29 | ASTTAKAMEQV | 2.07 | | | | |
| M | N/A | 186 | 0.23 | yes | 2 | 0.05 | 99.33 | STTAKAMEQMA | 97.26 | STTAKAMEQVA | 2.07 | | | | |
| M | N/A | 187 | 0.23 | yes | 2 | 0.05 | 99.35 | TTAKAMEQMAG | 97.27 | TTAKAMEQVAG | 2.07 | | | | |
| M | N/A | 188 | 0.23 | yes | 2 | 0.06 | 99.3 | TAKAMEQMAGS | 97.22 | TAKAMEQVAGS | 2.07 | | | | |
| M | N/A | 189 | 0.25 | yes | 2 | 0.06 | 99.08 | AKAMEQMAGSS | 97.08 | AKAMEQVAGSS | 2 | | | | |
| M | N/A | 190 | 0.26 | yes | 2 | 0.06 | 99.06 | KAMEQMAGSSE | 97.06 | KAMEQVAGSSE | 2 | | | | |
| M | N/A | 191 | 0.26 | yes | 3 | 0.06 | 99.24 | AMEQMAGSSEQ | 97 | AMEQVAGSSEQ | 1.99 | AMEQIAGSSEQ | 0.25 | | | |
| M | N/A | 192 | 0.26 | yes | 2 | 0.05 | 99.02 | MEQMAGSSEQA | 97.02 | MEQVAGSSEQA | 2 | | | | |
| M | N/A | 193 | 0.29 | yes | 3 | 0.05 | 99.03 | EQMAGSSEQAA | 96.8 | EQVAGSSEQAA | 1.98 | EQIAGSSEQAA | 0.24 | | | |
| M | N/A | 194 | 0.3 | yes | 3 | 0.05 | 99.11 | QMAGSSEQAAE | 96.74 | QVAGSSEQAAE | 1.98 | QIAGSSEQAAE | 0.24 | QMAGSNEQAAE | 0.24 | |
| M | N/A | 195 | 0.29 | yes | 3 | 0.05 | 99.14 | MAGSSEQAAEA | 96.77 | VAGSSEQAAEA | 1.99 | IAGSSEQAAEA | 0.24 | MAGSNEQAAEA | 0.24 | |
| M | N/A | 196 | 0.15 | yes | 2 | 0.04 | 99.19 | AGSSEQAAEAM | 98.72 | AGSSEQAAEAM | 0.24 | AGSNEQAAEAM | 0.23 | | | |
| M | N/A | 197 | 0.18 | yes | 2 | 0.04 | 99.19 | GSSEQAAEAME | 98.43 | GSSEQAAEAIE | 0.29 | GSNEQAAEAME | 0.23 | | | |
| M | N/A | 198 | 0.92 | yes | 4 | 0.05 | 99.05 | SEQAAEAMEVA | 77.31 | SEQAAEMEIA | 21.17 | SEQAAEAIEVA | 0.24 | SEQAAEAMDIA | 0.2 | NEQAAEAMEVA | 0.14 |
| M | N/A | 199 | 1.12 | yes | 4 | 0.07 | 99.02 | LENLQAYQKR | 75.5 | LLENLQTYQKR | 18.34 | LIENLQAYQKR | 4.47 | LDNLQAYQKR | 0.71 | LENLQAYQNRM | 0.14 |
| M | N/A | 236 | 1.12 | yes | 5 | 0.07 | 99.02 | LENLQAYQKR | 75.5 | LLENLQTYQKR | 18.34 | LIENLQAYQKR | 4.47 | LDNLQAYQKR | 0.71 | LENLQAYQNRM | 0.14 |
| M | N/A | 237 | 1.12 | yes | 4 | 0.08 | 99.19 | ENLQAYQKRM | 75.48 | ENLQTYQKRM | 18.33 | IENLQAYQKRM | 4.47 | LDNLQAYQKRM | 0.71 | LENLQAYQNRM | |
| M | N/A | 238 | 0.87 | yes | 4 | 0.08 | 99.24 | NLQAYQKRMG | 79.95 | ENLQTYQKRMG | 18.33 | ENLQAYQKRMG | 0.71 | DNLQAYQKRMG | 0.6 | |
| M | N/A | 239 | 0.85 | yes | 5 | 0.09 | 99.06 | LQAYQKRMGV | 80.13 | NLQTYQKRMGV | 18.34 | NLQAYQKRMGV | 0.6 | | | |
| M | N/A | 240 | 0.84 | yes | 5 | 0.09 | 99.13 | QAYQKRMGVQ | 80.17 | LQTYQKRMGVQ | 18.36 | LQAYQKRMGLQ | 0.6 | QAYQKRMGVQI | 2.08 | QAYQKRMGLQM | 0.6 |
| M | N/A | 241 | 1.11 | yes | 5 | 0.09 | 99.06 | AYQKRMGVQM | 76.39 | QTYQKRMGVQM | 18.34 | QAYQKRMGVQL | 2.08 | YQKRMGVQMHR | 0.36 |
| M | N/A | 243 | 0.46 | yes | 5 | 0.08 | 99.17 | YQKRMGVQMQR | 94.44 | YQKRMGVQOR | 2.08 | YQKRMGVQMHR | 0.36 | | | |
| M | N/A | 246 | 0 | no | 1 | 99.99 | 100 | RMGVQMQRFRR | 100 | | | | | | | |
| M | N/A | 247 | 0 | no | 1 | 99.99 | 100 | MGVQMQRFRRP | 100 | | | | | | | |
| M | N/A | 248 | 0 | no | 1 | 99.99 | 100 | GVQMQRFRRPD | 100 | | | | | | | |
| M | N/A | 249 | 0 | no | 1 | 99.99 | 100 | VQMQRFRRPDS | 100 | | | | | | | |
| M | N/A | 250 | 0 | no | 1 | 99.99 | 100 | QMQRFRRPDSS | 100 | | | | | | | |
| M | N/A | 251 | 0 | no | 1 | 99.99 | 100 | MQRFRRPDSSW | 100 | | | | | | | |
| M | N/A | 252 | 0 | no | 1 | 99.99 | 100 | QRFRRPDSSWL | 100 | | | | | | | |
| M | N/A | 253 | 0 | no | 1 | 99.99 | 100 | RFRRPDSSWLF | 100 | | | | | | | |
| M | N/A | 254 | 0 | no | 1 | 99.99 | 100 | FRRPDSSWLFG | 100 | | | | | | | |
| M | N/A | 255 | 0 | no | 1 | 99.99 | 100 | RRPDSSWLFGG | 100 | | | | | | | |
| M | N/A | 256 | 0 | no | 1 | 99.99 | 100 | RPDSSWLFGGS | 100 | | | | | | | |
| M | N/A | 257 | 0 | no | 1 | 99.99 | 100 | SSRHCSKYHWN | 100 | | | | | | | |
| M | N/A | 258 | 0 | no | 1 | 99.99 | 100 | SRHCSKYHWNL | 100 | | | | | | | |
| M | N/A | 259 | 0 | no | 1 | 99.99 | 100 | RHCSKYHWNLA | 100 | | | | | | | |
| M | N/A | 260 | 0 | no | 1 | 99.99 | 100 | HCSKYHWNLAL | 100 | | | | | | | |
| M | N/A | 261 | 0 | no | 1 | 99.99 | 100 | CSKYHWNLALD | 100 | | | | | | | |
| M | N/A | 262 | 0 | no | 1 | 99.99 | 100 | SKYHWNLALDI | 100 | | | | | | | |
| M | N/A | 263 | 0 | no | 1 | 99.99 | 100 | KYHWNLALDIV | 100 | | | | | | | |

Fig. 75-255

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| M1 | N/A | 264 | 0 | no | 1 | 99.99 | 100 | YHWNLALDIVD | 100 | | | | | | |
| M1 | N/A | 265 | 0 | no | 1 | 99.99 | 100 | HWNLALDIVDS | 100 | | | | | | |
| M2 | N/A | 10 | 0 | no | 2 | 99.99 | 100 | RPTRNGWGCKC | 100 | | | | | | |
| M2 | N/A | 89 | 0.92 | no | 1 | 99.98 | 100 | DDHFYSIELEG | 66.67 | DGHFVNIELED | 33.33 | | | | | |
| NP | N/A | 1 | 0 | no | 1 | 99.99 | 100 | SKSRVDNHSMS | 100 | | | | | | |
| NP | N/A | 2 | 0 | no | 1 | 99.99 | 100 | KSRVDNHSMSD | 100 | | | | | | |
| NP | N/A | 3 | 0 | no | 1 | 99.99 | 100 | SRVDNHSMSDI | 100 | | | | | | |
| NP | N/A | 4 | 0 | no | 1 | 99.99 | 100 | RVDNHSMSDIE | 100 | | | | | | |
| NP | N/A | 5 | 0 | no | 1 | 99.99 | 100 | VDNHSMSDIEA | 100 | | | | | | |
| NP | N/A | 6 | 0 | no | 1 | 99.99 | 100 | DNHSMSDIEAM | 100 | | | | | | |
| NP | N/A | 7 | 0 | no | 1 | 99.99 | 100 | NHSMSDIEAMA | 100 | | | | | | |
| NP | N/A | 8 | 0 | no | 1 | 99.99 | 100 | HSMSDIEAMAS | 100 | | | | | | |
| NP | N/A | 9 | 0 | no | 1 | 99.99 | 100 | SMSDIEAMASQ | 100 | | | | | | |
| NP | N/A | 10 | 0 | no | 1 | 99.99 | 100 | MSDIEAMASQG | 100 | | | | | | |
| NP | N/A | 11 | 0.52 | yes | 4 | 99.32 | 99.02 | SDIEAMASQGT | 92.16 | MSDIGAMASQG | 4.9 | MSDIGAMASQG | 0.98 | MSDIEIMASQG | 0.98 |
| NP | N/A | 12 | 0.52 | yes | 4 | 99.32 | 99.02 | DIEAMASQGTK | 92.16 | SDIGAMASQGT | 4.9 | SDIGAMASQGT | 0.98 | SDIEIMASQG | 0.98 |
| NP | N/A | 13 | 0.52 | yes | 4 | 99.32 | 99.02 | IEAMASQGTKR | 92.16 | DIEAMATQGTK | 4.9 | DIEAMATQGTK | 0.98 | DIEIMASQGTK | 0.98 |
| NP | N/A | 14 | 0.55 | yes | 4 | 99.31 | 99.03 | EAMASQGTKRS | 91.26 | IEIMASQGTKR | 5.83 | IEAMATQGTKR | 0.97 | IEAMATQGTKR | 0.97 |
| NP | N/A | 15 | 0.55 | yes | 4 | 99.31 | 99.03 | AMASQGTKRSF | 91.26 | EAMATQGTKRS | 5.83 | GAMASQGTKRS | 0.97 | GAMASQGTKRS | 0.97 |
| NP | N/A | 16 | 0.51 | yes | 3 | 99.31 | 99.03 | IMASQGTKRSY | 97.32 | AMASQGTKRSF | 6.8 | | | | | |
| NP | N/A | 17 | 0.27 | yes | 5 | 1.02 | 99.13 | MASQGTKRSHE | 97.26 | MALQGTKRSYE | 0.91 | MASQGTKRPYE | 0.63 | MASQGTKRPYE | 0.63 |
| NP | N/A | 18 | 0.28 | yes | 4 | 0.74 | 99.14 | ASQGTKRSHEQ | 97.33 | ALQGTKRSYEQ | 0.82 | ASQGTKRPYEQ | 0.63 | ASQGTKRPYE | 0.63 |
| NP | N/A | 19 | 0.27 | yes | 2 | 0.7 | 99.04 | SQGTKRSHEQM | 98.3 | LQGTKRSYEQM | 0.81 | SQGTKRPYEQM | 0.63 | SQGTKRPYEQ | 0.63 |
| NP | N/A | 20 | 0.18 | yes | 4 | 0.64 | 99.12 | QGTKRSHEQME | 98.39 | | | | | | |
| NP | N/A | 21 | 0.16 | yes | 2 | 0.51 | 99.21 | GTKRSHEQMET | 98.39 | | | | | | |
| NP | N/A | 22 | 1.14 | yes | 5 | 0.47 | 99.16 | TKRSHEQMETG | 68.82 | TKRSYEQMETS | 28.3 | TKRSHEQMETG | 1.24 | TKRSHEQMETG | 0.81 |
| NP | N/A | 26 | 1.11 | yes | 3 | 0.43 | 99.19 | KRSYEQMETGG | 68.5 | KRSYEQMETSG | 28.29 | KRSHEQMETSG | 1.26 | KRSYEQMETGE | 0.84 |
| NP | N/A | 51 | 0 | no | 1 | 99.99 | 100 | SEQMETGGERQ | 100 | | | | | | |
| NP | N/A | 52 | 0.32 | yes | 3 | 0.01 | 99.65 | GIGRFYIQMCT | 95.79 | GIGKFYIQMCT | 2.27 | RFYIQMCTELQ | 1.58 | | |
| NP | N/A | 53 | 0.32 | yes | 3 | 0.01 | 99.67 | IGRFYIQMCTE | 95.81 | IGKFYIQMCTE | 2.27 | | | | | |
| NP | N/A | 54 | 0.33 | yes | 3 | 0.01 | 99.54 | GRFYIQMCTEL | 95.69 | GKFYIQMCTEL | 2.27 | GKFYIQMCTEL | 1.58 | | |
| NP | N/A | 55 | 0.45 | yes | 3 | 0.01 | 99.44 | RFYIQMCTELK | 94.24 | KFYIQMCTELK | 2.27 | KFYIQMCTELK | 1.57 | | |
| NP | N/A | 56 | 0.34 | yes | 3 | 0 | 99.45 | FYIQMCTELKL | 95.73 | FYIQMCTELQL | 2.29 | FYIQMCTELQ | 1.38 | | |
| NP | N/A | 70 | 0.79 | yes | 5 | 0 | 99.02 | YIQMCTELKLS | 87.52 | YIQMCTELKLN | 7.84 | YIQMCTELQLS | 1.46 | YIQMCTELKLS | 1.36 |
| NP | N/A | 78 | 1.06 | yes | 5 | 0.03 | 99.2 | GRLIQNSITIE | 70.48 | GRLIQNSMTIE | 27.34 | GRLIQNSITIE | 0.72 | GRLIQNSITIE | 0.35 |
| NP | N/A | 79 | 0.79 | yes | 3 | 0.01 | 99.04 | TIERMVLSAFD | 82.13 | TVERMVLSAFD | 16.49 | TVERMVLSAFD | 0.41 | | |
| NP | N/A | 80 | 0.8 | yes | 2 | 0 | 99 | IERMVLSAFDE | 82.1 | IEKMVLSAFDE | 16.49 | VERMVLSAFDE | 0.41 | | |
| NP | N/A | 81 | 0.73 | yes | 3 | 0.01 | 99.23 | ERMVLSAFDER | 82.73 | EKMVLSAFDER | 16.5 | | | | | |
| NP | N/A | 82 | 0.73 | yes | 3 | 0.01 | 99.24 | RMVLSAFDERR | 82.74 | KMVLSAFDERR | 16.5 | | | | | |
| NP | N/A | 83 | 0.09 | yes | 1 | 0.01 | 99.24 | MVLSAFDERRN | 99.24 | | | | | | |
| NP | N/A | | 0.9 | yes | 2 | 0.01 | 99.23 | VLSAFDERRNK | 73.9 | VLSAFDERRNR | 25.33 | | | | | |

Fig. 75-256

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 84 | 0.85 | yes | 2 | 0.01 | 99.74 | LSAFDERRNKY | 74.36 | LSAFDERRNKY | | | | | |
| NP | N/A | 85 | 0.85 | yes | 2 | 0.01 | 99.77 | SAFDERRNKYL | 74.4 | SAFDERRNKYL | | | | | |
| NP | N/A | 86 | 0.85 | yes | 2 | 0.01 | 99.75 | AFDERRNKYLE | 74.39 | AFDERRNKYLE | | | | | |
| NP | N/A | 87 | 0.87 | yes | 2 | 0.02 | 99.56 | FDERRNKYLEE | 74.25 | FDERRNKYLEE | | | | | |
| NP | N/A | 88 | 0.91 | yes | 2 | 0.02 | 99.03 | DERRNKYLEEH | 74.25 | DERRNKYLEEH | | | | | |
| NP | N/A | 89 | 0.91 | yes | 2 | 0.02 | 99.03 | ERRNKYLEEHP | 74.25 | ERRNKYLEEHP | | | | | |
| NP | N/A | 90 | 0.97 | yes | 4 | 0.03 | 99.45 | RRNKYLEEHPS | 73.7 | RRNKYLEEHPS | | | | | |
| NP | N/A | 91 | 1.05 | yes | 5 | 0.03 | 99.05 | RNKYLEEHPSA | 73.09 | RNKYLEEHPSA | | RNKYLEEHPN | 24.66 | RNRYLEEHPS | 0.59 | RNRYLEENPS | 0.5 |
| NP | N/A | 92 | 1.05 | yes | 5 | 0.03 | 99.02 | NKYLEEHPSAG | 73.06 | NKYLEEHPSAG | | NKYLEEHPNA | 24.42 | RNKYLEEHPST | 0.56 | RNRYLEENPSA | 0.49 |
| NP | N/A | 94 | 0.29 | yes | 5 | 0.03 | 99.25 | YLEEHPSAGKD | 97.1 | YLEEHPSAGKD | | NKYLEEHPNAG | 24.42 | NKYLEEHPSTG | 0.56 | NRYLEENPSAG | 0.49 |
| NP | N/A | 95 | 0.29 | yes | 5 | 0.03 | 99.24 | LEEHPSAGKDP | 97.09 | LEEHPSAGKDP | 0.66 | YLEEHPSTGKD | 0.62 | YLEEHPSAGKD | 0.49 | YLEEHPSAGRD | 0.39 |
| NP | N/A | 96 | 0.3 | yes | 4 | 0.04 | 99.12 | EEHPSAGKDPK | 96.97 | EEHPSAGKDPK | 0.66 | LEEHPSTGKDP | 0.62 | LEEHPSAGKDP | 0.49 | LEEHPSAGRDP | 0.39 |
| NP | N/A | 97 | 0.3 | yes | 4 | 0.04 | 99.1 | EHPSAGKDPKK | 96.95 | EHPSAGKDPKK | 0.66 | EEHPSTGKDPK | 0.62 | EEHPSAGKDPK | 0.5 | EHPSAGRDPKK | 0.39 |
| NP | N/A | 98 | 0.28 | yes | 4 | 0.03 | 99.33 | HPSAGKDPKKT | 97.16 | HPSAGKDPKKT | 0.67 | EHPSTGKDPKK | 0.62 | ENPSAGKDPKK | 0.5 | HPSAGRDPKKT | 0.39 |
| NP | N/A | 99 | 0.23 | yes | 4 | 0.03 | 99.37 | PSAGKDPKKTG | 97.67 | PSAGKDPKKTG | 0.7 | HPSTGKDPKKT | 0.67 | NPSAGKDPKKT | 0.5 | | |
| NP | N/A | 100 | 0.23 | yes | 4 | 0.04 | 99.37 | SAGKDPKKTGG | 97.67 | SAGKDPKKTGG | 0.7 | PSTGKDPKKTG | 0.7 | PSAGKDPKKTG | 0.62 | | |
| NP | N/A | 101 | 0.17 | yes | 3 | 0.03 | 99 | AGKDPKKTGGP | 98.36 | AGKDPKKTGGP | | STGKDPKKTGG | 0.64 | SAGRDPKKTGG | 0.39 | | |
| NP | N/A | 102 | 0.11 | yes | 1 | 0.03 | 99.03 | GKDPKKTGGPI | 99.03 | GKDPKKTGGPI | | | | | | | |
| NP | N/A | 103 | 0.1 | yes | 1 | 0.04 | 99.07 | KDPKKTGGPIY | 99.07 | KDPKKTGGPIY | | | | | | | |
| NP | N/A | 104 | 0.75 | yes | 2 | 0.05 | 99.52 | DPKKTGGPIYK | 81.28 | DPKKTGGPIYK | 18.23 | PKKTGPIYKK | 1.28 | | | | |
| NP | N/A | 105 | 0.83 | yes | 3 | 0.07 | 99.36 | PKKTGGPIYKR | 81.12 | PKKTGGPIYKR | 16.95 | AGLTHMIMWHS | 15.3 | SGLTHIMIWHS | 4.89 | | |
| NP | N/A | 147 | 1.78 | yes | 4 | 0.07 | 99.06 | AGLTHIMIWHS | 39.64 | AGLTHIMIWHS | 39.24 | GLTHIMIMWHSN | 15.6 | | | | |
| NP | N/A | 148 | 1.53 | yes | 3 | 0.03 | 99.4 | GLTHIMIWHSN | 44.56 | GLTHIMIWHSN | 39.27 | LTHIMMIWHSNL | 15.6 | | | | |
| NP | N/A | 149 | 1.53 | yes | 3 | 0.03 | 99.42 | LTHIMIWHSNL | 44.57 | THIMIWHSNL | 39.26 | THMMIWHSNLN | 15.6 | | | | |
| NP | N/A | 150 | 1.51 | yes | 3 | 0.03 | 99.71 | THIMIWHSNLN | 44.69 | THIMIWHSNLN | 39.42 | HIMMIWHSNLND | 15.6 | | | | |
| NP | N/A | 151 | 1.5 | yes | 3 | 0.03 | 99.74 | HIMIWHSNLND | 44.69 | HIMIWHSNLND | 39.45 | HMMIWHSNLND | 8.47 | MIWHSNLNDT | 7.34 | MMIWHSNLNDA | 7.1 |
| NP | N/A | 152 | 2 | yes | 3 | 0.03 | 99.2 | LMIWHSNLNDA | 39.17 | LMIWHSNLNDA | 37.21 | MMIWHSNLNDT | | IMIWHSNLNDT | | | |
| NP | N/A | 153 | 0.7 | yes | 2 | 0.02 | 99.42 | MIWHSNLNDAT | 83.4 | MIWHSNLNDAT | 16.03 | | | | | | |
| NP | N/A | 154 | 0.7 | yes | 2 | 0.03 | 99.42 | IWHSNLNDATY | 83.4 | IWHSNLNDATY | 16.03 | | | | | | |
| NP | N/A | 155 | 0.71 | yes | 2 | 0.03 | 99.4 | WHSNLNDATYQ | 83.37 | WHSNLNDATYQ | 16.03 | | | | | | |
| NP | N/A | 156 | 0.71 | yes | 2 | 0.03 | 99.42 | HSNLNDATYQR | 83.37 | HSNLNDATYQR | 16.03 | | | | | | |
| NP | N/A | 157 | 0.71 | yes | 2 | 0.03 | 99.42 | SNLNDATYQRT | 83.4 | SNLNDATYQRT | 16.03 | | | | | | |
| NP | N/A | 158 | 0.71 | yes | 2 | 0.02 | 99.41 | NLNDATYQRTR | 83.38 | NLNDATYQRTR | 16.03 | | | | | | |
| NP | N/A | 159 | 0.71 | yes | 2 | 0.03 | 99.4 | LNDATYQRTRA | 83.38 | LNDATYQRTRA | 16.03 | | | | | | |
| NP | N/A | 160 | 0.71 | yes | 2 | 0.02 | 99.37 | NDATYQRTRAL | 83.35 | NDATYQRTRAL | 16.02 | | | | | | |
| NP | N/A | 161 | 0.71 | yes | 2 | 0.01 | 99.4 | DATYQRTRALV | 83.38 | DATYQRTRALV | 16.02 | | | | | | |
| NP | N/A | 162 | 0.7 | yes | 2 | 0.01 | 99.42 | ATYQRTRALVR | 83.4 | ATYQRTRALVR | 16.02 | | | | | | |
| NP | N/A | 163 | 0.19 | yes | 2 | 0.02 | 99.3 | TYQRTRALVRT | 97.73 | TYQRTRALVRT | 1.58 | | | | | | |
| NP | N/A | 164 | 0.19 | yes | 2 | 0.02 | 99.33 | YQRTRALVRTG | 97.75 | YQRTRALVRTG | 1.58 | | | | | | |
| NP | N/A | 165 | 0.21 | yes | 2 | 0.03 | 99.15 | QRTRALVRTGM | 97.57 | QRTRALVRSGM | 1.58 | | | | | | |

Fig. 75-257

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 166 | 0.2 | yes | 2 | 0.01 | 99.18 | RTRALVRTGMD | 97.61 | RTRALVRSGMD | 1.58 | | | | |
| NP | N/A | 167 | 0.21 | yes | 2 | 0.01 | 99.18 | TRALVRTGMDP | 97.6 | TRALVRSGMDP | 1.58 | | | | |
| NP | N/A | 168 | 0.21 | yes | 2 | 0.02 | 99.12 | RALVRTGMDPR | 97.55 | RALVRSGMDPR | 1.58 | | | | |
| NP | N/A | 169 | 0.21 | yes | 2 | 0.02 | 99.13 | ALVRTGMDPRM | 97.55 | ALVRSGMDPRM | 1.58 | | | | |
| NP | N/A | 170 | 0.21 | yes | 2 | 0.02 | 99.14 | LVRTGMDPRMC | 97.56 | LVRSGMDPRMC | 1.58 | | | | |
| NP | N/A | 171 | 0.21 | yes | 2 | 0.02 | 99.16 | VRTGMDPRMCS | 97.59 | VRSGMDPRMCS | 1.58 | | |

Fig. 75-258

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 216 | 0.28 | yes | 3 | 0.01 | 99.59 | GINDRNFWRGE | 96.6 | GINDRNFWRGD

Fig. 75-259

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 264 | 0.55 | yes | 3 | 0.02 | 99.02 | NPGNAEIEDLI | 91.02 | NPGNAEIEDLT | 7.59 | SPGNAEIEDLI | 0.41 | | |
| NP | N/A | 265 | 0.5 | yes | 2 | 0.02 | 99.06 | PGNAEIEDLIF | 91.47 | PGNAEIEDLTF | 7.59 | | | | |
| NP | N/A | 266 | 0.67 | yes | 4 | 0.02 | 99.03 | GNAEIEDLIFL | 89.31 | GNAEIEDLTFL | 7.59 | GNAEIEDLIFM | 1.53 | NAEIEDLIFLT | 0.25 |
| NP | N/A | 267 | 0.69 | yes | 5 | 0.03 | 99.05 | NAEIEDLIFLA | 89.08 | NAEIEDLTFLA | 7.59 | NAEIEDLIFMA | 1.53 | AEIEDLIFLTR | 0.25 |
| NP | N/A | 268 | 0.69 | yes | 5 | 0.03 | 99.07 | AEIEDLIFLAR | 89.1 | AEIEDLTFLAR | 7.59 | AEIEDLIFMAR | 1.53 | EIEDLIFLTRS | 0.25 |
| NP | N/A | 269 | 0.68 | yes | 5 | 0.03 | 99.18 | EIEDLIFLARS | 89.2 | EIEDLTFLARS | 7.61 | EIEDLIFMARS | 1.53 | IEDLIFLTRSA | 0.25 |
| NP | N/A | 270 | 0.68 | yes | 4 | 0.03 | 99.16 | IEDLIFLARSA | 89.2 | IEDLTFLARSA | 7.61 | IEDLIFMARSA | 1.53 | | |
| NP | N/A | 271 | 0.64 | yes | 5 | 0.04 | 99.34 | EDLIFLARSAL | 89.4 | EDLTFLARSAL | 7.82 | EDLIFMARSAL | 1.53 | DLIFLARSALV | 0.35 |
| NP | N/A | 272 | 0.68 | yes | 5 | 0.04 | 99.32 | DLIFLARSALI | 89.05 | DLTFLARSALI | 7.79 | DLIFMARSALI | 1.53 | LIFLARSALVL | 0.35 |
| NP | N/A | 273 | 0.68 | yes | 4 | 0.03 | 99.32 | LIFLARSALIL | 89.05 | LTFLARSALIL | 7.8 | LIFMARSALIL | 1.53 | | |
| NP | N/A | 274 | 0.67 | yes | 4 | 0.04 | 99.04 | IFLARSALILR | 89.11 | TFLARSALILR | 7.81 | IFMARSALILR | 1.53 | | |
| NP | N/A | 275 | 0.27 | yes | 3 | 0.05 | 99.11 | FLARSALILRG | 96.98 | FSARSALILRG | 1.53 | FMARSALILRG | 0.6 | | |
| NP | N/A | 276 | 0.31 | yes | 3 | 0.03 | 99.1 | LARSALILRGS | 96.53 | SARSALILRGS | 1.52 | MARSALILRGS | 0.6 | LARSALILRGA | 0.45 |
| NP | N/A | 277 | 0.24 | yes | 3 | 0.03 | 99.02 | ARSALILRGSV | 97.41 | ARSALILRGSI | 1.15 | ARSALILRGAV | 0.45 | | |
| NP | N/A | 278 | 0.22 | yes | 3 | 0.03 | 99.26 | RSALILRGSVA | 97.66 | RSALILRGSIA | 1.15 | RSALILRGAVA | 0.45 | | |
| NP | N/A | 279 | 0 | no | 1 | 99.99 | 100 | SALILRGSVA | 100 | | | | | | |
| NP | N/A | 280 | 0 | no | 1 | 99.99 | 100 | ASALILRGSVA | 100 | | | | | | |
| NP | N/A | 281 | 0.22 | yes | 3 | 0.03 | 99.24 | SALILRGSVAH | 97.64 | SALILRGSIAH | 1.15 | SALILRGAVAH | 0.45 | | |
| NP | N/A | 282 | 0.22 | yes | 3 | 0.03 | 99.24 | ALILRGSVAHK | 97.65 | ALILRGSIAHK | 1.15 | ALILRGAVAHK | 0.45 | | |
| NP | N/A | 283 | 0.22 | yes | 3 | 0.02 | 99.26 | LILRGSVAHKS | 97.67 | LILRGSIAHKS | 1.15 | LILRGAVAHKS | 0.45 | | |
| NP | N/A | 284 | 0.19 | yes | 3 | 0.01 | 99.21 | ILRGSVAHKSC | 97.61 | ILRGSIAHKSC | 1.15 | ILRGAVAHKSC | 0.45 | | |

Fig. 75-260

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 317 | 1.4 | yes | 4 | 0.02 | 99.22 | LVGIDPFKLLQ | 49.73 | LVGIDPFKLLQ | 42.55 | LVGIDPFKLLQ | 6.67 | LVGDP

Fig. 75-261

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| NP | N/A | 433 | 0.73 | yes | 4 | 0.02 | 99.28 | TFSVQRNLPFE | 87.79 | TFSVQRNLPFE | 8.51 | TFSVQRSLPFE | 1.53 | A

Fig. 75-262

| Protein | Sub-type | Start Pos | Block Entropy | Gaps <10% | # to cover 99% | % gap | Coverage | Peptides included | Freq | Peptides included | Freq | Peptides included | Freq | Peptides included | Freq |
|---|---|---|---|---|---|---|---|---|---|---|---|---|---|---|---|
| NS1 | N/A | 17 | 0 | no | 1 | 99.96 | 100 | LLQSAILSLQT | 100 | | | | | | |
| NS1 | N/A | 26 | 1.51 | yes | 5 | 0.82 | 99.03 | FQVDCFLWHWR | 46.79 | FQVDCFLWHIR | 42.15 | FQVDCFIWHIR | 9.78 | FQVDCFLWY

Fig. 75-263

| Protein | Sub-type | Start Pos | Block | Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|---|
| NS1 | N/A | 285 | — | — | no | 2 | 99.99 | 100 | EVRDQ

Fig. 75-264

| Protein | Sub-type | Start Pos | Block | Entropy | Gaps <10% | # to cover 99% | Gap % | Coverage | Peptides included | Freq |
|---|---|---|---|---|---|---|---|---|---|---|
| NS2 | N/A | 36 | 0 | 0 | no | — | 99.99 | 100 | PFLDRLRRDQK | 100 |
| NS2 | N/A | 37 | 0 | 0 | no | — | 99.99 | 100 | FLDRLRRDQKS | 100 |
| NS2 | N/A | 38 | 0 | 0 | no | — | 99.99 |

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 36 | 0.39 | yes | 5 | 0.06 | 99.19 | AAICTHLEVCF | 95.4 | AAICTHLEICF | 2.05 | AAICTHLEVCF | 1.14 | AAVCTHLEVCF | 0.36 |
| PA | N/A | 37 | 0.36 | yes | 4 | 0.05 | 99.27 | AICTHLEVCFM | 95.71 | AICTHLEICFM | 2.05 | AICTHLEVCFM | 1.14 | SICTHLEVCFM | 0.36 |
| PA | N/A | 38 | 0.32 | yes | 3 | 0.05 | 99.27 | ICTHLEVCFMY | 96.08 | ICTHLEICFMY | 2.05 | ICTHLEICFMY | 1.14 | | |
| PA | N/A | 39 | 0.3 | yes | 3 | 0.05 | 99.48 | CTHLEVCFMYS | 96.29 | CTHLEICFMYS | 2.05 | CTHLEICFMYS | 1.14 | | |
| PA | N/A | 40 | 0.3 | yes | 3 | 0.04 | 99.47 | THLEVCFMYSD | 96.29 | THLEICFMYSD | 2.05 | THLEICFMYSD | 1.14 | | |
| PA | N/A | 41 | 0.29 | yes | 3 | 0.05 | 99.55 | HLEVCFMYSDF | 96.36 | HLEICFMYSDF | 2.06 | HLEICFMYSDF | 1.13 | | |
| PA | N/A | 42 | 0.29 | yes | 2 | 0.04 | 99.56 | LEVCFMYSDFH | 96.37 | LEICFMYSDFH | 2.06 | LEICFMYSDF | 1.13 | | |
| PA | N/A | 43 | 0.14 | yes | 2 | 0.05 | 99.6 | EVCFMYSDFHF | 98.46 | EICFMYSDFHF | 1.14 | | | | |
| PA | N/A | 44 | 0.16 | yes | 2 | 0.05 | 99.46 | VCFMYSDFHFI | 98.32 | ICFMYSDFHFI | 1.14 | | | | |
| PA | N/A | 45 | 0.93 | yes | 2 | 0.04 | 99.57 | CFMYSDFHFID | 98.57 | | | | | | |
| PA | N/A | 46 | 0.94 | yes | 5 | 0.06 | 99.28 | FMYSDFHFIDE | 70.26 | FMYSDFHFIN | 29.31 | | | | |
| PA | N/A | 47 | 1.23 | yes | 4 | 0.05 | 99.05 | MYSDFHFIDER | 70.15 | MYSDFHFINEQ | 29.31 | MYSDFHFINER | 1.9 | MYSDFHFINEQ | 0.92 |
| PA | N/A | 67 | 0.39 | yes | 5 | 0.05 | 99.13 | DPNALLKHRFE | 68.79 | DPNVLLKHRFE | 26.03 | DPNTLLKHRFE | 1.59 | MYSDFHFINEL | 0.17 |
| PA | N/A | 68 | 0.4 | yes | 3 | 0.04 | 99.19 | PNALLKHRFEI | 95.32 | PNVLLKHRFEI | 1.9 | PNTLLKHRFEI | 1.51 | QNALLKHRFEI | |
| PA | N/A | 69 | 0.24 | yes | — | 0.04 | 99.2 | NALLKHRFEII | 95.32 | NVLLKHRFEII | 1.58 | | 0.24 | | |
| PA | N/A | 70 | 0.24 | yes | — | 0.04 | 99.25 | ALLKHRFEIIE | 97.38 | VLLKHRFEIIE | 1.58 | TLLKHRFEIIE | 0.24 | | |
| PA | N/A | 71 | 0.09 | yes | — | 0.03 | 99.25 | LLKHRFEIIEG | 97.38 | | | | | | |
| PA | N/A | 72 | 0.07 | yes | — | 0.03 | 99.33 | LKHRFEIIEGR | 99.33 | | | | | | |
| PA | N/A | 73 | 0.08 | yes | — | 0.03 | 99.34 | KHRFEIIEGRD | 99.34 | | | | | | |
| PA | N/A | 74 | 0.07 | yes | — | 0.02 | 99.47 | HRFEIIEGRDR | 99.47 | | | | | | |
| PA | N/A | 75 | 1.09 | yes | 4 | 0.03 | 99.33 | RFEIIEGRDRT | 72.75 | RFEIIEGRDRI | 23.42 | RFEIIEGRDRA | 2.21 | | |
| PA | N/A | 102 | 0.36 | yes | 5 | 0.03 | 99.31 | KPKFLPDLYDY | 95.9 | KPRFLPDLYDY | 1.67 | KPRYLPDLYDY | 0.79 | KPKSLPDLYDY | 0.45 |
| PA | N/A | 103 | 0.37 | yes | 5 | 0.03 | 99.24 | PKFLPDLYDYK | 95.84 | PRFLPDLYDYK | 1.67 | PRYLPDLYDYK | 0.79 | PKSLPDLYDYK | 0.44 |
| PA | N/A | 106 | 0.34 | yes | 4 | 0.03 | 96.11 | LPDLYDYKENR | 96.15 | LPDLYDYKESR | 2.32 | LPDLYDYKKNR | 0.34 | | |
| PA | N/A | 107 | 0.34 | yes | 4 | 0.03 | 99.06 | PDLYDYKENRF | 94.91 | PDLYDYKEDRF | 2.32 | PDLYDYKKNRF | 0.34 | | |
| PA | N/A | 116 | 0.66 | yes | 5 | 0.03 | 99.1 | RFEIGVTRRE | 89.57 | RFEIGVTRRE | 3.16 | RFEIGVTRRE | 0.65 | | |
| PA | N/A | 120 | 0.62 | yes | 5 | 0.06 | 99.24 | IGVTRREVHIY | 89.91 | IGVTRREVHY | 7.72 | GVTRREIHY | 0.65 | IGVTRREVHMY | 0.44 |
| PA | N/A | 121 | 0.64 | yes | 5 | 0.05 | 99.02 | GVTRREVHIYY | 89.84 | GVTRREVHYY | 7.73 | GVTRREIHYY | 0.66 | GVTRREVHMYY | 0.44 |
| PA | N/A | 122 | 0.65 | yes | 5 | 0.05 | 99.4 | VTRREVHIYYL | 89.85 | VTRREVHTYYL | 7.58 | VTRREIHIYYL | 0.66 | VTRREVHMYYL | 0.44 |
| PA | N/A | 123 | 0.65 | yes | 5 | 0.05 | 99.17 | TRREVHIYYLE | 89.84 | TRREVHTYYLE | 7.5 | TREIHIYYLE | 0.66 | TRREVHMYYLE | 0.44 |
| PA | N/A | 124 | 0.65 | yes | 5 | 0.07 | 99.1 | RREVHIYYLEK | 89.84 | RREVHTYYLEK | 7.5 | RREIHIYYLEK | 0.66 | RREVHMYYLEK | 0.44 |
| PA | N/A | 130 | 0.17 | yes | 4 | 0.06 | 99.04 | YLEKANKIKT | 97.78 | YLEKANKIKS | 0.63 | YYMEKANKIKS | 0.43 | | |
| PA | N/A | 143 | 0.16 | yes | 2 | 0.05 | 99.13 | THIHIFSFNGE | 98.4 | THIHIFSFTGE | 0.73 | | | | |
| PA | N/A | 144 | 0.16 | yes | 2 | 0.05 | 99.16 | HIHIFSFNGEE | 98.43 | HIHIFSFTGEE | 0.73 | | | | |
| PA | N/A | 145 | 0.16 | yes | 2 | 0.05 | 99.19 | IHIFSFNGEEM | 98.45 | IHIFSFTGEEM | 0.73 | | | | |
| PA | N/A | 146 | 0.22 | yes | 2 | 0.07 | 99.14 | HIFSFNGEEMA | 98.41 | HIFSFTGEEMA | 0.73 | | | | |
| PA | N/A | 147 | 0.17 | yes | 2 | 0.07 | 99.23 | IFSFNGEEMAT | 97.81 | IFSFTGEEMAT | 1.01 | ISFTGEEMAT | 0.36 | FSFTGEEMATK | 0.32 |
| PA | N/A | 148 | 0.32 | yes | 5 | 0.07 | 99.13 | FSFTGEEMATK | 96.7 | FSFTGEEMATR | 0.73 | FSFTGEEMASK | 0.32 | | |
| PA | N/A | 160 | 0.22 | yes | 2 | 0.04 | 99.02 | DYTIDEESRAR | 97.89 | DYTIDEESRAR | 0.69 | DYILDEESRAR | 0.24 | | |
| PA | N/A | 161 | 0.2 | yes | 3 | 0.05 | 99.03 | YTIDEESRARI | 98.14 | YTIDEESRARI | 0.69 | YILDEESRARI | 0.2 | | |

Fig. 75-267

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 162 | 0.17 | yes | 2 | 0.04 | 99.12 | TIDEESRARIK | 98.43 | TIDEESRARIK | 0.69 | | | | |
| PA | N/A | 163 | 0.14 | yes | 2 | 0.03 | 99.36 | LDEESRARIKT | 98.67 | IDEESRARIKT | 0.69 | | | | |
| PA | N/A | 164 | 0 | no | 1 | 99.99 | 100 | ASSKSRARIKT | 100 | | | | |

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 452 | 0.25 | yes | 5 | 0.1 | 99.15 | YFTAEVSHCRA | 97.67 | YFTAEV

Fig. 75-270

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 498 | 0.28 | yes | 3 | 0.03 | 99.09 | RTKEGRRKTNL | 97.07 | RTKEGRRKTNL | 1.49 | | | | |

Fig. 75-271

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 575 | 0.65 | yes | 2 | 0.03 | 99.54 | RTNGTSKIKMK | 85.36 | RTNGTSKVKMK | 85.36 | | | | |
| PA | N/A | 576 | 0.64 | yes | 2 | 0.03 | 99.58 | TNGTSKIKMKW | 85.4 | TNGTSKVKMKW | 85.4 | | | | |
| PA | N/A | 577 | 0.65 | yes | 2 | 0.03 | 99.49 | NGTSKIKMKWG | 85.31 | NGTSKVKMK

Fig. 75-272

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 644 | 0.13 | yes | 2 | 0.03 | 99.24 | KVCRTLLAKSV | 98.83 | KVCRALLAKSV | 0.41 | | | | |
| PA | N/A | 645 | 0.14 | yes | 2 | 0.03 | 99.2 | VCRTLLAKSVF | 98.79 | VCRALLAKSVF | 0.41 | | | | |
| PA | N/A | 646 | 0.11 | yes | 2 | 0.02 | 99.4 | CRTLLAKSVFN | 98.99 | CRALLAKSVFN | 0.41 | | | | |
|

Fig. 75-273

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PA | N/A | 705 | 0.06 | yes | 1 | 0.73 | 99.56 | NDPWVLLNASW | 99.56 | | | | | | |
| PA | N/A | 706 | 0.08 | yes | 1 | 0.73 | 99.4 | DPWVLLNASWF | 99.4 | | | | | | |
| PA | N/A | 707 | 0.07 | yes | 1 | 0.76 | 99.46 | PWVLLNASWFN | 99.46 | | | | | | |
| PA | N/A | 708 | 0.07 | yes | 1 | 0.76 | 99.47 | WVLLNASWFNS | 99.47 | | | | | | |
| PA | N/A | 709 | 0.07 | yes | 1 | 0.91 | 99.42 | VLLNASWFNSF | 99.42 | | | | | | |
| PA | N/A | 710 | 0.09 | yes | 1 | 0.93 | 99.42 | LLNASWFNSFL | 99.42 | | | | | | |
| PA | N/A | 711 | 0.66 | yes | 5 | 0.97 | 99.29 | LNASWFNSFLA | 89.91 | LNASWFNSFLV | 7.08 | LNASWFNSFLI | 1.11 | LNASWFNSFLK | 0.36 |
| PA | N/A | 712 | 0.66 | no | 5 | 1.02 | 99.04 | NASWFNSFLAH | 89.89 | NASWFNSFLVH | 7.06 | NASWFNSFLIH | 1.11 | NASWFNSFLKH | 0.36 |
| PA | N/A | 716 | 1.92 | no | 4 | 99.97 | 100 | FNSFLAHALKL | 40 | FNSFLVHALKS | 20 | FNSFLTHALRF | 20 | | |
| PA | N/A | 717 | 1.5 | no | 3 | 99.97 | 100 | NSFLAHALKLV | 50 | NSFLVHALKS | 25 | NSFLTHALRFL | 25 | | |
| PA | N/A | 718 | 0.92 | no | 2 | 99.98 | 100 | SFLAHALKLVW | 66.67 | | 33.33 | | | | |
| PA | N/A | 719 | 0.92 | no | 2 | 99.98 | 100 | FLAHALKLVWA | 66.67 | | 33.33 | | | | |
| PA | N/A | 720 | 0.92 | no | 2 | 99.98 | 100 | LAHALKLVWAM | 66.67 | | 33.33 | | | | |
| PA | N/A | 721 | 0.92 | no | 2 | 99.98 | 100 | AHALKLVWAML | 66.67 | | 33.33 | | | | |
| PA | N/A | 722 | 0 | no | 1 | 99.99 | 100 | HALRELWQCYY | 100 | | | | | | |
| PA | N/A | 723 | 0 | no | 1 | 99.99 | 100 | ALRELWQCYYL | 100 | | | | | | |
| PA | N/A | 724 | 0.15 | yes | 1 | 99.99 | 98.87 | LRELWQCYLL | 98.87 | | | | | | |
| PBI | N/A | 1 | 0 | no | 1 | 6.58 | 100 | MDVNPTLLFLK | 100 | MDVNPTLLFLE | 0.16 | | | | |
| PBI | N/A | 4 | 0 | no | 1 | 99.99 | 100 | NPTLLFLKVP | 100 | | | | | | |
| PBI | N/A | 9 | 0.15 | yes | 1 | 99.98 | 100 | YFFLKVPQNA | 100 | | | | | | |
| PBI | N/A | 15 | 0.67 | yes | 2 | 1.1 | 99.26 | PAQNAISTTFP | 86.47 | PVQNAISTTFP | 12.41 | PAQNAISTTFPY | 0.38 | | |
| PBI | N/A | 16 | 0.67 | yes | 2 | 0.76 | 99.31 | AQNAISTTFPY | 86.56 | VQNAISTTFPY | 12.38 | AQNAISTTFPY | 0.37 | | |
| PBI | N/A | 17 | 0.12 | yes | 1 | 0.72 | 99.01 | QNAISTTFPYT | 99.01 | | | | | | |
| PBI | N/A | 18 | 0.11 | yes | 1 | 0.65 | 99.06 | NAISTTFPYTG | 99.06 | | | | | | |
| PBI | N/A | 19 | 0.09 | yes | 1 | 0.61 | 99.21 | AISTTFPYTGD | 99.21 | | | | | | |
| PBI | N/A | 20 | 0.08 | yes | 1 | 0.23 | 99.24 | ISTTFPYTGDP | 99.24 | | | | | | |
| PBI | N/A | 21 | 0.04 | yes | 1 | 0.22 | 99.3 | STTFPYTGDPP | 99.3 | | | | | | |
| PBI | N/A | 22 | 0.04 | yes | 1 | 0.2 | 99.3 | TTFPYTGDPPY | 99.3 | | | | | | |
| PBI | N/A | 23 | 0.04 | yes | 1 | 0.2 | 99.74 | TFPYTGDPPYS | 99.74 | | | | | | |
| PBI | N/A | 24 | 0.04 | yes | 1 | 0.18 | 99.74 | FPYTGDPPYSH | 99.74 | | | | | | |
| PBI | N/A | 25 | 0.03 | yes | 1 | 0.16 | 99.75 | PYTGDPPYSHG | 99.75 | | | | | | |
| PBI | N/A | 26 | 0.03 | yes | 1 | 0.14 | 99.76 | YTGDPPYSHGT | 99.76 | | | | | | |
| PBI | N/A | 27 | 0.04 | yes | 1 | 0.13 | 99.75 | TGDPPYSHGTG | 99.75 | | | | | | |
| PBI | N/A | 28 | 0.04 | yes | 1 | 0.13 | 99.76 | GDPPYSHGTGT | 99.76 | | | | | | |
| PBI | N/A | 29 | 0.04 | yes | 1 | 0.12 | 99.74 | DPPYSHGTGTG | 99.74 | | | | | | |
| PBI | N/A | 30 | 0.04 | yes | 1 | 0.12 | 99.73 | PPYSHGTGTGY | 99.73 | | | | | | |
| PBI | N/A | 31 | 0.05 | yes | 1 | 0.13 | 99.66 | PYSHGTGTGYT | 99.66 | | | | | | |
| PBI | N/A | 32 | 0.08 | yes | 1 | 0.11 | 99.32 | YSHGTGTGYTM | 99.32 | | | | | | |
| PBI | N/A | 33 | 0.08 | yes | 1 | 0.11 | 99.32 | SHGTGTGYTMD | 99.32 | | | | | | |
| PBI | N/A | 34 | 0.08 | yes | 1 | 0.12 | 99.35 | HGTGTGYTMDT | 99.35 | | | | | | |

Fig. 75-274

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 35 | 0.08 | yes | 1 | 0.05 | 99.35 | GTGTGYTMDTV | 99.35 | | | | | | |
| PB1 | N/A | 36 | 0.12 | yes | 2 | 0.05 | 99.24 | TGTGYTMDTVN | 98.93 | | | | | | |
| PB1 | N/A | 37 | 0.12 | yes | 2 | 0.04 | 99.24 | GTGYTMDTVNR | 98.96 | TGTGYTMDTVS | 0.3 | | | | |
| PB1 | N/A | 38 | 0.12 | yes | 2 | 0.04 | 99.26 | TGYTMDTVNRT | 98.96 | GTGYTMDTVSR | 0.3 | | | | |
| PB1 | N/A | 39 | 0.12 | yes | 2 | 0.04 | 99.26 | GYTMDTVNRTH | 99.08 | TGYTMDTVSRT | 0.3 | | | | |
| PB1 | N/A | 40 | 0.14 | yes | 2 | 0.04 | 99.08 | YTMDTVNRTHQ | 98.78 | GYTMDTVSRTH | 0.3 | | | | |
| PB1 | N/A | 41 | 0.13 | yes | 2 | 0.03 | 99.14 | TMDTVNRTHQY | 98.83 | YTMDTVSRTHQ | 0.3 | | | | |
| PB1 | N/A | 42 | 0.11 | yes | 2 | 0.02 | 99.08 | MDTVNRTHQYS | 98.85 | TMDTVSRTHQY | 0.3 | | | | |
| PB1 | N/A | 43 | 0.74 | yes | 3 | 0.03 | 99.24 | DTVNRTHQYSE | 99.08 | MDTVSRTHQYS | 0.3 | | | | |
| PB1 | N/A | 44 | 0.74 | yes | 3 | 0.02 | 99.22 | TVNRTHQYSEK | 83.73 | TVSRTHQYSER | 15.21 | | | | |
| PB1 | N/A | 45 | 1.09 | yes | 5 | 0.02 | 99.01 | VNRTHQYSEKG | 83.71 | VSRTHQYSERG | 15.21 | | | | |
| PB1 | N/A | 46 | 1.05 | yes | 4 | 0.02 | 99.01 | NRTHQYSEKGK | 80.77 | RTHQYSERGRW | 8.55 | NRTHQYSEKGR | 6.64 | SRTHQYSEKGK | 2.75 |
| PB1 | N/A | 47 | 0.3 | yes | 5 | 0.01 | 99.08 | RTHQYSEKGKW | 81.16 | NRTHQYSERGR | 8.55 | RTHQYSEKGRW | 6.64 | | 2.77 |
| PB1 | N/A | 62 | 0.22 | yes | 4 | 0.01 | 99.13 | ETGAPQLNPID | 96.94 | ETGAPQLNPID | 0.94 | ETGALQLNPID | 0.54 | ETGAPQLNPVD | 0.41 |
| PB1 | N/A | 63 | 0.13 | yes | 2 | 0.01 | 99.13 | TGAPQLNPIDG | 96.98 | IGAPQLNPIDG | 0.94 | TGALQLNPIDG | 0.54 | TGAPQLNPVDG | 0.4 |
| PB1 | N/A | 64 | 0.14 | yes | 2 | 0.01 | 99.22 | GAPQLNPIDGP | 97.91 | KAPQLNPIDGP | 0.55 | GAPQLNPVDGP | 0.4 | | 0.27 |
| PB1 | N/A | 65 | 0.37 | yes | 4 | 0.02 | 99.19 | PQLNPIDGPLP | 98.82 | ALQLNPIDGPL | 0.4 | | | | |
| PB1 | N/A | 66 | 0.29 | yes | 4 | 0.01 | 99.19 | QLNPIDGPLPE | 98.79 | LQLNPIDGPLP | 0.4 | | | | |
| PB1 | N/A | 67 | 0.26 | yes | 2 | 0.01 | 99.16 | QLNPIDGPLPK | 95.48 | QLNPIDGPLPD | 2.4 | QLNPIDGPLPV | 0.98 | | 0.32 |
| PB1 | N/A | 79 | 0.23 | yes | 4 | 0.02 | 99.24 | NEPSGYAQTDC | 96.73 | NDPSGYAQTDC | 1.84 | NEPNGYAQTDC | 0.36 | | 0.24 |
| PB1 | N/A | 80 | 0.06 | yes | 4 | 0.04 | 99.19 | EPSGYAQTDCV | 97.04 | DPSGYAQTDCV | 1.84 | | 0.36 | | |
| PB1 | N/A | 81 | 0.07 | yes | 2 | 0.04 | 99.19 | PSGYAQTDCVL | 97.35 | | 1.84 | | | | |
| PB1 | N/A | 82 | 0.07 | yes | 1 | 0.05 | 99.52 | SGYAQTDCVLE | 97.35 | | | | | | |
| PB1 | N/A | 83 | 0.13 | yes | 1 | 0.05 | 99.47 | GYAQTDCVLEA | 99.52 | | | | | | |
| PB1 | N/A | 84 | 0.13 | yes | 1 | 0.05 | 99.45 | YAQTDCVLEAM | 99.47 | | | | | | |
| PB1 | N/A | 85 | 0.15 | yes | 1 | 0.05 | 99.25 | AQTDCVLEAMA | 98.92 | | | | | | |
| PB1 | N/A | 86 | 0.37 | yes | 2 | 0.05 | 99.26 | QTDCVLEAMAF | 98.93 | QTDCVLEAMAL | 0.33 | | | | |
| PB1 | N/A | 87 | 0.38 | yes | 2 | 0.05 | 99.03 | TDCVLEAMAFL | 98.7 | TDCVLEAMALL | 0.33 | | | | |
| PB1 | N/A | 88 | 0.38 | yes | 3 | 0.09 | 99.09 | DCVLEAMAFLE | 95.7 | DCVLEAMALLE | 0.33 | CVLEAMAFLED | 2.45 | CVLEAMAFLED | 0.33 |
| PB1 | N/A | 89 | 0.64 | yes | 5 | 0.07 | 99.09 | CVLEAMAFLEK | 95.62 | CVLEAMAFLEN | 2.45 | CVLEAMALLEE | 0.43 | VLEAMAFLEDS | 0.33 |
| PB1 | N/A | 90 | 0.63 | yes | 5 | 0.09 | 99.03 | VLEAMAFLEES | 95.64 | VLEAMAFLENS | 2.46 | VLEAMALLEES | 0.43 | EAMAFLEDSHP | 0.33 |
| PB1 | N/A | 92 | 0.38 | yes | 5 | 0.05 | 99.1 | EAMAFLEKSHP | 89.68 | EAMAFLENSHP | 8.17 | EAMALLEESHP | 0.43 | SHPGIFESSCL | 0.38 |
| PB1 | N/A | 100 | 0.33 | yes | 5 | 0.05 | 99.16 | SHPGIFENSCI | 89.73 | SHPGLFENSCI | 8.18 | SHPGIFGNSCL | 0.56 | HPGIFESSCLE | 0.38 |
| PB1 | N/A | 101 | 0.18 | yes | 4 | 0.05 | 99.3 | HPGIFENSCLE | 96.16 | HPGIFENSCLE | 1.92 | HPGIFGNSCLE | 0.56 | | 0.32 |
| PB1 | N/A | 116 | 0.19 | yes | 2 | 0.05 | 99.06 | QQTRVDKLTQ | 98.17 | QQTRVDKLTQG | 0.89 | VQQTRMDKLTQ | 0.89 | | |
| PB1 | N/A | 117 | 0.18 | yes | 2 | 0.04 | 99.02 | QTRVDKLTQG | 98.13 | QTRVDKLTQGR | 0.89 | | | | |
| PB1 | N/A | 118 | 0.18 | yes | 2 | 0.05 | 99.04 | TRVDKLTQGRQ | 98.16 | TRVDKLTQGRQ | 0.88 | | | | |
| PB1 | N/A | 119 | 0.18 | yes | 2 | 0.05 | 99.08 | RVDKLTQGRQT | 98.2 | RVDKLTQGRQT | 0.88 | | | | |
| PB1 | N/A | 120 | 0.31 | yes | 3 | 0.05 | 99.11 | VDKLTQGRQTY | 96.29 | VDKLTQGRQTF | 1.94 | VDRLTQGRQTY | 0.88 | | |

Fig. 75-275

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 122 | 0.26 | yes | 3 | 0.06 | 99.61 | DKLTQGRQTYD | 96.79 | DKLTQGRQTYD | 1.94 | DRLTQGRQTYD | 0.88 | | |
| PBI | N/A | 123 | 0.26 | yes | 3 | 0.06 | 99.63 | KLTQGRQTYDW | 96.81 | KLTQGRQTYDW | 1.94 | RLTQGRQTYDW | 0.88 | | |
| PBI | N/A | 124 | 0.18 | yes | 2 | 0.06 | 99.64 | LTQGRQTYDWT | 97.7 | LTQGRQTYDWT | 1.94 | | | | |
| PBI | N/A | 125 | 0.19 | yes | 2 | 0.07 | 99.62 | TQGRQTYDWTL | 97.68 | TQGRQTYDWTL | 1.94 | | | | |
| PBI | N/A | 126 | 0.19 | yes | 2 | 0.07 | 99.61 | QGRQTYDWTLN | 97.67 | QGRQTYDWTLN | 1.94 | | | | |
| PBI | N/A | 127 | 0.2 | yes | 2 | 0.07 | 99.56 | GRQTYDWTLNR | 97.62 | GRQTYDWTLNR | 1.94 | | | | |
| PBI | N/A | 128 | 0.19 | yes | 2 | 0.07 | 99.56 | RQTYDWTLNRN | 97.62 | RQTYDWTLNRN | 1.94 | | | | |
| PBI | N/A | 129 | 0.19 | yes | 2 | 0.07 | 99.61 | QTYDWTLNRNQ | 97.67 | QTYDWTLNRNQ | 1.94 | | | | |
| PBI | N/A | 130 | 0.19 | yes | 2 | 0.08 | 99.61 | TYDWTLNRNQP | 97.67 | TYDWTLNRNQP | 1.94 | | | | |
| PBI | N/A | 131 | 0.19 | yes | 2 | 0.08 | 99.59 | YDWTLNRNQPA | 97.65 | YDWTLNRNQPA | 1.94 | | | | |
| PBI | N/A | 132 | 0.06 | yes | 1 | 0.08 | 99.53 | DWTLNRNQPAA | 99.53 | DWTLNRNQPAA | 1.95 | | | | |
| PBI | N/A | 133 | 0.07 | yes | 1 | 0.07 | 99.49 | WTLNRNQPAAT | 99.49 | WTLNRNQPAAT | | | | | |
| PBI | N/A | 134 | 0.07 | yes | 1 | 0.07 | 99.44 | TLNRNQPAATA | 99.44 | TLNRNQPAATA | | | | | |
| PBI | N/A | 135 | 0.08 | yes | 1 | 0.07 | 99.43 | LNRNQPAATAL | 99.43 | LNRNQPAATAL | | | | | |
| PBI | N/A | 136 | 0.08 | yes | 1 | 0.06 | 99.41 | NRNQPAATALA | 99.41 | NRNQPAATALA | | | | | |
| PBI | N/A | 137 | 0.06 | yes | 1 | 0.06 | 99.54 | RNQPAATALAN | 99.54 | RNQPAATALAN | | | | | |
| PBI | N/A | 138 | 0.06 | yes | 1 | 0.05 | 99.57 | NQPAATALANT | 99.57 | NQPAATALANT | | | | | |
| PBI | N/A | 139 | 0.06 | yes | 1 | 0.05 | 99.55 | QPAATALANTI | 99.55 | QPAATALANTI | | | | | |
| PBI | N/A | 140 | 0.07 | yes | 1 | 0.05 | 99.48 | PAATALANTIE | 99.48 | PAATALANTIE | | | | | |
| PBI | N/A | 141 | 0.56 | yes | 2 | 0.04 | 99.45 | AATALANTIEI | 88.91 | AATALANTIEI | | | | | |
| PBI | N/A | 142 | 0.56 | yes | 2 | 0.04 | 99.45 | ATALANTIEIF | 88.91 | ATALANTIEIF | | | | | |
| PBI | N/A | 143 | 0.58 | yes | 2 | 0.05 | 99.22 | TALANTIEIFR | 88.72 | TALANTIEIFR | | | | | |
| PBI | N/A | 144 | 0.85 | yes | 3 | 0.05 | 99.09 | ALANTIEIFRS | 84.74 | ALANTIEIFRS | 10.55 | ALANTIEVFRL | 3.69 | ALANTIEVFKS | 0.2 | ALANTIEVFRA |
| PBI | N/A | 145 | 0.85 | yes | 3 | 0.06 | 99.12 | LANTIEIFRSN | 84.76 | LANTIEIFRSN | 10.53 | LANTIEVFRLN | 3.69 | LANTIEVFKSN | 0.2 | LANTIEVFRMN |
| PBI | N/A | 160 | 0.4 | yes | 2 | 0.07 | 99.15 | NESGRLIDFLK | 94.68 | NESGRLIDFLK | 10.49 | NESGRLMDFLK | | | | |
| PBI | N/A | 161 | 0.19 | yes | 1 | 0.05 | 99.11 | ESGRLIDFLKD | 98.14 | ESGRLIDFLKD | 10.33 | | | | | |
| PBI | N/A | 162 | 0.17 | yes | 1 | 0.06 | 99.15 | SGRLIDFLKDV | 98.26 | SGRLIDFLKDV | 10.35 | | | | | |
| PBI | N/A | 163 | 0.41 | yes | 2 | 0.06 | 99.28 | GRLIDFLKDVM | 95.23 | GRLIDFLKDVM | 3.49 | | | 1.32 | GRLMDFLKDVM | 1.01 | GRLIDFLKDVT |
| PBI | N/A | 185 | 0.28 | yes | 2 | 0.05 | 99.22 | THFQRKRVRD | 96.91 | THFQRKRVRD | 1.01 | | | | | |
| PBI | N/A | 186 | 0.29 | yes | 2 | 0.06 | 99.11 | HFQRKRVRDN | 96.76 | HFQRKRVRDN | 1.02 | | | | | |
| PBI | N/A | 218 | 1.22 | yes | 5 | 0.1 | 99 | SYLIRALTLNT | 55.75 | SYLIRALTLNT | 1.34 | SYLIRTLTLNT | 0.31 | SYLIRTLTLNT | 0.5 | SYLIRALTLNT |
| PBI | N/A | 219 | 0.41 | yes | 3 | 0.1 | 99.07 | YLIRALTLNTM | 98.32 | YLIRALTLNTM | 1.89 | NYLIRALTLNT | 0.31 | | | |
| PBI | N/A | 220 | 0.18 | yes | 2 | 0.08 | 99.26 | LIRALTLNTMT | 98.32 | LIRALTLNTMT | 1.93 | YLIRALTLNTM | 0.74 | | | |
| PBI | N/A | 221 | 0.18 | yes | 2 | 0.08 | 99.25 | IRALTLNTMTK | 98.31 | IRALTLNTMTK | 41.68 | YLIRALTLNT | 0.43 | | | |
| PBI | N/A | 222 | 0.13 | yes | 2 | 0.07 | 99.31 | RALTLNTMTKD | 98.81 | RALTLNTMTKD | 0.5 | IIRALTLNTMT | 0.43 | | | |
| PBI | N/A | 223 | 0.12 | yes | 2 | 0.07 | 99.39 | ALTLNTMTKDA | 98.89 | ALTLNTMTKDA | 0.5 | | | | | |
| PBI | N/A | 224 | 0.11 | yes | 2 | 0.06 | 99.45 | LTLNTMTKDAE | 98.95 | LTLNTMTKDAE | 0.5 | | | | | |
| PBI | N/A | 225 | 0.06 | yes | 1 | 0.09 | 99.5 | TLNTMTKDAER | 99.5 | TLNTMTKDAER | 0.5 | | | | | |
| PBI | N/A | 226 | 0.06 | yes | 1 | 0.09 | 99.52 | LNTMTKDAERG | 99.52 | LNTMTKDAERG | 0.5 | | | | | |
| PBI | N/A | 227 | 0.03 | yes | 1 | 0.1 | 99.76 | NTMTKDAERGK | 99.76 | NTMTKDAERGK | | | | | | |
| PBI | N/A | | 0.04 | yes | 1 | 0.1 | 99.72 | | 99.72 | | | | | | | |

Fig. 75-276

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 228 | 0.04 | yes | 1 | 0.1 | 99.72 | TMTKDAERGKL | 99.72 | | | | | | |
| PB1 | N/A | 229 | 0.09 | yes | 1 | 0.1 | 99.24 | MTKDAERGKLK | 99.24 | | | | | | |
| PB1 | N/A | 230 | 0.09 | yes | 1 | 0.1 | 99.2 | TKDAERGKLKR | 99.2 | | | | | | |
| PB1 | N/A | 231 | 0.09 | yes | 1 | 0.11 | 99.24 | KDAERGKLKRR | 99.24 | | | | | | |
| PB1 | N/A | 232 | 0.09 | yes | 1 | 0.11 | 99.22 | DAERGKLKRRA | 99.22 | | | | | | |
| PB1 | N/A | 233 | 0.08 | yes | 1 | 0.11 | 99.22 | AERGKLKRRAI | 99.22 | | | | | | |
| PB1 | N/A | 234 | 0.08 | yes | 1 | 0.09 | 99.24 | ERGKLKRRAIA | 99.24 | | | | | | |
| PB1 | N/A | 235 | 0.08 | yes | 1 | 0.09 | 99.25 | RGKLKRRAIAT | 99.25 | | | | | | |
| PB1 | N/A | 236 | 0.08 | yes | 1 | 0.09 | 99.26 | GKLKRRAIATP | 99.26 | | | | | | |
| PB1 | N/A | 237 | 0.08 | yes | 1 | 0.1 | 99.26 | KLKRRAIATPG | 99.26 | | | | | | |
| PB1 | N/A | 238 | 0.09 | yes | 1 | 0.1 | 99.18 | LKRRAIATPGM | 99.18 | | | | | | |
| PB1 | N/A | 239 | 0.05 | yes | 1 | 0.1 | 99.17 | KRRAIATPGMQ | 99.17 | | | | | | |
| PB1 | N/A | 240 | 0.05 | yes | 1 | 0.16 | 99.66 | RRAIATPGMQI | 99.66 | | | | | | |
| PB1 | N/A | 241 | 0.04 | yes | 1 | 0.16 | 99.68 | RAIATPGMQIR | 99.68 | | | | | | |
| PB1 | N/A | 242 | 0.04 | yes | 1 | 0.16 | 99.69 | AIATPGMQIRG | 99.69 | | | | | | |
| PB1 | N/A | 243 | 0.06 | yes | 1 | 0.17 | 99.49 | IATPGMQIRGF | 99.49 | | | | | | |
| PB1 | N/A | 244 | 0.06 | yes | 1 | 0.17 | 99.51 | ATPGMQIRGFV | 99.51 | | | | | | |
| PB1 | N/A | 245 | 0.13 | yes | 2 | 0.2 | 99.43 | TPGMQIRGFVY | 98.68 | TPGMQIRGFVH | 0.74 | | | | | |
| PB1 | N/A | 246 | 0.17 | yes | 2 | 0.2 | 99.15 | PGMQIRGFVYF | 98.41 | PGMQIRGFVHF | 0.74 | | | | | |
| PB1 | N/A | 247 | 0.17 | yes | 2 | 0.2 | 99.09 | GMQIRGFVYFV | 98.36 | GMQIRGFVHFV | 0.74 | | | | | |
| PB1 | N/A | 248 | 0.17 | yes | 2 | 0.17 | 99.08 | MQIRGFVYFVE | 98.34 | MQIRGFVHFVE | 0.74 | | | | | |
| PB1 | N/A | 249 | 0.31 | yes | 5 | 0.2 | 99.18 | QIRGFVYFVET | 96.76 | QIRGFVHFVEA | 1.38 | QIRGFVYFVEI | 0.57 | QIRGWYFVET | 0.27 | |
| PB1 | N/A | 250 | 0.31 | yes | 5 | 0.2 | 99.17 | IRGFVYFVETL | 96.75 | IRGFVHFVEAL | 1.38 | IRGFVYFVEIL | 0.57 | IRGWYFVETL | 0.27 | |
| PB1 | N/A | 251 | 0.3 | yes | 5 | 0.2 | 99.18 | RGFVYFVETLA | 96.77 | RGFVHFVEALA | 1.38 | RGFVYFVEILA | 0.58 | RGWYFVETLA | 0.27 | |
| PB1 | N/A | 260 | 0.28 | yes | 4 | 0.12 | 99.14 | LARICEKLEQS | 97.03 | LARNICEKLEQ | 0.98 | LARICEKLEQ | 0.68 | | | |
| PB1 | N/A | 261 | 0.28 | yes | 4 | 0.12 | 96.99 | ARSICEKLEQS | 96.99 | ARNICEKLEQ | 0.98 | ARNICEKLEQ | 0.68 | | | |
| PB1 | N/A | 262 | 0.28 | yes | 4 | 0.11 | 97.01 | RSICEKLEQSG | 97.01 | RRICEKLEQSG | 0.98 | RNICEKLEQSG | 0.68 | | | |
| PB1 | N/A | 263 | 0.26 | yes | 4 | 0.14 | 97.24 | SICEKLEQSGL | 97.24 | CICEKLEQSGL | 0.98 | NICEKLEQSGL | 0.68 | | | |
| PB1 | N/A | 264 | 0.05 | yes | 1 | 0.13 | 99.59 | ICEKLEQSGLP | 99.59 | | | | | | |
| PB1 | N/A | 265 | 0.06 | yes | 1 | 0.13 | 99.51 | CEKLEQSGLPV | 99.51 | | | | | | |
| PB1 | N/A | 266 | 0.06 | yes | 1 | 0.16 | 99.5 | EKLEQSGLPVG | 99.5 | | | | | | |
| PB1 | N/A | 267 | 0.04 | yes | 1 | 0.17 | 99.66 | KLEQSGLPVGG | 99.66 | | | | | | |
| PB1 | N/A | 268 | 0.04 | yes | 1 | 0.17 | 99.68 | LEQSGLPVGGN | 99.68 | | | | | | |
| PB1 | N/A | 269 | 0.04 | yes | 1 | 0.18 | 99.68 | EQSGLPVGGNE | 99.68 | | | | | | |
| PB1 | N/A | 270 | 0.04 | yes | 1 | 0.18 | 99.66 | QSGLPVGGNEK | 99.66 | | | | | | |
| PB1 | N/A | 271 | 0.03 | yes | 1 | 0.18 | 99.68 | SGLPVGGNEKK | 99.68 | | | | | | |
| PB1 | N/A | 272 | 0.03 | yes | 1 | 0.18 | 99.74 | GLPVGGNEKKA | 99.74 | | | | | | |
| PB1 | N/A | 273 | 0.03 | yes | 1 | 0.18 | 99.74 | LPVGGNEKKAK | 99.74 | | | | | | |
| PB1 | N/A | 274 | 0.03 | yes | 1 | 0.16 | 99.75 | PVGGNEKKAKL | 99.75 | | | | | | |
| PB1 | N/A | 275 | 0.03 | yes | 1 | 0.16 | 99.74 | VGGNEKKAKLA | 99.74 | | | | | | |

Fig. 75-277

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 276 | 0.02 | yes | 1 | 0.14 | 99.86 | GGNEKKAKLAN | 99.86 | | | | | | |
| PB1 | N/A | 277 | 0.02 | yes | 1 | 0.13 | 99.87 | GNEKKAKLANV | 99.87 | | | | | | |
| PB1 | N/A | 278 | 0.04 | yes | 1 | 0.13 | 99.72 | NEKKAKLANVV | 99.72 | | | | | | |
| PB1 | N/A | 279 | 0.05 | yes | 1 | 0.13 | 99.6 | EKKAKLANVVR | 99.6 | | | | | | |
| PB1 | N/A | 280 | 0.05 | yes | 1 | 0.13 | 99.6 | KKAKLANVVRK | 99.6 | | | | | | |
| PB1 | N/A | 281 | 0.05 | yes | 1 | 0.12 | 99.61 | KAKLANVVRKM | 99.61 | | | | | | |
| PB1 | N/A | 282 | 0.08 | yes | 1 | 0.14 | 99.59 | AKLANVVRKMM | 99.59 | | | | | | |
| PB1 | N/A | 283 | 0.08 | yes | 1 | 0.15 | 99.37 | KLANVVRKMMT | 99.37 | | | | | | |
| PB1 | N/A | 284 | 0.12 | yes | 1 | 0.14 | 99.34 | LANVVRKMMTS | 99.34 | 0.38 | LANVVRKMMTS | | | | |
| PB1 | N/A | 285 | 0.12 | yes | 2 | 0.14 | 99.32 | ANVVRKMMTSS | 98.96 | 0.38 | ANVVRKMMTSS | | | | |
| PB1 | N/A | 286 | 0.16 | yes | 2 | 0.14 | 99.08 | NVVRKMMTSSQ | 98.95 | 0.38 | NVVRKMMTSQ | | NVVRKMMTNSH | 0.14 | |
| PB1 | N/A | 287 | 0.16 | yes | 3 | 0.14 | 99.09 | VVRKMMTSSQD | 98.57 | 0.38 | VVRKMMTSSQD | | VVRKMMTNSRD | 0.14 | |
| PB1 | N/A | 288 | 0.17 | yes | 3 | 0.16 | 99.13 | VRKMMTSSQDT | 98.57 | 0.38 | VRKMMTSQDT | | VRKMMTNSRDT | 0.14 | VRKMMTNSHDT | 0.14 |
| PB1 | N/A | 289 | 0.17 | yes | 3 | 0.14 | 99.06 | RKMMTSSQDTE | 98.48 | 0.38 | RKMMTSQDTFE | | RKMMTNSRDTE | 0.15 | | |
| PB1 | N/A | 295 | 1.07 | yes | 4 | 0.16 | 99.15 | SQDTELSFTIT | 98.53 | 31.4 | SQDTELSFTIT | | SQDTELSFTVT | 0.55 | SQDTEVSFTIT | 0.21 |
| PB1 | N/A | 296 | 1.06 | yes | 4 | 0.14 | 99.17 | QDTELSFTITG | 66.98 | 31.4 | QDTELSFTITG | | QDTELSFTVTG | 0.55 | QDTEVSFTITG | 0.21 |
| PB1 | N/A | 297 | 1.02 | yes | 3 | 0.16 | 99.11 | DTELSFTITGD | 67.01 | 31.45 | DTELSFTITGD | | DTELSFTVTGD | 0.55 | | |
| PB1 | N/A | 298 | 1.02 | yes | 3 | 0.15 | 99.36 | TELSFTITGDN | 67.37 | 31.45 | TELSFTITGDN | | TELSFTVTGDN | 0.55 | | |
| PB1 | N/A | 299 | 1.01 | yes | 3 | 0.16 | 99.34 | ELSFTITGDNT | 67.34 | 31.45 | ELSFTITGDNT | | ELSFTVTGDNT | 0.55 | | |
| PB1 | N/A | 300 | — | yes | 3 | 0.17 | 99.45 | LSFTITGDNTK | 67.44 | 31.45 | LSFTITGDNTK | | LSFTVTGDNTK | 0.55 | | |
| PB1 | N/A | 301 | 0.09 | yes | 1 | 0.16 | 99.5 | SFTITGDNTKW | 67.5 | | | | | | |
| PB1 | N/A | 302 | 0.08 | yes | 1 | 0.16 | 99.18 | FTITGDNTKWN | 99.18 | | | | | | |
| PB1 | N/A | 303 | 0.08 | yes | 1 | 0.16 | 99.17 | TITGDNTKWNE | 99.17 | | | | | | |
| PB1 | N/A | 304 | 0.08 | yes | 1 | 0.16 | 99.19 | ITGDNTKWNEN | 99.19 | | | | | | |
| PB1 | N/A | 305 | 0.03 | yes | 1 | 0.15 | 99.2 | TGDNTKWNENQ | 99.2 | | | | | | |
| PB1 | N/A | 306 | 0.06 | yes | 1 | 0.16 | 99.81 | GDNTKWNENQN | 99.82 | | | | | | |
| PB1 | N/A | 307 | 0.07 | yes | 1 | 0.14 | 99.41 | DNTKWNENQNP | 99.41 | | | | | | |
| PB1 | N/A | 308 | 0.07 | yes | 1 | 0.15 | 99.38 | NTKWNENQNPR | 99.38 | | | | | | |
| PB1 | N/A | 309 | 0.39 | yes | 3 | 0.14 | 99.36 | TKWNENQNPRM | 99.37 | 2.31 | TKWNENQNPRV | | TKWNENQNPRI | 1.93 | | |
| PB1 | N/A | 310 | 0.39 | yes | 3 | 0.15 | 99.15 | KWNENQNPRMF | 94.92 | 2.3 | KWNENQNPRVF | | KWNENQNPRIF | 1.93 | | |
| PB1 | N/A | 311 | 0.39 | no | 3 | 0.13 | 99.16 | WNENQNPRMFL | 94.86 | 2.3 | WNENQNPRVFL | | WNENQNPRIFL | 1.93 | | |
| PB1 | N/A | 312 | 0.42 | no | 5 | 0.14 | 99.09 | NENQNPRMFLA | 94.84 | 1.83 | NENQNPRVFLA | | NENQNPRIFLA | 1.41 | NENQSPRMFLA | 0.9 |
| PB1 | N/A | 313 | 0.42 | yes | 3 | 0.15 | 99.37 | ENQNPRMFLAM | 94.85 | 1.83 | ENQNPRVFLAM | | ENQNPRIFLAM | 1.41 | ENQSPRMFLAM | 0.89 |
| PB1 | N/A | 314 | 0 | yes | — | 99.99 | 99.38 | ENQNPRMFLAM | 100 | | | | | | |
| PB1 | N/A | 315 | 0 | yes | — | 99.99 | 100 | ONONPRMFLAM | 100 | | | | | | |
| PB1 | N/A | 316 | 0.44 | yes | 5 | 0.13 | 99.2 | NONPRMFLAMI | 94.67 | 1.83 | NONPRMFLAMI | | NONPRVFLAMI | 1.4 | NQSPRMFLAMI | 0.89 |
| PB1 | N/A | 317 | 0.46 | yes | 5 | 0.14 | 99.09 | QNPRMFLAMIT | 94.57 | 1.82 | QNPRIFLAMIT | | QNPRVFLAMIT | 1.4 | QSPRMFLAMIT | 0.89 |
| PB1 | N/A | 318 | 0.46 | yes | 5 | 0.14 | 99.03 | NPRMFLAMITY | 94.57 | 1.78 | NPRIFLAMITY | | NPRVFLAMITY | 1.4 | SPRMFLAMITY | 0.89 |
| PB1 | N/A | 319 | 0.45 | yes | 5 | 0.15 | 99.04 | PRMFLAMITYI | 94.73 | 1.78 | PRIFLAMITYI | | PRVFLAMITYI | 1.4 | PRTFLAMITYI | 0.89 |
| PB1 | N/A | 320 | 0.45 | yes | 5 | 0.15 | 99.05 | RMFLAMITYIT | 94.75 | 1.78 | RIFLAMITYIT | | RVFLAMITYIT | 1.4 | RTFLAMITYIT | 0.89 |

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 424 | 0.12 | yes | 2 | 0.11 | 99.47 | TVLGVSILNLG | 98.89 | TVLGVSILNLG | 0.58 | | | | |
| PBI | N/A | 425 | 0.13 | yes | 2 | 0.12 | 99.37 | VLGVSILNLGQ | 98.79 | VLGVSILNLGQ | 0.58 | | | | |
| PBI | N/A | 426 | 0.23 | yes | 3 | 0.14 | 99.36 | LGVSILNLGQK | 97.55 | LGVSILNLGQK | 1.24 | | | | |
| PBI | N/A | 441 | 1.02 | yes | 5 | 0.18 | 99.61 | TTYWWDGLQSS | 75.01 | TTYWWDGLQSS | 22.01 | TYWWDGLQSS | 0.57 | TAYWWDGLQSS | 0.82 |
| PBI | N/A | 442 | 1.01 | yes | 5 | 0.18 | 99.65 | TYWWDGLQSSD | 75.04 | TYWWDGLQSSD | 22.01 | TYWWDGLQSSD | 0.91 | AYWWDGLQSSD | 0.83 |
| PBI | N/A | 443 | 0.04 | yes | 1 | 0.16 | 99.74 | YWWDGLQSSDD | 99.74 | | | YWWDGLQSSD | 0.91 | | |
| PBI | N/A | 444 | 0.03 | yes | 1 | 0.16 | 99.8 | WWDGLQSSDDF | 99.8 | | | | | | |
| PBI | N/A | 445 | 0.04 | yes | 1 | 0.16 | 99.74 | WDGLQSSDDFA | 99.74 | | | | | | |
| PBI | N/A | 446 | 0.04 | yes | 1 | 0.17 | 99.75 | DGLQSSDDFAL | 99.75 | | | | | | |
| PBI | N/A | 447 | 0.04 | yes | 1 | 0.17 | 99.75 | GLQSSDDFALI | 99.75 | | | | | | |
| PBI | N/A | 448 | 0.11 | yes | 2 | 0.15 | 99.53 | LQSSDDFALIL | 98.95 | LQSSDDFALIL | 0.58 | | | | |
| PBI | N/A | 449 | 0.11 | yes | 2 | 0.15 | 99.53 | QSSDDFALILN | 98.95 | QSSDDFALILN | 0.58 | | | | |
| PBI | N/A | 450 | 0.11 | yes | 2 | 0.15 | 99.51 | SSDDFALILNA | 98.93 | SSDDFALILNA | 0.58 | | | | |
| PBI | N/A | 451 | 0.26 | yes | 4 | 0.22 | 99.32 | SDDFALIVNAP | 97.21 | SDDFALIVNAS | 0.94 | SDDFALILNAP | 0.59 | | |
| PBI | N/A | 465 | 0.22 | yes | 3 | 0.16 | 99.18 | GIQAGVNREYR | 97.75 | GIQAGVNREYR | 1.16 | GVQAGVNREYR | 0.26 | | |
| PBI | N/A | 466 | 0.44 | yes | 4 | 0.17 | 99.05 | IQAGVDRFYRT | 94.25 | IQAGVDRFYRI | 3.43 | IQAGVDRFYRT | 1.12 | | |
| PBI | N/A | 467 | 0.42 | yes | 4 | 0.17 | 99.05 | QAGVDRFYRTC | 94.48 | QAGVDRFYRIC | 3.45 | VQAGVDRFYRT | 1.12 | | |
| PBI | N/A | 468 | 0.41 | yes | 4 | 0.17 | 99.09 | AGVDRFYRTCK | 94.52 | AGVDRFYRICK | 3.45 | | 1.12 | | |
| PBI | N/A | 469 | 0.87 | yes | 3 | 0.11 | 99.17 | GVDRFYRTCKL | 94.6 | GVDRFYRICKL | 3.45 | | | | |
| PBI | N/A | 470 | 0.78 | yes | 3 | 0.1 | 99.04 | DRFYRTCKLLG | 85.06 | DRFYRICKLLG | 9.46 | NRFYRTCKLVG | 3.41 | NRFYRTCKLLG | 0.89 |
| PBI | N/A | 471 | 0.76 | yes | 3 | 0.13 | 99.04 | RFYRTCKLLGI | 85.93 | RFYRICKLLGI | 9.68 | | 3.43 | | |
| PBI | N/A | 472 | 0.77 | yes | 5 | 0.12 | 99.25 | FYRTCKLLGIN | 86.1 | FYRICKLLGIN | 9.7 | | 3.45 | | |
| PBI | N/A | 473 | 0.77 | yes | 3 | 0.12 | 99.24 | YRTCKLLGINM | 86.1 | YRICKLVGINM | 9.69 | | 3.45 | | |
| PBI | N/A | 474 | 0.77 | yes | 3 | 0.12 | 99.19 | RTCKLLGINMS | 86.05 | RICKLVGINMS | 9.69 | | 3.45 | | |
| PBI | N/A | 475 | 0.58 | yes | 3 | 0.13 | 99.22 | TCKLLGINMSK | 86.08 | ICKLVGINMSK | 9.65 | | 3.45 | | |
| PBI | N/A | 476 | 0.58 | yes | 3 | 0.13 | 99.36 | CKLLGINMSKK | 89.2 | CKLVGINMSKR | 9.64 | | 0.52 | | |
| PBI | N/A | 477 | 0.58 | yes | 3 | 0.11 | 99.36 | KLLGINMSKKK | 89.2 | KLVGINMSKRK | 9.64 | | 0.52 | | |
| PBI | N/A | 478 | 0.58 | yes | 3 | 0.11 | 99.38 | LLGINMSKKKS | 89.22 | LVGINMSKRKS | 9.64 | | 0.52 | | |
| PBI | N/A | 479 | 0.12 | yes | 2 | 0.11 | 99.55 | LGINMSKKKSY | 89.22 | VGINMSKRKSY | 9.64 | | 0.52 | | |
| PBI | N/A | 480 | 0.11 | yes | 2 | 0.09 | 99.56 | GINMSKKKSYI | 98.93 | GINMSKRKSY | 0.62 | | | | |
| PBI | N/A | 481 | 1.1 | yes | 2 | 0.1 | 99.27 | INMSKKKSYIN | 98.93 | INMSKRKSYIN | 0.63 | | | | |
| PBI | N/A | 482 | 1.1 | yes | 2 | 0.1 | 99.26 | NMSKKKSYINR | 56.9 | NMSKRKSYINK | 42.02 | NMSKRKSYINK | 0.35 | | |
| PBI | N/A | 483 | 1.09 | yes | 2 | 0.1 | 99.3 | MSKKKSYINRT | 56.87 | MSKRKSYINKT | 42.04 | MSKRKSYINKT | 0.35 | | |
| PBI | N/A | 484 | 1.09 | yes | 2 | 0.11 | 99.05 | SKKKSYINRTG | 56.9 | SKRKSYINKTG | 42.05 | SKRKSYINKTG | 0.35 | | |
| PBI | N/A | 485 | 1.08 | yes | 2 | 0.12 | 99.01 | KKKSYINRTGT | 56.99 | KKSYINKTGT | 42.06 | | | | |
| PBI | N/A | 486 | 1.08 | yes | 2 | 0.12 | 99.64 | KKSYINRTGTF | 56.96 | KKSYINKTGTF | 42.41 | | | | |
| PBI | N/A | 487 | 1.03 | yes | 2 | 0.12 | 99.66 | KSYINRTGTFE | 57.23 | KSYINKTGTFE | 42.41 | | | | |
| PBI | N/A | 488 | 1.03 | yes | 2 | 0.12 | 99.64 | SYINRTGTFEF | 57.25 | SYINKTGTFEF | 42.41 | | | | |
| PBI | N/A | 489 | 1.03 | yes | 2 | 0.12 | 99.66 | YINRTGTFEFT | 57.23 | YINKTGTFEFT | 42.41 | | | | |
| PBI | N/A | 490 | 1.03 | yes | 2 | 0.12 | 99.64 | INRTGTFEFTS | 57.25 | INKTGTFEFTS | 42.41 | | | | |
| PBI | N/A | 491 | 1.03 | yes | 2 | 0.12 | 99.66 | NRTGTFEFTS | | NKTGTFEFTS | | | | | |

Fig. 75-280

| Protein | Sub-type | Start Pos | Block Entropy | Gaps >10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 492 | 1.01 | yes | 2 | 0.12 | 99.8 | NRTGTFEFTSF | 57.36 | NKTGTFEFTSF | 42.44 | | | | |
| PB1 | N/A | 493 | 1.01 | yes | 2 | 0.13 | 99.78 | RTGTFEFTSFF | 57.35 | KTGTFEFTSFF | 42.43 | | | | |
| PB1 | N/A | 494 | 0.03 | yes | 1 | 0.13 | 99.78 | TGTFEFTSFFY | 99.78 | | | | | | |
| PB1 | N/A | 495 | 0.03 | yes | 1 | 0.12 | 99.81 | GTFEFTSFFYR | 99.81 | | | | | | |
| PB1 | N/A | 496 | 0.04 | yes | 1 | 0.13 | 99.74 | TFEFTSFFYRY | 99.74 | | | | | | |
| PB1 | N/A | 497 | 0.03 | yes | 1 | 0.13 | 99.74 | FEFTSFFYRYG | 99.74 | | | | | | |
| PB1 | N/A | 498 | 0.03 | yes | 1 | 0.12 | 99.78 | EFTSFFYRYGF | 99.78 | | | | | | |
| PB1 | N/A | 499 | 0.04 | yes | 1 | 0.11 | 99.77 | FTSFFYRYGFV | 99.77 | | | | | | |
| PB1 | N/A | 500 | 0.03 | yes | 1 | 0.11 | 99.72 | TSFFYRYGFVA | 99.72 | | | | | | |
| PB1 | N/A | 501 | 0.04 | yes | 1 | 0.11 | 99.7 | SFFYRYGFVAN | 99.7 | | | | | | |
| PB1 | N/A | 502 | 0.04 | yes | 1 | 0.11 | 99.72 | FFYRYGFVANF | 99.72 | | | | | | |
| PB1 | N/A | 503 | 0.04 | yes | 1 | 0.11 | 99.68 | FYRYGFVANFS | 99.68 | | | | | | |
| PB1 | N/A | 504 | 0.04 | yes | 1 | 0.11 | 99.68 | YRYGFVANFSM | 99.68 | | | | | | |
| PB1 | N/A | 505 | 0.04 | yes | 1 | 0.11 | 99.64 | RYGFVANFSME | 99.64 | | | | | | |
| PB1 | N/A | 506 | 0.05 | yes | 1 | 0.11 | 99.65 | YGFVANFSMEL | 99.65 | | | | | | |
| PB1 | N/A | 507 | 0.04 | yes | 1 | 0.11 | 99.65 | GFVANFSMELP | 99.65 | | | | | | |
| PB1 | N/A | 508 | 0.04 | yes | 1 | 0.1 | 99.7 | FVANFSMELPS | 99.7 | | | | | | |
| PB1 | N/A | 509 | 0.05 | yes | 1 | 0.11 | 99.65 | VANFSMELPSF | 99.65 | | | | | | |
| PB1 | N/A | 510 | 0.06 | yes | 1 | 0.11 | 99.55 | ANFSMELPSFG | 99.55 | | | | | | |
| PB1 | N/A | 511 | 0.06 | yes | 1 | 0.11 | 99.55 | NFSMELPSFGV | 99.55 | | | | | | |
| PB1 | N/A | 512 | 0.06 | yes | 1 | 0.11 | 99.59 | FSMELPSFGVS | 99.59 | | | | | | |
| PB1 | N/A | 513 | 0.08 | yes | 1 | 0.11 | 99.36 | SMELPSFGVSG | 99.36 | | | | | | |
| PB1 | N/A | 514 | 0.08 | yes | 2 | 0.11 | 99.38 | MELPSFGVSGI | 99.38 | MELPSFGVSGV | 67.79 | | | | |
| PB1 | N/A | 515 | 0.99 | yes | 2 | 0.1 | 99.24 | ELPSFGVSGIN | 99.29 | ELPSFGVSGVN | 67.82 | | | | |
| PB1 | N/A | 516 | 0.99 | yes | 2 | 0.09 | 99.31 | LPSFGVSGINE | 99.31 | LPSFGVSGVNE | 67.82 | | | | |
| PB1 | N/A | 517 | 0.98 | yes | 2 | 0.09 | 99.31 | PSFGVSGINES | 99.31 | PSFGVSGVNES | 67.82 | | | | |
| PB1 | N/A | 518 | 0.98 | yes | 2 | 0.09 | 99.26 | SFGVSGINESA | 99.26 | SFGVSGVNESA | 67.78 | | | | |
| PB1 | N/A | 519 | 0.99 | yes | 2 | 0.07 | 99.27 | FGVSGINESAD | 99.27 | FGVSGVNESAD | 67.8 | | | | |
| PB1 | N/A | 520 | 0.99 | yes | 2 | 0.07 | 99.28 | GVSGINESADM | 99.28 | GVSGVNESADM | 67.78 | | | | |
| PB1 | N/A | 521 | 0.99 | yes | 2 | 0.05 | 99.22 | VSGINESADMS | 99.22 | VSGVNESADMS | 67.76 | | | | |
| PB1 | N/A | 522 | 0.99 | yes | 2 | 0.06 | 99.08 | SGINESADMSI | 99.08 | SGVNESADMSI | 67.71 | INESADMSIGI | 1.87 | | |
| PB1 | N/A | 523 | 1.01 | yes | 2 | 0.05 | 99.33 | GINESADMSIG | 99.33 | GVNESADMSIG | 67.92 | | | | |
| PB1 | N/A | 524 | 0.98 | yes | 2 | 0.05 | 99.11 | INESADMSIGV | 99.11 | VNESADMSIGV | 65.86 | | | | |
| PB1 | N/A | 525 | 1.15 | yes | 3 | 0.04 | 99.14 | NESADMSIGVT | 99.11 | VNESADMSIGT | 96.95 | ESADMSIGVAV | 2.09 | VNESADMSIGI | 0.22 | |
| PB1 | N/A | 526 | 0.26 | yes | 3 | 0.05 | 99.1 | ESADMSIGVTV | 99.1 | ESADMSIGVTI | 96.88 | SADMSIGVAVI | 2.06 | ESADMSIGVAV | 0.2 | |
| PB1 | N/A | 527 | 0.28 | yes | 4 | 0.05 | 99.11 | SADMSIGVTVI | 99.11 | SADMSIGVTVI | 96.84 | ADMSIGVTVIR | 2.06 | SADMSIGVAVI | 0.2 | |
| PB1 | N/A | 528 | 0.32 | yes | 4 | 0.04 | 99.09 | ADMSIGVTVIK | 99.09 | ADMSIGITVIK | 96.38 | DMSIGVTVIRN | 2.07 | ADMSIGVAVIK | 0.47 | ADMSIGVAVIK | 0.2 |
| PB1 | N/A | 529 | 0.32 | yes | 4 | 0.05 | 99.08 | DMSIGVTVIKN | 99.08 | DMSIGITVIKN | 96.36 | MSIGVTVIRNN | 2.07 | DMSIGVAVIKN | 0.47 | MSIGVAVIKN | 0.2 |
| PB1 | N/A | 530 | 0.34 | yes | 5 | 0.05 | 99.08 | MSIGVTVIKNN | 99.08 | MSIGITVIKNN | 96.24 | SIGVTVIRNNM | 2.07 | MSIGVAVIKNN | 0.47 | MSIGVAVIKNN | 0.2 | MSVGVTVIKNN | 0.11 |
| PB1 | N/A | 531 | 0.33 | yes | 4 | 0.05 | 99.07 | SIGVTVIKNNM | 99.07 | SIGITVIKNNM | 96.33 | | | SIGVAVIKNNM | 0.47 | SIGVAVIKNNM | 0.21 | |

Fig. 75-281

| Protein | Sub-type | Start Pos | Block Entropy | Gaps < 10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 532 | 0.35 | yes | 5 | 0.05 | 99.1 | IGVTVIKNNMI | 96.07 | IGTVIIKNNMI | 2.05 | IGTVIIKNNMI | 0.47 | IGVAVIKNNMI | 0.21 |
| PBI | N/A | 533 | 0.34 | yes | 4 | 0.05 | 99.02 | GVTVIKNNMIN | 96.21 | GITVIKNNMIN | 2.05 | GVTVIKNNMYN | 0.47 | | |
| PBI | N/A | 534 | 0.2 | yes | 4 | 0.05 | 99.19 | TVIKNNMINND | 98.19 | TVIRNNMINND | 0.48 | AVIKNNMINND | 0.31 | | |
| PBI | N/A | 535 | 0.18 | yes | 3 | 0.05 | 99.17 | VIKNNMINNDL | 98.38 | VIRNMINNDL | 0.48 | | 0.31 | | |
| PBI | N/A | 536 | 0.16 | yes | 2 | 0.05 | 99.28 | IKNNMINNDLG | 98.49 | IRNNMINNDLG | 0.48 | | | | |
| PBI | N/A | 537 | 0.16 | yes | 2 | 0.05 | 99.01 | KNNMINNDLGP | 98.53 | RNNMINNDLGP | 0.48 | | | | |
| PBI | N/A | 538 | 0.12 | yes | 1 | 0.04 | 99.3 | NNMINNDLGPA | 98.99 | NNMVNNDLGPA | 0.31 | | | | |
| PBI | N/A | 539 | 0.11 | yes | 1 | 0.04 | 99.04 | NMINNDLGPAT | 99.04 | | | | | | |
| PBI | N/A | 540 | 0.1 | yes | 1 | 0.05 | 99.14 | MINNDLGPATA | 99.14 | | | | | | |
| PBI | N/A | 541 | 0.1 | yes | 1 | 0.05 | 99.14 | INNDLGPATAQ | 99.14 | | | | | | |
| PBI | N/A | 542 | 0.07 | yes | 1 | 0.05 | 99.45 | NNDLGPATAQM | 99.45 | | | | | | |
| PBI | N/A | 543 | 0.07 | yes | 1 | 0.05 | 99.63 | NDLGPATAQMA | 99.63 | | | | | | |
| PBI | N/A | 544 | 0.05 | yes | 1 | 0.05 | 99.68 | DLGPATAQMAL | 99.68 | | | | | | |
| PBI | N/A | 545 | 0.04 | yes | 1 | 0.05 | 99.7 | LGPATAQMALQ | 99.7 | | | | | | |
| PBI | N/A | 546 | 0.04 | yes | 1 | 0.06 | 99.69 | GPATAQMALQL | 99.69 | | | | | | |
| PBI | N/A | 547 | 0.1 | yes | 1 | 0.06 | 99.13 | PATAQMALQLF | 99.13 | | | | | | |
| PBI | N/A | 548 | 0.1 | yes | 1 | 0.06 | 99.12 | ATAQMALQLFI | 99.12 | | | | | | |
| PBI | N/A | 549 | 0.1 | yes | 1 | 0.06 | 99.09 | TAQMALQLFIK | 99.09 | | | | | | |
| PBI | N/A | 550 | 0.1 | yes | 1 | 0.06 | 99.08 | AQMALQLFIKD | 99.08 | | | | | | |
| PBI | N/A | 551 | 0.1 | yes | 1 | 0.06 | 99.08 | QMALQLFIKDY | 99.08 | | | | | | |
| PBI | N/A | 552 | 0.1 | yes | 1 | 0.07 | 99.1 | MALQLFIKDYR | 99.1 | | | | | | |
| PBI | N/A | 553 | 0.1 | yes | 1 | 0.07 | 99.11 | ALQLFIKDYRY | 99.11 | | | | | | |
| PBI | N/A | 554 | 0.1 | yes | 1 | 0.07 | 99.11 | LQLFIKDYRYT | 99.11 | | | | | | |
| PBI | N/A | 555 | 0.1 | yes | 1 | 0.07 | 99.14 | QLFIKDYRYTY | 99.14 | | | | | | |
| PBI | N/A | 556 | 0.1 | yes | 1 | 0.07 | 99.15 | LFIKDYRYTYR | 99.15 | | | | | | |
| PBI | N/A | 557 | 0.1 | yes | 1 | 0.08 | 99.16 | FIKDYRYTYRC | 99.16 | | | | | | |
| PBI | N/A | 558 | 0.12 | yes | 2 | 0.08 | 99.15 | IKDYRYTYRCH | 99.15 | KDYRYTYRCHK | 0.88 | YTYRCHRGDT | 0.47 | YTYRCHRGDAQ | 0.31 |
| PBI | N/A | 559 | 0.12 | yes | 2 | 0.11 | 99.69 | KDYRYTYRCHR | 98.81 | DYRYTYRCHKG | 0.88 | YTYRCHRGDTH | 0.47 | | |
| PBI | N/A | 560 | 0.12 | yes | 2 | 0.11 | 99.63 | DYRYTYRCHRG | 98.75 | YRYTYRCHKGD | 0.88 | YTYRCHRGDMQ | 0.42 | | |
| PBI | N/A | 561 | 0.12 | yes | 3 | 0.11 | 99.62 | YRYTYRCHRGD | 98.74 | RYTYRCHKGDT | 0.88 | | | | |
| PBI | N/A | 562 | 0.22 | yes | 5 | 0.11 | 99.11 | RYTYRCHRGDT | 97.76 | YTYRCHKGDTQ | 0.88 | RYTYRCHRGDM | 0.88 | | |
| PBI | N/A | 563 | 0.29 | yes | 3 | 0.12 | 99.21 | YTYRCHRGDTQ | 97.13 | GLLVSDGGPNL | 1.69 | YTYRCHRGDMQ | 0.88 | | |
| PBI | N/A | 564 | 0.26 | yes | 3 | 0.07 | 99.2 | GLLVSDGGPNL | 96.97 | LLISDGGPNL | 1.69 | GLLYADGGPNL | 0.88 | | |
| PBI | N/A | 595 | 0.27 | yes | 3 | 0.07 | 99.18 | LLVSDGGPNLY | 96.91 | LISDGGPNLYN | 1.69 | LVADGGPNL | 0.88 | | |
| PBI | N/A | 596 | 0.27 | yes | 3 | 0.07 | 99.2 | LVSDGGPNLYN | 96.89 | ISDGGPNLYNI | 1.69 | LVADGGPNLYN | 0.61 | | |
| PBI | N/A | 597 | 0.28 | yes | 2 | 0.07 | 99.15 | VSDGGPNLYNI | 96.8 | ADGGPNLYNIR | 0.64 | VADGGPNLYNI | 0.61 | | |
| PBI | N/A | 598 | 0.16 | yes | 2 | 0.06 | 99.17 | SDGGPNLYNIR | 98.51 | | | | 0.61 | | |
| PBI | N/A | 599 | 0.1 | yes | 1 | 0.06 | 99.1 | DGGPNLYNIRN | 99.17 | | | | 0.61 | | |
| PBI | N/A | 600 | 0.1 | yes | 1 | 0.05 | 99.11 | GGPNLYNIRNL | 99.13 | | | | | | |
| PBI | N/A | 601 | 0.11 | yes | 1 | 0.04 | 99.1 | GPNLYNIRNLH | 99.1 | | | | | | |

Fig. 75-282

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PBI | N/A | 603 | 0.13 | yes | 2 | 0.05 | 99.27 | PNLYNIRNLHI | 98.92 | SNLYNIRNLHI | 0.35 | | | | |
| PBI | N/A | 604 | 0.1 | yes | 1 | 0.05 | 99.24 | NLYNIRNLHIP | 99.24 | | | | | | |
| PBI | N/A | 605 | 0.11 | yes | 1 | 0.05 | 99.09 | LYNIRNLHIPE | 99.09 | | | | | | |
| PBI | N/A | 606 | 0.14 | yes | 2 | 0.05 | 99.12 | YNIRNLHIPEV | 98.83 | YNIRNLHIPEA | 0.28 | | | | |
| PBI | N/A | 607 | 0.14 | yes | 2 | 0.05 | 99.03 | NIRNLHIPEVC | 98.87 | NIRNLHIPEAG | 0.17 | | | | |
| PBI | N/A | 608 | 0.15 | yes | 2 | 0.05 | 99 | IRNLHIPEVCL | 98.82 | IRNLHIPEAGL | 0.18 | | | | |
| PBI | N/A | 609 | 0.13 | yes | 2 | 0.07 | 99.12 | RNLHIPEVCLK | 98.93 | RNLHIPEAGLK | 0.18 | | | | |
| PBI | N/A | 610 | 0.14 | yes | 2 | 0.07 | 99.1 | NLHIPEVCLKW | 98.92 | NLHIPEAGLKW | 0.18 | | | | |
| PBI | N/A | 611 | 0.2 | yes | 4 | 0.06 | 99.07 | LHIPEVCLKWE | 98.21 | LHIPEAGLKWE | 0.53 | LHIPEVCLKWG | 0.18 | LHIPEAGLKWD | |
| PBI | N/A | 612 | 0.2 | yes | 4 | 0.06 | 99.1 | HIPEVCLKWEL | 98.24 | HIPEAGLKWEL | 0.53 | HIPEVCLKWGL | 0.18 | HIPEAGLKWDL | |
| PBI | N/A | 613 | 0.2 | yes | 4 | 0.07 | 99.12 | IPEVCLKWELM | 98.26 | IPEAGLKWELM | 0.53 | IPEVCLKWGLM | 0.18 | IPEAGLKWDLM | |
| PBI | N/A | 614 | 0.18 | yes | 3 | 0.06 | 99.11 | PEVCLKWELMD | 98.39 | PEAGLKWELMD | 0.53 | | | | |
| PBI | N/A | 627 | 1.22 | yes | 4 | 0.07 | 99.13 | YOGRLCNPLNP | 54.6 | YKGRLCNPLNP | 42.59 | YOGRLCNPMNP | 1.7 | | |
| PBI | N/A | 628 | 1.22 | yes | 4 | 0.08 | 99.12 | QGRLCNPLNPF | 54.61 | KGRLCNPLNPF | 42.58 | QGRLCNPMNPF | 1.7 | | |
| PBI | N/A | 629 | 0.15 | yes | 2 | 0.09 | 99.08 | GRLCNPLNPFV | 98.67 | | | | | | |
| PBI | N/A | 630 | 0.33 | yes | 5 | 0.08 | 99.18 | RLCNPLNPFVS | 96.46 | RLCNPLNPFVT | 0.41 | RLCNPMNPFVS | 0.6 | RLCNPLNPFVG | 0.2 |
| PBI | N/A | 631 | 0.35 | yes | 5 | 0.07 | 99.01 | LCNPLNPFVSH | 96.3 | LCNPLNPFVTH | 1.52 | LCNPMNPFVSH | 0.6 | LCNPLNPFVGH | 0.2 |
| PBI | N/A | 635 | 0 | no | 1 | 99.99 | 100 | HPRGLLEVGTR | 100 | CNPLNPFVSHK | 1.51 | | | | |
| PBI | N/A | 636 | 0 | no | 1 | 99.99 | 100 | PRGLLEVGTRW | 100 | | | | | | |
| PBI | N/A | 637 | 0 | no | 1 | 99.99 | 100 | RGLLEVGTRWM | 100 | | | | | | |
| PBI | N/A | 638 | 0 | no | 1 | 99.99 | 100 | GLLEVGTRWMK | 100 | | | | | | |
| PBI | N/A | 639 | 0 | no | 1 | 99.99 | 100 | LLEVGTRWMKI | 100 | | | | | | |
| PBI | N/A | 640 | 0 | no | 1 | 99.99 | 100 | LEVGTRWMKII | 100 | | | | | | |
| PBI | N/A | 641 | 0 | no | 1 | 99.99 | 100 | EVGTRWMKIIR | 100 | | | | | | |
| PBI | N/A | 642 | 0 | no | 1 | 99.99 | 100 | VGTRWMKIIRV | 100 | | | | | | |
| PBI | N/A | 643 | 0 | no | 1 | 99.99 | 100 | GTRWMKIIRVG | 100 | | | | | | |
| PBI | N/A | 644 | 0 | no | 1 | 99.99 | 100 | TRWMKIIRVGC | 100 | | | | | | |
| PBI | N/A | 645 | 0 | no | 1 | 99.99 | 100 | RWMKIIRVGCV | 100 | | | | | | |
| PBI | N/A | 646 | 0 | no | 1 | 99.99 | 100 | WMKIIRVGCVI | 100 | | | | | | |
| PBI | N/A | 647 | 0 | no | 1 | 99.99 | 100 | MKIIRVGCVIL | 100 | | | | | | |
| PBI | N/A | 648 | 0 | no | 1 | 99.99 | 100 | KIIRVGCVILL | 100 | | | | | | |
| PBI | N/A | 649 | 0 | no | 1 | 99.99 | 100 | IIRVGCVILLN | 100 | | | | | | |
| PBI | N/A | 650 | 0 | no | 1 | 99.99 | 100 | IRVGCVILLNP | 100 | | | | | | |
| PBI | N/A | 651 | 0 | no | 1 | 99.99 | 100 | RVGCVILLNPF | 100 | | | | | | |
| PBI | N/A | 652 | 0 | no | 1 | 99.99 | 100 | VGCVILLNPFV | 100 | | | | | | |
| PBI | N/A | 653 | 0 | no | 1 | 99.99 | 100 | GCVILLNPFVS | 100 | | | | | | |
| PBI | N/A | 654 | 0 | no | 1 | 99.99 | 100 | CVILLNPFVSH | 100 | | | | | | |
| PBI | N/A | 655 | 0 | no | 1 | 99.99 | 100 | VILLNPFVSHK | 100 | | | | | | |
| PBI | N/A | 656 | 0 | no | 1 | 99.99 | 100 | ILLNPFVSHKE | 100 | | | | | | |
| PBI | N/A | 657 | 0 | no | 1 | 99.99 | 100 | LLNPFVSHKEI | 100 | | | | | | |

Fig. 75-283

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 685 | 0.17 | yes | 3 | 0.01 | 99.28 | MEYDAVATTHS | 98.37 | IEYDAVATTHS | 0.56 | VEYDAVATTHS | 0.35 | | |
| PB1 | N/A | 686 | 0.07 | yes | 1 | 0.01 | 99.4 | EYDAVATTHSW | 99.4 | YDAVATTHSWV | 10.74 | YDAVATTHSWT | 1.02 | | |
| PB1 | N/A | 687 | 0.66 | yes | 3 | 0.02 | 99.3 | YDAVATTHSWI | 87.55 | DAVATTHSWVP | 10.7 | DAVATTHSWTP | 1.02 | | |
| PB1 | N/A | 688 | 0.67 | yes | 3 | 0.03 | 99.18 | DAVATTHSWIP | 87.46 | AVATTHSWVPK | 10.7 | AVATTHSWTPK | 1.02 | | |
| PB1 | N/A | 689 | 0.68 | yes | 3 | 0.06 | 99.15 | AVATTHSWIPK | 87.43 | VATTHSWVPKR | 10.7 | VATTHSWTPKR | 1.02 | | |
| PB1 | N/A | 690 | 0.68 | yes | 3 | 0.08 | 99.12 | VATTHSWIPKR | 87.4 | ATTHSWVPKRN | 10.7 | ATTHSWTPKRN | 1.02 | | |
| PB1 | N/A | 691 | 0.67 | yes | 3 | 0.08 | 99.25 | ATTHSWIPKRN | 87.53 | TTHSWVPKRNR | 10.71 | TTHSWTPKRNR | 1.02 | | |
| PB1 | N/A | 692 | 0.65 | yes | 3 | 0.08 | 99.41 | TTHSWIPKRNR | 87.68 | THSWVPKRNRS | 10.71 | THSWTPKRNRS | 1.02 | | |
| PB1 | N/A | 693 | 0.64 | yes | 3 | 0.08 | 99.45 | THSWIPKRNRS | 87.71 | HSWVPKRNRSI | 10.71 | HSWTPKRNRSI | 1.02 | | |
| PB1 | N/A | 694 | 0.65 | yes | 3 | 0.07 | 99.36 | HSWIPKRNRSI | 87.63 | SWVPKRNRSIL | 10.71 | SWTPKRNRSIL | 1.02 | | |
| PB1 | N/A | 695 | 0.65 | yes | 3 | 0.09 | 99.32 | SWIPKRNRSIL | 87.6 | WVPKRNRSILN | 10.72 | WTPKRNRSILN | 1.02 | | |
| PB1 | N/A | 696 | 0.65 | yes | 3 | 0.09 | 99.34 | WIPKRNRSILN | 87.6 | VPKRNRSILNT | 10.72 | TPKRNRSILNT | 1.02 | | |
| PB1 | N/A | 697 | 0.65 | yes | 3 | 0.09 | 99.33 | IPKRNRSILNT | 87.6 | | | | | | |
| PB1 | N/A | 698 | 0.1 | yes | 1 | 0.09 | 99.23 | PKRNRSILNTS | 99.16 | | | | | | |
| PB1 | N/A | 699 | 0.09 | yes | 1 | 0.09 | 99.05 | KRNRSILNTSQ | 99.23 | | | | | | |
| PB1 | N/A | 700 | 0.11 | yes | 1 | 0.09 | 99.08 | RNRSILNTSQR | 99.05 | | | | | | |
| PB1 | N/A | 701 | 0.1 | yes | 2 | 0.09 | 99.07 | NRSILNTSQRG | 99.08 | RSILNTSQRGV | 0.34 | | | | |
| PB1 | N/A | 702 | 0.14 | yes | 2 | 0.05 | 99.02 | RSILNTSQRGI | 98.74 | SILNTSQRGVL | 0.34 | | | | |
| PB1 | N/A | 703 | 0.14 | yes | 1 | 0.05 | 99.02 | SILNTSQRGIL | 98.68 | | | | | | |
| PB1 | N/A | 704 | 0 | no | 1 | 99.99 | 100 | ICNSNAITRSG | 100 | | | | | | |
| PB1 | N/A | 705 | 0 | no | 1 | 99.99 | 100 | CNSNAITRSGQ | 100 | | | | | | |
| PB1 | N/A | 706 | 0 | no | 1 | 99.99 | 100 | NSNAITRSGQN | 100 | | | | | | |
| PB1 | N/A | 707 | 0 | no | 1 | 99.99 | 100 | SNAITRSGQNH | 100 | | | | | | |
|

Fig. 75-284

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB1 | N/A | 725 | 0 | no | 1 | 99.99 | 100 | THSWVPILNTS | 100 | | | | | | |
| PB1 | N/A | 726 | 0 | no | 1 | 99.99 | 100 | HSWVPILNTSQ | 100 | | | | | | |
| PB1 | N/A | 727 | 0 | no | 1 | 99.99 | 100 | SWVPILNTSQR | 100 | | | | | | |
| PB1 | N/A | 728 | 0 | no | 1 | 99.99 | 100 | WVPILNTSQRG | 100 | | | | | | |
| PB1 | N/A | 729 | 0 | no | 1 | 99.99 | 100 | VPILNTSQRGI | 100 | | | | | | |
| PB1 | N/A | 730 | 0 | no | 1 | 99.99 | 100 | PILNTSQRGIL | 100 | | | | | | |
| PB1 | N/A | 731 | 0.15 | yes | 1 | 0.05 | 99 | ILNTSQRGILE | 98.66 | | | | | | |
| PB1 | N/A | 732 | 0.14 | yes | 2 | 0.05 | 99.1 | LNTSQRGILED | 98.76 | | | | | | |
| PB1 | N/A | 733 | 0.14 | yes | 2 | 0.05 | 99.07 | NTSQRGILEDE | 98.73 | | | | | | |
| PB1 | N/A | 734 | 0.19 | yes | 4 | 0.05 | 99.18 | TSQRGILEDEQ | 98.33 | TNQRGILEDEQ | 0.34 | TSQNGILEDEQ | 0.28 | | |
| PB1 | N/A | 735 | 0.2 | yes | 4 | 0.05 | 99.05 | SQRGILEDEQM | 98.2 | NQRGILEDEQM | 0.34 | SQKGILEDEQM | 0.28 | | |
| PB1 | N/A | 736 | 0.16 | yes | 3 | 0.06 | 99.12 | QRGILEDEQMY | 98.55 | QKGILEDEQMY | 0.34 | | | | |
| PB1 | N/A | 737 | 0.17 | yes | 3 | 0.05 | 99.05 | RGILEDEQMYQ | 98.49 | GVLEDEQMYQ | 0.34 | | | | |
| PB1 | N/A | 738 | 0.55 | yes | 4 | 0.06 | 99.06 | GILEDEQMYQK | 90.92 | VLEDEQMYOK | 7.77 | GILEDERMYQK | 0.22 | | |
| PB1 | N/A | 739 | 0.55 | yes | 2 | 0.06 | 99.06 | ILEDEQMYOKC | 90.92 | VLEDEQMYOKC | 7.77 | ILEDERMYOKC | 0.22 | | |
| PB1 | N/A | 740 | 0.52 | yes | 2 | 0.06 | 99.05 | LEDEQMYORCC | 91.13 | | 7.91 | | | | |
| PB1 | N/A | 741 | 0.75 | yes | 5 | 0.03 | 99.08 | EDEQMYORCCN | 87.92 | EDEQMYOKCCS | 7.89 | EDEQMYOKCCT | 2.48 | EDERMYOKCCN | 0.62 |
| PB1 | N/A | 742 | 0.75 | yes | 5 | 0.03 | 99.06 | DEQMYORCCNL | 87.88 | DEQMYOKCCSL | 7.89 | DEQMYOKCCTL | 2.48 | DERMYOKCCNL | 0.62 |
| PB1 | N/A | 743 | 0.76 | yes | 5 | 0.04 | 99.03 | EQMYORCCNLF | 87.95 | EQMYOKCCSLF | 7.89 | EQMYOKCCTLF | 2.47 | ERMYOKCCNLF | 0.61 |
| PB1 | N/A | 744 | 0.75 | yes | 4 | 0.06 | 99.03 | MYORCCNLFEK | 87.95 | MYOKCCSLFEK | 7.83 | MYOKCCTLFEK | 2.48 | MYOKCCNLFEK | 0.62 |
| PB1 | N/A | 745 | 0.74 | yes | 4 | 0.06 | 99.01 | YORCCNLFEKF | 88.08 | YOKCCSLFEKF | 7.83 | YOKCCTLFEKF | 2.48 | | 0.62 |
| PB1 | N/A | 746 | 0.74 | yes | 4 | 0.06 | 99.01 | QRCCNLFEKFF | 88.09 | QKCCSLFEKFF | 7.83 | QKCCTLFEKFF | 2.48 | | 0.62 |
| PB1 | N/A | 747 | 0.73 | yes | 4 | 0.05 | 99.11 | RCCNLFEKFFP | 88.16 | KCCSLFEKFFP | 7.84 | KCCTLFEKFFP | 2.48 | | |
| PB1 | N/A | 748 | 0.33 | yes | 3 | 0.05 | 99.07 | CCNLFEKFFPS | 96 | CCSLFEKFFPS | 2.49 | CTLFEKFFPS | 0.62 | | |
| PB1 | N/A | 749 | 0.34 | yes | 3 | 0.05 | 99.03 | CNLFEKFFPSS | 95.96 | CSLFEKFFPSS | 2.49 | CTLFEKFFPSS | 0.62 | | |
| PB1 | N/A | 750 | 0.34 | yes | 3 | 0.04 | 99.03 | NLFEKFFPSSS | 95.92 | SLFEKFFPSSS | 2.49 | TLFEKFFPSSS | 0.62 | | |
| PB1 | N/A | 751 | 0.1 | yes | 1 | 0.05 | 99.22 | LFEKFFPSSSY | 99.22 | | | | | | |
| PB1 | N/A | 752 | 0.1 | yes | 1 | 0.05 | 99.21 | FEKFFPSSSYR | 99.21 | | | | | | |
| PB1 | N/A | 753 | 0.09 | yes | 1 | 0.05 | 99.18 | EKFFPSSSYRR | 99.18 | | | | | | |
| PB1 | N/A | 754 | 0.11 | yes | 1 | 0.04 | 99.25 | KFFPSSSYRRP | 99.25 | | | | | | |
| PB1 | N/A | 755 | 0.49 | yes | 2 | 0.05 | 99.64 | FPSSSYRRPV | 90.62 | FPSSSYRRPIG | 0.67 | | | | |
| PB1 | N/A | 756 | 0.49 | yes | 2 | 0.05 | 99.64 | PSSSYRRPVG | 90.63 | PSSSYRRPIG | 0.66 | | | | |
| PB1 | N/A | 757 | 0.49 | yes | 2 | 0.04 | 99.65 | SSSYRRPVGI | 90.57 | SSSYRRPIGI | 0.68 | | | | |
| PB1 | N/A | 758 | 0.5 | yes | 2 | 0.04 | 99.59 | SSYRRPVGIS | 90.57 | SSYRRPIGIS | 0.68 | | | | |
| PB1 | N/A | 759 | 0.5 | yes | 2 | 0.05 | 99.59 | SYRRPVGISS | 90.52 | SYRRPIGISS | 0.72 | | | | |
| PB1 | N/A | 760 | 0.5 | yes | 2 | 0.05 | 99.54 | YRRPVGISSM | 90.51 | YRRPIGISSM | 0.72 | YRRPVGISSMG | 9.02 | YRRPVGISSMM | 0.72 |
| PB1 | N/A | 761 | 0.63 | yes | 2 | 0.04 | 99.52 | RRPVGISSMV | 89.07 | RRPIGISSMV | | RRPVGISSMGE | 9.02 | RRPVGISSMME | 0.72 |
| PB1 | N/A | 762 | 0.64 | yes | 4 | 0.05 | 99.32 | RPVGISSMVE | 89.01 | | | RPVGISSMGEA | 9.02 | RPVGISSMVEA | 0.72 |
| PB1 | N/A | 763 | 0.63 | yes | 4 | 0.04 | 99.39 | PVGISSMVEA | 89.06 | | | PVGISSMGEAM | 9.02 | PVGISSMVEAM | 0.72 |
| PB1 | N/A | 764 | 0.63 | yes | 4 | 0.04 | 99.39 | PVGISSMVEAM | 89.06 | | | | 9.01 | | |
| PB1 | N/A | 765 | 0.63 | yes | 4 | 0.03 | 99.39 | PVGISSMVEAM | 89.06 | | | | 8.94 | | |

Fig. 75-285

| Protein | Sub-type | Start Pos | Block Entropy | Gaps < 10% | # to cover 99% | Gap % | Coverage | Peptides included | Freq | Peptides included | Freq | Peptides included | Freq |
|---|---|---|---|---|---|---|---|---|---|---|---|---|---|
| PB1 | N/A | 767 | 0.3 | yes | 5 | 0.05 | 99.37 | GISSMVEAMYS | 96.88

Fig. 75-286

| Protein | Sub-type | Start Pos | Block Entropy | Gaps < 10% | # to cover 99% | Gap % | coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 23 | 0.38 | yes | 5 | 0.45 | 99.08 | SRTREILT

Fig. 75-287

| Protein | Sub-type | Start Pos | Block Entropy | Gaps <10% | # to cover 99% | % Gap | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 102 | 0.47 | yes | 4 | 0.02 | 99.11 | MVSPLAVTWWN | 93.22 | MISPLAVTWWN | 5.08 | MVSPLAITWWN | 0.5 | | |
| PB2 | N/A | 103 | 0.41 | yes | 3 | 0.02 | 99.28 | VSPLAVTWWNR | 93.89 | ISPLAVTWWNR | 5.08 | SPLAITWWNRN | 0.31 | | |
| PB2 | N/A | 104 | 0.24 | yes | 4 | 0.02 | 99.29 | SPLAVTWWNRN | 97.6 | SPLAVTWWNRK | 0.91 | PLAITWWNRNG | 0.31 | | |
| PB2 | N/A | 105 | 0.24 | yes | 4 | 0.03 | 99.29 | PLAVTWWNRNG | 97.59 | PLAVTWWNRSG | 0.91 | | | | |
| PB2 | N/A | 106 | 0.21 | yes | 3 | 0.03 | 99.25 | LAVTWWNRNGP | 97.86 | LAVTWWNRKGP | 0.92 | | | | |
| PB2 | N/A | 140 | 0.25 | yes | 5 | 0.05 | 99.12 | GTFGPVHFRNQ | 97.6 | GIFGPVHFRNQ | 0.68 | GTFGPVHFRSQ | 0.27 | GAFGPVHFRNQ | 0.24 |
| PB2 | N/A | 142 | 0.26 | yes | 4 | 0.05 | 99.19 | FGPVHFRNQIK | 97.28 | FGPVHFQNQVK | 0.97 | FGPVHFRSQVK | 0.27 | | |
| PB2 | N/A | 143 | 0.28 | yes | 4 | 0.05 | 99.08 | GPVHFRNQIKI | 97.18 | GPVHFQNQVKI | 0.96 | GPVHFRSQVKI | 0.27 | | |
| PB2 | N/A | 144 | 0.28 | yes | 4 | 0.04 | 99.06 | PVHFRNQIKIR | 97.19 | PVHFQNQVKIR | 0.96 | PVHFRSQVKIR | 0.25 | | |
| PB2 | N/A | 145 | 0.28 | yes | 4 | 0.04 | 99.06 | VHFRNQIKIRR | 97.15 | VHFQNQVKIRR | 0.96 | VHFRSQVKIRR | 0.25 | | |
| PB2 | N/A | 146 | 0.28 | yes | 4 | 0.04 | 99.06 | HFRNQIKIRRR | 97.23 | HFQNQVKIRRR | 0.94 | HFRSQVKIRRR | 0.25 | | |
| PB2 | N/A | 147 | 0.25 | yes | 3 | 0.03 | 99.05 | FRNQIKIRRRV | 97.46 | FQNQVKIRRRV | 0.94 | | | | |
| PB2 | N/A | 148 | 0.26 | yes | 3 | 0.03 | 99.01 | RNQIKIRRRVD | 97.43 | QNQVKIRRRVD | 0.94 | | | | |
| PB2 | N/A | 150 | 1.28 | yes | 5 | 0.02 | 99.06 | QVKIRRRVDIN | 63.96 | QVKIRRRVDTN | 31.25 | QIKIRRRVDIN | 2.29 | OVKIRRRVDMN | 0.8 |
| PB2 | N/A | 151 | 1.28 | yes | 5 | 0.03 | 99.06 | VKIRRRVDINP | 63.97 | VKIRRRVDVNP | 31.23 | IKIRRRVDINP | 2.28 | VKIRRRVDMNP | 0.77 |
| PB2 | N/A | 152 | 1.21 | yes | 4 | 0.03 | 99.19 | KIRRRVDINPG | 64.76 | KIRRRVDVNPG | 31.35 | KIRRRVDMNPG | 2.31 | | |
| PB2 | N/A | 153 | 1.24 | yes | 4 | 0.04 | 99.18 | IRRRVDINPGH | 64.44 | IRRRVDTNPGH | 31.34 | IRRRVDMNPGH | 2.31 | RRVDINPGHS | 0.23 |
| PB2 | N/A | 154 | 1.24 | yes | 5 | 0.04 | 99.03 | RRRVDINPGHA | 64.44 | RRRVDTNPGHA | 31.29 | RRRVDMNPGHA | 2.29 | RRVDINPGHS | 0.14 |
| PB2 | N/A | 169 | 0.31 | yes | 2 | 0.03 | 99.08 | SKEAQDVIMEV | 96.64 | AKEAQDVIMEI | 1.96 | TKEAQDVIMEV | 0.18 | VKEAQDVIMEV | |
| PB2 | N/A | 170 | 0.13 | yes | 1 | 0.03 | 99.1 | KEAQDVIMEVV | 98.92 | KEAQDVIMEIV | 0.18 | | | | |
| PB2 | N/A | 171 | 0.13 | yes | 1 | 0.03 | 99.12 | EAQDVIMEVVF | 98.94 | EAQDVIMEIVF | 0.18 | | | | |
| PB2 | N/A | 172 | – | – | – | 0.03 | 99 | AQDVIMEVVFP | 99 | | | | | | |
| PB2 | N/A | 173 | 0.12 | yes | 2 | 0.03 | 99.18 | QDVIMEVVFPN | 98.99 | ODVIMEIVFPN | 0.18 | | | | |
| PB2 | N/A | 174 | – | – | – | 0.03 | 99.06 | DVIMEVVFPNE | 99.06 | | | | | | |
| PB2 | N/A | 175 | – | – | – | 0.03 | 99.04 | VIMEVVFPNEV | 99.04 | | | | | | |
| PB2 | N/A | 176 | – | – | – | 0.03 | 99.17 | IMEVVFPNEVG | 99.17 | | | | | | |
| PB2 | N/A | 177 | 0.09 | yes | 2 | 0.03 | 99.23 | MEVVFPNEVGA | 99.23 | | | | | | |
| PB2 | N/A | 178 | 0.18 | yes | 2 | 0.03 | 99.2 | EVVFPNEVGAR | 98.23 | EWFPNEVGAK | 0.97 | IVFPNEVGARI | 0.18 | | |
| PB2 | N/A | 179 | 0.22 | yes | 3 | 0.05 | 99.06 | VVFPNEVGARI | 97.91 | VVFPNEVGAKI | 0.97 | FPNEVGARII | 0.21 | | |
| PB2 | N/A | 180 | 0.23 | yes | 3 | 0.04 | 99.14 | VFPNEVGARIL | 97.91 | VFPNEVGAKIL | 0.97 | FPNEVGARIIT | 0.2 | FPNEVGARILA | 0.16 |
| PB2 | N/A | 181 | 0.22 | yes | 4 | 0.05 | 99.01 | FPNEVGARILT | 97.8 | FPNEVGAKILT | 0.98 | PNEVGARIITS | 0.2 | | |
| PB2 | N/A | 182 | 0.24 | yes | 4 | 0.03 | 99.1 | PNEVGARILTS | 97.83 | PNEVGAKILTS | 0.98 | NEVGARIITSE | 0.2 | NEVGARILASE | 0.16 |
| PB2 | N/A | 183 | 0.22 | yes | 3 | 0.03 | 99.03 | NEVGARILTSE | 97.76 | NEVGAKILTSE | 0.99 | EVGARIITSES | 0.2 | EVGARILASES | 0.16 |
| PB2 | N/A | 184 | 0.24 | yes | 4 | 0.04 | 99 | EVGARILTSES | 97.69 | EVGAKILTSES | 0.99 | VGARIITSESQ | 0.2 | VGARILASESQ | 0.16 |
| PB2 | N/A | 185 | 0.27 | yes | 4 | 0.06 | 99.06 | VGARILTSESQ | 97.66 | VGAKILTSESQ | 0.99 | GARIITSESQL | 0.37 | GARILASESQL | 0.2 |
| PB2 | N/A | 186 | – | – | – | 0.07 | 99.05 | GARILTSESQL | 97.34 | GAKILTSESQL | 0.99 | GARILTSESQM | 0.23 | | |
| PB2 | N/A | 211 | 0.99 | yes | 3 | 0.06 | 99.06 | IAPLMVAYMLE | 70.26 | IAPLMVAYMLE | 28.56 | | | | |
| PB2 | N/A | 212 | 0.12 | yes | 1 | 0.06 | 99.12 | APLMVAYMLER | 70.34 | APLMVAYMLER | 28.55 | | | | |
| PB2 | N/A | 213 | 0.12 | yes | – | 0.06 | 99.03 | PLMVAYMLERE | 99.03 | | | | | | |
| PB2 | N/A | 214 | 0.13 | yes | 2 | 0.06 | 99.27 | LMVAYMLEREL | 98.95 | LMMAYMLEREL | 0.32 | | | | |

Fig. 75-288

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 215 | 0.14 | yes | 2 | 0.06 | 99.15 | MAYMLERELV | 98.83 | MMAYMLERELV | 0.32 | | | | |
| PB2 | N/A | 216 | 0.12 | yes | 1 | 0.08 | 99.02 | VAYMLERELVR | 99.02 | | | | | | |
| PB2 | N/A | 217 | 0.09 | yes | 1 | 0.08 | 99.31 | AYMLERELVRK | 99.31 | | | | | | |
| PB2 | N/A | 218 | 0.1 | yes | 1 | 0.08 | 99.23 | YMLERELVRKT | 99.23 | | | | | | |
| PB2 | N/A | 219 | 0.1 | yes | 1 | 0.08 | 99.2 | MLERELVRKTR | 99.2 | | | | | | |
| PB2 | N/A | 220 | 0.09 | yes | 1 | 0.08 | 99.27 | LERELVRKTRF | 99.27 | | | | | | |
| PB2 | N/A | 221 | 0.09 | yes | 1 | 0.07 | 99.31 | ERELVRKTRFL | 99.31 | | | | | | |
| PB2 | N/A | 222 | 0.09 | yes | 1 | 0.06 | 99.32 | RELVRKTRFLP | 99.32 | | | | | | |
| PB2 | N/A | 223 | 0.1 | yes | 1 | 0.06 | 99.15 | ELVRKTRFLPV | 99.15 | | | | | | |
| PB2 | N/A | 224 | 0.28 | yes | 4 | 0.1 | 99.18 | LVRKTRFLPVA | 99.18 | LVRKTRFLPVT | 1.25 | LVRKTRFLPV | 0.57 | | |
| PB2 | N/A | 225 | 0.28 | yes | 4 | 0.1 | 99.22 | VRKTRFLPVAG | 99.22 | VRKTRFLPVTG | 1.25 | VRKTRFLPVVG | 0.57 | | |
| PB2 | N/A | 226 | 0.27 | yes | 4 | 0.1 | 99.36 | RKTRFLPVAGG | 99.36 | RKTRFLPVTGG | 1.25 | RKTRFLPVWGG | 0.57 | | |
| PB2 | N/A | 227 | 0.27 | yes | 5 | 0.11 | 99.3 | KTRFLPVAGGT | 99.36 | KTRFLPVTGGT | 1.25 | KTRFLPVGGT | 0.57 | | |
| PB2 | N/A | 228 | 1.07 | yes | 4 | 0.11 | 99.05 | TRFLPVAGGTS | 72 | TRFLPVTGGTS | 25.23 | TRFLPVSGGTS | 1.21 | TRFLPVWGGTS | 0.38 |
| PB2 | N/A | 229 | 1.06 | yes | 5 | 0.11 | 99.09 | RFLPVAGGTSS | 72.08 | RFLPVTGGTSS | 25.22 | RFLPVSGGTSS | 1.21 | | 0.38 |
| PB2 | N/A | 235 | 1.56 | yes | 5 | 0.1 | 99.12 | GGTSYIEVL | 56.41 | GGTSSYIEVL | 24.99 | GGTGSYIEVL | 16.9 | GGTGSYIEVL | 0.55 |
| PB2 | N/A | 236 | 1.56 | yes | 3 | 0.11 | 99.08 | GTSYIEVLH | 56.43 | GTSSYIEVLH | 25 | GTGSYIEVLH | 16.9 | GTGSYIEVLH | 0.55 |
| PB2 | N/A | 237 | 1.56 | yes | 3 | 0.11 | 99.14 | TSYIEVLHL | 56.41 | TSSYIEVLHL | 25.02 | TSSYIEVLH | 16.9 | TSSYIEVLHT | 0.55 |
| PB2 | N/A | 238 | 0.81 | yes | 3 | 0.12 | 99.16 | SYIEVLHLT | 81.45 | SSYIEVLHLT | 17.15 | SSYIEVLHLT | 0.55 | SSMYIEVLHT | 0.55 |
| PB2 | N/A | 239 | 0.8 | yes | 3 | 0.12 | 99.18 | YIEVLHLTQ | 81.47 | YYIEVLHLTQ | 17.16 | YIEVLHLT | 0.55 | | |
| PB2 | N/A | 240 | 0.26 | yes | 2 | 0.12 | 99.4 | IEVLHLTQG | 96.94 | YEVLHLTOG | 1.92 | IEVLHLTQG | 0.54 | | |
| PB2 | N/A | 241 | 0.26 | yes | 2 | 0.12 | 99.39 | EVLHLTQGA | 96.93 | YEVLHLTQGT | 1.92 | IEVLHLTQGT | | | |
| PB2 | N/A | 242 | 0.21 | yes | 2 | 0.12 | 99.42 | VLHLTQGAC | 97.5 | IEVLHLTQGAC | 1.92 | IEVLHLTQGTC | | | |
| PB2 | N/A | 243 | 0.19 | yes | 2 | 0.12 | 99.39 | LHLTQGACW | 97.47 | VLHLTQGACW | 1.93 | | | | |
| PB2 | N/A | 244 | 0.28 | yes | 2 | 0.12 | 99.64 | HLTQGACWE | 97.71 | LHLTQGACWE | 1.91 | HLTQGTCWEQL | 0.84 | | |
| PB2 | N/A | 245 | 0.28 | yes | 3 | 0.12 | 99.42 | LTQGACWEQ | 96.68 | HLTQGACWEQ | 1.91 | LTQGTCWEQLY | 0.84 | | |
| PB2 | N/A | 246 | 0.28 | yes | 3 | 0.12 | 99.44 | TQGACWEQM | 96.69 | LTQGACWEQM | 1.91 | TQGTCWEQLYT | 0.84 | | |
| PB2 | N/A | 247 | 0.3 | yes | 3 | 0.12 | 99.22 | QGACWEQMY | 96.57 | TQGACWEQMY | 1.91 | QGTCWEQLYTP | 0.84 | | |
| PB2 | N/A | 248 | 0.31 | yes | 3 | 0.12 | 99.31 | GACWEQMYT | 96.47 | QGACWEQMYT | 1.91 | GTCWEQLYTPG | 0.84 | | |
| PB2 | N/A | 249 | 0.31 | yes | 3 | 0.12 | 99.19 | ACWEQMYTP | 96.44 | GACWEQMYTP | 1.91 | TCWEQLYTPGG | 0.84 | | |
| PB2 | N/A | 250 | 0.32 | yes | 3 | 0.13 | 99.14 | CWEQMYTPG | 96.4 | ACWEQMYTPG | 1.91 | CWEQLYTPGGE | 6.01 | CWEQMYNPGGE | 0.55 |
| PB2 | N/A | 251 | 0.68 | yes | 5 | 0.12 | 99.1 | WEQMYTPGG | 89.77 | CWEQMYTPGG | 6.01 | WEQLYTPGGEV | 2.68 | CWEQMYNPGGE | 0.55 |
| PB2 | N/A | 252 | 0.68 | yes | 5 | 0.12 | 99.06 | EQMYTPGGE | 89.73 | WEQMYTPGGE | 6.01 | WEQMYTPGGK | 2.68 | WEQMYNPGGEV | 0.55 |
| PB2 | N/A | 253 | 0.56 | yes | 4 | 0.12 | 99.15 | NDDVDQSLIIA | 91.34 | NDDIDQSLIIA | 6.65 | NDEVDQSLIIA | 0.92 | NDEVDQSLIIA | 0.24 |
| PB2 | N/A | 266 | 0.56 | yes | 4 | 0.12 | 99.13 | DDVDQSLIIAA | 91.31 | DDIDQSLIIAA | 6.67 | DEVDQSLIIAA | 0.92 | DEVDQSLIIAA | 0.24 |
| PB2 | N/A | 267 | 0.56 | yes | 4 | 0.12 | 99.15 | DVDQSLIIAAR | 91.35 | DIDQSLIIAAR | 6.67 | DVDQSLVIAAR | 0.92 | | |
| PB2 | N/A | 268 | 0.68 | yes | 5 | 0.12 | 89.68 | VDQSLIIAARN | 89.68 | IDQSLIIAARN | 6.41 | VDQSLVIAARN | 0.92 | IDQSLIIAARS | 0.25 |
| PB2 | N/A | 269 | 0.32 | yes | 4 | 0.12 | 99.29 | DQSLIIAARNI | 96.18 | DQSLIIAARSI | 2.18 | DQSLVIAARNI | 1.91 | | 0.92 |
| PB2 | N/A | 270 | 0.32 | yes | 3 | 0.12 | 99.24 | QSLIIAARNIV | 96.13 | QSLIIAARSIV | 2.19 | QSLVIAARNIV | 0.92 | | |

Fig. 75-289

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 271 | 0.31 | yes | 3 | 0.12 | 99.36 | SLIIAARNIVR | 96.25 | SLIIAARSIVR | 2.19 | | | | |
| PB2 | N/A | 272 | 0.31 | yes | 3 | 0.12 | 99.36 | LIIAARNIVRR | 96.25 | LIIAARSIVRR | 2.19 | | | | |
| PB2 | N/A | 273 | 0.32 | yes | 3 | 0.12 | 99.26 | IIAARNIVRRA | 96.15 | IIAARSIVRRA | 2.19 | | | | |
| PB2 | N/A | 274 | 1.28 | yes | 4 | 0.12 | 99.09 | IAARNIVRRAA | 51.89 | IAARSIVRRAT | 44.4 | | | | |
| PB2 | N/A | 275 | 1.27 | yes | 4 | 0.12 | 99.23 | AARNIVRRAAV | 51.92 | AARSIVRRATV | 44.49 | IAARNIVRRAI | 0.92 | | |
| PB2 | N/A | 276 | 1.27 | yes | 5 | 0.12 | 99.23 | ARNIVRRAAVS | 51.92 | ARSIVRRATVS | 44.5 | AARNIVRRAIV | 0.92 | | |
| PB2 | N/A | 277 | 1.29 | yes | 5 | 0.12 | 99.17 | RNIVRRAAVSA | 51.87 | RSIVRRATVSA | 44.32 | ARNIVRRAIVS | 0.92 | | |
| PB2 | N/A | 278 | 1.29 | yes | 5 | 0.12 | 99.16 | NIVRRAAVSAD | 51.85 | SIVRRATVSAD | 44.32 | RNIVRRAIVSA

Fig. 75-290

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 330 | 0.23 | yes | 3 | 0.14 | 99.16 | LRISSSFSF

Fig. 75-291

| Protein | Sub-type | Start Pos | Block Entropy | Gaps <10% | # to cover 99% | gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 448 | 0.33 | yes | 5 | 0.08 | 99.03 | LRHFQKDAKVL | 96.54 | LRHFQKDAKIL | 1.37 | LRHFQKDARVL | | LRHFQKN

Fig. 75-292

| Protein | Sub-type | Start Pos | Block Entropy | Gaps < 10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 589 | 0.29 | yes | 3 | 0.09 | 99.51 | EFEP

Fig. 75-293

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 700 | 0.11 | yes | 1 | 0.09 | 99.08 | GVESAVLRGFL | 99.08 | | | | | | |
| PB2 | N/A | 701 | 0.11 | yes | 1 | 0.09 | 99.06 | VESAVLRGFLI | 99.06 | | | | | | |
|

Fig. 75-294

| Protein | Sub-type | Start Pos | Block Entropy | Gaps <10% | # to cover 99% | Gap % | Coverage | Peptides included | Freq | Peptides included | Freq | Peptides included | Freq | Peptides included | Freq |
|---|---|---|---|---|---|---|---|---|---|---|---|---|---|---|---|
| PB2 | N/A | 759 | 0.06 | yes | 1 | 2.07 | 99.59 | ILTDSQTATKR | 99.59 | LTDSQTATKRL | 98.92 | | | | |
| PB2 | N/A | 760 | 0.12 | yes | 2 | 2.49 | 99.56 | LTDSQTATKRI | 99.56 | TDSQTATKRLR | 98.82 | | | | |
| PB2 | N/A | 761 | 0.13 | yes | 2 | 2.63 | 99.46 | TDSQTATKRIR | 99.46 | DSQTATKRLRM | 98.4 | | | | |
| PB2 | N/A | 762 | 0.18 | yes | 2 | 4.35 | 99.05 | DSQTATKRIRM | 99.05 | SQTATKRLRMA | 98.33 | SQTATKRIRLA | 0.64 | | |
| PB2 | N/A | 763 | 0.19 | yes | 3 | 4.53 | 99.13 | SQTATKRIRMA | 99.13 | QTATKRLRMAI | 97.91 | QTATKRIRMAT | 0.64 | | |
| PB2 | N/A | 764 | 0.23 | yes | 4 | 5.14 | 99.08 | QTATKRIRMAI | 99.08 | TKRIRMATNEC | 42.86 | TKRIRMAINLV | 0.65 | QTATKRIRLAI | 0.14 | OTATKRIRLAI | 0.14 |
| PB2 | N/A | 767 | 2.13 | no | 5 | 99.95 | 100 | TKRIRMAINQC | 50 | KRIRMAINWGR | 50 | | 0.65 | TKRIRMAINWG | 0.37 | |
| PB2 | N/A | 768 | — | no | 2 | 99.99 | 100 | KRIRMATNECR | 50 | RIRMAINWGRI | 50 | | 0.66 | TKRIRMAINYS | 14.3 | TKRIRMAINYS | 14.29 |
| PB2 | N/A | 769 | — | no | 2 | 99.99 | 100 | RIRMATNECRI | 50 | | 50 | | 14.29 | | | |
| PB2 | N/A | 770 | — | no | 2 | 99.99 | 100 | IRMAINWGRIV | 50 | | 50 | | | | | |

FIG. 76-1

>Protein:HA|Subtype:ALL|Blocksize:8|String:1
KQGKTKATKMxxxxIFIFILLTHxxxxxxxxSQITNGTTGNPIICxxxxxxxxxxxxxxxxxxxxxxxxxxxxxxGVIPLTTTPTKSYFANLKGxxxxxxxxxxx
xxxxxxxxxxxxxxxxxxxxxxxxxxxxxxxxxxxxxxxxxxxxxxxxxxxxxxxxxxxxxxIMHDRTKIRxxxxxxxxxxxxxxxxxxxxxxxxxxxxxxxxxxxxxxxxxxxxxxxxxxxxxxxxxxx
xxxxxxxEKENSYPMxxLTVEVPYVxxxxxxxxxxxxxxxxxxxxxxxxxxxxxxxxxxxxxxxxxxxxxxxGVTTHYVSxxxxxxxxxxxDEGLPQSGRIVVxxxxxxxxxxx
xxxxxxxxxxxxxxxxxxxxxxxAPSGIEYNGKSLGIQxxEDIPIGNCxxxPSVKLPMGAIGAIDSSMxxxxxxxGEHAKAIGxxxxxxxxxxxxxxxxxxxxxxxl
PIGERGLRRKKRGLFxxTHKQLTHHMRKKRGLFGxxRMTRGLFGAIGLFGAIAGLFGAIAGFIEGGWxxxxxxGRLVRFRHQxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxLPTFDSLNITAASLNDxxxxxxxxxxxxxxxxxxxxxxxxxxxVTTRQASPSCLVVNHGSLVLSxxxxxxxxxxxxxxxxxxLCSVEYASKTRISx
KFVSSDCSxx
>Protein:HA|Subtype:ALL|Blocksize:8|String:2
xxSKSRGYKMxxxxIFIFLLLTHxxxxxxxxxxxxxxxxxxxxNNNNNTATxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
EKENSYPKxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxAPSGVEYNGKSLxxxxxEDIPIGSCxxxxxxxxxxxxYGGLNKSKxxxxxxxxxxxxxxxxxxxxxxxxxxxxxxxxxxxxxxxxxxxPAKLLKERGFFKKRGL
FGAHKQLTHHxxxxxxxxxxxRETRGLFGARGLFGAIAxIFGAIAGFIENGWxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxEFPSTGNHGSLVLxxxxxxxxxxxxxxxxxxxxxxxxxxxxxxxxxxxxxxxKICESRLRxx
>Protein:HA|Subtype:ALL|Blocksize:8|String:3
xxMKSRGYKMxxxxIFNFILLTHxxxxxxxxxxxxxxxxxxxxxxxxNNSTATLCxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
DNNKNATNxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxNNNKGAVFxxxxxxxxxEDIPIENCxxxxxxxxxxxxxxxxxxxxxTSLTSLPFQNxxxxxxxxxxxxxxxxxxxxxxxxxxxxxxxxxxxxxxREREGGRRRKRGLFx
xIHKQLTHHxxxxxxxxxxxRKTRGLFGARGIFGAIAGxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxRFVNSDCSKx
>Protein:HA|Subtype:ALL|Blocksize:8|String:4
xxxxxxxxxxxxxxxxxxRFSYVFCLxxxxxxxxxxxxxxxxxxSDNADKICxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxRRKRGLFGxxxxxxxxxxxxxxxx
xxxxxxQMTRGLFGRRGLFGAIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxDFRDMRKNTL
>Protein:HA|Subtype:ALL|Blocksize:8|String:5

FIG. 76-2 xxxxxxxxxxxxxxxxVLSCIFCLxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxKRKKRGLFxxxxxxxxxxxxxxxxxxxxxxxxxxx
xxxxPRGLFGAIxxxxxxxxxxxxxxxxxxxxxxxxxxxxxxxxxxxxxxxxxxxxxxxxxxxxxxxxxxxxxx

FIG. 76-4 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:NA|Subtype:ALL|Blocksize:8|String:1
IGLREQKQEFKMNPNKKIIIAIGSVxxxxxxxxxxxxxxxxxxxxxxxxxxxxxxxxxxxxxxxxxxxVPLVPCEPIIxxxxxxxxxxxxxxxxxxxxxxx
xxxxxxxxxxxxxxxxxxxxxxxxxxxxxxxxxxxxxxxxxxxxxxxxxILRTQES

FIG. 76-5 xxxxxAKAGVKMNPNQKxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxRTQESSCVCxxxxxxxxxxxxxxxx
xxxxxxxxxxxxxxxxxxxxxxxxxxxxxxx

FIG. 76-6 xxxxxxxxxxxxxxxxxxxxxxxxxxxxxxxxxxxxxxxxxxxxxxxxxxxxxxxxxxxxxxxxxxxxxxxxxxIEECSCYGxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxx
>Protein:NA|Subtype:N1|Blocksize:8|String:1
IGLREQKQE

FIG. 76-7

DNGAVAVVKYNGIITxxxxxxxxxxxxxxxxxNGFCFTVMTDGPNxxxxxxxxxxxxxxxxxxxxxxxxxxAPNYYYEECSCxxxxxxxxxxxx
xxxRPWISFNQxxxYRIGYICSGVLGDNPRxxxxxxxxxxxxxxxxxGVKGFSYRYGDGVWIGRTxxxxxxxIWDPNGWAxxxxxxxxxxxxx
xxxxxxxxxxxxxxxNCIKPCFWVELxxxxxxxxxxxxxxxxxxxxxxxxxxxxxxxxxxxxWSWPDD

FIG. 76-8 xxxxxxxxxxxxxxxxxxxxxxxxxxxxxxxxxxxxxxxxxxxxxxxxxxxxxxxxxxxxxxxxxxxxxxxxxxxxxxxxxxxxGFAPF
TKDNSIRLSASGxVWVTREPYVSCSxxxxxxxxxxxxxxxxxxxxxPYRTLLMSExxVPFHLGTRQVCIAWSxSSCHDGNAWLHVCxx
xxxNATAS

FIG. 76-9

>Protein:NA|Subtype:N2|Blocksize:8

FIG. 76-10 xxxxxxxxxxxxxxxxALIIGVGNLAFNAVIHEKxxxxxxxxxxxxxxxxxxxxxxxxxxxxxxxxxxxxxxxxxxxxxxxxxxxxxxxxxxxNAIRLG
ETxxVIITREPYVSCDYxHCWSFALAQGALVGTKHSNGTIEDRTPYRSLIKFPxxAAPVLGNYxEMCVAWSSxxxDGKEWMHICxxxxxxx
xxxxxxxxxxxxxxxxxxxxxxxxxxxxxxxxxxxxxxxxxxxxKNILRTQExxxxxxxxxxxxITDGPAANNADYRVYWIRxxx
xxxxxxxxKVQHLEECSxxxxxDIYCVCRDNxxxSNRPWVRINNETIVETGYVCSxxHSDTPRPSDPSxxxxxxxxxxEPGVKGFGxxxGSDV
WLGRTxxxxWRSGFEIIRVxxxxxxxxxxTQTLVANNDWxGYSGSFSVxxxxxxxxxxYIELIRGKPNxxxxxSWTSNSIIxxxxxNEPGSGN
GPDGSKIGFMPx
>Protein:NA|Subtype:N3|Blocksize:8|String:5
xxxxxxxxxxxxxxxxxxxxxALLVGIGNLVFNTVIHERxxxxxxxxxxxxxxxxxxxxxxxxxxxxxxxxxxxxxxxxxxxxxxxxxxxxxxxxxx
xxxAIVTREPYVSCDSxVCWSFALAxxxxxxxxNGTIRDRTPYRSLIQFPMGxAPVLGNCKEMCIAWSSxxxxxxxxxxxxxxxxxxxxxxxx
xxxxxxxxxxxxxxxxxxxxxxxxxxxxxxxxxxxxxxxxxxxxxxxxxNDILRTQExxxxxxxxxxVTDDPAANSADHRIYWIKxxxxxxxxx
xxxKIRHLEECSCxxxxxxxxxxxxNRPWMRISNETILETGYVCGKxHSDTPRPTDPSxxxxxxxxxRPGVKGFGxxSNDVWLGRxxx
xxxxxxxIKVAEGWIxxxxxxxxxxxxxxxxxxELIRGRLNxxxxxxxxxxxxxxxxxxxxxNEPGSGSWPDGPKIGxxxx
>Protein:NA|Subtype:N3|Blocksize:8|String:6
xxxxxxxxxxxxxxxxxxxxxxGIGNLAFNxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxLSQGALLGxxxxxxxxxKDRAPYRSLIRxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxIKVTDGWIxxxxxxxxxxxxxxxxxxxxxxxxx
xxxxxxxxxxxxxxxxxxxxxxxxxxxxxxxxxxxxxxxxxxxSGNWPDGAxxxxxxx
>Protein:NA|Subtype:N3|Blocksize:8|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxSGNWPDGPxxxxxxxx
>Protein:NA|Subtype:N3|Blocksize:8|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxDGSNIKFMPx
>Protein:NA|Subtype:N4|Blocksize:8|String:1
MNPNQKIITIGSISxxLTTVGLLLQITSLCSIWFSHYNQVTQTxxxxCSNNTTNYYNETFVNVTNVQNNYTTVxxxxxxxxxxxxLCPIRG
WAPLSKDNGIRIGSRGEVFVIREPFISCSISECRTFFLTQGALLNDKHSNGTVKDRSPFRTLMSCPIGVAPSPSNSRFESVAWSATACSDG
PGWLTLGITGPDATAVAVLKYNGIITDTLKSWKGNIMRTQESECVCQDEFCYTLITDGPSDAQAFYKILRIKGKIVxxDVDATGFHFE
ECSCYPSGTDIECVCRDNWRGSNRPWIRFNSDLDYQIGYVCSGIFGDNPRPVDGTGSCxSPVNNGKGRYGVKGFSFRYGDGVWIGRT

FIG. 76-11

KSLESRSGFEMVWDANGWVSTDKDSNGVQDIIDNDNWSGYSGSFSIRGETTGRNCTVPCFWVEMIRGQPKEKTIWTSGSSIAFCGVN
SDTTGWSWPDGALLPFDIDK
>Protein:NA|Subtype:N4|Blocksize:8|String:2
MNPNQSIITIGSVSxxxLTTIGLLLQITxxxxxWFSHYNQMTQAxxxxCSNDTINYYNETFVNITNVQNDYTTVxxxxxxxxxxxxxLCPVKG
WAPLSKxxxxxxxxxVFVIREPCISCSINECRTFFLxxxxxxxxxxxxxRTLMSCPMGVAPSPSxxxxxxxxxATACSDGSGWLTLGIT
GPDSTAVAVIKYNGIITDTFKSWKGNIxxxxxxxxDEFCYTLMTDGPSDAQAFYKLLKIKKGKIVxxxDVDATGYHFEECSCYPSGENV
ECVCRDNxQ

FIG. 76-12 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxVNSDTTCWS
WPxxxxxxxxxx >Protein:NA|Subtype:N5|Blocksize:8|String:1

FIG. 76-13

```
xxxxxxxxxxxxxxxxDTPRFQDSxxxxxxxSAVGGSGTxxxxxxxxxxxxxxxxxxxNISSRSGFEVLLIENGxxxxxxxxxxEVLNNRNWSG
YSGAFTIPVTMTxxxxxxxxxxxxxxxxxxPEEKTSIWTSSxxxxxxxxSSEVPEWSWDDGAxxxxxxxxx
>Protein:NA|Subtype:N5|Blocksize:8|String:6

FIG. 76-14 xxxxQKIICISTTGMTLSVVNLLIGLVNLGLNIGxxxxxxxxxxxxxxxxxxxxxxxxxxxxxxxxxxxxxxxxxxxxxxxxxxxxxxxxxxLTKSLCEVNSWHIFSK
DNAIRIGEGAHILVTRxxxxxxxxxxxxxxxRHANGTINDRSPFRAxISWEMGLAPSPYNxxIECVGWSSTSCHDGRSRMSICMSG
PNDNASAVVWxxxxxIEIPSWAGNVxxxxxECVCHNGVCPVVMTDGPANDRAxxxxxxxxxxxxxxxxGKAQHIEECxxxxxxxxxxxx
xxxxxNRPVITID

FIG. 76-15 xxxKATCVCRDNxxGANRPVIKIDMxxxxHTSRYICTGxLTDTSRPKDKxxGECFNPITGSPGVPGVKGFGFLNESNTWLGRTISPKLRSGF
EMLRIPNAETDPxxxxxERQEIVSNxNLS

FIG. 76-16 xxxxxxxxxxxxxxxxxxxxxxxxxxxxxxxxxxxxxxxxxxxxxREYNETVRVExxxxxxxxxxxxxxxxxxxxxxxxxxxxxxxxx
xxxxxxxxxxxxxxxxxxxxxxxxxxxxxxxxxxxxxxxxxxxxxxKGFAPFSKDNGIRIGSRGHVFVIREPFVSCSPxECRTFFLTQGSLLN
DKHSNGTVKDRSPYRTLMSVEIGQSPNVYQARFEAVAWSATACHDGKKWMTIGVTGPDxxxxxxxxxxxxxSWAGDILRTQESSC
TCIQGECYWV

FIG. 76-17 xxxxxxxxxxxxxxxxxxxxxxxxxxxxxxxxxxxxxxxxxxxxxxxxxxxxxxxxxxxxxxxxxxxxxxxxxxxxxxxx
xxxxxxxxxIGLSPNVYQAxxxxxxxxxxxxxxxxxWMIIGVTGxxxxxxxxxxxxxxxxxxxAEDILRTQxxxxxxxxxxxxxxxxxxxxxxxxxxxxxxx
SxxxxxxxxxxxxxxxxxxxxxxxxxxxxxxxxxxxxxxxxxxxxxxxxxxxxxxxxxxxxxxxxxxxxxxxxxxxxxxxDKHSNGTMKDR
xxxxxxxxxxxxxxxxxxxxxxxxxxxxxxxxxxxxxxxxxxxxxxxxxxxxxxIVMCGVEHxxxxxxxxGAILPFDFDKISQ >Protein:NA|Subtype:N8|Blocksize:8

FIG. 76-18 xxNNNASTVIWYxKRPVTEINxxxxxxxxxxECVCQNGVCPVxxxxxxTGPADTRVYYFREGKIIKWEPLxxxxxxxEECSCYGKxxxxxxxxxx
xxxxxxxxxxxxxTMTHTSQYxxxxxxxNPRPNDPVxxxxxPYPGNNBNGVK

FIG. 76-19

>Protein:HA|Subtype:H10|Blocksize:8|String:2
xxxxxxxxxxxxxxxGIDKICLGHHAVPNGTTVKTLTxxQEEVTNATETVENxxxxxxxxxxxxxKDLGSCHPIGMxxxxxxxxxHLAGTWDTIIERx
xxxAYCYPGTTINEEALRQKIMESGEIDKxxxxxxxxxxxxxxxxxxxxxxxxxxSFYTELKWLVSGxKGQSFPQTTNTYRNTDTxxxxxVWGIHH
PSNTxEKNDLYGAQSLSISVESSTYQNNFVPVIGARPQVNGQRGRIDFHWAxxRPGDNITFLHNGGLIAPDRVSKLxGKGIGIQSxxxxxxN
CESKCFWRGGSINTRLPFQNLSxxxxGQCPKYVSKRSLLLATGMRNVPEIxQERGLFGAIxxxxxNGWEGMIDGWYGFRHQNAQGIGQA
ADYKSTQTAIVQITGKLNxxxxxxxxxxESIESEFNEIEHQIGxxxxxxxxxxITYIWTYQAELLIAxxNQHTIDMGDSEMLNLYDRVRKQLRQN
AEEDGRGCFEIYHACDxSCMESIRNNTYNHTQYREESLLNRLSINPVTLSSGYKDIILWFSFGASSFVLLAVxxxxxFFCLRNGNMRxxxxx
xxxxxxx
>Protein:HA|Subtype:H10|Blocksize:8|String:3
xxxxxxxxxxxxxxxGLDRICLGHHAVANGTVVKTLTxxHEEVTNATxxxxxxxxxxxxxxxxxxKDLDNCHPIGMxxxxxxxxxHLTGKWDTLIER
ExxxAHCYPGATVNEGALRQKIMESGGVNKxxxxxxxxxxxxxxxxxxxxxxxxxxxSFYGELKWLISKxKGQNFPRTTNTYRNTDPxxxxxMWGI
HHPSSAxEKNELYGTQPLSISVGSSTYHNSFVPVVGARPKVNGQSGRIEFHWTxxQPGDSITFSHNGGRIAPSRVTKLxGKGLGIQSxxxxx
xGCESKCFWKGGTINTELPFQNLSxxxxGQCPKYVKKKSLMLATGMRNVPETxxGRGLFGAKAGFIENGxxxxxxxxxxxxxNDQGTGQA
ADYESTQAAINQITGKLNxxxxxxxxxxxxIESEFSETEHQIGNVxxxxxxxxxxxxTYNAELLVxxxxQHTIEMTDSEMLxxxxxxxxxxxxxxxxxxx
GCFEIYHTCDxNCMESIRDNTYDHSQYREEALLNRLSINSVKLSSGYKNxxxxxSFGASCFILLAVxxxxxFLCLKNGNMQxxxxxxxxxxxx
>Protein:HA|Subtype:H10|Blocksize:8|String:4
xxxxxxxxxxxxxxxSLDKICLGHHAVTNGTFVKTLTxxKEKVTNATxxxxxxxxxxxxxxxxxxRDLGNCHPVGMxxxxxxxxxYLTGTWDTLIER
GxxxAYCYPGSTVSEEALRQxxMESGGISKxxxxxxxxxxxxxxxxxxxxxxxxxxSFYAELRWLVSKxKEQNFPQTANTYRNTDxxxxxxTWGIH
HPSSIxERNDLYGTQSLSISIGSSTYQNSFVPVVRARPQVNGQSGRINFHWTxxQPGDHITFSHNGGLIAPNRVSKLxGRGLGVQSxxxxxx
SCESKCFWREGSINTxxxxxxxxxxxxQCPKYVNQRSLMLATGxxxxxxxxxxxxxxxxxxxxxxxxxxxxxxxxxxxxxxxAQGTGLAADYKSTQKTI
DQVTGKLNRLxxxxxxxxxxxxSEFNEIEYQIGNVINxxxxxxxxxxxxQEELLVAMxxxHTIDLADSEMxxxxxxxxxxxxxxxxxxxxGCFEIYHNCD
xSCMERIRNNTYDHSQxxEEAPLNRLNINSVKLFSGYKDIxxxxxxxxSCFVLLAAxxxxxFFCLKDGNMRxxxxxxxxxxxx
>Protein:HA|Subtype:H10|Blocksize:8|String:5
xxxxxxxxxxxxxxxxxxxxxxxxxxxxxxxxxxxxxxxMEEVTNATxxxxxxxxxxxxxxxxxxxxxGNCHPIGIxxxxxxxxxHLTGTWNTLIERDxxxAYCY
PGVTINEGALRQxxMESGGINKxxxxxxxxxxxxxxxxxxxxSFYSELKWxxxxxKGRNFPQTTxxxxxxxxxxxxLWGIHHPSxxxEKNNL
YGTxxxxxxVGSSTYQSNFVPVVRARPLVNGQRGRIVFHWTxxQPGDNIIFSHNxxxIAPSRVGKxxGRDLGIQSxxxxxxxxKSKCFWRGGSI
ITELPFQNxxxxxxxQCPKYVSQGSLLLATGxxxxxxxxxxxxxxxxxxxxxxxxxxxxxxxxYKSTQAAVDQITGKLxxxxxxxxxx
xxxxxxxxSEIEHQISNxxxxxxxxxxxxxxxxxxxxxxxxxxxxxxMADSTMLNLxxxxxxxxxxxxxxxxxGCFEIYHVxxxDCMESIRNNTYDHAQYRE
EALLNRINxNPVKLSSSYKDIIxxxxxxxSCFVLLAIxxxxxxFCLKNGNTxxxxxxxxxxxxx
>Protein:HA|Subtype:H10|Blocksize:8|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxGKWDTPIERxxxxxxxxxxxxxxx
xxxxxxxxxxxxxxxxxxxxxxxxxxxxxxxxxxxxxxxxxxFYAEVKWLVSKxxGQNFPQTAxxxxxxxxxxxxxxxxxxxxxxxxxxxxxxxxxxxxxxxxxxxxxxxxxQ
NNFVPVMGARPQVNGQSGRIVFHWxxxxPGHNITFSHxxxxxAPSRVSKFxxxxxxxxxxxxxxxxxxxxxFWKGGSIKTKLPFQNxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-20

```
xxxxxxxxxxxxxxxxxxxxxxxxxxxxxxxxxxxxxxxxxxxxxxWFEIYHTCxxxxxxxNNTYDHSHYREEALLxxxxNPVELSSGxxxxxxxxxxxxxxxxxxxxx
xxxxxxxxxxxxxxxxxxxxxxxxx
>Protein:HA|Subtype:H10|Blocksize:8|String:7
xxxxxxxxxxxxxxxxxxxxxxxxxxxxxxx

FIG. 76-21

EEDGRGCFEIYHACDDSCMESIRNNTYDHAQYREEALLNRLSINPVKLSSGYKDIILWFSFGASCFILLAVIVGLVFFCLRNGNMRCTxx
x
>Protein:HA|Subtype:H10N7|Blocksize:8|String:3
xxxxxxxxxxxxxxxGLDRICLGHHAVANGTIVKTLTNEQEEVTNATETVESTxxxxxxxxxxxHKDLGNCHPVGMLIGTPVCDPHLTGTWDT
LIERGSSVAYCYPGSTVNEEALxxxxxESGGISKMSTxFAYGSSINSAGDTxxxxxxGKNSFYAELKWLVSKTKGQNFPRTTNTYRNTDPxE
HLIMWGIHHPSSTKEKNDLYGTQPLSISVGSSIYQNSFVPVVGAxxxxxxxxGRIDFHWALVQPGDNITFSDNGGLIAPDRVSxxxGKGLGI
QSGSxxDNSCESKCFWKGGSIKTKLPFQNxxxxxxxQCPKYVNQKSLMLATGMRNVPETxxxxxxFGAKAGFIENxxxxxxxxxxxxxxxxxxxx
xxADYKSTQKTIDQVTGKxxxxxxxxxxxxxxIESEFSETEHQIGNVxxxxxxxxxxxxxYQAELLIAxxxxxxIDLADSEMLNLYDRxxxxxxxxxxxx
xxGCFEIYHTCDNNCMESIRDNTYDHSQYREEALLNRLNINSVKLSSGYxxxxxxxxxxxSCFVLLAAIMGLFFFCLKNGxxxxxxxx
>Protein:HA|Subtype:H10N7|Blocksize:8|String:4
xxxxxxxxxxxxxxxSLDKICLGHHAIPNGTIIKTLTNEKEKVTNATETVESRxxxxxxxxxxxYKDLDNCHPIGMIIGAPACDLHLTGIWDTLIE
RENSIAHCYPGATINEEALRQxxxESGGIDKVSTxFTYESSINPAGTTxxxxxxGRNSFYAELKWLVSKNKGQSFPQTTNTxxxxxxxEHLIT
WGIHHPSSTKEKNELYGTQSLSISIGSSTYQNSFVPxxxxxxxxxxxxxxxxxxxxTVQPGDNITFLHNGGLIAPSRVTKLKGRGLGIQSDAxxxx
xxxxxxxxRGGSINTRLPFQNLSxxxxxQCPKYVSQRSLMLATGxxxxxxxxxxxxxxxxxxxxxxxxxxxxxxxxxxxxxxxxxxxxxxxxxxxxYKSTQAAVDQ
ITGKLxxxxxxxxxxxxxxxSEFNEIEYQIGNVINxxxxxxxxxxxxxxxxxxxxxxxxxxxxxxxxEMLNLYEGxxxxxxxxxxxxxxGCFEIYHNCDDNCME
RIRNNTYDHSQxxxxxxxxRLNINPVTLSSGYKDxxxxxxxxxSCFVLLAIVMGLVFFCxxxxxxxxxxxx
>Protein:HA|Subtype:H10N7|Blocksize:8|String:5
xxxxxxxxxxxxxxxxxxxxxLGHHAVTNGTIVKTLTNEREEVTNATxxxxxxxxxxxxxxxxxHRDLGNCHPIGMLIGAPSCDLHLTGKWDTLIER
DNAIAHCYPGATVNEGALRQKIMxSGGIDKIGTxFTYGSSITSAGTTxxxxxxxENSFYAELKWLVSKDKGRNFPQTTNxxxxxxxxEHLVM
WGIHxxSSTQERNDLYGTQxxxxxVGSSTYHNSFVPVVxxxxxxxxxxxxxxxxxxIVRPGDNITFxxxxxxxxPSRVSKLTGRGLGIQSEAxxxxxx
xxxxxxxxxxxxxxxxxxxxxxxxxxxxxxxxxxxGSLLLATGxxxxxxxxxxxxxxxxxxxxxxxxxxxxxxxxxxxxxxxxxxxxxxxxxxxxxxxxxTQATIDQITGKxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxFEIYHKCNDNCMESIxxxxxxxxxxxxxxxx
xxxxxxxxRLSSGYKDxxxxxxxxxxCFVLLAVVMGLxxxxxxxxxxxxxxxx
>Protein:HA|Subtype:H10N7|Blocksize:8|String:6
xxxxxxxxxxxxxxxxxxxxxxxxxxxxANGTVVKTLTNEHEEVTNAxxxxxxxxxxxxxxxxxxxxxxxxxxxxxxxxxxxxxxxxxxxLHLTGMWDTLIExxxxIAYC
YPGSxxxxxxxxxxxxxxxxxxxxxxxxxxGASINSAGATxxxxxxxxxxxxxxxxxxxxxxxxxxxxxxxxxxxxxxxxxxxxxxxIIMWGIHHxxSTQEKNALYGTQS
LxxxxxxxxxxxxxxxxxxxxxxxxxxxxxxxxxxxxxxIQPGDNITxxxxxxxxxPSRVSKLIGxGLGIQSGVxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxPCMESIRNxxxxxxxxxxxxxxxxxxxxxxxxxxxxxxxxxxxxxxxxxxxxxxxxCFVLLADVM
GLxxxxxxxxxxxxxxxx
>Protein:HA|Subtype:H10N7|Blocksize:8|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxIANCYPGAxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-22 xxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxx
>Protein:HA|Subtype:H10N7|Blocksize:8|String:8
xxxxxxxxxxxxxxxxxxxxxxxxxxxxxxxxxxxxxxxxxxxxxxxxxxxxxxxxxxxxxxxxxxxxYCYPG

FIG. 76-23

>Protein:NA|Subtype:H10N7|Blocksize:8|String:5
xxxxxxxFALSGVAVAxxxxxxxxxxxxxxxxxxxxxxxxxxxxxxxxxxxxxxxxxxxxxxxxxxVNNTTVISxxxxxxxxxxxxLLNKSLCSVEGWVVIxxxxxxxxx
xxxxxxxxxxxxxxxxxCDPIGCKMYAxxxxxxxxxxxxxxxxxxxxxxxxxxxxxxxxPPIVSNSEFLCVGWSxxxxxxxxxxMIICIQGNNxxxxxTVYYNR
RPTTTIxxxxxxxxxxxxxxxxxxxxxxxxIMTDGSANxQAHTKVLYFHKGLIxKEETLKGSARHxxxCSCYGHNQKVTCxxxxxxxxNRPIIEINxx
xMKHTSQYLCxxxxxxxxxxxxxxxxxxxxxxxxxxxxxxxxxxxxxxxxxxxxxxxxxxxxxxxxPNAETDPSSxIIERQEIVDNSDWSGYSGSxxxxx
xxxSACYNPCFYxxxxxxxxxxxxxxxxxxxxxxxxxxxxxxxxxxxxxxxxxxxxxx
>Protein:NA|Subtype:H10N7|Blocksize:8|String:6
xxxxxxxxALSGMAIALSxxxxxxxxxxxxxxxxxxxxxxxxxxxxxxxxxxxxxxxxxxxxxxxxxNNTTIISKxxxxxxxxxxxKRLCKVEGWxxxxxxxxxxx
xxxxxxxxxxxxxxxxxxLGCKTYALxxxxxxxxxxxxxxxxxxxxxxxxxxxxxxxxxxxxxxxxxxxxxxxxxxxxxxxxxxxxxICVQGNNKNAxxxxxxxxxxxxxxx
xxxxxxxxxxxxxxxxxxxxxxxxMTDGPASSQAYTKILYFHKGLLIKEExxxxxxxxxxxxxCYGHSQKATxxxxxxxxxxxRPAIEIDMxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxx
>Protein:NA|Subtype:H10N7|Blocksize:8|String:7
xxxxxxxxALSGVAITxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxGSASSQAHTKVxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxx
>Protein:NA|Subtype:H10N7|Blocksize:8|String:8
xxxxxxxxxLSGVAISLSxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxQAHTKILYFHxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxx
>Protein:HA|Subtype:H11|Blocksize:8|String:1
xxxxxxxxxxxxxxQADEICIGYLSNNSTEKVDTIIESNVTVTSSVELVENEHTGSFCSIDGKAPISLGDCSFAGWILGNPMCDDLIGKTSWSY
IVEKPNPTNGICYPGTLExEEELRLKFxxxxxxxxxxxxxxxxxxxxxxxxxxxxxxxxxxxxxSFFRNMVWLIHQSGTYPVIxRTFNNTKGRDVLxxxx
xxxxxxxxxxxDLYKKDSSYVxxxxxxxxxxxxxxxxxxxVNGQAGRMTFYWTIVxxxxxITFESNGAFLAPRYAFELVSxGNGKLFRSDLxxxxC
STKCQSEIGGINTNRSFHNVHRNTIGDCPKYVNVKSLKLATGLRNVPAIATRGLFGAIAGFIEGGWPGLINGWYGFQHRNEEGTGIAAD
KESTQKAxxxxxxxxNNIVDRMNxxxxxxxxxxxxxxIEERINQLSxxxxxxxIDIWSYNAQLLVLLENEKTLDLHDSNVRNLHEKVRRMLKDNAK
DEGNGCFTFYHKCDNECIEKVRNGTYDHKEFEEESKLNRQEIEGVKLDxxGNVYKILSIYSCIASSLVLAAIIMGFxxWACSNGSCRCTIC
I
>Protein:HA|Subtype:H11|Blocksize:8|String:2
xxxxxxxxxxxxxxKADEICIGYMSNNSTEKVDTIIENNVTVTSSIELVENGHTGSFCSLDGKAPISLGGCSFAGWLLGNPMCDELIGKTSWS
YIVEKLNPANGICYPGSLDxEEELKLKFxxxxxxxxxxxxxxxxxxxxxxxxxxxxxxxxxxxxxSFFRHMVWLIYQSGTYPVVxRTFNNIKGRDVLxx

FIG. 76-24 xxxxxxxxxxDLYKKDNSYVxxxxxxxxxxxxxxxxxINGQAGRMTFYWKIVxxxxxITFESDGAFLAPRYSFELVSxGNGKLFKSELxxxx
CSTKCQTEIGGINTTKSFHSVHRNTIGNCPKYVNVRSLKLATGPRNVPAIASRGLFGAIxxxxxxxYGFQHRNDEGTGIAADRES
TQKAxxxxxxNKIVDRMNxxxxxxxxIEERINHLSxxxxxxVDIWSYNARLLVLLExxxxDLHDSNVTNLHERVRRMLRDNAKDEGx
GCFPFYH

FIG. 76-25 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEESRINRQEIExxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H12|Blocksize:8|String:1
MEKFIILSTxxxxFA

FIG. 76-26 xEKFIVLSVxxxxxxxxxxxxxxxxxxxxxxxxxxxTDTVNTLTExxxxxxxxELVHGGINPxxxxxxxxxxxxxxxxxxxxSLEGLILSNPKCDLYxxxxxxxxxxxxxxxxx
VCYPGSIKxxxxxxxxxxxxxxxxxxxxxxxxxxxxxxxxxxxxxxxSKACNSIS

FIG. 76-27

NEGNGCFELLHKCNNTCMETIRNGTYNHAKYEEESKLKRQEIDGIKLKSDDNVYKALxxxxCIASSIVMVGLILAFIMWTCNSGNCRFN
xxx
>Protein:HA|Subtype:H13|Blocksize:8|String:4
xxxxxxxxxxxxxxxxxxxxxxxxxLSTNSSEKVDTLLENNVPVTSSIDLVETSHTGTYCSLSGxxxxxxxxCSFEGWIGGNPACxxxxxxxxxSYLIED
PTAPHGLCYxxxxxxxxxxxxxxxxxxxxxxxxLIPPASWGDLLDGxxxxxxxxKGFNSFYRNLVWLVxxxxxxxxxxxGAYNNTTGRDVLVMWGL
HHPVSxxxxxxxxxxxxPYTLVSTGSWSxxxxxxxGVRPRYNGQRSWMKIYWVLxxxxxxxTFESNGGFxxxxxxxxxxxxxKGRIFQSHIRxxxxxx
xxxxxxxxxxxxRTFQNIDRNALGDCxxxxxxxxxxxxTGLRNVPTxxxRGFFGAIAGFxxxxxxxxxxxxxxxxxQNEQGVGIAADKExxxxxxxxxxxx
xxxxxxxxxxxxxxxxGEFSQVERRINMLADxxxxxxxxxxxxxxxxxxxxxxxxxxDMHDANVKNLHEQVRKxxxxxxxxxxxxxxxxxxKCNDSCMDT
IRNGTYNHSxxxxxxxxxRQEIEGIRLKSDDGVYKALSIxxxxxSSVVLVGPILSFIMWAGSNGNCRFNxxx
>Protein:HA|Subtype:H13|Blocksize:8|String:5
xxxxxxxxxxxxxxxxxxxxxxxxxxxTNSSEKVNTLLENDVPVTSTIDLIETxxxxxxxxxxxxxxxxxxxxxxxxxxxxxxxxxxxxxxxxxxxxxxEDPSAPHR
LCYPGELxxxxxxxxxxxxxxxxxxxxxLIAPSSWGEVIDGxxxxxxxxRGTNSFYRNLVWFIxxxxxxxxxxxGVYNNTTGRxxxxxxxxxxxxxxxxxxxx
xxxxxPYTLVSTRSWSxxxxxxxxxxxxxxxxxSWMKIYWDLxxxxxxxxxxxxxxxxxxxxxxxxxxxxxxxxxxxxxxxxxxxxxxxxxxxxxxxxxxIERN
ALGNCPKYIKSxxxxxxTGLRNVPSxxxxxxxxxxxxxxxxxxxxxxxxxxxxxxxxxxQGTGIAAEKESTQKAxxxxxxxxxxxxxxxxxxxxxxxGEFNQVE
QRINxxxxxxxxxxxxxxxxxxxxxxxxxxxxxxxxxxxxVRNLHEQIKRxxxxxxxxxxxxxxxxxxxxxxxxxxxxRNGTYNHIxxxxxxxxxxxEIEGIKLESE
DNVYRALSIYSCxxxxxVLVGLILTFIMWACNSGNCRxxxxx
>Protein:HA|Subtype:H13|Blocksize:8|String:6
xxxxxxxxxxxxxxxxxxxxxxxxxxxxxxxxxxxxxxxxNGVPVTSTxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxGFYRNLVWxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxLKSEDGVYKALxxxxxxxxxxxxxxxxxxxxxxxMWACSNGNCR
FHxxx
>Protein:HA|Subtype:H14|Blocksize:8|String:1
MIALILVALALSHTAYSQITNGTTGNPIICLGHHAVENGTSVKTLTDNHVEVVSAKELVETNHTDELCPSPLKLVDGQDCDLINGALGS
PGCDRLQDTTWDVFIERPTAVDTCYPFDVPDYQSLRSILASSGSLEFIAEQFTWNGVKVDGSSSACLRGGRNSFFSRLNWLTKATNGN
YGPINVTKENTGSYVRLYLWGVHHPSSDNEQTDLYKVATGRVTVSTRSDQISIVPNIGSRPRVRNQSGRISIYWTLVNPGDSIIFNSIGN
LIAPRGHYKISKSTKSTVLKSDKRIGSCTSPCLTDKGSIQSDKPFQNVSRIAIGNCPKYVKQGSLMLATGMRNIPGKQAKGLFGAIAGFI
ENGWQGLIDGWYGFRHQNAEGTGTAADLKSTQAAIDQINGKLNRLIEKTNEKYHQIEKEFEQVEGRIQDLEKYVEDTKIDLWSYNAE
LLVALENQHTIDVTDSEMNKLFERVRRQLRENAEDQGNGCFEIFHQCDNNCIESIRNGTYDHNIYRDEAINNRIKINPVTLTMGYKDIIL
WISFSMSCFVFVALILGFVLWACQNGNIRCQICI
>Protein:HA|Subtype:H14|Blocksize:8|String:2
xxxxxxxxxGSEHTAYSQIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxRLNWLTKETNGNYGPxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-28 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H15|Blocksize:8|String:1
MNTQIIVILV

FIG. 76-29

FIEGGWPGLINGWYGFQHQNEQGTGIAADKASTQKAIDEITTKINNIIEKMNGNYDSIRGEFNQVEKRINMLADRVDDAVTDIWSYNA
KLLVLIENDRTLDLHDANVRNLHDQVKRxLKNNAIDEGDGCFNLLHKCNDSCMETIRNGTYNHEDYKEESQLKRQEIEGIKLKTEDN
VYKVLSIYSCIASSIVLVGLILAFIMWACSSGNCRFNVCI
>Protein:HA|Subtype:H16|Blocksize:8|String:2
xxxxxxxxxxxxxxxVKYSRADKICIGYLSNNATDTVDTLTETGVPVTSSIDLVETNHxxTYCSLNGISPIHLGDxxxxxxxVGNPSCASNINIRE
WxxxIEDPNAPHKLCFPGEVDNNGELRxxxxxxxxFSRTELINPSKWGDILEGTTASCQNRGANSFYRNLIWLVNxxNGKYPVIKGDYNNT
xxxxxxxxWGIHHPDSETTATKLYVNKNPxxxVSTKEWSRRYELEIGARIGEGQRSWMKIYWHLMHPGERIMFESNGGLIAPRYGYIIEKY
GSGRIFQSGIRMARCNTKCQTSVGGIDTNKTFQNIDRNAIGDCPKYIxxxxxxxxTGLRNVPIPIGERGLxxxxxxxxxxxxxxxxxxxxxxxxxxxxx
TGIAADKTSTQKAINEITTKINxxxxxxxxxxxxxxxxxxxVEKRINMIADRVDDAVTDVWSYNAKLLVLLENGRTLDLHDANVKNLHEQVK
RxLKSNAIDEGDGCFSILHKCNDSCMEAIRNGTYNHEDYREESQLKRxxIEGIKLKSEDNVYKVLAIYSCIASSTVLVGLILAFILWACSS
GNCRFSVCI
>Protein:HA|Subtype:H16|Blocksize:8|String:3
xxxxxxxxxxxxxxxGRYSIADKICIGYLSNNSTDKVDTLTENxxxxxxxxxxxxxxxxxxxxSLNGVSPVHLGDCSFxxxxxxxxxxxxxxxxxxxxxxxxD
PNAPNKFCYPGELDNNxxxxxxxxxxxxFSRTELIPPSKWGDVLDGVTASCRDNGADSFYRNLIWLVKxxxxxxxxVKGEYNNTTGRxxxxxx
xIHHPDTETTANKLYVNKNxxxxxxxxxxxxxxxxEIGTRIGExxxxxxKLYWHLMHPGERTTFESNGGxxxxxxxxxxxxxxTGRIFQSRIRMGKC
NTKCQTSLGGIxxxKTFQNIEKNALGDCPxxxxxxxxxxxxGLRNVPSVxNERGLFGAxxxxxxxxxxxxxxxxxxxxxxxxxxTGIAADKVSTQKAI
NxxxxxxxxxxxxxxxxxxxxxxxxxxxxxRINMLADWVDDAVTDxxxxxxxLLVLLENDRTLDxxxANVRNLHEQIKRxLKDNAIDEGDGCFSLL
HKCNDxxxxxxxxxxxxxxxxREESQLKKQEIEGIKLKTEDNIYKILSIYSCIASSVVLVGLILxFIMWACSNGSCRFNVCI
>Protein:HA|Subtype:H16|Blocksize:8|String:4
xxxxxxxxxxxxxxxGRYSRADKIxxxxLSNNSTDTVDTLxxxxxxxxxxxxxxxxxxxxxxxxSLNGISPVHLGDxxxxxxxxxxxxxxxxxxxxxxxxxxxxxN
APNKLCYPGELDxxxxxxxxxxxxxxxxRTELINPNKWGNVLDxVTASCLDKGAKSFYRNLVWIVKxxxxxxxxVRGDYNNTTxxxxxxxxxIHH
PDTEEVATRLYVNKNPxxxxxxxxxxxxxxxxxxxxxxxxxxxxxxKLYWHLMSPGERITFESSGGLLAPRxxxxxxxxxxxxIFQSGVRLAKCNTKCQ
TSMGGVNTNKTFQxxxxxxxxxxxxxxxxxxxxxxxxxxxxxxxxVERGLFGAxxxxxxxxxxxxxxxxxxxxxxxxxxxxxxxxxKVSTQKALNEITTKIxxxx
xxxxxxxxxxxxxxxxxxxxxxxxxxxxxxxxxxxxxxxxxxxxxxLENGRTLGLHDANVRNLHDQIKRxLQNNAIDEGDGCFNFFHKCNDSCxxxxxxxx
xxxxxxxxxxxxxxxxxxxxxxxTEDNVYKILSIYxCIASSIVMVGLILAFxMWACSNGNCRFNVxx
>Protein:HA|Subtype:H16|Blocksize:8|String:5
xxxxxxxxxxxxxxxSRYSKADKxxxxxxSNNSTDKIDTLTETGxxxxxxxxxxxxxxxxxxxxxxxxxxxxxxxxxxxxxxxxxxxxxxxxxxxxxxxxxxxxxxxxxxxNAP
HKLCYPGEVDNNxxxxxxxxxxxxxxRTELISPNKWGDILDGVTASCLDRGTSSFYRNLIWLVQxxxxxxxxxxxxxxxxxxxxxxxxxxxxHHPDTE
AVAINLYASKNPYTLVxxxxxxxxxxxxxxxxxxxxxxxxxxxxxxLMRPGERTxxxxxxxxxxxxxxxxxxxxxxxxxIFQSGVRVARCNTKCQTSLGGV
xxxxxxxxxxxxxxxxxxxxxxxxxxxxxxxxxxxxxxxxSERGLFGAxxxxxxxxxxxxxxxxxxxxxxxxxxxxxxxxxxASTQKAINxxxxxxxxxxxxxxxxxxxxxxx
xxxxxxxxxxxxxxxxxxxxxxxxxxxxxxxxxxxxxxxxxxxxxxxANVKNLHDQIKxxxxxxxxxxxxxxxxxxxxxxxxxxxxxxxxxxxxxxxxxxxxxxxxxxxxxxxxxxx
xxxxxxxxxxxxCIASSTVMVGLILxxxxxxxxxxxxxxxxxx
>Protein:HA|Subtype:H16|Blocksize:8|String:6
xxxxxxxxxxxxxxxxxxxxxxxxxxxxxxxxxxxKVDTLTETxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-30 xxxxxxxxxxxxxxxxxxxxxxxxxxxxxxxxxxxxxxxxxxxxxxxxxxxxxxxxxxxxxxxxxxxxxxxxxxxxxxxxxxxx
DERGLFGAxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H1|Blocksize:8|String:1
KQGKTKATKMKAILV

FIG. 76-31 xxxxxxxxxxxxxxxxxxxxxxxxxxxxxxxxxxxxxxxxxxxxEGGWPGLVAGWYGFQHQNxQGVGMAADxxxxxxxxxxxxxxxxxxx
xxxxxxxxxxxxxxxxxxxxxxxxxxxxxxWAYNAELLILLENEKTLDxxxxxxxxxxxxxxxGNGCFELLHxxxxxxxxxxxxxxxxxxxxxxx
xxxxxxxxxxxxxxLSIYSSVAS

FIG. 76-32 xxxxxxxxxIIIVVLLYxxxxxxxxxxxxxxxxxTVDTVLERNVTVTxxxxxxxxxxxxxxxxxxxxxxxxxxxxxxxxxxxxxxxxxxxxxxxxxLGNPECGLxxxxSWSYI
VERxxxxxxxxxxxxxxxxxxxxxxxxxxxxxxxSSVSSFEKFxxxxxxxxxxxxxxxxxxxxxxxxxxxxGFYKNLIWxxxxxxxxxxxxxxxxxxxxVLVIWGIHHPxx
xxxxxxxxxxxxxxxxxxxxxxxxxxxxxxxxxxRMNYYWTIxxPRDTIIFEASGxxxxxxxxxxxxxxxxxxxxxxxxxxxxxxxxxxxxxxxxxxxxGALNSNLPS
LPFQNVHPFTIGECSKYVKSTRLRMATGLxxxxxxxxxxxxxxxxxxxxxxxxxxxxxKSTQTA

FIG. 76-33

IGLREQKQEFKMNPNQKIxxxxxxxxxxxxxxxxxxxxxxxxxxxxxxxxxxxxxxxxxxxxxxxxxxxxxxxxxxxxxxxxxxxxxxxxxxGW
AIYSKDNSIRIGSKGDVFVIREPFISCSPLECRTFFLTQGALLNDKHSNGTIKDRSPYRTLMSCPIGEVPSPYNSRFESVAWSASACHDGIN
WLTIGISGPDNGAVAVLKYNGIITDTIKSWxxNILRTQESECACVNGSCFTVMTDGPSVMGQASYKxxxxxxxxxxAPNYHYEECS
CYPDSxxITCVCRDNWHGSNRPWVSFNQNLxYQIGYICSGIFGDNPRPNDxxxxxxxxxGANGVKGFSFKYGNGVWIGRTKSIxxxGF
EMIWDPNGWTxxxxxxxxxxNEWSGYSGSFVQHPELTGLDCIRPCFWVELIRGRPxxxTTIWTSGSSISFCGVNSxxxGWSWPDGAEL
PFTIxxx
>Protein:NA|Subtype:H1N1|Blocksize:8|String:2
xxxxxxxxxxxxxxxxxxxxxxxxxxxxxxxxxxxxxxxxxxxxxxxxxxxxx

FIG. 76-34 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxLPFTQEQK
>Protein:HA|Subtype:H1N2|Blocksize:8|String:1
xxxxxxx

FIG. 76-35

DGFLDxxxxxxxxxxxxxxxxxxxxxxxxxxxxxxxxNNAKETGNGCxEFYHKCDNxxxxSVKNGTYEYxxxxxxxxxxxxxxxxxxxxxxxxHQIL
AIYSAAxxxxxxxxxxxxxxxSHGSLQCRVCI
>Protein:HA|Subtype:H1N2|Blocksize:8|String:6
xxxxxxx

FIG. 76-36 xxxxxxxxxxxxxxxxxxxxxxxxxxxxxxxxxxxxxxxxxxxxxxxxxxxxxxxxxxYRDWSKPQCxVTGFAPFSxxxxIRL
SAGGAIWVTREPYVSCSxxxxxxLGQGTTLKNxxxxxxD

FIG. 76-37

>Protein:HA|Subtype:H2|Blocks

FIG. 76-38 xxxxxxxxLENLDKKMEDGFRxxxxxxxxxxxENERILDFHDSNVKNLYEKVRMQLRDNAKETGNGCFEFxxKCDDECMSSVKNGTYY
YPKYEEESKLNRTEIKGIKLSxxxxxxxxxxxxxxxxxxxxxxAIMMAGI

FIG. 76-39

AGYAADKESTQRAFxxxxxVNSIIEKMNTQSEAVGKEFNNLERRLENLSKRMEDGFIDVWTYNAxxLVLMENEMTLDFHDSSVKSLY
DKVRMQLKDNAKEIGNGCFEFYHKCNDECMNSVRNGTYDYPKYEKESKLNRNEIKGVELSSMGVYQILVIYATVxxSLSLAIMIAGIS
LWMCSNGSLQFRICI
>Protein:HA|Subtype:H2N2|Blocksize:8|String:3
xxxxxxxxxVRGDQICVGYHSNNSTKKVDT

FIG. 76-40

```
xxxxxxxxxxxxxxxxxxxxxxxxxxxxxxxxxxxxxxxxxxxxxxxxxxxxxxxxxxxxxxxxxxxDRLVLAIGxxxxxxxxxxx
xxxxxxxxxxxxxxxxxxxxxxxxxxxxxxxxxxxxxxxxxxxxxxxxxxxxxxxxxKRLGNLNKKMEDGFRDVWTYNxxxxxxxxxxxx
xxxxxxxxxxxxxxxxxxxxxxxxxxxxxxxxxxxxxxxxxxxVRNGTYNYPKYEEExxxxxxxxxxxxxxxxxxxxxxxxxxxxxxxxxx
xxxxx
>Protein:NA|Subtype:H2N2|

FIG. 76-41

GSNRPIVDINMVDYSIDSxxxxxxxDTPRNDDRSSNSNCKDPNNERGYPGVKGWxxxxGNDLWMGTTISKxxxxxxxFRVIGGWVTAxS
KSQANRQVIVGNNxxxxxxxxxxKNCINRCFYVELIRGMPQEARVWWTSNxxxxxxxxxxPDGANINLMPI
>Protein:NA|Subtype:H2N2|Blocksize:8|String:6
xxxxxKIITIGSASLT

FIG. 76-42

RRQLRENAEDIGNGCFTIYHKCDNSCxESIRNGTYNHxxYRDEAVNNRFQxxxxxxxxGYKDWVLWISFAISCFLICxxxLGFIVWACQRG
NIRCNIxx
>Protein:HA|Subtype:H3|Blocksize:8

FIG. 76-43 xxxxxxxxxxxxxxxxxxxxxxxxxxxxxxxxxxxxxxxxxWYGFRYQNSEGxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxIYHKCNNACxxxxxxxxxxxxxxxxxxxxxxxxxxxxxxxxxxxxxxxxxxxx
xxxxxxxxxxxxx >Protein:HA

FIG. 76-44 xxxxxxxxxxxxxxxxxxxxxxxxxxxxMATLCLGHHAVPNGTVVKTITxDQVEVTNATELVQIxxxxxxxxxxxxxxxxxxxxxxCTLVDALLGDPxxxxx
xxxxWDLYVERSxxxSSCYPYDVPEYxSLRSIVASSGTLEFTxxxxxxxxxxxxxxxxxxxxGFFRRLNWLTxxxxxxxxxxxxxxxxSDKLYI
WGIHHPSTxxxxxxxxxxxxxxxxxxxxxxISVYWTVVKPGDxxxxxCTGNLIAPRGYFRxxxGKSSVMRSDxxxxxxxxS
GCITPNGSIPNEKPFQNVNRITYGPCPRYVKQKTLK

FIG. 76-46

AKAGVKMNPNQKIITIGSVxxxxxxxxxxxxxxxxTTVTLHFKQxxxxxxxxxxxxxxxxxxxxxxxxEKEKEICSVxxxYRNWSKPQCx
ITGFAPFSKDNSIRLSAGGDIWVTREPYVSCDxDKCYQFALGQGTTLNNxxxxxxxRTPYRTLLMNELGVPFHLGTKQVCIAWSSSSCH
DGKAWLHVCVTGxDKNATASFIYNGxLVDSIGSWSxEILRTQESECVCINGTCTVMTDGSASGxxxxxLFIEEGKIxxxxxxLSGSAQH
VEECSCYPRYPGVRCVCRDNWK

FIG. 76-47

```
xxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxDINLMPIYxxxxx
>Protein:NA|Subtype:H3N2|Blocksize:8|String:7
xxxxxxxxxQKIITISSxxxxxxx

FIG. 76-48

```
xxTQAAINQINGKLxRLIEKTNDKYHQIEKxFEQVEGRTQDLERYVEDTKIxxxxxxxxxxHTIDVADSEMNRLFERVRRxxxxxxxxx
xGCFEIFHRCDNKCIESIRNGTYDHNVYRDEAINSRFQIQGVRLTQGYKDIILWFSxVTTRQASPSCLVxxALLLAFVLWACQTGNIRCQx
xx
>Protein:HA

FIG. 76-49 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSGNIRCQI
xx
>Protein:HA|Subtype:H5|Blocksize:8|String:1
SVKMEKIVLLxxxxxxSDQICIGY

FIG. 76-50

>Protein:HA|Subtype:H5|Blocksize:8|String:5
xxxxxxxxxxxxxxxxxSDQICVGYxxHANNSTERVDTIMExxxxxxHAQDILERxxxxxxxxxxGVKPLILGDCSVAGWxxxxxxxxxxxNAPEWS
YIxxxxxxxxxxxxxxxxxxxDYEEMKHLxxxxxxxxxxxxxxxxxxxxxxxxxxxxxxxxxxxxxAFFRNVVWIxxxxxxxxxxxxxxxxxxxxLLVLWGV
HHxxxxxxxxxxxxxxxxHISVGTSTLNQRMxxxxxxxxxxxxxxxxxxxxxxxxxxxxxxxxxxxxxxxxxxxxxxxxxxxxxxxxxxxxxxxxxxxxxxxxCQTPLGAI
NxxSSSMPFHNVHPLAIGExxxxxxxxxxxxxxxxxxxxxxxxxxxRRKRRGLFxxxxxxxxxxxxxxxxxxxxxxxxxxxxxxxxxxxxADKESTQRAIDG
xxNRVNSIIDKMNTRFxxxxxxxxxxxxDLNKKMEDGFIDVWxxxxxxxxxxxxxxxxxxNVKNLYDRVRLQLRDxxxxxxxxxxxxxxxxxxxx
xMDSVRNGTxxxxxxxxxxxxxxxxxxxxxxxxxxxQILSVYSTxVSSLALAIxSSLALAIIVAGLxxxMCFNGSLQCRIAxKICESRLRx
>Protein:HA|Subtype:H5|Blocksize:8|String:6
xxxxxxxxxxxxxxxxxxxxDQICIGYHANNSxxQIDTIMEKNxxxxxxxxxxxxxxxxxxxxxxxxFILKDCSVSGWxxxxxxxxxxxxxxxxxxx
xxxxxxxxxxxxxxxxxxxxxxxxxxxxxxxxxxxxxxxxxxxxxxxxxxxxxxxxxxxFFRNLVWLxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxCQTPMGAVNxxNSSKPFHNIxxF
TIGECPRxxxxxxxxxxxxxxxxxxxxxxxxKKKRGLFGAxxxxxxxxxxxxxxxxxxxxxxxxxxxxxxxxxxxxxxxxxxxNGVTNKVNxxxxxxxxxxxx
xxxxxxxxxxxxxxxxxxEDGFLGVWTYNAExxxxxxxxxxxxxxxxxxxxxxxxxxxxxxxxxxxxxxxxxxxxxxxxxxxxxxxxxxxxxxxxxxxxxxxxxxx
xxxxxxxxxxxLSIYSTVTSSPSTGNHGSLVLSxxxxxxxxxxxxxxxxxxCIKICESRxxx
>Protein:HA|Subtype:H5|Blocksize:8|String:7
xxxxxxxxxxxxxxxxxxxxDHICIGYHAxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxGAINSSMPxxxxxxxxxxxxxxxxxxxx
xxxxxxxxxxxxxxxxxxxETRGLFGAxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEFPST
GNHGxxxxxxxxxxxxxxxxxxxxxxxxxxxxxxxxxx
>Protein:HA|Subtype:H5|Blocksize:8|String:8
xxxxxxxxxxxxxxxxxxxxDRICIGYHAxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxGAINSSLPxxxxxxxxxxxxxxxxxxxxx
xxxxxxxxxxxxxxxxxxRKRGLFGAxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxx
>Protein:HA|Subtype:H5|Blocksize:8|String:9
xxxxxxxxxxxxxxxxxxxxDQICVGYHANNSxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxGAVNSSMPxxxxxxxxxxxxxxxxx
xxxxxxxxxxxxxxxxxxxxxxKTRGLFGAxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxx

FIG. 76-51

>Protein:HA|Subtype:H5|Blocksize:8|String

FIG. 76-52

LYDKVRLQLKDNAKELGxGCFEFYHRCDNxCMESIRNGTYNYPQYxxxxxxxxxxxxxxxxxxxxGIYQILSIYSTAASSLALANHGSLVLSxxx
AGLFLWMCSNGSYxxxxAFKFVSSDCSx
>Protein:HA|Subtype:H5N1|Blocksize:8|String:3
xxxxxxxxxxxxxxxxGDQICIGY

FIG. 76-53 xxxxxxxxxxxxxxxxxxxxxxxxxxxxxxxxxxxxxxxxxxxxxxxxxxxxxxxxAYKIIKKGDSxxxxxxxxxxxxxCQTPMGAINSVNSSMPFHxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEF
xxxxxxxxxxxxxxxxxxxxxxxxxxxxxxxxxxxxxxxxxxxxxxxxxxxxxxxxxxxxxxxxxxxxxNGTYDYPHYxxxxxxxxxxxxxxxxxxxxxxxxxxxxxxxxx
PSTGNHGxxxLAIIVAGLxxxxxxxxxxxxxxxxxxxxxxxxxxx
>Protein:HA|Subtype:H5N1|Blocksize:8|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxCQTPVGAINSINSSMPLHNxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSSLALAI
Ixxxxxxxxxxxxxxxxxxxxxxxxxxxxx
>Protein:HA|Subtype:H5N1|Blocksize:8|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxCQTPLGAINSxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxQTPMGAVNSxxxxxxxxxxxxxxxxxxxxxxxxxxxxxxxxxxxxxxx
xxxxxxxxxxxxxxxxxxxxxxxxxxxxxxxxxxxx
>Protein:HA|Subtype:H5N1|Blocksize:8|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H5N1|Blocksize:8|String:11
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxGAIGAIDSSMxxxxxxxxxxxxxxxxxxxxxxxxxxxxxxx
xxxxxxxxxxxxxxxxxxxxxxxxxxxxxxxxxxxxxx
>Protein:HA|Subtype:H5N1|Blocksize:8|String:12
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-54

```
xxxxxxxxxxxxxxxxxxxxxxxxxxxxxxxxxxxxxxxxxxxxxxxxxxxxxxGAINSSMPFxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxx
>Protein:HA|Subtype:H5N1|Blocksize:8|String:13
xxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxGAVNSSMPFxxxxxxxxxxxxxxxxxxxxxxxxxxxxxx
xxxxxxxxxxxxxxxxxxxxxxxxxxx
>Protein:HA|Subtype:H5N1|Blocksize:8|String:14
xxxxxxxxxxxxxxxxxxxxxxxxxxxxxxxxxxxxxxxxxxxxxxxxxxxxxxxxxxxxxxxxxxAINSSMPLxxxxxxxxxxxxxx
xxxxxxxxxxxxxxxxxxxxxxxxxxxxxxxxxxx
>Protein:NA|Subtype:H5N1|Blocksize:8|String:1
LVFREQKQEFKMNPNKKINRDITIGSICxxxxxxxxxxxxxNLDLNMGQPFYxxxxxxxxxxxxxxxxxxITYENNTWVNQTYVxxxxxxxxxxxxx
xxxxxGNSSLCPIxGWAVYSKDNSIRIGSKGDVFVIREPFISCSHLECRTFFLTQGALLNDKHSNGTVKDRSPHRTLMSCPVGEAPSPYNS
RFESVAWSASACHDGTSWLTIGISGPDNGAVAVLKYNGIITDTIKSWRxNILRTQESECACVNGSCFTVMTDGPSxxQASYKIFKxxxGK
KGKWLNxxxxxAPNYHYEECSCYPDAGExTCVCRDNWHGSNRPWVSFNQxxxYQIGYICSGVFGDNPRPNDGTGSCGPxxxxGAYGVK
GFSFKYGNGVWIGRTKSTNSRSGFEMIWDPNGWxxxxxxxxxxxxxxITDWSGYSGSFVQHPELTGLDCIRPCFWVELIRGRPKExTIWTS
GSSISFCGVNSIFLWCKIVTTVGWSWPDGAELPFTIDKY
>Protein:NA|Subtype:H5N1|Blocksize:8|String:2
xGLREQKQEFKMNPNQKIIEIITIGSICxxxxxxxxxxxxxxxxGPSHSIHTxxxxxxxxxxxxxIIYENNTWGNQTYxxxxxxxxxxxxxxx
xGNSSLCPVxGWAVHSKDNSIRIGSRGDVFVVREPFISCSHMECRTFFLTHGALLNDKHSNETVKDRSPYRTLMSCPMGEAPSPYNSKF
ESVAxxASACHDGISWLTIGVSGPDNGAVAVVKYNGMITDTIKSWGxNIMRTQESECACINGSCFTIMTDGPSxxQASHKIFKxxxGKRG
KWVKxxxxxAPDYHYEECSCYPNAGExICVCRDNWHGSNRPWISFNQxxxYRIGYICSGIFGDNPRPSDGTGSCDPxxxxGAYGIKGFSFK
YGDGVWIGRTKSPSSRSGFEMVWDPNGWxxxxxxxxxxxxxxTTDWSGYSGSFIQHPELTGLNCIRPCFWVELVRGRPKExTVWTSGSSI
SFCGVSSxxxxxxTVSWSWPDGAELPSxxxxx
>Protein:NA|Subtype:H5N1|Blocksize:8|String:3
xFSGSQKQEFKMxxxxxxxxxxxxxxxxxxxxxxxxxxxxxxxxxxxxxxxxxxxINYENNTWVNQTFVxxxxxxxxxxxxxxxxxxG
NSPLCPIxGWAIHSKDNNIRIGSKGDVFVTREPFISCSHSECRTFFLTQGSLLNDKHSNGTIKDRSPHRALMSCPVGVAPSPYNSxxxxxxxxx
```

FIG. 76-55

ASACHDGSSWLTIGISGPDSGAVAVLKYDGIITDTIRSWRxNTLRTQESECACANGFCFTVMTDGPNxxQASYKIFRxxxxxxxxxxxx
APNYYYEECSCYPDSGExMCVCRDNWHGSNRPWLSFNQxxxYKIGYICSGFFGDNPRPDDGTGSCSPxxxGTYGVKGFSFRYGNGVW
IGRTKSIHSRSGFEMIWDPDGWxxxxxxxxxLTDWSGYSxSFVQHPEMTGLDCMRPCFWVELIRGQPKExTVWTSGSIISFCGVNG
xxxxxxxxIVSWSWPDDAELPFII

FIG. 76-56

STQKAIDGITNxxNSIIDKMNxxxxxxxxxxxxxxxxxxxxxxxxxxDVWTYNAELLVLMENERTLDFHDSNVKNLYDKVRLQLRDNAKEL
GNGCFEFYHKCDNECMESVRNGTYDYxxxxxxxxxxxxxYQILSIYSTVASSLALAIMIAGLSFWMCSNGSLQCRIC1
>Protein:HA|Subtype:H5N2|Blocksize:8|String:2
xxxxxxxxxxSDQIC

FIG. 76-57 xxxxxxxxxxxxxxxxxxxxxxxxxxxxxxxxVQLQLRDNxxxxxxxxxxxxxxxxxxxxxxxxSVKNGTYNYxxxxxxxxxxxxxxxxxxxxxxxxxxxxxxxxVVSS
LALAIxETGLSLCMxxxxxxxxxx
>Protein:HA|Sub

FIG. 76-58

YETFRVIxxxxxxxxxxxxxxxxxNNWSGYSGIFSVExxSCINRCFYVELIRGRPQExRVWWTSNSIVVFCGTSGTYGTGSWPDGANINFM
Px
>Protein:NA|Subtype:H5N2|Blocksize:8|String:2
xxxxQRIITTGSISLxxxxxxxxxxxxxxxxxxxxxxxxxxxxxxxxxxxxxxxxxxxxxxxxxxxxYRDWSKPQCQVTGFAPFSKDNSIQ
LSAGGDIWTREPYVSCSxxRCYQFALGQGTTLNNNHSNGTIHDRTPHRTLLMSELGVPFHLGTRQVCIAWSSSSCYDGKAWLHICVT
GDDKNATASFVYxxxxxxxxSWSKNILRTQESECICxxxxCAVVMTDGSASRRxxxxxxxxxxxSPLTGSAQHIEECSCYPQSYLNVRC
VCRDNWMGSNRPVxxxxxxxxxSSYICSGLVGDTPRNNDSxSNSNCKDPNNERGNSGVKGWAFDYxNDVWMGRTVSKDSRLGYET
FKVIxxxxxxxxxxxxxxxxxSNWSGYSGVFSVExxGCINRCFYVEMIRGRPxxxRVWWTTNSIVVFCxxxxxxxGSWPDGADINFMPx
>Protein:NA|Subtype:H5N2|Blocksize:8|String:3
xxxxQKIITVGSVSLxxxxxxxxxxxxxxxxxxxxxxGQGTTLDHNHSNGTIHDRSSYRTLLMNELGIPFHLGTKQVCMAWSSSSCHDGRAWLHVCVTG
LSAGGNIWxxREPYVSCGxxxxxxxxxSWSLNILRxQESECVCVNxxCTVIMTDGSASGKAxxxxxxxxxxxSSLSGSAQHVEECSCYPHxxxxIRCVC
DDGNATASIIYxxxxxxxxxSRYICSGLVxDTPRNDDGxSNSNCRDPNNESGSQVKGWAFDDxSDVWMGRTISRDSRSGYETFKVxx
RDNWKGSNRPIxxxxxxxxxxxNNRSGYSGIFSIExxSCVNRCFYVELIRGRPKExxWWTSNSIIAFCGTSGTxxxxxPDGANINLMPx
>Protein:NA|Subtype:H5N2|Blocksize:8|String:4
xxxxQKIIAIGSVSLxxxxxxxxxxxxxxxxxxxxxxxxxxxxxxxxxxxxxxxxxxxxxxxxxxxxYRGWSKPQCKITGFAPFxxxxxRL
SAGGSIWxxxxxxxxxxxxxxxGQGTTLKDRHSNGTIHxxxSHRTLLMNxxxxxLGTKQVCVAWSSSSCHDGNAWLHVCVTGDDSNA
TASLIYxxxxxxxxxSCSQNILRxESECVCISxxxxAVVMTDGNASGRAxxxxxxxxxxxSPLSGNAQHIEECSCYPKxxxxVRCICRDNWKG
xxxxxxxxxxxxxxxxSHYVCSGLVxDTPRNDDIxSSSNCKDPNxxxGSPGVKGWAFDIxDDIWMGRTISEDSRSGYETFRVTxxxxxxxxxxxxxx
xxxxxxxKNWSGYSGxxxxxxHCINRCFYxxxxxxxxxxxxxxxxxxxxxxWTSNSIVAFCGTSGxxxxxxxxxGANINFMAx
>Protein:NA|Subtype:H5N2|Blocksize:8|String:5
xxxxHKIITTIGSASLxxxxxxxxxxxxxxxxxxxxxxxxxxxxxxxxxxxxxxxxxxxxxxxxxxxxYRSWSKPQCQIAGFAPFSKxxxxR
LSAGGGIWxxxxxxxxxxxxxxxxNRHSNGTIxxxxPYRTLLMNxxxxxxxxxxxxxxSRSSCHDGRAWLHIxxTGHDKNATASxxx
xxxxxxxxxxxxxxxxxESECVCIDxxxxxTDGSASERxxxxxxxxxxxSPLLGSAQxxxxxxxxxxxVTCVCRDNWKSSNRPVxxxxxx
xxxxxxxxxxxxxxxxxxSSSNCRDSNNERGNHGVKGWAFDSxNDIWMGRTINKNSRSGYETFRVLxxxxxxxxxxxxxxDNWSG
YSGxxxxxHCINRCFYxxxxxxxxxxxxxxxxxxxxxxxxxxxxxGANINFMSx
>Protein:NA|Subtype:H5N2|Blocksize:8|String:6
xxxxxxxxxxxxxxxxxxxxxxxxxxxxxxxxxxxNKHSNGTMxxxxxxxxxxxxxxxxxxxxxxxxxxxxxxxxxxxxxxKAWLHVCITGDDRNATANxxxxxxxxxxxxxxxxxx
xxxxxxxxxxxxxxxxxDGSATGKAxxxxxxxxxxxxPLSGGAQHIEECxxxxxxxxxxxxxxxxxxxxxxxxxxxxxxxxxxxxxxxxxxx
xxxxxxxxxCRDPNNEKGxxxxxxxxxxxxxVWLGRTISKNSRSGYETFRIIxxxxxxxxxxxxxxxxxxxxxxxxxxxxxxxxxxxxx
xxxxxxxxxxxxxxxxxxxxxxxxxxxxxxxxx
>Protein:NA|Subtype:H5N2|Blocksize:8|String:7
xxxxxxxxxxxxxxxxxxxxxxxxxxxxxxxxxNGTTHDRTxxxxxxxxxxxxxxxxxxxxxxxxxxxxxxxxxxxxxxxGNDRNATAxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxx

FIG. 76-59 xxxxxxxxxxxxxxxxDGSASGEAxxxxxxxxxxxxxPLGSAQATxxxxxxxxxxxxxxxxxxxxxxxxxxxxxxxxxxxxxxx
xxxxxxxxxxxxxxxxxxxxxxxxxxxxxxxxxxxGRTIKEDSxxxxxxxxxxxxxxxxxxxxxxxxxxxxxxxxxxxxxxxxxxxxxx
xxxxxxxxxxxxxxxxxxxxxxx
>Protein:NA|Subtype:H5N2|Blocksize:8|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-60

```
QNAxxxWVGECPKYVRSxxxxxxxxxARGLFGAIxxxxxxxxxxxxxxxxxxxxxxxxxxxxxxxADKESTQRAVNxITNKANSIIDKVNTQFE
AVxxxxxxxxxxxSLNKRMEDGFMDVWTYNAxxLVLLEDERTLDQHDANVKxxxxxVKSLLRDNAKDxxxxxxFWHKCDNDCxxSIKNG
TYDxxxxxxxxxxxxxxxxxxxxxxxIGVYQILAxxxxVSSGLVL

FIG. 76-61

```
IIWGIHHxxxxxxxxxxxxxxxxxxxxxxxxxxxxxxxxINGQSGRINFHWLxxxxxxxTFSFNGAFIAPNRASFxxxxxxxxxxxxxxxx
xxxxxxLPFQNINPxxVGRCPRYVKQxSLMLATGMKNVPExxAHKQLTHHxxxxxxxRETRGLFGARGLFGAIxxxxxxxENGWE
GLVDGWYGFRHQNSQEGTAAxYKSTQSAVDQITGKLNRIIGKTNQQFEMIxxxxEVEKQIGNVINWTQDAxTEIWSYNAEFLVAVEN
QHTIDLTDSEMSKLYERVKKQLRENAEEDGNGCFEIFHQCDNxCMASIRNNTYNHxxYREEAMQNRxxxxVKLSGGYKDIILxxSFGAS
CFILLAxxxxxxFICVKNGNM

FIG. 76-62

>Protein:HA|Subtype:H7|Blocksize:8|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxPSFYAEMKWLLSSxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxTKPRPRRGLFGAxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxVKRLLRENAxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxx
>Protein:HA|Subtype:H7|Blocksize:8|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxSSFYAEMEWLLSNxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxx
>Protein:HA|Subtype:H7N2|Blocksize:8|String:1
SKSRGYKMNTQILIxxxxxxxGAKGDKICLGHHAVANGTKVNTLTERGIEVVNATETVETAxxxxxxxxxxxxxDLGQCGLLGTLIGPPQCD
QFLEFSSDLIIERREGTDVCYPGKFTNEESLRQILRRSGGIGKExxGFTYSGIRTNGATSxxxRSGSSFYAEMKWLLSNSDNxxxxxxxxxxxx
xxxxxALIIWGVHHSxxxSEQTKLYGSGNKLIxxxSSKYQQSFxxxPGARRIDFHWLGRIDFHWLLLxxNDTVTFTFNGAFIAPDRASFFRGE
xxxxxxxxxxxxxxxxxCFHSGGTIVSSLPFQNINSRTVGKCPRYVKQKSLLLATGMRNVPEKPKPRGLFGAIAGFIENGWEGLINGWYGFR
HQNAQGEGTAADYKSTQSAIDQITGKLNRLIGKTNQQFELIDNEFNEIEQQIGNVINWTRDAMTEIWSYNAELLVAMENQHTIDLADS
EMSKLYERVKKQLRENAEEDGTGCFEIFHKCDDQCMESIRNNTYDHTQYRTESLQNRIQIDPVKLSSGYKDIILWFSFGASCFLLLAIA
MGLVFICIKNGNMQCTICIxxxxxx
>Protein:HA|Subtype:H7N2|Blocksize:8|String:2
xxxxxxxxxxxxxxxxxxxxxGVKGDKICLGHHAVSNGTKVNTLTEKGIEVVNATETVERTxxxxxxxxxxxxxxDLGRCGLLGTLTGPPQCDQFL
EFYADLIIERREGNDVCYPGRFTNEEPLRQILRGSGGIDKExxGFTYNGIRTNGAASxxxRLGSSFYAEMKWLLSSSDNxxxxxxxxxxxxxxx
xxALIIWGIHHSxxxTEQTKLYGNGNKLVxxxSSKYRQSFxxxPGARPQVNGQSGRIDFHWLMLxxNDTVTFSFNGAFIAPNRASFFRGAxx
xxxxxxxxxxxxxxxCFHNGGTIISNLPFQNINPRTVGRCPRYVKQTSLLLATGMKNVPEIPKKRGLFGAIxxxxENGWEGLVDGWYGFRHQ
NTQGEGTAAxxxxxxxxxxxxxGKLNRLIDKTNQQFELINNEFNEVEQQIGNVINWTQDAMTEVWSYNAELLVALENQHTIDLTDSEMSK
LYERVRKQLRENAxxxxxxxxxEIFHKCDNQCMESIRNNTYNHTQYRTGSMQNRIQIDSVKLSSGYKDVILWFSFGASCFILLAIAIGLVFM
CVKNGNMRCTICIxxxxxx
>Protein:HA|Subtype:H7N2|Blocksize:8|String:3
xxxxxxxxxxxxxxxxxxxxxPTNADKICLGHxxVSNGTKINTLTERGVEVVNATETVETTxxxxxxxxxxxxxxxGQCGLLGILIGPPQCDKFLEFS
SDLIIERKEGTDICYPGRFVNEEALRQILRESGGIDKExxGFTYSEIRTNGTTSxxxRSSSSFYAEMKWLLSNTDNxxxxxxxxxxxxxxxxxALI
VWGIHHSxxxAEQTKLYGSGSKLIxxxSSNYQQSFxxxPGTRRIDFHWFGRIDFHWLILxxNDTVTFIFNGAFIAPDRASFLRGKxxxxxxxxxx
xxxxxxxCYHSGGTIISSLPFQNISPRTVGKCPKYVKQESLLLATGMRNIPENPKTRGLFGAIxxxxxNGWEGLIDGWYGFRxxxxxxxxxxxxx

FIG. 76-63 xxxxxxxxxGKLNRLISKTNQFEMIDNEFTEVEKQIGNVINWTRDSMTEVWSYxxxxxVAIENQHTIDLADSEMNKLYERVRRQLREN
AExxxxxxxIFHKCDDHCMESIRNNTYDHSKYREEAMQNRIQIDQVKLSSGYxxxxxxxxxxSCFLLLAVVMGLVFICVKNGNMxCSALF
VYSLRK
>Protein:HA|Subtype:H7N2|Blocksize:8|String:4
xxxxxxx

FIG. 76-64 xxxxxxxxxxxxxxxxxxxxxxxxxxxxxxxxxxxxxxxxxxxxxxxxxxELIDNEFSEIEQxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxAIAMGFVFxxxxxxxxxxxxxxxxxxxxxxxxxxxxxxxxxxxx >Protein:NA|Subtype:H7N2|Blocksize:8|String:1
MNPNQKIITIGSVSLTIATV

FIG. 76-65

YSIGSSYYVCSxxxxxxRNDDSSSNSNCRDPNDERGNPGVxGWAFDYGSDVWMGxxxxxxxxxxxxxxxxxFRVIGGWATANSKSQIxxxVIVENN
NWxxxxGIFSVEGKxxxxxxxxxxVRGRPQETxxxxxxxxxxxxxxxxxxxxxxxxxxxxxxxxxxxxxxxxGANIKFMPx
>Protein:NA|Subtype:H7N2|Blocksize:8|String:6
xxxxxxxxxxxxxxx

FIG. 76-66

AIAxxxxxxxxxxNGWEGLINGWYGFRHxxxxxxxxxxYKSTQSAVDQITGKLNRLIEKTNQQFKLIDNEFSEIEQQIGxxINWTRDSITEVW
SYNxxxxxxxxxDQADSEMNNLYERVRKxxxxxxxxxxxxxxxxxNCMASIRNSTYDHSRYREEAMQNRMQINPVKLSGGYKDIIL
xxxFGASCFLFLAIxxxxxFMCVKNGNMxxxxxx
>Protein:HA|Subtype:H7N3|Bl

FIG. 76-67 xxxxxxxxxxxxxxxxxxxxxxxxxxxxxxxxxxxxxxxxxxxxxxxxxxxxxxxxxxxxxxxxxxxxxxxxxxV
CYPGKFVNxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxWLMLNPNGxxxFNFNGAFIxxxxxxxxxxxxxxxxxxxx
xxxxxxxxxxxxxxxxxxxxxxxxxxxxxAYQKQMTRGLFGxxxxxxxxxxxxxxxxxxxxxxxxxxxxxxxxx
xxxxxxxxxxxxxxxxxxxxxxxxxxxx
>Protein:HA|Subtype:H7N3|Blocksize:8|String:9 xxxxxxxxxxxxxxxxxxxxxxxxxxxxxxxxxxxxxxxxxxxxxxxxxxxxxxxxxxxxxxxxxxxxxxxxxx

FIG. 76-68 xxxxxxxxGAVNTTLSTIALFIGVGNLAFNAVIHGxxxxxxxxxxxxxxxxxxxxxxxxxxxITYNNTVNNITTTITTxxxxFKPPLPLCPFKGFFPF
HKDNAIRPGENxGVIVTREPCVxxxxxxxxxxHCWSFALAQGALVGTKHSNGTNKDRAPYRSLIQFPMGTAPVLGNYREVCIAWSSSxxxxGKE
WMHVSMTGNDxxxxxxxxxxxxxxxxxxxxxxxxxxxxxxxxxxxxxxxxxGRMSDSIKSWRxxxxxxQESECQRIDGICVAVTD
GPADNKADHRIYWIKxxxxxxxxxxxRIQHLEECSCYVDTDVYCICRxxxKGSNRPWVRINNETILETRYVCSKFHSDTPRPVDPSTISCD
SPSNVKGGPGVKGFGFKKGSDVW

FIG. 76-69

TKSYKNTRxxPALIIWGIHHSGSxxEQTKLYGSGNKLITVGSSNYQQSFxxxxxRPQVNGQSGRIDFHWLxxxxNDTVTFSFNGAFIAPDR
ASFxxxxxxxxxxxxxxxxxxCYHSGGTIxSNLPFQNINSRAVGKCPRYVKQxSLLLATGMKNVPExxTHKQLTHHMRKKRGLFGFGAIA
GFIENGWEGLIDGWYGFRHQNAQGEGTAADYKSTQSAIDQITGKLNRLIEKTNQQFELIDNEFTEVEKQIGNVINWTRDSMTEVWSYN
AELLVAMENQHTIDLADSEMNKLYERVRRQLRENAEEDGTGCFEIFHKCDDDCMASIRNNTYDHSKYRxxAMQNRIQIDPVKLSSGY
KDVILWFSFGASCFILLAIxxxLVFICVKNGNMRCTICI
>Protein:HA|Subtype:H7N7|Blocksize:8|String:2
MKSRGYKMNIQILIxxxxxxxxxxxxx

FIG. 76-70

QITRKLNRLIxxxxxxELIDNEFSEIEKQLGNVINWTxxxIEIWSYNAxxxxxxQHTIDSTDSEMNKxxxxxxxxxxxxxxxxxxxxxxxxxxxxIFHKCDD
RCMASIRNNSYDHSKYxxxAMQNIIQIDPVELSSGYKDVIIWFSFGASCFLFLAIxxxLIFMCVKNGNHAVxxxx
>Protein:HA|Subtype:H7N7|Blocksize:8|String:6
xxxxxxxxxxxxxxxxxxxxxxxxxxxxxxxxxxxxxxxxNTLTERGI

FIG. 76-71

LRSGFEMLRIPNAGIDPNSxxxERQEIVSNDNWSGYSYSGSFIDYWDExNECYNPCFxxxxxxxxPEEAKYVEWTSNSLIxxxxxxxSVGSGSFPD
GAQIKYFS
>Protein:NA|Subtype:H7N7|Blocksize:8|String:3
xNPNQKLFTLSGVAIAL

FIG. 76-72 xxxxxxxxMLLASTNAYDRICIGYQSNNSTDTVNTLIEQNVPVTQTMELVETEKHPAYCNTDLGAPLELRDCKIEAVIYGNPKCDIHLKD
QGWSYIVERPSAPEGMCYPGSVENLEELRFVFSNAASYKRIRLFDYSRWNVTSSGTSKACNASTGGQSFYRSINWLTKKKPDTYDFNN
EGSYVNNEDGDIIFLWGIHHPPDTKEQTTLYKNANTLSSVTTNTINRSFQPNIGPRPLVRGQQGRMDYYWGILKRGETLKIRTNGNLIA
PEFGYLLKGESHGRIIQNEDIPIGNCHTKCQTYAGAINSSKPFQNASRHYMGECPKYVKKASLRLAVGLRNTPSIEPKGLFGAIAGFIEG
GWSGMIDGWYGFHHSNSEGTGMAADQKSTQEAIDKITNKVNNIVDKMNREFEVVNHEFSEVEKRINMINDKIDDQIEDLWAYNAEL
LVLLENQKTLDEHDSNVKNLFDEVKRRLSANAIDAGNGCFDILHKCN

FIG. 76-73

KMxxxxxVVNHEFSKVEKKINMINDKIDDQIEELWAYNAExxxxxxxxxxxxxxxxxxxxxxxxxxxxxEVRRRLSVNAIDTGKGCFDILHxxxxxxxxxxN
GTYDHKDYEEExxxRSKINGVRLEENTTYxxxxxxxxxxxxxxxxxxxxxxxxxxxxxxxxxxxxxxxxxxxxxxxx
>Protein:HA|Subtype:H8|Blocksize:8|String:6
xxxxxxxxLLASTNAHDRICI

FIG. 76-74

```
xxxxxxxxxxxxxxxxxxxxxxxxxxxxxxGHQSTNSTEAVDTxxxxxxxxxxxxxxEHNGILCATxxxxxxxxxxxxxIEGLVYGNPSCDxxxxxxKWSYIVER
SSAxxxxxxxxxxxxxxxxxxxxxxxxxxxxxxxxxxxxxxxxxxxxxxxxxxxxxxxxxxxxxxxxxxSFYRNMRWLTxxxxxxxxxxxxxxxxxxxxxxxxxxxxxx
xxxxxxxxxxxxxxxxxxxxxxxxxxxxxGRINYYWSILKPGQTLRVRSNGNLIAPLYGHxxxxxxxxxxxxxxxxxxxxxxxxxxGGLNSTLPFHNVSKYAF
GTCPKYxxxKSLKLAIGLRNxxxxxRGIFGAIAGFIEGGWPGLVAG

FIG. 76-75

>Protein:HA|Subtype:H9N2|Bl

FIG. 76-76 xxxxxxxxxxxxxxxxxxxxxxxxxxxxxxxxxxxxxxNSPETVDTxxxxxxxxxxxELLHTGHNxxxxxxxxxxxxxxxxxxxxxxxxxxxxxxxxxxxxYIIERPSAxxxx
xxxxxxxxxxxxxxxxxxxxxxxxxxxxxxxxxxxxxxxxxxxxxxxxxSFYKSMRWLTxxxxxxxxxxxxxxxxxxxxxxxxxxxxxxxxxxxxxxxxxxxxxxxxxxxxx
xxxxxxxxxxxxxxxxYYWSVLRP

FIG. 76-77

SNRPVxxxxxxxxxxxxYLCSGLVGDTPRSxxxxxxxxxxxxxxxxSGVKGWAFxxxDVWMGRTIxxxxxxxxxxxxxxxxxxxxxxxxxxxxxxxxxxxxxxxxxxxxxxxxxxxxxxxxxxxx
xxxxxxxxxxxxxx

FIG. 76-78 xxxxxxxxxSCTVVMTDxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xTGSCHDGAxxxxxxx
>Protein:NA|Subtype:H9N2|Blocksize:8|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-79

```
xxxxxxxxxxxxxxxxxxxxxxxxxEIAQRLENVFAGKNxxxxxxxxxxxxxxxxxxxxxxxxxxxxxxxxxxxxxxxxxxxxxxxxxxxxxxxxxxxxxxxxxxxxxDKAVKLYKKxx
xxxxxGAKEVALGYSTGALAxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxTRQM
VQAMRAVGTHPxxxxxNDLLDNLQAYQKRMGVQMHRFKxxxxxxxxxxxxxxxxxxxx
>Protein:M1|Subtype:N/A|Blocksize:8|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xEVALSYSAGxxxxxxxxxxxxxxxxxxxxxxxxxxxxxxx

FIG. 76-80

ARSALILILRGSIAHKSCLPACIYGLVVxSGYDFEKEGYSLVGIDPFRLLQxxxxxxxSLIRPKENPAHKSQLIWMACNSAAFEDLRISxxxx
xxxxPRGQLATRGVQIASNENVxxxxSITLELRSKYWAIRTRSGGNNNQQRSSAGQTSVQPAFSVQRNLPFDKxxxxxxxGNAEGRTSD
MRTEVIRxxxxxxxxxxxEVSFRGRGVFELxSDEKATSPIVPSFDMNNEGSYFFGDSAEEYxxxx
>Protein:NP|Subtype:N/A|Blocksize:8|String:4
xxxxxxx

FIG. 76-81

>Protein:NP|Subtype:N/A|Blocksize:8|String:9
xxxxxxxxxxxxxxxxxxxxxxxxxEQMETSGERQxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPRLLQNSQVxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxELSDERAAxxxxxxxxxxxxxxxxxxxxxxxxxxx
>Protein:NP|Subtype:N/A|Blocksize:8|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxKLLQNSQVxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxx
>Protein:NP|Subtype:N/A|Blocksize:8|String:11
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxKLLQNSQIxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
>Protein:NP|Subtype:N/A|Blocksize:8|String:12
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxKLLQTSQVxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
>Protein:NP|Subtype:N/A|Blocksize:8|String:13
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxRLLQSSQVxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxx
>Protein:NS1|Subtype:N/A|Blocksize:8|String:1
MLFVQSYFQLFLVCVSLLQSAILSSFQVDCFLWHVRxxxxxxxxGDAPFLDRLRRDNLCRFLETxxxxxxxxxxPMRTPIAFLTSSIVCxxxxxx
xxxxxxxxxxxxxxxxxxxxxxxxxxIASVPASRYLIDxxxxxxxxxxxxxxxxxxxxxxxxxxxxxxxxxxxxxxxxxxxxxxAGVETMVILxxxxxxxxxxxx
xxxxxxxxxxxxxxxxxNWPSSSGGxxxxxxxxxxxxxxxxxxxxxxxxxxxxxxxxxSRNGKWREQLSQKFEEIxxxxxxxRRDQMAHCRMFEQITFMQA
LQL

FIG. 76-82

>Protein:NS1|Subtype:N/A|Blocksize:8|String:2
xxxxxxxxxxxxxxxxxxxxxxxTSFQVDCYLWHIRxxxxxxxxSDAPFLDRIRRDxLDRLRRDQKSLRGRxxxxxxxxxxxxxxxxxxxxxxxxxxxxxxxx
xxxxxxxxxxxxxxxxxxxxxLKMPASRYLTDxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxRHRLKITENSFEQITFMxxxxx
>Protein:NS1|Subtype:N/A|Blocksize:8|String:3
xxxxxxxxxxxxxxxxxxxxxxxLSFQVDCFIWHIRxxxxxxxxCDAPFDDRLRRDxDDRLRRDQRSLRGRxxxxxxxxxxxxxxxxxxxxxxxxxxxxxxx
xxxxxxxxxxxxxxxxxxxxxxSKITLKFAFNxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxRGDQMAHCxxxxxxxxxxxxxx
>Protein:NS1|Subtype:N/A|Blocksize:8|String:4
xxxxxxxxxxxxxxxxxxxxxxxxxxxVDCFLWHIRxxxxxxxxxxxSLLLLQANLCRFLEDQKSLKGRxxxxxxxxxxxxxxxxxxxxxxxxxxxxxxxxxxxx
xxxxxxxxxxxxxxxxxxxxVPASRYLTxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:NS1|Subtype:N/A|Blocksize:8|String:5
xxxxxxxxxxxxxxxxxxxxxxxxxxxxxxxxxxxxxxxxxxxxxxxxxSSLLLQANLDRIRRDQKSLKGxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:NS1|Subtype:N/A|Blocksize:8|String:6
xxxxxxxxxxxxxxxxxxxxxxxxxxxxxxxxxxxxxxxxxxxxxxxxxxxxxxxxxIDRLRRDQKALKGRxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxx
>Protein:NS1|Subtype:N/A|Blocksize:8|String:7
xxxxxxxxxxxxxxxxxxxxxxxxxxxxxxxxxxxxxxxxxxxxxxxxxxxxxxxxxxxRLRRDQRALKGRxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxx
>Protein:NS2|Subtype:N/A|Blocksize:8|String:1
TAFSGMSANGDIxFQYLLFQDILMRRFADQELGDAPFLDRLRRDQKSLRGRGSTLGLDIRTATREGKHIVERILEEESDEALKMTIASDI
LKRMxxxxxxRPHPEDLNxxxxxxxxxxxxxxxxxxxxxxxxxxxxxxxxxxxxxxQLGQKFEEIRWLIxxxxxxxxxTENSFEQITFMQALQLLLEVEQEI
RTFSFQLINNKKP
>Protein:NS2|Subtype:N/A|Blocksize:8|String:2
xxxxxxxxxxxxxFQVDCFLWHVRKRFADQELxxxxxxxxxxxxxxxxxxxxxxxxxxxxxxxxxxxxxxxxxxxxxxxxxxxxxTIASDILTRMxxxxxxxxxxxx
xxxxxxxxxxxxxxxxxxxxxxxxxxxxxxxxxxxxxxxxQLSQKFEEIKWLIxxxxxxxxxTESSFEQITFLQALQLLLEVESEIRTFSFQFIxxxxx
>Protein:NS2|Subtype:N/A|Blocksize:8|String:3
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxELSQKFEEMRWLIxxxxxxxxxxxxxxxxxTFIQALQLLLEVENEIRTFSFQLILLxxx
>Protein:NS2|Subtype:N/A|Blocksize:8|String:4

FIG. 76-83 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxQLSHKFEEVRWLIxxxxxxxxxxxxxxxxxxxxxxxxxxxxMQALQLLFEVEQEIRAFSFQLILxxx
>Protein:NS2|Subtype:N/A|Blocksize:8

FIG. 76-84 xxxxxGEETIEEKFExxxxxxKLANYSLPPNFSxxxSFRAYVDGFKPNGCIEGKLSQMPKEVxxxxxxxxxxxxxxxxxxxCFQRSKFLLxxxx
KLSI

FIG. 76-85 xxxxxxxxxxxxxxxxxxxxxxxxxxxxxxxxxxxxxxxxxxxxxxxxxxxxxxxxxxACELTDSTWxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxx
>Protein:PA|Subtype:N/A|Blocksize:8|String:9
xxxxxxxxxxxxxxxxxxxxxxxxxxxxxxxxxxxxxxxxxxxxxxxxxxxxxxx

FIG. 76-86

RKMMTSSQDTELSFTVTGxxxxNENQNPRVFIFLAMITYITKNQPEWFRNVLSIAPIMFSNKVARLGKGYMFESKRMKIRTQIPAExxxx
IDLKYFNDxxxxxxxxKIERIRPLLxxGAASLSPGMxxxxxxxxxxLGVSVLNLGQKRHTxTIYWWDGLQxxDDFALILNAPxxAGIQAGVDRF
YRICKLVGINMSKRKSYINKTGTFEFTxxxxxxxxxxxxxxxxxxxPSFGVSGVNESADMSIGITVIKNNMxxxxxxxxxxxxxxxxxxRYTYRCHK
GDTQIQTKRSFELKxxxxxxxxxxGLLISDGGPNLxxxxxL

FIG. 76-87

>Protein:PB1|Subtype:N/A|Blocksize:8|String:6
xxxxxxxLLFLKVPVxxxxxxxxxxxxxxxxxxxxxxxxxxxxxxxxxxxxxxxxxxxxxxxxxxxxxxxxxxxxxxxxxxxxxxxxxxxxxxESHPGIFGxxxxx
xxxxxxxxxxxxxxxxxxxxxxxxxxxxxxxxxxxxxxxxxxxxxxxxxxxxxxxxxxxxxxxxxxxxxxxxxxxxxxxHRKRRVRDNMTRKMxxxxxxxxxxxxxxxxxxxx
xxxxxxxxxxxxxxxxxxxxxxxxxxxxxxxxxxxxxxVETLARCICxxxxxxxxxxxxxxxxxxxxxxxxxxxxxxxxxxxxxxxxxxxxxxxxxxxxNQNPRIFLAMITxxx
xxxxxWFRNILSIAPIMxxxxxxxxxxxxxxxxxxxxxLRTQVSAExxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxHPRGLLEVGTRWMKxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxx
>Protein:PB1|Subtype:N/A|Blocksize:8|String:7
xxxxxxxLLFLKIPVxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxRMITQRTIxxxxxxxxxxxxxxxxxxxxx
xxxxxxxxxxxxxxxxxxxxxxxxxxxxxxVETLARNICEKLEQxxxxxxxxxxxxxxxxxxxxxxxxxxxxxxxxxxxxxxxxxxxxxxxxQNPRVFLTMITYITRxxxx
xxxNALSIAPIMxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxx
>Protein:PB1|Subtype:N/A|Blocksize:8|String:8
xxxxxxxxYFFLKVPVQNAISxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxx
>Protein:PB1|Subtype:N/A|Blocksize:8|String:9
xxxxxxxxxLFLKIPAQNAISIxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-88 xxxxxxxxxxxxxxxxxxxxxxxxxxxx
>Protein:PB1|Subtype:N/A|Blocksize:8|String:10
xxxxxxxxLFLKVPVQxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-89

RHFQKDAKVLxxxxxxxxxVMGMIGILPDMTPxxxxxxxRVSKMGVDEYSSTERxVVSIDRFLRVRDQRGNVLLSPEEVSETQGTEKL
TITYSSSMMWEINGPESVLVNTYQWIIRNWExxKIQWSQDPTxLYNKMEFEPFQSLVPKAxRGQYSGFVRTLFQQMRDVLGTFDTVQII
KLLPFAAAPPEQSRMQFSSLTVNVRGSGMRILVRGNSPVFNYNKxTKRLTVLGKDAGALxxxxxxxxAGVESAVLRGFLILGKEDKRY
GGPALSINELSNLAKGEKANVLIGQGDVVLVMKR

FIG. 76-90 xxxxxxxxxxxELMSQSRTxxxxxxxxxxxxKKYTSARQEKNxxxxxxxxKYPITADRxxxxxxRNEQGQMLWxxxxxxGSDRV
MISPLAVTWxxxxxxxxxxHYPKVYKP

FIG. 76-91 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxDLNAKEAQDxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxKEDRRYGPALSxxxxxxxxxxxxxxxxxxxxxxxxxxxxxxxxxxxxxxxxxxxxxxxxxxxxxxxxxxxxxxxxxxx
>Protein:P

FIG. 76-92 xxxxxxxxxxxxxxxxxxxxxxxxAPSGIEYNGKSLGIQSxxxxxxxxxxPSVKLPMGAIGAIDSSMPxxxxxGEHAKAIGNxxxxxxxxxxxxx
xxxIPIGERGLFxK

>Protein:NA|Subtype:ALL|Blocksize:9|String:1
IGLREQKQEFKMNPN

FIG. 76-95

```
xxxxxxxxxxxxxxxxxxxxxxxxxxxxxxxxxxxxxxxxxxxxxxxxxxxxxxxxxxxxxxxRTQESECQCxxxxxxxxxxxxxxxxxxxxxxxxxxxxxxxxxYKYKIFKNGKxxxxxxxxxxxxxxxIRHLEECS
Cxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxx
>Protein:NA|Subtype:ALL|Blocksize:9|String:5
xxxxxAKAGVKMNPNQKIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-96 xxxxxQKQEIKMNPNQKINRDITIGSIxxxxxxxxxxxxxxxxxxxxxxxxxxxxxxxxxxxxxxxxxxxxxxxxxxxxxxxxxx
GWAVHSKDNGIRIGSKGDIFVIREPFxxxxxSECRTFFLTxxxxxNDKHSNGTAxDRSPHRALMSCPIGEAPSPYNxxxxxxSASACHDGLG
WITIGISGPDNEAVAVLKYNGVITxxxxxxxxxxxxxxxxxxxNGFCFTVMTDGPNxxxxxxxxxxxxAPNSHYEECSCYPD
AxxxIC

FIG. 76-97

RCICRDNWKGSNRPVxxxxxxxxxxYLCSGLVGDTPRNxxxxxxxxxxPGVKGWAFDNxxxxxxxxxxRSGYETFRVxxxxxx
xxxxxxxxxxxxxxxxSGYSGVF

FIG. 76-98 xxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxADIKSHAYISxxxx
xxxxxxxxxxxxxxxxxxxxxxxx
>Protein:NA|Subtype:N2|Blocksize:9|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-99

KxQNDVWLGRTISxxRSGFEIIRVxxxxxxxxxxxxxxxxxxxxxIQTLVSNNDxSGYSGSFIIxxxGCFQPCFYVELTRGVxxxxxxVSWTSNSMVTFCGL
DNEPGSExWPDGANIGFMPK
>Protein:NA|Subtype:N3|Blocksize:9|String:4
xxxxxxxxxxxxxxxxxxxxxxxxxxxxxxxxxALIIGVGNLIFNAVIHxxxxxxxxxxxxxxxxxxxxxxxxxxxxxxxxxxxxxxxxxxxxxDNAIRLGE
TxxxIITREPYVSCDYxHCWSFALAQGALVG

FIG. 76-100

```
xxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxDGSKIGFMPx
>Protein:NA|Subtype:N4|Blocksize:9|String:1
MNPNQKIITIGSISIxLTTVGLLLQITSLCSIWFSHYNQVTQTxxxCSNNTTNYYNETFVNVTNVQNNYTTVxxxxxxxxxxLCPIRG
WAPLSKDNGIRIGSRGEVFVIREPFISCSISECRTFFLTQGALLNDKHSNGTVKDRSPFRTLMSCPIGV APSPSNSRFESVAWSATACSDG
PGWLTLGITGPDATAVAVLKYNGIITDTLKSWKGNIMRTQESECVCQDEFCYTLITDGPSDAQAFYKILKIRKGKIVxxxxxATGFHFEE
CSCYPSGTDIECVCRDNWRGSNRPWIRFNSDLDYQIGYVCSGIFGDNPRPVDGTGSCxSPVNNGKGRYGVKGFSFRYGDGVWIGRTKS
LESRSGFEMVWDANGWVSTDKDSNGVQDIIDNDNWSGYSGSFSIRGETTGRNCTVPCFWVEMIRGQPKEKTIWTSGSSIAFCGVNSD
TTGWSWPDGALLPFDIDK
>Protein:NA|Subtype:N4|Blocksize:9|String:2
MNPNQKIVTIGSVSIxLTTIGLLLQITSxxxIWFSHYNQMTQAxxxxCSNDTINYYNETFVNITNVQNDYTTVxxxxxxxxxxLCPVKG
WAPLSKDxxxxxxxEVFVIREPCISCSINECRTFFLTxxxxxxxxxxxxxxxxxQDEFCYTLMTDGPSDAQAFYKLLKIRKGKIVxxxxxATGYHFEECSCYPSGE
ITGPDSTAVAVIKYNGIITDTFKSWKGNIMxxxxxxxxQDEFCYTLMTDGPSDAQAFYKLLKIKKGKIVxxxxxATGYHFEECSCYPSGE
NVECVCRDNWRGSNRPWVRFNSDLDYQIGYICSGVFGDNPRPADGTGSCxGPINNGKGRYGxxxxxxxxxEVWIGRTKSLESRRGFEM
VWDANGWVTADKDSNGVQDIIDNNWSGYSGSFSIRWETTGRNCTIPCFWVEMIRGQPNERTIWTSGSSIAFCGVDSDTTGWPWPDG
ALLPLTxxx
>Protein:NA|Subtype:N4|Blocksize:9|String:3
MNPNQSIITIGSVSIxxTTVGLLLQVTSLCxxWFSHYNQMKQAxxxxxxxxxxxNETFVNVTHVQNNYTTVxxxxxxxxxxxLCPIKGW
APLSKxxxxxxxxxVFVIREPFVSCSIDECRTFFLTxxxxxxxxxxxxxxxxxFRTLMSCPVGVAPSPSNxxxxxxxxxxSDGPGWLTIGITGP
DATAVVVLKYNGVITDTLKSWxxxxxxxxxxxxxxxxQDEFCYTLVTDGPSDAQAFYKILKIKKGKIMxxxxxxAPGFHFEECSCYPSGESIECV
CRDNxQGSNRPWIRFNSNLDYQIGYVCSGVFGDNPRPMDSTGSCxSPINNGKGRxxxxxxxxxxxxxxxxxRTKNLESRSGFEMIWDANGW
VSTDKNSNGVQDIIxxxxxxxxxxxxxxxxxxxxxxxxIRGQPKEKAIWTSGSSIAFCGVNFDLTSWSWPDGALFPxxxxx
>Protein:NA|Subtype:N4|Blocksize:9|String:4
xNPNQMIITIGSASIxxxTVGLLLQIISLCSIWFSHYNQVAQxxxxxxxxxxxxNETFVNMTNVQNNYTTIxxxxxxxxxxxxxxxxxxxxxxx
xxxxxxxxxxxxxxxxxxxxxxxREPFISCSVSECRTFFLxxxxxxxxxxxxxxxxxLMSCPIGVVPSPSxxxxxxxxxxxxxxxxTLGITGPDTTAVAVL
KYNGVIxxxxxxxxxxxxxxxxxxxxxxxxxxxxxTLITDGPSNAQAFYKILKIKKGKLxxxxxxAAGFHFEECSCYPSGEDVECVCRDNxxxxxPWI
RFNSDPDYQIGYVCxGIFGDSPRPVDGIGSCxxxxxxxxxxxxxxxxxxxxxxxxWDDNGWVSTDKSSNGxxxxxxxxxxxxxxxx
xxxxxxxxxxxxxxxIRGQPKERTIWTSGxxxxCGVDSDTTSWSWPDGALLPFDIDR
>Protein:NA|Subtype:N4|Blocksize:9|String:5
xxxRSKIITIGSISVxxxTIGLLLQIISxxxxxSHYNQVTQPxxxxxxxxxxxxVNVTNVQNDYTxxxxxxxxxxxxxxxxxxxxxxxxxxxxxxxxxxxxxxxxxxxxx
xxxxxxxxxxxxxxxISCSIDECRxxxxxxxxxxxxxxxxxxxxxxxMSCHIGVAPSPxxxxxxxxxxxxxxxxxxxxxDATAVAVIKYxxxxx
xxxxxxxxxxxxxxxxxxxxxxxxxxxxxxGQAFYKILKIRKGKIMxxxxxATGFHLEECxxxxxxxxxNIECVCRDNxxxxxxxIRFNSDLNYQIGY
```

FIG. 76-101

ICSGIFGDNPRSVDGxxxxxxxxxxxxxxxxxxxxxxxxxxxxxxxxxxxxxxxxxxxxxxxxxxxxxxxxxxxxxxxxxxxxx
xxxxxxxxxxxxxxxxxxCGVNSDTTSWxxxxxxxxxxxxx
>Protein:NA|Subtype:N4|Blocksize:9|String:6
xxxxxxxxxxxxxIGPLLQITSxxxxxxSHYNQITQTxxxxxxxxxxxxxxxxxxxxHVQNNYTTIxxxxxxxxxxxxxxxxxxxxx
xxxxxxx

FIG. 76-102

>Protein:NA|Subtype:N5|Blocksize:9|String:4
xxxxQKIITIGSMSLALxxxxxxxxxxxxxxxxxxxxxxxxxxxxxxxxxxxxxxxxxTTEVYSETVRVETxVIPVNNTIYxxxxxxxxxKFLNNTEPLCDVSGFAIISKDN
GIRIxxxxxxxxEPFVACGPSECRTxxxxxxxxxxxxxxxxxxxxxxxxxxxxxxxxMSVPLGSSSNAYQAKxESIAWSATACHDGKEWMxxGVSGTDDD
AYxxxxYGGVPTDVIRSWRKQILxxQESSCVCMNGxxxxVMTDGPANKQASYKIFKSRxxxxxxxxEVSFRGGHIEECSCYPNLGQVECVC
RDNxxxxxxxxxxYDVGYLCAGIxTDTPRVQDDxxxxxxAIGGSGTDNxxxxGFAFKQGNSVWAGRTISISSRNGFEILLIEEGWxxx
xxxxxxxEVLNNRNWSGYSGSxxxxxxxxxxxxxxMIRGKPEEGTSIWTSSSxxxxxGVSSEVPGCTxxxxxxxxxxxx
>Protein:NA|Subtype:N5|Blocksize:9|String:5
xxxxxKIMTIGSVSLTLxxxxxxxxxxxxxxxxxxxxxxxxxxxxxVTKVYNETVRVEIxTIPINNTIYxxxxxxxxxxxxLCEISGFAIASKDNGIR
xxxxxxxxEPFVACGPAECRTFFLTxxxxxxxxxxxxxxxxxxxxxxxxxxxxxxxACHDGKK

FIG. 76-103

GSxxxVKCICRDNWRGANRPVITIDxxxMTHMSKYLCSKVLTDTSRPSDPxxxxxxxGGGPDPGVKGFAFLNGxNSWLGRTTSKDSRS
GYEVLKVPNAExxxxxxxxxxIVNNQDWSGYSGAFMDYWxxKECFNPCFYVELIRGMPKESSVFWTSNSIVALCGSRERLGSWSWHD
GAEIIYFK
>Protein:NA|Subtype:N6|Blocksize:9|String:3
MNPNQKIMCISATGMALSVVSLLxGVANLGLNIGxxxxxxxx

FIG. 76-104

MNPNQKLFTLSGVAIxxxxLNLIIGISNVGLKVSLHLKxxxxxxxxxxxxxENKYVNNTTIIxxxxxxxYLLLNKSLCNVxGWVV
IAKDNAVRFGESEQIxxxxEPYVSCDPTGCRMYALHQG

FIG. 76-105

```
xxxxxxxxxxxxxxxxxxxxxxxxxxxxxxxxxxxxTWLGRTFSPRSRSGFEVLKIPNAGIDPxxxxxxxxxxxxxxxxxxxxxxxxxxxxxxxxxxxx
xxxxxxxxxxxxxxxxxxxxxxxxxxxPDGARIQYFS
>Protein:NA|Subtype:N7|Blocksize:9|String:8 xxxxxxxxxxxxxxxxxxxxxxxxxxxxxxxxxxINDRTAFRGxxxxxxxxxxxxxxxxxxxxxxxxxxxxxxxxxxxxxxxxxxxxxxxxxxxxxxxx
xxxxxxxxxxxxxxxxxxxxxxxxxxxxxxxxEMLKVPNAGxxxxxxxxxxxxxxxxxxxxxxxxxxxxxxxxxxxxxxxxxxxxxxxxxxxxxxxxxx
xxxxxxxxxxxx
>Protein:NA|Subtype:N8|Blocksize:9|String:1 xxxxxxxxxxxxxxxxxxxxxxxxxxxxxxxxxxxxxxxxxxxxEYNETVRVExxxxxxxxxxxxxxxxxxxxxxxxxxxxxxxxxxxxxxxxxxxxxx
xxxxxxxxxxxxxxxxxxxxxxxxxxxxxxKGFAPFSKDNGIRIGSRGHVFVIREPFVSCSPxECRTFFLTQGSLLN
DKHSNGTVKDRSPYRTLMSVEIGQSPN

FIG. 76-106

Fxxxxxxxxxxxxxxx FGFRQGSDVWxxxxxxxxxxxxxxxxxxxxxxxxxxxxxxxxxxxxxxxxxxxxxxDNPNWSGYSGSFTLPVEMxxxSCLVPCFWVxxxxxxx
xxTVWTSSSSI

FIG. 76-107

>Protein:NA|Subtype:N9|Blocksize:9|String:3
MNPNQKIQCTxxxxxxxxxxxxxxxxxxTNLGLNIGLxxxxxxxxxxxxxxxxSQTIINNYHNETNITQISNINIxxxxxxFNNLTRGLCTINSWHIF
GKDNAVRIGENSGVLVTxEPYVSCDPNECRFYALSxxxxxxxxxxxDRSQYRALVSWPLSSPPTVYNRxxxxxSTSCHDGKARMS
VCISGPNNNASAVVWYNGRPITEINTWARxxxxxEESECVCHNGICPVFTxxxATGPAETRIYFxxGKTLKWEPLAGTAKHIEECSCYG
VxxxIICTCRDNWQxSNRPVIQINPxMMTHTSQYIxxxxxDNPRPNDPNVGKCNEPYPGNNNNGVKGFAxxxxxNTWVGRTISIASRSGYE
MLKVPNALIDDRSKPxQGQTIVSNTDWSGYSGSFVDYWAEGDCYRACFYxxIRGRPKEDRVWWTSNSIxxxxxxxQWNWPDGAE
IEYFL >Protein:NA|

FIG. 76-108 xxxxxxxxxxxxxxxxxxxTISTASRAGYEMLKVPxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxx
>Protein:HA|Subtype:H10|Blocksize:9|String:1
xxxxxxxxxxxxxxxxxGLDKICLGHHAVSNGTIVKTLTxxKEEVTNATETVESxxxxxxxxxxKDLGNCHPIGMxxxxxxxxxxxxGTWDTLIERx
xxxxxxxxxxxxxVNEEALRQKIMESGGIxxxxxxxxxxxxxxxxxxxxxxxxxxxxxxxxSFYAELKWLxxxxxGQNFPQTTNTYRNTDSxxxxxxWGIHHPSST
xxxxxxLYGTQSLSISVGSSTYQNNFVPVVGARPQVNGQSGRIDFHWxxxxPGDNITFSHNGGLIAPSRVxxxxxxxxxxxxxxxxxxCESKCFW
KGGSINTKLPFQNLSPRTVGQCPKYVNKKSLLLATGMRNVPEVxQGRGLFGAIAGFIENGWEGMVDGWYGFRHQNAQGTGQAADY
KSTQAAIDQITGKLNRLIEKTNTEFESIESESFSEIEHQIGNVINWTKDSITDIWTYQAELLVAMENQHTIDMADSEMLNLYERVRKQLRQ
NAEEDGKGCFEIYHKCxxNCMESIRNNTYDHTQYREEALLNRLNINPVKLSSGYKDVILWFSFGASCFVLLAxxxxxxFFCLKNGNMRC
TISLVKTTLFL
>Protein:HA|Subtype:H10|Blocksize:9|String:2
xxxxxxxxxxxxxxxxGIDKICLGHHAVPNGTVVKTLTxxQEEVTNATETVENxxxxxxx

FIG. 76-109 xxGQCPKYVSQGSLLLATGMxxxxxxxxxxxxxxxxxxxxxxxxxxxxxxxxxxAADYKSTQKTIDQVTGKLNRLIxxxxxxxxxxFSE
IEHQISNVINWxxxxxxxxxxxxxxxxxxxxxxxxxIDMADSTMLNLxxxxxxxxxxxxxxxxxxxxGCFEIYHVCxxNCMESIRDNTYDHSHYREEALLNR
LNINSVKLFSGYKDIILxxxxxxxxxxxxxxxxxxxFFCLKNGNTxxxxxxxxxxxxxx
>Protein:HA|Subtype:H10|

FIG. 76-110

ADSEMLNLYERVRKQLRQNAEEDGKGCFEIYHKCDDNCMESIRNNTYDHTQYREEALLNRLNINPVKLSSGYKDVILWFSFGASCFV
LLAVIMGLVFFCLKNGNMRCTICI
>Protein:HA|Subtype:H10N7|Blocksize:9|String:2
xxxxxxxxxxxxxxxGIDKICLGHHAVPNGTIVKTLTSEKEEVINATETVESTxxxxxxxxxxxYKDLGSCHPIGMIIGTPVCDPHLTGTWDTLIE
RENAIAHCYPGATINEEALRQKIMESGGISKISTxFIYGSSINSxxxxxxxxxxGGDSFYAELKWLISKSKEQNFPQTANTYRNTDSxEHLIV
WGIHHPSSAQEKNDLYGAQSLSISVESSTYQNNFVPVIxxxxxVNGQSGRINFHWTxVRPGDNITFSDNGGLIAPSRVTKLKGRGLGIQSE
xxxDNNCESKCFWRGGSINTKLxxxxxxxxxVGQCPKYVSKRSLLLATGMRNVPEIxQERGLFGAIAGFLENxxxxxxxxxxxxxxxxxxGTGQA
ADYESTQAAIDQMTGKxxxxxxxxxxxFESIESEFNEIEHQIGNxxxxxxxxxxxxWTYQAELLIxxxxxHTIDLADSEMLNLYDRVRKQLRQNA
EEDGRGCFEIYHKCDDSCMESIRNNTYDHAQYREEALLNRLSINPVKLSSGYKDIILWFSFGASCFILLAVIVGLVFFCLKNGNMRCTIL
x
>Protein:HA|Subtype:H10N7|Blocksize:9|String:3
xxxxxxxxxxxxxxxGLDRICLGHHAVANGTIVKTLTNEQEEVTNATETVENKxxxxxxxxxxxHKDLGNCHPVGMLIGTPACDLYLTGTWDT
LIERGSSIAYCYPGTTVNEEALRxxxMESGGISKMSTxFAYGSSINSxxxxxxxxxxGKNSFYAELKWLVSKTKGQNFPRTTNTYRNTDTxE
HLITWGIHHPSSTKEKNDLYGTQPLSISVGSSIYQNSFVPVVGARxxxxxxSGRIDFHWAxIQPGDNITFLHNGGLIAPDRVSxxxGRGLGIQ
SDxxxDNSCESKCFWKGGSIKTKLPFQNLxxxxxGQCPKYVNQKSLMLATGMRNVPETxxxxxxxxAKAGFIENGWxxxxxxxxxxxxxxxxxxx
xAADYKSTQKTIDQVTGKLNRLIxxxxxxxxSIESEFSETEHQIGNVIxxxxxxxxxxxTYNAELLVAMExxxxxDMADSTMLNLYERVxxxxxxx
xxxxxKGCFEIYHACDNNCMESIRNNTYDHSQYREEALLNRLNINSVKLSSGYKxxxxxxxxxASCFVLLAAIMGLFFFCLKNGNxxxxxxx
>Protein:HA|Subtype:H10N7|Blocksize:9|String:4
xxxxxxxxxxxxxxxSLDKICLGHHAIPNGTVVKTLTNEHEEVTNATETVESRxxxxxxxxxxxYKDLDNCHPIGMLIGAPACDLHLTGKWDTL
IERENSIAYCYPGSTVNEEALRxxxMESGGIDKVSTxFTYESSINPAGxxxxxxxxGRNSFYAELKWLVSKNKGQSFPQTTNTYRNTDPxEH
LIMWGIHHPSSTKEKNELYGTQSLSISIGSSTYQNNxxxxxxxxxxxxxxxxxxxxxxxxxQPGDNIIFSHNGGLIAPSRVSKLRGRDLGIQSExxxx
xxxxxxxxWRGGSINTRLPFQNLSPxxxGQCPKYVSQGSLLLATGMxxxxxxxxxxxxxxxxxxxxxxxxxxxxxxxxxxxxxDYKSTQAAV
DQITGKLNxxxxxxxxxxxxxESEFNEIEYQIGNVINWxxxxxxxxxxxxxxxxxxxxxxxxxxxxxxxxxxxxxxxxxxxxxxxxxxxxKGCFEIYHTCDDPCM
ESIRDNTYDHxxxxxxxxxNRLNINPVTLSSGYKDIxxxxxxxASCFVLLAIVMGLVFFCLRNGNMRCTIxx
>Protein:HA|Subtype:H10N7|Blocksize:9|String:5
xxxxxxxxxxxxxxxxxxxxxxGHHAVTNGTIIKTLTNEKEKVTNATETVxxxxxxxxxxxxxxYRDLGNCHPIGMVVGAPSCDLHLTGIWDTLIER
DNAIANCYPGATVNEGALRQKIMESGGIDKIGTxFTYGSSITSAGxxxxxxxxxxxxxxxELKWLVSKDKGRNFPQTTNTxxxxxxxEHLVMW
GIHHPSSTQEKNALYGTQSLSISVESSTYQNSFVPVxxxxxxxxxxxxxxxxxxxxxxxxxxxxFSHNGGLVAPSRVSKLIGKGLGIQSGxxxxxxxxx
xxxxxxxxxxxxxxxxxxxxxxxxxxxxxxxxRSLMLATGMxxxxxxxxxxxxxxxxxxxxxxxxxxxxxxxxxxxxxxxxxxxxxxxxxSTQATIDQITGKLxxxxxx
xxxxxxxxxxxxxxxxxxxxxxxxxxxxxxxxxxxxxxxxxxxxxxxxxxxxxxxxxxxxxxxxxxxxxxxxxxxxKGCFEIYHNCDDNCMERIRNNTYDxxxxxxx
xxxNRLNINPVRLSSGYKDIxxxxxxxASCFVLLADxxxxxxxxxxxxxxxxxxxx
>Protein:HA|Subtype:H10N7|Blocksize:9|String:6
xxxxxxxxxxxxxxxxxxxxxxxHHAVANGTVVKTLTNEREEVTNATxxxxxxxxxxxxxxxxxxxxxxxxxxxxxxxxxxxxDLHLTGMWDTLIERDxxx
AYCYPGATMxxxxxxxxxxxxxxxxxxxxxxYGASINSAGxxxxxxxxxxxxxxxxxxxxxxxxxxxxxxxxxxxxxxxxxxxHIIMWGIHHxSSTQERNDL
YGTQSxxxxVGSSTYQNSFxxxxxxxxxxxxxxxxxxAPSRVSKLTGxxxxxxxxxxxxxxxxxxxxxxxxxxxxxxxxxxxxxxxx

FIG. 76-111 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxCFEIYHRCDDNCMESIRDNxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSCF
VLLAVVxxxxxxxxxxxxxxxxx >Protein:HA|Subtype:H10N7|Blocksize:9|String:7
xxxxxxxxxxxxxxxxxxxxxxxxxxxSNGTIIKTLxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxGSSTYHNSFVPV
VGxxxxxxxxxxxxxxxxxxxxxxxxxxxxxxxxxxxxxxxxxxxxxxxxxxxxx

FIG. 76-112

TIxxxxxxEMLKIPNAETDPNSxxTGRQEIVDNNNLSGYSGSFIDYWDDxSVCYNPCFYVxxxxxxxxxxxxxxxxxxxxxxxxxLVALCGSPVSVGSGS
FPNGAQIQYFS
>Protein:NA|Subtype:H10N7|Blocksize:9|String:4
xxPNQNLFTLSGVAISLSxFNLLIGISNxxxxxxxxERGTKQEENxxxxxxTGTAKQNYLxxYVNNTTIINKxxxxxxxxYLMLSKSLCKVEGxx
xxxxxxIRFGESEQVIVTREPYVSCDPLGCRMYALHQG

FIG. 76-113 xxxxxxxxxLYKKDSSYVxxxxxxxxxxxxxxxxxxxxxVNGQAGRMTFYWTIVxxxxxTFESNGAFLAPRYAFELVSxxxxxxxxxxxxxxxxxKCQS
EIGGINTxxxxHNVHRNTIGDCPKYVNVKSLKLATGLRNVPAIATRGLFGAIAGFIEGGWPGLINGWYGFQHRNEEGTGIAADKESTQK
AxxxxxxxxxxxxxxxxxxxxxxxxIEERINQLSxxxxxxxxDIWSYNAQLLVLLENEKTLDLHDSNVRNLHEKVRRMLKDNAKDEGNGCFT
FYHKCDNECIEKVRNGTYDHKEFEEESKLNRQEIEGVKLDxxGNVYKILSIYSCIASSLVLAAIIMGxxxWACSNGSCRCTICl
>Protein:HA|Subtype:H11|Blocksize:9|String:2
xxxxxxxxxxxxxxxxxKADEICIGYMSNNSTEKVDTIIENNVTVTSSVELVETxHTGSFCSINGKQPISLGDCSFTGWILGNPRCDDLIGKNSWSY
IVEKTNPANGICYPGSLDxxxxxxxxxxxxxxxxxxxxxxxxxxxxxxSFFRHMVWLIHQSETYPVIxxFNNTKERDVxxxxxxx
xxxxxxxxxLYKKDSSYIxxxxxxxxxxxxxxxxxxxxxxxxxxxTFESNGAFIAPRYAFELVFxxxxxxxxxxxxxxxK

FIG. 76-114 xxxxxxxxxxxxxxxxxxxxxxxxxxRMTFYWTIIxxxxxxxxSNGAFLAPGYAFEIVxxxxxxxxxxxxxxxxxxxxxxxxxxxxxxxxxxxxxNVHRNTIGNC
PKYVNVKSLKLAIGPRNVPAIxxxxxxxxxxxxxxxxxxxxLHEKVRQMLxxxxRDEGNGCFTxYHKCDNGCIxxxxxxxHKEFEKESKLNRQEIGGxxxxxxxxxxxx
xxxxxxxxxSSLVLAALNMGxxxxxxxxxxxxxxxxxx
>

FIG. 76-115

MEKFITLSTxxxxxVAYDKICIGxxxxSTETVNTLSEQNVPVTQVEELVHGQVNPxxxxTKLGSPLVLDDCSLEGIILGNPKCDLYLSGREW
SYIVERPKEIEGICYPGSIKNQEELRSLxxxxxxERVKMFDFIKWNVTYTGTSRACNNTSNQDSFYRSMKWLTLKSGQxxxxxxEYKNTR
DSNIxFIWAIHHPPTSNEQVxxxxxxxxxxxxxEINRIFRPNIGPR

FIG. 76-116

>Protein:HA|Subtype:H13|Blocksize:9|String:2
xxxxxxxxxxxxxxxxxxADRICIGYLSTNSSDKVDTLLENDVPVTSSIDLIETNHTGTYCSLDGVSPVHLGDCRFEGWIVGNPSCxxxxGVREW
SYLIEDPGAPHGLCYPGELNNNGELRHLFSGIKSFSRTELIPPxxxxxxxxxxxxxxxxxxTGTSSFYRNLIWFVxxxxxxxxxxxxGTYNNTTGRDVL
VMWGIHHPxxxxxxxxxxxxxxPYTLVSTKSWSxxxxxxxGIRPGYNGQKSWMKIYWYLxxxxxxITFESNGGLLAPKYGYIIEEYGRGRIFQSR
IIxxRCNTKCQTSVGGIDTNKTFQNIDKNALGDCPKYIKSDQLKLATGLKNVPAxxxRAVDGTIAGFIEGGxxxxxxxxxxFQHQNEQGTGI
AADKESTQKAIDRITTKINNIIEKMNGNYDSIRGEFSQVEQRINMLADRIDDAVTDIWSYNAKLLxLLENDKTLNMHDANVRNLHEQV
RxxxxxNAVDEGNGCFELLHKCNNSCMETIRNGTYDHTEYEEESKLKRQEINGIKLKSDDSVYKALSIYSCIASSIVLVGLILSFIMWACS
NGSCRFNxxx
>Protein:HA|Subtype:H13|Blocksize:9|String:3
xxxxxxxxxxxxxxxxxADKICVGYLSTNSTEKVDTLLENNVPVTSSVDLIETTHTGTYCSLGGxSPVHLGDCNFEGWIVGNxxxxxxxGTREW
SYLIEDPAAPHGLCYPxxxxxxxxxxxxxxGIKSFSRTQLIAPxxxxxxxxxxxxxxxxxxTGTNSFYRNLAWFVxxxxxxxxxxxxRTYNNTTGRDVLVI
WGIHHPxxxxxxxxxxxxxxPYTLVSTGSWSxxxxxxxGTRPGYNGQKSWTKIYWYLxxxxxxITFESNGGFLAPRYGYIxxxxGKGRIFQSPIRxx
RCNTRCQTSVGGINTNRTFQNIDKNALGECPKYIKSDxxKLATGLRNIPAxxxRGFFGAIAGFIxxxxxxxxxxxxxFQHQNEQGMGMAADK
ESxxxxxxxxxxxxxxxxxxxxxxxxxxRGEFNQVENRINMLADRxxxxxTDIWSYNARLLVLLENDKTLDLHDANVRNLHDQIRxxxxxNAINEG
NGCFELLHKCNNTCMETIRNGTYNHAKYEEESKLKRQEIDGIKLKSDDNVYKALSxxSCIASSIVMVGLILAFIMWTCNSGNCRFNxxx
>Protein:HA|Subtype:H13|Blocksize:9|String:4
xxxxxxxxxxxxxxxxxxxxxxxxYLSTNSSEKVDTLLESDVPVTSSIDLVETSHTGTYCSLSGxxxxxxxDCSFEGWIGGNPACxxxxxxxxWSYLIE
DPTAPHGLCYPxxxxxxxxxxxxxxxxxxxxxxxxxxxxxxxxxxxxxxxxxxxxxRGTNSFYRNLVWLVxxxxxxxxxxxxGAYNNTTGRDVLVMWGLH
HPxxxxxxxxxxxxxxPYTLVTTSSWSxxxxxxxGVRPRYNGQRSWMKIYWVLxxxxxxVSFESNGGLxxxxxxxxxxxxGKGRIFQSHIRxxxxxxxx
xxxxxxxxxNRTFQNIDRNALGDCPxxxxxxxxxxxATGLRNVPTxxxRGLLGAIAGFIExxxxxxxxxxxxxxxHQNEQGVGIAADKESxxxxxxxxxxxx
xxxxxxxxxxxxxxRGEFSQVERRINMLADRxxxxxxxxxxxxxxxxxxxxxxxxLDMHDANVKNLHEQVRxxxxxxxxxxxxxxxxxxHKCNDSCMDT
IRNGTYNHIxxxxxxxxKRQEIEGIRLKSEDGVYKALSIYxxxASSVVLVGPILSFIMWAGxxxxxxxxxxx
>Protein:HA|Subtype:H13|Blocksize:9|String:5
xxxxxxxxxxxxxxxxxxxxxxxxxxSTNSSEKVNTLLENDVPVTSTIDLIETxxxxxxxxxxxxxxxxxxxxxxxxxxxxxxxxxxxxxxxxxxxxxxIEDPSAPHRL
CYPGELDxxxxxxxxxxxxxxxxxxxxxxxxxxxxxxxxxxxxxxxxxxxKGFNSFYRNLVWFIxxxxxxxxxxxxGVYNNTTGRDxxxxxxxxxxxxxxxxxxxxxxxx
xPYTLVSTRSWSxxxxxxxxVRPGYNGQKSWMKIYWDLxxxxxxxxxxxxxxxxxxxxxxxxxxxxxxxxxxxxxxxxxxxxxxxxxxxxxxxxxxxxxxxxxNIERN
ALGNCPKYIKSGxxxxATGLRNVPSxxxxxxxxxxxxxxxxxxxxxxxxxxxxxxxxxxEQGTGIAAEKESTQKAIxxxxxxxxxxxxxxxxxxxxxxRGEFNQV
EQRINMxxxxxxxxxxxxxxxxxxxxxxxxxxxxxxxxxxxxxNVRNLHEQIKxxxxxxxxxxxxxxxxxxxxxxxxxxxxxIRNGTYNHSxxxxxxxxxxxQEIEGIKLE
SEDNVYRALSIYSCIxxxxVLVGLILTFIMWACNSGNCRFxxxx
>Protein:HA|Subtype:H13|Blocksize:9|String:6
xxxxxxxxxxxxxxxxxxxxxxxxxxxxxxxxxxxxxxxxENGVPVTSTxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxGFYRNLVWFxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-117 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxIMWACSNGNCRFN
xxx >Protein:HA|Subtype:H13|Blocksize:9|String:7

FIG. 76-118

SLGxxxxxxxxxxxxxxxxxxxxLPFQNIDSWAVGRCPRYVKQSxxxxxxMKNVPEKIHTRGLFGAIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxNRLIEKTNTQFELIDNExxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxMINPVKLSGGYKDVILWxxxxxxxxxxxxxxxxxxxxxxxxxxxxxxxxxxxxxxxxxx
>Protein:HA|Subtype:H15|Blocksize:9|String:3
xxxxxxxxxxxxxxxxxxxxxxxxxxxxxxxxxxxxxxxxxxxxxxxxxxxEMKWLSSSGNNQVFPQLxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxKNVPEKIRVKRRPVAKAGFIENGWxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxx

FIG. 76-119 xxxxxxxxxxxxxGRYSIADKICIGYLSNNSTDKVDTLTENGVPVTSSVxxxxxxxxxCSLNGVSPVHLGDCSFExxxxxxxxxxxxxxxxx
xEDPNAPNKFCYPGELDNNGxxxxxxxxxSFSRTELIPPSKWGDVLDGVTASCRDNGADSFYRNLIWLVKxxxxxxxVKGDYNNTTxxxxx
xxxGIHHPDTETTANKLYVNKNPxxxxxxxxxKRYELEIGARIGEGQRSxMKLYWHLMHPGERTTFESNGGLIxxxxxxxxxGTGRIFQSRI
RMGKCNTKCQTSLGGIxxNKTFQ

FIG. 76-120

```
xxGKTKATKMEAILVVxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxSNAPSGVEYNGKSLGxxxxxxxxx
xxxxxxxxxxxxxxxxxxxxxxxxxxxxxxxxxxxxxxxxxxxxxxxxxxxxxxxxGAIAGFIENGWEGMVDGWYGFRHQNxxxxxxxxxxxxxxxxxxx
xxxxxxxxxxxxxxxxxxxxxxxxxxxxxxxxxxxxxxxxYQAELLVAMENQHTIDxxxxxxxxxxxxxxxxxxGKGCFEIYHxxxxxxxxxxxxxxxxx
xxxxxxxxxxxxxxxxxxxxxxxxxLSIYSCIASxxxxxxxxxxxxxxxxxxxxxxxxxxxxxxxxxxQCRICIRADGxxxxxx
>Protein:HA|Sub

FIG. 76-121

KQGKTKATKMKAILVVLxxxxxxxADTLCIGYHANNSTDTVDTVLEKNVTVTHSVNLLExxxxxxxxxxxxxxxxxxxxxxIAGWILGNPECx
xxxxxxxxxxxxxxxxxxxxxxxxxDYEELREQLSSVSSFERFEIFPKxxxxxxxxxxxxxxxxxxxxxxxxxxxxxxxxxxxKEKENSYPMIxxxxxxxxxxV
LVLWGIHHPxxxxxxxxxxxxxxxxxxxxxxxxxxxxxxxxxxxxxxxxxxxxGRMNYYWTLxxxDKITFEATGNLVPxxxxxxxxxxxxxxxxxxxxxxxxx
xxxxxxx

FIG. 76-122

FSxxxxxxxxNKKVDDGFIDIWTYNAExxxxxxERTLDYHDFxxxxxxxxxxxxxxxxxxxxxxxxxxxxxxxxxxxxxxxxxxxxxxxxPKYSKEAKLxxxx
xxxxxxxxxxxxxxxxxxxxxxxxxxxxxxASSLVLIVSLGAIGFWMCSNGSGSLQCRICIQCRICILDQNFRNxxx
>Protein:HA|Subtype:H1N1|Blocksize:9|String:6
xxxxxxxxxxxxxxxxxxxxxxxxxxxxFERFEIFPNxxxxxxx

FIG. 76-123

MIWDPNGWTxxxxxxxxxxxxxxNEWSGYSGSFVQHPELTGLDCIRPCFWVELIRGRPxxTTIWTSGSSISFCGVNSxxxGWSWPDGAELP
FTIxxx
>Protein:NA|Subtype:H1N1|Blocksize:9|String:2 xxxxxxxxxxxxxxx

FIG. 76-124

```
xxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxIWIGRTKSTxxxxxxxxxxxxxxxxxxxxxxxxx
xxxxxxxxxxxxxxxxxxxxxxxxx
>Protein:HA|Subtype:H1N2|Blocksize:9|String:1
xxxxxxxxxxxxxxxxDTICIGYHANNSTDTVDTxxxKNVTVTHSVNLLExxxxxxxxxxxxxxxxxxxVAGWILGNPECxxxxxxxxxxxxxxxxxx
xxxxxxxxxxxxYEELREQLSxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxPFQNVHPVTIGECPKYVK
SxxLRMVTGLRNxxSIQSRGLFGAIAGFIEGGWTGMIDGWYGYxxxNEQGSGYAADxxxxxxxxxxxxxxxxxxxxxxEN
LNKKVDDGFxDIWTYNAELLVLLENERTLDFHD

FIG. 76-125

```
xxxxxxxxxxxxxxxxxxxxTLCICYHANxxxxxxxxxxKNVTVTHAVxxxxxxxxxxxxxxxxxxxxxxxxxxxxxxxxVVGWISGNPxxxxxxxxxxxxxxxxxxxxx
xxxxxxxxxxYEELREQMSxxxxxxxxxxxxxxxxxxxxxxxxxxxxxxxxxxxxxxxxxxxxxxxxxxxxxxxxxxxxxxxxxPFQNIHPATIGECPKYxxxxL
RMARGLRNxxSIQTRGLFGAIAxxxxxxxxxxxxxxxxxxEQGYGYAADxxxxxxxxxxxxxxxxxxxxxxxxxxxxxx

FIG. 76-126

RPIVDxxxxxxxSSYICSGLVGDTxxxxxxxxxxxxxxxGNPGVKGWAFDYxxxxxxxxxxxxxxRSGYETFRVIxxxxxxxxxxxxxxxxxxxxxxx
RSGYSGVFSVEx

FIG. 76-127 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxTYGAGS WPDxxxxxxxxxx >Protein:HA|Subtype:H2|Blocksize:9|String:1
MDNQTKTMTITFLILxxxxxG

FIG. 76-128 xxxxxxxxxxxxxxxxxxxxxxxDQICVGYHANNSTERVDTxxxxxVTVTHAEDILEKAHNGKLCRLNGVPPLELGDCxxxxxxLGNPECDLFLxxx
EWSYIMEKKxxxxxxxxxxxxxxxxxxxxxxxxxxxxxxxxxxxxxxxxxxxxxxxxxxxxxxxxxxxxxxxxxxxxxxxRSYNNTSGG

FIG. 76-129

>Protein:HA|Subtype:H2N2|Blocksize:9|String:3
xxxxxxxxxxxxVRGDQICVGYHSNNSTKKVDTNLERNVTVTHAKNILEKTHNGKLCRLSGIPPLExGNCSIAGWLxxNPECDRLLTVPEW
SYIIEKENPxxSLCYPGSLNDYEELKHFxxxVKHFEKVRILPKDxxxxxxxxxxxxxxxxPSFFRNMIWLTxxxxxxxVAKRSYNNTNGEQILII
WGIHHPNDExxxxxLYQEVGTYVSxxxxxxxxxxxxxxxxxxxxxxxxxRMEFFWTLLxxWDVISFESTGNLIAPEYGFRISKRGSSGVMKTEGTL
xDCETKCQTPLGALNTTLPFHNVHPLAIGECPKYVRSEKLVLATGLRNIPQIESRGLxxxxxxxxxxxxxxxxxxxxxxxxxxxxxxxGSGYAADKAST
QKAIxxxxxxVNFVIEKMNTQSEAVGKEFGNLERRLENLNKRMEDGFLGVWTYNAxxxxLMENERILDFHDSNVKSLYDKVRMQLRDN
AKEIGNxxFEFYHKCDNECMDSVKNGTYYYPKYEEESRLNRNEIKGVKLSNMGVYQILAxxxxxxGSLSLAIMVAGISxxxxxNGSLQCR
VCI
>Protein:HA|Subtype:H2N2|Blocksize:9|String:4
xxxxxxxxxxxxVKGDRICIGYHANNSTETVDTILERNxxxTHAQDILERTHNGKLCRLRGIPPLELGxxxxxxxxxxNPECDRLLNVPEWSYIV
EKENPxxSLCYPGNFNDYEELKLLxxxVRHFEKVKILPRDxxxxxxxxxxxxxxxxxxxxxxxxxxxxVAQGSYNNTSGKQMLIIWGV
HHPIDExxxxxLYQNVETYVSxxxxxxxxxxxxxxxxxxxxxxxxxxxRMEFSWILLxxLDTINFESTxxLVVPEYGFKISKRGGSGIMKTERTLxNCDT
KCQTPLGxxxxxxxxxxxxHPLTMGECPKYVKSDRLVLATGLRNAHKMESRGLFGAxxxxxxxxxxxxxxxxxxxxxxxxxxxxxxxxDKESTQKAIxx
xxxxENSVIEKMNIQFEAVEKEFSNLEKRLENLNKKVEDGFLDVWTYNTELxxxxENERTLGFHDSNVKNLYNKVRMQLRDNAKELGN
GCFxxxxxxxxxCMSSVKNGTYNYPKYEEESKLKRNEIKGVKLSNMGIYQILAIYAxxxxxxxLAIMIAGIFLWMCSNGSxxxxxxx
>Protein:HA|Subtype:H2N2|Blocksize:9|String:5
xxxxxxxxxxxxxxxxxxxxxxxxNNSTEMVDTILERNxxxxHAQNILEKTHNxxxxxxxxxxxxxxxxxxxxxxxxxNPECDRFLSxxxWSYIVERETPxx
NLCYPGSLNDYEELKYLxxxVTHFEKIKILPRDxxxxxxxxxxxxxxxxxxxxxxxxxxxxxxxxxxxxxxVARGSYNNTSGEQMLVIWGVHHPKDEx
xxxxxxxxxxxxxxxxxxxxxxxxxxxxxxxxxxxxxxxxxxxxxxxxxxxWDTISFESTGNLVxxxxxxxxxxxxGSSGIMKTGGTLxNCETQCQTPLxxxxxxxx
xxxxxxxxxxxCPKYVKSERLVLATGLRNVPQMESRGLFGxxxxxxxxxxxxxxxxxxxxxxxxxxxxxxxxDKESTQKAVxxxxxxVNSVIEKINTQF
ESVGKEFSNLEKRLENLDKKMEDGFRDVWTYNAExxxxxxxxRTLDFHDSSVKNLYEKVRMQLRDxxxxxxxxxxxxxxxxxxxCMNSVKTG
TYDYPKYEEESKLNKNEIKGVKLSSMGIYQILAxxxxxxxxxxLAIMMAGIFFWMCSNGSxxxxxxx
>Protein:HA|Subtype:H2N2|Blocksize:9|String:6
xxxxxxxxxxxxxxxxxxxxxxxxxxxxxKADTILERNxxxxHAKDILEKAHNGKLCRxxxxxxxxxxxxxxxxxxxxxxxxxxxLIVPEWSYIxxxxxxxxxxx
xxxxFNDYEELKYxxxxxxxxxxxxxxxxxxxxxxxxxxxxxxxxxxxxxxxxxxxxxxxxAKGSYNNTNGExxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxEIKCQTPLGAxxxxxxxxxxxxxxxxCPKYVKSK
RLVLATGLxNVPQIEPRGLFGAIAxxxxxxxxxxxxxxxxxxxxxxxxxxxxxxxxxxxxxxxxxxxxxxxxxxxxxxKEFNNLEKRLENxxxxxEDG
LLDVWTYNAxxxxxxxxxxxxxxxxDSNVKNLYExxxxxxxxxxxxxxxxxxxxxxxxxxxxxxSVRNGTYNYPKxxxxxxxKRNEIKGVExxNMGVYQ
VLAIYATVxxxxxxxxxxxxxxxxxxxxxxxxxxxxxx
>Protein:HA|Subtype:H2N2|Blocksize:9|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSDRLVLAIGxxxxxxxxxxx
xxxxxxxxxxxxxxxxxxxxxxxxxxxxxxxxxxxxxxxxxxxxxxxxxxxxxxxxxxxxxxxxxxxxxxxEKRLGNLNKKMEDxxxxxxxxxxxxxxxxxxxxxxxxxxx

FIG. 76-130 xxxxxxDRVRMQLRDxxxxxxxxxxxxxxxxxxxxxxxxxxxxxxxxNGTYDYSKYEEESKLxxxxxxxxxxxxxxxxxxxxxxxxxxxxxxxxxxxxxxxxxxxxxxxx
xxx
>Protein:NA|Subtype:H2N2|Blocksize:9|String:1
MNPNQKIITIGSVSLTxxxxxxQIAILATTVTLHFKQHECDxxxxxxxPCEPIIERNxTEIVYLNNTTxxxxxxxxxYRNWSKPQCQITGFA
PFSKDNSIRLSAGGDIWVTREPYVSCDPGKCYQFALGQGTTLDNKHSNGTIHDRIPHRTLLMNELGVPFHLGTKQVCVAWSSSSCHDG
KAWLHVCVTGDDRNATASFIYDGxxxDSIGSWSQNILRTQESECVCINGTCTVVMTDGSASGRADTRILFIKEGKIVHISPLSGSAQHIEE
CSCYPRYPDVRCICRD

FIG. 76-131

NWxGSNRPIVDINMVDYSIDSGYVCSGLVGDTPRNDDRSSSSNCRNPNNEKGYPGVKGWAxxxGDDVLMGRTIxxxxxxxTFRVIGG
WTTxxxxxxxxxxxKNNWSGYSGxxxxxxKNCINRCFYVELIRGMPQEARVWTSNSxxxxxxxxxxxxWPDGANINLMPI
>Protein:NA|Subtype:H2N2|Blocksize:9|String:6
xxxxxxxITIGFVSL

FIG. 76-132

```
>Protein:HA|Subtype:H3|Bl

FIG. 76-133

>Protein:HA|Subtype:H3|Blocksize:9|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxWYGFRYQNSEGxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxx
>Protein:HA|Subtype:H3|Blocksize:9|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxWYGFRHHNSEGxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxx
>Protein:HA|Subtype:H3|Blocksize:9|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxWYGFRHLNSEGxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxx
>Protein:HA|Subtype:H3N2|Blocksize:9|String:1
HSMSGFRSNLxxxxxxxxxxxxxNNNNNTATLLCLGHHAVPNGTIVKTITxDQIEVTNATELVQSxxxxxxxxxxxxxxxxxKNCTLIDALLGDPQ
CDxxxxxxxxxxxxxxxxxxxCYPYDVPDYxSLRSLVASSGTLEFxxxxxxxxxxxxxxxxxxxxxxxxxSFFSRLNWLTxxxxxxxxxxxxxxxxxxFDKLYI
WGVHHPxxxxxxxxxxxxxxxxxxxxxxxxxxxxxxxxxxxxxxxxxxxxSIYWTIVKPGDxxxxxSTGNLIAPRGYFKIxxxxLNNEIRWPPxxxxxxSECI
TPNGSIPNDKPFQNVNRITYGACPRYVKQNTLKLATGMRNVPEKQTRGIFGAIAGFIENGWEGMVDGWYGFRHQNxNSEGTGQAAD
LKSTQAAINQIxxxxxxxIGKTNEKFHQIEKEFSEVEGRIQDLEKYVEDTKIDLWSYNAELLVALENQHTIDLTDSEMNKLFERTKKQLRE
NAEDMGNGCFKIYHKCDNACIGSIRNGTYDHDxYRDEALNNRFQIKxxxxxxGYKDWILWISFAISCFLLCxxxLGFIMWACQKGNIRCNI
CI
>Protein:HA|Subtype:H3N2|Blocksize:9|String:2
xMKTIIIVLSxxxxxxxxxxxxxxxxNNSTATLCLGHHAVPNGTLVKTITxDHIEVTNATELVQNxxxxxxxxxxxxxxxxxxxCTLMDALLGDPHC
DxxxxxxxxxxxxxxxxxxxCYPYYVPDYxSLRSLIASSGTLEFxxxxxxxxxxxxxxxxxxxxxxxxxGFFSRLNWLHxxxxxxxxxxxxxxxxxxFDKLYV
WGVHHPxxxxxxxxxxxxxxxxxxxxxxxxxxxxxxxxxxxxxxxxxxxxSVYWTVVKPGDxxxxxSNGNLIAPRGYYKMxxxxxxxxxxxxxxxxxxxSA
CITPNGSISNDKPFQNVNKITYGACPKYVKQSTLKLATGMRNIPEKQTRGLFGAIAGFIENGWEGMMDGWYGFRHHNxNSEGIGQAA
DLKSTQAAVNQIxxxxxxxIEKTNEKFHQxxKEFTEVEGRIQDLERYVEDTKIDLWSYNAGLLVALENQNTIDLTDSEMSKLFERTRKQL

FIG. 76-134

RENAEEMGNGCFKIYHKCNNxCIESIRNGTYDHNxYRDEAVNNRFQIKxxxxxGYKDWVLWISFAISxxxxxxLGFIVWACQRGNIRC
NICx
>Protein:HA|Subtype:H3N2|Blocksize:9|String:3
xxxxxxxxxxxxxxxxxxxxxxxxxxxxxMATLCLGHHAVPNGTVVKTITxDQVEVTN

FIG. 76-135 xxxxxxx
>Protein:HA|Subtype:H3N2|Blocksize:9|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-136

>Protein:NA|Subtype:H3N2|Blocksize:9|String:4
xxxxxxMNPIKKIITxxxxxxxxxxxxxxxxxxxxxxxxxxxxxxxxxxxxxxxxxxxxxxxxxxxxxxxxxxxxxxxxxxxxxxxxxYRSWSKPQCxxxxxxxxxx
xxxxxxxxxxDIWVTRVPYxxxxxNKCYQFALGxxxxxxxxxxxxxxxxxxxxxxxLMSELGVPFHLGTKQVCMxxxxxxxxxxxxxxxxxxxxxxNNAT
ASFIYxxxxxxxxxxxxxDILRTQESECVCISGTCAVVMTDGNASGxxxxxxxxxxxxxxxxxxxxxLSGNAQHVEECSCYPRYPNxxxxxxxxWKG
SNRPVIDINxxxxxxxSSYLCSGLVGDTxxxxxxxxxxxxxxxxxxxxxxxVKGWAFDYGNDIWMGRTISxxxxLGYETFKVVxxxxxxxxxxxxxxxxx
xxxxxRSGYSGVFSVEGKxxxxxxxxxxxxxxxxxxKVWWTSNSIxxxxxxxxxxxTGSWPDGAEIxxxxxxxxxxx
>Protein:NA|Subtype:H3N2|Blocksize:9|String:5
xxxxxxMNPNQRIITxxxxxxxxxxxxxxxxxxxxxxxxxxxxxxxxxxxxxxxxxxxxxxxxxxxxxxxxxxxxxxxxxxxxxxxxYRNWTKPQCxxxxxxxxx
xxxxxxxxxxxxxxxTREPYVSCGxxxxxxxxxxxxxxxxxxxxxxxxxxxxxxxxxxxxxxxxGVPFYLGTKQxxxxxxxxxxxxxxxxxxxxxxxxxRNATASFVY
DGxxxxxxxxxxxxxxxxxxxxxxxINGICTVVMTDGNAxxxxxxxxxxxxxxxxxxxxxxxxLSGGAQHVExCSCYPRYPDxxxxxxxxWKGSNRPIIDI
NxxxxxxxxxxxxxxxxxxxxxxxxxxxxxxxxxxxxxxxxxxxxxxxxxGNDLWMGRTIxxxxxxxxxxxxxxxxxxxxxxxxxxxxxxxxxxxxxxxxxxxxxxxxxxx
xxxxxxxxxxxxxxxxxxDVLWTSNSIxxxxxxxxxxxxxxxxxxADINLMPIYSxxxx
>Protein:NA|Subtype:H3N2|Blocksize:9|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxVMTDGSASDxxxxxxxxxxxxxxxxxxxxxxxxxxxxxxxxxxxxxxxxxxxxxxxxxxxxxSNRPVVDIRxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxADIKSHAYISxxxx
>Protein:HA|Subtype:H4|Blocksize:9|String:1
xxxxxxxxxxxxxxxxxYTGNPVICLGHHAVVPNGTMVKTLTDxxIEVVTAQELVESQxxxELCPSPLRLVDGQxCDIVNGALGSPGCDHLxx
xEWDVFIERPxxxDTCYPFDVPDYQSLRSILANNGKFEFIAEEFxxxTVKQNGKSGACKRANxNDFFNRLNWLxxxxxxAYPLQNLTKVNN
GDYARLYIWGVHHPSTDTEQxxLYKNNPGRVTVSTKxxQTSVVPNIGxRPWVRGQSGRISFYWTIVEPGDLIVFNTIGNLIAPRGHYKLx
xxxxxxxxxxxxxIGSCVSKCHTDRGSxxxxKPFQNISRISxGDCPKYVKQGSLKLATGMRNIPEKxxRGLFGAIAGFIENGWQGLIDGWYGF
RHQNAEGTGTAADLKSTQAAIDQINGKLNRLIEKTNEKYHQIEKEFEQVEGRIQDLEKYVEDTKIDLWSYNAELLVALENQHTIDVTD
SEMNKLFERVRRQLRENAEDKGNGCFEIFHQCDNNCIESIRNGTYDHDIYRDEAINNRFQIQGVKLTQGYKDIILWISFSISCFLLVSCFL
LVALLLAFILWACQNGNIRCQICI
>Protein:HA|Subtype:H4|Blocksize:9|String:2
xxxxxxxxxxxxxxxxxYTGNPVICMGHHAVVSNGTMVKTLADxxVEVVTAQELVEAQxxxELCPSPLKLIDGQxCDIINGALGSPGCDRLxx
xEWDIFIERPxxxxTCYPFDVPEYQSLRSILANNGRFEFIAEEFxxxTVKQNGKSSACKRANxNDFFRRLNWLxxxxxxEYPLQNLTKINNGD
YTRLYIWGVHHPSTDKEQxxLYKNSPGRVTVSTQxxQTSVVPNIDxRPLVRGQSGRVSFYWTIVEPEDLIVFNTIGNLVAPRGHYKLxxxx
xxxxxxxxxxIGSCASKCHTDKGSxxxxKPFQNISRVSxGDCPKYIKQGSLKLATGMRNIPERxxKGLFGAIAGxxxxxxxxxxxxWYGFRHQNS
EGTGTAADLKSTQTAIDQINGKLNRLIERTNEKYHQIEKEFGQVEGRIQDLERYVEDTKIDxxxxxxxxxxxLENQHTIDMTDSEMNKLFE
RVKRQLRENAEDRGNGCFEIFHKCDNSCIESIRNGTYNHDVYRDEAISNRFQIQGVRLTQGYKDIILWVSFSISCFLLASCFLLAALLLA
FVLWACQNGNLRCQICI
>Protein:HA|Subtype:H4|Blocksize:9|String:3

FIG. 76-137 xxxxxxxxxxxxxxxxYTENPVICLGHHSVVANGTMVKTLTGxxIEVVAAQELVESQxxxELCPKPLKLVDGQxCDIVNSALGSPGCDxxxx
xEWDVYIERPxxxxTCYPFDVPGYQSLRSILxNNGKFEFIVEKFxxxTVKQDGKSSACKRxxxDDFFNRLNWxxxxxxAYPFQNLTKVNSG
DYARLYIxGVHHPSTDAEQxxLYENNPGRVTVSTRxxQTSIVPNIGxRPLVRSQSGRISFYWTIVDPGDIIVFNTIGNLIAPRGHYRLxxxxxxx
xxxxxxxIGSCESKCHTEKGSxxxxKPFQNVSRIAxGECPKYVKQGSLRLATGMRNIxxxxxxxxxxxxxxxxxxxxxxxxxxxxxxxxxxxxxxx
KSTQAAIDKINGKLNRLIEKTNDKYHQIEKEFEQVEGRTQDLEN

FIG. 76-138

>Protein:HA|Subtype:H4|Blocksize:9|String:8
xxxxxxxxxxxxxxxxxxxxxxxxxxxxxGHHAVTNGTMVKTxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxSISCFLLIALxxxxFIWGLSEWKxx
xxxxx
>Protein:HA|Subtype:H5|Blocksize:9|String:1
SVKMEKIVLLLxxxxxxxSDQICIGYHxxxxxxxxQVDTIMEKNVTVTHAQDILEKxxxxxxxxxxxxKPLILRDCSVAGWLLGNPMCDEFxxVP
EWSYIVEKxxxxxxxxxxxxxxxxxxxxxxxxxxxxxxxxxxxxADHPPKVAWxxxxxxxxxxxxxxxxxNGRSSFFRNxxxxxxxxxxxxxxxxxxxxxxxxxLLV
LWGIHHxxxxxxxxxxxxxxxxYISVGTSTLNQRLxxxxxxxxxxxxxxxxxxxxxxxxxxxxxxxxFESNGNFIAPEYAYKIxxxxxxxxxxxxxxxxxxxPSV
KLPMGAIGAIDSSMPFHNIHPLTIGECPKYVKSxxLVLATGLRNxxxREREGGRRRKRGLFGRRGLFGAIAGFIEGGWQGMVDGWYGY
HHSNEQGSGYAADKESTQKAIDGVTNKVNSIIDKMNTQFxxxxxxxxxLERRIENLNKKMEDGFLDVWTYNAELLVLMENERTLDFHDS
NVKNLYDKVRLQLRDNAKELGNGCFEFYHKCDNxCMESVRNGTYxxxxxxxxxxxxxxxxxxxxxxxxxTYQILSIYSTVASSLSTGNHGSLV
LSLWxAGLSLWMCSNGSLQCRICIKFVSSDCSx
>Protein:HA|Subtype:H5|Blocksize:9|String:2
ICQMEKIVLLFxxxxxxxGDQICIGYHxxxxxxxxQIDTIMEKNVTVTHAKDILEKxxxxxxxxxxxxKPLILKDCSVAGWLLGNPLCDEFxxVSE
WSYIVEKxxxxxxxxxxxxxxxxxxxxxxxxxxxxxxxxxxxxxxxxxxxxxxxxxxxxxxxxxxTGRSSFFRNxxxxxxxxxxxxxxxxxxxxxxxxxLLILWGIH
HxxxxxxxxxxxxxxxxYVSVGTSTLNLRLxxxxxxxxxxxxxxxxxxxxxxxxxxxxxxxxFESTGNFIAPEYAYIVxxxxxxxxxxxxxxxxxxxxxCQTPMG
AINxxxSSMPFHNVHPLTIGKCPKYVKSxxLVLATGPRNxxxxxxxxxRRKKRGLFGxxxxxxxxxxxIEGGWQGMIDGWYGYHHNNGQGSG
YAADQESTQKAINGITNKVNSIINKMNTQFxxxxxxxxxLEKRIENLNRKMEDGFLNVWTYNAELxxxMENERTLDLHDSNVKNLYEKV
RLQLKDNAKELGNGCFEFYHRCDNxCMESIRNGTYxxxxxxxxxxxxxxxxxxxxxxxxxIYQILSIYSTAASSLxxxxxxxxxxxxxxAGLSFWMCS
NGSLQCKICIKICESRLRx
>Protein:HA|Subtype:H5|Blocksize:9|String:3
xxxxxxxxxxxxxxxxxxSDHICIGYHxxxxxxxxQVDTIMERNVTVTHAQNILEKxxxxxxxxxxxxRPLILKDCSIAGWLLGNPMCDKFxxAPEWS
YIVERxxxxxxxxxxxxxxxxxxxxxxxxxxxxxxxxxxxxxxxxxxxxxxxxxxxxxxxxxxSGRSSFFRNxxxxxxxxxxxxxxxxxxxxxxxxxLLIIWGIHHxx
xxxxxxxxxxxxxxYISIGTSTLNQRSxxxxxxxxxxxxxxxxxxxxxxxxxxxxxxxxFDSNGNFIAPENAYKIxxxxxxxxxxxxxxxxxxxxxxCQTPIGAINxx
xSSLPFHNVHPFTIGECPKYxxxxxLILATGLRNxxxxxxxxxRRKRGLFGAxxxxxxxxxxxxxxxxxxGMVDGWYGFHHSNDQGSGYAADREST
QKAVDGITNKVNSIIGKMNTQFxxxxxxxxxLERRIESLNKKMEDDFLDVWTYNAEILVLMENxxxLDFHDSNVRNLYDKVRHQLRDNA
RELGNGCFEFYHKCNNxCMESVKNGTYxxxxxxxxxxxxxxxxxxxxxxxxxVYQILSIYSTVVSSLxxxxxxxxxxxxxxAGLFLWMCSNGSYNxx
xxFKFVSSDCSx
>Protein:HA|Subtype:H5|Blocksize:9|String:4
xxxxxxxxxxxxxxxxxxGDRICIGYHxxxxxxxxHVDTIMEKNITVTHAQDILERxxxxxxxxxxxxRPLILRDCSVSGWLLGNPMCDAxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxLLVMWGIHHxxxxxx
xxxxxxxxxxYVSIGTSTLNQRMxxxxxxxxxxxxxxxxxxxxxxxxxxxxxxFESNGNFITPEYAYKIxxxxxxxxxxxxxxxxxxxxxxCQTPVGAINxxxS

FIG. 76-139

SMPLHNIHPLTIGECPRYVKSxxxxxxxxxxxxxxxxKRKKRGLFGxxxxxxxxxxxxxxxxxxxxxDGWYGYHHINxxGSGYAADKKSTQKAI
DGITNKINSIIDKMNIQFxxxxxxxxLEGRIENLNKKMEEGFIDVWTYNAExxxxxxxxxxxxxxxDSNVKNLYNKVRLQLKDNARELGNxxFE
FYHKCDDxCIESVRNGTYxxxxxxxxxxxxxxxxxxxxxxxxxxxxxTYQILSVYSTVASSPS

FIG. 76-140

```
xxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxTRGLFGAIAxxxxxxxxxxxxxxxxxxxxxxxxxxxxxxxxxxxxxxxx
xxxxxxxxxxxxxxxxxxxxxxxxxxxxxxxxxxxxxx
>Protein:HA|Subtype:H5N1|Blocksize:9|String:1
SVKMEKIVLLLxxxxxxxSDQICIG

FIG. 76-141

FYHKCDDxCIESVRNGTYNYxxxxxxxxxxGVYQILSIYSTVVSSLALAIMxxxxxxxAGLLLWMCSNGSLQCRVCIKFVSS
DCSx
>Protein:HA|Subtype:H5N1|Blocksize:9|String:5
xxxxxxxxxxxxxxxxxxDQICIGYHANNSTEHVDTIMERNVTVTHAQDILERxxxxxxLEGVKPLILRNCxxxxxxxxxxxxxxxxxxxxxxxx
xxxxxxxxxxFRDYEELKHLLSRTxxxxxxxxxxxxxxxxxxxxxxxxxxxxxxxxxxxxxxxxxxxxxxxxxxxxxxxxxxxxxxxxxxxxxxx
xxxTHISVGTSTxxxxxxxxxxxxxxxxxxxxxxxxxxxxxxxxxxxxxxPEYAYKVVKxxxxxxxxxxxxxCQTPLGAINSSMPxxxxx
xxxxxECPKYVKSTxxxxxxxxxxxxxxxxxxRKRGLFGAIxxxxxxxxxxWYGYHHSKEQGSGYAxxxSTQKAIDGITNKVNSIIDK
MNTQFETVxxxxxxxxxxxxxxxxxxxxxxxxxxxxxxxxxxxxxxxxxxxxxxxxxxxxxxxxxxxxxCMDSVRNGTYSYPQYxxx
xxxxxxxxxxxxxxxxxxxxxxxxxxYSTVASSLVLAIMxxxxxxxAGLSLWMCFNGSLQCRIAxxxxxxxxx
>Protein:HA|Subtype:H5N1|Blocksize:9|String:6
xxxxxxxxxxxxxxxxxxxxxxxxxxxxDHICIGYHANNSTKQVDTIMERNxxxxxDILEKAHNGxxxxxxxxxxxxxxxxxxxxxxxxxxxxxx
xxxxxxxxxxxxxxxxxxxxxxxxxxxxxxxxxxxxxxxxxxxxxxxxxxxxAYKIIKKGDSxxxxxxxxxxxxCQTPMGAVNSSMPxxxxxxxxxxxxx
xxxxxxxxxxxxxxxxxxxxxxxxxxxxxxxTRGLFGAIAxxxxxxxxxxxxRHSNEQGSGxxxxxxxxxAIDGITNKINxxxxxNIQFEAVGRExxx
xxxYSTVASSLTLAIMxxxxxxxxxxxxWMCSNGALQxxxxxxxxxxxxxxxxxxxxxxxxxxxxxxSIRNGTYSYxxxxxxxxxxxxxxxxxxxxxxxxxxxxx
>Protein:HA|Subtype:H5N1|Blocksize:9|String:7
xxxxxxxxxxxxxxxxxxxxxxxxxxxxxxxxxDQICVGYHANNSTVxxxxxxxxxxxxxxxxxxxxxxxxxxxDILEKEHNGxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxGAIGAIDSSMPFHNVHxxxxxxxxxxxx
xxxxxxxxxxxxxxxxxxxxxxxxxxxxxxxxxxxxxxxxxxxxxxxxxxxxxxxxxxNGTYDYPRYxxxxxxxxxxxxxxxxxxxxxxxxxxxxxxxEFPST
GNHGSLxxxxxxxxxxxxxxxxxxxxxxxxxxxxxxxxx
>Protein:HA|Subtype:H5N1|Blocksize:9|String:8
xxxxxxxxxxxxxxxxxxxxxxxxxxxxxxxxxxxEQVDTIMERxxxxxxDILEKKHNGxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxGAINSSMPFHNVxxxxxxxxxxxxxxxx
xxxxxxxxxxxxxxxxxxxxxxxxxxxxxxxxxxxxxxxxxxxxxxx
>Protein:HA|Subtype:H5N1|Blocksize:9|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxGAVNSSMPFHNxxxxxxxxxxxxxxxxxxxxxx

FIG. 76-142 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxx
>Protein:HA|Subtype:H5N1|Blocksize:9

FIG. 76-143

RTKSTxSRSGFEIIWDPxxxxxxxxxxxxxxxxxTTDWSGYSGSFVQHPEMTGLDCMRPCFWVELIRGQPKExTVWTSGSIISFCGVNxxxxxx
xxxxxxGWSWPDDAELPFTIDKY
>Protein:NA|Subtype:H5N1|Bl

FIG. 76-144 xxxxxxxxxxxGDQICIGYHANNSTEQVDTIMEKNVTVTHAQDxxxxxxxxxxxxxxxxxxxxxxxxxxxxxxxxxAGWLLGNPMCxxxxxVPEWSYIVE
KDNPxxxxxxxxxxxxxxxxxxxxxxxxxxxxxxxxxxxxxxxxxxxxxYYNGRSSFFRNVVWLIKKxxxxxxxxxxxxxxxxxxxxxxxxxxxxxxxxxxxx
xxxxxxxxxxxGTSTLNQRSxxxIATRPKVNGQSGxxxxxxxxxxxxFESNGNFIAPEYAYKIVKxxxxxxxxxxxxxYGNCDTKCQTPxxxxxxx
xxxxxxxxxxxxxxxxxxxxxxxxxxxxxxRKRKRKTRGLFGGLFGAIAGFIEGGWQGMVDGWYGYHHSNEQGSYAADKESTQKAIDGI
TxxxxxxxxxxxxxxxxxxxxxxxxxxxxxxxxxxxxxxxVWTYNAELLVLMENERTLDFHD

FIG. 76-145 xxxxxxxxxxxxxxxxDRICVGYHANNSTEQVDTIREKNVTVTRAxxxxxxxxxxxxxxxxxxxxxxxxxxxxxxxxxxxxxxxx
xxxxxxxxxxRLKVNGQSGxxxxxxxxxxxxxxxxxxxxxxxxxxxxxxxxxxxxxxxxxxxxxxxxxxxxxxxxxxxxxxxxxx
xxxxxxxxxxxxETKGLFGAIxxxxxxxxxxxxxxxxxxxEHGSGYAADKASTQxxxxxxxxxxxxxxxxxxxxxxxxxxxxxxxx
xxxxxLLVLMETERTLDFxxxxxxxxxxxxxxxxxxxxxxxFKFYHKCDNxxESVKNGTYNYxxxxxxxxxxxxxxxxxxxxxxxV
VSSLALAIxVAGLSLWMCxxxxxxxxxx
>Protein:HA|Subtype:H5N2|Blocksize:9|String:7
xxxxxxxxxxxxxxxxxxxxxxxxxxxxxxxxxxxxxxxxQVDTIVEKNVTVTHTQxxxxxxxxxxxxxxxxxxxxxxxxxxxxxx
xxxxxxxxxxxxxxxxxxxxxxxxxxxxxxxxxxxxxxxxGSGYAANKESTQKAINGxxxxxxxxxxxxxxxxxxxxxxxxxxSLC
xxxMVNERTLDFxxxxxxxxxxxxxxxxxxxxxxxxxxxxxxxxxxxxxxxxxxxxxxxxxxxxxxxxxxxxxxxxxxxxxxxxxx
MCSNGSLxxxxxx
>Protein:HA|Subtype:H5N2|Blocksize:9|String:8
xxxxxxxxxxxxxxxxxxxxxxxxxxxxxxxxxxxxxxxDTTMEKNVTVTQAQDxxxxxxxxxxxxxxxxxxxxxxxxxxxxxxxx
xxxxxxxxxxxxxxxxxxxxxxxxxxxxxxxxxxxxxxxxSGYGEDNESTQKAVDGxxxxxxxxxxxxxxxxxxxxxxxxxxxYWM
CSNGSLxxxxxx
>Protein:HA|Subtype:H5N2|Blocksize:9|String:9
xxxxxxxxxxxxxxxxxxxxxxxxxxxxxxxxxxxxxxxxDTIMEKSVTVSHAQxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxx
xx
>Protein:HA|Subtype:H5N2|Blocksize:9|String:10
xxxxxxxxxxxxxxxxxxxxxxxxxxxxxxxxxxxxxxxxIIEKNVTVTxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:NA|Subtype:H5N2|Blocksize:9|String:1

FIG. 76-146 xxxxxxIITIGSVSLxxxxxxxxxxxxxxxxxxxxxxxxxxxxxxxxxxxxxxxxxxxxxxxxxxxxxxxxYRNWSKPQCQITGFAPFSKDNSIRL
SAGGDIWVTREPYVSCDxxKCYQFALGQGTTLDNKHSNGTIHDRIPHRTLLMNELGVPFHLGTKQVCIAWSSSSCHDGKAWLHVCVT
GDDRNATASxxxxxxxxxxxSWSQNILRTQESECVCINxxCTVVMTDGSASGRAxxxxxxxxxxxxSPLSGSAQHEECSCYPxSYPNVRC
VCRDNWKGSNRPVKLDINMADYxxxSSYVCSGLVGDTPRNDDSxSSSNCRDPNNERGNPGVKGWAFDNxxDVWMGRTISKDSRSGY
ETFRVIxxxxxxxx

FIG. 76-147

>Protein:NA|Subtype:H5N2|Blocksize:9|String:7

FIG. 76-148 xxxxxxxxxxGKSDRICIGxxxxNSTTQVDTLLEKNVTVTHSIELLESxxxxxxxxxxxxxxxxxxxxxxxxxxxxxxxxxxxxxxxxxxxxxxxKGWILGNPRCGxxxxQSWSCIVERPx
AQYGICYPGxxxxxxxxxxxxxxxxxxxxxxxxxxxxxxxxxxxxxxxxxxxxxxxx

FIG. 76-149

MKSRGYKMNNQILxxxxxxxxxxxxxxxxxxxxGDKICLGHHxxNGTKVDTLTERGVEVVNATETVERxxxxxxxxxxxxxxxxxxxxxxxxxxxxxGPPQC
DLFLEFxxxxxxxxxxxxxxxxxxxxxxxxxxxxxxxxxxxxxxxxxxxxxxxxxxxxxxxxxxxPSFYAEMKWLLSS

FIG. 76-150 xxxxxxxxxxxxxxxxxxxxxxxxxxxxxxxxxxxxxxxxxxEFLVAMENQHIIDLADSEMxxxxxxxxxxxxxxxxxxxxxxxxxxxxxxxxxxx
xxxxxxxxxxxxxxxxxxxxxxxxxxxxxxFGASCFLLIAxxxxxxxxxxxxxxxxxxxxxxxxxxxxxx
>Protein:HA|Subtype:H7|Blocksize:9|String:7
xxxxxxxxxxxxxxxxxxxxxxxxxxxxxxxxxxxxxxxxxxxxxxxxxxxxxxx

FIG. 76-151

```
xxxxxxxxxxxxxxxxxTKGDKICLGxxxxxxxxxVNTILTERGVxxxNATETVETVxxxxxxxxxxxxxxxCGLLGTITGPPHCDQFLExxxLI
IERREGADVCYPGKFVNGEALRQILRKSGGIGKExxGFIYSGIRTNGTxxxxRSGPSFYAEMKWLLSSTDNxxxxxxxxxxxxxALIVW
GVHHSxxxAEQTKLYGSGNKLVxxxxxxxxxxxTGARRIDFHQFGRIDFHWLMxxxNDTVTFNFNGxxxAPDRASFFKGxxxxxxxxxxx
xxxxxxxGGTIASSLPFQNINSxTVGKCPRYIKQKSLMLATGMKNVxxxPKGRGLFGAIAxxxxxxxxxxxxxxxxxxxxxxxxxxxxxx
xxTGKLNRLIEKTNQQFELIDSEFNExxxxxxVINWTRDSITEVWSYNAxxxxxxxxIDLTDSEMNKLYERVKRQLRENAExxxxxEIF
HKCDDDCMASIRNNTYDHTKYRTESLQNRIQIDQVKLSSGYKxxxxxxxxSCFLLLAIVMGLVFICVKNGNMRxxxxxxxxx
>Protein:HA|Subtype:H7N2|Blocksize:9|String:5
xxxxxxxxxxxxxxxxxxxxxxxxxARGDKICLGHxxxxxxxxxxxxxxxxxxxxxxxxxxxxxxxxxxxxxxxCGLLGTVTGPPxxxxxxxxxxLIIERREG
SDVCYPGGFTNEESLRQVLRRSGGISKExxxxxYSGIRTNGVxxxxxSGSSFYAELKxxxxxxxxxxxxxxxxALVIWGVHHSxxxDE
QTKLYGSxxxxxxxxxxxxxxxxxPGARRIDFNWLLRIDFHWLILxxxTITFSFNGAxxxxxxxxxxxxxxxxxxxxEGTIVSSLPF
QSINPRAVGKCPKYVKQESLMLATGMRNVPENPKxxxxxxxxxxxxxxxxxxxxxxxxxxxxxxxxxxxxxxxxxNHLIGKTNQQFG
LIDNEFNxxxxxxxxxxxxxxxxxxxxxxWTRDAMTEVWSxxxxxxxxxxxxIDLADSEMKKLYERVRxxxxxxxxxxxxRNNTYDHSRYR
EEAMQNxxxxxxxxxxxxxxxxxxxxxxSCFLLAIVMGLVFMCVKNGNxxxxxxxxxx
>Protein:HA|Subtype:H7N2|Blocksize:9|String:6
xxxxxxxxxxxxxxxxxxxxxxxxxxxxxxxxxxxxxxxxxxxxxxxxxxxxxxxxxxxxxxxxxxxxxxxxxxIGPPHCDQFxxxxxxxxxxxxxxx
YPGKFANEESLRQIIRRSGGIxxxxxxxxxxxxxxxxxxxxxxxTGSSFYAEMxxxxxxxxxxxxxxxxxxxxxxxxxLYGNGNK
LIxxxxxxxxxxxxxxxPQVNGQFGRIDFHWLIxxxxxxxxxxxxxxxxxxxxxxxxxxxxxxxxxxxLPFQNINPKxxxxxxx
VKQKSILLATGMRNIPEKPKxxxxxxxxxxxxxxxxxxxxxxxxxxxxxxxxxxxxxxxxxxxJGRTNQQFELIDNEFTEVEKQxxxxxx
xxxxxxxxxxxxxxxxxxxxxxxxxxxxxxxxxxxxxxDSEIKKLYExxxxxxxxxxxxxxxxxxxxxRKEAMQNRIQxxxxxxxxxxxxxxxxx
xxxxxLLAJVMGLVFICMKNGNMQCTxxxxxxxx
>Protein:HA|Subtype:H7N2|Blocksize:9|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxGRIDFHWLVxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxNKQFELIDNEFSEIEQQIGNxxxxxxxxxxxxxxxxx
xxxxxxxxxxxxxxxxxxxxxxxxxxxxxxxxxxxxxxxxxxxxxxxxxxxxxxxxxxxxxxxLTIAMGLVFMCVxxxTCSA
LFVYSxxxxx
>Protein:HA|Subtype:H7N2|Blocksize:9|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxRIDFHWLFLxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxNQQFEMIDNEFTEIEQQxxxxxxxxxxxxxxxxxxxxxxxxx
xxxxxxxxxxxxxxxxxxxxxxxxxxxxxxxxxxxxxxxxxxxxxxxxxxxxxxxxxxxxxxAIAMGLVFMCIKNGNMRC
Txxxxxxxxx
>Protein:HA|Subtype:H7N2|Blocksize:9|String:9
```

FIG. 76-152 xxxxxxxxxxxxxxxxxxxxxxxxxxxxxxxxxxxxxxxxxxxxxxxxxxxxxxxxxxxxxxxxxxxxxxxxxxxx
xxxxxxxxxxxRIDFNWLLLxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxAIAMGFVFICIKNGNMRxxxxxx
xxxxx
>Protein:HA|Subtype:H7N2|Blocksize:9|String

FIG. 76-153 xxxxxxITIGSVSLIIATxCFLMQIATLxxxxxxxxxxxxxxxxxxxxxxxxxxxxEKNITEIVYLNSTxxxxxxxxxxxYRDWSKPQCQIIGFAPFSKD
NSVRLSASGDIWITREPYVSCGPGKCYQFALGQGTTLENKHSNGTIHDRTPHRTLLMNxxxxxLGTKQVCMAWSSSSCHxGKAWLH
VCITGDDRNATASFIYDGxLIDSIGSWSQxxxxxxxCVCINGSCAVVMTDGSASGRADTRIxxxEGKIAHISPLSGSxxxxxCSCYPRYPD
VRCV

FIG. 76-154 xxxxxxxxxxxxxxxxxxxxxxxxxxxxxxxxxxxxxxxxxxxxxxxxxxxxxxxxxxxxxxxxxxxxxxxxxxxxxxxxxxTTVWWTSNSxxxxxxxxxxxxxxxxx
xxxxxxxxxxxx
>Protein:HA|Subtype:H7N3|Blocksize:9|String:1
SKSR

FIG. 76-155 xxxxxxxxxxxxxxxxxxxxxxxxxxxxxxxxHHAVANGTRVNTLTEKGIEVVDATETVERxxxxxxxxxxxTDMGQCGLLGTVTGPPQCDxxxxxx
xxxxxxxxxxxDICYPGKFTNxxxxQILRGSGGVxxxxGFTYSGVRTxxxxxxxxxGSSSFYAEMKWLLSNSDxxxxxxxxxxxxxxxx
xxxxxxxxxxxKLYGSGSKLITVxSYNYHQSFVPSPGSRxQVDGQSGRIDFHWMMLNPNDTITFSFNGxxIAPDRASFLxxxxxxxxxxxx
xxxxxxxxxxxGGTIASSLPFQNINSRTLGKCPRYVKxxxxxxMKNVPEIPRxxKKRGLFGAIxxxxxxxxxxxxxxxxxxxxxxxxxxxxxxx
xxxxxxxxxxxxxxxxxxxxxxxxxxxxxGKLNRLIDRTNHQFELIDNEFNEVEKQIGxxxxWTRDSMTEIWSYNxxxxxxxxxxLANSEMNKLYER
VKKQLxxxxxxxxxxxxxxxxxxxxxxxxTYREEAMQNRVKIDPVKLS

FIG. 76-156

>Protein:HA|Subtype:H7N3|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPRGLFGAIAxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-157

>Protein:NA|Subtype:H7N3|Blocksize:9|String:5
xxxxxxxxxxGSVNTVLSIIALLIGIGNLIFNTVIHExxxxxxxxxxxxxxxxxxxxxxxxxxVTYNNTVINNMTTTIINxxxxxxRLPLPLCPFxxxxPFHKG
NSARLIHHxDVLVTREPYISxxxxxxxxxxxAQGALLGTRHSNGTIKDKTPYRSLIRFPIGVAPVLGNYKEIRIAWSSSSCxxGKEWLHVCIT
GxxxxxxxxxxxxxxxxxxxxxxxxxxxxxxxxxxxxxxxxxxxxxxxxxxxxxxxGRMSDSIKSWRKxxxxxQESECQCISGxxxVSVTDGPAANSADH
RIYWIKExxxxxxxxxxxxxxxxxEECSCYVDTDVYCICRDxxxxxNRPWVRMNNETILxxxxxxxxxxxxxxxxxDPSVVSCDSPSNANGGxGVKG
FGFKSGxxxxxxRTISYSSRSGFEIIRVIEGWINSPxxVKSVTQTLVSNDDWSGYSxxxxxxxKDCFQSCFYVELIRGRLNxDDDVSWTSNxxx
xxxxxxxxxxSGHWPDGSNIGxxxx
>Protein:NA|Subtype:H7N3|Blocksize:9|String:6
xxxxxxxxxxxxVNTILSTKALLIGIGNLAFNAVIHxxxxxxxxxxxxxxxxxxxxxxxxxxxxxxNHTTINNITNVVLxxxxxxxxxSLPLCPFKGxxxxxxxx
xxxxxxxxxxxxxxxxxxxxxxxxxxxxxxxxxxxxxxxxxxxxxKDRAPYRSLxxxxxxxxxxLGNYKEMCAAWSSSxxxxxKEWMHVCMAGxxxxxxxx
xxxxxxxxxxxxxxxxxxxxxxxxxxxxxxxxxxxxxxxxxxxxxxxxxxxxxxRMADSIKSWRxxxxxxQESECQCLYGxxxxxxxxxxAANNADHRVYWIxxxx
xxxxxxxxxxxxxxxxxCSCYVDIDIYCxxxxxxxxxxxxxxRINNETIVETGYVCSKxxxxxxxxxxxxxxSCSSPSGIEGxxxxxxxxxxxxxxxxxxxxxxxxxS
GRLGFEIIxxxxxxxxxxxxxxAATQTLVSNNxxxxxxxxxxxxxxxxxxxxxxVELIRGRPIxxxxxxxxxxxxxxxxxxxxxxxxxxxxxxxxxxxxxxx
>Protein:NA|Subtype:H7N3|Blocksize:9|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxEICVAWSSTSCFxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxNKADHRIYWIREGRxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
>Protein:HA|Subtype:H7N7|Blocksize:9|String:1
SKSRGYKMNTQILVFxxxxxxxxGCDHSDNADKICLGHHAVxNGTKVNTLTERGVEVVNATETVERxxxxxxxxxxxxxxDLGQCGLLGTxT
GPPQCDQFLEFxxDLIIERREGxxxxxxxxxxxEEALRQILRESGGxxxxxMGFTYSGIRTNGxxxxxxRSGSSFYAEMKWLLSNxxxxxFPQMTK
SYKNxxxxPALIIWGIHHxxxxxEQTKLYGSGxxxxTVGSSNYQQSxxxxxxxRPQVNGQSGRIDFHWLxxxxNDTVTFSFNGAFIAPDRASFxx
xxxxxxxxxxxxxxxxxxxxxxxxxxxxSNLPFQNINSRAVGKCPRYVKQxSLLLATGMKNVPExxTHKQLTHHMRKKRGLFGAGAIAGFIENG
WEGLIDGWYGFRHQNAQGEGTAADYKSTQSAIDQITGKLNRLIEKTNQQFELIDNEFTEVEKQIGNVINWTRDSMTEVWSYNAELLV
AMENQHTIDLADSEMNKLYERVRRQLRENAEEDGTGCFEIFHKCDDDCMASIRNNTYDHSKYRxxxxQNRIQIDPVKLSSGYKDVILW
FSFGASCFILLAIxxxLVFICVKNGNMRCTICI
>Protein:HA|Subtype:H7N7|Blocksize:9|String:2
MKSRGYKMNIQILILxxxxxxxxxxxxxxxGDKICLGHHAExNGTKVDTLTEKGIEVVNATETVEQxxxxxxxxxxxxxxDLGKCGLLGxxIGPPQ
CDQFxxxxxNLIIERREGxxxxxxxxxxxEETLRQILRKSGGxxxxxMGFTYTGVRTNGxxxxxxRSRSSFYAEMKWLLSSxxxxxFPQTTKSYKN
xxxxPALIVWGIHHxxxxxEQTRLYGSGxxxxTVGSSKYQQSxxxxxxxRPQINGQSGRIDFYWLxxxxNDTVTFTFNGAFIAPNRASFxxxxxxx
xxxxxxxxxxxxxxxxxxxxxxxxSSLPFQNINPRTIGKCPRYVKxxSLMLATGMKNVxxxxAHKQLTHHMKKREKRGLFGAIAGFIENGWEGLV
DGWYGFRHQKAQGEGTAxDYKSTQSAVNQITGKLNRLIDKTNQQFELIDNKFNEIEKQIGNVINWTRDSITEMWSYNAELLIAMENQ
HTIDLTDSEMNKLYEKVRRQLRENAEEDCTGCFEIFHQCDNDCMESIRNNTYDHKKYRxxxxQNRIQIDAVKLSSGYKEVILWFSFGAS
CFLLLAIxxxLVFMCVKNGNMRGTNWI

FIG. 76-158

>Protein:HA|Subtype:H7N7|Bl

FIG. 76-159 xxxxxxxxxxxxxxxxxxxxxxxxxxxxxxxxxxxxxxxxxxxxxxxxxxxxxxxIFHKCDDNCxxxxxxxxxxxxxxxxxxxxxxxxxxxxxxxxxxxx
xxxxxxxVKNGNHAVHYCx
>Protein:HA|Subtype:H7N7|Blocksize:9

FIG. 76-160

RSGFEMLRIPNAGIDPxxxxxRQEIVGNDNWSGYSGSFIDYWDDxxxxxxxxxxxxxxxxxEEAKYVWWASNSLIALCxxxxPVGPGSFPDG
AQxxxxx
>Protein:NA|Subtype:H7N7|Blocksize:9|String:4
xNPNQKLFASSGIAIVLGI

FIG. 76-161 xxxNNEDGDIIFLWGIHHPPDTKEQTTLYKNANTLSSVTTNTINRSFQPNIGPRPLVRGQQGRMDYYWGILKRGETLKIRTNGNLIAPEF
GYLLKGESHGRIIQNEDIPIGNCHTKCQTYAGAINSSKPFQNASRHYMGECPKYVKKASLRLAVGLRNTPSIEPKGLFGAIAGFIEGGW
SGMIDGWYGFHHSNSEGTGMAADQKSTQEAIDKITNKVNNIVDKMNREFEVVNHEFSxxEKRINMINDKIDDQIEDLWAYNAELLVL
LENQKTLDEHDSNVKNLFDEVKRRLSANAIDAGNGCFDILHKCNNECMETIKNGTYNHKEYEEEAKLERSKINGVKLEENTTYKILSI
YSTVAASLCLAILIAGGLILGMQNGSCRCMFCI
>Protein:HA|Subtype:H8|Blocksize:9|String:2
xxxxxxxxxLLVSTNAYDRIxxGYQSNNSTNTVNTLI

FIG. 76-162

>Protein:HA|Subtype:H8|Blocksize:9|String:6
xxxxxxxxxxxxxxxxxxxxxxxxxxxxxxxxxxxxxxxxxxxxxxxxxxxxxEKHLAYCNTDLxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxPDIYDFNEGSYxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxYTGAINSSKPFQNASRYxxxxxxxxxKKESLR
LAIGLRNTPSIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxx
>Protein:HA|Subtype:H8|Blocksize:9|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxDTYDFNEGTYINNxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H8|Blocksize:9|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxDTYDFNEGAYVNNxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H8|Blocksize:9|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxFNEGTYVNNxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H9|Blocksize:9|String:1
RWKHVTNTILxxxxxxxxxxxxxxxxxGYQSTNSTETVDTxxxxxxxxxxxxxxxxxEHNGMLCATxxxxxxxxxxxxIEGLIYGNPSCDxxxxxxxWSYIV
ERPSAxxxxxxxxxxxxxxxxxxxxxxxxxxxxxxxxxxxxxxxxxxxxxxxxxxxFYRSMRWLTxxxxxxxxxxxxxxxxxxxxxxxxxxxxxxxxxxxxxxxxxxxxx
xxxxxxxxxxxxxxxxxxxxxxxxxxxxxxxxxxxVLKPGQTLRIRSNGNLIAPWYGHxxxxxxxxxxxxxxxxxxxxxxxxxxxxxxxxxxxLPFQNVSKYAFG
xxxxxxxxxSLKLAVGLRNxxxxxxxRGLFGAIAGFIEGGWSGLVAGWYGFQHSNDQGxxxxxxxxxxxxxxxxxxxxxxxxxxxxxxxxxxxxxxxxxxxxx
xxxxxxxxxxDQIQDIWAYNAELLVLLENQKTLDEHDxxxxxxxxxxxxxxxxxxxEDGKGCFELYHKCDxxCMETIRNGTYxxxxxxxxxxxxxxxx
xxxxxxxEGTYKILTIYSTVASSLxxxxxxxxxxxxxxxxxxxxxxxxx
>Protein:HA|Subtype:H9|Blocksize:9|String:2
xxxxxxxxxxxxxxxxxxxxxxxxxGHQSTNSTETVNTxxxxxxxxxxxxxxxxxEHNGILCATxxxxxxxxxxIEGLVYGNPSCDxxxxxxxWSYIVERS
SAxxxxxxxxxxxxxxxxxxxxxxxxxxxxxxxxxxxxxxxxxxxxxxxxxxxFYRNMRWLTxxxxxxxxxxxxxxxxxxxxxxxxxxxxxxxxxxxxxxxxxxxxxxxxx

FIG. 76-163 xxxxxxxxxxxxxxxxxxxxxxxxxxxxxxxxxxxxxxILKPGQTLRVRSNGNLIAPLYGHxxxxxxxxxxxxxxxxxxxxxxxxxxxxxxxxxxLPFHNVSKYAFGxxxxx
xxxxSLKLAIGLRNxxxxxxRGIFGALAGFIEGGWPGLVAGWYGFQHTNDQGxxxxxxxxxxxxxxxxxxxxxxxxxxxxxxxxxxxxxxxxxxxxxxxxxxxxxxxxxxxxx
xxxxDQIQDVWAYNAELLVLLGNQKTLDEHExxxxxxxxxxxxxxxxxxxEDGNGCFELYHKCNxxCMATIRNGTYxxxxxxxxxxxxxxxxxxxxxxxxxxxxxxxxxxxxx
xxEGIYKILTIYSTAASSLxxxxxxxxxxxxxxxxxxxxxxxxxxxxxxx
>Protein:HA|Subtype:H

FIG. 76-164 xxxxxxxxxxxxxxxxxxxxxxxxxxxxxxxIRSNGNLVAPxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H9N2|Blocksize:9|String:1
RWKHVTNTILxxxxxxxxxxxxxxxxxxxxxGYQSTNSTETVDTxxxxxxxxxxxxxxEHNGMLCATxxxxxxxxxxxxIEGLIYGNPSCDxxxxxxWSYIVERPSAxxxxxxxxxxxxxxxxxxxxxxxxxxxxxxxxxxxxxxxxxxxxxxxxxxxxxxxxxFYRSMRWLTxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSVLKPGQTLRIRSNGNLIAPWYGHxxxxxxxxxxxxxxxxxxxxxxxxxxxxxxxxxxxxxxxxxxxxxxxxxLPFQNVSKYAFGNCSKYxxxxSLKLAVGLRNxxxxxxRGLFGAIAGFIEGGWSGLVAGWYGFQHSNDQGxxxxxxxxxxxxxxxxxxxxxxxxxxxxxxxxxxxxxxxxxxxxxxxxxxxxxxxxxxxxxxxxxxxxxxxxxxDDQIQDIWAYNAELLVLLENQKTLDEHDANVNxxxxxxxxxxxxxxxxEDGKGCFELYHKCDxxCMETIRNGTYxxxxxxxxxxxxxxxxxxxxxxxxxxxxxxEGTYKILTIYSTVASSLxxxxxxxxxxxxxxxxxxxx
>Protein:HA|Subtype:H9N2|Blocksize:9|String:2
xxxxxxxxxxxxxxxxxxxxxxxxxxxxxxxxxxxxxxxxxxxxxxxxxGHQSTNSTETVNTxxxxxxxxxxxxxxxxxxxxxxxxxxxxxEHNGILCATxxxxxxxxxxxxxxxxIEGLVYGNPSCDxxxxxxxWSYIVERSSAxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxFYRNMRWLTxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxAVLKPGQTLRVRSNGNLIAPLYGHxxxxxxxxxxxxxxxxxxxxxxxxxxxxxxxxxxxxxxxxxxxxxxxxxxLPFHNVSKYAFGNCPKYxxxxSLKLAIGLRNxxxxxxxxxxxxxxxxxxxxxxAGFIEGGWPGLVAGWYGFQHTNDQGxxxxxxxxxxxxxxxxxxxxxxxxxxxxxxxxxxxxxxxxxxxxxxxxxxxxxxxxxxxxxxxxxxxxDDQIQDVWAYNAELVLLGNQKTLDEHVANVNxxxxxxxxxxxxxxxxxxxEDGNGCFELYHKCNxxCMATIRNGTYxxxxxxxxxxxxxxxxxxxxxxxxxxxxxxxEGIYKILTIYSTAASSLxxxxxxxxxxxxxxxxxxx
>Protein:HA|Subtype:H9N2|Blocksize:9|String:3
xxxxxxxxxxxxxxxxxxxxxxxxxxxxxxxxxxxxxxxxxxxxxxxxxxGYLSTNSTETVYTxxxxxxxxxxxxxxxxxxxxxxxxxxxxxxxxxEHNGLLCATxxxxxxxxxxxxxVEGLIYGNPSCNxxxxxxWSYIVERPTAxxxxxxxxxxxxxxxxxxxxxxxxxxxxxxxxxxxxxxxxxxxxxxxxxxxxxxxxxxxxxxxxxxxxxxxxxxxxxxxxxxxxxxxxFYRGMRWLTxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSILKPGQTLRVKSNGNLIAPWFGHxxxxxxxxxxxxxxxxxxxxxxxxxxxxxxxxxxxxxxxxxxxxxxxxxxxxxxxLPFHNISKYAFGTCPKYxxxxSLKLAVGMRNxxxxxxxxxxxxxxxxxxxxxxxxIEGGWSGLIAGWYGFQHSNAQGxxxxxxxxxxxxxxxxxxxxxxxxxxxxxxxxxxxxxxxxxxxxxxxxxxxxxxxxxxxxxxxxxxxxxxxxxxDDQIQNIWAYNAELLVLIENQKTLDEHEANxxxxxxxxxxxxxxxxxxxxxxEDGKGCFDLYHKCDxxCMGTIRNGTYxxxxxxxxxxxxxxxxxxxxxxxxxxxxxxEETYKILTIYSTVASSIxxxxxxxxxxxxxxxxxxxxxx
>Protein:HA|Subtype:H9N2|Blocksize:9|String:4
xxxxxxxxxxxxxxxxxxxxxxxxxxxxxxxxxxxxxxxxxxxxxxxxxxxxxVHQSTNSTEAVDTxxxxxxxxxxxxxxxxxxxxxxxxxxxxxEHNGVLCATxxxxxxxxxxxxxxxxxVEGLVYGNPACDxxxxxxWSYIVERPLxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxFYKSMRWLTxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPVLKPGQTLRVRSDGNLIAPWYGYxxxxxxxxxxxxxxxxxxxxxxxxxxxxxxxxxxxxxxxxxxxxxxxxxxxxxxxLPFQNISKYAFGICPKYxxxSLKLAVGLKNxxxxxxxxxxxxxxxxxxxxxxxxxxWYGFQHSNEQGxxxxxxxxxxxxxxxxxxxxxxxxxxxxxxxxxxxxxxxxxxxxxxxxxxxxxxxxxxxxxxxxxxxxxxxxxxxxDDQIQDLWAYNAELLVLLENQKPLDEHDANVHxxxxxxxxxxxxxxxxxxxxENGNGCFELYHRCDxxCMEAIRNGTYxxxxxxxxxxxxxxxxxxxxxxxxxxxxxxxEGAYKILTIYSTVASSFxxxxxxxxxxxxxxxxxxxxxxx
>Protein:HA|Subtype:H9N2|Blocksize:9|String:5
xxxxxxxxxxxxxxxxxxxxxxxxxxxxxxxxxxxxxxxxxxxxxxxxxxxGHQSTNSTDxxxxxxxxxxxxxxxxxxxxxxxxxxxxxxxxxxxxGHNGMLCATxxxxxxxxxxxxxxxxxxxxLIYGNPFCDxxxxxxxxxSYIVERSSPxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxFYRSVRWLTxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSVLRPGQTLRVRSNGNLVAPWYGHxxxxxxxxxxxxxxxxxxxxxxxxxxxxxxxxxxxxxxxxxxxxxxxxxxxLPFQNVSRYAFGNCPM

FIG. 76-165

YxxxxSLKLAVGPRNxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEDQI
QDIWAxxxxxxxxQKTLDEHDSNVNxxxxxxxxxxxxxxxxDGKGCFETYxxxxxCMETTRNGTYxxxxxxxxxxxxxxxxxxxxxxxxxxxxxxxxxxxxxxYKILSI
YSTVASSxxxxxxxxxxxxxxxxxxxxxxx

FIG. 76-166 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxWSKPQCLITGFAPxxxxxxR
LSAGGSIWITREPYVSCxxRCYQFALGQxxxxxxxxxxxxPHRTLLMSELGVPFNxxTRQVCIAWSSASCHDGRAWxxxxxxxxxxx
xxxxxxxxxxTILRTQESECVCISGTCAVVMxxxxxxxxxxxxxxxxxxxxxxxxxGNAQHVEECSCYPQYxxxxCVYRDNWKGSNRPI
xxxxxxxxxxYFLDVFAGDxxxxxxxxxxxxxxxxxxxxxxxxxxxPGVKGWGFDxxxxxxxxxxxxxxxxxxxxxxxxxxxxxxxxxxxxxxxxxxxxx
xxxxxxxxxxFYVELIRGKPxxxxxxxxxxxxxFCGTTGTYGAGSWPDGANVxxxxx
>Protein:NA|Subtype:H9N2|Blocksize:9|String:4
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxWSKPQCQIAGFAPxxxxxxR
LSAGGGIWVNREPYVSCxxxKCYQFALGHGTTLxxxxxxxxxxxxSYRTLLMSExxxxxxxxxTQQVCIAWSSSSCYDGKAWLHxxxxxxxxxxx
xxxxxxxxxxxxxxxNILITQESECVCIDGTCTVVMxxxxxxxxxxxxxxxxxxxGGAQHVEECSCYPSYxxxxCVCWDNWRGSNRPI
xxxxxxxxxxxxxxGLVGDTPRDxxxxxxxxxxxxxxxFCGTPGTYGTGSWADGANIxxxxx
>Protein:NA|Subtype:H9N2|Blocksize:9|String:5
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxWSKPQCHITxxxxxxxxxxRL
AAAGDIWVAREPYVSCxxxKCNQFALGQGTxxxxxxxxxxxxxxLMNELGVPLHLxTKQLCIAWSxxSCHDGKEWLHxxxxxxxxxxxx
xxxxxxxxxxxxxxxxxxNILKTQESExxxINGICTVVMTDxxxxxxxxxxxxxxxxxxxxxxxGSAKHVEECSCYPQHxxxxDCRDNWKGSxxxxxx
xxxxxxxxxxxxxxxxxxxxxxxGLVGDTPRTxxxxxxxxxxxxxxxxxxxxxxxxFCGTSGTCGTGSWPDGANFxxxxx
>Protein:NA|Subtype:H9N2|Blocksize:9|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPQCQITGFVPxxxxxxxxxx
xxxxxxxxxxxxxxxxxxxxxxxxxxxxxxxxxxxxxxxxxxxxxxxxxxxxxxxxMNELGVPFNLxxKQVCIAYSSxxxxxxxxxxxxxxxxxxxxxxxxxxxx
xxxxxRTQESGCVCxxGTCTAVMTDxxxxxxxxxxxxxxxxxxxxxxxxxxIEECSCYPQxxxxxxxxxxxxxxxxxxxxxxxxxxxxxxxxxxxxxxxxx
xxxxxxxxxGTHGTGSWPDxxxxxxxxx
>Protein:NA|Subtype:H9N2|Blocksize:9|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxNEIGVPFHLxxxxxxxxxxxxxxxxxxxxxxxxxxxxxxxxxxxxxxR
THESECVCxxGTCTVVLTDxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxx
>Protein:NA|Subtype:H9N2|Blocksize:9|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxT
QESDCVCIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxx

FIG. 76-167

>Protein:NA|Subtype:H9N2|Blocksize:9|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxT
QEYECVCIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxx
>Protein:NA|Subtype:H9N2|Blocksize:9|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
GSECVCINGxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxx
>Protein:M1|Subtype:N/A|Blocksize:9|String:1
MLKMSLLTEVETYVLSIVPSGPLKAEIAQRLEDVFAGKNTDLEALMEWLKTRPILSPLTKGILGFVFTLTVPSERGLQRRRFVQNALNG
NGDPNNMDRAVKLYRKLKREITFHGAKEVALSYSTGALASCMGLIYNRMGTVTxxxAFGLVCATCEQIADSQHRSHRQMVTTTNPLI
RHENRMVLASTTAKAMEQMAGSSEQAAEAMEVAxxARQMVQAMRTIGTHPxxxxxxxxDLLENLQAYQKRMGVQMQRFKRPDSSWL
FGGWNLALDIVDS
>Protein:M1|Subtype:N/A|Blocksize:9|String:2
xxxxxxxxxVETYVLSIIPSGPLKAEIAQKLEDVFAGKNADLEALMEWIKTRPILSPLTKGMLGFVFTLTxxxxRGLQRRRFIQNALNGNGD
PNNMDKAVKLYRKLKREMTFHGAKEVSLSYSTGALxxxxGLIYNRMGAVTxxxAFGLICATCEQIADAQHRSHRQMAATTNPLIKHEN
RMVLAxTTAKAMEQVAGSSEQAAEAIEVAxxTRQMVHAMRTIGTQPxxxxxxxxDLLENLQTYQKRMGVQLQRFKxSSRHCSKYHWNL
ALDIVxx
>Protein:M1|Subtype:N/A|Blocksize:9|String:3
xxxxxxxxxVETYVLSVIPSGPLxAEIAQRLESVFAGKNSDLEALMEWxxxxxxxxxxLTKGVLGFVFxxxxxxxxxxxxxRRFVQNALSGNGDPNN
MARAVKLYKKLKREITFYGAKEIALSYSAGALASCMGLIYNRMGTITxxxALGLVCATCEQIADSHHRSHRQMATITNPLIRHENRMVI
ASTTAKAMxxIAGSSEQAAEAMDIxxxARRMVQAMRAIGTHPxxxxxxxxNLLENLQAYQKRMGLQMQRFKxxxxxxxxxxxxxxxxxxxx
>Protein:M1|Subtype:N/A|Blocksize:9|String:4
xxxxxxxxxxxxxxxxxxxxxxxxAEIAQRLEGVFAGKNTDLEVLMExxxxxxxxxxxxxxxxxxxxxxxxxxxxxxxxxxxxxxxxxxxxxGDPSNMDRAVKL
YKKLKREMTFHGAKEIALGYSTGALASxxxxIYNRMGTVAxxxxxxxxxxxxEQIADSQHKSHRQMVATTNPLIRHxxxxxxxxxxxxxxxxxxxxxxxxxxxxxxxxxxxxxxx
xEQAAEAMEIAxxARQMVHAMRTVGTHPxxxxxxxxDLIENLQAYQKRMGVQIQRFKxxxxxxxxxxxxxxxxxxxx
>Protein:M1|Subtype:N/A|Blocksize:9|String:5
xxxxxxxxxxxxxxxxxxxxxxxxAEIAQRLENVFAGKNxxxxxxxxxxxxxxxxxxxxxxxxxxxxxxxxxxxxxxxxxxxxxxxxxxxxxxxxxxxxxMDKAVKLYKKL
xxxITFHGAKEISLSYxxxxxxxxxxxxxxxxxxxxxxxxxxxxxxxxxxxxxxxxxxxxxxxxxxxxxxxxxxxxxxxxxxxxxxxxxxxxxxxxxxxTRQMV
QAMRAVGTHPxxxxxxxxDLLDNLQAYQKRMGVQMHRFKxxxxxxxxxxxxxxxxxxxx
>Protein:M1|Subtype:N/A|Blocksize:9|String:6

FIG. 76-168

```
xxxxxxxxxxxxxxxxxxxxxxxxxxxxxLEDVFSGKNxxxxxxxxxxxxxxxxxxxxxxxxxxxxxxxxxxxxxxxxxxxxxxxxxxxxxxxxxxxxxxxxVT
FHGAKEVALGYSTGAxxxxxxxxxxxxxxxxxxxxxxxxxxxxxxxxxGVQMQRFRRPDSSWLFxxxxxxxxxxxxxxxxxxxxxxxxxxxxxxxxxxMVQA
MRTVGTxxxxxxxxxxxxxxxxxxxxxxxGVQMQRFRRPDSSWLFxxxxxxxxxxxx
>Protein:M1|Subtype:N/A|Blocksize:9|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxITFHR
AKEVALSYSAGAxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxx
>Protein:M2|Subtype:N/A|Blocksize:9|String:1
MSLLTEVETPxxxxxxxxxxxxxxxxxxxxxxGILHLILWIxxxxxxxxxxxxxxxxxxGVPESMREEYRQExxxxxxxxxHFVSIELEG
>Protein:M2|Subtype:N/A|Blocksize:9|String:2
xSLLTEVETLxxxxxxxxxxxxxxxxxxxxxxGIVHLILWIxxxxxxxxxxxxxxxxxxGVPKSMREEYRKExxxxxxxxxxHFVNIELED
>Protein:M2|Subtype:N/A|Blocksize:9|String:3
xSLLTEVETHxxxxxxxxxxxxxxxxxxxxxxGVLHLILWIxxxxxxxxxxxxxxxxxxGIPESMREEYQQExxxxxxxxxxxxxxxxxxx
>Protein:M2|Subtype:N/A|Blocksize:9|String:4
xSQLTEVETPxxxxxxxxxxxxxxxxxxxxxxGILHLVLWIxxxxxxxxxxxxxxxxxxGMPESMREEYREExxxxxxxxxxxxxxxxxxx
>Protein:M2|Subtype:N/A|Blocksize:9|String:5
xxxxxxxxxRPTRNGWGCxxxxxxxxxxxxxxxxxxxxxxxxxxxxxxxxxxxxxxxxxxxxxxxSMREEYRQKxxxxxxxxxxxxxxxxxx
>Protein:NP|Subtype:N/A|Blocksize:9|String:1
SKSRVDNHSMSDIEAMASQGTKRSYEQMETGGExxxxATEIRASVGRMVGGIGRFYIQMCTELKLSDYEGRLIQNSITIERMVLSAFDE
RRNKYLEEHPSAGKDPKKTGGPIYRRxxxxxxxxxxxxEIRRIWRQANNGEDAxAGLTHMIWHSNLNDATYQRTRALVRTGMDPRM
CSLMQGSTLPRRSGAAGAAVKGVGTMVMELI

FIG. 76-169

RSALILRLRGSVAHKSCLPACIYGLVVxSGYDFEKEGYSLVGIDPFRLLQxxxxxxSLIRPKENPAHKSQLIWMACNSAAFEDLRISxxx
xxxxPRGQLATRGVQIASxxxxxxxxTLELRSKYWAIRTRSGGNNNQxxASAGQISTQPTFSVQRSLPFERxxxxxxGNAEGRTSDMRT
EVIRxxxxxxxxEVSFRGRGVFELSxxxxATSPIVPSFDMSKEGSYFFGDSAEExxxxx
>Protein:NP|Subtype:N/A|Blocksize:9|String:4
xxxxxxxxMSDIGAMASQGTKRSHEEQMETGGERQxANEIRASVGRMIGGIGRFYVQMCTELKLSEQEGRLIQNSMTIERMxxxxxxxxN
RYLEENPSAGKDPKxxxxxxxxxxxxxxxxxxxxxxxxEVRRIWRQANNGEDSxSGLTHIMIWxxxxxxxxxxxxxxxxxxxxxxxxxxx
xAAVKGVGTIVLELIRMIKRxxxxxxxxxxxxxxxxxxTRTAYERMCNIxxxGKFQTAAQKAMMDQVRESRSPGNAEIEDLIFMARSALILRLRGS
IAHKSCLPACVYGPAVxSGYNFEKEGYSLVGVDPFRLLQxxxxxxSLIRSNENPAHKSQLVWMACNSAAFEDLRVLxxxxxxxxxPRGRL
STRGIQIASNENxxxxxxxxxxxxxxxxIRTKSGGNTNxxxASAGQISIQPTFSVQRNLPFEKxxxxxxxGNSEGRTSDMRAEIIKxxxxxxxxxxxxxx
EVSFQGRGVVFELSDEKATNPVVPSFDMSNDGSYFFGDNAEEFxxxx
>Protein:NP|Subtype:N/A|Blocksize:9|String:5
xxxxxxxxDIEIMASQGTxRSYEQMETDGExxxxATEIRTSVGRMVGGIGKFYIQMCTExxxxNEGRLIQNSLTIERMxxxxxxxxKYLE
EHPSTGKDPKKTGxxxxxxxxxxxxxxxxxxxxxxxELRRIWRQANSGEDAxxxxxxxxxxxxxxxxxxxxxxxxxxxxxxxxxxxAAIKG
IGTMVMELVRMIKRGINxxxxxxxxxxxTRGAYERMCNIxxxxQTAAQRAMVDQVxxxxxxxEIEDLIFLTRSASALILRGSVAHKxxLP
ACVYGLVVxGGYDFEREGxxxxxDPDPFRLLQNSQVxxxxxxxxxxxxxxxxxxxxxxxxxxxxPRGQLTTRGVQIAxxxxxxxxx
xxxxxxxxxxxTRSGGNTNHxxASAGQVSVQPxxxxxxxxxxxxxxxxxxxxxxxxGNPEGRTSDMRTEIIKxxxxxxxxxxxxxEMSFQGRGVFFELSDE
RATNPIVPSFEMSNEGSYxxxxxxxxxxxxx
>Protein:NP|Subtype:N/A|Blocksize:9|String:6
xxxxxxxxxxxxxxxxxMALQGTKRSYEQMETS

FIG. 76-170

>Protein:NP|Subtype:N/A|Blocksize:9|String:9
xxxxxxxxxxxxxxxxxxxxxxxxxxxEQMETDGDRQxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxFKLLQNSQIxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxGVFELSDERAAxxxxxxxxxxxxxxxxxxxxxxxxxxxxx
>Protein:NP|Subtype:N/A|Blocksize:9|String:10
xxxxxxxxxxxxxxxxxxxxxxxxxxxEQMETDGERQxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPRLLQNSQVxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxx
>Protein:NP|Subtype:N/A|Blocksize:9|String:11
xxxxxxxxxxxxxxxxxxxxxxxxxxxEQMETSGERQxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
>Protein:NP|Subtype:N/A|Blocksize:9|String:12
xxxxxxxxxxxxxxxxxxxxxxxxxxxxQMETGERQNxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxx
>Protein:NS1|Subtype:N/A|Blocksize:9|String:1
MLFVQSYFQLFLVCVSLLQSAILSLFQVDCFLWHVRxxxxxxxxGDAPFLDRLRRDQxDRLRRDQKSLRGRxxxPMRTPIAFLTSSIVCPxx
xxxxxxxxxxxxxxxxxxxxxxxxxxxxxxxxIASVPASRYLIDMxxxxxxxxxxxxxxxxxxxxxxxxxxxxxxxxxxxxxxxxxxxxxxxxAGVETMVILSxxxxxxxx
xxxxxxxxxxxxxxxxxxxxxxNWPSSSGGLxxxxxxxxxxxxxxxxxxxxxxxxxxxxxxSRNGKWREQLSQKFEEIRxxxxxVRGDQMAHCNSFEQITF
MQALQL
>Protein:NS1|Subtype:N/A|Blocksize:9|String:2
xxxxxxxxxxxxxxxxxxxxxxxxSSFQVDCFLWHIRxxxxxxxxSDAPFLDRLLQANLCRFLETRxxxxxxxxxxxxxxxxxxxxxxxxxxxxxxxxxxxxxxxxx
xxxxxxxxxxxxxxxxxxxxLKMPASRYLTDMxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxVRRDQMAHCRMxxxxxxxxxxxx
>Protein:NS1|Subtype:N/A|Blocksize:9|String:3

FIG. 76-171 xxxxxxxxxxxxxxxxxxxxxxxxxxxxxxxxxxxxxxxxxxTSFQVDCYLWHIRxxxxxxxCDAPFDDRLRRDQxDRLRRDQRSLRGRxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSKITLKFA

FIG. 76-172

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxQKFEEMRWLIxxxxxxxxxxNSFEQITFIQALQLLLEVENEIRTFSFQLILLxxx
>Protein:NS2|Subtype:N/A|Blocksize:9|String

FIG. 76-173

```
xxxxxxxxRGEETIEEKFEIxxxxxxxDQSLPPNFPSxxSFRAYVDGFKPNGCIEGKLSQMPKEVxxxxxxxxxxxxxxxxxxxxxxCFQRSKFLL
MxxLKLSIENPSHExxxGIPLYDAVKCMRTFGWKEPxxxxxxxxxxxxxxxxxxxxxxxxxxxxxxxxLKWTLGENMAPEKVD
FExxxxxxxxxxxxxxxxxWVQSEFNKACELTDSTxxWVELDEIGEDVAPIEYVASMRRSYFTAEVSSHCRATEYIMKGVYINTAML
NASCAAM

FIG. 76-174 xxxxxxxxxxxxxxxxxxxxxxxxxxxxxxxxxxxxxxxxxxxxxxxxxxxxxxxxxxxxxACELTDSIWxxxxxxxxxxxxxxxxxxxxxxxx
xxxxHCRATEYMMKxxxxxxxxxxxxxxxxxxxxxxxxxxxxxxxxxxxxxxxxxxFSLVDPRLExxxxxxxxxxxxxxxxxxxxxxxxxxxxx
xxxxxxxxxxxxxxxxxxxxxxxxxxxxxxxxxxxxxxxxxxxxxxxxxxxxxxxxxx
>Protein:PA|Subtype:N/A|Blocksize:9|String:9

FIG. 76-175

NMINNDLGPATAQMALQLFIKDYRYTYRCHRGDTQIQTRRSFELKxxxxxxxxGLLVSDGGPNLYNIRNLHIPEVCLKWELMDxxYQG
RLCNPLNPFVSHVGTRWMKIIRVGCVILLNPFVSHKxxxxxxxxxMEYDAVATTHSWIPKRNRSILNTSQRGRSGQNHGICAV
ATTHSWVPILNTSQRGILEDEQMYQKCCNLFEKFFPSSSYRRPVGISSMVEAMVSRARIDARIDFESGRIGKKEFSEIxxxxxEELRRQ
KSLIWLWLVLREKMP
>Protein:PB1|Subtype:N/A|Blocksize:9|String:2
xxVNPTLLFLExKIPAQNAISTxxxxxxxxxxxxxTGYTMDTV

FIG. 76-176 xxxxHPTLLFLKVPVQxxxxxxxxxxxxxxxxxxxxxxxxxxxxxxxxxxNTETGALQLNPIDGPLPVDNEPNGYAQxxxxLEAMAFLEDS
HPGIFGNSCLETxxxxxxxxxxxxxxxxxxxxxxxxxxxxxxxxxxxxxxxxxxLIDFLKDVTxxxxxxGITHFQRKRRVRDSMTxRMIT
QRTIGxxxxxxxSYIIRALTLNTxxxxxxxxxxxxxxxxxxxxVYFVETLAKNICEKLEQSxxxxxxxxxxxxxxxxxxTNSQDTEVSFTIxxx
xxxxxxNQNPRIFLAMITYIxxxPDWFRNVLSxxxxxxxxxxxxxxxxxxxxxxxxxxxxxxxxxxxxxxxxxxxxxxxxxxxxxx

FIG. 76-177

>Protein:PB1|Subtype:N/A|Blocksize:9|String:9
xxxxxxxxYFFLKVPVQNAISTxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxTFLAMITYIxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxx
>Protein:PB1|Subtype:N/A|Blocksize:9|String:10
xxxxxxxxxxxxKIPVQNAISTxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxx
>Protein:PB1|Subtype:N/A|Blocksize:9|String:11
xxxxxxxxxxxxEVPAQNAISITFxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxx
>Protein:PB2|Subtype:N/A|Blocksize:9|String:1
SKSRSNIFNMERIKELRxLMSQSRTREILTKTTVDHMAIIKKYTSGRQGRQEKNPALRMKWMMAMKYPITADxxxxxxIPERNEQGQTL
WxxxxxxxxxxxMVSPLAVTWWNRNGPxxxxxHYPKVYKTYFxxxxxxxxGTFGPVHFRNQVKIRRRVDINPGHADxxxAKEAQDVIMEVVF
PNEVGARILTSESQLxxxxxxxxxxxxxxIAPLMVAYMLERELVRKTRFLPVAGGTSSVYIEVLHLTQGTCWEQMYTPGGEVRNDDVDQSL
IIAARNIVRRAAVSADPLASLLEMCHSTQIGGxxxxDILRQNPTEEQAVDICKAAMGLRISSSFSFGGFTFKRTSGSSxxxEEEVLTGNLQT
LKIxxxEGYEEFTMVGxRATAILRKATRRLIQLIVSGRxxxxxxxxxIVAMVFSQEDCMIKAVRGDLNFVNRANQRLNPMHQLLRHFQKDA
KVLxxxxxxxxxxxxxxxxxxxxxxxxxxxxxxxxRVSKMGVDEYSSTERxVVSIDRFLRVRDQRGNVLLSPEEVSETQGTEKLTITYSSSMMWE
INGPESVLVNTYQWIIRNWExxKIQWSQDPTxLYNKMEFEPFQSLVPKAxRGQYSGFVRTLFQQMRDVLGTFDTVQIIKLLPFAAAPPE

FIG. 76-178

```
QSRMQFSSLTVNVRGSGMRILVRGNSPVFNYNKxTKRLTVLGKDAGAGALAEDPxxxxAGVESAVLRGFLILGKEDKRYGPPALSINEL
SNLAKGEKANVLIGQGDVVLVMKRKRDSSILTDSQTATKRIRMAINQCxxx
>Protein:PB2|Subtype:N/A|Blocksize:9|String:2
SESRSNIFNMxxxxxxxLMLQSRTREILTRTTVDHMAIIKRYTSYTSGRQEKNPAxRMKWMMAMRYPITADxxxxxxVPERNEQGQILWx
xxxxxxxxxMISPLAVTWWNRKGPxxxxxxH

FIG. 76-179 xxxxxxxxxxxxxxxxxxxxxxxGTGSIYIEVLHxxxxxxxEQMYTPGGKVRNDEVDQSLIIxxxxxxxATVSADPLVSLLExxxxxxxxxxxxxx
xxNPTEEQAVE

FIG. 76-181 xxxxxxxxxxxxxxLPTFDSLNITAASLNDDGxxxxxxxxxxxxxxxxxVTTRQASPSCLVVRKxxxxxxxxxxxxxxxxxxxxxxSGSLQCRICIx
xxxxILDQNFRNIRK
>Protein:HA|Subtype:ALL|Blocksize:10|String

FIG. 76-183 xxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxKGLFGAIAGFxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxx
>Protein:NA|Subtype:ALL|Blocksize:10|String:1
IGLREQKQEFKMNPNKK

FIG. 76-184

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxx
>Protein:NA|Subtype:ALL|Blocksize:10|String:5
xxxxxAKAGVKMNPNQKIINRDITIGSICxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxx
>Protein:NA|Subtype:ALL|Blocksize:10|String:6
xxxxxxxxxIKMNPNQKIIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-185

DGTGWLTIGISGPDNEAVAVLKYNGMITxxxxxxxIMRTQESECACxNGSCFTVLTDGPSxxxxxxxxxxGKRGKWVKSVxxxAPNF
YYEECSCYPDTxxxxxxxxNWHASNRPWISFxxxxxxYICSGVFGDSPRxxxxxxxxxxxxxxxxxKYDNGVWIGRTKxxxxxGFE
MVWDPNGWxxxxxxxxxxxxNDWSGYSGSFIQHPELTGLNCMRPCFWVELIRGQPxxxxTIWASGSSISFCGVSxxxxxxxxxxxWSW
PDGAEVPFxxxxxxx
>Protein:NA|Sub

FIG. 76-186

VRCVCRDNWRGSNRPVxxxxxxxxxxYLCSGLVGDTPRNxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxSGY

FIG. 76-187

```
xxxxxxxxxxxxxxxxxxxxxxxxxxxxxxxxxxxxxxxxxxxxxxxxxxxxxxxxxxxxxxxxxKDILRTQESECQCIxxxxxxxxxxxxxxxxxxxxxxxxxxxxxx
xxxxxKIQHLEECSCYVDxDVYCICRDNWKGSNRPWMRINNETILETGYVCSKFHSDTPRPADPSxxxxxxxxxxxxxxxxxxGNDVWL
GRTVSxxxxxxxxxxxxxxxxxxxxxxxxxTQTLVSNNDWSGYSGSFIVxxxDCFQPCFYVELIRGRxxxxxxVSWTSNSIVTFCGLDNEPGSGN
WPDGSNIGFMPK
>Protein:NA|Subtype:N3|Blocksize:10|String:2
xxxxxxxxxxxxxxxxxxxxxxxxxxxxxxxxxxxxxxxxxxxxxxxxxGNLIFNTVIHxxxxxxxxxxxxxxxxxxxxxxxxxxxxxxxxxxxxLPLCPFKGFFPFHKDNALR
LAENxxxIVTREPYISCD

FIG. 76-188 xxxxxxxxxGSNRPWMRISNETIxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxDNEPGSGSWPDGSKIGFMPx
>Protein:NA|Subtype:N3|Blocksize:10|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxx

FIG. 76-189

```
xxxxxxxxxxxxxxxxTTIGLLLQIISLxxxWFSHYNQVAQxxxxxxxxxxxxxFVNVTNVQNDYTTVxxxxxxxxxxxxxxxxxxxxxxxx
xxxxxxxxxxxxxxxxISCSIDECRTxxxxxxxxxxxxxxxxxxxxLMSCHIGVAPSPSNxxxxxxxxxxxxxxxxxxxxxxxPDATAVVLKxxxx
xxxxxxxxxxxxxxxxxxxxxxxxxxxxxxxDGQAFYKILKIRKGKIMxxxxxAAGFHFEECSCxxxxDVECVCRDNWxxxxxPWIRFNSDLN
YQIGYICSGIFGDNPRPMDGxxxxxxxxxxxxxxxxxxxxxxANGWVSTDKSSNGVQDxxxxxxxxxxxxxxxxxxxxxxxx
xxxxxxxxxxxxxxxxxxxxxxxxxxxxFCGVNSDTTSWxxxxGALLPFDIDR
>Protein:NA|Subtype:N4|Blocksize:10|String:6
xxxxxxxxxxxxxxxxxxxxxxVGLLLQVTSLxxxxFSHYNQVTQPxxxxxxxxxxxxxxxxxxxxxTHVQNNYTT

FIG. 76-190

AYAxxHYGGVPTDVIRSWRKQILRTQESSCVCMNGxxxWVMTDGPANKQASYKIFKSRxxxxxxEISFQSGHIEECSCYPNLGQVECV
CRDNWxxxxxxxxxxYKVGYLCAGIPTDTPRVQDDxxxxxxxAIGGSGTDNYGxKGFAFKQGNSVWAGRTIxxSSRNGFEILLIEEG
WxxxxxxxxxEILNNKNWSGYSGSFxxxxxxxxxxxxxxxxEMI

FIG. 76-191

MNPNQKITCISATGVTLSVVSLLxGIANLGLNIGIHxxxxxxxxxxxxxxxxxxxxxxxxxxxxxxxxxxxxxxxxxxxxxxxxxxxxxxKPLCEVSSWHILSK
DNAVRIGEDAHVLVTREPYLSCDPxGCRMFALSQGTTLKGRHANGTIHDRSQFRALISWEMGLAPSPYNxxVECIGWSSTSCHDGMSR
MSICISGPNNNASAVIWYxxxxTEIPSWAGNILRTQESECVCHKGICPVVMTDGPASxxxxxxxxxxxxxxxxxGNAQHIEECSCYGSxx
xVKCICRDNWKGANRPIITNxxxMTHMSKYLCSKVLTDTSRPSDPxxxxxxxxxGGGPDPGVKGFAFLNGxNSWLGRTTSKDSRSGYEV
LKVPNAExxxxxxxxxIVNNQDWSGYSGAFIxxxxxK

FIG. 76-192 xxxxxxxxxxxxxxxxxxxxxxxxxxxxxxxxxxxxxxxxxxxxxxxxxxxxxxxxxxxxxxxxNWSGYSGAFVDYWxxxxxxxxxxxxxxxxxxxxxxxxxxxxxxxxxxxxxxxxxxxxxxxxxxxxxxxxxxxxxxxxxxxxxxxx
xxxxxxxxxxxxxxxxx
>Protein:NA|Subtype:N6|Blocksize:10|String:8
xxxxxxxxxxxxxxxxxxxxxxxxxxx

FIG. 76-193

GFEMLKIPNAETDPxxxxxxxxxxxxxxxxxxxxxxxxxxSACYNPCFYVExxxxxPEEAKYVWASNSLIALCGSPVPIGSGFFPDGPQIQY
Fx
>Protein:NA|Subtype:N7|Blocksize:10|String:5
MNPNQNLFF

FIG. 76-194

HSNGTVKDRSPYRTLMSVEIGQSPNVYQARFEAVAWSATACHDGKKWMTxxxxxxxxxxxxxxxxxxxxxxxxxGDILRTQESSCTCIQG
ECYWVMTDGPANRQAxxxxxxxxxxxxxFNGGHIEECSCYPNEGKVECVCRDNWTGTNRPVLVISxxLSYRVGYLCAGLPSDTPR
GEDSQFxxxxxx

FIG. 76-195 xxxxxxxxxIGLSPNVYQARFxxxxxxxxxxxxxxxxxxxxxxxxxxxxxxxxxxxxxxxxxxxxxxxxxxTQESSCTCIRGxxxxxxxxxxxxxxxxxxxxxxxxx
xxxxxxxxxxxxxxxxxxxxxxxxxxxxxxxxxxxxxxxxKGTNRPVLVIxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxSWQDGAILPFxxxxxxx
>Protein:NA|Subtype:N8|Blocksize:10|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxPNVYQAKFEAxxxxxxxxxxxxxxxxxxxxxxxxxxxxxxxxxxxxxxxxxxxxxxxxxxxxxxQGSLLNDKHFNxxxxx
xxxxxxxxxxxxxxxxxxxxxxxxxxxxxxxxxxxxxxxxxxxxxxxxxxxxxxxxxxxxxxxTQESSCTCILGxxxxxxxxxxxxxxxxx
xxxxxxxxxxxxxxxxxxxxxxxxxxxxxxxxxxxxxxxxxxxxxxxxxxxxxxx
>Protein:NA|Subtype:N8|Blocksize:10|String:8
xxxxxxxxxxxxxxxxxxxxxxxxxxxxxxxxxxxxxxxxxxxxxxxxxxxxxxxxxxxxxxxxxxxxxxxxxxxNDKHSNGTMKD
Rxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxx
>Protein:NA|Subtype:N9|Blocksize:10|String:1
MNPNQKILCTSATAxxxxxxxxxANLGLNIGLHLKPxxxxxxxxxxSQTIINNYYNETNxxxxxxxxxxxxxxFNNLTKGLCTINSWH
IYGKDNAVRIGEDSDVLVTREPYVSCDPDECRFYALSQGTTIRGKHSNGTIHDRSQYRALISWPLSSPPTVYNSRVECIGWSSTSCHDG
RARMSICISGPNNNASAVIWYNRRPVTEINTWARNILRTQESECVCHNGVCPVVFTDGSATGPAETRVYFxxxxxxLTGTAKHIEE
CSCYGExxxITCTCRDNWQGSNRPVIQIDPxAMTHTSQYICSPVLTDNPRPNDPAVGKCNDPYPGNNNNGVKGFSYLDGxNTWLGRTIS
TASRSGYEMLKVPNALIDDRSKPxQGQTIVLNTDWSGYSGSFMDYWAEGECYRACFYVELIRGRPKEDKVWTSNSIVSMCSSTEFL
GQWNWPDGAKIEYFL
>Protein:N

FIG. 76-196

RSGYEMLKVPNALTDNRSKPxQGQTIVLTTDWSGYSGSFVDYWAEGDCYRACFYVELIRGRPKEDRVWWTSNSIVxxxxxxxxGQWN
WPDGAEIEYFL
>Protein:NA|Subtype:N9|Blocksize:10|String:4
MNPNQRILCTSAxxxxxxxxxxxxxxxxxxTNLGLNIGLHxxxxxxxxxxxxxxxxxxxSRTIINNYYNKTNxxxxxxxxxxxxxxxxxFNNLTKRLCTINSWHIF
GKDNAVRIGEKSDVLVTREPYVSCDPDGCRFYALSQGxxxxxxxxxxxxxxxxxQYRALISWPQSSPPTVYNSKVECIGWSSTSCHDGKFRM
SxxxxGPNNNASPVIxxxKRPVTEINTWxxxxxxxQESECVCHDGVCPVVFxxxSATGPADTRVYYFxxxxxxxxxxxxxxxHIEECSCYGKxxxx
xxxxxxxxxxxxxxxxxTMTHTSQYICxxxTDNPRPNDPVxxxxNDPYPGNSNNGVKGFSYxxxxNTWVGRTISIASRSGYEILKVPNALT
DDKSKPxQGQIIVLNTDWSxxSGSFIDYWAEGxxxxxxxxxIRGRPKEDEVWWTSNSIVxxxxxxxxxxxxxxDWPDGAKIKYFL
>Protein:NA|Subtype:N9|Blocksize:10|String:5
xNPNQKIQCTSATxxxxxxxxxxxxxxxxxxxxxxxxxxxxxxxxxxxxxxxxxxxxxxQTIINNYYNKxxxxxxxxxxxxxxxxxxxxxFNNLTKELCTxxWHIYGK
DNAIRIGEDSDILVTREPYVSxxxxxxxxxxxxxxxxxxxxxxxxxxSSPPTVYSSRxxxxSSTSCHDGKTRMxxxxPNNNAST
VIWYNGRPTTEINTWARNxxxxESECVCHNGICPVVFTDxxxxxxxxxxxxxxxxxxxxxxxxxxxxxxxxxxxxxxxx
xAMKHTSQYICSPxxTDNPRPNDPSxxxxNDPYPGSNNNGVKGFSxxxxxTWLGRTTSTASRSGYEVLRVPNALTDDRSTxxxGQTIVLDT
DWSGxxGSFIDYWAKEECYRACFYVxxxxxxxxxxxxxxxxxxxxxxxxxxWPDGAKIETLx
>Protein:NA|Subtype:N9|Blocksize:10|String:6
xxxNQKILCTSAIAxxxxxxxxxxxxxxxxxxxxxxxxxxxxxxxxxxxxxxxxxxxxxxxQTIINNYYNDTNxxxxxxxxxxxxxxxxxxxxxxxxNNLTKGLCIINSWHIYGKD
NAVRIGESSDVLVTREPxxxxxxxxxxxxxxxxVCHSGVCPVVFxxxxxxxxxxxxxxxxxxxxxxxxxxxxxxxxxxxxxxxxNNASAVIWYKx
xxxxxxxxxxxxxxxNDPYPGNNNKGVKGFxxxxxxxxxWLGRTINTASRSGYExxKVPNALTDERSKPxxxxTIVSNTDWSGYSxxxxDYWAK
GDCYRACFYxxxxxxxxxxxxxxxxxxxxxxxxxxxxxxxxxxxxxxxxx
>Protein:NA|Subtype:N9|Blocksize:10|String:7
xxxxxxxxxxxxxxxxxxxxxxxxxxxxxxxxxxxxxxxxxxxxxxxxxxxxxxxxxxxxxxxxxxxxxxxxxxxxNLTRGLCKINSWHxxxxxxxxxx
xxxxxxxHNGICPVAFTDxxxxxxxxxxxxxxxxxxxxxxxxxxxxxxxxxxxxxxxxxxxxxxxxxxxxxxxxxxxxxxxxxxxxxxxx
xDPYPGNNNGVKxxxxxxxxxxGRTISTASRAGYEMLKVPNALTNDRSKxxxxxxxxxxxxxxxxxxxxxxxxxxxxxxxxxxxxxxxxxx
xxxxxxxxxxxxxxxxxxxxxxx
>Protein:NA|Subtype:N9|Blocksize:10|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxRTISTASRYGYEMLKVxxxxxxxxxxxxxxxxxxxxxxxxxxxxxxxxxxxxxxxxxxxxxxxxxxxxx
xxxxxxxxxx
>Protein:HA|Subtype:H10|Blocksize:10|String:1
xxxxxxxxxxxxxGLDKICLGHHAVSNGTxxxxxxxKEEVTNATETVESxxxxxxxxxxxxKDLGNCHPIGMxxxxxxxxxxxxxxxxxxxxx
xxxxxxxNEEALRQKIMESGGIxxxxxxxxxxxxxxxxxxxxxxxxxxxxxxxxxxxxxxxQNFPQTTNTYRNTDSxxxxxxxxxxxxxxxxxxxxxxLYGT

FIG. 76-197

QSLSISVGSSTYQNNFVPVVGARPQVNGQSGRIDFHWxxxxPGDNITFSHNGGLIAPSRVxxxxxxxxxxxxxxxxCESKCFWKGGSINTK
LPFQNLSPRTVGQCPKYVNxKSLLLATGMRNVPEVxQGRGLFGAIAGFIENGWEGMVDGWYGFRHQNAQGTGQAADYKSTQAAIDQ
ITGKLNRLIEKTNTEFESIESESFSEIEHQIGNVINWTKDSITDIWTYQAELLVAMENQHTIDMADSEMLNLYERVRKQLRQNAEEDGKG
CFEIYHxxxxNCMESIRNNTYDHTQYREEALLNRLNINPVKLSSGYKDVILWFSFGASCFVLLAxxxxxxxxxGNMRCTISLVKTTLFL
>Protein:HA|Subtype:H10|Blocksize:10|String:2
xxxxxxxxxxGIDKICLGHHAVPNGTxxxxxxxQEEVTN

FIG. 76-198

VRARPQVNGQSGRIVFHWxxxxxGDHITFSHNGGLIAPNRVxxxxxxxxxxxxxxxxxxxxxxxxxxxxxKCFWKGGSIKTKLPFxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxQAADYKSTQKTIxxxxxxxxxxxxxxxxxxxxxxxxxxxxxxxxxxxxxxxxxxxxxxxxxxxxxxxxxxxxxxxxxIRNNTYDHSHYREEALLNRLNINSVKLFSGYKDIILWxxxxxxxxxxxxxxxxxxxxxxxxxxxxxxxxxxxxxxxxxxxxx >Protein:HA|Subtype:H10|

FIG. 76-199 xxxxxxxxxxxGLDRICLGHHAVANGTIVKTLTNEQEEVTNATETVENKxxxxxxxxxxxKDLGNCHPVGMxxGTPVCDPHLTGTWDT
LIERGSSxAYCYPGTTVNEEALRQxIMESGGISKMSTxxxxxxxxxxxxxxxxxxxGKNSFYAELKWLVSKTKGQNFPRTTNTYRNTDTxEH
LITWGIHHPSSAQEKNDLYGAQSLSISVESSTYQNNFVPVIGAxxxxxxQSGRIDFHWAxIQPGDNITFSDNGGLIAPSRVTKLKGxxxxxxxxx
xxxDNSCESKCFWKGGSIKTKLPFQNLSxxxVGQCPKYVNQKSLMLATGMRNVPETxxxxGLFGAKAGFIENGWEGMVNxxxxxxxxxxxx
xxQ

FIG. 76-200

MNPNQKLFALSGVAIALxxLNLLIGISNVGLNVSLHLKEKGTKQEENLxxxxxTQNNTTLIENTYVNNTTVINKxxxxxxYLMLNKSLCK
VEGWVVVAKDNAIRFGESEQIIVTREPYVSCDPLGCKMYALHQGTTIRNKHSNGTIHDRTAFRGLISTPLGSPPIVSNSDFLCVGWSSTS
CHDGIGRMTICVQGNNDNATATVYYDRRLTTTIKTWAGNILRTQESECVCHNGTCVVIMTDGSASSQAYTKVLYFHKGLVIKEEALK
GSARHIEECSCYGHNSKVTCVCRDNWQGANRPVIEIDMxAMEHTSQYLCTGVLTDTSRPSDKxxGDCNPITGSPGAPGVKGFGFLDS
GNTWLGRTISPRSRSGFEMLKIPNAGTDPNSxxxxxxxxxxNNNWSGYSGSFIDYWDExSECYNPCFYVELIRGRPEEAKYVWWTSNSLV
ALCGSPISVGSGSFPDGAQIQYFS
>Protein:NA|Subtype:H10N7|Blocksize:10|String:2
MNPNQKLFTLSGVAIALxxLNLI

FIG. 76-201 xxxxxLFALSGVAITLxxxxxxxxxxxxxxxxxxxxxxxxxxxxxxxxxxxxxxxxxxxxxxxxxxxxxxxxxxxxxxxxxLNKRLCKVEGxxxxxxxxxx
xxxxxxxxxxxxxxxxxxxxxxxxxxxxxxxxxxxxxxxxISTPLGSP

FIG. 76-202

NTxxxxxNVHRSTIGDCPKYVNIKSLKLATGPRNVPAxxARGLFGAIAGxxxxxxxxxxYGFQHRDEEGTGIAADRESTQKAxxxxxxxxx
xxxxxxxxxxxxxxxxxxxxxxxxxxxxxxxxxxxxxDIWSYNARLLVLLExxxLDLHDSNVRSLHEKxxxxLKGNAKDEGNGCFPFYHKCDNKCIER
VRNGTYDHKEFEKESKLNRQEIGGVKLDxxGDVYKILSIYSCIASSLILAAIIMGxxxWACNNGSCRCTICx
>Protein:HA|Subtype:H11|Blocksize:10|String:4
xxxxxxxxxxxQADEICI

FIG. 76-203

KSHGRILKNNLPxxxxTECQLNEGVMNTSKPFQNTSKHYIGKCPKYIPSGSLKLAIGLRNVPQAQDRGLFGAIAGFIEGGWPGLVAGW
YGFQHQNAEGTGIAADRDSTQKAIDNMQNKLNNVIDKMNKQFxxxxxEFSEVESRINMINSKIDDQITDIWAYNAELLVLLENQKTLDE
HDANVRNLHDRVRRxxxENAIDTGDGCFEILHKCDNxxxxTIRNGTYNHKxYEEESKIERQKINGVKLEENSTYKILSIYSSVASSLVLLL
MIIGGFIFGCQNGNVRCTFCI
>Protein:HA|Subtype:H12|Blocksize:10|String:2 xxxxxxxxxxxLAYDKICIGYQ

FIG. 76-204 xxxxxxxxxxxxxxxxxxxxxxxxxxxxxxxxxxxxxxxxxxxxxxxxxxxxxxxxxxxxxxxxxxxxxxxxxxxxxxxxxxxxxxxSIEN
QEELRLFxxxxxxxxxxxxxxxxxxxxxxxxxxxxxxxxxxxxxxxxxxxxxxxxxxxxxxxxxxxxxxxxxxxxxxxxxxxxAIGPRNVPQV
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
QxxxxxxxxxxxxxxxxxxxxxxxxxxxxxxxxxxxxxxxxxxxxxxxxxxxxxxxxVESRINTINSKIxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H13|Blocksize:10|String:1
xxxxxxxxxxxxxxxxxxxADRICVGYLSTNSSERV

FIG. 76-205 xxxxxxxxxxxIRGEFSQVERRINMLADRIxxxxxxxxxxxxxxxxxxxxTLDMHDANVKNLHEQVRxxxxxxxxxxxxxxxxxxxxxLHKCNDSCM
DTIRNGTYNHIxxxxxxLKRQEIEGIRLKSEDGVYKALSIYSxIASSVVLVGPILSFIMWAGxxxxxxxxx
>Protein:HA|Subtype:H13|Blocksize:10|String:5
xxxxxxxxxxxxxxxxxxxxxxxxxxxxxxxxxxxxxxxxxxxLSTNSSEKVNTLLENDVPVTSTIDLI

FIG. 76-206

FLRSNAPSGIEYNGKSLGIQSDAQIDESCEGECFYSGGTINSPLPFQNIDSRAVGKCPRYVKQSSLPLALGMKNVPEKIRTRGLFGAIAGF
IENGWEGLIDGWYGFRHQNAQGQGTAADYKSTQAAIDQITGKLNRLIEKTNKQFELIDNEFTEVEQQIGNVINWTRDSLTEIWSYNAE
LLVAMENQHTIDLADSEMNKLYERVRRQLRENAEEDGTGCFEIFHRCDDQCMESIRNNTYNHTEYRQEALQNRIMINPVKLSSGYKD
VILWFSFGASCVMLLAIAMGLIFMCVKNGNLRCTICI

FIG. 76-207 xxxxxxxxxxxxxVKYSRADKICIGYLSNNATDTVDTLTENGVPVTSSVDLVETNHTGTYCSLNGISPIHLGDCSxxxWIVGNPSCASNINI
REWSYLIEDPNAPHKLCFPGEVDNNGELRHLxxxxNSFSRTELINPSKWGDILEGTTASCQNRGAxSFYRNLIWLVNxxIGEYPVVKGEY
NNTTGRDVxVLWGIHHPDSETTATKLYVNKNPYTLVSTKEWSRRYELEIGTRIGEGQRSWMKIYWHLMHPGERIMFESNGGLIAPRY
GYIIEKYGSGRIFQS

FIG. 76-208 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxYSCIASSTVMVGLILAF
xxxxxxxxxxxxxxxxx
>Protein:HA|Subtype:H1|Blocksize:10

FIG. 76-209 xxxxxxxxxxxxxxxxxxxxxxxxxxxxxxxxxxxxxYNAKLLVLLENxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxLCSVEYASKTRISEIxxxxxxxxx
>Protein:HA|Subtype:H1|Blocksize:10|String:6
xxxxxxx

FIG. 76-210 xxxxxNKVNSVIEKMNTQFTAVGKEFNxxxxRIENLNKKVDDGFLDIWTYNAELLVLLENERTLDYHDSxxxxxxxxxxNNAKEIGNG
CFEFYHKCDNxCMESVKNGTYDYPKYSEEAKLxxxxxxxxxxxIYQILAIYSTVASSLVLVVSLGAISFWMCSNGSLQCRICIxLQCRICI
RADGxxxxxx
>Protein:HA|Subtype:H1N1|Blocksize:10|String:2
xQGKTKAT

FIG. 76-211 xxxxxxxxxxxxxxxxxxxxxxxxxxxxxxxxxxxxxFEATGNLVAPxxxxxxxxxxxxxxxxxxxxxxxxxxxxxxxxxxxxxxxxxxxxx
xxxLRLATGLRNIPSxxxxxxxxxxxxxxxxxxxxxxxxxxxxxxxxxxxxxxxxxxxxxxxxEKMNTQFTSVGKEFxxxxxxLNKKVDD
GFIDVWTYNAELxxxxxxxxxxxxxxxxxxxxxxxxx

FIG. 76-212

WLTIGISGPDNGAVAVLKYNGIITDTIKSWxxNILRTQESECACVNGSCFTVMTDGPSVMGQASYKIFxxxxxxxxAPNYHYEECS
CYPDSxxITCVCRDNWHGSNRPWVSFNQNLxxxIGYICSGIFGDNPRPxxxxxxxxxxGANGVKGFSFKYGNGVWIGRTKSIxxxGFE
MIWDPNGWTxxxxxxxxxxxxxxxNEWSGYSGSFVQHPELTGLDCIRPCFWVELIRGRPxxxTTIWTSGSSISFCGVNSxxxxWSWPDGAELP
FTIxxx
>Protein:NA|Subtype:H1N1|Blocksize:10|String:2
xxxxxxxxxxKMNPN

FIG. 76-213

>Protein:NA|Subtype:H1N1|Blocksize:10|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxVLKYNGIITETxx
xxxxxxxxxxxxxxxxxxxxxxxxxxxxxxxxxxxxxxxxxxxxxxxxxxxxxxxxxxxxxxxxxxxxxxxxxxxxxxxxxxANRPWVSFNQxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxx
>Protein:NA|Subtype:H1N1|Blocksize:10|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxNRPWVSFNHNLxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxx
>Protein:HA|Subtype:H1N2|Blocksize:10|String:1
xxxxxxxxxxxxxxxxxDTICIGYHANNSTDTVDTxxxKNVTVTHSVNLLExxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxPFQNVHPVTIGECPKYVKSxxxxx
xxxxxxxxSIQSRGLFGAIAGFIEGGWTGMIDGWYGYxxxNEQGSGYAADxxxxxxxxxxxxxxxxxxxxxxxxxxxxxxxxxxxxxxxxxxxENLNKKVDD
GxxDIWTYNAELLVLLENERTLDFHDSNVxxxxxxxxxxxxNNAKEIGNGCFEFYHKCNNxCMESVKNGTYxxxxxxxxxxxxxxxxxxxxxxxxx
xxxxxxxxxxxxxxxxxxxxxxxxSFWMCSNGSLQCRIxx
>Protein:HA|Subtype:H1N2|Blocksize:10|String:2
xxxxxxxxxxxxxxxxxDTLCIGYHANNSTETVDTxxxKNITVTHSVNLLxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxPFQNIHPVTIGKCPKYVKSxxxxx
xxxxxxxxSIQTRGLFGAIAGFIEGGWTGMVDGWYGYxxxNEQGSGFAADxxxxxxxxxxxxxxxxxxxxxxxxxxxxxxxxxxxxxxxxxxxESLNNKVDD
GxxDVWTYNAELLVLLENERTLDYHDSNVxxxxxxxxxxxxNNAKELGNGCFEFYHRCDDxCMDSVKNGTYxxxxxxxxxxxxxxxxxxxxxxxx
xxxxxxxxxxxxxxxxxxxxxxxxxxCFWMCSNGSLHGRIxx
>Protein:HA|Subtype:H1N2|Blocksize:10|String:3
xxxxxxxxxxxxxxxxxDTICVGYHANNSTDTIDTxxxKNVTVTHSINLLExxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxPFQNVHPITIGECPKYVRSxxxxx
xxxxxxxxSVQSRGLFGAIxxxIEGGWTGMVNGWYGYxxxNDQGSGYAADxxxxxxxxxxxxxxxxxxxxxxxxxxxxxxxxxxxxxxxxxxxENLNKKIDD
GxxDLWTYNAELLILLENERTLDLHDSNVxxxxxxxxxxxxNNAQEIGNGCFEFYHKCDDxCMESVRNGTYxxxxxxxxxxxxxxxxxxxxxxxxx
xxxxxxxxxxxxxxxxxxxxxxxxGFWMCSNGSLQCKIxx
>Protein:HA|Subtype:H1N2|Blocksize:10|String:4

FIG. 76-214 xxxxxxxxxxxxxxxxxxxxxxxxxxxxxxDPICIGYHANxxxxxxxxxKNVTVTHAVNLLxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPFQNIHPITIGxxxxxxxxxxxxxxxxSIHSRGLFGAIAxxFEGGWTGMIDxxxxxxxNEQGSGYAANxxxxxxxxxxxxxxxxxxxxxENLNRKVDDGxxDIWTYNAEMLxxxxNERTLDFHDFNVxxxxxxxxxxxxxxNNAREIGNGCFEFYHKCNDxCMESIKNGTYxxxxxxxxxxxxxxxxxxxxxxxxxxxxxxxxxxxxxxxxxxxxxxxxxxxxxxxxxxxxxxxSFWMCPNGSLQCKxxx
>Protein:HA|Subtype:H1N2|Blocksize:10

FIG. 76-215

```
xxxxxxxxxxxxxxxxxxxxxxNILRTQESECVCIxxTCTVVMTDGSASGxxxxxxxxxxxxxxxGSAQHVEECSCYPRYPxVRCVCRDNWK
GSNRPIVDIxxxxxxxxxxxSSYVCSGLVGDTPRxxxxxxxxxxxxxGGHGVKGWAFDxxxxxxxxxxxxRSGYETFKVIxxxxxxxxxxxxxxxxxx
xxxxxSGYSGIFSVExxSCINRCFYVELIRGRKxxxxVWWTSNSIVV

FIG. 76-216 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxTGFAPFSEDNxxxVSA
GGDIWVTRKPYxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxWTSNSIVAFCG
TSGTxxxxxxxxxxxxxxxxxxxxx
>Protein:NA|Subtype:H1N2|Blocksize:10|String:8
xxxxxxxxxxxxxxx

FIG. 76-217 xxxxxxxxxxxxxxxxxxxxxxxxxxxxxxxxxxxxxxxxxxxISFESTGNLVAxxYGFKISKRGNSGIMKTxxxxxCETKCQSPLGA
INTTLxxxxxxxTIGECPKYVRSxxxxxxxxxxPQTESRGLFGAIxxxxxxxxxxxxxxxxxxxxxxxxxxxxxxxxxxxxxxxxxxx
xxxxNLEKRLGNLNK

FIG. 76-218 xxxxxxxxxxVKGDQICIGYHSNNSTEKVDTNLERNVTVTHAQDILEKTHNGRLCKLSGIPPLELGDCSITGWLLGNPECDRLLRVPEW
SYIVERENPxxxLCYPGSFNNYEELKxxxxxVTHFEKVKILPRDxxxxxxxxxxxxxxxxxxxxxxPSFFRNMIWLTxxxxxxxAKRSYNNTSGEQVLV
IWGIHH

FIG. 76-219

GVWTYNAELxxxxxxxxxxHDSNVKNLYERVRMQLRDNAxxxxxxxxxxxxxxxxxxxxxxxxxRNGTYNYPKYEEESRLNRNEIKGIKLSSMGI
YQILAIxxxxxxxxxxxxxxxxxxxxxxxxxxxxxxxxxxxxxxxxxxx
>Protein:HA|Subtype:H2N2|

FIG. 76-220

SGYETFRVIGGWATxxxxxxxxxxxSNNWSGYSGIFSVENKRCINRCFYVELIRGRQQETRVWWTSSSIVVFCGTSxxxxKGSWPDGAN
IDFMPV
>Protein:NA|Subtype:H2N2|Blocksize:10|String:4
xxPNQKIITMGSVSLxxxxxxxxQIAILATTITLHFKQNECxxxxxxxxxPCEPTIIERNxxxxxxxxxxxxxxxxxxxxxxxxxxWSKPQCHITGFAxxxxx
NSIRLSASGDIWVTREPYVSCDSNKCYQFALGQGTTLNNKHSNGTI

FIG. 76-221

MLSLIMRTVIALSYxxxxxxxxxxxxxxxxNNNNNTATLCCLGHHAVPNGTxxxxxxDQIEVTNATELVQSxxxxxxxxxxxxxWEKNCTLIDA
LLGDPQCDxxxxxxxxxxxxxxxxxxxxxxxxxxSLRSLVASSGTLExxxxxxxxxxxxxxxxxxxxxxxxxxxxxxxxxxxxxxxxFDKL
YIWGVHHPxxxxxxxxxxxxxxxxxxxxxxxxxxxxxxxxxxxxxxxxxxxxxxxxxxxxxxxxxxxxxxxxxxxxxxxxxxxxxxSECI
TPNGSIPNDKPFQNVNRITYGxxxxxxxxTLKLATGMRNVPEKxxRGIFGAIAGFIENGWEGMVDGWYGFRHQNSNSEGTGQAADLKST
QAAIDQIxxxxxxIGKTNEKFHQIEKEFSEVEGRIQDLEKYVEDTKIDLWSYNAELLVALENQHTIDLTDSEMNKLFExTKKQLRENAED
MGNGCFKIYHKCDNxxxxxxxxxxxxxxxxxxxxxxxxxxGYKDWILWISFAISCFLxxxxxxGFIMWACQKGNIRCNICI
>Protein:HA|Subtype:H3|Blocksize:10|String:2
xxxHSMSGFRSNLP

FIG. 76-222 xxxxxxxxxxxRFSYVFCLALxxxxxxxxxxxxTLCLGHHAVSNGTxxxxxxxxxxxxxxxxxxxxxxxxxxxxxxxxxxxxxxxxxxxxx
xxxxxxxxxxxxxxxxxxxxxxxxxxxxxxxxxxxxxxx

FIG. 76-223

HSMSGFRSNLPxxxxxxxxNNNNNTATLCCLGHHAVPNGTIVKTITxDQIEVTNATELVQSxxxxxxxxxxxxxxxKNCTLIDALLGDP
QCDxxxxxxxxxxxxxxxxxxxxxxxxxSLRSLVASSGTLEFxxxxxxxxxxxxxxxxxxxxxxxxxxxxxxxxxxxxxxxxxFDKLYIWG
VHHPxxxxxxxxxxxxxxxxxxxxxxxxxxxxxxxxxxxxxSIYWTIVKPGDxxxxSTGNLIAPRGYFKIxxxxLNNEIRWPPHxxxxSECITP
NGSIPNDKPFQNVNRITYGACPxYV

FIG. 76-224 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxQNVNRITYGVCPxxxxxxxxxxx
xxxxxxxxxxxxxxxxxxxxxxxxxxxxxxxxxGWYGFRHLNSxxxxxxxxKSTQAAIDQVxxxxxxxxxxxxxxxxxxxxxxxxxxxxxxxxxxxxxxxxYN
AELLVAMENQHTIDLxDSEMSKLFEKTxxxxxxAEDM

FIG. 76-225

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxRHQNSEGRGQxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxx
>Protein:HA|Subtype:H3N2|Blocksize:10

FIG. 76-226

SFVYDGxxxxxxxxxDILRTQESECVCISGTCAVVMTDGSASDxxxxxxxxxxxxxxxxxxxLSGNAQHVEECSCYPRYPNVRCVCRDNW
RGSNRPIVD

FIG. 76-227

RENAEDKGNGCFEIFHKCDNSCIESIRNGTYNHDxYRDEAISNRFQIQGVRLTQGYKDIILWVSFSISCFLLAAxxxxxALLIAFVLWACQ
NGNLRCQICI
>Protein:HA|Subtype:H4|Blocksize:10|String:3
xxxxxxxxxxxxxxxxxxYTENPVICLGHHSVxxNGTIVKTLTDxxIEVVAAQELVESxxxxxLCPSPLKLIDxxxCDIVNSALGSPGCDHxxxxxxxx
xxxxxxxxDTCYPFDVPGYQSLRSILANNGKFEFIVEKFxxxTVKQDGKSSACKRAxxDDFFNRLNWLxxxxxxxYPLQNLTKTNNGDYxxxx
xWGVHHPSTDAEQxxLYKNNPGRVSVSTKxxxxxxxxxxxxRPLVRSQSGRISFYWTIVDPGDIIVFNTIGNLIAPRGHYRLxxxxxxxxxxxxxx
IGSCESKCHTxxxxxxxxxxxxxxxxxxxGECPKYVKQGSLRLATGMRNIPxxxxxxxxxxxxxxxxxxxxxxxxxxxxxxxxxxxxxxxxxxxLKSTQAAIDK
INGKLNRLIEKTNDKYHQIEKEFEQVEGRTQDLEEYVEDTKIDxxxxxxxxxxxxxNQHTIDVADSEMNKLFERVKRQLRENAEDRGNGCF
EIFHRCDNKCIESIRNGTYDHNxYRNEAINNRFQIQGIKLTQGYKDVILWISFSISCFLFISCFLLVALLLAFVLWACQNGNVRCQICI
>Protein:HA|Subtype:H4|Blocksize:10|String:4
xxxxxxxxxxxxxxxxxxHTGNPVICLGxxxxxxNGTMVKTLTGxxVEVVAAQELVxxxxxxxLCPSPLKLVDxxxCDIVNAALGSPGCDHxxxxxx
xxxxxxxxxxDTCYPFDVPNYQSLRSILANNGKLEFIAEEFxxxTIKQNGKSGACKRADxNDFFKRLNWLxxxxxxxYPIQNLTKVNSGDYAR
LYIWxxxxxxxxxxxxxxLYENNPGRVTVSTQxxxxxxxxxxxxGPWVRGQSGRISFYWTIVKPGDLILFNTIGNLIAxxxxxxxxxxxxxxxxxxxxxxIG
SCVSRCHTxxxxxxxxxxxxxxxxxxxGDCPRYVKQGSLKLxxxxxxxxxxxxxxxxxxxxxxxxxxxxxxxxxxxxxxxxxxxxxxxxxxxKSTQAAIDQVNG
KLNRLIExxxxxxxxxxxxFEQVEGRIQYLEKYVEDTKVDLWSYNAELxxxxxxQHIIDVTDSEMNRLFERVRRQLxxxxxxxxxxCFEIFHQCN
NNCIESIRNGTYNHNxYRDEAINSRFQIQGVKLAQGYKDIILWFSFSISCFLLIAxxxxxALLLAFMLWACQNGNIRWxxxx
>Protein:HA|Subtype:H4|Blocksize:10|String:5
xxxxxxxxxxxxxxxxxxYPGNPVICLGxxxxxxNGTVVKTLTDxxVEVITAQELVESxxxxxLCPKPLKLVDxxxxxxxxxxxxxxxxxxxxxxxxxxxxxx
xxxxxTCYPFDVPDHxxxxxxxxxNGKFEFIAEDFxxxAVKQNGKSGAxxxxxxxxxxxxxxxxxxxxxxxxxxxQNLTKVNNGNYARLYIWGVxxxxx
xxxxxxLYKSNPGRVTVSTRxxxxxxxxxxxxxRPWVRGLSSRISFYWTIVEPGNLIVFNTIGxxxxxxxxxxxxxxxxxxxxxxxxxIGSCISKCHTxxxxx
xxxxxxxxxxxxxxGNCPKYVKQGSxxxxxxxxxxxxxxxxxxxxxxxxxxxxxxxxxxxxxxxxxxxxxxxxxxxxxxxxxxxxxxxKSTQAAINQINGKLNRxxxxxxxxxxx
xxxxFEQIEGRIQDLENYVEDTKIxxxxxxxxxxxxxxxxxTIDVTDSEMDKLFERVRHQLRENAExxxxxxxxxxxxCGNNCIESIRNxxxxxxxxRD
DAINNRFQIQGVKLIQGYKDIILWISFSMSRQASPSCLVVRKLFLAFILWACQTGNIRCQxxx
>Protein:HA|Subtype:H4|Blocksize:10|String:6
xxxxxxxxxxxxxxxxxxxxxxxxWICMGHHAVAxxxxxxxxxxxxxxxxxxxxxxxxxxxxxxxxxxxxxxxxxxxxxxxxxxxxxxxxxxxxxxxxxxxxxxxxxxxxxxxxxxxx
xxDVPDYQSIRSILANxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxVKGQSGRISFYWTVVEPxDVIVFNTIGNxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxTQTAIDQITGKLNRLIEKxxxxxxxxxxxxNKIEGRVQDLxxxxxxxxxxxxxx
xxxxxxxxxxxxTIDVTDSEMSKLFERVRxxxxxxxxxxxxxxxxxxxxxxDNTCIESIRNGTxxxxxxxxxxxxxxxxxxxxxxxxxxxxxxxxxxxxVTTRQASP
SCLVxxALFLAFILWAxxxxxxxxxxxxx
>Protein:HA|Subtype:H4|Blocksize:10|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxQAAIDQISGKLNRLIxxxxxxxxxxxxxxxQVEGRIQNLExxxxxxxxxxxxxxxxxxxxxxxxxxxxxx

FIG. 76-228

```
xxxxxxxxxxxxxxxxxxxxxxxxxxxxxxxxxxxxxxxxxxxxxxxxxxxxxxxxxxxxxxxxxxxSISCFLLVALFLTFILWACQNGx
xxxxxxx
>Protein:

FIG. 76-229

```
LGNGCFEFYHRCDNxCMESIRNGTYxxxxxxxxxxxxxxxxxxxxxxxxYQILSIYSTAASSLxxxxxxxxxxxxxxxxxGLSFWMCSNGSLQCKICIK
ICESRLRx
>Protein:HA|Subtype:H5|Blocksize:10|String:3
xxxxxxxxxxxxxxxxxxxxxxSDHICI

FIG. 76-230 xxxxxxxxxxxxxxxxxxxxxxxxxxxxxKRRKKRGLFGAIAGxxxxxxxxxxxxxxxxxxxxxxxYAADKESTQRAxxxxxxxxxxxxxxxxxxxxxxxxxx
xxxxxxxxxxxxxxxxxxxxxxxxxxxxxxxxxxxxxxxxxxxxxxxxxxxxxxx

FIG. 76-231

KLPMGAIGAIDSSMPFHNIHPLTIGECPKYVKSNRLVLATGLRNxxxREREGGRRRKRGLFGAIAGGFIEGGWQGMVDGWYGYHHSNE
QGSGYAADKESTQKAIDGVTNKVNSIIDKMNTQFEAVGREFNxLERRIENLNKKMEDGFLDVWTYNAELLVLMENERTLDFHDSNV
KNLYDKVRLQLRDNAKELGNGCFEFYHKCDNxCMESVRNGTYxxxxxxxxxxxxxxxxxxGTYQILSIYSTVASSLALAIHGSLVLSL
WMAGLSLWMCSNGSLQCRICIKFVSSDCSx
>

FIG. 76-232

>Protein:HA|Subtype:H5N1|Blocksize:10|String:6
xxxxxxxxxxxxxxxxxDHICIGYHANNSTKQxxxxxxxxxxxxxxxxxxxxxxxxxxxxxxxxxxxxxxxxxxxxxxxxxRPLILKDCSIAGWxxxxxxxxxxxxxxxxxxxxxxxxxxxxxx
xxxxxxxxxDYEELKHLLNRIxxxxxxxxxxxxxxxxxxxxxxxxxxxxxxxxxxxxxxxxxxxxxxxxxAYKIIKKGDSxxxxxxxxxxxxxxCQTPMGAVNSxxxxxxxxxxxxxxxxxxx
xxxxxxxxxxxxxxxxxxxxxxxxxxxxxxxxTRGLFGAIAGxxxxxxxxxxxxxxxxxxxxxxxxxxxxESTQKAMDGVTNKVNSxxxKMNIQFEAVGREF
Sxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxYSTVASSLTLAIxxxxxxxxxxxxSLWMCSNGSYNAxxxxxxxxxxxxxx
>Protein:HA|Subtype:H5N1|Blocksize:10|String:7
xxxxxxxxxxxxxxxxxxDQICVGYHANNSTERVDTIMEKNVxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxEELKHLLSRTxxxxxxxxxxxxxxxxxxxxxxxxxxxxxxxxxxxxxxxxxxxxxxxxxxxxxxxxxxxxxxxxxxxxxxxxxxxxxxxxxGAINSSMPFHNxxxxxxxxxxxxx
xxxxxxxxxxxxxxxxxxxxxxxxxxxxxxxxRRGLFGAIAGxxxxxxxxxxxxxxxxxxxxxxxxxxxxxxxxxxxxxxxxxxxxxxxxxxxxxxxxAIDGITNKINSIIDxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEF
PSTGNHGSLVxxxxxxxxLWMCSNGALQxxxxxxxxxxxxxx
>Protein:HA|Subtype:H5N1|Blocksize:10|String:8
xxxxxxxxxxxxxxxxxIGYHANNSTVQxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxGAVNSSMPFHNxxxxxxxxxxxxxxxxx
xxxxxxxxxxxxxxxxxxxxxxxxxxxx
>Protein:HA|Subtype:H5N1|Blocksize:10|String:9
xxxxxxxxxxxxxxxxxxxxGYHANNSTEHxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxGAINSSMPLHNxxxxxxxxxxxxxxxxxxxxx
xxxxxxxxxxxxxxxxxxxxxxxxxxx
>Protein:HA|Subtype:H5N1|Blocksize:10|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxGAISSSMPFHNxxxxxxxxxxxxxxxxxxx
xxxxxxxxxxxxxxxxxxxxxxxxxxxx

FIG. 76-233

>Protein:NA|Subtype:H5N1|Bl

FIG. 76-234 xxxxxxxxxxxxxxxxxxxNRDITIGSICxxxxxxxxxxxxxxxxxxxxxxxxxxxxxxxxxxxxxxxxxxxxxxxxxENNTWGNQTYxxxxxxxxxxxxxxxxxxxxxxxxxxxxxxxxx
xxxxxxxxxxxxxGDVFAIREPF

FIG. 76-235 xxxxxxxxxxxxxxxxxxxxxIAIRPKVNGQxxxxxxxxxxxxxxxxxxxxxxxxxxxxxxxxxxxxxxYGNCDAKCQTPxxxxxxxxxxxxxxxx
xxxxxxxxxxxxxxxxxxxxxxxxxxxxETRGLFGAIAGxxxxxxxVDGWYGY

FIG. 76-236 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxAADKDSTQKAxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxLWMCSNGSLQxxxxx
>Protein:NA|Subtype:H5N2|Blocksize:10|String:1
xxxxxxxxxxxxxxxxxxxxxxxxxxxxxxxxxxxxxxxxxxxxxxxxxxxxxxxxxxxxxxxxxxxxxxxxxxxxxxxxxxxxxKPQCQITGFAPFSKDNSIRLSAGGxIWVTREPYVSCDxxKCYQFALGQGTTLDxKHSNGTIHDRIPHRTLLMNELGVPFHLGTKQVCIAWSSSSCHDGKAWLHVCVTGDDxxxxxxxxxxxSWSQNILRTQESECVCINxxCTVVMTDGSASGxxxxxxxxxxxxxxxGSAQHIEECSCYPxSYPNVRCVCRDNWKGSNRPVKLDINMADYSxxSSYVCSGLVGDTPRNDDSxSSSNCRDPNNERGNPGVKGWAFDxxxxxxxxxxSKDSRSGYETFRVIxxxxxxxxxxxxxxxxxxNWSGYSGIFSVExxSCINRCFYVELIRGRPQExRVWWTSNSIVVFCGTSGTYGTGSWPDGANINFMPx
>Protein:NA|Subtype:H5N2|Blocksize:10|String:2
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxKPQCQVTGFAPFSKDNSIQLSAGGxIWITREPYVSCDxxRCYQFALGQGTTLNxNHSNGTIHDRTPHRTLLMSELGVPFHLGTRQVCIAWSSSSCYDGKAWLHICVTGDDxxxxxxxxxxxSWSKNILRTQESECICINxxCAVVMTDGSASRxxxxxxxxxxxxxxxGSAQHVEECSCYPxSYLNVRCVCRDNWMGSNRPVxxxxxxxxxxxSSYICSGLVGDTPRNNDSxSNSNCKDPNNERGNSGVKGWAFDxxxxxxxxxxSKNSRSGYETFKVIxxxxxxxxxxxxxxxxxxNWSGYSGVFSVExxGCINRCFYVEMIRGRPKxxRVWWTSNSIIVLCGxxxxxGTGSWPDGADINFMPx
>Protein:NA|Subtype:H5N2|Blocksize:10|String:3
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxKPQCQIAGFAPFSKDNSVRLSAxxxxxVTREPYVSCSxxxxxxFALGQGTPLNxRHSNGTIHDRSSYRTLLMNELGIPFHLGTKQVCMAWSSSSCHDGRAWLHVCITGDDxxxxxxxxxxxxxSWSLNILRTQESECVCVNxxCTV1MTDGSASGxxxxxxxxxxxxxxxGNAQHIEECSxxxxxxIRCVCRDNWKGSNRPIxxxxxxxxxxxSRYICSGLVGDTPRNDDGxSNSNCRDPNNESGSQGVKGWAFDxxxxxxxxxxSRDSRSGYETFKxxxxxxxSWPDGANINLMPx
xxxxxxNRSGYSGIFSVxxxSCVNRCFYVELIRGRPKExRVWWTNSIVVFCGTxxxxxxxSWPDGANINLMPx
>Protein:NA|Subtype:H5N2|Blocksize:10|String:4
xxxxxxxxxxxxxxxxxxxxxxxxxxxxxxxxxxxxxxxxxxxxxxxxxxxxxxxxxxxxxxxxxxxxxxxxxxxxxxxHSNDTIHDRTSHRTLLMNELGVPFHMGTKQVCVAWSSSSCHDGNAWLHVCVTGHxxxxxxxxxxxxTWSQNILRTQEPxxxxxxCAVVMTDGNASGxxxxxxxxxxxxxxxSAQATEECSRxxxxxVRCICRDNWKGSNxxxxxxxxxxxxSHYVCSGLVGDTPRNDDIxSSSNCKDPNNExGSPGVKGWAFDxxxxxxxxxxSEDSRSGYETFRVTxxxxxxxxxxxxxxxxxxxxxxWSGYSGIFSIExxNCINRCFYVELTRGRPQExxVWWTSNSIVAFCGTSGTYGxxxxPDGANINFMAx
>Protein:NA|Subtype:H5N2|Blocksize:10|String:5
xxxxxxxxxxxxxxxxxxxxxxxxxxxxxxxxxxxxxxxxxxxxxxxxxxxxxxxxxxxxxxxxxxxxxxxxxxxxxxxPYRTLLMNELxxxFHLGTKQVCVAWSRSSCHDGKAWLHICxxxxxxxxxxxxxxxxxxxxxxxWSQNILRTHExxxxxxxxxVVITDGSASGxxxxxxxxxxxxxxxxxxxxxxxxxxxxxxxxVTCVCRDNWKSSNRPVxxxxxxxxxxxxxxxxxxxxxSSSNCRDSNNERRNPGVKGWAFxxxxxxxxxxxxxxxxxRSGYETFRVLxxxxxxxxxxxxxxxxxxxxxxxxxxxxxxxxxxHCINRCFYVExxxxxxxxxxxxxxxxxxxxxxxxxxxxxxxxxxxPDGGNINFMPx
>Protein:NA|Subtype:H5N2|Blocksize:10|String:6

FIG. 76-237 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxTQESECVCISxxxxxxxxxxxxxxxxxxxxxxxxxxxxxxxxMTELGVPFHLxxxxxIAWSRSSCHDGRAWLHICxxxxxxxxxxxxxxxxxxxxxx
xxSNCRDPNNEKxxxxxxxxxxxxxxxxxxxxxxxxxxxxxxxxxRSGYETFRIIxxxxxxxxxxxxxxxxxxxxxxxxxxxxxxxxxxxxxxxTQESE
CVCIDxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxx >Protein:NA|Subtype:H5N2|Blocksize:10|String:7

>Protein:HA|Subtype:H

FIG. 76-238 xxxxxxxxxxxxxxxxxxxxxxxxxxxxxxxxxxxxxxxxxWSMLKPGETLNIESNGNLIAPWYAYRxxxxxxxxxxxxxxxxxxxxxxxxxxxxxxxxxTNKTFQNASPx
xxxxxxxxxxxLRLATGLRNIPxxxARGLFGAIAGxxxxxxxxxxxxxxxxxxxxxxxxYAADKESTQRAxxxxxxxxxxxxxxxxxxxxxxxxxxxHEFSNLE
RRVxxxxxxxNGFLDVWTYNAELLVLLENGRT

FIG. 76-239

```
xxxxxxxxxxxxxxxxxxxxxxxxxxxxxxxxxxxxxxxxxxxxxGQSGRIDFYWxxxxxxxxFSFNGAFIAPNRASFxxxxxxxxxxxxxxxxxxxx
xxxxxxxxxxxxxxxxxxxxxxxxxxxxxSLLLATGMKNVPExxAHKQLTHHMRKKRGLFGAKRMTRGLFGAIAxxxxxxxxxxxxFIENGWEGLVDGW
YGFRHQNSQGEGTAADYKSTQSAVDQITGKLNRIIxxxxxxxxxxxxEKQIGNVINWTQDAxxxxWSYNAEFLVAVENQHTIDLTDSE
MSKLYERVKKQLRENAE

FIG. 76-240 xxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxARGLFGAIAGxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H7|Bl

FIG. 76-241 xxxFEIFHKCDDHCMESIRNNTYDHSKYREEAMQNRIQIDPVKLSGGYKDIILWFxxGASCFLLLAVVMGLVFICIKNGNVRCTIxxxxxxx
x
>Protein:HA|Subtype:H7N2|Blocksize:10|String:4
xxxxxxxxxxxxxxxxxxxxxxxTKGDKICLGHxxxxxxxKVNTLTERGVExVNATETVETVxxxxxxxxxxxxxxxxxCGLLGTITGPPHCDQFLEFxxD
LIIERREGADxCYPGKFVNGEALRQILRESGGIxxxxxGFTYSEIRTNxxxxxxxRSSSSFYAEMKWLLSNTDNxxxxxxxxxxxxxxxxxALIVWG
VHHSxxxxxxxKLYGSGNKLVxxxxxxxxxxxxxxTGARRIDFHWLFLxxxxxxxxxxNDTITFSFNGAFIAPNRASFFRGxxxxxxxxxxxxxxxxxxxx
xxRGTIVSSLPFQSINxxTVGKCPRYIKQESLMLATGMKNVPxxPKGRGLFGAIAGxxxxxxxxxxxxxxxxxxxxxxxxxxxxxxxxxxxxxxxITGKL
NRLIEKTNQQFELIDNEFTEVEKQIxNVINWTRDSITEVWSYNAExxxxMENQHTIDLTDSEMNKLYERVRxxxxxxxxxxxxxxFEIFHKCD
DDCMASIRNNTYDHTKYRTESLQNRIQIDQVKLSSGYKDxxxxxxxxASCFLLLAIVMGLVFICVKNGNMRCTIxxxxxxxx
>Protein:HA|Subtype:H7N2|Blocksize:10|String:5
xxxxxxxxxxxxxxxxxxxxxxxARGDKICLGHHxxxxxxxxxxxxxxxxxxxxxxxxxxxxxxxxxxxxxxxxxxxxxxxxxxCGLLGTVTGPPxxxxxxxxxxDLIIERRE
GSDxCYPGGFTNEESLRQIIRxxxxxxxxxxxxTYSGIRTNGTxxxxxRPGSSFYAEMKWLLSSTDNxxxxxxxxxxxxxxxxxALVIWGVHHSxxxx
xxxKLYGNGNKLIxxxxxxxxxxxxxxPGARRIDFNWLLLxxxxxxxxxxxxxxxxTFNGAFIAPNxxxxxxxxxxxxxxxxxxxxxxxxxxxxxxGGTIASSLP
FQNISPxAVGKCPKYVKQESLMLATGMRNVPENPKxxxxxxxxxxxxxxxxxxxxxxxxxxxxxxxxxxxxxxxxxxxxxxxxxxxxxxxxLNHLIGKTNQQF
GLIDNEFNExxxxxxxxxNWTRDAMTEVWSYxxxxxxxxxxxxxIDLADSEMNKLYERVKRQLRENAEExxxxxxxxxxxxxxxxxxxIRNNTYDH
SRYREEAMQNRLKIDxxxxxxxxxxxxxxxxxxASCFILLAIVMGLVFMCVKNGNMRCSALFVYSLRK
>Protein:HA|Subtype:H7N2|Blocksize:10|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxIGPPHCDQFLxxxxxxxxxxxxxxxxxx
xxxFANEESLRQILRKSGGIxxxxxxxTYSGIRTNGVxxxxxxSDSSFYAEMKxxxxxxxxxxxxxxxxxxxxxxxxxxxxxxxxxxxxxxxxxxxxxxxxxxxxxxxxxxxxx
xxxxxxxxxxxxxxGARPQVNGQFGRIDFHWLMLxxxxxxxxxxxxxxxxxxxxxxxxxxxxxxxxxxxxxxxxxxxxxxxxxxxxxxxxxxxxxVSSLPFQNISxxxxxxxxxxx
VKQKSILLATGMRNIPEKPKxxxxxxxxxxxxxxxxxxxxxxxxxxxxxxxxxxxxxxxxxxxxxxxxxxxxxxxxxxxxxxxxxLIGRTNQQFELIDNEFSEIEQQIGNVxx
xxxxxxxxxxxxxxxxxxxxxxxxxxIDLADSEMKKLYERVRxxxxxxxxxxxxxxxxxxxxxxxxxxxxxxxxxxxxxxxxxxxxxxxxxxxxKEAMQNRIQINPVKLSSGxxxxxx
xxxxxxxxxxLLAJVMGLVFICMKNGNxxxxxxxxxxxxxx
>Protein:HA|Subtype:H7N2|Blocksize:10|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxNEEPLRQILRxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxSGRIDFHWLMxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxTNQQFEMIDNEFTEIEQQIxxxxxxxxxxxxxxxxxxxxxxxxxxxxx
xxxxxxDSEMDKLYERxxxxxxxxxxxxxxxxxxxxxxxxxxxxxxxxxxxxxxxxxxxxxxxxxxxxxxxxxxxxxxxxxxxxxxxxxxxxxxxxxxxxxAIAMGLVFMCVKx
ETCSALFVYSLxxxx
>Protein:HA|Subtype:H7N2|Blocksize:10|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxSGRIDFHWLILxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxQRFELIDNEFxxxxxxxxxxxxxxxxxxxxxxxxxxxxxxxxxxxxxxxxxxxx

FIG. 76-242 xxxxxxxxxxxxxxxxxxxxxxxxxxxxxxxxxxxxxxxxxxxxxxxxxxxxxxxxxxxxxxxxxxxxAMGLVFICVKxxxxxxxxxxx
xxxxx
>Protein:HA|Subtype:H7N2|Blocksize:10|String:9
xxxxxxxxxxxxxxxxxxxxxxxxxxxxxxxxxxxxxxxxxxx

FIG. 76-243

NRPVIDVNMxxxIDSSYLCSGLVGDTPRNDDSSSNSNCxDPNNEKGNPGVKGWAFDYGSDVWMGRTIxxxxSGYETFRVIDGWTTAN
SKSxxxRQVIVDNNSWSGYSGIxxxxxNCINRCFYVExxxxxPQETGVWWTSNSIVVFCGTSRTxxxxSWPDGANINLMxx
>Protein:NA|Subtype:H7N2|Blocksize:10|String:5
xxxxxxxxIGSVSLTIAIxxxxxxxxxxxxxxxxxxxxxxxx

FIG. 76-244 xTIDLADSEMDKLYERVRRQLRENAEEDxxxCFEIFHKCDNxCMASIRNNTYDHSKYREEAMQNRIQINPVKLSSGYKEVILWFSFGAS
CFILLAIxxxxxFICVKNGNMRCTIxx
>Protein:HA|Subtype:H7N3|Blocksize:10|String:3
xKSRGYKMNTRILILTxxxxxxxxxxKICLGHHAVPNGTKVDTLTGRGIEVVNATETVEQxxxxxxxxxxxxxxIDLGQCGLLGTITGPPQCDLF
LEFxxxxxxxxxxxxxxxDVCYPGKFANxxxLRQILRRSGGIxxxxxxxxxxxxxxxxxxxxxxxxxxxGPSFYAEMKWxxxxxxxxxxxxxxxxxxxxxxxxPA
LIVWGIHHSxxxxxxxxLYGSGSKLITVxSSNYHQSFVPSPGVRxxVDGQSGRIDFHWMxxxxNDTITFSFNGAFVAPDRVSFFxxxxxxxxxxx
xxxxxxxxxxxxxGGTITSPLPFQNINPRxVGKCPRYVRQxSLMLATGMKNVPETPKxKRKRGLFGAIAKPRPRRGLFGAIAGFIxxxxxxIENG
WEGLINGWYGFRHQNxxxxGTAADYKSTPSAIDQITGKLNRLIEKTNQQFKLIDNEFSEIEQQIGNVINWTRDSITEVWSYNAELLIxxxxx
xTIDLANSEMNKLYERVKRQLRENAEExxxxxxxxxxxxxxxCMASIRNSTYDHSRYREEAMQNRMQINPVKLNSGYKDIILWFSFGASCF
LFLAIxxxxxFMCVKNGNMRCxxxx
>Protein:HA|Subtype:H7N3|Blocksize:10|String:4
xxxxGYKMNTQILIFTxxxxxxxxxxKICLGHHAVTNGTKVNTLTERGVEVVNATETVENxxxxxxxxxxxxxxTDLGQCGILGILTGPPQCDRF
LEFxxxxxxxxxxxxxxxDVCYPGKFSNxxxLRQVLRESGGIxxxxxxxxxxxxxxxxxxxxxxxxxxxDSSFYAEMKWxxxxxxxxxxxxxxxxxxxxxxxxPA
LIVWGVHHSxxxxxxxxLYGSGNKLVTVxSSKCQQSFTPSPGTRxxVNGQTGRIDFHWLxxxxNDTVIFSFNGAFIAPDRATFLxxxxxxxxxxx
xxxxxxxxxxxxxGGTITSNLPFQNVNSRAVGRCPRYVKQxxxxxATGMRNVPEKPKxxRRRGLFGAIAxxxxxxxxxxxxxxxxxxxxxxxxxxxxGL
IDGWYGFKHQNAQGEGTxxDYKSTQSAINQITGKLNRLIDRTNHQFELIDNEFIEVEKQIGNVINWTRDSVTELWSYNAELLVxxxxxxxI
DLADSEMNNLYERVRKQLRAxxxxxxxxxxxxxxxxxxxxxxSIRNNTYDHNQYRAESLQNRIRIDPVKLSGGYKDIILWFGFGASCFLLIAIxx
xxxFICVKNGNHAVHYxx
>Protein:HA|Subtype:H7N3|Blocksize:10|String:5
xxxxxxxxxxxxxxxxxxxxxxxxxxxxxxGHHAVANGTRVNTLTEKGIEVVDATETVERxxxxxxxxxxxxxxxTDMGQCGLLGTVTGPPQCDxxxxx
xxxxxxxxxxxxxxDICYPGKFTNxxxxRQILRGSGGVxxxxxxxxxxxxxxxxxxxxxxxxxxxGSSSFYAEMKWLLSNSDNxxxxxxxxxxxxxxxxxxxx
xxxxxxxxxxxxxxxLYGNGNKLITxxSSKYLQSFTPSPGxxxxVNGQSGRINFHWLxxxxNDTVTGSFNGxFIAPDRASFLxxxxxxxxxxxxxxxxx
xxxxxxxGGTIASSLPFQNINSRTLGKCPRYVKQxxxxxxxGMKNVPEIPRxxKKRGLFGAIAxxxxxxxxxxxxxxxxxxxxxxxxxxxxxxxxxxxxxx
xxxxxxxxxxxxxxxxxxxNQITGKLNRIIDKTNQQFEMIDNEFNEVEKQIGNIINWTRDSMTEIWSYNAxxxxxxxxxxxxxDLADSEMSKLYERV
KKQLRExxxxxxxxxxxxxxxxxxxxxxxxxxxxxxxxxTYREEAMQNRVKIDPVKLSNGYKDVILWFSFGASCFLLIxxxxxxxFICIKDGNMRCTICI
>Protein:HA|Subtype:H7N3|Blocksize:10|String:6
xxxxxxxxxxxxxxxxxxxxxxxxxxxxxxxxxxxxxxxxxNTLAERGVEVVDATETVxxxxxxxxxxxxxxxxxxxxxxxxxxxxxIGPPQCDLFLxxxxxxxxxxx
xxxxxxxxxxxxxxxxxxxxxxxxxxxxxxxxxxxxxxxxxxxxxxxxxxxxxxxxxxPSFYAEMKWLLSNTDNxxxxxxxxxxxxxxxxxxxxxxxxxxxxxxxxxxx
xYGSENKLITVxxxxYQQSFTPSPExxxxxxxxxxxxxxxxxxxxxxxxxxxFNFNGAFIAPxxxxxxxxxxxxxxxxxxxxxxxxxxxxxxxxxxxxxxLPFQNINS
RVxxxxxxxxxxxxxxxxxxxxxxxxxxxxxxxxAYRKRMTRGLFGAIAxxxxxxxxxxxxxxxxxxxxxxxxxxxxxxxxxxxxxxxxxxxxxxxxxxxxxxxxxxITGKLN
RFIEKTNQQFxxxxxxxxEVERQIGNVINWTRDSITELWSYNAxxxxxxxxxxxxxQADSEMNKLYTRVKRQLRENAEKxxxxxxxxxxxxxxxxx
xxxxxxxxxxxxxxxxxxxxxxxxxxxxxSSGYKDVILWFSFGASCFIFLAIxxxxxxICIKNGNMQCTICx
>Protein:HA|Subtype:H7N3|Blocksize:10|String:7
xxxxxxxxxxxxxxxxxxxxxxxxxxxxxxxxxxxxxxxxxxxLTERGVEVVDAxxxxxxxxxxxxxxxxxxxxxxxxxxxxxxxxxxxIGPPQCDRFLxxxxxxxxxxxxx
xxxxxxxxxxxxxxxxxxxxxxxxxxxxxxxxxxxxxxxxxxxxxxxxxxxxxxxxxxxxxxxxAEMKWLLSNNDNxxxxxxxxxxxxxxxxxxxxxxxxxxxxxxxxxxxxxx

FIG. 76-245 xxxxxxxxxxxxxQSFVPSPGSRxxxxxxxxxxxxxxxxxxxxxFSSNGAFIAPDxxxxxxxxxxxxxxxxxxxxxxxxxxxxxxxxxxxxxxxxx
xxxxxxxxxxxxxxxxxxxxxxxxxxxxxxAYQ

FIG. 76-246

HVCITxxxxxxxxxxxxxxxxxxxxxxxxxxxxxxxxxxxxxxxxxxxxxxGKMTDSIKSWRRDILRTQESECLCIDGTCVVTVTDGPA
ANSAHHRVYWIREGKxxxxxxxxxKIKHLEECSCYVDVDVYCICRDNWKGSNRPWIRINNETILETRYVCSKFHSDTPRPDDPSTMSCD
SPSNINGGLGVKGFGFKTGDDVWLGRTVSNSGRSxxxxxxEGWINSPNHVKSITQTLVSNNDWSGYSGSFVxxxGCFQPCFYIELIRG
RPNxN

FIG. 76-247 xxxxxxxxxxxxxxxxxxxxxxxxxxxxxxxxxxxxxxxxxxxxxxxxxxxxxxxxxxxxxxxxxxxxxxxxxxxxxxxxxxKAATQTLVSNNDxxxxxx
xxxxxxxxxxxxxxxxxxxxxxxxxxxxxxxxxxxxxxxxxxxxxxxx
>Protein:HA|Subtype:H7N7

FIG. 76-248 xxxxxxxxxxxxxxxxxxxxxxxxxxxxxxxxxxxxxxxxGTKVNTLTEKGIEVxxxxxxxxxxxxxxxxxxxxxxxxxxxxxxxxxDLGKCGLLGTxxxxxxxxxxxxxxx
xxxxxxxxxxxxxxxxxxxxxxxxxxLRQILRRSGGxxxxMGLTYNGIRTxxxxxxRLGSSFYAEMKxxxxxxxxxxxxxxxxxxxxxxxxxxxxxxxxxxxxxxxxxxxxxx
xxxxxxxxTVWSSKYRRSxxxxxxxxxxxxxxxxxxxxxxxxxxxxxxxxxNDTVTFNFNGAFVAPxxxxxxxxxxxxxxxxxxxxxxxxxxxxxxxxxxxxxxxxxxxxxxx
xxVGECPRYVKQxxxxxxxxxxKKRKKRGLFGAKKRGLFGAIAxxxxxxxxxDGWYGFKHQNxxxxxxxxxxxTQSAIDQITRKLN
RLIEKTxxQFELIDNEFSEVEKQLGNVINWTRDxxIEIWSYNAEFLxxVENQHTIDSTDSEMNKLxxxxxxxxxxxEEDGTGCFELFHKCDD
DCMGSIRNNTYDHRKYKxxxxxxxxxIDPVKLSGGYKDVILWFSLGASCFLLIAIxxLIFMCVKNGNMQCTIxx
>Protein:HA|Subtype:H7N7|Blocksize:10|String:6
xxxxxxxxxxxxxxxxxxxxxxxxxxxxxxxxxxxxxxxxxxKVNTLTEREVEVVNATExxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxGFTYTGVRTDGxxxxxxxxxxxxxxxxxxxxxxxxxxxxxxxxxxxxxxxxxxxxxxxxxxxxxxxxxxx
xxxxxxxxxxxxxxxxxxxxxxxxxxxxKGLFGAIAGFxxxxxxxxxxGWYGFRHQKAQGEGTAAxxxxQSAIDQITGTLNRLIDKxxxxFKLIDNEF
TExxxxxxxxxxxxxxxxxxxxxxxxxxxxxxxxxxxxENQHTIDLAESEMNKLYERxxxxxxxxxxxxxxxxxxxFEIFHKCDDNxMANIRNNTYDHSTYRxxxxxxxxx
xxxxxxLSSGYKEIILWFSFGAxxxxxxxxxxFICVKNGNMQCxxxx
>Protein:HA|Subtype:H7N7|Blocksize:10|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxICV
KNGNHAVHYCI
>Protein:HA|Subtype:H7N7|Blocksize:10|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxK
NGNMRGTNWI
>Protein:NA|Subtype:H7N7|Blocksize:10|String:1
MNPNQKLFALSGVAIALSVLNLLIGISNVGLNVSLHLxxxxxxxxxxxxxxxxxxxENTYVNNTTIIxxxxxxxxSYLLLNKSLCNVEGWV
VIAKDNAVRFGESEQIIVTREPYVSCDPTGCKMYALHQGTTIRNKHSNGTIHDRTAFRGLISTPLGxxxxxSNSDFMCVGWSSTTCHDGI
GRMTICIQGNNDNATATVYYNRRLTTTIKTWARNILRTQESECVCHNGTCAVVMTDGSASSQAxxxxxxxxxxxxxxLKGSARHIEECS
CYGHNxxVTCVCRDNWQGANRPIIEIDMNxLEHTSRYVCTGILTDTSRPGDKxxGDCSNPITGSPGAPGVKGFGFLNGDNTWLGRTISP
RSRSGFEMLKIPNAGTDPxxxxxRQEIVDNNNWSGYSGSFIDYWNDxSECYNPCFYVELIRGRPEEAKYVWWTSNSLIALCGSPxPVGS
GSFPDGAQIQYFS
>Protein:NA|Subtype:H7N7|Blocksize:10|String:2

FIG. 76-249

MNPNQKLFASSGIAIVLGIINLLIGISNMSLNISLYSxxxxxxxxxxxxxxxxxxENTYVNNTTVIxxxxxxxxNYLMLNKSLCKVEGWV
VVAKDNAIRFGESEQIIxxREPYVSCDPLSCKMYALHQGTTIRNKHSNSTTHDRTAFRGLMSTPLGxxxxxSNSDFICVGWSSTSCHDGIA
RMTICVQGNNNNATATVYYDRRLTTTIRTWAKNILRTQESECVRHNGTCAVVMTDGPASSQAxxxxxxxxxxxLKGSAKHIEECS
CYGHSxxATCVCRDNWQGANRPVIEI

FIG. 76-250 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxx
>Protein:NA|Subtype:H7N7|Blocksize:10|String:8
xxxxxxxxxxxxxxxxxxxxxxxxxxxxxxxxxxxxxxxxxxxxx

FIG. 76-251

DIIFLWGIHHPPDETEQTKLYKNTNTLSSVTTNTINRNFQPNIGPRPLVRGQQGTMDYYWGILKxxxxxxxxxxxGYLLKGESHCR
IIQNEDIPxxxCKTKCQTYAGAINSSRPFQNASRHHMGECPKYAKKASLRLALGLRNTPSIEPRGLFGAIAGFxxxxxxxxxxxxxxx
xxxDQKSTQEAIEKITNKVNNIxxKMNREFEVVDHEFSxxEKKINMINDKINDQIEDLWAYxxxxxxxxxxxTLDEHDSNVENLFDEVRRR
LSTNAVDTGNGCFDIxxxxxxxxxxxIKNGTYNHKDYEEEAKLERSKIN

FIG. 76-252

IWAYNAELLVLLENQKTLDEHxxxxxxxxxxxxxxxxxxxxEDGKGCFELYHKCDxxCMETIRNGTYxxxxxxxxxxxxxxxxxxxxxxxxxxxxxEGTYKILT
IYSTVASSLxxxxxxxxxxxxxxxxxxxx
>Protein:HA|Subtype:H

FIG. 76-253 xxxxxxxxxxxxxxxxxxxxxxxxxxxxxxxxxxxxDGKGCFELHHxxxxxxxxxxxxxxxxxxxxxxxxxxxxxxxxxxxxIYKILSIYSTVASSxxxxxxxxxxxxxxxxxxxxxxxxxxxx
x
>Protein:HA|Subtype:H9|Blocksize:10|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxGKGCFELYHRCxxxxxxxxxxxxxxxxxxxxxxxxxxxxxxxxxxxxxxxxxxxxxxxxxxxxxxxxxxxxxxx
>Protein:HA|Subtype:H9|Blocksize:10|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxGKGCFELYHECDxxxxxxxxxxxxxxxxxxxxxxxxxxxxxxxxxxxxxxxxxxxxxxxxxxxxxxxxxxxxxxxxxxx
>Protein:HA|Subtype:H9N2|Blocksize:10|String:1
RWKHVTNTILLxxxxxxxxxxxxYQSTNSTETVxxxxxxxxxxxxxxxxxxxxxxxxxxxxxxxxxxxxxxxxxxxxxxxxxxxxxxEGLIYGNPSCDxxxxxxxxxxxxxxxxxxxxxSLKLAV
GLRNxxxxxRGLFGAIAGFIEGGWSGLVAGWYG

FIG. 76-254

>Protein:HA|Subtype:H9N2|Blocksize:10|String:4
xxxxxxxxxxxxxxxxxxxxxxxxxYLSTNSTETVxxxxxxxxxxxxxxxxxxxxxxxxxxxxxxxxxxxxxxxxGLIYGNPSCNxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxLKPGQTLRIISNGNLxxxxxxxxxxxxxxxxxxxxxxxxxxxxxxxxxxxxxxxxxxxxxxxxxxxxxxxxxxxxxxxxxxSLKLAVGLKN
xxxxxxxxxxxxxxxxxxxxxxxxxGWYGFQHSNEQGxxxxxxxxxxxxxxxxxxxxxxxxxxxxxxxxxxxxxxxxxxxxxxxxxxxxxDDQIQDLWAYNAEL
LVLLENQKPLDEHDxxxxxxxxxxxxxxxxxxxENGNGCFELYHRCDxxCMEAIRNGTYxxxxxxxxxxxxxxxxxxxxxxEGAYKILTIYSTVASSF
xxxxxxxxxxxxxxxxxxxxxxxx
>Protein:HA|Subtype:H9N2|Blocksize:10|String:5
xxxxxxxxxxxxxxxxxxxxxxxxxYQSTNSTEIVxxxxxxxxxxxxxxxxxxxxxxxxxxxxxxxxxxxxxxxxGLIYGNPFCDxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxLRPGQTLRVRSDGNLIAPWYxxxxxxxxxxxxxxxxxxxxxxxxxxxxxxxxxxxxxxxxxxxxxxxxxxxxxxxSLKLAVGP
RNxxxxxxxxxxxxxxxxxxxxxxxxxxxxxxxxxxxxxxxxxxxxxxxxxxxxxxxxxxxxxxxxxxxxxxxxxxxxxxxxxxxxxxxDDRIQDIWAYNxxxxxL
LENQKTLDDxxxxxxxxxxxxxxxxxxxxEDGKGCSELYxxxxxxCMETTRNGTYxxxxxxxxxxxxxxxxxxxxxxDGTYKILTIYSTVASPLxxxxx
xxxxxxxxxxxxxxxxxxx
>Protein:HA|Subtype:H9N2|Blocksize:10|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxPSQTLRVRSNENLIAPWYxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxENQKTLDEHV
xxxxxxxxxxxxxxxxxxxDGKGCFELHHxxxxxxxxxxxxxxxxxxxxxxxxxxxxxxxxxxxxxxIYKILSIYSTVASSxxxxxxxxxxxxxxxxxxxxxxxx
x
>Protein:HA|Subtype:H9N2|Blocksize:10|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxGKGCFELYHRCxxxxxxxxxxxxxxxxxxxxxxxxxxxxxxxxxxxxxxxxxxxxxxxxxxxxxxxxxxxxxxxxxxxxx
>Protein:HA|Subtype:H9N2|Blocksize:10|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxGKGCFELYHECDxxxxxxxxxxxxxxxxxxxxxxxxxxxxxxxxxxxxxxxxxxxxxxxxxxxxxxxxxxxxxxxxxxxx
>Protein:NA|Subtype:H9N2|Blocksize:10|String:1

FIG. 76-255 xxxxxxxIAIGSVSRTIxxxxxxxxxxxxxxxxxxxxxxxxxxxxVPLVPCEPIIIExxxxxxxxxxxxxxxxxxxxxxxxxWSKPQCQITGFAxxxxxxx
xxxxxxxxxxxxxxxxxxxxxxxxxxCYQFALGQGTTLxxxxxxxxxxxxxxxPHRTLLMNELGVPFHxxTKQVCIAWSSSSCHDGKAWLHxxxxxxxxxxxxx
xxxxxxxxxxxxNILRTQESECVCxxxxxxxxxxxxxxxxxxxxxxxxxxxxxxxG

FIG. 76-256

>Protein:NA|Subtype:H9N2|Blocks

FIG. 76-257 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEITFHG
SKEVxxxxxxxxxxxxxxxxxxxxxxxxxxxxxxMGVQMQRFRRPDSSxxxxxxxxxxxxxxx
>Protein:M2|Subtype:N/A|Blocksize:10|String:1
MSLLTEVETPxxxxxxxxxxxxxxxxxxxxxxxx

FIG. 76-258 xxxxxxxxMSDIEAMATQGTKRSYEQMETDGERxxxxTEIRTSVGRMVGGIGRFYVQMCTELKLNxxEGRLLQNSMTIExxxxxxxxxRNR
YLEENPSAGKDPKKxxxxxxxxxxxxxxxxxxxxxxxxEVRRIWRQANSGEDAxSGLTHIMIWHxxxxxxxxxxxxxxxxxxxxxxxxxxxx
GAAVKGVGTIVLELIRMIKRGxxxxxxxxxxxxxTRTAYERMCNILxKGKFQTAAQKAMMDQVRESRSPGNAEIEDLIFMARSALILRGR
GSVAHKSCLPACVYGPAxxxGYNFFEKEGYSLVGVDPFRLLQxxxxxxxxxxRPNENPVHKSQLIWMAxHSAAFEDLRISxxxxxxxxxxL
ATRGVQIASNxxxxxxxxxxxAIRTKSGGNTN

FIG. 76-259 xxxxxxxxxxxxxxxxxxxxxxxxxxxxxxxxxxxxxxxxxxxxxxxxxxxxxxxxxxxxxxxxxxxxxxxxxxxxxxxxxx
>Protein:NP|Subtype:N/A|Blocksize:10|String:10
xxxxxxxxxxxxxxxxxxxxxxxxxxxxxxxxxxxxxxxRGVFEFSDERAAxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxEQMETSGERQxxxxx
xxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxPRLLQNSQVFxxxx
xxxxxxxxxxxxxxxxxxxxxxxxxxxxxxxxxxxxxxxVFELSDEKAAxxxxxxxxxxxxxxxxxxxxxxxxxxxxxxxxx
>Protein:NP|Subtype:N/A|Blocksize:10|String:11
xxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxVFELSDERAAxxxxxxxxxxxxxxxxxxxxxxxxxxxxxxxxxxxxxxxxx
>Protein:NS1|Subtype:N/A|Blocksize:10|String:1
MLFVQSYFQLFLVCVSLLQSAILSLQQVDCFLWHVRxxxxxxGDAPFLDRLRRDQxDRLRRDQKSLRGRxxxPMRTPIAFLTSSIVCPGx
xxxxxxxxxxxxxxxxxxxxxxxxxIASVPASRYLIDMTxxxxxxxxxxxxxxxxxxxxxxxxxxxxxxxAGVETMVILSAxxxxxx
xxxxxxxxxxxxxxxxxxxxxxxNWPSSSGGLExxxxxxxxxxxxxxxxxxxxxxxSRNGKWREQLSQKFEEIRWxxxEVRGDQMAHCNSFEQI
TFMQALQL
>Protein:NS1|Subtype:N/A|Blocksize:10|String:2
xxxxxxxxxxxxxxxxxxxxxxxxxxxSSFQVDCFLWHVxxxxxxxxSDAPFLDRLRQANLCRFLETRTxxxxxxxxxxxxxxxxxxxxxxx
xxxxxxxxxxxxxxxxxxxxxASVPASRYLTDMTxxxxxxxxxxxxxxxxxxxxxxxxxxxxxxxxxEVRHRLKITENSFEQITFMxxxxxx
>Protein:NS1|Subtype:N/A|Blocksize:10|String:3
xxxxxxxxxxxxxxxxxxxxxTSFQVDCYLWHIRxxxxxxCDAPFDDRLRRDQxDRLRRDQRSLRGRxxxxxxxxxxxxxxxxxxxxx
xxxxxxxxxxxxxxxxxxxxLKMPASRYLTDMxxxxxxxxxxxxxxxxxxxxxxxxxxxxxxxxxEVRRDQMAHCRMxxxxxxxxxxx
>Protein:NS1|Subtype:N/A|Blocksize:10|String:4
xxxxxxxxxxxxxxxxxxxxxLSFQVDCFLWHIRxxxxxxGDAPFLDRIRRDQxDRLRRDQKALKGRxxxxxxxxxxxxxxxxxxxxxx
xxxxxxxxxxxxxxxxxxxxxSKITLKFAFNMMxxxxxxxxxxxxxxxxxxxxxxxxxxxxxxxxx
>Protein:NS1|Subtype:N/A|Blocksize:10|String:5
xxxxxxxxxxxxxxxxxxxxxxSSFQVDCF1WHIRxxxxxxGDAPFIDRLRRDQxDRLRRDQRALKGRxxxxxxxxxxxxxxxxxxxxxxxx
xxxxxxxxxxxxxxxxxxxxxxxxxxxxxxxxxxxxxxxxxxxxxxxxxxxxxxxxxxx

FIG. 76-260

>Protein:NS1|Subtype:N/A|Blocksize:10|String:6
xxxxxxxxxxxxxxxxxxxxxxxxxFQVDCFLWYVRxxxxxxxxxxxPFLDRVRRDQxDRIRRDQKSLKGRxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:NS1|Subtype:N/A|Blocksize:10|String:7
xxxxxxxxxxxxxxxxxxxxxxxxxxxxxxxxxxxxxxxxxxxxxxxxxxSLLLLQANLCRFLExxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxx
>Protein:NS1|Subtype:N/A|Blocksize:10|String:8
xxxxxxxxxxxxxxxxxxxxxxxxxxxxxxxxxxxxxxxxxxxxxxxxxxSSLLLQANLCRxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxx
>Protein:NS2|Subtype:N/A|Blocksize:10|String:1
TAFSGMSANGDILMQYLLFQDILMRMSADQELGDAPFLDRLRRDQKSLRGRGSTLGLDIRTATREGKHIVERILEEESDEALKMTIASD
ILTRMSKxxxxRPHPEDLNGMxxxxxxxxxxxxxxxxxxxxxxxxxxxxxxxxxxxxxxxxxxxxxxxxxxxxxxxxxxxxxxxTENSFEQITFMQALQLLLEVEQEI
RTFSFQLILIxxx
>Protein:NS2|Subtype:N/A|Blocksize:10|String:2
xxxxxxxxxxxxxFQYLLFQDILRKRFADQELGDAPxxxxxxxxxxxxxxxxxxxxxxxxxxxxxxxxxxxxxxxxxxxxxxxKMTIASDILKRMSKxxxxxxxx
xxxxxxxxxxxxxxxxxxxxxxxxxxxxxxxxxxxxxxxxxxxxxxxxxxxxxxxxxxxxxxxxxTESSFEQITFMQALQLLFEVEQEIRAFSFQLINNKKP
>Protein:NS2|Subtype:N/A|Blocksize:10|String:3
xxxxxxxxxxxxxFQVDCFLWHVRKRFADQELxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxENSFEQITFLQALQLLLEVESEIRTFSFQFIxxxxx
>Protein:NS2|Subtype:N/A|Blocksize:10|String:4
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxENSFEQITFIQALQLLLEVENEIRTFSFQLINNKxx
>Protein:NS2|Subtype:N/A|Blocksize:10|String:5
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxEVEQEMRTFSFQLILLxxx
>Protein:PA|Subtype:N/A|Blocksize:10|String:1
MEDFVRQCFNPMIVELAEKAMKEYGExxxxETNKFAAICTHLEVCFMYSDFHFIDERxxxxxxxxxDPNALLKHRFEIIEGRDRTxxxxxxxxx
xxxxxxxKPKFLPDLYDYKENRFIEIGVTRREVHIYYLEKANKIKSEKTHIHIFSFTGEEMATKxDYTLDEESRARIKKTRLFTIRQEMASR
GLWDSFRQSERGEETIEERFEIxxxxxxxLADQSLPPNFSxxxxFRAYVDGFEPNGCIEGKLSQMSKxxxxxxxxxxxxxxxxxxxxxxxxxCSQRSKF
LLMDALKLSIEDPSHEGEGEGIPLYDAIKCxxxxxxxxxxxxxxxxxxxxxxxxxxxxxxxxxxxxxxxxLKDEEKIPKTxxxxxxxxxLKWALGENMAPEK
VDFxxxxxxxxxxxxxxxxxxxxxxxxWIQSEFNKACELTDSSWxWIELDEIGEDVAPIEHIASMRRNYFTAEVSHCRATEYIxMKGVYINTALL
NASCAAMDDFQLIPMISKCRTKEGRRKTNLYGFIIKGRSHLRNDTDVVNFVSMEFxxxxxxxxxxxxxxxxxxxxxxxxxxxxxxxxxxxxPMFLYV

FIG. 76-261

RTNGTSKIKMKWGMEMRRCLLQSLQQIESMIEAESSVKEKDMTKEFFExxxxxxxxxxVEEGSIGKVCRTLLAKSVFNSLYASPQLE
GFSAESRKLLLIVQALRDNLEPGTFDLGGLYEAIEECLINDPWVLLNASWFNSFLTHALRFLxxxxxxxx
>Protein:PA|Subtype:N/A|Blocksize:10|String:2
MENFVRQCFNPMVVELAEKTMKEYGExxxxETNKLAAICTHLEICFMYSDFHFINEQxxxxxxxxxDSNALLKHRFEIIEGRDRIxxxxxxxx
xxxxxxKPRFLPDLYDYKEDRFVEIGVTRREIHIYYLEKAS

FIG. 76-262

RRTxxxxxxxxxxxxxxVVNFVSMEFSLTDPKLExxxxxxxxxxxxxxxxxxxxxxxxxSMFLYVRTNGxxxxxxxxxxxxxxxxxxxxxxSMIEA
ESSVREKDMTKEFFVxxxxxxxxxxxxxIEEGSIGKVCxxxxAKSVFNSLYSSPQLEGFSAESRKLLLITQAxRDDLEPGTFDxxxYEAVEEC
LINDPWxxxNASWFNSFLKH

FIG. 76-263

>Protein:PA|Subtype:N/A|Blocksize:10|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxSIENPSHEGEGIPLHDxxxxxxxxxxxxxxxxxxxxxxxxxxxxxxxxxxxxxx
xSHCRATEYMMKGVYxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxx
>Protein:PA|Subtype:N/A|Blocksize:10|String:11
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxSIEEPSHEGEGIPLCxxxxxxxxxxxxxxxxxxxxxxxxxxxxxxxxxxxxxxx
xxxxATEYIIKGVYxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxx
>Protein:PB1|Subtype:N/A|Blocksize:10|String:1
MDVNPTLLFLKVxxPAQNAISTTFPYTGDPPYSHGTGTGYTMDTVNRTHQYSEKGKWxxxTETGAPQLNPIDGPLPEDNEPSGYAQTD
CVLEAMAFLEESHPGIFENSCLExxxxVQQTRVDKLTQGRQTYDWTLNRNQPAATALANTIEVFRSNxxxxNESGRLIDFLKDVMxxxxxx
xxxITTHFQRKRRVRDNxxxMVTQRTIGK

FIG. 76-264 xxxxxxxxxxxxxxxxIEYDAVATTHSWVPKRNRSILNTSQRGVxxxxxxxxxxxxxxxxILNTSQRGVLEDEQMYQKCCSLFEKFPPSSSYRR
PIGISSMVEAMISRARIDARIDFESGRMGKKEFSEIMKxxxxxIEELRRQKWWVWLWLVLREKxx
>Protein:PB1|Subtype:N/A|Blocksize:10|String:3
xDVNPTLLFLRVxxPAQN

FIG. 76-265

WFRNILSIAPIMFSxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxHPRGLLEVGTRWMKIIxxxxxxxxxxxxxxxxxxxxxx
xxxxxxxxxxxxxxxxxxxxxxxxxxxxxxxxxxxxxxxx
>Protein:PB1|Subtype:N/A|Bl

FIG. 76-266 xxxxxxxxxxxxxxxxxxxxxxxxxxxxxxxxxxxxxxxxxxxxxxxxxxxxxxxxxxxxxxxxxxxxxxxxxxxxxNQSPRMFLAMITxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxx
>Protein:PB1|Subtype:N/A|Blocksize:10|String:11
xxxxxxxxYFFLKVPVQNxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxRTFLAMITYITxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxx
>Protein:PB2|Subtype:N/A|Blocksize:10|String:1
SKSRSNIFNMERIKELRDLMSQSRTREILTKTTVDHMAIIKKYTSGRQERQEKNPALRMKWMMAMKYPITADxxxxxxxxxxxxxxxxxxxxxxxxxxxx
xxxxxxxxxMVSPLAVTWWNRNGPxxxxxHYPKVYKTYFxxxxxxxxGTFGPVHFRNQVKIRRRVDINPGHADxxxAKEAQDVIMEVVFPNE
VGARILTSESQLxxxxxxxxxxxxxxIAPLMVAYMLERELVRKTRFLPVAGGTSSVYIEVLHLTQGTCWEQMYTPGGEVRNDDVDQSLIIA
ARNIVRRAAVSADPLASLLEMCHSTQIGGxxxxDILRQNPTEEQAVDICKAAMGLRISSSFSFGGFTFKRTSGSSxxxEEEVLTGNLQTLKI
xxxEGYEEFTMVGxxATAILRKATRxxxxxxxxxxxxxxxxxxxIVAMVFSQEDCMIKAVRGDLNFVNRANQRLNPMHQLLRHFQKDAKVLx
xxxxxxxxxxxxxxxxxxxxxxxxxxxxxxxxRVSKMGVDEYSSTERxVVSIDRFLRVRDQRGNVLLSPEEVSETQGTEKLTITYSSSMMWEINGP
ESVLVNTYQWIIRNWExxxxxxxxxxxxLYNKMEFEPFQSLVPKAxxxQYSGFVRTLFQQMRDVLGTFDTVQIIKLLPFAAAPPEQSRMQFS
SLTVNVRGSGMRILVRGNSPVFNYNKxxKRLTVLGKDAGAGALAEDPDxxxAGVESAVLRGFLILGKEDKRYGPAxxxxxxxxxLAKGEK
ANVLIGQGDVVLVMKRKRDSSILTDSQTATKRIRMAINQCxxx
>Protein:PB2|Subtype:N/A|Blocksize:10|String:2
SESRSNIFNMERIKELRYLMLQSRTREILTRTTVDHMAIIKRYTSGTSGRQEKNPALRMKWMMAMRYPITADxxxxxxxxxxxxxxxxxxxxxxxxxxxx
xxxxxxxxMISPLAVTWWNRKGPxxxxxHYPKIYKTYFxxxxxxxxGTFGPVHFQNQVKIRRRVDTNPGHADxxxSKEAQDVIMEVVFPNEV
GAKILTSESQLxxxxxxxxxxxxxxISPLMVAYMLExxxVRKTRFLPVSGGTSSIYIEVLHLTQGACWEQLYTPGGEVKNDDVDQSLVIAAR
NIVRRATVSADPLASLLEMCHGTQIGGxxxxDILKQNPTEEQAVGICKAAMGLKISSSFSFGGFTFKRTKGSSxxxEEEMLTGNLQTLKLx
xxEGYEEFTLVGxxATAILKKATRxxxxxxxxxxxxxxxxxxxVVAMVFSQEDRMIKAVRGDLxxVNRANQRLNTMHQLLRHFQKNAKVLxx
xxxxxxxxxxxxxxxxxxxxxxxxxxxxxxxxRISKMGVDEYSNAERxIVSIDRFLRVKDQQGNVLLSPEEVSEAQGTERLTITYSSSMMWEVNGPE
SVLVNTYQWVIRNWExxxxxxxxxxxxLYNKIEFEPFQSLVPRAxxxRYSGFVRTLFQQMRDILGTFDTTQIIKLLPFASAPPEQSKMQFSSL
TVNVRGTGMRILVRGNSPAFNYNKxxKRLTILGKDAGxxxxxxxxxxxxSGVESAVLRGFLIIGKEDRRYGPAxxxxxxxxxLTKGEKANVLI
GQGDIVLVMKRKRDxxxxTDSQTATKRLRMAINWGRIV

FIG. 76-267

>Protein:PB2|Subtype:N/A|Bl

FIG. 76-268

RGSGLRILIRGNSPxxxxxxxxxxxxxxxxxxxxxxxxxxxxxxGKENKKYGPAxxxxxxxxxxxxxxxxxxxxxxxxxxxxxx
xxxxxKRIRMAINWGRIx
>Protein:PB2|Subtype:N/

FIG. 76-269

>Protein:PB2|Subtype:N/A|Blocksize:10|String:11
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxKENKRYGPALSIxxxxxxxxxxxxxxxxxxxxxxxxxxxxxxxxxxxxxxxxxxxxxxxxxxxxxxxxx
>Protein:PB2|Subtype:N/A|Blocksize:10|String:12
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxKENKKYGPALSINExxxxxxxxxxxxxxxxxxxxxxxxxxxxxxxxxxxxxxxxxxxxxxxxxxxxxxxxx
>Protein:PB2|Subtype:N/A|Blocksize:10|String:13
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxRRYGPALSISxxxxxxxxxxxxxxxxxxxxxxxxxxxxxxxxxxxxxxxxxxxxxxxxxxxxxxxxx
>Protein:HA|Subtype:ALL|Blocksize:11|String:1
KQGKTKATKMKAxxIFIFILLTHWAYxxxxxSQITNGTTGNPIICLGHxxxxxxxxxxxxxxxxxxxxxxxxxxxxGVIPLTTTPTKSYFANLKGTRTxx
xxxxxxxxxxxxxxxxxxxxxxxxxxxxxxxxxxxxxxxxxxxxxxxxxxxxxxxxxxxxxIMHDRTKIRQLPxxxxxxxxxxxxxxxxxxxxxxxxxxxxxxxxxxxxxxxxxxxxxxx
xxxxxxxxxxxxxxEKENSYPMINKxxxxxxxxxxxxxxxxxxxxxxxxxxxxxxxxxxxxxxxxxxxxxxxxxxGVTTHYVSQIGxxxxxxDEGLPQSGRIVVDYM
xxxxxxxxxxxxxxxxxxxxxxxxxxxxxxAPSGIEYNGKSLGIQSDAxxxxxxxxxxPSVKLPMGAINxxxTSLTSLPFQNIHPxxxxxxxxxxxxxxxxxxxxxxxxxxxxxxxxxxxxxxx
xxxxPAKLLKERGFFGAIRQKRGLFGAIAGMRKKRGLFGAIAMTRGLFGAIAGFxxxxxLFGAIAGFIEGGWxxxxxxGRLVRFRHQNSExx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxLPTFDSLNITAASLNDDGLxxxxxxxxxxxxxxxxxxxxxxxVTTRQASPSCLVVRKSxxxxxxxxxxxxxxxxxxxxxxxLCSVEYASK
TRISEIxxxxxxxxx
>Protein:HA|Subtype:ALL|Blocksize:11|String:2

FIG. 76-270

KQGKTKATKMEAxxIFIFLLLTHWAYxxxxxxxxxxxxNNNNNTATLCLxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxEKENSYPKINKxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxAPSGVEYNGKSLGIQxxxxxxxxxxxxxxxGAIGAIDSSMPFHxxxGEHAKAIGNCPxxxxxxxxxxxxxxxxxxIPIGERGLFGA
xTRRQKR

FIG. 76-271 xxxxxxxxxxxxxxxxxxxxxxxxxxxxxxxxxxxxxxxxxxxxxxxxxxxxxxxxxxxxxxxxTHKQLTHHMRKRxx
xxxxQMTRGLFGAIAxxxxxxxxxxxxxxxxxxxxxxxxxxxxxxxxxxxxxxxxxxxxxxxxxxxxxxxxxxxxxxxxx
xxxxxxxxxxxxxxx

FIG. 76-272 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxx
>Protein:HA|Subtype:ALL|Bl

FIG. 76-273 xFSGSQKQEFKMNPNQKIIIxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-274

HYEECSCYPxxxxxCVCRDNWHGSNRPWVSFxxxxxxGYICSGVFGDNPRxxxxxxxxxxxxxxxxxxxxxxxxYGNGVWIGRTKxxxxxG
FEMIWDPNGWxxxxxxxxxxxxTDWSGYSGSFVQHPELTGLDCIRPCFWVELIRGRPxxxTTIWTSGSSISFCGVNxxIFLWCKIVTTVG
WSWPDGAELPFxxxxxxx
>Protein:NA|Subtype:N1|Blocksize:11|String:2
LVFREQKQEFKMN

FIG. 76-275

>Protein:NA|Subtype:N2|Blocksize:11|String:1
AKAGVKMNPNQKIITIxxxxxxxxxxxxxxxxxxxxxxxxxxxxxxxxxxxxxxKNNQVILCEPTxxxxxxxKTVVHLNSTTIxxxEKEKEICSVVLExxxxx
xxxxxxxxxxxxxKDNSIRLSAGGxIWVTREPYVSCxxxKCYQFALGQGTTLxxxxxxxxxxxxxPYRTLLMNELGVPFHLGTKQVCIAWSSSSC
HDGKAWLHxxxxxxxxxxxxxxxxxxxxxxxxxxxxxxILRTQESECVCINxxCTVVMTDGSASREGLILEYYFVxxxxxxxxxxxxxGSAQHVEECS
CYPRSYLNVRCVCRDNWKGSNRPIKLDINMADYSIxxxYVCSGLVGDTPRKxxxxxxxxxxxxxxxxxxxxxxxxxxxxxxxxxxxxxxxxxxxxxxxx
xxxxxxxxxxxxxxxxxxxxxxxxxxxxxxxxxxxxxxxxCINRCFYVELIRGRxxxxxxxxTSNSIVVFCGTSGTYGTGSWPDGADINLHAYISxxxxx
>Protein:NA|Subtype:N2|Blocksize:11|String:2
xxxxxxxxxxxIIIAIGSVSRTxxxxxxxxxxxxxxxxxxxxxxxxxxxxxxxxxKNNQVILCEQTxxxxxxxxxxxxxxxxxxxxxxxxxxxxxxxxxxxxxxxxxxxxxxx
xxxxKDNSIRLSASGxIWITREPYVSCxxxRCYQFALGQGTxxxxxxxxxxxxxxxPHRTLLMNELGVPFHLATKQVCMAWSSSSCHDGRAW
LHxxxxxxxxxxxxxxxxxxxxxxxxxxxxxxILRTQESECICINxxCAVVMTDGSASRKGLILEYYSLxxxxxxxxxxxxxGSAQHIEECSCYPRSYPN
VRCVCRDNWRGSNRPVxxxxxxxxxxxxxxYLCSGLVGDTPRNxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxCVNRCFYVELIRGSxxxxxxxxTSNSIIVFCGTSGTYGSGSWPDGANINFMPYISxxxxx
>Protein:NA|Subtype:N2|Blocksize:11|String:3
xxxxxxxxxxxxxxxxxxxxxxxxxxxxxxxxxxxxxxxxxxxxxxxxxxxxxKNNQVILCGPTxxxxxxxxxxxxxxxxxxxxxxxxxxxxxxxxxxxxxxxxxxxxxxxx
xxxKDNSVRLSAGGxIWVTRELYVSCxxxNCYQFALGQGTxxxxxxxxxxxxxxxPHRTLLMSELGVPFHLGTRQVCIAWSSSSCYDGKAWL
HxxxxxxxxxxxxxxxxxxxxxxxxxxxxxxxxRTQESECVCISxxCTVVMTDGNASxxxxxxxxxxxxxxxxxxxxxxxxGNAQHVEECSCYPQxxxxVRC
ICRDNWKGSNRPVxxxxxxxxxxxxxxYMCSGLVGDTPRSxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxRCFYVELVRGRxxxxxxxxTSNSIVAFCGTSGTYGTGTWPDGADINLMPIYSxxxxx
>Protein:NA|Subtype:N2|Blocksize:11|String:4
xxxxxxxxxxxxxxxxxxxxxxxxxxxxxxxxxxxxxxxxxxxxxxxxxxxxxxxxxxxVPLVPCEPIIIERxxxxxxxxxxxxxxxxxxxxxxxxxxxxxxxxxxxxxxxxxxx
xKDNSIRLAAGGxVWVTREPYVSCxxxxxxxxxxxxxxxxxxxxxxxxxxxxxPYRTLLMSELGVPFYLGTKQVCVAWSSSSCHDGNAWLHxxx
xxxxxxxxxxxxxxxxxxxxxxxxxxxxxRTQESECVCIDxxCTVIMTDGSASxxxxxxxxxxxxxxxxxxxxxxxxxQHIEECSCYPQxxxxIRCVCRDN
WKGxxxxxxxxxxxxxxxxxxxxxxxCSGLVGDTPRDxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxTSNSIIAFCGTSGTYGAGSWPDGADIKSHAYISxxxxx
>Protein:NA|Subtype:N2|Blocksize:11|String:5
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
KDNSIQLSAGGxxxxxxxxxxxxxxxxxxxxxxxxxxxxxxxxxxxxxxxxxSHRTLLMNELGIPFHLGTKQVCxxxxxxxxxxxxxxxxxxxxxxxxxxxxxxxx
xxxxxxxxxxxxxxxxxxxxxxxxxxxxxxxxxxxxxxxxIREGLILEYYFxxxxxxxxxxxxxxxQHVEECSCYPSxxxxVKCVCRDNWKGSxxxxxxxxxx
xxxxxxxxxxCSGLVGDTPRExxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxTANSIIVFCGTSGTYGAxxxxxGRTSISCLYKLSQFxx
>Protein:NA|Subtype:N2|Blocksize:11|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxYRTLLMNELGIxxxxxxRQVCMAWSSSSxxxxxxxxxxxxxxxxxxxxxxxxxxxxxxxxxx
xxxxxxxxxxxxxxxxxxxxxxxxxxxxxxxxxxxxxIRKGLILEYYSxxxxxxxxxxxxxxxxxxxxxxxxxxxxxxxxxxxxRDNWRGSNRPIxxxxxxxxxxxxx

FIG. 76-276 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxVFCGTSGTYGKGSWPxxxADINLHAYISFRNL
>Protein:NA|Subtype:N2|Blocksize:11|String:7

FIG. 76-277

>Protein:NA|Subtype:N3|Blocksize:11|String:4

FIG. 76-278

SRSGFEMVWDANGWVSTDKDSNGVQDIIDNDNWSGYSGSFSIRGETTGRNCTVPCFWVEMIRGQPKEKTIWTSGSSIAFCGVNSDTT
GWSWPDGALLPFDIDK
>Protein:NA|Subtype:N4|Blocksize:11|String:2
MNPNQSIITIGSAxxxLTTIGLLLQITSLCSIWFSHYNQMTQAxxxxCSNDTINYYNETFVNVTHVQNNYTTxxxxxxxxxxxxxxxxxLCPVKG
WAPLSKDNGxxxxxRGEVSVIREPFISCSVSECRTFFLTQxxxxxxxxxxxxxxxxxSPFRTLMSCPMGVAPSPSNSRxxxxAWSATACSDGSGWL
TLGITGPDSTAVAVIKYNGIITDTLxxxxxxxxxxxxxxxxxVCQDEFCYTLMTDGPSDAQAFYKLLKIRKGKIVxxxxxxATGYHFEECSCYPSG
ENVECVCRDNWRGSNRPWVRFNSDLDYQIGYICSGVFGDNPRPxxxxxxxxGPINNGKGRYGVKxxxxxxGDGVWIGRTKNLESRSGFE
MVWDDNGWVSTDKDSNGVQDIIDNNNWSGYSGSFSIRWETTGRNCTVPxLWVEMIRGQPKEKAIWTSGSSIAFCGVDSDTTGWPWP
DGALLPFDIDR
>Protein:NA|Subtype:N4|Blocksize:11|String:3
MNPNQMIITIGSAxxxLTTVGLLLQIISLCSIWFSHYNQMKQAxxxxxxxxxTNYYNETFVNMTNVQNNYTTxxxxxxxxxxxxxxxxxLCPIKG
WAPLSKDNxxxxxxxGEVFVIREPFVSCSIHECRTFFLTQGxxxxxxxxxxxxxxxSPFRTLMSCPVGVAPSPSNSRxxxxxxxxxACSDGPGWLTI
GITGPDATAVAVIKYNGIITDTFKSWKGNIMRTxxxxxVCQDEFCYTLVTDGPSDAQAFYKILKIKKGKIVxxxxxxAPGFHFEECSCYPSR
ENxxxxxxxNWQGSNRPWIRFNSNLDYQIGYVCSGVFGDNPRxxxxxxxxxSPINNGKGRYGxxxxxxxxxEEVWIGRTKSLESRRGFEMIWD
ANGWVSTDKNSNGVQDIIDNxxxxxxxxxxxxxRGETTGRNCTIPCFWVEMIRGQPNERTIWTSGSSIAFCGVNSNTTGWSWPDGALFPLTx
xx
>Protein:NA|Subtype:N4|Blocksize:11|String:4
xxPNQKIITIGSVxxxLTTVGLLLQVTSLCSIWFSHYNQITxxxxxxxxxxxxxYYNETFVNITNVQNNYTxxxxxxxxxxxxxxxxxxxxxxxxxxxxxxxxxxx
xxxxxxxxxxxEVFVIREPCISCSINECRTFFLTQGxxxxxxxxxxxxxxxxxxxxRTLMSCHIGVAPSPSNSxxxxxxxxxxxxxxxxxxxWLTLGITGPDTTAV
AVLKYNGVITDTLKSWKGxxxxxxxxxxxxxxxxxxCYTLITDGPSNAQAFYKILKIKKGKLxxxxxxxxAAGFHFEECSCYPSGESxxxxxxxxxxxxxN
RPWIRFNSDPDYQIGYVCSGIFGDSPRPxxxxxxxxxxxxxxxxxxxxxxxxxxxxxxxxxxxxxxxxxSLESRSGFEMIWDANGWVTADKDSNGVQDIxxx
xxxxxxxxxxxxxxxxxxxxxxxxxxxxxxxxxxIRGQPKERTIWTSGSSIAFCGVNFDLTSWSWPDGALLPLTxxx
>Protein:NA|Subtype:N4|Blocksize:11|String:5
xxPNQKIITIGSAxxxLTTIGPLLQITSLCSIWFSHYNQVAQTxxxxxxxxxxxxxxxxxTFVNVTNVQNDYTTxxxxxxxxxxxxxxxxxxxxxxxxxxxxxxxxxx
xxxxxxxxxxxxxxxxxxISCSIDECRTFFLTQGxxxxxxxxxxxxxxxxxxxxxxxxCPIGVVPSPSNxxxxxxxxxxxxxxxxxxxxxxxxxxxPDATAVVVLKY
NGxxxxxxxxxxxxxxxxxxxxxxxxxxxxxxxxxxxxxxGPSDGQAFYKILKIKKGKIMxxxxxxATGFHLEECSCYPSGxxxxxxxxxxxxxxxxxxIRFNSDL
NYQIGYICSGIFGDNPRxxxxxxxxxxxxxxxxxxxxxxxxxxxxxxxxxxxxxxxxxxxxxxxxxxxxxxxMVWDANGWVTAxxxxxxxxxxxxxxxxxxxxxxxxxxxxxxxxx
xxxxxxxxxxxxxxxxxxxxxxxxxxxxxxxxxxAFCGVDSDTTSWSWPDGALxxxxxxx
>Protein:NA|Subtype:N4|Blocksize:11|String:6
xxxxxxxxxxxxxxxxxxTTIGLLLQIISxxxxWFSHYNQVTQPxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxKILKIRKGKIMxxxxxxxIGFHFEECSCYxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxANGWVSTDKSSxxxxxxxxxxxxxxxxxxxxxxxxxxxxxxxxxxxxxxxxxxxxxxxxxxxxxxxxxxxxxxxxxxxxxxA
FCGVNSDTTSWxxxxxxxxxxxxxxx
>Protein:NA|Subtype:N4|Blocksize:11|String:7

FIG. 76-279 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSDTTCWSWPDGALLPxxxxx >Protein:NA|Subtype:N5|Blocksize:11|String:1
MNPNQKIITIGSVSLALxxxxxxxxxxxxxxxxxxxxxxxxxxxxxxxxxxxxxxxxxxxxxxxxxxxxxxxxxxxxxxxxxxxxxxxxxxxxFLNNTEPLCNVSGFAIVSKDNGIRI
GSRGHVFVIREPFVACGPTECRTFFLTQGALLNDKHSNNTVKDRSPYRALMSVPLGSSPNAYQAKFESVAWSATACHDGKEWLxxGIS
GADDDAYAVIHY

FIG. 76-280

IHYGGVPTDVMRSWRRQILRTQESSCxxxxxxxxxxDGPANNQASYRIFKSxxxxxxxxISFQSGHIEECSCYPNLCQVECVCRDNWxxx
xxxxxxxxxxxxxxxxxxIPTDTPRFQDSxxxxxxxxxxIGGSGTDNYGVxxxxxQGNSVWAGRTMxxxSRSGFEVLFIEDGWxxxxxxxxxxEVL
NNKHWSGYSGSFTxxxxxxxxxxxxxxxxxxxxxxPEEKTSIWTSSSSxxFCGVSSEVPGCxxxxxxxxxxxxxxxxx
>Protein:NA|Subtype:N5|Blocksize:11|String:6
xxxxKIITIGSVSLTLxxxxxxxxxxxxxxxxxxxxxxxxxxxxxxxxxxxxxxxxxxxxxxxxxxxxxxxxxxxxxGFAIASKDNGIRIGxxxxx
xxxxxxxxxSTECRTFFLTQxxxxxxxxxxxxxxxxxxxxxxxxxxxxxxxxESIAWSATACHDGKKWMxxxxxxxxxxxxxxxxGGIPTDVIRS
WxxxxxxxxxxxxxxxxxxxxxxxxxxxxxxxxxxxxxxxxxxxxxxxxxxFCSCYPNLGIVECVCRxxxxxxxxxxxxxxxxxxxxxxxxxxxxx
xxxxxxxxxxxxxxxxxxxxxxxxxxxxxxxxxxxxxxxxxxRSGFEILLIEEGWxxxxxxxxxxxVLNNRNWSGYSGSFTxxxxxxxxxxxxxxxxx
xEERPSIWTSSSSTVFCGVSSEVPEWSWDDGAILPxxxxxx
>Protein:NA|Subtype:N5|Blocksize:11|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxPTDVVRSWRRQILRTxxx
xxxxxxxxxxxxxxxxxxxxxxxxxxxxxxxxxxxxxxxxxxxxxxxxxxxxxxNWSGYSGAFTVPIxxxxxxxxxxxxxxxxxxxxxxxxxxxxxVS
SEVPGWSWGDGxxxxxxxxx
>Protein:NA|Subtype:N5|Blocksize:11|String:8
xxxxxxxxxxxxxxxxxxxxxxxxxxxxxxxxxxxxxxxxxxxxxxxxxxxxxxxxxxxxxxxSGYSGAFTIPTxxxxxxxxxxxxxxxxxxxxxxxx
xxxxxxxxxxxxxx
>Protein:NA|Subtype:N5|Blocksize:11|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxSGYSGAFTIPVxxxxxxxxxxxxxxxxxxxxxxxxxxxxxxxx
xxxxxxxxxxxxxxx
>Protein:NA|Subtype:N6|Blocksize:11|String:1
MNPNQKIICISATGMTLSVxxxxxxxxxxxxxxxxxxxxxxxxxxxxxxxxxTTTTIINNNTQxxxxxxxxxxxxxxxxxxxxxxxKPLCEVNSWHILSK
DNAIRIGEDAHILVTREPYLSCGPxECRMFALSQGTTLRGRHANGTIHDRSPFRALISWEMGQAPSPYNxxVECVGWSSTSCHDGISRM
SICMSGPNNNASAVVWYxxxxTEIASWAGNILRTQESECVCHNGICPVVMTDGPANxxxxxxxxxxxxxxxxxxxxGSAQHIEECSCYGAx
xxIKCICRDNWKGANRPVITxxxxxxxxxYLCSKILTDTSRPxxxxxxxxxxGGSPDPGVKGFAFLDGxNSWLGRTISKDSRSGYEMLKV
PNAExxxxxxxxIVNNQNWSGYSGAFIDYWxxRECFNPCFYVELIRGRPKExxVLWTSNSIVALCGSKERLGSWSWHDGAEIIYFK
>Protein:NA|Subtype:N6|Blocksize:11|String:2

FIG. 76-281

MNPNQKITCISATGVTLSVxxxxxxxxxxxxxxxxxxxxxxxxxxxxxxxxxxxxxxxxxxxxxxxxxxxxxxxxxxxxxxxxxxxxKPLCEVSSWHILSKDN
AVRIGEDAHVLVTREPYLSCDPxGCRMFALSQGTTLKGRHANGTIHDRSQFRALISWEMGLAPSPYNxxVECIGWSSTSCHDGMSRMS
ICISGPNNNASAVIWYxxxxTEIPSWAGNILRTQESECVCHKGICPVVMTDGPASxxxxxxxxxxxxxGNAQHEECSCYGSxxxV
KCICRDNWKGANRPHTIxxxxxxxYLCSKVLTDTSRPxxxxxxxxxxGGGPDPGVKGFAFLNGxNSWLGRTTSKDSRSGYEVLKVPN
AExxxxxxxxxxxIVNNQDWSGYSGAFMDYWxxKEC

FIG. 76-282

>Protein:NA|Subtype:N7|Blocksize:11|String:1
MNPNQKLFALSGVAIxxxxxNLLIGISNVGLNVSLHLxxxxxxxxxxxxxxxxxxxxxxxxxENTYVNNTTVIxxxxxxxxxxYLMLNKSLCKVxxWV
VVAKDNAIRFGESEQIIVTREPYVSCDPLGCKMYALHQGTTIRNKHSNGTIHDRTAFRGLISTPLGxxxxxSNSDFLCVGWSSTSCHDGIG
RMTICxQGNNDNATATVYYDRRLTTTIKTWAGNILRTQESECVCHNGTCVxxxxxxxxxxxxxxxxxxxxxxxxxxxxxxxLKGSARHIEECSCYG
HNxxVTCVCRDNWQGANRPVIEIDMxxxxxxxxxxCTGVLTDTSRPSDxxxGDCNNPITGSPGAPGVKGFGFLDxxNTWLGRTISPRSRSGF
EMLKIPNAGxxxxxxxxxxxxxxxxxxNWSGYSGSFIDYWDExSECYNPCFYVELIRGRPEEAKYVWWTSNSLVALCGSPISVGSGSFPDGAQ
IQYFS
>Protein:NA|Subtype:N7|Blocksize:11|String:2
MNPNQKLFASSGIAIxxxxxNLIIGISNVGLNMSLHLxxxxxxxxxxxxxxxxxxxxxxxxxENTYVNNTTIIxxxxxxxxxxYLLLNKSLCNVxxWVVI
AKDNAVRFGESEQIIVTREPYVSCDPTGCRMYALHQGTTIRNRHSNGTIHDRTTFRGLLSTxxxxxxxxSNSDFMCVGWSSTTCHDGIAR
MTICxQGNNNNATATVYYDKRLTTTIKTWARNILRTQESECVCHNSTCVxxxxxxxxxxxxxxxxxxxxxxxxxxxxxxLKGSAKHIEECSCYGHS
xxATCVCRDNWQGANRPIIEIDMxxxxxxxxxxCTGILTDTSRPGDxxxGDCSNPITGSPGVPGVKGFGFLNxxNTWLGRTISPKLRSGFEML
KIPNAExxxxxxxxxxxxxxxxxNLSGYSGSFIDYWNDxNECYNPCFYVELIRGRPEEVKYVWWTSNSLIALCGSPFPVGSGSFPDGARIQYF
x
>Protein:NA|Subtype:N7|Blocksize:11|String:3
MNPNQKLFTLSGVAIxxxxxNLLIGISNMSLNISLYSxxxxxxxxxxxxxxxxxxxxxxxxxxKNTYVNNTTIIxxxxxxxxxxYLVLNKSLCKVxxWVVI
AKDNAIRFGEGEQIIVTREPYVSCDPSSCKMYALHQGTTIRNKHSNSTTHDRTAFRGLMSTPLGxxxxxSNSDFICVGWSSTSCHDGVGR
MTICxQGDNENATATVYYNRRLTTTIKPWARNILRTQESECVRHNGTCxxxxxxxxxxxxxxxxxxxxxxxxxxxxxxxLRGSARHIEECPCYGHxx
xITCVCRDNWQGANRPVIKIDMxxxxxxxxxxxTGVLTDTSRPKDxxxGECFNPITGSPGSPGxxxxxxxxxxNTWLGRTISTRSRSGFEMLKVP
NAExxxxxxxxxxxxxxxxxxKWSGYSGSFIDYWDDxSVCYNPCFYVELxRGRPEEAKYVEWTSNSLIALCGSPIPVGPGSFPDGAQIKYFS
>Protein:NA|Subtype:N7|Blocksize:11|String:4
MNPSQKLFALSGVAVxxxxxNLLIGVSNVGLNxxxxxxxxxxxxxxxxxxxxxxxxxxxxxxENKYVNNTTIIxxxxxxxxxxYLLLNKSLCSVxxWVA
VAKDNAIRFGESEQVIVTREPYVSCDPIGCKMFALHQGTTIRNKHSNGTTHDRAAFRGLISTHLGxxxxxSNSEFICVGWSSTTCHDGVS
RMTICxQGNNENATATVYYNKRLTTTIKTWAKNILRTQESECVCHNGTCAxxxxxxxxxxxxxxxxxxxxxxxxxxxxxxLQGSARHIEECSCYG
HDxxVSCVCRDNWQGANRPVIEINMxxxxxxxxxxxTGVLTDTSRPGDxxxxDCSNPITGSPSAPGVKGFGFLNxxSTWLGRTISPRLRSGFE
MLKIHNxxxxxxxxxxxxxxxxxxxxxxxxxxxxxxxxxxxxxSKCYNPCFYVELxxxRPEEAKYVWWASNSLIALCGSPVPIGSGFFPDGPQIQYxx
>Protein:NA|Subtype:N7|Blocksize:11|String:5
MNPNQNLFTLSxxxxxxxxxNLLIGISNVVLNVSLHLxxxxxxxxxxxxxxxxxxxxxxxxxENTYVNKTTVIxxxxxxxxxxYLMLSKSLCKVxxWVVI
AQDNAIRFGExxxxxxTREPYVSCDPKxxxxxxxxxxxxxxxxxxxxxxxxxxxxxxxxTINDRTAFRGLISTQLGxxxxxSNSEFLCVGWSSTxCHDGVNRMTICxQ
GNNKNATATVYYDGRLTTTIKTWAGKILRTQESECVSHNGTWAxxxxxxxxxxxxxxxxxxxxxxxxxxxxxLKGSAMHIEECxxxxxxxxVTCIC
RDNWQGANRPAIEIDxxxxxxxxxxxxTGILTDTSRPSDxxxxDCSNPITGSPCAPGIKGFGFLNxxNTWLGGTISPRSRSGFEVLKVPNAxxxx
xxxxxxxxxxxxxxxxxxxxxxxxxxxxxxxSACYNPCFYVExxxxxxxxxxxxxxxxxNSLVALCGSPVxVGSGSFPNGAQIQYFS
>Protein:NA|Subtype:N7|Blocksize:11|String:6
xNPNQKLFALSEVAIxxxxxxxxxxxSNIGLNVSLHLxxxxxxxxxxxxxxxxxxxxxxxxxxxxxxxxxxxxxxxxxxxxxxxxxxxxxxxxxxxxxxxxxVVIEKDNAV
RFGxxxxxxxxxxxxxxxxxxxxxxxxxxxxxxxxxxxxxxxxTIHDRNAFRGLxxxxxxxxxxxxxxxxxxxxxxxxxxxxxxxxxxxxxxxxxxNDNATATVYYNGRL

FIG. 76-283

TTTIxxxxxxRTQDSECVSHNGxxxxxxxxxxxxxxxxxxxxxxxxxxxxxxxxGSARHVEECSCYGxxxxTCVCRDNWRGANRxxxxxxxxxx
xxxxxxxxxxxxxxxxxxxxxxxxxxxxxxxxxxxxxxxxxxxxxAPGTKGFGFLNxxxTWLGRTFSPRSRSGFEMLKIHxxxxxxxxxxxxxxxxxxxxxxxxx
xxxxxxxxxxxxxxxxxxxxxxxxxxxxxxxxxxxxxxxxxxxxxGSGSFPDGAKIQYFS
>Protein:NA|Subtype:N7|Blocksize:11|String:7
xxPKSKLFTLSGVAxxxxxxxxxxxxxxxxxxxxxxxxxxxxxxxxxxxxxxxxxxxxxxxxxxxxxxxxxxxxxxxxxxxxxVYYNRRPTTTIKTWA
xxxxxxxxxxxxxxxxxxxxxxxxxxxxxxxxxxxxxxxxxxxxxDGTAFRGLISTxxxxxxxxxxxxxxxxxxxxxxxxxSARHIEEWSCY

FIG. 76-284

AQFxxxxxxxLGYGVKGFGFRQGDDVWxxxxxxxxxxxxxxxxxxxxxxxxxxxxxxxxDNSNWSGYSGSFTLPVGLxxxxxxxPCFWVEMI
RGRPEExTVWTSSSSIVMCGVNYxxxDWSWHDGAVLPFxxxxxxx
>Protein:NA|Subtype:N8|Blocksize:11|String:4
xxxxxxxxxxxxxxxxxxxxxxxxxxxxxxxxxxxxxxxxxxxxxxx

FIG. 76-285

>Protein:NA|Subtype:N9|Blocksize:11|String:2
MNPNQKILCASATAIxxxxxxxxxxxVNLGLNIGLHLRPxxxxxxxxxxxxxxxxxxxxxxxxxxxxxxxxxxxxxxxxxxxxxxFNNLTRELCTINSWHIYG
KDNAIRIGENSDVLVTREPYVSCEPDECRFYALSQGTTIRGRHSNGTIHDRSQYRSLISWPLSSPPTVYNTRIECIGWSSTSCHDGKSRM
SICVSGPNNNASAVVWYNxRPVAEINTWARNILRTQESECVCHSGICPVVFTDGSATGPADTRIYYFxxxxxxxxxxLAGTAKHIEECSSYx
xxxxVTCTCRDNWQGSNRPVIRIDPxVMTHTSQYICSPILTDNPRPNDPTIGKCNDPYPGNNBNGVKGFSYLNGxNTWLGRTISIASRSG
YEMLKVPNALTDNRSKPxQGQTVVLNTDWSGYSGSFIDYWAKGECYRACFYVELIRGRPKEEKVWWTSNSIVxxCSSTEFLGQWDW
PDGAKIEYFx
>Protein:NA|Subtype:N9|Blocksize:11|String:3
MNPNQKILFASATAIxxxxxxxxxxxANLGLNVGLHLKPxxxxxxxxxxxxxxxxxxxxxxxxxxxxxxxxxxxxxxxxxxxxxxxFNNLTRGLCTINSWHIFG
KDNAIRIGEDSDILVTREPYVSCDPNECRFYALSQGxxxxxxxxxxxIHDRSQYRALVSWPLSSPPTVYNNKVECIGWSSTSCHDGKARMS
VCISGPNNNASAIVWYNxRPITEINTWARNIxRTEESECVCHNGICPVVFTDGSATGPAETRIYYFxxxxxxxxxxLNGTAKHIEECSCYGVx
xxIICTCRDNWQGSNRPVIQINPxMMTHTSQYICSxxLTDNPRPNDPNVGKCNEPYPGNNNNGVKGFAYLDGxNTWLGRTLNTASRSG
YEMLKVPNALTNDRSKPxQGQTIVLTTDWSGYSGSFVDYWAEGDCYRACFYVELIRGRPKEDRVWWTSNSIVSxxxxxxxLGQWNWP
DGAEIEYFL
>Protein:NA|Subtype:N9|Blocksize:11|String:4
MNPNQRILCTSATxxxxxxxxxxxxxTNLGLNIGLHLxxxxxxxxxxxxxxxxxxxxxxxxxxxxxxxxxxxxxxxxxxxxxxxxFNNLTKRLCTINSWHIYGK
DNAVRIGENSGVLVTREPYVSCDPDGCRFYALSQGTxxxxxxxxxxxxxxSQYRALISWPQSSPPTVYNSxxxxxxWSSTSCHDGKFRMSxxx
SGPNNNASTVIxxxxRPTTEINTWARNIxxxQESECVCHNGICPVAFTDGSATGPADTRVYYFxxxxxxxxxxxxGTATHIEECSCxxxxxxxxxx
xxxxxxxxxxxxxxxxxxTMTHTSQYICSxxLTDNPRPNDPVxxKCNDPYPGSNNNGVKGFSYLNxxNTWLGRTTSTASRSGYEVLRVPNALT
DDKSKPxQGQIIVLNTDWxxYSGSFIDYWAEGxxxxxxxxxxLIRGRPKEDEVWWTSNSIVSxxxxxxxxxxWNWPDGAKIETLx
>Protein:NA|Subtype:N9|Blocksize:11|String:5
xxPNQKILCTSAIAIxxxxxxxxxxxxxxxxxxxxxxxxxxxxxxxxxxxxxxxxxxxxxxxxxxxxxxxxxxxxxxxxxxxxFNNLTKGLCIINSWHIYGKDNAI
RIGGNSDVLVTRxxxxxxxxxxxxxxxxxxxxxxxxxxxxxxxxxxxxxxxxxxxxxxxxxxxxxxxxxxxxxxxxxxxWSSTSCHDGKTRMSxxxxGPNNNASAIIWY
NxxxxxxxxxxxxxxxxxQESECVCHDGVCPVVFTDGxxxxxxxxxxxxxxxxxxxxxxxxxxxxARHIEECSCYGDxxxxxxxxxxxxxxxxxxxxxxxxxAM
KHTSQYICSPVLTDNPRPNDPSxxxCNDPYPGNNNKGVKGxxxxxxxxxxxGRTISTASRAGYEMLKVPNALTDDKSxxxxGQTIVLDTDWS
GYSGSFIDYWAKEECYRACFYVExxxxxxxxDKVWWTSNSIISMCSSTEFLGxxDWPDGAKIKYFL
>Protein:NA|Subtype:N9|Blocksize:11|String:6
xxxSQKILCTSATALxxxxxxxxxxxxxxxxxxxxxxxxxxxxxxxxxxxxxxxxxxxxxxxxxxxxxxxxxxxxxxxxxxxxxxxxxxxxxNNLTRGLCKINSWHIFGKDNA
VRIGESSDVLVTxxxxxxxxxxxxxxxxxxxxxxxxxxxxxxxxxxxxxxxxxxxxxxxxxxxxxxxxxxxxxxxxxxxxxxxxxxxxxxxxxxPNNNASPVIWYxxxxx
xxxxxxxxxxxxxQESECVCQNGVCPVVFTxxxxxxxxxxxxxxxxxxxxxxxxxxxxxxxKHIEECSCYGKxxxxxxxxxxxxxxxxxxxxxxxxxxxxxxxxxx
xxxxxxxxxxxxxxxxxCNDPYPGNNNGVKGFSxxxxxxxxxxGRTINTASRSGYEILKVPNALTDERSKPxxxxxxVSNTDWSGYSGSxxDYWA
KGDCYRACFYVxxxxxxxxxxxxxxxxxxxxxxxxxxxxxxxxxxxxxxxxxxxx
>Protein:NA|Subtype:N9|Blocksize:11|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxNLTKELCTINSWHIHGKDxxxxIG
EKSDVLVTREPYxxxxxxxxxxxxxxxxxxxxxxxxxxxxxxxxxxxxxxxxxxxxxxxxxxxxxxxxxxxxxxxxxxxxxxxxxxxxxxxxxxxNNNASAVIWYKxxxxxxx

FIG. 76-286 xxxxxxxxxxxVCHSGVCPVVFTDxxxxxxxxxxxxxxxxxxxxxxxxxxxxxxxxxxxxxxxxxxxxxxxxxxxxxxxxx
xxxxxxxxxxxxGNSNNGVKGFSYLDExxxxxRTISTASRYGYEMLKVPNALIDDRSKxxxxxxxxxxxxxxxxxxxxxxxxxxxxxxxxxxxxxxxxxxxxxxxxxxxx
xxxxxxxxxxxxxxxxxxxxxxxxxxxxxxxxxxxx
>Protein:NA|Subtype:N9|Blocksize:11|String:8
xxxxxxxxxxxxx

FIG. 76-287 xxxxxSIESEFNEIEYQIGNVINWTKxxxxxIWTYQEELLVAMENQHTIDMADSTMLNLYERVRKxxxxxxxxxxxxxxxxxxxxxxxxxxSCMERIRNN
TYDHAQYREEALLNRLSINPVxLFSGYKDIILWFSFGASSxxxxxxxxxxxxxxxxxxxxxxxxxxxxxxxxx
>Protein:HA|Subtype:H10|Blocksize:11

FIG. 76-288

>Protein:HA|Subtype:H10N7|Blocksize:11|String:1
xxxxxxxxxxxxxxxGLDKICLGHHAVSNGTIVKTLTNEKEEVTNATETVESKxxxxxxxxxxxxKDLGNCHPIGMxxGTPACDLHLTGTWDTLI
ERDNxxAYCYPGATVNEEALRQKIMESGGIDKISTxxxxxxxxxxxxxxxxxxxxGGNSFYAELKWLVSKSKGQNFPQTTNTYRNTDSxEHLII
WGIHHPSSTQEKNDLYGTQSLSISVGSSTYQNNFVPVVGARPQVNGQSGRIDFHWTxVQPGDNITFSHNGGLIAPSRVSKLxxxxxxxxxx
xxxxxxCESKCFWKGGSINTKLPFQNLSPRTVGQCPKYVNKKSLLLATGMRNVPEVxQGRGLFGAIAGFIENGWEGMVDGWYGFRHQ
NAQGTGQAADYKSTQAAIDQITGKLNRLIEKTNTEFESIESEFSEIEHQIGNVINWTKDSITDIWTYQAELLVAMENQHTIDMADSEML
NLYERVRKQLRQNAEEDGKGCFEIYHKCxDNCMESIRNNTYDHTQYREEALLNRLNINPVKLSSGYKDVILWFSFGASCFVLLAVIMG
LVFFCLKNGNMRCTICI
>Protein:HA|Subtype:H10N7|Blocksize:11|String:2
xxxxxxxxxxxxxxxGIDKICLGHHAVPNGTIVKTLTSEKEKVTNATETVESTxxxxxxxxxxxxKDLGSCHPIGMxxGTPVCDPHLTGTWDTLIE
RENxxAHCYPGATINEEALRQKIMESGGISKISTxxxxxxxxxxxxxxxxxxxxGGDSFYAELKWLVSKTKGQNFPQTANTYRNTDSxEHLIVW
GIHHPSSTKEKNDLYGTQPLSISVGSSTYHNSFVPVVGARPQVNGQSGRINFHWTxVRPGDNITFSHNGGLVAPSRVSKxxxxxxxxxxxxx
xxxxCESKCFWRGGSINTKLPFxxxxxRTVGQCPKYVSKRSLLLATGMRNVPEIxQERGLFGAIAGFLENGWEGMVDxxxxxxxxxAQGTG
QAADYESTQAAIDQITxxxxxxxxxxxTEFESIESEFNEIEHQIGNVIxxxxxxxxDIWTYNAELLVAMENQHTIDLADSEMLNLYDRVRKQLR
QNAEEDGRGCFEIYHKCxDSCMESIRNNTYDHAQYREEALLNRLSINPVKLSSGYKDIILWFSFGASCFILLAVVMGLVFFCLKNxxxxx
xxxx
>Protein:HA|Subtype:H10N7|Blocksize:11|String:3
xxxxxxxxxxxxxxxGLDRICLGHHAVANGTIIKTLTNEKEEVINATETVExxxxxxxxxxxxxxxKDLDNCHPIGMxxGTPACDLYLTGTWDTLIE
RGSxxAYCYPGTTVNEEALRQKIMESGGISKMSTxxxxxxxxxxxxxxxxxxxxGKNSFYAELKWLISKSKEQNFPRTTNTYRNTDSxEHLITW
GIHHPSSAQEKNDLYGAQSLSISVESSTYQNNFVPVIGARxxxxGQSGRIDFHWAxIQPGDNITFSHNGGLIAPDRVSKLxxxxxxxxxxxxxx
xxxxSKCFWKGGSIKTKLPFQNLSPxTVGQCPKYVNQKSLMLATGMRNVPETxxxRGLFGAKAGFIENGWEGMVNGxxxxxxxxxxxxGQ
AADYKSTQKTIDQVTGKLNRLIEKxxxxFESIESEFSETEHQIGNVINWxxxxxxxIWTYQAELLIAMENQHTIDMADSTMLNLYERVRKxx
xxxxxxDGKGCFEIYHACxNNCMESIRNNTYDHSQYREEALLNRLNINSVKLSSGYKDIILWFSFGESCFVLLAVIMGLVFFCLRNGNMR
CTICI
>Protein:HA|Subtype:H10N7|Blocksize:11|String:4
xxxxxxxxxxxxxxxSLDKICLGHHAVANGTVxxxxxxEQEEVTNATETVENKxxxxxxxxxxxxKDLGNCHPVGMxxGAPACDLHLTGMWDTL
IERDxxxAYCYPGSTVNEEALRQKIMESGGIDKVSTxxxxxxxxxxxxxxxxxxxxGENSFYAELKWLVSKNKGQSFPQTTNTYRNTDTxEHLI
MWGIHHPSSTKEKNELYGTQSLSISIGSSTYQNNFVxxxxxxxxxxxxxxxxxxxxxxVQPGDNITFLHNGGLIAPSRVTKLxxxxxxxxxxxxxxxxx
xxxCFWRGGSINTRLPFQNLSPRTVGQCPKYVSQGSLLLATGMRNxxxxxxxxxxxxxxxxxxxxxxxxxxxxxxxxxxxxxxxxxxxQAADYKSTQATI
DQITGKLNxxxxxxxxxxxSIESEFNEIEYQIGNVINWTKxxxxxxxxxxxxxxxxxxxxxxxxxMADSEMLNLYDxxxxxxxxxxxxDGKGCFEIYHTCx
DNCMERIRNNTYDHTQxxxxxLLNRLNINPVTLSSGYKDIILxxxFGASCFVLLAAIMGLFFFCLKNGNMRxxxxx
>Protein:HA|Subtype:H10N7|Blocksize:11|String:5
xxxxxxxxxxxxxxxxDKICLGHHAVTNGTIVKTLTNEQExVTNATETVESRxxxxxxxxxxxxRDLGNCHPIGMxxGAPSCDLHLTGIWDTLIE
RDNxxANCYPGATVNEGALRQKIMESGGIDKIGTxxxxxxxxxxxxxxxxxxxxxRNSFYAELKWLVSKDKGRNFPQTTNTYRNTDPxEHIIM
WGIHHPSSTQERNDLYGTQSLSISVESSTYQNSFVPVVGARxxxxxxxxxxxxxxxxVQPGDNITFSDNGGLIAPxxxxxxxxxxxxxxxxxxxxxxxxx

FIG. 76-289 xxxxxxxxxxxxxxxxxxxxxxxxxxxxxxxxxxxxxxxxxxxRSLMLATGMRNxxxxxxxxxxxxxxxxxxxxxxxxxxxxxxxxxxxxxxxxxxxxxxxxxxxxxxxxAADYKSTQAAVDQITGKL
NRLxxxxxxxxxxxxxxxxxxxxxxxxxxxxxxxxxxxxxxxxxxxxxxxxxxxxxxxADSEMLNLYEGVxxxxxxxxxxDGKGCFEIYHNCxDNCMESIRDN
TYDHTxxxxxLLSRLNINPVKLSSGYKNVILWFSFGASCFVLLAIIVGLVFFCLKNGxxxxxxxx
>Protein:HA|Subtype:H10N7|Blocksize:11|String:6
xxxxxxxxxxxxxxxxxxxxxxxxxxxxxxxxxxKICLGHHAIPNGTIVKTLTNEREEVTNATETVxxxxxxxxxxxxxxxxxxxxxxxxxxxxxxxxxxxxxLHLTGKWDTLIERENxxx
xxxxxxxxxxxxxxxxxxxxxxxxxxxxxxxxxxxxxxxxxxxxxxxxxxxxxxxxxxxxxxxxxxxxxxxxxxxxxxHLVMWGIHHPSSTQ

FIG. 76-290

NTWLGRTISPRSRSGFEMLKVxxxxxxxxxxxxxxxxxxxxNSDWSGYSGSFIDYWDDxSVCYNPCFYVELxxxxxxxxxxxxxxxxxNSLVALCGSPV
SVGSGSFPDGARIQYFx
>Protein:NA|Subtype:H10N7|Blocksize:11

FIG. 76-291

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxYNRRLTTIKTWxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
>Protein:HA|Subtype:H11|Blocksize:11|String:1
xxxxxxxxxxxQADEICIGY

FIG. 76-292 xxxxxxxxxxADEICIGHLSNNSTDKVNTIIENNVTVTNSVLVExxHTGTFCSINGKAPISLGDCSFTGWILGNPMCDNLIGKTSWSY
IVEKLNPxxxxxxxxxxxxxxxxxxxxxxxxxxxxxxxxxxxxxxxxxxxxxxxxxxxxxxxxxxxxxxxxxxxxxxxxxxxxxxxxxxxxxxxNVHR
xxxxxxxxxxxxxxxxxxxxxxxxQAGRMTFYWTMxxxxxxTFESNGVFLAPRYxxxxxxxxxxxxxxxxxxxxxxxxxxxxxxxxxxxxxxxxxx
NTIGNCPKYVNxKSLKLAIGPRNVPAxxxxxxxxxxxxxxxxxxxxxxxxxxNEEGTGIAADRExxxxxxxxxxxxxxxxxxxxxxxxxxxxxxxx
xxxxxxxxxxxxxxIWSYNAKLLVLLENxxxxxxHDSNVRNLHERxxxxLQDNAKDEGNGCFTFYHKCDDECIEKVRNGTYDHKDFEEESR
INRQEIEGVR

FIG. 76-293

ANVRNLHERIRRxxxENAIDAGDGCFEILHKCNDxxxxxxxxxxxxxxxxYEEESKLERQKVNGVKLEENSTxxxxxxSSVASSLVLLFMIIGGF
IFGCQNGNIRCTFCI
>Protein:HA|Subtype:H12|Blocksize:11|String

FIG. 76-294

>Protein:HA|Subtype:H13|Bl

FIG. 76-295

ERNALGNCPKYIKSGQLKLATGLRNVPTxxxxxxxxxxxxxxxxxxxxxxxxxQNEQGTGIAAEKESTQKAIDQxxxxxxxxxxxxxxxxxSIR
GEFNQVEQRINMLAxxxxxxxxxxxxxxxxxxxxxxxxxxDANVRNLHDQIRxxxxxxxxxxxxxxxxxxxxxxxxxxxxxxxxxxKRQE
IEGIKLESEDNVYRALSIYSCIASxxVLVGLILTFIMWACNSGNCRFxxxx
>Protein:HA|Subtype:H13|Blocksize:11|String:6
xxxxxxxxxxxxxxxxxxxxxxxxxxYLSTNSSEKVNTLLENDVPVTxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxKLATGLR
NVPSxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxFIMWACSNGNC
RFxxxx
>Protein:HA|Subtype:H14|Blocksize:11|String:1
MIALILVALALSHTAYSQITNGTTGNPIICLGHHAVENGTSVKTLTDNHVEVVSAKELVETNHTDELCPSPLKLVDGQDCDLINGALGS
PGCDRLQDTTWDVFIERPTAVDTCYPFDVPD

FIG. 76-296 xxxxxxVILVLGLSMVRSDKICLGHHAVPNGTKVNTLTEKGVEVVNATETVEITGINKVCTKGKKAVxxxxxxxGTIIGPPQCDSHLKFKA
DLIIERRNSSDICYPGKFTNEEALRQIIRESGGIDKEPMGFRYSGIKTDGATSACKRxxSSFYSEMKWLLSSKANQVFPQLNQTYRNNRK
EPALIVWGxxxxSLDEQNKLYGAGNKLITVGSSKYRQSFSPSPGARxxxxxxxxxxxxxxxxxxTFLRSNAPSGVEYN
GKSLGIQxxxxxxxxxxxxxxxxxxxSPLPFQNIDSWAVGRCPRYVKQSSLxxLGMKNVPEKIHTRGLFGAIAGxxxxxxxxxxxxxxxxxx
xxxxxxxxxxxxxxxxxxxxxxxxxxKLNRLIEKTNTQFELIDNEFTxxxxxxxx

FIG. 76-297

ANVKNLHEQVKRxLKDNAIDEGDGCFSILHKCNDSCMEAIRNGTYNHEDYREESQLKRQEIEGIKLKSEDNVYKVLSIYSCIASSTVLV
GLILAFIMWACSNGSCRFNVCI
>Protcin:HA|Subtypc:H16|Blocksizc:11|String:3
xxxxxxxxxxxxxxxGRYSIADKICIGYLSNNSTDKVDTLTENGVPxxxxxxxxxxxxxxTYCSLNGVSPVHLGDCSFEGWxxxxxxxxxxxxxxxxxx
LIEDPNAPNKFCYPGELDNNGELxxxxxxVNSFSRTELIPPSKWGDVLDGVTASCLDKGAxSFYRNLVWIVKxxxxxxxxVKGDYNNTTGR
xxxxLWGIHHPDTEATANKLYVNKNPYTxxxxxxWSKRYELEIGARIGEGQRSWMKLYWHLMHPGERITFESSGGLLAPRYGYxxxKYG
TGRIFQSRIRMGKCNTKCQTSLGGINTNKTFQNIDRxxxxxxxxxxxxxxxxLATGLRNVPSVxVERGLFGAIAGxxxxxxxxxxxxxxxxxxxxEQ
GTGIAADKVSTQKAINEITxxxxxxxxxxxxxxxxxxxxxxxxVEKRINMLADWVDDAVTDIWSxNAKLLVLLENDRTLDLHDANVRNLHEQIK
RxLKSNAIDEGDGCFSLLHKCNDSCMxxxxxxxxxxEDYREESQLKKQEIEGIKLKTEDNIYKILSIYSCIASSVVLVGLILAFILWACSSGN
CRFSVCI
>Protein:HA|Subtype:H16|Blocksize:11|String:4
xxxxxxxxxxxxxxxGRYSRADKICIGYLSNNSTDTVDTLTETGVPVTSSVDLxxxxxxxTYCSLNGISPVHLGDCSFxxxxxxxxxxxxxxxxxxxxxxx
xEDPNAPNKLCYPGELDNNGxxxxxxxxxxSFSRTELINPNKWGNVLDGVTASCRDNGAxSFYRNLIWLVKxxxxxxxxVRGDYNNTTGRD
xxxLWGIHHPDTEEVAINLYASKNPYTLVSTKxxxxxxxxxxxxxIGDGQRSWMKIYWHLMSPGERIMFESNGGLLAPxxxxxxxxYGTGRIF
QSGIRMARCNTKCQTSLGGVNTNKTFQNIEKNALGDCPKYIxxxxxxxxxxxxxxxxxxNERGLFGAIAGxxxxxxxxxxxxxxxxxxxxxxxxxxxAA
DKVSTQKALNEITTKINNIxxxxxxxxxxxxxxxxxxxxxxxxxxxxxxxxxxxxxxxxxxxxxxLVLLENGRTLGLHDANVRNLHDQIKRxLQNNAIDEGD
GCFNFFHKCNDSCMETxxxxxxxxxxxxxxxxxxxxxxxxxxKLKTEDNVYKILSIYSCIASSIVLVGLILAFIMWACSNGNCRFNVCI
>Protein:HA|Subtype:H16|Blocksize:11|String:5
xxxxxxxxxxxxxxxSRYSKADKICIGYLSNNSTDKIDTLTETGVPVxxxxxxxxxxxxxxxxxxxxxxxxxxxxxxxxxxxxxxxxxxxxxxxxxxxxxxxxxxxxxxEDPN
APHKLCYPGEVDNNGELxxxxxxxxSFSRTELISPNKWGDILDGVTASCRDxxxxSFYRNLIWLVQxxxxxxxxxxxxxxxxxxxxxxxxxWGIHHP
DTEAVATRLYVNKNPYTLxxxxxxxxxxxxxxxxxxxxxxxxxSWMKLYWHLMSPGERTTFESNGGLIAPxxxxxxxxxxxGRIFQSGVRVARCNTK
CQTSVGxxxxxxxxxxxxxxxxxxxxxxxxxxxxxxxxxxxxxxxxxxxSERGLFGAIAGxxxxxxxxxxxxxxxxxxxxxxxxxxxxADKASTQKAINEITxxxxxxxx
xxxxxxxxxxxxxxxxxxxxxxxxxxxxxxxxxxxxxxxxxxxxxxxxxxxxxxxxxxxLHDANVKNLHDQIKRxxxxxxxxxxxxxxxxxxxxxxxxxxxxxxxxxxxxxxxxxxxxxxxxxx
xxxxxxxxxxxKTEDNVYKVLAIYSCIASSIVxxxxxxxxxxxxxxxxxxxxxxxxx
>Protein:HA|Subtype:H16|Blocksize:11|String:6
xxxxxxxxxxxxxxxxxxxxxxxxxxxxxxxxxxxxxxTDKVDTLTETGVPxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxGVTASCLDRGTxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxYWHLMRPGERTxxxxxxxxxxxxxxxxxxxxxxxxxxxxxxxxxxxxxxxxxNTKCQTSMGGVxxxxxxxxxxxxxxxxxxxxxxxxxxxxx
xxxxxxxxxxxxxxxxxDERGLFGAIAGxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxIYSCIASSTVMVGLIL
AFIxxxxxxxxxxxxxxxx
>Protein:HA|Subtype:H1|Blocksize:11|String:1
KQGKTKATKMKAILVVLLxxxxxxxxTAYSQITNGTTGNPIICLGHHxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSNAPSGIEYNGKSLGIQSDAxxxxx

FIG. 76-298 xxxxxxxxxxxTSLTSLPFQNIHPxxxxxxxxxxxxxxxxxxxxxxxxxxRGLFGAIAGFIEGGWTGMVDGWYGYHHxxxxxxxxxxxxxxxxx
xxxxxxxxxxxxxxxxxxxxxxxxxxxxxxxxxxxxxxxxxxxxxxxxxxYNAELLVLLENxxxxxxxxxxxxxxxxxxxxxxxxxxxxxxxxx
xxxxxxxxxxxxxxxxxxxxxxxxxxxxxxxxxxxxxxxxxxxxxxxxxxLCSVEYASKTRISEIxxxxxxxxx >Protein:HA|Subtype:H1|Blocksize:11|String:2

FIG. 76-299 xxxxTSLTSLPFQNIIHPxTIGKCPKYVKSTxLRLATGLRNVPSIQSRGLFGAIAGFIEGGWTGMVDGWYGYHHQNEQGSGYAADLKSTQx
xxxxxNKVNSVIEKMNTQFTAVGKEFxxxxRIENLNKKVDDGFLDIWTYNAELLVLLENERTLDYHDSxxxxxxxxxxNNAKEIGNG
CFEFYHKCDNxCMESVKNGTYDYPKYSEEAxxxxxxxxxxxxxxxYQILAIYSTVASSLVLVVSLGAISFWMCSNGSLQCRICISLQCRICI
RADGxxxxxx
>Protein:HA|Subtype:H1N1|Blocksize:11|String:2
KQGKTKATKMEAILVVLL

FIG. 76-300

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxLKEQLSSVSSFKRFEIFPKxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxNSIIEKMNIQFTxxxxxxxxxxxxxxxxxxxxxx
xxxxxVTGLRNVPSIQxxxxxxxxxxxxxxxxxxxxxxxxxxxxxxxxxxxxxxxxxxxxxxxxxxxxxxxxxxxxxxxxxxxxxxxxxNLNKKVDDGF
IDVWTYNAELLxxxxxxxxxxxxxxxxxxxxxxxxxxxxxxxxxxxxxxxxxxxxxxxxxxxxxxxxxxxxxxxxxxxxxxxxxxxxxxxxxxxASTLV
LLVSLGAIGFWMCSWSLQCRICIxxxxxxxxxxxxxxxxxxx
>Protein:HA|Subtype:H1N1|Blocksize:11|String:7
xxxxxxxxxxxxxxxxxxxxxxxxxxxxxxxxxxxxxxxxxxxxxxx

FIG. 76-301 xxHGSNRPWVSFDxxxxxxVGYICSGVFGDNPRSxxxxxxxxxxxxxxxxxxGFSYKYDNGVWIGRTKSxxxxxxFEIIWDPNGWTxxxxxxxxx
xxxxxTNWSGYSGSFVQHPELTGMDCIxxxxxxxxxxxxxxxxxTIWTSAS

FIG. 76-302

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPFQNVHPVTIGECPKYVRSxxxx
xxxxxxxSIQSRGLFGAIAGFIEGGWTGMIDGWYGYxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxIW
TYNAELLVLLENERTLDFHDSNVxxxxxxxxxxNNAKEIGNGCFEFYHKCNNxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxSFWMCSNGSLQCRIxx
>Protein:HA|Subtype:H

FIG. 76-303 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxVTIGECPKYVKxxxxxxxx
xxxxxxxxxxxxxxxxxxxxxxxxxxxxxxxxxxxxxxNARELGNGCFEFY

FIG. 76-304

>Protein:NA|Subtype:H1N2|Bl

FIG. 76-305 xxxxxxxxxxxxxxxxxxxxxNLERRLENLNKKMEDGFxxVWTYNAELLVLMENERTLDFHDSNVKNLYDKVRMQLRDNAKEIGNGCF
EFYHKCDDECMNSxxxGTYDYPKYEEESKLNRNEIKGxxxxMGVYQILAIYATVAGSLSLAIMIAGISFWMCSNGSLQCRICI
>Protein:HA|Subtype:H2|Blocksize:11|String:2
MDKQTKTMTITFLxxxxxxxGDQICIGY

FIG. 76-306 xxxMENERILDFHDSNVKSLYxKVKMQLRDNAKExxxxxxxxxxxxxxxxxxxxxxxxTYNYSKYEEESxxxxxxxxxxxxxxxxxxxxxxxxxx
xxxxxxxxxxxxxxxxxxxxxxxxx
>Protein:HA|Subtype:H2|Blocksize:11|String:7
xxxxxxx

FIG. 76-307

GALNTTLPFHNIHPLTMGECPKYVKSDRLVLATGLRNVPQMESRGLFGAIAxxxxxxxxxxxDQGSGYAADKASTQKAIxxxx
xxxxxxxxxxxxxxxxxxxxKEFNNLERRLENLSKRMEDGFIDVWTYNAELLVLMENEMTLDFHDSNVRNLYDKVRMQLKDNAKEIGNGCFE
FYHKCDNECMxxxKNGTYYYPKYEEESKLKRNEIKGVKLSNMGIYQILAIYATVAGSLSLAIMVAGISxxMCSNGSLQFRICI
>

FIG. 76-308

```
xxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxKLKRNEIKGVELSSxxxxxxxxxxxxxxxxxxxxxxxxxx
xxxxxxxxxxxxxxxxxxxxxxxxxxxxxxxxxxxxxxxxxxxxxxxxxxxxxxx
>Protein:NA|Subtype:H2N2|Blocksize:11|String:1
MNPNQKIITIGSVSLxxxxxxxQIAILATTVTLHFKQH

FIG. 76-309

CTCRDNWKGSNxxxxDISMEDYSIGSGYVCSGLVGDTPRNDDRSSSSNCRNPNNEKGNHGVKGWAFDxxxxxxxxxxKESRSGYETFK
VxxxxxxxxxxxxxxxxxKNNWSGYSGIFxxxxKSCVNRCFYVELIRGMPQxxxxxxxxxxxxxxxxxxxxxxTGSWPDGANTNFMPI
>Protein:NA|Subtype:H2N2|Blocksize:11|String

FIG. 76-310 xxxHSMSGFRSNLPGxxxxxxxxxxxxxxxxxNNSTATLCLGHHAVPNGTxxxxxxDHIEVTNATELVQNxxxxxxxxxxxxxxxxxCTLMDALL
GDPxxxxxxxxxxxxxxxxxxxxxxxxxxxxxSLRSLIASSGTLxxxxxxxxxxxxxxxxxxxxxxxxxxxxxxxxxxxxxxxxxxxxFDKLYVW
GVHHPxxxxxxxxxxxxxxxxxxxxxxxxxxxxxxxxxxxxxxxxxxxxxxxxxxxxxxxxSNGNLIAPRGYF

FIG. 76-311 xxxxxxxxxxRFSYVFCLALGxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxWYGFRHQNSEGRGQAADLxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxVVLENQHTIDLxxxxxxxxxxxxxxxxxxxxxxxxxxxxENAEDMGNGCLxxxxxxxxxxxxxxxxxxxxxxxxxxxxxxxxxxxxxxxxxxxxxxxxxxxxxxxxxxxxxxxxxxxxxxxxxxxxxxxxxxxxACQKGNIRCSIxx
>Protein:HA|Subtype:H3|Blocksize:11|String:8
xxxxxxxxxxxxxxxxxxxxxxxxxxxxxxxxxxxxxxxxxxxxxxxxxxxxxxx

FIG. 76-312

```
xMKTIIIVLSCIxxxxxxxxxxxxNNSTATLCLGHHAVPNGTLVKTITxDHIEVTNATELVQNxxxxxxxxxxxxxxxxxxCTLMDALLGDPHC
DxxxxxxxxxxxxxxxxxxxxxxxxxxxxxxxxxxxxxxxxxxSLRSLIASSGTLEFxxxxxxxxxxxxxxxxxxxxxxxxxxxxFDKLYVWGVH
HPxxxxxxxxxxxxxxxxxxxxxxxxxxxxxxxxxxxxxxxxSVYWTVVKPGDxxxxSNGNLIAPRGYFRIxxxxxxxxxxxxACITPNGS
IPNEKPFQNVNKITYGACPxYVKQSTLK

FIG. 76-313 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-314

```
xxxxxxxxxxxxxxxxxxxxxxxxxxxxxxxxxxxxxxxxxxxxxxxxxxxxxxxxxxxxxxxxxxxxxxxxIAGFAPFSKDN
SIRLAAGGDIWVTRELYVSCDxGKCYQFALGQGTTLDNxxxxxxRIPHRTLLMNELGVPFHLGTRQVCIAWSSSSCHDGRAWLHVC
VxxxxxxxxxxxxxxxxxxxxxxKILRTQESECVCISGTCAVVMTDGSASGxxxxxxxxxxxxxxxLSGSAQHIEECSCYPRYPNVRCI
CRDNWKGSNRPVVDIxxxxxxSRYVCSGLVGDTPRNxxxxxxxxxxxxxxxxxxxxxxxxxxxxxxxxxxxxxxxxxxxxxxxxxx
xxxxxxWSGYSGIFSVESKSCVNRCFYVELIRGSxxxxxVWWTSNSIVVFCGTSGTYGSGSWPDGADINLMPIYSxxx
>Protein:NA|Subtype:H3N2|Blocksize:11

FIG. 76-315

>Protein:NA|Subtype:H3N2|Blocksize:11|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxTVVMTDGSASDxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxx
>Protein:HA|Subtype:H4|Blocksize:11|String:1
xxxxxxxxxxxxxxxxxxYTGNPVICLGHHAVxxxxxxxxxxxxxxIEVVTAQELVESxxxxxxxxxxxxxxxxxxCDIVNGALGSPGCDHLxxxxxxxxxx
xxxxxxxCYPFDVPDYQSLRSILANNGKFEFIAEEFxxxTVKQNGKSGACKRANxxxxxxxxxxxxxxxxxxxxxxQNLTKVNNGDYARLYIWGV
HHPSTDTEQxxxxxxxxxxxxxxxxxxxxxxxxxxxxxxxxxVRGQSGRISFYWTIVEPGDLIVFNTIGNLIAPRGHYKLxxxxxxxxxxxxxxxxxxxxxxxxx
xxxxxxxxxxxxxxxxxxGDCPKYVKQGSLKLATGMRNIPEKxxRGLFGAIAGFIENGWQGLIDGWYGFRHQNAEGTGTAADLKSTQAAID
QINGKLNRLIEKTNEKYHQIEKEFEQVEGRIQDLEKYVEDTKIDLWSYNAELLVALENQHTIDVTDSEMNKLFERVRRQLRENAEDKG
NGCFEIFHQCDNNCIESIRNGTYDHDxYRDEAINNRFQIQGVKLTQGYKDIILWISFSISCFLLVALxxxxALLLAFILWACQNGNIRCQICI
>Protein:HA|Subtype:H4|Blocksize:11|String:2
xxxxxxxxxxxxxxxxxxYTGNPVICMGHHAVxxxxxxxxxxxxxxVEVVTAQELVEAxxxxxxxxxxxxxxxxxxxCDIINGALGSPGCDRLxxxxxxxxxx
xxxxxxxCYPFDVPEYQSLRSILANNGRFEFIAEEFxxxTVKQNGKSSACKRANxxxxxxxxxxxxxxxxxxxxxxQNLTKINNGDYTRLYIWGVH
HPSTDKEQxxxxxxxxxxxxxxxxxxxxxxxxxxxxxxxxxVRGQSGRVSFYWTIVEPGNLIVFNTIGNLVAPRGHYKLxxxxxxxxxxxxxxxxxxxxxxxxx
xxxxxxxxxxxxxxxxxxxGDCPKYIKQGSLKLATGMRNIPERxxKGLFGAIAGFIxxxxxxxxDGWYGFRHQNSEGTGTAADLKSTQTAIDQIN
GKLNRLIERTNEKYHQIEKEFGQVEGRIQDLERYVEDTKIDLWxxxxxxxVALENQHTIDMTDSEMNRLFERVRRQLRENAEDRGNGCF
EIFHKCDNSCIESIRNGTYNHDxYRDEAISNRFQIQGVRLTQGYKDIILWVSFSISCFLLVxxxxxxALLIAFVLWACQNGNLRCQICI
>Protein:HA|Subtype:H4|Blocksize:11|String:3
xxxxxxxxxxxxxxxxxxYTENPVICLGHHAxxxxxxxxxxxxxxxIEVVAAQELVESxxxxxxxxxxxxxxxxxxCDIVNSALGSPGCDHLxxxxxxxxxxx
xxxxxxCYPFDVPNYQSLRSILANNGKFEFIVEKFxxxTVKQDGKSSACKRANxxxxxxxxxxxxxxxxxxxxxxQNLTKVNSGDYARLYIWGVH
HPSTDAEQxxxxxxxxxxxxxxxxxxxxxxxxxxxxxxxxxVRSQSGRISFYWTIVDPGDIIVFNTIGNLIAPRGHYRLxxxxxxxxxxxxxxxxxxxxxxxxxxx
xxxxxxxxxxxxxxxxGECPKYVKQGSLRLATGMRNIPExxxxxxxxxxxxxxxxxxxxxxxxxxxxxxxxxxxxxxxxxxxDLKSTQAAIDKINGKLNRLIEKT
NDKYHQIEKEFEQVEGRTQDLENYVEDTKIxxxxxxxxxxxALENQHIIDVTDSEMNKLFERIRHQLRENAEDKGNGCFEIFHKCDNKCIE
SIRNGTYDHNxYRNEAINNRFQIQGIKLTQGYKDVILWISFSISCFLLAALxxxxALLLAFVLWACQNGNVRCQICI
>Protein:HA|Subtype:H4|Blocksize:11|String:4
xxxxxxxxxxxxxxxxxxYIGNPVICMGHxxxxxxxxxxxxxxxxxxVEVVAAQELVExxxxxxxxxxxxxxxxxxxxCDIVNAALGSPGCDHLxxxxxxxxxxx
xxxxxxCYPFDVPGYQSLRSILANNGKLEFIAEEFxxxTIKQNGKSGACKRADxxxxxxxxxxxxxxxxxxxxxxQNLTKVNNGNYARLYIWGVH
HPSTSTxxxxxxxxxxxxxxxxxxxxxxxxxxxxxxxxxxxVRGLSSRISFYWTIVEPEDLILFNTIGNLIAPxxxxxxxxxxxxxxxxxxxxxxxxxxxxxxxxxxxxxx
xxxxxxxxxxxxxxGDCPRYVKQGSLKLAxxxxxxxxxxxxxxxxxxxxxxxxxxxxxxxxxxxxxxxxxxxxxxxxxxxxxxxxLKSTQAAINQINGKLNRLxxxxxxxxxx
xxxEFEQVEGRIQYLEKYVEDTKIxxxxxxxxxxxxxxxNQHTIDVADSEMNKLFERVRHQLRENAEDKGNGCFEIFHRCDNTCIESIRNGTYN
HNxYRDEAINSRFQIQGVKLAQGYKDIILWFSFSISCFLLVxxxxxxALLLAFMLWACQTGNIRCQxxx
>Protein:HA|Subtype:H4|Blocksize:11|String:5

FIG. 76-316 xxxxxxxxxxxxxxxxxxxHTGNPVICLGHHSVxxxxxxxxxxxVEVITAQELVESxxxxxxxxxxxxxxxxxxxxxxxxxxxxxxxxxxxxxxxxxxxxxxxxxxxxxxxxxxxxx
xxxxxxVPDYQSIRSILANN

FIG. 76-317 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSISCFLLVALFLxxxxxxxxxxxxxxxxxx
>Protein:HA|Subtype:H4|Blocksize:11|String:11
xxxxxxxxxxxxxxxxxxxxxxxxxxxxxxx

FIG. 76-318 xxxxxxxxxxxxxxxxxxxxxxxxxxxxxxxxxxxxxxxxxxxxxxxxGVWTYNAELLVxxxxRTLDFHDSNVRNLYDKVRLQLKDNARELGNGCFEFYH
KCNNxxxxxxxxxxxxxxx

FIG. 76-319

```
xxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxx
>Protein:HA|Subtype:H5|

FIG. 76-320 xxxxxxxxxxxxTYVSVGTSTLNQRSxxxxxxxxxxxxxxxxxxxxxxxxxxxxxxxxxxSFESNGNFIAPEYAYIVxxxxxxxxxxxxxxxxxxxxx
GAINSSMPFHNVHPLTIGKCPKYVKSNxxxxxxxxxxxxxxxxxxxxxRKRGLFGAIAGAGFIEGGWQGMIDGWYGYHHSNEQGSGYAADQE
STQKAIDGITNKINSIIDKMNTQFETVGKEFxxLERRIESLNKKMEDGFLDIxxxxxxxxxxxxxxxFHDSNVKNLYEKVRLQLRDNAxxxx
NGCFEFYHKCNNxxxxxxxxxxxxxxx

FIG. 76-321 xxxxxxxxxxxxxxxxxxxxxxxxxxxxxxxxxxxxxxxxxxxxxxxxxxxxxxxxxxxxxxxxxxxxxxxxxCIGYHANNSTVxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx >Protein:NA|Subtype:H5N1|Blocks

FIG. 76-322 xxxxxEIKMNPNQKIMTxxxxxxxxxxxxxxxxxxxxxxxxxxxxxxxxxxxxxxxxxxxxxxxxxxxxxxxxxxNQNSTWVSQTYxxxxxxxxxxxxxxxxx
xxxxxxxxHSKDNGIRIGSRGDVFIxxAPFISCSYLECRTFLTHGALLNDKHSNGTAKDRSPQRTLMSCPxGESPSYNSRFxxxxWSAS
ACHDGASWLIIGISGPDNxxxxxxxx

FIG. 76-323 xxxxxxxxxxxxxxxxxxxxxxxVWTYNAELFVLMENERTLDLHDSNVKNLYDxxxxxxDNARELGNGCFEFYHRCDxECMESVKNGTYxxxxx
xxxxxxxxxxxxxxxxxxxxxxxxILSIYSTVVSSLxLAIMVAGLSFW

FIG. 76-324

NERTLDFHDSNVRxxxxxxxxxxxxxxxxxxxxxxxxxxxxxxxxxxxxxxxxxxxxxxxxxxxxxxxxxxxxxxxxxxxxxxxxxxxx
xxxxxxxx
>Protein:HA|Subtype:H5N2|Blocksize:11|String:8
xxxxxxx

FIG. 76-325

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxKPQCEITGFAPFxxxxxxxxxx
xxWVTREPYVSCGxxxxxxxxxxxxxxxxxxxxxxxxxxxxxxxSHRTLLMNELGIPFHLGTKQVCMAWSSSSCHDGNAWLHVCVTGHDxxxxxxxxx
xxxxxxxxxSSPQNILRTQESECVCISxxCAVVMTDGNASxxxxxxxxxxxxxxxxxxxxxxxSAQHIEGCSCYxxxxxVRCICRDNWKGSNRxxxxx
xxxxxxx

FIG. 76-326 xxxxxxxxxDGFLNVWTYNAELLVLLEDERTLDMHDANVxxxxxxxxLRDNAKDLGNGCFEFWHRxxxxxxxxxxxxxxxxxxxxxxxxxxxxxxxxxxxxxxxxxxxx
xxxxxxxxxDVYQILAIYSTISSSLVLMxxxxxxxWMCSNGSMQCKxxxxx
>Protein:HA|Sub

FIG. 76-327 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxAEMLVLLENERxxxx
xxxxxxxxxxxxxxxxxxxxxxxxxxxxxxxxxxxxxxxxxxxxxx
>Protein:HA|Subtype:H7|Bl

FIG. 76-328 xKSRGYKMNTKIL xxxxxxxxxxxxxxxxxxxxxxxLTGRGIEVVNATETVENxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxNGAFIAPDRATFxxxxxxxxxxxxxxxxxxxxxxxxxxxxxxxxxxxxxxx
xxxxxxSILLATGMRNVxxxxxxxxxxxxxxxxxxxxxxRKTRGLFGAIAGxxxxxxxxxxxxxxEGLIDGWY

FIG. 76-329 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxTKPRPRRGLFGAIAGFIExxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx >Protein:HA|Subtype:H7N2|Blocksize:11|String:1
SKSRGYKMNTQIL

FIG. 76-330

IEKTNQQFELIDSEFSEIEQQIGNVINWTRDSITEVWSYNAELxxAMENQHTIDLTDSEMSKLYGRVKRQLRENAEEDxxxCFEIFHKCDD
DCMASIRNNTYDHSRYREEAMQNRIQIDQVKLSSGYKDIxxxxxxGASCFLLLAIVMGLVFICVKNGNMRCTxxxxxxxxx
>Protein:HA|Subtype:H7N2|Blocksize:11|String:5
xxxxxxxxxxxxxxxxxxxxxxARGDKICLGHHAxxxxxxxxxxxxxxxxVVNATETVETVxxxxxxxxxxxxxxxxxCGLLGTVTGPPHCDQFLEFxxDL
IIERREGSDxxxxxxxxxxxxLRQVLRRSGGIxxxxxxxxxxxxxxxxxxxxxxRLGPSFYAEMKWLLSSTDNxxxxxxxxxxxxxxxxxxxxxxxxxxxxxxx
xxTKLYGNGNKLIxxxxxxxxxxxxxxxxARRIDFNWLLLDxxxxxxxxxxDTITFSFNGAFIAxxxxxxxxxxxxxxxxxxxxxxxxxxxxxxxxGGTIASNL
PFQxxxxxAVGKCPKYVKQESLMLATGMRNVPENPKxxxxxxxxxxxxxxxxxxxxxxxxxxxxxxxxxxxxxxxxxxxxxxxxxxxxxxxxxxxKLNHLIGKTNQQ
FGLIDNEFSEIEQQIGxxINWTRDAMTEVWSYNxxxxxxxxxQHIIDLADSEMSKLYERVRxxxxxxxxxxxxxxxxxxxxxxxxxxxxSIRNNTYDHT
KYRTESLQNRIQIDSVKLSSGYKDVILWFSFGASCFILLAIVMGLVFICMKNGNMQCTICxxxxxxx
>Protein:HA|Subtype:H7N2|Blocksize:11|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxIGPPHCDQFLExxxxxxxxxxxxxxxxx
xxxxxxxxxxxxxxxxxxxxxxxxxxxxxxxxxxxxxxxxxxxxxSDSSFYAEMKWxxxxxxxxxxxxxxxxxxxxxxxxxxxxxxxxxxxxxxxxxxxxxxxxxxxxxxxxxxxxxxxxxx
xxxxxxxxxxxxPQVNGQFGRIDFHWLMLNxxxxxxFTFNGAFIAPNRxxxxxxxxxxxxxxxxxxxxxxxxxxxxxxxxIVSSLPFQNISxxxxxxxxxxVKQ
KSILLATGMRNIPEKPKxxxxxxxxxxxxxxxxxxxxxxxxxxxxxxxxxxxxxxxxxxxxxxxxxxxxxxxxxxxxxxLIGRTNQQFELIxNEFTEIEQQIGNVIxxxxxx
xxxxxxxxxxxxxxxxxxxxIDLTDSEMNKLYERVKRQLRENAxxxxxxxxxxxxxxxxxxxxxxxxxxxxxxxTYREEAMQNRLKIDPVKLSSGYKDVx
xxxxxxxxxxxxxxxAMGLVFICVKNETCSALFVYSLRxxx
>Protein:HA|Subtype:H7N2|Blocksize:11|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxQSGRIDFHWLMLxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxTNKQFELIDNExxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxYRKEAMQNRIQIDxxxxxxxxxxxxxxxxxxxxxxxxxxxAMGLVFICMKNxx
xxCSALFVYSLRK
>Protein:HA|Subtype:H7N2|Blocksize:11|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxQSGRIDFHWLILNxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxRTGSLQNRIQIDQVKxxxxxxxxxxxxxxxxxxxxxxxxxxxxxVFICIKNGNMRCTI
Cxxxxxxx
>Protein:HA|Subtype:H7N2|Blocksize:11|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxQSGRIDFHWLVLNxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-331 xxxxxxxxxxxxxxxxxxxxxxxxxxxxxxxxxxxxxxxxxxxxxxxxxxxxxAESLQNRIQIDQxxxxxxxxxxxxxxxxxxxxxxxxxxxxxxxxxxxxxxxxxxx
xxxxx
>Protein:HA|Subtype:H7N2|Blocksize:11|String:10
xxxxxxxxxxxxxxxxxxxxx

FIG. 76-332

YETFKVIGGWTIANSKSxxxxxxxVDNSNWSGYSGIFSxxxKRCINRCFYVELIRGRPQENRVWWTSNSIVVFWGTSGTYGTGSWPDGAN
IDFVxx
>Protein:NA|Subtype:H7N2|Blocksize:11|String:4
xxxxxxxITIGSVSLTITTxxxxxxxxxxxxxxxxxxxxxxxxxxxxxxxxxxxxxxxxxxxEKNITKIVYLNSTxxxxxxxxxxxYRIWSKPQCQIxxxxxxxxDNSIR
LSAGGNIWITREPYVSxxxDKCYQFALGQGTTLNNKHSNGTxHDRISHRTLLMNELxxxxxxxxxxxxxxxxxxxxxxxWLHVCVTGDDKN
ATASFIYxxxxxxxxxxxxxxxxxxxxxxSECVCINGTCAVVMTDGSASRKADTxxxxxxEGKISHISPLSGSAQxxxxxxxxxxxxxxxxKCVCRDNWKGS
NRPVIDVNMxxxxIDSSYLCSGLVxDTPRNEDSSSNSNCxDPNNEKGNPGVKGWAFDYGSDVWMGRTISMDSRSGYETFRVIDGWTTA
NSKSxxxxxxxVDNNSWSGYSGIFSVxxKNCINRCFYVELxxxxPQETRVWWTSSSIVVFCGTSRTxxxGSWPDGANINLMxx
>Protein:NA|Subtype:H7N2|Blocksize:11|String:5
xxxxxxxxTIGSVSLTIAIxxxxxxxxxxxxxxxxxxxxxxxxxxxxxxxxxxxxxxxxxxxxxERNVTETLYLNHTxxxxxxxxxxxYKSWSKPQCQIxxxxxxxxxNS
VRLSAGGDIWVTREPYVSCSxNRCYQFALGQGTTLDNEHSNGTIHDRIPHRTLLMSELxxxxxxxxxxxxxxxxxxxxxxxxxWLHVCVTGDD
GNATxxxxxxxxxxxxxxxxxxxxxxxxxxxxSECVCINGSCIVVMTDGSASGxxxxxxxxxEGKVVHISPLSGSAxxxxxxxxxxxxxxxxxxxxxxxxxxxxxxxxx
xxxxxxxxxxDSGYVCSGLVGDTPRNDDSSSNSNCxDPNEERGSPGVKGWAFDSEDDVWMGRTISMxxxxxYETFRVIGGWATANSKSxxx
xxxxVNNNNWSGYSGVFSVExxxxxxxxxxxxxxxxxPQETKVWWTSNSIVVFCGTSATYxxxxxxxxxxxxxxxxxx
>Protein:NA|Subtype:H7N2|Blocksize:11|String:6
xxxxxxxxTIGSVSLTIAAxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xWVTREPYVSCGxxxxxxxxxxxxxxxxNEHSNGTTHDRIxxxxxxxxxxxxxxxxxxxxxxxxxxxxxxxxxxxxxxxxxxxxxxxxxxxxxxxxxxxxxxxxxxxxxxxxxxx
xxxxxxxxxxxxxGSCTVVMTDGNASGKADTxxxxxxxxxxVHISSLSGSAQxxxxxxxxxxxxxxxxxxxxxxxxxxxxxxxxxxxxxxxxxxxxSSYMCSGLVG
DTxxxxxxxxxxxxxxxxxxxxxxGVKGWAFDNGNDVWMGRTIxRDSRSGYETFKxxxxxxxxxxxxxxxxxxxxxxxxxxxxxxxxxxxxxxxxxxxxxxxxxxxxxx
xxxxxQEARVWWTSNSIVAFCGTSGTYGxxxxxxxxxxxxxx
>Protein:NA|Subtype:H7N2|Blocksize:11|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxETTVWWTSNSIxxxxxxxxxxxxxxxxxxxxxxxx
xxxxxxxxxxxxx
>Protein:NA|Subtype:H7N2|Blocksize:11|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxGVWWTSNSIVVxxxxxxxxxxxxxxxxxxxxxx
xxxxxxxxxxxxxx
>Protein:NA|Subtype:H7N2|Blocksize:11|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-333 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxLVVFCGTSGTYxxxx
xxxxxxxxxxx
>Protein:HA|Subtype:H7N3|Blocksize:11|String:1
SKSRGYKMNTQILVFALxxxxxxGDK

FIG. 76-334

>Protein:HA|Subtype:H7N3

FIG. 76-335

>Protein:HA|Subtype:H7N3|Blocksize:11|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxPRGLFGAIAGFxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxx
>Protein:HA|Subtype:H7N3|Blocksize:11|String:11
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxTKPRPRRGLFGAxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxx
>Protein:NA|Subtype:H7N3|Blocksize:11|String:1
xxxxxxxxxxGVVNTTLSTIALLIGVGNLVFNTVIHExxxxxxxxxxxxxxxxxxxxxxxxxxTYNNTVINNITTTIIxxxxxxxxxPLPLCPFRGFFPFHK
DNAIRLGENKxVIVTREPYVSCDNxNCWSFALAQGALLGTKHSNGTxxDRTPYRSLIRFPIGTAPVLGNYKEICIAWSSSSCFDGKEWM
HVCMTGxxxxxxxxxxxxxxxxxxxxxxxxxxxxxxxxxxxxxxxxxxxxxxxxxxxxxxxxxxxxGRMTDSIKSWRKDILRTQESECQCIDGTCVVAVTDGP
AANSADHRVYWIREGxxxxxxxxxxxKIQHLEECSCYVDIDVYCICRDNWKGSNRPWMRINNETILETGYVCSKFHSDTPRPADPSTVSC
DSPSNVNGGPGVKGFGFKxGNDVWLGRTVSTSGRSxxxxxxxxEGWINSPNHAKSVTQTLVSNNDWSGYSGSFIVxxxDCFQPCFYVELI
RGRPNxxDDVSWTSNSIVTFCGLDNEPGSGNWPDGSNIGFMPK
>Protein:NA|Subtype:H7N3|Blocksize:11|String:2
xxxxxxxxxxGIVNTTLSTIALIIGVGNLIFNTVIHGxxxxxxxxxxxxxxxxxxxxxxxxxxTYNSTVVNNITTTIVxxxxxxxxxSLPLCPFRGFFPFHKD
NALRLAExxxVIVTREPYISCDNxDCWSFALAQGALVGTKHSNGTxxDRTPYRSLIQFPMGTAPVLGNYREICIAWSSTSCFDGKEWMHI
CMTGxxxxxxxxxxxxxxxxxxxxxxxxxxxxxxxxxxxxxxxxxxxxxxxxxxxxxxxxxxxxGKMTDSIKSWRRDILRTQESECLCIDGTCVVTVTDGPAA
NSAHHRVYWIREGxxxxxxxxxxxKIKHLEECSCYVDVDVYCICRDNWKGSNRPWIRINNETILETRYVCSKFHSDTPRPDDPSTMSCDSP
SNINGGLGVKGFGFKxGDDVWLGRTVSTxxxxxxxxxxxxEGWINSPNHVKSITQTLVSNNDWSGYSGSFTVxxxGCFQPCFYIELIRGRPN
xxDNVSWTSNSIVTFCGLNNEPGSGNWPDGANIGFMPx
>Protein:NA|Subtype:H7N3|Blocksize:11|String:3
xxxxxxxxxxGAVNTTLSTIALFIGVGNLAFNTVIHxxxxxxxxxxxxxxxxxxxxxxxxxxxxTYNNTVVNNITTTIIxxxxxxxxxSLPLCPFQGFFPFHK
DNAIRPGENKxVIITREPYVSCDNxHCWSFALAQGALLGTNHSNGTxxDRTSYRSLIRFPIGVAPVLGNYKEMCAAWSSSSCFDGKEWL
HVCITGxxxxxxxxxxxxxxxxxxxxxxxxxxxxxxxxxxxxxxxxxxxxxxxxxxxxxxxxxxGKMRDSIKSWRNNILRTQESECQCLYGICVVAVTDGPA
DNKADHRIYWIKExxxxxxxxxxxxRIQHLEECSCYMDIDVYCVCRDNWKGSNRPWVRMNNETILETGYICSKFHSDTPRPVDPSTISCDS
PSNINGEPGVKGFGFKxGSDVWLGRTVSTxxxxxxxxxxxxEGWINSPSQAKSITQTLVSNDDWSGYSGSFIIxxxGCFQPCFYVELTRGVxx
xxDEVSWTSNSIVTxCGLDNEPGSGHWPDGSNIGFMxx

FIG. 76-336

>Protein:NA|Subtype:H7N3|Blocksize:11|String:4
xxxxxxxxxxGVVNTALSTIALLIGIGNLVFNTVIHGxxxxxxxxxxxxxxxxxxxxxxxxxxTYNKTVINNITTTITxxxxxxxxxPLPLCPFKGFFPFHK
DNAIRLGENRxVLVTREPYISCxxxGCWSFALAQGALLGTRHSNGTxxDKTPYRSLIRFPVGTAPVLGNYREVCIAWSSSSCFDGKEWM
HVSMxxxxxxxxxxxxxxxxxxxxxxxxxxxxxxxxxxxxxxxxxxxxxxxxxxxxxxxxxxxxGRMADSIKSWRKDxxRTQESECQCIGGTCIVAVTDGPA
ANNADHRIYWIRKGxxxxxxxxxxxKIRHLEECSCYVDTDVYCICRDNWKGSNRPWMRISNETILETGYVxSKFHSDTPRPTDPSIMSCDS
PSNVKGGPGVKGFGFxxxNDVWLGRTVSNSGRSxxxxxxxxDGWINSPNHAKSLTQTLVSNNDWxxxxxxxxxxxxxCFQSCFYVELIRGRL
NxxDDVSWASNSIVTFCGLxxxPGSGNWPDGSDIGFMPK
>Protein:NA|Subtype:H7N3|Blocksize:11|String:5
xxxxxxxxxxGSVNTVLSIIALLIGIGNLIFNTVIHExxxxxxxxxxxxxxxxxxxxxxxxxxTYNNTVINNMTxxxxxxxxxxxxxSLPLCPFKGFFPFHKG
NSARLIHHTxxIVTREPCVSCDxxNCWSFALAQGVLLGTKHSNGTxxxxTPYRSLIQFPIGTAPILGNYKEICVAWSSSSCFDGKEWMHVC
ITGxxxxxxxxxxxxxxxxxxxxxxxxxxxxxxxxxxxxxxxxxxxxxxxxxxxxxxxxxxxxGRMSDSIKSWRKDIxRTQESECQCISGxCVVSVTDGPAANSA
DHRIYWIREGxxxxxxxxxxxxIQHLEECSCYTDIDIYCICRDNWKGxxRPWVRINNETILETxxxxxxxxxxxxxxxDPSVVSCDSPSNxxxxxxxxx
xxxxxxDDVWLGRTVSINGRSxxxxxxxxEGWIDSPNHAKSITQTLVSNSDWSGYSGSFIxxxxxxxxPCFYIELIRGKPNxxDDVSWTSNSLVx
xxxxxxxxxxxxxxxxxxxxxxxx
>Protein:NA|Subtype:H7N3|Blocksize:11|String:6
xxxxxxxxxxxVVNTILSTKALLIGIGNLAFNAVIHGxxxxxxxxxxxxxxxxxxxxxxxxxxxNNHTTINNITNVVLxxxxxxxxxxxxxxPVQGFFPFHK
DNxxxxxxxxxxxVTREPYVSCDYxxxxxxxxxxxxxxxxxxxxxxxxxxxxxxxxxxxxxxxxxxxxxLGNYKEIRIAWSSSSCFDGKEWMHVCMAGxxxxx
xxxxxxxxxxxxxxxxxxxxxxxxxxxxxxxxxxxxxxxxxxxxxxxxxxxxxxxxxxxxxxxxxxxxxxxxxRTQESECQRIDxxxxxxxxxxPAANNADHRVYWIRxxxx
xxxxxxxxxxxxHSEECSCYVDIDIYCxxxxxxxxxxxPWMRINNETIVETGYVCSKFHxxxxxxxxxxxxSCSSPSGIEGRxxxxxxxxxxxxDVWLGR
TVSISGRSxxxxxxxxxxxxxxxxVKSVTQTLVSNxxxxxxxxxxxxxxxxxxxxxFYVELIRGRPIxxxxxxxxxxxxxxxxxxxxxxxxxxxxxxxxxxxxxxx
>Protein:NA|Subtype:H7N3|Blocksize:11|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxEICVAWSSTSCFDGxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxLGRTISYSSRSxxxxxxxxxxxxxxxxxxxxAATQTLVSNNDxxx
xxxxxxxxxxxxxxxxxxxxxxxxxxxxxxxxxxxxxxxxxxxxxxxxxxxxxxxxxxxxxxxxxxxx
>Protein:HA|Subtype:H7N7|Blocksize:11|String:1
SKSRGYKMNTQILVFALxxxxxxGCDHSDNADKICLGHHAVxNGTKVNTLTERGVEVVNATETVERxxxxxxxxxxxxxxxxxxxxxxxxxxTGP
PQCDQFLEFxxxxxxxxxxxxxxxxxxxxxxxxxxxxxxxxxxxxxxxxxGFTYSGIRTNGxxxxxxRSGSSFYAEMKWLLSNxxxxxxxxxxxxxxxxxxxxxx
xxxxxxxxxxxxxxxxxxxxxxxxxxxxxxxxxxxxxxxxxxxxxxxxRPQVNGQSGRIDFHWLxxxxNDTVTFSFNGAFIAPDRASFxxxxxxxxxxxxxxxxxxxxx
xxxxxxxxxxxxxxxxxxxxxxxxxxxxxxxxxxSLLLATGMKNVPExxTHKQLTHHMRKKRGLFGAIAIAGFIENGWEGLIDGWYGFRHQNAQGE
GTAADYKSTQSAIDQITGKLNRLIEKTNQQFELIDNEFTEVEKQIGNVINWTRDSMTEVWSYNAELLVAMENQHTIDLADSEMNKLYE
RVRRQLRENAEEDGTGCFEIFHKCDDDCMASIRNNTYDHSKYRxxxxxxxxxxIDPVKLSSGYKDVILWFSFGASCFILxxxxxxLVFICVKN
GNMRCTICI
>Protein:HA|Subtype:H7N7|Blocksize:11|String:2

FIG. 76-337

```
SKSRGYKMNTKILVLALxxxxxxxxxGDKICLGHHAVxNGTKVDTLTEKGIEVVNATETVEQxxxxxxxxxxxxxxxxxxxxxxIGPPQC
DQFLExxxxxxxxxxxxxxxxxxxxxxxxxxxxxxxxxxxxxxxxxGFTYTGVRTNGxxxxxRSRSSFYAEMKWLLSSxxxxxxxxxxxxxxxxx
xxxxxxxxxxxxxxxxxxxxxxxxxxxxxxxxxxRPQINGQSGRIDFYWLxxxNDTVTFTNGAFIAPNRASFxxxxxxxxxxxxxxxxxxxxxx
xxxxxxxxxxxxxxxxxxxxxxSLMLATGMKNVPExxAHKQLTHHMRKKRGLFGAKxxxGFIEN

FIG. 76-338

NEFTExxxxxxxxxxxxxxxxxxxxxxxxAVENQHTIDSTESEMNKLYERVxxxxxxxxxxxxxxxxxxFEIFHKCDDRCMTSIRNNTYDHxxxxxxxx
xxxxxxxxxxxxSGYKEIILWFSFGASCFFxxxxxxxxxFICVKNGNMQCTxxx
>Protein:HA|Subtype:H7N7|Blocksize:11|String:7

FIG. 76-339

RSGFEMLKIHNAGTDPxxxxxxRQEIVGNDNWSGYSGSFIDYWDDxxxxxxxxxxxxxxxxxxxxxxRPEEAKYVWWASNSLIALCGSxxPVGPGSFPD
GAQIQxxx
>Protein:NA|Subtype:H7N7|Blocksize:11|String:4
MNPNQKLFTLSGVAI

FIG. 76-340 xxxxxxxxLLVSTNAYDRICIGYQSNNSTNTVNTLIEQKVPVTQTMELVEAEKHSAYCNTDLGAPLELRDCKIEAVIYGNPKCDVHLKD
QSWSYIVERPSAPEGMCYPGFVENLEELRFVFSSAASYKRIRLFDYSKWNVTRSGTSKACNASTGAQSFYRSINWLTKKEPDTYDFNE
GxxxxNNEDGNIIFLWGIHHPPNTKEQTALYKNANTLSSVNTNTINRSFQPNIGPRALVRGQQGRMDxxxxxxxxxxxxxLIAPEFGY
LLRGESHGRTIQNEDIPIGNCNTKCQTYAGAVNSSKPFQNASRYYMG

FIG. 76-341

```
xxxxxxxxxxxxxxxxxxxxxxxxxxxxxxxxxxxxxxxxxxxxxxxxxxxxxxxxxxxxxxxxxxxxxxxxxxxxxxxxxx
xxxxxxxx
>Protein:HA|Subtype:H8|Bl

FIG. 76-342

>Protein:HA|Subtype:H9|Blocks

FIG. 76-343

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxLKPGQTLRVRSxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEGLVYGNPSCDxxxxxxxxxxxxxxxxxxxxxxxxxxxxxxxxxxxxx
xxGIFGAIAGFIEGGWPGLVAGWYGFQHTNDQGxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxDQIQDVWAYNAEL
LVLIENQKTLDEHxxxxxxxxxxxxxxxxEDGNGCFELYHKCxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxGIYKILTIYSTVASPxxxxxx
xxxxxxxxxxxxxxxx
>Protein:HA|Subtype:H9N2|Blocksize:11|String:3 xxxxxxxx

FIG. 76-344 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxVLLENQKTLDDxxxxx
xxxxxxxxxxxxxxxGKGCFELYHECxxxxxxxxxxxxxxxxxxxxxxxxxxxxxxxxxxxxxxxxxxxxxxxxxxxxxxxxxxxx
>Protein:HA|Subtype:H9N2|

FIG. 76-345

>Protein:NA|Subtype:H9N2|Blocksize:11|String:5
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxPHRTLLMNEIGVxxxxxxxxxxxxxxxxSSSCHDGKEWLxxxxxxxxxxxxxxxxxxxxxxxxxxxxxxxxx
xxILRTQESDCVCxxxxxxxxxxxxxxxxxxxxxxxxxxxxxxxxxxxxxxxGSAKHVEECSCYPxxxxxxxVCWDNWRGSNRxxxxxxxxxxxxxxxxxxxCSGL
VGDTPRTxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxYGTGSWADGANxxxxxx
>Protein:NA|Subtype:H9N2|Blocksize:11|String:6
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxHRTLLMNELGIPFHxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxCSGLVGDTPRGxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxx
>Protein:NA|Subtype:H9N2|Blocksize:11|String:7
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxTLLMNELGVPLHxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxx
>Protein:NA|Subtype:H9N2|Blocksize:11|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxLLMNELGGPFHxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxx
>Protein:M1|Subtype:N/A|Blocksize:11|String:1
MLKMSLLTEVETYVLSIVPSGPLKAEIAQRLEDVFAGKNTDLEALMEWLKTRPILSPLTKGILGFVFTLTVPSERGLQRRRFVQNALNG
NGDPNNMDRAVKLYRKLKREITFHGAKEVALSYSTGALASCMGLIYNRMGTVTxxxAFGLVCATCEQIADSQHRSHRQMxTTTNPLIR
HENRMVLASTTAKAMEQMAGSSEQAAEAMEVAxxxxxxxxxxxxxxxxxxxxxxxxxxxxxxLLENLQAYQKRMGVQMQRFRRPDSSWLFGGxxx
xxxxxxx
>Protein:M1|Subtype:N/A|Blocksize:11|String:2
xxxxSQLTEVETYVLSVIPSGPLKAEIAQKLEDVFAGKNADLEALMEWLKxRPILSPLTKGMLGFVFTLTVPSERGLQRRRFIQNALNGN
GDPSNMDRAVKLYKKLKREITFHGAKEIALSYSAGALASCMGLIYNRMGAVTxxxAFGLICATCEQIADSHHRSHRQMxATTNPLIKH
ENRMVLASTTAKAMEQVAGSSEQAAEAIEVAxxxxxxxxxxxxxxxxxxxxxxxxxxxLLENLQTYQKRMGVQMHRxxxSSRHCSKYHWNLAL
DIVDS
>Protein:M1|Subtype:N/A|Blocksize:11|String:3

FIG. 76-346 xxxxxxTEVETYVLSIIPSGPLKAEIAQRLESVFAGKNSDLEALMEWLKxxxxSSLTKGVLGFVFTLxxxxxQRRRFVQNALSGNGDP
NNMDRxVKLYKKLKREMTFHGAKEVSLSYSTGALASxMGLIYNRMGTITxxxALGLVCATCEQIADAQHRSHRQMxTITNPLIRHENR
MVIASTTAKAMEQIAGSSEQAAEAMDIAxxxxxxxxxxxxxxxxxxxxxxxxLIENLQAYQKRMGLQMQRxxxxxxxxxxxxxxxxxxxxxxxxx
>Protein:M1|Subtype:N/A|Blocksize:11|String:4
xxxxxxxxxxxxxxxLKAEIAQRLEGVFAGKNTDLEV

FIG. 76-347 xxxxxxxxxxxxLSTRGVQVASNENxxxxxxTLELRSGYWAIRTRSGGNTSQxxxxxxxxSTQPTFSVQRNLPFDKxxxxxxxxxEGRTSDM
RAEIIxxxxxxxxxxxDLSFQGRGVFELSDERxxxxxxxxxxMNNEGSYFFGDNAKEYxxxx
>Protein:NP|Subtype:N/A|Blocksize:11|String:3
xxxxxxxMSDIGAMASQGTKRSFS

FIG. 76-348

>Protein:NP|Subtype:N/A|Blocksize:11|String:8
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxSALILRGAVAHKSCxxxxxxxxxxxxxxxxxxxxxxxxxxxxxxxDPFKLLQTSQVxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxRGVFELSDERATxxxxxxxxxxxxxxxxxxxxxxxxxxxxxxxx
>Protein:NP|Subtype:N/A|Blocksize:11|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxDPFRLLQSSQVxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxRGVFEFSDERAAxxxxxxxxxxxxxxxxxxxxxxxxxxxxxxxx
>Protein:NP|Subtype:N/A|Blocksize:11|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPRLLQNSQVFSxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxGVFELSDEKAAxxxxxxxxxxxxxxxxxxxxxxxxxxxxxxxx
>Protein:NP|Subtype:N/A|Blocksize:11|String:11
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxGVFELSDERAAxxxxxxxxxxxxxxxxxxxxxxxxxxxxxxx
>Protein:NS1|Subtype:N/A|Blocksize:11|String:1
MLFVQSYFQLFLVCVSLLQSAILSLQTxxxxxxxxxxxxxxxxxGDAPFLDRLRRDQxxxxxxxxxxxxxxxxxxxPMRTPIAFLTSSIVCPGKxxxxxxx
xxxxxxxxxxxxxxxxxxxxxxxxxxxIASVPASRYLIDMTLxxxxxxxxxxxxxxxxxxxxxxxxxxxxxxxxxxxxxxxxxxxxxxxxxxxxAGVETMVILSASxxxxxxxxxxxxxx
xxxxxxxxxxxxxxxxxNWPSSSGGLEWxxxxxxxxxxxxxxxxxxxxxxxxxxxxxxxxxSRNGKWREQLSQKFEEIRWLxSEVRRDQMAHCRMFEQITFMQ
ALQL
>Protein:NS1|Subtype:N/A|Blocksize:11|String:2
xxxxxxxxxxxxxxxxxxxxxxxxxxxxFQVDCFLWHVRxxxxxxxxSDAPFLDRLRRANLCRFLETRTVxxxxxxxxxxxxxxxxxxxxxxxxxxxxxxxxxxxxxxxxxx
xxxxxxxxxxxxxxxxxxxxxIASVPASRYLTDMTLxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxSEVRGDQMAHCNSFEQITFMQALxx
>Protein:NS1|Subtype:N/A|Blocksize:11|String:3

FIG. 76-349 xxxxxxxxxxxxxxxxxxxxxFQVDCFLWHIRxxxxxxxCDAPFDDRLRRDQxxxxxxxxxxxxxxxxxxxxxxxxxxxxxxxxxxxxxxx
xxxxxxxxxxxxxxxLKMPASRYLTDMTxxxxxxxxxxxxxxxx

FIG. 76-350 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxTENSFEQITFIQALQLLLEVENExxxxxxxxxxxxxx >Protein:NS2|Subtype:N/A|Blocksize:11|String:5
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx

FIG. 76-351

DPFRQSERGEETIEEKFEIxxxxxxLADQSLPPNFPxxxxFRTYVDGFEPNGSIEGKLxxxxxxxxxxxxxxxxxxxxxxxxxxxxCFQRSKFLLMDx
xKLSIEDPDHEGEGEGIPLYDxxxxxxxxxxxxxxxxxxxxxxxxxxxxxxxxxxxxxxxxxxxxxxxxxxxxxxxxxxxLKWTLGENMAPEKxxxxxxxxx
xxxxxxxxxxxxxxxxWVQSEFNKACELTGSSWxxxEFDEIGEDVAPIEYVASMRRxYFTTEVSHCRATEYMMxKGVYINTAMLNASCAA
MDDYQLIPMISKCRTREGRRKTNLYGxxxxxxxxxxGSLNFVSMEFSLTDPRLExxxxxxxxxxxxxxxxxxxxxxxxxxLFLYVRTNGTSxxx
xxxxxxxxxSLQQVESMIEAES

FIG. 76-352

```
xxxxxxxxxxxxxxxxxxxxxxxxxxxxxxxxxxxxxxxxxxxxxxxxxxxxxxxxxxxxxxxxxxxxxxxxxxxxxx
xxSYCRATEYIMKGxxxxxxxxxxxxxxxxxxxxxxxxxxxxxxxxxxxxxxMEFSLVDPRLExxxxxxxxxxxxxxxx
xxxxxxxxxxxxxxxxxxxxxxxxxxxxxxxxxxxxxxxxxxxxxxxxxxxx >Protein:PA|Subtype:N/A|Blocksize:11|String:9
xxxxxxxxxxxxxxxxxxxxx

FIG. 76-353

ATAQMALQLFIKDYRYTYRCHRGDTQxxxxxxxxxxxxxxxxxxxxGLLVSDGGPNLYNIRNLHIPEVCLKWELMDxxYQGRLCNPLNPFVS
HVGTRWMKIIRVGCVILLNPFVSHKEIxxxxxxxxxxxxxxxxxMEYDAVATTHSWIPKRNRSILNTSQRGILGQNHGICAVATTHSWVPILN
TSQRGILEDEQMYQKCCNLFEKFFPSSSYRRPVGISSMVEAMVSRARIDARIDFESGRxGKKEEFSEIMKxxxTIEELRRQKWWVWLWL
VLREKMP
>Protein:PB1|Subtype:N/A|Blocksize:11|String:2
MDVNPTLLFLExxxPVQNAISTTFPYxxxxxxxxxTGTGYTMDTVSRTHQYSEKGKxxxxxEIGAPQLNPIDGPLPKxNEPTGYAQTDCVLEA
MALLEESHPGIFENSCIExxxxIQQTRVDKLTQGRQTFDWTLNRNQPAATALANTIEIFRSNxxxxSESGRLIDFLKDVIxxxxxxxxxxxTHFQ
RKRRIRDNxxxxxxxxxxxxxxxxxxxxxGYLIRALTLNTxxxxxxxxxxxxxxxxTPGMQIRGFVHFVEALARRICEKLEQSGLxxxxxxxxxxxLANVV
RKMMTSSQDTEISFTITGDNTKWNENQNPRVFLAMxxxxxxxxxxxxWFRNILSMAPIMFSNKMAKLGxxxxxxxxxxxxxxxxxxxxxxxxxxxxx
xxxxxxxxxxxxxxxxxxxxGAASLSPGMMMGxxNMLSTVLGVSVLNLGQKxxxxTIYWWDGLQSSDDFALILNAPxxxGIQAGVNRFYRTCK
LVGINMSKRKSYINKTGTFEFTSFFxxxxxxxxxxMELPSFGVSGVNESADMSIGVAVIKNNMINNDxxxxxxxxxxxxxxKDYRYTYRCHKG
DTQxxxxxxxxxxxxxxxxxxxxGLLISDGGPNLYNIRNLHIPEAGLKWELMDxxYRGRLCNPLNPFVNHxxxxxxxxxxxxxxxxxxxxxxxxxxxxx
xxxxxxxxxxxxxIEYDAVATTHSWVPKRNRSILNTSQRGVLxxxxxxxxxxxxxxxxxILNTSQRGVLEDEQMYQKCCSLFEKFFPSSSYRRPIGI
SSMVEAMISRARIDARIDxxxxxxGKKEEFSEIMRxxxTIEELRRQKSLIWLWLVLREKxx
>Protein:PB1|Subtype:N/A|Blocksize:11|String:3
xxxINPTLLFLKVPPAQNAISITFPYxxxxxxxxxxxxxxxxxTVNRTHQYSERGRWxxxxETKAPQLNPIDGPLPDxNDPSGYAQTDCVLEAMA
FLEKSHPGLFENSCLExxxxVQQTRVDRLTQGRQTYDWxxxxxxxxxxxALANTIEVFRLNxxxxNESGRLMDFLKDVMxxxxxxxxxxxTHFHR
KRRVRDNxxxxxxxxxxxxxxxxxxxxxNYLIRALTLNTxxxxxxxxxxxxxxxxxxxxQIRGFVYFVEALARCICEKLEQSGLxxxxxxxxxxxxNVVRK
MMTNSHDTELSFTVTGDNTKWNENQNPRIFLAMxxxxxxxxxxxxWFRNILSIAPIMFSNKVARLGKGYMFExxxxxxxxxxxxxxxxxxxxxxxxx
xxxxxxxxxxxxxxxxxxxGTVSLSPGMMMGMxxxxxxxLGVSILNLGQRxxxxTSYWWDGLQSSDDFALIVNASxxxGVQAGVDRFYRTCKL
LGINMSKKKSYINKTGTFxxxxxxxxxxxxxxxxxxxxxxxxxxxINESADMSIGITVIKNNMINxxxxxxxxxxxxxxxxxxxRYTYRCHRGDMQxxxxx
xxxxxxxxxxxxxxxGLLVADGGPNLYNIRxLHIPEVCLKWDLMDxxYKGRLCNPLNPFVTHxxxxxxxxxxxxxxxxxxxxxxxxxxxxxxxxxxxxxx
xxxxVEYDAVATTHSWTPKRNRSILNTNAITRSGQNHGICAVAxxxxxxxxxxTNQRGILEDEQMYQRCCNLFEKFFPxxxYRRPVGISSMG
EAMVSRARIDARVDFESGRxGKKEFSEIMKIxxxxxxxxxxxxxxxxxxxxxxxxxx
>Protein:PB1|Subtype:N/A|Blocksize:11|String:4
xxxxxxxxYFFLKVPVQNAxxxxxxxxxxxxxxxxxxxxxxxxxxxNRTHQYSERGKWxxxxETGALQLNPIDGPLPVxNEPNGYAQTDCVLEAMAF
LENSHPGIFGNSCLExxxxVQQTRMDKLTQxxxxxxxxxxxxxxxxxALANTIEVFKSNxxxxxxxGRLIDFLKDVVxxxxxxxxxxxxxxxxxxxxxxxx
xxxxxxxxxxxxxxxxxxxxSYLIRTLTLNTMTKDAxxxxxxxxxxxxxxxxQIRGFVYFVEILARNICEKLEQSGLxxxxxxxxxxxxxxVVRKMMTNSRD
TExxxxxxxxxxxxNENQNPRVFLTMxxxxxxxxxxxxxWFRNVLSVAPIMFSNKMARLGRGYMFESKxxxxxxxxxxxxxxxxxxxxxxxxxxxxxxxxx
xxxxxxxxGTAALSPGMMMxxxxxxxxxxxxxxxxxxxxxxxxTVYWWDGLQSSDDFALIVNALxxxxIQAGVDRFYRICKLVGINMSKxxxxxxxx
xxxxxxxxxxxxxxxxxxxxxxxxxxxxxVNESADMSIGITVIRNNMINNDLGPxxxxxxxxxxxxxxxYTYRCHRGDTHxxxxxxxxxxxxxxxxxxxxxxxxx
xxxxSNLYNIRNLHIPEVCLKWGLMxxxYQGRLCNPMNPFVSHxxxxxxxxxxxxxxxxxxxxxxxxxxxxxxxxxxxxxxxxxxxxxxxxxxxx
xxICNSNAITRSGQNHxxxxxxxxxxxxxxxxTSQKGILEDEQMYQKCCTLFEKFFPSSSYRRPVGISSMMEAMVSRARIDARTDxxxxxxxxxxx
xxxxxxxxxxxxxxxxxxxxxxxxxxxxxxxxxx
>Protcin:PB1|Subtypc:N/A|Blocksizc:11|String:5

FIG. 76-354 xxxxxxxxxxxxxxxxxxxxxxxxxxxxxxxxxxxxxxxxxxxxxxxxxxxxxNRTHQYSEKGRWxxxxETGAPQLNPVDGPxxxxxxxxxxxxCVLEAMAFLEDSHP
GIFESSCLEx

FIG. 76-355

>Protein:PB1|Subtype:N/A|Blocksize:11|String:9
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxNQNPRVFLTMITYITxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxx
>Protein:PB1|Subtype:N/A|Blocksize:11|String:10
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxNQSPRMFLAMITYxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxx
>Protein:PB1|Subtype:N/A|Blocksize:11|String:11
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxPRTFLAMITYITxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxx
>Protein:PB2|Subtype:N/A|Blocksize:11|String:1
SESRSNIFNMERIKELRDLMSQSRTREILTKTTVDHMAIIKKYTSGRQEKQEKNPALRMKWMMAMKYPITADxxxxxxxxxxxxxxxxxxxxxxxxxxxx
xxxxxxxxxMVSPLAVTWWNRNGPxxxxxxxxxxxxxxxxxxxxxxxxGTFGPVHFRNQVKIRRRVDINPGHAxxxxxAKEAQDVIMEVVFPNEVG
ARILTSESQLxxxxxxxxxxxxxxIAPLMVAYMLERELVRKTRFLPVAGGTSSVYIEVLHLTQGTCWEQMYTPGGEVxNDDVDQSLIIAARN
IVRRAAVSADPLASLLEMCHSTQIGGxxxxDILRQNPTEEQAVDICKAAMGLRISSSFSFGGFTFKRTSGxxxxxEEEVLTGNLQTLKxxxxx
xxxxxxxxxxxxxxxxxxxxxxxxxxxxxxxxxxxxxxxIVAMVFSQEDCMIKAVRGDLNFVNRANQRLNPMHQLLRHFQKDAKVLxxxxxxxxxxx
xxxxxxxxxxxxxxxxxxxxxxxxxxxxxxxxxxxxxxVSIDRFLRVRDQRGNVLLSPEEVSETQGTEKLTITYSSSMMWEINGPESVLVNTYQWII
RNWExxxxxxxxxxxxLYNKMEFEPFQSLVPKAxxxQYSGFVRTLFQQMRDVLGTFDTxQIIKLLPFAAAPPEQSRMQFSSLTVNVRGSGM

FIG. 76-356

RILVRGNSPVFNYNKxxKRLTVLGKDAGAGALAEDPDExxAGVESAVLRGFLILGKEDKKRYGPALSINELSxLAKGEKANVLIGQGD
VVLVMKRKRDSSILTDSQTATKRIRMAINQCxxx
>Protein:PB2|Subtype:N/A|Blocksize:11|String:2
SKSRSNIFNMERIKELRYLMLQSRTREILTRTTVDHMAIIKRYTSGRSGRQEKNPALRMKWMMAMRYPITADxxxxxxxxxxxxxxxxxxxx
xxxxxxxxxMISPLAVTWWNRKGPxxxxxxxxxxxxxxxxxxxxxxxGTFGPVHFQNQVKIRRRVDTNPGHAxxxxSKEAQDVIMEVVFPNEVGA
KILTSESQLxxxxxxxxxxxxxxISPLMVAYMLERxLVRKTRFLPVSGGTSSIYIEVLHLTQGACWEQLYTPGGEVxNDDIDQSLIIAARNIVR
RATVSADPLASLLEMCHGTQIGGxxxxDILKQNPTEEQAVGICKAAMGLKISSSFSFGGFTFKRTKGxxxxxEEEMLTGNLQTLKxxxxxxxx
xxxxxxxxxxxxxxxxxxxxxxxxxxxxxxxxxxxxxVVAMVFSQEDCVVKAVRGDLNFVNRANQRLNTMHQLLRHFQKNAKVLxxxxxxxxxxxxx
xxxxxxxxxxxxxxxxxxxxxxxxxxxxxxxxxxxxxVNIDRFLRVRDQQGNILLSPEEVSETQGIERLTITYSSSMMWEVNGPESVLVNTYQWVIR
NWExxxxxxxxxxxxLYNKIEFEPFQSLVPRAxxxRYSGFVRTLFQQMRDILGTFDTxQVIKLLPFAAAPPKQSRMQFSSLAVNVRGSGMRV
LIRGNSPVFNYNRxxKRLTILGKDAGxxxxxxxxxxxxSGVESAVLRGFLIIGKEDRRRYGPALSINELGxLTKGEKANVLIGQGDIVLVMKR
KRDSxxLTDSQTATKRLRMAIxxxxxx
>Protein:PB2|Subtype:N/A|Blocksize:11|String:3
SKSRSIIFNMERIKELxxLMSQSRTRGILTKTTVDHMAVIKKYTSARQEKQEKNPSLRMKWMMAMKYPITAExxxxxxxxxxxxxxxxxxxxx
xxxxxxxxIVSPLAVTWWNRSGPxxxxxxxxxxxxxxxxxxxxxxGIFGPVHFRNQIKIRRRVDINPGHSxxxxAKEAQDVIMEIVFPNEVGARIIT
SESQLxxxxxxxxxxxxxxIAPLMMAYMLERELVRKTRFLPVTGGTSSVYVEVLHLTQGTCWEQLYTPGGxxxNDDVDQSLVIAARNIVRR
AIVSADPLASLLEMCHSTRIGGxxxxDILKHNPTEEQAVNICKAAMGMRISSSFSFGGFTFKRTNGxxxxxEEEVLTGNLQALKxxxxxxxxx
xxxxxxxxxxxxxxxxxxxxxxxxxxxxxxxxxxxxIVAMVFSQEECMVKAVRGDLNFxxxxxxxxxxxxQLLRHFQKDARVLxxxxxxxxxxxxxxxxxxxx
xxxxxxxxxxxxxxxxxxxxxxxxxxxxxxVSIDRFLRVKDQQGxVLLSPEEVSEAQGTEKLTITYSSSLMWEINGPESVLINTYQWIIRNWxxxxxx
xxxxxxxLYNKVEFEPFQSLVPxxxxxLYSGFVRTLFQQMRDVIGTFDTxQIIKLLPFASAPPEQSKMQFSSLTVNVRGTGMRILVRGNSPAF
NYNKxxKRLTIIGKDAGxxxxxxxxxxxxTGVESAVLRGFLILGREDKKKYGPALSINELxxLARGEKANVLIGQxDVVLVMKRKRNSSILT
DSQTATKRIRLAIxxxxxx
>Protein:PB2|Subtype:N/A|Blocksize:11|String:4
xxxxxxxxxxxxxxxxxxLMSLSRTREILTKITVDHMAIIKKYTSARQERQEKNPSLRMKxMMAMKYPITANxxxxxxxxxxxxxxxxxxxxxxxxxxx
xxMVSPLAITWWNRNGxxxxxxxxxxxxxxxxxxxxxxxxGTFGPVHFRSQVKIRRRVDVNPGHAxxxxTKEAQDVIMEVxFPNEVGARILASE
SQLxxxxxxxxxxxxxxxxxxxxxxxxxxxLVRKTRFLPVVGGTSSMYIEVLHLTxxxCWEQMYTPGGGVxNDEVDQSLIIAARSIVRRATVSAD
PLLSLLEMCHSTQVGGxxxxDILRQNPSEEQAVDICKAAIGLRISSSFSFGSFTFKRTSxxxxxxEEELLTGNLQTLKxxxxxxxxxxxxxxxxxxxx
xxxxxxxxxxxxxxxxxxxxxxxxxIVAIVFSQEDCMMKAVRGDLNFVxxxxxxxxxxxxLLRHFQKDAKILxxxxxxxxxxxxxxxxxxxxxxxxxxxxxxxx
xxxxxxxxxxxxxxxxxxxxxDRFLRVRDQLGxxLLSPEEISETQGTEKLTIIYSSSMMWEINGPDSVLVNTYQWIIKNWExxxxxxxxxxxxLYNK
LEFEPFQSLVPxxxxxxxxxxxxxxxxxxxxxxxxxxxxQIIKMLPFAAAPPVQSRMQFSSFTVNVRGSGLRILVRGNSPVFNHxxxxRRLTVLGKD
AGxxxxxxxxxxxxGGVESAVLRGFLILGKENKKRYGPALSISELSxIAKGEKANVLIxxxxxxxxxxxxxxxxxxxxQTATKRIRMATNECRII
>Protein:PB2|Subtype:N/A|Blocksize:11|String:5
xxxxxxxxxxxxxxxxxxxMSQPRTREILTKTTVDHMAIIRHNQEYTSGRQEKNPALxxxxxxxxxxxxxxxxxxxxxxxxxxxxxxxxxxxxxxxxxxxxxxx
xxxxxxxxxxxxxxxxxxxxxxxxxxxxxxxxxxxGAFGPVHFRNQVKIRRRVDMNPGHAxxxxVKEAQDVIMEVxxxxxxGARILTSESQMxxxxxxx
xxxxxxxxxxxxxxxxxxxxxxxxTRFLPVAGGTGSVYIEVLHLTxxxCWEQMYTPGGKVxxxxIDQSLIIAARSxxRRATVSADPLVSLLEMCHS

FIG. 76-357

TQxxxxxxDILRQNSTEEQAVEICKAALGLRISSSFSFxxxxxxxxxxEVLTGNLQTLRxxxxxxxxxxxxxxxxxxxxxxxxxxxxxxxxxx
xxxxxxxxIVAMVFSQEDRMIKAVRGDLNxxxxxxxxxxLLRHFQKDAKMLxxxxxxxxxxxxxxxxxxxxxxxxxxxxxxxxxxxxxxxxxx
xxxxxDRFLRVRDQMGxxxSPEEVSETQGMEKLTITYSSPMMWEINGPESxxxxxxxxxxxxxxxxxxxxxxxKMEFEPFQSLIPKAxxxx
xxxxxxxxx

FIG. 76-358 xxxxxxxxxxxxxxxxxxxxxxxxxxxxxxxxxxxxxxxxxxxxxxxxxxxxxxxxxxxxxxxxxxxxxENKRYGPALSIxxxxxxxxxxxxxxxxxxxxxxxxxxxxxxxxxxxxxxxxxx
>Protein:PB2|Subtype:N/A|Blocksize:11|String:10

```
xxxxxxxxxxxxxxxxxxxxxxxxxxxxxxxxxxxxxxxxxxxxxxxxxxxxxxxxxxxxxRTQESECQCxxxxxxxxxxxxxxxxxxxxxxxxxxxxxxxxxxxxxxIRHLEECSxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxx
>Protein:NA|Subtype:ALL|Blocksize:8|String:5
xxxxAKAGVKMNPNQKxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxx >Protein:NA|Subtype:N1|Blocksize:8|String:4
xxxxQKQEIKMNPNQK

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxGFAPF
TKDNSIRLSASGxVWVTREPYVSCSxxxxxxxxxxxxxxxxxxxxxxxxxxxxxxxxxxPYRTLLMSExxVPFHLGTRQVCIAWSxSSCHDGNAWLHVCxx
xxxxNATASLIYxxxxxxxxxxxx

```
xxxxxxxxxxxxxxxxxxxxALIIGVGNLAFNAVIHEKxxxxxxxxxxxxxxxxxxxxxxxxxxxxxxxxxxxxxxxxxxxxxxxxxxNAIRLG
ETxxVIITREPYVSCDYxHCWSFALAQGALVGTKHSNGTIEDRTPYRSLIKFPxxAAPVLGNYxEMCVAWSSxxxxDGKEWMHICxxxxxxx
xxxxxxxxxxxxxxxxxxxxxxxxxxxxx xNPNQMIITIGSASxxxxxVGLLLQIISLxxxxFSHYNQVAQTxxxxxxxxxxxxxETFVNMTNVQNNYxxxxxxxxxxxxxxxxxxxxxxxxxxxxxxxxxxxxxxxxx
xxxxxxxxxxxxEPFISCSVSECR

```
xxxxxGGVPTDVIRSWRKQIxxxxESSCVCMNGxxxxMTDGPANKQASYKIFKSRxxxxxxEVSFRGGHIEExSCYPNLGQVECVCRDxxx
xxxxxxxxxxxYDVGYLCAGxxxDTPRVQDDxxxxxxNAVGRSGTNNxxxxxxxRQGNNVWAxxxxSISSRNGFEILLIEFGWxxxxxxxxxx
xEVLNNKHWSGYSGAFTIPTTMTxxxxxxxxxxxxIRGKPEEGTSIWTSSxxxxxxxVSSEVPGCTMGxxxxxxxxxxxx
>Protein:NA|Subtype:N5|Blocksize:8|String:5
xxxxxxM xxxxxNRPVITIDxxxMTHSSKYLCSRVLTDTSRxxxxxxxxxxxxxGGTPDPGVKGFAFLDRANSWLGRTISKDTRSGYEMLKVPNAEAxxx
xxxxxxxxIVNNPNWSGYSGAFVDYWxxxxxxxxxxxxxxIRGRPKENSVLWTSNSVxxxCGSKKRLGSWSWxxxxxxxxxx
>Protein:NA|Subtype:N6|Blocksize:8|String:5
xxxxxIICISAAGMILSVVSLL xKITCVCRDNxxxxNRPVIEINMxxxxHTSRYMCTGxxxDTSRPGDRxxxxxxPITGSPEAxxxKGFGFLDGNNTWLGRTISPHSRSGFEMLK
VPNAGTDPxxxxERQEIVGNxxxxxxxxxxxxSKCYNPCFxxxxxxxx QFxxxxxxxxxxxxxxGFRQGSDVWVGRTISLTSRSGFExxxxxxxxxxxxxxxxxxxxxxxxxDNPNWSGYSxSFTLPVEMxxxSCLVPCFWxxxxxx
xxxxxxxxxxxxSIVMCGVNYxxADW xxxxxxxxxxxxxxTMTHTSQYxxxxxxxNPRPNDPVxxxxxPYPGNNBNGVKGFxxxxxSNTWLGRTISIASRSGYExxxxPNALTDDKSKP
TQGQTVVLNTDWSxxxxSFIDYWA HPSSIxERNDLYGTQSLSISIGSSTYQNSFVPVVRARPQVNGQSGRINFHWTxxQPGDHITFSHNGGLIAPNRVSKLxGRGLGVQSxxxxx
SCESKCFWREGSINTxxxxxxxxxxxQCPKYVNQRSLMLATGxxxxxxxxxxxxxxxxxxxxxxxxxxxxxxxxxxxxAQGTGLAADYKSTQKTI
DQVTGKLNRLxxxxxxxxxxxxSEFNEIEYQIGNVINxxxxxxxxxxxxxxxxxxQEELLVAMxxHTIDLADSEMxxxxxxxxxxxxxxxxxxGCFEIYHNCD
xSCMERIRNNTYDHSQxxEEAPLNRLNINSVKLFSGYKDIxxxxxxxxxFFCLKDGNMRxxxxxxxxxxx
>Protein:HA|Subtype:H10|Blocksize:8|String:5
xxxxxxxxxxxxxxxxxxxxxxxxxxxxxxxxxxxxxxxxxxxMEEVTNATxxxxxxxx \>Protein:HA|Subtype:H10N7|Blocksize:8|String:4
xxxxxxxxxxxxSLDKIC RSGxxMLKIPNAETDPNSxIAERQEIVDNRNWSGYSGSFIDYWDDxSVCYNPCFYxxxxxxxxxxxxxxxxxxxxxxxxVALCGSPVSVGSGSFPNG
AQIQYxx
>Protein:NA|Subtype:H10N7|Blocksize:8|String:4
xNPNQNLFTLSG xxxxxNNIVDWMNxxxxxxxxxxxIEEGINQLxxxxxxxxxINIWSYNAQLLVWLENEKTLxLHDSNVRSLHEKVRRILKGNAKDEGNxCFTFY
HRCDNECIERVRNxxYDHKEFEKESKLNRQEIGGVKLDxxS MEKFITLSTxxxxxVAYDKICIxxxxxxTETVNTLSEQNVPVTxVEELVHGQVNPxxxTKLGSPLVLDDCSLEGIILGNPKCDLYLSGREW
SYIVERPKEIEGICYPGSIKNQEELRSLFSSIKRYERVKMFDFIKWNVTYTGTSRACNNTSNRGSFYRSMRWLTLKLGQFPVQTxxYKNT
RDSNIxF QVRRxxxNAVDEGNGCFELLHKCNNSCMETIRNGTYDHTEYEEESKLKRQEINGIKLKSDDSVYKALSIYSCIASSIVLVGLILSFIMW
ACSNGSCRFNxxx
>Protein:HA|Subtype:H13|Blocksize:8|String:3
xxxxxxxxxxxADKICVGYLS QPNDGQVLYxxxxxxGRYSKADKICIGYLSNNSSDTVDTLTENGVPVTSSVDLVETNHTGTYCSLNGVSPIHLGDCSFEGWIVGNPSCAT
NNIREWSYLIEDPNAPNKLCFPGELDNNGELRHLFSGVNS xxxxxxxxxxxxxxxxxxxxxxxxxxxxxxxxxxxxxxxxxxCIASSTVMVGLIIxxxxxxxxxxxxxxxxxxxxxxxxxxxxxxxxxxxxxxxxxxxxxxxxxxxxxxxANVKNLHDQIKxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxx
>Protein:HA|Subtype:H1|Blocksize:8|String xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEGGWPGLVAGWYGFQHQNxQGVGMAADxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxWAYNAELLILLENEKTLDxxxxxxxxxxxxxxxxxxxxxxxxGNGCFELLHxxxxxxxxxxxxxxxxxxxxxxxxxxxxxxxxxxxxxxxxxxxxxxxxxxxxxxxxxLSIYSSVASSxxxxxxxxxxxxxxxxxxxxxxxxxxxxxCRICIDFRDMRKNTL
>Protein:HA|Subt >Protein:HA|Subtype:H1N1|Blocksize:8|String:5

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxYSKD
NSVRIGSKGDxxxxxxxxSCSHLECKTFFLTQGxxxxxRHSNGTIKDRSPFRALxxxxxxxxxxxxxxxxxxASACHDGVxxxxxxxxxxxxxxxxxxxxxxxxxxxxxxxxxxxxxxxxxxxxxxxxxxxxxxxxxxx
xxKYNDIITDTIKxxxxxxxxQESECACINGSCxxxxxxx

```
xxxxxxxxxxxxxxxTLCIDYHAxxxxxxxxxxEKNVAVTHSxxxxxxHNGKLCNLxxxxxxxxxxxVVGWISGNPECxxxxxxxxxxxxxxxxxx
xxxxxxxxxxEELREQISxxxxxxxxxxxxxxxxxxxxxxxx xxxxxxxxxxxxxxxxxxxxxxxxxxxxxxxGSHGVKGWAFDExxxxxxxxxxxxxxxxxxxxxxxxxxxxxxxxxxxxxxxxxxxxxxxxxxxxxxxxxxxxxxxxxxxxxxxxxxxxxxxxxxxxxMSGYSGIFxxxxxxxxxxxx
xVELIRGRExxxxxxxxNSIVVFCSTSGTYGAGSWPDGRTxxxxxxxxxxxx
>Protein:HA|Subtype:H2|Blocksize:8|String:1
MDNQTKTMTITFLI

```
xxxxxxxxxxxxxxxxxxxxxxxxQICVGYHANNSTERVDTxxxxxxxxHAQDILERTHNGKLCRLNGVPPLELGDxxxxxxGNPECDLFLxxxxW
SYIMEKKxxxxxxxxx KCQTPLxxxxxxxxxNVHPLAIGECPKYVKSDRLVLATGLRNAHKMESRGLFGxxxxxxxxxxxxxxxxxxxxxxxxxxxxxxxxxxxxxKESTQKAIxxxx
xxVNSMIEKMNIQFESVGKEFSNLEKRLENLNKKVEDGFLDVxxxxxxxxxxENERILDFHDSNVRNLYDKVRxxLRDNAKELGNGCxxx
xxxxxxxCMSSVKNGTYDYSKYE TGDDKNATASFVYDGxxxDSIGSWSHNILRTQExECVCINGSCTxxxxxxxxxxDTRILFIEEGKVVHISPLAGSAQHVExxSCYPRYPGVR
CICRDxxxGSNRPVLDISMEDYSIDSNYVCSGLVGDTPRSDDSSSNSKSRDPNNEKGNQGVKGWAFDYGNDLWMGRTISKESRSGYET
FRVIGGWTxxSKSQTSRQIIVDNNNRSGYSGxxxxxxKSCVNRCFYVELIRGRSQETRVWxxxxxxxxxxxxWPDGANTNFMPx
>Protein:NA|Subtype:H2N2|Blocksize:8|String:5
xxxxQKIITIGFVSxxxxxxx

```
xxxxxxxxxxIFIFLLLTHxxxxxxxxxxxxxxxxxxxxxxAATLCLGHHAVSNxxxxxxxxDRIEVTNATELVQGxxxxxxxxxxxxxxxxxxxxxCTLVDALLGDPx
xxxxxxxxxxxxxxxxxxWDLFVERNxxxSSCYPYDVPExxTLRSLVASSGNLEFxxxxxxxxxxxxxxxxxxxxxxxxSFFSKLNWLxxxxxxxxxxxxxxxxxxxxx
xxxxxxxxxxxxxxxxxxxxxxxxxxxxxxxxxxxxxxxxxxxxxxxxxxxxSVYWTIVKSGDxxxxxCTGNLIAPRGYFKLxxxxxxxxxxxxxxxxxxFECITP
NGSIPNNKPFQNVNxxTYGPCPRYxxQGTLKLATG KSTQAAIDQVNGKLNRxIKKTNEKFHxxxxxxxxxxxxxxKYVEDTKVDLWSYNAELLIAxxxNTIDLTDSEMSKLFERTRRQLRENAE
DLGNGCFKIYHKCDNTCIESIRNGTYDHNxYRNEALNNRFQIKGIxLKTGYKDWVLWISFAIxxxxxxxxLGFIMWTCQKGNIKCNICI
>Protein:HA|Subtype:H3N2|Blocksize:8|String:4
xxxxxxxxxxxxxxx GIRCVCRDNWRGSNRPIVxxxxxxxxxSSYMCSGLVGDxxxxxxxxxxxxxxxxxxxxxxxxxxxxQGVKGWAFDNENDVWMGRTIGExSRSGYETFRV
IxxxxxxxxQVNRQVIVxxxxMSGYSGIFSVENKSCxxxxxxxxxxxxxxxxxxxxRVWWTSNSxxxxxxxxxxxxxxxxSWPDGADLGLMGRTRISxx
>Protein:NA|Subtype:H3N2|Blocksize:8|String:4
xxxxxxxxxxxxxMNPNQRIITxxxxxxxx

```
xxxxxxxxxxIGSCESKCHTEKGSxxxxRPFQNISRVSxGECPKYVKQGSLRLATGxxxxxxxxxxxxxxxxxxxxxxxxxxxxxxxxxxxxxxxxx
xxTQAAINQINGKLxRLIEKTNDKYHQIEKxFEQVEGRTQDLERYVEDTKIxxxxxxxxxxHTIDVADSEMNRLFERVRRxxxxxxxxx
xGCFEIFHRCDNKCIESIRNGTYDHNVYRDEAINSRFQIQGVRLTQGYKDIILWFSxVTTRQASPSCLVxxALLLAFVLWACQTGNIRCQx
xx
>Protein:HA >Protein:HA|Subtype:H5|Blocksize:8|String:3
xxxxxxxxxxxxxxxxxSDHICIGYxYHANN LLILWGIHHSNDxxxxxxxxxTYISIGTSTLNQRSxxxxxxKINGQSGRxxxxxxxxxxIHFESNGNFITPEYAYKIVKEGDSxxxxxxxxx
xCNTRCQTPPMGAINSSMSSMPFHNVHPLTIGECPKYVKSDKLVLATGLRNTxxxxxxRKKRGLFGAAIAGFIEGGWQGMIDGWYG
YHHNNEQGSGYAADQESTQKAINGVTNKVNSIINKMNTQFEAIGREFNNLEKRIENLNKxxxxxxxxxxxxxxxxxxDFHDSNVRN
LYDKVRLQLKDNAKELGxGCFEFY GFSFKYGNGVWIGRTKSTNSRSGFEMIWDPNGWxxxxxxxxxxxxxxxITDWSGYSGSFVQHPELTGLDCIRPCFWVELIRGRPKExTIWTS
GSSISFCGVNSIFLWCKIVTTVGWSWPDGAELPFTIDKY STQKAIDGITNxxNSIIDKMNxxxxxxxxxxxxxxxxxxxxxxxxxxxxxxxxxxxxxxxxxDVWTYNAELLVLMENERTLDFHDSNVKNLYDKVRLQLRDNAKEL
GNGCFEFYHKCDNECMESVRNGTYDYxxxxxxxxxxxxxxxxxxxxxxxxxxxxxxxxxxxYQILSIYSTVASSLALAIMIAGLSFWMCSNGSLQCRICI
>Protein:HA|Subtype:H5N2|Blocksize:8|String:2
xxxxxxxxxxx

```
CVCRDNWKGSNRPVKLDINMADxxxxSSYVCSGLVGDTPRNDDSxSSSNCRDPNNERGNPGVKGWAFDNxDDVWMGRTISKDSRSG
YETFRVI ANDLGNGCFEFWHKCDNECxxSVKNGTYDYPKYQxxxxxxxxxxxxxxxxLGVYQILAIYSTVSSSLVLVGLIxxxxxWMCSNGSMQCRICIGS >Protein:HA|Subtype:H6|Blocksize:8|String

```
xxxxxxxxxxxLPFQNINSxxVGKCPRYVKQxSLLLATGMRNVPExxTHKQLTHHMRKKRGLFGxxRMTRGLFGAIGLFGAIAGLFGAIA
GFI >Protein:HA|Subtype:H7N2|Bl

```
xxxxxxxxxxxxxxxGARGDKICLGxxxxxxxxxxxxxxxxxxxxxxxxxxxxxxxxxxxxxxxxxxxxxxxxxxxxxxxxxxxxxxxxxxxxxxxxxxxxxxxxxxxxQCGLLGTVTGPPQCDQFLEFAxxxIIER
REGSDVCYPGKFVNEESLRQVLRRSGGISKEx xxxxxxxxxxSVSLTIAIVCFLM xxxxxxxxIDGWYGFKHQNAQGExxxxxxKSTQSAINQITGKLNRFIEKTNQQxxLIDNEFNEVEKQIxxxINWTRDSVTELWSYNAELxxxx
xxxxxxxLANSEMNKLHERVRKxxxxxxxxxxxxxxxxxxxxQCMASIRNNTYDHNKYRAESLQNRIRIDPVKLSGGYKDVILWFSFGASCF
LLIAIxxxxxxCVKNGNHAVHYxx
>Protein:HA|Subtype:H xxxxxxxxGVVNTALSTIALLIGIGNLVFNTVIHGxxxxxxxxxxxxxxxxxxxITYNKTVINNITNVVxxxxxxFKPSLPLCPFQGFFPFH
KDNALRLAENKDVLVTREPYISCDNxGCWSFALAQGALLGTNHSNGTIEDRTPYRSLIQFPIGTAPILGNYKEIRIAWSSSxxxxGKEWL
HVCITGNDxxxxxxxxxxxxxxxxxxxxxxxxxxxxxxxxx xxLIDGWYGYRHQNAQGEGIAxxxKSTQSAINQITGKLNRLIERTNQQFELIDNKFxEIEQQIGNVINWTRDSLTEIWSYNAEFLVAVENQ
HTIDLTNSEMNKLYERVKRQLRENAEEDGNGCFEI xNPNQKLFTLSGVAIALSILNLLIGISNIGLNVSLHLRxxxxxxxxxxxxxxxxxxxxxxxxxENKYVNNTTIxxxxxxxxGYLLLNKSLCSVEGWVV
IEKDNAVRFGESEQIVVTREPYVSCDPSGCRMYALHQGxxxxNKHSNGTTHDRTAFRGLISTHLGxxxxSNSDFLCVGWSSTSCHDGVG
RMTICVQGNNNNATATVYYNKRLTTTIKTWAKNILRTQDSECVSHNGTWAVVMTDGPASSQAHTKxxxxxxxxLRGSARHIEE
WSCYGHSxxITCVCRDNxxxxxPIIEIDMT >Protein:HA|Subtype:H8|Blocksize:8|String:3
xxxxxxxMLLMSTNAYDRxxxxxxNNSTDTVDTLIEQN

```
xxxxxxxxxDKIDDQIQNIWAYNAELLVLLGNQKTLDEHEANVNNLYNKRxxxxxxxEDGNGCFELYHRCDDxCMATIRNGTYDxxxx
xxxxxxxxxxEGIYKILTIYSTAASSLVxxxxxAAFMFWAMSxxxxxxxxxx
>Protein:HA|

FGTCPKYxxxKSLKLAIGLRNVxxxxxxxxxxxxGFIEGGWPGLVAGWYGFQHSNAQGTGMAADxxxxxxxxxxxxxxxKVNNIIDKxxxxxxxxxx
xxxxxxxxxxxxxDKIDDQIQNIWAYNAELLVLLGNQKTLDEHEANVNNLYKKVKxxxxxxxEDGNGCFELYHRCDDxCMATIRNGTYDx
xxxxxxxxxxxxxxxxxFEGTYKILTI SNRPVxxxxxxxxxxYLCSGLVGDTPRSxxxxxxxxxxxxxxxxxxxSGVKGWAFxxxxDVWMGRTIxxxxxxxxxxxxxxxxxxxxxxxxxxxxxxxxxxx
xxxxxxxxxxxxxCVNRCFYVELVRGRPxxxKVWW >Protein:M1|Subtype:N/A|Blocksize:8|String:4
xxxxxxxxxxxxxxxxxxxxxEIAQ xxxxxxxxMSDIEIMASQGTKRSHEQMETGGxxRQNANEIRASVGKMISGIGRFYIxMCTELKLNDHEGRLIQNSMTIERMxxxxxxxxxK
YLEEHPNAGKDPKKTGGPIYKKxxxxxxRELILHDKEEIMRIWRQANNGEEAxAGLTHMMIWHSNLxxxxxxxxxxxxxxxxxxxxxxxxx
xxxxxAGAAVKGIGTMVMELIRMVKRGINDRxxWRGENGRKTRSAYERMCNxxxKGKFQTAAQRAMMDQVREGRNPGNAEIEDLIFS
ARSALILILRGSIAHKSCLPACIYGL MENFVRQCFNPMVVELAEKTMKEYGExxxVETNKFAAICTHMEVCFMYSDFHFINEQxxxxxxxDSNALLKHRxxIIEGRDRIMAWTV
VNSLCxxxxxxKPRFLPDLYDYKEDRFVEIGVTRREIHIYYLEKASKIKSENTHIHIFSFNGEEMATKxDYTIDEESRARxxxxxLFTIRQELA
SRSLWDSFRQSERGEDTIEERFExxxxxxKLADQSLPPNFSCxxNFRVYVDGFEPNGYIEGKLSQMSREVxxxxxxxxxxxxxxxxxCHQ
RSKFLLMDSLKLSIEDPNHNHE DMTKExxxxxxETWPVGESPKGMEEGSIGKxxxxxxxxxFNSLYASSQLxxxxxxSRKLLLITQALRDxxxxxxxxxxxxxxxxxxxxxxxxxxxxxxS
WFNSFLKHxxxxxxxxx
>Protein:PB1|Subtype:N/A|

```
xxxxPTLLFLKMPPVQNAISTxxxxxxxxxxxxxxxxxxxxxxxxHQYSEKGRWxxNTETKAPQLNPIDGPLPDDNDPSGYAQxxxxEAMAFL
ENSHPGIFENSCIETMExxxxxxxxxxxxxxxxxxxxxxxxxxxxxxxxxxxxxNTIEVFKSNxxxxxxxxxxIDFLKDVVxxxxxxEIITHFQRKRRVRDNITK
KMVTQRTVGKKKQxxxxSYLIRTLTLNTMxxxxxxxxxxxxxxxxxxxxxxxxxxxxxGFVYFVEILARCICEKLEQxxxxxxxxxxxxxxxxxTNSQDTE
VSxxxxxxxxxxxxxNQNQNPRMFLAMITYITRSQPKWFRNVL KVLxxxxxxxxxVMGMVGVLPDMTPxxxxxxxxxRISKMGVDEYSNAERxIVSIDRFLRVKDQQGNVLLSPEEVSEAQGTERLTITYSSPM
MWEINGPDSVLVNTYQWVIRNWExxKIQWSQNPAxLYNK

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxRTQESECQCxxxxxxxxxxxxxxxxxxxxxxxxYKYKIFKNGKxxxxxxxxxxxxxxIRHLEECS
Cxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxx
>Protein:NA|Subtype:ALL|Blocksize:9|String:5
xxxxxAKAGVKMNPN

```
>Protein:NA|Subtype:N1|Blocks xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxGFAPF
TKDNSIRLSxxxxVVWTREPYVSCSxxxxxxxxxxxxxxxxxxxxxxxxxxxxxxxxxxxxPYRTLLMSELGVPFHLGTRQVCIAWSSSSCYDGKAWLHICVT
GxxxxxxxxxxxxxxxxxxxxxxDILRTQESECVCIDGxCTVIMTDGSASGxxxxxxxxxxxxxxxxxxxxxxxxxxxxxxxxxxxIEECSCYPQSYLNVRCVCxxN
WRGSNRPIxxxxxxxxxxxxxxxxxxxxxxGLVGDTPRDxxxxxxxxxxxxxxxxxxxxGVKGWAFDYxxxxxxxxxxxRAGYETFRVxxxxxxxxxxxxxxxxxxxx
xxxxxxxxxxxxxxxxxxxxxxxxxxxxxxxVWWTANSIIVFCGTSGTYGTGTWPDGADIINFMPYISFAxx
>Protein:NA|Subtype:N2|Blocksize:9|String

```
xxxxxxxxxxxxxxxxxALIIGVGNLIFNAVIHxxxxxxxxxxxxxxxxxxxxxxxxxxxxxxxxxxxxxxxxxxxxxxxxxxxxxxxxxxxxxxxxxxDNAIRLGE
TxxxIITREPYVSCDYxHCWSFALAQGALVGTKHSNGTIEDRTPYRSLIKFPIGAAPVLGNYxxxxxxxxxxxFDGKEWMHICxxxxxxxxxxx
xxxxxxxxxxxxxxxxxxxxxxxxxxxxxxxxxxxxxxxxxxxxxxxxxxxxxxxxKNILRTQESxxxxxxx xNPNQMIITIGSASIxxxTVGLLLQIISLCSIWFSHYNQVAQxxxxxxxxxxxxNETFVNMTNVQNNYTIxxxxxxxxxxxxxxxxxx
xxxxxxxxxxxxxxxxREPFISCSVSECRTFFLxxxxxxxxxxxxxxxxxxxxxLMSCPIGVVPSPSxxxxxxxxxxxxxxxxxxxxxxxTLGITGPDTTAVAVL
KYNGVIxxxxxxxxxxxxxxxxxxxxxxxxxTLITDGPSNA xxxxQKIITIGSMSLALxxxxxxxxxxxxxxxxxxxxxxxxxxxxxxxxxxxxxxxxxxxxxxxxxxxxxxxxxTTEVYSETVRVETxVIPVNNTIYxxxxxxxxxKFLNNTEPLCDVSGFAIISKDN
GIRIxxxxxxxxEPFVACGPSECRTxxxxxxxxxxxxxxxxxxxxxxxxxxxxxxxxxxxxxxxxxxxxxxMSVPLGSSSNAYQAKxESIAWSATACHDGKEWMxxGVSGTDDD
AYxxxxYGGVPTDVIRSWRKQILxxQESSCVCMNGxxxxVMTDGPANKQASYKIFKSRxxxxxxxEVSFRGGHIEECSCYPNLGQVECVC
RDNxxxxxxxxxxxxxYDVGYLCAGIxTDTPRVQDDxxxxxAIGG

```
SGPNDNASAVVWYxxxxxIEIPSWAGNVLRxxxSECVCHNGVCPVVxTDGPANNKAxxxxxxxxxxxxxxxxxxxGKAQHIEECxxxxxxxxxxx
xxxxxKGANRPVIIIDxxxMTHSSKYLCSRVLTDTSRPxxxxxxxxxxxxGGTPDPGVKGFAFLDRxxxLGRTISKDTRSGYEMLKxxxxxxxxx
xxxxxxxxIVDNQNWSGYSGAFVDYWxxxxxxxxxxVELIRGRPGENSVLWTSNSMVALCGSKKRLGSWSWHxxxxxxxx
>Protein:NA|Subtype:N6|Blocksize:9|String:5
xxxxxxx CYGxxxKITCVCRDNWxxANRPVIEINMxxxxHTSRYMCTGVLTDTSRPGDRxxxxSNPITGSPSAPGxxxxxxxNNTWLGRTISPRLRSG
FEMLKIHNxxxxxxxxxxxxxxxxxxxxxxxxxxxxxxxxxxxxxxxxxxxxxxxxSACYNPCFYVxxxxxE Fxxxxxxxxxxxxxx FGFRQGSDVWxxxxxxxxxxxxxxxxxxxxxxxxxxxxxxxxxxxxxxxxDNPNWSGYSGSFTLPVEMxxxSCLVPCFWVxxxxxxxx
xxTVWTSSSSIVMCGVDY

```
xxxxxxxxxxxxxxxxxxxxxxTMTHTHTSQYIxxxxxDNPRPNDPVxxxxDPYPGNNNGVKGFxxxxxxxTWLGRTISIASRYGYEMLKVPNA
LTDNRSKPxQGQIIVLNTDWxxxxGSFIDYW TKLPFQNLxxxxxGQCPKYVNQRSLMLATGMxxxxxxxxxxxxxxxxxxxxxxxxxxxxDQGTGQAADYESTQxAVDQITGKLNxxx
xxxxxxxxESEFNEIEYQIGNVxxxxxxxxxYNAELLVAMExxxTIEMTDSEMLNLYxxxxxxxxxxxxxxxGCFEIYHNCxxSCMERIRNN
TYDHAQYREEALLNRLSINSVKLSSGYKNxxxxxxxxxxxxxxxxxxxFFCLKDGNMxxxxxxxxx
>Protein:HA|Sub

```
xxxxxxxxxxxxSLDKICLGHHAIPNGTVVKTLTNEHEEVTNATETVESRxxxxxxxxYKDLDNCHPIGMLIGAPACDLHLTGKWDTL
IERENSIAYCYPGSTVNEEALRxxxMESGGIDKVSTxFTYESSINPAGxxxxxxGRNSFYAELKWLVSKNKGQSFPQTTNTYRNTDPxEH
LIMWGIHHPSSTKEKNELYGTQSLSIS

```
>Protein:NA|Subtype:H10N7|Blocksize:9|String:4 xxxxxxxxxxxADEICIGHLSNNSTERVDTIIESNITVTSSVELxxxHTGTFCSINGKAPISLGGCSFAGWILGNPRCDNLIGKTSWSYIV
EKSNPINGICYPGTLGxxxxxxxxxxxxxxxxxxxxxxxxxxxxxxxxxxxxxxxxxxxxxxSFFRNMIWLIYQ EGIGIAADRDSTQRAIDNMQNKxNNVIDKMNNQFxxxxxEFSEVETRINTINSKIDDQVTDIWAYNAxxxxxxxxxxxxxxxxxxxNVRNLHDRIR
RVLKENAIDNGDGCFEILHRCNDxxxxTIRTGTYNHREYEDESRIERQKIxxxxxxxxxxxxxxxxxxxxxxxxxxxxxxxxxxxxxxxxxxxxxx
>Protein:HA|Subtype:H12|Blocksize:9|String:4
MEKFIVLSVxxxxxxxxxxxxxxxxx xxxxxxxxxxxxxADKICVGYLSTNSTEKVDTLLENNVPVTSSVDLIETTHTGTYCSLGGxSPVHLGDCNFEGWIVGNxxxxxGTREW
SYLIEDPAAPHGLCYPxxxxxxxxxxGIKSFSRTQLI VKGEYNNTTGRDVLVLWGIHHPDTEATATNLYVNKNPYTLVSTKEWSKRYELEIGTRIGDGQRSWMKLYWHLMRPGERITFESNGG
LLAPRYGYIIEKYGTGRIFQSGVRMAKCNT >Protein:HA|Subtype:H1|Blocksize:9|String:1
KQGKTKATKMKAILVVxxxxxxxxx xxxxxxxxxxxxxxxxxxxxxxxxxxxxxxxxxYNAKLLVLLENDKTLDxxxxxxxxxxxxxxxxxxxxxxxxxxGNGCFELLHxxxxxxxxxxxxxxxxxxxxxxxxxxxxxxxxx
xxxxxxxxxxxLSIYSSVASxxxxxxxxxxxxxxxxxxxxxxxQCRICILDQNFRNIRK
>Protein:HA|Subtype:H1N1|Bl xxxxxxxxxxxIIIVVLLLYTxxxxxxxxxxxDTVDTVLERNVTVTHSVxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxQLSSVSSFKRFEIxxxxxxxxxxxxxxxxxxxxxxxxxxxxxxxxxxxxxxxxxxxxxxxxxxxVLVIWGIHHPxxxxxxx
xxxxxxxxxxxxxxxxxxxxxxxxxxxxxxxGRMNYYWTIxxxxDTIIFEATGNLL

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxYSKD
NSVRIGSKGDVxxxxxxISCSHLECKTFFLTQGAxxxDRHSNGTIKDRSPFRALxxxxxxxxxxxxxxxxxxxxxxSASACHDGVxxxxxxxxxxxxxxxx
xxLKYNGIITETIKSWxxxxxxTQESECACINGSCxxxxxxxxxxxxxxxxxxxxxxxxxxxxxxxxxxxxxxx xxxxxxxxxxxxxxxxTLCICYHANxxxxxxxxxxxxxxxxxxKNVTVTHAVxxxxxxxxxxxxxxxxxxxxxxxxxxxxxxxVVGWISGNPxxxxxxxxxxxxxxxxxxxxxxxx
xxxxxxxYEELREQMSxxxxxxxxxxxxxxx xxxxxxxxxxxxxxxxxxxxxxxxxxxxxxxxxxxxxGSHGVKGWAFDExxxxxxxxxxxxxxxxxSGYETFRVTxxxxxxxxxxxxxxxxxxxxxxxxxxxxxWSGYSGVFSxxx
xxxxxx

```
xxxxxxxxxxxxxxxxxxxxxxxDQICVGYHANNSTERVDTxxxxxVTVTHAEDILEKAHNGKLCRLNGVPPLELGDCxxxxxxLGNPECDLFLxxx
EWSYIMEKKxxxxxxxxxxxxxxxxxxxxxxxx KCQTPLGxxxxxxxxxHPLTMGECPKYVKSDRLVLATGLRNAHKMESRGLFGAxxxxxxxxxxxxxxxxxxxxxxxxDKESTQKAIxx
xxxENSVIEKMNIQFEAVEKEFSNLEKRLENLNKKVEDGFLDVWTYNTELxxxENERTLGFHDSNVKNLYNKVRMQLRDNAKELGN
GCFxxxxxxxCMSSVKNGTYN VCITGDDKNATASFVYDxxxxDSIGSWSHNILRTQESECVCISGICTVVMTDGxxxxKADTRILFVKEGKIVHIGPLSGSAQHIEECSCYPQ
YPDVRCVCRDNWRGSNRPVLDISME xxxx DQIxxxxxxIKKTNEKFHQxxxxxxxxEKYVEDTKVDLWSYNAELLIALENQHTIHLTDSEMNKLFEKTRRQLRENAEDLGNGCF
KIYHKCDNSCIGSIRNETYDHDxYRNEALNNRFQxxxxxxEYKDWIL VCRDNWRGSNRPIVDxxxxxxxSSYMCSGLVGDTxxxxxxxxxxxxxxxxxxxxxxxQGVKGWAFDNENDVWMGRTIGxxRSGYETFRVIxx
xxxxxxxxxxxxxxxxxxxxxxMSGYSGIFSVENKNCINRCFYVxxxxxxxxxxxRVWWTSNSIxxxxxxxxxxTGSWPDGANIKSHAYISFxxx
>Protein:NA|Subtype:H3N2|Blocksize:9|String:4
xxxxxxMNP xxxxxxxIGSCESKCHTEKGSxxxxKPFQNVSRIAxGECPKYVKQGSLRLATGMRNIxxxxxxxxxxxxxxxxxxxxxxxxxxxxxxxxxxxxxxx
KSTQAAIDKINGKLNRLIEKTNDKYHQIEKEFEQVEGRTQDLENYVEDTKVDLWSYNAExxxxxxQHIIDVTDSEMDKLFERVRHQLR
ENAEDxxNGCFEIFHRCDNKCIES >Protein:HA|Subtype:H5|Blocksize:9|String:3
xxxxxxxxxxxxxxxxxxSDHICIGYHxxxxxxxxQVDTIMERNV

```
WGIHHxxxxxxxxxxxTYISIGTSTLNQRSxxxxxxxxxxxxxxxxxxxxxxIHFESNGNFITPEYAYKIVKEGDSxxxxxxxxxxxC
QTPIGAINSSMPSMPFHNVHPLTIGECPKYVKSDKL

```
KYGNGVWIGRTKSTxSRSGFEMIWDPNGWxxxxxxxxxxxITDWSGYSGSFVQHPELTGLDCIRPCFWVELIRGRPKExTIWTSGSSIS
FCGVNxIFLWCKIVTTVGWSWPDGAELPFTIDKS
>Protein:NA|Subtype:H5N1|Blocksize:9|String:2
xGLREQKQEFKMNPNQKIIRDITTGSICMxxxxxxxxxxxxxxxxxxxGPSHSIHTGxxxxxxxxxxxxxxxxYENTTWVNQTYxxxxxxxxxx
xxxxxxxxxxGWAVHSKDNSIRIGSRGDVFVVREPFIS TxxxxxxxxxxxxxxxxxxxxxxxxxxxxxxxxxxxxxxxxxxxxxxVWTYNAELLVLMENERTLDFHDSNVKNLYDKVRLQLRDNAKELGNGCFEFYHK
CDNECMESVRNGTYDYxxxxxxxxxxxxxxxxxxxxxxxxxxxxxxxILSIYSTVASSLALAIMIAGLSFWMCSNGSLQCRICI
>Protein:HA|Subtype:H5N2|Blocksize:9|String:2
xxxxxxxxxxxxSDQICIGYHANNSKKQIDTIMEKNVIFTHAQxxxxxxxxxxxxxxxxxxxxAGLVLGNPMCxxxxxxAPEWSYIVEKN
NPxxxxxxxxxxxxxxxxxxxxxxxxxxxxxxxxxxxxxxxxxxxxxYHTGRSSFFRNIVWLIxxxxxxxxxxxxxxxxxxxxxxxxxxxxx
xxxxxxxxGTSTLNQRLxxxIATRPQVNGQRGxxxxxxxxxxxxxxxFESTGNFIAPEYAFKIAKxxxxxxxxxxxYGNCNTKCQTPxxxxxxxxxxxx
xxxxxxxxxxxxxxxxxxxxxxxxxxxxxxxxEKRRKKRGLFGAIAGFIEGGWQGLVDGWYGYHHINGQGSGYAADRKSTQKAIDGVTxxxxxx
xxxxxxxxxxxxxxxxxxxxxxxxxxxxxxxxVWTYNTELLVLMENERTLYFHDSNVKNLYNKVRLQLKDNARELGNGCFEFYHRCDNECM
ESVKNGTYDYxxxxxxxxxxxxxxxxxxxxxxxxxxxxxxxxxxxxxxILSIYSTVSSLVLAIMVAGLSFWMCSNGSLQCRVCI
>Protein:HA|Subtype:H5N2|Blocksize:9|String:3
xxxxxxxxxxxxxxGDRICIGYHANNSTKQVDTIMEKIVTVTHAQDxxxxxxxxxxxxxxxxxxxxxxxxxxAGWLIGNPKCxxxxTPEWSYIVEKA
NPxxxxxxxxxxxxxxxxxxxxxxxxxxxxxxxxxxxxxxxxxxxxxxxxxxxxxxxxxSSFYRNVVWLIKxxxxxxxxxxxxxxxxxxxxxxxxxxxxx
xxxxxxxGTSTLNKRSxxxIATRPRVNGQSGxxxxxxxxxxxxxxxxxFIAPEYAYRIIKxxxxxxxxxxxYGNCNAKCQTPxxxxxxxxxxxxxxx
xxxxxxxxxxxxxxxxxxxxxxxxxxxxxxxxERRRKKRGLFxxxxxIEGGWQGMIDGWYGYHHTNDQGSGYAADKKSTQKAINGITxxxxxxxxxxxx
xxxxxxxxxxxxxxxxxxxxxxxxxxxxxxxxVWTYNAELFVLMENERTLDLHDSNVKNLYDKVRHQLRDNAKEMGNGCFEFYHKCNxKCMESV
RNGTYNYxxxxxxxxxxxxxxxxxxxxxxxxxxILSIYSSVASSLVLAIMMAGLSFWMCSNGSLQCTICI
>Protein:HA|Subtype:H5N2|Blocksize:9|String:4
xxxxxxxxxxxxxSDRICIGYHANNSTKQIDTIMERNVTVTHAQNxxxxxxxxxxxxxxxxxxxxxxxxxxxAGWILGNPMCxxxxxxxxWSYIVEKD
SPxxxxxxxxxxxxxxxxxxxxxxxxxxxxxxxxxxxxxxxxxxxxxxPSFFRNVVWLTKKxxxxxxxxxxxxxxxxxxxxxxxxxxxxxxxxxxxxx
xxxxxxxGTPTLNQRSxxxIAIRPKVNGQxxxxxxxxxxxxxxxxxxxPEYAYKIIKxxxxxxxxxYGNCDAKCQTPxxxxxxxxxxxxxx
xxxxxxxxxxxxxxxxxxxxxxxxxxxxxxxxETRGLFGAIAxxxxxxxxDGWYGYHHNNAQGSGYAADKDSTQKAVDGITxxxxxxxxxxx
xxxxxxxxxxxxxxxxxxxxxxxxxxxxxxxxYNAELLVLIENERTLDFHDSNVRNLYDKVRFQLKDNAKEWGNGCFEFYHKCDDVCMESVRNG
TYKYxxxxxxxxxxxxxxxxxxxxxxxxxxxxILSVYSTVASSLTLAIMIAGLFFWMCSNGSxxxxxxx
>Protein:HA|Subtype:H5N2|Blocksize:9|String:5
xxxxxxxxxxxxxxxxxSDQICIGHHANNSTEQVDTIMERNVTVTHARDxxxxxxxxxxxxxxxxxxxxxxxxxxxWSYIVEKDKPx
xxxxxxxxxxxxxxxxxxxxxxxxxxxxxxxxxxxxxxxxxxxxxxxxFFRNVVWLVKKxxxxxxxxxxxxxxxxxxxxxxxxxxxxxx
xxxxGTSTLNHRSxxxIATRSKVNGQSGxxxxxxxxxxxxxxxxxxxxPEYAYKIAKxxxxxxxxxxxNEQGGGYAADKESTQRAIDGITxxxxxxxxxxx
xxxxxxxxxxxxxxxxxxxxxxxxxxxxxxxxAEFLVLMENxxxxxxxxxxxKLYDRVRLQLRNNAKELGNGxFEFYHRCDDECIESVRNGTYxxxxxxxxxxxxxxx
xxxxxxxxxxxILTIYSTVASSxxLAIIIAGLSFWxxxxxxxxxxxxxx
>Protein:NA|Subtype:H5N2|Blocksize:9|String:1
xxxxxIITIGSVSLxxxxxxxxxxxxxxxxxxxxxxxxxxxxxxxxxxxxxxxxxxxxxxxxxYRNWSKPQCQITGFAPFSKDNSIRL
SAGGDIWVTREPYVSCDxxKCYQFALGQQTTLDNKHSNGTIHDRIPHRTLLMNELGVPFHLGTKQVCIAWSSSSCHDGKAWLHVCVT
GDDRNATASxxxxxxxxxxSWSQNILRTQESECVCINxxCTVVMTDGSASGRAxxxxxxxxxxxSPLSGSAQHIEECSCYPxSYPNVRC

FIG. 77-95

VCRDNWKGSNRPVKLDINMADYxxxSSYVCSGLVGDTPRNDDSxSSSNCRDPNNERGNPGVKGWAFDNxxDVWMGRTISKDSRSGY
ETFRVIxxxxxxxxxxxxxxxxxxxxNWSGYSGIFSVExxSCINRC xxxxxxxxxxxxGRSDKICIGYHANNSTTKVDTILERNVTVTHSVELLESxxxxxxxxxxxxxxxxxxxxEGWILGNPRCDxxxxxRSWSYIVER
LxAQHGIC ENQHTIDLADSEMNKLYERVRKQLRENAEEDGTGCFEIFHKCDDxCMESIRNNTYDHxxYRTESLQNRxxxxxxxxSGYKDIILWFSFGA
SCFLLLAxxxxxxFICIKNGNMRCTICI SKSRGYKMNTQILILxxxxxxxAKGDKICLGHHAVANGTKVNTLTERGIEVVNATETVETAxxxxxxxxxxDLGQCGLLGTLIGPPQCDQ
FLEFxSDLIIERREGTDVCYPGKFTNEESLRQILRRSGGIG QSINPRAVGKCPKYVKQESLMLATGMRNVPENPKxxxxxxxxxxxxxxxxxxxxxxxxxxxxxxxxxxxxxxxxxxxxxxxNHLIGKTNQQFG
LIDNEFNxxxxxxxxxxWTRDAMTEVWSxxxxxxxxxIDLADSEMKKLYERVRxxxxxxxxxxxxxxxxxxxxxxxxxxxxxxxRNNTYDHSRYR
EEAMQNxxxxxxxxxxxxxxxxxxxxxxSCFILLAIVMGLVFMCVKNGNxxxxxxxxxxx
>Protein:NA|Subtype:H7N2|Blocksize:9|String:1
MNPNQKIITIGSVS

```
xxxxxxxxxxGSSYVCSGLxxxxPRNDDSSSNSNCRDPNDERGNPGVKGWAFDYGSDVWMGRxxxxxxxxxxTFRVIGGWATANSKSQxx
xQVMVDNNNWxxxxxxxxxxxxxxxxxLVRGRPQETGVWWTSNSIxxxxxxxxxxxxxxxxDGANINFMHx
>Protein:HA|Subtype:H7N3|Blocksize:9|String:1
SKSRGYKMNTQILVFxxxxxxxGDKICLGHHAVANGTKVNTLTERGIEVVNATETVETxxxxxxxxxxxTDLGQCGLLGTLIGPPQCD
QFLEFxxDLIIERREGxxxDVCYPGKFTNxxxLRQILRGSGGIxxxxGFTYSGIRTxxxxxxxxxxGSSFYAEMKKWLLSNSDNxxxxxxxxx
xxxxxxPALIIWGVHHSxxxxEQTKLYGSGNKLITVxSSKYQQSFTPSPGARxQVNGQSGRIDFHWLLDPNDTVTFTFNGAFIAPDRASFF
xxxxxxxxxxxxxxxxxxxxxxxGGTIVSSLPFQNINPRTVGKCPRYVKQxSLLLATGMRNVPENPKxCSPLSRCRETRGLFGAIAxxxxxxxLFG
AIAGFIENGWEGLIDGWYGFRHQNAQGEGTAADYKSTQSAIDQITGKLNRLIDKTNQQFELIDNEFNEIEQQIGNVINWTRDSMTEVW
SYNAELLVAMENQHTIDLADSEMNKLYERVRKQLRENAEEDGTGCFEIFHKCDDxCMESIRNNTYDHTQYRTESLQNRIQIDPVKLSS
GYKDIILWFSFGASCFLLLAIxxxxxFICIKNGNMRCTICI
>Protein:HA|Subtype:H7N3|Blocksize:9|String:2
xKSRGYKMNNQILILxxxxxxxxADKICLGHHAVSNGTKVDTLTEKGIEVVNATETVERxxxxxxxxxxxxxVDLGQCGLLGITGPPQCDQ
FxxxxxNLIIERREGxxDVCYPGKFVNxxxLRQILRESGGIxxxxxGFTYSGIMTxxxxxxxxxxxESSFYAEMKKWLLSNTDNxxxxxxxxxxxx
xxxxPALIIWGIHHSxxxxEQTRLYGSGNKLVTVxSSNYQQSFVPSPGARxQVNGQFGRINFHWLMLNPNDTVTFSFNGAFIAPDRVSFLxx
xxxxxxxxxxxxxxxxxxxxxGGTIISNLPFQNINSRAIGKCPRYVKxxSLLLATGMKNVPEIPKxCSPLSRCRKTRGLFGAIGLFGAIAGFxxxxx
xxIENGWEGLVDGWYGFRHQNAQGEGIAADYKSTQSAVDQITGKLNRIIEKTNQQFELIDNEFTEVEKQIGNVINWTRDAMTEIWSYN
AELLxxxxxxxIDLADSEMDKLYERVRRQLRENAEExxxxFEIFHKCDNxCMASIRNNTYDHSKYREEAMQNRIQINPVKLSSGYKEVIL
WFSFGASCFILLAIxxxxxFICVKNGNMRCTxxx
>Protein:HA|Subtype:H7N3|Blocksize:9|String:3
xxSRGYKMNTRILILxxxxxxxxICLGHHAVPNGTKVNTLAERGVEVVNATETVEQxxxxxxxxxxxxxIDLGQCGLLGTITGPPQCDLF
LEFxxDLIVERQEGxxxDVCYPGKFANxxxLRQILRRSGGIxxxxxGFTYSGMRTxxxxxxxxxxxxGPSFYAEMKKWLLSNNDNxxxxxxxxxx
xxxxxxPALIVWGIHHSxxxxEQAKLYGSGAKLITVxSSNYHQSFVPSPGVRxQVNGQTGRIDFHWLILNPNDTVTFNFNGAFIAPDRATFL
xxxxxxxxxxxxxxxxxxxxxxxGGTITSPLPFQNINPxxVGKCPRYVRQxSLMLATGMKNVPETPKxKRKRGLFGAITKPRPRRGLFGAIAGxx
xxxxxxENGWEGLINGWYGFRHQxxxxxTAADYKSTPSAIDQITGKLNRLIEKTNQQFKLIDNEFSEIEQQIGNVINWTRDSITEVWSYN
AEFLVAMExxxxIDQADSEMNKLHERVRKQLRxxxxxxxxxxxxxxxxxxxxCMASIRNSTYDHSRYREEAMQNRMQINPVKLNSGYKDVIL
WFSFGASCFLFLAIxxxxxFMCVKNGNMRxxxxx
>Protein:HA|Subtype:H7N3|Blocksize:9|String:4
xxxxxxYKMNTQILIFxxxxxxxxxICLGHHAVTNGTKVNTLTERGVEVVNATETVENxxxxxxxxxxxxxxxxxDSSFYAEMKKWLLSNADNxxxxxxxxxx
EFxxDLIVERQDGxxxDVCYPGKFSNxxxLRQVLRESGGIxxxxGFTYSEIRTxxxxxxxxxxxxGFTYSPTPSPGTRxPVNGQSGRINFHWLMLNSNDTVIFSFNGAFVAPDRVSFFxx
xxxPALIVWGVHHSxxxxEQTKLYGNGAKLIxxxSSKCQQSFTPSPGTRxPVNGQSGRINFHWLMLNSNDTVIFSFNGAFVAPDRVSFFxx
xxxxxxxxxxxxxxxxxxxxxxxxxGGTITSNLPFQNVNSRAVGRCPRYVKQxxxxxTGMRNVPEKPKxxRRRGLFGAIxxxxxxxxxxxxxxx
xxxxxxxxxLIDGWYGFKHQNAQGEGxxxYKSTQSAINQITGKLNRFIEKTNQQFEMIDNEFIEVEKQIGNVINWTRDSVTELWSYNAELLx
xxxxxxxxDLADSEMSKLYERVKRQLRENAExxxxxxxxxxxxxxxxxxxxIRNNTYDHNQYRAESLQNRIRIDPVKLSGGYKDIILWxSFGASC
FVLxxxxxxxxYICVKNGNMQCTICx
```

FIG. 77-101

```
>Protein:HA|Subtype:H7N3|Blocksize:9|String

EPGVKGFGFKVGxxxWLGRTVSINGRSGFFEVIRVTEGWIDSPNHAKSLTQTLVSNNxxxxxxxxxxxKGCFQPCFYIELIRGKPNxNDDVS
WASNSI xxxxxYKMNTQIL RSGFEMLRIPNAGIDPxxxxxxRQEIVGNDNWSGYSGSFIDYWDDxxxxxxxxxxxxxxxxxEEAKYVWWASNSLIALCxxxxPVGPGSFPDG
AQxxxxx
>Protein:NA|Subtype:H7N7|Blocksize:9|String:4

GESYGRIIQNEDIPIGSCHTKCQTYTGAINSSRPFQNASRHHMGECPKYVRKASLRLAVGLRNTPSIDPKGLFGAIxxxxxxxxxxxxx
xxxxxxxxxxQKSTQEAIEKITNKVNNxxxKMNREFEVMNHEFSxxEKRTNMINDKIDDQIEGLWAYNAELxxxLENQKTLDKHDSNVK
NLFDEVRR xxxxxxxxxxxxxxxxxxxxxxxGYLSTNSTETVYTxxxxxxxxxxxxxxxxEHNGLLCATxxxxxxxxxxxxxxxxxxVEGLIYGNPSCNxxxxxxWSYIVERP
TAxxxxxxxxxxxxxxxxxxxxxxxxxxxxxxxxxxxxxxxx >Protein:HA|Subtype:H9N2|Blocksize:9|String:3
xxxxxxxxxxxxxxxxxxxxxxxGYLSTN xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxWSKPQCLITGFAPxxxxxxR
LSAGGSIWITREPYVSCxxRCYQFALGQxxxxxxxxxxxxxxxxxxxxxxxxxxxxxxxxxxxxxxxxxxxxxxxxxxxxxxPHRTLLMSELGVPFNxxTRQVCIAWSSASCHDGRAWxxxxxxxxxxxxxx
xxxxxxxxxxxxxxxxxTILRTQESECVCISGTCAVVMxxxxxxxxxxxxxxxxxxxxxxxxxxxxGNAQHVEECSCYPQYxxxxCVYRDNWKGSNRPI
xxxxxxxxxxY

```
xxxxxxxxxxxxxxxxxxxxAEIAQRLEGVFAGKNTDLEVLMExxxxxxxxxxxxxxxxxxxxxxxxxxxxxxxxxxxxxxxxxxxxxGDPSNMDRAVKL
YKKLKREMTFHGAKEIALGYSTGALASxxxxIYNRMGTVAxxxxxxxxxxxxxEQIADSQHKSHRQMVATTNPLIRHxxxxxxxxxxxxxxxxxxxxxx
xEQAAEAMEIAxxARQMVHAMRTVGTHPxxxxxxxxDLIENL

```
xxxAAGAAVKGIGTMVMELIRMVKRGINDRNFWRGENGRKTRSAYERMCNIxxKGKFQTAAQRAMMDQVREGRNPGNAEIEDLIFSA
RSALILRLRGSVAHKSCLPACIYGLVVxSGYDFEKEGYSLVGIDPFRLLQxxxxxxSLIRPKENPAHKSQLIWMACNSAAFEDLRISxxxx
xxxxxPRGQLATRGVQIASxxxxxxxxTLELRSKY xxxxxxxxxxxxxxxxxxxxxxxxxxxxxxxxxxxxLSFQVDCFLWYVRxxxxxxxGDAPFLDRIRRDQxDRLRRDQKALKGRxxxxxxxxxxxxxxxxxxxxxxxxxxxxx
xxxxxxxxxxxxxxxxxxxxxxxxxxxxxxxxxxxxSVPASRYLTDxxxxxxxxxxxxxxxx MENFVRQCFNPMVVELAEKTMKEYGExxxxETNKLAAICTHLEICFMYSDFHFINEQxxxxxxDSNALLKHRFEIIEGRDRIxAWTVV
NSLCxxxxxxKPRFLPDLYDYKEDRFVEIGVTRREIHIYYLEKASKIKSENTHIHIFSFNGEEMATKxDYTIDEESRARIxxxRLFTIRQELAS
RSLWDSFRQSERGEDTIEERFEIxxxxxxxLANQSLPPNFSCxxNFRVYVDG MIEAESSVREKDMTKEFxxxxETWPVGESPKGMEEGSIGKVxxxxxKSVFNSLYSSPQLEGFxxESRKLLLITQALRDxxxxxxxxxxxxEA
VEECLINDPxxxxxASWFNSFLKHxxxxxxxxxxxx
>Protein:PB1|Subtype:N/A|Blocksize:9|String:1
MDVNPTLLFLKxKVPAQNAISTTFPYTGDPPYSHGTGTGYTMDTVNRTHQYSEKGKWxxNTETGAPQLNPIDGPLPEDNEPSGYAQTD
CVLEAMAFLEESHPGIFENSCLETxxxVQQTRVDKLTQGRQTYDWTLNRNQPAATALANTIEVFRSNxxxxNESGRLIDFLKDVMxxxxxx
xxEITTHFQRKRRVRDNMTKKMVTQRTIGKKKQxxxxxSYLIRALTLNTMTKDAERGKLKRRAIATPGMQIRGFVYFVETLARSICEKLE
QSGLPVGGNEKKAKLANVVRKMMTNSQDTELSFTITGDNTKWNENQNPRMFLFLAMITYITRxQPEWFRNILSMAPIMFSNKMARLG
KGYMFESKSMxxxxxxxxxxxxxxxxxxxxxxxxKIEKIEKIRPLxxxGTASLSPGMMMGMFNMLSTVLGVSILNLGQKRYTxTTYWWDGLQ
SSDDFALIVNAPxxxGIQAGVDRFYRTCKLVGINMSKKKSYINRTGTFEFTSFFYRYGFVANFSMELPSFGVSGINESADMSIGVTVIKN
NMINNDLGPATAQMALQLFIKDYRYTYRCHRGDTQIQTRRSFELKxxxxxxxxxxGLLVSDGGPNLYNIRNLHIPEVCLKWELMDxxYQG
RLCNPLNPFVSHVGTRWMKIIRVGCVILLNPFVSHKxxxxxxxxxxxxxxxxxxxMEYDAVATTHSWIPKRNRSILNTSQRGRSGQNHGICAV
ATTHSWVPILNTSQRGILEDEQMYQKCCNLFEKFFPSSSYRRPVGISSMVEAMVSRARIDARIDFESGRIGKKEEFSEIxxxxxxxEELRRQ
KSLIWLWLVLREKMP
>Protein:PB1|Subtype:N/A|Blocksize:9|String:2
xxVNPTLLFLExKIPAQNAISTxxxxxxxxxxxxxxxTGYTMDTVSRTHQYSEKGRWxxNSETGAPQLNPVDxxxxxDNEPTGYAQTDCVLEA
MALLEESHPGLFENSCLETxxxIQQTRVDKLTQGRQTFDWTLNRNQxxxTALANTIEIFRSNxxxxSESGRLIDFLKDVIxxxxxxxxEVTTHF
QRKRRIRDNMTKKMITQRTIGKKKHxxxxxGYLIRALTLxxxxxxxxxxxxxxxxxxxxxGMQIRGFVHFVEALARSICxxxxxxxxxxxxxxxxxxxxxN
VVRKMMTSSQDTELSFTVTGDNxxWNENQNPRVFLFLTMITYITRxQPEWFRNVLSIAPIMFSNKVARLGKGYMFESKRMxxxxxxxxxx
xxxxxxxxxxxxxxxxxxxxxxxxxxxxxGAASLSPGMMxxxxxxxxxVLGVSVLNLGQKKYTxTIYWWDGLQSSDDFALILNAPxxxGIQAGVNRF
YRTCKLLGINMSKKKSYINKTGTFEFTSxxxxxxxxxxxxxxLPSFGVSGVNESADMSIGITVIKNNMIxxxxxxxxxxxxxxxxxxYRYTYRCHK
GDTQIQTKRSFELKxxxxxxxxxxGLLISDGGPNLYxIRNLHIPEAGLKWELMxxxYRGRLCNPLNPFVNHxxxxxxxxxxxxxxxxxxxxxxxxxxx
xxxxxxxxxxxxxxxxIEYDAVATTHSWVPKRNRSILNSNAITRSGQNHGIxxxxxxxxxxxILNTSQRGVLEDEQMYQRCCNLFEKFxPSSSYRR
PIGISSMVEAMISRARIDARVDFESGRIGKKEFSEIMxxxxxxxEELRRQKWWVWLWLVLRExxx
>Protein:PB1|Subtype:N/A|Blocksize:9|String:3
xxxINPTLLFLKVPAQxxxxxxxxxxxxxxxxxxxxxxxxxxxxxxNRTHQYSERGRWxxNTEIGAPQLNPIDGPLPKNNEPSGYAQxxxxLEAMAFL
EKSHPGIFESSCLETxxxVQQTRVDRLTQGRQTYxxxxxxxxxxxxxxANTIEVFRLNxxxxNESGRLMDFLKDVMxxxxxxxxEIVTHFQRKRR
VRDNVTKRMVTQRTIGKRKQxxxxxNYLIRALTLxxxxxxxxxxxxxxxxxxxxxxxxxRGFVYFVEALARRICEKLEQSxxxxxxxxxxxxxxxxVRK
MMTNSHDTEISFTITGDNxxWNENQNPRIFLxLAMITYITKxQPGWFRNVLSVAPIMFSNKMARLGRGYMFESKNMxxxxxxxxxxxxxxxx
xxxxxxxxxxxxxxxxxxxxxxxGTVSLSPGMMMxxxxxxxxxxxVSILNLGQRKYTxTSYWWDGLQSxxDFALIVNASxxxGVQAGVDRFYRICK
LVGINMSKRKSYINxxxxxxxxxxxxxxxxxxxxxxxxxxxxxxxxxxxxxADMSIGVAVIKNNMVNNxxxxxxxxxxxxxxxxxxxxxTYRCHRGDMQIQTR
RAFELKxxxxxxxxxxGLLVADGGPNLYNxxxxxIPEVCLKWDLMDxxYKGRLCNPLNPFVTHxxxxxxxxxxxxxxxxxxxxxxxxxxxxxxxxxxxxxx
xxxxxxVEYDAVATTHSWTPKRNRSILxxxxxxxxxxxxxxxxxxxxxxxxxxxxxxxxKGILEDEQMYQKCCSLFEKFFPSxxxxRPVGISSMGEAMV
SRARIDARVDSESGRIxxxxxxxxxxxxxxxxxxxxxxxxxxxxxxxxxxxxxx
>Protein:PB1|Subtype:N/A|Blocksize:9|String:4

FIG. 77-114 xxxNPTLFLFLKIPAQxxxxxxxxxxxxxxxxxxxxxxxxxxxxxxxxxTHQYSERGKWxxNTETKAPQLNPIDGPLPDDNDPSGYAQTDxxLEAMAFL
ENSHPGIFENSCIETxxxxxxxxxxxxxxxxxxxxxxxxxxxxxxxxxxxxxxxANTIEVFKSNxxxxxxxLIDFLKDVVxxxxxxxEIITHFQRKRRVRDNITRK
MVTQRTVGKKKQxxxxxSYLIRTLTLNTMTxxxxxxxxxxxxxxxxxxxxxxxxxRGFVYFVEILARCICEKLEQSxxxxxxxxxxxxxxxxxxxxxTNSQDTEI
SFTIxxxxxxNQNQNPRMFLAM

```
xxxxxxxxxxxxxxxxxxxxxxxxxxxxxxxxRISKMGVDEYSNAERxIVSIDRFLRVKDQOGNVLLSPEEVSEAQGTERLTITYSSSLMWEINGPES
VLINTYQWIIRxxxxxKIQWSQNPAxLYNK

```
KQGKTKATKMKxxxIFIFILLTHWAxxxxxxSQITNGTTGNPIICLGxxxxxxxxxxxxxxxxxxxxxxxxxxxxxGVIPLTTTPTKSYFANLKGTRxxxxx
xxxxxxxxxxxxxxxxxxxxxxxxxxxxxxxxxxxxxxxxxxxxxxxxxxxxxxxxxxxxxxxIMHDRTKIRQLxxxxxxxxxxxxxxxxxxxxxxxxxxxxxxxxxxxxxxxxxxxxxxxxx
xxxxxxxxxxxxxxxxxxEKENSYPMINLTVEVPYVCTxxxxxxxxxxxxxxxxxxxxxxxxxxxxxxxxxxxxxxGVTTHYVSQIxxxxxxDEGLPQSGRIVVDYxx
xxxxxxxxxxxxxxxxxxxxxxxxxxxxxxxxxxxxxAPSGIEYNGKSLGIQSDxxxxxxxxxPSVKLPMGAIGAIDSSMPFxxxxGEHAKAIGNCxxxxxxxxxxx
xxxxxPAKLLKERGFFGARRQKRGLFGAIAHMRKKRGLFGAIRMTRGLFGAIAGxxxxxLFGAIAGFIEGGWxxxxxGRLVRFRHQNSx
xxxxxxxxxxxxxxxxxxxLPTFDSLNITAASLNDDGxxxxxxxxxxxxxxxxxxxxxxV

```
>Protein:NA|Subtype:N1|Blocksize:10|String:4
xxxxQKQEIKMNPNQK xxxxxxxxxxxxxxxxxxxxxxxxxxxxxxxxxxxxxxxxxxxxxxxxxxxxxxxxxxxxxxxxxVPLVPCEPIIIExxxxxxxxxxxxxxxxxxxxxxxxxxxxxxxxxxxxxxxxxxxxxxxxGFAP
FTKDNSIRLSAxxxVWVTREPYVSxxxxxxxxxxxxxxDILRTQESECxxxxxxxxxxxxxxxxxxxxxxPYRTLLMSELGVPFHLATKQVCVAWSSSSCHDGNAWLHxxx
xxxxxxxxxxxxxxxxxxxxxxxxxxxxxxxxxSGLVGDTPRDxxxxxxxxxxxxxxxxxxxxxCTVIMTDGSASxxxxxxxxxxxxxxxxxxxxxxxxHIEECSCYPQxxxxIRCVCRDNW
KxxxxxxxxxxxxxxxxxxxxxxxxxxxxxxxxxxxxxxxxxWTSNSIIAFCGTSGTYGTGTWP xxxxxxxxxxxxxxxxxxxxxGNLIFNAVIHxxxxxxxxxxxxxxxxxxxxxxxxxxxxxxxxxxxxxxxxxxxxxxxxxxxxxxxxxxxKDNAIRLGE
TxxIITREPYVSCDYxHCWSFALAQGALVGTKHSNGTIEDRTPYRSLIKFPIGxxxxxxxxxxxxxxxxxCFDGKEWMHICxxxxxxxxxxxxx
xxxxxxxxxxxxxxxxxxxxxxxxxxxxxxxxxxxxxxx xNPNQKIVTIGSxxxxxTTVGLLLQIISLCSIWFSHYNQITQTxxxxxxxxxxYNETFVNVTHVQNNYTTVxxxxxxxxxxxxxxxxxxxxxxxxxx
xxxxxxxxxxxx xxxNQKIMTIGSVSLAxxxxxxxxxxxxxxxxxxxxxxxxxxxxxxxxxxxxTTEVYSETVRVxxxxxxxxxxxxxxxxxxxxxxKFLNNTEPLCDVSGFAIFSKDNG
IRIGxxxxxxxREPFVACGPSECRTFxxxxxxxxxxxxxxxxxxxxxxxxxxxxLMSVPLGSSSNAYQAKFESIAWSATACHDGKEWMxxGVSGTDDD
AYAxxHYGGVPTDVIRSWR MSGPNDNASAVVWYxxxxxTEIPTWAGNIxxxxTEIPTWAGNIxxxxESECVCHNGVCPVVxxxxxxxxxxxxxxxxxxxxxxxxxxGTAQHIEECSxxxxxxxIKCICR
DNWRGANRPVITIDxxxMTHSSKYLCSRVLTDTSRPxxxxxxxxxxGGNPDPGVKGFAFLDRxxxWLGRTISKDTRSGYEMLKVxxxxxxx
xxxxxxxxxxIVDNQNWSGYSGVxxxxxxxxxxYVEL CYGHDxKITCVCRDNWQGANRPVIKIDMxxxxxxxxxxGVLTDTSRPGDRxxxxCSNPITGSPSAPGIKGFGFLxxNNTWLGRTISPRLRS
GFEMLKIPNAETDP WVMTDGPANNQAxxxxxxxxxxxxxxxFNEGHIEECSCYPNEGKVECICRDxWTGTNRPVVxxxLSYQVGYLCAGxPSDTPRGEDN
QFxxxxxxxxxxxxxGFGFRQGSDVWxxxxxxxxxxxxxxxxxxxxxxxxxxxxxxxDNPNWSGYSGSFTLPVEMxxxSCLVPCFWVETIRG
KPEExAIWTSSSSIVMCGVDYxxASWSWHDGAVLxxxxxxxxx
>Protein:NA|Subtype:N8|Blocksize:10|String:5
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxx SxxxxGPNNNASPVIxxxKRPVTEINTWxxxxxxxQESECVCHDGVCPVVFxxxSATGPADTRVYFxxxxxxxxxxxxHIEECSCYGKxxxx
xxxxxxxxxxxxxxxxxxTMTHTSQYICxxxxTDNPRPNDPVxxxxNDPYPGNSNNGVKGFSYxxxxNTWVGRTISIASRSGYEILKVPNALT
DDKSKPxQGQIIVLNTDWSxxSGSFIDYWAEGxxxxxxxxxxxIRGRPKEDEVWWTSNSIVxxxxxxxxxxxDWPDGAKIKYFL
>Protein:NA|Subtype:N9|Blocksize:10|String:5
xNPNQKIQCTSATxxxxxxxxxxxxxxxxxxxxxxxxxxxxxxxxxxxxxxxxQTIINNY

```
LSxxxxxxxxxxRSLMLATGMRxxxxxxxxxxxxxxxxxxxxxxxxxxxxxxQNAQGTGLAADYESTQAAIVQITGKLNRLxxxxxxxxxIES
EFNEIEYQIGNVINWTxxxxxxxTYNAELLVAMxxQHTIDLADSEMLNLYDxxxxxxxxxxxxxxxxxxxxxxxNCMERIRNNTYDHSQYRE
EALLNRLSINPVRLSSGYxxxxxxxxxxxxxxxxxxxxxxxxxxxxxxxxxxx
>Protein:HA|Subtype:H10|Blocksize:10|String:5
xxxxxxxxxxxxxxxxxxKIC >Protein:HA|Subtype:H10N7|Blocksize:10|String:4
xxxxxxxxxxSLDKICLGHHAVAN

```
GRTISxxxxxxFEMLKIPNAETDPNSxxxxxxxxxxNNKWSGYSGSFIDYWDDxSVCYNPCFYVExxxxxxxxxxxxxxxxxSLVALCGSPVSVGS
GSFPDGARIQYFS
>Protein:NA|Subt

```
xxxxxxxxxxxxxxxxxxxxxxxxxxxxxxxxxxxxxxxxxxxDIWSYNARLLVLLExxxLDLHDSNVRSLHEKxxxLKGNAKDEGNGCFPFYHKCDNKCIER
VRNGTYDHKEFEKESKLNRQEIGGVKLDxxGDVYKILSIYSCIASSLLAAIIMGxxxWACNNGSCRCTICx
>Protein:HA|Subtype:H11|Blocksize:10|String:4
xxxxxxxxxxxxxxQADEICIGYMSNNSTEKVDTIIENNVTVTSSIELVENxHTGSFCSLDGKAPISLGGCSFAGWILGNPRCDDLIEKTSWSY
IVEKSNPINGICYPGTLGxxxxxxxxxxxxxxxxxxxxxxxxxxxxxxxxxxxxSFFRNMIWLIDQSGTYPxxxxxFKNTKGRDVLxxxxxxxx
xxxxxxxxxxxxxxxxxxxxxxxxxxxxxxxxxxxxxxxxxQTGRMTFYWTMVxxxxxTFESNGALLAPRYALELVxxxxxxxxxxxxxxxxxxCQSEIG
WINTxxxxxNVHRNTIGNCPKYVNVRSLKLATGLRNIPAxxSRGLFGAKAGFIEGGWPxxxxxxxQHRNEEGTGVAADKESTQEAxxxxx
xxxxxxxxxxxxxxxxxxxxxxxxxxxxxxxxxxxxxxxxxDIWSYNAKLLVLLENEKxLDLHDSNVTNLHxxxxLQDNAKDEGNGCFTFYHKCNN
ECIEKIRNGTYDHKEFKEESRLNRQEIEGVRLDxxGNVYKILSICSCIASSLVLAALNMGxxxWACGNGSCRCTICx
>Protein:HA|Subtype:H11|Blocksize:10|String:5
xxxxxxxxxxxxxxxADEICIGHLSNNSTDKVNTIIENNVTVxxxxxxxxxxxxxxxxTGSFCSINGRAPISLGDCSxxxWILGNPMCDNLIGKTSWSYIVE
KLNPxxxxxxxxxxxxxxxxxxxxxxxxxxxxxxxxxxxxxxxxxxSFFRNMVWLVHQSGTYPxxxxxFNNIKGRDVLxxxxxxxxxxxx
xxxxxxxxxxxxxxxxxxxxxxxxxxxxxxxxxxxxxxxxxxAGRMTFYWTMxxxxxxxIFESNGAFLAPGYAFEIVSxxxxxxxxxxxxxxxxxxCQSEIGGIST xxx
xxNVHRNAIGDCPKYVNVRSLKLAIGPRNVPxxxxxxxxxxxxxxxxxxxxxxxxxxxxxxxxxIAADKESTQExxxxxxxxxxxxxxxxxx
xxxxxxxxxxxxxxxxxxxxxxxxxLWSYNAQLLVxxxxxxxDSNVRNLHERxxxLKNNAKDEGNGCFTFYHKCDDECIEKVRNGxxDHKEFE
EESRINRQEIEGVRxxxxxxxxxxxxxxxxIASSLILAALIMxxxxWVCSNGSCRCTxxx
>Protein:HA|Subtype:H12|Blocksize:10|String:1
xxxxxxxxxxxxxxxxxxxxxxFAYDKICIGYQTNNSTETVNTLIEQNVPVTQVEELVHGGIDPxxxxTELGSPLVLDDCSLEGLILGNPKCDLYLNGREW
SYIVERPKEMEGICYPGSIENQEELRSLFSSIKKYERVKMFDFTKWNVTYTGTSKACNxTSNQGSFYRSMRWLTLKSGQFPVQTDEYK
NTRDSDIxFTWAIHHPPTSDEQVxxxxxxxxxxxxxxxEINRSFKPNIGPRPLVRGQQGRMDYYWAVLKPGQTVKIQTNGNLIAPEYGHLITG
KSHGRILKNNLPxxxxxTECQLNEGVMNTSKPFQNTSKHYIGKCPKYIPSGSLKLAIGLRNVPQAQDRGLFGAIAGFIEGGWPGLVAGW
YGFQHQNAEGTGIAADRDSTQKAIDNMQNKLNNVIDKMNKQFxxxxEFSEVESRINMINSKIDDQITDIWAYNAELLVLLENQKTLDE
HDANVRNLHDRVRRxxENAIDTGDGCFEILHKCDNxxxxTIRNGTYNHKxYEEESKIERQKINGVKLEENSTYKILSIYSSVASSLVLLL
MIIGGFIFGCQNGNVRCTFCI
>Protein:HA|Subtype:H12|Blocksize:10|String:2
xxxxxxxxxxxxxxxxxxxxxxLAYDKICIGYQTNNSTDIVNTLIEQNIPVTQVEELVHRGIDPxxxxTELGAPLVLDDCSLKGLILGNPKCDPYLNGREW
SYIVERTKEMEGICYPGSVENQEELRSLFSSIKRYERVKMFDFSKWNVTYTGTSRACNxISNQGSFYRNMRWLTLKSEQFPVQTDEYK
NTGDSDIxFMWAIHHPPTSNEQVxxxxxxxxxxxxxxxEINRSFRPNIGPRPLVMGQQGRMDYYWAILKPGQTVKIKTNGNLIAPEYGYLIT
GKSHGRVLKNNLPxxxxxTGCQLNEGVMNTSKPLQNTSKHYIGKCPRYIPSGSLKLAIGPRNVPQAQNRGLFGAIAGFIEGRWPGLVAG
WYGFQHQNSEGTGIAADRGSTQKAIDNMQNRLNNVIDKMNNQFxxxxxEFSKVETRINMINSKINDQITDIWAYNAELIVLLENQKTLx
xHDANVRNLHERIRRxxxENAIDAGDGCFEILHRCDDxxxxTIKNGTYNHQxYEEESKLERQKVNGVKLEENSxxxxxxxxSVASSLVLLF
MIIGGFIFGCQNGNIRCTFCI
>Protein:HA|Subtype:H12|Blocksize:10|String:3
```

FIG. 77-132 xxxxxxxxxxxxxxVAYDKICIGYxxxNSTETVNTLSEQNVPVTQVEELVHGQVNPxxxxTKLGSPLVLDDCSLEGIILGNPKCDLYLSGREWS
YIVERPKEIEGICYPGSIKNQEELRSLFxxxxxYERVKMFDFIKWNVTYTGTxxxxxTSNRGSFYRSMRWLTLKLGQFPVQTDEYKNTRD
SNIxFIWAIHHPPTSAEQVxxxxxxxxxxxxEINRI RxxxxNAVDEGNGCFELLHKCNNSCMETIRNGTYDHTEYEEESKLKRQEINGIKLKSDDSVYKALSIYSCIASSIVLVGLILSFIMWACS
NGSCRFxxxx
>Protein:

```
xxxxxxxxxGSEHTAYSQITNxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxFSRLNWLTKETNGNYGPINxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx
xx
>Protein:HA|Subtype:H15|Blocksize:10|String:1
MNTQIIVLVLGLSMVKSDK xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxx >Protein:HA|Subtype:H16|Blocksize:10|String:1
QPNDGQVLYFLxxxxGRYSKADKICIG xxxxxxxxxSRYSKADKICxxYLSNNSTDKIDTLTETGVPxxxxxxxxxxxxxxxxxxxxxxxxxxxxxxxxxxxxxxDPNA
PHKLCYPGEVDNNG >Protein:HA|Subtype:H1|Blocksize:10|String:5
xxxxxxxxxxxxxxxxxxxxxxxxxxxxxxxxxxxxxxxxxxxxxxxxxxxxxxx xxxxITIGKCSKYVKSTQLRMATGLRNVPSVQSRGLFGAIxxxxxxxxxxxxxxxxxxxxEQGSGYAADQxxxxxxxxxxxxNKVNTVIEKMNIQF
TSVGKEFNxxxxRIENLNRKVDDGFLDxxxxxxxxxxxNERTLDFHDFxxxxxxxxxxxxxxxxxxxxxCFEFYHKCNNxxMESVKNGTYNYP
KYSEESRLxxxxxxxx

```
RDNWHGSNRPWISFDQNLxxxVGYICSGVFGDNPRSxxxxxxxxxxxxxxxxGAYGVKGFSFRYGNGVWIGRTKSTxxxxxxxxxxxxxxxxxxxxxxxxxxxx
xxxxxxxxTNWSGYSGSFVQHPELTGMDCIxxxxxxxxxxxxxxxxxTIWTSASSISFCGVNxxxxxxWPDGAELPFAIxxx
>Protein:NA|Subtype:H1N1|Blocksize:10|String:5 xxxxxxxxxxxxxxxxxxxxxxxxxxxxxxxxxxxxxxxx

YNAEMLxxxxNERTLDFHDFNVxxxxxxxxxxxxNNAREIGNGCFEFYHKCNDxCMESIKNGTYxxxxxxxxxxxxxxxxxxxxxxxxxxxxxxxxxxxx
xxxxxxxxxxxxxxSFWMCPNGSLQCKxxx
>Protein:HA|Subtype:H xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxITGFASFSKDxxIRLSAG
GAVWVTREPxxxxxxxxxxxxxxxxxxxxxxxxxxxxxxxxxxxxxxxxxxDRSPYRTLLMxxLGVPFHLGTRQVCMAWSSSxCYDGKAWLHICxxxxxxxxxxxxx
xxxxxxxxxxxxxxxxxxxxxxxxxxxxxxxxxxxICAVVMTDGSALGxxxxxxxxxxxxxxxxxxxxxxxxxxxxxxxxxEEGSVYPR

```
xxxxxxxxxxxxxxxxxxxxxxGDQICVGYHANNSTERxxxxxxNTVTHAKDILERxHNGKLCRLNGIPPLELGNCxxxxLLGNPECDLFLxxPE
WSYIMEKKxxxxxxxxxxxxxxxxxxxxxxxxxxxxxxxxxxxxxxxxxxxxxxxxxxxxxxxxxxxxxxx QTPLGAxxxxxPFHNVHPLAIGECPKYVKSERLVLATGLRNAHKMESRGLFGAIxxxxxxxxxxxxxxxxxxxxxxxxADKESTQKAIxxxx
xxxNFVIEKMNTQxxAVEKEFSNLEKRLENLNKKVEDGF VCITGDDKNATASLIYDGxxxDSISSWSQNILRTQESECVCISGTCAVVMTDGSASGKADTRILFVKEGKVVHISPLAGSAQHVEECSCY
PQYPDVRCVCRDNWRGSNRPVLDISMEDYSIDSGYVCSGLVGDTPRNNDGxSNSNCKDPNNERGTQGVKGWAFDDGNDLWMGRTI
xKESRSGYETFKxxxxxxxx GVHxxxxxxxxxxxxxxxxxxxxxxxxxxxxxxxxxxxxxxxxxxxCTGNLIAPRGxxxxxxxxxxxxxxxxxxxxxFECITPNGSIS
NDKPFQxxxxxxxxxxxxxxxxxxxxATGMRNVPETxxxxxxxxxIENGWEGMIVNGWYGFRHQNxNSEGMGQAADLKSTQAAINQIxxxxx
xxIKKTNEKFHQIxxxxxxxxxxxxLEKYVEDTKVDLWSYNADVL xxxxxxxxxxxxxxxxxxxxxxxxxxxxxxxAATLCLGHHAVPNGTIVRTITxDNIEVTNATExxxxxxxxxxxxxxxxxxxxxxxxxxxxxxxxxxxxxxLIDALLGDPHCxxxxxx
xxxxxxxxxxxxxxxxxxxxxxxxxxxxxxTLRSLVASSGNLEFxxxxxxxxxxxxxxxxxxSVYWTIVKPGDxxxxxxxxLIAPRGYFKMxxxxxxxxxxxxxxxxxxxFDKLYIWGIHHPxxxxx
xxxxxxxxxxxxxxxYVKQKTLKLATGMRNVPERQTRGIFGAIxxxIENGWEGMVNGWYGFRHQNxxSEGMGQAADLKSTQAAITQxxxxx
QNVNKxxxxxxxYVKQKTLKLATGMRNVPERQTRGIFGAIxxxIENGWEGMVNGWYGFRHQNxxSEGMGQAADLKSTQAAITQxxxxx
xxVEKTNEKFHQxxxxxxxxLEKYVEDTKVDLWSYNAEFLVALENQHTIHMTDSEMNKLFEKTxKQLRENAEEMGNGCFKIxxxx
xxxCMESIRNGTYDxxxYRDEALNNRSQIKxxxxxxGYKDWFLWISFAMSCFLLCxxxLGFIVWACQRGNIRxxxxx
>Protein:HA|Subtype:H3N2|Blocksize:10|String:5 xxxxxxxxxxxxxxxxxxxxxxxxxxxxxxxxxxxxxxxxxxxxxxxxxxxxxxxxxxxTAMLCLGHHAVPNGTMVKTITxxxxxxxxxxxxxxxxxxxxxxxxxxxxxxxxxxxLIDSLLGDPHCxxxxxxxx
xxxxxxxxxxxxxxxxxxxxxxxxxxxxxxxxxxxxxxxxxxxxxxxxSIYWTVVKPGDxxxxxxxxLIAPRGYFKVxxxxxxxxxxxxxxxxxxxxxFNKLYIWGVHxxxxxxxxxxxxx
RITYGPCPxYVRQNTLKLATGMRNIPERQTRGLFGAIxxxxxxVDGWYGFRHHNSxxxxxxxDFKSTQAAINQxxxxxxxxxxxxxxxxxSKCITPNGSIPNGKPFQNVN
RDEALSNRFQIKxxxxxxxYKNWILWISFAIxxxxxxxLGFVMWACQKGNIKCNxxx
>Protein:NA|Subtype:H3N2|Blocksize:10|String:1

AKAGVKMNPNQKIITxxxxxxxxxxxxxxxxxxxxxxxxxxxxxxxxxxxxxxxxxxxxxxxxxxxxxxxxxxxxxxxEKEKEICSVVLxxxxxxxxxxITGFA
PFSKDNSIRLSAGGDIWVTREPYVSCDxDKCYQFALGQGTTLNNxxxxxxxxRTPYRTLLMNELGVPFHLGTKQVCIAWSSSSCHDGKA
WLHVCVTGxxNATASFIYNGxxxxxxxxxxEILRTQESECVCINGTCTVVMTDGSASGxxxxxxEYYFVKEGKIVHxxxLSGSAQHVEECS
CYPRYPGVRCVCRDNWKGSNRPIVDINxxxxxxSSYVCSGLVGDTPRKxxxxxxxxxxxxxHGVKGWAFDDGNDVWMGRTIxxxR
SGYETFKVIxxxxxxxxxxxxxxxxxxxxxxxxRSGYSGIFSVEGKSCINRCFYVELIRGRxxxEVLWTSNSIVFCGTSGTYGTGSWPDGADINLH
AYISFRNL
>Protein:NA|Subtype:H3N2|Blocksize:10|String:2 xxxxxxxxxxxxxxxxxxxxxxxxxxxxxxxxxxxxxxxxxxxxxxxxxxxxxxxxxxxxxxxxxxxxxxxxxxxxxxxxxxxxxxxxIAGFAPFSKDN
SIRLAAGGDIWVTRVPYVxxxxGKCYQFALGQGTTLDNxxxxxxxxRIPHRTLLMNELGIPFHLGTRQVCIAWSSSxCHDGRAWLHVCxx
xxxNATASFIYDGxxxxxxxxxxKILRTQESECICINGTCTVVMTDGNASGxxxxxxxxxxxxxxxxLSGSAQHIEECSCYPRYSGVRCI
CRDNWKGSNRPVVDINxxxxxxxSRYVCSGLVGDTPRNxxxxxxxxxxxxxPGVKGWAFDNGDDVWMGRTIxxxRLGYETFKVIxxx
xxxxxxxxxxxxxxxxxxxxxxxxxxxxWSGYSGIFSVESKSCVNRCFYVELIRGSxxxxEVWWTSNSIVFCGTSGTYGSGSWPDGADINLMPIYSxxxx
>Protein:NA|Subtype:H3N2|Blocksize:10|String:3 xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxNSIR
LSAGGAIWVTREPYVSCSxSKCYQFALGQGTTLSNxxxxxxxRTPHRTLLMNELGVPFHLGTRQVCMAWSSSSCHDGKAWLHVCITG
xxxNATASFIYGGxxxxxxxxxxNILRTQESECVCINGTCAVVMTDGSASExxxxxxxxxxxxxxxxxxxLLGSAQHVEECSCYPRFPGIRCV
CRDNWKGSNRPVIDINxxxxxxSSYMCSGLVGDTPxxxxxxxxxxxxxxxxQGVKGWAFDNENDVWMGRTIxxxRSGYETFRVIxxxxx
xxxxxxxxxxxxxxxxxxxxxxMSGYSGIFSVENKNCINRCFYVExxxxxxxxRVWWTSNSIVAFCGTSxxxGTGSWPDGANxxxxxxxxxxxxxxx
>Protein:NA|Subtype:H3N2|Blocksize:10|String:4

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSIR
LAAGGAIWVTRELYVSCDxNKCYQFALGQxxxxxxxxxxxxxxxxxxxxxxxxxLLMSELGVPFHLGTKQVCMAxxxxxxxxxxxxxxxNATA
SFVYDGxxxxxxxDILRTQESECVCISGTCAVVMTDGSASDxxxxxxxxxxxxxxxxxxxxLSGNAQHVEECSCYPRYPNVRCVCRDNW
RGSNRPIVDIxxxxxxxSSYLCSGLVGDTPxxxxxxxxxxxxxxxxxxxxxxPGVKGWAFDDGNDIWMGRTIxxxxRLGYETFKVVxxxxxxxxxxxx
xxxxxxxxRSGYSGVFSVEGKxxxxxxxxxxxxxxxxxxxKVWWTSNSIVxxxxxxxxGTGSWPDGAExxxxxxxxxxxx
>Protein:NA|Subtype:H3N2|Blocksize:10

>Protein:HA|Subtype:H4|Blocksize:10|String:4
xxxxxxxxxxHTGNPVICLGxxxxxNGTMV

```
xxPFHNVHPFTIGECPKYxxxxxxxxxxxxxxxxxxxxxxRRKRGLFGAIxxxxxxxxxxxxxxxxxxxxxQGMVDGWYGFHHSNGQGSGYAADKKSTQKA
xxGITNKINSIIDKMNTxxxxxxxx >Protein:HA|Subtype:H5N1|Blocksize:10|String:3
xxxxxxxxxxxxxxxxxGDQICIG KSVxxxAPDYHYEECSCYPNAGExICVCRDNWHGSNRPWISFNxxxxxIGYICSGIFGDNPRPSDGxxxxxxxxxGIKGFSFKYGDGVW
IGRTKSPxSRSGFEMVWDPNGWxxxxxxxxxxxx

```
xxxxxxxxxxxxxxxxxxxxxxxxxxxxxxxxxxxxxxxxxxxxxxxxxxxxxxxxxxxxxxxxxxxxEKRRKKRGLFGAIAGFIEGGWQGLVDGWYGYHHINxxGSGYAADKKSTQKAINGITxxxxxxxxxx
xxxxxxxxxxxxxxxxxxxxxxxxxxxxxxxxxxxxxxxxVWTYNTELLVLMENEITLDFHDSNVRNLYDKVRHQLxDNARELGNGCFEFYHRCDxECMESVKNGT
YDYxxxxxxxxxxxxxxxxxxxxxxxILSIYSTVVSSLxLAIMVAGLSFWMCSNGSLQCTICI
>Protein:HA|Subtype:H5N2|Blocksize:10|String:3
xxxxxxxxxxxxxxxxDQICIGHHANNSTEQVDTIMERNVTVTHAQxxxxxxxxxxxxxxxxxxxxxxxxxxxxxxxxxxxxAGLVLGNPMCxxxxxTPEWSYIVEKA
NPxxxxxxxxxxxxxxxxxxxxxxxxxxxxxxxxxxxxxxxxxxxxxxxxxxxxxxxxSSFYRNVVWLIKKxxxxxxxxxxxxxxxxxxxxxxxxxxxxxxxxxxxxxx
xxxxxxxxxxxxxxxxxxxxxxxIATRPRVNGQxxxxxxxxxxxxxxxxxxxxxxxxxxNFIAPEYAYRIxxxxxxxxxYGNCNAKCQTPxxxxxxxxxxxxxxxxxx
xxxxxxxxxxxxxxxxxxxxxxERRKKKRGLFGxxxFIEGGWQGMIDGWYGYHHSxxxGSGYAADRKSTQKAIDGVTxxxxxxxxxx
xxxxxxxxxxxxxxxxxxxxxxxxxxxxxxxVWTYNAELFVLMENERTLYFHDSNVKNLYNKVRLQLxDNAKEMGNGCFEFYHKCNxKCMESVRN
GTYNYxxxxxxxxxxxxxxxxxxxxxxILSIYSSVASSLxLAIMMAGLSFWMCSNGSLQCRVCI
>Protein:HA|Subtype:H5N2|Blocksize:10|String:4
xxxxxxxxxxxxxxxxDRICVGYHANNSTKQVDTIREKNVTVTHARxxxxxxxxxxxxxxxxxxxxxxxxxxxAGWILGNPMCxxxxxxEWSYIVEKD
SPxxxxxxxxxxxxxxxxxxxxxxxxxxxxxxxxxxxxxxxxxxxxxxxxPSFFRNVVWLTKKxxxxxxxxxxxxxxxxxxxxxxxxxxxxxxxxxxxxxxxxxxx
xxxxxxxxxxxxxxxxxxxxxIAIRPKVNGQxxxxxxxxxxxxxxxxxxxxxxxxxxxxxxxxxxxxYGNCDAKCQTPxxxxxxxxxxxxxxxxxxxxxxxxxxxxx
xxxxxxxxxxxxxxxxxxxxxxxxxxxxxETRGLFGAIAGxxxxxxxxxxVDGWYGYHHTNxxGGGYAADKESTQRAIDGITxxxxxxxxxxxxxxxxx
xxxxxxxxxxxxxxxxxxxxxxxxxTYNAELLVLIENERTLDLHDSNVKNLYDKVRFQLxNNAKELGNGCxxxxxxxxVCMESVRNGTYKYxxxx
xxxxxxxxxxILTIYSTVASSLxLAIMIAGLFFWMCSNGSLxxxxxx
>Protein:HA|Subtype:H5N2|Blocksize:10|String:5
xxxxxxxxxxxxxxxxxxxxxxxxxIGYHANNSTKQIDTIMEKIVTVTHAQxxxxxxxxxxxxxxxxxxxxxxxxxxxxxxxxxxxxxxxEWSYIVEKDKPxxx
xxxxxxxxxxxxxxxxxxxxxxxxxxxxxxxxxxxxxxxxxxxxxxxxxxxSFFRNVVWLVKKxxxxxxxxxxxxxxxxxxxxxxxxxxxxxxxxxxxxxxxxxxxx
xxxxxxxxxxxxxxxxxIATRSKVNGQxxxxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxKTRGLFGAIAxxxxxxxxxxVDGWYGYHHNNxxGSGYGEDNESTQKAVDGITxxxxxxxxxxxxxxxxxxxxxxxxxxxx
xxxxxxxxxxxxxxxxxxxxxxxxxxNAEFFVLMENERTLDLHxxxxKLYDRVRLQLxxNAKEWGNGCFEFYHxxxxECIESVRNGTYxxxxxxxxxxxxxxxxxx
xxxxxxxxxxILSVYSTVASSLxLAIIIAGLSFWRCSNGSLxxxxxx
>Protein:NA|Subtype:H5N2|Blocksize:10|String:1
xxxxxxxxxxxxxxxxxxxxxxxxxxxxxxxxxxxxxxxxxxxxxxxxxxxxxxxxxxxxxxxxxxxxxxxxxxxxxxxxxKPQCQITGFAPFSKDNSIRLSA
GGxIWVTREPYVSCDxxKCYQFALGQGTTLDxKHSNGTIHDRIPHRTLLMNELGVPFHLGTKQVCIAWSSSSCHDGKAWLIHVCVTGD
DxxxxxxxxxxxxxxxxxxxxxxSWSQNILRTQESECVCINxxCTVVMTDGSASGxxxxxxxxxxxxxxxxGSAQHIEECSCYPxSYPNVRCVCRDN
WKGSNRPVKLDINMADYSxxSSYVCSGLVGDTPRNDDSxSSSNCRDPNNERGNPGVKGWAFDxxxxxxxxxxSKDSRSGYETFRVIxxxx
xxxxxxxxxxxxxxxxxNWSGYSGIFSVExxSCINRCFYVELIRGRPQExRVWWTSNSIVVFCGTSGTYGTGSWPDGANINFMPx
>Protein:NA|Subtype:H5N2|Blocksize:10|String:2
xxxxxxxxxxxxxxxxxxxxxxxxxxxxxxxxxxxxxxxxxxxxxxxxxxxxxxxxxxxxxxxxxxxxxxxxxxxxxxxxxxxxKPQCQVTGFAPFSKDNSIQLS
AGGxIWITREPYVSCDxxRCYQFALGQGTTLNxNHSNGTIHDRTPHRTLLMSELGVPFHLGTRQVCIAWSSSSCYDGKAWLHICVTGD
DxxxxxxxxxxxxxxxxxxxxxxSWSKNILRTQESECICINxxCAVVMTDGSASRxxxxxxxxxxxxxxxxGSAQHVEECSCYPxSYLNVRCVCRDN
```

FIG. 77-153

WMGSNRPVxxxxxxxxxSSYICSGLVGDTPRNNDSxSNSNCKDPNNERGNSGVKGWAFDxxxxxxxxxSKNSRSGYETFKVIxxxxxxx
xxxxxxxxxxxNWSGYSGVFSVExxGCINRCFYVEMIRGRPK >Protein:HA|Subtype:H6|Blocksize:10|String:3
xxxxxxxxxxxKSDRICIGYHANN YGFRHQNSQGEGTAADYKSTQSAVDQITGKLNRIIxxxxxxxxxxxxEKQIGNVINWTQDAxxxxWSYNAEFLVAVENQHTIDLTDSE
MSKLYERVKKQLRENAEEDGNGCFEIFHQCDNxCMASIRNNTYDHxxxxxxxxxxxxxxxxSGYKDVILWFSFGASCFILxxxxxxxxxx
xKNGNMQCTICIxxxxxx
>Protein:HA|Subtype:H7|Blocksize:10|String:3
SKSRGYKMN xxxxxxxxxxxxxxxxxxxxxxVKGDKICLGHHAVSNGTIKVNTLTEKGIEVVNATETVERTxxxxxxxxxxxDLGRCGLLGTLTGPPQCDQFLx
xxADLIIERREGNDxCYPGRFTNEESLRQVLRSSGIxxxxxGFTYNGIRTNGAxxxxxRLGSSFYAEMKWLLSSSDNxxxxxxxxxxxxA
LIIWGIHHSxxxxEQTKLYGNGNKLVxxxxxxxxxxxxxPGARPQVNGQSGRIDFHWLLLxxNDTVTFSFNGAFIAPDRASFLRGxxxxxxxxxx
xxxxxxxxGGTIISNLPFQ

RSGYETFRVIGGWTTANSK

LVAMENQHTIDLADSEMNKLYERVRKQLRENAEEDGTGCFEIFHKCDDxCMESIRNNTYDHTQYRTESLQNRIQIDPVKLSSGYKDIIL
WFSFGASCFLLLAIxxxxxFICIKNGNMRCTICI
>Protein:HA|Sub

```
xxxxxxxxxGVVNTTLSTIALLIGVGNLVFNTVIHExxxxxxxxxxxxxxxxxxxxxxxxITYNNTVINNTTTIIxxxxxxFKSPLPLCPFRGFFPHK
DNAIRLGENKxVIVTREPYVSCDNxNCWSFALAQGALLGTKHSNGTxKDRTPYRSLIRFPIGTAPVLGNYKEICIAWSSSSCFDGKEWM
HVCMTGxxxxxxxxxxxxxxxxxxxxxxxxxxxxxxxxxxxxxxxxxGRMTDSI >Protein:HA|Subtype:H7N7|Blocksize:10|String:1
SKSRGYKMNTQILVFAxxxxxxxxGCDHSDNADKICLGHHAVxNGTKVNTLTERGVEVVNATETVERxxxxxxxxxxxDLGQCGLLGTxT
GPPQCDQFLEFxxxxxxxxxxxxxxxxxxxxxxxxxLRQILRESGGxxxxxMGFTYSGIRTNGxxxxxxRSGSSFYAEMKWLLSNxxxxxFPQMTKSY
KNxxxPALIIWGIHHxxxxxxxxxxxxxxxxxxxxxTVGSSNYQQSxxxxxxRPQVNGQSGRIDFHWLxxxxNDTVTFSFNGAFIAPDRASFxxxxxx
xxxxxxxxxxxxxxxxxxxxxxxxxxLPFQNINSRAVGKCPRYVKQxSLLLATGMKNVPExxTHKQLTHHMRKKRGLFGAGAIAGFIENGWEGLI
DGWYGFRHQNAQGEGTAADYKSTQSAIDQITGKLNRLIEKTNQQFELIDNEFTEVEKQIGNVINWTRDSMTEVWSYNAELLVAMEN
QHTIDLADSEMNKLYERVRRQLRENAEEDGTGCFEIFHKCDDDCMASIRNNTYDHSKYRxxxxxxxxxxIDPVKLSSGYKDVILWFSFGAS
CFILLAIxxxLVFICVKNGNMRCTICI
>Protein:HA|Subtype:H7N7|Blocksize:10|String:2
SKSRGYKMNIQILILAxxxxxxxxxxxxxxGDKICLGHHAAxNGTKVDTLTEKGIEVVNATETVEQxxxxxxxxxxxxxDLGQCGLLGIxIGPPQ
CDQFLxxxxxxxxxxxxxxxxxxxxxxxxxxxLRQILRKSGGxxxxxMGFTYTGVRTNGxxxxxRSRSSFYAEMKWLLSSxxxxxFPQTTKSYKNxx
xxPALIVWGIHHxxxxxxxxxxxxxxxxxxxTVGSSKYQQSxxxxxxRPQINGQSGRIDFYWLxxxxNDTVTFTFNGAFIAPNRASFxxxxxxxxxxxx
xxxxxxxxxxxxxxxxxxxxLPFQNINSRTIGKCPRYVKQxSLMLATGMKNVPxxxAHKQLTHHMRxxEKRGLFGAIAGFIENGWEGLVDGW
YGFRHQNSQGEGTAADYKSTQAAIDQITGKLNRLIDKTNQQFELIDNKFNEIEKQIGNVINWTRDSITEMWSYNAELLIAMENQHTIDL
TDSEMNKLYEKVRRQLRENAEEDCTGCFEIFHKCDDQCMESIRNNTYDHKKYRxxxxxxxxIDAVKLSSGYKDIILWFSFGASCFLLLAI
xxxLVFMCVKNGNMRCTSxx
>Protein:HA|Subtype:H7N7|Blocksize:10|String:3
MKSRGYKMNTKILVLAxxxxxxxxxxxxxxxADKICLGRHAVxNGIKVDTLTEKEVEVVNATETVETxxxxxxxxxxxxxxDLSQCGLLGTxIGPP
QCDLFLEFxxxxxxxxxxxxxxxxxxxxxxxxxxxxxxxxLRQILRGSGGxxxxxTGFTYSGIRTDGxxxxxxRSESSFYAEMEWLLSNxxxxxFPQMTKSYRNxx
xxPALIIWGVHHxxxxxxxxxxxxxxxxxxxRPQMNGQSGRIDFHWMxxxNDTITFSFNGAFVAPDRVSFxxxxxxxxxx
xxxxxxxxxxxxxxxxxxxLPFQNINPRTVGKCPKYVKQxSLLLATGMRNVPExxIHKQLTHHMRxxRRRGLFGAIAxxxxxEGLIDGWY
GYRHQNAQGEGIAADYKSTQSAINQITGKLNRLIERTNQQFELIDNEFNEIEQQIGNVINWTRDSLTEVWSYNADLLVAMENQHIIDLA
DSEMNKLYERVKRQLRENAEEDGNGCFEIFHQCNDCMTSIRNNTYDHTQYRxxxxxxxxxINPVKLSSGYKEVILWFSFGASCFTLLAIx
xxLAFICIKNGNMRCTIxx
>Protein:HA|Subtype:H7N7|Blocksize:10|String:4
xxxxGYKMNTQILIFAxxxxxxxxxxxxxxxDKISLGHHAVxNGAKVNTLTERGIEVVNATExxxxxxxxxxxxxxxxxDLGRCGLLGTxTGPPQC
DLFLxxxxxxxxxxxxxxxxxxxxxxxxxxxxxxLRKILRKSGGxxxxxMRFTYSGIRTNxxxxxxRSGPSFYAEMKWLLSDxxxxxFPQMTRSYKNxxx
PALITWGIHHxxxxxxxxxxxxxxxxxxxxxxTVWSSKYQRSxxxxxxRPPVNGQSGRIDxxxxxxNDTVNFSFNGAFIAPDRAGFxxxxxxxxxxxx
xxxxxxxxxxxxxxxxxxxxxxxxxxxxxxLPFQNVNSRAVGRCPRYVKQxxxxxxxxxxxxxxxxxxxxxKKKKKKKKRGLFGARKRGLFGAIAxxxxxxxxGLIDGWYGYKHQ
NAQGEGTxxDYKSTQSAVNQITGKLNRxIDKTNQQFEMIDNEFNEVERQIGNVINWTRDSIIEVWSYNAEFLVAVENQHTIDLTNSEMN
KLYERVRKQLRENAEEDGTACFEIFHKCDDRCMASIRNNSYDHSKxxxxxxxxxxxIDPVELSSGYKDVIIWFSFGASCFLFLAIxxxLVFICI
KNGNMQCTICI
>Protein:HA|Subtype:H7N7|Blocksize:10|String:5

FIG. 77-161

FIG. 77-162 xxxxxxxxxxxxxxxxxxxxxxxxxxxxxxxxxxxxxxGTKVNTLTEKGIEVxxxxxxxxxxxxxxxxxxxxxxxDLGKCGLLGTxxxxxxxxxxxxxxxxxx
xxxxxxxxxxxxxxxxxxxxxxLRQILRRSGGxxxxxMGLTYNGIRTxxxxxxRLGSFYAEMKxxxxxxxxxxxxxxxxxxxxxxxxxxxxxxxxxxxxxxx
xxxxxxxxxTVWSSKYRRSxxxxxxxxxxxxxxxxxxxxxxNDTVTFNFNGAFVAPxxxxxxxxxxxxxxxxxxxxxxxxxxxxxxxxxxxxxxxxxxxxxxx
xxVGECPRYVKQxxxxxxxxxxxKKRKRKRGLFGAKKRGLFGAIAxxxxxxxxxxDGWYGFKHQNxxxxxxxxxxTQSAIDQITRKLN
RLIEKTxxQFELIDNEFSEVEKQLGNVINWTRD xxxxxLFASSGIAIALGIINLLIGISNVVLNVSLHLxxxxxxxxxxxxxxxxxxxxxxxGNTYVNNTTVxxxxxxxxxxLMLNKSLCKIEGWVVIA
QDNAIRFGESEQI xxxxDQKSTQEAIEKITNKVNNIxxKMNREFEVVDHEFSxxEKKINMINDKINDQIEDLWAYxxxxxxxxxxxxTLDEHDSNVENLFDEVRRR
LSTNAVDTGNGCFDIxxxxxxxxxIKNGTYNHKDYEEEAKLER KNxxxxxxxxxxIEGGWSGLVDGWYGFQHSNEQGxxxxxxxxxxxxxxxxxxxxxxxxxxxxxxxxxxxxxxxxxxxxxxxxxDQIQDLWAY
NAELLVLLENQKILDExxxxxxxxxxxxxxxx

```
xxxxxxxxxxxxxxxxxLKPGQTLRIISNGNLxxxxxxxxxxxxxxxxxxxxxxxxxxxxxxxxxxxxxxxxxxxxxxxxxxxxxxxxxxxxxxxxxxxxxxxxxxxxSLKLAVGLKN
xxxxxxxxxxxxxxxxxxxxxxxxxxxxxxxGWYGFQHSNEQGxxxxxxxxxxxxxxxxxxxxxxxxxxxxxxxxxxxxxxxxxxxxxxxxxxxxxxxxDDQIQDLWAYNAEL
LVLLENQKPLDEHDxxxxxxxxxxxxxxxENGNGCFELYHRCDxxCMEAIRNGTYxxxxxxxxxxxxxxxxxxxxxxxxxxxxxEGAYKILTIYSTVASSF
xxxxxxxxxxxxxxxxxxx
>Protein:HA|Subtype:H9N2|Blocksize:10|String:5
xxxxxxxxxxxxxxxxxxxxxxxxxxxxxxYQSTNSTEIVxxxxxxxxxxxxxxxxxxxxxxxxxxxxxxxxxxxxxxxxxxxGLIYGNPFCDxxxxxxxxxxxxxxxxxxxx
xxxxxxxxxxxxxxxxxxxxxxxLRPGQTLRVRSDGNLIAPWYxxxxxxxxxxxxxxxxxxxxxxxxxxxxxxxxxxxxxxxxxxxxxxxxxxxxSLKLAVGP
RNxxxxxxxxxxxxxxxxxxxxxxxxxxxxxxxxxxxxxxxxxxxxxxxxxxxxxxxxxxxxxxxxxxxxxxxxxxxxxxxxxxxxxxxDDRIQDIWAYNxxxxL
LENQKTLDDxxxxxxxxxxxxxxxxxxxxxxEDGKGCSELYxxxxxCMETTRNGTYxxxxxxxxxxxxxxxxxxxxxxxxxxDGTYKILTIYSTVASPLxxxxx
xxxxxxxxxxxxxxxxxx
>Protein:NA|Subtype:H9N2|Blocksize:10|String:1
xxxxxxxIAIGSVSRT1xxxxxxxxxxxxxxxxxxxxxxxxxxxxxxxxxxxxxxxVPLVPCEPIIIExxxxxxxxxxxxxxxxxxxxxxxxxxxxWSKPQCQITGFAxxxxxxx
xxxxxxxxxxxxxxxxxxxxxxxxxxxxxCYQFALGQGTTLxxxxxxxxxxxxxxxxPHRTLLMNELGVPFHxxTKQVCIAWSSSSCHDGKAWLHxxxxxxxxxxxx
xxxxxxxxxxxxxxxxxxNILRTQESECVCxxxxxxxxxxxxxxxxxxxxxxxxxxxxxxxxxGSAQHVEECSCYPRxxxxxVCRDNWKGSNRPVxxxx
xxxxxxxYVCSGLVGDTPRNxxxxxxxxxxxxxxxxxxxxxxxxxxxxGTGSWPDGANxxxxx
CINRCFYVELIRGRPxxxxxxxxxxxxxxxxxxxxxxxxxxxxx
>Protein:NA|Subtype:H9N2|Blocksize:10|String:2
xxxxxxxxxxxxxxxxxxxxxxxxxxxxxxxxxxxxxxxxxxxxxxxxxxxxxxxxxxxxxxxxxxxxxxxxxxxxxxxxxxxWLKPQCQITGFVxxxxxxxxx
xxxxxxxxxxxxxxxxxxxxxxxxxxxxxxCYQFALGHGTTLxxxxxxxxxxxxxxPYRTLLMSELGVPFHxxTKQVCMAWSSSSCHDGRAWLHxxxxxxxxxxxxxx
xxxxxxxxxxxxxxxxxxSILRTQESECICxxxxxxxxxxxxxxxxxxxxxxxxxxxGSAQHIEECSCYPRxxxxxVCRDNWRGSNRPVxxxxxxxx
xxxxxxYLCSGLVGDTPRSxxxxxxxxxxxxxxxxxxxxxxxxxxxGTGSWPDGADxxxxxx
RCFYVELIRGKPxxxxxxxxxxxxxxxxxxxxxxxxxxxxx
>Protein:NA|Subtype:H9N2|Blocksize:10|String:3
xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxWSKPQCQIAGFAxxxxxxxxxx
xxxxxxxxxxxxxxxxxxxxxxxxxxxxxCYQFALGQGATLxxxxxxxxxxxxxxPHRTLLMSELGVPFYxxTRQVCIAWSSASCHDGRAWLxxxxxxxxxxxx
xxxxxxxxxxxxTILRTQESECxxxxxxxxxxxxxxxxxxxxxxxxxGGAQHVEECSCYPQxxxxxVYRDNWKGSNRPIxxxxxx
xxxxxYFLDVFAGDTxxxxxxxxxxxxxxxxxxxxxxxxxxxGAGSWPDGANxxxxxx
FYVELVRGRPxxxxxxxxxxxxxxxxxxxxxxxxxxxxxxxxxxxxxxxxxxxxxxINRC
>Protein:NA|Subtype:H9N2|Blocksize:10|String:4
xxxxxxxxxxxxxxxxxxxxxxxxxxxxxxxxxxxxxxxxxxxxxxxxxxxxxxxxxxxxxxxxxxxxxxxxxxxxxxxxxxxxWSKPQCLITGFAxxxxxxxxxx
xxxxxxxxxxxxxxxxxxxxxxxxxxxCNQFALGQGTTxxxxxxxxxxxxxxxSYRTLLMSELGVPFNxxTQQVCIAWSSSSCYDGKAWLHxxxxxxxxxxxxx
xxxxxxxxxxxxxxNILITQESECVCxxxxxxxxxxxxxxxxxxxxxxxxxxxxGNAQHVEECSCYPSxxxxxxVHISPLSGSAxxxxxxxxxxxxxxx
```

FIG. 77-166 xxxxxSGLVGDTPRDxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxCFY
VELTRGRxxxxxxxxxxxxxxxxxxxxxxxxxGTGSWADGANxxxxxx
>Protein:NA|Subtype:H9N2|Blocksize:10|String:5

\>Protein:M2|Subtype:N/A|Blocksize:10|String:3
MSLLTEVETHxxxxxxxxx

>Protein:NP|Subtype:N/A|Blocksize:10|String:5
xxxxxxxxxxDIGAMASQGTKRSYEQMETSGERxxxxNEIRASVGRMIGGIGKFYIQMCTELKLSExxGRLVQNSITIExxxxxxxxxxNKYLE
EHPSTG xxxxxxxxxxxFQYLLFQDILRKRFADQELGDAPxxxxxxxxxxxxxxxxxxxxxxxxxxxxxxxxxxxxxxxKMTIASDILKRMSKxxxxxxx
xxxxxxxxxxxxxxxxxxxxxxxxxxxxxxxxxxxxxxxxxxxxxxxxxxxxxxxxxxxxxxxxxxTESSFEQITFMQALQLLFEVEQEIRAFSFQLINNKKP >Protein:NS2|Subtype:N/A|Blocksize:10|String:3
xxxxxxxxxxxxxxxxFQV DFxxxxxxxxxxxxxxxxxxWVQNEFNKACELTDSVxWMELDEIGEDLAPIEYIASMRRDYFTAEVSYCRATEYIxMKGVYMNTA
LLNASCAAMDEFQLIPMISKCC xDVNPTLLFLEVxxPVQNAISITTFPxxxxxxxxxGTGYTMDTVSRTHQYSEKGRWxxSETGAPQLNPVDGxxxxDNEPTGYAQTDCVLE
AMALLEESHPGLFENSCLExxxxIQQTRVDKLTQGRQTFDWTLN xxxxxxxxxxxxxxxxxxxxxxxxxxxxxxxTAYWWDGLQSSxxxxxxxxxxxxxxxxxNRFYRTCKLLxxxxxxxxxxxxxxxxxxxxxxxxxxxxxxxxxx
xxxxxxxxxxGVTVIKNNMVNNxxxxxxxxxxxxxxxxTYRCHRGDAQIxxxxxxxxxxxxxxxxxxxxxxxxxxxxxxxxxxxxxxxxxxxxxxxxxxxxxxx
xxxCNPLNPFVGHxxxxxxxxxxxxxxxxxxxxxxxxxxxxxxxxxxxxxxxxxxxxxxxxxxxxxxxxxxxxxxxxxxxxxxxxxxxxxxxxxxxxxxxxxIL
EDERMYQKCCNLFxxxxxxxxxxxxxxx

```
>Protein:PB2|Subtype:N/A|Blocksize:10|String:4
xxxxxxx

```
IGLREQKQEFKMNPNKKIITIxxxxxxxxxxxxxxxxxxxxxxxxxxxxxxxxxxxxxxxxxxxDLNMGQPFYSHxxxxxxxxxxxxxxxxxxxxxxxxxxxxxxxxxxxx
xxxxxxxxxxxIRIGSKGDVFVIREPFISCSxLECRTFFLTQGALLNDKHSNGTIxxRSPYRTLMSCPxGEVPSPYNSRFESVAWSASACHD
GINWLTIGISGPDNGAVAVLKYxxxxxxxxxxILRTQESECACxNGSCFTVMTDGPxVMGQASYKIFKxxxGKKGKWLNQSKxxAPNY
HY

```
AKAGVKMNPNQKIITIxxxxxxxxxxxxxxxxxxxxxxxxxxxxxxxxxxxxxxxxxxxxxxxxxxxxxxxxxxxxxxxxxxxxxxxxxxxxxxxxxxxKNNQVILCEPTxxxxxxxxxxKTVVHLNSTTIxxEKEKEICSVVLExxxxx
xxxxxxxxxxKDNSIRLSAGGxIWVTREPYVSCxxKCYQFALGQGTTLxxxxxxxxxxPYRTLLMNELGVPFHLGTKQVCIAWSSSSC
HDGKAWLHxxxxxxxxxxxxxxxxxxxxxxxxxxxILRTQESECVCINxxCTVVMTDGSASREGLILEYYFVxxxxxxxxxxGSAQHVEECS
CY xxxxxxxxxxxxxxxxxxxxxxxTQTLVSNNDWSGYSGSFIVxxxDCFQPCFYVELIRGRxxxxxxVSWTSNSIVTFCGLDNEPGSGNWPDGSNIGF
MPK
>Protein:NA|Sub SRSGFEMVWDANGWVSTDKDSNGVQDIIDNDNWSGYSGSFSIRGETTGRNCTVPCFWVEMIRGQPKEKTIWTSGSSIAFCGVNSDTT
GWSWPDGALLPFDIDK
>Protein:NA|Subtype:N4|Blocksize:11|String:2
MNPNQSIITIGSAxxxLTTIGLLLQITSLCSIWFSHYNQMTQAxxxxxCSNDTINYYNETFVNVTHVQNNYTTxxxxxxxxxxxxxxxLCPVKG
WAPLSKDNGxxxxRGEVSVIREPFISCSVSECRTFFLTQxxxxxxxxxxxxxxxxSPFRTLMSCPMGVAPSPSNSRxxxxAWSATACSDGSGWL
TLGITGPDSTAVAVIKYNGIITDTLxxxxxxxxxxxxxxxxVCQDEFCYTLMTDGPSDAQAFYKLLKIRKGKIVxxxxxxATGYHFEECSCYPSG
ENVECV GFEILLIEDGWxxxxxxxxxEVLNNKNWSGYSGAFTIPIxxxxxxCLVPCFWLEMIRGKPEERTSIWTSSSSTVFCGVSSEVPGWSWDDGA
ILPFDJ >Protein:NA|Subtype:N6|Blocksize:11|String:2
MNPNQKITCISATGVTL MTICxQGNNNNATATVYYDKRLTTTIKTWARNILRTQESECVCHNSTCVxxxxxxxxxxxxxxxxxxxxxxxxxxxxLKGSAKHIEECSCYGHS
xxATCVCRDNWQGANRPIIEIDMxxxxxxxx QFxxxxxxxxKGYGVKGFGFRQGTDVWxxxxxxxxxxxxxxxxxxxxxxxxxxxxxxxxxxxxxxxxxxxxxxxDDPNWSGYSGSFTLPIELxxxxxxPCFWVEMIR
GEPEExT xxxxVTCTCRDNWQGSNRPVIRIDPxVMTHTSQYICSPILTDNPRPNDPTIGKCNDPYPGNNBNGVKGFSYLNGxNTWLGRTISIASRSG
YEMLKVPNALTDNRSKPxQGQTVVLNTDWSGYSGSFIDYWAKGECYRACFYVELIRGRPKEEKVWTSNSIVxxCSSTEFLGQWDW
PDGAKIEYFx
>Protein:NA|Subtype:N9|Blocksize:11|String:3
MNPNQKILFASATAIxxxxxxxxxANLGLNVGLHLKPxxxxxxxxxxxxxxxx LIxxxTEFESIESEFNEIEHQIGNVIxxxKDSITYIWTYQAELLVAMENQHTIDMGDSEMLNLYERxxxQLRQNAEEDGRGCFEIYHxxxS
CMESIRNNTYNHTQYREESL GIHHPSSTKEKNDLYGTQPLSISVGSSTYHNSFVPVVGARPQVNGQSGRINFHWTxVRPGDNITFSHNGGLVAPSRVSKxxxxxxxxx
xxxCESKCFWRGGSINTKLPFxxxxxTEFESIESEFNEIEHQIGNVIxxxxxxDIWTYNAELLVAMENQHTIDLADSEMLNLYDRVRKQLR
QAADYESTQAAIDQITxxxxxxxxxRTVGQCPKYVSKRSLLLATGMRNVPEIxQERGLFGAIAGFIENGWEGMVDxxxxxxAQGTG
QNAEEDGRGCFEIYHKCxDSCMESIRNNTYD >Protein:NA|Subtype:H10N7|Blocksize:11|String:2
MNPNQKLFTLSGVAIAL >Protein:HA|Subtype:H11|Blocksize:11|String:2
xxxxxxxxxxxKADEICIGYLSNNSTDK DANVRNLHDRVRRxxxENAIDTGDGCFEILHKCDNxxxxxxxxxxxxYEEESKIERQKINGVKLEENSTYKILSIYSSVASSLVLLLMIIG
GFIFGCQNGNVRCTFCI
>Protein:HA|Subtype:H12|Blocksize:11|String:2
xxxxxxxxxxxLAYDKICIGYQTNNSTDTV LWGIHHPxxxxxxxxxxxPYTLVSTSSWSxxxxxxGVRPGYNGQRSWMKIYWxxxxxxxISFESNGGLLAPRYGYIIEEYGKGRIFQSRIR
xxKCNTKCQTSVGGINTNKTFQNIERNALGDCPKYIKSGQLKLATGLRNVPAxxxRGLFGAIAGFIEGGWPGLINGWYGFQHQNEQGV
GMAADKESTQKAIDQITTKINNIIDKMNGNYDSIRGEFNQVEKRINMLADRIDDAVTDVWSYNAKLLVLLENDKTLDMHDANVRNL
HDQVRxxxxNAIDEGNGCFELLHKCNDSCMETIRNGTYNHxEYAE GEFNQVEQRINMLAxxxxxxxxxxxxxxxxxxxxxxxxDANVRNLHDQIRxxxxxxxxxxxxxxxxxxxxxxxxxxxxxxxxxxxxxxxxxxxKRQE
IEGIKLESEDNVYRALSIYSCIASxxVLVGLILTFIMWACNSGNCRFxxxx
>Protein:HA|Subtype:H14|Blocksize:11 xxxxxxxxxxxxxxxxxxxxxxxxxxxxxxxxxxxxxxxxxxxxxxxxxxxxxxxxxxxxxxxxxxxxxxxxxxxxYQQS
FSPSPGDRPKVNGQAGRxxxxxxxxxxxxxxxxxxxxxxxxYSEMKWLSSSGNNQVFPQLNQxxxxxxxxxxxxxxx
xxxxxGMKNVPEKIRVKRRPVAKAGFIENGWEGxxxxxxxxxxxxxxxxxxxxxxxxxxxxxxxxxxxxxxxxxxxx
xxxxxxxxxxxxxxxx
>Protein:HA|Subtype:H15|Blocksize:11|String:4
xxxxxxxxxxxxxxxxxxxxxxxxxxxxxxx

```
GTGIAADKVSTQKAINEITxxxxxxxxxxxxxxxxxxxxxxxxVEKRINMLADWVDDAVTDIWSxNAKLLVLLENDRTLDLHDANVRNLHEQIK
RxLKSNAIDEGDGCFSLLHKCNDSCMxxxxxxxxEDYREESQLKKQEIEGIKLKTEDNIYKILSIYSCIASSVLVGLILAFILWACSSGN
CRFSVCI
>Protein:HA|Subtype:H16|Blocksize:11|String

```
xxxxxxxxxxxxxxxxxxxxxxxxxxxxxxxxxxxxxxxxxxxxxxxxxxxxxxxxxxxxxxAIAGFIEGGWPGLINGWYGFQHxxxxxxxxxxxxxxxxxxxxxxxxxxx
xxxxxxxxxxxxxxxxxxxxxxxxxYNAELLILLENxxxxxxxxxxxxxxxxxxxxxxxxxxxxxxxxxxxxxxxxxxxxxxxxxxxxxxxxxxxxxxxxxxxxxxxxxxxxx
xxxxxxxxxxxxxxxxxxxxxxxxxxxxxxxxxxxxxxxxxxxxxxxxxSLQCRICILDQNFRNIRK
>Protein:HA|Subtype:H1|Blocksize:11|String:4
xxxxxxQPNDGQVLYFLI \>Protein:HA|Subtype:H1N1|Blocksize:11|String:3
xxxKTKATKMKAIIVVLLYx

```
xxxxxxxxxxxxxxxxxxxxxxxxxxxxxxxxxxxxxxxxxxxxxxxxxxxxxxxxxxxxxxxxxxxxxxxxxxxxxxxxxxxxxxxSKD
NSVRIGSKGDVFVMREPFISCSHLxxxxxxxxxLLNDKHSNGTVKDRSPHRTLMSCPIGEAPSPYNSRFESxAWSASACHDGTSWLTIGI
SGPDNEAVAVLKYNDIITDTxxxxxxxxLRTQESECVCVNGSCFTVLTDGPSxxxxxxxxxxxxxxxxxxxxxAPNFYYEECSCYPxxxxxxxxx
xDNWHASNRPWISFDQNLxxxMGYICSGIFGD xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxPFQNVHPITIGECPKYVKSxxxx
xxxxxxSIHSRGLFGAIAGFIEGGWTGMVNGWY NRPIVDIxxxxxxSSYICSGLVGDTPRxxxxxxxxxxGNPGVKGWAFDxxxxxxxxxxxxxxxxxxxxxxxxxxxxxxxx
xxxxxxxxxRCINRCFYVELIRGRNxxxxVGWTSNSIVVFCGASGTYGxxxxxxxxxxxxxxxxxxxx
>Protein:NA|Subtype:H1N2|Blocks xxxxxxxxxxxSLERRLENLNKRMEDGFxxVWTYNAEVLVLMENERTLDYHDSNVKNLYEKVRMQLRDNAKELGNGCFEFYHKC
DNECMDSxxxGTYNYPKYEEESKLKRNEIKGxxxxxMGVYQILVIYAxVAGSLSLAIMVAGISIWMCSNGSLQCxxxx
>Protein:HA|Subtype:H2|Blocksize:11|String:4
MDNQTKKMTITFLI xxxxxxxxxxVRGDQICVGYHSNNSTEKIDTILERNVTVTHAKNILEKTHNGKLCRLSGIPPLELGDCxxxxxxLGNPECDRLLTVPEWSYI
VEKENPxxxLCYPGSLNDYEELKxxxxxxxHFEKVRILPKDxxxxxxxxxxxxxxxxxxxxxxPSFFRNMIWLTxxxxxxxxARGSYNNTSGEQVLVxxxx
xxxxxxxxxxxxxxxxxxxxxxxxxxxxxxxxxxxxxxxxxxxxxxxxxxxxxxxxW >Protein:NA|Subtype:H2N2|Blocksize:11|String:3
MNPNQKIITDSVSLxxxxxxxxQ \>Protein:HA|Subtype:H3|Blocksize:11|String:3
xxxxxxxxxxIFIFILLTHWAYxxxxxxxxxxxxxxx

```
AVNQxxxxxxxIEKTNEKFHQIEKEFTEVEGRIQDLERYVEDTKIDLWSYNAGLLVALENQNTIDLTDSEMNKLFDRTRKQLRENAEDL
GNGCFKIYHKCNxxIESIRNGTYDHxxYRDEAVNNRFQxxxxxxGYKDWVLWISFAISCFxxxxxLGFIMWACQRGNIRCNICI
>Protein:HA|Subtype:H3N2|

CRDNWKGSNRPVVDIxxxxxxSRYVCSGLVGDTPRNxxxxxxxxxxxxxxxxxxxxxxxxxxxxxxxxxxxxxxxxxxxxxxxx
xxxxxxWSGYSGIFSVESKSCVNRCFYVELIRGSxxxxxVWWTSNSIVFCGTSGTYGSGSWPDGADINLMPIYSxxxx
>Protein:NA|Subtype:H3N2|Blocksize:11|String:3
xxxxxxxxxxxxxxxxxxxxxxxxxxxxxxxxxxxxxxxxxxxxxxxxxxxxxxxxxxxxxxxxxxxxxxxxxxxxxxxD >Protein:HA|Subtype:H4|Blocksize:11|String:3
xxxxxxxxxxxxxxYTENPVICLGHHAxxxxxxxxxxxxxxIEVVAAQEL

```
QKAxxxxxxxxxxxxxxxxxxxxxxxxxxxxxxxxxxxxxxxxxxxxNVWTYNAELLVLMENERTLDLHDSNVKNLYDRVRLQLKDNAKELGNGC
FEFYHRCDNxxxxxxxxxxxxxxxxxxxxxxxxxxxxxxxxxxxxxxLSIYSTAASSLxxxxxxxxxxxxxxxxxxxxxFWMCSNGSLQCKICKICESRLRx
>Protein:HA|Subtype:H5|Blocksize:11|String:3

FIG. 77-208

```
WIGRTKSxxSRSGFEMIWDP

```
xxxxxxxxxxxxxxxxxxxxxxxxxxxxxxxxxxxxxxxxxxxxxxxxxxxxxxxxxxxxxxxVWTYNAELLVLMENERTLDFHDSNVKNLYDKVRxxxDNAKELGNGCFEFYHKCDxECMESVRNGT
YxxxxxxxxxxxxxxxxxxxxxxxxxxxxxxxxILSIYSTVASSLxLAIMIAGLSFWMCSNGSLQCRICI
>Protein:HA|Subtype:H5N2|Blocksize:11

GSNRPVKLDINMADYSIxSSYVCSGLVGDTPRNDDSxSSSNCRDPNNExGNPGVKGWAFDxxxxxxxxSKDSRSGYETFRVIxxxxxxxx
xxxxxxxxNWSGYSGIFSVExxSCINRCFYVELIRGRPQEx xxxxxxxxxxxxxRSDKICIGYHANNSTTKVDTILERNVTVTHSVELLESxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxSLKLATGLRNVPQxxTRGIFGAIAGFIEGGWTGLIDGWYGYHHENSQGSGYAADRESTQKAxxxxxxxxxxxxxxxxxxxxxxxxxxxxxxxxxxxxxxxxxxxxxxxxxxxxxxxxxxxxxxxxxxxxxxDGFLNVWTYNAELLVLLEDERTLDMHDANVxxxxxxxxxxLRDNAKDLGNGCFEFWHIRxxxxxxxxxxxxxxxxxxxxxxxxxxxxxxxxxxxxxxxxxxxxxxxxxxxxxxxxxxxxxxxxxxxDVYQILAIYSTISSSLVLMxxxxxxxxWMCSNGSMQCKxxxxx
>Protein:H

```
xxxxxxVRKQLRENAEEDGTGCFEIFHKCDDxCMESIRNNTYDHxxxxxxxxxxxxxxxxxxxxxxSGYKDIILWFSFGASCFLLxxxxxxxxxxxxxKN
GNMRCTICIxxxxxx SKSRGYKMNTQILILALxxxxAKGDKICLGHHAVANGTKVNTLTERGIEVVNATETVETAxxxxxxxxxxxxxxxCGLLGTLIGPPQCDQ
FLEFxxDLIIERREGTDxxxxxxxxxxxxxxxxLRQILRRSGGIxxxxxGFTY FGLIDNEFSEIEQQIGxxINWTRDAMTEVWSYNxxxxxxxxxQHIIDLADSEMSKLYERVRxxxxxxxxxxxxxxxxxxxxxxxxSIRNNTYDHT
KYRTES xxxxxxxxxDSGYVCSGLVGDTPRNDDSSSNSNCxDPNEERGSPGVKGWAFDSEDDVWMGRTISMxxxxxYETFRVIGGWATANSKSxxx
xxxxVNNNNWSGYSGVFSVExxxxxxxxxxxxxxPQETKVWWTSN

```
>Protein:HA|Subtype:H7N3|Blocksize:11|String:5
xxxxxxxxxxxxxxxxxxxxxxxxxxLGHHAVANGTRVNTLTGRGIEVVNATETVENxxxxxxxxxxxxxxxxxxCGLLGIITGPPQCDxxxxxxx
xxxxxxxxxxxxxxxxxxxxxxxxxxLRQILRGSGGVxxxxxxxxxxxxxxxxxxxxxxxxDSSFYAEMKWLxxxxxxxxxxxxxxxxxxxxxxxx
xxxxxxxLYGSENKLITVxSSKCQQSFTPSPGxxxxVNGQSGRINFHWLxxxxxxxxFNFNGAFIAPDxxxxxxxxxxxxxxxxxxxxxxxxxxGGT
IASSLPFQNINxxxxxxxxxxxxxxxxxTGMKNVPEIPRxxKKRGLFGAIAGxxxxxxxxxxxxxxxxxxxxxxxxxxxxxxxxxxxxxxxxxxxx
xxxINQITGKLNRIIDKTNQQFEMIDNEFxxxxxxGNVIDWTRDSVTELWSYNAEFLVAMENQxTIDQADSEMNKLHERVRKQLRENxxx
xxxxxxxxxxxxxxxxxASIRNNTYDHNxxxxxxxQNRVKIDPVKLNSGYKDIILWFSFGASCFLLIAIxxxxxFICIKDGNMRCTxxx
>Protein:NA|Subtype:H7N3|Blocksize:11|String:1
xxxxxxxxxxGVVNTTLSTIALLIGVGNLVFNTVIHExxxxxxxxxxxxxxxxxxxxxxxxxxxxxxxxxxxTYNNTVINNITTTIIxxxxxxxPLPLCPFRGFFPFHK
DNAIRLGENKxVIVTREPYVSCDNxNCWSFALAQGALLGTKHSNGTxxDRTPYRSLIRFPIGTAPVLGNYKEICIAWSSSSCFDGKEWM
HVCMTGxxxxxxxxxxxxxxxxxxxxxxxxxxxxxxxxxxxxxxxxxxxxxxxxxxGRMTDSIKSWRKDILRTQESECQCIDGTCVVAVTDGP
AANSADHRVYWIREGxxxxxxxxxxxKIQHLEECSCYVDIDVYCICRDNWKGSNRPWMRINNETILETGYVCSKFHSDTPRPADPSTVSC
DSPSNVNGGPGVKGFGFKxGNDVWLGRTVSTSGRSxxxxxxEGWINSPNHAKSVTQTLVSNNDWSGYSGSFIVxxxDCFQPCFYVELI
RGRPNxxDDVSWTSNSIVTFCGLDNEPGSGNWPDGSNIGFMPK
>Protein:NA|Subtype:H7N3|Blocksize:11|String:2
xxxxxxxxxxGIVNTTLSTIALIIGVGNLIFNTVIHGxxxxxxxxxxxxxxxxxxxxxxxxxxxxxxxxxxxxTYNSTVVNNITTTIVxxxxxxxxxSLPLCPFRGFFPFHKD
NALRLAExxxVIVTREPYISCDNxDCWSFALAQGALVGTKHSNGTxxDRTPYRSLIQFPMGTAPVLGNYREICIAWSSTSCFDGKEWMHI
CMTGxxxxxxxxxxxxxxxxxxxxxxxxxxxxxxxxxxxxxxxxxxxxxxxGKMTDSIKSWRRDILRTRYVCSKFHSDTPRPDDPSTMSCDSP
NSAHIRVYWIREGxxxxxxxxxxxxKIKIHLEECSCYVDDVDVYCICRDNWKGSNRPWIRINNETILETRYVCSKFHSDTPRPDDPSTMSCDSP
SNINGGLGVKGFGFKxGDDVWLGRTVSTxxxxxxxxEGWINSPNHVKSITQTLVSNNDWSGYSGSFTVxxxGCFQPCFYIELIRGRPN
xxDNVSWTSNSIVTFCGLNNEPGSGNWPDGANIGFMPx
>Protein:NA|Subtype:H7N3|Blocksize:11|String:3
xxxxxxxxxxGAVNTTLSTIALFIGVGNLAFNTVIHxxxxxxxxxxxxxxxxxxxxxxxxxxxxxxxxxxxxTYNNTVVNNITTTIIxxxxxxxxSLPLCPFQGFFPFHK
DNAIRPGENKxVIITREPYVSCDNxHCWSFALAQGALLGTNHSNGTxxDRTSYRSLIRFPIGVAPVLGNYKEMCAAWSSSSCFDGKEWL
HVCITGxxxxxxxxxxxxxxxxxxxxxxxxxxxxxxxxxxxxxxxxGKMRDSIKSWRNNILRTQESECQCLYGICVVAVTDGPA
DNKADHRIYWIKExxxxxxxxxxxRIQHLEECSCYMDIDVYCVCRDNWKGSNRPWVRMNETILETGYICSKFHSDTPRPVDPSTISCDS
PSNINGEPGVKGFGFKxGSDVWLGRTVSTxxxxxxxxEGWINSPSQAKSITQTLVSNDDWSGYSGSFIIxxGCFQPCFYVELTRGVxx
xxDEVSWTSNSIVTxCGLDNEPGSGHWPDGSNIGFMxx
>Protein:NA|Subtype:H7N3|Blocksize:11|String:4
xxxxxxxxGVVNTALSTIALLIGIGNLVFNTVIHGxxxxxxxxxxxxxxxxxxxxxxxxxxxxxxxxxxxxxTYNKTVINNITTTITxxxxxxxxPLPLCPFKGFFPFHK
DNAIRLGENRxVLVTREPYISCxxxGCWSFALAQGALLGTRHSNGTxxDKTPYRSLIRFPVGTAPVLGNYREVCIAWSSSSCFDGKEWM
HVSMxxxxxxxxxxxxxxxxxxxxxxxxxxxxxxxxxxxxxxxxxxxxxxxGRMADSIKSWRKDxxRTQESECQCIGGTCIVAVTDGPA
ANNADHRIYWIRKGxxxxxxxxxxKIRHLEECSCYVDTDVYCICRDNWKGSNRPWMRISNETILETGYVxSKFHSDTPRPTDPSIMSCDS
```

FIG. 77-217

PSNVKGGPGVKGFGFxxxNDVWLGRTVSNSGRSxxxxxxxDGWINSPNHAKSLTQTLVSNNDWxxxxxxxxxxxCFQSCFYVELIRGRL
NxxD MKSRGYKMNTQILIFALxxxxxxxxxxADKISLGHHAVxNGAKVNTLTERGIEVVNATETxxxxxxxxxxxxxxxxxxxxxxxxxxxxxxIGPPQCD
LFLExxxxxxxxxxxxxxxxxxxxxxxxxxxxxxxxxxxxxxxxxxRFTYSGIRTNGxxxxxxRSGPSFYAEMKWLLSDxxxxxxxxxxxxxxxxxxxxxxxx
xxxxxxxxxxxxxxxxxxxxxxxxxxxxxxxxxxxxxxxxxxxxxxRPP >Protein:NA|Subtype:H7N7|

DSNVKNLFDEVKRRLSTNAMDAGNGCFDILHKCDNKCMETIKNGTYNRKEYEEEAKLERSKINEVKLEENTTYRILSIYSTVAASLCL
AILVAGGLILGMQNxxxxxxxx
>Protein:HA|Subtype:H8|Blocksize:11|String

```
xxxxxxxxxxxxxxxxxxLKPGQTLRVKSxxxxxxxxxxxxxxxxxxxxxxxxxxxxxxxxxxxxxxxxxxxxxxxxxxxxxxxxxxxxxxxxxxxxxxDQIQNIWAYNAELLV
xxxxxxISGFIEGGWPGLIAGWYGFQHSNAQGxxxxxxxxxxxxxxxxxxxxxxxxxxxxxxxxxxxxxxxxxxxxxxxxxxxxxxxxxxxxxxxxxxxxxxxxxxxxxxxxxxx
LLGNQKTLDEHxxxxxxxxxxxxxxxxxxxxxxEDGKGCFDLYHKCxxxxxxxxxxxxxxxxxxxxxxxxxxxxxxxxxxxxxxxxxxxxETYKILTIYSTAASSLxxxxxx
xxxxxxxxxxxxxxxxx
>Protein:HA|Subtype:H9|Blocksize:11|String:4
xxxxxxx xxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxxEGLVYGNPACDxxxxxxxxxxxxxxxxxxxxxxxx
xxxxxxxxxxxxxxxxxxxLKPGGQTLRVKSxxxxxxxxxxxxxxxxxxxxxxxxxxxxxxxx xxxxxxxxxxxxxxxxxxxxCYQFALGQGATLxxxxxxxxxxxxxPHRTLLMSELGVxxxxxxxxQVCIAWSSASCHDGRAWLxxxxxxxxxxxxxxxxxxxxx
xxxxxxxxILRTQESECVCxxxxxxxxxxxxxxxxxxxxxxxxxxxxxxxxxxGGA

```
xxxxxxxxxxxxxxxxxxxxLKAEIAQRLEGVFAGKNTDLEVLMEWLKxxxxxxxxxxxxxxxxxxxxxxxxxxxxxxxxxxxxxxNGNGDPNNMDKAV
KLYRKLKREMTFHGxxxxALGYSTGALASCMGLIYNRMGTVAxxxxxxxxTCEQIADSQHKSHRQMxATTNPLIRHENxxxxxxxxxxxxx
QMA xxxxxxxxMSDIEIMASQGTKRSHEQMETGGxxxxxxxxxxxxxxxxxxxxxxxxRFYIQMCTELQLSxxxGRLVQNSITIExxxxxxxxRRNRYLEENP
SAGKDPKKTxxxxxxxxxxxxxxx >Protein:NS2|Subtype:N/A|Blocksize:11|String:1
TAFSGMSANGDILMRYLL

FIG. 77-228

```
>Protein:PA|Subtype:N/A|Blocksize:11|String:3
MEGFVRQCFNPMVVELAEKAMKEHGEx

ATAQMALQLFIKDYRYTYRCHRGDTQxxxxxxxxxxxxxxxxxxxxxxxxGLLVSDGGPNLYNIRNLHIPEVCLKWELMDxxYQGRLCNPLNPFVS
HVGTRWMKIIRVGCVILLNPFVSHKEIxxxxxxxxxxxxxxxxMEYDAVATTHSWIPKRNRSILNTSQRGILGQNHGICAVATTHSWVPILN
TSQRGILEDEQMYQKCCNLFEKFFPSSSYRRPVGISSMVEAMVSRARIDARIDFESGRxGKKEEFSEIMKxxxTIEELRRQKWWVWLWL
VLREKMP >Protein:PB1|Subtype:N/A|Blocksize:11

>Protein:PB1|Subtype:N/A|Blocksize:11|String:5
xxxxxxxxxxxxxxxxxxxxxxxxxxxxxxxxxxxxxxxxxxxxxxxxxxN

```
xxxxxxxxxxxxxxxxxxxxxxxxxxxxxxxxxxxxxxxxxxxxxxxxIVAMVFSQEECMVKAVRGDLNFxxxxxxxxxxQLLRHFQKDARVLxxxxxxxxxxxxxxxxxx
xxxxxxxxxxxxxxxxxxxxxxx

Fig. 78-1

| Peptide | Affinity (nM) | Allele | Peptide | Affinity (nM) | Allele | Peptide | Affinity (nM) | Allele |
|---|---|---|---|---|---|---|---|---|
| MTNQNSTW | 3.01 | HLA-B*5801 | GPAECRTF | 96.86 | HLA-B*0702 | YIKSGQLK | 258.22 | HLA-A*0301 |
| FLMQIATL | 3.4 | HLA-A*0201 | SQYREEAL | 97.52 | HLA-B*3901 | TANSIIVF | 258.26 | HLA-B*1501 |
| ETIKNGTY | 3.4 | HLA-A*2601 | AMEDFQLI | 97.57 | HLA-A*0201 | NIYKILSI | 258.58 | HLA-A*0201 |
| ITYENNTW | 3.51 | HLA-B*5801 | GQGDVVLV | 97.58 | HLA-A*0201 | HNVHRSTI | 258.69 | HLA-B*0801 |
| LSAGGHIW | 3.69 | HLA-B*5801 | ALFLAFIL | 97.67 | HLA-A*0201 | YLTGTWDT | 258.78 | HLA-A*0201 |
| REIHIYYL | 3.73 | HLA-B*4001 | WFRNILSM | 97.7 | HLA-B*0801 | EVITAQEL | 258.78 | HLA-A*2601 |
| ETIRNGTY | 3.78 | HLA-A*2601 | QIRGFVYF | 97.78 | HLA-B*1501 | RFLFSSIK | 258.8 | HLA-A*0301 |
| REVHMYYL | 3.84 | HLA-B*4001 | QLIPMISK | 97.9 | HLA-A*0301 | ATRLYVNK | 258.84 | HLA-A*0301 |
| RMDYYWAV | 3.86 | HLA-A*0201 | LLLIVQAL | 97.91 | HLA-A*0201 | SIVRRATV | 258.85 | HLA-B*0801 |
| IMMAGLSF | 3.89 | HLA-B*1501 | IPSGSLKL | 97.97 | HLA-B*0702 | SLESRSGF | 259.1 | HLA-B*1501 |
| REVHVYYL | 3.94 | HLA-B*4001 | TIHDRSPY | 98 | HLA-B*1501 | WSGYSGIF | 259.11 | HLA-B*1501 |
| FLAMITYI | 4.08 | HLA-A*0201 | FEVMNHEF | 98.29 | HLA-B*4001 | IASMRRSY | 259.19 | HLA-B*1501 |
| REVHIYYL | 4.14 | HLA-B*4001 | SGSFIDYW | 98.3 | HLA-B*5801 | SFGGFTFK | 259.42 | HLA-A*0301 |
| REVHTYYL | 4.18 | HLA-B*4001 | NLVAPWYA | 98.44 | HLA-A*0201 | LENSHPGI | 259.58 | HLA-B*4001 |
| ITYKNNTW | 4.23 | HLA-B*5801 | SIASRSGY | 98.45 | HLA-A*2601 | LLEKNVTV | 259.68 | HLA-A*0201 |
| TLIENTYV | 4.33 | HLA-A*0201 | MMAMRYPI | 98.46 | HLA-B*1501 | AIMIAGIF | 259.68 | HLA-B*1501 |
| LSAGGAIW | 4.34 | HLA-B*5801 | LIAPWYAY | 98.53 | HLA-B*1501 | GLVLGNPM | 260.36 | HLA-B*1501 |
| VTTVGWSW | 4.4 | HLA-B*5801 | RRLIQLIV | 98.58 | HLA-B*2705 | SVSSFEKF | 260.53 | HLA-B*1501 |
| RSWMKLYW | 4.43 | HLA-B*5801 | RRSGGIGK | 98.79 | HLA-B*2705 | LLLAFILW | 260.74 | HLA-B*5801 |
| LSAGGSIW | 4.44 | HLA-B*5801 | YQSRFEAV | 98.86 | HLA-B*3901 | DANVHNLY | 261 | HLA-A*2601 |
| ITSLCSIW | 4.44 | HLA-B*5801 | ETSHTGTY | 99.02 | HLA-A*0101 | RLGKGYMF | 261.14 | HLA-B*1501 |
| ETIVETGY | 4.5 | HLA-A*2601 | KEIGNGCF | 99.18 | HLA-B*4001 | MRTFFGWK | 261.2 | HLA-B*2705 |
| YQSGTYPV | 4.56 | HLA-A*0201 | IEGGWTGL | 99.23 | HLA-B*4001 | LILRDCSV | 261.25 | HLA-A*0201 |
| SMSCFVFV | 4.66 | HLA-A*0201 | GIFSVEGK | 99.65 | HLA-A*0301 | SVWAGRTM | 261.49 | HLA-B*1501 |
| KSWTKIYW | 4.69 | HLA-B*5801 | RTSISCLY | 99.71 | HLA-B*5801 | FQKDAKIL | 261.54 | HLA-B*3901 |
| IMIAGLSF | 4.69 | HLA-B*1501 | SILNLGQK | 99.75 | HLA-A*0301 | GTYDYSKY | 261.59 | HLA-A*0301 |
| DVVNFLSM | 4.81 | HLA-A*2601 | DIILWFSF | 99.8 | HLA-A*2601 | SLMLATGM | 261.61 | HLA-A*0201 |
| LSASGDIW | 4.95 | HLA-B*5801 | FSFGASCF | 99.91 | HLA-B*5801 | GTYNYPKY | 261.87 | HLA-A*0301 |
| ETILETGY | 5.02 | HLA-A*2601 | SVQRNLPF | 100.06 | HLA-B*1501 | HANNSTTK | 261.94 | HLA-A*0301 |
| LSAGGNIW | 5.2 | HLA-B*5801 | ALSVVSLL | 100.14 | HLA-A*0201 | SEAPGWSW | 262.24 | HLA-B*4001 |
| FLMQITIL | 5.22 | HLA-A*0201 | FQNVSPIW | 100.24 | HLA-B*5801 | RRNYFTAE | 262.47 | HLA-B*2705 |
| NPRMFLAM | 5.25 | HLA-B*0702 | VTNGTMVK | 100.3 | HLA-A*0301 | IMINPVKL | 262.52 | HLA-A*0201 |
| ETIIETGY | 5.27 | HLA-A*2601 | GPRNVPQI | 100.46 | HLA-B*0702 | LILAFIMW | 262.54 | HLA-B*5801 |
| FLMQIAVL | 5.3 | HLA-A*0201 | LIDSISSW | 100.55 | HLA-B*5801 | CHDGMSRM | 262.57 | HLA-B*3901 |
| VSSEVPGW | 5.3 | HLA-B*5801 | KLYKKLKR | 100.58 | HLA-A*0301 | MTHTSQYI | 263.13 | HLA-B*5801 |
| LAAAGDIW | 5.34 | HLA-B*5801 | KIIKWEPL | 100.7 | HLA-A*0301 | SFYRGMRW | 263.16 | HLA-A*2402 |
| YQNSFVPV | 5.51 | HLA-A*0201 | RLGNLNKK | 100.7 | HLA-A*0301 | PEWFRNVL | 263.22 | HLA-B*4001 |
| YQNNFVPV | 5.6 | HLA-A*0201 | LVAPWYAY | 100.73 | HLA-B*1501 | KAVKLYRK | 263.7 | HLA-A*0301 |
| IMVAGLSF | 5.82 | HLA-B*1501 | GLVFFCLK | 100.79 | HLA-A*0301 | KYVEDTKI | 263.79 | HLA-A*2402 |
| SLIWLWLV | 5.84 | HLA-A*0201 | RRMEFSWT | 101.09 | HLA-B*2705 | APDRASFF | 263.85 | HLA-B*0702 |
| FLAPRYAL | 5.98 | HLA-A*0201 | KINSIIDK | 101.15 | HLA-A*0301 | QASYRIFK | 264.05 | HLA-A*0301 |
| LLMSELGV | 6.02 | HLA-A*0201 | YQEVGTYV | 101.16 | HLA-A*0201 | KYSRADKI | 264.07 | HLA-A*2402 |
| KSWMKIYW | 6.05 | HLA-B*5801 | YEELKEQL | 101.32 | HLA-B*4001 | KMFDFTKW | 264.13 | HLA-B*1501 |
| APRYALEL | 6.09 | HLA-B*0702 | SGAFIDYW | 101.46 | HLA-B*5801 | ALGQGTTL | 264.21 | HLA-A*0201 |
| VSSEAPGW | 6.1 | HLA-B*5801 | KINNIVDK | 101.71 | HLA-A*0301 | GLNIGLHL | 264.22 | HLA-A*0201 |
| YMLERELV | 6.25 | HLA-A*0201 | KTNQQFEL | 101.75 | HLA-B*5801 | SLKLASGL | 264.27 | HLA-B*0801 |
| FLMQIAIL | 6.4 | HLA-A*0201 | NLHAYISF | 101.85 | HLA-B*1501 | GIITDTLK | 264.6 | HLA-A*0301 |
| LSAGGDIW | 6.52 | HLA-B*5801 | RMQINPVK | 101.99 | HLA-A*0301 | IRQEMASK | 265.03 | HLA-B*2705 |
| FMYSDFHF | 6.59 | HLA-B*1501 | FHLGTKQV | 101.99 | HLA-B*3901 | LVAGWYGF | 265.17 | HLA-B*1501 |
| LLMNELGV | 6.63 | HLA-A*0201 | IFLARSAL | 102.06 | HLA-B*0801 | RTLDFHDF | 265.33 | HLA-B*1501 |
| SMCSSTEF | 6.7 | HLA-B*1501 | KLSSMGIY | 102.12 | HLA-B*1501 | YNAQLLVW | 265.38 | HLA-B*5801 |
| RSWMKIYW | 6.79 | HLA-B*5801 | NLYGFIIK | 102.57 | HLA-A*0301 | TRQMVHAM | 265.72 | HLA-B*3901 |
| FMPYISFA | 6.82 | HLA-A*0201 | ASAVIWYK | 102.64 | HLA-A*0301 | ATKLYVNK | 265.74 | HLA-A*0301 |
| DTIRNGTY | 6.87 | HLA-A*2601 | TVKDRSPY | 102.75 | HLA-A*2601 | VIAKDNAV | 266.01 | HLA-A*0201 |
| LLMDALKL | 7.1 | HLA-A*0201 | LVRKTRFL | 102.79 | HLA-B*0801 | ALALSHTA | 266.02 | HLA-A*0201 |
| LLADVMGL | 7.26 | HLA-A*0201 | CVYRDNWK | 102.87 | HLA-A*0301 | TFDIGGLY | 266.11 | HLA-A*0101 |
| MSDSIKSW | 7.34 | HLA-B*5801 | WMGRTVSK | 102.95 | HLA-A*0301 | FRNMVWLI | 266.19 | HLA-B*3901 |
| LSAGGGIW | 7.36 | HLA-B*5801 | ILANNGKF | 103 | HLA-B*1501 | AESRKMLL | 266.39 | HLA-B*4001 |
| CEISGFAI | 7.37 | HLA-B*4001 | VYINTAML | 103.08 | HLA-A*2402 | NRMQINPV | 266.61 | HLA-B*2705 |
| KLFALSGV | 7.39 | HLA-A*0201 | MIWDPDGW | 103.21 | HLA-B*5801 | VSWTSNSI | 266.66 | HLA-B*5801 |
| FLLAALLL | 7.44 | HLA-A*0201 | TIALFIGV | 103.25 | HLA-A*0201 | LVAGWYGF | 266.76 | HLA-A*2601 |
| YLIRTLTL | 7.45 | HLA-A*0201 | YQVGYLCA | 103.26 | HLA-A*0201 | CYHSGGTI | 266.86 | HLA-A*2402 |
| WMDYYWGI | 7.56 | HLA-A*0201 | WMKIYWYL | 103.35 | HLA-B*0801 | GRMTFYWT | 266.86 | HLA-B*2705 |
| YLIRALTL | 7.56 | HLA-A*0201 | SITEVWSY | 103.58 | HLA-A*2601 | DRSPYRAL | 267 | HLA-B*3901 |
| LLMDSLKL | 7.57 | HLA-A*0201 | GRMTFYWA | 103.69 | HLA-B*2705 | CFVFVALI | 267.19 | HLA-A*2402 |

Fig. 78-2

| Peptide | Affinity (nM) | Allele | Peptide | Affinity (nM) | Allele | Peptide | Affinity (nM) | Allele |
|---|---|---|---|---|---|---|---|---|
| RPIGISSM | 7.67 | HLA-B*0702 | WMKIYWYL | 103.76 | HLA-A*0201 | RALTLNTM | 267.52 | HLA-B*5801 |
| ALANTIEV | 7.71 | HLA-A*0201 | SIPEWSYI | 103.89 | HLA-A*0201 | YLEEHPST | 267.66 | HLA-A*0201 |
| RPVGISSM | 7.74 | HLA-B*0702 | RARIKTRL | 103.97 | HLA-B*0702 | LPACVYGL | 267.7 | HLA-B*0702 |
| FLLVALFL | 7.75 | HLA-A*0201 | LVAPWYAY | 104.04 | HLA-A*2601 | RADTRILF | 267.84 | HLA-B*5801 |
| GSYGTGSW | 7.88 | HLA-B*5801 | NRLNINPV | 104.1 | HLA-B*3901 | DRSQFRAL | 267.91 | HLA-B*3901 |
| APRYAFEL | 7.89 | HLA-B*0702 | KSWKGNIM | 104.1 | HLA-B*5801 | GIYKILTI | 268.06 | HLA-A*0201 |
| VSAGGDIW | 8.12 | HLA-B*5801 | IEGGWSGL | 104.19 | HLA-B*4001 | GVQLQRFK | 268.06 | HLA-A*0301 |
| IMNTSKPF | 8.15 | HLA-B*1501 | SSMGVYQI | 104.43 | HLA-B*5801 | RRQLRENA | 268.52 | HLA-B*2705 |
| FLTMITYI | 8.23 | HLA-A*0201 | FAMSCFLL | 104.46 | HLA-B*3901 | FEVVDHEF | 268.53 | HLA-B*4001 |
| LSADGDIW | 8.31 | HLA-B*5801 | REQLSQKF | 104.57 | HLA-B*4001 | FFGAIAGF | 268.61 | HLA-A*2402 |
| FLAHALKL | 8.33 | HLA-A*0201 | LANTIEIF | 104.73 | HLA-B*5801 | LTVPEWSY | 268.7 | HLA-A*2601 |
| FLAFILWA | 8.42 | HLA-A*0201 | KILKWEPL | 104.75 | HLA-A*0201 | MMAGLSFW | 268.72 | HLA-B*1501 |
| DVVNFVSM | 8.42 | HLA-A*2601 | APSRVSKF | 104.91 | HLA-B*0702 | CSVAGWLL | 268.73 | HLA-B*5801 |
| YLIEDPTA | 8.45 | HLA-A*0201 | IEGGWPGL | 104.95 | HLA-B*4001 | SVSSFKRF | 268.84 | HLA-B*1501 |
| MQFSSLTV | 8.47 | HLA-A*0201 | KSFSRTQL | 104.95 | HLA-B*5801 | FGDNAEEY | 268.89 | HLA-A*0101 |
| YLIEDPAA | 8.52 | HLA-A*0201 | TSNRGSFY | 105.03 | HLA-A*0101 | FIERPTAV | 269.04 | HLA-A*0201 |
| SPRSRSGF | 8.62 | HLA-B*0702 | KINSWHIF | 105.21 | HLA-B*5801 | ESAVLRGF | 269.09 | HLA-A*2601 |
| TMHDRSPF | 8.64 | HLA-B*1501 | ALFVYSLR | 105.26 | HLA-A*0301 | YRNLVWFI | 269.13 | HLA-B*2705 |
| KPWARNIL | 8.68 | HLA-B*0702 | NPRVFLTM | 105.43 | HLA-B*0801 | NTYDHTKY | 269.16 | HLA-B*1501 |
| YLIEDPSA | 8.75 | HLA-A*0201 | VLWTSNSM | 105.54 | HLA-B*1501 | WMKIYWSL | 269.19 | HLA-A*0201 |
| FIFNGAFI | 8.77 | HLA-A*0201 | WMACHSAA | 105.55 | HLA-B*1501 | IRVGCVIL | 269.36 | HLA-B*3901 |
| KLFTLSGV | 8.93 | HLA-A*0201 | MELRRCLL | 105.59 | HLA-B*4001 | NTYDHKKY | 269.45 | HLA-A*2601 |
| FMQALQLL | 8.97 | HLA-A*0201 | LANTIEVF | 105.66 | HLA-B*5801 | TEIIIRMM | 269.81 | HLA-B*4001 |
| MMAGLSFW | 8.97 | HLA-B*5801 | RLCTINSW | 105.69 | HLA-B*5801 | KAAIGLRI | 269.94 | HLA-B*5801 |
| MLSTVLGV | 9.04 | HLA-A*0201 | TRDSVTEL | 105.83 | HLA-B*3901 | KMFDFSKW | 269.94 | HLA-B*1501 |
| FSFGASSF | 9.07 | HLA-B*1501 | NILSIAPI | 106.14 | HLA-A*0201 | GLRNVPQV | 270.25 | HLA-A*0201 |
| KPRPRRGL | 9.19 | HLA-B*0702 | ETNKFAAI | 106.28 | HLA-A*2601 | FSSLTVSV | 270.31 | HLA-A*0201 |
| MEFSWTIL | 9.21 | HLA-B*4001 | GLTNIPSI | 106.62 | HLA-A*0201 | YVKQSTLK | 270.34 | HLA-A*0301 |
| LAAGGDIW | 9.23 | HLA-B*5801 | NRCYQFAL | 106.66 | HLA-B*3901 | ILEKNITV | 270.42 | HLA-A*0201 |
| FLNNTEPL | 9.35 | HLA-A*0201 | KIMESGEI | 106.84 | HLA-A*0201 | SLYDKVRM | 270.66 | HLA-A*0201 |
| GTYGTGTW | 9.51 | HLA-B*5801 | LRLAVGLR | 106.91 | HLA-B*2705 | QGFAPFSK | 270.71 | HLA-A*0301 |
| LTTTVKTW | 9.58 | HLA-B*5801 | FFRHMVWL | 106.98 | HLA-B*0801 | FESTGNLV | 270.8 | HLA-B*4001 |
| MEFSWILL | 9.61 | HLA-B*4001 | AINEITTK | 107.15 | HLA-A*0301 | RIRIDPVK | 270.82 | HLA-A*0301 |
| GLNSTLPF | 9.65 | HLA-B*1501 | LLGINMSK | 107.18 | HLA-A*0301 | RTSISCLY | 270.88 | HLA-A*0101 |
| MMMGMFNM | 9.71 | HLA-A*0201 | WLGRTISI | 107.32 | HLA-A*0201 | NRIQIDAV | 270.9 | HLA-B*3901 |
| NPRVFLAM | 9.71 | HLA-B*0702 | AATVTLHF | 107.33 | HLA-B*5801 | KGFNSFYR | 271.14 | HLA-A*0301 |
| MSNEGSYF | 9.72 | HLA-B*5801 | KMTITFLI | 107.43 | HLA-A*0201 | RYVEDTKI | 271.7 | HLA-A*2402 |
| MTDSIKSW | 9.72 | HLA-B*5801 | FIMWTCQK | 107.47 | HLA-A*0301 | NLDYQIGY | 271.72 | HLA-A*0101 |
| CEVSGFAI | 9.73 | HLA-B*4001 | RLNPMHQL | 107.54 | HLA-A*0201 | YAFGICPK | 271.96 | HLA-A*0301 |
| RMDYYWAI | 9.85 | HLA-A*0201 | NRLSINPV | 107.55 | HLA-B*3901 | RQEKNPAL | 271.97 | HLA-B*3901 |
| MEFSWTLL | 9.91 | HLA-B*4001 | ALSQGTTI | 107.56 | HLA-A*0201 | LVRGNSPA | 272 | HLA-B*0702 |
| LTTTIRTW | 9.98 | HLA-B*5801 | ETNKFASI | 107.63 | HLA-A*2601 | KLYVWGVH | 272.16 | HLA-A*0301 |
| RMDYYWTL | 10.08 | HLA-A*0201 | FMYSDFHF | 107.7 | HLA-A*2402 | NIVRRATV | 272.42 | HLA-B*0801 |
| QEIGGVKL | 10.09 | HLA-B*4001 | NLYERVRK | 107.73 | HLA-A*0301 | FYRSIRWL | 272.59 | HLA-A*2402 |
| ALNTTLPF | 10.2 | HLA-B*1501 | RADVNDFF | 107.77 | HLA-B*5801 | ISIYWTLV | 272.64 | HLA-A*0201 |
| ETTHTGTY | 10.27 | HLA-A*2601 | GTFGPVHF | 107.95 | HLA-B*1501 | GSFYRSMR | 272.7 | HLA-A*0301 |
| PSDAQAFY | 10.31 | HLA-A*0101 | AVRGDLNF | 108.04 | HLA-B*1501 | IEKEFSEI | 272.76 | HLA-B*4001 |
| WMCSNSSM | 10.31 | HLA-B*1501 | VMEHTSQY | 108.36 | HLA-B*1501 | SSMNNQVF | 272.88 | HLA-B*5801 |
| MADSIKSW | 10.36 | HLA-B*5801 | QEELLVAM | 108.72 | HLA-B*4001 | SRYVCSGL | 273.54 | HLA-B*2705 |
| VMNTSKPF | 10.41 | HLA-B*1501 | IVMCGVNY | 108.81 | HLA-B*1501 | WSYNAQLL | 274.25 | HLA-B*5801 |
| FIIREPFV | 10.42 | HLA-A*0201 | GESHGKII | 109.2 | HLA-B*4001 | SLTEIWSY | 274.31 | HLA-A*2601 |
| MVAGLSFW | 10.45 | HLA-B*5801 | TTITLHFK | 109.21 | HLA-A*0301 | SWMKIYWV | 274.62 | HLA-A*0201 |
| FLSMEFSL | 10.53 | HLA-A*0201 | KYISSGSL | 109.56 | HLA-A*2402 | RGFLIIGK | 274.91 | HLA-A*0301 |
| SELCPSPL | 10.55 | HLA-B*4001 | CHNGVCPV | 109.58 | HLA-B*3901 | WPLSSPPT | 274.95 | HLA-B*0702 |
| NPRIFLAM | 10.57 | HLA-B*0702 | SIHECRTF | 109.64 | HLA-B*1501 | SMFLYVRT | 275.35 | HLA-A*0201 |
| ETSHTGTY | 10.61 | HLA-A*2601 | TSLCSIWF | 109.66 | HLA-B*5801 | RALMSVPM | 275.44 | HLA-B*5801 |
| TEIGAPQL | 10.78 | HLA-B*4001 | ARLGRGYM | 109.84 | HLA-B*2705 | RALMSVPL | 275.67 | HLA-B*0702 |
| FLQALQLL | 10.89 | HLA-A*0201 | LEFKADLI | 109.87 | HLA-B*4001 | KAAMGLKI | 275.8 | HLA-B*5801 |
| KMFDFTKW | 10.91 | HLA-B*5801 | MSIGITVI | 109.94 | HLA-B*5801 | RQTYDWTL | 275.87 | HLA-A*0201 |
| SPRLRSGF | 10.93 | HLA-B*0702 | YAFGNCPM | 109.94 | HLA-B*1501 | RALMSCPL | 275.88 | HLA-B*0702 |
| LPRRSGAA | 10.96 | HLA-B*0702 | WMGRTINK | 110.55 | HLA-A*0301 | IYNETVRL | 276.02 | HLA-A*2402 |
| FESSGGLL | 11 | HLA-B*4001 | CQNGVCPV | 110.62 | HLA-A*0201 | HQYSERGK | 276.24 | HLA-A*0301 |
| YLIEDPGA | 11.16 | HLA-A*0201 | GPRNVPQV | 110.8 | HLA-B*0702 | ALHQGTTI | 276.31 | HLA-A*0201 |
| SLNGISPV | 11.19 | HLA-A*0201 | SSLPLCPF | 110.91 | HLA-B*5801 | TTAVAVLK | 276.31 | HLA-A*0301 |
| IMIAGLFF | 11.31 | HLA-B*1501 | LEFIAEEF | 111.19 | HLA-B*4001 | WIRFNSDL | 276.77 | HLA-B*0801 |

Fig. 78-3

| Peptide | Affinity (nM) | Allele | Peptide | Affinity (nM) | Allele | Peptide | Affinity (nM) | Allele |
|---|---|---|---|---|---|---|---|---|
| FESNGALL | 11.51 | HLA-B*4001 | NRIMINPV | 111.22 | HLA-B*3901 | VPKRNRSI | 276.83 | HLA-B*0801 |
| LLIGISNV | 11.54 | HLA-A*0201 | VEQRINML | 111.23 | HLA-B*4001 | TSNQGSFY | 276.95 | HLA-B*1501 |
| GTYGTGSW | 11.55 | HLA-B*5801 | CSNDTINY | 111.24 | HLA-A*0101 | SFYAEMEW | 277.1 | HLA-A*2402 |
| VEWTSNSL | 11.66 | HLA-B*4001 | AELAEKAM | 111.25 | HLA-B*4001 | GTYDHKEF | 277.11 | HLA-B*1501 |
| TEVETYVL | 11.66 | HLA-B*4001 | GLMGRTRI | 111.26 | HLA-A*0201 | TFDIEGLY | 277.19 | HLA-A*0101 |
| KLLPFAAA | 11.74 | HLA-A*0201 | SLVGIDPF | 111.34 | HLA-B*1501 | FLMQITIL | 277.56 | HLA-B*3901 |
| ILAIYATV | 11.74 | HLA-A*0201 | GLIAPNRV | 111.43 | HLA-A*0201 | KLNRLIER | 277.6 | HLA-A*0301 |
| FLARSALI | 11.75 | HLA-A*0201 | LYKNTNTL | 111.46 | HLA-A*2402 | ITVGSSNY | 277.64 | HLA-A*2601 |
| GTYGAGSW | 11.76 | HLA-B*5801 | SSFYAEMK | 111.51 | HLA-A*0301 | DECRFYAL | 277.64 | HLA-B*4001 |
| MMTHTSQY | 12 | HLA-B*1501 | KRLTTTIK | 111.57 | HLA-B*2705 | VSWTSNSM | 277.69 | HLA-B*1501 |
| YMFESKSM | 12 | HLA-B*1501 | SFFYRYGF | 111.58 | HLA-A*2402 | FALSGVAI | 277.84 | HLA-A*0201 |
| YLIEDPNA | 12.04 | HLA-A*0201 | SVFNSLYA | 111.68 | HLA-A*0201 | IVALCGSK | 278.11 | HLA-A*0301 |
| LTTTIKTW | 12.06 | HLA-B*5801 | FLAPRYSF | 111.8 | HLA-A*0201 | CQLNEGVM | 278.11 | HLA-B*1501 |
| MMAMRYPI | 12.07 | HLA-B*0801 | GRLMDFLK | 112.03 | HLA-B*2705 | CMRTFFGW | 278.21 | HLA-B*5801 |
| FESNGAFL | 12.1 | HLA-B*4001 | FYRNVVWL | 112.09 | HLA-A*2402 | FEATGNLV | 278.45 | HLA-B*4001 |
| APRGHYRL | 12.14 | HLA-B*0702 | ATVTLHFK | 112.26 | HLA-A*0301 | KAALGLRI | 278.47 | HLA-B*5801 |
| IIIAGLSF | 12.18 | HLA-B*1501 | GPSFYAEM | 112.52 | HLA-B*0702 | MTLSVVSL | 278.51 | HLA-A*0201 |
| SPRSRNGF | 12.3 | HLA-B*0702 | LVLGLSMV | 112.89 | HLA-A*0201 | RMEFSWTI | 278.6 | HLA-A*0201 |
| SILYFWGV | 12.31 | HLA-A*0201 | WSGYSGVF | 112.89 | HLA-B*1501 | SVQSRGLF | 278.77 | HLA-B*1501 |
| MEFFWTLL | 12.38 | HLA-B*4001 | SARSALIL | 113 | HLA-B*0702 | GLLDVWTY | 279.06 | HLA-B*1501 |
| LLMSTNAY | 12.48 | HLA-B*1501 | KIITIGSV | 113.18 | HLA-A*0201 | SFYAELRW | 279.07 | HLA-A*2402 |
| DVVNYVSM | 12.54 | HLA-A*2601 | WLGRTISK | 113.29 | HLA-A*0301 | SRLNRQEI | 279.15 | HLA-B*2705 |
| ISNEGSYF | 12.54 | HLA-B*5801 | KELGNGCF | 113.37 | HLA-B*4001 | IQNEDIPI | 279.44 | HLA-B*1501 |
| SLFSSIKK | 12.56 | HLA-A*0301 | ALTGGQSF | 113.68 | HLA-B*1501 | APPEQSRM | 279.54 | HLA-B*0702 |
| SQSGRISF | 12.7 | HLA-B*1501 | KLSSMGVY | 113.69 | HLA-A*0301 | FELINNEF | 279.67 | HLA-B*4001 |
| FLVCVSLL | 12.71 | HLA-A*0201 | FIAEEFQW | 113.79 | HLA-B*5801 | RAVKLYRK | 279.73 | HLA-A*0301 |
| KLYERVRK | 12.71 | HLA-A*0301 | YLMLNKSL | 113.9 | HLA-A*0201 | HGVKGFSF | 279.75 | HLA-B*1501 |
| KMFDFSKW | 12.73 | HLA-B*5801 | APACDLHL | 114.06 | HLA-B*0702 | GTNNYGVK | 280.11 | HLA-A*0301 |
| IEYNGKSL | 12.83 | HLA-B*4001 | KMLLIVQA | 114.21 | HLA-A*0201 | MLLIVQAL | 280.5 | HLA-B*0801 |
| ITDTIRSW | 12.84 | HLA-B*5801 | GTQGVKGW | 114.25 | HLA-B*5801 | DRIPHRTL | 280.52 | HLA-B*3901 |
| AMKHTSQY | 12.84 | HLA-B*1501 | MIWDANGW | 114.25 | HLA-B*5801 | RKRMTRGL | 280.54 | HLA-B*0702 |
| GLNTTLPF | 12.85 | HLA-B*1501 | WFRNVLSI | 114.34 | HLA-B*0801 | QAYTKVMY | 280.68 | HLA-B*1501 |
| ETNHTGTY | 12.91 | HLA-A*2601 | SSVKNGTY | 114.39 | HLA-B*1501 | VEQEIRAF | 280.8 | HLA-B*4001 |
| YQKCCSLF | 12.91 | HLA-B*1501 | RPWVRGQS | 114.43 | HLA-B*0702 | HKMESRGL | 280.87 | HLA-B*3901 |
| KADHRIYW | 12.96 | HLA-B*5801 | RPAIEIDM | 114.58 | HLA-B*0702 | QINGKLNK | 281.1 | HLA-A*0301 |
| AINSSMPF | 13.04 | HLA-B*1501 | TIALLIGV | 114.63 | HLA-A*0201 | RTLMSVEI | 281.19 | HLA-B*5801 |
| KLLPFASA | 13.09 | HLA-A*0201 | YSIDSGYV | 114.8 | HLA-A*0201 | AATVTLHF | 281.55 | HLA-B*1501 |
| FESNGGFL | 13.11 | HLA-B*4001 | EMSNEGSY | 114.84 | HLA-A*2601 | MSDIEAMA | 281.62 | HLA-A*0101 |
| QEINGIKL | 13.13 | HLA-B*4001 | YNAELFVL | 114.84 | HLA-B*3901 | ITYSSPMM | 281.65 | HLA-B*1501 |
| AMDEFQLI | 13.15 | HLA-A*0201 | FEMIDNEF | 114.84 | HLA-B*4001 | LEVGTRWM | 281.68 | HLA-B*4001 |
| ISFATSCF | 13.15 | HLA-B*5801 | MSLNISLY | 114.89 | HLA-A*0101 | LRDNAKEL | 281.94 | HLA-B*3901 |
| FESNGGLL | 13.24 | HLA-B*4001 | NEIRTFSF | 115.09 | HLA-B*4001 | NKCYQFAL | 281.95 | HLA-B*3901 |
| RMNYYWTL | 13.27 | HLA-A*0201 | VVSPDLSY | 115.2 | HLA-B*1501 | FYRSVRWL | 282.09 | HLA-A*2402 |
| QEIEGIKL | 13.3 | HLA-B*4001 | MSNNSTEK | 115.23 | HLA-A*0301 | PADTRVYY | 282.16 | HLA-A*0101 |
| ILAVYSTV | 13.33 | HLA-A*0201 | NMRCTSCI | 115.28 | HLA-B*0801 | QITGFAPF | 282.24 | HLA-B*1501 |
| LMSCPIGV | 13.41 | HLA-A*0201 | NYARLYIW | 115.52 | HLA-A*2402 | VLKPGQTV | 282.4 | HLA-A*0201 |
| HEGEGIPL | 13.49 | HLA-B*4001 | ALLLAFVL | 115.61 | HLA-A*0201 | SPRSRSGF | 282.46 | HLA-B*0801 |
| KQMTRGLF | 13.53 | HLA-B*1501 | YQAKFEAV | 115.61 | HLA-B*3901 | SLQFRICI | 282.7 | HLA-B*0801 |
| SVLYFWGV | 13.54 | HLA-A*0201 | RESTQKAI | 115.72 | HLA-B*4001 | FQKNAKVL | 282.77 | HLA-B*1501 |
| MQIRGFVY | 13.63 | HLA-B*1501 | GEKANVLI | 115.98 | HLA-B*4001 | YLCTGILT | 283.28 | HLA-A*0201 |
| LMSCPMGV | 13.64 | HLA-A*0201 | ILNLGQRK | 116.26 | HLA-A*0301 | KSCVNRCF | 283.39 | HLA-B*5801 |
| ITDTVKSW | 13.64 | HLA-B*5801 | ILAIYSTA | 116.32 | HLA-A*0201 | LIDSIGSW | 283.9 | HLA-B*5801 |
| LLMNELGI | 13.65 | HLA-A*0201 | IYSSSMMW | 116.44 | HLA-A*2402 | LAIYSTAA | 284.05 | HLA-B*1501 |
| EVILWFSF | 13.68 | HLA-A*2601 | LQDTTWDV | 116.51 | HLA-A*0201 | WSYNADLL | 284.15 | HLA-B*5801 |
| LLDPGDTV | 13.74 | HLA-A*0201 | YGIKGFSF | 116.55 | HLA-B*1501 | GENSDVLV | 284.18 | HLA-B*4001 |
| RISSSFSF | 13.77 | HLA-B*1501 | IIFVKEGK | 116.58 | HLA-A*0301 | SSTYQSNF | 284.23 | HLA-B*1501 |
| GTYGSGSW | 13.81 | HLA-B*5801 | WMGTTISK | 116.61 | HLA-A*0301 | GYQSLRSI | 284.32 | HLA-A*2402 |
| LLIGVSNV | 13.83 | HLA-A*0201 | GTFEFTSF | 116.67 | HLA-B*5801 | NSFEQITF | 284.5 | HLA-B*5801 |
| FMARSALI | 13.99 | HLA-A*0201 | SFYRNLLW | 117.04 | HLA-A*2402 | SLLLQANL | 284.61 | HLA-A*0201 |
| FEKEGYSL | 14 | HLA-B*4001 | FQNVSPVW | 117.09 | HLA-B*5801 | RPKEMEGI | 284.62 | HLA-B*0702 |
| MACHSAAF | 14.05 | HLA-B*1501 | LYKNANTL | 117.14 | HLA-A*2402 | LSYSAGAL | 285.02 | HLA-B*1501 |
| KMSLLTEV | 14.1 | HLA-A*0201 | TSNSMVTF | 117.55 | HLA-B*1501 | RIDFHWLL | 285.3 | HLA-A*0201 |
| LLDPNDTV | 14.14 | HLA-A*0201 | KLSNMGIY | 117.57 | HLA-B*1501 | TEEQAVGI | 285.34 | HLA-B*4001 |
| LLAAIMGL | 14.14 | HLA-A*0201 | MARSALIL | 117.82 | HLA-B*0801 | CQTPLGAL | 285.45 | HLA-B*3901 |
| QEIDGIKL | 14.14 | HLA-B*4001 | RSGYSGVF | 117.94 | HLA-B*1501 | RIESLNKK | 285.82 | HLA-A*0301 |

Fig. 78-4

| Peptide | Affinity (nM) | Allele | Peptide | Affinity (nM) | Allele | Peptide | Affinity (nM) | Allele |
|---|---|---|---|---|---|---|---|---|
| KLYGSGSK | 14.26 | HLA-A*0301 | GVNDRNFW | 117.99 | HLA-B*5801 | SLVLIVSL | 285.88 | HLA-A*0201 |
| KMFDFIKW | 14.26 | HLA-B*5801 | FHLATKQV | 118.02 | HLA-B*3901 | EVKRRLST | 285.99 | HLA-B*0801 |
| SLNGVSPV | 14.27 | HLA-A*0201 | IPSWAGNI | 118.09 | HLA-B*0702 | GTIRNGTY | 286.58 | HLA-B*1501 |
| KMNTQILV | 14.33 | HLA-A*0201 | LIAPRGYY | 118.12 | HLA-B*1501 | FRNMVWLI | 286.63 | HLA-B*2705 |
| LMSCPVGV | 14.59 | HLA-A*0201 | ITVWSSKY | 118.42 | HLA-B*5801 | YLWGVHHP | 286.67 | HLA-A*0201 |
| VLWTSNSV | 14.6 | HLA-A*0201 | FYRSLLWI | 118.8 | HLA-A*2402 | CIVPCFWL | 286.82 | HLA-A*0201 |
| QEIEGVKL | 14.68 | HLA-B*4001 | RRKRRGLF | 118.91 | HLA-B*2705 | KGMLGFVF | 286.82 | HLA-B*1501 |
| FESDGAFL | 14.7 | HLA-B*4001 | GMRNVPEK | 118.97 | HLA-A*0301 | FAISCFLL | 286.96 | HLA-B*3901 |
| RMNYYWTI | 14.73 | HLA-A*0201 | SGSFMDYW | 119.21 | HLA-B*5801 | SQYICSPV | 287.1 | HLA-B*3901 |
| SEIKGVKL | 14.82 | HLA-B*4001 | LSSRISFY | 119.21 | HLA-B*5801 | RANENDFF | 287.45 | HLA-B*1501 |
| APRGHYKL | 14.89 | HLA-B*0702 | YQRTRALV | 119.41 | HLA-B*0801 | NGMNRPIL | 287.61 | HLA-B*0801 |
| FEATGNLL | 14.92 | HLA-B*4001 | IMRTVIAL | 119.73 | HLA-B*0801 | KMEKIVLL | 287.67 | HLA-A*0201 |
| KLYERVKK | 14.97 | HLA-A*0301 | QGWMDYYW | 119.74 | HLA-B*5801 | FESNGGLL | 287.72 | HLA-B*3901 |
| MACNSAAF | 14.98 | HLA-B*1501 | YSIDSSYI | 119.78 | HLA-A*0201 | SFYAELKW | 287.76 | HLA-A*2402 |
| KLYGSGNK | 15.04 | HLA-A*0301 | SSKYRQSF | 119.82 | HLA-B*1501 | LIRGNSPI | 287.78 | HLA-B*0801 |
| FTSFFYRY | 15.08 | HLA-A*0101 | KMNIQILI | 120.03 | HLA-A*0201 | ITIGKCPK | 287.87 | HLA-A*0301 |
| WMCSNGSY | 15.13 | HLA-B*1501 | RMEFFWTL | 120.13 | HLA-A*0201 | VLFIEDGW | 288.07 | HLA-B*5801 |
| AMDDFQLI | 15.17 | HLA-A*0201 | KYGNGAWI | 120.19 | HLA-A*2402 | QIIDIWAY | 288.19 | HLA-B*1501 |
| YQKCCTLF | 15.2 | HLA-B*1501 | QELGDAPF | 120.2 | HLA-B*4001 | FPQMTRSY | 288.33 | HLA-B*0702 |
| AQMALQLF | 15.27 | HLA-B*1501 | TVKDRSPF | 120.24 | HLA-B*1501 | MKHTSQYL | 288.37 | HLA-B*3901 |
| FQNASRHY | 15.3 | HLA-B*1501 | VYVNTALL | 120.28 | HLA-A*2402 | NHTTINNI | 289.18 | HLA-B*3901 |
| AVNSSMPF | 15.41 | HLA-B*1501 | NLLENLQA | 120.29 | HLA-A*0201 | IVLGIINL | 289.35 | HLA-A*0201 |
| KISSSFSF | 15.43 | HLA-B*1501 | ISNQGSFY | 120.32 | HLA-B*1501 | KLRMATGL | 289.53 | HLA-B*1501 |
| ILAIYSTV | 15.46 | HLA-A*0201 | FFKRLNWL | 120.34 | HLA-B*0801 | MSELGVPF | 289.72 | HLA-B*5801 |
| FEREGYSL | 15.56 | HLA-B*4001 | RINYYWTL | 120.55 | HLA-A*0201 | VQNNYTTV | 289.95 | HLA-B*1501 |
| KMNREFEV | 15.57 | HLA-A*0201 | KLEENTSY | 120.55 | HLA-B*1501 | MKLYWHLM | 290.31 | HLA-B*3901 |
| AVATTHSW | 15.66 | HLA-B*5801 | MRINNETI | 120.95 | HLA-B*3901 | RSRSGFEM | 290.31 | HLA-B*5801 |
| AINTTLPF | 15.68 | HLA-B*1501 | VYVEVLHL | 121.16 | HLA-A*2402 | LRFVFSIA | 290.49 | HLA-B*2705 |
| FLLVALLL | 15.78 | HLA-A*0201 | FSNAASYK | 121.19 | HLA-A*0301 | GYSGSFII | 290.53 | HLA-A*2402 |
| SETGAPQL | 15.85 | HLA-B*4001 | KYGNGVWI | 121.31 | HLA-A*2402 | VLNLLIGI | 291.21 | HLA-A*0201 |
| FLLVALLI | 15.87 | HLA-A*0201 | RYGNGVWI | 121.42 | HLA-A*2402 | FESNGGFL | 291.22 | HLA-B*3901 |
| YQRCCNLF | 15.89 | HLA-B*1501 | SSKANQVF | 121.55 | HLA-B*1501 | YLCAGLPS | 291.51 | HLA-A*0201 |
| FQLFLVCV | 15.94 | HLA-A*0201 | VMGARPQV | 121.87 | HLA-A*0201 | EWSRRYEL | 292.11 | HLA-B*0801 |
| RMKWMMAM | 15.96 | HLA-B*1501 | YMFESKRM | 122 | HLA-A*0201 | KIRRRVDM | 292.19 | HLA-B*0801 |
| KSYFANLK | 16.05 | HLA-A*0301 | FKSTQAAI | 122.28 | HLA-B*3901 | SLQNRIQI | 292.23 | HLA-A*0201 |
| WMKIYWSL | 16.13 | HLA-B*0801 | SRSGFEML | 122.3 | HLA-B*3901 | SLKLATGM | 292.24 | HLA-B*1501 |
| EITGFAPF | 16.24 | HLA-A*2601 | NHAVHYCI | 122.31 | HLA-B*3901 | SRINRQEI | 292.31 | HLA-B*2705 |
| RMDYYWGI | 16.27 | HLA-A*0201 | KIIHISPL | 122.37 | HLA-B*1501 | NWILWISF | 292.38 | HLA-A*2402 |
| VSGEVPGW | 16.32 | HLA-B*5801 | NQEELRSL | 122.46 | HLA-B*3901 | GRIDFYWL | 292.56 | HLA-B*2705 |
| RLRSGFEM | 16.42 | HLA-B*1501 | AIGKITNK | 123 | HLA-A*0301 | LVGINMSK | 292.7 | HLA-A*0301 |
| EVSETQGM | 16.43 | HLA-A*2601 | RPKVNGQA | 123.13 | HLA-B*0702 | RRLSANAI | 292.9 | HLA-B*3901 |
| ISFAMSCF | 16.44 | HLA-B*5801 | RLFERVRR | 123.16 | HLA-A*0301 | ILASSGSL | 292.94 | HLA-A*0201 |
| KEWMHVCM | 16.47 | HLA-B*4001 | RINMINDK | 123.23 | HLA-A*0301 | AETRIYYF | 293.01 | HLA-B*4001 |
| SEQAAEAI | 16.53 | HLA-B*4001 | SRSGYEIL | 123.27 | HLA-B*3901 | GVQIQRFK | 293.36 | HLA-A*0301 |
| NTASRSGY | 16.66 | HLA-A*2601 | ALNNRFQI | 123.4 | HLA-A*0201 | TQAAIDQV | 293.66 | HLA-A*0201 |
| ISFAISCF | 16.69 | HLA-B*5801 | YSGSFIDY | 123.53 | HLA-A*0101 | LILSFIMW | 293.82 | HLA-B*5801 |
| HLSSVSSF | 16.69 | HLA-B*1501 | IMMAGLSF | 123.53 | HLA-B*5801 | RIQIDQVK | 294.08 | HLA-A*0301 |
| YERMCNIL | 16.7 | HLA-B*4001 | TPKRNRSI | 123.61 | HLA-B*0702 | LLLIVQAF | 294.28 | HLA-B*1501 |
| KLYGTGNK | 16.71 | HLA-A*0301 | NRIKINPV | 123.66 | HLA-B*3901 | NVLSVAPI | 294.38 | HLA-A*0201 |
| WLKTRPIL | 16.71 | HLA-B*0801 | KLSSMGIY | 123.7 | HLA-A*0301 | GQGGRMEF | 294.46 | HLA-B*1501 |
| TIISSLPF | 16.72 | HLA-B*1501 | SHYVCSGL | 123.77 | HLA-B*3901 | VANGTMVK | 294.59 | HLA-A*0301 |
| QEIEGIRL | 16.78 | HLA-B*4001 | SRAGYEML | 123.77 | HLA-B*3901 | GTYDYPHY | 294.78 | HLA-A*0301 |
| KEWMHICM | 16.86 | HLA-B*4001 | GLIAPSRV | 123.83 | HLA-A*0201 | RTLMSCPM | 294.79 | HLA-B*5801 |
| RLYGSGNK | 16.88 | HLA-A*0301 | SKMQFSSL | 123.85 | HLA-B*3901 | KYDNGVWI | 295.2 | HLA-A*2402 |
| KLYGSGAK | 16.88 | HLA-A*0301 | MEFSWTIL | 123.86 | HLA-B*3901 | FSFQLILL | 295.26 | HLA-A*0201 |
| ILAIYSAV | 16.92 | HLA-A*0201 | KRMQDGFL | 123.92 | HLA-B*2705 | GYSGSFTL | 295.31 | HLA-A*2402 |
| RYGFVANF | 16.97 | HLA-A*2402 | KRFADQEL | 123.96 | HLA-B*2705 | KTEDNIYK | 295.39 | HLA-A*0301 |
| SMTEVMVV | 17.06 | HLA-A*0201 | SMDSRSGY | 124.15 | HLA-A*0101 | IMEKNVTV | 295.59 | HLA-A*0201 |
| SECRTFFL | 17.12 | HLA-B*4001 | RVRDNITK | 124.47 | HLA-A*0201 | YLCAGIPS | 296.14 | HLA-A*0201 |
| LLKHRFEI | 17.15 | HLA-B*0801 | ATNLYVNK | 124.5 | HLA-A*0301 | GRMTDSIK | 296.31 | HLA-B*2705 |
| KLLQTSQV | 17.2 | HLA-A*0201 | TIISNLPF | 124.6 | HLA-A*2601 | LLTEVETY | 296.49 | HLA-B*1501 |
| MLNPNDTV | 17.2 | HLA-A*0201 | LAASIMGF | 124.68 | HLA-B*5801 | YINNTTII | 296.63 | HLA-A*0201 |
| SIYWTIVK | 17.2 | HLA-A*0301 | VISPDLSY | 124.72 | HLA-B*1501 | CYHNGGTI | 296.7 | HLA-A*2402 |
| EAIRNGTY | 17.33 | HLA-A*2601 | CHNGTCAV | 124.87 | HLA-B*3901 | FSLGASCF | 296.83 | HLA-B*5801 |
| FILKDCSV | 17.38 | HLA-A*0201 | NTYNHTQY | 125.1 | HLA-B*1501 | NLKLATGL | 297 | HLA-B*0801 |

Fig. 78-5

| Peptide | Affinity (nM) | Allele | Peptide | Affinity (nM) | Allele | Peptide | Affinity (nM) | Allele |
|---|---|---|---|---|---|---|---|---|
| ETTRNGTY | 17.44 | HLA-A*2601 | KINMINDK | 125.2 | HLA-A*0301 | YIKQNTLK | 297.04 | HLA-A*0301 |
| NEIKGVEL | 17.44 | HLA-B*4001 | RTHQYSEK | 125.24 | HLA-A*0301 | APEYGHLI | 297.1 | HLA-B*0702 |
| FVIREPFV | 17.46 | HLA-A*0201 | ITVGSSNY | 125.29 | HLA-B*1501 | IQIDSVKL | 297.24 | HLA-B*1501 |
| TMKDRSPY | 17.53 | HLA-B*1501 | KRIRLFDY | 125.3 | HLA-B*2705 | SLPLCPFK | 297.47 | HLA-A*0301 |
| MMIWHSNL | 17.57 | HLA-A*0201 | GYSGAFTI | 125.45 | HLA-A*2402 | KGILGFVF | 297.47 | HLA-B*1501 |
| ITDTIKSW | 17.62 | HLA-B*5801 | FESDGAFL | 125.51 | HLA-B*3901 | RADTKILF | 297.61 | HLA-B*5801 |
| GTFEFTSF | 17.71 | HLA-B*1501 | SSFQVDCF | 125.51 | HLA-B*5801 | YKSTQSAI | 297.87 | HLA-B*3901 |
| KSHAYISF | 17.78 | HLA-B*5801 | SVFNNLYA | 125.58 | HLA-A*0201 | CHDGRSRM | 298.21 | HLA-B*3901 |
| KEWMHVCI | 17.87 | HLA-B*4001 | GIITDTFK | 125.64 | HLA-A*0301 | VPEWSYIM | 298.22 | HLA-B*0702 |
| GLRISSSF | 17.88 | HLA-B*1501 | APDRASFL | 125.74 | HLA-B*0702 | ASGSSISF | 298.43 | HLA-B*5801 |
| SIYWTVVK | 17.94 | HLA-A*0301 | SGAFMDYW | 126.05 | HLA-B*5801 | QIIKLLPF | 298.67 | HLA-A*2601 |
| AECRTFFL | 17.96 | HLA-B*4001 | ISMEDYSI | 126.07 | HLA-B*5801 | GLILGNPK | 298.74 | HLA-A*0301 |
| CLVPCFVV | 17.97 | HLA-A*0201 | FQIQGVRL | 126.13 | HLA-A*0201 | SSSYRRPI | 298.77 | HLA-B*0801 |
| APRGYFKM | 18.01 | HLA-B*0702 | LVRKTRFL | 126.26 | HLA-B*0702 | YLIRALTL | 298.81 | HLA-B*0801 |
| SLNDYEEL | 18.12 | HLA-A*0201 | LVLATGLK | 126.49 | HLA-A*0301 | PEWFRNIL | 298.81 | HLA-B*4001 |
| QEIEGVRL | 18.15 | HLA-B*4001 | LAASIMGF | 126.5 | HLA-B*1501 | DRSPHRAL | 298.84 | HLA-B*3901 |
| RVRSNGNL | 18.38 | HLA-B*0702 | GMRNIPEK | 126.54 | HLA-A*0301 | GRCPRYVK | 298.86 | HLA-B*2705 |
| LELCPSPL | 18.45 | HLA-B*4001 | SLCLAILV | 126.66 | HLA-A*0201 | YMGECPKY | 298.92 | HLA-B*1501 |
| QELCPSPL | 18.47 | HLA-B*4001 | KYIKQGSL | 126.66 | HLA-A*2402 | SFFRNIVW | 299.12 | HLA-A*2402 |
| WSGLVAGW | 18.56 | HLA-B*5801 | IIKGRSHL | 126.72 | HLA-B*0801 | TRFTYSGI | 299.29 | HLA-B*2705 |
| LLASTNAY | 18.61 | HLA-B*1501 | KIHTRGLF | 126.77 | HLA-B*1501 | VTIGKCPK | 299.31 | HLA-A*0301 |
| ESIRTGTY | 18.62 | HLA-A*2601 | ELRFVFSI | 126.86 | HLA-B*0801 | PTAVDTCY | 299.39 | HLA-A*0101 |
| SMRWLTLK | 18.64 | HLA-A*0301 | STASRSGY | 126.94 | HLA-B*1501 | TSYKILSI | 299.43 | HLA-B*5801 |
| KLNRLISK | 18.81 | HLA-A*0301 | FLAPRYAF | 127.38 | HLA-A*0201 | ASMRRNYF | 299.53 | HLA-B*5801 |
| RANVDDFF | 18.97 | HLA-B*5801 | GMRNIPGK | 127.46 | HLA-A*0301 | KLYIWGVH | 299.55 | HLA-A*0301 |
| RRFIQNAL | 19.04 | HLA-B*2705 | FSRLNWLY | 127.61 | HLA-B*1501 | AIFRKATR | 299.89 | HLA-A*0301 |
| WHDGAEII | 19.05 | HLA-B*3901 | MQIRGFVH | 127.69 | HLA-B*1501 | IQLIVSGK | 300.16 | HLA-A*0301 |
| KLNGIPPL | 19.17 | HLA-A*0201 | SPRLRSGF | 127.74 | HLA-B*0801 | KESLRLAV | 300.41 | HLA-B*4001 |
| FQNTSRHY | 19.29 | HLA-B*1501 | SGFAVVSK | 127.84 | HLA-A*0301 | STYQNSFV | 300.44 | HLA-A*0201 |
| YQAKFESV | 19.48 | HLA-A*0201 | TLVTTSSW | 127.84 | HLA-B*5801 | ITNKVNSI | 300.56 | HLA-B*5801 |
| ITDTLKSW | 19.51 | HLA-B*5801 | SISNDKPF | 128.06 | HLA-B*1501 | WMKIYWHL | 300.7 | HLA-A*0201 |
| ALANTIEI | 19.54 | HLA-A*0201 | RRIWRQAN | 128.14 | HLA-B*2705 | VVDATETV | 300.76 | HLA-A*0201 |
| SVYWTIVK | 19.61 | HLA-A*0301 | LLFLKIPA | 128.27 | HLA-A*0201 | ATTVTLHF | 300.81 | HLA-B*1501 |
| RRLTVLGK | 19.61 | HLA-B*2705 | ARSALILR | 128.27 | HLA-B*2705 | SISCFLLA | 301.15 | HLA-A*0201 |
| ITDTFKSW | 19.61 | HLA-B*5801 | FQRSKFLL | 128.45 | HLA-B*0801 | ITIGKCSK | 301.33 | HLA-A*0301 |
| FSFGGFTF | 19.64 | HLA-B*5801 | MIWDPNGW | 128.51 | HLA-B*5801 | TEVYSETV | 301.45 | HLA-B*4001 |
| NPRVFLTM | 19.68 | HLA-B*0702 | LTLKSGQF | 128.53 | HLA-B*1501 | TRVYYFKK | 301.55 | HLA-B*2705 |
| AQRLESVF | 19.68 | HLA-B*1501 | FSFNGEEM | 128.71 | HLA-B*1501 | RIDFHWLI | 301.58 | HLA-A*0201 |
| ALQLLFEV | 19.71 | HLA-A*0201 | RISSSFSF | 128.87 | HLA-B*5801 | VGVAPSPY | 301.64 | HLA-B*1501 |
| FQNASRYY | 19.74 | HLA-B*1501 | TQIIVILV | 128.96 | HLA-A*0201 | KPKFLPDL | 301.83 | HLA-B*0702 |
| FSFGGFTF | 19.78 | HLA-B*1501 | SGFAIISK | 128.99 | HLA-A*0301 | MALQLFIK | 302.03 | HLA-A*0301 |
| RIDYYWSV | 19.82 | HLA-A*0201 | RSLIQFPI | 128.99 | HLA-B*5801 | ALKLVVAM | 302.06 | HLA-B*0801 |
| ESIKNGTY | 19.95 | HLA-A*2601 | GYKDWFLW | 129.12 | HLA-A*2402 | SLRLAVGL | 302.07 | HLA-B*0801 |
| WMCSNGSM | 19.99 | HLA-B*1501 | TILETRYV | 129.44 | HLA-A*0201 | VLMENEMT | 302.2 | HLA-A*0201 |
| SLRMKWMM | 20.05 | HLA-B*0801 | KWWVWLWL | 129.45 | HLA-A*2402 | YKKLKREI | 302.52 | HLA-B*0801 |
| AINSSRPF | 20.07 | HLA-B*1501 | SVKLFSGY | 129.66 | HLA-B*1501 | TRPILSPL | 302.77 | HLA-B*3901 |
| SMKWLTLK | 20.08 | HLA-A*0301 | FYRNLLWI | 129.72 | HLA-A*2402 | LIRGNSPI | 302.85 | HLA-B*0702 |
| ILLHIVSI | 20.09 | HLA-A*0201 | YVKQGSLN | 129.74 | HLA-B*1501 | SFYKSMRW | 303.13 | HLA-A*2402 |
| SVYWTVVK | 20.09 | HLA-A*0301 | DIILWVSF | 129.83 | HLA-A*2601 | FFRNIVWL | 303.17 | HLA-B*0801 |
| MLNKSLCK | 20.24 | HLA-A*0301 | ILAIYSAA | 129.91 | HLA-A*0201 | HVDTIMEK | 303.2 | HLA-A*0301 |
| MSNEGSYF | 20.3 | HLA-B*1501 | SSKCQQSF | 129.97 | HLA-B*1501 | MRISNETI | 303.2 | HLA-B*2705 |
| NTYDHSHY | 20.31 | HLA-A*2601 | SYNAELLI | 130.11 | HLA-A*2402 | STDTVDTI | 303.48 | HLA-A*0101 |
| SLCYPGSF | 20.34 | HLA-B*1501 | RRLVQLIV | 130.29 | HLA-B*2705 | YQAELLVA | 303.54 | HLA-B*1501 |
| KYIPSNSL | 20.36 | HLA-A*2402 | IMKTGGTL | 130.34 | HLA-B*1501 | QVTGFAPF | 303.65 | HLA-B*1501 |
| IIYENNTW | 20.38 | HLA-B*5801 | IIIAIGSV | 130.5 | HLA-A*0201 | RISHRTLL | 303.67 | HLA-B*0702 |
| FLAPRYSF | 20.53 | HLA-B*1501 | VLVTREPY | 130.69 | HLA-B*1501 | CPSPLRLI | 303.71 | HLA-B*0702 |
| ALMEWLKT | 20.57 | HLA-A*0201 | QTIINNYY | 130.81 | HLA-A*2601 | FRNVVWLV | 303.77 | HLA-B*3901 |
| HMRKKRGL | 20.6 | HLA-B*0801 | TGFASFSK | 131.13 | HLA-A*0301 | VANVNNLY | 303.93 | HLA-A*0101 |
| YQAKFEAV | 20.7 | HLA-A*0201 | ISVGSGSF | 131.18 | HLA-B*5801 | YVSMEFSL | 304.02 | HLA-A*0201 |
| YQNVGTYV | 20.76 | HLA-A*0201 | FYRNLLWL | 131.29 | HLA-A*2402 | FFRNMVWL | 304.03 | HLA-B*0801 |
| MRWLTLKL | 20.82 | HLA-B*2705 | VQNNYTTI | 131.69 | HLA-B*1501 | KTSWSYIV | 304.22 | HLA-A*0201 |
| YHANNSTV | 20.93 | HLA-B*3901 | VLEAMAFL | 131.72 | HLA-A*0201 | FFRNMIWL | 304.43 | HLA-B*0801 |
| LQANLCRF | 21 | HLA-B*1501 | WFRNVLSV | 131.8 | HLA-B*0801 | HQSGTYPI | 304.51 | HLA-A*0201 |
| MLKVPNAL | 21.04 | HLA-B*0801 | SLQCTICI | 131.88 | HLA-A*0201 | TYQRTRAL | 304.6 | HLA-A*2402 |
| AMTHTSQY | 21.07 | HLA-B*1501 | GQAGRIDF | 131.9 | HLA-B*1501 | GTYDYPQY | 304.76 | HLA-A*0301 |

Fig. 78-6

| Peptide | Affinity (nM) | Allele | Peptide | Affinity (nM) | Allele | Peptide | Affinity (nM) | Allele |
|---|---|---|---|---|---|---|---|---|
| SLVKTTLF | 21.09 | HLA-B*1501 | DVCYPGGF | 132.02 | HLA-A*2601 | RALMSVPM | 304.76 | HLA-B*0702 |
| KLYGAGNK | 21.1 | HLA-A*0301 | FLTHALRF | 132.06 | HLA-B*1501 | VTVGSSKY | 304.78 | HLA-B*1501 |
| KLYGNGNK | 21.12 | HLA-A*0301 | RPWMRISN | 132.09 | HLA-B*0702 | LMIWHSNL | 304.99 | HLA-B*0801 |
| GLFFFCLK | 21.17 | HLA-A*0301 | KILCTSAI | 132.37 | HLA-A*0201 | SLQCRVCI | 305.09 | HLA-B*0801 |
| LLVSTNAY | 21.22 | HLA-B*1501 | GRLIDFLK | 132.64 | HLA-B*2705 | DEICIGYL | 305.34 | HLA-B*4001 |
| ILLHIASI | 21.29 | HLA-A*0201 | FESNGAFL | 132.92 | HLA-B*3901 | LRFVFSNA | 305.54 | HLA-B*2705 |
| KLRSGFEM | 21.29 | HLA-B*1501 | GMKNVPEK | 132.95 | HLA-A*0301 | SQRSKFLL | 305.75 | HLA-B*0801 |
| MVDGWYGY | 21.31 | HLA-A*0101 | ATIRNGTY | 132.95 | HLA-B*1501 | GPNNNASA | 306.65 | HLA-B*0702 |
| FSMSCFVF | 21.41 | HLA-B*5801 | LHIPEVCL | 133.09 | HLA-B*3901 | RMEFSWTL | 306.89 | HLA-B*3901 |
| YKMNNQIL | 21.45 | HLA-B*3901 | NEHSNGTI | 133.1 | HLA-B*4001 | YRNLVWLV | 306.92 | HLA-B*2705 |
| LTTTIKPW | 21.47 | HLA-B*5801 | SRNGFEML | 133.15 | HLA-B*3901 | TSGSSIAF | 306.97 | HLA-B*5801 |
| FVMREPFI | 21.53 | HLA-A*0201 | SLLQSAIL | 133.4 | HLA-A*0201 | AETRVYYF | 307.12 | HLA-B*4001 |
| CEVSGFAV | 21.68 | HLA-B*4001 | RTFSFQLI | 133.58 | HLA-B*5801 | SRFESVAW | 307.14 | HLA-B*2705 |
| EAVAVLKY | 21.7 | HLA-A*2601 | FSFNGAFI | 133.66 | HLA-A*0201 | RLRGIPPL | 307.41 | HLA-B*1501 |
| STASRSGY | 21.84 | HLA-A*2601 | SEGIYKIL | 133.78 | HLA-B*4001 | SQYLCTGI | 307.52 | HLA-A*0201 |
| FLLIALLL | 21.94 | HLA-A*0201 | IYNRMGTI | 133.88 | HLA-A*2402 | APEFGYLL | 307.55 | HLA-B*0702 |
| RSGFEMVW | 21.95 | HLA-B*5801 | SVQPTFSV | 133.9 | HLA-A*0201 | RRLSTNAI | 307.81 | HLA-B*3901 |
| ILSVYSTV | 21.97 | HLA-A*0201 | FSSAASYK | 133.99 | HLA-A*0301 | KTEDNVYK | 307.9 | HLA-A*0301 |
| ITGTIKSW | 22.01 | HLA-B*5801 | FESNGALL | 134.32 | HLA-B*3901 | AVTDVWSY | 308.23 | HLA-A*2601 |
| SIITELPF | 22.11 | HLA-B*1501 | SLMQGSTL | 134.39 | HLA-B*1501 | CHDGKGWL | 308.29 | HLA-B*3901 |
| SINTRLPF | 22.11 | HLA-B*1501 | YAFGNCPM | 134.62 | HLA-B*3901 | GSANSQAY | 308.47 | HLA-A*0101 |
| APRGYYKM | 22.15 | HLA-B*0702 | ISIGSSTY | 134.71 | HLA-B*5801 | SLQCRICI | 308.77 | HLA-B*0801 |
| GPRNVPAI | 22.24 | HLA-B*0702 | CVNRCFYV | 134.75 | HLA-A*0201 | WHDGAEIT | 309.05 | HLA-B*3901 |
| LLFLKIPV | 22.26 | HLA-A*0201 | GTFDTVQV | 135.04 | HLA-A*0201 | YIKQGSLK | 309.28 | HLA-A*0301 |
| NTYDHAQY | 22.27 | HLA-A*2601 | LPLPLCPF | 135.06 | HLA-B*0702 | ILGDCSVA | 309.4 | HLA-A*0201 |
| LSMAPIMF | 22.3 | HLA-B*5801 | KVNNMVDK | 135.47 | HLA-A*0301 | GVRLTQGY | 309.65 | HLA-B*1501 |
| RLSGIPPL | 22.31 | HLA-A*0201 | SYFQLFLV | 135.52 | HLA-A*2601 | LIAPWYGY | 309.74 | HLA-A*2601 |
| ALAQGALV | 22.42 | HLA-A*0201 | ERFEIFPK | 135.61 | HLA-B*2705 | WREQLSQK | 309.93 | HLA-B*2705 |
| NTYDHSRY | 22.45 | HLA-A*2601 | ISNQGSFY | 135.63 | HLA-B*5801 | QYLLFQDI | 309.99 | HLA-A*2402 |
| SSNYHQSF | 22.45 | HLA-B*1501 | SSMPFHNI | 135.66 | HLA-B*5801 | KMITQRTI | 310.24 | HLA-A*0201 |
| KLNRFIEK | 22.48 | HLA-A*0301 | SFYAELRW | 135.68 | HLA-B*5801 | VLIAGGLI | 310.34 | HLA-A*0201 |
| NTYDHSTY | 22.64 | HLA-A*2601 | RTFSFQFI | 136.01 | HLA-A*0201 | TIHDRSQY | 310.64 | HLA-B*1501 |
| RANVNDFF | 22.65 | HLA-B*5801 | VISSDLSY | 136.01 | HLA-B*1501 | WMKIYWVL | 310.8 | HLA-B*3901 |
| WSGMIDGW | 22.66 | HLA-B*5801 | SSRHCSKY | 136.15 | HLA-B*1501 | KGVKLSSM | 311.13 | HLA-B*1501 |
| TETGALQL | 22.67 | HLA-B*4001 | SPLPLCPF | 136.3 | HLA-B*0702 | MKTIIIVL | 311.98 | HLA-B*3901 |
| ITGDNTKW | 22.78 | HLA-B*5801 | YMGECPEY | 136.48 | HLA-B*1501 | STSSRSGF | 312.02 | HLA-A*2601 |
| RRLSTNAM | 22.79 | HLA-B*2705 | LSVPEWSY | 136.55 | HLA-B*1501 | LTKGILGF | 312.07 | HLA-A*2601 |
| FSFNGAFV | 22.81 | HLA-A*0201 | GRINFHWL | 136.56 | HLA-B*2705 | VIVDNNNW | 312.15 | HLA-B*5801 |
| MSKEGSYF | 22.83 | HLA-B*1501 | RTNQQFEL | 136.61 | HLA-B*5801 | ILTDSQTA | 312.3 | HLA-A*0201 |
| ALMEWIKT | 22.87 | HLA-A*0201 | EIKCQTPL | 136.64 | HLA-B*0801 | FSSLTVNV | 312.43 | HLA-A*0201 |
| WSGLIAGW | 22.92 | HLA-B*5801 | WLGRTTSK | 136.67 | HLA-A*0301 | FSFQLILL | 312.77 | HLA-B*3901 |
| TIASSLPF | 22.94 | HLA-B*1501 | YIIERPSA | 136.71 | HLA-A*0201 | TPLGSPPI | 312.89 | HLA-B*0702 |
| MVNGWYGY | 22.99 | HLA-A*2601 | KIRTRGLF | 136.79 | HLA-B*1501 | LSIYSSVA | 312.9 | HLA-B*1501 |
| LLLQIISL | 23.11 | HLA-A*0201 | FLAPRYSF | 137.09 | HLA-B*0801 | GTYDYPQY | 313.09 | HLA-B*5801 |
| TSNSIVTF | 23.18 | HLA-B*5801 | IMIWHSNL | 137.1 | HLA-B*1501 | GRLIQNSI | 313.15 | HLA-B*2705 |
| MEHTSQYL | 23.27 | HLA-B*4001 | KLLLITQA | 137.12 | HLA-A*0201 | VTYTGTSR | 313.53 | HLA-A*0301 |
| YKMNTQIL | 23.29 | HLA-B*3901 | SSRSGFEM | 137.14 | HLA-B*1501 | YLIRTLTL | 313.56 | HLA-B*1501 |
| ALASCMGL | 23.32 | HLA-A*0201 | MRISNETI | 137.15 | HLA-B*3901 | DSEMSKLY | 313.59 | HLA-A*0101 |
| QEVEGVKL | 23.32 | HLA-B*4001 | GPSECRTF | 137.4 | HLA-B*0702 | WVWLWLVL | 313.6 | HLA-B*3901 |
| LLAPRYAF | 23.41 | HLA-B*1501 | SEGTYKIL | 137.41 | HLA-B*4001 | KISHISPL | 313.65 | HLA-B*1501 |
| WTGMVNGW | 23.45 | HLA-B*5801 | GTFGPVHF | 137.66 | HLA-B*5801 | WTYNAELF | 313.8 | HLA-A*2601 |
| SLMQGSTL | 23.49 | HLA-A*0201 | VTNVQNDY | 137.69 | HLA-A*0101 | SLKLATGL | 314.11 | HLA-B*0801 |
| QLSSVSSF | 23.52 | HLA-B*1501 | IWSYNAEF | 137.71 | HLA-A*2402 | SLVLLVSL | 314.36 | HLA-A*0201 |
| VTYTGTSK | 23.54 | HLA-A*0301 | KMNTRILI | 137.93 | HLA-A*0201 | KTWARNIL | 314.67 | HLA-B*5801 |
| YINKTGTF | 23.54 | HLA-B*1501 | LLAPKYGY | 138.03 | HLA-B*1501 | SMVTFCGL | 314.71 | HLA-B*1501 |
| MECRTFFL | 23.59 | HLA-B*4001 | MSKEGSYF | 138.18 | HLA-B*5801 | CPKYVRSA | 314.89 | HLA-B*0702 |
| SEQAAEAM | 23.77 | HLA-B*4001 | SLLNDKHF | 138.4 | HLA-B*1501 | MSRARIDA | 315.85 | HLA-B*0801 |
| ILLHVASI | 23.94 | HLA-A*0201 | RTFSFQFI | 138.5 | HLA-B*5801 | SGVKGWAF | 315.95 | HLA-B*1501 |
| LQNASRHY | 23.98 | HLA-B*1501 | FEGTYKIL | 138.54 | HLA-B*4001 | NSIRNGTY | 316.03 | HLA-B*1501 |
| ISFSISCF | 24.01 | HLA-B*5801 | EIEDLIFM | 138.75 | HLA-A*2601 | GVAIALSV | 316.18 | HLA-A*0201 |
| ISFATSCF | 24.04 | HLA-B*1501 | MELPSFGV | 138.96 | HLA-B*4001 | SEIRTFSF | 316.37 | HLA-B*1501 |
| YSIDSNYV | 24.08 | HLA-A*0201 | LRLATGLR | 139.03 | HLA-B*2705 | DRSPFRTL | 316.48 | HLA-B*3901 |
| ILWVSFSI | 24.16 | HLA-A*0201 | VSWASNSI | 139.1 | HLA-B*5801 | ASDILTRM | 316.63 | HLA-A*0101 |
| MTFYWTMV | 24.18 | HLA-A*0201 | QITDIWAY | 139.16 | HLA-A*2601 | ILHLILWI | 316.82 | HLA-A*0201 |
| ESIRNGTY | 24.24 | HLA-A*2601 | RIQINPVK | 139.17 | HLA-A*0301 | RTSISCLY | 316.95 | HLA-B*1501 |

Fig. 78-7

| Peptide | Affinity (nM) | Allele | Peptide | Affinity (nM) | Allele | Peptide | Affinity (nM) | Allele |
|---|---|---|---|---|---|---|---|---|
| NECRFYAL | 24.24 | HLA-B*4001 | RRDQRALK | 139.21 | HLA-B*2705 | KRCINRCF | 316.97 | HLA-B*2705 |
| LLLQITSL | 24.32 | HLA-A*0201 | CMRPCFWV | 139.3 | HLA-A*0201 | QGFFPFHK | 317.09 | HLA-A*0301 |
| QIIDIWAY | 24.34 | HLA-A*2601 | FSRLNWLY | 139.52 | HLA-A*0101 | DELCPSPL | 317.19 | HLA-B*4001 |
| SLRCRICI | 24.34 | HLA-B*0801 | SSDDFALI | 139.59 | HLA-A*0101 | TYSSSMMW | 317.26 | HLA-A*2402 |
| VEYNGKSL | 24.34 | HLA-B*4001 | WMKIYWDL | 139.72 | HLA-B*0801 | RSSFYAEM | 317.27 | HLA-B*1501 |
| KLYGNGAK | 24.39 | HLA-A*0301 | VPASRYLI | 139.96 | HLA-B*0702 | NLEELRFV | 317.32 | HLA-A*0201 |
| SLYASPQL | 24.43 | HLA-A*0201 | LLIAFVLW | 140.01 | HLA-B*5801 | SRFQIQGV | 317.33 | HLA-B*2705 |
| MLSKSLCK | 24.46 | HLA-A*0301 | TIHDRAAF | 140.08 | HLA-B*1501 | CVLEAMAF | 317.5 | HLA-B*1501 |
| LLFLKVPV | 24.49 | HLA-A*0201 | LEECSCYM | 140.12 | HLA-B*4001 | NGRAPISL | 317.51 | HLA-B*0801 |
| KLFASSGI | 24.49 | HLA-A*0201 | GPSDAQAF | 140.38 | HLA-B*0702 | GTYSYPQY | 317.56 | HLA-B*1501 |
| ILVSTNAY | 24.6 | HLA-B*1501 | KRLGSWSW | 140.49 | HLA-B*2705 | VSWTSNSM | 317.61 | HLA-B*5801 |
| YSIDSSYV | 24.68 | HLA-A*0201 | LRSGFEML | 140.62 | HLA-B*3901 | VLEDEQMY | 317.65 | HLA-A*0101 |
| VQNDYTTV | 24.71 | HLA-A*0201 | VLVGLILA | 140.65 | HLA-A*0201 | RRAIATPG | 317.67 | HLA-B*2705 |
| MMMGMFNM | 24.93 | HLA-B*1501 | FSLGASCF | 140.66 | HLA-B*1501 | STAVAVIK | 317.74 | HLA-A*0301 |
| VQSYFQLF | 24.94 | HLA-B*1501 | VSLGAVSF | 140.73 | HLA-B*1501 | ILKPGQTV | 317.86 | HLA-A*0201 |
| WTGMVDGW | 24.98 | HLA-B*5801 | SILANNGK | 140.75 | HLA-A*0301 | LSGREWSY | 318 | HLA-A*0101 |
| KEWLHVCI | 25 | HLA-B*4001 | HNVHRNAI | 140.78 | HLA-B*0801 | FIMWACNS | 318.1 | HLA-A*0201 |
| ILWISFAI | 25.03 | HLA-A*0201 | KMNTRFEA | 140.84 | HLA-A*0201 | SFYAEMKW | 318.25 | HLA-B*5801 |
| RSRIDYYW | 25.05 | HLA-B*5801 | GRNSFFSR | 140.84 | HLA-B*2705 | SQGTKRPY | 318.41 | HLA-B*1501 |
| FMYSDFHF | 25.13 | HLA-A*0201 | RRFIQNAL | 140.86 | HLA-B*3901 | YKSTPSAI | 318.64 | HLA-B*3901 |
| FTFNGAFI | 25.22 | HLA-A*0201 | GLILSNPK | 141.03 | HLA-A*0301 | SRLNRNEI | 318.75 | HLA-B*2705 |
| NTYDHSQY | 25.22 | HLA-A*2601 | GMCYPGFV | 141.07 | HLA-A*0201 | MRCTISLV | 318.76 | HLA-B*2705 |
| FLTQGALL | 25.25 | HLA-A*0201 | GVKGFGFK | 141.27 | HLA-A*0301 | SFYRSIRW | 318.78 | HLA-A*2402 |
| ILSIYSTV | 25.34 | HLA-A*0201 | STSSRSGF | 141.54 | HLA-B*1501 | SVKLSSGY | 319.25 | HLA-A*2601 |
| SVTELWSY | 25.39 | HLA-A*2601 | FSISCFLL | 141.57 | HLA-A*0201 | SFFSKLNW | 319.41 | HLA-A*2402 |
| FLFSSIKK | 25.5 | HLA-A*0301 | SLQQIESI | 141.7 | HLA-A*0201 | NARLLVLL | 319.49 | HLA-B*0801 |
| SSFSFGGF | 25.59 | HLA-B*1501 | NQPAATAL | 141.71 | HLA-B*3901 | FGASCFIL | 319.76 | HLA-B*3901 |
| SIISFCGV | 25.67 | HLA-A*0201 | LTKGMLGF | 141.81 | HLA-B*1501 | GTYNHREY | 319.8 | HLA-A*0301 |
| GQSGRISF | 25.69 | HLA-B*1501 | YQRSKFLL | 141.85 | HLA-B*0801 | LIRHENRM | 319.99 | HLA-B*1501 |
| GQAGRMTF | 25.75 | HLA-B*1501 | GWYGYHHI | 141.88 | HLA-A*2402 | VWWTANSI | 320.03 | HLA-A*2402 |
| IEEGINQL | 25.79 | HLA-B*4001 | SSMGIYQI | 141.89 | HLA-B*5801 | AMQNRIQI | 320.44 | HLA-A*0201 |
| RSGFEMIW | 25.83 | HLA-B*5801 | VLAIYSCI | 141.92 | HLA-A*0201 | SRVDNHSM | 321.04 | HLA-B*3901 |
| ISFSMSCF | 25.84 | HLA-B*5801 | TSNSIVAF | 141.93 | HLA-B*1501 | WRGSNRPV | 321.07 | HLA-B*3901 |
| KLANVVRK | 25.91 | HLA-A*0301 | CRFEGWIV | 141.94 | HLA-B*3901 | TVVLNTDW | 321.25 | HLA-B*5801 |
| MIAGLSFW | 25.97 | HLA-B*5801 | IQNEDIPI | 141.98 | HLA-A*0201 | SPRSRNGF | 321.26 | HLA-B*0801 |
| FSMSCFVF | 25.99 | HLA-B*1501 | TTIRTWAK | 142.13 | HLA-A*0301 | GTYNYPQY | 321.32 | HLA-B*1501 |
| FSMELPSF | 26.14 | HLA-B*1501 | LLIGIGNL | 142.18 | HLA-A*0201 | ERNVTETL | 321.71 | HLA-B*3901 |
| ILAATVTL | 26.19 | HLA-A*0201 | KLLLIAQA | 142.2 | HLA-A*0201 | VTTVTLHF | 321.77 | HLA-B*1501 |
| LLLQVTSL | 26.28 | HLA-A*0201 | GQRGRIDF | 142.26 | HLA-B*1501 | SECYNPCF | 321.92 | HLA-B*4001 |
| APRYAFEI | 26.3 | HLA-B*0702 | NLYDRVRL | 142.33 | HLA-A*0201 | LTDNHVEV | 322.04 | HLA-A*0101 |
| TMDYYWGI | 26.39 | HLA-A*0201 | AGFAPFSK | 142.42 | HLA-A*0301 | GLVFMCVK | 322.17 | HLA-A*0301 |
| FPVGSGSF | 26.45 | HLA-B*0702 | NLYDKVRL | 142.52 | HLA-A*0201 | GVYQILSI | 322.5 | HLA-A*0201 |
| NEVGARIL | 26.5 | HLA-B*4001 | AAFMFWAM | 142.94 | HLA-B*1501 | RRSYFTAE | 322.75 | HLA-B*2705 |
| YQNVETYV | 26.55 | HLA-A*0201 | YVNVRSLK | 143.04 | HLA-A*0301 | LRDNANDL | 322.82 | HLA-B*3901 |
| YQKCCNLF | 26.69 | HLA-B*1501 | RISFYWTI | 143.17 | HLA-A*0201 | TSNSIVSM | 322.89 | HLA-B*5801 |
| ETVEITGI | 26.7 | HLA-A*2601 | FYKNLLWL | 143.18 | HLA-A*2402 | ASRSGYEM | 322.89 | HLA-B*1501 |
| CLINDPWV | 26.82 | HLA-A*0201 | TQFTAVGK | 143.24 | HLA-A*0301 | SYKRIRLF | 323.16 | HLA-A*2402 |
| SQASYKIF | 26.85 | HLA-B*1501 | ILWISFAM | 143.68 | HLA-A*0201 | FLMQIAIL | 323.25 | HLA-B*3901 |
| MYSDFHFI | 27.01 | HLA-A*2402 | KIVHISPL | 143.7 | HLA-A*0201 | RREIHIYY | 323.3 | HLA-B*2705 |
| SPHRTLLM | 27.08 | HLA-B*0702 | CIASSTVM | 143.72 | HLA-B*1501 | GRMSDSIK | 323.32 | HLA-B*2705 |
| KRMTRGLF | 27.19 | HLA-B*2705 | YLMLSKSL | 143.73 | HLA-B*0801 | VLGDCSIA | 323.53 | HLA-A*0201 |
| MIAGLFFW | 27.2 | HLA-B*5801 | NQNPRVFL | 143.82 | HLA-B*3901 | YHANNSTT | 323.63 | HLA-B*3901 |
| GQSGRVSF | 27.21 | HLA-B*1501 | MARLGKGY | 143.9 | HLA-B*1501 | GMITDTIK | 323.68 | HLA-A*0301 |
| VTDSIKSW | 27.22 | HLA-B*5801 | SFFRNVIW | 144.11 | HLA-A*2402 | SLRLAIGL | 323.9 | HLA-B*0801 |
| KMKWGMEM | 27.23 | HLA-B*1501 | SGFAIVSK | 144.28 | HLA-A*0301 | ETTHTGTY | 323.92 | HLA-A*0101 |
| TIVSSLPF | 27.38 | HLA-B*1501 | ASSGTLEF | 144.32 | HLA-B*1501 | SLVLVVSL | 323.95 | HLA-A*0201 |
| NTYNHTEY | 27.39 | HLA-A*2601 | NIVRRAAV | 144.41 | HLA-B*0801 | NHVEVVSA | 323.95 | HLA-B*3901 |
| TSNSIAVF | 27.5 | HLA-B*5801 | LGMQNGSY | 144.91 | HLA-B*1501 | RIENLNKK | 324.2 | HLA-A*0301 |
| FAMSCFLL | 27.62 | HLA-A*0201 | DLNYQIGY | 144.92 | HLA-A*2601 | LANTIEIF | 324.25 | HLA-B*1501 |
| TSNSMVTF | 27.74 | HLA-B*5801 | TYVNNTTI | 144.98 | HLA-A*2402 | FATSCFLL | 324.33 | HLA-A*0201 |
| IALCGSPF | 27.74 | HLA-B*1501 | SQIIINNY | 144.98 | HLA-B*1501 | VIVTREPY | 324.55 | HLA-B*1501 |
| RRFVQNAL | 27.75 | HLA-B*2705 | LIVPEWSY | 144.99 | HLA-B*1501 | FEREGYSL | 324.73 | HLA-B*3901 |
| MLFVQSYF | 27.8 | HLA-B*1501 | APLNRLNI | 145.05 | HLA-B*0702 | LFGAIAGF | 324.98 | HLA-A*2402 |
| FLRVRDQL | 27.86 | HLA-B*0801 | SISECRTF | 145.07 | HLA-B*1501 | GINTNKTF | 325.02 | HLA-B*1501 |
| VMTHTSQY | 27.87 | HLA-B*1501 | SLGAVSFW | 145.21 | HLA-B*5801 | NGDYTRLY | 325.04 | HLA-A*0101 |

Fig. 78-8

| Peptide | Affinity (nM) | Allele | Peptide | Affinity (nM) | Allele | Peptide | Affinity (nM) | Allele |
|---|---|---|---|---|---|---|---|---|
| WIKTRPIL | 27.88 | HLA-B*0801 | LLFLKVPA | 145.22 | HLA-A*0201 | LRDNVKEL | 325.09 | HLA-B*3901 |
| MMAMKYPI | 28.06 | HLA-B*0801 | LRMVTGLR | 145.36 | HLA-B*2705 | FSFGASSF | 325.17 | HLA-A*2601 |
| KLLQNSQV | 28.08 | HLA-A*0201 | GVFSVEGK | 145.42 | HLA-A*0301 | GYICSGVF | 325.26 | HLA-A*2402 |
| VTYTGISK | 28.2 | HLA-A*0301 | IQAGVDRF | 145.56 | HLA-B*1501 | ASVPASRY | 325.3 | HLA-B*5801 |
| ILSIYSSV | 28.23 | HLA-A*0201 | SPKLRSGF | 145.85 | HLA-B*0801 | KAWLHICV | 325.32 | HLA-A*0201 |
| HQSETYPV | 28.36 | HLA-A*0201 | MIAELAEK | 145.92 | HLA-A*0301 | HNVHRNTI | 325.52 | HLA-B*0801 |
| YQARFEAV | 28.38 | HLA-A*0201 | CYGHNQKI | 146.07 | HLA-A*2402 | FIKWNVTY | 325.58 | HLA-A*2601 |
| RANENDFF | 28.66 | HLA-B*5801 | ITVWSSKY | 146.08 | HLA-B*1501 | SQYREEAL | 325.76 | HLA-B*1501 |
| IPHRTLLM | 28.73 | HLA-B*0702 | TIISSLPF | 146.31 | HLA-A*2601 | MQNRLNNV | 325.92 | HLA-A*0201 |
| HECRTFFL | 28.79 | HLA-B*4001 | KVNNIIDK | 146.58 | HLA-A*0301 | GYKDWVLW | 326.02 | HLA-A*2402 |
| TEIKGVKL | 28.82 | HLA-B*4001 | KEVGNGCF | 146.61 | HLA-B*4001 | RTLTLNTM | 326.75 | HLA-B*1501 |
| ILATTITL | 28.85 | HLA-A*0201 | ASVPASRY | 146.81 | HLA-B*1501 | FTFNGSFI | 327.01 | HLA-A*2601 |
| FLTHGSLL | 28.94 | HLA-A*0201 | LANTIEVF | 146.82 | HLA-B*1501 | GQKARIDY | 327.15 | HLA-B*1501 |
| GLKISSSF | 28.94 | HLA-B*1501 | LILKDCSV | 146.87 | HLA-A*0201 | WAAQELV | 327.28 | HLA-A*0201 |
| YQARFESV | 29.01 | HLA-A*0201 | FPVGTAPV | 146.9 | HLA-B*0702 | HQSGTYPI | 327.29 | HLA-B*1501 |
| APRGYFKL | 29.1 | HLA-B*0702 | DQLGNILL | 146.95 | HLA-B*3901 | GRGLFGAK | 327.42 | HLA-B*2705 |
| ILWISFSI | 29.16 | HLA-A*0201 | LLFQDILM | 147.15 | HLA-A*0201 | VQLIVSGK | 327.66 | HLA-A*0301 |
| KLNRLIGK | 29.18 | HLA-A*0301 | VLLNASWF | 147.2 | HLA-B*1501 | SVYKALSI | 327.89 | HLA-A*0201 |
| SYVRLYLW | 29.19 | HLA-A*2402 | MQINPVKL | 147.23 | HLA-B*3901 | YINNATII | 328.57 | HLA-A*0201 |
| FTSFFYRY | 29.19 | HLA-A*2601 | KRMQDGFM | 147.28 | HLA-B*2705 | YMFESKSM | 328.66 | HLA-B*3901 |
| QMYTPGGK | 29.31 | HLA-A*0301 | QESSCVCI | 147.32 | HLA-B*4001 | KYGTGRIF | 328.79 | HLA-A*2402 |
| KEMGNGCF | 29.33 | HLA-B*4001 | SVQPAFSV | 147.4 | HLA-A*0201 | RATAIIRK | 328.81 | HLA-A*0301 |
| RMNYHWTL | 29.35 | HLA-A*0201 | ITVTLHFK | 147.58 | HLA-A*0301 | IRAFSFQL | 328.84 | HLA-B*3901 |
| TSNSIVEF | 29.43 | HLA-B*5801 | TRWMKIIR | 147.62 | HLA-B*2705 | YLLLNKSL | 328.85 | HLA-B*0801 |
| SLYSSPQL | 29.54 | HLA-A*0201 | GRLIQNSM | 147.69 | HLA-B*2705 | ESDEALKM | 329.14 | HLA-A*0101 |
| ELRRQKSL | 29.56 | HLA-B*0801 | STEFLGQW | 147.7 | HLA-B*5801 | FSFQLILI | 329.34 | HLA-A*0201 |
| KLYDRVRL | 29.67 | HLA-A*0201 | FITEEFQW | 147.72 | HLA-B*5801 | LFSGVNSF | 329.46 | HLA-A*2402 |
| MIDGWYGY | 29.75 | HLA-A*0101 | KTNKQFEL | 147.77 | HLA-B*5801 | GLIDGWYG | 329.96 | HLA-A*0201 |
| KYMNVKSL | 29.76 | HLA-A*2402 | RSGYETFK | 147.81 | HLA-A*0301 | VLKYKGII | 329.97 | HLA-B*0801 |
| FSFGASCF | 29.81 | HLA-B*1501 | RGYKMNTK | 147.96 | HLA-A*0301 | DEICIGHL | 330.17 | HLA-B*4001 |
| KESLRLAL | 29.82 | HLA-B*4001 | KLLLIVQA | 147.98 | HLA-A*0201 | ATIRNGTY | 330.21 | HLA-A*2601 |
| VLLSPEEV | 29.83 | HLA-A*0201 | KSFSRTEL | 147.99 | HLA-B*5801 | QYICSPVL | 330.26 | HLA-A*2402 |
| YKMNIQIL | 29.86 | HLA-B*3901 | FEVVNHEF | 148.14 | HLA-B*4001 | LTDNHVEV | 330.39 | HLA-A*0201 |
| VLSCIFCL | 30.08 | HLA-A*0201 | FHNIHPLA | 148.18 | HLA-B*3901 | TQYRTESL | 330.39 | HLA-B*1501 |
| KMNREFGV | 30.1 | HLA-A*0201 | AMRAVGTH | 148.29 | HLA-B*1501 | SYKRVRLF | 330.74 | HLA-A*2402 |
| GLNTILPF | 30.23 | HLA-B*1501 | YSGSFVDY | 148.39 | HLA-A*0101 | KSLIWLWL | 330.76 | HLA-B*5801 |
| LALSHTAY | 30.26 | HLA-B*1501 | LSVAPIMF | 148.45 | HLA-B*1501 | YLLLNKSL | 330.8 | HLA-A*0201 |
| LMIWHSNL | 30.3 | HLA-A*0201 | ITQRTIGK | 148.46 | HLA-A*0301 | SFYRNLLW | 330.94 | HLA-B*5801 |
| RRIENLNK | 30.33 | HLA-B*2705 | ALLLAFIL | 148.53 | HLA-A*0201 | GMIDGWYG | 331.14 | HLA-A*0201 |
| NPRMFLAM | 30.41 | HLA-B*0801 | YMFESKKM | 148.62 | HLA-A*0201 | SIQTRGLF | 331.17 | HLA-B*1501 |
| KLNRLIEK | 30.49 | HLA-A*0301 | VLLENQKI | 148.79 | HLA-A*0201 | RNIVRRAI | 331.25 | HLA-B*0801 |
| ILLSPEEV | 30.54 | HLA-A*0201 | RRFVQNAL | 148.94 | HLA-B*3901 | IEYQIGNV | 331.34 | HLA-B*4001 |
| SEVPGCTM | 30.54 | HLA-B*4001 | RSNAPSGI | 148.94 | HLA-B*5801 | DRAPYRSL | 331.46 | HLA-B*3901 |
| KPRYLPDL | 30.61 | HLA-B*0702 | FLLMDSLK | 149.17 | HLA-A*0301 | NSAHHRVY | 331.58 | HLA-B*1501 |
| DVILWISF | 30.76 | HLA-A*2601 | ILNLGQKK | 149.21 | HLA-A*0301 | GTYNHKEY | 331.68 | HLA-B*1501 |
| VLWISFAI | 30.84 | HLA-A*0201 | KVPEWSYI | 149.25 | HLA-A*0201 | GTPACDLY | 331.77 | HLA-A*0101 |
| LLGSAQHV | 30.88 | HLA-A*0201 | FEAVGREF | 149.36 | HLA-B*4001 | DRSQYRAL | 331.85 | HLA-B*3901 |
| RPSAPEGM | 30.89 | HLA-B*0702 | SMAPIMFS | 149.79 | HLA-A*0201 | KRLIQLIV | 331.87 | HLA-B*2705 |
| ISIGSSTY | 30.97 | HLA-B*1501 | ELRSRYWA | 149.98 | HLA-B*0801 | ILEQNVTV | 332.11 | HLA-A*0201 |
| MEMRRCLL | 31.04 | HLA-B*4001 | TSGSIISF | 150.15 | HLA-B*5801 | SMTEIWSY | 332.24 | HLA-A*2601 |
| ISPLAVTW | 31.05 | HLA-B*5801 | MDYYWAVL | 150.2 | HLA-B*3901 | IQIDSVKL | 332.78 | HLA-A*0201 |
| SSRISFYW | 31.08 | HLA-B*5801 | STASRSGY | 150.23 | HLA-A*0101 | KLKRRAIA | 332.83 | HLA-B*0801 |
| ISFSMSCF | 31.08 | HLA-B*1501 | FSLTDPRF | 150.36 | HLA-B*5801 | ASTGAQSF | 332.83 | HLA-B*5801 |
| MQALQLLF | 31.18 | HLA-B*1501 | KMKWGMEL | 150.44 | HLA-A*0201 | HMYYLEKA | 332.99 | HLA-A*0201 |
| KSHAYISF | 31.23 | HLA-B*1501 | GINKVCTK | 150.44 | HLA-A*0301 | DRNATASL | 332.99 | HLA-B*3901 |
| YEELKHLL | 31.28 | HLA-B*4001 | TLLAKSVF | 150.51 | HLA-B*1501 | VANVNNLY | 333.18 | HLA-B*1501 |
| VLNKSLCK | 31.39 | HLA-A*0301 | MTIGSVSL | 150.56 | HLA-A*2601 | TSNRGSFY | 333.64 | HLA-B*1501 |
| KMNTKILV | 31.44 | HLA-A*0201 | TTHDRTAF | 150.56 | HLA-B*1501 | LTKGMLGF | 333.65 | HLA-A*2601 |
| TSNSIVVF | 31.48 | HLA-B*5801 | GVLHLILW | 150.58 | HLA-B*5801 | SFFRHMVW | 333.67 | HLA-A*2402 |
| HRIYWIRK | 31.5 | HLA-B*2705 | SLYASSQL | 150.9 | HLA-B*1501 | QAYTKIMY | 333.75 | HLA-B*1501 |
| RINYYWSV | 31.58 | HLA-A*0201 | FLAPRYGY | 151.04 | HLA-A*2601 | SEVPGWSW | 333.78 | HLA-B*4001 |
| NTYDHTQY | 31.73 | HLA-A*2601 | RVRDNVTK | 151.47 | HLA-A*0301 | SIIPSGPL | 334.16 | HLA-B*1501 |
| EVRRRLSV | 31.74 | HLA-B*0801 | AISTTFPY | 151.61 | HLA-A*0101 | KRKTRGLF | 334.45 | HLA-B*2705 |
| LIDQSGTY | 31.75 | HLA-A*0101 | MSGYSGIF | 151.74 | HLA-B*5801 | SLHGRICI | 334.81 | HLA-B*0801 |
| ILSLYSTV | 31.75 | HLA-A*0201 | ELWQCYYL | 151.81 | HLA-A*0201 | LRLGYETF | 335.03 | HLA-B*2705 |

Fig. 78-9

| Peptide | Affinity (nM) | Allele | Peptide | Affinity (nM) | Allele | Peptide | Affinity (nM) | Allele |
|---|---|---|---|---|---|---|---|---|
| RRLENLNK | 31.81 | HLA-B*2705 | VETYVLSI | 151.96 | HLA-B*4001 | SLSPGMMM | 335.07 | HLA-B*1501 |
| NPAHKSQL | 31.83 | HLA-B*0702 | MLNASCAA | 152 | HLA-A*0201 | AIEKITNK | 335.1 | HLA-A*0301 |
| EIILWFSF | 31.9 | HLA-A*2601 | RMNYHWTL | 152.08 | HLA-B*3901 | TENSFEQI | 335.1 | HLA-B*4001 |
| SIRWLTLK | 31.94 | HLA-A*0301 | ISVESSTY | 152.1 | HLA-B*5801 | KTWAGKIL | 335.15 | HLA-B*5801 |
| NTYDHSKY | 31.94 | HLA-A*2601 | YEELKHLM | 152.35 | HLA-B*4001 | RLCKVEGW | 335.31 | HLA-B*5801 |
| APRYGYII | 31.96 | HLA-B*0702 | RAIATPGM | 152.4 | HLA-B*5801 | LSYTVGYL | 335.39 | HLA-B*5801 |
| GLNITLPF | 32.02 | HLA-B*1501 | FYRNLVWI | 152.41 | HLA-A*2402 | NRCFYVEL | 335.91 | HLA-B*3901 |
| ILAFIMWA | 32.07 | HLA-A*0201 | FHNVHPLA | 152.58 | HLA-B*3901 | GVHHSSSL | 336.22 | HLA-B*0702 |
| QLSTVSSF | 32.07 | HLA-B*1501 | KLNRNEIK | 152.7 | HLA-A*0301 | SFRGRGVF | 336.43 | HLA-B*0801 |
| IIAGLSFW | 32.08 | HLA-B*5801 | AVKLSSGY | 153.06 | HLA-B*1501 | MVDGWYGY | 337.07 | HLA-A*2601 |
| RLFDYSRW | 32.11 | HLA-B*5801 | KIKKIRPL | 153.11 | HLA-B*0801 | DQQGNVLL | 338.24 | HLA-B*3901 |
| SRMQFSSL | 32.21 | HLA-B*2705 | SFYAEMEW | 153.19 | HLA-B*5801 | WSYNAELL | 338.47 | HLA-B*3901 |
| FLAPRYAF | 32.29 | HLA-B*1501 | KVNNIVDK | 153.33 | HLA-A*0301 | RALTLNTM | 338.76 | HLA-B*1501 |
| TIISNLPF | 32.31 | HLA-B*1501 | FLAPRYAF | 153.45 | HLA-B*0801 | EELLTGNL | 338.8 | HLA-B*4001 |
| GQRGRMEF | 32.39 | HLA-B*1501 | SFYKNLLW | 153.46 | HLA-A*2402 | TILETGYI | 338.92 | HLA-A*0201 |
| YQSGTYPV | 32.44 | HLA-B*3901 | KIMESGGI | 153.64 | HLA-A*0201 | NIRCNICI | 339.03 | HLA-B*0801 |
| MLGFVFTL | 32.58 | HLA-A*0201 | RLEENTTY | 153.69 | HLA-B*1501 | SITEVWSY | 339.03 | HLA-B*1501 |
| GTYGKGSW | 32.61 | HLA-B*5801 | ALILGFVL | 153.76 | HLA-A*0201 | NTYDHSRY | 339.23 | HLA-A*0101 |
| LVDGWYGY | 32.68 | HLA-A*0101 | IMMAGLSF | 153.81 | HLA-A*0201 | KGVELSSM | 339.38 | HLA-B*1501 |
| ISFAMSCF | 32.7 | HLA-B*1501 | YQAKFESI | 153.89 | HLA-B*1501 | CSNDTINY | 339.39 | HLA-B*5801 |
| ALQLLLEV | 32.84 | HLA-A*0201 | TLVSTRSW | 154.01 | HLA-B*5801 | HKWERYCV | 339.43 | HLA-B*3901 |
| FIIREPFI | 32.9 | HLA-A*0201 | APSCDLHL | 154.29 | HLA-B*0702 | GAVAVLKY | 339.74 | HLA-B*5801 |
| NEIKGLKL | 32.92 | HLA-B*4001 | FSDNGGLI | 154.43 | HLA-A*0101 | QTVINNYY | 339.95 | HLA-A*2601 |
| YINRTGTF | 33 | HLA-B*1501 | RMNNETIL | 154.77 | HLA-B*1501 | YRNLAWFV | 339.99 | HLA-B*3901 |
| LLAFILWA | 33.03 | HLA-A*0201 | AINQITGK | 154.78 | HLA-A*0301 | AMKHTSQY | 340.2 | HLA-A*0301 |
| WTYNAELF | 33.04 | HLA-B*5801 | RLGFEIIK | 155.33 | HLA-A*0301 | MTIGSVSL | 340.29 | HLA-A*0201 |
| GRMTFYWK | 33.05 | HLA-B*2705 | VIITREPY | 155.36 | HLA-B*1501 | SRINGVKL | 340.57 | HLA-B*3901 |
| RRIESLNK | 33.13 | HLA-B*2705 | RSLISWPL | 155.54 | HLA-B*5801 | DQDWSYIV | 340.72 | HLA-B*3901 |
| SYLECRTF | 33.17 | HLA-A*2402 | RLNRNEIK | 155.81 | HLA-A*0301 | FYRYGFVA | 340.83 | HLA-B*0801 |
| ASNSIVTF | 33.27 | HLA-B*5801 | WMCSNGSL | 156.06 | HLA-B*1501 | FEEVRWLI | 340.83 | HLA-B*4001 |
| YEELKHFL | 33.37 | HLA-B*4001 | MISKCKTK | 156.17 | HLA-A*0301 | QMESRGLF | 341.32 | HLA-B*1501 |
| LVDSISSW | 33.4 | HLA-B*5801 | GVRPLILK | 156.21 | HLA-A*0301 | ILWISFSM | 341.76 | HLA-B*1501 |
| FQNTSKHY | 33.41 | HLA-B*1501 | RPVIDVNM | 156.28 | HLA-B*0702 | ARFESVAW | 341.93 | HLA-B*2705 |
| RYGPALSI | 33.45 | HLA-A*2402 | ILVLGLSM | 156.35 | HLA-B*1501 | LYFHKGLI | 341.98 | HLA-A*2402 |
| WTGMIDGW | 33.47 | HLA-B*5801 | SWFNSFLK | 156.39 | HLA-A*0301 | GTYNHQEY | 342.32 | HLA-A*0301 |
| KTMTITFL | 33.56 | HLA-A*0201 | IIVDNNNW | 156.5 | HLA-B*5801 | FQNINSRV | 342.63 | HLA-A*0201 |
| LSSRISFY | 33.61 | HLA-A*0101 | DVILWFSL | 156.54 | HLA-A*2601 | FESSGGLL | 342.98 | HLA-B*3901 |
| ALYGTQSL | 33.69 | HLA-B*1501 | VVNHEFSK | 156.84 | HLA-A*0301 | FTFNGAFI | 343.05 | HLA-A*2601 |
| MYQKCCTL | 33.69 | HLA-A*2402 | GTYDYPHY | 156.94 | HLA-B*1501 | TQFEAVGK | 343.13 | HLA-A*0301 |
| SAHHRVYW | 33.72 | HLA-B*5801 | ISNVGLNI | 156.99 | HLA-B*5801 | ALYGTQSL | 343.17 | HLA-B*1501 |
| SMTEVWSY | 33.74 | HLA-B*1501 | SLFSSIKR | 157.01 | HLA-A*0301 | LILVALAL | 343.41 | HLA-A*0201 |
| NRMQINPV | 33.75 | HLA-B*3901 | RAIATPGM | 157.26 | HLA-B*1501 | SVTELWSY | 343.73 | HLA-B*1501 |
| FSMELPSF | 34.05 | HLA-B*5801 | SSMPLHNI | 157.29 | HLA-B*5801 | IQIDAVKL | 343.76 | HLA-A*0201 |
| LVDSVVSW | 34.07 | HLA-B*5801 | DSVKNGTY | 157.44 | HLA-A*2601 | CIASSIVM | 343.92 | HLA-B*1501 |
| KMEAILVV | 34.2 | HLA-A*0201 | EGRRKTNL | 157.5 | HLA-B*0801 | SRFEAVAW | 344.07 | HLA-B*2705 |
| TSNSIIVF | 34.2 | HLA-B*5801 | FIAEEFPW | 157.54 | HLA-B*5801 | IESKLSQM | 344.11 | HLA-B*4001 |
| MMAMKYPI | 34.23 | HLA-A*0201 | MMGMFNML | 157.69 | HLA-A*0201 | MTLSVVSL | 344.21 | HLA-B*5801 |
| ILAFILWA | 34.24 | HLA-A*0201 | YQAKFESI | 157.75 | HLA-B*3901 | ASSQLEGF | 344.3 | HLA-B*5801 |
| RRLTTTVK | 34.27 | HLA-B*2705 | KESLRLAI | 157.79 | HLA-B*4001 | KLKRNEIK | 344.31 | HLA-A*0301 |
| KSVFNSLY | 34.28 | HLA-B*5801 | RPVIDINM | 157.83 | HLA-B*0702 | WKSSNRPV | 344.41 | HLA-B*3901 |
| AQRLENVF | 34.37 | HLA-B*1501 | ETYKILTI | 157.87 | HLA-A*2601 | SQDTELSF | 344.63 | HLA-B*1501 |
| QEMRTFSF | 34.41 | HLA-B*4001 | GSASSQAY | 157.88 | HLA-B*1501 | YHTGRSSF | 344.96 | HLA-B*3901 |
| KLNRIIEK | 34.42 | HLA-A*0301 | ESSFYAEM | 158.11 | HLA-A*2601 | RTLMSVEV | 345.19 | HLA-A*0201 |
| IYIEVLHL | 34.5 | HLA-A*2402 | YQARFESV | 158.25 | HLA-B*3901 | TSGSSISF | 345.46 | HLA-B*1501 |
| SLLNRLSI | 34.53 | HLA-B*0801 | RRGLFGAI | 158.38 | HLA-B*2705 | SFYAEMKW | 345.54 | HLA-A*2402 |
| SISCFLLV | 34.74 | HLA-A*0201 | LVGPILSF | 158.57 | HLA-B*1501 | SRSGFEII | 345.6 | HLA-B*3901 |
| TYINNATI | 34.84 | HLA-A*2402 | KPRGLFGA | 158.81 | HLA-B*0702 | RPLVRSQS | 346.02 | HLA-B*0702 |
| RIRSNGNL | 35.11 | HLA-B*0702 | RTLTLNTM | 159.01 | HLA-B*5801 | SFYTELKW | 346.1 | HLA-A*2402 |
| GQSGRIVF | 35.2 | HLA-B*1501 | RILKWEPL | 159.06 | HLA-A*0201 | VMEHTSQY | 346.9 | HLA-A*0101 |
| SSMNNQVF | 35.28 | HLA-B*1501 | SISCFLLI | 159.13 | HLA-A*0201 | YDKVRHQL | 346.92 | HLA-B*0801 |
| KQASYKIF | 35.31 | HLA-B*1501 | SSKDNQVF | 159.22 | HLA-B*1501 | DQAWSYIV | 346.96 | HLA-B*3901 |
| YMFESKNM | 35.49 | HLA-B*1501 | SSKYRQSF | 159.24 | HLA-B*0801 | VTVWSSKY | 347.15 | HLA-A*0101 |
| SQLEGFSA | 35.5 | HLA-A*0201 | VTHTGTSK | 159.3 | HLA-A*0301 | NMDKAVKL | 347.28 | HLA-B*3901 |
| SRMQFSSL | 35.5 | HLA-B*3901 | APRGYFKI | 159.55 | HLA-B*0702 | SVWAGRTM | 347.77 | HLA-B*0702 |
| TIIYSSSM | 35.5 | HLA-B*1501 | RGRLCNPL | 159.63 | HLA-B*0702 | DQQGNILL | 348.19 | HLA-B*3901 |

Fig. 78-10

| Peptide | Affinity (nM) | Allele | Peptide | Affinity (nM) | Allele | Peptide | Affinity (nM) | Allele |
|---|---|---|---|---|---|---|---|---|
| WEKNCTLI | 35.55 | HLA-B*4001 | GYSGSFTI | 159.73 | HLA-A*2402 | MGSSPNAY | 348.19 | HLA-B*1501 |
| TETGAPQL | 35.9 | HLA-B*4001 | LSSPPTVY | 159.76 | HLA-A*0101 | IWGVHHPI | 348.34 | HLA-A*2402 |
| ITETIKSW | 35.93 | HLA-B*5801 | RALISWEM | 159.8 | HLA-B*5801 | FERVRHQL | 348.44 | HLA-B*4001 |
| FSKWNVTY | 35.94 | HLA-B*1501 | WLGRTVSI | 159.95 | HLA-A*0201 | VISTDLSY | 348.47 | HLA-A*0101 |
| IVMGLVFI | 35.98 | HLA-A*0201 | CPKYVRSA | 159.99 | HLA-B*0801 | FMDVWTYN | 348.79 | HLA-A*0201 |
| RRLTTTIK | 36 | HLA-B*2705 | GLIAPDRV | 160.07 | HLA-A*0201 | RKRNSSIL | 349.14 | HLA-B*0702 |
| MVWDANGW | 36.07 | HLA-B*5801 | RSLIQFPM | 160.09 | HLA-B*5801 | AVIHYGGV | 349.57 | HLA-A*0201 |
| SEIRTFSF | 36.08 | HLA-B*4001 | HESECVCI | 160.14 | HLA-B*4001 | CHDGKEWL | 349.7 | HLA-B*3901 |
| VTTVTLHF | 36.26 | HLA-B*5801 | LIAPEYGF | 160.21 | HLA-B*1501 | YQAELLVA | 349.71 | HLA-B*3901 |
| RELGNGCF | 36.3 | HLA-B*4001 | RVKSNGNL | 160.26 | HLA-B*0702 | IAFLTSSI | 349.82 | HLA-B*5801 |
| AINSSKPF | 36.38 | HLA-B*1501 | WMGRTIGK | 160.27 | HLA-A*0301 | DMSNEGSY | 349.83 | HLA-A*2601 |
| QVTDIWAY | 36.41 | HLA-A*2601 | LILAFILW | 160.28 | HLA-B*5801 | WSYNAELL | 350.01 | HLA-B*5801 |
| KSVFNCLY | 36.45 | HLA-B*5801 | NSYDHSKY | 160.28 | HLA-B*1501 | VLRGFLIL | 350.16 | HLA-B*0801 |
| ESECQCLY | 36.59 | HLA-A*0101 | CHDGKAWL | 160.29 | HLA-B*3901 | LVLAASIM | 350.4 | HLA-B*1501 |
| AQDVIMEV | 36.6 | HLA-A*0201 | RPIIDINM | 160.38 | HLA-B*0702 | YQMGYICS | 350.45 | HLA-A*0201 |
| RRCLLQSL | 36.61 | HLA-B*2705 | FQIQGVKL | 160.39 | HLA-A*0201 | GLVFICVK | 350.54 | HLA-A*0301 |
| LLIGISNI | 36.66 | HLA-A*0201 | APDRATFL | 160.43 | HLA-B*0702 | RPVIEIDM | 350.6 | HLA-B*0702 |
| GQFGRINF | 36.7 | HLA-B*1501 | RVDTIMEK | 160.63 | HLA-A*0301 | RPIIEIDM | 350.6 | HLA-B*0702 |
| HQSGTYPI | 36.78 | HLA-B*3901 | AIDRITTK | 160.64 | HLA-A*0301 | EMNKLFEK | 350.64 | HLA-A*0301 |
| DVILWFSF | 36.79 | HLA-A*2601 | LYLNGREW | 160.72 | HLA-A*2402 | KLLKERGF | 350.97 | HLA-B*1501 |
| KPRFLPDL | 36.86 | HLA-B*0702 | NESADMSI | 160.75 | HLA-B*4001 | VEIRINMI | 350.98 | HLA-B*4001 |
| FLTQGSLL | 37.02 | HLA-A*0201 | GSANSQAY | 160.89 | HLA-B*1501 | RALISWGM | 351.2 | HLA-B*5801 |
| WMKIYWVL | 37.05 | HLA-B*0801 | FMWAIHHP | 161.82 | HLA-A*0201 | MSDINIMA | 351.24 | HLA-A*0101 |
| RMAKCNTK | 37.19 | HLA-A*0301 | SVLNLGQK | 161.94 | HLA-A*0301 | VLWTSNSM | 351.35 | HLA-A*0201 |
| RMARCNTK | 37.28 | HLA-A*0301 | ILTFIMWA | 162.18 | HLA-A*0201 | MTDGPANK | 351.71 | HLA-A*0301 |
| LSIAPIMF | 37.36 | HLA-B*5801 | ASSGSLEF | 162.19 | HLA-B*1501 | GTYDYPQY | 351.72 | HLA-B*1501 |
| RRLSVNAI | 37.37 | HLA-B*2705 | YTRVKRQL | 162.35 | HLA-B*0801 | KYVKQGSL | 351.74 | HLA-A*2402 |
| SPYRTLLM | 37.41 | HLA-B*0702 | TSNSIIAF | 162.8 | HLA-B*1501 | LTNSEMNK | 351.81 | HLA-A*0301 |
| YKMNTRIL | 37.42 | HLA-B*3901 | NQNPRIFL | 162.82 | HLA-B*3901 | KMNTQFDA | 352.07 | HLA-A*0201 |
| REIGNGCF | 37.45 | HLA-B*4001 | RSRSGFEM | 162.85 | HLA-B*0702 | ARRMVQAM | 352.44 | HLA-B*2705 |
| ILFASATA | 37.55 | HLA-A*0201 | ASGSSISF | 162.96 | HLA-B*1501 | YNAELLIL | 352.67 | HLA-B*3901 |
| REMTFHGA | 37.56 | HLA-B*4001 | RTFSPRSR | 163.19 | HLA-A*0301 | NMQCTICI | 352.77 | HLA-A*0201 |
| ISVGSGSF | 37.57 | HLA-B*1501 | RSRNGFEM | 163.29 | HLA-B*0702 | SLVLLLMI | 353.13 | HLA-A*0201 |
| GEALRQIL | 37.63 | HLA-B*4001 | YEKVRLQL | 163.44 | HLA-B*4001 | KRMENGFL | 353.18 | HLA-B*3901 |
| LEESHPGL | 37.73 | HLA-B*4001 | IEGGWQGL | 163.68 | HLA-B*4001 | YDKVRFQL | 353.29 | HLA-B*0801 |
| YMFESKSM | 37.76 | HLA-A*0201 | SFFRNMIW | 163.72 | HLA-A*2402 | AIDGITNK | 353.31 | HLA-A*0301 |
| RSINWLTK | 37.77 | HLA-A*0301 | MLLVSTNA | 163.88 | HLA-A*0201 | NTYNHTEY | 353.44 | HLA-A*0101 |
| KYVNNTTI | 37.78 | HLA-A*2402 | MVNGWYGF | 163.96 | HLA-B*1501 | IMKTEGTL | 354.12 | HLA-B*1501 |
| AIAMGLVF | 37.9 | HLA-B*1501 | KLLLVVQA | 164.04 | HLA-A*0201 | MIIGGFIF | 354.24 | HLA-A*2601 |
| LLAFVLWA | 37.94 | HLA-A*0201 | IFGAIAGF | 164.21 | HLA-A*2402 | FATSCFLL | 354.27 | HLA-B*3901 |
| SLNGISPI | 38 | HLA-A*0201 | AQKLEDVF | 164.36 | HLA-B*1501 | RYVKQGSL | 354.59 | HLA-A*2402 |
| GIKGFSFK | 38.2 | HLA-A*0301 | GVKPLILK | 164.45 | HLA-A*0301 | REIHIYYL | 354.74 | HLA-A*2402 |
| SINTKLPF | 38.2 | HLA-B*1501 | FPIGTAPV | 164.6 | HLA-B*0702 | TYCSLNGI | 354.75 | HLA-A*2402 |
| FMIIGGFI | 38.21 | HLA-A*0201 | KLFERVKR | 164.67 | HLA-A*0301 | FEEIRWLI | 354.8 | HLA-B*4001 |
| WTGLIDGW | 38.33 | HLA-B*5801 | IMEKSVTV | 164.68 | HLA-A*0201 | RSLIRFPI | 354.93 | HLA-B*0801 |
| LTGGQSFY | 38.51 | HLA-A*0101 | GRLTTTIK | 164.93 | HLA-B*2705 | TSNSIVEF | 355.24 | HLA-B*1501 |
| NEIKGVKL | 38.8 | HLA-B*4001 | ALSGVAIA | 165.1 | HLA-A*0201 | YQSLRSIL | 355.26 | HLA-B*0801 |
| AQRLEGVF | 38.82 | HLA-B*1501 | LLIGISNM | 165.36 | HLA-B*1501 | FVTREPFI | 355.32 | HLA-A*0201 |
| KYGPALSI | 38.86 | HLA-A*2402 | WIRFNSNL | 165.55 | HLA-B*0702 | IIIVVLLY | 355.49 | HLA-A*0301 |
| YQSLRSIL | 38.86 | HLA-B*3901 | NTYDHSQY | 165.61 | HLA-B*1501 | LRFLFSSI | 356.3 | HLA-B*3901 |
| NTYDHTKY | 38.97 | HLA-A*2601 | YLMLNKSL | 166.04 | HLA-B*0801 | RIDFNWLL | 356.38 | HLA-A*0201 |
| FQNVSPLW | 38.99 | HLA-B*5801 | MEFFWTLL | 166.1 | HLA-B*3901 | STWVSQTY | 356.54 | HLA-A*0101 |
| YQAELLVA | 39.21 | HLA-A*0201 | GVYINTAM | 166.29 | HLA-B*1501 | LSIYSTVA | 356.71 | HLA-B*1501 |
| YYNGRSSF | 39.41 | HLA-A*2402 | KSVFNNLY | 166.3 | HLA-B*1501 | GYSGSFVI | 356.72 | HLA-A*2402 |
| YQSRFEAV | 39.55 | HLA-A*0201 | CSIWFSHY | 166.31 | HLA-A*0101 | MSDIEIMA | 356.95 | HLA-A*0101 |
| YLLFQDIL | 39.7 | HLA-A*0201 | FYRNLVWL | 166.39 | HLA-A*2402 | MMMGMFNM | 357.44 | HLA-B*0801 |
| TIHDGTAF | 39.72 | HLA-B*1501 | ASSGNLEF | 166.41 | HLA-B*5801 | VTSSVDLI | 357.87 | HLA-B*5801 |
| QIIKLLPF | 39.83 | HLA-B*1501 | KTNQQFKL | 166.63 | HLA-B*5801 | RLYIWGVH | 358.11 | HLA-A*0301 |
| VSFSISCF | 39.94 | HLA-B*5801 | ILSIYSCI | 166.94 | HLA-A*0201 | LPACIYGL | 358.16 | HLA-B*0702 |
| LLESDVPV | 39.98 | HLA-A*0201 | ILWISFAT | 167 | HLA-A*0201 | MVIASTTA | 358.23 | HLA-B*1501 |
| KEWGNGCF | 40.01 | HLA-B*4001 | ILFIEEGK | 167.18 | HLA-A*0301 | SRGLFGAK | 358.45 | HLA-B*2705 |
| TECRTFFL | 40.04 | HLA-B*4001 | KLYERVKR | 167.35 | HLA-A*0301 | QTAAQRAM | 358.71 | HLA-A*2601 |
| GTHGTGSW | 40.06 | HLA-B*5801 | SFYRNLAW | 167.45 | HLA-A*2402 | NIVRRAIV | 358.82 | HLA-B*0801 |
| RRLSANAI | 40.09 | HLA-B*2705 | SSTYQNSF | 167.45 | HLA-B*1501 | SGFVRTLF | 359.33 | HLA-B*1501 |
| RPVAKAGF | 40.16 | HLA-B*0702 | VTQRTIGK | 167.47 | HLA-A*0301 | IPLTTTPT | 359.44 | HLA-B*0702 |

Fig. 78-11

| Peptide | Affinity (nM) | Allele | Peptide | Affinity (nM) | Allele | Peptide | Affinity (nM) | Allele |
|---|---|---|---|---|---|---|---|---|
| SSWHILSK | 40.25 | HLA-A*0301 | LIAPRYGY | 167.53 | HLA-B*1501 | YQKVGTYV | 359.48 | HLA-A*0201 |
| GLSSRISF | 40.29 | HLA-B*1501 | VSNGTMVK | 167.55 | HLA-A*0301 | MRTFSFQL | 359.64 | HLA-B*2705 |
| LLAVIMGL | 40.34 | HLA-B*0201 | CHDGKSWL | 167.63 | HLA-B*3901 | MNELGVPL | 359.73 | HLA-B*3901 |
| LEQSGLPV | 40.34 | HLA-B*4001 | GTYNHQEY | 167.83 | HLA-B*1501 | SACYNPCF | 360.11 | HLA-B*1501 |
| AEIEDLIF | 40.52 | HLA-B*4001 | KVNSIIDK | 167.84 | HLA-A*0301 | TQNNTTLI | 360.49 | HLA-B*1501 |
| NLIAPWYA | 40.57 | HLA-A*0201 | SISSRNGF | 167.96 | HLA-B*1501 | NTWARNIL | 360.78 | HLA-B*0801 |
| KSVFNNLY | 40.62 | HLA-B*5801 | YAFGNCPM | 168.01 | HLA-A*2601 | RQTYDWTL | 360.81 | HLA-B*4001 |
| VYMNTALL | 40.68 | HLA-A*2402 | KMNIQFTA | 168.08 | HLA-A*0201 | SMQCNVCI | 361.09 | HLA-A*0201 |
| SMTEIWSY | 40.72 | HLA-B*1501 | SLVLLFMI | 168.3 | HLA-A*0201 | SGICPVVF | 361.23 | HLA-B*1501 |
| ELSSMGVY | 40.87 | HLA-A*2601 | RMDYYWAI | 168.3 | HLA-B*3901 | IGIGNLVF | 361.63 | HLA-B*1501 |
| CSIWFSHY | 40.88 | HLA-B*1501 | ASMRRNYF | 168.3 | HLA-B*1501 | NLIAPRGY | 361.87 | HLA-B*1501 |
| FTFNGSFI | 41.01 | HLA-A*0201 | LRSGYEML | 168.41 | HLA-B*3901 | FQNVSPVW | 361.88 | HLA-B*1501 |
| LECRTFFL | 41.02 | HLA-B*4001 | NITEIVYL | 168.55 | HLA-A*0201 | ALLNASCA | 362.04 | HLA-A*0201 |
| LSVAPIMF | 41.12 | HLA-B*5801 | TRSGYEML | 168.61 | HLA-B*3901 | NQTKTMTI | 362.17 | HLA-B*3901 |
| RANINDFF | 41.15 | HLA-B*5801 | VESNGNLI | 168.75 | HLA-B*4001 | STVASSFV | 362.69 | HLA-A*0201 |
| SRLNWLTK | 41.28 | HLA-B*2705 | SRSGYEML | 168.77 | HLA-B*3901 | YKSTQAAV | 362.69 | HLA-B*3901 |
| TMTHTSQY | 41.28 | HLA-B*1501 | CVILLNPF | 168.78 | HLA-B*1501 | SPYRTLLM | 362.76 | HLA-B*0801 |
| FLRVRDQM | 41.29 | HLA-B*0801 | NIREWSYL | 169.11 | HLA-B*0801 | ATTITLHF | 363.14 | HLA-B*1501 |
| THSWVPIL | 41.29 | HLA-B*3901 | RTNMINDK | 169.2 | HLA-A*0301 | AAFLFWAM | 363.49 | HLA-B*1501 |
| TLASTNAY | 41.35 | HLA-B*1501 | TITSNLPF | 169.3 | HLA-B*1501 | ASSRAYTK | 363.62 | HLA-A*0301 |
| KTFQNIEK | 41.39 | HLA-A*0301 | KLSNMGVY | 169.31 | HLA-B*1501 | WAYNAELI | 363.82 | HLA-B*5801 |
| LECKTFFL | 41.47 | HLA-B*4001 | FQNASRHH | 169.4 | HLA-B*1501 | GTYDYPKY | 363.97 | HLA-A*0301 |
| SSKYHQSF | 41.52 | HLA-B*1501 | GLIFMCVK | 169.41 | HLA-A*0301 | LLVSLGAI | 364.28 | HLA-A*0201 |
| ASSLVLLF | 41.59 | HLA-B*5801 | ATAVAVLK | 169.47 | HLA-A*0301 | MIALILVA | 364.34 | HLA-A*0201 |
| MQFSSLTV | 41.68 | HLA-B*1501 | ILVTTVTL | 169.55 | HLA-A*0201 | MTIASDIL | 364.8 | HLA-B*5801 |
| ITYSSSLM | 41.83 | HLA-B*1501 | RYERVKMF | 169.67 | HLA-A*2402 | RTLMSCPI | 365.01 | HLA-B*5801 |
| ITYGACPK | 41.92 | HLA-A*0301 | YMGECPNY | 170.17 | HLA-B*1501 | LTVPEWSY | 365.34 | HLA-A*0101 |
| LLAFMLWA | 42.03 | HLA-A*0201 | NQNPRMFL | 170.41 | HLA-B*3901 | MTDSEMNK | 365.44 | HLA-A*0301 |
| SPLTKGML | 42.12 | HLA-B*0702 | KVNSIVDK | 170.49 | HLA-A*0301 | KPRPRRGL | 365.5 | HLA-B*0801 |
| FIKWNVTY | 42.13 | HLA-B*1501 | LVRGNSPV | 170.49 | HLA-B*0702 | SINGRAPI | 365.65 | HLA-B*0801 |
| SHYREEAL | 42.24 | HLA-B*3901 | RMNYYWTI | 170.84 | HLA-B*1501 | GIILGNPK | 365.9 | HLA-A*0301 |
| MYQKCCSL | 42.4 | HLA-A*2402 | SGFAIASK | 170.97 | HLA-A*0301 | IPSWEGNI | 366.09 | HLA-B*0702 |
| KIVTTVGW | 42.41 | HLA-B*5801 | DTICIGYH | 171.22 | HLA-A*2601 | IQFPMGTA | 366.29 | HLA-B*1501 |
| MVWDPNGW | 42.42 | HLA-B*5801 | MVNGWYGF | 171.29 | HLA-A*2601 | YQRSKFLL | 366.3 | HLA-B*1501 |
| NEVGAKIL | 42.48 | HLA-B*4001 | RVNSIIDK | 171.3 | HLA-A*0301 | WSYNARLL | 366.39 | HLA-B*3901 |
| RYAFELVF | 42.54 | HLA-A*2402 | ALSGVAVA | 171.31 | HLA-A*0201 | AVIHYGGM | 366.53 | HLA-B*1501 |
| KLYWHLMR | 42.6 | HLA-A*0301 | KIVHVSPL | 171.35 | HLA-B*1501 | RRIDFHWL | 366.55 | HLA-B*3901 |
| YSTVASSF | 42.64 | HLA-B*5801 | NILSMAPI | 171.4 | HLA-A*0201 | IYGKDNAI | 366.73 | HLA-A*2402 |
| YIIRALTL | 42.67 | HLA-A*0201 | SIGITVIK | 171.44 | HLA-A*0301 | MVHAMRTI | 366.9 | HLA-B*0801 |
| ESIRNNTY | 42.75 | HLA-A*2601 | IALCGSPF | 171.48 | HLA-B*5801 | KTWAKNIL | 367.07 | HLA-B*5801 |
| WILWISFA | 42.78 | HLA-A*0201 | RPCFWVEL | 171.51 | HLA-B*0702 | FLMQIATL | 367.16 | HLA-B*0801 |
| RRIENLNR | 42.86 | HLA-B*2705 | SSKYQRSF | 171.71 | HLA-B*1501 | KLFASSGI | 367.19 | HLA-B*1501 |
| SVQRSLPF | 42.93 | HLA-B*1501 | GIYQILAI | 171.96 | HLA-A*0201 | TSRHYIGK | 367.42 | HLA-A*0301 |
| EVNSWHIF | 43 | HLA-A*2601 | MEFSWTLL | 172.42 | HLA-B*3901 | GIITGTIK | 367.43 | HLA-A*0301 |
| SLYASSQL | 43.05 | HLA-A*0201 | SVSSFERF | 172.77 | HLA-B*1501 | DSEMDKLY | 367.49 | HLA-A*0101 |
| AMTEVWSY | 43.23 | HLA-B*1501 | GRVTVSTK | 172.94 | HLA-A*0301 | AIDGVNSK | 367.51 | HLA-A*0301 |
| ILWFSFGA | 43.28 | HLA-A*0201 | LYLSGREW | 172.97 | HLA-A*2402 | RPKEMEGV | 367.62 | HLA-B*0702 |
| HLKFKADL | 43.28 | HLA-B*0801 | SLGGCSFA | 173.01 | HLA-A*0201 | SLYDKVRM | 367.63 | HLA-B*1501 |
| MMAMRYPI | 43.4 | HLA-A*0201 | APPVQSRM | 173.02 | HLA-B*0702 | YVRQNTLK | 367.7 | HLA-A*0301 |
| ETEQTKLY | 43.48 | HLA-A*0101 | LRFVFSSA | 173.08 | HLA-B*2705 | KRMGLQMQ | 367.71 | HLA-B*2705 |
| IFMARSAL | 43.52 | HLA-B*0801 | HQRSKFLL | 173.09 | HLA-B*0801 | NENATASF | 367.75 | HLA-B*4001 |
| TTNSIVVF | 43.65 | HLA-B*5801 | SPLMVAYM | 173.16 | HLA-B*0702 | ITVGSSKY | 368.15 | HLA-A*2601 |
| RRMVQAMR | 43.81 | HLA-B*2705 | SLYSGFVR | 173.22 | HLA-A*0301 | FFRNVIWL | 368.35 | HLA-B*0801 |
| GMLGFVFT | 43.86 | HLA-A*0201 | GINTNRTF | 173.34 | HLA-B*1501 | AMSCFLLC | 368.43 | HLA-A*0201 |
| VLWTSNSI | 43.96 | HLA-A*0201 | HKDNAVRL | 173.46 | HLA-B*3901 | YESSINPA | 368.43 | HLA-B*4001 |
| QVIKLLPF | 43.96 | HLA-B*1501 | ERFEMFPK | 173.54 | HLA-B*2705 | NRFQIKSV | 368.94 | HLA-B*3901 |
| RRLSTNAI | 44.08 | HLA-B*2705 | KIRTNGNL | 173.61 | HLA-B*0702 | EEVLTGNL | 369.52 | HLA-B*4001 |
| YQAELLIA | 44.16 | HLA-A*0201 | RGYMFESK | 173.67 | HLA-A*0301 | APPVQSKM | 369.96 | HLA-B*0702 |
| MIIGGFIF | 44.16 | HLA-B*1501 | LLLAFMLW | 173.71 | HLA-B*5801 | GRHANGTM | 369.97 | HLA-B*2705 |
| IIYSSSMM | 44.17 | HLA-B*1501 | CHNGTCVV | 173.72 | HLA-B*3901 | RQTFDWTL | 370.18 | HLA-B*4001 |
| SPLTKGIL | 44.2 | HLA-B*0702 | FIMWACQK | 174.29 | HLA-A*0301 | APDRVSKL | 370.38 | HLA-B*0702 |
| VLASTTAK | 44.24 | HLA-A*0301 | TQYREESL | 174.37 | HLA-B*3901 | FFRNVVWL | 370.39 | HLA-B*0801 |
| IMKTEKTF | 44.27 | HLA-B*1501 | RTVGQCPK | 174.39 | HLA-A*0301 | SFYRGMRW | 370.57 | HLA-B*5801 |
| KYIKSDQL | 44.39 | HLA-A*2402 | NIKGRDVL | 174.46 | HLA-B*0801 | GYFGVFSV | 370.83 | HLA-A*2402 |
| LVDSIVSW | 44.51 | HLA-B*5801 | VTQRTVGK | 174.48 | HLA-A*0301 | RSLIRFPI | 371.27 | HLA-B*5801 |

Fig. 78-12

| Peptide | Affinity (nM) | Allele | Peptide | Affinity (nM) | Allele | Peptide | Affinity (nM) | Allele |
|---|---|---|---|---|---|---|---|---|
| RRLTTTIR | 44.55 | HLA-B*2705 | KSVFNCLY | 174.59 | HLA-B*1501 | GQQGTMDY | 371.36 | HLA-B*1501 |
| CLYKLSQF | 44.64 | HLA-B*1501 | YISSGSLK | 174.73 | HLA-A*0301 | VVSPDLSY | 371.71 | HLA-A*0101 |
| YKMNTKIL | 44.85 | HLA-B*3901 | SFFSRLNW | 175.04 | HLA-A*2402 | YRNLIWLV | 371.85 | HLA-B*3901 |
| KYIPSRSL | 44.88 | HLA-A*2402 | YNAEVLVL | 175.09 | HLA-B*3901 | KLCFPGEV | 371.87 | HLA-A*0201 |
| RLLQSSQV | 44.9 | HLA-A*0201 | LLIGVGNL | 175.15 | HLA-A*0201 | RANVNDFF | 372.26 | HLA-B*1501 |
| AMITYITK | 44.9 | HLA-A*0301 | ILWISFSM | 175.19 | HLA-A*0201 | RIDFHWML | 372.42 | HLA-A*0201 |
| LIIGISNV | 44.95 | HLA-A*0201 | IMIAGLSF | 175.19 | HLA-B*5801 | LQGTKRSY | 372.78 | HLA-B*1501 |
| KRLTILGK | 44.95 | HLA-B*2705 | KYERVKMF | 175.25 | HLA-A*2402 | EVSSWHIL | 372.83 | HLA-A*2601 |
| GTCGTGSW | 44.96 | HLA-B*5801 | AQSLSISV | 175.32 | HLA-A*0201 | VTASCLDK | 373.11 | HLA-A*0301 |
| ILATTVTL | 45.12 | HLA-A*0201 | MEMRRCLL | 175.42 | HLA-B*3901 | FAYDKICI | 373.67 | HLA-B*1501 |
| NTYNHTQY | 45.17 | HLA-A*2601 | WMGSNRPV | 175.51 | HLA-A*0201 | SLYSSPQL | 373.94 | HLA-B*1501 |
| FTKWNVTY | 45.24 | HLA-B*1501 | VSLGAISF | 175.67 | HLA-B*1501 | SFYSELKW | 374.24 | HLA-B*5801 |
| HQSGTYPV | 45.31 | HLA-B*3901 | SMMEAMVS | 175.9 | HLA-A*0201 | ILEENTTY | 374.29 | HLA-B*1501 |
| TYINNTTI | 45.43 | HLA-A*2402 | SSNAYQAK | 175.9 | HLA-A*0301 | ILHLVLWI | 374.33 | HLA-A*0201 |
| LIDGWYGY | 45.44 | HLA-A*0101 | RRKKRGLF | 175.98 | HLA-B*2705 | ALQNRIMI | 374.41 | HLA-A*0201 |
| RLFDYSKW | 45.5 | HLA-B*5801 | SFYRNLIW | 176.12 | HLA-A*2402 | LIAPWYAY | 374.42 | HLA-A*2601 |
| KLHERVRK | 45.57 | HLA-A*0301 | PSNAQAFY | 176.2 | HLA-A*0101 | GTYNYPQY | 374.43 | HLA-B*5801 |
| RINMINSK | 45.74 | HLA-A*0301 | CHDGIARM | 176.52 | HLA-B*3901 | YQSGTYPV | 374.43 | HLA-B*1501 |
| YQSIRSIL | 45.81 | HLA-B*3901 | AESRKLLL | 176.76 | HLA-B*4001 | CSKYHWNL | 374.47 | HLA-B*0801 |
| STGAQSFY | 45.82 | HLA-A*0101 | FEAIGREF | 176.86 | HLA-B*4001 | LRSRYWAI | 374.78 | HLA-B*3901 |
| MTFYWTIV | 45.86 | HLA-A*0201 | VLGNYREV | 176.93 | HLA-A*0201 | ISHRTLLM | 374.78 | HLA-B*5801 |
| RINTINSK | 45.88 | HLA-A*0301 | AVTDIWSY | 176.99 | HLA-A*2601 | TKSYFANL | 374.93 | HLA-B*3901 |
| FPMGTAPV | 45.89 | HLA-B*0702 | EMSNEGSY | 177.01 | HLA-B*1501 | TVYWWDGL | 374.96 | HLA-A*0201 |
| SQYICSPV | 45.97 | HLA-A*0201 | KRMEDGLL | 177.48 | HLA-B*2705 | MVGLILAF | 375.54 | HLA-B*1501 |
| KINNIIEK | 46.04 | HLA-A*0301 | ETNKLAAI | 177.56 | HLA-A*2601 | YLIRTLTL | 375.58 | HLA-B*3901 |
| TELPFQNL | 46.06 | HLA-B*4001 | FRHMVWLI | 177.66 | HLA-B*3901 | GRMNYYWT | 375.68 | HLA-B*2705 |
| KIITIDSV | 46.07 | HLA-A*0201 | RINVINDK | 177.72 | HLA-A*0301 | SPLPFQNI | 375.82 | HLA-B*0702 |
| MRWLTLKL | 46.1 | HLA-B*3901 | NMRCTICI | 177.77 | HLA-B*0801 | KAWLHVCV | 375.95 | HLA-A*0201 |
| QIRGFVHF | 46.11 | HLA-B*1501 | KGYMFESK | 177.82 | HLA-A*0301 | FQIQGVRL | 376.01 | HLA-B*1501 |
| KLSQMSKK | 46.12 | HLA-A*0301 | ASNQASYK | 178.02 | HLA-A*0301 | ISIGTSTL | 376.2 | HLA-B*5801 |
| KIMESGGV | 46.14 | HLA-A*0201 | DPRMCSLM | 178.03 | HLA-B*0702 | RRLSANAV | 376.27 | HLA-B*3901 |
| HQSETYPV | 46.26 | HLA-B*3901 | NTYDHSRY | 178.15 | HLA-B*1501 | IEGRWPGL | 376.28 | HLA-B*4001 |
| SVLYFWGI | 46.29 | HLA-A*0201 | ILGFVLWA | 178.3 | HLA-A*0201 | IAFLTSSI | 376.48 | HLA-B*1501 |
| LLDNLQAY | 46.4 | HLA-A*0101 | YIQMCTEL | 178.3 | HLA-A*0201 | AMQNRMQI | 376.49 | HLA-A*0201 |
| LSVPEWSY | 46.44 | HLA-B*5801 | VTNVQNNY | 178.47 | HLA-A*0101 | SFYGELKW | 376.51 | HLA-A*2402 |
| KMNAQFEA | 46.47 | HLA-A*0201 | GRLIQNSL | 178.58 | HLA-B*2705 | CSNNTTNY | 376.65 | HLA-B*5801 |
| CVSHNGTW | 46.58 | HLA-B*5801 | ISLGDCSF | 178.64 | HLA-B*1501 | NPSCASNI | 376.66 | HLA-B*0702 |
| YMFESKRM | 46.58 | HLA-B*1501 | MLLMSTNA | 178.65 | HLA-A*0201 | DMSKEGSY | 376.76 | HLA-A*2601 |
| SSFEQITF | 46.73 | HLA-B*5801 | SVKLFSGY | 178.68 | HLA-A*2601 | VQNNYTTI | 376.8 | HLA-A*0201 |
| ISNEGSYF | 46.82 | HLA-B*1501 | GMRNVPEV | 178.96 | HLA-A*0201 | QVKIRRRV | 376.86 | HLA-B*0801 |
| TINSPLPF | 46.9 | HLA-B*1501 | SRLGYETF | 179.07 | HLA-B*2705 | NSFYAELK | 376.87 | HLA-A*0301 |
| YEELKLLL | 46.92 | HLA-B*4001 | CYNPCFYV | 179.2 | HLA-A*2402 | NSFEQITF | 376.97 | HLA-B*1501 |
| IQFTSVGK | 47.05 | HLA-A*0301 | IPKRNRSI | 179.64 | HLA-B*0801 | NRLNINPV | 377.25 | HLA-B*2705 |
| FQQMRDVL | 47.09 | HLA-B*3901 | NPRPNDPA | 179.67 | HLA-B*0702 | RTNGTSKI | 377.49 | HLA-B*5801 |
| ISLCSIWF | 47.13 | HLA-B*5801 | FYRNLIWL | 179.74 | HLA-A*2402 | GTYDHKEY | 377.49 | HLA-B*1501 |
| LLAVVMGL | 47.21 | HLA-A*0201 | ETNHTGTY | 179.78 | HLA-A*0101 | MVQAMRAI | 377.74 | HLA-B*0801 |
| AVNSSKPF | 47.22 | HLA-B*1501 | FLWGIHHP | 179.9 | HLA-A*0201 | LSVVNLLI | 377.88 | HLA-B*5801 |
| YLEEHPSA | 47.35 | HLA-A*0201 | RMTFYWTM | 179.91 | HLA-A*0201 | YNARLLVL | 377.92 | HLA-B*3901 |
| AEIEDLTF | 47.39 | HLA-B*4001 | YGVKGFSF | 180.04 | HLA-B*1501 | NTYDHAQY | 378.06 | HLA-B*1501 |
| TINDRSPF | 47.43 | HLA-B*1501 | QMALQLFI | 180.29 | HLA-A*0201 | NIRCQICI | 378.56 | HLA-B*0801 |
| KLSSMGVY | 47.48 | HLA-B*1501 | STYHNSFV | 180.48 | HLA-A*0201 | AIDQITTK | 378.64 | HLA-A*0301 |
| MYQRCCNL | 47.53 | HLA-A*2402 | VIVDNNSW | 180.58 | HLA-B*5801 | TSGSSIAF | 378.87 | HLA-B*1501 |
| SLSLAIMV | 47.66 | HLA-A*0201 | KLSNMGIY | 180.7 | HLA-A*0301 | IIALLIGI | 378.96 | HLA-A*0201 |
| RLGYETFK | 47.73 | HLA-A*0301 | TTIKTWAK | 180.72 | HLA-A*0301 | RLRMATGL | 378.99 | HLA-B*0801 |
| IMIWHSNL | 47.87 | HLA-A*0201 | RFSYVFCL | 180.83 | HLA-A*2402 | RFYRICKL | 379 | HLA-A*2402 |
| RSLFSSIK | 47.87 | HLA-A*0301 | LEFIAEQF | 180.85 | HLA-B*4001 | TPACDLHL | 379.57 | HLA-B*0702 |
| MLNLYDRV | 48.08 | HLA-A*0201 | TIKDRSPY | 180.94 | HLA-B*1501 | CHDGIGRM | 379.59 | HLA-B*3901 |
| AIAMGFVF | 48.14 | HLA-B*1501 | NQEELKSL | 181.05 | HLA-B*3901 | NRFQIKSV | 379.84 | HLA-B*2705 |
| LLAIAIGL | 48.29 | HLA-A*0201 | FYKNLIWL | 181.65 | HLA-A*2402 | PILYFWGV | 380.06 | HLA-A*0201 |
| VVMGLVFI | 48.3 | HLA-A*0201 | QESSCVCM | 181.66 | HLA-B*4001 | MARSALIL | 380.06 | HLA-B*1501 |
| RLGPSFYA | 48.38 | HLA-A*0201 | LRSGYWAI | 181.67 | HLA-B*3901 | FEKEGYSL | 380.08 | HLA-B*3901 |
| FTWNGVKV | 48.51 | HLA-A*0201 | NTYDHTQY | 181.74 | HLA-B*1501 | RRLSVNAI | 380.09 | HLA-B*3901 |
| ILVIYATV | 48.6 | HLA-A*0201 | GRYGVKGF | 181.97 | HLA-B*2705 | FIYSGIRT | 380.35 | HLA-A*0201 |
| AMQNIIQI | 48.84 | HLA-A*0201 | TIVETGYV | 181.99 | HLA-A*0201 | GTYDHNIY | 380.64 | HLA-A*0301 |
| AMTEIWSY | 48.87 | HLA-B*1501 | GSLNFVSM | 182.04 | HLA-B*1501 | NSWHIFGK | 380.72 | HLA-A*0301 |

Fig. 78-13

| Peptide | Affinity (nM) | Allele | Peptide | Affinity (nM) | Allele | Peptide | Affinity (nM) | Allele |
|---|---|---|---|---|---|---|---|---|
| AMDHTSQY | 49.1 | HLA-A*0101 | FSFTGEEM | 182.11 | HLA-B*1501 | ILRGSVAH | 380.75 | HLA-B*1501 |
| SSFEQITF | 49.16 | HLA-B*1501 | RVPEWSYI | 182.25 | HLA-A*0201 | FLMQIAVL | 380.98 | HLA-B*0801 |
| KLKREMTF | 49.45 | HLA-B*1501 | LTLKSEQF | 182.26 | HLA-B*5801 | FPIGTAPV | 381.1 | HLA-B*3901 |
| RMTFYWAI | 49.65 | HLA-A*0201 | FLAPRYAL | 182.44 | HLA-B*3901 | MVLASTTA | 381.23 | HLA-A*0201 |
| NECRTFFL | 49.78 | HLA-B*4001 | ASSGTVEF | 182.67 | HLA-B*1501 | RRRFIQNA | 381.84 | HLA-B*2705 |
| QTYRNTRK | 49.8 | HLA-A*0301 | ARIKTRLF | 182.92 | HLA-B*2705 | KQMTRGLF | 381.94 | HLA-B*2705 |
| ISVESSTY | 49.86 | HLA-B*1501 | SLMLATGM | 182.95 | HLA-B*1501 | ALGIINLL | 382.63 | HLA-A*0201 |
| KSLFSSIK | 50.08 | HLA-A*0301 | SGSFSIRW | 182.97 | HLA-B*5801 | THIHIFSF | 382.67 | HLA-A*2402 |
| FLWCKIVT | 50.09 | HLA-A*0201 | TELGAPLV | 183.04 | HLA-B*4001 | GYKNWILW | 383.07 | HLA-A*2402 |
| SLGDCSFA | 50.09 | HLA-A*0201 | ASIRRNYF | 183.18 | HLA-B*1501 | LAAIIMGF | 383.07 | HLA-B*5801 |
| ESVKNGTY | 50.18 | HLA-A*2601 | WAYNAELL | 183.25 | HLA-B*3901 | KAAMGMRI | 383.07 | HLA-B*5801 |
| LSFQVDCF | 50.2 | HLA-B*5801 | RMTFYWKI | 183.36 | HLA-A*0201 | MVIASTTA | 383.15 | HLA-A*0201 |
| FIAPRYAF | 50.22 | HLA-B*1501 | TEKVDTLL | 183.36 | HLA-B*4001 | KMPASRYL | 383.18 | HLA-A*0201 |
| KRLTVLGK | 50.27 | HLA-B*2705 | SLTEIWSY | 183.47 | HLA-B*1501 | WRGSNRPI | 383.41 | HLA-B*3901 |
| KLKREITF | 50.31 | HLA-B*1501 | GRWPGLVA | 183.53 | HLA-B*2705 | CHNSTCVV | 383.79 | HLA-B*3901 |
| SSNYQQSF | 50.38 | HLA-B*1501 | LETRIENL | 183.6 | HLA-B*4001 | RPLVRGQS | 383.95 | HLA-B*0702 |
| TSNSIVAF | 50.41 | HLA-B*5801 | TGFAPFSK | 183.8 | HLA-A*0301 | TTVTLHLK | 384.02 | HLA-A*0301 |
| MMIWHSNL | 50.45 | HLA-B*1501 | GTYDHNIY | 183.85 | HLA-B*1501 | IVTHFQRK | 384.37 | HLA-A*0301 |
| CLVPCFWL | 50.53 | HLA-A*0201 | SYRSLIRF | 183.91 | HLA-A*2402 | RATAILKK | 384.67 | HLA-A*0301 |
| MYQKCCNL | 50.64 | HLA-A*2402 | RPGDNITF | 183.96 | HLA-B*0702 | ARFEAVAW | 384.77 | HLA-B*2705 |
| SMVTFCGL | 50.72 | HLA-A*0201 | YSGAFIDY | 184.02 | HLA-A*0101 | KLYIWGIH | 384.83 | HLA-A*0301 |
| LLAVIVGL | 50.82 | HLA-A*0201 | SMREEYRK | 184.03 | HLA-A*0301 | SRMQFSSL | 384.96 | HLA-B*0801 |
| ILFIREGK | 50.85 | HLA-A*0301 | LSSRISFY | 184.07 | HLA-B*1501 | IEGGWCGM | 384.98 | HLA-B*4001 |
| LVHQSGTY | 50.87 | HLA-B*1501 | GRIFQSPI | 184.1 | HLA-B*2705 | WESLNGTA | 385.04 | HLA-B*4001 |
| RVRSDGNL | 50.89 | HLA-B*0702 | CSNGNCRF | 184.2 | HLA-B*5801 | FEATGNLV | 385.2 | HLA-B*3901 |
| IEMTDSEM | 50.98 | HLA-B*4001 | WMACNSAA | 184.27 | HLA-B*1501 | TEEQAVNI | 385.34 | HLA-B*4001 |
| KYHWNLAL | 51.08 | HLA-A*2402 | KADTRILF | 184.29 | HLA-B*5801 | FQKDAKVL | 385.63 | HLA-B*1501 |
| TSNSIIAF | 51.08 | HLA-B*5801 | RLRGIPPL | 184.37 | HLA-A*0201 | SNRPWLSF | 385.86 | HLA-B*1501 |
| SIHWTIVK | 51.12 | HLA-A*0301 | GPTECRTF | 184.62 | HLA-B*0702 | WVTRELYV | 385.88 | HLA-A*0201 |
| VYINTALL | 51.17 | HLA-A*2402 | NSWHIFSK | 184.9 | HLA-A*0301 | YRNLVWLV | 386.16 | HLA-B*3901 |
| YEAIEECL | 51.19 | HLA-B*4001 | CHDGISRM | 184.95 | HLA-B*3901 | NTASRSGY | 386.73 | HLA-A*0101 |
| LTLNTMTK | 51.28 | HLA-A*0301 | TSIRNNTY | 184.99 | HLA-B*1501 | CSFTGWIL | 386.97 | HLA-B*5801 |
| YESIEECL | 51.38 | HLA-B*4001 | GTYYYPKY | 185.04 | HLA-A*0301 | FVHFVEAL | 387.07 | HLA-A*0201 |
| SLIMRTVI | 51.42 | HLA-B*0801 | RPVIEINM | 185.36 | HLA-B*0702 | PFHNVHPF | 387.18 | HLA-A*2402 |
| MTFYWAIV | 51.47 | HLA-A*0201 | SLSLAIMI | 185.47 | HLA-A*0201 | SRARIKTR | 387.24 | HLA-B*2705 |
| FYRNLVWF | 51.57 | HLA-A*2402 | FQRSKFLL | 185.48 | HLA-B*3901 | RLNWLTKA | 387.84 | HLA-A*0201 |
| IQAGVNRF | 51.59 | HLA-B*1501 | CSNNTTNY | 185.72 | HLA-B*1501 | AVTWWNRK | 387.84 | HLA-A*0301 |
| RLAKCNTK | 51.64 | HLA-A*0301 | GRVSVSTK | 185.81 | HLA-B*2705 | YNVELLVL | 388.04 | HLA-B*3901 |
| LLAIAMGL | 51.66 | HLA-A*0201 | ALLNRLSI | 185.84 | HLA-B*0801 | FPIGVAPV | 389.28 | HLA-B*3901 |
| LIHQSGTY | 51.66 | HLA-B*1501 | MRFTYSGI | 186.03 | HLA-B*3901 | ALKLVVAM | 389.32 | HLA-B*1501 |
| ISFSISCF | 51.79 | HLA-B*1501 | AILRKATK | 186.21 | HLA-A*0301 | YFFLKVPV | 389.71 | HLA-B*0801 |
| FYRNLAWF | 51.93 | HLA-A*2402 | NTYQWIIK | 186.25 | HLA-A*0301 | FLDVWTYN | 390.2 | HLA-A*0201 |
| RLRMATGL | 51.94 | HLA-B*0702 | CHDGVNRM | 186.36 | HLA-B*3901 | EVSFQGGH | 390.26 | HLA-A*2601 |
| RRMIQLIV | 52.12 | HLA-B*2705 | QESSCTCI | 186.51 | HLA-B*4001 | SFYKNLLW | 390.28 | HLA-B*5801 |
| KMNNQILI | 52.13 | HLA-A*0201 | GTCWEQMY | 186.58 | HLA-A*0101 | GIVHLILW | 390.48 | HLA-B*5801 |
| ASIRNNSY | 52.21 | HLA-B*1501 | GPILSFIM | 186.6 | HLA-B*0702 | LLVGIGNL | 390.64 | HLA-A*0201 |
| VMGQASYK | 52.25 | HLA-A*0301 | AMRAIGTH | 186.66 | HLA-B*1501 | KESTQRAI | 390.72 | HLA-B*4001 |
| SINWLTKK | 52.44 | HLA-A*0301 | TESSFEQI | 187.32 | HLA-B*4001 | ITVWSSKY | 390.89 | HLA-A*2601 |
| LEALMEWL | 52.48 | HLA-B*4001 | TMHDRSPF | 187.46 | HLA-B*0801 | NTYDHTQY | 391.4 | HLA-A*0101 |
| SEKVNTLL | 52.49 | HLA-B*4001 | SLLRDNAK | 187.56 | HLA-A*0301 | DANVNNLY | 392.1 | HLA-A*2601 |
| ILNPNDTV | 52.53 | HLA-A*0201 | NQASYKIF | 187.63 | HLA-B*1501 | LEPGTFDI | 392.24 | HLA-B*4001 |
| RMTFYWTI | 52.54 | HLA-A*0201 | TSGSSISF | 187.74 | HLA-B*5801 | LLENLQAY | 392.27 | HLA-B*1501 |
| YLCAGIPT | 52.55 | HLA-A*0201 | KRLENLDK | 187.76 | HLA-B*2705 | RRDQKSLR | 392.31 | HLA-B*2705 |
| ASIRNSTY | 52.61 | HLA-B*1501 | LVAPEYGF | 187.81 | HLA-B*1501 | EMSKLFEK | 392.32 | HLA-A*0301 |
| LIAPRGYF | 52.64 | HLA-B*1501 | LSYSTGAL | 187.88 | HLA-B*1501 | NADVLVAL | 392.41 | HLA-B*3901 |
| LLENDVPV | 52.72 | HLA-A*0201 | IIKKYTSA | 188.43 | HLA-B*0801 | SLVLVGLV | 392.61 | HLA-A*0201 |
| GQSGRIEF | 52.92 | HLA-B*1501 | TFEFTSFF | 188.53 | HLA-A*2402 | ELSSMGVY | 392.64 | HLA-B*1501 |
| LIAPWYAF | 52.94 | HLA-B*1501 | ASRYGYEM | 188.64 | HLA-B*1501 | FRNVVWLI | 392.7 | HLA-B*3901 |
| HPRGLLEV | 53.02 | HLA-B*0702 | ALSYSTGA | 188.68 | HLA-A*0201 | CQNGVCPV | 392.85 | HLA-B*3901 |
| VYIEVLHL | 53.04 | HLA-A*2402 | KIITMGSV | 188.86 | HLA-A*0201 | WMKLYWHL | 392.86 | HLA-A*0201 |
| LPQSGRIV | 53.13 | HLA-B*0702 | SVWAGRTV | 188.99 | HLA-A*0201 | IASSIVLV | 393.23 | HLA-A*0201 |
| LTVEVPYV | 53.19 | HLA-A*0201 | SFYRNMRW | 189.08 | HLA-A*2402 | SHTAYSQI | 393.24 | HLA-B*3901 |
| FSFGASSF | 53.2 | HLA-B*5801 | VANVNNLY | 189.19 | HLA-B*5801 | AIDIMQNK | 393.34 | HLA-A*0301 |
| RSSFYAEM | 53.35 | HLA-B*5801 | ITVGSSKY | 189.35 | HLA-B*1501 | TSKHYIGK | 393.41 | HLA-A*0301 |
| YLLKGESY | 53.35 | HLA-B*1501 | MPASRYLT | 189.4 | HLA-B*0702 | YLIRALTL | 393.52 | HLA-B*3901 |

Fig. 78-14

| Peptide | Affinity (nM) | Allele | Peptide | Affinity (nM) | Allele | Peptide | Affinity (nM) | Allele |
|---|---|---|---|---|---|---|---|---|
| WTYNAELF | 53.39 | HLA-B*1501 | LTVPEWSY | 189.45 | HLA-B*1501 | MKWLSSSM | 393.88 | HLA-B*1501 |
| GVKGFSFK | 53.43 | HLA-A*0301 | HMECRTFF | 189.48 | HLA-B*1501 | AVTDVWSY | 394.44 | HLA-B*1501 |
| TSLTSLPF | 53.49 | HLA-B*5801 | NSWHILSK | 189.52 | HLA-A*0301 | AINSSMPL | 394.82 | HLA-A*0201 |
| KRYERVKM | 53.5 | HLA-B*2705 | VLNPGETL | 189.61 | HLA-A*0201 | GVYMNTAL | 395.25 | HLA-B*1501 |
| GIFFVEHK | 53.57 | HLA-A*0301 | KTKATKMK | 190.02 | HLA-A*0301 | RTLDYHDF | 395.32 | HLA-B*1501 |
| STKSTVLK | 53.75 | HLA-A*0301 | SRSNIFNM | 190.17 | HLA-B*2705 | LIWLWLVL | 396.28 | HLA-A*0201 |
| YQILVIYA | 53.84 | HLA-A*0201 | LQAYQKRM | 190.23 | HLA-B*1501 | FLMQITIL | 396.37 | HLA-B*0801 |
| LEPGTFDL | 53.89 | HLA-B*4001 | KIVHVSPL | 190.34 | HLA-A*0201 | FFRNLVWL | 396.87 | HLA-B*0801 |
| KINSWHIF | 53.9 | HLA-B*1501 | FPIGTAPI | 190.42 | HLA-B*3901 | SGDYARLY | 396.9 | HLA-A*0101 |
| ILSFIMWA | 54.09 | HLA-A*0201 | GVWIGRTK | 190.47 | HLA-A*0301 | GVNTNKTF | 396.97 | HLA-B*1501 |
| YRTLMSVK | 54.11 | HLA-B*2705 | ALSIYSCI | 190.57 | HLA-A*0201 | LRSRYWAI | 397.18 | HLA-B*2705 |
| YMFESKNM | 54.12 | HLA-A*0201 | RYPDVRCI | 190.77 | HLA-A*2402 | FFMQIAIL | 397.24 | HLA-B*3901 |
| LLENGVPV | 54.13 | HLA-A*0201 | IAMGLVFI | 190.82 | HLA-A*0201 | NVSEWSYI | 397.26 | HLA-A*0201 |
| QLLRHFQK | 54.17 | HLA-A*0301 | KLYEKVRR | 191.07 | HLA-A*0301 | GYFGIFFV | 397.87 | HLA-A*0201 |
| FTKWNVTY | 54.17 | HLA-A*2601 | APLMVAYM | 191.25 | HLA-B*0702 | RPWIRFNS | 397.97 | HLA-B*0702 |
| KMNTQILI | 54.28 | HLA-A*0201 | KLVLATGL | 191.31 | HLA-A*0201 | RRRLSVNA | 398.11 | HLA-B*2705 |
| FESNGAFI | 54.37 | HLA-B*4001 | SRYICSGL | 191.31 | HLA-B*2705 | TIASSLPF | 398.15 | HLA-A*2601 |
| QRFEMFPK | 54.43 | HLA-B*2705 | KISHISPL | 191.37 | HLA-A*0201 | IMIAGLFF | 399.2 | HLA-A*0201 |
| KRLTIIGK | 54.44 | HLA-B*2705 | AIDKITNK | 191.39 | HLA-A*0301 | FYKSMRWL | 399.32 | HLA-A*2402 |
| CFQPCFYI | 54.56 | HLA-A*2402 | DVIMEVVF | 191.41 | HLA-A*2601 | ITMGSVSL | 399.52 | HLA-A*0201 |
| RMDYYWTL | 54.56 | HLA-B*3901 | SFFRNVVW | 191.49 | HLA-A*2402 | SLVLAASI | 399.65 | HLA-A*0201 |
| LQNTSKHY | 54.64 | HLA-B*1501 | APRGYFKV | 191.56 | HLA-B*0702 | MRTPIAFL | 399.82 | HLA-B*2705 |
| TSNQDSFY | 54.7 | HLA-A*0101 | RRRKRGLF | 191.56 | HLA-B*2705 | CSFAGWIL | 399.89 | HLA-B*3901 |
| VLINTYQW | 54.72 | HLA-B*5801 | KMKWGMEL | 191.65 | HLA-B*1501 | ASSGNLEF | 400.34 | HLA-B*1501 |
| REITFHGA | 54.85 | HLA-B*4001 | RRDQRSLR | 191.79 | HLA-B*2705 | RPDSSWLF | 400.35 | HLA-B*0702 |
| FLAPRYGY | 55.12 | HLA-B*1501 | MRKKRGLF | 191.96 | HLA-B*0801 | SQTIINNY | 400.43 | HLA-B*1501 |
| FVQSYFQL | 55.19 | HLA-A*0201 | TSNSIVTF | 192.05 | HLA-B*1501 | ISSMGEAM | 400.69 | HLA-B*1501 |
| RLRSGFEM | 55.33 | HLA-B*0702 | IELAEKAM | 192.11 | HLA-B*4001 | LEGRIENL | 401.02 | HLA-B*4001 |
| WMCLNGSM | 55.35 | HLA-B*1501 | IFSARSAL | 192.33 | HLA-B*0801 | WSYNAEFL | 401.19 | HLA-B*3901 |
| ESVLINTY | 55.41 | HLA-A*2601 | GVQMHRFK | 192.58 | HLA-A*0301 | ITNKVNNI | 401.44 | HLA-B*5801 |
| SIKTKLPF | 55.41 | HLA-B*1501 | FVSMEFSL | 192.67 | HLA-A*0201 | ESIRTGTY | 401.47 | HLA-B*1501 |
| KLSNMGVY | 55.43 | HLA-B*1501 | FMYSDFHF | 193.07 | HLA-B*5801 | TIKDRSPY | 401.6 | HLA-A*2601 |
| FQQMRDIL | 55.44 | HLA-B*3901 | SVPEWSYI | 193.19 | HLA-A*0201 | RSGYEILK | 401.96 | HLA-A*0301 |
| TIHDRSPF | 55.55 | HLA-B*1501 | SVSECRTF | 193.46 | HLA-B*1501 | ITMGSVSL | 401.97 | HLA-B*1501 |
| SLNGVSPI | 55.6 | HLA-A*0201 | VISTDLSY | 193.52 | HLA-B*1501 | SKDNSIQL | 402.14 | HLA-B*3901 |
| NPRIFLAM | 55.77 | HLA-B*0801 | CYHIGGTI | 193.69 | HLA-A*2402 | RTFSFQLI | 402.31 | HLA-A*0201 |
| RTLDYHDF | 55.96 | HLA-B*5801 | GTYSYPQY | 193.81 | HLA-A*0301 | SGRVSFYW | 402.35 | HLA-B*5801 |
| TSSSSTVF | 56 | HLA-B*5801 | AICTHLEV | 193.96 | HLA-A*0201 | LSNNSTEK | 402.53 | HLA-A*0301 |
| SHNGTWAV | 56.05 | HLA-B*3901 | ETEQTKLY | 194.44 | HLA-A*2601 | FLNNTEPL | 402.98 | HLA-B*3901 |
| ALAQGTLL | 56.06 | HLA-A*0201 | SWPDGALF | 194.58 | HLA-A*2402 | RPADGTGS | 403.04 | HLA-B*0702 |
| WVLLNASW | 56.08 | HLA-B*5801 | CINGICTV | 194.61 | HLA-A*0201 | WSYIVEKI | 403.16 | HLA-B*5801 |
| VINTSKPF | 56.1 | HLA-B*1501 | RSGYSGIF | 194.78 | HLA-B*5801 | QASYKIFK | 403.37 | HLA-A*0301 |
| APSRVSKL | 56.15 | HLA-B*0702 | TSNSIVVF | 194.85 | HLA-B*1501 | YNAQLLVL | 403.43 | HLA-B*3901 |
| RLNINSVK | 56.25 | HLA-A*0301 | WPQSSPPT | 195.05 | HLA-B*0702 | TFIFNGAF | 403.65 | HLA-A*2402 |
| KLNNVIDK | 56.41 | HLA-A*0301 | CSFAGWIL | 195.05 | HLA-B*5801 | ILEKNVTV | 403.66 | HLA-A*0201 |
| ISFAISCF | 56.47 | HLA-B*1501 | RMENLNKK | 195.16 | HLA-A*0301 | YQAKFESV | 403.93 | HLA-B*1501 |
| LMLATGMK | 56.51 | HLA-A*0301 | GTYDYSKY | 195.25 | HLA-B*1501 | SSIAFCGV | 404.06 | HLA-A*0201 |
| FYRNLIWF | 56.53 | HLA-A*2402 | SSNYQQSF | 195.35 | HLA-B*5801 | STDKVNTI | 404.37 | HLA-A*0101 |
| IPSRSLKL | 56.53 | HLA-B*0702 | HKDNAIRL | 195.36 | HLA-B*3901 | TIVSSLPF | 404.41 | HLA-A*2601 |
| CEVSSWHI | 56.55 | HLA-B*4001 | AVAVLKYK | 195.63 | HLA-A*0301 | NGNMRCTI | 404.53 | HLA-B*0801 |
| IMASQGTK | 56.61 | HLA-A*0301 | MGLAPSPY | 195.96 | HLA-B*1501 | MKIYWHLM | 404.54 | HLA-B*1501 |
| TILETGYV | 56.65 | HLA-A*0201 | GRYSIADK | 195.98 | HLA-B*2705 | KRKRNSSI | 404.59 | HLA-B*2705 |
| LLTEVETL | 56.66 | HLA-A*0201 | FQNISPVW | 196.14 | HLA-B*5801 | ISSMVEAM | 404.61 | HLA-B*5801 |
| SLLNRLSI | 56.68 | HLA-A*0201 | FLMQIATL | 196.29 | HLA-B*3901 | SQGTKRSY | 404.66 | HLA-B*1501 |
| SVKNGTYY | 57.01 | HLA-B*1501 | VLNVSLHL | 196.42 | HLA-A*0201 | ASCMGLIY | 404.69 | HLA-B*1501 |
| GVKGFSYK | 57.08 | HLA-A*0301 | SFYSELKW | 196.67 | HLA-A*2402 | LSNRFQIK | 404.82 | HLA-A*0301 |
| IPKRNRSI | 57.12 | HLA-B*0702 | SITDIWTY | 196.76 | HLA-A*2601 | SQDTEISF | 404.95 | HLA-B*1501 |
| MRTPIAFL | 57.18 | HLA-B*3901 | RLNTMHQL | 196.86 | HLA-A*0201 | FSISCFLL | 405.03 | HLA-B*3901 |
| FIQALQLL | 57.21 | HLA-B*1501 | NVLSIAPI | 196.88 | HLA-A*0201 | KIRRRVDM | 405.06 | HLA-B*0702 |
| VSVGSGSF | 57.3 | HLA-B*1501 | GIYQILSI | 196.99 | HLA-A*0201 | LRSKYWAI | 405.24 | HLA-B*3901 |
| KVNTLTEK | 57.33 | HLA-A*0301 | RRRGLFGA | 197.16 | HLA-B*2705 | TRDAMTEI | 405.85 | HLA-B*3901 |
| CQMEKIVL | 57.37 | HLA-B*3901 | TSNSIAVF | 197.3 | HLA-B*1501 | NRVKIDPV | 405.98 | HLA-B*3901 |
| SYNYHQSF | 57.39 | HLA-A*2402 | RGWAPLSK | 197.32 | HLA-A*0301 | NIYKILSI | 406.43 | HLA-B*0801 |
| QEIRAFSF | 57.39 | HLA-B*4001 | GSASSQAY | 197.35 | HLA-A*0101 | DSEMNKLY | 406.63 | HLA-A*0101 |
| NPVHKSQL | 57.47 | HLA-B*0702 | GRMADSIK | 197.53 | HLA-B*2705 | TLSTIALF | 406.82 | HLA-B*1501 |

Fig. 78-15

| Peptide | Affinity (nM) | Allele | Peptide | Affinity (nM) | Allele | Peptide | Affinity (nM) | Allele |
|---|---|---|---|---|---|---|---|---|
| IISLCSIW | 57.74 | HLA-B*5801 | NRIRIDPV | 197.77 | HLA-B*3901 | KSVFNSLY | 407 | HLA-A*0101 |
| WMACHSAA | 57.75 | HLA-A*0201 | FSIAASYK | 197.8 | HLA-A*0301 | FRSGYETF | 407.11 | HLA-B*3901 |
| NTDLEALM | 57.85 | HLA-A*0101 | KRMEDGFL | 198.17 | HLA-B*2705 | LAIYSTVA | 407.23 | HLA-B*1501 |
| SLCYPGNF | 57.89 | HLA-B*1501 | RSFSRTEL | 198.29 | HLA-B*5801 | TAVAVIKY | 407.24 | HLA-B*5801 |
| TIIETGYV | 57.98 | HLA-A*0201 | VYEGYEEF | 198.41 | HLA-A*2402 | EHQIGNVI | 407.41 | HLA-B*3901 |
| LSMAPIMF | 58.04 | HLA-B*1501 | RIFQSHIR | 198.56 | HLA-A*0301 | WSWPDGAL | 407.48 | HLA-B*3901 |
| KLNRLIDK | 58.09 | HLA-A*0301 | LEESHPGI | 198.66 | HLA-B*4001 | SLKLAVGL | 407.55 | HLA-B*0801 |
| CSIWFSHY | 58.29 | HLA-B*5801 | RGFLILGK | 198.88 | HLA-A*0301 | RISHRTLL | 407.55 | HLA-B*0801 |
| GESYGRII | 58.36 | HLA-B*4001 | SLGAISFW | 199.29 | HLA-B*5801 | RANINDFF | 407.56 | HLA-B*1501 |
| ASSGTLEF | 58.51 | HLA-B*5801 | REVEVVNA | 199.47 | HLA-B*4001 | SPGARPKV | 407.69 | HLA-B*0702 |
| MLLASTNA | 58.79 | HLA-A*0201 | IVMCGVDY | 199.69 | HLA-B*1501 | TLVSTKEW | 407.72 | HLA-B*5801 |
| TLSTIALL | 58.79 | HLA-A*0201 | GQRSRIDY | 199.73 | HLA-B*1501 | IIFESNGA | 407.91 | HLA-A*0201 |
| CLYASPQL | 58.9 | HLA-A*0201 | GYICSGIF | 199.92 | HLA-A*2402 | FPIGVAPV | 408.02 | HLA-B*0702 |
| ITYSSSMM | 58.9 | HLA-A*0201 | GTYSYPQY | 199.93 | HLA-B*5801 | FEATGNLI | 408.4 | HLA-B*3901 |
| DAYAVIHY | 58.93 | HLA-A*2601 | YLFIKEGK | 199.94 | HLA-A*0301 | APEYGHLV | 408.62 | HLA-B*0702 |
| TENPVICL | 58.93 | HLA-B*4001 | MQINPVKL | 200.05 | HLA-B*1501 | KINTLTER | 409.23 | HLA-A*0301 |
| WVLWISFA | 59.05 | HLA-A*0201 | RPMDSTGS | 200.15 | HLA-B*0702 | ETQTRGIF | 409.28 | HLA-A*2601 |
| AYTKVMYF | 59.05 | HLA-A*2402 | FMQALQLL | 200.16 | HLA-B*3901 | YLCTGVLT | 409.39 | HLA-A*0201 |
| RRAEIIKM | 59.07 | HLA-B*2705 | TLSVVSLL | 200.32 | HLA-A*0201 | LVAPRGHY | 409.39 | HLA-A*2601 |
| YRYTYRCH | 59.12 | HLA-B*2705 | GLCYPGNF | 200.35 | HLA-B*1501 | ALRLAENK | 409.57 | HLA-A*0301 |
| FESNGNLI | 59.16 | HLA-B*4001 | TLVSTGSW | 200.53 | HLA-B*5801 | RKRKTRGL | 409.84 | HLA-B*0702 |
| MRFTYSGI | 59.21 | HLA-B*2705 | KVVHISPL | 200.63 | HLA-A*0201 | YSIDSSYI | 409.84 | HLA-B*5801 |
| MLNLYERV | 59.42 | HLA-A*0201 | ALSYSAGA | 200.67 | HLA-A*0201 | NASWFNSF | 410.42 | HLA-B*1501 |
| CEVNSWHI | 59.45 | HLA-B*4001 | RMNYYWTL | 200.68 | HLA-B*3901 | SRYSKADK | 410.64 | HLA-B*2705 |
| VTLSSGYK | 59.76 | HLA-A*0301 | RYGDGVWI | 200.69 | HLA-A*2402 | AAFLFWTM | 410.97 | HLA-B*1501 |
| TEYRQEAL | 60.21 | HLA-A*0201 | SQYICSPV | 200.71 | HLA-B*1501 | NIDRFLRV | 410.98 | HLA-A*0201 |
| RRSGGISK | 60.36 | HLA-B*2705 | VWSYNAEF | 200.97 | HLA-A*2402 | YRNMRWLT | 411.38 | HLA-B*2705 |
| KIIHISPL | 60.44 | HLA-A*0201 | RVSFYWTI | 201.01 | HLA-A*0201 | RIDYYWSM | 411.4 | HLA-A*0201 |
| RRIDFHWL | 60.45 | HLA-B*2705 | RTATREGK | 201.25 | HLA-A*0301 | LYFHKGLL | 411.4 | HLA-A*2402 |
| KTGGPIYK | 60.46 | HLA-A*0301 | ALSGMAIA | 201.4 | HLA-A*0201 | NENGDIIF | 411.42 | HLA-B*4001 |
| HQSGTYPV | 60.59 | HLA-A*0201 | SINTRLPF | 201.4 | HLA-B*0801 | SFERFEIF | 411.51 | HLA-A*2402 |
| MSLNISLY | 60.63 | HLA-B*1501 | SIYSTVAA | 202.02 | HLA-A*0201 | VWWTSNSI | 411.9 | HLA-A*2402 |
| ISVGSSTY | 60.72 | HLA-B*1501 | MQNKLNNV | 202.29 | HLA-A*0201 | RQTFDWTL | 412.09 | HLA-B*3901 |
| YLMLSKSL | 60.88 | HLA-A*0201 | MGQAPSPY | 202.29 | HLA-B*1501 | TTLPFHNV | 412.1 | HLA-A*0201 |
| GLCYPGSF | 60.88 | HLA-B*1501 | DTICVGYH | 202.3 | HLA-A*2601 | DRSPYRTL | 412.22 | HLA-B*3901 |
| FIAPENAY | 60.9 | HLA-B*1501 | RYSIADKI | 202.4 | HLA-A*2402 | GRLGFEII | 412.55 | HLA-B*2705 |
| FLAPRYAL | 61 | HLA-B*0801 | CTVPCFWV | 202.51 | HLA-A*0201 | VARLGKGY | 412.56 | HLA-B*1501 |
| TINDRTAF | 61.08 | HLA-B*1501 | FQKDARVL | 202.73 | HLA-B*1501 | GSFYRSIR | 412.64 | HLA-A*0301 |
| YSGSFMDY | 61.09 | HLA-A*0101 | RLILATGL | 202.74 | HLA-A*0201 | LSYQVGYL | 412.81 | HLA-B*5801 |
| SARHIEEW | 61.11 | HLA-B*5801 | MDYYWAIL | 203.03 | HLA-B*3901 | YESTQAAI | 412.89 | HLA-B*3901 |
| RAYVDGFK | 61.14 | HLA-A*0301 | FQKDARVL | 203.29 | HLA-B*3901 | EWSKRYEL | 413.48 | HLA-B*0801 |
| IINNYYNK | 61.17 | HLA-A*0301 | YKSTQAAI | 203.46 | HLA-B*3901 | WSYNAEFL | 413.49 | HLA-B*5801 |
| LWQCYYLL | 61.24 | HLA-A*2402 | WKHVTNTI | 203.84 | HLA-B*3901 | DVIVFNTI | 413.7 | HLA-A*2601 |
| FALSGVAV | 61.26 | HLA-A*0201 | ALGHGTTL | 204.37 | HLA-A*0201 | TRDAMTEV | 413.96 | HLA-B*3901 |
| LLAIVMGL | 61.43 | HLA-A*0201 | TIHDRSPY | 204.6 | HLA-A*2601 | TLEHTSRY | 413.99 | HLA-A*0101 |
| FESNGGLI | 61.58 | HLA-B*4001 | MMAMRYPI | 204.63 | HLA-B*3901 | GLITDTIK | 414.02 | HLA-A*0301 |
| APNRVSKL | 61.62 | HLA-B*0702 | HKDNALRL | 204.66 | HLA-B*3901 | YQWVIRNW | 414.02 | HLA-B*5801 |
| APNRASFF | 61.83 | HLA-B*0702 | TTNSIVVF | 204.66 | HLA-B*1501 | LLFLKVPV | 414.63 | HLA-B*0801 |
| ALRMKWMM | 61.86 | HLA-B*0801 | WLIDQSGT | 204.72 | HLA-A*0201 | ARLYIWGV | 414.71 | HLA-B*2705 |
| GIFSVESK | 61.89 | HLA-A*0301 | SIYASPQL | 204.78 | HLA-A*0201 | DMNNEGSY | 414.74 | HLA-A*2601 |
| VSLGAISF | 61.96 | HLA-B*5801 | SESRSNIF | 204.78 | HLA-B*4001 | KYSKEAKL | 414.77 | HLA-A*2402 |
| TSNQGSFY | 62.02 | HLA-A*0101 | QLTHHMRK | 205.08 | HLA-A*0301 | DRISHRTL | 414.94 | HLA-B*3901 |
| YQAKFESI | 62.04 | HLA-A*0201 | YAYKIVKK | 205.09 | HLA-A*0301 | TFYRNMRW | 415.42 | HLA-B*5801 |
| SEETYKIL | 62.15 | HLA-B*4001 | RMEFFWTL | 205.18 | HLA-B*3901 | KAVKLYKK | 415.44 | HLA-A*0301 |
| SMSDIEAM | 62.17 | HLA-B*1501 | FIMWACSS | 205.21 | HLA-A*0201 | MEDGFLGV | 415.98 | HLA-B*4001 |
| LELGDCSI | 62.28 | HLA-B*4001 | YKWEKYCV | 205.23 | HLA-B*3901 | FMARSALI | 416.06 | HLA-B*3901 |
| KEAQDVIM | 62.29 | HLA-B*4001 | RIQIDSVK | 205.27 | HLA-A*0301 | TQSAIDQV | 416.14 | HLA-A*0201 |
| FESNGNFI | 62.29 | HLA-B*4001 | IIVTREPY | 205.32 | HLA-B*1501 | RTLMSCPV | 416.49 | HLA-A*0201 |
| SRSGFEVL | 62.32 | HLA-B*3901 | LMDFLKDV | 205.38 | HLA-A*0201 | YLECRTFF | 416.81 | HLA-B*1501 |
| KVNSIINK | 62.39 | HLA-A*0301 | KVVHISPL | 205.65 | HLA-B*1501 | FQKDAKML | 417.14 | HLA-B*3901 |
| VSPLAVTW | 62.41 | HLA-B*5801 | RRVLRENA | 205.81 | HLA-B*2705 | TSYRSLIR | 417.44 | HLA-A*0301 |
| YMFESKKM | 62.48 | HLA-B*1501 | MSELGVPF | 206.01 | HLA-B*1501 | RPKENPAH | 417.59 | HLA-B*0702 |
| MARSALIL | 62.5 | HLA-B*0702 | VTRSGTSK | 206.05 | HLA-A*0301 | NMGKVECV | 417.69 | HLA-A*0201 |
| RTSISCLY | 62.51 | HLA-A*0101 | CYRACFYV | 206.09 | HLA-A*2402 | SLQCRICI | 417.71 | HLA-A*0201 |
| RSMRWLTL | 62.61 | HLA-B*5801 | FPMGTAPV | 206.11 | HLA-B*3901 | QESECQCI | 417.73 | HLA-B*4001 |

Fig. 78-16

| Peptide | Affinity (nM) | Allele | Peptide | Affinity (nM) | Allele | Peptide | Affinity (nM) | Allele |
|---|---|---|---|---|---|---|---|---|
| NTYDHSHY | 62.61 | HLA-B*1501 | MVNGWYGY | 206.43 | HLA-B*1501 | TLSGVAIA | 417.86 | HLA-A*0201 |
| RIMINPVK | 62.7 | HLA-A*0301 | RAGYETFK | 206.48 | HLA-A*0301 | KYVKSKRL | 417.92 | HLA-A*2402 |
| ALLNRLSI | 62.72 | HLA-A*0201 | KFFPSSSY | 206.53 | HLA-B*1501 | MTFYWTII | 418.11 | HLA-B*5801 |
| DSEMLNLY | 62.86 | HLA-B*0702 | ITYSSPMM | 206.68 | HLA-B*5801 | RMKWMMAM | 418.76 | HLA-B*0702 |
| AIVMGLVF | 62.89 | HLA-B*1501 | FLNNTEPL | 206.82 | HLA-B*1501 | AIDEITTK | 418.9 | HLA-A*0301 |
| GQFGRIDF | 62.94 | HLA-B*1501 | KYGDGVWI | 206.86 | HLA-A*2402 | ASTGGQSF | 418.93 | HLA-B*1501 |
| LMEQNVPV | 62.95 | HLA-A*0201 | MIIELAEK | 207 | HLA-A*0301 | GFFSRLNW | 418.94 | HLA-A*2402 |
| TLSTIALI | 63.08 | HLA-A*0201 | RLENLNKK | 207.23 | HLA-A*0301 | QTIINNYY | 419.05 | HLA-B*1501 |
| RSMKWLTL | 63.23 | HLA-B*5801 | MMMGMFNM | 207.51 | HLA-B*3901 | GLVFICIK | 419.91 | HLA-A*0301 |
| KLYWHLMH | 63.35 | HLA-A*0301 | ASCMGLIY | 207.69 | HLA-A*0101 | NRRLTTTI | 420.04 | HLA-B*0801 |
| KTMTITFL | 63.39 | HLA-B*5801 | TIASDILK | 207.69 | HLA-A*0301 | NMSKKKSY | 420.04 | HLA-B*1501 |
| LRFLFSSI | 63.51 | HLA-B*2705 | KRVRLFDY | 207.91 | HLA-B*2705 | RQASPSCL | 420.3 | HLA-B*1501 |
| KTNQQFEM | 63.51 | HLA-B*5801 | ILSTKALL | 208.24 | HLA-A*0201 | FQNISPVW | 420.35 | HLA-B*1501 |
| AYTKVLYF | 63.54 | HLA-A*2402 | GTYDYPRY | 208.32 | HLA-A*0301 | CISGTCAV | 420.46 | HLA-A*0201 |
| MLLIVQAL | 63.62 | HLA-A*0201 | IRWETTGR | 208.43 | HLA-B*2705 | GVITDTLK | 420.55 | HLA-A*0301 |
| AINKITNK | 63.64 | HLA-A*0301 | KAAMGLRI | 208.43 | HLA-B*5801 | LGVKGFGF | 421.16 | HLA-B*1501 |
| APRGHYKI | 63.71 | HLA-B*0702 | SEECSCYV | 208.54 | HLA-B*4001 | LTDWSGYS | 421.2 | HLA-A*0101 |
| THMEVCFM | 63.73 | HLA-B*3901 | WRGANRPV | 208.58 | HLA-B*3901 | RRRLSTNA | 421.64 | HLA-B*2705 |
| MTNVQNNY | 63.74 | HLA-A*0101 | FVVREPFI | 208.76 | HLA-A*0201 | TPLGSPPV | 421.86 | HLA-B*0702 |
| SIKTKLPF | 63.79 | HLA-B*0801 | GSIRNNTY | 208.85 | HLA-B*1501 | TQNNTTVV | 422.05 | HLA-B*1501 |
| FQNICKPY | 63.8 | HLA-B*1501 | RYSKADKI | 208.88 | HLA-A*2402 | IYSSSMMW | 422.18 | HLA-B*5801 |
| VSLGAVSF | 63.84 | HLA-B*5801 | KGWAPLSK | 208.91 | HLA-A*0301 | TSKVKMKW | 422.29 | HLA-B*5801 |
| SWFNSFLI | 63.86 | HLA-A*2402 | YSGAFVDY | 208.97 | HLA-A*0101 | ASIRNSTY | 422.45 | HLA-B*5801 |
| TVVENTYV | 63.88 | HLA-A*0201 | TTVTLHFK | 209.01 | HLA-A*0301 | NADHRIYW | 423.08 | HLA-B*5801 |
| KMKAILVV | 64.09 | HLA-A*0201 | KMVTQRTV | 209.03 | HLA-A*0201 | LRSLFSSI | 423.22 | HLA-B*2705 |
| KSHGRILK | 64.48 | HLA-A*0301 | RSGYSGSF | 209.42 | HLA-B*5801 | SLKLAIGL | 423.31 | HLA-B*0801 |
| TPHRTLLM | 64.49 | HLA-B*0702 | LLFQDILM | 209.47 | HLA-B*1501 | QGTMDYYW | 423.68 | HLA-B*5801 |
| SRYGYEML | 64.57 | HLA-B*3901 | SFYAELKW | 209.57 | HLA-B*5801 | MGAVNSSM | 423.71 | HLA-B*1501 |
| YLEEHPNA | 64.88 | HLA-A*0201 | IVKGRSHL | 209.66 | HLA-B*0801 | APDRVSFF | 424.01 | HLA-B*0702 |
| SIQPTFSV | 64.97 | HLA-A*0201 | LIAPEFGY | 209.67 | HLA-B*1501 | IHYGGVPT | 424.01 | HLA-B*3901 |
| SEKVDTLL | 65.12 | HLA-B*4001 | SFYRNVVW | 209.75 | HLA-A*2402 | RREVHIYY | 424.1 | HLA-B*2705 |
| YVKQGSLM | 65.16 | HLA-A*2601 | MTIGSVSL | 209.84 | HLA-B*1501 | RLGRGYMF | 424.19 | HLA-B*1501 |
| SSTYHNSF | 65.17 | HLA-B*1501 | QSSPPTVY | 209.85 | HLA-B*1501 | LLNPFVSH | 424.27 | HLA-B*1501 |
| STGGQSFY | 65.22 | HLA-A*0101 | TITSPLPF | 210.21 | HLA-B*1501 | DRSPHRTL | 424.39 | HLA-B*3901 |
| SSFYSEMK | 65.28 | HLA-A*0301 | PMRTPIAF | 210.24 | HLA-B*1501 | ITIDSVSL | 424.41 | HLA-B*1501 |
| GYICSGFF | 65.41 | HLA-A*2402 | KLCYPGEV | 210.39 | HLA-A*0201 | WSYNADLL | 424.45 | HLA-B*3901 |
| TFLARSAL | 65.42 | HLA-B*0801 | FRNMVWLV | 210.49 | HLA-B*3901 | RSLIRFPV | 424.47 | HLA-B*0801 |
| MMIWHSNL | 65.52 | HLA-B*0801 | AMDHTSQY | 210.98 | HLA-B*1501 | WMCSNGSL | 424.61 | HLA-B*3901 |
| YNKVRLQL | 65.53 | HLA-B*0801 | RIFQSPIR | 211.03 | HLA-A*0301 | SERGEETI | 424.91 | HLA-B*4001 |
| APSRVTKL | 65.55 | HLA-B*0702 | GQSGRIDF | 211.13 | HLA-B*1501 | FQRSKFLL | 425.14 | HLA-B*1501 |
| WMKLYWHL | 65.74 | HLA-B*0801 | KLRSGFEM | 211.62 | HLA-B*0702 | ASMRRDYF | 425.32 | HLA-B*1501 |
| MLNPNDTI | 65.8 | HLA-A*0201 | KIAHISPL | 211.76 | HLA-B*1501 | GLVAPSRV | 425.55 | HLA-A*0201 |
| ALAQGALL | 65.93 | HLA-A*0201 | FGDSAEEY | 211.86 | HLA-A*0101 | YNTELLVL | 425.65 | HLA-B*3901 |
| ESVRNGTY | 65.95 | HLA-A*2601 | AMRTVGTH | 212.16 | HLA-B*1501 | NTWVNQTF | 425.68 | HLA-B*5801 |
| RPRVNGQS | 66 | HLA-B*0702 | RSGYSGVF | 212.2 | HLA-B*5801 | WEMGQAPS | 425.92 | HLA-B*4001 |
| RLGSSFYA | 66.03 | HLA-A*0201 | DRSPFRAL | 212.23 | HLA-B*3901 | FPMGTAPV | 425.93 | HLA-A*0201 |
| RLLQNSQV | 66.04 | HLA-A*0201 | MACHSAAF | 212.61 | HLA-B*5801 | GYVCSGIF | 426.16 | HLA-A*2402 |
| IESNGNLI | 66.04 | HLA-B*4001 | YLIRTLTL | 212.74 | HLA-B*0801 | ELIRGRPI | 426.2 | HLA-B*0801 |
| SQYLCTGV | 66.06 | HLA-A*0201 | RMNYHWTL | 212.95 | HLA-B*0801 | YDKVRLQL | 426.32 | HLA-B*0801 |
| RECFNPCF | 66.09 | HLA-B*4001 | RLRMATGL | 212.95 | HLA-B*1501 | LSGREWSY | 426.55 | HLA-B*5801 |
| GTCWEQLY | 66.12 | HLA-A*0101 | NLYEKVRL | 213.26 | HLA-A*0201 | LRMKWMMA | 426.56 | HLA-B*2705 |
| RMNYHWTL | 66.16 | HLA-B*1501 | GTYNYPQY | 213.44 | HLA-A*0301 | DVCYPGRF | 426.7 | HLA-A*2601 |
| FESTGNLI | 66.34 | HLA-B*4001 | VLLVSLGA | 213.45 | HLA-A*0201 | NEEGDIIF | 427 | HLA-B*4001 |
| SYRCMFCI | 66.39 | HLA-A*2402 | YVNIKSLK | 213.53 | HLA-A*0301 | VQNDYTTV | 427.35 | HLA-B*1501 |
| KSHGRVLK | 66.5 | HLA-A*0301 | TEIYNETV | 213.54 | HLA-B*4001 | ETKCQSPL | 427.56 | HLA-A*2601 |
| RLNNVIDK | 66.79 | HLA-A*0301 | YDRVRLQL | 213.69 | HLA-B*0801 | IQIDAVKL | 427.61 | HLA-B*1501 |
| LLFLEVPA | 66.81 | HLA-A*0201 | KLFERVRH | 213.77 | HLA-A*0301 | TLASTNAY | 427.79 | HLA-A*2601 |
| VQNNYTTV | 66.82 | HLA-A*0201 | LSYSVGYL | 213.85 | HLA-B*5801 | ITSKVNSI | 427.81 | HLA-B*5801 |
| AVVMGLVF | 66.85 | HLA-B*1501 | SICTHLEV | 214.02 | HLA-A*0201 | IAILATTI | 427.86 | HLA-B*5801 |
| SISSRSGF | 67.06 | HLA-B*1501 | ITYSSSMM | 214.06 | HLA-B*5801 | RLYLWGVH | 428.43 | HLA-A*0301 |
| KLIDNEFT | 67.08 | HLA-A*0201 | FLMQIAVL | 214.24 | HLA-B*3901 | IHYGGMPT | 428.44 | HLA-B*3901 |
| LVAPRGYF | 67.09 | HLA-B*1501 | MEFSWILL | 214.28 | HLA-B*3901 | AIDNMQNK | 428.48 | HLA-A*0301 |
| YMNVKSLK | 67.2 | HLA-A*0301 | IITHFQRK | 214.35 | HLA-A*0301 | GRYSKADK | 428.98 | HLA-B*2705 |
| IPSNSLKL | 67.22 | HLA-B*0702 | TYNAELLI | 214.82 | HLA-A*2402 | TINSWHIY | 429.02 | HLA-B*1501 |
| ILWFSLGA | 67.25 | HLA-A*0201 | NIIFLWGI | 214.89 | HLA-A*0201 | VRSEKLVL | 429.03 | HLA-B*3901 |

Fig. 78-17

| Peptide | Affinity (nM) | Allele | Peptide | Affinity (nM) | Allele | Peptide | Affinity (nM) | Allele |
|---|---|---|---|---|---|---|---|---|
| LLENNVPV | 67.3 | HLA-A*0201 | ILNLLIGI | 215.02 | HLA-A*0201 | LSMVRSDK | 429.28 | HLA-A*0301 |
| EVRRRLSA | 67.3 | HLA-B*0801 | KVDTLTEK | 215.14 | HLA-A*0301 | RTWAKNIL | 429.5 | HLA-B*5801 |
| FEANGNLI | 67.3 | HLA-B*4001 | KYVKSERL | 215.35 | HLA-A*2402 | RSGYEVLK | 429.86 | HLA-A*0301 |
| TIHDRTAF | 67.39 | HLA-B*1501 | RISIYWTL | 215.38 | HLA-A*0201 | LTQGRQTY | 430.06 | HLA-A*0101 |
| MRTFSFQL | 67.51 | HLA-B*3901 | VENRINML | 215.59 | HLA-B*4001 | RRLSTNAM | 430.18 | HLA-B*3901 |
| NTYDHSTY | 67.59 | HLA-B*1501 | LARSALIL | 216.22 | HLA-B*0702 | DIIFLWGI | 430.21 | HLA-A*2601 |
| MSLNISLY | 67.79 | HLA-B*5801 | LSFQVDCF | 216.34 | HLA-B*1501 | RMITQRTI | 430.23 | HLA-B*1501 |
| RYIPSGSL | 67.83 | HLA-A*2402 | SSFERFEM | 216.56 | HLA-B*1501 | FHFEECSC | 430.38 | HLA-B*3901 |
| RLRGIPPL | 67.85 | HLA-B*0702 | SIGVTVIK | 216.6 | HLA-A*0301 | GTSKIKMK | 430.55 | HLA-A*0301 |
| SADHRVYW | 68 | HLA-B*5801 | KLEENTTY | 216.66 | HLA-B*1501 | WINSPNHV | 430.66 | HLA-A*0201 |
| GMMDGWYG | 68.03 | HLA-A*0201 | TTHDRTAF | 217.45 | HLA-A*2601 | RSWRRQIL | 430.89 | HLA-B*0801 |
| QESECQCL | 68.04 | HLA-B*4001 | RHENRMVL | 217.48 | HLA-B*3901 | MIVELAEK | 431.01 | HLA-A*0301 |
| RLFDYSGW | 68.16 | HLA-B*5801 | TAVAVLKY | 217.55 | HLA-B*5801 | IENGWEGM | 431.06 | HLA-B*4001 |
| TIIYSSSM | 68.19 | HLA-A*2601 | FSFGASCV | 217.59 | HLA-A*0201 | SFYRSMRW | 431.2 | HLA-B*5801 |
| KIYWHLMH | 68.26 | HLA-A*0301 | TEQVDTIM | 217.72 | HLA-B*4001 | NVYKILSI | 431.29 | HLA-A*0201 |
| YQNNFVPV | 68.31 | HLA-B*1501 | GYFGIFFV | 217.74 | HLA-A*2402 | AMISRARI | 431.71 | HLA-A*0201 |
| KIIAIGSV | 68.32 | HLA-A*0201 | TSYRTLLM | 217.87 | HLA-B*5801 | FYRSMRWL | 431.78 | HLA-A*2402 |
| FFRRLNWL | 68.33 | HLA-B*0801 | RIFQSGVR | 217.93 | HLA-A*0301 | DINLMPIY | 432.04 | HLA-A*2601 |
| RRQKRGLF | 68.34 | HLA-B*2705 | MMAMKYPI | 217.95 | HLA-B*1501 | ASTGGQAF | 432.14 | HLA-B*1501 |
| VLNLLIGV | 68.43 | HLA-A*0201 | LMIIGGFI | 218.01 | HLA-A*0201 | KIEGWVVV | 432.16 | HLA-A*0201 |
| VVYAELLV | 68.57 | HLA-A*0201 | DVYQILAI | 218.1 | HLA-A*2601 | RALVRSGM | 432.25 | HLA-B*0702 |
| RTLDFHDF | 68.59 | HLA-B*5801 | AVIYGNPK | 218.16 | HLA-A*0301 | GTSKVKMK | 432.5 | HLA-A*0301 |
| TANSIIVF | 68.72 | HLA-B*5801 | VLSIYSCI | 218.22 | HLA-A*0201 | SSSYRRPV | 432.68 | HLA-B*0801 |
| VLVNTYQW | 68.8 | HLA-B*5801 | SMQCRVCI | 218.51 | HLA-B*0801 | CHDGVGRM | 433.27 | HLA-B*3901 |
| EIITIGSI | 68.87 | HLA-A*2601 | SFFRNMVW | 218.56 | HLA-A*2402 | NVPEWSYI | 433.37 | HLA-A*0201 |
| SRYSGFVR | 68.89 | HLA-B*2705 | SLRLALGL | 218.64 | HLA-B*0801 | EEGDIIFL | 434.24 | HLA-B*4001 |
| IENGWQGL | 68.9 | HLA-B*4001 | AICTHMEV | 218.76 | HLA-A*0201 | THFEKIKI | 434.53 | HLA-B*3901 |
| SERVDTLL | 68.92 | HLA-B*4001 | FGASSFVL | 218.81 | HLA-B*3901 | WESLTGTA | 434.64 | HLA-B*4001 |
| RLNINPVK | 68.97 | HLA-A*0301 | GLVYGNPA | 218.93 | HLA-A*0201 | GLRNTPSV | 434.7 | HLA-A*0201 |
| YQNNFVPV | 69.04 | HLA-B*3901 | LHIPEAGL | 219.02 | HLA-B*3901 | VLHLILWI | 434.8 | HLA-A*0201 |
| DSIRNGTY | 69.09 | HLA-A*2601 | ATTITLHF | 219.06 | HLA-B*5801 | FTKWNVTY | 435.07 | HLA-A*0101 |
| RLIEKTNK | 69.13 | HLA-A*0301 | KLEENSTY | 219.44 | HLA-B*1501 | FRYGNGVW | 435.2 | HLA-B*2705 |
| KRLGNLNK | 69.17 | HLA-B*2705 | LIAPWYGY | 219.5 | HLA-B*1501 | VLGIINLL | 435.48 | HLA-A*0201 |
| FHLGTRQV | 69.22 | HLA-B*3901 | VTSSGTSK | 219.78 | HLA-A*0301 | HSRYREEA | 435.56 | HLA-B*0801 |
| AYTKIMYF | 69.28 | HLA-A*2402 | VLFQGGHI | 219.94 | HLA-A*0201 | GTYDYPRY | 435.7 | HLA-B*1501 |
| LLAPRYGY | 69.39 | HLA-B*1501 | KENTGSYV | 219.98 | HLA-B*4001 | SLQCKICI | 435.73 | HLA-A*0201 |
| RSGYSGSF | 69.41 | HLA-B*1501 | YKKLKREM | 220.47 | HLA-B*0801 | KLCRLSGI | 435.99 | HLA-A*0201 |
| LTVPEWSY | 69.46 | HLA-B*5801 | QESECICI | 220.56 | HLA-B*4001 | KIITIGSI | 436.08 | HLA-A*0201 |
| CYQRSKFL | 69.53 | HLA-A*2402 | YNAELLVL | 220.62 | HLA-B*3901 | ELCPSPLK | 436.13 | HLA-A*0301 |
| ESIRDNTY | 69.56 | HLA-A*2601 | ISVGSSTY | 220.92 | HLA-B*5801 | HMAIIKKY | 436.26 | HLA-B*1501 |
| MQFSSLTV | 69.57 | HLA-B*3901 | FEEMRWLI | 221.1 | HLA-B*4001 | SMRRNYFT | 436.31 | HLA-B*0801 |
| FVYFVEAL | 69.64 | HLA-A*0201 | MMDGWYGF | 221.21 | HLA-A*0201 | NTYDHSQY | 436.57 | HLA-A*0101 |
| KRMENGFL | 69.92 | HLA-B*2705 | YRNLVWIV | 221.21 | HLA-B*3901 | LAALIMGF | 436.63 | HLA-B*5801 |
| RIRDNMTK | 69.93 | HLA-A*0301 | CHDGVSRM | 221.34 | HLA-B*3901 | SFYGELKW | 436.69 | HLA-B*5801 |
| NFMPYISF | 70.11 | HLA-A*2402 | RIENLNRK | 221.42 | HLA-A*0301 | TSNRGSFY | 436.73 | HLA-B*5801 |
| RRLSANAV | 70.24 | HLA-B*2705 | SSVSSFEK | 221.64 | HLA-A*0301 | SNDTINYY | 437.08 | HLA-A*0101 |
| KMNTQFEA | 70.34 | HLA-A*0201 | FPRTTNTY | 221.73 | HLA-B*0702 | ISLCSIWF | 437.17 | HLA-B*1501 |
| ISNQGSFY | 70.38 | HLA-A*0101 | KIVHISPL | 221.82 | HLA-B*1501 | LQALQLLL | 437.44 | HLA-B*3901 |
| KVNSVVEK | 70.47 | HLA-A*0301 | MTNVQNNY | 222.14 | HLA-B*5801 | APRYAFEL | 437.64 | HLA-B*0801 |
| CHDGTNWL | 70.53 | HLA-B*3901 | GLILAFIL | 222.2 | HLA-A*0201 | ITVWSSKY | 437.92 | HLA-A*0101 |
| FVIREPFI | 70.71 | HLA-A*0201 | SSNYHQSF | 222.22 | HLA-B*5801 | RAVKLYKK | 437.93 | HLA-A*0301 |
| MISKSRTK | 70.76 | HLA-A*0301 | VLDDCSLK | 222.28 | HLA-A*0301 | NINFMPYI | 437.98 | HLA-A*0201 |
| AMEHTSQY | 71.07 | HLA-B*1501 | TFDLGGLY | 222.94 | HLA-A*0101 | RALISWPL | 438.14 | HLA-B*5801 |
| IENGWEGL | 71.21 | HLA-B*4001 | PFQGFFPF | 223.01 | HLA-A*2402 | ALGYSTGA | 438.18 | HLA-A*0201 |
| VMVGLILA | 71.34 | HLA-A*0201 | KYVKSEKL | 223.02 | HLA-A*2402 | KTFQNIER | 438.25 | HLA-A*0301 |
| YEELREHL | 71.43 | HLA-B*4001 | ILSIYSTA | 223.15 | HLA-A*0201 | SQYLCTGI | 438.77 | HLA-B*1501 |
| ILTIYSTV | 71.45 | HLA-A*0201 | YMDIDVYC | 223.19 | HLA-A*0201 | YQSLRSIL | 439.34 | HLA-B*1501 |
| DVNPTLLF | 71.55 | HLA-A*2601 | IVVTREPY | 223.36 | HLA-B*1501 | ASTGAQSF | 439.49 | HLA-B*1501 |
| GIFSVEHK | 71.73 | HLA-A*0301 | IGIGNLAF | 223.51 | HLA-B*1501 | ILEDEQMY | 439.7 | HLA-A*0101 |
| WMKIYWHL | 71.86 | HLA-B*0801 | RRYGPALS | 223.52 | HLA-B*2705 | MTNVQNNY | 439.72 | HLA-A*2601 |
| TSSSSTVF | 71.89 | HLA-B*1501 | FGASCFVL | 223.58 | HLA-B*3901 | WMKIYWSL | 439.99 | HLA-B*3901 |
| NPRPNDPV | 71.92 | HLA-B*0702 | LLAPRYAF | 223.69 | HLA-B*0801 | AINSSMPL | 440.9 | HLA-B*1501 |
| FIAEQFTW | 72.12 | HLA-B*5801 | SMQCRICI | 223.69 | HLA-B*0801 | NRFQIQGI | 440.95 | HLA-B*2705 |
| KLTVTHSV | 72.23 | HLA-A*0201 | RHNGTCAV | 223.76 | HLA-B*3901 | TREGKHIV | 441.12 | HLA-B*3901 |
| SEGAYKIL | 72.27 | HLA-B*4001 | IMIAGLFF | 223.98 | HLA-B*5801 | FESIESEF | 441.15 | HLA-B*4001 |

Fig. 78-18

| Peptide | Affinity (nM) | Allele | Peptide | Affinity (nM) | Allele | Peptide | Affinity (nM) | Allele |
|---|---|---|---|---|---|---|---|---|
| VLSIIALL | 72.59 | HLA-A*0201 | VLIVSLGA | 224.06 | HLA-A*0201 | ISKTNQQF | 441.41 | HLA-B*1501 |
| FESTGNFI | 72.62 | HLA-B*4001 | FQVDCFLW | 224.15 | HLA-B*5801 | NTYDHSTY | 441.5 | HLA-A*0101 |
| AYTKILYF | 72.68 | HLA-A*2402 | VMNTSKPL | 224.25 | HLA-B*1501 | VETLARSI | 441.51 | HLA-B*4001 |
| ILANNGRF | 72.69 | HLA-B*1501 | FQKDAKVL | 224.26 | HLA-B*3901 | QIQTRRAF | 441.77 | HLA-B*0801 |
| VSFSISCF | 72.84 | HLA-B*1501 | RIFQSRIR | 224.28 | HLA-A*0301 | QLRMATGL | 442.61 | HLA-B*0801 |
| ALNEITTK | 72.91 | HLA-A*0301 | GEVPGWSW | 224.4 | HLA-B*4001 | GLGIQSGV | 442.69 | HLA-A*0201 |
| FVYFVETL | 72.95 | HLA-A*0201 | SPGMMMGM | 224.46 | HLA-B*0702 | SMQCRICI | 442.72 | HLA-A*0201 |
| SGSFVDYW | 73.02 | HLA-B*5801 | NLRCQICI | 224.61 | HLA-B*0801 | HKWEKYCI | 442.76 | HLA-B*3901 |
| RGFAPFSK | 73.06 | HLA-A*0301 | SIIDKMNI | 224.73 | HLA-A*0201 | CSFTGWIL | 442.85 | HLA-B*3901 |
| CHSGICPV | 73.11 | HLA-B*3901 | MKIYWHLM | 224.82 | HLA-B*3901 | GSIRNETY | 443.53 | HLA-B*1501 |
| WMGRTISM | 73.11 | HLA-B*1501 | LSVVSLLI | 225.15 | HLA-B*5801 | VMLLAIAM | 443.66 | HLA-A*0201 |
| FPIGTAPI | 73.18 | HLA-B*0702 | VMLLAIAM | 225.18 | HLA-B*1501 | CHDGKARM | 443.68 | HLA-B*3901 |
| KYIKSGQL | 73.22 | HLA-A*2402 | CSIAGWLL | 225.19 | HLA-B*5801 | NSIRNGTY | 443.92 | HLA-A*2601 |
| FQIQGVKL | 73.22 | HLA-B*3901 | KIMKIRPI | 225.29 | HLA-A*0201 | CFILLAVI | 443.96 | HLA-A*2402 |
| SSKYQQAF | 73.24 | HLA-B*1501 | SRYREEAM | 225.29 | HLA-B*3901 | RGVKGFGF | 444.04 | HLA-B*1501 |
| KVNSVIEK | 73.33 | HLA-A*0301 | QIKIRRRV | 225.42 | HLA-B*0801 | ITTHFQRK | 444.27 | HLA-A*0301 |
| SSLPLCPF | 73.39 | HLA-B*1501 | LELRDCSI | 225.61 | HLA-B*4001 | GIDKVCTK | 444.27 | HLA-A*0301 |
| FEATGNLI | 73.43 | HLA-B*4001 | SIQSDKPF | 225.67 | HLA-B*1501 | ITYNNTVI | 444.5 | HLA-B*5801 |
| SADHRIYW | 73.45 | HLA-B*5801 | KLRMATGL | 225.71 | HLA-B*0702 | SLVLAALI | 444.78 | HLA-A*0201 |
| CHDGASWL | 73.49 | HLA-B*3901 | KIRKGKIM | 225.8 | HLA-B*0702 | GIFESSCL | 444.81 | HLA-A*0201 |
| GLFENSCL | 73.5 | HLA-A*0201 | LIAPEYGY | 226.14 | HLA-B*1501 | AQSFYRSI | 444.98 | HLA-B*1501 |
| GIFSVENK | 73.52 | HLA-A*0301 | RPQMNGQS | 226.17 | HLA-B*0702 | YRVGYLCA | 445.27 | HLA-B*2705 |
| KGFAPFSK | 73.59 | HLA-A*0301 | TRLPFQNL | 226.22 | HLA-B*3901 | ILAATVTL | 445.58 | HLA-B*1501 |
| RALVSWEM | 73.59 | HLA-B*5801 | DANANNLY | 226.43 | HLA-A*2601 | RTSHRTLL | 445.63 | HLA-B*0702 |
| LLKERGFF | 73.78 | HLA-B*1501 | RYVCTGIL | 226.68 | HLA-A*2402 | SLILAAII | 445.67 | HLA-A*0201 |
| YEELREQL | 73.81 | HLA-B*4001 | YEELKHLI | 226.69 | HLA-B*4001 | RATEYMMK | 445.88 | HLA-A*0301 |
| WRSGFEII | 73.82 | HLA-B*3901 | IPSWAGNV | 226.75 | HLA-B*0702 | YIKSDQLK | 445.89 | HLA-A*0301 |
| SMSDIEAM | 73.9 | HLA-A*0201 | ARLGKGYM | 226.77 | HLA-B*2705 | FEANGNLI | 446.44 | HLA-B*3901 |
| SGAFVDYW | 74.01 | HLA-B*5801 | SFYRNLVW | 226.88 | HLA-A*2402 | NGKAPISL | 446.78 | HLA-B*0801 |
| VILLNPFV | 74.22 | HLA-A*0201 | SFYKNLIW | 227.05 | HLA-A*2402 | ISIGTSTL | 446.82 | HLA-B*1501 |
| KITGFAPF | 74.22 | HLA-B*1501 | LLLLQANL | 227.13 | HLA-A*0201 | VLEKNVTV | 446.86 | HLA-A*0201 |
| NPRVFLAM | 74.28 | HLA-B*0801 | YRNVVWLI | 227.19 | HLA-B*2705 | WFGYFGIF | 446.96 | HLA-A*2402 |
| KYIPSGSL | 74.3 | HLA-A*2402 | NYQSLRSI | 227.32 | HLA-A*2402 | VSSSGTSK | 447.13 | HLA-A*0301 |
| KMKAIIVV | 74.54 | HLA-A*0201 | VTVWSSKY | 227.39 | HLA-B*5801 | IMIDGSAS | 447.69 | HLA-B*1501 |
| QIAGFAPF | 74.58 | HLA-B*1501 | VIVDNSNW | 227.42 | HLA-B*5801 | LTHHMRKK | 448.27 | HLA-A*0301 |
| ALLLAFML | 74.76 | HLA-A*0201 | YVNVKSLK | 227.43 | HLA-A*0301 | TRDSITEV | 448.48 | HLA-B*3901 |
| TQYRAESL | 74.89 | HLA-B*3901 | LLIGISNM | 227.49 | HLA-A*0201 | SKVYKTYF | 448.53 | HLA-B*1501 |
| RINMLADW | 74.93 | HLA-B*5801 | SSMPFHNV | 227.56 | HLA-A*0201 | ITNKINSI | 448.69 | HLA-B*5801 |
| TTHSWTPK | 74.97 | HLA-A*0301 | SRYVCSGL | 227.81 | HLA-B*3901 | RVLRENAV | 448.99 | HLA-A*0201 |
| ILFVKEGK | 74.97 | HLA-A*0301 | AIMIAGLF | 227.86 | HLA-B*1501 | STQPTFSV | 449.26 | HLA-A*0201 |
| GESHGRTI | 75.02 | HLA-B*4001 | FAISCLLL | 227.91 | HLA-A*0201 | LLASTNAH | 449.54 | HLA-B*1501 |
| TPLGSPPM | 75.03 | HLA-B*0702 | LMSPGERI | 227.93 | HLA-A*0201 | WSYNAKLL | 449.55 | HLA-B*3901 |
| RRIDFNWL | 75.07 | HLA-B*2705 | NRIQIDPV | 228.09 | HLA-B*3901 | NRLSINPV | 450.06 | HLA-B*2705 |
| ALAQGVLL | 75.14 | HLA-A*0201 | NLRCTICI | 228.27 | HLA-B*0801 | VTYQILSI | 450.29 | HLA-B*5801 |
| ILGFVFTL | 75.23 | HLA-A*0201 | RIGEDAHV | 228.31 | HLA-A*0201 | STDTVNTL | 450.3 | HLA-A*0101 |
| LSIAPIMF | 75.4 | HLA-B*1501 | PELCPSPL | 228.38 | HLA-B*4001 | CSNDTINY | 450.46 | HLA-B*1501 |
| SVRNGTYK | 75.43 | HLA-A*0301 | GEPGVKGF | 228.52 | HLA-B*4001 | YQSIRSIL | 451 | HLA-B*0801 |
| FIAPEYAY | 75.65 | HLA-A*2601 | GQRGRIDY | 228.62 | HLA-B*1501 | IQMCTELK | 451.3 | HLA-A*0301 |
| SVFNCLYA | 75.66 | HLA-A*0201 | CQMEKIVL | 228.76 | HLA-A*0201 | KTNLYGFI | 451.55 | HLA-B*5801 |
| CINRCFYV | 75.68 | HLA-A*0201 | IPIGERGL | 228.8 | HLA-B*0702 | NTKCQTSL | 451.66 | HLA-B*0801 |
| TLVSTSSW | 75.69 | HLA-B*5801 | SIQSRGLF | 228.94 | HLA-B*1501 | IMIWHSNL | 451.76 | HLA-B*3901 |
| IMKIRPIL | 75.75 | HLA-B*0801 | ALILVALA | 229.01 | HLA-A*0201 | KIMKIRPI | 451.81 | HLA-B*0801 |
| YESTQAAI | 75.81 | HLA-B*4001 | EPYVSCSL | 229.2 | HLA-B*0702 | KSTKSTVL | 451.83 | HLA-B*5801 |
| IESEFSEI | 76.08 | HLA-B*4001 | KILKWESL | 229.4 | HLA-A*0201 | KMITQRTI | 452.36 | HLA-B*1501 |
| TSLTSLPF | 76.19 | HLA-B*1501 | NMDRAVKL | 229.45 | HLA-B*3901 | AQYREEAL | 452.37 | HLA-B*3901 |
| LLLVVQAL | 76.3 | HLA-A*0201 | LIAGWYGF | 229.63 | HLA-B*1501 | TEVYNETV | 452.8 | HLA-B*4001 |
| RPVIKIDM | 76.31 | HLA-B*0702 | KLYWHLMS | 229.65 | HLA-A*0201 | NAYKIVKK | 452.81 | HLA-A*0301 |
| KTFQNIDK | 76.35 | HLA-A*0301 | LLLAFVLW | 229.91 | HLA-B*5801 | RQMVHAMR | 452.84 | HLA-B*2705 |
| KLYRKLKR | 76.57 | HLA-A*0301 | GLRNVPSV | 229.93 | HLA-A*0201 | SMQCKICI | 452.85 | HLA-A*0201 |
| SINECRTF | 76.86 | HLA-B*1501 | FVFVALIL | 230.05 | HLA-A*0201 | KILSIYST | 452.96 | HLA-A*0201 |
| GESHCRII | 76.87 | HLA-B*4001 | CHDGKFRM | 230.21 | HLA-B*3901 | SSFVLLAV | 453.06 | HLA-A*0201 |
| TKRIRLAI | 76.92 | HLA-B*0801 | QESECVCM | 230.24 | HLA-B*4001 | GQKGRIDY | 453.13 | HLA-B*1501 |
| ASSGSLEF | 76.97 | HLA-B*5801 | ILSKDNAI | 230.37 | HLA-A*0201 | FTSFFYRY | 453.19 | HLA-B*1501 |
| LIHQSETY | 77.03 | HLA-B*1501 | SVKNGTYY | 230.4 | HLA-A*2601 | ATAVAVIK | 453.46 | HLA-A*0301 |
| NTYNHTEY | 77.14 | HLA-B*1501 | ARQMVHAM | 230.4 | HLA-B*2705 | LIRGNSPV | 453.59 | HLA-B*0702 |

Fig. 78-19

| Peptide | Affinity (nM) | Allele | Peptide | Affinity (nM) | Allele | Peptide | Affinity (nM) | Allele |
|---|---|---|---|---|---|---|---|---|
| YNKVRMQL | 77.19 | HLA-B*0801 | NGMNRPVL | 230.66 | HLA-B*0801 | RRVLKENA | 453.71 | HLA-B*2705 |
| AMASQGTK | 77.22 | HLA-A*0301 | VTVWSSKY | 230.98 | HLA-A*0301 | LVGIDPFK | 453.77 | HLA-A*0301 |
| SQRGRIDY | 77.37 | HLA-B*1501 | SQKQEFKM | 231.02 | HLA-B*1501 | FQIQGIKL | 454.45 | HLA-B*1501 |
| ILSVVSLL | 77.43 | HLA-A*0201 | FRHMVWLI | 231.08 | HLA-B*2705 | RRRLSANA | 454.69 | HLA-B*2705 |
| MMIWHSNL | 77.54 | HLA-B*3901 | RALVSWPL | 231.28 | HLA-B*5801 | HEGEGIPL | 454.75 | HLA-B*3901 |
| MSGYSGIF | 77.75 | HLA-B*1501 | FSDYEELK | 231.3 | HLA-A*0101 | SQLEGFSA | 454.96 | HLA-B*1501 |
| EVKRRLSA | 77.77 | HLA-B*0801 | SMDSRSGY | 231.94 | HLA-B*1501 | SLNGVSPI | 455.08 | HLA-B*1501 |
| LIAPRGHY | 77.77 | HLA-B*1501 | LLMIIGGF | 231.95 | HLA-B*1501 | HKWEKYCV | 455.15 | HLA-B*3901 |
| FEFIAEEF | 77.85 | HLA-B*4001 | MRWLTLKS | 231.98 | HLA-B*2705 | FTAVGKEF | 455.47 | HLA-B*1501 |
| GESHGRII | 77.91 | HLA-B*4001 | ILHKCDNK | 232.1 | HLA-A*0301 | RLVLATGL | 455.67 | HLA-A*0201 |
| RLSINPVK | 77.97 | HLA-A*0301 | GYSGSFSI | 232.13 | HLA-A*2402 | KIVHIGPL | 455.93 | HLA-A*0201 |
| SVKNGTYK | 78.01 | HLA-A*0301 | CSIWFSHY | 232.35 | HLA-A*2601 | FYRNMRWL | 456.03 | HLA-A*2402 |
| ASNSIVTF | 78.22 | HLA-B*1501 | ILASSGSL | 232.44 | HLA-B*1501 | FALSGVAI | 456.04 | HLA-B*3901 |
| LLQSLQQI | 78.31 | HLA-A*0201 | RSGYSGIF | 232.46 | HLA-B*1501 | RSRNGFEM | 456.3 | HLA-B*5801 |
| STGGQAFY | 78.45 | HLA-A*0101 | KECFNPCF | 232.48 | HLA-B*4001 | SLFEKFFP | 456.4 | HLA-A*0201 |
| GQGDIVLV | 78.53 | HLA-A*0201 | QESECVCI | 232.53 | HLA-B*4001 | LLFLKIPV | 456.77 | HLA-B*0801 |
| LRDNAMIL | 78.68 | HLA-B*3901 | KPWARNIL | 232.86 | HLA-B*0801 | KRMEDGFI | 456.79 | HLA-B*2705 |
| VLGLSMVK | 78.77 | HLA-A*0301 | LIAFVLWA | 233.12 | HLA-A*0201 | KLRMVTGL | 456.91 | HLA-B*1501 |
| RSGFEVLF | 78.89 | HLA-B*5801 | GTYNHREY | 233.25 | HLA-B*1501 | SRSLKLAI | 457.06 | HLA-B*2705 |
| AQRLEDVF | 79.03 | HLA-B*1501 | RYPGVRCI | 233.31 | HLA-A*2402 | VSSLVLAI | 457.15 | HLA-B*5801 |
| TKRIRMAI | 79.19 | HLA-B*0801 | ERFEMFPR | 233.32 | HLA-B*2705 | IVLVMKRK | 457.39 | HLA-A*0301 |
| ISLGDCSF | 79.28 | HLA-B*5801 | TIYWWDGL | 233.43 | HLA-A*0201 | STDKVDTI | 457.41 | HLA-A*0101 |
| LSSPPTVY | 79.37 | HLA-B*1501 | YAFGTCPK | 233.57 | HLA-A*0301 | TQYRAESL | 457.49 | HLA-B*1501 |
| RMNYYWTL | 79.54 | HLA-B*1501 | THLEICFM | 233.68 | HLA-B*3901 | GRILKNNL | 457.64 | HLA-B*2705 |
| KYVNIKSL | 79.65 | HLA-A*2402 | FMDYWAEG | 233.7 | HLA-A*0201 | GMGMAADK | 457.7 | HLA-A*0301 |
| KYVNVRSL | 79.99 | HLA-A*2402 | MMGMFNML | 234.02 | HLA-B*0801 | IAPNRASF | 457.72 | HLA-B*1501 |
| IMRTVIAL | 79.99 | HLA-B*1501 | LKITENSF | 234.08 | HLA-B*1501 | SIAHKSCL | 457.87 | HLA-B*0801 |
| YQILAIYA | 80.15 | HLA-A*0201 | YQAKFESV | 234.15 | HLA-B*3901 | SFYTELKW | 457.88 | HLA-B*5801 |
| TKRLRMAI | 80.19 | HLA-B*0801 | PADTRIYY | 234.32 | HLA-A*0101 | LTQGRQTF | 458 | HLA-B*1501 |
| SPSECRTF | 80.35 | HLA-B*0702 | QVTGFAPF | 234.41 | HLA-A*2601 | ILRGSIAH | 458.16 | HLA-B*1501 |
| DIILWISF | 80.37 | HLA-A*2601 | YEKVRMQL | 234.41 | HLA-B*4001 | KVDNIVDK | 458.28 | HLA-A*0301 |
| CHDGNAWL | 80.6 | HLA-B*3901 | QAYTKVLY | 234.48 | HLA-B*1501 | LTIGKCPK | 458.49 | HLA-A*0301 |
| VSFHLGTK | 80.67 | HLA-A*0301 | GVQMQRFK | 234.5 | HLA-A*0301 | YAQTDCVL | 458.97 | HLA-B*3901 |
| KTNTQFEL | 80.69 | HLA-B*5801 | HSNNSTEK | 234.54 | HLA-A*0301 | SSSMMWEI | 459.04 | HLA-B*5801 |
| LRMARGLR | 80.7 | HLA-B*2705 | RYSRADKI | 234.59 | HLA-A*2402 | YIVERPTA | 459.68 | HLA-A*0201 |
| YQARFEAV | 80.7 | HLA-B*3901 | SRYREEAM | 234.65 | HLA-B*2705 | NECRFYAL | 459.88 | HLA-B*3901 |
| FYRSINWL | 80.76 | HLA-A*2402 | YDRVRMQL | 234.7 | HLA-B*0801 | TEMWSYNA | 460.55 | HLA-B*4001 |
| LLKERGFF | 80.82 | HLA-B*0801 | YRYGFVAN | 234.77 | HLA-B*2705 | RQTFDWTL | 460.59 | HLA-A*0201 |
| LRMATGLR | 80.88 | HLA-B*2705 | YRKLKREI | 235.03 | HLA-B*0801 | FAAICTHL | 460.86 | HLA-A*0201 |
| KVNSIIEK | 80.95 | HLA-A*0301 | MRINNETI | 235.08 | HLA-B*2705 | IEHQIGNV | 461.34 | HLA-B*4001 |
| LLLATGMK | 81.01 | HLA-A*0301 | MACNSAAF | 235.15 | HLA-B*5801 | MGAINSSM | 461.5 | HLA-B*1501 |
| ILFIKEGK | 81.03 | HLA-A*0301 | IMVAGLSF | 235.18 | HLA-B*5801 | RPFVRGQQ | 461.98 | HLA-B*0702 |
| NTDLEVLM | 81.05 | HLA-A*0101 | ILSICSCI | 235.24 | HLA-A*0201 | GINDRNFW | 462.08 | HLA-B*5801 |
| RVARCNTK | 81.05 | HLA-A*0301 | TINSWHIF | 235.41 | HLA-B*1501 | MMGMFNML | 462.18 | HLA-B*3901 |
| LSSPPTVY | 81.08 | HLA-B*5801 | SIDRFLRV | 235.48 | HLA-A*0201 | ALLAPRYA | 462.25 | HLA-A*0201 |
| RTREILTK | 81.24 | HLA-A*0301 | APDRVSFL | 235.59 | HLA-B*0702 | IRMAINLV | 462.3 | HLA-B*3901 |
| SSKYQQSF | 81.25 | HLA-B*1501 | RRDQKSLK | 235.89 | HLA-B*2705 | YQFALGHG | 462.4 | HLA-B*1501 |
| RTFQNIDK | 81.27 | HLA-A*0301 | LTKGILGF | 235.93 | HLA-B*1501 | MENERTLY | 462.62 | HLA-B*1501 |
| KIITIGAV | 81.38 | HLA-A*0201 | GLNVSLHL | 235.98 | HLA-A*0201 | FQLFLVCV | 463.25 | HLA-B*3901 |
| LILGDCSV | 81.4 | HLA-A*0201 | WITREPYV | 236.25 | HLA-A*0201 | LEECSCYV | 463.65 | HLA-B*4001 |
| KIITIGSM | 81.49 | HLA-B*1501 | FGYFGIFF | 236.38 | HLA-B*1501 | RKRDSSIL | 463.98 | HLA-B*0702 |
| ESEMNKLY | 81.57 | HLA-A*0101 | TIKTWAGK | 236.48 | HLA-A*0301 | TSYRTLLM | 465.29 | HLA-B*1501 |
| FTLSGVAI | 81.6 | HLA-A*0201 | SVCYNPCF | 236.55 | HLA-B*1501 | SLYASPQL | 465.6 | HLA-B*1501 |
| TQDAMTEV | 81.71 | HLA-A*0201 | LLNASCAA | 236.9 | HLA-A*0201 | AIVQITGK | 465.95 | HLA-A*0301 |
| TQFTVVGK | 81.81 | HLA-A*0301 | FIAPRYAF | 237.03 | HLA-B*0801 | IHYGGIPT | 466.3 | HLA-B*3901 |
| LTHQSGTY | 81.85 | HLA-B*1501 | DEFQLIPM | 237.3 | HLA-B*4001 | TYSSSLMW | 466.69 | HLA-B*5801 |
| RMTFYWTM | 82.12 | HLA-B*1501 | TFDLEGLY | 237.38 | HLA-A*0101 | MQALQLLL | 466.97 | HLA-B*1501 |
| KLILATGL | 82.23 | HLA-A*0201 | TITYSSSM | 237.74 | HLA-B*1501 | YRNLAWFV | 467 | HLA-B*2705 |
| KLNRSEIK | 82.23 | HLA-A*0301 | VEKEFSNL | 237.84 | HLA-B*4001 | KTLKWEPL | 467.05 | HLA-A*0201 |
| FIAPEYAY | 82.34 | HLA-B*1501 | QVKLSSGY | 237.97 | HLA-B*1501 | QYRALVSW | 467.13 | HLA-A*2402 |
| YQNSFVPV | 82.37 | HLA-B*1501 | CSSGNCRF | 238.11 | HLA-B*5801 | YAFGNCPK | 467.16 | HLA-A*0301 |
| NLYDRVRK | 82.39 | HLA-A*0301 | YKSTQTAI | 238.16 | HLA-B*3901 | GTYDYPRY | 467.27 | HLA-A*0101 |
| VIASTTAK | 82.41 | HLA-A*0301 | TKYRTESL | 238.21 | HLA-B*3901 | ITNKANSI | 467.36 | HLA-B*5801 |
| SPKLRSGF | 82.51 | HLA-B*0702 | NRLNINSV | 238.28 | HLA-B*3901 | ISATGMTL | 467.38 | HLA-B*5801 |
| FIAPEYAF | 82.54 | HLA-B*1501 | FGASCFTL | 238.31 | HLA-B*3901 | VWWASNSL | 467.41 | HLA-A*2402 |

Fig. 78-20

| Peptide | Affinity (nM) | Allele | Peptide | Affinity (nM) | Allele | Peptide | Affinity (nM) | Allele |
|---|---|---|---|---|---|---|---|---|
| AIMMAGIF | 82.64 | HLA-B*1501 | KYGSGRIF | 238.42 | HLA-A*2402 | VELAEKAM | 467.93 | HLA-B*4001 |
| RTLMSCPM | 82.86 | HLA-B*1501 | LTLKSEQF | 238.96 | HLA-B*1501 | SKCYQFAL | 468.17 | HLA-B*3901 |
| ILVTREPY | 83.06 | HLA-B*1501 | GLNVGLHL | 239.03 | HLA-A*0201 | ASIRRNYF | 468.19 | HLA-B*5801 |
| ALSNRFQI | 83.13 | HLA-A*0201 | FEFIAEDF | 239.52 | HLA-B*4001 | NKRYGPAL | 468.31 | HLA-B*0702 |
| TQYRTESL | 83.24 | HLA-B*3901 | ARQMVQAM | 239.53 | HLA-B*2705 | MDYYWGIL | 468.54 | HLA-B*3901 |
| FQIQGIKL | 83.34 | HLA-B*3901 | WQGANRPI | 239.63 | HLA-B*3901 | FGASCFLL | 468.84 | HLA-B*3901 |
| LLLIAQAL | 83.39 | HLA-A*0201 | TVKDRSPY | 239.74 | HLA-B*1501 | ISATGVTL | 468.95 | HLA-B*5801 |
| QVIKLLPF | 83.4 | HLA-A*2601 | KLCKLNGI | 239.91 | HLA-A*0201 | YDKVRMQL | 469.17 | HLA-B*0801 |
| KLNRTEIK | 83.55 | HLA-A*0301 | YNAELIVL | 240.03 | HLA-B*3901 | THFEKVKI | 469.36 | HLA-B*3901 |
| CHDGTSWL | 83.66 | HLA-B*3901 | TSNSIIVF | 240.06 | HLA-B*1501 | SGNCRFSV | 469.56 | HLA-B*0801 |
| RIDYFWSI | 83.98 | HLA-A*0201 | RARIKTRL | 240.07 | HLA-B*0801 | GQAFYRSI | 469.6 | HLA-B*1501 |
| RGFFPFHK | 83.99 | HLA-A*0301 | RSGFEMLK | 240.29 | HLA-A*0301 | SVASSLVL | 469.6 | HLA-B*1501 |
| TTHSWIPK | 83.99 | HLA-A*0301 | RRINMLAD | 240.33 | HLA-B*2705 | LLLQITSL | 469.69 | HLA-B*0801 |
| GVKGFAFK | 84.03 | HLA-A*0301 | SPRTVGQC | 240.62 | HLA-B*0702 | LHNGGLIA | 470.09 | HLA-B*3901 |
| RINMISDK | 84.65 | HLA-A*0301 | IEERINRL | 240.62 | HLA-B*4001 | IGKTSWSY | 470.26 | HLA-B*1501 |
| FEATGNLL | 84.69 | HLA-B*3901 | SSFSFGGF | 240.75 | HLA-B*5801 | LVASSGTL | 470.28 | HLA-B*1501 |
| WMGRTISK | 84.72 | HLA-A*0301 | RASFLRGK | 240.97 | HLA-A*0301 | LIASSGTL | 470.41 | HLA-B*1501 |
| GENSGVLV | 84.82 | HLA-B*4001 | LINGWYGF | 241.01 | HLA-B*1501 | YIIRALTL | 470.73 | HLA-B*0801 |
| QEIRTFSF | 84.88 | HLA-B*4001 | RRDQKALK | 241.05 | HLA-B*2705 | WSYNAGLL | 470.91 | HLA-B*3901 |
| WSGYSGSF | 85.07 | HLA-B*1501 | HSRSGFEM | 241.06 | HLA-B*1501 | RQKSLIWL | 471.12 | HLA-B*1501 |
| IISPDLSY | 85.12 | HLA-B*1501 | LERRIESL | 241.28 | HLA-B*4001 | FSHYNQMK | 471.58 | HLA-A*0301 |
| KGFFPFHK | 85.25 | HLA-A*0301 | VISSDLSY | 241.49 | HLA-A*0101 | HMGECPKY | 471.8 | HLA-B*1501 |
| VPVGSGSF | 85.25 | HLA-B*0702 | RRILKENA | 241.62 | HLA-B*2705 | NVRCTFCI | 471.92 | HLA-B*0801 |
| QTYRNNRK | 85.26 | HLA-A*0301 | SFYRSMKW | 241.65 | HLA-A*2402 | VANGTIVK | 471.93 | HLA-A*0301 |
| TQYREEAL | 85.27 | HLA-B*3901 | GLNMSLHL | 241.71 | HLA-A*0201 | FFNNTEPL | 471.93 | HLA-B*3901 |
| GQSGRINF | 85.34 | HLA-B*1501 | RRQKWWVW | 241.72 | HLA-B*2705 | VLRPGQTL | 471.95 | HLA-B*1501 |
| SLVGVDPF | 85.48 | HLA-B*1501 | IRLFDYSK | 241.76 | HLA-B*2705 | CYPNLCQV | 472.43 | HLA-A*2402 |
| KVNSIIGK | 85.53 | HLA-A*0301 | GRYSRADK | 241.8 | HLA-B*2705 | IITREPYV | 472.54 | HLA-A*0201 |
| RALMSVPM | 85.55 | HLA-B*1501 | IRMAINLV | 241.93 | HLA-B*2705 | STGGQAFY | 472.63 | HLA-A*2601 |
| KMNTQFTA | 85.65 | HLA-A*0201 | LVNTYQWV | 242.03 | HLA-A*0201 | FQSLIPKA | 472.7 | HLA-A*0201 |
| CFLLVALF | 85.65 | HLA-A*2402 | GLRNVPQM | 242.06 | HLA-B*1501 | VNSDTTSW | 472.72 | HLA-B*5801 |
| GSHGVKGW | 85.68 | HLA-B*5801 | TMTITFLI | 242.27 | HLA-A*0201 | VTTHFQRK | 473.17 | HLA-A*0301 |
| RSRNGFEM | 85.76 | HLA-B*1501 | SRSGFEVI | 242.48 | HLA-B*3901 | SLQNRIQI | 473.29 | HLA-B*0801 |
| NLYGFIVK | 85.8 | HLA-A*0301 | KEKEICSV | 242.53 | HLA-B*4001 | WQGSNRPV | 473.3 | HLA-B*3901 |
| APPKQSRM | 85.84 | HLA-B*0702 | SSFQVDCF | 242.9 | HLA-B*1501 | RMEFSWIL | 473.67 | HLA-B*3901 |
| YLEENPSA | 85.85 | HLA-A*0201 | TELGSPLV | 243.13 | HLA-B*4001 | SSSLMWEI | 473.7 | HLA-B*5801 |
| FQIQGIKL | 85.85 | HLA-A*0201 | FRNMIWLI | 243.25 | HLA-B*2705 | CPSPLRLV | 473.81 | HLA-B*0702 |
| IEERINHL | 85.94 | HLA-B*4001 | QIAGFAPF | 243.28 | HLA-A*2601 | KIKMKWGN | 473.82 | HLA-B*0801 |
| AINGVTNK | 86.22 | HLA-A*0301 | THLEVCFM | 243.42 | HLA-B*3901 | GRFYIQMC | 473.96 | HLA-B*2705 |
| TIHDRTTF | 86.25 | HLA-B*1501 | LILGFVLW | 243.75 | HLA-B*5801 | YRNLIWFV | 474.17 | HLA-B*2705 |
| KRIENLNK | 86.72 | HLA-B*2705 | SLRLATGL | 243.95 | HLA-B*0801 | KIIRVGCV | 474.26 | HLA-A*0201 |
| FQIQGVRL | 86.78 | HLA-B*3901 | TIHDRSQF | 244.4 | HLA-B*1501 | ISSMMEAM | 474.38 | HLA-B*1501 |
| MQALQLLL | 86.88 | HLA-B*3901 | RSGYEMLK | 244.58 | HLA-A*0301 | LVKTTLFL | 474.5 | HLA-B*0801 |
| SGFAIFSK | 86.89 | HLA-A*0301 | NMSLNISL | 244.75 | HLA-B*3901 | KYGNGVWM | 474.54 | HLA-A*2402 |
| FAISCFLI | 86.9 | HLA-A*0201 | MTFYWTII | 244.76 | HLA-A*0201 | RFYRTCKL | 474.76 | HLA-A*2402 |
| VTLTMGYK | 87.35 | HLA-A*0301 | KPKYLPDL | 244.79 | HLA-B*0702 | FSMELPSF | 474.96 | HLA-A*2601 |
| CTIPCFWV | 87.5 | HLA-A*0201 | FVYFVEIL | 245.08 | HLA-A*0201 | NQNNTTVV | 475.69 | HLA-A*3901 |
| KTWAGNIL | 87.6 | HLA-B*5801 | INYENNTW | 245.15 | HLA-B*5801 | ETKCQTPL | 475.86 | HLA-A*2601 |
| TLHFKQHK | 87.66 | HLA-A*0301 | TVKDRSPF | 245.19 | HLA-B*0801 | ISFQSGHI | 476.82 | HLA-B*5801 |
| SLGASCFL | 87.7 | HLA-A*0201 | LAALNMGF | 245.2 | HLA-B*1501 | IRTFFGWK | 476.93 | HLA-B*2705 |
| RSRSGFEM | 87.89 | HLA-B*1501 | TITYSSPM | 245.28 | HLA-B*1501 | IMERNVTV | 476.98 | HLA-A*0201 |
| TPYRTLLM | 88.06 | HLA-B*0702 | LTLKLGQF | 245.3 | HLA-B*1501 | GINMSKKK | 477.19 | HLA-A*0301 |
| RMGKCNTK | 88.29 | HLA-A*0301 | STWVSQTY | 245.61 | HLA-B*5801 | GTYSYPQY | 477.35 | HLA-A*0101 |
| SIHSRGLF | 88.33 | HLA-B*1501 | MKRKRNSS | 245.78 | HLA-B*0801 | GQCGILGI | 477.53 | HLA-A*0201 |
| NMRWLTLK | 88.36 | HLA-A*0301 | ASMRRDYF | 245.86 | HLA-B*5801 | LKMPASRY | 477.68 | HLA-B*1501 |
| YGIKGFSY | 88.52 | HLA-B*1501 | YGVKGFAF | 245.86 | HLA-B*1501 | GESEQIVV | 477.79 | HLA-B*4001 |
| YSGAFMDY | 88.53 | HLA-A*0101 | VEALARSI | 246.09 | HLA-B*4001 | HANNSTEK | 477.95 | HLA-A*0301 |
| YQNSFVPV | 88.53 | HLA-B*3901 | LTHQSGTY | 246.1 | HLA-A*0101 | FAAICTHM | 478.57 | HLA-B*1501 |
| SRSGFEIL | 88.56 | HLA-B*3901 | EVRRRLST | 246.21 | HLA-B*0801 | GTYYYPKY | 479.11 | HLA-B*1501 |
| CHDGISWL | 88.57 | HLA-B*3901 | RRVWRQAN | 246.34 | HLA-B*2705 | NLYDRVRL | 479.12 | HLA-B*0801 |
| IQFTAVGK | 88.63 | HLA-A*0301 | FRNMIWLI | 246.36 | HLA-B*3901 | GYKDWILW | 479.45 | HLA-A*2402 |
| WFRNILSI | 88.7 | HLA-B*0801 | KYVRSEKL | 246.37 | HLA-A*2402 | SFYRNLAW | 479.69 | HLA-B*5801 |
| WSGYSGAF | 89.13 | HLA-B*1501 | GPRNVPQA | 246.43 | HLA-B*0702 | MEYDAVAT | 479.7 | HLA-B*4001 |
| KISSSFSF | 89.24 | HLA-B*5801 | NIRCTFCI | 246.84 | HLA-B*0801 | EVSFRGGH | 479.79 | HLA-A*2601 |
| AVIHYGGM | 89.38 | HLA-A*2601 | WVWLWLVL | 246.97 | HLA-A*0201 | NSADHRVY | 479.87 | HLA-B*1501 |

Fig. 78-21

| Peptide | Affinity (nM) | Allele | Peptide | Affinity (nM) | Allele | Peptide | Affinity (nM) | Allele |
|---|---|---|---|---|---|---|---|---|
| DSEMNNLY | 89.39 | HLA-A*0101 | FIMWTCNS | 247 | HLA-A*0201 | SRSGFEMI | 479.98 | HLA-B*3901 |
| RYVKQSSL | 89.4 | HLA-A*2402 | FALIVNAL | 247.12 | HLA-B*3901 | FVFSIAAS | 480.19 | HLA-A*0201 |
| WEMGLAPS | 89.5 | HLA-B*4001 | GRVTVSTR | 247.14 | HLA-B*2705 | TETVNTLI | 480.3 | HLA-B*4001 |
| GSQGVKGW | 89.82 | HLA-B*5801 | MMAMKYPI | 247.17 | HLA-B*3901 | SHNGGLIA | 480.32 | HLA-B*3901 |
| AINLYASK | 89.9 | HLA-A*0301 | KEPDTYDF | 247.43 | HLA-B*4001 | YVNNTTVI | 480.48 | HLA-B*1501 |
| FIAEDFQW | 89.93 | HLA-B*5801 | TTVDHMAI | 247.93 | HLA-A*2601 | YSSVASSL | 480.53 | HLA-B*5801 |
| SRSGYEVL | 89.96 | HLA-B*3901 | FEAVGKEF | 248.01 | HLA-B*4001 | GQQGWMDY | 480.56 | HLA-B*1501 |
| LSSVSSFK | 90.11 | HLA-A*0301 | GRLVRFRH | 248.12 | HLA-B*2705 | RVKRRPVA | 481.29 | HLA-B*0801 |
| ASIRNNTY | 90.24 | HLA-B*1501 | TQMAIDNM | 248.26 | HLA-B*1501 | RIPHRTLL | 481.55 | HLA-B*0702 |
| ASSGTVEF | 90.4 | HLA-B*5801 | RMDYYWAV | 248.74 | HLA-B*3901 | YQAELLIA | 481.72 | HLA-B*3901 |
| TETKAPQL | 90.41 | HLA-B*4001 | SLSYSTGA | 248.84 | HLA-A*0201 | NTYNHTQY | 481.82 | HLA-A*0101 |
| KRMGVQMH | 90.5 | HLA-B*2705 | MEMRRCLL | 249.13 | HLA-B*0801 | RRRFVQNA | 482.23 | HLA-B*2705 |
| GLQMQRFK | 90.74 | HLA-A*0301 | GSIRNGTY | 249.21 | HLA-B*1501 | GTYDYPRY | 482.26 | HLA-B*5801 |
| ALLIAFVL | 90.77 | HLA-B*1501 | HSNNSTKK | 249.44 | HLA-A*0301 | ESDGAFLA | 482.45 | HLA-A*0101 |
| NQASYRIF | 90.8 | HLA-B*1501 | AVNQITGK | 249.5 | HLA-A*0301 | NPKCDRLL | 482.66 | HLA-B*0702 |
| LRLAIGLR | 90.89 | HLA-B*2705 | FIVEKFQW | 249.52 | HLA-B*5801 | WTSNSIAV | 482.68 | HLA-A*0201 |
| YSTVASSF | 91.34 | HLA-B*1501 | MQALQLLL | 249.61 | HLA-A*0201 | GTYNHQDY | 482.72 | HLA-B*1501 |
| WIRFNSNL | 91.35 | HLA-B*0801 | YSKVYKTY | 249.87 | HLA-B*1501 | NTYDHAQY | 482.94 | HLA-A*0101 |
| TTHSWVPK | 91.36 | HLA-A*0301 | FLLMDALK | 249.95 | HLA-A*0301 | LRGRGSTL | 483.12 | HLA-B*3901 |
| IEERINQL | 91.37 | HLA-B*4001 | NQEELRFL | 250.33 | HLA-B*3901 | VSSFYSEM | 483.2 | HLA-B*5801 |
| HIQTRRSF | 91.38 | HLA-B*0801 | SRSIIFNM | 250.46 | HLA-B*2705 | FESTGNLV | 483.38 | HLA-B*3901 |
| KSVFNSLY | 91.43 | HLA-B*1501 | WESLAGTA | 250.64 | HLA-B*4001 | GYKDIILW | 483.73 | HLA-A*2402 |
| RMKWMMAM | 91.44 | HLA-B*0801 | NEDGNIIF | 250.66 | HLA-B*4001 | NVIDKMYK | 483.81 | HLA-A*0301 |
| EEMLTGNL | 91.48 | HLA-B*4001 | RIQDIWAY | 250.67 | HLA-B*1501 | FERVRRQL | 483.9 | HLA-B*0801 |
| CHNGICPV | 91.53 | HLA-B*3901 | MNNEGSYF | 250.67 | HLA-B*1501 | LINTYQWI | 484.11 | HLA-A*0201 |
| KLLQNSQI | 91.57 | HLA-A*0201 | DMSNDGSY | 250.82 | HLA-A*2601 | FLMQIAIL | 484.47 | HLA-B*0801 |
| LVDSIGSW | 91.64 | HLA-B*5801 | SRINGVKL | 250.88 | HLA-B*2705 | LEHTSRYI | 484.53 | HLA-B*4001 |
| RSIRWLTL | 91.76 | HLA-B*5801 | RPGETLNV | 250.91 | HLA-B*0702 | KSCLPACI | 485.04 | HLA-B*5801 |
| ITYSSSLM | 91.78 | HLA-B*5801 | SFYRSMRW | 250.95 | HLA-A*2402 | TVNRTHQY | 485.08 | HLA-B*1501 |
| IESEFNEI | 91.92 | HLA-B*4001 | TYSSSLMW | 250.95 | HLA-A*2402 | YNFNEGSY | 485.39 | HLA-B*1501 |
| SIASRSGY | 91.92 | HLA-B*1501 | WSYNAQLL | 251.12 | HLA-B*3901 | ESRSGFEM | 485.61 | HLA-A*2601 |
| GMFNMLST | 91.97 | HLA-A*0201 | KETGNGCF | 251.16 | HLA-B*4001 | IGDGQRSW | 485.77 | HLA-B*5801 |
| SLPDGAQI | 92.13 | HLA-A*0201 | TPKRNRSI | 251.22 | HLA-B*0801 | YKSTQSAV | 485.83 | HLA-B*3901 |
| MISKCRTK | 92.13 | HLA-A*0301 | RATAILRK | 251.3 | HLA-A*0301 | NRHSNGTI | 486.1 | HLA-B*3901 |
| MARLGRGY | 92.15 | HLA-B*1501 | RIFQSGIR | 251.31 | HLA-A*0301 | CYMDIDVY | 486.16 | HLA-A*2402 |
| SVKLSSGY | 92.16 | HLA-B*1501 | ILIAGGLI | 251.45 | HLA-A*0201 | CSNGSCRF | 486.24 | HLA-B*1501 |
| NRFYRTCK | 92.3 | HLA-B*2705 | STWVSQTY | 251.72 | HLA-B*1501 | NLGQVECV | 486.3 | HLA-A*0201 |
| RPRRGLFG | 92.32 | HLA-B*0702 | VSVGSGSF | 251.77 | HLA-B*5801 | YRNLIWFV | 486.81 | HLA-B*3901 |
| NRIQINPV | 92.37 | HLA-B*3901 | TQRAIDNM | 251.77 | HLA-B*1501 | WEPLAGTA | 486.84 | HLA-B*4001 |
| RVRDNMTK | 92.38 | HLA-A*0301 | SLDEQNKL | 251.87 | HLA-A*0201 | CKRTVSSF | 486.91 | HLA-B*1501 |
| LMIWHSNL | 92.4 | HLA-B*1501 | LMIWHSNL | 251.93 | HLA-B*3901 | RTLMSVKI | 487.01 | HLA-B*5801 |
| CSNGSCRF | 92.49 | HLA-B*5801 | SGYSGSFM | 252.08 | HLA-B*1501 | AVTDIWSY | 487.4 | HLA-B*1501 |
| MSKKKSYI | 92.55 | HLA-B*0801 | SFYSEMKW | 252.29 | HLA-A*2402 | YIVERPSA | 487.47 | HLA-A*0201 |
| LRLALGLR | 92.55 | HLA-B*2705 | KPKSLPDL | 252.35 | HLA-B*0702 | ILCASATA | 487.51 | HLA-A*0201 |
| RAFSFQLI | 92.66 | HLA-B*5801 | NTYDHSKY | 252.39 | HLA-B*1501 | LINDPWVL | 487.7 | HLA-A*0201 |
| KRLENLNK | 92.69 | HLA-B*2705 | LSIYSTAA | 252.43 | HLA-B*1501 | CRFYALSQ | 487.74 | HLA-B*2705 |
| AIAMGLIF | 92.69 | HLA-B*1501 | MKWLSSSM | 252.45 | HLA-B*3901 | WIRFNSDL | 487.96 | HLA-B*0702 |
| ILAFIMWT | 92.7 | HLA-A*0201 | VIVENNNW | 252.68 | HLA-B*5801 | YLIGKTSW | 488.14 | HLA-B*5801 |
| SVSSRSGF | 92.81 | HLA-B*1501 | CHDGRARM | 252.84 | HLA-B*3901 | KPGQTLRV | 488.59 | HLA-B*0702 |
| GIFGPVHF | 92.86 | HLA-B*1501 | SRYGYEML | 252.86 | HLA-B*2705 | TSRSGFEM | 488.79 | HLA-B*1501 |
| FAISCFLL | 93.21 | HLA-A*0201 | YRNLIWLV | 253.15 | HLA-B*2705 | SFYKSMRW | 489.09 | HLA-B*5801 |
| FIAPENAY | 93.23 | HLA-A*2601 | STYQNNFV | 253.16 | HLA-A*0201 | QSGRISFY | 489.17 | HLA-A*0101 |
| FNMLSTVL | 93.41 | HLA-B*3901 | QPNDGQVL | 253.33 | HLA-B*0702 | NTIEVFRL | 489.57 | HLA-A*0201 |
| KIAHISPL | 93.52 | HLA-A*0201 | QESECACI | 253.46 | HLA-B*4001 | AGFIENGW | 489.59 | HLA-B*5801 |
| ALSQGTTL | 93.54 | HLA-A*0201 | YRYGNGVW | 253.57 | HLA-B*2705 | SISCLYKL | 489.7 | HLA-A*0201 |
| VPKRNRSI | 93.58 | HLA-B*0702 | SLCEVNSW | 253.59 | HLA-B*5801 | MQNRLNNV | 489.81 | HLA-B*3901 |
| ALLNRLNI | 93.63 | HLA-A*0201 | KYVKSDRL | 253.74 | HLA-A*2402 | KLGSPLVL | 489.83 | HLA-A*0201 |
| NTKGRYVL | 93.68 | HLA-B*0801 | AIVTREPY | 253.74 | HLA-B*1501 | SLNGISPI | 490.09 | HLA-B*1501 |
| KINNIIDK | 93.79 | HLA-A*0301 | SFYRSINW | 253.82 | HLA-A*2402 | ISVGTSTL | 490.14 | HLA-B*5801 |
| RIDYYWSI | 93.89 | HLA-A*0201 | YQRSKFLL | 253.9 | HLA-B*3901 | ELKWLISK | 490.24 | HLA-A*0301 |
| CSNNTTNY | 94.16 | HLA-A*0101 | RMEFSWTL | 254.09 | HLA-A*0201 | IMYFHKGL | 490.28 | HLA-A*0201 |
| ATTVTLHF | 94.24 | HLA-B*5801 | KATAILRK | 254.15 | HLA-A*0301 | SSKYHQSF | 490.42 | HLA-B*0801 |
| CHDGSSWL | 94.4 | HLA-B*3901 | AMRTIGTH | 254.26 | HLA-B*1501 | HSVHRNTI | 490.5 | HLA-B*0801 |
| FVALILGF | 94.56 | HLA-A*2601 | FQVDCYLW | 254.68 | HLA-B*5801 | ALILRGSI | 491.21 | HLA-B*0801 |
| ALSVLNLL | 94.67 | HLA-A*0201 | SKINGVIL | 254.8 | HLA-B*3901 | SVYKALSI | 491.25 | HLA-B*1501 |

Fig. 78-22

| Peptide | Affinity (nM) | Allele | Peptide | Affinity (nM) | Allele | Peptide | Affinity (nM) | Allele |
|---|---|---|---|---|---|---|---|---|
| AILPLTSI | 94.86 | HLA-A*0201 | FEFIVEKF | 254.86 | HLA-B*4001 | KIRRRVDI | 491.63 | HLA-B*0801 |
| AVLKYNGV | 95.01 | HLA-A*0201 | RIQIDPVK | 255.06 | HLA-A*0301 | YQQSFTPS | 492.03 | HLA-B*1501 |
| MLKIHNAG | 95.02 | HLA-B*0801 | RQTYDWTL | 255.65 | HLA-B*3901 | SKCHQFAL | 492.28 | HLA-B*3901 |
| LVAPRGHY | 95.12 | HLA-B*1501 | TLVSTKSW | 256.22 | HLA-B*5801 | YLIRALTL | 492.44 | HLA-B*1501 |
| KLFERVRR | 95.24 | HLA-A*0301 | RRQILRTQ | 256.34 | HLA-B*2705 | WWVWLWLV | 492.66 | HLA-A*0201 |
| CHDGRAWL | 95.47 | HLA-B*3901 | WQGANRPV | 256.36 | HLA-B*3901 | RREVHVYY | 492.72 | HLA-B*2705 |
| GPSNAQAF | 95.54 | HLA-B*0702 | AYISFRNL | 256.42 | HLA-A*2402 | SPHRTLLM | 492.79 | HLA-B*0801 |
| GYSGIFSI | 95.87 | HLA-A*2402 | GVYQILAI | 256.45 | HLA-A*0201 | FYRSMKWL | 492.85 | HLA-A*2402 |
| MSIGVTVI | 95.93 | HLA-B*5801 | FQKNAKVL | 256.68 | HLA-B*0801 | ELRSKYWA | 492.96 | HLA-B*0801 |
| ALSILNLL | 96.21 | HLA-A*0201 | NQSGRISI | 256.69 | HLA-B*3901 | FVIREPCI | 493.04 | HLA-A*0201 |
| TIALIIGV | 96.29 | HLA-A*0201 | STDTVDTV | 257.13 | HLA-A*0101 | CYPRYPNV | 493.1 | HLA-A*2402 |
| WMACNSAA | 96.34 | HLA-A*0201 | FSMSCFVF | 257.18 | HLA-A*2402 | EVNSWHIL | 493.53 | HLA-A*2601 |
| QAFYKILK | 96.34 | HLA-A*0301 | GTYDYPHY | 257.19 | HLA-B*5801 | RVSFYWTI | 493.71 | HLA-B*5801 |
| KYVNVKSL | 96.43 | HLA-A*2402 | SQTVINNY | 257.34 | HLA-B*1501 | KRKKRGLF | 493.83 | HLA-B*2705 |
| NSDLEALM | 96.61 | HLA-A*0101 | KRMGVQLQ | 257.46 | HLA-B*2705 | EVTNATEL | 494.38 | HLA-A*2601 |
| AMMSRARI | 96.7 | HLA-A*0201 | PTTEINTW | 257.48 | HLA-B*5801 | VKMEKIVL | 494.92 | HLA-B*3901 |
| RPRVRNQS | 96.72 | HLA-B*0702 | APKYGYII | 257.49 | HLA-B*0702 | SLQQIESM | 495.08 | HLA-B*1501 |
| AISTTFPY | 96.78 | HLA-B*1501 | SRYICSGL | 257.55 | HLA-B*3901 | YEVGYLCA | 495.34 | HLA-B*4001 |
| KLYERVRR | 96.82 | HLA-A*0301 | TFYRNMRW | 258.01 | HLA-A*2402 | RYICSGLV | 495.79 | HLA-A*2402 |
| ESVLVNTY | 96.83 | HLA-A*2601 | AINQINGK | 258.07 | HLA-A*0301 | TRDSLTEI | 495.86 | HLA-B*3901 |
| | | | | | | KPGQTLRI | 496.17 | HLA-B*0702 |
| | | | | | | TRRAFELK | 496.4 | HLA-B*2705 |
| | | | | | | KSITQTLV | 496.74 | HLA-B*5801 |
| | | | | | | MGLFFFCL | 496.83 | HLA-B*0801 |
| | | | | | | SLCSVEGW | 496.87 | HLA-B*5801 |
| | | | | | | KRLLRENA | 496.92 | HLA-B*2705 |
| | | | | | | FELIDNEF | 497.26 | HLA-B*4001 |
| | | | | | | YIIEKYGT | 497.86 | HLA-A*0201 |
| | | | | | | GMCYPGSV | 497.95 | HLA-A*0201 |
| | | | | | | SIQSKGLF | 497.95 | HLA-B*1501 |
| | | | | | | WMDYYWGI | 498.05 | HLA-B*3901 |
| | | | | | | YVQMCTEL | 498.24 | HLA-A*0201 |
| | | | | | | YSTVASSI | 498.25 | HLA-B*5801 |
| | | | | | | QESSCVCV | 498.26 | HLA-B*4001 |
| | | | | | | SVFNSLYA | 498.29 | HLA-A*0301 |
| | | | | | | ITNLGLNI | 498.59 | HLA-B*5801 |
| | | | | | | NPSCATNI | 499.18 | HLA-B*0702 |
| | | | | | | FESTGNLI | 499.34 | HLA-B*3901 |
| | | | | | | KRGLFGAI | 499.55 | HLA-B*2705 |
| | | | | | | LILTFIMW | 499.8 | HLA-B*5801 |
| | | | | | | WEINGPES | 499.86 | HLA-B*4001 |

SUMMARY
The number of weak binders is 3389
The number of strong binders is 787

| Allele | Number of predicted binders |
|---|---|
| HLA-A*0101 | 114 |
| HLA-A*0201 | 758 |
| HLA-A*0301 | 459 |
| HLA-A*2402 | 214 |
| HLA-A*2601 | 160 |
| HLA-B*0702 | 200 |
| HLA-B*0801 | 226 |
| HLA-B*1501 | 737 |
| HLA-B*2705 | 215 |
| HLA-B*3901 | 368 |
| HLA-B*4001 | 286 |
| HLA-B*5801 | 439 |

Fig. 79-1

| Peptide | y (nM) | Allele | Peptide | Affinity (nM) | Allele | Peptide | Affinity (nM) | Allele |
|---|---|---|---|---|---|---|---|---|
| FMYSDFHFI | 2.33 | HLA-A*0201 | LIFLARSAL | 91.3 | HLA-B*0801 | FHNISKYAF | 253.79 | HLA-B*3901 |
| ITYSSSLMW | 2.39 | HLA-B*5801 | GLSSRISFY | 91.5 | HLA-A*0301 | GGYKDVILW | 253.8 | HLA-B*5801 |
| YMGECPNYV | 2.49 | HLA-A*0201 | ELRFVFSSA | 91.5 | HLA-B*0801 | RERLGSWSW | 253.92 | HLA-B*4001 |
| LSSRISFYW | 2.5 | HLA-B*5801 | FLWGIHHPP | 91.8 | HLA-A*0201 | QMYQKCCTL | 254.03 | HLA-B*3901 |
| CAVATTHSW | 2.54 | HLA-B*5801 | RISIYWTLV | 91.9 | HLA-A*0201 | SRSGFEMLK | 254.04 | HLA-B*2705 |
| YMGECPEYV | 2.69 | HLA-A*0201 | STIGDCPKY | 92 | HLA-A*2601 | FQPCFYIEL | 254.06 | HLA-B*3901 |
| YTLVTTSSW | 3 | HLA-B*5801 | ASWFNSFLV | 92 | HLA-A*0201 | RREVHTYYL | 254.09 | HLA-B*3901 |
| TLMEQNVPV | 3.18 | HLA-A*0201 | LMWALGENM | 92 | HLA-B*1501 | GLIAGWYGF | 254.75 | HLA-A*0201 |
| ITYSSSMMW | 3.2 | HLA-B*5801 | TYINNTTII | 92.1 | HLA-A*2402 | NASWFNSFL | 254.76 | HLA-B*3901 |
| ITYSSPMMW | 3.29 | HLA-B*5801 | FASSGIAIV | 92.1 | HLA-A*0201 | SPYRTLMSV | 254.79 | HLA-B*0801 |
| YTLVSTSSW | 3.38 | HLA-B*5801 | KMNTQILIF | 92.2 | HLA-B*5801 | RTNEKFHQI | 254.8 | HLA-B*5801 |
| WHDGAILPL | 3.51 | HLA-B*3901 | SECVCHNGI | 92.2 | HLA-B*4001 | SYNARLLVL | 254.99 | HLA-A*2402 |
| WMACHSAAF | 3.64 | HLA-B*1501 | KFEEMRWLI | 92.2 | HLA-A*2402 | ILAFILWAC | 255.04 | HLA-A*0201 |
| TLMSCPMGV | 3.77 | HLA-A*0201 | KVWWTSNSI | 92.3 | HLA-A*0201 | FGASCLILL | 255.13 | HLA-A*0201 |
| FMDVWTYNA | 3.83 | HLA-A*0201 | KFEEIKWLI | 92.4 | HLA-A*2402 | RQKWWVWL | 255.14 | HLA-B*5801 |
| GTMDYYWGI | 3.86 | HLA-A*0201 | LANNGRFEF | 92.4 | HLA-B*5801 | FVIREPFVA | 255.29 | HLA-A*0201 |
| REPYVSCSL | 3.87 | HLA-B*4001 | LILAFIMWA | 92.5 | HLA-A*0201 | TTNYYNETF | 255.95 | HLA-B*1501 |
| FLDVWTYNA | 4 | HLA-A*0201 | GAINTTLPF | 92.5 | HLA-B*5801 | KLANVVRKM | 256.04 | HLA-B*1501 |
| FIAPEYAYI | 4.07 | HLA-A*0201 | KSSLPLCPF | 92.5 | HLA-B*1501 | MEWIKTRPI | 256.11 | HLA-B*4001 |
| KSFYRNLVW | 4.25 | HLA-B*5801 | KIDDQIEEL | 92.5 | HLA-A*0201 | FRYGDGVWI | 256.24 | HLA-B*3901 |
| ETYKILTIY | 4.37 | HLA-A*2601 | SPYRALMSV | 92.6 | HLA-B*0702 | SWMKIYWSL | 256.26 | HLA-B*0801 |
| LLTEVETYV | 4.42 | HLA-A*0201 | GVNSDTTGW | 92.7 | HLA-B*5801 | GSSKYRQSF | 256.46 | HLA-B*1501 |
| TLMSCPIGV | 4.48 | HLA-A*0201 | SSCHDGNAW | 92.8 | HLA-B*5801 | YQAKFEAVA | 256.46 | HLA-B*1501 |
| MVSPLAVTW | 4.48 | HLA-B*5801 | ALNNRSQIK | 92.9 | HLA-A*0301 | ITYGACPRY | 256.51 | HLA-A*0301 |
| GMFNMLSTV | 4.66 | HLA-A*0201 | EREAKLFVL | 92.9 | HLA-B*3901 | VTRREVHTY | 256.59 | HLA-B*1501 |
| LMNELGVPF | 4.8 | HLA-B*1501 | STDTVDTLI | 93 | HLA-A*0101 | FKYGNGVWI | 256.79 | HLA-B*3901 |
| DVYQILAIY | 4.88 | HLA-A*2601 | RRQKSLIWL | 93.1 | HLA-B*2705 | FRTLMSCPI | 256.81 | HLA-B*2705 |
| GMLGFVFTL | 4.89 | HLA-A*0201 | IQSKGLFGA | 93.2 | HLA-A*0201 | LIRMIKRGI | 256.84 | HLA-B*0801 |
| IVSPLAVTW | 4.89 | HLA-B*5801 | TLTENGVPV | 93.2 | HLA-A*0201 | NLVAPWYAY | 256.84 | HLA-B*1501 |
| MVSPLAITW | 4.96 | HLA-B*5801 | YAFGNCSKY | 94 | HLA-B*1501 | EIASWAGNI | 256.91 | HLA-A*2601 |
| LMNELGIPF | 4.98 | HLA-B*1501 | ISNKVNSVI | 94 | HLA-B*5801 | SVKMEKIVL | 257.18 | HLA-B*0801 |
| TLIEQNIPV | 5.18 | HLA-A*0201 | RMDYYWAIL | 94 | HLA-B*3901 | IRHENRMVI | 257.3 | HLA-B*3901 |
| WMMAMKYPI | 5.24 | HLA-A*0201 | RIDDAVTDV | 94.3 | HLA-A*0201 | LLFMIIGGF | 257.37 | HLA-B*1501 |
| CQIAGFAPF | 5.27 | HLA-B*1501 | TEDNIYKIL | 94.4 | HLA-B*4001 | NLLIGISNI | 257.48 | HLA-A*0201 |
| FLDIWTYNA | 5.35 | HLA-A*0201 | KEGYSLVGI | 94.4 | HLA-B*4001 | KAIDGVTNK | 257.48 | HLA-A*0301 |
| YLECRTFFL | 5.36 | HLA-A*0201 | MEFEPFQSL | 94.4 | HLA-B*3901 | SRSGYEVLK | 257.64 | HLA-B*2705 |
| TLMSCPVGV | 5.37 | HLA-A*0201 | MQNRLNNVI | 94.4 | HLA-B*3901 | KLLKERGFF | 257.73 | HLA-B*1501 |
| LTHALRELW | 5.37 | HLA-B*5801 | VMCVCRDNW | 94.6 | HLA-B*5801 | TQIIVILVL | 258.12 | HLA-B*3901 |
| VSLGAVSFW | 5.4 | HLA-B*5801 | YNAEFLVAL | 94.7 | HLA-B*3901 | KLYIWGVHH | 258.36 | HLA-A*0301 |
| WMMAMRYPI | 5.52 | HLA-A*0201 | WTSNSIVAF | 94.7 | HLA-A*2601 | LQSFTPSPG | 258.36 | HLA-B*1501 |
| VSLGAISFW | 5.57 | HLA-B*5801 | GSIPNGKPF | 94.8 | HLA-B*1501 | TSYKILSIY | 258.41 | HLA-B*5801 |
| FVFSNAASY | 5.64 | HLA-A*2601 | LSNPKCDLY | 95.1 | HLA-A*0101 | NRFYRTCKL | 258.49 | HLA-B*2705 |
| TLLENNVPV | 5.67 | HLA-A*0201 | HQSGTYPVV | 95.1 | HLA-B*3901 | FMARSALIL | 258.75 | HLA-B*1501 |
| YTLVSTRSW | 5.69 | HLA-B*5801 | TVLERNVTV | 95.2 | HLA-A*0201 | MVNERTLDF | 258.94 | HLA-B*0801 |
| LMSELGVPF | 5.73 | HLA-B*1501 | RLESVFAGK | 95.4 | HLA-A*0301 | YESIEECLI | 259.14 | HLA-B*4001 |
| CQITGFAPF | 5.77 | HLA-B*1501 | ATAVAVLKY | 95.4 | HLA-A*0101 | TLTNEHEEV | 259.21 | HLA-A*0201 |
| FLAHALKLV | 5.8 | HLA-A*0201 | CLRGGRNSF | 95.4 | HLA-B*0801 | LAKSVFNNL | 259.34 | HLA-B*0801 |
| WMACNSAAF | 5.85 | HLA-B*1501 | TACSDGSGW | 95.4 | HLA-B*5801 | NVYKILSIY | 259.38 | HLA-B*1501 |
| VSDGGPNLY | 5.86 | HLA-A*0101 | YQNSFVPVV | 95.6 | HLA-B*3901 | MDYYWAILK | 259.39 | HLA-A*0301 |
| ISDGGPNLY | 5.95 | HLA-A*0101 | GTIKDRSPY | 95.8 | HLA-B*1501 | SQVEQRINM | 259.59 | HLA-B*1501 |
| TLIEQNVPV | 6.05 | HLA-A*0201 | HMECRTFFL | 95.8 | HLA-B*0801 | KMNIQILIL | 259.8 | HLA-A*0201 |
| TLLESDVPV | 6.12 | HLA-A*0201 | SQFRALISW | 95.9 | HLA-B*5801 | RGLQRRRFI | 260.27 | HLA-B*0801 |
| LMNELGVSF | 6.2 | HLA-B*1501 | YVKSERLVL | 95.9 | HLA-B*0801 | FQNASRHHM | 260.6 | HLA-B*3901 |
| RELWQCYYL | 6.24 | HLA-B*4001 | GLNIGLHLK | 96 | HLA-A*0301 | KMKAIIVVL | 260.66 | HLA-B*1501 |
| FSMSCFVFV | 6.25 | HLA-A*0201 | WTSNSVVVF | 96.1 | HLA-B*5801 | FVANFSMEL | 260.69 | HLA-A*2601 |
| DTVNRTHQY | 6.29 | HLA-A*2601 | YSSPMMWEI | 96.1 | HLA-A*0201 | MVTQRTVGK | 260.96 | HLA-A*0301 |
| IVTTVGWSW | 6.33 | HLA-B*5801 | HQNEQGSGY | 96.3 | HLA-B*1501 | ALLPFDIDK | 260.97 | HLA-A*0301 |
| YTLVSTGSW | 6.38 | HLA-B*5801 | NSVKLSSGY | 96.5 | HLA-B*1501 | RMATGLRNI | 261.08 | HLA-A*0201 |
| GAINTTLPF | 6.38 | HLA-B*1501 | VQSYFQLFL | 96.7 | HLA-A*0201 | LYKKDSSYI | 261.09 | HLA-A*2402 |
| MSNEGSYFF | 6.46 | HLA-B*5801 | VLNTDWSGY | 96.7 | HLA-B*1501 | RRDYFTAEV | 261.46 | HLA-B*3901 |
| SELGVPFHL | 6.5 | HLA-B*4001 | ISFESNGNF | 96.7 | HLA-B*1501 | SSFERFEMF | 261.67 | HLA-B*5801 |

Fig. 79-2

| Peptide | y (nM) | Allele | Peptide | Affinity (nM) | Allele | Peptide | Affinity (nM) | Allele |
|---|---|---|---|---|---|---|---|---|
| FLNVWTYNA | 6.6 | HLA-A*0201 | WTSNSIVSM | 96.7 | HLA-B*1501 | RSWRKQILR | 261.91 | HLA-A*0301 |
| YMGECPKYV | 6.74 | HLA-A*0201 | SSVSSFEKF | 96.8 | HLA-B*5801 | ITFMQALQL | 261.97 | HLA-B*5801 |
| YSGSFSIRW | 6.76 | HLA-B*5801 | YPRYPNVRC | 96.8 | HLA-B*0702 | QAYTKVMYF | 262.29 | HLA-B*5801 |
| FVFSSAASY | 6.86 | HLA-A*2601 | QQIESIIEA | 96.9 | HLA-A*0201 | LVISTDLSY | 262.57 | HLA-A*2601 |
| QVDCFLWYV | 6.87 | HLA-A*0201 | GRMDYYWGI | 96.9 | HLA-A*0201 | ISKSRATEY | 263.15 | HLA-B*1501 |
| IMMAGLSFW | 7.01 | HLA-B*5801 | VTKENTGSY | 96.9 | HLA-A*2601 | HRTLLMSEL | 263.23 | HLA-B*2705 |
| SSFYRNLLW | 7.01 | HLA-B*5801 | MQIRGFVYF | 97 | HLA-A*2402 | MSQSRTREI | 263.25 | HLA-B*4001 |
| TLDFHDFNV | 7.06 | HLA-A*0201 | TVSSFYSEM | 97.1 | HLA-A*2601 | YEAIEECLI | 263.28 | HLA-B*4001 |
| ISMCSSTEF | 7.12 | HLA-B*1501 | KAIDRITTK | 97.2 | HLA-A*0301 | KILKIRKGK | 263.56 | HLA-A*0301 |
| CQVTGFAPF | 7.16 | HLA-B*1501 | RRQKWWVWL | 97.2 | HLA-B*2705 | WLGRTISTA | 263.57 | HLA-A*0201 |
| KSLCEVNSW | 7.17 | HLA-B*5801 | ILFNTIGNL | 97.2 | HLA-A*0201 | HHAVPNGTI | 264.08 | HLA-B*3901 |
| MQIRGFVHF | 7.21 | HLA-B*1501 | EVWSYNAEF | 97.3 | HLA-A*2601 | HLTGTWDTL | 264.37 | HLA-B*3901 |
| YIWTYQAEL | 7.23 | HLA-A*0201 | SQYRSLISW | 97.3 | HLA-B*1501 | AAIKGVGTM | 264.38 | HLA-B*1501 |
| FVFSIAASY | 7.24 | HLA-A*2601 | HQSGTYPVI | 97.4 | HLA-B*3901 | TTAVAVLKY | 264.6 | HLA-A*2601 |
| RLQDTTWDV | 7.54 | HLA-A*0201 | TFQNVSPLW | 97.4 | HLA-A*2402 | KIRVKRRPV | 264.8 | HLA-B*0801 |
| KSLCSVEGW | 7.62 | HLA-B*5801 | RILFIREGK | 97.6 | HLA-A*0301 | IASVPASRY | 265.12 | HLA-B*5801 |
| GLWAYNAEL | 7.63 | HLA-A*0201 | NHGSLVLSL | 97.7 | HLA-B*3901 | KVNTQFEAV | 265.45 | HLA-A*0201 |
| YSGAFIDYW | 7.65 | HLA-B*5801 | ELWAYNAEL | 97.7 | HLA-A*0201 | GYKNWILWI | 265.59 | HLA-A*2402 |
| CEVSSWHIL | 7.69 | HLA-B*4001 | KSLESRSGF | 97.7 | HLA-B*5801 | GSINTRLPF | 265.94 | HLA-B*5801 |
| GAINSSMPF | 7.71 | HLA-B*1501 | APFSKDNSV | 97.8 | HLA-B*0702 | GTFGPVHFR | 266.01 | HLA-A*0301 |
| YTLVSTKSW | 7.73 | HLA-B*5801 | YSSSLMWEI | 97.9 | HLA-B*5801 | FPFHKDNAV | 266.43 | HLA-B*0801 |
| SSFYRNLVW | 7.74 | HLA-B*5801 | YPKVYRTYF | 98 | HLA-B*0702 | WGIHHPSSI | 266.53 | HLA-B*0801 |
| MYQRCCNLF | 7.77 | HLA-A*2402 | EQITFMQAL | 98.1 | HLA-B*3901 | FVRTLFQQM | 266.57 | HLA-B*1501 |
| ELRSRYWAI | 7.89 | HLA-B*0801 | LTIIYSSSM | 98.5 | HLA-A*2601 | ATKRIRLAI | 266.72 | HLA-B*0801 |
| MMMGMFNML | 7.91 | HLA-A*0201 | YNAEILVAL | 98.6 | HLA-B*3901 | SLFSSIKKY | 267.05 | HLA-A*0301 |
| ISNEGSYFF | 7.92 | HLA-B*5801 | FHGAKEVSL | 98.6 | HLA-B*3901 | TKMEAILVV | 267.25 | HLA-B*3901 |
| WMMAMRYPI | 7.95 | HLA-B*0801 | SMRWLTLKL | 98.6 | HLA-B*0801 | NPKSKLFTL | 267.32 | HLA-B*0702 |
| MYQKCCNLF | 7.96 | HLA-A*2402 | ISFESNGNF | 98.8 | HLA-B*5801 | AEDIGNGCF | 267.37 | HLA-B*4001 |
| MPFHNVHPL | 7.98 | HLA-B*0702 | GQWDWPDG | 99 | HLA-A*0201 | QVIVDNSNW | 267.42 | HLA-B*5801 |
| SLFEKFFPS | 8.04 | HLA-A*0201 | FSVQRSLPF | 99 | HLA-B*5801 | LIGKTSWSY | 267.48 | HLA-B*1501 |
| FLGVWTYNA | 8.23 | HLA-A*0201 | MGYICSGVF | 99.1 | HLA-B*1501 | PSFFRNVVW | 267.51 | HLA-B*5801 |
| MPFHNIHPL | 8.31 | HLA-B*0702 | TEDNVYKIL | 99.4 | HLA-B*4001 | QAYTKIMYF | 267.64 | HLA-B*5801 |
| ALCGSPFPV | 8.32 | HLA-A*0201 | ITNKVNSVI | 99.5 | HLA-B*5801 | YQSGTYPVI | 267.64 | HLA-B*1501 |
| MKRKRNSSI | 8.36 | HLA-B*0801 | FPIGTAPIL | 99.5 | HLA-B*0702 | YVRQNTLKL | 267.65 | HLA-B*0801 |
| YQNNFVPVV | 8.42 | HLA-A*0201 | TLDFHDSSV | 99.5 | HLA-A*0201 | AMEHTSQYL | 267.81 | HLA-A*0201 |
| YQNNFVPVM | 8.42 | HLA-B*1501 | GTYDHNIYR | 99.6 | HLA-A*0301 | GVKLIQGYK | 267.98 | HLA-A*0301 |
| YQNSFVPVV | 8.44 | HLA-A*0201 | IYSTVSSSL | 99.7 | HLA-A*2402 | NILLHIASI | 268.2 | HLA-A*0201 |
| GWMDYYWGI | 8.45 | HLA-A*0201 | KFEFIVEKF | 99.8 | HLA-A*2402 | PSAPHGLCY | 268.26 | HLA-A*0101 |
| CEVNSWHIL | 8.5 | HLA-B*4001 | MVGLILAFI | 100 | HLA-A*0201 | FTIGECPRY | 268.33 | HLA-B*1501 |
| REEALLNRL | 8.53 | HLA-B*4001 | WPQSSPPTV | 100 | HLA-B*0702 | FSRLNWLTK | 268.35 | HLA-A*0301 |
| GSYVRLYLW | 8.54 | HLA-B*5801 | RLTQGRQTY | 101 | HLA-B*1501 | ITNKINSII | 268.47 | HLA-B*5801 |
| MQIRGFVYF | 8.72 | HLA-B*1501 | MMAMRYPIT | 101 | HLA-B*0801 | FALGQGTTL | 268.54 | HLA-B*3901 |
| DLIENLQAY | 8.75 | HLA-A*2601 | RANQRLNTM | 101 | HLA-B*1501 | CPFKGFFPF | 268.55 | HLA-B*0801 |
| FSVQRSLPF | 8.82 | HLA-B*1501 | FQNVNKVTY | 101 | HLA-B*1501 | STAASSLVL | 268.57 | HLA-B*1501 |
| MISPLAVTW | 8.83 | HLA-B*5801 | KRYERVKMF | 101 | HLA-B*2705 | FVRTLFQQM | 268.64 | HLA-B*0801 |
| AEIEDLIFL | 8.86 | HLA-B*4001 | NSVKLSSGY | 101 | HLA-A*2601 | GTYKILTIY | 268.67 | HLA-A*0301 |
| AEIEDLTFL | 8.92 | HLA-B*4001 | LISKTNQQF | 101 | HLA-B*1501 | RRVDVNPGH | 268.78 | HLA-B*2705 |
| FMQALQLLL | 9.01 | HLA-A*0201 | SSSFSFGGF | 101 | HLA-B*1501 | RPQVNGQSG | 268.85 | HLA-B*0702 |
| KEWSRRYEL | 9.09 | HLA-B*4001 | FIKDYRYTY | 101 | HLA-B*1501 | TQYREEALL | 269.01 | HLA-B*3901 |
| SMIEAESSV | 9.12 | HLA-A*0201 | WPDGALLPF | 101 | HLA-B*0702 | FIIKGRSHL | 269.31 | HLA-B*0801 |
| FPFHKDNAL | 9.17 | HLA-B*0702 | RLENVFAGK | 101 | HLA-A*0301 | GVKGFSFKY | 269.75 | HLA-A*0301 |
| SSFYAEMEW | 9.23 | HLA-B*5801 | NLLIGVSNV | 101 | HLA-A*0201 | FSFNGAFVA | 269.83 | HLA-A*0201 |
| RLSAGGHIW | 9.28 | HLA-B*5801 | TLNMHDANV | 101 | HLA-A*0201 | VPQAQNRGL | 269.94 | HLA-B*0702 |
| IMIAGLFFW | 9.42 | HLA-B*5801 | AMGLVFMCV | 101 | HLA-A*0201 | NMSKKKSYI | 270.08 | HLA-B*0801 |
| YSGAFMDYW | 9.44 | HLA-B*5801 | CRLSGIPPL | 102 | HLA-B*2705 | QSRFEAVAW | 270.22 | HLA-B*5801 |
| RVSAGGDIW | 9.47 | HLA-B*5801 | WHASNRPWI | 102 | HLA-B*3901 | GTSSVYIEV | 270.35 | HLA-A*0201 |
| REPFISCSI | 9.59 | HLA-B*4001 | WLGRTISPK | 102 | HLA-A*0301 | RILFIEEGK | 270.52 | HLA-A*0301 |
| IPSWAGNVL | 9.6 | HLA-B*0702 | FRYGNGVWI | 102 | HLA-B*3901 | ASTGGQAFY | 270.67 | HLA-A*0101 |
| NELGVSFHL | 9.71 | HLA-B*4001 | YRSMKWLTL | 102 | HLA-B*0801 | WGVHHSSSL | 270.71 | HLA-B*0801 |
| SWMKIYWHL | 9.8 | HLA-A*2402 | KTFQNVSPV | 102 | HLA-A*0201 | QVKLSSGYK | 270.73 | HLA-A*0301 |
| VSMCSSTEF | 9.86 | HLA-B*1501 | WTSNSIVVF | 102 | HLA-B*5801 | VQNRGLFGA | 271.16 | HLA-A*0201 |

Fig. 79-3

| Peptide | y (nM) | Allele | Peptide | Affinity (nM) | Allele | Peptide | Affinity (nM) | Allele |
|---|---|---|---|---|---|---|---|---|
| NMLSTVLGV | 9.91 | HLA-A*0201 | HMGECPKYV | 102 | HLA-A*0201 | RMQLRDNAK | 271.19 | HLA-A*0301 |
| AQNAISTTF | 10 | HLA-B*1501 | GLNVGLHLK | 102 | HLA-A*0301 | RTSYRTLLM | 271.23 | HLA-B*5801 |
| WEINGPESV | 10.1 | HLA-B*4001 | FHQCDNNCI | 103 | HLA-B*3901 | GTFDLGGLY | 271.24 | HLA-A*0301 |
| KEWSKRYEL | 10.1 | HLA-B*4001 | GTIHDRSPY | 103 | HLA-B*1501 | FIAPNRASF | 271.49 | HLA-B*0702 |
| YTLVSTKEW | 10.1 | HLA-B*5801 | TTMEKNVTV | 103 | HLA-A*0201 | SSSSFYAEM | 271.51 | HLA-B*1501 |
| QSGRVSFYW | 10.1 | HLA-B*5801 | GLIDGWYGY | 103 | HLA-B*1501 | LIFSARSAL | 271.61 | HLA-B*0801 |
| SEDGVYKAL | 10.1 | HLA-B*4001 | KLYGSGAKL | 103 | HLA-A*0201 | KVMYFHKGL | 271.98 | HLA-A*0201 |
| YSGSFVDYW | 10.3 | HLA-B*5801 | GLIAGWYGF | 103 | HLA-B*1501 | MKRKRNSSI | 272.37 | HLA-B*0702 |
| SWMKIYWSL | 10.3 | HLA-A*2402 | SPFRTLMSV | 103 | HLA-B*0702 | FSISCFLLA | 272.44 | HLA-A*0201 |
| KPNIGPRPL | 10.3 | HLA-B*0702 | FALGHGTTL | 103 | HLA-B*3901 | AIGDCPKYV | 272.45 | HLA-A*0201 |
| KSLCNVEGW | 10.3 | HLA-B*5801 | TTAVAVLKY | 103 | HLA-A*0101 | SVRNGTYKY | 272.52 | HLA-A*2601 |
| TLLENGVPV | 10.4 | HLA-A*0201 | RRMVQAMRA | 103 | HLA-B*2705 | RISHRTLLM | 272.52 | HLA-B*0801 |
| MEFEPFQSL | 10.4 | HLA-B*4001 | PTAPHGLCY | 103 | HLA-A*0101 | KTNDKYHQI | 272.98 | HLA-B*5801 |
| KPRGLFGAI | 10.5 | HLA-B*0702 | RCMKTFFGW | 103 | HLA-B*5801 | VLRPGQTLR | 273.19 | HLA-A*0301 |
| AIMMAGLSF | 10.5 | HLA-B*1501 | GPVHFRNQV | 103 | HLA-B*0702 | FQNVSPVWI | 273.52 | HLA-A*0201 |
| MYQKCCSLF | 10.5 | HLA-A*2402 | YRALVSWPL | 103 | HLA-B*2705 | SPGMMMGM | 273.67 | HLA-B*0702 |
| YRALMSVPL | 10.5 | HLA-B*3901 | RRSYFTAEV | 103 | HLA-B*2705 | WPDGANINL | 273.81 | HLA-B*3901 |
| SSFYRNLIW | 10.5 | HLA-B*5801 | LVLNKSLCK | 103 | HLA-A*0301 | RLATGLRNI | 273.89 | HLA-A*0201 |
| WILWISFAI | 10.6 | HLA-A*0201 | YPKVYRTYF | 104 | HLA-B*0801 | RSSFYAEMK | 273.9 | HLA-A*0301 |
| WEINGPDSV | 10.7 | HLA-B*4001 | MESGGIDKI | 104 | HLA-B*4001 | YQGRLCNPM | 273.9 | HLA-B*3901 |
| CETQCQTPL | 10.7 | HLA-B*4001 | WTSNSMVTF | 104 | HLA-A*2601 | IASMRRSYF | 274 | HLA-B*0801 |
| SSFYAEMKW | 10.7 | HLA-B*5801 | SPYRTLMSV | 104 | HLA-B*0702 | ASYKIFKSY | 274.17 | HLA-A*0301 |
| IMIAGLSFW | 10.7 | HLA-B*5801 | YQNNFVPVV | 104 | HLA-B*1501 | IFMARSALI | 274.29 | HLA-A*2402 |
| REPFVSCSI | 10.8 | HLA-B*4001 | GYKDIILWF | 104 | HLA-A*2402 | SLSLAIMVA | 274.61 | HLA-A*0201 |
| WVLWISFAI | 10.9 | HLA-A*0201 | REVEVVNAT | 104 | HLA-B*4001 | GRIDFHWML | 274.63 | HLA-B*2705 |
| SSFFRNMVW | 10.9 | HLA-B*5801 | SMRWLTLKL | 104 | HLA-B*1501 | RTELISPNK | 274.69 | HLA-A*0301 |
| KMNTQFTAV | 11 | HLA-A*0201 | FVRGQQGRM | 104 | HLA-A*2601 | GIYQILSIY | 274.82 | HLA-B*1501 |
| ATNPVVPSF | 11 | HLA-B*5801 | GFYRNLVWF | 104 | HLA-A*2402 | LAMITYITK | 274.84 | HLA-A*0301 |
| REESLLNRL | 11.1 | HLA-B*4001 | GLFGAIAGF | 104 | HLA-B*1501 | APYRSLIRF | 275.31 | HLA-B*0702 |
| SSFYSEMKW | 11.3 | HLA-B*5801 | GTIHDRAAF | 104 | HLA-B*1501 | GVRLTQGYK | 275.92 | HLA-A*0301 |
| NEIGVPFHL | 11.3 | HLA-B*4001 | GLSSRISFY | 104 | HLA-B*1501 | RPLVRSQSG | 275.92 | HLA-B*0702 |
| NELYGTQSL | 11.4 | HLA-B*4001 | WTSNSMVTF | 105 | HLA-B*5801 | ENKRYGPAL | 275.98 | HLA-B*0801 |
| KMNTQILVF | 11.4 | HLA-B*1501 | RLIQNSITI | 105 | HLA-A*0201 | LAIMIAGLF | 275.98 | HLA-B*1501 |
| GTIVSSLPF | 11.5 | HLA-B*1501 | GQRSWMKIY | 105 | HLA-B*1501 | VTRREVNYV | 276.05 | HLA-B*1501 |
| QELGDAPFL | 11.5 | HLA-B*4001 | NVWTYNAEL | 105 | HLA-A*0201 | MGYICSGIF | 276.08 | HLA-B*1501 |
| ETHIHIFSF | 11.5 | HLA-A*2601 | GQRSWMKLY | 105 | HLA-B*1501 | GVDSDTTSW | 276.09 | HLA-B*5801 |
| IEFEPFQSL | 11.5 | HLA-B*4001 | VMELIRMVK | 105 | HLA-A*0301 | NRIQIDPVK | 276.38 | HLA-B*2705 |
| RPVGISSMM | 11.5 | HLA-B*0702 | YQGRLCNPM | 105 | HLA-B*1501 | TFQNISPVW | 276.53 | HLA-A*2402 |
| MLLDPGDTV | 11.5 | HLA-A*0201 | KPQCHITGF | 105 | HLA-B*0702 | ISKDSRSGY | 276.73 | HLA-B*1501 |
| SSEAPGWSW | 11.6 | HLA-B*5801 | ALTLNTMTK | 105 | HLA-A*0301 | DRSPHRTLL | 276.79 | HLA-B*3901 |
| MPLHNIHPL | 11.7 | HLA-B*0702 | ITYGVCPRY | 106 | HLA-B*5801 | VAKDNAVRF | 276.91 | HLA-B*1501 |
| KLAAICTHL | 11.7 | HLA-A*0201 | GSNRPWLSF | 106 | HLA-B*1501 | KPFQNVNKI | 276.97 | HLA-B*0702 |
| APIEHVASM | 11.7 | HLA-B*0702 | LENQHTIDL | 106 | HLA-B*4001 | CIASSTVMV | 277.27 | HLA-A*0201 |
| FQNASRHHM | 11.9 | HLA-B*1501 | LMDSLKLSI | 106 | HLA-A*0201 | LITVGSSKY | 277.33 | HLA-B*1501 |
| IMVAGLSFW | 12 | HLA-B*5801 | KCIKTFFGW | 106 | HLA-B*5801 | NLVAPRGHY | 277.71 | HLA-B*1501 |
| YYNETFVNI | 12 | HLA-A*2402 | YTRLYIWGV | 106 | HLA-A*0201 | LWMCSNGSY | 277.78 | HLA-B*1501 |
| RLCNPLNPF | 12.1 | HLA-B*1501 | LPFHNVHPL | 106 | HLA-B*3901 | FEATGNLVA | 277.99 | HLA-B*3901 |
| IEVTNATEL | 12.1 | HLA-B*4001 | APLSKDNSI | 106 | HLA-B*0702 | IITGTIKSW | 278.12 | HLA-B*5801 |
| AQMALQLFI | 12.1 | HLA-A*0201 | CTINSWHIF | 106 | HLA-A*2601 | KLSSGYKDV | 278.2 | HLA-A*0201 |
| TLLEKNVTV | 12.1 | HLA-A*0201 | RREIHIYYL | 106 | HLA-B*2705 | LEENTTYKI | 278.23 | HLA-B*4001 |
| MLLAIAMGL | 12.1 | HLA-A*0201 | GRMDYYWAI | 106 | HLA-A*0201 | IFMARSALI | 278.33 | HLA-B*0801 |
| SWMKIYWYL | 12.1 | HLA-A*2402 | IAWSSSSCY | 106 | HLA-B*1501 | VSNSDWSGY | 279.53 | HLA-A*0101 |
| YVWWASNSL | 12.3 | HLA-A*0201 | KEMCAAWSS | 106 | HLA-B*4001 | RGLQRRRFV | 279.59 | HLA-B*0801 |
| SVLNLLIGV | 12.3 | HLA-A*0201 | RVWWTSNSI | 106 | HLA-A*0201 | LHDSNVKNL | 279.68 | HLA-B*3901 |
| TLSEQNVPV | 12.3 | HLA-A*0201 | ATATVYYNK | 107 | HLA-A*0301 | MARLGRGYM | 279.68 | HLA-B*1501 |
| HLFSGIRSF | 12.3 | HLA-B*1501 | KRIENLNKK | 107 | HLA-B*2705 | NELYGTQSL | 279.82 | HLA-B*3901 |
| ALISWEMGL | 12.4 | HLA-A*0201 | HQSGTYPII | 107 | HLA-B*3901 | YSLVGVDPF | 279.95 | HLA-B*1501 |
| YRALISWPL | 12.4 | HLA-B*3901 | ALGDCPKYI | 107 | HLA-A*0201 | QTAAQRAMM | 280.02 | HLA-A*2601 |
| FHNVHPFTI | 12.4 | HLA-B*3901 | TIINNYYNK | 107 | HLA-A*0301 | MGNGCFTIY | 280.16 | HLA-B*1501 |
| GAVNSSMPF | 12.5 | HLA-B*1501 | IYSTVASSL | 107 | HLA-A*2402 | SQTVINNYY | 280.46 | HLA-B*1501 |
| LLKHRFEII | 12.5 | HLA-B*0801 | MQFSSLTVS | 107 | HLA-B*1501 | YLSGREWSY | 280.5 | HLA-B*1501 |

Fig. 79-4

| Peptide | y (nM) | Allele | Peptide | Affinity (nM) | Allele | Peptide | Affinity (nM) | Allele |
|---|---|---|---|---|---|---|---|---|
| KPRPRRGLF | 12.5 | HLA-B*0702 | NPNQKLFAL | 107 | HLA-B*0801 | NPSLRMKWM | 280.82 | HLA-B*0702 |
| ISMCSSTEF | 12.5 | HLA-B*5801 | WISFSISCF | 107 | HLA-B*1501 | ITDTFKSWK | 281.16 | HLA-A*0301 |
| FVANFSMEL | 12.6 | HLA-A*0201 | FSFGASCFL | 107 | HLA-A*0201 | ISFSMSCFV | 281.43 | HLA-A*0201 |
| VLMENEMTL | 12.6 | HLA-A*0201 | HHAVANGTV | 107 | HLA-A*0201 | SWLGRTISK | 281.56 | HLA-A*0301 |
| QAGRMTFYW | 12.6 | HLA-B*5801 | QTLVANNDW | 107 | HLA-B*5801 | FQNTSRHYM | 281.59 | HLA-B*3901 |
| VMVGLILAF | 12.6 | HLA-B*1501 | KQIGNVINW | 107 | HLA-B*5801 | WSWHDGAIL | 281.7 | HLA-B*3901 |
| GIMNTSKPF | 12.7 | HLA-B*1501 | CSNDTINYY | 108 | HLA-A*0101 | NPNQKIMCI | 281.85 | HLA-B*0801 |
| GSFYRSMRW | 12.7 | HLA-B*5801 | KAGFIEGGW | 108 | HLA-B*5801 | TLMDALLGD | 281.91 | HLA-A*0201 |
| APIEHIASM | 12.7 | HLA-B*0702 | FSYKYGNGV | 108 | HLA-A*0201 | CSIDECRTF | 281.99 | HLA-B*1501 |
| GALNTTLPF | 12.7 | HLA-B*1501 | IILWISFSM | 108 | HLA-A*0201 | ALILVALAL | 282.01 | HLA-A*0201 |
| KMNTQFETV | 12.8 | HLA-A*0201 | QTLVSNNDW | 108 | HLA-B*5801 | HSGICPVVF | 282.09 | HLA-B*5801 |
| LTITYSSPM | 12.9 | HLA-B*1501 | LLAIVMGLV | 108 | HLA-A*0201 | ALTGGQSFY | 282.09 | HLA-B*1501 |
| TLDEHDANV | 13 | HLA-A*0201 | CPFRGFFPF | 108 | HLA-B*0702 | QTYDWTLNR | 282.22 | HLA-A*0301 |
| SSFFRNVVW | 13 | HLA-B*5801 | VIITREPYV | 108 | HLA-A*0201 | GTYKILTIY | 282.3 | HLA-B*1501 |
| GVMNTSKPF | 13 | HLA-B*1501 | AVKLSSGYK | 108 | HLA-A*0301 | FVYFVEILA | 282.44 | HLA-A*0201 |
| FIDVWTYNA | 13 | HLA-A*0201 | ALRELWQCY | 108 | HLA-B*1501 | SQYREEALL | 282.53 | HLA-B*3901 |
| LQNASRHYM | 13.1 | HLA-B*1501 | YVNVRSLKL | 108 | HLA-B*0801 | RLPLPLCPF | 282.66 | HLA-B*1501 |
| WTSSSSTVF | 13.2 | HLA-B*1501 | TVLSIIALL | 109 | HLA-A*0201 | TMDYYWGIL | 282.67 | HLA-B*3901 |
| ALFVYSLRK | 13.2 | HLA-A*0301 | ILKGKFQTA | 109 | HLA-B*0801 | KSRVDNHSM | 282.94 | HLA-B*1501 |
| LAATVTLHF | 13.4 | HLA-B*5801 | CHSGICPVV | 109 | HLA-B*3901 | MFLAMITYI | 282.97 | HLA-A*0201 |
| IIYSSSMMW | 13.4 | HLA-B*5801 | SFQVDCFLW | 109 | HLA-A*2402 | VTFSFNGAF | 283.04 | HLA-B*5801 |
| WMMAMRYPI | 13.5 | HLA-B*3901 | APSPYNSKF | 109 | HLA-B*0702 | QNRIRIDPV | 283.08 | HLA-B*0801 |
| SSFYRNVVW | 13.5 | HLA-B*5801 | LRSLFSSIK | 109 | HLA-B*2705 | AEDRGNGCF | 283.08 | HLA-B*4001 |
| KSLCKVEGW | 13.5 | HLA-B*5801 | FMYSDFHFI | 109 | HLA-B*1501 | IMFESNGGL | 283.17 | HLA-B*1501 |
| MYQKCCTLF | 13.6 | HLA-A*2402 | FGRINFHWL | 109 | HLA-B*0801 | VASSLALAI | 283.28 | HLA-B*5801 |
| FLWCKIVTT | 13.6 | HLA-A*0201 | ITFESNGGF | 109 | HLA-B*1501 | VLIAGGLIL | 283.36 | HLA-A*0201 |
| KMNTQFEAV | 13.6 | HLA-A*0201 | GQKSWTKIY | 109 | HLA-B*1501 | KPRPRRGLF | 283.4 | HLA-B*0801 |
| FVFSSAASY | 13.7 | HLA-B*1501 | TSFFYRYGF | 110 | HLA-B*5801 | KILFIEEGK | 283.45 | HLA-A*0301 |
| VQNAISTTF | 13.7 | HLA-B*1501 | TLDFHDSNV | 110 | HLA-A*0201 | RRGLFGAIA | 283.48 | HLA-B*2705 |
| QVDCFLWHV | 13.8 | HLA-A*0201 | FFRNMIWLI | 110 | HLA-A*2402 | STAASSLAL | 283.55 | HLA-B*0702 |
| MLSKSLCKV | 13.8 | HLA-A*0201 | GMILSVVSL | 110 | HLA-A*0201 | NEEALRQII | 283.71 | HLA-B*4001 |
| NEGNGCFEL | 13.8 | HLA-B*4001 | HRLCYPGEL | 110 | HLA-B*3901 | IYSTAASSL | 283.86 | HLA-A*2402 |
| CEITGFAPF | 13.9 | HLA-B*4001 | YMNVKSLKL | 110 | HLA-A*0201 | ITFLQALQL | 283.93 | HLA-B*5801 |
| FTIGECPRY | 14 | HLA-A*2601 | QVDCFIWHI | 110 | HLA-A*0201 | MLGFVFTLT | 283.98 | HLA-A*0201 |
| KSLCKIEGW | 14 | HLA-B*5801 | KMNTKILVL | 110 | HLA-A*0201 | VTTVTLHFK | 283.98 | HLA-A*0301 |
| SLIRFPIGV | 14 | HLA-A*0201 | VPFSKDNSI | 110 | HLA-B*0702 | THNGKLCRL | 284.02 | HLA-B*3901 |
| IEVVAAQEL | 14 | HLA-B*4001 | KRLENLNKK | 111 | HLA-B*2705 | YLSTNSTET | 284.03 | HLA-A*0201 |
| CFMYSDFHF | 14 | HLA-A*2402 | SVKNGTYEY | 111 | HLA-A*2601 | YVRKASLRL | 284.24 | HLA-B*1501 |
| SWMKLYWHL | 14 | HLA-A*2402 | SMELPSFGV | 111 | HLA-A*0201 | AIWTSSSSI | 284.27 | HLA-B*1501 |
| GPATAQMAL | 14.1 | HLA-B*0702 | RIRRDQKSL | 112 | HLA-B*0702 | RQASPSCLV | 284.47 | HLA-A*0201 |
| MLADWVDDA | 14.1 | HLA-A*0201 | NRFQIQGIK | 112 | HLA-B*2705 | MENEMTLDF | 284.51 | HLA-B*4001 |
| YVWWTSNSL | 14.1 | HLA-A*0201 | FMQALQLLL | 112 | HLA-B*3901 | SLISWPLSS | 284.86 | HLA-A*0201 |
| HTKYRTESL | 14.2 | HLA-B*0801 | KTGTYDYPK | 112 | HLA-A*0301 | TPKRNRSIL | 285.25 | HLA-B*0801 |
| TLFEKFFPS | 14.2 | HLA-A*0201 | MVTQRTMGK | 112 | HLA-A*0301 | QSYFQLFLV | 285.45 | HLA-A*0201 |
| FQNASRHYM | 14.2 | HLA-B*1501 | WMKLYWHLM | 112 | HLA-B*1501 | GVMNTSKPL | 285.8 | HLA-B*1501 |
| ILDEHDSNV | 14.2 | HLA-A*0201 | MRPCFWVEL | 112 | HLA-B*3901 | QTRRSFELK | 285.96 | HLA-A*0301 |
| ILFASATAI | 14.3 | HLA-A*0201 | YKGRLCNPL | 112 | HLA-B*3901 | QFGRIDFHW | 286.01 | HLA-A*2402 |
| FHNIHPLAI | 14.3 | HLA-B*3901 | GTYCSLNGV | 112 | HLA-A*0201 | KAVRGDLNF | 286.01 | HLA-B*1501 |
| DAVKLSSGY | 14.4 | HLA-A*2601 | RLFTIRQEM | 112 | HLA-B*1501 | VTNKVNSII | 286.02 | HLA-B*5801 |
| LTIAMGLVF | 14.4 | HLA-B*1501 | CTINSWHIY | 112 | HLA-B*5801 | AIDGVTNKV | 286.08 | HLA-A*0201 |
| SMSCFVFVA | 14.4 | HLA-A*0201 | LIFSARSAL | 112 | HLA-B*1501 | LRSKYWAIR | 286.12 | HLA-B*2705 |
| IASSGTLEF | 14.4 | HLA-B*5801 | HIMIWHSNL | 112 | HLA-B*0801 | FQNISPVWI | 286.32 | HLA-A*0201 |
| IILWFSFSI | 14.5 | HLA-A*0201 | LMSCPLGEA | 113 | HLA-A*0201 | ITYGACPKY | 286.33 | HLA-B*5801 |
| YRALVSWPL | 14.5 | HLA-B*3901 | TVSSSLVLV | 113 | HLA-A*0201 | KRNEIKGVK | 286.58 | HLA-B*2705 |
| NELGVPFHL | 14.5 | HLA-B*4001 | IMMAGLSFW | 113 | HLA-B*1501 | SVKNGTYNY | 286.66 | HLA-A*2601 |
| FHNVHPLAI | 14.6 | HLA-B*3901 | IMMAGLSFW | 113 | HLA-A*0201 | KSCVNRCFY | 286.87 | HLA-B*5801 |
| SEDNVYKAL | 14.6 | HLA-B*4001 | FKSWKGNIM | 113 | HLA-B*3901 | LLNASCAAM | 287.14 | HLA-B*1501 |
| GSFYRNMRW | 14.7 | HLA-B*5801 | MIALILVAL | 113 | HLA-A*0201 | TYVNNTTII | 287.15 | HLA-A*2402 |
| ELRSKYWAI | 14.7 | HLA-B*0801 | YQAKFESVA | 113 | HLA-B*1501 | KEGYSLVGV | 287.22 | HLA-B*4001 |
| SSFFRNIVW | 14.8 | HLA-B*5801 | VTFIFNGAF | 113 | HLA-B*1501 | ALLIGIGNL | 287.36 | HLA-A*0201 |
| KTMTITFLI | 14.8 | HLA-A*0201 | WTSGSSISF | 113 | HLA-B*5801 | FYRNLIWFV | 287.5 | HLA-A*2402 |

Fig. 79-5

| Peptide | y (nM) | Allele | Peptide | Affinity (nM) | Allele | Peptide | Affinity (nM) | Allele |
|---|---|---|---|---|---|---|---|---|
| YSGSFMDYW | 14.8 | HLA-B*5801 | HLECRTFFL | 114 | HLA-B*0801 | SSFEQITFM | 287.63 | HLA-B*1501 |
| FQNIDSWAV | 14.9 | HLA-A*0201 | KTWARNILR | 114 | HLA-A*0301 | FIEGGWQGL | 287.68 | HLA-A*0201 |
| FHDSNVKSL | 14.9 | HLA-B*3901 | TINYYNETF | 114 | HLA-B*1501 | RSLMLATGM | 287.87 | HLA-B*5801 |
| YRSLISWPL | 15 | HLA-B*3901 | NPNQKTITI | 114 | HLA-B*0702 | KMNTQFEAI | 288.18 | HLA-B*1501 |
| QSGRISFYW | 15.1 | HLA-B*5801 | LFVQSYFQL | 114 | HLA-A*2402 | RQTRGLFGA | 288.27 | HLA-A*0201 |
| LLNKSLCSV | 15.2 | HLA-A*0201 | MSIGVTVIK | 114 | HLA-A*0301 | RTLLAKSVF | 288.4 | HLA-B*1501 |
| NELGIPFHL | 15.2 | HLA-B*4001 | SRSGFEVLL | 114 | HLA-B*3901 | GRNCTIPCF | 288.62 | HLA-B*2705 |
| DSVKLSSGY | 15.3 | HLA-A*2601 | TSYKILSIY | 114 | HLA-B*1501 | LTDAEMNKL | 288.69 | HLA-A*0101 |
| LVRGNSPAF | 15.3 | HLA-B*1501 | RMFALSQGT | 114 | HLA-A*0201 | IRMATNECR | 288.9 | HLA-B*2705 |
| FGYFGIFFV | 15.4 | HLA-A*0201 | GIHHPSSTK | 114 | HLA-A*0301 | KVLSIYSCI | 288.94 | HLA-A*0201 |
| YQRSKFLLM | 15.5 | HLA-B*1501 | GPTECRTFF | 114 | HLA-B*0702 | LYGTQPLSI | 289.22 | HLA-A*2402 |
| IQIIKLLPF | 15.5 | HLA-B*1501 | ETFKVIGGW | 114 | HLA-A*2601 | QAYQKRMGL | 289.24 | HLA-B*0801 |
| YRYTYRCHK | 15.6 | HLA-B*2705 | SRMQFSSLA | 114 | HLA-B*2705 | KLYGSGSKL | 289.33 | HLA-A*0201 |
| YMNTALLNA | 15.6 | HLA-A*0201 | HQNGQGSGY | 115 | HLA-B*1501 | SMGIYQILA | 289.33 | HLA-A*0201 |
| RSMKWLTLK | 15.9 | HLA-A*0301 | GTKQVCMAW | 115 | HLA-B*5801 | SSFQVDCFI | 289.63 | HLA-B*5801 |
| TELGSPLVL | 16 | HLA-B*4001 | CSNNTTNYY | 115 | HLA-B*1501 | ELRRQKSLI | 289.67 | HLA-B*0801 |
| RSMRWLTLK | 16.1 | HLA-A*0301 | WMKIYWHLM | 115 | HLA-B*1501 | VTDSEMNRL | 289.7 | HLA-A*0101 |
| GSINTRLPF | 16.2 | HLA-B*1501 | RRNKYLEEH | 115 | HLA-B*2705 | TTYKILSIY | 289.72 | HLA-A*0301 |
| IPSWAGNIL | 16.2 | HLA-B*0702 | KRINMISDK | 115 | HLA-B*2705 | EVCLKWELM | 289.77 | HLA-A*2601 |
| NELGVPFNL | 16.2 | HLA-B*4001 | SIHECRTFF | 115 | HLA-B*1501 | LPVSGGTSS | 290.33 | HLA-B*0702 |
| FQNVSRYAF | 16.2 | HLA-B*1501 | SQYLCTGVL | 115 | HLA-B*1501 | CSISECRTF | 290.42 | HLA-B*5801 |
| YRNLIWLVK | 16.2 | HLA-B*2705 | RSRSGFEVL | 115 | HLA-B*0702 | SVRNGTYNY | 290.51 | HLA-A*2601 |
| MSFQGRGVF | 16.3 | HLA-B*1501 | HLMIWHSNL | 115 | HLA-A*0201 | WFRNVLSVA | 290.69 | HLA-B*0801 |
| IPKRNRSIL | 16.3 | HLA-B*0702 | VTKENTGSY | 116 | HLA-B*1501 | RRLTTTIKP | 290.72 | HLA-B*2705 |
| GTINSPLPF | 16.3 | HLA-B*1501 | KWWVWLWLV | 116 | HLA-A*2402 | VILEENTTY | 291.07 | HLA-B*1501 |
| FTIGECPKY | 16.3 | HLA-A*2601 | ALMSVPLGS | 116 | HLA-A*0201 | ISSMVEAMM | 291.17 | HLA-B*5801 |
| KTMTITFLI | 16.4 | HLA-B*5801 | TYINNATII | 116 | HLA-A*2402 | NTFGDCPKY | 291.29 | HLA-A*2601 |
| RSYNNTSGK | 16.5 | HLA-A*0301 | HLTDSEMNK | 116 | HLA-A*0301 | DSLTEIWSY | 291.32 | HLA-A*2601 |
| SSTEFLGQW | 16.5 | HLA-B*5801 | YVRKASLRL | 116 | HLA-B*0801 | EMLKVPNAL | 291.35 | HLA-B*3901 |
| LLDVWTYNA | 16.5 | HLA-A*0201 | KLKTEDNIY | 116 | HLA-B*1501 | ETGYVCGKF | 291.37 | HLA-A*2601 |
| FSVQRNLPF | 16.5 | HLA-B*1501 | VASSGNLEF | 116 | HLA-B*1501 | YLIGKTSWS | 291.49 | HLA-A*0201 |
| LPFHNVHPL | 16.6 | HLA-B*0702 | AMTHTSQYI | 117 | HLA-A*0201 | LLQSAILSL | 291.67 | HLA-B*1501 |
| SEFNKACEL | 16.6 | HLA-B*4001 | NRFYRTCKL | 117 | HLA-B*3901 | YTMDTVNRT | 291.89 | HLA-A*0201 |
| RLAAAGDIW | 16.6 | HLA-B*5801 | LIFMARSAL | 117 | HLA-B*1501 | YKMNTQILV | 291.98 | HLA-B*3901 |
| HLFSGIKSF | 16.6 | HLA-B*1501 | TTTPTKSYF | 117 | HLA-B*5801 | ISSMVEAMI | 292.18 | HLA-B*5801 |
| LLNKSLCNV | 16.7 | HLA-A*0201 | SVKNGTYYY | 117 | HLA-A*2601 | VETYVLSVI | 292.36 | HLA-B*4001 |
| FSFGASCFV | 16.8 | HLA-A*0201 | AIAMGLVFI | 117 | HLA-A*0201 | RGRHANGTI | 292.62 | HLA-B*0702 |
| VASSLVLLF | 16.8 | HLA-B*5801 | KILCASATA | 117 | HLA-A*0201 | SRSPGNAEI | 292.81 | HLA-B*3901 |
| FIFNGAFIA | 16.9 | HLA-A*0201 | WTSNSIISM | 117 | HLA-B*1501 | GQWNWPDG | 292.88 | HLA-A*0201 |
| QSGRIDFYW | 17 | HLA-B*5801 | KQVDTIMEK | 117 | HLA-A*0301 | SVREKDMTK | 292.94 | HLA-A*0301 |
| YYNGRSSFF | 17 | HLA-A*2402 | NEDGDIIFL | 117 | HLA-B*4001 | YRGRLCNPL | 292.96 | HLA-B*2705 |
| LMNELGVPL | 17 | HLA-A*0201 | HRLCYPGEL | 118 | HLA-B*2705 | LNRLNINSV | 293.03 | HLA-B*0801 |
| REILTRTTV | 17 | HLA-B*4001 | YRSLIRFPV | 118 | HLA-B*2705 | HSNDQGAGY | 293.08 | HLA-A*2601 |
| RMADSIKSW | 17 | HLA-B*5801 | VLKPGQTVK | 118 | HLA-A*0301 | FSDNGGLIA | 293.35 | HLA-A*0101 |
| AIMVAGLSF | 17.1 | HLA-B*1501 | IITDTIRSW | 118 | HLA-B*5801 | VYQAKFESV | 293.74 | HLA-A*2402 |
| LPFHNIHPL | 17.4 | HLA-B*0702 | DVFAIREPF | 118 | HLA-A*2601 | FSFGASCLI | 294 | HLA-B*3901 |
| RLSAGGAIW | 17.4 | HLA-B*5801 | CIASSTVLV | 118 | HLA-A*0201 | TSCFDGKEW | 294.01 | HLA-B*5801 |
| AQIIKLLPF | 17.4 | HLA-B*1501 | WMMAMKYPI | 118 | HLA-B*1501 | RPITEINTW | 294.07 | HLA-B*5801 |
| GTITSNLPF | 17.4 | HLA-B*1501 | FQNVNKITY | 118 | HLA-B*1501 | KLAIGPRNV | 294.17 | HLA-A*0201 |
| LTITYSSSM | 17.5 | HLA-B*1501 | SHYREEALL | 118 | HLA-B*3901 | YIKQGSLKL | 294.18 | HLA-B*0801 |
| FQNTSRHYM | 17.5 | HLA-B*1501 | SLGAISFWM | 118 | HLA-A*0201 | NMRCTISLV | 294.66 | HLA-B*0801 |
| FIDIWTYNA | 17.5 | HLA-A*0201 | REQKQEFKM | 118 | HLA-B*4001 | ITNKANSII | 295.55 | HLA-B*5801 |
| FYRNVVWLI | 17.5 | HLA-A*2402 | SINWLTKKK | 119 | HLA-A*0301 | GQLKLATGL | 295.6 | HLA-A*0201 |
| WMMAMKYPI | 17.6 | HLA-B*3901 | MSIGITVIK | 119 | HLA-A*0301 | FIAPENAYK | 295.92 | HLA-A*0301 |
| NSFFSRLNW | 17.7 | HLA-B*5801 | AQAFYKILK | 119 | HLA-A*0301 | ILSVYSTVA | 296.01 | HLA-A*0201 |
| MLNKSLCKV | 17.7 | HLA-A*0201 | CSNDTINYY | 119 | HLA-B*5801 | ISLVKTTLF | 296.34 | HLA-B*1501 |
| FQRSKFLLM | 17.7 | HLA-B*1501 | RPVDGTGSC | 119 | HLA-B*0702 | RVSFYWTIV | 296.35 | HLA-A*0201 |
| MPFHNVHPF | 17.8 | HLA-B*0702 | TYQNNFVPV | 119 | HLA-A*2402 | YQILAIYAT | 296.42 | HLA-A*0201 |
| CETKCQTPL | 17.8 | HLA-B*4001 | GRVSFYWTI | 119 | HLA-B*2705 | KSCLPACIY | 296.57 | HLA-B*5801 |
| MLNASCAAM | 17.8 | HLA-B*1501 | LQIISLCSI | 120 | HLA-B*1501 | VPKRNRSIL | 296.59 | HLA-B*0801 |
| NELGVPLHL | 17.8 | HLA-B*4001 | CQMEKIVLL | 120 | HLA-B*3901 | YQKRMGVQL | 296.63 | HLA-B*3901 |

Fig. 79-6

| Peptide | y (nM) | Allele | Peptide | Affinity (nM) | Allele | Peptide | Affinity (nM) | Allele |
|---|---|---|---|---|---|---|---|---|
| SQSGRISFY | 17.8 | HLA-B*1501 | SLGAVSFWM | 120 | HLA-A*0201 | MEWLKTRPI | 297.01 | HLA-B*0801 |
| RLIDFLKDV | 17.9 | HLA-A*0201 | WTGLIDGWY | 120 | HLA-A*0101 | VMKRKRNSS | 297.52 | HLA-B*0801 |
| ALANTIEVF | 18.2 | HLA-B*1501 | GSIQSDKPF | 120 | HLA-B*1501 | TTIKTWAGK | 297.82 | HLA-A*0301 |
| WEVNGPESV | 18.2 | HLA-B*4001 | EMWSYNAEL | 121 | HLA-A*0201 | STVSSFERF | 297.84 | HLA-A*2601 |
| FVFSNAASY | 18.2 | HLA-B*1501 | FIEGGWPGL | 121 | HLA-A*0201 | FRGLMSTPL | 297.86 | HLA-B*2705 |
| GMMMGMFNM | 18.2 | HLA-A*0201 | REEAMQNRV | 121 | HLA-B*4001 | RLIQNSMTI | 297.9 | HLA-B*1501 |
| GAINSSKPF | 18.3 | HLA-B*1501 | YRSLIKFPI | 121 | HLA-B*2705 | SECVCHNGV | 298 | HLA-B*4001 |
| FVALILGFV | 18.3 | HLA-A*0201 | IYSTISSSL | 121 | HLA-A*2402 | KTNKQFELI | 298.01 | HLA-B*5801 |
| KLASGLRNV | 18.4 | HLA-A*0201 | PSFYRNLLW | 121 | HLA-B*5801 | AQTDCVLEA | 298.13 | HLA-A*0201 |
| SLRGRGSTL | 18.5 | HLA-B*0801 | RIGSRGHIF | 121 | HLA-B*1501 | IAPNRASFF | 298.31 | HLA-B*1501 |
| NELGVPFYL | 18.5 | HLA-B*4001 | GYKEIILWF | 121 | HLA-A*2402 | RGNPGVKG | 298.35 | HLA-B*5801 |
| SKYHWNLAL | 18.6 | HLA-B*3901 | VLKPGETLK | 121 | HLA-A*0301 | MTRGLFGAI | 298.48 | HLA-B*0801 |
| REILTKITV | 18.6 | HLA-B*4001 | EPFISCSPL | 121 | HLA-B*0702 | SPHRSLMSC | 298.59 | HLA-B*0702 |
| AQNAISITF | 18.7 | HLA-B*1501 | RLTTTIKTW | 121 | HLA-B*5801 | MQFSSLTVN | 298.7 | HLA-B*1501 |
| MIWDANGWV | 18.8 | HLA-A*0201 | CTINSWHIY | 121 | HLA-B*1501 | SRLNRNEIK | 298.77 | HLA-B*2705 |
| ITCVCRDNW | 18.8 | HLA-B*5801 | QAYTKIMYF | 121 | HLA-B*1501 | WTRDSVTEL | 298.81 | HLA-B*1501 |
| NSFYAELKW | 18.8 | HLA-B*5801 | LASCMGLIY | 121 | HLA-B*1501 | GRIDFHWLL | 299.13 | HLA-B*3901 |
| RMSDSIKSW | 18.9 | HLA-B*5801 | VYQARFESV | 122 | HLA-A*2402 | SECVCHKGI | 299.32 | HLA-B*4001 |
| CETRCQTPL | 18.9 | HLA-B*4001 | RGRGSTLGL | 122 | HLA-B*0702 | TTYRILSIY | 299.73 | HLA-A*0101 |
| GTSKVKMKW | 18.9 | HLA-B*5801 | ITDIWTYQA | 122 | HLA-A*0101 | NTGSYVRLY | 299.74 | HLA-A*0101 |
| NHEGEGIPL | 18.9 | HLA-B*3901 | ASNRPWVSF | 122 | HLA-B*1501 | MSSVKNGTY | 299.97 | HLA-B*1501 |
| RPWVRGLSS | 19 | HLA-B*0702 | HHAVANGTI | 122 | HLA-B*3901 | FIIKGRSHL | 300.02 | HLA-B*1501 |
| KMNTQFDAV | 19.1 | HLA-A*0201 | RIDYYWSFL | 122 | HLA-A*0201 | ARNIVRRAI | 300.07 | HLA-B*2705 |
| DAVTDIWSY | 19.2 | HLA-A*2601 | ILVLGLSMV | 122 | HLA-A*0201 | NPNQKIITI | 300.15 | HLA-B*0801 |
| IILWISFSI | 19.2 | HLA-A*0201 | TLTEKGVEV | 122 | HLA-A*0201 | KPFQNVNKV | 300.31 | HLA-B*0702 |
| LAATVTLHF | 19.2 | HLA-B*1501 | TRFTYSGIR | 122 | HLA-B*2705 | RIGDGQRSW | 300.56 | HLA-B*5801 |
| KMEDGFLDV | 19.3 | HLA-A*0201 | FNMERIKEL | 123 | HLA-B*0801 | SRMQFSSLT | 300.61 | HLA-B*2705 |
| QESSCTCIL | 19.4 | HLA-B*4001 | KCIRTFFGW | 123 | HLA-B*5801 | RSRSGFEML | 300.64 | HLA-B*0702 |
| TLKSGQFPV | 19.5 | HLA-A*0201 | YSGSFTLPV | 123 | HLA-A*0201 | NSTWVSQTY | 301.29 | HLA-A*0101 |
| QTGRIDFHW | 19.5 | HLA-B*5801 | LVAPSRVSK | 123 | HLA-A*0301 | ILKIRKGKI | 301.32 | HLA-B*0801 |
| LVISSDLSY | 19.6 | HLA-B*1501 | FQNVSRIAI | 123 | HLA-B*3901 | HLTGIWDTL | 301.52 | HLA-A*0201 |
| MKRKRDSSI | 19.6 | HLA-B*0801 | YNAELLVAL | 123 | HLA-B*3901 | GAMASQGTK | 301.57 | HLA-A*0301 |
| ATNPIVPSF | 19.7 | HLA-B*5801 | CPFQGFFPV | 123 | HLA-B*0702 | YTGAINSSK | 301.69 | HLA-A*0301 |
| GSFYRSIRW | 19.7 | HLA-B*5801 | TLTERGVEV | 123 | HLA-A*0201 | YAFGNCPKY | 302.01 | HLA-A*2601 |
| YVKQKTLKL | 19.8 | HLA-B*0801 | SIKNGTYDY | 123 | HLA-B*1501 | VMGLVFFCL | 302.1 | HLA-A*0201 |
| IEVVTAQEL | 19.8 | HLA-B*4001 | RTYNNTTGR | 124 | HLA-A*0301 | VLATGLRNA | 302.31 | HLA-A*0201 |
| DTKVDLWSY | 19.9 | HLA-A*2601 | AEQFTWNGV | 124 | HLA-B*4001 | GSIPNDKPF | 302.48 | HLA-B*1501 |
| NVYKVLAIY | 20 | HLA-A*2601 | IEECSCYGV | 124 | HLA-B*4001 | GSIKTKLPF | 302.64 | HLA-B*5801 |
| VASSGTLEF | 20 | HLA-B*5801 | KLSQMSKEV | 124 | HLA-A*0201 | AAWSSSSCF | 302.87 | HLA-B*5801 |
| MGYKDIILW | 20.1 | HLA-B*5801 | THFEKIKIL | 124 | HLA-B*3901 | FQNVSPLWI | 302.89 | HLA-A*0201 |
| RLSAGGSIW | 20.1 | HLA-B*5801 | YSLVGIDPF | 124 | HLA-B*5801 | YINTAMLNA | 303.11 | HLA-A*0201 |
| KLATGLKNV | 20.1 | HLA-A*0201 | CPFKGFFPF | 124 | HLA-B*0702 | GTSSVYVEV | 303.23 | HLA-A*0201 |
| FHNIHPLTI | 20.2 | HLA-B*3901 | FSFGASCFI | 124 | HLA-A*0201 | KMNTQFTAV | 303.26 | HLA-B*1501 |
| SVLVNTYQW | 20.2 | HLA-B*5801 | GLLLQITSL | 124 | HLA-A*0201 | IQHPELTGL | 303.31 | HLA-A*0201 |
| CPVKGWAPL | 20.3 | HLA-B*0702 | MLSLIMRTV | 124 | HLA-A*0201 | RSWKKQILR | 303.42 | HLA-A*0301 |
| NLFEKFFPS | 20.3 | HLA-A*0201 | WIGECPKYV | 124 | HLA-A*0201 | VMTDGPANK | 303.43 | HLA-A*0301 |
| LIRGNSPVF | 20.4 | HLA-B*1501 | VAWSSTSCF | 124 | HLA-B*5801 | YARLYIWGV | 303.66 | HLA-A*0201 |
| GVINTSKPF | 20.4 | HLA-B*1501 | ALRMKWMMA | 124 | HLA-B*0801 | SISCFLLIA | 303.68 | HLA-A*0201 |
| REPFISCSV | 20.6 | HLA-B*4001 | CKLNGIPPL | 124 | HLA-B*3901 | EMKWLLSSK | 303.82 | HLA-A*0301 |
| GELNNNGEL | 20.6 | HLA-B*4001 | WSGMIDGWY | 124 | HLA-A*0101 | VINNITTTI | 304.06 | HLA-A*0201 |
| YLTGTWDTL | 20.8 | HLA-A*0201 | LRHLFSGIR | 124 | HLA-B*2705 | WMRISNETI | 304.08 | HLA-B*1501 |
| WMMAMKYPI | 20.8 | HLA-B*0801 | YINTALLNA | 124 | HLA-A*0201 | KTNLYGFIV | 304.16 | HLA-A*0201 |
| TMLNLYERV | 20.8 | HLA-A*0201 | IAGFIEGGW | 125 | HLA-B*5801 | RRGVKGFGF | 304.19 | HLA-B*2705 |
| SWMKIYWVL | 20.9 | HLA-A*2402 | NPNQKLFTL | 125 | HLA-B*0702 | TTNTINRNF | 304.26 | HLA-B*5801 |
| DQIENLWAY | 20.9 | HLA-A*2601 | FPIGVAPVL | 125 | HLA-B*3901 | KAINEITTK | 304.4 | HLA-A*0301 |
| IILWFSFGA | 21.1 | HLA-A*0201 | SGYKDIILW | 125 | HLA-B*5801 | KEKENSYPM | 304.73 | HLA-B*1501 |
| VADGGPNLY | 21.1 | HLA-A*0101 | SLLLATGMK | 125 | HLA-A*0301 | HVLVTREPY | 304.74 | HLA-B*1501 |
| KPNIGPRPF | 21.1 | HLA-B*0702 | DQIQDIWAY | 125 | HLA-A*2601 | NTKLPFQNL | 305.01 | HLA-B*0801 |
| FHNVHPLTI | 21.2 | HLA-B*3901 | GMALSVVSL | 125 | HLA-B*0702 | LRSGYEMLK | 305.15 | HLA-B*2705 |
| LIDNEFTEV | 21.3 | HLA-A*0201 | IPSIQSRGL | 125 | HLA-B*0702 | FSVQRSLPF | 305.26 | HLA-B*0801 |
| TIMEKNVTV | 21.3 | HLA-A*0201 | QILAIYSTV | 125 | HLA-A*0201 | QTKRSFELK | 305.36 | HLA-A*0301 |

Fig. 79-7

| Peptide | y (nM) | Allele | Peptide | Affinity (nM) | Allele | Peptide | Affinity (nM) | Allele |
|---|---|---|---|---|---|---|---|---|
| RLSASGDIW | 21.3 | HLA-B*5801 | NPSQKLFAL | 126 | HLA-B*0801 | RVFLAMITY | 305.57 | HLA-B*1501 |
| KAVRGDLNF | 21.4 | HLA-B*5801 | VVNFVSMEF | 126 | HLA-B*5801 | NLIAPRGYY | 305.6 | HLA-B*1501 |
| FLLMDSLKL | 21.4 | HLA-A*0201 | GPRNVPAIA | 126 | HLA-B*0702 | LLMIIGGFI | 305.91 | HLA-A*0201 |
| FLTHALRFL | 21.4 | HLA-A*0201 | KPFHNISRI | 126 | HLA-B*0702 | SLRGRGSTL | 305.97 | HLA-B*1501 |
| GRMTFYWTM | 21.4 | HLA-B*2705 | NVIVTREPY | 126 | HLA-A*2601 | KLRSGFEML | 306.03 | HLA-B*1501 |
| VEFEPFQSL | 21.5 | HLA-B*4001 | FPFHKDNAL | 127 | HLA-B*0801 | RPFVRGQQG | 306.23 | HLA-B*0702 |
| GELDNNGEL | 21.6 | HLA-B*4001 | GRMDYYWAI | 127 | HLA-B*3901 | IPQIESRGL | 306.56 | HLA-B*0702 |
| YRNLVWLVK | 21.6 | HLA-B*2705 | YVKSDRLVL | 127 | HLA-B*0801 | WASNSLIAL | 306.78 | HLA-B*3901 |
| QSGRIDFHW | 21.7 | HLA-B*5801 | VAWSSSSCF | 127 | HLA-B*5801 | MVNGWYGF | 306.84 | HLA-A*0301 |
| FQNASRYYM | 21.8 | HLA-B*1501 | FVQSYFQLF | 127 | HLA-B*1501 | WAVGRCPRY | 307.02 | HLA-B*1501 |
| GMIDGWYGF | 21.8 | HLA-B*1501 | QALQLLFEV | 127 | HLA-A*0201 | RMTFYWTII | 307.48 | HLA-A*0201 |
| CQMEKIVLL | 21.9 | HLA-A*0201 | GLVDGWYGF | 128 | HLA-A*0201 | SIGSWSHNI | 307.72 | HLA-A*0201 |
| LTIAMGLVF | 21.9 | HLA-B*5801 | CIASSIVMV | 128 | HLA-A*0201 | RAVGKCPRY | 307.81 | HLA-B*1501 |
| FLLMDALKL | 22 | HLA-A*0201 | KRINMINDK | 128 | HLA-B*2705 | DLWAYNAEL | 307.92 | HLA-A*0201 |
| VILWFSFGA | 22 | HLA-A*0201 | HQLLRHFQK | 128 | HLA-A*0301 | FALSQGTTL | 308.05 | HLA-B*3901 |
| SMVEAESSV | 22.1 | HLA-A*0201 | ITGFASFSK | 128 | HLA-A*0301 | HLKFKADLI | 308.26 | HLA-B*0801 |
| YSSSMMWEV | 22.1 | HLA-A*0201 | WISFSMSCF | 128 | HLA-B*1501 | MMAMKYPIT | 308.58 | HLA-B*0801 |
| YQAELLVAM | 22.2 | HLA-A*0201 | IIDKMNGNY | 128 | HLA-A*0101 | VSWTSNSII | 308.6 | HLA-B*5801 |
| LPQSGRIVV | 22.2 | HLA-B*0702 | WIPKRNRSI | 129 | HLA-B*0801 | TTAVAVLKY | 308.68 | HLA-B*5801 |
| VQIIKLLPF | 22.3 | HLA-B*1501 | VVNFVSMEF | 129 | HLA-B*1501 | SMLKPGETL | 308.72 | HLA-A*0201 |
| HMRKKRGLF | 22.3 | HLA-B*0801 | ILKPGQTVK | 129 | HLA-A*0301 | SGYSGSFSV | 309.23 | HLA-A*0201 |
| DSITDIWTY | 22.4 | HLA-A*2601 | ELWSYNAEL | 129 | HLA-A*0201 | FQIQGVKLI | 309.3 | HLA-A*0201 |
| LMSCPIGEV | 22.4 | HLA-A*0201 | SLEPGTFDL | 129 | HLA-A*0201 | CPFRGFFPF | 309.63 | HLA-B*3901 |
| LTITYSSPM | 22.6 | HLA-A*2601 | TYGACPKYI | 129 | HLA-A*2402 | HILSKDNAI | 309.93 | HLA-B*0801 |
| ALNEITTKI | 22.7 | HLA-A*0201 | LIEKTSWSY | 130 | HLA-A*0101 | SMGVYQILA | 310.18 | HLA-A*0201 |
| KLATGLRNV | 22.7 | HLA-A*0201 | RIRLFDYSK | 130 | HLA-A*0301 | SRAGYEMLK | 310.21 | HLA-B*2705 |
| VPKRNRSIL | 22.7 | HLA-B*0702 | IMIDGSASG | 130 | HLA-B*1501 | ITYGACPRY | 310.35 | HLA-B*1501 |
| LIALCGSPF | 22.8 | HLA-B*1501 | MQIRGFVHF | 130 | HLA-A*2402 | AIGECPKYV | 310.41 | HLA-A*0201 |
| KQAKGLFGA | 22.9 | HLA-A*0201 | GTLNRLIDK | 130 | HLA-A*0301 | TPRGEDSQF | 310.6 | HLA-B*0702 |
| IILWVSFSI | 22.9 | HLA-A*0201 | KSDRICIGY | 130 | HLA-A*0101 | MASIRNNTY | 310.67 | HLA-B*1501 |
| LLIGISNVV | 23 | HLA-A*0201 | TTYKILSIY | 130 | HLA-B*1501 | AINKITNKV | 310.73 | HLA-A*0201 |
| VSMCSSTEF | 23 | HLA-B*5801 | ASNRPWVSF | 130 | HLA-B*5801 | KSLLLATGM | 311.12 | HLA-B*5801 |
| KLLGINMSK | 23 | HLA-A*0301 | ILEENTTYK | 130 | HLA-A*0301 | NPGVKGWAF | 311.17 | HLA-B*0702 |
| VEVTNATEL | 23.1 | HLA-B*4001 | EMGQAPSPY | 130 | HLA-B*1501 | LTVPEWSYI | 311.34 | HLA-B*5801 |
| DAMTEIWSY | 23.1 | HLA-A*2601 | YIVERTKEM | 131 | HLA-A*2601 | RAIDGVTNK | 311.35 | HLA-A*0301 |
| TTYKILSIY | 23.1 | HLA-A*2601 | ASNRPWISF | 131 | HLA-B*5801 | CKIEGWVVV | 311.43 | HLA-B*3901 |
| CPIKGWAPL | 23.2 | HLA-B*0702 | YYLEKASKI | 131 | HLA-A*2402 | FHQCDNDCM | 311.66 | HLA-B*3901 |
| LASSGSLEF | 23.2 | HLA-B*1501 | ASYKRVRLF | 131 | HLA-B*1501 | MTDGSASGK | 311.75 | HLA-A*0301 |
| GRMDYYWAV | 23.2 | HLA-A*0201 | ARLYIWGVH | 131 | HLA-B*2705 | RMQLRDNVK | 312.17 | HLA-A*0301 |
| QSGRINFHW | 23.3 | HLA-B*5801 | IVSLGAISF | 131 | HLA-B*1501 | GLSMVRSDK | 312.19 | HLA-A*0301 |
| SVYKALSIY | 23.3 | HLA-B*1501 | LIDGWYGYK | 131 | HLA-A*0301 | DSFYAELKW | 312.26 | HLA-B*5801 |
| GILGFVFTL | 23.4 | HLA-A*0201 | YQMGYICSG | 131 | HLA-B*1501 | ENKKYGPAL | 312.27 | HLA-B*0801 |
| LATTVTLHF | 23.5 | HLA-B*5801 | WSGYSGSFM | 131 | HLA-B*1501 | LLMDSLKLS | 312.35 | HLA-A*0201 |
| QMRDVLGTF | 23.5 | HLA-B*1501 | KFEEIRWMI | 131 | HLA-A*2402 | WMACNSAAF | 312.57 | HLA-B*3901 |
| SYINRTGTF | 23.6 | HLA-A*2402 | IQAGVNRFY | 131 | HLA-B*1501 | SSCFDGKEW | 312.69 | HLA-B*5801 |
| KMTDSIKSW | 23.7 | HLA-B*5801 | QERGLFGAI | 132 | HLA-B*4001 | DRISHRTLL | 312.73 | HLA-B*3901 |
| ATSPIVPSF | 23.7 | HLA-B*5801 | LVSLGAISF | 132 | HLA-B*1501 | YNRRPTTTI | 312.82 | HLA-B*0801 |
| KMNTQILIF | 23.7 | HLA-B*1501 | HLKDQAWSY | 132 | HLA-B*1501 | AEDKGNGCF | 313.13 | HLA-B*4001 |
| DVIVTREPY | 23.7 | HLA-A*2601 | VMTHTSQYI | 132 | HLA-A*0201 | IMWGIHHPS | 313.15 | HLA-A*0201 |
| AIMIAGLSF | 23.8 | HLA-B*1501 | SLKLAVGLK | 132 | HLA-A*0301 | YVWWASNSL | 313.8 | HLA-B*0702 |
| CETKCQSPL | 23.9 | HLA-B*4001 | AILATTVTL | 132 | HLA-A*0201 | GRMDYYWAV | 313.8 | HLA-B*2705 |
| RLSAGGNIW | 23.9 | HLA-B*5801 | GTKQVCAAW | 132 | HLA-B*5801 | LNASWFNSF | 313.99 | HLA-B*1501 |
| FRTLMSCPM | 23.9 | HLA-B*3901 | SLIQFPMGT | 132 | HLA-A*0201 | EHDANVRNL | 314.05 | HLA-B*3901 |
| GMIDGWYGY | 24.1 | HLA-B*1501 | SLSYSTGAL | 132 | HLA-B*1501 | GSDIGFMPK | 314.12 | HLA-A*0301 |
| GTITSPLPF | 24.2 | HLA-B*1501 | LYEKVRMQL | 132 | HLA-A*2402 | ITFESNGGF | 314.44 | HLA-A*2601 |
| FVRQCFNPM | 24.2 | HLA-A*2601 | RPRVRNQSG | 132 | HLA-B*0702 | SRSGFEMLR | 314.59 | HLA-B*2705 |
| RRIDFNWLL | 24.2 | HLA-B*2705 | IYSTVVSSL | 132 | HLA-A*2402 | NSGDYARLY | 314.64 | HLA-A*0101 |
| REGYSLVGI | 24.2 | HLA-B*4001 | FSFGASCFL | 132 | HLA-B*3901 | TQYREESLL | 314.83 | HLA-B*3901 |
| GRMNYHWTL | 24.2 | HLA-B*2705 | EECSCYPNL | 132 | HLA-B*4001 | MRWLTLKLG | 314.89 | HLA-B*2705 |
| LVISTDLSY | 24.3 | HLA-B*1501 | RREVHTYYL | 133 | HLA-B*2705 | SLSLAIMIA | 314.91 | HLA-A*0201 |
| DTKIDLWSY | 24.3 | HLA-A*2601 | VPQMESRGL | 133 | HLA-B*0702 | LTIGECPRY | 315.04 | HLA-A*2601 |

Fig. 79-8

| Peptide | y (nM) | Allele | Peptide | Affinity (nM) | Allele | Peptide | Affinity (nM) | Allele |
|---|---|---|---|---|---|---|---|---|
| GRMNYYWTL | 24.4 | HLA-B*2705 | KMNTKILVL | 133 | HLA-B*1501 | FLGQWDWP | 315.24 | HLA-A*0201 |
| GTFEFTSFF | 24.5 | HLA-B*1501 | FVYFVEALA | 133 | HLA-A*0201 | GRQEKNPAL | 315.3 | HLA-B*3901 |
| STYKILSIY | 24.5 | HLA-A*2601 | STYKILSIY | 133 | HLA-A*0301 | VLIGQGDVV | 315.55 | HLA-A*0201 |
| DSMTEIWSY | 24.5 | HLA-A*2601 | SWMKIYWYL | 133 | HLA-A*0201 | YQARFESVA | 315.65 | HLA-B*1501 |
| IIIAGLSFW | 24.5 | HLA-B*5801 | YQNSFVPVV | 133 | HLA-B*1501 | SLIASSGTL | 315.7 | HLA-A*0201 |
| LLNPFVSHK | 24.6 | HLA-A*0301 | GRMDYYWTL | 133 | HLA-A*0201 | VWWASNSLI | 315.88 | HLA-A*2402 |
| DQIEGLWAY | 24.6 | HLA-A*2601 | LQSSDDFAL | 133 | HLA-B*3901 | AAIKGIGTM | 315.88 | HLA-B*1501 |
| SLRMKWMMA | 24.6 | HLA-B*0801 | GLVDGWYGF | 133 | HLA-B*1501 | IRTWAKNIL | 315.9 | HLA-B*3901 |
| LLQSAILSL | 24.7 | HLA-A*0201 | ILKRGETLK | 133 | HLA-A*0301 | KVWWTSNSI | 316.12 | HLA-B*5801 |
| RPMDSTGSC | 24.8 | HLA-B*0702 | MQNKLNNVI | 134 | HLA-B*3901 | RMYALHQGT | 316.23 | HLA-A*0201 |
| FQGRGVFEL | 24.8 | HLA-A*0201 | RRFVQNALS | 134 | HLA-B*2705 | FWMCPNGSL | 316.26 | HLA-B*3901 |
| EQLSSVSSF | 24.8 | HLA-B*1501 | KLTQGRQTY | 134 | HLA-B*1501 | LTTTPTKSY | 316.28 | HLA-B*1501 |
| STDTVNTLM | 25 | HLA-A*0101 | DLLENLQAY | 134 | HLA-A*2601 | QIVVTREPY | 316.69 | HLA-B*1501 |
| VLWTSNSMV | 25.1 | HLA-A*0201 | ISTASRYGY | 134 | HLA-B*5801 | NASAVIWYK | 317.38 | HLA-A*0301 |
| RTSISCLYK | 25.2 | HLA-A*0301 | STVSSFERF | 134 | HLA-B*5801 | VMEHTSQYL | 317.49 | HLA-A*0201 |
| NSFYRNLIW | 25.2 | HLA-B*5801 | FFRNVVWLI | 134 | HLA-A*2402 | LTIGECPRY | 317.82 | HLA-A*0101 |
| RLSAGGDIW | 25.2 | HLA-B*5801 | RRLTTTIKT | 134 | HLA-B*2705 | NPAHKSQLI | 317.92 | HLA-B*0702 |
| FQRSKFLLM | 25.2 | HLA-B*0801 | MITQRTIGK | 134 | HLA-A*0301 | MGFRYSGIK | 317.96 | HLA-A*0301 |
| FSFGGFTFK | 25.3 | HLA-A*0301 | KQTRGLFGA | 134 | HLA-A*0201 | NLIAPRGYF | 318.02 | HLA-B*1501 |
| QLSSVSSFK | 25.3 | HLA-A*0301 | THFEKVKIL | 134 | HLA-B*3901 | LINDPWVLL | 318.04 | HLA-A*0201 |
| DSITEVWSY | 25.3 | HLA-A*2601 | GLIAPRYGY | 134 | HLA-B*1501 | FQNVHPVTI | 318.08 | HLA-B*1501 |
| LEMCHSTQI | 25.3 | HLA-B*4001 | VLLKHRFEI | 135 | HLA-B*0801 | LYGAQSLSI | 318.37 | HLA-A*2402 |
| WASGSSISF | 25.4 | HLA-B*1501 | NRFQIQGVR | 135 | HLA-B*2705 | LTKATNGNY | 318.4 | HLA-B*1501 |
| SQRSKFLLM | 25.4 | HLA-B*1501 | SIVPSGPLK | 135 | HLA-A*0301 | CQITGFAPF | 318.58 | HLA-A*2402 |
| IYSTVASSF | 25.5 | HLA-A*2402 | LHDANVRNL | 135 | HLA-B*3901 | RLYIWGVHH | 318.62 | HLA-A*0301 |
| GTMHDRSPF | 25.5 | HLA-B*1501 | CIINSWHIY | 135 | HLA-B*1501 | IVRRATVSA | 318.67 | HLA-B*0702 |
| YQNNFVPVI | 25.5 | HLA-A*0201 | RMCNILKGK | 136 | HLA-A*0301 | RKRRVRDSM | 318.77 | HLA-B*0702 |
| RLAAGGDIW | 25.7 | HLA-B*5801 | KLYIWGIHH | 136 | HLA-A*0301 | SKFLLMDAL | 318.78 | HLA-B*3901 |
| FSFGASSFV | 25.8 | HLA-A*0201 | LILAFILWA | 136 | HLA-A*0201 | YQSTNSTEI | 319.53 | HLA-B*1501 |
| NVYKILSIY | 25.9 | HLA-A*2601 | SQVERRINM | 136 | HLA-B*1501 | FRYGNGVWI | 319.79 | HLA-B*2705 |
| WTSNSVVVF | 26 | HLA-B*1501 | EMWSYNAEL | 136 | HLA-B*3901 | SFFSRLNWL | 320.14 | HLA-B*0801 |
| IASSGTLEF | 26 | HLA-B*1501 | YQFALGQGA | 136 | HLA-A*0201 | SRSGYEILK | 320.14 | HLA-B*2705 |
| TLIEQKVPV | 26.1 | HLA-A*0201 | SFSMSCFVF | 136 | HLA-A*2402 | RSRNGFEML | 320.15 | HLA-B*0702 |
| GRMTFYWAI | 26.2 | HLA-B*2705 | RNMRWLTLK | 136 | HLA-A*0301 | IVMVGLILA | 320.21 | HLA-A*0201 |
| LIAPWYAYK | 26.2 | HLA-A*0301 | ILSIYSTAA | 136 | HLA-A*0201 | VWLGRTVSI | 320.28 | HLA-B*0801 |
| TLTEQNVPV | 26.3 | HLA-A*0201 | NGNMRCTIL | 136 | HLA-B*0801 | MENERTLDY | 320.46 | HLA-B*1501 |
| LRFLFSSIK | 26.3 | HLA-B*2705 | GTFEFTSFF | 136 | HLA-B*5801 | THNGKLCKL | 320.5 | HLA-B*3901 |
| SWMKIYWDL | 26.4 | HLA-A*2402 | GTAPILGNY | 137 | HLA-A*0101 | YVNKNPYTL | 320.61 | HLA-B*3901 |
| LSFQGRGVF | 26.5 | HLA-B*1501 | DLLDNLQAY | 137 | HLA-A*2601 | VETYVLSII | 320.98 | HLA-B*4001 |
| SLLEMCHST | 26.5 | HLA-A*0201 | MEKFIVLSI | 137 | HLA-B*4001 | SECVCINGI | 321.02 | HLA-B*4001 |
| WTANSIIVF | 26.6 | HLA-B*1501 | QPEWFRNIL | 137 | HLA-B*0702 | CPRYVKQSS | 321.14 | HLA-B*0702 |
| LEMCHGTQI | 26.7 | HLA-B*4001 | AIDGITNKV | 137 | HLA-A*0201 | WGVHHSSSL | 321.29 | HLA-B*0702 |
| RMTDSIKSW | 26.7 | HLA-B*5801 | YYLEKANKI | 137 | HLA-A*2402 | WMRINNETI | 321.29 | HLA-B*0801 |
| LVRGNSPVF | 27 | HLA-B*1501 | GRMTFYWAI | 138 | HLA-B*3901 | YLSTNSSEK | 321.33 | HLA-A*0301 |
| YQAELLVAM | 27.1 | HLA-B*1501 | KLSQMSREV | 138 | HLA-A*0201 | ETILETRYV | 321.33 | HLA-A*2601 |
| RMDYYWAVL | 27.2 | HLA-A*0201 | YSLVGVDPF | 138 | HLA-B*5801 | VPAQNAIST | 321.63 | HLA-B*0702 |
| QMRDILGTF | 27.3 | HLA-B*1501 | ILCASATAI | 138 | HLA-A*0201 | LHEKVRQML | 321.76 | HLA-B*3901 |
| QAGRIDFHW | 27.3 | HLA-B*5801 | RILFVKEGK | 138 | HLA-A*0301 | IMVAGLSFW | 322.13 | HLA-B*1501 |
| MVWDANGWV | 27.4 | HLA-A*0201 | ILVTREPYL | 138 | HLA-A*0201 | SPHRALMSC | 322.33 | HLA-B*0702 |
| KILSIYSSV | 27.4 | HLA-A*0201 | TYGACPRYI | 138 | HLA-A*2402 | GRFYVQMCT | 322.34 | HLA-B*2705 |
| MVLASTTAK | 27.4 | HLA-A*0301 | RLFTIRQEL | 138 | HLA-A*0201 | RTELIPPSK | 322.92 | HLA-A*0301 |
| YRALMSVLL | 27.5 | HLA-B*3901 | SVKKGTYDY | 139 | HLA-B*1501 | TSISCLYKL | 322.96 | HLA-B*5801 |
| IMQNKLNNV | 27.5 | HLA-A*0201 | IIFNMERIK | 139 | HLA-A*0301 | YQGRLCNPL | 323.23 | HLA-A*0201 |
| ASWFNSFLK | 27.5 | HLA-A*0301 | RGYPGVKGW | 139 | HLA-B*5801 | GTIHDRSPY | 323.32 | HLA-A*2601 |
| GLNMSLHLK | 27.5 | HLA-A*0301 | KTHNGKLCK | 139 | HLA-A*0301 | EKIEKIRPL | 323.8 | HLA-B*0801 |
| ITSLCSIWF | 27.5 | HLA-B*5801 | LMNELGVPL | 139 | HLA-B*3901 | EVVDATETV | 324.06 | HLA-A*2601 |
| AMDHTSQYL | 27.6 | HLA-A*0201 | RIAIGNCPK | 139 | HLA-A*0301 | GMELRRCLL | 324.15 | HLA-B*0801 |
| KTKKMTITF | 27.7 | HLA-B*1501 | KSRSIIFNM | 139 | HLA-B*5801 | MVDGWYGF | 324.2 | HLA-A*0101 |
| FPFHKDNAI | 27.9 | HLA-B*0702 | TIWTSSSSV | 139 | HLA-A*0201 | GIFGPVHFR | 324.46 | HLA-A*0301 |
| GRMNYYWTI | 28 | HLA-B*2705 | YRALISWEM | 139 | HLA-B*2705 | FQNASRYYM | 324.7 | HLA-A*0201 |
| FRGLMSTPL | 28 | HLA-B*3901 | SLLTEVETY | 139 | HLA-B*1501 | KSRVDNHSM | 324.71 | HLA-B*5801 |

Fig. 79-9

| Peptide | Affinity (nM) | Allele | Peptide | Affinity (nM) | Allele | Peptide | Affinity (nM) | Allele |
|---|---|---|---|---|---|---|---|---|
| ITFSFNGAF | 28.1 | HLA-B*1501 | VLDTDWSGY | 139 | HLA-A*0101 | TTYRILSIY | 324.95 | HLA-B*5801 |
| LMLNKSLCK | 28.1 | HLA-A*0301 | STAASSLAL | 139 | HLA-B*1501 | VLTGNLQTL | 325.08 | HLA-A*0201 |
| TQIIKLLPF | 28.1 | HLA-B*1501 | ATTHSWIPK | 140 | HLA-A*0301 | SLIRFPIGT | 325.11 | HLA-A*0201 |
| GMVNGWYGF | 28.2 | HLA-B*1501 | HLECRTFFL | 140 | HLA-A*0201 | KGNPGVKGW | 325.17 | HLA-B*5801 |
| CPIRGWAPL | 28.3 | HLA-B*0702 | VLVTREPYL | 140 | HLA-A*0201 | GYKDIILWI | 325.54 | HLA-A*2402 |
| QPKWFRNVL | 28.3 | HLA-B*0702 | FTLSGVAIA | 140 | HLA-A*0201 | TSFFYRYGF | 325.69 | HLA-B*1501 |
| FIAPNRASF | 28.6 | HLA-B*1501 | HHAVTNGTI | 140 | HLA-B*3901 | YPKIYKTYF | 326.08 | HLA-B*0801 |
| SPRMFLAMI | 28.7 | HLA-B*0702 | STIALLIGI | 140 | HLA-A*0201 | GRYSRADKI | 326.2 | HLA-B*2705 |
| HLEECSCYV | 28.7 | HLA-A*0201 | SSDDFALIL | 140 | HLA-A*0101 | NSTWVSQTY | 326.58 | HLA-B*5801 |
| RLGYETFKV | 28.8 | HLA-A*0201 | YISVGTSTL | 141 | HLA-A*0201 | YAFGICPKY | 326.66 | HLA-A*2601 |
| FLAPGYAFE | 28.8 | HLA-A*0201 | SVKNGTYDY | 141 | HLA-B*1501 | WPWPDGALL | 326.78 | HLA-B*3901 |
| VEVVAAQEL | 28.8 | HLA-B*4001 | WASGSSISF | 141 | HLA-B*5801 | KLSGGYKDV | 326.83 | HLA-A*0201 |
| LLNASCAAM | 28.9 | HLA-B*1501 | AVNNRFQIK | 141 | HLA-A*0301 | IAQRLESVF | 326.98 | HLA-B*1501 |
| ALSGVAIAL | 29 | HLA-A*0201 | SISECRTFF | 142 | HLA-B*1501 | SILANNGRF | 327.12 | HLA-B*1501 |
| SHEGEGIPL | 29.1 | HLA-B*3901 | STVASSLAL | 142 | HLA-B*1501 | GLMSTPLGS | 327.18 | HLA-A*0201 |
| MSNEGSYFF | 29.1 | HLA-B*1501 | VLSIIALLI | 142 | HLA-A*0201 | VSKMGVDEY | 327.29 | HLA-B*1501 |
| RRIDFHWLL | 29.1 | HLA-B*2705 | RPGVKGFGF | 142 | HLA-B*0702 | STVASSLVL | 327.43 | HLA-B*1501 |
| STIALLIGV | 29.1 | HLA-A*0201 | KLSQMPKEV | 143 | HLA-A*0201 | VTYQILSIY | 327.53 | HLA-A*2601 |
| YQRSKFLLM | 29.1 | HLA-B*0801 | KMEAILVVL | 143 | HLA-A*0201 | REMTFHGAK | 327.54 | HLA-B*2705 |
| NTVKDRSPY | 29.2 | HLA-A*2601 | GANRPWVSF | 143 | HLA-B*1501 | GVYQVLAIY | 327.66 | HLA-B*1501 |
| MLATGMRNV | 29.2 | HLA-A*0201 | YLLFQDILM | 143 | HLA-A*0201 | STVASSLTL | 327.74 | HLA-B*1501 |
| YRNLVWIVK | 29.3 | HLA-B*2705 | AYGVKGFSF | 143 | HLA-A*2402 | FQNIDSWAV | 327.8 | HLA-B*3901 |
| EQLSTVSSF | 29.4 | HLA-B*1501 | VSHCRATEY | 143 | HLA-B*2705 | CPIRGWAPL | 327.84 | HLA-B*0801 |
| KVPEWSYIV | 29.4 | HLA-A*0201 | WTSGSIISF | 144 | HLA-B*5801 | TACHDGRKW | 328.39 | HLA-B*5801 |
| TMHQLLRHF | 29.5 | HLA-B*1501 | LIALCGSPV | 144 | HLA-A*0201 | QLSQKFEEI | 328.63 | HLA-A*0201 |
| FSISCFLLV | 29.5 | HLA-A*0201 | TFQNVSPIW | 144 | HLA-A*2402 | LTMGECPKY | 329.25 | HLA-A*0101 |
| RMTFYWTMV | 29.5 | HLA-A*0201 | YYNETFVNV | 144 | HLA-A*2402 | FFRHMVWLI | 329.45 | HLA-B*0801 |
| GRMTFYWTI | 29.5 | HLA-B*2705 | SQHKSHRQM | 144 | HLA-B*1501 | LVAPEYGFK | 329.6 | HLA-A*0301 |
| GTRRIDFHW | 29.7 | HLA-B*5801 | FRTLMSCPM | 144 | HLA-B*2705 | VFSIAASYK | 329.83 | HLA-A*0301 |
| MSKEGSYFF | 29.7 | HLA-B*1501 | IPSVQSRGL | 144 | HLA-B*0702 | VLMENERTL | 329.84 | HLA-A*0201 |
| RMKWMMAMK | 29.7 | HLA-A*0301 | SPLMVAYML | 144 | HLA-B*0702 | GRISIYWTL | 329.99 | HLA-B*3901 |
| CYQRSKFLL | 29.8 | HLA-A*2402 | HLKDQDWSY | 145 | HLA-B*1501 | EIWSYNAEF | 330.04 | HLA-A*2601 |
| LLAPKYGYI | 29.8 | HLA-A*0201 | RRIDFNWLL | 145 | HLA-B*3901 | HILVTREPY | 330.27 | HLA-B*1501 |
| IMFESNGGL | 29.8 | HLA-A*0201 | FHRAKEVAL | 145 | HLA-B*3901 | GTIKDRSPY | 330.39 | HLA-A*2601 |
| YLWGVHHPS | 29.9 | HLA-A*0201 | RRLTTTIRT | 145 | HLA-B*2705 | GRQTFDWTL | 330.42 | HLA-B*3901 |
| FRGLISTPL | 29.9 | HLA-B*3901 | ESEFNEIEY | 145 | HLA-A*0101 | QILSLYSTV | 330.54 | HLA-A*0201 |
| LMNELGVPL | 30 | HLA-B*1501 | VWMGRTISM | 145 | HLA-B*0801 | NTVKDRSPY | 330.77 | HLA-B*1501 |
| GPNNNASAI | 30 | HLA-B*0702 | SQYLCTGVL | 145 | HLA-B*3901 | KTWAGNILR | 331.19 | HLA-A*0301 |
| LAIAMGLIF | 30 | HLA-B*1501 | GALNTTLPF | 145 | HLA-B*5801 | LVQLIVSGK | 331.6 | HLA-A*0301 |
| FHDSNVRNL | 30.1 | HLA-B*3901 | VSNDNWSGY | 145 | HLA-B*1501 | CSCYPNMGK | 332.03 | HLA-A*0301 |
| YRSINWLTK | 30.1 | HLA-B*2705 | YSSSMMWEI | 145 | HLA-A*0201 | GMALSVVSL | 332.47 | HLA-B*1501 |
| VTFNFNGAF | 30.2 | HLA-B*1501 | YLNGREWSY | 145 | HLA-B*1501 | TFQNVSPIW | 332.54 | HLA-B*5801 |
| RRIENLNRK | 30.2 | HLA-B*2705 | FYAEMEWLL | 145 | HLA-A*2402 | LIWMACHSA | 332.6 | HLA-A*0201 |
| LMLSKSLCK | 30.3 | HLA-A*0301 | YSGFVRTLF | 145 | HLA-B*5801 | VPVTSSIDL | 333.25 | HLA-B*0702 |
| QSFYRSINW | 30.3 | HLA-B*5801 | RANQRLNTM | 145 | HLA-B*0702 | VTQRTVGKK | 334 | HLA-A*0301 |
| NTIGNCPKY | 30.4 | HLA-A*2601 | MLATGMRNI | 145 | HLA-A*0201 | WVGECPKYV | 334.15 | HLA-A*0201 |
| GMVDGWYGF | 30.5 | HLA-B*1501 | LIAPEYGFK | 146 | HLA-A*0301 | ALSIYSCIA | 334.24 | HLA-A*0201 |
| GTIISNLPF | 30.8 | HLA-B*1501 | YQSTNSTEI | 146 | HLA-A*0201 | WSGYSGAFM | 334.56 | HLA-B*1501 |
| SLAIMIAGI | 30.8 | HLA-A*0201 | WSGLVAGWY | 146 | HLA-A*0101 | GLLEVGTRW | 334.82 | HLA-B*5801 |
| LASSGSLEF | 30.8 | HLA-B*5801 | RLRSGFEML | 146 | HLA-B*0702 | LTFLARSAL | 334.85 | HLA-B*0801 |
| KMNIQFTAV | 30.8 | HLA-A*0201 | LIAPEFGYL | 146 | HLA-A*0201 | LVALCGSPV | 334.89 | HLA-A*0201 |
| KEYEEEAKL | 30.9 | HLA-B*4001 | STTHDRTAF | 146 | HLA-B*1501 | TYHNSFVPV | 334.92 | HLA-A*2402 |
| SYIIRALTL | 30.9 | HLA-A*2402 | GLANLGLNI | 146 | HLA-A*0201 | GAVNSSMPF | 334.94 | HLA-B*5801 |
| MLATGMKNV | 30.9 | HLA-A*0201 | NVYRALSIY | 146 | HLA-B*1501 | GTFDIGGLY | 335 | HLA-A*0301 |
| ELRFLFSSI | 31 | HLA-B*0801 | ILRGAVAHK | 146 | HLA-A*0301 | HSHYREEAL | 335.17 | HLA-B*0801 |
| KSLIWLWLV | 31.1 | HLA-A*0201 | WPDGADLPF | 147 | HLA-B*0702 | MALSVVSLL | 335.18 | HLA-B*5801 |
| DVIITREPY | 31.1 | HLA-A*2601 | VASSLVLLF | 147 | HLA-B*1501 | FRLLQNSQV | 335.34 | HLA-B*3901 |
| FVRQCFNPM | 31.1 | HLA-B*1501 | YQMGYICSG | 147 | HLA-A*0201 | WTGMIDGWY | 335.43 | HLA-A*2601 |
| WTSNSIVAF | 31.1 | HLA-B*1501 | WEMGLAPSP | 147 | HLA-B*4001 | QADEICIGY | 335.44 | HLA-A*0101 |
| FHGAKEIAL | 31.2 | HLA-B*3901 | LLGAIAGFI | 147 | HLA-A*0201 | KPQCKITGF | 335.47 | HLA-B*0702 |
| KSSLPLCPF | 31.2 | HLA-B*5801 | RTLLAKSVF | 147 | HLA-B*5801 | CIASSLVLA | 335.48 | HLA-A*0201 |

Fig. 79-10

| Peptide | y (nM) | Allele | Peptide | Affinity (nM) | Allele | Peptide | Affinity (nM) | Allele |
|---|---|---|---|---|---|---|---|---|
| RPMDGTGSC | 31.3 | HLA-B*0702 | CSNNTTNYY | 147 | HLA-B*5801 | LIRGNSPVF | 335.68 | HLA-B*0702 |
| TPKRNRSIL | 31.4 | HLA-B*0702 | GAKEIALSY | 148 | HLA-B*1501 | RTNGTSKIK | 335.92 | HLA-A*0301 |
| GLANLGLNV | 31.5 | HLA-A*0201 | TSWSYIVEK | 148 | HLA-A*0301 | GPWVRGQS | 336.16 | HLA-B*0702 |
| GMIDGWYGF | 31.5 | HLA-A*0201 | SQYRALVSW | 148 | HLA-B*1501 | LLATGMRNI | 336.18 | HLA-A*0201 |
| REILTKTTV | 31.5 | HLA-B*4001 | LSVPEWSYI | 148 | HLA-B*5801 | RVWWTTNSI | 336.31 | HLA-B*0702 |
| KMNIQFTSV | 31.6 | HLA-A*0201 | NYLIRALTL | 148 | HLA-A*2402 | YVNIKSLKL | 336.46 | HLA-B*0801 |
| LVISPDLSY | 31.6 | HLA-B*1501 | GQAFYKILK | 148 | HLA-A*0301 | LQSSDDFAL | 336.75 | HLA-A*0201 |
| ALCGSPVPV | 31.7 | HLA-A*0201 | WTSGSSISF | 148 | HLA-A*2601 | KVNSIIEKM | 336.79 | HLA-B*5801 |
| YRSLIQFPM | 31.7 | HLA-B*3901 | SVYKALSIY | 148 | HLA-A*0301 | ITFIQALQL | 337.11 | HLA-B*5801 |
| KTHIHIFSF | 31.7 | HLA-B*5801 | SGYKDVILW | 148 | HLA-B*5801 | NILLHIVSI | 337.61 | HLA-A*0201 |
| NIWAYNAEL | 31.8 | HLA-A*0201 | KRINVINDK | 148 | HLA-A*0301 | YVSVGTSTL | 338.45 | HLA-A*0201 |
| YRNMRWLTL | 31.8 | HLA-B*0801 | SRTRGILTK | 149 | HLA-B*2705 | GISSMGEAM | 338.57 | HLA-B*1501 |
| CTINSWHIF | 31.9 | HLA-B*5801 | ATSPIVPSF | 149 | HLA-B*1501 | GRQTYDWTL | 338.7 | HLA-B*3901 |
| YVRLYLWGV | 32 | HLA-A*0201 | FPIGTAPIL | 149 | HLA-B*3901 | YWMCSNGSL | 338.95 | HLA-B*3901 |
| GTSKIKMKW | 32 | HLA-B*5801 | LVGPILSFI | 149 | HLA-A*0201 | FSFGASCLI | 339.09 | HLA-A*0201 |
| NPSQKLFAL | 32 | HLA-B*0702 | YAFGNCSKY | 149 | HLA-A*2601 | TFIQALQLL | 339.2 | HLA-A*2402 |
| FRTLMSCPV | 32.1 | HLA-B*3901 | KRQEINGIK | 149 | HLA-B*2705 | GSIPNEKPF | 339.2 | HLA-B*1501 |
| KRMGLQMQR | 32.3 | HLA-B*2705 | KPFQNVSRI | 149 | HLA-B*0702 | MVFSQEDCV | 339.39 | HLA-A*0201 |
| GAVNSSKPF | 32.4 | HLA-B*1501 | RMYQKCCNL | 149 | HLA-A*0201 | GISSMVEAM | 339.58 | HLA-B*1501 |
| LLAPRYGYI | 32.5 | HLA-A*0201 | KVNSVIEKM | 149 | HLA-B*5801 | IASMRRNYF | 339.73 | HLA-B*0801 |
| VQVIKLLPF | 32.6 | HLA-B*1501 | GYLIRALTL | 149 | HLA-A*2402 | LGLRISSSF | 339.73 | HLA-B*1501 |
| KEKENSYPM | 32.8 | HLA-B*4001 | VLVTREPYI | 149 | HLA-A*0201 | IIAARSIVR | 339.87 | HLA-A*0301 |
| AEIEDLIFM | 32.8 | HLA-B*4001 | ASNRPWISF | 149 | HLA-B*1501 | EVVNATETV | 339.95 | HLA-A*2601 |
| VLVGPILSF | 32.8 | HLA-B*1501 | KMNTRILIL | 149 | HLA-A*0201 | SRARIKTRL | 339.96 | HLA-B*2705 |
| TLDEHDSNV | 32.9 | HLA-A*0201 | RLEDVFAGK | 150 | HLA-A*0301 | HTQYREEAL | 340.06 | HLA-B*0801 |
| NAISTTFPY | 32.9 | HLA-A*2601 | CHSGVCPVV | 150 | HLA-B*3901 | QRLNTMHQL | 340.49 | HLA-B*3901 |
| RRLENLNKK | 33 | HLA-B*2705 | YSSSLMWEI | 150 | HLA-A*0201 | FQNTSKHYI | 340.8 | HLA-B*3901 |
| SACHDGASW | 33.1 | HLA-B*5801 | VSRMGVDEY | 150 | HLA-B*1501 | SFAISCFLI | 340.96 | HLA-A*2402 |
| FVRQCFNPM | 33.2 | HLA-B*0702 | WPDDAELPL | 150 | HLA-B*0702 | QVIVTREPY | 341.15 | HLA-A*2601 |
| FRGLLSTPL | 33.3 | HLA-B*3901 | WTSNSIIVF | 150 | HLA-B*5801 | CSVSECRTF | 341.17 | HLA-B*5801 |
| MMTHTSQYI | 33.3 | HLA-A*0201 | WLGRTLNTA | 150 | HLA-A*0201 | MRWLTLKSG | 341.19 | HLA-B*2705 |
| KMQFSSLTV | 33.3 | HLA-A*0201 | VMELIRMIK | 151 | HLA-A*0301 | IIVTREPYV | 341.53 | HLA-A*0201 |
| LAIVMGLVF | 33.4 | HLA-B*1501 | RTSHRTLLM | 151 | HLA-A*0101 | RIPHRTLLM | 341.6 | HLA-B*1501 |
| NVYKVLSIY | 33.5 | HLA-A*2601 | ALGQGTTLK | 151 | HLA-A*0301 | RHFEKVKIL | 342.18 | HLA-B*3901 |
| CSNNTTNYY | 33.5 | HLA-A*0101 | VLLGSSPNA | 151 | HLA-A*0201 | ILSIYSTVA | 342.58 | HLA-A*0201 |
| GLYDAIEEC | 33.6 | HLA-A*0201 | VSFRGRGVF | 151 | HLA-B*1501 | LEESHPGIF | 342.63 | HLA-B*4001 |
| WTSNSIIAF | 33.6 | HLA-B*1501 | TYQNSFVPV | 151 | HLA-A*2402 | WTSNSIVAF | 342.74 | HLA-B*5801 |
| ALSGVAISL | 33.6 | HLA-A*0201 | FSFRYGNGV | 152 | HLA-A*0201 | HTQYREESL | 342.77 | HLA-B*0801 |
| MPLHNIHPL | 33.7 | HLA-B*0801 | FEATGNLLV | 152 | HLA-B*4001 | TTTIRTWAK | 342.92 | HLA-A*0301 |
| YRNVVWLIK | 33.7 | HLA-B*2705 | EVEQEIRAF | 152 | HLA-A*2601 | LRRCLLQSL | 342.95 | HLA-B*0801 |
| HQRSKFLLM | 33.9 | HLA-B*1501 | GQSGRIDFY | 152 | HLA-B*1501 | YMSNNSTEK | 342.97 | HLA-A*0301 |
| MHDANVRNL | 33.9 | HLA-B*3901 | RREVHIYYL | 152 | HLA-B*2705 | GTFDLEGLY | 342.99 | HLA-A*0101 |
| FRTLMSCPI | 33.9 | HLA-B*3901 | LYDKVRMQL | 152 | HLA-A*2402 | EIAQRLESV | 343.12 | HLA-A*2601 |
| SFGASCFLF | 33.9 | HLA-A*2402 | WPLSSPPTV | 152 | HLA-B*0702 | IGYICSGVF | 343.4 | HLA-B*1501 |
| RRIENLNKK | 33.9 | HLA-B*2705 | FPIGTAPVL | 152 | HLA-B*3901 | GSNRPWIRF | 343.66 | HLA-B*5801 |
| YQSGTYPVI | 33.9 | HLA-A*0201 | ALGECPKYI | 152 | HLA-A*0201 | YVSIGTSTL | 343.69 | HLA-A*0201 |
| CQDEFCYTL | 33.9 | HLA-B*3901 | AQDRGLFGA | 152 | HLA-A*0201 | IMESGGISK | 343.71 | HLA-A*0301 |
| GEVDNNGEL | 33.9 | HLA-B*4001 | GRMDYYWAV | 152 | HLA-B*3901 | QLSAGGDIW | 343.79 | HLA-B*5801 |
| LIISPDLSY | 33.9 | HLA-B*1501 | KMNPNQKIM | 152 | HLA-B*1501 | TLYKNANTL | 343.86 | HLA-A*0201 |
| KQLTHHMRK | 34 | HLA-A*0301 | NPNQKLFTL | 152 | HLA-B*0801 | RRQKRGLFG | 344.02 | HLA-B*2705 |
| FMQALQLLF | 34 | HLA-B*1501 | TTYQRTRAL | 152 | HLA-B*0801 | IEKQIGNVI | 344.16 | HLA-B*4001 |
| YRACFYVEL | 34.1 | HLA-B*3901 | ESCEGECFY | 152 | HLA-A*2601 | GRQTYDWTL | 344.3 | HLA-B*2705 |
| FRDMRKNTL | 34.2 | HLA-B*3901 | FSISCFLLI | 152 | HLA-A*0201 | YQNNFVPVM | 344.62 | HLA-A*0201 |
| YVRQNTLKL | 34.2 | HLA-B*0702 | ATYQRTRAL | 153 | HLA-B*0702 | KSLESRRGF | 344.68 | HLA-B*5801 |
| GQSGRISFY | 34.5 | HLA-B*1501 | FRALISWGM | 153 | HLA-B*3901 | YPKVYKTYF | 344.85 | HLA-B*0801 |
| LAIAMGLIF | 34.5 | HLA-B*5801 | MVKAVRGDL | 153 | HLA-B*0801 | RSHKICIGY | 345.04 | HLA-A*0101 |
| SACHDGISW | 34.5 | HLA-B*5801 | FLWMCSNGS | 153 | HLA-A*0201 | PSFFRNMIW | 345.06 | HLA-B*5801 |
| IEYQIGNVI | 34.5 | HLA-B*4001 | LSNMGVYQI | 153 | HLA-B*5801 | WILWISFAI | 345.45 | HLA-B*3901 |
| FLAFILWAC | 34.5 | HLA-A*0201 | MPFHNVHPF | 153 | HLA-B*0801 | GTFDIEGLY | 345.55 | HLA-A*0101 |
| SWTKIYWYL | 34.5 | HLA-A*2402 | RSWRRQILR | 153 | HLA-A*0301 | RIDFHWLFL | 345.64 | HLA-A*0201 |
| RLYVNKNPY | 34.6 | HLA-B*1501 | LSNMGIYQI | 153 | HLA-B*5801 | SVKEKDMTK | 345.65 | HLA-A*0301 |

Fig. 79-11

| Peptide | y (nM) | Allele | Peptide | Affinity (nM) | Allele | Peptide | Affinity (nM) | Allele |
|---|---|---|---|---|---|---|---|---|
| LLIAFVLWA | 34.7 | HLA-A*0201 | WTSNSIIVF | 153 | HLA-A*2601 | RTNGTSKVK | 345.72 | HLA-A*0301 |
| KLITVGSSK | 34.8 | HLA-A*0301 | FQNASRYYM | 153 | HLA-B*3901 | LYQKVGTYV | 345.94 | HLA-A*2402 |
| GPALSISEL | 34.8 | HLA-B*0702 | KGLCIINSW | 154 | HLA-B*5801 | VLLVSLGAI | 345.96 | HLA-A*0201 |
| SLFSSIKRY | 34.9 | HLA-B*1501 | KLEQSGLPV | 154 | HLA-A*0201 | KQSSLPLAL | 346.1 | HLA-A*0201 |
| TLKSEQFPV | 34.9 | HLA-A*0201 | ATTITLHFK | 154 | HLA-A*0301 | IASVPASRY | 346.32 | HLA-B*1501 |
| ETNGNYGPI | 34.9 | HLA-A*2601 | LIDGWYGFK | 154 | HLA-A*0301 | WFRNVLSIA | 346.38 | HLA-B*0801 |
| VEVITAQEL | 34.9 | HLA-B*4001 | IMFSNKMAR | 154 | HLA-A*0301 | SRSGYEMLK | 346.6 | HLA-B*2705 |
| VASSGTLEF | 34.9 | HLA-B*1501 | FFRNIVWLI | 154 | HLA-A*2402 | LRDCKVEAV | 346.79 | HLA-B*3901 |
| GSINTKLPF | 35 | HLA-B*1501 | SLVGVDPFK | 154 | HLA-A*0301 | RYSGFVRTL | 346.87 | HLA-A*2402 |
| QILAIYATV | 35 | HLA-A*0201 | YKMNNQILI | 154 | HLA-B*3901 | HIFGKDNAV | 346.97 | HLA-A*0201 |
| RSLFSSIKK | 35.1 | HLA-A*0301 | KLEDVFAGK | 154 | HLA-A*0301 | VASSLVLLL | 347.1 | HLA-B*5801 |
| SILNLLIGI | 35.1 | HLA-A*0201 | KQSSLPLAL | 154 | HLA-B*1501 | FRGLLSTPL | 347.22 | HLA-B*2705 |
| NHTGTYCSL | 35.1 | HLA-B*3901 | GTAPVLGNY | 154 | HLA-A*0101 | NVTNVQNNY | 347.54 | HLA-A*2601 |
| RMDYYWAIL | 35.1 | HLA-A*0201 | RRFVQNALN | 154 | HLA-B*2705 | GASCFLFLA | 347.58 | HLA-A*0201 |
| RRIDFHWLF | 35.1 | HLA-B*2705 | KLYKNTNTL | 155 | HLA-B*1501 | DQVTDIWAY | 348.26 | HLA-A*2601 |
| NPNQKLFAL | 35.2 | HLA-B*0702 | NRLNINPVR | 155 | HLA-B*2705 | MRRCLLQSL | 348.29 | HLA-B*3901 |
| SYLECRTFF | 35.4 | HLA-A*2402 | QAYTKVLYF | 155 | HLA-B*5801 | KSRSNIFNM | 348.32 | HLA-B*1501 |
| KSLFSSIKK | 35.4 | HLA-A*0301 | WTSGSSIAF | 155 | HLA-A*2601 | DSFYRNLIW | 348.4 | HLA-B*5801 |
| WTSNSIVVF | 35.5 | HLA-B*1501 | TQDAMTEVW | 155 | HLA-B*5801 | WTSSSSIVM | 348.55 | HLA-A*2601 |
| LTIIYSSSM | 35.5 | HLA-B*1501 | KLATGPRNV | 155 | HLA-A*0201 | KTFQNVSPL | 348.57 | HLA-B*5801 |
| WTSGSSIAF | 35.5 | HLA-B*1501 | HMECRTFFL | 156 | HLA-A*0201 | VWWTSNSLI | 348.77 | HLA-A*2402 |
| MRFTYSGIR | 35.6 | HLA-B*2705 | LPFHNIHPL | 156 | HLA-B*3901 | RFLRVRDQL | 349 | HLA-A*2402 |
| LLLAFILWA | 35.6 | HLA-A*0201 | VMELVRMIK | 156 | HLA-A*0301 | TMHDRSPFR | 349.35 | HLA-A*0301 |
| SSEVPEWSW | 35.6 | HLA-B*5801 | SRYVCTGIL | 156 | HLA-B*3901 | SPYRALMSV | 349.65 | HLA-B*0801 |
| YELEIGTRI | 35.7 | HLA-B*4001 | VTDIWSYNA | 156 | HLA-A*0101 | ESKLKRQEI | 349.68 | HLA-B*0801 |
| YRSMRWLTL | 35.7 | HLA-B*0801 | RGKLKRRAI | 156 | HLA-B*0801 | HRTLLMNEL | 349.73 | HLA-B*3901 |
| YRNMRWLTL | 35.8 | HLA-B*2705 | YVKKASLRL | 156 | HLA-B*0801 | KLYGNGNKL | 349.89 | HLA-A*0201 |
| FMARSALIL | 35.9 | HLA-A*0201 | QIIVTREPY | 156 | HLA-B*1501 | TMTHTSQYI | 349.94 | HLA-A*0201 |
| ETILETGYI | 35.9 | HLA-A*2601 | ITNKVNSII | 156 | HLA-B*5801 | FRGLISTHL | 350.12 | HLA-B*3901 |
| FHDSNVKNL | 35.9 | HLA-B*3901 | SYLIRTLTL | 156 | HLA-B*0801 | RLNTMHQLL | 350.5 | HLA-A*0201 |
| GLSPNVYQA | 36 | HLA-A*0201 | HAQYREEAL | 156 | HLA-B*0801 | GSSTYHNSF | 350.63 | HLA-B*5801 |
| VLVNTYQWV | 36 | HLA-A*0201 | KPFQNISRV | 156 | HLA-B*0702 | QMYQKCCSL | 350.71 | HLA-B*1501 |
| GVNSDTTSW | 36.1 | HLA-B*5801 | RQIGNVINW | 157 | HLA-B*5801 | LTIGKCPKY | 350.72 | HLA-A*2601 |
| SLNISLYSK | 36.2 | HLA-A*0301 | RTRGLFGAI | 157 | HLA-B*0702 | KSCLPACVY | 350.88 | HLA-B*5801 |
| LTITYSSSM | 36.2 | HLA-A*2601 | VENQHTIDL | 157 | HLA-B*4001 | WTGMVNGW | 351.22 | HLA-A*2601 |
| RLSADGDIW | 36.2 | HLA-B*5801 | RILFIKEGK | 157 | HLA-A*0301 | WVLWISFAI | 351.55 | HLA-B*3901 |
| AEDMGNGCL | 36.3 | HLA-B*4001 | KRMTRGLFG | 157 | HLA-B*2705 | VIVTREPYV | 352.23 | HLA-A*0201 |
| SYLIRTLTL | 36.3 | HLA-A*2402 | KRINMIADR | 157 | HLA-B*2705 | ASTGAQSFY | 352.3 | HLA-A*0101 |
| VTFSFNGAF | 36.3 | HLA-B*1501 | RTSYRSLIR | 158 | HLA-A*0301 | VAKDNAIRF | 352.72 | HLA-B*1501 |
| RLRRDQRAL | 36.3 | HLA-B*0702 | SRYWAIRTR | 158 | HLA-B*2705 | MSTNAYDRI | 352.79 | HLA-B*5801 |
| GMVDGWYGY | 36.3 | HLA-B*1501 | GRIDFHWLM | 159 | HLA-B*2705 | TRWMKIIRV | 352.83 | HLA-B*2705 |
| FLFSSIKKY | 36.4 | HLA-B*1501 | KMRDSIKSW | 159 | HLA-B*1501 | SRSGFEILL | 352.85 | HLA-B*2705 |
| AANPIVPSF | 36.6 | HLA-B*5801 | VLVNTYQWI | 159 | HLA-A*0201 | YVKKESLRL | 353.02 | HLA-B*0801 |
| KINPVTLTM | 36.6 | HLA-B*5801 | NLIAPRGYY | 159 | HLA-A*2601 | YVKSEKLVL | 353.09 | HLA-B*0801 |
| WTSGSSISF | 36.6 | HLA-B*1501 | NERGLFGAI | 159 | HLA-B*4001 | WQGSNRPVI | 353.21 | HLA-B*3901 |
| FIAPDRASF | 36.6 | HLA-B*1501 | SLSGSAQHI | 160 | HLA-A*0201 | LILAFIMWT | 353.24 | HLA-A*0201 |
| ASNINIREW | 36.6 | HLA-B*5801 | MFNMLSTVL | 160 | HLA-B*0801 | FESTGNFIA | 353.36 | HLA-B*3901 |
| ILSIYSTVV | 36.7 | HLA-A*0201 | RVKMFDFIK | 160 | HLA-A*0301 | HLGTRQVCI | 353.55 | HLA-B*0801 |
| CLLQSLQQI | 36.7 | HLA-A*0201 | GTIISNLPF | 160 | HLA-B*5801 | MVRSDKICL | 353.69 | HLA-B*0702 |
| QPNIGPRAL | 36.7 | HLA-B*0702 | LMSCPIGEA | 160 | HLA-A*0201 | QTFDWTLNR | 354.23 | HLA-A*0301 |
| APIEYVASM | 36.8 | HLA-B*0702 | RTPYRSLIK | 160 | HLA-A*0301 | FQHQNAEGI | 354.29 | HLA-B*3901 |
| AIIIAGLSF | 36.8 | HLA-B*1501 | KSLESRSGF | 160 | HLA-B*1501 | YVWWTSNSL | 354.68 | HLA-B*3901 |
| MRISNETIL | 36.9 | HLA-B*3901 | GRIDFHWLL | 160 | HLA-B*2705 | YQAKFEAVA | 355.07 | HLA-B*3901 |
| VTCVCRDNW | 36.9 | HLA-B*5801 | TTINNITNV | 161 | HLA-A*2601 | VEELVHGGI | 355.17 | HLA-B*4001 |
| VASSGNLEF | 36.9 | HLA-B*5801 | YKMNTQILI | 161 | HLA-B*3901 | NIHPLTIGK | 355.29 | HLA-A*0301 |
| FIAPDRVSF | 37 | HLA-B*1501 | IQTRRAFEL | 161 | HLA-B*3901 | ITDTLKSWK | 355.3 | HLA-A*0301 |
| ISIASRSGY | 37.1 | HLA-B*1501 | YAKKASLRL | 161 | HLA-B*0801 | GLLDVWTYN | 355.46 | HLA-A*0201 |
| MMKAVRGDL | 37.1 | HLA-B*0801 | GTRQVCVAW | 161 | HLA-B*5801 | FQNVHPITI | 355.51 | HLA-B*1501 |
| CLPACIYGL | 37.2 | HLA-A*0201 | WTANSIIVF | 161 | HLA-B*5801 | KLYGSGSKL | 355.53 | HLA-B*1501 |
| CLRGGRNSF | 37.2 | HLA-B*1501 | RRIDFHWLL | 161 | HLA-B*3901 | APGTKGFGF | 355.57 | HLA-B*0702 |
| FQNVSKYAF | 37.2 | HLA-B*1501 | HSGVCPVVF | 161 | HLA-B*5801 | CPIKGWAPL | 355.66 | HLA-B*3901 |

Fig. 79-12

| Peptide | y (nM) | Allele | Peptide | Affinity (nM) | Allele | Peptide | Affinity (nM) | Allele |
|---|---|---|---|---|---|---|---|---|
| RSINWLTKK | 37.2 | HLA-A*0301 | ITFSFNGAF | 161 | HLA-B*5801 | SRNPGNAEI | 355.7 | HLA-B*3901 |
| ISMDSRSGY | 37.3 | HLA-B*1501 | SSCHDGKSW | 162 | HLA-B*5801 | SGYSGAFTV | 355.8 | HLA-A*0201 |
| VLATGLRNV | 37.4 | HLA-A*0201 | FSVQRNLPF | 162 | HLA-B*5801 | VSSFERFEM | 356.02 | HLA-B*5801 |
| KRMGVQMHR | 37.4 | HLA-B*2705 | VLLENQKPL | 162 | HLA-A*0201 | GRYSIADKI | 356.42 | HLA-B*2705 |
| TLTDNHVEV | 37.5 | HLA-A*0201 | QVMVDNNNW | 162 | HLA-B*5801 | SGYFGVFSV | 356.43 | HLA-A*0201 |
| KPSLPLCPF | 37.5 | HLA-B*0702 | KTGGPIYKK | 162 | HLA-A*0301 | FRALISWEM | 356.6 | HLA-B*2705 |
| ALALSHTAY | 37.6 | HLA-B*1501 | SSSMNNQVF | 162 | HLA-B*1501 | GLLGAIAGF | 356.66 | HLA-B*1501 |
| YMGECPKYA | 37.6 | HLA-A*0201 | KAINGVTNK | 162 | HLA-A*0301 | RMYQKCCNL | 356.67 | HLA-B*1501 |
| LPRRSGAAG | 37.6 | HLA-B*0702 | GTFEFTSFF | 162 | HLA-A*2601 | SQHRSHRQM | 356.68 | HLA-B*1501 |
| QPNIGPRPL | 37.7 | HLA-B*0702 | VYSTVASSL | 162 | HLA-A*2402 | CPIKGWAPL | 357.03 | HLA-B*0801 |
| GTIHDRSPF | 37.9 | HLA-B*1501 | YKMNTRILI | 162 | HLA-B*3901 | TRLYIWGVH | 357.28 | HLA-B*2705 |
| VLNKSLCKV | 38 | HLA-A*0201 | FIAPEYAYK | 162 | HLA-A*0301 | FYAELKWLV | 357.48 | HLA-A*0201 |
| KILTIYSTV | 38 | HLA-A*0201 | KLYGSGNKL | 163 | HLA-A*0201 | ITQRTIGKK | 357.68 | HLA-A*0301 |
| GTINDRSPF | 38.1 | HLA-B*1501 | GSKEQLGSW | 163 | HLA-B*5801 | EVCLKWDLM | 357.75 | HLA-A*2601 |
| DAVTDVWSY | 38.1 | HLA-A*2601 | YERRLTTTI | 163 | HLA-B*4001 | WTYNVELLV | 357.87 | HLA-A*0201 |
| APIMFSNKM | 38.1 | HLA-B*0702 | GSFIDYWAK | 163 | HLA-A*0301 | LPVTGGTSS | 357.9 | HLA-B*0702 |
| GARRIDFHW | 38.1 | HLA-B*5801 | KLYWHLMSP | 163 | HLA-A*0201 | SPNAYQAKF | 358.31 | HLA-B*0702 |
| MRINNETIL | 38.2 | HLA-B*3901 | LHDANVKNL | 163 | HLA-B*3901 | MESGGIDKV | 358.36 | HLA-B*4001 |
| MVNERTLDF | 38.3 | HLA-B*1501 | GLLLQIISL | 163 | HLA-A*0201 | RILCTSATA | 358.7 | HLA-A*0201 |
| RANQRLNPM | 38.4 | HLA-B*0702 | MMTHTSQYI | 164 | HLA-B*1501 | TTYQRTRAL | 359.41 | HLA-B*0702 |
| SESSFYAEM | 38.5 | HLA-B*4001 | VVFCGTSGI | 164 | HLA-A*0201 | CQIAGFAPF | 360.01 | HLA-B*4001 |
| RILSIYSTV | 38.5 | HLA-A*0201 | QAYTKILYF | 164 | HLA-B*5801 | SSQDTELSF | 360.02 | HLA-B*5801 |
| IYSCIASSI | 38.5 | HLA-A*2402 | HMECRTFFL | 164 | HLA-B*3901 | GSSKYQQSF | 360.12 | HLA-B*5801 |
| RRIESLNKK | 38.5 | HLA-B*2705 | ASYKRIRLF | 164 | HLA-B*1501 | HIWVTREPY | 360.15 | HLA-B*1501 |
| YVKQSSLPL | 38.6 | HLA-B*0702 | KRLGSWSWH | 165 | HLA-B*2705 | ILSPLTKGM | 360.46 | HLA-B*1501 |
| FQPCFYIEL | 38.7 | HLA-A*0201 | TLDKHDSNV | 165 | HLA-A*0201 | FSFGASCLI | 360.47 | HLA-B*5801 |
| FSFGASCVM | 38.8 | HLA-B*1501 | RFLFSSIKK | 165 | HLA-A*0301 | YVKQSTLKL | 360.66 | HLA-B*0801 |
| KRMGVQMQR | 38.9 | HLA-B*2705 | KTKKMTITF | 165 | HLA-B*5801 | VLGVSILNL | 361.25 | HLA-A*0201 |
| WHDGAILPF | 38.9 | HLA-B*3901 | HSNLNDTTY | 165 | HLA-B*1501 | RARIKTRLF | 361.46 | HLA-B*1501 |
| GARRIDFNW | 38.9 | HLA-B*5801 | FPFHKDNAI | 165 | HLA-B*0801 | VVNFLSMEF | 361.67 | HLA-B*5801 |
| VPVVGDRPL | 38.9 | HLA-B*0702 | FQNTSRHYI | 165 | HLA-B*1501 | ELRFVFSNA | 362.43 | HLA-B*0801 |
| LATTITLHF | 38.9 | HLA-B*5801 | CHNGTCVVV | 165 | HLA-B*3901 | YVRQNTLKL | 362.52 | HLA-B*1501 |
| VLVTREPYV | 39 | HLA-A*0201 | MASIRNSTY | 165 | HLA-B*1501 | RSNENPAHK | 362.62 | HLA-A*0301 |
| CVLEAMAFL | 39 | HLA-A*0201 | GLVAGWYGF | 165 | HLA-B*1501 | RRQILRTQE | 362.67 | HLA-B*2705 |
| YRYTYRCHR | 39 | HLA-B*2705 | RRTNLYGFI | 165 | HLA-B*2705 | NQASYKIFK | 362.79 | HLA-A*0301 |
| ALSGMAIAL | 39.1 | HLA-A*0201 | FSARSALIL | 165 | HLA-B*3901 | RLVQNSITI | 363.4 | HLA-A*0201 |
| TTYRILSIY | 39.1 | HLA-A*2601 | SSCFDGREW | 165 | HLA-B*5801 | GRFTNEEAL | 363.42 | HLA-B*2705 |
| YQSGTYPVI | 39.1 | HLA-B*3901 | RLTTTVKTW | 165 | HLA-B*5801 | TLSTIALII | 363.79 | HLA-A*0201 |
| WTSNSIISM | 39.2 | HLA-A*2601 | QVIVTREPY | 166 | HLA-B*1501 | KILKIKKGK | 363.82 | HLA-A*0301 |
| RPRYNGQRS | 39.2 | HLA-B*0702 | RIFQSRIRM | 166 | HLA-B*1501 | IYCICRDNW | 363.95 | HLA-A*2402 |
| FQNVNRITY | 39.4 | HLA-B*1501 | VVNYVSMEF | 166 | HLA-B*5801 | STDKVNTII | 364.04 | HLA-A*0101 |
| YRYGFVANF | 39.4 | HLA-B*2705 | RRLTTTVKT | 166 | HLA-B*2705 | YSGAFTVPI | 364.11 | HLA-A*0201 |
| HQRSKFLLM | 39.4 | HLA-B*0801 | RREVHVYYL | 166 | HLA-B*2705 | NRIQIDSVK | 364.3 | HLA-B*2705 |
| SFYRNLVWF | 39.5 | HLA-A*2402 | WMACHSAAF | 166 | HLA-B*0801 | RSGAAGAAI | 364.33 | HLA-B*5801 |
| SFYRNLAWF | 39.5 | HLA-A*2402 | MTDGSASRK | 166 | HLA-A*0301 | TFMQALQLL | 364.44 | HLA-A*2402 |
| FRGRGVFEL | 39.6 | HLA-B*3901 | DQITDIWAY | 166 | HLA-A*2601 | DRTPYRTLL | 364.45 | HLA-B*3901 |
| WTANSIIVF | 39.6 | HLA-A*2601 | WPDDAELPL | 167 | HLA-B*3901 | ILTIYSTAA | 364.51 | HLA-A*0201 |
| NPKSKLFTL | 39.7 | HLA-B*0801 | ATTHSWVPK | 167 | HLA-A*0301 | FKMNPNQKI | 365.05 | HLA-B*3901 |
| REEAMQNRM | 39.7 | HLA-B*4001 | SGYSGVFSV | 167 | HLA-A*0201 | FIAPDRASF | 365.16 | HLA-A*2601 |
| VRKTRFLPV | 39.7 | HLA-B*0801 | SQFRALISW | 167 | HLA-B*1501 | ISKDLRSGY | 365.34 | HLA-B*1501 |
| GPNNNASAV | 39.7 | HLA-B*0702 | KQTRGIFGA | 167 | HLA-A*0201 | HQSGTYPVV | 365.44 | HLA-A*0201 |
| WMKLYWHLM | 39.8 | HLA-B*0801 | LPFHNIHPL | 167 | HLA-B*0801 | ETFVNVTHV | 365.58 | HLA-A*2601 |
| VLVGLILSF | 39.8 | HLA-B*1501 | WWVWLWLVL | 167 | HLA-B*3901 | VLIVSLGAI | 365.79 | HLA-A*0201 |
| RPWVRGQSG | 39.9 | HLA-B*0702 | TFQNVSPLW | 168 | HLA-B*5801 | MIEAESSVK | 365.9 | HLA-A*0301 |
| VLNVSLHLK | 39.9 | HLA-A*0301 | LMWALGENM | 168 | HLA-A*0201 | IIGKMNTQF | 366.32 | HLA-B*1501 |
| GQSGRVSFY | 39.9 | HLA-B*1501 | SGYSGSFTL | 168 | HLA-B*3901 | IFLAMITYI | 366.46 | HLA-A*2402 |
| NVYKALSIY | 39.9 | HLA-A*2601 | AEDMGGGCF | 168 | HLA-B*4001 | WPDGAEVPF | 366.78 | HLA-B*0702 |
| GMVNGWYGY | 40 | HLA-B*1501 | YISIGTSTL | 168 | HLA-A*0201 | WSYIVERTK | 366.8 | HLA-A*0301 |
| NNRIKINPV | 40 | HLA-B*0801 | ITGFAPFSK | 168 | HLA-A*0301 | EVENEIRTF | 366.86 | HLA-A*2601 |
| FTFNGSFIA | 40.1 | HLA-A*0201 | SLNDYEELK | 168 | HLA-A*0301 | FGASCFLFL | 367.27 | HLA-A*0201 |
| STIALIIGV | 40.2 | HLA-A*0201 | AEEMGNGCF | 168 | HLA-B*4001 | LVVSPDLSY | 367.47 | HLA-A*2601 |

Fig. 79-13

| Peptide | Affinity (nM) | Allele | Peptide | Affinity (nM) | Allele | Peptide | Affinity (nM) | Allele |
|---|---|---|---|---|---|---|---|---|
| MPFHNVHPL | 40.2 | HLA-B*3901 | AYQARFESV | 168 | HLA-A*2402 | GRWPGLVAG | 367.54 | HLA-B*2705 |
| TLTETGVPV | 40.2 | HLA-A*0201 | CTINSWHIY | 168 | HLA-A*0101 | HSNEQGSGY | 367.83 | HLA-A*2601 |
| WHDGAVLPF | 40.3 | HLA-B*3901 | RNIVRRATV | 168 | HLA-B*0801 | MVRSDKICL | 367.84 | HLA-B*0801 |
| YVRKASLRL | 40.3 | HLA-B*0702 | KPFQNISRI | 169 | HLA-B*0702 | SLVKTTLFL | 367.87 | HLA-B*1501 |
| MVIASTTAK | 40.3 | HLA-A*0301 | DQIQDLWAY | 169 | HLA-A*2601 | FQHQNAEGI | 368.38 | HLA-A*0201 |
| YRSLIQFPM | 40.3 | HLA-B*2705 | NPRVFLTMI | 169 | HLA-B*0702 | TSYKILSIY | 368.42 | HLA-A*2601 |
| CTINSWHIY | 40.4 | HLA-A*2601 | FQTAAQRAM | 169 | HLA-B*3901 | TPRNGDSSS | 368.53 | HLA-B*0702 |
| MHDANVKNL | 40.6 | HLA-B*3901 | YQKQMTRGL | 169 | HLA-B*1501 | RVWWTTNSI | 368.64 | HLA-B*5801 |
| MPFHNIHPL | 40.6 | HLA-B*0801 | ILSPLTKGI | 169 | HLA-A*0201 | VINNMTTTI | 368.84 | HLA-B*1501 |
| SVLINTYQW | 40.6 | HLA-B*5801 | RMADSIKSW | 169 | HLA-B*1501 | ELREQLSSV | 368.93 | HLA-B*0801 |
| ILVTREPYV | 40.6 | HLA-A*0201 | IAKDNAVRF | 170 | HLA-B*1501 | MNNEGSYFF | 369.22 | HLA-B*1501 |
| MQNGSYRCM | 40.7 | HLA-B*1501 | NMQNRLNNV | 170 | HLA-B*0801 | RTELINPSK | 369.35 | HLA-A*0301 |
| FQNVHPVTI | 40.7 | HLA-B*3901 | ILAIYSTVA | 170 | HLA-A*0201 | VFSNAASYK | 369.58 | HLA-A*0301 |
| REEALLNRI | 40.8 | HLA-B*4001 | IICVCRDNW | 170 | HLA-B*5801 | YIQMCTELK | 370.37 | HLA-A*0301 |
| EIRASVGRM | 40.8 | HLA-A*2601 | MLRIPNAGI | 170 | HLA-B*0801 | SSVASSLVL | 370.87 | HLA-B*1501 |
| LLLAFVLWA | 40.8 | HLA-A*0201 | KRINMLADR | 170 | HLA-B*2705 | WSWPDGAE | 371.09 | HLA-A*0201 |
| MMMGMFNML | 40.8 | HLA-B*3901 | VVCVCRDNW | 170 | HLA-B*5801 | YVWWTSNSL | 371.98 | HLA-B*0702 |
| YRSLIRFPI | 40.9 | HLA-B*3901 | SQYRALISW | 170 | HLA-B*1501 | KMKAILVVL | 372.12 | HLA-B*1501 |
| KLKSEDNVY | 40.9 | HLA-B*1501 | NPALRMKWM | 170 | HLA-B*0702 | IIFEATGNL | 372.35 | HLA-A*0201 |
| YVKQSSLPL | 40.9 | HLA-B*1501 | VTDVWSYNA | 170 | HLA-A*0101 | LMSCPIGVA | 372.71 | HLA-A*0201 |
| VEVVTAQEL | 41.1 | HLA-B*4001 | SVKTGTYDY | 170 | HLA-B*1501 | IAQDNAIRF | 372.75 | HLA-B*5801 |
| LIRGNSPIF | 41.2 | HLA-B*1501 | FQNASRHYM | 170 | HLA-B*3901 | RLQLRDNAK | 372.84 | HLA-A*0301 |
| SACHDGTSW | 41.3 | HLA-B*5801 | VSFSISCFL | 170 | HLA-B*5801 | WTSGSSIAF | 372.98 | HLA-B*5801 |
| FRNVVWLTK | 41.4 | HLA-B*2705 | NLIAPWYAY | 171 | HLA-B*1501 | EKIEKIRPL | 373.23 | HLA-B*3901 |
| KQASYKIFK | 41.4 | HLA-A*0301 | SRSGFEILL | 171 | HLA-B*3901 | CHNGICPVA | 373.47 | HLA-B*3901 |
| GLIDGWYGF | 41.5 | HLA-A*0201 | QILSIYSTV | 171 | HLA-A*0201 | HLMIWHSNL | 373.62 | HLA-B*3901 |
| RWKHVTNTI | 41.5 | HLA-A*2402 | RMTICVQGK | 171 | HLA-A*0301 | LRFVFSNAA | 373.95 | HLA-B*3901 |
| FPVGTAPVL | 41.5 | HLA-B*0702 | RMFLAMITY | 171 | HLA-A*0301 | YMNTALLNA | 373.98 | HLA-B*1501 |
| KINPVTLTM | 41.7 | HLA-B*1501 | MLNASCAAM | 171 | HLA-A*0201 | YKYGNGVWI | 374.09 | HLA-B*3901 |
| NEEALRQIL | 41.7 | HLA-B*4001 | LILTFIMWA | 171 | HLA-A*0201 | GVFELSDEK | 374.2 | HLA-A*0301 |
| KLATGMRNV | 41.8 | HLA-A*0201 | LILGFVLWA | 171 | HLA-A*0201 | RRVWRQANN | 374.48 | HLA-B*2705 |
| LMIIGGFIF | 42.1 | HLA-B*1501 | ATTHSWTPK | 172 | HLA-A*0301 | GLVNLGLNI | 374.59 | HLA-A*0201 |
| GMGQAPSPY | 42.1 | HLA-B*1501 | ALYKNANTL | 172 | HLA-A*0201 | SLIWLWLVL | 374.7 | HLA-B*3901 |
| KLSSGYKEV | 42.2 | HLA-A*0201 | NRIRIDPVK | 172 | HLA-B*2705 | HSRGLFGAI | 374.81 | HLA-B*0801 |
| LLSSKANQV | 42.3 | HLA-A*0201 | RRRFIQNAL | 172 | HLA-B*2705 | LIYNRMGAV | 374.95 | HLA-A*0201 |
| RRLENLSKR | 42.3 | HLA-B*2705 | KMYALHQGT | 172 | HLA-A*0201 | KLYWHLMRP | 375.27 | HLA-A*0201 |
| SPSECRTFF | 42.3 | HLA-B*0702 | RANQRLNTM | 173 | HLA-B*0801 | LISDGGPNL | 375.3 | HLA-A*0201 |
| RLKITENSF | 42.4 | HLA-B*1501 | TWLGRTISI | 173 | HLA-B*0801 | FYAEMEWLL | 375.41 | HLA-A*0201 |
| LQITSLCSI | 42.5 | HLA-B*1501 | NLIAPRGHY | 173 | HLA-B*1501 | LIYNRMGTV | 375.66 | HLA-A*0201 |
| FYRNLVWFI | 42.5 | HLA-A*2402 | AIDEITTKI | 174 | HLA-A*0201 | QNRMQINPV | 375.66 | HLA-B*0801 |
| MTDSEMLNL | 42.5 | HLA-A*0101 | GTKQVCVAW | 174 | HLA-B*5801 | MEKFIVLSV | 375.95 | HLA-B*4001 |
| TYQWVIRNW | 42.6 | HLA-A*2402 | KMEKIVLLL | 174 | HLA-A*0201 | NSRFESVAW | 375.95 | HLA-B*5801 |
| VLVGLILAF | 42.6 | HLA-B*1501 | RLEGVFAGK | 174 | HLA-A*0301 | ETIEERFEI | 376.33 | HLA-A*2601 |
| WMMAMRYPI | 42.6 | HLA-B*1501 | LSIYSTVAA | 174 | HLA-B*1501 | RILTSESQM | 376.34 | HLA-B*1501 |
| LPFHNVHPF | 42.7 | HLA-B*0702 | SLSLAIMMA | 174 | HLA-A*0201 | LTIGECPRY | 376.49 | HLA-B*1501 |
| QAFYRSINW | 42.7 | HLA-B*5801 | ITYGVCPRY | 175 | HLA-A*0301 | LAIMIAGLF | 376.53 | HLA-B*5801 |
| APIEYIASM | 42.8 | HLA-B*0702 | TTINNITNV | 175 | HLA-A*0201 | ITYGPCPRY | 377.02 | HLA-B*1501 |
| SLAIMVAGI | 42.9 | HLA-B*0702 | GTAPILGNY | 175 | HLA-A*2601 | RMEFSWILL | 377.26 | HLA-A*0201 |
| RANQRLNPM | 42.9 | HLA-B*1501 | ALSVLNLLI | 175 | HLA-A*0201 | FQYLLFQDI | 377.57 | HLA-A*0201 |
| MLQSRTREI | 42.9 | HLA-B*0801 | GSIITELPF | 175 | HLA-B*5801 | YVKQNTLKL | 377.72 | HLA-B*0801 |
| NEFNKACEL | 42.9 | HLA-B*4001 | RTWAKNILR | 175 | HLA-A*0301 | KLDINMADY | 377.78 | HLA-A*0101 |
| WTSNSIVTF | 42.9 | HLA-B*1501 | ALSILNLLI | 175 | HLA-A*0201 | TTLSTIALF | 378 | HLA-B*1501 |
| GSIKTKLPF | 43 | HLA-B*1501 | YNAGLLVAL | 175 | HLA-B*3901 | YRSLIRFPI | 378.04 | HLA-B*0801 |
| LKISSSFSF | 43 | HLA-B*1501 | TKLGSPLVL | 175 | HLA-B*3901 | RMDYYWGIL | 378.28 | HLA-B*3901 |
| NENGDIIFL | 43.1 | HLA-B*4001 | GSSTYQNSF | 175 | HLA-B*1501 | LLGNPMCDK | 378.34 | HLA-A*0301 |
| MARLGRGYM | 43.1 | HLA-B*0702 | ISRDSRSGY | 176 | HLA-B*1501 | NLTRGLCTI | 378.5 | HLA-A*0201 |
| SVLNLLIGI | 43.2 | HLA-A*0201 | CVILLNPFV | 176 | HLA-A*0201 | RMVLASTTA | 378.76 | HLA-B*1501 |
| FVAPDRVSF | 43.2 | HLA-B*1501 | CHNGTCPVV | 176 | HLA-B*3901 | SSCHDGKAW | 378.88 | HLA-B*5801 |
| TIIESNVTV | 43.3 | HLA-A*0201 | RVKRRPVAK | 176 | HLA-A*0301 | SLCSVEGWV | 379.13 | HLA-A*0201 |
| YRSLIRFPV | 43.3 | HLA-B*3901 | LLAFMLWAC | 176 | HLA-A*0201 | TIHDRTTFR | 379.14 | HLA-A*0301 |
| YQAELLVAM | 43.3 | HLA-B*3901 | VLELIRMIK | 176 | HLA-A*0301 | FTIGECPKY | 379.36 | HLA-A*0101 |

Fig. 79-14

| Peptide | y (nM) | Allele | Peptide | Affinity (nM) | Allele | Peptide | Affinity (nM) | Allele |
|---|---|---|---|---|---|---|---|---|
| SMSDIEAMA | 43.4 | HLA-A*0201 | LPACVYGPA | 176 | HLA-B*0702 | CIASSLILA | 379.61 | HLA-A*0201 |
| KLEENTSYK | 43.4 | HLA-A*0301 | RLIQNSLTI | 176 | HLA-A*0201 | AIWVTREPY | 379.97 | HLA-B*1501 |
| SLDEQNKLY | 43.4 | HLA-A*0101 | RVDDAVTDV | 176 | HLA-A*0201 | LTMGECPKY | 380.02 | HLA-B*1501 |
| SVKNGTYEY | 43.5 | HLA-B*1501 | FQNVHPITI | 176 | HLA-A*0201 | LNRLSINPV | 380.36 | HLA-B*0801 |
| QSGRISIYW | 43.5 | HLA-B*5801 | KYLPDLYDY | 176 | HLA-A*2402 | SCIASSTVM | 380.46 | HLA-B*1501 |
| IAWSSSSCF | 43.7 | HLA-B*1501 | NKYVNNTTI | 176 | HLA-B*3901 | NLEPGTFDI | 380.6 | HLA-A*0201 |
| FVAPDRASF | 43.9 | HLA-B*1501 | HSMSDIEAM | 176 | HLA-B*1501 | FGRIDFHWL | 381.1 | HLA-B*0801 |
| STYKILSIY | 44 | HLA-B*1501 | VPSIQSRGL | 176 | HLA-B*0702 | YQSRFEAVA | 381.18 | HLA-B*3901 |
| SHTGTYCSL | 44 | HLA-B*3901 | IVKTLTSEK | 176 | HLA-A*0301 | SMSGFRSNL | 381.7 | HLA-B*1501 |
| SSFERFEIF | 44.1 | HLA-B*1501 | CIINSWHIY | 176 | HLA-A*2601 | RARIKTRLF | 381.79 | HLA-B*0801 |
| WTSNSIIVF | 44.1 | HLA-B*1501 | SLVGIDPFK | 176 | HLA-A*0301 | APEYGHLVT | 381.9 | HLA-B*0702 |
| ETKGLFGAI | 44.1 | HLA-A*2601 | YAFGNCPMY | 177 | HLA-B*1501 | PQCDLFLEF | 381.91 | HLA-B*1501 |
| KRMGVQIQR | 44.5 | HLA-B*2705 | RYLPDLYDY | 177 | HLA-A*2402 | RIDYYWSVL | 382.07 | HLA-B*3901 |
| YSHGTGTGY | 44.5 | HLA-B*1501 | GSSKYQQSF | 177 | HLA-B*1501 | YSLVGIDPF | 382.42 | HLA-B*1501 |
| SYINKTGTF | 44.5 | HLA-A*2402 | MARLGKGYM | 177 | HLA-B*0702 | SLIRFPVGT | 382.69 | HLA-A*0201 |
| LRWALGENM | 44.5 | HLA-B*2705 | FQHQNEQGM | 177 | HLA-B*1501 | VLSIYSCIA | 382.84 | HLA-A*0201 |
| LGNGCFEFW | 44.6 | HLA-B*5801 | RPWIRFNSN | 177 | HLA-B*0801 | SIVSWSQNI | 383.13 | HLA-A*0201 |
| ILDFHDSNV | 44.6 | HLA-A*0201 | SRINTINSK | 177 | HLA-B*2705 | ILSIYSCIA | 383.31 | HLA-A*0201 |
| FMARSALIL | 44.9 | HLA-B*3901 | VETNHTDEL | 177 | HLA-B*4001 | AIWTSGSSI | 383.33 | HLA-B*1501 |
| GLNISLHLK | 44.9 | HLA-A*0301 | MGLRISSSF | 177 | HLA-B*1501 | YQFALGHGT | 383.56 | HLA-A*0201 |
| FHSDTPRPV | 45 | HLA-B*3901 | FRHQNAQGI | 177 | HLA-B*3901 | FEATGNLIA | 383.71 | HLA-B*3901 |
| VTFTFNGAF | 45 | HLA-B*1501 | KMKAIIVVL | 178 | HLA-A*0201 | RVRNQSGRI | 384.23 | HLA-B*0702 |
| YRSLIQFPI | 45 | HLA-B*3901 | LASCMGLIY | 178 | HLA-A*0101 | SSVSSFKRF | 384.9 | HLA-B*5801 |
| YSSPQLEGF | 45.1 | HLA-B*5801 | LSSKDNQVF | 178 | HLA-B*1501 | MQIRGFVYF | 384.92 | HLA-A*0201 |
| MLADRIDDA | 45.1 | HLA-A*0201 | RLNPMHQLL | 178 | HLA-A*0201 | AEDMGDGCF | 385.03 | HLA-B*4001 |
| KMNREFEVM | 45.2 | HLA-B*1501 | CFQRSKFLL | 178 | HLA-A*2402 | IQTRGLFGA | 385.25 | HLA-A*0201 |
| SFSFGGFTF | 45.2 | HLA-A*2402 | KISLGHHAV | 178 | HLA-A*0201 | SQYLCTGIL | 385.64 | HLA-B*1501 |
| SSVSSFERF | 45.2 | HLA-B*1501 | TLCLGHHAV | 179 | HLA-A*0201 | GVAPVLGNY | 385.71 | HLA-A*2601 |
| RMATGLRNV | 45.3 | HLA-A*0201 | RLIEKTNDK | 179 | HLA-A*0301 | VLIGQGDIV | 385.86 | HLA-A*0201 |
| GLNVSLHLK | 45.4 | HLA-A*0301 | FLHNGGLIA | 179 | HLA-A*0201 | FESNGNFIA | 386.78 | HLA-B*3901 |
| WTSNSMVTF | 45.5 | HLA-B*1501 | FQNTSKHYI | 179 | HLA-A*0201 | RPVTEINTW | 386.95 | HLA-B*5801 |
| VLWTSNSVV | 45.5 | HLA-A*0201 | FQNVSRIAI | 179 | HLA-B*1501 | VQHPELTGL | 387.05 | HLA-A*0201 |
| TLDQHDANV | 45.6 | HLA-A*0201 | GMFNMLSTV | 179 | HLA-B*1501 | STDTVNTLT | 387.14 | HLA-A*0101 |
| GQAGRMTFY | 45.6 | HLA-B*1501 | VTYQILSIY | 179 | HLA-B*1501 | NTSYKILSI | 387.3 | HLA-B*0801 |
| SIRNGTYNY | 45.9 | HLA-B*1501 | SVENGTYDY | 179 | HLA-A*0101 | SYIIRALTL | 387.3 | HLA-B*0801 |
| GTYDHKEFK | 46 | HLA-A*0301 | FLAPRYALE | 179 | HLA-A*0201 | IAIGNCPKY | 387.43 | HLA-B*1501 |
| YHWNLALDI | 46 | HLA-B*3901 | YMNVKSLKL | 180 | HLA-B*0801 | RMVTGLRNI | 388.03 | HLA-A*0201 |
| TLSTIALFI | 46.2 | HLA-A*0201 | ELRSGYWAI | 180 | HLA-B*0801 | SQYRALVSW | 388.21 | HLA-A*2402 |
| YAVIHYGGM | 46.2 | HLA-A*2601 | EIRAFSFQL | 180 | HLA-B*0801 | WSWPDGALL | 388.38 | HLA-B*5801 |
| YPRYPGVRC | 46.2 | HLA-B*0702 | FVYFVETLA | 180 | HLA-A*0201 | FMCVGWSST | 388.41 | HLA-A*0201 |
| ETILETGYV | 46.3 | HLA-A*2601 | FRDMRKNTL | 180 | HLA-B*0801 | LYNIRNLHI | 388.63 | HLA-A*2402 |
| MMMGMFNML | 46.4 | HLA-B*0801 | RLRRDQKSL | 180 | HLA-B*0702 | YQKRMGVQL | 388.79 | HLA-B*1501 |
| KMNTQFEAI | 46.4 | HLA-A*0201 | LLQANLCRF | 181 | HLA-B*1501 | GRNCTVPCF | 389.12 | HLA-B*2705 |
| YQNNFVPVI | 46.5 | HLA-B*1501 | NSCESKCFW | 181 | HLA-B*5801 | LIFLARSAL | 389.3 | HLA-B*1501 |
| YHDSNVKNL | 46.5 | HLA-B*3901 | GLVDGWYGY | 181 | HLA-B*1501 | YSGAFTIPI | 389.36 | HLA-A*0201 |
| YRGRLCNPL | 46.7 | HLA-B*3901 | IADKICIGY | 181 | HLA-A*0101 | YQARFESVA | 389.4 | HLA-B*3901 |
| KILSIYSCV | 46.7 | HLA-A*0201 | QMTRGLFGA | 181 | HLA-A*0201 | YPIQNLTKV | 389.73 | HLA-B*0702 |
| LVAPWYAYK | 46.7 | HLA-A*0301 | CIKTFFGWK | 181 | HLA-A*0301 | HSNLNDTTY | 389.76 | HLA-B*5801 |
| QAYTKVLYF | 46.8 | HLA-B*1501 | FEATGNLLV | 181 | HLA-B*3901 | VYQARFEAV | 389.83 | HLA-A*2402 |
| ELKSLFSSI | 46.9 | HLA-B*0801 | IQSRGLFGA | 181 | HLA-A*0201 | RREVHVYYL | 389.88 | HLA-B*3901 |
| GRMNYHWTL | 46.9 | HLA-B*3901 | LRFVFSIAA | 181 | HLA-B*2705 | KRTNMINDK | 389.89 | HLA-B*2705 |
| VLINTYQWI | 46.9 | HLA-A*0201 | TRINMINSK | 182 | HLA-B*2705 | RPKVNGQSG | 390.05 | HLA-B*0702 |
| TYQWIIKNW | 47 | HLA-A*2402 | RPVAEINTW | 182 | HLA-B*5801 | GTYQILSIY | 390.12 | HLA-A*0101 |
| DAMTEVWSY | 47 | HLA-A*2601 | NMSLNISLY | 182 | HLA-B*1501 | YQILSVYST | 390.41 | HLA-A*0201 |
| YRSMRWLTL | 47 | HLA-B*2705 | YIKQNTLKL | 182 | HLA-B*0801 | CSYLECRTF | 390.75 | HLA-B*1501 |
| FPIGTAPVL | 47 | HLA-B*0702 | GMLGFVFTL | 183 | HLA-B*3901 | HDRSQFRAL | 390.87 | HLA-B*0801 |
| STVSSFERF | 47.1 | HLA-B*1501 | KTNTQFELI | 183 | HLA-B*5801 | ERTNQQFEL | 390.98 | HLA-B*3901 |
| FTFKRTKGF | 47.2 | HLA-B*1501 | KEQLGSWSW | 183 | HLA-B*4001 | SRTREILTR | 391.15 | HLA-B*2705 |
| FQGRGVFEL | 47.2 | HLA-B*3901 | HIAILVTTV | 183 | HLA-A*0201 | HSNGQGSGY | 391.17 | HLA-A*2601 |
| RVGSRGHVF | 47.2 | HLA-B*1501 | YRKRMTRGL | 183 | HLA-B*2705 | SWMKIYWSL | 391.39 | HLA-A*0201 |
| YRSLIRFPI | 47.5 | HLA-B*2705 | SPNAYQAQF | 183 | HLA-B*0702 | LPLCPFRGF | 391.88 | HLA-B*0702 |

Fig. 79-15

| Peptide | y (nM) | Allele | Peptide | Affinity (nM) | Allele | Peptide | Affinity (nM) | Allele |
|---|---|---|---|---|---|---|---|---|
| WTSGSIISF | 47.6 | HLA-A*2601 | YISSGSLKL | 183 | HLA-A*0201 | KTNQQFEMI | 392.03 | HLA-B*5801 |
| SSFERFEMF | 47.6 | HLA-B*1501 | RPLVRGQSG | 184 | HLA-B*0702 | RMIQLIVSG | 392.21 | HLA-B*1501 |
| ALANTIEIF | 47.8 | HLA-B*1501 | FLAPRYSFE | 184 | HLA-A*0201 | RVFLAMITY | 392.36 | HLA-A*0301 |
| RPRRGLFGA | 47.9 | HLA-B*0702 | FQNTSRHYI | 184 | HLA-A*0201 | LIMRTVIAL | 392.39 | HLA-B*1501 |
| FLAMITYIT | 47.9 | HLA-A*0201 | SRNGFEMLK | 184 | HLA-B*2705 | WSWDDGAIL | 392.55 | HLA-B*3901 |
| CQDEFCYTL | 47.9 | HLA-A*0201 | FRGLISTQL | 184 | HLA-B*3901 | LSNPKCDLY | 392.77 | HLA-B*5801 |
| GRINYYWTL | 47.9 | HLA-B*2705 | LRFVFSSAA | 184 | HLA-B*2705 | LLAIAMGLI | 392.79 | HLA-A*0201 |
| GTIVSSLPF | 48.1 | HLA-B*5801 | AMGLVFICV | 184 | HLA-A*0201 | KEECYRACF | 392.83 | HLA-B*4001 |
| TSYRSLIRF | 48.1 | HLA-B*5801 | GTSSIYIEV | 184 | HLA-A*0201 | KSCLPACAY | 393.05 | HLA-B*1501 |
| FHGAKEVAL | 48.1 | HLA-B*3901 | LLAKSVFNS | 184 | HLA-A*0201 | NDLYGTQPL | 393.24 | HLA-B*3901 |
| LENQHTIHL | 48.2 | HLA-B*4001 | YQSTNSTEI | 184 | HLA-B*3901 | YVKQSTLKL | 393.27 | HLA-B*1501 |
| RLIERTNEK | 48.3 | HLA-A*0301 | APLMVAYML | 184 | HLA-B*0702 | QIAILAATV | 393.54 | HLA-A*0201 |
| RTHIHIFSF | 48.4 | HLA-B*5801 | VTDIWAYNA | 185 | HLA-A*0101 | ATAVAVLKY | 393.9 | HLA-A*0301 |
| QPGWFRNVL | 48.6 | HLA-B*0702 | GIKGFSFRY | 185 | HLA-A*0301 | IPMISKSRT | 393.98 | HLA-B*0702 |
| RGRHANGTM | 48.6 | HLA-B*0702 | ITIGKCSKY | 185 | HLA-A*2601 | ILCTSATAL | 394.02 | HLA-B*1501 |
| GWMDYYWGI | 48.7 | HLA-A*2402 | GRIDFHWML | 185 | HLA-B*3901 | SGRINFHWL | 394.08 | HLA-B*0801 |
| TILEQNVTV | 48.8 | HLA-A*0201 | LSSKDNQVF | 185 | HLA-B*5801 | AYQAQFESV | 394.14 | HLA-A*2402 |
| CLPACVYGL | 48.8 | HLA-A*0201 | AEDMGNGCF | 185 | HLA-B*4001 | ATKRLRMAI | 394.17 | HLA-B*0801 |
| RPVAKAGFI | 48.8 | HLA-B*0702 | LSSVTTNTI | 185 | HLA-B*5801 | LTKTTVDHM | 394.41 | HLA-B*1501 |
| NSADHRVYW | 48.9 | HLA-B*5801 | KPFQNVNRI | 186 | HLA-B*0702 | NEFNKACEL | 394.65 | HLA-B*3901 |
| WILWISFAM | 48.9 | HLA-A*0201 | GLFGAIAGF | 186 | HLA-A*0201 | NQDSFYRSM | 394.81 | HLA-B*3901 |
| QVLAIYATV | 48.9 | HLA-A*0201 | GVIVTREPY | 186 | HLA-B*1501 | QVIVDNNNW | 394.9 | HLA-B*5801 |
| AAWSSSSCF | 49 | HLA-B*1501 | LYDRVRMQL | 186 | HLA-A*2402 | YKMNTKILV | 394.95 | HLA-B*3901 |
| RRKTNLYGF | 49.1 | HLA-B*2705 | GYKDWFLWI | 186 | HLA-A*2402 | KADEICIGY | 395.91 | HLA-A*0101 |
| NRMQINPVK | 49.1 | HLA-B*2705 | YRNLIWLVQ | 186 | HLA-B*2705 | KTLKLATGM | 396.32 | HLA-B*5801 |
| LIAPRGYYK | 49.1 | HLA-A*0301 | MENEMTLDF | 186 | HLA-B*1501 | DVFVIREPF | 396.35 | HLA-A*2601 |
| HLRDQGWSY | 49.1 | HLA-B*1501 | SLFSSIKRY | 186 | HLA-A*0301 | RSLLLATGM | 396.56 | HLA-B*5801 |
| VASSGTVEF | 49.1 | HLA-B*5801 | ITNRVNSII | 186 | HLA-B*5801 | SVKNGTYYY | 396.59 | HLA-A*0301 |
| VVNYVSMEF | 49.1 | HLA-B*1501 | SSFERFEIF | 186 | HLA-B*5801 | LTSVTTNTI | 396.76 | HLA-B*5801 |
| KSLPDLYDY | 49.2 | HLA-B*5801 | MANIRNNTY | 187 | HLA-B*1501 | IKSHAYISF | 396.89 | HLA-B*1501 |
| RLATGLRNV | 49.2 | HLA-A*0201 | KMNGNYDSI | 187 | HLA-A*0201 | KQSSLPLAL | 397.08 | HLA-B*3901 |
| RRRTNLYGF | 49.3 | HLA-B*2705 | IQMCTELQL | 187 | HLA-A*0201 | WMRISNETI | 397.27 | HLA-B*0801 |
| DQIEDLWAY | 49.3 | HLA-A*2601 | DEGDGCFSL | 187 | HLA-B*4001 | GSSFYAELK | 397.32 | HLA-A*0301 |
| YVKQSSLPL | 49.5 | HLA-B*0801 | LMENERTLY | 187 | HLA-B*1501 | YPKVYKTYF | 397.4 | HLA-B*0702 |
| QSGRIEFHW | 49.5 | HLA-B*5801 | GSSTYHNSF | 187 | HLA-B*1501 | MMEAMVSRA | 397.48 | HLA-A*0201 |
| YRALMSVPL | 49.7 | HLA-B*2705 | YVKSDRLVL | 187 | HLA-B*0702 | NLEPGTFDL | 397.54 | HLA-A*0201 |
| GTITSPLPF | 49.7 | HLA-B*5801 | KMARLGKGY | 187 | HLA-A*0301 | ETYKILTIY | 398.18 | HLA-A*0101 |
| VLWTSNSIV | 49.9 | HLA-A*0201 | NLIAPWYGY | 187 | HLA-A*2601 | LIGKTNQQF | 398.77 | HLA-B*1501 |
| LIAPRGYFK | 49.9 | HLA-A*0301 | GIHHPPNTK | 187 | HLA-A*0301 | SPLSRCRET | 398.98 | HLA-B*0702 |
| LIFMARSAL | 49.9 | HLA-B*0801 | KLYWHLMHP | 187 | HLA-A*0201 | FIENGWQGL | 399.09 | HLA-A*0201 |
| RMDYYWAVL | 50 | HLA-B*3901 | LVTTVTLHF | 188 | HLA-B*5801 | VITDTIKSW | 399.14 | HLA-B*5801 |
| RANQRLNPM | 50 | HLA-B*0801 | LVISPDLSY | 188 | HLA-A*2601 | SSSGNNQVF | 399.37 | HLA-B*1501 |
| GPVHFRNQI | 50.2 | HLA-B*0702 | GRMDYYWGI | 188 | HLA-B*2705 | FEANGNLIA | 399.5 | HLA-B*3901 |
| VPAQNAISI | 50.2 | HLA-B*0702 | YRICKLVGI | 188 | HLA-B*2705 | SIYIEVLHL | 399.65 | HLA-A*0201 |
| FQNIHPATI | 50.2 | HLA-B*3901 | QMALQLFIK | 188 | HLA-A*0301 | KMNREFGVV | 399.7 | HLA-A*0201 |
| TYQWIIRNW | 50.2 | HLA-A*2402 | FQTAAQKAM | 188 | HLA-B*3901 | SLTHALREL | 399.72 | HLA-A*0201 |
| MPFHNVHPL | 50.3 | HLA-B*0801 | AEEDGNGCF | 188 | HLA-B*4001 | NLERRLENL | 399.89 | HLA-B*0801 |
| SLFSSIKKY | 50.3 | HLA-B*1501 | LYEKVRLQL | 188 | HLA-A*2402 | NIWAYNAEL | 400 | HLA-B*3901 |
| RRINMLADR | 50.4 | HLA-B*2705 | LINTYQWII | 188 | HLA-A*0201 | ILCTSATAL | 400.17 | HLA-A*0201 |
| SVRNGTYNY | 50.4 | HLA-B*1501 | KLYGTGNKL | 188 | HLA-A*0201 | VYQSRFEAV | 400.43 | HLA-A*2402 |
| WTSNSIVSM | 50.4 | HLA-A*2601 | KSRSNIFNM | 188 | HLA-B*5801 | NKDGDIIFL | 400.78 | HLA-B*3901 |
| SASTGGQSF | 50.5 | HLA-B*1501 | ALGQGTTLY | 188 | HLA-B*1501 | GADDDAYAV | 400.8 | HLA-A*0201 |
| FYSEMKWLL | 50.6 | HLA-A*2402 | GTRQVCIAW | 189 | HLA-B*5801 | QMYQKCCSL | 400.89 | HLA-B*3901 |
| LLLAFMLWA | 50.6 | HLA-A*0201 | CIRTFFGWK | 189 | HLA-A*0301 | ITFSFNGAF | 400.94 | HLA-A*2601 |
| EIRASVGKM | 50.8 | HLA-A*2601 | FHNVSKYAF | 189 | HLA-B*3901 | ETFVNVTNV | 401.37 | HLA-A*2601 |
| ALLKHRFEI | 50.8 | HLA-A*0201 | CSIHECRTF | 189 | HLA-B*0801 | NPAYCNTDL | 401.37 | HLA-B*0702 |
| IPSWEGNIL | 50.8 | HLA-B*0702 | YLECRTFFL | 189 | HLA-B*0801 | FMYSDFHFI | 401.38 | HLA-A*2402 |
| CEVNSWHIF | 50.9 | HLA-B*4001 | GSNRPWVSF | 189 | HLA-B*1501 | NPRVFLAMI | 401.46 | HLA-B*0801 |
| ALSGVAVAL | 50.9 | HLA-A*0201 | LVISSDLSY | 189 | HLA-A*2601 | WMACHSAAF | 401.5 | HLA-A*0201 |
| GERGLFGAI | 51 | HLA-B*4001 | VQSYFQLFL | 189 | HLA-B*1501 | NMRCTISLV | 401.6 | HLA-A*0201 |
| FRALISWEM | 51 | HLA-B*3901 | ETFRVIDGW | 189 | HLA-B*5801 | SADPLASLL | 401.75 | HLA-B*3901 |

Fig. 79-16

| Peptide | Affinity (nM) | Allele | Peptide | Affinity (nM) | Allele | Peptide | Affinity (nM) | Allele |
|---|---|---|---|---|---|---|---|---|
| GLYEAIEEC | 51.1 | HLA-A*0201 | KLYVNKNPY | 189 | HLA-A*0301 | GVKLAQGYK | 401.93 | HLA-A*0301 |
| WMKIYWHLM | 51.2 | HLA-B*0801 | GRIDFHWLI | 190 | HLA-B*2705 | NGYKDVILW | 402.22 | HLA-B*5801 |
| RPADGTGSC | 51.2 | HLA-B*0702 | AQDVIMEVV | 190 | HLA-A*0201 | VTLHFKQHK | 403.14 | HLA-A*0301 |
| SLAIMMAGI | 51.3 | HLA-A*0201 | TIIYSSSMM | 190 | HLA-A*2601 | SIVMCGVDY | 403.33 | HLA-B*1501 |
| NEEGDIIFL | 51.4 | HLA-B*4001 | YAFGTCPKY | 190 | HLA-B*1501 | WICMGHHAV | 403.36 | HLA-A*0201 |
| YRSIRWLTL | 51.7 | HLA-B*2705 | VQSRGLFGA | 190 | HLA-A*0201 | NTTWVNQTY | 403.44 | HLA-A*2601 |
| AMLNASCAA | 51.8 | HLA-A*0201 | GVYKALSIY | 190 | HLA-A*0301 | RLIQNSITI | 403.44 | HLA-B*1501 |
| LYDKVRHQL | 51.9 | HLA-A*2402 | SIDRFLRVK | 190 | HLA-A*0301 | MQRFRRPDS | 403.5 | HLA-B*0801 |
| GPAECRTFF | 51.9 | HLA-B*0702 | RRVDMNPGH | 191 | HLA-B*2705 | YTLVSTSSW | 403.71 | HLA-B*1501 |
| TLDMHDANV | 52 | HLA-A*0201 | VQDRGLFGA | 191 | HLA-A*0201 | KLFALSGVA | 403.83 | HLA-A*0201 |
| ISFATSCFL | 52 | HLA-B*5801 | RTSHRTLLM | 191 | HLA-B*1501 | ARQMVQAMR | 403.9 | HLA-B*2705 |
| TILEKNVTV | 52 | HLA-A*0201 | MVTQRTIGK | 191 | HLA-A*0301 | FTIGECPKY | 404.22 | HLA-B*1501 |
| REEAMQNRI | 52 | HLA-B*4001 | QPKWFRNVL | 191 | HLA-B*0801 | WRGANRPVI | 404.5 | HLA-B*2705 |
| RVYWIREGK | 52.1 | HLA-A*0301 | TLDLHDSNV | 191 | HLA-A*0201 | DQIQDVWAY | 404.54 | HLA-A*2601 |
| FQNVHPITI | 52.1 | HLA-B*3901 | SLQQIESMV | 191 | HLA-A*0201 | GQCGLLGTV | 404.56 | HLA-A*0201 |
| APRYAFEIV | 52.2 | HLA-B*0702 | RMDYYWGIL | 191 | HLA-A*0201 | TVSSFYSEM | 404.69 | HLA-B*1501 |
| RIKTRLFTI | 52.3 | HLA-B*0801 | FSFRYGDGV | 191 | HLA-A*0201 | MPFHNVHPF | 405.16 | HLA-B*3901 |
| SLGASCFLL | 52.4 | HLA-A*0201 | RRVDINPGH | 191 | HLA-B*2705 | RQTRGIFGA | 405.78 | HLA-A*0201 |
| RPRVNGQSG | 52.4 | HLA-B*0702 | TLGLHDANV | 192 | HLA-A*0201 | RLYLWGVHH | 405.8 | HLA-A*0301 |
| DSMTEVWSY | 52.5 | HLA-A*2601 | IPAQNAIST | 192 | HLA-B*0702 | ITIGFVSLI | 405.8 | HLA-A*2601 |
| YQGRLCNPL | 52.5 | HLA-B*3901 | WSYNAEFLV | 192 | HLA-A*0201 | VPVTSSVDL | 405.91 | HLA-B*0702 |
| IEQQIGNVI | 52.6 | HLA-B*4001 | YASPQLEGF | 192 | HLA-B*5801 | KLNNVIDKM | 405.94 | HLA-A*0201 |
| LYDKVRFQL | 52.7 | HLA-A*2402 | GTKQVCIAW | 192 | HLA-B*5801 | SLVLAASIM | 406.62 | HLA-B*1501 |
| CRLSGIPPL | 52.8 | HLA-B*3901 | GTYQILSIY | 193 | HLA-B*1501 | HSNLNDATY | 406.72 | HLA-A*0101 |
| FLYVRTNGT | 52.9 | HLA-A*0201 | GTFDIGGLY | 193 | HLA-A*0101 | CFNPMIAEL | 406.89 | HLA-A*2402 |
| VTCTCRDNW | 53 | HLA-B*5801 | TTNTINRSF | 193 | HLA-B*5801 | NPNQMIITI | 406.93 | HLA-B*0702 |
| FVRQCFNPM | 53.1 | HLA-B*0801 | GTVKDRSPY | 193 | HLA-B*1501 | YRTCKLLGI | 407.1 | HLA-B*2705 |
| IINKMNTQF | 53.1 | HLA-B*1501 | WQGANRPVI | 193 | HLA-B*3901 | RGRHSNGTI | 407.21 | HLA-B*0702 |
| LYNKVRMQL | 53.2 | HLA-A*2402 | FSLGASCFL | 193 | HLA-A*0201 | SFGASCFLL | 407.47 | HLA-A*2402 |
| FQPCFYVEL | 53.3 | HLA-A*0201 | FMQALQLLF | 193 | HLA-A*0201 | FSLGASCFL | 408.29 | HLA-B*3901 |
| LAVVMGLVF | 53.3 | HLA-B*1501 | ATGLRNVPK | 193 | HLA-A*0301 | ISTRSRSGF | 408.57 | HLA-B*5801 |
| LSSKANQVF | 53.3 | HLA-B*5801 | CEITGFAPF | 193 | HLA-B*1501 | FESNGNFIA | 408.63 | HLA-B*4001 |
| LVVSPDLSY | 53.4 | HLA-B*1501 | FIAPNRASF | 193 | HLA-A*2601 | ASTGAQSFY | 408.87 | HLA-B*1501 |
| KSFSRTELI | 53.4 | HLA-B*5801 | VSPLAVTWW | 193 | HLA-B*5801 | GLLAPRYGY | 409.16 | HLA-B*1501 |
| GTIHDRTAF | 53.4 | HLA-B*1501 | SQYLCTGIL | 193 | HLA-B*3901 | GIQAGVNRF | 409.25 | HLA-B*1501 |
| FQTAAQRAM | 53.4 | HLA-B*1501 | GRADTRILF | 193 | HLA-B*2705 | GYKDWILWI | 410.06 | HLA-A*2402 |
| SLRGRGSTL | 53.4 | HLA-B*0702 | EALLNRLSI | 194 | HLA-B*0801 | GTTHDRTAF | 410.49 | HLA-B*1501 |
| APFAKDNSI | 53.5 | HLA-B*0702 | LQSRTREIL | 194 | HLA-B*3901 | YSGAFTVPI | 410.62 | HLA-B*5801 |
| SISVGSSTY | 53.5 | HLA-B*1501 | NLIAPWYAY | 194 | HLA-A*2601 | FLCVGWSST | 410.64 | HLA-A*0201 |
| QPEWFRNVL | 53.5 | HLA-B*0702 | FQNIHPATI | 194 | HLA-A*0201 | ISFATSCFL | 410.66 | HLA-B*1501 |
| GPVHFRSQV | 53.9 | HLA-B*0702 | RLIQNSLTI | 194 | HLA-B*1501 | VVIEKDNAV | 410.68 | HLA-A*0201 |
| WTQDAMTEV | 54 | HLA-A*0201 | GSIPNNKPF | 194 | HLA-B*1501 | FAFKQGNSV | 410.79 | HLA-A*0201 |
| KLYVNKNPY | 54 | HLA-B*1501 | YNADVLVAL | 194 | HLA-B*3901 | RVWWTTNSI | 411.12 | HLA-B*1501 |
| RTHIHIFSF | 54 | HLA-B*1501 | FQNVHPVTI | 194 | HLA-A*0201 | MEWIKTRPI | 411.41 | HLA-B*0801 |
| KLKTEDNVY | 54.1 | HLA-B*1501 | ALLKHRFEI | 194 | HLA-B*0801 | FRGLISTPL | 411.43 | HLA-B*2705 |
| SVKNGTYYY | 54.1 | HLA-B*1501 | RRDQMAHCR | 194 | HLA-B*2705 | VQMCTELKL | 411.66 | HLA-A*0201 |
| WTSSSSTVF | 54.3 | HLA-B*5801 | GAINSSMPL | 195 | HLA-B*1501 | RPWMRISNE | 411.66 | HLA-B*0702 |
| ISFAMSCFL | 54.5 | HLA-B*5801 | TAVDTCYPF | 195 | HLA-B*5801 | QIRGFVHFV | 411.84 | HLA-A*0201 |
| MENQHIIDL | 54.5 | HLA-B*4001 | ITIGKCSKY | 195 | HLA-B*1501 | SMREEYRQK | 412.38 | HLA-A*0301 |
| TILEKNITV | 54.6 | HLA-A*0201 | CPFRGFFPF | 195 | HLA-B*0801 | ELRHLFSGV | 412.8 | HLA-B*0801 |
| THTGTYCSL | 54.8 | HLA-B*3901 | AEEDGTGCF | 195 | HLA-B*4001 | EQITFMQAL | 412.88 | HLA-B*1501 |
| NTIGDCPKY | 54.8 | HLA-A*2601 | MITDTIKSW | 195 | HLA-B*5801 | MIEAESSIK | 413.25 | HLA-A*0301 |
| IPVTQTMEL | 54.8 | HLA-B*0702 | WHGSNRPWL | 195 | HLA-B*3901 | IASRSGYEM | 413.45 | HLA-B*5801 |
| EIRSSVGKM | 54.9 | HLA-A*2601 | NNMARAVKL | 195 | HLA-B*0801 | MIDGWYGFH | 413.55 | HLA-A*0101 |
| ETIVETGYV | 55 | HLA-A*2601 | TTNTINRIF | 195 | HLA-B*5801 | RSILANNGK | 413.61 | HLA-A*0301 |
| TLDLHDANV | 55.1 | HLA-A*0201 | IQAGVDRFY | 196 | HLA-B*1501 | LIRMIKRGV | 414.48 | HLA-B*0801 |
| LPFAAAPPV | 55.2 | HLA-B*0702 | QAHTKVLYF | 196 | HLA-B*1501 | WTYNAEVLV | 414.84 | HLA-A*0201 |
| TTVDHMAII | 55.2 | HLA-A*2601 | RLYVNKNPY | 196 | HLA-A*0301 | FQNIHPATI | 414.86 | HLA-B*1501 |
| LLATGMRNV | 55.3 | HLA-A*0201 | KLRMVTGLR | 196 | HLA-A*0301 | SFYRNLVWI | 414.88 | HLA-A*2402 |
| ISFAISCFL | 55.3 | HLA-B*5801 | NWFGYFGIF | 196 | HLA-A*2402 | GKIAHISPL | 414.94 | HLA-B*1501 |
| FRNVVWLVK | 55.3 | HLA-B*2705 | IAKDNAIRF | 196 | HLA-B*1501 | AIALGIINL | 415.23 | HLA-A*0201 |

Fig. 79-17

| Peptide | Affinity (nM) | Allele | Peptide | Affinity (nM) | Allele | Peptide | Affinity (nM) | Allele |
|---|---|---|---|---|---|---|---|---|
| WKHVTNTIL | 55.3 | HLA-B*3901 | DLNMGQPFY | 196 | HLA-A*2601 | SRSGFEVLL | 415.6 | HLA-B*2705 |
| GSIITELPF | 55.3 | HLA-B*1501 | CLRGGRNSF | 196 | HLA-B*0702 | VFVALILGF | 415.9 | HLA-A*2402 |
| QTIVLNTDW | 55.4 | HLA-B*5801 | FQNTSRHYI | 196 | HLA-B*3901 | FALGHGTTL | 415.93 | HLA-A*0201 |
| KQIDTIMEK | 55.5 | HLA-A*0301 | DRIPHRTLL | 197 | HLA-B*3901 | NLVAPWYAY | 415.94 | HLA-A*2601 |
| KAGFIENGW | 55.5 | HLA-B*5801 | IPKRNRSIL | 197 | HLA-B*0801 | KLRLATGLR | 416.04 | HLA-A*0301 |
| LIAPRGHYK | 55.5 | HLA-A*0301 | GTFDLGGLY | 197 | HLA-A*0101 | YQVGYICSG | 416.04 | HLA-B*1501 |
| MPFHNIHPL | 55.5 | HLA-B*3901 | GRINYYWTL | 197 | HLA-B*3901 | YNKRLTTTI | 416.09 | HLA-B*0801 |
| FQNIHPITI | 55.5 | HLA-B*3901 | RTSYRTLLM | 197 | HLA-B*1501 | LRFVFSNAA | 416.14 | HLA-B*2705 |
| DQIQNIWAY | 55.6 | HLA-A*2601 | GVSFHLGTK | 197 | HLA-A*0301 | YTMDTVSRT | 416.51 | HLA-A*0201 |
| VLSCIFCLA | 55.7 | HLA-A*0201 | KTWAKNILR | 197 | HLA-A*0301 | RPTTEINTW | 416.51 | HLA-B*5801 |
| YELEIGARI | 55.8 | HLA-B*4001 | GLLLQVTSL | 197 | HLA-A*0201 | EGRLIQNSI | 416.54 | HLA-B*0801 |
| FIQALQLLL | 55.8 | HLA-A*0201 | YNAEFLVAV | 198 | HLA-A*0201 | STVASSLTL | 416.54 | HLA-B*5801 |
| LLATGMKNV | 55.9 | HLA-A*0201 | IITETIKSW | 198 | HLA-B*5801 | YRTLLMNEL | 416.62 | HLA-B*2705 |
| STIALFIGV | 56 | HLA-A*0201 | YLTGTWDTL | 198 | HLA-B*3901 | HSKEQGSGY | 416.71 | HLA-A*2601 |
| TILERNVTV | 56.1 | HLA-A*0201 | NTHIHIFSF | 198 | HLA-A*2601 | GQQGRMDY | 416.79 | HLA-B*1501 |
| ETRGLFGAI | 56.1 | HLA-A*2601 | KMKAILVVL | 198 | HLA-A*0201 | CINGICTVV | 416.94 | HLA-A*0201 |
| KTFQNISPV | 56.1 | HLA-A*0201 | SRISFYWTI | 198 | HLA-B*3901 | RPLVNGQSG | 417.16 | HLA-B*0702 |
| GLKVSLHLK | 56.1 | HLA-A*0301 | RTSHRTLLM | 198 | HLA-B*5801 | RACFYVELI | 417.19 | HLA-B*5801 |
| HHAVPNGTL | 56.2 | HLA-B*3901 | SGYKEIILW | 198 | HLA-B*5801 | YRIGYICSG | 417.25 | HLA-B*2705 |
| QVDCYLWHI | 56.3 | HLA-A*0201 | ETFRVIGGW | 198 | HLA-A*2601 | RIFQSGVRV | 417.35 | HLA-A*0201 |
| WLIHQSGTY | 56.4 | HLA-B*1501 | KPPLPLCPF | 198 | HLA-B*0702 | RVWWTSNSI | 417.39 | HLA-B*5801 |
| WTGMVNGWY | 56.4 | HLA-A*0101 | KTNTEFESI | 199 | HLA-B*5801 | RANQRLNTM | 417.4 | HLA-B*5801 |
| FQNISKYAF | 56.4 | HLA-B*1501 | HHAVSNGTI | 199 | HLA-B*3901 | RLYGSGNKL | 417.82 | HLA-A*0201 |
| ELREHLSSV | 56.5 | HLA-B*0801 | NRFYRTCKL | 199 | HLA-B*0801 | NLEKRLENL | 417.85 | HLA-B*0801 |
| RTFQNVSPL | 56.5 | HLA-B*1501 | MLERELVRK | 199 | HLA-A*0301 | HRTLLMSEL | 418.03 | HLA-B*3901 |
| LMSCPIGVV | 56.7 | HLA-A*0201 | VWMGRTISK | 199 | HLA-A*0301 | SAINQITGK | 418.06 | HLA-A*0301 |
| YRALMSVLL | 56.8 | HLA-B*2705 | KAIDQITTK | 199 | HLA-A*0301 | GTYQILSIY | 418.15 | HLA-A*0301 |
| KRLVLATGL | 56.9 | HLA-B*2705 | AIDKITNKV | 199 | HLA-A*0201 | RMVIASTTA | 418.27 | HLA-B*1501 |
| GVSSEVPEW | 56.9 | HLA-B*5801 | LHNIHPLTI | 199 | HLA-B*3901 | GSSTYQSNF | 418.54 | HLA-B*1501 |
| IEHQIGNVI | 57 | HLA-B*4001 | IMIAGLSFW | 199 | HLA-B*1501 | VLLEDERTL | 418.67 | HLA-A*0201 |
| WLIDQSGTY | 57 | HLA-B*1501 | YQILAIYST | 200 | HLA-A*0201 | RIDYYWSML | 418.92 | HLA-A*0201 |
| QAYTKILYF | 57.1 | HLA-B*1501 | MSFQGRGVF | 200 | HLA-B*5801 | VTFTFNGAF | 418.93 | HLA-B*5801 |
| KTHIHIFSF | 57.2 | HLA-B*1501 | TVASSLALA | 200 | HLA-A*0201 | VWLGRTVSI | 419.12 | HLA-A*2402 |
| NSADHRIYW | 57.2 | HLA-B*5801 | QIRGFVYFV | 200 | HLA-A*0201 | RVWWTSNSI | 419.12 | HLA-B*0702 |
| LAKSVFNSL | 57.4 | HLA-B*0801 | KTNQQFELI | 200 | HLA-B*5801 | IAGFAPFSK | 419.24 | HLA-A*0301 |
| NELGVPFHM | 57.4 | HLA-B*4001 | LIAPEYGYL | 200 | HLA-A*0201 | CSVSECRTF | 419.31 | HLA-B*1501 |
| TACSDGPGW | 57.4 | HLA-B*5801 | SVASSLVLL | 200 | HLA-A*0201 | GRFTNEEAL | 419.5 | HLA-B*3901 |
| FTFNGAFIA | 57.5 | HLA-A*0201 | WSLGAISF | 200 | HLA-B*1501 | FALGQGATL | 419.73 | HLA-B*3901 |
| VSSWHILSK | 57.6 | HLA-A*0301 | LSSVSSFEK | 200 | HLA-A*0301 | RIFLAMITY | 419.78 | HLA-A*0301 |
| KLEENTTYK | 57.7 | HLA-A*0301 | ELRHLFSGI | 200 | HLA-B*0801 | RSHKICIGY | 419.9 | HLA-A*0301 |
| GRMTFYWKI | 57.8 | HLA-B*2705 | ELRFVFSIA | 201 | HLA-B*0801 | FRLLQSSQV | 420.08 | HLA-B*3901 |
| SYCRATEYI | 57.9 | HLA-A*2402 | QMYQKCCSL | 201 | HLA-B*0801 | AYQAKFESV | 420.19 | HLA-A*2402 |
| IYSTVAASL | 58 | HLA-A*2402 | ITYGPCPRY | 201 | HLA-A*0301 | KWSGYSGSF | 420.22 | HLA-A*2402 |
| NILLHIASI | 58.1 | HLA-B*0801 | LTGNLQTLK | 201 | HLA-A*0301 | YVNKNPYTL | 420.32 | HLA-A*0201 |
| NEESLRQVL | 58.4 | HLA-B*4001 | FFRNMVWLI | 201 | HLA-A*2402 | REHLSSVSS | 420.47 | HLA-B*4001 |
| REICIAWSS | 58.7 | HLA-B*4001 | IPIGERGLF | 201 | HLA-B*0702 | WTYNAELLI | 421.02 | HLA-B*5801 |
| APSPSNSRF | 58.7 | HLA-B*0702 | RQKWWVWL | 201 | HLA-A*2402 | YRALISWPQ | 421.16 | HLA-B*2705 |
| WPDGAKLPF | 58.8 | HLA-B*0702 | CQIAGFAPF | 201 | HLA-A*2402 | YLSGREWSY | 421.46 | HLA-A*0101 |
| NEESLRQIL | 58.9 | HLA-B*4001 | FLGQWNWPD | 202 | HLA-A*0201 | LVISSDLSY | 421.69 | HLA-B*5801 |
| SLLTEVETL | 59 | HLA-A*0201 | CHQRSKFLL | 202 | HLA-B*3901 | RMQLKDNAK | 421.75 | HLA-A*0301 |
| FIAPDRATF | 59.1 | HLA-B*1501 | CSNDTINYY | 202 | HLA-B*1501 | HALKLVVAM | 421.8 | HLA-B*1501 |
| KMARLGRGY | 59.2 | HLA-B*1501 | FFRHMVWLI | 202 | HLA-A*2402 | SPGRVTVST | 422.01 | HLA-B*0702 |
| FYAELKWLI | 59.5 | HLA-A*2402 | NTTYRILSI | 203 | HLA-B*0801 | HQNEQGMG | 422.41 | HLA-B*1501 |
| MLNKSLCKI | 59.6 | HLA-A*0201 | MTLSVVSLL | 203 | HLA-B*5801 | ATGLRNAHK | 422.42 | HLA-A*0301 |
| LEMCHSTRI | 59.6 | HLA-B*4001 | GVKGFSFRY | 203 | HLA-A*0301 | LASCMGLIY | 422.91 | HLA-B*5801 |
| LESRSGFEM | 59.9 | HLA-B*4001 | AMKHTSQYI | 203 | HLA-B*1501 | IHHPDTEAV | 423.08 | HLA-B*3901 |
| MENERTLYF | 59.9 | HLA-B*1501 | VMGQASYKI | 203 | HLA-A*0201 | RMQFSSLTV | 423.13 | HLA-B*1501 |
| NQSGRISIY | 60 | HLA-B*1501 | LLGINMSKK | 203 | HLA-A*0301 | ILGMQNGSY | 423.45 | HLA-B*1501 |
| HTQYRTGSL | 60 | HLA-B*0801 | ELPFTIDKY | 203 | HLA-A*2601 | AVVMGLVFI | 423.57 | HLA-A*0201 |
| EPRGLFGAI | 60.1 | HLA-B*0702 | RTFQNVSPL | 203 | HLA-B*0702 | RISHRTLLM | 423.64 | HLA-A*0301 |
| SSVSSFKRF | 60.2 | HLA-B*1501 | YRTLLMNEL | 203 | HLA-B*3901 | RSLMLATGM | 423.8 | HLA-B*1501 |

Fig. 79-18

| Peptide | y (nM) | Allele | Peptide | Affinity (nM) | Allele | Peptide | Affinity (nM) | Allele |
|---|---|---|---|---|---|---|---|---|
| SQASYKIFK | 60.3 | HLA-A*0301 | TSYRSLIRF | 204 | HLA-B*1501 | ALISWPQSS | 423.95 | HLA-A*0201 |
| FRALVSWEM | 60.4 | HLA-B*3901 | RRIWRQANN | 204 | HLA-B*2705 | CSIDECRTF | 424.06 | HLA-B*5801 |
| FEATGNLVV | 60.4 | HLA-B*3901 | CHNGTCAVV | 204 | HLA-B*3901 | HIFSKDNAI | 424.15 | HLA-B*0801 |
| NVSEWSYIV | 60.4 | HLA-A*0201 | NLIAPWYAF | 204 | HLA-B*1501 | YVWWTSNSL | 424.22 | HLA-B*1501 |
| YSGAFTIPV | 60.5 | HLA-A*0201 | GMEMRRCLL | 204 | HLA-B*0801 | ISFAMSCFL | 424.5 | HLA-B*1501 |
| ALCGSPISV | 60.6 | HLA-A*0201 | GMQIRGFVY | 204 | HLA-B*1501 | STDSEMNKL | 424.6 | HLA-A*0101 |
| GAKEVSLSY | 60.7 | HLA-B*1501 | GENMAPEKM | 204 | HLA-B*4001 | WTYQAELLI | 424.66 | HLA-B*5801 |
| YRSMKWLTL | 60.7 | HLA-B*3901 | KMRDSIKSW | 204 | HLA-B*5801 | WTYNAELLV | 425.2 | HLA-A*0201 |
| FVFSIAASY | 60.9 | HLA-B*1501 | AMELIRMIK | 204 | HLA-A*0301 | AMLNASCAA | 425.37 | HLA-B*1501 |
| WPDGALLPL | 61.1 | HLA-B*0702 | FQPCFYVEL | 205 | HLA-B*3901 | GVYQILAIY | 425.56 | HLA-B*1501 |
| FMWAIHHPP | 61.1 | HLA-A*0201 | KEKEICSVV | 205 | HLA-B*4001 | FIEGRWPGL | 425.68 | HLA-A*0201 |
| RLSGGGDIW | 61.1 | HLA-B*5801 | SMSGFRSNL | 205 | HLA-A*0201 | FIENGWEGL | 425.91 | HLA-A*0201 |
| VTCGCRDNW | 61.3 | HLA-B*5801 | FTIGECPRY | 205 | HLA-A*0101 | GMTLSVVSL | 426.02 | HLA-A*0201 |
| ALNNRFQIK | 61.3 | HLA-A*0301 | LQIISLCSI | 205 | HLA-A*0201 | YASSQLEGF | 426.07 | HLA-B*5801 |
| FQNIDRNAL | 61.3 | HLA-B*3901 | MLKVPNALI | 205 | HLA-B*0801 | SLFEKFFPS | 426.1 | HLA-B*0801 |
| SERGLFGAI | 61.4 | HLA-B*4001 | VTGFAPFSK | 205 | HLA-A*0301 | AAIKGIGTM | 426.24 | HLA-A*2601 |
| NLYASKNPY | 61.4 | HLA-B*1501 | STVASSSVL | 205 | HLA-B*1501 | WFSFGASSF | 426.54 | HLA-A*2402 |
| CIASSIVLV | 61.6 | HLA-A*0201 | LLAFILWAC | 206 | HLA-A*0201 | MTSIRNNTY | 426.81 | HLA-B*1501 |
| YRSMRWLTL | 61.7 | HLA-B*3901 | IQMCTELQL | 206 | HLA-B*1501 | HQISNVINW | 426.88 | HLA-B*5801 |
| FHRAKEVAL | 61.7 | HLA-B*0801 | RPKVNGQAG | 206 | HLA-B*0702 | SMSGFRSNL | 427.02 | HLA-B*3901 |
| VAWSSSSCF | 61.8 | HLA-B*1501 | TYNAELFVL | 206 | HLA-A*2402 | ISMDSRSGY | 427.06 | HLA-B*5801 |
| VAWSSTSCF | 61.8 | HLA-B*1501 | WTTNSIVVF | 207 | HLA-A*2601 | AILPFDIDK | 427.26 | HLA-A*0301 |
| LVTTVTLHF | 61.8 | HLA-B*1501 | GGYKDIILW | 207 | HLA-B*5801 | KTWAGKILR | 427.43 | HLA-A*0301 |
| WLIYQSGTY | 61.8 | HLA-B*1501 | APFISCSYL | 207 | HLA-B*0702 | SPLMVAYML | 427.65 | HLA-B*0801 |
| GVWTYNAEL | 61.9 | HLA-A*0201 | FEKEGYSLV | 207 | HLA-B*4001 | GQNHGICAV | 427.72 | HLA-B*1501 |
| RIFQSGVRM | 61.9 | HLA-B*1501 | ITIGFVSLI | 207 | HLA-A*0201 | SSFQVDCFL | 427.79 | HLA-B*5801 |
| LEEESDEAL | 61.9 | HLA-B*4001 | SMCSSTEFL | 207 | HLA-B*1501 | LYGSGAKLI | 427.88 | HLA-A*2402 |
| KFEFIAEEF | 62 | HLA-A*2402 | LRSGYWAIR | 207 | HLA-B*2705 | LRGFLILGK | 428.05 | HLA-B*2705 |
| YRSMKWLTL | 62.1 | HLA-B*2705 | FSFGASCVM | 207 | HLA-B*3901 | NILLHVASI | 428.24 | HLA-A*0201 |
| GSNIGFMPK | 62.1 | HLA-A*0301 | VASSLTLAI | 207 | HLA-B*5801 | VRLYLWGVH | 428.29 | HLA-B*2705 |
| FSDYEELKH | 62.1 | HLA-A*0101 | ILSMAPIMF | 208 | HLA-B*1501 | GVYQILSIY | 428.49 | HLA-A*0301 |
| WLIHQSETY | 62.2 | HLA-B*1501 | YRNLIWLVN | 208 | HLA-B*2705 | ILIAGGLIL | 428.51 | HLA-B*1501 |
| GTINSPLPF | 62.3 | HLA-B*5801 | EGRLIQNSL | 208 | HLA-B*0801 | RTFQNVSPL | 428.8 | HLA-B*5801 |
| FQNIERNAL | 62.4 | HLA-B*3901 | WTSNSIVVF | 208 | HLA-A*2601 | LMQGSTLPR | 428.94 | HLA-A*0301 |
| RMTRGLFGA | 62.4 | HLA-A*0201 | LMENERTLY | 208 | HLA-A*0101 | SQKILCTSA | 428.97 | HLA-B*1501 |
| ATNINIREW | 62.4 | HLA-B*5801 | NPRIFLAMI | 208 | HLA-B*0801 | HRDEEGTGI | 429.06 | HLA-B*3901 |
| NILLHVASI | 62.6 | HLA-B*0801 | GAYKILTIY | 208 | HLA-B*1501 | DQVKLSSGY | 429.09 | HLA-A*2601 |
| NEEPLRQIL | 62.7 | HLA-B*4001 | ALSYSTGAL | 208 | HLA-B*1501 | SIKSWRRDI | 429.23 | HLA-B*0801 |
| GTYNHEDYK | 62.7 | HLA-A*0301 | QVIVDNNSW | 209 | HLA-B*5801 | LRFVFSSAA | 429.85 | HLA-B*3901 |
| YRNMRWLTL | 62.8 | HLA-B*3901 | WPDGANISF | 209 | HLA-B*0702 | RIDFHWMLL | 430.29 | HLA-A*0201 |
| QSRMQFSSL | 62.9 | HLA-B*0801 | VLATGPRNV | 209 | HLA-A*0201 | SSDDFALIL | 430.32 | HLA-B*3901 |
| QTLVSNSDW | 62.9 | HLA-B*5801 | YKMNIQILI | 209 | HLA-B*3901 | NYKEICVAW | 430.46 | HLA-A*2402 |
| RMTFYWTIV | 62.9 | HLA-A*0201 | LPFHNVHPL | 209 | HLA-B*0801 | RIFLAMITY | 430.79 | HLA-B*1501 |
| HGSLVLSLW | 63 | HLA-B*5801 | RIGEGQRSW | 209 | HLA-B*5801 | REQLSSVSS | 430.86 | HLA-B*4001 |
| LATTVTLHF | 63.2 | HLA-B*1501 | DRDSTQMAI | 209 | HLA-B*3901 | KRKRNSSIL | 431.05 | HLA-B*2705 |
| NVYRALSIY | 63.4 | HLA-A*2601 | SVCYNPCFY | 210 | HLA-B*1501 | GILHLILWI | 431.09 | HLA-A*0201 |
| ALLNASCAA | 63.4 | HLA-A*0201 | LYDKVRLQL | 210 | HLA-A*2402 | RTSYRTLLM | 431.1 | HLA-A*0301 |
| GAKEISLSY | 63.4 | HLA-B*1501 | TIREKNVTV | 210 | HLA-B*0801 | ALSYSTGAL | 431.23 | HLA-A*0201 |
| RRAIATPGM | 63.4 | HLA-B*2705 | CHNGTCVVI | 210 | HLA-B*3901 | TITYSSSLM | 431.31 | HLA-B*1501 |
| EMKWLSSSM | 63.5 | HLA-B*1501 | SVSECRTFF | 210 | HLA-B*1501 | LVADGGPNL | 431.63 | HLA-A*0201 |
| FSYKYDNGV | 63.7 | HLA-A*0201 | ATTVTLHFK | 210 | HLA-A*0301 | QLRENAEEM | 431.65 | HLA-B*1501 |
| RRNYFTTEV | 63.7 | HLA-B*2705 | FQNIHPITI | 210 | HLA-A*0201 | VIMEVVFPN | 431.67 | HLA-A*0201 |
| CRLRGIPPL | 63.9 | HLA-B*3901 | NQKILFASA | 210 | HLA-B*0801 | STVVSSLAL | 431.67 | HLA-B*1501 |
| WTSNSIIAF | 64 | HLA-A*2601 | MVVYAELLV | 210 | HLA-A*0201 | FALSGVAVA | 431.85 | HLA-A*0201 |
| SQYICSPVL | 64 | HLA-B*3901 | SLLLLQANL | 211 | HLA-A*0201 | WSYIVERPL | 431.93 | HLA-B*3901 |
| MRRCLLQSL | 64 | HLA-B*0801 | LTDSEMSKL | 211 | HLA-A*0101 | GTFDLGGLY | 432.04 | HLA-A*2601 |
| FPFHKDNAV | 64.1 | HLA-B*0702 | GVYQILSIY | 211 | HLA-B*1501 | MEWLKTRPI | 432.06 | HLA-B*3901 |
| RMQFSSLAV | 64.2 | HLA-A*0201 | GVSGEVPGW | 211 | HLA-B*5801 | RELWQCYYL | 432.11 | HLA-A*2402 |
| YSSPMMWEI | 64.4 | HLA-B*5801 | CHNGVCPVV | 211 | HLA-B*3901 | NALTGGQSF | 432.59 | HLA-B*1501 |
| QTIVSNTDW | 64.5 | HLA-B*5801 | NTTWVNQTY | 211 | HLA-A*0101 | DRTPHRTLL | 432.7 | HLA-B*3901 |
| NRLSINPVK | 64.5 | HLA-B*2705 | SACYNPCFY | 211 | HLA-B*1501 | YSGSFTLPI | 432.87 | HLA-A*0101 |

Fig. 79-19

| Peptide | y (nM) | Allele | Peptide | Affinity (nM) | Allele | Peptide | Affinity (nM) | Allele |
|---|---|---|---|---|---|---|---|---|
| IRMAINWGR | 64.5 | HLA-B*2705 | LVRGNSPVF | 212 | HLA-B*0702 | SLVASSGTL | 433.27 | HLA-B*1501 |
| NLLIGISNV | 64.7 | HLA-A*0201 | RELCTINSW | 212 | HLA-B*4001 | KIDLWSYNA | 433.42 | HLA-A*0201 |
| NLDYQIGYV | 64.8 | HLA-A*0201 | LPVAGGTSS | 212 | HLA-B*0702 | WTSNSIIAF | 433.47 | HLA-B*5801 |
| IYSTVASSI | 64.8 | HLA-A*2402 | GITTHFQRK | 212 | HLA-A*0301 | MEVVFPNEV | 433.76 | HLA-B*4001 |
| HQNAEGTGM | 64.8 | HLA-B*1501 | ARQEKNPAL | 212 | HLA-B*3901 | SHMECRTFF | 433.85 | HLA-B*3901 |
| KFEEIRWLI | 65 | HLA-A*2402 | RMQFSSLAV | 212 | HLA-B*1501 | YPLQNLTKV | 434.64 | HLA-B*0702 |
| SVKLSSGYK | 65 | HLA-A*0301 | TSFQVDCYL | 212 | HLA-B*5801 | QMYQKCCSL | 434.77 | HLA-A*0201 |
| HSKYREEAM | 65.2 | HLA-B*0801 | QTLVSNDDW | 212 | HLA-B*5801 | HIYGKDNAV | 434.85 | HLA-A*0201 |
| VLVGLILTF | 65.3 | HLA-B*1501 | GSISNDKPF | 213 | HLA-B*1501 | KICLGHHAV | 435.27 | HLA-A*0201 |
| MSSVKNGTY | 65.5 | HLA-A*0101 | NVYKVLSIY | 213 | HLA-B*1501 | NQGSFYRSM | 435.44 | HLA-A*0201 |
| KTNLYGFII | 65.6 | HLA-B*5801 | LIVPEWSYI | 213 | HLA-A*0201 | SSSFYAEMK | 435.85 | HLA-A*0301 |
| RRRGLFGAI | 65.7 | HLA-B*2705 | GIFGAIAGF | 213 | HLA-B*1501 | ILCASATAI | 435.93 | HLA-B*1501 |
| WMDYYWGIL | 65.7 | HLA-B*3901 | VTYQILSIY | 213 | HLA-A*0101 | TVMVGLILA | 435.97 | HLA-A*0201 |
| YASKNPYTL | 65.8 | HLA-B*3901 | VPVTSTIDL | 213 | HLA-B*0702 | FRRPDSSWL | 436.66 | HLA-B*3901 |
| RIFQSGIRM | 65.8 | HLA-B*1501 | RGINDRNFW | 213 | HLA-B*5801 | DLWSYNAEL | 437.03 | HLA-A*0201 |
| QNRMQFSSL | 65.9 | HLA-B*0801 | WPDDAELPF | 213 | HLA-B*0702 | GRNSFYAEL | 437.27 | HLA-B*2705 |
| TLLMSELGV | 66 | HLA-A*0201 | VLAIYSCIA | 213 | HLA-A*0201 | LIRMVKRGI | 437.58 | HLA-B*0801 |
| VLLKHRFEI | 66.1 | HLA-A*0201 | ISKMGVDEY | 213 | HLA-B*1501 | IMTIGSVSL | 437.64 | HLA-B*1501 |
| SVYKALSIY | 66.1 | HLA-A*2601 | LIFLARSAL | 214 | HLA-B*0702 | SSLVLAALI | 437.75 | HLA-B*5801 |
| APFSKDNSI | 66.2 | HLA-B*0702 | MGIYQILAI | 214 | HLA-B*0801 | LTIGECPKY | 438.03 | HLA-A*2601 |
| LLAIAMGLV | 66.2 | HLA-A*0201 | STKEWSRRY | 214 | HLA-A*2601 | SMVEAESSV | 438.38 | HLA-B*1501 |
| NAISTTFPY | 66.3 | HLA-B*1501 | ETFVNITNV | 214 | HLA-A*2601 | FRNQIKIRR | 438.39 | HLA-B*2705 |
| NEDGNIIFL | 66.3 | HLA-B*4001 | AEEDGRGCF | 214 | HLA-B*4001 | YLIEDPAAP | 438.43 | HLA-A*0201 |
| ILRGSIAHK | 66.4 | HLA-A*0301 | ASWFNSFLI | 214 | HLA-B*5801 | LRDCKIEAV | 438.43 | HLA-B*3901 |
| MENQHTIDL | 66.4 | HLA-B*4001 | GSWPDGANF | 214 | HLA-B*5801 | IRINNETIL | 438.6 | HLA-B*3901 |
| NRLNINPVK | 66.5 | HLA-B*2705 | GRQTFDWTL | 214 | HLA-B*2705 | VPQIQNRGL | 438.76 | HLA-B*0702 |
| SLIWLWLVL | 66.5 | HLA-A*0201 | MAIIKRYTS | 215 | HLA-B*0801 | WMMAMRYPI | 438.86 | HLA-B*0702 |
| RMTFYWAIV | 66.7 | HLA-A*0201 | ITYGACPRY | 215 | HLA-B*5801 | FYRNLVWLV | 439.59 | HLA-A*2402 |
| LMDALKLSI | 66.8 | HLA-A*0201 | GSNRPWISF | 215 | HLA-B*5801 | FSVQRNLPF | 439.63 | HLA-B*0801 |
| SLIMRTVIA | 67 | HLA-B*0801 | IVLGIINLL | 215 | HLA-A*0201 | ITLKFAFNM | 439.79 | HLA-A*0201 |
| KYVNNTTII | 67.1 | HLA-A*2402 | ATAVAVLKY | 215 | HLA-B*5801 | IMIAGLFFW | 440.15 | HLA-A*2402 |
| RRLENLNKR | 67.1 | HLA-B*2705 | PQCDRFLEF | 215 | HLA-B*1501 | MFLAMITYI | 440.19 | HLA-A*2402 |
| ASYKIFKSY | 67.1 | HLA-B*1501 | RRRFVQNAL | 215 | HLA-B*2705 | QARFEAVAW | 440.58 | HLA-B*5801 |
| STQEKNDLY | 67.2 | HLA-A*0101 | KSLMLATGM | 215 | HLA-B*5801 | FVANFSMEL | 440.59 | HLA-B*1501 |
| FRNVVWLIK | 67.3 | HLA-B*2705 | NVNRITYGV | 216 | HLA-A*0201 | RSLFSSIKR | 440.8 | HLA-A*0301 |
| VEWTSNSLI | 67.4 | HLA-B*4001 | YQILSIYST | 216 | HLA-A*0201 | SLNITAASL | 440.81 | HLA-A*0201 |
| RPIGISSMV | 67.6 | HLA-B*0702 | MQNRLNNVI | 216 | HLA-B*1501 | GLSMVKSDK | 441.04 | HLA-A*0301 |
| FYAEMKWLL | 67.6 | HLA-A*2402 | VLATGLRNI | 216 | HLA-A*0201 | VLLENQKTL | 441.45 | HLA-A*0201 |
| QTKKMTITF | 67.7 | HLA-B*1501 | EMKWLSSSM | 216 | HLA-A*2601 | LYQNVETYV | 441.52 | HLA-A*2402 |
| QTVVLNTDW | 67.8 | HLA-B*5801 | CPIRGWAPL | 216 | HLA-B*3901 | VSNSDWSGY | 441.56 | HLA-B*5801 |
| TTAKAMEQM | 67.9 | HLA-A*2601 | RSIEEKFEI | 217 | HLA-B*5801 | VVLNVSLHL | 441.64 | HLA-A*0201 |
| SVRNGTYKY | 68 | HLA-B*1501 | WTTNSIVVF | 217 | HLA-B*5801 | SPYRALMSC | 441.64 | HLA-B*0702 |
| VTCICRDNW | 68 | HLA-B*5801 | MPLHNIHPL | 218 | HLA-B*3901 | VLGIINLLI | 441.69 | HLA-A*0201 |
| LVRGNSPAF | 68.1 | HLA-B*0702 | LIEKTNTEF | 218 | HLA-B*1501 | TSYKILSIY | 441.92 | HLA-A*0101 |
| HLKDQSWSY | 68.1 | HLA-B*1501 | SVGGINTNK | 218 | HLA-A*0301 | SLERRLENL | 441.93 | HLA-B*0801 |
| VVNFLSMEF | 68.1 | HLA-B*1501 | IASMRRSYF | 218 | HLA-B*1501 | CKVEGWVVV | 442.35 | HLA-B*3901 |
| TIIENNVTV | 68.2 | HLA-A*0201 | PSFYAEMKW | 219 | HLA-B*5801 | LIEKTNDKY | 442.37 | HLA-A*0101 |
| FHKDNAIRL | 68.2 | HLA-B*3901 | FLTMITYIT | 219 | HLA-A*0201 | VTYQILSIY | 442.38 | HLA-A*0301 |
| IYSCIASSL | 68.2 | HLA-A*2402 | SGYKEVILW | 219 | HLA-B*5801 | FESTGNLVA | 442.48 | HLA-B*3901 |
| VASSGTVEF | 68.4 | HLA-B*1501 | IMGLFFFCL | 219 | HLA-A*0201 | VQMCTELKL | 442.67 | HLA-B*1501 |
| TEDNVYKVL | 68.4 | HLA-B*4001 | ALLVGIGNL | 219 | HLA-A*0201 | FSVQRNLPF | 443.09 | HLA-A*2601 |
| APSPYNSRF | 68.6 | HLA-B*0702 | KEICIAWSS | 219 | HLA-B*4001 | YSKVYKTYF | 443.47 | HLA-B*1501 |
| RPVGISSMV | 68.8 | HLA-B*0702 | IVALCGSKK | 219 | HLA-A*0301 | IVKTLTNEK | 443.61 | HLA-A*0301 |
| MESGGISKI | 68.9 | HLA-B*4001 | GQGDIVLVM | 220 | HLA-B*1501 | SPYNSRFES | 443.62 | HLA-B*0702 |
| LAIVMGLVF | 68.9 | HLA-B*5801 | PEVCLKWEL | 220 | HLA-B*4001 | MINNDLGPA | 443.87 | HLA-A*0201 |
| WTGMIDGWY | 69 | HLA-A*0101 | LEENTSYKI | 220 | HLA-B*4001 | KILTIYSTA | 444.28 | HLA-A*0201 |
| RLSAGGGIW | 69.1 | HLA-B*5801 | VERGLFGAI | 220 | HLA-B*4001 | EGRLIQNSM | 444.44 | HLA-B*0801 |
| ILAIYSTAA | 69.2 | HLA-A*0201 | CFLLVALLI | 220 | HLA-A*2402 | CSIHECRTF | 444.46 | HLA-B*5801 |
| MESGGISKM | 69.2 | HLA-B*4001 | WMMAMRYPI | 220 | HLA-B*2705 | EGIYKILTI | 444.63 | HLA-B*0801 |
| MRCTISLVK | 69.5 | HLA-B*2705 | SGYSGSFVM | 221 | HLA-B*1501 | SPRSRSGFE | 444.75 | HLA-B*0702 |
| GPALSINEL | 69.7 | HLA-B*0702 | GAINSSMPF | 221 | HLA-B*5801 | TTNTINRSF | 445.1 | HLA-B*1501 |

Fig. 79-20

| Peptide | y (nM) | Allele | Peptide | Affinity (nM) | Allele | Peptide | Affinity (nM) | Allele |
|---|---|---|---|---|---|---|---|---|
| SEHTAYSQI | 69.8 | HLA-B*4001 | NMARAVKLY | 221 | HLA-B*1501 | LIAPWYAYR | 445.9 | HLA-A*0301 |
| VEVVSAKEL | 69.8 | HLA-B*4001 | KACELTDSI | 221 | HLA-B*5801 | GMVNGWYG | 445.93 | HLA-A*0201 |
| SRFQIQGVK | 69.9 | HLA-B*2705 | HVFVIREPF | 221 | HLA-B*1501 | GADDEAYAV | 445.97 | HLA-A*0201 |
| KTHNGRLCK | 70.1 | HLA-A*0301 | LHDSNVRNL | 221 | HLA-B*3901 | GYGVKGFGF | 446.33 | HLA-A*2402 |
| RFEFIAEEF | 70.2 | HLA-A*2402 | ASCHDGRAW | 222 | HLA-B*5801 | YIPSGSLKL | 446.48 | HLA-A*0201 |
| VSFQGRGVF | 70.2 | HLA-B*1501 | YQIGYVCSG | 222 | HLA-B*1501 | KSLKLATGL | 446.56 | HLA-B*5801 |
| YRSIRWLTL | 70.3 | HLA-B*0801 | HIFVIREPF | 222 | HLA-B*1501 | RTELINPNK | 446.58 | HLA-A*0301 |
| NPRMFLAMI | 70.5 | HLA-B*0702 | GTIHDRSQF | 222 | HLA-B*1501 | ISFAISCFL | 446.75 | HLA-A*0201 |
| AANPIVPSF | 70.7 | HLA-B*1501 | RVFLTMITY | 222 | HLA-B*1501 | GTFDLGGLY | 446.83 | HLA-B*1501 |
| KANQVFPQL | 70.7 | HLA-B*5801 | GLYGAIEEC | 222 | HLA-A*0201 | FVALILGFV | 447.01 | HLA-A*2601 |
| DQIEELWAY | 70.8 | HLA-A*2601 | MLKIHNAGT | 222 | HLA-B*0801 | KMQFSSLTV | 447.18 | HLA-B*1501 |
| YQKRMGVQM | 70.8 | HLA-B*1501 | MTLSVVSLL | 222 | HLA-A*0201 | SFLTHALRF | 447.32 | HLA-A*2402 |
| KLAIGLRNV | 70.8 | HLA-A*0201 | WMACHSAAF | 223 | HLA-B*3901 | YLSNNSTEK | 447.45 | HLA-A*0301 |
| STQERNDLY | 70.9 | HLA-A*0101 | ISTASRSGY | 223 | HLA-B*1501 | NVTHVQNNY | 447.63 | HLA-A*2601 |
| GMMMGMFNM | 70.9 | HLA-B*1501 | GRMNYYWTI | 223 | HLA-B*3901 | SRLNWLTKA | 447.87 | HLA-B*2705 |
| KLTQGRQTF | 70.9 | HLA-B*1501 | ATKRIRMAI | 223 | HLA-B*0801 | HQNEQGVG | 447.91 | HLA-B*1501 |
| NLTKRLCTI | 70.9 | HLA-B*0801 | LTDSEMNKL | 223 | HLA-A*0101 | ILYFWGVHH | 448.33 | HLA-A*0301 |
| FHKDNAVRL | 70.9 | HLA-B*3901 | GRMTFYWTI | 223 | HLA-B*3901 | FESNGAFLA | 448.54 | HLA-B*4001 |
| LLSSKDNQV | 70.9 | HLA-A*0201 | MDYYWAVLK | 223 | HLA-A*0301 | YLSTNSTEK | 448.59 | HLA-A*0301 |
| KMNREFEVV | 71 | HLA-A*0201 | STYKILSIY | 223 | HLA-A*0101 | MAMKYPITA | 448.99 | HLA-B*0801 |
| WPWPDGALL | 71.1 | HLA-B*0702 | KLRMATGLR | 223 | HLA-A*0301 | MQFSSLAVN | 449.01 | HLA-B*1501 |
| RLRRDQRSL | 71.1 | HLA-B*0702 | ITDIWAYNA | 224 | HLA-A*0101 | LIAPRYGYI | 449.07 | HLA-A*0201 |
| IEIITIGSI | 71.1 | HLA-B*4001 | GRMTFYWTM | 224 | HLA-B*3901 | LPSFGVSGI | 449.08 | HLA-B*0702 |
| SPRMFLAMI | 71.1 | HLA-B*0801 | LENGRTLGL | 224 | HLA-B*4001 | EMLKVPNAL | 449.12 | HLA-B*0801 |
| LENQNTIDL | 71.2 | HLA-B*4001 | NPRVFLAMI | 224 | HLA-B*0702 | KSLKLASGL | 449.21 | HLA-B*5801 |
| SSVSSFERF | 71.2 | HLA-B*5801 | SIVMCGVNY | 224 | HLA-B*1501 | NIGPRPLVM | 449.63 | HLA-B*0801 |
| ATNPVVPSF | 71.2 | HLA-B*1501 | SQSRTREIL | 224 | HLA-B*3901 | KVDLWSYNA | 449.76 | HLA-A*0201 |
| CTINSWHIF | 71.2 | HLA-B*1501 | RIGSRGDVF | 224 | HLA-B*1501 | PRYGYIIEK | 449.92 | HLA-B*2705 |
| FVAPDRASF | 71.3 | HLA-A*2601 | SPFRTLMSV | 224 | HLA-B*0801 | NVYKVLAIY | 449.97 | HLA-B*1501 |
| SMCSSTEFL | 71.3 | HLA-A*0201 | YSHGTGTGY | 224 | HLA-A*2601 | TFLQALQLL | 450.27 | HLA-A*2402 |
| TTLSTIALF | 71.4 | HLA-B*5801 | VLYFWGIHH | 224 | HLA-A*0301 | VTDSEMNKL | 450.47 | HLA-A*0101 |
| FHGAKEISL | 71.5 | HLA-B*3901 | KMNTRILIL | 224 | HLA-A*0101 | YQSTNSTEA | 450.48 | HLA-B*1501 |
| MLADRVDDA | 71.7 | HLA-A*0201 | CHSAAFEDL | 225 | HLA-B*3901 | KFASICTHL | 450.86 | HLA-A*2402 |
| SISCFLLAA | 71.8 | HLA-A*0201 | TLTNEQEEV | 225 | HLA-A*0201 | HHRSHRQMA | 450.9 | HLA-B*0801 |
| HRFEIIEGR | 71.8 | HLA-B*2705 | FQGRGVFEF | 225 | HLA-B*1501 | FHNIHPLAI | 451.31 | HLA-B*0801 |
| APFTKDNSI | 72.1 | HLA-B*0702 | KALNEITTK | 225 | HLA-A*0301 | KVATGRVTV | 451.52 | HLA-A*0201 |
| KSFSRTQLI | 72.3 | HLA-B*5801 | FSISCFLLI | 225 | HLA-B*5801 | YVWWASNSL | 451.75 | HLA-B*3901 |
| RVKMFDFSK | 72.4 | HLA-A*0301 | KRLENLDKK | 225 | HLA-B*2705 | IEKMVLSAF | 451.8 | HLA-B*4001 |
| KTRPILSPL | 72.4 | HLA-B*0702 | NLYVNKNPY | 225 | HLA-B*1501 | DLLENLQTY | 451.81 | HLA-A*2601 |
| NLIIGISNV | 72.4 | HLA-A*0201 | NLSGYSGSF | 225 | HLA-B*1501 | RPKEMEGVC | 452 | HLA-B*0702 |
| KGLCTINSW | 72.5 | HLA-B*5801 | HTKILYFHK | 225 | HLA-A*0301 | NRVKIDPVK | 452.08 | HLA-B*2705 |
| RVKMFDFTK | 72.6 | HLA-A*0301 | KMNTRILIL | 225 | HLA-B*0801 | YMNVKSLKL | 452.84 | HLA-B*3901 |
| SIIPSGPLK | 72.6 | HLA-A*0301 | GTAPVLGNY | 225 | HLA-A*2601 | LEENTTYRI | 452.85 | HLA-B*4001 |
| GRMDYYWTL | 72.7 | HLA-B*3901 | WFRNILSIA | 225 | HLA-B*0801 | MENERTLDL | 452.91 | HLA-B*4001 |
| SSVSSFEKF | 72.7 | HLA-B*1501 | IQMCTELQL | 225 | HLA-B*3901 | GSSTYQNSF | 452.95 | HLA-B*5801 |
| TLYFHDSNV | 72.7 | HLA-A*0201 | FPVGTAPVL | 226 | HLA-B*3901 | SRYVCTGIL | 452.98 | HLA-B*2705 |
| YRSIRWLTL | 72.7 | HLA-B*3901 | KEICVAWSS | 226 | HLA-B*4001 | NVIVTREPY | 453.13 | HLA-B*1501 |
| GRMDYYWTL | 72.8 | HLA-B*2705 | PSFFRNMVW | 226 | HLA-B*5801 | FQNIHPITI | 453.41 | HLA-B*1501 |
| STDTVNTLI | 72.8 | HLA-A*0101 | ESRSNIFNM | 226 | HLA-A*2601 | LEKAHNGKL | 453.55 | HLA-B*4001 |
| GVYKALSIY | 72.9 | HLA-B*1501 | VPVTQAMEL | 227 | HLA-B*0702 | SKSTKSTVL | 453.69 | HLA-B*3901 |
| SIRNGTYDY | 72.9 | HLA-B*1501 | FFGDNAEEF | 227 | HLA-A*2402 | MENERILDF | 453.72 | HLA-B*1501 |
| SISVESSTY | 73.2 | HLA-B*1501 | AEDQGNGCF | 227 | HLA-B*4001 | CEKLEQSGL | 453.84 | HLA-B*4001 |
| LSSKANQVF | 73.5 | HLA-B*1501 | VWTYNAELF | 227 | HLA-A*2402 | FVAPDRVSF | 454.06 | HLA-A*2601 |
| NMQNKLNNV | 73.6 | HLA-A*0201 | AINEITTKI | 227 | HLA-A*0201 | WINSPNHVK | 454.46 | HLA-A*0301 |
| YRSLIKFPI | 73.6 | HLA-B*3901 | RLRSGFEML | 227 | HLA-B*1501 | SASSQAYTK | 454.54 | HLA-A*0301 |
| GPSECRTFF | 73.7 | HLA-B*0702 | FSVQRSLPF | 227 | HLA-A*2601 | NTYDHSTYR | 454.78 | HLA-A*0301 |
| MSKEGSYFF | 73.7 | HLA-B*5801 | TIVEKNVTV | 227 | HLA-A*0201 | LIMRTVIAL | 454.93 | HLA-B*0801 |
| FQNIDKNAL | 73.7 | HLA-B*3901 | ITDTIKSWK | 228 | HLA-A*0301 | FSFGASCVM | 454.93 | HLA-B*5801 |
| KLYGAGNKL | 73.8 | HLA-A*0201 | YAFGNCPKY | 228 | HLA-B*1501 | HRTLLMNEL | 455.4 | HLA-B*2705 |
| FQNVSPLWV | 73.8 | HLA-A*0201 | LLAFVLWAC | 228 | HLA-A*0201 | CSCYPNLGK | 455.88 | HLA-A*0301 |
| WMDYYWGIL | 73.9 | HLA-A*0201 | EIRTFSFQL | 228 | HLA-B*0801 | VSNNDWSGY | 456.23 | HLA-A*0101 |

Fig. 79-21

| Peptide | y (nM) | Allele | Peptide | Affinity (nM) | Allele | Peptide | Affinity (nM) | Allele |
|---|---|---|---|---|---|---|---|---|
| ILRGSVAHK | 74.2 | HLA-A*0301 | KTNEKFHQI | 228 | HLA-B*5801 | ITYGVCPRY | 456.41 | HLA-B*1501 |
| NILLHIVSI | 74.2 | HLA-B*0801 | MFSNKVARL | 228 | HLA-B*0801 | SRYSKADKI | 457.11 | HLA-B*2705 |
| CLINDPWVL | 74.3 | HLA-A*0201 | ILKIKKGKL | 228 | HLA-B*0801 | MENQHTIDM | 458.06 | HLA-B*1501 |
| SINECRTFF | 74.3 | HLA-B*1501 | QQIESMIEA | 228 | HLA-A*0201 | LYQNVGTYV | 458.33 | HLA-A*2402 |
| MTSIRNNTY | 74.4 | HLA-A*0101 | ELVRKTRFL | 228 | HLA-B*0801 | LASTTAKAM | 458.34 | HLA-B*1501 |
| RSFSRTELI | 74.5 | HLA-B*5801 | KILSIYSCI | 229 | HLA-A*0201 | RSLYSGFVR | 458.54 | HLA-A*0301 |
| WILWISFAT | 74.5 | HLA-A*0201 | VRMNNETIL | 229 | HLA-B*3901 | IRKGLILEY | 458.69 | HLA-B*2705 |
| TIIYSSSMM | 74.5 | HLA-B*1501 | ITSKVNSII | 229 | HLA-B*5801 | GLFGAKAGF | 458.85 | HLA-B*1501 |
| SLVKTTLFL | 74.7 | HLA-A*0201 | RMEFFWTLL | 229 | HLA-A*0201 | IFGAIAGFI | 458.9 | HLA-A*2402 |
| FMIIGGFIF | 74.7 | HLA-B*1501 | NTRLPFQNL | 229 | HLA-B*0801 | YVNTALLNA | 459.06 | HLA-A*0201 |
| SRISFYWTI | 74.8 | HLA-B*2705 | KLRSGFEML | 229 | HLA-A*0201 | WHSNLNDAT | 459.17 | HLA-B*3901 |
| SLMLATGMK | 75 | HLA-A*0301 | ILAIYATVA | 229 | HLA-A*0201 | FPYTGDPPY | 459.66 | HLA-B*0702 |
| LHDSNVRSL | 75 | HLA-B*3901 | FWMCSNGSL | 230 | HLA-B*3901 | FALGHGTTL | 459.71 | HLA-B*0702 |
| LATTITLHF | 75.2 | HLA-B*1501 | MENERTLDF | 230 | HLA-B*1501 | CPFQGFFPF | 459.71 | HLA-B*3901 |
| KCMKTFFGW | 75.2 | HLA-B*5801 | VLTDTSRPK | 230 | HLA-A*0301 | NPNQKIITI | 459.9 | HLA-B*0702 |
| TLTERGIEV | 75.3 | HLA-A*0201 | LRSRYWAIR | 230 | HLA-B*2705 | SSVASSLVL | 459.99 | HLA-B*5801 |
| ALSNRFQIK | 75.3 | HLA-A*0301 | MARLGKGYM | 230 | HLA-B*0801 | MADSTMLNL | 460.05 | HLA-A*0101 |
| SIIEAESSV | 75.3 | HLA-A*0201 | GENMAPEKI | 230 | HLA-B*4001 | TIGDCPKYV | 460.47 | HLA-A*0201 |
| LLAVVMGLV | 75.5 | HLA-A*0201 | IMGLVFFCL | 230 | HLA-A*0201 | EFIAEQFTW | 460.86 | HLA-B*5801 |
| GRISFYWTI | 75.6 | HLA-B*2705 | WISFAISCF | 231 | HLA-B*1501 | FIFILLTHW | 460.95 | HLA-B*5801 |
| LRHLFSGIK | 75.6 | HLA-B*2705 | SLIASSGTL | 231 | HLA-B*1501 | RADKICIGY | 461.09 | HLA-A*0101 |
| WTTNSIVVF | 75.6 | HLA-B*1501 | RTELISPSK | 231 | HLA-A*0301 | SSLPLALGM | 461.18 | HLA-B*5801 |
| GRISIYWTL | 75.6 | HLA-B*2705 | DRSPYRTLL | 231 | HLA-B*3901 | LVRMIKRGI | 461.22 | HLA-B*0801 |
| IAGFIENGW | 75.7 | HLA-B*5801 | QLKLATGLK | 231 | HLA-A*0301 | AVRGDLNFV | 461.95 | HLA-A*0201 |
| GPNDNASAV | 75.9 | HLA-B*0702 | IQTKRSFEL | 231 | HLA-B*3901 | NASTGGQSF | 462.24 | HLA-B*1501 |
| GQNHGICAV | 75.9 | HLA-A*0201 | LSSMGVYQI | 232 | HLA-B*5801 | HTRGLFGAI | 462.26 | HLA-B*0801 |
| LILSFIMWA | 75.9 | HLA-A*0201 | LRRCLLQSL | 232 | HLA-B*2705 | ISDGGPNLY | 462.52 | HLA-B*5801 |
| HQNAQGSGY | 76 | HLA-B*1501 | EVSWTSNSI | 232 | HLA-A*2601 | MVDGWYGY | 462.58 | HLA-A*0101 |
| KLYKNTNTL | 76 | HLA-A*0201 | MEWLKTRPI | 232 | HLA-B*4001 | ISTASRSGY | 462.9 | HLA-B*5801 |
| VLLVSLGAV | 76 | HLA-A*0201 | YVKSERLVL | 232 | HLA-B*0702 | NMDKAVKLY | 462.98 | HLA-A*0101 |
| FQNIEKNAL | 76.2 | HLA-B*3901 | VSNNDWSGY | 233 | HLA-B*1501 | NPNQKIVTI | 463.48 | HLA-B*0702 |
| ILFASATAI | 76.4 | HLA-B*1501 | KFFPSSSYR | 233 | HLA-A*0301 | SLCNVEGWV | 463.68 | HLA-A*0201 |
| HLMIWHSNL | 76.5 | HLA-B*0801 | SMIEAESSV | 233 | HLA-B*1501 | LRSGYETFK | 463.78 | HLA-B*2705 |
| RGLCTINSW | 76.5 | HLA-B*5801 | EVEQEMRTF | 233 | HLA-A*2601 | ESIAWSATA | 463.94 | HLA-A*2601 |
| FALAQGALV | 76.6 | HLA-A*0201 | RNIVRRAIV | 233 | HLA-B*0801 | TVASSLTLA | 464.08 | HLA-A*0201 |
| YQNNFVPVI | 76.6 | HLA-B*3901 | QMYQRCCNL | 233 | HLA-B*0801 | GTIHDRSQY | 464.49 | HLA-B*1501 |
| MMMGMFNML | 76.7 | HLA-B*1501 | IICTCRDNW | 233 | HLA-B*5801 | VPQIESRGL | 464.65 | HLA-B*0702 |
| SECVCHSGI | 76.8 | HLA-B*4001 | SSFEQITFM | 233 | HLA-A*2601 | KRQEIDGIK | 464.83 | HLA-B*2705 |
| SISIGSSTY | 76.9 | HLA-B*1501 | YRTLLMSEL | 233 | HLA-B*3901 | LGDCSIAGW | 465.06 | HLA-B*5801 |
| FTFKRTKGF | 77 | HLA-A*2601 | GSNRPWISF | 233 | HLA-B*1501 | WAVGRCPRY | 465.11 | HLA-A*2601 |
| GSFCSINGK | 77 | HLA-A*0301 | ASTGGQSFY | 233 | HLA-A*0101 | SPYRALISW | 465.19 | HLA-B*5801 |
| LYNKVRLQL | 77.1 | HLA-A*2402 | GMILSVVSL | 233 | HLA-B*1501 | CSLNGISPV | 465.32 | HLA-A*0201 |
| LIAPSRVTK | 77.1 | HLA-A*0301 | GIKGFSFKY | 233 | HLA-A*0301 | QMYQRCCNL | 465.36 | HLA-B*3901 |
| LANNGRFEF | 77.1 | HLA-B*1501 | RTSYRTLLM | 234 | HLA-A*0101 | LENSHPGIF | 465.59 | HLA-B*4001 |
| IAGFIEGRW | 77.3 | HLA-B*5801 | SQYICSPVL | 234 | HLA-A*0201 | VSGADNDAY | 465.75 | HLA-A*0101 |
| SPGVKGWAF | 77.3 | HLA-B*0702 | IITDTLKSW | 234 | HLA-B*5801 | VVSSLVLAI | 465.75 | HLA-A*0201 |
| MQNKLNNVI | 77.3 | HLA-B*1501 | FQNIDRNAI | 234 | HLA-B*3901 | AQMALQLFI | 465.93 | HLA-B*2705 |
| MIKAVRGDL | 77.4 | HLA-B*0801 | ATYQRTRAL | 234 | HLA-B*0801 | RMFLAMITY | 466.18 | HLA-B*5801 |
| WTSNSIVTF | 77.6 | HLA-B*5801 | SIKEKDMTK | 234 | HLA-A*0301 | GSFCSIDGK | 466.19 | HLA-A*0301 |
| QVDCFLWHI | 77.8 | HLA-A*0201 | LRSGFEMLK | 235 | HLA-B*2705 | WTGMVDGW | 466.24 | HLA-A*2601 |
| KVCRTLLAK | 77.8 | HLA-A*0301 | LNRLNINPV | 235 | HLA-B*0801 | LIEKTNTQF | 466.37 | HLA-B*1501 |
| AMGLIFMCV | 77.8 | HLA-A*0201 | IITDTIKSW | 235 | HLA-B*5801 | SFFYRYGFV | 466.42 | HLA-B*0801 |
| ISNEGSYFF | 77.8 | HLA-B*1501 | IMTIGSVSL | 235 | HLA-A*0201 | VASMRRNYF | 467.4 | HLA-B*0801 |
| GVSSEVPGW | 77.8 | HLA-B*5801 | RSIVRRATV | 235 | HLA-B*0801 | ITYGPCPRY | 468.09 | HLA-B*5801 |
| GYKDVILWF | 77.8 | HLA-A*2402 | NPNQKTITI | 235 | HLA-B*0801 | MKIIRVGCV | 468.23 | HLA-B*0801 |
| RLTTTIRTW | 77.9 | HLA-B*5801 | SYNARLLVL | 235 | HLA-B*0801 | GRIDFHWLV | 468.27 | HLA-B*2705 |
| GTMKDRSPY | 78 | HLA-B*1501 | KLATGMRNI | 235 | HLA-A*0201 | YQKRMTRGL | 468.34 | HLA-B*1501 |
| QSKMQFSSL | 78 | HLA-B*0801 | IFNSIGNLI | 235 | HLA-A*2402 | LTFLARSAL | 469.32 | HLA-B*1501 |
| NRLNINSVK | 78.1 | HLA-B*2705 | KLSQMSKNV | 236 | HLA-A*0201 | HSNDQGSGY | 469.38 | HLA-A*2601 |
| SQRSKFLLM | 78.1 | HLA-B*0801 | LIQLIVSGK | 236 | HLA-A*0301 | FHKCNDSCM | 469.58 | HLA-B*3901 |
| ALMSVPMGS | 78.2 | HLA-A*0201 | RRKRGLFGA | 236 | HLA-B*2705 | WLWLVLREK | 470.66 | HLA-A*0301 |

Fig. 79-22

| Peptide | y (nM) | Allele | Peptide | Affinity (nM) | Allele | Peptide | Affinity (nM) | Allele |
|---|---|---|---|---|---|---|---|---|
| GRMNYYWTL | 78.2 | HLA-B*3901 | RISFYWTIV | 236 | HLA-A*0201 | NLIAPWYGY | 470.86 | HLA-B*1501 |
| RMQFSSLTV | 78.2 | HLA-A*0201 | KVLAIYSCI | 236 | HLA-A*0201 | TPRGEDNQF | 471.08 | HLA-B*0702 |
| RSDKICIGY | 78.2 | HLA-A*0101 | GSINTKLPF | 236 | HLA-B*5801 | NRDITIGSI | 471.28 | HLA-B*3901 |
| LIFMARSAL | 78.3 | HLA-B*0702 | MLKIPNAGI | 236 | HLA-B*0801 | IAWSSSSCY | 471.64 | HLA-B*5801 |
| YRSLIQFPI | 78.5 | HLA-B*2705 | WTSNSIVTF | 236 | HLA-A*2601 | MRINNETIL | 471.68 | HLA-B*2705 |
| YRALISWPL | 78.6 | HLA-B*2705 | LTFLARSAL | 236 | HLA-B*0702 | YPKVYKPYF | 471.82 | HLA-B*0702 |
| LTITYSSSL | 78.6 | HLA-B*1501 | CIDFRDMRK | 236 | HLA-A*0301 | VQMCTELKL | 471.92 | HLA-B*3901 |
| CIASSVVLV | 78.7 | HLA-A*0201 | QQIESMVEA | 236 | HLA-A*0201 | RARIKTRLF | 472.08 | HLA-B*0702 |
| TLSTIALLI | 78.7 | HLA-A*0201 | DHEGEGIPL | 236 | HLA-B*3901 | KINPVTLTM | 472.17 | HLA-A*0201 |
| LAVVMGLVF | 78.8 | HLA-B*5801 | QGYKDIILW | 237 | HLA-B*5801 | IWSYNAQLL | 472.25 | HLA-A*2402 |
| IAWSSSSCF | 79 | HLA-B*5801 | SSCHDGRAW | 237 | HLA-B*5801 | VEITGINKV | 472.61 | HLA-B*4001 |
| SACHDGTNW | 79 | HLA-B*5801 | TTYRILSIY | 237 | HLA-B*1501 | GKIVHVSPL | 473.12 | HLA-B*3901 |
| IYSSVASSL | 79.1 | HLA-A*2402 | HTKVLYFHK | 237 | HLA-A*0301 | TTLSTIALF | 473.33 | HLA-A*2601 |
| IYSTVTSSL | 79.2 | HLA-A*2402 | KQLGNVINW | 237 | HLA-B*5801 | MTRGLFGAI | 473.35 | HLA-B*0702 |
| NPRMFLAMI | 79.2 | HLA-B*0801 | LAKSVFNCL | 237 | HLA-B*0801 | VSNDNWSGY | 473.64 | HLA-B*5801 |
| GSNRPWLSF | 79.2 | HLA-B*5801 | VLTGNLQAL | 237 | HLA-A*0201 | ASTGGQSFY | 473.77 | HLA-B*1501 |
| FPIGVAPVL | 79.9 | HLA-B*0702 | YRACFYVEL | 237 | HLA-B*2705 | VFSSAASYK | 473.86 | HLA-A*0301 |
| FEATGNLVV | 80 | HLA-B*4001 | SISCFLLVA | 238 | HLA-A*0201 | KWGDVLDGV | 474.51 | HLA-A*0201 |
| ALASCMGLI | 80 | HLA-A*0201 | YNRRLTTTI | 238 | HLA-B*0801 | IYCVCRDNW | 474.89 | HLA-A*2402 |
| VLASTTAKA | 80.3 | HLA-A*0201 | WQGANRPII | 238 | HLA-B*3901 | LGDCSVAGW | 475.41 | HLA-B*5801 |
| SSQDTELSF | 80.4 | HLA-B*1501 | ELWQCYYLL | 238 | HLA-A*0201 | YRICKLVGI | 475.42 | HLA-B*3901 |
| ATNPIVPSF | 80.4 | HLA-B*1501 | WLIYQSGTY | 238 | HLA-A*2601 | GAVAVLKYK | 475.81 | HLA-A*0301 |
| MGLKISSSF | 80.4 | HLA-B*1501 | EELRFVFSI | 239 | HLA-B*4001 | CQIAGFAPF | 475.83 | HLA-B*3901 |
| ISLVKTTLF | 80.7 | HLA-B*5801 | SQGVKGWAF | 239 | HLA-B*1501 | GENMAPEKV | 475.91 | HLA-B*4001 |
| ISPLAVTWW | 80.8 | HLA-B*5801 | KFEFIAEDF | 239 | HLA-A*2402 | ALQGTKRSY | 475.95 | HLA-B*1501 |
| SSDDFALIV | 80.9 | HLA-A*0101 | LTDSQTATK | 240 | HLA-A*0101 | IAMENQHTI | 476.06 | HLA-B*5801 |
| KMARLGRGY | 81 | HLA-A*0301 | LYDRVRLQL | 240 | HLA-A*2402 | EKKAKLANV | 476.78 | HLA-B*0801 |
| GTIHDRTTF | 81 | HLA-B*1501 | IHECRTFFL | 240 | HLA-B*3901 | QMYQKCCTL | 477.65 | HLA-A*0201 |
| YVRSEKLVL | 81.1 | HLA-B*0702 | GSNRPWVSF | 240 | HLA-B*5801 | YIWTYQAEL | 477.65 | HLA-B*3901 |
| LIAPSRVSK | 81.1 | HLA-A*0301 | LAIMIAGIF | 240 | HLA-B*1501 | AILVTTVTL | 477.71 | HLA-A*0201 |
| SRYGYEMLK | 81.4 | HLA-B*2705 | CSISECRTF | 240 | HLA-B*1501 | LRIRSNGNL | 478.18 | HLA-B*2705 |
| RPQMNGQSG | 81.5 | HLA-B*0702 | VSNSDWSGY | 240 | HLA-B*1501 | TMDYYWGIL | 478.57 | HLA-A*0201 |
| SFYRNLIWF | 81.7 | HLA-A*2402 | KTFQNVSPI | 240 | HLA-B*5801 | RPVDGIGSC | 478.8 | HLA-B*0702 |
| EMRTFSFQL | 81.7 | HLA-B*0801 | LHLEFKADL | 240 | HLA-B*3901 | AEEDCTGCF | 479.54 | HLA-B*4001 |
| WPDGALLPL | 81.7 | HLA-B*3901 | HSNLNDATY | 240 | HLA-B*5801 | KTFQNVSPL | 479.62 | HLA-A*0201 |
| YSSSMMWEI | 81.8 | HLA-B*5801 | ALISWPLSS | 241 | HLA-A*0201 | SRMSICISG | 479.66 | HLA-B*2705 |
| WTGMVDGWY | 82 | HLA-A*0101 | GLLGAIAGF | 241 | HLA-A*0201 | ASSLVLLLM | 480.02 | HLA-B*5801 |
| WTSSSSVVM | 82.2 | HLA-B*1501 | LSSMGIYQI | 241 | HLA-B*5801 | RMTDSIKSW | 480.23 | HLA-B*1501 |
| HQSETYPVI | 82.3 | HLA-B*3901 | KILCTSATA | 241 | HLA-A*0201 | RLNNVIDKM | 480.26 | HLA-B*1501 |
| RRNRYLEEH | 82.4 | HLA-B*2705 | IKHENRMVL | 241 | HLA-B*3901 | KRQEIEGIK | 480.49 | HLA-B*2705 |
| KRYGPALSI | 82.4 | HLA-B*2705 | NLTKGLCTI | 241 | HLA-A*0201 | WTSSSSVVM | 480.62 | HLA-B*5801 |
| DAVATTHSW | 82.4 | HLA-B*5801 | DRTNHQFEL | 241 | HLA-B*3901 | ASSLVLLLM | 480.66 | HLA-A*0101 |
| APIEHIASI | 82.6 | HLA-B*0702 | ISIASRSGY | 241 | HLA-B*5801 | VRMQLRDNV | 480.92 | HLA-B*2705 |
| GRMDYYWAI | 82.6 | HLA-B*2705 | APIEHIASM | 241 | HLA-A*2601 | LPFHNVHPF | 481.35 | HLA-B*0801 |
| NMSKRKSYI | 82.7 | HLA-B*0801 | SFGASCFTL | 241 | HLA-A*2402 | WVRMNNETI | 481.65 | HLA-B*0702 |
| MILSVVSLL | 82.7 | HLA-A*0201 | KILFASATA | 242 | HLA-A*0201 | HSMSDIEAM | 481.72 | HLA-A*2601 |
| KMNTQILVF | 82.8 | HLA-B*5801 | GVKGFGFKK | 242 | HLA-A*0301 | NSTYKILSI | 481.84 | HLA-B*0801 |
| YRSLISWPL | 82.9 | HLA-B*2705 | LMSCPVGEA | 242 | HLA-A*0201 | SASGQAYTK | 482 | HLA-A*0301 |
| AMKHTSQYL | 82.9 | HLA-B*1501 | LTRTTVDHM | 242 | HLA-B*1501 | TGRDVLVIW | 482.4 | HLA-B*5801 |
| CRLRGIPPL | 83.1 | HLA-B*2705 | GVWWTSNSI | 242 | HLA-A*0201 | LIEKTNEKY | 482.44 | HLA-A*0101 |
| YQNNFVPVV | 83.2 | HLA-B*3901 | RMSDSIKSW | 243 | HLA-B*1501 | QGVKLTQGY | 482.44 | HLA-B*1501 |
| NRIMINPVK | 83.3 | HLA-B*2705 | TTYRILSIY | 243 | HLA-A*0301 | GSFTLPVEM | 482.58 | HLA-B*5801 |
| CMRTFFGWK | 83.4 | HLA-A*0301 | NSFEQITFM | 243 | HLA-A*2601 | EVYNETVRL | 482.66 | HLA-A*2601 |
| MARLGRGYM | 83.4 | HLA-B*0801 | LLMDALKLS | 243 | HLA-A*0201 | EVEQEIRTF | 482.78 | HLA-A*2601 |
| SFQVDCYLW | 83.9 | HLA-A*2402 | FEREGYSLV | 243 | HLA-B*4001 | ALGIINLLI | 482.94 | HLA-A*0201 |
| RMFLAMITY | 83.9 | HLA-B*1501 | FESNGAFIA | 244 | HLA-B*4001 | RLYGSENKL | 483.15 | HLA-A*0201 |
| ATCVCRDNW | 83.9 | HLA-B*5801 | ASCAAMDEF | 244 | HLA-B*5801 | QRLNTMHQL | 483.26 | HLA-B*2705 |
| SQYRALISW | 84.1 | HLA-B*5801 | KAIDIMQNK | 244 | HLA-A*0301 | KFAAICTHL | 483.67 | HLA-A*2402 |
| WTSGSIISF | 84.1 | HLA-B*1501 | CSYLECRTF | 244 | HLA-B*5801 | TFLARSALI | 483.74 | HLA-B*0801 |
| SQYICSPVL | 84.2 | HLA-B*1501 | YQIGYICSG | 244 | HLA-B*1501 | STDTVDTLT | 484.1 | HLA-A*0101 |
| APRYAFELV | 84.2 | HLA-B*0702 | IKMKWGMEL | 244 | HLA-B*3901 | FFCLRNGNM | 484.49 | HLA-B*0801 |

Fig. 79-23

| Peptide | y (nM) | Allele | Peptide | Affinity (nM) | Allele | Peptide | Affinity (nM) | Allele |
|---|---|---|---|---|---|---|---|---|
| TAVDTCYPF | 84.2 | HLA-B*1501 | NPRIFLAMI | 244 | HLA-B*0702 | IIDIWAYNA | 484.58 | HLA-A*0201 |
| RLIQNSMTI | 84.3 | HLA-A*0201 | YRTLLMSEL | 244 | HLA-B*2705 | YVKQNTLKL | 485.24 | HLA-B*0702 |
| AIMIAGLFF | 84.4 | HLA-B*1501 | LLAKSVFNC | 244 | HLA-A*0201 | NLTKELCTI | 485.6 | HLA-A*0201 |
| CMKTFFGWK | 84.5 | HLA-A*0301 | RVFLTMITY | 244 | HLA-A*0301 | WEINGPESV | 485.92 | HLA-B*3901 |
| RIGSKGHVF | 84.7 | HLA-B*1501 | WLIHQSGTY | 244 | HLA-A*2601 | VSNDNWSGY | 486.12 | HLA-A*0101 |
| NRFQIQGVK | 84.7 | HLA-B*2705 | WRGANRPVI | 244 | HLA-B*3901 | LIIERRNSS | 486.13 | HLA-B*0801 |
| RTFSFQLIL | 84.7 | HLA-B*5801 | HQLLRHFQK | 245 | HLA-B*2705 | KVTNATETV | 486.62 | HLA-A*0201 |
| GMVDGWYGF | 84.7 | HLA-A*0201 | AIWTSSSSI | 245 | HLA-A*0201 | TPYRSLIQF | 486.96 | HLA-B*0702 |
| TLDYHDSNV | 84.8 | HLA-A*0201 | SGEVPGWSW | 245 | HLA-B*5801 | CFNPMTVEL | 487.08 | HLA-A*2402 |
| ALCGSPVSV | 84.8 | HLA-A*0201 | CHITGFAPF | 245 | HLA-B*3901 | LKAEIAQKL | 487.38 | HLA-B*3901 |
| NVPEWSYIV | 84.8 | HLA-A*0201 | KYHQIEKEF | 245 | HLA-A*2402 | RRDYFTAEV | 487.64 | HLA-B*2705 |
| KMARLGKGY | 84.9 | HLA-B*1501 | SPNVYQSRF | 245 | HLA-B*0702 | STDKVDTII | 487.66 | HLA-A*0101 |
| KWWVWLWLV | 84.9 | HLA-A*0201 | YVRSEKLVL | 245 | HLA-B*0801 | RRYELEIGT | 488.04 | HLA-B*2705 |
| LVLGLSMVK | 84.9 | HLA-A*0301 | KLYVWGVHH | 245 | HLA-A*0301 | LVISTDLSY | 488.16 | HLA-B*5801 |
| ITNKVNTVI | 85 | HLA-B*5801 | FMYSDFHFI | 245 | HLA-B*3901 | RGNSPIFNY | 488.22 | HLA-B*5801 |
| TTNYYNETF | 85 | HLA-B*5801 | IGYVCSGVF | 246 | HLA-B*1501 | RIQDLERYV | 488.28 | HLA-A*0201 |
| KTIDQVTGK | 85 | HLA-A*0301 | NPIVPSFEM | 246 | HLA-B*0702 | CYPGSFNNY | 488.43 | HLA-A*2402 |
| GLIDGWYGF | 85 | HLA-B*1501 | YQFALGQGA | 246 | HLA-B*1501 | GKISHISPL | 488.51 | HLA-B*3901 |
| TLKLGQFPV | 85.2 | HLA-A*0201 | YAFGNCPMY | 246 | HLA-A*2601 | YNAELIVLL | 489.11 | HLA-B*3901 |
| GTVKDRSPF | 85.2 | HLA-B*1501 | RTNMINDKI | 246 | HLA-B*5801 | EVWSYNAEL | 489.45 | HLA-A*2601 |
| FSFKYGNGV | 85.2 | HLA-A*0201 | WRGGSINTK | 247 | HLA-B*2705 | WSFALAQGV | 489.92 | HLA-A*0201 |
| EMKWLSSSM | 85.2 | HLA-B*0801 | NIMASQGTK | 247 | HLA-A*0301 | KMTITFLIL | 490.05 | HLA-A*0201 |
| NIWSYNAQL | 85.3 | HLA-A*0201 | GKIAHISPL | 247 | HLA-B*3901 | SQITNGTTG | 490.1 | HLA-B*1501 |
| WPDRAELPF | 85.4 | HLA-B*0702 | KTFQNVSPI | 247 | HLA-B*1501 | VWIGRTKSL | 490.16 | HLA-B*0801 |
| ISHCRATEY | 85.6 | HLA-B*1501 | AIAMGFVFI | 247 | HLA-A*0201 | FIVKGRSHL | 490.48 | HLA-B*1501 |
| TVLEKNVTV | 85.7 | HLA-A*0201 | NYLIRALTL | 247 | HLA-B*0801 | WVRMNNETI | 490.55 | HLA-B*0801 |
| KMNTQILIL | 85.7 | HLA-A*0201 | IMIAGLFFW | 247 | HLA-A*0201 | ALLIGVGNL | 490.98 | HLA-A*0201 |
| MTIASDILK | 85.7 | HLA-A*0301 | LANNGKFEF | 247 | HLA-B*1501 | WTYNTELLV | 491.59 | HLA-A*0201 |
| YQNNFVPVM | 85.8 | HLA-B*3901 | FPNEVGAKI | 247 | HLA-B*0702 | GIYQILAIY | 491.67 | HLA-B*1501 |
| YRALISWEM | 86.1 | HLA-B*3901 | HSNLNDATY | 247 | HLA-B*1501 | RIDDAVTDI | 491.74 | HLA-A*0201 |
| KTFQNVSPL | 86.3 | HLA-B*1501 | KIDDQIENL | 248 | HLA-A*0201 | VTRREIHIY | 491.79 | HLA-B*1501 |
| FHKDNALRL | 86.5 | HLA-B*3901 | SRSGFEVLF | 248 | HLA-B*2705 | RIGSKGDVF | 491.85 | HLA-B*1501 |
| APRYSFELV | 86.7 | HLA-B*0702 | RLTTTIKPW | 248 | HLA-B*5801 | SSMPFHNVH | 491.93 | HLA-B*1501 |
| HLKDQGWSY | 86.8 | HLA-B*1501 | STVSSSLVL | 248 | HLA-B*1501 | YHKCNNECI | 492.39 | HLA-B*3901 |
| QTKTMTITF | 86.8 | HLA-B*1501 | EMGLAPSPY | 248 | HLA-B*1501 | SRSSFYAEM | 492.53 | HLA-B*2705 |
| FLYIRTNGT | 86.8 | HLA-A*0201 | RRCLLQSLQ | 248 | HLA-B*2705 | GLISTPLGT | 492.56 | HLA-A*0201 |
| NMQNRLNNV | 86.9 | HLA-A*0201 | HHAVPNGTV | 248 | HLA-B*3901 | IWAYNAELI | 492.56 | HLA-A*2402 |
| GYKEVILWF | 86.9 | HLA-A*2402 | GVKLTQGYK | 249 | HLA-A*0301 | FRALVSWEM | 492.63 | HLA-B*2705 |
| LRISSSFSF | 87.2 | HLA-B*2705 | WVPKRNRSI | 249 | HLA-B*0801 | IMWACSNGS | 492.82 | HLA-A*0201 |
| RLRRDQKAL | 87.2 | HLA-B*0702 | CTINSWHIF | 249 | HLA-A*2402 | YLIEDPTAP | 493.01 | HLA-A*0201 |
| VILWFSLGA | 87.3 | HLA-A*0201 | QLNEGIMNT | 249 | HLA-A*0201 | MALSVVSLL | 493.2 | HLA-B*3901 |
| APLMMAYML | 87.3 | HLA-B*0702 | DEGNGCFEL | 249 | HLA-B*4001 | SSCYDGKAW | 493.25 | HLA-B*5801 |
| LPACAYGPA | 87.3 | HLA-B*0702 | SYNAQLLVW | 249 | HLA-B*5801 | ARQMVHAMR | 493.27 | HLA-B*2705 |
| FQTAAQKAM | 87.4 | HLA-B*1501 | WSYIVERPK | 249 | HLA-A*0301 | YYFVKEGKI | 493.8 | HLA-A*2402 |
| RTNLYGFII | 87.5 | HLA-B*5801 | IQNRGLFGA | 249 | HLA-A*0201 | SSSSFYAEM | 493.84 | HLA-B*5801 |
| LVAPRGYFK | 87.7 | HLA-A*0301 | TLTGRGIEV | 250 | HLA-A*0201 | WILWISFAM | 493.99 | HLA-B*3901 |
| SVKNGTYNY | 87.7 | HLA-B*1501 | KIMYFHKGL | 250 | HLA-A*0201 | FITPEYAYK | 494.29 | HLA-A*0301 |
| ETIIETGYV | 87.8 | HLA-A*2601 | ITFESNGGF | 250 | HLA-B*5801 | SPQLEGFSA | 494.51 | HLA-B*0702 |
| LANNGKFEF | 87.8 | HLA-B*5801 | AQMALQLFI | 250 | HLA-B*1501 | TIHDRSPYR | 494.72 | HLA-A*0301 |
| RVWWTTNSI | 87.9 | HLA-A*0201 | YRILSIYST | 250 | HLA-B*2705 | GRIFQSPIR | 494.89 | HLA-B*2705 |
| MRRCLLQSL | 87.9 | HLA-B*2705 | LSFQVDCFL | 250 | HLA-B*5801 | VLGVSVLNL | 495.13 | HLA-A*0201 |
| AILAATVTL | 87.9 | HLA-A*0201 | KAIDGITNK | 251 | HLA-A*0301 | ITYGACPKY | 495.25 | HLA-A*0301 |
| SQYRSLISW | 88 | HLA-B*5801 | ISFYWTIVV | 251 | HLA-A*0201 | GSFCSLDGK | 495.25 | HLA-A*0301 |
| LQITSLCSI | 88.1 | HLA-A*0201 | TTYKILSIY | 251 | HLA-A*0101 | APGVKGFGF | 495.51 | HLA-B*0702 |
| RRNYFTAEV | 88.2 | HLA-B*2705 | REKDMTKEF | 251 | HLA-B*4001 | EVESEIRTF | 495.61 | HLA-A*2601 |
| LIMRTVIAL | 88.3 | HLA-A*0201 | SPNAYQARF | 251 | HLA-B*0702 | SPNVYQARF | 495.87 | HLA-B*0702 |
| WLVHQSGTY | 88.3 | HLA-B*1501 | YPLQNLTKI | 251 | HLA-B*0702 | MGLRISSSF | 496.12 | HLA-B*0801 |
| RRFIQNALN | 88.5 | HLA-B*2705 | HLTGIWDTL | 252 | HLA-B*3901 | SQVERRINM | 496.22 | HLA-B*0801 |
| WLIDQSGTY | 88.5 | HLA-A*2601 | IYATVAGSL | 252 | HLA-A*2402 | SGYSGAFTI | 497.55 | HLA-B*3901 |
| WHASNRPWV | 88.6 | HLA-B*3901 | FQNVSPIWI | 252 | HLA-A*0201 | CPVKGWAPL | 497.6 | HLA-B*3901 |
| ISFSISCFL | 88.6 | HLA-B*5801 | ESKLKRNEI | 252 | HLA-B*0801 | QQIESIIEA | 497.8 | HLA-B*1501 |

Fig. 79-24

| Peptide | Affinity (nM) | Allele | Peptide | Affinity (nM) | Allele | Peptide | Affinity (nM) | Allele |
|---|---|---|---|---|---|---|---|---|
| GLYESIEEC | 88.7 | HLA-A*0201 | RTVGQCPKY | 252 | HLA-B*5801 | ILNTSQRGV | 498.02 | HLA-A*0201 |
| NVYKALSIY | 88.7 | HLA-B*1501 | YSGSFTLPI | 252 | HLA-B*5801 | LEESHPGLF | 498.19 | HLA-B*4001 |
| ARLGKGYMF | 88.8 | HLA-B*2705 | ILCTSAIAI | 252 | HLA-A*0201 | YQKRMTRGL | 498.87 | HLA-B*0801 |
| VPVTQTMEL | 89.1 | HLA-B*0702 | GTFDIGGLY | 252 | HLA-A*2601 | FQNVSRYAF | 499.38 | HLA-B*3901 |
| NRIQINPVK | 89.2 | HLA-B*2705 | GRFYIQMCT | 252 | HLA-B*2705 | | | |
| CKITGFAPF | 89.3 | HLA-B*1501 | NPNQKIVTI | 252 | HLA-B*0801 | | | |
| WISFATSCF | 89.5 | HLA-B*1501 | RLRMATGLR | 252 | HLA-A*0301 | | | |
| TEHQIGNVI | 89.5 | HLA-B*4001 | RGSPGVKGW | 253 | HLA-B*5801 | | | |
| TLTEREVEV | 89.6 | HLA-A*0201 | IITDTFKSW | 253 | HLA-B*5801 | | | |
| LEFKADLII | 89.7 | HLA-B*4001 | VTYQILSIY | 253 | HLA-B*5801 | | | |
| REVCIAWSS | 89.7 | HLA-B*4001 | ALFIGVGNL | 253 | HLA-A*0201 | | | |
| RISHRTLLM | 89.8 | HLA-B*1501 | MGLFFFCLK | 253 | HLA-A*0301 | | | |
| HTQYRTESL | 89.9 | HLA-B*0801 | ILIAGGLIL | 253 | HLA-A*0201 | | | |
| LVSLGAVSF | 90.2 | HLA-B*1501 | RREVHMYYL | 253 | HLA-B*2705 | | | |
| SQYRALVSW | 90.3 | HLA-B*5801 | AIVMGLVFI | 253 | HLA-A*0201 | | | |
| KRLGNLNKK | 90.5 | HLA-B*2705 | TGRDVLVLW | 253 | HLA-B*5801 | | | |
| GTITSNLPF | 90.6 | HLA-B*5801 | FIEGGWSGM | 253 | HLA-A*2601 | | | |
| IRINMINSK | 90.7 | HLA-B*2705 | LQANLCRFL | 253 | HLA-B*1501 | | | |
| SGYSGIFSV | 90.7 | HLA-A*0201 | FPFHKDNAL | 253 | HLA-B*3901 | | | |
| LIFSARSAL | 90.7 | HLA-B*0702 | SIVALCGSK | 253 | HLA-A*0301 | | | |
| KCMRTFFGW | 90.7 | HLA-B*5801 | NYVSMEFSL | 253 | HLA-A*2402 | | | |
| QAYTKVMYF | 90.9 | HLA-B*1501 | HLGTRQVCM | 253 | HLA-B*0801 | | | |
| RLIEKTNEK | 91 | HLA-A*0301 | RTNEKYHQI | 253 | HLA-B*5801 | | | |
| WTSSSSIVM | 91.1 | HLA-B*1501 | YQARFEAVA | 254 | HLA-B*3901 | | | |
| LVAPRGHYK | 91.3 | HLA-A*0301 | RPWIRFNSN | 254 | HLA-B*0702 | | | |

SUMMARY
The number of weak binders is 3367
The number of strong binders is 896

Allele
HLA-A*0101
HLA-A*0201
HLA-A*0301
HLA-A*2402
HLA-A*2601
HLA-B*0702
HLA-B*0801
HLA-B*1501
HLA-B*2705
HLA-B*3901
HLA-B*4001
HLA-B*5801

Number of predicted binders
101
835
345
178
200

Fig. 79-25

| Peptide | Affinity (nM) | Allele | Peptide | Affinity (nM) | Allele | Peptide | Affinity (nM) | Allele |
|---|---|---|---|---|---|---|---|---|
| | | | 267 | | | | | |
| | | | 284 | | | | | |
| | | | 739 | | | | | |
| | | | 249 | | | | | |
| | | | 374 | | | | | |
| | | | 188 | | | | | |
| | | | 503 | | | | | |

Fig. 80-5

| Peptide | Affinity (nM) | Allele | Peptide | Affinity (nM) | Allele | Peptide | Affinity (nM) | Allele |
|---|---|---|---|---|---|---|---|---|
| IINSWHIYGK | 44.14 | HLA-A*0301 | NRMQFSSLTV | 180.53 | HLA-B*2705 | RTLMSCPVGV | 388.97 | HLA-A*0201 |
| VESAVLRGFL | 44.25 | HLA-B*4001 | VPSVQSRGLF | 180.62 | HLA-B*0702 | VPDYQSIRSI | 389.11 | HLA-B*0702 |
| KIMESGGISK | 44.66 | HLA-A*0301 | SWPDGALLPF | 180.8 | HLA-A*2402 | LQIISLCSIW | 389.22 | HLA-B*1501 |
| QADSEMNKLY | 44.95 | HLA-A*0101 | RRLTVLGKDA | 180.96 | HLA-B*2705 | VEFEPFQSLV | 389.29 | HLA-B*4001 |
| FIWAIHHPPT | 45.47 | HLA-A*0201 | RVSKMGVDEY | 181.19 | HLA-B*1501 | LIGKTSWSYI | 389.5 | HLA-A*0201 |
| LTITYSSSLM | 45.79 | HLA-A*2601 | ALGMKNVPEK | 181.67 | HLA-A*0301 | RIGEDSDVLV | 389.55 | HLA-B*3901 |
| FSFGASCFLF | 46 | HLA-B*1501 | WGMEMRRCLL | 181.85 | HLA-B*0801 | HSMSGFRSNL | 390.89 | HLA-A*0201 |
| TTGRDVLVIW | 46.58 | HLA-B*5801 | RSFRPNIGPR | 182.31 | HLA-A*0301 | RSILASSGSL | 391.37 | HLA-B*1501 |
| KESLRLAIGL | 46.72 | HLA-B*4001 | NHSMSDIEAM | 182.68 | HLA-B*3901 | GIITGTIKSW | 392.15 | HLA-B*5801 |
| RFIEKTNQQF | 46.89 | HLA-A*2402 | ALLAFVLWA | 182.84 | HLA-A*0201 | LLSPEEVSET | 392.34 | HLA-A*0201 |
| RSPYRALISW | 46.89 | HLA-B*5801 | QESLMLATGM | 182.94 | HLA-B*4001 | RIAWSSSSCF | 392.36 | HLA-B*5801 |
| SISCFLLAAL | 46.93 | HLA-A*0201 | YVNNTTVINK | 183.27 | HLA-A*0301 | SIYSCIASSI | 392.41 | HLA-B*1501 |
| NVINWTQDAM | 47.56 | HLA-A*2601 | RTFSFQLILI | 183.57 | HLA-A*0201 | VMTDGNASGK | 393 | HLA-A*0301 |
| NRNQPAATAL | 47.8 | HLA-B*3901 | NRQEIGGVKL | 183.6 | HLA-B*3901 | RSQSGRISFY | 393.43 | HLA-A*0301 |
| NRMQFSSLTV | 48.05 | HLA-B*3901 | KVDTLTETGV | 183.68 | HLA-A*0201 | HTIDVTDSEM | 393.45 | HLA-B*1501 |
| KEDRRYGPAL | 48.4 | HLA-B*4001 | STGNFIAPEY | 183.76 | HLA-A*0101 | ILGNPMCDEL | 393.62 | HLA-B*1501 |
| CVAWSSTSCF | 48.61 | HLA-B*1501 | FIMWACSNGS | 183.82 | HLA-A*0201 | NKLAAICTHL | 394.12 | HLA-B*3901 |
| FSFGASCFVL | 48.8 | HLA-B*3901 | GRMTFYWAIV | 183.82 | HLA-B*2705 | KSTQEAIEKI | 394.23 | HLA-B*5801 |
| TKMEAILVVL | 49.29 | HLA-B*3901 | KSTQAAVDQI | 184.91 | HLA-B*5801 | FPSSSYRRPI | 394.32 | HLA-B*0801 |
| TSGKQMLIIW | 49.47 | HLA-B*5801 | WISFATSCFL | 185.45 | HLA-A*0201 | IMFSNKVARL | 394.71 | HLA-B*1501 |
| RSPFRALISW | 49.58 | HLA-B*5801 | IEFEPFQSLV | 185.56 | HLA-A*0201 | IEVVAAQELV | 394.77 | HLA-B*4001 |
| FHLGTKQVCI | 50.19 | HLA-B*3901 | CGVDSDTTGW | 186.06 | HLA-B*5801 | CSHSECRTFF | 395.13 | HLA-B*5801 |
| FYRSIRWLTL | 50.41 | HLA-B*4001 | SPIHLGDCSF | 186.76 | HLA-B*0702 | KVRNGTYDHK | 395.18 | HLA-A*0301 |
| FQLFLVCVSL | 51.54 | HLA-A*2402 | LKMTIASDIL | 186.87 | HLA-B*3901 | MMDGWYGFRH | 395.48 | HLA-B*2705 |
| RMGVQMHRFK | 52.43 | HLA-A*0301 | YRKRMTRGLF | 187.06 | HLA-B*3901 | EIKGVKLSSM | 396.38 | HLA-B*0801 |
| KENKRYGPAL | 52.55 | HLA-B*4001 | YQILSIYSTV | 187.11 | HLA-A*0201 | TALANTIEVF | 396.53 | HLA-B*1501 |
| RMGLQMQRFK | 52.84 | HLA-A*0301 | NMQNRLNNVI | 187.35 | HLA-B*0801 | ILHKCNDSCM | 396.75 | HLA-B*1501 |
| FIFLLLTHWA | 53.45 | HLA-A*0301 | LYASPQLEGF | 187.55 | HLA-A*2402 | EVRRRLSTNA | 397.72 | HLA-B*0801 |
| RECFNPCFYV | 53.5 | HLA-A*0201 | FALSGVAVAL | 188.33 | HLA-B*3901 | LIFMARSALI | 398.05 | HLA-B*2705 |
| GTYDYPKYEK | 53.51 | HLA-A*0301 | GEAMVSRARI | 189.43 | HLA-A*0201 | ARILTSEESQL | 398.23 | HLA-B*1501 |
| FTIGECPKYV | 53.81 | HLA-A*0201 | MISDKIDDQI | 190.14 | HLA-B*4001 | LARGEKANVL | 398.62 | HLA-B*0702 |
| ETGNGCFEFY | 53.89 | HLA-A*2601 | SIRLSAGGAI | 190.16 | HLA-A*0201 | MGVYQILAIY | 398.65 | HLA-B*1501 |
| IRALTLNTM | 54.53 | HLA-B*1501 | NESGRLMDFL | 190.23 | HLA-A*0201 | KSLPDLYDYK | 399.33 | HLA-A*0301 |
| VLDDCSLKGL | 54.63 | HLA-B*3901 | IHDRTPHRTL | 190.25 | HLA-B*4001 | SYFQLFLVCV | 399.48 | HLA-A*2402 |
| WHIFGKDNAV | 54.81 | HLA-A*0201 | YSSVASSLVL | 190.27 | HLA-B*3901 | ASVPASRYLI | 400.21 | HLA-B*5801 |
| GEVFVIREPF | 55.1 | HLA-A*0301 | VEYNGKSLGI | 191.49 | HLA-A*0201 | LVSDGGPNLY | 400.8 | HLA-B*1501 |
| TGSYVRLYLW | 55.14 | HLA-B*5801 | SLTSLPFQNI | 191.77 | HLA-B*5801 | YSTGALASCM | 401.99 | HLA-A*2601 |
| FYRNMRWLTL | 55.39 | HLA-B*0801 | NKFASICTHL | 192.21 | HLA-A*0201 | IHDRSQYRSL | 403.76 | HLA-B*3901 |
| SEECSCYVDI | 55.7 | HLA-B*4001 | IRMAINWGRI | 192.43 | HLA-B*3901 | TVLVGLILAF | 403.97 | HLA-B*1501 |
| LHLTGKWDTL | 55.72 | HLA-A*0301 | VLTGNLQALK | 192.7 | HLA-B*2705 | EAIEKITNKV | 404.07 | HLA-A*2601 |
| RMGVQMQRFK | 55.74 | HLA-A*0301 | LTKGVLGFVF | 192.81 | HLA-B*1501 | WGMEMRRCLL | 404.48 | HLA-B*3901 |
| FHLGTKQVCV | 55.75 | HLA-B*3901 | EQMYQRCCNL | 192.83 | HLA-B*3901 | EAIGKITNKV | 406.53 | HLA-A*2601 |

Fig. 81-10

| Peptide | Affinity | Allele | Peptide | Affinity | Allele | Peptide | Affinity (nM) | Allele |
|---|---|---|---|---|---|---|---|---|
| HPSSTQEKNAL | 30.39 | HLA-B*0702 | GVIPLTTTPTK | 148.16 | HLA-A*0301 | RATEYMMKGVY | 329.46 | HLA-B*1501 |
| IPHRTLLMSEL | 30.43 | HLA-B*0702 | WAYNAELLVLL | 148.22 | HLA-B*3901 | ISCSYLECRTF | 329.53 | HLA-B*1501 |
| RTHQYSERGKW | 30.53 | HLA-B*5801 | WSFALAQGTLL | 148.3 | HLA-B*5801 | SECVCHNSTCV | 329.69 | HLA-B*4001 |
| HLRNDTDVVNY | 30.53 | HLA-B*1501 | WISFATSCFLL | 148.46 | HLA-A*0201 | WSWHDGAEITY | 329.7 | HLA-A*0101 |
| AILATTVTLHF | 30.73 | HLA-B*1501 | TVKDRSPYRAL | 148.51 | HLA-B*0801 | STYQNNFVPVV | 329.75 | HLA-A*0201 |
| WSWPDGAELPF | 30.81 | HLA-B*5801 | KSLGIQSDAQI | 148.77 | HLA-B*5801 | RRQILRTQESS | 329.86 | HLA-B*2705 |
| RPLVMGQQGRM | 30.99 | HLA-B*0702 | RTLNTASRSGY | 148.82 | HLA-B*1501 | TLVSNNDWSGY | 329.92 | HLA-A*2601 |
| SQYRSLISWPL | 31.09 | HLA-B*3901 | QLSSVSSFEKF | 149.01 | HLA-B*1501 | IISMCSSTEFL | 329.97 | HLA-A*0201 |
| MLFVQSYFQLF | 31.1 | HLA-B*1501 | SIAGWLLGNPM | 149.02 | HLA-A*0301 | RLSAGGAIWVT | 330.27 | HLA-A*0201 |
| KMKAIIVVLLY | 31.25 | HLA-A*0301 | QAFYKILKIRK | 149.1 | HLA-A*0301 | SVASSLVLLFM | 330.49 | HLA-B*1501 |
| MMMGMFNMLST | 31.33 | HLA-A*0201 | LLVSTNAYDRI | 149.22 | HLA-A*0201 | RRAEIIKMESA | 330.68 | HLA-B*2705 |
| KYERVKMFDFI | 31.53 | HLA-A*2402 | NHEDYREESQL | 149.35 | HLA-B*3901 | YRSWSKPQCQI | 330.87 | HLA-B*3901 |
| LIALCGSPFPV | 31.54 | HLA-A*0201 | FPFHKGNSARL | 149.6 | HLA-B*3901 | ILKDCSIAGWL | 331.4 | HLA-A*0201 |
| SPHSRSGFEML | 31.61 | HLA-B*0702 | CFNPCFYVELI | 149.77 | HLA-A*2402 | GHDFEREGYSL | 331.56 | HLA-B*3901 |
| RMFALSQGTTL | 31.92 | HLA-B*1501 | SYGRIIQNEDI | 149.85 | HLA-A*2402 | YLIEDPAAPHG | 332.15 | HLA-A*0201 |
| SSSSCFDGKEW | 31.97 | HLA-B*5801 | NRPWVSFNQNL | 150.12 | HLA-B*3901 | IVNTTLSTIAL | 332.19 | HLA-B*1501 |
| LPFHNIHPLAI | 32.16 | HLA-B*0702 | TIRNRHSNGTI | 150.2 | HLA-B*0801 | NRPWVSFDQNL | 332.21 | HLA-B*3901 |
| ALRDSLEPGTF | 32.19 | HLA-B*1501 | KINPVTLTMGY | 150.27 | HLA-B*5801 | NQSPRMFLAMI | 332.7 | HLA-B*3901 |
| REITFHRAKEV | 32.34 | HLA-B*5801 | MKWGMELRRCL | 150.46 | HLA-B*3901 | AINNRFQIQGV | 333.19 | HLA-A*0201 |
| TVVLNTDWSGY | 32.37 | HLA-A*2601 | ALAQGALVGTK | 150.9 | HLA-A*0301 | LWISFAISCFL | 333.2 | HLA-A*0201 |
| GEETIEEERFAI | 32.49 | HLA-B*4001 | GIHHPSSTQEK | 150.9 | HLA-A*0301 | NQNPRVFLAMI | 333.21 | HLA-A*0301 |
| TMDTVSRTHQY | 32.53 | HLA-A*0101 | FQHQNEQGVGM | 150.92 | HLA-B*1501 | GRFYIQMCTEL | 333.48 | HLA-B*3901 |
| FMWAIHHPPTS | 32.53 | HLA-A*0201 | NEIKGVKLSSM | 151.47 | HLA-B*4001 | VSCSHLECRTF | 333.71 | HLA-B*1501 |
| KMKAILVVLLY | 32.7 | HLA-A*0301 | FLHNGGLIAPS | 151.55 | HLA-A*0201 | CHSAAFEDLRL | 333.77 | HLA-A*0201 |
| RPWMRINNETI | 32.85 | HLA-B*0702 | ILFNTIGNLIA | 151.55 | HLA-A*0301 | FPFHKDNAIRL | 333.82 | HLA-B*0801 |
| FLYVRTNGTSK | 32.87 | HLA-A*0301 | ALGQGTTLYNK | 151.8 | HLA-A*0301 | MEEVTNATETV | 334.09 | HLA-B*4001 |
| VYQARFESVAW | 32.87 | HLA-A*2402 | SARHVEECSCY | 152.59 | HLA-B*1501 | TIGDCPKYVNV | 334.37 | HLA-A*0201 |
| AAIGLRISSSF | 32.92 | HLA-B*1501 | IQDIWAYNAEL | 152.61 | HLA-B*3901 | CRTFFLTHGAL | 334.54 | HLA-B*3901 |
| KISSSFSFGGF | 33.01 | HLA-B*1501 | KEECYRACFYV | 152.61 | HLA-B*4001 | QEELRSLFSSI | 335.15 | HLA-B*4001 |
| VLLNASWFNSF | 33.4 | HLA-B*1501 | ISCSYLECRTF | 152.74 | HLA-B*1501 | GQFPVQTDEYK | 335.21 | HLA-A*0301 |
| RPTAVDTCYPF | 33.41 | HLA-B*1501 | SFYRNLIWLVK | 152.8 | HLA-A*0301 | SAKHIEECSCY | 335.27 | HLA-A*0301 |
| YQKCCNLFEKF | 33.43 | HLA-B*1501 | RFVFSNAASYK | 152.88 | HLA-A*0301 | GRMSDSIKSWR | 335.81 | HLA-B*2705 |
| RTHQYSEKGKW | 33.45 | HLA-B*5801 | TLVNPGDSIIF | 152.88 | HLA-B*1501 | YQIAIYATVA | 336.11 | HLA-B*3901 |
| AEEDGNGCFEI | 33.51 | HLA-B*4001 | AMDAGNGCFDI | 153.17 | HLA-B*1501 | REWSYIVERTK | 336.21 | HLA-A*0301 |
| SIWFSHYNQMK | 33.58 | HLA-A*0301 | STVMVGLILAF | 153.18 | HLA-A*0301 | VQNEFNKACEL | 336.29 | HLA-B*5801 |
| QTYAGAVNSSK | 33.66 | HLA-A*0301 | SVRNGTYDYPK | 153.4 | HLA-A*0301 | IAASYKRIRLF | 336.56 | HLA-B*1501 |
| DLVETNHTGTY | 33.86 | HLA-A*2601 | TPYRTLLMNEL | 153.41 | HLA-B*0702 | IQAGVDRFYRI | 336.82 | HLA-A*0201 |
| KMARLGRGYMF | 33.86 | HLA-B*1501 | VLIAGGLILGM | 153.61 | HLA-B*1501 | IQNIWAYNAEL | 336.84 | HLA-B*3901 |
| SLYASPQLEGF | 33.92 | HLA-B*1501 | KTVVHLNSTTI | 153.84 | HLA-B*5801 | LQNTSKHYIGK | 336.93 | HLA-A*0301 |
| VSWTSNSIVTF | 34.15 | HLA-B*5801 | RLSAGGDIWVM | 153.88 | HLA-B*1501 | FVNITNVQNNY | 336.93 | HLA-B*1501 |
| GVSSEVPEWSW | 34.37 | HLA-A*0201 | RTISIASRSGY | 153.97 | HLA-B*5801 | QLFIKDYRYTY | 337.24 | HLA-A*0301 |
| GQFGRIDFHWL | 34.44 | HLA-A*0201 | FRYGDGVWIGR | 154.1 | HLA-B*2705 | RTVGQCPKYVK | 337.3 | HLA-B*1501 |
| YLLLNKSLCNV | | | WFRNILSMAPI | 154.61 | HLA-B*0801 | WSWDDGAILPL | 337.32 | HLA-A*0201 |

Fig. 81-11

| Peptide | Affinity | Allele | Peptide | Affinity | Allele | Peptide | Affinity (nM) | Allele |
|---|---|---|---|---|---|---|---|---|
| WSWPDGAKLPF | 34.47 | HLA-B*5801 | SQRGILEDEQM | 154.75 | HLA-B*1501 | FRTLMSCPIGV | 337.36 | HLA-B*3901 |
| VLMENERTLYF | 34.47 | HLA-B*1501 | KIRHLEECSCY | 154.96 | HLA-B*1501 | NVKVTHRENLL | 337.46 | HLA-B*0801 |
| LVMKRKRDSSI | 34.6 | HLA-B*0801 | WSWPDGAEVPF | 155.11 | HLA-B*1501 | YGKGRIFQSHI | 337.63 | HLA-B*0801 |
| TEWSGYSGSFV | 34.62 | HLA-B*4001 | MSFQGRGVFEL | 155.25 | HLA-B*3901 | AHALKLVVAML | 338.59 | HLA-B*3901 |
| SSSSCHDGRAW | 34.67 | HLA-B*5801 | SLQQIESIIEA | 155.26 | HLA-B*4001 | WSGYSGSFIDY | 339.14 | HLA-A*0101 |
| SSASCHDGRAW | 34.75 | HLA-B*5801 | REGRNPGNAEI | 155.91 | HLA-A*0201 | EQMYQKCCTLF | 338.81 | HLA-B*1501 |
| KLATGLRNVPI | 34.82 | HLA-A*0201 | VMTDGPASNQA | 156.06 | HLA-B*4001 | SLAVNVRGSGM | 339.44 | HLA-B*1501 |
| ALANTIEVFRA | 34.88 | HLA-A*0201 | IENNVTVTSSV | 156.06 | HLA-A*0201 | CIVPCFWLEMI | 339.49 | HLA-A*0201 |
| QTYAGAINSSK | 34.9 | HLA-A*0301 | LIWLWLVLREK | 156.07 | HLA-A*0301 | FQHQNAEGIGI | 339.57 | HLA-B*3901 |
| AEEDGTGCFEI | 35.12 | HLA-B*4001 | IMIWHSNLNDA | 156.08 | HLA-B*4001 | IAMGLIFMCVK | 339.63 | HLA-A*0301 |
| AILATTITLHF | 35.12 | HLA-B*1501 | DSNGNFIAPEY | 156.19 | HLA-A*2601 | REFEVVDHEFS | 339.73 | HLA-B*4001 |
| NPNWSGYSGAF | 35.17 | HLA-B*0702 | MKWMMAMKYPI | 156.28 | HLA-B*0801 | LRELWQCYLL | 340.24 | HLA-B*3901 |
| EMTDSEMLNLY | 35.18 | HLA-A*2601 | RFYIQMCTELK | 156.37 | HLA-A*0301 | AIDNGDGCFEI | 340.53 | HLA-A*0201 |
| VYQSRFEAVAW | 35.22 | HLA-A*2402 | DRIEVTNATEL | 156.41 | HLA-B*3901 | GRQTYDWTLNR | 340.67 | HLA-B*2705 |
| WLTLKLGQFPV | 35.25 | HLA-A*0201 | KSLESRRGFEM | 156.5 | HLA-B*5801 | FYIQMCTELKL | 340.71 | HLA-A*2402 |
| CYRACFYVELI | 35.31 | HLA-A*0201 | WEGMIDGWYYGF | 156.51 | HLA-A*2601 | HLRDQGWSYIV | 341 | HLA-A*0201 |
| AILAATVTLHF | 35.31 | HLA-B*1501 | DLADSEMDKLY | 156.58 | HLA-A*2601 | SGRIDFHWLIL | 341.04 | HLA-B*0801 |
| GVWTYNAELLV | 35.45 | HLA-A*0201 | LMNELGVPFHL | 156.66 | HLA-B*1501 | GSYNNTSGKQM | 341.24 | HLA-B*1501 |
| LLAKSVFNSIY | 35.47 | HLA-B*1501 | TIHLTDSEMNK | 156.78 | HLA-A*0301 | HPSSTKEKNDL | 341.5 | HLA-B*0702 |
| AIYSTVASSLV | 35.57 | HLA-A*0201 | IQHLEECSCYM | 157.26 | HLA-B*1501 | FPFHKGNSARL | 341.5 | HLA-B*3901 |
| VSWTSNSIITF | 35.63 | HLA-B*5801 | QQGWNDYYWGI | 157.27 | HLA-A*0201 | LEVGTRWMKII | 341.64 | HLA-B*4001 |
| DAYAVIHYGGM | 35.67 | HLA-A*0201 | FSFGASCVMLL | 157.35 | HLA-B*1501 | LHLTGIWDTLI | 341.71 | HLA-A*0201 |
| RTISPRSRSGF | 36.07 | HLA-B*1501 | RRGLFGAIAGF | 157.38 | HLA-B*5801 | KMYALHQGTTI | 342 | HLA-B*5801 |
| AIYSTVASSSV | 36.13 | HLA-A*0201 | LLVSLGAISFW | 157.41 | HLA-B*5801 | KRLTTTIKTWA | 342.23 | HLA-B*2705 |
| APQLNPIDGPL | 36.15 | HLA-B*0702 | NWFGYFGIFFV | 157.45 | HLA-A*0201 | FELIDNEFTEV | 342.42 | HLA-B*4001 |
| ALLAKSVFNSL | 36.18 | HLA-A*0201 | MIRGQPKEKAI | 157.59 | HLA-B*0801 | REQQGRMDYYW | 342.47 | HLA-B*4001 |
| RTISPRLRSGF | 36.35 | HLA-B*1501 | SVAGWLLGNPM | 157.63 | HLA-B*1501 | MLLDPGDTVTF | 342.48 | HLA-A*0201 |
| LSMAPIMFSNK | 36.38 | HLA-A*0301 | YIIEKYGTGRI | 157.65 | HLA-A*0201 | NLFTLSGVAIA | 342.76 | HLA-A*0301 |
| VYQARFEAVAW | 36.5 | HLA-A*2402 | LVLGDCSIAGW | 157.75 | HLA-B*5801 | TIIETGYVCSK | 342.91 | HLA-A*0301 |
| SLQNRIQIDSV | 36.68 | HLA-A*0201 | WSKPQCHITGF | 157.78 | HLA-B*1501 | WSWHDGAEIIY | 343.21 | HLA-A*0101 |
| IESNVTVTSSI | 36.7 | HLA-B*4001 | ISCSHMECRTF | 157.8 | HLA-B*1501 | LLQSAILSLQT | 343.45 | HLA-A*0201 |
| SQFRALISWEM | 36.88 | HLA-B*1501 | KMNPNQKIITI | 157.9 | HLA-A*0201 | IESIIEAESSV | 343.5 | HLA-B*4001 |
| KYGPALSINEL | 36.9 | HLA-B*1501 | FSISCFLLAAL | 157.91 | HLA-A*0201 | YQILAIYSTAA | 343.71 | HLA-A*0201 |
| VSWTSNSMVTF | 36.97 | HLA-B*4001 | SFYRNLVWLVK | 158.25 | HLA-A*0301 | TLVANNDWSGY | 343.95 | HLA-A*2601 |
| WEQMYNPGGEV | 37.09 | HLA-B*4001 | YIIRALTLNTM | 158.33 | HLA-B*1501 | GQSGRIDFHWM | 344.19 | HLA-B*1501 |
| KLNNVIDKMNK | 37.19 | HLA-A*0301 | ILWISFSMSCF | 158.47 | HLA-B*1501 | RQCFNPMTVEL | 344.43 | HLA-B*4001 |
| STVMVGLILAF | 37.19 | HLA-B*1501 | YLVLNKSLCKV | 158.5 | HLA-A*0201 | VPILNTSQRGI | 344.48 | HLA-A*0201 |
| SSFEKFEIFPK | 37.37 | HLA-A*0301 | LTDSQTATKRI | 158.53 | HLA-A*0101 | GRYSKADKICI | 344.5 | HLA-A*0101 |
| LVWMACHSAAF | 37.37 | HLA-B*1501 | FMYSDFHFINE | 158.99 | HLA-B*3901 | NRPWISFDQNL | 344.5 | HLA-B*3901 |
| RTISTASRSGY | 37.4 | HLA-B*1501 | KTFFLTQGSLL | 159 | HLA-B*5801 | PSSAQEKNDLY | 345.01 | HLA-A*0101 |
| KLVDGQDCDLI | 37.44 | HLA-A*0201 | IREPFISCSPL | 159.02 | HLA-B*3901 | GSWPDGANISF | 345.09 | HLA-B*1501 |
| KMNTQFEAVGK | 37.59 | HLA-A*0301 | WISFSISCFLL | 159.13 | HLA-A*0201 | IHDRSQYRALI | 345.11 | HLA-A*0201 |
| FEPNGCIESKL | 37.62 | HLA-B*4001 | KMEAILVVLLY | 159.22 | HLA-A*0301 | GRFYVQMCTEL | 345.12 | HLA-B*3901 |

Fig. 81-23

| Peptide | Affinity | Allele | Peptide | Affinity | Allele | Peptide | Affinity (nM) | Allele |
|---|---|---|---|---|---|---|---|---|
| TMKDRSPYRTL | 78.48 | HLA-B*0801 | SFYRNVVWLIK | 228.03 | HLA-A*0301 | WSGYSGSFIDY | 455.88 | HLA-B*1501 |
| ESNGVFLAPRY | 78.51 | HLA-A*2601 | VLLENDKTLDL | 228.13 | HLA-A*0201 | LFSGYKDIILW | 455.91 | HLA-B*5801 |
| LLASTNAHDRI | 78.9 | HLA-A*0201 | KRQEIEGIRLK | 228.21 | HLA-B*2705 | SLKLATGLRNI | 456.09 | HLA-B*0801 |
| ESNGGFLAPRY | 78.97 | HLA-A*2601 | SACLRGGRNSF | 228.21 | HLA-B*1501 | FFNNTEPLCEV | 456.4 | HLA-A*0201 |
| FSFGASCVMLL | 79.23 | HLA-B*3901 | KGRYGVKGFSF | 228.22 | HLA-B*1501 | ALLNRLNINPV | 457.05 | HLA-B*0801 |
| SSMPFHNVHPL | 79.27 | HLA-B*3901 | ALILRGAVAHK | 228.58 | HLA-A*0301 | KYRTESLQNRI | 457.24 | HLA-A*2402 |
| KPRPRRGLFGA | 79.42 | HLA-B*0702 | VMTDGPANNQA | 228.65 | HLA-A*0201 | KMNPNQKIII | 457.5 | HLA-A*0201 |
| LLDPGDTVTFT | 79.56 | HLA-A*0201 | MGLRISSSFSF | 228.77 | HLA-B*1501 | APEGMCYPGSV | 457.24 | HLA-B*0702 |
| MILGNGCFEFW | 79.72 | HLA-B*5801 | SVSSFERFEMF | 228.86 | HLA-B*1501 | QQGTMDYYWGI | 457.55 | HLA-A*0201 |
| SLSPGMMMGMF | 79.72 | HLA-B*1501 | QESECVCHSGI | 228.92 | HLA-B*4001 | QRSWMKIYWHL | 457.7 | HLA-B*3901 |
| SIAGWLLGNPK | 79.9 | HLA-A*0301 | TPYRSLIQFPI | 229.1 | HLA-B*0702 | GPANNQASYKI | 457.71 | HLA-B*0702 |
| KLCRLSGIPPL | 79.92 | HLA-A*0201 | LQSSDDFALIV | 229.24 | HLA-A*0201 | VLLENERTLDY | 458 | HLA-B*1501 |
| MKWMMAMRYPI | 80.01 | HLA-A*0201 | GEVPSPYNSRF | 229.37 | HLA-B*4001 | FEREGYSLVGV | 458.27 | HLA-B*4001 |
| ELWSYNAELLV | 80.08 | HLA-B*0801 | GIITDTFKSWK | 229.38 | HLA-A*0301 | KIDPVKLSSGY | 458.53 | HLA-A*0101 |
| MPFHNVHPLTI | 80.17 | HLA-B*0801 | CRLSGIPPLEL | 229.42 | HLA-B*2705 | YQNSFVPVVGA | 458.68 | HLA-B*1501 |
| YILDEESRARI | 80.17 | HLA-B*0801 | EKLTITYSSSL | 229.45 | HLA-B*3901 | GVQDIIDNDNW | 459.3 | HLA-B*5801 |
| FRNVLSIAPIM | 80.21 | HLA-A*0201 | SLVGIDPFRLL | 229.54 | HLA-A*0201 | LMSQSRTRGIL | 459.5 | HLA-B*1501 |
| VANFSMELPSF | 80.49 | HLA-B*3901 | TEIEQQIGNVI | 229.56 | HLA-A*0201 | AINTTLPFHNI | 459.64 | HLA-B*1501 |
| IAVFCGTSGTY | 80.6 | HLA-B*1501 | SLCKIEGWVVI | 229.7 | HLA-A*0201 | WLLGNPTCDEF | 459.78 | HLA-A*0201 |
| IMWACQKGNIK | 80.9 | HLA-B*1501 | KQPISLGDCSF | 229.71 | HLA-B*1501 | ELKSLFSSIKK | 459.94 | HLA-A*0301 |
| ESSGGLLAPRY | 80.91 | HLA-A*2601 | FPFHKDNALRL | 229.9 | HLA-B*0801 | NQSPRMFLAMI | 460.21 | HLA-A*0201 |
| TLLAKSVFNNL | 81.12 | HLA-A*0201 | VLGLSMVKSDK | 230.1 | HLA-A*0301 | FQHQNAEGIGI | 460.3 | HLA-A*0201 |
| RRSGAAGAAVK | 81.14 | HLA-A*0301 | SLVGVDPFKLL | 230.11 | HLA-A*0201 | FRQGNSVWAGR | 460.39 | HLA-B*2705 |
| IHDRIPHRTLL | 81.23 | HLA-B*2705 | ESNGNFITPEY | 230.45 | HLA-A*0101 | LSIYSCIASSV | 460.93 | HLA-B*1501 |
| YENNTWVNQTF | 81.29 | HLA-B*3901 | NLLIGVSNVGL | 230.49 | HLA-B*1501 | LFQDILMRMSK | 460.94 | HLA-A*0301 |
| WLLGNPECDRL | 81.38 | HLA-B*4001 | TMTITFLILLF | 230.54 | HLA-B*0801 | WSGYSGAFINY | 461.15 | HLA-B*1501 |
| KIMESGGISKM | 81.47 | HLA-B*1501 | ELRRQKSLIWL | 230.74 | HLA-B*3901 | MWACSNGSCRF | 461.45 | HLA-A*2402 |
| GSRERLGSWSW | 81.49 | HLA-B*5801 | FPFHKDNAVRL | 231.09 | HLA-A*0201 | MWACSSGNCRF | 461.77 | HLA-A*2402 |
| DVISFESTGNL | 81.8 | HLA-A*2601 | GLICATCEQIA | 231.5 | HLA-A*0301 | SSMPFHNIHPL | 461.93 | HLA-A*0201 |
| ESNGGLIAPRY | 81.81 | HLA-A*2601 | LSVAPIMFSNK | 231.57 | HLA-A*0301 | RETRGLFGAIA | 462.02 | HLA-B*4001 |
| RTISKDLRSGY | 81.85 | HLA-B*1501 | VLLENERTLDL | 231.58 | HLA-A*0201 | SATGPADTRVY | 462.03 | HLA-A*0201 |
| NEIEHQIGNVI | 81.91 | HLA-B*4001 | SFFRNVVWLVK | 231.76 | HLA-A*0301 | SFYRSMRWLTL | 462.16 | HLA-A*2402 |
| YVWWTSNSLIA | 82.02 | HLA-A*0201 | AINNRIKINPV | 232.15 | HLA-A*0201 | FSMSCFVFVAL | 462.31 | HLA-B*1501 |
| LAIYSTVASSL | 82.05 | HLA-B*1501 | NLIIGISNVGL | 232.27 | HLA-B*1501 | KLVATGPRNV | 462.35 | HLA-A*0201 |
| FIMWACQKGNI | 82.23 | HLA-B*1501 | KIRTRGLFGAI | 232.28 | HLA-B*0702 | TPIAFLTSSIV | 462.41 | HLA-B*0702 |
| WSWPDGADLPF | 82.52 | HLA-B*1501 | LAHALKLVAM | 232.45 | HLA-A*0201 | LIFSARSALIL | 462.42 | HLA-B*1501 |
| KSLESRSGFEM | 82.55 | HLA-B*5801 | YPFDVPDYQSL | 232.52 | HLA-B*4001 | MKIIRVGCVIL | 462.6 | HLA-B*3901 |
| YRICKLVGINM | 82.57 | HLA-B*2705 | WEGLIDGWYGF | 232.52 | HLA-B*1501 | STVASSLTLAI | 462.76 | HLA-B*5801 |
| IVAFCGTSGTY | 82.67 | HLA-B*1501 | YRIWSKPQCCQI | 232.59 | HLA-B*2705 | KMEAILVVLY | 463.22 | HLA-B*1501 |
| MINPVKLSGGY | 82.82 | HLA-A*0301 | FYIQMCTELQL | 232.94 | HLA-A*2402 | AVTDIWSYNAK | 463.3 | HLA-A*0301 |
| AVATTHSWTPK | 82.87 | HLA-B*0702 | KQESLMLATGM | 233.55 | HLA-B*1501 | AKYVWWTSNSL | 463.33 | HLA-B*3901 |
| YPGKFTNEEAL | 82.9 | HLA-A*0301 | VLMENERTLYF | 233.79 | HLA-A*0301 | MLSTVLGVSVL | 463.53 | HLA-B*1501 |
| RTNEKYHQIEK | 82.96 | HLA-A*0301 | SLMLATGMRNI | 233.8 | HLA-A*0201 | KKMEDGFLDVW | 463.91 | HLA-B*5801 |

Fig. 81-25

| Peptide | Affinity | Allele | Peptide | Affinity | Allele | Peptide | Affinity (nM) | Allele |
|---|---|---|---|---|---|---|---|---|
| LMNELGVSFHL | 87.82 | HLA-B*1501 | SMGVYQILAIY | 242.38 | HLA-B*1501 | RRIDFHWLFLD | 476.3 | HLA-B*2705 |
| RPLVNGQRGRI | 87.83 | HLA-B*0702 | RTNGTSKIKMK | 242.64 | HLA-A*0301 | LTKKEPDTYDF | 476.91 | HLA-B*1501 |
| AVATTHSWVPK | 88.14 | HLA-A*0301 | RTISPRSRNGF | 243.08 | HLA-B*5801 | QNRMQFSSLTV | 477.08 | HLA-B*0801 |
| NLDLNMGQPFY | 88.16 | HLA-A*0101 | LPFHNVHPLAI | 243.1 | HLA-B*0801 | GAFIAPDRASF | 477.25 | HLA-B*5801 |
| NLIAPEYGHLI | 88.16 | HLA-A*0201 | FSISCFLLVAL | 243.54 | HLA-A*0201 | KMNTQFEAIGR | 477.45 | HLA-A*0301 |
| ESNGGLLAPRY | 88.22 | HLA-A*2601 | TKMKAILVVLL | 243.57 | HLA-B*3901 | TPYRSLIQFPI | 477.61 | HLA-B*3901 |
| LTIYSTVASSF | 88.23 | HLA-B*5801 | GYKDWVLWISF | 243.61 | HLA-A*2402 | VSCGPSECRTF | 477.64 | HLA-B*5801 |
| KLLKERGFFGA | 88.27 | HLA-A*0201 | WSYNAQLVLL | 243.62 | HLA-B*3901 | RTISTASRAGY | 477.77 | HLA-A*0301 |
| YVKQSSLPLAL | 88.32 | HLA-A*0201 | QRLNTMHQLLR | 243.86 | HLA-B*2705 | SQYRALISWPL | 477.8 | HLA-B*2705 |
| REWSYLIEDPT | 88.32 | HLA-B*4001 | RYNGQRSWMKI | 243.93 | HLA-A*2402 | MQNRLNNVIDK | 478.22 | HLA-A*0301 |
| FGASCFVLLAV | 88.39 | HLA-A*0201 | CISATGMILSV | 244 | HLA-A*0201 | SWIPKRNRSIL | 478.48 | HLA-B*0801 |
| APFSKDNSVRL | 88.48 | HLA-B*0702 | WSWPDGALFPL | 244.05 | HLA-B*5801 | ISKRGSSGIMK | 478.55 | HLA-A*0301 |
| RTREGRRKTNL | 88.68 | HLA-B*0702 | KLAIGPRNVPA | 244.16 | HLA-A*0201 | GIYQILAIYAT | 478.6 | HLA-A*0201 |
| ALSILNLLIGI | 88.79 | HLA-A*0201 | GTIIKTLTNEK | 244.32 | HLA-A*0301 | GAKAGFIEGGW | 478.79 | HLA-B*5801 |
| RRLTTTIKTWA | 88.84 | HLA-B*2705 | VLLSPEEVSEA | 244.44 | HLA-A*0201 | ITVDHMAIIKK | 478.83 | HLA-A*0301 |
| ITYSSSLMWEI | 89.29 | HLA-B*5801 | TVWTSSSSIVM | 244.48 | HLA-B*1501 | IENLEELRFVF | 479.02 | HLA-A*0301 |
| MLSTVLGVSVL | 89.3 | HLA-A*0201 | VLLENEKTLDL | 244.53 | HLA-A*0301 | LILKDCSVAGW | 479.15 | HLA-B*5801 |
| WFRNALSIAPI | 89.31 | HLA-B*0801 | RLCTINSWHIY | 244.6 | HLA-B*5801 | IDLADSEMNK | 479.47 | HLA-A*0301 |
| WTYQAELLVAM | 89.49 | HLA-A*2601 | NGQAGRMTFYW | 244.64 | HLA-A*0301 | LRDCSVAGWL | 479.67 | HLA-A*0201 |
| SFPNGAQIQYF | 89.51 | HLA-A*0201 | KRQEIQIGKLK | 244.7 | HLA-A*0301 | IASSIVLVGLI | 479.83 | HLA-B*5801 |
| CVKNGNHAVHY | 89.59 | HLA-A*2402 | CIESKLSQMSK | 244.74 | HLA-A*0101 | NQNPRIFLAMI | 480.36 | HLA-A*0201 |
| SIRIGSKGDVF | 89.6 | HLA-B*1501 | VQSEFNKACEL | 244.78 | HLA-B*1501 | LRSLVASSGTL | 480.68 | HLA-B*2705 |
| LPFQNIDSRAV | 89.8 | HLA-B*0801 | GLCKINSWHIF | 244.86 | HLA-B*1501 | IHDRSQYRALV | 480.81 | HLA-B*3901 |
| WFSFGASCFLF | 89.88 | HLA-A*2402 | ESNGALLAPRY | 244.97 | HLA-A*2601 | TMHDRSPFRAL | 480.89 | HLA-A*0201 |
| WTYQAELLVAM | 89.99 | HLA-B*1501 | GSYNNTSGEQM | 245.46 | HLA-A*0201 | LPFHNVHPLTI | 481.14 | HLA-B*3901 |
| TIWTSGSIISF | 90.09 | HLA-B*1501 | ETTHTGTYCSL | 245.49 | HLA-A*0201 | KEVILWFSFGA | 481.18 | HLA-B*4001 |
| LLVAIENQHTI | 90.2 | HLA-A*0201 | REGLILEYYFV | 245.63 | HLA-A*0201 | LWFSFGASCFI | 481.41 | HLA-B*4001 |
| WFRNILSIAPI | 90.3 | HLA-B*0801 | TIGDCPKYMNV | 245.78 | HLA-A*0301 | ATNLYVNKNPY | 481.49 | HLA-A*2402 |
| KVQEWSYIVEK | 90.36 | HLA-A*0301 | IGYMSNNSTEK | 245.96 | HLA-A*0101 | WSGYSGAFINY | 481.68 | HLA-A*0101 |
| FIMWTCQKGNI | 90.66 | HLA-A*0201 | KQTKTMTITFL | 246.02 | HLA-A*0201 | WSYNAEFLVAV | 482.96 | HLA-B*3901 |
| SEIEQQIGKNV | 90.86 | HLA-B*4001 | ESNGAFLAPRY | 246.04 | HLA-A*0101 | LMSCHIGVAPS | 483.02 | HLA-A*2601 |
| KMFDFTKWNVT | 90.9 | HLA-B*0801 | LRSIVASSGTL | 246.13 | HLA-A*0201 | FVNVTHVQNNY | 483.69 | HLA-B*1501 |
| WMKIIRVGCVI | 90.98 | HLA-A*0201 | MSLLTEVETYV | 246.3 | HLA-B*2705 | ICIAWSSSSCF | 483.8 | HLA-A*0201 |
| NTTGRDVLVLW | 91.01 | HLA-B*5801 | GRQTFDWTLNR | 246.31 | HLA-B*0702 | ILGNPKCDLYL | 483.93 | HLA-A*0201 |
| RSWMKLYWHLM | 91.07 | HLA-B*5801 | RPLILRDCSVA | 246.36 | HLA-B*5801 | MWACSNGNCRF | 484.49 | HLA-A*2402 |
| ISCSISECRTF | 91.19 | HLA-B*5801 | MTIASDILTRM | 246.4 | HLA-B*1501 | LISTPLGSPPI | 484.58 | HLA-A*0201 |
| RSKFLLMDSLK | 91.31 | HLA-A*0301 | SFRPNIGPRPL | 246.75 | HLA-B*0702 | WQGMVDGWYGF | 485.31 | HLA-B*1501 |
| VYYDRRLTTTI | 91.32 | HLA-A*2402 | GIRIGSKGDVF | 246.85 | HLA-B*3901 | WSWHDGAEITY | 485.42 | HLA-A*0201 |
| RLTTTIKTWAK | 91.33 | HLA-A*0301 | NHEDYKEESQL | 247.12 | HLA-B*5801 | ITDGPSDAQAF | 485.48 | HLA-A*0101 |
| RREVHIYYLEK | 91.61 | HLA-B*2705 | GAKAGFIENGW | 247.21 | HLA-A*0101 | RLNPMHQLLRH | 485.82 | HLA-A*0301 |
| RLGPSFYAEMK | 91.82 | HLA-A*0301 | WSGYSGSFMDY | 247.3 | HLA-A*0301 | YMNTALLNASC | 485.96 | HLA-A*0201 |
| YPGRFTNEEAL | 91.86 | HLA-B*0702 | VGYLSTNSTEK | 247.48 | HLA-B*1501 | ETNKFASICTH | 486.46 | HLA-A*2601 |
| KMNTRILILTL | 91.88 | HLA-B*1501 | KGVELSSMGVY |  |  | NINSVKLSSGY | 487.01 | HLA-B*1501 |

Fig. 81-27

| Peptide | Affinity | Allele | Peptide | Affinity | Allele | Peptide | Affinity (nM) | Allele |
|---|---|---|---|---|---|---|---|---|
| IHYGGVPTDVM | 97.76 | HLA-B*3901 | LIMRTVIALSY | 254.23 | HLA-A*0301 | RMFLAMITYIT | 494.89 | HLA-A*0201 |
| STVMVGLILAF | 97.8 | HLA-A*2601 | RTNGTSKVKMK | 254.32 | HLA-A*0301 | TEVEQQIGNVI | 495.81 | HLA-B*4001 |
| TPHRTLLMNEL | 97.84 | HLA-B*0702 | GYHANNSTDTI | 254.46 | HLA-A*2402 | SPLTKGMLGFV | 496.38 | HLA-B*0702 |
| GVWWTSNSIVV | 97.88 | HLA-A*0201 | GAFVAPDRVSF | 254.69 | HLA-B*1501 | YRRPIGISSMV | 496.69 | HLA-B*2705 |
| FSFGASCFLLL | 97.9 | HLA-B*1501 | SVPMGSSPNAY | 254.86 | HLA-A*2601 | KMNTKILVLAL | 496.8 | HLA-B*0801 |
| IVVFCGTSATY | 98.25 | HLA-B*1501 | FPFHKDNAIRL | 254.86 | HLA-B*3901 | MQNKLNNVIDK | 498.3 | HLA-A*0301 |
| GEETIEEKFEI | 98.88 | HLA-B*4001 | ITEWSGYSGSF | 254.97 | HLA-B*5801 | WSYNAELLVAI | 498.45 | HLA-B*1501 |
| LEPGTFDIGGL | 99.12 | HLA-B*4001 | RLSAGGDIWAT | 255.03 | HLA-A*0201 | QLGSWSWHDGA | 498.53 | HLA-A*0201 |
| RTKSLESRSGF | 99.12 | HLA-B*1501 | TEDNIYKILSI | 255.18 | HLA-B*4001 | SPFRTLMSCPI | 499.48 | HLA-B*3901 |
| SVKNGTYNYPK | 99.27 | HLA-A*0301 | LEGFSAESRKL | 255.33 | HLA-B*4001 | ASNINIREWSY | 499.55 | HLA-B*5801 |
| KMFDFSKWNVT | 99.3 | HLA-A*0201 | YRILSIYSTVA | 255.36 | HLA-B*3901 | YRSMRWLTLKL | 499.92 | HLA-B*0801 |
| QKWWWLWLVL | 99.41 | HLA-B*3901 | LRSRYWAIRTR | 255.42 | HLA-B*2705 | | | |
| ILAGGLILGM | 99.53 | HLA-B*1501 | RTKSLESRRGF | 255.61 | HLA-B*1501 | | | |
| SMVFCGVSGEV | 99.87 | HLA-A*0201 | IYSTVASSLVL | 255.68 | HLA-A*2402 | | | |
| KLTQGRQTFDW | 99.92 | HLA-B*5801 | KTLDMHDANVK | 255.74 | HLA-A*0301 | | | |
| TVDHMAIIKRY | 99.99 | HLA-A*0101 | GQFGRINFHWL | 256.18 | HLA-B*3901 | | | |
| MLSTVLGVSIL | 100.1 | HLA-A*0201 | HLGDCSFEGWI | 256.27 | HLA-A*0201 | | | |
| LLVSDGGPNLY | 100.2 | HLA-B*1501 | AYQKRMTRGLF | 256.55 | HLA-B*1501 | | | |
| GGMPTDVVRSW | 100.2 | HLA-B*5801 | EMLTGNLQTLK | 256.62 | HLA-A*2402 | | | |
| IQDLWAYNAEL | 100.2 | HLA-B*3901 | SQYRALVSWPL | 257.08 | HLA-B*4001 | | | |
| LMIWHSNLNDA | 100.3 | HLA-A*0201 | ITGKLNRFIEK | 257.23 | HLA-A*0301 | | | |
| GTSGTYGKGSW | 100.3 | HLA-B*5801 | NLIAPRGYFKI | 257.45 | HLA-A*0201 | | | |
| LTQGTCWEQMY | 100.4 | HLA-A*0101 | TAKHIEECSSY | 257.54 | HLA-A*0101 | | | |
| SISCFLLAALL | 100.4 | HLA-A*0201 | TIWTSSSSIVM | 257.7 | HLA-B*1501 | | | |
| GEVFVIREPFI | 100.5 | HLA-B*4001 | ILWISFAMSCF | 257.73 | HLA-B*1501 | | | |
| TLLMNELGVPF | 100.6 | HLA-B*1501 | ASYKRVRLFDY | 257.74 | HLA-A*0301 | | | |
| WSYNAELLVAL | 100.6 | HLA-B*3901 | LSFTVTGDNTK | 258.08 | HLA-A*0301 | | | |
| SPYNSRFESVA | 100.8 | HLA-B*0702 | MTEVWSYNAEF | 258.09 | HLA-A*0101 | | | |
| WISFSMSCFVF | 101.1 | HLA-B*1501 | PQCQVTGFAPF | 258.17 | HLA-B*1501 | | | |

SUMMARY
The number of weak binders is 2808
The number of strong binders is 615

Allele
HLA-A*0101
HLA-A*0201
HLA-A*0301
HLA-A*2402
HLA-A*2601
HLA-B*0702

Fig. 81-28

| Peptide | Affinity | Allele | Peptide | Affinity | Allele | Peptide | Affinity (nM) | Allele |
|---------|----------|--------|---------|----------|--------|---------|---------------|--------|
| | | HLA-B*0801 | | | | | | |
| | | HLA-B*1501 | | | | | | |
| | | HLA-B*2705 | | | | | | |
| | | HLA-B*3901 | | | | | | |
| | | HLA-B*4001 | | | | | | |
| | | HLA-B*5801 | | | | | | |

FIG. 82-1

| Block size | Protein | Subtype | Number of blocks with X peptides | 1 | 2 | 3 | 4 | 5 |
|---|---|---|---|---|---|---|---|---|
| 8 | HA | ALL | | 2 | 6 | 0 | 0 | 0 |
| 8 | HA | H1 | | 5 | 3 | 3 | 4 | 21 |
| 8 | HA | H10 | | 80 | 89 | 53 | 45 | 56 |
| 8 | HA | H10N7 | | 125 | 109 | 77 | 56 | 51 |
| 8 | HA | H11 | | 44 | 66 | 50 | 61 | 69 |
| 8 | HA | H12 | | 83 | 115 | 107 | 77 | 59 |
| 8 | HA | H13 | | 72 | 113 | 90 | 62 | 50 |
| 8 | HA | H14 | | 531 | 11 | 0 | 0 | 0 |
| 8 | HA | H15 | | 392 | 147 | 9 | 7 | 0 |
| 8 | HA | H16 | | 165 | 149 | 91 | 47 | 41 |
| 8 | HA | H1N1 | | 36 | 68 | 69 | 34 | 36 |
| 8 | HA | H1N2 | | 18 | 24 | 27 | 22 | 32 |
| 8 | HA | H2 | | 49 | 59 | 84 | 36 | 63 |
| 8 | HA | H2N2 | | 66 | 93 | 96 | 75 | 57 |
| 8 | HA | H3 | | 32 | 52 | 58 | 54 | 34 |
| 8 | HA | H3N2 | | 50 | 68 | 73 | 45 | 37 |
| 8 | HA | H4 | | 79 | 90 | 88 | 58 | 46 |
| 8 | HA | H5 | | 31 | 55 | 41 | 45 | 41 |
| 8 | HA | H5N1 | | 65

FIG. 82-2

| Block size | Protein | Subtype | Number of blocks with X peptides | 1 | 2 | 3 | 4 | 5 |
|---|---|---|---|---|---|---|---|---|
| 9 | HA | ALL | | 101 | 148 | 108 | 77 | 73 |
| 9 | HA | H1 | | 4 | 3 | 3 | 1 | 16 |
| 9 | HA | H10 | | 65 | 78 | 54 | 37 | 51 |
| 9 | HA | H10N7 | | 107 | 100 | 75 | 52 | 55 |
| 9 | HA | H11 | | 33 | 58 | 43 | 53 | 59 |
| 9 | HA | H12 | | 66 | 107 | 97 | 82 | 69

FIG. 82-3

| Block size | Protein | Subtype | Number of blocks with X peptides | 1 | 2 | 3 | 4 | 5 |
|---|---|---|---|---|---|---|---|---|
| 10 | HA | ALL | | 75 | 116 | 109 | 71 | 70 |
| 10 | HA | H1 | | 3 | 3 | 3 | 12 | 0 |
| 10 | HA | H10 | | 53 | 72 | 50 | 31 | 46 |
| 10 | HA | H10N7 | | 91 | 94 | 65 | 55 | 55 |
| 10 | HA | H11 | | 24 | 50 | 43 | 39 | 54 |
| 10 | HA | H12 | | 51 | 102 | 82 | 87 | 75 |
| 10 | HA | H13 | | 42 | 95 | 88 | 59 | 54 |
| 10 | HA | H14 | | 527 | 13 | 0 | 0 | 0 |
| 10 | HA | H15 | | 357 | 175 | 12 | 9 | 0 |
| 10 | HA | H16 | | 129 | 133 | 92 | 64 | 49 |
| 10 | HA | H1N1 | | 18 | 43 | 50 | 33 | 40 |
| 10 | HA | H1N2 | | 9 | 16 | 20 | 13 | 16 |
| 10 | HA | H2 | | 33 | 40 | 60 | 31 | 59 |
| 10 | HA | H2N2 | | 45 | 60 | 84 | 71 | 59 |
| 10 | HA | H3 | | 15 | 27 | 28 | 53 | 30 |
| 10 | HA | H3N2 | | 24 | 41 | 53 | 45 | 46 |
| 10 | HA | H4 | | 43 | 71 | 63 | 53 | 47 |
| 10 | HA | H5 | | 17 | 29 | 19 | 25 | 38 |
| 10 | HA | H5N1 | | 44 | 37 | 49 | 54 | 36 |
| 10 | HA | H5N2 | | 9 | 14 | 34 | 24 | 32 |
| 10 | HA | H6 | | 21 | 31 | 35 | 30 | 19 |
| 10 | HA | H7 | | 13 | 23 | 36 | 21 | 30 |
| 10 | HA | H7N2 | | 48 | 55 | 66 | 71 | 54 |
| 10 | HA | H7N3 | | 40 | 31 | 43 | 49 | 69 |
| 10 | HA | H7N7 | | 16 | 27 | 46 | 64 | 61 |
| 10 | HA | H8 | | 78 | 98 | 124 | 90 | 82 |
| 10 | HA | H9 | | 4 | 12 | 15 | 12 | 21 |
| 10 | HA | H9N2 | | 7 | 10 | 15 | 16 | 18 |
| 10 | M1 | N/A | | 26 | 64 | 42 | 21 | 23 |
| 10 | M2 | N/A | | 1 | 0 | 0 | 0 | 0 |
| 10 | NA | ALL | | 0 | 0 | 0 | 0 | 0 |
| 10 | NA | H10N7 | | 41 | 87 | 79 | 62 | 46 |
| 10 | NA | H1N1 | | 15 | 40 | 39 | 36 | 35 |
| 10 | NA | H1N2 | | 13 | 17 | 23 | 29 | 26 |
| 10 | NA | H2N2 | | 31 | 55 | 56 | 63 | 63 |
| 10 | NA | H3N2 | | 31 | 46 | 32 | 26 | 13 |
| 10 | NA | H5N1 | | 13 | 23 | 37 | 28 | 48 |
| 10 | NA | H5N2 | | 19 | 35 | 36 | 26 | 18 |
| 10 | NA | H7N2 | | 59 | 58 | 62 | 33 | 57 |
| 10 | NA | H7N3 | | 14 | 52 | 58 | 43 | 68 |
| 10 | NA | H7N7 | | 26 | 33 | 51 | 77 | 59 |
| 10 | NA | H9N2 | | 1 | 8 | 12 | 9 | 15 |
| 10 | NA | N1 | | 8 | 29 | 20 | 20 | 34 |
| 10 | NA | N2 | | 6 | 11 | 22 | 21 | 21 |
| 10 | NA | N3 | | 9 | 23 | 34 | 24 | 29 |
| 10 | NA | N4 | | 118 | 104 | 83 | 36 | 18 |
| 10 | NA | N5 | | 49 | 55 | 60 | 42 | 46 |
| 10 | NA | N6 | | 26 | 32 | 34 | 60 | 42 |
| 10 | NA | N7 | | 24 | 29 | 32 | 46 | 63 |
| 10 | NA | N8 | | 23 | 38 | 35 | 42 | 23 |
| 10 | NA | N9 | | 65 | 66 | 47 | 61 | 44 |
| 10 | NP | N/A | | 34 | 71 | 79 | 44 | 36 |
| 10 | NS1 | N/A | | 1 | 3 | 6 | 0 | 0 |
| 10 | NS2 | N/A | | 2 | 5 | 8 | 1 | 0 |
| 10 | PA | N/A | | 45 | 83 | 64 | 86 | 63 |
| 10 | PB1 | N/A | | 173 | 107 | 86 | 44 | 48 |
| SUM | | | | 2709 | 2692 | 2521 | 2162 | 2098 |

FIG. 82-4

| Block size | Protein | Subtype | Number of blocks with X peptides | 1 | 2 | 3 | 4 | 5 |
|---|---|---|---|---|---|---|---|---|
| 11 | HA | ALL | | 56 | 94 | 89 | 81 | 69 |
| 11 | HA | H1 | | 2 | 3 | 3 | 10 | 0 |
| 11 | HA | H10 | | 42 | 66 | 44 | 30 | 42 |
| 11 | HA | H10N7 | | 77 | 86 | 60 | 56 | 53 |
| 11 | HA | H11 | | 17 | 40 | 46 | 30 | 45 |
| 11 | HA | H12 | | 42 | 91 | 73 | 86 | 82 |
| 11 | HA | H13 | | 32 | 82 | 87 | 62 | 56 |
| 11 | HA | H14 | | 525 | 14 | 0 | 0 | 0 |
| 11 | HA | H15 | | 341 | 187 | 14 | 10 | 0 |
| 11 | HA | H16 | | 115 | 122 | 93 | 71 | 51 |
| 11 | HA | H1N1 | | 14 | 34 | 40 | 29 | 39 |
| 11 | HA | H1N2 | | 7 | 11 | 15 | 10 | 19 |
| 11 | HA | H2 | | 27 | 32 | 54 | 29 | 48 |
| 11 | HA | H2N2 | | 36 | 55 | 72 | 61 | 68 |
| 11 | HA | H3 | | 9 | 18 | 21 | 39 | 35 |
| 11 | HA | H3N2 | | 13 | 33 | 37 | 45 | 49 |
| 11 | HA | H4 | | 35 | 64 | 46 | 48 | 39 |
| 11 | HA | H5 | | 13 | 24 | 16 | 13 | 21 |
| 11 | HA | H5N1 | | 36 | 31 | 32 | 44 | 36 |
| 11 | HA | H5N2 | | 7 | 9 | 24 | 16 | 31 |
| 11 | HA | H6 | | 16 | 27 | 27 | 31 | 14 |
| 11 | HA | H7 | | 9 | 16 | 28 | 17 | 29 |
| 11 | HA | H7N2 | | 39 | 45 | 59 | 66 | 50 |
| 11 | HA | H7N3 | | 33 | 23 | 38 | 42 | 57 |
| 11 | HA | H7N7 | | 12 | 16 | 39 | 58 | 54 |
| 11 | HA | H8 | | 63 | 91 | 115 | 92 | 87 |
| 11 | HA | H9 | | 2 | 7 | 14 | 10 | 11 |
| 11 | HA | H9N2 | | 4 | 6 | 15 | 10 | 12 |
| 11 | M1 | N/A | | 19 | 55 | 47 | 19 | 22 |
| 11 | M2 | N/A | | 0 | 0 | 0 | 0 | 0 |
| 11 | NA | ALL | | 0 | 0 | 0 | 0 | 0 |
| 11 | NA | H10N7 | | 30 | 77 | 75 | 62 | 51 |
| 11 | NA | H1N1 | | 12 | 28 | 29 | 33 | 25 |
| 11 | NA | H1N2 | | 7 | 11 | 21 | 23 | 25 |
| 11 | NA | H2N2 | | 19 | 51 | 54 | 54 | 59 |
| 11 | NA | H3N2 | | 18 | 41 | 31 | 27 | 13 |
| 11 | NA | H5N1 | | 8 | 12 | 26 | 31 | 36 |
| 11 | NA | H5N2 | | 13 | 26 | 26 | 29 | 18 |
| 11 | NA | H7N2 | | 49 | 47 | 58 | 34 | 56 |
| 11 | NA | H7N3 | | 6 | 48 | 42 | 41 | 68 |
| 11 | NA | H7N7 | | 21 | 25 | 41 | 72 | 57 |
| 11 | NA | H9N2 | | 3 | 6 | 11 | 9 | 0 |
| 11 | NA | N1 | | 5 | 23 | 13 | 12 | 25 |
| 11 | NA | N2 | | 3 | 6 | 15 | 18 | 16 |
| 11 | NA | N3 | | 4 | 14 | 32 | 21 | 25 |
| 11 | NA | N4 | | 103 | 92 | 91 | 46 | 15 |
| 11 | NA | N5 | | 35 | 49 | 61 | 40 | 49 |
| 11 | NA | N6 | | 15 | 26 | 28 | 54 | 41 |
| 11 | NA | N7 | | 18 | 23 | 23 | 39 | 49 |
| 11 | NA | N8 | | 12 | 31 | 32 | 40 | 21 |
| 11 | NA | N9 | | 51 | 59 | 46 | 59 | 46 |
| 11 | NP | N/A | | 27 | 58 | 72 | 40 | 35 |
| 11 | NS1 | N/A | | 1 | 3 | 0 | 0 | 0 |
| 11 | NS2 | N/A | | 4 | 8 | 1 | 0 | 0 |
| 11 | PA | N/A | | 32 | 67 | 54 | 60 | 74 |
| 11 | PB1 | N/A | | 151 | 99 | 84 | 40 | 46 |
| 11 | PB2 | N/A | | 38 | 74 | 73 | 73 | 64 |

FIG. 82-5

| Block size | Protein | Subtype | Number of blocks with X peptides | 1 | 2 | 3 | 4 | 5 |
|---|---|---|---|---|---|---|---|---|
| SUM | | | | 2328 | 2386 | 2287 | 2072 | 2033 |
| SUM ALL | | | | 12066 | 11792 | 10578 | 8925 | 8340 |

Fig. 83-1

| Block size 8 | SIN | Block size 9 | SIN | Block size 10 | SIN | Block size 11 | SIN |
|---|---|---|---|---|---|---|---|
| AADKASTQK | | AADKASTQK | | AADKASTQKA | | AADFKSTQAAI | |
| AADKDSTQK | | AADKDSTQK | | AADKDSTQKA | | AADKASTQKAI | |
| AADKESTQE | | AADKESTQE | | AADKESTQEA | | AADKESTQKAF | |
| AADKESTQK | | AADKESTQK | | AADKESTQKA | | AADKESTQKAI | |
| AADKESTQR | | AADKESTQR | | AADKESTQKT | | AADKESTQKAV | |
| AADKESTQT | | AADKESTQT | | AADKESTQRA | | AADKESTQRAF | |
| AADKKSTQK | | AADKKSTQK | | AADKESTQTA | | AADKTSTQKAI | |
| AADKTSTQK | | AADKTSTQK | | AADKKSTQKA | | AADKVSTQKAI | |
| AADKVSTQK | | AADKVSTQK | | AADKTSTQKA | | AADKVSTQKAL | |
| AADLKSTQA | | AADLKSTQA | | AADKVSTQKA | | AADLKSTQAAI | |
| AADLKSTQT | | AADLKSTQT | | AADLKSTQKA | | AADLKSTQAAV | |
| AADQESTQK | | AADQESTQK | | AADLKSTQTA | | AADLKSTQTAI | |
| AADQKSTQE | | AADQKSTQE | | AADQESTQKA | | AADQKSTQEAI | |
| AADRDSTQK | | AADRDSTQK | | AADQKSTQEA | | AADRDSTQKAI | |
| AADRDSTQM | | AADRDSTQM | | AADRDSTQKA | | AADRDSTQMAI | |
| AADRDSTQR | | AADRDSTQR | | AADRDSTQMA | | AADRDSTQRAI | |
| AADRESTQK | | AADRESTQK | | AADRDSTQRA | | AADRGSTQKAI | |
| AADRESTQR | | AADRESTQR | | AADRESTQKA | | AADYESTQAAI | |
| AADRGSTQK | | AADRGSTQK | | AADRESTQRA | | AADYKSTPSAI | |
| AADRKSTQK | | AADRKSTQK | | AADRGSTQKA | | AADYKSTQAAI | |
| AADYESTQA | | AADYESTQA | | AADRKSTQKA | | AADYKSTQAAV | |
| AADYKSTPS | | AADYKSTPS | | AADYESTQAA | | AADYKSTQATI | |
| AADYKSTQA | | AADYKSTQA | | AADYKSTPSA | | AADYKSTQKTI | |
| AADYKSTQK | | AADYKSTQK | | AADYKSTQAA | | AADYKSTQSAI | |
| AADYKSTQS | | AADYKSTQS | | AADYKSTQKT | | AADYKSTQSAV | |
| AADYKSTQT | | AADYKSTQT | | AADYKSTQSA | | AADYKSTQTAI | |
| AAEKESTQK | | AAEKESTQK | | AADYKSTQTA | | AAEKESTQKAI | |
| AAFEDLRIS | | AAFEDLRIS | | AAEKESTQKA | | AAGAAIKGVGT | |
| AAFEDLRLL | | AAFEDLRLL | | AAGAAIKGVG | | AAGAAVKGIGT | |
| AAFEDLRVL | | AAFEDLRVL | | AAGAAVKGIG | | AAGAAVKGVGT | |
| AAFEDLRVS | | AAFEDLRVS | | AAGAAVKGVG | | AAGFHFEECSC | |
| AAFRGLIST | | AAFRGLIST | | AAGFHFEECS | | AAGGAIWVTRE | |
| AAGAAIKGV | | AAGAAIKGV | | AAGGDIWVTR | | AAGGDIWVTRE | |
| AAGAAVKGI | | AAGAAVKGI | | AAICTHLEIC | | AAICTHLEICF | |
| AAGAAVKGV | | AAGAAVKGV | | AAICTHLEVC | | AAICTHLEVCF | |
| AAGFHFEEC | | AAGFHFEEC | | AAICTHMEVC | | AAICTHMEVCF | |
| AAGGDIWVT | | AAGGDIWVT | | AAIDQINGKL | | AAIDKINGKLN | |
| AAICTHLEI | | AAICTHLEI | | AAIDQISGKL | | AAIDQINGKLN | |
| AAICTHLEV | | AAICTHLEV | | AAIDQITGKL | | AAIDQITGKLN | |
| AAICTHMEV | | AAICTHMEV | | AAIDQVNGKL | | AAIGLRISSSF | |
| AAIDQINGK | | AAIDQINGK | | AAIGLRISSS | | AAINQINGKLN | |
| AAIDQISGK | | AAIDQISGK | | AALGLRISSS | | AALGLRISSSF | |
| AAIDQITGK | | AAIDQITGK | | AALGSPGCDH | | AALGSPGCDHL | |
| AAIDQMTGK | | AAIDQMTGK | | AAMDDFQLIP | | AAMDDFQLIPM | |
| AAIGLRISS | | AAIGLRISS | | AAMDEFQLIP | | AAMDDYQLIPM | |
| AAIKGIGTM | | AAIKGIGTM | | AAMEDFQLIP | | AAMDEFQLIPM | |
| AAIKGVGTM | | AAIKGVGTM | | AAMGLKISSS | | AAMEDFQLIPM | |
| AAINQINGK | | AAINQINGK | | AAMGLRISSS | | AAMGLKISSSF | |
| AALGLRISS | | AALGLRISS | | AAMGMRISSS | | AAMGLRISSSF | |
| AALGSPGCD | | AALGSPGCD | | AANNADHRIY | | AAMGMRISSSF | |
| AAMDDFQLI | | AAMDDFQLI | | AANPIVPSFD | | AANNADHRIYW | |
| AAMDEFQLI | | AAMDEFQLI | | AANSADHRIY | | AANNADHRVYW | |
| AAMEDFQLI | | AAMEDFQLI | | AANSADHRVY | | AANSADHRIYW | |
| AAMGLKISS | | AAMGLKISS | | AANSAHHRVY | | AANSADHRVYW | |
| AAMGLRISS | | AAMGLRISS | | AAPHGLCYPG | | AAPHGLCYPGE | |
| AAMGMRISS | | AAMGMRISS | | AAQKAMMDQV | | AAQKAMMDQVR | |
| AANNADHRI | | AANNADHRI | | AAQRAMMDQV | | AAQRAMMDQVR | |
| AANNADHRV | | AANNADHRV | | AAQRAMVDQV | | AAQRAMVDQVR | |
| AANPIVPSF | | AANPIVPSF | | AARNIVRRAA | | AARNIVRRAAV | |
| AANSADHRI | | AANSADHRI | | AARNIVRRAI | | AARNIVRRAIV | |
| AANSADHRV | | AANSADHRV | | AARNIVRRAT | | AARNIVRRATV | |
| AANSAHHRV | | AANSAHHRV | | AARSIVRRAT | | AARSIVRRATV | |

Fig. 83-2

| Block size 8 | SIN | Block size 9 | SIN | Block size 10 | SIN | Block size 11 | SIN |
|---|---|---|---|---|---|---|---|
| AAPHGLCYP | | AAPHGLCYP | | AASLCLAILI | | AASLCLAILIA | |
| AAPPEQSRM | | AAPPEQSRM | | AASLCLAILV | | AASLCLAILVA | |
| AAPPKQSRM | | AAPPKQSRM | | AASLCLAVLI | | AASLCLAVLIA | |
| AAPPVQSKM | | AAPPVQSKM | | AASLSPGMMM | | AASLSPGMMMG | |
| AAPPVQSRM | | AAPPVQSRM | | AASYKRIRLF | | AASYKRIRLFD | |
| AAQELVESQ | | AAQELVESQ | | AASYKRVRLF | | AASYKRVRLFD | |
| AAQKAMMDQ | | AAQKAMMDQ | | AATALANTIE | | AATALANTIEI | |
| AAQRAMMDQ | | AAQRAMMDQ | | AATLCLGHHA | | AATALANTIEV | |
| AAQRAMVDQ | | AAQRAMVDQ | | AATQTLVSNN | | AATLCLGHHAV | |
| AARNIVRRA | | AARNIVRRA | | AATVTLHFKQ | | AATQTLVSNND | |
| AARSIVRRA | | AARSIVRRA | | AAVDQITGKL | | AATVTLHFKQH | |
| AASLCLAIL | | AASLCLAIL | | AAVSADPLAS | | AAVCTHLEVCF | |
| AASLCLAVL | | AASLCLAVL | | AAWSSSSCFD | | AAVDQITGKLN | |
| AASLSPGMM | | AASLSPGMM | | AAWSSSSCHD | | AAVSADPLASL | |
| AASSLALAI | | AASSLALAI | | ACFQPCFYVE | | AAWSSSSCFDG | |
| AASYKRIRL | | AASYKRIRL | | ACFYVELIRG | | AAWSSSSCHDG | |
| AASYKRVRL | | AASYKRVRL | | ACGNGSCRCT | | ACFQPCFYVEL | |
| AATALANTI | | AATALANTI | | ACGPAECRTF | | ACFYVELIRGR | |
| AATLCLGHH | | AATLCLGHH | | ACGPSECRTF | | ACGNGSCRCTI | |
| AATQTLVSN | | AATQTLVSN | | ACGPTECRTF | | ACGPAECRTFF | |
| AATVTLHFK | | AATVTLHFK | | ACHDGKKWMA | | ACGPSECRTFF | |
| AAVDQITGK | | AAVDQITGK | | ACHDGKKWMT | | ACGPTECRTFF | |
| AAVKGIGTM | | AAVKGIGTM | | ACHDGKKWTT | | ACHSAAFEDLR | |
| AAVKGVGTI | | AAVKGVGTI | | ACHDGNKWMT | | ACITPNGSIPN | |
| AAVKGVGTM | | AAVKGVGTM | | ACHDGRKWMT | | ACKRTVSSFYS | |
| AAVSADPLA | | AAVSADPLA | | ACHSAAFEDL | | ACLRGGRNSFF | |
| AAWSSSSCF | | AAWSSSSCF | | ACITPNGSIP | | ACNALTGGQSF | |
| AAWSSSSCH | | AAWSSSSCH | | ACKRTVSSFY | | ACNASTGAQSF | |
| ACELTDSIW | | ACELTDSIW | | ACLRGGRNSF | | ACNASTGGQAF | |
| ACELTDSSW | | ACELTDSSW | | ACNALTGGQS | | ACNASTGGQSF | |
| ACELTDSTW | | ACELTDSTW | | ACNASTGAQS | | ACNNGSCRCTI | |
| ACELTDSVW | | ACELTDSVW | | ACNASTGGQA | | ACNSAAFEDLR | |
| ACELTGSSW | | ACELTGSSW | | ACNASTGGQS | | ACQKGNIKCNI | |
| ACFQPCFYV | | ACFQPCFYV | | ACNNGSCRCT | | ACQKGNIRCDI | |
| ACFYVELIR | | ACFYVELIR | | ACNSAAFEDL | | ACQKGNIRCNI | |
| ACGNGSCRC | | ACGNGSCRC | | ACQKGNIKCN | | ACQKGNIRCSI | |
| ACGPAECRT | | ACGPAECRT | | ACQKGNIRCD | | ACQNGNIRCQI | |
| ACGPSECRT | | ACGPSECRT | | ACQKGNIRCN | | ACQNGNLRCQI | |
| ACGPTECRT | | ACGPTECRT | | ACQNGNIRCQ | | ACQNGNVRCQI | |
| ACHDGASWL | | ACHDGASWL | | ACQNGNLRCQ | | ACQRGNIRCNI | |
| ACHDGISWL | | ACHDGISWL | | ACQNGNVRCQ | | ACSASTGGQSF | |
| ACHDGKEWL | | ACHDGKEWL | | ACQRGNIRCN | | ACSDGPGWLTI | |
| ACHDGKEWM | | ACHDGKEWM | | ACQTGNIRCQ | | ACSDGPGWLTL | |
| ACHDGKGWL | | ACHDGKGWL | | ACSASTGGQS | | ACSDGSGWLTL | |
| ACHDGKKWL | | ACHDGKKWL | | ACSDGPGWLT | | ACSNGCRFNV | |
| ACHDGKKWM | | ACHDGKKWM | | ACSDGSGWLT | | ACSNGSCRCTI | |
| ACHDGKKWT | | ACHDGKKWT | | ACSNGCRFN | | ACSNGSCRFNV | |
| ACHDGRKWM | | ACHDGRKWM | | ACSNGSCRCT | | ACSPSECRTFF | |
| ACHDGSSWL | | ACHDGSSWL | | ACSNGSCRFN | | ACSSGNCRFNV | |
| ACHDGTNWL | | ACHDGTNWL | | ACSPSECRTF | | ACSSGNCRFSV | |
| ACHDGTSWL | | ACHDGTSWL | | ACSSGNCRFN | | ACWEQLYTPGG | |
| ACHSAAFED | | ACHSAAFED | | ACSSGNCRFS | | ACYNPCFYVEL | |
| ACITPNGSI | | ACITPNGSI | | ACWEQLYTPG | | ADAQHRSHRQM | |
| ACKRTVSSF | | ACKRTVSSF | | ACYNPCFYVE | | ADDDAYAVIHY | |
| ACLRGGRNS | | ACLRGGRNS | | ADAQHRSHRQ | | ADDEAYAVIHY | |
| ACNALTGGQ | | ACNALTGGQ | | ADDDAYAVIH | | ADEICIGHLSN | |
| ACNASTGAQ | | ACNASTGAQ | | ADDEAYAVIH | | ADEICIGYLSN | |
| ACNASTGGQ | | ACNASTGGQ | | ADEICIGHLS | | ADEICIGYMSN | |
| ACNNGSCRC | | ACNNGSCRC | | ADEICIGYLS | | ADFKSTQAAIN | |
| ACNSAAFED | | ACNSAAFED | | ADEICIGYMS | | ADGDIWVTREP | |
| ACNSGNCRF | | ACNSGNCRF | | ADFKSTQAAI | | ADGGPNLYNIR | |
| ACQKGNIKC | | ACQKGNIKC | | ADGDIWVTRE | | ADHPPKVAWSS | |

Fig. 83-3

| Block size 8 | SIN | Block size 9 | SIN | Block size 10 | SIN | Block size 11 | SIN |
|---|---|---|---|---|---|---|---|
| ACQKGNIRC | | ACQKGNIRC | | ADGGPNLYNI | | ADHRIYWIREG | |
| ACQNGNLRC | | ACQNGNIRC | | ADHPPKVAWS | | ADHRIYWIRKG | |
| ACQNGNVRC | | ACQNGNLRC | | ADHRIYWIRE | | ADHRVYWIREG | |
| ACQRGNIRC | | ACQNGNVRC | | ADHRIYWIRK | | ADIKSHAYISF | |
| ACQTGNIRC | | ACQRGNIRC | | ADHRVYWIRE | | ADINLHAYISF | |
| ACSASTGGQ | | ACQTGNIRC | | ADIKSHAYIS | | ADKASTQKAID | |
| ACSDGPGWL | | ACSASTGGQ | | ADINLHAYIS | | ADKASTQKAIN | |
| ACSDGSGWL | | ACSDGPGWL | | ADINLMPIYS | | ADKDSNGVQDI | |
| ACSNGNCRF | | ACSDGSGWL | | ADKASTQKAI | | ADKESTQKAID | |
| ACSNGSCRC | | ACSNGNCRF | | ADKESTQKAF | | ADKICIGYLSN | |
| ACSNGSCRF | | ACSNGSCRC | | ADKESTQKAI | | ADKICLGHHAA | |
| ACSPSECRT | | ACSNGSCRF | | ADKESTQKAV | | ADKICLGHHAV | |
| ACSSGNCRF | | ACSPSECRT | | ADKESTQRAF | | ADKICLGRHAV | |
| ACWEQLYTP | | ACSSGNCRF | | ADKICIGYLS | | ADKICVGYLST | |
| ACYNPCFYV | | ACWEQLYTP | | ADKICLGHHA | | ADKISLGHHAV | |
| ADAQHRSHR | | ACYNPCFYV | | ADKICLGRHA | | ADKTSTQKAIN | |
| ADDDAYAVI | | ADAQHRSHR | | ADKICVGYLS | | ADKVSTQKAIN | |
| ADDEAYAVI | | ADDDAYAVI | | ADKTSTQKAI | | ADKVSTQKALN | |
| ADEICIGHL | | ADDEAYAVI | | ADKVSTQKAI | | ADLEALMEWLK | |
| ADEICIGYL | | ADEICIGHL | | ADKVSTQKAL | | ADLIIERRNSS | |
| ADEICIGYM | | ADEICIGYL | | ADLEALMEWL | | ADLKSTQAAID | |
| ADGDIWVTR | | ADEICIGYM | | ADLIIERREG | | ADLKSTQAAIN | |
| ADGGPNLYN | | ADGDIWVTR | | ADLIIERRNS | | ADLKSTQAAIT | |
| ADGVKGFSY | | ADGGPNLYN | | ADLKSTQAAI | | ADLKSTQAAVN | |
| ADHPPKVAW | | ADGVKGFSY | | ADLKSTQAAV | | ADLKSTQTAID | |
| ADHRIYWIK | | ADHPPKVAW | | ADLKSTQTAI | | ADLLVAMENQH | |
| ADHRIYWIR | | ADHRIYWIK | | ADLLVAMENQ | | ADMSIGITVIK | |
| ADHRIYWVR | | ADHRIYWIR | | ADLPFTQEQK | | ADMSIGVAVIK | |
| ADHRVYWIR | | ADHRIYWVR | | ADMSIGITVI | | ADMSIGVTVIK | |
| ADIKSHAYI | | ADHRVYWIR | | ADMSIGVAVI | | ADMSIGVTVIR | |
| ADINLHAYI | | ADIKSHAYI | | ADMSIGVTVI | | ADNDAYAVIHY | |
| ADINLMPIY | | ADINLHAYI | | ADNDAYAVIH | | ADNKADHRIYW | |
| ADKASTQKA | | ADINLMPIY | | ADNKADHRIY | | ADPLASLLEMC | |
| ADKDSNGVQ | | ADKASTQKA | | ADPLASLLEM | | ADPLLSLLEMC | |
| ADKDSTQKA | | ADKDSNGVQ | | ADPLLSLLEM | | ADPLVSLLEMC | |
| ADKESTQEA | | ADKDSTQKA | | ADPLVSLLEM | | ADQELGDAPFL | |
| ADKESTQKA | | ADKESTQEA | | ADQELGDAPF | | ADQKSTQEAID | |
| ADKESTQKT | | ADKESTQKA | | ADQKSTQEAI | | ADQKSTQEAIE | |
| ADKESTQRA | | ADKESTQKT | | ADQSLPPNFP | | ADQKSTQEAIG | |
| ADKESTQTA | | ADKESTQRA | | ADQSLPPNFS | | ADQKSTQEAIN | |
| ADKICIGYL | | ADKESTQTA | | ADRDSTQKAI | | ADRDSTQKAID | |
| ADKICLGHH | | ADKICIGYL | | ADRDSTQMAI | | ADRDSTQMAID | |
| ADKICLGRH | | ADKICLGHH | | ADRDSTQRAI | | ADRDSTQRAID | |
| ADKICVGYL | | ADKICLGRH | | ADRGSTQKAI | | ADRGSTQKAID | |
| ADKKSTQKA | | ADKICVGYL | | ADRICIGYLS | | ADRICIGYLST | |
| ADKTSTQKA | | ADKKSTQKA | | ADRICVGYLS | | ADRICVGYLST | |
| ADKVSTQKA | | ADKTSTQKA | | ADRIDDAVTD | | ADRIDDAVTDI | |
| ADLEALMEW | | ADKVSTQKA | | ADRVDDAVTD | | ADRIDDAVTDV | |
| ADLIIERRE | | ADLEALMEW | | ADSEMDKLYE | | ADRVDDAVTDI | |
| ADLIIERRN | | ADLIIERRE | | ADSEMDKLYT | | ADRVDDAVTDV | |
| ADLKSTQAA | | ADLIIERRN | | ADSEMLNLYD | | ADSEMDKLYER | |
| ADLKSTQTA | | ADLKSTQAA | | ADSEMLNLYE | | ADSEMDKLYTR | |
| ADLLVAMEN | | ADLKSTQTA | | ADSEMNKLFE | | ADSEMLNLYDR | |
| ADMSIGITV | | ADLLVAMEN | | ADSEMNKLYE | | ADSEMLNLYEG | |
| ADMSIGVAV | | ADMSIGITV | | ADSEMNNLYE | | ADSEMLNLYER | |
| ADMSIGVTV | | ADMSIGVAV | | ADSHHRSHRQ | | ADSEMNKLFER | |
| ADNDAYAVI | | ADMSIGVTV | | ADSQHKSHRQ | | ADSEMNKLYER | |
| ADPLASLLE | | ADNDAYAVI | | ADSQHRSHRQ | | ADSEMSKLYER | |
| ADPLLSLLE | | ADPLASLLE | | ADTICIGYHA | | ADSHHRSHRQM | |
| ADPLVSLLE | | ADPLLSLLE | | ADTICVGYHA | | ADSQHKSHRQM | |
| ADQELGDAP | | ADPLVSLLE | | ADTILERNVT | | ADSQHRSHRQM | |
| | | ADQELGDAP | | ADTKILFIEE | | ADTICIGYHAN | |

Fig. 83-4

| Block size 8 | SIN | Block size 9 | SIN | Block size 10 | SIN | Block size 11 | SIN |
|---|---|---|---|---|---|---|---|
| ADQESTQKA | | ADQESTQKA | | ADTLCIGYHA | | ADTICVGYHAN | |
| ADQKSTQEA | | ADQKSTQEA | | ADTRILFIEE | | ADTILERNVTV | |
| ADQSLPPNF | | ADQSLPPNF | | ADTRILFIKE | | ADTKILFIEEG | |
| ADRDSTQKA | | ADRDSTQKA | | ADTRILFIRE | | ADTLCIGYHAN | |
| ADRDSTQMA | | ADRDSTQMA | | ADTRILFVKE | | ADTRILFIEEG | |
| ADRDSTQRA | | ADRDSTQRA | | ADVLVALENQ | | ADTRILFIKEG | |
| ADRESTQKA | | ADRESTQKA | | ADWSWHDGAI | | ADTRILFIREG | |
| ADRESTQRA | | ADRESTQRA | | ADWSWHDGAV | | ADTRILFVKEG | |
| ADRGSTQKA | | ADRGSTQKA | | ADWVDDAVTD | | ADWVDDAVTDI | |
| ADRICIGYL | | ADRICIGYL | | ADYESTQAAI | | ADYESTQAAID | |
| ADRICVGYL | | ADRICVGYL | | ADYKSTPSAI | | ADYKSTPSAID | |
| ADRIDDAVT | | ADRIDDAVT | | ADYKSTQAAI | | ADYKSTQAAID | |
| ADRKSTQKA | | ADRKSTQKA | | ADYKSTQAAV | | ADYKSTQAAVD | |
| ADRVDDAVT | | ADRVDDAVT | | ADYKSTQKTI | | ADYKSTQKTID | |
| ADSEMDKLY | | ADSEMDKLY | | ADYKSTQSAI | | ADYKSTQSAID | |
| ADSEMKKLY | | ADSEMKKLY | | ADYKSTQSAV | | ADYKSTQSAIN | |
| ADSEMLNLY | | ADSEMLNLY | | ADYKSTQTAI | | ADYKSTQSAVD | |
| ADSEMNKLF | | ADSEMNKLF | | AECRTFFLTQ | | ADYKSTQSAVN | |
| ADSEMNKLH | | ADSEMNKLH | | AEDKGNGCFE | | AECRTFFLTQG | |
| ADSEMNKLY | | ADSEMNKLY | | AEDMGNGCFK | | AEDKGNGCFEI | |
| ADSEMSKLY | | ADSEMSKLY | | AEDMGNGCFR | | AEDMGNGCFKI | |
| ADSHHRSHR | | ADSHHRSHR | | AEDMGNGCFT | | AEDMGNGCFRI | |
| ADSQHKSHR | | ADSQHKSHR | | AEDMGNGCLK | | AEDMGNGCFTI | |
| ADSQHRSHR | | ADSQHRSHR | | AEDQGNGCFE | | AEDMGNGCLKI | |
| ADTICIGYH | | ADTICIGYH | | AEDRGNGCFE | | AEDQGNGCFEI | |
| ADTICVGYH | | ADTICVGYH | | AEEDCTGCFE | | AEDRGNGCFEI | |
| ADTKILFIE | | ADTKILFIE | | AEEDGKGCFE | | AEEDCTGCFEI | |
| ADTLCIGYH | | ADTLCIGYH | | AEEDGNGCFE | | AEEDGKGCFEI | |
| ADTRILFIE | | ADTRILFIE | | AEEDGRGCFE | | AEEDGNGCFEI | |
| ADTRILFIK | | ADTRILFIK | | AEEDGTGCFE | | AEEDGRGCFEI | |
| ADTRILFIR | | ADTRILFIR | | AEEMGNGCFK | | AEEDGTGCFEI | |
| ADTRILFVK | | ADTRILFVK | | AEESKLKRQE | | AEEDGTGCFEL | |
| ADVLVALEN | | ADVLVALEN | | AEFLVALENQ | | AEEMGNGCFKI | |
| ADWSWHDGA | | ADWSWHDGA | | AEFLVAMENQ | | AEESKLKRQEI | |
| ADWSWQDGA | | ADWSWQDGA | | AEFLVAVENQ | | AEFLVAVENQH | |
| ADWVDDAVT | | ADWVDDAVT | | AEGDCYRACF | | AEGDCYRACFY | |
| ADYESTQAA | | ADYESTQAA | | AEGECYRACF | | AEGECYRACFY | |
| ADYKSTPSA | | ADYKSTPSA | | AEGIGIAADR | | AEGTGMAADQK | |
| ADYKSTQAA | | ADYKSTQAA | | AEGTGIAADR | | AEGTGTAADLK | |
| ADYKSTQKT | | ADYKSTQKT | | AEGTGMAADQ | | AEIAQKLEDVF | |
| ADYKSTQSA | | ADYKSTQSA | | AEGTGMAADR | | AEIAQRLEDVF | |
| ADYKSTQTA | | ADYKSTQTA | | AEGTGTAADL | | AEIAQRLEGVF | |
| ADYRVYWIR | | ADYRVYWIR | | AEIAQKLEDV | | AEIAQRLENVF | |
| AECRTFFLT | | AECRTFFLT | | AEIAQRLEDV | | AEIAQRLESVF | |
| AEDIGNGCF | | AEDIGNGCF | | AEIAQRLEGV | | AEIEDLIFLAR | |
| AEDKGNGCF | | AEDKGNGCF | | AEIAQRLENV | | AEIEDLIFLTR | |
| AEDMGDGCF | | AEDMGDGCF | | AEIAQRLESV | | AEIEDLIFMAR | |
| AEDMGGGCF | | AEDMGGGCF | | AEIEDLIFLA | | AEIEDLIFSAR | |
| AEDMGNGCF | | AEDMGNGCF | | AEIEDLIFLT | | AEIEDLTFLAR | |
| AEDMGNGCL | | AEDMGNGCL | | AEIEDLIFMA | | AEILVLMENER | |
| AEDQGNGCF | | AEDQGNGCF | | AEIEDLIFSA | | AEINTWARNIL | |
| AEDRGNGCF | | AEDRGNGCF | | AEIEDLTFLA | | AEISHCRATEY | |
| AEEDCTGCF | | AEEDCTGCF | | AEILVALENQ | | AEKESTQKAID | |
| AEEDGKGCF | | AEEDGKGCF | | AEILVLMENE | | AELIVLLENQK | |
| AEEDGNGCF | | AEEDGNGCF | | AEINTWARNI | | AELKWLISKSK | |
| AEEDGRGCF | | AEEDGRGCF | | AEISHCRATE | | AELKWLVSKDK | |
| AEEDGTGCF | | AEEDGTGCF | | AEKAMKEHGE | | AELKWLVSKNK | |
| AEEMGNGCF | | AEEMGNGCF | | AEKAMKEYGE | | AELKWLVSKSK | |
| AEESKLKRQ | | AEESKLKRQ | | AEKESTQKAI | | AELKWLVSKTK | |
| AEFLVALEN | | AEFLVALEN | | AEKTMKEYGE | | AELLIAMENQH | |
| AEFLVAVEN | | AEFLVAVEN | | AELAEKAMKE | | AELLILLENER | |
| AEFLVLMEN | | AEFLVLMEN | | AELFVLMENE | | AELLVAIENQH | |

Fig. 83-5

| Block size 8 | SIN | Block size 9 | SIN | Block size 10 | SIN | Block size 11 | SIN |
|---|---|---|---|---|---|---|---|
| AEGDCYRAC | | AEGDCYRAC | | AELIRGRPKE | | AELLVALENQH | |
| AEGECYRAC | | AEGECYRAC | | AELIVLLENQ | | AELLVAMENQH | |
| AEGIGIAAD | | AEGIGIAAD | | AELKWLISKS | | AELLVLIENQK | |
| AEGRTSDMR | | AEGRTSDMR | | AELKWLVSKD | | AELLVLLEDER | |
| AEGTGIAAD | | AEGTGIAAD | | AELKWLVSKN | | AELLVLLENER | |
| AEGTGMAAD | | AEGTGMAAD | | AELKWLVSKS | | AELLVLLENGR | |
| AEGTGTAAD | | AEGTGTAAD | | AELKWLVSKT | | AELLVLLENQK | |
| AEIAQKLED | | AEIAQKLED | | AELLIAMENQ | | AELLVLLGNQK | |
| AEIAQRLED | | AEIAQRLED | | AELLILLENE | | AELLVLMENEM | |
| AEIAQRLEG | | AEIAQRLEG | | AELLVALENQ | | AELLVLMENER | |
| AEIAQRLEN | | AEIAQRLEN | | AELLVAMENQ | | AEMKWLLSNAD | |
| AEIAQRLES | | AEIAQRLES | | AELLVLIENE | | AEMKWLLSNND | |
| AEIEDLIFL | | AEIEDLIFL | | AELLVLIENQ | | AEMKWLLSNSD | |
| AEIEDLIFM | | AEIEDLIFM | | AELLVLLEDE | | AEMKWLLSNTD | |
| AEIEDLIFS | | AEIEDLIFS | | AELLVLLENE | | AEMKWLLSSSD | |
| AEIEDLTFL | | AEIEDLTFL | | AELLVLLENG | | AEMKWLLSSTD | |
| AEILVALEN | | AEILVALEN | | AELLVLLENQ | | AEMLVLLENER | |
| AEILVLMEN | | AEILVLMEN | | AELLVLLGNQ | | AEQFTWNGVKV | |
| AEINTWARN | | AEINTWARN | | AELLVLMENE | | AERGKLKRRAI | |
| AEISHCRAT | | AEISHCRAT | | AELLVLMETE | | AESEMNKLYER | |
| AEKAMKEHG | | AEKAMKEHG | | AELPFTIDKS | | AESLQNRIQID | |
| AEKAMKEYG | | AEKAMKEYG | | AELPFTIDKY | | AESRKLLLIAQ | |
| AEKESTQKA | | AEKESTQKA | | AEMKWLLSNA | | AESRKLLLITQ | |
| AEKTMKEYG | | AEKTMKEYG | | AEMKWLLSNN | | AESRKLLLIVQ | |
| AELAEKAMK | | AELAEKAMK | | AEMKWLLSNS | | AESRKLLLVVQ | |
| AELFVLMEN | | AELFVLMEN | | AEMKWLLSNT | | AESRKMLLIVQ | |
| AELIVLLEN | | AELIVLLEN | | AEMKWLLSSS | | AESSIKEKDMT | |
| AELKWLISK | | AELKWLISK | | AEMKWLLSST | | AESSVKEKDLT | |
| AELKWLVSK | | AELKWLVSK | | AEQFTWNGVK | | AESSVKEKDMT | |
| AELLIAMEN | | AELLIAMEN | | AERAMKEYGE | | AESSVREKDMT | |
| AELLILLEN | | AELLILLEN | | AERGKLKRRA | | AEVLVLMENER | |
| AELLVAIEN | | AELLVAIEN | | AESRKLLLIA | | AEVSHCRATEY | |
| AELLVALEN | | AELLVALEN | | AESRKLLLIT | | AEVSYCRATEY | |
| AELLVAMEN | | AELLVAMEN | | AESRKLLLIV | | AFCGTSGTYGT | |
| AELLVLIEN | | AELLVLIEN | | AESRKLLLVV | | AFCGVDSDTTG | |
| AELLVLLED | | AELLVLLED | | AESRKMLLIV | | AFCGVDSDTTS | |
| AELLVLLEN | | AELLVLLEN | | AESSIKEKDM | | AFCGVNSDTTG | |
| AELLVLLGN | | AELLVLLGN | | AESSVKEKDL | | AFCGVNSDTTS | |
| AELLVLMEN | | AELLVLMEN | | AESSVKEKDM | | AFCGVNSNTTG | |
| AEMEWLLSN | | AEMEWLLSN | | AESSVREKDM | | AFDERRNKYLE | |
| AEMKWLLSD | | AEMKWLLSD | | AEVLVLMENE | | AFDERRNRYLE | |
| AEMKWLLSN | | AEMKWLLSN | | AEVSHCRATE | | AFGLICATCEQ | |
| AEMKWLLSS | | AEMKWLLSS | | AEVSYCRATE | | AFGLVCATCEQ | |
| AEQFTWNGV | | AEQFTWNGV | | AFCGTSGTYG | | AFIAPDRASFF | |
| AEQTKLYGS | | AEQTKLYGS | | AFCGVDSDTT | | AFIAPDRASFL | |
| AERGKLKRR | | AERGKLKRR | | AFCGVNSDTT | | AFIAPDRATFL | |
| AERQEIVDN | | AERQEIVDN | | AFDERRNKYL | | AFIAPNRASFF | |
| AESEMNKLY | | AESEMNKLY | | AFDERRNRYL | | AFILWACSSGN | |
| AESRKLLLI | | AESRKLLLI | | AFFRNMVWLI | | AFIMWACSNGN | |
| AESRKLLLV | | AESRKLLLV | | AFGLICATCE | | AFIMWACSNGS | |
| AESRKMLLI | | AESRKMLLI | | AFGLVCATCE | | AFIMWACSSGN | |
| AESSIKEKD | | AESSIKEKD | | AFGPVHFRNQ | | AFKQGNSVWAG | |
| AESSVKEKD | | AESSVKEKD | | AFIAPDRAGF | | AFLTSSIVCPG | |
| AESSVREKD | | AESSVREKD | | AFIAPDRASF | | AFRDNLEPGTF | |
| AEVLVLMEN | | AEVLVLMEN | | AFIAPDRATF | | AFRGLISTHLG | |
| AEVSHCRAT | | AEVSHCRAT | | AFIAPDRVSF | | AFRGLISTPLG | |
| AEVSYCRAT | | AEVSYCRAT | | AFIAPNRASF | | AFRGLISTQLG | |
| AFCGTSGTY | | AFCGTSGTY | | AFICIKNGNM | | AFRGLMSTPLG | |
| AFCGVDSDT | | AFCGVDSDT | | AFILWACQNG | | AFSGMSANGDI | |
| AFCGVNFDL | | AFCGVNFDL | | AFILWACQTG | | AFSVQRNLPFD | |
| AFCGVNSDT | | AFCGVNSDT | | AFILWACSSG | | AFYKILKIKKG | |
| AFDERRNKY | | AFDERRNKY | | AFIMWACSNG | | AFYKILKIRKG | |

Fig. 83-6

| Block size 8 | SIN | Block size 9 | SIN | Block size 10 | SIN | Block size 11 | SIN |
|---|---|---|---|---|---|---|---|
| AFDERRNY | | AFDERRNY | | AFIMWACSSG | | AFYRSINWLTK | |
| AFFRNMVWL | | AFFRNMVWL | | AFKFVSSDCS | | AGAAIKGIGTM | |
| AFGLICATC | | AFGLICATC | | AFKQGNSVWA | | AGAAIKGVGTM | |
| AFGLVCATC | | AFGLVCATC | | AFLTSSIVCP | | AGAAVKGIGTM | |
| AFGPVHFRN | | AFGPVHFRN | | AFMLWACQNG | | AGAAVKGVGTI | |
| AFIAPDRAS | | AFIAPDRAS | | AFRDNLEPGT | | AGAAVKGVGTM | |
| AFIAPDRAT | | AFIAPDRAT | | AFRGLISTHL | | AGAGALAEDPD | |
| AFIAPDRVS | | AFIAPDRVS | | AFRGLISTPL | | AGALASCMGLI | |
| AFIAPNRAS | | AFIAPNRAS | | AFRGLISTQL | | AGDGCFEILHK | |
| AFICIKNGN | | AFICIKNGN | | AFRGLMSTPL | | AGFAPFSKDNS | |
| AFILWACQN | | AFILWACQN | | AFSGMSANGD | | AGFIEGGWCGM | |
| AFILWACSS | | AFILWACSS | | AFSVQRNLPF | | AGFIEGGWPGL | |
| AFIMWACSN | | AFIMWACSN | | AFVAPDRVSF | | AGFIEGGWQGL | |
| AFIMWACSS | | AFIMWACSS | | AFVLWACQNG | | AGFIEGGWQGM | |
| AFKQGNSVW | | AFKQGNSVW | | AFYKILKIKK | | AGFIEGGWSGL | |
| AFLEDSHPG | | AFLEDSHPG | | AFYKILKIRK | | AGFIEGGWSGM | |
| AFLEESHPG | | AFLEESHPG | | AFYRSINWLT | | AGFIEGGWTGL | |
| AFLEKSHPG | | AFLEKSHPG | | AGAAIKGVGT | | AGFIEGGWTGM | |
| AFLENSHPG | | AFLENSHPG | | AGAAVKGIGT | | AGFIEGRWPGL | |
| AFLTSSIVC | | AFLTSSIVC | | AGAAVKGVGT | | AGFIENGWEGL | |
| AFMLWACQN | | AFMLWACQN | | AGAGALAEDP | | AGFIENGWEGM | |
| AFRDNLEPG | | AFRDNLEPG | | AGALASCMGL | | AGFIENGWQGL | |
| AFRGLISTH | | AFRGLISTH | | AGDGCFEILH | | AGGAIWVTREP | |
| AFRGLISTP | | AFRGLISTP | | AGFAPFSKDN | | AGGAVWVTREP | |
| AFRGLISTQ | | AFRGLISTQ | | AGFHFEECSC | | AGGDIWITREP | |
| AFRGLMSTP | | AFRGLMSTP | | AGFIEGGWCG | | AGGDIWVMREP | |
| AFSGMSANG | | AFSGMSANG | | AGFIEGGWPG | | AGGDIWVTREH | |
| AFSVQRNLP | | AFSVQRNLP | | AGFIEGGWQG | | AGGDIWVTREL | |
| AFVAPDRAS | | AFVAPDRAS | | AGFIEGGWSG | | AGGDIWVTREP | |
| AFVAPDRVS | | AFVAPDRVS | | AGFIEGGWTG | | AGGDIWVTRVP | |
| AFVLWACQN | | AFVLWACQN | | AGFIEGRWPG | | AGGHIWVTREP | |
| AFYKILKIK | | AFYKILKIK | | AGFIENGWEG | | AGGLILGMQNG | |
| AFYKILKIR | | AFYKILKIR | | AGFIENGWQG | | AGGNIWITREP | |
| AFYRSINWL | | AFYRSINWL | | AGGAIWVTRE | | AGIFFWMCSNG | |
| AGAAIKGVG | | AGAAIKGVG | | AGGDIWATRE | | AGIFLWMCSNG | |
| AGAAVKGIG | | AGAAVKGIG | | AGGDIWITRE | | AGIPSDTPRGE | |
| AGAAVKGVG | | AGAAVKGVG | | AGGDIWVTRE | | AGIPTDTPRGE | |
| AGAGALAED | | AGAGALAED | | AGGDIWVTRV | | AGIPTDTPRIQ | |
| AGAINSSKP | | AGAINSSKP | | AGGHIWVTRE | | AGIPTDTPRVQ | |
| AGAINSSRP | | AGAINSSRP | | AGGLILGMQN | | AGISFWMCSNG | |
| AGALASCMG | | AGALASCMG | | AGGNIWITRE | | AGISIWMCSNG | |
| AGAVNSSKP | | AGAVNSSKP | | AGIFFWMCSN | | AGISLWMCSNG | |
| AGDGCFEIL | | AGDGCFEIL | | AGIFLWMCSN | | AGKDPKKTGGP | |
| AGFAPFSKD | | AGFAPFSKD | | AGIPSDTPRG | | AGKILRTQESE | |
| AGFHFEECS | | AGFHFEECS | | AGIPTDTPRG | | AGKNADLEALM | |
| AGFIEGGWC | | AGFIEGGWC | | AGIPTDTPRI | | AGKNSDLEALM | |
| AGFIEGGWP | | AGFIEGGWP | | AGIPTDTPRV | | AGKNTDLEALM | |
| AGFIEGGWQ | | AGFIEGGWQ | | AGISFWMCSN | | AGKNTDLEVLM | |
| AGFIEGGWS | | AGFIEGGWS | | AGISIWMCSN | | AGLFFWMCSNG | |
| AGFIEGGWT | | AGFIEGGWT | | AGISLWMCSN | | AGLFLWMCSNG | |
| AGFIEGRWP | | AGFIEGRWP | | AGKDPKKTGG | | AGLLLWMCSNG | |
| AGFIENGWE | | AGFIENGWE | | AGKILRTQES | | AGLPSDTPRGE | |
| AGFIENGWQ | | AGFIENGWQ | | AGKNADLEAL | | AGLSFWMCSNG | |
| AGGAIWVTR | | AGGAIWVTR | | AGKNSDLEAL | | AGLSLWMCFNG | |
| AGGDIWATR | | AGGDIWATR | | AGKNTDLEAL | | AGLSLWMCSNG | |
| AGGDIWITR | | AGGDIWITR | | AGKNTDLEVL | | AGLTHIMIWHS | |
| AGGDIWVTR | | AGGDIWVTR | | AGLFFWMCSN | | AGLTHLMIWHS | |
| AGGHIWVTR | | AGGHIWVTR | | AGLFLWMCSN | | AGLTHMMIWHS | |
| AGGLILGMQ | | AGGLILGMQ | | AGLLLWMCSN | | AGNGCFDILHK | |
| AGGNIWITR | | AGGNIWITR | | AGLLVALENQ | | AGNILRTQESE | |
| AGIFFWMCS | | AGIFFWMCS | | AGLPSDTPRG | | AGNKLITVGSS | |
| AGIFLWMCS | | AGIFLWMCS | | AGLSFWMCSN | | AGRIDFHWMLL | |

Fig. 83-7

| Block size 8 | SIN | Block size 9 | SIN | Block size 10 | SIN | Block size 11 | SIN |
|---|---|---|---|---|---|---|---|
| AGIPSDTPR | | AGIPSDTPR | | AGLSLWMCFN | | AGSAQHVEECS | |
| AGIPTDTPR | | AGIPTDTPR | | AGLSLWMCSN | | AGSLSLAIMIA | |
| AGISFWMCS | | AGISFWMCS | | AGLTHIMIWH | | AGSLSLAIMMA | |
| AGISIWMCS | | AGISIWMCS | | AGLTHLMIWH | | AGSLSLAIMVA | |
| AGISLWMCS | | AGISLWMCS | | AGLTHMMIWH | | AGSNEQAAEAM | |
| AGKDPKKTG | | AGKDPKKTG | | AGLVLGNPMC | | AGSSEQAAEAI | |
| AGKILRTQE | | AGKILRTQE | | AGNGCFDILH | | AGSSEQAAEAM | |
| AGKNADLEA | | AGKNADLEA | | AGNILRTQES | | AGTAKHIEECS | |
| AGKNSDLEA | | AGKNSDLEA | | AGNKLITVGS | | AGVDRFYRICK | |
| AGKNTDLEA | | AGKNTDLEA | | AGRIDFHWML | | AGVDRFYRTCK | |
| AGKNTDLEV | | AGKNTDLEV | | AGRMTFYWAI | | AGVEFAVLRGF | |
| AGLFFWMCS | | AGLFFWMCS | | AGRMTFYWII | | AGVESAVLRGF | |
| AGLFLWMCS | | AGLFLWMCS | | AGRMTFYWKI | | AGVETMVILSA | |
| AGLLLWMCS | | AGLLLWMCS | | AGRMTFYWTI | | AGVKMNPNQKI | |
| AGLLVALEN | | AGLLVALEN | | AGRMTFYWTM | | AGVNRFYRTCK | |
| AGLPSDTPR | | AGLPSDTPR | | AGSAQHVEEC | | AGWILGNPMCD | |
| AGLSFWMCS | | AGLSFWMCS | | AGSLSLAIMI | | AGWILGNPRCD | |
| AGLSLWMCF | | AGLSLWMCF | | AGSLSLAIMM | | AGWLLGNPECD | |
| AGLSLWMCS | | AGLSLWMCS | | AGSLSLAIMV | | AGWLLGNPKCD | |
| AGLTHIMIW | | AGLTHIMIW | | AGSNEQAAEA | | AGWLLGNPLCD | |
| AGLTHLMIW | | AGLTHLMIW | | AGSSEQAAEA | | AGWLLGNPMCD | |
| AGLTHMMIW | | AGLTHMMIW | | AGTAKHIEEC | | AGWYGFQHQNA | |
| AGLVLGNPM | | AGLVLGNPM | | AGVDRFYRIC | | AGWYGFQHQNS | |
| AGNGCFDIL | | AGNGCFDIL | | AGVDRFYRTC | | AGYAADKESTQ | |
| AGNILRTQE | | AGNILRTQE | | AGVESAVLRG | | AHALKLVVAML | |
| AGNKLITVG | | AGNKLITVG | | AGVETMVILS | | AHCYPGATINE | |
| AGRIDFHWM | | AGRIDFHWM | | AGVKMNPNQK | | AHDRICIGYQS | |
| AGRMTFYWA | | AGRMTFYWA | | AGVNRFYRTC | | AHHRVYWIREG | |
| AGRMTFYWI | | AGRMTFYWI | | AGWILGNPEC | | AHILVTREPYL | |
| AGRMTFYWK | | AGRMTFYWK | | AGWILGNPKC | | AHISPLSGSAQ | |
| AGRMTFYWT | | AGRMTFYWT | | AGWILGNPMC | | AHKQLTHHMRK | |
| AGSAQHVEE | | AGSAQHVEE | | AGWILGNPRC | | AHKSCLPACAY | |
| AGSLSLAIM | | AGSLSLAIM | | AGWLIGNPKC | | AHKSCLPACIY | |
| AGSSEQAAE | | AGSSEQAAE | | AGWLLGNPEC | | AHKSCLPACVY | |
| AGSWPDGAN | | AGSWPDGAN | | AGWLLGNPKC | | AHKSQLIWMAC | |
| AGTAKHIEE | | AGTAKHIEE | | AGWLLGNPLC | | AHKSQLVWMAC | |
| AGVDRFYRI | | AGVDRFYRI | | AGWLLGNPMC | | AHNGKLCRLSG | |
| AGVDRFYRT | | AGVDRFYRT | | AGWYGFQHQN | | AHTKVLYFHKG | |
| AGVESAVLR | | AGVESAVLR | | AGWYGFQHSN | | AHVLVTREPYL | |
| AGVETMVIL | | AGVETMVIL | | AGWYGFQHTN | | AIAGFIEGGWC | |
| AGVKMNPNQ | | AGVKMNPNQ | | AGYAADKEST | | AIAGFIEGGWP | |
| AGVNRFYRT | | AGVNRFYRT | | AGYEMLKVPN | | AIAGFIEGGWQ | |
| AGWILGNPE | | AGWILGNPE | | AHALKLVVAM | | AIAGFIEGGWS | |
| AGWILGNPK | | AGWILGNPK | | AHCYPGATIN | | AIAGFIEGGWT | |
| AGWILGNPM | | AGWILGNPM | | AHDRICIGYQ | | AIAGFIEGRWP | |
| AGWILGNPR | | AGWILGNPR | | AHHRVYWIRE | | AIAGFIENGWE | |
| AGWLIGNPK | | AGWLIGNPK | | AHILVTREPY | | AIAGFIENGWQ | |
| AGWLLGNPE | | AGWLLGNPE | | AHISPLSGSA | | AIAGFLENGWE | |
| AGWLLGNPK | | AGWLLGNPK | | AHKMESRGLF | | AIALGIINLLI | |
| AGWLLGNPL | | AGWLLGNPL | | AHKQLTHHMR | | AIALSILNLLI | |
| AGWLLGNPM | | AGWLLGNPM | | AHKSCLPACA | | AIALSVLNLLI | |
| AGWYGFQHQ | | AGWYGFQHQ | | AHKSCLPACI | | AIAMGLIFMCV | |
| AGWYGFQHS | | AGWYGFQHS | | AHKSCLPACV | | AIATPGMQIRG | |
| AGWYGFQHT | | AGWYGFQHT | | AHKSQLIWMA | | AIAWSATACHD | |
| AGYAADKES | | AGYAADKES | | AHKSQLVWMA | | AICTHLEICFM | |
| AGYEMLKVP | | AGYEMLKVP | | AHNGKLCRLS | | AICTHLEVCFM | |
| AHALKLVVA | | AHALKLVVA | | AHTKILYFHK | | AICTHMEVCFM | |
| AHCYPGATI | | AHCYPGATI | | AHTKVLYFHK | | AIDAGDGCFEI | |
| AHDRICIGY | | AHDRICIGY | | AHVLVTREPY | | AIDAGNGCFDI | |
| AHHRVYWIR | | AHHRVYWIR | | AIAGFIEGGW | | AIDEGDGCFNF | |
| AHILVTREP | | AHILVTREP | | AIAGFIEGRW | | AIDEGDGCFNL | |
| AHISPLSGS | | AHISPLSGS | | AIAGFIENGW | | AIDEGDGCFSI | |

Fig. 83-8

| Block size 8 | SIN | Block size 9 | SIN | Block size 10 | SIN | Block size 11 | SIN |
|---|---|---|---|---|---|---|---|
| AHKQLTHHM | | AHKQLTHHM | | AIAGFLENGW | | AIDEGDGCFSL | |
| AHKSCLPAC | | AHKSCLPAC | | AIALGIINLL | | AIDEGNGCFEL | |
| AHKSQLIWM | | AHKSQLIWM | | AIALSILNLL | | AIDEITTKINN | |
| AHKSQLVWM | | AHKSQLVWM | | AIALSVLNLL | | AIDGITNKINS | |
| AHNGKLCRL | | AHNGKLCRL | | AIAMGLIFMC | | AIDGITNKVNS | |
| AHTKVLYFH | | AHTKVLYFH | | AIAMGLVFIC | | AIDGVTNKVNS | |
| AHVLVTREP | | AHVLVTREP | | AIAMGLVFMC | | AIDIMQNKLNN | |
| AIAGFIEGG | | AIAGFIEGG | | AIASKDNGIR | | AIDKITNKINN | |
| AIAGFIEGR | | AIAGFIEGR | | AIATPGMQIR | | AIDKITNKVNN | |
| AIAGFIENG | | AIAGFIENG | | AICTHLEICF | | AIDNGDGCFEI | |
| AIALGIINL | | AIALGIINL | | AICTHLEVCF | | AIDNMQNKLNN | |
| AIALSILNL | | AIALSILNL | | AICTHMEVCF | | AIDNMQNRLNN | |
| AIALSVLNL | | AIALSVLNL | | AIDAGDGCFE | | AIDQINGKLNR | |
| AIAMGFVFI | | AIAMGFVFI | | AIDAGNGCFD | | AIDQISGKLNR | |
| AIAMGLIFM | | AIAMGLIFM | | AIDEGDGCFN | | AIDQITGKLNH | |
| AIAMGLVFI | | AIAMGLVFI | | AIDEGDGCFS | | AIDQITGKLNR | |
| AIAMGLVFM | | AIAMGLVFM | | AIDEGNGCFE | | AIDQITRKLNR | |
| AIASKDNGI | | AIASKDNGI | | AIDEITTKIN | | AIDQITTKINN | |
| AIATPGMQI | | AIATPGMQI | | AIDGITNKIN | | AIDQMTGKLNR | |
| AICTHLEIC | | AICTHLEIC | | AIDGITNKVN | | AIDQVNGKLNR | |
| AICTHLEVC | | AICTHLEVC | | AIDGVTNKVN | | AIDQVTGKLNR | |
| AICTHMEVC | | AICTHMEVC | | AIDIMQNKLN | | AIDRITTKINN | |
| AIDAGDGCF | | AIDAGDGCF | | AIDKINGKLN | | AIDTGDGCFEI | |
| AIDAGNGCF | | AIDAGNGCF | | AIDKITNKIN | | AIDTGKGCFDI | |
| AIDEGDGCF | | AIDEGDGCF | | AIDKITNKVN | | AIDTGNGCFDI | |
| AIDEGNGCF | | AIDEGNGCF | | AIDNGDGCFE | | AIEECLINDPW | |
| AIDEITTKI | | AIDEITTKI | | AIDNMQNKLN | | AIEKITNKVNN | |
| AIDGITNKI | | AIDGITNKI | | AIDNMQNRLN | | AIENQHTIDLA | |
| AIDGITNKV | | AIDGITNKV | | AIDQINGKLN | | AIGAIDSSMPF | |
| AIDGVTNKV | | AIDGVTNKV | | AIDQITGKLN | | AIGDCPKYIKS | |
| AIDIMQNKL | | AIDIMQNKL | | AIDQITRKLN | | AIGDCPKYVNV | |
| AIDKITNKI | | AIDKITNKI | | AIDQITTKIN | | AIGECPKYVKS | |
| AIDKITNKV | | AIDKITNKV | | AIDQMTGKLN | | AIGFWMCSNGS | |
| AIDNGDGCF | | AIDNGDGCF | | AIDQVNGKLN | | AIGGSGTNNYG | |
| AIDNMQNKL | | AIDNMQNKL | | AIDQVTGKLN | | AIGKITNKVNN | |
| AIDNMQNRL | | AIDNMQNRL | | AIDRITTKIN | | AIGLRISSSFS | |
| AIDQINGKL | | AIDQINGKL | | AIDTGDGCFE | | AIGLRNTPSIE | |
| AIDQITGKL | | AIDQITGKL | | AIDTGKGCFD | | AIGLRNVPQAQ | |
| AIDQITGTL | | AIDQITGTL | | AIDTGNGCFD | | AIGLRNVPQIE | |
| AIDQITRKL | | AIDQITRKL | | AIEECLINDP | | AIGLRNVPQIQ | |
| AIDQITTKI | | AIDQITTKI | | AIEKITNKVN | | AIGLRNVPQVQ | |
| AIDQVNGKL | | AIDQVNGKL | | AIENQHTIDL | | AIGNCPKYVKQ | |
| AIDQVTGKL | | AIDQVTGKL | | AIFSKDNGIR | | AIGPRNVPQAQ | |
| AIDRITTKI | | AIDRITTKI | | AIGAIDSSMP | | AIGPRNVPQVQ | |
| AIDTGDGCF | | AIDTGDGCF | | AIGDCPKYIK | | AIHHPPTSAEQ | |
| AIDTGKGCF | | AIDTGKGCF | | AIGDCPKYVN | | AIHHPPTSDEQ | |
| AIDTGNGCF | | AIDTGNGCF | | AIGECPKYVK | | AIHHPPTSNEQ | |
| AIEECLIND | | AIEECLIND | | AIGFWMCSNG | | AIHHPPTTDEQ | |
| AIEKITNKV | | AIEKITNKV | | AIGGSGTDNY | | AIIKKYTSARQ | |
| AIENQHTID | | AIENQHTID | | AIGGSGTNNY | | AIIKKYTSGRQ | |
| AIFSKDNGI | | AIFSKDNGI | | AIGKITNKVN | | AILAATVTLHF | |
| AIGAIDSSM | | AIGAIDSSM | | AIGLRISSSF | | AILATTITLHF | |
| AIGDCPKYI | | AIGDCPKYI | | AIGLRNTPSI | | AILATTVTLHF | |
| AIGDCPKYV | | AIGDCPKYV | | AIGLRNVPQA | | AILIAGGLILG | |
| AIGECPKYV | | AIGECPKYV | | AIGLRNVPQI | | AILKPGQTVKI | |
| AIGGSGTDN | | AIGGSGTDN | | AIGLRNVPQV | | AILPFDFDKIS | |
| AIGGSGTNN | | AIGGSGTNN | | AIGNCPKYVK | | AILPFDIDKII | |
| AIGKITNKV | | AIGKITNKV | | AIGPRNVPQA | | AILVAGGLILG | |
| AIGLRISSS | | AIGLRISSS | | AIGPRNVPQV | | AILVTTVTLHF | |
| AIGLRNTPS | | AIGLRNTPS | | AIHHPPTSAE | | AINEGNGCFEL | |
| AIGLRNVPQ | | AIGLRNVPQ | | AIHHPPTSDE | | AINEITTKINN | |
| AIGNCPKYV | | AIGNCPKYV | | AIHHPPTSNE | | AINGVTNKVNS | |

Fig. 83-9

| Block size 8 | SIN | Block size 9 | SIN | Block size 10 | SIN | Block size 11 | SIN |
|---|---|---|---|---|---|---|---|
| AIGPRNVPQ | | AIGPRNVPQ | | AIHHPPTTDE | | AINKITNKVNN | |
| AIHHPPTSA | | AIHHPPTSA | | AIIIAGLSFW | | AINLYASKNPY | |
| AIHHPPTSD | | AIHHPPTSD | | AIIKKYTSAR | | AINNRFQIQGI | |
| AIHHPPTSN | | AIHHPPTSN | | AIIKKYTSGR | | AINNRFQIQGV | |
| AIHHPPTTD | | AIHHPPTTD | | AIISKDNGIR | | AINNRIKINPV | |
| AIIIAGLSF | | AIIIAGLSF | | AILAATVTLH | | AINQITGKLNR | |
| AIIKKYTSA | | AIIKKYTSA | | AILATTITLH | | AINSRFQIQGV | |
| AIIKKYTSG | | AIIKKYTSG | | AILATTVTLH | | AINSSKPFQNA | |
| AIISKDNGI | | AIISKDNGI | | AILIAGGLIL | | AINSSKPFQNT | |
| AILAATVTL | | AILAATVTL | | AILKPGQTVK | | AINSSKPLQNA | |
| AILATTITL | | AILATTITL | | AILPFDIDKM | | AINSSMPFHNI | |
| AILATTVTL | | AILATTVTL | | AILVAGGLIL | | AINSSMPFHNV | |
| AILIAGGLI | | AILIAGGLI | | AILVTTVTLH | | AINSSMPLHNI | |
| AILKPGQTV | | AILKPGQTV | | AIMIAGLFFW | | AINSSRPFQNA | |
| AILPFDIDK | | AILPFDIDK | | AIMIAGLSFW | | AINTSMPFHNI | |
| AILPLTSIR | | AILPLTSIR | | AIMMAGLSFW | | AINTTLPFHNI | |
| AILVAGGLI | | AILVAGGLI | | AIMVAGLSFW | | AINTTLPFHNV | |
| AILVTTVTL | | AILVTTVTL | | AINEGNGCFE | | AIRFGEGEQII | |
| AIMIAGLFF | | AIMIAGLFF | | AINEITTKIN | | AIRFGESEQII | |
| AIMIAGLSF | | AIMIAGLSF | | AINGVTNKVN | | AIRFGESEQIV | |
| AIMMAGLSF | | AIMMAGLSF | | AINKITNKVN | | AIRFGESEQVI | |
| AIMVAGLSF | | AIMVAGLSF | | AINLYASKNP | | AIRNGTYNHED | |
| AINEGNGCF | | AINEGNGCF | | AINNRFQIQG | | AIRTKSGGNTN | |
| AINEITTKI | | AINEITTKI | | AINNRIKINP | | AIRTRSGGNNN | |
| AINGVTNKV | | AINGVTNKV | | AINQITGKLN | | AIRTRSGGNTN | |
| AINKITNKV | | AINKITNKV | | AINSRFQIQG | | AIRTRSGGNTS | |
| AINLYASKN | | AINLYASKN | | AINSSKPFQN | | AISFWMCSGHS | |
| AINNRFQIQ | | AINNRFQIQ | | AINSSKPLQN | | AISFWMCSNGS | |
| AINNRIKIN | | AINNRIKIN | | AINSSMPFHN | | AISNRFQIQGV | |
| AINQINGKL | | AINQINGKL | | AINSSMPLHN | | AISTTFPYTGD | |
| AINQITGKL | | AINQITGKL | | AINSSRPFQN | | AITRSGQNHGI | |
| AINSRFQIQ | | AINSRFQIQ | | AINTTLPFHN | | AIVLGIINLLI | |
| AINSSKPFQ | | AINSSKPFQ | | AIRFGEGEQI | | AIVQITGKLNR | |
| AINSSKPLQ | | AINSSKPLQ | | AIRFGESEQI | | AIVSADPLASL | |
| AINSSMPFH | | AINSSMPFH | | AIRFGESEQV | | AIWTSGSSIAF | |
| AINSSMPLH | | AINSSMPLH | | AIRNGTYNHE | | AIWTSSSSIVM | |
| AINSSRPFQ | | AINSSRPFQ | | AIRTKSGGNT | | AIWVTREPYVS | |
| AINTSMPFH | | AINTSMPFH | | AIRTRSGGNT | | AIYATVAGSLS | |
| AINTTLPFH | | AINTTLPFH | | AISFWMCSGH | | AIYSCIASSIV | |
| AIRFGEGEQ | | AIRFGEGEQ | | AISFWMCSNG | | AIYSTAASSLV | |
| AIRFGESEQ | | AIRFGESEQ | | AISNRFQIQG | | AIYSTISSSLV | |
| AIRIGEDAH | | AIRIGEDAH | | AISSSMPFHN | | AIYSTVASSLI | |
| AIRIGEEAH | | AIRIGEEAH | | AISTTFPYTG | | AIYSTVASSLV | |
| AIRIGEGAH | | AIRIGEGAH | | AITRSGQNHG | | AIYSTVASSSV | |
| AIRIGENAH | | AIRIGENAH | | AIVFSQEDCM | | AIYSTVSSSLV | |
| AIRNGTYNH | | AIRNGTYNH | | AIVLGIINLL | | AKAGFIEGGWP | |
| AIRPKVNGQ | | AIRPKVNGQ | | AIVMGLVFIC | | AKAGFIENGWE | |
| AIRTRSGGN | | AIRTRSGGN | | AIVQITGKLN | | AKAGVKMNPNQ | |
| AISFWMCSG | | AISFWMCSG | | AIVSADPLAS | | AKAMEQMAGSS | |
| AISFWMCSN | | AISFWMCSN | | AIVSKDNGIR | | AKAMEQVAGSS | |
| AISNRFQIQ | | AISNRFQIQ | | AIWTSGSSIA | | AKDEGNGCFTF | |
| AISTTFPYT | | AISTTFPYT | | AIWTSSSSIV | | AKDILEKAHNG | |
| AITRSGQNH | | AITRSGQNH | | AIWVTREPYV | | AKDILEKTHNG | |
| AIVFSQEDC | | AIVFSQEDC | | AIYATVAGSL | | AKDLGNGCFEF | |
| AIVLGIINL | | AIVLGIINL | | AIYSCIASSI | | AKDNAIRFGEG | |
| AIVMGLVFI | | AIVMGLVFI | | AIYSTAASSL | | AKDNAIRFGES | |
| AIVQITGKL | | AIVQITGKL | | AIYSTISSSL | | AKDNAVRFGES | |
| AIVSADPLA | | AIVSADPLA | | AIYSTVASSL | | AKDNSIRLSAG | |
| AIVSKDNGI | | AIVSKDNGI | | AIYSTVASSS | | AKEAQDVIMEI | |
| AIWTSGSSI | | AIWTSGSSI | | AIYSTVSSSL | | AKEAQDVIMEV | |
| AIWTSSSSI | | AIWTSSSSI | | AJVMGLVFIC | | AKEECYRACFY | |
| AIWVTREPY | | AIWVTREPY | | AKAGFIEGGW | | AKEIGNGCFEF | |

Fig. 83-10

| Block size 8 | SIN | Block size 9 | SIN | Block size 10 | SIN | Block size 11 | SIN |
|---|---|---|---|---|---|---|---|
| AIYATVAGS | | AIYATVAGS | | AKAGFIENGW | | AKELGNGCFEF | |
| AIYSCIASS | | AIYSCIASS | | AKAGVKMNPN | | AKELVETNHTD | |
| AIYSTAASS | | AIYSTAASS | | AKAMEQMAGS | | AKEMGNGCFEF | |
| AIYSTISSS | | AIYSTISSS | | AKAMEQVAGS | | AKEQTALYKNA | |
| AIYSTVASS | | AIYSTVASS | | AKCNTKCQTS | | AKEQTTLYKNA | |
| AIYSTVSSS | | AIYSTVSSS | | AKDEGNGCFT | | AKETGNGCFEF | |
| AKAGFIEGG | | AKAGFIEGG | | AKDILEKTHN | | AKEVGNGCFEF | |
| AKAGFIENG | | AKAGFIENG | | AKDLGNGCFE | | AKEWGNGCFEF | |
| AKAGVKMNP | | AKAGVKMNP | | AKDNAIRFGE | | AKFEAVAWSAT | |
| AKAMEQMAG | | AKAMEQMAG | | AKDNAVRFGE | | AKFESVAWSAT | |
| AKAMEQVAG | | AKAMEQVAG | | AKDNSIRLSA | | AKGDCYRACFY | |
| AKCNTKCQT | | AKCNTKCQT | | AKEAQDVIME | | AKGDKICLGHH | |
| AKDEGNGCF | | AKDEGNGCF | | AKEECYRACF | | AKGECYRACFY | |
| AKDILEKTH | | AKDILEKTH | | AKEIGNGCFE | | AKGEKANVLIG | |
| AKDLGNGCF | | AKDLGNGCF | | AKEIGNGCFK | | AKGEKTNVLIG | |
| AKDNAIRFG | | AKDNAIRFG | | AKELGNGCFE | | AKGLFGAIAGF | |
| AKDNAVRFG | | AKDNAVRFG | | AKELVETNHT | | AKGSYNNTNGE | |
| AKDNSIRLS | | AKDNSIRLS | | AKEMGNGCFE | | AKGSYNNTSGE | |
| AKEAQDVIM | | AKEAQDVIM | | AKEQTALYKN | | AKHIEECSCYG | |
| AKEECYRAC | | AKEECYRAC | | AKEQTTLYKN | | AKHVEECSCYP | |
| AKEIALSYS | | AKEIALSYS | | AKETGNGCFE | | AKLANVVRKMM | |
| AKEIGNGCF | | AKEIGNGCF | | AKEVGNGCFE | | AKLEKSRINGV | |
| AKELGNGCF | | AKELGNGCF | | AKEWGNGCFE | | AKLERSKINEV | |
| AKELVETNH | | AKELVETNH | | AKFEAVAWSA | | AKLERSKINGV | |
| AKEMGNGCF | | AKEMGNGCF | | AKFESVAWSA | | AKLLVLIENDR | |
| AKEQTALYK | | AKEQTALYK | | AKGDCYRACF | | AKLLVLLENDK | |
| AKEQTTLYK | | AKEQTTLYK | | AKGDKICLGH | | AKLLVLLENDR | |
| AKETGNGCF | | AKETGNGCF | | AKGECYRACF | | AKLLVLLENGR | |
| AKEVALGYS | | AKEVALGYS | | AKGEKANVLI | | AKNILEKTHNG | |
| AKEVALSYS | | AKEVALSYS | | AKGLFGAIAG | | AKNILRTQESE | |
| AKEVGNGCF | | AKEVGNGCF | | AKGSYNNTNG | | AKRSYNNTSGE | |
| AKEVSLSYS | | AKEVSLSYS | | AKGSYNNTSG | | AKSITQTLVSN | |
| AKEWGNGCF | | AKEWGNGCF | | AKHIEECSCY | | AKSLTQTLVSN | |
| AKFEAVAWS | | AKFEAVAWS | | AKHIEECSSY | | AKSVFNCLYAS | |
| AKFESVAWS | | AKFESVAWS | | AKHVEECSCY | | AKSVFNNLYAS | |
| AKGDCYRAC | | AKGDCYRAC | | AKILTSESQL | | AKSVFNSIYAS | |
| AKGDKICLG | | AKGDKICLG | | AKLANVVRKM | | AKSVFNSLYAS | |
| AKGECYRAC | | AKGECYRAC | | AKLEKSRING | | AKSVFNSLYSS | |
| AKGEKANVL | | AKGEKANVL | | AKLERSKINE | | AKSVTQTLVSN | |
| AKGLFGAIA | | AKGLFGAIA | | AKLERSKING | | AKYVEWTSNSL | |
| AKGSYNNTN | | AKGSYNNTN | | AKLLVLIEND | | AKYVWWASNSL | |
| AKGSYNNTS | | AKGSYNNTS | | AKLLVLLEND | | AKYVWWTSNSL | |
| AKHIEECSC | | AKHIEECSC | | AKLLVLLENE | | ALALSHTAYSQ | |
| AKHIEECSS | | AKHIEECSS | | AKLLVLLENG | | ALANTIEIFRS | |
| AKHVEECSC | | AKHVEECSC | | AKNILEKTHN | | ALANTIEVFKS | |
| AKILTSESQ | | AKILTSESQ | | AKNILRTQES | | ALANTIEVFRA | |
| AKKASLRLA | | AKKASLRLA | | AKRSYNNTSG | | ALANTIEVFRL | |
| AKLANVVRK | | AKLANVVRK | | AKSITQTLVS | | ALANTIEVFRS | |
| AKLEKSRIN | | AKLEKSRIN | | AKSLTQTLVS | | ALAQGALLGTK | |
| AKLERSKIN | | AKLERSKIN | | AKSVFNCLYA | | ALAQGALLGTN | |
| AKLLVLIEN | | AKLLVLIEN | | AKSVFNNLYA | | ALAQGALLGTR | |
| AKLLVLLEN | | AKLLVLLEN | | AKSVFNSIYA | | ALAQGALVGTK | |
| AKNGICYPG | | AKNGICYPG | | AKSVFNSLYA | | ALAQGVLLGTK | |
| AKNILEKTH | | AKNILEKTH | | AKSVFNSLYS | | ALASCMGLIYN | |
| AKNILRTQE | | AKNILRTQE | | AKSVTQTLVS | | ALCGSKEQLGS | |
| AKRSYNNTS | | AKRSYNNTS | | AKYVEWTSNS | | ALCGSKERLGS | |
| AKSITQTLV | | AKSITQTLV | | AKYVWWASNS | | ALCGSKKRLGS | |
| AKSLTQTLV | | AKSLTQTLV | | AKYVWWTSNS | | ALCGSPFPVGS | |
| AKSVFNCLY | | AKSVFNCLY | | ALALSHTAYS | | ALCGSPISVGS | |
| AKSVFNNLY | | AKSVFNNLY | | ALANTIEIFR | | ALCGSPVPVGS | |
| AKSVFNSIY | | AKSVFNSIY | | ALANTIEVFR | | ALCGSPVSVGS | |
| AKSVFNSLY | | AKSVFNSLY | | ALAQGALLGT | | ALCGSRERLGS | |

Fig. 83-11

| Block size 8 | SIN | Block size 9 | SIN | Block size 10 | SIN | Block size 11 | SIN |
|---|---|---|---|---|---|---|---|
| AKSVTQTLV | | AKSVTQTLV | | ALAQGALVGT | | ALDTGDGCFEI | |
| AKVNTLTER | | AKVNTLTER | | ALAQGTLLGT | | ALENQHIIDVT | |
| AKYVEWTSN | | AKYVEWTSN | | ALAQGVLLGT | | ALENQHTIDLA | |
| AKYVWWASN | | AKYVWWASN | | ALASCMGLIY | | ALENQHTIDLT | |
| AKYVWWTSN | | AKYVWWTSN | | ALCGSKEQLG | | ALENQHTIDMT | |
| ALALSHTAY | | ALALSHTAY | | ALCGSKERLG | | ALENQHTIDVT | |
| ALANTIEIF | | ALANTIEIF | | ALCGSKKRLG | | ALENQHTIHLT | |
| ALANTIEVF | | ALANTIEVF | | ALCGSPFPVG | | ALENQNTIDLT | |
| ALAQGALLG | | ALAQGALLG | | ALCGSPISVG | | ALGDCPKYIKS | |
| ALAQGALVG | | ALAQGALVG | | ALCGSPVPVG | | ALGECPKYIKS | |
| ALAQGTLLG | | ALAQGTLLG | | ALCGSPVSVG | | ALGIINLLIGI | |
| ALAQGVLLG | | ALAQGVLLG | | ALCGSRERLG | | ALGLRISSSFS | |
| ALASCMGLI | | ALASCMGLI | | ALDTGDGCFE | | ALGLRNTPSIE | |
| ALCGSKEQL | | ALCGSKEQL | | ALENQHTIDL | | ALGLVCATCEQ | |
| ALCGSKERL | | ALCGSKERL | | ALENQHTIDM | | ALGMKNVPEKI | |
| ALCGSPFPV | | ALCGSPFPV | | ALENQHTIDV | | ALGNCPKYIKS | |
| ALCGSPISV | | ALCGSPISV | | ALENQHTIHL | | ALGQGTTLDNE | |
| ALCGSPVPV | | ALCGSPVPV | | ALENQNTIDL | | ALGQGTTLDNK | |
| ALCGSPVSV | | ALCGSPVSV | | ALFLAFILWA | | ALGQGTTLENK | |
| ALCGSRERL | | ALCGSRERL | | ALGDCPKYIK | | ALGQGTTLNNK | |
| ALDTGDGCF | | ALDTGDGCF | | ALGECPKYIK | | ALGQGTTLYNK | |
| ALENQHTID | | ALENQHTID | | ALGENMAPEK | | ALGSPGCDRLQ | |
| ALENQHTIH | | ALENQHTIH | | ALGIINLLIG | | ALGYSTGALAS | |
| ALENQNTID | | ALENQNTID | | ALGLRISSSF | | ALHLLLEVEQE | |
| ALFIGVGNL | | ALFIGVGNL | | ALGLRNTPSI | | ALHQGTTIRNK | |
| ALFLAFILW | | ALFLAFILW | | ALGLVCATCE | | ALHQGTTIRNR | |
| ALFVYSLRK | | ALFVYSLRK | | ALGMKNVPEK | | ALILGFVLWAC | |
| ALGDCPKYI | | ALGDCPKYI | | ALGNCPKYIK | | ALILRGAVAHK | |
| ALGECPKYI | | ALGECPKYI | | ALGQGTTLDN | | ALILRGSIAHK | |
| ALGENMAPE | | ALGENMAPE | | ALGQGTTLEN | | ALILRGSVAHK | |
| ALGIINLLI | | ALGIINLLI | | ALGQGTTLKN | | ALILVALALSH | |
| ALGLRISSS | | ALGLRISSS | | ALGQGTTLNN | | ALISWEMGLAP | |
| ALGLRNTPS | | ALGLRNTPS | | ALGQGTTLSN | | ALISWEMGQAP | |
| ALGLVCATC | | ALGLVCATC | | ALGQGTTLYN | | ALISWGMGQAP | |
| ALGMKNVPE | | ALGMKNVPE | | ALGSPGCDHL | | ALISWPLSSPP | |
| ALGNCPKYI | | ALGNCPKYI | | ALGSPGCDRL | | ALISWPQSSPP | |
| ALGQGTTLD | | ALGQGTTLD | | ALGYSTGALA | | ALIVWGVHHSS | |
| ALGQGTTLE | | ALGQGTTLE | | ALHQGTTIRN | | ALKDNLEPGTF | |
| ALGQGTTLK | | ALGQGTTLK | | ALIIWGIHHS | | ALKMTIASDIL | |
| ALGQGTTLN | | ALGQGTTLN | | ALIIWGVHHS | | ALLAKSVFNSL | |
| ALGQGTTLS | | ALGQGTTLS | | ALILGFVLWA | | ALLGTKHSNGT | |
| ALGQGTTLY | | ALGQGTTLY | | ALILRGAVAH | | ALLGTNHSNGT | |
| ALGSPGCDH | | ALGSPGCDH | | ALILRGSIAH | | ALLGTRHSNGT | |
| ALGSPGCDR | | ALGSPGCDR | | ALILRGSVAH | | ALLIAFVLWAC | |
| ALGYSTGAL | | ALGYSTGAL | | ALILVALALS | | ALLKHRFEIIE | |
| ALHQGTTIR | | ALHQGTTIR | | ALISWEMGLA | | ALLLAFILWAC | |
| ALIDDRSKP | | ALIDDRSKP | | ALISWEMGQA | | ALLLAFMLWAC | |
| ALIIGVGNL | | ALIIGVGNL | | ALISWGMGQA | | ALLLAFVLWAC | |
| ALIIWGIHH | | ALIIWGIHH | | ALISWPLSSP | | ALLLTFILWAC | |
| ALIIWGVHH | | ALIIWGVHH | | ALISWPQSSP | | ALLNASCAAMD | |
| ALILGFVLW | | ALILGFVLW | | ALIVWGIHHS | | ALLNASCAAME | |
| ALILRGAVA | | ALILRGAVA | | ALIVWGVHHS | | ALLNDKHSNET | |
| ALILRGSIA | | ALILRGSIA | | ALKDNLEPGT | | ALLNDKHSNGS | |
| ALILRGSVA | | ALILRGSVA | | ALKMTIASDI | | ALLNDKHSNGT | |
| ALILVALAL | | ALILVALAL | | ALLGTKHSNG | | ALLNDKHSNNT | |
| ALISWEMGL | | ALISWEMGL | | ALLGTNHSNG | | ALLNDRHSNGT | |
| ALISWEMGQ | | ALISWEMGQ | | ALLGTRHSNG | | ALLNRLNINPV | |
| ALISWGMGQ | | ALISWGMGQ | | ALLIAFVLWA | | ALLNRLNINSV | |
| ALISWPLSS | | ALISWPLSS | | ALLKHRFEII | | ALLNRLSINPV | |
| ALISWPQSS | | ALISWPQSS | | ALLLAFILWA | | ALLSRLNINPV | |
| ALITWGIHH | | ALITWGIHH | | ALLLAFMLWA | | ALMEWIKTRPI | |
| ALIVWGIHH | | ALIVWGIHH | | ALLLAFVLWA | | ALMEWLKTRPI | |

Fig. 83-12

| Block size 8 | SIN | Block size 9 | SIN | Block size 10 | SIN | Block size 11 | SIN |
|---|---|---|---|---|---|---|---|
| ALIVWGVHH | | ALIVWGVHH | | ALLNASCAAM | | ALMSVLLGSSP | |
| ALKDNLEPG | | ALKDNLEPG | | ALLNDKHSNE | | ALMSVPLGSSP | |
| ALKLSIEDP | | ALKLSIEDP | | ALLNDKHSNG | | ALMSVPLGSSS | |
| ALKLVVAML | | ALKLVVAML | | ALLNDKHSNN | | ALNEITTKINN | |
| ALKMTIASD | | ALKMTIASD | | ALLNDRHSNG | | ALNGNGDPNNM | |
| ALLEESHPG | | ALLEESHPG | | ALLNRININP | | ALNTTLPFHNI | |
| ALLGDPHCD | | ALLGDPHCD | | ALLNRLNINP | | ALNYHYEECSC | |
| ALLGDPQCD | | ALLGDPQCD | | ALLNRLNINS | | ALQGTKRSYEQ | |
| ALLGTKHSN | | ALLGTKHSN | | ALLNRLSINP | | ALQLFIKDYRY | |
| ALLGTNHSN | | ALLGTNHSN | | ALMEWIKTRP | | ALQLLFEVEQE | |
| ALLGTRHSN | | ALLGTRHSN | | ALMEWLKTRP | | ALQLLLEVENE | |
| ALLIAFVLW | | ALLIAFVLW | | ALMSVLLGSS | | ALQLLLEVEQE | |
| ALLIGIGNL | | ALLIGIGNL | | ALMSVPLGSS | | ALQLLLEVESE | |
| ALLIGVGNL | | ALLIGVGNL | | ALNEITTKIN | | ALQLNPIDGPL | |
| ALLKHRFEI | | ALLKHRFEI | | ALNGNGDPNN | | ALQNRIMINPV | |
| ALLLAFILW | | ALLLAFILW | | ALNTTLPFHN | | ALRDNLEPGTF | |
| ALLLAFMLW | | ALLLAFMLW | | ALQGTKRSYE | | ALRDSLEPGTF | |
| ALLLAFVLW | | ALLLAFVLW | | ALQLFIKDYR | | ALRELWQCYYL | |
| ALLNASCAA | | ALLNASCAA | | ALQLLFEVEQ | | ALRMKWMMAMK | |
| ALLNDKHSN | | ALLNDKHSN | | ALQLLLEVEN | | ALRMKWMMAMR | |
| ALLNDRHSN | | ALLNDRHSN | | ALQLLLEVEQ | | ALRQIIRESGG | |
| ALLNRLNIN | | ALLNRLNIN | | ALQLLLEVES | | ALRQKIMESGE | |
| ALLNRLSIN | | ALLNRLSIN | | ALQLNPIDGP | | ALRQKIMESGG | |
| ALLPFDIDK | | ALLPFDIDK | | ALQNRIMINP | | ALSGNGDPNNM | |
| ALLPFDIDR | | ALLPFDIDR | | ALRDNLEPGT | | ALSGVAIALSI | |
| ALLSRLNIN | | ALLSRLNIN | | ALRDSLEPGT | | ALSGVAIALSV | |
| ALLVGIGNL | | ALLVGIGNL | | ALRELWQCYY | | ALSHTAYSQIT | |
| ALMEWIKTR | | ALMEWIKTR | | ALRMKWMMAM | | ALSIAPIMFSN | |
| ALMEWLKTR | | ALMEWLKTR | | ALRQIIRESG | | ALSILNLLIGI | |
| ALMSCPIGE | | ALMSCPIGE | | ALRQKIMESG | | ALSIYSCIASS | |
| ALMSCPLGE | | ALMSCPLGE | | ALSGNGDPNN | | ALSQGTTIRGK | |
| ALMSVPLGS | | ALMSVPLGS | | ALSGVAIALS | | ALSQGTTIRGR | |
| ALMSVPMGS | | ALMSVPMGS | | ALSHTAYSQI | | ALSQGTTLKGR | |
| ALNEITTKI | | ALNEITTKI | | ALSIAPIMFS | | ALSQGTTLRGQ | |
| ALNGNGDPN | | ALNGNGDPN | | ALSILNLLIG | | ALSQGTTLRGR | |
| ALNNRFQIK | | ALNNRFQIK | | ALSIYSCIAS | | ALSVLNLLIGI | |
| ALNNRSQIK | | ALNNRSQIK | | ALSQGALLGT | | ALSVLNLLIGV | |
| ALNTTLPFH | | ALNTTLPFH | | ALSQGTTIRG | | ALSYSAGALAS | |
| ALQGTKRSY | | ALQGTKRSY | | ALSQGTTLKG | | ALSYSTGALAS | |
| ALQLFIKDY | | ALQLFIKDY | | ALSQGTTLRG | | ALTGGQSFYRS | |
| ALQLLFEVE | | ALQLLFEVE | | ALSVLNLLIG | | ALTLNTMTKDA | |
| ALQLLLEVE | | ALQLLLEVE | | ALSYSAGALA | | ALVGTKHSNGT | |
| ALQLNPIDG | | ALQLNPIDG | | ALSYSTGALA | | ALVRGQQGRMD | |
| ALQNRIMIN | | ALQNRIMIN | | ALTGGQSFYR | | ALVRSGMDPRM | |
| ALRDNLEPG | | ALRDNLEPG | | ALTLNTMTKD | | ALVRTGMDPRM | |
| ALRDSLEPG | | ALRDSLEPG | | ALVGTKHSNG | | ALVSWEMGQAP | |
| ALRELWQCY | | ALRELWQCY | | ALVIWGVHHS | | ALVSWPLSSPP | |
| ALRMKWMMA | | ALRMKWMMA | | ALVRGQQGRM | | ALYGTQSLSIS | |
| ALRQIIRES | | ALRQIIRES | | ALVRSGMDPR | | ALYKNANTLSS | |
| ALRQKIMES | | ALRQKIMES | | ALVRTGMDPR | | AMASQGTKRSF | |
| ALSGMAIAL | | ALSGMAIAL | | ALVSWEMGQA | | AMASQGTKRSY | |
| ALSGNGDPN | | ALSGNGDPN | | ALVSWPLSSP | | AMDAGNGCFDI | |
| ALSGVAIAL | | ALSGVAIAL | | ALYGTQSLSI | | AMDDFQLIPII | |
| ALSGVAISL | | ALSGVAISL | | ALYKNANTLS | | AMDDFQLIPMI | |
| ALSGVAVAL | | ALSGVAVAL | | AMAFLEDSHP | | AMDDYQLIPMI | |
| ALSHTAYSQ | | ALSHTAYSQ | | AMAFLEESHP | | AMDEFQLIPMI | |
| ALSIAPIMF | | ALSIAPIMF | | AMAFLEKSHP | | AMDGVTNKVNS | |
| ALSILNLLI | | ALSILNLLI | | AMAFLENSHP | | AMDHTSQYLCT | |
| ALSINELGN | | ALSINELGN | | AMALLEESHP | | AMEDFQLIPMI | |
| ALSINELSK | | ALSINELSK | | AMASQGTKRS | | AMEHTSQYLCT | |
| ALSINELSN | | ALSINELSN | | AMDAGNGCFD | | AMELIRMIKRG | |
| ALSINELSS | | ALSINELSS | | AMDDFQLIPM | | AMENQHTIDLA | |

Fig. 83-13

| Block size 8 | SIN | Block size 9 | SIN | Block size 10 | SIN | Block size 11 | SIN |
|---|---|---|---|---|---|---|---|
| ALSISELSN | | ALSISELSN | | AMDEFQLIPM | | AMENQHTIDLT | |
| ALSIYSCIA | | ALSIYSCIA | | AMDGVTNKVN | | AMENQHTIDMA | |
| ALSNRFQIK | | ALSNRFQIK | | AMDHTSQYLC | | AMENQHTIDMG | |
| ALSQGALLG | | ALSQGALLG | | AMEDFQLIPM | | AMEQIAGSSEQ | |
| ALSQGTTIR | | ALSQGTTIR | | AMEHTSQYLC | | AMEQMAGSSEQ | |
| ALSQGTTLR | | ALSQGTTLR | | AMELIRMIKR | | AMEQVAGSSEQ | |
| ALSVLNLLI | | ALSVLNLLI | | AMELVEAEKH | | AMGLIFMCVKN | |
| ALSYSAGAL | | ALSYSAGAL | | AMENQHIIDL | | AMGLKISSSFS | |
| ALSYSTGAL | | ALSYSTGAL | | AMENQHTIDL | | AMGLRISSSFS | |
| ALTDDKSKP | | ALTDDKSKP | | AMENQHTIDM | | AMGLVFICIKN | |
| ALTDDRSKP | | ALTDDRSKP | | AMEQMAGSSE | | AMGLVFICMKN | |
| ALTDERSKP | | ALTDERSKP | | AMEQVAGSSE | | AMGLVFICVKN | |
| ALTDNRSKP | | ALTDNRSKP | | AMGLIFMCVK | | AMGLVFMCVKN | |
| ALTGGQSFY | | ALTGGQSFY | | AMGLKISSSF | | AMGMRISSSFS | |
| ALTLNTMTK | | ALTLNTMTK | | AMGLRISSSF | | AMISRARIDAR | |
| ALVGTKHSN | | ALVGTKHSN | | AMGLVFICIK | | AMKHTSQYICS | |
| ALVIWGVHH | | ALVIWGVHH | | AMGLVFICMK | | AMKHTSQYLCT | |
| ALVRGQQGR | | ALVRGQQGR | | AMGLVFICVK | | AMLCLGHHAVP | |
| ALVRSGMDP | | ALVRSGMDP | | AMGLVFMCVK | | AMLNASCAAMD | |
| ALVRTGMDP | | ALVRTGMDP | | AMGMRISSSF | | AMMDQVREGRN | |
| ALVSWEMGQ | | ALVSWEMGQ | | AMISRARIDA | | AMMDQVRESRN | |
| ALVSWPLSS | | ALVSWPLSS | | AMKHTSQYIC | | AMMSRARIDAR | |
| ALYGTQSLS | | ALYGTQSLS | | AMKHTSQYLC | | AMQNRIQIDPV | |
| ALYKNANTL | | ALYKNANTL | | AMLNASCAAM | | AMTEIWSYNAE | |
| AMAFLEDSH | | AMAFLEDSH | | AMMDQVREGR | | AMTEVWSYNAE | |
| AMAFLEESH | | AMAFLEESH | | AMMDQVRESR | | AMTHTSQYICS | |
| AMAFLEKSH | | AMAFLEKSH | | AMMSRARIDA | | AMVDQVRESRN | |
| AMAFLENSH | | AMAFLENSH | | AMQNRIQIDP | | AMVSRARIDAR | |
| AMALLEESH | | AMALLEESH | | AMTEIWSYNA | | ANCYPGATVNE | |
| AMASQGTKR | | AMASQGTKR | | AMTEVWSYNA | | ANDLGNGCFEF | |
| AMDAGNGCF | | AMDAGNGCF | | AMTHTSQYIC | | ANELGNGCFEF | |
| AMDDFQLIP | | AMDDFQLIP | | AMVDQVRESR | | ANFSMELPSFG | |
| AMDEFQLIP | | AMDEFQLIP | | AMVFSQEDCM | | ANGTIHDRSPF | |
| AMDHTSQYL | | AMDHTSQYL | | AMVFSQEDCV | | ANGTIHDRSPY | |
| AMEDFQLIP | | AMEDFQLIP | | AMVFSQEECM | | ANGTIHDRSQF | |
| AMEHTSQYL | | AMEHTSQYL | | AMVSRARIDA | | ANGTINDRSPF | |
| AMELIRMIK | | AMELIRMIK | | ANCYPGATVN | | ANGTKVNTLTE | |
| AMELVEAEK | | AMELVEAEK | | ANDLGNGCFE | | ANGTMHDRSPF | |
| AMENQHTID | | AMENQHTID | | ANFSMELPSF | | ANGWVSTDKDS | |
| AMEQMAGSS | | AMEQMAGSS | | ANGTIHDRSP | | ANGWVSTDKNS | |
| AMEQVAGSS | | AMEQVAGSS | | ANGTIHDRSQ | | ANGWVSTDKSS | |
| AMGLIFMCV | | AMGLIFMCV | | ANGTINDRSP | | ANINFMPYISF | |
| AMGLKISSS | | AMGLKISSS | | ANGTIVKTLT | | ANKLYVNKNPY | |
| AMGLRISSS | | AMGLRISSS | | ANGTKVNTLT | | ANKQASYKIFK | |
| AMGLVFICI | | AMGLVFICI | | ANGTMHDRSP | | ANLCRFLETRT | |
| AMGLVFICM | | AMGLVFICM | | ANGWVSTDKD | | ANLGLNIGLHL | |
| AMGLVFICV | | AMGLVFICV | | ANGWVSTDKN | | ANLGLNVGLHL | |
| AMGLVFMCV | | AMGLVFMCV | | ANGWVSTDKS | | ANNADHRIYWI | |
| AMGMRISSS | | AMGMRISSS | | ANINFMPYIS | | ANNADHRVYWI | |
| AMISRARID | | AMISRARID | | ANIRNNTYDH | | ANNDWSGYSGS | |
| AMKHTSQYI | | AMKHTSQYI | | ANKLYVNKNP | | ANNGKFEFIAE | |
| AMKHTSQYL | | AMKHTSQYL | | ANKQASYKIF | | ANNGKFEFIVE | |
| AMKYPITAD | | AMKYPITAD | | ANLCRFLETR | | ANNGKLEFIAE | |
| AMKYPITAE | | AMKYPITAE | | ANLGLNIGIH | | ANNGRFEFIAE | |
| AMKYPITAN | | AMKYPITAN | | ANLGLNIGLH | | ANNQASYKIFK | |
| AMLGDPHCD | | AMLGDPHCD | | ANLGLNVGLH | | ANNQASYRIFK | |
| AMLNASCAA | | AMLNASCAA | | ANNADHRIYW | | ANNSKKQIDTI | |
| AMMDQVREG | | AMMDQVREG | | ANNADHRVYW | | ANNSPEQVDTI | |
| AMMDQVRES | | AMMDQVRES | | ANNGKFEFIA | | ANNSTDTVDTI | |
| AMMSRARID | | AMMSRARID | | ANNGKFEFIV | | ANNSTDTVDTV | |
| AMQNRIQID | | AMQNRIQID | | ANNGKLEFIA | | ANNSTEHVDTI | |
| AMRAIGTHP | | AMRAIGTHP | | ANNGRFEFIA | | ANNSTEQVDTI | |

Fig. 83-14

| Block size 8 | SIN | Block size 9 | SIN | Block size 10 | SIN | Block size 11 | SIN |
|---|---|---|---|---|---|---|---|
| AMRAVGTHP | | AMRAVGTHP | | ANNQASYKIF | | ANNSTERVDTI | |
| AMRTIGTHP | | AMRTIGTHP | | ANNQASYRIF | | ANNSTKQIDTI | |
| AMRTIGTQP | | AMRTIGTQP | | ANNSKKQIDT | | ANNSTKQVDTI | |
| AMRTVGTHP | | AMRTVGTHP | | ANNSTDTIDT | | ANNSTTKVDTI | |
| AMRYPITAD | | AMRYPITAD | | ANNSTDTVDT | | ANNSTTQIDTI | |
| AMTEIWSYN | | AMTEIWSYN | | ANNSTEHVDT | | ANNSTTQVDTI | |
| AMTEVWSYN | | AMTEVWSYN | | ANNSTEQVDT | | ANNSTTQVDTL | |
| AMTHTSQYI | | AMTHTSQYI | | ANNSTERVDT | | ANNSTTQVNTI | |
| AMVDQVRES | | AMVDQVRES | | ANNSTETVDT | | ANNSTVQVDTI | |
| AMVFSQEDC | | AMVFSQEDC | | ANNSTKQIDT | | ANQRLNPMHQL | |
| AMVFSQEEC | | AMVFSQEEC | | ANNSTKQVDT | | ANQRLNTMHQL | |
| AMVSRARID | | AMVSRARID | | ANNSTTKVDT | | ANQVFPQLNQT | |
| ANDLGNGCF | | ANDLGNGCF | | ANNSTTQIDT | | ANRPIIEIDMN | |
| ANEESLRQI | | ANEESLRQI | | ANNSTTQVDT | | ANRPIIEIDMS | |
| ANEIRASVG | | ANEIRASVG | | ANNSTTQVNT | | ANRPIIEIDMT | |
| ANFSMELPS | | ANFSMELPS | | ANNSTVQVDT | | ANRPVIEIDMN | |
| ANGTIHDRS | | ANGTIHDRS | | ANQRLNPMHQ | | ANRPVIEIDMS | |
| ANGTINDRS | | ANGTINDRS | | ANQRLNTMHQ | | ANSADHRIYWI | |
| ANGTIVKTL | | ANGTIVKTL | | ANQSLPPNFS | | ANSADHRVYWI | |
| ANGTKVNTL | | ANGTKVNTL | | ANQVFPQLNQ | | ANSEMNKLYER | |
| ANGTMHDRS | | ANGTMHDRS | | ANRPIIEIDM | | ANSQASYKIFK | |
| ANGTVVKTL | | ANGTVVKTL | | ANRPIIEINM | | ANTLSSVNTNT | |
| ANGVKGFSF | | ANGVKGFSF | | ANRPVIEIDM | | ANTLSSVTTNT | |
| ANGVKGFSY | | ANGVKGFSY | | ANRPVIEINM | | ANTLTSVTTNT | |
| ANGWVSTDK | | ANGWVSTDK | | ANRPVIKIDM | | ANVKNLHDQIK | |
| ANGWVTADK | | ANGWVTADK | | ANRPWVSFNQ | | ANVKNLHEQVK | |
| ANINFMPYI | | ANINFMPYI | | ANSADHRIYW | | ANVKNLHEQVR | |
| ANIRNNTYD | | ANIRNNTYD | | ANSADHRVYW | | ANVLIGQGDIV | |
| ANKLYVNKN | | ANKLYVNKN | | ANSAHHRVYW | | ANVLIGQGDVV | |
| ANKQASYKI | | ANKQASYKI | | ANSEMNKLYE | | ANVRNLHDQIK | |
| ANLCRFLET | | ANLCRFLET | | ANSIIVFCGT | | ANVRNLHDQIR | |
| ANLGLNIGI | | ANLGLNIGI | | ANSQASYKIF | | ANVRNLHDQVK | |
| ANLGLNIGL | | ANLGLNIGL | | ANTIEIFRSN | | ANVRNLHDQVR | |
| ANLGLNVGL | | ANLGLNVGL | | ANTIEVFKSN | | ANVRNLHDRIR | |
| ANNADHRIY | | ANNADHRIY | | ANTIEVFRLN | | ANVRNLHDRTR | |
| ANNADHRVY | | ANNADHRVY | | ANTIEVFRSN | | ANVRNLHDRVK | |
| ANNGKFEFI | | ANNGKFEFI | | ANTLSSVNTN | | ANVRNLHDRVR | |
| ANNGRFEFI | | ANNGRFEFI | | ANTLSSVTTN | | ANVRNLHEQIK | |
| ANNQASYKI | | ANNQASYKI | | ANTLTSVTTN | | ANVRNLHEQVR | |
| ANNQASYRI | | ANNQASYRI | | ANVKNLHDQI | | ANVRNLHERIR | |
| ANNSKKQID | | ANNSKKQID | | ANVKNLHEQV | | ANVVRKMMTNS | |
| ANNSTDTID | | ANNSTDTID | | ANVLIGQGDI | | ANVVRKMMTSS | |
| ANNSTDTVD | | ANNSTDTVD | | ANVLIGQGDV | | APDRATFLRSN | |
| ANNSTEHVD | | ANNSTEHVD | | ANVRNLHDQI | | APDYHYEECSC | |
| ANNSTEQVD | | ANNSTEQVD | | ANVRNLHDQV | | APEFGYLLKGE | |
| ANNSTERVD | | ANNSTERVD | | ANVRNLHDRI | | APEFGYLLRGE | |
| ANNSTETVD | | ANNSTETVD | | ANVRNLHDRT | | APEGMCYPGFV | |
| ANNSTKQID | | ANNSTKQID | | ANVRNLHDRV | | APEGMCYPGSI | |
| ANNSTKQVD | | ANNSTKQVD | | ANVRNLHEQI | | APEGMCYPGSV | |
| ANNSTTKVD | | ANNSTTKVD | | ANVRNLHEQV | | APEYGFKISKR | |
| ANNSTTQID | | ANNSTTQID | | ANVRNLHERI | | APEYGFRISKR | |
| ANNSTTQVD | | ANNSTTQVD | | ANVVRKMMTN | | APEYGHLITGK | |
| ANNSTTQVN | | ANNSTTQVN | | ANVVRKMMTS | | APEYGHLTTGK | |
| ANNSTVQVD | | ANNSTVQVD | | ANWSWHDGAI | | APEYGHLVTGK | |
| ANPIVPSFD | | ANPIVPSFD | | ANYSLPPNFS | | APEYGYLITGK | |
| ANQRLNPMH | | ANQRLNPMH | | APACDLHLTG | | APFAKDNSIRL | |
| ANQRLNTMH | | ANQRLNTMH | | APDRASFFKG | | APFDDRLRRDQ | |
| ANQSLPPNF | | ANQSLPPNF | | APDRASFFRG | | APFIDRLRRDQ | |
| ANQVFPQLN | | ANQVFPQLN | | APDRASFLRG | | APFISCSYLEC | |
| ANRPAIEID | | ANRPAIEID | | APDRATFLRS | | APFLDRIRRDQ | |
| ANRPIIEID | | ANRPIIEID | | APDYHYEECS | | APFLDRLRRDQ | |
| ANRPIITID | | ANRPIITID | | APEFGYLLKG | | APFLDRVRRDQ | |

Fig. 83-15

| Block size 8 | SIN | Block size 9 | SIN | Block size 10 | SIN | Block size 11 | SIN |
|---|---|---|---|---|---|---|---|
| ANRPIITIN | | ANRPIITIN | | APEFGYLLRG | | APFSEDNSIRL | |
| ANRPVIEID | | ANRPVIEID | | APEGMCYPGF | | APFSKDNGIRI | |
| ANRPVIEIN | | ANRPVIEIN | | APEGMCYPGS | | APFSKDNSIQL | |
| ANRPVIIID | | ANRPVIIID | | APEWSYIVEK | | APFSKDNSIRL | |
| ANRPVIKID | | ANRPVIKID | | APEYGFKISK | | APFSKDNSVRL | |
| ANRPVITID | | ANRPVITID | | APEYGFRISK | | APGFHFEECSC | |
| ANRPVITIN | | ANRPVITIN | | APEYGHLITG | | APGIKGFGFLN | |
| ANRPWVSFN | | ANRPWVSFN | | APEYGHLTTG | | APGTKGFGFLN | |
| ANSADHRIY | | ANSADHRIY | | APEYGHLVTG | | APGVKGFGFLD | |
| ANSADHRVY | | ANSADHRVY | | APEYGYLITG | | APGVKGFGFLN | |
| ANSAHHRVY | | ANSAHHRVY | | APFAKDNSIR | | APGWSWDDGAI | |
| ANSIIVFCG | | ANSIIVFCG | | APFDDRLRRD | | APHGLCYPGEL | |
| ANSQASYKI | | ANSQASYKI | | APFIDRLRRD | | APHRLCYPGEL | |
| ANSQAYTKV | | ANSQAYTKV | | APFISCSYLE | | APIEHIASIRR | |
| ANTIEIFRS | | ANTIEIFRS | | APFLDRIRRD | | APIEHIASMRR | |
| ANTIEVFKS | | ANTIEVFKS | | APFLDRLRRD | | APIEHVASMRR | |
| ANTIEVFRL | | ANTIEVFRL | | APFSKDNGIR | | APIEYIASMRR | |
| ANTIEVFRS | | ANTIEVFRS | | APFSKDNSIQ | | APIEYVASMRR | |
| ANTLSSVNT | | ANTLSSVNT | | APFSKDNSIR | | APILGNYKEIC | |
| ANTLSSVTT | | ANTLSSVTT | | APFSKDNSVR | | APIMFSNKMAK | |
| ANTLTSVTT | | ANTLTSVTT | | APGFHFEECS | | APIMFSNKMAR | |
| ANTYRNTDS | | ANTYRNTDS | | APGIKGFGFL | | APIMFSNKVAR | |
| ANVKNLHDQ | | ANVKNLHDQ | | APGTKGFGFL | | APISLGDCSFA | |
| ANVKNLHEQ | | ANVKNLHEQ | | APGVKGFGFL | | APISLGGCSFA | |
| ANVLIGQGD | | ANVLIGQGD | | APGWSWDDGA | | APKYGYIIEEY | |
| ANVRNLHDQ | | ANVRNLHDQ | | APGYAFEIVS | | APLELRDCKIE | |
| ANVRNLHDR | | ANVRNLHDR | | APHGLCYPGE | | APLELRDCKVE | |
| ANVRNLHEQ | | ANVRNLHEQ | | APHKLCFPGE | | APLMMAYMLER | |
| ANVRNLHER | | ANVRNLHER | | APHKLCYPGE | | APLMVAYMLER | |
| ANVVRKMMT | | ANVVRKMMT | | APHRLCYPGE | | APLSKDNGIRI | |
| ANWSWHDGA | | ANWSWHDGA | | APIEHIASIR | | APLVLDDCSLE | |
| ANYSLPPNF | | ANYSLPPNF | | APIEHIASMR | | APNFHYEECSC | |
| APACDLHLT | | APACDLHLT | | APIEHVASMR | | APNFYYEECSC | |
| APDRASFFK | | APDRASFFK | | APIEYIASMR | | APNSHYEECSC | |
| APDRASFFR | | APDRASFFR | | APIEYVASMR | | APNYHYEECSC | |
| APDRASFLR | | APDRASFLR | | APILGNYKEI | | APNYYYEECSC | |
| APDRATFLR | | APDRATFLR | | APIMFSNKMA | | APQLNPIDGPL | |
| APDYHYEEC | | APDYHYEEC | | APISLGDCSF | | APRGHYKISKS | |
| APEFGYLLK | | APEFGYLLK | | APKYGYIIEE | | APRYGYIIEEY | |
| APEFGYLLR | | APEFGYLLR | | APLELRDCKI | | APRYGYIIEKY | |
| APEGMCYPG | | APEGMCYPG | | APLELRDCKV | | APSGIEYNGKS | |
| APEWSYIVE | | APEWSYIVE | | APLMMAYMLE | | APSGVEYNGKS | |
| APEYGFKIS | | APEYGFKIS | | APLMVAYMLE | | APSPSNSRFES | |
| APEYGFRIS | | APEYGFRIS | | APLSKDNGIR | | APSPYNSKFES | |
| APEYGHLIT | | APEYGHLIT | | APLVLDDCSL | | APSPYNSRFES | |
| APEYGHLTT | | APEYGHLTT | | APNFHYEECS | | APVLGNYKEIC | |
| APEYGHLVT | | APEYGHLVT | | APNFYYEECS | | APVLGNYKEMC | |
| APEYGYLIT | | APEYGYLIT | | APNKFCYPGE | | APVLGNYREIC | |
| APFAKDNSI | | APFAKDNSI | | APNKLCFPGE | | APVLGNYREVC | |
| APFDDRLRR | | APFDDRLRR | | APNKLCYPGE | | AQAFYKILKIK | |
| APFISCSYL | | APFISCSYL | | APNRASFFRG | | AQAFYKILKIR | |
| APFLDRIRR | | APFLDRIRR | | APNSHYEECS | | AQDILEKTHNG | |
| APFLDRLRR | | APFLDRLRR | | APNYHYEECS | | AQDILERTHNG | |
| APFSKDNGI | | APFSKDNGI | | APNYYYEECS | | AQDNAIRFGES | |
| APFSKDNSI | | APFSKDNSI | | APPEQSKMQF | | AQDVIMEVVFP | |
| APFSKDNSV | | APFSKDNSV | | APPEQSRMQF | | AQEIGNGCFEF | |
| APFTKDNSI | | APFTKDNSI | | APPKQSRMQF | | AQGALLGTKHS | |
| APGFHFEEC | | APGFHFEEC | | APPVQSKMQF | | AQGALLGTNHS | |
| APGIKGFGF | | APGIKGFGF | | APPVQSRMQF | | AQGALLGTRHS | |
| APGTKGFGF | | APGTKGFGF | | APQLNPIDGP | | AQGALVGTKHS | |
| APGVKGFGF | | APGVKGFGF | | APRGHYKISK | | AQGEGIAADYK | |
| APGWSWDDG | | APGWSWDDG | | APRYAFEIVS | | AQGEGTAADYK | |

Fig. 83-16

| Block size 8 | SIN | Block size 9 | SIN | Block size 10 | SIN | Block size 11 | SIN |
|---|---|---|---|---|---|---|---|
| APGYAFEIV | | APGYAFEIV | | APRYAFELVF | | AQGIGQAADYK | |
| APHGLCYPG | | APHGLCYPG | | APRYAFELVS | | AQGGQGTAADYK | |
| APHKLCFPG | | APHKLCFPG | | APRYGYIIEE | | AQGSGYAADLK | |
| APHKLCYPG | | APHKLCYPG | | APRYGYIIEK | | AQGSYNNTSGE | |
| APHRLCYPG | | APHRLCYPG | | APRYSFELVS | | AQGTGQAADYE | |
| APIEHIASI | | APIEHIASI | | APSCDLHLTG | | AQGTGQAADYK | |
| APIEHIASM | | APIEHIASM | | APSGIEYNGK | | AQGVLLGTKHS | |
| APIEHVASM | | APIEHVASM | | APSGVEYNGK | | AQHIEECSCYG | |
| APIEYIASM | | APIEYIASM | | APSPSNSRFE | | AQHIEECSCYP | |
| APIEYVASM | | APIEYVASM | | APSPYNSKFE | | AQHVEECSCYP | |
| APILGNYKE | | APILGNYKE | | APSPYNSRFE | | AQIDESCEGEC | |
| APIMFSNKM | | APIMFSNKM | | APSRVSKLIG | | AQKAMMDQVRE | |
| APISLGDCS | | APISLGDCS | | APSRVSKLKG | | AQKLEDVFAGK | |
| APKYGYIIE | | APKYGYIIE | | APSRVSKLRG | | AQLLVLLENEK | |
| APLELRDCK | | APLELRDCK | | APSRVSKLTG | | AQLLVWLENEK | |
| APLMMAYML | | APLMMAYML | | APSRVTKLKG | | AQMALQLFIKD | |
| APLMVAYML | | APLMVAYML | | APVLGNYKEI | | AQNAISITFPY | |
| APLSKDNGI | | APLSKDNGI | | APVLGNYREI | | AQNAISTTFPY | |
| APLSKDNSI | | APLSKDNSI | | APVLGNYREV | | AQRAMMDQVRE | |
| APLVLDDCS | | APLVLDDCS | | APYRSLIRFP | | AQRAMVDQVRE | |
| APNFHYEEC | | APNFHYEEC | | AQAFYKILKI | | AQRLEDVFAGK | |
| APNFYYEEC | | APNFYYEEC | | AQDILEKTHN | | AQRLEGVFAGK | |
| APNKFCYPG | | APNKFCYPG | | AQDILERTHN | | AQRLENVFAGK | |
| APNKLCFPG | | APNKLCFPG | | AQDNAIRFGE | | AQRLESVFAGK | |
| APNKLCYPG | | APNKLCYPG | | AQDVIMEVVF | | AQSFYRSINWL | |
| APNRASFFR | | APNRASFFR | | AQGALLGTKH | | AQSLSISVGSS | |
| APNSHYEEC | | APNSHYEEC | | AQGALLGTNH | | AQTDCVLEAMA | |
| APNYHYEEC | | APNYHYEEC | | AQGALLGTRH | | AQYREEALLNR | |
| APNYYYEEC | | APNYYYEEC | | AQGALVGTKH | | ARCICEKLEQS | |
| APPEQSRMQ | | APPEQSRMQ | | AQGEGIAADY | | ARDEGNGCFTF | |
| APPKQSRMQ | | APPKQSRMQ | | AQGEGTAADY | | AREIGNGCFEF | |
| APPVQSKMQ | | APPVQSKMQ | | AQGIGQAADY | | ARELGNGCFEF | |
| APPVQSRMQ | | APPVQSRMQ | | AQGGQGTAADY | | ARFEAVAWSAT | |
| APQLNPIDG | | APQLNPIDG | | AQGSGYAADL | | ARFESVAWSAT | |
| APRGHYKIS | | APRGHYKIS | | AQGSYNNTSG | | ARGDKICLGHH | |
| APRYAFEIV | | APRYAFEIV | | AQGTGLAADY | | ARGEKANVLIG | |
| APRYAFELV | | APRYAFELV | | AQGTGQAADY | | ARGLFGAIAGF | |
| APRYGYIIE | | APRYGYIIE | | AQGVLLGTKH | | ARGSYNNTSGE | |
| APRYSFELV | | APRYSFELV | | AQGYKDIILW | | ARHIEECSCYG | |
| APSCDLHLT | | APSCDLHLT | | AQHIEECSCY | | ARHIEEWSCYG | |
| APSGIEYNG | | APSGIEYNG | | AQHVEECSCY | | ARHVEECSCYG | |
| APSGVEYNG | | APSGVEYNG | | AQIDESCEGE | | ARIDARIDFES | |
| APSPSNSRF | | APSPSNSRF | | AQIIKLLPFA | | ARIDARVDFES | |
| APSPYNSKF | | APSPYNSKF | | AQKAMMDQVR | | ARIDARVDSES | |
| APSPYNSRF | | APSPYNSRF | | AQKLEDVFAG | | ARIGEGQRSWM | |
| APSRVSKLI | | APSRVSKLI | | AQLLVLLENE | | ARIKTRLFTIR | |
| APSRVSKLK | | APSRVSKLK | | AQLLVWLENE | | ARLGKGYMFES | |
| APSRVSKLR | | APSRVSKLR | | AQMALQLFIK | | ARLGRGYMFES | |
| APSRVSKLT | | APSRVSKLT | | AQNAISITFP | | ARLLVLLENDK | |
| APSRVTKLK | | APSRVTKLK | | AQNAISTTFP | | ARLLVLLENEK | |
| APVLGNCKE | | APVLGNCKE | | AQNILEKTHN | | ARLYIWGVHHP | |
| APVLGNYKE | | APVLGNYKE | | AQRAMMDQVR | | ARNICEKLEQS | |
| APVLGNYRE | | APVLGNYRE | | AQRAMVDQVR | | ARNILRTQDSE | |
| APYRSLIRF | | APYRSLIRF | | AQRLEDVFAG | | ARNILRTQESE | |
| AQAFYKILK | | AQAFYKILK | | AQRLEGVFAG | | ARNIVRRAAVS | |
| AQDILEKTH | | AQDILEKTH | | AQRLENVFAG | | ARNIVRRAIVS | |
| AQDILERTH | | AQDILERTH | | AQRLESVFAG | | ARNIVRRATVS | |
| AQDNAIRFG | | AQDNAIRFG | | AQSFYRSINW | | ARPKVNGQAGR | |
| AQDRGLFGA | | AQDRGLFGA | | AQSLSISVGS | | ARPLVNGQSGR | |
| AQDVIMEVV | | AQDVIMEVV | | AQTDCVLEAM | | ARPQVNGQRGR | |
| AQEKNDLYG | | AQEKNDLYG | | AQYREEALLN | | ARPQVNGQSGR | |
| AQGALLGTK | | AQGALLGTK | | ARCICEKLEQ | | ARQEKNPALRM | |

Fig. 83-17

| Block size 8 | SIN | Block size 9 | SIN | Block size 10 | SIN | Block size 11 | SIN |
|---|---|---|---|---|---|---|---|
| AQGALLGTN | | AQGALLGTN | | ARCNTKCQTS | | ARRICEKLEQS | |
| AQGALLGTR | | AQGALLGTR | | ARDEGNGCFT | | ARRIDFHWLFL | |
| AQGALVGTK | | AQGALVGTK | | AREIGNGCFE | | ARRIDFHWLLL | |
| AQGEGIAAD | | AQGEGIAAD | | ARELGNGCFE | | ARRIDFNWLLL | |
| AQGEGTAAD | | AQGEGTAAD | | ARFEAVAWSA | | ARSALILRGAV | |
| AQGIGQAAD | | AQGIGQAAD | | ARFESVAWSA | | ARSALILRGSI | |
| AQGQGTAAD | | AQGQGTAAD | | ARGDKICLGH | | ARSALILRGSV | |
| AQGSGYAAD | | AQGSGYAAD | | ARGEKANVLI | | ARSICEKLEQS | |
| AQGSYNNTS | | AQGSYNNTS | | ARGLFGAIAG | | ARSIVRRATVS | |
| AQGTGQAAD | | AQGTGQAAD | | ARGSYNNTSG | | ARVWWTSNSIV | |
| AQGVLLGTK | | AQGVLLGTK | | ARHIEECSCY | | ASACHDGASWL | |
| AQGYKDIIL | | AQGYKDIIL | | ARHIEEWSCY | | ASACHDGISWL | |
| AQHGICYPG | | AQHGICYPG | | ARHVEECSCY | | ASACHDGSSWL | |
| AQHIEECSC | | AQHIEECSC | | ARIDARIDFE | | ASACHDGTNWL | |
| AQHRSHRQM | | AQHRSHRQM | | ARIDARVDFE | | ASACHDGTSWL | |
| AQHVEECSC | | AQHVEECSC | | ARIDARVDSE | | ASALILRGSVA | |
| AQIDESCEG | | AQIDESCEG | | ARIDFESGRI | | ASCAAMDDFQL | |
| AQIIKLLPF | | AQIIKLLPF | | ARIDFESGRM | | ASCAAMDEFQL | |
| AQKAMMDQV | | AQKAMMDQV | | ARIDFESGRV | | ASCAAMEDFQL | |
| AQKLEDVFA | | AQKLEDVFA | | ARIGEGQRSW | | ASCMGLIYNRM | |
| AQLLVLLEN | | AQLLVLLEN | | ARIITSESQL | | ASCVMLLAIAM | |
| AQLLVWLEN | | AQLLVWLEN | | ARIKTRLFTI | | ASDILKRMSKM | |
| AQMALQLFI | | AQMALQLFI | | ARILASESQL | | ASDILTRMSKM | |
| AQNAISITF | | AQNAISITF | | ARILTSESQL | | ASGDIWITREP | |
| AQNAISTTF | | AQNAISTTF | | ARILTSESQM | | ASGDIWVTREP | |
| AQNGICYPG | | AQNGICYPG | | ARLGKGYMFE | | ASGDVWVTREP | |
| AQNILEKTH | | AQNILEKTH | | ARLGRGYMFE | | ASGKADTRILF | |
| AQNRGLFGA | | AQNRGLFGA | | ARLLVLLEND | | ASGRADTKILF | |
| AQRAMMDQV | | AQRAMMDQV | | ARLYIWGVHH | | ASGRADTRILF | |
| AQRAMVDQV | | AQRAMVDQV | | ARNICEKLEQ | | ASGSSISFCGV | |
| AQRLEDVFA | | AQRLEDVFA | | ARNILRTQDS | | ASICTHLEVCF | |
| AQRLEGVFA | | AQRLEGVFA | | ARNILRTQES | | ASIRNNTYDHN | |
| AQRLENVFA | | AQRLENVFA | | ARNIVRRAAV | | ASIRNNTYDHS | |
| AQRLESVFA | | AQRLESVFA | | ARNIVRRAIV | | ASIRNNTYDHT | |
| AQSFYRSIN | | AQSFYRSIN | | ARNIVRRATV | | ASIRNSTYDHS | |
| AQSLSISVG | | AQSLSISVG | | ARPKVNGQAG | | ASKEPEVHEGE | |
| AQTDCVLEA | | AQTDCVLEA | | ARPKVNGQSG | | ASKNPYTLVST | |
| AQYGICYPG | | AQYGICYPG | | ARPQVNGQRG | | ASLCLAILIAG | |
| AQYREEALL | | AQYREEALL | | ARPQVNGQSG | | ASLCLAILVAG | |
| ARCICEKLE | | ARCICEKLE | | ARQEKNPALR | | ASLCLAVLIAG | |
| ARCNTKCQT | | ARCNTKCQT | | ARRICEKLEQ | | ASLLEMCHGTQ | |
| ARELGNGCF | | ARELGNGCF | | ARRIDFHWLF | | ASLLEMCHSTQ | |
| ARFEAVAWS | | ARFEAVAWS | | ARRIDFNWLL | | ASLLEMCHSTR | |
| ARFESVAWS | | ARFESVAWS | | ARRIDFNWLL | | ASLRLAVGLRN | |
| ARGDKICLG | | ARGDKICLG | | ARSALILRGA | | ASLSPGMMMGM | |
| ARGEKANVL | | ARGEKANVL | | ARSALILRGS | | ASNINIREWSY | |
| ARGLFGAIA | | ARGLFGAIA | | ARSICEKLEQ | | ASNQASYKIFK | |
| ARGSYNNTS | | ARGSYNNTS | | ARSIVRRATV | | ASNSIVTFCGL | |
| ARHIEECPC | | ARHIEECPC | | ARVDFESGRI | | ASNSLIALCGS | |
| ARHIEECSC | | ARHIEECSC | | ARVDSESGRI | | ASPQLEGFSAE | |
| ARHIEEWSC | | ARHIEEWSC | | ARVWWTSNSI | | ASPSCLVVRKS | |
| ARIDARIDF | | ARIDARIDF | | ASACHDGASW | | ASQGTKRPYEQ | |
| ARIDARVDF | | ARIDARVDF | | ASACHDGISW | | ASQGTKRSHEQ | |
| ARIDARVDS | | ARIDARVDS | | ASACHDGSSW | | ASQGTKRSYEQ | |
| ARIDFESGR | | ARIDFESGR | | ASACHDGTNW | | ASQYGPSHSIH | |
| ARIGEGQRS | | ARIGEGQRS | | ASACHDGTSW | | ASRSGFEVLLI | |
| ARIITSESQ | | ARIITSESQ | | ASAGQISIQP | | ASRSGYEILKV | |
| ARIKTRLFT | | ARIKTRLFT | | ASAGQISTQP | | ASRSGYEMLKV | |
| ARILASESQ | | ARILASESQ | | ASAGQISVQP | | ASRSGYEVLRV | |
| ARILTSESQ | | ARILTSESQ | | ASAGQTSVQP | | ASSGIAIALGI | |
| ARLGKGYMF | | ARLGKGYMF | | ASAGQVSVQP | | ASSGIAIVLGI | |
| ARLGRGYMF | | ARLGRGYMF | | ASALILRGSV | | ASSGSLEFIAE | |

Fig. 83-18

| Block size 8 | SIN | Block size 9 | SIN | Block size 10 | SIN | Block size 11 | SIN |
|---|---|---|---|---|---|---|---|
| ARLLVLLEN | | ARLLVLLEN | | ASCAAMDDFQ | | ASSIVLVGLIL | |
| ARLYIWGVH | | ARLYIWGVH | | ASCAAMDEFQ | | ASSIVMVGLIL | |
| ARMTICIQG | | ARMTICIQG | | ASCAAMEDFQ | | ASSKSRARIKT | |
| ARNGICYPG | | ARNGICYPG | | ASCFILLAIA | | ASSLILAAIIM | |
| ARNICEKLE | | ARNICEKLE | | ASCFILLAIV | | ASSLILAALIM | |
| ARNILRTQD | | ARNILRTQD | | ASCFLLLAIA | | ASSLVLAAIIM | |
| ARNILRTQE | | ARNILRTQE | | ASCFLLLAIV | | ASSLVLAALIM | |
| ARNIVRRAA | | ARNIVRRAA | | ASCFLLLAVV | | ASSLVLAALNM | |
| ARNIVRRAI | | ARNIVRRAI | | ASCHDGRAWL | | ASSLVLIVSLG | |
| ARNIVRRAT | | ARNIVRRAT | | ASCMGLIYNR | | ASSLVLLFMII | |
| ARPKVNGQA | | ARPKVNGQA | | ASCVMLLAIA | | ASSLVLLLMII | |
| ARPLVNGQS | | ARPLVNGQS | | ASDILKRMSK | | ASSLVLLVSLG | |
| ARPQVNGQS | | ARPQVNGQS | | ASDILTRMSK | | ASSLVLVVSLG | |
| ARQEKNPAL | | ARQEKNPAL | | ASGDIWITRE | | ASSQLEGFSAE | |
| ARQMVHAMR | | ARQMVHAMR | | ASGDIWVTRE | | ASSSVLLVSLG | |
| ARQMVQAMR | | ARQMVQAMR | | ASGKADTRIL | | ASSTVLVGLIL | |
| ARRICEKLE | | ARRICEKLE | | ASGRADTKIL | | ASSTVMVGLIL | |
| ARRIDFHWL | | ARRIDFHWL | | ASGRADTRIL | | ASSVVLVGLIL | |
| ARRIDFNWL | | ARRIDFNWL | | ASGSSISFCG | | ASSVVLVGPIL | |
| ARRMVQAMR | | ARRMVQAMR | | ASICTHLEVC | | ASTGAQSFYRS | |
| ARSALILRG | | ARSALILRG | | ASIRNNTYDH | | ASTGGQAFYRS | |
| ARSICEKLE | | ARSICEKLE | | ASIRNNTYNH | | ASTGGQSFYRS | |
| ARSIVRRAT | | ARSIVRRAT | | ASIRNSTYDH | | ASTLVLLVSLG | |
| ARVDFESGR | | ARVDFESGR | | ASKEPEVHEG | | ASTNAHDRICI | |
| ARVWWTSNS | | ARVWWTSNS | | ASKNPYTLVS | | ASTNAYDRICI | |
| ASACHDGAS | | ASACHDGAS | | ASLCLAILIA | | ASTQKAIDEIT | |
| ASACHDGIS | | ASACHDGIS | | ASLCLAILVA | | ASTQKAINEIT | |
| ASACHDGSS | | ASACHDGSS | | ASLCLAVLIA | | ASTTAKAMEQM | |
| ASACHDGTN | | ASACHDGTN | | ASLLEMCHGT | | ASTTAKAMEQV | |
| ASACHDGTS | | ASACHDGTS | | ASLLEMCHST | | ASVPASRYLID | |
| ASAGQISIQ | | ASAGQISIQ | | ASLRLAVGLR | | ASVPASRYLTD | |
| ASAGQISTQ | | ASAGQISTQ | | ASLSPGMMMG | | ASWAGNILRTQ | |
| ASAGQISVQ | | ASAGQISVQ | | ASNINIREWS | | ASYKRIRLFDY | |
| ASAGQTSVQ | | ASAGQTSVQ | | ASNQASYKIF | | ASYKRVRLFDY | |
| ASAGQVSVQ | | ASAGQVSVQ | | ASNRPWISFD | | ATACHDGKEWL | |
| ASALILRGS | | ASALILRGS | | ASNRPWVSFD | | ATACHDGKEWM | |
| ASCAAMDDF | | ASCAAMDDF | | ASNRPWVSFN | | ATACHDGKGWL | |
| ASCAAMDEF | | ASCAAMDEF | | ASNSIVTFCG | | ATACHDGKKWI | |
| ASCAAMEDF | | ASCAAMEDF | | ASNSLIALCG | | ATACHDGKKWL | |
| ASCFIFLAI | | ASCFIFLAI | | ASPQLEGFSA | | ATACHDGKKWM | |
| ASCFILLAI | | ASCFILLAI | | ASPSCLVVRK | | ATACHDGKKWT | |
| ASCFILLAV | | ASCFILLAV | | ASQGTKRPYE | | ATACHDGRKWM | |
| ASCFLFLAI | | ASCFLFLAI | | ASQGTKRSHE | | ATACSDGPGWL | |
| ASCFLLIAI | | ASCFLLIAI | | ASQGTKRSYE | | ATACSDGSGWL | |
| ASCFLLLAI | | ASCFLLLAI | | ASQYGPSHSI | | ATALANTIEIF | |
| ASCFLLLAV | | ASCFLLLAV | | ASRAGYEMLK | | ATALANTIEVF | |
| ASCFTLLAI | | ASCFTLLAI | | ASRHHMGECP | | ATAQMALQLFI | |
| ASCFVLLAA | | ASCFVLLAA | | ASRHYMGECP | | ATATVYYDRRL | |
| ASCFVLLAD | | ASCFVLLAD | | ASRSGYEMLK | | ATATVYYERRL | |
| ASCFVLLAI | | ASCFVLLAI | | ASRYGYEMLK | | ATATVYYNGRL | |
| ASCFVLLAV | | ASCFVLLAV | | ASRYYMGECP | | ATATVYYNKRL | |
| ASCHDGRAW | | ASCHDGRAW | | ASSGIAIALG | | ATATVYYNRRL | |
| ASCMGLIYN | | ASCMGLIYN | | ASSGIAIVLG | | ATAVAVLKYNG | |
| ASCVMLLAI | | ASCVMLLAI | | ASSGSLEFIA | | ATAVVVLKYNG | |
| ASDILKRMS | | ASDILKRMS | | ASSISFCGVN | | ATCEQIADAQH | |
| ASDILTRMS | | ASDILTRMS | | ASSIVLVGLI | | ATCEQIADSHH | |
| ASGDIWITR | | ASGDIWITR | | ASSIVMVGLI | | ATCEQIADSQH | |
| ASGDIWVTR | | ASGDIWVTR | | ASSKSRARIK | | ATCVCRDNWQG | |
| ASGKADTRI | | ASGKADTRI | | ASSLILAAII | | ATETVEITGID | |
| ASGKAETRI | | ASGKAETRI | | ASSLILAALI | | ATETVEITGIN | |
| ASGLRNVPA | | ASGLRNVPA | | ASSLPFQNIN | | ATFLRSNAPSG | |
| ASGRADTKI | | ASGRADTKI | | ASSLVLAAII | | ATGFHFEECSC | |

Fig. 83-19

| Block size 8 | SIN | Block size 9 | SIN | Block size 10 | SIN | Block size 11 | SIN |
|---|---|---|---|---|---|---|---|
| ASGRADTRI | | ASGRADTRI | | ASSLVLAALI | | ATGFHLEECSC | |
| ASGSSISFC | | ASGSSISFC | | ASSLVLAALN | | ATGLRNIPQIE | |
| ASICTHLEV | | ASICTHLEV | | ASSLVLIVSL | | ATGLRNIPSIQ | |
| ASIRNNSYD | | ASIRNNSYD | | ASSLVLLFMI | | ATGLRNIPSVQ | |
| ASIRNNTYD | | ASIRNNTYD | | ASSLVLLLMI | | ATGLRNVPQIE | |
| ASIRNNTYN | | ASIRNNTYN | | ASSLVLLVSL | | ATGLRNVPQME | |
| ASIRNSTYD | | ASIRNSTYD | | ASSLVLVVSL | | ATGLRNVPSIQ | |
| ASIRRNYFT | | ASIRRNYFT | | ASSQLEGFSA | | ATGMKNVPEIP | |
| ASKEPEVHE | | ASKEPEVHE | | ASSSVLLVSL | | ATGMKNVPETP | |
| ASKNPYTLV | | ASKNPYTLV | | ASSTVLVGLI | | ATGMRNIPEKP | |
| ASLCLAILI | | ASLCLAILI | | ASSTVMVGLI | | ATGMRNIPEKQ | |
| ASLCLAILV | | ASLCLAILV | | ASSVVLVGLI | | ATGMRNIPENP | |
| ASLCLAVLI | | ASLCLAVLI | | ASSVVLVGPI | | ATGMRNIPERQ | |
| ASLLEMCHG | | ASLLEMCHG | | ASTGAQSFYR | | ATGMRNIPGKQ | |
| ASLLEMCHS | | ASLLEMCHS | | ASTGGQAFYR | | ATGMRNVPEKP | |
| ASLRLAVGL | | ASLRLAVGL | | ASTGGQSFYR | | ATGMRNVPEKQ | |
| ASLSPGMMM | | ASLSPGMMM | | ASTLVLLVSL | | ATGMRNVPENP | |
| ASMRRDYFT | | ASMRRDYFT | | ASTNAHDRIC | | ATGMRNVPERQ | |
| ASMRRNYFT | | ASMRRNYFT | | ASTNAYDRIC | | ATGMRNVPETQ | |
| ASMRRSYFT | | ASMRRSYFT | | ASTQKAIDEI | | ATGPADTRIYY | |
| ASNINIREW | | ASNINIREW | | ASTQKAINEI | | ATGPADTRVYY | |
| ASNQASYKI | | ASNQASYKI | | ASTTAKAMEQ | | ATGPAETRIYY | |
| ASNRPWISF | | ASNRPWISF | | ASVPASRYLI | | ATGPAETRVYY | |
| ASNRPWVSF | | ASNRPWVSF | | ASVPASRYLT | | ATGPRNVPQIE | |
| ASNSIVTFC | | ASNSIVTFC | | ASWAGNILRT | | ATGRVTVSTRS | |
| ASNSLIALC | | ASNSLIALC | | ASWFNSFLAH | | ATGYHFEECSC | |
| ASPQLEGFS | | ASPQLEGFS | | ASWFNSFLIH | | ATIDQITGKLN | |
| ASPSCLVVR | | ASPSCLVVR | | ASWFNSFLKH | | ATIGECPKYVK | |
| ASQGTKRPY | | ASQGTKRPY | | ASWFNSFLTH | | ATINEEALRQK | |
| ASQGTKRSH | | ASQGTKRSH | | ASWFNSFLVH | | ATIWTSGSSIS | |
| ASQGTKRSY | | ASQGTKRSY | | ASWSWHDGAI | | ATKLYVNKNPY | |
| ASQYGPSHS | | ASQYGPSHS | | ASWSWHDGAV | | ATKMEAILVVL | |
| ASRHHMGEC | | ASRHHMGEC | | ASYKRIRLFD | | ATKMKAIIVVL | |
| ASRHYMGEC | | ASRHYMGEC | | ASYKRVRLFD | | ATKMKAILVVL | |
| ASRKADTRI | | ASRKADTRI | | ATACHDGKEW | | ATLCLGHHAVA | |
| ASRSGYEML | | ASRSGYEML | | ATACHDGKGW | | ATLCLGHHAVP | |
| ASRSGYEVL | | ASRSGYEVL | | ATACHDGKKW | | ATLCLGHHAVQ | |
| ASRYGYEML | | ASRYGYEML | | ATACHDGRKW | | ATLCLGHHAVS | |
| ASRYYMGEC | | ASRYYMGEC | | ATACSDGPGW | | ATNGNYGPINV | |
| ASSGIAIAL | | ASSGIAIAL | | ATACSDGSGW | | ATNINIREWSY | |
| ASSGSLEFI | | ASSGSLEFI | | ATAIFRKATR | | ATNLYVNKNPY | |
| ASSISFCGV | | ASSISFCGV | | ATAIIRKATR | | ATPGMQIRGFV | |
| ASSIVLVGL | | ASSIVLVGL | | ATAILKKATR | | ATQGTKRSYEQ | |
| ASSIVMVGL | | ASSIVMVGL | | ATAILRKATK | | ATREGKHIVER | |
| ASSKSRARI | | ASSKSRARI | | ATAILRKATR | | ATRGVQIASNE | |
| ASSLALAII | | ASSLALAII | | ATALANTIEI | | ATRLYVNKNPY | |
| ASSLALAIM | | ASSLALAIM | | ATALANTIEV | | ATSACKRTVSS | |
| ASSLILAAI | | ASSLILAAI | | ATAQMALQLF | | ATTHSWIPKRN | |
| ASSLPFQNI | | ASSLPFQNI | | ATATVYYDRR | | ATTHSWTPKRN | |
| ASSLTLAIM | | ASSLTLAIM | | ATATVYYNGR | | ATTHSWVPILN | |
| ASSLVLAAI | | ASSLVLAAI | | ATATVYYNKR | | ATTHSWVPKRN | |
| ASSLVLAAL | | ASSLVLAAL | | ATATVYYNRR | | ATTITLHFKQN | |
| ASSLVLAAS | | ASSLVLAAS | | ATAVAVIKYN | | ATTNPLIKHEN | |
| ASSLVLAIM | | ASSLVLAIM | | ATAVAVLKYN | | ATTNPLIRHEN | |
| ASSLVLIVS | | ASSLVLIVS | | ATCEQIADAQ | | ATTVTLHFKQH | |
| ASSLVLLFM | | ASSLVLLFM | | ATCEQIADSH | | ATTVTLHFKQN | |
| ASSLVLLLM | | ASSLVLLLM | | ATCEQIADSQ | | ATVAGSLSLAI | |
| ASSLVLLVS | | ASSLVLLVS | | ATCVCRDNWQ | | ATVNEEALRQK | |
| ASSLVLVVS | | ASSLVLVVS | | ATDTVDTLTE | | ATVNEGALRQK | |
| ASSQAHTKI | | ASSQAHTKI | | ATETVEITGI | | ATVSADPLASL | |
| ASSQAHTKV | | ASSQAHTKV | | ATEYIIKGVY | | ATVSADPLLSL | |
| | | | | ATEYIMKGVY | | ATVSADPLVSL | |

Fig. 83-20

| Block size 8 | SIN | Block size 9 | SIN | Block size 10 | SIN | Block size 11 | SIN |
|---|---|---|---|---|---|---|---|
| ASSQAYTKI | | ASSQAYTKI | | ATEYMMKGVY | | ATVYYDRRLTT | |
| ASSQAYTKV | | ASSQAYTKV | | ATFLRSNAPS | | ATVYYERRLTT | |
| ASSQLEGFS | | ASSQLEGFS | | ATGFHFEECS | | ATVYYNGRLTT | |
| ASSSVLLVS | | ASSSVLLVS | | ATGFHLEECS | | ATVYYNKRLTT | |
| ASSTVLVGL | | ASSTVLVGL | | ATGLRNAHKM | | ATVYYNRRLTT | |
| ASSTVMVGL | | ASSTVMVGL | | ATGLRNIPQI | | ATYQRTRALVR | |
| ASSVVLVGL | | ASSVVLVGL | | ATGLRNIPSI | | AVAKDNAIRFG | |
| ASSVVLVGP | | ASSVVLVGP | | ATGLRNVPIP | | AVANGTKVNTL | |
| ASTGAQSFY | | ASTGAQSFY | | ATGLRNVPQI | | AVATTHSWIPK | |
| ASTGGQAFY | | ASTGGQAFY | | ATGLRNVPQM | | AVATTHSWTPK | |
| ASTGGQSFY | | ASTGGQSFY | | ATGLRNVPSI | | AVATTHSWVPI | |
| ASTLVLLVS | | ASTLVLLVS | | ATGLRNVPSV | | AVATTHSWVPK | |
| ASTNAHDRI | | ASTNAHDRI | | ATGMKNVPEI | | AVAVIKYNGII | |
| ASTNAYDRI | | ASTNAYDRI | | ATGMKNVPET | | AVAVLKYKGII | |
| ASTQKAIDE | | ASTQKAIDE | | ATGMRNIPEK | | AVAVLKYNDII | |
| ASTQKAINE | | ASTQKAINE | | ATGMRNIPEN | | AVAVLKYNGII | |
| ASTTAKAME | | ASTTAKAME | | ATGMRNIPER | | AVAVLKYNGVI | |
| ASVPASRYL | | ASVPASRYL | | ATGMRNIPGK | | AVAWSATACHD | |
| ASWAGNILR | | ASWAGNILR | | ATGMRNVPEI | | AVDEGNGCFEL | |
| ASWFNSFLA | | ASWFNSFLA | | ATGMRNVPEK | | AVDGTIAGFIE | |
| ASWFNSFLI | | ASWFNSFLI | | ATGMRNVPEN | | AVDLGSCGILG | |
| ASWFNSFLK | | ASWFNSFLK | | ATGMRNVPER | | AVDQITGKLNR | |
| ASWFNSFLT | | ASWFNSFLT | | ATGMRNVPET | | AVDTCYPFDVP | |
| ASWFNSFLV | | ASWFNSFLV | | ATGMRNVPEV | | AVDTGDGCFEI | |
| ASWSWHDGA | | ASWSWHDGA | | ATGPADTRIY | | AVDTGNGCFDI | |
| ASYKIFKSH | | ASYKIFKSH | | ATGPADTRVY | | AVEECLINDPW | |
| ASYKIFKSQ | | ASYKIFKSQ | | ATGPAETRIY | | AVENGTSVKTL | |
| ASYKIFKSR | | ASYKIFKSR | | ATGPAETRVY | | AVENQHTIDLT | |
| ASYKIFKSY | | ASYKIFKSY | | ATGPRNVPQI | | AVENQHTIDST | |
| ASYKRIRLF | | ASYKRIRLF | | ATGRVTVSTR | | AVFCGTSGTYG | |
| ASYKRVRLF | | ASYKRVRLF | | ATGYHFEECS | | AVGGSGTDNYG | |
| ASYRIFKSH | | ASYRIFKSH | | ATIDQITGKL | | AVGGSGTNNYG | |
| ATACHDGKE | | ATACHDGKE | | ATIGECPKYV | | AVGKCPKYVKQ | |
| ATACHDGKG | | ATACHDGKG | | ATINEEALRQ | | AVGKCPRYVKQ | |
| ATACHDGKK | | ATACHDGKK | | ATIWTSGSSI | | AVGLRNTPSID | |
| ATACHDGRK | | ATACHDGRK | | ATKLYVNKNP | | AVGLRNTPSIE | |
| ATACSDGPG | | ATACSDGPG | | ATKMEAILVV | | AVGLRNTPSVE | |
| ATACSDGSG | | ATACSDGSG | | ATKMKAIIVV | | AVGRCPRYVKQ | |
| ATAIFRKAT | | ATAIFRKAT | | ATKMKAILVV | | AVGRSGTNNYG | |
| ATAIIRKAT | | ATAIIRKAT | | ATLCLGHHAV | | AVIHYGGIPTD | |
| ATAILKKAT | | ATAILKKAT | | ATNGNYGPIN | | AVIHYGGMPTD | |
| ATAILRKAT | | ATAILRKAT | | ATNINIREWS | | AVIHYGGVPTD | |
| ATALANTIE | | ATALANTIE | | ATNLYVNKNP | | AVIKNNMINND | |
| ATAQMALQL | | ATAQMALQL | | ATNPIVPSFD | | AVIKYNGIITD | |
| ATASFIYDG | | ATASFIYDG | | ATNPIVPSFE | | AVIYGNPKCDI | |
| ATASFIYEG | | ATASFIYEG | | ATNPVVPSFD | | AVIYGNPKCDT | |
| ATASFIYGG | | ATASFIYGG | | ATPGMQIRGF | | AVIYGNPKCDV | |
| ATASFIYNG | | ATASFIYNG | | ATQTLVSNND | | AVKLYKKLKRE | |
| ATASFVYDG | | ATASFVYDG | | ATREGKHIVE | | AVKLYRKLKRE | |
| ATASLIYDG | | ATASLIYDG | | ATRGVQIASN | | AVKQNGKSGAC | |
| ATASLIYNG | | ATASLIYNG | | ATRLYVNKNP | | AVLIAGGLILG | |
| ATATVYYDR | | ATATVYYDR | | ATSACKRTVS | | AVLKPGQTVKI | |
| ATATVYYER | | ATATVYYER | | ATSPIVPSFD | | AVLKYKGIITG | |
| ATATVYYNG | | ATATVYYNG | | ATTHSWIPKR | | AVLKYNDIITD | |
| ATATVYYNK | | ATATVYYNK | | ATTHSWTPKR | | AVLKYNGIITD | |
| ATATVYYNR | | ATATVYYNR | | ATTHSWVPIL | | AVLKYNGIITE | |
| ATAVAVIKY | | ATAVAVIKY | | ATTHSWVPKR | | AVLKYNGIITG | |
| ATAVAVLKY | | ATAVAVLKY | | ATTITLHFKQ | | AVLKYNGVITD | |
| ATCEQIADA | | ATCEQIADA | | ATNPLIKHE | | AVLRGFLIIGK | |
| ATCEQIADS | | ATCEQIADS | | ATTNPLIRHE | | AVLRGFLILGK | |
| ATCVCRDNW | | ATCVCRDNW | | ATTVTLHFKQ | | AVLRGFLILGR | |
| ATDTVDTLT | | ATDTVDTLT | | ATVAGSLSLA | | AVNQITGKLNR | |

Fig. 83-21

| Block size 8 | SIN | Block size 9 | SIN | Block size 10 | SIN | Block size 11 | SIN |
|---|---|---|---|---|---|---|---|
| ATEIRASVG | | ATEIRASVG | | ATVNEEALRQ | | AVNSSKPFQNA | |
| ATEIRSSVG | | ATEIRSSVG | | ATVNEGALRQ | | AVNSSMPFHNI | |
| ATEIRTSVG | | ATEIRTSVG | | ATVSADPLAS | | AVNSWHILSKD | |
| ATETVEITG | | ATETVEITG | | ATVSADPLLS | | AVNTTLSTIAL | |
| ATEYIMKGV | | ATEYIMKGV | | ATVSADPLVS | | AVPNGTIVKTI | |
| ATEYMMKGV | | ATEYMMKGV | | ATVTLHFKQH | | AVPNGTIVRTI | |
| ATFLRSNAP | | ATFLRSNAP | | ATVYYDRRLT | | AVPNGTKVNTL | |
| ATGFHFEEC | | ATGFHFEEC | | ATVYYNGRLT | | AVPNGTLVKTI | |
| ATGFHLEEC | | ATGFHLEEC | | ATVYYNKRLT | | AVPNGTMVKTI | |
| ATGLKNVPA | | ATGLKNVPA | | ATVYYNRRLT | | AVPNGTVVKTI | |
| ATGLRNAHK | | ATGLRNAHK | | ATVYYNRRPT | | AVRFGESEQII | |
| ATGLRNIPA | | ATGLRNIPA | | ATYQRTRALV | | AVRGDLNFVNR | |
| ATGLRNIPQ | | ATGLRNIPQ | | AVAKDNAIRF | | AVSFWMCSNGS | |
| ATGLRNIPS | | ATGLRNIPS | | AVANGTKVNT | | AVSNGTKINTL | |
| ATGLRNVPA | | ATGLRNVPA | | AVATTHSWIP | | AVSNGTKVNTL | |
| ATGLRNVPI | | ATGLRNVPI | | AVATTHSWTP | | AVTDGPAANNA | |
| ATGLRNVPK | | ATGLRNVPK | | AVATTHSWVP | | AVTDGPAANSA | |
| ATGLRNVPQ | | ATGLRNVPQ | | AVAVIKYNGI | | AVTDGPADNKA | |
| ATGLRNVPS | | ATGLRNVPS | | AVAVLKYKGI | | AVTDIWSYNAK | |
| ATGLRNVPT | | ATGLRNVPT | | AVAVLKYNDI | | AVTDIWSYNAR | |
| ATGMALSVV | | ATGMALSVV | | AVAVLKYNGI | | AVTDVWSYNAK | |
| ATGMILSVV | | ATGMILSVV | | AVAVLKYNGV | | AVVMTDGSASG | |
| ATGMKNVPE | | ATGMKNVPE | | AVAWSATACH | | AWLHICVTGDD | |
| ATGMRNIPE | | ATGMRNIPE | | AVDEGNGCFE | | AWLHVCITGDD | |
| ATGMRNIPG | | ATGMRNIPG | | AVDGTIAGFI | | AWLHVCVTGDD | |
| ATGMRNVPE | | ATGMRNVPE | | AVDICKAAIG | | AWLHVCVTGHD | |
| ATGMTLSVV | | ATGMTLSVV | | AVDICKAALG | | AWLHVCVTGYE | |
| ATGPADTRI | | ATGPADTRI | | AVDICKAAMG | | AWSASACHDGI | |
| ATGPADTRV | | ATGPADTRV | | AVDLGSCGIL | | AWSASACHDGL | |
| ATGPAETRI | | ATGPAETRI | | AVDQITGKLN | | AWSASACHDGM | |
| ATGPAETRV | | ATGPAETRV | | AVDTCYPFDV | | AWSASACHDGS | |
| ATGPRNVPA | | ATGPRNVPA | | AVDTGDGCFE | | AWSASACHDGT | |
| ATGPRNVPQ | | ATGPRNVPQ | | AVDTGNGCFD | | AWSASACHDGV | |
| ATGRVTVST | | ATGRVTVST | | AVEECLINDP | | AWSATACHDGK | |
| ATGVTLSVV | | ATGVTLSVV | | AVEKEFSNLE | | AWSATACHDGR | |
| ATGYHFEEC | | ATGYHFEEC | | AVENGTSVKT | | AWSATACSDGP | |
| ATIGECPKY | | ATIGECPKY | | AVENQHTIDL | | AWSATACSDGS | |
| ATINEEALR | | ATINEEALR | | AVFCGTSGTY | | AWSRSSCHDGK | |
| ATIWTSGSS | | ATIWTSGSS | | AVGGSGTDNY | | AWSSASCHDGR | |
| ATKLYVNKN | | ATKLYVNKN | | AVGGSGTNNY | | AWSSSSCFDGK | |
| ATKMEAILV | | ATKMEAILV | | AVGICKAAMG | | AWSSSSCFDGR | |
| ATKMKAIIV | | ATKMKAIIV | | AVGKCPKYVK | | AWSSSSCHDGK | |
| ATKMKAILV | | ATKMKAILV | | AVGKCPRYVK | | AWSSSSCHDGN | |
| ATKRIRLAI | | ATKRIRLAI | | AVGKEFGNLE | | AWSSSSCHDGR | |
| ATKRIRMAI | | ATKRIRMAI | | AVGKEFNNLE | | AWSSSSCYDGK | |
| ATKRIRMAT | | ATKRIRMAT | | AVGKEFSNLE | | AWSSTSCFDGK | |
| ATKRLRMAI | | ATKRLRMAI | | AVGLRNTPSI | | AWSYIVERPSA | |
| ATLCLGHHA | | ATLCLGHHA | | AVGLRNTPSV | | AYAVIHYGGIP | |
| ATNGNYGPI | | ATNGNYGPI | | AVGRCPRYVK | | AYAVIHYGGMP | |
| ATNINIREW | | ATNINIREW | | AVIHYGGIPT | | AYAVIHYGGVP | |
| ATNLYVNKN | | ATNLYVNKN | | AVIHYGGMPT | | AYCNTDLGAPL | |
| ATNPIVPSF | | ATNPIVPSF | | AVIHYGGVPT | | AYCNTDLGSPL | |
| ATNPVVPSF | | ATNPVVPSF | | AVIKYNGIIT | | AYCNTDLGTPL | |
| ATPGMQIRG | | ATPGMQIRG | | AVIYGNPKCD | | AYCYPGATVNE | |
| ATQTLVSNN | | ATQTLVSNN | | AVKLSSGYKD | | AYCYPGSTVNE | |
| ATREGKHIV | | ATREGKHIV | | AVKLYKKLKR | | AYCYPGTTVNE | |
| ATRGVQIAS | | ATRGVQIAS | | AVKLYRKLKR | | AYDKICIGYQT | |
| ATRLYVNKN | | ATRLYVNKN | | AVKQNGKSGA | | AYDRICIGYQS | |
| ATRPKVNGQ | | ATRPKVNGQ | | AVLIAGGLIL | | AYERMCNILKG | |
| ATRPQVNGQ | | ATRPQVNGQ | | AVLKPGQTVK | | AYKILTIYSTV | |
| ATRPRVNGQ | | ATRPRVNGQ | | AVLKYKGIIT | | AYMLERELVRK | |
| ATRSKVNGQ | | ATRSKVNGQ | | AVLKYNDIIT | | AYNAELIVLLE | |

Fig. 83-22

| Block size 8 | SIN | Block size 9 | SIN | Block size 10 | SIN | Block size 11 | SIN |
|---|---|---|---|---|---|---|---|
| ATSACKRTV | | ATSACKRTV | | AVLKYNGIIT | | AYNAELLVLIE | |
| ATSPIVPSF | | ATSPIVPSF | | AVLKYNGMIT | | AYNAELLVLLE | |
| ATTHSWIPK | | ATTHSWIPK | | AVLKYNGVIT | | AYNAELLVLLG | |
| ATTHSWTPK | | ATTHSWTPK | | AVLRGFLIIG | | AYNNTTGRDVL | |
| ATTHSWVPI | | ATTHSWVPI | | AVLRGFLILG | | AYQILAIYATV | |
| ATTHSWVPK | | ATTHSWVPK | | AVNICKAAMG | | AYQKQMTRGLF | |
| ATTITLHFK | | ATTITLHFK | | AVNQITGKLN | | AYQKRMTRGLF | |
| ATTNPLIKH | | ATTNPLIKH | | AVNSSKPFQN | | AYRKRMTRGLF | |
| ATTNPLIRH | | ATTNPLIRH | | AVNSSMPFHN | | AYSQITNGTTG | |
| ATTVTLHFK | | ATTVTLHFK | | AVNSWHILSK | | AYTKILYFHKG | |
| ATVAGSLSL | | ATVAGSLSL | | AVNTTLSTIA | | AYTKIMYFHKG | |
| ATVNEEALR | | ATVNEEALR | | AVPNGTIVKT | | AYTKVLYFHKG | |
| ATVNEGALR | | ATVNEGALR | | AVPNGTIVRT | | AYTKVMYFHKG | |
| ATVSADPLA | | ATVSADPLA | | AVPNGTKVNT | | AYWWDGLQSSD | |
| ATVSADPLL | | ATVSADPLL | | AVPNGTLVKT | | CAAMDDFQLIP | |
| ATVSADPLV | | ATVSADPLV | | AVPNGTMVKT | | CAAMDDYQLIP | |
| ATVTLHFKQ | | ATVTLHFKQ | | AVPNGTVVKT | | CAAMDEFQLIP | |
| ATVYYDRRL | | ATVYYDRRL | | AVRFGESEQI | | CAAMEDFQLIP | |
| ATVYYERRL | | ATVYYERRL | | AVRGDLNFVN | | CAAWSSSSCFD | |
| ATVYYNGRL | | ATVYYNGRL | | AVSADPLASL | | CAAWSSSSCHD | |
| ATVYYNKRL | | ATVYYNKRL | | AVSFWMCSNG | | CAGIPSDTPRG | |
| ATVYYNRRL | | ATVYYNRRL | | AVSIDRFLRV | | CAGIPTDTPRG | |
| ATVYYNRRP | | ATVYYNRRP | | AVSNGTKINT | | CAGIPTDTPRI | |
| ATYQRTRAL | | ATYQRTRAL | | AVSNGTKVNT | | CAGIPTDTPRV | |
| AVAKDNAIR | | AVAKDNAIR | | AVTDGPAANN | | CAGLPSDTPRG | |
| AVANGTKVN | | AVANGTKVN | | AVTDGPAANS | | CASNINIREWS | |
| AVATTHSWI | | AVATTHSWI | | AVTDIWSYNA | | CATCEQIADAQ | |
| AVATTHSWT | | AVATTHSWT | | AVTDVWSYNA | | CATCEQIADSH | |
| AVATTHSWV | | AVATTHSWV | | AVTWWNRKGP | | CATCEQIADSQ | |
| AVAVIKYNG | | AVAVIKYNG | | AVTWWNRNGP | | CATNINIREWS | |
| AVAVLKYDG | | AVAVLKYDG | | AVTWWNRSGP | | CAVATTHSWVP | |
| AVAVLKYKG | | AVAVLKYKG | | AVVKYNGIIT | | CAVNSWHILSK | |
| AVAVLKYNG | | AVAVLKYNG | | AVVMGLVFIC | | CAVVMTDGNAS | |
| AVAVVKYNG | | AVAVVKYNG | | AVVMTDGNAS | | CAVVMTDGSAS | |
| AVAWSATAC | | AVAWSATAC | | AVVMTDGPAS | | CCNLFEKFFPS | |
| AVDEGNGCF | | AVDEGNGCF | | AVVMTDGSAS | | CCSLFEKFFPS | |
| AVDGTIAGF | | AVDGTIAGF | | AWLHICVTGD | | CCTLFEKFFPS | |
| AVDICKAAI | | AVDICKAAI | | AWLHVCITGD | | CDAPFDDRLRR | |
| AVDICKAAL | | AVDICKAAL | | AWLHVCVTGD | | CDDDCMASIRN | |
| AVDICKAAM | | AVDICKAAM | | AWLHVCVTGH | | CDDHCMESIRN | |
| AVDLGSCGI | | AVDLGSCGI | | AWSASACHDG | | CDDLIGKNSWS | |
| AVDQITGKL | | AVDQITGKL | | AWSATACHDG | | CDDLIGKTSWS | |
| AVDTCYPFD | | AVDTCYPFD | | AWSATACSDG | | CDDQCMESIRN | |
| AVDTGDGCF | | AVDTGDGCF | | AWSRSSCHDG | | CDELIGKTSWS | |
| AVDTGNGCF | | AVDTGNGCF | | AWSSASCHDG | | CDHSDNADKIC | |
| AVEKEFSNL | | AVEKEFSNL | | AWSSSSCFDG | | CDIINGALGSP | |
| AVENGTSVK | | AVENGTSVK | | AWSSSCHDG | | CDIVNAALGSP | |
| AVENQHTID | | AVENQHTID | | AWSSSSCHDG | | CDIVNGALGSP | |
| AVFCGTSGT | | AVFCGTSGT | | AWSSSSCYDG | | CDIVNSALGSP | |
| AVGGSGTDN | | AVGGSGTDN | | AWSSTSCFDG | | CDLHLEFKADL | |
| AVGGSGTNN | | AVGGSGTNN | | AWSYIVERPS | | CDLHLTGIWDT | |
| AVGICKAAM | | AVGICKAAM | | AYAVIHYGGI | | CDLHLTGMWDT | |
| AVGKCPKYV | | AVGKCPKYV | | AYAVIHYGGM | | CDLHLTGTWDT | |
| AVGKCPRYV | | AVGKCPRYV | | AYAVIHYGGV | | CDLINGALGSP | |
| AVGKEFGNL | | AVGKEFGNL | | AYCNTDLGAP | | CDLYLNGREWS | |
| AVGKEFNNL | | AVGKEFNNL | | AYCNTDLGSP | | CDLYLSGREWS | |
| AVGKEFSNL | | AVGKEFSNL | | AYCNTDLGTP | | CDLYLTGTWDT | |
| AVGLRNTPS | | AVGLRNTPS | | AYCYPGATVN | | CDNECMETIKN | |
| AVGRCPRYV | | AVGRCPRYV | | AYCYPGSTVN | | CDNKCIESIRN | |
| AVIHYGGIP | | AVIHYGGIP | | AYCYPGTTVN | | CDNKCMETIKN | |
| AVIHYGGMP | | AVIHYGGMP | | AYDKICIGYQ | | CDNLIGKTSWS | |
| AVIHYGGVP | | AVIHYGGVP | | AYDRICIGYQ | | CDNNCIESIRN | |
| | | | | AYERMCNILK | | | |

Fig. 83-23

| Block size 8 | SIN | Block size 9 | SIN | Block size 10 | SIN | Block size 11 | SIN |
|---|---|---|---|---|---|---|---|
| AVIKYNGII | | AVIKYNGII | | AYIVKKGDSA | | CDNQCMESIRN | |
| AVIYGNPKC | | AVIYGNPKC | | AYKIIKKGDS | | CDNSCIESIRN | |
| AVKLSSGYK | | AVKLSSGYK | | AYKILTIYST | | CDNTCIESIRN | |
| AVKLYKKLK | | AVKLYKKLK | | AYKIVKEGDS | | CDPDECRFYAL | |
| AVKLYRKLK | | AVKLYRKLK | | AYKIVKKGDS | | CDPDGCRFYAL | |
| AVKQNGKSG | | AVKQNGKSG | | AYKIVKTGDS | | CDPHLTGTWDT | |
| AVLIAGGLI | | AVLIAGGLI | | AYMLERELVR | | CDPLGCKMYAL | |
| AVLKPGQTL | | AVLKPGQTL | | AYNAELIVLL | | CDPLGCKTYAL | |
| AVLKPGQTV | | AVLKPGQTV | | AYNAELLVLI | | CDPLGCRMYAL | |
| AVLKYKGII | | AVLKYKGII | | AYNAELLVLL | | CDPNECRFYAL | |
| AVLKYNGII | | AVLKYNGII | | AYNNTTGRDV | | CDPSGCKMYAL | |
| AVLKYNGMI | | AVLKYNGMI | | AYQKQMTRGL | | CDPTGCKMYAL | |
| AVLKYNGVI | | AVLKYNGVI | | AYQKRMGLQM | | CDPYLNGREWS | |
| AVLRGFLII | | AVLRGFLII | | AYQKRMGVQI | | CDRLQDTTWDV | |
| AVLRGFLIL | | AVLRGFLIL | | AYQKRMGVQL | | CDSHLKFKADL | |
| AVNICKAAM | | AVNICKAAM | | AYQKRMGVQM | | CDTKCQTPLGA | |
| AVNNRFQIK | | AVNNRFQIK | | AYQKRMTRGL | | CDYLIGKTSWS | |
| AVNSSKPFQ | | AVNSSKPFQ | | AYRKRMTRGL | | CEGECFYSGGT | |
| AVNSSMPFH | | AVNSSMPFH | | AYSQITNGTT | | CEKLEQSGLPV | |
| AVNSWHILS | | AVNSWHILS | | AYTKIMYFHK | | CEPDECRFYAL | |
| AVNTTLSTI | | AVNTTLSTI | | AYTKVLYFHK | | CEQIADAQHRS | |
| AVPNGTIVK | | AVPNGTIVK | | AYTKVMYFHK | | CEQIADSHHRS | |
| AVPNGTIVR | | AVPNGTIVR | | AYVDGFEPNG | | CEQIADSQHKS | |
| AVPNGTKVN | | AVPNGTKVN | | AYVDGFKPNG | | CEQIADSQHRS | |
| AVPNGTLVK | | AVPNGTLVK | | AYWWDGLQSS | | CESKCFWKGGS | |
| AVPNGTMVK | | AVPNGTMVK | | CAAMDDFQLI | | CESKCFWKGGT | |
| AVPNGTVVK | | AVPNGTVVK | | CAAMDEFQLI | | CESKCFWRGGS | |
| AVRFGESEQ | | AVRFGESEQ | | CAAMEDFQLI | | CETKCQSPLGA | |
| AVRGDLNFV | | AVRGDLNFV | | CAAWSSSSCF | | CETKCQTPLGA | |
| AVRIGEDAH | | AVRIGEDAH | | CAAWSSSSCH | | CETQCQTPLGA | |
| AVSADPLAS | | AVSADPLAS | | CAGIPSDTPR | | CETRCQTPLGA | |
| AVSFWMCSN | | AVSFWMCSN | | CAGIPTDTPR | | CEVNSWHIFSK | |
| AVSIDRFLR | | AVSIDRFLR | | CAGLPSDTPR | | CEVNSWHILSK | |
| AVSNGTKIN | | AVSNGTKIN | | CASNINIREW | | CEVSSWHILSK | |
| AVSNGTKVN | | AVSNGTKVN | | CATCEQIADA | | CFDGKEWLHVC | |
| AVTDGPAAN | | AVTDGPAAN | | CATCEQIADS | | CFDGKEWMHIC | |
| AVTDGPADN | | AVTDGPADN | | CATNINIREW | | CFDGKEWMHVC | |
| AVTDIWSYN | | AVTDIWSYN | | CAVATTHSWV | | CFDGKEWMHVS | |
| AVTDVWSYN | | AVTDVWSYN | | CAVNSWHILS | | CFDGREWMHVC | |
| AVTWWNRKG | | AVTWWNRKG | | CAVVMTDGNA | | CFDILHKCDNE | |
| AVTWWNRNG | | AVTWWNRNG | | CAVVMTDGSA | | CFDILHKCDNK | |
| AVTWWNRSG | | AVTWWNRSG | | CCNLFEKFFP | | CFDILHKCNNE | |
| AVVKYNGII | | AVVKYNGII | | CCSLFEKFFP | | CFEFWHKCDDE | |
| AVVMGLVFI | | AVVMGLVFI | | CCTLFEKFFP | | CFEFWHKCDND | |
| AVVMTDGNA | | AVVMTDGNA | | CDAPFDDRLR | | CFEFWHKCDNE | |
| AVVMTDGPA | | AVVMTDGPA | | CDDDCMASIR | | CFEFWHKCNNE | |
| AVVMTDGSA | | AVVMTDGSA | | CDDHCMESIR | | CFEFYHKCDDE | |
| AVVSKDNGI | | AVVSKDNGI | | CDDLIGKNSW | | CFEFYHKCDNE | |
| AWIGRTKST | | AWIGRTKST | | CDDLIGKTSW | | CFEFYHKCNDE | |
| AWLHICVTG | | AWLHICVTG | | CDDNCMERIR | | CFEIFHKCDDD | |
| AWLHVCITG | | AWLHVCITG | | CDDNCMESIR | | CFEIFHKCDDH | |
| AWLHVCVTG | | AWLHVCVTG | | CDDQCMESIR | | CFEIFHKCDDN | |
| AWSASACHD | | AWSASACHD | | CDDSCMESIR | | CFEIFHKCDDQ | |
| AWSATACHD | | AWSATACHD | | CDELIGKTSW | | CFEIFHKCDNQ | |
| AWSATACSD | | AWSATACSD | | CDHSDNADKI | | CFEIFHQCDND | |
| AWSRSSCHD | | AWSRSSCHD | | CDIINGALGS | | CFEIFHQCDNN | |
| AWSSASCHD | | AWSSASCHD | | CDIVNAALGS | | CFEIFHRCDDQ | |
| AWSSSSCFD | | AWSSSSCFD | | CDIVNGALGS | | CFELFHKCDDD | |
| AWSSSSCHD | | AWSSSSCHD | | CDIVNSALGS | | CFELLHKCNDS | |
| AWSSSSCYD | | AWSSSSCYD | | CDLHLEFKAD | | CFELLHKCNNS | |
| AWSSTSCFD | | AWSSTSCFD | | CDLHLTGKWD | | CFELLHKCNNT | |
| AWSYIVERP | | AWSYIVERP | | CDLHLTGMWD | | CFLWHVRKRFA | |

Fig. 83-24

| Block size 8 | SIN | Block size 9 | SIN | Block size 10 | SIN | Block size 11 | SIN |
|---|---|---|---|---|---|---|---|
| AWTAVNSIC | | AWTAVNSIC | | CDLHLTGTWD | | CFMYSDFHFID | |
| AWTMVNSIC | | AWTMVNSIC | | CDLINGALGS | | CFMYSDFHFIN | |
| AWTVINSIC | | AWTVINSIC | | CDLYLNGREW | | CFNFFHKCNDS | |
| AWTVVNSIC | | AWTVVNSIC | | CDLYLSGREW | | CFNGSLQCRIC | |
| AWTVVNSLC | | AWTVVNSLC | | CDLYLTGTWD | | CFNLLHKCNDS | |
| AYAVIHYGG | | AYAVIHYGG | | CDNECMETIK | | CFNPCFYVELI | |
| AYCNTDLGA | | AYCNTDLGA | | CDNKCIESIR | | CFNPMIAELAE | |
| AYCNTDLGS | | AYCNTDLGS | | CDNKCMETIK | | CFNPMIIELAE | |
| AYCNTDLGT | | AYCNTDLGT | | CDNLIGKTSW | | CFNPMIVELAE | |
| AYCYPGATM | | AYCYPGATM | | CDNNCIESIR | | CFNPMTVELAE | |
| AYCYPGATV | | AYCYPGATV | | CDNNCMESIR | | CFNPMVVELAE | |
| AYCYPGSTV | | AYCYPGSTV | | CDNQCMESIR | | CFPGELDNNGE | |
| AYCYPGTTV | | AYCYPGTTV | | CDNSCIESIR | | CFPGEVDNNGE | |
| AYDKICIGY | | AYDKICIGY | | CDPDECRFYA | | CFQPCFYIELI | |
| AYDRICIGY | | AYDRICIGY | | CDPDGCRFYA | | CFQPCFYVELI | |
| AYERMCNIL | | AYERMCNIL | | CDPHLTGTWD | | CFQPCFYVELT | |
| AYGVKGFSF | | AYGVKGFSF | | CDPLGCKMYA | | CFQRSKFLLMD | |
| AYIVKKGDS | | AYIVKKGDS | | CDPLGCKTYA | | CFQSCFYVELI | |
| AYKIIKKGD | | AYKIIKKGD | | CDPLGCRMYA | | CFSILHKCNDS | |
| AYKILTIYS | | AYKILTIYS | | CDPNECRFYA | | CFSLLHKCNDS | |
| AYKIVKEGD | | AYKIVKEGD | | CDPSGCKMYA | | CFVFVALILGF | |
| AYKIVKKGD | | AYKIVKKGD | | CDPTGCKMYA | | CFWIELIRGRP | |
| AYKIVKTGD | | AYKIVKTGD | | CDPYLNGREW | | CFWKGGSIKTK | |
| AYMLERELV | | AYMLERELV | | CDRLQDTTWD | | CFWKGGSINTK | |
| AYNAELIVL | | AYNAELIVL | | CDSHLKFKAD | | CFWLEMIRGKP | |
| AYNAELLVL | | AYNAELLVL | | CDSPSNINGE | | CFWLEMIRGRP | |
| AYNFNEGSY | | AYNFNEGSY | | CDSPSNINGG | | CFWMCSNGSLQ | |
| AYNNTTGRD | | AYNNTTGRD | | CDSPSNVKGG | | CFWRGGSINTK | |
| AYPFQNLTK | | AYPFQNLTK | | CDSPSNVNGG | | CFWRGGSINTR | |
| AYPLQNLTK | | AYPLQNLTK | | CDTKCQTPLG | | CFWVELIRGQP | |
| AYQAKFESV | | AYQAKFESV | | CDYLIGKTSW | | CFWVELIRGRP | |
| AYQAQFESV | | AYQAQFESV | | CEGECFYSGG | | CFWVELVRGLP | |
| AYQARFESV | | AYQARFESV | | CEKLEQSGLP | | CFWVELVRGRP | |
| AYQKQMTRG | | AYQKQMTRG | | CEPDECRFYA | | CFWVEMIRGEP | |
| AYQKRMGLQ | | AYQKRMGLQ | | CEQIADAQHR | | CFWVEMIRGKP | |
| AYQKRMGVQ | | AYQKRMGVQ | | CEQIADSHHR | | CFWVEMIRGQP | |
| AYQKRMTRG | | AYQKRMTRG | | CEQIADSQHK | | CFWVEMIRGRP | |
| AYRKRMTRG | | AYRKRMTRG | | CEQIADSQHR | | CFWVMTDGPAN | |
| AYSQITNGT | | AYSQITNGT | | CESKCFWKGG | | CFYIELIRGKP | |
| AYTKILYFH | | AYTKILYFH | | CESKCFWKSG | | CFYIELIRGRP | |
| AYTKIMYFH | | AYTKIMYFH | | CESKCFWRGG | | CFYLELIRGRP | |
| AYTKVLYFH | | AYTKVLYFH | | CETKCQSPLG | | CFYSGGTINSP | |
| AYTKVMYFH | | AYTKVMYFH | | CETKCQTPLG | | CFYVELIRGKP | |
| AYVDGFEPN | | AYVDGFEPN | | CETQCQTPLG | | CFYVELIRGMP | |
| AYVDGFKPN | | AYVDGFKPN | | CETRCQTPLG | | CFYVELIRGRE | |
| AYWWDGLQS | | AYWWDGLQS | | CEVNSWHIFS | | CFYVELIRGRK | |
| CAAMDDFQL | | CAAMDDFQL | | CEVNSWHILS | | CFYVELIRGRL | |
| CAAMDEFQL | | CAAMDEFQL | | CEVSSWHILS | | CFYVELIRGRN | |
| CAAMEDFQL | | CAAMEDFQL | | CFDGKEWLHV | | CFYVELIRGRP | |
| CAAWSSSSC | | CAAWSSSSC | | CFDGKEWMHI | | CFYVELIRGRQ | |
| CAGIPSDTP | | CAGIPSDTP | | CFDGKEWMHV | | CFYVELIRGRR | |
| CAGIPTDTP | | CAGIPTDTP | | CFDGREWMHV | | CFYVELIRGRS | |
| CAGLPSDTP | | CAGLPSDTP | | CFDILHKCDN | | CFYVELTRGRP | |
| CASNINIRE | | CASNINIRE | | CFDILHKCNN | | CFYVELVRGRP | |
| CATCEQIAD | | CATCEQIAD | | CFEFWHKCDD | | CGCRDNWQGAN | |
| CATNINIRE | | CATNINIRE | | CFEFWHKCDN | | CGILGILTGPP | |
| CAVATTHSW | | CAVATTHSW | | CFEFWHKCNN | | CGILGTIIGPP | |
| CAVNSWHIL | | CAVNSWHIL | | CFEFYHKCDD | | CGLDNEPGSGH | |
| CAVVMTDGN | | CAVVMTDGN | | CFEFYHKCDN | | CGLDNEPGSGN | |
| CAVVMTDGS | | CAVVMTDGS | | CFEFYHKCND | | CGLLGIITGPP | |
| CCNLFEKFF | | CCNLFEKFF | | CFEFYHKCNN | | CGLLGILIGPP | |
| CCSLFEKFF | | CCSLFEKFF | | CFEFYHRCDD | | CGLLGTITGPP | |

Fig. 83-25

| Block size 8 | SIN | Block size 9 | SIN | Block size 10 | SIN | Block size 11 | SIN |
|---|---|---|---|---|---|---|---|
| CCTLFEKFF | | CCTLFEKFF | | CFEFYHRCDN | | CGLLGTLIGPP | |
| CDAPFDDRL | | CDAPFDDRL | | CFEIFHKCDD | | CGLLGTLTGPP | |
| CDDDCMASI | | CDDDCMASI | | CFEIFHKCDN | | CGLLGTVTGPP | |
| CDDHCMESI | | CDDHCMESI | | CFEIFHQCDN | | CGLNNEPGSGN | |
| CDDLIGKNS | | CDDLIGKNS | | CFEIFHQCNN | | CGMIDGWYGFH | |
| CDDLIGKTS | | CDDLIGKTS | | CFEIFHRCDD | | CGNGSCRCTIC | |
| CDDNCMESI | | CDDNCMESI | | CFEIFHRCDN | | CGNNCIESIRN | |
| CDDPCMESI | | CDDPCMESI | | CFEILHKCDD | | CGPAECRTFFL | |
| CDDQCMESI | | CDDQCMESI | | CFEILHKCDN | | CGPSECRTFFL | |
| CDDSCMESI | | CDDSCMESI | | CFEILHKCND | | CGPTECRTFFL | |
| CDELIGKTS | | CDELIGKTS | | CFEILHRCDD | | CGSKEQLGSWS | |
| CDHSDNADK | | CDHSDNADK | | CFEILHRCND | | CGSKERLGSWS | |
| CDIINGALG | | CDIINGALG | | CFELLHKCND | | CGSKKRLGSWS | |
| CDIVNAALG | | CDIVNAALG | | CFELLHKCNN | | CGSPFPVGSGS | |
| CDIVNGALG | | CDIVNGALG | | CFKIYHKCDN | | CGSPISVGSGS | |
| CDIVNSALG | | CDIVNSALG | | CFKIYHKCNN | | CGSPVPVGSGS | |
| CDLHLEFKA | | CDLHLEFKA | | CFKIYHRCDN | | CGSPVSVGSGS | |
| CDLHLTGIW | | CDLHLTGIW | | CFLWHVRKRF | | CGSRERLGSWS | |
| CDLHLTGKW | | CDLHLTGKW | | CFMYSDFHFI | | CGTSGTYGAGS | |
| CDLHLTGTW | | CDLHLTGTW | | CFNFFHKCND | | CGTSGTYGSGS | |
| CDLINGALG | | CDLINGALG | | CFNGSLQCRI | | CGTSGTYGTGS | |
| CDLYLNGRE | | CDLYLNGRE | | CFNLLHKCND | | CGTSGTYGTGT | |
| CDLYLSGRE | | CDLYLSGRE | | CFNPCFYVEL | | CGVSGEVPGWS | |
| CDLYLTGTW | | CDLYLTGTW | | CFNPITGSPG | | CGVSSEAPGWS | |
| CDNECMETI | | CDNECMETI | | CFNPMIAELA | | CGVSSEVPEWS | |
| CDNKCIESI | | CDNKCIESI | | CFNPMIIELA | | CGVSSEVPGWS | |
| CDNKCMETI | | CDNKCMETI | | CFNPMIVELA | | CHDGIARMTIC | |
| CDNLIGKTS | | CDNLIGKTS | | CFNPMTVELA | | CHDGIGRMTIC | |
| CDNNCIESI | | CDNNCIESI | | CFNPMVVELA | | CHDGKAWLHIC | |
| CDNNCMESI | | CDNNCMESI | | CFPFYHKCDN | | CHDGKAWLHVC | |
| CDNQCMESI | | CDNQCMESI | | CFPGELDNNG | | CHDGKSWLHVC | |
| CDNSCIESI | | CDNSCIESI | | CFPGEVDNNG | | CHDGNAWLHVC | |
| CDNTCIESI | | CDNTCIESI | | CFQPCFYIEL | | CHDGRAWLHIC | |
| CDPDECRFY | | CDPDECRFY | | CFQPCFYVEL | | CHDGRAWLHVC | |
| CDPDGCRFY | | CDPDGCRFY | | CFQRSKFLLM | | CHDGVGRMTIC | |
| CDPHLTGTW | | CDPHLTGTW | | CFRIYHKCDN | | CHDGVNRMTIC | |
| CDPIGCKMY | | CDPIGCKMY | | CFSILHKCND | | CHDGVSRMTIC | |
| CDPLGCKMY | | CDPLGCKMY | | CFSLLHKCND | | CHITGFAPFSK | |
| CDPLGCRMY | | CDPLGCRMY | | CFTFYHKCDD | | CHNGICPVAFT | |
| CDPNECRFY | | CDPNECRFY | | CFTFYHKCDN | | CHNGICPVVFT | |
| CDPSGCKMY | | CDPSGCKMY | | CFTFYHKCNN | | CHNGTCAVVMT | |
| CDPTGCKMY | | CDPTGCKMY | | CFTIMTDGPN | | CHNGTCVVIMT | |
| CDPYLNGRE | | CDPYLNGRE | | CFTIMTDGPS | | CHNGTCVVVMT | |
| CDRLQDTTW | | CDRLQDTTW | | CFTIYHKCDN | | CHNGVCPVVFT | |
| CDSHLKFKA | | CDSHLKFKA | | CFTVLTDGPS | | CHQFALGQGTT | |
| CDSPSNING | | CDSPSNING | | CFTVMTDGPN | | CHQRSKFLLMD | |
| CDSPSNVKG | | CDSPSNVKG | | CFTVMTDGPS | | CHSAAFEDLRI | |
| CDSPSNVNG | | CDSPSNVNG | | CFVFVALILG | | CHSAAFEDLRL | |
| CDTKCQTPL | | CDTKCQTPL | | CFWIELIRGR | | CHSAAFEDLRV | |
| CDYLIGKTS | | CDYLIGKTS | | CFWKGGSIKT | | CHSGICPVVFT | |
| CEGECFYSG | | CEGECFYSG | | CFWKGGSINT | | CHTKCQTYAGA | |
| CEITGFAPF | | CEITGFAPF | | CFWKSGSINT | | CHTKCQTYTGA | |
| CEKLEQSGL | | CEKLEQSGL | | CFWLEMIRGK | | CIASSIVLVGL | |
| CEPDECRFY | | CEPDECRFY | | CFWLEMIRGR | | CIASSIVMVGL | |
| CEPIIIEKN | | CEPIIIEKN | | CFWMCSNGSL | | CIASSLILAAI | |
| CEPIIIERN | | CEPIIIERN | | CFWRGGSIIT | | CIASSLILAAL | |
| CEPIIVERN | | CEPIIVERN | | CFWRGGSINT | | CIASSLVLAAI | |
| CEPTIIERN | | CEPTIIERN | | CFWVELIRGQ | | CIASSLVLAAL | |
| CEQIADAQH | | CEQIADAQH | | CFWVELIRGR | | CIASSTVLVGL | |
| CEQIADSHH | | CEQIADSHH | | CFWVELVRGL | | CIASSTVMVGL | |
| CEQIADSQH | | CEQIADSQH | | CFWVELVRGR | | CIASSVVLVGL | |
| CESKCFWKG | | CESKCFWKG | | CFWVEMIRGE | | CIASSVVLVGP | |

Fig. 83-26

| Block size 8 | SIN | Block size 9 | SIN | Block size 10 | SIN | Block size 11 | SIN |
|---|---|---|---|---|---|---|---|
| CESKCFWRG | | CESKCFWRG | | CFWVEMIRGK | | CIAWSRSSCHD | |
| CETKCQSPL | | CETKCQSPL | | CFWVEMIRGQ | | CIAWSSASCHD | |
| CETKCQTPL | | CETKCQTPL | | CFWVEMIRGR | | CIAWSSSSCFD | |
| CETQCQTPL | | CETQCQTPL | | CFWVMTDGPA | | CIAWSSSSCHD | |
| CETRCQTPL | | CETRCQTPL | | CFYIELIRGK | | CIAWSSSSCYD | |
| CEVNSWHIF | | CEVNSWHIF | | CFYIELIRGR | | CICEKLEQSGL | |
| CEVNSWHIL | | CEVNSWHIL | | CFYSGGTINS | | CICINGTCTVV | |
| CEVSSWHIL | | CEVSSWHIL | | CFYVELIRGK | | CICRDNWKGAN | |
| CFDGKEWLH | | CFDGKEWLH | | CFYVELIRGM | | CICRDNWKGSN | |
| CFDGKEWMH | | CFDGKEWMH | | CFYVELIRGR | | CICRDNWQGAN | |
| CFDGREWMH | | CFDGREWMH | | CFYVELIRGS | | CICRDNWRGAN | |
| CFDILHKCD | | CFDILHKCD | | CFYVELTRGR | | CICRDNWTGTN | |
| CFDILHKCN | | CFDILHKCN | | CFYVELTRGV | | CIDFRDMRKNT | |
| CFDLYHKCD | | CFDLYHKCD | | CFYVELVRGR | | CIDGTCTVVMT | |
| CFEFWHKCD | | CFEFWHKCD | | CGCRDNWQGA | | CIEGKLSQMPK | |
| CFEFWHKCN | | CFEFWHKCN | | CGILGILTGP | | CIEGKLSQMSK | |
| CFEFYHKCD | | CFEFYHKCD | | CGILGTIIGP | | CIEKIRNGTYD | |
| CFEFYHKCN | | CFEFYHKCN | | CGLDNEPGSE | | CIEKVRNGTYD | |
| CFEFYHRCD | | CFEFYHRCD | | CGLDNEPGSG | | CIERVRNGTYD | |
| CFEIFHKCD | | CFEIFHKCD | | CGLLGIITGP | | CIESIRNGTYD | |
| CFEIFHQCD | | CFEIFHQCD | | CGLLGILIGP | | CIESIRNGTYN | |
| CFEIFHRCD | | CFEIFHRCD | | CGLLGTITGP | | CIESKLSQMSK | |
| CFEILHKCD | | CFEILHKCD | | CGLLGTLIGP | | CIGHHANNSTE | |
| CFEILHKCN | | CFEILHKCN | | CGLLGTLTGP | | CIGWSSTSCHD | |
| CFEILHRCD | | CFEILHRCD | | CGLLGTVTGP | | CIGYHANKSTK | |
| CFEILHRCN | | CFEILHRCN | | CGLNNEPGSG | | CIGYHANNSKK | |
| CFEIYHACD | | CFEIYHACD | | CGMIDGWYGF | | CIGYHANNSTD | |
| CFEIYHKCD | | CFEIYHKCD | | CGNGSCRCTI | | CIGYHANNSTE | |
| CFEIYHNCD | | CFEIYHNCD | | CGNNCIESIR | | CIGYHANNSTK | |
| CFEIYHRCD | | CFEIYHRCD | | CGPAECRTFF | | CIGYHANNSTT | |
| CFEIYHTCD | | CFEIYHTCD | | CGPSECRTFF | | CIGYHANNSTV | |
| CFELLHKCN | | CFELLHKCN | | CGPTECRTFF | | CIGYHSNNSTE | |
| CFELYHKCD | | CFELYHKCD | | CGSKEQLGSW | | CIGYHSNNSTK | |
| CFELYHKCN | | CFELYHKCN | | CGSKERLGSW | | CIGYLSNNATD | |
| CFELYHRCD | | CFELYHRCD | | CGSKKRLGSW | | CIGYLSNNSSD | |
| CFFMQIAIL | | CFFMQIAIL | | CGSPFPVGSG | | CIGYLSNNSTD | |
| CFKIYHKCD | | CFKIYHKCD | | CGSPISVGSG | | CIGYLSNNSTE | |
| CFKIYHKCN | | CFKIYHKCN | | CGSPVPVGSG | | CIGYLSTNSSE | |
| CFKIYHRCD | | CFKIYHRCD | | CGSPVSVGSG | | CIGYMSNNSTE | |
| CFLLAALLL | | CFLLAALLL | | CGSRERLGSW | | CIGYQSNNSTD | |
| CFLLIALLL | | CFLLIALLL | | CGTSGTYGAG | | CIGYQSNNSTN | |
| CFLLVALFL | | CFLLVALFL | | CGTSGTYGSG | | CIGYQTNNSTD | |
| CFLLVALLI | | CFLLVALLI | | CGTSGTYGTG | | CIGYQTNNSTE | |
| CFLLVALLL | | CFLLVALLL | | CGVDSDTTGW | | CIKNGNMQCTI | |
| CFLMQIAIL | | CFLMQIAIL | | CGVDSDTTSW | | CIKNGNMRCTI | |
| CFLMQIATL | | CFLMQIATL | | CGVNSDTTCW | | CIKNGNVRCTI | |
| CFLMQIAVL | | CFLMQIAVL | | CGVNSDTTGW | | CIKPCFWVELI | |
| CFLMQITIL | | CFLMQITIL | | CGVNSDTTSW | | CILDQNFRNIR | |
| CFLWHVRKR | | CFLWHVRKR | | CGVSGEVPGW | | CINGICTVVMT | |
| CFMYSDFHF | | CFMYSDFHF | | CGVSSEAPGW | | CINGSCAVVMT | |
| CFNFFHKCN | | CFNFFHKCN | | CGVSSEVPGC | | CINGSCIVVMT | |
| CFNLLHKCN | | CFNLLHKCN | | CGVSSEVPGW | | CINGSCTVVMT | |
| CFNPCFYVE | | CFNPCFYVE | | CHDGASWLTI | | CINGTCAVVMT | |
| CFNPITGSP | | CFNPITGSP | | CHDGIARMTI | | CINGTCTVIMT | |
| CFNPMIAEL | | CFNPMIAEL | | CHDGIGRMTI | | CINGTCTVVMT | |
| CFNPMIIEL | | CFNPMIIEL | | CHDGISWLTI | | CINRCFYVELI | |
| CFNPMIVEL | | CFNPMIVEL | | CHDGKAWLHI | | CINRCFYVELV | |
| CFNPMTVEL | | CFNPMTVEL | | CHDGKAWLHV | | CIQGNNDNATA | |
| CFNPMVVEL | | CFNPMVVEL | | CHDGKSWLHV | | CIRFVNSDCSK | |
| CFPFYHKCD | | CFPFYHKCD | | CHDGNAWLHV | | CIRPCFWVELI | |
| CFPGELDNN | | CFPGELDNN | | CHDGRAWLHI | | CIRPCFWVELV | |
| CFPGEVDNN | | CFPGEVDNN | | CHDGRAWLHV | | CISATGMALSV | |

Fig. 83-27

| Block size 8 | SIN | Block size 9 | SIN | Block size 10 | SIN | Block size 11 | SIN |
|---|---|---|---|---|---|---|---|
| CFQPCFYIE | | CFQPCFYIE | | CHDGSSWLTI | | CISATGMILSV | |
| CFQPCFYVE | | CFQPCFYVE | | CHDGTNWLTI | | CISATGMTLSV | |
| CFQRSKFLL | | CFQRSKFLL | | CHDGTSWLTI | | CISATGVTLSV | |
| CFRIYHKCD | | CFRIYHKCD | | CHDGVCPVVF | | CISGPNNNASA | |
| CFSILHKCN | | CFSILHKCN | | CHDGVGRMTI | | CISGTCAVVMT | |
| CFSLLHKCN | | CFSLLHKCN | | CHDGVNRMTI | | CISTTGMTLSV | |
| CFTFYHKCD | | CFTFYHKCD | | CHDGVSRMTI | | CITGDDKNATA | |
| CFTFYHKCN | | CFTFYHKCN | | CHIGVAPSPS | | CITGDDRNATA | |
| CFTIMTDGP | | CFTIMTDGP | | CHNGICPVVF | | CITPNGSIPND | |
| CFTIYHKCD | | CFTIYHKCD | | CHNGTCAVVM | | CITPNGSIPNE | |
| CFTVLTDGP | | CFTVLTDGP | | CHNGTCVVIM | | CITPNGSIPNG | |
| CFTVMTDGP | | CFTVMTDGP | | CHNGTCVVVM | | CITPNGSIPNN | |
| CFVFVALIL | | CFVFVALIL | | CHNGVCPVVF | | CITPNGSISND | |
| CFWKGGSIK | | CFWKGGSIK | | CHQRSKFLLM | | CIVAVTDGPAA | |
| CFWKGGSIN | | CFWKGGSIN | | CHSAAFEDLR | | CIVPCFWLEMI | |
| CFWKGGTIN | | CFWKGGTIN | | CHSGICPVVF | | CIVVMTDGSAS | |
| CFWLEMIRG | | CFWLEMIRG | | CHSGVCPVVF | | CKAAIGLRISS | |
| CFWMCSNGS | | CFWMCSNGS | | CHTKCQTYAG | | CKAALGLRISS | |
| CFWRGGSII | | CFWRGGSII | | CHTKCQTYTG | | CKAAMGLKISS | |
| CFWRGGSIN | | CFWRGGSIN | | CIASSIVLVG | | CKAAMGLRISS | |
| CFWVELIRG | | CFWVELIRG | | CIASSIVMVG | | CKAAMGMRISS | |
| CFWVELVRG | | CFWVELVRG | | CIASSLILAA | | CKIEAVIYGNP | |
| CFWVEMIRG | | CFWVEMIRG | | CIASSLVLAA | | CKINSWHIFGK | |
| CFWVMTDGP | | CFWVMTDGP | | CIASSTVLVG | | CKITGFAPFSK | |
| CFYIELIRG | | CFYIELIRG | | CIASSTVMVG | | CKIVTTVGWSW | |
| CFYSGGTIN | | CFYSGGTIN | | CIASSVVLVG | | CKLLGINMSKK | |
| CFYVELIRG | | CFYVELIRG | | CIAWSSASCH | | CKLNGIPPLEL | |
| CFYVELTRG | | CFYVELTRG | | CIAWSSSSCF | | CKLVGINMSKK | |
| CFYVELVRG | | CFYVELVRG | | CIAWSSSSCH | | CKLVGINMSKR | |
| CGCRDNWQG | | CGCRDNWQG | | CIAWSSSSCY | | CKMYALHQGTT | |
| CGILGILTG | | CGILGILTG | | CICEKLEQSG | | CKPYIGKCPKY | |
| CGILGTIIG | | CGILGTIIG | | CICINGTCTV | | CKRTVSSFYSE | |
| CGLDNEPGS | | CGLDNEPGS | | CICRDNWKGA | | CKSKCFWRGGS | |
| CGLLGIITG | | CGLLGIITG | | CICRDNWKGS | | CKTFFLTQGAL | |
| CGLLGILIG | | CGLLGILIG | | CICRDNWRGA | | CKTKCQTYAGA | |
| CGLLGTITG | | CGLLGTITG | | CICRDNWTGT | | CKTKEGRRKTN | |
| CGLLGTLIG | | CGLLGTLIG | | CIDFRDMRKN | | CKVEAVIYGNP | |
| CGLLGTLTG | | CGLLGTLTG | | CIEGKLSQMP | | CKVEGWVVVAK | |
| CGLLGTVTG | | CGLLGTVTG | | CIEGKLSQMS | | CLAILIAGGLI | |
| CGLNNEPGS | | CGLNNEPGS | | CIEKIRNGTY | | CLAILVAGGLI | |
| CGMIDGWYG | | CGMIDGWYG | | CIEKVRNGTY | | CLAVLIAGGLI | |
| CGNGSCRCT | | CGNGSCRCT | | CIERVRNGTY | | CLGHHAVANGT | |
| CGNNCIESI | | CGNNCIESI | | CIESIRNGTY | | CLGHHAVENGT | |
| CGPAECRTF | | CGPAECRTF | | CIESKLSQMS | | CLGHHAVPNGT | |
| CGPSECRTF | | CGPSECRTF | | CIESVRNGTY | | CLGHHAVQNGT | |
| CGPTECRTF | | CGPTECRTF | | CIGHHANNST | | CLGHHAVSNGT | |
| CGSKEQLGS | | CGSKEQLGS | | CIGSIRNETY | | CLGHHAVTNGT | |
| CGSKERLGS | | CGSKERLGS | | CIGSIRNGTY | | CLINDPWVLLN | |
| CGSKKRLGS | | CGSKKRLGS | | CIGWSSTSCH | | CLKNGNMRCTI | |
| CGSPFPVGS | | CGSPFPVGS | | CIGYHANNSK | | CLLQSLQQIES | |
| CGSPISVGS | | CGSPISVGS | | CIGYHANNST | | CLRGGRNSFFS | |
| CGSPVPVGS | | CGSPVPVGS | | CIGYHSNNST | | CLRNGNMRCTI | |
| CGSPVSVGS | | CGSPVSVGS | | CIGYLSNNAT | | CLTDKGSIQSD | |
| CGSRERLGS | | CGSRERLGS | | CIGYLSNNSS | | CLVPCFWLEMI | |
| CGTGSWPDG | | CGTGSWPDG | | CIGYLSNNST | | CLVPCFWVEMI | |
| CGTSGTYGA | | CGTSGTYGA | | CIGYLSTNSS | | CLYASPQLEGF | |
| CGTSGTYGS | | CGTSGTYGS | | CIGYMSNNST | | CMANIRNNTYD | |
| CGTSGTYGT | | CGTSGTYGT | | CIGYQSNNST | | CMASIRNNSYD | |
| CGVDSDTTG | | CGVDSDTTG | | CIGYQTNNST | | CMASIRNNTYD | |
| CGVDSDTTS | | CGVDSDTTS | | CIINSWHIYG | | CMASIRNNTYN | |
| CGVNSDTTG | | CGVNSDTTG | | CIKDGNMRCT | | CMASIRNSTYD | |
| CGVNSDTTS | | CGVNSDTTS | | CIKFVSSDCS | | CMAWSSSSCHD | |

Fig. 83-28

| Block size 8 | SIN | Block size 9 | SIN | Block size 10 | SIN | Block size 11 | SIN |
|---|---|---|---|---|---|---|---|
| CGVNSNTTG | | CGVNSNTTG | | CIKICESRLR | | CMDTIRNGTYN | |
| CGVSGEVPG | | CGVSGEVPG | | CIKNGNMQCT | | CMEAIRNGTYN | |
| CGVSSEVPE | | CGVSSEVPE | | CIKNGNMRCT | | CMERIRNNTYD | |
| CGVSSEVPG | | CGVSSEVPG | | CIKNGNVRCT | | CMESIKNGTYD | |
| CHDGASWLT | | CHDGASWLT | | CIKPCFWVEL | | CMESIRNNTYD | |
| CHDGIARMT | | CHDGIARMT | | CILDQNFRNI | | CMESIRNNTYN | |
| CHDGIGRMT | | CHDGIGRMT | | CINGICTVVM | | CMESVKNGTYD | |
| CHDGISRMS | | CHDGISRMS | | CINGSCAVVM | | CMESVKNGTYN | |
| CHDGISWLT | | CHDGISWLT | | CINGSCIVVM | | CMESVRNGTYD | |
| CHDGKARMS | | CHDGKARMS | | CINGSCTVVM | | CMETIKNGTYD | |
| CHDGKAWLH | | CHDGKAWLH | | CINGTCAVVM | | CMETIKNGTYN | |
| CHDGKEWLH | | CHDGKEWLH | | CINGTCTVIM | | CMETIRNGTYD | |
| CHDGKFRMS | | CHDGKFRMS | | CINGTCTVVM | | CMETIRNGTYN | |
| CHDGKKWMA | | CHDGKKWMA | | CINRCFYVEL | | CMGLIYNRMGA | |
| CHDGKKWMT | | CHDGKKWMT | | CIQGNNDNAT | | CMGLIYNRMGT | |
| CHDGKSRMS | | CHDGKSRMS | | CIRFVNSDCS | | CMGSIRNNTYD | |
| CHDGKSWLH | | CHDGKSWLH | | CIRPCFWVEL | | CMIKAIRGDLN | |
| CHDGMSRMS | | CHDGMSRMS | | CISATGMALS | | CMIKAVRGDLN | |
| CHDGNAWLH | | CHDGNAWLH | | CISATGMILS | | CMMKAVRGDLN | |
| CHDGNKWMT | | CHDGNKWMT | | CISATGMTLS | | CMRPCFWVELI | |
| CHDGRARMS | | CHDGRARMS | | CISATGVTLS | | CMRPCFWVELV | |
| CHDGRAWLH | | CHDGRAWLH | | CISGPNNNAS | | CMSGPNDNASA | |
| CHDGRKWMT | | CHDGRKWMT | | CISGTCAVVM | | CMSGPNNNASA | |
| CHDGRSRMS | | CHDGRSRMS | | CISTTGMTLS | | CMVKAVRGDLN | |
| CHDGSSWLT | | CHDGSSWLT | | CITGDDKNAT | | CNALTGGQSFY | |
| CHDGTNWLT | | CHDGTNWLT | | CITGDDRNAT | | CNASTGAQSFY | |
| CHDGTSWLT | | CHDGTSWLT | | CITPNGSIPN | | CNASTGGQAFY | |
| CHDGVGRMT | | CHDGVGRMT | | CITPNGSISN | | CNASTGGQSFY | |
| CHDGVNRMT | | CHDGVNRMT | | CIVAVTDGPA | | CNDPYPGNNBN | |
| CHDGVSRMS | | CHDGVSRMS | | CIVPCFWLEM | | CNDPYPGNNNG | |
| CHDGVSRMT | | CHDGVSRMT | | CKAAIGLRIS | | CNDPYPGNNNK | |
| CHIGVAPSP | | CHIGVAPSP | | CKAALGLRIS | | CNDPYPGNNNN | |
| CHITGFAPF | | CHITGFAPF | | CKAAMGLKIS | | CNDSCMDTIRN | |
| CHKGICPVV | | CHKGICPVV | | CKAAMGLRIS | | CNDSCMEAIRN | |
| CHKGVCPVV | | CHKGVCPVV | | CKAAMGMRIS | | CNDSCMETIRN | |
| CHNGICPVA | | CHNGICPVA | | CKIEAVIYGN | | CNEPYPGNNNN | |
| CHNGICPVV | | CHNGICPVV | | CKITGFAPFS | | CNFEGWIVGNP | |
| CHNGTCAVV | | CHNGTCAVV | | CKIVTTVGWS | | CNILKGKFQTA | |
| CHNGTCPVV | | CHNGTCPVV | | CKLLGINMSK | | CNLFEKFFPSS | |
| CHNGTCVVI | | CHNGTCVVI | | CKLNGIPPLE | | CNNECMETIKN | |
| CHNGTCVVV | | CHNGTCVVV | | CKLVGINMSK | | CNNGSCRCTIC | |
| CHNGVCPVV | | CHNGVCPVV | | CKMYALHQGT | | CNNPITGSPEA | |
| CHPIGMIIG | | CHPIGMIIG | | CKPYIGKCPK | | CNNPITGSPGA | |
| CHPIGMLIG | | CHPIGMLIG | | CKRTVSSFYS | | CNNSCMETIRN | |
| CHPIGMVIG | | CHPIGMVIG | | CKTFFLTQGA | | CNNTCMETIRN | |
| CHPIGMVVG | | CHPIGMVVG | | CKTKCQTYAG | | CNQFALGQGTT | |
| CHPVGMLIG | | CHPVGMLIG | | CKTKEGRRKT | | CNSAAFEDLRV | |
| CHQRSKFLL | | CHQRSKFLL | | CKVEAVIYGN | | CNSNAITRSGQ | |
| CHSAAFEDL | | CHSAAFEDL | | CKVEGWVVVA | | CNTDLGAPLEL | |
| CHSGVCPVV | | CHSGICPVV | | CLAILIAGGL | | CNTDLGSPLEL | |
| CHSGVCPVV | | CHSGVCPVV | | CLAILVAGGL | | CNTDLGTPLEL | |
| CHTKCQTYA | | CHTKCQTYA | | CLAVLIAGGL | | CNTKCQTSLGG | |
| CHTKCQTYT | | CHTKCQTYT | | CLGHHAIPNG | | CNTKCQTSMGG | |
| CIASSIVLV | | CIASSIVLV | | CLGHHAVANG | | CNTKCQTSVGG | |
| CIASSIVMV | | CIASSIVMV | | CLGHHAVENG | | CNTKCQTYAGA | |
| CIASSLILA | | CIASSLILA | | CLGHHAVPNG | | CNTRCQTSVGG | |
| CIASSLVLA | | CIASSLVLA | | CLGHHAVQNG | | CNVEGWVVIAK | |
| CIASSTVLV | | CIASSTVLV | | CLGHHAVSNG | | CPFKGFFPFHK | |
| CIASSTVMV | | CIASSTVMV | | CLGHHAVTNG | | CPFQGFFPFHK | |
| CIASSVVLV | | CIASSVVLV | | CLINDPWVLL | | CPFRGFFPFHK | |
| CIAWSSASC | | CIAWSSASC | | CLKIYHKCDN | | CPIGEAPSPYN | |
| CIAWSSSSC | | CIAWSSSSC | | CLKNGNMRCT | | CPIGEVPSPYN | |

Fig. 83-29

| Block size 8 | SIN | Block size 9 | SIN | Block size 10 | SIN | Block size 11 | SIN |
|---|---|---|---|---|---|---|---|
| CICEKLEQS | | CICEKLEQS | | CLLQSLQQIE | | CPIGVAPSPSN | |
| CICINGTCT | | CICINGTCT | | CLPACAYGPA | | CPIGVVPSPSN | |
| CICRDNWKG | | CICRDNWKG | | CLPACIYGLV | | CPIKGWAPLSK | |
| CICRDNWQG | | CICRDNWQG | | CLPACVYGLA | | CPIRGWAPLSK | |
| CICRDNWRG | | CICRDNWRG | | CLPACVYGLV | | CPKYIKQGSLK | |
| CICRDNWTG | | CICRDNWTG | | CLPACVYGPA | | CPKYIKSDQLK | |
| CIDFRDMRK | | CIDFRDMRK | | CLRGGRNSFF | | CPKYIKSGQLK | |
| CIEGKLSQM | | CIEGKLSQM | | CLRNGNMRCT | | CPKYIPSGSLK | |
| CIEKIRNGT | | CIEKIRNGT | | CLTDKGSIQS | | CPKYIPSNSLK | |
| CIEKVRNGT | | CIEKVRNGT | | CLVPCFWLEM | | CPKYIPSRSLK | |
| CIERVRNGT | | CIERVRNGT | | CLVPCFWVEM | | CPKYISSGSLK | |
| CIESIRNGT | | CIESIRNGT | | CLYASPQLEG | | CPKYMNVKSLK | |
| CIESKLSQM | | CIESKLSQM | | CMASIRNNSY | | CPKYVKQGSLK | |
| CIESVRNGT | | CIESVRNGT | | CMASIRNNTY | | CPKYVKQGSLM | |
| CIGHHANNS | | CIGHHANNS | | CMASIRNSTY | | CPKYVKQGSLR | |
| CIGSIRNET | | CIGSIRNET | | CMATIRNGTY | | CPKYVKSDRLV | |
| CIGSIRNGT | | CIGSIRNGT | | CMAWSSSSCH | | CPKYVKSEKLV | |
| CIGWSSTSC | | CIGWSSTSC | | CMDSVKNGTY | | CPKYVKSERLV | |
| CIGYHANNS | | CIGYHANNS | | CMDSVRNGTY | | CPKYVKSKRLV | |
| CIGYHSNNS | | CIGYHSNNS | | CMDTIRNGTY | | CPKYVNIKSLK | |
| CIGYLSNNA | | CIGYLSNNA | | CMEAIRNGTY | | CPKYVNVKSLK | |
| CIGYLSNNS | | CIGYLSNNS | | CMERIRNNTY | | CPKYVNVRSLK | |
| CIGYLSTNS | | CIGYLSTNS | | CMESIKNGTY | | CPKYVRSEKLV | |
| CIGYMSNNS | | CIGYMSNNS | | CMESIRNGTY | | CPLGEAPSPYN | |
| CIGYQSNNS | | CIGYQSNNS | | CMESIRNNTY | | CPMGVAPSPSN | |
| CIGYQTNNS | | CIGYQTNNS | | CMESVKNGTY | | CPRYIPSGSLK | |
| CIINSWHIY | | CIINSWHIY | | CMESVRNGTY | | CPRYVKQGSLK | |
| CIKNGNMQC | | CIKNGNMQC | | CMETIKNGTY | | CPRYVKQSSLP | |
| CIKNGNMRC | | CIKNGNMRC | | CMETIRNGTY | | CPSPLKLVDGQ | |
| CIKPCFWVE | | CIKPCFWVE | | CMETTRNGTY | | CPVGEAPSPYN | |
| CIKTFFGWK | | CIKTFFGWK | | CMGLIYNRMG | | CPVGVAPSPSN | |
| CILDQNFRN | | CILDQNFRN | | CMGSIRNNTY | | CPVIMTDGPAN | |
| CINGICTVV | | CINGICTVV | | CMGTIRNGTY | | CPVKGWAPLSK | |
| CINGSCAVV | | CINGSCAVV | | CMIKAVRGDL | | CPVVFTDGSAT | |
| CINGSCIVV | | CINGSCIVV | | CMMKAVRGDL | | CPVVMTDGPAD | |
| CINGSCTVV | | CINGSCTVV | | CMNSVKNGTY | | CPVVMTDGPAN | |
| CINGTCAVV | | CINGTCAVV | | CMNSVKTGTY | | CPVVMTDGPAS | |
| CINGTCTVI | | CINGTCTVI | | CMNSVRNGTY | | CQDEFCYTLIT | |
| CINGTCTVV | | CINGTCTVV | | CMRPCFWVEL | | CQDEFCYTLMT | |
| CINRCFYVE | | CINRCFYVE | | CMSGPNDNAS | | CQDEFCYTLVT | |
| CIQGNNDNA | | CIQGNNDNA | | CMSGPNNNAS | | CQITGFAPFSK | |
| CIRPCFWVE | | CIRPCFWVE | | CMSSVKNGTY | | CQKGNIKCNIC | |
| CIRTFFGWK | | CIRTFFGWK | | CMTSIRNNTY | | CQKGNIRCDIC | |
| CISATGMAL | | CISATGMAL | | CMVKAVRGDL | | CQKGNIRCNIC | |
| CISATGMIL | | CISATGMIL | | CNALTGGQSF | | CQLNEGIMNTS | |
| CISATGMTL | | CISATGMTL | | CNASTGAQSF | | CQLNEGVINTS | |
| CISATGVTL | | CISATGVTL | | CNASTGGQAF | | CQLNEGVMNTS | |
| CISGPNNNA | | CISGPNNNA | | CNASTGGQSF | | CQMEKIVLLFA | |
| CISGTCAVV | | CISGTCAVV | | CNDNCMESIR | | CQNGNIRCQIC | |
| CISTTGMTL | | CISTTGMTL | | CNDPYPGNNB | | CQNGNIRCTFC | |
| CITGDDKNA | | CITGDDKNA | | CNDPYPGNNN | | CQNGNLRCQIC | |
| CITGDDRNA | | CITGDDRNA | | CNDSCMDTIR | | CQNGNVRCQIC | |
| CITPNGSIP | | CITPNGSIP | | CNDSCMEAIR | | CQNGNVRCTFC | |
| CITPNGSIS | | CITPNGSIS | | CNDSCMETIR | | CQNGVCPVVFT | |
| CIVAVTDGP | | CIVAVTDGP | | CNEPYPGNNN | | CQRGNIRCNIC | |
| CIVPCFWLE | | CIVPCFWLE | | CNFEGWIVGN | | CQSPLGAINTT | |
| CKAAIGLRI | | CKAAIGLRI | | CNILKGKFQT | | CQTPLGAINTT | |
| CKAALGLRI | | CKAALGLRI | | CNLFEKFFPS | | CQTPLGALNTT | |
| CKAAMGLKI | | CKAAMGLKI | | CNNECMETIK | | CQTSVGGIDTN | |
| CKAAMGLRI | | CKAAMGLRI | | CNNGSCRCTI | | CQTSVGGINTN | |
| CKAAMGMRI | | CKAAMGMRI | | CNNNCIESIR | | CQTYAGAINSS | |
| CKDPNNERG | | CKDPNNERG | | CNNPITGSPE | | CQTYAGAVNSS | |

Fig. 83-30

| Block size 8 | SIN | Block size 9 | SIN | Block size 10 | SIN | Block size 11 | SIN |
|---|---|---|---|---|---|---|---|
| CKIEAVIYG | | CKIEAVIYG | | CNNPITGSPG | | CQTYTGAINSS | |
| CKIEGWVVV | | CKIEGWVVV | | CNNSCMETIR | | CQVECVCRDNW | |
| CKITGFAPF | | CKITGFAPF | | CNNTCMETIR | | CRALLAKSVFN | |
| CKIVTTVGW | | CKIVTTVGW | | CNPLNPFVGH | | CRATEYIMKGV | |
| CKLLGINMS | | CKLLGINMS | | CNPLNPFVNH | | CRATEYMMKGV | |
| CKLNGIPPL | | CKLNGIPPL | | CNPLNPFVSH | | CRDNWHASNRP | |
| CKLVGINMS | | CKLVGINMS | | CNPLNPFVTH | | CRDNWHGSNRP | |
| CKMYALHQG | | CKMYALHQG | | CNPMNPFVSH | | CRDNWKGANRP | |
| CKPYIGKCP | | CKPYIGKCP | | CNQFALGQGT | | CRDNWKGSNRP | |
| CKRTVSSFY | | CKRTVSSFY | | CNSAAFEDLR | | CRDNWMGSNRP | |
| CKSKCFWRG | | CKSKCFWRG | | CNSNAITRSG | | CRDNWNGMNRP | |
| CKTFFLTQG | | CKTFFLTQG | | CNTDLGAPLE | | CRDNWQGANRP | |
| CKTKCQTYA | | CKTKCQTYA | | CNTDLGSPLE | | CRDNWQGSNRP | |
| CKVEAVIYG | | CKVEAVIYG | | CNTDLGTPLE | | CRDNWRGANRP | |
| CKVEGWVVV | | CKVEGWVVV | | CNTKCQTSLG | | CRDNWRGSNRP | |
| CLAILIAGG | | CLAILIAGG | | CNTKCQTSMG | | CRDNWTGTNRP | |
| CLAILVAGG | | CLAILVAGG | | CNTKCQTSVG | | CRETRGLFGAI | |
| CLAVLIAGG | | CLAVLIAGG | | CNTKCQTYAG | | CRFEGWIVGNP | |
| CLGHHAIPN | | CLGHHAIPN | | CNTRCQTSVG | | CRFYALSQGTT | |
| CLGHHAVAN | | CLGHHAVAN | | CNVEGWVVIA | | CRICIDFRDMR | |
| CLGHHAVEN | | CLGHHAVEN | | CPFKGFFPFH | | CRICILDQNFR | |
| CLGHHAVPN | | CLGHHAVPN | | CPFQGFFPFH | | CRIIQNEDIPI | |
| CLGHHAVQN | | CLGHHAVQN | | CPFRGFFPFH | | CRKTRGLFGAI | |
| CLGHHAVSN | | CLGHHAVSN | | CPIGEAPSPY | | CRLRGIPPLEL | |
| CLGHHAVTN | | CLGHHAVTN | | CPIGEVPSPY | | CRLSGIPPLEL | |
| CLINDPWVL | | CLINDPWVL | | CPIGVAPSPS | | CRMFALSQGTT | |
| CLKIYHKCD | | CLKIYHKCD | | CPIKGWAPLS | | CRMYALHQGTT | |
| CLKNGNMRC | | CLKNGNMRC | | CPIRGWAPLS | | CRTFFLTHGAL | |
| CLLQSLQQI | | CLLQSLQQI | | CPKYIKQGSL | | CRTFFLTHGSL | |
| CLNGSMQCR | | CLNGSMQCR | | CPKYIKSDQL | | CRTFFLTQGAL | |
| CLPACAYGP | | CLPACAYGP | | CPKYIKSGQL | | CRTFFLTQGSL | |
| CLPACIYGL | | CLPACIYGL | | CPKYIPSGSL | | CRTKEGRRKTN | |
| CLPACVYGL | | CLPACVYGL | | CPKYIPSNSL | | CRTKEGRRRTN | |
| CLPACVYGP | | CLPACVYGP | | CPKYIPSRSL | | CRTLLAKSVFN | |
| CLRGGRNSF | | CLRGGRNSF | | CPKYISSGSL | | CRTREGRRKTN | |
| CLRNGNMRC | | CLRNGNMRC | | CPKYMNVKSL | | CSALFVYSLRK | |
| CLTDKGSIQ | | CLTDKGSIQ | | CPKYVKQGSL | | CSASTGGQSFY | |
| CLVPCFWLE | | CLVPCFWLE | | CPKYVKSDRL | | CSCYMDIDVYC | |
| CLVPCFWVE | | CLVPCFWVE | | CPKYVKSEKL | | CSCYPNDGKVE | |
| CLYASPQLE | | CLYASPQLE | | CPKYVKSERL | | CSCYPNEGKVE | |
| CMASIRNNS | | CMASIRNNS | | CPKYVNIKSL | | CSCYPNLGIVE | |
| CMASIRNNT | | CMASIRNNT | | CPKYVNVKSL | | CSCYPNLGKVE | |
| CMASIRNST | | CMASIRNST | | CPKYVNVRSL | | CSCYPNLGQVE | |
| CMATIRNGT | | CMATIRNGT | | CPKYVRSEKL | | CSCYPNMGKVE | |
| CMAWSSSSC | | CMAWSSSSC | | CPLGEAPSPY | | CSCYPNNGKVE | |
| CMDSVKNGT | | CMDSVKNGT | | CPMGVAPSPS | | CSCYPNSGKVE | |
| CMDSVRNGT | | CMDSVRNGT | | CPNGSLQCTI | | CSCYPQYPNVR | |
| CMDTIRNGT | | CMDTIRNGT | | CPRYIPSGSL | | CSCYPRYPDVR | |
| CMEAIRNGT | | CMEAIRNGT | | CPRYVKQGSL | | CSCYPRYPGVR | |
| CMERIRNNT | | CMERIRNNT | | CPRYVKQSSL | | CSCYPRYPNVR | |
| CMESIKNGT | | CMESIKNGT | | CPRYVKSEKL | | CSCYSRYPNVR | |
| CMESIRDNT | | CMESIRDNT | | CPSPLKLVDG | | CSCYVDIDIYC | |
| CMESIRNGT | | CMESIRNGT | | CPVGEAPSPY | | CSCYVDIDVYC | |
| CMESIRNNT | | CMESIRNNT | | CPVGVAPSPS | | CSCYVDTDVYC | |
| CMESVKNGT | | CMESVKNGT | | CPVKGWAPLS | | CSCYVDVDVYC | |
| CMESVRNGT | | CMESVRNGT | | CPVVFTDGSA | | CSDGPGWLTIG | |
| CMETIKNGT | | CMETIKNGT | | CPVVMTDGPA | | CSDGPGWLTLG | |
| CMETIRNGT | | CMETIRNGT | | CQDEFCYTLI | | CSDGSGWLTLG | |
| CMETTRNGT | | CMETTRNGT | | CQDEFCYTLM | | CSFAGWILGNP | |
| CMGLIYNRM | | CMGLIYNRM | | CQDEFCYTLV | | CSFEGWIGGNP | |
| CMGSIRNNT | | CMGSIRNNT | | CQIAGFAPFS | | CSFEGWIVGNP | |
| CMGTIRNGT | | CMGTIRNGT | | CQITGFAPFS | | CSFTGWILGNP | |

Fig. 83-31

| Block size 8 | SIN | Block size 9 | SIN | Block size 10 | SIN | Block size 11 | SIN |
|---|---|---|---|---|---|---|---|
| CMIKAVRGD | | CMIKAVRGD | | CQKGNIKCNI | | CSGFFGDNPRP | |
| CMKNGNMQC | | CMKNGNMQC | | CQKGNIRCDI | | CSGIFGDNPRP | |
| CMKTFFGWK | | CMKTFFGWK | | CQKGNIRCNI | | CSGIFGDSPRP | |
| CMKTFFGWR | | CMKTFFGWR | | CQLNEGIMNT | | CSGLVGDTPRD | |
| CMMKAVRGD | | CMMKAVRGD | | CQLNEGVINT | | CSGLVGDTPRE | |
| CMNSVKNGT | | CMNSVKNGT | | CQLNEGVMNT | | CSGLVGDTPRG | |
| CMNSVKTGT | | CMNSVKTGT | | CQMEKIVLLF | | CSGLVGDTPRK | |
| CMNSVRNGT | | CMNSVRNGT | | CQNGNIRCQI | | CSGLVGDTPRN | |
| CMRPCFWVE | | CMRPCFWVE | | CQNGNIRCTF | | CSGLVGDTPRS | |
| CMRTFFGWK | | CMRTFFGWK | | CQNGNLRCQI | | CSGLVGDTPRT | |
| CMSGPNDNA | | CMSGPNDNA | | CQNGNVRCQI | | CSGVFGDNPRP | |
| CMSGPNNNA | | CMSGPNNNA | | CQNGNVRCTF | | CSGVFGDNPRS | |
| CMSSVKNGT | | CMSSVKNGT | | CQRGNIRCNI | | CSGVFGDSPRP | |
| CMTSIRNNT | | CMTSIRNNT | | CQSEIGGINT | | CSGVFGDTPRP | |
| CMVKAVRGD | | CMVKAVRGD | | CQSEIGGIST | | CSGVLGDNPRP | |
| CNALTGGQS | | CNALTGGQS | | CQSEIGWINT | | CSHLECRTFFL | |
| CNASTGAQS | | CNASTGAQS | | CQSPLGAINT | | CSHMECRTFFL | |
| CNASTGGQA | | CNASTGGQA | | CQTEIGGINT | | CSHSECRTFFL | |
| CNASTGGQS | | CNASTGGQS | | CQTEVGGINT | | CSIAGWLLGNP | |
| CNDNCMESI | | CNDNCMESI | | CQTPIGAINS | | CSIDECRTFFL | |
| CNDPYPGNN | | CNDPYPGNN | | CQTPLGAINS | | CSIDGKAPISL | |
| CNDSCMDTI | | CNDSCMDTI | | CQTPLGAINT | | CSIHECRTFFL | |
| CNDSCMEAI | | CNDSCMEAI | | CQTPLGALNT | | CSINECRTFFL | |
| CNDSCMETI | | CNDSCMETI | | CQTPMGAINS | | CSINGKAPISL | |
| CNEPYPGNN | | CNEPYPGNN | | CQTPMGAVNS | | CSINGKEPISL | |
| CNFEGWIVG | | CNFEGWIVG | | CQTPVGAINS | | CSINGKQPISL | |
| CNILKGKFQ | | CNILKGKFQ | | CQTSVGGIDT | | CSINGRAPISL | |
| CNLFEKFFP | | CNLFEKFFP | | CQTSVGGINT | | CSISECRTFFL | |
| CNNECMETI | | CNNECMETI | | CQTYAGAINS | | CSIWFSHYNQM | |
| CNNGSCRCT | | CNNGSCRCT | | CQTYAGAVNS | | CSIWFSHYNQV | |
| CNNPITGSP | | CNNPITGSP | | CQTYTGAINS | | CSKFHSDTPRP | |
| CNNSCMETI | | CNNSCMETI | | CQVECVCRDN | | CSKILTDTSRP | |
| CNNTCMETI | | CNNTCMETI | | CRATEYIMKG | | CSKTLTDTSRP | |
| CNPLNPFVN | | CNPLNPFVN | | CRATEYMMKG | | CSKVLTDTSRP | |
| CNPLNPFVS | | CNPLNPFVS | | CRDNWHASNR | | CSKYHWNLALD | |
| CNPLNPFVT | | CNPLNPFVT | | CRDNWHGSNR | | CSLEGIILGNP | |
| CNPMNPFVS | | CNPMNPFVS | | CRDNWKGANR | | CSLEGLILGNP | |
| CNSAAFEDL | | CNSAAFEDL | | CRDNWKGSNR | | CSLEGLILSNP | |
| CNSGNCRFN | | CNSGNCRFN | | CRDNWMGSNR | | CSLEGLVLGNP | |
| CNSNAITRS | | CNSNAITRS | | CRDNWNGMNR | | CSLFEKFFPSS | |
| CNTDLGAPL | | CNTDLGAPL | | CRDNWQGANR | | CSLKGLILGNP | |
| CNTDLGSPL | | CNTDLGSPL | | CRDNWQGSNR | | CSLMQGSTLPR | |
| CNTDLGTPL | | CNTDLGTPL | | CRDNWRGANR | | CSLNGISPIHL | |
| CNTKCQTSL | | CNTKCQTSL | | CRDNWRGSNR | | CSLNGISPVHL | |
| CNTKCQTSM | | CNTKCQTSM | | CRDNWTGTNR | | CSLNGVSPIHL | |
| CNTKCQTSV | | CNTKCQTSV | | CRETRGLFGA | | CSLNGVSPVHL | |
| CNTKCQTYA | | CNTKCQTYA | | CRFEGWIVGN | | CSNDTINYYNE | |
| CNTRCQTSV | | CNTRCQTSV | | CRFYALSQGT | | CSNGNCRFNVC | |
| CNVEGWVVI | | CNVEGWVVI | | CRICIDFRDM | | CSNGSCRCTIC | |
| CNVEGWVVV | | CNVEGWVVV | | CRICILDQNF | | CSNGSCRFNVC | |
| CPFKGFFPF | | CPFKGFFPF | | CRIIQNEDIP | | CSNGSLQCKIC | |
| CPFQGFFPF | | CPFQGFFPF | | CRKTRGLFGA | | CSNGSLQCRIA | |
| CPFRGFFPF | | CPFRGFFPF | | CRLRGIPPLE | | CSNGSLQCRIC | |
| CPIGEAPSP | | CPIGEAPSP | | CRLSGIPPLE | | CSNGSLQCRVC | |
| CPIGEVPSP | | CPIGEVPSP | | CRMFALSQGT | | CSNGSLQCTIC | |
| CPIGVAPSP | | CPIGVAPSP | | CRMYALHQGT | | CSNGSLRCRIC | |
| CPIKGWAPL | | CPIKGWAPL | | CRTFFLTHGA | | CSNNTTNYYNE | |
| CPIRGWAPL | | CPIRGWAPL | | CRTFFLTHGS | | CSNPITGSPGA | |
| CPKYIKQGS | | CPKYIKQGS | | CRTFFLTQGA | | CSNPITGSPSA | |
| CPKYIKSDQ | | CPKYIKSDQ | | CRTFFLTQGS | | CSPLSRCRETR | |
| CPKYIKSGQ | | CPKYIKSGQ | | CRTKEGRRKT | | CSPLSRCRKTR | |
| CPKYIPSGS | | CPKYIPSGS | | CRTKEGRRRT | | CSPSECRTFFL | |

Fig. 83-32

| Block size 8 | SIN | Block size 9 | SIN | Block size 10 | SIN | Block size 11 | SIN |
|---|---|---|---|---|---|---|---|
| CPKYIPSNS | | CPKYIPSNS | | CRTLLAKSVF | | CSPVLTDNPRP | |
| CPKYIPSRS | | CPKYIPSRS | | CRTREGRRKT | | CSQLECRTFFL | |
| CPKYISSGS | | CPKYISSGS | | CSALFVYSLR | | CSQRSKFLLMD | |
| CPKYMNVKS | | CPKYMNVKS | | CSASTGGQSF | | CSRILTDTSRP | |
| CPKYVKQES | | CPKYVKQES | | CSCIASSLVL | | CSRVLTDTSRP | |
| CPKYVKQGS | | CPKYVKQGS | | CSCYMDIDVY | | CSSGNCRFNVC | |
| CPKYVKSDR | | CPKYVKSDR | | CSCYPNDGKV | | CSSGNCRFSVC | |
| CPKYVKSEK | | CPKYVKSEK | | CSCYPNEGKV | | CSSTEFLGQWD | |
| CPKYVKSER | | CPKYVKSER | | CSCYPNLGIV | | CSSTEFLGQWN | |
| CPKYVKSKR | | CPKYVKSKR | | CSCYPNLGKV | | CSVAGWLLGNP | |
| CPKYVNIKS | | CPKYVNIKS | | CSCYPNLGQV | | CSVEGWVVIAK | |
| CPKYVNVKS | | CPKYVNVKS | | CSCYPNMGKV | | CSVEYASKTRI | |
| CPKYVNVRS | | CPKYVNVRS | | CSCYPNNGKV | | CSVSECRTFFL | |
| CPKYVRSEK | | CPKYVRSEK | | CSCYPNSGKV | | CSWSLQCRICI | |
| CPLGEAPSP | | CPLGEAPSP | | CSCYPQYPNV | | CSYLECRTFFL | |
| CPMGVAPSP | | CPMGVAPSP | | CSCYPRYPDV | | CTCRDNWKGSN | |
| CPNGSLQCT | | CPNGSLQCT | | CSCYPRYPGV | | CTCRDNWQGSN | |
| CPRYIKQKS | | CPRYIKQKS | | CSCYPRYPNV | | CTGCFEIFHKC | |
| CPRYIPSGS | | CPRYIPSGS | | CSCYSRYPNV | | CTGILTDTSRP | |
| CPRYVKQES | | CPRYVKQES | | CSCYVDIDIY | | CTGNLIAPRGY | |
| CPRYVKQGS | | CPRYVKQGS | | CSCYVDIDVY | | CTGVLTDTSRP | |
| CPRYVKQKS | | CPRYVKQKS | | CSCYVDTDVY | | CTHLEICFMYS | |
| CPRYVKQSS | | CPRYVKQSS | | CSCYVDVDVY | | CTHLEVCFMYS | |
| CPRYVKQTS | | CPRYVKQTS | | CSDGPGWLTI | | CTHMEVCFMYS | |
| CPSPLKLID | | CPSPLKLID | | CSDGPGWLTL | | CTINSWHIFGK | |
| CPSPLKLVD | | CPSPLKLVD | | CSDGSGWLTL | | CTINSWHIYGK | |
| CPSPLRLID | | CPSPLRLID | | CSFAGWILGN | | CTIPCFWVEMI | |
| CPSPLRLVD | | CPSPLRLVD | | CSFAGWLLGN | | CTISLVKTTLF | |
| CPVGEAPSP | | CPVGEAPSP | | CSFEGWIGGN | | CTKGKKAVDLG | |
| CPVGVAPSP | | CPVGVAPSP | | CSFEGWIVGN | | CTLFEKFFPSS | |
| CPVKGWAPL | | CPVKGWAPL | | CSGFFGDNPR | | CTLIDALLGDP | |
| CPVVFTDGS | | CPVVFTDGS | | CSGHSCRICI | | CTLIDAMLGDP | |
| CPVVMTDGP | | CPVVMTDGP | | CSGIFGDNPR | | CTLMDALLGDP | |
| CQDEFCYTL | | CQDEFCYTL | | CSGLVGDTPR | | CTLVDALLGDP | |
| CQIAGFAPF | | CQIAGFAPF | | CSGVFGDNPR | | CTSPCLTDKGS | |
| CQITGFAPF | | CQITGFAPF | | CSGVFGDSPR | | CTVIMTDGSAS | |
| CQKGNIKCN | | CQKGNIKCN | | CSGVFGDTPR | | CTVPCFWVEMI | |
| CQKGNIRCD | | CQKGNIRCD | | CSGVLGDNPR | | CTVVLTDGSAS | |
| CQKGNIRCN | | CQKGNIRCN | | CSHLECRTFF | | CTVVMTDGNAS | |
| CQLNEGIMN | | CQLNEGIMN | | CSHMECRTFF | | CTVVMTDGSAS | |
| CQLNEGVIN | | CQLNEGVIN | | CSHSECRTFF | | CTVVMTDGSAT | |
| CQLNEGVMN | | CQLNEGVMN | | CSIAGWLLGN | | CTVVMTDGSVS | |
| CQMEKIVLL | | CQMEKIVLL | | CSIDECRTFF | | CVASSLVLAAI | |
| CQNGNIRCQ | | CQNGNIRCQ | | CSIDGKAPIS | | CVAWSSSSCFD | |
| CQNGNIRCT | | CQNGNIRCT | | CSIHECRTFF | | CVAWSSSSCHD | |
| CQNGNLRCQ | | CQNGNLRCQ | | CSINECRTFF | | CVAWSSTSCFD | |
| CQNGNVRCQ | | CQNGNVRCQ | | CSINGKAPIS | | CVCHKGICPVV | |
| CQNGNVRCT | | CQNGNVRCT | | CSINGKQPIS | | CVCHKGVCPVV | |
| CQRGNIRCN | | CQRGNIRCN | | CSINGRAPIS | | CVCHNGICPVA | |
| CQSEIGGIN | | CQSEIGGIN | | CSISECRTFF | | CVCHNGICPVV | |
| CQSEIGGIS | | CQSEIGGIS | | CSIWFSHYNQ | | CVCHNGTCAVV | |
| CQSEIGWIN | | CQSEIGWIN | | CSKFHSDTPR | | CVCHNGTCPVV | |
| CQSPLGAIN | | CQSPLGAIN | | CSKILTDTSR | | CVCHNGTCVVI | |
| CQTEIGGIN | | CQTEIGGIN | | CSKTLTDTSR | | CVCHNGTCVVV | |
| CQTEVGGIN | | CQTEVGGIN | | CSKVLTDTSR | | CVCHNGVCPVV | |
| CQTGNIRCQ | | CQTGNIRCQ | | CSKYHWNLAL | | CVCHSGICPVV | |
| CQTPIGAIN | | CQTPIGAIN | | CSLDGKAPIS | | CVCINGICTVV | |
| CQTPLGAIN | | CQTPLGAIN | | CSLEGIILGN | | CVCINGSCAVV | |
| CQTPLGALN | | CQTPLGALN | | CSLEGLILGN | | CVCINGSCIVV | |
| CQTPMGAIN | | CQTPMGAIN | | CSLEGLILSN | | CVCINGSCTVV | |
| CQTPMGAVN | | CQTPMGAVN | | CSLEGLVLGN | | CVCINGTCAVV | |
| CQTPVGAIN | | CQTPVGAIN | | CSLFEKFFPS | | CVCINGTCTVI | |

Fig. 83-33

| Block size 8 | SIN | Block size 9 | SIN | Block size 10 | SIN | Block size 11 | SIN |
|---|---|---|---|---|---|---|---|
| CQTSVGGID | | CQTSVGGID | | CSLKGLILGN | | CVCINGTCTVV | |
| CQTSVGGIN | | CQTSVGGIN | | CSLMQGSTLP | | CVCISGTCAVV | |
| CQTYAGAIN | | CQTYAGAIN | | CSLNGISPIH | | CVCQDEFCYTL | |
| CQTYAGAVN | | CQTYAGAVN | | CSLNGISPVH | | CVCQNGVCPVV | |
| CQTYTGAIN | | CQTYTGAIN | | CSLNGVSPIH | | CVCRDNWHASN | |
| CQVTGFAPF | | CQVTGFAPF | | CSLNGVSPVH | | CVCRDNWHGSN | |
| CRATEYIMK | | CRATEYIMK | | CSNDTINYYN | | CVCRDNWKGAN | |
| CRATEYMMK | | CRATEYMMK | | CSNGNCRFNV | | CVCRDNWKGSN | |
| CRDNWHASN | | CRDNWHASN | | CSNGSCRCTI | | CVCRDNWMGSN | |
| CRDNWHGSN | | CRDNWHGSN | | CSNGSCRFNV | | CVCRDNWNGMN | |
| CRDNWKGAN | | CRDNWKGAN | | CSNGSLHGRI | | CVCRDNWQGAN | |
| CRDNWKGSN | | CRDNWKGSN | | CSNGSLQCKI | | CVCRDNWRGSN | |
| CRDNWMGSN | | CRDNWMGSN | | CSNGSLQCRI | | CVCRDNWTGTN | |
| CRDNWNGMN | | CRDNWNGMN | | CSNGSLQCRV | | CVGWSSTSCHD | |
| CRDNWQGAN | | CRDNWQGAN | | CSNGSLQCTI | | CVGWSSTTCHD | |
| CRDNWQGSN | | CRDNWQGSN | | CSNGSLRCRI | | CVGYHANNSTD | |
| CRDNWRGAN | | CRDNWRGAN | | CSNNTTNYYN | | CVGYHANNSTE | |
| CRDNWRGSN | | CRDNWRGSN | | CSNPITGSPC | | CVGYHANNSTK | |
| CRDNWTGTN | | CRDNWTGTN | | CSNPITGSPG | | CVGYHSNNSTE | |
| CRDPNNERG | | CRDPNNERG | | CSNPITGSPS | | CVGYLSTNSSD | |
| CRETRGLFG | | CRETRGLFG | | CSPLSRCRET | | CVGYLSTNSSE | |
| CRFEGWIVG | | CRFEGWIVG | | CSPLSRCRKT | | CVGYLSTNSTE | |
| CRFYALSQG | | CRFYALSQG | | CSPSECRTFF | | CVILLNPFVSH | |
| CRICIDFRD | | CRICIDFRD | | CSPVLTDNPR | | CVKNGNHAVHY | |
| CRICILDQN | | CRICILDQN | | CSQMECRTFF | | CVKNGNLRCTI | |
| CRICIRADG | | CRICIRADG | | CSQRSKFLLM | | CVKNGNMQCTI | |
| CRIIQNEDI | | CRIIQNEDI | | CSRILTDTSR | | CVKNGNMRCTI | |
| CRKTRGLFG | | CRKTRGLFG | | CSRVLTDTSR | | CVKNGNMRCTS | |
| CRLRGIPPL | | CRLRGIPPL | | CSSGNCRFNV | | CVLEAMAFLED | |
| CRLSGIPPL | | CRLSGIPPL | | CSSGNCRFSV | | CVLEAMAFLEE | |
| CRMFALSQG | | CRMFALSQG | | CSSPSGIEGR | | CVLEAMAFLEK | |
| CRMYALHQG | | CRMYALHQG | | CSSTEFLGQW | | CVLEAMAFLEN | |
| CRNPNNEKG | | CRNPNNEKG | | CSVAGWLLGN | | CVLEAMALLEE | |
| CRNPNNERG | | CRNPNNERG | | CSVEGWVVIA | | CVLLNDKHSNN | |
| CRTFFLTHG | | CRTFFLTHG | | CSVEYASKTR | | CVMLLAIAMGL | |
| CRTFFLTQG | | CRTFFLTQG | | CSVSECRTFF | | CVNRCFYVELI | |
| CRTKEGRRK | | CRTKEGRRK | | CSWSLQCRIC | | CVQGNNDNATA | |
| CRTKEGRRR | | CRTKEGRRR | | CSYLECRTFF | | CVQGNNKNATA | |
| CRTLLAKSV | | CRTLLAKSV | | CTAMDDFQLI | | CVQGNNNNATA | |
| CRTREGRRK | | CRTREGRRK | | CTCRDNWKGS | | CVSGPNNNASA | |
| CSALFVYSL | | CSALFVYSL | | CTCRDNWQGS | | CVSLLQSAILS | |
| CSASTGGQS | | CSASTGGQS | | CTGCFEIFHK | | CVTGDDKNATA | |
| CSCYGHDSK | | CSCYGHDSK | | CTGILTDTSR | | CVTGDDRNATA | |
| CSCYGHNQK | | CSCYGHNQK | | CTGNLIAPRG | | CVTGYEKNATA | |
| CSCYGHNSK | | CSCYGHNSK | | CTGVLTDTSR | | CVVAVTDGPAA | |
| CSCYGHSQK | | CSCYGHSQK | | CTHLEICFMY | | CVVIMTDGPAN | |
| CSCYMDIDV | | CSCYMDIDV | | CTHLEVCFMY | | CVVIMTDGPAS | |
| CSCYPDAGE | | CSCYPDAGE | | CTHMEVCFMY | | CVVIMTDGSAS | |
| CSCYPDAGK | | CSCYPDAGK | | CTINSWHIFG | | CVVSVTDGPAA | |
| CSCYPDASE | | CSCYPDASE | | CTINSWHIYG | | CVVTVTDGPAA | |
| CSCYPDSGE | | CSCYPDSGE | | CTIPCFWVEM | | CVVVMTDGSAS | |
| CSCYPNAGE | | CSCYPNAGE | | CTISLVKTTL | | CWEQLYTPGGE | |
| CSCYPNDGK | | CSCYPNDGK | | CTKGKKAVDL | | CWEQMYNPGGE | |
| CSCYPNEGK | | CSCYPNEGK | | CTLFEKFFPS | | CWEQMYTPGGE | |
| CSCYPNLCQ | | CSCYPNLCQ | | CTLIDALLGD | | CWEQMYTPGGG | |
| CSCYPNLGK | | CSCYPNLGK | | CTLIDAMLGD | | CWEQMYTPGGK | |
| CSCYPNLGQ | | CSCYPNLGQ | | CTLMDALLGD | | CWSFALAQGAL | |
| CSCYPNMGK | | CSCYPNMGK | | CTLVDALLGD | | CWSFALAQGTL | |
| CSCYPNSGK | | CSCYPNSGK | | CTSPCLTDKG | | CWSFALAQGVL | |
| CSCYPQYPN | | CSCYPQYPN | | CTVIMTDGSA | | CWSWPDGALLP | |
| CSCYPRFPG | | CSCYPRFPG | | CTVPCFWVEM | | CYDGKAWLHIC | |
| CSCYPRYPD | | CSCYPRYPD | | CTVVMTDGNA | | CYDGKAWLHVC | |

Fig. 83-34

| Block size 8 | SIN | Block size 9 | SIN | Block size 10 | SIN | Block size 11 | SIN |
|---|---|---|---|---|---|---|---|
| CSCYPRYPG | | CSCYPRYPG | | CTVVMTDGSA | | CYNPCFYVELI | |
| CSCYPRYPN | | CSCYPRYPN | | CVAWSSSSCF | | CYPFDVPDYQS | |
| CSCYPRYSG | | CSCYPRYSG | | CVAWSSSSCH | | CYPFDVPEYQS | |
| CSCYPSGED | | CSCYPSGED | | CVAWSSTSCF | | CYPFDVPGYQS | |
| CSCYPSGEN | | CSCYPSGEN | | CVCHDGVCPV | | CYPFDVPNYQS | |
| CSCYPSGES | | CSCYPSGES | | CVCHKGICPV | | CYPGATINEEA | |
| CSCYPSGTD | | CSCYPSGTD | | CVCHKGVCPV | | CYPGATVNEEA | |
| CSCYSRYPN | | CSCYSRYPN | | CVCHNGICPV | | CYPGATVNEGA | |
| CSCYVDIDI | | CSCYVDIDI | | CVCHNGTCAV | | CYPGELDNNGE | |
| CSCYVDIDV | | CSCYVDIDV | | CVCHNGTCVV | | CYPGELNNNGE | |
| CSCYVDTDV | | CSCYVDTDV | | CVCHNGVCPV | | CYPGEVDNNGE | |
| CSCYVDVDV | | CSCYVDVDV | | CVCHNSTCVV | | CYPGFVENLEE | |
| CSDGPGWLT | | CSDGPGWLT | | CVCHSGICPV | | CYPGKFTNEEA | |
| CSDGSGWLT | | CSDGSGWLT | | CVCINGICTV | | CYPGNFNDYEE | |
| CSFAGWILG | | CSFAGWILG | | CVCINGSCAV | | CYPGRFTNEEA | |
| CSFAGWLLG | | CSFAGWLLG | | CVCINGSCIV | | CYPGSFNDYEE | |
| CSFEGWIGG | | CSFEGWIGG | | CVCINGSCTV | | CYPGSFNNYEE | |
| CSFEGWIVG | | CSFEGWIVG | | CVCINGTCAV | | CYPGSIENLEE | |
| CSGFFGDNP | | CSGFFGDNP | | CVCINGTCTV | | CYPGSIENQEE | |
| CSGHSCRIC | | CSGHSCRIC | | CVCISGTCAV | | CYPGSIKNQEE | |
| CSGIFGDNP | | CSGIFGDNP | | CVCQDEFCYT | | CYPGSLNDYEE | |
| CSGLVGDTP | | CSGLVGDTP | | CVCRDNWHAS | | CYPGSTVNEEA | |
| CSGVFGDNP | | CSGVFGDNP | | CVCRDNWHGS | | CYPGSVENLEE | |
| CSGVFGDSP | | CSGVFGDSP | | CVCRDNWKGA | | CYPGSVENQEE | |
| CSGVFGDTP | | CSGVFGDTP | | CVCRDNWKGS | | CYPGTTVNEEA | |
| CSGVLGDNP | | CSGVLGDNP | | CVCRDNWMGS | | CYPNDGKVECV | |
| CSHLECRTF | | CSHLECRTF | | CVCRDNWNGM | | CYPNEGKVECI | |
| CSHMECRTF | | CSHMECRTF | | CVCRDNWQGA | | CYPNEGKVECV | |
| CSHSECRTF | | CSHSECRTF | | CVCRDNWRGS | | CYPNLGIVECV | |
| CSIAGWLLG | | CSIAGWLLG | | CVCRDNWTGT | | CYPNLGKVECV | |
| CSIDECRTF | | CSIDECRTF | | CVGWSSTSCH | | CYPNLGQVECV | |
| CSIDGKAPI | | CSIDGKAPI | | CVGWSTTCH | | CYPNMGKVECV | |
| CSIHECRTF | | CSIHECRTF | | CVGYHANNST | | CYPNNGKVECI | |
| CSINECRTF | | CSINECRTF | | CVGYHSNNST | | CYPNSGKVECV | |
| CSINGKAPI | | CSINGKAPI | | CVGYLSTNSS | | CYPQYPNVRCV | |
| CSINGKEPI | | CSINGKEPI | | CVGYLSTNST | | CYPRYPDVRCV | |
| CSINGKQPI | | CSINGKQPI | | CVILLNPFVS | | CYPRYPNVRCV | |
| CSINGRAPI | | CSINGRAPI | | CVKNGNHAVH | | CYQFALGHGTT | |
| CSISECRTF | | CSISECRTF | | CVKNGNLRCT | | CYQFALGQGAT | |
| CSIWFSHYN | | CSIWFSHYN | | CVKNGNMQCT | | CYQFALGQGTT | |
| CSKFHSDTP | | CSKFHSDTP | | CVKNGNMRCT | | CYQRSKFLLMD | |
| CSKILTDTS | | CSKILTDTS | | CVLEAMAFLE | | CYRACFYVELI | |
| CSKTLTDTS | | CSKTLTDTS | | CVLEAMALLE | | CYTKCQTYAGA | |
| CSKVLTDTS | | CSKVLTDTS | | CVMLLAIAMG | | CYTLITDGPSD | |
| CSKYHWNLA | | CSKYHWNLA | | CVNRCFYVEL | | CYTLITDGPSN | |
| CSLEGIILG | | CSLEGIILG | | CVQGNNDNAT | | CYTLMTDGPSD | |
| CSLEGLILG | | CSLEGLILG | | CVQGNNKNAT | | CYTLVTDGPSD | |
| CSLEGLILS | | CSLEGLILS | | CVQGNNNNAT | | CYWVMTDGPAN | |
| CSLEGLVLG | | CSLEGLVLG | | CVRHNGTCAV | | CYWVMTDGPAS | |
| CSLFEKFFP | | CSLFEKFFP | | CVSGPNNNAS | | DAERGKLKRRA | |
| CSLKGLILG | | CSLKGLILG | | CVSHNGTWAV | | DAGDGCFEILH | |
| CSLMQGSTL | | CSLMQGSTL | | CVSLLQSAIL | | DAGNGCFDILH | |
| CSLNGISPI | | CSLNGISPI | | CVTGDDENAT | | DAHILVTREPY | |
| CSLNGISPV | | CSLNGISPV | | CVTGDDKNAT | | DAHVLVTREPY | |
| CSLNGVSPI | | CSLNGVSPI | | CVTGDDRNAT | | DAIEECLINDP | |
| CSLNGVSPV | | CSLNGVSPV | | CVVAVTDGPA | | DAINNRFQIQG | |
| CSNDTINYY | | CSNDTINYY | | CVVIMTDGPA | | DAMTEIWSYNA | |
| CSNGNCRFH | | CSNGNCRFH | | CVVIMTDGSA | | DAMTEVWSYNA | |
| CSNGNCRFN | | CSNGNCRFN | | CVVTVTDGPA | | DANGWVSTDKD | |
| CSNGSCRCT | | CSNGSCRCT | | CVVVMTDGSA | | DANGWVSTDKN | |
| CSNGSCRFN | | CSNGSCRFN | | CWEQLYTPGG | | DANGWVTADKD | |
| CSNGSLHGR | | CSNGSLHGR | | CWEQMYTPGG | | DANVKNLHDQI | |

Fig. 83-35

| Block size 8 | SIN | Block size 9 | SIN | Block size 10 | SIN | Block size 11 | SIN |
|---|---|---|---|---|---|---|---|
| CSNGSLQCK | | CSNGSLQCK | | CWSFALAQGA | | DANVKNLHEQV | |
| CSNGSLQCR | | CSNGSLQCR | | CWSFALAQGT | | DANVRNLHDQI | |
| CSNGSLQFR | | CSNGSLQFR | | CWSFALAQGV | | DANVRNLHDQV | |
| CSNGSLRCR | | CSNGSLRCR | | CWSWPDGALL | | DANVRNLHDRI | |
| CSNGSMQCK | | CSNGSMQCK | | CYDGKAWLHI | | DANVRNLHDRT | |
| CSNGSMQCN | | CSNGSMQCN | | CYDGKAWLHV | | DANVRNLHDRV | |
| CSNGSMQCR | | CSNGSMQCR | | CYGHDSKVTC | | DANVRNLHEQI | |
| CSNNTTNYY | | CSNNTTNYY | | CYGHNQKITC | | DANVRNLHEQV | |
| CSNPITGSP | | CSNPITGSP | | CYGHNSKVTC | | DANVRNLHERI | |
| CSNSSMQCR | | CSNSSMQCR | | CYGHSQKATC | | DAPFDDRLRRD | |
| CSPLSRCRE | | CSPLSRCRE | | CYGHSQKVTC | | DAPFIDRLRRD | |
| CSPLSRCRK | | CSPLSRCRK | | CYNPCFYVEL | | DAPFLDRIRRD | |
| CSPSECRTF | | CSPSECRTF | | CYPFDVPDYQ | | DAPFLDRLRRD | |
| CSPVLTDNP | | CSPVLTDNP | | CYPFDVPEYQ | | DAQAFYKILKI | |
| CSQNILRTQ | | CSQNILRTQ | | CYPFDVPGYQ | | DAQAFYKLLKI | |
| CSQRSKFLL | | CSQRSKFLL | | CYPFDVPNYQ | | DAQIDESCEGE | |
| CSRILTDTS | | CSRILTDTS | | CYPGATINEE | | DATAVAVIKYN | |
| CSRVLTDTS | | CSRVLTDTS | | CYPGATVNEE | | DATAVAVLKYN | |
| CSSGNCRFN | | CSSGNCRFN | | CYPGATVNEG | | DATLCLGHHAV | |
| CSSGNCRFS | | CSSGNCRFS | | CYPGELDNNG | | DATYQRTRALV | |
| CSSPLRLVD | | CSSPLRLVD | | CYPGELNNNG | | DAVATTHSWIP | |
| CSSPSGIEG | | CSSPSGIEG | | CYPGEVDNNG | | DAVATTHSWTP | |
| CSSTEFLGQ | | CSSTEFLGQ | | CYPGFVENLE | | DAVATTHSWVP | |
| CSVAGWLLG | | CSVAGWLLG | | CYPGGFTNEE | | DAVTDIWSYNA | |
| CSVEGWVVI | | CSVEGWVVI | | CYPGKFTNEE | | DAVTDVWSYNA | |
| CSVEYASKT | | CSVEYASKT | | CYPGKFVNEE | | DAYAVIHYGGI | |
| CSVSECRTF | | CSVSECRTF | | CYPGKFVNGE | | DAYAVIHYGGM | |
| CSYLECRTF | | CSYLECRTF | | CYPGNFNDYE | | DAYAVIHYGGV | |
| CTCRDNWKG | | CTCRDNWKG | | CYPGRFTNEE | | DCDLINGALGS | |
| CTCRDNWQG | | CTCRDNWQG | | CYPGSFNDYE | | DCDNPITGSPG | |
| CTGCFEIFH | | CTGCFEIFH | | CYPGSFNNYE | | DCETKCQTPLG | |
| CTGILTDTS | | CTGILTDTS | | CYPGSIENLE | | DCFLWHVRKRF | |
| CTGNLIAPR | | CTGNLIAPR | | CYPGSIENQE | | DCFQPCFYVEL | |
| CTGVLTDTS | | CTGVLTDTS | | CYPGSIKNQE | | DCIKPCFVVEL | |
| CTHLEICFM | | CTHLEICFM | | CYPGSLNDYE | | DCIRPCFVVEL | |
| CTHLEVCFM | | CTHLEVCFM | | CYPGSTVNEE | | DCKIEAVIYGN | |
| CTHMEVCFM | | CTHMEVCFM | | CYPGSVENLE | | DCKVEAVIYGN | |
| CTINSWHIF | | CTINSWHIF | | CYPGSVENQE | | DCMASIRNNTY | |
| CTINSWHIY | | CTINSWHIY | | CYPGTTVNEE | | DCMESIRNNTY | |
| CTIPCFWVE | | CTIPCFWVE | | CYPNDGKVEC | | DCMRPCFWVEL | |
| CTISLVKTT | | CTISLVKTT | | CYPNEGKVEC | | DCNFEGWIVGN | |
| CTKGKKAVD | | CTKGKKAVD | | CYPNLGIVEC | | DCNNPITGSPG | |
| CTLFEKFFP | | CTLFEKFFP | | CYPNLGKVEC | | DCPKYIKQGSL | |
| CTLIDALLG | | CTLIDALLG | | CYPNLGQVEC | | DCPKYIKSGQL | |
| CTLIDAMLG | | CTLIDAMLG | | CYPNMGKVEC | | DCPKYMNVKSL | |
| CTLMDALLG | | CTLMDALLG | | CYPNNGKVEC | | DCPKYVKQGSL | |
| CTLVDALLG | | CTLVDALLG | | CYPNSGKVEC | | DCPKYVNIKSL | |
| CTSPCLTDK | | CTSPCLTDK | | CYPQYPNVRC | | DCPKYVNVKSL | |
| CTVIMTDGS | | CTVIMTDGS | | CYPRYPDVRC | | DCPKYVNVRSL | |
| CTVPCFWVE | | CTVPCFWVE | | CYPRYPGVRC | | DCPRYVKQGSL | |
| CTVVMTDGN | | CTVVMTDGN | | CYPRYPNVRC | | DCRFEGWIVGN | |
| CTVVMTDGS | | CTVVMTDGS | | CYQFALGHGT | | DCRTFFLTQGS | |
| CVAWSSSSC | | CVAWSSSSC | | CYQFALGQGA | | DCSFAGWILGN | |
| CVAWSSTSC | | CVAWSSTSC | | CYQFALGQGT | | DCSFAGWLLGN | |
| CVCHKGICP | | CVCHKGICP | | CYQRSKFLLM | | DCSFEGWIGGN | |
| CVCHKGVCP | | CVCHKGVCP | | CYRACFYVEL | | DCSFEGWIVGN | |
| CVCHNGICP | | CVCHNGICP | | CYSRYPNVRC | | DCSFTGWILGN | |
| CVCHNGTCA | | CVCHNGTCA | | CYTKCQTYAG | | DCSIAGWLLGN | |
| CVCHNGTCV | | CVCHNGTCV | | CYTLITDGPS | | DCSITGWLLGN | |
| CVCHNGVCP | | CVCHNGVCP | | CYTLMTDGPS | | DCSLEGIILGN | |
| CVCHNSTCV | | CVCHNSTCV | | CYTLVTDGPS | | DCSLEGLILGN | |
| CVCHSGICP | | CVCHSGICP | | CYWVMTDGPA | | DCSLEGLILSN | |

Fig. 83-36

| Block size 8 | SIN | Block size 9 | SIN | Block size 10 | SIN | Block size 11 | SIN |
|---|---|---|---|---|---|---|---|
| CVCHSGVCP | | CVCHSGVCP | | DAERGKLKRR | | DCSLEGLVLGN | |
| CVCINGICT | | CVCINGICT | | DAGDGCFEIL | | DCSLKGLILGN | |
| CVCINGSCA | | CVCINGSCA | | DAGNGCFDIL | | DCSNPITGSPC | |
| CVCINGSCI | | CVCINGSCI | | DAHILVTREP | | DCSNPITGSPG | |
| CVCINGSCT | | CVCINGSCT | | DAHVLVTREP | | DCSNPITGSPS | |
| CVCINGTCA | | CVCINGTCA | | DAIEECLIND | | DCSVAGWLLGN | |
| CVCINGTCT | | CVCINGTCT | | DAINNRFQIQ | | DCSVSGWLLGN | |
| CVCISGTCA | | CVCISGTCA | | DALKLSIEDP | | DCTGCFEIFHK | |
| CVCQDEFCY | | CVCQDEFCY | | DALLGDPHCD | | DCVLEAMAFLE | |
| CVCRDNWHA | | CVCRDNWHA | | DALLGDPQCD | | DCVLEAMALLE | |
| CVCRDNWHG | | CVCRDNWHG | | DAMLGDPHCD | | DCWSFALAQGA | |
| CVCRDNWKG | | CVCRDNWKG | | DAMTEIWSYN | | DCYRACFYVEL | |
| CVCRDNWMG | | CVCRDNWMG | | DAMTEVWSYN | | DCYWVMTDGPA | |
| CVCRDNWNG | | CVCRDNWNG | | DANGWVSTDK | | DDAVTDIWSYN | |
| CVCRDNWQG | | CVCRDNWQG | | DANVKNLHDQ | | DDAVTDVWSYN | |
| CVCRDNWRG | | CVCRDNWRG | | DANVKNLHEQ | | DDAYAVIHYGG | |
| CVCRDNWTG | | CVCRDNWTG | | DANVRNLHDQ | | DDCMASIRNNT | |
| CVCWDNWRG | | CVCWDNWRG | | DANVRNLHDR | | DDCSLEGIILG | |
| CVGWSSTSC | | CVGWSSTSC | | DANVRNLHEQ | | DDCSLEGLILG | |
| CVGWSSTTC | | CVGWSSTTC | | DANVRNLHER | | DDCSLEGLILS | |
| CVGYHANNS | | CVGYHANNS | | DAPFDDRLRR | | DDCSLEGLVLG | |
| CVGYHSNNS | | CVGYHSNNS | | DAPFIDRLRR | | DDCSLKGLILG | |
| CVGYLSTNS | | CVGYLSTNS | | DAPFLDRIRR | | DDDAYAVIHYG | |
| CVILLNPFV | | CVILLNPFV | | DAPFLDRLRR | | DDDCMASIRNN | |
| CVKNGNLRC | | CVKNGNLRC | | DAQAFYKILK | | DDENATASFIY | |
| CVKNGNMQC | | CVKNGNMQC | | DAQHRSHRQM | | DDFQLIPMISK | |
| CVKNGNMRC | | CVKNGNMRC | | DAQIDESCEG | | DDFQLIPMISN | |
| CVKNGNMRG | | CVKNGNMRG | | DARIDFESGR | | DDGAILPFDID | |
| CVLEAMAFL | | CVLEAMAFL | | DARVDFESGR | | DDGAILPFGID | |
| CVMLLAIAM | | CVMLLAIAM | | DATAVAVIKY | | DDGAILPLTSI | |
| CVNRCFYVE | | CVNRCFYVE | | DATAVAVLKY | | DDGAVAVLKYN | |
| CVQGNNDNA | | CVQGNNDNA | | DATYQRTRAL | | DDGFIDIWTYN | |
| CVQGNNKNA | | CVQGNNKNA | | DAVATTHSWI | | DDGFIDVWTYN | |
| CVQGNNNNA | | CVQGNNNNA | | DAVATTHSWT | | DDGFLDIWTYN | |
| CVRHNGTCA | | CVRHNGTCA | | DAVATTHSWV | | DDGFLDVWTYN | |
| CVSGPNNNA | | CVSGPNNNA | | DAVKLSSGYK | | DDGLLDVWTYN | |
| CVSHNGTWA | | CVSHNGTWA | | DAVTDIWSYN | | DDHCMESIRNN | |
| CVSLLQSAI | | CVSLLQSAI | | DAVTDVWSYN | | DDHFVSIELEG | |
| CVTGDDKNA | | CVTGDDKNA | | DAYAVIHYGG | | DDIDQSLIIAA | |
| CVTGDDRNA | | CVTGDDRNA | | DCDLINGALG | | DDKNATASFIY | |
| CVTGYEKNA | | CVTGYEKNA | | DCETKCQTPL | | DDLIEKTSWSY | |
| CVVAVTDGP | | CVVAVTDGP | | DCFLWHVRKR | | DDLIGKTSWSY | |
| CVVIMTDGP | | CVVIMTDGP | | DCFQPCFYVE | | DDNGWVSTDKD | |
| CVVIMTDGS | | CVVIMTDGS | | DCIRPCFWIE | | DDNVYKALSIY | |
| CVVTVTDGP | | CVVTVTDGP | | DCIRPCFWVE | | DDPNWSGYSGS | |
| CVVVMTDGS | | CVVVMTDGS | | DCKIEAVIYG | | DDQCMESIRNN | |
| CVYRDNWKG | | CVYRDNWKG | | DCKVEAVIYG | | DDQIEDLWAYN | |
| CWEQLYTPG | | CWEQLYTPG | | DCLVPCFWVE | | DDQIEELWAYN | |
| CWEQMYTPG | | CWEQMYTPG | | DCMASIRNNT | | DDQIEGLWAYN | |
| CWSFALAQG | | CWSFALAQG | | DCMIKAVRGD | | DDQIENLWAYN | |
| CYDGKAWLH | | CYDGKAWLH | | DCMMKAVRGD | | DDQIIDIWAYN | |
| CYGHDSKVT | | CYGHDSKVT | | DCMRPCFWVE | | DDQITDIWAYN | |
| CYGHNQKIT | | CYGHNQKIT | | DCMVKAVRGD | | DDQVTDIWAYN | |
| CYGHNQKVT | | CYGHNQKVT | | DCNFEGWIVG | | DDRNATASFIY | |
| CYGHNSKVT | | CYGHNSKVT | | DCNNPITGSP | | DDRNATASFVY | |
| CYGHSQKVT | | CYGHSQKVT | | DCPKYIKQGS | | DDRNATASLIY | |
| CYMDIDVYC | | CYMDIDVYC | | DCPKYIKSGQ | | DDSVYKALSIY | |
| CYNPCFYVE | | CYNPCFYVE | | DCPKYMNVKS | | DDVDQSLIIAA | |
| CYPFDVPDY | | CYPFDVPDY | | DCPKYVKQGS | | DDVDQSLVIAA | |
| CYPFDVPEY | | CYPFDVPEY | | DCPKYVNIKS | | DDVSWASNSIV | |
| CYPFDVPGY | | CYPFDVPGY | | DCPKYVNVKS | | DDVSWTSNSIV | |
| CYPFDVPNY | | CYPFDVPNY | | DCPKYVNVRS | | DDVSWTSNSLV | |

Fig. 83-37

| Block size 8 | SIN | Block size 9 | SIN | Block size 10 | SIN | Block size 11 | SIN |
|---|---|---|---|---|---|---|---|
| CYPGATINE | | CYPGATINE | | DCPRYVKQGS | | DDVWLGRTVSI | |
| CYPGATVNE | | CYPGATVNE | | DCRFEGWIVG | | DDVWLGRTVST | |
| CYPGELDNN | | CYPGELDNN | | DCRTFFLTQG | | DDVWMGRTISK | |
| CYPGELNNN | | CYPGELNNN | | DCSFAGWILG | | DDVWMGRTISM | |
| CYPGEVDNN | | CYPGEVDNN | | DCSFAGWLLG | | DDVWMGRTISR | |
| CYPGFVENL | | CYPGFVENL | | DCSFEGWIGG | | DDWSGYSGSFI | |
| CYPGGFTNE | | CYPGGFTNE | | DCSFEGWIVG | | DDYQLIPMISK | |
| CYPGKFTNE | | CYPGKFTNE | | DCSIAGWLLG | | DEAINNRIKIN | |
| CYPGKFVNE | | CYPGKFVNE | | DCSLEGIILG | | DEALKMTIASD | |
| CYPGKFVNG | | CYPGKFVNG | | DCSLEGLILG | | DECIEKVRNGT | |
| CYPGNFNDY | | CYPGNFNDY | | DCSLEGLILS | | DECRFYALSQG | |
| CYPGRFTNE | | CYPGRFTNE | | DCSLEGLVLG | | DECRTFFLTQG | |
| CYPGSFNDY | | CYPGSFNDY | | DCSLKGLILG | | DEEGTGIAADK | |
| CYPGSFNNY | | CYPGSFNNY | | DCSNPITGSP | | DEESRARIKTR | |
| CYPGSIENL | | CYPGSIENL | | DCSVAGWLLG | | DEFCYTLITDG | |
| CYPGSIENQ | | CYPGSIENQ | | DCSVSGWLLG | | DEFCYTLMTDG | |
| CYPGSIKNQ | | CYPGSIKNQ | | DCTGCFEIFH | | DEFCYTLVTDG | |
| CYPGSLNDY | | CYPGSLNDY | | DCVLEAMAFL | | DEFQLIPMISK | |
| CYPGSTVNE | | CYPGSTVNE | | DCVLEAMALL | | DEGDGCFNFFH | |
| CYPGSVENL | | CYPGSVENL | | DCWSFALAQG | | DEGDGCFNLLH | |
| CYPGSVENQ | | CYPGSVENQ | | DCYRACFYVE | | DEGDGCFSILH | |
| CYPGTTVNE | | CYPGTTVNE | | DCYWVMTDGP | | DEGDGCFSLLH | |
| CYPNDGKVE | | CYPNDGKVE | | DDAINNRFQI | | DEGLPQSGRIV | |
| CYPNEGKVE | | CYPNEGKVE | | DDAVTDIWSY | | DEGNGCFELLH | |
| CYPNLCQVE | | CYPNLCQVE | | DDAVTDVWSY | | DEGNGCFTFYH | |
| CYPNLGKVE | | CYPNLGKVE | | DDAYAVIHYG | | DEHDANVRNLH | |
| CYPNLGQVE | | CYPNLGQVE | | DDCMASIRNN | | DEHDSNVENLF | |
| CYPNMGKVE | | CYPNMGKVE | | DDCSLEGIIL | | DEHDSNVKNLF | |
| CYPNNGKVE | | CYPNNGKVE | | DDCSLEGLIL | | DEICIGYLSNN | |
| CYPNSGKVE | | CYPNSGKVE | | DDCSLEGLVL | | DEICIGYMSNN | |
| CYPQYPNVR | | CYPQYPNVR | | DDCSLKGLIL | | DEIGEDIAPIE | |
| CYPRYPDVR | | CYPRYPDVR | | DDDAYAVIHY | | DEIGEDLAPIE | |
| CYPRYPGVR | | CYPRYPGVR | | DDDCMASIRN | | DEIGEDVAPIE | |
| CYPRYPNVR | | CYPRYPNVR | | DDDVSWTSNS | | DEITTKINNII | |
| CYPYDVPDH | | CYPYDVPDH | | DDENATASFI | | DELCPSPLKLV | |
| CYPYDVPDY | | CYPYDVPDY | | DDFALILNAP | | DELIGKTSWSY | |
| CYPYDVPEY | | CYPYDVPEY | | DDFALIVNAL | | DEQMYQKCCNL | |
| CYPYDVQDY | | CYPYDVQDY | | DDFALIVNAP | | DEQMYQKCCSL | |
| CYPYYVPDY | | CYPYYVPDY | | DDFALIVNAS | | DEQMYQKCCTL | |
| CYQFALGHG | | CYQFALGHG | | DDFFNRLNWL | | DEQMYQRCCNL | |
| CYQFALGQG | | CYQFALGQG | | DDFQLIPMIS | | DEQNKLYGAGN | |
| CYQRSKFLL | | CYQRSKFLL | | DDGAILPFDI | | DEQNKLYGTGN | |
| CYRACFYVE | | CYRACFYVE | | DDGAILPFGI | | DERGLFGAIAG | |
| CYSRYPNVR | | CYSRYPNVR | | DDGAILPLTS | | DERGNPGVKGW | |
| CYTKCQTYA | | CYTKCQTYA | | DDGAVAVLKY | | DERMYQKCCNL | |
| CYTLITDGP | | CYTLITDGP | | DDGFIDIWTY | | DERRNKYLEEH | |
| CYTLMTDGP | | CYTLMTDGP | | DDGFIDVWTY | | DERRNRYLEEH | |
| CYTLVTDGP | | CYTLVTDGP | | DDGFLDIWTY | | DESCEGECFYS | |
| CYVDIDIYC | | CYVDIDIYC | | DDGFLDVWTY | | DEVDQSLIIAA | |
| CYVDIDVYC | | CYVDIDVYC | | DDGLLDVWTY | | DEVKRRLSANA | |
| CYVDTDVYC | | CYVDTDVYC | | DDHCMESIRN | | DEVKRRLSTNA | |
| CYVDVDVYC | | CYVDVDVYC | | DDIDQSLIIA | | DEVRRRLSANA | |
| CYWVMTDGP | | CYWVMTDGP | | DDKNATASFI | | DEVRRRLSTNA | |
| DAEMNKLFE | | DAEMNKLFE | | DDLIEKTSWS | | DEVRRRLSVNA | |
| DAERGKLKR | | DAERGKLKR | | DDLIGKTSWS | | DEVSWTSNSIV | |
| DAGDGCFEI | | DAGDGCFEI | | DDNGWVSTDK | | DEVWWTSNSIV | |
| DAGNGCFDI | | DAGNGCFDI | | DDNVYKALSI | | DEYKNTGDSDI | |
| DAHILVTRE | | DAHILVTRE | | DDPNWSGYSG | | DEYKNTRDSDI | |
| DAHVLVTRE | | DAHVLVTRE | | DDQCMESIRN | | DEYKNTRDSNI | |
| DAIEECLIN | | DAIEECLIN | | DDQIEDLWAY | | DFEKEGYSLVG | |
| DAINNRFQI | | DAINNRFQI | | DDQIEELWAY | | DFEREGYSLVG | |
| DALKLSIED | | DALKLSIED | | DDQIEGLWAY | | DFHDSNVKNLY | |

Fig. 83-38

| Block size 8 | SIN | Block size 9 | SIN | Block size 10 | SIN | Block size 11 | SIN |
|---|---|---|---|---|---|---|---|
| DALLGDPHC | | DALLGDPHC | | DDQIENLWAY | | DFHDSNVKSLY | |
| DALLGDPQC | | DALLGDPQC | | DDQIIDIWAY | | DFHDSNVRNLY | |
| DAMLGDPHC | | DAMLGDPHC | | DDQIQDIWAY | | DFHWMLLDPGD | |
| DAMTEIWSY | | DAMTEIWSY | | DDQIQDLWAY | | DFICVGWSSTS | |
| DAMTEVWSY | | DAMTEVWSY | | DDQIQDVWAY | | DFICVGWSSTT | |
| DANGWVSTD | | DANGWVSTD | | DDQIQNIWAY | | DFIKWNVTYTG | |
| DANGWVTAD | | DANGWVTAD | | DDQITDIWAY | | DFKSTQAAINQ | |
| DANVKNLHD | | DANVKNLHD | | DDQVTDIWAY | | DFLCVGWSSTS | |
| DANVKNLHE | | DANVKNLHE | | DDRIQDIWAY | | DFMCVGWSSTT | |
| DANVRNLHD | | DANVRNLHD | | DDRNATASFI | | DFQLIPMISKC | |
| DANVRNLHE | | DANVRNLHE | | DDRNATASLI | | DFQLIPMISKS | |
| DAPFDDRLR | | DAPFDDRLR | | DDSVYKALSI | | DFQLIPMISNC | |
| DAPFLDRIR | | DAPFLDRIR | | DDVDQSLIIA | | DFSKWNVTYTG | |
| DAPFLDRLR | | DAPFLDRLR | | DDVDQSLVIA | | DFTKWNVTHTG | |
| DAQAFYKIL | | DAQAFYKIL | | DDVSWASNSI | | DFTKWNVTYTG | |
| DAQAFYKLL | | DAQAFYKLL | | DDVSWTSNSI | | DGADIKSHAYI | |
| DAQHRSHRQ | | DAQHRSHRQ | | DDVWLGRTVS | | DGADINLHAYI | |
| DAQIDESCE | | DAQIDESCE | | DDVWMGRTIS | | DGADINLMPIY | |
| DARIDFESG | | DARIDFESG | | DDWSGYSGSF | | DGAILPFDIDK | |
| DARVDFESG | | DARVDFESG | | DEAINNRFQI | | DGAILPFGIDK | |
| DATAVAVIK | | DATAVAVIK | | DEAINNRIKI | | DGALLPFDIDK | |
| DATAVAVLK | | DATAVAVLK | | DEAINSRFQI | | DGALLPFDIDR | |
| DATYQRTRA | | DATYQRTRA | | DEAISNRFQI | | DGATSACKRTV | |
| DAVATTHSW | | DAVATTHSW | | DEALKMTIAS | | DGAVAVLKYNG | |
| DAVKLSSGY | | DAVKLSSGY | | DECIEKVRNG | | DGCFEILHKCD | |
| DAVTDIWSY | | DAVTDIWSY | | DECRFYALSQ | | DGCFEILHKCN | |
| DAVTDVWSY | | DAVTDVWSY | | DECRTFFLTQ | | DGCFEILHRCD | |
| DAYAVIHYG | | DAYAVIHYG | | DEESRARIKT | | DGCFEILHRCN | |
| DCDLINGAL | | DCDLINGAL | | DEFCYTLITD | | DGCFNFFHKCN | |
| DCETKCQTP | | DCETKCQTP | | DEFCYTLMTD | | DGCFNLLHKCN | |
| DCFLWHVRK | | DCFLWHVRK | | DEFCYTLVTD | | DGCFSILHKCN | |
| DCFQPCFYV | | DCFQPCFYV | | DEFQLIPMIS | | DGCFSLLHKCN | |
| DCIKPCFWV | | DCIKPCFWV | | DEGDGCFNFF | | DGCRFYALSQG | |
| DCIRPCFWV | | DCIRPCFWV | | DEGDGCFNLL | | DGDIIFLWGIH | |
| DCKIEAVIY | | DCKIEAVIY | | DEGDGCFSIL | | DGDIWVTREPY | |
| DCKVEAVIY | | DCKVEAVIY | | DEGDGCFSLL | | DGFIDIWTYNA | |
| DCLVPCFWV | | DCLVPCFWV | | DEGLPQSGRI | | DGFIDVWTYNA | |
| DCMASIRNN | | DCMASIRNN | | DEGNGCFELL | | DGFLDIWTYNA | |
| DCMESIRNN | | DCMESIRNN | | DEGNGCFTFY | | DGFLDVWTYNA | |
| DCMIKAVRG | | DCMIKAVRG | | DEGTGIAADK | | DGFLDVWTYNT | |
| DCMMKAVRG | | DCMMKAVRG | | DEHDANVRNL | | DGFLGVWTYNA | |
| DCMRPCFWV | | DCMRPCFWV | | DEHDSNVENL | | DGFLNVWTYNA | |
| DCMVKAVRG | | DCMVKAVRG | | DEHDSNVKNL | | DGFMDVWTYNA | |
| DCNFEGWIV | | DCNFEGWIV | | DEICIGYLSN | | DGFRDVWTYNA | |
| DCNNPITGS | | DCNNPITGS | | DEICIGYMSN | | DGGHIEECSCY | |
| DCPKYIKQG | | DCPKYIKQG | | DEIGEDIAPI | | DGGPNLYNIRN | |
| DCPKYIKSG | | DCPKYIKSG | | DEIGEDLAPI | | DGHFVNIELED | |
| DCPKYMNVK | | DCPKYMNVK | | DEIGEDVAPI | | DGIGRMTICIQ | |
| DCPKYVKQG | | DCPKYVKQG | | DEITTKINNI | | DGIGRMTICVQ | |
| DCPKYVNIK | | DCPKYVNIK | | DELCPSPLKL | | DGITNKVNSII | |
| DCPKYVNVK | | DCPKYVNVK | | DELIGKTSWS | | DGKAPISLGDC | |
| DCPKYVNVR | | DCPKYVNVR | | DENATASFIY | | DGKAWLHICVT | |
| DCPRYVKQG | | DCPRYVKQG | | DEQMYQKCCN | | DGKAWLHVCIT | |
| DCRDNWKGS | | DCRDNWKGS | | DEQMYQKCCS | | DGKAWLHVCVT | |
| DCRFEGWIV | | DCRFEGWIV | | DEQMYQKCCT | | DGKEWLHVCIT | |
| DCRTFFLTQ | | DCRTFFLTQ | | DEQMYQRCCN | | DGKEWMHICMT | |
| DCSFAGWIL | | DCSFAGWIL | | DEQNKLYGAG | | DGKEWMHVCIT | |
| DCSFAGWLL | | DCSFAGWLL | | DEQNKLYGTG | | DGKEWMHVCMA | |
| DCSFEGWIG | | DCSFEGWIG | | DERGLFGAIA | | DGKEWMHVCMT | |
| DCSFEGWIV | | DCSFEGWIV | | DERGNPGVKG | | DGKGCFEIYHA | |
| DCSIAGWLL | | DCSIAGWLL | | DERMYQKCCN | | DGKGCFEIYHK | |
| DCSITGWLL | | DCSITGWLL | | DERRNKYLEE | | DGKGCFEIYHN | |

Fig. 83-39

| Block size 8 | SIN | Block size 9 | SIN | Block size 10 | SIN | Block size 11 | SIN |
|---|---|---|---|---|---|---|---|
| DCSLEGIIL | | DCSLEGIIL | | DERRNRYLEE | | DGKGCFEIYHT | |
| DCSLEGLIL | | DCSLEGLIL | | DESCEGECFY | | DGKSSACKRAN | |
| DCSLEGLVL | | DCSLEGLVL | | DEVDQSLIIA | | DGKVECVCRDN | |
| DCSLKGLIL | | DCSLKGLIL | | DEVKRRLSAN | | DGLLDVWTYNA | |
| DCSNPITGS | | DCSNPITGS | | DEVKRRLSTN | | DGLQSSDDFAL | |
| DCSVAGWLL | | DCSVAGWLL | | DEVRRRLSAN | | DGNGCFEIFHQ | |
| DCSVSGWLL | | DCSVSGWLL | | DEVRRRLSTN | | DGNIIFLWGIH | |
| DCTGCFEIF | | DCTGCFEIF | | DEVRRRLSVN | | DGPAANNADHR | |
| DCVLEAMAF | | DCVLEAMAF | | DEVSWTSNSI | | DGPAANSADHR | |
| DCVLEAMAL | | DCVLEAMAL | | DEVWWTSNSI | | DGPAANSAHHR | |
| DCWSFALAQ | | DCWSFALAQ | | DEYKNTGDSD | | DGPANKQASYK | |
| DCYRACFYV | | DCYRACFYV | | DEYKNTRDSD | | DGPANNQASYK | |
| DCYWVMTDG | | DCYWVMTDG | | DEYKNTRDSN | | DGPANNQASYR | |
| DDAINNRFQ | | DDAINNRFQ | | DFEKEGYSLV | | DGPANSQASYK | |
| DDAVTDIWS | | DDAVTDIWS | | DFEREGYSLV | | DGPANSQAYTK | |
| DDAVTDVWS | | DDAVTDVWS | | DFHDSNVKNL | | DGPASNQASYK | |
| DDAYAVIHY | | DDAYAVIHY | | DFHDSNVKSL | | DGPGWLTIGIT | |
| DDCMASIRN | | DDCMASIRN | | DFHDSNVRNL | | DGPGWLTLGIT | |
| DDCSLEGII | | DDCSLEGII | | DFHWMLLDPG | | DGPSDAQAFYK | |
| DDCSLEGLI | | DDCSLEGLI | | DFICVGWSST | | DGPSNAQAFYK | |
| DDCSLEGLV | | DDCSLEGLV | | DFIKWNVTYT | | DGQDCDLINGA | |
| DDCSLKGLI | | DDCSLKGLI | | DFKSTQAAIN | | DGQRSWMKIYW | |
| DDDAYAVIH | | DDDAYAVIH | | DFLCVGWSST | | DGQRSWMKLYW | |
| DDDCMASIR | | DDDCMASIR | | DFLNNTEPLC | | DGQSGRIDFHW | |
| DDDVSWTSN | | DDDVSWTSN | | DFMCVGWSST | | DGRAWLHVCVT | |
| DDENATASF | | DDENATASF | | DFQLIPMISK | | DGRGCFEIYHK | |
| DDFALILNA | | DDFALILNA | | DFRDMRKNTL | | DGSANSQAYTK | |
| DDFALIVNA | | DDFALIVNA | | DFSKWNVTYT | | DGSASGKADTR | |
| DDFFNRLNW | | DDFFNRLNW | | DFTKWNVTHT | | DGSASGQAYTK | |
| DDFQLIPMI | | DDFQLIPMI | | DFTKWNVTYT | | DGSASGRADTK | |
| DDGAILPFD | | DDGAILPFD | | DFVRQCFNPM | | DGSASGRADTR | |
| DDGAILPFG | | DDGAILPFG | | DFVRQCFSPM | | DGSASSQAHTK | |
| DDGAILPLT | | DDGAILPLT | | DGADINFMPI | | DGSASSQAYTK | |
| DDGAVAVLK | | DDGAVAVLK | | DGAILPFDID | | DGSATGPADTR | |
| DDGFIDIWT | | DDGFIDIWT | | DGAILPFGID | | DGSATGPAETR | |
| DDGFIDVWT | | DDGFIDVWT | | DGALLPFDID | | DGSGWLTLGIT | |
| DDGFLDIWT | | DDGFLDIWT | | DGANIDFMPV | | DGSIGKVCRTL | |
| DDGFLDVWT | | DDGFLDVWT | | DGANIGFMPK | | DGSSSACLRGG | |
| DDGLLDVWT | | DDGLLDVWT | | DGANINFMPI | | DGSYFFGDNAE | |
| DDHCMESIR | | DDHCMESIR | | DGANINLMPI | | DGTACFEIFHK | |
| DDIDQSLII | | DDIDQSLII | | DGANISFMPI | | DGTAFRGLIST | |
| DDKNATASF | | DDKNATASF | | DGATSACKRT | | DGTGCFEIFHK | |
| DDLIEKTSW | | DDLIEKTSW | | DGAVAVLKYN | | DGTGCFEIFHR | |
| DDLIGKTSW | | DDLIGKTSW | | DGCFEILHKC | | DGTGCFEILHK | |
| DDNCMERIR | | DDNCMERIR | | DGCFEILHRC | | DGTIAGFIEGG | |
| DDNCMESIR | | DDNCMESIR | | DGCFNFFHKC | | DGVCPVVFTDG | |
| DDNVYKALS | | DDNVYKALS | | DGCFNLLHKC | | DGVGRMTICIQ | |
| DDPNWSGYS | | DDPNWSGYS | | DGCFSILHKC | | DGVGRMTICVQ | |
| DDQCMESIR | | DDQCMESIR | | DGCFSLLHKC | | DGVTASCLDKG | |
| DDQIEDLWA | | DDQIEDLWA | | DGCRFYALSQ | | DGVTASCLDRG | |
| DDQIEELWA | | DDQIEELWA | | DGDIIFLWGI | | DGVTASCRDNG | |
| DDQIEGLWA | | DDQIEGLWA | | DGFEPNGCIE | | DGVTNKVNSII | |
| DDQIENLWA | | DDQIENLWA | | DGFEPNGSIE | | DGVWIGRTKSL | |
| DDQIIDIWA | | DDQIIDIWA | | DGFEPNGYIE | | DGVYKALSIYS | |
| DDQIQDIWA | | DDQIQDIWA | | DGFIDIWTYN | | DGWINSPNHAK | |
| DDQIQDLWA | | DDQIQDLWA | | DGFIDVWTYN | | DGWYGFHHSNA | |
| DDQIQDVWA | | DDQIQDVWA | | DGFKPNGCIE | | DGWYGFHHSNS | |
| DDQIQNIWA | | DDQIQNIWA | | DGFLDIWTYN | | DGWYGFKHQNA | |
| DDQITDIWA | | DDQITDIWA | | DGFLDVWTYN | | DGWYGFRHHNS | |
| DDQVTDIWA | | DDQVTDIWA | | DGFLGVWTYN | | DGWYGFRHLNS | |
| DDRNATASF | | DDRNATASF | | DGFLNVWTYN | | DGWYGFRHQKA | |
| DDRNATASL | | DDRNATASL | | DGFMDVWTYN | | DGWYGFRHQNA | |

Fig. 83-40

| Block size 8 | SIN | Block size 9 | SIN | Block size 10 | SIN | Block size 11 | SIN |
|---|---|---|---|---|---|---|---|
| DDSCMESIR | | DDSCMESIR | | DGFRDVWTYN | | DGWYGFRHQNS | |
| DDSSSNSNC | | DDSSSNSNC | | DGGHIEECSC | | DGWYGFRHQNT | |
| DDSSSSSNC | | DDSSSSSNC | | DGGPNLYNIR | | DGWYGFRYQNS | |
| DDSVYKALS | | DDSVYKALS | | DGIGRFYIQM | | DGWYGYHHENS | |
| DDVDQSLII | | DDVDQSLII | | DGIGRMTICI | | DGWYGYHHQNE | |
| DDVDQSLVI | | DDVDQSLVI | | DGIGRMTICV | | DGWYGYHHQNG | |
| DDVLMGRTI | | DDVLMGRTI | | DGITNKVNSI | | DGWYGYHHSND | |
| DDVSWASNS | | DDVSWASNS | | DGKAPISLGD | | DGWYGYKHQNA | |
| DDVSWTSNS | | DDVSWTSNS | | DGKAPISLGG | | DGWYGYRHQNA | |
| DDVWLGRTV | | DDVWLGRTV | | DGKAWLHICV | | DHAQYREEALL | |
| DDVWMGRTI | | DDVWMGRTI | | DGKAWLHVCI | | DHCMESIRNNT | |
| DEAINNRFQ | | DEAINNRFQ | | DGKAWLHVCV | | DHEGEGIPLYD | |
| DEAINNRIK | | DEAINNRIK | | DGKEWMHICM | | DHICIGYHANN | |
| DEAINSRFQ | | DEAINSRFQ | | DGKEWMHVCI | | DHIEVTNATEL | |
| DEAISNRFQ | | DEAISNRFQ | | DGKEWMHVCM | | DHKDYEEEAKL | |
| DEALKMTIA | | DEALKMTIA | | DGKEWMHVSM | | DHKEYEEEAKL | |
| DEALNNRFQ | | DEALNNRFQ | | DGKGCFDLYH | | DHMAIIKKYTS | |
| DEALNNRSQ | | DEALNNRSQ | | DGKGCFEIYH | | DHMAIIKRYTS | |
| DEALSNRFQ | | DEALSNRFQ | | DGKGCFELHH | | DHNIYRDEAIN | |
| DEAVNNRFQ | | DEAVNNRFQ | | DGKGCFELYH | | DHSDNADKICL | |
| DECIEKVRN | | DECIEKVRN | | DGKSSACKRA | | DHSQYREEALL | |
| DECRFYALS | | DECRFYALS | | DGKVECVCRD | | DHTQYREEALL | |
| DECRTFFLT | | DECRTFFLT | | DGLLDVWTYN | | DHTSQYLCTGV | |
| DEEGTGIAA | | DEEGTGIAA | | DGLQSSDDFA | | DICYPGKFTNE | |
| DEESRARIK | | DEESRARIK | | DGNASGKADT | | DICYPGRFTNE | |
| DEFCYTLIT | | DEFCYTLIT | | DGNGCFEIFH | | DIDIYCICRDN | |
| DEFCYTLMT | | DEFCYTLMT | | DGNGCFELYH | | DIDQSLIIAAR | |
| DEFCYTLVT | | DEFCYTLVT | | DGNIIFLWGI | | DIDVYCICRDN | |
| DEFQLIPMI | | DEFQLIPMI | | DGNMRCTICI | | DIDVYCVCRDN | |
| DEGDGCFNF | | DEGDGCFNF | | DGPAANNADH | | DIEAMASQGTK | |
| DEGDGCFNL | | DEGDGCFNL | | DGPAANSADH | | DIEAMATQGTK | |
| DEGDGCFSI | | DEGDGCFSI | | DGPAANSAHH | | DIEIMASQGTK | |
| DEGDGCFSL | | DEGDGCFSL | | DGPANKQASY | | DIFVIREPFIS | |
| DEGLPQSGR | | DEGLPQSGR | | DGPANNQASY | | DIFVMREPFIS | |
| DEGNGCFEL | | DEGNGCFEL | | DGPANSQASY | | DIIDNDNWSGY | |
| DEGNGCFTF | | DEGNGCFTF | | DGPANSQAYT | | DIIDNNNWSGY | |
| DEHDANVRN | | DEHDANVRN | | DGPASNQASY | | DIIFLWGIHHP | |
| DEHDSNVEN | | DEHDSNVEN | | DGPASSQAYT | | DIILWFSFGAS | |
| DEHDSNVKN | | DEHDSNVKN | | DGPGWLTIGI | | DIILWFSFGES | |
| DEICIGHLS | | DEICIGHLS | | DGPGWLTLGI | | DIILWFSFSIS | |
| DEICIGYLS | | DEICIGYLS | | DGPSDAQAFY | | DIILWISFSIS | |
| DEICIGYMS | | DEICIGYMS | | DGPSNAQAFY | | DIILWISFSMS | |
| DEIGEDIAP | | DEIGEDIAP | | DGQAFYKILK | | DIILWVSFSIS | |
| DEIGEDLAP | | DEIGEDLAP | | DGQDCDLING | | DIINGALGSPG | |
| DEIGEDVAP | | DEIGEDVAP | | DGQRSWMKIY | | DIIVFNTIGNL | |
| DEITTKINN | | DEITTKINN | | DGQRSWMKLY | | DILDGVTASCR | |
| DELCPSPLK | | DELCPSPLK | | DGQSGRIDFH | | DILEGTTASCQ | |
| DELIGKTSW | | DELIGKTSW | | DGRAWLHVCV | | DILEKAHNGKL | |
| DENATASFI | | DENATASFI | | DGRGCFEIYH | | DILEKTHNGKL | |
| DEQMYQKCC | | DEQMYQKCC | | DGRLIQNSIT | | DILEKVHNGKL | |
| DEQMYQRCC | | DEQMYQRCC | | DGSASGKADT | | DILERTHNGKL | |
| DEQNKLYGA | | DEQNKLYGA | | DGSASGKAET | | DILHKCDNECM | |
| DEQNKLYGT | | DEQNKLYGT | | DGSASGQAYT | | DILHKCDNKCM | |
| DEQTKLYGS | | DEQTKLYGS | | DGSASGRADT | | DILHKCNNECM | |
| DERGLFGAI | | DERGLFGAI | | DGSASRKADT | | DILKHNPTEEQ | |
| DERGNPGVK | | DERGNPGVK | | DGSASSQAHT | | DILKQNPTEEQ | |
| DERRNKYLE | | DERRNKYLE | | DGSASSQAYT | | DILRQNPSEEQ | |
| DERRNRYLE | | DERRNRYLE | | DGSATGPADT | | DILRQNPTEEQ | |
| DESCEGECF | | DESCEGECF | | DGSATGPAET | | DILRQNSTEEQ | |
| DESRIERQK | | DESRIERQK | | DGSDIGFMPK | | DILRTQESECQ | |
| DEVDQSLII | | DEVDQSLII | | DGSGWLTLGI | | DILRTQESECV | |
| DEVKRRLSA | | DEVKRRLSA | | DGSIGKVCRT | | DILRTQESSCS | |

Fig. 83-41

| Block size 8 | SIN | Block size 9 | SIN | Block size 10 | SIN | Block size 11 | SIN |
|---|---|---|---|---|---|---|---|
| DEVKRRLST | | DEVKRRLST | | DGSNIGFMPK | | DILRTQESSCT | |
| DEVRRRLSA | | DEVRRRLSA | | DGSSSACLRG | | DILVTREPYVS | |
| DEVRRRLST | | DEVRRRLST | | DGTACFEIFH | | DIMQNKLNNVI | |
| DEVRRRLSV | | DEVRRRLSV | | DGTAFRGLIS | | DIMRTQESSCT | |
| DEVSWTSNS | | DEVSWTSNS | | DGTGCFEIFH | | DINIAEYSIDS | |
| DEVWWTSNS | | DEVWWTSNS | | DGTIAGFIEG | | DINIMASQGTK | |
| DEYKNTGDS | | DEYKNTGDS | | DGTYKILTIY | | DINLHAYISFR | |
| DEYKNTRDS | | DEYKNTRDS | | DGVGRMTICI | | DINMADYSIDS | |
| DFALILNAP | | DFALILNAP | | DGVGRMTICV | | DINMEDYSIDS | |
| DFALIVNAL | | DFALIVNAL | | DGVTASCLDK | | DIRTATREGKH | |
| DFALIVNAP | | DFALIVNAP | | DGVTASCLDR | | DISMEDYSIDS | |
| DFALIVNAS | | DFALIVNAS | | DGVTASCRDN | | DISMEDYSIGS | |
| DFEKEGYSL | | DFEKEGYSL | | DGVTNKVNSI | | DITIGSICMVT | |
| DFEREGYSL | | DFEREGYSL | | DGVWIGRTKN | | DIVLVMKRKRD | |
| DFFKRLNWL | | DFFKRLNWL | | DGVWIGRTKS | | DIVNAALGSPG | |
| DFFNRLNWL | | DFFNRLNWL | | DGVYKALSIY | | DIVNGALGSPG | |
| DFFRRLNWL | | DFFRRLNWL | | DGWILGNPQC | | DIVNSALGSPG | |
| DFHDSNVKN | | DFHDSNVKN | | DGWINSPNHA | | DIWAYNAELIV | |
| DFHDSNVKS | | DFHDSNVKS | | DGWTTANSKS | | DIWAYNAELLV | |
| DFHDSNVRN | | DFHDSNVRN | | DGWYGFHHSN | | DIWITREPYVS | |
| DFHDSSVKN | | DFHDSSVKN | | DGWYGFKHQN | | DIWSYNAKLLV | |
| DFHWMLLDP | | DFHWMLLDP | | DGWYGFRHHN | | DIWSYNAQLLV | |
| DFICVGWSS | | DFICVGWSS | | DGWYGFRHQN | | DIWSYNARLLV | |
| DFIKWNVTY | | DFIKWNVTY | | DGWYGFRYQN | | DIWTYNAELLV | |
| DFKSTQAAI | | DFKSTQAAI | | DGWYGFYHHEN | | DIWTYQAELLV | |
| DFLCVGWSS | | DFLCVGWSS | | DGWYGYHHIN | | DIWVTRELYVS | |
| DFLDVWTYN | | DFLDVWTYN | | DGWYGYHHNN | | DIWVTREPYAS | |
| DFLNNTEPL | | DFLNNTEPL | | DGWYGYHHQN | | DIWVTREPYVS | |
| DFMCVGWSS | | DFMCVGWSS | | DGWYGYHHSK | | DIWVTRVPYVS | |
| DFQLIPMIS | | DFQLIPMIS | | DGWYGYHHSN | | DIYCICRDNWK | |
| DFRDMRKNT | | DFRDMRKNT | | DGWYGYHHTN | | DIYCVCRDNWK | |
| DFSKWNVTY | | DFSKWNVTY | | DGWYGYKHQN | | DKASTQKAIDE | |
| DFTKWNVTH | | DFTKWNVTH | | DGWYGYRHQN | | DKASTQKAINE | |
| DFTKWNVTY | | DFTKWNVTY | | DHAQYREEAL | | DKAVKLYKKLK | |
| DFVRQCFNP | | DFVRQCFNP | | DHCMESIRNN | | DKAVKLYRKLK | |
| DGADINFMP | | DGADINFMP | | DHEGEGIPLY | | DKCYQFALGQG | |
| DGADLPFTI | | DGADLPFTI | | DHFVSIELEG | | DKDSNGVQDII | |
| DGAEIEYFL | | DGAEIEYFL | | DHGVKGWAFD | | DKEPMGFRYSG | |
| DGAEIIYFE | | DGAEIIYFE | | DHICIGYHAN | | DKESMGFRYSG | |
| DGAEIIYFK | | DGAEIIYFK | | DHIEVTNATE | | DKESTQKAIDQ | |
| DGAEITYFK | | DGAEITYFK | | DHITFSHNGG | | DKESTQKAIDR | |
| DGAELPFAI | | DGAELPFAI | | DHKDFEEESK | | DKGNGCFEIFH | |
| DGAELPFII | | DGAELPFII | | DHKDYEEEAK | | DKGSIQSDKPF | |
| DGAELPFTI | | DGAELPFTI | | DHKEFEEESK | | DKHDSNVKNLF | |
| DGAFLAPRY | | DGAFLAPRY | | DHKEFEEESR | | DKHSNGTIKDR | |
| DGAILPFDF | | DGAILPFDF | | DHKEFEKESK | | DKHSNGTMKDR | |
| DGAILPFDI | | DGAILPFDI | | DHKEFEKESR | | DKHSNGTVKDR | |
| DGAILPFGI | | DGAILPFGI | | DHKEYEEEAK | | DKHSNNTVKDR | |
| DGAILPLTS | | DGAILPLTS | | DHMAIIKKYT | | DKHSSGTVKDR | |
| DGAKIEYFL | | DGAKIEYFL | | DHNIYRDEAI | | DKICIGYHANN | |
| DGAKIKYFL | | DGAKIKYFL | | DHRIYWIREG | | DKICIGYLSNN | |
| DGAKIQYFS | | DGAKIQYFS | | DHRIYWIRKG | | DKICIGYQTNN | |
| DGAKLPFTI | | DGAKLPFTI | | DHRVYWIREG | | DKICLGHHAVA | |
| DGALLPFDI | | DGALLPFDI | | DHSDNADKIC | | DKICLGHHAVP | |
| DGANIDFMP | | DGANIDFMP | | DHSQYREEAL | | DKICLGHHAVS | |
| DGANIDFVP | | DGANIDFVP | | DHTQYREEAL | | DKICLGHHAVT | |
| DGANIGFMP | | DGANIGFMP | | DHTSQYLCTG | | DKICVGYLSTN | |
| DGANINFMA | | DGANINFMA | | DICYPGKFTN | | DKIDDQIEDLW | |
| DGANINFMH | | DGANINFMH | | DICYPGRFTN | | DKIDDQIEELW | |
| DGANINFMP | | DGANINFMP | | DIDIYCICRD | | DKIDDQIEGLW | |
| DGANINFMS | | DGANINFMS | | DIDQSLIIAA | | DKIDDQIENLW | |
| DGANINLMP | | DGANINLMP | | DIDVYCICRD | | DKIDTLTETGV | |

Fig. 83-42

| Block size 8 | SIN | Block size 9 | SIN | Block size 10 | SIN | Block size 11 | SIN |
|---|---|---|---|---|---|---|---|
| DGANISFMP | | DGANISFMP | | DIDVYCVCRD | | DKINDQIEDLW | |
| DGAQIKYFS | | DGAQIKYFS | | DIEAMASQGT | | DKITFEATGNL | |
| DGAQIQYFS | | DGAQIQYFS | | DIEAMATQGT | | DKITNKINNIV | |
| DGARIQYFS | | DGARIQYFS | | DIECVCRDNW | | DKITNKVNNIV | |
| DGATSACKR | | DGATSACKR | | DIFVIREPFI | | DKLTQGRQTFD | |
| DGAVAVLKY | | DGAVAVLKY | | DIFVMREPFI | | DKLTQGRQTYD | |
| DGAVLPFDI | | DGAVLPFDI | | DIGAMASQGT | | DKLYIWGIHHP | |
| DGCFEILHK | | DGCFEILHK | | DIIDNDNWSG | | DKLYIWGVHHP | |
| DGCFEILHR | | DGCFEILHR | | DIIDNNNWSG | | DKLYVWGIHHP | |
| DGCFNFFHK | | DGCFNFFHK | | DIIFLWGIHH | | DKLYVWGVHHP | |
| DGCFNLLHK | | DGCFNLLHK | | DIILWFSFGA | | DKMNGNYDSIR | |
| DGCFSILHK | | DGCFSILHK | | DIILWISFSI | | DKMNREFEVMN | |
| DGCFSLLHK | | DGCFSLLHK | | DIILWISFSM | | DKMNREFEVVD | |
| DGCRFYALS | | DGCRFYALS | | DIILWVSFSI | | DKMNREFEVVN | |
| DGDIIFLWG | | DGDIIFLWG | | DIINGALGSP | | DKMNREFGVVN | |
| DGFEPNGCI | | DGFEPNGCI | | DIITDTIKSW | | DKNALGDCPKY | |
| DGFEPNGYI | | DGFEPNGYI | | DIIVFNTIGN | | DKNALGECPKY | |
| DGFIDIWTY | | DGFIDIWTY | | DIKSHAYISF | | DKNSNGVQDII | |
| DGFIDVWTY | | DGFIDVWTY | | DILDGVTASC | | DKPFQNVSRIA | |
| DGFKPNGCI | | DGFKPNGCI | | DILEGTTASC | | DKQTKTMTITF | |
| DGFLDIWTY | | DGFLDIWTY | | DILEKAHNGK | | DKRIGSCTSPC | |
| DGFLDVWTY | | DGFLDVWTY | | DILEKTHNGK | | DKTLDLHDANV | |
| DGFLGVWTY | | DGFLGVWTY | | DILEKVHNGK | | DKTLDMHDANV | |
| DGFLNVWTY | | DGFLNVWTY | | DILERTHNGK | | DKTLNMHDANV | |
| DGFMDVWTY | | DGFMDVWTY | | DILHKCDNEC | | DKTNQQFELID | |
| DGGHIEECS | | DGGHIEECS | | DILHKCDNKC | | DKTNQQFEMID | |
| DGGPNLYNI | | DGGPNLYNI | | DILHKCNNEC | | DKTPYRSLIRF | |
| DGIARMTIC | | DGIARMTIC | | DILKHNPTEE | | DKTSTQKAINE | |
| DGIGRFYIQ | | DGIGRFYIQ | | DILKQNPTEE | | DKVCTKGKKAV | |
| DGIGRMTIC | | DGIGRMTIC | | DILRQNPSEE | | DKVDTLTENGV | |
| DGITNKINS | | DGITNKINS | | DILRQNPTEE | | DKVDTLTETGV | |
| DGITNKVNS | | DGITNKVNS | | DILRTQESEC | | DKVRLQLKDNA | |
| DGKAPISLG | | DGKAPISLG | | DILRTQESSC | | DKVRLQLRDNA | |
| DGKAWLHIC | | DGKAWLHIC | | DILVTREPYV | | DKVRMQLKDNA | |
| DGKAWLHVC | | DGKAWLHVC | | DIMQNKLNNV | | DKVRMQLRDNA | |
| DGKEWLHVC | | DGKEWLHVC | | DIMRTQESSC | | DKVRMQLRDNV | |
| DGKEWMHIC | | DGKEWMHIC | | DINIAEYSID | | DKVSTQKAINE | |
| DGKEWMHVC | | DGKEWMHVC | | DINIMASQGT | | DKVSTQKALNE | |
| DGKEWMHVS | | DGKEWMHVS | | DINLHAYISF | | DKVWWTSNSII | |
| DGKGCFDLY | | DGKGCFDLY | | DINMADYSID | | DKVWWTSNSIV | |
| DGKGCFEIY | | DGKGCFEIY | | DINMEDYSID | | DKYHQIEKEFE | |
| DGKGCFELY | | DGKGCFELY | | DIRTATREGK | | DLADSEMDKLY | |
| DGKGCFETY | | DGKGCFETY | | DISMEDYSID | | DLADSEMKKLY | |
| DGKGCSELY | | DGKGCSELY | | DISMEDYSIG | | DLADSEMLNLY | |
| DGKSSACKR | | DGKSSACKR | | DITIGSICMV | | DLADSEMNKLY | |
| DGKSWLHVC | | DGKSWLHVC | | DIVLVMKRKR | | DLADSEMNNLY | |
| DGKVECVCR | | DGKVECVCR | | DIVNAALGSP | | DLADSEMSKLY | |
| DGLLDVWTY | | DGLLDVWTY | | DIVNGALGSP | | DLANSEMNKLY | |
| DGLQSSDDF | | DGLQSSDDF | | DIVNSALGSP | | DLDYQIGYICS | |
| DGNASGKAD | | DGNASGKAD | | DIWATREPYV | | DLDYQIGYVCS | |
| DGNAWLHVC | | DGNAWLHVC | | DIWAYNAELI | | DLEALMEWLKT | |
| DGNGCFEIF | | DGNGCFEIF | | DIWAYNAELL | | DLEALMEWLKT | |
| DGNGCFELY | | DGNGCFELY | | DIWITREPYV | | DLEKYIEDTKI | |
| DGNIIFLWG | | DGNIIFLWG | | DIWSYNAKLL | | DLEKYVEDTKI | |
| DGNLIAPWY | | DGNLIAPWY | | DIWSYNAQLL | | DLEKYVEDTKV | |
| DGPAANNAD | | DGPAANNAD | | DIWSYNARLL | | DLENYVEDTKI | |
| DGPAANSAD | | DGPAANSAD | | DIWTYNAELL | | DLERYVEDTKI | |
| DGPAANSAH | | DGPAANSAH | | DIWTYNAEML | | DLGAPLELRDC | |
| DGPANKQAS | | DGPANKQAS | | DIWTYQAELL | | DLGNGCFEFWH | |
| DGPANNQAS | | DGPANNQAS | | DIWVTRELYV | | DLGPATAQMAL | |
| DGPANSQAS | | DGPANSQAS | | DIWVTREPYA | | DLGSCGILGTI | |
| DGPANSQAY | | DGPANSQAY | | DIWVTREPYV | | DLGSPLELRDC | |

Fig. 83-43

| Block size 8 | SIN | Block size 9 | SIN | Block size 10 | SIN | Block size 11 | SIN |
|---|---|---|---|---|---|---|---|
| DGPASNQAS | | DGPASNQAS | | DIWVTRVPYV | | DLGTPLELRDC | |
| DGPGWLTIG | | DGPGWLTIG | | DIYCICRDNW | | DLHDANVKNLH | |
| DGPGWLTLG | | DGPGWLTLG | | DIYCVCRDNW | | DLHDANVRNLH | |
| DGPQIQYFS | | DGPQIQYFS | | DIYDFNEGSY | | DLHDSNVKNLH | |
| DGPSDAQAF | | DGPSDAQAF | | DKASTQKAID | | DLHDSNVKNLY | |
| DGPSNAQAF | | DGPSNAQAF | | DKASTQKAIN | | DLHDSNVRNLH | |
| DGQDCDLIN | | DGQDCDLIN | | DKAVKLYKKL | | DLHDSNVRSLH | |
| DGQRSWMKI | | DGQRSWMKI | | DKAVKLYRKL | | DLHLEFKADLI | |
| DGQRSWMKL | | DGQRSWMKL | | DKCYQFALGQ | | DLHLTGIWDTL | |
| DGQSGRIDF | | DGQSGRIDF | | DKDSNGVQDI | | DLHLTGMWDTL | |
| DGRAWLHIC | | DGRAWLHIC | | DKEPMGFRYS | | DLHLTGTWDTL | |
| DGRAWLHVC | | DGRAWLHVC | | DKESMGFRYS | | DLIETNHTGTY | |
| DGREWMHVC | | DGREWMHVC | | DKESTQKAID | | DLIETTHTGTY | |
| DGRGCFEIY | | DGRGCFEIY | | DKGNGCFEIF | | DLIFLARSALI | |
| DGRLIQNSI | | DGRLIQNSI | | DKGSIQSDKP | | DLIFLARSALV | |
| DGSANSQAY | | DGSANSQAY | | DKHDSNVKNL | | DLIFMARSALI | |
| DGSASGKAD | | DGSASGKAD | | DKHSNGTIKD | | DLIFSARSALI | |
| DGSASGKAE | | DGSASGKAE | | DKHSNGTMKD | | DLIGKNSWSYI | |
| DGSASGQAY | | DGSASGQAY | | DKHSNGTVKD | | DLIGKTSWSYI | |
| DGSASGRAD | | DGSASGRAD | | DKHSNNTVKD | | DLIIERKEGTD | |
| DGSASRKAD | | DGSASRKAD | | DKICIGYHAN | | DLIIERREGAD | |
| DGSASSQAH | | DGSASSQAH | | DKICIGYLSN | | DLIIERREGND | |
| DGSASSQAY | | DGSASSQAY | | DKICIGYQTN | | DLIIERREGSD | |
| DGSATGPAD | | DGSATGPAD | | DKICLGHHAA | | DLIIERREGTD | |
| DGSATGPAE | | DGSATGPAE | | DKICLGHHAV | | DLIIERRNSSD | |
| DGSDIGFMP | | DGSDIGFMP | | DKICLGRHAV | | DLILFNTIGNL | |
| DGSGWLTLG | | DGSGWLTLG | | DKICVGYLST | | DLINGALGSPG | |
| DGSIGKVCR | | DGSIGKVCR | | DKIDDQIEDL | | DLIVFNTIGNL | |
| DGSKIGFMP | | DGSKIGFMP | | DKIDDQIEEL | | DLKSTQAAIDK | |
| DGSNIGFMP | | DGSNIGFMP | | DKIDDQIEGL | | DLKSTQAAIDQ | |
| DGSNIKFMP | | DGSNIKFMP | | DKIDDQIENL | | DLKSTQAAINQ | |
| DGSSSACLR | | DGSSSACLR | | DKIDTLTETG | | DLKSTQAAITQ | |
| DGTAFRGLI | | DGTAFRGLI | | DKINDQIEDL | | DLKSTQAAVNQ | |
| DGTGCFEIF | | DGTGCFEIF | | DKINGKLNRL | | DLKSTQTAIDQ | |
| DGTGCFELF | | DGTGCFELF | | DKISLGHHAV | | DLLVAMENQHT | |
| DGTIAGFIE | | DGTIAGFIE | | DKITFEATGN | | DLNFVNRANQR | |
| DGTYKILTI | | DGTYKILTI | | DKITNKINNI | | DLNMGQPFYSH | |
| DGVGRMTIC | | DGVGRMTIC | | DKITNKVNNI | | DLNYQIGYICS | |
| DGVNRMTIC | | DGVNRMTIC | | DKLTQGRQTF | | DLRSGYEMLKV | |
| DGVSRMTIC | | DGVSRMTIC | | DKLTQGRQTY | | DLRSGYETFKV | |
| DGVTASCLD | | DGVTASCLD | | DKLYIWGIHH | | DLSFQGRGVFE | |
| DGVTASCRD | | DGVTASCRD | | DKLYIWGVHH | | DLTDSEMNKLF | |
| DGVTNKVNS | | DGVTNKVNS | | DKLYVWGIHH | | DLTDSEMNKLY | |
| DGVWIGRTK | | DGVWIGRTK | | DKLYVWGVHH | | DLTDSEMSKLF | |
| DGVYKALSI | | DGVYKALSI | | DKMNGNYDSI | | DLTDSEMSKLY | |
| DGWILGNPQ | | DGWILGNPQ | | DKMNREFEVM | | DLTFLARSALI | |
| DGWINSPNH | | DGWINSPNH | | DKMNREFEVV | | DLTNSEMNKLY | |
| DGWTTANSK | | DGWTTANSK | | DKMNREFGVV | | DLVETNHTGTY | |
| DGWYGFHHS | | DGWYGFHHS | | DKNALGDCPK | | DLVETSHTGTY | |
| DGWYGFKHQ | | DGWYGFKHQ | | DKNALGECPK | | DLWAYNAELLV | |
| DGWYGFRHH | | DGWYGFRHH | | DKNATASFIY | | DLWSYNADVLV | |
| DGWYGFRHQ | | DGWYGFRHQ | | DKNSNGVQDI | | DLWSYNAELLI | |
| DGWYGFRYQ | | DGWYGFRYQ | | DKPFQNVSRI | | DLWSYNAELLV | |
| DGWYGYHHE | | DGWYGYHHE | | DKQTKTMTIT | | DLWSYNAGLLV | |
| DGWYGYHHI | | DGWYGYHHI | | DKRIGSCTSP | | DLWSYNAQLLV | |
| DGWYGYHHN | | DGWYGYHHN | | DKRYGPALSI | | DLYGTQPLSIS | |
| DGWYGYHHQ | | DGWYGYHHQ | | DKTLDLHDAN | | DLYGTQSLSIS | |
| DGWYGYHHS | | DGWYGYHHS | | DKTLDMHDAN | | DLYKVATGRVT | |
| DGWYGYHHT | | DGWYGYHHT | | DKTLNMHDAN | | DLYLNGREWSY | |
| DGWYGYKHQ | | DGWYGYKHQ | | DKTNQQFELI | | DLYLSGREWSY | |
| DGWYGYRHQ | | DGWYGYRHQ | | DKTNQQFEMI | | DLYLTGTWDTL | |
| DHAQYREEA | | DHAQYREEA | | DKTPYRSLIR | | DMADSEMLNLY | |

Fig. 83-44

| Block size 8 | SIN | Block size 9 | SIN | Block size 10 | SIN | Block size 11 | SIN |
|---|---|---|---|---|---|---|---|
| DHCMESIRN | | DHCMESIRN | | DKTSTQKAIN | | DMGDSEMLNLY | |
| DHEGEGIPL | | DHEGEGIPL | | DKVCTKGKKA | | DMHDANVKNLH | |
| DHGVKGWAF | | DHGVKGWAF | | DKVDTIIENN | | DMHDANVRNLH | |
| DHICIGYHA | | DHICIGYHA | | DKVDTLTENG | | DMSIGITVIKN | |
| DHIEVTNAT | | DHIEVTNAT | | DKVDTLTETG | | DMSIGVAVIKN | |
| DHITFSHNG | | DHITFSHNG | | DKVNTIIENN | | DMSIGVTVIKN | |
| DHKDFEEES | | DHKDFEEES | | DKVRLQLKDN | | DMSIGVTVIRN | |
| DHKDYEEEA | | DHKDYEEEA | | DKVRLQLRDN | | DMTDSEMNKLF | |
| DHKEFEEES | | DHKEFEEES | | DKVRMQLKDN | | DNADKICLGHH | |
| DHKEFEKES | | DHKEFEKES | | DKVRMQLRDN | | DNAIDEGDGCF | |
| DHKEYEEEA | | DHKEYEEEA | | DKVSTQKAIN | | DNAIRFGEGEQ | |
| DHMAIIKKY | | DHMAIIKKY | | DKVSTQKALN | | DNAIRFGESEQ | |
| DHNIYRDEA | | DHNIYRDEA | | DKVWWTSNSI | | DNAIRIGEDAH | |
| DHRIYWIKE | | DHRIYWIKE | | DKYHQIEKEF | | DNAIRIGEEAH | |
| DHRIYWIRE | | DHRIYWIRE | | DLADSEMDKL | | DNAIRIGEGAH | |
| DHRIYWIRK | | DHRIYWIRK | | DLADSEMKKL | | DNAIRIGENAH | |
| DHRVYWIRE | | DHRVYWIRE | | DLADSEMLNL | | DNAKDEGNGCF | |
| DHSDNADKI | | DHSDNADKI | | DLADSEMNKL | | DNAKDLGNGCF | |
| DHSQYREEA | | DHSQYREEA | | DLADSEMNNL | | DNAKEIGNGCF | |
| DHTQYREEA | | DHTQYREEA | | DLADSEMSKL | | DNAKELGNGCF | |
| DHTSQYLCT | | DHTSQYLCT | | DLAESEMNKL | | DNAKEMGNGCF | |
| DICYPGKFT | | DICYPGKFT | | DLDNCHPIGM | | DNAKETGNGCF | |
| DICYPGRFT | | DICYPGRFT | | DLDYQIGYIC | | DNAKEVGNGCF | |
| DIDIYCICR | | DIDIYCICR | | DLDYQIGYVC | | DNAKEWGNGCF | |
| DIDQSLIIA | | DIDQSLIIA | | DLEALMEWIK | | DNANDLGNGCF | |
| DIDVYCICR | | DIDVYCICR | | DLEALMEWLK | | DNARELGNGCF | |
| DIDVYCVCR | | DIDVYCVCR | | DLEEYVEDTK | | DNATATVYYDR | |
| DIEAMASQG | | DIEAMASQG | | DLEKYIEDTK | | DNATATVYYNR | |
| DIEAMATQG | | DIEAMATQG | | DLEKYVEDTK | | DNAVRFGESEQ | |
| DIECVCRDN | | DIECVCRDN | | DLENYVEDTK | | DNAVRIGEDAH | |
| DIEIMASQG | | DIEIMASQG | | DLERYVEDTK | | DNCMERIRNNT | |
| DIFVIREPF | | DIFVIREPF | | DLGAPLELRD | | DNCMESIRDNT | |
| DIFVMREPF | | DIFVMREPF | | DLGKCGLLGT | | DNCMESIRNNT | |
| DIIDNDNWS | | DIIDNDNWS | | DLGNCHPIGI | | DNDAYAVIHYG | |
| DIIDNNNWS | | DIIDNNNWS | | DLGNCHPIGM | | DNDNWSGYSGS | |
| DIIFLWGIH | | DIIFLWGIH | | DLGNCHPVGM | | DNEAVAVLKYN | |
| DIILWFSFG | | DIILWFSFG | | DLGNGCFEFW | | DNECMETIKNG | |
| DIILWISFS | | DIILWISFS | | DLGNGCFKIY | | DNEFTEVEQQI | |
| DIILWVSFS | | DIILWVSFS | | DLGPATAQMA | | DNENATATVYY | |
| DIINGALGS | | DIINGALGS | | DLGQCGILGI | | DNEPGSGDWPD | |
| DIITDTIKS | | DIITDTIKS | | DLGQCGLLGI | | DNEPGSGNGLM | |
| DIIVFNTIG | | DIIVFNTIG | | DLGQCGLLGT | | DNEPGSGNWPD | |
| DIKSHAYIS | | DIKSHAYIS | | DLGRCGLLGT | | DNEQTDLYKVA | |
| DILDGVTAS | | DILDGVTAS | | DLGSCGILGT | | DNGAVAVLKYK | |
| DILEGTTAS | | DILEGTTAS | | DLGSCHPIGM | | DNGAVAVLKYN | |
| DILEKAHNG | | DILEKAHNG | | DLGSPLELRD | | DNGDGCFEILH | |
| DILEKKHNG | | DILEKKHNG | | DLGTPLELRD | | DNGIRIGSKGD | |
| DILEKTHNG | | DILEKTHNG | | DLHDANVKNL | | DNGIRIGSKGH | |
| DILEKVHNG | | DILEKVHNG | | DLHDANVRNL | | DNGIRIGSRGE | |
| DILERTHNG | | DILERTHNG | | DLHDSNVKNL | | DNGIRIGSRGH | |
| DILHKCDNE | | DILHKCDNE | | DLHDSNVRNL | | DNGIRVGSRGH | |
| DILHKCDNK | | DILHKCDNK | | DLHDSNVRSL | | DNGVRIGSKGD | |
| DILHKCNNE | | DILHKCNNE | | DLHLEFKADL | | DNGVWIGRTKS | |
| DILKHNPTE | | DILKHNPTE | | DLHLTGIWDT | | DNGWVSTDKDS | |
| DILKQNPTE | | DILKQNPTE | | DLHLTGMWDT | | DNHSMSDIEAM | |
| DILRQNPSE | | DILRQNPSE | | DLHLTGTWDT | | DNHVEVVSAKE | |
| DILRQNPTE | | DILRQNPTE | | DLIENLQAYQ | | DNIEVTNATEL | |
| DILRTQESE | | DILRTQESE | | DLIETNHTGT | | DNITFLHNGGL | |
| DILRTQESS | | DILRTQESS | | DLIETTHTGT | | DNITFSDNGGL | |
| DILVTREPY | | DILVTREPY | | DLIFLARSAL | | DNITFSHNGGL | |
| DIMQNKLNN | | DIMQNKLNN | | DLIFMARSAL | | DNIYKILSIYS | |
| | | | | DLIFSARSAL | | DNKADHRIYWI | |

Fig. 83-45

| Block size 8 | SIN | Block size 9 | SIN | Block size 10 | SIN | Block size 11 | SIN |
|---|---|---|---|---|---|---|---|
| DIMRTQESS | | DIMRTQESS | | DLIGKNSWSY | | DNKCMETIKNG | |
| DINIAEYSI | | DINIAEYSI | | DLIGKTSWSY | | DNKHSNDTIHD | |
| DINIMASQG | | DINIMASQG | | DLIIERKEGT | | DNKHSNDTVHD | |
| DINLHAYIS | | DINLHAYIS | | DLIIERREGA | | DNKHSNGTIHD | |
| DINLMPIYS | | DINLMPIYS | | DLIIERREGN | | DNKNWSGYSGS | |
| DINMADYSI | | DINMADYSI | | DLIIERREGS | | DNKTKKMTITF | |
| DINMEDYSI | | DINMEDYSI | | DLIIERREGT | | DNLIGKTSWSY | |
| DIRTATREG | | DIRTATREG | | DLIIERRNSS | | DNLNWSGYSGS | |
| DISMEDYSI | | DISMEDYSI | | DLILFNTIGN | | DNLQAYQKRMG | |
| DITIGSICM | | DITIGSICM | | DLINGALGSP | | DNMQNKLNNVI | |
| DIVLVMKRK | | DIVLVMKRK | | DLIVFNTIGN | | DNMQNRLNNVI | |
| DIVNAALGS | | DIVNAALGS | | DLKSTQAAID | | DNNCIESIRNG | |
| DIVNGALGS | | DIVNGALGS | | DLKSTQAAIN | | DNNGELRHLFS | |
| DIVNSALGS | | DIVNSALGS | | DLKSTQAAIT | | DNNIRIGSKGD | |
| DIWAYNAEL | | DIWAYNAEL | | DLKSTQAAVN | | DNNKNATNPLT | |
| DIWITREPY | | DIWITREPY | | DLKSTQTAID | | DNNNWSGYSGS | |
| DIWMGRTIS | | DIWMGRTIS | | DLLDNLQAYQ | | DNPIRLSGGGD | |
| DIWSYNAKL | | DIWSYNAKL | | DLLENLQAYQ | | DNPNWSGYSGS | |
| DIWSYNAQL | | DIWSYNAQL | | DLLENLQTYQ | | DNQCMESIRNN | |
| DIWSYNARL | | DIWSYNARL | | DLLVAMENQH | | DNQTKKMTITF | |
| DIWTYNAEL | | DIWTYNAEL | | DLNFVNRANQ | | DNQTKTMTITF | |
| DIWTYQAEL | | DIWTYQAEL | | DLNMGQPFYS | | DNQVFPQLNQT | |
| DIWVTRELY | | DIWVTRELY | | DLNYQIGYIC | | DNRSGYSGIFS | |
| DIWVTREPY | | DIWVTREPY | | DLRSGYEMLK | | DNSIRIGSKGD | |
| DIWVTRKPY | | DIWVTRKPY | | DLRSGYETFK | | DNSIRIGSRGD | |
| DIWVTRVPY | | DIWVTRVPY | | DLSFQGRGVF | | DNSIRLAAGGA | |
| DIYCICRDN | | DIYCICRDN | | DLSQCGLLGT | | DNSIRLAAGGD | |
| DIYCVCRDN | | DIYCVCRDN | | DLTDSEMNKL | | DNSIRLSAGGA | |
| DIYDFNEGS | | DIYDFNEGS | | DLTDSEMSKL | | DNSIRLSAGGD | |
| DKASTQKAI | | DKASTQKAI | | DLTFLARSAL | | DNSIRLSAGGH | |
| DKAVKLYKK | | DKAVKLYKK | | DLVETNHTGT | | DNSIRLSAGGN | |
| DKAVKLYRK | | DKAVKLYRK | | DLVETSHTGT | | DNSIRLSASGD | |
| DKCYQFALG | | DKCYQFALG | | DLWAYNAELL | | DNSNWSGYSGS | |
| DKDSNGVQD | | DKDSNGVQD | | DLWSYNAELL | | DNSVRIGSKGD | |
| DKEPMGFRY | | DKEPMGFRY | | DLWSYNAGLL | | DNSVRLSASGD | |
| DKESMGFRY | | DKESMGFRY | | DLWTYNAELL | | DNTKWNENQNP | |
| DKESTQKAF | | DKESTQKAF | | DLYDYKEDRF | | DNTWLGGTISP | |
| DKESTQKAI | | DKESTQKAI | | DLYDYKENRF | | DNTWLGRTISP | |
| DKESTQKAV | | DKESTQKAV | | DLYDYKESRF | | DNVKELGNGCF | |
| DKESTQRAF | | DKESTQRAF | | DLYDYKKNRF | | DNVSWTSNSIV | |
| DKGNGCFEI | | DKGNGCFEI | | DLYGTQPLSI | | DNVYKALSIYS | |
| DKGSIQSDK | | DKGSIQSDK | | DLYGTQSLSI | | DNVYKILSIYS | |
| DKHDSNVKN | | DKHDSNVKN | | DLYKVATGRV | | DNVYKVLAIYS | |
| DKHSNGTAK | | DKHSNGTAK | | DLYLNGREWS | | DNVYKVLSIYS | |
| DKHSNGTIK | | DKHSNGTIK | | DLYLSGREWS | | DNVYRALSIYS | |
| DKHSNGTMK | | DKHSNGTMK | | DLYLTGTWDT | | DNWHASNRPWI | |
| DKHSNGTVK | | DKHSNGTVK | | DMADSEMLNL | | DNWHASNRPWV | |
| DKHSNNTVK | | DKHSNNTVK | | DMGDSEMLNL | | DNWHGANRPWV | |
| DKHSNNTVR | | DKHSNNTVR | | DMGNGCFKIY | | DNWHGSNRPWI | |
| DKICIGYHA | | DKICIGYHA | | DMGNGCFRIY | | DNWHGSNRPWL | |
| DKICIGYLS | | DKICIGYLS | | DMGNGCFTIY | | DNWHGSNRPWV | |
| DKICIGYQT | | DKICIGYQT | | DMGNGCLKIY | | DNWKGANRPII | |
| DKICLGHHA | | DKICLGHHA | | DMGQCGLLGT | | DNWKGANRPVI | |
| DKICLGRHA | | DKICLGRHA | | DMHDANVKNL | | DNWKGSNRPII | |
| DKICVGYLS | | DKICVGYLS | | DMHDANVRNL | | DNWKGSNRPIV | |
| DKIDDQIED | | DKIDDQIED | | DMSIGITVIK | | DNWKGSNRPVI | |
| DKIDDQIEE | | DKIDDQIEE | | DMSIGVAVIK | | DNWKGSNRPVV | |
| DKIDDQIEG | | DKIDDQIEG | | DMSIGVTVIK | | DNWKGSNRPWI | |
| DKIDDQIEN | | DKIDDQIEN | | DMSIGVTVIR | | DNWKGSNRPWM | |
| DKIDTLTET | | DKIDTLTET | | DMTDSEMNKL | | DNWKGSNRPWV | |
| DKINDQIED | | DKINDQIED | | DNADKICLGH | | DNWNGMNRPIL | |
| DKITFEATG | | DKITFEATG | | DNAEEYRRLR | | DNWNGMNRPVL | |

Fig. 83-46

| Block size 8 | SIN | Block size 9 | SIN | Block size 10 | SIN | Block size 11 | SIN |
|---|---|---|---|---|---|---|---|
| DKITNKINN | | DKITNKINN | | DNAIDEGDGC | | DNWQGANRPII | |
| DKITNKVNN | | DKITNKVNN | | DNAIRFGEGE | | DNWQGANRPVI | |
| DKLTQGRQT | | DKLTQGRQT | | DNAIRFGESE | | DNWQGSNRPVI | |
| DKLYIWGIH | | DKLYIWGIH | | DNAIRIGEDA | | DNWRGANRPVI | |
| DKLYIWGVH | | DKLYIWGVH | | DNAIRIGEDS | | DNWRGSNRPIV | |
| DKLYVWGIH | | DKLYVWGIH | | DNAIRIGEEA | | DNWRGSNRPWI | |
| DKLYVWGVH | | DKLYVWGVH | | DNAIRIGEGA | | DNWRGSNRPWV | |
| DKMNGNYDS | | DKMNGNYDS | | DNAIRIGENA | | DNWSGYSGSFI | |
| DKMNREFEV | | DKMNREFEV | | DNAIRIGENS | | DNWSGYSGSFS | |
| DKMNREFGV | | DKMNREFGV | | DNAIRLGENK | | DNWTGTNRPIL | |
| DKMNTQFEA | | DKMNTQFEA | | DNAIRPGENK | | DNWTGTNRPVL | |
| DKMNTQFET | | DKMNTQFET | | DNAKDEGNGC | | DNYGVKGFGFR | |
| DKMNTRFEA | | DKMNTRFEA | | DNAKDLGNGC | | DPAAPHGLCYP | |
| DKNALGDCP | | DKNALGDCP | | DNAKEIGNGC | | DPDECRFYALS | |
| DKNALGECP | | DKNALGECP | | DNAKELGNGC | | DPDGCRFYALS | |
| DKNATASFI | | DKNATASFI | | DNAKEMGNGC | | DPDHEGEGIPL | |
| DKNSNGVQD | | DKNSNGVQD | | DNAKETGNGC | | DPDPFRLLQNS | |
| DKPFQNVNK | | DKPFQNVNK | | DNAKEVGNGC | | DPFKLLQNSQI | |
| DKPFQNVNR | | DKPFQNVNR | | DNALRLAENK | | DPFKLLQNSQV | |
| DKPFQNVSR | | DKPFQNVSR | | DNANDLGNGC | | DPFKLLQTSQV | |
| DKQTKTMTI | | DKQTKTMTI | | DNARELGNGC | | DPFRLLQNSQV | |
| DKRIGSCTS | | DKRIGSCTS | | DNATATVYYD | | DPFRLLQSSQV | |
| DKRYGPALS | | DKRYGPALS | | DNATATVYYN | | DPGAPHGLCYP | |
| DKTLDLHDA | | DKTLDLHDA | | DNAVRFGESE | | DPGDTVTFTFN | |
| DKTLDMHDA | | DKTLDMHDA | | DNAVRIGEDA | | DPGIKGFAFLD | |
| DKTLNMHDA | | DKTLNMHDA | | DNAVRIGEDS | | DPGVKGFAFLD | |
| DKTNQQFEL | | DKTNQQFEL | | DNAVRIGENS | | DPGVKGFAFLN | |
| DKTNQQFEM | | DKTNQQFEM | | DNAVRIGESS | | DPHLTGTWDTL | |
| DKTPYRSLI | | DKTPYRSLI | | DNCMERIRNN | | DPKGLFGAIAG | |
| DKTSTQKAI | | DKTSTQKAI | | DNCMESIRDN | | DPKKTGGPIYK | |
| DKVCTKGKK | | DKVCTKGKK | | DNCMESIRNN | | DPKKTGGPIYR | |
| DKVDTIIEN | | DKVDTIIEN | | DNDAYAVIHY | | DPLASLLEMCH | |
| DKVDTLLEN | | DKVDTLLEN | | DNDCESKCFW | | DPLGCKMYALH | |
| DKVDTLTEN | | DKVDTLTEN | | DNDNWSGYSG | | DPLGCKTYALH | |
| DKVDTLTET | | DKVDTLTET | | DNDPSGYAQT | | DPLGCRMYALH | |
| DKVNTIIEN | | DKVNTIIEN | | DNEAVAVLKY | | DPLLSLLEMCH | |
| DKVRLQLKD | | DKVRLQLKD | | DNECMETIKN | | DPNALLKHRFE | |
| DKVRLQLRD | | DKVRLQLRD | | DNEFTEVEQQ | | DPNAPHKLCFP | |
| DKVRMQLKD | | DKVRMQLKD | | DNENATATVY | | DPNAPHKLCYP | |
| DKVRMQLRD | | DKVRMQLRD | | DNEPGSGDWP | | DPNAPNKFCYP | |
| DKVSTQKAI | | DKVSTQKAI | | DNEPGSGNWP | | DPNAPNKLCFP | |
| DKVSTQKAL | | DKVSTQKAL | | DNEPGSGSWP | | DPNAPNKLCYP | |
| DKVWWTSNS | | DKVWWTSNS | | DNEPNGYAQT | | DPNDERGNPGV | |
| DKYHQIEKE | | DKYHQIEKE | | DNEPSGYAQT | | DPNECRFYALS | |
| DLADSEMDK | | DLADSEMDK | | DNEPTGYAQT | | DPNEERGNPGV | |
| DLADSEMKK | | DLADSEMKK | | DNEQTDLYKV | | DPNEERGSPGV | |
| DLADSEMNK | | DLADSEMNK | | DNGAVAVLKY | | DPNHEGEGIPL | |
| DLADSEMSK | | DLADSEMSK | | DNGAVAVVKY | | DPNNEKGNPGV | |
| DLDNCHPIG | | DLDNCHPIG | | DNGDGCFEIL | | DPNNERGNPGV | |
| DLDYQIGYI | | DLDYQIGYI | | DNGGLIAPSR | | DPNNIDRAVKL | |
| DLDYQIGYV | | DLDYQIGYV | | DNGIRIGSKG | | DPNNMARAVKL | |
| DLEALMEWI | | DLEALMEWI | | DNGIRIGSRG | | DPNNMDKAVKL | |
| DLEALMEWL | | DLEALMEWL | | DNGIRVGSRG | | DPNNMDRAVKL | |
| DLEKYVEDT | | DLEKYVEDT | | DNGVRIGSKG | | DPNTLLKHRFE | |
| DLENYVEDT | | DLENYVEDT | | DNGVWIGRTK | | DPNVLLKHRFE | |
| DLERYVEDT | | DLERYVEDT | | DNGWVSTDKD | | DPNWSGYSGSF | |
| DLGAPLELR | | DLGAPLELR | | DNHSMSDIEA | | DPPYSHGTGTG | |
| DLGKCGLLG | | DLGKCGLLG | | DNHVEVVSAK | | DPRMCSLMQGS | |
| DLGNCHPIG | | DLGNCHPIG | | DNIEVTNATE | | DPSAPHGLCYP | |
| DLGNCHPVG | | DLGNCHPVG | | DNIIFSHNGG | | DPSAPHRLCYP | |
| DLGNGCFEF | | DLGNGCFEF | | DNITFSDNGG | | DPSGCKMYALH | |
| DLGPATAQM | | DLGPATAQM | | DNITFSHNGG | | DPSGYAQTDCV | |

Fig. 83-47

| Block size 8 | SIN | Block size 9 | SIN | Block size 10 | SIN | Block size 11 | SIN |
|---|---|---|---|---|---|---|---|
| DLGQCGILG | | DLGQCGILG | | DNIYKILSIY | | DPSHEGEGIPL | |
| DLGQCGLLG | | DLGQCGLLG | | DNKCIESIRN | | DPSIMSCDSPS | |
| DLGRCGLLG | | DLGRCGLLG | | DNKCMETIKN | | DPSNMDRAVKL | |
| DLGSCGILG | | DLGSCGILG | | DNKHSNDTIH | | DPSTISCDSPS | |
| DLGSCHPIG | | DLGSCHPIG | | DNKHSNDTVH | | DPSTMSCDSPS | |
| DLGSPLELR | | DLGSPLELR | | DNKHSNGTIH | | DPSTVSCDSPS | |
| DLGTPLELR | | DLGTPLELR | | DNKNWSGYSG | | DPSVVSCDSPS | |
| DLHDANVKN | | DLHDANVKN | | DNKTKKMTIT | | DPTAPHGLCYP | |
| DLHDANVRN | | DLHDANVRN | | DNLEPGTFDI | | DPTGCKMYALH | |
| DLHDSNVKN | | DLHDSNVKN | | DNLEPGTFDL | | DPVKLSGGYKD | |
| DLHDSNVRN | | DLHDSNVRN | | DNLIGKTSWS | | DPVKLSSGYKD | |
| DLHDSNVRS | | DLHDSNVRS | | DNLNWSGYSG | | DPWVLLNASWF | |
| DLHLEFKAD | | DLHLEFKAD | | DNLQAYQKRM | | DPYLNGREWSY | |
| DLHLTGIWD | | DLHLTGIWD | | DNMQNKLNNV | | DPYPGNNBNGV | |
| DLHLTGMWD | | DLHLTGMWD | | DNMQNRLNNV | | DPYPGNNNKGV | |
| DLHLTGTWD | | DLHLTGTWD | | DNNCESKCFW | | DPYPGNNNNGV | |
| DLIENLQAY | | DLIENLQAY | | DNNCIESIRN | | DPYPGSNNNGV | |
| DLIETNHTG | | DLIETNHTG | | DNNGELRHLF | | DQAWSYIVERP | |
| DLIETTHTG | | DLIETTHTG | | DNNIRIGSKG | | DQCMESIRNNT | |
| DLIFLARSA | | DLIFLARSA | | DNNKNATNPL | | DQDWSYIVERP | |
| DLIFMARSA | | DLIFMARSA | | DNNNRSGYSG | | DQELGDAPFLD | |
| DLIFSARSA | | DLIFSARSA | | DNNNWFGYFG | | DQGAGYAADKE | |
| DLIGKNSWS | | DLIGKNSWS | | DNNNWSGYSG | | DQGNGCFEIFH | |
| DLIGKTSWS | | DLIGKTSWS | | DNNSWSGYSG | | DQGSGYAADKA | |
| DLIIERKEG | | DLIIERKEG | | DNPIRLSGGG | | DQGSGYAADKE | |
| DLIIERRDG | | DLIIERRDG | | DNPITGSPGA | | DQGTGQAADYK | |
| DLIIERREG | | DLIIERREG | | DNPNWSGYSG | | DQGWSYIVERP | |
| DLIIERRNS | | DLIIERRNS | | DNQCMESIRN | | DQICIGHHANN | |
| DLILFNTIG | | DLILFNTIG | | DNQNWSGYSG | | DQICIGYHANN | |
| DLINGALGS | | DLINGALGS | | DNQTKKMTIT | | DQICIGYHSNN | |
| DLIVERQDG | | DLIVERQDG | | DNQTKTMTIT | | DQICVGYHANN | |
| DLIVERQEG | | DLIVERQEG | | DNQVFPQLNQ | | DQICVGYHSNN | |
| DLIVFNTIG | | DLIVFNTIG | | DNRSGYSGIF | | DQIEDLWAYNA | |
| DLKSTQAAI | | DLKSTQAAI | | DNSCESKCFW | | DQIEELWAYNA | |
| DLKSTQAAV | | DLKSTQAAV | | DNSCIESIRN | | DQIEGLWAYNA | |
| DLKSTQTAI | | DLKSTQTAI | | DNSIQLSAGG | | DQIENLWAYNA | |
| DLLDNLQAY | | DLLDNLQAY | | DNSIRIGSKG | | DQIEVTNATEL | |
| DLLENLQAY | | DLLENLQAY | | DNSIRIGSRG | | DQIIDIWAYNA | |
| DLLENLQTY | | DLLENLQTY | | DNSIRLAAGG | | DQINGKLNRLI | |
| DLLVAMENQ | | DLLVAMENQ | | DNSIRLSADG | | DQIQDIWAYNA | |
| DLNFVNRAN | | DLNFVNRAN | | DNSIRLSAGG | | DQIQDLWAYNA | |
| DLNMGQPFY | | DLNMGQPFY | | DNSIRLSASG | | DQIQDVWAYNA | |
| DLPFTQEQK | | DLPFTQEQK | | DNSNWSGYSG | | DQIQNIWAYNA | |
| DLRSGYEML | | DLRSGYEML | | DNSVRIGSKG | | DQISGKLNRLI | |
| DLRSGYETF | | DLRSGYETF | | DNSVRLSAGG | | DQISIVPNIGS | |
| DLSFQGRGV | | DLSFQGRGV | | DNTCIESIRN | | DQITDIWAYNA | |
| DLSQCGLLG | | DLSQCGLLG | | DNTKWNENQN | | DQITGKLNHLI | |
| DLTDAEMNK | | DLTDAEMNK | | DNTWLGGTIS | | DQITGKLNRLI | |
| DLTDSEMNK | | DLTDSEMNK | | DNTWLGRTIS | | DQITRKLNRLI | |
| DLTDSEMSK | | DLTDSEMSK | | DNVKELGNGC | | DQITTKINNII | |
| DLTFLARSA | | DLTFLARSA | | DNVSWTSNSI | | DQKSLRGRGST | |
| DLTNSEMNK | | DLTNSEMNK | | DNVYKALSIY | | DQKSTQEAIDK | |
| DLVETNHTG | | DLVETNHTG | | DNVYKILSIY | | DQKSTQEAIEK | |
| DLVETSHTG | | DLVETSHTG | | DNVYKVLAIY | | DQKSTQEAIGK | |
| DLWAYNAEL | | DLWAYNAEL | | DNVYKVLSIY | | DQKSTQEAINK | |
| DLWMGRTIS | | DLWMGRTIS | | DNVYRALSIY | | DQLKLATGLRN | |
| DLWMGTTIS | | DLWMGTTIS | | DNWHASNRPW | | DQSLIIAARNI | |
| DLWSYNAEL | | DLWSYNAEL | | DNWHGSNRPW | | DQSLIIAARSI | |
| DLWSYNAGL | | DLWSYNAGL | | DNWKGANRPI | | DQSLVIAARNI | |
| DLWTYNAEL | | DLWTYNAEL | | DNWKGANRPV | | DQSWSYIVERP | |
| DLYDYKEDR | | DLYDYKEDR | | DNWKGCNRPV | | DQVEVTNATEL | |
| DLYDYKENR | | DLYDYKENR | | DNWKGSNRPD | | DQVKLSSGYKD | |

Fig. 83-48

| Block size 8 | SIN | Block size 9 | SIN | Block size 10 | SIN | Block size 11 | SIN |
|---|---|---|---|---|---|---|---|
| DLYDYKESR | | DLYDYKESR | | DNWKGSNRPI | | DQVNGKLNRLI | |
| DLYDYKKNR | | DLYDYKKNR | | DNWKGSNRPV | | DQVREGRNPGN | |
| DLYGTQPLS | | DLYGTQPLS | | DNWKGSNRPW | | DQVRESRNPGN | |
| DLYGTQSLS | | DLYGTQSLS | | DNWKSSNRPV | | DQVTDIWAYNA | |
| DLYKVATGR | | DLYKVATGR | | DNWMGSNRPV | | DQVTGKLNRLI | |
| DLYLNGREW | | DLYLNGREW | | DNWNGMNRPI | | DRAAFRGLIST | |
| DLYLSGREW | | DLYLSGREW | | DNWNGMNRPV | | DRAPYRSLIRF | |
| DLYLTGTWD | | DLYLTGTWD | | DNWQGANRPI | | DRATFLRSNAP | |
| DMADSEMLN | | DMADSEMLN | | DNWQGANRPV | | DRAVKLYKKLK | |
| DMADSTMLN | | DMADSTMLN | | DNWQGSNRPV | | DRAVKLYRKLK | |
| DMGDSEMLN | | DMGDSEMLN | | DNWRGANRPV | | DRCYQFALGQG | |
| DMGNGCFKI | | DMGNGCFKI | | DNWRGSNRPI | | DRDSTQKAIDI | |
| DMGNGCFRI | | DMGNGCFRI | | DNWRGSNRPV | | DRDSTQKAIDN | |
| DMGNGCFTI | | DMGNGCFTI | | DNWRGSNRPW | | DRDSTQMAIDN | |
| DMGNGCLKI | | DMGNGCLKI | | DNWSGYSGSF | | DRDSTQRAIDN | |
| DMGQCGLLG | | DMGQCGLLG | | DNWTGTNRPI | | DRFLRVKDQQG | |
| DMHDANVKN | | DMHDANVKN | | DNWTGTNRPV | | DRFLRVRDQLG | |
| DMHDANVRN | | DMHDANVRN | | DNYGVKGFGF | | DRFLRVRDQMG | |
| DMSIGITVI | | DMSIGITVI | | DPAAPHGLCY | | DRFLRVRDQQG | |
| DMSIGVAVI | | DMSIGVAVI | | DPDECRFYAL | | DRFLRVRDQRG | |
| DMSIGVTVI | | DMSIGVTVI | | DPDGCRFYAL | | DRFYRICKLVG | |
| DMTDSEMNK | | DMTDSEMNK | | DPDHEGEGIP | | DRFYRTCKLLG | |
| DNADKICLG | | DNADKICLG | | DPDPFRLLQN | | DRFYRTCKLVG | |
| DNAIDEGDG | | DNAIDEGDG | | DPFKLLQNSQ | | DRGLFGAIAGF | |
| DNAIRFGEG | | DNAIRFGEG | | DPFKLLQTSQ | | DRGLFGAKAGF | |
| DNAIRFGES | | DNAIRFGES | | DPFRLLQNSQ | | DRGNGCFEIFH | |
| DNAIRIGED | | DNAIRIGED | | DPFRLLQSSQ | | DRGSTQKAIDN | |
| DNAIRIGEE | | DNAIRIGEE | | DPGAPHGLCY | | DRHSNGTVKDR | |
| DNAIRIGEN | | DNAIRIGEN | | DPGDTVTFTF | | DRHSNNTVKDR | |
| DNAIRLGEN | | DNAIRLGEN | | DPGVKGFAFL | | DRICIGYHANN | |
| DNAIRLGET | | DNAIRLGET | | DPHLTGTWDT | | DRICIGYLSTN | |
| DNAIRPGEN | | DNAIRPGEN | | DPICIGYHAN | | DRICIGYQSNN | |
| DNAKDEGNG | | DNAKDEGNG | | DPKGLFGAIA | | DRICLGHHAVA | |
| DNAKDLGNG | | DNAKDLGNG | | DPKKTGGPIY | | DRICVGYHANN | |
| DNAKEIGNG | | DNAKEIGNG | | DPLASLLEMC | | DRICVGYLSTN | |
| DNAKELGNG | | DNAKELGNG | | DPLGCKMYAL | | DRIDDAVTDIW | |
| DNAKEMGNG | | DNAKEMGNG | | DPLGCKTYAL | | DRIDDAVTDVW | |
| DNAKETGNG | | DNAKETGNG | | DPLGCRMYAL | | DRIEVTNATEL | |
| DNAKEVGNG | | DNAKEVGNG | | DPLLSLLEMC | | DRIPHRTLLMN | |
| DNALRLAEN | | DNALRLAEN | | DPNALLKHRF | | DRIPHRTLLMS | |
| DNANDLGNG | | DNANDLGNG | | DPNAPHKLCF | | DRIQDIWAYNA | |
| DNARELGNG | | DNARELGNG | | DPNAPHKLCY | | DRISHRTLLMN | |
| DNASAVVWY | | DNASAVVWY | | DPNAPNKFCY | | DRITTKINNII | |
| DNATATVYY | | DNATATVYY | | DPNAPNKLCF | | DRLQDTTWDVF | |
| DNAVRFGES | | DNAVRFGES | | DPNAPNKLCY | | DRLRRDQKSLR | |
| DNAVRIGED | | DNAVRIGED | | DPNDERGNPG | | DRLTQGRQTYD | |
| DNAVRIGEN | | DNAVRIGEN | | DPNECRFYAL | | DRLVLAIGLRN | |
| DNAVRIGES | | DNAVRIGES | | DPNEERGNPG | | DRLVLATGLRN | |
| DNAVRLGEN | | DNAVRLGEN | | DPNEERGSPG | | DRNAIGDCPKY | |
| DNCMERIRN | | DNCMERIRN | | DPNHEGEGIP | | DRNALGDCPKY | |
| DNCMESIRD | | DNCMESIRD | | DPNNEKGNPG | | DRNFWRGDNGR | |
| DNCMESIRN | | DNCMESIRN | | DPNNERGNPG | | DRNFWRGENGR | |
| DNDAYAVIH | | DNDAYAVIH | | DPNNMARAVK | | DRPKVNGQAGR | |
| DNDCESKCF | | DNDCESKCF | | DPNNMDKAVK | | DRRLTTTIKTW | |
| DNDNWSGYS | | DNDNWSGYS | | DPNNMDRAVK | | DRSFRPNIGPR | |
| DNDPSGYAQ | | DNDPSGYAQ | | DPNTLLKHRF | | DRSPFRALISW | |
| DNEAVAVLK | | DNEAVAVLK | | DPNVLLKHRF | | DRSPFRALVSW | |
| DNECMETIK | | DNECMETIK | | DPNWSGYSGS | | DRSPFRTLMSC | |
| DNEFTEVEQ | | DNEFTEVEQ | | DPPYSHGTGT | | DRSPFRTLMSV | |
| DNENATATV | | DNENATATV | | DPRMCSLMQG | | DRSPHRALMSC | |
| DNEPGSGKL | | DNEPGSGKL | | DPSAPHGLCY | | DRSPHRSLMSC | |
| DNEPGSGNW | | DNEPGSGNW | | DPSAPHRLCY | | DRSPHRTLLMN | |

Fig. 83-49

| Block size 8 | SIN | Block size 9 | SIN | Block size 10 | SIN | Block size 11 | SIN |
|---|---|---|---|---|---|---|---|
| DNEPNGYAQ | | DNEPNGYAQ | | DPSGCKMYAL | | DRSPHRTLMSC | |
| DNEPSGYAQ | | DNEPSGYAQ | | DPSGYAQTDC | | DRSPQRTLMSC | |
| DNEPTGYAQ | | DNEPTGYAQ | | DPSHEGEGIP | | DRSPYRALISW | |
| DNEQTDLYK | | DNEQTDLYK | | DPSIMSCDSP | | DRSPYRALMSC | |
| DNGAVAVLK | | DNGAVAVLK | | DPSNMDRAVK | | DRSPYRALMSV | |
| DNGAVAVVK | | DNGAVAVVK | | DPSTISCDSP | | DRSPYRTLMSC | |
| DNGDGCFEI | | DNGDGCFEI | | DPSTMSCDSP | | DRSPYRTLMSV | |
| DNGGLIAPS | | DNGGLIAPS | | DPSTVSCDSP | | DRSQFRALISW | |
| DNGIRIGSK | | DNGIRIGSK | | DPSVVSCDSP | | DRSQYRALISW | |
| DNGIRIGSR | | DNGIRIGSR | | DPTAPHGLCY | | DRSQYRALVSW | |
| DNGIRVGSR | | DNGIRVGSR | | DPTGCKMYAL | | DRSQYRSLISW | |
| DNGVRIGSK | | DNGVRIGSK | | DPVELSSGYK | | DRTAFRGLIST | |
| DNGVWIGRT | | DNGVWIGRT | | DPVKLSGGYK | | DRTAFRGLMST | |
| DNHSMSDIE | | DNHSMSDIE | | DPVKLSNGYK | | DRTLDLHDANV | |
| DNHVEVVSA | | DNHVEVVSA | | DPVKLSSGYK | | DRTNHQFELID | |
| DNIEVTNAT | | DNIEVTNAT | | DPWVLLNASW | | DRTPHRTLLMN | |
| DNIIFSHNG | | DNIIFSHNG | | DPYLNGREWS | | DRTPYRSLIKF | |
| DNITFLHNG | | DNITFLHNG | | DPYPGNNNGV | | DRTPYRSLIQF | |
| DNITFSDNG | | DNITFSDNG | | DPYPGNNNKG | | DRTPYRSLIRF | |
| DNITFSHNG | | DNITFSHNG | | DPYPGNNNNG | | DRTSHRTLLMN | |
| DNIYKILSI | | DNIYKILSI | | DPYPGNSNNG | | DRTSYRSLIRF | |
| DNKCIESIR | | DNKCIESIR | | DQAWSYIVER | | DRTTFRGLIST | |
| DNKCMETIK | | DNKCMETIK | | DQCMESIRNN | | DRTTFRGLLST | |
| DNKHSNDTI | | DNKHSNDTI | | DQDWSYIVER | | DRVDDAVTDIW | |
| DNKHSNDTV | | DNKHSNDTV | | DQELGDAPFL | | DRVDDAVTDVW | |
| DNKHSNGTI | | DNKHSNGTI | | DQGAGYAADK | | DRVRKQLRQNA | |
| DNKNWSGYS | | DNKNWSGYS | | DQGNGCFEIF | | DRVRLQLRDNA | |
| DNKTKKMTI | | DNKTKKMTI | | DQGSGYAADK | | DRVWWTSNSIV | |
| DNLEPGTFD | | DNLEPGTFD | | DQGWSYIVER | | DSCMDTIRNGT | |
| DNLIGKTSW | | DNLIGKTSW | | DQICIGHHAN | | DSCMEAIRNGT | |
| DNLNWSGYS | | DNLNWSGYS | | DQICIGYHAN | | DSCMESIRNNT | |
| DNLQAYQKR | | DNLQAYQKR | | DQICIGYHSN | | DSCMETIRNGT | |
| DNMQNKLNN | | DNMQNKLNN | | DQICVGYHAN | | DSDILVTREPY | |
| DNMQNRLNN | | DNMQNRLNN | | DQICVGYHSN | | DSDVLVTREPY | |
| DNNCESKCF | | DNNCESKCF | | DQIEDLWAYN | | DSDVLVTRESY | |
| DNNCIESIR | | DNNCIESIR | | DQIEELWAYN | | DSECVSHNGTW | |
| DNNCMESIR | | DNNCMESIR | | DQIEGLWAYN | | DSEMDKLFERV | |
| DNNGELRHL | | DNNGELRHL | | DQIENLWAYN | | DSEMDKLYERV | |
| DNNIRIGSK | | DNNIRIGSK | | DQIEVTNATE | | DSEMDKLYTRV | |
| DNNKNATNP | | DNNKNATNP | | DQIIDIWAYN | | DSEMKKLYERV | |
| DNNNRSGYS | | DNNNRSGYS | | DQINGKLNRL | | DSEMLNLYDRV | |
| DNNNWFGYF | | DNNNWFGYF | | DQIQDIWAYN | | DSEMLNLYEGV | |
| DNNNWSGYS | | DNNNWSGYS | | DQIQDLWAYN | | DSEMLNLYERV | |
| DNNSWSGYS | | DNNSWSGYS | | DQIQDVWAYN | | DSEMNKLFEKT | |
| DNPITGSPG | | DNPITGSPG | | DQIQNIWAYN | | DSEMNKLFERI | |
| DNPNWSGYS | | DNPNWSGYS | | DQISIVPNIG | | DSEMNKLFERT | |
| DNPRPNDPA | | DNPRPNDPA | | DQITDIWAYN | | DSEMNKLFERV | |
| DNPRPNDPN | | DNPRPNDPN | | DQITGKLNHL | | DSEMNKLHERV | |
| DNPRPNDPS | | DNPRPNDPS | | DQITGKLNRL | | DSEMNKLYEKV | |
| DNPRPNDPT | | DNPRPNDPT | | DQITRKLNRL | | DSEMNKLYERV | |
| DNPRPNDPV | | DNPRPNDPV | | DQITTKINNI | | DSEMNRLFERV | |
| DNQCMESIR | | DNQCMESIR | | DQKSLRGRGS | | DSEMSKLFEKT | |
| DNQNWSGYS | | DNQNWSGYS | | DQKSTQEAID | | DSEMSKLFERT | |
| DNQTKKMTI | | DNQTKKMTI | | DQKSTQEAIE | | DSEMSKLFERV | |
| DNQTKTMTI | | DNQTKTMTI | | DQKSTQEAIG | | DSEMSKLYERV | |
| DNQVFPQLN | | DNQVFPQLN | | DQKSTQEAIN | | DSEMSKLYGRV | |
| DNRSGYSGI | | DNRSGYSGI | | DQLKLATGLR | | DSFRQSERGED | |
| DNSCESKCF | | DNSCESKCF | | DQSLIIAARN | | DSFRQSERGEE | |
| DNSCIESIR | | DNSCIESIR | | DQSLIIAARS | | DSFYAELKWLV | |
| DNSIQLSAG | | DNSIQLSAG | | DQSLVIAARN | | DSFYRSMKWLT | |
| DNSIRIGSK | | DNSIRIGSK | | DQSWSYIVER | | DSGYVCSGLVG | |
| DNSIRIGSR | | DNSIRIGSR | | DQVEVTNATE | | DSHLKFKADLI | |

Fig. 83-50

| Block size 8 | SIN | Block size 9 | SIN | Block size 10 | SIN | Block size 11 | SIN |
|---|---|---|---|---|---|---|---|
| DNSIRLAAG | | DNSIRLAAG | | DQVKLSSGYK | | DSIGSWSHNIL | |
| DNSIRLSAD | | DNSIRLSAD | | DQVNGKLNRL | | DSIGSWSQNIL | |
| DNSIRLSAG | | DNSIRLSAG | | DQVREGRNPG | | DSIIFNSIGNL | |
| DNSIRLSAS | | DNSIRLSAS | | DQVRESRNPG | | DSIKSWRKDIL | |
| DNSNWSGYS | | DNSNWSGYS | | DQVTDIWAYN | | DSIKSWRRDIL | |
| DNSVRIGSK | | DNSVRIGSK | | DQVTGKLNRL | | DSIRGEFNQVE | |
| DNSVRLSAG | | DNSVRLSAG | | DRAAFRGLIS | | DSIRGEFSQVE | |
| DNSVRLSAS | | DNSVRLSAS | | DRAPYRSLIR | | DSITDIWTYQA | |
| DNTCIESIR | | DNTCIESIR | | DRATFLRSNA | | DSITEVWSYNA | |
| DNTKWNENQ | | DNTKWNENQ | | DRAVKLYKKL | | DSITYIWTYQA | |
| DNTWLGGTI | | DNTWLGGTI | | DRAVKLYRKL | | DSIVSWSQNIL | |
| DNTWLGRTI | | DNTWLGRTI | | DRCYQFALGQ | | DSLNITAASLN | |
| DNVKELGNG | | DNVKELGNG | | DRDSTQKAID | | DSLTEIWSYNA | |
| DNVSWTSNS | | DNVSWTSNS | | DRDSTQMAID | | DSMTEIWSYNA | |
| DNVYKALSI | | DNVYKALSI | | DRDSTQRAID | | DSMTEVWSYNA | |
| DNVYKILSI | | DNVYKILSI | | DRFLRVKDQQ | | DSNALLKHRFE | |
| DNVYKVLAI | | DNVYKVLAI | | DRFLRVRDQL | | DSNGNFIAPEY | |
| DNVYKVLSI | | DNVYKVLSI | | DRFLRVRDQM | | DSNGVQDIIDN | |
| DNVYRALSI | | DNVYRALSI | | DRFLRVRDQQ | | DSNVENLFDEV | |
| DNWHASNRP | | DNWHASNRP | | DRFLRVRDQR | | DSNVKNLFDEV | |
| DNWHGSNRP | | DNWHGSNRP | | DRFYRICKLV | | DSNVKNLYDKV | |
| DNWKGANRP | | DNWKGANRP | | DRFYRTCKLL | | DSNVKNLYDRV | |
| DNWKGSNRP | | DNWKGSNRP | | DRFYRTCKLV | | DSNVKNLYEKV | |
| DNWMGSNRP | | DNWMGSNRP | | DRGLFGAIAG | | DSNVKNLYNKV | |
| DNWNGMNRP | | DNWNGMNRP | | DRGLFGAKAG | | DSNVRNLYDKV | |
| DNWQGANRP | | DNWQGANRP | | DRGNGCFEIF | | DSNYVCSGLVG | |
| DNWQGSNRP | | DNWQGSNRP | | DRGSTQKAID | | DSQTATKRIRM | |
| DNWRGANRP | | DNWRGANRP | | DRHSNGTVKD | | DSQTATKRLRM | |
| DNWRGSNRP | | DNWRGSNRP | | DRHSNNTVKD | | DSRAVGKCPRY | |
| DNWSGYSGS | | DNWSGYSGS | | DRICIGYHAN | | DSRSGYEILKV | |
| DNWTGTNRP | | DNWTGTNRP | | DRICIGYLST | | DSRSGYEMLKV | |
| DNYGVKGFG | | DNYGVKGFG | | DRICIGYQSN | | DSRSGYETFKV | |
| DPAAPHGLC | | DPAAPHGLC | | DRICLGHHAV | | DSRSGYETFRI | |
| DPDECRFYA | | DPDECRFYA | | DRICVGYHAN | | DSRSGYETFRV | |
| DPDGCRFYA | | DPDGCRFYA | | DRICVGYLST | | DSRSGYEVLKV | |
| DPDHEGEGI | | DPDHEGEGI | | DRIDDAVTDI | | DSSFYAEMKWL | |
| DPDPFRLLQ | | DPDPFRLLQ | | DRIDDAVTDV | | DSSILTDSQTA | |
| DPDYQIGYV | | DPDYQIGYV | | DRIEVTNATE | | DSSYICSGLVG | |
| DPFKLLQNS | | DPFKLLQNS | | DRIPHRTLLM | | DSSYVCSGLVG | |
| DPFKLLQTS | | DPFKLLQTS | | DRIQDIWAYN | | DSTAVAVIKYN | |
| DPFRLLQNS | | DPFRLLQNS | | DRIRRDQKSL | | DSTDSEMNKLY | |
| DPFRLLQSS | | DPFRLLQSS | | DRISHRTLLM | | DSTQKAIDIMQ | |
| DPGAPHGLC | | DPGAPHGLC | | DRITTKINNI | | DSTQKAIDNMQ | |
| DPGDTVTFT | | DPGDTVTFT | | DRLQDTTWDV | | DSTQMAIDNMQ | |
| DPGVKGFAF | | DPGVKGFAF | | DRLRRDQKAL | | DSTQRAIDNMQ | |
| DPHLTGTWD | | DPHLTGTWD | | DRLRRDQKSL | | DSTWLGRTISP | |
| DPICIGYHA | | DPICIGYHA | | DRLRRDQRAL | | DSVGSWSQNIL | |
| DPIGCKMYA | | DPIGCKMYA | | DRLRRDQRSL | | DSVKLSSGYKD | |
| DPKGLFGAI | | DPKGLFGAI | | DRLTQGRQTY | | DSVLVNTYQWI | |
| DPKKTGGPI | | DPKKTGGPI | | DRLVLATGLR | | DSVTELWSYNA | |
| DPLASLLEM | | DPLASLLEM | | DRMIKAVRGD | | DSVYKALSIYS | |
| DPLGCKMYA | | DPLGCKMYA | | DRNAFRGLIS | | DSWAVGRCPRY | |
| DPLGCRMYA | | DPLGCRMYA | | DRNAIGDCPK | | DTCYPFDVPDY | |
| DPLLSLLEM | | DPLLSLLEM | | DRNALGDCPK | | DTDVVNFLSME | |
| DPNALLKHR | | DPNALLKHR | | DRNATASFIY | | DTDVVNFVSME | |
| DPNAPHKLC | | DPNAPHKLC | | DRNATASLIY | | DTDVVNYVSME | |
| DPNAPNKFC | | DPNAPNKFC | | DRNFWRGDNG | | DTDVYCICRDN | |
| DPNAPNKLC | | DPNAPNKLC | | DRNFWRGENG | | DTEISFTITGD | |
| DPNDERGNP | | DPNDERGNP | | DRPKVNGQAG | | DTELSFTITGD | |
| DPNECRFYA | | DPNECRFYA | | DRRLTTTIKT | | DTELSFTVTGD | |
| DPNEERGNP | | DPNEERGNP | | DRRYGPALSI | | DTFKSWKGNIM | |
| DPNEERGSP | | DPNEERGSP | | DRSFRPNIGP | | DTGDGCFEILH | |

Fig. 83-51

| Block size 8 | SIN | Block size 9 | SIN | Block size 10 | SIN | Block size 11 | SIN |
|---|---|---|---|---|---|---|---|
| DPNHEGEGI | | DPNHEGEGI | | DRSPFRALIS | | DTGKGCFDILH | |
| DPNNEKGNP | | DPNNEKGNP | | DRSPFRALMS | | DTGNGCFDILH | |
| DPNNERGNP | | DPNNERGNP | | DRSPFRALVS | | DTICIGYHANN | |
| DPNNMDKAV | | DPNNMDKAV | | DRSPFRTLMS | | DTICVGYHANN | |
| DPNNMDRAV | | DPNNMDRAV | | DRSPHRALMS | | DTIIEKNVTVT | |
| DPNTLLKHR | | DPNTLLKHR | | DRSPHRTLLM | | DTIIENNVTVT | |
| DPNVLLKHR | | DPNVLLKHR | | DRSPHRTLMS | | DTIIESNVTVT | |
| DPNWSGYSG | | DPNWSGYSG | | DRSPQRTLMS | | DTIIFEANGNL | |
| DPPYSHGTG | | DPPYSHGTG | | DRSPYRALIS | | DTIIFEASGNL | |
| DPRMCSLMQ | | DPRMCSLMQ | | DRSPYRALMS | | DTIIFEATGNL | |
| DPSAPHGLC | | DPSAPHGLC | | DRSPYRTLLM | | DTILEKNITVT | |
| DPSAPHRLC | | DPSAPHRLC | | DRSPYRTLMS | | DTILEKNVTVT | |
| DPSGCKMYA | | DPSGCKMYA | | DRSQFRALIS | | DTILEQNVTVT | |
| DPSGYAQTD | | DPSGYAQTD | | DRSQYRALIS | | DTILERNVTVT | |
| DPSHEGEGI | | DPSHEGEGI | | DRSQYRALVS | | DTIMEKNITVT | |
| DPSIMSCDS | | DPSIMSCDS | | DRSQYRSLIS | | DTIMEKNVTVT | |
| DPSNMDRAV | | DPSNMDRAV | | DRTAFRGLIS | | DTIMERNVTVT | |
| DPSTISCDS | | DPSTISCDS | | DRTAFRGLMS | | DTINFESTGNL | |
| DPSTMSCDS | | DPSTMSCDS | | DRTLDLHDAN | | DTINYYNETFV | |
| DPSTVSCDS | | DPSTVSCDS | | DRTNHQFELI | | DTIREKNVTVT | |
| DPSVVSCDS | | DPSVVSCDS | | DRTPHRTLLM | | DTISFESTGNL | |
| DPTAPHGLC | | DPTAPHGLC | | DRTPYRSLIK | | DTITFEATGNL | |
| DPTGCKMYA | | DPTGCKMYA | | DRTPYRSLIQ | | DTITFSFNGAF | |
| DPVELSSGY | | DPVELSSGY | | DRTPYRSLIR | | DTKCQTPLGAI | |
| DPVKLSGGY | | DPVKLSGGY | | DRTPYRTLLM | | DTKIDLWSYNA | |
| DPVKLSNGY | | DPVKLSNGY | | DRTSHRTLLM | | DTKILFIEEGK | |
| DPVKLSSGY | | DPVKLSSGY | | DRTSYRSLIR | | DTKVDLWSYNA | |
| DPWVLLNAS | | DPWVLLNAS | | DRTSYRTLLM | | DTLCICYHANN | |
| DPYLNGREW | | DPYLNGREW | | DRTTFRGLIS | | DTLCIGYHANN | |
| DPYPGNNBN | | DPYPGNNBN | | DRTTFRGLLS | | DTLKSWKGNIM | |
| DPYPGNNNG | | DPYPGNNNG | | DRVDDAVTDI | | DTLLEKNVTVT | |
| DPYPGNNNN | | DPYPGNNNN | | DRVDDAVTDV | | DTLLENDVPVT | |
| DPYPGSNNN | | DPYPGSNNN | | DRVRKQLRQN | | DTLLENGVPVT | |
| DQADSEMNK | | DQADSEMNK | | DRVRLQLRDN | | DTLLENNVPVT | |
| DQAWSYIVE | | DQAWSYIVE | | DRVRMQLRDN | | DTLLESDVPVT | |
| DQCMESIRN | | DQCMESIRN | | DRVWWTSNSI | | DTLTEKGIEVV | |
| DQDWSYIVE | | DQDWSYIVE | | DSCMDTIRNG | | DTLTENGVPVT | |
| DQELGDAPF | | DQELGDAPF | | DSCMEAIRNG | | DTLTETGVPVT | |
| DQGAGYAAD | | DQGAGYAAD | | DSCMESIRNN | | DTNKTFQNIDK | |
| DQGNGCFEI | | DQGNGCFEI | | DSCMETIRNG | | DTNKTFQNIDR | |
| DQGSGYAAD | | DQGSGYAAD | | DSDILVTREP | | DTPRNDDSSSN | |
| DQGTGQAAD | | DQGTGQAAD | | DSDVLVTREP | | DTPRNDDSSSS | |
| DQGWSYIVE | | DQGWSYIVE | | DSECVSHNGT | | DTPRNEDGSSS | |
| DQICIGHHA | | DQICIGHHA | | DSEMDKLFER | | DTPRNEDSSSN | |
| DQICIGYHA | | DQICIGYHA | | DSEMDKLYER | | DTPRNEDSSSS | |
| DQICIGYHS | | DQICIGYHS | | DSEMDKLYTR | | DTRILFIEEGK | |
| DQICVGYHA | | DQICVGYHA | | DSEMKKLYER | | DTRILFIKEGK | |
| DQICVGYHS | | DQICVGYHS | | DSEMLNLYDR | | DTRILFIREGK | |
| DQIEDLWAY | | DQIEDLWAY | | DSEMLNLYEG | | DTRILFVKEGK | |
| DQIEELWAY | | DQIEELWAY | | DSEMLNLYER | | DTRSGYEMLKV | |
| DQIEGLWAY | | DQIEGLWAY | | DSEMNKLFEK | | DTTAVAVLKYN | |
| DQIENLWAY | | DQIENLWAY | | DSEMNKLFER | | DTTCWSWPDGA | |
| DQIEVTNAT | | DQIEVTNAT | | DSEMNKLYEK | | DTTGWPWPDGA | |
| DQIIDIWAY | | DQIIDIWAY | | DSEMNKLYER | | DTTGWSWPDGA | |
| DQINGKLNR | | DQINGKLNR | | DSEMNNLYER | | DTTMEKNVTVT | |
| DQIQDIWAY | | DQIQDIWAY | | DSEMNRLFER | | DTTSWSWPDGA | |
| DQIQDLWAY | | DQIQDLWAY | | DSEMSKLFEK | | DTTWDVFIERP | |
| DQIQDVWAY | | DQIQDVWAY | | DSEMSKLFER | | DTTYQRTRALV | |
| DQIQNIWAY | | DQIQNIWAY | | DSEMSKLYER | | DTVDTLTENGV | |
| DQISGKLNR | | DQISGKLNR | | DSFRQSERGE | | DTVLEKNVTVT | |
| DQISIVPNI | | DQISIVPNI | | DSFYAELKWL | | DTVLERNVTVT | |
| DQITDIWAY | | DQITDIWAY | | DSFYRSMKWL | | DTVNFSFNGAF | |

Fig. 83-52

| Block size 8 | SIN | Block size 9 | SIN | Block size 10 | SIN | Block size 11 | SIN |
|---|---|---|---|---|---|---|---|
| DQITGKLNH | | DQITGKLNH | | DSGAVAVLKY | | DTVNRTHQYSE | |
| DQITGKLNR | | DQITGKLNR | | DSGYVCSGLV | | DTVREKNVTVT | |
| DQITGTLNR | | DQITGTLNR | | DSHHRSHRQM | | DTVTFIFNGAF | |
| DQITTKINN | | DQITTKINN | | DSHLKFKADL | | DTVTFNFNGAF | |
| DQKSLRGRG | | DQKSLRGRG | | DSIGSWSHNI | | DTVTFSFNGAF | |
| DQKSTQEAI | | DQKSTQEAI | | DSIGSWSQNI | | DTVTFTFNGAF | |
| DQLKLATGL | | DQLKLATGL | | DSIIFNSIGN | | DVDQSLIIAAR | |
| DQNFRNIRK | | DQNFRNIRK | | DSIKSWRKDI | | DVDQSLVIAAR | |
| DQSLIIAAR | | DQSLIIAAR | | DSIKSWRRDI | | DVDVYCICRDN | |
| DQSLPPNFP | | DQSLPPNFP | | DSIRGEFNQV | | DVFIERPTAVD | |
| DQSLPPNFS | | DQSLPPNFS | | DSIRGEFSQV | | DVFVIREPFIS | |
| DQSLVIAAR | | DQSLVIAAR | | DSISSWSQNI | | DVGYLCAGIPT | |
| DQSWSYIVE | | DQSWSYIVE | | DSITDIWTYQ | | DVILWFSFGAS | |
| DQVEVTNAT | | DQVEVTNAT | | DSITEVWSYN | | DVILWFSLGAS | |
| DQVKLSSGY | | DQVKLSSGY | | DSITFSHNGG | | DVIMEVVFPNE | |
| DQVREGRNP | | DQVREGRNP | | DSITYIWTYQ | | DVINFESTGNL | |
| DQVRESRNP | | DQVRESRNP | | DSIVSWSQNI | | DVIRSWRKQIL | |
| DQVTDIWAY | | DQVTDIWAY | | DSLEPGTFDL | | DVISFESTGNL | |
| DQVTGKLNR | | DQVTGKLNR | | DSLKLSIEDP | | DVLDGVTASCL | |
| DRAAFRGLI | | DRAAFRGLI | | DSLLGDPHCD | | DVLVIWGIHHP | |
| DRAPYRSLI | | DRAPYRSLI | | DSLNITAASL | | DVLVLWGIHHP | |
| DRATFLRSN | | DRATFLRSN | | DSLTEIWSYN | | DVLVMWGIHHP | |
| DRAVKLYKK | | DRAVKLYKK | | DSMTEIWSYN | | DVLVMWGLHHP | |
| DRAVKLYRK | | DRAVKLYRK | | DSMTEVWSYN | | DVLVTREPYVS | |
| DRDSTQKAI | | DRDSTQKAI | | DSNALLKHRF | | DVPDYQSLRSI | |
| DRDSTQMAI | | DRDSTQMAI | | DSNGNFIAPE | | DVPEWSYIVEK | |
| DRDSTQRAI | | DRDSTQRAI | | DSNGVQDIID | | DVRCVCRDNWK | |
| DRFLRVKDQ | | DRFLRVKDQ | | DSNVENLFDE | | DVSFQGRGVFE | |
| DRFLRVRDQ | | DRFLRVRDQ | | DSNVKNLFDE | | DVSWASNSIVT | |
| DRFYRICKL | | DRFYRICKL | | DSNVKNLHEK | | DVSWTSNSIVT | |
| DRFYRTCKL | | DRFYRTCKL | | DSNVKNLYDK | | DVTDSEMNKLF | |
| DRGLFGAIA | | DRGLFGAIA | | DSNVKNLYDR | | DVVLVMKRKRD | |
| DRGLFGAKA | | DRGLFGAKA | | DSNVKNLYEK | | DVVLVMKRKRN | |
| DRGNGCFEI | | DRGNGCFEI | | DSNVKNLYNK | | DVVNFLSMEFS | |
| DRGSTQKAI | | DRGSTQKAI | | DSNVRNLHEK | | DVVNFVSMEFS | |
| DRHSNGTIK | | DRHSNGTIK | | DSNVRNLHER | | DVVNYVSMEFS | |
| DRHSNGTVK | | DRHSNGTVK | | DSNVRNLYDK | | DVVRSWKKQIL | |
| DRICIGYHA | | DRICIGYHA | | DSNVRSLHEK | | DVVRSWRKKIL | |
| DRICIGYLS | | DRICIGYLS | | DSNYVCSGLV | | DVVRSWRKQIL | |
| DRICIGYQS | | DRICIGYQS | | DSQHKSHRQM | | DVVRSWRRQIL | |
| DRICLGHHA | | DRICLGHHA | | DSQHRSHRQM | | DVWAYNAELLV | |
| DRICVGYHA | | DRICVGYHA | | DSQTATKRIR | | DVWLGRTVSIN | |
| DRICVGYLS | | DRICVGYLS | | DSQTATKRLR | | DVWLGRTVSIS | |
| DRIDDAVTD | | DRIDDAVTD | | DSRAVGKCPR | | DVWLGRTVSNS | |
| DRIEVTNAT | | DRIEVTNAT | | DSRSGYEILK | | DVWLGRTVSTS | |
| DRIPHRTLL | | DRIPHRTLL | | DSRSGYEMLK | | DVWMGRTISKD | |
| DRIQDIWAY | | DRIQDIWAY | | DSRSGYETFK | | DVWMGRTISMD | |
| DRIRRDQKS | | DRIRRDQKS | | DSRSGYETFR | | DVWMGRTISRD | |
| DRISHRTLL | | DRISHRTLL | | DSRSGYEVLK | | DVWSYNAKLLV | |
| DRITTKINN | | DRITTKINN | | DSSFYAEMKW | | DVWTYNAEILV | |
| DRLQDTTWD | | DRLQDTTWD | | DSSILTDSQT | | DVWTYNAELLI | |
| DRLRRDQKA | | DRLRRDQKA | | DSSYICSGLV | | DVWTYNAELLV | |
| DRLRRDQKS | | DRLRRDQKS | | DSSYLCSGLV | | DVWVTREPYVS | |
| DRLRRDQRA | | DRLRRDQRA | | DSSYVCSGLV | | DVYCICRDNWK | |
| DRLRRDQRS | | DRLRRDQRS | | DSTAVAVIKY | | DVYCVCRDNWK | |
| DRLTQGRQT | | DRLTQGRQT | | DSTDSEMNKL | | DVYKILSIYSC | |
| DRLVLATGL | | DRLVLATGL | | DSTQKAIDIM | | DVYQILAIYST | |
| DRMIKAVRG | | DRMIKAVRG | | DSTQKAIDNM | | DWILWISFAIS | |
| DRNAIGDCP | | DRNAIGDCP | | DSTQMAIDNM | | DWILWISFAMS | |
| DRNALGDCP | | DRNALGDCP | | DSTQRAIDNM | | DWILWISFATS | |
| DRNATASFI | | DRNATASFI | | DSTWLGRTIS | | DWPDGAKIEYF | |
| DRNATASLI | | DRNATASLI | | DSVKLSSGYK | | DWPDGAKIKYF | |

Fig. 83-53

| Block size 8 | SIN | Block size 9 | SIN | Block size 10 | SIN | Block size 11 | SIN |
|---|---|---|---|---|---|---|---|
| DRNFWRGDN | | DRNFWRGDN | | DSVTELWSYN | | DWSGYSGSFID | |
| DRNFWRGEN | | DRNFWRGEN | | DSVYKALSIY | | DWSGYSGSFII | |
| DRPKVNGQA | | DRPKVNGQA | | DSWAVGRCPR | | DWSGYSGSFIQ | |
| DRPLVNGQR | | DRPLVNGQR | | DTCYPFDVPD | | DWSGYSGSFIV | |
| DRRLTTTIK | | DRRLTTTIK | | DTCYPFDVPE | | DWSGYSGSFMD | |
| DRRYGPALS | | DRRYGPALS | | DTCYPFDVPG | | DWSGYSGSFSV | |
| DRSFRPNIG | | DRSFRPNIG | | DTCYPFDVPN | | DWSGYSGSFTV | |
| DRSPFRALI | | DRSPFRALI | | DTDVVNFLSM | | DWSGYSGSFVD | |
| DRSPFRALM | | DRSPFRALM | | DTDVVNFVSM | | DWSGYSGSFVI | |
| DRSPFRALV | | DRSPFRALV | | DTDVVNYVSM | | DWSGYSGSFVQ | |
| DRSPFRTLM | | DRSPFRTLM | | DTDVYCICRD | | DWSGYSGSFVV | |
| DRSPHRALM | | DRSPHRALM | | DTEISFTITG | | DWSWHDGAILP | |
| DRSPHRTLL | | DRSPHRTLL | | DTELSFTITG | | DWSWHDGAVLP | |
| DRSPHRTLM | | DRSPHRTLM | | DTELSFTVTG | | DWSYIVERPSA | |
| DRSPQRTLM | | DRSPQRTLM | | DTFKSWKGNI | | DWTLNRNQPAA | |
| DRSPYRALI | | DRSPYRALI | | DTGDGCFEIL | | DWVDDAVTDIW | |
| DRSPYRALM | | DRSPYRALM | | DTGKGCFDIL | | DWVLWISFAIS | |
| DRSPYRTLL | | DRSPYRTLL | | DTGNGCFDIL | | DYARLYIWGVH | |
| DRSPYRTLM | | DRSPYRTLM | | DTICIGYHAN | | DYEEEAKLERS | |
| DRSQFRALI | | DRSQFRALI | | DTICVGYHAN | | DYEELKEQLST | |
| DRSQYRALI | | DRSQYRALI | | DTIIENNVTV | | DYEELREQLSS | |
| DRSQYRALV | | DRSQYRALV | | DTIIESNVTV | | DYEELREQLST | |
| DRSQYRSLI | | DRSQYRSLI | | DTIIFEANGN | | DYESTQAAIDQ | |
| DRTAFRGLI | | DRTAFRGLI | | DTIIFEASGN | | DYHDSNVKNLY | |
| DRTAFRGLM | | DRTAFRGLM | | DTIIFEATGN | | DYHYEECSCYP | |
| DRTLDLHDA | | DRTLDLHDA | | DTILEKNITV | | DYILDEESRAR | |
| DRTNHQFEL | | DRTNHQFEL | | DTILEKNVTV | | DYKEESQLKRQ | |
| DRTPHRTLL | | DRTPHRTLL | | DTILEQNVTV | | DYKSTPSAIDQ | |
| DRTPYRSLI | | DRTPYRSLI | | DTILERNVTV | | DYKSTQAAIDQ | |
| DRTPYRTLL | | DRTPYRTLL | | DTIMEKIVTV | | DYKSTQAAVDQ | |
| DRTSHRTLL | | DRTSHRTLL | | DTIMEKNVIF | | DYKSTQKTIDQ | |
| DRTSYRSLI | | DRTSYRSLI | | DTIMEKNVTV | | DYKSTQSAIDQ | |
| DRTSYRTLL | | DRTSYRTLL | | DTIMERNVTV | | DYKSTQSAINQ | |
| DRTTFRGLI | | DRTTFRGLI | | DTINFESTGN | | DYKSTQSAVDQ | |
| DRTTFRGLL | | DRTTFRGLL | | DTINYYNETF | | DYLIGKTSWSY | |
| DRVDDAVTD | | DRVDDAVTD | | DTIRNGTYNH | | DYNNTTGRDVL | |
| DRVRKQLRQ | | DRVRKQLRQ | | DTISFESTGN | | DYPKYEEESKL | |
| DRVRLQLRD | | DRVRLQLRD | | DTITFEATGN | | DYPKYEEESRL | |
| DRVRMQLRD | | DRVRMQLRD | | DTITFSFNGA | | DYPKYEKESKL | |
| DRVWWTSNS | | DRVWWTSNS | | DTKCQTPLGA | | DYQIGYICSGV | |
| DSCMDTIRN | | DSCMDTIRN | | DTKIDLWSYN | | DYQIGYVCSGI | |
| DSCMEAIRN | | DSCMEAIRN | | DTKILFIEEG | | DYQIGYVCSGV | |
| DSCMESIRN | | DSCMESIRN | | DTKVDLWSYN | | DYQSIRSILAN | |
| DSCMETIRN | | DSCMETIRN | | DTLCIGYHAN | | DYQSLRSILAN | |
| DSDILVTRE | | DSDILVTRE | | DTLKSWKGNI | | DYQSLRSILAS | |
| DSDVLVTRE | | DSDVLVTRE | | DTLLEKNVTV | | DYREESQLKKQ | |
| DSECVSHNG | | DSECVSHNG | | DTLLENDVPV | | DYREESQLKRQ | |
| DSEIKKLYE | | DSEIKKLYE | | DTLLENGVPV | | DYRYTYRCHKG | |
| DSEMDKLFE | | DSEMDKLFE | | DTLLENNVPV | | DYRYTYRCHRG | |
| DSEMDKLYE | | DSEMDKLYE | | DTLLESDVPV | | DYSIDSGYVCS | |
| DSEMKKLYE | | DSEMKKLYE | | DTLTEKGIEV | | DYSIDSNYVCS | |
| DSEMLNLYD | | DSEMLNLYD | | DTLTENGVPV | | DYSIDSSYICS | |
| DSEMLNLYE | | DSEMLNLYE | | DTLTETGVPV | | DYSIDSSYVCS | |
| DSEMNKLFE | | DSEMNKLFE | | DTNKTFQNID | | DYSKYEEESKL | |
| DSEMNKLYE | | DSEMNKLYE | | DTPRGEDAQF | | DYTIDEESRAR | |
| DSEMNNLYE | | DSEMNNLYE | | DTPRGEDGQF | | DYTLDEESRAR | |
| DSEMNRLFE | | DSEMNRLFE | | DTPRGEDNQF | | DYTRLYIWGVH | |
| DSEMSKLFE | | DSEMSKLFE | | DTPRGEDSQF | | DYWAEGDCYRA | |
| DSEMSKLYE | | DSEMSKLYE | | DTPRNDDRFS | | DYWAEGECYRA | |
| DSFRQSERG | | DSFRQSERG | | DTPRNDDRSS | | DYWAKEECYRA | |
| DSFYAELKW | | DSFYAELKW | | DTPRNDDSSS | | DYWAKGDCYRA | |
| DSFYRNLIW | | DSFYRNLIW | | DTPRNEDGSS | | DYWAKGECYRA | |

Fig. 83-54

| Block size 8 | SIN | Block size 9 | SIN | Block size 10 | SIN | Block size 11 | SIN |
|---|---|---|---|---|---|---|---|
| DSFYRSMKW | | DSFYRSMKW | | DTPRNEDSSS | | DYYWAILKPGQ | |
| DSGAVAVLK | | DSGAVAVLK | | DTPRNGDSSS | | DYYWAVLKPGQ | |
| DSGYVCSGL | | DSGYVCSGL | | DTPRSDDSSS | | DYYWGILKRGE | |
| DSHHRSHRQ | | DSHHRSHRQ | | DTRILFIEEG | | EAESSIKEKDM | |
| DSHLKFKAD | | DSHLKFKAD | | DTRILFIKEG | | EAESSVKEKDL | |
| DSIGSWSHN | | DSIGSWSHN | | DTRILFIREG | | EAESSVKEKDM | |
| DSIGSWSQN | | DSIGSWSQN | | DTRILFVKEG | | EAESSVREKDM | |
| DSIIFNSIG | | DSIIFNSIG | | DTRSGYEMLK | | EAHILVTREPY | |
| DSIKSWRKD | | DSIKSWRKD | | DTTAVAVLKY | | EAIDKITNKIN | |
| DSIKSWRRD | | DSIKSWRRD | | DTTCWSWPDG | | EAIDKITNKVN | |
| DSIRGEFNQ | | DSIRGEFNQ | | DTTGWPWPDG | | EAIEECLINDP | |
| DSIRGEFSQ | | DSIRGEFSQ | | DTTGWSWPDG | | EAIEKITNKVN | |
| DSITDIWTY | | DSITDIWTY | | DTTMEKNVTV | | EAIGKITNKVN | |
| DSITEVWSY | | DSITEVWSY | | DTTSWSWPDG | | EAINKITNKVN | |
| DSITFSHNG | | DSITFSHNG | | DTTWDVFIER | | EAINNRFQIQG | |
| DSIVSWSQN | | DSIVSWSQN | | DTTYQRTRAL | | EAINNRIKINP | |
| DSLEPGTFD | | DSLEPGTFD | | DTVDTILEKN | | EAINSRFQIQG | |
| DSLKLSIED | | DSLKLSIED | | DTVDTLLEKN | | EAIRNGTYNHE | |
| DSLNITAAS | | DSLNITAAS | | DTVDTLTENG | | EAISNRFQIQG | |
| DSLTEIWSY | | DSLTEIWSY | | DTVDTVLEKN | | EAKLEKSRING | |
| DSMTEIWSY | | DSMTEIWSY | | DTVDTVLERN | | EAKLERSKINE | |
| DSMTEVMVV | | DSMTEVMVV | | DTVDTVREKN | | EAKLERSKING | |
| DSMTEVWSY | | DSMTEVWSY | | DTVLEKNVTV | | EAKYVEWTSNS | |
| DSNALLKHR | | DSNALLKHR | | DTVLERNVTV | | EAKYVWWASNS | |
| DSNGNFIAP | | DSNGNFIAP | | DTVNFSFNGA | | EAKYVWWTSNS | |
| DSNGVQDII | | DSNGVQDII | | DTVNRTHQYS | | EALKMTIASDI | |
| DSNVENLFD | | DSNVENLFD | | DTVNTLIEQN | | EALLNRININP | |
| DSNVKNLFD | | DSNVKNLFD | | DTVNTLTEQN | | EALLNRLNINP | |
| DSNVKNLYD | | DSNVKNLYD | | DTVREKNVTV | | EALLNRLNINS | |
| DSNVKNLYE | | DSNVKNLYE | | DTVTFIFNGA | | EALLNRLSINP | |
| DSNVKNLYN | | DSNVKNLYN | | DTVTFNFNGA | | EALMEWIKTRP | |
| DSNVKSLYD | | DSNVKSLYD | | DTVTFSFNGA | | EALMEWLKTRP | |
| DSNVRNLHE | | DSNVRNLHE | | DTVTFTFNGA | | EALQNRIMINP | |
| DSNVRNLYD | | DSNVRNLYD | | DTYDFNEGAY | | EALRQIIRESG | |
| DSNVRSLHE | | DSNVRSLHE | | DTYDFNEGSY | | EALRQKIMESG | |
| DSNVTNLHE | | DSNVTNLHE | | DTYDFNEGTY | | EAMAFLEDSHP | |
| DSNYVCSGL | | DSNYVCSGL | | DVCYPGKFAN | | EAMAFLEESHP | |
| DSPSNANGG | | DSPSNANGG | | DVCYPGKFSN | | EAMAFLEKSHP | |
| DSPSNINGE | | DSPSNINGE | | DVCYPGKFTN | | EAMAFLENSHP | |
| DSPSNINGG | | DSPSNINGG | | DVCYPGKFVN | | EAMALLEESHP | |
| DSPSNVKGG | | DSPSNVKGG | | DVDQSLIIAA | | EAMASQGTKRS | |
| DSPSNVNGG | | DSPSNVNGG | | DVDQSLVIAA | | EAMATQGTKRS | |
| DSQHKSHRQ | | DSQHKSHRQ | | DVDVYCICRD | | EAMISRARIDA | |
| DSQHRSHRQ | | DSQHRSHRQ | | DVECVCRDNW | | EAMMSRARIDA | |
| DSQTATKRI | | DSQTATKRI | | DVFIERPTAV | | EAMQNRIQIDP | |
| DSQTATKRL | | DSQTATKRL | | DVFVIREPFI | | EAMVSRARIDA | |
| DSRAVGKCP | | DSRAVGKCP | | DVGYLCAGIP | | EAPGWSWDDGA | |
| DSRSGYEIL | | DSRSGYEIL | | DVILWFSFGA | | EAPSPYNSKFE | |
| DSRSGYEML | | DSRSGYEML | | DVILWFSLGA | | EAPSPYNSRFE | |
| DSRSGYETF | | DSRSGYETF | | DVILWISFSI | | EAQDVIMEIVF | |
| DSRSGYEVL | | DSRSGYEVL | | DVIMEVVFPN | | EAQDVIMEVVF | |
| DSSFYAEMK | | DSSFYAEMK | | DVINFESTGN | | EARGLFGAIAG | |
| DSSILTDSQ | | DSSILTDSQ | | DVIRSWRKQI | | EARVWWTSNSI | |
| DSSYICSGL | | DSSYICSGL | | DVISFESTGN | | EAVAWSATACH | |
| DSSYLCSGL | | DSSYLCSGL | | DVIVFNTIGN | | EAVEECLINDP | |
| DSSYVCSGL | | DSSYVCSGL | | DVLDGVTASC | | EAVIYGNPKCD | |
| DSTAVAVIK | | DSTAVAVIK | | DVLVALENQH | | ECFNPCFYVEL | |
| DSTDSEMNK | | DSTDSEMNK | | DVLVIWGIHH | | ECFNPITGSPG | |
| DSTQKAIDI | | DSTQKAIDI | | DVLVLWGIHH | | ECFWVMTDGPA | |
| DSTQKAIDN | | DSTQKAIDN | | DVLVMWGIHH | | ECFYSGGTINS | |
| DSTQMAIDN | | DSTQMAIDN | | DVLVMWGLHH | | ECICINGTCTV | |
| DSTQRAIDN | | DSTQRAIDN | | DVLVTREPYV | | ECICRDNWTGT | |

Fig. 83-55

| Block size 8 | SIN | Block size 9 | SIN | Block size 10 | SIN | Block size 11 | SIN |
|---|---|---|---|---|---|---|---|
| DSTWLGRTI | | DSTWLGRTI | | DVLWTSNSIV | | ECIEKIRNGTY | |
| DSVGSWSQN | | DSVGSWSQN | | DVNPTLLFLE | | ECIEKVRNGTY | |
| DSVKLSSGY | | DSVKLSSGY | | DVNPTLLFLK | | ECIERVRNGTY | |
| DSVTELWSY | | DSVTELWSY | | DVNPTLLFLR | | ECIESVRNGTY | |
| DSVYKALSI | | DSVYKALSI | | DVPDYQSIRS | | ECIGWSSTSCH | |
| DSWAVGRCP | | DSWAVGRCP | | DVPDYQSLRS | | ECITPNGSIPN | |
| DTCYPFDVP | | DTCYPFDVP | | DVPEWSYIVE | | ECITPNGSISN | |
| DTDVVNFLS | | DTDVVNFLS | | DVPEYQSLRS | | ECKTFFLTQGA | |
| DTDVVNFVS | | DTDVVNFVS | | DVPGYQSLRS | | ECLINDPWVLL | |
| DTDVVNYVS | | DTDVVNYVS | | DVPNYQSLRS | | ECMESVKNGTY | |
| DTDVYCICR | | DTDVYCICR | | DVRCICRDNW | | ECMESVRNGTY | |
| DTEISFTIT | | DTEISFTIT | | DVRCTCRDNW | | ECMETIKNGTY | |
| DTELSFTIT | | DTELSFTIT | | DVRCVCRDNW | | ECPKYIKSDQL | |
| DTELSFTVT | | DTELSFTVT | | DVSFQGRGVF | | ECPKYVKQGSL | |
| DTFKSWKGN | | DTFKSWKGN | | DVSWASNSIV | | ECPKYVKSDRL | |
| DTGDGCFEI | | DTGDGCFEI | | DVSWTSNSIV | | ECPKYVKSEKL | |
| DTGKGCFDI | | DTGKGCFDI | | DVTDSEMNKL | | ECPKYVKSERL | |
| DTGNGCFDI | | DTGNGCFDI | | DVVLVMKRKR | | ECPKYVRSEKL | |
| DTHIHIFSF | | DTHIHIFSF | | DVVNFLSMEF | | ECPRYVKSEKL | |
| DTICIGYHA | | DTICIGYHA | | DVVNFVSMEF | | ECQLNEGIMNT | |
| DTICVGYHA | | DTICVGYHA | | DVVNYVSMEF | | ECQLNEGVINT | |
| DTIEERFEI | | DTIEERFEI | | DVVRSWKKQI | | ECQLNEGVMNT | |
| DTIIENNVT | | DTIIENNVT | | DVVRSWRKKI | | ECRFYALSQGT | |
| DTIIESNVT | | DTIIESNVT | | DVVRSWRKQI | | ECRIFALSQGT | |
| DTIIFEANG | | DTIIFEANG | | DVVRSWRRQI | | ECRMFALSQGT | |
| DTIIFEASG | | DTIIFEASG | | DVWAYNAELL | | ECRTFFLTHGA | |
| DTIIFEATG | | DTIIFEATG | | DVWLGRTVSI | | ECRTFFLTHGS | |
| DTILEKNIT | | DTILEKNIT | | DVWLGRTVSN | | ECRTFFLTQGA | |
| DTILEKNVT | | DTILEKNVT | | DVWLGRTVST | | ECRTFFLTQGS | |
| DTILEQNVT | | DTILEQNVT | | DVWMGRTISK | | ECSCYMDIDVY | |
| DTILERNVT | | DTILERNVT | | DVWMGRTISM | | ECSCYPNDGKV | |
| DTIMEKNVI | | DTIMEKNVI | | DVWMGRTISR | | ECSCYPNEGKV | |
| DTIMEKNVT | | DTIMEKNVT | | DVWSYNAKLL | | ECSCYPNLGIV | |
| DTIMEKSVT | | DTIMEKSVT | | DVWTYNAELL | | ECSCYPNLGKV | |
| DTIMERNVT | | DTIMERNVT | | DVWTYNTELL | | ECSCYPNLGQV | |
| DTINFESTG | | DTINFESTG | | DVYCICRDNW | | ECSCYPNMGKV | |
| DTINYYNET | | DTINYYNET | | DVYCVCRDNW | | ECSCYPNNGKV | |
| DTIRNGTYN | | DTIRNGTYN | | DVYKILSIYS | | ECSCYPNSGKV | |
| DTISFESTG | | DTISFESTG | | DVYQILAIYS | | ECSCYPQYPDV | |
| DTITFEATG | | DTITFEATG | | DWILWISFAI | | ECSCYPQYPNV | |
| DTITFSFNG | | DTITFSFNG | | DWILWISFAM | | ECSCYPRYPDV | |
| DTKCQTPLG | | DTKCQTPLG | | DWILWISFAT | | ECSCYPRYPGV | |
| DTKIDLWSY | | DTKIDLWSY | | DWPDGAKIEY | | ECSCYPRYPNV | |
| DTKILFIEE | | DTKILFIEE | | DWPDGAKIKY | | ECSCYVDIDIY | |
| DTKVDLWSY | | DTKVDLWSY | | DWSGYSGAFI | | ECSCYVDIDVY | |
| DTLCIGYHA | | DTLCIGYHA | | DWSGYSGSFI | | ECSCYVDTDVY | |
| DTLIERDNA | | DTLIERDNA | | DWSGYSGSFM | | ECSCYVDVDVY | |
| DTLIERDNS | | DTLIERDNS | | DWSGYSGSFS | | ECVCHKGICPV | |
| DTLIERENA | | DTLIERENA | | DWSGYSGSFV | | ECVCHKGVCPV | |
| DTLIERENS | | DTLIERENS | | DWSWHDGAIL | | ECVCHNGICPV | |
| DTLIERGSS | | DTLIERGSS | | DWSWHDGAVL | | ECVCHNGTCAV | |
| DTLKSWKGN | | DTLKSWKGN | | DWSYIVERPS | | ECVCHNGTCVV | |
| DTLLEKNVT | | DTLLEKNVT | | DWTLNRNQPA | | ECVCHNGVCPV | |
| DTLLENDVP | | DTLLENDVP | | DWVDDAVTDI | | ECVCHNSTCVV | |
| DTLLENGVP | | DTLLENGVP | | DWVLWISFAI | | ECVCHSGICPV | |
| DTLLENNVP | | DTLLENNVP | | DYARLYIWGV | | ECVCINGICTV | |
| DTLLESDVP | | DTLLESDVP | | DYEEEAKLER | | ECVCINGSCAV | |
| DTLTEKGIE | | DTLTEKGIE | | DYEELKEQLS | | ECVCINGSCIV | |
| DTLTENGVP | | DTLTENGVP | | DYEELKHLLN | | ECVCINGSCTV | |
| DTLTETGVP | | DTLTETGVP | | DYEELKHLLS | | ECVCINGTCAV | |
| DTNKTFQNI | | DTNKTFQNI | | DYEELKHLMS | | ECVCINGTCTV | |
| DTPRGEDAQ | | DTPRGEDAQ | | DYEELREQLS | | ECVCISGTCAV | |

Fig. 83-56

| Block size 8 | SIN | Block size 9 | SIN | Block size 10 | SIN | Block size 11 | SIN |
|---|---|---|---|---|---|---|---|
| DTPRGEDGQ | | DTPRGEDGQ | | DYESTQAAID | | ECVCQDEFCYT | |
| DTPRGEDNQ | | DTPRGEDNQ | | DYHDSNVKNL | | ECVCQNGVCPV | |
| DTPRGEDSQ | | DTPRGEDSQ | | DYHYEECSCY | | ECVCRDNWNGM | |
| DTPRNDDRF | | DTPRNDDRF | | DYILDEESRA | | ECVCRDNWRGS | |
| DTPRNDDRS | | DTPRNDDRS | | DYKEESQLKR | | ECVCRDNWTGT | |
| DTPRNDDSS | | DTPRNDDSS | | DYKSTPSAID | | ECVGWSSTSCH | |
| DTPRNEDGS | | DTPRNEDGS | | DYKSTQAAID | | ECVRHNGTCAV | |
| DTPRNEDSS | | DTPRNEDSS | | DYKSTQAAVD | | ECVSHNGTWAV | |
| DTPRNGDSS | | DTPRNGDSS | | DYKSTQKTID | | ECYNPCFYVEL | |
| DTPRPADPS | | DTPRPADPS | | DYKSTQSAID | | ECYRACFYVEL | |
| DTPRPDDPS | | DTPRPDDPS | | DYKSTQSAIN | | ECYWVMTDGPA | |
| DTPRPSDPS | | DTPRPSDPS | | DYKSTQSAVD | | EDCTGCFEIFH | |
| DTPRPTDPS | | DTPRPTDPS | | DYKSTQSAVN | | EDDVWMGRTIS | |
| DTPRPVDPS | | DTPRPVDPS | | DYLIGKTSWS | | EDEQMYQKCCN | |
| DTPRSDDSS | | DTPRSDDSS | | DYNNTTGRDV | | EDEQMYQKCCS | |
| DTRILFIEE | | DTRILFIEE | | DYPKYEEESK | | EDEQMYQKCCT | |
| DTRILFIKE | | DTRILFIKE | | DYPKYEEESR | | EDEQMYQRCCN | |
| DTRILFIRE | | DTRILFIRE | | DYPKYEKESK | | EDERMYQKCCN | |
| DTRILFVKE | | DTRILFVKE | | DYQIGYICSG | | EDEVWWTSNSI | |
| DTRSGYEML | | DTRSGYEML | | DYQIGYVCSG | | EDFQLIPMISK | |
| DTTAVAVLK | | DTTAVAVLK | | DYQLIPMISK | | EDGDIIFLWGI | |
| DTTCWSWPD | | DTTCWSWPD | | DYQSIRSILA | | EDGFIDVWTYN | |
| DTTGWSWPD | | DTTGWSWPD | | DYQSLRSILA | | EDGFLDVWTYN | |
| DTTMEKNVT | | DTTMEKNVT | | DYREESQLKK | | EDGFLGVWTYN | |
| DTTSWSWPD | | DTTSWSWPD | | DYREESQLKR | | EDGKGCFDLYH | |
| DTTWDVFIE | | DTTWDVFIE | | DYRYTYRCHK | | EDGKGCFEIYH | |
| DTTYQRTRA | | DTTYQRTRA | | DYRYTYRCHR | | EDGKGCFELYH | |
| DTVDTILEK | | DTVDTILEK | | DYSIDSGYVC | | EDGKGWFELYH | |
| DTVDTLIEQ | | DTVDTLIEQ | | DYSIDSNYVC | | EDGLLDVWTYN | |
| DTVDTLLEK | | DTVDTLLEK | | DYSIDSSYIC | | EDGNGCFEIFH | |
| DTVDTLTEN | | DTVDTLTEN | | DYSIDSSYVC | | EDGNGCFELYH | |
| DTVDTVLEK | | DTVDTVLEK | | DYTIDEESRA | | EDGNIIFLWGI | |
| DTVDTVLER | | DTVDTVLER | | DYTLDEESRA | | EDGRGCFEIYH | |
| DTVDTVREK | | DTVDTVREK | | DYTRLYIWGV | | EDGSIGKVCRT | |
| DTVIFSFNG | | DTVIFSFNG | | DYWAEGDCYR | | EDGTACFEIFH | |
| DTVLEKNVT | | DTVLEKNVT | | DYWAEGECYR | | EDGTGCFEIFH | |
| DTVLERNVT | | DTVLERNVT | | DYWAKEECYR | | EDGTGCFEILH | |
| DTVNFSFNG | | DTVNFSFNG | | DYWAKGDCYR | | EDGVYKALSIY | |
| DTVNRTHQY | | DTVNRTHQY | | DYWAKGECYR | | EDKGNGCFEIF | |
| DTVNTLIEQ | | DTVNTLIEQ | | DYYWAILKPG | | EDKRYGPALSI | |
| DTVNTLMEQ | | DTVNTLMEQ | | DYYWAVLKPG | | EDKVWWTSNSI | |
| DTVNTLTEQ | | DTVNTLTEQ | | DYYWGILKRG | | EDLGNGCFKIY | |
| DTVREKNVT | | DTVREKNVT | | EAESSIKEKD | | EDLIFLARSAL | |
| DTVTFIFNG | | DTVTFIFNG | | EAESSVKEKD | | EDLIFMARSAL | |
| DTVTFNFNG | | DTVTFNFNG | | EAESSVREKD | | EDLIFSARSAL | |
| DTVTFSFNG | | DTVTFSFNG | | EAGLKWELMD | | EDLTFLARSAL | |
| DTVTFTFNG | | DTVTFTFNG | | EAHILVTREP | | EDLWAYNAELL | |
| DTYDFNEGA | | DTYDFNEGA | | EAIDKITNKI | | EDMGNGCFKIY | |
| DTYDFNEGS | | DTYDFNEGS | | EAIDKITNKV | | EDMGNGCFRIY | |
| DTYDFNEGT | | DTYDFNEGT | | EAIEECLIND | | EDMGNGCFTIY | |
| DVADSEMNK | | DVADSEMNK | | EAIEKITNKV | | EDMGNGCLKIY | |
| DVCYPGKFA | | DVCYPGKFA | | EAIGKITNKV | | EDNIYKILSIY | |
| DVCYPGKFS | | DVCYPGKFS | | EAINKITNKV | | EDNVYKALSIY | |
| DVCYPGKFT | | DVCYPGKFT | | EAINNRFQIQ | | EDNVYKILSIY | |
| DVCYPGKFV | | DVCYPGKFV | | EAINNRIKIN | | EDNVYKVLAIY | |
| DVDQSLIIA | | DVDQSLIIA | | EAINSRFQIQ | | EDNVYKVLSIY | |
| DVDQSLVIA | | DVDQSLVIA | | EAIRNGTYNH | | EDNVYRALSIY | |
| DVDVYCICR | | DVDVYCICR | | EAISNRFQIQ | | EDPAAPHGLCY | |
| DVECVCRDN | | DVECVCRDN | | EAKLEKSRIN | | EDPDHEGEGIP | |
| DVFAIREPF | | DVFAIREPF | | EAKLERSKIN | | EDPGAPHGLCY | |
| DVFIERPTA | | DVFIERPTA | | EAKYVEWTSN | | EDPNAPHKLCF | |
| DVFIIREPF | | DVFIIREPF | | EAKYVWWASN | | EDPNAPHKLCY | |

Fig. 83-57

| Block size 8 | SIN | Block size 9 | SIN | Block size 10 | SIN | Block size 11 | SIN |
|---|---|---|---|---|---|---|---|
| DVFVIREPF | | DVFVIREPF | | EAKYVWWTSN | | EDPNAPNKFCY | |
| DVFVMREPF | | DVFVMREPF | | EALKMTIASD | | EDPNAPNKLCF | |
| DVFVTREPF | | DVFVTREPF | | EALLNRLNIN | | EDPNAPNKLCY | |
| DVFVVREPF | | DVFVVREPF | | EALLNRLSIN | | EDPNHEGEGIP | |
| DVGYLCAGI | | DVGYLCAGI | | EALLSRLNIN | | EDPSAPHGLCY | |
| DVIITREPY | | DVIITREPY | | EALMEWIKTR | | EDPSAPHRLCY | |
| DVILWFSFG | | DVILWFSFG | | EALMEWLKTR | | EDPSHEGEGIP | |
| DVILWFSLG | | DVILWFSLG | | EALNNRFQIK | | EDPTAPHGLCY | |
| DVILWISFS | | DVILWISFS | | EALNNRSQIK | | EDQGNGCFEIF | |
| DVIMEVVFP | | DVIMEVVFP | | EALQNRIMIN | | EDQITDIWAYN | |
| DVINFESTG | | DVINFESTG | | EALRQIIRES | | EDRGNGCFEIF | |
| DVIRSWRKQ | | DVIRSWRKQ | | EALRQKIMES | | EDRRYGPALSI | |
| DVISFESTG | | DVISFESTG | | EALSNRFQIK | | EDRVWWTSNSI | |
| DVIVTREPY | | DVIVTREPY | | EAMAFLEDSH | | EDTKIDLWSYN | |
| DVLDGVTAS | | DVLDGVTAS | | EAMAFLEESH | | EDTKVDLWSYN | |
| DVLVALENQ | | DVLVALENQ | | EAMAFLEKSH | | EDYKEESQLKR | |
| DVLVIWGIH | | DVLVIWGIH | | EAMAFLENSH | | EDYREESQLKK | |
| DVLVLWGIH | | DVLVLWGIH | | EAMALLEESH | | EDYREESQLKR | |
| DVLVMWGIH | | DVLVMWGIH | | EAMASQGTKR | | EEAKLEKSRIN | |
| DVLVMWGLH | | DVLVMWGLH | | EAMATQGTKR | | EEAKLERSKIN | |
| DVLVTREPY | | DVLVTREPY | | EAMISRARID | | EEAKYVEWTSN | |
| DVLWTSNSI | | DVLWTSNSI | | EAMMSRARID | | EEAKYVWWASN | |
| DVNPTLLFL | | DVNPTLLFL | | EAMQNRIQID | | EEAKYVWWTSN | |
| DVPDYQSIR | | DVPDYQSIR | | EAMQNRLKID | | EEALLNRININ | |
| DVPDYQSLR | | DVPDYQSLR | | EAMVSRARID | | EEALLNRLNIN | |
| DVPEWSYIV | | DVPEWSYIV | | EAPGWSWDDG | | EEALLNRLSIN | |
| DVPEYQSLR | | DVPEYQSLR | | EAPSPYNSKF | | EEALRQIIRES | |
| DVPGYQSLR | | DVPGYQSLR | | EAPSPYNSRF | | EEALRQKIMES | |
| DVPNYQSLR | | DVPNYQSLR | | EAQDVIMEVV | | EEAMQNRIQID | |
| DVRCICKDN | | DVRCICKDN | | EARGLFGAIA | | EEAMQNRLKID | |
| DVRCICRDN | | DVRCICRDN | | EARVWWTSNS | | EECLINDPWVL | |
| DVRCVCRDN | | DVRCVCRDN | | EAVAVLKYNG | | EECSCYGHDSK | |
| DVSFQGRGV | | DVSFQGRGV | | EAVAWSATAC | | EECSCYGHNQK | |
| DVSWASNSI | | DVSWASNSI | | EAVEECLIND | | EECSCYGHNSK | |
| DVSWTSNSI | | DVSWTSNSI | | EAVIYGNPKC | | EECSCYGHSQK | |
| DVTDSEMDK | | DVTDSEMDK | | EAVNNRFQIK | | EECSCYMDIDV | |
| DVTDSEMNK | | DVTDSEMNK | | EAYNFNEGSY | | EECSCYPNDGK | |
| DVTDSEMNR | | DVTDSEMNR | | ECFNPCFYVE | | EECSCYPNEGK | |
| DVVLVMKRK | | DVVLVMKRK | | ECFNPITGSP | | EECSCYPNLCQ | |
| DVVNFLSME | | DVVNFLSME | | ECFWVMTDGP | | EECSCYPNLGK | |
| DVVNFVSME | | DVVNFVSME | | ECFYSGGTIN | | EECSCYPNLGQ | |
| DVVNYVSME | | DVVNYVSME | | ECICINGTCT | | EECSCYPNMGK | |
| DVVRSWKKQ | | DVVRSWKKQ | | ECICRDNWTG | | EECSCYPNSGK | |
| DVVRSWRKK | | DVVRSWRKK | | ECIEKIRNGT | | EECSCYPQYPD | |
| DVVRSWRKQ | | DVVRSWRKQ | | ECIEKVRNGT | | EECSCYPQYPN | |
| DVVRSWRRQ | | DVVRSWRRQ | | ECIERVRNGT | | EECSCYPRFPG | |
| DVWAYNAEL | | DVWAYNAEL | | ECIESVRNGT | | EECSCYPRYPD | |
| DVWLGRTIS | | DVWLGRTIS | | ECIGWSSTSC | | EECSCYPRYPG | |
| DVWLGRTMS | | DVWLGRTMS | | ECITPNGSIP | | EECSCYPRYPN | |
| DVWLGRTVS | | DVWLGRTVS | | ECITPNGSIS | | EECSCYPRYSG | |
| DVWMGRTIG | | DVWMGRTIG | | ECKMYALHQG | | EECSCYPSGEN | |
| DVWMGRTIN | | DVWMGRTIN | | ECKTFFLTQG | | EECSCYPSGES | |
| DVWMGRTIS | | DVWMGRTIS | | ECLINDPWVL | | EECSCYPSGTD | |
| DVWMGRTVS | | DVWMGRTVS | | ECLVPCFWVE | | EECSCYPSREN | |
| DVWSYNAKL | | DVWSYNAKL | | ECMESVKNGT | | EECSCYVDIDI | |
| DVWTYNAEL | | DVWTYNAEL | | ECMESVRNGT | | EECSCYVDIDV | |
| DVWTYNTEL | | DVWTYNTEL | | ECMETIKNGT | | EECSCYVDTDV | |
| DVWTYNVEL | | DVWTYNVEL | | ECMIKAVRGD | | EECSCYVDVDV | |
| DVYCICRDN | | DVYCICRDN | | ECPKYIKSDQ | | EECYRACFYVE | |
| DVYCVCRDN | | DVYCVCRDN | | ECPKYVKQGS | | EEDCTGCFEIF | |
| DVYQILAIY | | DVYQILAIY | | ECPKYVKSDR | | EEDGKGCFEIY | |
| DWILWISFA | | DWILWISFA | | ECPKYVKSEK | | EEDGNGCFEIF | |

Fig. 83-58

| Block size 8 | SIN | Block size 9 | SIN | Block size 10 | SIN | Block size 11 | SIN |
|---|---|---|---|---|---|---|---|
| DWPDGAKIE | | DWPDGAKIE | | ECPKYVKSER | | EEDGRGCFEIY | |
| DWSGYSGAF | | DWSGYSGAF | | ECPKYVKSKR | | EEDGTACFEIF | |
| DWSGYSGSF | | DWSGYSGSF | | ECPKYVRSEK | | EEDGTGCFEIF | |
| DWSKPQCQI | | DWSKPQCQI | | ECQLNEGIMN | | EEDGTGCFEIL | |
| DWSWHDGAI | | DWSWHDGAI | | ECQLNEGVIN | | EEEAKLEKSRI | |
| DWSWHDGAV | | DWSWHDGAV | | ECQLNEGVMN | | EEEAKLERSKI | |
| DWSWPDGAE | | DWSWPDGAE | | ECRFYALSQG | | EEELLTGNLQT | |
| DWSYIVERP | | DWSYIVERP | | ECRIFALSQG | | EEEMLTGNLQT | |
| DWTLNRNQP | | DWTLNRNQP | | ECRMFALSQG | | EEESDEALKMT | |
| DWVDDAVTD | | DWVDDAVTD | | ECRTFFLTHG | | EEESKLKRNEI | |
| DWVLWISFA | | DWVLWISFA | | ECRTFFLTQG | | EEESKLKRQEI | |
| DYARLYIWG | | DYARLYIWG | | ECSCYGHDSK | | EEESKLNRNEI | |
| DYEEEAKLE | | DYEEEAKLE | | ECSCYGHNQK | | EEESKLNRSEI | |
| DYEELKEQL | | DYEELKEQL | | ECSCYGHNSK | | EEESKLNRTEI | |
| DYEELKHLL | | DYEELKHLL | | ECSCYGHSQK | | EEESRLNRNEI | |
| DYEELKHLM | | DYEELKHLM | | ECSCYMDIDV | | EEEVLTGNLQA | |
| DYEELREQL | | DYEELREQL | | ECSCYPDAGE | | EEEVLTGNLQT | |
| DYESTQAAI | | DYESTQAAI | | ECSCYPDAGK | | EEGDIIFLWGI | |
| DYHDSNVKN | | DYHDSNVKN | | ECSCYPDASE | | EEGSIGKLCRT | |
| DYHYEECSC | | DYHYEECSC | | ECSCYPDSGE | | EEGSIGKVCRA | |
| DYILDEESR | | DYILDEESR | | ECSCYPNAGE | | EEGSIGKVCRT | |
| DYKEESQLK | | DYKEESQLK | | ECSCYPNDGK | | EEGTGIAADKE | |
| DYKSTPSAI | | DYKSTPSAI | | ECSCYPNEGK | | EEGTGIAADRE | |
| DYKSTQAAI | | DYKSTQAAI | | ECSCYPNLGI | | EEGTGVAADKE | |
| DYKSTQAAV | | DYKSTQAAV | | ECSCYPNLGK | | EEGTSIWTSSS | |
| DYKSTQKTI | | DYKSTQKTI | | ECSCYPNLGQ | | EEHPNAGKDPK | |
| DYKSTQSAI | | DYKSTQSAI | | ECSCYPNMGK | | EEHPSAGKDPK | |
| DYKSTQSAV | | DYKSTQSAV | | ECSCYPNSGK | | EEHPSAGRDPK | |
| DYKSTQTAI | | DYKSTQTAI | | ECSCYPQYPD | | EEHPSTGKDPK | |
| DYLIGKTSW | | DYLIGKTSW | | ECSCYPQYPN | | EEKVWWTSNSI | |
| DYNNTTGRD | | DYNNTTGRD | | ECSCYPRFPG | | EELKEQLSTVS | |
| DYPKYEEES | | DYPKYEEES | | ECSCYPRYPD | | EELKSLFSSIK | |
| DYPKYEKES | | DYPKYEKES | | ECSCYPRYPG | | EELLTGNLQTL | |
| DYPKYSEEA | | DYPKYSEEA | | ECSCYPRYPN | | EELREHLSSVS | |
| DYPKYSEES | | DYPKYSEES | | ECSCYPRYSG | | EELREQLSSVS | |
| DYPKYSKES | | DYPKYSKES | | ECSCYPSGEN | | EELREQLSTVS | |
| DYQIGYICS | | DYQIGYICS | | ECSCYPSGES | | EELRFLFSSIK | |
| DYQIGYVCS | | DYQIGYVCS | | ECSCYPSGTD | | EELRFVFSIAA | |
| DYQSIRSIL | | DYQSIRSIL | | ECSCYPSREN | | EELRFVFSNAA | |
| DYQSLRSIL | | DYQSLRSIL | | ECSCYVDIDI | | EELRFVFSSAA | |
| DYREESQLK | | DYREESQLK | | ECSCYVDIDV | | EELRRQKSLIW | |
| DYRYTYRCH | | DYRYTYRCH | | ECSCYVDTDV | | EELRRQKWWVW | |
| DYSIDSGYV | | DYSIDSGYV | | ECSCYVDVDV | | EELRSLFSSIK | |
| DYSIDSNYV | | DYSIDSNYV | | ECVCHDGTCV | | EELWAYNAELL | |
| DYSIDSSYI | | DYSIDSSYI | | ECVCHKGICP | | EEMLTGNLQTL | |
| DYSIDSSYV | | DYSIDSSYV | | ECVCHKGVCP | | EENPSAGKDPK | |
| DYSKYEEES | | DYSKYEEES | | ECVCHNGICP | | EENSTYKILSI | |
| DYTIDEESR | | DYTIDEESR | | ECVCHNGTCA | | EENTSYKILSI | |
| DYTLDEESR | | DYTLDEESR | | ECVCHNGTCV | | EENTTYKILSI | |
| DYTRLYIWG | | DYTRLYIWG | | ECVCHNGVCP | | EENTTYRILSI | |
| DYWAEGDCY | | DYWAEGDCY | | ECVCHNSTCV | | EEQAVDICKAA | |
| DYWAEGECY | | DYWAEGECY | | ECVCHSGICP | | EEQAVGICKAA | |
| DYWAKEECY | | DYWAKEECY | | ECVCINGICT | | EEQAVNICKAA | |
| DYWAKGDCY | | DYWAKGDCY | | ECVCINGSCA | | EERGNPGVKGW | |
| DYWAKGECY | | DYWAKGECY | | ECVCINGSCI | | EERGSPGVKGW | |
| DYYWAILKP | | DYYWAILKP | | ECVCINGSCT | | EERNSIWTSSS | |
| DYYWAVLKP | | DYYWAVLKP | | ECVCINGTCA | | EERPSIWTSSS | |
| DYYWGILKR | | DYYWGILKR | | ECVCINGTCT | | EERTSIWTSSS | |
| EAESSIKEK | | EAESSIKEK | | ECVCISGTCA | | EESDEALKMTI | |
| EAESSVKEK | | EAESSVKEK | | ECVCQDEFCY | | EESKLKRNEIK | |
| EAESSVREK | | EAESSVREK | | ECVCQNGVCP | | EESKLKRQEID | |
| EAGLKWELM | | EAGLKWELM | | ECVCRDNWNG | | EESKLKRQEIE | |

Fig. 83-59

| Block size 8 | SIN | Block size 9 | SIN | Block size 10 | SIN | Block size 11 | SIN |
|---|---|---|---|---|---|---|---|
| EAHILVTRE | | EAHILVTRE | | ECVCRDNWRG | | EESKLKRQEIN | |
| EAIDKITNK | | EAIDKITNK | | ECVCRDNWTG | | EESKLNRNEIK | |
| EAIEECLIN | | EAIEECLIN | | ECVGWSSTSC | | EESLLNRLSIN | |
| EAIEKITNK | | EAIEKITNK | | ECVRHNGTCA | | EESQLKKQEIE | |
| EAIGKITNK | | EAIGKITNK | | ECVSHNGTWA | | EESQLKRQEIE | |
| EAINKITNK | | EAINKITNK | | ECYNPCFYVE | | EESRARIKTRL | |
| EAINNRFQI | | EAINNRFQI | | ECYRACFYVE | | EESRLNRNEIK | |
| EAINNRIKI | | EAINNRIKI | | ECYWVMTDGP | | EESSIGKVCRT | |
| EAINSRFQI | | EAINSRFQI | | EDCTGCFEIF | | EEVINATETVE | |
| EAIRNGTYN | | EAIRNGTYN | | EDEQMYQKCC | | EEVKYVWWTSN | |
| EAISNRFQI | | EAISNRFQI | | EDEQMYQRCC | | EEVLTGNLQAL | |
| EAKLEKSRI | | EAKLEKSRI | | EDESRIERQK | | EEVLTGNLQTL | |
| EAKLERSKI | | EAKLERSKI | | EDEVWWTSNS | | EEVRHRLKITE | |
| EAKYVEWTS | | EAKYVEWTS | | EDFQLIPMIS | | EEVTNATETVE | |
| EAKYVWWAS | | EAKYVWWAS | | EDGDIIFLWG | | EEVWIGRTKSL | |
| EAKYVWWTS | | EAKYVWWTS | | EDGFIDVWTY | | EEYGKGRIFQS | |
| EALKGSARH | | EALKGSARH | | EDGFLDVWTY | | EEYGRGRIFQS | |
| EALKMTIAS | | EALKMTIAS | | EDGFLGVWTY | | EEYVEDTKIDL | |
| EALLNRLNI | | EALLNRLNI | | EDGFRDVWTY | | EFCYTLITDGP | |
| EALLNRLSI | | EALLNRLSI | | EDGKGCFDLY | | EFCYTLMTDGP | |
| EALMEWIKT | | EALMEWIKT | | EDGKGCFEIY | | EFCYTLVTDGP | |
| EALMEWLKT | | EALMEWLKT | | EDGKGCFELY | | EFDEIGEDVAP | |
| EALNNRFQI | | EALNNRFQI | | EDGNGCFEIF | | EFEPFQSLIPK | |
| EALNNRSQI | | EALNNRSQI | | EDGNGCFELY | | EFEPFQSLVPK | |
| EALQGSARH | | EALQGSARH | | EDGNIIFLWG | | EFEPFQSLVPR | |
| EALQNRIMI | | EALQNRIMI | | EDGRGCFEIY | | EFEQVEGRIQD | |
| EALRQIIRE | | EALRQIIRE | | EDGSIGKVCR | | EFEQVEGRIQY | |
| EALRQKIME | | EALRQKIME | | EDGTGCFEIF | | EFEQVEGRTQD | |
| EALSNRFQI | | EALSNRFQI | | EDGTGCFEIL | | EFESIESEFNE | |
| EAMAFLEDS | | EAMAFLEDS | | EDGTGCFELF | | EFESIESEFSE | |
| EAMAFLEES | | EAMAFLEES | | EDGVYKALSI | | EFGNLERRLEN | |
| EAMAFLEKS | | EAMAFLEKS | | EDKGNGCFEI | | EFGQVEGRIQD | |
| EAMAFLENS | | EAMAFLENS | | EDKRYGPALS | | EFGYLLKGESH | |
| EAMALLEES | | EAMALLEES | | EDKVWWTSNS | | EFGYLLKGESY | |
| EAMASQGTK | | EAMASQGTK | | EDLIFLARSA | | EFGYLLRGESH | |
| EAMATQGTK | | EAMATQGTK | | EDLIFMARSA | | EFHDSNVKNLY | |
| EAMISRARI | | EAMISRARI | | EDLIFSARSA | | EFIAEQFTWNG | |
| EAMMSRARI | | EAMMSRARI | | EDLIVFNTIG | | EFICVGWSSTS | |
| EAMQNRIQI | | EAMQNRIQI | | EDLTFLARSA | | EFKADLIIERR | |
| EAMQNRMQI | | EAMQNRMQI | | EDLWAYNAEL | | EFKMNPNKKII | |
| EAMQNRVKI | | EAMQNRVKI | | EDMGNGCFKI | | EFKMNPNQKII | |
| EAMVSRARI | | EAMVSRARI | | EDMGNGCFRI | | EFLCVGWSSTS | |
| EANGNLIAP | | EANGNLIAP | | EDMGNGCFTI | | EFLGQWDWPDG | |
| EAPGWSWDD | | EAPGWSWDD | | EDMGNGCLKI | | EFLGQWNWPDG | |
| EAPLNRLNI | | EAPLNRLNI | | EDNIYKILSI | | EFLVAVENQHT | |
| EAPSPYNSK | | EAPSPYNSK | | EDNVYKALSI | | EFLVLMENERT | |
| EAPSPYNSR | | EAPSPYNSR | | EDNVYKILSI | | EFNEIEHQIGN | |
| EAQDVIMEV | | EAQDVIMEV | | EDNVYKVLAI | | EFNEIEQQIGN | |
| EARGLFGAI | | EARGLFGAI | | EDNVYKVLSI | | EFNEIEYQIGN | |
| EARVWWTSN | | EARVWWTSN | | EDNVYRALSI | | EFNEVEQQIGN | |
| EATGNLIAP | | EATGNLIAP | | EDPAAPHGLC | | EFNKACELTDS | |
| EATGNLLVP | | EATGNLLVP | | EDPDHEGEGI | | EFNKIEGRVQD | |
| EATGNLVAP | | EATGNLVAP | | EDPGAPHGLC | | EFNNLEKRLEN | |
| EATGNLVVP | | EATGNLVVP | | EDPNAPHKLC | | EFNNLERRLEN | |
| EAVAVLKYN | | EAVAVLKYN | | EDPNAPHKFC | | EFNQVEKRINM | |
| EAVAWSATA | | EAVAWSATA | | EDPNAPNKFC | | EFNQVENRINM | |
| EAVEECLIN | | EAVEECLIN | | EDPNAPNKLC | | EFNQVEQRINM | |
| EAVIYGNPK | | EAVIYGNPK | | EDPNHEGEGI | | EFPSTGNHGSL | |
| EAVNNRFQI | | EAVNNRFQI | | EDPSAPHGLC | | EFQLIPMISKC | |
| EAWPIGESP | | EAWPIGESP | | EDPSAPHRLC | | EFSEIEGRIQD | |
| EAYNFNEGS | | EAYNFNEGS | | EDPSHEGEGI | | EFSEIEHQIGN | |
| ECACINGSC | | ECACINGSC | | EDPTAPHGLC | | EFSEIEHQISN | |

Fig. 83-60

| Block size 8 | SIN | Block size 9 | SIN | Block size 10 | SIN | Block size 11 | SIN |
|---|---|---|---|---|---|---|---|
| ECACVNGSC | | ECACVNGSC | | EDQGNGCFEI | | EFSEIEQQIGN | |
| ECFNPCFYV | | ECFNPCFYV | | EDQITDIWAY | | EFSETEHQIGN | |
| ECFNPITGS | | ECFNPITGS | | EDRGNGCFEI | | EFSEVEGRIQD | |
| ECFWVMTDG | | ECFWVMTDG | | EDRRYGPALS | | EFSNLEKRLEN | |
| ECFYSGGTI | | ECFYSGGTI | | EDRTPYRSLI | | EFSNLERRLEN | |
| ECICINGTC | | ECICINGTC | | EDRVWWTSNS | | EFSQVEQRINM | |
| ECICRDNWT | | ECICRDNWT | | EDSDILVTRE | | EFSQVERRINM | |
| ECIEKIRNG | | ECIEKIRNG | | EDSDVLVTRE | | EFTEVEGRIQD | |
| ECIEKVRNG | | ECIEKVRNG | | EDTHIHIFSF | | EFTEVEKQIGN | |
| ECIERVRNG | | ECIERVRNG | | EDTIEERFEI | | EFTEVEQQIGN | |
| ECIESVRNG | | ECIESVRNG | | EDTKIDLWSY | | EFTSFFYRYGF | |
| ECIGWSSTS | | ECIGWSSTS | | EDTKVDLWSY | | EFYHKCDDECM | |
| ECITPNGSI | | ECITPNGSI | | EDVSWTSNSI | | EFYHKCDNECM | |
| ECKMFALSQ | | ECKMFALSQ | | EDYKEESQLK | | EFYHKCNDECM | |
| ECKTFFLTQ | | ECKTFFLTQ | | EDYREESQLK | | EGALRQKIMES | |
| ECLINDPWV | | ECLINDPWV | | EEAKLEKSRI | | EGDCYRACFYV | |
| ECLVPCFWV | | ECLVPCFWV | | EEAKLERSKI | | EGDGCFNFFHK | |
| ECMESVKNG | | ECMESVKNG | | EEAKYVEWTS | | EGDGCFNLLHK | |
| ECMESVRNG | | ECMESVRNG | | EEAKYVWWAS | | EGDGCFSILHK | |
| ECMETIKNG | | ECMETIKNG | | EEAKYVWWTS | | EGDGCFSLLHK | |
| ECMIKAVRG | | ECMIKAVRG | | EEALKGSARH | | EGDIIFLWGIH | |
| ECPKYIKSD | | ECPKYIKSD | | EEALLNRINI | | EGECFYSGGTI | |
| ECPKYVKQG | | ECPKYVKQG | | EEALLNRLNI | | EGECYRACFYV | |
| ECPKYVKSD | | ECPKYVKSD | | EEALLNRLSI | | EGEGIPLHDAI | |
| ECPKYVKSE | | ECPKYVKSE | | EEALQGSARH | | EGEGIPLYDAI | |
| ECPKYVKSN | | ECPKYVKSN | | EEALRQIIRE | | EGEGIPLYDAV | |
| ECPKYVKSS | | ECPKYVKSS | | EEALRQKIME | | EGEQIIVTREP | |
| ECPKYVKST | | ECPKYVKST | | EEAMQNRIQI | | EGFAPFSKDNG | |
| ECPKYVRSA | | ECPKYVRSA | | EECLINDPWV | | EGFSAESRKLL | |
| ECPKYVRSE | | ECPKYVRSE | | EECSCYGHDS | | EGFSAESRKML | |
| ECPKYVRST | | ECPKYVRST | | EECSCYGHNQ | | EGGWCGMIDGW | |
| ECPRYVKSE | | ECPRYVKSE | | EECSCYGHNS | | EGGWPGLINGW | |
| ECQLNEGIM | | ECQLNEGIM | | EECSCYGHSQ | | EGGWPGLVAGW | |
| ECQLNEGVI | | ECQLNEGVI | | EECSCYMDID | | EGGWQGLVDGW | |
| ECQLNEGVM | | ECQLNEGVM | | EECSCYPDAG | | EGGWQGMIDGW | |
| ECRFYALSQ | | ECRFYALSQ | | EECSCYPDAS | | EGGWQGMVDGW | |
| ECRMFALSQ | | ECRMFALSQ | | EECSCYPDSG | | EGGWSGLIAGW | |
| ECRTFFLTH | | ECRTFFLTH | | EECSCYPNAG | | EGGWSGLVAGW | |
| ECRTFFLTQ | | ECRTFFLTQ | | EECSCYPNDG | | EGGWSGLVDGW | |
| ECSCYGHDS | | ECSCYGHDS | | EECSCYPNEG | | EGGWSGMIDGW | |
| ECSCYGHNQ | | ECSCYGHNQ | | EECSCYPNLG | | EGGWTGLIDGW | |
| ECSCYGHNS | | ECSCYGHNS | | EECSCYPNMG | | EGGWTGMIDGW | |
| ECSCYGHSQ | | ECSCYGHSQ | | EECSCYPNSG | | EGGWTGMVDGW | |
| ECSCYMDID | | ECSCYMDID | | EECSCYPQYP | | EGGWTGMVNGW | |
| ECSCYPDAG | | ECSCYPDAG | | EECSCYPRFP | | EGHIEECSCYP | |
| ECSCYPDAS | | ECSCYPDAS | | EECSCYPRSP | | EGIAADYKSTQ | |
| ECSCYPDSG | | ECSCYPDSG | | EECSCYPRYP | | EGICYPGSIEN | |
| ECSCYPNAG | | ECSCYPNAG | | EECSCYPRYS | | EGICYPGSVEN | |
| ECSCYPNDG | | ECSCYPNDG | | EECSCYPSGE | | EGIGIAADRDS | |
| ECSCYPNEG | | ECSCYPNEG | | EECSCYPSGT | | EGIGQAADLKS | |
| ECSCYPNLG | | ECSCYPNLG | | EECSCYVDID | | EGIILGNPKCD | |
| ECSCYPNMG | | ECSCYPNMG | | EECSCYVDTD | | EGIKLKSEDNV | |
| ECSCYPNSG | | ECSCYPNSG | | EECSCYVDVD | | EGIKLKTEDNI | |
| ECSCYPQYP | | ECSCYPQYP | | EECYRACFYV | | EGIKLKTEDNV | |
| ECSCYPRFP | | ECSCYPRFP | | EEDCTGCFEI | | EGIMNTSKPFQ | |
| ECSCYPRSP | | ECSCYPRSP | | EEDGKGCFEI | | EGIPLHDAIKC | |
| ECSCYPRYP | | ECSCYPRYP | | EEDGNGCFEI | | EGIPLYDAIKC | |
| ECSCYPRYS | | ECSCYPRYS | | EEDGRGCFEI | | EGIPLYDAVKC | |
| ECSCYPSGE | | ECSCYPSGE | | EEDGTGCFEI | | EGIPLYDAVRC | |
| ECSCYPSGT | | ECSCYPSGT | | EEDGTGCFEL | | EGKHIVERILE | |
| ECSCYVDID | | ECSCYVDID | | EEEAKLEKSR | | EGKIAHISPLS | |
| ECSCYVDTD | | ECSCYVDTD | | EEEAKLERSK | | EGKIIHISPLS | |

Fig. 83-61

| Block size 8 | SIN | Block size 9 | SIN | Block size 10 | SIN | Block size 11 | SIN |
|---|---|---|---|---|---|---|---|
| ECSCYVDVD | | ECSCYVDVD | | EEELLTGNLQ | | EGKISHISPLS | |
| ECVCHDGTC | | ECVCHDGTC | | EEEMLTGNLQ | | EGKIVHISPLS | |
| ECVCHDGVC | | ECVCHDGVC | | EEESDEALKM | | EGKVECICRDN | |
| ECVCHKGIC | | ECVCHKGIC | | EEESKIERQK | | EGKVECVCRDN | |
| ECVCHKGVC | | ECVCHKGVC | | EEESKLERQK | | EGKVVHISPLS | |
| ECVCHNGIC | | ECVCHNGIC | | EEESKLERQR | | EGLIDGWYGFK | |
| ECVCHNGTC | | ECVCHNGTC | | EEESKLKRNE | | EGLIDGWYGFR | |
| ECVCHNGVC | | ECVCHNGVC | | EEESKLKRQE | | EGLIDGWYGYK | |
| ECVCHNSTC | | ECVCHNSTC | | EEESKLNKNE | | EGLIDGWYGYR | |
| ECVCHSGIC | | ECVCHSGIC | | EEESKLNRNE | | EGLILGNPKCD | |
| ECVCINGIC | | ECVCINGIC | | EEESKLNRSE | | EGLILSNPKCD | |
| ECVCINGSC | | ECVCINGSC | | EEESKLNRTE | | EGLINGWYGFR | |
| ECVCINGTC | | ECVCINGTC | | EEESRIERQK | | EGLIYGNPFCD | |
| ECVCISGTC | | ECVCISGTC | | EEESRLNRNE | | EGLIYGNPSCD | |
| ECVCMNGSC | | ECVCMNGSC | | EEEVLTGNLQ | | EGLIYGNPSCN | |
| ECVCQDEFC | | ECVCQDEFC | | EEGDIIFLWG | | EGLPQSGRIVV | |
| ECVCRDNWN | | ECVCRDNWN | | EEGSIGKVCR | | EGLVDGWYGFR | |
| ECVCRDNWR | | ECVCRDNWR | | EEGSVYPRFL | | EGLVLGNPKCD | |
| ECVCRDNWT | | ECVCRDNWT | | EEGTGIAADK | | EGLVYGNPACD | |
| ECVCVNGSC | | ECVCVNGSC | | EEGTGIAADR | | EGLVYGNPSCD | |
| ECVGWSSTS | | ECVGWSSTS | | EEGTSIWTSS | | EGLWAYNAELL | |
| ECVRHNGTC | | ECVRHNGTC | | EEHPNAGKDP | | EGMCYPGFVEN | |
| ECVSHNGTW | | ECVSHNGTW | | EEHPSAGKDP | | EGMCYPGSIEN | |
| ECYNPCFYV | | ECYNPCFYV | | EEHPSAGRDP | | EGMCYPGSVEN | |
| ECYRACFYV | | ECYRACFYV | | EEHPSTGKDP | | EGMGQAADLKS | |
| ECYWVMTDG | | ECYWVMTDG | | EEISETQGTE | | EGMIDGWYGFR | |
| EDCMIKAVR | | EDCMIKAVR | | EEKTSIWTSS | | EGMMDGWYGFR | |
| EDCMMKAVR | | EDCMMKAVR | | EEKVWWTSNS | | EGMVDGWYGFR | |
| EDCMVKAVR | | EDCMVKAVR | | EELKEQLSTV | | EGMVNGWYGFR | |
| EDCTGCFEI | | EDCTGCFEI | | EELKHLLNRI | | EGNGCFELLHK | |
| EDDVWMGRT | | EDDVWMGRT | | EELKHLLSRI | | EGNGCFTFYHK | |
| EDEQMYQKC | | EDEQMYQKC | | EELKHLLSRT | | EGNGCFTFYHR | |
| EDEQMYQRC | | EDEQMYQRC | | EELKHLLSST | | EGNILRTQESE | |
| EDESRIERQ | | EDESRIERQ | | EELKHLMSST | | EGQRSWMKIYW | |
| EDEVWWTSN | | EDEVWWTSN | | EELKSLFSSI | | EGRGQAADLKS | |
| EDFQLIPMI | | EDFQLIPMI | | EELLTGNLQT | | EGRIQDLEKYI | |
| EDFVRQCFN | | EDFVRQCFN | | EELREHLSSV | | EGRIQDLEKYV | |
| EDGDIIFLW | | EDGDIIFLW | | EELREQLSSV | | EGRIQDLERYV | |
| EDGFIDVWT | | EDGFIDVWT | | EELREQLSTV | | EGRNPGNAEIE | |
| EDGFLDVWT | | EDGFLDVWT | | EELRFLFSSI | | EGRRKTNLYGF | |
| EDGFLGVWT | | EDGFLGVWT | | EELRFVFSIA | | EGRRRTNLYGF | |
| EDGKGCFDL | | EDGKGCFDL | | EELRFVFSNA | | EGRTSDMRAEI | |
| EDGKGCFEI | | EDGKGCFEI | | EELRFVFSSA | | EGRTSDMRTEI | |
| EDGKGCFEL | | EDGKGCFEL | | EELRRQKSLI | | EGRTSDMRTEV | |
| EDGLLDVWT | | EDGLLDVWT | | EELRRQKWVV | | EGRWPGLVAGW | |
| EDGNGCFEI | | EDGNGCFEI | | EELRSLFSSI | | EGSIGKVCRAL | |
| EDGNGCFEL | | EDGNGCFEL | | EELVHGGIDP | | EGSIGKVCRTL | |
| EDGNIIFLW | | EDGNIIFLW | | EELVHGGINP | | EGSYFFGDNAE | |
| EDGRGCFEI | | EDGRGCFEI | | EELVHGGVDP | | EGSYFFGDNAK | |
| EDGSIGKVC | | EDGSIGKVC | | EELVHGQVNP | | EGSYFFGDSAE | |
| EDGSSSSNC | | EDGSSSSNC | | EELVHRGIDP | | EGTAADYKSTP | |
| EDGTGCFEI | | EDGTGCFEI | | EELWAYNAEL | | EGTAADYKSTQ | |
| EDGTGCFEL | | EDGTGCFEL | | EEMGNGCFKI | | EGTGIAADKES | |
| EDGVYKALS | | EDGVYKALS | | EEMLTGNLQT | | EGTGIAADRDS | |
| EDILRTQES | | EDILRTQES | | EENPSAGKDP | | EGTGIAADRES | |
| EDKGNGCFE | | EDKGNGCFE | | EENSTYKILS | | EGTGIAADRGS | |
| EDKRYGPAL | | EDKRYGPAL | | EENTSYKILS | | EGTGIVADRDS | |
| EDKVWWTSN | | EDKVWWTSN | | EENTTYKILS | | EGTGMAADQKS | |
| EDLGNGCFK | | EDLGNGCFK | | EENTTYRILS | | EGTGMAADRDS | |
| EDLIFLARS | | EDLIFLARS | | EEPLKGSAKH | | EGTGQAADLKS | |
| EDLIFMARS | | EDLIFMARS | | EEQAVDICKA | | EGTGTAADLKS | |
| EDLIFSARS | | EDLIFSARS | | EEQAVGICKA | | EGTSIWTSSSS | |

Fig. 83-62

| Block size 8 | SIN | Block size 9 | SIN | Block size 10 | SIN | Block size 11 | SIN |
|---|---|---|---|---|---|---|---|
| EDLTFLARS | | EDLTFLARS | | EEQAVNICKA | | EGTTASCQNRG | |
| EDLWAYNAE | | EDLWAYNAE | | EERGNPGVKG | | EGVCYPGSIEN | |
| EDMGNGCFK | | EDMGNGCFK | | EERGSPGVKG | | EGVCYPGSIKN | |
| EDMGNGCFR | | EDMGNGCFR | | EERNSIWTSS | | EGVINTSKPFQ | |
| EDMGNGCFT | | EDMGNGCFT | | EERTSIWTSS | | EGVMNTSKPFQ | |
| EDMGNGCLK | | EDMGNGCLK | | EESDEALKMT | | EGVMNTSKPLQ | |
| EDNIYKILS | | EDNIYKILS | | EESKLKRNEI | | EGWIDSPNHAK | |
| EDNVYKALS | | EDNVYKALS | | EESKLKRQEI | | EGWINSPNHAK | |
| EDNVYKILS | | EDNVYKILS | | EESKLNRNEI | | EGWINSPNHVK | |
| EDNVYKVLA | | EDNVYKVLA | | EESKLNRSEI | | EGWINSPSQAK | |
| EDNVYKVLS | | EDNVYKVLS | | EESKLNRTEI | | EGWIVGNPSCA | |
| EDNVYRALS | | EDNVYRALS | | EESLLNRLSI | | EGWVVIAKDNA | |
| EDPAAPHGL | | EDPAAPHGL | | EESQLKKQEI | | EGWVVIAQDNA | |
| EDPDHEGEG | | EDPDHEGEG | | EESQLKRQEI | | EGWVVIEKDNA | |
| EDPGAPHGL | | EDPGAPHGL | | EESRARIKTR | | EGWVVVAKDNA | |
| EDPNAPHKL | | EDPNAPHKL | | EESRLNRNEI | | EGYSLVGIDPF | |
| EDPNAPNKF | | EDPNAPNKF | | EESSIGKVCR | | EGYSLVGVDPF | |
| EDPNAPNKL | | EDPNAPNKL | | EETHIHIFSF | | EHDANVRNLHD | |
| EDPNHEGEG | | EDPNHEGEG | | EETIEEKFEI | | EHDANVRNLHE | |
| EDPSAPHGL | | EDPSAPHGL | | EETIEERFEI | | EHDSNVENLFD | |
| EDPSAPHRL | | EDPSAPHRL | | EETLKGSARH | | EHDSNVKNLFD | |
| EDPSHEGEG | | EDPSHEGEG | | EETVEERFEI | | EHEEVTNATET | |
| EDPTAPHGL | | EDPTAPHGL | | EETYKILTIY | | EHIIMWGIHHP | |
| EDQGNGCFE | | EDQGNGCFE | | EEVKYVWWTS | | EHLIIWGIHHP | |
| EDQIQDIWA | | EDQIQDIWA | | EEVLKGSARH | | EHLIMWGIHHP | |
| EDQITDIWA | | EDQITDIWA | | EEVLTGNLQA | | EHLITWGIHHP | |
| EDRGNGCFE | | EDRGNGCFE | | EEVLTGNLQT | | EHLIVWGIHHP | |
| EDRMIKAVR | | EDRMIKAVR | | EEVSEAQGTE | | EHLSSVSSFER | |
| EDRRYGPAL | | EDRRYGPAL | | EEVSETQGIE | | EHPNAGKDPKK | |
| EDRTPYRSL | | EDRTPYRSL | | EEVSETQGME | | EHPSAGKDPKK | |
| EDRVWWTSN | | EDRVWWTSN | | EEVSETQGTE | | EHPSAGRDPKK | |
| EDSDILVTR | | EDSDILVTR | | EEVTNATETV | | EHPSTGKDPKK | |
| EDSDVLVTR | | EDSDVLVTR | | EEYGKGRIFQ | | EHQIGNVINWT | |
| EDSRSGYET | | EDSRSGYET | | EEYGRGRIFQ | | EHSNGTIHDRI | |
| EDSSSNSNC | | EDSSSNSNC | | EEYVEDTKID | | EHSNGTTHDRI | |
| EDSSSSSNC | | EDSSSSSNC | | EFCGTSGTYG | | EHTAYSQITNG | |
| EDTHIHIFS | | EDTHIHIFS | | EFCYTLITDG | | EHTSQYLCTGI | |
| EDTIEERFE | | EDTIEERFE | | EFCYTLMTDG | | EHTSQYLCTGV | |
| EDTKIDLWS | | EDTKIDLWS | | EFCYTLVTDG | | EHTSRYVCTGI | |
| EDTKVDLWS | | EDTKVDLWS | | EFDEIGEDVA | | EIAQKLEDVFA | |
| EDYKEESQL | | EDYKEESQL | | EFEPFQSLIP | | EIAQRLEDVFA | |
| EDYREESQL | | EDYREESQL | | EFEPFQSLVP | | EIAQRLEGVFA | |
| EEAKLEKSR | | EEAKLEKSR | | EFEQVEGRIQ | | EIAQRLENVFA | |
| EEAKLERSK | | EEAKLERSK | | EFEQVEGRTQ | | EIAQRLESVFA | |
| EEAKYVEWT | | EEAKYVEWT | | EFESIESEFN | | EIASWAGNILR | |
| EEAKYVWWA | | EEAKYVWWA | | EFESIESEFS | | EICFMYSDFHF | |
| EEAKYVWWT | | EEAKYVWWT | | EFEVMNHEFS | | EICIAWSSSSC | |
| EEALKGSAR | | EEALKGSAR | | EFEVVDHEFS | | EICIGHLSNNS | |
| EEALLNRLN | | EEALLNRLN | | EFEVVNHEFS | | EICIGYLSNNS | |
| EEALLNRLS | | EEALLNRLS | | EFFNNTEPLC | | EICIGYMSNNS | |
| EEALQGSAR | | EEALQGSAR | | EFGNLERRLE | | EICVAWSSSSC | |
| EEALRQIIR | | EEALRQIIR | | EFGQVEGRIQ | | EICVAWSSTSC | |
| EEALRQILR | | EEALRQILR | | EFGVVNHEFS | | EIDRSFRPNIG | |
| EEALRQKIM | | EEALRQKIM | | EFGYLLKGES | | EIEDLIFLARS | |
| EEAMQNRIQ | | EEAMQNRIQ | | EFGYLLRGES | | EIEDLIFLTRS | |
| EEAPLNRLN | | EEAPLNRLN | | EFIAEQFTWN | | EIEDLIFMARS | |
| EECLINDPW | | EECLINDPW | | EFICVGWSST | | EIEDLIFSARS | |
| EECMIKAVR | | EECMIKAVR | | EFKADLIIER | | EIEDLTFLARS | |
| EECSCYGHD | | EECSCYGHD | | EFKMNPNKKI | | EIEGICYPGSI | |
| EECSCYGHN | | EECSCYGHN | | EFKMNPNQKI | | EIEGIKLKSED | |
| EECSCYGHS | | EECSCYGHS | | EFLCVGWSST | | EIEGIKLKTED | |
| EECSCYMDI | | EECSCYMDI | | EFLGQWDWPD | | EIEGRIQDLEK | |

Fig. 83-63

| Block size 8 | SIN | Block size 9 | SIN | Block size 10 | SIN | Block size 11 | SIN |
|---|---|---|---|---|---|---|---|
| EECSCYPDA | | EECSCYPDA | | EFLGQWNWPD | | EIEHQIGNVIN | |
| EECSCYPDS | | EECSCYPDS | | EFLNNTEPLC | | EIEHQISNVIN | |
| EECSCYPDT | | EECSCYPDT | | EFLVALENQH | | EIEKQIGNVIN | |
| EECSCYPES | | EECSCYPES | | EFLVAMENQH | | EIEQQIGNVIN | |
| EECSCYPNA | | EECSCYPNA | | EFLVAVENQH | | EIEYQIGNVIN | |
| EECSCYPND | | EECSCYPND | | EFNEIEHQIG | | EIFHKCDDDCM | |
| EECSCYPNE | | EECSCYPNE | | EFNEIEQQIG | | EIFHKCDDHCM | |
| EECSCYPNL | | EECSCYPNL | | EFNEIEYQIG | | EIFHKCDDNCM | |
| EECSCYPNM | | EECSCYPNM | | EFNEVEQQIG | | EIFHKCDDQCM | |
| EECSCYPNS | | EECSCYPNS | | EFNKACELTD | | EIFHKCDNQCM | |
| EECSCYPQH | | EECSCYPQH | | EFNNLEKRLE | | EIFHQCDNDCM | |
| EECSCYPQY | | EECSCYPQY | | EFNNLERRLE | | EIFHQCDNNCI | |
| EECSCYPRF | | EECSCYPRF | | EFNQVEKRIN | | EIFHRCDDQCM | |
| EECSCYPRH | | EECSCYPRH | | EFNQVENRIN | | EIGAPQLNPID | |
| EECSCYPRS | | EECSCYPRS | | EFNQVEQRIN | | EIGARIGEGQR | |
| EECSCYPRY | | EECSCYPRY | | EFPSTGNHGS | | EIGEDIAPIEH | |
| EECSCYPSG | | EECSCYPSG | | EFQLIPMISK | | EIGEDIAPIEY | |
| EECSCYPSY | | EECSCYPSY | | EFSEIEGRIQ | | EIGEDLAPIEY | |
| EECSCYSRY | | EECSCYSRY | | EFSEIEHQIG | | EIGEDVAPIEH | |
| EECSCYVDI | | EECSCYVDI | | EFSEIEHQIS | | EIGEDVAPIEY | |
| EECSCYVDT | | EECSCYVDT | | EFSEIEQQIG | | EIGNGCFEFYH | |
| EECSCYVDV | | EECSCYVDV | | EFSETEHQIG | | EIGTRIGDGQR | |
| EECYRACFY | | EECYRACFY | | EFSEVEGRIQ | | EIIIRMMENAR | |
| EEDCTGCFE | | EEDCTGCFE | | EFSEVEIRIN | | EIILWFSFGAS | |
| EEDGKGCFE | | EEDGKGCFE | | EFSEVESRIN | | EIITIGSICMV | |
| EEDGNGCFE | | EEDGNGCFE | | EFSEVETRIN | | EIKGVELSSMG | |
| EEDGRGCFE | | EEDGRGCFE | | EFSEVGSRIN | | EIKGVKLSNMG | |
| EEDGTGCFE | | EEDGTGCFE | | EFSKVETRIN | | EIKGVKLSSMG | |
| EEEAKLEKS | | EEEAKLEKS | | EFSLTDPKLE | | EIKMNPNQKII | |
| EEEAKLERS | | EEEAKLERS | | EFSLTDPRFE | | EIKMNPNQKIM | |
| EEELLTGNL | | EEELLTGNL | | EFSLTDPRLE | | EILKVPNALTD | |
| EEEMLTGNL | | EEEMLTGNL | | EFSLVDPRLE | | EILNNKNWSGY | |
| EEESDEALK | | EEESDEALK | | EFSNLEKRLE | | EILRTQESECI | |
| EEESKIERQ | | EEESKIERQ | | EFSNLERRLE | | EILRTQESECV | |
| EEESKLERQ | | EEESKLERQ | | EFSQVEQRIN | | EILTKITVDHM | |
| EEESKLKRN | | EEESKLKRN | | EFSQVERRIN | | EILTKTTVDHM | |
| EEESKLKRQ | | EEESKLKRQ | | EFTEVEGRIQ | | EILTRTTVDHM | |
| EEESKLNRN | | EEESKLNRN | | EFTEVEKQIG | | EINGPDSVLVN | |
| EEESKLNRS | | EEESKLNRS | | EFTEVEQQIG | | EINGPESVLIN | |
| EEESKLNRT | | EEESKLNRT | | EFTSFFYRYG | | EINGPESVLVN | |
| EEESRIERQ | | EEESRIERQ | | EFVRQCFNPM | | EINRIFRPNIG | |
| EEESRLNRN | | EEESRLNRN | | EFWHKCDDEC | | EINRNFKPNIG | |
| EEEVLTGNL | | EEEVLTGNL | | EFWHKCDNDC | | EINRSFKPNIG | |
| EEFVRQCFN | | EEFVRQCFN | | EFWHKCDNEC | | EINRSFRPNIG | |
| EEGDIIFLW | | EEGDIIFLW | | EFWHKCNNEC | | EINTWARNILR | |
| EEGSIGKVC | | EEGSIGKVC | | EFYHKCDDEC | | EIPSWAGNILR | |
| EEGTGIAAD | | EEGTGIAAD | | EFYHKCDNEC | | EIPSWAGNVLR | |
| EEGTGVAAD | | EEGTGVAAD | | EFYHKCNDEC | | EIPSWEGNILR | |
| EEGTSIWTS | | EEGTSIWTS | | EGALRQKIME | | EIRTFSFQLIL | |
| EEHPNAGKD | | EEHPNAGKD | | EGAYKILTIY | | EIRTFSFQLIN | |
| EEHPSAGKD | | EEHPSAGKD | | EGDCYRACFY | | EISFQGGHIEE | |
| EEHPSAGRD | | EEHPSAGRD | | EGDGCFNFFH | | EISFTITGDNT | |
| EEHPSTGKD | | EEHPSTGKD | | EGDGCFNLLH | | EISHCRATEYI | |
| EEISETQGT | | EEISETQGT | | EGDGCFSILH | | EITGIDKVCTK | |
| EEKTSIWTS | | EEKTSIWTS | | EGDGCFSLLH | | EITGINKVCTK | |
| EEKVWWTSN | | EEKVWWTSN | | EGDIIFLWGI | | EITTKINNIIE | |
| EELKEQLST | | EELKEQLST | | EGECFYSGGT | | EIVDNKNWSGY | |
| EELKHLLNR | | EELKHLLNR | | EGECYRACFY | | EIVDNNNWSGY | |
| EELKHLLSR | | EELKHLLSR | | EGEGIPLHDA | | EIVDNSNWSGY | |
| EELKHLLSS | | EELKHLLSS | | EGEGIPLYDA | | EIVGNDNWSGY | |
| EELKHLMSS | | EELKHLMSS | | EGEQIIVTRE | | EIVSNDNWSGY | |
| EELKSLFSS | | EELKSLFSS | | EGFAPFSKDN | | EIWSYNAELLV | |

Fig. 83-64

| Block size 8 | SIN | Block size 9 | SIN | Block size 10 | SIN | Block size 11 | SIN |
|---|---|---|---|---|---|---|---|
| EELLTGNLQ | | EELLTGNLQ | | EGFEEFTMVG | | EKAHNGKLCRL | |
| EELREHLSS | | EELREHLSS | | EGFSAESRKL | | EKAIWTSGSSI | |
| EELREQLSS | | EELREQLSS | | EGFSAESRKM | | EKANVLIGQGD | |
| EELREQLST | | EELREQLST | | EGGWCGMIDG | | EKDNAVRFGES | |
| EELRFLFSS | | EELRFLFSS | | EGGWPGLING | | EKEEVTNATET | |
| EELRFVFSI | | EELRFVFSI | | EGGWPGLVAG | | EKEFEQVEGRI | |
| EELRFVFSN | | EELRFVFSN | | EGGWQGLVDG | | EKEFEQVEGRT | |
| EELRFVFSS | | EELRFVFSS | | EGGWQGMIDG | | EKEFGQVEGRI | |
| EELRRQKSL | | EELRRQKSL | | EGGWQGMVDG | | EKEFSEIEGRI | |
| EELRRQKWW | | EELRRQKWW | | EGGWSGLIAG | | EKEFSEVEGRI | |
| EELRSLFSS | | EELRSLFSS | | EGGWSGLVAG | | EKEFTEVEGRI | |
| EELVHGGID | | EELVHGGID | | EGGWSGMIDG | | EKEGYSLVGID | |
| EELVHGGIN | | EELVHGGIN | | EGGWTGLIDG | | EKEGYSLVGVD | |
| EELVHGGVD | | EELVHGGVD | | EGGWTGMIDG | | EKEKEICSVVL | |
| EELVHGQVN | | EELVHGQVN | | EGGWTGMVDG | | EKEKVTNATET | |
| EELVHRGID | | EELVHRGID | | EGGWTGMVNG | | EKENSYPKINK | |
| EELWAYNAE | | EELWAYNAE | | EGHIEECSCY | | EKENSYPMINK | |
| EEMLTGNLQ | | EEMLTGNLQ | | EGIAADYKST | | EKESKLNRNEI | |
| EENPSAGKD | | EENPSAGKD | | EGICYPGSIE | | EKESTQKAIDQ | |
| EENSTYKIL | | EENSTYKIL | | EGICYPGSVE | | EKFFPSSSYRR | |
| EENTSYKIL | | EENTSYKIL | | EGIGIAADRD | | EKFHQIEKEFS | |
| EENTTYKIL | | EENTTYKIL | | EGIGQAADLK | | EKGAKQEENLT | |
| EENTTYRIL | | EENTTYRIL | | EGIILGNPKC | | EKGIEVVNATE | |
| EEPLKGSAK | | EEPLKGSAK | | EGIKLKSEDN | | EKGKVVKSVEL | |
| EEPLRQILR | | EEPLRQILR | | EGIKLKTEDN | | EKGNPGVKGWA | |
| EEQAVDICK | | EEQAVDICK | | EGIMNTSKPF | | EKGNQGVKGWA | |
| EEQAVGICK | | EEQAVGICK | | EGIPLHDAIK | | EKGPKQEENLT | |
| EEQAVNICK | | EEQAVNICK | | EGIPLYDAIK | | EKGPKQEENST | |
| EERGNPGVK | | EERGNPGVK | | EGIPLYDAVK | | EKGTKQEENLT | |
| EERGSPGVK | | EERGSPGVK | | EGIPLYDAVR | | EKGVEVVNATE | |
| EERNSIWTS | | EERNSIWTS | | EGIYKILTIY | | EKHLAYCNTDL | |
| EERTSIWTS | | EERTSIWTS | | EGKHIVERIL | | EKHPAYCNTDL | |
| EESDEALKM | | EESDEALKM | | EGKIAHISPL | | EKHSAYCNTDL | |
| EESECVCHN | | EESECVCHN | | EGKIIHISPL | | EKIEKIRPLLI | |
| EESHPGIFE | | EESHPGIFE | | EGKISHISPL | | EKIHTRGLFGA | |
| EESHPGIFG | | EESHPGIFG | | EGKIVHIGPL | | EKIRNGTYDHK | |
| EESHPGLFE | | EESHPGLFE | | EGKIVHISPL | | EKIRTRGLFGA | |
| EESKIERQK | | EESKIERQK | | EGKIVHVSPL | | EKIRVKRRPVA | |
| EESKINRQE | | EESKINRQE | | EGKVECICRD | | EKITNKVNNIV | |
| EESKLERQK | | EESKLERQK | | EGKVECVCRD | | EKKAKLANVVR | |
| EESKLERQR | | EESKLERQR | | EGKVVHISPL | | EKKINMINDKI | |
| EESKLKRNE | | EESKLKRNE | | EGLIDGWYGF | | EKLEQSGLPVG | |
| EESKLKRQE | | EESKLKRQE | | EGLIDGWYGY | | EKLTIIYSSSM | |
| EESKLNKNE | | EESKLNKNE | | EGLILGNPKC | | EKLTITYSSPM | |
| EESKLNRNE | | EESKLNRNE | | EGLILSNPKC | | EKLTITYSSSL | |
| EESKLNRQE | | EESKLNRQE | | EGLINGWYGF | | EKLTITYSSSM | |
| EESKLNRSE | | EESKLNRSE | | EGLIYGNPSC | | EKLVLATGLRN | |
| EESKLNRTE | | EESKLNRTE | | EGLPQSGRIV | | EKLVLATGPRN | |
| EESLLNRLS | | EESLLNRLS | | EGLVDGWYGF | | EKMNGNYDSIR | |
| EESLRQILR | | EESLRQILR | | EGLVLGNPKC | | EKMVLSAFDER | |
| EESLRQVLR | | EESLRQVLR | | EGLVYGNPAC | | EKNALGDCPKY | |
| EESQLKKQE | | EESQLKKQE | | EGLVYGNPSC | | EKNDLYGAQSL | |
| EESQLKRQE | | EESQLKRQE | | EGLWAYNAEL | | EKNDLYGTQPL | |
| EESRARIKT | | EESRARIKT | | EGMCYPGFVE | | EKNDLYGTQSL | |
| EESRIERQK | | EESRIERQK | | EGMCYPGSIE | | EKNELYGTQSL | |
| EESRINRQE | | EESRINRQE | | EGMCYPGSVE | | EKNITEIVYLN | |
| EESRLNRNE | | EESRLNRNE | | EGMGQAADLK | | EKNITKIVYLN | |
| EESRLNRQE | | EESRLNRQE | | EGMIDGWYGF | | EKNITVTHAQD | |
| EESSIGKVC | | EESSIGKVC | | EGMMDGWYGF | | EKNITVTHSVE | |
| EETHIHIFS | | EETHIHIFS | | EGMVDGWYGF | | EKNPALRMKWM | |
| EETIEEKFE | | EETIEEKFE | | EGMVNGWYGF | | EKNPAYCNTDL | |
| EETIEERFE | | EETIEERFE | | EGNGCFELLH | | EKNPSLRMKWM | |

Fig. 83-65

| Block size 8 | SIN | Block size 9 | SIN | Block size 10 | SIN | Block size 11 | SIN |
|---|---|---|---|---|---|---|---|
| EETLKGSAR | | EETLKGSAR | | EGNGCFTFYH | | EKNVTVTHAKD | |
| EETLRKILR | | EETLRKILR | | EGNILRTQES | | EKNVTVTHAQD | |
| EETLRQILR | | EETLRQILR | | EGQRSWMKIY | | EKNVTVTHAQN | |
| EETVEERFE | | EETVEERFE | | EGRGQAADLK | | EKNVTVTHSIE | |
| EETYKILTI | | EETYKILTI | | EGRIQDLEKY | | EKNVTVTHSVD | |
| EEVKYVWWT | | EEVKYVWWT | | EGRIQDLERY | | EKNVTVTHSVE | |
| EEVLKGSAR | | EEVLKGSAR | | EGRLIQNSIT | | EKNVTVTHSVN | |
| EEVLTGNLQ | | EEVLTGNLQ | | EGRLIQNSLT | | EKQIGNLINWT | |
| EEVSEAQGT | | EEVSEAQGT | | EGRLIQNSMT | | EKQIGNVINWT | |
| EEVSETQGI | | EEVSETQGI | | EGRNPGNAEI | | EKQLGNVINWT | |
| EEVSETQGM | | EEVSETQGM | | EGRRKTNLYG | | EKQTRGIFGAI | |
| EEVSETQGT | | EEVSETQGT | | EGRRRTNLYG | | EKQTRGLFGAI | |
| EEVTNATET | | EEVTNATET | | EGRTSDMRAE | | EKRGLFGAIAG | |
| EEWSCYGHS | | EEWSCYGHS | | EGRTSDMRTE | | EKRIENLNKKM | |
| EEYGKGRIF | | EEYGKGRIF | | EGRWPGLVAG | | EKRINMIADRV | |
| EEYGRGRIF | | EEYGRGRIF | | EGSIGKVCRA | | EKRINMINDKI | |
| EEYVEDTKI | | EEYVEDTKI | | EGSIGKVCRT | | EKRINMISDKI | |
| EFCYTLITD | | EFCYTLITD | | EGSYFFGDNA | | EKRINMLADRI | |
| EFCYTLMTD | | EFCYTLMTD | | EGTAADYKST | | EKRINMLADRV | |
| EFCYTLVTD | | EFCYTLVTD | | EGTGIAADKE | | EKRINMLADWV | |
| EFDEIGEDV | | EFDEIGEDV | | EGTGIAADRD | | EKRINVINDKI | |
| EFEPFQSLI | | EFEPFQSLI | | EGTGIAADRE | | EKRRKKRGLFG | |
| EFEPFQSLV | | EFEPFQSLV | | EGTGIAADRG | | EKRTNMINDKI | |
| EFEQVEGRI | | EFEQVEGRI | | EGTGIVADRD | | EKSRINGVKLE | |
| EFEQVEGRT | | EFEQVEGRT | | EGTGMAADQK | | EKTHNGKLCKL | |
| EFESIESEF | | EFESIESEF | | EGTGMAADRD | | EKTHNGKLCRL | |
| EFEVMNHEF | | EFEVMNHEF | | EGTGQAADLK | | EKTHNGRLCKL | |
| EFEVVDHEF | | EFEVVDHEF | | EGTGTAADLK | | EKTIWTSGSSI | |
| EFEVVNHEF | | EFEVVNHEF | | EGTSIWTSSS | | EKTLDLHDSNV | |
| EFFNNTEPL | | EFFNNTEPL | | EGTTASCQNR | | EKTNDKYHQIE | |
| EFGNLERRL | | EFGNLERRL | | EGTYKILTIY | | EKTNEKFHQIE | |
| EFGQVEGRI | | EFGQVEGRI | | EGVCYPGSIE | | EKTNEKYHQIE | |
| EFGVVNHEF | | EFGVVNHEF | | EGVCYPGSIK | | EKTNKQFELID | |
| EFGYLLKGE | | EFGYLLKGE | | EGVINTSKPF | | EKTNQQFELID | |
| EFGYLLRGE | | EFGYLLRGE | | EGVMNTSKPF | | EKTNQQFKLID | |
| EFHDSNVKN | | EFHDSNVKN | | EGVMNTSKPL | | EKTNTEFESIE | |
| EFIAEQFTW | | EFIAEQFTW | | EGWIDSPNHA | | EKTNTQFELID | |
| EFICVGWSS | | EFICVGWSS | | EGWIGGNPAC | | EKTSIWTSSSS | |
| EFKADLIIE | | EFKADLIIE | | EGWILGNPKC | | EKTSWSYIVEK | |
| EFKMNPNKK | | EFKMNPNKK | | EGWILGNPQC | | EKVRLQLRDNA | |
| EFKMNPNQK | | EFKMNPNQK | | EGWILGNPRC | | EKVRMQLRDNV | |
| EFLCVGWSS | | EFLCVGWSS | | EGWINSPNHA | | EKVRNGTYDHK | |
| EFLGQWDWP | | EFLGQWDWP | | EGWINSPNHV | | EKVRRQLRENA | |
| EFLGQWNWP | | EFLGQWNWP | | EGWINSPSQA | | EKVWWTSNSIV | |
| EFLNNTEPL | | EFLNNTEPL | | EGWIVGNPAC | | EKYGSGRIFQS | |
| EFLVALENQ | | EFLVALENQ | | EGWIVGNPSC | | EKYGTGRIFQS | |
| EFLVAMENQ | | EFLVAMENQ | | EGWVVIAKDN | | EKYHQIEKEFE | |
| EFLVAVENQ | | EFLVAVENQ | | EGWVVIAQDN | | EKYHQIEKEFG | |
| EFNEIEHQI | | EFNEIEHQI | | EGWVVIEKDN | | EKYVEDTKIDL | |
| EFNEIEQQI | | EFNEIEQQI | | EGWVVVAKDN | | EKYVEDTKVDL | |
| EFNEIEYQI | | EFNEIEYQI | | EGYEEFTIVG | | ELAEKAMKEHG | |
| EFNEVEQQI | | EFNEVEQQI | | EGYEEFTLVG | | ELAEKAMKEYG | |
| EFNKACELT | | EFNKACELT | | EGYEEFTMIG | | ELAEKTMKEYG | |
| EFNNLEKRL | | EFNNLEKRL | | EGYEEFTMVG | | ELAERAMKEYG | |
| EFNNLERRL | | EFNNLERRL | | EGYSLVGIDP | | ELCPSPLKLVD | |
| EFNQVEKRI | | EFNQVEKRI | | EGYSLVGVDP | | ELCTINSWHIY | |
| EFNQVENRI | | EFNQVENRI | | EHDANVRNLH | | ELDEIGEDIAP | |
| EFNQVEQRI | | EFNQVEQRI | | EHDSNVENLF | | ELDEIGEDLAP | |
| EFPSTGNHG | | EFPSTGNHG | | EHDSNVKNLF | | ELDEIGEDVAP | |
| EFQLIPMIS | | EFQLIPMIS | | EHEEVTNATE | | ELDNNGELRHL | |
| EFSEIEGRI | | EFSEIEGRI | | EHLIIWGIHH | | ELEIGARIGEG | |
| EFSEIEHQI | | EFSEIEHQI | | EHLIMWGIHH | | ELEIGTRIGDG | |

Fig. 83-66

| Block size 8 | SIN | Block size 9 | SIN | Block size 10 | SIN | Block size 11 | SIN |
|---|---|---|---|---|---|---|---|
| EFSEIEQQI | | EFSEIEQQI | | EHLITWGIHH | | ELFHKCDDDCM | |
| EFSETEHQI | | EFSETEHQI | | EHLIVWGIHH | | ELFVLMENERT | |
| EFSEVEGRI | | EFSEVEGRI | | EHLSSVSSFE | | ELGAPLVLDDC | |
| EFSEVEIRI | | EFSEVEIRI | | EHLVMWGIHH | | ELGDAPFLDRL | |
| EFSEVESRI | | EFSEVESRI | | EHPNAGKDPK | | ELGDCSIAGWL | |
| EFSEVETRI | | EFSEVETRI | | EHPSAGKDPK | | ELGIPFHLGTK | |
| EFSEVGSRI | | EFSEVGSRI | | EHPSAGRDPK | | ELGIPFHLGTR | |
| EFSKVETRI | | EFSKVETRI | | EHPSTGKDPK | | ELGNCSIAGWL | |
| EFSLTDPKL | | EFSLTDPKL | | EHQIGNVINW | | ELGNGCFEFYH | |
| EFSLTDPRF | | EFSLTDPRF | | EHSNGTIHDR | | ELGSPLVLDDC | |
| EFSLTDPRL | | EFSLTDPRL | | EHSNGTTHDR | | ELGVPFHLATK | |
| EFSNLEKRI | | EFSNLEKRI | | EHTAYSQITN | | ELGVPFHLGTK | |
| EFSNLEKRL | | EFSNLEKRL | | EHTSKYVCTG | | ELGVPFHLGTR | |
| EFSNLERRI | | EFSNLERRI | | EHTSQYICTG | | ELGVPFYLGTK | |
| EFSNLERRL | | EFSNLERRL | | EHTSQYLCTG | | ELGVPFYLGTR | |
| EFSQVEQRI | | EFSQVEQRI | | EHTSRYICTG | | ELGVSFHLGTK | |
| EFSQVERRI | | EFSQVERRI | | EHTSRYVCTG | | ELIDNEFTEVE | |
| EFSSLERRI | | EFSSLERRI | | EIAQKLEDVF | | ELIGKTSWSYI | |
| EFTEVEGRI | | EFTEVEGRI | | EIAQRLEDVF | | ELIRGRPEEAK | |
| EFTEVEKQI | | EFTEVEKQI | | EIAQRLEGVF | | ELIRGRPEEVK | |
| EFTEVEQQI | | EFTEVEQQI | | EIAQRLENVF | | ELIRGRPKEDK | |
| EFTSFFYRY | | EFTSFFYRY | | EIAQRLESVF | | ELIRGRPKEDR | |
| EFVRQCFNP | | EFVRQCFNP | | EIASWAGNIL | | ELIRGRPKEEK | |
| EFWHKCDDE | | EFWHKCDDE | | EICFMYSDFH | | ELIRMIKRGIN | |
| EFWHKCDND | | EFWHKCDND | | EICIAWSSSS | | ELIRMIKRGVN | |
| EFWHKCDNE | | EFWHKCDNE | | EICIGYLSNN | | ELIRMVKRGIN | |
| EFWHKCNNE | | EFWHKCNNE | | EICIGYMSNN | | ELIVLLENQKT | |
| EFYHKCDDE | | EFYHKCDDE | | EICVAWSSSS | | ELKEQLSTVSS | |
| EFYHKCDNE | | EFYHKCDNE | | EICVAWSSTS | | ELKSLFSSIKK | |
| EFYHKCNDE | | EFYHKCNDE | | EIDRSFRPNI | | ELKWLISKSKE | |
| EGADVCYPG | | EGADVCYPG | | EIEDLIFLAR | | ELKWLVSKDKG | |
| EGALRQKIM | | EGALRQKIM | | EIEDLIFLTR | | ELKWLVSKNKG | |
| EGAYKILTI | | EGAYKILTI | | EIEDLIFMAR | | ELKWLVSKSKG | |
| EGDCYRACF | | EGDCYRACF | | EIEDLIFSAR | | ELKWLVSKTKG | |
| EGDGCFNFF | | EGDGCFNFF | | EIEDLTFLAR | | ELLHKCNDSCM | |
| EGDGCFNLL | | EGDGCFNLL | | EIEGICYPGS | | ELLHKCNNSCM | |
| EGDGCFSIL | | EGDGCFSIL | | EIEGIKLKSE | | ELLHKCNNTCM | |
| EGDGCFSLL | | EGDGCFSLL | | EIEGIKLKTE | | ELLIAMENQHT | |
| EGDIIFLWG | | EGDIIFLWG | | EIEGRIQDLE | | ELLILLENERT | |
| EGECFYSGG | | EGECFYSGG | | EIEHQIGNVI | | ELLTGNLQTLK | |
| EGECYRACF | | EGECYRACF | | EIEHQISNVI | | ELLVAIENQHT | |
| EGEGIPLHD | | EGEGIPLHD | | EIEKQIGNVI | | ELLVALENQHT | |
| EGEGIPLYD | | EGEGIPLYD | | EIEQQIGNVI | | ELLVAMENQHT | |
| EGEQIIVTR | | EGEQIIVTR | | EIEYQIGNVI | | ELLVLIENERT | |
| EGFAPFSKD | | EGFAPFSKD | | EIFHKCDDDC | | ELLVLIENQKT | |
| EGFEEFTMV | | EGFEEFTMV | | EIFHKCDDHC | | ELLVLLEDERT | |
| EGFSAESRK | | EGFSAESRK | | EIFHKCDDQC | | ELLVLLENERT | |
| EGFVRQCFN | | EGFVRQCFN | | EIFHKCDDRC | | ELLVLLENGRT | |
| EGGWCGMID | | EGGWCGMID | | EIFHKCDNQC | | ELLVLLENQKI | |
| EGGWPGLIN | | EGGWPGLIN | | EIFHQCDNDC | | ELLVLLENQKP | |
| EGGWPGLVA | | EGGWPGLVA | | EIFHQCDNNC | | ELLVLLENQKT | |
| EGGWQGLVD | | EGGWQGLVD | | EIFHRCDDQC | | ELLVLLGNQKT | |
| EGGWQGMID | | EGGWQGMID | | EIGAPQLNPI | | ELLVLMENEIT | |
| EGGWQGMVD | | EGGWQGMVD | | EIGARIGEGQ | | ELLVLMENEMT | |
| EGGWSGLIA | | EGGWSGLIA | | EIGEDIAPIE | | ELLVLMENERT | |
| EGGWSGLVA | | EGGWSGLVA | | EIGEDLAPIE | | ELNNNGELRHL | |
| EGGWSGMID | | EGGWSGMID | | EIGEDVAPIE | | ELPFQNLSPRT | |
| EGGWTGLID | | EGGWTGLID | | EIGNGCFEFY | | ELPSFGVSGIN | |
| EGGWTGMID | | EGGWTGMID | | EIGTRIGDGQ | | ELPSFGVSGVN | |
| EGGWTGMVD | | EGGWTGMVD | | EIGVTRREIH | | ELRDCKIEAVI | |
| EGGWTGMVN | | EGGWTGMVN | | EIGVTRREVH | | ELRDCKVEAVI | |
| EGHIEECSC | | EGHIEECSC | | EIIRMMENA | | ELRDCSIAGWL | |

Fig. 83-67

| Block size 8 | SIN | Block size 9 | SIN | Block size 10 | SIN | Block size 11 | SIN |
|---|---|---|---|---|---|---|---|
| EGIAADYKS | | EGIAADYKS | | EIILWFSFGA | | ELREHLSSVSS | |
| EGICYPGSI | | EGICYPGSI | | EIITIGSICM | | ELREQLSSVSS | |
| EGICYPGSV | | EGICYPGSV | | EIKGVELSSM | | ELREQLSTVSS | |
| EGIGIAADR | | EGIGIAADR | | EIKGVKLSNM | | ELRFLFSSIKK | |
| EGIGQAADL | | EGIGQAADL | | EIKGVKLSSM | | ELRFVFSIAAS | |
| EGIILGNPK | | EGIILGNPK | | EIKMNPNQKI | | ELRFVFSNAAS | |
| EGIKLKSED | | EGIKLKSED | | EILKVPNALT | | ELRFVFSSAAS | |
| EGIKLKTED | | EGIKLKTED | | EILNNKNWSG | | ELRHLFSGIKS | |
| EGIMNTSKP | | EGIMNTSKP | | EILRTQESEC | | ELRHLFSGIRS | |
| EGIPLHDAI | | EGIPLHDAI | | EILTKITVDH | | ELRHLFSGVNS | |
| EGIPLYDAI | | EGIPLYDAI | | EILTKTTVDH | | ELRRCLLQSLQ | |
| EGIPLYDAV | | EGIPLYDAV | | EILTRTTVDH | | ELRRQKSLIWL | |
| EGIYKILTI | | EGIYKILTI | | EIMASQGTKR | | ELRRQKWWVWL | |
| EGKHIVERI | | EGKHIVERI | | EIMRIWRQAN | | ELRSGYWAIRT | |
| EGKIAHISP | | EGKIAHISP | | EINGPDSVLV | | ELRSKYWAIRT | |
| EGKIIHISP | | EGKIIHISP | | EINGPESVLI | | ELRSLFSSIKK | |
| EGKISHISP | | EGKISHISP | | EINGPESVLV | | ELRSLFSSIKR | |
| EGKIVHIGP | | EGKIVHIGP | | EINRIFRPNI | | ELRSRYWAIRT | |
| EGKIVHISP | | EGKIVHISP | | EINRNFKPNI | | ELSFTITGDNT | |
| EGKIVHVSP | | EGKIVHVSP | | EINRSFKPNI | | ELSFTVTGDNT | |
| EGKLSQMSK | | EGKLSQMSK | | EINRSFRPNI | | ELSSMGVYQIL | |
| EGKLSQMSR | | EGKLSQMSR | | EINTWARNIL | | ELVETNHTDEL | |
| EGKVECICR | | EGKVECICR | | EIPSWAGNIL | | ELVRKTRFLPV | |
| EGKVECVCR | | EGKVECVCR | | EIPSWAGNVL | | ELVRMIKRGIN | |
| EGKVVHISP | | EGKVVHISP | | EIPSWEGNIL | | ELWAYNAELLV | |
| EGLIDGWYG | | EGLIDGWYG | | EIRAFSFQLI | | ELWSYNAELLV | |
| EGLILGNPK | | EGLILGNPK | | EIRASVGKMI | | ELYGTQSLSIS | |
| EGLILSNPK | | EGLILSNPK | | EIRASVGRMI | | EMCAAWSSSSC | |
| EGLINGWYG | | EGLINGWYG | | EIRASVGRMV | | EMEGICYPGSI | |
| EGLIYGNPS | | EGLIYGNPS | | EIRIAWSSSS | | EMEGICYPGSV | |
| EGLPQSGRI | | EGLPQSGRI | | EIRRIWRQAN | | EMEGVCYPGSI | |
| EGLVDGWYG | | EGLVDGWYG | | EIRRVWRQAN | | EMGNGCFEFYH | |
| EGLVLGNPK | | EGLVLGNPK | | EIRSSVGKMI | | EMIRGQPKEKA | |
| EGLVYGNPA | | EGLVYGNPA | | EIRTFSFQFI | | EMIRGQPKEKT | |
| EGLVYGNPS | | EGLVYGNPS | | EIRTFSFQLI | | EMIRGQPNERT | |
| EGLWAYNAE | | EGLWAYNAE | | EIRTSVGRMV | | EMIWDANGWVS | |
| EGMCYPGFV | | EGMCYPGFV | | EISFQGGHIE | | EMKWLLSNADN | |
| EGMCYPGSI | | EGMCYPGSI | | EISFQSGHIE | | EMKWLLSNNDN | |
| EGMCYPGSV | | EGMCYPGSV | | EISFTITGDN | | EMKWLLSNSDN | |
| EGMGQAADL | | EGMGQAADL | | EISHCRATEY | | EMKWLLSNSNN | |
| EGMIDGWYG | | EGMIDGWYG | | EITFHGAKEI | | EMKWLLSNTDN | |
| EGMMDGWYG | | EGMMDGWYG | | EITFHGAKEV | | EMKWLLSSKAN | |
| EGMVDGWYG | | EGMVDGWYG | | EITFHGSKEV | | EMKWLLSSKDN | |
| EGMVNGWYG | | EGMVNGWYG | | EITFHRAKEV | | EMKWLLSSSDN | |
| EGNDVCYPG | | EGNDVCYPG | | EITGIDKVCT | | EMKWLLSSTDN | |
| EGNGCFELL | | EGNGCFELL | | EITGINKVCT | | EMKWLSSSGNN | |
| EGNGCFTFY | | EGNGCFTFY | | EITTKINNII | | EMKWLSSSMNN | |
| EGNILRTQE | | EGNILRTQE | | EIVDNKNWSG | | EMLKIHNAGTD | |
| EGQRSWMKI | | EGQRSWMKI | | EIVDNNNWSG | | EMLKIPNAETD | |
| EGRGQAADL | | EGRGQAADL | | EIVDNSNWSG | | EMLKIPNAGID | |
| EGRIQDLEK | | EGRIQDLEK | | EIVGNDNWSG | | EMLKIPNAGTD | |
| EGRIQDLER | | EGRIQDLER | | EIVSNDNWSG | | EMLKVPNAGTD | |
| EGRLIQNSI | | EGRLIQNSI | | EIWSYNAEFL | | EMLKVPNALTD | |
| EGRLIQNSL | | EGRLIQNSL | | EIWSYNAELL | | EMLNLYDRVRK | |
| EGRLIQNSM | | EGRLIQNSM | | EKAHNGKLCR | | EMLNLYERVRK | |
| EGRNPGNAE | | EGRNPGNAE | | EKAIWTSGSS | | EMLRIPNAGID | |
| EGRRKTNLY | | EGRRKTNLY | | EKANVLIGQG | | EMLTGNLQTLK | |
| EGRRRTNLY | | EGRRRTNLY | | EKDLTKEFFE | | EMNKLFERVRR | |
| EGRTSDMRA | | EGRTSDMRA | | EKDMTKDFFE | | EMNKLYEKVRR | |
| EGRTSDMRT | | EGRTSDMRT | | EKDMTKEFFE | | EMNKLYERVKR | |
| EGRWPGLVA | | EGRWPGLVA | | EKDMTKEFFV | | EMNKLYERVRK | |
| EGSDVCYPG | | EGSDVCYPG | | EKDMTREFFE | | EMNKLYERVRR | |

Fig. 83-68

| Block size 8 | SIN | Block size 9 | SIN | Block size 10 | SIN | Block size 11 | SIN |
|---|---|---|---|---|---|---|---|
| EGSIGKVCR | | EGSIGKVCR | | EKDNAVRFGE | | EMRRCLLQSLQ | |
| EGSINTRLP | | EGSINTRLP | | EKEEVINATE | | EMSFQGRGVFE | |
| EGSYFFGDN | | EGSYFFGDN | | EKEEVTNATE | | EMTDSEMLNLY | |
| EGTAADYKS | | EGTAADYKS | | EKEFEQVEGR | | EMTLDFHDSNV | |
| EGTDICYPG | | EGTDICYPG | | EKEFGQVEGR | | EMVWDANGWVS | |
| EGTDVCYPG | | EGTDVCYPG | | EKEFSEIEGR | | EMVWDDNGWVS | |
| EGTGIAADK | | EGTGIAADK | | EKEFSEVEGR | | ENAEDIGNGCF | |
| EGTGIAADR | | EGTGIAADR | | EKEFTEVEGR | | ENAEDKGNGCF | |
| EGTGIVADR | | EGTGIVADR | | EKEGYSLVGI | | ENAEDMGDGCF | |
| EGTGMAADQ | | EGTGMAADQ | | EKEGYSLVGV | | ENAEDMGGGCF | |
| EGTGMAADR | | EGTGMAADR | | EKEKEICSVV | | ENAEDMGNGCF | |
| EGTGQAADL | | EGTGQAADL | | EKEKVTNATE | | ENAEDMGNGCL | |
| EGTGTAADL | | EGTGTAADL | | EKENSYPKIN | | ENAEDQGNGCF | |
| EGTIVSSLP | | EGTIVSSLP | | EKENSYPMIN | | ENAEDRGNGCF | |
| EGTSIWTSS | | EGTSIWTSS | | EKESTQKAID | | ENAEEDCTGCF | |
| EGTTASCQN | | EGTTASCQN | | EKFFPSSSYR | | ENAEEDGNGCF | |
| EGTYKILTI | | EGTYKILTI | | EKFHQIEKEF | | ENAEEDGTGCF | |
| EGVCYPGSI | | EGVCYPGSI | | EKGAKQEENL | | ENAEEMGNGCF | |
| EGVINTSKP | | EGVINTSKP | | EKGIEVVNAT | | ENAIDAGDGCF | |
| EGVMNTSKP | | EGVMNTSKP | | EKGKVVKSVE | | ENAIDNGDGCF | |
| EGWIDSPNH | | EGWIDSPNH | | EKGNPGVKGW | | ENAIDTGDGCF | |
| EGWIGGNPA | | EGWIGGNPA | | EKGNQGVKGW | | ENALDTGDGCF | |
| EGWILGNPK | | EGWILGNPK | | EKGPKQEENL | | ENAVDTGDGCF | |
| EGWILGNPQ | | EGWILGNPQ | | EKGPKQEENS | | ENDKTLDLHDA | |
| EGWILGNPR | | EGWILGNPR | | EKGTKQEENL | | ENDKTLDMHDA | |
| EGWINSPNH | | EGWINSPNH | | EKGVEVVNAT | | ENDKTLNMHDA | |
| EGWINSPSQ | | EGWINSPSQ | | EKHLAYCNTD | | ENDRTLDLHDA | |
| EGWIVGNPA | | EGWIVGNPA | | EKHPAYCNTD | | ENEKTLDLHDS | |
| EGWIVGNPS | | EGWIVGNPS | | EKHSAYCNTD | | ENEMTLDFHDS | |
| EGWVVIAKD | | EGWVVIAKD | | EKIEKIRPLL | | ENERILDFHDS | |
| EGWVVIAQD | | EGWVVIAQD | | EKIHTRGLFG | | ENERTLDFHDF | |
| EGWVVIEKD | | EGWVVIEKD | | EKIRNGTYDH | | ENERTLDFHDL | |
| EGWVVVAKD | | EGWVVVAKD | | EKIRTRGLFG | | ENERTLDFHDS | |
| EGYEEFTIV | | EGYEEFTIV | | EKIRVKRRPV | | ENERTLDLHDA | |
| EGYEEFTLV | | EGYEEFTLV | | EKITNKVNNI | | ENERTLDLHDS | |
| EGYEEFTMI | | EGYEEFTMI | | EKIVTVTHAQ | | ENERTLDMHDA | |
| EGYEEFTMV | | EGYEEFTMV | | EKKAKLANVV | | ENERTLDMHDV | |
| EGYSLVGID | | EGYSLVGID | | EKKINMINDK | | ENERTLDQHDA | |
| EGYSLVGVD | | EGYSLVGVD | | EKLEQSGLPV | | ENERTLDYHDF | |
| EHDANVRNL | | EHDANVRNL | | EKLTIIYSSS | | ENERTLDYHDS | |
| EHDSNVENL | | EHDSNVENL | | EKLTITYSSP | | ENERTLEFHDS | |
| EHDSNVKNL | | EHDSNVKNL | | EKLTITYSSS | | ENERTLYFHDS | |
| EHEEVTNAT | | EHEEVTNAT | | EKLVLATGLR | | ENGDIIFLWGI | |
| EHGSGYAAD | | EHGSGYAAD | | EKLVLATGPR | | ENGNGCFELYH | |
| EHLIIWGIH | | EHLIIWGIH | | EKMNGNYDSI | | ENGRTLDLHDA | |
| EHLIMWGIH | | EHLIMWGIH | | EKMNIQFTAV | | ENGRTLDMHDA | |
| EHLITWGIH | | EHLITWGIH | | EKMNIQFTSV | | ENGRTLGLHDA | |
| EHLIVWGIH | | EHLIVWGIH | | EKMNTQFTAV | | ENGTSVKTLTD | |
| EHLSSVSSF | | EHLSSVSSF | | EKMNTQFTSV | | ENGVPVTSSID | |
| EHLVMWGIH | | EHLVMWGIH | | EKMVLSAFDE | | ENGVPVTSSVD | |
| EHNGILCAT | | EHNGILCAT | | EKNALGDCPK | | ENGWEGLIDGW | |
| EHNGLLCAT | | EHNGLLCAT | | EKNALYGTQS | | ENGWEGLINGW | |
| EHNGMLCAT | | EHNGMLCAT | | EKNATASFIY | | ENGWEGLVDGW | |
| EHNGVLCAT | | EHNGVLCAT | | EKNDLYGTQP | | ENGWEGMIDGW | |
| EHPNAGKDP | | EHPNAGKDP | | EKNDLYGTQS | | ENGWEGMMDGW | |
| EHPSAGKDP | | EHPSAGKDP | | EKNELYGTQS | | ENGWEGMVDGW | |
| EHPSAGRDP | | EHPSAGRDP | | EKNITEIVYL | | ENGWEGMVNGW | |
| EHPSTGKDP | | EHPSTGKDP | | EKNITKIVYL | | ENGWQGLIDGW | |
| EHQIGNVIN | | EHQIGNVIN | | EKNITVTHAQ | | ENKHSNGTKHD | |
| EHQISNVIN | | EHQISNVIN | | EKNITVTHSV | | ENKKYGPALSI | |
| EHSNGTIHD | | EHSNGTIHD | | EKNPALRMKW | | ENKRYGPALSI | |
| EHSNGTTHD | | EHSNGTTHD | | EKNPAYCNTD | | ENKYVNNTTII | |

Fig. 83-69

| Block size 8 | SIN | Block size 9 | SIN | Block size 10 | SIN | Block size 11 | SIN |
|---|---|---|---|---|---|---|---|
| EHTAYSQIT | | EHTAYSQIT | | EKNPSLRMKW | | ENLEELRFVFS | |
| EHTSKYVCT | | EHTSKYVCT | | EKNVTVTHAK | | ENLFDEVRRRL | |
| EHTSQYLCT | | EHTSQYLCT | | EKNVTVTHAQ | | ENLNKKIDDGF | |
| EHTSRYICT | | EHTSRYICT | | EKNVTVTHAR | | ENLNKKMEDGF | |
| EHTSRYVCT | | EHTSRYVCT | | EKNVTVTHSI | | ENLNKKMEDGL | |
| EIALSYSAG | | EIALSYSAG | | EKNVTVTHSV | | ENLNKKVDDGF | |
| EIAQKLEDV | | EIAQKLEDV | | EKNVTVTHTQ | | ENLNKKVDDGL | |
| EIAQRLEDV | | EIAQRLEDV | | EKQIGNLINW | | ENLNKKVEDGF | |
| EIAQRLEGV | | EIAQRLEGV | | EKQIGNVINW | | ENLNKRMEDGF | |
| EIAQRLENV | | EIAQRLENV | | EKQLGNVINW | | ENLNRKMEDGF | |
| EIAQRLESV | | EIAQRLESV | | EKQTRGIFGA | | ENLNRKVDDGF | |
| EIASWAGNI | | EIASWAGNI | | EKQTRGLFGA | | ENLQAYQKRMG | |
| EICFMYSDF | | EICFMYSDF | | EKRGLFGAIA | | ENLQAYQNRMG | |
| EICIAWSSS | | EICIAWSSS | | EKRIENLNKK | | ENLQTYQKRMG | |
| EICIGYLSN | | EICIGYLSN | | EKRINMIADR | | ENLWAYNAELL | |
| EICIGYMSN | | EICIGYMSN | | EKRINMINDK | | ENNVTVTSSVE | |
| EICVAWSSS | | EICVAWSSS | | EKRINMISDK | | ENPAHKSQLIW | |
| EICVAWSST | | EICVAWSST | | EKRINMLADR | | ENPAHKSQLVW | |
| EIDGIKLKS | | EIDGIKLKS | | EKRINMLADW | | ENPGVKGWAFD | |
| EIDRSFRPN | | EIDRSFRPN | | EKRINVINDK | | ENPSAGKDPKK | |
| EIEDLIFLA | | EIEDLIFLA | | EKRLENLNKK | | ENPSHEGEGIP | |
| EIEDLIFLT | | EIEDLIFLT | | EKRLGNLNKK | | ENPVHKSQLIW | |
| EIEDLIFMA | | EIEDLIFMA | | EKRRKKRGLF | | ENPVICLGHHA | |
| EIEDLIFSA | | EIEDLIFSA | | EKRTNMINDK | | ENQEELKSLFS | |
| EIEDLTFLA | | EIEDLTFLA | | EKSDVLVTRE | | ENQEELRFLFS | |
| EIEGICYPG | | EIEGICYPG | | EKSRINGVKL | | ENQEELRSLFS | |
| EIEGIKLES | | EIEGIKLES | | EKTHIHIFSF | | ENQHIIDLADS | |
| EIEGIKLKS | | EIEGIKLKS | | EKTHNGKLCK | | ENQHIIDVTDS | |
| EIEGIKLKT | | EIEGIKLKT | | EKTHNGKLCR | | ENQHTIDLADS | |
| EIEGIRLKS | | EIEGIRLKS | | EKTIWTSGSS | | ENQHTIDLTDA | |
| EIEGRIQDL | | EIEGRIQDL | | EKTLDLHDSN | | ENQHTIDLTDS | |
| EIEHQIGNV | | EIEHQIGNV | | EKTNDKYHQI | | ENQHTIDLTNS | |
| EIEHQISNV | | EIEHQISNV | | EKTNEKFHQI | | ENQHTIDMADS | |
| EIEKQIGNV | | EIEKQIGNV | | EKTNEKYHQI | | ENQHTIDMTDS | |
| EIEQQIGNV | | EIEQQIGNV | | EKTNKQFELI | | ENQHTIDSTDS | |
| EIEYQIGNV | | EIEYQIGNV | | EKTNQQFELI | | ENQHTIDVTDS | |
| EIFHKCDDD | | EIFHKCDDD | | EKTNQQFKLI | | ENQHTIEMTDS | |
| EIFHKCDDH | | EIFHKCDDH | | EKTNTEFESI | | ENQHTIHLTDS | |
| EIFHKCDDQ | | EIFHKCDDQ | | EKTNTQFELI | | ENQKILDEHDS | |
| EIFHKCDDR | | EIFHKCDDR | | EKTSIWTSSS | | ENQKTLDEHDA | |
| EIFHKCDNQ | | EIFHKCDNQ | | EKVDTIIESN | | ENQKTLDEHDS | |
| EIFHQCDND | | EIFHQCDND | | EKVNTIIESN | | ENQKTLDKHDS | |
| EIFHQCDNN | | EIFHQCDNN | | EKVRLQLRDN | | ENQNPRIFLAM | |
| EIFHRCDDQ | | EIFHRCDDQ | | EKVRMQLRDN | | ENQNPRMFLAM | |
| EIGAPQLNP | | EIGAPQLNP | | EKVRNGTYDH | | ENQNPRVFLAM | |
| EIGARIGEG | | EIGARIGEG | | EKVRRQLREN | | ENQNPRVFLTM | |
| EIGEDIAPI | | EIGEDIAPI | | EKVTNATETV | | ENQNTIDLTDS | |
| EIGEDLAPI | | EIGEDLAPI | | EKVWWTSNSI | | ENQSPRMFLAM | |
| EIGEDVAPI | | EIGEDVAPI | | EKYGSGRIFQ | | ENRINMLADRI | |
| EIGNGCFEF | | EIGNGCFEF | | EKYGTGRIFQ | | ENRMVIASTTA | |
| EIGTRIGDG | | EIGTRIGDG | | EKYHQIEKEF | | ENRMVLASTTA | |
| EIGVTRREI | | EIGVTRREI | | EKYVEDTKID | | ENRVWWTSNSI | |
| EIGVTRREV | | EIGVTRREV | | EKYVEDTKVD | | ENSFEQITFIQ | |
| EIHIYYLEK | | EIHIYYLEK | | ELAEKAMKEH | | ENSFEQITFLQ | |
| EIIEGRDRA | | EIIEGRDRA | | ELAEKAMKEY | | ENSFEQITFMQ | |
| EIIEGRDRI | | EIIEGRDRI | | ELAEKTMKEY | | ENSQGSGYAAD | |
| EIIEGRDRN | | EIIEGRDRN | | ELAERAMKEY | | ENSTYKILSIY | |
| EIIEGRDRT | | EIIEGRDRT | | ELCPSPLKLV | | ENTGSYVRLYL | |
| EIIIRMMEN | | EIIIRMMEN | | ELCTINSWHI | | ENTSYKILSIY | |
| EIILWFSFG | | EIILWFSFG | | ELDEIGEDIA | | ENTTYKILSIY | |
| EIITHFQRK | | EIITHFQRK | | ELDEIGEDLA | | ENTTYRILSIY | |
| EIITIGSIC | | EIITIGSIC | | ELDEIGEDVA | | ENTYVNKTTVI | |

Fig. 83-70

| Block size 8 | SIN | Block size 9 | SIN | Block size 10 | SIN | Block size 11 | SIN |
|---|---|---|---|---|---|---|---|
| EIKCQTPLG | | EIKCQTPLG | | ELDNNGELRH | | ENTYVNNTTII | |
| EIKGVELSS | | EIKGVELSS | | ELEIGARIGE | | ENTYVNNTTVI | |
| EIKGVKLSN | | EIKGVKLSN | | ELEIGTRIGD | | EPALIVWGVHH | |
| EIKGVKLSS | | EIKGVKLSS | | ELEIGTRIGE | | EPDECRFYALS | |
| EIKMNPNQK | | EIKMNPNQK | | ELFHKCDDDC | | EPFISCSHFEC | |
| EILKVPNAE | | EILKVPNAE | | ELFVLMENER | | EPFISCSHLEC | |
| EILLIEDGW | | EILLIEDGW | | ELGAPLVLDD | | EPFISCSHMEC | |
| EILLIEEGW | | EILLIEEGW | | ELGDAPFLDR | | EPFISCSHSEC | |
| EILNNKNWS | | EILNNKNWS | | ELGDCSIAGW | | EPFISCSPLEC | |
| EILRTQESE | | EILRTQESE | | ELGIPFHLGT | | EPFISCSQLEC | |
| EILTKITVD | | EILTKITVD | | ELGNCSIAGW | | EPFVACGPAEC | |
| EILTKTTVD | | EILTKTTVD | | ELGNGCFEFY | | EPFVACGPSEC | |
| EILTRTTVD | | EILTRTTVD | | ELGSPLVLDD | | EPFVACGPTEC | |
| EILVALENQ | | EILVALENQ | | ELGVPFHLAT | | EPFVACSPSEC | |
| EIMRIWRQA | | EIMRIWRQA | | ELGVPFHLGT | | EPFVSCGPSEC | |
| EIMYLNNTT | | EIMYLNNTT | | ELGVPFYLGT | | EPFVSCSHLEC | |
| EINGIKLKS | | EINGIKLKS | | ELGVSFHLGT | | EPGSGDWPDGS | |
| EINGPDSVL | | EINGPDSVL | | ELIDNEFTEV | | EPGSGNWPDGA | |
| EINGPESVL | | EINGPESVL | | ELIGKTSWSY | | EPGSGNWPDGP | |
| EINRIFRPN | | EINRIFRPN | | ELIRGMPKES | | EPGSGNWPDGS | |
| EINRNFKPN | | EINRNFKPN | | ELIRGRPEEA | | EPGTFDIEGLY | |
| EINRSFKPN | | EINRSFKPN | | ELIRGRPEEV | | EPGTFDIGGLY | |
| EINRSFRPN | | EINRSFRPN | | ELIRGRPKED | | EPGTFDLEGLY | |
| EINTWARNI | | EINTWARNI | | ELIRGRPKEE | | EPGTFDLGGLY | |
| EIPSWAGNI | | EIPSWAGNI | | ELIRGRPKEN | | EPISLGDCSFA | |
| EIPSWEGNI | | EIPSWEGNI | | ELIRGRPKES | | EPKGLFGAIAG | |
| EIPTWAGNI | | EIPTWAGNI | | ELIRGRPRES | | EPLCDVSGFAI | |
| EIRAFSFQL | | EIRAFSFQL | | ELIRMIKRGI | | EPLCEVSGFAI | |
| EIRASVGKM | | EIRASVGKM | | ELIRMIKRGV | | EPLCEVSGFAV | |
| EIRASVGRM | | EIRASVGRM | | ELIRMVKRGI | | EPLCEVSGFVI | |
| EIRIAWSSS | | EIRIAWSSS | | ELIVLLENQK | | EPLCNVSGFAI | |
| EIRINMINS | | EIRINMINS | | ELKEQLSTVS | | EPMGFRYSGIK | |
| EIRRIWRQA | | EIRRIWRQA | | ELKSLFSSIK | | EPRGLFGAIAG | |
| EIRRVWRQA | | EIRRVWRQA | | ELKWLISKSK | | EPSGYAQTDCV | |
| EIRSSVGKM | | EIRSSVGKM | | ELKWLVSKDK | | EPTGYAQTDCV | |
| EIRTFSFQF | | EIRTFSFQF | | ELKWLVSKNK | | EPYPGNNNNGV | |
| EIRTFSFQL | | EIRTFSFQL | | ELKWLVSKSK | | EPYVSCDPDEC | |
| EISETQGTE | | EISETQGTE | | ELKWLVSKTK | | EPYVSCDPDGC | |
| EISFQGGHI | | EISFQGGHI | | ELLHKCNDSC | | EPYVSCDPLGC | |
| EISFTITGD | | EISFTITGD | | ELLHKCNNSC | | EPYVSCDPNEC | |
| EISHCRATE | | EISHCRATE | | ELLHKCNNTC | | EPYVSCDPSGC | |
| EITFHGAKE | | EITFHGAKE | | ELLIAMENQH | | EPYVSCDPTGC | |
| EITFYGAKE | | EITFYGAKE | | ELLILLENER | | EPYVSCEPDEC | |
| EITGIDKVC | | EITGIDKVC | | ELLTGNLQTL | | EQAVDICKAAI | |
| EITGINKVC | | EITGINKVC | | ELLVALENQH | | EQAVDICKAAL | |
| EITTHFQRK | | EITTHFQRK | | ELLVALENQN | | EQAVDICKAAM | |
| EITTKINNI | | EITTKINNI | | ELLVAMENQH | | EQAVGICKAAM | |
| EIVDNKNWS | | EIVDNKNWS | | ELLVLIENER | | EQAVNICKAAM | |
| EIVDNNNWS | | EIVDNNNWS | | ELLVLIENQK | | EQEEVTNATET | |
| EIVDNSNWS | | EIVDNSNWS | | ELLVLLEDER | | EQFPVQTDEYK | |
| EIVGNDNWS | | EIVGNDNWS | | ELLVLLENER | | EQFTWNGVKVD | |
| EIVSNDNWS | | EIVSNDNWS | | ELLVLLENGR | | EQGMGMAADKE | |
| EIVTHFQRK | | EIVTHFQRK | | ELLVLLENQK | | EQGSGYAADKE | |
| EIVYLNDTI | | EIVYLNDTI | | ELLVLLGNQK | | EQGSGYAADLK | |
| EIVYLNNTI | | EIVYLNNTI | | ELLVLMENEM | | EQGSGYAADQK | |
| EIVYLNNTT | | EIVYLNNTT | | ELLVLMENER | | EQGSGYAADRK | |
| EIVYLNSTT | | EIVYLNSTT | | ELLVLMVNER | | EQGTGIAADKA | |
| EIWSYNAEF | | EIWSYNAEF | | ELNNNGELRH | | EQGTGIAADKE | |
| EIWSYNAEL | | EIWSYNAEL | | ELPFQNLSPR | | EQGTGIAADKT | |
| EIYNETVRL | | EIYNETVRL | | ELPSFGVSGI | | EQGTGIAADKV | |
| EKAIWTSGS | | EKAIWTSGS | | ELPSFGVSGV | | EQGTGIAAEKE | |
| EKAMKEHGE | | EKAMKEHGE | | ELRDCKIEAV | | EQGVGIAADKE | |

Fig. 83-71

| Block size 8 | SIN | Block size 9 | SIN | Block size 10 | SIN | Block size 11 | SIN |
|---|---|---|---|---|---|---|---|
| EKAMKEYGE | | EKAMKEYGE | | ELRDCKVEAV | | EQGVGMAADKE | |
| EKANKIKAE | | EKANKIKAE | | ELRDCSIAGW | | EQIADAQHRSH | |
| EKANKIKSE | | EKANKIKSE | | ELREHLSSVS | | EQIADSHHRSH | |
| EKANKIKTE | | EKANKIKTE | | ELREQLSSVS | | EQIADSQHKSH | |
| EKANVLIGQ | | EKANVLIGQ | | ELREQLSTVS | | EQIADSQHRSH | |
| EKASKIKSE | | EKASKIKSE | | ELRFLFSSIK | | EQIAGSSEQAA | |
| EKDLTKEFF | | EKDLTKEFF | | ELRFVFSIAA | | EQIIVTREPYV | |
| EKDMTKEFF | | EKDMTKEFF | | ELRFVFSNAA | | EQITFIQALQL | |
| EKDMTREFF | | EKDMTREFF | | ELRFVFSSAA | | EQITFLQALQL | |
| EKDNAVRFG | | EKDNAVRFG | | ELRHLFSGIK | | EQITFMQALQL | |
| EKEEVINAT | | EKEEVINAT | | ELRHLFSGIR | | EQIVVTREPYV | |
| EKEEVTNAT | | EKEEVTNAT | | ELRHLFSGVN | | EQKQEFKMNPN | |
| EKEFEQVEG | | EKEFEQVEG | | ELRRCLLQSL | | EQKVPVTQTME | |
| EKEFGQVEG | | EKEFGQVEG | | ELRRIWRQAN | | EQLGSWSWHDG | |
| EKEFSEIEG | | EKEFSEIEG | | ELRRQKSLIW | | EQLSQKFEEIR | |
| EKEFSEVEG | | EKEFSEVEG | | ELRRQKWWVW | | EQLSSVSSFEK | |
| EKEGYSLVG | | EKEGYSLVG | | ELRSGYWAIR | | EQLSSVSSFER | |
| EKEKEICSV | | EKEKEICSV | | ELRSKYWAIR | | EQLSSVSSFKR | |
| EKENSYPKI | | EKENSYPKI | | ELRSLFSSIK | | EQLSTVSSFER | |
| EKENSYPMI | | EKENSYPMI | | ELRSRYWAIR | | EQMAGSSEQAA | |
| EKESKLNRN | | EKESKLNRN | | ELSFTITGDN | | EQMYQKCCNLF | |
| EKESTQKAI | | EKESTQKAI | | ELSFTVTGDN | | EQMYQKCCSLF | |
| EKFFPSSSY | | EKFFPSSSY | | ELSSGYKDVI | | EQMYQKCCTLF | |
| EKFHQIEKE | | EKFHQIEKE | | ELSSMGVYQI | | EQMYQRCCNLF | |
| EKGAKQEEN | | EKGAKQEEN | | ELVETNHTDE | | EQNGKSGACKR | |
| EKGIEVVNA | | EKGIEVVNA | | ELVRGRPKES | | EQNIPVTQTME | |
| EKGKVVKSV | | EKGKVVKSV | | ELVRKTRFLP | | EQNIPVTQVEE | |
| EKGNPGVKG | | EKGNPGVKG | | ELVRMIKRGI | | EQNKLYGAGNK | |
| EKGNQGVKG | | EKGNQGVKG | | ELWAYNAELL | | EQNKLYGTGNK | |
| EKGPKQEEN | | EKGPKQEEN | | ELWSYNAELL | | EQNVPVTQAME | |
| EKGTKQEEN | | EKGTKQEEN | | ELYGTQSLSI | | EQNVPVTQTME | |
| EKGVEVVNA | | EKGVEVVNA | | EMCAAWSSSS | | EQNVPVTQVEE | |
| EKHLAYCNT | | EKHLAYCNT | | EMCHGTQIGG | | EQQGRMDYYWA | |
| EKHPAYCNT | | EKHPAYCNT | | EMCHSTQIGG | | EQQGRMDYYWG | |
| EKHSAYCNT | | EKHSAYCNT | | EMCHSTRIGG | | EQQIGNVINWT | |
| EKIEKIRPL | | EKIEKIRPL | | EMDKLFERVR | | EQRINMLADRI | |
| EKIHTRGLF | | EKIHTRGLF | | EMEGICYPGS | | EQSGLPVGGNE | |
| EKIKILPRD | | EKIKILPRD | | EMEGVCYPGS | | EQTALYKNANT | |
| EKIRNGTYD | | EKIRNGTYD | | EMGHAPSPYN | | EQTDLYKVATG | |
| EKIRTRGLF | | EKIRTRGLF | | EMGLAPSPYN | | EQTKLYGNGNK | |
| EKIRVKRRP | | EKIRVKRRP | | EMGNGCFEFY | | EQTKLYGSGNK | |
| EKITNKVNN | | EKITNKVNN | | EMGQAPSPYN | | EQTKLYGSGSK | |
| EKIVTVTHA | | EKIVTVTHA | | EMGQAPSPYT | | EQTKLYKNTNT | |
| EKKAKLANV | | EKKAKLANV | | EMIRGKPEEG | | EQTTLYKNANT | |
| EKKINMIND | | EKKINMIND | | EMIRGKPEER | | EQVAGSSEQAA | |
| EKLEQSGLP | | EKLEQSGLP | | EMIRGKPKER | | EQVEGRIQDLE | |
| EKLTIIYSS | | EKLTIIYSS | | EMIRGQPKEK | | EQVIVTREPYV | |
| EKLTITYSS | | EKLTITYSS | | EMIRGQPKER | | EREAKLFVLFC | |
| EKLVLATGL | | EKLVLATGL | | EMIRGRPEER | | EREEVTNATET | |
| EKLVLATGP | | EKLVLATGP | | EMIWDANGWV | | EREGGRRRKRG | |
| EKMNGNYDS | | EKMNGNYDS | | EMIWDPDGWT | | EREGYSLVGID | |
| EKMNIQFTA | | EKMNIQFTA | | EMIWDPNGWT | | EREGYSLVGVD | |
| EKMNIQFTS | | EKMNIQFTS | | EMKKLYERVR | | ERELVRKTRFL | |
| EKMNTQFTA | | EKMNTQFTA | | EMKWLLSNAD | | EREVEVVNATE | |
| EKMNTQFTV | | EKMNTQFTV | | EMKWLLSNND | | ERGEDTIEERF | |
| EKMVLSAFD | | EKMVLSAFD | | EMKWLLSNSD | | ERGEETIEEKF | |
| EKNALGDCP | | EKNALGDCP | | EMKWLLSNTD | | ERGEETIEERF | |
| EKNALYGTQ | | EKNALYGTQ | | EMKWLLSSKA | | ERGEETVEERF | |
| EKNATASFI | | EKNATASFI | | EMKWLLSSKD | | ERGIEVVNATE | |
| EKNDLYGTQ | | EKNDLYGTQ | | EMKWLLSSSD | | ERGKLKRRAIA | |
| EKNELYGTQ | | EKNELYGTQ | | EMKWLLSSTD | | ERGLFGAIAGF | |
| EKNITEIVY | | EKNITEIVY | | EMKWLSSSGN | | ERGLQRRRFIQ | |

Fig. 83-72

| Block size 8 | SIN | Block size 9 | SIN | Block size 10 | SIN | Block size 11 | SIN |
|---|---|---|---|---|---|---|---|
| EKNITKIVY | | EKNITKIVY | | EMKWLSSSMN | | ERGLQRRRFVQ | |
| EKNITVTHA | | EKNITVTHA | | EMLKIHNAGT | | ERGNPGVKGWA | |
| EKNITVTHS | | EKNITVTHS | | EMLKIPNAET | | ERGNQGVKGWA | |
| EKNPALRMK | | EKNPALRMK | | EMLKIPNAGI | | ERGSPGVKGWA | |
| EKNPAYCNT | | EKNPAYCNT | | EMLKIPNAGT | | ERGTKQEENLT | |
| EKNPSLRMK | | EKNPSLRMK | | EMLKVPNAGT | | ERGTQGVKGWA | |
| EKNVTVTHA | | EKNVTVTHA | | EMLKVPNALT | | ERGVEVVDATE | |
| EKNVTVTHS | | EKNVTVTHS | | EMLNLYDRVR | | ERGVEVVNATE | |
| EKNVTVTRA | | EKNVTVTRA | | EMLNLYEGVR | | ERGYPGVKGWA | |
| EKPFQNVNK | | EKPFQNVNK | | EMLNLYERVR | | ERILDFHDSNV | |
| EKQIGNVIN | | EKQIGNVIN | | EMLRIPNAGI | | ERILEEESDEA | |
| EKQLGNVIN | | EKQLGNVIN | | EMLTGNLQTL | | ERIMFESNGGL | |
| EKQTRGIFG | | EKQTRGIFG | | EMNKLFERVK | | ERITFESNGGL | |
| EKQTRGLFG | | EKQTRGLFG | | EMNKLFERVR | | ERITFESSGGL | |
| EKRGLFGAI | | EKRGLFGAI | | EMNKLYEKVR | | ERLGSWSWHDG | |
| EKRIENLNK | | EKRIENLNK | | EMNKLYERVK | | ERLTITYSSSM | |
| EKRINMIAD | | EKRINMIAD | | EMNKLYERVR | | ERLVLATGLRN | |
| EKRINMIND | | EKRINMIND | | EMNRLFERVR | | ERMCNILKGKF | |
| EKRINMISD | | EKRINMISD | | EMRRCLLQSL | | ERMVLSAFDER | |
| EKRINMLAD | | EKRINMLAD | | EMRTFSFQLI | | ERMYQKCCNLF | |
| EKRINVIND | | EKRINVIND | | EMSFQGRGVF | | ERNALGDCPKY | |
| EKRLENLDK | | EKRLENLDK | | EMSKLFERVR | | ERNALGNCPKY | |
| EKRLENLNK | | EKRLENLNK | | EMSKLYERVK | | ERNDLYGTQSL | |
| EKRLGNLNK | | EKRLGNLNK | | EMSKLYERVR | | ERNITEIVYLN | |
| EKRRKKRGL | | EKRRKKRGL | | EMTFHGAKEV | | ERNSIWTSSSS | |
| EKRTNMIND | | EKRTNMIND | | EMTLDFHDSN | | ERNVTETLYLN | |
| EKSHPGIFE | | EKSHPGIFE | | EMVWDANGWV | | ERNVTVTHAKD | |
| EKSNKIKSE | | EKSNKIKSE | | EMVWDPNGWT | | ERNVTVTHAKN | |
| EKSRINGVK | | EKSRINGVK | | EMWSYNAELL | | ERNVTVTHAQD | |
| EKTHIHIFS | | EKTHIHIFS | | ENAEDIGNGC | | ERNVTVTHSVE | |
| EKTHNGKLC | | EKTHNGKLC | | ENAEDKGNGC | | ERNVTVTHSVN | |
| EKTHNGRLC | | EKTHNGRLC | | ENAEDMGDGC | | ERPKEIEGICY | |
| EKTIWTSGS | | EKTIWTSGS | | ENAEDMGGGC | | ERPKEMEGICY | |
| EKTLDLHDS | | EKTLDLHDS | | ENAEDMGNGC | | ERPKEMEGVCY | |
| EKTMKEYGE | | EKTMKEYGE | | ENAEDQGNGC | | ERPSAPEGMCY | |
| EKTNDKYHQ | | EKTNDKYHQ | | ENAEDRGNGC | | ERPTAVDTCYP | |
| EKTNEKFHQ | | EKTNEKFHQ | | ENAEEDCTGC | | ERQIGNVINWT | |
| EKTNEKYHQ | | EKTNEKYHQ | | ENAEEDGNGC | | ERQKINGVKLE | |
| EKTNKQFEL | | EKTNKQFEL | | ENAEEDGTGC | | ERQKISGVKLE | |
| EKTNQQFEL | | EKTNQQFEL | | ENAEEMGNGC | | ERQKVNGVKLE | |
| EKTNQQFKL | | EKTNQQFKL | | ENAIDAGDGC | | ERQRINGVKLE | |
| EKTNTEFES | | EKTNTEFES | | ENAIDNGDGC | | ERQTRGIFGAI | |
| EKTNTQFEL | | EKTNTQFEL | | ENAIDTGDGC | | ERQTRGLFGAI | |
| EKTSWSYIV | | EKTSWSYIV | | ENALDTGDGC | | ERRIENLNKKM | |
| EKVDTIIEN | | EKVDTIIEN | | ENATATVYYN | | ERRIENLNRKM | |
| EKVDTIIES | | EKVDTIIES | | ENAVDTGDGC | | ERRIESLNKKM | |
| EKVDTLLEN | | EKVDTLLEN | | ENDKTLDLHD | | ERRINMLADRI | |
| EKVDTLLES | | EKVDTLLES | | ENDKTLDMHD | | ERRLTTTIKTW | |
| EKVEGRIQD | | EKVEGRIQD | | ENDKTLNMHD | | ERRNKYLEEHP | |
| EKVHNGKLC | | EKVHNGKLC | | ENDRTLDLHD | | ERRNRYLEEHP | |
| EKVKILARN | | EKVKILARN | | ENDVWMGRTI | | ERRNSSDICYP | |
| EKVKILPKD | | EKVKILPKD | | ENEKTLDLHD | | ERRRKKRGLFG | |
| EKVKILPRD | | EKVKILPRD | | ENEMTLDFHD | | ERRVENLNKKM | |
| EKVNTLLEN | | EKVNTLLEN | | ENERILDFHD | | ERSKINEVKLE | |
| EKVRILPKD | | EKVRILPKD | | ENERTLDFHD | | ERSKINGVILE | |
| EKVRLQLRD | | EKVRLQLRD | | ENERTLDLHD | | ERSKINGVKLE | |
| EKVRMQLRD | | EKVRMQLRD | | ENERTLDMHD | | ERSKINGVRLE | |
| EKVRNGTYD | | EKVRNGTYD | | ENERTLDQHD | | ERTIWTSGSSI | |
| EKVRRQLRE | | EKVRRQLRE | | ENERTLDYHD | | ERTKEMEGICY | |
| EKVTNATET | | EKVTNATET | | ENERTLEFHD | | ERTLDFHDFNV | |
| EKVWWTSNS | | EKVWWTSNS | | ENERTLYFHD | | ERTLDFHDSNV | |
| EKWPIGESP | | EKWPIGESP | | ENGDIIFLWG | | ERTLDFHESNV | |

Fig. 83-73

| Block size 8 | SIN | Block size 9 | SIN | Block size 10 | SIN | Block size 11 | SIN |
|---|---|---|---|---|---|---|---|
| EKYGSGRIF | | EKYGSGRIF | | ENGNGCFELY | | ERTLDLHDANV | |
| EKYGTGRIF | | EKYGTGRIF | | ENGRTLDLHD | | ERTLDLHDSNV | |
| EKYHQIEKE | | EKYHQIEKE | | ENGRTLDMHD | | ERTLDMHDANV | |
| EKYVEDTKI | | EKYVEDTKI | | ENGRTLGLHD | | ERTLDQHDANV | |
| EKYVEDTKV | | EKYVEDTKV | | ENGTSVKTLT | | ERTLDYHDSNV | |
| ELAEKAMKE | | ELAEKAMKE | | ENGTYDYPKY | | ERTLGFHDSNV | |
| ELAEKTMKE | | ELAEKTMKE | | ENGVPVTSSI | | ERTLYFHDSNV | |
| ELAERAMKE | | ELAERAMKE | | ENGVPVTSSV | | ERTNEKFHQIE | |
| ELCPKPLKL | | ELCPKPLKL | | ENGWEGLIDG | | ERTNEKYHQIE | |
| ELCPSPLKL | | ELCPSPLKL | | ENGWEGLING | | ERTNQQFELID | |
| ELCPSPLRL | | ELCPSPLRL | | ENGWEGLVDG | | ERTSIWTSSSS | |
| ELCSSPLRL | | ELCSSPLRL | | ENGWEGMIDG | | ERTTFESNGGL | |
| ELCTINSWH | | ELCTINSWH | | ENGWEGMMDG | | ERVKKQLRENA | |
| ELDEIGEDI | | ELDEIGEDI | | ENGWEGMVDG | | ERVKMFDFIKW | |
| ELDEIGEDL | | ELDEIGEDL | | ENGWEGMVNG | | ERVKMFDFSKW | |
| ELDEIGEDV | | ELDEIGEDV | | ENGWQGLIDG | | ERVKMFDFTKW | |
| ELDNNGELR | | ELDNNGELR | | ENIAPEKVDF | | ERVKRQLRENA | |
| ELEIGARIG | | ELEIGARIG | | ENKHSNGTKH | | ERVRHQLRENA | |
| ELEIGTRIG | | ELEIGTRIG | | ENKKYGPALS | | ERVRKQLRENA | |
| ELFHKCDDD | | ELFHKCDDD | | ENKRYGPALS | | ERVRKQLRQNA | |
| ELFVLMENE | | ELFVLMENE | | ENKYVNNTTI | | ERVRNGTYDHK | |
| ELGAPLVLD | | ELGAPLVLD | | ENLDKKMEDG | | ERVRRQLRENA | |
| ELGDAPFLD | | ELGDAPFLD | | ENLEELRFVF | | ERYVEDTKIDL | |
| ELGDCSIAG | | ELGDCSIAG | | ENLFDEVRRR | | ESADMSIGITV | |
| ELGDCSITG | | ELGDCSITG | | ENLNKKIDDG | | ESADMSIGVAV | |
| ELGIPFHLG | | ELGIPFHLG | | ENLNKKMEDG | | ESADMSIGVTV | |
| ELGNGCFEF | | ELGNGCFEF | | ENLNKKVDDG | | ESAVLRGFLII | |
| ELGSPLVLD | | ELGSPLVLD | | ENLNKKVEDG | | ESAVLRGFLIL | |
| ELGVPFHLA | | ELGVPFHLA | | ENLNKRVDDG | | ESCEGECFYSG | |
| ELGVPFHLG | | ELGVPFHLG | | ENLNRKMEDG | | ESDEALKMTIA | |
| ELGVPFYLG | | ELGVPFYLG | | ENLNRKVDDG | | ESDGAFLAPRY | |
| ELGVSFHLG | | ELGVSFHLG | | ENLQAYQKRM | | ESDGNFIAPEN | |
| ELIDNEFNE | | ELIDNEFNE | | ENLQAYQNRM | | ESECACINGSC | |
| ELIDNEFSE | | ELIDNEFSE | | ENLQTYQKRM | | ESECACVNGSC | |
| ELIDNEFTE | | ELIDNEFTE | | ENLSKRMEDG | | ESECICINGTC | |
| ELIDSEFNE | | ELIDSEFNE | | ENLWAYNAEL | | ESECVCHDGVC | |
| ELIGKTSWS | | ELIGKTSWS | | ENMAPEKIDF | | ESECVCHKGIC | |
| ELINNEFNE | | ELINNEFNE | | ENMAPEKMDF | | ESECVCHKGVC | |
| ELINPNKWG | | ELINPNKWG | | ENMAPEKVDF | | ESECVCHNGIC | |
| ELINPSKWG | | ELINPSKWG | | ENNTWGNQTY | | ESECVCHNGTC | |
| ELIPPSKWG | | ELIPPSKWG | | ENNTWVNQTF | | ESECVCHNGVC | |
| ELIRGMPKE | | ELIRGMPKE | | ENNTWVNQTY | | ESECVCHNSTC | |
| ELIRGMPQE | | ELIRGMPQE | | ENNVTVTSSV | | ESECVCHSGIC | |
| ELIRGQPKE | | ELIRGQPKE | | ENPAHKSQLI | | ESECVCINGIC | |
| ELIRGRKQE | | ELIRGRKQE | | ENPAHKSQLV | | ESECVCINGSC | |
| ELIRGRPEE | | ELIRGRPEE | | ENPSAGKDPK | | ESECVCINGTC | |
| ELIRGRPKE | | ELIRGRPKE | | ENPSHEGEGI | | ESECVCISGTC | |
| ELIRGRPQE | | ELIRGRPQE | | ENPVHKSQLI | | ESECVCMNGSC | |
| ELIRGRPRE | | ELIRGRPRE | | ENPVICLGHH | | ESECVCQDEFC | |
| ELIRGRQQE | | ELIRGRQQE | | ENQEELKSLF | | ESECVCVNGSC | |
| ELIRGRSQE | | ELIRGRSQE | | ENQEELRFLF | | ESECVRHNGTC | |
| ELIRMIKRG | | ELIRMIKRG | | ENQEELRSLF | | ESEFNEIEHQI | |
| ELIRMVKRG | | ELIRMVKRG | | ENQHIIDLAD | | ESEFNEIEYQI | |
| ELISPNKWG | | ELISPNKWG | | ENQHTIDLAD | | ESEFSEIEHQI | |
| ELISPSKWG | | ELISPSKWG | | ENQHTIDLAE | | ESEFSETEHQI | |
| ELIVLLENQ | | ELIVLLENQ | | ENQHTIDLTD | | ESEMNKLYERV | |
| ELKEQLSTV | | ELKEQLSTV | | ENQHTIDLTN | | ESEQIIVTREP | |
| ELKHLLNRI | | ELKHLLNRI | | ENQHTIDMAD | | ESEQIVVTREP | |
| ELKHLLSRI | | ELKHLLSRI | | ENQHTIDMTD | | ESEQVIVTREP | |
| ELKHLLSRT | | ELKHLLSRT | | ENQHTIDSTD | | ESGGIDKEPMG | |
| ELKHLLSST | | ELKHLLSST | | ENQHTIDVTD | | ESGGIDKESMG | |
| ELKHLMSST | | ELKHLMSST | | ENQHTIEMTD | | ESGRLIDFLKD | |

Fig. 83-74

| Block size 8 | SIN | Block size 9 | SIN | Block size 10 | SIN | Block size 11 | SIN |
|---|---|---|---|---|---|---|---|
| ELKSLFSSI | | ELKSLFSSI | | ENQHTIHLTD | | ESGRLMDFLKD | |
| ELKWLISKS | | ELKWLISKS | | ENQKILDEHD | | ESHCRIIQNED | |
| ELKWLVSKD | | ELKWLVSKD | | ENQKPLDEHD | | ESHGKIIQNED | |
| ELKWLVSKN | | ELKWLVSKN | | ENQKTLDEHD | | ESHGRIIQNED | |
| ELKWLVSKS | | ELKWLVSKS | | ENQKTLDEHE | | ESHGRTIQNED | |
| ELKWLVSKT | | ELKWLVSKT | | ENQKTLDEHV | | ESIAWSATACH | |
| ELLHKCNDS | | ELLHKCNDS | | ENQKTLDKHD | | ESIEECLINDP | |
| ELLHKCNNS | | ELLHKCNNS | | ENQNPRIFLA | | ESIESEFNEIE | |
| ELLHKCNNT | | ELLHKCNNT | | ENQNPRMFLA | | ESIESEFSEIE | |
| ELLIAMENQ | | ELLIAMENQ | | ENQNPRVFLA | | ESIESEFSETE | |
| ELLILLENE | | ELLILLENE | | ENQNPRVFLT | | ESIIEAESSVK | |
| ELLVALENQ | | ELLVALENQ | | ENQSPRMFLA | | ESIKNGTYDYP | |
| ELLVAMENQ | | ELLVAMENQ | | ENRINMLADR | | ESIRDNTYDHT | |
| ELLVLIENE | | ELLVLIENE | | ENRMVIASTT | | ESIRNGTYDHD | |
| ELLVLIENQ | | ELLVLIENQ | | ENRMVLASTT | | ESIRNGTYDHN | |
| ELLVLLENE | | ELLVLLENE | | ENRVWWTSNS | | ESIRNGTYNHD | |
| ELLVLLENQ | | ELLVLLENQ | | ENSDVLVTRE | | ESIRNGTYNHN | |
| ELLVLLGNQ | | ELLVLLGNQ | | ENSFEQITFI | | ESIRNNTYDHA | |
| ELLVLMENE | | ELLVLMENE | | ENSFEQITFL | | ESIRNNTYDHS | |
| ELNNNGELR | | ELNNNGELR | | ENSFEQITFM | | ESIRNNTYDHT | |
| ELPFQNLSP | | ELPFQNLSP | | ENSQGSGYAA | | ESIRNNTYNHT | |
| ELPFTIDKS | | ELPFTIDKS | | ENSTYKILSI | | ESKCFWKGGSI | |
| ELPFTIDKY | | ELPFTIDKY | | ENTGSYVRLY | | ESKCFWKGGTI | |
| ELPSFGVSG | | ELPSFGVSG | | ENTHIHIFSF | | ESKCFWKSGSI | |
| ELRDCKIEA | | ELRDCKIEA | | ENTSYKILSI | | ESKCFWRGGSI | |
| ELRDCKVEA | | ELRDCKVEA | | ENTTWVNQTY | | ESKINRQEIEG | |
| ELRDCSIAG | | ELRDCSIAG | | ENTTYKILSI | | ESKLKRNEIKG | |
| ELREHLSSV | | ELREHLSSV | | ENTTYRILSI | | ESKLKRQEIDG | |
| ELREQLSSV | | ELREQLSSV | | ENTYVNKTTV | | ESKLKRQEIEG | |
| ELREQLSTV | | ELREQLSTV | | ENTYVNNTTI | | ESKLKRQEING | |
| ELRFLFSSI | | ELRFLFSSI | | ENTYVNNTTV | | ESKLNRNEIKG | |
| ELRFVFSIA | | ELRFVFSIA | | EPALIVWGVH | | ESKLNRQEIEG | |
| ELRFVFSNA | | ELRFVFSNA | | EPDECRFYAL | | ESKLNRQEIGG | |
| ELRFVFSSA | | ELRFVFSSA | | EPDTYDFNEG | | ESKLNRSEIKG | |
| ELRHLFSGI | | ELRHLFSGI | | EPFISCSHFE | | ESKLNRTEIKG | |
| ELRHLFSGV | | ELRHLFSGV | | EPFISCSHLE | | ESLLLATGMKN | |
| ELRRCLLQS | | ELRRCLLQS | | EPFISCSHME | | ESLLNRLSINP | |
| ELRRIWRQA | | ELRRIWRQA | | EPFISCSHSE | | ESLMLATGMKN | |
| ELRRQKSLI | | ELRRQKSLI | | EPFISCSPLE | | ESLNKKMEDGF | |
| ELRRQKWWV | | ELRRQKWWV | | EPFISCSQLE | | ESLQNRIQIDP | |
| ELRSGYWAI | | ELRSGYWAI | | EPFQSLIPKA | | ESLQNRIQIDQ | |
| ELRSKYWAI | | ELRSKYWAI | | EPFQSLVPKA | | ESLQNRIQIDS | |
| ELRSLFSSI | | ELRSLFSSI | | EPFQSLVPRA | | ESLQNRIQIGP | |
| ELRSRYWAI | | ELRSRYWAI | | EPFVACGPAE | | ESLRLAIGLRN | |
| ELSFTITGD | | ELSFTITGD | | EPFVACGPSE | | ESLRLALGLRN | |
| ELSFTVTGD | | ELSFTVTGD | | EPFVACGPTE | | ESLRLAVGLRN | |
| ELSSGYKDV | | ELSSGYKDV | | EPFVACSPSE | | ESLSISVGSST | |
| ELSSMGVYQ | | ELSSMGVYQ | | EPFVSCGPSE | | ESMGFRYSGIR | |
| ELVETNHTD | | ELVETNHTD | | EPFVSCSHLE | | ESMIEAESSIK | |
| ELVHGGIDP | | ELVHGGIDP | | EPGSGDWPDG | | ESMIEAESSVK | |
| ELVHGGINP | | ELVHGGINP | | EPGSGNWPDG | | ESMIEAESSVR | |
| ELVHGGVDP | | ELVHGGVDP | | EPGTFDIEGL | | ESMVEAESSVK | |
| ELVHGQVNP | | ELVHGQVNP | | EPGTFDIGGL | | ESNGAFIAPRY | |
| ELVHRGIDP | | ELVHRGIDP | | EPGTFDLEGL | | ESNGAFLAPRY | |
| ELVRGRPKE | | ELVRGRPKE | | EPGTFDLGGL | | ESNGALLAPRY | |
| ELVRKTRFL | | ELVRKTRFL | | EPGVKGFGFK | | ESNGGFLAPRY | |
| ELVRMIKRG | | ELVRMIKRG | | EPISLGDCSF | | ESNGGLIAPRY | |
| ELWAYNAEL | | ELWAYNAEL | | EPKGLFGAIA | | ESNGGLLAPKY | |
| ELWQCYYLL | | ELWQCYYLL | | EPLCDVSGFA | | ESNGGLLAPRY | |
| ELWSYNAEL | | ELWSYNAEL | | EPLCEVSGFA | | ESNGNFIAPEN | |
| ELYGTQSLS | | ELYGTQSLS | | EPLCEVSGFV | | ESNGNFIAPEY | |
| | | | | EPLCNVSGFA | | ESNGNFITPEY | |

Fig. 83-75

| Block size 8 | SIN | Block size 9 | SIN | Block size 10 | SIN | Block size 11 | SIN |
|---|---|---|---|---|---|---|---|
| EMCAAWSSS | | EMCAAWSSS | | EPMGFRYSGI | | ESNGNLIAPEY | |
| EMCHGTQIG | | EMCHGTQIG | | EPNGCIEGKL | | ESNGNLIAPWY | |
| EMCHSTQIG | | EMCHSTQIG | | EPNGCIESKL | | ESNGNLVAPWY | |
| EMCHSTRIG | | EMCHSTRIG | | EPNGSIEGKL | | ESNGVFLAPRY | |
| EMDKLFERV | | EMDKLFERV | | EPNGYIEGKL | | ESNITVTSSVE | |
| EMDKLYERV | | EMDKLYERV | | EPRGLFGAIA | | ESNVTVTSSIE | |
| EMDKLYTRV | | EMDKLYTRV | | EPSGYAQTDC | | ESNVTVTSSVE | |
| EMEGICYPG | | EMEGICYPG | | EPTGYAQTDC | | ESQLKKQEIEG | |
| EMEGVCYPG | | EMEGVCYPG | | EPYPGNNNNG | | ESQLKRQEIEG | |
| EMGLAPSPY | | EMGLAPSPY | | EPYVSCDPDE | | ESRARIKTRLF | |
| EMGNGCFEF | | EMGNGCFEF | | EPYVSCDPDG | | ESRGLFGAIAG | |
| EMGNGCFKI | | EMGNGCFKI | | EPYVSCDPLG | | ESRINRQEIEG | |
| EMGQAPSPY | | EMGQAPSPY | | EPYVSCDPNE | | ESRKLLLIAQA | |
| EMIDNEFNE | | EMIDNEFNE | | EPYVSCDPSG | | ESRKLLLITQA | |
| EMIRGEPEE | | EMIRGEPEE | | EPYVSCDPTG | | ESRKLLLIVQA | |
| EMIRGKPEE | | EMIRGKPEE | | EPYVSCEPDE | | ESRKLLLVVQA | |
| EMIRGKPKE | | EMIRGKPKE | | EQAAEAIEVA | | ESRKMLLIVQA | |
| EMIRGQPKE | | EMIRGQPKE | | EQAAEAMDIA | | ESRLNRNEIKG | |
| EMIRGRPEE | | EMIRGRPEE | | EQAAEAMEIA | | ESRLNRQEIEG | |
| EMIWDANGW | | EMIWDANGW | | EQAAEAMEVA | | ESRNPGNAEIE | |
| EMIWDPDGW | | EMIWDPDGW | | EQAVDICKAA | | ESRSGFEMIWD | |
| EMIWDPNGW | | EMIWDPNGW | | EQAVGICKAA | | ESRSGFEMVWD | |
| EMKKLYERV | | EMKKLYERV | | EQAVNICKAA | | ESRSGYETFKV | |
| EMKWLLSNA | | EMKWLLSNA | | EQEEVTNATE | | ESRSNIFNMER | |
| EMKWLLSNN | | EMKWLLSNN | | EQFPVQTDEY | | ESRSPGNAEIE | |
| EMKWLLSNS | | EMKWLLSNS | | EQFTWNGVKV | | ESSFEQITFMQ | |
| EMKWLLSNT | | EMKWLLSNT | | EQGMGMAADK | | ESSFYAEMEWL | |
| EMKWLLSSK | | EMKWLLSSK | | EQGSGYAADK | | ESSFYAEMKWL | |
| EMKWLLSSS | | EMKWLLSSS | | EQGSGYAADL | | ESSGGLLAPRY | |
| EMKWLLSST | | EMKWLLSST | | EQGSGYAADQ | | ESSIGKVCRTL | |
| EMKWLSSSG | | EMKWLSSSG | | EQGSGYAADR | | ESSIKEKDMTK | |
| EMKWLSSSM | | EMKWLSSSM | | EQGTGIAADK | | ESSTYQNNFVP | |
| EMLKIHNAG | | EMLKIHNAG | | EQGTGIAAEK | | ESSVKEKDLTK | |
| EMLKIPNAE | | EMLKIPNAE | | EQGVGIAADK | | ESSVKEKDMTK | |
| EMLKIPNAG | | EMLKIPNAG | | EQGVGMAADK | | ESSVKEKDMTR | |
| EMLKVPDAE | | EMLKVPDAE | | EQIADAQHRS | | ESSVREKDMTK | |
| EMLKVPNAE | | EMLKVPNAE | | EQIADSHHRS | | ESTGNFIAPEY | |
| EMLKVPNAG | | EMLKVPNAG | | EQIADSQHKS | | ESTGNLIAPEY | |
| EMLKVPNAL | | EMLKVPNAL | | EQIADSQHRS | | ESTGNLVAPEY | |
| EMLNLYDRV | | EMLNLYDRV | | EQIIVTREPY | | ESTQAAIDQIT | |
| EMLNLYERV | | EMLNLYERV | | EQITFIQALQ | | ESTQKAIDQIT | |
| EMLRIPNAG | | EMLRIPNAG | | EQITFLQALQ | | ESTQKAIDRIT | |
| EMLTGNLQT | | EMLTGNLQT | | EQITFMQALQ | | ESVAWSASACH | |
| EMNKLFEKT | | EMNKLFEKT | | EQIVVTREPY | | ESVAWSATACH | |
| EMNKLFERT | | EMNKLFERT | | EQKQEFKMNP | | ESVAWSATACS | |
| EMNKLFERV | | EMNKLFERV | | EQKVPVTQTM | | ESVGWSATACH | |
| EMNKLYEKV | | EMNKLYEKV | | EQLGSWSWHD | | ESVKNGTYDYP | |
| EMNKLYERV | | EMNKLYERV | | EQLSQKFEEI | | ESVKNGTYNYP | |
| EMNRLFERV | | EMNRLFERV | | EQLSSVSSFE | | ESVLINTYQWI | |
| EMRRCLLQS | | EMRRCLLQS | | EQLSSVSSFK | | ESVLVNTYQWI | |
| EMRTFSFQL | | EMRTFSFQL | | EQLSTVSSFE | | ESVLVNTYQWV | |
| EMSFQGRGV | | EMSFQGRGV | | EQLYTPGGEV | | ESVRNGTYDYP | |
| EMSKLFEKT | | EMSKLFEKT | | EQMAGSSEQA | | ESYGRIIQNED | |
| EMSKLFERT | | EMSKLFERT | | EQMETDGDRQ | | ETCSALFVYSL | |
| EMSKLFERV | | EMSKLFERV | | EQMETDGERQ | | ETEHQIGNVIN | |
| EMSKLYERV | | EMSKLYERV | | EQMETGGERQ | | ETEQTKLYKNT | |
| EMTDSEMLN | | EMTDSEMLN | | EQMETSGERQ | | ETFKVIGGWST | |
| EMTFHGAKE | | EMTFHGAKE | | EQMYQKCCNL | | ETFKVIGGWTT | |
| EMTLDFHDS | | EMTLDFHDS | | EQMYQKCCSL | | ETFRVIGGWAT | |
| EMVWDANGW | | EMVWDANGW | | EQMYQKCCTL | | ETFRVIGGWTT | |
| EMVWDPNGW | | EMVWDPNGW | | EQMYQRCCNL | | ETFRVIGGWVT | |
| EMWPIGESP | | EMWPIGESP | | EQMYTPGGEV | | ETFVNMTNVQN | |

Fig. 83-76

| Block size 8 | SIN | Block size 9 | SIN | Block size 10 | SIN | Block size 11 | SIN |
|---|---|---|---|---|---|---|---|
| EMWSYNAEL | | EMWSYNAEL | | EQMYTPGGGV | | ETFVNVTHVQN | |
| EMYNETVRV | | EMYNETVRV | | EQMYTPGGKV | | ETFVNVTNVQN | |
| ENAEDIGNG | | ENAEDIGNG | | EQNIPVTQTM | | ETGALQLNPID | |
| ENAEDKGNG | | ENAEDKGNG | | EQNIPVTQVE | | ETGAPQLNPID | |
| ENAEDMGDG | | ENAEDMGDG | | EQNKLYGAGN | | ETGAPQLNPVD | |
| ENAEDMGGG | | ENAEDMGGG | | EQNKLYGTGN | | ETGNGCFEFYH | |
| ENAEDMGNG | | ENAEDMGNG | | EQNVPVTQAM | | ETGVPVTSSVD | |
| ENAEDQGNG | | ENAEDQGNG | | EQNVPVTQTM | | ETGYICSKFHS | |
| ENAEDRGNG | | ENAEDRGNG | | EQNVPVTQVE | | ETGYVCGKFHS | |
| ENAEEDCTG | | ENAEEDCTG | | EQNVTVTHAK | | ETGYVCSKFHS | |
| ENAEEDGNG | | ENAEEDGNG | | EQQGRMDYYW | | ETIIETGYVCS | |
| ENAEEDGTG | | ENAEEDGTG | | EQQIGNVINW | | ETIKNGTYDHK | |
| ENAEEMGNG | | ENAEEMGNG | | EQRINMLADR | | ETIKNGTYNHK | |
| ENAIDAGDG | | ENAIDAGDG | | EQSGLPVGGN | | ETIKNGTYNRK | |
| ENAIDNGDG | | ENAIDNGDG | | EQTALYKNAN | | ETILETGYICS | |
| ENAIDTGDG | | ENAIDTGDG | | EQTDLYKVAT | | ETILETGYVCG | |
| ENALDTGDG | | ENALDTGDG | | EQTKLYGNGN | | ETILETGYVCS | |
| ENATASFIY | | ENATASFIY | | EQTKLYGSGN | | ETILETRYVCS | |
| ENATATVYY | | ENATATVYY | | EQTKLYGSGS | | ETIRNGTYNHE | |
| ENAVDTGDG | | ENAVDTGDG | | EQTKLYKNTN | | ETIVETGYVCS | |
| ENDKTLDLH | | ENDKTLDLH | | EQTTLYKNAN | | ETKAPQLNPID | |
| ENDKTLDMH | | ENDKTLDMH | | EQVAGSSEQA | | ETKCQSPLGAI | |
| ENDKTLNMH | | ENDKTLNMH | | EQVDTIMEKN | | ETKCQTPLGAI | |
| ENDRTLDLH | | ENDRTLDLH | | EQVDTIMERN | | ETKCQTPLGAL | |
| ENDVPVTSS | | ENDVPVTSS | | EQVEGRIQDL | | ETKGLFGAIAG | |
| ENDVWMGRT | | ENDVWMGRT | | EQVEGRIQYL | | ETLKIRTNGNL | |
| ENEKTLDLH | | ENEKTLDLH | | EQVEGRTQDL | | ETLKVESNGNL | |
| ENEMTLDFH | | ENEMTLDFH | | EQVIVTREPY | | ETLNIESNGNL | |
| ENERTLDFH | | ENERTLDFH | | EREAKLFVLF | | ETLNVESNGNL | |
| ENERTLDLH | | ENERTLDLH | | EREGGRRRKR | | ETNGNYGPINV | |
| ENERTLDMH | | ENERTLDMH | | EREGYSLVGI | | ETNHTDELCPS | |
| ENERTLDQH | | ENERTLDQH | | EREGYSLVGV | | ETNHTGTYCSL | |
| ENERTLDYH | | ENERTLDYH | | ERELVRKTRF | | ETNKFAAICTH | |
| ENERTLGFH | | ENERTLGFH | | EREVEVVNAT | | ETNKFAAVCTH | |
| ENERTLYFH | | ENERTLYFH | | ERGEDTIEER | | ETNKFASICTH | |
| ENFVRQCFN | | ENFVRQCFN | | ERGEETIEEK | | ETNKLAAICTH | |
| ENGDIIFLW | | ENGDIIFLW | | ERGEETIEER | | ETQCQTPLGAI | |
| ENGNGCFEL | | ENGNGCFEL | | ERGEETVEER | | ETQTRGIFGAI | |
| ENGRTLDLH | | ENGRTLDLH | | ERGIEVVNAT | | ETRGLFGAIAG | |
| ENGRTLDMH | | ENGRTLDMH | | ERGKLKRRAI | | ETRVWWTSNSI | |
| ENGRTLGLH | | ENGRTLGLH | | ERGLFGAIAG | | ETRVWWTSSSI | |
| ENGTSVKTL | | ENGTSVKTL | | ERGLQRRRFI | | ETSHTGTYCSL | |
| ENGTYDYPK | | ENGTYDYPK | | ERGLQRRRFV | | ETTGRNCTIPC | |
| ENGVPVTSS | | ENGVPVTSS | | ERGNHGVKGW | | ETTGRNCTVPC | |
| ENGVPVTST | | ENGVPVTST | | ERGNPGVKGW | | ETTHTGTYCSL | |
| ENGWEGLID | | ENGWEGLID | | ERGNQGVKGW | | ETTVWWTSNSI | |
| ENGWEGLIN | | ENGWEGLIN | | ERGSPGVKGW | | ETVEITGIDKV | |
| ENGWEGLVD | | ENGWEGLVD | | ERGTKQEENL | | ETVEITGINKV | |
| ENGWEGMID | | ENGWEGMID | | ERGTQGVKGW | | ETYKILTIYST | |
| ENGWEGMMD | | ENGWEGMMD | | ERGVEVVDAT | | ETYVLSIIPSG | |
| ENGWEGMVD | | ENGWEGMVD | | ERGVEVVNAT | | ETYVLSIVPSG | |
| ENGWEGMVN | | ENGWEGMVN | | ERILDFHDSN | | ETYVLSVIPSG | |
| ENGWQGLID | | ENGWQGLID | | ERILEEESDE | | EVCFMYSDFHF | |
| ENIAPEKVD | | ENIAPEKVD | | ERIMFESNGG | | EVCIAWSSSSC | |
| ENKHSNGTK | | ENKHSNGTK | | ERIRNNTYDH | | EVDNNGELRHL | |
| ENKKYGPAL | | ENKKYGPAL | | ERITFESNGG | | EVDQSLIIAAR | |
| ENKRYGPAL | | ENKRYGPAL | | ERITFESSGG | | EVEGRIQDLEK | |
| ENKYVNNTT | | ENKYVNNTT | | ERLGSWSWHD | | EVEGRIQDLER | |
| ENLDKKMED | | ENLDKKMED | | ERLTITYSSS | | EVEKQIGNVIN | |
| ENLEELRFV | | ENLEELRFV | | ERLVLATGLR | | EVEKQLGNVIN | |
| ENLFDEVRR | | ENLFDEVRR | | ERMCNILKGK | | EVEQQIGNVIN | |
| ENLIAPWYG | | ENLIAPWYG | | ERMVLSAFDE | | EVERQIGNVIN | |

Fig. 83-77

| Block size 8 | SIN | Block size 9 | SIN | Block size 10 | SIN | Block size 11 | SIN |
|---|---|---|---|---|---|---|---|
| ENLNKKIDD | | ENLNKKIDD | | ERMYQKCCNL | | EVETYVLSIIP | |
| ENLNKKMED | | ENLNKKMED | | ERNALGDCPK | | EVETYVLSIVP | |
| ENLNKKVDD | | ENLNKKVDD | | ERNALGNCPK | | EVETYVLSVIP | |
| ENLNKKVED | | ENLNKKVED | | ERNDLYGTQS | | EVEVVNATETV | |
| ENLNKRMED | | ENLNKRMED | | ERNITEIVYL | | EVFVIREPCIS | |
| ENLNKRVDD | | ENLNKRVDD | | ERNVTETLYL | | EVFVIREPFIS | |
| ENLNRKMED | | ENLNRKMED | | ERNVTVTHAK | | EVFVIREPFVS | |
| ENLNRKVDD | | ENLNRKVDD | | ERNVTVTHAQ | | EVGAKILTSES | |
| ENLQAYQKR | | ENLQAYQKR | | ERNVTVTHSV | | EVGARIITSES | |
| ENLQTYQKR | | ENLQTYQKR | | ERPKEIEGIC | | EVGARILASES | |
| ENLWAYNAE | | ENLWAYNAE | | ERPKEMEGIC | | EVGARILTSES | |
| ENMAPEKID | | ENMAPEKID | | ERPKEMEGVC | | EVGNGCFEFYH | |
| ENMAPEKMD | | ENMAPEKMD | | ERPSAPEGMC | | EVGTRWMKIIR | |
| ENMAPEKVD | | ENMAPEKVD | | ERPSIWTSSS | | EVGYLCAGIPT | |
| ENNTWGNQT | | ENNTWGNQT | | ERPTAVDTCY | | EVILWFSFGAS | |
| ENNTWVNQT | | ENNTWVNQT | | ERQIGNVINW | | EVITAQELVES | |
| ENNVPVTSS | | ENNVPVTSS | | ERQKINGVKL | | EVKYVWWTSNS | |
| ENNVTVTSS | | ENNVTVTSS | | ERQKISGVKL | | EVLDNKNWSGY | |
| ENPAHKSQL | | ENPAHKSQL | | ERQKVNGVKL | | EVLFQGGHIEE | |
| ENPSAGKDP | | ENPSAGKDP | | ERQRINGVKL | | EVLHLTQGACW | |
| ENPSHEGEG | | ENPSHEGEG | | ERQTRGIFGA | | EVLHLTQGTCW | |
| ENPVHKSQL | | ENPVHKSQL | | ERQTRGLFGA | | EVLNNKHWSGY | |
| ENQEELKSL | | ENQEELKSL | | ERRIENLNKK | | EVLNNKNWSGY | |
| ENQEELRFL | | ENQEELRFL | | ERRIENLNRK | | EVLNNMNWSGY | |
| ENQEELRSL | | ENQEELRSL | | ERRIESLNKK | | EVLRVPNALTD | |
| ENQHIIDLA | | ENQHIIDLA | | ERRINMLADR | | EVLTGNLQALK | |
| ENQHTIDLA | | ENQHTIDLA | | ERRLENLNKK | | EVLTGNLQTLK | |
| ENQHTIDLT | | ENQHTIDLT | | ERRLENLNKR | | EVLTGNLQTLR | |
| ENQHTIDMA | | ENQHTIDMA | | ERRLENLSKR | | EVLVLMENERT | |
| ENQHTIDMT | | ENQHTIDMT | | ERRNKYLEEH | | EVNGPESVLVN | |
| ENQHTIDVT | | ENQHTIDVT | | ERRNRYLEEH | | EVNSWHIFSKD | |
| ENQHTIHLT | | ENQHTIHLT | | ERRNSSDICY | | EVNSWHILSKD | |
| ENQKILDEH | | ENQKILDEH | | ERRRKKRGLF | | EVPGWSWDDGA | |
| ENQKPLDEH | | ENQKPLDEH | | ERSKINEVKL | | EVPGWSWGDGA | |
| ENQKTLDEH | | ENQKTLDEH | | ERSKINGVIL | | EVPSPYNSRFE | |
| ENQKTLDKH | | ENQKTLDKH | | ERSKINGVKL | | EVRHRLKITEN | |
| ENQNPRIFL | | ENQNPRIFL | | ERSKINGVRL | | EVRRDQMAHCR | |
| ENQNPRMFL | | ENQNPRMFL | | ERTHIHIFSF | | EVSFQGGHIEE | |
| ENQNPRVFL | | ENQNPRVFL | | ERTHNGKLCK | | EVSFQGRGVFE | |
| ENRINMLAD | | ENRINMLAD | | ERTIWTSGSS | | EVSFRGGHIEE | |
| ENRMVIAST | | ENRMVIAST | | ERTKEMEGIC | | EVSFRGRGVFE | |
| ENRMVLAST | | ENRMVLAST | | ERTLDFHDFN | | EVSHCRATEYI | |
| ENRVWWTSN | | ENRVWWTSN | | ERTLDFHDSN | | EVSHCRATEYM | |
| ENSDVLVTR | | ENSDVLVTR | | ERTLDFHDSS | | EVSSWHILSKD | |
| ENSFEQITF | | ENSFEQITF | | ERTLDFHESN | | EVSWTSNSIVT | |
| ENSHPGIFE | | ENSHPGIFE | | ERTLDLHDAN | | EVSYCRATEYI | |
| ENSQGSGYA | | ENSQGSGYA | | ERTLDLHDSN | | EVTNATELVQG | |
| ENSTYKILS | | ENSTYKILS | | ERTLDMHDAN | | EVTNATELVQI | |
| ENSVIEKMN | | ENSVIEKMN | | ERTLDMHDVN | | EVTNATELVQN | |
| ENSVLWTSN | | ENSVLWTSN | | ERTLDYHDSN | | EVTNATELVQS | |
| ENTGSYVRL | | ENTGSYVRL | | ERTLEFHDSN | | EVTNATETVEN | |
| ENTHIHIFS | | ENTHIHIFS | | ERTLYFHDSN | | EVTNATETVES | |
| ENTSYKILS | | ENTSYKILS | | ERTNEKFHQI | | EVTNATETVET | |
| ENTTWVNQT | | ENTTWVNQT | | ERTNEKYHQI | | EVVAAQELVES | |
| ENTTYKILS | | ENTNQQFELI | | ERTNQQFELI | | EVVDATETVER | |
| ENTTYRILS | | ENTTYRILS | | ERTSIWTSSS | | EVVFPNEVGAK | |
| ENTYVNKTT | | ENTYVNKTT | | ERTTFESNGG | | EVVFPNEVGAR | |
| ENTYVNNTT | | ENTYVNNTT | | ERVDTIIESN | | EVVNATETVEI | |
| EPALIVWGV | | EPALIVWGV | | ERVDTIMEKN | | EVVNATETVEN | |
| EPDECRFYA | | EPDECRFYA | | ERVKKQLREN | | EVVNATETVEQ | |
| EPDTYDFNE | | EPDTYDFNE | | ERVKMFDFIK | | EVVNATETVER | |
| EPFISCSHF | | EPFISCSHF | | ERVKMFDFSK | | EVVNATETVET | |

Fig. 83-78

| Block size 8 | SIN | Block size 9 | SIN | Block size 10 | SIN | Block size 11 | SIN |
|---|---|---|---|---|---|---|---|
| EPFISCSHL | | EPFISCSHL | | ERVKMFDFTK | | EVVSAKELVET | |
| EPFISCSHM | | EPFISCSHM | | ERVKRQLREN | | EVVTAQELVEA | |
| EPFISCSHS | | EPFISCSHS | | ERVRHQLREN | | EVVTAQELVEP | |
| EPFISCSPL | | EPFISCSPL | | ERVRKQLREN | | EVVTAQELVES | |
| EPFISCSQL | | EPFISCSQL | | ERVRKQLRQN | | EVWIGRTKSLE | |
| EPFQSLIPK | | EPFQSLIPK | | ERVRNGTYDH | | EVWSYNAEFLV | |
| EPFQSLVPK | | EPFQSLVPK | | ERVRRQLREN | | EVWSYNAELLV | |
| EPFQSLVPR | | EPFQSLVPR | | ERYVEDTKID | | EVWWTSNSIVS | |
| EPFVACGPA | | EPFVACGPA | | ESADMSIGIT | | EWGNGCFEFYH | |
| EPFVACGPS | | EPFVACGPS | | ESADMSIGVT | | EWIKTRPILSP | |
| EPFVACGPT | | EPFVACGPT | | ESAVLRGFLI | | EWLKTRPILSP | |
| EPFVACSPS | | EPFVACSPS | | ESCEGECFYS | | EWSGYSGSFVQ | |
| EPFVSCGPS | | EPFVSCGPS | | ESDEALKMTI | | EWSKRYELEIG | |
| EPFVSCSHL | | EPFVSCSHL | | ESDGAFLAPR | | EWSRRYELEIG | |
| EPGSGDWPD | | EPGSGDWPD | | ESECACINGS | | EWSWDDGAILP | |
| EPGSGNWPD | | EPGSGNWPD | | ESECACVNGS | | EWSYIIEKENP | |
| EPGTFDIEG | | EPGTFDIEG | | ESECICINGT | | EWSYIMEKENP | |
| EPGTFDIGG | | EPGTFDIGG | | ESECVCHKGI | | EWSYIVEKENP | |
| EPGTFDLEG | | EPGTFDLEG | | ESECVCHKGV | | EWSYIVERENP | |
| EPGTFDLGG | | EPGTFDLGG | | ESECVCHNGI | | EWSYIVERETP | |
| EPGVKGFGF | | EPGVKGFGF | | ESECVCHNGT | | EWSYIVERPKE | |
| EPISLGDCS | | EPISLGDCS | | ESECVCHNGV | | EWSYIVERTKE | |
| EPKGLFGAI | | EPKGLFGAI | | ESECVCHNST | | EWSYLIEDPAA | |
| EPLCDVSGF | | EPLCDVSGF | | ESECVCHSGI | | EWSYLIEDPGA | |
| EPLCEVSGF | | EPLCEVSGF | | ESECVCINGI | | EWSYLIEDPNA | |
| EPLCNVSGF | | EPLCNVSGF | | ESECVCINGS | | EWSYLIEDPSA | |
| EPLKGSAKH | | EPLKGSAKH | | ESECVCINGT | | EWSYLIEDPTA | |
| EPMGFRYSG | | EPMGFRYSG | | ESECVCISGT | | EWTSNSLIALC | |
| EPNGCIEGK | | EPNGCIEGK | | ESECVCMNGS | | EYAEESKLKRQ | |
| EPNGCIESK | | EPNGCIESK | | ESECVCQDEF | | EYASKTRISEI | |
| EPNGSIEGK | | EPNGSIEGK | | ESECVCQNGV | | EYDAVATTHSW | |
| EPNGYIEGK | | EPNGYIEGK | | ESECVCVNGS | | EYEEEAKLEKS | |
| EPRGLFGAI | | EPRGLFGAI | | ESECVRHNGT | | EYEEEAKLERS | |
| EPSGYAQTD | | EPSGYAQTD | | ESEFNEIEHQ | | EYEEESKLKRQ | |
| EPTGYAQTD | | EPTGYAQTD | | ESEFNEIEYQ | | EYGFKISKRGG | |
| EPYPGNNNN | | EPYPGNNNN | | ESEFSEIEHQ | | EYGFKISKRGN | |
| EPYVSCDPD | | EPYVSCDPD | | ESEFSETEHQ | | EYGFKISKRGS | |
| EPYVSCDPI | | EPYVSCDPI | | ESEMNKLYER | | EYGFRISKRGS | |
| EPYVSCDPK | | EPYVSCDPK | | ESEQIIVTRE | | EYGHLITGKSH | |
| EPYVSCDPL | | EPYVSCDPL | | ESEQIVVTRE | | EYGHLTTGKSH | |
| EPYVSCDPN | | EPYVSCDPN | | ESEQVIVTRE | | EYGHLVTGKSH | |
| EPYVSCDPS | | EPYVSCDPS | | ESGGIDKEPM | | EYGKGRIFQSH | |
| EPYVSCDPT | | EPYVSCDPT | | ESGGIDKESM | | EYGKGRIFQSP | |
| EPYVSCEPD | | EPYVSCEPD | | ESGGIDKIGT | | EYGKGRIFQSR | |
| EQAAEAIEV | | EQAAEAIEV | | ESGGIDKIST | | EYGRGRIFQSR | |
| EQAAEAMDI | | EQAAEAMDI | | ESGGIDKVST | | EYGYLITGKSH | |
| EQAAEAMEI | | EQAAEAMEI | | ESGGISKIST | | EYKDWILWISF | |
| EQAAEAMEV | | EQAAEAMEV | | ESGGISKMST | | EYNGKSLGIQS | |
| EQAKLYGSG | | EQAKLYGSG | | ESGRLIDFLK | | EYNNTTGRDVL | |
| EQAVDICKA | | EQAVDICKA | | ESGRLMDFLK | | EYQIGNVINWT | |
| EQAVGICKA | | EQAVGICKA | | ESHCRIIQNE | | EYQSLRSILAN | |
| EQAVNICKA | | EQAVNICKA | | ESHGKIIQNE | | EYRQEALQNRI | |
| EQEEVTNAT | | EQEEVTNAT | | ESHGRIIQNE | | EYSIDSSYVCS | |
| EQFPVQTDE | | EQFPVQTDE | | ESHGRTIQNE | | EYTLDEESRAR | |
| EQFTWNGVK | | EQFTWNGVK | | ESIAWSATAC | | EYYFVKEGKIV | |
| EQGMGMAAD | | EQGMGMAAD | | ESIEECLIND | | FADQELGDAPF | |
| EQGSGFAAD | | EQGSGFAAD | | ESIESEFNEI | | FAFKFVSSDCS | |
| EQGSGYAAD | | EQGSGYAAD | | ESIESEFSEI | | FAFKQGNSVWA | |
| EQGSGYAAN | | EQGSGYAAN | | ESIESEFSET | | FAGKNADLEAL | |
| EQGTGIAAD | | EQGTGIAAD | | ESIIEAESSV | | FAGKNSDLEAL | |
| EQGTGIAAE | | EQGTGIAAE | | ESIKNGTYDY | | FAGKNTDLEAL | |
| EQGVGIAAD | | EQGVGIAAD | | ESIRDNTYDH | | FAGKNTDLEVL | |

Fig. 83-79

| Block size 8 | SIN | Block size 9 | SIN | Block size 10 | SIN | Block size 11 | SIN |
|---|---|---|---|---|---|---|---|
| EQGVGMAAD | | EQGVGMAAD | | ESIRNGTYDH | | FAGWILGNPMC | |
| EQGYGYAAD | | EQGYGYAAD | | ESIRNGTYNH | | FAGWILGNPRC | |
| EQIADAQHR | | EQIADAQHR | | ESIRNNTYDH | | FAIASKDNGIR | |
| EQIADSHHR | | EQIADSHHR | | ESIRNNTYNH | | FAIFSKDNGIR | |
| EQIADSQHK | | EQIADSQHK | | ESKCFWKGGS | | FAIISKDNGIR | |
| EQIADSQHR | | EQIADSQHR | | ESKCFWREGS | | FAIVSKDNGIR | |
| EQIIVTREP | | EQIIVTREP | | ESKCFWRGGS | | FAKDNSIRLSA | |
| EQIKLYGSG | | EQIKLYGSG | | ESKINRQEIE | | FALAQGALLGT | |
| EQITFLQAL | | EQITFLQAL | | ESKLKRNEIK | | FALAQGALVGT | |
| EQITFMQAL | | EQITFMQAL | | ESKLKRQEID | | FALAQGTLLGT | |
| EQIVVTREP | | EQIVVTREP | | ESKLKRQEIE | | FALAQGVLLGT | |
| EQKQEFKMN | | EQKQEFKMN | | ESKLKRQEIN | | FALGQGTTLDN | |
| EQKVPVTQT | | EQKVPVTQT | | ESKLNRNEIK | | FALGQGTTLEN | |
| EQLGSWSWH | | EQLGSWSWH | | ESKLNRQEIE | | FALGQGTTLKN | |
| EQLSQKFEE | | EQLSQKFEE | | ESKLNRQEIG | | FALGQGTTLNN | |
| EQLSSVSSF | | EQLSSVSSF | | ESKLNRSEIK | | FALGQGTTLSN | |
| EQLSTVSSF | | EQLSTVSSF | | ESKLNRTEIK | | FALGQGTTLYN | |
| EQLYTPGGE | | EQLYTPGGE | | ESLLLATGMK | | FALSGVAIALS | |
| EQMAGSSEQ | | EQMAGSSEQ | | ESLLNRLSIN | | FALSQGALLGT | |
| EQMETDGDR | | EQMETDGDR | | ESLMLATGMK | | FALSQGTTLKG | |
| EQMETDGER | | EQMETDGER | | ESLNKKMEDG | | FALSQGTTLRG | |
| EQMETGGER | | EQMETGGER | | ESLNNKVDDG | | FAPFAKDNSIR | |
| EQMETSGER | | EQMETSGER | | ESLQNRIQID | | FAPFSKDNGIR | |
| EQMYQKCCN | | EQMYQKCCN | | ESLRLAIGLR | | FAPFSKDNGVR | |
| EQMYQKCCS | | EQMYQKCCS | | ESLRLALGLR | | FAPFSKDNSIQ | |
| EQMYQKCCT | | EQMYQKCCT | | ESLRLAVGLR | | FAPFSKDNSIR | |
| EQMYQRCCN | | EQMYQRCCN | | ESMGFRYSGI | | FAPFSKDNSVR | |
| EQMYTPGGE | | EQMYTPGGE | | ESMIEAESSI | | FASSGIAIALG | |
| EQMYTPGGG | | EQMYTPGGG | | ESMIEAESSV | | FASSGIAIVLG | |
| EQMYTPGGK | | EQMYTPGGK | | ESMVEAESSV | | FAVVSKDNGIR | |
| EQNFPQTTN | | EQNFPQTTN | | ESNGAFIAPR | | FAYDKICIGYQ | |
| EQNIPVTQT | | EQNIPVTQT | | ESNGAFLAPG | | FCGLDNEPGSE | |
| EQNIPVTQV | | EQNIPVTQV | | ESNGAFLAPR | | FCGLDNEPGSG | |
| EQNKLYGAG | | EQNKLYGAG | | ESNGGFLAPR | | FCGLNNEPGSG | |
| EQNKLYGTG | | EQNKLYGTG | | ESNGGLIAPR | | FCGTSGTYGAG | |
| EQNVPVTQA | | EQNVPVTQA | | ESNGGLLAPK | | FCGTSGTYGSG | |
| EQNVPVTQT | | EQNVPVTQT | | ESNGGLLAPR | | FCGTSGTYGTG | |
| EQNVPVTQV | | EQNVPVTQV | | ESNGNFIAPE | | FCGVDSDTTGW | |
| EQNVTVTHA | | EQNVTVTHA | | ESNGNFITPE | | FCGVDSDTTSW | |
| EQQGRMDYY | | EQQGRMDYY | | ESNGNLIAPE | | FCGVNSDTTGW | |
| EQQIGNVIN | | EQQIGNVIN | | ESNGNLIAPW | | FCGVNSDTTSW | |
| EQRINMLAD | | EQRINMLAD | | ESNGNLVAPW | | FCGVNSNTTGW | |
| EQSGLPVGG | | EQSGLPVGG | | ESNGVFLAPR | | FCGVSGEVPGW | |
| EQSKMQFSS | | EQSKMQFSS | | ESNITVTSSV | | FCGVSSEVPEW | |
| EQSRMQFSS | | EQSRMQFSS | | ESNVTVTSSI | | FCGVSSEVPGC | |
| EQTALYKNA | | EQTALYKNA | | ESNVTVTSSV | | FCGVSSEVPGW | |
| EQTDLYKVA | | EQTDLYKVA | | ESQLKKQEIE | | FCLKNGNMRCT | |
| EQTKLYGNG | | EQTKLYGNG | | ESQLKRQEIE | | FCLRNGNMRCT | |
| EQTKLYGSG | | EQTKLYGSG | | ESRARIKTRL | | FCSIDGKAPIS | |
| EQTKLYKNT | | EQTKLYKNT | | ESRGLFGAIA | | FCSINGKAPIS | |
| EQTRLYGSG | | EQTRLYGSG | | ESRINRQEIE | | FCSINGKEPIS | |
| EQTTLYKNA | | EQTTLYKNA | | ESRKLLLIAQ | | FCSINGKQPIS | |
| EQVAGSSEQ | | EQVAGSSEQ | | ESRKLLLITQ | | FCSLDGKAPIS | |
| EQVDTIMEK | | EQVDTIMEK | | ESRKLLLIVQ | | FCYPGELDNNG | |
| EQVDTIMER | | EQVDTIMER | | ESRKLLLVVQ | | FCYTLITDGPS | |
| EQVDTIREK | | EQVDTIREK | | ESRKMLLIVQ | | FCYTLMTDGPS | |
| EQVEGRIQD | | EQVEGRIQD | | ESRLNRNEIK | | FCYTLVTDGPS | |
| EQVEGRIQY | | EQVEGRIQY | | ESRLNRQEIE | | FDEIGEDVAPI | |
| EQVEGRTQD | | EQVEGRTQD | | ESRNPGNAEI | | FDERRNKYLEE | |
| EQVIVTREP | | EQVIVTREP | | ESRSGFEMIW | | FDERRNRYLEE | |
| EREAKLFVL | | EREAKLFVL | | ESRSGFEMVW | | FDEVKRRLSAN | |
| EREEVTNAT | | EREEVTNAT | | ESRSGYETFK | | FDEVKRRLSTN | |

Fig. 83-80

| Block size 8 | SIN | Block size 9 | SIN | Block size 10 | SIN | Block size 11 | SIN |
|---|---|---|---|---|---|---|---|
| EREGGRRRK | | EREGGRRRK | | ESRSNIFNME | | FDEVRRRLSAN | |
| EREGYSLVG | | EREGYSLVG | | ESRSPGNAEI | | FDEVRRRLSTN | |
| ERELVRKTR | | ERELVRKTR | | ESSDVLVTRE | | FDEVRRRLSVN | |
| EREVEVVNA | | EREVEVVNA | | ESSFEQITFM | | FDFIKWNVTYT | |
| ERGEDTIEE | | ERGEDTIEE | | ESSFYAEMEW | | FDFSKWNVTYT | |
| ERGEETIEE | | ERGEETIEE | | ESSFYAEMKW | | FDFTKWNVTHT | |
| ERGEETVEE | | ERGEETVEE | | ESSGGLLAPR | | FDFTKWNVTYT | |
| ERGIEVVNA | | ERGIEVVNA | | ESSIGKVCRT | | FDGGHIEECSC | |
| ERGKLKRRA | | ERGKLKRRA | | ESSIKEKDMT | | FDGKEWLHVCI | |
| ERGLFGAIA | | ERGLFGAIA | | ESSTYQNNFV | | FDGKEWMHVCI | |
| ERGLQRRRF | | ERGLQRRRF | | ESSVKEKDLT | | FDGKEWMHVCM | |
| ERGNHGVKG | | ERGNHGVKG | | ESSVKEKDMT | | FDGKEWMHVSM | |
| ERGNPGVKG | | ERGNPGVKG | | ESSVREKDMT | | FDILHKCDNEC | |
| ERGNQGVKG | | ERGNQGVKG | | ESTGNFIAPE | | FDILHKCDNKC | |
| ERGSPGVKG | | ERGSPGVKG | | ESTGNLIAPE | | FDILHKCNNEC | |
| ERGTKQEEN | | ERGTKQEEN | | ESTGNLVAPE | | FDKLYIWGIHH | |
| ERGTQGVKG | | ERGTQGVKG | | ESTQAAIDQI | | FDKLYIWGVHH | |
| ERGVEVVDA | | ERGVEVVDA | | ESTQKAIDGI | | FDKLYVWGIHH | |
| ERGVEVVNA | | ERGVEVVNA | | ESTQKAIDGV | | FDKLYVWGVHH | |
| ERILDFHDS | | ERILDFHDS | | ESTQKAIDQI | | FDSLNITAASL | |
| ERILEEESD | | ERILEEESD | | ESTQKAIDRI | | FDSNGNFIAPE | |
| ERIMFESNG | | ERIMFESNG | | ESTQKAINGV | | FDVPDYQSLRS | |
| ERIRNNTYD | | ERIRNNTYD | | ESTQKAMDGV | | FDWTLNRNQPA | |
| ERITFESNG | | ERITFESNG | | ESTQRAIDGV | | FEAVAWSATAC | |
| ERITFESSG | | ERITFESSG | | ESVAWSASAC | | FECRTFFLTQG | |
| ERLGSWSWH | | ERLGSWSWH | | ESVAWSATAC | | FEECSCYPSGE | |
| ERLTITYSS | | ERLTITYSS | | ESVGWSATAC | | FEECSCYPSGT | |
| ERLVLATGL | | ERLVLATGL | | ESVKNGTYDY | | FEECSCYPSRE | |
| ERMCNILKG | | ERMCNILKG | | ESVKNGTYNY | | FEFTSFFYRYG | |
| ERMVLSAFD | | ERMVLSAFD | | ESVLINTYQW | | FEFWHKCDDEC | |
| ERMYQKCCN | | ERMYQKCCN | | ESVLVNTYQW | | FEFWHKCDNDC | |
| ERNALGDCP | | ERNALGDCP | | ESVRNGTYDY | | FEFWHKCDNEC | |
| ERNALGNCP | | ERNALGNCP | | ESVRNGTYKY | | FEFWHKCNNEC | |
| ERNDLYGTQ | | ERNDLYGTQ | | ESVRNGTYNY | | FEFYHKCDDEC | |
| ERNITEIVY | | ERNITEIVY | | ESYGRIIQNE | | FEFYHKCDNEC | |
| ERNSIWTSS | | ERNSIWTSS | | ETCSALFVYS | | FEFYHKCNDEC | |
| ERNVTETLY | | ERNVTETLY | | ETEHQIGNVI | | FEGWIGGNPAC | |
| ERNVTVTHA | | ERNVTVTHA | | ETEQTKLYKN | | FEGWIVGNPAC | |
| ERNVTVTHS | | ERNVTVTHS | | ETFKVIGGWS | | FEGWIVGNPSC | |
| ERPKEIEGI | | ERPKEIEGI | | ETFKVIGGWT | | FEIFHKCDDDC | |
| ERPKEMEGI | | ERPKEMEGI | | ETFRVIDGWT | | FEIFHKCDDHC | |
| ERPKEMEGV | | ERPKEMEGV | | ETFRVIGGWA | | FEIFHKCDDQC | |
| ERPSAPEGM | | ERPSAPEGM | | ETFRVIGGWT | | FEIFHKCDDRC | |
| ERPSIWTSS | | ERPSIWTSS | | ETFRVIGGWV | | FEIFHKCDNQC | |
| ERPTAVDTC | | ERPTAVDTC | | ETFRVISGWT | | FEIFHQCDNDC | |
| ERQEIVDNN | | ERQEIVDNN | | ETFVNMTNVQ | | FEIFHQCDNNC | |
| ERQEIVDNR | | ERQEIVDNR | | ETFVNVTHVQ | | FEIFHRCDDQC | |
| ERQEIVDNS | | ERQEIVDNS | | ETFVNVTNVQ | | FEIIWDPNGWT | |
| ERQEIVGNN | | ERQEIVGNN | | ETGALQLNPI | | FEKEGYSLVGI | |
| ERQIGNVIN | | ERQIGNVIN | | ETGAPQLNPI | | FEKEGYSLVGV | |
| ERQKINGVK | | ERQKINGVK | | ETGAPQLNPV | | FEKFFPSSSYR | |
| ERQKISGVK | | ERQKISGVK | | ETGNGCFEFY | | FELFHKCDDDC | |
| ERQKVNGVK | | ERQKVNGVK | | ETGVPVTSSV | | FELIDNEFTEV | |
| ERQRINGVK | | ERQRINGVK | | ETGYICSKFH | | FELLHKCNDSC | |
| ERQTRGIFG | | ERQTRGIFG | | ETGYVCGKFH | | FELLHKCNNSC | |
| ERQTRGLFG | | ERQTRGLFG | | ETGYVCSKFH | | FELLHKCNNTC | |
| ERRIENLNK | | ERRIENLNK | | ETIIETGYVC | | FEMIWDANGWV | |
| ERRIENLNR | | ERRIENLNR | | ETIKNGTYDH | | FEMIWDPDGWT | |
| ERRIESLNK | | ERRIESLNK | | ETIKNGTYNH | | FEMIWDPNGWT | |
| ERRINMLAD | | ERRINMLAD | | ETIKNGTYNR | | FEMLKIHNAGT | |
| ERRLENLNK | | ERRLENLNK | | ETILETGYIC | | FEMLKIPNAET | |
| ERRLTTTIK | | ERRLTTTIK | | ETILETGYVC | | FEMLKIPNAGI | |

Fig. 83-81

| Block size 8 | SIN | Block size 9 | SIN | Block size 10 | SIN | Block size 11 | SIN |
|---|---|---|---|---|---|---|---|
| ERRNKYLEE | | ERRNKYLEE | | ETILETRYVC | | FEMLKIPNAGT | |
| ERRNRYLEE | | ERRNRYLEE | | ETIRNGTYDH | | FEMLKVPNAGT | |
| ERRNSSDIC | | ERRNSSDIC | | ETIRNGTYNH | | FEMLRIPNAGI | |
| ERRRKKRGL | | ERRRKKRGL | | ETIVETGYVC | | FEMVWDANGWV | |
| ERSKINEVK | | ERSKINEVK | | ETKAPQLNPI | | FEMVWDPNGWT | |
| ERSKINGVI | | ERSKINGVI | | ETKCQSPLGA | | FEPFQSLIPKA | |
| ERSKINGVK | | ERSKINGVK | | ETKCQTPLGA | | FEPFQSLVPKA | |
| ERSKINGVR | | ERSKINGVR | | ETKGLFGAIA | | FEPFQSLVPRA | |
| ERTHIHIFS | | ERTHIHIFS | | ETKVWWTSNS | | FEPNGCIEGKL | |
| ERTHNGKLC | | ERTHNGKLC | | ETLKIRTNGN | | FEPNGCIESKL | |
| ERTIWTSGS | | ERTIWTSGS | | ETLKVESNGN | | FEPNGSIEGKL | |
| ERTKEMEGI | | ERTKEMEGI | | ETLNIESNGN | | FEPNGYIEGKL | |
| ERTLDFHDF | | ERTLDFHDF | | ETLNVESNGN | | FEQITFIQALQ | |
| ERTLDFHDL | | ERTLDFHDL | | ETNGNYGPIN | | FEQITFLQALQ | |
| ERTLDFHDS | | ERTLDFHDS | | ETNHTDELCP | | FEQITFMQALQ | |
| ERTLDLHDA | | ERTLDLHDA | | ETNHTGTYCS | | FEQVEGRIQDL | |
| ERTLDLHDS | | ERTLDLHDS | | ETNKFAAICT | | FEQVEGRIQNL | |
| ERTLDMHDA | | ERTLDMHDA | | ETNKFAAVCT | | FEQVEGRIQYL | |
| ERTLDQHDA | | ERTLDQHDA | | ETNKFASICT | | FEQVEGRTQDL | |
| ERTLDYHDF | | ERTLDYHDF | | ETNKLAAICT | | FEREGYSLVGI | |
| ERTLDYHDS | | ERTLDYHDS | | ETQCQTPLGA | | FEREGYSLVGV | |
| ERTLYFHDS | | ERTLYFHDS | | ETQTRGIFGA | | FERVKRQLREN | |
| ERTNEKFHQ | | ERTNEKFHQ | | ETRCQTPLGA | | FERVRHQLREN | |
| ERTNEKYHQ | | ERTNEKYHQ | | ETRGLFGAIA | | FERVRRQLREN | |
| ERTNQQFEL | | ERTNQQFEL | | ETRVWWTSNS | | FESDGAFLAPR | |
| ERTSIWTSS | | ERTSIWTSS | | ETSHTGTYCS | | FESIESEFNEI | |
| ERTTFESNG | | ERTTFESNG | | ETTGRNCTIP | | FESIESEFSEI | |
| ERVDTIIES | | ERVDTIIES | | ETTGRNCTVP | | FESIESEFSET | |
| ERVDTIMEK | | ERVDTIMEK | | ETTHTGTYCS | | FESNGAFIAPR | |
| ERVDTLLEN | | ERVDTLLEN | | ETTVWWTSNS | | FESNGAFLAPG | |
| ERVKKQLRE | | ERVKKQLRE | | ETVEITGIDK | | FESNGAFLAPR | |
| ERVKMFDFI | | ERVKMFDFI | | ETVEITGINK | | FESNGALLAPR | |
| ERVKMFDFS | | ERVKMFDFS | | ETVNTLIEQN | | FESNGGFLAPR | |
| ERVKMFDFT | | ERVKMFDFT | | ETVNTLSEQN | | FESNGGLIAPR | |
| ERVKRQLRE | | ERVKRQLRE | | ETVNTLTEQN | | FESNGGLLAPK | |
| ERVRHQLRE | | ERVRHQLRE | | ETYKILTIYS | | FESNGGLLAPR | |
| ERVRKQLRE | | ERVRKQLRE | | ETYVLSIIPS | | FESNGNFIAPE | |
| ERVRKQLRQ | | ERVRKQLRQ | | ETYVLSIVPS | | FESNGNFITPE | |
| ERVRNGTYD | | ERVRNGTYD | | ETYVLSVIPS | | FESNGNLIAPE | |
| ERVRRQLRE | | ERVRRQLRE | | EVCFMYSDFH | | FESSGGLLAPR | |
| ERYVEDTKI | | ERYVEDTKI | | EVCLKWDLMD | | FESTGNFIAPE | |
| ESADMSIGI | | ESADMSIGI | | EVCLKWELMD | | FESTGNLIAPE | |
| ESADMSIGV | | ESADMSIGV | | EVDNNGELRH | | FESTGNLVAPE | |
| ESAVLRGFL | | ESAVLRGFL | | EVDQSLIIAA | | FESVAWSASAC | |
| ESCEGECFY | | ESCEGECFY | | EVEGRIQDLE | | FESVAWSATAC | |
| ESDEALKMT | | ESDEALKMT | | EVEKQIGNVI | | FESVEWSATAC | |
| ESDGAFLAP | | ESDGAFLAP | | EVEKQLGNVI | | FESVGWSATAC | |
| ESDVPVTSS | | ESDVPVTSS | | EVENEIRTFS | | FFCLKNGNMRC | |
| ESECACANG | | ESECACANG | | EVEQEIRAFS | | FFCLRNGNMRC | |
| ESECACING | | ESECACING | | EVEQEIRTFS | | FFFCLKNGNMR | |
| ESECACVNG | | ESECACVNG | | EVEQEMRTFS | | FFGAIAGFIEG | |
| ESECICING | | ESECICING | | EVEQQIGNVI | | FFHKCNDSCME | |
| ESECQCIDG | | ESECQCIDG | | EVERQIGNVI | | FFLTHGALLND | |
| ESECQCIGG | | ESECQCIGG | | EVESEIRTFS | | FFLTHGSLLND | |
| ESECQCISG | | ESECQCISG | | EVETYVLSII | | FFLTQGALLND | |
| ESECQCLYG | | ESECQCLYG | | EVETYVLSIV | | FFLTQGSLLND | |
| ESECQRIDG | | ESECQRIDG | | EVETYVLSVI | | FFLTQGSLVND | |
| ESECVCHKG | | ESECVCHKG | | EVEVVNATET | | FFNNTEPLCEV | |
| ESECVCHNG | | ESECVCHNG | | EVFVIREPCI | | FFPDGPQIQYF | |
| ESECVCHNS | | ESECVCHNS | | EVFVIREPFI | | FFPFHKDNAIR | |
| ESECVCHSG | | ESECVCHSG | | EVGAKILTSE | | FFPFHKDNALR | |
| ESECVCIDG | | ESECVCIDG | | EVGARIITSE | | FFPFHKDNAVR | |

Fig. 83-82

| Block size 8 | SIN | Block size 9 | SIN | Block size 10 | SIN | Block size 11 | SIN |
|---|---|---|---|---|---|---|---|
| ESECVCINE | | ESECVCINE | | EVGARILASE | | FFPFHKGNSAR | |
| ESECVCING | | ESECVCING | | EVGARILTSE | | FFPSSSYRRPI | |
| ESECVCISG | | ESECVCISG | | EVGNGCFEFY | | FFPSSSYRRPV | |
| ESECVCMNG | | ESECVCMNG | | EVGTRWMKII | | FFRNIVWLIKK | |
| ESECVCQDE | | ESECVCQDE | | EVGYLCAGIP | | FFRNVVWLIKK | |
| ESECVCVNG | | ESECVCVNG | | EVILWFSFGA | | FFRNVVWLTKK | |
| ESECVRHNG | | ESECVRHNG | | EVINATETVE | | FFRNVVWLVKK | |
| ESEFNEIEH | | ESEFNEIEH | | EVITAQELVE | | FFSRLNWLTKA | |
| ESEFNEIEY | | ESEFNEIEY | | EVKLEENTTY | | FFSRLNWLTKE | |
| ESEFSEIEH | | ESEFSEIEH | | EVKRRLSANA | | FFWMCSNGSLQ | |
| ESEFSETEH | | ESEFSETEH | | EVKRRLSTNA | | FFYRYGFVANF | |
| ESEMNKLYE | | ESEMNKLYE | | EVKYVWWTSN | | FGAIAGFIEGG | |
| ESEQIIVTR | | ESEQIIVTR | | EVLFQGGHIE | | FGAIAGFIEGR | |
| ESEQIVVTR | | ESEQIVVTR | | EVLHLTQGAC | | FGAIAGFIENG | |
| ESEQVIVTR | | ESEQVIVTR | | EVLHLTQGTC | | FGAIAGFLENG | |
| ESGGIDKEP | | ESGGIDKEP | | EVLNNKHWSG | | FGAKAGFIEGG | |
| ESGGIDKES | | ESGGIDKES | | EVLNNKNWSG | | FGAKAGFIENG | |
| ESGGIDKIG | | ESGGIDKIG | | EVLNNMNWSG | | FGASCFILLAI | |
| ESGGIDKIS | | ESGGIDKIS | | EVLNNRNWSG | | FGASCFILLAV | |
| ESGGIDKVS | | ESGGIDKVS | | EVLTGNLQAL | | FGASCFLFLAI | |
| ESGGISKIS | | ESGGISKIS | | EVLTGNLQTL | | FGASCFLLIAI | |
| ESGGISKMS | | ESGGISKMS | | EVLWTSNSIV | | FGASCFLLLAI | |
| ESGRLIDFL | | ESGRLIDFL | | EVNGPESVLV | | FGASCFLLLAV | |
| ESGRLMDFL | | ESGRLMDFL | | EVNSWHIFSK | | FGASCFVLLAA | |
| ESGVLWTSN | | ESGVLWTSN | | EVNSWHILSK | | FGASCFVLLAI | |
| ESHCRIIQN | | ESHCRIIQN | | EVPGWSWDDG | | FGASCFVLLAV | |
| ESHGKIIQN | | ESHGKIIQN | | EVPGWSWGDG | | FGASCVMLLAI | |
| ESHGRIIQN | | ESHGRIIQN | | EVPSPYNSRF | | FGCQNGNIRCT | |
| ESHGRTIQN | | ESHGRTIQN | | EVRGDQMAHC | | FGCQNGNVRCT | |
| ESIAWSATA | | ESIAWSATA | | EVRHRLKITE | | FGDCPKYVNVK | |
| ESIEECLIN | | ESIEECLIN | | EVRRDQMAHC | | FGEGEQIIVTR | |
| ESIESEFNE | | ESIESEFNE | | EVRRIWRQAN | | FGESCFVLLAV | |
| ESIESEFSE | | ESIESEFSE | | EVRRRLSANA | | FGESEQIIVTR | |
| ESIIEAESS | | ESIIEAESS | | EVRRRLSTNA | | FGESEQIVVTR | |
| ESIKNGTYD | | ESIKNGTYD | | EVRRRLSVNA | | FGESEQVIVTR | |
| ESIRNGTYD | | ESIRNGTYD | | EVSFQGGHIE | | FGFRQGNSVWA | |
| ESIRNGTYN | | ESIRNGTYN | | EVSFQGRGVF | | FGFRQGTSVWA | |
| ESIRNNTYD | | ESIRNNTYD | | EVSFRGRGVF | | FGGFTFKRTKG | |
| ESIRNNTYN | | ESIRNNTYN | | EVSHCRATEY | | FGGFTFKRTNG | |
| ESKCFWKGG | | ESKCFWKGG | | EVSSWHILSK | | FGGFTFKRTSG | |
| ESKCFWKSG | | ESKCFWKSG | | EVSVIREPFI | | FGKDNAIRIGE | |
| ESKCFWRGG | | ESKCFWRGG | | EVSWTSNSIV | | FGKDNAVRIGE | |
| ESKIERQKI | | ESKIERQKI | | EVTNATELVQ | | FGLICATCEQI | |
| ESKIERQKV | | ESKIERQKV | | EVTNATETVE | | FGLVCATCEQI | |
| ESKINRQEI | | ESKINRQEI | | EVVAAQELVE | | FGNLERRLENL | |
| ESKLERQKI | | ESKLERQKI | | EVVDATETVE | | FGPVHFQNQVK | |
| ESKLERQRI | | ESKLERQRI | | EVVFPNEVGA | | FGPVHFRNQIK | |
| ESKLKRNEI | | ESKLKRNEI | | EVVNATETVE | | FGPVHFRNQVK | |
| ESKLKRQEI | | ESKLKRQEI | | EVVSAKELVE | | FGPVHFRSQVK | |
| ESKLNRNEI | | ESKLNRNEI | | EVVTAQELVE | | FGQVEGRIQDL | |
| ESKLNRQEI | | ESKLNRQEI | | EVWIGRTKSL | | FGRIDFHWLML | |
| ESKLNRSEI | | ESKLNRSEI | | EVWSYNADLL | | FGVSGINESAD | |
| ESKLNRTEI | | ESKLNRTEI | | EVWSYNAEFL | | FGVSGVNESAD | |
| ESKLSQMSK | | ESKLSQMSK | | EVWSYNAELL | | FGYLLKGESHC | |
| ESLLLATGM | | ESLLLATGM | | EVWWTSNSIV | | FGYLLKGESHG | |
| ESLLNRLSI | | ESLLNRLSI | | EWGNGCFEFY | | FGYLLKGESYG | |
| ESLMLATGM | | ESLMLATGM | | EWIKTRPILS | | FGYLLRGESHG | |
| ESLNKKMED | | ESLNKKMED | | EWLKTRPILS | | FHDSNVKNLYD | |
| ESLNNKVDD | | ESLNNKVDD | | EWSGYSGSFV | | FHDSNVKNLYE | |
| ESLQNRIQI | | ESLQNRIQI | | EWSKRYELEI | | FHDSNVKNLYN | |
| ESLQNRIRI | | ESLQNRIRI | | EWSRRYELEI | | FHDSNVKSLYD | |
| ESLRLAIGL | | ESLRLAIGL | | EWSYIIEKEN | | FHDSNVRNLYD | |

Fig. 83-83

| Block size 8 | SIN | Block size 9 | SIN | Block size 10 | SIN | Block size 11 | SIN |
|---|---|---|---|---|---|---|---|
| ESLRLALGL | | ESLRLALGL | | EWSYIMEKEN | | FHFEECSCYPS | |
| ESLRLAVGL | | ESLRLAVGL | | EWSYIVEKAN | | FHHSNAEGTGM | |
| ESMGFRYSG | | ESMGFRYSG | | EWSYIVEKDK | | FHHSNSEGTGM | |
| ESMIEAESS | | ESMIEAESS | | EWSYIVEKDN | | FHKCDDDCMAS | |
| ESMVEAESS | | ESMVEAESS | | EWSYIVEKDS | | FHKCDDHCMES | |
| ESNGAFIAP | | ESNGAFIAP | | EWSYIVEKEN | | FHKCDDQCMES | |
| ESNGAFLAP | | ESNGAFLAP | | EWSYIVEKNN | | FHKCDNQCMES | |
| ESNGGFLAP | | ESNGGFLAP | | EWSYIVEREN | | FHKCNDSCMET | |
| ESNGGLIAP | | ESNGGLIAP | | EWSYIVERET | | FHKDNAIRLGE | |
| ESNGGLLAP | | ESNGGLLAP | | EWSYIVERPK | | FHKDNALRLAE | |
| ESNGNFIAP | | ESNGNFIAP | | EWSYIVERTK | | FHKDNAVRLGE | |
| ESNGNLIAP | | ESNGNLIAP | | EWSYLIEDPA | | FHKGNSARLIH | |
| ESNGNLVAP | | ESNGNLVAP | | EWSYLIEDPG | | FHLGTKQVCAA | |
| ESNGVFLAP | | ESNGVFLAP | | EWSYLIEDPN | | FHLGTKQVCIA | |
| ESNVLWTSN | | ESNVLWTSN | | EWSYLIEDPS | | FHLGTKQVCMA | |
| ESNVTVTNS | | ESNVTVTNS | | EWSYLIEDPT | | FHLGTKQVCVA | |
| ESNVTVTSS | | ESNVTVTSS | | EWTSNSLIAL | | FHLGTRQVCIA | |
| ESQLKKQEI | | ESQLKKQEI | | EYAEESKLKR | | FHLGTRQVCMA | |
| ESQLKRQEI | | ESQLKRQEI | | EYASKTRISE | | FHLGTRQVCVA | |
| ESRARIKTR | | ESRARIKTR | | EYDAVATTHS | | FHNIHPLAIGE | |
| ESRGLFGAI | | ESRGLFGAI | | EYEEEAKLEK | | FHNIHPLTIGE | |
| ESRIERQKI | | ESRIERQKI | | EYEEEAKLER | | FHNIHPLTIGK | |
| ESRINMINS | | ESRINMINS | | EYEEESKLKR | | FHNVHPLAIGE | |
| ESRINRQEI | | ESRINRQEI | | EYGFKISKRG | | FHNVHPLTIGE | |
| ESRINTINS | | ESRINTINS | | EYGFRISKRG | | FHQCDNNCIES | |
| ESRKLLLIA | | ESRKLLLIA | | EYGHLITGKS | | FHQIEKEFSEI | |
| ESRKLLLIT | | ESRKLLLIT | | EYGHLTTGKS | | FHQIEKEFSEV | |
| ESRKLLLIV | | ESRKLLLIV | | EYGHLVTGKS | | FHQIEKEFTEV | |
| ESRKLLLVV | | ESRKLLLVV | | EYGKGRIFQS | | FHRCDDQCMES | |
| ESRKMLLIV | | ESRKMLLIV | | EYGRGRIFQS | | FHSDTPRPADP | |
| ESRLNRNEI | | ESRLNRNEI | | EYGYLITGKS | | FHSDTPRPDDP | |
| ESRLNRQEI | | ESRLNRQEI | | EYKDWILWIS | | FHSDTPRPSDP | |
| ESRNPGNAE | | ESRNPGNAE | | EYKNTGDSDI | | FHSDTPRPTDP | |
| ESRSGFEMI | | ESRSGFEMI | | EYKNTRDSDI | | FHSDTPRPVDP | |
| ESRSGFEMV | | ESRSGFEMV | | EYKNTRDSNI | | FHWMLLDPGDT | |
| ESRSGYETF | | ESRSGYETF | | EYNGKSLGIQ | | FIAEQFTWNGV | |
| ESRSNIFNM | | ESRSNIFNM | | EYNNTTGRDV | | FIAPDRASFFK | |
| ESSCTCIKG | | ESSCTCIKG | | EYQIGNVINW | | FIAPDRASFFR | |
| ESSCTCILG | | ESSCTCILG | | EYQSLRSILA | | FIAPDRASFLR | |
| ESSCTCIQG | | ESSCTCIQG | | EYRQEALQNR | | FIAPDRATFLR | |
| ESSCTCIRG | | ESSCTCIRG | | EYSIDSSYVC | | FIAPNRASFFR | |
| ESSCVCIKG | | ESSCVCIKG | | EYTLDEESRA | | FICIKDGNMRC | |
| ESSCVCMKG | | ESSCVCMKG | | EYYFVKEGKI | | FICIKNGNMQC | |
| ESSCVCMNG | | ESSCVCMNG | | FADQELGDAP | | FICIKNGNMRC | |
| ESSCVCVKG | | ESSCVCVKG | | FAGKNADLEA | | FICMKNGNMQC | |
| ESSDVLVTR | | ESSDVLVTR | | FAGKNSDLEA | | FICVGWSSTSC | |
| ESSFEQITF | | ESSFEQITF | | FAGKNTDLEA | | FICVGWSSTTC | |
| ESSFYAEME | | ESSFYAEME | | FAGKNTDLEV | | FICVKNGNMQC | |
| ESSFYAEMK | | ESSFYAEMK | | FAGWILGNPM | | FICVKNGNMRC | |
| ESSGGLLAP | | ESSGGLLAP | | FAGWILGNPR | | FICVKNGNMRG | |
| ESSIGKVCR | | ESSIGKVCR | | FAIASKDNGI | | FIDIWTYNAEL | |
| ESSIKEKDM | | ESSIKEKDM | | FAIFSKDNGI | | FIDVWTYNAEL | |
| ESSTYQNNF | | ESSTYQNNF | | FAIISKDNGI | | FIEGGWCGMID | |
| ESSVFWTSN | | ESSVFWTSN | | FAIVSKDNGI | | FIEGGWPGLIN | |
| ESSVKEKDL | | ESSVKEKDL | | FAKDNSIRLS | | FIEGGWPGLVA | |
| ESSVKEKDM | | ESSVKEKDM | | FALAQGALLG | | FIEGGWQGLVD | |
| ESSVLWTSN | | ESSVLWTSN | | FALAQGALVG | | FIEGGWQGMID | |
| ESSVREKDM | | ESSVREKDM | | FALAQGTLLG | | FIEGGWQGMVD | |
| ESTGNFIAP | | ESTGNFIAP | | FALAQGVLLG | | FIEGGWSGLIA | |
| ESTGNLIAP | | ESTGNLIAP | | FALGQTPLN | | FIEGGWSGLVA | |
| ESTGNLVAP | | ESTGNLVAP | | FALGQTTLD | | FIEGGWSGLVD | |
| ESTQAAIDQ | | ESTQAAIDQ | | FALGQTTLE | | FIEGGWSGMID | |

Fig. 83-84

| Block size 8 | SIN | Block size 9 | SIN | Block size 10 | SIN | Block size 11 | SIN |
|---|---|---|---|---|---|---|---|
| ESTQKAIDG | | ESTQKAIDG | | FALGQGTTLK | | FIEGGWTGLID | |
| ESTQKAIDQ | | ESTQKAIDQ | | FALGQGTTLN | | FIEGGWTGMID | |
| ESTQKAIDR | | ESTQKAIDR | | FALGQGTTLS | | FIEGGWTGMIE | |
| ESTQKAING | | ESTQKAING | | FALGQGTTLY | | FIEGGWTGMVD | |
| ESTQKAMDG | | ESTQKAMDG | | FALSGMAIAL | | FIEGGWTGMVN | |
| ESTQKAVDG | | ESTQKAVDG | | FALSGVAIAL | | FIEGRWPGLVA | |
| ESTQRAIDG | | ESTQRAIDG | | FALSGVAITL | | FIENGWEGLID | |
| ESVAWSASA | | ESVAWSASA | | FALSGVAVAL | | FIENGWEGLIN | |
| ESVAWSATA | | ESVAWSATA | | FALSQGTTLK | | FIENGWEGLVD | |
| ESVGWSATA | | ESVGWSATA | | FALSQGTTLR | | FIENGWEGMID | |
| ESVKNGTYD | | ESVKNGTYD | | FANEESLRQI | | FIENGWEGMMD | |
| ESVKNGTYN | | ESVKNGTYN | | FAPFAKDNSI | | FIENGWEGMVD | |
| ESVLINTYQ | | ESVLINTYQ | | FAPFSKDNGI | | FIENGWEGMVN | |
| ESVLVNTYQ | | ESVLVNTYQ | | FAPFSKDNSI | | FIENGWQGLID | |
| ESVRNGTYD | | ESVRNGTYD | | FAPFSKDNSV | | FIERPTAVDTC | |
| ESVRNGTYK | | ESVRNGTYK | | FAPYSKDNGI | | FIFGCQNGNIR | |
| ESVRNGTYN | | ESVRNGTYN | | FASSGIAIAL | | FIFGCQNGNVR | |
| ESYGRIIQN | | ESYGRIIQN | | FASSGIAIVL | | FIFILLTHWAY | |
| ETEHQIGNV | | ETEHQIGNV | | FAYDKICIGY | | FIFLLLTHWAY | |
| ETEQTKLYK | | ETEQTKLYK | | FCFTVMTDGP | | FIFNGAFIAPD | |
| ETFKVIGGW | | ETFKVIGGW | | FCGLDNEPGS | | FIIKGRSHLRN | |
| ETFRVIDGW | | ETFRVIDGW | | FCGLNNEPGS | | FIIREPFISCS | |
| ETFRVIGGW | | ETFRVIGGW | | FCGTSGTYGA | | FIIREPFVSCS | |
| ETFRVISGW | | ETFRVISGW | | FCGTSGTYGS | | FIKDYRYTYRC | |
| ETFVNITNV | | ETFVNITNV | | FCGTSGTYGT | | FIKWNVTYTGT | |
| ETFVNVTHV | | ETFVNVTHV | | FCGVDSDTTG | | FILWACSSGNC | |
| ETFVNVTNV | | ETFVNVTNV | | FCGVDSDTTS | | FIMWACNSGNC | |
| ETGALQLNP | | ETGALQLNP | | FCGVNSDTTG | | FIMWACQKGNI | |
| ETGAPQLNP | | ETGAPQLNP | | FCGVNSDTTS | | FIMWACQRGNI | |
| ETGNGCFEF | | ETGNGCFEF | | FCGVNSNTTG | | FIMWACSNGNC | |
| ETGVPVTSS | | ETGVPVTSS | | FCGVSGEVPG | | FIMWACSNGSC | |
| ETGVWWTSN | | ETGVWWTSN | | FCGVSSEVPE | | FIMWACSSGNC | |
| ETGYICSKF | | ETGYICSKF | | FCGVSSEVPG | | FIMWTCNSGNC | |
| ETGYVCGKF | | ETGYVCGKF | | FCLKNGNMRC | | FIMWTCQKGNI | |
| ETGYVCSKF | | ETGYVCSKF | | FCLRNGNMRC | | FIQALQLLLEV | |
| ETHIHIFSF | | ETHIHIFSF | | FCSIDGKAPI | | FIQHPELTGLN | |
| ETIEEKFEI | | ETIEEKFEI | | FCSINGKAPI | | FIQNALNGNGD | |
| ETIEERFEI | | ETIEERFEI | | FCSINGKEPI | | FIVKGRSHLRN | |
| ETIIETGYV | | ETIIETGYV | | FCSINGKQPI | | FIVWACQRGNI | |
| ETIKNGTYD | | ETIKNGTYD | | FCSINGRAPI | | FIWAIHHPPTS | |
| ETIKNGTYN | | ETIKNGTYN | | FCYPGELDNN | | FKADLIIERRN | |
| ETILETGYI | | ETILETGYI | | FCYTLITDGP | | FKGFFPFHKDN | |
| ETILETGYV | | ETILETGYV | | FCYTLMTDGP | | FKHQNAQGEGT | |
| ETILETRYV | | ETILETRYV | | FCYTLVTDGP | | FKISKRGGSGI | |
| ETIRNGTYD | | ETIRNGTYD | | FDERRNKYLE | | FKISKRGNSGI | |
| ETIRNGTYN | | ETIRRNGTYN | | FDERRNRYLE | | FKISKRGSSGI | |
| ETIVETGYV | | ETIVETGYV | | FDEVKRRLSA | | FKISKRGSSGV | |
| ETKAPQLNP | | ETKAPQLNP | | FDEVKRRLST | | FKMNPNKKIIT | |
| ETKCQSPLG | | ETKCQSPLG | | FDEVRRRLSA | | FKMNPNQKIII | |
| ETKCQTPLG | | ETKCQTPLG | | FDEVRRRLST | | FKMNPNQKIIT | |
| ETKGLFGAI | | ETKGLFGAI | | FDEVRRRLSV | | FKPNGCIEGKL | |
| ETLKGSARH | | ETLKGSARH | | FDFIKWNVTY | | FKPNIGPRPFV | |
| ETLKIRTNG | | ETLKIRTNG | | FDFSKWNVTY | | FKPNIGPRPLV | |
| ETLKVESNG | | ETLKVESNG | | FDFTKWNVTH | | FKSWKGNIMRT | |
| ETLNIESNG | | ETLNIESNG | | FDFTKWNVTY | | FKYGDGVWIGR | |
| ETLNVESNG | | ETLNVESNG | | FDGGHIEECS | | FKYGNGAWIGR | |
| ETNGNYGPI | | ETNGNYGPI | | FDGKEWLHVC | | FKYGNGVWIGR | |
| ETNHTDELC | | ETNHTDELC | | FDGKEWMHIC | | FLAHALKLVVA | |
| ETNHTGTYC | | ETNHTGTYC | | FDGKEWMHVC | | FLAPRYGYIIE | |
| ETNKFAAIC | | ETNKFAAIC | | FDGKEWMHVS | | FLARSALILRG | |
| ETNKFASIC | | ETNKFASIC | | FDGREWMHVC | | FLCVGWSSTSC | |
| ETNKLAAIC | | ETNKLAAIC | | FDILHKCDNE | | FLDIWTYNAEL | |

Fig. 83-85

| Block size 8 | SIN | Block size 9 | SIN | Block size 10 | SIN | Block size 11 | SIN |
|---|---|---|---|---|---|---|---|
| ETQCQTPLG | | ETQCQTPLG | | FDILHKCDNK | | FLDRLRRDQKS | |
| ETQTRGIFG | | ETQTRGIFG | | FDILHKCNNE | | FLDVWTYNAEL | |
| ETRCQTPLG | | ETRCQTPLG | | FDKLYIWGIH | | FLENGWEGMVD | |
| ETRGLFGAI | | ETRGLFGAI | | FDKLYIWGVH | | FLFSSIKKYER | |
| ETRINMINS | | ETRINMINS | | FDKLYVWGIH | | FLGQWDWPDGA | |
| ETRVWWTSN | | ETRVWWTSN | | FDKLYVWGVH | | FLGQWNWPDGA | |
| ETSHTGTYC | | ETSHTGTYC | | FDSLNITAAS | | FLGVWTYNAEL | |
| ETTGRNCTI | | ETTGRNCTI | | FDSNGNFIAP | | FLHNGGLIAPS | |
| ETTGRNCTV | | ETTGRNCTV | | FDVPDYQSLR | | FLLMDALKLSI | |
| ETTHTGTYC | | ETTHTGTYC | | FDWTLNRNQP | | FLLMDSLKLSI | |
| ETVEERFEI | | ETVEERFEI | | FEANGNLIAP | | FLNNTEPLCDV | |
| ETVEITGID | | ETVEITGID | | FEATGNLIAP | | FLNNTEPLCEV | |
| ETVEITGIN | | ETVEITGIN | | FEATGNLLVP | | FLNNTEPLCNV | |
| ETVNTLIEQ | | ETVNTLIEQ | | FEATGNLVAP | | FLNVWTYNAEL | |
| ETVNTLSEQ | | ETVNTLSEQ | | FEATGNLVVP | | FLQALQLLLEV | |
| ETVNTLTEQ | | ETVNTLTEQ | | FEAVAWSATA | | FLRSNAPSGIE | |
| ETWPIGESP | | ETWPIGESP | | FECITPNGSI | | FLRSNAPSGVE | |
| ETWPVGESP | | ETWPVGESP | | FECRTFFLTQ | | FLSMEFSLTDP | |
| ETYKILTIY | | ETYKILTIY | | FEECSCYPSG | | FLTHGALLNDK | |
| ETYVLSIIP | | ETYVLSIIP | | FEECSCYPSR | | FLTHGSLLNDK | |
| ETYVLSIVP | | ETYVLSIVP | | FEFTSFFYRY | | FLTQGALLNDK | |
| ETYVLSVIP | | ETYVLSVIP | | FEFWHKCDDE | | FLTQGALLNDR | |
| EVALGYSTG | | EVALGYSTG | | FEFWHKCDND | | FLTQGSLLNDK | |
| EVALSYSAG | | EVALSYSAG | | FEFWHKCDNE | | FLTQGSLLNDR | |
| EVALSYSTG | | EVALSYSTG | | FEFWHKCNNE | | FLTQGSLPNDK | |
| EVCFMYSDF | | EVCFMYSDF | | FEFYHKCDDE | | FLTSSIVCPGK | |
| EVCLKWDLM | | EVCLKWDLM | | FEFYHKCDNE | | FLVALENQHTI | |
| EVCLKWELM | | EVCLKWELM | | FEFYHKCNDE | | FLVAVENQHTI | |
| EVDNNGELR | | EVDNNGELR | | FEGGWTGMID | | FLVCVSLLQSA | |
| EVEGRIQDL | | EVEGRIQDL | | FEGWIGGNPA | | FLVLMENERTL | |
| EVEKQIGNV | | EVEKQIGNV | | FEGWIVGNPA | | FLWCKIVTTVG | |
| EVEKQLGNV | | EVEKQLGNV | | FEGWIVGNPS | | FLWGIHHPPDA | |
| EVENEIRTF | | EVENEIRTF | | FEIFHKCDDD | | FLWGIHHPPDE | |
| EVEQEIRAF | | EVEQEIRAF | | FEIFHKCDDH | | FLWGIHHPPDT | |
| EVEQEIRTF | | EVEQEIRTF | | FEIFHKCDDN | | FLWGIHHPPNT | |
| EVEQEMRTF | | EVEQEMRTF | | FEIFHKCDDQ | | FLWISFAISCF | |
| EVEQQIGNV | | EVEQQIGNV | | FEIFHKCDDR | | FLWMCSNGSLQ | |
| EVERQIGNV | | EVERQIGNV | | FEIFHKCDNQ | | FLYIRTNGTSK | |
| EVESEIRTF | | EVESEIRTF | | FEIFHQCDND | | FLYVRTNGTSK | |
| EVETYVLSI | | EVETYVLSI | | FEIFHQCDNN | | FMARSALILRG | |
| EVEVVNATE | | EVEVVNATE | | FEIFHRCDDQ | | FMCVGWSSTTC | |
| EVFVIREPC | | EVFVIREPC | | FEIIEGRDRA | | FMCVKNGNLRC | |
| EVFVIREPF | | EVFVIREPF | | FEIIEGRDRI | | FMCVKNGNMRC | |
| EVGAKILTS | | EVGAKILTS | | FEIIEGRDRN | | FMDVWTYNAEL | |
| EVGARIITS | | EVGARIITS | | FEIIEGRDRT | | FMIIGGFIFGC | |
| EVGARILTS | | EVGARILTS | | FEILLIEDGW | | FMQALQLLFEV | |
| EVGNGCFEF | | EVGNGCFEF | | FEILLIEEGW | | FMQALQLLLEV | |
| EVGTRWMKI | | EVGTRWMKI | | FEKEGYSLVG | | FMWAIHHPPTS | |
| EVGYLCAGI | | EVGYLCAGI | | FEKFFPSSSY | | FMYSDFHFIDE | |
| EVHIYYLEK | | EVHIYYLEK | | FEKIKILPRD | | FMYSDFHFINE | |
| EVHMYYLEK | | EVHMYYLEK | | FEKVKILARN | | FNCLYASPQLE | |
| EVHTYYLEK | | EVHTYYLEK | | FEKVKILPKD | | FNEGHIEECSC | |
| EVHVYYLEK | | EVHVYYLEK | | FEKVKILPRD | | FNEIEHQIGNV | |
| EVILWFSFG | | EVILWFSFG | | FEKVRILPKD | | FNEIEQQIGNV | |
| EVITAQELV | | EVITAQELV | | FELIDNEFNE | | FNEIEYQIGNV | |
| EVKLEENTT | | EVKLEENTT | | FELIDNEFSE | | FNEVEQQIGNV | |
| EVKRRLSAN | | EVKRRLSAN | | FELIDNEFTE | | FNFFHKCNDSC | |
| EVKRRLSTN | | EVKRRLSTN | | FELINNEFNE | | FNFILLTHWAY | |
| EVKYVWWTS | | EVKYVWWTS | | FELLHKCNDS | | FNFNGAFIAPD | |
| EVLFIEDGW | | EVLFIEDGW | | FELLHKCNNS | | FNGAFIAPDRA | |
| EVLFQGGHI | | EVLFQGGHI | | FELLHKCNNT | | FNGAFIAPDRV | |
| EVLHLTQGA | | EVLHLTQGA | | FEMIDNEFNE | | FNGAFIAPNRA | |

Fig. 83-86

| Block size 8 | SIN | Block size 9 | SIN | Block size 10 | SIN | Block size 11 | SIN |
|---|---|---|---|---|---|---|---|
| EVLHLTQGT | | EVLHLTQGT | | FEMIWDANGW | | FNGAFVAPDRV | |
| EVLKGSARH | | EVLKGSARH | | FEMIWDPDGW | | FNGGHIEECSC | |
| EVLKVPDAE | | EVLKVPDAE | | FEMIWDPNGW | | FNGSLQCRICI | |
| EVLKVPNAE | | EVLKVPNAE | | FEMLKIHNAG | | FNKACELTDSI | |
| EVLLIEDGW | | EVLLIEDGW | | FEMLKIPNAE | | FNKACELTDSS | |
| EVLNNKHWS | | EVLNNKHWS | | FEMLKIPNAG | | FNKACELTDST | |
| EVLNNKNWS | | EVLNNKNWS | | FEMLKVPNAE | | FNKACELTDSV | |
| EVLNNMNWS | | EVLNNMNWS | | FEMLKVPNAG | | FNKACELTGSS | |
| EVLNNRNWS | | EVLNNRNWS | | FEMLRIPNAG | | FNKLYIWGVHH | |
| EVLTGNLQA | | EVLTGNLQA | | FEMVWDANGW | | FNLLHKCNDSC | |
| EVLTGNLQT | | EVLTGNLQT | | FEMVWDPNGW | | FNLLIGISNVG | |
| EVLWTSNSI | | EVLWTSNSI | | FEPFQSLIPK | | FNMERIKELRD | |
| EVNGPESVL | | EVNGPESVL | | FEPFQSLVPK | | FNMERIKELRY | |
| EVNSWHIFS | | EVNSWHIFS | | FEPFQSLVPR | | FNMLSTVLGVS | |
| EVNSWHILS | | EVNSWHILS | | FEPNGCIEGK | | FNNLEKRLENL | |
| EVPAQNAIS | | EVPAQNAIS | | FEPNGCIESK | | FNNLERRLENL | |
| EVPGWSWDD | | EVPGWSWDD | | FEPNGSIEGK | | FNNLTKGLCII | |
| EVPGWSWGD | | EVPGWSWGD | | FEPNGYIEGK | | FNNLTKGLCTI | |
| EVPSPYNSR | | EVPSPYNSR | | FEQIEGRIQD | | FNNLTKRLCTI | |
| EVRRIWRQA | | EVRRIWRQA | | FEQITFIQAL | | FNNLTRELCTI | |
| EVRRRLSAN | | EVRRRLSAN | | FEQITFLQAL | | FNNLTRGLCTI | |
| EVRRRLSTN | | EVRRRLSTN | | FEQITFMQAL | | FNNTEPLCEVS | |
| EVRRRLSVN | | EVRRRLSVN | | FEQVEGRIQD | | FNPCFYVELIR | |
| EVSEAQGTE | | EVSEAQGTE | | FEQVEGRIQY | | FNQVEKRINMI | |
| EVSETQGIE | | EVSETQGIE | | FEQVEGRTQD | | FNQVEKRINML | |
| EVSETQGME | | EVSETQGME | | FEREGYSLVG | | FNQVENRINML | |
| EVSETQGTE | | EVSETQGTE | | FERVKRQLRE | | FNQVEQRINML | |
| EVSFQGGHI | | EVSFQGGHI | | FERVRHQLRE | | FNSDLDYQIGY | |
| EVSFQGRGV | | EVSFQGRGV | | FERVRRQLRE | | FNSDPDYQIGY | |
| EVSFRGGHI | | EVSFRGGHI | | FESDGAFLAP | | FNSFLAHALKL | |
| EVSFRGRGV | | EVSFRGRGV | | FESIAWSATA | | FNSFLTHALRF | |
| EVSHCRATE | | EVSHCRATE | | FESIESEFNE | | FNSFLVHALKS | |
| EVSLSYSTG | | EVSLSYSTG | | FESIESEFSE | | FNSIGNLIAPR | |
| EVSSWHILS | | EVSSWHILS | | FESNGAFIAP | | FNSIYASPQLE | |
| EVSWTSNSI | | EVSWTSNSI | | FESNGAFLAP | | FNSLYASPQLE | |
| EVTNATELV | | EVTNATELV | | FESNGALLAP | | FNSLYASSQLE | |
| EVTNATETV | | EVTNATETV | | FESNGGFLAP | | FNSLYSSPQLE | |
| EVTTHFQRK | | EVTTHFQRK | | FESNGGLIAP | | FNSNLDYQIGY | |
| EVVAAQELV | | EVVAAQELV | | FESNGGLLAP | | FNSSLTHALRE | |
| EVVDATETV | | EVVDATETV | | FESNGNFIAP | | FNTIGNLIAPR | |
| EVVFPNEVG | | EVVFPNEVG | | FESNGNFITP | | FNTIGNLVAPR | |
| EVVNATETV | | EVVNATETV | | FESNGNLIAP | | FPDGAKIQYFS | |
| EVVSAKELV | | EVVSAKELV | | FESSGGLLAP | | FPDGAQIKYFS | |
| EVVTAQELV | | EVVTAQELV | | FESTGNFIAP | | FPDGAQIQYFS | |
| EVWIGRTKS | | EVWIGRTKS | | FESTGNLIAP | | FPDGPQIQYFS | |
| EVWSYNADL | | EVWSYNADL | | FESTGNLVAP | | FPFHKDNAIRL | |
| EVWSYNAEF | | EVWSYNAEF | | FESVAWSASA | | FPFHKDNAIRP | |
| EVWSYNAEL | | EVWSYNAEL | | FESVAWSATA | | FPFHKDNALRL | |
| EVWWTSNSI | | EVWWTSNSI | | FESVGWSATA | | FPFHKDNAVRL | |
| EVYNETVRL | | EVYNETVRL | | FEVLFIEDGW | | FPFHKGNSARL | |
| EVYNETVRV | | EVYNETVRV | | FEVLLIEDGW | | FPGELDNNGEL | |
| EVYSETVRV | | EVYSETVRV | | FFCLKNGNMR | | FPGEVDNNGEL | |
| EWDIFIERP | | EWDIFIERP | | FFCLRNGNMR | | FPIGTAPILGN | |
| EWDVFIERP | | EWDVFIERP | | FFFCLKNGNM | | FPIGTAPVLGN | |
| EWDVFVERP | | EWDVFVERP | | FFGAIAGFIE | | FPIGVAPVLGN | |
| EWDVYIERP | | EWDVYIERP | | FFHKCNDSCM | | FPMGTAPVLGN | |
| EWGNGCFEF | | EWGNGCFEF | | FFITQGSLLN | | FPNEVGAKILT | |
| EWIKTRPIL | | EWIKTRPIL | | FFLTHGALLN | | FPNEVGARIIT | |
| EWLHVCITG | | EWLHVCITG | | FFLTHGSLLN | | FPNEVGARILA | |
| EWLKTRPIL | | EWLKTRPIL | | FFLTQGALLN | | FPNEVGARILT | |
| EWMHICMTG | | EWMHICMTG | | FFLTQGSLLN | | FPNGAQIQYFS | |
| EWMHVCITG | | EWMHVCITG | | FFNNTEPLCE | | FPQLNQTYRNN | |

Fig. 83-87

| Block size 8 | SIN | Block size 9 | SIN | Block size 10 | SIN | Block size 11 | SIN |
|---|---|---|---|---|---|---|---|
| EWMHVCMAG | | EWMHVCMAG | | FFPDGPQIQY | | FPQLNQTYRNT | |
| EWMHVCMTG | | EWMHVCMTG | | FFPFHKDNAI | | FPQTANTYRNT | |
| EWSGYSGSF | | EWSGYSGSF | | FFPFHKDNAL | | FPQTTNTYRNT | |
| EWSKRYELE | | EWSKRYELE | | FFPFHKDNAV | | FPRTTNTYRNT | |
| EWSRRYELE | | EWSRRYELE | | FFPFHKGNSA | | FPSSSYRRPIG | |
| EWSWDDGAI | | EWSWDDGAI | | FFPSSSYRRP | | FPSSSYRRPVG | |
| EWSYIIEKE | | EWSYIIEKE | | FFRNIVWLIK | | FPSTGNHGSLV | |
| EWSYIMEKE | | EWSYIMEKE | | FFRNVVWLIK | | FPVGSGSFPDG | |
| EWSYIMEKK | | EWSYIMEKK | | FFRNVVWLTK | | FPVGTAPVLGN | |
| EWSYIVEKA | | EWSYIVEKA | | FFRNVVWLVK | | FPVQTDEYKNT | |
| EWSYIVEKD | | EWSYIVEKD | | FFSRLNWLTK | | FPYTGDPPYSH | |
| EWSYIVEKE | | EWSYIVEKE | | FFWMCSNGSL | | FQGFFPFHKDN | |
| EWSYIVEKN | | EWSYIVEKN | | FFYRYGFVAN | | FQGGHIEECSC | |
| EWSYIVERE | | EWSYIVERE | | FGAIAGFIEG | | FQGRGVFEFSD | |
| EWSYIVERP | | EWSYIVERP | | FGAIAGFIEN | | FQGRGVFELSD | |
| EWSYIVERT | | EWSYIVERT | | FGAKAGFIEG | | FQHQNAEGIGI | |
| EWSYLIEDP | | EWSYLIEDP | | FGAKAGFIEN | | FQHQNAEGTGI | |
| EWTSNSLIA | | EWTSNSLIA | | FGASCFILLA | | FQHQNAEGTGM | |
| EYAEESKLK | | EYAEESKLK | | FGASCFLFLA | | FQHQNEQGMGM | |
| EYASKTRIS | | EYASKTRIS | | FGASCFLLIA | | FQHQNEQGTGI | |
| EYDAVATTH | | EYDAVATTH | | FGASCFLLLA | | FQHQNEQGVGI | |
| EYEEEAKLE | | EYEEEAKLE | | FGASCFVLLA | | FQHQNEQGVGM | |
| EYEEESKLK | | EYEEESKLK | | FGASCVMLLA | | FQHQNSEGTGI | |
| EYGFKISKR | | EYGFKISKR | | FGASSFVLLA | | FQHRDEEGTGI | |
| EYGFKISRR | | EYGFKISRR | | FGCQNGNIRC | | FQHRNEEGTGI | |
| EYGFRISKR | | EYGFRISKR | | FGCQNGNVRC | | FQHRNEEGTGV | |
| EYGHLITGK | | EYGHLITGK | | FGDNPRPADG | | FQIQGIKLTQG | |
| EYGHLTTGK | | EYGHLTTGK | | FGDNPRPDDG | | FQIQGVKLAQG | |
| EYGHLVTGK | | EYGHLVTGK | | FGDNPRPMDG | | FQIQGVKLIQG | |
| EYGKGRIFQ | | EYGKGRIFQ | | FGDNPRPMDS | | FQIQGVKLTQG | |
| EYGRGRIFQ | | EYGRGRIFQ | | FGDNPRPNDG | | FQIQGVRLTQG | |
| EYGYLITGK | | EYGYLITGK | | FGDNPRPSDG | | FQLFLVCVSLL | |
| EYKDWILWI | | EYKDWILWI | | FGDNPRPVDG | | FQLIPMISKCK | |
| EYKNTGDSD | | EYKNTGDSD | | FGDNPRSVDG | | FQLIPMISKCR | |
| EYKNTRDSD | | EYKNTRDSD | | FGDSPRPNDG | | FQLIPMISKSR | |
| EYKNTRDSN | | EYKNTRDSN | | FGDTPRPNDG | | FQNASRHHMGE | |
| EYNETIRIE | | EYNETIRIE | | FGEGEQIIVT | | FQNASRHYMGE | |
| EYNETVKVE | | EYNETVKVE | | FGESEQIIVT | | FQNASRYYMGE | |
| EYNETVRIE | | EYNETVRIE | | FGESEQIVVT | | FQNICKPYIGK | |
| EYNETVRTE | | EYNETVRTE | | FGESEQVIVT | | FQNIDKNALGD | |
| EYNETVRVE | | EYNETVRVE | | FGFGASCFLL | | FQNIDKNALGE | |
| EYNGKSLGI | | EYNGKSLGI | | FGFRQGDDVW | | FQNIDRNAIGD | |
| EYNNTTGRD | | EYNNTTGRD | | FGFRQGNDVW | | FQNIDRNALGD | |
| EYPLQNLTK | | EYPLQNLTK | | FGFRQGNNVW | | FQNIDSRAVGK | |
| EYQIGNVIN | | EYQIGNVIN | | FGFRQGNSVW | | FQNIDSWAVGR | |
| EYQSLRSIL | | EYQSLRSIL | | FGFRQGSDVW | | FQNIEKNALGD | |
| EYRQEALQN | | EYRQEALQN | | FGFRQGTDVW | | FQNIERNALGD | |
| EYSIDSSYV | | EYSIDSSYV | | FGFRQGTSVW | | FQNIERNALGN | |
| EYTLDEESR | | EYTLDEESR | | FGGFTFKRTK | | FQNINRITYGA | |
| EYYFVKEGK | | EYYFVKEGK | | FGGFTFKRTN | | FQNLSPRTVGQ | |
| FAAAPPEQS | | FAAAPPEQS | | FGGFTFKRTS | | FQNQVKIRRRV | |
| FAAAPPKQS | | FAAAPPKQS | | FGKDNAIRIG | | FQNTSKHYIGK | |
| FAAAPPVQS | | FAAAPPVQS | | FGKDNAVRIG | | FQNTSRHYIGK | |
| FAAICTHLE | | FAAICTHLE | | FGLICATCEQ | | FQNTSRHYMGE | |
| FAAICTHME | | FAAICTHME | | FGLIDNEFNE | | FQNVNKITYGA | |
| FADQELGDA | | FADQELGDA | | FGLVCATCEQ | | FQNVNRITYGA | |
| FAFKQGNSV | | FAFKQGNSV | | FGNLERRLEN | | FQNVNRITYGP | |
| FAGKNADLE | | FAGKNADLE | | FGPVHFQNQV | | FQNVNRITYGV | |
| FAGKNSDLE | | FAGKNSDLE | | FGPVHFRNQI | | FQNVSRIAIGN | |
| FAGKNTDLE | | FAGKNTDLE | | FGPVHFRNQV | | FQPCFYIELIR | |
| FAGWILGNP | | FAGWILGNP | | FGPVHFRSQV | | FQPCFYVELIR | |
| FAGWLLGNP | | FAGWLLGNP | | FGQVEGRIQD | | FQPCFYVELTR | |

Fig. 83-88

| Block size 8 | SIN | Block size 9 | SIN | Block size 10 | SIN | Block size 11 | SIN |
|---|---|---|---|---|---|---|---|
| FAIASKDNG | | FAIASKDNG | | FGRIDFHWLM | | FQPNIGPRALV | |
| FAIFSKDNG | | FAIFSKDNG | | FGVSGINESA | | FQPNIGPRPLV | |
| FAIISKDNG | | FAIISKDNG | | FGVSGVNESA | | FQQMRDILGTF | |
| FAISCFLIC | | FAISCFLIC | | FGYFGIFFVE | | FQQMRDVLGTF | |
| FAISCFLLC | | FAISCFLLC | | FGYLLKGESH | | FQSCFYVELIR | |
| FAISCLLLC | | FAISCLLLC | | FGYLLKGESY | | FQTAAQKAMMD | |
| FAIVSKDNG | | FAIVSKDNG | | FGYLLRGESH | | FQTAAQRAMMD | |
| FAKDNSIRL | | FAKDNSIRL | | FHDSNVKNLY | | FQTAAQRAMVD | |
| FALAQGALL | | FALAQGALL | | FHDSNVKSLY | | FQVDCFIWHIR | |
| FALAQGALV | | FALAQGALV | | FHDSNVRNLY | | FQVDCFLWHIR | |
| FALAQGTLL | | FALAQGTLL | | FHFEECSCYP | | FQVDCFLWHVR | |
| FALAQGVLL | | FALAQGVLL | | FHHSNAEGTG | | FQVDCFLWYVR | |
| FALGHGTTL | | FALGHGTTL | | FHHSNSEGTG | | FQVDCYLWHIR | |
| FALGQGATL | | FALGQGATL | | FHKCDDDCMA | | FQYLLFQDILM | |
| FALGQGTTL | | FALGQGTTL | | FHKCDDHCME | | FRALISWEMGL | |
| FALSGVAIA | | FALSGVAIA | | FHKCDDQCME | | FRALISWEMGQ | |
| FALSGVAIS | | FALSGVAIS | | FHKCDNQCME | | FRALISWGMGQ | |
| FALSGVAIT | | FALSGVAIT | | FHKCNDSCME | | FRALVSWEMGQ | |
| FALSGVAVA | | FALSGVAVA | | FHKDNAIRLG | | FRAYVDGFEPN | |
| FALSQGALL | | FALSQGALL | | FHKDNAIRPG | | FRAYVDGFKPN | |
| FALSQGTTL | | FALSQGTTL | | FHKDNALRLA | | FRDNLEPGTFD | |
| FAMSCFLLC | | FAMSCFLLC | | FHKDNAVRLG | | FRDVWTYNAEL | |
| FAPFAKDNS | | FAPFAKDNS | | FHKGIVIKEE | | FREQKQEFKMN | |
| FAPFSKDNG | | FAPFSKDNG | | FHKGLIIKEE | | FRGFFPFHKDN | |
| FAPFSKDNS | | FAPFSKDNS | | FHKGLLIKEE | | FRGGHIEECSC | |
| FAPFTKDNS | | FAPFTKDNS | | FHKGLVIKEE | | FRGLISTPLGS | |
| FAPLSKDNS | | FAPLSKDNS | | FHKGLVVKEE | | FRGLISTPLGT | |
| FASAPPEQS | | FASAPPEQS | | FHKGNSARLI | | FRGLMSTPLGT | |
| FASICTHLE | | FASICTHLE | | FHLGTKQVCA | | FRGRGVFELSD | |
| FASSGIAIA | | FASSGIAIA | | FHLGTKQVCI | | FRHQNAEGTGT | |
| FASSGIAIV | | FASSGIAIV | | FHLGTKQVCM | | FRHQNAQGEGI | |
| FATSCFLLC | | FATSCFLLC | | FHLGTKQVCV | | FRHQNAQGEGT | |
| FAYDKICIG | | FAYDKICIG | | FHLGTRQVCI | | FRHQNAQGIGQ | |
| FAYGSSINS | | FAYGSSINS | | FHLGTRQVCM | | FRHQNAQGQGT | |
| FCFTVMTDG | | FCFTVMTDG | | FHLGTRQVCV | | FRHQNAQGTGQ | |
| FCGASGTYG | | FCGASGTYG | | FHNIHPLAIG | | FRHQNSEGTGT | |
| FCGLDNEPG | | FCGLDNEPG | | FHNIHPLTIG | | FRHQNTQGEGT | |
| FCGLNNEPG | | FCGLNNEPG | | FHNIHPLTMG | | FRISKRGSSGI | |
| FCGTPGTYG | | FCGTPGTYG | | FHNVHPFTIG | | FRNALSIAPIM | |
| FCGTSGIYG | | FCGTSGIYG | | FHNVHPLAIG | | FRNILSIAPIM | |
| FCGTSGSYG | | FCGTSGSYG | | FHNVHPLTIG | | FRNILSMAPIM | |
| FCGTSGTCG | | FCGTSGTCG | | FHQCDNNCIE | | FRNQIKIRRRV | |
| FCGTSGTYG | | FCGTSGTYG | | FHQIEKEFSE | | FRNQVKIRRRV | |
| FCGTTGTYG | | FCGTTGTYG | | FHRCDDQCME | | FRNVLSIAPIM | |
| FCGVDSDTT | | FCGVDSDTT | | FHRKRRVRDN | | FRNVLSVAPIM | |
| FCGVNSDTT | | FCGVNSDTT | | FHSDTPRPAD | | FRPNIGPRPLI | |
| FCGVSGEVP | | FCGVSGEVP | | FHSDTPRPDD | | FRPNIGPRPLV | |
| FCGVSSEVP | | FCGVSSEVP | | FHSDTPRPSD | | FRQGNNVWAGR | |
| FCLKNGNMQ | | FCLKNGNMQ | | FHSDTPRPTD | | FRQGNSVWAGR | |
| FCLKNGNMR | | FCLKNGNMR | | FHSDTPRPVD | | FRQGTSVWAGR | |
| FCLRNGNMR | | FCLRNGNMR | | FHWMLLDPGD | | FRQSERGEDTI | |
| FCSIDGKAP | | FCSIDGKAP | | FHYEECSCYP | | FRQSERGEETI | |
| FCSINGKAP | | FCSINGKAP | | FIAEQFTWNG | | FRQSERGEETV | |
| FCSINGKEP | | FCSINGKEP | | FIAPDRASFF | | FRRPDSSWLFG | |
| FCSINGKQP | | FCSINGKQP | | FIAPDRASFL | | FRTLMSCPIGV | |
| FCSLDGKAP | | FCSLDGKAP | | FIAPDRATFL | | FRTLMSCPMGV | |
| FCYPGELDN | | FCYPGELDN | | FIAPDRVSFL | | FRTLMSCPVGV | |
| FCYTLITDG | | FCYTLITDG | | FIAPENAYKI | | FRTYVDGFEPN | |
| FCYTLMTDG | | FCYTLMTDG | | FIAPEYAFKI | | FRTYVDGFKPN | |
| FCYTLVTDG | | FCYTLVTDG | | FIAPEYAYIV | | FRVYVDGFEPN | |
| FDDRLRRDQ | | FDDRLRRDQ | | FIAPEYAYKI | | FRYGDGVWIGR | |
| FDERRNKYL | | FDERRNKYL | | FIAPEYAYKV | | FRYGNGVWIGR | |

Fig. 83-89

| Block size 8 | SIN | Block size 9 | SIN | Block size 10 | SIN | Block size 11 | SIN |
|---|---|---|---|---|---|---|---|
| FDERRNRYL | | FDERRNRYL | | FIAPEYAYRI | | FRYSGIKTDGA | |
| FDEVKRRLS | | FDEVKRRLS | | FIAPNRASFF | | FRYSGIRTDGA | |
| FDEVRRRLS | | FDEVRRRLS | | FICIKDGNMR | | FSAESRKLLLI | |
| FDFIKWNVT | | FDFIKWNVT | | FICIKNGNMQ | | FSAESRKLLLV | |
| FDFSKWNVT | | FDFSKWNVT | | FICIKNGNMR | | FSAESRKMLLI | |
| FDFTKWNVT | | FDFTKWNVT | | FICIKNGNVR | | FSARSALILRG | |
| FDGGHIEEC | | FDGGHIEEC | | FICVGWSSTS | | FSEIEGRIQDL | |
| FDGKEWLHV | | FDGKEWLHV | | FICVGWSSTT | | FSEIEHQIGNV | |
| FDGKEWMHI | | FDGKEWMHI | | FICVKNGNHA | | FSEIEHQISNV | |
| FDGKEWMHV | | FDGKEWMHV | | FICVKNGNMQ | | FSEIEQQIGNV | |
| FDGREWMHV | | FDGREWMHV | | FICVKNGNMR | | FSETEHQIGNV | |
| FDILHKCDN | | FDILHKCDN | | FIDIWTYNAE | | FSEVEGRIQDL | |
| FDILHKCNN | | FDILHKCNN | | FIDVWTYNAE | | FSFGASCFIFL | |
| FDKLYIWGI | | FDKLYIWGI | | FIEGGWCGMI | | FSFGASCFILL | |
| FDKLYIWGV | | FDKLYIWGV | | FIEGGWPGLI | | FSFGASCFLFL | |
| FDKLYVWGI | | FDKLYVWGI | | FIEGGWPGLV | | FSFGASCFLLI | |
| FDKLYVWGV | | FDKLYVWGV | | FIEGGWQGLV | | FSFGASCFLLL | |
| FDMNNEGSY | | FDMNNEGSY | | FIEGGWQGMI | | FSFGASCFVLL | |
| FDMSKEGSY | | FDMSKEGSY | | FIEGGWQGMV | | FSFGASCVMLL | |
| FDMSNDGSY | | FDMSNDGSY | | FIEGGWSGLI | | FSFGASSFVLL | |
| FDMSNEGSY | | FDMSNEGSY | | FIEGGWSGLV | | FSFGGFTFKRT | |
| FDSLNITAA | | FDSLNITAA | | FIEGGWSGMI | | FSFIGEEMATK | |
| FDSNGNFIA | | FDSNGNFIA | | FIEGGWTGLI | | FSFNGAFIAPD | |
| FDVPDYQSL | | FDVPDYQSL | | FIEGGWTGMI | | FSFNGAFVAPD | |
| FDVYQILAI | | FDVYQILAI | | FIEGGWTGMV | | FSFNGEEMATK | |
| FDWTLNRNQ | | FDWTLNRNQ | | FIEGRWPGLV | | FSFQLINNKKP | |
| FDYSGWNVT | | FDYSGWNVT | | FIEIGVTRRE | | FSFRYGDGVWI | |
| FDYSKWNVS | | FDYSKWNVS | | FIENGWEGLI | | FSFSISCFLLV | |
| FDYSKWNVT | | FDYSKWNVT | | FIENGWEGLV | | FSFTGEEMASK | |
| FDYSRWNVT | | FDYSRWNVT | | FIENGWEGMI | | FSFTGEEMATK | |
| FEAIGREFN | | FEAIGREFN | | FIENGWEGMM | | FSFTGEEMATR | |
| FEANGNLIA | | FEANGNLIA | | FIENGWEGMV | | FSGGHIEECSC | |
| FEATGNLIA | | FEATGNLIA | | FIENGWQGLI | | FSGIKSFSRTE | |
| FEATGNLLV | | FEATGNLLV | | FIERPTAVDT | | FSGIKSFSRTQ | |
| FEATGNLVA | | FEATGNLVA | | FIEVEKQIGN | | FSGIRSFSRTE | |
| FEATGNLVV | | FEATGNLVV | | FIFGCQNGNI | | FSGKNTDLEAL | |
| FEAVAWSAT | | FEAVAWSAT | | FIFGCQNGNV | | FSGMSANGDIL | |
| FEAVGKEFN | | FEAVGKEFN | | FIFILLTHWA | | FSGSQKQEFKM | |
| FEAVGREFN | | FEAVGREFN | | FIFLLLTHWA | | FSGVNSFSRTE | |
| FEAVGREFS | | FEAVGREFS | | FIFNGAFIAP | | FSHNGGLIAPD | |
| FECITPNGS | | FECITPNGS | | FIIKGRSHLR | | FSHNGGLIAPS | |
| FEECSCYPS | | FEECSCYPS | | FIIREPFISC | | FSHNGGLVAPS | |
| FEFSDERAA | | FEFSDERAA | | FIIREPFVSC | | FSIAASYKRIR | |
| FEFTSFFYR | | FEFTSFFYR | | FIKDYRYTYR | | FSILHKCNDSC | |
| FEFWHKCDD | | FEFWHKCDD | | FIKWNVTYTG | | FSIRGETTGRN | |
| FEFWHKCDN | | FEFWHKCDN | | FILWACQNGN | | FSIRWETTGRN | |
| FEFWHKCNN | | FEFWHKCNN | | FILWACQTGN | | FSISCFLLAAL | |
| FEFYHKCDD | | FEFYHKCDD | | FILWACSSGN | | FSISCFLLIAL | |
| FEFYHKCDN | | FEFYHKCDN | | FIMWACNSGN | | FSISCFLLVAL | |
| FEFYHKCND | | FEFYHKCND | | FIMWACQKGN | | FSKDNAIRIGE | |
| FEFYHKCNN | | FEFYHKCNN | | FIMWACQRGN | | FSKDNGIRIGS | |
| FEFYHRCDD | | FEFYHRCDD | | FIMWACSNGN | | FSKDNSIQLSA | |
| FEFYHRCDN | | FEFYHRCDN | | FIMWACSNGS | | FSKDNSIRLAA | |
| FEGWIGGNP | | FEGWIGGNP | | FIMWACSSGN | | FSKDNSIRLSA | |
| FEGWIVGNP | | FEGWIVGNP | | FIMWTCNSGN | | FSKDNSVRLSA | |
| FEIFHKCDD | | FEIFHKCDD | | FIMWTCQKGN | | FSKWNVTYTGT | |
| FEIFHKCDN | | FEIFHKCDN | | FIQALQLLLE | | FSLLHKCNDSC | |
| FEIFHQCDN | | FEIFHQCDN | | FIQHPELTGL | | FSMELPSFGVS | |
| FEIFHQCNN | | FEIFHQCNN | | FIQNALNGNG | | FSMSCFVFVAL | |
| FEIFHRCDD | | FEIFHRCDD | | FISCSHLECR | | FSNAASYKRIR | |
| FEIFHRCDN | | FEIFHRCDN | | FISCSHMECR | | FSNKMARLGKG | |
| FEIIEGRDR | | FEIIEGRDR | | FISCSHSECR | | FSNKMARLGRG | |

Fig. 83-90

| Block size 8 | SIN | Block size 9 | SIN | Block size 10 | SIN | Block size 11 | SIN |
|---|---|---|---|---|---|---|---|
| FEILHKCDD | | FEILHKCDD | | FISCSYLECR | | FSNKVARLGKG | |
| FEILHKCDN | | FEILHKCDN | | FITPEYAYKI | | FSNLEKRLENL | |
| FEILHKCND | | FEILHKCND | | FIVKGRSHLR | | FSNLERRLENL | |
| FEILHRCDD | | FEILHRCDD | | FIVWACQRGN | | FSPSPGARPKV | |
| FEILHRCND | | FEILHRCND | | FIWAIHHPPT | | FSPSPGDRPKV | |
| FEILLIEDG | | FEILLIEDG | | FIYSGIRTNG | | FSQVEQRINML | |
| FEILLIEEG | | FEILLIEEG | | FKADLIIERR | | FSQVERRINML | |
| FEKEGYSLV | | FEKEGYSLV | | FKGFFPFHKD | | FSRLNWLTKAT | |
| FEKFEIFPK | | FEKFEIFPK | | FKHQNAQGEG | | FSRLNWLTKET | |
| FEKFFPSSS | | FEKFFPSSS | | FKISKRGGSG | | FSRTELINPNK | |
| FEKIKILPR | | FEKIKILPR | | FKISKRGNSG | | FSRTELINPSK | |
| FEKVKILAR | | FEKVKILAR | | FKISKRGSSG | | FSRTELIPPSK | |
| FEKVKILPK | | FEKVKILPK | | FKISRRGNSG | | FSRTELISPNK | |
| FEKVKILPR | | FEKVKILPR | | FKLIDNEFTE | | FSRTELISPSK | |
| FEKVRILPK | | FEKVRILPK | | FKMNPNKKII | | FSSAASYKRIR | |
| FELIDNEFN | | FELIDNEFN | | FKMNPNQKII | | FSSAASYKRVR | |
| FELIDNEFS | | FELIDNEFS | | FKNTKGRDVL | | FSSIKKYERVK | |
| FELIDNEFT | | FELIDNEFT | | FKPNGCIEGK | | FSSIKRYERVK | |
| FELIDNKFN | | FELIDNKFN | | FKPNIGPRPF | | FSSLAVNVRGS | |
| FELINNEFN | | FELINNEFN | | FKPNIGPRPL | | FSSLTVNVRGS | |
| FELLHKCND | | FELLHKCND | | FKPPLPLCPF | | FSSLTVNVRGT | |
| FELLHKCNN | | FELLHKCNN | | FKPSLPLCPF | | FSSLTVSVRGS | |
| FELSDEKAA | | FELSDEKAA | | FKPSLPLCPV | | FSVGSGSFPDG | |
| FELSDEKAT | | FELSDEKAT | | FKQGNSVWAG | | FSVQRNLPFDK | |
| FELSDERAA | | FELSDERAA | | FKSPLPLCPF | | FSVQRNLPFEK | |
| FELSDERAT | | FELSDERAT | | FKSSLPLCPF | | FSVQRNLPFER | |
| FEMIDNEFN | | FEMIDNEFN | | FKSTQAAINQ | | FSVQRSLPFER | |
| FEMIWDANG | | FEMIWDANG | | FKSWKGNIMR | | FTAEISHCRAT | |
| FEMIWDPDG | | FEMIWDPDG | | FKYGDGVWIG | | FTAEVSHCRAT | |
| FEMIWDPNG | | FEMIWDPNG | | FKYGNGAWIG | | FTAEVSYCRAT | |
| FEMLKIHNA | | FEMLKIHNA | | FKYGNGVWIG | | FTDGSATGPAD | |
| FEMLKIPNA | | FEMLKIPNA | | FLAHALKLVV | | FTDGSATGPAE | |
| FEMLKVPNA | | FEMLKVPNA | | FLAMITYITK | | FTEEVSHCRAT | |
| FEMLRIPNA | | FEMLRIPNA | | FLAMITYITR | | FTEGHIEECSC | |
| FEMSNEGSY | | FEMSNEGSY | | FLAPRYGYII | | FTEVEGRIQDL | |
| FEMVWDANG | | FEMVWDANG | | FLARSALILR | | FTEVEKQIGNV | |
| FEMVWDPNG | | FEMVWDPNG | | FLCVGWSSTS | | FTEVEQQIGNV | |
| FEPFQSLIP | | FEPFQSLIP | | FLDIWTYNAE | | FTFNGAFIAPD | |
| FEPFQSLVP | | FEPFQSLVP | | FLDRLRRDQK | | FTFNGAFIAPN | |
| FEPNGCIEG | | FEPNGCIEG | | FLDVWTYNAE | | FTGWILGNPMC | |
| FEPNGCIES | | FEPNGCIES | | FLDVWTYNTE | | FTITGDNTKWN | |
| FEPNGSIEG | | FEPNGSIEG | | FLEIGVTRRE | | FTKWNVTHTGT | |
| FEPNGYIEG | | FEPNGYIEG | | FLFSSIKKYE | | FTKWNVTYTGI | |
| FEQITFIQA | | FEQITFIQA | | FLGQWDWPDG | | FTKWNVTYTGT | |
| FEQITFLQA | | FEQITFLQA | | FLGQWNWPDG | | FTLSGVAIALS | |
| FEQITFMQA | | FEQITFMQA | | FLGVWTYNAE | | FTLTVPSERGL | |
| FEQVEGRIQ | | FEQVEGRIQ | | FLHNGGLIAP | | FTNEEALRQII | |
| FEQVEGRTQ | | FEQVEGRTQ | | FLLMDALKLS | | FTSFFYRYGFV | |
| FEREGYSLV | | FEREGYSLV | | FLLMDSLKLS | | FTTEVSHCRAT | |
| FERFEIFPK | | FERFEIFPK | | FLNNTEPLCD | | FTWAIHHPPTS | |
| FERFEIFPN | | FERFEIFPN | | FLNNTEPLCE | | FTWAIHHPPTT | |
| FERFEMFPK | | FERFEMFPK | | FLNNTEPLCN | | FTWNGVKVDGS | |
| FERVKRQLR | | FERVKRQLR | | FLNVWTYNAE | | FVACGPAECRT | |
| FERVRHQLR | | FERVRHQLR | | FLPDLYDYKE | | FVACGPSECRT | |
| FERVRRQLR | | FERVRRQLR | | FLPVAGGTGS | | FVACGPTECRT | |
| FESDGAFLA | | FESDGAFLA | | FLPVAGGTSS | | FVACSPSECRT | |
| FESIESEFN | | FESIESEFN | | FLPVSGGTSS | | FVALILGFVLW | |
| FESIESEFS | | FESIESEFS | | FLPVTGGTSS | | FVANFSMELPS | |
| FESNGAFIA | | FESNGAFIA | | FLQALQLLLE | | FVENLEELRFV | |
| FESNGAFLA | | FESNGAFLA | | FLRSNAPSGI | | FVFSIAASYKR | |
| FESNGALLA | | FESNGALLA | | FLRSNAPSGV | | FVFSNAASYKR | |
| FESNGGFLA | | FESNGGFLA | | FLRVKDQQGN | | FVFSSAASYKR | |

Fig. 83-91

| Block size 8 | SIN | Block size 9 | SIN | Block size 10 | SIN | Block size 11 | SIN |
|---|---|---|---|---|---|---|---|
| FESNGGLIA | | FESNGGLIA | | FLRVRDQLGN | | FVFTLTVPSER | |
| FESNGGLLA | | FESNGGLLA | | FLRVRDQMGN | | FVFVALILGFV | |
| FESNGNFIA | | FESNGNFIA | | FLRVRDQQGN | | FVIREPFISCS | |
| FESNGNFIT | | FESNGNFIT | | FLRVRDQRGN | | FVIREPFVACG | |
| FESNGNLIA | | FESNGNLIA | | FLSMEFSLTD | | FVIREPFVACS | |
| FESSGGLLA | | FESSGGLLA | | FLTHGALLND | | FVIREPFVSCG | |
| FESTGNFIA | | FESTGNFIA | | FLTHGSLLND | | FVIREPFVSCS | |
| FESTGNLIA | | FESTGNLIA | | FLTMITYITR | | FVLMENERTLD | |
| FESTGNLVA | | FESTGNLVA | | FLTQGALLND | | FVLWACQNGNI | |
| FESVAWSAS | | FESVAWSAS | | FLTQGSLLND | | FVMREPFISCS | |
| FESVAWSAT | | FESVAWSAT | | FLTQGSLVND | | FVMWACQKGNI | |
| FESVEWSAT | | FESVEWSAT | | FLTSSIVCPG | | FVNITNVQNNY | |
| FESVGWSAT | | FESVGWSAT | | FLVALENQHT | | FVNRANQRLNP | |
| FEVLFIEDG | | FEVLFIEDG | | FLVAVENQHT | | FVNRANQRLNT | |
| FEVLLIEDG | | FEVLLIEDG | | FLVCVSLLQS | | FVNVTHVQNNY | |
| FEVMNHEFS | | FEVMNHEFS | | FLWCKIVTTV | | FVNVTNVQNDY | |
| FEVVDHEFS | | FEVVDHEFS | | FLWGIHHPPD | | FVNVTNVQNNY | |
| FEVVNHEFS | | FEVVNHEFS | | FLWGIHHPPN | | FVPVIGARPQV | |
| FFARLNWLT | | FFARLNWLT | | FLWMCSNGSL | | FVPVMGARPQV | |
| FFCLKDGNM | | FFCLKDGNM | | FLYIRTNGTS | | FVPVVGARPQV | |
| FFCLKNGNM | | FFCLKNGNM | | FLYVRTNGTS | | FVPVVGDRPLV | |
| FFCLKNGNT | | FFCLKNGNT | | FMARSALILR | | FVPVVRARPQV | |
| FFCLRNGNM | | FFCLRNGNM | | FMCVGWSSTT | | FVQHPELTGLD | |
| FFFCLKNGN | | FFFCLKNGN | | FMCVKNGNLR | | FVQHPELTGLN | |
| FFGAIAGFI | | FFGAIAGFI | | FMCVKNGNMR | | FVQHPELTGMD | |
| FFGDNAEEF | | FFGDNAEEF | | FMDVWTYNAE | | FVQHPELTGMN | |
| FFGDNAEEY | | FFGDNAEEY | | FMIIGGFIFG | | FVQHPELTGVD | |
| FFGDNAKEY | | FFGDNAKEY | | FMLWACQNGN | | FVQHPEMTGLD | |
| FFHKCNDSC | | FFHKCNDSC | | FMQALQLLFE | | FVQNALNGNGD | |
| FFLTHGALL | | FFLTHGALL | | FMQALQLLLE | | FVQNALSGNGD | |
| FFLTHGSLL | | FFLTHGSLL | | FMWAIHHPPT | | FVQSYFQLFLV | |
| FFLTQGALL | | FFLTQGALL | | FMYSDFHFID | | FVRGQQGRMDY | |
| FFLTQGSLL | | FFLTQGSLL | | FMYSDFHFIN | | FVRTLFQQMRD | |
| FFNNTEPLC | | FFNNTEPLC | | FNCLYASPQL | | FVSCGPSECRT | |
| FFPDGPQIQ | | FFPDGPQIQ | | FNDYEELKHL | | FVSMEFSLTDP | |
| FFPFHKDNA | | FFPFHKDNA | | FNEGHIEECS | | FVVREPFISCS | |
| FFPSSSYRR | | FFPSSSYRR | | FNEIEHQIGN | | FWIELIRGRPK | |
| FFRHMVWLI | | FFRHMVWLI | | FNEIEQQIGN | | FWKGGSIKTKL | |
| FFRNIVWLI | | FFRNIVWLI | | FNEIEYQIGN | | FWKGGSINTKL | |
| FFRNMIWLI | | FFRNMIWLI | | FNEVEKQIGN | | FWLEMIRGKPE | |
| FFRNMIWLT | | FFRNMIWLT | | FNEVEQQIGN | | FWLEMIRGKPK | |
| FFRNMVWLI | | FFRNMVWLI | | FNFFHKCNDS | | FWLEMIRGRPE | |
| FFRNMVWLT | | FFRNMVWLT | | FNFILLTHWA | | FWMCPNGSLQC | |
| FFRNMVWLV | | FFRNMVWLV | | FNFNGAFIAP | | FWMCSGHSCRI | |
| FFRNVVWLI | | FFRNVVWLI | | FNFNGAFVAP | | FWMCSNGPLQC | |
| FFRNVVWLT | | FFRNVVWLT | | FNGAFIAPDR | | FWMCSNGSLHG | |
| FFRNVVWLV | | FFRNVVWLV | | FNGAFIAPNR | | FWMCSNGSLQC | |
| FFRRLNWLT | | FFRRLNWLT | | FNGAFVAPDR | | FWMCSNGSLRC | |
| FFSRLNWLH | | FFSRLNWLH | | FNGGHIEECS | | FWRGDNGRRTR | |
| FFSRLNWLT | | FFSRLNWLT | | FNGSLQCRIC | | FWRGENGRKTR | |
| FFSRLNWLY | | FFSRLNWLY | | FNKACELTDS | | FWRGENGRRTR | |
| FFWMCSNGS | | FFWMCSNGS | | FNKLYIWGVH | | FWRGGSINTKL | |
| FFYRYGFVA | | FFYRYGFVA | | FNLLHKCNDS | | FWRGGSINTRL | |
| FGAIAGFIE | | FGAIAGFIE | | FNLLIGISNV | | FWTSNSIVALC | |
| FGAIAGFLE | | FGAIAGFLE | | FNMERIKELR | | FWVELIRGQPK | |
| FGAKAGFIE | | FGAKAGFIE | | FNMLSTVLGV | | FWVELIRGRPE | |
| FGASCFILL | | FGASCFILL | | FNNIKGRDVL | | FWVELIRGRPK | |
| FGASCFLFL | | FGASCFLFL | | FNNLEKRLEN | | FWVELVRGRPK | |
| FGASCFLLI | | FGASCFLLI | | FNNLERRLEN | | FWVEMIRGEPE | |
| FGASCFLLL | | FGASCFLLL | | FNNLTKELCT | | FWVEMIRGKPE | |
| FGASCFVLL | | FGASCFVLL | | FNNLTKGLCT | | FWVEMIRGQPK | |
| FGASCLILL | | FGASCLILL | | FNNLTKRLCT | | FWVEMIRGRPE | |

Fig. 83-92

| Block size 8 | SIN | Block size 9 | SIN | Block size 10 | SIN | Block size 11 | SIN |
|---|---|---|---|---|---|---|---|
| FGASCVMLL | | FGASCVMLL | | FNNLTRELCT | | FYAELKWLISK | |
| FGASSFVLL | | FGASSFVLL | | FNNLTRGLCT | | FYAELKWLVSK | |
| FGCQNGNIR | | FGCQNGNIR | | FNNTEPLCEV | | FYAEMEWLLSN | |
| FGCQNGNVR | | FGCQNGNVR | | FNNTKERDVL | | FYAEMKWLLSD | |
| FGDNPRPAD | | FGDNPRPAD | | FNNTKGGDVL | | FYAEMKWLLSN | |
| FGDNPRPDD | | FGDNPRPDD | | FNNTKGRDVL | | FYAEMKWLLSS | |
| FGDNPRPMD | | FGDNPRPMD | | FNNYEELKHL | | FYALSQGTTIR | |
| FGDNPRPND | | FGDNPRPND | | FNPCFYVELI | | FYHKCDDECIE | |
| FGDNPRPSD | | FGDNPRPSD | | FNPMIAELAE | | FYHKCDDECMD | |
| FGDNPRPVD | | FGDNPRPVD | | FNPMIIELAE | | FYHKCDDECMN | |
| FGDNPRSVD | | FGDNPRSVD | | FNPMIVELAE | | FYHKCDDECMS | |
| FGDSPRPND | | FGDSPRPND | | FNPMTVELAE | | FYHKCDNECIE | |
| FGDTPRPND | | FGDTPRPND | | FNPMVVELAE | | FYHKCDNECMD | |
| FGEGEQIIV | | FGEGEQIIV | | FNQVEKRINM | | FYHKCDNKCIE | |
| FGESEQIIV | | FGESEQIIV | | FNQVENRINM | | FYHKCNDECMN | |
| FGESEQIVV | | FGESEQIVV | | FNQVEQRINM | | FYHKCNNECIE | |
| FGESEQVIV | | FGESEQVIV | | FNSDLDYQIG | | FYHRCDNECIE | |
| FGFRQGDDV | | FGFRQGDDV | | FNSDPDYQIG | | FYIELIRGKPN | |
| FGFRQGNDV | | FGFRQGNDV | | FNSIGNLIAP | | FYIELIRGRPN | |
| FGFRQGNSV | | FGFRQGNSV | | FNSIYASPQL | | FYIQMCTELKL | |
| FGFRQGSDV | | FGFRQGSDV | | FNSLYASPQL | | FYIQMCTELQL | |
| FGFRQGTDV | | FGFRQGTDV | | FNSLYASSQL | | FYKILKIKKGK | |
| FGFRQGTSV | | FGFRQGTSV | | FNSLYSSPQL | | FYKILKIRKGK | |
| FGGFTFKRT | | FGGFTFKRT | | FNSNLDYQIG | | FYRICKLVGIN | |
| FGKDNAIRI | | FGKDNAIRI | | FNTIGNLIAP | | FYRNMRWLTLK | |
| FGKDNAVRI | | FGKDNAVRI | | FNTIGNLVAP | | FYRNVVWLIKK | |
| FGLICATCE | | FGLICATCE | | FPDGAKIQYF | | FYRSINWLTKK | |
| FGLIDNEFN | | FGLIDNEFN | | FPDGAQIKYF | | FYRSIRWLTLK | |
| FGLVCATCE | | FGLVCATCE | | FPDGAQIQYF | | FYRSMKWLTLK | |
| FGNLERRLE | | FGNLERRLE | | FPDGPQIQYF | | FYRSMRWLTLK | |
| FGPVHFQNQ | | FGPVHFQNQ | | FPFHKDNAIR | | FYRTCKLLGIN | |
| FGPVHFRNQ | | FGPVHFRNQ | | FPFHKDNALR | | FYRTCKLVGIN | |
| FGPVHFRSQ | | FGPVHFRSQ | | FPFHKDNAVR | | FYRYGFVANFS | |
| FGQVEGRIQ | | FGQVEGRIQ | | FPFHKGNSAR | | FYSEMKWLLSS | |
| FGRIDFHWL | | FGRIDFHWL | | FPGELDNNGE | | FYSEMKWLSSS | |
| FGRINFHWL | | FGRINFHWL | | FPGEVDNNGE | | FYSGGTINSPL | |
| FGVSGINES | | FGVSGINES | | FPIGTAPILG | | FYVELIRGKPK | |
| FGVSGVNES | | FGVSGVNES | | FPIGTAPVLG | | FYVELIRGMPK | |
| FGVVNHEFS | | FGVVNHEFS | | FPIGVAPVLG | | FYVELIRGMPQ | |
| FGVYQILAI | | FGVYQILAI | | FPMGTAPVLG | | FYVELIRGRKQ | |
| FGYFGIFFV | | FGYFGIFFV | | FPNEVGAKIL | | FYVELIRGRLN | |
| FGYLLKGES | | FGYLLKGES | | FPNEVGARII | | FYVELIRGRPE | |
| FGYLLRGES | | FGYLLRGES | | FPNEVGARIL | | FYVELIRGRPI | |
| FHDSNVKNL | | FHDSNVKNL | | FPNGAQIQYF | | FYVELIRGRPK | |
| FHDSNVKSL | | FHDSNVKSL | | FPQLNQTYRN | | FYVELIRGRPN | |
| FHDSNVRNL | | FHDSNVRNL | | FPQMTKSYKN | | FYVELIRGRPQ | |
| FHFEECSCY | | FHFEECSCY | | FPQMTKSYRN | | FYVELIRGRPR | |
| FHGAKEIAL | | FHGAKEIAL | | FPQMTRSYKN | | FYVELIRGRQQ | |
| FHGAKEISL | | FHGAKEISL | | FPQTANTYRN | | FYVELIRGRSQ | |
| FHGAKEVAL | | FHGAKEVAL | | FPQTTKSYKN | | FYVELTRGRPQ | |
| FHGAKEVSL | | FHGAKEVSL | | FPQTTNTYRN | | FYVQMCTELKL | |
| FHHSNAEGT | | FHHSNAEGT | | FPRTTNTYRN | | GAAGAAIKGVG | |
| FHHSNSEGT | | FHHSNSEGT | | FPSSSYRRPI | | GAAGAAVKGIG | |
| FHKCDDDCM | | FHKCDDDCM | | FPSSSYRRPV | | GAAGAAVKGVG | |
| FHKCDDHCM | | FHKCDDHCM | | FPSTGNHGSL | | GAASLSPGMMM | |
| FHKCDDQCM | | FHKCDDQCM | | FPVGSGSFPD | | GACWEQLYTPG | |
| FHKCDDRCM | | FHKCDDRCM | | FPVGTAPVLG | | GADDDAYAVIH | |
| FHKCDNQCM | | FHKCDNQCM | | FPVQTDEYKN | | GADIKSHAYIS | |
| FHKCNDSCM | | FHKCNDSCM | | FPYTGDPPYS | | GADINLHAYIS | |
| FHKDNAIRL | | FHKDNAIRL | | FQGFFPFHKD | | GADINLMPIYS | |
| FHKDNAIRP | | FHKDNAIRP | | FQGGHIEECS | | GADLPFTQEQK | |
| FHKDNALRL | | FHKDNALRL | | FQGRGVFEFS | | GADNDAYAVIH | |

Fig. 83-93

| Block size 8 | SIN | Block size 9 | SIN | Block size 10 | SIN | Block size 11 | SIN |
|---|---|---|---|---|---|---|---|
| FHKDNAVRL | | FHKDNAVRL | | FQGRGVFELS | | GAELPFTIDKS | |
| FHKGIVIKE | | FHKGIVIKE | | FQHQNAEGIG | | GAELPFTIDKY | |
| FHKGLIIKE | | FHKGLIIKE | | FQHQNAEGTG | | GAFGPVHFRNQ | |
| FHKGLLIKE | | FHKGLLIKE | | FQHQNEQGMG | | GAFIAPDRAGF | |
| FHKGLVIKE | | FHKGLVIKE | | FQHQNEQGTG | | GAFIAPDRASF | |
| FHKGLVVKE | | FHKGLVVKE | | FQHQNEQGVG | | GAFIAPDRATF | |
| FHLATKQVC | | FHLATKQVC | | FQHQNSEGTG | | GAFIAPDRVSF | |
| FHLGTKQVC | | FHLGTKQVC | | FQHRNDEGTG | | GAFIAPNRASF | |
| FHLGTRQVC | | FHLGTRQVC | | FQHRNEEGTG | | GAFVAPDRVSF | |
| FHNIHPLAI | | FHNIHPLAI | | FQIQGIKLTQ | | GAGALAEDPDE | |
| FHNIHPLTI | | FHNIHPLTI | | FQIQGVKLAQ | | GAGNKLITVGS | |
| FHNISKYAF | | FHNISKYAF | | FQIQGVKLIQ | | GAGYAADKEST | |
| FHNVHPFTI | | FHNVHPFTI | | FQIQGVKLTQ | | GAHILVTREPY | |
| FHNVHPLAI | | FHNVHPLAI | | FQIQGVRLTQ | | GAIAGFIEGGW | |
| FHNVHPLTI | | FHNVHPLTI | | FQLFLVCVSL | | GAIAGFIEGRW | |
| FHNVSKYAF | | FHNVSKYAF | | FQLIPMISKC | | GAIAGFIENGW | |
| FHQCDNDCM | | FHQCDNDCM | | FQLIPMISKS | | GAIEECLINDP | |
| FHQCDNNCI | | FHQCDNNCI | | FQNASRHHMG | | GAIGAIDSSMP | |
| FHQIEKEFS | | FHQIEKEFS | | FQNASRHYMG | | GAIGFWMCSNG | |
| FHRAKEVAL | | FHRAKEVAL | | FQNASRYYMG | | GAILPFDIDKM | |
| FHRCDDQCM | | FHRCDDQCM | | FQNICKPYIG | | GAINSSKPFQN | |
| FHRKRRVRD | | FHRKRRVRD | | FQNIDKNALG | | GAINSSKPLQN | |
| FHSDTPRPA | | FHSDTPRPA | | FQNIDRNAIG | | GAINSSMPFHN | |
| FHSDTPRPD | | FHSDTPRPD | | FQNIDRNALG | | GAINSSMPLHN | |
| FHSDTPRPS | | FHSDTPRPS | | FQNIDSRAVG | | GAINSSRPFQN | |
| FHSDTPRPT | | FHSDTPRPT | | FQNIDSWAVG | | GAINTSMPFHN | |
| FHSDTPRPV | | FHSDTPRPV | | FQNIEKNALG | | GAINTTLPFHN | |
| FHWLILNPN | | FHWLILNPN | | FQNIERNALG | | GAISFWMCSGH | |
| FHWLLLDPN | | FHWLLLDPN | | FQNIHPATIG | | GAISFWMCSNG | |
| FHWLMLNPN | | FHWLMLNPN | | FQNIHPITIG | | GAIWVTREPYV | |
| FHWLMLNSN | | FHWLMLNSN | | FQNIHPVTIG | | GAKAGFIEGGW | |
| FHWMLLDPG | | FHWMLLDPG | | FQNISPVWIG | | GAKAGFIENGW | |
| FHWMMLNPN | | FHWMMLNPN | | FQNLSPRTVG | | GAKILTSESQL | |
| FHYEECSCY | | FHYEECSCY | | FQNQVKIRRR | | GALASCMGLIY | |
| FIAEQFTWN | | FIAEQFTWN | | FQNTSKHYIG | | GALGSPGCDHL | |
| FIAPDRASF | | FIAPDRASF | | FQNTSRHYIG | | GALGSPGCDRL | |
| FIAPDRATF | | FIAPDRATF | | FQNTSRHYMG | | GALLGTKHSNG | |
| FIAPDRVSF | | FIAPDRVSF | | FQNVHPITIG | | GALLGTNHSNG | |
| FIAPENAYK | | FIAPENAYK | | FQNVHPVTIG | | GALLGTRHSNG | |
| FIAPEYAFK | | FIAPEYAFK | | FQNVNKITYG | | GALLNDKHSNE | |
| FIAPEYAYI | | FIAPEYAYI | | FQNVNKVTYG | | GALLNDKHSNG | |
| FIAPEYAYK | | FIAPEYAYK | | FQNVNRITYG | | GALLNDKHSNN | |
| FIAPEYAYR | | FIAPEYAYR | | FQNVSPIWIG | | GALLNDRHSNG | |
| FIAPNRASF | | FIAPNRASF | | FQNVSPLWIG | | GALNTTLPFHN | |
| FIAPRYAFE | | FIAPRYAFE | | FQNVSPLWVG | | GALQLNPIDGP | |
| FICIKNGNM | | FICIKNGNM | | FQNVSPVWIG | | GALRQKIMESG | |
| FICIKNGNV | | FICIKNGNV | | FQNVSRIAIG | | GALVGTKHSNG | |
| FICVGWSST | | FICVGWSST | | FQPCFYIELI | | GAMASQGTKRS | |
| FICVKNGNM | | FICVKNGNM | | FQPCFYVELI | | GANINFMPYIS | |
| FICVRNGNM | | FICVRNGNM | | FQPCFYVELT | | GANRPIIEIDM | |
| FIDIWTYNA | | FIDIWTYNA | | FQPNIGPRAL | | GANRPIIEINM | |
| FIDRLRRDQ | | FIDRLRRDQ | | FQPNIGPRPL | | GANRPVIEIDM | |
| FIDVWTYNA | | FIDVWTYNA | | FQQMRDILGT | | GANRPVIEINM | |
| FIEGGWCGM | | FIEGGWCGM | | FQQMRDVLGT | | GANRPVIKIDM | |
| FIEGGWPGL | | FIEGGWPGL | | FQRKRRIRDN | | GAPACDLHLTG | |
| FIEGGWQGL | | FIEGGWQGL | | FQRKRRVRDN | | GAPGVKGFGFL | |
| FIEGGWQGM | | FIEGGWQGM | | FQRSKFLLMD | | GAPHGLCYPGE | |
| FIEGGWSGL | | FIEGGWSGL | | FQSCFYVELI | | GAPLELRDCKI | |
| FIEGGWSGM | | FIEGGWSGM | | FQSGHIEECS | | GAPLELRDCKV | |
| FIEGGWTGL | | FIEGGWTGL | | FQTAAQKAMM | | GAPLVLDDCSL | |
| FIEGGWTGM | | FIEGGWTGM | | FQTAAQRAMM | | GAPQLNPIDGP | |
| FIEGRWPGL | | FIEGRWPGL | | FQTAAQRAMV | | GAPQLNPVDGP | |

Fig. 83-94

| Block size 8 | SIN | Block size 9 | SIN | Block size 10 | SIN | Block size 11 | SIN |
|---|---|---|---|---|---|---|---|
| FIEIGVTRR | | FIEIGVTRR | | FQVDCFIWHI | | GAPSCDLHLTG | |
| FIEKTNQQF | | FIEKTNQQF | | FQVDCFLWHI | | GAQHVEECSCY | |
| FIENGWEGL | | FIENGWEGL | | FQVDCFLWHV | | GAQSFYRSINW | |
| FIENGWEGM | | FIENGWEGM | | FQVDCFLWYV | | GAQSLSISVGS | |
| FIENGWQGL | | FIENGWQGL | | FQVDCYLWHI | | GARIGEGQRSW | |
| FIERPTAVD | | FIERPTAVD | | FQYLLFQDIL | | GARIITSESQL | |
| FIEVEKQIG | | FIEVEKQIG | | FRALISWEMG | | GARILASESQL | |
| FIFGCQNGN | | FIFGCQNGN | | FRALISWGMG | | GARILTSESQL | |
| FIFILLTHW | | FIFILLTHW | | FRALVSWEMG | | GARILTSESQM | |
| FIFLLLTHW | | FIFLLLTHW | | FRAYVDGFEP | | GARPKVNGQAG | |
| FIFNGAFIA | | FIFNGAFIA | | FRAYVDGFKP | | GARPKVNGQSG | |
| FIGEEMATK | | FIGEEMATK | | FRDNLEPGTF | | GARPQVNGQRG | |
| FIIKGRSHL | | FIIKGRSHL | | FRDYEELKHL | | GARPQVNGQSG | |
| FIIREPFIS | | FIIREPFIS | | FREQKQEFKM | | GASCFILLAIA | |
| FIIREPFVS | | FIIREPFVS | | FRGFFPFHKD | | GASCFILLAIV | |
| FIKDYRYTY | | FIKDYRYTY | | FRGLISTHLG | | GASCFLLLAIA | |
| FIKWNVTYT | | FIKWNVTYT | | FRGLISTPLG | | GASCFLLLAIV | |
| FILWACQNG | | FILWACQNG | | FRGLISTQLG | | GASCFLLLAVV | |
| FILWACSSG | | FILWACSSG | | FRGLLSTPLG | | GASCVMLLAIA | |
| FIMWACNSG | | FIMWACNSG | | FRGLMSTPLG | | GATINEEALRQ | |
| FIMWACQKG | | FIMWACQKG | | FRGRGVFELS | | GATSACKRTVS | |
| FIMWACQRG | | FIMWACQRG | | FRHQKAQGEG | | GATVNEEALRQ | |
| FIMWACSNG | | FIMWACSNG | | FRHQNAEGTG | | GATVNEGALRQ | |
| FIMWACSSG | | FIMWACSSG | | FRHQNAQGEG | | GAVAVLKYKGI | |
| FIMWTCNSG | | FIMWTCNSG | | FRHQNAQGIG | | GAVAVLKYNDI | |
| FIMWTCQKG | | FIMWTCQKG | | FRHQNAQGQG | | GAVAVLKYNGI | |
| FIQALQLLL | | FIQALQLLL | | FRHQNAQGTG | | GAVAVLKYNGV | |
| FIQHPELTG | | FIQHPELTG | | FRHQNSEGTG | | GAVNSSKPFQN | |
| FIQNALNGN | | FIQNALNGN | | FRHQNSQGEG | | GAVNSSMPFHN | |
| FISCSHFEC | | FISCSHFEC | | FRISKRGSSG | | GAVNTTLSTIA | |
| FISCSHLEC | | FISCSHLEC | | FRNALSIAPI | | GAVSFWMCSNG | |
| FISCSHMEC | | FISCSHMEC | | FRNILSIAPI | | GAYERMCNILK | |
| FISCSHSEC | | FISCSHSEC | | FRNILSMAPI | | GAYKILTIYST | |
| FISCSPLEC | | FISCSPLEC | | FRNQIKIRRR | | GAYNNTTGRDV | |
| FISCSQLEC | | FISCSQLEC | | FRNQVKIRRR | | GCDHSDNADKI | |
| FISCSYLEC | | FISCSYLEC | | FRNVLSIAPI | | GCDRLQDTTWD | |
| FITPEYAYK | | FITPEYAYK | | FRNVLSVAPI | | GCFDILHKCDN | |
| FITQGSLLN | | FITQGSLLN | | FRNVVWLIKK | | GCFDILHKCNN | |
| FIVKGRSHL | | FIVKGRSHL | | FRNVVWLTKK | | GCFEFWHKCDD | |
| FIVWACQRG | | FIVWACQRG | | FRNVVWLVKK | | GCFEFWHKCDN | |
| FIWAIHHPP | | FIWAIHHPP | | FRPNIGPRPL | | GCFEFWHKCNN | |
| FIWGLSEWK | | FIWGLSEWK | | FRQGNSVWAG | | GCFEFYHKCDD | |
| FIYGSSINS | | FIYGSSINS | | FRQGTSVWAG | | GCFEFYHKCDN | |
| FIYSGIRTN | | FIYSGIRTN | | FRQSERGEDT | | GCFEFYHKCND | |
| FKADLIIER | | FKADLIIER | | FRQSERGEET | | GCFEFYHKCNN | |
| FKFVSSDCS | | FKFVSSDCS | | FRRPDSSWLF | | GCFEFYHRCDD | |
| FKFYHKCDN | | FKFYHKCDN | | FRTLMSCPIG | | GCFEFYHRCDN | |
| FKGFFPFHK | | FKGFFPFHK | | FRTLMSCPMG | | GCFEIFHKCDD | |
| FKHQNAQGE | | FKHQNAQGE | | FRTLMSCPVG | | GCFEIFHKCDN | |
| FKISKRGGS | | FKISKRGGS | | FRTYVDGFEP | | GCFEIFHQCDN | |
| FKISKRGNS | | FKISKRGNS | | FRTYVDGFKP | | GCFEIFHQCNN | |
| FKISKRGSS | | FKISKRGSS | | FRVYVDGFEP | | GCFEIFHRCDD | |
| FKIYHKCDN | | FKIYHKCDN | | FRYGDGVWIG | | GCFEIFHRCDN | |
| FKIYHKCNN | | FKIYHKCNN | | FRYGNGVWIG | | GCFEILHKCDD | |
| FKIYHRCDN | | FKIYHRCDN | | FRYSGIKTDG | | GCFEILHKCDN | |
| FKLLQNSQI | | FKLLQNSQI | | FRYSGIRTDG | | GCFEILHKCND | |
| FKLLQNSQV | | FKLLQNSQV | | FSAESRKLLL | | GCFEILHRCDD | |
| FKLLQTSQV | | FKLLQTSQV | | FSAESRKMLL | | GCFEILHRCND | |
| FKMNPNKKI | | FKMNPNKKI | | FSARSALILR | | GCFELFHKCDD | |
| FKNTKGRDV | | FKNTKGRDV | | FSDYEELKHL | | GCFELLHKCND | |
| FKPNGCIEG | | FKPNGCIEG | | FSEIEGRIQD | | GCFELLHKCNN | |
| | | | | FSEIEHQIGN | | GCFKIYHKCDN | |

Fig. 83-95

| Block size 8 | SIN | Block size 9 | SIN | Block size 10 | SIN | Block size 11 | SIN |
|---|---|---|---|---|---|---|---|
| FKPNIGPRP | | FKPNIGPRP | | FSEIEHQISN | | GCFKIYHRCDN | |
| FKPPLPLCP | | FKPPLPLCP | | FSEIEQQIGN | | GCFNFFHKCND | |
| FKPSLPLCP | | FKPSLPLCP | | FSETEHQIGN | | GCFNLLHKCND | |
| FKSPLPLCP | | FKSPLPLCP | | FSEVEGRIQD | | GCFPFYHKCDN | |
| FKSSLPLCP | | FKSSLPLCP | | FSFGASCFIL | | GCFQPCFYIEL | |
| FKSTQAAIN | | FKSTQAAIN | | FSFGASCFLF | | GCFQPCFYVEL | |
| FKSWKGNIM | | FKSWKGNIM | | FSFGASCFLL | | GCFRIYHKCDN | |
| FKVIGGWST | | FKVIGGWST | | FSFGASCFTL | | GCFSILHKCND | |
| FKVIGGWTT | | FKVIGGWTT | | FSFGASCFVL | | GCFSLLHKCND | |
| FKYGDGVWI | | FKYGDGVWI | | FSFGASCLIL | | GCFTFYHKCDD | |
| FKYGNGAWI | | FKYGNGAWI | | FSFGASCVML | | GCFTFYHKCDN | |
| FKYGNGVWI | | FKYGNGVWI | | FSFGASSFVL | | GCFTFYHKCNN | |
| FLAFILWAC | | FLAFILWAC | | FSFGGFTFKR | | GCFTIYHKCDN | |
| FLAHALKLV | | FLAHALKLV | | FSFIGEEMAT | | GCIEGKLSQMP | |
| FLAMITYIT | | FLAMITYIT | | FSFKYGNGVW | | GCIEGKLSQMS | |
| FLAPGYAFE | | FLAPGYAFE | | FSFNGAFIAP | | GCIESKLSQMS | |
| FLAPRYAFE | | FLAPRYAFE | | FSFNGAFVAP | | GCINRCFYVEL | |
| FLAPRYALE | | FLAPRYALE | | FSFNGEEMAT | | GCITPNGSIPN | |
| FLAPRYGYI | | FLAPRYGYI | | FSFQLINNKK | | GCKMFALHQGT | |
| FLAPRYSFE | | FLAPRYSFE | | FSFRYGDGVW | | GCKMYALHQGT | |
| FLARSALIL | | FLARSALIL | | FSFRYGNGVW | | GCLKIYHKCDN | |
| FLCVGWSST | | FLCVGWSST | | FSFTGEEMAS | | GCQLNEGVMNT | |
| FLDIWTYNA | | FLDIWTYNA | | FSFTGEEMAT | | GCQNGNIRCTF | |
| FLDRIRRDQ | | FLDRIRRDQ | | FSGGHIEECS | | GCQNGNVRCTF | |
| FLDRLRRDQ | | FLDRLRRDQ | | FSGIKSFSRT | | GCRDNWQGANR | |
| FLDVWTYNA | | FLDVWTYNA | | FSGIRSFSRT | | GCRFYALSQGT | |
| FLDVWTYNT | | FLDVWTYNT | | FSGMSANGDI | | GCRMFALSQGT | |
| FLEIGVTRR | | FLEIGVTRR | | FSGSQKQEFK | | GCRMYALHQGT | |
| FLFSSIKKY | | FLFSSIKKY | | FSGVNSFSRT | | GCRTFFLTQGS | |
| FLGQWDWPD | | FLGQWDWPD | | FSGYKDIILW | | GCVILLNPFVS | |
| FLGQWNWPD | | FLGQWNWPD | | FSHNGGLIAP | | GCWSFALAQGA | |
| FLGVWTYNA | | FLGVWTYNA | | FSHNGGLVAP | | GDAPFIDRLRR | |
| FLHNGGLIA | | FLHNGGLIA | | FSHNGGRIAP | | GDAPFLDRIRR | |
| FLIIGKEDR | | FLIIGKEDR | | FSHYNQITQT | | GDAPFLDRLRR | |
| FLILGKEDK | | FLILGKEDK | | FSHYNQMKQA | | GDCNFEGWIVG | |
| FLILGKEDR | | FLILGKEDR | | FSHYNQMTQA | | GDCNNPITGSP | |
| FLILGKENK | | FLILGKENK | | FSHYNQVTQP | | GDCPKYIKQGS | |
| FLILGREDK | | FLILGREDK | | FSHYNQVTQT | | GDCPKYIKSGQ | |
| FLLMDALKL | | FLLMDALKL | | FSIAASYKRI | | GDCPKYMNVKS | |
| FLLMDSLKL | | FLLMDSLKL | | FSILHKCNDS | | GDCPKYVKQGS | |
| FLNNTEPLC | | FLNNTEPLC | | FSIRGETTGR | | GDCPKYVNIKS | |
| FLNVWTYNA | | FLNVWTYNA | | FSIRWETTGR | | GDCPKYVNVKS | |
| FLPDLYDYK | | FLPDLYDYK | | FSISCFLLAA | | GDCPKYVNVRS | |
| FLPVAGGTG | | FLPVAGGTG | | FSISCFLLIA | | GDCPRYVKQGS | |
| FLPVAGGTS | | FLPVAGGTS | | FSISCFLLVA | | GDCRFEGWIVG | |
| FLPVSGGTS | | FLPVSGGTS | | FSKDNAIRIG | | GDCSFAGWILG | |
| FLPVTGGTS | | FLPVTGGTS | | FSKDNGIRIG | | GDCSFAGWLLG | |
| FLQALQLLL | | FLQALQLLL | | FSKDNSIQLS | | GDCSFEGWIGG | |
| FLRSNAPSG | | FLRSNAPSG | | FSKDNSIRLA | | GDCSFEGWIVG | |
| FLRVKDQQG | | FLRVKDQQG | | FSKDNSIRLS | | GDCSIAGWLLG | |
| FLRVRDQLG | | FLRVRDQLG | | FSKDNSVRLS | | GDCSNPITGSP | |
| FLRVRDQMG | | FLRVRDQMG | | FSKWNVTYTG | | GDCYRACFYVE | |
| FLRVRDQQG | | FLRVRDQQG | | FSLGASCFLL | | GDCYWVMTDGP | |
| FLRVRDQRG | | FLRVRDQRG | | FSLLHKCNDS | | GDDKNATASFI | |
| FLSMEFSLT | | FLSMEFSLT | | FSMELPSFGV | | GDDRNATASFI | |
| FLTHALRFL | | FLTHALRFL | | FSMSCFVFVA | | GDDRNATASFV | |
| FLTHGALLN | | FLTHGALLN | | FSNAASYKRI | | GDDRNATASLI | |
| FLTHGSLLN | | FLTHGSLLN | | FSNKMARLGK | | GDDVWLGRTVS | |
| FLTMITYIT | | FLTMITYIT | | FSNKMARLGR | | GDDVWMGRTIS | |
| FLTQGALLN | | FLTQGALLN | | FSNKVARLGK | | GDGCFEILHKC | |
| FLTQGSLLN | | FLTQGSLLN | | FSNLEKRLEN | | GDGCFEILHRC | |
| FLTSSIVCP | | FLTSSIVCP | | FSNLERRLEN | | GDGCFNFFHKC | |

Fig. 83-96

| Block size 8 | SIN | Block size 9 | SIN | Block size 10 | SIN | Block size 11 | SIN |
|---|---|---|---|---|---|---|---|
| FLVALENQH | | FLVALENQH | | FSPRSRSGFE | | GDGCFNLLHKC | |
| FLVAMENQH | | FLVAMENQH | | FSPSPGARPK | | GDGCFSILHKC | |
| FLVAVENQH | | FLVAVENQH | | FSPSPGDRPK | | GDGCFSLLHKC | |
| FLVCVSLLQ | | FLVCVSLLQ | | FSQEDCMIKA | | GDGQRSWMKIY | |
| FLWCKIVTT | | FLWCKIVTT | | FSQEDCMMKA | | GDGQRSWMKLY | |
| FLWGIHHPP | | FLWGIHHPP | | FSQEDCMVKA | | GDGVWIGRTKN | |
| FLWMCSNGS | | FLWMCSNGS | | FSQEDRMIKA | | GDGVWIGRTKS | |
| FLYIRTNGT | | FLYIRTNGT | | FSQEECMIKA | | GDHGVKGWAFD | |
| FLYVRTNGT | | FLYVRTNGT | | FSQVEQRINM | | GDHITFSHNGG | |
| FMARSALIL | | FMARSALIL | | FSQVERRINM | | GDIFVIREPFI | |
| FMCVGWSST | | FMCVGWSST | | FSRLNWLTKA | | GDIFVMREPFI | |
| FMCVKNGNL | | FMCVKNGNL | | FSRLNWLTKE | | GDIIFLWGIHH | |
| FMCVKNGNM | | FMCVKNGNM | | FSRTELINPN | | GDIIVFNTIGN | |
| FMDVWTYNA | | FMDVWTYNA | | FSRTELINPS | | GDILDGVTASC | |
| FMIIGGFIF | | FMIIGGFIF | | FSRTELIPPS | | GDILEGTTASC | |
| FMLWACQNG | | FMLWACQNG | | FSRTELISPN | | GDILRTQEFSC | |
| FMQALQLLF | | FMQALQLLF | | FSRTELISPS | | GDILRTQESSC | |
| FMQALQLLL | | FMQALQLLL | | FSSAASYKRI | | GDIMRTQESSC | |
| FMWAIHHPP | | FMWAIHHPP | | FSSAASYKRV | | GDIVLVMKRKR | |
| FMYSDFHFI | | FMYSDFHFI | | FSSIKKYERV | | GDIWITREPYV | |
| FNCLYASPQ | | FNCLYASPQ | | FSSIKRYERV | | GDIWVTREHYV | |
| FNDYEELKH | | FNDYEELKH | | FSSLAVNVRG | | GDIWVTRELYV | |
| FNDYEELKL | | FNDYEELKL | | FSSLTVNVRG | | GDIWVTREPYV | |
| FNDYEELKY | | FNDYEELKY | | FSSLTVSVRG | | GDIWVTRKPYV | |
| FNEGAYVNN | | FNEGAYVNN | | FSSNGAFIAP | | GDKICLGHHAV | |
| FNEGHIEEC | | FNEGHIEEC | | FSVGSGSFPD | | GDLILFNTIGN | |
| FNEGSYINN | | FNEGSYINN | | FSVQRNLPFD | | GDLIVFNTIGN | |
| FNEGSYVNN | | FNEGSYVNN | | FSVQRNLPFE | | GDLNFVNRANQ | |
| FNEGTYINN | | FNEGTYINN | | FSVQRSLPFE | | GDNAEEYRRLR | |
| FNEGTYVNN | | FNEGTYVNN | | FSYKYDNGVW | | GDNENATATVY | |
| FNEIEHQIG | | FNEIEHQIG | | FSYKYGNGVW | | GDNIIFSHNGG | |
| FNEIEQQIG | | FNEIEQQIG | | FSYRYGNGVW | | GDNITFLHNGG | |
| FNEIEYQIG | | FNEIEYQIG | | FTAEISHCRA | | GDNITFSDNGG | |
| FNEVEKQIG | | FNEVEKQIG | | FTAEVSHCRA | | GDNITFSHNGG | |
| FNEVEQQIG | | FNEVEQQIG | | FTAEVSYCRA | | GDNTKWNENQN | |
| FNFFHKCND | | FNFFHKCND | | FTDGSATGPA | | GDPNNMARAVK | |
| FNFILLTHW | | FNFILLTHW | | FTEGHIEECS | | GDPNNMDKAVK | |
| FNFNGAFVA | | FNFNGAFVA | | FTEIGVTRRE | | GDPNNMDRAVK | |
| FNGAFIAPD | | FNGAFIAPD | | FTEVEGRIQD | | GDPPYSHGTGT | |
| FNGAFIAPN | | FNGAFIAPN | | FTEVEKQIGN | | GDPSNMDRAVK | |
| FNGAFVAPD | | FNGAFVAPD | | FTEVEQQIGN | | GDQICIGYHAN | |
| FNGEEMATK | | FNGEEMATK | | FTFKRTKGFS | | GDQICIGYHSN | |
| FNGGHIEEC | | FNGGHIEEC | | FTFKRTKGSS | | GDQICVGYHAN | |
| FNKACELTD | | FNKACELTD | | FTFKRTNGSS | | GDQICVGYHSN | |
| FNLLHKCND | | FNLLHKCND | | FTFKRTSGSS | | GDRICIGYHAN | |
| FNLLIGISN | | FNLLIGISN | | FTFKRTSGTS | | GDRPKVNGQAG | |
| FNMERIKEL | | FNMERIKEL | | FTFNGAFIAP | | GDSEMLNLYER | |
| FNMLSTVLG | | FNMLSTVLG | | FTGWILGNPM | | GDSFYAELKWL | |
| FNNIKGRDV | | FNNIKGRDV | | FTIGECPKYV | | GDSIIFNSIGN | |
| FNNLEKRLE | | FNNLEKRLE | | FTITGDNTKW | | GDSITFSHNGG | |
| FNNLERRLE | | FNNLERRLE | | FTKWNVTHTG | | GDTPRNDDRFS | |
| FNNLTKGLC | | FNNLTKGLC | | FTKWNVTYTG | | GDTPRNDDRSS | |
| FNNLTKRLC | | FNNLTKRLC | | FTLSGVAIAL | | GDTPRNDDSSS | |
| FNNLTRELC | | FNNLTRELC | | FTLTVPSERG | | GDTPRNEDGSS | |
| FNNLTRGLC | | FNNLTRGLC | | FTNEEALRQI | | GDTPRNEDSSS | |
| FNNTEPLCE | | FNNTEPLCE | | FTNEESLRQI | | GDTPRNGDSSS | |
| FNNTKERDV | | FNNTKERDV | | FTNEESLRQV | | GDTPRSDDSSS | |
| FNNTKGRDV | | FNNTKGRDV | | FTSFFYRYGF | | GDTVTFTFNGA | |
| FNNTKGRYV | | FNNTKGRYV | | FTTEVSHCRA | | GDVFVIREPFI | |
| FNNYEELKH | | FNNYEELKH | | FTWAIHHPPT | | GDVIVFNTIGN | |
| FNPCFYVEL | | FNPCFYVEL | | FTWNGVKVDG | | GDVLDGVTASC | |
| FNPITGSPG | | FNPITGSPG | | FTYNGIRTNG | | GDVVLVMKRKR | |

Fig. 83-97

| Block size 8 | SIN | Block size 9 | SIN | Block size 10 | SIN | Block size 11 | SIN |
|---|---|---|---|---|---|---|---|
| FNPMIAELA | | FNPMIAELA | | FTYSGIRTDG | | GDVWVTREPYV | |
| FNPMIIELA | | FNPMIIELA | | FTYSGIRTNG | | GDVYKILSIYS | |
| FNPMIVELA | | FNPMIVELA | | FTYTGVRTDG | | GDYARLYIWGV | |
| FNPMTVELA | | FNPMTVELA | | FTYTGVRTNG | | GDYNNTTGRDV | |
| FNPMVVELA | | FNPMVVELA | | FVACGPAECR | | GDYTRLYIWGV | |
| FNQVEKRIN | | FNQVEKRIN | | FVACGPSECR | | GEAMVSRARID | |
| FNQVENRIN | | FNQVENRIN | | FVACGPTECR | | GEAPSPYNSKF | |
| FNQVEQRIN | | FNQVEQRIN | | FVACSPSECR | | GEAPSPYNSRF | |
| FNSDLDYQI | | FNSDLDYQI | | FVALILGFVL | | GECFNPITGSP | |
| FNSDLNYQI | | FNSDLNYQI | | FVANFSMELP | | GECFWVMTDGP | |
| FNSIGNLIA | | FNSIGNLIA | | FVAPDRVSFF | | GECFYSGGTIN | |
| FNSIYASPQ | | FNSIYASPQ | | FVEIGVTRRE | | GECPKYIKSDQ | |
| FNSLYASPQ | | FNSLYASPQ | | FVENLEELRF | | GECPKYVKQGS | |
| FNSLYASSQ | | FNSLYASSQ | | FVFSIAASYK | | GECPKYVKSDR | |
| FNSLYSSPQ | | FNSLYSSPQ | | FVFSNAASYK | | GECPKYVKSEK | |
| FNSNLDYQI | | FNSNLDYQI | | FVFSSAASYK | | GECPKYVKSER | |
| FNTIGNLIA | | FNTIGNLIA | | FVFTLTVPSE | | GECPKYVRSEK | |
| FNTIGNLVA | | FNTIGNLVA | | FVFVALILGF | | GECPRYVKSEK | |
| FPDGAKIQY | | FPDGAKIQY | | FVIREPCISC | | GECYRACFYVE | |
| FPDGAQIKY | | FPDGAQIKY | | FVIREPFISC | | GECYWVMTDGP | |
| FPDGAQIQY | | FPDGAQIQY | | FVIREPFVAC | | GEDSDILVTRE | |
| FPDGARIQY | | FPDGARIQY | | FVIREPFVSC | | GEDSDVLVTRE | |
| FPDGPQIQY | | FPDGPQIQY | | FVIVSKDNGI | | GEDTIEERFEI | |
| FPFHKDNAI | | FPFHKDNAI | | FVLMENERTL | | GEETIEEKFEI | |
| FPFHKDNAL | | FPFHKDNAL | | FVLWACQNGN | | GEETIEERFAI | |
| FPFHKDNAV | | FPFHKDNAV | | FVMREPFISC | | GEETIEERFEI | |
| FPGELDNNG | | FPGELDNNG | | FVMWACQKGN | | GEETVEERFEI | |
| FPGEVDNNG | | FPGEVDNNG | | FVNEEALRQI | | GEFNQVEKRIN | |
| FPIGTAPIL | | FPIGTAPIL | | FVNGEALRQI | | GEFNQVENRIN | |
| FPIGTAPVL | | FPIGTAPVL | | FVNMTNVQNN | | GEFNQVEQRIN | |
| FPIGVAPVL | | FPIGVAPVL | | FVNRANQRLN | | GEFSQVEQRIN | |
| FPMGTAPVL | | FPMGTAPVL | | FVNVTHVQNN | | GEFSQVERRIN | |
| FPNEVGAKI | | FPNEVGAKI | | FVNVTNVQND | | GEGEQIIVTRE | |
| FPNEVGARI | | FPNEVGARI | | FVNVTNVQNN | | GEGIAADYKST | |
| FPQLNQTYR | | FPQLNQTYR | | FVPVIGARPQ | | GEGIPLHDAIK | |
| FPQMTKSYK | | FPQMTKSYK | | FVPVMGARPQ | | GEGIPLYDAIK | |
| FPQMTKSYR | | FPQMTKSYR | | FVPVVGARPQ | | GEGIPLYDAVK | |
| FPQMTRSYK | | FPQMTRSYK | | FVPVVGDRPL | | GEGIPLYDAVR | |
| FPQTANTYR | | FPQTANTYR | | FVPVVRARPQ | | GEGQRSWMKIY | |
| FPQTTKSYK | | FPQTTKSYK | | FVQHPELTGL | | GEGTAADYKST | |
| FPQTTNTYR | | FPQTTNTYR | | FVQHPELTGM | | GEHAKAIGNCP | |
| FPRTTNTYR | | FPRTTNTYR | | FVQHPELTGV | | GEKANVLIGQG | |
| FPSSSYRRP | | FPSSSYRRP | | FVQHPEMTGL | | GEKSDVLVTRE | |
| FPSTGNHGS | | FPSTGNHGS | | FVQNALNGNG | | GELDNNGELRH | |
| FPVGSGSFP | | FPVGSGSFP | | FVQNALSGNG | | GELNNNGELRH | |
| FPVGTAPVL | | FPVGTAPVL | | FVQSYFQLFL | | GELRHLFSGIK | |
| FPVQTDEYK | | FPVQTDEYK | | FVRGQQGRMD | | GELRHLFSGIR | |
| FPYTGDPPY | | FPYTGDPPY | | FVRQCFNPMI | | GELRHLFSGVN | |
| FQGFFPFHK | | FQGFFPFHK | | FVRQCFNPMT | | GENIAPEKVDF | |
| FQGGHIEEC | | FQGGHIEEC | | FVRQCFNPMV | | GENMAPEKIDF | |
| FQGRGVFEF | | FQGRGVFEF | | FVRQCFSPMI | | GENMAPEKMDF | |
| FQGRGVFEL | | FQGRGVFEL | | FVRTLFQQMR | | GENMAPEKVDF | |
| FQHQNAEGI | | FQHQNAEGI | | FVSCGPSECR | | GENSDVLVTRE | |
| FQHQNAEGT | | FQHQNAEGT | | FVSCSHLECR | | GENSFYAELKW | |
| FQHQNEQGM | | FQHQNEQGM | | FVSMEFSLTD | | GENSGVLVTRE | |
| FQHQNEQGT | | FQHQNEQGT | | FVVREPFISC | | GEPGVKGFGFK | |
| FQHQNEQGV | | FQHQNEQGV | | FWIELIRGRP | | GEQIIVTREPY | |
| FQHQNSEGT | | FQHQNSEGT | | FWKGGSIKTK | | GERGLFGAIAG | |
| FQHRNDEGT | | FQHRNDEGT | | FWKGGSINTK | | GERIMFESNGG | |
| FQHRNEEGT | | FQHRNEEGT | | FWLEMIRGKP | | GERITFESNGG | |
| FQIQGIKLT | | FQIQGIKLT | | FWLEMIRGRP | | GERITFESSGG | |
| FQIQGVKLA | | FQIQGVKLA | | FWMCPNGSLQ | | GERTTFESNGG | |

Fig. 83-98

| Block size 8 | SIN | Block size 9 | SIN | Block size 10 | SIN | Block size 11 | SIN |
|---|---|---|---|---|---|---|---|
| FQIQGVKLI | | FQIQGVKLI | | FWMCSGHSCR | | GESEQIIVTRE | |
| FQIQGVKLT | | FQIQGVKLT | | FWMCSNGSLH | | GESEQIVVTRE | |
| FQIQGVRLT | | FQIQGVRLT | | FWMCSNGSLQ | | GESEQIVVTRE | |
| FQLFLVCVS | | FQLFLVCVS | | FWMCSNGSLR | | GESHCRIIQNE | |
| FQLINNKKP | | FQLINNKKP | | FWRGDNGRRT | | GESHGKIIQNE | |
| FQLIPMISK | | FQLIPMISK | | FWRGENGRKT | | GESHGRIIQNE | |
| FQNASRHHM | | FQNASRHHM | | FWRGENGRRT | | GESHGRTIQNE | |
| FQNASRHYM | | FQNASRHYM | | FWRGGSINTK | | GESPSPYNSRF | |
| FQNASRYYM | | FQNASRYYM | | FWRGGSINTR | | GESYGRIIQNE | |
| FQNICKPYI | | FQNICKPYI | | FWTSNSIVAL | | GETLKIRTNGN | |
| FQNIDKNAL | | FQNIDKNAL | | FWVELIRGQP | | GETLKVESNGN | |
| FQNIDRNAI | | FQNIDRNAI | | FWVELIRGRP | | GETLNIESNGN | |
| FQNIDRNAL | | FQNIDRNAL | | FWVELVRGLP | | GETLNVESNGN | |
| FQNIDSRAV | | FQNIDSRAV | | FWVELVRGRP | | GETTGRNCTIP | |
| FQNIDSWAV | | FQNIDSWAV | | FWVEMIRGEP | | GETTGRNCTVP | |
| FQNIEKNAL | | FQNIEKNAL | | FWVEMIRGKP | | GEVDNNGELRH | |
| FQNIERNAL | | FQNIERNAL | | FWVEMIRGQP | | GEVFVIREPFI | |
| FQNIHPATI | | FQNIHPATI | | FWVEMIRGRP | | GEVFVIREPFV | |
| FQNIHPITI | | FQNIHPITI | | FWVMTDGPAN | | GEVPGWSWDDG | |
| FQNIHPVTI | | FQNIHPVTI | | FYAELKWLIS | | GEVPSPYNSRF | |
| FQNISKYAF | | FQNISKYAF | | FYAELKWLVS | | GEVSVIREPFI | |
| FQNISPVWI | | FQNISPVWI | | FYAEMEWLLS | | GEYNNTTGRDV | |
| FQNLSPRTV | | FQNLSPRTV | | FYAEMKWLLS | | GFAIASKDNGI | |
| FQNQVKIRR | | FQNQVKIRR | | FYALSQGTTI | | GFAIFSKDNGI | |
| FQNTSKHYI | | FQNTSKHYI | | FYHKCDDECI | | GFAIISKDNGI | |
| FQNTSRHYI | | FQNTSRHYI | | FYHKCDDECM | | GFAIVSKDNGI | |
| FQNTSRHYM | | FQNTSRHYM | | FYHKCDNECI | | GFAPFAKDNSI | |
| FQNVHPITI | | FQNVHPITI | | FYHKCDNECM | | GFAPFSKDNGI | |
| FQNVHPVTI | | FQNVHPVTI | | FYHKCDNGCI | | GFAPFSKDNSI | |
| FQNVNKITY | | FQNVNKITY | | FYHKCDNKCI | | GFAPFSKDNSV | |
| FQNVNKVTY | | FQNVNKVTY | | FYHKCNDECM | | GFCFTVMTDGP | |
| FQNVNRITY | | FQNVNRITY | | FYHKCNNECI | | GFEILLIEDGW | |
| FQNVSKYAF | | FQNVSKYAF | | FYIELIRGKP | | GFEILLIEEGW | |
| FQNVSPIWI | | FQNVSPIWI | | FYIELIRGRP | | GFEMIWDANGW | |
| FQNVSPLWI | | FQNVSPLWI | | FYIQMCTELK | | GFEMIWDPDGW | |
| FQNVSPLWV | | FQNVSPLWV | | FYIQMCTELQ | | GFEMIWDPNGW | |
| FQNVSPVWI | | FQNVSPVWI | | FYKILKIKKG | | GFEMLKIHNAG | |
| FQNVSRIAI | | FQNVSRIAI | | FYKILKIRKG | | GFEMLKIPNAE | |
| FQNVSRYAF | | FQNVSRYAF | | FYRICKLVGI | | GFEMLKIPNAG | |
| FQPCFYIEL | | FQPCFYIEL | | FYRNLIWLVK | | GFEMLKVPNAE | |
| FQPCFYVEL | | FQPCFYVEL | | FYRNLIWLVN | | GFEMLKVPNAG | |
| FQPNIGPRA | | FQPNIGPRA | | FYRNLIWLVQ | | GFEMLRIPNAG | |
| FQPNIGPRP | | FQPNIGPRP | | FYRNLVWIVK | | GFEMVWDANGW | |
| FQQMRDILG | | FQQMRDILG | | FYRNLVWLVK | | GFEMVWDPNGW | |
| FQQMRDVLG | | FQQMRDVLG | | FYRNMRWLTL | | GFEVLFIEDGW | |
| FQRKRRIRD | | FQRKRRIRD | | FYRNVVWLIK | | GFEVLLIEDGW | |
| FQRKRRVRD | | FQRKRRVRD | | FYRSINWLTK | | GFFGAIAGFIE | |
| FQRSKFLLM | | FQRSKFLLM | | FYRSIRWLTL | | GFFPDGPQIQY | |
| FQTAAQKAM | | FQTAAQKAM | | FYRSMKWLTL | | GFFPFHKDNAI | |
| FQTAAQRAM | | FQTAAQRAM | | FYRSMRWLTL | | GFFPFHKDNAL | |
| FQVDCFIWH | | FQVDCFIWH | | FYRTCKLLGI | | GFFPFHKDNAV | |
| FQVDCFLWH | | FQVDCFLWH | | FYRTCKLVGI | | GFGFRQGDDVW | |
| FQVDCYLWH | | FQVDCYLWH | | FYRYGFVANF | | GFGFRQGNDVW | |
| FQYLLFQDI | | FQYLLFQDI | | FYSEMKWLLS | | GFGFRQGNNVW | |
| FRALISWEM | | FRALISWEM | | FYSEMKWLSS | | GFGFRQGNSVW | |
| FRALISWGM | | FRALISWGM | | FYSGGTINSP | | GFGFRQGSDVW | |
| FRALVSWEM | | FRALVSWEM | | FYVELIRGKP | | GFGFRQGTDVW | |
| FRAYVDGFE | | FRAYVDGFE | | FYVELIRGMP | | GFGFRQGTSVW | |
| FRAYVDGFK | | FRAYVDGFK | | FYVELIRGRE | | GFHDSNVKNLY | |
| FRDMRKNTL | | FRDMRKNTL | | FYVELIRGRK | | GFHFEECSCYP | |
| FRDNLEPGT | | FRDNLEPGT | | FYVELIRGRL | | GFHHSNAEGTG | |
| FRDYEELKH | | FRDYEELKH | | FYVELIRGRN | | GFHHSNSEGTG | |

Fig. 83-99

| Block size 8 | SIN | Block size 9 | SIN | Block size 10 | SIN | Block size 11 | SIN |
|---|---|---|---|---|---|---|---|
| FREQKQEFK | | FREQKQEFK | | FYVELIRGRP | | GFIDIWTYNAE | |
| FRGFFPFHK | | FRGFFPFHK | | FYVELIRGRQ | | GFIDVWTYNAE | |
| FRGGHIEEC | | FRGGHIEEC | | FYVELIRGRR | | GFIEGGWCGMI | |
| FRGLISTHL | | FRGLISTHL | | FYVELIRGRS | | GFIEGGWPGLI | |
| FRGLISTPL | | FRGLISTPL | | FYVELVRGRP | | GFIEGGWPGLV | |
| FRGLISTQL | | FRGLISTQL | | FYVEMIRGRP | | GFIEGGWQGLV | |
| FRGLLSTPL | | FRGLLSTPL | | FYVQMCTELK | | GFIEGGWQGMI | |
| FRGLMSTPL | | FRGLMSTPL | | FYWTIVDPGD | | GFIEGGWQGMV | |
| FRGRGVFEL | | FRGRGVFEL | | FYWTIVEPED | | GFIEGGWSGLI | |
| FRHQNAEGT | | FRHQNAEGT | | FYWTIVEPGD | | GFIEGGWSGLV | |
| FRHQNAQGE | | FRHQNAQGE | | FYWTIVEPGN | | GFIEGGWSGMI | |
| FRHQNAQGI | | FRHQNAQGI | | FYYEECSCYP | | GFIEGGWTGLI | |
| FRHQNAQGQ | | FRHQNAQGQ | | GAAGAAIKGV | | GFIEGGWTGMI | |
| FRHQNAQGT | | FRHQNAQGT | | GAAGAAVKGI | | GFIEGGWTGMV | |
| FRHQNSEGT | | FRHQNSEGT | | GAAGAAVKGV | | GFIEGRWPGLV | |
| FRHQNSQGE | | FRHQNSQGE | | GAAIKGIGTM | | GFIENGWEGLI | |
| FRISKRGSS | | FRISKRGSS | | GAAIKGVGTM | | GFIENGWEGLV | |
| FRIYHKCDN | | FRIYHKCDN | | GAASLSPGMM | | GFIENGWEGMI | |
| FRLLQNSQV | | FRLLQNSQV | | GAAVKGIGTM | | GFIENGWEGMM | |
| FRLLQSSQV | | FRLLQSSQV | | GAAVKGVGTI | | GFIENGWEGMV | |
| FRNILSIAP | | FRNILSIAP | | GAAVKGVGTM | | GFIENGWQGLI | |
| FRNILSMAP | | FRNILSMAP | | GACWEQLYTP | | GFIFGCQNGNI | |
| FRNQIKIRR | | FRNQIKIRR | | GADDDAYAVI | | GFIFGCQNGNV | |
| FRNQVKIRR | | FRNQVKIRR | | GADDEAYAVI | | GFIIKGRSHLR | |
| FRNVLSIAP | | FRNVLSIAP | | GADGVKGFSY | | GFIMWACQKGN | |
| FRNVLSVAP | | FRNVLSVAP | | GADIKSHAYI | | GFIMWACQRGN | |
| FRNVVWLIK | | FRNVVWLIK | | GADINLHAYI | | GFIMWTCQKGN | |
| FRNVVWLTK | | FRNVVWLTK | | GADINLMPIY | | GFIVKGRSHLR | |
| FRNVVWLVK | | FRNVVWLVK | | GADNDAYAVI | | GFIVWACQRGN | |
| FRPNIGPRP | | FRPNIGPRP | | GAFGPVHFRN | | GFIYSGIRTNG | |
| FRQGNNVWA | | FRQGNNVWA | | GAFIAPDRAG | | GFKHQNAQGEG | |
| FRQGNSVWA | | FRQGNSVWA | | GAFIAPDRAS | | GFKISKRGGSG | |
| FRQGTSVWA | | FRQGTSVWA | | GAFIAPDRAT | | GFKISKRGNSG | |
| FRQSERGED | | FRQSERGED | | GAFIAPDRVS | | GFKISKRGSSG | |
| FRQSERGEE | | FRQSERGEE | | GAFIAPNRAS | | GFKISRRGNSG | |
| FRRPDSSWL | | FRRPDSSWL | | GAFVAPDRVS | | GFLAPRYGYII | |
| FRTLMSCPI | | FRTLMSCPI | | GAGALAEDPD | | GFLDIWTYNAE | |
| FRTLMSCPM | | FRTLMSCPM | | GAGNKLITVG | | GFLDVWTYNAE | |
| FRTLMSCPV | | FRTLMSCPV | | GAGSWPDGAN | | GFLDVWTYNTE | |
| FRTYVDGFE | | FRTYVDGFE | | GAGYAADKES | | GFLGVWTYNAE | |
| FRVIGGWAT | | FRVIGGWAT | | GAHILVTREP | | GFLNVWTYNAE | |
| FRVIGGWTT | | FRVIGGWTT | | GAIAGFIEGG | | GFMDVWTYNAE | |
| FRVIGGWVT | | FRVIGGWVT | | GAIAGFIEGR | | GFQHQNAEGIG | |
| FRVYVDGFE | | FRVYVDGFE | | GAIAGFIENG | | GFQHQNAEGTG | |
| FRYGDGVWI | | FRYGDGVWI | | GAIEECLIND | | GFQHQNEQGMG | |
| FRYGNGVWI | | FRYGNGVWI | | GAIGAIDSSM | | GFQHQNEQGTG | |
| FRYSGIKTD | | FRYSGIKTD | | GAILPFDIDK | | GFQHQNEQGVG | |
| FRYSGIRTD | | FRYSGIRTD | | GAILPFGIDK | | GFQHQNSEGTG | |
| FSAESRKLL | | FSAESRKLL | | GAINSSKPFQ | | GFQHRNDEGTG | |
| FSAESRKML | | FSAESRKML | | GAINSSKPLQ | | GFQHRNEEGTG | |
| FSARSALIL | | FSARSALIL | | GAINSSMPFH | | GFRDVWTYNAE | |
| FSDNGGLIA | | FSDNGGLIA | | GAINSSMPLH | | GFRHQKAQGEG | |
| FSDYEELKH | | FSDYEELKH | | GAINSSRPFQ | | GFRHQNAEGTG | |
| FSEIEGRIQ | | FSEIEGRIQ | | GAINTTLPFH | | GFRHQNAQGEG | |
| FSEIEHQIG | | FSEIEHQIG | | GAISFWMCSG | | GFRHQNAQGIG | |
| FSEIEHQIS | | FSEIEHQIS | | GAISFWMCSN | | GFRHQNAQGQG | |
| FSEIEQQIG | | FSEIEQQIG | | GAISSSMPFH | | GFRHQNAQGTG | |
| FSETEHQIG | | FSETEHQIG | | GAIWVTREPY | | GFRHQNSEGTG | |
| FSEVEGRIQ | | FSEVEGRIQ | | GAKAGFIEGG | | GFRHQNSQGEG | |
| FSEVEIRIN | | FSEVEIRIN | | GAKAGFIENG | | GFRHQNTQGEG | |
| FSEVESRIN | | FSEVESRIN | | GAKEIALSYS | | GFRISKRGSSG | |
| FSEVETRIN | | FSEVETRIN | | GAKEISLSYS | | GFRQGNSVWAG | |

Fig. 83-100

| Block size 8 | SIN | Block size 9 | SIN | Block size 10 | SIN | Block size 11 | SIN |
|---|---|---|---|---|---|---|---|
| FSEVGSRIN | | FSEVGSRIN | | GAKEVALGYS | | GFRQGTSVWAG | |
| FSFGASCFI | | FSFGASCFI | | GAKEVALSYS | | GFRYSGIKTDG | |
| FSFGASCFL | | FSFGASCFL | | GAKEVSLSYS | | GFRYSGIRTDG | |
| FSFGASCFT | | FSFGASCFT | | GAKILTSESQ | | GFSAESRKLLL | |
| FSFGASCFV | | FSFGASCFV | | GAKVNTLTER | | GFSAESRKMLL | |
| FSFGASCLI | | FSFGASCLI | | GALASCMGLI | | GFSFKYGNGVW | |
| FSFGASCVM | | FSFGASCVM | | GALGSPGCDH | | GFSFRYGDGVW | |
| FSFGASSFV | | FSFGASSFV | | GALGSPGCDR | | GFSFRYGNGVW | |
| FSFGGFTFK | | FSFGGFTFK | | GALLGTKHSN | | GFSYKYDNGVW | |
| FSFKYGNGV | | FSFKYGNGV | | GALLGTNHSN | | GFSYKYGNGVW | |
| FSFNGAFIA | | FSFNGAFIA | | GALLGTRHSN | | GFSYRYGNGVW | |
| FSFNGAFVA | | FSFNGAFVA | | GALLNDKHSN | | GFTYNGIRTNG | |
| FSFNGEEMA | | FSFNGEEMA | | GALLNDRHSN | | GFTYSEIRTNG | |
| FSFQLINNK | | FSFQLINNK | | GALLPFDIDK | | GFTYSGIRTDG | |
| FSFRYGDGV | | FSFRYGDGV | | GALLPFDIDR | | GFTYSGIRTNG | |
| FSFRYGNGV | | FSFRYGNGV | | GALNTTLPFH | | GFTYTGVRTDG | |
| FSFTGEEMA | | FSFTGEEMA | | GALQLNPIDG | | GFTYTGVRTNG | |
| FSGGHIEEC | | FSGGHIEEC | | GALRQKIMES | | GFVANFSMELP | |
| FSGIKSFSR | | FSGIKSFSR | | GALVGTKHSN | | GFVENLEELRF | |
| FSGIRSFSR | | FSGIRSFSR | | GANGVKGFSF | | GFVFTLTVPSE | |
| FSGMSANGD | | FSGMSANGD | | GANGVKGFSY | | GFVIVSKDNGI | |
| FSGSQKQEF | | FSGSQKQEF | | GANRPIIEID | | GFVLWACQNGN | |
| FSGVNSFSR | | FSGVNSFSR | | GANRPIIEIN | | GFVMWACQKGN | |
| FSGYKDIIL | | FSGYKDIIL | | GANRPIITIN | | GFVRTLFQQMR | |
| FSHNGGLIA | | FSHNGGLIA | | GANRPVIEID | | GFWMCSNGSLQ | |
| FSHNGGLVA | | FSHNGGLVA | | GANRPVIEIN | | GGAIWVTREPY | |
| FSHNGGRIA | | FSHNGGRIA | | GANRPVIIID | | GGAQHVEECSC | |
| FSHYNQMKQ | | FSHYNQMKQ | | GANRPVIIIN | | GGAVWVTREPY | |
| FSHYNQMTQ | | FSHYNQMTQ | | GANRPVIKID | | GGCSFAGWILG | |
| FSHYNQVAQ | | FSHYNQVAQ | | GANRPVITID | | GGDIWITREPY | |
| FSHYNQVTQ | | FSHYNQVTQ | | GANRPVITIN | | GGDIWVTREHY | |
| FSIAASYKR | | FSIAASYKR | | GAPACDLHLT | | GGDIWVTRELY | |
| FSILHKCND | | FSILHKCND | | GAPGVKGFGF | | GGDIWVTREPY | |
| FSIRGETTG | | FSIRGETTG | | GAPHGLCYPG | | GGDIWVTRKPY | |
| FSIRWETTG | | FSIRWETTG | | GAPLELRDCK | | GGDSFYAELKW | |
| FSISCFLLA | | FSISCFLLA | | GAPLVLDDCS | | GGFIFGCQNGN | |
| FSISCFLLI | | FSISCFLLI | | GAPQLNPIDG | | GGFLAPRYGYI | |
| FSISCFLLV | | FSISCFLLV | | GAPQLNPVDG | | GGGPDPGVKGF | |
| FSKDNAIRI | | FSKDNAIRI | | GAPSCDLHLT | | GGGYAADKEST | |
| FSKDNGIRI | | FSKDNGIRI | | GAQHVEECSC | | GGHGVKGWAFD | |
| FSKDNSIQL | | FSKDNSIQL | | GAQSFYRSIN | | GGHIEECSCYP | |
| FSKDNSIRL | | FSKDNSIRL | | GAQSLSISVG | | GGHIWVTREPY | |
| FSKDNSVRL | | FSKDNSVRL | | GARIGEGQRS | | GGIDKEPMGFR | |
| FSKVETRIN | | FSKVETRIN | | GARIITSESQ | | GGIDKESMGFR | |
| FSKWNVTYT | | FSKWNVTYT | | GARILASESQ | | GGIDTNKTFQN | |
| FSLGASCFL | | FSLGASCFL | | GARILTSESQ | | GGINTNKTFQN | |
| FSLLHKCND | | FSLLHKCND | | GARPKVNGQA | | GGINTNRTFQN | |
| FSLTDPKLE | | FSLTDPKLE | | GARPKVNGQS | | GGIPTDVIRSW | |
| FSLTDPRFE | | FSLTDPRFE | | GARPQVNGQF | | GGIPTDVVRSW | |
| FSLTDPRLE | | FSLTDPRLE | | GARPQVNGQS | | GGLGVKGFGFK | |
| FSLVDPRLE | | FSLVDPRLE | | GARRIDFHWL | | GGLIAPRYGYI | |
| FSMELPSFG | | FSMELPSFG | | GARRIDFNWL | | GGLIAPSRVSK | |
| FSMSCFVFV | | FSMSCFVFV | | GASCFIFLAI | | GGLIAPSRVTK | |
| FSNAASYKR | | FSNAASYKR | | GASCFILLAI | | GGLILGMQNGS | |
| FSNKMARLG | | FSNKMARLG | | GASCFILLAV | | GGLLAPKYGYI | |
| FSNKVARLG | | FSNKVARLG | | GASCFLFLAI | | GGLLAPRYGYI | |
| FSNLEKRLE | | FSNLEKRLE | | GASCFLLIAI | | GGLVAPSRVSK | |
| FSNLERRLE | | FSNLERRLE | | GASCFLLLAI | | GGMPTDVVRSW | |
| FSPRSRSGF | | FSPRSRSGF | | GASCFLLLAV | | GGNEKKAKLAN | |
| FSPSPGARP | | FSPSPGARP | | GASCFTLLAI | | GGNIWITREPY | |
| FSPSPGDRP | | FSPSPGDRP | | GASCFVLLAA | | GGNPDPGVKGF | |
| FSQEDCMIK | | FSQEDCMIK | | GASCFVLLAD | | GGNSFYAELKW | |

Fig. 83-101

| Block size 8 | SIN | Block size 9 | SIN | Block size 10 | SIN | Block size 11 | SIN |
|---|---|---|---|---|---|---|---|
| FSQEDCMMK | | FSQEDCMMK | | GASCFVLLAI | | GGPDPGVKGFA | |
| FSQEDCMVK | | FSQEDCMVK | | GASCFVLLAV | | GGPGVKGFGFK | |
| FSQEDRMIK | | FSQEDRMIK | | GASCVMLLAI | | GGPNLYNIRNL | |
| FSQEECMIK | | FSQEECMIK | | GATINEEALR | | GGQAFYRSINW | |
| FSQVEQRIN | | FSQVEQRIN | | GATSACKRTV | | GGQSFYRSINW | |
| FSQVERRIN | | FSQVERRIN | | GATVNEEALR | | GGRNSFFSRLN | |
| FSRLNWLTK | | FSRLNWLTK | | GATVNEGALR | | GGSGTDNYGVK | |
| FSRTELIAP | | FSRTELIAP | | GAVAVLKYDG | | GGSGTNNYGVK | |
| FSRTELINP | | FSRTELINP | | GAVAVLKYKG | | GGSIITELPFQ | |
| FSRTELIPP | | FSRTELIPP | | GAVAVLKYND | | GGSIKTKLPFQ | |
| FSRTELISP | | FSRTELISP | | GAVAVLKYNG | | GGSINTKLPFQ | |
| FSRTQLIAP | | FSRTQLIAP | | GAVAVVKYNG | | GGSINTRLPFQ | |
| FSSAASYKR | | FSSAASYKR | | GAVNSSKPFQ | | GGSPDPGVKGF | |
| FSSIKKYER | | FSSIKKYER | | GAVNSSMPFH | | GGTGSIYIEVL | |
| FSSIKRYER | | FSSIKRYER | | GAVNTTLSTI | | GGTGSVYIEVL | |
| FSSLAVNVR | | FSSLAVNVR | | GAVSFWMCSN | | GGTIASNLPFQ | |
| FSSLTVNVR | | FSSLTVNVR | | GAWIGRTKST | | GGTIASSLPFQ | |
| FSSLTVSVR | | FSSLTVSVR | | GAYERMCNIL | | GGTIISNLPFQ | |
| FSVQRNLPF | | FSVQRNLPF | | GAYGVKGFSF | | GGTIISSLPFQ | |
| FSVQRSLPF | | FSVQRSLPF | | GAYKILTIYS | | GGTINSPLPFQ | |
| FSYKYDNGV | | FSYKYDNGV | | GAYNNTTGRD | | GGTISPRSRSG | |
| FSYKYGNGV | | FSYKYGNGV | | GCDHSDNADK | | GGTITSNLPFQ | |
| FSYRYGNGV | | FSYRYGNGV | | GCDRLQDTTW | | GGTITSPLPFQ | |
| FTAEISHCR | | FTAEISHCR | | GCFDILHKCD | | GGTIVSSLPFQ | |
| FTAEVSHCR | | FTAEVSHCR | | GCFDILHKCN | | GGTPDPGVKGF | |
| FTAEVSYCR | | FTAEVSYCR | | GCFDLYHKCD | | GGTSSIYIEVL | |
| FTAVGKEFN | | FTAVGKEFN | | GCFEFWHKCD | | GGTSSVYIEVL | |
| FTAVGKEFS | | FTAVGKEFS | | GCFEFWHKCN | | GGTSSVYVEVL | |
| FTDGSATGP | | FTDGSATGP | | GCFEFYHKCD | | GGVESAVLRGF | |
| FTEGHIEEC | | FTEGHIEEC | | GCFEFYHKCN | | GGVNTNKTFQN | |
| FTEIGVTRR | | FTEIGVTRR | | GCFEFYHRCD | | GGVPTDVIRSW | |
| FTEVEGRIQ | | FTEVEGRIQ | | GCFEIFHKCD | | GGVPTDVVRSW | |
| FTEVEKQIG | | FTEVEKQIG | | GCFEIFHQCD | | GGWCGMIDGWY | |
| FTEVEQQIG | | FTEVEQQIG | | GCFEIFHRCD | | GGWPGLINGWY | |
| FTFKRTKGF | | FTFKRTKGF | | GCFEILHKCD | | GGWPGLVAGWY | |
| FTFKRTKGS | | FTFKRTKGS | | GCFEILHKCN | | GGWQGLVDGWY | |
| FTFKRTSGS | | FTFKRTSGS | | GCFEILHRCD | | GGWQGMIDGWY | |
| FTFKRTSGT | | FTFKRTSGT | | GCFEILHRCN | | GGWQGMVDGWY | |
| FTFNGAFIA | | FTFNGAFIA | | GCFEIYHACD | | GGWSGLIAGWY | |
| FTFNGSFIA | | FTFNGSFIA | | GCFEIYHKCD | | GGWSGLVAGWY | |
| FTFYHKCDD | | FTFYHKCDD | | GCFEIYHNCD | | GGWSGMIDGWY | |
| FTFYHKCDN | | FTFYHKCDN | | GCFEIYHRCD | | GGWTGLIDGWY | |
| FTFYHKCNN | | FTFYHKCNN | | GCFEIYHTCD | | GGWTGMIDGWY | |
| FTFYHRCDN | | FTFYHRCDN | | GCFELFHKCD | | GGWTGMVDGWY | |
| FTGEEMASK | | FTGEEMASK | | GCFELLHKCN | | GGWTGMVNGWY | |
| FTGEEMATK | | FTGEEMATK | | GCFELYHECD | | GGYKDIILWFS | |
| FTGEEMATR | | FTGEEMATR | | GCFELYHKCD | | GGYKDVILWFS | |
| FTIGECPKY | | FTIGECPKY | | GCFELYHKCN | | GGYPVIKKTYN | |
| FTIGECPRY | | FTIGECPRY | | GCFELYHRCD | | GHDFEREGYSL | |
| FTIMTDGPN | | FTIMTDGPN | | GCFKIYHKCD | | GHHANNSTEQV | |
| FTIMTDGPS | | FTIMTDGPS | | GCFKIYHRCD | | GHHAVANGTKV | |
| FTIRQELAS | | FTIRQELAS | | GCFNFFHKCN | | GHHAVANGTRV | |
| FTIRQEMAG | | FTIRQEMAG | | GCFNLLHKCN | | GHHAVENGTSV | |
| FTIRQEMAI | | FTIRQEMAI | | GCFPFYHKCD | | GHHAVPNGTIV | |
| FTIRQEMAN | | FTIRQEMAN | | GCFQPCFYIE | | GHHAVPNGTKV | |
| FTIRQEMAS | | FTIRQEMAS | | GCFQPCFYVE | | GHHAVPNGTLV | |
| FTITGDNTK | | FTITGDNTK | | GCFRIYHKCD | | GHHAVPNGTVV | |
| FTIYHKCDN | | FTIYHKCDN | | GCFSILHKCN | | GHHAVSNGTKV | |
| FTKDNSIRL | | FTKDNSIRL | | GCFSLLHKCN | | GHHAVTNGTKV | |
| FTKWNVTHT | | FTKWNVTHT | | GCFTFYHKCD | | GHIEECSCYPN | |
| FTKWNVTYT | | FTKWNVTYT | | GCFTFYHKCN | | GHIFVIREPFV | |
| FTLSGVAIA | | FTLSGVAIA | | GCFTIYHKCD | | GHIWVTREPYV | |

Fig. 83-102

| Block size 8 | SIN | Block size 9 | SIN | Block size 10 | SIN | Block size 11 | SIN |
|---|---|---|---|---|---|---|---|
| FTLTVPSER | | FTLTVPSER | | GCIEGKLSQM | | GHLITGKSHGR | |
| FTNEEALRQ | | FTNEEALRQ | | GCIESKLSQM | | GHLTTGKSHGR | |
| FTNEEPLRQ | | FTNEEPLRQ | | GCINRCFYVE | | GHLVTGKSHGR | |
| FTNEESLRQ | | FTNEESLRQ | | GCITPNGSIP | | GHNQEYTSGRQ | |
| FTSFFYRYG | | FTSFFYRYG | | GCKMYALHQG | | GHVFIIREPFV | |
| FTSVGKEFN | | FTSVGKEFN | | GCLKIYHKCD | | GHVFVIREPFV | |
| FTTEVSHCR | | FTTEVSHCR | | GCLVPCFWVE | | GHWPDGSNIGF | |
| FTVLTDGPS | | FTVLTDGPS | | GCQLNEGVMN | | GHYKISKSTKS | |
| FTVMTDGPN | | FTVMTDGPN | | GCQNGNIRCT | | GIAADKASTQK | |
| FTVMTDGPS | | FTVMTDGPS | | GCQNGNVRCT | | GIAADKESTQE | |
| FTWAIHHPP | | FTWAIHHPP | | GCRDNWQGAN | | GIAADKESTQK | |
| FTWNGVKVD | | FTWNGVKVD | | GCRFYALSQG | | GIAADKESTQT | |
| FTYESSINP | | FTYESSINP | | GCRMFALSQG | | GIAADKTSTQK | |
| FTYGSSINS | | FTYGSSINS | | GCRMYALHQG | | GIAADKVSTQK | |
| FTYGSSITS | | FTYGSSITS | | GCRTFFLTQG | | GIAADRESTQK | |
| FTYNGIRTN | | FTYNGIRTN | | GCSFAGWILG | | GIAADYKSTQS | |
| FTYSGIRTD | | FTYSGIRTD | | GCVILLNPFV | | GIAAEKESTQK | |
| FTYSGIRTN | | FTYSGIRTN | | GCWSFALAQG | | GIAIALGIINL | |
| FTYTGVRTD | | FTYTGVRTD | | GDAPFIDRLR | | GIAIVLGIINL | |
| FTYTGVRTN | | FTYTGVRTN | | GDAPFLDRIR | | GICAVATTHSW | |
| FVACGPAEC | | FVACGPAEC | | GDAPFLDRLR | | GICPVVFTDGS | |
| FVACGPSEC | | FVACGPSEC | | GDCNFEGWIV | | GICPVVMTDGP | |
| FVACGPTEC | | FVACGPTEC | | GDCNNPITGS | | GICTVVMTDGS | |
| FVACSPSEC | | FVACSPSEC | | GDCPKYIKQG | | GICVVAVTDGP | |
| FVALILGFV | | FVALILGFV | | GDCPKYIKSG | | GICYPGSIENQ | |
| FVANFSMEL | | FVANFSMEL | | GDCPKYMNVK | | GICYPGSVENQ | |
| FVAPDRASF | | FVAPDRASF | | GDCPKYVKQG | | GIDKEPMGFRY | |
| FVAPDRVSF | | FVAPDRVSF | | GDCPKYVNIK | | GIDKESMGFRY | |
| FVEIGVTRR | | FVEIGVTRR | | GDCPKYVNVK | | GIDKICLGHHA | |
| FVENLEELR | | FVENLEELR | | GDCPKYVNVR | | GIDKVCTKGKK | |
| FVFSIAASY | | FVFSIAASY | | GDCPRYVKQG | | GIDTNKTFQNI | |
| FVFSNAASY | | FVFSNAASY | | GDCRFEGWIV | | GIEVVNATETV | |
| FVFSSAASY | | FVFSSAASY | | GDCSFAGWIL | | GIEYNGKSLGI | |
| FVFTLTVPS | | FVFTLTVPS | | GDCSFAGWLL | | GIFFWMCSNGS | |
| FVFVALILG | | FVFVALILG | | GDCSFEGWIG | | GIFGAIAGFIE | |
| FVHFVEALA | | FVHFVEALA | | GDCSFEGWIV | | GIFGPVHFRNQ | |
| FVIEKMNTQ | | FVIEKMNTQ | | GDCSFTGWIL | | GIFLWMCSNGS | |
| FVIREPCIS | | FVIREPCIS | | GDCSIAGWLL | | GIGIAADRDST | |
| FVIREPFIS | | FVIREPFIS | | GDCSITGWLL | | GIGKFYIQMCT | |
| FVIREPFVA | | FVIREPFVA | | GDCSNPITGS | | GIGNLAFNAVI | |
| FVIREPFVS | | FVIREPFVS | | GDCYRACFYV | | GIGNLIFNTVI | |
| FVIVSKDNG | | FVIVSKDNG | | GDCYWVMTDG | | GIGNLVFNTVI | |
| FVLMENERT | | FVLMENERT | | GDDENATASF | | GIGQAADLKST | |
| FVLWACQNG | | FVLWACQNG | | GDDKNATASF | | GIGQAADYKST | |
| FVMREPFIS | | FVMREPFIS | | GDDRNATASF | | GIGRFYIQMCT | |
| FVMWACQKG | | FVMWACQKG | | GDDRNATASL | | GIGRFYVQMCT | |
| FVNEEALRQ | | FVNEEALRQ | | GDDVLMGRTI | | GIGRMTICIQG | |
| FVNGEALRQ | | FVNGEALRQ | | GDDVWLGRTV | | GIGRMTICVQG | |
| FVNMTNVQN | | FVNMTNVQN | | GDDVWMGRTI | | GIHHPDSETTA | |
| FVNRANQRL | | FVNRANQRL | | GDGCFEILHK | | GIHHPDTEATA | |
| FVNVTHVQN | | FVNVTHVQN | | GDGCFEILHR | | GIHHPDTEAVA | |
| FVNVTNVQN | | FVNVTNVQN | | GDGCFNFFHK | | GIHHPDTEEVA | |
| FVPFSKDNS | | FVPFSKDNS | | GDGCFNLLHK | | GIHHPDTETTA | |
| FVPVIGARP | | FVPVIGARP | | GDGCFSILHK | | GIHHPPDAKEQ | |
| FVPVMGARP | | FVPVMGARP | | GDGCFSLLHK | | GIHHPPDETEQ | |
| FVPVVGARP | | FVPVVGARP | | GDGQRSWMKI | | GIHHPPDTKEQ | |
| FVPVVRARP | | FVPVVRARP | | GDGQRSWMKL | | GIHHPPNTKEQ | |
| FVQHPELTG | | FVQHPELTG | | GDGVWIGRTK | | GIHHPSSAQEK | |
| FVQHPEMTG | | FVQHPEMTG | | GDHGVKGWAF | | GIHHPSSTKEK | |
| FVQNALNGN | | FVQNALNGN | | GDHITFSHNG | | GIHHPSSTQEK | |
| FVQNALSGN | | FVQNALSGN | | GDIFVIREPF | | GIILGNPKCDL | |
| FVQSYFQLF | | FVQSYFQLF | | GDIFVMREPF | | GIINLLIGISN | |

Fig. 83-103

| Block size 8 | SIN | Block size 9 | SIN | Block size 10 | SIN | Block size 11 | SIN |
|---|---|---|---|---|---|---|---|
| FVRGQQGRM | | FVRGQQGRM | | GDIIFLWGIH | | GIITDTFKSWK | |
| FVRQCFNPM | | FVRQCFNPM | | GDIIVFNTIG | | GIITDTLKSWK | |
| FVRTLFQQM | | FVRTLFQQM | | GDILDGVTAS | | GIKLKSEDNVY | |
| FVSCGPSEC | | FVSCGPSEC | | GDILEGTTAS | | GIKLKTEDNIY | |
| FVSCSHLEC | | FVSCSHLEC | | GDILRTHESS | | GIKLKTEDNVY | |
| FVSMEFSLT | | FVSMEFSLT | | GDILRTQDSS | | GIKSFSRTELI | |
| FVTREPFIS | | FVTREPFIS | | GDILRTQESS | | GIKSFSRTQLI | |
| FVVREPFIS | | FVVREPFIS | | GDIMRTQESS | | GIKTDGATSAC | |
| FVYFVEALA | | FVYFVEALA | | GDIVLVMKRK | | GILEDEQMYQK | |
| FVYFVEILA | | FVYFVEILA | | GDIWITREPY | | GILEDEQMYQR | |
| FVYFVETLA | | FVYFVETLA | | GDIWVTRELY | | GILEDERMYQK | |
| FWHKCDDEC | | FWHKCDDEC | | GDIWVTREPY | | GILGFVFTLTV | |
| FWHKCDNDC | | FWHKCDNDC | | GDIWVTRKPY | | GILGILTGPPQ | |
| FWHKCDNEC | | FWHKCDNEC | | GDIWVTRVPY | | GILGTIIGPPQ | |
| FWHKCNNEC | | FWHKCNNEC | | GDKICLGHHA | | GILKRGETLKI | |
| FWIELIRGR | | FWIELIRGR | | GDLILFNTIG | | GILTDTSRPGD | |
| FWKGGSIKT | | FWKGGSIKT | | GDLIVFNTIG | | GILTDTSRPSD | |
| FWKGGSINT | | FWKGGSINT | | GDLNFVNRAN | | GILTKTTVDHM | |
| FWKGGTINT | | FWKGGTINT | | GDNENATATV | | GIMNTSKPFQN | |
| FWLEMIRGK | | FWLEMIRGK | | GDNITFLHNG | | GINDRNFWRGD | |
| FWLEMIRGR | | FWLEMIRGR | | GDNITFSDNG | | GINDRNFWRGE | |
| FWLKNGNMR | | FWLKNGNMR | | GDNITFSHNG | | GINESADMSIG | |
| FWMCPNGSL | | FWMCPNGSL | | GDNTKWNENQ | | GINKVCTKGKK | |
| FWMCSGHSC | | FWMCSGHSC | | GDPNNMDKAV | | GINMSKKKSYI | |
| FWMCSNGSL | | FWMCSNGSL | | GDPNNMDRAV | | GINMSKRKSYI | |
| FWRGDNGRR | | FWRGDNGRR | | GDPPYSHGTG | | GINTNKTFQNI | |
| FWRGENGRK | | FWRGENGRK | | GDPSNMDRAV | | GINTNRTFQNI | |
| FWRGENGRR | | FWRGENGRR | | GDQICIGYHA | | GIPFHLGTKQV | |
| FWRGGSIIT | | FWRGGSIIT | | GDQICIGYHS | | GIPPLELGDCS | |
| FWRGGSINT | | FWRGGSINT | | GDQICVGYHA | | GIPPLELGNCS | |
| FWTSNSIVA | | FWTSNSIVA | | GDQICVGYHS | | GIPPLELRDCS | |
| FWTSNSIVT | | FWTSNSIVT | | GDRICIGYHA | | GIPPLVLGDCS | |
| FWVELIRGQ | | FWVELIRGQ | | GDRPKVNGQA | | GIPSDTPRGED | |
| FWVELIRGR | | FWVELIRGR | | GDRPLVNGQR | | GIPTDTPRGED | |
| FWVELVRGL | | FWVELVRGL | | GDSEMLNLYE | | GIPTDTPRIQD | |
| FWVELVRGR | | FWVELVRGR | | GDSFYAELKW | | GIPTDTPRVQD | |
| FWVEMIRGE | | FWVEMIRGE | | GDSIIFNSIG | | GIQAGVDRFYR | |
| FWVEMIRGK | | FWVEMIRGK | | GDSITFSHNG | | GIQAGVNRFYR | |
| FWVEMIRGQ | | FWVEMIRGQ | | GDTPRNDDRF | | GIQSDAQIDES | |
| FWVEMIRGR | | FWVEMIRGR | | GDTPRNDDRS | | GIREWSYLIED | |
| FWVMTDGPA | | FWVMTDGPA | | GDTPRNDDSS | | GIRIGSKGDVF | |
| FYAELKWLI | | FYAELKWLI | | GDTPRNEDGS | | GIRIGSKGHVF | |
| FYAELKWLV | | FYAELKWLV | | GDTPRNEDSS | | GIRIGSRGEVF | |
| FYAEMEWLL | | FYAEMEWLL | | GDTPRNGDSS | | GIRIGSRGHIF | |
| FYAEMKWLL | | FYAEMKWLL | | GDTPRSDDSS | | GIRIGSRGHVF | |
| FYALSQGTT | | FYALSQGTT | | GDTVTFTFNG | | GIRPGYNGQKS | |
| FYHKCDDEC | | FYHKCDDEC | | GDVFAIREPF | | GIRSFSRTELI | |
| FYHKCDNEC | | FYHKCDNEC | | GDVFIIREPF | | GIRTDGATSAC | |
| FYHKCDNKC | | FYHKCDNKC | | GDVFVIREPF | | GIRVGSRGHVF | |
| FYHKCNDEC | | FYHKCNDEC | | GDVFVMREPF | | GISFWMCSNGS | |
| FYHKCNNEC | | FYHKCNNEC | | GDVFVTREPF | | GISGADDDAYA | |
| FYHRCDNEC | | FYHRCDNEC | | GDVFVVREPF | | GISGPDDGAVA | |
| FYIELIRGK | | FYIELIRGK | | GDVLDGVTAS | | GISGPDNEAVA | |
| FYIELIRGR | | FYIELIRGR | | GDVVLVMKRK | | GISGPDNGAVA | |
| FYIQMCTEL | | FYIQMCTEL | | GDVYKILSIY | | GISGPDSGAVA | |
| FYKILKIKK | | FYKILKIKK | | GDYARLYIWG | | GISIWMCSNGS | |
| FYKILKIRK | | FYKILKIRK | | GDYNNTTGRD | | GISLWMCSNGS | |
| FYKSMRWLT | | FYKSMRWLT | | GDYTRLYIWG | | GISNVGLKVSL | |
| FYLGTKQVC | | FYLGTKQVC | | GEAMVSRARI | | GISNVGLNVSL | |
| FYLGTRQVC | | FYLGTRQVC | | GEAPSPYNSK | | GISPIHLGDCS | |
| FYRGMRWLT | | FYRGMRWLT | | GEAPSPYNSR | | GISPVHLGDCS | |
| FYRICKLVG | | FYRICKLVG | | GECFNPITGS | | GISSMGEAMVS | |

Fig. 83-104

| Block size 8 | SIN | Block size 9 | SIN | Block size 10 | SIN | Block size 11 | SIN |
|---|---|---|---|---|---|---|---|
| FYRNLAWFV | | FYRNLAWFV | | GECFWVMTDG | | GISSMMEAMVS | |
| FYRNLIWFV | | FYRNLIWFV | | GECFYSGGTI | | GISSMVEAMIS | |
| FYRNLIWLV | | FYRNLIWLV | | GECPKYIKSD | | GISSMVEAMMS | |
| FYRNLVWFI | | FYRNLVWFI | | GECPKYVKQG | | GISSMVEAMVS | |
| FYRNLVWFV | | FYRNLVWFV | | GECPKYVKSD | | GITGPDATAVA | |
| FYRNLVWIV | | FYRNLVWIV | | GECPKYVKSE | | GITGPDSTAVA | |
| FYRNLVWLV | | FYRNLVWLV | | GECPKYVKSN | | GITGPDTTAVA | |
| FYRNMRWLT | | FYRNMRWLT | | GECPKYVKSS | | GITNKINSIID | |
| FYRNVVWLI | | FYRNVVWLI | | GECPKYVKST | | GITNKVNSIID | |
| FYRSINWLT | | FYRSINWLT | | GECPKYVRSA | | GITVIKNNMIN | |
| FYRSIRWLT | | FYRSIRWLT | | GECPKYVRSE | | GIVNTTLSTIA | |
| FYRSMKWLT | | FYRSMKWLT | | GECPKYVRST | | GIWDTLIERDN | |
| FYRSMRWLT | | FYRSMRWLT | | GECPRYVKSE | | GIYKILSIYST | |
| FYRSVRWLT | | FYRSVRWLT | | GECYRACFYV | | GIYKILTIYST | |
| FYRTCKLLG | | FYRTCKLLG | | GECYWVMTDG | | GIYQILAIYAT | |
| FYRTCKLVG | | FYRTCKLVG | | GEDSDILVTR | | GIYQILAIYST | |
| FYRYGFVAN | | FYRYGFVAN | | GEDSDVLVTR | | GIYQILSIYST | |
| FYSEMKWLL | | FYSEMKWLL | | GEDTIEERFE | | GKAPISLGDCS | |
| FYSEMKWLS | | FYSEMKWLS | | GEETIEEKFE | | GKAPISLGGCS | |
| FYSGGTINS | | FYSGGTINS | | GEETIEERFE | | GKAQHIEECSC | |
| FYVELIRGK | | FYVELIRGK | | GEETVEERFE | | GKAWLHICVTG | |
| FYVELIRGM | | FYVELIRGM | | GEFNQVEKRI | | GKAWLHVCITG | |
| FYVELIRGR | | FYVELIRGR | | GEFNQVENRI | | GKAWLHVCVTG | |
| FYVELIRGS | | FYVELIRGS | | GEFNQVEQRI | | GKCNDPYPGNN | |
| FYVELTRGV | | FYVELTRGV | | GEFSQVEQRI | | GKCNEPYPGNN | |
| FYVELVRGR | | FYVELVRGR | | GEFSQVERRI | | GKCPKYIPSGS | |
| FYVQMCTEL | | FYVQMCTEL | | GEGEQIIVTR | | GKCPKYIPSNS | |
| FYWTIVDPG | | FYWTIVDPG | | GEGIAADYKS | | GKCPKYIPSRS | |
| FYWTIVEPE | | FYWTIVEPE | | GEGIPLHDAI | | GKCPKYISSGS | |
| FYWTIVEPG | | FYWTIVEPG | | GEGIPLYDAI | | GKCPRYIPSGS | |
| FYYEECSCY | | FYYEECSCY | | GEGIPLYDAV | | GKCPRYVKQSS | |
| GAAGAAIKG | | GAAGAAIKG | | GEGQRSWMKI | | GKCYQFALGQG | |
| GAAGAAVKG | | GAAGAAVKG | | GEGTAADYKS | | GKDNAIRIGED | |
| GAAIKGVGT | | GAAIKGVGT | | GEHAKAIGNC | | GKDNAIRIGEN | |
| GAAPVLGNY | | GAAPVLGNY | | GEKANVLIGQ | | GKDNAIRIGGN | |
| GAASLSPGM | | GAASLSPGM | | GEKSDVLVTR | | GKDNAVRIGED | |
| GAAVKGIGT | | GAAVKGIGT | | GELDNNGELR | | GKDNAVRIGEN | |
| GAAVKGVGT | | GAAVKGVGT | | GELNNNGELR | | GKDPKKTGGPI | |
| GACWEQLYT | | GACWEQLYT | | GELRHLFSGI | | GKEPISLGDCS | |
| GADDDAYAV | | GADDDAYAV | | GELRHLFSGV | | GKEWLHVCITG | |
| GADDEAYAV | | GADDEAYAV | | GENIAPEKVD | | GKEWMHICMTG | |
| GADGVKGFS | | GADGVKGFS | | GENMAPEKID | | GKEWMHVCITG | |
| GADINFMPI | | GADINFMPI | | GENMAPEKMD | | GKEWMHVCMAG | |
| GADNDAYAV | | GADNDAYAV | | GENMAPEKVD | | GKEWMHVCMTG | |
| GADSFYRNL | | GADSFYRNL | | GENSDVLVTR | | GKFQTAAQKAM | |
| GAFGPVHFR | | GAFGPVHFR | | GEPGVKGFGF | | GKFQTAAQRAM | |
| GAFIAPDRA | | GAFIAPDRA | | GEQIIVTREP | | GKFTNEEALRQ | |
| GAFIAPDRV | | GAFIAPDRV | | GERGLFGAIA | | GKFYIQMCTEL | |
| GAFIAPNRA | | GAFIAPNRA | | GERIMFESNG | | GKGCFDILHKC | |
| GAFIAPRYA | | GAFIAPRYA | | GERITFESNG | | GKGCFDLYHKC | |
| GAFLAPRYA | | GAFLAPRYA | | GERITFESSG | | GKGCFEIYHAC | |
| GAFLAPRYS | | GAFLAPRYS | | GERTTFESNG | | GKGCFEIYHKC | |
| GAFVAPDRV | | GAFVAPDRV | | GESEQIIVTR | | GKGCFEIYHNC | |
| GAGALAEDP | | GAGALAEDP | | GESEQIVVTR | | GKGCFEIYHTC | |
| GAGNKLITV | | GAGNKLITV | | GESEQVIVTR | | GKGCFELYHEC | |
| GAGSWPDGA | | GAGSWPDGA | | GESHCRIIQN | | GKGCFELYHKC | |
| GAGYAADKE | | GAGYAADKE | | GESHGKIIQN | | GKGCFELYHRC | |
| GAHILVTRE | | GAHILVTRE | | GESHGRIIQN | | GKGRIFQSHIR | |
| GAIAGFIEG | | GAIAGFIEG | | GESHGRTIQN | | GKGRIFQSPIR | |
| GAIAGFIEN | | GAIAGFIEN | | GESSDVLVTR | | GKGRIFQSRII | |
| GAIAGFLEN | | GAIAGFLEN | | GESYGRIIQN | | GKGRIFQSRIR | |
| GAIEECLIN | | GAIEECLIN | | GETLKIRTNG | | GKGRYGVKGFS | |

Fig. 83-105

| Block size 8 | SIN | Block size 9 | SIN | Block size 10 | SIN | Block size 11 | SIN |
|---|---|---|---|---|---|---|---|
| GAIGAIDSS | | GAIGAIDSS | | GETLKVESNG | | GKGSWPDGANI | |
| GAILPFDID | | GAILPFDID | | GETLNIESNG | | GKGVWIGRTKS | |
| GAILPFGID | | GAILPFGID | | GETLNVESNG | | GKHIVERILEE | |
| GAINSSKPF | | GAINSSKPF | | GETTGRNCTI | | GKHSNGTIHDR | |
| GAINSSKPL | | GAINSSKPL | | GETTGRNCTV | | GKIAHISPLSG | |
| GAINSSMPF | | GAINSSMPF | | GEVDNNGELR | | GKIIHISPLSG | |
| GAINSSMPL | | GAINSSMPL | | GEVFVIREPF | | GKIIQNEDIPI | |
| GAINSSRPF | | GAINSSRPF | | GEVPGWSWDD | | GKILRTQESEC | |
| GAINTTLPF | | GAINTTLPF | | GEVPSPYNSR | | GKISHISPLSG | |
| GAISFWMCS | | GAISFWMCS | | GEVSVIREPF | | GKITNKVNNIV | |
| GAIWVTREP | | GAIWVTREP | | GEYNNTTGRD | | GKIVHISPLSG | |
| GAKAGFIEG | | GAKAGFIEG | | GFAFKQGNSV | | GKKAVDLGSCG | |
| GAKAGFIEN | | GAKAGFIEN | | GFAIFSKDNG | | GKKEEFSEIMK | |
| GAKEIALSY | | GAKEIALSY | | GFAIISKDNG | | GKKEEFSEIMR | |
| GAKEISLSY | | GAKEISLSY | | GFAIVSKDNG | | GKKEFSEIMKI | |
| GAKEVALGY | | GAKEVALGY | | GFAPFAKDNS | | GKKGKWLNQSK | |
| GAKEVALSY | | GAKEVALSY | | GFAPFSKDNG | | GKLCKLNGIPP | |
| GAKEVSLSY | | GAKEVSLSY | | GFAPFSKDNS | | GKLCRLRGIPP | |
| GAKILTSES | | GAKILTSES | | GFAPFTKDNS | | GKLCRLSGIPP | |
| GAKSFYRNL | | GAKSFYRNL | | GFAPLSKDNS | | GKLKRRAIATP | |
| GAKVNTLTE | | GAKVNTLTE | | GFAVVSKDNG | | GKLNRFIEKTN | |
| GALASCMGL | | GALASCMGL | | GFCFTVMTDG | | GKLNRIIEKTN | |
| GALGSPGCD | | GALGSPGCD | | GFEILLIEDG | | GKLNRLIDKTN | |
| GALLAPRYA | | GALLAPRYA | | GFEILLIEEG | | GKLNRLIDRTN | |
| GALLGTKHS | | GALLGTKHS | | GFEMIWDANG | | GKLNRLIEKTN | |
| GALLGTNHS | | GALLGTNHS | | GFEMIWDPDG | | GKLNRLIERTN | |
| GALLGTRHS | | GALLGTRHS | | GFEMIWDPNG | | GKLNRLIGKTN | |
| GALLNDKHS | | GALLNDKHS | | GFEMLKIHNA | | GKLNRLISKTN | |
| GALLNDRHS | | GALLNDRHS | | GFEMLKIPNA | | GKMRDSIKSWR | |
| GALLPFDID | | GALLPFDID | | GFEMLKVPNA | | GKMTDSIKSWR | |
| GALNTTLPF | | GALNTTLPF | | GFEMLRIPNA | | GKNADLEALME | |
| GALQLNPID | | GALQLNPID | | GFEMVWDANG | | GKNSDLEALME | |
| GALRQKIME | | GALRQKIME | | GFEMVWDPNG | | GKNSFYAELKW | |
| GALVGTKHS | | GALVGTKHS | | GFEPNGCIEG | | GKNTDLEALME | |
| GAMASQGTK | | GAMASQGTK | | GFEPNGCIES | | GKNTDLEVLME | |
| GANGVKGFS | | GANGVKGFS | | GFEPNGSIEG | | GKQAKGLFGAI | |
| GANIDFMPV | | GANIDFMPV | | GFEPNGYIEG | | GKQPISLGDCS | |
| GANIGFMPK | | GANIGFMPK | | GFEVLLIEDG | | GKRGKWVKSVQ | |
| GANINFMPI | | GANINFMPI | | GFEVLLIENG | | GKSHGRILKND | |
| GANINLMPI | | GANINLMPI | | GFFGAIAGFI | | GKSHGRILKNN | |
| GANISFMPI | | GANISFMPI | | GFFPDGPQIQ | | GKSHGRVLKNN | |
| GANRPIIEI | | GANRPIIEI | | GFFPFHKDNA | | GKSLGIQSDAQ | |
| GANRPIITI | | GANRPIITI | | GFGFRQGDDV | | GKTKATKMEAI | |
| GANRPVIEI | | GANRPVIEI | | GFGFRQGNDV | | GKTKATKMKAI | |
| GANRPVIII | | GANRPVIII | | GFGFRQGNSV | | GKTNEKFHQIE | |
| GANRPVIKI | | GANRPVIKI | | GFGFRQGSDV | | GKTSWSYIVEK | |
| GANRPVITI | | GANRPVITI | | GFGFRQGTDV | | GKTSWSYIVER | |
| GANRPWVSF | | GANRPWVSF | | GFGFRQGTSV | | GKVCRALLAKS | |
| GANSFYRNL | | GANSFYRNL | | GFHDSNVKNL | | GKVCRTLLAKS | |
| GAPACDLHL | | GAPACDLHL | | GFHFEECSCY | | GKVECICRDNW | |
| GAPGVKGFG | | GAPGVKGFG | | GFHHSNAEGT | | GKVECVCRDNW | |
| GAPHGLCYP | | GAPHGLCYP | | GFHHSNSEGT | | GKVVHISPLSG | |
| GAPLELRDC | | GAPLELRDC | | GFIDIWTYNA | | GKWDTLIEREN | |
| GAPLVLDDC | | GAPLVLDDC | | GFIDVWTYNA | | GKWREQLSQKF | |
| GAPQLNPID | | GAPQLNPID | | GFIEGGWCGM | | GLAPFSKDNGI | |
| GAPQLNPVD | | GAPQLNPVD | | GFIEGGWPGL | | GLCKINSWHIF | |
| GAPSCDLHL | | GAPSCDLHL | | GFIEGGWQGL | | GLCTINSWHIF | |
| GAQHIEECS | | GAQHIEECS | | GFIEGGWQGM | | GLCTINSWHIY | |
| GAQHVEECS | | GAQHVEECS | | GFIEGGWSGL | | GLCYPGELDNN | |
| GAQSFYRSI | | GAQSFYRSI | | GFIEGGWSGM | | GLCYPGELNNN | |
| GAQSLSISV | | GAQSLSISV | | GFIEGGWTGL | | GLDIRTATREG | |
| GARIGEGQR | | GARIGEGQR | | GFIEGGWTGM | | GLDKICLGHHA | |

Fig. 83-106

| Block size 8 | SIN | Block size 9 | SIN | Block size 10 | SIN | Block size 11 | SIN |
|---|---|---|---|---|---|---|---|
| GARIITSES | | GARIITSES | | GFIEGRWPGL | | GLDNEPGSGHW | |
| GARILASES | | GARILASES | | GFIENGWEGL | | GLDNEPGSGNW | |
| GARILTSES | | GARILTSES | | GFIENGWEGM | | GLDRICLGHHA | |
| GARPKVNGQ | | GARPKVNGQ | | GFIENGWQGL | | GLFFFCLKNGN | |
| GARPLVNGQ | | GARPLVNGQ | | GFIFGCQNGN | | GLFFWMCSNGS | |
| GARPQVNGQ | | GARPQVNGQ | | GFIIKGRSHL | | GLFGAIAGFIE | |
| GARRIDFHW | | GARRIDFHW | | GFIMWACQKG | | GLFGAIAGFLE | |
| GARRIDFNW | | GARRIDFNW | | GFIMWACQRG | | GLFGAKAGFIE | |
| GASCFILLA | | GASCFILLA | | GFIMWTCQKG | | GLFLWMCSNGS | |
| GASCFLFLA | | GASCFLFLA | | GFIVKGRSHL | | GLHDANVRNLH | |
| GASCFLLIA | | GASCFLLIA | | GFIVWACQRG | | GLIAGWYGFQH | |
| GASCFLLLA | | GASCFLLLA | | GFIYSGIRTN | | GLIAPDRVSKL | |
| GASCFTLLA | | GASCFTLLA | | GFKHQNAQGE | | GLIAPRYGYII | |
| GASCFVLLA | | GASCFVLLA | | GFKISKRGGS | | GLIAPSRVSKL | |
| GASCLILLA | | GASCLILLA | | GFKISKRGNS | | GLIAPSRVTKL | |
| GASCVMLLA | | GASCVMLLA | | GFKISKRGSS | | GLICATCEQIA | |
| GASSFVLLA | | GASSFVLLA | | GFKISRRGNS | | GLIDGWYGFKH | |
| GASSFYRNL | | GASSFYRNL | | GFKPNGCIEG | | GLIDGWYGFRH | |
| GATINEEAL | | GATINEEAL | | GFLAPRYGYI | | GLIDGWYGYHH | |
| GATSACKRT | | GATSACKRT | | GFLDIWTYNA | | GLIDGWYGYKH | |
| GATVNEEAL | | GATVNEEAL | | GFLDVWTYNA | | GLIDGWYGYRH | |
| GATVNEGAL | | GATVNEGAL | | GFLGVWTYNA | | GLIFMCVKNGN | |
| GAVAVLKYD | | GAVAVLKYD | | GFLIIGKEDR | | GLILAFILWAC | |
| GAVAVLKYK | | GAVAVLKYK | | GFLILGKEDK | | GLILAFIMWAC | |
| GAVAVLKYN | | GAVAVLKYN | | GFLILGKEDR | | GLILAFIMWTC | |
| GAVAVVKYN | | GAVAVVKYN | | GFLILGKENK | | GLILGMQNGSC | |
| GAVNSSKPF | | GAVNSSKPF | | GFLILGREDK | | GLILGMQNGSY | |
| GAVNSSMPF | | GAVNSSMPF | | GFLNVWTYNA | | GLILGNPKCDL | |
| GAVNTTLST | | GAVNTTLST | | GFMDVWTYNA | | GLILGNPKCDP | |
| GAVWVTREP | | GAVWVTREP | | GFQHQNAEGI | | GLILSFIMWAC | |
| GAYERMCNI | | GAYERMCNI | | GFQHQNAEGT | | GLILSNPKCDL | |
| GAYGVKGFS | | GAYGVKGFS | | GFQHQNEQGM | | GLILTFIMWAC | |
| GAYKILTIY | | GAYKILTIY | | GFQHQNEQGT | | GLINGWYGFQH | |
| GAYNNTTGR | | GAYNNTTGR | | GFQHQNEQGV | | GLINGWYGFRH | |
| GCDHSDNAD | | GCDHSDNAD | | GFQHQNSEGT | | GLISTPLGSPP | |
| GCDRLQDTT | | GCDRLQDTT | | GFQHRDEEGT | | GLISTPLGTPP | |
| GCFDILHKC | | GCFDILHKC | | GFQHRNEEGT | | GLIYNRMGAVT | |
| GCFDLYHKC | | GCFDLYHKC | | GFRDVWTYNA | | GLIYNRMGTIT | |
| GCFEFWHKC | | GCFEFWHKC | | GFRHQKAQGE | | GLIYNRMGTVA | |
| GCFEFYHKC | | GCFEFYHKC | | GFRHQNAEGT | | GLIYNRMGTVN | |
| GCFEFYHRC | | GCFEFYHRC | | GFRHQNAQGE | | GLIYNRMGTVT | |
| GCFEIFHKC | | GCFEIFHKC | | GFRHQNAQGI | | GLKISSSFSFG | |
| GCFEIFHQC | | GCFEIFHQC | | GFRHQNAQGQ | | GLLAPKYGYII | |
| GCFEIFHRC | | GCFEIFHRC | | GFRHQNAQGT | | GLLAPRYGYII | |
| GCFEILHKC | | GCFEILHKC | | GFRHQNSEGT | | GLLDVWTYNAE | |
| GCFEILHRC | | GCFEILHRC | | GFRHQNSQGE | | GLLEVGTRWMK | |
| GCFEIYHAC | | GCFEIYHAC | | GFRHQNTQGE | | GLLGAIAGFIE | |
| GCFEIYHKC | | GCFEIYHKC | | GFRISKRGSS | | GLLGIITGPPQ | |
| GCFEIYHNC | | GCFEIYHNC | | GFRQGNSVWA | | GLLGTITGPPQ | |
| GCFEIYHTC | | GCFEIYHTC | | GFRQGTSVWA | | GLLGTLIGPPQ | |
| GCFEIYHVC | | GCFEIYHVC | | GFRYSGIKTD | | GLLGTVTGPPQ | |
| GCFELFHKC | | GCFELFHKC | | GFRYSGIRTD | | GLLISDGGPNL | |
| GCFELLHKC | | GCFELLHKC | | GFSAESRKLL | | GLLLQIISLCS | |
| GCFELYHKC | | GCFELYHKC | | GFSAESRKML | | GLLLQITSLCS | |
| GCFELYHRC | | GCFELYHRC | | GFSFKYGNGV | | GLLLWMCSNGS | |
| GCFKIYHKC | | GCFKIYHKC | | GFSFRYGDGV | | GLLVADGGPNL | |
| GCFKIYHRC | | GCFKIYHRC | | GFSFRYGNGV | | GLLVSDGGPNL | |
| GCFNFFHKC | | GCFNFFHKC | | GFSYKYDNGV | | GLMSTPLGSPP | |
| GCFNLLHKC | | GCFNLLHKC | | GFSYKYGNGV | | GLNNEPGSGNW | |
| GCFQPCFYI | | GCFQPCFYI | | GFSYRYGNGV | | GLPQSGRIVVD | |
| GCFQPCFYV | | GCFQPCFYV | | GFTYNGIRTN | | GLPSDTPRGED | |
| GCFSILHKC | | GCFSILHKC | | GFTYSEIRTN | | GLPVGGNEKKA | |

Fig. 83-107

| Block size 8 | SIN | Block size 9 | SIN | Block size 10 | SIN | Block size 11 | SIN |
|---|---|---|---|---|---|---|---|
| GCFSLLHKC | | GCFSLLHKC | | GFTYSGIRTD | | GLQRRRFIQNA | |
| GCFTFYHKC | | GCFTFYHKC | | GFTYSGIRTN | | GLQRRRFVQNA | |
| GCFTFYHRC | | GCFTFYHRC | | GFTYTGVRTD | | GLQSSDDFALI | |
| GCFTIYHKC | | GCFTIYHKC | | GFTYTGVRTN | | GLREQKQEFKM | |
| GCIEGKLSQ | | GCIEGKLSQ | | GFVANFSMEL | | GLRILIRGNSP | |
| GCIESKLSQ | | GCIESKLSQ | | GFVENLEELR | | GLRILVRGNSP | |
| GCINRCFYV | | GCINRCFYV | | GFVFTLTVPS | | GLRISSSFSFG | |
| GCITPNGSI | | GCITPNGSI | | GFVHFVEALA | | GLRNIPSIQSR | |
| GCKMFALHQ | | GCKMFALHQ | | GFVIVSKDNG | | GLRNIPSVQSR | |
| GCKMYALHQ | | GCKMYALHQ | | GFVLWACQNG | | GLRNTPSIDPK | |
| GCLKIYHKC | | GCLKIYHKC | | GFVMWACQKG | | GLRNTPSIEPK | |
| GCLVPCFWV | | GCLVPCFWV | | GFVPFSKDNS | | GLRNTPSIEPR | |
| GCQLNEGVM | | GCQLNEGVM | | GFVRQCFNPM | | GLRNTPSVEPK | |
| GCQNGNIRC | | GCQNGNIRC | | GFVRTLFQQM | | GLRNTPSVEPR | |
| GCQNGNVRC | | GCQNGNVRC | | GFVYFVEALA | | GLRNVPSIQSR | |
| GCRDNWQGA | | GCRDNWQGA | | GFVYFVEILA | | GLSFWMCSNGS | |
| GCRFYALSQ | | GCRFYALSQ | | GFVYFVETLA | | GLSLWMCFNGS | |
| GCRMFALSQ | | GCRMFALSQ | | GFWMCSNGSL | | GLSLWMCSNGS | |
| GCRMYALHQ | | GCRMYALHQ | | GGAIWVTREP | | GLSMVKSDKIC | |
| GCRTFFLTQ | | GCRTFFLTQ | | GGAQHVEECS | | GLSMVRSDKIC | |
| GCSFAGWIL | | GCSFAGWIL | | GGAVWVTREP | | GLSPNVYQARF | |
| GCVILLNPF | | GCVILLNPF | | GGDIWATREP | | GLSSRISFYWT | |
| GCWSFALAQ | | GCWSFALAQ | | GGDIWITREP | | GLTHIMIWHSN | |
| GDAPFIDRL | | GDAPFIDRL | | GGDIWVMREP | | GLTHLMIWHSN | |
| GDAPFLDRI | | GDAPFLDRI | | GGDIWVTREL | | GLTHMMIWHSN | |
| GDAPFLDRL | | GDAPFLDRL | | GGDIWVTREP | | GLVAGWYGFQH | |
| GDCNFEGWI | | GDCNFEGWI | | GGDIWVTRVP | | GLVCATCEQIA | |
| GDCNNPITG | | GDCNNPITG | | GGDSFYAELK | | GLVDGWYGFRH | |
| GDCPKYIKQ | | GDCPKYIKQ | | GGFIFGCQNG | | GLVDGWYGYHH | |
| GDCPKYIKS | | GDCPKYIKS | | GGFLAPRYGY | | GLVFFCLKNGN | |
| GDCPKYMNV | | GDCPKYMNV | | GGFTFKRTKG | | GLVFFCLRNGN | |
| GDCPKYVKQ | | GDCPKYVKQ | | GGFTFKRTNG | | GLVFICIKNGN | |
| GDCPKYVNI | | GDCPKYVNI | | GGFTFKRTSG | | GLVFICMKNGN | |
| GDCPKYVNV | | GDCPKYVNV | | GGGDIWVTRE | | GLVFICVKNGN | |
| GDCPRYVKQ | | GDCPRYVKQ | | GGGPDPGVKG | | GLVFMCVKNGN | |
| GDCRFEGWI | | GDCRFEGWI | | GGGYAADKES | | GLVGDTPRNDD | |
| GDCSFAGWI | | GDCSFAGWI | | GGHGVKGWAF | | GLVGDTPRNED | |
| GDCSFAGWL | | GDCSFAGWL | | GGHIEECSCY | | GLVGDTPRNGD | |
| GDCSFEGWI | | GDCSFEGWI | | GGHIWVTREP | | GLVGDTPRNND | |
| GDCSFTGWI | | GDCSFTGWI | | GGIDKEPMGF | | GLVLGNPKCDL | |
| GDCSIAGWL | | GDCSIAGWL | | GGIDKESMGF | | GLWAYNAELLV | |
| GDCSNPITG | | GDCSNPITG | | GGIDTNKTFQ | | GLWDPFRQSER | |
| GDCSVAGWL | | GDCSVAGWL | | GGIGKFYIQM | | GLWDSFRQSER | |
| GDCYRACFY | | GDCYRACFY | | GGIGRFYIQM | | GLYDAIEECLI | |
| GDCYWVMTD | | GDCYWVMTD | | GGIGRFYVQM | | GLYEAIEECLI | |
| GDDGNATAS | | GDDGNATAS | | GGINTNKTFQ | | GLYEAVEECLI | |
| GDDKNATAS | | GDDKNATAS | | GGINTNRTFQ | | GLYESIEECLI | |
| GDDRKATAS | | GDDRKATAS | | GGIPTDVVRS | | GLYGAIEECLI | |
| GDDRNATAS | | GDDRNATAS | | GGLGVKGFGF | | GMAADKESTQK | |
| GDDVLMGRT | | GDDVLMGRT | | GGLIAPRYGY | | GMAADQKSTQE | |
| GDDVWLGRT | | GDDVWLGRT | | GGLIAPSRVS | | GMCYPGFVENL | |
| GDDVWMGRT | | GDDVWMGRT | | GGLIAPSRVT | | GMCYPGSIENL | |
| GDFVRQCFN | | GDFVRQCFN | | GGLILGMQNG | | GMCYPGSVENL | |
| GDGCFEILH | | GDGCFEILH | | GGLLAPKYGY | | GMDPRMCSLMQ | |
| GDGCFKIYH | | GDGCFKIYH | | GGLLAPRYGY | | GMELRRCLLQS | |
| GDGCFNFFH | | GDGCFNFFH | | GGLVAPSRVS | | GMEMRRCLLQS | |
| GDGCFNLLH | | GDGCFNLLH | | GGMPTDVVRS | | GMFNMLSTVLG | |
| GDGCFSILH | | GDGCFSILH | | GGNEKKAKLA | | GMGMAADKEST | |
| GDGCFSLLH | | GDGCFSLLH | | GGNIWITREP | | GMGQAADLKST | |
| GDGQRSWMK | | GDGQRSWMK | | GGNPDPGVKG | | GMIDGWYGFHH | |
| GDGVWIGRT | | GDGVWIGRT | | GGNSFYAELK | | GMIDGWYGFRH | |
| GDHGVKGWA | | GDHGVKGWA | | GGPDPGVKGF | | GMIDGWYGYHH | |

Fig. 83-108

| Block size 8 | SIN | Block size 9 | SIN | Block size 10 | SIN | Block size 11 | SIN |
|---|---|---|---|---|---|---|---|
| GDHITFSHN | | GDHITFSHN | | GGPGVKGFGF | | GMKNVPEKIHT | |
| GDIFVIREP | | GDIFVIREP | | GGPNLYNIRN | | GMKNVPEKIRT | |
| GDIFVMREP | | GDIFVMREP | | GGQAFYRSIN | | GMKNVPEKIRV | |
| GDIIFLWGI | | GDIIFLWGI | | GGQSFYRSIN | | GMLGFVFTLTV | |
| GDIIVFNTI | | GDIIVFNTI | | GGRNSFFSRL | | GMMDGWYGFRH | |
| GDILDGVTA | | GDILDGVTA | | GGSGTDNYGV | | GMMMGMFNMLS | |
| GDILEGTTA | | GDILEGTTA | | GGSGTNNYGV | | GMQIRGFVHFV | |
| GDILRTQES | | GDILRTQES | | GGSIITELPF | | GMQIRGFVYFV | |
| GDIMRTQES | | GDIMRTQES | | GGSIKTKLPF | | GMQNGSCRCMF | |
| GDIVLVMKR | | GDIVLVMKR | | GGSINTKLPF | | GMQNGSYRCMF | |
| GDIWITREP | | GDIWITREP | | GGSINTRLPF | | GMRILIRGNSP | |
| GDIWVTREL | | GDIWVTREL | | GGSPDPGVKG | | GMRILVRGNSP | |
| GDIWVTREP | | GDIWVTREP | | GGTGSVYIEV | | GMRNIPEKQTR | |
| GDKICLGHH | | GDKICLGHH | | GGTIASSLPF | | GMRNIPERQTR | |
| GDLILFNTI | | GDLILFNTI | | GGTIISNLPF | | GMRNIPGKQAK | |
| GDLIVFNTI | | GDLIVFNTI | | GGTIISSLPF | | GMRNVPEKQTR | |
| GDLNFVNRA | | GDLNFVNRA | | GGTINSPLPF | | GMRNVPERQTR | |
| GDNENATAT | | GDNENATAT | | GGTINTKLPF | | GMRNVPETQTR | |
| GDNIIFSHN | | GDNIIFSHN | | GGTITSNLPF | | GMRVLIRGNSP | |
| GDNITFLHN | | GDNITFLHN | | GGTITSPLPF | | GMSANGDILMR | |
| GDNITFSDN | | GDNITFSDN | | GGTIVSSLPF | | GMVDGWYGFHH | |
| GDNITFSHN | | GDNITFSHN | | GGTPDPGVKG | | GMVDGWYGFRH | |
| GDNPRPADG | | GDNPRPADG | | GGTSSIYIEV | | GMVDGWYGFRY | |
| GDNPRPDDG | | GDNPRPDDG | | GGTSSMYIEV | | GMVDGWYGYHH | |
| GDNPRPMDG | | GDNPRPMDG | | GGTSSVYIEV | | GMVNGWYGFRH | |
| GDNPRPMDS | | GDNPRPMDS | | GGTSSVYVEV | | GNAEIEDLIFL | |
| GDNPRPNDG | | GDNPRPNDG | | GGVESAVLRG | | GNAEIEDLIFM | |
| GDNPRPSDG | | GDNPRPSDG | | GGVNTNKTFQ | | GNAEIEDLIFS | |
| GDNPRPVDG | | GDNPRPVDG | | GGVPTDVIRS | | GNAEIEDLTFL | |
| GDNPRSVDG | | GDNPRSVDG | | GGVPTDVMRS | | GNAKDEGNGCF | |
| GDNTKWNEN | | GDNTKWNEN | | GGVPTDVVRS | | GNAQHIEECSC | |
| GDPNNMDKA | | GDPNNMDKA | | GGWATANSKS | | GNAQHVEECSC | |
| GDPNNMDRA | | GDPNNMDRA | | GGWCGMIDGW | | GNCPKYIKSGQ | |
| GDPPYSHGT | | GDPPYSHGT | | GGWPGLINGW | | GNCPKYVKQGS | |
| GDPSNMDRA | | GDPSNMDRA | | GGWPGLVAGW | | GNCSIAGWLLG | |
| GDQICIGYH | | GDQICIGYH | | GGWQGLVDGW | | GNCYWVMTDGP | |
| GDQICVGYH | | GDQICVGYH | | GGWQGMIDGW | | GNDNWSGYSGS | |
| GDRICIGYH | | GDRICIGYH | | GGWQGMVDGW | | GNDVWLGRTVS | |
| GDRPKVNGQ | | GDRPKVNGQ | | GGWSGLIAGW | | GNDVWMGRTIS | |
| GDSFYAELK | | GDSFYAELK | | GGWSGLVAGW | | GNEKKAKLANV | |
| GDSIIFNSI | | GDSIIFNSI | | GGWSGMIDGW | | GNFIAPENAYK | |
| GDSITFSHN | | GDSITFSHN | | GGWTGLIDGW | | GNFIAPEYAFK | |
| GDSPRPNDG | | GDSPRPNDG | | GGWTGMIDGW | | GNFIAPEYAYI | |
| GDTPRNDDG | | GDTPRNDDG | | GGWTGMVDGW | | GNFIAPEYAYK | |
| GDTPRNDDI | | GDTPRNDDI | | GGWTGMVNGW | | GNFIAPEYAYR | |
| GDTPRNDDR | | GDTPRNDDR | | GGWTIANSKS | | GNFITPEYAYK | |
| GDTPRNDDS | | GDTPRNDDS | | GGWTTANSKS | | GNGAWIGRTKS | |
| GDTPRNEDG | | GDTPRNEDG | | GGYKDIILWF | | GNGCFDILHKC | |
| GDTPRNEDS | | GDTPRNEDS | | GGYKDVILWF | | GNGCFEFWHKC | |
| GDTPRNGDS | | GDTPRNGDS | | GGYPVIKKTY | | GNGCFEFYHKC | |
| GDTPRNNDS | | GDTPRNNDS | | GHDFEREGYS | | GNGCFEFYHRC | |
| GDTPRPNDG | | GDTPRPNDG | | GHFVNIELED | | GNGCFEIFHKC | |
| GDTPRSDDS | | GDTPRSDDS | | GHGVKGWAFD | | GNGCFEIFHQC | |
| GDTVTFTFN | | GDTVTFTFN | | GHHAIPNGTI | | GNGCFEIFHRC | |
| GDVFIIREP | | GDVFIIREP | | GHHANNSTEQ | | GNGCFELLHKC | |
| GDVFVIREP | | GDVFVIREP | | GHHAVANGTI | | GNGCFELYHKC | |
| GDVFVMREP | | GDVFVMREP | | GHHAVANGTK | | GNGCFKIYHKC | |
| GDVFVTREP | | GDVFVTREP | | GHHAVANGTR | | GNGCFTFYHKC | |
| GDVFVVREP | | GDVFVVREP | | GHHAVANGTV | | GNGCFTFYHRC | |
| GDVIVFNTI | | GDVIVFNTI | | GHHAVENGTS | | GNGCFTIYHKC | |
| GDVLDGVTA | | GDVLDGVTA | | GHHAVPNGTI | | GNGCLKIYHKC | |
| GDVVLVMKR | | GDVVLVMKR | | GHHAVPNGTK | | GNGDPNNMDKA | |

Fig. 83-109

| Block size 8 | SIN | Block size 9 | SIN | Block size 10 | SIN | Block size 11 | SIN |
|---|---|---|---|---|---|---|---|
| GDVYKILSI | | GDVYKILSI | | GHHAVPNGTL | | GNGDPNNMDRA | |
| GDYARLYIW | | GDYARLYIW | | GHHAVPNGTV | | GNGDPSNMDRA | |
| GDYNNTTGR | | GDYNNTTGR | | GHHAVSNGTI | | GNGSCRCTICI | |
| GDYTRLYIW | | GDYTRLYIW | | GHHAVSNGTK | | GNGVWIGRTKS | |
| GEALRQILR | | GEALRQILR | | GHHAVTNGTK | | GNGVWMGRTKS | |
| GEAMVSRAR | | GEAMVSRAR | | GHIEECSCYP | | GNHGSLVLSLW | |
| GEAPSPYNS | | GEAPSPYNS | | GHIFVIREPF | | GNHGVKGWAFD | |
| GECFNPITG | | GECFNPITG | | GHIWVTREPY | | GNIIFLWGIHH | |
| GECFWVMTD | | GECFWVMTD | | GHLITGKSHG | | GNILLSPEEVS | |
| GECFYSGGT | | GECFYSGGT | | GHLTTGKSHG | | GNILRTQESEC | |
| GECPEYVKK | | GECPEYVKK | | GHLVTGKSHG | | GNILRTQESSC | |
| GECPKYAKK | | GECPKYAKK | | GHNQEYTSGR | | GNIMRTQESEC | |
| GECPKYIKS | | GECPKYIKS | | GHVFVIREPF | | GNIWITREPYV | |
| GECPKYVKK | | GECPKYVKK | | GHWPDGSNIG | | GNIYKILSIYS | |
| GECPKYVKQ | | GECPKYVKQ | | GHYKISKSTK | | GNKLITVGSSK | |
| GECPKYVKS | | GECPKYVKS | | GIAADKASTQ | | GNLAFNAVIHG | |
| GECPKYVRK | | GECPKYVRK | | GIAADKESTQ | | GNLIAPEFGYL | |
| GECPKYVRS | | GECPKYVRS | | GIAADKTSTQ | | GNLIAPEYGFK | |
| GECPNYVKK | | GECPNYVKK | | GIAADKVSTQ | | GNLIAPEYGFR | |
| GECPRYVKQ | | GECPRYVKQ | | GIAADRDSTQ | | GNLIAPEYGHL | |
| GECPRYVKS | | GECPRYVKS | | GIAADRESTQ | | GNLIAPEYGYL | |
| GECYRACFY | | GECYRACFY | | GIAADRGSTQ | | GNLIAPRGHYK | |
| GECYWVMTD | | GECYWVMTD | | GIAADYKSTQ | | GNLIAPRGHYR | |
| GEDIAPIEH | | GEDIAPIEH | | GIAAEKESTQ | | GNLIAPRGYFK | |
| GEDIAPIEY | | GEDIAPIEY | | GIAIALGIIN | | GNLIAPRGYFR | |
| GEDLAPIEY | | GEDLAPIEY | | GIAIVLGIIN | | GNLIAPRGYYK | |
| GEDSDILVT | | GEDSDILVT | | GIANLGLNIG | | GNLIAPWYAFR | |
| GEDSDVLVT | | GEDSDVLVT | | GICAVATTHS | | GNLIAPWYAYK | |
| GEDTIEERF | | GEDTIEERF | | GICPVVFTDG | | GNLIAPWYAYR | |
| GEDVAPIEH | | GEDVAPIEH | | GICPVVMTDG | | GNLIFNTVIHE | |
| GEDVAPIEY | | GEDVAPIEY | | GICTVVMTDG | | GNLIFNTVIHG | |
| GEETIEEKF | | GEETIEEKF | | GICVVAVTDG | | GNLIVFNTIGN | |
| GEETIEERF | | GEETIEERF | | GICYPGSIEN | | GNLNKKMEDGF | |
| GEETVEERF | | GEETVEERF | | GICYPGSVEN | | GNLVAPEYGFK | |
| GEFNQVEKR | | GEFNQVEKR | | GIDKEPMGFR | | GNLVAPRGHYK | |
| GEFNQVENR | | GEFNQVENR | | GIDKESMGFR | | GNLVAPRGYFK | |
| GEFNQVEQR | | GEFNQVEQR | | GIDKICLGHH | | GNLVAPWYAYK | |
| GEFSQVEQR | | GEFSQVEQR | | GIDKVCTKGK | | GNLVAPWYAYR | |
| GEFSQVERR | | GEFSQVERR | | GIDTNKTFQN | | GNLVFNTVIHE | |
| GEGEQIIVT | | GEGEQIIVT | | GIEVVNATET | | GNLVFNTVIHG | |
| GEGIAADYK | | GEGIAADYK | | GIEYNGKSLG | | GNMRCTISLVK | |
| GEGIPLHDA | | GEGIPLHDA | | GIFFWMCSNG | | GNNBNGVKGFS | |
| GEGIPLYDA | | GEGIPLYDA | | GIFGAIAGFI | | GNNDNATATVY | |
| GEGQRSWMK | | GEGQRSWMK | | GIFGPVHFRN | | GNNENATATVY | |
| GEGTAADYK | | GEGTAADYK | | GIFLWMCSNG | | GNNKNATATVY | |
| GEHAKAIGN | | GEHAKAIGN | | GIGIAADRDS | | GNNNNATATVY | |
| GEKANVLIG | | GEKANVLIG | | GIGKFYIQMC | | GNNNNGVKGFA | |
| GELDNNGEL | | GELDNNGEL | | GIGNLIFNTV | | GNNNNGVKGFS | |
| GELNNNGEL | | GELNNNGEL | | GIGNLVFNTV | | GNNQVFPQLNQ | |
| GELRHLFSG | | GELRHLFSG | | GIGQAADLKS | | GNPDPGVKGFA | |
| GENMAPEKI | | GENMAPEKI | | GIGQAADYKS | | GNPGVKGWAFD | |
| GENMAPEKM | | GENMAPEKM | | GIGRFYIQMC | | GNPIICLGHHA | |
| GENMAPEKV | | GENMAPEKV | | GIGRFYVQMC | | GNPKCDIHLKD | |
| GENSDVLVT | | GENSDVLVT | | GIGRMTICIQ | | GNPKCDIHLRD | |
| GENSGVLVT | | GENSGVLVT | | GIGRMTICVQ | | GNPKCDLYLNG | |
| GEPGVKGFG | | GEPGVKGFG | | GIHHPDSETT | | GNPKCDLYLSG | |
| GEQIIVTRE | | GEQIIVTRE | | GIHHPDTEAT | | GNPKCDPYLNG | |
| GEQILIIWG | | GEQILIIWG | | GIHHPDTEAV | | GNPKCDTHLKD | |
| GEQMLIIWG | | GEQMLIIWG | | GIHHPDTEEV | | GNPKCDVHLKD | |
| GEQMLVIWG | | GEQMLVIWG | | GIHHPDTETT | | GNPMCDDLIGK | |
| GEQVLVIWG | | GEQVLVIWG | | GIHHPPDAKE | | GNPMCDELIGK | |
| GERGLFGAI | | GERGLFGAI | | GIHHPPDETE | | GNPMCDNLIGK | |

Fig. 83-110

| Block size 8 | SIN | Block size 9 | SIN | Block size 10 | SIN | Block size 11 | SIN |
|---|---|---|---|---|---|---|---|
| GERIMFESN | | GERIMFESN | | GIHHPPDTKE | | GNPMCDYLIGK | |
| GERITFESN | | GERITFESN | | GIHHPPNTKE | | GNPRCDDLIGK | |
| GERITFESS | | GERITFESS | | GIHHPSSAQE | | GNPSCASNINI | |
| GERTTFESN | | GERTTFESN | | GIHHPSSTKE | | GNPSCATNINI | |
| GESEQIIVT | | GESEQIIVT | | GIHHPSSTQE | | GNPVICLGHHA | |
| GESEQIVVT | | GESEQIVVT | | GIILGNPKCD | | GNPVICLGHHS | |
| GESEQVIVT | | GESEQVIVT | | GIINLLIGIS | | GNPVICMGHHA | |
| GESHCRIIQ | | GESHCRIIQ | | GIITDTFKSW | | GNQGVKGWAFD | |
| GESHGKIIQ | | GESHGKIIQ | | GIITDTIKSW | | GNQHTIDLADS | |
| GESHGRIIQ | | GESHGRIIQ | | GIITDTIRSW | | GNSFYAELKWL | |
| GESHGRTIQ | | GESHGRTIQ | | GIITDTLKSW | | GNSGVKGWAFD | |
| GESSDVLVT | | GESSDVLVT | | GIITETIKSW | | GNSNNGVKGFS | |
| GESYGRIIQ | | GESYGRIIQ | | GIITGPPQCD | | GNTWLGRTISP | |
| GETLKIRTN | | GETLKIRTN | | GIITGTIKSW | | GNTYVNNTTVI | |
| GETLKVESN | | GETLKVESN | | GIKGFAFLDG | | GNVIDWTRDSV | |
| GETLNIESN | | GETLNIESN | | GIKGFGFLNE | | GNVINWTKDSI | |
| GETLNVESN | | GETLNVESN | | GIKGFSFKYG | | GNVINWTQDAM | |
| GETTGRNCT | | GETTGRNCT | | GIKGFSFRYG | | GNVINWTRDAM | |
| GEVDNNGEL | | GEVDNNGEL | | GIKLKSEDNV | | GNVINWTRDSI | |
| GEVFVIREP | | GEVFVIREP | | GIKLKTEDNI | | GNVINWTRDSL | |
| GEVPGWSWD | | GEVPGWSWD | | GIKLKTEDNV | | GNVINWTRDSM | |
| GEVPSPYNS | | GEVPSPYNS | | GIKSFSRTEL | | GNVINWTRDSV | |
| GEYNNTTGR | | GEYNNTTGR | | GIKSFSRTQL | | GNVLDGVTASC | |
| GFAFKQGNS | | GFAFKQGNS | | GIKTDGATSA | | GNVLLSPEEVS | |
| GFAFKYGNG | | GFAFKYGNG | | GIKVDTLTEK | | GNVYKILSICS | |
| GFAIFSKDN | | GFAIFSKDN | | GILEDEQMYQ | | GNVYKILSIYS | |
| GFAIISKDN | | GFAIISKDN | | GILGFVFTLT | | GNWPDGANIGF | |
| GFAIVSKDN | | GFAIVSKDN | | GILGILTGPP | | GNWPDGSNIGF | |
| GFAPFAKDN | | GFAPFAKDN | | GILGTIIGPP | | GNYARLYIWGV | |
| GFAPFSKDN | | GFAPFSKDN | | GILKRGETLK | | GNYDSIRGEFN | |
| GFAPFTKDN | | GFAPFTKDN | | GILTDTSRPG | | GNYDSIRGEFS | |
| GFAVVSKDN | | GFAVVSKDN | | GILTDTSRPS | | GNYGPINVTKE | |
| GFCFTVMTD | | GFCFTVMTD | | GILTGPPQCD | | GNYKEICIAWS | |
| GFEEFTMVG | | GFEEFTMVG | | GIMNTSKPFQ | | GNYKEICVAWS | |
| GFEILLIED | | GFEILLIED | | GINDRNFWRG | | GNYKEIRIAWS | |
| GFEILLIEE | | GFEILLIEE | | GINESADMSI | | GNYKEMCAAWS | |
| GFEMIWDAN | | GFEMIWDAN | | GINKVCTKGK | | GNYREICIAWS | |
| GFEMIWDPD | | GFEMIWDPD | | GINMSKKKSY | | GPAANNADHRI | |
| GFEMIWDPN | | GFEMIWDPN | | GINTNKTFQN | | GPAANSADHRI | |
| GFEMLKIHN | | GFEMLKIHN | | GINTNRTFQN | | GPAANSADHRV | |
| GFEMLKIPN | | GFEMLKIPN | | GIPESMREEY | | GPAANSAHHRV | |
| GFEMLKVPN | | GFEMLKVPN | | GIPFHLGTKQ | | GPADNKADHRI | |
| GFEMLRIPN | | GFEMLRIPN | | GIPLHDAIKC | | GPAECRTFFLT | |
| GFEMVWDAN | | GFEMVWDAN | | GIPLYDAIKC | | GPANKQASYKI | |
| GFEMVWDPN | | GFEMVWDPN | | GIPLYDAVKC | | GPANNQASYKI | |
| GFEPNGCIE | | GFEPNGCIE | | GIPLYDAVRC | | GPANNQASYRI | |
| GFEPNGYIE | | GFEPNGYIE | | GIPPLELGDC | | GPANSQASYKI | |
| GFEVLFIED | | GFEVLFIED | | GIPPLELGNC | | GPASNQASYKI | |
| GFEVLLIED | | GFEVLLIED | | GIPPLELRDC | | GPATAQMALQL | |
| GFFGAIAGF | | GFFGAIAGF | | GIPPLVLGDC | | GPDATAVAVIK | |
| GFFGDNPRP | | GFFGDNPRP | | GIPSDTPRGE | | GPDATAVAVLK | |
| GFFPDGPQI | | GFFPDGPQI | | GIPTDTPRGE | | GPDDGAVAVLK | |
| GFFPFHKDN | | GFFPFHKDN | | GIPTDTPRIQ | | GPDNEAVAVLK | |
| GFFRRLNWL | | GFFRRLNWL | | GIPTDTPRVQ | | GPDNGAVAVLK | |
| GFFSRLNWL | | GFFSRLNWL | | GIPTDVIRSW | | GPDNGAVAVVK | |
| GFGFRQGDD | | GFGFRQGDD | | GIPTDVVRSW | | GPDPGVKGFAF | |
| GFGFRQGND | | GFGFRQGND | | GIQAGVDRFY | | GPDSGAVAVLK | |
| GFGFRQGNS | | GFGFRQGNS | | GIQAGVNRFY | | GPDSTAVAVIK | |
| GFGFRQGTD | | GFGFRQGTD | | GIQSDAQIDE | | GPDSVLVNTYQ | |
| GFGFRQGTS | | GFGFRQGTS | | GIREWSYLIE | | GPDTTAVAVLK | |
| GFHFEECSC | | GFHFEECSC | | GIRIGSKGDV | | GPESVLINTYQ | |
| GFHHSNAEG | | GFHHSNAEG | | GIRIGSKGHV | | GPESVLVNTYQ | |

Fig. 83-111

| Block size 8 | SIN | Block size 9 | SIN | Block size 10 | SIN | Block size 11 | SIN |
|---|---|---|---|---|---|---|---|
| GFHHSNEQG | | GFHHSNEQG | | GIRIGSRGEV | | GPGSFPDGAQI | |
| GFHHSNSEG | | GFHHSNSEG | | GIRIGSRGHI | | GPGWLTIGITG | |
| GFIDIWTYN | | GFIDIWTYN | | GIRIGSRGHV | | GPGWLTLGITG | |
| GFIDVWTYN | | GFIDVWTYN | | GIRPGYNGQK | | GPILSFIMWAG | |
| GFIEGGWCG | | GFIEGGWCG | | GIRSFSRTEL | | GPINNGKGRYG | |
| GFIEGGWPG | | GFIEGGWPG | | GIRTDGATSA | | GPINVTKENTG | |
| GFIEGGWQG | | GFIEGGWQG | | GIRVGSRGHV | | GPLKAEIAQKL | |
| GFIEGGWSG | | GFIEGGWSG | | GISFWMCSNG | | GPLKAEIAQRL | |
| GFIEGGWTG | | GFIEGGWTG | | GISGADDDAY | | GPLLQITSLCS | |
| GFIEGRWPG | | GFIEGRWPG | | GISGPDDGAV | | GPLSGSAQHIE | |
| GFIENGWEG | | GFIENGWEG | | GISGPDNEAV | | GPNDNASAVVW | |
| GFIENGWQG | | GFIENGWQG | | GISGPDNGAV | | GPNLYNIRNLH | |
| GFIFGCQNG | | GFIFGCQNG | | GISGPDSGAV | | GPNNNASAIIW | |
| GFIIKGRSH | | GFIIKGRSH | | GISIWMCSNG | | GPNNNASAIVW | |
| GFIMWACQK | | GFIMWACQK | | GISLWMCSNG | | GPNNNASAVIW | |
| GFIMWACQR | | GFIMWACQR | | GISNVGLNIS | | GPNNNASAVVW | |
| GFIMWTCQK | | GFIMWTCQK | | GISNVGLNVS | | GPPHCDQFLEF | |
| GFIVKGRSH | | GFIVKGRSH | | GISPIHLGDC | | GPPQCDKFLEF | |
| GFIVWACQR | | GFIVWACQR | | GISPVHLGDC | | GPPQCDLFLEF | |
| GFIYSGIRT | | GFIYSGIRT | | GISSMGEAMV | | GPPQCDLHLEF | |
| GFKHQNAQG | | GFKHQNAQG | | GISSMMEAMV | | GPPQCDQFLEF | |
| GFKISKRGG | | GFKISKRGG | | GISSMVEAMI | | GPPQCDRFLEF | |
| GFKISKRGN | | GFKISKRGN | | GISSMVEAMM | | GPPQCDSHLKF | |
| GFKISKRGS | | GFKISKRGS | | GISSMVEAMV | | GPRALVRGQQG | |
| GFKPNGCIE | | GFKPNGCIE | | GITGPDATAV | | GPRPFVRGQQG | |
| GFLAPRYGY | | GFLAPRYGY | | GITGPDSTAV | | GPRPLIRGQQG | |
| GFLDIWTYN | | GFLDIWTYN | | GITGPDTTAV | | GPRPLVMGQQG | |
| GFLDVWTYN | | GFLDVWTYN | | GITNKINSII | | GPRPLVREQQG | |
| GFLGVWTYN | | GFLGVWTYN | | GITNKVNSII | | GPRPLVRGQQG | |
| GFLIIGKED | | GFLIIGKED | | GITNRVNSII | | GPSDAQAFYKI | |
| GFLILGKED | | GFLILGKED | | GITVIKNNMI | | GPSDGQAFYKI | |
| GFLILGKEN | | GFLILGKEN | | GIVADRDSTQ | | GPSECRTFFLT | |
| GFLILGRED | | GFLILGRED | | GIVNTTLSTI | | GPSFYAEMKWL | |
| GFLNVWTYN | | GFLNVWTYN | | GIWIGRTKST | | GPSHSIHTGNQ | |
| GFMDVWTYN | | GFMDVWTYN | | GIYKILTIYS | | GPSNAQAFYKI | |
| GFQHQNAEG | | GFQHQNAEG | | GIYQILAIYA | | GPTECRTFFLT | |
| GFQHQNEQG | | GFQHQNEQG | | GIYQILAIYS | | GPVHFQNQVKI | |
| GFQHQNSEG | | GFQHQNSEG | | GIYQILSIYS | | GPVHFRNQIKI | |
| GFQHRDEEG | | GFQHRDEEG | | GKADTRILFI | | GPVHFRNQVKI | |
| GFQHRNEEG | | GFQHRNEEG | | GKADTRILFV | | GPVHFRSQVKI | |
| GFQHSNAQG | | GFQHSNAQG | | GKAPISLGDC | | GPVKLSSGYKD | |
| GFQHSNDQG | | GFQHSNDQG | | GKAPISLGGC | | GQAADLKSTQA | |
| GFQHSNEQG | | GFQHSNEQG | | GKAWLHICVT | | GQAADLKSTQT | |
| GFQHTNDQG | | GFQHTNDQG | | GKAWLHVCIT | | GQAADYESTQA | |
| GFRDVWTYN | | GFRDVWTYN | | GKAWLHVCVT | | GQAADYKSTQA | |
| GFRHHNSEG | | GFRHHNSEG | | GKCNDPYPGN | | GQAADYKSTQK | |
| GFRHLNSEG | | GFRHLNSEG | | GKCNEPYPGN | | GQAADYKSTQT | |
| GFRHQNAEG | | GFRHQNAEG | | GKCNTKCQTS | | GQAFYKILKIK | |
| GFRHQNAQG | | GFRHQNAQG | | GKCPKYIPSG | | GQAFYRSINWL | |
| GFRHQNSEG | | GFRHQNSEG | | GKCPKYIPSN | | GQAGRIDFHWM | |
| GFRHQNSQG | | GFRHQNSQG | | GKCPKYIPSR | | GQAGRMTFYWA | |
| GFRHQNTQG | | GFRHQNTQG | | GKCPKYISSG | | GQAGRMTFYWI | |
| GFRISKRGS | | GFRISKRGS | | GKCPKYVKST | | GQAGRMTFYWK | |
| GFRQGDDVW | | GFRQGDDVW | | GKCPRYIPSG | | GQAGRMTFYWT | |
| GFRQGNDVW | | GFRQGNDVW | | GKCPRYVKQS | | GQDCDLINGAL | |
| GFRQGNSVW | | GFRQGNSVW | | GKCSKYVKST | | GQFGRIDFHWL | |
| GFRQGSDVW | | GFRQGSDVW | | GKCYQFALGQ | | GQFGRINFHWL | |
| GFRQGTDVW | | GFRQGTDVW | | GKDNAIRIGE | | GQFPVQTDEYK | |
| GFRQGTSVW | | GFRQGTSVW | | GKDNAVRIGE | | GQGDIVLVMKR | |
| GFRYQNSEG | | GFRYQNSEG | | GKDPKKTGGP | | GQGDVVLVMKR | |
| GFRYSGIKT | | GFRYSGIKT | | GKEDKRYGPA | | GQGSGYAADQK | |
| GFRYSGIRT | | GFRYSGIRT | | GKEDRRYGPA | | GQGTAADYKST | |

Fig. 83-112

| Block size 8 | SIN | Block size 9 | SIN | Block size 10 | SIN | Block size 11 | SIN |
|---|---|---|---|---|---|---|---|
| GFSAESRKL | | GFSAESRKL | | GKENKKYGPA | | GQGTTLDNEHS | |
| GFSAESRKM | | GFSAESRKM | | GKENKRYGPA | | GQGTTLDNKHS | |
| GFSFKYGDG | | GFSFKYGDG | | GKEPISLGDC | | GQGTTLENKHS | |
| GFSFKYGNG | | GFSFKYGNG | | GKEWLHVCIT | | GQGTTLNNKHS | |
| GFSFRYGDG | | GFSFRYGDG | | GKEWMHICMT | | GQGTTLYNKHS | |
| GFSFRYGNG | | GFSFRYGNG | | GKEWMHVCIT | | GQHANGTIHDR | |
| GFSYKYDNG | | GFSYKYDNG | | GKEWMHVCMA | | GQLKLATGLKN | |
| GFSYKYGNG | | GFSYKYGNG | | GKEWMHVCMT | | GQLKLATGLRN | |
| GFSYRYGNG | | GFSYRYGNG | | GKFEFIAEDF | | GQNHGICAVAT | |
| GFTFKRTKG | | GFTFKRTKG | | GKFEFIAEEF | | GQPKEKAIWTS | |
| GFTFKRTNG | | GFTFKRTNG | | GKFEFIVEKF | | GQPKEKTIWTS | |
| GFTFKRTSG | | GFTFKRTSG | | GKFQTAAQKA | | GQPNERTIWTS | |
| GFTYNGIRT | | GFTYNGIRT | | GKFQTAAQRA | | GQQGRMDYYWA | |
| GFTYSEIRT | | GFTYSEIRT | | GKFTNEEALR | | GQQGRMDYYWG | |
| GFTYSGIMT | | GFTYSGIMT | | GKFYIQMCTE | | GQQGTMDYYWG | |
| GFTYSGIRT | | GFTYSGIRT | | GKGCFDILHK | | GQQGWMDYYWG | |
| GFTYSGMRT | | GFTYSGMRT | | GKGCFDLYHK | | GQRSWMKIYWH | |
| GFTYSGVRT | | GFTYSGVRT | | GKGCFEIYHA | | GQRSWMKLYWH | |
| GFTYTGVRT | | GFTYTGVRT | | GKGCFEIYHK | | GQSFYRSINWL | |
| GFVANFSME | | GFVANFSME | | GKGCFEIYHN | | GQSGRIDFHWA | |
| GFVENLEEL | | GFVENLEEL | | GKGCFEIYHT | | GQSGRIDFHWL | |
| GFVFTLTVP | | GFVFTLTVP | | GKGCFELYHE | | GQSGRIDFHWM | |
| GFVHFVEAL | | GFVHFVEAL | | GKGCFELYHK | | GQSGRIDFHWT | |
| GFVIVSKDN | | GFVIVSKDN | | GKGCFELYHR | | GQSGRIDFYWL | |
| GFVLWACQN | | GFVLWACQN | | GKGRIFQSHI | | GQSGRINFHWL | |
| GFVPFSKDN | | GFVPFSKDN | | GKGRIFQSPI | | GQSGRINFHWT | |
| GFVRQCFNP | | GFVRQCFNP | | GKGRIFQSRI | | GQSGRISFYWT | |
| GFVRTLFQQ | | GFVRTLFQQ | | GKGRYGVKGF | | GQSGRVSFYWT | |
| GFVYFVEAL | | GFVYFVEAL | | GKHIVERILE | | GQSPNVYQAKF | |
| GFVYFVEIL | | GFVYFVEIL | | GKHSNGTIHD | | GQSPNVYQARF | |
| GFVYFVETL | | GFVYFVETL | | GKIAHISPLS | | GQSPNVYQSRF | |
| GFWMCSNGS | | GFWMCSNGS | | GKIIHISPLS | | GQTGRIDFHWL | |
| GFYRNLVWF | | GFYRNLVWF | | GKIIQNEDIP | | GQTIVLDTDWS | |
| GGAIWVTRE | | GGAIWVTRE | | GKILRTQESE | | GQTIVLNTDWS | |
| GGAQHVEEC | | GGAQHVEEC | | GKISHISPLS | | GQTIVLTTDWS | |
| GGCFQPCFY | | GGCFQPCFY | | GKITNKVNNI | | GQTVKIKTNGN | |
| GGCPKYVKS | | GGCPKYVKS | | GKIVHISPLS | | GQTVKIQTNGN | |
| GGDIWATRE | | GGDIWATRE | | GKKAVDLGSC | | GQTVKIQTSGN | |
| GGDIWITRE | | GGDIWITRE | | GKKEEFSEIM | | GQTVVLNTDWS | |
| GGDIWVMRE | | GGDIWVMRE | | GKKEFSEIMK | | GQVECVCRDNW | |
| GGDIWVTRE | | GGDIWVTRE | | GKKGKWLNQS | | GQWDWPDGAKI | |
| GGDSFYAEL | | GGDSFYAEL | | GKLCKLNGIP | | GQWNWPDGAEI | |
| GGFIFGCQN | | GGFIFGCQN | | GKLCRLRGIP | | GQWNWPDGAKI | |
| GGFLAPRYG | | GGFLAPRYG | | GKLCRLSGIP | | GRAWLHVCVTG | |
| GGFTFKRTK | | GGFTFKRTK | | GKLEFIAEEF | | GRCPRYVKQSS | |
| GGFTFKRTN | | GGFTFKRTN | | GKLKRRAIAT | | GRDVLVIWGIH | |
| GGFTFKRTS | | GGFTFKRTS | | GKLNRFIEKT | | GRDVLVLWGIH | |
| GGGCFKIYH | | GGGCFKIYH | | GKLNRIIEKT | | GRDVLVMWGIH | |
| GGGDIWVTR | | GGGDIWVTR | | GKLNRLIDKT | | GRDVLVMWGLH | |
| GGGPDPGVK | | GGGPDPGVK | | GKLNRLIDRT | | GREWSYIVERP | |
| GGGYAADKE | | GGGYAADKE | | GKLNRLIEKT | | GREWSYIVERT | |
| GGHGVKGWA | | GGHGVKGWA | | GKLNRLIERT | | GRFTNEEALRQ | |
| GGHIEECSC | | GGHIEECSC | | GKLNRLIGKT | | GRFYIQMCTEL | |
| GGHIWVTRE | | GGHIWVTRE | | GKLNRLISKT | | GRFYVQMCTEL | |
| GGIDKEPMG | | GGIDKEPMG | | GKMRDSIKSW | | GRGCFEIYHKC | |
| GGIDKESMG | | GGIDKESMG | | GKMTDSIKSW | | GRGIEVVNATE | |
| GGIDNKTF | | GGIDNKTF | | GKNADLEALM | | GRGLFGAIAGF | |
| GGIGKFYIQ | | GGIGKFYIQ | | GKNSDLEALM | | GRGLFGAKAGF | |
| GGIGRFYIQ | | GGIGRFYIQ | | GKNSFYAELK | | GRGQAADLKST | |
| GGIGRFYVQ | | GGIGRFYVQ | | GKNSWSYIVE | | GRGRIFQSRIR | |
| GGINTNKTF | | GGINTNKTF | | GKNTDLEALM | | GRGSTLGLDIR | |
| GGINTNRTF | | GGINTNRTF | | GKNTDLEVLM | | GRGVFEFSDER | |

Fig. 83-113

| Block size 8 | SIN | Block size 9 | SIN | Block size 10 | SIN | Block size 11 | SIN |
|---|---|---|---|---|---|---|---|
| GGIPTDVIR | | GGIPTDVIR | | GKQAKGLFGA | | GRGVFELSDEK | |
| GGIPTDVVR | | GGIPTDVVR | | GKQPISLGDC | | GRGVFELSDER | |
| GGLGVKGFG | | GGLGVKGFG | | GKRGKWVKSV | | GRHANGTIHDR | |
| GGLIAPDRV | | GGLIAPDRV | | GKSGACKRAD | | GRHANGTINDR | |
| GGLIAPNRV | | GGLIAPNRV | | GKSGACKRAN | | GRHANGTMHDR | |
| GGLIAPRYG | | GGLIAPRYG | | GKSHGRILKN | | GRHSNGTIHDR | |
| GGLIAPSRV | | GGLIAPSRV | | GKSHGRVLKN | | GRIDFHWLILN | |
| GGLILGMQN | | GGLILGMQN | | GKSLGIQSDA | | GRIDFHWLILS | |
| GGLLAPKYG | | GGLLAPKYG | | GKSSACKRAN | | GRIDFHWLLLD | |
| GGLLAPRYG | | GGLLAPRYG | | GKTKATKMEA | | GRIDFHWLMLN | |
| GGLVAPSRV | | GGLVAPSRV | | GKTKATKMKA | | GRIDFHWLVLN | |
| GGMPTDVVR | | GGMPTDVVR | | GKTNEKFHQI | | GRIDFHWMLLD | |
| GGNEKKAKL | | GGNEKKAKL | | GKTNQQFELI | | GRIFQSGIRMA | |
| GGNIWITRE | | GGNIWITRE | | GKTSWSYIVE | | GRIFQSGVRLA | |
| GGNPDPGVK | | GGNPDPGVK | | GKVCRALLAK | | GRIFQSGVRMA | |
| GGNSFYAEL | | GGNSFYAEL | | GKVCRTLLAK | | GRIFQSGVRVA | |
| GGPDPGVKG | | GGPDPGVKG | | GKVECICRDN | | GRIFQSRIRMG | |
| GGPGVKGFG | | GGPGVKGFG | | GKVECVCRDN | | GRIIQNEDIPI | |
| GGPNLYNIR | | GGPNLYNIR | | GKVVHISPLS | | GRIQDLEKYIE | |
| GGQAFYRSI | | GGQAFYRSI | | GKWDTLIERE | | GRIQDLEKYVE | |
| GGQSFYRSI | | GGQSFYRSI | | GKWREQLSQK | | GRIQDLERYVE | |
| GGRIAPSRV | | GGRIAPSRV | | GLANLGLNIG | | GRISFYWTIVD | |
| GGRNSFFSR | | GGRNSFFSR | | GLANLGLNVG | | GRISFYWTIVE | |
| GGSGIMKTE | | GGSGIMKTE | | GLCTINSWHI | | GRISIYWTLVN | |
| GGSGTDNYG | | GGSGTDNYG | | GLCYPGELDN | | GRISVYWTIVE | |
| GGSGTNNYG | | GGSGTNNYG | | GLCYPGELNN | | GRLCNPLNPFV | |
| GGSIITELP | | GGSIITELP | | GLDIRTATRE | | GRLCNPMNPFV | |
| GGSIKTKLP | | GGSIKTKLP | | GLDKICLGHH | | GRLIDFLKDVI | |
| GGSINTKLP | | GGSINTKLP | | GLDNEPGSGK | | GRLIDFLKDVM | |
| GGSINTRLP | | GGSINTRLP | | GLDNEPGSGN | | GRLIDFLKDVT | |
| GGSPDPGVK | | GGSPDPGVK | | GLDRICLGHH | | GRLIDFLKDVV | |
| GGTGSVYIE | | GGTGSVYIE | | GLFFFCLKNG | | GRLIQNSITIE | |
| GGTIASSLP | | GGTIASSLP | | GLFFWMCSNG | | GRLIQNSITVE | |
| GGTIISNLP | | GGTIISNLP | | GLFGAIAGFI | | GRLIQNSLTIE | |
| GGTIISSLP | | GGTIISSLP | | GLFGAKAGFI | | GRLIQNSMTIE | |
| GGTINSPLP | | GGTINSPLP | | GLFLWMCSNG | | GRLMDFLKDVM | |
| GGTITSNLP | | GGTITSNLP | | GLGVKGFGFK | | GRLTTTIKTWA | |
| GGTITSPLP | | GGTITSPLP | | GLHDANVRNL | | GRLVQNSITIE | |
| GGTIVSSLP | | GGTIVSSLP | | GLIAGWYGFQ | | GRLVRFRHQNS | |
| GGTPDPGVK | | GGTPDPGVK | | GLIAPDRVSK | | GRMADSIKSWR | |
| GGTSSIYIE | | GGTSSIYIE | | GLIAPRYGYI | | GRMDYYWAILK | |
| GGTSSVYIE | | GGTSSVYIE | | GLIAPSRVSK | | GRMDYYWAVLK | |
| GGTSSVYVE | | GGTSSVYVE | | GLIAPSRVTK | | GRMDYYWGILK | |
| GGVESAVLR | | GGVESAVLR | | GLICATCEQI | | GRMSDSIKSWR | |
| GGVNTNKTF | | GGVNTNKTF | | GLIDGWYGFK | | GRMTDSIKSWR | |
| GGVPTDVIR | | GGVPTDVIR | | GLIDGWYGFR | | GRMTICIQGNN | |
| GGVPTDVVR | | GGVPTDVVR | | GLIDGWYGYH | | GRMTICVQGKN | |
| GGWATANSK | | GGWATANSK | | GLIDGWYGYK | | GRMTICVQGNN | |
| GGWCGMIDG | | GGWCGMIDG | | GLIDGWYGYR | | GRNCTIPCFWV | |
| GGWPGLING | | GGWPGLING | | GLIFMCVKNG | | GRNCTVPCFWV | |
| GGWPGLVAG | | GGWPGLVAG | | GLILAFILWA | | GRNPGNAEIED | |
| GGWQGLVDG | | GGWQGLVDG | | GLILAFIMWA | | GRNSFFSRLNW | |
| GGWQGMIDG | | GGWQGMIDG | | GLILAFIMWT | | GRPEEAKYVEW | |
| GGWQGMVDG | | GGWQGMVDG | | GLILGMQNGS | | GRPEEAKYVWW | |
| GGWSGLIAG | | GGWSGLIAG | | GLILGNPKCD | | GRPEEVKYVWW | |
| GGWSGLVAG | | GGWSGLVAG | | GLILSFIMWA | | GRPKEDEVWWT | |
| GGWSGMIDG | | GGWSGMIDG | | GLILSNPKCD | | GRPKEDKVWWT | |
| GGWTGLIDG | | GGWTGLIDG | | GLILTFIMWA | | GRPKEDRVWWT | |
| GGWTGMIDG | | GGWTGMIDG | | GLINGWYGFQ | | GRPKEEKVWWT | |
| GGWTGMVDG | | GGWTGMVDG | | GLINGWYGFR | | GRQEKNPALRM | |
| GGWTGMVNG | | GGWTGMVNG | | GLISTPLGSP | | GRQEKNPSLRM | |
| GGWTIANSK | | GGWTIANSK | | GLISTPLGTP | | GRQTFDWTLNR | |

Fig. 83-114

| Block size 8 | SIN | Block size 9 | SIN | Block size 10 | SIN | Block size 11 | SIN |
|---|---|---|---|---|---|---|---|
| GGWTTANSK | | GGWTTANSK | | GLITDTIKSW | | GRQTYDWTLNR | |
| GGYAADKES | | GGYAADKES | | GLIYGNPFCD | | GRRKTNLYGFI | |
| GGYDFEREG | | GGYDFEREG | | GLIYGNPSCD | | GRRRTNLYGFI | |
| GGYKDIILW | | GGYKDIILW | | GLIYGNPSCN | | GRSHLRNDTDV | |
| GGYKDVILW | | GGYKDVILW | | GLIYNRMGAV | | GRTFSPRSRSG | |
| GGYPVIKKT | | GGYPVIKKT | | GLIYNRMGTI | | GRTINTASRSG | |
| GHDFEREGY | | GHDFEREGY | | GLIYNRMGTV | | GRTIQNEDIPI | |
| GHDKNATAS | | GHDKNATAS | | GLKISSSFSF | | GRTISIASRSG | |
| GHGVKGWAF | | GHGVKGWAF | | GLLAPKYGYI | | GRTISKDLRSG | |
| GHHANNSTE | | GHHANNSTE | | GLLAPRYGYI | | GRTISKDSRSG | |
| GHHAVANGT | | GHHAVANGT | | GLLDVWTYNA | | GRTISKDTRSG | |
| GHHAVENGT | | GHHAVENGT | | GLLEVGTRWM | | GRTISMDSRSG | |
| GHHAVPNGT | | GHHAVPNGT | | GLLGAIAGFI | | GRTISPKLRSG | |
| GHHAVQNGT | | GHHAVQNGT | | GLLGIITGPP | | GRTISPRLRSG | |
| GHHAVSNGT | | GHHAVSNGT | | GLLGILIGPP | | GRTISPRSRNG | |
| GHHAVTNGT | | GHHAVTNGT | | GLLGTITGPP | | GRTISPRSRSG | |
| GHHSVPNGT | | GHHSVPNGT | | GLLGTLIGPP | | GRTISRDSRSG | |
| GHIEECSCY | | GHIEECSCY | | GLLGTLTGPP | | GRTISTASRAG | |
| GHIFVIREP | | GHIFVIREP | | GLLGTVTGPP | | GRTISTASRSG | |
| GHIWVTREP | | GHIWVTREP | | GLLISDGGPN | | GRTKSLESRRG | |
| GHLITGKSH | | GHLITGKSH | | GLLLQIISLC | | GRTKSLESRSG | |
| GHLTTGKSH | | GHLTTGKSH | | GLLLQITSLC | | GRTLDLHDANV | |
| GHLVTGKSH | | GHLVTGKSH | | GLLLWMCSNG | | GRTLDMHDANV | |
| GHNGMLCAT | | GHNGMLCAT | | GLLVADGGPN | | GRTLGLHDANV | |
| GHNITFSHN | | GHNITFSHN | | GLLVALENQH | | GRTLNTASRSG | |
| GHNQEYTSG | | GHNQEYTSG | | GLLVSDGGPN | | GRTSDMRAEII | |
| GHPGVKGWA | | GHPGVKGWA | | GLMSTPLGSP | | GRTSDMRTEII | |
| GHQSTNSTD | | GHQSTNSTD | | GLNIGLHLKP | | GRTSDMRTEVI | |
| GHQSTNSTE | | GHQSTNSTE | | GLNIGLHLRP | | GRTSISCLYKL | |
| GHVFVIREP | | GHVFVIREP | | GLNNEPGSGN | | GRTTSKDSRSG | |
| GHWPDGSNI | | GHWPDGSNI | | GLNVGLHLKP | | GRVSFYWTIVE | |
| GHYKISKST | | GHYKISKST | | GLPQSGRIVV | | GRVTVSTRSDQ | |
| GIAADKAST | | GIAADKAST | | GLPSDTPRGE | | GRWPGLVAGWY | |
| GIAADKEST | | GIAADKEST | | GLPVGGNEKK | | GRYGVKGFSFR | |
| GIAADKTST | | GIAADKTST | | GLQRRRFIQN | | GRYSIADKICI | |
| GIAADKVST | | GIAADKVST | | GLQRRRFVQN | | GRYSKADKICI | |
| GIAADRDST | | GIAADRDST | | GLQSSDDFAL | | GRYSRADKICI | |
| GIAADREST | | GIAADREST | | GLREQKQEFK | | GSAEHIEECSC | |
| GIAADRGST | | GIAADRGST | | GLRILIRGNS | | GSAKHIEECSC | |
| GIAADYKST | | GIAADYKST | | GLRILVRGNS | | GSAKHVEECSC | |
| GIAAEKEST | | GIAAEKEST | | GLRISSSFSF | | GSAQHIEECSC | |
| GIAIALGII | | GIAIALGII | | GLRNIPSIQS | | GSAQHVEECSC | |
| GIAIVLGII | | GIAIVLGII | | GLRNIPSVQS | | GSARHIEECPC | |
| GIANLGLNI | | GIANLGLNI | | GLRNTPSIDP | | GSARHIEECSC | |
| GICAVATTH | | GICAVATTH | | GLRNTPSIEP | | GSARHIEEWSC | |
| GICPVVFTD | | GICPVVFTD | | GLRNTPSVEP | | GSARHVEECSC | |
| GICPVVMTD | | GICPVVMTD | | GLRNVPSIQS | | GSASGKADTRI | |
| GICTVVMTD | | GICTVVMTD | | GLSFWMCSNG | | GSASGRADTKI | |
| GICVVAVTD | | GICVVAVTD | | GLSLWMCFNG | | GSASGRADTRI | |
| GICYPGILE | | GICYPGILE | | GLSLWMCSNG | | GSATGPADTRI | |
| GICYPGSIE | | GICYPGSIE | | GLSMVKSDKI | | GSATGPADTRV | |
| GICYPGSLD | | GICYPGSLD | | GLSMVRSDKI | | GSATGPAETRI | |
| GICYPGSVE | | GICYPGSVE | | GLSPNVYQAR | | GSATGPAETRV | |
| GICYPGTLE | | GICYPGTLE | | GLSSRISFYW | | GSCAVVMTDGS | |
| GICYPGTLG | | GICYPGTLG | | GLTHIMIWHS | | GSCFTIMTDGP | |
| GIDKEPMGF | | GIDKEPMGF | | GLTHLMIWHS | | GSCFTLMTDGP | |
| GIDKESMGF | | GIDKESMGF | | GLTHMMIWHS | | GSCFTVLTDGP | |
| GIDKICLGH | | GIDKICLGH | | GLVAGWYGFQ | | GSCFTVMTDGP | |
| GIDKVCTKG | | GIDKVCTKG | | GLVCATCEQI | | GSCGILGTIIG | |
| GIDPFKLLQ | | GIDPFKLLQ | | GLVDGWYGFR | | GSCTSPCLTDK | |
| GIDPFRLLQ | | GIDPFRLLQ | | GLVDGWYGYH | | GSCTVVMTDGN | |
| GIDTNKTFQ | | GIDTNKTFQ | | GLVFFCLKNG | | GSCTVVMTDGS | |

Fig. 83-115

| Block size 8 | SIN | Block size 9 | SIN | Block size 10 | SIN | Block size 11 | SIN |
|---|---|---|---|---|---|---|---|
| GIEVVNATE | | GIEVVNATE | | GLVFFCLRNG | | GSDVWLGRTVS | |
| GIEYNGKSL | | GIEYNGKSL | | GLVFICIKNG | | GSEHTAYSQIT | |
| GIFENSCIE | | GIFENSCIE | | GLVFICMKNG | | GSFIQHPELTG | |
| GIFENSCLE | | GIFENSCLE | | GLVFICVKNG | | GSFNGAFIAPD | |
| GIFESSCLE | | GIFESSCLE | | GLVFMCVKNG | | GSFPDGAKIQY | |
| GIFFWMCSN | | GIFFWMCSN | | GLVGDTPRND | | GSFPDGAQIKY | |
| GIFGAIAGF | | GIFGAIAGF | | GLVGDTPRNE | | GSFPDGAQIQY | |
| GIFGDNPRP | | GIFGDNPRP | | GLVGDTPRNG | | GSFPDGARIQY | |
| GIFGDSPRP | | GIFGDSPRP | | GLVGDTPRNN | | GSFPNGAQIQY | |
| GIFGNSCLE | | GIFGNSCLE | | GLVGDTPRSD | | GSFSIRGETTG | |
| GIFGPVHFR | | GIFGPVHFR | | GLVLGNPKCD | | GSFSIRWETTG | |
| GIFLWMCSN | | GIFLWMCSN | | GLVNLGLNIG | | GSFVQHPELTG | |
| GIGIAADRD | | GIGIAADRD | | GLVYGNPACD | | GSFVQHPEMTG | |
| GIGKFYIQM | | GIGKFYIQM | | GLVYGNPSCD | | GSFYRNMRWLT | |
| GIGNLAFNA | | GIGNLAFNA | | GLWAYNAELL | | GSFYRSIRWLT | |
| GIGNLVFNT | | GIGNLVFNT | | GLWDPFRQSE | | GSFYRSMRWLT | |
| GIGQAADLK | | GIGQAADLK | | GLWDSFRQSE | | GSGFFPDGPQI | |
| GIGQAADYK | | GIGQAADYK | | GLYDAIEECL | | GSGHWPDGSNI | |
| GIGRFYIQM | | GIGRFYIQM | | GLYEAIEECL | | GSGNWPDGANI | |
| GIGRFYVQM | | GIGRFYVQM | | GLYESIEECL | | GSGNWPDGSNI | |
| GIGRMTICI | | GIGRMTICI | | GLYGAIEECL | | GSGRIFQSGVR | |
| GIGRMTICV | | GIGRMTICV | | GMAADKESTQ | | GSGSFPDGAKI | |
| GIHHPDSET | | GIHHPDSET | | GMAADQKSTQ | | GSGSFPDGAQI | |
| GIHHPDTEA | | GIHHPDTEA | | GMAADRDSTQ | | GSGSFPDGARI | |
| GIHHPDTEE | | GIHHPDTEE | | GMALSVVSLL | | GSGSFPNGAQI | |
| GIHHPDTET | | GIHHPDTET | | GMCYPGFVEN | | GSGTDNYGVKG | |
| GIHHPPDAK | | GIHHPPDAK | | GMCYPGSIEN | | GSGTNNYGVKG | |
| GIHHPPDET | | GIHHPPDET | | GMCYPGSVEN | | GSGWLTLGITG | |
| GIHHPPDTK | | GIHHPPDTK | | GMDPRMCSLM | | GSGYAADKAST | |
| GIHHPPNTK | | GIHHPPNTK | | GMELRRCLLQ | | GSGYAADKESS | |
| GIHHPSSAQ | | GIHHPSSAQ | | GMEMRRCLLQ | | GSGYAADKEST | |
| GIHHPSSTK | | GIHHPSSTK | | GMFNMLSTVL | | GSGYAADKKST | |
| GIHHPSSTQ | | GIHHPSSTQ | | GMGMAADKES | | GSGYAADLKST | |
| GIILGNPKC | | GIILGNPKC | | GMGQAADLKS | | GSGYAADQEST | |
| GIINLLIGI | | GIINLLIGI | | GMGQAPSPYN | | GSGYAADQKST | |
| GIITDTFKS | | GIITDTFKS | | GMIDGWYGFH | | GSGYAADREST | |
| GIITDTIKS | | GIITDTIKS | | GMIDGWYGFR | | GSGYAADRKST | |
| GIITDTIRS | | GIITDTIRS | | GMIDGWYGYH | | GSHGVKGWAFD | |
| GIITDTLKS | | GIITDTLKS | | GMILSVVSLL | | GSIAHKSCLPA | |
| GIITETIKS | | GIITETIKS | | GMITDTIKSW | | GSIENLEELRF | |
| GIITGPPQC | | GIITGPPQC | | GMKNVPEIPK | | GSIENQEELKS | |
| GIITGTIKS | | GIITGTIKS | | GMKNVPEIPR | | GSIENQEELRF | |
| GIKGFAFLD | | GIKGFAFLD | | GMKNVPEKIH | | GSIENQEELRS | |
| GIKGFGFLN | | GIKGFGFLN | | GMKNVPEKIR | | GSIGKVCRALL | |
| GIKGFSFKY | | GIKGFSFKY | | GMKNVPETPK | | GSIGKVCRTLL | |
| GIKGFSFRY | | GIKGFSFRY | | GMLGFVFTLT | | GSIITELPFQN | |
| GIKLKSEDN | | GIKLKSEDN | | GMMDGWYGFR | | GSIKNQEELRS | |
| GIKLKTEDN | | GIKLKTEDN | | GMMMGMFNML | | GSIKTKLPFQN | |
| GIKSFSRTE | | GIKSFSRTE | | GMPESMREEY | | GSINTKLPFQN | |
| GIKSFSRTQ | | GIKSFSRTQ | | GMPTDVVRSW | | GSINTRLPFQN | |
| GIKTDGATS | | GIKTDGATS | | GMQIRGFVHF | | GSIPNDKPFQN | |
| GIKVDTLTE | | GIKVDTLTE | | GMQIRGFVYF | | GSIPNEKPFQN | |
| GILEDEQMY | | GILEDEQMY | | GMQNGSCRCM | | GSIPNGKPFQN | |
| GILGFVFTL | | GILGFVFTL | | GMQNGSYRCM | | GSIPNNKPFQN | |
| GILGILTGP | | GILGILTGP | | GMRILIRGNS | | GSIQSDKPFQN | |
| GILGTIIGP | | GILGTIIGP | | GMRILVRGNS | | GSISNDKPFQN | |
| GILHLILWI | | GILHLILWI | | GMRNIPEKPK | | GSKEQLGSWSW | |
| GILHLVLWI | | GILHLVLWI | | GMRNIPEKQT | | GSKERLGSWSW | |
| GILKRGETL | | GILKRGETL | | GMRNIPENPK | | GSKGDIFVIRE | |
| GILTDTSRP | | GILTDTSRP | | GMRNIPERQT | | GSKGDIFVMRE | |
| GILTGPPQC | | GILTGPPQC | | GMRNIPGKQA | | GSKGDVFVIRE | |
| GIMKTEGTL | | GIMKTEGTL | | GMRNVPEKPK | | GSKGDVFVMRE | |

Fig. 83-116

| Block size 8 | SIN | Block size 9 | SIN | Block size 10 | SIN | Block size 11 | SIN |
|---|---|---|---|---|---|---|---|
| GIMKTEKTL | | GIMKTEKTL | | GMRNVPEKQT | | GSKGHVFVIRE | |
| GIMKTERTL | | GIMKTERTL | | GMRNVPENPK | | GSKKRLGSWSW | |
| GIMKTGGTL | | GIMKTGGTL | | GMRNVPERQT | | GSLEFIAEQFT | |
| GIMNTSKPF | | GIMNTSKPF | | GMRNVPETQT | | GSLKLAIGLRN | |
| GINDRNFWR | | GINDRNFWR | | GMRVLIRGNS | | GSLKLAIGPRN | |
| GINESADMS | | GINESADMS | | GMSANGDILM | | GSLKLATGMRN | |
| GINKVCTKG | | GINKVCTKG | | GMTLSVVSLI | | GSLLLATGMRN | |
| GINMSKKKS | | GINMSKKKS | | GMTLSVVSLL | | GSLLNDKHFNG | |
| GINTNKTFQ | | GINTNKTFQ | | GMVDGWYGFH | | GSLLNDKHSNG | |
| GINTNRTFQ | | GINTNRTFQ | | GMVDGWYGFR | | GSLLNDRHSNG | |
| GIPESMREE | | GIPESMREE | | GMVDGWYGYH | | GSLMLATGMRN | |
| GIPFHLGTK | | GIPFHLGTK | | GMVNGWYGFR | | GSLNFVSMEFS | |
| GIPFHLGTR | | GIPFHLGTR | | GMWDTLIERD | | GSLPDGAQIQY | |
| GIPLHDAIK | | GIPLHDAIK | | GNAEIEDLIF | | GSLPNDKHSNG | |
| GIPLYDAIK | | GIPLYDAIK | | GNAEIEDLTF | | GSLRLATGMRN | |
| GIPLYDAVK | | GIPLYDAVK | | GNAKDEGNGC | | GSLSLAIMIAG | |
| GIPLYDAVR | | GIPLYDAVR | | GNAQHIEECS | | GSLSLAIMMAG | |
| GIPPLELGD | | GIPPLELGD | | GNAQHVEECS | | GSLSLAIMVAG | |
| GIPPLELRD | | GIPPLELRD | | GNCDAKCQTP | | GSMQCRICIGS | |
| GIPPLVLGD | | GIPPLVLGD | | GNCDTKCQTP | | GSNEQAAEAME | |
| GIPSDTPRG | | GIPSDTPRG | | GNCNAKCQTP | | GSNNNGVKGFS | |
| GIPTDTPRG | | GIPTDTPRG | | GNCNTKCQTP | | GSNRPIIDINM | |
| GIPTDTPRI | | GIPTDTPRI | | GNCPKYIKSG | | GSNRPVIDINM | |
| GIPTDTPRV | | GIPTDTPRV | | GNCPKYVKQG | | GSNRPVIDVNM | |
| GIPTDVVRS | | GIPTDVVRS | | GNCYWVMTDG | | GSNRPVIQIDP | |
| GIQAGVDRF | | GIQAGVDRF | | GNDIWMGRTI | | GSNRPVIQINP | |
| GIQAGVNRF | | GIQAGVNRF | | GNDLWMGRTI | | GSNRPVIRIDP | |
| GIQIASNEN | | GIQIASNEN | | GNDNWSGYSG | | GSNRPVVDINM | |
| GIQSDAQID | | GIQSDAQID | | GNDVWLGRTV | | GSNRPWIRFNS | |
| GIREWSYLI | | GIREWSYLI | | GNDVWMGRTI | | GSNRPWIRINN | |
| GIRIGSKGD | | GIRIGSKGD | | GNEKKAKLAN | | GSNRPWMRINN | |
| GIRIGSKGH | | GIRIGSKGH | | GNFIAPENAY | | GSNRPWMRISN | |
| GIRIGSRGE | | GIRIGSRGE | | GNFIAPEYAF | | GSNRPWVRINN | |
| GIRIGSRGH | | GIRIGSRGH | | GNFIAPEYAY | | GSNRPWVRMNN | |
| GIRPGYNGQ | | GIRPGYNGQ | | GNFNDYEELK | | GSPDPGVKGFA | |
| GIRSFSRTE | | GIRSFSRTE | | GNGAWIGRTK | | GSPFPVGSGSF | |
| GIRTDGATS | | GIRTDGATS | | GNGCFDILHK | | GSPGAPGVKGF | |
| GIRVGSRGH | | GIRVGSRGH | | GNGCFEFWHK | | GSPGCDRLQDT | |
| GISFWMCSN | | GISFWMCSN | | GNGCFEFYHK | | GSPGVKGWAFD | |
| GISGADDDA | | GISGADDDA | | GNGCFEFYHR | | GSPISVGSGSF | |
| GISGPDDGA | | GISGPDDGA | | GNGCFEIFHK | | GSPLELRDCKI | |
| GISGPDNEA | | GISGPDNEA | | GNGCFEIFHQ | | GSPLVLDDCSL | |
| GISGPDNGA | | GISGPDNGA | | GNGCFEIFHR | | GSPPIVSNSDF | |
| GISGPDSGA | | GISGPDSGA | | GNGCFELLHK | | GSPPIVSNSEF | |
| GISIWMCSN | | GISIWMCSN | | GNGCFELYHK | | GSPPMVSNSDF | |
| GISLWMCSN | | GISLWMCSN | | GNGCFKIYHK | | GSPPVVSNSDF | |
| GISNVGLKV | | GISNVGLKV | | GNGCFTFYHK | | GSPSAPGVKGF | |
| GISNVGLNV | | GISNVGLNV | | GNGCFTFYHR | | GSPVPVGSGSF | |
| GISPIHLGD | | GISPIHLGD | | GNGCFTIYHK | | GSPVSVGSGSF | |
| GISPLELGD | | GISPLELGD | | GNGCLKIYHK | | GSQGVKGWAFD | |
| GISPVHLGD | | GISPVHLGD | | GNGDPNNMDK | | GSQKQEFKMNP | |
| GISSMGEAM | | GISSMGEAM | | GNGDPNNMDR | | GSRERLGSWSW | |
| GISSMMEAM | | GISSMMEAM | | GNGSCRCTIC | | GSRGEVFVIRE | |
| GISSMVEAM | | GISSMVEAM | | GNGVWIGRTK | | GSRGHIFVIRE | |
| GITGPDATA | | GITGPDATA | | GNGVWMGRTK | | GSRGHVFVIRE | |
| GITGPDSTA | | GITGPDSTA | | GNHGSLVLSL | | GSRPRVRNQSG | |
| GITGPDTTA | | GITGPDTTA | | GNHGVKGWAF | | GSSEQAAEAIE | |
| GITNKINSI | | GITNKINSI | | GNIIFLWGIH | | GSSEQAAEAMD | |
| GITNKVNSI | | GITNKVNSI | | GNILLSPEEV | | GSSEQAAEAME | |
| GITTHFQRK | | GITTHFQRK | | GNILRTQESE | | GSSFYAEMKWL | |
| GITVIKNNM | | GITVIKNNM | | GNILRTQESS | | GSSIAFCGVDS | |
| GIVADRDST | | GIVADRDST | | GNIMRTQESE | | GSSIAFCGVNS | |

Fig. 83-117

| Block size 8 | SIN | Block size 9 | SIN | Block size 10 | SIN | Block size 11 | SIN |
|---|---|---|---|---|---|---|---|
| GIVECVCRD | | GIVECVCRD | | GNIWITREPY | | GSSIYQNSFVP | |
| GIVHLILWI | | GIVHLILWI | | GNIYKILSIY | | GSSKYQQSFSP | |
| GIVNTTLST | | GIVNTTLST | | GNKLITVGSS | | GSSKYRQSFSP | |
| GIWDTLIER | | GIWDTLIER | | GNLAFNAVIH | | GSSPNAYQAKF | |
| GIYKILTIY | | GIYKILTIY | | GNLAFNTVIH | | GSSPNAYQARF | |
| GIYQILAIY | | GIYQILAIY | | GNLERRLENL | | GSSSACLRGGR | |
| GIYQILSIY | | GIYQILSIY | | GNLIAPEFGY | | GSSSFYAEMKW | |
| GKADTRILF | | GKADTRILF | | GNLIAPEYGF | | GSSSNAYQAKF | |
| GKAPISLGD | | GKAPISLGD | | GNLIAPEYGH | | GSSTYQNNFVP | |
| GKAPISLGG | | GKAPISLGG | | GNLIAPEYGY | | GSSTYQNSFVP | |
| GKAQHIEEC | | GKAQHIEEC | | GNLIAPRGHY | | GSSTYQSNFVP | |
| GKAWLHICV | | GKAWLHICV | | GNLIAPRGYF | | GSSYVCSGLVG | |
| GKAWLHVCI | | GKAWLHVCI | | GNLIAPRGYY | | GSTLGLDIRTA | |
| GKAWLHVCV | | GKAWLHVCV | | GNLIAPWYAF | | GSTLPRRSGAA | |
| GKCNDPYPG | | GKCNDPYPG | | GNLIAPWYAY | | GSTQKAIDNMQ | |
| GKCNEPYPG | | GKCNEPYPG | | GNLIFNAVIH | | GSTVNEEALRQ | |
| GKCNTKCQT | | GKCNTKCQT | | GNLIFNTVIH | | GSVAHKSCLPA | |
| GKCPKYIPS | | GKCPKYIPS | | GNLIVFNTIG | | GSVENLEELRF | |
| GKCPKYISS | | GKCPKYISS | | GNLNKKMEDG | | GSVENQEELRS | |
| GKCPKYVKQ | | GKCPKYVKQ | | GNLVAPEYGF | | GSVNTVLSIIA | |
| GKCPKYVKS | | GKCPKYVKS | | GNLVAPRGHY | | GSVYIEVLHLT | |
| GKCPRYIKQ | | GKCPRYIKQ | | GNLVAPRGYF | | GSWPDGADINF | |
| GKCPRYIPS | | GKCPRYIPS | | GNLVAPWYAY | | GSWPDGANIDF | |
| GKCPRYVKQ | | GKCPRYVKQ | | GNLVFNTVIH | | GSWPDGANINF | |
| GKCPRYVRQ | | GKCPRYVRQ | | GNMRCTISLV | | GSWPDGANINL | |
| GKCYQFALG | | GKCYQFALG | | GNNBNGVKGF | | GSWPDGANISF | |
| GKDNAIRIG | | GKDNAIRIG | | GNNCIESIRN | | GSWPDGANTNF | |
| GKDNAVRIG | | GKDNAVRIG | | GNNDNATATV | | GSWSHNILRTQ | |
| GKDPKKTGG | | GKDPKKTGG | | GNNENATATV | | GSWSQNILRTH | |
| GKEDKRYGP | | GKEDKRYGP | | GNNKNATATV | | GSWSQNILRTQ | |
| GKEDRRYGP | | GKEDRRYGP | | GNNNKGVKGF | | GSWSWHDGAEI | |
| GKENKKYGP | | GKENKKYGP | | GNNNNATATV | | GSYFFGDNAED | |
| GKENKRYGP | | GKENKRYGP | | GNNNNGVKGF | | GSYFFGDNAEE | |
| GKEPISLGD | | GKEPISLGD | | GNNQVFPQLN | | GSYFFGDNAKE | |
| GKEWLHVCI | | GKEWLHVCI | | GNPDPGVKGF | | GSYFFGDSAEE | |
| GKEWMHICM | | GKEWMHICM | | GNPECDRFLS | | GSYNNTGEQI | |
| GKEWMHVCI | | GKEWMHVCI | | GNPECDRLLN | | GSYNNTSGEQM | |
| GKEWMHVCM | | GKEWMHVCM | | GNPECDRLLR | | GSYNNTSGKQM | |
| GKFEFIAED | | GKFEFIAED | | GNPECDRLLS | | GSYVRLYLWGV | |
| GKFEFIAEE | | GKFEFIAEE | | GNPECDRLLT | | GTAADLKSTQA | |
| GKFEFIVEK | | GKFEFIVEK | | GNPGVKGWAF | | GTAADLKSTQT | |
| GKFQTAAQK | | GKFQTAAQK | | GNPIICLGHH | | GTAADYKSTPS | |
| GKFQTAAQR | | GKFQTAAQR | | GNPKCDIHLK | | GTAADYKSTQA | |
| GKFTNEEAL | | GKFTNEEAL | | GNPKCDIHLR | | GTAADYKSTQS | |
| GKFYIQMCT | | GKFYIQMCT | | GNPKCDLYLN | | GTAALSPGMMM | |
| GKGCFDILH | | GKGCFDILH | | GNPKCDLYLS | | GTACFEIFHKC | |
| GKGCFDLYH | | GKGCFDLYH | | GNPKCDPYLN | | GTAKHIEECSC | |
| GKGCFEIYH | | GKGCFEIYH | | GNPKCDTHLK | | GTAPILGNYKE | |
| GKGCFELYH | | GKGCFELYH | | GNPKCDVHLR | | GTAPVLGNYKE | |
| GKGLGIQSG | | GKGLGIQSG | | GNPMCDDLIG | | GTAPVLGNYRE | |
| GKGRIFQSH | | GKGRIFQSH | | GNPMCDELIG | | GTASLSPGMMM | |
| GKGRIFQSP | | GKGRIFQSP | | GNPMCDNLIG | | GTATHIEECSC | |
| GKGRIFQSR | | GKGRIFQSR | | GNPMCDYLIG | | GTCAVVMTDGS | |
| GKGRYGVKG | | GKGRYGVKG | | GNPRCDDLIG | | GTCIVAVTDGP | |
| GKGSWPDGA | | GKGSWPDGA | | GNPSCASNIN | | GTCTVIMTDGS | |
| GKGYMFESK | | GKGYMFESK | | GNPSCATNIN | | GTCTVVMTDGN | |
| GKHIVERIL | | GKHIVERIL | | GNPVICLGHH | | GTCTVVMTDGS | |
| GKHSNGTIH | | GKHSNGTIH | | GNPVICMGHH | | GTCVVAVTDGP | |
| GKIAHISPL | | GKIAHISPL | | GNQGVKGWAF | | GTCVVIMTDGP | |
| GKIIHISPL | | GKIIHISPL | | GNQKTLDEHD | | GTCVVIMTDGS | |
| GKIIKWEPL | | GKIIKWEPL | | GNSARLIHHT | | GTCVVTVTDGP | |
| GKIIQNEDI | | GKIIQNEDI | | GNSFYAELKW | | GTCVVVMTDGS | |

Fig. 83-118

| Block size 8 | SIN | Block size 9 | SIN | Block size 10 | SIN | Block size 11 | SIN |
|---|---|---|---|---|---|---|---|
| GKILKWEPL | | GKILKWEPL | | GNSGVKGWAF | | GTCWEQLYTPG | |
| GKILKWESL | | GKILKWESL | | GNSPAFNYNK | | GTCWEQMYTPG | |
| GKILRTQES | | GKILRTQES | | GNSPIFNYNK | | GTDDDAYAVIH | |
| GKISHISPL | | GKISHISPL | | GNSPVFNYNK | | GTDNYGVKGFG | |
| GKITNKVNN | | GKITNKVNN | | GNSPVFNYNR | | GTFEFTSFFYR | |
| GKIVHIGPL | | GKIVHIGPL | | GNSPVFNYSK | | GTFGPVHFQNQ | |
| GKIVHISPL | | GKIVHISPL | | GNSVWAGRTI | | GTFGPVHFRNQ | |
| GKIVHVSPL | | GKIVHVSPL | | GNSVWAGRTM | | GTFGPVHFRSQ | |
| GKKAVDLGS | | GKKAVDLGS | | GNSVWAGRTV | | GTGCFEIFHKC | |
| GKKEEFSEI | | GKKEEFSEI | | GNTWLGRTIS | | GTGCFEIFHRC | |
| GKKEFSEIM | | GKKEFSEIM | | GNTYVNNTTV | | GTGCFEILHKC | |
| GKKGKWLNQ | | GKKGKWLNQ | | GNVINWTKDS | | GTGIAADKAST | |
| GKLCKLNGI | | GKLCKLNGI | | GNVINWTQDA | | GTGIAADKEST | |
| GKLCRLRGI | | GKLCRLRGI | | GNVINWTRDA | | GTGIAADKTST | |
| GKLCRLSGI | | GKLCRLSGI | | GNVINWTRDS | | GTGIAADKVST | |
| GKLEFIAEE | | GKLEFIAEE | | GNVLDGVTAS | | GTGIAADRDST | |
| GKLKRRAIA | | GKLKRRAIA | | GNVLLSPEEV | | GTGIAADREST | |
| GKLNRFIEK | | GKLNRFIEK | | GNVYKILSIC | | GTGIAADRGST | |
| GKLNRIIEK | | GKLNRIIEK | | GNVYKILSIY | | GTGIAAEKEST | |
| GKLNRLIDK | | GKLNRLIDK | | GNWPDGSDIG | | GTGIVADRDST | |
| GKLNRLIDR | | GKLNRLIDR | | GNWPDGSNIG | | GTGMAADQKST | |
| GKLNRLIEK | | GKLNRLIEK | | GNYARLYIWG | | GTGMAADRDST | |
| GKLNRLIER | | GKLNRLIER | | GNYDSIRGEF | | GTGNKLITVGS | |
| GKLNRLIGK | | GKLNRLIGK | | GNYGPINVTK | | GTGQAADLKST | |
| GKLNRLISK | | GKLNRLISK | | GNYKEICIAW | | GTGQAADYEST | |
| GKMNTQFEA | | GKMNTQFEA | | GNYKEICVAW | | GTGQAADYKST | |
| GKMRDSIKS | | GKMRDSIKS | | GNYKEMCAAW | | GTGRIFQSGIR | |
| GKMTDSIKS | | GKMTDSIKS | | GNYREICIAW | | GTGRIFQSGVR | |
| GKNADLEAL | | GKNADLEAL | | GNYREVCIAW | | GTGRIFQSRIR | |
| GKNSDLEAL | | GKNSDLEAL | | GPAANNADHR | | GTGSIYIEVLH | |
| GKNSFYAEL | | GKNSFYAEL | | GPAANSADHR | | GTGSVYIEVLH | |
| GKNTDLEAL | | GKNTDLEAL | | GPADNKADHR | | GTGSWPDGADI | |
| GKNTDLEVL | | GKNTDLEVL | | GPADTRIYYF | | GTGSWPDGANI | |
| GKPFQNVNR | | GKPFQNVNR | | GPADTRVYYR | | GTGTAADLKST | |
| GKQAKGLFG | | GKQAKGLFG | | GPAECRTFFL | | GTGTGYTMDTV | |
| GKQPISLGD | | GKQPISLGD | | GPAETRIYYF | | GTGYTMDTVNR | |
| GKRGKWVKS | | GKRGKWVKS | | GPAETRVYYF | | GTGYTMDTVSR | |
| GKSDKICIG | | GKSDKICIG | | GPALSINELG | | GTIAGFIEGGW | |
| GKSDRICIG | | GKSDRICIG | | GPALSINELS | | GTIASSLPFQN | |
| GKSGACKRA | | GKSGACKRA | | GPALSISELS | | GTIHDRAAFRG | |
| GKSHGRILK | | GKSHGRILK | | GPANKQASYK | | GTIHDRSPFRA | |
| GKSHGRVLK | | GKSHGRVLK | | GPANNQASYK | | GTIHDRSPYRA | |
| GKSLGIQSD | | GKSLGIQSD | | GPANNQASYR | | GTIHDRSQFRA | |
| GKSSACKRA | | GKSSACKRA | | GPANSQASYK | | GTIHDRSQYRA | |
| GKTKATKME | | GKTKATKME | | GPANSQAYTK | | GTIHDRSQYRS | |
| GKTKATKMK | | GKTKATKMK | | GPASNQASYK | | GTIHDRTAFRG | |
| GKTLKWEPL | | GKTLKWEPL | | GPASSQAYTK | | GTIHDRTTFRG | |
| GKTNEKFHQ | | GKTNEKFHQ | | GPATAQMALQ | | GTIIGPPQCDL | |
| GKTNQQFEL | | GKTNQQFEL | | GPDATAVAVI | | GTIIGPPQCDS | |
| GKTSWSYIV | | GKTSWSYIV | | GPDATAVAVL | | GTIIKTLTNEK | |
| GKVCRTLLA | | GKVCRTLLA | | GPDDGAVAVL | | GTIISNLPFQN | |
| GKVECICRD | | GKVECICRD | | GPDNEAVAVL | | GTIISSLPFQN | |
| GKVECVCRD | | GKVECVCRD | | GPDNGAVAVL | | GTIKDRSPYRT | |
| GKVVHISPL | | GKVVHISPL | | GPDNGAVAVV | | GTINDRSPFRA | |
| GKWDTLIER | | GKWDTLIER | | GPDPGVKGFA | | GTINSPLPFQN | |
| GKWREQLSQ | | GKWREQLSQ | | GPDSGAVAVL | | GTISPRSRSGF | |
| GLANLGLNI | | GLANLGLNI | | GPDSTAVAVI | | GTITSNLPFQN | |
| GLANLGLNV | | GLANLGLNV | | GPDSVLVNTY | | GTITSPLPFQN | |
| GLCTINSWH | | GLCTINSWH | | GPDTTAVAVL | | GTIVKTLTNEK | |
| GLCYPGELD | | GLCYPGELD | | GPESVLINTY | | GTIVKTLTNEQ | |
| GLCYPGELN | | GLCYPGELN | | GPESVLVNTY | | GTIVKTLTNER | |
| GLCYPGSFN | | GLCYPGSFN | | GPGSFPDGAQ | | GTIVKTLTSEK | |

Fig. 83-119

| Block size 8 | SIN | Block size 9 | SIN | Block size 10 | SIN | Block size 11 | SIN |
|---|---|---|---|---|---|---|---|
| GLDIRTATR | | GLDIRTATR | | GPGVKGFGFK | | GTIVSSLPFQN | |
| GLDKICLGH | | GLDKICLGH | | GPGWLTIGIT | | GTIVSSLPFQS | |
| GLDNEPGSE | | GLDNEPGSE | | GPGWLTLGIT | | GTKINTLTERG | |
| GLDNEPGSG | | GLDNEPGSG | | GPILSFIMWA | | GTKQVCAAWSS | |
| GLDRICLGH | | GLDRICLGH | | GPINNGKGRY | | GTKQVCIAWSS | |
| GLFENSCLE | | GLFENSCLE | | GPINVTKENT | | GTKQVCMAWSS | |
| GLFFFCLKN | | GLFFFCLKN | | GPLKAEIAQK | | GTKQVCVAWSS | |
| GLFFWMCSN | | GLFFWMCSN | | GPLKAEIAQR | | GTKRSHEQMET | |
| GLFGAIAGF | | GLFGAIAGF | | GPLLQITSLC | | GTKRSYEQMET | |
| GLFGAKAGF | | GLFGAKAGF | | GPLSGSAQHI | | GTKVNTLTEKG | |
| GLFLWMCSN | | GLFLWMCSN | | GPNDNASAVV | | GTKVNTLTERG | |
| GLGVKGFGF | | GLGVKGFGF | | GPNLYNIRNL | | GTLNRLIDKTN | |
| GLHDANVRN | | GLHDANVRN | | GPNNNASAIV | | GTMDYYWGILK | |
| GLIAGWYGF | | GLIAGWYGF | | GPNNNASAVI | | GTMHDRSPFRA | |
| GLIAPDRVS | | GLIAPDRVS | | GPNNNASAVV | | GTMKDRSPYRT | |
| GLIAPRYGY | | GLIAPRYGY | | GPNNNASPVI | | GTNNYGVKGFG | |
| GLIAPSRVS | | GLIAPSRVS | | GPPHCDQFLE | | GTPACDLHLTG | |
| GLIAPSRVT | | GLIAPSRVT | | GPPQCDKFLE | | GTPACDLYLTG | |
| GLICATCEQ | | GLICATCEQ | | GPPQCDLFLE | | GTPDPGVKGFA | |
| GLIDGWYGF | | GLIDGWYGF | | GPPQCDLHLE | | GTPLELRDCKI | |
| GLIDGWYGY | | GLIDGWYGY | | GPPQCDQFLE | | GTPPTVSNSDF | |
| GLIFMCVKN | | GLIFMCVKN | | GPPQCDRFLE | | GTPVCDPHLTG | |
| GLILAFILW | | GLILAFILW | | GPPQCDSHLK | | GTQGVKGWAFD | |
| GLILAFIMW | | GLILAFIMW | | GPRALVRGQQ | | GTQPLSISVGS | |
| GLILGMQNG | | GLILGMQNG | | GPRPFVRGQQ | | GTQSLSISIGS | |
| GLILGNPKC | | GLILGNPKC | | GPRPLIRGQQ | | GTQSLSISVES | |
| GLILSFIMW | | GLILSFIMW | | GPRPLVMGQQ | | GTQSLSISVGS | |
| GLILSNPKC | | GLILSNPKC | | GPRPLVREQQ | | GTREWSYLIED | |
| GLILTFIMW | | GLILTFIMW | | GPRPLVRGQQ | | GTRIGDGQRSW | |
| GLINGWYGF | | GLINGWYGF | | GPSDAQAFYK | | GTRPGYNGQKS | |
| GLISTPLGS | | GLISTPLGS | | GPSECRTFFL | | GTRQVCIAWSS | |
| GLISTPLGT | | GLISTPLGT | | GPSFYAEMKW | | GTRQVCMAWSS | |
| GLITDTIKS | | GLITDTIKS | | GPSHSIHTGN | | GTRQVCVAWSS | |
| GLIYGNPSC | | GLIYGNPSC | | GPSNAQAFYK | | GTRWMKIIRVG | |
| GLIYNRMGA | | GLIYNRMGA | | GPTECRTFFL | | GTSGTYGAGSW | |
| GLIYNRMGT | | GLIYNRMGT | | GPVHFQNQVK | | GTSGTYGKGSW | |
| GLKISSSFS | | GLKISSSFS | | GPVHFRNQIK | | GTSGTYGSGSW | |
| GLKVSLHLK | | GLKVSLHLK | | GPVHFRNQVK | | GTSGTYGTGSW | |
| GLLAPKYGY | | GLLAPKYGY | | GPVHFRSQVK | | GTSGTYGTGTW | |
| GLLAPRYGY | | GLLAPRYGY | | GPWVRGQSGR | | GTSIWTSSSST | |
| GLLDVWTYN | | GLLDVWTYN | | GQAADLKSTQ | | GTSKACNALTG | |
| GLLEVGTRW | | GLLEVGTRW | | GQAADYESTQ | | GTSKACNASTG | |
| GLLGAIAGF | | GLLGAIAGF | | GQAADYKSTQ | | GTSKACSASTG | |
| GLLGIITGP | | GLLGIITGP | | GQAFYKILKI | | GTSKIKMKWGM | |
| GLLGILIGP | | GLLGILIGP | | GQAFYRSINW | | GTSKVKMKWGM | |
| GLLGTITGP | | GLLGTITGP | | GQAGRIDFHW | | GTSSIYIEVLH | |
| GLLGTLIGP | | GLLGTLIGP | | GQAGRMTFYW | | GTSSVYIEVLH | |
| GLLGTLTGP | | GLLGTLTGP | | GQDCDLINGA | | GTSSVYVEVLH | |
| GLLGTVTGP | | GLLGTVTGP | | GQFGRIDFHW | | GTSVKTLTDNH | |
| GLLISDGGP | | GLLISDGGP | | GQFGRINFHW | | GTTASCQNRGA | |
| GLLLQIISL | | GLLLQIISL | | GQFPVQTDEY | | GTTGNPIICLG | |
| GLLLQITSL | | GLLLQITSL | | GQGDIVLVMK | | GTTHDRTAFRG | |
| GLLLQVTSL | | GLLLQVTSL | | GQGDVVLVMK | | GTTIRGKHSNG | |
| GLLLWMCSN | | GLLLWMCSN | | GQGSGYAADK | | GTTIRGRHSNG | |
| GLLVADGGP | | GLLVADGGP | | GQGSGYAADQ | | GTTIRNKHSNG | |
| GLLVALENQ | | GLLVALENQ | | GQGTAADYKS | | GTTIRNKHSNS | |
| GLLVSDGGP | | GLLVSDGGP | | GQGTTLDNEH | | GTTIRNRHSNG | |
| GLMGRTRIS | | GLMGRTRIS | | GQGTTLDNKH | | GTTLDNEHSNG | |
| GLMSTPLGS | | GLMSTPLGS | | GQGTTLENKH | | GTTLDNKHSND | |
| GLNIGLHLK | | GLNIGLHLK | | GQGTTLNNKH | | GTTLDNKHSNG | |
| GLNIGLHLR | | GLNIGLHLR | | GQGTTLYNKH | | GTTLENKHSNG | |
| GLNISLHLK | | GLNISLHLK | | GQHANGTIHD | | GTTLKGRHANG | |

Fig. 83-120

| Block size 8 | SIN | Block size 9 | SIN | Block size 10 | SIN | Block size 11 | SIN |
|---|---|---|---|---|---|---|---|
| GLNMSLHLK | | GLNMSLHLK | | GQKSWMKIYW | | GTTLNNKHSNG | |
| GLNNEPGSG | | GLNNEPGSG | | GQKSWTKIYW | | GTTLRGQHANG | |
| GLNVGLHLK | | GLNVGLHLK | | GQLKLATGLK | | GTTLRGRHANG | |
| GLNVSLHLK | | GLNVSLHLK | | GQLKLATGLR | | GTTLYNKHSNG | |
| GLNVSLHLR | | GLNVSLHLR | | GQNHGICAVA | | GTTVNEEALRQ | |
| GLPQSGRIV | | GLPQSGRIV | | GQPKEKAIWT | | GTVKDRSPFRT | |
| GLPSDTPRG | | GLPSDTPRG | | GQPKEKTIWT | | GTVKDRSPYRT | |
| GLPVGGNEK | | GLPVGGNEK | | GQPKERTIWT | | GTVSLSPGMMM | |
| GLQRRRFIQ | | GLQRRRFIQ | | GQQGRMDYYW | | GTWDTLIERDN | |
| GLQRRRFVQ | | GLQRRRFVQ | | GQQGTMDYYW | | GTWDTLIEREN | |
| GLQSSDDFA | | GLQSSDDFA | | GQQGWMDYYW | | GTWDTLIERGS | |
| GLREQKQEF | | GLREQKQEF | | GQRGRIDFHW | | GTYCSLNGISP | |
| GLRILIRGN | | GLRILIRGN | | GQRSWMKIYW | | GTYCSLNGVSP | |
| GLRILVRGN | | GLRILVRGN | | GQRSWMKLYW | | GTYDHKDYEEE | |
| GLRISSSFS | | GLRISSSFS | | GQSFYRSINW | | GTYDHKEFEEE | |
| GLRNIPAIA | | GLRNIPAIA | | GQSGRIDFHW | | GTYDHKEFEKE | |
| GLRNIPQIE | | GLRNIPQIE | | GQSGRIDFYW | | GTYDHKEFKEE | |
| GLRNIPSIQ | | GLRNIPSIQ | | GQSGRIEFHW | | GTYDHKEYEEE | |
| GLRNTPSID | | GLRNTPSID | | GQSGRINFHW | | GTYDHNIYRDE | |
| GLRNTPSIE | | GLRNTPSIE | | GQSGRISFYW | | GTYDYIKYEEE | |
| GLRNTPSVE | | GLRNTPSVE | | GQSGRIVFHW | | GTYDYPKYEEE | |
| GLRNVPAIA | | GLRNVPAIA | | GQSGRVSFYW | | GTYDYPKYEKE | |
| GLRNVPAIS | | GLRNVPAIS | | GQSPNVYQAK | | GTYDYPKYSEE | |
| GLRNVPAIT | | GLRNVPAIT | | GQSPNVYQAR | | GTYDYPKYSKE | |
| GLRNVPQAQ | | GLRNVPQAQ | | GQSPNVYQSR | | GTYDYSKYEEE | |
| GLRNVPQIE | | GLRNVPQIE | | GQTGRIDFHW | | GTYGAGSWPDG | |
| GLRNVPQIQ | | GLRNVPQIQ | | GQTIVLDTDW | | GTYGSGSWPDG | |
| GLRNVPQME | | GLRNVPQME | | GQTIVLNTDW | | GTYGTGSWPDG | |
| GLRNVPQVQ | | GLRNVPQVQ | | GQTIVLTTDW | | GTYGTGTWPDG | |
| GLRNVPSIQ | | GLRNVPSIQ | | GQTVKIKTNG | | GTYKILTIYST | |
| GLSFWMCSN | | GLSFWMCSN | | GQTVKIQTNG | | GTYNHEDYKEE | |
| GLSLWMCFN | | GLSLWMCFN | | GQTVKIQTSG | | GTYNHEDYREE | |
| GLSLWMCSN | | GLSLWMCSN | | GQTVVLNTDW | | GTYNHKDYEEE | |
| GLSMVKSDK | | GLSMVKSDK | | GQVECVCRDN | | GTYNHKEYEEE | |
| GLSMVRSDK | | GLSMVRSDK | | GQVEGRIQDL | | GTYNNTTGRDV | |
| GLSPNVYQA | | GLSPNVYQA | | GQWDWPDGAK | | GTYNRKEYEEE | |
| GLSSRISFY | | GLSSRISFY | | GQWNWPDGAE | | GTYNYPKYEEE | |
| GLTHIMIWH | | GLTHIMIWH | | GQWNWPDGAK | | GTYNYPKYSEE | |
| GLTHLMIWH | | GLTHLMIWH | | GRADTKILFI | | GTYQILSIYST | |
| GLTHMMIWH | | GLTHMMIWH | | GRADTRILFI | | GTYQILSLYST | |
| GLVAGWYGF | | GLVAGWYGF | | GRAWLHVCVT | | GTYYYPKYEEE | |
| GLVCATCEQ | | GLVCATCEQ | | GRCPRYVKQS | | GVAADKESTQK | |
| GLVDGWYGF | | GLVDGWYGF | | GRDVLVIWGI | | GVAIALSILNL | |
| GLVDGWYGY | | GLVDGWYGY | | GRDVLVLWGI | | GVAIALSVLNL | |
| GLVFFCLKN | | GLVFFCLKN | | GRDVLVMWGI | | GVAPSPSNSRF | |
| GLVFFCLRN | | GLVFFCLRN | | GRDVLVMWGL | | GVAPSPYNSRF | |
| GLVFICIKN | | GLVFICIKN | | GREDKRYGPA | | GVAPVLGNYKE | |
| GLVFICVKN | | GLVFICVKN | | GREWSYIVER | | GVCPVVFTDGS | |
| GLVFMCVKN | | GLVFMCVKN | | GRFEFIAEEF | | GVCPVVMTDGP | |
| GLVGDTPRD | | GLVGDTPRD | | GRFTNEEALR | | GVCYPGSIENQ | |
| GLVGDTPRE | | GLVGDTPRE | | GRFYIQMCTE | | GVCYPGSIKNQ | |
| GLVGDTPRK | | GLVGDTPRK | | GRFYVQMCTE | | GVDRFYRICKL | |
| GLVGDTPRN | | GLVGDTPRN | | GRGCFEIYHK | | GVDRFYRTCKL | |
| GLVGDTPRS | | GLVGDTPRS | | GRGIEVVNAT | | GVELSSMGVYQ | |
| GLVGDTPRT | | GLVGDTPRT | | GRGLFGAIAG | | GVESAVLRGFL | |
| GLVLGNPKC | | GLVLGNPKC | | GRGLFGAKAG | | GVETMVILSAS | |
| GLVLGNPMC | | GLVLGNPMC | | GRGQAADLKS | | GVEVVDATETV | |
| GLVNLGLNI | | GLVNLGLNI | | GRGRIFQSRI | | GVEVVNATETV | |
| GLVYGNPAC | | GLVYGNPAC | | GRGSTLGLDI | | GVEYNGKSLGI | |
| GLVYGNPSC | | GLVYGNPSC | | GRGVFEFSDE | | GVFEFSDERAA | |
| GLWAYNAEL | | GLWAYNAEL | | GRGVFELSDE | | GVFELSDEKAA | |
| GLWDPFRQS | | GLWDPFRQS | | GRHANGTIHD | | GVFELSDEKAT | |

Fig. 83-121

| Block size 8 | SIN | Block size 9 | SIN | Block size 10 | SIN | Block size 11 | SIN |
|---|---|---|---|---|---|---|---|
| GLWDSFRQS | | GLWDSFRQS | | GRHANGTIND | | GVFELSDERAA | |
| GLYDAIEEC | | GLYDAIEEC | | GRHANGTMHD | | GVFELSDERAT | |
| GLYEAIEEC | | GLYEAIEEC | | GRHSNGTIHD | | GVGIAADKEST | |
| GLYESIEEC | | GLYESIEEC | | GRIDFHWLIL | | GVGMAADKEST | |
| GLYGAIEEC | | GLYGAIEEC | | GRIDFHWLLL | | GVGNLIFNTVI | |
| GMAADKEST | | GMAADKEST | | GRIDFHWLML | | GVGNLVFNTVI | |
| GMAADQKST | | GMAADQKST | | GRIDFHWLVL | | GVGRMTICIQG | |
| GMAADRDST | | GMAADRDST | | GRIDFHWMLL | | GVGRMTICVQG | |
| GMALSVVSL | | GMALSVVSL | | GRIFQSGIRM | | GVHHPSSDNEQ | |
| GMCYPGFVE | | GMCYPGFVE | | GRIFQSGVRL | | GVHHPSTDAEQ | |
| GMCYPGSIE | | GMCYPGSIE | | GRIFQSGVRM | | GVHHPSTDKEQ | |
| GMCYPGSVE | | GMCYPGSVE | | GRIFQSGVRV | | GVHHPSTDTEQ | |
| GMDPRMCSL | | GMDPRMCSL | | GRIFQSRIRM | | GVHHSSSLDEQ | |
| GMEEGSIGK | | GMEEGSIGK | | GRIIQNEDIP | | GVINTSKPFQN | |
| GMELRRCLL | | GMELRRCLL | | GRIQDLEKYI | | GVIPLTTTPTK | |
| GMEMRRCLL | | GMEMRRCLL | | GRIQDLEKYV | | GVITDTLKSWK | |
| GMFNMLSTV | | GMFNMLSTV | | GRIQDLERYV | | GVKGFGFRQGD | |
| GMGMAADKE | | GMGMAADKE | | GRISFYWTIV | | GVKGFGFRQGN | |
| GMGQAADLK | | GMGQAADLK | | GRISIYWTLV | | GVKGFGFRQGT | |
| GMGQAPSPY | | GMGQAPSPY | | GRLCNPLNPF | | GVKGFSFRYGD | |
| GMIDGWYGF | | GMIDGWYGF | | GRLCNPMNPF | | GVKGWAFDNGD | |
| GMIDGWYGY | | GMIDGWYGY | | GRLIDFLKDV | | GVKGWAFDNGN | |
| GMILSVVSL | | GMILSVVSL | | GRLIQNSITI | | GVKGWAFDSGD | |
| GMITDTIKS | | GMITDTIKS | | GRLIQNSITV | | GVKGWAFDYGN | |
| GMKNVPEIP | | GMKNVPEIP | | GRLIQNSLTI | | GVKGWAFDYGS | |
| GMKNVPEKI | | GMKNVPEKI | | GRLIQNSMTI | | GVKLEENSTYK | |
| GMKNVPETP | | GMKNVPETP | | GRLMDFLKDV | | GVKLSNMGIYQ | |
| GMLGFVFTL | | GMLGFVFTL | | GRLTTTIKTW | | GVKLSNMGVYQ | |
| GMMDGWYGF | | GMMDGWYGF | | GRLVQNSITI | | GVKLSSMGIYQ | |
| GMMMGMFNM | | GMMMGMFNM | | GRLVRFRHQN | | GVKLSSMGVYQ | |
| GMPESMREE | | GMPESMREE | | GRMDYYWAIL | | GVKMNPNQKII | |
| GMPTDVVRS | | GMPTDVVRS | | GRMDYYWAVL | | GVKVDGSSSAC | |
| GMQIRGFVH | | GMQIRGFVH | | GRMDYYWGIL | | GVLEDEQMYQK | |
| GMQIRGFVY | | GMQIRGFVY | | GRMSDSIKSW | | GVLLGTKHSNG | |
| GMQNGSCRC | | GMQNGSCRC | | GRMTDSIKSW | | GVLTDTSRPGD | |
| GMQNGSYRC | | GMQNGSYRC | | GRMTFYWAIV | | GVLTDTSRPKD | |
| GMRILIRGN | | GMRILIRGN | | GRMTFYWKIV | | GVLTDTSRPSD | |
| GMRILVRGN | | GMRILVRGN | | GRMTFYWTII | | GVMNTSKPFQN | |
| GMRNIPEKP | | GMRNIPEKP | | GRMTFYWTIV | | GVMNTSKPLQN | |
| GMRNIPEKQ | | GMRNIPEKQ | | GRMTFYWTMV | | GVNDRNFWRGE | |
| GMRNIPENP | | GMRNIPENP | | GRMTICIQGN | | GVNESADMSIG | |
| GMRNIPERQ | | GMRNIPERQ | | GRMTICVQGK | | GVNRFYRTCKL | |
| GMRNIPGKQ | | GMRNIPGKQ | | GRMTICVQGN | | GVNSFSRTELI | |
| GMRNVPEKP | | GMRNVPEKP | | GRNCTIPCFW | | GVNTNKTFQNI | |
| GMRNVPEKQ | | GMRNVPEKQ | | GRNCTVPCFW | | GVPFHLATKQV | |
| GMRNVPENP | | GMRNVPENP | | GRNPGNAEIE | | GVPFHLGTKQV | |
| GMRNVPERQ | | GMRNVPERQ | | GRNSFFSRLN | | GVPFHLGTRQV | |
| GMRNVPETQ | | GMRNVPETQ | | GRNSFYAELK | | GVPFYLGTKQV | |
| GMSANGDIL | | GMSANGDIL | | GRPEEAKYVE | | GVPPLELGDCS | |
| GMTLSVVSL | | GMTLSVVSL | | GRPEEAKYVW | | GVPVTSSIDLV | |
| GMVDGWYGF | | GMVDGWYGF | | GRPEEVKYVW | | GVPVTSSVDLV | |
| GMVDGWYGY | | GMVDGWYGY | | GRPITEINTW | | GVQAGVDRFYR | |
| GMVNGWYGF | | GMVNGWYGF | | GRPKEDEVWW | | GVQDIIDNDNW | |
| GMVNGWYGY | | GMVNGWYGY | | GRPKEDKVWW | | GVQDIIDNNNW | |
| GMWDTLIER | | GMWDTLIER | | GRPKEDRVWW | | GVQMQRFRRPD | |
| GNAEGRTSD | | GNAEGRTSD | | GRPKEEKVWW | | GVREWSYLIED | |
| GNAEIEDLI | | GNAEIEDLI | | GRPTTEINTW | | GVRIGSKGDVF | |
| GNAEIEDLT | | GNAEIEDLT | | GRQEKNPALR | | GVRPGYNGQKS | |
| GNAKDEGNG | | GNAKDEGNG | | GRQEKNPSLR | | GVRPGYNGQRS | |
| GNAQHIEEC | | GNAQHIEEC | | GRQTFDWTLN | | GVRPRYNGQRS | |
| GNAQHVEEC | | GNAQHVEEC | | GRQTYDWTLN | | GVSFHLGTKQV | |
| GNASGKADT | | GNASGKADT | | GRRKTNLYGF | | GVSGADDDAYA | |

Fig. 83-122

| Block size 8 | SIN | Block size 9 | SIN | Block size 10 | SIN | Block size 11 | SIN |
|---|---|---|---|---|---|---|---|
| GNAWLHVCV | | GNAWLHVCV | | GRRRTNLYGF | | GVSGADNDAYA | |
| GNCDAKCQT | | GNCDAKCQT | | GRSHLRNDTD | | GVSGEVPGWSW | |
| GNCDTKCQT | | GNCDTKCQT | | GRTFSPRSRS | | GVSGINESADM | |
| GNCNAKCQT | | GNCNAKCQT | | GRTINTASRS | | GVSGPDNGAVA | |
| GNCNTKCQT | | GNCNTKCQT | | GRTIQNEDIP | | GVSGTDDDAYA | |
| GNCPKYIKS | | GNCPKYIKS | | GRTISIASRS | | GVSGVNESADM | |
| GNCPKYVKQ | | GNCPKYVKQ | | GRTISKDLRS | | GVSPIHLGDCS | |
| GNCRFNVCI | | GNCRFNVCI | | GRTISKDSRS | | GVSPVHLGDCN | |
| GNCRFSVCI | | GNCRFSVCI | | GRTISKDTRS | | GVSPVHLGDCR | |
| GNCSIAGWL | | GNCSIAGWL | | GRTISMDSRS | | GVSPVHLGDCS | |
| GNCYWVMTD | | GNCYWVMTD | | GRTISPHSRS | | GVSSEAPGWSW | |
| GNDIWMGRT | | GNDIWMGRT | | GRTISPKLRS | | GVSSEVPEWSW | |
| GNDLWMGRT | | GNDLWMGRT | | GRTISPRLRS | | GVSSEVPGWSW | |
| GNDNWSGYS | | GNDNWSGYS | | GRTISPRSRN | | GVTASCLDKGA | |
| GNDVWLGRT | | GNDVWLGRT | | GRTISPRSRS | | GVTASCLDRGA | |
| GNDVWMGRT | | GNDVWMGRT | | GRTISRDSRS | | GVTASCLDRGT | |
| GNEKKAKLA | | GNEKKAKLA | | GRTISTASRA | | GVTASCRDNGA | |
| GNFIAPENA | | GNFIAPENA | | GRTISTASRS | | GVTNKVNSIID | |
| GNFIAPEYA | | GNFIAPEYA | | GRTKSLESRR | | GVTNKVNSIIG | |
| GNFNDYEEL | | GNFNDYEEL | | GRTKSLESRS | | GVTNKVNSIIN | |
| GNGAWIGRT | | GNGAWIGRT | | GRTLDLHDAN | | GVTRREIHIYY | |
| GNGCFDILH | | GNGCFDILH | | GRTLDMHDAN | | GVTRREVHIYY | |
| GNGCFEFWH | | GNGCFEFWH | | GRTLGLHDAN | | GVTRREVHMYY | |
| GNGCFEFYH | | GNGCFEFYH | | GRTNQQFELI | | GVTRREVHTYY | |
| GNGCFEIFH | | GNGCFEIFH | | GRTSDMRAEI | | GVTRREVHVYY | |
| GNGCFELLH | | GNGCFELLH | | GRTSDMRTEI | | GVTTHYVSQIG | |
| GNGCFELYH | | GNGCFELYH | | GRTSDMRTEV | | GVTVIKNNMIN | |
| GNGCFKIYH | | GNGCFKIYH | | GRTTSKDSRS | | GVTVIKNNMVN | |
| GNGCFTFYH | | GNGCFTFYH | | GRTTSTASRS | | GVTVIRNNMIN | |
| GNGCFTIYH | | GNGCFTIYH | | GRTVSINGRS | | GVVNTALSTIA | |
| GNGCLKIYH | | GNGCLKIYH | | GRTVSISGRS | | GVVNTTLSTIA | |
| GNGDPNNMD | | GNGDPNNMD | | GRTVSNSGRS | | GVWIGRTKSLE | |
| GNGNKLITV | | GNGNKLITV | | GRTVSTSGRL | | GVWTYNAELLV | |
| GNGSCRCTI | | GNGSCRCTI | | GRTVSTSGRS | | GVWWTSNSIVV | |
| GNGVWIGRT | | GNGVWIGRT | | GRVSFYWTIV | | GVYINTALLNA | |
| GNGVWMGRT | | GNGVWMGRT | | GRVTDSIKSW | | GVYINTALLNS | |
| GNHGSLVLS | | GNHGSLVLS | | GRVTVSTRSD | | GVYINTAMLNA | |
| GNHGVKGWA | | GNHGVKGWA | | GRWPGLVAGW | | GVYKALSIYSC | |
| GNIIFLWGI | | GNIIFLWGI | | GRYGVKGFSF | | GVYMNTALLNA | |
| GNIKCNICI | | GNIKCNICI | | GRYSIADKIC | | GVYNNTTGRDV | |
| GNILLSPEE | | GNILLSPEE | | GRYSKADKIC | | GVYQILAIYAT | |
| GNILRTQES | | GNILRTQES | | GRYSRADKIC | | GVYQILAIYST | |
| GNIMRTQES | | GNIMRTQES | | GSAEHIEECS | | GVYQILSIYST | |
| GNIRCDICI | | GNIRCDICI | | GSAKHIEECS | | GVYQVLAIYAT | |
| GNIRCNICI | | GNIRCNICI | | GSAKHVEECS | | GVYVNTALLNA | |
| GNIRCQICI | | GNIRCQICI | | GSAMHIEECS | | GWAPLSKDNGI | |
| GNIRCTFCI | | GNIRCTFCI | | GSAQHIEECS | | GWCGMIDGWYG | |
| GNIWITREP | | GNIWITREP | | GSAQHVEECS | | GWEGLIDGWYG | |
| GNIYKILSI | | GNIYKILSI | | GSARHIEECS | | GWEGLINGWYG | |
| GNKLITVGS | | GNKLITVGS | | GSARHIEEWS | | GWEGLVDGWYG | |
| GNLAFNAVI | | GNLAFNAVI | | GSARHVEECS | | GWEGMIDGWYG | |
| GNLAFNTVI | | GNLAFNTVI | | GSASGKADTR | | GWEGMMDGWYG | |
| GNLERRLEN | | GNLERRLEN | | GSASGQAYTK | | GWEGMVDGWYG | |
| GNLIAPEFG | | GNLIAPEFG | | GSASGRADTK | | GWEGMVNGWYG | |
| GNLIAPEYG | | GNLIAPEYG | | GSASGRADTR | | GWIDSPNHAKS | |
| GNLIAPLYG | | GNLIAPLYG | | GSASSQAHTK | | GWILGNPMCDD | |
| GNLIAPRGH | | GNLIAPRGH | | GSASSQAYTK | | GWILGNPMCDE | |
| GNLIAPRGY | | GNLIAPRGY | | GSATGPADTR | | GWILGNPMCDN | |
| GNLIAPWFG | | GNLIAPWFG | | GSATGPAETR | | GWILGNPMCDY | |
| GNLIAPWYA | | GNLIAPWYA | | GSCAVVMTDG | | GWILGNPRCDD | |
| GNLIAPWYG | | GNLIAPWYG | | GSCFTIMTDG | | GWINSPNHAKS | |
| GNLIFNAVI | | GNLIFNAVI | | GSCFTLMTDG | | GWINSPNHVKS | |

Fig. 83-123

| Block size 8 | SIN | Block size 9 | SIN | Block size 10 | SIN | Block size 11 | SIN |
|---|---|---|---|---|---|---|---|
| GNLIFNTVI | | GNLIFNTVI | | GSCFTVLTDG | | GWINSPSQAKS | |
| GNLIVFNTI | | GNLIVFNTI | | GSCFTVMTDG | | GWITIGISGPD | |
| GNLNKKMED | | GNLNKKMED | | GSCGILGTII | | GWIVGNPSCAS | |
| GNLRCQICI | | GNLRCQICI | | GSCTSPCLTD | | GWIVGNPSCAT | |
| GNLRCTICI | | GNLRCTICI | | GSCTVVMTDG | | GWLLGNPECDI | |
| GNLVAPEYG | | GNLVAPEYG | | GSDVWLGRTV | | GWLLGNPECDL | |
| GNLVAPRGH | | GNLVAPRGH | | GSDVWMGRTI | | GWLLGNPECDR | |
| GNLVAPRGY | | GNLVAPRGY | | GSEHTAYSQI | | GWLLGNPKCDR | |
| GNLVAPWYA | | GNLVAPWYA | | GSFIDYWAEG | | GWLLGNPLCDE | |
| GNLVFNTVI | | GNLVFNTVI | | GSFIDYWAKE | | GWLLGNPMCDA | |
| GNMQCTICI | | GNMQCTICI | | GSFIDYWAKG | | GWLLGNPMCDE | |
| GNMRCTICI | | GNMRCTICI | | GSFIQHPELT | | GWLLGNPMCDK | |
| GNMRCTSCI | | GNMRCTSCI | | GSFMDYWAEG | | GWLTIGISGPD | |
| GNMRGTNWI | | GNMRGTNWI | | GSFNDYEELK | | GWLTIGITGPD | |
| GNNBNGVKG | | GNNBNGVKG | | GSFNNYEELK | | GWLTLGITGPD | |
| GNNCIESIR | | GNNCIESIR | | GSFPDGAKIQ | | GWMDYYWGILK | |
| GNNDNATAT | | GNNDNATAT | | GSFPDGAQIK | | GWPGLINGWYG | |
| GNNEGRTSD | | GNNEGRTSD | | GSFPDGAQIQ | | GWPGLVAGWYG | |
| GNNENATAT | | GNNENATAT | | GSFPNGAQIQ | | GWQGLIDGWYG | |
| GNNKNATAT | | GNNKNATAT | | GSFSIRGETT | | GWQGLVDGWYG | |
| GNNNGVKGF | | GNNNGVKGF | | GSFSIRWETT | | GWQGMIDGWYG | |
| GNNNNATAT | | GNNNNATAT | | GSFVDYWAEG | | GWQGMVDGWYG | |
| GNNNNGVKG | | GNNNNGVKG | | GSFVQHPELT | | GWSATACHDGK | |
| GNNQVFPQL | | GNNQVFPQL | | GSFVQHPEMT | | GWSGLIAGWYG | |
| GNPDPGVKG | | GNPDPGVKG | | GSFYRNMRWL | | GWSGLVAGWYG | |
| GNPECDILL | | GNPECDILL | | GSFYRSIRWL | | GWSGMIDGWYG | |
| GNPECDLFL | | GNPECDLFL | | GSFYRSMRWL | | GWSSTSCHDGI | |
| GNPECDLLL | | GNPECDLLL | | GSGFFPDGPQ | | GWSSTSCHDGK | |
| GNPECDRLL | | GNPECDRLL | | GSGHWPDGSN | | GWSSTSCHDGM | |
| GNPEGRTSD | | GNPEGRTSD | | GSGLRILIRG | | GWSSTSCHDGR | |
| GNPGVKGWA | | GNPGVKGWA | | GSGLRILVRG | | GWSSTSCHDGV | |
| GNPIICLGH | | GNPIICLGH | | GSGMRILIRG | | GWSSTTCHDGI | |
| GNPKCDIHL | | GNPKCDIHL | | GSGMRILVRG | | GWSSTTCHDGV | |
| GNPKCDLYL | | GNPKCDLYL | | GSGNWPDGSD | | GWSWDDGAILP | |
| GNPKCDPYL | | GNPKCDPYL | | GSGNWPDGSN | | GWSWPDGALFP | |
| GNPKCDRLL | | GNPKCDRLL | | GSGRIFQSGV | | GWSWPDGALLP | |
| GNPKCDTHL | | GNPKCDTHL | | GSGSFPDGAK | | GWSYIVERPSA | |
| GNPKCDVHL | | GNPKCDVHL | | GSGSFPDGAQ | | GWTGLIDGWYG | |
| GNPMCDDLI | | GNPMCDDLI | | GSGSFPDGAR | | GWTGMIDGWYG | |
| GNPMCDELI | | GNPMCDELI | | GSGSLPDGAQ | | GWTGMVDGWYG | |
| GNPMCDNLI | | GNPMCDNLI | | GSGSWPDGAD | | GWTGMVNGWYG | |
| GNPMCDYLI | | GNPMCDYLI | | GSGTDNYGVK | | GWTSNSIVVFC | |
| GNPRCDDLI | | GNPRCDDLI | | GSGTNNYGVK | | GWVSTDKDSNG | |
| GNPSCASNI | | GNPSCASNI | | GSGWLTLGIT | | GWVSTDKNSNG | |
| GNPSCATNI | | GNPSCATNI | | GSGYAADKAS | | GWVTADKDSNG | |
| GNPVICLGH | | GNPVICLGH | | GSGYAADKES | | GWVVIAKDNAI | |
| GNPVICMGH | | GNPVICMGH | | GSGYAADKKS | | GWVVIAKDNAV | |
| GNQGVKGWA | | GNQGVKGWA | | GSGYAADLKS | | GWVVIAQDNAI | |
| GNQKTLDEH | | GNQKTLDEH | | GSGYAADQES | | GWVVIEKDNAV | |
| GNSARLIHH | | GNSARLIHH | | GSGYAADQKS | | GWVVVAKDNAI | |
| GNSDVLVTR | | GNSDVLVTR | | GSGYAADRES | | GWYGFHHSNAE | |
| GNSEGRTSD | | GNSEGRTSD | | GSGYAADRKS | | GWYGFHHSNSE | |
| GNSFYAELK | | GNSFYAELK | | GSGYGEDNES | | GWYGFKHQNAQ | |
| GNSGVKGWA | | GNSGVKGWA | | GSHGVKGWAF | | GWYGFQHQNAE | |
| GNSNNGVKG | | GNSNNGVKG | | GSIAHKSCLP | | GWYGFQHQNEQ | |
| GNSPAFNYN | | GNSPAFNYN | | GSIENLEELR | | GWYGFQHQNSE | |
| GNSPIFNYN | | GNSPIFNYN | | GSIENQEELK | | GWYGFQHRNDE | |
| GNSPVFNYN | | GNSPVFNYN | | GSIENQEELR | | GWYGFQHRNEE | |
| GNSVWAGRT | | GNSVWAGRT | | GSIGKVCRAL | | GWYGFQHSNAQ | |
| GNTEGRTSD | | GNTEGRTSD | | GSIGKVCRTL | | GWYGFQHSNDQ | |
| GNTWLGRTI | | GNTWLGRTI | | GSIISFCGVN | | GWYGFQHSNEQ | |
| GNTYVNNTT | | GNTYVNNTT | | GSIITELPFQ | | GWYGFQHTNDQ | |

Fig. 83-124

| Block size 8 | SIN | Block size 9 | SIN | Block size 10 | SIN | Block size 11 | SIN |
|---|---|---|---|---|---|---|---|
| GNVINWTKD | | GNVINWTKD | | GSIKNQEELR | | GWYGFRHHNSE | |
| GNVINWTQD | | GNVINWTQD | | GSIKTKLPFQ | | GWYGFRHLNSE | |
| GNVINWTRD | | GNVINWTRD | | GSINTKLPFQ | | GWYGFRHQKAQ | |
| GNVLDGVTA | | GNVLDGVTA | | GSINTRLPFQ | | GWYGFRHQNAE | |
| GNVLLSPEE | | GNVLLSPEE | | GSIPNDKPFQ | | GWYGFRHQNAQ | |
| GNVRCQICI | | GNVRCQICI | | GSIPNEKPFQ | | GWYGFRHQNSE | |
| GNVRCTFCI | | GNVRCTFCI | | GSIPNGKPFQ | | GWYGFRHQNSQ | |
| GNVYKILSI | | GNVYKILSI | | GSIPNNKPFQ | | GWYGFRHQNTQ | |
| GNWPDGANI | | GNWPDGANI | | GSIQSDKPFQ | | GWYGFRYQNSE | |
| GNWPDGSNI | | GNWPDGSNI | | GSIRNETYDH | | GWYGYHHENSQ | |
| GNYARLYIW | | GNYARLYIW | | GSIRNGTYDH | | GWYGYHHQNEQ | |
| GNYDSIRGE | | GNYDSIRGE | | GSIRNGTYNH | | GWYGYHHQNGQ | |
| GNYGPINVT | | GNYGPINVT | | GSIRNNTYDH | | GWYGYHHSNDQ | |
| GNYKEICIA | | GNYKEICIA | | GSISNDKPFQ | | GWYGYKHQNAQ | |
| GNYKEICVA | | GNYKEICVA | | GSIYIEVLHL | | GWYGYRHQNAQ | |
| GNYKEMCAA | | GNYKEMCAA | | GSKEQLGSWS | | GYAADKASTQK | |
| GNYREICIA | | GNYREICIA | | GSKERLGSWS | | GYAADKESTQK | |
| GNYREVCIA | | GNYREVCIA | | GSKGDIFVIR | | GYAADKESTQR | |
| GPAANNADH | | GPAANNADH | | GSKGDIFVMR | | GYAADKKSTQK | |
| GPAANSADH | | GPAANSADH | | GSKGDVFVIR | | GYAADQESTQK | |
| GPAANSAHH | | GPAANSAHH | | GSKGDVFVMR | | GYAADRESTQK | |
| GPADTRIYY | | GPADTRIYY | | GSKGHVFVIR | | GYAADRESTQR | |
| GPADTRVYY | | GPADTRVYY | | GSKKRLGSWS | | GYAADRKSTQK | |
| GPAECRTFF | | GPAECRTFF | | GSLEFIAEQF | | GYAQTDCVLEA | |
| GPAETRIYY | | GPAETRIYY | | GSLKLAIGLR | | GYCFTVMTDGP | |
| GPAETRVYY | | GPAETRVYY | | GSLKLAIGPR | | GYDFEKEGYSL | |
| GPALSINEL | | GPALSINEL | | GSLLLATGMR | | GYDFEREGYSL | |
| GPALSISEL | | GPALSISEL | | GSLLNDKHFN | | GYEILKVPNAE | |
| GPANKQASY | | GPANKQASY | | GSLLNDKHSN | | GYEKNATASFI | |
| GPANNQASY | | GPANNQASY | | GSLLNDKHSS | | GYEMLKVPDAE | |
| GPANSQASY | | GPANSQASY | | GSLLNDRHSN | | GYEMLKVPNAE | |
| GPANSQAYT | | GPANSQAYT | | GSLMLATGMR | | GYEMLKVPNAL | |
| GPASNQASY | | GPASNQASY | | GSLNDYEELK | | GYETFKVIGGW | |
| GPATAQMAL | | GPATAQMAL | | GSLNFVSMEF | | GYETFRVIDGW | |
| GPDATAVAV | | GPDATAVAV | | GSLRLATGMR | | GYETFRVIGGW | |
| GPDDGAVAV | | GPDDGAVAV | | GSLSLAIMIA | | GYETFRVISGW | |
| GPDNEAVAV | | GPDNEAVAV | | GSLSLAIMMA | | GYEVLKVPDAE | |
| GPDNGAVAV | | GPDNGAVAV | | GSLSLAIMVA | | GYEVLKVPNAE | |
| GPDPGVKGF | | GPDPGVKGF | | GSMQCRICIG | | GYGEDNESTQK | |
| GPDSGAVAV | | GPDSGAVAV | | GSNEQAAEAM | | GYGVKGFGFRQ | |
| GPDSTAVAV | | GPDSTAVAV | | GSNNNGVKGF | | GYHANNSKKQI | |
| GPDSVLVNT | | GPDSVLVNT | | GSNRPIIDIN | | GYHANNSSDTV | |
| GPDTTAVAV | | GPDTTAVAV | | GSNRPIVDIN | | GYHANNSTDTI | |
| GPESVLINT | | GPESVLINT | | GSNRPVIDIN | | GYHANNSTDTV | |
| GPESVLVNT | | GPESVLVNT | | GSNRPVIDVN | | GYHANNSTEQV | |
| GPGSFPDGA | | GPGSFPDGA | | GSNRPVIQID | | GYHANNSTETV | |
| GPGVKGFGF | | GPGVKGFGF | | GSNRPVIQIN | | GYHANNSTKQI | |
| GPGWLTIGI | | GPGWLTIGI | | GSNRPVIRID | | GYHANNSTKQV | |
| GPGWLTLGI | | GPGWLTLGI | | GSNRPVLDIS | | GYHANNSTTKV | |
| GPILSFIMW | | GPILSFIMW | | GSNRPVVDIN | | GYHANNSTTQI | |
| GPINNGKGR | | GPINNGKGR | | GSNRPVVDIR | | GYHANNSTTQV | |
| GPINVTKEN | | GPINVTKEN | | GSNRPWIRFN | | GYHFEECSCYP | |
| GPLKAEIAQ | | GPLKAEIAQ | | GSNRPWIRIN | | GYHHENSQGSG | |
| GPLSGSAQH | | GPLSGSAQH | | GSNRPWISFN | | GYHHQNAQGSG | |
| GPNDNASAV | | GPNDNASAV | | GSNRPWLSFN | | GYHHQNEQGSG | |
| GPNLYNIRN | | GPNLYNIRN | | GSNRPWMRIN | | GYHHQNGQGSG | |
| GPNNNASAI | | GPNNNASAI | | GSNRPWMRIS | | GYHHSNDQGAG | |
| GPNNNASAV | | GPNNNASAV | | GSNRPWVRIN | | GYHHSNDQGSG | |
| GPPHCDQFL | | GPPHCDQFL | | GSNRPWVRMN | | GYICSGFFGDN | |
| GPPQCDKFL | | GPPQCDKFL | | GSNRPWVSFD | | GYICSGIFGDN | |
| GPPQCDLFL | | GPPQCDLFL | | GSNRPWVSFN | | GYICSGVFGDN | |
| GPPQCDLHL | | GPPQCDLHL | | | | GYICSGVFGDS | |

Fig. 83-125

| Block size 8 | SIN | Block size 9 | SIN | Block size 10 | SIN | Block size 11 | SIN |
|---|---|---|---|---|---|---|---|
| GPPQCDQFL | | GPPQCDQFL | | GSPDPGVKGF | | GYICSGVFGDT | |
| GPPQCDRFL | | GPPQCDRFL | | GSPFPVGSGS | | GYICSGVLGDN | |
| GPPQCDSHL | | GPPQCDSHL | | GSPGAPGVKG | | GYICSKFHSDT | |
| GPRALVRGQ | | GPRALVRGQ | | GSPGCDRLQD | | GYIEGKLSQMS | |
| GPRNVPAIA | | GPRNVPAIA | | GSPGVKGWAF | | GYIIEEYGKGR | |
| GPRNVPQAQ | | GPRNVPQAQ | | GSPISVGSGS | | GYIIEEYGRGR | |
| GPRNVPQIE | | GPRNVPQIE | | GSPLELRDCK | | GYIIEKYGSGR | |
| GPRNVPQVQ | | GPRNVPQVQ | | GSPLVLDDCS | | GYIIEKYGTGR | |
| GPRPFVRGQ | | GPRPFVRGQ | | GSPPIVSNSD | | GYKDIILWFSF | |
| GPRPLIRGQ | | GPRPLIRGQ | | GSPPIVSNSE | | GYKDIILWISF | |
| GPRPLVMGQ | | GPRPLVMGQ | | GSPPMVSNSD | | GYKDIILWVSF | |
| GPRPLVREQ | | GPRPLVREQ | | GSPPVVSNSD | | GYKDVIIWFSF | |
| GPRPLVRGQ | | GPRPLVRGQ | | GSPSAPGVKG | | GYKDVILWFSF | |
| GPSDAQAFY | | GPSDAQAFY | | GSPVPVGSGS | | GYKDVILWFSL | |
| GPSECRTFF | | GPSECRTFF | | GSPVSVGSGS | | GYKDVILWISF | |
| GPSFYAEMK | | GPSFYAEMK | | GSQGVKGWAF | | GYKDWFLWISF | |
| GPSHSIHTG | | GPSHSIHTG | | GSQKQEFKMN | | GYKDWILWISF | |
| GPSNAQAFY | | GPSNAQAFY | | GSRERLGSWS | | GYKDWVLWISF | |
| GPTECRTFF | | GPTECRTFF | | GSRGEVFVIR | | GYKEVILWFSF | |
| GPVHFQNQV | | GPVHFQNQV | | GSRGHIFVIR | | GYKHQNAQGEG | |
| GPVHFRNQI | | GPVHFRNQI | | GSRGHVFVIR | | GYKMNIQILIL | |
| GPVHFRNQV | | GPVHFRNQV | | GSRPRVRNQS | | GYKMNNQILIL | |
| GPVHFRSQV | | GPVHFRSQV | | GSSEQAAEAI | | GYKMNTKILVL | |
| GPWVRGQSG | | GPWVRGQSG | | GSSEQAAEAM | | GYKMNTQILIF | |
| GQAADLKST | | GQAADLKST | | GSSFYAELKW | | GYKMNTQILIL | |
| GQAADYEST | | GQAADYEST | | GSSFYAEMKW | | GYKMNTQILVF | |
| GQAADYKST | | GQAADYKST | | GSSIAFCGVD | | GYKMNTRILIL | |
| GQAFYKILK | | GQAFYKILK | | GSSIAFCGVN | | GYKNWILWISF | |
| GQAFYRSIN | | GQAFYRSIN | | GSSISFCGVD | | GYLCAGIPSDT | |
| GQAGRIDFH | | GQAGRIDFH | | GSSISFCGVN | | GYLCAGIPTDT | |
| GQAGRMTFY | | GQAGRMTFY | | GSSISFCGVS | | GYLCAGLPSDT | |
| GQCGILGIL | | GQCGILGIL | | GSSKYQQSFS | | GYLIRALTLNT | |
| GQCGLLGII | | GQCGLLGII | | GSSKYRQSFS | | GYLITGKSHGR | |
| GQCGLLGTI | | GQCGLLGTI | | GSSPNAYQAK | | GYLLKGESHCR | |
| GQCGLLGTL | | GQCGLLGTL | | GSSPNAYQAQ | | GYLLKGESHGK | |
| GQCGLLGTV | | GQCGLLGTV | | GSSPNAYQAR | | GYLLKGESHGR | |
| GQCPKYVKK | | GQCPKYVKK | | GSSSACLRGG | | GYLLKGESYGR | |
| GQCPKYVNK | | GQCPKYVNK | | GSSSFYAEMK | | GYLLLNKSLCN | |
| GQCPKYVNQ | | GQCPKYVNQ | | GSSTYHNSFV | | GYLLRGESHGR | |
| GQCPKYVSK | | GQCPKYVSK | | GSSTYQNNFV | | GYLSNNATDTV | |
| GQCPKYVSQ | | GQCPKYVSQ | | GSSTYQNSFV | | GYLSNNSSDTV | |
| GQDCDLING | | GQDCDLING | | GSSTYQSNFV | | GYLSNNSTDKI | |
| GQFGRIDFH | | GQFGRIDFH | | GSSYVCSGLV | | GYLSNNSTDKV | |
| GQFGRINFH | | GQFGRINFH | | GSTLGLDIRT | | GYLSNNSTDTV | |
| GQFPVQTDE | | GQFPVQTDE | | GSTLPRRSGA | | GYLSNNSTEKV | |
| GQGDIVLVM | | GQGDIVLVM | | GSTQKAIDNM | | GYLSNNSTERV | |
| GQGDVVLVM | | GQGDVVLVM | | GSTVNEEALR | | GYLSTNSSDKV | |
| GQGSGYAAD | | GQGSGYAAD | | GSVAHKSCLP | | GYLSTNSSEKV | |
| GQGTAADYK | | GQGTAADYK | | GSVENLEELR | | GYLSTNSSERV | |
| GQGTTLDNE | | GQGTTLDNE | | GSVENQEELR | | GYLSTNSTEKV | |
| GQGTTLDNK | | GQGTTLDNK | | GSVYIEVLHL | | GYMSNNSTEKV | |
| GQGTTLENK | | GQGTTLENK | | GSWPDGADIN | | GYNFEKEGYSL | |
| GQGTTLNNK | | GQGTTLNNK | | GSWPDGANID | | GYNGQKSWMKI | |
| GQGTTLYNK | | GQGTTLYNK | | GSWPDGANIN | | GYNGQKSWTKI | |
| GQHANGTIH | | GQHANGTIH | | GSWPDGANIS | | GYNGQRSWMKI | |
| GQIIVLNTD | | GQIIVLNTD | | GSWPDGANTN | | GYQSLRSILAN | |
| GQKSWMKIY | | GQKSWMKIY | | GSWSQNILRT | | GYQSNNSTDTV | |
| GQKSWTKIY | | GQKSWTKIY | | GSWSWHDGAE | | GYQSNNSTNTV | |
| GQLKLATGL | | GQLKLATGL | | GSYFFGDNAE | | GYQTNNSTDTV | |
| GQNFPQTAN | | GQNFPQTAN | | GSYFFGDNAK | | GYQTNNSTETV | |
| GQNFPQTTN | | GQNFPQTTN | | GSYFFGDSAE | | GYRHQNAQGEG | |
| GQNFPRTTN | | GQNFPRTTN | | GSYNNTNGEQ | | GYSGIFSVEGK | |

Fig. 83-126

| Block size 8 | SIN | Block size 9 | SIN | Block size 10 | SIN | Block size 11 | SIN |
|---|---|---|---|---|---|---|---|
| GQNHGICAV | | GQNHGICAV | | GSYNNTSGEQ | | GYSGIFSVEHK | |
| GQPKEKAIW | | GQPKEKAIW | | GSYNNTSGKQ | | GYSGIFSVENK | |
| GQPKEKTIW | | GQPKEKTIW | | GSYVRLYLWG | | GYSGIFSVESK | |
| GQPNERTIW | | GQPNERTIW | | GTAADLKSTQ | | GYSGSFIDYWA | |
| GQQGRMDYY | | GQQGRMDYY | | GTAADYKSTP | | GYSGSFIDYWD | |
| GQQGTMDYY | | GQQGTMDYY | | GTAADYKSTQ | | GYSGSFIDYWN | |
| GQQGWMDYY | | GQQGWMDYY | | GTAALSPGMM | | GYSGSFIQHPE | |
| GQRGRIDFH | | GQRGRIDFH | | GTAFRGLIST | | GYSGSFMDYWA | |
| GQRSWMKIY | | GQRSWMKIY | | GTAKHIEECS | | GYSGSFSIRGE | |
| GQRSWMKLY | | GQRSWMKLY | | GTAPILGNYK | | GYSGSFSIRWE | |
| GQSFPQTTN | | GQSFPQTTN | | GTAPVLGNYK | | GYSGSFTLPIE | |
| GQSFYRSIN | | GQSFYRSIN | | GTAPVLGNYR | | GYSGSFTLPVE | |
| GQSGRIDFH | | GQSGRIDFH | | GTAQHIEECS | | GYSGSFTLPVG | |
| GQSGRIDFY | | GQSGRIDFY | | GTASLPGMM | | GYSGSFVDYWA | |
| GQSGRIEFH | | GQSGRIEFH | | GTCAVVMTDG | | GYSGSFVQHPE | |
| GQSGRINFH | | GQSGRINFH | | GTCGTGSWPD | | GYSGVFSVEGK | |
| GQSGRISFY | | GQSGRISFY | | GTCIVAVTDG | | GYSLVGIDPFK | |
| GQSGRIVFH | | GQSGRIVFH | | GTCTVVMTDG | | GYSLVGIDPFR | |
| GQSGRVSFY | | GQSGRVSFY | | GTCVAVMTDG | | GYSLVGVDPFK | |
| GQSPNVYQA | | GQSPNVYQA | | GTCVVAVTDG | | GYSTGALASCM | |
| GQSPNVYQS | | GQSPNVYQS | | GTCVVIMTDG | | GYTMDTVNRTH | |
| GQTGRIDFH | | GQTGRIDFH | | GTCVVTVTDG | | GYTMDTVSRTH | |
| GQTIVLNTD | | GQTIVLNTD | | GTCVVVMTDG | | GYVCGKFHSDT | |
| GQTIVSNTD | | GQTIVSNTD | | GTCWEQLYTP | | GYVCSGIFGDN | |
| GQTLRIISN | | GQTLRIISN | | GTCWEQMYTP | | GYVCSGIFGDS | |
| GQTLRIRSN | | GQTLRIRSN | | GTDNYGVKGF | | GYVCSGLVGDT | |
| GQTLRVKSN | | GQTLRVKSN | | GTFDTAQIIK | | GYVCSGVFGDN | |
| GQTLRVRSD | | GQTLRVRSD | | GTFDTIQIIK | | GYVCSKFHSDT | |
| GQTLRVRSN | | GQTLRVRSN | | GTFDTTQIIK | | GYWAIRTRSGG | |
| GQTVKIKTN | | GQTVKIKTN | | GTFDTVQIIK | | HAKDILEKAHN | |
| GQTVKIQTN | | GQTVKIQTN | | GTFDTVQVIK | | HAKDILEKTHN | |
| GQTVKIQTS | | GQTVKIQTS | | GTFEFTSFFY | | HAKNILEKTHN | |
| GQTVVLNTD | | GQTVVLNTD | | GTFGPVHFQN | | HALRELWQCYY | |
| GQVECVCRD | | GQVECVCRD | | GTFGPVHFRN | | HANGTIHDRSP | |
| GQVEGRIQD | | GQVEGRIQD | | GTFGPVHFRS | | HANGTIHDRSQ | |
| GQWDPDGA | | GQWDPDGA | | GTGCFEIFHK | | HANGTINDRSP | |
| GQWNWPDGA | | GQWNWPDGA | | GTGCFEIFHR | | HANGTMHDRSP | |
| GRADTKILF | | GRADTKILF | | GTGCFEILHK | | HANNSKKQIDT | |
| GRADTRILF | | GRADTRILF | | GTGCFELFHK | | HANNSTDTIDT | |
| GRAWLHVCV | | GRAWLHVCV | | GTGIAADKAS | | HANNSTDTVDT | |
| GRCPRYVKQ | | GRCPRYVKQ | | GTGIAADKES | | HANNSTEQVDT | |
| GRDLGIQSE | | GRDLGIQSE | | GTGIAADKTS | | HANNSTETVDT | |
| GRDVLVIWG | | GRDVLVIWG | | GTGIAADKVS | | HANNSTKQIDT | |
| GRDVLVLWG | | GRDVLVLWG | | GTGIAADRDS | | HANNSTKQVDT | |
| GRDVLVMWG | | GRDVLVMWG | | GTGIAADRES | | HANNSTTKVDT | |
| GREDKRYGP | | GREDKRYGP | | GTGIAADRGS | | HANNSTTQIDT | |
| GREWSYIVE | | GREWSYIVE | | GTGIAAEKES | | HANNSTTQVDT | |
| GRFEFIAEE | | GRFEFIAEE | | GTGIVADRDS | | HANNSTTQVNT | |
| GRFTNEEAL | | GRFTNEEAL | | GTGMAADQKS | | HAQDILEKTHN | |
| GRFYIQMCT | | GRFYIQMCT | | GTGMAADRDS | | HAQNILEKTHN | |
| GRFYVQMCT | | GRFYVQMCT | | GTGMRILVRG | | HAQYREEALLN | |
| GRGCFEIYH | | GRGCFEIYH | | GTGNKLITVG | | HASNRPWISFD | |
| GRGIEVVNA | | GRGIEVVNA | | GTGQAADLKS | | HASNRPWVSFD | |
| GRGLFGAIA | | GRGLFGAIA | | GTGQAADYES | | HASNRPWVSFN | |
| GRGLFGAKA | | GRGLFGAKA | | GTGQAADYKS | | HAVANGTKVNT | |
| GRGLGIQSD | | GRGLGIQSD | | GTGRIFQSGI | | HAVENGTSVKT | |
| GRGLGIQSE | | GRGLGIQSE | | GTGRIFQSGV | | HAVPNGTIVKT | |
| GRGLGIQSG | | GRGLGIQSG | | GTGRIFQSRI | | HAVPNGTIVRT | |
| GRGQAADLK | | GRGQAADLK | | GTGSIYIEVL | | HAVPNGTKVNT | |
| GRGRIFQSR | | GRGRIFQSR | | GTGSVYIEVL | | HAVPNGTLVKT | |
| GRGSTLGLD | | GRGSTLGLD | | GTGSWADGAN | | HAVPNGTMVKT | |
| GRGVFEFSD | | GRGVFEFSD | | GTGSWPDGAD | | HAVPNGTVVKT | |

Fig. 83-127

| Block size 8 | SIN | Block size 9 | SIN | Block size 10 | SIN | Block size 11 | SIN |
|---|---|---|---|---|---|---|---|
| GRGVFELSD | | GRGVFELSD | | GTGSWPDGAE | | HAVSNGTKINT | |
| GRGYMFESK | | GRGYMFESK | | GTGSWPDGAN | | HAVSNGTKVNT | |
| GRHANGTIH | | GRHANGTIH | | GTGTAADLKS | | HCINRCFYVEL | |
| GRHANGTIN | | GRHANGTIN | | GTGTGYTMDT | | HCMESIRNNTY | |
| GRHANGTMH | | GRHANGTMH | | GTGYTMDTVN | | HCRATEYIIKG | |
| GRHSNGTIH | | GRHSNGTIH | | GTGYTMDTVS | | HCRATEYIMKG | |
| GRIDFHWLI | | GRIDFHWLI | | GTIAGFIEGG | | HCRATEYMMKG | |
| GRIDFHWLL | | GRIDFHWLL | | GTIASSLPFQ | | HCRIIQNEDIP | |
| GRIDFHWLM | | GRIDFHWLM | | GTIHDRAAFR | | HCSKYHWNLAL | |
| GRIDFHWLV | | GRIDFHWLV | | GTIHDRSPFR | | HCWSFALAQGA | |
| GRIDFHWML | | GRIDFHWML | | GTIHDRSPYR | | HDANVKNLHDQ | |
| GRIFQSGIR | | GRIFQSGIR | | GTIHDRSQFR | | HDANVKNLHEQ | |
| GRIFQSGVR | | GRIFQSGVR | | GTIHDRSQYR | | HDANVRNLHDQ | |
| GRIFQSHIR | | GRIFQSHIR | | GTIHDRTAFR | | HDANVRNLHDR | |
| GRIFQSPIR | | GRIFQSPIR | | GTIHDRTTFR | | HDANVRNLHEQ | |
| GRIFQSRII | | GRIFQSRII | | GTIIGPPQCD | | HDANVRNLHER | |
| GRIFQSRIR | | GRIFQSRIR | | GTIISNLPFQ | | HDFEREGYSLV | |
| GRIIQNEDI | | GRIIQNEDI | | GTIISSLPFQ | | HDGIGRMTICI | |
| GRILKNDLP | | GRILKNDLP | | GTIKDRSPYR | | HDGIGRMTICV | |
| GRILKNNLP | | GRILKNNLP | | GTINDRSPFR | | HDGKAWLHICV | |
| GRILKWEPL | | GRILKWEPL | | GTINSPLPFQ | | HDGKAWLHVCI | |
| GRINYYWTL | | GRINYYWTL | | GTISPRSRSG | | HDGKAWLHVCV | |
| GRIQDLEKY | | GRIQDLEKY | | GTITGPPQCD | | HDGRAWLHVCV | |
| GRIQDLERY | | GRIQDLERY | | GTITSNLPFQ | | HDGVGRMTICI | |
| GRISFYWTI | | GRISFYWTI | | GTITSPLPFQ | | HDGVGRMTICV | |
| GRISIYWTL | | GRISIYWTL | | GTIVKTLTNE | | HDRAAFRGLIS | |
| GRLCNPLNP | | GRLCNPLNP | | GTIVKTLTSE | | HDRICIGYQSN | |
| GRLCNPMNP | | GRLCNPMNP | | GTIVSSLPFQ | | HDRIPHRTLLM | |
| GRLIDFLKD | | GRLIDFLKD | | GTKGFGFLNE | | HDRISHRTLLM | |
| GRLIQNSIT | | GRLIQNSIT | | GTKINTLTER | | HDRSPFRALIS | |
| GRLIQNSLT | | GRLIQNSLT | | GTKQVCAAWS | | HDRSPFRALVS | |
| GRLIQNSMT | | GRLIQNSMT | | GTKQVCIAWS | | HDRSPHRTLLM | |
| GRLMDFLKD | | GRLMDFLKD | | GTKQVCMAWS | | HDRSPYRALIS | |
| GRLTTTIKT | | GRLTTTIKT | | GTKQVCVAWS | | HDRSQFRALIS | |
| GRLVRFRHQ | | GRLVRFRHQ | | GTKRSHEQME | | HDRSQYRALIS | |
| GRMDYYWAI | | GRMDYYWAI | | GTKRSYEQME | | HDRSQYRALVS | |
| GRMDYYWAV | | GRMDYYWAV | | GTKVDTLTEK | | HDRSQYRSLIS | |
| GRMDYYWGI | | GRMDYYWGI | | GTKVNTLTEK | | HDRTAFRGLIS | |
| GRMDYYWTL | | GRMDYYWTL | | GTKVNTLTER | | HDRTAFRGLMS | |
| GRMNYHWTL | | GRMNYHWTL | | GTLIGPPQCD | | HDRTPHRTLLM | |
| GRMNYYWTI | | GRMNYYWTI | | GTMDYYWGIL | | HDRTSHRTLLM | |
| GRMNYYWTL | | GRMNYYWTL | | GTMHDRSPFR | | HDRTTFRGLIS | |
| GRMSDSIKS | | GRMSDSIKS | | GTMKDRSPYR | | HDRTTFRGLLS | |
| GRMTDSIKS | | GRMTDSIKS | | GTNGVKGFSF | | HDSNVENLFDE | |
| GRMTFYWAI | | GRMTFYWAI | | GTNNYGVKGF | | HDSNVKNLFDE | |
| GRMTFYWKI | | GRMTFYWKI | | GTNRPILVIS | | HDSNVKNLYDK | |
| GRMTFYWTI | | GRMTFYWTI | | GTNRPVLIIS | | HDSNVKNLYDR | |
| GRMTFYWTM | | GRMTFYWTM | | GTNRPVLVIS | | HDSNVKNLYEK | |
| GRMTICIQG | | GRMTICIQG | | GTNRPVLVVS | | HDSNVKNLYNK | |
| GRMTICVQG | | GRMTICVQG | | GTPACDLHLT | | HDSNVRNLHEK | |
| GRNCTIPCF | | GRNCTIPCF | | GTPACDLYLT | | HDSNVRNLHER | |
| GRNCTVPCF | | GRNCTVPCF | | GTPDPGVKGF | | HDSNVRNLYDK | |
| GRNPGNAEI | | GRNPGNAEI | | GTPLELRDCK | | HDSNVRSLHEK | |
| GRNSFFSRL | | GRNSFFSRL | | GTPPTVSNSD | | HDSNVTNLHEK | |
| GRNSFYAEL | | GRNSFYAEL | | GTPVCDPHLT | | HECRTFFLTQG | |
| GRPEEAKYV | | GRPEEAKYV | | GTQGVKGWAF | | HEDYKEESQLK | |
| GRPEEVKYV | | GRPEEVKYV | | GTQPLSISVG | | HEDYREESQLK | |
| GRPITEINT | | GRPITEINT | | GTQSLSISIG | | HEEVTNATETV | |
| GRPKEDEVW | | GRPKEDEVW | | GTQSLSISVE | | HEGEGIPLHDA | |
| GRPKEDKVW | | GRPKEDKVW | | GTQSLSISVG | | HEGEGIPLYDA | |
| GRPKEDRVW | | GRPKEDRVW | | GTREWSYLIE | | HENRMVIASTT | |
| GRPKEEKVW | | GRPKEEKVW | | GTRIGDGQRS | | HENRMVLASTT | |

Fig. 83-128

| Block size 8 | SIN | Block size 9 | SIN | Block size 10 | SIN | Block size 11 | SIN |
|---|---|---|---|---|---|---|---|
| GRPTTEINT | | GRPTTEINT | | GTRPGYNGQK | | HENSQGSYAA | |
| GRQEIVDNN | | GRQEIVDNN | | GTRQVCIAWS | | HERVRKQLREN | |
| GRQEKNPAL | | GRQEKNPAL | | GTRQVCMAWS | | HESECVCINGT | |
| GRQEKNPSL | | GRQEKNPSL | | GTRQVCVAWS | | HFEECSCYPSG | |
| GRQTFDWTL | | GRQTFDWTL | | GTRRIDFHWL | | HFEKIKILPRD | |
| GRQTYDWTL | | GRQTYDWTL | | GTRWMKIIRV | | HFEKVKILARN | |
| GRRKTNLYG | | GRRKTNLYG | | GTSGTYGAGS | | HFEKVKILPKD | |
| GRSDKICIG | | GRSDKICIG | | GTSGTYGSGS | | HFEKVKILPRD | |
| GRSHLRNDT | | GRSHLRNDT | | GTSGTYGTGS | | HFEKVRILPKD | |
| GRTFSPRSR | | GRTFSPRSR | | GTSGTYGTGT | | HFESNGNFIAP | |
| GRTINTASR | | GRTINTASR | | GTSIWTSSSS | | HFHRKRRVRDN | |
| GRTIQNEDI | | GRTIQNEDI | | GTSKACNALT | | HFQNQVKIRRR | |
| GRTISEDSR | | GRTISEDSR | | GTSKACNAST | | HFQRKRRIRDN | |
| GRTISIASR | | GRTISIASR | | GTSKACSAST | | HFQRKRRVRDN | |
| GRTISKDLR | | GRTISKDLR | | GTSKIKMKWG | | HFRNQIKIRRR | |
| GRTISKDSR | | GRTISKDSR | | GTSKVKMKWG | | HFRNQVKIRRR | |
| GRTISKDTR | | GRTISKDTR | | GTSSIYIEVL | | HFRSQVKIRRR | |
| GRTISKNSR | | GRTISKNSR | | GTSSVYIEVL | | HGALLNDKHSN | |
| GRTISMDSR | | GRTISMDSR | | GTSSVYVEVL | | HGICAVATTHS | |
| GRTISPHSR | | GRTISPHSR | | GTSVKTLTDN | | HGKIIQNEDIP | |
| GRTISPKLR | | GRTISPKLR | | GTSVWAGRTI | | HGLCYPGELDN | |
| GRTISPRLR | | GRTISPRLR | | GTSVWAGRTV | | HGLCYPGELNN | |
| GRTISPRSR | | GRTISPRSR | | GTTASCQNRG | | HGRIIQNEDIP | |
| GRTISRDSR | | GRTISRDSR | | GTTGNPIICL | | HGRTIQNEDIP | |
| GRTISTASR | | GRTISTASR | | GTTHDRTAFR | | HGSLLNDKHSN | |
| GRTISTRSR | | GRTISTRSR | | GTTIRGKHSN | | HGSLVLSLWMC | |
| GRTKSLESR | | GRTKSLESR | | GTTIRGRHSN | | HGSNRPWISFN | |
| GRTLDLHDA | | GRTLDLHDA | | GTTIRNKHSN | | HGSNRPWLSFN | |
| GRTLDMHDA | | GRTLDMHDA | | GTTIRNRHSN | | HGSNRPWVSFD | |
| GRTLGLHDA | | GRTLGLHDA | | GTTLDNEHSN | | HGSNRPWVSFN | |
| GRTNQQFEL | | GRTNQQFEL | | GTTLDNKHSN | | HGTGSWPDGAN | |
| GRTSDMRAE | | GRTSDMRAE | | GTTLENKHSN | | HGTGTGYTMDT | |
| GRTSDMRTE | | GRTSDMRTE | | GTTLKGRHAN | | HHANNSTEQVD | |
| GRTTSKDSR | | GRTTSKDSR | | GTTLNNKHSN | | HHAVANGTKVN | |
| GRTVSINGR | | GRTVSINGR | | GTTLRGQHAN | | HHAVENGTSVK | |
| GRTVSISGR | | GRTVSISGR | | GTTLRGRHAN | | HHAVPNGTIVK | |
| GRTVSKDSR | | GRTVSKDSR | | GTTLYNKHSN | | HHAVPNGTIVR | |
| GRTVSNSGR | | GRTVSNSGR | | GTTVNEEALR | | HHAVPNGTKVN | |
| GRTVSTSGR | | GRTVSTSGR | | GTVKDRSPFR | | HHAVPNGTLVK | |
| GRVLKNNLP | | GRVLKNNLP | | GTVKDRSPYR | | HHAVPNGTMVK | |
| GRVSFYWTI | | GRVSFYWTI | | GTVSLSPGMM | | HHAVPNGTVVK | |
| GRVTDSIKS | | GRVTDSIKS | | GTVTGPPQCD | | HHAVSNGTKIN | |
| GRVTVSTRS | | GRVTVSTRS | | GTVVKTLTNE | | HHAVSNGTKVN | |
| GRWPGLVAG | | GRWPGLVAG | | GTWAVVMTDG | | HHENSQGSGYA | |
| GRYGVKGFS | | GRYGVKGFS | | GTWDTLIERD | | HHMRKKRGLFG | |
| GRYSIADKI | | GRYSIADKI | | GTWDTLIERE | | HHPSSAQEKND | |
| GRYSKADKI | | GRYSKADKI | | GTWDTLIERG | | HHPSSDNEQTD | |
| GRYSRADKI | | GRYSRADKI | | GTYCSLNGIS | | HHPSSTKEKND | |
| GSAEHIEEC | | GSAEHIEEC | | GTYCSLNGVS | | HHPSSTKEKNE | |
| GSAKHIEEC | | GSAKHIEEC | | GTYDHKDFEE | | HHPSSTQEKND | |
| GSAKHVEEC | | GSAKHVEEC | | GTYDHKDYEE | | HHPSSTQERND | |
| GSANSQAYT | | GSANSQAYT | | GTYDHKEFEE | | HHQNAQGSGYA | |
| GSAQATEEC | | GSAQATEEC | | GTYDHKEFEK | | HHQNEQGSGYA | |
| GSAQHIEEC | | GSAQHIEEC | | GTYDHKEYEE | | HHQNGQGSGYA | |
| GSAQHVEEC | | GSAQHVEEC | | GTYDHNIYRD | | HHSNAEGTGMA | |
| GSARHIEEC | | GSARHIEEC | | GTYDYPKYEE | | HHSNDQGAGYA | |
| GSARHIEEW | | GSARHIEEW | | GTYDYPKYEK | | HHSNDQGSGYA | |
| GSARHVEEC | | GSARHVEEC | | GTYDYPKYSE | | HHSNSEGTGMA | |
| GSASGKADT | | GSASGKADT | | GTYDYPKYSK | | HHSSSLDEQNK | |
| GSASGKAET | | GSASGKAET | | GTYDYSKYEE | | HIAILATTVTL | |
| GSASGQAYT | | GSASGQAYT | | GTYGAGSWPD | | HICIGYHANNS | |
| GSASGRADT | | GSASGRADT | | GTYGKGSWPD | | HICVTGDDRNA | |

Fig. 83-129

| Block size 8 | SIN | Block size 9 | SIN | Block size 10 | SIN | Block size 11 | SIN |
|---|---|---|---|---|---|---|---|
| GSASRKADT | | GSASRKADT | | GTYGSGSWPD | | HIEECPCYGHN | |
| GSASSQAHT | | GSASSQAHT | | GTYGTGSWPD | | HIEECSCYGHD | |
| GSASSQAYT | | GSASSQAYT | | GTYGTGTWPD | | HIEECSCYGHN | |
| GSATGPADT | | GSATGPADT | | GTYKILTIYS | | HIEECSCYGHS | |
| GSATGPAET | | GSATGPAET | | GTYNHEDYKE | | HIEECSCYPND | |
| GSCASKCHT | | GSCASKCHT | | GTYNHEDYRE | | HIEECSCYPNE | |
| GSCAVVMTD | | GSCAVVMTD | | GTYNHKDYEE | | HIEECSCYPNL | |
| GSCESKCHT | | GSCESKCHT | | GTYNHKEYEE | | HIEECSCYPNM | |
| GSCFTIMTD | | GSCFTIMTD | | GTYNNTTGRD | | HIEECSCYPNS | |
| GSCFTLMTD | | GSCFTLMTD | | GTYNRKEYEE | | HIEECSCYPQY | |
| GSCFTVLTD | | GSCFTVLTD | | GTYNYPKYEE | | HIEECSCYPRY | |
| GSCFTVMTD | | GSCFTVMTD | | GTYNYPKYSE | | HIEECSCYSRY | |
| GSCGILGTI | | GSCGILGTI | | GTYQILSIYS | | HIEEWSCYGHS | |
| GSCISKCHT | | GSCISKCHT | | GTYYYPKYEE | | HIEVTNATELV | |
| GSCRCMFCI | | GSCRCMFCI | | GVAIALSILN | | HIFGKDNAIRI | |
| GSCRCTICI | | GSCRCTICI | | GVAIALSVLN | | HIFGKDNAVRI | |
| GSCRFNVCI | | GSCRFNVCI | | GVANLGLNIG | | HIFSFNGEEMA | |
| GSCTSPCLT | | GSCTSPCLT | | GVAPSPSNSR | | HIFSFTGEEMA | |
| GSCTVVMTD | | GSCTVVMTD | | GVAPSPYNSR | | HIFSKDNAIRI | |
| GSCVSKCHT | | GSCVSKCHT | | GVAPVLGNYK | | HIFVIREPFVA | |
| GSCVSRCHT | | GSCVSRCHT | | GVCPVVFTDG | | HIFVIREPFVS | |
| GSDIGFMPK | | GSDIGFMPK | | GVCPVVMTDG | | HIGPLSGSAQH | |
| GSDVWLGRT | | GSDVWLGRT | | GVCYPGSIEN | | HIGVAPSPSNS | |
| GSDVWMGRT | | GSDVWMGRT | | GVCYPGSIKN | | HIHIFSFNGEE | |
| GSECVCING | | GSECVCING | | GVDEYSNAEK | | HIHIFSFTGEE | |
| GSEHTAYSQ | | GSEHTAYSQ | | GVDEYSNAER | | HIIDLADSEMN | |
| GSFCSIDGK | | GSFCSIDGK | | GVDEYSSAER | | HIIDVTDSEMN | |
| GSFCSINGK | | GSFCSINGK | | GVDEYSSTEK | | HILSKDNAIRI | |
| GSFCSINGR | | GSFCSINGR | | GVDEYSSTER | | HILSKDNAVRI | |
| GSFCSLDGK | | GSFCSLDGK | | GVDRFYRICK | | HILVTREPYLS | |
| GSFIDYWAE | | GSFIDYWAE | | GVDRFYRTCK | | HIMIWHSNLND | |
| GSFIDYWAK | | GSFIDYWAK | | GVELSSMGVY | | HIPEAGLKWEL | |
| GSFIDYWDD | | GSFIDYWDD | | GVESAVLRGF | | HIPEVCLKWDL | |
| GSFIDYWDE | | GSFIDYWDE | | GVETMVILSA | | HIPEVCLKWEL | |
| GSFIDYWND | | GSFIDYWND | | GVEVVDATET | | HIPEVCLKWGL | |
| GSFIQHPEL | | GSFIQHPEL | | GVEVVNATET | | HISPLAGSAQH | |
| GSFMDYWAE | | GSFMDYWAE | | GVEYNGKSLG | | HISPLSGSAQH | |
| GSFNDYEEL | | GSFNDYEEL | | GVFEFSDERA | | HITGFAPFSKD | |
| GSFNGAFIA | | GSFNGAFIA | | GVFELSDEKA | | HIVERILEEES | |
| GSFNNYEEL | | GSFNNYEEL | | GVFELSDERA | | HIWVTREPYVS | |
| GSFPDGAKI | | GSFPDGAKI | | GVGIAADKES | | HIYGKDNAIRI | |
| GSFPDGAQI | | GSFPDGAQI | | GVGMAADKES | | HIYGKDNAVRI | |
| GSFPNGAQI | | GSFPNGAQI | | GVGNLAFNTV | | HKCDDDCMASI | |
| GSFSIRGET | | GSFSIRGET | | GVGNLIFNTV | | HKCDDHCMESI | |
| GSFSIRWET | | GSFSIRWET | | GVGNLVFNTV | | HKCDDQCMESI | |
| GSFTLPIEL | | GSFTLPIEL | | GVGRMTICIQ | | HKCDNECMETI | |
| GSFTLPVEL | | GSFTLPVEL | | GVGRMTICVQ | | HKCDNKCMETI | |
| GSFTLPVEM | | GSFTLPVEM | | GVHHPSSDNE | | HKCDNQCMESI | |
| GSFTLPVGL | | GSFTLPVGL | | GVHHPSTDAE | | HKCNDSCMDTI | |
| GSFVDYWAE | | GSFVDYWAE | | GVHHPSTDKE | | HKCNDSCMEAI | |
| GSFVQHPEL | | GSFVQHPEL | | GVHHPSTDTE | | HKCNDSCMETI | |
| GSFVQHPEM | | GSFVQHPEM | | GVHHSSSLDE | | HKCNNECMETI | |
| GSFYRNMRW | | GSFYRNMRW | | GVILEENTTY | | HKCNNSCMETI | |
| GSFYRSIRW | | GSFYRSIRW | | GVINTSKPFQ | | HKCNNTCMETI | |
| GSFYRSMRW | | GSFYRSMRW | | GVIPLTTTPT | | HKDNAIRLGEN | |
| GSGAKLITV | | GSGAKLITV | | GVITDTIKSW | | HKDNAIRLGET | |
| GSGDWPDGS | | GSGDWPDGS | | GVITDTLKSW | | HKDNAIRPGEN | |
| GSGFFPDGP | | GSGFFPDGP | | GVKGFAFKYG | | HKDNALRLAEN | |
| GSGLRILIR | | GSGLRILIR | | GVKGFAFLDE | | HKDNAVRLGEN | |
| GSGLRILVR | | GSGLRILVR | | GVKGFAFLDG | | HKDYEEEAKLE | |
| GSGMRILIR | | GSGMRILIR | | GVKGFAFLDR | | HKEYEEEAKLE | |
| GSGMRILVR | | GSGMRILVR | | GVKGFAFLNG | | HKGNSARLIHH | |

Fig. 83-130

| Block size 8 | SIN | Block size 9 | SIN | Block size 10 | SIN | Block size 11 | SIN |
|---|---|---|---|---|---|---|---|
| GSGNKLITV | | GSGNKLITV | | GVKGFAYLDG | | HKICIGYHANN | |
| GSGNKLVTV | | GSGNKLVTV | | GVKGFGFKAG | | HKILTIYSTVA | |
| GSGNWPDGA | | GSGNWPDGA | | GVKGFGFKKG | | HKMESRGLFGA | |
| GSGNWPDGP | | GSGNWPDGP | | GVKGFGFKSG | | HKQLTHHMRKK | |
| GSGNWPDGS | | GSGNWPDGS | | GVKGFGFKTG | | HKSCLPACAYG | |
| GSGRIFQSG | | GSGRIFQSG | | GVKGFGFKVG | | HKSCLPACIYG | |
| GSGSFPDGA | | GSGSFPDGA | | GVKGFGFLDG | | HKSCLPACVYG | |
| GSGSFPNGA | | GSGSFPNGA | | GVKGFGFLDN | | HKSQLIWMACH | |
| GSGSKLITV | | GSGSKLITV | | GVKGFGFLDS | | HKSQLVWMACH | |
| GSGSWPDGA | | GSGSWPDGA | | GVKGFGFLNG | | HKSQLVWMACN | |
| GSGTDNYGV | | GSGTDNYGV | | GVKGFGFLSG | | HLEECSCYMDI | |
| GSGTNNYGV | | GSGTNNYGV | | GVKGFGFRQG | | HLEECSCYPSG | |
| GSGWLTLGI | | GSGWLTLGI | | GVKGFSFKYG | | HLEECSCYVDI | |
| GSGYAADKA | | GSGYAADKA | | GVKGFSFRYG | | HLEECSCYVDT | |
| GSGYAADKE | | GSGYAADKE | | GVKGFSYKYD | | HLEECSCYVDV | |
| GSGYAADKK | | GSGYAADKK | | GVKGFSYKYG | | HLEFKADLIIE | |
| GSGYAADLK | | GSGYAADLK | | GVKGFSYLDG | | HLEICFMYSDF | |
| GSGYAADQE | | GSGYAADQE | | GVKGFSYLNG | | HLEVCFMYSDF | |
| GSGYAADQK | | GSGYAADQK | | GVKGFSYRYG | | HLFSGIKSFSR | |
| GSGYAADRE | | GSGYAADRE | | GVKGWAFDDG | | HLFSGIRSFSR | |
| GSGYAADRK | | GSGYAADRK | | GVKGWAFDNE | | HLFSGVNSFSR | |
| GSGYAANKE | | GSGYAANKE | | GVKGWAFDNG | | HLGDCNFEGWI | |
| GSHGVKGWA | | GSHGVKGWA | | GVKGWAFDSG | | HLGDCRFEGWI | |
| GSIAHKSCL | | GSIAHKSCL | | GVKGWAFDYG | | HLGDCSFEGWI | |
| GSIENLEEL | | GSIENLEEL | | GVKLAQGYKD | | HLGTKQVCAAW | |
| GSIENQEEL | | GSIENQEEL | | GVKLEENSTY | | HLGTKQVCIAW | |
| GSIGKVCRA | | GSIGKVCRA | | GVKLEENTSY | | HLGTKQVCMAW | |
| GSIGKVCRT | | GSIGKVCRT | | GVKLEENTTY | | HLGTKQVCVAW | |
| GSIISFCGV | | GSIISFCGV | | GVKLIQGYKD | | HLGTRQVCIAW | |
| GSIITELPF | | GSIITELPF | | GVKLSNMGIY | | HLGTRQVCMAW | |
| GSIKNQEEL | | GSIKNQEEL | | GVKLSNMGVY | | HLGTRQVCVAW | |
| GSIKTKLPF | | GSIKTKLPF | | GVKLSSMGIY | | HLIIWGIHHPS | |
| GSINTKLPF | | GSINTKLPF | | GVKLSSMGVY | | HLIMWGIHHPS | |
| GSINTRLPF | | GSINTRLPF | | GVKLTQGYKD | | HLITGKSHGRI | |
| GSIPNDKPF | | GSIPNDKPF | | GVKMNPNQKI | | HLITGKSHGRV | |
| GSIPNEKPF | | GSIPNEKPF | | GVKPLILKDC | | HLITWGIHHPS | |
| GSIPNGKPF | | GSIPNGKPF | | GVKPLILRDC | | HLIVWGIHHPS | |
| GSIPNNKPF | | GSIPNNKPF | | GVKPLILRNC | | HLKDQAWSYIV | |
| GSIQSDKPF | | GSIQSDKPF | | GVKVDGSSSA | | HLKDQDWSYIV | |
| GSIRNETYD | | GSIRNETYD | | GVLEDEQMYQ | | HLKDQGWSYIV | |
| GSIRNGTYD | | GSIRNGTYD | | GVLLGTKHSN | | HLKDQSWSYIV | |
| GSIRNGTYN | | GSIRNGTYN | | GVLTDTSRPG | | HLKFKADLIIE | |
| GSISLTIAA | | GSISLTIAA | | GVLTDTSRPK | | HLMIWHSNLND | |
| GSISNDKPF | | GSISNDKPF | | GVLTDTSRPS | | HLRDQGWSYIV | |
| GSIYIEVLH | | GSIYIEVLH | | GVMNTSKPFQ | | HLRNDTDVVNF | |
| GSKEQLGSW | | GSKEQLGSW | | GVMNTSKPLQ | | HLRNDTDVVNY | |
| GSKERLGSW | | GSKERLGSW | | GVNDRNFWRG | | HLSSVSSFERF | |
| GSKGDIFVI | | GSKGDIFVI | | GVNESADMSI | | HLTDSEMNKLF | |
| GSKGDIFVM | | GSKGDIFVM | | GVNRFYRTCK | | HLTGIWDTLIE | |
| GSKGDVFVI | | GSKGDVFVI | | GVNSFSRTEL | | HLTGMWDTLIE | |
| GSKGDVFVM | | GSKGDVFVM | | GVNTNKTFQN | | HLTGTWDTLIE | |
| GSKGHVFVI | | GSKGHVFVI | | GVPESMREEY | | HLTQGACWEQL | |
| GSKKRLGSW | | GSKKRLGSW | | GVPFHLATKQ | | HLTQGTCWEQL | |
| GSLEFIAEQ | | GSLEFIAEQ | | GVPFHLGTKQ | | HLTQGTCWEQM | |
| GSLHGRICI | | GSLHGRICI | | GVPFHLGTRQ | | HLTTGKSHGRI | |
| GSLKLAIGL | | GSLKLAIGL | | GVPFYLGTKQ | | HLVMWGIHHPS | |
| GSLKLAIGP | | GSLKLAIGP | | GVPKSMREEY | | HLVTGKSHGRI | |
| GSLKLATGM | | GSLKLATGM | | GVPPLELGDC | | HMAIIKKYTSA | |
| GSLLLATGM | | GSLLLATGM | | GVPTDVIRSW | | HMAIIKKYTSG | |
| GSLLNDKHF | | GSLLNDKHF | | GVPTDVVRSW | | HMAIIKRYTSG | |
| GSLLNDKHS | | GSLLNDKHS | | GVPVTSSIDL | | HMEVCFMYSDF | |
| GSLLNDRHS | | GSLLNDRHS | | GVPVTSSVDL | | HMMIWHSNLND | |

Fig. 83-131

| Block size 8 | SIN | Block size 9 | SIN | Block size 10 | SIN | Block size 11 | SIN |
|---|---|---|---|---|---|---|---|
| GSLMLATGM | | GSLMLATGM | | GVQAGVDRFY | | HMRKKRGLFGA | |
| GSLNDYEEL | | GSLNDYEEL | | GVQDIIDNDN | | HNGGLIAPDRV | |
| GSLNFVSME | | GSLNFVSME | | GVQDIIDNNN | | HNGGLIAPNRV | |
| GSLQCKICI | | GSLQCKICI | | GVQMQRFRRP | | HNGGLIAPSRV | |
| GSLQCRICI | | GSLQCRICI | | GVRCICRDNW | | HNGGLIAPTRV | |
| GSLQCRICM | | GSLQCRICM | | GVREWSYLIE | | HNGGLVAPSRV | |
| GSLQCRVCI | | GSLQCRVCI | | GVRIGSKGDV | | HNGGRIAPSRV | |
| GSLQCTICI | | GSLQCTICI | | GVRLEENTTY | | HNGICPVAFTD | |
| GSLRCRICI | | GSLRCRICI | | GVRLTQGYKD | | HNGICPVVFTD | |
| GSLRLATGM | | GSLRLATGM | | GVRPGYNGQK | | HNGKLCKLNGI | |
| GSLSLAIMI | | GSLSLAIMI | | GVRPGYNGQR | | HNGKLCRLRGI | |
| GSLSLAIMM | | GSLSLAIMM | | GVRPLILKDC | | HNGKLCRLSGI | |
| GSLSLAIMV | | GSLSLAIMV | | GVRPLILRDC | | HNGTCAVVMTD | |
| GSMQCKICI | | GSMQCKICI | | GVRPRYNGQR | | HNGTCVVIMTD | |
| GSMQCNVCI | | GSMQCNVCI | | GVSFHLGTKQ | | HNGTCVVVMTD | |
| GSMQCRICI | | GSMQCRICI | | GVSGADDDAY | | HNGTWAVVMTD | |
| GSMQCRVCI | | GSMQCRVCI | | GVSGADNDAY | | HNGVCPVVFTD | |
| GSNIGFMPK | | GSNIGFMPK | | GVSGEVPGWS | | HNIHPLAIGEC | |
| GSNRPIIDI | | GSNRPIIDI | | GVSGINESAD | | HNIHPLTIGEC | |
| GSNRPIVDI | | GSNRPIVDI | | GVSGPDNGAV | | HNIHPLTIGKC | |
| GSNRPVIDI | | GSNRPVIDI | | GVSGTDDDAY | | HNILRTQESEC | |
| GSNRPVIDV | | GSNRPVIDV | | GVSGVNESAD | | HNIYRDEAINN | |
| GSNRPVIQI | | GSNRPVIQI | | GVSILNLGQK | | HNNEQGSGYAA | |
| GSNRPVIRI | | GSNRPVIRI | | GVSILNLGQR | | HNQEYTSGRQE | |
| GSNRPVLDI | | GSNRPVLDI | | GVSPIHLGDC | | HNSTCVVVMTD | |
| GSNRPVVDI | | GSNRPVVDI | | GVSPVHLGDC | | HNVHPLAIGEC | |
| GSNRPWIRF | | GSNRPWIRF | | GVSSEAPGWS | | HNVHPLTIGEC | |
| GSNRPWIRI | | GSNRPWIRI | | GVSSEVPGCT | | HPATIGECPKY | |
| GSNRPWISF | | GSNRPWISF | | GVSSEVPGWS | | HPFTIGECPKY | |
| GSNRPWLSF | | GSNRPWLSF | | GVSVLNLGQK | | HPFTIGECPRY | |
| GSNRPWMRI | | GSNRPWMRI | | GVTASCLDKG | | HPGIFENSCIE | |
| GSNRPWVRI | | GSNRPWVRI | | GVTASCLDRG | | HPGIFENSCLE | |
| GSNRPWVRM | | GSNRPWVRM | | GVTASCRDNG | | HPGIFESSCLE | |
| GSNRPWVSF | | GSNRPWVSF | | GVTLSVVSLL | | HPGIFGNSCLE | |
| GSPDPGVKG | | GSPDPGVKG | | GVTNKVNSII | | HPGLFENSCLE | |
| GSPFPVGSG | | GSPFPVGSG | | GVTRREIHIY | | HPITIGECPKY | |
| GSPGAPGVK | | GSPGAPGVK | | GVTRREVHIY | | HPLAIGECPKY | |
| GSPGCDRLQ | | GSPGCDRLQ | | GVTRREVHMY | | HPLTIGECPKY | |
| GSPGVKGWA | | GSPGVKGWA | | GVTRREVHTY | | HPLTIGECPRY | |
| GSPISVGSG | | GSPISVGSG | | GVTRREVHVY | | HPLTIGKCPKY | |
| GSPLELRDC | | GSPLELRDC | | GVTTHYVSQI | | HPLTMGECPKY | |
| GSPLVLDDC | | GSPLVLDDC | | GVTVIKNNMI | | HPNAGKDPKKT | |
| GSPPIVSNS | | GSPPIVSNS | | GVTVIKNNMV | | HPRGLLEVGTR | |
| GSPPMVSNS | | GSPPMVSNS | | GVTVIRNNMI | | HPSAGKDPKKT | |
| GSPPVVSNS | | GSPPVVSNS | | GVVNTALSTI | | HPSAGRDPKKT | |
| GSPSAPGVK | | GSPSAPGVK | | GVVNTILSTK | | HPSSAQEKNDL | |
| GSPVPVGSG | | GSPVPVGSG | | GVVNTTLSTI | | HPSSDNEQTDL | |
| GSPVSVGSG | | GSPVSVGSG | | GVWIGRTKSA | | HPSSTKEKNDL | |
| GSQGVKGWA | | GSQGVKGWA | | GVWIGRTKSI | | HPSSTKEKNEL | |
| GSQKQEFKM | | GSQKQEFKM | | GVWIGRTKSL | | HPSSTQEKNAL | |
| GSRERLGSW | | GSRERLGSW | | GVWIGRTKSN | | HPSSTQEKNDL | |
| GSRGEVFVI | | GSRGEVFVI | | GVWIGRTKSP | | HPSTGKDPKKT | |
| GSRGHIFVI | | GSRGHIFVI | | GVWIGRTKST | | HPVTIGECPKY | |
| GSRGHVFVI | | GSRGHVFVI | | GVWMGRTKSN | | HPVTIGKCPKY | |
| GSRINMINS | | GSRINMINS | | GVWTYNAELL | | HQCDNNCIESI | |
| GSRPRVRNQ | | GSRPRVRNQ | | GVYINTALLN | | HQGTTIRNKHS | |
| GSSEQAAEA | | GSSEQAAEA | | GVYINTAMLN | | HQGTTIRNRHS | |
| GSSFYAELK | | GSSFYAELK | | GVYKALSIYS | | HQIEKEFEQVE | |
| GSSFYAEMK | | GSSFYAEMK | | GVYMNTALLN | | HQIEKEFGQVE | |
| GSSGIMKTE | | GSSGIMKTE | | GVYNNTTGRD | | HQIEKEFSEIE | |
| GSSGIMKTG | | GSSGIMKTG | | GVYQILAIYA | | HQIEKEFSEVE | |
| GSSGVMKTE | | GSSGVMKTE | | GVYQILAIYS | | HQIEKEFTEVE | |

Fig. 83-132

| Block size 8 | SIN | Block size 9 | SIN | Block size 10 | SIN | Block size 11 | SIN |
|---|---|---|---|---|---|---|---|
| GSSIAFCGV | | GSSIAFCGV | | GVYQILSIYS | | HQIGNVINWTK | |
| GSSISFCGV | | GSSISFCGV | | GVYQILVIYA | | HQILAIYSTVA | |
| GSSKYQQSF | | GSSKYQQSF | | GVYVNTALLN | | HQLLRHFQKDA | |
| GSSKYRQSF | | GSSKYRQSF | | GWAIHTKDNS | | HQLLRHFQKNA | |
| GSSPNAYQA | | GSSPNAYQA | | GWAIYSKDNG | | HQLRDNAKELG | |
| GSSSACLRG | | GSSSACLRG | | GWAIYSKDNS | | HQLRENAEDKG | |
| GSSSFYAEM | | GSSSFYAEM | | GWAIYTKDNS | | HQNAEGIGIAA | |
| GSSTYHNSF | | GSSTYHNSF | | GWAPLSKDNG | | HQNAEGTGIAA | |
| GSSTYQNNF | | GSSTYQNNF | | GWATANSKSQ | | HQNAEGTGMAA | |
| GSSTYQNSF | | GSSTYQNSF | | GWCGMIDGWY | | HQNAEGTGTAA | |
| GSSTYQSNF | | GSSTYQSNF | | GWEGLIDGWY | | HQNAQGEGIAA | |
| GSSYVCSGL | | GSSYVCSGL | | GWEGLINGWY | | HQNAQGEGTAA | |
| GSTLGLDIR | | GSTLGLDIR | | GWEGLVDGWY | | HQNAQGIGQAA | |
| GSTLPRRSG | | GSTLPRRSG | | GWEGMIDGWY | | HQNAQGQGTAA | |
| GSTQKAIDN | | GSTQKAIDN | | GWEGMMDGWY | | HQNAQGSGYAA | |
| GSTVNEEAL | | GSTVNEEAL | | GWEGMVDGWY | | HQNAQGTGQAA | |
| GSVAHKSCL | | GSVAHKSCL | | GWEGMVNGWY | | HQNDQGTGQAA | |
| GSVENLEEL | | GSVENLEEL | | GWIDSPNHAK | | HQNEQGMGMAA | |
| GSVENQEEL | | GSVENQEEL | | GWILGNPKCD | | HQNEQGSGYAA | |
| GSVNTVLSI | | GSVNTVLSI | | GWILGNPMCD | | HQNEQGTGIAA | |
| GSVSLIIAT | | GSVSLIIAT | | GWILGNPQCD | | HQNEQGVGIAA | |
| GSVSLTIAI | | GSVSLTIAI | | GWILGNPRCD | | HQNEQGVGMAA | |
| GSVSLTIAT | | GSVSLTIAT | | GWILGNPRCG | | HQNGQGSGYAA | |
| GSVSLTITT | | GSVSLTITT | | GWINSPNHAK | | HQNSEGTGIAA | |
| GSVYIEVLH | | GSVYIEVLH | | GWINSPNHVK | | HQNSEGTGIVA | |
| GSWADGANI | | GSWADGANI | | GWINSPSQAK | | HQNSEGTGTAA | |
| GSWPDGADI | | GSWPDGADI | | GWITIGISGP | | HQNSQGEGTAA | |
| GSWPDGADL | | GSWPDGADL | | GWIVGNPSCA | | HQNTQGEGTAA | |
| GSWPDGAEI | | GSWPDGAEI | | GWLLGNPECD | | HRCDDQCMESI | |
| GSWPDGANF | | GSWPDGANF | | GWLLGNPKCD | | HRDEEGTGIAA | |
| GSWPDGANI | | GSWPDGANI | | GWLLGNPLCD | | HRFEIIEGRDR | |
| GSWPDGANV | | GSWPDGANV | | GWLLGNPMCD | | HRLCYPGELDN | |
| GSWPDGRTS | | GSWPDGRTS | | GWLTIGISGP | | HRLKITENSFE | |
| GSWSHNILR | | GSWSHNILR | | GWLTIGITGP | | HRNAIGDCPKY | |
| GSWSQNILR | | GSWSQNILR | | GWLTLGITGP | | HRNEEGTGIAA | |
| GSWSWHDGA | | GSWSWHDGA | | GWMDYYWGIL | | HRNEEGTGVAA | |
| GSYFFGDNA | | GSYFFGDNA | | GWPGLINGWY | | HRNTFGDCPKY | |
| GSYGTGSWP | | GSYGTGSWP | | GWPGLVAGWY | | HRNTIGDCPKY | |
| GSYNNTNGE | | GSYNNTNGE | | GWPWPDGALL | | HRNTIGNCPKY | |
| GSYNNTSGE | | GSYNNTSGE | | GWQGLIDGWY | | HRTLLMNEIGV | |
| GSYRCMFCI | | GSYRCMFCI | | GWQGLVDGWY | | HRTLLMNELGI | |
| GSYVRLYLW | | GSYVRLYLW | | GWQGMIDGWY | | HRTLLMNELGV | |
| GTAADLKST | | GTAADLKST | | GWQGMVDGWY | | HRTLLMSELGV | |
| GTAADYKST | | GTAADYKST | | GWSATACHDG | | HSDNADKICLG | |
| GTAALSPGM | | GTAALSPGM | | GWSGLIAGWY | | HSDTPRPADPS | |
| GTACFEIFH | | GTACFEIFH | | GWSGLVAGWY | | HSDTPRPDDPS | |
| GTAKHIEEC | | GTAKHIEEC | | GWSGMIDGWY | | HSDTPRPSDPS | |
| GTAPILGNY | | GTAPILGNY | | GWSSTSCHDG | | HSDTPRPTDPS | |
| GTAPVLGNY | | GTAPVLGNY | | GWSSTTCHDG | | HSDTPRPVDPS | |
| GTASLPGM | | GTASLPGM | | GWSWDDGAIL | | HSEECSCYVDI | |
| GTCAVVMTD | | GTCAVVMTD | | GWSWGDGAIL | | HSGICPVVFTD | |
| GTCGTGSWP | | GTCGTGSWP | | GWSWPDGALL | | HSGVCPVVFTD | |
| GTCIVAVTD | | GTCIVAVTD | | GWSYIVERPS | | HSKDNGIRIGS | |
| GTCTAVMTD | | GTCTAVMTD | | GWTGLIDGWY | | HSKDNNIRIGS | |
| GTCTVVLTD | | GTCTVVLTD | | GWTGMIDGWY | | HSKDNSIRIGS | |
| GTCTVVMTD | | GTCTVVMTD | | GWTGMVDGWY | | HSKEQGSGYAA | |
| GTCVAVMTD | | GTCVAVMTD | | GWTGMVNGWY | | HSMSDIEAMAS | |
| GTCVVAVTD | | GTCVVAVTD | | GWTIANSKSQ | | HSMSGFRSNLP | |
| GTCVVIMTD | | GTCVVIMTD | | GWTSNSIVVF | | HSNAEGTGMAA | |
| GTCVVTVTD | | GTCVVTVTD | | GWTTANSKSK | | HSNDQGAGYAA | |
| GTCVVVMTD | | GTCVVVMTD | | GWTTANSKSQ | | HSNDQGSGYAA | |
| GTCWEQLYT | | GTCWEQLYT | | GWVAVAKDNA | | HSNEQGSGYAA | |

Fig. 83-133

| Block size 8 | SIN | Block size 9 | SIN | Block size 10 | SIN | Block size 11 | SIN |
|---|---|---|---|---|---|---|---|
| GTCWEQMYT | | GTCWEQMYT | | GWVSTDKDSN | | HSNETVKDRSP | |
| GTDNYGVKG | | GTDNYGVKG | | GWVSTDKNSN | | HSNGQGSGYAA | |
| GTFDIEGLY | | GTFDIEGLY | | GWVSTDKSSN | | HSNGTAKDRSP | |
| GTFDIGGLY | | GTFDIGGLY | | GWVVIAKDNA | | HSNGTIHDRAA | |
| GTFDLEGLY | | GTFDLEGLY | | GWVVIAQDNA | | HSNGTIHDRSQ | |
| GTFDLGGLY | | GTFDLGGLY | | GWVVIEKDNA | | HSNGTIHDRTA | |
| GTFDTAQII | | GTFDTAQII | | GWVVVAKDNA | | HSNGTIHDRTT | |
| GTFDTIQII | | GTFDTIQII | | GWYGFHHSNA | | HSNGTIKDRSP | |
| GTFDTTQII | | GTFDTTQII | | GWYGFHHSNE | | HSNGTMKDRSP | |
| GTFDTVQII | | GTFDTVQII | | GWYGFHHSNS | | HSNGTTHDRTA | |
| GTFDTVQVI | | GTFDTVQVI | | GWYGFKHQNA | | HSNGTVKDRSP | |
| GTFEFTSFF | | GTFEFTSFF | | GWYGFQHQNA | | HSNGTVNDRSP | |
| GTFGPVHFQ | | GTFGPVHFQ | | GWYGFQHQNE | | HSNLNDATYQR | |
| GTFGPVHFR | | GTFGPVHFR | | GWYGFQHQNS | | HSNLNDTTYQR | |
| GTGAWPDGA | | GTGAWPDGA | | GWYGFQHRND | | HSNNTVKDRSP | |
| GTGCFEIFH | | GTGCFEIFH | | GWYGFQHRNE | | HSNSEGTGMAA | |
| GTGIAADKA | | GTGIAADKA | | GWYGFQHSNA | | HSNSTTHDRTA | |
| GTGIAADKE | | GTGIAADKE | | GWYGFQHSND | | HSQYREEALLN | |
| GTGIAADKT | | GTGIAADKT | | GWYGFQHSNE | | HSRGLFGAIAG | |
| GTGIAADKV | | GTGIAADKV | | GWYGFQHTND | | HSSGTVKDRSP | |
| GTGIAADRD | | GTGIAADRD | | GWYGFRHHNS | | HSSSLDEQNKL | |
| GTGIAADRE | | GTGIAADRE | | GWYGFRHLNS | | HSWIPKRNRSI | |
| GTGIAADRG | | GTGIAADRG | | GWYGFRHQKA | | HSWTPKRNRSI | |
| GTGIAAEKE | | GTGIAAEKE | | GWYGFRHQNA | | HSWVPILNTSQ | |
| GTGIVADRD | | GTGIVADRD | | GWYGFRHQNS | | HSWVPKRNRSI | |
| GTGMAADQK | | GTGMAADQK | | GWYGFRHQNT | | HTAYSQITNGT | |
| GTGMAADRD | | GTGMAADRD | | GWYGFRYQNS | | HTDELCPSPLK | |
| GTGMRILVR | | GTGMRILVR | | GWYGYHHENS | | HTEYRQEALQN | |
| GTGNKLITV | | GTGNKLITV | | GWYGYHHNNE | | HTGNPVICLGH | |
| GTGQAADLK | | GTGQAADLK | | GWYGYHHQNE | | HTGSFCSIDGK | |
| GTGQAADYE | | GTGQAADYE | | GWYGYHHQNG | | HTGSFCSINGK | |
| GTGQAADYK | | GTGQAADYK | | GWYGYHHSKE | | HTGSFCSLDGK | |
| GTGRIFQSG | | GTGRIFQSG | | GWYGYHHSND | | HTGTFCSINGK | |
| GTGRIFQSR | | GTGRIFQSR | | GWYGYHHSNE | | HTGTYCSLNGI | |
| GTGSIYIEV | | GTGSIYIEV | | GWYGYHHSNG | | HTGTYCSLNGV | |
| GTGSVYIEV | | GTGSVYIEV | | GWYGYKHQNA | | HTIDLADSEMD | |
| GTGSWPDGA | | GTGSWPDGA | | GWYGYRHQNA | | HTIDLADSEML | |
| GTGTAADLK | | GTGTAADLK | | GYAADKASTQ | | HTIDLADSEMN | |
| GTGTGYTMD | | GTGTGYTMD | | GYAADKESTQ | | HTIDLADSEMS | |
| GTGTWPDGA | | GTGTWPDGA | | GYAADKKSTQ | | HTIDLTDSEMN | |
| GTGYTMDTV | | GTGYTMDTV | | GYAADLKSTQ | | HTIDLTDSEMS | |
| GTHGTGSWP | | GTHGTGSWP | | GYAADQESTQ | | HTIDLTNSEMN | |
| GTIAGFIEG | | GTIAGFIEG | | GYAADQKSTQ | | HTIDMADSEML | |
| GTIASSLPF | | GTIASSLPF | | GYAADRESTQ | | HTIDMADSTML | |
| GTIHDRAAF | | GTIHDRAAF | | GYAADRKSTQ | | HTIDMTDSEMN | |
| GTIHDRSPF | | GTIHDRSPF | | GYAEGQESPP | | HTIDSTDSEMN | |
| GTIHDRSPY | | GTIHDRSPY | | GYAQTDCVLE | | HTIDVTDSEMD | |
| GTIHDRSQF | | GTIHDRSQF | | GYCFTVMTDG | | HTIDVTDSEMN | |
| GTIHDRSQY | | GTIHDRSQY | | GYDFEKEGYS | | HTIDVTDSEMS | |
| GTIHDRTAF | | GTIHDRTAF | | GYDFEREGYS | | HTIEMTDSEML | |
| GTIHDRTTF | | GTIHDRTTF | | GYEILKVPNA | | HTIHLTDSEMN | |
| GTIIGPPQC | | GTIIGPPQC | | GYEMLKVPDA | | HTQYREEALLN | |
| GTIIKTLTN | | GTIIKTLTN | | GYEMLKVPNA | | HTRGLFGAIAG | |
| GTIISNLPF | | GTIISNLPF | | GYETFKVIGG | | HTSQYICSPVL | |
| GTIISSLPF | | GTIISSLPF | | GYETFRVIDG | | HTSQYLCTGIL | |
| GTIKDRSPY | | GTIKDRSPY | | GYETFRVIGG | | HTSQYLCTGVL | |
| GTINDRSPF | | GTINDRSPF | | GYETFRVISG | | HTSRYVCTGIL | |
| GTINSPLPF | | GTINSPLPF | | GYEVLKVPDA | | HTTINNITNVV | |
| GTISPRSRS | | GTISPRSRS | | GYEVLKVPNA | | HVCITGDDRNA | |
| GTITGPPQC | | GTITGPPQC | | GYGVKGFGFR | | HVCVTGDDGNA | |
| GTITSNLPF | | GTITSNLPF | | GYHANNSKKQ | | HVCVTGDDKNA | |
| GTITSPLPF | | GTITSPLPF | | GYHANNSTDT | | HVCVTGDDRNA | |

Fig. 83-134

| Block size 8 | SIN | Block size 9 | SIN | Block size 10 | SIN | Block size 11 | SIN |
|---|---|---|---|---|---|---|---|
| GTIVKTLTD | | GTIVKTLTD | | GYHANNSTEH | | HVDTIMEKNVT | |
| GTIVKTLTN | | GTIVKTLTN | | GYHANNSTEK | | HVEECSCYPRF | |
| GTIVKTLTS | | GTIVKTLTS | | GYHANNSTEQ | | HVEECSCYPRS | |
| GTIVSSLPF | | GTIVSSLPF | | GYHANNSTER | | HVEECSCYPRY | |
| GTKGFGFLN | | GTKGFGFLN | | GYHANNSTET | | HVEVVSAKELV | |
| GTKINTLTE | | GTKINTLTE | | GYHANNSTKQ | | HVFIIREPFVS | |
| GTKQVCAAW | | GTKQVCAAW | | GYHANNSTTK | | HVFVIREPFIS | |
| GTKQVCIAW | | GTKQVCIAW | | GYHANNSTTQ | | HVFVIREPFVA | |
| GTKQVCMAW | | GTKQVCMAW | | GYHANNSTVQ | | HVFVIREPFVS | |
| GTKQVCVAW | | GTKQVCVAW | | GYHFEECSCY | | HVLVTREPYLS | |
| GTKRSHEQM | | GTKRSHEQM | | GYHHENSQGS | | HVRKRFADQEL | |
| GTKRSYEQM | | GTKRSYEQM | | GYHHQNAQGS | | HVSPLSGSAQH | |
| GTKVDTLTE | | GTKVDTLTE | | GYHHQNEQGS | | HWMLLDPGDTV | |
| GTKVNTLAE | | GTKVNTLAE | | GYHHQNGQGS | | HWNLALDIVDS | |
| GTKVNTLTE | | GTKVNTLTE | | GYHHSNDQGA | | HWPDGSNIGFM | |
| GTLIGPPQC | | GTLIGPPQC | | GYHHSNDQGS | | HYEECSCYPDA | |
| GTLNRLIDK | | GTLNRLIDK | | GYHSNNSTEK | | HYEECSCYPDS | |
| GTMDYYWGI | | GTMDYYWGI | | GYHSNNSTKK | | HYEECSCYPNA | |
| GTMHDRSPF | | GTMHDRSPF | | GYICSGFFGD | | HYGGIPTDVVR | |
| GTMKDRSPY | | GTMKDRSPY | | GYICSGIFGD | | HYGGMPTDVVR | |
| GTMVKTLAD | | GTMVKTLAD | | GYICSGVFGD | | HYGGVPTDVIR | |
| GTMVKTLTD | | GTMVKTLTD | | GYICSKFHSD | | HYGGVPTDVMR | |
| GTMVKTLTG | | GTMVKTLTG | | GYIEGKLSQM | | HYGGVPTDVVR | |
| GTNGVKGFS | | GTNGVKGFS | | GYIIEEYGKG | | HYIGKCPKYIP | |
| GTNNYGVKG | | GTNNYGVKG | | GYIIEEYGRG | | HYIGKCPKYIS | |
| GTNRPILVI | | GTNRPILVI | | GYIIEKYGSG | | HYIGKCPRYIP | |
| GTNRPVLII | | GTNRPVLII | | GYIIEKYGTG | | HYKISKSTKST | |
| GTNRPVLVI | | GTNRPVLVI | | GYKDIILWFS | | HYREEALLNRL | |
| GTNRPVLVV | | GTNRPVLVV | | GYKDIILWIS | | HYVCSGLVGDT | |
| GTPACDLHL | | GTPACDLHL | | GYKDIILWVS | | IAADKASTQKA | |
| GTPACDLYL | | GTPACDLYL | | GYKDVIIWFS | | IAADKESTQKA | |
| GTPDPGVKG | | GTPDPGVKG | | GYKDVILWFS | | IAADKTSTQKA | |
| GTPLELRDC | | GTPLELRDC | | GYKDWFLWIS | | IAADKVSTQKA | |
| GTPPTVSNS | | GTPPTVSNS | | GYKDWILWIS | | IAADYKSTQSA | |
| GTPTLNQRS | | GTPTLNQRS | | GYKDWVLWIS | | IAAEKESTQKA | |
| GTPVCDPHL | | GTPVCDPHL | | GYKEVILWFS | | IAARNIVRRAA | |
| GTQGVKGWA | | GTQGVKGWA | | GYKHQNAQGE | | IAARNIVRRAI | |
| GTQPLSISV | | GTQPLSISV | | GYKMNIQILI | | IAARNIVRRAT | |
| GTQSLSISI | | GTQSLSISI | | GYKMNNQILI | | IAARSIVRRAT | |
| GTQSLSISV | | GTQSLSISV | | GYKMNTKILV | | IAASYKRIRLF | |
| GTREWSYLI | | GTREWSYLI | | GYKMNTQILI | | IADAQHRSHRQ | |
| GTRIGDGQR | | GTRIGDGQR | | GYKMNTQILV | | IADKICIGYLS | |
| GTRPGYNGQ | | GTRPGYNGQ | | GYKMNTRILI | | IADRVDDAVTD | |
| GTRQVCIAW | | GTRQVCIAW | | GYKNWILWIS | | IADSHHRSHRQ | |
| GTRQVCMAW | | GTRQVCMAW | | GYLCAGIPSD | | IADSQHKSHRQ | |
| GTRQVCVAW | | GTRQVCVAW | | GYLCAGIPTD | | IADSQHRSHRQ | |
| GTRRIDFHW | | GTRRIDFHW | | GYLCAGLPSD | | IAEQFTWNGVK | |
| GTRVNTLTE | | GTRVNTLTE | | GYLIRALTLN | | IAFCGTSGTYG | |
| GTRWMKIIR | | GTRWMKIIR | | GYLITGKSHG | | IAFCGVDSDTT | |
| GTSGTYGAG | | GTSGTYGAG | | GYLLKGESHC | | IAFCGVNSDTT | |
| GTSGTYGSG | | GTSGTYGSG | | GYLLKGESHG | | IAFLTSSIVCP | |
| GTSGTYGTG | | GTSGTYGTG | | GYLLKGESYG | | IAGFAPFSKDN | |
| GTSIWTSSS | | GTSIWTSSS | | GYLLLNKSLC | | IAGFIEGGWCG | |
| GTSKACNAL | | GTSKACNAL | | GYLLRGESHG | | IAGFIEGGWPG | |
| GTSKACNAS | | GTSKACNAS | | GYLSNNATDT | | IAGFIEGGWQG | |
| GTSKACSAS | | GTSKACSAS | | GYLSNNSSDT | | IAGFIEGGWSG | |
| GTSKIKMKW | | GTSKIKMKW | | GYLSNNSTDK | | IAGFIEGGWTG | |
| GTSKVKMKW | | GTSKVKMKW | | GYLSNNSTDT | | IAGFIEGRWPG | |
| GTSSFYRNL | | GTSSFYRNL | | GYLSNNSTEK | | IAGFIENGWEG | |
| GTSSIYIEV | | GTSSIYIEV | | GYLSNNSTER | | IAGFIENGWQG | |
| GTSSVYIEV | | GTSSVYIEV | | GYLSTNSSDK | | IAGGLILGMQN | |
| GTSSVYVEV | | GTSSVYVEV | | GYLSTNSSEK | | IAGLFFWMCSN | |

Fig. 83-135

| Block size 8 | SIN | Block size 9 | SIN | Block size 10 | SIN | Block size 11 | SIN |
|---|---|---|---|---|---|---|---|
| GTSTLNHRS | | GTSTLNHRS | | GYLSTNSSER | | IAGLSFWMCSN | |
| GTSTLNKRS | | GTSTLNKRS | | GYLSTNSTEK | | IAGSSEQAAEA | |
| GTSTLNLRL | | GTSTLNLRL | | GYMSNNSTEK | | IAGWILGNPEC | |
| GTSTLNQKL | | GTSTLNQKL | | GYNFEKEGYS | | IAGWLLGNPEC | |
| GTSTLNQRL | | GTSTLNQRL | | GYNGQKSWMK | | IAGWLLGNPKC | |
| GTSTLNQRM | | GTSTLNQRM | | GYNGQKSWTK | | IAGWLLGNPMC | |
| GTSTLNQRS | | GTSTLNQRS | | GYNGQRSWMK | | IAGWYGFQHSN | |
| GTSVKTLTD | | GTSVKTLTD | | GYPGVKGWAF | | IAHISPLSGSA | |
| GTSVWAGRT | | GTSVWAGRT | | GYQSLRSILA | | IAHKSCLPACV | |
| GTTASCQNR | | GTTASCQNR | | GYQSNNSTDT | | IAIALGIINLL | |
| GTTGNPIIC | | GTTGNPIIC | | GYQSNNSTNT | | IAIGNCPKYVK | |
| GTTHDRTAF | | GTTHDRTAF | | GYQTNNSTDT | | IAIGSVSRTIA | |
| GTTIRGKHS | | GTTIRGKHS | | GYQTNNSTET | | IAILAATVTLH | |
| GTTIRGRHS | | GTTIRGRHS | | GYRHQNAQGE | | IAILATTITLH | |
| GTTIRNKHS | | GTTIRNKHS | | GYSGAFIDYW | | IAILATTVTLH | |
| GTTIRNRHS | | GTTIRNRHS | | GYSGAFMDYW | | IAILVTTVTLH | |
| GTTLDNEHS | | GTTLDNEHS | | GYSGAFTIPI | | IAIVLGIINLL | |
| GTTLDNKHS | | GTTLDNKHS | | GYSGAFTIPT | | IAKDNAIRFGE | |
| GTTLENKHS | | GTTLENKHS | | GYSGAFTIPV | | IAKDNAVRFGE | |
| GTTLKGRHA | | GTTLKGRHA | | GYSGAFTVPI | | IAKGEKANVLI | |
| GTTLNNKHS | | GTTLNNKHS | | GYSGAFVDYW | | IALCGSPFPVG | |
| GTTLRGQHA | | GTTLRGQHA | | GYSGIFSVEG | | IALCGSPFSVG | |
| GTTLRGRHA | | GTTLRGRHA | | GYSGIFSVEH | | IALGIINLLIG | |
| GTTLYNKHS | | GTTLYNKHS | | GYSGIFSVEN | | IALILVALALS | |
| GTTVNEEAL | | GTTVNEEAL | | GYSGIFSVES | | IALSILNLLIG | |
| GTVKDRSPF | | GTVKDRSPF | | GYSGSFIDYW | | IALSVLNLLIG | |
| GTVKDRSPY | | GTVKDRSPY | | GYSGSFIQHP | | IAMENQHTIDL | |
| GTVSLSPGM | | GTVSLSPGM | | GYSGSFMDYW | | IAMENQHTIDM | |
| GTVTGPPQC | | GTVTGPPQC | | GYSGSFSIRG | | IAMGLIFMCVK | |
| GTVVKTLTD | | GTVVKTLTD | | GYSGSFSIRW | | IAPDRASFFKG | |
| GTWAVVMTD | | GTWAVVMTD | | GYSGSFTIPT | | IAPDRASFFRG | |
| GTWDTIIER | | GTWDTIIER | | GYSGSFTLPI | | IAPDRASFLRG | |
| GTWDTLIER | | GTWDTLIER | | GYSGSFTLPV | | IAPDRATFLRS | |
| GTWNTLIER | | GTWNTLIER | | GYSGSFVDYW | | IAPEFGYLLKG | |
| GTWPDGADI | | GTWPDGADI | | GYSGSFVQHP | | IAPEFGYLLRG | |
| GTYCSLNGI | | GTYCSLNGI | | GYSGVFSVEG | | IAPEYGFKISK | |
| GTYCSLNGV | | GTYCSLNGV | | GYSLVGIDPF | | IAPEYGFKISR | |
| GTYDHKDYE | | GTYDHKDYE | | GYSLVGVDPF | | IAPEYGFRISK | |
| GTYDHKEFE | | GTYDHKEFE | | GYSTGALASC | | IAPEYGHLITG | |
| GTYDHKEFK | | GTYDHKEFK | | GYTMDTVNRT | | IAPEYGHLTTG | |
| GTYDHKEYE | | GTYDHKEYE | | GYTMDTVSRT | | IAPEYGHLVTG | |
| GTYDHNIYR | | GTYDHNIYR | | GYVCGKFHSD | | IAPEYGYLITG | |
| GTYDYPKYE | | GTYDYPKYE | | GYVCSGIFGD | | IAPIMFSNKMA | |
| GTYDYPKYQ | | GTYDYPKYQ | | GYVCSGLVGD | | IAPIMFSNKVA | |
| GTYDYPKYS | | GTYDYPKYS | | GYVCSGVFGD | | IAPLMMAYMLE | |
| GTYDYSKYE | | GTYDYSKYE | | GYVCSKFHSD | | IAPLMVAYMLE | |
| GTYGAGSWP | | GTYGAGSWP | | GYWAIRTRSG | | IAPNRASFFRG | |
| GTYGSGSWP | | GTYGSGSWP | | HAKDILEKAH | | IAPRGHYKISK | |
| GTYGTGAWP | | GTYGTGAWP | | HAKDILEKTH | | IAPRYGYIIEK | |
| GTYGTGSWP | | GTYGTGSWP | | HAKNILEKTH | | IAQDNAIRFGE | |
| GTYGTGTWP | | GTYGTGTWP | | HALKLVVAML | | IAQKLEDVFAG | |
| GTYKILTIY | | GTYKILTIY | | HALRELWQCY | | IAQRLEDVFAG | |
| GTYNHEDYK | | GTYNHEDYK | | HANGTIHDRS | | IAQRLEGVFAG | |
| GTYNHEDYR | | GTYNHEDYR | | HANGTINDRS | | IAQRLENVFAG | |
| GTYNHKDYE | | GTYNHKDYE | | HANGTMHDRS | | IAQRLESVFAG | |
| GTYNHKEYE | | GTYNHKEYE | | HANNSKKQID | | IASDILKRMSK | |
| GTYNHQDYE | | GTYNHQDYE | | HANNSTDTID | | IASDILTRMSK | |
| GTYNHQEYE | | GTYNHQEYE | | HANNSTDTVD | | IASKDNGIRIG | |
| GTYNHREYE | | GTYNHREYE | | HANNSTEHVD | | IASRSGYEILK | |
| GTYNNTTGR | | GTYNNTTGR | | HANNSTEQVD | | IASRSGYEMLK | |
| GTYNRKEYE | | GTYNRKEYE | | HANNSTERVD | | IASSIVLVGLI | |
| GTYNYPKYE | | GTYNYPKYE | | HANNSTETVD | | IASSIVMVGLI | |

Fig. 83-136

| Block size 8 | SIN | Block size 9 | SIN | Block size 10 | SIN | Block size 11 | SIN |
|---|---|---|---|---|---|---|---|
| GTYNYPKYH | | GTYNYPKYH | | HANNSTKQID | | IASSLPFQNIN | |
| GTYNYPKYQ | | GTYNYPKYQ | | HANNSTKQVD | | IASSTVLVGLI | |
| GTYNYPKYS | | GTYNYPKYS | | HANNSTTKVD | | IASSTVMVGLI | |
| GTYQILSIY | | GTYQILSIY | | HANNSTTQID | | IASSVVLVGLI | |
| GTYYYPKYE | | GTYYYPKYE | | HANNSTTQVD | | IASSVVLVGPI | |
| GVAIALSIL | | GVAIALSIL | | HANNSTTQVN | | IASTTAKAMEQ | |
| GVAIALSVL | | GVAIALSVL | | HANNSTVQVD | | IASVPASRYLI | |
| GVANLGLNI | | GVANLGLNI | | HAQDILEKTH | | IASVPASRYLT | |
| GVAPSPSNS | | GVAPSPSNS | | HAQNILEKTH | | IASWAGNILRT | |
| GVAPSPYNS | | GVAPSPYNS | | HAQYREEALL | | IATPGMQIRGF | |
| GVAPVLGNY | | GVAPVLGNY | | HASNRPWISF | | IAVFCGTSGTY | |
| GVCPVVFTD | | GVCPVVFTD | | HASNRPWVSF | | IAWSATACHDG | |
| GVCPVVMTD | | GVCPVVMTD | | HAVANGTKVN | | IAWSRSSCHDG | |
| GVCYPGSIE | | GVCYPGSIE | | HAVENGTSVK | | IAWSSASCHDG | |
| GVCYPGSIK | | GVCYPGSIK | | HAVPNGTIVK | | IAWSSSSCFDG | |
| GVDEYSNAE | | GVDEYSNAE | | HAVPNGTIVR | | IAWSSSSCHDG | |
| GVDEYSSAE | | GVDEYSSAE | | HAVPNGTKVN | | IAWSSSSCYDG | |
| GVDEYSSTE | | GVDEYSSTE | | HAVPNGTLVK | | IAYERMCNILK | |
| GVDPFKLLQ | | GVDPFKLLQ | | HAVPNGTMVK | | ICATCEQIADS | |
| GVDPFRLLQ | | GVDPFRLLQ | | HAVPNGTVVK | | ICAVATTHSWV | |
| GVDRFYRIC | | GVDRFYRIC | | HAVSNGTKIN | | ICAVVMTDGSA | |
| GVDRFYRTC | | GVDRFYRTC | | HAVSNGTKVN | | ICEKLEQSGLP | |
| GVDSDTTGW | | GVDSDTTGW | | HCINRCFYVE | | ICFMYSDFHFI | |
| GVDSDTTSW | | GVDSDTTSW | | HCMESIRNNT | | ICIAWSSSSCF | |
| GVEDGSIGK | | GVEDGSIGK | | HCRATEYIMK | | ICIDFRDMRKN | |
| GVEEGSIGK | | GVEEGSIGK | | HCRATEYMMK | | ICIGHHANNST | |
| GVEESSIGK | | GVEESSIGK | | HCRIIQNEDI | | ICIGYHANKST | |
| GVELSSMGV | | GVELSSMGV | | HCSKYHWNLA | | ICIGYHANNSK | |
| GVESAVLRG | | GVESAVLRG | | HCWSFALAQG | | ICIGYHANNST | |
| GVETMVILS | | GVETMVILS | | HCYPGATINE | | ICIGYHSNNST | |
| GVEVVDATE | | GVEVVDATE | | HDANVKNLHD | | ICIGYLSNNAT | |
| GVEVVNATE | | GVEVVNATE | | HDANVKNLHE | | ICIGYLSNNSS | |
| GVEYNGKSL | | GVEYNGKSL | | HDANVRNLHD | | ICIGYLSNNST | |
| GVFEFSDER | | GVFEFSDER | | HDANVRNLHE | | ICIGYLSTNSS | |
| GVFELSDEK | | GVFELSDEK | | HDFEREGYSL | | ICIGYMSNNST | |
| GVFELSDER | | GVFELSDER | | HDGAEIIYFE | | ICIGYQSNNST | |
| GVFGDNPRP | | GVFGDNPRP | | HDGAEIIYFK | | ICIGYQTNNST | |
| GVFGDNPRS | | GVFGDNPRS | | HDGAEITYFK | | ICIKDGNMRCT | |
| GVFGDSPRP | | GVFGDSPRP | | HDGIARMTIC | | ICIKICESRLR | |
| GVFGDTPRP | | GVFGDTPRP | | HDGIGRMTIC | | ICIKNGNMQCT | |
| GVFLAPRYA | | GVFLAPRYA | | HDGKAWLHIC | | ICIKNGNMRCT | |
| GVGIAADKE | | GVGIAADKE | | HDGKAWLHVC | | ICIKNGNVRCT | |
| GVGMAADKE | | GVGMAADKE | | HDGKSWLHVC | | ICILDQNFRNI | |
| GVGNLAFNT | | GVGNLAFNT | | HDGNAWLHVC | | ICIQGNNDNAT | |
| GVGNLIFNT | | GVGNLIFNT | | HDGRAWLHIC | | ICIRFVNSDCS | |
| GVGNLVFNT | | GVGNLVFNT | | HDGRAWLHVC | | ICISGPNNNAS | |
| GVGRMTICI | | GVGRMTICI | | HDGVGRMTIC | | ICKAAIGLRIS | |
| GVGRMTICV | | GVGRMTICV | | HDGVNRMTIC | | ICKAALGLRIS | |
| GVHHPSSDN | | GVHHPSSDN | | HDGVSRMTIC | | ICKAAMGLKIS | |
| GVHHPSTDA | | GVHHPSTDA | | HDRAAFRGLI | | ICKAAMGLRIS | |
| GVHHPSTDK | | GVHHPSTDK | | HDRICIGYQS | | ICKAAMGMRIS | |
| GVHHPSTDT | | GVHHPSTDT | | HDRIPHRTLL | | ICKDNWKGSNR | |
| GVHHSSSLD | | GVHHSSSLD | | HDRISHRTLL | | ICKLVGINMSK | |
| GVILEENTT | | GVILEENTT | | HDRSPFRALI | | ICKPYIGKCPK | |
| GVINTSKPF | | GVINTSKPF | | HDRSPFRALV | | ICLGHHAVANG | |
| GVIPLTTTP | | GVIPLTTTP | | HDRSPHRTLL | | ICLGHHAVENG | |
| GVITDTIKS | | GVITDTIKS | | HDRSPYRALI | | ICLGHHAVPNG | |
| GVITDTLKS | | GVITDTLKS | | HDRSQFRALI | | ICLGHHAVSNG | |
| GVIVTREPY | | GVIVTREPY | | HDRSQYRALI | | ICLGHHAVTNG | |
| GVKGFAFKY | | GVKGFAFKY | | HDRSQYRALV | | ICMSGPNDNAS | |
| GVKGFAFLD | | GVKGFAFLD | | HDRSQYRSLI | | ICMSGPNNNAS | |
| GVKGFAFLN | | GVKGFAFLN | | HDRTAFRGLI | | ICNSNAITRSG | |

Fig. 83-137

| Block size 8 | SIN | Block size 9 | SIN | Block size 10 | SIN | Block size 11 | SIN |
|---|---|---|---|---|---|---|---|
| GVKGFAYLD | | GVKGFAYLD | | HDRTAFRGLM | | ICPVVFTDGSA | |
| GVKGFGFKA | | GVKGFGFKA | | HDRTPHRTLL | | ICPVVMTDGPA | |
| GVKGFGFKK | | GVKGFGFKK | | HDRTSHRTLL | | ICQMEKIVLLF | |
| GVKGFGFKS | | GVKGFGFKS | | HDRTTFRGLI | | ICRDNWKGANR | |
| GVKGFGFKT | | GVKGFGFKT | | HDRTTFRGLL | | ICRDNWKGSNR | |
| GVKGFGFKV | | GVKGFGFKV | | HDSNVENLFD | | ICRDNWRGANR | |
| GVKGFGFLD | | GVKGFGFLD | | HDSNVKNLFD | | ICRDNWRGSNR | |
| GVKGFGFLN | | GVKGFGFLN | | HDSNVKNLHE | | ICRDNWTGTNR | |
| GVKGFGFLS | | GVKGFGFLS | | HDSNVKNLYD | | ICSCIASSLVL | |
| GVKGFGFRQ | | GVKGFGFRQ | | HDSNVKNLYE | | ICSGFFGDNPR | |
| GVKGFSFKY | | GVKGFSFKY | | HDSNVKNLYN | | ICSGIFGDNPR | |
| GVKGFSFRY | | GVKGFSFRY | | HDSNVKSLYD | | ICSGLVGDTPR | |
| GVKGFSYKY | | GVKGFSYKY | | HDSNVRNLHE | | ICSGVFGDNPR | |
| GVKGFSYLD | | GVKGFSYLD | | HDSNVRNLYD | | ICSGVFGDSPR | |
| GVKGFSYLN | | GVKGFSYLN | | HDSNVRSLHE | | ICSGVFGDTPR | |
| GVKGFSYRY | | GVKGFSYRY | | HECRTFFLTQ | | ICSGVLGDNPR | |
| GVKGWAFDD | | GVKGWAFDD | | HEDYKEESQL | | ICSKFHSDTPR | |
| GVKGWAFDE | | GVKGWAFDE | | HEDYREESQL | | ICSPVLTDNPR | |
| GVKGWAFDI | | GVKGWAFDI | | HEEVTNATET | | ICTCRDNWQGS | |
| GVKGWAFDN | | GVKGWAFDN | | HEFSNLEKRI | | ICTGILTDTSR | |
| GVKGWAFDS | | GVKGWAFDS | | HEFSNLERRI | | ICTGVLTDTSR | |
| GVKGWAFDV | | GVKGWAFDV | | HEFSNLERRV | | ICTHLEICFMY | |
| GVKGWAFDY | | GVKGWAFDY | | HEFSSLERRI | | ICTHLEVCFMY | |
| GVKLAQGYK | | GVKLAQGYK | | HEGEGIPLHD | | ICTHMEVCFMY | |
| GVKLEENST | | GVKLEENST | | HEGEGIPLYD | | ICTVVMTDGSA | |
| GVKLEENTS | | GVKLEENTS | | HENRMVIAST | | ICVAWSSSSCF | |
| GVKLEENTT | | GVKLEENTT | | HENRMVLAST | | ICVAWSSTSCF | |
| GVKLIQGYK | | GVKLIQGYK | | HENSQGSGYA | | ICVCRDNWHGS | |
| GVKLSNMGI | | GVKLSNMGI | | HEQMETGGER | | ICVGWSSTSCH | |
| GVKLSNMGV | | GVKLSNMGV | | HFEECSCYPS | | ICVGWSSTTCH | |
| GVKLSSMGI | | GVKLSSMGI | | HFEKIKILPR | | ICVGYHANNST | |
| GVKLSSMGV | | GVKLSSMGV | | HFEKVKILAR | | ICVGYHSNNST | |
| GVKLTQGYK | | GVKLTQGYK | | HFEKVKILPK | | ICVGYLSTNSS | |
| GVKMNPNQK | | GVKMNPNQK | | HFEKVKILPR | | ICVGYLSTNST | |
| GVKPLILKD | | GVKPLILKD | | HFEKVRILPK | | ICVKNGNHAVH | |
| GVKPLILRD | | GVKPLILRD | | HFESNGNFIA | | ICVKNGNMQCT | |
| GVKPLILRN | | GVKPLILRN | | HFHRKRRVRD | | ICVKNGNMRCT | |
| GVKVDGSSS | | GVKVDGSSS | | HFQNQVKIRR | | ICVQGNNDNAT | |
| GVLEDEQMY | | GVLEDEQMY | | HFQRKRRIRD | | ICVQGNNKNAT | |
| GVLGDNPRP | | GVLGDNPRP | | HFQRKRRVRD | | ICVQGNNNNAT | |
| GVLHLILWI | | GVLHLILWI | | HFRNQIKIRR | | ICVSGPNNNAS | |
| GVLLGTKHS | | GVLLGTKHS | | HFRNQVKIRR | | ICVTGDDRNAT | |
| GVLTDTSRP | | GVLTDTSRP | | HFRSQVKIRR | | ICVVAVTDGPA | |
| GVMKTEGTL | | GVMKTEGTL | | HGALLNDKHS | | ICYPGKFTNEE | |
| GVMNTSKPF | | GVMNTSKPF | | HGANRPWVSF | | ICYPGRFTNEE | |
| GVMNTSKPL | | GVMNTSKPL | | HGICAVATTH | | ICYPGSIENQE | |
| GVNDRNFWR | | GVNDRNFWR | | HGKIIQNEDI | | ICYPGSVENQE | |
| GVNESADMS | | GVNESADMS | | HGLCYPGELD | | IDAGDGCFEIL | |
| GVNRFYRTC | | GVNRFYRTC | | HGLCYPGELN | | IDAGNGCFDIL | |
| GVNSDTTGW | | GVNSDTTGW | | HGRIIQNEDI | | IDALLGDPHCD | |
| GVNSDTTSW | | GVNSDTTSW | | HGRILKNDLP | | IDALLGDPQCD | |
| GVNSFSRTE | | GVNSFSRTE | | HGRILKNNLP | | IDARIDFESGR | |
| GVNSNTTGW | | GVNSNTTGW | | HGRTIQNEDI | | IDARVDFESGR | |
| GVNTNKTFQ | | GVNTNKTFQ | | HGRVLKNNLP | | IDAVKLSSGYK | |
| GVPESMREE | | GVPESMREE | | HGSLLNDKHS | | IDDAVTDIWSY | |
| GVPFHLATK | | GVPFHLATK | | HGSLQCRICI | | IDDAVTDVWSY | |
| GVPFHLGTK | | GVPFHLGTK | | HGSLVLSLWM | | IDDQIEDLWAY | |
| GVPFHLGTR | | GVPFHLGTR | | HGSNRPWISF | | IDDQIEELWAY | |
| GVPFYLGTK | | GVPFYLGTK | | HGSNRPWLSF | | IDDQIEGLWAY | |
| GVPFYLGTR | | GVPFYLGTR | | HGSNRPWVSF | | IDDQIENLWAY | |
| GVPKSMREE | | GVPKSMREE | | HGTGTGYTMD | | IDDQIIDIWAY | |
| GVPPLELGD | | GVPPLELGD | | HGVKGWAFDD | | IDDQITDIWAY | |

Fig. 83-138

| Block size 8 | SIN | Block size 9 | SIN | Block size 10 | SIN | Block size 11 | SIN |
|---|---|---|---|---|---|---|---|
| GVPTDVIRS | | GVPTDVIRS | | HHANNSTEQV | | IDDQVTDIWAY | |
| GVPTDVMRS | | GVPTDVMRS | | HHAVANGTKV | | IDECRTFFLTQ | |
| GVPTDVVRS | | GVPTDVVRS | | HHAVANGTRV | | IDEESRARIKT | |
| GVPVTSSID | | GVPVTSSID | | HHAVENGTSV | | IDEGDGCFNFF | |
| GVPVTSSVD | | GVPVTSSVD | | HHAVPNGTIV | | IDEGDGCFNLL | |
| GVQAGVDRF | | GVQAGVDRF | | HHAVPNGTKV | | IDEGDGCFSIL | |
| GVQDIIDND | | GVQDIIDND | | HHAVPNGTLV | | IDEGDGCFSLL | |
| GVQDIIDNN | | GVQDIIDNN | | HHAVPNGTVV | | IDEGNGCFELL | |
| GVQIASNEN | | GVQIASNEN | | HHAVSNGTKV | | IDEITTKINNI | |
| GVQMQRFRR | | GVQMQRFRR | | HHAVTNGTKV | | IDESCEGECFY | |
| GVQVASNEN | | GVQVASNEN | | HHENSQGSGY | | IDFHWMLLDPG | |
| GVRCICRDN | | GVRCICRDN | | HHMRKKRGLF | | IDFRDMRKNTL | |
| GVREWSYLI | | GVREWSYLI | | HHPPDAKEQT | | IDGFEPNGCIE | |
| GVRLEENTT | | GVRLEENTT | | HHPPDETEQT | | IDGITNKINSI | |
| GVRLTQGYK | | GVRLTQGYK | | HHPPDTKEQT | | IDGITNKVNSI | |
| GVRPGYNGQ | | GVRPGYNGQ | | HHPPNTKEQT | | IDGVTNKVNSI | |
| GVRPLILKD | | GVRPLILKD | | HHPPTSAEQV | | IDGWTTANSKS | |
| GVRPLILRD | | GVRPLILRD | | HHPPTSDEQI | | IDGWYGFHHSN | |
| GVRPRYNGQ | | GVRPRYNGQ | | HHPPTSDEQV | | IDGWYGFKHQN | |
| GVSFHLGTK | | GVSFHLGTK | | HHPPTSNEQV | | IDGWYGFRHQN | |
| GVSGADDDA | | GVSGADDDA | | HHPPTTDEQM | | IDGWYGYHHEN | |
| GVSGADNDA | | GVSGADNDA | | HHPSSAQEKN | | IDGWYGYHHQN | |
| GVSGEVPGW | | GVSGEVPGW | | HHPSSDNEQT | | IDGWYGYHHSN | |
| GVSGINESA | | GVSGINESA | | HHPSSTKEKN | | IDGWYGYKHQN | |
| GVSGPDNGA | | GVSGPDNGA | | HHPSSTQEKN | | IDGWYGYRHQN | |
| GVSGTDDDA | | GVSGTDDDA | | HHQNAQGSGY | | IDIMQNKLNNV | |
| GVSGVNESA | | GVSGVNESA | | HHQNEQGSGY | | IDIWAYNAELL | |
| GVSILNLGQ | | GVSILNLGQ | | HHQNGQGSGY | | IDIWTYNAELL | |
| GVSPIHLGD | | GVSPIHLGD | | HHRVYWIREG | | IDIYCICRDNW | |
| GVSPVHLGD | | GVSPVHLGD | | HHSNAEGTGM | | IDKEPMGFRYS | |
| GVSSEVPEW | | GVSSEVPEW | | HHSNDQGAGY | | IDKESMGFRYS | |
| GVSSEVPGC | | GVSSEVPGC | | HHSNDQGSGY | | IDKICLGHHAV | |
| GVSSEVPGW | | GVSSEVPGW | | HHSNSEGTGM | | IDKINGKLNRL | |
| GVSVLNLGQ | | GVSVLNLGQ | | HHSSSLDEQN | | IDKITNKINNI | |
| GVTASCLDK | | GVTASCLDK | | HIAILVTTVT | | IDKITNKVNNI | |
| GVTASCLDR | | GVTASCLDR | | HICIGYHANN | | IDKMNGNYDSI | |
| GVTASCRDN | | GVTASCRDN | | HICVTGDDRN | | IDKNALGDCPK | |
| GVTLSVVSL | | GVTLSVVSL | | HIEECPCYGH | | IDKNALGECPK | |
| GVTNKVNSI | | GVTNKVNSI | | HIEECSCYGA | | IDKTNQQFELI | |
| GVTRREIHI | | GVTRREIHI | | HIEECSCYGE | | IDKTNQQFEMI | |
| GVTRREVHI | | GVTRREVHI | | HIEECSCYGH | | IDKVCTKGKKA | |
| GVTRREVHM | | GVTRREVHM | | HIEECSCYGK | | IDLADSEMDKL | |
| GVTRREVHT | | GVTRREVHT | | HIEECSCYGS | | IDLADSEMKKL | |
| GVTRREVHV | | GVTRREVHV | | HIEECSCYGV | | IDLADSEMLNL | |
| GVTTHYVSQ | | GVTTHYVSQ | | HIEECSCYPN | | IDLADSEMNKL | |
| GVTVIKNNM | | GVTVIKNNM | | HIEECSCYPQ | | IDLADSEMNNL | |
| GVTVIRNNM | | GVTVIRNNM | | HIEECSCYPR | | IDLADSEMSKL | |
| GVVNTALST | | GVVNTALST | | HIEECSCYSR | | IDLAESEMNKL | |
| GVVNTTLST | | GVVNTTLST | | HIEEWSCYGH | | IDLANSEMNKL | |
| GVWIGRTKN | | GVWIGRTKN | | HIEVTNATEL | | IDLTDSEMNKL | |
| GVWIGRTKS | | GVWIGRTKS | | HIFGKDNAIR | | IDLTDSEMSKL | |
| GVWTYNAEL | | GVWTYNAEL | | HIFGKDNAVR | | IDLTNSEMNKL | |
| GVWWTSNSI | | GVWWTSNSI | | HIFSFNGEEM | | IDLVETNHTGT | |
| GVYINTALL | | GVYINTALL | | HIFSFTGEEM | | IDLWSYNADVL | |
| GVYINTAML | | GVYINTAML | | HIFSKDNAIR | | IDLWSYNAELL | |
| GVYKALSIY | | GVYKALSIY | | HIFVIREPFV | | IDLWSYNAGLL | |
| GVYMNTALL | | GVYMNTALL | | HIGPLSGSAQ | | IDMADSEMLNL | |
| GVYNNTTGR | | GVYNNTTGR | | HIGVAPSPSN | | IDNDNWSGYSG | |
| GVYQILAIY | | GVYQILAIY | | HIHIFSFNGE | | IDNEFTEVEQQ | |
| GVYQILSIY | | GVYQILSIY | | HIHIFSFTGE | | IDNGDGCFEIL | |
| GVYQVLAIY | | GVYQVLAIY | | HIIDLADSEM | | IDNMQNKLNNV | |
| GVYVNTALL | | GVYVNTALL | | HILSKDNAIR | | IDNMQNRLNNV | |

Fig. 83-139

| Block size 8 | SIN | Block size 9 | SIN | Block size 10 | SIN | Block size 11 | SIN |
|---|---|---|---|---|---|---|---|
| GWAFDNGDD | | GWAFDNGDD | | HILSKDNAVR | | IDNNNWSGYSG | |
| GWAFDNGND | | GWAFDNGND | | HILVTREPYL | | IDPKGLFGAIA | |
| GWAFDSGDD | | GWAFDSGDD | | HIMIWHSNLN | | IDPVELSSGYK | |
| GWAFDYGND | | GWAFDYGND | | HIPEAGLKWE | | IDPVKLSGGYK | |
| GWAFDYGSD | | GWAFDYGSD | | HIPEVCLKWD | | IDPVKLSSGYK | |
| GWAIHSKDN | | GWAIHSKDN | | HIPEVCLKWE | | IDQINGKLNRL | |
| GWAIHTKDN | | GWAIHTKDN | | HIPEVCLKWG | | IDQITGKLNRL | |
| GWAIYSKDN | | GWAIYSKDN | | HISPLAGSAQ | | IDQITRKLNRL | |
| GWAIYTKDN | | GWAIYTKDN | | HISPLSGSAQ | | IDQITTKINNI | |
| GWAPLSKDN | | GWAPLSKDN | | HISVGTSTLN | | IDQSLIIAARN | |
| GWATANSKS | | GWATANSKS | | HIVERILEEE | | IDQSLIIAARS | |
| GWAVHSKDN | | GWAVHSKDN | | HIWVTREPYV | | IDQVKLSSGYK | |
| GWAVYSKDN | | GWAVYSKDN | | HIYGKDNAIR | | IDQVTGKLNRL | |
| GWCGMIDGW | | GWCGMIDGW | | HIYGKDNAVR | | IDRITTKINNI | |
| GWEGLIDGW | | GWEGLIDGW | | HKCDDDCMAS | | IDRNAIGDCPK | |
| GWEGLINGW | | GWEGLINGW | | HKCDDECMDS | | IDRNALGDCPK | |
| GWEGLVDGW | | GWEGLVDGW | | HKCDDECMNS | | IDRSFRPNIGP | |
| GWEGMIDGW | | GWEGMIDGW | | HKCDDECMSS | | IDRTNHQFELI | |
| GWEGMMDGW | | GWEGMMDGW | | HKCDDHCMES | | IDSGYVCSGLV | |
| GWEGMVDGW | | GWEGMVDGW | | HKCDDQCMES | | IDSIGSWSQNI | |
| GWEGMVNGW | | GWEGMVNGW | | HKCDNECMDS | | IDSLLGDPHCD | |
| GWIDSPNHA | | GWIDSPNHA | | HKCDNECMET | | IDSNYVCSGLV | |
| GWIGGNPAC | | GWIGGNPAC | | HKCDNKCMET | | IDSRAVGKCPR | |
| GWILGNPEC | | GWILGNPEC | | HKCDNQCMES | | IDSSYICSGLV | |
| GWILGNPKC | | GWILGNPKC | | HKCNDECMNS | | IDSSYLCSGLV | |
| GWILGNPMC | | GWILGNPMC | | HKCNDSCMDT | | IDSSYVCSGLV | |
| GWILGNPQC | | GWILGNPQC | | HKCNDSCMEA | | IDSVKLSSGYK | |
| GWILGNPRC | | GWILGNPRC | | HKCNDSCMET | | IDSWAVGRCPR | |
| GWINSPNHA | | GWINSPNHA | | HKCNNECMET | | IDTGDGCFEIL | |
| GWINSPNHV | | GWINSPNHV | | HKCNNSCMET | | IDTGKGCFDIL | |
| GWINSPSQA | | GWINSPSQA | | HKCNNTCMET | | IDTGNGCFDIL | |
| GWITIGISG | | GWITIGISG | | HKDNAIRLGE | | IDTIMEKNVTV | |
| GWIVGNPAC | | GWIVGNPAC | | HKDNAIRPGE | | IDTLTETGVPV | |
| GWIVGNPSC | | GWIVGNPSC | | HKDNALRLAE | | IDTNKTFQNID | |
| GWLIGNPKC | | GWLIGNPKC | | HKDNAVRLGE | | IDVTDSEMNKL | |
| GWLLGNPAC | | GWLLGNPAC | | HKDYEEEAKL | | IDVWTYNAELL | |
| GWLLGNPEC | | GWLLGNPEC | | HKEYEEEAKL | | IDVYCICRDNW | |
| GWLLGNPGC | | GWLLGNPGC | | HKICIGYHAN | | IDVYCVCRDNW | |
| GWLLGNPKC | | GWLLGNPKC | | HKMESRGLFG | | IDWTRDSVTEL | |
| GWLLGNPLC | | GWLLGNPLC | | HKQLTHHMRK | | IEAESSIKEKD | |
| GWLLGNPMC | | GWLLGNPMC | | HKSCLPACAY | | IEAESSVKEKD | |
| GWLTIGISG | | GWLTIGISG | | HKSCLPACIY | | IEAESSVREKD | |
| GWLTIGITG | | GWLTIGITG | | HKSCLPACVY | | IEAMASQGTKR | |
| GWLTLGITG | | GWLTLGITG | | HKSQLIWMAC | | IEAMATQGTKR | |
| GWMDYYWGI | | GWMDYYWGI | | HKSQLVWMAC | | IEARGLFGAIA | |
| GWPGLINGW | | GWPGLINGW | | HLAYCNTDLG | | IEAVIYGNPKC | |
| GWPGLVAGW | | GWPGLVAGW | | HLECRTFFLA | | IECIGWSSTSC | |
| GWPWPDGAL | | GWPWPDGAL | | HLECRTFFLT | | IECVCRDNWRG | |
| GWQGLIDGW | | GWQGLIDGW | | HLEECSCYMD | | IECVGWSSTSC | |
| GWQGLVDGW | | GWQGLVDGW | | HLEECSCYTD | | IEDLIFLARSA | |
| GWQGMIDGW | | GWQGMIDGW | | HLEECSCYVD | | IEDLIFLTRSA | |
| GWQGMVDGW | | GWQGMVDGW | | HLEFKADLII | | IEDLIFMARSA | |
| GWSATACHD | | GWSATACHD | | HLEICFMYSD | | IEDLIFSARSA | |
| GWSGLIAGW | | GWSGLIAGW | | HLEVCFMYSD | | IEDLTFLARSA | |
| GWSGLVAGW | | GWSGLVAGW | | HLFSGIKSFS | | IEDLWAYNAEL | |
| GWSGMIDGW | | GWSGMIDGW | | HLFSGIRSFS | | IEDPAAPHGLC | |
| GWSSTSCHD | | GWSSTSCHD | | HLFSGVNSFS | | IEDPDHEGEGI | |
| GWSSTTCHD | | GWSSTTCHD | | HLGDCNFEGW | | IEDPGAPHGLC | |
| GWSWDDGAI | | GWSWDDGAI | | HLGDCRFEGW | | IEDPNAPHKLC | |
| GWSWPDDAE | | GWSWPDDAE | | HLGDCSFEGW | | IEDPNAPNKFC | |
| GWSWPDGAE | | GWSWPDGAE | | HLGTKQVCAA | | IEDPNAPNKLC | |
| GWSWPDGAK | | GWSWPDGAK | | HLGTKQVCIA | | IEDPNHEGEGI | |

Fig. 83-140

| Block size 8 | SIN | Block size 9 | SIN | Block size 10 | SIN | Block size 11 | SIN |
|---|---|---|---|---|---|---|---|
| GWSWPDGAL | | GWSWPDGAL | | HLGTKQVCMA | | IEDPSAPHGLC | |
| GWSYIVERP | | GWSYIVERP | | HLGTKQVCVA | | IEDPSAPHRLC | |
| GWTGLIDGW | | GWTGLIDGW | | HLGTRQVCIA | | IEDPSHEGEGI | |
| GWTGMIDGW | | GWTGMIDGW | | HLGTRQVCMA | | IEDPTAPHGLC | |
| GWTGMVDGW | | GWTGMVDGW | | HLGTRQVCVA | | IEDQITDIWAY | |
| GWTGMVNGW | | GWTGMVNGW | | HLIGKTNQQF | | IEECLINDPWV | |
| GWTIANSKS | | GWTIANSKS | | HLIIWGIHHP | | IEECPCYGHNS | |
| GWTSNSIVV | | GWTSNSIVV | | HLIMWGIHHP | | IEECSCYGHDS | |
| GWTTANSKS | | GWTTANSKS | | HLITGKSHGR | | IEECSCYGHNQ | |
| GWVAVAKDN | | GWVAVAKDN | | HLITWGIHHP | | IEECSCYGHNS | |
| GWVSTDKDS | | GWVSTDKDS | | HLIVWGIHHP | | IEECSCYGHSQ | |
| GWVSTDKNS | | GWVSTDKNS | | HLKDQAWSYI | | IEECSCYPNDG | |
| GWVTADKDS | | GWVTADKDS | | HLKDQDWSYI | | IEECSCYPNEG | |
| GWVVIAKDN | | GWVVIAKDN | | HLKDQGWSYI | | IEECSCYPNLG | |
| GWVVIAQDN | | GWVVIAQDN | | HLKDQSWSYI | | IEECSCYPNMG | |
| GWVVIEKDN | | GWVVIEKDN | | HLKFKADLII | | IEECSCYPNNG | |
| GWVVVAKDN | | GWVVVAKDN | | HLMIWHSNLN | | IEECSCYPNSG | |
| GWYGFHHSN | | GWYGFHHSN | | HLRDQGWSYI | | IEECSCYPQYP | |
| GWYGFKHQN | | GWYGFKHQN | | HLRNDTDVVN | | IEECSCYPRYP | |
| GWYGFQHQN | | GWYGFQHQN | | HLSSVSSFER | | IEEGSIGKVCR | |
| GWYGFQHRN | | GWYGFQHRN | | HLTDSEMNKL | | IEEGSVYPRFL | |
| GWYGFQHSN | | GWYGFQHSN | | HLTGKWDTLI | | IEELRRQKSLI | |
| GWYGFRHHN | | GWYGFRHHN | | HLTGMWDTLI | | IEELRRQKWWV | |
| GWYGFRHQK | | GWYGFRHQK | | HLTGTWDTLI | | IEELWAYNAEL | |
| GWYGFRHQN | | GWYGFRHQN | | HLTQGACWEQ | | IEEPSHEGEGI | |
| GWYGFRYQN | | GWYGFRYQN | | HLTQGTCWEQ | | IEEYGKGRIFQ | |
| GWYGYHHEN | | GWYGYHHEN | | HLTTGKSHGR | | IEEYGRGRIFQ | |
| GWYGYHHIN | | GWYGYHHIN | | HLVMWGIHHP | | IEFEPFQSLVP | |
| GWYGYHHNN | | GWYGYHHNN | | HLVTGKSHGR | | IEGGWCGMIDG | |
| GWYGYHHQN | | GWYGYHHQN | | HMAIIKKYTS | | IEGGWPGLING | |
| GWYGYHHSN | | GWYGYHHSN | | HMAIIKRYTS | | IEGGWPGLVAG | |
| GWYGYHHTN | | GWYGYHHTN | | HMECRTFFLT | | IEGGWQGLVDG | |
| GWYGYKHQN | | GWYGYKHQN | | HMEVCFMYSD | | IEGGWQGMIDG | |
| GWYGYRHQN | | GWYGYRHQN | | HMMIWHSNLN | | IEGGWQGMVDG | |
| GYAADKAST | | GYAADKAST | | HMRKKRGLFG | | IEGGWSGLIAG | |
| GYAADKDST | | GYAADKDST | | HNGGLIAPDR | | IEGGWSGLVAG | |
| GYAADKEST | | GYAADKEST | | HNGGLIAPNR | | IEGGWSGLVDG | |
| GYAADKKST | | GYAADKKST | | HNGGLIAPSR | | IEGGWSGMIDG | |
| GYAADLKST | | GYAADLKST | | HNGGLVAPSR | | IEGGWTGLIDG | |
| GYAADQEST | | GYAADQEST | | HNGGRIAPSR | | IEGGWTGMIDG | |
| GYAADQKST | | GYAADQKST | | HNGICPVAFT | | IEGGWTGMIEG | |
| GYAADREST | | GYAADREST | | HNGICPVVFT | | IEGGWTGMVDG | |
| GYAADRKST | | GYAADRKST | | HNGKLCKLNG | | IEGGWTGMVNG | |
| GYAQTDCVL | | GYAQTDCVL | | HNGKLCKLSG | | IEGICYPGSIE | |
| GYCFTVMTD | | GYCFTVMTD | | HNGKLCRLNG | | IEGIKLKSEDN | |
| GYDFEKEGY | | GYDFEKEGY | | HNGKLCRLRG | | IEGIKLKTEDN | |
| GYDFEREGY | | GYDFEREGY | | HNGKLCRLSG | | IEGLWAYNAEL | |
| GYEEFTIVG | | GYEEFTIVG | | HNGTCAVVMT | | IEGRIQDLEKY | |
| GYEEFTLVG | | GYEEFTLVG | | HNGTCVVIMT | | IEGRWPGLVAG | |
| GYEEFTMVG | | GYEEFTMVG | | HNGTCVVVMT | | IEGWVVVAKDN | |
| GYEILKVPN | | GYEILKVPN | | HNGTWAVVMT | | IEHQIGNVINW | |
| GYEKNATAS | | GYEKNATAS | | HNGVCPVVFT | | IEIITIGSICM | |
| GYEMLKVPD | | GYEMLKVPD | | HNIHPLAIGE | | IEIMASQGTKR | |
| GYEMLKVPN | | GYEMLKVPN | | HNIHPLTIGE | | IEIPSWAGNIL | |
| GYETFKVIG | | GYETFKVIG | | HNIHPLTIGK | | IEIWSYNAEFL | |
| GYETFRVID | | GYETFRVID | | HNIHPLTMGE | | IEKDNAVRFGE | |
| GYETFRVIG | | GYETFRVIG | | HNITFSHNGG | | IEKEFEQVEGR | |
| GYETFRVIS | | GYETFRVIS | | HNIYRDEAIN | | IEKEFGQVEGR | |
| GYEVLKVPD | | GYEVLKVPD | | HNNEQGSGYA | | IEKEFSEIEGR | |
| GYEVLKVPN | | GYEVLKVPN | | HNQEYTSGRQ | | IEKEFSEVEGR | |
| GYFGIFFVE | | GYFGIFFVE | | HNSTCVVVMT | | IEKEFTEVEGR | |
| GYFGVFSVE | | GYFGVFSVE | | HNVHPLTIGE | | IEKIEKIRPLL | |

Fig. 83-141

| Block size 8 | SIN | Block size 9 | SIN | Block size 10 | SIN | Block size 11 | SIN |
|---|---|---|---|---|---|---|---|
| GYGVKGFGF | | GYGVKGFGF | | HPATIGECPK | | IEKIRNGTYDH | |
| GYHANNSKK | | GYHANNSKK | | HPAYCNTDLG | | IEKITNKVNNI | |
| GYHANNSTD | | GYHANNSTD | | HPELTGLDCI | | IEKMNGNYDSI | |
| GYHANNSTE | | GYHANNSTE | | HPELTGLDCM | | IEKMVLSAFDE | |
| GYHANNSTK | | GYHANNSTK | | HPELTGLNCI | | IEKNALGDCPK | |
| GYHANNSTT | | GYHANNSTT | | HPELTGMDCI | | IEKQIGNVINW | |
| GYHANNSTV | | GYHANNSTV | | HPELTGMNCI | | IEKTNDKYHQI | |
| GYHFEECSC | | GYHFEECSC | | HPFTIGECPK | | IEKTNEKFHQI | |
| GYHHENSQG | | GYHHENSQG | | HPFTIGECPR | | IEKTNEKYHQI | |
| GYHHNNEQG | | GYHHNNEQG | | HPGIFENSCI | | IEKTNKQFELI | |
| GYHHQNEQG | | GYHHQNEQG | | HPGIFENSCL | | IEKTNQQFELI | |
| GYHHQNGQG | | GYHHQNGQG | | HPGIFESSCL | | IEKTNQQFKLI | |
| GYHHSKEQG | | GYHHSKEQG | | HPGIFGNSCL | | IEKTNTEFESI | |
| GYHHSNDQG | | GYHHSNDQG | | HPGLFENSCL | | IEKTNTQFELI | |
| GYHHSNEQG | | GYHHSNEQG | | HPITIGECPK | | IEKTSWSYIVE | |
| GYHHSNGQG | | GYHHSNGQG | | HPLAIGECPK | | IEKVRNGTYDH | |
| GYHSNNSTE | | GYHSNNSTE | | HPLTIGECPK | | IEKYGSGRIFQ | |
| GYICSGFFG | | GYICSGFFG | | HPLTIGKCPK | | IEKYGTGRIFQ | |
| GYICSGIFG | | GYICSGIFG | | HPLTMGECPK | | IEMTDSEMLNL | |
| GYICSGVFG | | GYICSGVFG | | HPNAGKDPKK | | IENDRTLDLHD | |
| GYICSKFHS | | GYICSKFHS | | HPRGLLEVGT | | IENGWEGLIDG | |
| GYIEGKLSQ | | GYIEGKLSQ | | HPSAGKDPKK | | IENGWEGLING | |
| GYIIEEYGK | | GYIIEEYGK | | HPSAGRDPKK | | IENGWEGLVDG | |
| GYIIEEYGR | | GYIIEEYGR | | HPSSAQEKND | | IENGWEGMIDG | |
| GYIIEKYGS | | GYIIEKYGS | | HPSSDNEQTD | | IENGWEGMMDG | |
| GYIIEKYGT | | GYIIEKYGT | | HPSSTKEKND | | IENGWEGMVDG | |
| GYKDIILWF | | GYKDIILWF | | HPSSTKEKNE | | IENGWEGMVNG | |
| GYKDIILWI | | GYKDIILWI | | HPSSTQEKNA | | IENGWQGLIDG | |
| GYKDIILWV | | GYKDIILWV | | HPSSTQEKND | | IENLEELRFVF | |
| GYKDVILWF | | GYKDVILWF | | HPSTGKDPKK | | IENLNKKIDDG | |
| GYKDWFLWI | | GYKDWFLWI | | HPTLLFLKVP | | IENLNKKMEDG | |
| GYKDWILWI | | GYKDWILWI | | HPVTIGECPK | | IENLNKKVDDG | |
| GYKDWVLWI | | GYKDWVLWI | | HPVTIGKCPK | | IENLNRKMEDG | |
| GYKEIILWF | | GYKEIILWF | | HQCDNNCIES | | IENLNRKVDDG | |
| GYKEVILWF | | GYKEVILWF | | HQFELIDNEF | | IENLQAYQKRM | |
| GYKHQNAQG | | GYKHQNAQG | | HQGTTIRNKH | | IENLWAYNAEL | |
| GYKMNIQIL | | GYKMNIQIL | | HQGTTIRNRH | | IENNVTVTSSV | |
| GYKMNNQIL | | GYKMNNQIL | | HQIEKEFEQV | | IENPSHEGEGI | |
| GYKMNTKIL | | GYKMNTKIL | | HQIEKEFGQV | | IENQEELKSLF | |
| GYKMNTQIL | | GYKMNTQIL | | HQIEKEFSEI | | IENQEELRFLF | |
| GYKMNTRIL | | GYKMNTRIL | | HQIEKEFSEV | | IENQEELRSLF | |
| GYKNWILWI | | GYKNWILWI | | HQIEKEFTEV | | IENQHTIDLAD | |
| GYLCAGIPS | | GYLCAGIPS | | HQIGNVINWT | | IENTYVNKTTV | |
| GYLCAGIPT | | GYLCAGIPT | | HQILAIYSTV | | IENTYVNNTTI | |
| GYLCAGLPS | | GYLCAGLPS | | HQLLRHFQKD | | IENTYVNNTTV | |
| GYLIRALTL | | GYLIRALTL | | HQLLRHFQKN | | IEPKGLFGAIA | |
| GYLITGKSH | | GYLITGKSH | | HQLRDNAKEL | | IEPRGLFGAIA | |
| GYLLKGESH | | GYLLKGESH | | HQLRENAEDK | | IEQNIPVTQVE | |
| GYLLKGESY | | GYLLKGESY | | HQNAEGIGIA | | IEQNVPVTQVE | |
| GYLLLNKSL | | GYLLLNKSL | | HQNAEGTGIA | | IEQQIGNVINW | |
| GYLLRGESH | | GYLLRGESH | | HQNAEGTGMA | | IERMVLSAFDE | |
| GYLSNNATD | | GYLSNNATD | | HQNAEGTGTA | | IERNALGDCPK | |
| GYLSNNSSD | | GYLSNNSSD | | HQNAQGEGIA | | IERNALGNCPK | |
| GYLSNNSTD | | GYLSNNSTD | | HQNAQGEGTA | | IERPTAVDTCY | |
| GYLSNNSTE | | GYLSNNSTE | | HQNAQGIGQA | | IERRNSSDICY | |
| GYLSTNSSD | | GYLSTNSSD | | HQNAQGQGTA | | IERTNEKFHQI | |
| GYLSTNSSE | | GYLSTNSSE | | HQNAQGSGYA | | IERTNEKYHQI | |
| GYLSTNSTE | | GYLSTNSTE | | HQNAQGTGQA | | IERTNQQFELI | |
| GYMFESKKM | | GYMFESKKM | | HQNAQGTGQV | | IERVRNGTYDH | |
| GYMFESKNM | | GYMFESKNM | | HQNEQGMGMA | | IESEFNEIEHQ | |
| GYMFESKRM | | GYMFESKRM | | HQNEQGSGYA | | IESEFNEIEYQ | |
| GYMFESKSM | | GYMFESKSM | | HQNEQGTGIA | | IESEFSEIEHQ | |

Fig. 83-142

| Block size 8 | SIN | Block size 9 | SIN | Block size 10 | SIN | Block size 11 | SIN |
|---|---|---|---|---|---|---|---|
| GYMSNNSTE | | GYMSNNSTE | | HQNEQGVGIA | | IESEFSETEHQ | |
| GYNFEKEGY | | GYNFEKEGY | | HQNEQGVGMA | | IESIIEAESSV | |
| GYNGQKSWM | | GYNGQKSWM | | HQNGQGSGYA | | IESIRNGTYDH | |
| GYNGQKSWT | | GYNGQKSWT | | HQNSEGTGIA | | IESIRNGTYNH | |
| GYNGQRSWM | | GYNGQRSWM | | HQNSEGTGIV | | IESLNKKMEDG | |
| GYPGVKGWA | | GYPGVKGWA | | HQNSEGTGTA | | IESMIEAESSI | |
| GYQSLRSIL | | GYQSLRSIL | | HQNSQGEGTA | | IESMIEAESSV | |
| GYQSNNSTD | | GYQSNNSTD | | HQNTQGEGTA | | IESMVEAESSV | |
| GYQSNNSTN | | GYQSNNSTN | | HQRSKFLLMD | | IESNGNLIAPW | |
| GYQSTNSTE | | GYQSTNSTE | | HQSTNSTETV | | IESNVTVTNSV | |
| GYQTNNSTD | | GYQTNNSTD | | HRCDDQCMES | | IESNVTVTSSI | |
| GYQTNNSTE | | GYQTNNSTE | | HRDEEGTGIA | | IESNVTVTSSV | |
| GYRHQNAQG | | GYRHQNAQG | | HRFEIIEGRD | | IESRGLFGAIA | |
| GYSGAFIDY | | GYSGAFIDY | | HRIYWIREGK | | IETGYVCSKFH | |
| GYSGAFMDY | | GYSGAFMDY | | HRIYWIREGR | | IETNHTGTYCS | |
| GYSGAFTIP | | GYSGAFTIP | | HRIYWIRKGR | | IETTHTGTYCS | |
| GYSGAFTVP | | GYSGAFTVP | | HRLCYPGELD | | IEVLHLTQGAC | |
| GYSGAFVDY | | GYSGAFVDY | | HRLKITENSF | | IEVLHLTQGTC | |
| GYSGIFSIE | | GYSGIFSIE | | HRNAIGDCPK | | IEVTNATELVQ | |
| GYSGIFSVE | | GYSGIFSVE | | HRNDEGTGIA | | IEVVAAQELVE | |
| GYSGSFIDY | | GYSGSFIDY | | HRNEEGTGIA | | IEVVNATETVE | |
| GYSGSFIQH | | GYSGSFIQH | | HRNTFGDCPK | | IEVVTAQELVE | |
| GYSGSFMDY | | GYSGSFMDY | | HRNTIGDCPK | | IEVWSYNAEFL | |
| GYSGSFSIR | | GYSGSFSIR | | HRSTIGDCPK | | IEYDAVATTHS | |
| GYSGSFTIP | | GYSGSFTIP | | HRTLLMNELG | | IEYNGKSLGIQ | |
| GYSGSFTLP | | GYSGSFTLP | | HRTLLMSELG | | IEYQIGNVINW | |
| GYSGSFVDY | | GYSGSFVDY | | HRVYWIREGK | | IFFWMCSNGSL | |
| GYSGSFVQH | | GYSGSFVQH | | HRVYWIREGR | | IFGAIAGFIEG | |
| GYSGVFSVE | | GYSGVFSVE | | HSAAFEDLRI | | IFGAIAGFIEN | |
| GYSLVGIDP | | GYSLVGIDP | | HSAAFEDLRL | | IFGCQNGNIRC | |
| GYSLVGVDP | | GYSLVGVDP | | HSAAFEDLRV | | IFGCQNGNVRC | |
| GYSTGALAS | | GYSTGALAS | | HSAYCNTDLG | | IFGKDNAIRIG | |
| GYTMDTVNR | | GYTMDTVNR | | HSCLQCRICI | | IFGKDNAVRIG | |
| GYTMDTVSR | | GYTMDTVSR | | HSDNADKICL | | IFHKCDDDCMA | |
| GYVCSGIFG | | GYVCSGIFG | | HSDTPRPADP | | IFHKCDDHCME | |
| GYVCSGLVG | | GYVCSGLVG | | HSDTPRPDDP | | IFHKCDDQCME | |
| GYVCSGVFG | | GYVCSGVFG | | HSDTPRPSDP | | IFHKCDNQCME | |
| GYVCSKFHS | | GYVCSKFHS | | HSDTPRPTDP | | IFHQCDNNCIE | |
| GYWAIRTRS | | GYWAIRTRS | | HSDTPRPVDP | | IFHRCDDQCME | |
| HAKDILEKA | | HAKDILEKA | | HSECRTFFLT | | IFIFILLTHWA | |
| HAKDILEKT | | HAKDILEKT | | HSGICPVVFT | | IFIFLLLTHWA | |
| HAKNILEKT | | HAKNILEKT | | HSHYREEALL | | IFLARSALILR | |
| HALKLVVAM | | HALKLVVAM | | HSKDNGIRIG | | IFLWCKIVTTV | |
| HALRELWQC | | HALRELWQC | | HSKDNNIRIG | | IFLWGIHHPPD | |
| HANGTIHDR | | HANGTIHDR | | HSKDNSIRIG | | IFLWGIHHPPN | |
| HANGTINDR | | HANGTINDR | | HSKEQGSGYA | | IFLWMCSNGSL | |
| HANGTMHDR | | HANGTMHDR | | HSMSDIEAMA | | IFLYVRTNGTS | |
| HANNSKKQI | | HANNSKKQI | | HSMSGFRSNL | | IFMARSALILR | |
| HANNSTDTI | | HANNSTDTI | | HSNAEGTGMA | | IFMCVKNGNLR | |
| HANNSTDTV | | HANNSTDTV | | HSNDQGAGYA | | IFNFILLTHWA | |
| HANNSTEHV | | HANNSTEHV | | HSNDQGSGYA | | IFNGAFIAPDR | |
| HANNSTEQV | | HANNSTEQV | | HSNDTIHDRT | | IFNMERIKELR | |
| HANNSTERV | | HANNSTERV | | HSNEQGSGYA | | IFNSIGNLIAP | |
| HANNSTETV | | HANNSTETV | | HSNETVKDRS | | IFQPNIGPRPL | |
| HANNSTKQI | | HANNSTKQI | | HSNGQGSGYA | | IFRPNIGPRPL | |
| HANNSTKQV | | HANNSTKQV | | HSNGTAKDRS | | IFSARSALILR | |
| HANNSTTKV | | HANNSTTKV | | HSNGTIEDRT | | IFSFIGEEMAT | |
| HANNSTTQI | | HANNSTTQI | | HSNGTIHDRA | | IFSFNGEEMAT | |
| HANNSTTQV | | HANNSTTQV | | HSNGTIHDRI | | IFSFTGEEMAS | |
| HANNSTVQV | | HANNSTVQV | | HSNGTIHDRS | | IFSFTGEEMAT | |
| HAQDILEKT | | HAQDILEKT | | HSNGTIHDRT | | IFSHNGGLIAP | |
| HAQNILEKT | | HAQNILEKT | | HSNGTIKDRA | | IFSKDNAIRIG | |

Fig. 83-143

| Block size 8 | SIN | Block size 9 | SIN | Block size 10 | SIN | Block size 11 | SIN |
|---|---|---|---|---|---|---|---|
| HAQYREEAL | | HAQYREEAL | | HSNGTIKDRS | | IFSKDNGIRIG | |
| HASNRPWIS | | HASNRPWIS | | HSNGTIKDRT | | IFVIREPFISC | |
| HASNRPWVS | | HASNRPWVS | | HSNGTINDRT | | IFVIREPFVAC | |
| HAVANGTKV | | HAVANGTKV | | HSNGTMKDRS | | IFVIREPFVSC | |
| HAVANGTRV | | HAVANGTRV | | HSNGTNKDRT | | IFVMREPFISC | |
| HAVENGTSV | | HAVENGTSV | | HSNGTTHDRI | | IGAIDSSMPFH | |
| HAVPNGTIV | | HAVPNGTIV | | HSNGTTHDRT | | IGAPQLNPIDG | |
| HAVPNGTKV | | HAVPNGTKV | | HSNGTVKBRS | | IGARIGEGQRS | |
| HAVPNGTLV | | HAVPNGTLV | | HSNGTVKDRS | | IGCKMYALHQG | |
| HAVPNGTVV | | HAVPNGTVV | | HSNGTVKDRT | | IGDCPKYIKSG | |
| HAVSNGTKV | | HAVSNGTKV | | HSNGTVKNRS | | IGDCPKYMNVK | |
| HAVTNGTKV | | HAVTNGTKV | | HSNGTVNDRS | | IGDCPKYVNIK | |
| HAYISFRNL | | HAYISFRNL | | HSNLNDATYQ | | IGDCPKYVNVK | |
| HCINRCFYV | | HCINRCFYV | | HSNLNDTTYQ | | IGDCPKYVNVR | |
| HCMESIRNN | | HCMESIRNN | | HSNNTVKDRS | | IGDGQRSWMKI | |
| HCRATEYIM | | HCRATEYIM | | HSNSEGTGMA | | IGDGQRSWMKL | |
| HCRATEYMM | | HCRATEYMM | | HSNSTTHDRT | | IGECPKYVKSD | |
| HCRIIQNED | | HCRIIQNED | | HSQYREEALL | | IGECPKYVKSE | |
| HCSKYHWNL | | HCSKYHWNL | | HSRGLFGAIA | | IGECPKYVKSN | |
| HCWSFALAQ | | HCWSFALAQ | | HSRSGFEMLK | | IGECPKYVKSS | |
| HCYPGATIN | | HCYPGATIN | | HSSGTVKDRS | | IGECPKYVKST | |
| HDANVKNLH | | HDANVKNLH | | HSSSLDEQNK | | IGECPKYVRSA | |
| HDANVRNLH | | HDANVRNLH | | HSWIPKRNRS | | IGECPKYVRSE | |
| HDFEREGYS | | HDFEREGYS | | HSWTPKRNRS | | IGECPKYVRST | |
| HDGAEIIYF | | HDGAEIIYF | | HSWVPILNTS | | IGECPRYVKSE | |
| HDGAEITYF | | HDGAEITYF | | HSWVPKRNRS | | IGEDSDILVTR | |
| HDGASWLTI | | HDGASWLTI | | HTAYSQITNG | | IGEDSDVLVTR | |
| HDGIARMTI | | HDGIARMTI | | HTDELCPSPL | | IGEGQRSWMKI | |
| HDGIGRMTI | | HDGIGRMTI | | HTEYRQEALQ | | IGEKSDVLVTR | |
| HDGISWLTI | | HDGISWLTI | | HTGNPVICLG | | IGENSDVLVTR | |
| HDGKAWLHI | | HDGKAWLHI | | HTGSFCSIDG | | IGEYPVVKGEY | |
| HDGKAWLHV | | HDGKAWLHV | | HTGSFCSING | | IGFHFEECSCY | |
| HDGKSWLHV | | HDGKSWLHV | | HTGSFCSLDG | | IGFWMCSNGSL | |
| HDGNAWLHV | | HDGNAWLHV | | HTGTFCSING | | IGGFIFGCQNG | |
| HDGRAWLHI | | HDGRAWLHI | | HTGTYCSLDG | | IGGNSDVLVTR | |
| HDGRAWLHV | | HDGRAWLHV | | HTGTYCSLGG | | IGGSGTDNYGV | |
| HDGSSWLTI | | HDGSSWLTI | | HTGTYCSLNG | | IGGSGTNNYGV | |
| HDGTNWLTI | | HDGTNWLTI | | HTGTYCSLSG | | IGGWATANSKS | |
| HDGTSWLTI | | HDGTSWLTI | | HTIDLADSEI | | IGGWTIANSKS | |
| HDGVGRMTI | | HDGVGRMTI | | HTIDLADSEM | | IGGWTTANSKS | |
| HDGVNRMTI | | HDGVNRMTI | | HTIDLAESEM | | IGHHANNSTEQ | |
| HDGVSRMTI | | HDGVSRMTI | | HTIDLTDAEM | | IGIAADRDSTQ | |
| HDIYRDEAI | | HDIYRDEAI | | HTIDLTDSEM | | IGIGNLIFNTV | |
| HDIYRNEAI | | HDIYRNEAI | | HTIDLTNSEM | | IGIGNLVFNTV | |
| HDRAAFRGL | | HDRAAFRGL | | HTIDMADSEM | | IGISGPDDGAV | |
| HDRICIGYQ | | HDRICIGYQ | | HTIDMADSTM | | IGISGPDNEAV | |
| HDRIPHRTL | | HDRIPHRTL | | HTIDMTDSEM | | IGISGPDNGAV | |
| HDRISHRTL | | HDRISHRTL | | HTIDVADSEM | | IGISGPDSGAV | |
| HDRNAFRGL | | HDRNAFRGL | | HTIDVTDSEM | | IGISNVGLKVS | |
| HDRSPFRAL | | HDRSPFRAL | | HTIHLTDSEM | | IGISNVGLNVS | |
| HDRSPHRTL | | HDRSPHRTL | | HTKCQTYAGA | | IGITGPDATAV | |
| HDRSPYRAL | | HDRSPYRAL | | HTKCQTYTGA | | IGITVIKNNMI | |
| HDRSQFRAL | | HDRSQFRAL | | HTKVLYFHKG | | IGKCNDPYPGN | |
| HDRSQYRAL | | HDRSQYRAL | | HTQYREEALL | | IGKCPKYIPSG | |
| HDRSQYRSL | | HDRSQYRSL | | HTQYREESLL | | IGKCPKYIPSN | |
| HDRTAFRGL | | HDRTAFRGL | | HTRGLFGAIA | | IGKCPKYIPSR | |
| HDRTPHRTL | | HDRTPHRTL | | HTSQYICSPV | | IGKCPKYISSG | |
| HDRTSHRTL | | HDRTSHRTL | | HTSQYLCTGI | | IGKCPKYVKSN | |
| HDRTTFRGL | | HDRTTFRGL | | HTSQYLCTGV | | IGKCPKYVKST | |
| HDSNVENLF | | HDSNVENLF | | HTSRYVCTGI | | IGKCPRYIPSG | |
| HDSNVKNLF | | HDSNVKNLF | | HTTINNITNV | | IGKCSKYVKST | |
| HDSNVKNLH | | HDSNVKNLH | | HVCITGDDRN | | IGKFYIQMCTE | |

Fig. 83-144

| Block size 8 | SIN | Block size 9 | SIN | Block size 10 | SIN | Block size 11 | SIN |
|---|---|---|---|---|---|---|---|
| HDSNVKNLY | | HDSNVKNLY | | HVCVTGDDGN | | IGKITNKVNNI | |
| HDSNVKSLY | | HDSNVKSLY | | HVCVTGDDKN | | IGKTNEKFHQI | |
| HDSNVRNLH | | HDSNVRNLH | | HVCVTGDDRN | | IGKTNQQFELI | |
| HDSNVRNLY | | HDSNVRNLY | | HVDTIMEKNV | | IGKTSWSYIVE | |
| HDSNVRSLH | | HDSNVRSLH | | HVEECSCYGH | | IGKVCRALLAK | |
| HDVYRDEAI | | HDVYRDEAI | | HVEECSCYPQ | | IGKVCRTLLAK | |
| HECRTFFLT | | HECRTFFLT | | HVEECSCYPR | | IGLLLQITSLC | |
| HEDYKEESQ | | HEDYKEESQ | | HVEECSCYPS | | IGLREQKQEFK | |
| HEDYREESQ | | HEDYREESQ | | HVEVVSAKEL | | IGLRISSSFSF | |
| HEEVTNATE | | HEEVTNATE | | HVFIIREPFV | | IGLRNTPSIEP | |
| HEFSNLEKR | | HEFSNLEKR | | HVFVIREPFV | | IGNCPKYVKQG | |
| HEFSNLERR | | HEFSNLERR | | HVLVTREPYL | | IGNGCFEFYHK | |
| HEFSSLERR | | HEFSSLERR | | HVRKRFADQE | | IGNGCFEFYHR | |
| HEGEGIPLH | | HEGEGIPLH | | HVSPLSGSAQ | | IGNGCFEFYHT | |
| HEGEGIPLY | | HEGEGIPLY | | HWMLLDPGDT | | IGNLAFNAVIH | |
| HEGRLIQNS | | HEGRLIQNS | | HWNLALDIVD | | IGNLIAPRGHY | |
| HENRMVIAS | | HENRMVIAS | | HWPDGSNIGF | | IGNLVAPRGHY | |
| HENRMVLAS | | HENRMVLAS | | HYEECSCYPD | | IGNLVFNTVIH | |
| HENSQGSGY | | HENSQGSGY | | HYEECSCYPE | | IGNVINWTKDS | |
| HEQMETGGE | | HEQMETGGE | | HYEECSCYPN | | IGNVINWTQDA | |
| HERVRKQLR | | HERVRKQLR | | HYGGIPTDVI | | IGNVINWTRDA | |
| HFEECSCYP | | HFEECSCYP | | HYGGIPTDVV | | IGNVINWTRDS | |
| HFEKIKILP | | HFEKIKILP | | HYGGMPTDVV | | IGPLLQITSLC | |
| HFEKVKILA | | HFEKVKILA | | HYGGVPTDVI | | IGPLSGSAQHI | |
| HFEKVKILP | | HFEKVKILP | | HYGGVPTDVV | | IGPPHCDQFLE | |
| HFEKVRILP | | HFEKVRILP | | HYIGKCPKYI | | IGPPQCDKFLE | |
| HFESNGNFI | | HFESNGNFI | | HYIGKCPRYI | | IGPPQCDLFLE | |
| HFQKDAKIL | | HFQKDAKIL | | HYKISKSTKS | | IGPPQCDLHLE | |
| HFQKDAKML | | HFQKDAKML | | HYPKIYKTYF | | IGPPQCDQFLE | |
| HFQKDAKVL | | HFQKDAKVL | | HYPKVYKPYF | | IGPPQCDRFLE | |
| HFQKDARVL | | HFQKDARVL | | HYPKVYKTYF | | IGPPQCDSHLK | |
| HFQKNAKVL | | HFQKNAKVL | | HYPKVYRTYF | | IGPRALVRGQQ | |
| HFQNQVKIR | | HFQNQVKIR | | HYREEALLNR | | IGPRPFVRGQQ | |
| HFQRKRRIR | | HFQRKRRIR | | HYSKVYKTYF | | IGPRPLIRGQQ | |
| HFQRKRRVR | | HFQRKRRVR | | HYVCSGLVGD | | IGPRPLVMGQQ | |
| HFRNQIKIR | | HFRNQIKIR | | IAADKASTQK | | IGPRPLVREQQ | |
| HFRNQVKIR | | HFRNQVKIR | | IAADKESTQE | | IGPRPLVRGQQ | |
| HFRSQVKIR | | HFRSQVKIR | | IAADKESTQK | | IGQAADLKSTQ | |
| HFVNIELED | | HFVNIELED | | IAADKESTQR | | IGQAADYKSTQ | |
| HFVSIELEG | | HFVSIELEG | | IAADKESTQT | | IGQGDIVLVMK | |
| HGALLNDKH | | HGALLNDKH | | IAADKTSTQK | | IGQGDVVLVMK | |
| HGANRPWVS | | HGANRPWVS | | IAADKVSTQK | | IGRFYIQMCTE | |
| HGICAVATT | | HGICAVATT | | IAADRESTQK | | IGRFYVQMCTE | |
| HGKIIQNED | | HGKIIQNED | | IAADYKSTQS | | IGRMTICIQGN | |
| HGLCYPGEL | | HGLCYPGEL | | IAAEKESTQK | | IGRMTICVQGK | |
| HGRIIQNED | | HGRIIQNED | | IAARNIVRRA | | IGRMTICVQGN | |
| HGRILKNDL | | HGRILKNDL | | IAARSIVRRA | | IGRTKNLESRS | |
| HGRILKNNL | | HGRILKNNL | | IAASYKRIRL | | IGRTKSLESRS | |
| HGRTIQNED | | HGRTIQNED | | IADAQHRSHR | | IGRTNQQFELI | |
| HGRVLKNNL | | HGRVLKNNL | | IADKICIGYL | | IGSCTSPCLTD | |
| HGSGYAADK | | HGSGYAADK | | IADRVDDAVT | | IGSGFFPDGPQ | |
| HGSLLNDKH | | HGSLLNDKH | | IADSHHRSHR | | IGSIRNETYDH | |
| HGSLQCRIC | | HGSLQCRIC | | IADSQHKSHR | | IGSIRNGTYDH | |
| HGSLVLSLW | | HGSLVLSLW | | IADSQHRSHR | | IGSIRNGTYNH | |
| HGSNRPWIS | | HGSNRPWIS | | IAEQFTWNGV | | IGSKGDIFVIR | |
| HGSNRPWLS | | HGSNRPWLS | | IAFCGTSGTY | | IGSKGDIFVMR | |
| HGSNRPWVS | | HGSNRPWVS | | IAFCGVDSDT | | IGSKGDVFVIR | |
| HGTGTGYTM | | HGTGTGYTM | | IAFCGVNSDT | | IGSKGDVFVMR | |
| HGVKGWAFD | | HGVKGWAFD | | IAFCGVNSNT | | IGSKGHVFVIR | |
| HHANNSTEQ | | HHANNSTEQ | | IAFLTSSIVC | | IGSRGEVFVIR | |
| HHAVANGTI | | HHAVANGTI | | IAFVLWACQN | | IGSRGHIFVIR | |
| HHAVANGTK | | HHAVANGTK | | IAGFAPFSKD | | IGSRGHVFVIR | |

Fig. 83-145

| Block size 8 | SIN | Block size 9 | SIN | Block size 10 | SIN | Block size 11 | SIN |
|---|---|---|---|---|---|---|---|
| HHAVANGTR | | HHAVANGTR | | IAGFIEGGWC | | IGSRPRVRNQS | |
| HHAVANGTV | | HHAVANGTV | | IAGFIEGGWP | | IGSSTYQNNFV | |
| HHAVENGTS | | HHAVENGTS | | IAGFIEGGWQ | | IGSSYVCSGLV | |
| HHAVPNGTI | | HHAVPNGTI | | IAGFIEGGWS | | IGSWSHNILRT | |
| HHAVPNGTK | | HHAVPNGTK | | IAGFIEGGWT | | IGSWSQNILRT | |
| HHAVPNGTL | | HHAVPNGTL | | IAGFIEGRWP | | IGTRIGDGQRS | |
| HHAVPNGTV | | HHAVPNGTV | | IAGFIENGWE | | IGVAPSPSNSR | |
| HHAVSNGTI | | HHAVSNGTI | | IAGFIENGWQ | | IGVAVIKNNMI | |
| HHAVSNGTK | | HHAVSNGTK | | IAGFLENGWE | | IGVGNLAFNTV | |
| HHAVTNGTI | | HHAVTNGTI | | IAGGLILGMQ | | IGVGNLIFNTV | |
| HHAVTNGTK | | HHAVTNGTK | | IAGLFFWMCS | | IGVGNLVFNTV | |
| HHENSQGSG | | HHENSQGSG | | IAGLSFWMCS | | IGVSGPDNGAV | |
| HHMGECPKY | | HHMGECPKY | | IAGSSEQAAE | | IGVTRREIHIY | |
| HHMRKKRGL | | HHMRKKRGL | | IAGWILGNPE | | IGVTRREVHIY | |
| HHNNEQGSG | | HHNNEQGSG | | IAGWLLGNPE | | IGVTRREVHMY | |
| HHNSEGTGQ | | HHNSEGTGQ | | IAGWLLGNPK | | IGVTRREVHTY | |
| HHPDSETTA | | HHPDSETTA | | IAGWLLGNPM | | IGVTRREVHVY | |
| HHPDTEATA | | HHPDTEATA | | IAGWYGFQHS | | IGVTVIKNNMI | |
| HHPDTEAVA | | HHPDTEAVA | | IAHISPLSGS | | IGVTVIKNNMV | |
| HHPDTEEVA | | HHPDTEEVA | | IAHKSCLPAC | | IGVTVIRNNMI | |
| HHPDTETTA | | HHPDTETTA | | IAIALGIINL | | IGWSSTSCHDG | |
| HHPPDAKEQ | | HHPPDAKEQ | | IAIGNCPKYV | | IGYHANNSKKQ | |
| HHPPDETEQ | | HHPPDETEQ | | IAIGSVSRTI | | IGYHANNSTDT | |
| HHPPDTKEQ | | HHPPDTKEQ | | IAILAATVTL | | IGYHANNSTEK | |
| HHPPNTKEQ | | HHPPNTKEQ | | IAILATTITL | | IGYHANNSTEM | |
| HHPPTSAEQ | | HHPPTSAEQ | | IAILATTVTL | | IGYHANNSTEQ | |
| HHPPTSDEQ | | HHPPTSDEQ | | IAILVTTVTL | | IGYHANNSTET | |
| HHPPTSNEQ | | HHPPTSNEQ | | IAIRPKVNGQ | | IGYHANNSTKQ | |
| HHPPTTDEQ | | HHPPTTDEQ | | IAIVLGIINL | | IGYHANNSTTK | |
| HHPSSAQEK | | HHPSSAQEK | | IAKDNAIRFG | | IGYHANNSTTQ | |
| HHPSSDNEQ | | HHPSSDNEQ | | IAKDNAVRFG | | IGYHSNNSTEK | |
| HHPSSTKEK | | HHPSSTKEK | | IAKGEKANVL | | IGYICSGIFGD | |
| HHPSSTQEK | | HHPSSTQEK | | IALCGSPFPV | | IGYICSGVFGD | |
| HHPSTDAEQ | | HHPSTDAEQ | | IALCGSPISV | | IGYLSNNATDT | |
| HHPSTDKEQ | | HHPSTDKEQ | | IALFIGVGNL | | IGYLSNNSSDT | |
| HHPSTDTEQ | | HHPSTDTEQ | | IALGIINLLI | | IGYLSNNSTDK | |
| HHQNAQGSG | | HHQNAQGSG | | IALIIGVGNL | | IGYLSNNSTDT | |
| HHQNEQGSG | | HHQNEQGSG | | IALILVALAL | | IGYLSNNSTEK | |
| HHQNGQGSG | | HHQNGQGSG | | IALLIGIGNL | | IGYLSNNSTER | |
| HHRSHRQMA | | HHRSHRQMA | | IALLIGVGNL | | IGYLSTNSSER | |
| HHSKEQGSG | | HHSKEQGSG | | IALSILNLLI | | IGYMSNNSTEK | |
| HHSNAEGTG | | HHSNAEGTG | | IALSVLNLLI | | IGYQSNNSTDT | |
| HHSNDQGAG | | HHSNDQGAG | | IALSYSAGAL | | IGYQSNNSTNT | |
| HHSNDQGSG | | HHSNDQGSG | | IAMENQHTID | | IGYQTNNSTDT | |
| HHSNEQGSG | | HHSNEQGSG | | IAMGLIFMCV | | IGYQTNNSTET | |
| HHSNGQGSG | | HHSNGQGSG | | IAPDRASFFK | | IGYVCSGIFGD | |
| HHSNSEGTG | | HHSNSEGTG | | IAPDRASFFR | | IGYVCSGVFGD | |
| HHSSSLDEQ | | HHSSSLDEQ | | IAPDRASFLR | | IHDRIPHRTLL | |
| HIAILVTTV | | HIAILVTTV | | IAPDRATFLR | | IHDRSPHRTLL | |
| HICIGYHAN | | HICIGYHAN | | IAPEFGYLLK | | IHDRSQYRALI | |
| HICVTGDDR | | HICVTGDDR | | IAPEFGYLLR | | IHDRSQYRALV | |
| HIEECPCYG | | HIEECPCYG | | IAPEYGFKIS | | IHDRSQYRSLI | |
| HIEECSCYG | | HIEECSCYG | | IAPEYGFRIS | | IHDRTAFRGLI | |
| HIEECSCYP | | HIEECSCYP | | IAPEYGHLIT | | IHDRTAFRGLM | |
| HIEEWSCYG | | HIEEWSCYG | | IAPEYGHLTT | | IHDRTPHRTLL | |
| HIEVTNATE | | HIEVTNATE | | IAPEYGHLVT | | IHECRTFFLTQ | |
| HIFGKDNAI | | HIFGKDNAI | | IAPEYGYLIT | | IHHPPDAKEQT | |
| HIFGKDNAV | | HIFGKDNAV | | IAPIMFSNKM | | IHHPPDETEQT | |
| HIFSFNGEE | | HIFSFNGEE | | IAPLMMAYML | | IHHPPDTKEQT | |
| HIFSFTGEE | | HIFSFTGEE | | IAPLMVAYML | | IHHPPNTKEQT | |
| HIFSKDNAI | | HIFSKDNAI | | IAPNRASFFR | | IHHPPTSAEQV | |
| HIFVIREPF | | HIFVIREPF | | IAPRGHYKIS | | IHHPPTSDEQI | |

Fig. 83-146

| Block size 8 | SIN | Block size 9 | SIN | Block size 10 | SIN | Block size 11 | SIN |
|---|---|---|---|---|---|---|---|
| HIGPLSGSA | | HIGPLSGSA | | IAPRYAFELV | | IHHPPTSDEQV | |
| HIHIFSFNG | | HIHIFSFNG | | IAPRYGYIIE | | IHHPPTSNEQV | |
| HIHIFSFTG | | HIHIFSFTG | | IAQDNAIRFG | | IHHPPTTDEQM | |
| HIIDLADSE | | HIIDLADSE | | IAQKLEDVFA | | IHHPSSAQEKN | |
| HIIDVTDSE | | HIIDVTDSE | | IAQRLEDVFA | | IHHPSSTKEKN | |
| HIIMWGIHH | | HIIMWGIHH | | IAQRLEGVFA | | IHHPSSTQEKN | |
| HILSKDNAI | | HILSKDNAI | | IAQRLENVFA | | IHIFSFNGEEM | |
| HILSKDNAV | | HILSKDNAV | | IAQRLESVFA | | IHIFSFTGEEM | |
| HILVTREPY | | HILVTREPY | | IASDILKRMS | | IHISPLSGSAQ | |
| HIMIWHSNL | | HIMIWHSNL | | IASDILTRMS | | IHKQLTHHMRK | |
| HIPEVCLKW | | HIPEVCLKW | | IASIRRNYFT | | IHLGDCSFEGW | |
| HIQTRRSFE | | HIQTRRSFE | | IASKDNGIRI | | IHLTDSEMNKL | |
| HISPLAGSA | | HISPLAGSA | | IASMRRDYFT | | IHPLAIGECPK | |
| HISPLSGSA | | HISPLSGSA | | IASMRRNYFT | | IHPLTIGECPK | |
| HISVGTSTL | | HISVGTSTL | | IASMRRSYFT | | IHPLTIGKCPK | |
| HITFSHNGG | | HITFSHNGG | | IASRSGYEIL | | IHPLTMGECPK | |
| HITGFAPFS | | HITGFAPFS | | IASRSGYEML | | IHSRGLFGAIA | |
| HIVERILEE | | HIVERILEE | | IASSIVLVGL | | IHTRGLFGAIA | |
| HIWVTREPY | | HIWVTREPY | | IASSIVMVGL | | IHYGGIPTDVV | |
| HIYGKDNAI | | HIYGKDNAI | | IASSLILAAI | | IHYGGMPTDVV | |
| HIYGKDNAV | | HIYGKDNAV | | IASSLILAAL | | IHYGGVPTDVI | |
| HKCDDDCMA | | HKCDDDCMA | | IASSLPFQNI | | IHYGGVPTDVM | |
| HKCDDECIE | | HKCDDECIE | | IASSLVLAAI | | IHYGGVPTDVV | |
| HKCDDECMD | | HKCDDECMD | | IASSLVLAAL | | IIAARNIVRRA | |
| HKCDDECMN | | HKCDDECMN | | IASSLVLAAS | | IIAARSIVRRA | |
| HKCDDECMS | | HKCDDECMS | | IASSTVLVGL | | IIALLIGIGNL | |
| HKCDDHCME | | HKCDDHCME | | IASSTVMVGL | | IICLGHHAVEN | |
| HKCDDQCME | | HKCDDQCME | | IASSVVLVGL | | IICTCRDNWQG | |
| HKCDNECIE | | HKCDNECIE | | IASSVVLVGP | | IIDIWAYNAEL | |
| HKCDNECMD | | HKCDNECMD | | IASTTAKAME | | IIDKMNGNYDS | |
| HKCDNECME | | HKCDNECME | | IASVPASRYL | | IIDKMNTQFEA | |
| HKCDNKCIE | | HKCDNKCIE | | IASWAGNILR | | IIDKMNTQFET | |
| HKCDNKCME | | HKCDNKCME | | IATPGMQIRG | | IIDKMNTRFEA | |
| HKCDNQCME | | HKCDNQCME | | IATRPKVNGQ | | IIDLADSEMNK | |
| HKCNDECMN | | HKCNDECMN | | IATRPQVNGQ | | IIDNDNWSGYS | |
| HKCNDSCMD | | HKCNDSCMD | | IATRPRVNGQ | | IIDNNNWSGYS | |
| HKCNDSCME | | HKCNDSCME | | IATRSKVNGQ | | IIEAESSVKEK | |
| HKCNNECIE | | HKCNNECIE | | IAVFCGTSGT | | IIEEYGKGRIF | |
| HKCNNECME | | HKCNNECME | | IAWSRSSCHD | | IIEEYGRGRIF | |
| HKCNNSCME | | HKCNNSCME | | IAWSSASCHD | | IIEKMNGNYDS | |
| HKCNNTCME | | HKCNNTCME | | IAWSSSSCFD | | IIEKNVTVTHA | |
| HKDLGNCHP | | HKDLGNCHP | | IAWSSSSCHD | | IIEKYGSGRIF | |
| HKDNAIRLG | | HKDNAIRLG | | IAWSSSSCYD | | IIEKYGTGRIF | |
| HKDNAIRPG | | HKDNAIRPG | | IAYERMCNIL | | IIENNVTVTSS | |
| HKDNALRLA | | HKDNALRLA | | ICATCEQIAD | | IIERRNSSDIC | |
| HKDNAVRLG | | HKDNAVRLG | | ICAVATTHSW | | IIESNITVTSS | |
| HKDYEEEAK | | HKDYEEEAK | | ICAVVMTDGS | | IIESNVTVTSS | |
| HKEFEEESK | | HKEFEEESK | | ICEKLEQSGL | | IIETGYVCSKF | |
| HKEFEEESR | | HKEFEEESR | | ICFMYSDFHF | | IIFLWGIHHPP | |
| HKEFEKESK | | HKEFEKESK | | ICIAWSSSSC | | IIFNMERIKEL | |
| HKEFEKESR | | HKEFEKESR | | ICIDFRDMRK | | IIFNSIGNLIA | |
| HKEFKEESK | | HKEFKEESK | | ICIGHHANNS | | IIGGFIFGCQN | |
| HKEYEEEAK | | HKEYEEEAK | | ICIGYHANNS | | IIGISNVGLNV | |
| HKGIVIKEE | | HKGIVIKEE | | ICIGYHSNNS | | IIGKMNTQFEA | |
| HKGLIIKEE | | HKGLIIKEE | | ICIGYLSNNA | | IIGPPQCDLHL | |
| HKGLLIKEE | | HKGLLIKEE | | ICIGYLSNNS | | IIGPPQCDSHL | |
| HKGLVIKEE | | HKGLVIKEE | | ICIGYLSTNS | | IIHISPLSGSA | |
| HKGLVVKEE | | HKGLVVKEE | | ICIGYMSNNS | | IIIAIGSVSRT | |
| HKGNSARLI | | HKGNSARLI | | ICIGYQSNNS | | IIIRMMENARP | |
| HKICIGYHA | | HKICIGYHA | | ICIGYTNNS | | IIVVLLYTFA | |
| HKMESRGLF | | HKMESRGLF | | ICIKNGNMQC | | IIKGRSHLRND | |
| HKQLTHHMR | | HKQLTHHMR | | ICIKNGNMRC | | IIKKYTSARQE | |

Fig. 83-147

| Block size 8 | SIN | Block size 9 | SIN | Block size 10 | SIN | Block size 11 | SIN |
|---|---|---|---|---|---|---|---|
| HKSCLPACA | | HKSCLPACA | | ICIKNGNVRC | | IIKKYTSGRQE | |
| HKSCLPACI | | HKSCLPACI | | ICILDQNFRN | | IIKLLPFAAAP | |
| HKSCLPACV | | HKSCLPACV | | ICINGTCTVV | | IIKLLPFASAP | |
| HKSQLIWMA | | HKSQLIWMA | | ICIQGNNDNA | | IIKMLPFAAAP | |
| HKSQLVWMA | | HKSQLVWMA | | ICISGPNNNA | | IILGNPKCDLY | |
| HLAYCNTDL | | HLAYCNTDL | | ICKAAIGLRI | | IILWFSFGASC | |
| HLECRTFFL | | HLECRTFFL | | ICKAALGLRI | | IILWFSFGASS | |
| HLEECSCYM | | HLEECSCYM | | ICKAAMGLKI | | IILWFSFSISC | |
| HLEECSCYT | | HLEECSCYT | | ICKAAMGLRI | | IILWISFSISC | |
| HLEECSCYV | | HLEECSCYV | | ICKAAMGMRI | | IILWISFSMSC | |
| HLEFKADLI | | HLEFKADLI | | ICKLVGINMS | | IILWVSFSISC | |
| HLEICFMYS | | HLEICFMYS | | ICKPYIGKCP | | IINGALGSPGC | |
| HLEVCFMYS | | HLEVCFMYS | | ICLGHHAIPN | | IINKMNTQFEA | |
| HLFSGIKSF | | HLFSGIKSF | | ICLGHHAVAN | | IINLLIGISNM | |
| HLFSGIRSF | | HLFSGIRSF | | ICLGHHAVEN | | IINNQNWSGYS | |
| HLFSGVNSF | | HLFSGVNSF | | ICLGHHAVPN | | IIPSGPLKAEI | |
| HLGDCNFEG | | HLGDCNFEG | | ICLGHHAVSN | | IIQNEDIPIEN | |
| HLGDCRFEG | | HLGDCRFEG | | ICLGHHAVTN | | IIQNEDIPIGN | |
| HLGDCSFEG | | HLGDCSFEG | | ICMSGPNDNA | | IIQNEDIPIGS | |
| HLGTKQVCA | | HLGTKQVCA | | ICMSGPNNNA | | IIRALTLNTMT | |
| HLGTKQVCI | | HLGTKQVCI | | ICNSNAITRS | | IIREPFVSCSP | |
| HLGTKQVCM | | HLGTKQVCM | | ICPVVFTDGS | | IIRESGGIDKE | |
| HLGTKQVCV | | HLGTKQVCV | | ICPVVMTDGP | | IIRVGCVILLN | |
| HLGTRQVCI | | HLGTRQVCI | | ICQMEKIVLL | | IISKDNGIRIG | |
| HLGTRQVCM | | HLGTRQVCM | | ICRDNWKGAN | | IISLCSIWFSH | |
| HLGTRQVCV | | HLGTRQVCV | | ICRDNWKGSN | | IISMCSSTEFL | |
| HLIGKTNQQ | | HLIGKTNQQ | | ICRDNWQGAN | | IISNLPFQNIN | |
| HLIIWGIHH | | HLIIWGIHH | | ICRDNWRGAN | | IISSLPFQNIN | |
| HLIMWGIHH | | HLIMWGIHH | | ICRDNWTGTN | | IITDTFKSWKG | |
| HLITGKSHG | | HLITGKSHG | | ICSCIASSLV | | IITDTLKSWKG | |
| HLITWGIHH | | HLITWGIHH | | ICSGFFGDNP | | IITELPFQNLS | |
| HLIVWGIHH | | HLIVWGIHH | | ICSGIFGDNP | | IITIGSASLGL | |
| HLKDQAWSY | | HLKDQAWSY | | ICSGLVGDTP | | IITIGSICMVT | |
| HLKDQDWSY | | HLKDQDWSY | | ICSGVFGDNP | | IITIGSISLGL | |
| HLKDQGWSY | | HLKDQGWSY | | ICSGVFGDSP | | IITIGSISLTI | |
| HLKDQSWSY | | HLKDQSWSY | | ICSGVFGDTP | | IITIGSVSLAL | |
| HLKFKADLI | | HLKFKADLI | | ICSGVLGDNP | | IITIGSVSLTI | |
| HLMHPGERI | | HLMHPGERI | | ICSKFHSDTP | | IITIGSVSLTL | |
| HLMIWHSNL | | HLMIWHSNL | | ICSPVLTDNP | | IITREPYVSCD | |
| HLMRPGERI | | HLMRPGERI | | ICTCRDNWQG | | IIVFCGTSGTY | |
| HLMRPGERT | | HLMRPGERT | | ICTGILTDTS | | IIVFNTIGNLI | |
| HLMSPGERI | | HLMSPGERI | | ICTGVLTDTS | | IIVILVLGLSM | |
| HLRDQGWSY | | HLRDQGWSY | | ICTHLEICFM | | IIVTREPYVSC | |
| HLRNDTDVV | | HLRNDTDVV | | ICTHLEVCFM | | IIYSSSMMWEI | |
| HLSSVSSFE | | HLSSVSSFE | | ICTHMEVCFM | | IKAVRGDLNFV | |
| HLTDSEMNK | | HLTDSEMNK | | ICTVVMTDGS | | IKCICRDNWKG | |
| HLTGIWDTL | | HLTGIWDTL | | ICVAWSSSSC | | IKCICRDNWRG | |
| HLTGKWDTL | | HLTGKWDTL | | ICVAWSSTSC | | IKCQTPLGAIN | |
| HLTGTWDTL | | HLTGTWDTL | | ICVCRDNWHG | | IKCVCRDNWKG | |
| HLTQGACWE | | HLTQGACWE | | ICVGWSSTSC | | IKDRSPYRTLM | |
| HLTQGTCWE | | HLTQGTCWE | | ICVGWSSTTC | | IKDYRYTYRCH | |
| HLTTGKSHG | | HLTTGKSHG | | ICVGYHANNS | | IKGDYNNTTGR | |
| HLVTGKSHG | | HLVTGKSHG | | ICVGYHSNNS | | IKGFAPFSKDN | |
| HMAIIKKYT | | HMAIIKKYT | | ICVGYLSTNS | | IKGRSHLRNDT | |
| HMECRTFFL | | HMECRTFFL | | ICVKNGNHAV | | IKGVELSSMGV | |
| HMEVCFMYS | | HMEVCFMYS | | ICVKNGNMQC | | IKGVKLSNMGI | |
| HMGECPKYV | | HMGECPKYV | | ICVKNGNMRC | | IKGVKLSNMGV | |
| HMMIWHSNL | | HMMIWHSNL | | ICVQGNNDNA | | IKGVKLSSMGI | |
| HMRKKRGLF | | HMRKKRGLF | | ICVQGNNKNA | | IKGVKLSSMGV | |
| HNGGLIAPD | | HNGGLIAPD | | ICVQGNNNNA | | IKGWAPLSKDN | |
| HNGGLIAPN | | HNGGLIAPN | | ICVSGPNNNA | | IKHENRMVLAS | |
| HNGGLIAPS | | HNGGLIAPS | | ICVTGDDRNA | | IKHLEECSCYV | |

Fig. 83-148

| Block size 8 | SIN | Block size 9 | SIN | Block size 10 | SIN | Block size 11 | SIN |
|---|---|---|---|---|---|---|---|
| HNGGLVAPS | | HNGGLVAPS | | ICVVAVTDGP | | IKINPVTLTMG | |
| HNGGRIAPS | | HNGGRIAPS | | ICYPGKFTNE | | IKIRRRVDINP | |
| HNGICPVAF | | HNGICPVAF | | ICYPGRFTNE | | IKKTNEKFHQI | |
| HNGICPVVF | | HNGICPVVF | | ICYPGSIENQ | | IKKYERVKMFD | |
| HNGKLCKLN | | HNGKLCKLN | | ICYPGSVENQ | | IKKYTSARQEK | |
| HNGKLCKLS | | HNGKLCKLS | | IDAGDGCFEI | | IKKYTSGRQEK | |
| HNGKLCRLN | | HNGKLCRLN | | IDAGNGCFDI | | IKLKSEDNVYK | |
| HNGKLCRLR | | HNGKLCRLR | | IDALLGDPHC | | IKLKTEDNIYK | |
| HNGKLCRLS | | HNGKLCRLS | | IDALLGDPQC | | IKLKTEDNVYK | |
| HNGTCAVVM | | HNGTCAVVM | | IDARIDFESG | | IKLLPFAAAPP | |
| HNGTCVVIM | | HNGTCVVIM | | IDARVDFESG | | IKLLPFASAPP | |
| HNGTCVVVM | | HNGTCVVVM | | IDAVKLSSGY | | IKMKWGMELRR | |
| HNGTWAVVM | | HNGTWAVVM | | IDDAVTDIWS | | IKMKWGMEMRR | |
| HNGVCPVVF | | HNGVCPVVF | | IDDAVTDVWS | | IKMNPNQKIIT | |
| HNIHPLAIG | | HNIHPLAIG | | IDDQIEDLWA | | IKMNPNQKIMT | |
| HNIHPLTIG | | HNIHPLTIG | | IDDQIEELWA | | IKNGNMQCTIC | |
| HNILRTQES | | HNILRTQES | | IDDQIEGLWA | | IKNGNMRCTIC | |
| HNISKYAFG | | HNISKYAFG | | IDDQIENLWA | | IKNGTYDHKDY | |
| HNIYRDEAI | | HNIYRDEAI | | IDDQIIDIWA | | IKNGTYDHKEY | |
| HNNEQGSGY | | HNNEQGSGY | | IDDQITDIWA | | IKNGTYDYPKY | |
| HNQEYTSGR | | HNQEYTSGR | | IDDQVTDIWA | | IKNGTYNHKDY | |
| HNSFVPVVG | | HNSFVPVVG | | IDECRTFFLT | | IKNGTYNHKEY | |
| HNSTCVVVM | | HNSTCVVVM | | IDEESRARIK | | IKNGTYNRKEY | |
| HNVHPFTIG | | HNVHPFTIG | | IDEGDGCFNF | | IKNNMINNDLG | |
| HNVHPLAIG | | HNVHPLAIG | | IDEGDGCFNL | | IKNNMVNNDLG | |
| HNVHPLTIG | | HNVHPLTIG | | IDEGDGCFSI | | IKNQEELRSLF | |
| HNVHRNAIG | | HNVHRNAIG | | IDEGDGCFSL | | IKPCFWVELIR | |
| HNVHRNTIG | | HNVHRNTIG | | IDEGNGCFEL | | IKPWARNILRT | |
| HNVHRSTIG | | HNVHRSTIG | | IDEITTKINN | | IKQGSLKLATG | |
| HNVSKYAFG | | HNVSKYAFG | | IDESCEGECF | | IKQNGKSGACK | |
| HNVYRDEAI | | HNVYRDEAI | | IDFHWMLLDP | | IKQNTLKLATG | |
| HPATIGECP | | HPATIGECP | | IDFRDMRKNT | | IKRGINDRNFW | |
| HPAYCNTDL | | HPAYCNTDL | | IDGITNKINS | | IKRGVNDRNFW | |
| HPELTGLDC | | HPELTGLDC | | IDGITNKVNS | | IKRIRMATNEC | |
| HPELTGLNC | | HPELTGLNC | | IDGKAPISLG | | IKRYERVKMFD | |
| HPELTGMDC | | HPELTGMDC | | IDGTCTVVMT | | IKSDQLKLATG | |
| HPELTGMNC | | HPELTGMNC | | IDGVTNKVNS | | IKSFSRTELIA | |
| HPELTGVDC | | HPELTGVDC | | IDGWTTANSK | | IKSFSRTQLIA | |
| HPEMTGLDC | | HPEMTGLDC | | IDGWYGFHHS | | IKSGQLKLATG | |
| HPFTIGECP | | HPFTIGECP | | IDGWYGFKHQ | | IKSWRKDILRT | |
| HPGIFENSC | | HPGIFENSC | | IDGWYGFRHQ | | IKSWRRDILRT | |
| HPGIFGNSC | | HPGIFGNSC | | IDGWYGYHHE | | IKTDGATSACK | |
| HPGLFENSC | | HPGLFENSC | | IDGWYGYHHQ | | IKTKLPFQNLS | |
| HPITIGECP | | HPITIGECP | | IDGWYGYHHS | | IKTNGNLIAPE | |
| HPLAIGECP | | HPLAIGECP | | IDGWYGYKHQ | | IKTRLFTIRQE | |
| HPLTIGECP | | HPLTIGECP | | IDGWYGYRHQ | | IKTRLYTIRQE | |
| HPLTIGKCP | | HPLTIGKCP | | IDIMQNKLNN | | IKTRPILSPLT | |
| HPLTMGECP | | HPLTMGECP | | IDIWAYNAEL | | IKTWAGKILRT | |
| HPNAGKDPK | | HPNAGKDPK | | IDIWTYNAEL | | IKTWAGNILRT | |
| HPPDAKEQT | | HPPDAKEQT | | IDIYCICRDN | | IKTWAKNILRT | |
| HPPDETEQT | | HPPDETEQT | | IDKEPMGFRY | | IKTWARNILRT | |
| HPPDTKEQT | | HPPDTKEQT | | IDKESMGFRY | | IKWNVTYTGTS | |
| HPPNTKEQT | | HPPNTKEQT | | IDKICLGHHA | | IKYNGIITDTF | |
| HPPTSAEQV | | HPPTSAEQV | | IDKITNKINN | | IKYNGIITDTL | |
| HPPTSDEQI | | HPPTSDEQI | | IDKITNKVNN | | ILAATVTLHFK | |
| HPPTSDEQV | | HPPTSDEQV | | IDKMNGNYDS | | ILAFILWACSS | |
| HPPTSNEQV | | HPPTSNEQV | | IDKMNTQFEA | | ILAFIMWACSN | |
| HPPTTDEQM | | HPPTTDEQM | | IDKMNTQFET | | ILAFIMWACSS | |
| HPRGLLEVG | | HPRGLLEVG | | IDKMNTRFEA | | ILAIYATVAGS | |
| HPSAGKDPK | | HPSAGKDPK | | IDKNALGDCP | | ILAIYSTAASS | |
| HPSAGRDPK | | HPSAGRDPK | | IDKNALGECP | | ILAIYSTISSS | |
| HPSSAQEKN | | HPSSAQEKN | | IDKTNQQFEL | | ILAIYSTVASS | |

Fig. 83-149

| Block size 8 | SIN | Block size 9 | SIN | Block size 10 | SIN | Block size 11 | SIN |
|---|---|---|---|---|---|---|---|
| HPSSDNEQT | | HPSSDNEQT | | IDKTNQQFEM | | ILAIYSTVSSS | |
| HPSSTKEKN | | HPSSTKEKN | | IDKVCTKGKK | | ILANNGKFEFI | |
| HPSSTQEKN | | HPSSTQEKN | | IDLADSEMDK | | ILANNGRFEFI | |
| HPSTGKDPK | | HPSTGKDPK | | IDLADSEMKK | | ILASSGSLEFI | |
| HPTLLFLKV | | HPTLLFLKV | | IDLADSEMLN | | ILATTITLHFK | |
| HPVTIGECP | | HPVTIGECP | | IDLADSEMNK | | ILATTVTLHFK | |
| HPVTIGKCP | | HPVTIGKCP | | IDLADSEMNN | | ILDEHDSNVKN | |
| HQCDNNCIE | | HQCDNNCIE | | IDLADSEMSK | | ILDFHDSNVKN | |
| HQFELIDNE | | HQFELIDNE | | IDLAESEMNK | | ILDGVTASCRD | |
| HQGTTIRNK | | HQGTTIRNK | | IDLANSEMNK | | ILDQNFRNIRK | |
| HQGTTIRNR | | HQGTTIRNR | | IDLGQCGLLG | | ILEDEQMYQKC | |
| HQIEKEFEQ | | HQIEKEFEQ | | IDLTDSEMNK | | ILEDEQMYQRC | |
| HQIEKEFGQ | | HQIEKEFGQ | | IDLTDSEMSK | | ILEDERMYQKC | |
| HQIEKEFSE | | HQIEKEFSE | | IDLVETNHTG | | ILEEESDEALK | |
| HQIGNVINW | | HQIGNVINW | | IDLWSYNADV | | ILEENTTYKIL | |
| HQILAIYST | | HQILAIYST | | IDLWSYNAEL | | ILEGTTASCQN | |
| HQISNVINW | | HQISNVINW | | IDLWSYNAGL | | ILEKMHNGKLC | |
| HQLLRHFQK | | HQLLRHFQK | | IDMADSEMLN | | ILEKNITVTHS | |
| HQLRENAED | | HQLRENAED | | IDMADSTMLN | | ILEKNVTVTHA | |
| HQNAEGIGI | | HQNAEGIGI | | IDMTDSEMNK | | ILEKNVTVTHS | |
| HQNAEGTGI | | HQNAEGTGI | | IDNDNWSGYS | | ILEKTHNGKLC | |
| HQNAEGTGM | | HQNAEGTGM | | IDNEFTEVEQ | | ILEKTHNGRLC | |
| HQNAEGTGT | | HQNAEGTGT | | IDNGDGCFEI | | ILEKVHNGKLC | |
| HQNAQGEGI | | HQNAQGEGI | | IDNMQNKLNN | | ILEQNVTVTHA | |
| HQNAQGEGT | | HQNAQGEGT | | IDNMQNRLNN | | ILERNVTVTHA | |
| HQNAQGIGQ | | HQNAQGIGQ | | IDNNNWSGYS | | ILERNVTVTHS | |
| HQNAQGQGT | | HQNAQGQGT | | IDPKGLFGAI | | ILERTHNGKLC | |
| HQNAQGSGY | | HQNAQGSGY | | IDPVELSSGY | | ILETGYICSKF | |
| HQNAQGTGQ | | HQNAQGTGQ | | IDPVKLSGGY | | ILETGYVCGKF | |
| HQNEQGMGM | | HQNEQGMGM | | IDPVKLSSGY | | ILETGYVCSKF | |
| HQNEQGSGY | | HQNEQGSGY | | IDQINGKLNR | | ILETRYVCSKF | |
| HQNEQGTGI | | HQNEQGTGI | | IDQISGKLNR | | ILFNTIGNLIA | |
| HQNEQGVGI | | HQNEQGVGI | | IDQITGKLNH | | ILGFVFTLTVP | |
| HQNEQGVGM | | HQNEQGVGM | | IDQITGKLNR | | ILGFVLWACQN | |
| HQNGQGSGY | | HQNGQGSGY | | IDQITGTLNR | | ILGILTGPPQC | |
| HQNSEGIGQ | | HQNSEGIGQ | | IDQITTKINN | | ILGMQNGSCRC | |
| HQNSEGMGQ | | HQNSEGMGQ | | IDQSLIIAAR | | ILGMQNGSYRC | |
| HQNSEGRGQ | | HQNSEGRGQ | | IDQVKLSSGY | | ILGNGCFEFWH | |
| HQNSEGTGI | | HQNSEGTGI | | IDQVTGKLNR | | ILGNPKCDLYL | |
| HQNSEGTGQ | | HQNSEGTGQ | | IDRFLRVKDQ | | ILGNPKCDPYL | |
| HQNSQGEGT | | HQNSQGEGT | | IDRFLRVRDQ | | ILGNPMCDDLI | |
| HQNTQGEGT | | HQNTQGEGT | | IDRITTKINN | | ILGNPMCDELI | |
| HQRSKFLLM | | HQRSKFLLM | | IDRNAIGDCP | | ILGNPMCDNLI | |
| HQSETYPVI | | HQSETYPVI | | IDRNALGDCP | | ILGNPMCDYLI | |
| HQSFVPSPG | | HQSFVPSPG | | IDRSFRPNIG | | ILGNPRCDDLI | |
| HQSGTYPII | | HQSGTYPII | | IDRTNHQFEL | | ILGTIIGPPQC | |
| HQSGTYPVI | | HQSGTYPVI | | IDSGYVCSGL | | ILHKCDNECME | |
| HQSGTYPVV | | HQSGTYPVV | | IDSIGSWSQN | | ILHKCDNKCME | |
| HQSTNSTET | | HQSTNSTET | | IDSLLGDPHC | | ILHKCNDSCME | |
| HQYSEKGKW | | HQYSEKGKW | | IDSNYVCSGL | | ILHKCNNECME | |
| HQYSEKGRW | | HQYSEKGRW | | IDSRAVGKCP | | ILIAGGLILGM | |
| HQYSERGKW | | HQYSERGKW | | IDSSYICSGL | | ILITQESECVC | |
| HQYSERGRW | | HQYSERGRW | | IDSSYLCSGL | | ILKDCSIAGWL | |
| HRCDDQCME | | HRCDDQCME | | IDSSYVCSGL | | ILKDCSVAGWL | |
| HRCDNECIE | | HRCDNECIE | | IDSTDSEMNK | | ILKGKFQTAAQ | |
| HRDEEGTGI | | HRDEEGTGI | | IDSVKLSSGY | | ILKHNPTEEQA | |
| HRFEIIEGR | | HRFEIIEGR | | IDSWAVGRCP | | ILKPGQTVKIQ | |
| HRIYWIREG | | HRIYWIREG | | IDTGDGCFEI | | ILKQNPTEEQA | |
| HRIYWIRKG | | HRIYWIRKG | | IDTGKGCFDI | | ILKRGETLKIR | |
| HRKRRVRDN | | HRKRRVRDN | | IDTGNGCFDI | | ILKVPNALTDE | |
| HRLCYPGEL | | HRLCYPGEL | | IDTILERNVT | | ILLENERTLDF | |
| HRLKITENS | | HRLKITENS | | IDTIMEKNVT | | ILLENERTLDL | |

Fig. 83-150

| Block size 8 | SIN | Block size 9 | SIN | Block size 10 | SIN | Block size 11 | SIN |
|---|---|---|---|---|---|---|---|
| HRNDEGTGI | | HRNDEGTGI | | IDTLTETGVP | | ILLNPFVSHKE | |
| HRNEEGTGI | | HRNEEGTGI | | IDTNKTFQNI | | ILLSPEEVSET | |
| HRNTFGDCP | | HRNTFGDCP | | IDVADSEMNK | | ILNLLIGISNV | |
| HRNTIGDCP | | HRNTIGDCP | | IDVTDSEMDK | | ILNNKNWSGYS | |
| HRNTIGNCP | | HRNTIGNCP | | IDVTDSEMNK | | ILNTSQRGILE | |
| HRSTIGDCP | | HRSTIGDCP | | IDVTDSEMNR | | ILNTSQRGVLE | |
| HRTLLMNEL | | HRTLLMNEL | | IDVWTYNAEL | | ILPFDFDKISQ | |
| HRTLLMSEL | | HRTLLMSEL | | IDVYCICRDN | | ILPFDIDKIIT | |
| HRVYWIREG | | HRVYWIREG | | IDVYCVCRDN | | ILRDCSVAGWL | |
| HSAAFEDLR | | HSAAFEDLR | | IEAESSIKEK | | ILRGAVAHKSC | |
| HSAYCNTDL | | HSAYCNTDL | | IEAESSVKEK | | ILRGSIAHKSC | |
| HSDNADKIC | | HSDNADKIC | | IEAESSVREK | | ILRGSVAHKSC | |
| HSDTPRPAD | | HSDTPRPAD | | IEAMASQGTK | | ILRQNPSEEQA | |
| HSDTPRPDD | | HSDTPRPDD | | IEAMATQGTK | | ILRQNPTEEQA | |
| HSDTPRPSD | | HSDTPRPSD | | IEARGLFGAI | | ILRTHESECVC | |
| HSDTPRPTD | | HSDTPRPTD | | IEAVIYGNPK | | ILRTQDSECVS | |
| HSDTPRPVD | | HSDTPRPVD | | IECIGWSSTS | | ILRTQESDCVC | |
| HSECRTFFL | | HSECRTFFL | | IECVCRDNWR | | ILRTQESECAC | |
| HSGICPVVF | | HSGICPVVF | | IECVGWSSTS | | ILRTQESECIC | |
| HSGVCPVVF | | HSGVCPVVF | | IEDLIFLARS | | ILRTQESECLC | |
| HSHYREEAL | | HSHYREEAL | | IEDLIFLTRS | | ILRTQESECQC | |
| HSKDNGIRI | | HSKDNGIRI | | IEDLIFMARS | | ILRTQESECVC | |
| HSKDNNIRI | | HSKDNNIRI | | IEDLIFSARS | | ILRTQESECVR | |
| HSKDNSIRI | | HSKDNSIRI | | IEDLTFLARS | | ILRTQESECVS | |
| HSKEQGSGY | | HSKEQGSGY | | IEDLWAYNAE | | ILRTQESSCSC | |
| HSKYREEAM | | HSKYREEAM | | IEDPAAPHGL | | ILRTQESSCTC | |
| HSMSDIEAM | | HSMSDIEAM | | IEDPDHEGEG | | ILRTQESSCVC | |
| HSMSGFRSN | | HSMSGFRSN | | IEDPGAPHGL | | ILSIAPIMFSN | |
| HSNAEGTGM | | HSNAEGTGM | | IEDPNAPHKL | | ILSIYSCIASS | |
| HSNDQGAGY | | HSNDQGAGY | | IEDPNAPNKF | | ILSIYSCVASS | |
| HSNDQGSGY | | HSNDQGSGY | | IEDPNAPNKL | | ILSIYSSVASS | |
| HSNDTIHDR | | HSNDTIHDR | | IEDPNHEGEG | | ILSIYSTAASS | |
| HSNDTVHDR | | HSNDTVHDR | | IEDPSAPHGL | | ILSIYSTVAAS | |
| HSNEQGSGY | | HSNEQGSGY | | IEDPSAPHRL | | ILSIYSTVASS | |
| HSNETVKDR | | HSNETVKDR | | IEDPSHEGEG | | ILSIYSTVSSS | |
| HSNGQGSGY | | HSNGQGSGY | | IEDPTAPHGL | | ILSIYSTVTSS | |
| HSNGTAKDR | | HSNGTAKDR | | IEDQITDIWA | | ILSIYSTVVSS | |
| HSNGTIEDR | | HSNGTIEDR | | IEECLINDPW | | ILSKDNAIRIG | |
| HSNGTIHDR | | HSNGTIHDR | | IEECSCYGHD | | ILSMAPIMFSN | |
| HSNGTIKDK | | HSNGTIKDK | | IEECSCYGHN | | ILSNPKCDLYL | |
| HSNGTIKDR | | HSNGTIKDR | | IEECSCYGHS | | ILSPLTKGILG | |
| HSNGTINDR | | HSNGTINDR | | IEECSCYPND | | ILSPLTKGMLG | |
| HSNGTKHDR | | HSNGTKHDR | | IEECSCYPNE | | ILSVYSTVASS | |
| HSNGTMKDR | | HSNGTMKDR | | IEECSCYPNL | | ILTDSQTATKR | |
| HSNGTNKDR | | HSNGTNKDR | | IEECSCYPNM | | ILTDTSRPGDK | |
| HSNGTTHDR | | HSNGTTHDR | | IEECSCYPNS | | ILTDTSRPGDR | |
| HSNGTVKBR | | HSNGTVKBR | | IEECSCYPQY | | ILTDTSRPSDK | |
| HSNGTVKDR | | HSNGTVKDR | | IEECSCYPRY | | ILTIYSTAASS | |
| HSNGTVKNR | | HSNGTVKNR | | IEEGSIGKVC | | ILTIYSTVASP | |
| HSNGTVNDR | | HSNGTVNDR | | IEELRRQKSL | | ILTIYSTVASS | |
| HSNLNDATY | | HSNLNDATY | | IEELRRQKWW | | ILTKITVDHMA | |
| HSNLNDTTY | | HSNLNDTTY | | IEELWAYNAE | | ILTKTTVDHMA | |
| HSNNTVKDR | | HSNNTVKDR | | IEEWSCYGHS | | ILTRTTVDHMA | |
| HSNSEGTGM | | HSNSEGTGM | | IEEYGKGRIF | | ILVAGGLILGM | |
| HSNSTTHDR | | HSNSTTHDR | | IEEYGRGRIF | | ILVALALSHTA | |
| HSQYREEAL | | HSQYREEAL | | IEFEPFQSLV | | ILVALENQHTI | |
| HSRGLFGAI | | HSRGLFGAI | | IEGGWCGMID | | ILVIYATVAGS | |
| HSRYREEAM | | HSRYREEAM | | IEGGWPGLIN | | ILVLGLSMVKS | |
| HSSSLDEQN | | HSSSLDEQN | | IEGGWPGLVA | | ILVLGLSMVRS | |
| HSVHRNTFG | | HSVHRNTFG | | IEGGWQGLVD | | ILVSTNAYDRI | |
| HSVHRNTIG | | HSVHRNTIG | | IEGGWQGMID | | ILVTREPYLSC | |
| HSWIPKRNR | | HSWIPKRNR | | IEGGWQGMVD | | ILVTREPYVSC | |

Fig. 83-151

| Block size 8 | SIN | Block size 9 | SIN | Block size 10 | SIN | Block size 11 | SIN |
|---|---|---|---|---|---|---|---|
| HSWTPKRNR | | HSWTPKRNR | | IEGGWSGLIA | | ILVTTVTLHFK | |
| HSWVPILNT | | HSWVPILNT | | IEGGWSGLVA | | ILWACSSGNCR | |
| HSWVPKRNR | | HSWVPKRNR | | IEGGWSGLVD | | ILWFSFGASCF | |
| HTAYSQITN | | HTAYSQITN | | IEGGWSGMID | | ILWFSFGASCV | |
| HTDELCPSP | | HTDELCPSP | | IEGGWTGLID | | ILWFSFGASSF | |
| HTEYRQEAL | | HTEYRQEAL | | IEGGWTGMID | | ILWFSLGASCF | |
| HTGNPVICL | | HTGNPVICL | | IEGGWTGMVD | | ILWISFAISCF | |
| HTGSFCSID | | HTGSFCSID | | IEGGWTGMVN | | ILWISFAISCL | |
| HTGSFCSIN | | HTGSFCSIN | | IEGICYPGSI | | ILWISFAMSCF | |
| HTGTFCSIN | | HTGTFCSIN | | IEGIKLKSED | | ILWISFATSCF | |
| HTGTSKACN | | HTGTSKACN | | IEGIKLKTED | | ILWISFSISCF | |
| HTGTYCSLD | | HTGTYCSLD | | IEGKLSQMSK | | ILWISFSMSCF | |
| HTGTYCSLG | | HTGTYCSLG | | IEGKLSQMSR | | ILWTSNSIVVF | |
| HTGTYCSLN | | HTGTYCSLN | | IEGLWAYNAE | | ILWVSFSISCF | |
| HTGTYCSLS | | HTGTYCSLS | | IEGRIQDLEK | | IMASQGTKRSY | |
| HTIDLADSE | | HTIDLADSE | | IEGRWPGLVA | | IMEKNITVTHA | |
| HTIDLAESE | | HTIDLAESE | | IEGWVVVAKD | | IMEKNVAVTHA | |
| HTIDLTDAE | | HTIDLTDAE | | IEHQIGNVIN | | IMEKNVTVTHA | |
| HTIDLTDSE | | HTIDLTDSE | | IEIITIGSIC | | IMERNVTVTHA | |
| HTIDLTNSE | | HTIDLTNSE | | IEIWSYNAEF | | IMESGGIDKIG | |
| HTIDMADSE | | HTIDMADSE | | IEKDNAVRFG | | IMESGGIDKIS | |
| HTIDMGDSE | | HTIDMGDSE | | IEKEFEQVEG | | IMESGGIDKVS | |
| HTIDMTDSE | | HTIDMTDSE | | IEKEFGQVEG | | IMESGGISKIS | |
| HTIDSTDSE | | HTIDSTDSE | | IEKEFSEIEG | | IMESGGISKMS | |
| HTIDVTDSE | | HTIDVTDSE | | IEKEFSEVEG | | IMEVVFPNEVG | |
| HTIHLTDSE | | HTIHLTDSE | | IEKIEKIRPL | | IMFSNKMAKLG | |
| HTKCQTYAG | | HTKCQTYAG | | IEKIRNGTYD | | IMFSNKMARLG | |
| HTKCQTYTG | | HTKCQTYTG | | IEKITNKVNN | | IMFSNKVARLG | |
| HTKDNSIRI | | HTKDNSIRI | | IEKMNGNYDS | | IMGLFFFCLKN | |
| HTKILYFHK | | HTKILYFHK | | IEKMNIQFTA | | IMGLVFFCLKN | |
| HTKVLYFHK | | HTKVLYFHK | | IEKMNIQFTS | | IMGLVFFCLRN | |
| HTKYRTESL | | HTKYRTESL | | IEKMNTQFTA | | IMHDRTKIRQL | |
| HTQYREEAL | | HTQYREEAL | | IEKMNTQFTV | | IMINPVKLSGG | |
| HTQYREESL | | HTQYREESL | | IEKMVLSAFD | | IMINPVKLSSG | |
| HTQYRTESL | | HTQYRTESL | | IEKNALGDCP | | IMIWHSNLNDA | |
| HTQYRTGSL | | HTQYRTGSL | | IEKQIGNVIN | | IMIWHSNLNDT | |
| HTRGLFGAI | | HTRGLFGAI | | IEKTNDKYHQ | | IMNTSKPFQNT | |
| HTSKYVCTG | | HTSKYVCTG | | IEKTNEKFHQ | | IMQNKLNNVID | |
| HTSQYICSP | | HTSQYICSP | | IEKTNEKYHQ | | IMRTQESECAC | |
| HTSQYLCTG | | HTSQYLCTG | | IEKTNKQFEL | | IMRTQESECVC | |
| HTSRYICTG | | HTSRYICTG | | IEKTNQQFEL | | IMRTQESSCTC | |
| HTSRYMCTG | | HTSRYMCTG | | IEKTNQQFKL | | IMRTVIALSYI | |
| HTSRYVCTG | | HTSRYVCTG | | IEKTNTEFES | | IMTDGPANSQA | |
| HVCITGDDR | | HVCITGDDR | | IEKTNTQFEL | | IMTDGPASSQA | |
| HVCVTGDDG | | HVCVTGDDG | | IEKTSWSYIV | | IMTDGSASSQA | |
| HVCVTGDDK | | HVCVTGDDK | | IEKVRNGTYD | | IMTIGSVSLAL | |
| HVCVTGDDR | | HVCVTGDDR | | IEKYGSGRIF | | IMWACNSGNCR | |
| HVDTIMEKN | | HVDTIMEKN | | IEKYGTGRIF | | IMWACQKGNIK | |
| HVEECSCYP | | HVEECSCYP | | IELAEKAMKE | | IMWACQKGNIR | |
| HVEVVSAKE | | HVEVVSAKE | | IELIRGRPKE | | IMWACQRGNIR | |
| HVFVIREPF | | HVFVIREPF | | IEMTDSEMLN | | IMWACSNGNCR | |
| HVLVTREPY | | HVLVTREPY | | IENDRTLDLH | | IMWACSNGSCR | |
| HVQNNYTTI | | HVQNNYTTI | | IENERTLDFH | | IMWACSSGNCR | |
| HVQNNYTTV | | HVQNNYTTV | | IENGWEGLID | | IMWTCNSGNCR | |
| HVRKRFADQ | | HVRKRFADQ | | IENGWEGLIN | | IMWTCQKGNIR | |
| HVSPLSGSA | | HVSPLSGSA | | IENGWEGLVD | | INDPWVLLNAS | |
| HWMLLDPGD | | HWMLLDPGD | | IENGWEGMID | | INDQIEDLWAY | |
| HWNLALDIV | | HWNLALDIV | | IENGWEGMMD | | INDQITDIWAY | |
| HWPDGSNIG | | HWPDGSNIG | | IENGWEGMVD | | INDRNFWRGDN | |
| HWTIVKPGD | | HWTIVKPGD | | IENGWEGMVE | | INDRNFWRGEN | |
| HYEECSCYP | | HYEECSCYP | | IENGWEGMVN | | INECRTFFLTQ | |
| HYGGIPTDV | | HYGGIPTDV | | IENGWQGLID | | INEEALRQKIM | |

Fig. 83-152

| Block size 8 | SIN | Block size 9 | SIN | Block size 10 | SIN | Block size 11 | SIN |
|---|---|---|---|---|---|---|---|
| HYGGMPTDV | | HYGGMPTDV | | IENLEELRFV | | INEGNGCFELL | |
| HYGGVPTDV | | HYGGVPTDV | | IENLNKKIDD | | INEITTKINNI | |
| HYIGKCPKY | | HYIGKCPKY | | IENLNKKMED | | INESADMSIGI | |
| HYIGKCPRY | | HYIGKCPRY | | IENLNKKVDD | | INESADMSIGV | |
| HYKISKSTK | | HYKISKSTK | | IENLNRKMED | | INEVKLEENTT | |
| HYMGECPEY | | HYMGECPEY | | IENLNRKVDD | | INFESNGNLIA | |
| HYMGECPKY | | HYMGECPKY | | IENLQAYQKR | | INFESTGNLIA | |
| HYMGECPNY | | HYMGECPNY | | IENLWAYNAE | | INFESTGNLVA | |
| HYPKIYKTY | | HYPKIYKTY | | IENNVTVTSS | | INGALGSPGCD | |
| HYPKVYKPY | | HYPKVYKPY | | IENPSHEGEG | | INGICTVVMTD | |
| HYPKVYKTY | | HYPKVYKTY | | IENQEELKSL | | INGKLNRLIEK | |
| HYPKVYRTY | | HYPKVYRTY | | IENQEELRFL | | INGKLNRLIER | |
| HYREEALLN | | HYREEALLN | | IENQEELRSL | | INGPDSVLVNT | |
| HYSKVYKTY | | HYSKVYKTY | | IENQHTIDLA | | INGPESVLINT | |
| HYVCSGLVG | | HYVCSGLVG | | IENQKTLDEH | | INGPESVLVNT | |
| IAADKASTQ | | IAADKASTQ | | IENTYVNKTT | | INGQAGRMTFY | |
| IAADKESTQ | | IAADKESTQ | | IENTYVNNTT | | INGQSGRIDFH | |
| IAADKTSTQ | | IAADKTSTQ | | IEPKGLFGAI | | INGQSGRIDFY | |
| IAADKVSTQ | | IAADKVSTQ | | IEPRGLFGAI | | INGSCAVVMTD | |
| IAADRDSTQ | | IAADRDSTQ | | IEQNIPVTQV | | INGSCIVVMTD | |
| IAADRESTQ | | IAADRESTQ | | IEQNVPVTQV | | INGSCTVVMTD | |
| IAADRGSTQ | | IAADRGSTQ | | IEQQIGNVIN | | INGTCAVVMTD | |
| IAADYKSTQ | | IAADYKSTQ | | IERMVLSAFD | | INGTCTVIMTD | |
| IAAEKESTQ | | IAAEKESTQ | | IERNALGDCP | | INGTCTVVITD | |
| IAARNIVRR | | IAARNIVRR | | IERNALGNCP | | INGTCTVVMTD | |
| IAARSIVRR | | IAARSIVRR | | IERPTAVDTC | | INGVILEENTT | |
| IAASYKRIR | | IAASYKRIR | | IERRNSSDIC | | INGVKLEENST | |
| IADAQHRSH | | IADAQHRSH | | IERTNEKFHQ | | INGVKLEENTS | |
| IADKICIGY | | IADKICIGY | | IERTNEKYHQ | | INGVKLEENTT | |
| IADRVDDAV | | IADRVDDAV | | IERTNQQFEL | | INGVRLEENTT | |
| IADSHHRSH | | IADSHHRSH | | IERVRNGTYD | | INGVTNKVNSI | |
| IADSQHKSH | | IADSQHKSH | | IESEFNEIEH | | INGWYGFQHQN | |
| IADSQHRSH | | IADSQHRSH | | IESEFNEIEY | | INGWYGFQHRD | |
| IAEQFTWNG | | IAEQFTWNG | | IESEFSEIEH | | INGWYGFQHRN | |
| IAFCGTSGT | | IAFCGTSGT | | IESEFSETEH | | INGWYGFRHQN | |
| IAFCGVDSD | | IAFCGVDSD | | IESIIEAESS | | INIMASQGTKR | |
| IAFCGVNFD | | IAFCGVNFD | | IESIRNGTYD | | INIREWSYLIE | |
| IAFCGVNSD | | IAFCGVNSD | | IESIRNGTYN | | INKITNKVNNI | |
| IAFLTSSIV | | IAFLTSSIV | | IESKLSQMSK | | INKTGTFEFTS | |
| IAFVLWACQ | | IAFVLWACQ | | IESLNKKMED | | INKVCTKGKKA | |
| IAGFAPFSK | | IAGFAPFSK | | IESMIEAESS | | INLHAYISFRN | |
| IAGFIEGGW | | IAGFIEGGW | | IESMVEAESS | | INLLIGISNMS | |
| IAGFIEGRW | | IAGFIEGRW | | IESNGNLIAP | | INLYASKNPYT | |
| IAGFIENGW | | IAGFIENGW | | IESNVTVTNS | | INMIADRVDDA | |
| IAGGLILGM | | IAGGLILGM | | IESNVTVTSS | | INMINDKIDDQ | |
| IAGLFFWMC | | IAGLFFWMC | | IESRGLFGAI | | INMINDKINDQ | |
| IAGLSFWMC | | IAGLSFWMC | | IETGYVCSKF | | INMINSKIDDQ | |
| IAGSSEQAA | | IAGSSEQAA | | IETNHTGTYC | | INMINSKIEDQ | |
| IAGWILGNP | | IAGWILGNP | | IETTHTGTYC | | INMINSKINDQ | |
| IAGWLLGNP | | IAGWLLGNP | | IEVLHLTQGA | | INMINSQIDDQ | |
| IAGWYGFQH | | IAGWYGFQH | | IEVLHLTQGT | | INMISDKIDDQ | |
| IAHCYPGAT | | IAHCYPGAT | | IEVTNATELV | | INMLADRIDDA | |
| IAHISPLSG | | IAHISPLSG | | IEVVAAQELV | | INMLADRVDDA | |
| IAHKSCLPA | | IAHKSCLPA | | IEVVNATETV | | INMLADWVDDA | |
| IAIALGIIN | | IAIALGIIN | | IEVVTAQELV | | INMSKKKSYIN | |
| IAIGNCPKY | | IAIGNCPKY | | IEVWSYNAEF | | INMSKRKSYIN | |
| IAIGSVSRT | | IAIGSVSRT | | IEYDAVATTH | | INNDLGPATAQ | |
| IAILAATVT | | IAILAATVT | | IEYNGKSLGI | | INNETIIETGY | |
| IAILATTIT | | IAILATTIT | | IEYQIGNVIN | | INNETILETGY | |
| IAILATTVT | | IAILATTVT | | IFESNGAFLA | | INNETIVETGY | |
| IAILVTTVT | | IAILVTTVT | | IFFWMCSNGS | | INNGKGRYGVK | |
| IAIRPKVNG | | IAIRPKVNG | | IFGAIAGFIE | | INNIIDKMNGN | |

Fig. 83-153

| Block size 8 | SIN | Block size 9 | SIN | Block size 10 | SIN | Block size 11 | SIN |
|---|---|---|---|---|---|---|---|
| IAIVLGIIN | | IAIVLGIIN | | IFGCQNGNIR | | INNIIEKMNGN | |
| IAKDNAIRF | | IAKDNAIRF | | IFGCQNGNVR | | INNIVDKMNRE | |
| IAKDNAVRF | | IAKDNAVRF | | IFGKDNAIRI | | INNQNWSGYSG | |
| IAKGEKANV | | IAKGEKANV | | IFGKDNAVRI | | INNRIKINPVT | |
| IAKRSYNNT | | IAKRSYNNT | | IFGPVHFRNQ | | INPTLLFLKVP | |
| IALCGSPFP | | IALCGSPFP | | IFHKCDDDCM | | INPVELSSGYK | |
| IALCGSPFS | | IALCGSPFS | | IFHKCDDHCM | | INPVKLSGGYK | |
| IALFIGVGN | | IALFIGVGN | | IFHKCDDQCM | | INPVKLSSGYK | |
| IALGIINLL | | IALGIINLL | | IFHKCDDRCM | | INPVTLSSGYK | |
| IALIIGVGN | | IALIIGVGN | | IFHKCDNQCM | | INPVTLTMGYK | |
| IALILVALA | | IALILVALA | | IFHQCDNDCM | | INQINGKLNRL | |
| IALLIGIGN | | IALLIGIGN | | IFHQCDNNCI | | INQITGKLNRI | |
| IALLIGVGN | | IALLIGVGN | | IFHRCDDQCM | | INQITGKLNRL | |
| IALSILNLL | | IALSILNLL | | IFIFILLTHW | | INRCFYVELIR | |
| IALSVLNLL | | IALSVLNLL | | IFIFLLLTHW | | INRCFYVELTR | |
| IALSYSAGA | | IALSYSAGA | | IFLAMITYIT | | INRCFYVELVR | |
| IAMENQHTI | | IAMENQHTI | | IFLARSALIL | | INRIFQPNIGP | |
| IAMGLIFMC | | IAMGLIFMC | | IFLWCKIVTT | | INRIFRPNIGP | |
| IAMGLVFIC | | IAMGLVFIC | | IFLWGIHHPP | | INRNFKPNIGP | |
| IAMGLVFMC | | IAMGLVFMC | | IFLWMCSNGS | | INRNFQPNIGP | |
| IANCYPGAT | | IANCYPGAT | | IFLYVRTNGT | | INRQEIEGARL | |
| IANLGLNIG | | IANLGLNIG | | IFMARSALIL | | INRQEIEGVKL | |
| IAPDRASFF | | IAPDRASFF | | IFMCVKNGNL | | INRQEIEGVRL | |
| IAPDRASFL | | IAPDRASFL | | IFMCVKNGNM | | INRSFKPNIGP | |
| IAPDRATFL | | IAPDRATFL | | IFNFILLTHW | | INRSFQPNIGP | |
| IAPDRVSFL | | IAPDRVSFL | | IFNGAFIAPD | | INRSFRPNIGP | |
| IAPEFGYLL | | IAPEFGYLL | | IFNMERIKEL | | INRTGTFEFTS | |
| IAPEKVDFE | | IAPEKVDFE | | IFNSIGNLIA | | INSIIDKMNTQ | |
| IAPENAYKI | | IAPENAYKI | | IFQPNIGPRP | | INSPLPFQNID | |
| IAPEYAFKI | | IAPEYAFKI | | IFRPNIGPRP | | INSSKPFQNAS | |
| IAPEYAYIV | | IAPEYAYIV | | IFSARSALIL | | INSSKPFQNTS | |
| IAPEYAYKI | | IAPEYAYKI | | IFSFNGEEMA | | INSSKPLQNAS | |
| IAPEYAYKV | | IAPEYAYKV | | IFSFTGEEMA | | INSSMPFHNIH | |
| IAPEYAYRI | | IAPEYAYRI | | IFSHNGGLIA | | INSSMPFHNVH | |
| IAPEYGFKI | | IAPEYGFKI | | IFSKDNAIRI | | INSSMPLHNIH | |
| IAPEYGFRI | | IAPEYGFRI | | IFSKDNGIRI | | INSSRPFQNAS | |
| IAPEYGHLI | | IAPEYGHLI | | IFVIREPFIS | | INSSYVCSGLV | |
| IAPEYGHLT | | IAPEYGHLT | | IFVIREPFVA | | INSVKLFSGYK | |
| IAPEYGHLV | | IAPEYGHLV | | IFVIREPFVS | | INSVKLSSGYK | |
| IAPEYGYLI | | IAPEYGYLI | | IFVMREPFIS | | INSWHIFGKDN | |
| IAPIMFSNK | | IAPIMFSNK | | IGAIDSSMPF | | INSWHIYGKDN | |
| IAPLMMAYM | | IAPLMMAYM | | IGAMASQGTK | | INTALLNASCA | |
| IAPLMVAYM | | IAPLMVAYM | | IGAPQLNPID | | INTAMLNASCA | |
| IAPNRASFF | | IAPNRASFF | | IGARIGEGQR | | INTINSKIDDQ | |
| IAPRGHYKI | | IAPRGHYKI | | IGARPQVNGQ | | INTKLPFQNLS | |
| IAPRGHYKL | | IAPRGHYKL | | IGDCPKYIKS | | INTLTERGVEV | |
| IAPRGHYRL | | IAPRGHYRL | | IGDCPKYMNV | | INTNKTFQNID | |
| IAPRGYFKI | | IAPRGYFKI | | IGDCPKYVNI | | INTNKTFQNIE | |
| IAPRGYFKM | | IAPRGYFKM | | IGDCPKYVNV | | INTNRTFQNID | |
| IAPRGYFKV | | IAPRGYFKV | | IGDGQRSWMK | | INTRLPFQNLS | |
| IAPRGYYKM | | IAPRGYYKM | | IGEAPSPYNS | | INTSKPFQNTS | |
| IAPRYAFEL | | IAPRYAFEL | | IGECPKYIKS | | INTTLPFHNIH | |
| IAPRYGYII | | IAPRYGYII | | IGECPKYVKS | | INTTLPFHNVH | |
| IAPSRVSKL | | IAPSRVSKL | | IGECPKYVRS | | INTWARNILRT | |
| IAPSRVTKL | | IAPSRVTKL | | IGECPRYVKS | | INTYQWIIRNW | |
| IAQDNAIRF | | IAQDNAIRF | | IGEDIAPIEH | | INVINDKIDDQ | |
| IAQKLEDVF | | IAQKLEDVF | | IGEDIAPIEY | | INVTKENTGSY | |
| IAQRLEDVF | | IAQRLEDVF | | IGEDLAPIEY | | INWLTKKEPDT | |
| IAQRLEGVF | | IAQRLEGVF | | IGEDSDILVT | | INWLTKKKNPE | |
| IAQRLENVF | | IAQRLENVF | | IGEDSDVLVT | | INWLTKKKPDI | |
| IAQRLESVF | | IAQRLESVF | | IGEDVAPIEH | | INWLTKKKPDT | |
| IASDILKRM | | IASDILKRM | | IGEDVAPIEY | | INWTKDSITDI | |

Fig. 83-154

| Block size 8 | SIN | Block size 9 | SIN | Block size 10 | SIN | Block size 11 | SIN |
|---|---|---|---|---|---|---|---|
| IASDILTRM | | IASDILTRM | | IGEGQRSWMK | | INWTQDAMTEV | |
| IASIRRNYF | | IASIRRNYF | | IGEKSDVLVT | | INWTRDAMTEI | |
| IASKDNGIR | | IASKDNGIR | | IGENSDVLVT | | INWTRDAMTEV | |
| IASMRRDYF | | IASMRRDYF | | IGENSGVLVT | | INWTRDSITEV | |
| IASMRRNYF | | IASMRRNYF | | IGEVPSPYNS | | INWTRDSLTEI | |
| IASMRRSYF | | IASMRRSYF | | IGEYPVVKGE | | INWTRDSMTEI | |
| IASRSGYEM | | IASRSGYEM | | IGFHFEECSC | | INWTRDSMTEV | |
| IASSGTLEF | | IASSGTLEF | | IGFWMCSNGS | | INWTRDSVTEL | |
| IASSIVLVG | | IASSIVLVG | | IGGFIFGCQN | | INYYNETFVNV | |
| IASSIVMVG | | IASSIVMVG | | IGGSGTDNYG | | IPCFWVEMIRG | |
| IASSLILAA | | IASSLILAA | | IGGSGTNNYG | | IPEAGLKWELM | |
| IASSLPFQN | | IASSLPFQN | | IGGWATANSK | | IPEVCLKWDLM | |
| IASSLVLAA | | IASSLVLAA | | IGGWTIANSK | | IPEVCLKWELM | |
| IASSTVLVG | | IASSTVLVG | | IGGWTTANSK | | IPEVCLKWGLM | |
| IASSTVMVG | | IASSTVMVG | | IGHHANNSTE | | IPFHLGTKQVC | |
| IASSVVLVG | | IASSVVLVG | | IGIAADRDST | | IPGKQAKGLFG | |
| IASTTAKAM | | IASTTAKAM | | IGIGNLIFNT | | IPHRTLLMNEL | |
| IASVPASRY | | IASVPASRY | | IGIGNLVFNT | | IPHRTLLMSEL | |
| IASWAGNIL | | IASWAGNIL | | IGISGPDDGA | | IPIGERGLFGA | |
| IATPGMQIR | | IATPGMQIR | | IGISGPDNEA | | IPKRNRSILNT | |
| IATREPYVS | | IATREPYVS | | IGISGPDNGA | | IPLTTTPTKSY | |
| IATRPKVNG | | IATRPKVNG | | IGISGPDSGA | | IPMISKCKTKE | |
| IATRPQVNG | | IATRPQVNG | | IGISNVGLNI | | IPMISKCRTKE | |
| IATRPRVNG | | IATRPRVNG | | IGISNVGLNV | | IPMISKCRTRE | |
| IATRSKVNG | | IATRSKVNG | | IGISSMVEAM | | IPMISKSRTKE | |
| IAVFCGTSG | | IAVFCGTSG | | IGITGPDATA | | IPMISNCRTKE | |
| IAWSATACH | | IAWSATACH | | IGITVIKNNM | | IPPLELGDCSI | |
| IAWSRSSCH | | IAWSRSSCH | | IGKCNDPYPG | | IPPLELGNCSI | |
| IAWSSASCH | | IAWSSASCH | | IGKCPKYIPS | | IPPLELRDCSI | |
| IAWSSSSCF | | IAWSSSSCF | | IGKCPKYISS | | IPPLVLGDCSI | |
| IAWSSSSCH | | IAWSSSSCH | | IGKCPKYVKS | | IPQIESRGLFG | |
| IAWSSSSCY | | IAWSSSSCY | | IGKCPRYIPS | | IPSGPLKAEIA | |
| IAYCYPGAT | | IAYCYPGAT | | IGKCPRYVKQ | | IPSGSLKLAIG | |
| IAYCYPGST | | IAYCYPGST | | IGKFYIQMCT | | IPSIQSRGLFG | |
| IAYCYPGTT | | IAYCYPGTT | | IGKITNKVNN | | IPSNSLKLAIG | |
| IAYERMCNI | | IAYERMCNI | | IGKMNTQFEA | | IPSRSLKLAIG | |
| ICATCEQIA | | ICATCEQIA | | IGKTNEKFHQ | | IPSVQSRGLFG | |
| ICAVATTHS | | ICAVATTHS | | IGKTNQQFEL | | IPSWAGNILRT | |
| ICAVVMTDG | | ICAVVMTDG | | IGKTSWSYIV | | IPSWAGNVLRT | |
| ICEKLEQSG | | ICEKLEQSG | | IGKVCRTLLA | | IPSWEGNILRT | |
| ICFMYSDFH | | ICFMYSDFH | | IGLLLQIISL | | IPTDTPRFQDS | |
| ICIAWSSSS | | ICIAWSSSS | | IGLLLQITSL | | IPTDTPRIQDS | |
| ICIDFRDMR | | ICIDFRDMR | | IGLREQKQEF | | IPTDTPRVQDD | |
| ICIGHHANN | | ICIGHHANN | | IGLRISSSFS | | IPTDTPRVQDN | |
| ICIGYHANN | | ICIGYHANN | | IGLRNTPSIE | | IPTDTPRVQDS | |
| ICIGYHSNN | | ICIGYHSNN | | IGLRNVPQAQ | | IPVTQTMELVE | |
| ICIGYLSNN | | ICIGYLSNN | | IGLRNVPQIE | | IPVTQVEELVH | |
| ICIGYLSTN | | ICIGYLSTN | | IGLRNVPQIQ | | IQAGVDRFYRI | |
| ICIGYMSNN | | ICIGYMSNN | | IGLRNVPQVQ | | IQAGVDRFYRT | |
| ICIGYQSNN | | ICIGYQSNN | | IGLSPNVYQA | | IQAGVNRFYRT | |
| ICIGYQTNN | | ICIGYQTNN | | IGNCPKYVKQ | | IQALQLLLEVE | |
| ICIKNGNMQ | | ICIKNGNMQ | | IGNCPKYVNV | | IQDIWAYNAEL | |
| ICIKNGNMR | | ICIKNGNMR | | IGNGCFEFYH | | IQDLEKYIEDT | |
| ICILDQNFR | | ICILDQNFR | | IGNLAFNAVI | | IQDLEKYVEDT | |
| ICINGTCTV | | ICINGTCTV | | IGNLIAPRGH | | IQDLERYVEDT | |
| ICIQGNNDN | | ICIQGNNDN | | IGNLIFNTVI | | IQDLWAYNAEL | |
| ICISGPNNN | | ICISGPNNN | | IGNLVAPRGH | | IQDVWAYNAEL | |
| ICKAAIGLR | | ICKAAIGLR | | IGNLVFNTVI | | IQGIKLTQGYK | |
| ICKAALGLR | | ICKAALGLR | | IGNVINWTKD | | IQGNNDNATAT | |
| ICKAAMGLK | | ICKAAMGLK | | IGNVINWTQD | | IQGVKLAQGYK | |
| ICKAAMGLR | | ICKAAMGLR | | IGNVINWTRD | | IQGVKLIQGYK | |
| ICKAAMGMR | | ICKAAMGMR | | IGPLSGSAQH | | IQGVKLTQGYK | |

Fig. 83-155

| Block size 8 | SIN | Block size 9 | SIN | Block size 10 | SIN | Block size 11 | SIN |
|---|---|---|---|---|---|---|---|
| ICKLVGINM | | ICKLVGINM | | IGPPHCDQFL | | IQGVRLTQGYK | |
| ICKPYIGKC | | ICKPYIGKC | | IGPPQCDKFL | | IQHLEECSCYM | |
| ICLGHHAIP | | ICLGHHAIP | | IGPPQCDLFL | | IQHLEECSCYT | |
| ICLGHHAVA | | ICLGHHAVA | | IGPPQCDLHL | | IQHLEECSCYV | |
| ICLGHHAVE | | ICLGHHAVE | | IGPPQCDQFL | | IQHPELTGLNC | |
| ICLGHHAVP | | ICLGHHAVP | | IGPPQCDRFL | | IQIDPVKLSGG | |
| ICLGHHAVS | | ICLGHHAVS | | IGPPQCDSHL | | IQIDPVKLSSG | |
| ICLGHHAVT | | ICLGHHAVT | | IGPRALVRGQ | | IQIDQVKLSSG | |
| ICMKNGNMQ | | ICMKNGNMQ | | IGPRNVPQAQ | | IQIDSVKLSSG | |
| ICMSGPNDN | | ICMSGPNDN | | IGPRNVPQVQ | | IQINPVKLSSG | |
| ICMSGPNNN | | ICMSGPNNN | | IGPRPFVRGQ | | IQNALNGNGDP | |
| ICNSNAITR | | ICNSNAITR | | IGPRPLIRGQ | | IQNEDIPIENC | |
| ICPVVFTDG | | ICPVVFTDG | | IGPRPLVMGQ | | IQNEDIPIGNC | |
| ICPVVMTDG | | ICPVVMTDG | | IGPRPLVREQ | | IQNEDIPIGSC | |
| ICQMEKIVL | | ICQMEKIVL | | IGPRPLVRGQ | | IQNEFNKACEL | |
| ICRDNWKGA | | ICRDNWKGA | | IGQAADLKST | | IQNIWAYNAEL | |
| ICRDNWKGS | | ICRDNWKGS | | IGQAADYKST | | IQPGDNITFSH | |
| ICRDNWRGA | | ICRDNWRGA | | IGQGDIVLVM | | IQPTFSVQRNL | |
| ICRDNWTGT | | ICRDNWTGT | | IGQGDVVLVM | | IQQTRVDKLTQ | |
| ICSCIASSL | | ICSCIASSL | | IGQSANVYQA | | IQSDAQIDESC | |
| ICSGFFGDN | | ICSGFFGDN | | IGQSPNVYQA | | IQSDKPFQNVS | |
| ICSGIFGDN | | ICSGIFGDN | | IGQSPNVYQS | | IQSEFNKACEL | |
| ICSGLVGDT | | ICSGLVGDT | | IGRFYIQMCT | | IQSKGLFGAIA | |
| ICSGVFGDN | | ICSGVFGDN | | IGRFYVQMCT | | IQSRGLFGAIA | |
| ICSGVFGDS | | ICSGVFGDS | | IGRMTICIQG | | IQTLVSNNDWS | |
| ICSGVFGDT | | ICSGVFGDT | | IGRMTICVQG | | IQTNGNLIAPE | |
| ICSGVLGDN | | ICSGVLGDN | | IGRTKSLESR | | IQTRGLFGAIA | |
| ICSKFHSDT | | ICSKFHSDT | | IGRTNQQFEL | | IQTSGNLIAPE | |
| ICSPVLTDN | | ICSPVLTDN | | IGSCASKCHT | | IRALTLNTMTK | |
| ICTCRDNWQ | | ICTCRDNWQ | | IGSCESKCHT | | IRCVCRDNWKG | |
| ICTGILTDT | | ICTGILTDT | | IGSCISKCHT | | IREGLILEYYF | |
| ICTGVLTDT | | ICTGVLTDT | | IGSCTSPCLT | | IREPFISCSHL | |
| ICTHLEICF | | ICTHLEICF | | IGSCVSKCHT | | IREPFISCSPL | |
| ICTHLEVCF | | ICTHLEVCF | | IGSCVSRCHT | | IREPFISCSQL | |
| ICTHMEVCF | | ICTHMEVCF | | IGSGFFPDGP | | IREPFVACGPA | |
| ICTVVMTDG | | ICTVVMTDG | | IGSIRNETYD | | IREPFVACGPS | |
| ICVAWSSSS | | ICVAWSSSS | | IGSIRNGTYD | | IREPFVACGPT | |
| ICVAWSSTS | | ICVAWSSTS | | IGSIRNGTYN | | IREPFVACSPS | |
| ICVCRDNWH | | ICVCRDNWH | | IGSKGDIFVI | | IREPFVSCGPS | |
| ICVGWSSTS | | ICVGWSSTS | | IGSKGDIFVM | | IRESGGIDKEP | |
| ICVGWSSTT | | ICVGWSSTT | | IGSKGDVFVI | | IRESGGIDKES | |
| ICVGYHANN | | ICVGYHANN | | IGSKGDVFVM | | IREWSYLIEDP | |
| ICVGYHSNN | | ICVGYHSNN | | IGSKGHVFVI | | IRFGEGEQIIV | |
| ICVGYLSTN | | ICVGYLSTN | | IGSRGEVFVI | | IRFGESEQIIV | |
| ICVKNGNHA | | ICVKNGNHA | | IGSRGHIFVI | | IRFGESEQIVV | |
| ICVKNGNMQ | | ICVKNGNMQ | | IGSRGHVFVI | | IRFGESEQVIV | |
| ICVKNGNMR | | ICVKNGNMR | | IGSRPRVRNQ | | IRFNSDLDYQI | |
| ICVQGNNDN | | ICVQGNNDN | | IGSSTYQNNF | | IRFNSDLNYQI | |
| ICVQGNNKN | | ICVQGNNKN | | IGSSYVCSGL | | IRFNSNLDYQI | |
| ICVQGNNNN | | ICVQGNNNN | | IGSVSLIIAT | | IRGEFNQVEKR | |
| ICVSGPNNN | | ICVSGPNNN | | IGSVSLTIAA | | IRGEFNQVENR | |
| ICVTGDDRN | | ICVTGDDRN | | IGSVSLTIAI | | IRGEFNQVEQR | |
| ICVVAVTDG | | ICVVAVTDG | | IGSVSLTIAT | | IRGEFSQVEQR | |
| ICYPGKFTN | | ICYPGKFTN | | IGSVSLTITT | | IRGEFSQVERR | |
| ICYPGRFTN | | ICYPGRFTN | | IGSWSHNILR | | IRGETTGRNCT | |
| ICYPGSIEN | | ICYPGSIEN | | IGSWSQNILR | | IRGFVHFVEAL | |
| ICYPGSVEN | | ICYPGSVEN | | IGTAPILGNY | | IRGFVYFVEAL | |
| IDAGDGCFE | | IDAGDGCFE | | IGTAPVLGNY | | IRGFVYFVEIL | |
| IDAGNGCFD | | IDAGNGCFD | | IGTRIGDGQR | | IRGFVYFVETL | |
| IDALLGDPH | | IDALLGDPH | | IGTSTLNQRL | | IRGKHSNGTIH | |
| IDALLGDPQ | | IDALLGDPQ | | IGVAPSPSNS | | IRGNSPIFNYN | |
| IDARIDFES | | IDARIDFES | | IGVAPVLGNY | | IRGNSPVFNYN | |

Fig. 83-156

| Block size 8 | SIN | Block size 9 | SIN | Block size 10 | SIN | Block size 11 | SIN |
|---|---|---|---|---|---|---|---|
| IDARVDFES | | IDARVDFES | | IGVAVIKNNM | | IRGQPKEKAIW | |
| IDAVKLSSG | | IDAVKLSSG | | IGVGNLAFNT | | IRGQPKEKTIW | |
| IDDAVTDIW | | IDDAVTDIW | | IGVGNLIFNT | | IRGQPKERTIW | |
| IDDAVTDVW | | IDDAVTDVW | | IGVGNLVFNT | | IRGQQGRMDYY | |
| IDDQIEDLW | | IDDQIEDLW | | IGVSGPDNGA | | IRGRHSNGTIH | |
| IDDQIEELW | | IDDQIEELW | | IGVTRREIHI | | IRGRPEEAKYV | |
| IDDQIEGLW | | IDDQIEGLW | | IGVTRREVHI | | IRGRPEEVKYV | |
| IDDQIENLW | | IDDQIENLW | | IGVTRREVHM | | IRGRPKEDEVW | |
| IDDQIIDIW | | IDDQIIDIW | | IGVTRREVHT | | IRGRPKEDKVW | |
| IDDQITDIW | | IDDQITDIW | | IGVTRREVHV | | IRGRPKEDRVW | |
| IDDQVTDIW | | IDDQVTDIW | | IGVTVIKNNM | | IRGRPKEEKVW | |
| IDECRTFFL | | IDECRTFFL | | IGVTVIRNNM | | IRGVVYFVETL | |
| IDEESRARI | | IDEESRARI | | IGWSSTSCHD | | IRGWAPLSKDN | |
| IDEGDGCFN | | IDEGDGCFN | | IGYHANNSKK | | IRHENRMVIAS | |
| IDEGDGCFS | | IDEGDGCFS | | IGYHANNSTD | | IRHENRMVLAS | |
| IDEGNGCFE | | IDEGNGCFE | | IGYHANNSTE | | IRHLEECSCYV | |
| IDEITTKIN | | IDEITTKIN | | IGYHANNSTK | | IRIAWSSSSCF | |
| IDESCEGEC | | IDESCEGEC | | IGYHANNSTT | | IRIGSKGDIFV | |
| IDFHWMLLD | | IDFHWMLLD | | IGYHANNSTV | | IRIGSKGDVFA | |
| IDFRDMRKN | | IDFRDMRKN | | IGYHSNNSTE | | IRIGSKGDVFV | |
| IDGFEPNGC | | IDGFEPNGC | | IGYHSNNSTK | | IRIGSKGHVFV | |
| IDGITNKIN | | IDGITNKIN | | IGYICSGFFG | | IRIGSRGDVFI | |
| IDGITNKVN | | IDGITNKVN | | IGYICSGIFG | | IRIGSRGDVFV | |
| IDGKAPISL | | IDGKAPISL | | IGYICSGVFG | | IRIGSRGEVFV | |
| IDGTCTVVM | | IDGTCTVVM | | IGYICSGVLG | | IRIGSRGHIFV | |
| IDGVTNKVN | | IDGVTNKVN | | IGYLSNNATD | | IRIGSRGHVFI | |
| IDGWTTANS | | IDGWTTANS | | IGYLSNNSSD | | IRIGSRGHVFV | |
| IDGWYGFHH | | IDGWYGFHH | | IGYLSNNSTD | | IRINNETILET | |
| IDGWYGFKH | | IDGWYGFKH | | IGYLSNNSTE | | IRKGLILEYYS | |
| IDGWYGFRH | | IDGWYGFRH | | IGYLSTNSSE | | IRLAAGGAIWV | |
| IDGWYGYHH | | IDGWYGYHH | | IGYMSNNSTE | | IRLAAGGDIWV | |
| IDGWYGYKH | | IDGWYGYKH | | IGYQSNNSTD | | IRLFDYSGWNV | |
| IDGWYGYRH | | IDGWYGYRH | | IGYQSNNSTN | | IRLFDYSKWNV | |
| IDIMQNKLN | | IDIMQNKLN | | IGYQTNNSTD | | IRLFDYSRWNV | |
| IDIWAYNAE | | IDIWAYNAE | | IGYQTNNSTE | | IRLQLRDNAKE | |
| IDIWTYNAE | | IDIWTYNAE | | IGYVCSGIFG | | IRLSADGDIWV | |
| IDIYCICRD | | IDIYCICRD | | IGYVCSGVFG | | IRLSAGGAIWV | |
| IDKEPMGFR | | IDKEPMGFR | | IHDGTAFRGL | | IRLSAGGDIWI | |
| IDKESMGFR | | IDKESMGFR | | IHDRAAFRGL | | IRLSAGGDIWV | |
| IDKICLGHH | | IDKICLGHH | | IHDRIPHRTL | | IRLSGGGDIWV | |
| IDKINGKLN | | IDKINGKLN | | IHDRSPFRAL | | IRMAINWGRIV | |
| IDKITNKIN | | IDKITNKIN | | IHDRSPHRTL | | IRMATNECRII | |
| IDKITNKVN | | IDKITNKVN | | IHDRSPYRAL | | IRMIKRGINDR | |
| IDKMNGNYD | | IDKMNGNYD | | IHDRSQFRAL | | IRMIKRGVNDR | |
| IDKMNTQFE | | IDKMNTQFE | | IHDRSQYRAL | | IRMVKRGINDR | |
| IDKMNTRFE | | IDKMNTRFE | | IHDRSQYRSL | | IRNGTYDHKEF | |
| IDKNALGDC | | IDKNALGDC | | IHDRTAFRGL | | IRNGTYDHNIY | |
| IDKNALGEC | | IDKNALGEC | | IHDRTPHRTL | | IRNGTYNHEDY | |
| IDKTNQQFE | | IDKTNQQFE | | IHDRTTFRGL | | IRNKHSNGTIH | |
| IDKVCTKGK | | IDKVCTKGK | | IHECRTFFLT | | IRNKHSNGTTH | |
| IDLADSEMD | | IDLADSEMD | | IHFESNGNFI | | IRNKHSNSTTH | |
| IDLADSEMK | | IDLADSEMK | | IHHPDSETTA | | IRNLHIPEAGL | |
| IDLADSEML | | IDLADSEML | | IHHPDTEATA | | IRNLHIPEVCL | |
| IDLADSEMN | | IDLADSEMN | | IHHPDTEAVA | | IRNNMINNDLG | |
| IDLADSEMS | | IDLADSEMS | | IHHPDTEEVA | | IRNNSYDHSKY | |
| IDLGQCGLL | | IDLGQCGLL | | IHHPDTETTA | | IRNNTYDHAQY | |
| IDLTDAEMN | | IDLTDAEMN | | IHHPPDAKEQ | | IRNNTYDHKKY | |
| IDLTDSEMN | | IDLTDSEMN | | IHHPPDETEQ | | IRNNTYDHSHY | |
| IDLTDSEMS | | IDLTDSEMS | | IHHPPDTKEQ | | IRNNTYDHSKY | |
| IDLTNSEMN | | IDLTNSEMN | | IHHPPNTKEQ | | IRNNTYDHSQY | |
| IDLVETNHT | | IDLVETNHT | | IHHPPTSAEQ | | IRNNTYDHSRY | |
| IDLWSYNAE | | IDLWSYNAE | | IHHPPTSDEQ | | IRNNTYDHSTY | |

Fig. 83-157

| Block size 8 | SIN | Block size 9 | SIN | Block size 10 | SIN | Block size 11 | SIN |
|---|---|---|---|---|---|---|---|
| IDLWSYNAG | | IDLWSYNAG | | IHHPPTSNEQ | | IRNNTYDHTKY | |
| IDMADSEML | | IDMADSEML | | IHHPPTTDEQ | | IRNNTYDHTQY | |
| IDMADSTML | | IDMADSTML | | IHHPSSAQEK | | IRNNTYNHTEY | |
| IDMTDSEMN | | IDMTDSEMN | | IHHPSSTKEK | | IRNNTYNHTQY | |
| IDNDNWSGY | | IDNDNWSGY | | IHHPSSTQEK | | IRNRHSNGTIH | |
| IDNEFIEVE | | IDNEFIEVE | | IHIFSFNGEE | | IRPCFWVELIR | |
| IDNEFNEIE | | IDNEFNEIE | | IHIFSFTGEE | | IRPCFWVELVR | |
| IDNEFNEVE | | IDNEFNEVE | | IHISPLSGSA | | IRPGYNGQKSW | |
| IDNEFSEIE | | IDNEFSEIE | | IHKQLTHHMR | | IRRRVDINPGH | |
| IDNEFSEVE | | IDNEFSEVE | | IHLGDCSFEG | | IRRRVDMNPGH | |
| IDNEFTEIE | | IDNEFTEIE | | IHLTDSEMNK | | IRRRVDTNPGH | |
| IDNEFTEVE | | IDNEFTEVE | | IHPLAIGECP | | IRRRVDVNPGH | |
| IDNGDGCFE | | IDNGDGCFE | | IHPLTIGECP | | IRSFSRTELIA | |
| IDNMQNKLN | | IDNMQNKLN | | IHPLTIGKCP | | IRSFSRTELIP | |
| IDNMQNRLN | | IDNMQNRLN | | IHPLTMGECP | | IRSILANNGKF | |
| IDNNNWSGY | | IDNNNWSGY | | IHQILAIYST | | IRSWRKQILRT | |
| IDPKGLFGA | | IDPKGLFGA | | IHSRGLFGAI | | IRTATREGKHI | |
| IDPVELSSG | | IDPVELSSG | | IHTRGLFGAI | | IRTDGATSACK | |
| IDPVKLSGG | | IDPVKLSGG | | IHWTIVKPGD | | IRTFSFQLILI | |
| IDPVKLSSG | | IDPVKLSSG | | IHYGGIPTDV | | IRTFSFQLILL | |
| IDQADSEMN | | IDQADSEMN | | IHYGGMPTDV | | IRTFSFQLINN | |
| IDQINGKLN | | IDQINGKLN | | IHYGGVPTDV | | IRTKSGGNTNQ | |
| IDQITGKLN | | IDQITGKLN | | IIAARNIVRR | | IRTLTLNTMTK | |
| IDQITRKLN | | IDQITRKLN | | IIAARSIVRR | | IRTNGNLIAPE | |
| IDQITTKIN | | IDQITTKIN | | IIAFCGTSGT | | IRTNGTSKIKM | |
| IDQSLIIAA | | IDQSLIIAA | | IICIQGNNDN | | IRTRGLFGAIA | |
| IDQVKLSSG | | IDQVKLSSG | | IICLGHHAVE | | IRTRSGGNNNQ | |
| IDQVTGKLN | | IDQVTGKLN | | IICTCRDNWQ | | IRTRSGGNTNH | |
| IDRFLRVKD | | IDRFLRVKD | | IICVCRDNWH | | IRTRSGGNTNQ | |
| IDRFLRVRD | | IDRFLRVRD | | IIDIWAYNAE | | IRTRSGGNTSQ | |
| IDRITTKIN | | IDRITTKIN | | IIDKMNGNYD | | IRTWAKNILRT | |
| IDRNAIGDC | | IDRNAIGDC | | IIDKMNTQFE | | IRVGCVILLNP | |
| IDRNALGDC | | IDRNALGDC | | IIDKMNTRFE | | IRVGSRGHVFV | |
| IDRSFRPNI | | IDRSFRPNI | | IIDLADSEMN | | IRVKRRPVAKA | |
| IDRTNHQFE | | IDRTNHQFE | | IIDNDNWSGY | | IRWETTGRNCT | |
| IDSGYVCSG | | IDSGYVCSG | | IIDNNNWSGY | | IRWLTLKSGQF | |
| IDSIGSWSQ | | IDSIGSWSQ | | IIEAESSVKE | | ISCFLLAALLL | |
| IDSLLGDPH | | IDSLLGDPH | | IIEEYGKGRI | | ISCFLLIALLL | |
| IDSNYVCSG | | IDSNYVCSG | | IIEEYGRGRI | | ISCFLLVALFL | |
| IDSPNHAKS | | IDSPNHAKS | | IIEKMNGNYD | | ISCFLLVALLI | |
| IDSRAVGKC | | IDSRAVGKC | | IIEKMNTQFT | | ISCFLLVALLL | |
| IDSSYICSG | | IDSSYICSG | | IIEKYGSGRI | | ISCSHLECRTF | |
| IDSSYLCSG | | IDSSYLCSG | | IIEKYGTGRI | | ISCSHMECRTF | |
| IDSSYMCSG | | IDSSYMCSG | | IIENNVTVTS | | ISCSHSECRTF | |
| IDSSYVCSG | | IDSSYVCSG | | IIERRNSSDI | | ISCSIDECRTF | |
| IDSTDSEMN | | IDSTDSEMN | | IIESNVTVTN | | ISCSINECRTF | |
| IDSVKLSSG | | IDSVKLSSG | | IIESNVTVTS | | ISCSISECRTF | |
| IDSWAVGRC | | IDSWAVGRC | | IIETGYVCSK | | ISCSVSECRTF | |
| IDTGDGCFE | | IDTGDGCFE | | IIFLWGIHHP | | ISCSYLECRTF | |
| IDTGKGCFD | | IDTGKGCFD | | IIFNMERIKE | | ISDGGPNLYNI | |
| IDTGNGCFD | | IDTGNGCFD | | IIFNSIGNLI | | ISECRTFFLTQ | |
| IDTILERNV | | IDTILERNV | | IIFSHNGGLI | | ISFAISCFLLC | |
| IDTIMEKNV | | IDTIMEKNV | | IIGGFIFGCQ | | ISFAISCLLLC | |
| IDTLTETGV | | IDTLTETGV | | IIGISNVGLN | | ISFAMSCFLLC | |
| IDTNKTFQN | | IDTNKTFQN | | IIGKMNTQFE | | ISFATSCFLLC | |
| IDVTDSEMD | | IDVTDSEMD | | IIGPPQCDLH | | ISFESNGGLLA | |
| IDVTDSEMN | | IDVTDSEMN | | IIGPPQCDSH | | ISFESTGNLIA | |
| IDVTDSEMS | | IDVTDSEMS | | IIHISPLSGS | | ISFESTGNLVA | |
| IDVWTYNAE | | IDVWTYNAE | | IIIAIGSVSR | | ISFQGGHIEEC | |
| IDVYCICRD | | IDVYCICRD | | IIIRMMENAR | | ISFQSGHIEEC | |
| IDVYCVCRD | | IDVYCVCRD | | IIVVLLYTF | | ISFSISCFLLA | |
| IEAESSIKE | | IEAESSIKE | | IIKGRSHLRN | | ISFSISCFLLI | |

Fig. 83-158

| Block size 8 | SIN | Block size 9 | SIN | Block size 10 | SIN | Block size 11 | SIN |
|---|---|---|---|---|---|---|---|
| IEAESSVKE | | IEAESSVKE | | IIKKYTSARQ | | ISFSISCFLLV | |
| IEAESSVRE | | IEAESSVRE | | IIKKYTSGRQ | | ISFSMSCFVFV | |
| IEAMASQGT | | IEAMASQGT | | IIKLLPFAAA | | ISFTITGDNTK | |
| IEAMATQGT | | IEAMATQGT | | IIKLLPFASA | | ISFWMCSGHSC | |
| IEARGLFGA | | IEARGLFGA | | IIKMLPFAAA | | ISFWMCSNGSL | |
| IEAVIYGNP | | IEAVIYGNP | | IIKTLTNEKE | | ISFYWTIVDPG | |
| IECIGWSST | | IECIGWSST | | IILGNPKCDL | | ISFYWTIVEPE | |
| IECVCRDNW | | IECVCRDNW | | IILWFSFGAS | | ISFYWTIVEPG | |
| IECVGWSST | | IECVGWSST | | IILWFSFSIS | | ISFYWTIVVPG | |
| IEDLIFLAR | | IEDLIFLAR | | IILWISFSIS | | ISGADDDAYAV | |
| IEDLIFLTR | | IEDLIFLTR | | IILWISFSMS | | ISGFIEGGWPG | |
| IEDLIFMAR | | IEDLIFMAR | | IILWVSFSIS | | ISGPDDGAVAV | |
| IEDLIFSAR | | IEDLIFSAR | | IINGALGSPG | | ISGPDNEAVAV | |
| IEDLTFLAR | | IEDLTFLAR | | IINKMNTQFE | | ISGPDNGAVAV | |
| IEDLWAYNA | | IEDLWAYNA | | IINLLIGISN | | ISGPDSGAVAV | |
| IEDPAAPHG | | IEDPAAPHG | | IINNQNWSGY | | ISGPNNNASAI | |
| IEDPDHEGE | | IEDPDHEGE | | IINNYHNETN | | ISGPNNNASAV | |
| IEDPGAPHG | | IEDPGAPHG | | IINNYYNDTN | | ISGTCAVVMTD | |
| IEDPNAPHK | | IEDPNAPHK | | IINNYYNETN | | ISGVKLEENST | |
| IEDPNAPNK | | IEDPNAPNK | | IINNYYNKTN | | ISGWTTANSKS | |
| IEDPNHEGE | | IEDPNHEGE | | IINSWHIYGK | | ISHCRATEYIM | |
| IEDPSAPHG | | IEDPSAPHG | | IINWTRDSMT | | ISHISPLSGSA | |
| IEDPSAPHR | | IEDPSAPHR | | IIPSGPLKAE | | ISHRTLLMNEL | |
| IEDPSHEGE | | IEDPSHEGE | | IIQNEDIPIE | | ISIGSSTYQNN | |
| IEDPTAPHG | | IEDPTAPHG | | IIQNEDIPIG | | ISIGTSTLNQR | |
| IEDQITDIW | | IEDQITDIW | | IIRALTLNTM | | ISIVPNIGSRP | |
| IEECLINDP | | IEECLINDP | | IIREPFVSCS | | ISIWMCSNGSL | |
| IEECPCYGH | | IEECPCYGH | | IIRESGGIDK | | ISIYWTLVNPG | |
| IEECSCYGA | | IEECSCYGA | | IIRVGCVILL | | ISKCKTKEGRR | |
| IEECSCYGE | | IEECSCYGE | | IISKDNGIRI | | ISKCRTKEGRR | |
| IEECSCYGH | | IEECSCYGH | | IISLCSIWFS | | ISKCRTREGRR | |
| IEECSCYGK | | IEECSCYGK | | IISMCSSTEF | | ISKDNGIRIGS | |
| IEECSCYGS | | IEECSCYGS | | IISNLPFQNI | | ISKDSRSGYET | |
| IEECSCYGV | | IEECSCYGV | | IISSLPFQNI | | ISKRGGSGIMK | |
| IEECSCYPN | | IEECSCYPN | | IITDTFKSWK | | ISKRGNSGIMK | |
| IEECSCYPQ | | IEECSCYPQ | | IITDTLKSWK | | ISKRGSSGIMK | |
| IEECSCYPR | | IEECSCYPR | | IITELPFQNL | | ISKRGSSGIVK | |
| IEEGINQLS | | IEEGINQLS | | IITHFQRKRR | | ISKRGSSGVMK | |
| IEEGSIGKV | | IEEGSIGKV | | IITIGSASLG | | ISKSRATEYIM | |
| IEELWAYNA | | IEELWAYNA | | IITIGSICMV | | ISKSRTKEGRR | |
| IEERINHLS | | IEERINHLS | | IITIGSISLG | | ISKSTKSTVLK | |
| IEERINQLS | | IEERINQLS | | IITIGSMSLA | | ISKTNQQFELI | |
| IEEWSCYGH | | IEEWSCYGH | | IITIGSVSLA | | ISLCSIWFSHY | |
| IEEYGKGRI | | IEEYGKGRI | | IITIGSVSLI | | ISLGDCSFAGW | |
| IEEYGRGRI | | IEEYGRGRI | | IITIGSVSLT | | ISLGDCSFTGW | |
| IEFDEIGED | | IEFDEIGED | | IITREPYVSC | | ISLWMCSNGSL | |
| IEFEPFQSL | | IEFEPFQSL | | IIVFCGTSGT | | ISMCSSTEFLG | |
| IEGGWCGMI | | IEGGWCGMI | | IIVFNTIGNL | | ISMDSRSGYET | |
| IEGGWPGLI | | IEGGWPGLI | | IIVILVLGLS | | ISNEGSYFFGD | |
| IEGGWPGLV | | IEGGWPGLV | | IIVTREPYVS | | ISNETILETGY | |
| IEGGWQGLV | | IEGGWQGLV | | IIWGIHHPSS | | ISNVGLNISLH | |
| IEGGWQGMI | | IEGGWQGMI | | IIYSSSMMWE | | ISNVGLNVSLH | |
| IEGGWQGMV | | IEGGWQGMV | | IKAVRGDLNF | | ISPHSRSGFEM | |
| IEGGWSGLI | | IEGGWSGLI | | IKCICRDNWK | | ISPIHLGDCSF | |
| IEGGWSGLV | | IEGGWSGLV | | IKCICRDNWR | | ISPKLRSGFEM | |
| IEGGWSGMI | | IEGGWSGMI | | IKCVCRDNWK | | ISPLAGSAQHV | |
| IEGGWTGLI | | IEGGWTGLI | | IKDRSPYRTL | | ISPLAVTWWNR | |
| IEGGWTGMI | | IEGGWTGMI | | IKDYRYTYRC | | ISPLMVAYMLE | |
| IEGGWTGMV | | IEGGWTGMV | | IKGDYNNTTG | | ISPLSGSAQHI | |
| IEGICYPGS | | IEGICYPGS | | IKGFAPFSKD | | ISPLSGSAQHV | |
| IEGIKLKSE | | IEGIKLKSE | | IKGRSHLRND | | ISPRLRSGFEM | |
| IEGIKLKTE | | IEGIKLKTE | | IKGVELSSMG | | ISPRSRNGFEM | |

Fig. 83-159

| Block size 8 | SIN | Block size 9 | SIN | Block size 10 | SIN | Block size 11 | SIN |
|---|---|---|---|---|---|---|---|
| IEGKLSQMS | | IEGKLSQMS | | IKGVKLSNMG | | ISPRSRSGFEM | |
| IEGLIYGNP | | IEGLIYGNP | | IKGVKLSSMG | | ISPVHLGDCSF | |
| IEGLVYGNP | | IEGLVYGNP | | IKGVYINTAL | | ISRARIDARID | |
| IEGLWAYNA | | IEGLWAYNA | | IKGWAPLSKD | | ISRDSRSGYET | |
| IEGRIQDLE | | IEGRIQDLE | | IKHENRMVLA | | ISSGSLKLAIG | |
| IEGRVQDLE | | IEGRVQDLE | | IKHLEECSCY | | ISSMGEAMVSR | |
| IEGRWPGLV | | IEGRWPGLV | | IKINPVTLTM | | ISSMMEAMVSR | |
| IEGWVVVAK | | IEGWVVVAK | | IKIRRRVDIN | | ISSMVEAMISR | |
| IEHIASIRR | | IEHIASIRR | | IKKTNEKFHQ | | ISSMVEAMMSR | |
| IEHIASMRR | | IEHIASMRR | | IKKYERVKMF | | ISSMVEAMVSR | |
| IEHQIGNVI | | IEHQIGNVI | | IKKYTSARQE | | ISSSFSFGGFT | |
| IEHQISNVI | | IEHQISNVI | | IKKYTSGRQE | | ISSSLVLVGLI | |
| IEHVASMRR | | IEHVASMRR | | IKLKSEDNVY | | ISTPLGSPPIV | |
| IEIGVTRRE | | IEIGVTRRE | | IKLKTEDNIY | | ISTPLGSPPMV | |
| IEIITIGSI | | IEIITIGSI | | IKLKTEDNVY | | ISTPLGSPPVV | |
| IEIMASQGT | | IEIMASQGT | | IKLLPFAAAP | | ISTPLGTPPTV | |
| IEIPSWAGN | | IEIPSWAGN | | IKLLPFASAP | | ISTTFPYTGDP | |
| IEIWSYNAE | | IEIWSYNAE | | IKMKWGMELR | | ISVESSTYQNN | |
| IEKDNAVRF | | IEKDNAVRF | | IKMKWGMEMR | | ISVGSGSFPDG | |
| IEKEFEQVE | | IEKEFEQVE | | IKMNPNQKII | | ISVGSSTYHNS | |
| IEKEFGQVE | | IEKEFGQVE | | IKMNPNQKIM | | ISVGSSTYQNN | |
| IEKEFSEIE | | IEKEFSEIE | | IKNGNMQCTI | | ISVGSSTYQNS | |
| IEKEFSEVE | | IEKEFSEVE | | IKNGNMRCTI | | ISVGTSTLNLR | |
| IEKIEKIRP | | IEKIEKIRP | | IKNGNVRCTI | | ISVGTSTLNQR | |
| IEKINTQFE | | IEKINTQFE | | IKNGTYDHKD | | ISWEMGLAPSP | |
| IEKIRNGTY | | IEKIRNGTY | | IKNGTYDHKE | | ISWEMGQAPSP | |
| IEKITNKVN | | IEKITNKVN | | IKNGTYDYPK | | ISWGMGQAPSP | |
| IEKMNGNYD | | IEKMNGNYD | | IKNGTYNHKD | | ISWPLSSPPTV | |
| IEKMNIQFE | | IEKMNIQFE | | IKNGTYNHKE | | ISWPQSSPPTV | |
| IEKMNIQFT | | IEKMNIQFT | | IKNGTYNRKE | | ITAASLNDDGL | |
| IEKMNTQFE | | IEKMNTQFE | | IKNNMINNDL | | ITCTCRDNWQG | |
| IEKMNTQFG | | IEKMNTQFG | | IKNNMVNNDL | | ITCVCRDNWQG | |
| IEKMNTQFT | | IEKMNTQFT | | IKNQEELRSL | | ITDGPSDAQAF | |
| IEKMNTQSE | | IEKMNTQSE | | IKPCFWVELI | | ITDGPSNAQAF | |
| IEKMVLSAF | | IEKMVLSAF | | IKPWARNILR | | ITDIWAYNAEL | |
| IEKNALGDC | | IEKNALGDC | | IKQGSLKLAT | | ITDIWTYQAEL | |
| IEKQIGNVI | | IEKQIGNVI | | IKQNGKSGAC | | ITDTFKSWKGN | |
| IEKRINQLS | | IEKRINQLS | | IKQNTLKLAT | | ITDTLKSWKGN | |
| IEKTNDKYH | | IEKTNDKYH | | IKRGINDRNF | | ITDWSGYSGSF | |
| IEKTNEKFH | | IEKTNEKFH | | IKRGVNDRNF | | ITEINTWARNI | |
| IEKTNEKYH | | IEKTNEKYH | | IKRYERVKMF | | ITELPFQNLSP | |
| IEKTNKQFE | | IEKTNKQFE | | IKSDQLKLAT | | ITENSFEQITF | |
| IEKTNQQFE | | IEKTNQQFE | | IKSFSRTELI | | ITEVWSYNAEL | |
| IEKTNQQFK | | IEKTNQQFK | | IKSFSRTQLI | | ITEWSGYSGSF | |
| IEKTNTEFE | | IEKTNTEFE | | IKSGQLKLAT | | ITFESNGGFLA | |
| IEKTNTQFE | | IEKTNTQFE | | IKSWRKDILR | | ITFESNGGLLA | |
| IEKTSWSYI | | IEKTSWSYI | | IKSWRRDILR | | ITFIQALQLLL | |
| IEKVRNGTY | | IEKVRNGTY | | IKTDGATSAC | | ITFLHNGGLIA | |
| IEKYGSGRI | | IEKYGSGRI | | IKTKLPFQNL | | ITFLQALQLLL | |
| IEKYGTGRI | | IEKYGTGRI | | IKTNGNLIAP | | ITFMQALQLLF | |
| IELAEKAMK | | IELAEKAMK | | IKTRLFTIRQ | | ITFMQALQLLL | |
| IELDEIGED | | IELDEIGED | | IKTRPILSPL | | ITFSDNGGLIA | |
| IELIRGKPN | | IELIRGKPN | | IKTWAGKILR | | ITFSFNGAFIA | |
| IELIRGRPK | | IELIRGRPK | | IKTWAGNILR | | ITFSHNGGLIA | |
| IELIRGRPN | | IELIRGRPN | | IKTWAKNILR | | ITFSHNGGLVA | |
| IENDRTLDL | | IENDRTLDL | | IKTWARNILR | | ITFSHNGGRIA | |
| IENGWEGLI | | IENGWEGLI | | IKWNVTYTGT | | ITGDDKNATAS | |
| IENGWEGLV | | IENGWEGLV | | IKYNGIITDT | | ITGDDRNATAS | |
| IENGWEGMI | | IENGWEGMI | | ILAATVTLHF | | ITGDNTKWNEN | |
| IENGWEGMM | | IENGWEGMM | | ILAFILWACS | | ITGFAPFSEDN | |
| IENGWEGMV | | IENGWEGMV | | ILAFIMWACS | | ITGFAPFSKDN | |
| IENGWQGLI | | IENGWQGLI | | ILAIYATVAG | | ITGIDKVCTKG | |

Fig. 83-160

| Block size 8 | SIN | Block size 9 | SIN | Block size 10 | SIN | Block size 11 | SIN |
|---|---|---|---|---|---|---|---|
| IENLEELRF | | IENLEELRF | | ILAIYSTAAS | | ITGINKVCTKG | |
| IENLNKKID | | IENLNKKID | | ILAIYSTISS | | ITGKLNRFIEK | |
| IENLNKKME | | IENLNKKME | | ILAIYSTVAS | | ITGKLNRIIEK | |
| IENLNKKVD | | IENLNKKVD | | ILAIYSTVSS | | ITGKLNRLIDK | |
| IENLNRKME | | IENLNRKME | | ILANNGKFEF | | ITGKLNRLIDR | |
| IENLNRKVD | | IENLNRKVD | | ILANNGRFEF | | ITGKLNRLIEK | |
| IENLQAYQK | | IENLQAYQK | | ILASSGSLEF | | ITGKLNRLIER | |
| IENLWAYNA | | IENLWAYNA | | ILATTITLHF | | ITGKLNRLIGK | |
| IENNVTVTS | | IENNVTVTS | | ILATTVTLHF | | ITGKLNRLISK | |
| IENPSHEGE | | IENPSHEGE | | ILDEHDSNVK | | ITGKSHGRILK | |
| IENQEELKS | | IENQEELKS | | ILDFHDSNVK | | ITGKSHGRVLK | |
| IENQEELRF | | IENQEELRF | | ILDGVTASCR | | ITGPDATAVAV | |
| IENQEELRS | | IENQEELRS | | ILDQNFRNIR | | ITGPDSTAVAV | |
| IENQHTIDL | | IENQHTIDL | | ILEDEQMYQK | | ITGPDTTAVAV | |
| IENQKTLDE | | IENQKTLDE | | ILEDEQMYQR | | ITGSPGAPGVK | |
| IENTYVNKT | | IENTYVNKT | | ILEDERMYQK | | ITGSPSAPGVK | |
| IENTYVNNT | | IENTYVNNT | | ILEEESDEAL | | ITIGECPKYVK | |
| IEPKGLFGA | | IEPKGLFGA | | ILEENTTYKI | | ITIGISGPDDG | |
| IEPRGLFGA | | IEPRGLFGA | | ILEGTTASCQ | | ITIGISGPDNG | |
| IEQKVPVTQ | | IEQKVPVTQ | | ILEKAHNGKL | | ITIGSVSLIIA | |
| IEQNIPVTQ | | IEQNIPVTQ | | ILEKMHNGKL | | ITIGSVSLTIA | |
| IEQNVPVTQ | | IEQNVPVTQ | | ILEKNITVTH | | ITIGSVSLTIT | |
| IEQQIGNVI | | IEQQIGNVI | | ILEKNVTVTH | | ITLKFAFNMMF | |
| IERMVLSAF | | IERMVLSAF | | ILEKTHNGKL | | ITNGTTGNPII | |
| IERNALGDC | | IERNALGDC | | ILEKTHNGRL | | ITNKINNIVDK | |
| IERNALGNC | | IERNALGNC | | ILEKVHNGKL | | ITNKINSIIDK | |
| IERPTAVDT | | IERPTAVDT | | ILEQNVTVTH | | ITNKVNNIVDK | |
| IERQEIVDN | | IERQEIVDN | | ILERNVTVTH | | ITNKVNSIIDK | |
| IERRNSSDI | | IERRNSSDI | | ILERTHNGKL | | ITNPLIRHENR | |
| IERTNEKFH | | IERTNEKFH | | ILETGYICSK | | ITNWSGYSGSF | |
| IERTNEKYH | | IERTNEKYH | | ILETGYVCGK | | ITQGSLLNDKH | |
| IERTNQQFE | | IERTNQQFE | | ILETGYVCSK | | ITQTLVSNDDW | |
| IERVRNGTY | | IERVRNGTY | | ILFNTIGNLI | | ITQTLVSNNDW | |
| IESEFNEIE | | IESEFNEIE | | ILGFVFTLTV | | ITQTLVSNSDW | |
| IESEFSEIE | | IESEFSEIE | | ILGFVLWACQ | | ITREPYVSCDN | |
| IESEFSETE | | IESEFSETE | | ILGILTGPPQ | | ITRKLNRLIEK | |
| IESIIEAES | | IESIIEAES | | ILGMQNGSCR | | ITRSGQNHGIC | |
| IESIRNGTY | | IESIRNGTY | | ILGMQNGSYR | | ITSLCSIWFSH | |
| IESKLSQMS | | IESKLSQMS | | ILGNGCFEFW | | ITSNLPFQNVN | |
| IESLNKKME | | IESLNKKME | | ILGNPKCDLY | | ITSPLPFQNIN | |
| IESMIEAES | | IESMIEAES | | ILGNPKCDPY | | ITTKINNIIDK | |
| IESMVEAES | | IESMVEAES | | ILGNPMCDDL | | ITTKINNIIEK | |
| IESNGNLIA | | IESNGNLIA | | ILGNPMCDEL | | ITVDHMAIIKK | |
| IESNITVTS | | IESNITVTS | | ILGNPMCDNL | | ITVGSSKYQQS | |
| IESNVTVTS | | IESNVTVTS | | ILGNPMCDYL | | ITVGSSKYRQS | |
| IESRGLFGA | | IESRGLFGA | | ILGNPRCDDL | | ITVTHAQDILE | |
| IESVRNGTY | | IESVRNGTY | | ILGTIIGPPQ | | ITVTHSVELLE | |
| IETGYVCSK | | IETGYVCSK | | ILHKCDNECM | | ITVTHSVNLLE | |
| IETNHTGTY | | IETNHTGTY | | ILHKCDNKCM | | ITYIWTYQAEL | |
| IETTHTGTY | | IETTHTGTY | | ILHKCNDSCM | | ITYSSPMMWEI | |
| IEVEKQIGN | | IEVEKQIGN | | ILHKCNNECM | | ITYSSSLMWEI | |
| IEVLHLTQG | | IEVLHLTQG | | ILIAGGLILG | | ITYSSSMMWEI | |
| IEVTNATEL | | IEVTNATEL | | ILITQESECV | | ITYSSSMMWEV | |
| IEVVAAQEL | | IEVVAAQEL | | ILKDCSIAGW | | IVAFCGTSGTY | |
| IEVVNATET | | IEVVNATET | | ILKDCSVAGW | | IVAIVFSQEDC | |
| IEVVTAQEL | | IEVVTAQEL | | ILKGKFQTAA | | IVALCGSKEQL | |
| IEVWSYNAE | | IEVWSYNAE | | ILKHNPTEEQ | | IVALCGSKERL | |
| IEYDAVATT | | IEYDAVATT | | ILKIKKGKIM | | IVALCGSKKRL | |
| IEYIASMRR | | IEYIASMRR | | ILKIKKGKIV | | IVALCGSRERL | |
| IEYNGKSLG | | IEYNGKSLG | | ILKIRKGKIM | | IVAMVFSQEDC | |
| IEYQIGNVI | | IEYQIGNVI | | ILKIRKGKIV | | IVAMVFSQEDR | |
| IEYVASMRR | | IEYVASMRR | | ILKPGQTVKI | | IVAMVFSQEEC | |

Fig. 83-161

| Block size 8 | SIN | Block size 9 | SIN | Block size 10 | SIN | Block size 11 | SIN |
|---|---|---|---|---|---|---|---|
| IFENSCIET | | IFENSCIET | | ILKQNPTEEQ | | IVAVTDGPAAN | |
| IFENSCLET | | IFENSCLET | | ILKRGETLKI | | IVDKMNREFEV | |
| IFESSCLET | | IFESSCLET | | ILLATGMRNV | | IVDKMNREFGV | |
| IFFWMCSNG | | IFFWMCSNG | | ILLENERTLD | | IVDNKNWSGYS | |
| IFGAIAGFI | | IFGAIAGFI | | ILLNPFVSHK | | IVDNNNWSGYS | |
| IFGCQNGNI | | IFGCQNGNI | | ILLSPEEVSE | | IVDNQNWSGYS | |
| IFGCQNGNV | | IFGCQNGNV | | ILNLLIGISN | | IVDNSNWSGYS | |
| IFGKDNAIR | | IFGKDNAIR | | ILNNKNWSGY | | IVERILEEESD | |
| IFGKDNAVR | | IFGKDNAVR | | ILNTSQRGIL | | IVERPKEIEGI | |
| IFGNSCLET | | IFGNSCLET | | ILNTSQRGVL | | IVERPKEMEGI | |
| IFGPVHFRN | | IFGPVHFRN | | ILPFDFDKIS | | IVERPKEMEGV | |
| IFHKCDDDC | | IFHKCDDDC | | ILPFDIDKII | | IVERPSAPEGM | |
| IFHKCDDHC | | IFHKCDDHC | | ILRDCSVAGW | | IVERTKEMEGI | |
| IFHKCDDNC | | IFHKCDDNC | | ILRGAVAHKS | | IVETGYVCSKF | |
| IFHKCDDQC | | IFHKCDDQC | | ILRGSIAHKS | | IVFCGTSGTYG | |
| IFHKCDNQC | | IFHKCDNQC | | ILRGSVAHKS | | IVFNTIGNLIA | |
| IFHQCDNDC | | IFHQCDNDC | | ILRQNPSEEQ | | IVFNTIGNLVA | |
| IFHQCDNNC | | IFHQCDNNC | | ILRQNPTEEQ | | IVFPNEVGARI | |
| IFHRCDDQC | | IFHRCDDQC | | ILRTHESECV | | IVGLVFFCLKN | |
| IFIFILLTH | | IFIFILLTH | | ILRTQDSECV | | IVGNDNWSGYS | |
| IFIFLLLTH | | IFIFLLLTH | | ILRTQESECA | | IVGNPSCASNI | |
| IFLAMITYI | | IFLAMITYI | | ILRTQESECI | | IVGNPSCATNI | |
| IFLARSALI | | IFLARSALI | | ILRTQESECQ | | IVHISPLSGSA | |
| IFLWCKIVT | | IFLWCKIVT | | ILRTQESECV | | IVILVLGLSMV | |
| IFLWGIHHP | | IFLWGIHHP | | ILRTQESSCS | | IVKGRSHLRND | |
| IFLWMCSNG | | IFLWMCSNG | | ILRTQESSCT | | IVLGIINLLIG | |
| IFLYVRTNG | | IFLYVRTNG | | ILRTQESSCV | | IVLLENQKTLD | |
| IFMARSALI | | IFMARSALI | | ILSIAPIMFS | | IVLNTDWSGYS | |
| IFMCVKNGN | | IFMCVKNGN | | ILSIYSCIAS | | IVLTTDWSGYS | |
| IFNFILLTH | | IFNFILLTH | | ILSIYSCVAS | | IVLVGLILAFI | |
| IFNGAFIAP | | IFNGAFIAP | | ILSIYSSVAS | | IVLVMKRKRDS | |
| IFNMERIKE | | IFNMERIKE | | ILSIYSTAAS | | IVMVGLILAFI | |
| IFNSIGNLI | | IFNSIGNLI | | ILSIYSTVAA | | IVNAALGSPGC | |
| IFQPNIGPR | | IFQPNIGPR | | ILSIYSTVAS | | IVNGALGSPGC | |
| IFQSGIRMA | | IFQSGIRMA | | ILSIYSTVTS | | IVNNQDWSGYS | |
| IFQSGVRLA | | IFQSGVRLA | | ILSIYSTVVS | | IVNNQNWSGYS | |
| IFQSGVRMA | | IFQSGVRMA | | ILSKDNAIRI | | IVNSALGSPGC | |
| IFQSGVRVA | | IFQSGVRVA | | ILSLYSTVAS | | IVNTTLSTIAL | |
| IFQSRIRMG | | IFQSRIRMG | | ILSMAPIMFS | | IVPCFWLEMIR | |
| IFRPNIGPR | | IFRPNIGPR | | ILSNPKCDLY | | IVPNIGSRPRV | |
| IFSARSALI | | IFSARSALI | | ILSPLTKGIL | | IVPSGPLKAEI | |
| IFSFNGEEM | | IFSFNGEEM | | ILSPLTKGML | | IVQITGKLNRL | |
| IFSFTGEEM | | IFSFTGEEM | | ILSTKALLIG | | IVRRAAVSADP | |
| IFSHNGGLI | | IFSHNGGLI | | ILSVYSTVAS | | IVRRAIVSADP | |
| IFSKDNAIR | | IFSKDNAIR | | ILTDSQTATK | | IVRRATVSADP | |
| IFSKDNGIR | | IFSKDNGIR | | ILTDTSRPGD | | IVSKDNGIRIG | |
| IFVIREPFI | | IFVIREPFI | | ILTDTSRPSD | | IVSKDNGIRVG | |
| IFVIREPFV | | IFVIREPFV | | ILTIYSTAAS | | IVSLGAISFWM | |
| IFVMREPFI | | IFVMREPFI | | ILTIYSTVAS | | IVSMCSSTEFL | |
| IGAIDSSMP | | IGAIDSSMP | | ILTKITVDHM | | IVSNDNWSGYS | |
| IGAINSSMP | | IGAINSSMP | | ILTKTTVDHM | | IVSPLAVTWWN | |
| IGAPQLNPI | | IGAPQLNPI | | ILTRTTVDHM | | IVSSLPFQNIN | |
| IGARIGEGQ | | IGARIGEGQ | | ILVAGGLILG | | IVSSLPFQNIS | |
| IGARPQVNG | | IGARPQVNG | | ILVALALSHT | | IVSSLPFQSIN | |
| IGDCPKYIK | | IGDCPKYIK | | ILVALENQHT | | IVSWSQNILRT | |
| IGDCPKYMN | | IGDCPKYMN | | ILVGSSTYQN | | IVTFCGLBNEP | |
| IGDCPKYVN | | IGDCPKYVN | | ILVLGLSMVK | | IVTFCGLDNEP | |
| IGDGQRSWM | | IGDGQRSWM | | ILVLGLSMVR | | IVTFCGLNNEP | |
| IGEAPSPYN | | IGEAPSPYN | | ILVSTNAYDR | | IVTREPCVSCD | |
| IGECPKYIK | | IGECPKYIK | | ILVTREPYLS | | IVTREPYISCD | |
| IGECPKYVK | | IGECPKYVK | | ILVTREPYVS | | IVTREPYVSCD | |
| IGECPKYVR | | IGECPKYVR | | ILVTTVTLHF | | IVTTVGWSWPD | |

Fig. 83-162

| Block size 8 | SIN | Block size 9 | SIN | Block size 10 | SIN | Block size 11 | SIN |
|---|---|---|---|---|---|---|---|
| IGECPRYVK | | IGECPRYVK | | ILWACSSGNC | | IVVFCGTSATY | |
| IGEDIAPIE | | IGEDIAPIE | | ILWFSFGASC | | IVVFCGTSGTY | |
| IGEDLAPIE | | IGEDLAPIE | | ILWFSFGASS | | IVVMTDGSASG | |
| IGEDSDILV | | IGEDSDILV | | ILWFSLGASC | | IVVTREPYVSC | |
| IGEDSDVLV | | IGEDSDVLV | | ILWISFAISC | | IVWACQRGNIR | |
| IGEDVAPIE | | IGEDVAPIE | | ILWISFAMSC | | IVWGVHHSSSL | |
| IGEGQRSWM | | IGEGQRSWM | | ILWISFATSC | | IWASGSSISFC | |
| IGENSDVLV | | IGENSDVLV | | ILWISFSISC | | IWAYNAELIVL | |
| IGERINQLS | | IGERINQLS | | ILWISFSMSC | | IWAYNAELLVL | |
| IGESSDVLV | | IGESSDVLV | | ILWVSFSISC | | IWDANGWVSTD | |
| IGEVPSPYN | | IGEVPSPYN | | ILYFWGVHHP | | IWFSHYNQMKQ | |
| IGEYPVVKG | | IGEYPVVKG | | IMASQGTKRS | | IWFSHYNQMTQ | |
| IGFHFEECS | | IGFHFEECS | | IMEKNITVTH | | IWFSHYNQVAQ | |
| IGFWMCSNG | | IGFWMCSNG | | IMEKNVTVTH | | IWFSHYNQVTQ | |
| IGGFIFGCQ | | IGGFIFGCQ | | IMERNVTVTH | | IWGVHHPSTDA | |
| IGGNSDVLV | | IGGNSDVLV | | IMESGGIDKI | | IWGVHHPSTDK | |
| IGGSGTNNY | | IGGSGTNNY | | IMESGGIDKV | | IWGVHHPSTDT | |
| IGGWATANS | | IGGWATANS | | IMESGGISKI | | IWGVHHPSTST | |
| IGGWTIANS | | IGGWTIANS | | IMESGGISKM | | IWHSNLNDATY | |
| IGGWTTANS | | IGGWTTANS | | IMEVVFPNEV | | IWHSNLNDTTY | |
| IGHHANNST | | IGHHANNST | | IMFSNKMAKL | | IWITREPYVSC | |
| IGIAADRDS | | IGIAADRDS | | IMFSNKMARL | | IWMACHSAAFE | |
| IGIGNLIFN | | IGIGNLIFN | | IMFSNKVARL | | IWMCSNGSLQC | |
| IGIGNLVFN | | IGIGNLVFN | | IMGLFFFCLK | | IWSYNAELLVA | |
| IGISGPDDG | | IGISGPDDG | | IMGLVFFCLK | | IWSYNAKLLVL | |
| IGISGPDNE | | IGISGPDNE | | IMGLVFFCLR | | IWSYNAQLLVL | |
| IGISGPDNG | | IGISGPDNG | | IMHDRTKIRQ | | IWSYNAQLLVW | |
| IGISGPDSG | | IGISGPDSG | | IMINPVKLSG | | IWSYNARLLVL | |
| IGISNIGLN | | IGISNIGLN | | IMINPVKLSS | | IWTSASSISFC | |
| IGISNMSLN | | IGISNMSLN | | IMIWHSNLND | | IWTSGSIISFC | |
| IGISNVGLN | | IGISNVGLN | | IMNTSKPFQN | | IWTSGSSIAFC | |
| IGISNVVLN | | IGISNVVLN | | IMQNKLNNVI | | IWTSGSSISFC | |
| IGISSMVEA | | IGISSMVEA | | IMRTQESECA | | IWTSSSSIVMC | |
| IGITGPDAT | | IGITGPDAT | | IMRTQESECV | | IWTSSSSTVFC | |
| IGITVIKNN | | IGITVIKNN | | IMRTQESSCT | | IWTSSSSVVMC | |
| IGKCNDPYP | | IGKCNDPYP | | IMRTVIALSY | | IWTYNAELLIL | |
| IGKCPKYIP | | IGKCPKYIP | | IMTDGPANSQ | | IWTYNAELLVL | |
| IGKCPKYIS | | IGKCPKYIS | | IMTDGSANSQ | | IWTYQAELLIA | |
| IGKCPKYVK | | IGKCPKYVK | | IMTDGSASSQ | | IWTYQAELLVA | |
| IGKCPRYIP | | IGKCPRYIP | | IMTIGSVSLA | | IWTYQEELLVA | |
| IGKCPRYVK | | IGKCPRYVK | | IMWACNSGNC | | IWVTRELYVSC | |
| IGKFYIQMC | | IGKFYIQMC | | IMWACQGNI | | IWVTREPYVSC | |
| IGKITNKVN | | IGKITNKVN | | IMWACQRGNI | | IYATVAGSLSL | |
| IGKMNTQFE | | IGKMNTQFE | | IMWACSNGNC | | IYCICRDNWKG | |
| IGKTNEKFH | | IGKTNEKFH | | IMWACSNGSC | | IYCVCRDNWKG | |
| IGKTNQQFE | | IGKTNQQFE | | IMWACSSGNC | | IYGKDNAIRIG | |
| IGKTSWSYI | | IGKTSWSYI | | IMWGIHHPSS | | IYGKDNAVRIG | |
| IGKVCRTLL | | IGKVCRTLL | | IMWTCNSGNC | | IYGNPKCDIHL | |
| IGLLLQIIS | | IGLLLQIIS | | IMWTCQKGNI | | IYGNPKCDTHL | |
| IGLLLQITS | | IGLLLQITS | | INDKIDDQIE | | IYGNPKCDVHL | |
| IGLNVSLHL | | IGLNVSLHL | | INDKINDQIE | | IYIEVLHLTQG | |
| IGLREQKQE | | IGLREQKQE | | INDPWVLLNA | | IYKILSIYSCI | |
| IGLRISSSF | | IGLRISSSF | | INDQIEDLWA | | IYKILTIYSTV | |
| IGLRNTPSI | | IGLRNTPSI | | INDQITDIWA | | IYQILAIYATV | |
| IGLRNVPQA | | IGLRNVPQA | | INDRNFWRGD | | IYQILAIYSTV | |
| IGLRNVPQI | | IGLRNVPQI | | INDRNFWRGE | | IYRDEAINNRI | |
| IGLRNVPQV | | IGLRNVPQV | | INDRSPFRAL | | IYSCIASSIVL | |
| IGLSPNVYQ | | IGLSPNVYQ | | INDRTAFRGL | | IYSCIASSIVM | |
| IGNCPKYVK | | IGNCPKYVK | | INECRTFFLT | | IYSCIASSLIL | |
| IGNCPKYVN | | IGNCPKYVN | | INEEALRQKI | | IYSCIASSLVL | |
| IGNGCFEFY | | IGNGCFEFY | | INEGNGCFEL | | IYSCIASSTVL | |
| IGNLIAPRG | | IGNLIAPRG | | INEITTKINN | | IYSCIASSTVM | |

Fig. 83-163

| Block size 8 | SIN | Block size 9 | SIN | Block size 10 | SIN | Block size 11 | SIN |
|---|---|---|---|---|---|---|---|
| IGNLIFNTV | | IGNLIFNTV | | INESADMSIG | | IYSCIASSVVL | |
| IGNLVAPRG | | IGNLVAPRG | | INEVKLEENT | | IYSSSMMWEIN | |
| IGNLVFNTV | | IGNLVFNTV | | INFDSNGNFI | | IYSSVASSLVL | |
| IGNVINWTK | | IGNVINWTK | | INFESNGNFI | | IYSTAASSLVL | |
| IGNVINWTQ | | IGNVINWTQ | | INFESNGNLI | | IYSTISSSLVL | |
| IGNVINWTR | | IGNVINWTR | | INFESTGNLI | | IYSTVAASLCL | |
| IGPLLQITS | | IGPLLQITS | | INFESTGNLV | | IYSTVASSLIL | |
| IGPLSGSAQ | | IGPLSGSAQ | | INFMPYISFA | | IYSTVASSLVL | |
| IGPPHCDQF | | IGPPHCDQF | | INGALGSPGC | | IYSTVASSSVL | |
| IGPPQCDKF | | IGPPQCDKF | | INGICTVVMT | | IYSTVSSSLVL | |
| IGPPQCDLF | | IGPPQCDLF | | INGKAPISLG | | IYWHLMHPGER | |
| IGPPQCDLH | | IGPPQCDLH | | INGKEPISLG | | IYWTLVNPGDS | |
| IGPPQCDQF | | IGPPQCDQF | | INGKLNRLIE | | IYWWDGLQSSD | |
| IGPPQCDRF | | IGPPQCDRF | | INGKQPISLG | | KAAIGLRISSS | |
| IGPPQCDSH | | IGPPQCDSH | | INGPDSVLVN | | KAALGLRISSS | |
| IGPRALVRG | | IGPRALVRG | | INGPESVLIN | | KAAMGLKISSS | |
| IGPRNVPAI | | IGPRNVPAI | | INGPESVLVN | | KAAMGLRISSS | |
| IGPRNVPQA | | IGPRNVPQA | | INGQAGRMTF | | KAAMGMRISSS | |
| IGPRNVPQV | | IGPRNVPQV | | INGQSGRIDF | | KACNALTGGQS | |
| IGPRPFVRG | | IGPRPFVRG | | INGSCAVVMT | | KACNASTGAQS | |
| IGPRPLIRG | | IGPRPLIRG | | INGSCIVVMT | | KACNASTGGQA | |
| IGPRPLVMG | | IGPRPLVMG | | INGSCTVVMT | | KACNASTGGQS | |
| IGPRPLVRE | | IGPRPLVRE | | INGTCAVVMT | | KACSASTGGQS | |
| IGPRPLVRG | | IGPRPLVRG | | INGTCTVIMT | | KADEICIGYLS | |
| IGQAADLKS | | IGQAADLKS | | INGTCTVVMT | | KADHRIYWIKE | |
| IGQAADYKS | | IGQAADYKS | | INGVILEENT | | KADKICIGYLS | |
| IGQGDIVLV | | IGQGDIVLV | | INGVKLEENS | | KADLIIERRNS | |
| IGQGDVVLV | | IGQGDVVLV | | INGVKLEENT | | KAEIAQKLEDV | |
| IGQSANVYQ | | IGQSANVYQ | | INGVRLEENT | | KAEIAQRLEDV | |
| IGQSPNVYQ | | IGQSPNVYQ | | INGVTNKVNS | | KAEIAQRLEGV | |
| IGRFYIQMC | | IGRFYIQMC | | INGWYGFQHQ | | KAEIAQRLENV | |
| IGRFYVQMC | | IGRFYVQMC | | INGWYGFQHR | | KAEIAQRLESV | |
| IGRMTICIQ | | IGRMTICIQ | | INGWYGFRHQ | | KAGFIEGGWPG | |
| IGRMTICVQ | | IGRMTICVQ | | INIAEYSIDS | | KAGFIENGWEG | |
| IGRTKSLES | | IGRTKSLES | | INIMASQGTK | | KAGVKMNPNQK | |
| IGRTNQQFE | | IGRTNQQFE | | INIREWSYLI | | KAHNGKLCRLS | |
| IGSCASKCH | | IGSCASKCH | | INKITNKVNN | | KAIDEITTKIN | |
| IGSCESKCH | | IGSCESKCH | | INKMNTQFEA | | KAIDIMQNKLN | |
| IGSCISKCH | | IGSCISKCH | | INKTGTFEFT | | KAIDNMQNKLN | |
| IGSCTSPCL | | IGSCTSPCL | | INKVCTKGKK | | KAIDNMQNRLN | |
| IGSCVSKCH | | IGSCVSKCH | | INLHAYISFR | | KAIDQITTKIN | |
| IGSCVSRCH | | IGSCVSRCH | | INLLIGISNM | | KAIDRITTKIN | |
| IGSGFFPDG | | IGSGFFPDG | | INLYASKNPY | | KAINEITTKIN | |
| IGSIRNETY | | IGSIRNETY | | INMADYSIDS | | KAIWTSGSSIA | |
| IGSIRNGTY | | IGSIRNGTY | | INMEDYSIDS | | KAKLANVVRKM | |
| IGSISLTIA | | IGSISLTIA | | INMIADRVDD | | KALNEITTKIN | |
| IGSKGDIFV | | IGSKGDIFV | | INMINDKIDD | | KALSIYSCIAS | |
| IGSKGDVFV | | IGSKGDVFV | | INMINDKIND | | KAMEQMAGSSE | |
| IGSKGHVFV | | IGSKGHVFV | | INMINSKIDD | | KAMEQVAGSSE | |
| IGSRGDVFI | | IGSRGDVFI | | INMINSKIED | | KAMMDQVRESR | |
| IGSRGDVFV | | IGSRGDVFV | | INMINSKIND | | KANQVFPQLNQ | |
| IGSRGEVFV | | IGSRGEVFV | | INMINSQIDD | | KANVLIGQGDI | |
| IGSRGHIFV | | IGSRGHIFV | | INMISDKIDD | | KANVLIGQGDV | |
| IGSRGHVFV | | IGSRGHVFV | | INMLADRIDD | | KAPISLGDCSF | |
| IGSRPRVRN | | IGSRPRVRN | | INMLADRVDD | | KAPISLGGCSF | |
| IGSSTYQNN | | IGSSTYQNN | | INMLADWVDD | | KAPQLNPIDGP | |
| IGSVSLTIA | | IGSVSLTIA | | INMSKKKSYI | | KAQGEGTAADY | |
| IGSVSLTIT | | IGSVSLTIT | | INMSKRKSYI | | KAQHIEECSCY | |
| IGSWSHNIL | | IGSWSHNIL | | INNDLGPATA | | KASKEPEVHEG | |
| IGSWSQNIL | | IGSWSQNIL | | INNETIIETG | | KASLRLAVGLR | |
| IGTAPILGN | | IGTAPILGN | | INNETILETG | | KASTQKAIDEI | |
| IGTAPVLGN | | IGTAPVLGN | | INNETILETR | | KASTQKAINEI | |

Fig. 83-164

| Block size 8 | SIN | Block size 9 | SIN | Block size 10 | SIN | Block size 11 | SIN |
|---|---|---|---|---|---|---|---|
| IGTRIGDGQ | | IGTRIGDGQ | | INNETIVETG | | KATKMEAILVV | |
| IGTSTLNQR | | IGTSTLNQR | | INNGKGRYGV | | KATKMKAIIVV | |
| IGVAPSPSN | | IGVAPSPSN | | INNIIDKMNG | | KATKMKAILVV | |
| IGVAPVLGN | | IGVAPVLGN | | INNIIEKMNG | | KATNGNYGPIN | |
| IGVAVIKNN | | IGVAVIKNN | | INNIVDKMNR | | KAVDLGSCGIL | |
| IGVGNLAFN | | IGVGNLAFN | | INNQNWSGYS | | KAVKLYKKLKR | |
| IGVGNLIFN | | IGVGNLIFN | | INNRFQIQGI | | KAVKLYRKLKR | |
| IGVGNLVFN | | IGVGNLVFN | | INNRFQIQGV | | KAVRGDLNFVN | |
| IGVSGPDNG | | IGVSGPDNG | | INNRIKINPV | | KAWLHICVTGD | |
| IGVSNVGLN | | IGVSNVGLN | | INPTLLFLKV | | KAWLHVCITGD | |
| IGVTRREIH | | IGVTRREIH | | INPVELSSGY | | KAWLHVCVTGD | |
| IGVTRREVH | | IGVTRREVH | | INPVKLSGGY | | KAWLHVCVTGY | |
| IGVTVIKNN | | IGVTVIKNN | | INPVKLSSGY | | KCCNLFEKFFP | |
| IGVTVIRNN | | IGVTVIRNN | | INPVRLSSGY | | KCCSLFEKFFP | |
| IGVYQILAI | | IGVYQILAI | | INPVTLSSGY | | KCCTLFEKFFP | |
| IGWSSTSCH | | IGWSSTSCH | | INPVTLTMGY | | KCDDDCMASIR | |
| IGYHANNSK | | IGYHANNSK | | INQINGKLNR | | KCDDHCMESIR | |
| IGYHANNST | | IGYHANNST | | INQITGKLNR | | KCDDQCMESIR | |
| IGYHSNNST | | IGYHSNNST | | INRCFYVELI | | KCDLYLNGREW | |
| IGYICSGFF | | IGYICSGFF | | INRCFYVELV | | KCDLYLSGREW | |
| IGYICSGIF | | IGYICSGIF | | INRIFQPNIG | | KCDNECMETIK | |
| IGYICSGVF | | IGYICSGVF | | INRIFRPNIG | | KCDNKCMETIK | |
| IGYICSGVL | | IGYICSGVL | | INRITYGACP | | KCDNQCMESIR | |
| IGYLSNNAT | | IGYLSNNAT | | INRNFKPNIG | | KCDPYLNGREW | |
| IGYLSNNSS | | IGYLSNNSS | | INRNFQPNIG | | KCFNPCFYVEL | |
| IGYLSNNST | | IGYLSNNST | | INRQEIEGAR | | KCFWKGGSIKT | |
| IGYLSTNSS | | IGYLSTNSS | | INRQEIEGVK | | KCFWKGGSINT | |
| IGYMSNNST | | IGYMSNNST | | INRQEIEGVR | | KCFWKSGSINT | |
| IGYQSNNST | | IGYQSNNST | | INRSFKPNIG | | KCFWRGGSIIT | |
| IGYQTNNST | | IGYQTNNST | | INRSFQPNIG | | KCFWRGGSINT | |
| IGYVCSGIF | | IGYVCSGIF | | INRSFRPNIG | | KCICRDNWKGA | |
| IGYVCSGVF | | IGYVCSGVF | | INRTGTFEFT | | KCICRDNWRGA | |
| IHDRAAFRG | | IHDRAAFRG | | INSIIDKMNT | | KCIERVRNGTY | |
| IHDRIPHRT | | IHDRIPHRT | | INSPLPFQNI | | KCIESIRNGTY | |
| IHDRSPFRA | | IHDRSPFRA | | INSRFQIQGV | | KCITPNGSIPN | |
| IHDRSPHRT | | IHDRSPHRT | | INSSKPFQNA | | KCKTKEGRRKT | |
| IHDRSPYRA | | IHDRSPYRA | | INSSKPFQNT | | KCMESVRNGTY | |
| IHDRSQFRA | | IHDRSQFRA | | INSSKPLQNA | | KCMETIKNGTY | |
| IHDRSQYRA | | IHDRSQYRA | | INSSMPFHNI | | KCNDPYPGNNN | |
| IHDRSQYRS | | IHDRSQYRS | | INSSMPFHNV | | KCNDPYPGSNN | |
| IHDRTAFRG | | IHDRTAFRG | | INSSMPLHNI | | KCNDSCMDTIR | |
| IHDRTPHRT | | IHDRTPHRT | | INSSRPFQNA | | KCNDSCMEAIR | |
| IHDRTTFRG | | IHDRTTFRG | | INSSYVCSGL | | KCNDSCMETIR | |
| IHECRTFFL | | IHECRTFFL | | INSVKLSSGY | | KCNEPYPGNNN | |
| IHFESNGNF | | IHFESNGNF | | INSWHIFGKD | | KCNNECMETIK | |
| IHHPDSETT | | IHHPDSETT | | INSWHIYGKD | | KCNNSCMETIR | |
| IHHPDTEAT | | IHHPDTEAT | | INTALLNASC | | KCNNTCMETIR | |
| IHHPDTEAV | | IHHPDTEAV | | INTAMLNASC | | KCNTKCQTSLG | |
| IHHPDTEEV | | IHHPDTEEV | | INTASRSGYE | | KCNTKCQTSMG | |
| IHHPDTETT | | IHHPDTETT | | INTINSKIDD | | KCNTKCQTSVG | |
| IHHPPDAKE | | IHHPPDAKE | | INTKLPFQNL | | KCPKYIPSGSL | |
| IHHPPDETE | | IHHPPDETE | | INTLTERGVE | | KCPKYIPSNSL | |
| IHHPPDTKE | | IHHPPDTKE | | INTNKTFQNI | | KCPKYIPSRSL | |
| IHHPPNTKE | | IHHPPNTKE | | INTNRTFQNI | | KCPKYISSGSL | |
| IHHPPTSAE | | IHHPPTSAE | | INTRLPFQNL | | KCPRYIPSGSL | |
| IHHPPTSDE | | IHHPPTSDE | | INTSKPFQNT | | KCPRYVKQSSL | |
| IHHPPTSNE | | IHHPPTSNE | | INTTLPFHNI | | KCQLNEGVMNT | |
| IHHPPTTDE | | IHHPPTTDE | | INTTLPFHNV | | KCQQSFTPSPG | |
| IHHPSSAQE | | IHHPSSAQE | | INTWARNILR | | KCQSPLGAINT | |
| IHHPSSTKE | | IHHPSSTKE | | INTYQWIIRN | | KCQTPLGAINT | |
| IHHPSSTQE | | IHHPSSTQE | | INVINDKIDD | | KCQTPLGALNT | |
| IHIFSFNGE | | IHIFSFNGE | | INVTKENTGS | | KCQTSVGGIDT | |

Fig. 83-165

| Block size 8 | SIN | Block size 9 | SIN | Block size 10 | SIN | Block size 11 | SIN |
|---|---|---|---|---|---|---|---|
| IHIFSFTGE | | IHIFSFTGE | | INWLTKKEPD | | KCQTSVGGINT | |
| IHISPLSGS | | IHISPLSGS | | INWLTKKKNP | | KCQTYAGAINS | |
| IHIYYLEKA | | IHIYYLEKA | | INWLTKKKPD | | KCQTYAGAVNS | |
| IHKQLTHHM | | IHKQLTHHM | | INWTKDSITD | | KCQTYTGAINS | |
| IHLGDCSFE | | IHLGDCSFE | | INWTQDAMTE | | KCRTKEGRRKT | |
| IHLTDSEMN | | IHLTDSEMN | | INWTRDAMTE | | KCRTKEGRRRT | |
| IHPLAIGEC | | IHPLAIGEC | | INWTRDSIIE | | KCRTREGRRKT | |
| IHPLTIGEC | | IHPLTIGEC | | INWTRDSITE | | KCVCRDNWKGA | |
| IHPLTIGKC | | IHPLTIGKC | | INWTRDSLTE | | KCVCRDNWKGS | |
| IHQILAIYS | | IHQILAIYS | | INWTRDSMTE | | KCYNPCFYVEL | |
| IHSRGLFGA | | IHSRGLFGA | | INWTRDSVTE | | KCYQFALGQGA | |
| IHTRGLFGA | | IHTRGLFGA | | INYYNETFVN | | KCYQFALGQGT | |
| IHWTIVKPG | | IHWTIVKPG | | IPCFWVEMIR | | KDAERGKLKRR | |
| IHYGGIPTD | | IHYGGIPTD | | IPEAGLKWEL | | KDCSVAGWLLG | |
| IHYGGMPTD | | IHYGGMPTD | | IPEVCLKWDL | | KDEGNGCFTFY | |
| IHYGGVPTD | | IHYGGVPTD | | IPEVCLKWEL | | KDGDIIFLWGI | |
| IIAARNIVR | | IIAARNIVR | | IPEVCLKWGL | | KDIILWFSFGA | |
| IIAARSIVR | | IIAARSIVR | | IPEWSYIMEK | | KDIILWFSFSI | |
| IIAFCGTSG | | IIAFCGTSG | | IPFHLGTKQV | | KDIILWISFSI | |
| IIAIGSVSL | | IIAIGSVSL | | IPGKQAKGLF | | KDIILWISFSM | |
| IIALLIGIG | | IIALLIGIG | | IPHRTLLMNE | | KDIILWVSFSI | |
| IICIQGNND | | IICIQGNND | | IPHRTLLMSE | | KDILRTQESEC | |
| IICLGHHAV | | IICLGHHAV | | IPIGERGLFG | | KDLDNCHPIGM | |
| IICTCRDNW | | IICTCRDNW | | IPKRNRSILN | | KDLGNCHPIGM | |
| IICVCRDNW | | IICVCRDNW | | IPLTTTPTKS | | KDLGNCHPVGM | |
| IIDIWAYNA | | IIDIWAYNA | | IPMISKCKTK | | KDLGNGCFEFW | |
| IIDKMNGNY | | IIDKMNGNY | | IPMISKCRTK | | KDLGSCHPIGM | |
| IIDKMNIQF | | IIDKMNIQF | | IPMISKCRTR | | KDLRSGYETFK | |
| IIDKMNTQF | | IIDKMNTQF | | IPMISNCRTK | | KDNAIDEGDGC | |
| IIDKMNTRF | | IIDKMNTRF | | IPNAETDPNS | | KDNAIRFGEGE | |
| IIDKVNTQF | | IIDKVNTQF | | IPNAETDPSS | | KDNAIRFGESE | |
| IIDLADSEM | | IIDLADSEM | | IPNAGIDPNS | | KDNAIRIGEDA | |
| IIDNDNWSG | | IIDNDNWSG | | IPNAGTDPNS | | KDNAIRIGEDS | |
| IIDNNNWSG | | IIDNNNWSG | | IPPLELGDCS | | KDNAIRIGEEA | |
| IIDVTDSEM | | IIDVTDSEM | | IPPLELRDCS | | KDNAIRIGEGA | |
| IIEAESSVK | | IIEAESSVK | | IPPLVLGDCS | | KDNAIRIGENA | |
| IIEEYGKGR | | IIEEYGKGR | | IPQIESRGLF | | KDNAIRIGENS | |
| IIEEYGRGR | | IIEEYGRGR | | IPSDTPRGED | | KDNAIRIGGNS | |
| IIEKMNGNY | | IIEKMNGNY | | IPSGPLKAEI | | KDNAIRLGENK | |
| IIEKMNTQF | | IIEKMNTQF | | IPSGSLKLAI | | KDNAIRLGENR | |
| IIEKNVTVT | | IIEKNVTVT | | IPSIQSRGLF | | KDNAIRPGENK | |
| IIEKTNQQF | | IIEKTNQQF | | IPSNSLKLAI | | KDNAKDEGNGC | |
| IIEKYGSGR | | IIEKYGSGR | | IPSRSLKLAI | | KDNAKDLGNGC | |
| IIEKYGTGR | | IIEKYGTGR | | IPSVQSRGLF | | KDNAKELGNGC | |
| IIENNVTVT | | IIENNVTVT | | IPSWAGNILR | | KDNANDLGNGC | |
| IIERKEGTD | | IIERKEGTD | | IPSWAGNVLR | | KDNARELGNGC | |
| IIERREGAD | | IIERREGAD | | IPSWEGNILR | | KDNAVRFGESE | |
| IIERREGND | | IIERREGND | | IPTDTPRGED | | KDNAVRIGEDA | |
| IIERREGSD | | IIERREGSD | | IPTDTPRIQD | | KDNAVRIGEDS | |
| IIERREGTD | | IIERREGTD | | IPTDTPRVQD | | KDNAVRIGENS | |
| IIERRNSSD | | IIERRNSSD | | IPVTQTMELV | | KDNGIRIGSKG | |
| IIESNVTVT | | IIESNVTVT | | IPVTQVEELV | | KDNGIRIGSRG | |
| IIETGYVCS | | IIETGYVCS | | IQAGVDRFYR | | KDNGIRVGSRG | |
| IIFEANGNL | | IIFEANGNL | | IQAGVNRFYR | | KDNGVRIGSKG | |
| IIFEATGNL | | IIFEATGNL | | IQALQLLLEV | | KDNLEPGTFDL | |
| IIFLWGIHH | | IIFLWGIHH | | IQDIWAYNAE | | KDNNIRIGSKG | |
| IIFNMERIK | | IIFNMERIK | | IQDLEKYVED | | KDNQVFPQLNQ | |
| IIFNSIGNL | | IIFNSIGNL | | IQDLERYVED | | KDNSIQLSAGG | |
| IIFSHNGGL | | IIFSHNGGL | | IQDLWAYNAE | | KDNSIRIGSKG | |
| IIGGFIFGC | | IIGGFIFGC | | IQDVWAYNAE | | KDNSIRIGSRG | |
| IIGISGPDN | | IIGISGPDN | | IQFEAVGREF | | KDNSIRLAAGG | |
| IIGISNVGL | | IIGISNVGL | | IQFTAVGKEF | | KDNSIRLSADG | |

Fig. 83-166

| Block size 8 | SIN | Block size 9 | SIN | Block size 10 | SIN | Block size 11 | SIN |
|---|---|---|---|---|---|---|---|
| IIGKMNTQF | | IIGKMNTQF | | IQFTSVGKEF | | KDNSIRLSAGG | |
| IIGPPQCDL | | IIGPPQCDL | | IQGNNDNATA | | KDNSIRLSASG | |
| IIGPPQCDS | | IIGPPQCDS | | IQGVKLAQGY | | KDNSVRIGSKG | |
| IIHISPLSG | | IIHISPLSG | | IQGVKLIQGY | | KDNSVRLSAGG | |
| IIIAGLSFW | | IIIAGLSFW | | IQGVKLTQGY | | KDNSVRLSASG | |
| IIIAIGSVS | | IIIAIGSVS | | IQGVRLTQGY | | KDPKKTGGPIY | |
| IIIRMMENA | | IIIRMMENA | | IQGYKDIILW | | KDQAWSYIVER | |
| IIIVVLLYT | | IIIVVLLYT | | IQHLEECSCY | | KDQDWSYIVER | |
| IIKGRSHLR | | IIKGRSHLR | | IQHPELTGLN | | KDQGWSYIVER | |
| IIKKYTSAR | | IIKKYTSAR | | IQIDPVKLSG | | KDQSWSYIVER | |
| IIKKYTSGR | | IIKKYTSGR | | IQIDPVKLSS | | KDRSPFRALMS | |
| IIKLLPFAA | | IIKLLPFAA | | IQIDQVKLSS | | KDRSPFRTLMS | |
| IIKLLPFAS | | IIKLLPFAS | | IQIDSVKLSS | | KDRSPHRALMS | |
| IILGNPKCD | | IILGNPKCD | | IQIIKLLPFA | | KDRSPHRTLMS | |
| IILWFSFGA | | IILWFSFGA | | IQMCTELKLN | | KDRSPQRTLMS | |
| IILWFSFSI | | IILWFSFSI | | IQMCTELKLS | | KDRSPYRALMS | |
| IILWISFSI | | IILWISFSI | | IQMCTELQLS | | KDRSPYRTLMS | |
| IILWISFSM | | IILWISFSM | | IQNALNGNGD | | KDSITDIWTYQ | |
| IILWVSFSI | | IILWVSFSI | | IQNEDIPIEN | | KDSITYIWTYQ | |
| IINGALGSP | | IINGALGSP | | IQNEDIPIGN | | KDSNGVQDIID | |
| IINKMNTQF | | IINKMNTQF | | IQNEDIPIGS | | KDSRSGYETFK | |
| IINLLIGIS | | IINLLIGIS | | IQNEFNKACE | | KDSRSGYETFR | |
| IINNQNWSG | | IINNQNWSG | | IQNIWAYNAE | | KDVILWFSFGA | |
| IINNYHNET | | IINNYHNET | | IQPGDNITFS | | KDVILWFSLGA | |
| IINNYYNDT | | IINNYYNDT | | IQPTFSVQRN | | KDVILWISFSI | |
| IINNYYNET | | IINNYYNET | | IQQTRVDKLT | | KDWILWISFAI | |
| IINNYYNKT | | IINNYYNKT | | IQSDAQIDES | | KDWILWISFAM | |
| IIPSGPLKA | | IIPSGPLKA | | IQSDKPFQNV | | KDWILWISFAT | |
| IIPVNNTIY | | IIPVNNTIY | | IQSEFNKACE | | KDWVLWISFAI | |
| IIQNEDIPI | | IIQNEDIPI | | IQSKGLFGAI | | KDYEEEAKLER | |
| IIRALTLNT | | IIRALTLNT | | IQSRGLFGAI | | KDYRYTYRCHK | |
| IIREPFVSC | | IIREPFVSC | | IQTLVSNNDW | | KDYRYTYRCHR | |
| IIRESGGID | | IIRESGGID | | IQTNGNLIAP | | KEAMQNRIQID | |
| IIRVGCVIL | | IIRVGCVIL | | IQTRGLFGAI | | KEAQDVIMEIV | |
| IISFCGVNS | | IISFCGVNS | | IQTSGNLIAP | | KEAQDVIMEVV | |
| IISKDNGIR | | IISKDNGIR | | IRALTLNTMT | | KECFNPCFYVE | |
| IISLCSIWF | | IISLCSIWF | | IRCVCRDNWK | | KEDEVWWTSNS | |
| IISMCSSTE | | IISMCSSTE | | IREGLILEYY | | KEDKVWWTSNS | |
| IISNLPFQN | | IISNLPFQN | | IREPFISCSH | | KEDRVWWTSNS | |
| IISSLPFQN | | IISSLPFQN | | IREPFISCSI | | KEDSRSGYETF | |
| IITDTFKSW | | IITDTFKSW | | IREPFISCSP | | KEEALKGSARH | |
| IITDTIKSW | | IITDTIKSW | | IREPFISCSQ | | KEEALQGSARH | |
| IITDTIRSW | | IITDTIRSW | | IREPFISCSV | | KEECYRACFYV | |
| IITDTLKSW | | IITDTLKSW | | IREPFVACGP | | KEEKVWWTSNS | |
| IITELPFQN | | IITELPFQN | | IREPFVACSP | | KEEPLKGSAKH | |
| IITETIKSW | | IITETIKSW | | IREPFVSCGP | | KEESQLKRQEI | |
| IITGPPQCD | | IITGPPQCD | | IREPFVSCSH | | KEETLKGSARH | |
| IITGTIKSW | | IITGTIKSW | | IREPFVSCSI | | KEEVINATETV | |
| IITHFQRKR | | IITHFQRKR | | IREPFVSCSP | | KEEVLKGSARH | |
| IITIDSVSL | | IITIDSVSL | | IRESGGIDKE | | KEEVTNATETV | |
| IITIGSASI | | IITIGSASI | | IREWSYLIED | | KEFEQVEGRIQ | |
| IITIGSASL | | IITIGSASL | | IRFGEGEQII | | KEFEQVEGRTQ | |
| IITIGSICM | | IITIGSICM | | IRFGESEQII | | KEFGNLERRLE | |
| IITIGSISI | | IITIGSISI | | IRFGESEQIV | | KEFGQVEGRIQ | |
| IITIGSISL | | IITIGSISL | | IRFGESEQVI | | KEFNNLEKRLE | |
| IITIGSISV | | IITIGSISV | | IRFNSDLDYQ | | KEFNNLERRLE | |
| IITIGSVSI | | IITIGSVSI | | IRFNSDLNYQ | | KEFSEIEGRIQ | |
| IITIGSVSL | | IITIGSVSL | | IRFNSDPDYQ | | KEFSEVEGRIQ | |
| IITMGSVSL | | IITMGSVSL | | IRFNSNLDYQ | | KEFSNLEKRLE | |
| IITREPYVS | | IITREPYVS | | IRFVNSDCSK | | KEFSNLERRLE | |
| IITVGSVSL | | IITVGSVSL | | IRGEFNQVEK | | KEFTEVEGRIQ | |
| IIVFCGTSG | | IIVFCGTSG | | IRGEFNQVEN | | KEGRRKTNLYG | |

Fig. 83-167

| Block size 8 | SIN | Block size 9 | SIN | Block size 10 | SIN | Block size 11 | SIN |
|---|---|---|---|---|---|---|---|
| IIVFNTIGN | | IIVFNTIGN | | IRGEFNQVEQ | | KEGRRRTNLYG | |
| IIVILVLGL | | IIVILVLGL | | IRGEFSQVEQ | | KEGSYFFGDNA | |
| IIVTREPYV | | IIVTREPYV | | IRGEFSQVER | | KEGYSLVGIDP | |
| IIWGIHHPS | | IIWGIHHPS | | IRGETTGRNC | | KEGYSLVGVDP | |
| IIYSSSMMW | | IIYSSSMMW | | IRGFVHFVEA | | KEIEGICYPGS | |
| IKAVRGDLN | | IKAVRGDLN | | IRGFVYFVEA | | KEIGNGCFEFY | |
| IKCICRDNW | | IKCICRDNW | | IRGFVYFVEI | | KEIILWFSFGA | |
| IKCQTPLGA | | IKCQTPLGA | | IRGFVYFVET | | KEKAIWTSGSS | |
| IKCVCRDNW | | IKCVCRDNW | | IRGKHSNGTI | | KEKEICSVVLE | |
| IKDGNMRCT | | IKDGNMRCT | | IRGNSPIFNY | | KEKENSYPKIN | |
| IKDRSPYRT | | IKDRSPYRT | | IRGNSPVFNY | | KEKENSYPMIN | |
| IKDYRYTYR | | IKDYRYTYR | | IRGQPKEKAI | | KEKTIWTSGSS | |
| IKEKDMTKE | | IKEKDMTKE | | IRGQPKEKTI | | KEKVTNATETV | |
| IKFVSSDCS | | IKFVSSDCS | | IRGQPKERTI | | KELGNGCFEFY | |
| IKGDYNNTT | | IKGDYNNTT | | IRGQQGRMDY | | KELVETNHTDE | |
| IKGFAFLDG | | IKGFAFLDG | | IRGRHSNGTI | | KEMEGICYPGS | |
| IKGFAPFSK | | IKGFAPFSK | | IRGRPEEAKY | | KEMEGVCYPGS | |
| IKGFGFLNE | | IKGFGFLNE | | IRGRPEEVKY | | KEMGNGCFEFY | |
| IKGFSFKYG | | IKGFSFKYG | | IRGRPKEDEV | | KENPAHKSQLV | |
| IKGFSFRYG | | IKGFSFRYG | | IRGRPKEDKV | | KENTGSYVRLY | |
| IKGRSHLRN | | IKGRSHLRN | | IRGRPKEDRV | | KEPALIVWGVH | |
| IKGVELSSM | | IKGVELSSM | | IRGRPKEEKV | | KEPDTYDFNEG | |
| IKGVKLSNM | | IKGVKLSNM | | IRGVVYFVET | | KEPISLGDCSF | |
| IKGVKLSSM | | IKGVKLSSM | | IRGWAPLSKD | | KEPMGFRYSGI | |
| IKGVYINTA | | IKGVYINTA | | IRHENRMVIA | | KEQGSGYAADK | |
| IKGWAPLSK | | IKGWAPLSK | | IRHENRMVLA | | KEQLGSWSWHD | |
| IKHENRMVL | | IKHENRMVL | | IRHLEECSCY | | KEQTALYKNAN | |
| IKHLEECSC | | IKHLEECSC | | IRIAWSSSSC | | KEQTTLYKNAN | |
| IKICESRLR | | IKICESRLR | | IRIGSKGDIF | | KERLGSWSWHD | |
| IKINPVTLT | | IKINPVTLT | | IRIGSKGDVF | | KERTSIWTSSS | |
| IKIRRRVDI | | IKIRRRVDI | | IRIGSKGHVF | | KESKLNRNEIK | |
| IKKTNEKFH | | IKKTNEKFH | | IRIGSRGDVF | | KESLRLAIGLR | |
| IKKYERVKM | | IKKYERVKM | | IRIGSRGEVF | | KESLRLALGLR | |
| IKKYTSARQ | | IKKYTSARQ | | IRIGSRGHIF | | KESLRLAVGLR | |
| IKKYTSGRQ | | IKKYTSGRQ | | IRIGSRGHVF | | KESMGFRYSGI | |
| IKLKSEDNV | | IKLKSEDNV | | IRINMINSKI | | KESRSGYETFK | |
| IKLKTEDNI | | IKLKTEDNI | | IRINNETILE | | KESTQKAIDQI | |
| IKLKTEDNV | | IKLKTEDNV | | IRKGLILEYY | | KESTQKAIDRI | |
| IKLLPFAAA | | IKLLPFAAA | | IRLAAGGAIW | | KETGNGCFEFY | |
| IKLLPFASA | | IKLLPFASA | | IRLAAGGDIW | | KETNGNYGPIN | |
| IKMKWGMEL | | IKMKWGMEL | | IRLFDYSGWN | | KETRVWWTSNS | |
| IKMKWGMEM | | IKMKWGMEM | | IRLFDYSKWN | | KEVGNGCFEFY | |
| IKMNPNQKI | | IKMNPNQKI | | IRLFDYSRWN | | KEVILWFSFGA | |
| IKNGNMQCT | | IKNGNMQCT | | IRLSADGDIW | | KEWGNGCFEFY | |
| IKNGNMRCT | | IKNGNMRCT | | IRLSAGGAVW | | KEWSGYSGSFV | |
| IKNGTYDHK | | IKNGTYDHK | | IRLSAGGAVW | | KEWSKRYELEI | |
| IKNGTYNHK | | IKNGTYNHK | | IRLSAGGDIW | | KEWSRRYELEI | |
| IKNGTYNHQ | | IKNGTYNHQ | | IRLSAGGHIW | | KEYEEEAKLEK | |
| IKNGTYNRK | | IKNGTYNRK | | IRLSAGGNIW | | KEYEEEAKLER | |
| IKNNMINND | | IKNNMINND | | IRLSGGGDIW | | KFCYPGELDNN | |
| IKNQEELRS | | IKNQEELRS | | IRMAINWGRI | | KFEAVAWSATA | |
| IKPCFWVEL | | IKPCFWVEL | | IRMATNECRI | | KFESVAWSASA | |
| IKPWARNIL | | IKPWARNIL | | IRMIKRGIND | | KFESVAWSATA | |
| IKQGSLKLA | | IKQGSLKLA | | IRMIKRGVND | | KFFPSSSYRRP | |
| IKQNGKSGA | | IKQNGKSGA | | IRMVKRGIND | | KFHQIEKEFSE | |
| IKQNTLKLA | | IKQNTLKLA | | IRNGTYDHKE | | KFHQIEKEFTE | |
| IKRGINDRN | | IKRGINDRN | | IRNGTYDHNI | | KFHSDTPRPAD | |
| IKRGVNDRN | | IKRGVNDRN | | IRNGTYNHED | | KFHSDTPRPDD | |
| IKRYERVKM | | IKRYERVKM | | IRNKHSNGTI | | KFHSDTPRPSD | |
| IKSDQLKLA | | IKSDQLKLA | | IRNKHSNGTT | | KFHSDTPRPTD | |
| IKSFSRTEL | | IKSFSRTEL | | IRNKHSNSTT | | KFHSDTPRPVD | |
| IKSFSRTQL | | IKSFSRTQL | | IRNLHIPEAG | | KFKADLIIERR | |

Fig. 83-168

| Block size 8 | SIN | Block size 9 | SIN | Block size 10 | SIN | Block size 11 | SIN |
|---|---|---|---|---|---|---|---|
| IKSGQLKLA | | IKSGQLKLA | | IRNLHIPEVC | | KFLLMDALKLS | |
| IKSHAYISF | | IKSHAYISF | | IRNNMINNDL | | KFLLMDSLKLS | |
| IKSLKLATG | | IKSLKLATG | | IRNNSYDHSK | | KFQTAAQKAMM | |
| IKSWRKDIL | | IKSWRKDIL | | IRNNTYDHAQ | | KFQTAAQRAMM | |
| IKSWRRDIL | | IKSWRRDIL | | IRNNTYDHKK | | KFQTAAQRAMV | |
| IKTDGATSA | | IKTDGATSA | | IRNNTYDHSH | | KFTNEEALRQI | |
| IKTKLPFQN | | IKTKLPFQN | | IRNNTYDHSK | | KFYIQMCTELK | |
| IKTLTNEKE | | IKTLTNEKE | | IRNNTYDHSQ | | KGCFDILHKCD | |
| IKTNGNLIA | | IKTNGNLIA | | IRNNTYDHSR | | KGCINRCFYVE | |
| IKTRLFTIR | | IKTRLFTIR | | IRNNTYDHST | | KGDCYRACFYV | |
| IKTRPILSP | | IKTRPILSP | | IRNNTYDHTK | | KGDIFVIREPF | |
| IKTWAGKIL | | IKTWAGKIL | | IRNNTYDHTQ | | KGDIFVMREPF | |
| IKTWAGNIL | | IKTWAGNIL | | IRNNTYNHTE | | KGDKICLGHHA | |
| IKTWAKNIL | | IKTWAKNIL | | IRNNTYNHTQ | | KGDQICIGYHA | |
| IKTWARNIL | | IKTWARNIL | | IRNRHSNGTI | | KGDRICIGYHA | |
| IKVDTLTEK | | IKVDTLTEK | | IRPCFWVELI | | KGDVFVIREPF | |
| IKWNVTYTG | | IKWNVTYTG | | IRPCFWVELV | | KGDVFVMREPF | |
| IKYNGIITD | | IKYNGIITD | | IRPGYNGQKS | | KGDYNNTTGRD | |
| ILAATVTLH | | ILAATVTLH | | IRRRVDINPG | | KGECYRACFYV | |
| ILAFILWAC | | ILAFILWAC | | IRRRVDMNPG | | KGEKANVLIGQ | |
| ILAFIMWAC | | ILAFIMWAC | | IRRRVDTNPG | | KGEYNNTTGRD | |
| ILAFIMWTC | | ILAFIMWTC | | IRRRVDVNPG | | KGFAPFSKDNG | |
| ILAIYATVA | | ILAIYATVA | | IRSFSRTELI | | KGFAPFSKDNS | |
| ILAIYSTAA | | ILAIYSTAA | | IRSWRKQILR | | KGFFPFHKDNA | |
| ILAIYSTVA | | ILAIYSTVA | | IRTATREGKH | | KGFGFRQGDDV | |
| ILAIYSTVS | | ILAIYSTVS | | IRTDGATSAC | | KGFGFRQGNDV | |
| ILANNGKFE | | ILANNGKFE | | IRTFSFQLIL | | KGFGFRQGNNV | |
| ILANNGRFE | | ILANNGRFE | | IRTFSFQLIN | | KGFGFRQGNSV | |
| ILASSGSLE | | ILASSGSLE | | IRTKSGGNTN | | KGFGFRQGSDV | |
| ILATTITLH | | ILATTITLH | | IRTLTLNTMT | | KGFGFRQGTDV | |
| ILATTVTLH | | ILATTVTLH | | IRTNGNLIAP | | KGFGFRQGTSV | |
| ILCASATAI | | ILCASATAI | | IRTNGTSKIK | | KGFSFRYGDGV | |
| ILCTSAIAI | | ILCTSAIAI | | IRTRGLFGAI | | KGGPGVKGFGF | |
| ILCTSATAI | | ILCTSATAI | | IRTRSGGNNN | | KGGSIKTKLPF | |
| ILCTSATAL | | ILCTSATAL | | IRTRSGGNTN | | KGGSINTKLPF | |
| ILDEHDSNV | | ILDEHDSNV | | IRTRSGGNTS | | KGHVFVIREPF | |
| ILDFHDSNV | | ILDFHDSNV | | IRTWAKNILR | | KGIEVVNATET | |
| ILDGVTASC | | ILDGVTASC | | IRVGCVILLN | | KGILEDEQMYQ | |
| ILDQNFRNI | | ILDQNFRNI | | IRVGSRGHVF | | KGILGFVFTLT | |
| ILEDEQMYQ | | ILEDEQMYQ | | IRVKRRPVAK | | KGKFQTAAQKA | |
| ILEEESDEA | | ILEEESDEA | | IRWETTGRNC | | KGKFQTAAQRA | |
| ILEENTTYK | | ILEENTTYK | | IRWLTLKSGQ | | KGKKAVDLGSC | |
| ILEGTTASC | | ILEGTTASC | | ISATGMALSV | | KGLCTINSWHI | |
| ILEKAHNGK | | ILEKAHNGK | | ISATGMILSV | | KGLFGAIAGFI | |
| ILEKNITVT | | ILEKNITVT | | ISATGMTLSV | | KGLILGNPKCD | |
| ILEKNVTVT | | ILEKNVTVT | | ISATGVTLSV | | KGLWDSFRQSE | |
| ILEKTHNGK | | ILEKTHNGK | | ISCFLLAALL | | KGMLGFVFTLT | |
| ILEKTHNGR | | ILEKTHNGR | | ISCFLLIALL | | KGNAKDEGNGC | |
| ILEKVHNGK | | ILEKVHNGK | | ISCFLLVALF | | KGNGCFEIFHK | |
| ILEQNVTVT | | ILEQNVTVT | | ISCFLLVALL | | KGNGCFEIFHQ | |
| ILERNVTVT | | ILERNVTVT | | ISCLYKLSQF | | KGNGCFEIFHR | |
| ILERTHNGK | | ILERTHNGK | | ISCSHLECRT | | KGNIMRTQESE | |
| ILETGYICS | | ILETGYICS | | ISCSHMECRT | | KGNPGVKGWAF | |
| ILETGYVCG | | ILETGYVCG | | ISCSHSECRT | | KGNQGVKGWAF | |
| ILETGYVCS | | ILETGYVCS | | ISCSIDECRT | | KGNSARLIHHT | |
| ILETRYVCS | | ILETRYVCS | | ISCSIHECRT | | KGRGLFGAIAG | |
| ILFASATAI | | ILFASATAI | | ISCSINECRT | | KGRHANGTIHD | |
| ILFIEEGKI | | ILFIEEGKI | | ISCSISECRT | | KGRLCNPLNPF | |
| ILFIEEGKV | | ILFIEEGKV | | ISCSVSECRT | | KGRSHLRNDTD | |
| ILFIKEGKI | | ILFIKEGKI | | ISCSYLECRT | | KGRYGVKGFSF | |
| ILFIREGKI | | ILFIREGKI | | ISDGGPNLYN | | KGSAKHIEECS | |
| ILFNTIGNL | | ILFNTIGNL | | ISDKIDDQIE | | KGSARHIEECS | |

Fig. 83-169

| Block size 8 | SIN | Block size 9 | SIN | Block size 10 | SIN | Block size 11 | SIN |
|---|---|---|---|---|---|---|---|
| ILFVKEGKI | | ILFVKEGKI | | ISECRTFFLT | | KGSARHIEEWS | |
| ILGDCSVAG | | ILGDCSVAG | | ISFAISCFLL | | KGSARHVEECS | |
| ILGFVFTLT | | ILGFVFTLT | | ISFAMSCFLL | | KGSIQSDKPFQ | |
| ILGFVLWAC | | ILGFVLWAC | | ISFATSCFLL | | KGSNRPIIDIN | |
| ILGILTGPP | | ILGILTGPP | | ISFESNGGLL | | KGSNRPVIDIN | |
| ILGMQNGSC | | ILGMQNGSC | | ISFESNGNFI | | KGSNRPVIDVN | |
| ILGMQNGSY | | ILGMQNGSY | | ISFESTGNLI | | KGSNRPVVDIN | |
| ILGNPKCDL | | ILGNPKCDL | | ISFESTGNLV | | KGSNRPWIRIN | |
| ILGNPKCDP | | ILGNPKCDP | | ISFQGGHIEE | | KGSNRPWMRIN | |
| ILGNPMCDD | | ILGNPMCDD | | ISFSISCFLF | | KGSNRPWMRIS | |
| ILGNPMCDE | | ILGNPMCDE | | ISFSISCFLL | | KGSNRPWVRMN | |
| ILGNPMCDN | | ILGNPMCDN | | ISFSMSCFVF | | KGSWPDGANIN | |
| ILGNPMCDY | | ILGNPMCDY | | ISFTITGDNT | | KGSYNNTNGEQ | |
| ILGNPRCDD | | ILGNPRCDD | | ISFWMCSGHS | | KGSYNNTSGEQ | |
| ILGNYKEIC | | ILGNYKEIC | | ISFWMCSNGS | | KGVELSSMGVY | |
| ILGTIIGPP | | ILGTIIGPP | | ISFYWTIVDP | | KGVEVVNATET | |
| ILHKCDNEC | | ILHKCDNEC | | ISFYWTIVEP | | KGVKLSNMGIY | |
| ILHKCDNKC | | ILHKCDNKC | | ISFYWTVVEP | | KGVKLSNMGVY | |
| ILHKCNDSC | | ILHKCNDSC | | ISGADDDAYA | | KGVKLSSMGIY | |
| ILHKCNNEC | | ILHKCNNEC | | ISGPDDGAVA | | KGVKLSSMGVY | |
| ILIAGGLIL | | ILIAGGLIL | | ISGPDNEAVA | | KGVYINTALLN | |
| ILITQESEC | | ILITQESEC | | ISGPDNGAVA | | KGVYINTAMLN | |
| ILKDCSIAG | | ILKDCSIAG | | ISGPDSGAVA | | KGVYMNTALLN | |
| ILKDCSVAG | | ILKDCSVAG | | ISGPNNNASA | | KGVYVNTALLN | |
| ILKDCSVSG | | ILKDCSVSG | | ISGTCAVVMT | | KGWAPLSKDNG | |
| ILKGKFQTA | | ILKGKFQTA | | ISGVKLEENS | | KGYGVKGFGFR | |
| ILKHNPTEE | | ILKHNPTEE | | ISGWTTANSK | | KHDRIPHRTLL | |
| ILKIKKGKI | | ILKIKKGKI | | ISHCRATEYI | | KHDSNVKNLFD | |
| ILKIKKGKL | | ILKIKKGKL | | ISHISPLSGS | | KHENRMVLAST | |
| ILKIRKGKI | | ILKIRKGKI | | ISHRTLLMNE | | KHIEECSCYGE | |
| ILKPGETLN | | ILKPGETLN | | ISIASRSGYE | | KHIEECSCYGH | |
| ILKPGQTLR | | ILKPGQTLR | | ISIGSSTYQN | | KHIEECSCYGK | |
| ILKPGQTVK | | ILKPGQTVK | | ISIGTSTLNQ | | KHIEECSCYGV | |
| ILKQNPTEE | | ILKQNPTEE | | ISIVPNIGSR | | KHIVERILEEE | |
| ILKRGETLK | | ILKRGETLK | | ISIWMCSNGS | | KHLAYCNTDLG | |
| ILLENERTL | | ILLENERTL | | ISIYWTLVNP | | KHLEECSCYVD | |
| ILLNPFVSH | | ILLNPFVSH | | ISKCCKTKEGR | | KHPAYCNTDLG | |
| ILLSPEEVS | | ILLSPEEVS | | ISKCRTKEGR | | KHQNAQGEGTA | |
| ILNLLIGIS | | ILNLLIGIS | | ISKCRTREGR | | KHRFEIIEGRD | |
| ILNNKNWSG | | ILNNKNWSG | | ISKDLRSGYE | | KHSAYCNTDLG | |
| ILNPDTVT | | ILNPDTVT | | ISKDNGIRIG | | KHSNGTIHDRA | |
| ILNTSQRGI | | ILNTSQRGI | | ISKDSRSGYE | | KHSNGTIHDRI | |
| ILNTSQRGV | | ILNTSQRGV | | ISKDTRSGYE | | KHSNGTIHDRS | |
| ILPFDIDKM | | ILPFDIDKM | | ISKRGGSGIM | | KHSNGTIHDRT | |
| ILRDCSVAG | | ILRDCSVAG | | ISKRGNSGIM | | KHSNGTIKDRS | |
| ILRGAVAHK | | ILRGAVAHK | | ISKRGSSGIM | | KHSNGTMKDRS | |
| ILRGSIAHK | | ILRGSIAHK | | ISKRGSSGIV | | KHSNGTTHDRT | |
| ILRGSVAHK | | ILRGSVAHK | | ISKRGSSGVM | | KHSNGTVKDRS | |
| ILRQNPTEE | | ILRQNPTEE | | ISKSRATEYI | | KHSNNTVKDRS | |
| ILRTHESEC | | ILRTHESEC | | ISKSRTKEGR | | KHSNSTTHDRT | |
| ILRTQDSEC | | ILRTQDSEC | | ISKSTKSTVL | | KHSSGTVKDRS | |
| ILRTQESEC | | ILRTQESEC | | ISKTNQQFEL | | KHTSQYICSPV | |
| ILRTQESSC | | ILRTQESSC | | ISLCSIWFSH | | KHTSQYLCTGV | |
| ILSFIMWAC | | ILSFIMWAC | | ISLGDCSFAG | | KHWSGYSGSFT | |
| ILSFIMWAG | | ILSFIMWAG | | ISLGGCSFAG | | KHYIGKCPKYI | |
| ILSIAPIMF | | ILSIAPIMF | | ISLVKTTLFL | | KHYIGKCPRYI | |
| ILSICSCIA | | ILSICSCIA | | ISLWMCSNGS | | KICIGYHANNS | |
| ILSIYSCIA | | ILSIYSCIA | | ISMCSSTEFL | | KICIGYLSNNA | |
| ILSIYSSVA | | ILSIYSSVA | | ISMDSRSGYE | | KICIGYLSNNS | |
| ILSIYSTAA | | ILSIYSTAA | | ISMEDYSIDS | | KICIGYQTNNS | |
| ILSIYSTVA | | ILSIYSTVA | | ISMEDYSIGS | | KICLGHHAIPN | |
| ILSIYSTVS | | ILSIYSTVS | | ISNEGSYFFG | | KICLGHHAVAN | |

Fig. 83-170

| Block size 8 | SIN | Block size 9 | SIN | Block size 10 | SIN | Block size 11 | SIN |
|---|---|---|---|---|---|---|---|
| ILSIYSTVT | | ILSIYSTVT | | ISNETILETG | | KICLGHHAVPN | |
| ILSIYSTVV | | ILSIYSTVV | | ISNLPFQNIN | | KICLGHHAVSN | |
| ILSKDNAIR | | ILSKDNAIR | | ISNQGSFYRN | | KICLGHHAVTN | |
| ILSMAPIMF | | ILSMAPIMF | | ISNQGSFYRS | | KICVGYLSTNS | |
| ILSNPKCDL | | ILSNPKCDL | | ISNRFQIQGV | | KIDDQIEDLWA | |
| ILSPLTKGI | | ILSPLTKGI | | ISNVGLNISL | | KIDDQIEELWA | |
| ILSPLTKGM | | ILSPLTKGM | | ISNVGLNVSL | | KIDDQIEGLWA | |
| ILSTKALLI | | ILSTKALLI | | ISPHSRSGFE | | KIDDQIENLWA | |
| ILSVYSTVA | | ILSVYSTVA | | ISPIHLGDCS | | KIDLWSYNADV | |
| ILTDSQTAT | | ILTDSQTAT | | ISPKLRSGFE | | KIDLWSYNAEL | |
| ILTDTSRPG | | ILTDTSRPG | | ISPLAGSAQH | | KIDLWSYNAGL | |
| ILTDTSRPS | | ILTDTSRPS | | ISPLAVTWWN | | KIDPVKLSSGY | |
| ILTFIMWAC | | ILTFIMWAC | | ISPLMVAYML | | KIDTILERNVT | |
| ILTGPPQCD | | ILTGPPQCD | | ISPLSGSAQH | | KIDTLTETGVP | |
| ILTIYSTAA | | ILTIYSTAA | | ISPRLRSGFE | | KIEAVIYGNPK | |
| ILTIYSTVA | | ILTIYSTVA | | ISPRSRNGFE | | KIEFEPFQSLV | |
| ILTKITVDH | | ILTKITVDH | | ISPRSRSGFE | | KIEKIEKIRPL | |
| ILTKTTVDH | | ILTKTTVDH | | ISPVHLGDCS | | KIHTRGLFGAI | |
| ILTRTTVDH | | ILTRTTVDH | | ISRARIDARI | | KIIQNEDIPIG | |
| ILVAGGLIL | | ILVAGGLIL | | ISRDSRSGYE | | KIIRVGCVILL | |
| ILVALALSH | | ILVALALSH | | ISSGSLKLAI | | KIITIGSASLG | |
| ILVALENQH | | ILVALENQH | | ISSLPFQNIN | | KIITIGSISLG | |
| ILVIYATVA | | ILVIYATVA | | ISSMGEAMVS | | KIITIGSISLT | |
| ILVLGLSMV | | ILVLGLSMV | | ISSMMEAMVS | | KIITIGSVSLA | |
| ILVSTNAYD | | ILVSTNAYD | | ISSMVEAMIS | | KIITIGSVSLI | |
| ILVTREPYL | | ILVTREPYL | | ISSMVEAMMS | | KIITIGSVSLT | |
| ILVTREPYV | | ILVTREPYV | | ISSMVEAMVS | | KIKHLEECSCY | |
| ILVTTVTLH | | ILVTTVTLH | | ISSSFSFGGF | | KIKMKWGMELR | |
| ILWACQNGN | | ILWACQNGN | | ISSSLVLMGL | | KIKMKWGMEMR | |
| ILWACQTGN | | ILWACQTGN | | ISTASRSGYE | | KIKTNGNLIAP | |
| ILWACSSGN | | ILWACSSGN | | ISTASRYGYE | | KILDEHDSNVK | |
| ILWFSFGAS | | ILWFSFGAS | | ISTPLGSPPI | | KILKIKKGKIM | |
| ILWFSLGAS | | ILWFSLGAS | | ISTPLGSPPM | | KILKIKKGKIV | |
| ILWISFAIS | | ILWISFAIS | | ISTPLGSPPV | | KILKIRKGKIM | |
| ILWISFAMS | | ILWISFAMS | | ISTPLGTPPT | | KILKIRKGKIV | |
| ILWISFATS | | ILWISFATS | | ISTTFPYTGD | | KILRTQESECV | |
| ILWISFSIS | | ILWISFSIS | | ISTTGMTLSV | | KILRTQESSCV | |
| ILWISFSMS | | ILWISFSMS | | ISVESSTYQN | | KILSIYSCIAS | |
| ILWVSFSIS | | ILWVSFSIS | | ISVGSGSFPD | | KILSIYSCVAS | |
| ILYFWGVHH | | ILYFWGVHH | | ISVGSSIYQN | | KILSIYSSVAS | |
| IMASQGTKR | | IMASQGTKR | | ISVGSSTYQN | | KILSIYSTVAA | |
| IMEKIVTVT | | IMEKIVTVT | | ISVGTSTLNL | | KILSIYSTVAS | |
| IMEKNITVT | | IMEKNITVT | | ISVGTSTLNQ | | KILTIYSTAAS | |
| IMEKNVTVT | | IMEKNVTVT | | ISWEMGLAPS | | KILTIYSTVAS | |
| IMERNVTVT | | IMERNVTVT | | ISWEMGQAPS | | KIMESGGIDKI | |
| IMESGGIDK | | IMESGGIDK | | ISWGMGQAPS | | KIMESGGIDKV | |
| IMESGGISK | | IMESGGISK | | ISWPLSSPPT | | KIMESGGISKI | |
| IMEVVFPNE | | IMEVVFPNE | | ISWPQSSPPT | | KIMESGGISKM | |
| IMFESNGGL | | IMFESNGGL | | ITAASLNDDG | | KIMTIGSVSLA | |
| IMFSNKMAR | | IMFSNKMAR | | ITCTCRDNWQ | | KINDQIEDLWA | |
| IMFSNKVAR | | IMFSNKVAR | | ITCVCRDNWH | | KINEVKLEENT | |
| IMGLFFFCL | | IMGLFFFCL | | ITCVCRDNWQ | | KINGKLNRLIE | |
| IMGLVFFCL | | IMGLVFFCL | | ITDGPSDAQA | | KINGVILEENT | |
| IMHDRTKIR | | IMHDRTKIR | | ITDGPSNAQA | | KINGVKLEENS | |
| IMIAGLFFW | | IMIAGLFFW | | ITDIWAYNAE | | KINGVKLEENT | |
| IMIAGLSFW | | IMIAGLSFW | | ITDIWTYQAE | | KINGVRLEENT | |
| IMIDGSASG | | IMIDGSASG | | ITDTFKSWKG | | KINNIIDKMNG | |
| IMINPVKLS | | IMINPVKLS | | ITDTLKSWKG | | KINNIIEKMNG | |
| IMIWHSNLN | | IMIWHSNLN | | ITDWSGYSGS | | KINNIVDKMNR | |
| IMMAGLSFW | | IMMAGLSFW | | ITEINTWARN | | KINPVTLTMGY | |
| IMNTSKPFQ | | IMNTSKPFQ | | ITEIVYLNHT | | KINSIIDKMNT | |
| IMQNKLNNV | | IMQNKLNNV | | ITEIVYLNNT | | KINTLTERGVE | |

Fig. 83-171

| Block size 8 | SIN | Block size 9 | SIN | Block size 10 | SIN | Block size 11 | SIN |
|---|---|---|---|---|---|---|---|
| IMRIWRQAN | | IMRIWRQAN | | ITEIVYLNST | | KIPNAETDPNS | |
| IMRTQESEC | | IMRTQESEC | | ITEIYNETVR | | KIPNAETDPSS | |
| IMRTQESSC | | IMRTQESSC | | ITELPFQNLS | | KIPNAGIDPNS | |
| IMRTVIALS | | IMRTVIALS | | ITENSFEQIT | | KIPNAGTDPNS | |
| IMSCDSPSN | | IMSCDSPSN | | ITEVWSYNAE | | KIQHLEECSCY | |
| IMTDGPASS | | IMTDGPASS | | ITEWSGYSGS | | KIQTNGNLIAP | |
| IMTDGSANS | | IMTDGSANS | | ITFESNGGFL | | KIQTSGNLIAP | |
| IMTDGSASG | | IMTDGSASG | | ITFESNGGLL | | KIRHLEECSCY | |
| IMTDGSASS | | IMTDGSASS | | ITFIQALQLL | | KIRLQLRDNAK | |
| IMTIGSVSL | | IMTIGSVSL | | ITFLHNGGLI | | KIRNGTYDHKE | |
| IMVAGLSFW | | IMVAGLSFW | | ITFLQALQLL | | KIRRRVDINPG | |
| IMWACNSGN | | IMWACNSGN | | ITFMQALQLL | | KIRRRVDMNPG | |
| IMWACQKGN | | IMWACQKGN | | ITFSDNGGLI | | KIRRRVDTNPG | |
| IMWACQRGN | | IMWACQRGN | | ITFSFNGAFI | | KIRRRVDVNPG | |
| IMWACSNGN | | IMWACSNGN | | ITFSHNGGLI | | KIRTNGNLIAP | |
| IMWACSNGS | | IMWACSNGS | | ITFSHNGGLV | | KIRTRGLFGAI | |
| IMWACSSGN | | IMWACSSGN | | ITFSHNGGRI | | KIRVKRRPVAK | |
| IMWGIHHPS | | IMWGIHHPS | | ITGDDKNATA | | KISGVKLEENS | |
| IMWTCNSGN | | IMWTCNSGN | | ITGDDRNATA | | KISKRGGSGIM | |
| IMWTCQKGN | | IMWTCQKGN | | ITGDNTKWNE | | KISKRGSSGIM | |
| INDKIDDQI | | INDKIDDQI | | ITGFAPFSKD | | KISKRGSSGVM | |
| INDKINDQI | | INDKINDQI | | ITGFASFSKD | | KISKSTKSTVL | |
| INDPWVLLN | | INDPWVLLN | | ITGIDKVCTK | | KISSSFSFGGF | |
| INDQIEDLW | | INDQIEDLW | | ITGINKVCTK | | KITCVCRDNWQ | |
| INDQITDIW | | INDQITDIW | | ITGKLNRFIE | | KITENSFEQIT | |
| INDRNFWRG | | INDRNFWRG | | ITGKLNRIIE | | KITGFAPFSKD | |
| INDRSPFRA | | INDRSPFRA | | ITGKLNRLID | | KITLKFAFNMM | |
| INDRTAFRG | | INDRTAFRG | | ITGKLNRLIE | | KITNKINNIVD | |
| INECRTFFL | | INECRTFFL | | ITGKLNRLIG | | KITNKVNNIVD | |
| INEEALRQK | | INEEALRQK | | ITGKLNRLIS | | KITVDHMAIIK | |
| INEGALRQK | | INEGALRQK | | ITGKSHGRIL | | KIVTTVGWSWP | |
| INEGNGCFE | | INEGNGCFE | | ITGKSHGRVL | | KIYWHLMHPGE | |
| INEITTKIN | | INEITTKIN | | ITGPDATAVA | | KKAKLANVVRK | |
| INESADMSI | | INESADMSI | | ITGPDSTAVA | | KKASLRLAVGL | |
| INEVKLEEN | | INEVKLEEN | | ITGPDTTAVA | | KKAVDLGSCGI | |
| INFDSNGNF | | INFDSNGNF | | ITGSPGAPGV | | KKCFNPCFYVE | |
| INFESNGNF | | INFESNGNF | | ITGSPSAPGV | | KKEPDTYDFNE | |
| INFESNGNL | | INFESNGNL | | ITGTLNRLID | | KKESLRLAIGL | |
| INFESTGNL | | INFESTGNL | | ITHFQRKRRV | | KKESLRLALGL | |
| INFMPYISF | | INFMPYISF | | ITIGECPKYV | | KKESLRLAVGL | |
| INGALGSPG | | INGALGSPG | | ITIGISGPDD | | KKHPAYCNTDL | |
| INGFAPFSK | | INGFAPFSK | | ITIGISGPDN | | KKILRTQESSC | |
| INGICTVVM | | INGICTVVM | | ITIGKCPKYV | | KKKKKKRGLFG | |
| INGKAPISL | | INGKAPISL | | ITIGKCSKYV | | KKKKKRGLFGA | |
| INGKEPISL | | INGKEPISL | | ITIGSISLTI | | KKKKRGLFGAI | |
| INGKLNRLI | | INGKLNRLI | | ITIGSVSLTI | | KKKNPEAYNFN | |
| INGKQPISL | | INGKQPISL | | ITKIVYLNST | | KKKPDIYDFNE | |
| INGPDSVLV | | INGPDSVLV | | ITLHFKQNEC | | KKKPDTYDFNE | |
| INGPESVLI | | INGPESVLI | | ITLKFAFNMM | | KKKRGLFGAIA | |
| INGPESVLV | | INGPESVLV | | ITNGTTGNPI | | KKKSYINKTGT | |
| INGQAGRMT | | INGQAGRMT | | ITNKINNIVD | | KKKSYINRTGT | |
| INGQSGRID | | INGQSGRID | | ITNKINSIID | | KKLKREITFHG | |
| INGRAPISL | | INGRAPISL | | ITNKVNNIVD | | KKLKREMTFHG | |
| INGSCAVVM | | INGSCAVVM | | ITNKVNSIID | | KKMEDGFLDVW | |
| INGSCIVVM | | INGSCIVVM | | ITNPLIRHEN | | KKMEDGFLNVW | |
| INGSCTVVM | | INGSCTVVM | | ITNVQNNYTT | | KKMTITFLILL | |
| INGTCAVVM | | INGTCAVVM | | ITNWSGYSGS | | KKNPEAYNFNE | |
| INGTCTVIM | | INGTCTVIM | | ITPNGSIPND | | KKPDIYDFNEG | |
| INGTCTVVM | | INGTCTVVM | | ITPNGSIPNE | | KKPDTYDFNEG | |
| INGVILEEN | | INGVILEEN | | ITPNGSIPNG | | KKQEIEGIKLK | |
| INGVKLEEN | | INGVKLEEN | | ITPNGSIPNN | | KKQILRTQESS | |
| INGVRLEEN | | INGVRLEEN | | ITPNGSISND | | KKQLRENAEED | |

Fig. 83-172

| Block size 8 | SIN | Block size 9 | SIN | Block size 10 | SIN | Block size 11 | SIN |
|---|---|---|---|---|---|---|---|
| INGVTNKVN | | INGVTNKVN | | ITQTLVSNDD | | KKRGLFGAIAG | |
| INGWYGFQH | | INGWYGFQH | | ITQTLVSNND | | KKRKKRGLFGA | |
| INGWYGFRH | | INGWYGFRH | | ITQTLVSNSD | | KKRLGSWSWHD | |
| INIAEYSID | | INIAEYSID | | ITREPYVSCD | | KKSYINKTGTF | |
| INIMASQGT | | INIMASQGT | | ITRSGQNHGI | | KKSYINRTGTF | |
| INIREWSYL | | INIREWSYL | | ITSLCSIWFS | | KKTNEKFHQIE | |
| INKITNKVN | | INKITNKVN | | ITSNLPFQNV | | KKYERVKMFDF | |
| INKMNTQFE | | INKMNTQFE | | ITSPLPFQNI | | KKYGPALSINE | |
| INKTGTFEF | | INKTGTFEF | | ITTHFQRKRR | | KKYTSARQEKN | |
| INKVCTKGK | | INKVCTKGK | | ITTKINNIID | | KKYTSGRQEKN | |
| INLHAYISF | | INLHAYISF | | ITTKINNIIE | | KLAIGLRNVPQ | |
| INLLIGISN | | INLLIGISN | | ITVDHMAIIK | | KLAIGPRNVPA | |
| INLYASKNP | | INLYASKNP | | ITVGSSKYQQ | | KLAIGPRNVPQ | |
| INMADYSID | | INMADYSID | | ITVGSSKYRQ | | KLANVVRKMMT | |
| INMEDYSID | | INMEDYSID | | ITVIKNNMIN | | KLAQGYKDIIL | |
| INMIADRVD | | INMIADRVD | | ITVTHAKDIL | | KLASGLRNVPA | |
| INMINDKID | | INMINDKID | | ITVTHAQDIL | | KLATGLKNVPA | |
| INMINDKIN | | INMINDKIN | | ITVTHSVELL | | KLATGLRNIPA | |
| INMINSKID | | INMINSKID | | ITVTHSVNLL | | KLATGLRNVPA | |
| INMINSKIE | | INMINSKIE | | ITVTSSVELV | | KLATGLRNVPI | |
| INMINSKIN | | INMINSKIN | | ITWGIHHPSS | | KLATGLRNVPQ | |
| INMINSQID | | INMINSQID | | ITYIWTYQAE | | KLATGLRNVPS | |
| INMISDKID | | INMISDKID | | ITYNKTVINN | | KLATGLRNVPT | |
| INMLADRID | | INMLADRID | | ITYNNTVINN | | KLATGMRNIPE | |
| INMLADRVD | | INMLADRVD | | ITYNNTVVNN | | KLATGMRNVPE | |
| INMLADWVD | | INMLADWVD | | ITYNSTVVNN | | KLATGPRNVPA | |
| INMSKKKSY | | INMSKKKSY | | ITYSSPMMWE | | KLCFPGELDNN | |
| INNDLGPAT | | INNDLGPAT | | ITYSSSLMWE | | KLCFPGEVDNN | |
| INNETIIET | | INNETIIET | | ITYSSSMMWE | | KLCKLNGIPPL | |
| INNETILET | | INNETILET | | IVAFCGTSGT | | KLCRLRGIPPL | |
| INNETIVET | | INNETIVET | | IVAIVFSQED | | KLCRLSGIPPL | |
| INNGKGRYG | | INNGKGRYG | | IVALCGSKEQ | | KLCYPGELDNN | |
| INNIIDKMN | | INNIIDKMN | | IVALCGSKER | | KLCYPGEVDNN | |
| INNIIEKMN | | INNIIEKMN | | IVALCGSKKR | | KLDINMADYSI | |
| INNITNVVL | | INNITNVVL | | IVALCGSRER | | KLEENSTYKIL | |
| INNITTTII | | INNITTTII | | IVAMVFSQED | | KLEENTSYKIL | |
| INNITTTIT | | INNITTTIT | | IVAMVFSQEE | | KLEENTTYKIL | |
| INNIVDKMN | | INNIVDKMN | | IVASSGTLEF | | KLEENTTYRIL | |
| INNQNWSGY | | INNQNWSGY | | IVAVTDGPAA | | KLEFEPFQSLV | |
| INNRFQIQG | | INNRFQIQG | | IVDKMNREFE | | KLEKSRINGVK | |
| INNRIKINP | | INNRIKINP | | IVDKMNREFG | | KLEQSGLPVGG | |
| INNYHNETN | | INNYHNETN | | IVDNKNWSGY | | KLERSKINEVK | |
| INNYYNDTN | | INNYYNDTN | | IVDNNNWFGY | | KLERSKINGVI | |
| INNYYNETN | | INNYYNETN | | IVDNNNWSGY | | KLERSKINGVK | |
| INNYYNKTN | | INNYYNKTN | | IVDNSWSGY | | KLERSKINGVR | |
| INPTLLFLK | | INPTLLFLK | | IVDNQNWSGY | | KLFALSGVAIA | |
| INPVELSSG | | INPVELSSG | | IVDNSNWSGY | | KLFALSGVAIS | |
| INPVKLSGG | | INPVKLSGG | | IVEFCGTSGT | | KLFALSGVAVA | |
| INPVKLSSG | | INPVKLSSG | | IVERILEEES | | KLFASSGIAIA | |
| INPVTLSSG | | INPVTLSSG | | IVERPKEIEG | | KLFASSGIAIV | |
| INPVTLTMG | | INPVTLTMG | | IVERPKEMEG | | KLFERVKRQLR | |
| INQINGKLN | | INQINGKLN | | IVERPSAPEG | | KLFERVRHQLR | |
| INQITGKLN | | INQITGKLN | | IVERTKEMEG | | KLFERVRRQLR | |
| INRCFYVEL | | INRCFYVEL | | IVETGYVCSK | | KLFTLSGVAIA | |
| INRIFQPNI | | INRIFQPNI | | IVFCGTSGTY | | KLGQFPVQTDE | |
| INRIFRPNI | | INRIFRPNI | | IVFNTIGNLI | | KLGSPLVLDDC | |
| INRITYGAC | | INRITYGAC | | IVFNTIGNLV | | KLIQGYKDIIL | |
| INRNFKPNI | | INRNFKPNI | | IVFSQEDCMI | | KLITVGSSKYQ | |
| INRNFQPNI | | INRNFQPNI | | IVGLVFFCLK | | KLITVGSSKYR | |
| INRQEIEGV | | INRQEIEGV | | IVGNDNWSGY | | KLKREITFHGA | |
| INRQEVEGV | | INRQEVEGV | | IVGNPSCASN | | KLKREMTFHGA | |
| INRSFKPNI | | INRSFKPNI | | IVGNPSCATN | | KLKRNEIKGVE | |

Fig. 83-173

| Block size 8 | SIN | Block size 9 | SIN | Block size 10 | SIN | Block size 11 | SIN |
|---|---|---|---|---|---|---|---|
| INRSFQPNI | | INRSFQPNI | | IVHISPLSGS | | KLKRNEIKGVK | |
| INRSFRPNI | | INRSFRPNI | | IVILVLGLSM | | KLKRQEIDGIK | |
| INRTGTFEF | | INRTGTFEF | | IVKGRSHLRN | | KLKRQEIEGIK | |
| INSIIDKMN | | INSIIDKMN | | IVKTLTNEKE | | KLKRQEIEGIR | |
| INSKIDDQI | | INSKIDDQI | | IVKTLTNEQE | | KLKRQEINGIK | |
| INSKIDDQV | | INSKIDDQV | | IVKTLTNERE | | KLKRRAIATPG | |
| INSKIEDQI | | INSKIEDQI | | IVKTLTSEKE | | KLKSEDNVYKV | |
| INSKINDQI | | INSKINDQI | | IVLGIINLLI | | KLKTEDNIYKI | |
| INSPLPFQN | | INSPLPFQN | | IVLLENQKTL | | KLKTEDNVYKI | |
| INSPNHAKS | | INSPNHAKS | | IVLNTDWSGY | | KLKTEDNVYKV | |
| INSPNHVKS | | INSPNHVKS | | IVLTTDWSGY | | KLLGINMSKKK | |
| INSPSQAKS | | INSPSQAKS | | IVLVGLILAF | | KLLKERGFFGA | |
| INSQIDDQI | | INSQIDDQI | | IVLVMKRKRD | | KLLKIRKGKIV | |
| INSRFQIQG | | INSRFQIQG | | IVMVGLILAF | | KLLPFAAAPPE | |
| INSSKPFQN | | INSSKPFQN | | IVNAALGSPG | | KLLPFAAAPPK | |
| INSSKPLQN | | INSSKPLQN | | IVNGALGSPG | | KLLPFAAAPPV | |
| INSSMPFHN | | INSSMPFHN | | IVNNNWSGY | | KLLPFASAPPE | |
| INSSMPLHN | | INSSMPLHN | | IVNNQDWSGY | | KLLVLIENDRT | |
| INSSRPFQN | | INSSRPFQN | | IVNNQNWSGY | | KLLVLLENDKT | |
| INSSYVCSG | | INSSYVCSG | | IVNSALGSPG | | KLLVLLENDRT | |
| INSVKLFSG | | INSVKLFSG | | IVNTTLSTIA | | KLLVLLENGRT | |
| INSVKLSSG | | INSVKLSSG | | IVPCFWLEMI | | KLNGIPPLELG | |
| INSWHIFGK | | INSWHIFGK | | IVPNIGSRPR | | KLNHLIGKTNQ | |
| INSWHIYGK | | INSWHIYGK | | IVPSGPLKAE | | KLNKNEIKGVK | |
| INTALLNAS | | INTALLNAS | | IVQITGKLNR | | KLNNVIDKMNK | |
| INTAMLNAS | | INTAMLNAS | | IVRRAAVSAD | | KLNNVIDKMNN | |
| INTINSKID | | INTINSKID | | IVRRAIVSAD | | KLNNVIDKMYK | |
| INTKLPFQN | | INTKLPFQN | | IVRRATVSAD | | KLNRFIEKTNQ | |
| INTLTERGV | | INTLTERGV | | IVSADPLASL | | KLNRIIEKTNQ | |
| INTNKTFQN | | INTNKTFQN | | IVSIDRFLRV | | KLNRLIDKTNQ | |
| INTNRTFQN | | INTNRTFQN | | IVSKDNGIRI | | KLNRLIDRTNH | |
| INTRLPFQN | | INTRLPFQN | | IVSKDNGIRV | | KLNRLIEKTND | |
| INTSKPFQN | | INTSKPFQN | | IVSLGAISFW | | KLNRLIEKTNE | |
| INTTLPFHN | | INTTLPFHN | | IVSMCSSTEF | | KLNRLIEKTNK | |
| INTWARNIL | | INTWARNIL | | IVSNDNWSGY | | KLNRLIEKTNQ | |
| INTYQWIIR | | INTYQWIIR | | IVSPLAVTWW | | KLNRLIEKTNT | |
| INVINDKID | | INVINDKID | | IVSSLPFQNI | | KLNRLIERTNE | |
| INVTKENTG | | INVTKENTG | | IVSSLPFQSI | | KLNRLIERTNQ | |
| INWLTKKEP | | INWLTKKEP | | IVSWSQNILR | | KLNRLIGKTNQ | |
| INWLTKKKN | | INWLTKKKN | | IVTFCGLDBE | | KLNRLISKTNQ | |
| INWLTKKKP | | INWLTKKKP | | IVTFCGLDNE | | KLNRNEIKGVK | |
| INWTKDSIT | | INWTKDSIT | | IVTFCGLNNE | | KLPFQNLSPRT | |
| INWTQDAMT | | INWTQDAMT | | IVTHFQRKRR | | KLRSGFEMLKI | |
| INWTRDAMT | | INWTRDAMT | | IVTREPCVSC | | KLSGGYKDIIL | |
| INWTRDSII | | INWTRDSII | | IVTREPYISC | | KLSGGYKDVIL | |
| INWTRDSIT | | INWTRDSIT | | IVTREPYVSC | | KLSIEDPDHEG | |
| INWTRDSLT | | INWTRDSLT | | IVTTVGWSWP | | KLSIEDPNHEG | |
| INWTRDSMT | | INWTRDSMT | | IVVFCGASGT | | KLSIEDPSHEG | |
| INWTRDSVT | | INWTRDSVT | | IVVFCGTPGT | | KLSIEEPSHEG | |
| INYYNETFV | | INYYNETFV | | IVVFCGTSAT | | KLSIENPSHEG | |
| IPAQNAIST | | IPAQNAIST | | IVVFCGTSGT | | KLSNMGIYQIL | |
| IPCFWVEMI | | IPCFWVEMI | | IVVFCGTSRT | | KLSNMGVYQIL | |
| IPEAGLKWE | | IPEAGLKWE | | IVVMTDGSAS | | KLSSGYKDIIL | |
| IPERNEHGQ | | IPERNEHGQ | | IVVTREPYVS | | KLSSGYKDVIL | |
| IPERNEQGQ | | IPERNEQGQ | | IVWACQRGNI | | KLSSMGIYQIL | |
| IPESMREEY | | IPESMREEY | | IVWGIHHPSS | | KLSSMGVYQIL | |
| IPEVCLKWD | | IPEVCLKWD | | IVWGVHHSSS | | KLTIIYSSSMM | |
| IPEVCLKWE | | IPEVCLKWE | | IWAIHHPPTS | | KLTITYSSPMM | |
| IPFHLGTKQ | | IPFHLGTKQ | | IWASGSSISF | | KLTITYSSSLM | |
| IPGKQAKGL | | IPGKQAKGL | | IWAYNAELIV | | KLTITYSSSMM | |
| IPHRTLLMN | | IPHRTLLMN | | IWAYNAELLV | | KLTQGRQTFDW | |
| IPHRTLLMS | | IPHRTLLMS | | IWDANGWVST | | KLTQGRQTYDW | |

Fig. 83-174

| Block size 8 | SIN | Block size 9 | SIN | Block size 10 | SIN | Block size 11 | SIN |
|---|---|---|---|---|---|---|---|
| IPIGERGLF | | IPIGERGLF | | IWDTLIERDN | | KLTQGYKDIIL | |
| IPKRNRSIL | | IPKRNRSIL | | IWFSHYNQIT | | KLVDGQDCDLI | |
| IPLHDAIKC | | IPLHDAIKC | | IWFSHYNQMK | | KLVGINMSKKK | |
| IPLTTTPTK | | IPLTTTPTK | | IWFSHYNQMT | | KLVGINMSKRK | |
| IPLYDAIKC | | IPLYDAIKC | | IWFSHYNQVT | | KLVLATGLRNA | |
| IPLYDAVKC | | IPLYDAVKC | | IWGIHHPNDD | | KLVLATGLRNV | |
| IPLYDAVRC | | IPLYDAVRC | | IWGIHHPNDE | | KLVLATGPRNV | |
| IPMISKCKT | | IPMISKCKT | | IWGVHHPIDE | | KLYEKVRRQLR | |
| IPMISKCRT | | IPMISKCRT | | IWGVHHPKDE | | KLYERVKKQLR | |
| IPMISKSRT | | IPMISKSRT | | IWGVHHPNDE | | KLYERVKRQLR | |
| IPNAETDPN | | IPNAETDPN | | IWGVHHPSTD | | KLYERVRKQLR | |
| IPNAETDPS | | IPNAETDPS | | IWHSNLNDAT | | KLYERVRRQLR | |
| IPNAGIDPN | | IPNAGIDPN | | IWHSNLNDTT | | KLYGAGNKLIT | |
| IPNAGTDPN | | IPNAGTDPN | | IWITREPYVS | | KLYGTGNKLIT | |
| IPNDKPFQN | | IPNDKPFQN | | IWLWLVLREK | | KLYKKLKREIT | |
| IPNEKPFQN | | IPNEKPFQN | | IWMACHSAAF | | KLYKKLKREMT | |
| IPNGKPFQN | | IPNGKPFQN | | IWMCSNGSLQ | | KLYKNTNTLSS | |
| IPNNKPFQN | | IPNNKPFQN | | IWSYNAELLV | | KLYRKLKREIT | |
| IPPLELGDC | | IPPLELGDC | | IWSYNAKLLV | | KLYTRVKRQLR | |
| IPPLELGNC | | IPPLELGNC | | IWSYNAQLLV | | KLYVNKNPYTL | |
| IPPLELRDC | | IPPLELRDC | | IWSYNARLLV | | KLYWHLMHPGE | |
| IPPLVLGDC | | IPPLVLGDC | | IWTSASSISF | | KLYWHLMRPGE | |
| IPQIESRGL | | IPQIESRGL | | IWTSGSIISF | | KLYWHLMSPGE | |
| IPSDTPRGE | | IPSDTPRGE | | IWTSGSSIAF | | KMARLGKGYMF | |
| IPSGPLKAE | | IPSGPLKAE | | IWTSGSSISF | | KMARLGRGYMF | |
| IPSGSLKLA | | IPSGSLKLA | | IWTSSSSIVM | | KMEAILVVLLY | |
| IPSIQSRGL | | IPSIQSRGL | | IWTSSSSTVF | | KMEDGFLDVWT | |
| IPSNSLKLA | | IPSNSLKLA | | IWTSSSSVVM | | KMEFEPFQSLI | |
| IPSRSLKLA | | IPSRSLKLA | | IWTYNAELLI | | KMEFEPFQSLV | |
| IPSVQSRGL | | IPSVQSRGL | | IWTYNAELLV | | KMEKIVLLLAI | |
| IPSWAGNIL | | IPSWAGNIL | | IWTYQAELLV | | KMEKIVLLLAT | |
| IPSWAGNVL | | IPSWAGNVL | | IWTYQEELLV | | KMESRGLFGAI | |
| IPSWEGNIL | | IPSWEGNIL | | IWVTRELYVS | | KMFDFIKWNVT | |
| IPTDTPRGE | | IPTDTPRGE | | IWVTREPYVS | | KMFDFSKWNVT | |
| IPTDTPRIQ | | IPTDTPRIQ | | IYATVAGSLS | | KMFDFTKWNVT | |
| IPTDTPRVQ | | IPTDTPRVQ | | IYCICRDNWK | | KMKAIIVVLLY | |
| IPTDVVRSW | | IPTDVVRSW | | IYCVCRDNWK | | KMKAILVVLLY | |
| IPVQNAIST | | IPVQNAIST | | IYGKDNAIRI | | KMKWGMELRRC | |
| IPVTQTMEL | | IPVTQTMEL | | IYGKDNAVRI | | KMKWGMEMRRC | |
| IPVTQVEEL | | IPVTQVEEL | | IYGNPKCDIH | | KMNGNYDSIRG | |
| IQAGVDRFY | | IQAGVDRFY | | IYGNPKCDTH | | KMNIQFEAVGR | |
| IQAGVNRFY | | IQAGVNRFY | | IYGNPKCDVH | | KMNIQILILAL | |
| IQALQLLLE | | IQALQLLLE | | IYIEVLHLTQ | | KMNNQILILAL | |
| IQDIWAYNA | | IQDIWAYNA | | IYKILSIYSC | | KMNPNKKIITI | |
| IQDLEKYVE | | IQDLEKYVE | | IYKILSIYST | | KMNPNQKIIII | |
| IQDLERYVE | | IQDLERYVE | | IYKILTIYST | | KMNPNQKIITI | |
| IQDLWAYNA | | IQDLWAYNA | | IYQILAIYAT | | KMNPNQKIMTI | |
| IQDVWAYNA | | IQDVWAYNA | | IYQILAIYST | | KMNREFEVMNH | |
| IQFEAVGRE | | IQFEAVGRE | | IYQILSIYST | | KMNREFEVVDH | |
| IQFPIGTAP | | IQFPIGTAP | | IYRDEAINNR | | KMNREFEVVNH | |
| IQFPMGTAP | | IQFPMGTAP | | IYSCIASSIV | | KMNREFGVVNH | |
| IQFTAVGKE | | IQFTAVGKE | | IYSCIASSLI | | KMNTKILVLAL | |
| IQFTSVGKE | | IQFTSVGKE | | IYSCIASSLV | | KMNTQFEAIGR | |
| IQGNNDNAT | | IQGNNDNAT | | IYSCIASSTV | | KMNTQFEAVGK | |
| IQGVKLAQG | | IQGVKLAQG | | IYSCIASSVV | | KMNTQFEAVGR | |
| IQGVKLIQG | | IQGVKLIQG | | IYSGIRTNGA | | KMNTQFETVGK | |
| IQGVKLTQG | | IQGVKLTQG | | IYSSSMMWEI | | KMNTQILIFAL | |
| IQGVRLTQG | | IQGVRLTQG | | IYSSVASSLV | | KMNTQILIFTL | |
| IQGYKDIIL | | IQGYKDIIL | | IYSTAASSLV | | KMNTQILILAL | |
| IQHLEECSC | | IQHLEECSC | | IYSTISSSLV | | KMNTQILVFAL | |
| IQHPELTGL | | IQHPELTGL | | IYSTVAASLC | | KMNTRILILTL | |
| IQIDAVKLS | | IQIDAVKLS | | IYSTVASSLV | | KMPASRYLTDM | |

Fig. 83-175

| Block size 8 | SIN | Block size 9 | SIN | Block size 10 | SIN | Block size 11 | SIN |
|---|---|---|---|---|---|---|---|
| IQIDPVKLS | | IQIDPVKLS | | IYSTVASSSV | | KMQFSSLTVNV | |
| IQIDQVKLS | | IQIDQVKLS | | IYSTVSSSLV | | KMSLLTEVETY | |
| IQIDSVKLS | | IQIDSVKLS | | IYWHLMHPGE | | KMTIASDILKR | |
| IQIIKLLPF | | IQIIKLLPF | | IYWTIVKPGD | | KMTIASDILTR | |
| IQINPVKLS | | IQINPVKLS | | IYWTLVNPGD | | KMTITFLILLF | |
| IQMCTELKL | | IQMCTELKL | | IYWTVVKPGD | | KMVLSAFDERR | |
| IQMCTELQL | | IQMCTELQL | | IYWWDGLQSS | | KMYALHQGTTI | |
| IQNALNGNG | | IQNALNGNG | | KAAIGLRISS | | KNADLEALMEW | |
| IQNEDIPIE | | IQNEDIPIE | | KAALGLRISS | | KNALGDCPKYI | |
| IQNEDIPIG | | IQNEDIPIG | | KAAMGLKISS | | KNALGECPKYI | |
| IQNEFNKAC | | IQNEFNKAC | | KAAMGLRISS | | KNALYGTQSLS | |
| IQNIWAYNA | | IQNIWAYNA | | KAAMGMRISS | | KNANTLSSVNT | |
| IQNRGLFGA | | IQNRGLFGA | | KAATQTLVSN | | KNANTLSSVTT | |
| IQPGDNITF | | IQPGDNITF | | KACELTDSIW | | KNANTLTSVTT | |
| IQPTFSVQR | | IQPTFSVQR | | KACELTDSSW | | KNATATVYYDR | |
| IQQTRVDKL | | IQQTRVDKL | | KACELTDSTW | | KNCINRCFYVE | |
| IQSDAQIDE | | IQSDAQIDE | | KACELTDSVW | | KNCTLIDALLG | |
| IQSDKPFQN | | IQSDKPFQN | | KACELTGSSW | | KNDLYGAQSLS | |
| IQSEFNKAC | | IQSEFNKAC | | KACNALTGGQ | | KNDLYGTQPLS | |
| IQSKGLFGA | | IQSKGLFGA | | KACNASTGAQ | | KNDLYGTQSLS | |
| IQSRGLFGA | | IQSRGLFGA | | KACNASTGGQ | | KNELYGTQSLS | |
| IQTKRSFEL | | IQTKRSFEL | | KACSASTGGQ | | KNGNHAVHYCI | |
| IQTLVSNND | | IQTLVSNND | | KADEICIGYL | | KNGNLRCTICI | |
| IQTNGNLIA | | IQTNGNLIA | | KADKICIGYL | | KNGNMQCTICI | |
| IQTRGLFGA | | IQTRGLFGA | | KADLIIERRN | | KNGNMRCTICI | |
| IQTRRAFEL | | IQTRRAFEL | | KADTILERNV | | KNGNMRGTNWI | |
| IQTRRSFEI | | IQTRRSFEI | | KAEIAQKLED | | KNGTYDHKDYE | |
| IQTRRSFEL | | IQTRRSFEL | | KAEIAQRLED | | KNGTYDHKEYE | |
| IQTSGNLIA | | IQTSGNLIA | | KAEIAQRLEG | | KNGTYDYPKYE | |
| IRAFSFQLI | | IRAFSFQLI | | KAEIAQRLEN | | KNGTYDYPKYS | |
| IRALTLNTM | | IRALTLNTM | | KAEIAQRLES | | KNGTYDYSKYE | |
| IRASVGKMI | | IRASVGKMI | | KAGFIEGGWP | | KNGTYNHKDYE | |
| IRASVGRMI | | IRASVGRMI | | KAGFIENGWE | | KNGTYNHKEYE | |
| IRASVGRMV | | IRASVGRMV | | KAGVKMNPNQ | | KNGTYNRKEYE | |
| IRCVCRDNW | | IRCVCRDNW | | KAHNGKLCRL | | KNGTYNYPKYS | |
| IREGLILEY | | IREGLILEY | | KAIDEITTKI | | KNGTYYYPKYE | |
| IREKNVTVT | | IREKNVTVT | | KAIDIMQNKL | | KNILRTQESEC | |
| IREPFISCS | | IREPFISCS | | KAIDNMQNKL | | KNITVTHAQDI | |
| IREPFVACG | | IREPFVACG | | KAIDNMQNRL | | KNITVTHSVEL | |
| IREPFVACS | | IREPFVACS | | KAIDQITTKI | | KNITVTHSVNL | |
| IREPFVSCG | | IREPFVSCG | | KAIDRITTKI | | KNLFDEVKRRL | |
| IREPFVSCS | | IREPFVSCS | | KAINEITTKI | | KNLFDEVRRRL | |
| IRESGGIDK | | IRESGGIDK | | KAIWTSGSSI | | KNLYDKVRLQL | |
| IREWSYLIE | | IREWSYLIE | | KAKLANVVRK | | KNLYDKVRMQL | |
| IRFGEGEQI | | IRFGEGEQI | | KALNEITTKI | | KNLYDRVRLQL | |
| IRFGESEQI | | IRFGESEQI | | KALSIYSCIA | | KNLYEKVRLQL | |
| IRFGESEQV | | IRFGESEQV | | KAMEQMAGSS | | KNLYEKVRMQL | |
| IRFNSDLDY | | IRFNSDLDY | | KAMEQVAGSS | | KNLYNKVRMQL | |
| IRFNSDLNY | | IRFNSDLNY | | KAMMDQVRES | | KNNAIDEGDGC | |
| IRFNSNLDY | | IRFNSNLDY | | KANQVFPQLN | | KNNAKDEGNGC | |
| IRFPIGTAP | | IRFPIGTAP | | KANVLIGQGD | | KNNMINNDLGP | |
| IRFPIGVAP | | IRFPIGVAP | | KAPISLGDCS | | KNNQVILCEPT | |
| IRFPVGTAP | | IRFPVGTAP | | KAPQLNPIDG | | KNNQVILCEQT | |
| IRFVNSDCS | | IRFVNSDCS | | KAQHIEECSC | | KNNQVILCGPT | |
| IRGEFNQVE | | IRGEFNQVE | | KASKEPEVHE | | KNNWSGYSGIF | |
| IRGEFSQVE | | IRGEFSQVE | | KASLRLAVGL | | KNPALRMKWMM | |
| IRGETTGRN | | IRGETTGRN | | KASTQKAIDE | | KNPAYCNTDLG | |
| IRGFVHFVE | | IRGFVHFVE | | KASTQKAINE | | KNPSLRMKWMM | |
| IRGFVYFVE | | IRGFVYFVE | | KATCVCRDNW | | KNPYTLVSTKE | |
| IRGIFGAIA | | IRGIFGAIA | | KATKMEAILV | | KNQEELRSLFS | |
| IRGKHSNGT | | IRGKHSNGT | | KATKMKAIIV | | KNRSPYRALMS | |
| IRGNSPIFN | | IRGNSPIFN | | KATKMKAILV | | KNSDLEALMEW | |

Fig. 83-176

| Block size 8 | SIN | Block size 9 | SIN | Block size 10 | SIN | Block size 11 | SIN |
|---|---|---|---|---|---|---|---|
| IRGNSPVFN | | IRGNSPVFN | | KATNGNYGPI | | KNSFYAELKWL | |
| IRGQPKEKA | | IRGQPKEKA | | KAVDLGSCGI | | KNSNGVQDIID | |
| IRGQPKEKT | | IRGQPKEKT | | KAVKLYKKLK | | KNSRSGYETFR | |
| IRGQPKERT | | IRGQPKERT | | KAVKLYRKLK | | KNSWSYIVEKP | |
| IRGQQGRMD | | IRGQQGRMD | | KAVRGDLNFV | | KNTDLEALMEW | |
| IRGRHSNGT | | IRGRHSNGT | | KAWLHICVTG | | KNTDLEVLMEW | |
| IRGRPEEAK | | IRGRPEEAK | | KAWLHVCITG | | KNTNTLSSVTT | |
| IRGRPEEVK | | IRGRPEEVK | | KAWLHVCVTG | | KNTYVNNTTII | |
| IRGRPKEDK | | IRGRPKEDK | | KCCNLFEKFF | | KNVAVTHSVNL | |
| IRGRPKEDR | | IRGRPKEDR | | KCCSLFEKFF | | KNVILWFSFGA | |
| IRGRPKEEK | | IRGRPKEEK | | KCCTLFEKFF | | KNVPEKIHTRG | |
| IRGWAPLSK | | IRGWAPLSK | | KCDDDCMASI | | KNVPEKIRTRG | |
| IRHENRMVI | | IRHENRMVI | | KCDDHCMESI | | KNVPEKIRVKR | |
| IRHENRMVL | | IRHENRMVL | | KCDDQCMESI | | KNVTVTHAKDI | |
| IRHLEECSC | | IRHLEECSC | | KCDLYLNGRE | | KNVTVTHAQDI | |
| IRIAWSSSS | | IRIAWSSSS | | KCDLYLSGRE | | KNVTVTHAQNI | |
| IRIGSKGDI | | IRIGSKGDI | | KCDNECMETI | | KNVTVTHSIEL | |
| IRIGSKGDV | | IRIGSKGDV | | KCDNKCMETI | | KNVTVTHSINL | |
| IRIGSKGHV | | IRIGSKGHV | | KCDNQCMESI | | KNVTVTHSVDL | |
| IRIGSRGDV | | IRIGSRGDV | | KCDPYLNGRE | | KNVTVTHSVEL | |
| IRIGSRGEV | | IRIGSRGEV | | KCFNPCFYVE | | KNVTVTHSVNI | |
| IRIGSRGHI | | IRIGSRGHI | | KCFWKGGSIK | | KNVTVTHSVNL | |
| IRIGSRGHV | | IRIGSRGHV | | KCFWKGGSIN | | KNWILWISFAI | |
| IRINMINSK | | IRINMINSK | | KCFWKGGTIN | | KNWSGYSGAFT | |
| IRINNETIL | | IRINNETIL | | KCFWRGGSII | | KNWSGYSGSFI | |
| IRKGLILEY | | IRKGLILEY | | KCFWRGGSIN | | KNWSGYSGSFT | |
| IRLAAGGDI | | IRLAAGGDI | | KCICRDNWKG | | KPCFWVELIRG | |
| IRLFDYSGW | | IRLFDYSGW | | KCICRDNWRG | | KPFQNICKPYI | |
| IRLFDYSKW | | IRLFDYSKW | | KCIERVRNGT | | KPFQNTSKHYI | |
| IRLFDYSRW | | IRLFDYSRW | | KCIESIRNGT | | KPFQNTSRHYI | |
| IRLSADGDI | | IRLSADGDI | | KCITPNGSIP | | KPFQNVNKITY | |
| IRLSAGGAI | | IRLSAGGAI | | KCKTKEGRRK | | KPFQNVNKVTY | |
| IRLSAGGDI | | IRLSAGGDI | | KCMESVRNGT | | KPFQNVNRITY | |
| IRLSAGGHI | | IRLSAGGHI | | KCMETIKNGT | | KPFQNVSRIAI | |
| IRLSAGGNI | | IRLSAGGNI | | KCNDPYPGNN | | KPGETLKVESN | |
| IRLSASGDI | | IRLSASGDI | | KCNDSCMDTI | | KPGETLNIESN | |
| IRLSASGDV | | IRLSASGDV | | KCNDSCMEAI | | KPGETLNVESN | |
| IRMAINWGR | | IRMAINWGR | | KCNDSCMETI | | KPGQTVKIKTN | |
| IRMATNECR | | IRMATNECR | | KCNEPYPGNN | | KPGQTVKIQTN | |
| IRMIKRGIN | | IRMIKRGIN | | KCNNECMETI | | KPGQTVKIQTS | |
| IRMIKRGVN | | IRMIKRGVN | | KCNNSCMETI | | KPKFLPDLYDY | |
| IRMVKRGIN | | IRMVKRGIN | | KCNNTCMETI | | KPKSLPDLYDY | |
| IRNETYDHD | | IRNETYDHD | | KCNTKCQTSL | | KPKYLPDLYDY | |
| IRNGTYDHD | | IRNGTYDHD | | KCNTKCQTSM | | KPLCAVNSWHI | |
| IRNGTYDHK | | IRNGTYDHK | | KCNTKCQTSV | | KPLCEVNSWHI | |
| IRNGTYDHN | | IRNGTYDHN | | KCPKYIPSGS | | KPLCEVSSWHI | |
| IRNGTYDHT | | IRNGTYDHT | | KCPKYIPSNS | | KPLILKDCSVA | |
| IRNGTYNHA | | IRNGTYNHA | | KCPKYIPSRS | | KPLILRDCSVA | |
| IRNGTYNHD | | IRNGTYNHD | | KCPKYISSGS | | KPLQNTSKHYI | |
| IRNGTYNHE | | IRNGTYNHE | | KCPRYIPSGS | | KPNIGPRPFVR | |
| IRNGTYNHI | | IRNGTYNHI | | KCPRYVKQSS | | KPNIGPRPLVM | |
| IRNGTYNHK | | IRNGTYNHK | | KCQLNEGVMN | | KPNIGPRPLVR | |
| IRNGTYNHN | | IRNGTYNHN | | KCQSPLGAIN | | KPQCEITGFAP | |
| IRNGTYNHQ | | IRNGTYNHQ | | KCQTPLGAIN | | KPQCHITGFAP | |
| IRNGTYNHR | | IRNGTYNHR | | KCQTPLGALN | | KPQCKITGFAP | |
| IRNGTYNHS | | IRNGTYNHS | | KCQTSVGGID | | KPQCQIAGFAP | |
| IRNGTYNHT | | IRNGTYNHT | | KCQTSVGGIN | | KPQCQITGFAP | |
| IRNKHSNGT | | IRNKHSNGT | | KCQTYAGAIN | | KPQCQVTGFAP | |
| IRNKHSNST | | IRNKHSNST | | KCQTYAGAVN | | KPRFLPDLYDY | |
| IRNLHIPEA | | IRNLHIPEA | | KCQTYTGAIN | | KPRGLFGAIAG | |
| IRNLHIPEV | | IRNLHIPEV | | KCRTKEGRRK | | KPRPRRGLFGA | |
| IRNNMINND | | IRNNMINND | | KCRTKEGRRR | | KPRYLPDLYDY | |

Fig. 83-177

| Block size 8 | SIN | Block size 9 | SIN | Block size 10 | SIN | Block size 11 | SIN |
|---|---|---|---|---|---|---|---|
| IRNNSYDHS | | IRNNSYDHS | | KCRTREGRRK | | KPWARNILRTQ | |
| IRNNTYDHA | | IRNNTYDHA | | KCVCRDNWKG | | KPYIGKCPKYI | |
| IRNNTYDHK | | IRNNTYDHK | | KCYNPCFYVE | | KQAKGLFGAIA | |
| IRNNTYDHN | | IRNNTYDHN | | KCYQFALGQG | | KQDGKSSACKR | |
| IRNNTYDHS | | IRNNTYDHS | | KDAERGKLKR | | KQEFKMNPNKK | |
| IRNNTYDHT | | IRNNTYDHT | | KDCSVAGWLL | | KQEFKMNPNQK | |
| IRNNTYNHT | | IRNNTYNHT | | KDEGNGCFTF | | KQEIEGIKLKT | |
| IRNRHSNGT | | IRNRHSNGT | | KDGDIIFLWG | | KQEIKMNPNQK | |
| IRNSTYDHS | | IRNSTYDHS | | KDIILWFSFG | | KQESLLLATGM | |
| IRPCFWVEL | | IRPCFWVEL | | KDIILWFSFS | | KQESLMLATGM | |
| IRPGYNGQK | | IRPGYNGQK | | KDIILWISFS | | KQFELIDNEFT | |
| IRRIWRQAN | | IRRIWRQAN | | KDIILWVSFS | | KQGKTKATKME | |
| IRRRVDINP | | IRRRVDINP | | KDILEKAHNG | | KQGKTKATKMK | |
| IRRRVDMNP | | IRRRVDMNP | | KDILEKTHNG | | KQGNSVWAGRT | |
| IRRRVDTNP | | IRRRVDTNP | | KDILRTQESE | | KQGSLKLATGM | |
| IRRRVDVNP | | IRRRVDVNP | | KDKTPYRSLI | | KQGSLMLATGM | |
| IRRVWRQAN | | IRRVWRQAN | | KDLDNCHPIG | | KQGSLRLATGM | |
| IRSFSRTEL | | IRSFSRTEL | | KDLGNCHPIG | | KQIGNVINWTR | |
| IRSNGNLIA | | IRSNGNLIA | | KDLGNCHPVG | | KQILRTQESSC | |
| IRSNGNLVA | | IRSNGNLVA | | KDLGNGCFEF | | KQKSLLLATGM | |
| IRSSVGKMI | | IRSSVGKMI | | KDLGSCHPIG | | KQKTLKLATGM | |
| IRSWRKQIL | | IRSWRKQIL | | KDLRSGYETF | | KQLGNVINWTR | |
| IRTATREGK | | IRTATREGK | | KDNAIDEGDG | | KQLRENAEDLG | |
| IRTDGATSA | | IRTDGATSA | | KDNAIRFGEG | | KQLRENAEDMG | |
| IRTFSFQFI | | IRTFSFQFI | | KDNAIRFGES | | KQLRENAEEDG | |
| IRTFSFQLI | | IRTFSFQLI | | KDNAIRIGED | | KQLRENAEEMG | |
| IRTGTYNHR | | IRTGTYNHR | | KDNAIRIGEE | | KQLRQNAEEDG | |
| IRTKSGGNT | | IRTKSGGNT | | KDNAIRIGEG | | KQLTHHMRKKR | |
| IRTLTLNTM | | IRTLTLNTM | | KDNAIRIGEN | | KQMTRGLFGAI | |
| IRTNGNLIA | | IRTNGNLIA | | KDNAIRLGEN | | KQNGKSGACKR | |
| IRTNGTSKI | | IRTNGTSKI | | KDNAIRLGET | | KQNGKSSACKR | |
| IRTRGLFGA | | IRTRGLFGA | | KDNAIRPGEN | | KQNTLKLATGM | |
| IRTRSGGNT | | IRTRSGGNT | | KDNAKDEGNG | | KQPISLGDCSF | |
| IRTSVGRMV | | IRTSVGRMV | | KDNAKDLGNG | | KQSSLPLALGM | |
| IRTWAKNIL | | IRTWAKNIL | | KDNAKELGNG | | KQSTLKLATGM | |
| IRVGCVILL | | IRVGCVILL | | KDNALRLAEN | | KQTKTMTITFL | |
| IRVGSRGHV | | IRVGSRGHV | | KDNANDLGNG | | KQTRGIFGAIA | |
| IRVKRRPVA | | IRVKRRPVA | | KDNARELGNG | | KQTRGLFGAIA | |
| IRWETTGRN | | IRWETTGRN | | KDNAVRFGES | | KQTSLLLATGM | |
| IRWLTLKSG | | IRWLTLKSG | | KDNAVRIGED | | KQVCAAWSSSS | |
| ISATGMALS | | ISATGMALS | | KDNAVRIGEK | | KQVCIAWSSSS | |
| ISATGMILS | | ISATGMILS | | KDNAVRIGEN | | KQVCMAWSSSS | |
| ISATGMTLS | | ISATGMTLS | | KDNAVRLGEN | | KQVCVAWSSSS | |
| ISATGVTLS | | ISATGVTLS | | KDNGIRIGSK | | KRCINRCFYVE | |
| ISCFLLAAL | | ISCFLLAAL | | KDNGIRIGSR | | KRDSSILTDSQ | |
| ISCFLLIAL | | ISCFLLIAL | | KDNGIRVGSR | | KREITFHGAKE | |
| ISCFLLVAL | | ISCFLLVAL | | KDNGVRIGSK | | KREITFYGAKE | |
| ISCLYKLSQ | | ISCLYKLSQ | | KDNLEPGTFD | | KREMTFHGAKE | |
| ISCSHFECR | | ISCSHFECR | | KDNNIRIGSK | | KRFADQELGDA | |
| ISCSHLECK | | ISCSHLECK | | KDNPIRLSGG | | KRGETLKIRTN | |
| ISCSHLECR | | ISCSHLECR | | KDNQVFPQLN | | KRGGSGIMKTE | |
| ISCSHMECR | | ISCSHMECR | | KDNSIQLSAG | | KRGINDRNFWR | |
| ISCSHSECR | | ISCSHSECR | | KDNSIRIGSK | | KRGLFGAIAGF | |
| ISCSIDECR | | ISCSIDECR | | KDNSIRIGSR | | KRGSSGIMKTE | |
| ISCSIHECR | | ISCSIHECR | | KDNSIRLAAG | | KRGSSGIMKTG | |
| ISCSINECR | | ISCSINECR | | KDNSIRLSAD | | KRGSSGVMKTE | |
| ISCSISECR | | ISCSISECR | | KDNSIRLSAG | | KRGVNDRNFWR | |
| ISCSPLECR | | ISCSPLECR | | KDNSIRLSAS | | KRIENLNKKME | |
| ISCSQLECR | | ISCSQLECR | | KDNSVRIGSK | | KRIGSCTSPCL | |
| ISCSVSECR | | ISCSVSECR | | KDNSVRLSAG | | KRINMIADRVD | |
| ISDGGPNLY | | ISDGGPNLY | | KDNSVRLSAS | | KRINMLADRID | |
| ISDKIDDQI | | ISDKIDDQI | | KDPKKTGGPI | | KRINMLADRVD | |

Fig. 83-178

| Block size 8 | SIN | Block size 9 | SIN | Block size 10 | SIN | Block size 11 | SIN |
|---|---|---|---|---|---|---|---|
| ISECRTFFL | | ISECRTFFL | | KDQAWSYIVE | | KRINMLADWVD | |
| ISFAISCFL | | ISFAISCFL | | KDQDWSYIVE | | KRIRLFDYSGW | |
| ISFAMSCFL | | ISFAMSCFL | | KDQGWSYIVE | | KRIRLFDYSKW | |
| ISFATSCFL | | ISFATSCFL | | KDQSWSYIVE | | KRIRLFDYSRW | |
| ISFESNGGL | | ISFESNGGL | | KDRAPYRSLI | | KRIRMAINWGR | |
| ISFESNGNF | | ISFESNGNF | | KDRSPFRALM | | KRIRMATNECR | |
| ISFESTGNL | | ISFESTGNL | | KDRSPFRTLM | | KRKKRGLFGAI | |
| ISFQGGHIE | | ISFQGGHIE | | KDRSPHRALM | | KRKRDSSILTD | |
| ISFQSGHIE | | ISFQSGHIE | | KDRSPHRTLM | | KRKRGLFGAIA | |
| ISFSISCFL | | ISFSISCFL | | KDRSPQRTLM | | KRKRKTRGLFG | |
| ISFSMSCFV | | ISFSMSCFV | | KDRSPYRALM | | KRKRNSSILTD | |
| ISFTITGDN | | ISFTITGDN | | KDRSPYRTLM | | KRKTRGLFGAI | |
| ISFWMCSGH | | ISFWMCSGH | | KDRTPYRSLI | | KRLAVLGKDAG | |
| ISFWMCSNG | | ISFWMCSNG | | KDRTSYRSLI | | KRLCTINSWHI | |
| ISFYWTIVD | | ISFYWTIVD | | KDSITDIWTY | | KRLGSWSWHDG | |
| ISFYWTIVE | | ISFYWTIVE | | KDSNGVQDII | | KRLLRENAEED | |
| ISFYWTIVV | | ISFYWTIVV | | KDSRSGYETF | | KRLTIIGKDAG | |
| ISGADDDAY | | ISGADDDAY | | KDVIIWFSFG | | KRLTILGKDAG | |
| ISGPDDGAV | | ISGPDDGAV | | KDVILWFSFG | | KRLTTTIKTWA | |
| ISGPDNEAV | | ISGPDNEAV | | KDVILWFSLG | | KRLTVLGKDAG | |
| ISGPDNGAV | | ISGPDNGAV | | KDWILWISFA | | KRMTRGLFGAI | |
| ISGPDSGAV | | ISGPDSGAV | | KDWVLWISFA | | KRNEIKGVELS | |
| ISGPNNNAS | | ISGPNNNAS | | KDYEEEAKLE | | KRNEIKGVKLS | |
| ISGTCAVVM | | ISGTCAVVM | | KDYRYTYRCH | | KRNITEIVYLN | |
| ISGVKLEEN | | ISGVKLEEN | | KEAMQNRIQI | | KRNRSILNTSQ | |
| ISGWTTANS | | ISGWTTANS | | KEAQDVIMEV | | KRNSSILTDSQ | |
| ISHCRATEY | | ISHCRATEY | | KECFNPCFYV | | KRQEIDGIKLK | |
| ISHISPLSG | | ISHISPLSG | | KEDEVWWTSN | | KRQEIEGIKLE | |
| ISHRTLLMN | | ISHRTLLMN | | KEDKRYGPAL | | KRQEIEGIKLK | |
| ISIASRSGY | | ISIASRSGY | | KEDKVWWTSN | | KRQEIEGIRLK | |
| ISIGSSTYQ | | ISIGSSTYQ | | KEDRRYGPAL | | KRQEINGIKLK | |
| ISIGTSTLN | | ISIGTSTLN | | KEDRVWWTSN | | KRQLRENAEDK | |
| ISIVPNIGS | | ISIVPNIGS | | KEEALKGSAR | | KRQLRENAEED | |
| ISIWMCSNG | | ISIWMCSNG | | KEEALQGSAR | | KRQLRENAEKD | |
| ISIYWTLVN | | ISIYWTLVN | | KEECYRACFY | | KRRAIATPGMQ | |
| ISKCKTKEG | | ISKCKTKEG | | KEEKVWWTSN | | KRRKKRGLFGA | |
| ISKCRTKEG | | ISKCRTKEG | | KEEPLKGSAK | | KRRPVAKAGFI | |
| ISKCRTREG | | ISKCRTREG | | KEESQLKRQE | | KRSHEQMETGG | |
| ISKDLRSGY | | ISKDLRSGY | | KEETLKGSAR | | KRSYEQMETDG | |
| ISKDNGIRI | | ISKDNGIRI | | KEEVINATET | | KRSYEQMETGE | |
| ISKDSRSGY | | ISKDSRSGY | | KEEVLKGSAR | | KRSYEQMETGG | |
| ISKDTRSGY | | ISKDTRSGY | | KEEVTNATET | | KRSYEQMETSG | |
| ISKMGVDEY | | ISKMGVDEY | | KEFEQVEGRI | | KRSYNNTSGEQ | |
| ISKRGGSGI | | ISKRGGSGI | | KEFEQVEGRT | | KRTVSSFYSEM | |
| ISKRGNSGI | | ISKRGNSGI | | KEFGNLERRL | | KRVRLFDYSRW | |
| ISKRGSSGI | | ISKRGSSGI | | KEFGQVEGRI | | KRYELEIGARI | |
| ISKRGSSGV | | ISKRGSSGV | | KEFNNLEKRL | | KRYELEIGTRI | |
| ISKSRATEY | | ISKSRATEY | | KEFNNLERRL | | KRYERVKMFDF | |
| ISKSTKSTV | | ISKSTKSTV | | KEFSEIEGRI | | KRYGPALSINE | |
| ISKTNQQFE | | ISKTNQQFE | | KEFSEVEGRI | | KRYGPALSISE | |
| ISLCSIWFS | | ISLCSIWFS | | KEFSNLEKRL | | KSCINRCFYVE | |
| ISLGDCSFA | | ISLGDCSFA | | KEFSNLERRL | | KSCLPACAYGP | |
| ISLGDCSFT | | ISLGDCSFT | | KEFTEVEGRI | | KSCLPACIYGL | |
| ISLVKTTLF | | ISLVKTTLF | | KEGRRKTNLY | | KSCLPACVYGL | |
| ISLWMCSNG | | ISLWMCSNG | | KEGRRRTNLY | | KSCLPACVYGP | |
| ISMCSSTEF | | ISMCSSTEF | | KEGSYFFGDN | | KSCVNRCFYVE | |
| ISMDSRSGY | | ISMDSRSGY | | KEGYSLVGID | | KSDKICIGYHA | |
| ISMEDYSID | | ISMEDYSID | | KEGYSLVGVD | | KSDKICLGHHA | |
| ISMEDYSIG | | ISMEDYSIG | | KEIEGICYPG | | KSDKRIGSCTS | |
| ISNDKPFQN | | ISNDKPFQN | | KEIGNGCFEF | | KSDQLKLATGL | |
| ISNEGSYFF | | ISNEGSYFF | | KEKAIWTSGS | | KSDRICIGYHA | |
| ISNETILET | | ISNETILET | | KEKDLTKEFF | | KSDVLVTREPY | |

Fig. 83-179

| Block size 8 | SIN | Block size 9 | SIN | Block size 10 | SIN | Block size 11 | SIN |
|---|---|---|---|---|---|---|---|
| ISNKVNSVI | | ISNKVNSVI | | KEKDMTKEFF | | KSEDNVYKVLS | |
| ISNLPFQNI | | ISNLPFQNI | | KEKDMTREFF | | KSEQFPVQTDE | |
| ISNQGSFYR | | ISNQGSFYR | | KEKEICSVVL | | KSFSRTELIAP | |
| ISNRFQIQG | | ISNRFQIQG | | KEKENSYPKI | | KSFSRTQLIAP | |
| ISNVGLKVS | | ISNVGLKVS | | KEKENSYPMI | | KSGQFPVQTDE | |
| ISNVGLNVS | | ISNVGLNVS | | KEKNDLYGTQ | | KSGQLKLATGL | |
| ISPIHLGDC | | ISPIHLGDC | | KEKNELYGTQ | | KSHGRILKNDL | |
| ISPKLRSGF | | ISPKLRSGF | | KEKTIWTSGS | | KSHGRILKNNL | |
| ISPLAGSAQ | | ISPLAGSAQ | | KEKVTNATET | | KSHGRVLKNNL | |
| ISPLAVTWW | | ISPLAVTWW | | KELGNGCFEF | | KSILLATGMRN | |
| ISPLMVAYM | | ISPLMVAYM | | KELVETNHTD | | KSITQTLVSND | |
| ISPLSGSAQ | | ISPLSGSAQ | | KEMEGICYPG | | KSITQTLVSNN | |
| ISPRLRSGF | | ISPRLRSGF | | KEMEGVCYPG | | KSITQTLVSNS | |
| ISPRSRNGF | | ISPRSRNGF | | KEMGNGCFEF | | KSKLFTLSGVA | |
| ISPRSRSGF | | ISPRSRSGF | | KENKKYGPAL | | KSLCEVNSWHI | |
| ISPVHLGDC | | ISPVHLGDC | | KENKRYGPAL | | KSLCKIEGWVV | |
| ISRARIDAR | | ISRARIDAR | | KENPAHKSQL | | KSLCKVEEWVV | |
| ISRDSRSGY | | ISRDSRSGY | | KENTGSYVRL | | KSLCKVEGWVV | |
| ISSGSLKLA | | ISSGSLKLA | | KEPALIVWGV | | KSLCNVEGWVV | |
| ISSLPFQNI | | ISSLPFQNI | | KEPDTYDFNE | | KSLCSVEGWVV | |
| ISSMGEAMV | | ISSMGEAMV | | KEPISLGDCS | | KSLESRRGFEM | |
| ISSMMEAMV | | ISSMMEAMV | | KEPMGFRYSG | | KSLESRSGFEM | |
| ISSMVEAMI | | ISSMVEAMI | | KEQGSGYAAD | | KSLFSSIKKYE | |
| ISSMVEAMM | | ISSMVEAMM | | KEQLGSWSWH | | KSLGIQSDAQI | |
| ISSMVEAMV | | ISSMVEAMV | | KEQLSSVSSF | | KSLIWLWLVLR | |
| ISSSFSFGG | | ISSSFSFGG | | KEQLSTVSSF | | KSLKLAIGPRN | |
| ISTASRAGY | | ISTASRAGY | | KEQTALYKNA | | KSLKLASGLRN | |
| ISTASRSGY | | ISTASRSGY | | KEQTTLYKNA | | KSLKLATGLRN | |
| ISTASRYGY | | ISTASRYGY | | KERLGSWSWH | | KSLKLATGPRN | |
| ISTPLGSPP | | ISTPLGSPP | | KERTSIWTSS | | KSLLLATGMRN | |
| ISTPLGTPP | | ISTPLGTPP | | KESKLNRNEI | | KSLMLATGMRN | |
| ISTRSRSGF | | ISTRSRSGF | | KESLRLAIGL | | KSLRGRGSTLG | |
| ISTTFPYTG | | ISTTFPYTG | | KESLRLALGL | | KSLTQTLVSNN | |
| ISTTGMTLS | | ISTTGMTLS | | KESLRLAVGL | | KSLYDKVRMQL | |
| ISVESSTYQ | | ISVESSTYQ | | KESMGFRYSG | | KSNAIDEGDGC | |
| ISVGSGSFP | | ISVGSGSFP | | KESRSGYETF | | KSQLIWMACHS | |
| ISVGSSIYQ | | ISVGSSIYQ | | KESTQKAIDQ | | KSQLVWMACHS | |
| ISVGSSTYQ | | ISVGSSTYQ | | KESTQKAIDR | | KSQLVWMACNS | |
| ISVGTSTLN | | ISVGTSTLN | | KETGNGCFEF | | KSRGYKMNIQI | |
| ISWEMGLAP | | ISWEMGLAP | | KETNGNYGPI | | KSRGYKMNNQI | |
| ISWEMGQAP | | ISWEMGQAP | | KETRVWWTSN | | KSRGYKMNTKI | |
| ISWGMGQAP | | ISWGMGQAP | | KETTVWWTSN | | KSRGYKMNTQI | |
| ISWPLSSPP | | ISWPLSSPP | | KEVGNGCFEF | | KSRGYKMNTRI | |
| ISWPQSSPP | | ISWPQSSPP | | KEVILWFSFG | | KSRINGVKLEE | |
| ITAASLNDD | | ITAASLNDD | | KEWGNGCFEF | | KSRSIIFNMER | |
| ITAQELVES | | ITAQELVES | | KEWMHICMTG | | KSRSNIFNMER | |
| ITCTCRDNW | | ITCTCRDNW | | KEWMHVCITG | | KSRTKEGRRKT | |
| ITCVCRDNW | | ITCVCRDNW | | KEWMHVCMAG | | KSRVDNHSMSD | |
| ITDGPSDAQ | | ITDGPSDAQ | | KEWMHVCMTG | | KSTKSTVLKSD | |
| ITDGPSNAQ | | ITDGPSNAQ | | KEWMHVSMTG | | KSTPSAIDQIT | |
| ITDIWAYNA | | ITDIWAYNA | | KEWSKRYELE | | KSTQAAIDQIN | |
| ITDIWTYQA | | ITDIWTYQA | | KEWSRRYELE | | KSTQAAIDQIT | |
| ITDTFKSWK | | ITDTFKSWK | | KEYEEEAKLE | | KSTQAAVDQIT | |
| ITDTIKSWG | | ITDTIKSWG | | KFAAICTHLE | | KSTQATIDQIT | |
| ITDTIKSWK | | ITDTIKSWK | | KFAAICTHME | | KSTQEAIDKIT | |
| ITDTIKSWR | | ITDTIKSWR | | KFASICTHLE | | KSTQEAIEKIT | |
| ITDTIRSWR | | ITDTIRSWR | | KFCYPGELDN | | KSTQEAIGKIT | |
| ITDTLKSWK | | ITDTLKSWK | | KFEAVAWSAT | | KSTQEAINKIT | |
| ITDWSGYSG | | ITDWSGYSG | | KFESVAWSAS | | KSTQKTIDQVT | |
| ITEINTWAR | | ITEINTWAR | | KFESVAWSAT | | KSTQSAIDQIT | |
| ITEIVYLNH | | ITEIVYLNH | | KFFPSSSYRR | | KSTQSAIDQVT | |
| ITEIVYLNN | | ITEIVYLNN | | KFHQIEKEFS | | KSTQSAINQIT | |

Fig. 83-180

| Block size 8 | SIN | Block size 9 | SIN | Block size 10 | SIN | Block size 11 | SIN |
|---|---|---|---|---|---|---|---|
| ITEIVYLNS | | ITEIVYLNS | | KFHSDTPRPA | | KSTQSAVDQIT | |
| ITEIYNETV | | ITEIYNETV | | KFHSDTPRPD | | KSTQSAVNQIT | |
| ITELPFQNL | | ITELPFQNL | | KFHSDTPRPS | | KSTVLKSDKRI | |
| ITENSFEQI | | ITENSFEQI | | KFHSDTPRPT | | KSVTQTLVSNN | |
| ITEVWSYNA | | ITEVWSYNA | | KFHSDTPRPV | | KSWKGNIMRTQ | |
| ITEWSGYSG | | ITEWSGYSG | | KFKADLIIER | | KSWRKDILRTQ | |
| ITFEATGNL | | ITFEATGNL | | KFLLMDALKL | | KSWRRDILRTQ | |
| ITFESNGGF | | ITFESNGGF | | KFLLMDSLKL | | KSYFANLKGTR | |
| ITFESNGGL | | ITFESNGGL | | KFLNNTEPLC | | KSYINKTGTFE | |
| ITFESSGGL | | ITFESSGGL | | KFLPDLYDYK | | KSYINRTGTFE | |
| ITFHGAKEI | | ITFHGAKEI | | KFQTAAQKAM | | KTAYELTDSSW | |
| ITFHGAKEV | | ITFHGAKEV | | KFQTAAQRAM | | KTDGATSACKR | |
| ITFHRAKEV | | ITFHRAKEV | | KFTNEEALRQ | | KTEDNIYKILS | |
| ITFIQALQL | | ITFIQALQL | | KFYIQMCTEL | | KTEDNVYKILS | |
| ITFLHNGGL | | ITFLHNGGL | | KGANRPIITI | | KTEDNVYKVLA | |
| ITFLQALQL | | ITFLQALQL | | KGANRPVIII | | KTEDNVYKVLS | |
| ITFMQALQL | | ITFMQALQL | | KGANRPVITI | | KTFFLTQGALL | |
| ITFSDNGGL | | ITFSDNGGL | | KGCFDILHKC | | KTFFLTQGSLL | |
| ITFSFNGAF | | ITFSFNGAF | | KGCFDLYHKC | | KTFQNIDKNAL | |
| ITFSHNGGL | | ITFSHNGGL | | KGCFEIYHAC | | KTFQNIDRNAI | |
| ITFSHNGGR | | ITFSHNGGR | | KGCFEIYHKC | | KTFQNIEKNAL | |
| ITGDDKNAT | | ITGDDKNAT | | KGCFEIYHNC | | KTFQNIERNAL | |
| ITGDDRNAT | | ITGDDRNAT | | KGCFEIYHTC | | KTGTFEFTSFF | |
| ITGDNTKWN | | ITGDNTKWN | | KGCFELYHKC | | KTHNGKLCKLN | |
| ITGFAPFSK | | ITGFAPFSK | | KGCFELYHRC | | KTHNGKLCRLR | |
| ITGFASFSK | | ITGFASFSK | | KGCINRCFYV | | KTHNGKLCRLS | |
| ITGIDKVCT | | ITGIDKVCT | | KGDCYRACFY | | KTHNGRLCKLN | |
| ITGINKVCT | | ITGINKVCT | | KGDIFVIREP | | KTIDQVTGKLN | |
| ITGKLNHLI | | ITGKLNHLI | | KGDIFVMREP | | KTIWTSGSSIA | |
| ITGKLNRII | | ITGKLNRII | | KGDKICLGHH | | KTKATKMEAIL | |
| ITGKLNRLI | | ITGKLNRLI | | KGDQICIGYH | | KTKATKMKAII | |
| ITGKSHGRI | | ITGKSHGRI | | KGDRICIGYH | | KTKATKMKAIL | |
| ITGKSHGRV | | ITGKSHGRV | | KGDVFVIREP | | KTKKMTITFLI | |
| ITGPDATAV | | ITGPDATAV | | KGDVFVMREP | | KTKLPFQNLSP | |
| ITGPDSTAV | | ITGPDSTAV | | KGDYNNTTGR | | KTLDEHDANVR | |
| ITGPDTTAV | | ITGPDTTAV | | KGECYRACFY | | KTLDEHDSNVE | |
| ITGSPCAPG | | ITGSPCAPG | | KGEKANVLIG | | KTLDEHDSNVK | |
| ITGSPEAPG | | ITGSPEAPG | | KGEYNNTTGR | | KTLDKHDSNVK | |
| ITGSPGAPG | | ITGSPGAPG | | KGFAFKQGNS | | KTLDLHDANVR | |
| ITGSPGSPG | | ITGSPGSPG | | KGFAFKYGNG | | KTLDLHDSNVR | |
| ITGSPGVPG | | ITGSPGVPG | | KGFAPFSKDN | | KTLDLHDSNVT | |
| ITGSPSAPG | | ITGSPSAPG | | KGFFPFHKDN | | KTLDMHDANVK | |
| ITHFQRKRR | | ITHFQRKRR | | KGFGFRQGDD | | KTLDMHDANVR | |
| ITIDSVSLT | | ITIDSVSLT | | KGFGFRQGND | | KTLKLATGMRN | |
| ITIGECPKY | | ITIGECPKY | | KGFGFRQGNS | | KTLNMHDANVR | |
| ITIGFVSLI | | ITIGFVSLI | | KGFGFRQGTD | | KTLTDNHVEVV | |
| ITIGISGPD | | ITIGISGPD | | KGFGFRQGTS | | KTMTITFLILL | |
| ITIGKCPKY | | ITIGKCPKY | | KGFNSFYRNL | | KTNDKYHQIEK | |
| ITIGKCSKY | | ITIGKCSKY | | KGFSFKYGDG | | KTNEKFHQIEK | |
| ITIGSASLT | | ITIGSASLT | | KGFSFKYGNG | | KTNEKYHQIEK | |
| ITIGSVSLI | | ITIGSVSLI | | KGFSFRYGDG | | KTNGNLIAPEY | |
| ITIGSVSLT | | ITIGSVSLT | | KGFSFRYGNG | | KTNKQFELIDN | |
| ITKIVYLNS | | ITKIVYLNS | | KGFSYKYDNG | | KTNLYGFIIKG | |
| ITLHFKQNE | | ITLHFKQNE | | KGFSYKYGNG | | KTNLYGFIVKG | |
| ITLKFAFNM | | ITLKFAFNM | | KGFSYRYGNG | | KTNQQFELIDN | |
| ITNGTTGNP | | ITNGTTGNP | | KGGPGVKGFG | | KTNQQFEMIDN | |
| ITNKANSII | | ITNKANSII | | KGGSIKTKLP | | KTNQQFKLIDN | |
| ITNKINNIV | | ITNKINNIV | | KGGSINTKLP | | KTNTEFESIES | |
| ITNKINSII | | ITNKINSII | | KGHVFVIREP | | KTNTQFELIDN | |
| ITNKVNNIV | | ITNKVNNIV | | KGIEVVNATE | | KTPYRSLIRFP | |
| ITNKVNSII | | ITNKVNSII | | KGILEDEQMY | | KTQCQITGFAP | |
| ITNKVNSVI | | ITNKVNSVI | | KGILGFVFTL | | KTRFLPVAGGT | |

Fig. 83-181

| Block size 8 | SIN | Block size 9 | SIN | Block size 10 | SIN | Block size 11 | SIN |
|---|---|---|---|---|---|---|---|
| ITNKVNSVV | | ITNKVNSVV | | KGKFQTAAQK | | KTRFLPVSGGT | |
| ITNKVNTVI | | ITNKVNTVI | | KGKFQTAAQR | | KTRFLPVTGGT | |
| ITNPLIRHE | | ITNPLIRHE | | KGKKAVDLGS | | KTRFLPVVGGT | |
| ITNRVNSII | | ITNRVNSII | | KGLCTINSWH | | KTRGLFGAIAG | |
| ITPEYAYKI | | ITPEYAYKI | | KGLFGAIAGF | | KTRLFTIRQEL | |
| ITPNGSIPN | | ITPNGSIPN | | KGLILGNPKC | | KTRLFTIRQEM | |
| ITPNGSISN | | ITPNGSISN | | KGLWDSFRQS | | KTRPILSPLTK | |
| ITQESECVC | | ITQESECVC | | KGMLGFVFTL | | KTSTQKAINEI | |
| ITQISNINI | | ITQISNINI | | KGNAKDEGNG | | KTSWSYIVEKL | |
| ITQISNTNI | | ITQISNTNI | | KGNGCFEIFH | | KTSWSYIVEKP | |
| ITQRTIGKK | | ITQRTIGKK | | KGNIKCNICI | | KTSWSYIVEKS | |
| ITQTLVSNN | | ITQTLVSNN | | KGNIMRTQES | | KTSWSYIVERP | |
| ITQTLVSNS | | ITQTLVSNS | | KGNIRCDICI | | KTTVDHMAIIK | |
| ITREPYVSC | | ITREPYVSC | | KGNIRCNICI | | KTTVDHMAIIR | |
| ITRKLNRLI | | ITRKLNRLI | | KGNPGVKGWA | | KTVINNITTTI | |
| ITRSGQNHG | | ITRSGQNHG | | KGNQGVKGWA | | KTVVHLNSTTI | |
| ITSKVNSII | | ITSKVNSII | | KGRGLFGAIA | | KTWAGKILRTQ | |
| ITSLCSIWF | | ITSLCSIWF | | KGRHANGTIH | | KTWAGNILRTQ | |
| ITSNLPFQN | | ITSNLPFQN | | KGRIFQSHIR | | KTWAKNILRTQ | |
| ITSPLPFQN | | ITSPLPFQN | | KGRIFQSPIR | | KTWARNILRTQ | |
| ITTHFQRKR | | ITTHFQRKR | | KGRIFQSRII | | KTYNNTTGRDV | |
| ITTKINNII | | ITTKINNII | | KGRIFQSRIR | | KVARLGKYMF | |
| ITTKVNSII | | ITTKVNSII | | KGRLCNPLNP | | KVATGRVTVST | |
| ITVGSSKYQ | | ITVGSSKYQ | | KGRSHLRNDT | | KVCRALLAKSV | |
| ITVGSSKYR | | ITVGSSKYR | | KGRYGVKGFS | | KVCRTLLAKSV | |
| ITVIKNNMI | | ITVIKNNMI | | KGSAKHIEEC | | KVCTKGKKAVD | |
| ITVTHAQDI | | ITVTHAQDI | | KGSARHIEEC | | KVDGSSSACLR | |
| ITVTHSVEL | | ITVTHSVEL | | KGSARHIEEW | | KVDLWSYNAEL | |
| ITVTHSVNL | | ITVTHSVNL | | KGSIQSDKPF | | KVDTIIENNVT | |
| ITVTSSVEL | | ITVTSSVEL | | KGSNRPIIDI | | KVDTIIESNIT | |
| ITWGIHHPS | | ITWGIHHPS | | KGSNRPIVDI | | KVDTIIESNVT | |
| ITYGACPKY | | ITYGACPKY | | KGSNRPVIDI | | KVDTILERNVT | |
| ITYGACPRY | | ITYGACPRY | | KGSNRPVIDV | | KVDTLTEKGIE | |
| ITYGPCPRY | | ITYGPCPRY | | KGSNRPVVDI | | KVDTLTENGVP | |
| ITYGVCPRY | | ITYGVCPRY | | KGSNRPWIRI | | KVDTLTETGVP | |
| ITYIWTYQA | | ITYIWTYQA | | KGSNRPWMKI | | KVDTNLERNVT | |
| ITYNKTVIN | | ITYNKTVIN | | KGSNRPWMRI | | KVEAVIYGNPK | |
| ITYNNTVIN | | ITYNNTVIN | | KGSNRPWVRI | | KVECICRDNWT | |
| ITYNNTVVN | | ITYNNTVVN | | KGSNRPWVRM | | KVECIGWSSTS | |
| ITYNSTVVN | | ITYNSTVVN | | KGSWPDGANI | | KVECVCRDNWN | |
| ITYSSPMMW | | ITYSSPMMW | | KGSYNNTNGE | | KVECVCRDNWT | |
| ITYSSSLMW | | ITYSSSLMW | | KGSYNNTSGE | | KVEFEPFQSLV | |
| ITYSSSMMW | | ITYSSSMMW | | KGTNRPVLVI | | KVEGWVVVAKD | |
| IVADRDSTQ | | IVADRDSTQ | | KGTNSFYRNL | | KVESNGNLIAP | |
| IVAFCGTSG | | IVAFCGTSG | | KGTYDYPKYQ | | KVGYLCAGIPT | |
| IVALCGSKE | | IVALCGSKE | | KGVELSSMGV | | KVKMKWGMEMR | |
| IVALCGSKK | | IVALCGSKK | | KGVEVVNATE | | KVKMQLRDNAK | |
| IVALCGSRE | | IVALCGSRE | | KGVKLSNMGI | | KVLAIYSCIAS | |
| IVAMVFSQE | | IVAMVFSQE | | KGVKLSNMGV | | KVLSIYSCIAS | |
| IVASSGTLE | | IVASSGTLE | | KGVKLSSMGI | | KVNGQAGRIDF | |
| IVASSGTVE | | IVASSGTVE | | KGVKLSSMGV | | KVNGVKLEENS | |
| IVAVTDGPA | | IVAVTDGPA | | KGVYINTALL | | KVNNIVDKMNR | |
| IVDKMNREF | | IVDKMNREF | | KGVYINTAML | | KVNSIIDKMNT | |
| IVDNKNWSG | | IVDNKNWSG | | KGVYMNTALL | | KVNSIIGKMNT | |
| IVDNNNWFG | | IVDNNNWFG | | KGVYVNTALL | | KVNSIINKMNT | |
| IVDNNNWSG | | IVDNNNWSG | | KGWAFDNGDD | | KVNTIIENNVT | |
| IVDNNSWSG | | IVDNNSWSG | | KGWAFDNGND | | KVNTLTEKGIE | |
| IVDNQNWSG | | IVDNQNWSG | | KGWAFDSGDD | | KVNTLTEKGVE | |
| IVDNSNWSG | | IVDNSNWSG | | KGWAFDYGND | | KVNTLTEREVE | |
| IVERILEEE | | IVERILEEE | | KGWAFDYGSD | | KVNTLTERGIE | |
| IVERPKEIE | | IVERPKEIE | | KGWAPLSKDN | | KVNTLTERGVE | |
| IVERPKEME | | IVERPKEME | | KGWILGNPRC | | KVPEWSYIVEK | |

Fig. 83-182

| Block size 8 | SIN | Block size 9 | SIN | Block size 10 | SIN | Block size 11 | SIN |
|---|---|---|---|---|---|---|---|
| IVERPSAPE | | IVERPSAPE | | KGYGVKGFGF | | KVPNAGTDPNS | |
| IVERTKEME | | IVERTKEME | | KHDRIPHRTL | | KVPNALIDDRS | |
| IVETGYVCS | | IVETGYVCS | | KHDSNVKNLF | | KVPNALTDDKS | |
| IVFCGTSGT | | IVFCGTSGT | | KHENRMVLAS | | KVPNALTDDRS | |
| IVFNTIGNL | | IVFNTIGNL | | KHIEECSCYG | | KVPNALTDNRS | |
| IVGLVFFCL | | IVGLVFFCL | | KHIEECSSYG | | KVPNALTNDRS | |
| IVGNDNWSG | | IVGNDNWSG | | KHIVERILEE | | KVPVTQTMELV | |
| IVGNNNWSG | | IVGNNNWSG | | KHLAYCNTDL | | KVQEWSYIVEK | |
| IVGNPSCAS | | IVGNPSCAS | | KHLEECSCYV | | KVQHLEECSCY | |
| IVGNPSCAT | | IVGNPSCAT | | KHNPTEEQAV | | KVRLQLKDNAK | |
| IVHISPLSG | | IVHISPLSG | | KHPAYCNTDL | | KVRLQLRDNAK | |
| IVILVLGLS | | IVILVLGLS | | KHQNAQGEGT | | KVRMQLKDNAK | |
| IVKGRSHLR | | IVKGRSHLR | | KHRFEIIEGR | | KVRMQLRDNAK | |
| IVKTLTNEK | | IVKTLTNEK | | KHSAYCNTDL | | KVRMQLRDNVK | |
| IVKTLTNEQ | | IVKTLTNEQ | | KHSNDTIHDR | | KVRNGTYDHKE | |
| IVKTLTNER | | IVKTLTNER | | KHSNDTVHDR | | KVRRQLRENAE | |
| IVKTLTSEK | | IVKTLTSEK | | KHSNETVKDR | | KVSTQKAINEI | |
| IVLGIINLL | | IVLGIINLL | | KHSNGTAKDR | | KVSTQKALNEI | |
| IVLLENQKT | | IVLLENQKT | | KHSNGTIHDR | | KVTCICRDNWQ | |
| IVLNTDWSG | | IVLNTDWSG | | KHSNGTIKDR | | KVTCVCRDNWQ | |
| IVLVGLILA | | IVLVGLILA | | KHSNGTKHDR | | KVTNATETVES | |
| IVLVMKRKR | | IVLVMKRKR | | KHSNGTMKDR | | KVWWTSNSIIS | |
| IVMGLVFIC | | IVMGLVFIC | | KHSNGTTHDR | | KVWWTSNSIVS | |
| IVMVGLILA | | IVMVGLILA | | KHSNGTVKDR | | KVWWTSNSIVV | |
| IVNAALGSP | | IVNAALGSP | | KHSNGTVNDR | | KWALGENMAPE | |
| IVNGALGSP | | IVNGALGSP | | KHSNNTVKDR | | KWGDILDGVTA | |
| IVNNQDWSG | | IVNNQDWSG | | KHSNNTVRDR | | KWGDILEGTTA | |
| IVNNQNWSG | | IVNNQNWSG | | KHSNSTTHDR | | KWGDVLDGVTA | |
| IVNSALGSP | | IVNSALGSP | | KHSSGTVKDR | | KWGMELRRCLL | |
| IVNTTLSTI | | IVNTTLSTI | | KHTSQYICSP | | KWGMEMRRCLL | |
| IVPCFWLEM | | IVPCFWLEM | | KHTSQYLCTG | | KWGNVLDGVTA | |
| IVPNIGSRP | | IVPNIGSRP | | KHWSGYSGSF | | KWLLSSKANQV | |
| IVPSFDMNN | | IVPSFDMNN | | KHYIGKCPKY | | KWLLSSKDNQV | |
| IVPSFDMSK | | IVPSFDMSK | | KHYIGKCPRY | | KWLSSSGNNQV | |
| IVPSFDMSN | | IVPSFDMSN | | KIAHISPLSG | | KWLSSSMNNQV | |
| IVPSFEMSN | | IVPSFEMSN | | KICIGYHANN | | KWLTLKSGQFP | |
| IVPSGPLKA | | IVPSGPLKA | | KICIGYLSNN | | KWMMAMKYPIT | |
| IVQITGKLN | | IVQITGKLN | | KICIGYQTNN | | KWMMAMRYPIT | |
| IVRRAAVSA | | IVRRAAVSA | | KICLGHHAIP | | KWNENQNPRIF | |
| IVRRAIVSA | | IVRRAIVSA | | KICLGHHAVA | | KWNENQNPRMF | |
| IVRRATVSA | | IVRRATVSA | | KICLGHHAVP | | KWNENQNPRVF | |
| IVSADPLAS | | IVSADPLAS | | KICLGHHAVS | | KWNVTHTGTSK | |
| IVSIDRFLR | | IVSIDRFLR | | KICLGHHAVT | | KWNVTYTGISK | |
| IVSKDNGIR | | IVSKDNGIR | | KICVGYLSTN | | KWNVTYTGTSK | |
| IVSLGAISF | | IVSLGAISF | | KIDDQIEDLW | | KWNVTYTGTSR | |
| IVSMCSSTE | | IVSMCSSTE | | KIDDQIEELW | | KWREQLSQKFE | |
| IVSNDNWSG | | IVSNDNWSG | | KIDDQIEGLW | | KWSGYSGSFID | |
| IVSNTDWSG | | IVSNTDWSG | | KIDDQIENLW | | KWTLGENMAPE | |
| IVSPLAVTW | | IVSPLAVTW | | KIDLWSYNAE | | KWVLGENMAPE | |
| IVSSLPFQN | | IVSSLPFQN | | KIDLWSYNAG | | KWWVWLWLVLR | |
| IVSSLPFQS | | IVSSLPFQS | | KIDTILERNV | | KYDNGVWIGRT | |
| IVSWSQNIL | | IVSWSQNIL | | KIDTLTETGV | | KYEEESKLKRN | |
| IVTFCGLDN | | IVTFCGLDN | | KIEAVIYGNP | | KYEEESKLKRQ | |
| IVTFCGLNN | | IVTFCGLNN | | KIEFEPFQSL | | KYEEESKLNRN | |
| IVTHFQRKR | | IVTHFQRKR | | KIEKIEKIRP | | KYEEESKLNRS | |
| IVTIGSVSI | | IVTIGSVSI | | KIHTRGLFGA | | KYEEESKLNRT | |
| IVTREPYIS | | IVTREPYIS | | KIIHISPLSG | | KYEEESRLNRN | |
| IVTREPYVS | | IVTREPYVS | | KIIQNEDIPI | | KYEKESKLNRN | |
| IVTTVGWSW | | IVTTVGWSW | | KIIRVGCVIL | | KYERVKMFDFI | |
| IVTVTHAQD | | IVTVTHAQD | | KIITIDSVSL | | KYERVKMFDFS | |
| IVVFCGASG | | IVVFCGASG | | KIITIGSASL | | KYERVKMFDFT | |
| IVVFCGTSA | | IVVFCGTSA | | KIITIGSISL | | KYGDGVWIGRT | |

Fig. 83-183

| Block size 8 | SIN | Block size 9 | SIN | Block size 10 | SIN | Block size 11 | SIN |
|---|---|---|---|---|---|---|---|
| IVVFCGTSG | | IVVFCGTSG | | KIITIGSVSL | | KYGNGAWIGRT | |
| IVVTREPYV | | IVVTREPYV | | KIITMGSVSL | | KYGNGVWIGRT | |
| IVWACQRGN | | IVWACQRGN | | KIKHLEECSC | | KYGNGVWMGRT | |
| IVWGIHHPS | | IVWGIHHPS | | KIKMKWGMEL | | KYGPALSINEL | |
| IVWGVHHSS | | IVWGVHHSS | | KIKMKWGMEM | | KYGSGRIFQSG | |
| IWAIHHPPT | | IWAIHHPPT | | KIKTNGNLIA | | KYGTGRIFQSG | |
| IWASGSSIS | | IWASGSSIS | | KILDEHDSNV | | KYGTGRIFQSR | |
| IWAYNAELI | | IWAYNAELI | | KILKIKKGKI | | KYGYIIEEYGK | |
| IWAYNAELL | | IWAYNAELL | | KILKIKKGKL | | KYHQIEKEFEQ | |
| IWDANGWVS | | IWDANGWVS | | KILKIRKGKI | | KYHQIEKEFGQ | |
| IWDTLIERD | | IWDTLIERD | | KILRTHESEC | | KYHWNLALDIV | |
| IWFSHYNQM | | IWFSHYNQM | | KILRTQESEC | | KYIKQGSLKLA | |
| IWFSHYNQV | | IWFSHYNQV | | KILRTQESSC | | KYIKSDQLKLA | |
| IWGIHHPND | | IWGIHHPND | | KILSIYSCIA | | KYIKSGQLKLA | |
| IWGIHHPSS | | IWGIHHPSS | | KILSIYSCVA | | KYIPSGSLKLA | |
| IWGVHHPID | | IWGVHHPID | | KILSIYSSVA | | KYIPSNSLKLA | |
| IWGVHHPKD | | IWGVHHPKD | | KILSIYSTVA | | KYIPSRSLKLA | |
| IWGVHHPND | | IWGVHHPND | | KILTIYSTAA | | KYISSGSLKLA | |
| IWGVHHPST | | IWGVHHPST | | KILTIYSTVA | | KYKIFKNGKKG | |
| IWHSNLNDA | | IWHSNLNDA | | KIMESGGIDK | | KYMNVKSLKLA | |
| IWHSNLNDT | | IWHSNLNDT | | KIMESGGISK | | KYNGIITDTFK | |
| IWIGRTKST | | IWIGRTKST | | KIMTIGSVSL | | KYNGIITDTLK | |
| IWITREPYV | | IWITREPYV | | KINDQIEDLW | | KYNGVITDTLK | |
| IWLWLVLRE | | IWLWLVLRE | | KINEVKLEEN | | KYQQSFSPSPG | |
| IWMACHSAA | | IWMACHSAA | | KINGVILEEN | | KYQQSFTPSPE | |
| IWMCSNGSL | | IWMCSNGSL | | KINGVKLEEN | | KYQQSFTPSPG | |
| IWRQANNGD | | IWRQANNGD | | KINGVRLEEN | | KYREEAMQNRI | |
| IWRQANNGE | | IWRQANNGE | | KINNIIDKMN | | KYRQSFSPSPG | |
| IWSKPQCQI | | IWSKPQCQI | | KINNIIEKMN | | KYRTESLQNRI | |
| IWSYNAEFL | | IWSYNAEFL | | KINNIVDKMN | | KYSRADKICIG | |
| IWSYNAELL | | IWSYNAELL | | KINPVTLTMG | | KYTSARQEKNP | |
| IWSYNAKLL | | IWSYNAKLL | | KINSIIDKMN | | KYTSGRQEKNP | |
| IWSYNAQLL | | IWSYNAQLL | | KINTLTERGV | | KYVEDTKIDLW | |
| IWSYNARLL | | IWSYNARLL | | KIPNAETDPN | | KYVEDTKVDLW | |
| IWTSASSIS | | IWTSASSIS | | KIPNAETDPS | | KYVEWTSNSLI | |
| IWTSGSIIS | | IWTSGSIIS | | KIPNAGIDPN | | KYVKQGSLKLA | |
| IWTSGSSIA | | IWTSGSSIA | | KIPNAGTDPN | | KYVKQGSLMLA | |
| IWTSGSSIS | | IWTSGSSIS | | KIQHLEECSC | | KYVKQGSLRLA | |
| IWTSSSSIV | | IWTSSSSIV | | KIQTNGNLIA | | KYVKSDRLVLA | |
| IWTSSSSTV | | IWTSSSSTV | | KIQTSGNLIA | | KYVKSEKLVLA | |
| IWTSSSSVV | | IWTSSSSVV | | KIRHLEECSC | | KYVKSERLVLA | |
| IWTYNAELL | | IWTYNAELL | | KIRNGTYDHK | | KYVKSKRLVLA | |
| IWTYQAELL | | IWTYQAELL | | KIRRRVDINP | | KYVNIKSLKLA | |
| IWVTRELYV | | IWVTRELYV | | KIRRRVDMNP | | KYVNVKSLKLA | |
| IWVTREPYV | | IWVTREPYV | | KIRRRVDTNP | | KYVNVRSLKLA | |
| IYATVAGSL | | IYATVAGSL | | KIRRRVDVNP | | KYVRSEKLVLA | |
| IYCICRDNW | | IYCICRDNW | | KIRTNGNLIA | | KYVWWASNSLI | |
| IYCVCRDNW | | IYCVCRDNW | | KIRTRGLFGA | | KYVWWTSNSLI | |
| IYDFNEGSY | | IYDFNEGSY | | KIRVKRRPVA | | KYVWWTSNSLV | |
| IYGKDNAIR | | IYGKDNAIR | | KISGVKLEEN | | KYWAIRTRSGG | |
| IYGKDNAVR | | IYGKDNAVR | | KISHISPLSG | | LAADYKSTQAA | |
| IYGNPKCDI | | IYGNPKCDI | | KISKRGGSGI | | LAAGGAIWVTR | |
| IYGNPKCDT | | IYGNPKCDT | | KISKRGNSGI | | LAAGGDIWVTR | |
| IYGNPKCDV | | IYGNPKCDV | | KISKRGSSGI | | LAATVTLHFKQ | |
| IYHKCDNAC | | IYHKCDNAC | | KISKRGSSGV | | LADQSLPPNFP | |
| IYHKCDNSC | | IYHKCDNSC | | KISKSTKSTV | | LADQSLPPNFS | |
| IYHKCDNTC | | IYHKCDNTC | | KISSSFSFGG | | LADRIDDAVTD | |
| IYHKCDNVC | | IYHKCDNVC | | KITCVCRDNW | | LADRVDDAVTD | |
| IYHKCNNAC | | IYHKCNNAC | | KITENSFEQI | | LADSEMLNLYE | |
| IYIEVLHLT | | IYIEVLHLT | | KITFEATGNL | | LADSEMNKLYE | |
| IYKILSIYS | | IYKILSIYS | | KITGFAPFSK | | LADWVDDAVTD | |
| IYKILTIYS | | IYKILTIYS | | KITLKFAFNM | | LAEKAMKEHGE | |

Fig. 83-184

| Block size 8 | SIN | Block size 9 | SIN | Block size 10 | SIN | Block size 11 | SIN |
|---|---|---|---|---|---|---|---|
| IYNETVRLE | | IYNETVRLE | | KITNKINNIV | | LAEKAMKEYGE | |
| IYNRMGAVT | | IYNRMGAVT | | KITNKVNNIV | | LAEKTMKEYGE | |
| IYNRMGTIT | | IYNRMGTIT | | KITVDHMAII | | LAERAMKEYGE | |
| IYNRMGTVA | | IYNRMGTVA | | KIVHISPLSG | | LAFICIKNGNM | |
| IYNRMGTVT | | IYNRMGTVT | | KIVTTVGWSW | | LAFILWACSSG | |
| IYQILAIYA | | IYQILAIYA | | KIYWHLMHPG | | LAFIMWACSNG | |
| IYQILAIYS | | IYQILAIYS | | KKAKLANVVR | | LAFIMWACSSG | |
| IYQILSIYS | | IYQILSIYS | | KKASLRLAVG | | LAGSAQHVEEC | |
| IYRDEAINN | | IYRDEAINN | | KKAVDLGSCG | | LAGTAKHIEEC | |
| IYSCIASSI | | IYSCIASSI | | KKCFNPCFYV | | LAHALKLVVAM | |
| IYSCIASSL | | IYSCIASSL | | KKEPDTYDFN | | LAIAMGLIFMC | |
| IYSCIASST | | IYSCIASST | | KKESLRLAIG | | LAIGECPKYVK | |
| IYSCIASSV | | IYSCIASSV | | KKESLRLALG | | LAIGLRNTPSI | |
| IYSSSMMWE | | IYSSSMMWE | | KKESLRLAVG | | LAIGLRNVPQA | |
| IYSSVASSL | | IYSSVASSL | | KKGTYDYPKY | | LAIGLRNVPQI | |
| IYSTAASSL | | IYSTAASSL | | KKHPAYCNTD | | LAIGLRNVPQV | |
| IYSTISSSL | | IYSTISSSL | | KKILRTQESS | | LAIGPRNVPQA | |
| IYSTVAASL | | IYSTVAASL | | KKINMINDKI | | LAIGPRNVPQV | |
| IYSTVASSF | | IYSTVASSF | | KKKKKKRGLF | | LAIIIAGLSFW | |
| IYSTVASSI | | IYSTVASSI | | KKKKKRGLFG | | LAILIAGGLIL | |
| IYSTVASSL | | IYSTVASSL | | KKKKRGLFGA | | LAILVAGGLIL | |
| IYSTVASSS | | IYSTVASSS | | KKKNPEAYNF | | LAIMIAGLFFW | |
| IYSTVSSSL | | IYSTVSSSL | | KKKPDIYDFN | | LAIMIAGLSFW | |
| IYSTVTSSL | | IYSTVTSSL | | KKKPDTYDFN | | LAIMMAGLSFW | |
| IYSTVVSSL | | IYSTVVSSL | | KKKRGLFGAI | | LAIMVAGLSFW | |
| IYWHLMHPG | | IYWHLMHPG | | KKKSYINKTG | | LAIYATVAGSL | |
| IYWTIVKPG | | IYWTIVKPG | | KKKSYINRTG | | LAIYSCIASSI | |
| IYWTLVNPG | | IYWTLVNPG | | KKLKREITFH | | LAIYSTAASSL | |
| IYWTVVKPG | | IYWTVVKPG | | KKLKREMTFH | | LAIYSTISSSL | |
| IYWWDGLQS | | IYWWDGLQS | | KKLTVTHSVN | | LAIYSTVASSL | |
| KAAIGLRIS | | KAAIGLRIS | | KKMEDGFLDI | | LAIYSTVASSS | |
| KAALGLRIS | | KAALGLRIS | | KKMEDGFLDV | | LAIYSTVSSSL | |
| KAAMGLKIS | | KAAMGLKIS | | KKMTITFLIL | | LAKCNTKCQTS | |
| KAAMGLRIS | | KAAMGLRIS | | KKNPEAYNFN | | LAKGEKANVLI | |
| KAAMGMRIS | | KAAMGMRIS | | KKPDIYDFNE | | LAKSVFNCLYA | |
| KACELTDSI | | KACELTDSI | | KKPDTYDFNE | | LAKSVFNNLYA | |
| KACELTDSS | | KACELTDSS | | KKQEIEGIKL | | LAKSVFNSIYA | |
| KACELTDST | | KACELTDST | | KKQILRTQES | | LAKSVFNSLYA | |
| KACELTDSV | | KACELTDSV | | KKQLRENAED | | LAKSVFNSLYS | |
| KACELTGSS | | KACELTGSS | | KKQLRENAEE | | LALGLRNTPSI | |
| KACNALTGG | | KACNALTGG | | KKRGLFGAIA | | LALGMKNVPEK | |
| KACNASTGA | | KACNASTGA | | KKRKKRGLFG | | LALSHTAYSQI | |
| KACNASTGG | | KACNASTGG | | KKRLGSWSWH | | LANNGKFEFIA | |
| KACSASTGG | | KACSASTGG | | KKSYINKTGT | | LANNGKFEFIV | |
| KADEICIGY | | KADEICIGY | | KKSYINRTGT | | LANNGKLEFIA | |
| KADHRIYWI | | KADHRIYWI | | KKTGGPIYKK | | LANNGRFEFIA | |
| KADKICIGY | | KADKICIGY | | KKTGGPIYKR | | LANQSLPPNFS | |
| KADLIIERR | | KADLIIERR | | KKTGGPIYRR | | LANTIEIFRSN | |
| KADTILERN | | KADTILERN | | KKTNEKFHQI | | LANTIEVFKSN | |
| KADTRILFI | | KADTRILFI | | KKYERVKMFD | | LANTIEVFRLN | |
| KADTRILFV | | KADTRILFV | | KKYGPALSIN | | LANTIEVFRMN | |
| KAEIAQKLE | | KAEIAQKLE | | KKYTSARQEK | | LANTIEVFRSN | |
| KAEIAQRLE | | KAEIAQRLE | | KKYTSGRQEK | | LANVVRKMMTN | |
| KAGFIEGGW | | KAGFIEGGW | | KLAAICTHLE | | LANVVRKMMTS | |
| KAGFIENGW | | KAGFIENGW | | KLAIGLRNVP | | LANYSLPPNFS | |
| KAGVKMNPN | | KAGVKMNPN | | KLAIGPRNVP | | LAPKYGYIIEE | |
| KAHNGKLCR | | KAHNGKLCR | | KLANVVRKMM | | LAPRYGYIIEE | |
| KAIDEITTK | | KAIDEITTK | | KLAQGYKDII | | LAPRYGYIIEK | |
| KAIDGITNK | | KAIDGITNK | | KLASGLRNVP | | LAQGALLGTKH | |
| KAIDGVTNK | | KAIDGVTNK | | KLATGLKNVP | | LAQGALLGTNH | |
| KAIDIMQNK | | KAIDIMQNK | | KLATGLRNIP | | LAQGALLGTRH | |
| KAIDNMQNK | | KAIDNMQNK | | KLATGLRNVP | | LAQGALVGTKH | |

Fig. 83-185

| Block size 8 | SIN | Block size 9 | SIN | Block size 10 | SIN | Block size 11 | SIN |
|---|---|---|---|---|---|---|---|
| KAIDNMQNR | | KAIDNMQNR | | KLATGMRNIP | | LAQGVLLGTKH | |
| KAIDQITTK | | KAIDQITTK | | KLATGMRNVP | | LAQGYKDIILW | |
| KAIDRITTK | | KAIDRITTK | | KLATGPRNVP | | LARCICEKLEQ | |
| KAINEITTK | | KAINEITTK | | KLCFPGELDN | | LARGEKANVLI | |
| KAINGVTNK | | KAINGVTNK | | KLCFPGEVDN | | LARNICEKLEQ | |
| KAIWTSGSS | | KAIWTSGSS | | KLCKLNGIPP | | LARRICEKLEQ | |
| KAKLANVVR | | KAKLANVVR | | KLCRLRGIPP | | LARSALILRGA | |
| KALNEITTK | | KALNEITTK | | KLCRLSGIPP | | LARSALILRGS | |
| KALSIYSCI | | KALSIYSCI | | KLCYPGELDN | | LARSICEKLEQ | |
| KAMEQMAGS | | KAMEQMAGS | | KLCYPGEVDN | | LASCMGLIYNR | |
| KAMEQVAGS | | KAMEQVAGS | | KLDINMADYS | | LASLLEMCHGT | |
| KAMMDQVRE | | KAMMDQVRE | | KLEENSTYKI | | LASLLEMCHST | |
| KANQVFPQL | | KANQVFPQL | | KLEENTSYKI | | LASSGSLEFIA | |
| KANVLIGQG | | KANVLIGQG | | KLEENTTYKI | | LASTNAHDRIC | |
| KAPISLGDC | | KAPISLGDC | | KLEENTTYRI | | LASTNAYDRIC | |
| KAPQLNPID | | KAPQLNPID | | KLEFEPFQSL | | LASTTAKAMEQ | |
| KARIDYYWS | | KARIDYYWS | | KLEKSRINGV | | LATGLRNAHKM | |
| KASKEPEVH | | KASKEPEVH | | KLEQSGLPVG | | LATGLRNIPQI | |
| KASLRLAVG | | KASLRLAVG | | KLERSKINEV | | LATGLRNVPIP | |
| KASTQKAID | | KASTQKAID | | KLERSKINGV | | LATGLRNVPQI | |
| KASTQKAIN | | KASTQKAIN | | KLFALSGVAI | | LATGLRNVPQM | |
| KATAILRKA | | KATAILRKA | | KLFALSGVAV | | LATGLRNVPSI | |
| KATCVCRDN | | KATCVCRDN | | KLFASSGIAI | | LATGLRNVPSV | |
| KATKMEAIL | | KATKMEAIL | | KLFERVKRQL | | LATGMKNVPEI | |
| KATKMKAII | | KATKMKAII | | KLFERVRHQL | | LATGMKNVPET | |
| KATKMKAIL | | KATKMKAIL | | KLFERVRRQL | | LATGMRNIPEK | |
| KATKRLIQL | | KATKRLIQL | | KLFTLSGVAI | | LATGMRNIPEN | |
| KATNGNYGP | | KATNGNYGP | | KLGQFPVQTD | | LATGMRNIPER | |
| KATRKLIQL | | KATRKLIQL | | KLGSPLVLDD | | LATGMRNIPGK | |
| KATRRLIQL | | KATRRLIQL | | KLILATGLRN | | LATGMRNVPEI | |
| KATRRLVQL | | KATRRLVQL | | KLIQGYKDII | | LATGMRNVPEK | |
| KATRRMIQL | | KATRRMIQL | | KLITVGSSKY | | LATGMRNVPEN | |
| KAVDLGSCG | | KAVDLGSCG | | KLKREITFHG | | LATGMRNVPER | |
| KAVKLYKKL | | KAVKLYKKL | | KLKREMTFHG | | LATGMRNVPET | |
| KAVKLYRKL | | KAVKLYRKL | | KLKRNEIKGV | | LATGMRNVPEV | |
| KAVRGDLNF | | KAVRGDLNF | | KLKRQEIDGI | | LATGPRNVPQI | |
| KAWLHICVT | | KAWLHICVT | | KLKRQEIEGI | | LATRGVQIASN | |
| KAWLHVCIT | | KAWLHVCIT | | KLKRQEINGI | | LATTITLHFKQ | |
| KAWLHVCVT | | KAWLHVCVT | | KLKRRAIATP | | LATTVTLHFKQ | |
| KCCNLFEKF | | KCCNLFEKF | | KLKSEDNVYK | | LAVGLRNTPSI | |
| KCCSLFEKF | | KCCSLFEKF | | KLKTEDNIYK | | LAVGLRNTPSV | |
| KCCTLFEKF | | KCCTLFEKF | | KLKTEDNVYK | | LAVLIAGGLIL | |
| KCDDDCMAS | | KCDDDCMAS | | KLLGINMSKK | | LAVNVRGSGMR | |
| KCDDECMDS | | KCDDECMDS | | KLLKERGFFG | | LAVTWWNRKGP | |
| KCDDECMNS | | KCDDECMNS | | KLLPFAAAPP | | LAVTWWNRNGP | |
| KCDDECMSS | | KCDDECMSS | | KLLPFASAPP | | LAVTWWNRSGP | |
| KCDDHCMES | | KCDDHCMES | | KLLVLIENDR | | LAYCNTDLGTP | |
| KCDDQCMES | | KCDDQCMES | | KLLVLLENDK | | LAYDKICIGYQ | |
| KCDIHLKDQ | | KCDIHLKDQ | | KLLVLLENDR | | LBNEPGSGNWP | |
| KCDIHLRDQ | | KCDIHLRDQ | | KLLVLLENEK | | LCAGIPSDTPR | |
| KCDLYLNGR | | KCDLYLNGR | | KLLVLLENGR | | LCAGIPTDTPR | |
| KCDLYLSGR | | KCDLYLSGR | | KLNGIPPLEL | | LCAGLPSDTPR | |
| KCDNECMDS | | KCDNECMDS | | KLNNVIDKMN | | LCAVNSWHILS | |
| KCDNECMET | | KCDNECMET | | KLNNVIDKMY | | LCEVNSWHIFS | |
| KCDNKCMET | | KCDNKCMET | | KLNRFIEKTN | | LCEVNSWHILS | |
| KCDNQCMES | | KCDNQCMES | | KLNRIIEKTN | | LCEVSSWHILS | |
| KCDPYLNGR | | KCDPYLNGR | | KLNRLIDKTN | | LCFPGELDNNG | |
| KCDTHLKDQ | | KCDTHLKDQ | | KLNRLIDRTN | | LCFPGEVDNNG | |
| KCDVHLKDQ | | KCDVHLKDQ | | KLNRLIEKTN | | LCGSKEQLGSW | |
| KCFNPCFYV | | KCFNPCFYV | | KLNRLIERTN | | LCGSKERLGSW | |
| KCFWKGGSI | | KCFWKGGSI | | KLNRLIGKTN | | LCGSKKRLGSW | |
| KCFWKSGSI | | KCFWKSGSI | | KLNRLISKTN | | LCGSPFPVGSG | |

Fig. 83-186

| Block size 8 | SIN | Block size 9 | SIN | Block size 10 | SIN | Block size 11 | SIN |
|---|---|---|---|---|---|---|---|
| KCFWRGGSI | | KCFWRGGSI | | KLNRNEIKGV | | LCGSPISVGSG | |
| KCICRDNWK | | KCICRDNWK | | KLPFQNLSPR | | LCGSPVPVGSG | |
| KCICRDNWR | | KCICRDNWR | | KLRLATGLRN | | LCGSPVSVGSG | |
| KCIERVRNG | | KCIERVRNG | | KLRMATGLRN | | LCGSRERLGSW | |
| KCIESIRNG | | KCIESIRNG | | KLRMVTGLRN | | LCIDYHAHNST | |
| KCIKTFFGW | | KCIKTFFGW | | KLRSGFEMLK | | LCIGYHANNST | |
| KCIRTFFGW | | KCIRTFFGW | | KLSGGYKDII | | LCIINSWHIYG | |
| KCKTKEGRR | | KCKTKEGRR | | KLSGGYKDVI | | LCKLNGIPPLE | |
| KCMESVRNG | | KCMESVRNG | | KLSIEDPDHE | | LCKVEGWVVVA | |
| KCMETIKNG | | KCMETIKNG | | KLSIEDPNHE | | LCLAILIAGGL | |
| KCMKTFFGW | | KCMKTFFGW | | KLSIEDPSHE | | LCLAILVAGGL | |
| KCMRTFFGW | | KCMRTFFGW | | KLSIEEPSHE | | LCLAVLIAGGL | |
| KCNDECMNS | | KCNDECMNS | | KLSIENPSHE | | LCLGHHAVANG | |
| KCNDPYPGN | | KCNDPYPGN | | KLSNMGIYQI | | LCLGHHAVPNG | |
| KCNDSCMDT | | KCNDSCMDT | | KLSNMGVYQI | | LCLGHHAVQNG | |
| KCNDSCMEA | | KCNDSCMEA | | KLSSGYKDII | | LCLGHHAVSNG | |
| KCNDSCMET | | KCNDSCMET | | KLSSGYKDVI | | LCNPLNPFVGH | |
| KCNEPYPGN | | KCNEPYPGN | | KLSSGYKEVI | | LCNPLNPFVNH | |
| KCNNECMET | | KCNNECMET | | KLSSMGIYQI | | LCNPLNPFVSH | |
| KCNNSCMET | | KCNNSCMET | | KLSSMGVYQI | | LCNPLNPFVTH | |
| KCNNTCMET | | KCNNTCMET | | KLTIIYSSSM | | LCNPMNPFVSH | |
| KCNQFALGQ | | KCNQFALGQ | | KLTITYSSPM | | LCNVEGWVVIA | |
| KCNTKCQTS | | KCNTKCQTS | | KLTITYSSSL | | LCPFKGFFPFH | |
| KCPKYIPSG | | KCPKYIPSG | | KLTITYSSSM | | LCPFQGFFPFH | |
| KCPKYIPSN | | KCPKYIPSN | | KLTQGRQTFD | | LCPFRGFFPFH | |
| KCPKYIPSR | | KCPKYIPSR | | KLTQGRQTYD | | LCPIKGWAPLS | |
| KCPKYISSG | | KCPKYISSG | | KLTQGYKDII | | LCPIRGWAPLS | |
| KCPKYVKST | | KCPKYVKST | | KLVDGQDCDL | | LCPSPLKLVDG | |
| KCPRYIPSG | | KCPRYIPSG | | KLVGINMSKK | | LCPVKGWAPLS | |
| KCPRYVKQS | | KCPRYVKQS | | KLVGINMSKR | | LCQVECVCRDN | |
| KCQLNEGVM | | KCQLNEGVM | | KLVLATGLRN | | LCRLRGIPPLE | |
| KCQSEIGGI | | KCQSEIGGI | | KLVLATGPRN | | LCRLSGIPPLE | |
| KCQSEIGWI | | KCQSEIGWI | | KLYDRVRLQL | | LCSGLVGDTPR | |
| KCQSPLGAI | | KCQSPLGAI | | KLYEKVRRQL | | LCSIWFSHYNQ | |
| KCQTEIGGI | | KCQTEIGGI | | KLYERVKKQL | | LCSKILTDTSR | |
| KCQTEVGGI | | KCQTEVGGI | | KLYERVKRQL | | LCSKTLTDTSR | |
| KCQTPLGAI | | KCQTPLGAI | | KLYERVRKQL | | LCSKVLTDTSR | |
| KCQTPLGAL | | KCQTPLGAL | | KLYERVRRQL | | LCSRILTDTSR | |
| KCQTSLGGI | | KCQTSLGGI | | KLYGAGNKLI | | LCSRVLTDTSR | |
| KCQTSLGGV | | KCQTSLGGV | | KLYGNGNKLI | | LCSVEGWVVIA | |
| KCQTSMGGI | | KCQTSMGGI | | KLYGNGNKLV | | LCSVEYASKTR | |
| KCQTSMGGV | | KCQTSMGGV | | KLYGSGNKLI | | LCTGILTDTSR | |
| KCQTSVGGI | | KCQTSVGGI | | KLYGSGNKLV | | LCTGVLTDTSK | |
| KCQTYAGAI | | KCQTYAGAI | | KLYGSGSKLI | | LCTGVLTDTSR | |
| KCQTYAGAV | | KCQTYAGAV | | KLYGTGNKLI | | LCTINSWHIFG | |
| KCQTYTGAI | | KCQTYTGAI | | KLYIWGIHHP | | LCTINSWHIYG | |
| KCRTKEGRR | | KCRTKEGRR | | KLYIWGVHHP | | LCVGWSSTSCH | |
| KCRTREGRR | | KCRTREGRR | | KLYKKLKREI | | LCYPGELDNNG | |
| KCSKYVKST | | KCSKYVKST | | KLYKKLKREM | | LCYPGELNNNG | |
| KCVCRDNWK | | KCVCRDNWK | | KLYKNTNTLS | | LCYPGEVDNNG | |
| KCYNPCFYV | | KCYNPCFYV | | KLYRKLKREI | | LCYPGNFNDYE | |
| KCYQFALGH | | KCYQFALGH | | KLYVNKNPYT | | LCYPGSFNDYE | |
| KCYQFALGQ | | KCYQFALGQ | | KLYVWGVHHP | | LCYPGSFNNYE | |
| KDAERGKLK | | KDAERGKLK | | KLYWHLMHPG | | LCYPGSLNDYE | |
| KDCFQPCFY | | KDCFQPCFY | | KLYWHLMRPG | | LDDCSLEGIIL | |
| KDCFQSCFY | | KDCFQSCFY | | KLYWHLMSPG | | LDDCSLEGLIL | |
| KDCSIAGWL | | KDCSIAGWL | | KMARLGKGYM | | LDDCSLEGLVL | |
| KDCSVAGWL | | KDCSVAGWL | | KMARLGRGYM | | LDDCSLKGLIL | |
| KDCSVSGWL | | KDCSVSGWL | | KMEAILVVLL | | LDEESRARIKT | |
| KDEGNGCFT | | KDEGNGCFT | | KMEDGFLDVW | | LDEHDANVRNL | |
| KDGDIIFLW | | KDGDIIFLW | | KMEFEPFQSL | | LDEHDSNVENL | |
| KDIILWFSF | | KDIILWFSF | | KMEKIVLLLA | | LDEHDSNVKNL | |

Fig. 83-187

| Block size 8 | SIN | Block size 9 | SIN | Block size 10 | SIN | Block size 11 | SIN |
|---|---|---|---|---|---|---|---|
| KDIILWISF | | KDIILWISF | | KMESRGLFGA | | LDEIGEDIAPI | |
| KDIILWVSF | | KDIILWVSF | | KMFDFIKWNV | | LDEIGEDLAPI | |
| KDILEKAHN | | KDILEKAHN | | KMFDFSKWNV | | LDEIGEDVAPI | |
| KDILEKTHN | | KDILEKTHN | | KMFDFTKWNV | | LDEQNKLYGAG | |
| KDILRTQES | | KDILRTQES | | KMKAIIVVLL | | LDEQNKLYGTG | |
| KDLDNCHPI | | KDLDNCHPI | | KMKAILVVLL | | LDFHDSNVKNL | |
| KDLGNCHPI | | KDLGNCHPI | | KMKWGMELRR | | LDFHDSNVKSL | |
| KDLGNCHPV | | KDLGNCHPV | | KMKWGMEMRR | | LDFHDSNVRNL | |
| KDLGNGCFE | | KDLGNGCFE | | KMMTNSQDTE | | LDFHDSSVKNL | |
| KDLGSCHPI | | KDLGSCHPI | | KMMTSSQDTE | | LDGVTASCLDK | |
| KDLRSGYEM | | KDLRSGYEM | | KMNGNYDSIR | | LDGVTASCLDR | |
| KDLRSGYET | | KDLRSGYET | | KMNIQFEAVG | | LDGVTASCRDN | |
| KDLTKEFFE | | KDLTKEFFE | | KMNIQFTAVG | | LDIRTATREGK | |
| KDMTKDFFE | | KDMTKDFFE | | KMNIQFTSVG | | LDIWTYNAELL | |
| KDMTKEFFE | | KDMTKEFFE | | KMNIQFTSVS | | LDKHDSNVKNL | |
| KDMTKEFFV | | KDMTKEFFV | | KMNIQILILA | | LDKICLGHHAV | |
| KDMTREFFE | | KDMTREFFE | | KMNNQILILA | | LDLHDANVKNL | |
| KDNAIDEGD | | KDNAIDEGD | | KMNPNKKIIT | | LDLHDANVRNL | |
| KDNAIRFGE | | KDNAIRFGE | | KMNPNQKIII | | LDLHDSNVKNL | |
| KDNAIRIGE | | KDNAIRIGE | | KMNPNQKIIT | | LDLHDSNVRNL | |
| KDNAIRLGE | | KDNAIRLGE | | KMNPNQKIMT | | LDLHDSNVRSL | |
| KDNAIRPGE | | KDNAIRPGE | | KMNREFEVMN | | LDLHDSNVTNL | |
| KDNAKDEGN | | KDNAKDEGN | | KMNREFEVVD | | LDLNMGQPFYS | |
| KDNAKDLGN | | KDNAKDLGN | | KMNREFEVVN | | LDMHDANVKNL | |
| KDNAKEIGN | | KDNAKEIGN | | KMNREFGVVN | | LDMHDANVRNL | |
| KDNAKELGN | | KDNAKELGN | | KMNTKILVLA | | LDNEPGSGDWP | |
| KDNALRLAE | | KDNALRLAE | | KMNTQFEAIG | | LDNEPGSGNWP | |
| KDNANDLGN | | KDNANDLGN | | KMNTQFEAVG | | LDNKHSNDTIH | |
| KDNARELGN | | KDNARELGN | | KMNTQFETVG | | LDNKHSNDTVH | |
| KDNAVRFGE | | KDNAVRFGE | | KMNTQFTAVG | | LDNKHSNGTIH | |
| KDNAVRIGE | | KDNAVRIGE | | KMNTQFTSVG | | LDNLQAYQKRM | |
| KDNAVRLGE | | KDNAVRLGE | | KMNTQILIFA | | LDNNGELRHLF | |
| KDNGIRIGS | | KDNGIRIGS | | KMNTQILIFT | | LDPGDTVTFTF | |
| KDNGIRVGS | | KDNGIRVGS | | KMNTQILILA | | LDRICLGHHAV | |
| KDNLEPGTF | | KDNLEPGTF | | KMNTQILVFA | | LDRLRRDQKSL | |
| KDNNIRIGS | | KDNNIRIGS | | KMNTRILILT | | LDTGDGCFEIL | |
| KDNQVFPQL | | KDNQVFPQL | | KMPASRYLTD | | LDTINFESTGN | |
| KDNSIQLSA | | KDNSIQLSA | | KMQFSSLTVN | | LDVWTYNAELL | |
| KDNSIRIGS | | KDNSIRIGS | | KMQLRDNAKE | | LDVWTYNTELL | |
| KDNSIRLAA | | KDNSIRLAA | | KMRDSIKSWR | | LDYHDSNVKNL | |
| KDNSIRLSA | | KDNSIRLSA | | KMSLLTEVET | | LDYQIGYICSG | |
| KDNSVRIGS | | KDNSVRIGS | | KMTDSIKSWR | | LDYQIGYVCSG | |
| KDNSVRLSA | | KDNSVRLSA | | KMTIASDILK | | LEALMEWIKTR | |
| KDPKKTGGP | | KDPKKTGGP | | KMTIASDILT | | LEALMEWLKTR | |
| KDQAWSYIV | | KDQAWSYIV | | KMTITFLILL | | LECKTFFLTQG | |
| KDQDWSYIV | | KDQDWSYIV | | KMVLSAFDER | | LECRTFFLTHG | |
| KDQGWSYIV | | KDQGWSYIV | | KMYALHQGTT | | LECRTFFLTQG | |
| KDQSWSYIV | | KDQSWSYIV | | KNADLEALME | | LEDEQMYQKCC | |
| KDRAPYRSL | | KDRAPYRSL | | KNALGDCPKY | | LEDEQMYQRCC | |
| KDRSPFRAL | | KDRSPFRAL | | KNALGECPKY | | LEECSCYMDID | |
| KDRSPFRTL | | KDRSPFRTL | | KNALYGTQSL | | LEECSCYVDID | |
| KDRSPHRAL | | KDRSPHRAL | | KNANTLSSVN | | LEECSCYVDTD | |
| KDRSPHRTL | | KDRSPHRTL | | KNANTLSSVT | | LEECSCYVDVD | |
| KDRSPQRTL | | KDRSPQRTL | | KNANTLTSVT | | LEEESDEALKM | |
| KDRSPYRAL | | KDRSPYRAL | | KNATATVYYD | | LEEHPNAGKDP | |
| KDRSPYRTL | | KDRSPYRTL | | KNCINRCFYV | | LEEHPSAGKDP | |
| KDRTPYRSL | | KDRTPYRSL | | KNCTLIDALL | | LEEHPSAGRDP | |
| KDRTSYRSL | | KDRTSYRSL | | KNDLYGTQPL | | LEEHPSTGKDP | |
| KDSITDIWT | | KDSITDIWT | | KNDLYGTQSL | | LEELRFVFSIA | |
| KDSNGVQDI | | KDSNGVQDI | | KNELYGTQSL | | LEELRFVFSNA | |
| KDSRSGYEI | | KDSRSGYEI | | KNGNHAVHYC | | LEELRFVFSSA | |
| KDSRSGYEM | | KDSRSGYEM | | KNGNLRCTIC | | LEENPSAGKDP | |

Fig. 83-188

| Block size 8 | SIN | Block size 9 | SIN | Block size 10 | SIN | Block size 11 | SIN |
|---|---|---|---|---|---|---|---|
| KDSRSGYET | | KDSRSGYET | | KNGNMQCTIC | | LEENSTYKILS | |
| KDSRSGYEV | | KDSRSGYEV | | KNGNMRCTIC | | LEENTSYKILS | |
| KDTRSGYEM | | KDTRSGYEM | | KNGNMRCTIL | | LEENTTYKILS | |
| KDVIIWFSF | | KDVIIWFSF | | KNGNMRGTNW | | LEENTTYRILS | |
| KDVILWFSF | | KDVILWFSF | | KNGTYDHKDY | | LEEYVEDTKID | |
| KDVILWFSL | | KDVILWFSL | | KNGTYDHKEY | | LEFEPFQSLVP | |
| KDWILWISF | | KDWILWISF | | KNGTYDYPKY | | LEFIAEQFTWN | |
| KDWVLWISF | | KDWVLWISF | | KNGTYKYPKY | | LEFKADLIIER | |
| KDYEEEAKL | | KDYEEEAKL | | KNGTYNHKDY | | LEGFSAESRKL | |
| KDYRYTYRC | | KDYRYTYRC | | KNGTYNHKEY | | LEGFSAESRKM | |
| KEAMQNRIQ | | KEAMQNRIQ | | KNGTYNRKEY | | LEGIILGNPKC | |
| KEAQDVIME | | KEAQDVIME | | KNGTYNYPKY | | LEGLILGNPKC | |
| KECFNPCFY | | KECFNPCFY | | KNGTYYYPKY | | LEGLILSNPKC | |
| KEDEVWWTS | | KEDEVWWTS | | KNILEKTHNG | | LEGLVLGNPKC | |
| KEDKRYGPA | | KEDKRYGPA | | KNILRTQESE | | LEGTTASCQNR | |
| KEDKVWWTS | | KEDKVWWTS | | KNITEIVYLN | | LEHTSKYVCTG | |
| KEDRRYGPA | | KEDRRYGPA | | KNITKIVYLN | | LEHTSRYICTG | |
| KEDRVWWTS | | KEDRVWWTS | | KNITVTHAQD | | LEHTSRYVCTG | |
| KEEALKGSA | | KEEALKGSA | | KNITVTHSVE | | LEICFMYSDFH | |
| KEEALQGSA | | KEEALQGSA | | KNITVTHSVN | | LEIGARIGEGQ | |
| KEECYRACF | | KEECYRACF | | KNLESRSGFE | | LEIGTRIGDGQ | |
| KEEKVWWTS | | KEEKVWWTS | | KNLFDEVKRR | | LEKAHNGKLCR | |
| KEEPLKGSA | | KEEPLKGSA | | KNLFDEVRRR | | LEKNITVTHSV | |
| KEESQLKRQ | | KEESQLKRQ | | KNLYDKVRLQ | | LEKNVTVTHAQ | |
| KEETLKGSA | | KEETLKGSA | | KNLYDKVRMQ | | LEKNVTVTHSI | |
| KEEVINATE | | KEEVINATE | | KNLYDRVRLQ | | LEKNVTVTHSV | |
| KEEVLKGSA | | KEEVLKGSA | | KNLYEKVRLQ | | LEKRIENLNKK | |
| KEEVTNATE | | KEEVTNATE | | KNLYEKVRMQ | | LEKRLENLDKK | |
| KEFEQVEGR | | KEFEQVEGR | | KNLYNKVRMQ | | LEKRLENLNKK | |
| KEFGNLERR | | KEFGNLERR | | KNNAIDEGDG | | LEKRLGNLNKK | |
| KEFGQVEGR | | KEFGQVEGR | | KNNAKDEGNG | | LEKSRINGVKL | |
| KEFNNLEKR | | KEFNNLEKR | | KNNMINNDLG | | LEKTHNGKLCK | |
| KEFNNLERR | | KEFNNLERR | | KNNQVILCEP | | LEKTHNGKLCR | |
| KEFSEIEGR | | KEFSEIEGR | | KNNQVILCEQ | | LEKYIEDTKID | |
| KEFSEVEGR | | KEFSEVEGR | | KNNQVILCGP | | LEKYVEDTKID | |
| KEFSNLEKR | | KEFSNLEKR | | KNNTWVNQTY | | LEKYVEDTKVD | |
| KEFSNLERR | | KEFSNLERR | | KNNWSGYSGI | | LELGDCSIAGW | |
| KEFTEVEGR | | KEFTEVEGR | | KNPALRMKWM | | LELGNCSIAGW | |
| KEGRRKTNL | | KEGRRKTNL | | KNPAYCNTDL | | LELIRMIKRGI | |
| KEGRRRTNL | | KEGRRRTNL | | KNPEAYNFNE | | LELRDCKIEAV | |
| KEGSYFFGD | | KEGSYFFGD | | KNPSLRMKWM | | LELRDCKVEAV | |
| KEGYSLVGI | | KEGYSLVGI | | KNPYTLVSTK | | LELRDCSIAGW | |
| KEGYSLVGV | | KEGYSLVGV | | KNQEELRSLF | | LELRSGYWAIR | |
| KEICIAWSS | | KEICIAWSS | | KNRSPYRALM | | LELRSKYWAIR | |
| KEICVAWSS | | KEICVAWSS | | KNSDLEALME | | LELRSRYWAIR | |
| KEIEGICYP | | KEIEGICYP | | KNSFYAELKW | | LEMCHGTQIGG | |
| KEIGNGCFE | | KEIGNGCFE | | KNSNGVQDII | | LEMCHSTQIGG | |
| KEIVYLNNT | | KEIVYLNNT | | KNSRSGYETF | | LEMCHSTQVGG | |
| KEKAIWTSG | | KEKAIWTSG | | KNTDLEALME | | LEMCHSTRIGG | |
| KEKDLTKEF | | KEKDLTKEF | | KNTDLEVLME | | LEMIRGKPEEG | |
| KEKDMTKEF | | KEKDMTKEF | | KNTNTLSSVT | | LEMIRGKPEER | |
| KEKDMTREF | | KEKDMTREF | | KNTYVNNTTI | | LEMIRGKPKER | |
| KEKEICSVV | | KEKEICSVV | | KNVPEKIHTR | | LEMIRGRPEER | |
| KEKENSYPK | | KEKENSYPK | | KNVPEKIRTR | | LENDKTLDLHD | |
| KEKENSYPM | | KEKENSYPM | | KNVPEKIRVK | | LENDKTLDMHD | |
| KEKNDLYGT | | KEKNDLYGT | | KNVTVTHAKD | | LENDKTLNMHD | |
| KEKNELYGT | | KEKNELYGT | | KNVTVTHAQD | | LENDRTLDLHD | |
| KEKTIWTSG | | KEKTIWTSG | | KNVTVTHAQN | | LENEKTLDLHD | |
| KEKVTNATE | | KEKVTNATE | | KNVTVTHAVN | | LENERTLDFHD | |
| KELGNGCFE | | KELGNGCFE | | KNVTVTHSIE | | LENERTLDLHD | |
| KELVETNHT | | KELVETNHT | | KNVTVTHSIN | | LENERTLDYHD | |
| KEMCAAWSS | | KEMCAAWSS | | KNVTVTHSVD | | LENGRTLDLHD | |

Fig. 83-189

| Block size 8 | SIN | Block size 9 | SIN | Block size 10 | SIN | Block size 11 | SIN |
|---|---|---|---|---|---|---|---|
| KEMEGICYP | | KEMEGICYP | | KNVTVTHSVE | | LENGRTLGLHD | |
| KEMEGVCYP | | KEMEGVCYP | | KNVTVTHSVN | | LENKHSNGTKH | |
| KEMGNGCFE | | KEMGNGCFE | | KNWILWISFA | | LENLNKKMEDG | |
| KENKKYGPA | | KENKKYGPA | | KNWSGYSGAF | | LENLNKKVEDG | |
| KENKRYGPA | | KENKRYGPA | | KNWSGYSGSF | | LENLNKRMEDG | |
| KENPAHKSQ | | KENPAHKSQ | | KPCFWVELIR | | LENLQAYQKRM | |
| KENTGSYVR | | KENTGSYVR | | KPDIYDFNEG | | LENLQAYQNRM | |
| KEPALIVWG | | KEPALIVWG | | KPDTYDFNEG | | LENLQTYQKRM | |
| KEPDTYDFN | | KEPDTYDFN | | KPFQNICKPY | | LENLSKRMEDG | |
| KEPISLGDC | | KEPISLGDC | | KPFQNTSKHY | | LENQHTIDLAD | |
| KEPMGFRYS | | KEPMGFRYS | | KPFQNTSRHY | | LENQHTIDLTD | |
| KEQLGSWSW | | KEQLGSWSW | | KPFQNVNKIT | | LENQHTIDMTD | |
| KEQLSTVSS | | KEQLSTVSS | | KPFQNVNKVT | | LENQHTIDVTD | |
| KEQTALYKN | | KEQTALYKN | | KPFQNVNRIT | | LENQHTIHLTD | |
| KEQTTLYKN | | KEQTTLYKN | | KPFQNVSRIA | | LENQKILDEHD | |
| KERLGSWSW | | KERLGSWSW | | KPGETLKVES | | LENQKTLDEHD | |
| KERTIWTSG | | KERTIWTSG | | KPGETLNIES | | LENQKTLDKHD | |
| KERTSIWTS | | KERTSIWTS | | KPGETLNVES | | LENQNTIDLTD | |
| KESLRLAIG | | KESLRLAIG | | KPGQTLRIIS | | LEPGTFDIEGL | |
| KESLRLALG | | KESLRLALG | | KPGQTLRIRS | | LEPGTFDIGGL | |
| KESLRLAVG | | KESLRLAVG | | KPGQTLRVKS | | LEPGTFDLEGL | |
| KESMGFRYS | | KESMGFRYS | | KPGQTLRVRS | | LEPGTFDLGGL | |
| KESRLNRQE | | KESRLNRQE | | KPGQTVKIKT | | LEQNVTVTHAK | |
| KESRSGYET | | KESRSGYET | | KPGQTVKIQT | | LEQSGLPVGGN | |
| KESTQKAID | | KESTQKAID | | KPKFLPDLYD | | LERELVRKTRF | |
| KETGNGCFE | | KETGNGCFE | | KPKSLPDLYD | | LERNVTVTHAK | |
| KETNGNYGP | | KETNGNYGP | | KPKYLPDLYD | | LERNVTVTHAQ | |
| KETRVWWTS | | KETRVWWTS | | KPLCAVNSWH | | LERNVTVTHSV | |
| KEVGNGCFE | | KEVGNGCFE | | KPLCEVNSWH | | LERRIENLNKK | |
| KEVILWFSF | | KEVILWFSF | | KPLCEVSSWH | | LERRIENLNRK | |
| KEWGNGCFE | | KEWGNGCFE | | KPLILKDCSV | | LERRIESLNKK | |
| KEWMHICMT | | KEWMHICMT | | KPLILRDCSV | | LERRLENLNKK | |
| KEWMHVCIT | | KEWMHVCIT | | KPLQNTSKHY | | LERRLENLSKR | |
| KEWMHVCMA | | KEWMHVCMA | | KPNGCIEGKL | | LERSKINEVKL | |
| KEWMHVCMT | | KEWMHVCMT | | KPNIGPRPFV | | LERSKINGVIL | |
| KEWMHVSMT | | KEWMHVSMT | | KPNIGPRPLV | | LERSKINGVKL | |
| KEWSKRYEL | | KEWSKRYEL | | KPQCEITGFA | | LERSKINGVRL | |
| KEWSRRYEL | | KEWSRRYEL | | KPQCHITGFA | | LERTHNGKLCK | |
| KEYEEEAKL | | KEYEEEAKL | | KPQCKITGFA | | LERYVEDTKID | |
| KFAAICTHL | | KFAAICTHL | | KPQCLITGFA | | LESRSGFEMIW | |
| KFAAICTHM | | KFAAICTHM | | KPQCQIAGFA | | LESRSGFEMVW | |
| KFASICTHL | | KFASICTHL | | KPQCQITGFA | | LETGYICSKFH | |
| KFCYPGELD | | KFCYPGELD | | KPQCQITGFV | | LETGYVCGKFH | |
| KFEAVAWSA | | KFEAVAWSA | | KPQCQITGSA | | LETGYVCSKFH | |
| KFEEIKWLI | | KFEEIKWLI | | KPQCQVTGFA | | LEVCFMYSDFH | |
| KFEEIRWLI | | KFEEIRWLI | | KPRFLPDLYD | | LEVGTRWMKII | |
| KFEEIRWMI | | KFEEIRWMI | | KPRGLFGAIA | | LFALSGVAIAL | |
| KFEEMRWLI | | KFEEMRWLI | | KPRPRRGLFG | | LFALSGVAISL | |
| KFEEVRWLI | | KFEEVRWLI | | KPRYLPDLYD | | LFALSGVAITL | |
| KFEFIAEDF | | KFEFIAEDF | | KPWARNILRT | | LFALSGVAVAL | |
| KFEFIAEEF | | KFEFIAEEF | | KPYIGKCPKY | | LFASSGIAIAL | |
| KFEFIVEKF | | KFEFIVEKF | | KQAKGLFGAI | | LFASSGIAIVL | |
| KFESVAWSA | | KFESVAWSA | | KQASYKIFKS | | LFDEVKRRLSA | |
| KFFPSSSYR | | KFFPSSSYR | | KQDGKSSACK | | LFDEVKRRLST | |
| KFHQIEKEF | | KFHQIEKEF | | KQEFKMNPNK | | LFDEVRRRLSA | |
| KFHSDTPRP | | KFHSDTPRP | | KQEFKMNPNQ | | LFDEVRRRLST | |
| KFKADLIIE | | KFKADLIIE | | KQEIEGIKLK | | LFDEVRRRLSV | |
| KFLLMDALK | | KFLLMDALK | | KQEIKMNPNQ | | LFEKFFPSSSY | |
| KFLLMDSLK | | KFLLMDSLK | | KQESLLLATG | | LFERVKRQLRE | |
| KFLNNTEPL | | KFLNNTEPL | | KQESLMLATG | | LFERVRHQLRE | |
| KFLPDLYDY | | KFLPDLYDY | | KQETRVWWTS | | LFERVRRQLRE | |
| KFQTAAQKA | | KFQTAAQKA | | KQFELIDNEF | | LFFFCLKNGNM | |

Fig. 83-190

| Block size 8 | SIN | Block size 9 | SIN | Block size 10 | SIN | Block size 11 | SIN |
|---|---|---|---|---|---|---|---|
| KFQTAAQRA | | KFQTAAQRA | | KQGKTKATKM | | LFFWMCSNGSL | |
| KFTNEEALR | | KFTNEEALR | | KQGSLKLATG | | LFGAIAGFIEG | |
| KFYIQMCTE | | KFYIQMCTE | | KQGSLMLATG | | LFGAIAGFIEN | |
| KGANRPIIT | | KGANRPIIT | | KQGSLRLATG | | LFGAIAGFLEN | |
| KGANRPVII | | KGANRPVII | | KQIGNLINWT | | LFGAKAGFIEG | |
| KGANRPVIT | | KGANRPVIT | | KQIGNVINWT | | LFGAKAGFIEN | |
| KGCFDILHK | | KGCFDILHK | | KQILRTQESS | | LFIKDYRYTYR | |
| KGCFDLYHK | | KGCFDLYHK | | KQKSLLLATG | | LFLVCVSLLQS | |
| KGCFEIYHA | | KGCFEIYHA | | KQKTLKLATG | | LFLYVRTNGTS | |
| KGCFEIYHK | | KGCFEIYHK | | KQLGNVINWT | | LFMIIGGFIFG | |
| KGCFEIYHN | | KGCFEIYHN | | KQLRENAEDL | | LFNTIGNLIAP | |
| KGCFEIYHT | | KGCFEIYHT | | KQLRENAEDM | | LFQDILMRMSK | |
| KGCFELYHK | | KGCFELYHK | | KQLRENAEED | | LFQGGHIEECS | |
| KGCFELYHR | | KGCFELYHR | | KQLRENAEEM | | LFQQMRDILGT | |
| KGCFQPCFY | | KGCFQPCFY | | KQLRQNAEED | | LFQQMRDVLGT | |
| KGCINRCFY | | KGCINRCFY | | KQLTHHMRKK | | LFSGIKSFSRT | |
| KGDCYRACF | | KGDCYRACF | | KQMTRGLFGA | | LFSGIRSFSRT | |
| KGDIFVIRE | | KGDIFVIRE | | KQNGKSGACK | | LFSGVNSFSRT | |
| KGDIFVMRE | | KGDIFVMRE | | KQNGKSSACK | | LFSGYKDIILW | |
| KGDKICLGH | | KGDKICLGH | | KQNPTEEQAV | | LFSSIKKYERV | |
| KGDQICIGY | | KGDQICIGY | | KQNTLKLATG | | LFSSIKRYERV | |
| KGDRICIGY | | KGDRICIGY | | KQPISLGDCS | | LFTLSGVAIAL | |
| KGDVFVIRE | | KGDVFVIRE | | KQSSLPLALG | | LFVLMENERTL | |
| KGDVFVMRE | | KGDVFVMRE | | KQSTLKLATG | | LFVQSYFQLFL | |
| KGDYNNTTG | | KGDYNNTTG | | KQTKTMTITF | | LGAIAGFIEGG | |
| KGECYRACF | | KGECYRACF | | KQTRGIFGAI | | LGAINTTLPFH | |
| KGEKANVLI | | KGEKANVLI | | KQTRGLFGAI | | LGAISFWMCSG | |
| KGEYNNTTG | | KGEYNNTTG | | KQTSLLLATG | | LGAISFWMCSN | |
| KGFAFKYGN | | KGFAFKYGN | | KQVCAAWSSS | | LGALNTTLPFH | |
| KGFAPFSKD | | KGFAPFSKD | | KQVCIAWSSS | | LGAPLELRDCK | |
| KGFFPFHKD | | KGFFPFHKD | | KQVCMAWSSS | | LGAPLVLDDCS | |
| KGFGFRQGD | | KGFGFRQGD | | KQVCVAWSSS | | LGAVSFWMCSN | |
| KGFGFRQGN | | KGFGFRQGN | | KQVDTIMEKN | | LGCKMYALHQG | |
| KGFGFRQGT | | KGFGFRQGT | | KRCINRCFYV | | LGCRMYALHQG | |
| KGFNSFYRN | | KGFNSFYRN | | KRDSSILTDS | | LGDAPFLDRLR | |
| KGFSFKYGD | | KGFSFKYGD | | KREITFHGAK | | LGDCNFEGWIV | |
| KGFSFKYGN | | KGFSFKYGN | | KREITFYGAK | | LGDCPKYIKSG | |
| KGFSFRYGD | | KGFSFRYGD | | KREMTFHGAK | | LGDCRFEGWIV | |
| KGFSFRYGN | | KGFSFRYGN | | KRFADQELGD | | LGDCSFAGWIL | |
| KGFSYKYDN | | KGFSYKYDN | | KRGETLKIRT | | LGDCSFAGWLL | |
| KGFSYKYGN | | KGFSYKYGN | | KRGGSGIMKT | | LGDCSFEGWIG | |
| KGFSYRYGN | | KGFSYRYGN | | KRGINDRNFW | | LGDCSFEGWIV | |
| KGGPGVKGF | | KGGPGVKGF | | KRGLFGAIAG | | LGDCSIAGWLL | |
| KGGSIKTKL | | KGGSIKTKL | | KRGNSGIMKT | | LGECPKYIKSD | |
| KGGSINTKL | | KGGSINTKL | | KRGSSGIMKT | | LGENIAPEKVD | |
| KGHVFVIRE | | KGHVFVIRE | | KRGSSGIVKT | | LGENMAPEKID | |
| KGIEVVNAT | | KGIEVVNAT | | KRGSSGVMKT | | LGENMAPEKMD | |
| KGILEDEQM | | KGILEDEQM | | KRGVNDRNFW | | LGENMAPEKVD | |
| KGILGFVFT | | KGILGFVFT | | KRIENLNKKM | | LGFIMWACQKG | |
| KGKFQTAAQ | | KGKFQTAAQ | | KRIGSCTSPC | | LGFIMWACQRG | |
| KGKKAVDLG | | KGKKAVDLG | | KRINMIADRV | | LGFIMWTCQKG | |
| KGLCIINSW | | KGLCIINSW | | KRINMINDKI | | LGFIVWACQRG | |
| KGLCTINSW | | KGLCTINSW | | KRINMISDKI | | LGFVFTLTVPS | |
| KGLFGAIAG | | KGLFGAIAG | | KRINMLADRI | | LGFVLWACQNG | |
| KGLILGNPK | | KGLILGNPK | | KRINMLADRV | | LGFVMWACQKG | |
| KGLWDSFRQ | | KGLWDSFRQ | | KRINMLADWV | | LGGCSFAGWIL | |
| KGMLGFVFT | | KGMLGFVFT | | KRINVINDKI | | LGGTISPRSRS | |
| KGNAKDEGN | | KGNAKDEGN | | KRIRLFDYSG | | LGHHAIPNGTI | |
| KGNGCFEIF | | KGNGCFEIF | | KRIRLFDYSK | | LGHHAVANGTI | |
| KGNIKCNIC | | KGNIKCNIC | | KRIRLFDYSR | | LGHHAVANGTK | |
| KGNIMRTQE | | KGNIMRTQE | | KRIRMAINLV | | LGHHAVANGTR | |
| KGNIRCDIC | | KGNIRCDIC | | KRIRMAINQC | | LGHHAVANGTV | |

Fig. 83-191

| Block size 8 | SIN | Block size 9 | SIN | Block size 10 | SIN | Block size 11 | SIN |
|---|---|---|---|---|---|---|---|
| KGNIRCNIC | | KGNIRCNIC | | KRIRMAINWG | | LGHHAVENGTS | |
| KGNPGVKGW | | KGNPGVKGW | | KRIRMAINYS | | LGHHAVPNGTI | |
| KGNQGVKGW | | KGNQGVKGW | | KRIRMATNEC | | LGHHAVPNGTK | |
| KGNSARLIH | | KGNSARLIH | | KRKKRGLFGA | | LGHHAVPNGTL | |
| KGRGLFGAI | | KGRGLFGAI | | KRKRDSSILT | | LGHHAVPNGTM | |
| KGRHANGTI | | KGRHANGTI | | KRKRGLFGAI | | LGHHAVPNGTV | |
| KGRIDYYWS | | KGRIDYYWS | | KRKRKTRGLF | | LGHHAVSNGTI | |
| KGRIFQSHI | | KGRIFQSHI | | KRKRNSSILT | | LGHHAVSNGTK | |
| KGRIFQSPI | | KGRIFQSPI | | KRKTRGLFGA | | LGHHAVTNGTK | |
| KGRIFQSRI | | KGRIFQSRI | | KRLAVLGKDA | | LGIINLLIGIS | |
| KGRLCNPLN | | KGRLCNPLN | | KRLCTINSWH | | LGIITGPPQCD | |
| KGRSHLRND | | KGRSHLRND | | KRLGSWSWHD | | LGILTGPPQCD | |
| KGRYGVKGF | | KGRYGVKGF | | KRLLRENAEE | | LGINMSKKKSY | |
| KGSAKHIEE | | KGSAKHIEE | | KRLTIIGKDA | | LGIPFHLGTKQ | |
| KGSARHIEE | | KGSARHIEE | | KRLTILGKDA | | LGIQSDAQIDE | |
| KGSIQSDKP | | KGSIQSDKP | | KRLTTTIKTW | | LGITGPDATAV | |
| KGSNRPIID | | KGSNRPIID | | KRLTVLGKDA | | LGITGPDSTAV | |
| KGSNRPIVD | | KGSNRPIVD | | KRLVLATGLR | | LGITGPDTTAV | |
| KGSNRPVID | | KGSNRPVID | | KRMTRGLFGA | | LGKVECVCRDN | |
| KGSNRPVVD | | KGSNRPVVD | | KRNEIKGVEL | | LGLDIRTATRE | |
| KGSNRPWIR | | KGSNRPWIR | | KRNEIKGVKL | | LGLHDANVRNL | |
| KGSNRPWMR | | KGSNRPWMR | | KRNITEIVYL | | LGLNIGLHLKP | |
| KGSNRPWVR | | KGSNRPWVR | | KRNRSILNTS | | LGLNIGLHLRP | |
| KGSYNNTNG | | KGSYNNTNG | | KRNSSILTDS | | LGLNVGLHLKP | |
| KGSYNNTSG | | KGSYNNTSG | | KRPVTEINTW | | LGLRISSSFSF | |
| KGTNSFYRN | | KGTNSFYRN | | KRQEIDGIKL | | LGLRNTPSIEP | |
| KGTYDYPKY | | KGTYDYPKY | | KRQEIEGIKL | | LGLSMVKSDKI | |
| KGVELSSMG | | KGVELSSMG | | KRQEIEGIRL | | LGLSMVRSDKI | |
| KGVEVVNAT | | KGVEVVNAT | | KRQEINGIKL | | LGLVCATCEQI | |
| KGVKLSNMG | | KGVKLSNMG | | KRQLRENAED | | LGMKNVPEKIH | |
| KGVKLSSMG | | KGVKLSSMG | | KRQLRENAEE | | LGMKNVPEKIR | |
| KGVYINTAL | | KGVYINTAL | | KRQLRENAEK | | LGMQNGSCRCM | |
| KGVYINTAM | | KGVYINTAM | | KRRAIATPGM | | LGMQNGSYRCM | |
| KGVYMNTAL | | KGVYMNTAL | | KRRKKRGLFG | | LGNCPKYIKSG | |
| KGVYVNTAL | | KGVYVNTAL | | KRRPVAKAGF | | LGNCSIAGWLL | |
| KGWAFDNGD | | KGWAFDNGD | | KRSHEQMETG | | LGNGCFEFWHK | |
| KGWAFDNGN | | KGWAFDNGN | | KRSYEQMETD | | LGNGCFEFWHR | |
| KGWAFDSGD | | KGWAFDSGD | | KRSYEQMETG | | LGNGCFEFYHK | |
| KGWAFDYGN | | KGWAFDYGN | | KRSYEQMETS | | LGNGCFEFYHR | |
| KGWAFDYGS | | KGWAFDYGS | | KRSYNNTSGE | | LGNGCFKIYHK | |
| KGWAPLSKD | | KGWAPLSKD | | KRTNMINDKI | | LGNLNKKMEDG | |
| KGWILGNPR | | KGWILGNPR | | KRTVSSFYSE | | LGNPECDRLLI | |
| KGYGVKGFG | | KGYGVKGFG | | KRVRLFDYSR | | LGNPECDRLLN | |
| KHDRIPHRT | | KHDRIPHRT | | KRYELEIGAR | | LGNPECDRLLR | |
| KHDSNVKNL | | KHDSNVKNL | | KRYELEIGTR | | LGNPECDRLLS | |
| KHENRMVLA | | KHENRMVLA | | KRYERVKMFD | | LGNPECDRLLT | |
| KHFEKVKIL | | KHFEKVKIL | | KRYGPALSIN | | LGNPKCDLYLN | |
| KHFEKVRIL | | KHFEKVRIL | | KRYGPALSIS | | LGNPKCDLYLS | |
| KHIEECSCY | | KHIEECSCY | | KSCINRCFYV | | LGNPKCDPYLN | |
| KHIVERILE | | KHIVERILE | | KSCLPACAYG | | LGNPMCDDLIG | |
| KHLAYCNTD | | KHLAYCNTD | | KSCLPACIYG | | LGNPMCDELIG | |
| KHLEECSCY | | KHLEECSCY | | KSCLPACVYG | | LGNPMCDNLIG | |
| KHPAYCNTD | | KHPAYCNTD | | KSCVNRCFYV | | LGNPMCDYLIG | |
| KHQNAQGEG | | KHQNAQGEG | | KSDKICIGYH | | LGNPRCDDLIG | |
| KHRFEIIEG | | KHRFEIIEG | | KSDKICLGHH | | LGNVINWTRDS | |
| KHSAYCNTD | | KHSAYCNTD | | KSDKRIGSCT | | LGNYKEICIAW | |
| KHSNDTIHD | | KHSNDTIHD | | KSDQLKLATG | | LGNYKEICVAW | |
| KHSNDTVHD | | KHSNDTVHD | | KSDRICIGYH | | LGNYKEIRIAW | |
| KHSNETVKD | | KHSNETVKD | | KSDRLVLAIG | | LGNYREICIAW | |
| KHSNGTAKD | | KHSNGTAKD | | KSDRLVLATG | | LGNYREVCIAW | |
| KHSNGTIHD | | KHSNGTIHD | | KSEDNVYKVL | | LGPATAQMALQ | |
| KHSNGTIKD | | KHSNGTIKD | | KSEKLVLATG | | LGQFPVQTDEY | |

Fig. 83-192

| Block size 8 | SIN | Block size 9 | SIN | Block size 10 | SIN | Block size 11 | SIN |
|---|---|---|---|---|---|---|---|
| KHSNGTKHD | | KHSNGTKHD | | KSEQFPVQTD | | LGQGTTLDNEH | |
| KHSNGTMKD | | KHSNGTMKD | | KSERLVLATG | | LGQGTTLDNKH | |
| KHSNGTTHD | | KHSNGTTHD | | KSFSRTELIA | | LGQGTTLENKH | |
| KHSNGTVKD | | KHSNGTVKD | | KSFSRTQLIA | | LGQGTTLNNKH | |
| KHSNGTVND | | KHSNGTVND | | KSGQFPVQTD | | LGQGTTLYNKH | |
| KHSNNTVKD | | KHSNNTVKD | | KSGQLKLATG | | LGQVECVCRDN | |
| KHSNNTVRD | | KHSNNTVRD | | KSHGRILKND | | LGQWDWPDGAK | |
| KHSNSTTHD | | KHSNSTTHD | | KSHGRILKNN | | LGQWNWPDGAE | |
| KHTSQYICS | | KHTSQYICS | | KSHGRVLKNN | | LGQWNWPDGAK | |
| KHTSQYLCT | | KHTSQYLCT | | KSITQTLVSN | | LGRTFSPRSRS | |
| KHYIGKCPK | | KHYIGKCPK | | KSKCFWRGGS | | LGRTISKDLRS | |
| KHYIGKCPR | | KHYIGKCPR | | KSKLFTLSGV | | LGRTISKDSRS | |
| KIAHISPLS | | KIAHISPLS | | KSLCEVNSWH | | LGRTISKDTRS | |
| KICIGYHAN | | KICIGYHAN | | KSLCKIEGWV | | LGRTISPKLRS | |
| KICIGYLSN | | KICIGYLSN | | KSLCKVEEWV | | LGRTISPRLRS | |
| KICIGYQTN | | KICIGYQTN | | KSLCKVEGWV | | LGRTISPRSRN | |
| KICLGHHAE | | KICLGHHAE | | KSLCNVEGWV | | LGRTISPRSRS | |
| KICLGHHAV | | KICLGHHAV | | KSLCSVEGWV | | LGRTISYSSRS | |
| KICLGRHAV | | KICLGRHAV | | KSLESRSGFE | | LGRTTSKDSRS | |
| KICVGYLST | | KICVGYLST | | KSLFSSIKKY | | LGRTVSINGRS | |
| KIDDQIEDL | | KIDDQIEDL | | KSLGIQSDAQ | | LGRTVSISGRS | |
| KIDDQIEEL | | KIDDQIEEL | | KSLIWLWLVL | | LGRTVSNSGRS | |
| KIDDQIEGL | | KIDDQIEGL | | KSLKLASGLR | | LGRTVSTSGRS | |
| KIDDQIENL | | KIDDQIENL | | KSLKLATGLR | | LGSAQHVEECS | |
| KIDLWSYNA | | KIDLWSYNA | | KSLKLATGPR | | LGSCGILGTII | |
| KIDTILERN | | KIDTILERN | | KSLKLVTGLR | | LGSPGCDRLQD | |
| KIDTLTETG | | KIDTLTETG | | KSLLLATGMR | | LGSPLELRDCK | |
| KIEAVIYGN | | KIEAVIYGN | | KSLMLATGMR | | LGSPLVLDDCS | |
| KIEFEPFQS | | KIEFEPFQS | | KSLPDLYDYK | | LGSPPIVSNSD | |
| KIEGRVQDL | | KIEGRVQDL | | KSLRGRGSTL | | LGSPPIVSNSE | |
| KIEKIEKIR | | KIEKIEKIR | | KSLYDKVRMQ | | LGSPPMVSNSD | |
| KIHNAGTDP | | KIHNAGTDP | | KSNAIDEGDG | | LGSPPVVSNSD | |
| KIHTRGLFG | | KIHTRGLFG | | KSQLIWMACH | | LGSSFYAEMKW | |
| KIIHISPLS | | KIIHISPLS | | KSQLVWMACH | | LGSSPNAYQAK | |
| KIIQNEDIP | | KIIQNEDIP | | KSQLVWMACN | | LGSSPNAYQAQ | |
| KIIRVGCVI | | KIIRVGCVI | | KSRGYKMNIQ | | LGSSPNAYQAR | |
| KIITIDSVS | | KIITIDSVS | | KSRGYKMNNQ | | LGSSSNAYQAK | |
| KIITIGSAS | | KIITIGSAS | | KSRGYKMNTK | | LGSWSWHDGAE | |
| KIITIGSIS | | KIITIGSIS | | KSRGYKMNTQ | | LGTIIGPPQCD | |
| KIITIGSVS | | KIITIGSVS | | KSRGYKMNTR | | LGTITGPPQCD | |
| KIITMGSVS | | KIITMGSVS | | KSRINGVKLE | | LGTKQVCAAWS | |
| KIKHLEECS | | KIKHLEECS | | KSRSIIFNME | | LGTKQVCIAWS | |
| KIKMKWGME | | KIKMKWGME | | KSRSNIFNME | | LGTKQVCMAWS | |
| KIKTNGNLI | | KIKTNGNLI | | KSRVDNHSMS | | LGTKQVCVAWS | |
| KILCASATA | | KILCASATA | | KSTKSTVLKS | | LGTLIGPPQCD | |
| KILCTSAIA | | KILCTSAIA | | KSTPSAIDQI | | LGTPLELRDCK | |
| KILCTSATA | | KILCTSATA | | KSTQAAIDQI | | LGTPPTVSNSD | |
| KILDEHDSN | | KILDEHDSN | | KSTQAAIDQM | | LGTRQVCIAWS | |
| KILFASATA | | KILFASATA | | KSTQAAIDQV | | LGTRQVCMAWS | |
| KILFIEEGK | | KILFIEEGK | | KSTQAAINQI | | LGTRQVCVAWS | |
| KILKIKKGK | | KILKIKKGK | | KSTQAAVDQI | | LGTVTGPPQCD | |
| KILKIRKGK | | KILKIRKGK | | KSTQAAVNQI | | LGVPFHLATKQ | |
| KILRTHESE | | KILRTHESE | | KSTQEAIDKI | | LGVPFHLGTKQ | |
| KILRTQESE | | KILRTQESE | | KSTQEAIEKI | | LGVPFHLGTRQ | |
| KILRTQESS | | KILRTQESS | | KSTQEAIGKI | | LGVPFYLGTKQ | |
| KILSIYSCI | | KILSIYSCI | | KSTQEAINKI | | LGVSFHLGTKQ | |
| KILSIYSCV | | KILSIYSCV | | KSTQKTIDQV | | LGVSILNLGQK | |
| KILSIYSSV | | KILSIYSSV | | KSTQSAIDQI | | LGVSILNLGQR | |
| KILSIYSTV | | KILSIYSTV | | KSTQSAIDQV | | LGVSVLNLGQK | |
| KILTDTSRP | | KILTDTSRP | | KSTQSAINQI | | LGVWTYNAELL | |
| KILTIYSTA | | KILTIYSTA | | KSTQSAVDQI | | LGYETFKVIGG | |
| KILTIYSTV | | KILTIYSTV | | KSTQSAVNQI | | LGYGVKGFGFR | |

Fig. 83-193

| Block size 8 | SIN | Block size 9 | SIN | Block size 10 | SIN | Block size 11 | SIN |
|---|---|---|---|---|---|---|---|
| KILTSESQL | | KILTSESQL | | KSTQTAIDQI | | LGYSTGALASC | |
| KILYFHKGL | | KILYFHKGL | | KSTVLKSDKR | | LHDANVKNLHD | |
| KIMESGGID | | KIMESGGID | | KSVFNCLYAS | | LHDANVKNLHE | |
| KIMESGGIS | | KIMESGGIS | | KSVFNNLYAS | | LHDANVRNLHD | |
| KIMTIGSVS | | KIMTIGSVS | | KSVFNSIYAS | | LHDANVRNLHE | |
| KIMYFHKGL | | KIMYFHKGL | | KSVFNSLYAS | | LHDSNVKNLYD | |
| KINDQIEDL | | KINDQIEDL | | KSVFNSLYSS | | LHDSNVKNLYN | |
| KINEVKLEE | | KINEVKLEE | | KSVTQTLVSN | | LHDSNVRNLHE | |
| KINGKLNRL | | KINGKLNRL | | KSWKGNIMRT | | LHDSNVRSLHE | |
| KINGVILEE | | KINGVILEE | | KSWRKDILRT | | LHDSNVTNLHE | |
| KINGVKLEE | | KINGVKLEE | | KSWRRDILRT | | LHERVRKQLRE | |
| KINGVRLEE | | KINGVRLEE | | KSWSKPQCQI | | LHICVTGDDRN | |
| KINMINDKI | | KINMINDKI | | KSYFANLKGT | | LHIPEAGLKWE | |
| KINNIIDKM | | KINNIIDKM | | KSYINKTGTF | | LHIPEVCLKWD | |
| KINNIIEKM | | KINNIIEKM | | KSYINRTGTF | | LHIPEVCLKWE | |
| KINNIVDKM | | KINNIVDKM | | KTAYELTDSS | | LHIPEVCLKWG | |
| KINPVTLTM | | KINPVTLTM | | KTDGATSACK | | LHKCDNECMET | |
| KINRQEIEG | | KINRQEIEG | | KTEDNIYKIL | | LHKCDNKCMET | |
| KINSIIDKM | | KINSIIDKM | | KTEDNVYKIL | | LHKCNDSCMDT | |
| KINSWHIFG | | KINSWHIFG | | KTEDNVYKVL | | LHKCNDSCMEA | |
| KINTLTERG | | KINTLTERG | | KTFFLTQGAL | | LHKCNDSCMET | |
| KIPAQNAIS | | KIPAQNAIS | | KTFQNIDKNA | | LHKCNNECMET | |
| KIPNAETDP | | KIPNAETDP | | KTFQNIDRNA | | LHKCNNSCMET | |
| KIPNAGIDP | | KIPNAGIDP | | KTFQNIEKNA | | LHKCNNTCMET | |
| KIPNAGTDP | | KIPNAGTDP | | KTFQNIERNA | | LHLEFKADLII | |
| KIPVQNAIS | | KIPVQNAIS | | KTFQNISPVW | | LHLTGIWDTLI | |
| KIQHLEECS | | KIQHLEECS | | KTFQNVSPIW | | LHLTGKWDTLI | |
| KIQTNGNLI | | KIQTNGNLI | | KTFQNVSPLW | | LHLTGTWDTLI | |
| KIQTSGNLI | | KIQTSGNLI | | KTFQNVSPVW | | LHLTQGACWEQ | |
| KIQWSQDPT | | KIQWSQDPT | | KTGTFEFTSF | | LHLTQGTCWEQ | |
| KIQWSQEPT | | KIQWSQEPT | | KTGTYDYPKY | | LHNGGLIAPSR | |
| KIQWSQNPA | | KIQWSQNPA | | KTHNGKLCKL | | LHNIHPLTIGE | |
| KIQWSQNPS | | KIQWSQNPS | | KTHNGKLCRL | | LHQGTTIRNKH | |
| KIQWSQNPT | | KIQWSQNPT | | KTHNGRLCKL | | LHQGTTIRNRH | |
| KIRHLEECS | | KIRHLEECS | | KTIDQVTGKL | | LHVCITGDDRN | |
| KIRNGTYDH | | KIRNGTYDH | | KTITIGSVSL | | LHVCVTGDDGN | |
| KIRRRVDIN | | KIRRRVDIN | | KTIWTSGSSI | | LHVCVTGDDKN | |
| KIRRRVDMN | | KIRRRVDMN | | KTKATKMEAI | | LHVCVTGDDRN | |
| KIRRRVDTN | | KIRRRVDTN | | KTKATKMKAI | | LIAGGLILGMQ | |
| KIRRRVDVN | | KIRRRVDVN | | KTKCQTYAGA | | LIAGWYGFQHS | |
| KIRTNGNLI | | KIRTNGNLI | | KTKKMTITFL | | LIALCGSPFPV | |
| KIRTRGLFG | | KIRTRGLFG | | KTKLPFQNLS | | LIALCGSPFSV | |
| KIRVKRRPV | | KIRVKRRPV | | KTLDEHDANV | | LIAMENQHTID | |
| KISGVKLEE | | KISGVKLEE | | KTLDEHDSNV | | LIAPEFGYLLK | |
| KISHISPLS | | KISHISPLS | | KTLDKHDSNV | | LIAPEFGYLLR | |
| KISKRGGSG | | KISKRGGSG | | KTLDLHDANV | | LIAPEYGFKIS | |
| KISKRGNSG | | KISKRGNSG | | KTLDLHDSNV | | LIAPEYGFRIS | |
| KISKRGSSG | | KISKRGSSG | | KTLDMHDANV | | LIAPEYGHLIT | |
| KISKSTKST | | KISKSTKST | | KTLKLATGMR | | LIAPEYGHLTT | |
| KISLGHHAV | | KISLGHHAV | | KTLNMHDANV | | LIAPEYGHLVT | |
| KISRRGNSG | | KISRRGNSG | | KTLTDNHVEV | | LIAPEYGYLIT | |
| KISSSFSFG | | KISSSFSFG | | KTLTNEHEEV | | LIAPRGHYKIS | |
| KITCVCRDN | | KITCVCRDN | | KTLTNEKEEV | | LIAPRYGYIIE | |
| KITENSFEQ | | KITENSFEQ | | KTLTNEKEKV | | LICATCEQIAD | |
| KITFEATGN | | KITFEATGN | | KTLTNEQEEV | | LIDALLGDPHC | |
| KITGFAPFS | | KITGFAPFS | | KTLTSEKEEV | | LIDALLGDPQC | |
| KITLKFAFN | | KITLKFAFN | | KTMTITFLIL | | LIDGWYGFKHQ | |
| KITNKINNI | | KITNKINNI | | KTNDKYHQIE | | LIDGWYGFRHQ | |
| KITNKVNNI | | KITNKVNNI | | KTNEKFHQIE | | LIDGWYGYHHE | |
| KITVDHMAI | | KITVDHMAI | | KTNEKYHQIE | | LIDGWYGYKHQ | |
| KIVHISPLS | | KIVHISPLS | | KTNGNLIAPE | | LIDGWYGYRHQ | |
| KIVTTVGWS | | KIVTTVGWS | | KTNKQFELID | | LIDKTNQQFEL | |

Fig. 83-194

| Block size 8 | SIN | Block size 9 | SIN | Block size 10 | SIN | Block size 11 | SIN |
|---|---|---|---|---|---|---|---|
| KIYWHLMHP | | KIYWHLMHP | | KTNLYGFIIK | | LIDKTNQQFEM | |
| KKAKLANVV | | KKAKLANVV | | KTNLYGFIVK | | LIDNEFTEVEQ | |
| KKASLRLAV | | KKASLRLAV | | KTNQQFELID | | LIDSIGSWSQN | |
| KKATRRLIQ | | KKATRRLIQ | | KTNQQFELIN | | LIDSLLGDPHC | |
| KKAVDLGSC | | KKAVDLGSC | | KTNQQFEMID | | LIEDPAAPHGL | |
| KKEPDTYDF | | KKEPDTYDF | | KTNQQFGLID | | LIEDPGAPHGL | |
| KKESLRLAI | | KKESLRLAI | | KTNQQFKLID | | LIEDPNAPHKL | |
| KKESLRLAL | | KKESLRLAL | | KTNTEFESIE | | LIEDPNAPNKF | |
| KKESLRLAV | | KKESLRLAV | | KTNTQFELID | | LIEDPNAPNKL | |
| KKGTYDYPK | | KKGTYDYPK | | KTPYRSLIRF | | LIEDPSAPHGL | |
| KKHPAYCNT | | KKHPAYCNT | | KTRFLPVAGG | | LIEDPSAPHRL | |
| KKIDDGFLD | | KKIDDGFLD | | KTRFLPVSGG | | LIEDPTAPHGL | |
| KKILRTQES | | KKILRTQES | | KTRFLPVTGG | | LIEKTNDKYHQ | |
| KKINMINDK | | KKINMINDK | | KTRGLFGAIA | | LIEKTNEKYHQ | |
| KKKKKKRGL | | KKKKKKRGL | | KTRLFTIRQE | | LIEKTNKQFEL | |
| KKKKKRGLF | | KKKKKRGLF | | KTRPILSPLT | | LIEKTNQQFEL | |
| KKKKRGLFG | | KKKKRGLFG | | KTSIWTSSSS | | LIEKTNTEFES | |
| KKKNPEAYN | | KKKNPEAYN | | KTSTQKAINE | | LIEKTNTQFEL | |
| KKKPDIYDF | | KKKPDIYDF | | KTSWSYIVEK | | LIENDRTLDLH | |
| KKKPDTYDF | | KKKPDTYDF | | KTSWSYIVER | | LIENERTLDLH | |
| KKKRGLFGA | | KKKRGLFGA | | KTTVDHMAII | | LIENLQAYQKR | |
| KKKSYINKT | | KKKSYINKT | | KTVINNITTT | | LIENQKTLDEH | |
| KKKSYINRT | | KKKSYINRT | | KTVVHLNSTT | | LIENTYVNNTT | |
| KKLKREITF | | KKLKREITF | | KTWAGKILRT | | LIEQNIPVTQV | |
| KKLKREMTF | | KKLKREMTF | | KTWAGNILRT | | LIEQNVPVTQV | |
| KKMEDGFLD | | KKMEDGFLD | | KTWAKNILRT | | LIERTNEKYHQ | |
| KKMTITFLI | | KKMTITFLI | | KTWARNILRT | | LIERTNQQFEL | |
| KKNPEAYNF | | KKNPEAYNF | | KTYNNTTGRD | | LIETNHTGTYC | |
| KKPDIYDFN | | KKPDIYDFN | | KVARLGKGYM | | LIETTHTGTYC | |
| KKPDTYDFN | | KKPDTYDFN | | KVATGRVTVS | | LIFLARSALIL | |
| KKQEIEGIK | | KKQEIEGIK | | KVCRALLAKS | | LIFLARSALVL | |
| KKQILRTQE | | KKQILRTQE | | KVCRTLLAKS | | LIFMARSALIL | |
| KKQLRENAE | | KKQLRENAE | | KVCTKGKKAV | | LIFMCVKNGNL | |
| KKREKRGLF | | KKREKRGLF | | KVDGSSSACL | | LIFMCVKNGNM | |
| KKRGLFGAI | | KKRGLFGAI | | KVDLWSYNAE | | LIFSARSALIL | |
| KKRKKRGLF | | KKRKKRGLF | | KVDTIIENNV | | LIGISNVGLKV | |
| KKRLGSWSW | | KKRLGSWSW | | KVDTIIESNV | | LIGISNVGLNV | |
| KKRRKRGLF | | KKRRKRGLF | | KVDTILERNV | | LIGKNSWSYIV | |
| KKSYINKTG | | KKSYINKTG | | KVDTLTEKGI | | LIGKTNQQFEL | |
| KKSYINRTG | | KKSYINRTG | | KVDTLTENGV | | LIGKTSWSYIV | |
| KKTGGPIYK | | KKTGGPIYK | | KVDTLTETGV | | LIGQGDIVLVM | |
| KKTGGPIYR | | KKTGGPIYR | | KVDTNLERNV | | LIGQGDVVLVM | |
| KKTNEKFHQ | | KKTNEKFHQ | | KVEAVIYGNP | | LIGRTNQQFEL | |
| KKVDDGFID | | KKVDDGFID | | KVECICRDNW | | LIIAARNIVRR | |
| KKVDDGFLD | | KKVDDGFLD | | KVECIGWSST | | LIIAARSIVRR | |
| KKVDDGLLD | | KKVDDGLLD | | KVECVCRDNW | | LIIERRNSSDI | |
| KKYERVKMF | | KKYERVKMF | | KVEFEPFQSL | | LIIGISNVGLN | |
| KKYGPALSI | | KKYGPALSI | | KVEGWVVVAK | | LIIWGIHHPSS | |
| KKYTSARQE | | KKYTSARQE | | KVESNGNLIA | | LIKHENRMVLA | |
| KKYTSGRQE | | KKYTSGRQE | | KVGYLCAGIP | | LILAFILWACS | |
| KLAAICTHL | | KLAAICTHL | | KVKMKWGMEM | | LILAFIMWACS | |
| KLAIGLRNV | | KLAIGLRNV | | KVLAIYSCIA | | LILFNTIGNLI | |
| KLAIGPRNV | | KLAIGPRNV | | KVLSIYSCIA | | LILGFVLWACQ | |
| KLANVVRKM | | KLANVVRKM | | KVNGQAGRID | | LILGMQNGSCR | |
| KLAQGYKDI | | KLAQGYKDI | | KVNGVKLEEN | | LILGMQNGSYR | |
| KLASGLRNV | | KLASGLRNV | | KVNNIVDKMN | | LILGNPKCDLY | |
| KLATGLKNV | | KLATGLKNV | | KVNSIIDKMN | | LILGNPKCDPY | |
| KLATGLRNI | | KLATGLRNI | | KVNSIIEKMN | | LILKDCSIAGW | |
| KLATGLRNV | | KLATGLRNV | | KVNSIINKMN | | LILKDCSVAGW | |
| KLATGMRNI | | KLATGMRNI | | KVNSVIEKMN | | LILLENERTLD | |
| KLATGMRNV | | KLATGMRNV | | KVNSVVEKMN | | LILRDCSVAGW | |
| KLATGPRNV | | KLATGPRNV | | KVNTIIENNV | | LILRGAVAHKS | |

Fig. 83-195

| Block size 8 | SIN | Block size 9 | SIN | Block size 10 | SIN | Block size 11 | SIN |
|---|---|---|---|---|---|---|---|
| KLCFPGELD | | KLCFPGELD | | KVNTIIESNV | | LILRGSIAHKS | |
| KLCFPGEVD | | KLCFPGEVD | | KVNTLTEKGI | | LILRGSVAHKS | |
| KLCKLNGIP | | KLCKLNGIP | | KVNTLTEKGV | | LILSNPKCDLY | |
| KLCRLRGIP | | KLCRLRGIP | | KVNTLTEREV | | LILVALALSHT | |
| KLCRLSGIP | | KLCRLSGIP | | KVNTLTERGI | | LIMRTVIALSY | |
| KLCYPGELD | | KLCYPGELD | | KVNTLTERGV | | LIMWGIHHPSS | |
| KLCYPGEVD | | KLCYPGEVD | | KVPEWSYIVE | | LINDPWVLLNA | |
| KLDINMADY | | KLDINMADY | | KVPNAGTDPN | | LINGALGSPGC | |
| KLEDVFAGK | | KLEDVFAGK | | KVPNALIDDR | | LINGWYGFQHQ | |
| KLEENSTYK | | KLEENSTYK | | KVPNALTDDK | | LINGWYGFQHR | |
| KLEENTSYK | | KLEENTSYK | | KVPNALTDDR | | LINGWYGFRHQ | |
| KLEENTTYK | | KLEENTTYK | | KVPNALTDER | | LINTYQWIIRN | |
| KLEENTTYR | | KLEENTTYR | | KVPNALTDNR | | LIPMISKCKTK | |
| KLEFEPFQS | | KLEFEPFQS | | KVPVTQTMEL | | LIPMISKCRTK | |
| KLEFIAEEF | | KLEFIAEEF | | KVQHLEECSC | | LIPMISKCRTR | |
| KLEKSRING | | KLEKSRING | | KVRHQLRDNA | | LIPMISKSRTK | |
| KLEQSGLPV | | KLEQSGLPV | | KVRLQLKDNA | | LIPMISNCRTK | |
| KLERSKINE | | KLERSKINE | | KVRLQLRDNA | | LIQGYKDIILW | |
| KLERSKING | | KLERSKING | | KVRMQLKDNA | | LIRALTLNTMT | |
| KLFALSGVA | | KLFALSGVA | | KVRMQLRDNA | | LIRGNSPIFNY | |
| KLFASSGIA | | KLFASSGIA | | KVRMQLRDNV | | LIRGNSPVFNY | |
| KLFERVKRQ | | KLFERVKRQ | | KVRNGTYDHK | | LIRGQQGRMDY | |
| KLFERVRHQ | | KLFERVRHQ | | KVRRQLRENA | | LIRGRPEEAKY | |
| KLFERVRRQ | | KLFERVRRQ | | KVSCVCRDNW | | LIRGRPEEVKY | |
| KLFTLSGVA | | KLFTLSGVA | | KVSTQKAINE | | LIRGRPKEDEV | |
| KLGQFPVQT | | KLGQFPVQT | | KVSTQKALNE | | LIRGRPKEDKV | |
| KLGSPLVLD | | KLGSPLVLD | | KVTCICRDNW | | LIRGRPKEDRV | |
| KLIDNEFTE | | KLIDNEFTE | | KVTCVCRDNW | | LIRGRPKEEKV | |
| KLILATGLR | | KLILATGLR | | KVTHRENLLL | | LIRHENRMVIA | |
| KLIQGYKDI | | KLIQGYKDI | | KVVHISPLSG | | LIRHENRMVLA | |
| KLIQLIVSG | | KLIQLIVSG | | KVWWTSNSII | | LIRMIKRGIND | |
| KLITVGSSK | | KLITVGSSK | | KVWWTSNSIV | | LIRMIKRGVND | |
| KLKREITFH | | KLKREITFH | | KWALGENMAP | | LIRMVKRGIND | |
| KLKREMTFH | | KLKREMTFH | | KWDTLIEREN | | LIRTLTLNTMT | |
| KLKRNEIKG | | KLKRNEIKG | | KWGDILDGVT | | LISDGGPNLYN | |
| KLKRQEIDG | | KLKRQEIDG | | KWGDILEGTT | | LISKTNQQFEL | |
| KLKRQEIEG | | KLKRQEIEG | | KWGDVLDGVT | | LISTPLGSPPI | |
| KLKRQEING | | KLKRQEING | | KWGMELRRCL | | LISTPLGSPPM | |
| KLKRRAIAT | | KLKRRAIAT | | KWGMEMRRCL | | LISTPLGSPPV | |
| KLKSEDNVY | | KLKSEDNVY | | KWGMVLDGVT | | LISTPLGTPPT | |
| KLKTEDNIY | | KLKTEDNIY | | KWLISKSKEQ | | LISWEMGLAPS | |
| KLKTEDNVY | | KLKTEDNVY | | KWLLSSKANQ | | LISWEMGQAPS | |
| KLLGINMSK | | KLLGINMSK | | KWLLSSKDNQ | | LISWGMGQAPS | |
| KLLKERGFF | | KLLKERGFF | | KWLSSSGNNQ | | LISWPLSSPPT | |
| KLLPFAAAP | | KLLPFAAAP | | KWLSSSMNNQ | | LISWPQSSPPT | |
| KLLPFASAP | | KLLPFASAP | | KWLTLKSGQF | | LITDGPSDAQA | |
| KLLVLIEND | | KLLVLIEND | | KWLVSKDKGR | | LITDGPSNAQA | |
| KLLVLLEND | | KLLVLLEND | | KWLVSKNKGQ | | LITGKSHGRIL | |
| KLLVLLENE | | KLLVLLENE | | KWLVSKSKGQ | | LITGKSHGRVL | |
| KLLVLLENG | | KLLVLLENG | | KWLVSKTKGQ | | LITVGSSKYQQ | |
| KLNGIPPLE | | KLNGIPPLE | | KWMMAMKYPI | | LITVGSSKYRQ | |
| KLNNVIDKM | | KLNNVIDKM | | KWMMAMRYPI | | LITWGIHHPSS | |
| KLNRFIEKT | | KLNRFIEKT | | KWNENQNPRI | | LIVFNTIGNLI | |
| KLNRIIEKT | | KLNRIIEKT | | KWNENQNPRM | | LIVFNTIGNLV | |
| KLNRLIDKT | | KLNRLIDKT | | KWNENQNPRV | | LIVLLENQKTL | |
| KLNRLIDRT | | KLNRLIDRT | | KWNVTHTGTS | | LIVSLGAISFW | |
| KLNRLIEKT | | KLNRLIEKT | | KWNVTYTGIS | | LIVWGIHHPSS | |
| KLNRLIERT | | KLNRLIERT | | KWNVTYTGTS | | LIVWGVHHSSS | |
| KLNRLIGKT | | KLNRLIGKT | | KWREQLSQKF | | LIWLWLVLREK | |
| KLNRLISKT | | KLNRLISKT | | KWSGYSGSFI | | LIWMACHSAAF | |
| KLNRNEIKG | | KLNRNEIKG | | KWTLGENMAP | | LKAEIAQKLED | |
| KLNRQEIEG | | KLNRQEIEG | | KWVLGENMAP | | LKAEIAQRLED | |

Fig. 83-196

| Block size 8 | SIN | Block size 9 | SIN | Block size 10 | SIN | Block size 11 | SIN |
|---|---|---|---|---|---|---|---|
| KLNRQEIGG | | KLNRQEIGG | | KWWVWLWLVL | | LKAEIAQRLEG | |
| KLNRSEIKG | | KLNRSEIKG | | KYDGIITDTI | | LKAEIAQRLEN | |
| KLNRTEIKG | | KLNRTEIKG | | KYDNGVWIGR | | LKAEIAQRLES | |
| KLPFQNLSP | | KLPFQNLSP | | KYEEESKLKR | | LKDCSVAGWLL | |
| KLRLATGLR | | KLRLATGLR | | KYEEESKLNK | | LKDEEKIPKTK | |
| KLRMATGLR | | KLRMATGLR | | KYEEESKLNR | | LKDGNMRCTIC | |
| KLRMVTGLR | | KLRMVTGLR | | KYEEESRLNR | | LKDNAIDEGDG | |
| KLRSGFEML | | KLRSGFEML | | KYERVKMFDF | | LKDNAKDEGNG | |
| KLSGGYKDI | | KLSGGYKDI | | KYGDGVWIGR | | LKDNAKDLGNG | |
| KLSGGYKDV | | KLSGGYKDV | | KYGNGAWIGR | | LKDNAKEIGNG | |
| KLSIEDPDH | | KLSIEDPDH | | KYGNGVWIGR | | LKDNAKELGNG | |
| KLSIEDPNH | | KLSIEDPNH | | KYGNGVWMGR | | LKDNANDLGNG | |
| KLSIEDPSH | | KLSIEDPSH | | KYGPALSINE | | LKDNARELGNG | |
| KLSIENPSH | | KLSIENPSH | | KYGSGRIFQS | | LKDNLEPGTFD | |
| KLSNMGIYQ | | KLSNMGIYQ | | KYGTGRIFQS | | LKDQAWSYIVE | |
| KLSNMGVYQ | | KLSNMGVYQ | | KYGYIIEEYG | | LKDQDWSYIVE | |
| KLSQMPKEV | | KLSQMPKEV | | KYHQIEKEFE | | LKDQGWSYIVE | |
| KLSQMSKEV | | KLSQMSKEV | | KYHQIEKEFG | | LKDQSWSYIVE | |
| KLSQMSKKV | | KLSQMSKKV | | KYHWNLALDI | | LKEQLSSVSSF | |
| KLSQMSKNV | | KLSQMSKNV | | KYIKQGSLKL | | LKEQLSTVSSF | |
| KLSQMSREV | | KLSQMSREV | | KYIKSDQLKL | | LKFKADLIIER | |
| KLSSGYKDI | | KLSSGYKDI | | KYIKSGQLKL | | LKGKFQTAAQK | |
| KLSSGYKDV | | KLSSGYKDV | | KYIPSGSLKL | | LKGKFQTAAQR | |
| KLSSGYKEV | | KLSSGYKEV | | KYIPSNSLKL | | LKGLILGNPKC | |
| KLSSMGIYQ | | KLSSMGIYQ | | KYIPSRSLKL | | LKGNAKDEGNG | |
| KLSSMGVYQ | | KLSSMGVYQ | | KYISSGSLKL | | LKGRHANGTIH | |
| KLTIIYSSS | | KLTIIYSSS | | KYKGIITDTI | | LKGSAKHIEEC | |
| KLTITYSSP | | KLTITYSSP | | KYKIFKNGKK | | LKGSAMHIEEC | |
| KLTITYSSS | | KLTITYSSS | | KYLEEHPNAG | | LKGSARHIEEC | |
| KLTQGRQTF | | KLTQGRQTF | | KYLEEHPSAG | | LKGSARHIEEW | |
| KLTQGRQTY | | KLTQGRQTY | | KYLEEHPSTG | | LKHNPTEEQAV | |
| KLTQGYKDI | | KLTQGYKDI | | KYLPDLYDYK | | LKHRFEIIEGR | |
| KLTVTHSVN | | KLTVTHSVN | | KYMNVKSLKL | | LKIPNAETDPN | |
| KLVDGQDCD | | KLVDGQDCD | | KYNGIITDTF | | LKIPNAETDPS | |
| KLVGINMSK | | KLVGINMSK | | KYNGIITDTI | | LKIPNAGIDPN | |
| KLVLATGLR | | KLVLATGLR | | KYNGIITDTL | | LKIPNAGTDPN | |
| KLVLATGPR | | KLVLATGPR | | KYNGLITDTI | | LKIRTNGNLIA | |
| KLYDRVRLQ | | KLYDRVRLQ | | KYNGMITDTI | | LKISSSFSFGG | |
| KLYEKVRRQ | | KLYEKVRRQ | | KYNGVITDTL | | LKITENSFEQI | |
| KLYERVKKQ | | KLYERVKKQ | | KYQQSFSPSP | | LKKQEIEGIKL | |
| KLYERVKRQ | | KLYERVKRQ | | KYQQSFTPSP | | LKLAIGLRNVP | |
| KLYERVRKQ | | KLYERVRKQ | | KYREEAMQNR | | LKLAIGPRNVP | |
| KLYERVRRQ | | KLYERVRRQ | | KYRQSFSPSP | | LKLASGLRNVP | |
| KLYGAGNKL | | KLYGAGNKL | | KYRTESLQNR | | LKLATGLKNVP | |
| KLYGNGNKL | | KLYGNGNKL | | KYSRADKICI | | LKLATGLRNIP | |
| KLYGSGAKL | | KLYGSGAKL | | KYTSARQEKN | | LKLATGLRNVP | |
| KLYGSGNKL | | KLYGSGNKL | | KYTSGRQEKN | | LKLATGMRNIP | |
| KLYGSGSKL | | KLYGSGSKL | | KYVEDTKIDL | | LKLATGMRNVP | |
| KLYGTGNKL | | KLYGTGNKL | | KYVEDTKVDL | | LKLATGPRNVP | |
| KLYIWGIHH | | KLYIWGIHH | | KYVEWTSNSL | | LKLGQFPVQTD | |
| KLYIWGVHH | | KLYIWGVHH | | KYVKQGSLKL | | LKLVDGQDCDL | |
| KLYKKLKRE | | KLYKKLKRE | | KYVKQGSLML | | LKLVTGLRNVP | |
| KLYKNTNTL | | KLYKNTNTL | | KYVKQGSLRL | | LKMPASRYLTD | |
| KLYRKLKRE | | KLYRKLKRE | | KYVKSDRLVL | | LKMSLLTEVET | |
| KLYVNKNPY | | KLYVNKNPY | | KYVKSEKLVL | | LKMTIASDILK | |
| KLYVWGVHH | | KLYVWGVHH | | KYVKSERLVL | | LKMTIASDILT | |
| KLYWHLMHP | | KLYWHLMHP | | KYVKSKRLVL | | LKNGNMRCTIC | |
| KLYWHLMRP | | KLYWHLMRP | | KYVNIKSLKL | | LKNNAIDEGDG | |
| KLYWHLMSP | | KLYWHLMSP | | KYVNVKSLKL | | LKNNAKDEGNG | |
| KMARLGKGY | | KMARLGKGY | | KYVNVRSLKL | | LKPGETLKVES | |
| KMARLGRGY | | KMARLGRGY | | KYVRSEKLVL | | LKPGETLNIES | |
| KMEAILVVL | | KMEAILVVL | | KYVWWASNSL | | LKPGETLNVES | |

Fig. 83-197

| Block size 8 | SIN | Block size 9 | SIN | Block size 10 | SIN | Block size 11 | SIN |
|---|---|---|---|---|---|---|---|
| KMEDGFLDV | | KMEDGFLDV | | KYVWWTSNSL | | LKPGQTLRIIS | |
| KMEFEPFQS | | KMEFEPFQS | | KYWAIRTRSG | | LKPGQTLRIRS | |
| KMEKIVLLL | | KMEKIVLLL | | LAAGGAIWVT | | LKPGQTLRVKS | |
| KMFDFIKWN | | KMFDFIKWN | | LAAGGDIWVT | | LKPGQTLRVRS | |
| KMFDFSKWN | | KMFDFSKWN | | LAATVTLHFK | | LKPGQTVKIKT | |
| KMFDFTKWN | | KMFDFTKWN | | LADQSLPPNF | | LKPGQTVKIQT | |
| KMGVDEYSN | | KMGVDEYSN | | LADRIDDAVT | | LKQNPTEEQAV | |
| KMGVDEYSS | | KMGVDEYSS | | LADRVDDAVT | | LKREITFHGAK | |
| KMITQRTIG | | KMITQRTIG | | LADSEMDKLY | | LKREITFYGAK | |
| KMKAIIVVL | | KMKAIIVVL | | LADSEMKKLY | | LKREMTFHGAK | |
| KMKAILVVL | | KMKAILVVL | | LADSEMLNLY | | LKRGETLKIRT | |
| KMKWGMELR | | KMKWGMELR | | LADSEMNKLF | | LKRNEIKGVEL | |
| KMKWGMEMR | | KMKWGMEMR | | LADSEMNKLY | | LKRNEIKGVKL | |
| KMMTNSQDT | | KMMTNSQDT | | LADSEMNNLY | | LKRQEIDGIKL | |
| KMMTSSQDT | | KMMTSSQDT | | LADSEMSKLY | | LKRQEIEGIKL | |
| KMNGNYDSI | | KMNGNYDSI | | LADWVDDAVT | | LKRQEIEGIRL | |
| KMNIQFTAV | | KMNIQFTAV | | LAEKAMKEHG | | LKRQEINGIKL | |
| KMNIQFTSV | | KMNIQFTSV | | LAEKAMKEYG | | LKRRAIATPGM | |
| KMNIQILIL | | KMNIQILIL | | LAEKTMKEYG | | LKSDKRIGSCT | |
| KMNNQILIL | | KMNNQILIL | | LAERAMKEYG | | LKSEDNVYKVL | |
| KMNPNKKII | | KMNPNKKII | | LAESEMNKLY | | LKSEQFPVQTD | |
| KMNPNQKII | | KMNPNQKII | | LAFICIKNGN | | LKSGQFPVQTD | |
| KMNPNQKIM | | KMNPNQKIM | | LAFILWACQN | | LKSLFSSIKKY | |
| KMNREFEVM | | KMNREFEVM | | LAFILWACSS | | LKSNAIDEGDG | |
| KMNREFEVV | | KMNREFEVV | | LAFIMWACSN | | LKSTQAAIDKI | |
| KMNREFGVV | | KMNREFGVV | | LAFIMWACSS | | LKSTQAAIDQI | |
| KMNTKILVL | | KMNTKILVL | | LAFMLWACQN | | LKSTQAAINQI | |
| KMNTQFDAV | | KMNTQFDAV | | LAFVLWACQN | | LKSTQTAIDQI | |
| KMNTQFEAI | | KMNTQFEAI | | LAGSAQHVEE | | LKSWKGNIMRT | |
| KMNTQFEAV | | KMNTQFEAV | | LAGTAKHIEE | | LKTEDNIYKIL | |
| KMNTQFETV | | KMNTQFETV | | LAHALKLVVA | | LKTEDNVYKIL | |
| KMNTQFTAV | | KMNTQFTAV | | LAIAMGLIFM | | LKTEDNVYKVL | |
| KMNTQILIF | | KMNTQILIF | | LAIGECPKYV | | LKTRPILSPLT | |
| KMNTQILIL | | KMNTQILIL | | LAIGLRNTPS | | LKVESNGNLIA | |
| KMNTQILVF | | KMNTQILVF | | LAIGLRNVPQ | | LKVPNAGTDPN | |
| KMNTRILIL | | KMNTRILIL | | LAIGPRNVPQ | | LKVPNALTDDK | |
| KMPASRYLT | | KMPASRYLT | | LAIIIAGLSF | | LKVPNALTDDR | |
| KMQFSSLTV | | KMQFSSLTV | | LAILIAGGLI | | LKVPNALTDER | |
| KMQLRDNAK | | KMQLRDNAK | | LAILVAGGLI | | LKVPNALTDNR | |
| KMRDSIKSW | | KMRDSIKSW | | LAIMIAGLFF | | LKVPNALTNDR | |
| KMSLLTEVE | | KMSLLTEVE | | LAIMIAGLSF | | LKWALGENMAP | |
| KMTDSIKSW | | KMTDSIKSW | | LAIMMAGLSF | | LKWLISKSKEQ | |
| KMTIASDIL | | KMTIASDIL | | LAIMVAGLSF | | LKWLVSKDKGR | |
| KMTITFLIL | | KMTITFLIL | | LAIYATVAGS | | LKWLVSKNKGQ | |
| KMVLSAFDE | | KMVLSAFDE | | LAIYSCIASS | | LKWLVSKSKGQ | |
| KMVTQRTIG | | KMVTQRTIG | | LAIYSTAASS | | LKWLVSKTKGQ | |
| KMVTQRTVG | | KMVTQRTVG | | LAIYSTISSS | | LKWTLGENMAP | |
| KMYALHQGT | | KMYALHQGT | | LAIYSTVASS | | LKWVLGENMAP | |
| KNADLEALM | | KNADLEALM | | LAIYSTVSSS | | LKYNGIITDTL | |
| KNALGDCPK | | KNALGDCPK | | LAKCNTKCQT | | LKYNGVITDTL | |
| KNALGECPK | | KNALGECPK | | LAKGEKANVL | | LLAIAMGLIFM | |
| KNALYGTQS | | KNALYGTQS | | LAKSVFNCLY | | LLAKSVFNCLY | |
| KNANTLSSV | | KNANTLSSV | | LAKSVFNNLY | | LLAKSVFNNLY | |
| KNANTLTSV | | KNANTLTSV | | LAKSVFNSIY | | LLAKSVFNSIY | |
| KNATASFIY | | KNATASFIY | | LAKSVFNSLY | | LLAKSVFNSLY | |
| KNATATVYY | | KNATATVYY | | LALGLRNTPS | | LLAPKYGYIIE | |
| KNCINRCFY | | KNCINRCFY | | LALGMKNVPE | | LLAPRYGYIIE | |
| KNCTLIDAL | | KNCTLIDAL | | LALSHTAYSQ | | LLASTNAHDRI | |
| KNDDIDQSL | | KNDDIDQSL | | LANNGKFEFI | | LLASTNAYDRI | |
| KNDDVDQSL | | KNDDVDQSL | | LANNGRFEFI | | LLATGMKNVPE | |
| KNDEVDQSL | | KNDEVDQSL | | LANQSLPPNF | | LLATGMRNIPE | |
| KNDLYGTQP | | KNDLYGTQP | | LANTIEIFRS | | LLATGMRNVPE | |

Fig. 83-198

| Block size 8 | SIN | Block size 9 | SIN | Block size 10 | SIN | Block size 11 | SIN |
|---|---|---|---|---|---|---|---|
| KNDLYGTQS | | KNDLYGTQS | | LANTIEVFKS | | LLDNLQAYQKR | |
| KNEIKGVKL | | KNEIKGVKL | | LANTIEVFRL | | LLDPGDTVTFT | |
| KNELYGTQS | | KNELYGTQS | | LANTIEVFRS | | LLDVWTYNAEL | |
| KNGNHAVHY | | KNGNHAVHY | | LANVVRKMMT | | LLEKNVTVTHS | |
| KNGNLRCTI | | KNGNLRCTI | | LANYSLPPNF | | LLEMCHGTQIG | |
| KNGNMQCTI | | KNGNMQCTI | | LAPKYGYIIE | | LLEMCHSTQIG | |
| KNGNMRCTI | | KNGNMRCTI | | LAPRYAFEIV | | LLEMCHSTQVG | |
| KNGNMRGTN | | KNGNMRGTN | | LAPRYAFELV | | LLEMCHSTRIG | |
| KNGTYDHKD | | KNGTYDHKD | | LAPRYALELV | | LLENDKTLDLH | |
| KNGTYDHKE | | KNGTYDHKE | | LAPRYGYIIE | | LLENDKTLDMH | |
| KNGTYDYPK | | KNGTYDYPK | | LAPRYSFELV | | LLENDKTLNMH | |
| KNGTYKYPK | | KNGTYKYPK | | LAQGALLGTK | | LLENDRTLDLH | |
| KNGTYNHKD | | KNGTYNHKD | | LAQGALLGTN | | LLENDVPVTSS | |
| KNGTYNHKE | | KNGTYNHKE | | LAQGALLGTR | | LLENEKTLDLH | |
| KNGTYNRKE | | KNGTYNRKE | | LAQGALVGTK | | LLENERTLDFH | |
| KNGTYNYPK | | KNGTYNYPK | | LAQGVLLGTK | | LLENERTLDLH | |
| KNGTYYYPK | | KNGTYYYPK | | LAQGYKDIIL | | LLENERTLDYH | |
| KNILEKTHN | | KNILEKTHN | | LARCICEKLE | | LLENGRTLDLH | |
| KNILRTQES | | KNILRTQES | | LARGEKANVL | | LLENGRTLGLH | |
| KNITEIVYL | | KNITEIVYL | | LARNICEKLE | | LLENGVPVTSS | |
| KNITKIVYL | | KNITKIVYL | | LARRICEKLE | | LLENGVPVTST | |
| KNITVTHAQ | | KNITVTHAQ | | LARSALILRG | | LLENLQAYQKR | |
| KNITVTHSV | | KNITVTHSV | | LARSICEKLE | | LLENLQTYQKR | |
| KNLFDEVKR | | KNLFDEVKR | | LASCMGLIYN | | LLENNVPVTSS | |
| KNLFDEVRR | | KNLFDEVRR | | LASGLRNVPA | | LLENQKALDEH | |
| KNLHDQIKR | | KNLHDQIKR | | LASLLEMCHG | | LLENQKILDEH | |
| KNLHEQVKR | | KNLHEQVKR | | LASLLEMCHS | | LLENQKPLDEH | |
| KNLYDKVRL | | KNLYDKVRL | | LASSGSLEFI | | LLENQKTLDEH | |
| KNLYDKVRM | | KNLYDKVRM | | LASTNAHDRI | | LLENQKTLDKH | |
| KNLYDRVRL | | KNLYDRVRL | | LASTNAYDRI | | LLESDVPVTSS | |
| KNLYEKVRL | | KNLYEKVRL | | LASTTAKAME | | LLEVGTRWMKI | |
| KNLYEKVRM | | KNLYEKVRM | | LATGLKNVPA | | LLFMIIGGFIF | |
| KNLYNKVRM | | KNLYNKVRM | | LATGLRNAHK | | LLFQDILMRMS | |
| KNNAIDEGD | | KNNAIDEGD | | LATGLRNIPA | | LLGAIAGFIEG | |
| KNNAKDEGN | | KNNAKDEGN | | LATGLRNIPQ | | LLGIITGPPQC | |
| KNNMINNDL | | KNNMINNDL | | LATGLRNIPS | | LLGINMSKKKS | |
| KNNQVILCE | | KNNQVILCE | | LATGLRNVPA | | LLGNPECDILL | |
| KNNQVILCG | | KNNQVILCG | | LATGLRNVPI | | LLGNPECDLFL | |
| KNNWSGYSG | | KNNWSGYSG | | LATGLRNVPK | | LLGNPECDLLL | |
| KNPALRMKW | | KNPALRMKW | | LATGLRNVPQ | | LLGNPECDRLL | |
| KNPAYCNTD | | KNPAYCNTD | | LATGLRNVPS | | LLGNPKCDRLL | |
| KNPEAYNFN | | KNPEAYNFN | | LATGLRNVPT | | LLGNQKTLDEH | |
| KNPSLRMKW | | KNPSLRMKW | | LATGMKNVPE | | LLGSAQHVEEC | |
| KNPYTLVST | | KNPYTLVST | | LATGMRNIPE | | LLGSSPNAYQA | |
| KNQEELRSL | | KNQEELRSL | | LATGMRNIPG | | LLGTITGPPQC | |
| KNRSPYRAL | | KNRSPYRAL | | LATGMRNVPE | | LLGTLIGPPQC | |
| KNSDLEALM | | KNSDLEALM | | LATGPRNVPA | | LLGTVTGPPQC | |
| KNSFYAELK | | KNSFYAELK | | LATGPRNVPQ | | LLHKCNDSCMD | |
| KNSNGVQDI | | KNSNGVQDI | | LATRGVQIAS | | LLHKCNDSCME | |
| KNSRSGYET | | KNSRSGYET | | LATTITLHFK | | LLHKCNNSCME | |
| KNTDLEALM | | KNTDLEALM | | LATTVTLHFK | | LLHKCNNTCME | |
| KNTDLEVLM | | KNTDLEVLM | | LAVGLRNTPS | | LLIAFVLWACQ | |
| KNTKGRDVL | | KNTKGRDVL | | LAVLIAGGLI | | LLIAMENQHTI | |
| KNTNTLSSV | | KNTNTLSSV | | LAVNVRGSGM | | LLIGISNIGLN | |
| KNTYVNNTT | | KNTYVNNTT | | LAVTWWNRKG | | LLIGISNMSLN | |
| KNVAVTHSV | | KNVAVTHSV | | LAVTWWNRNG | | LLIGISNVGLN | |
| KNVIFTHAQ | | KNVIFTHAQ | | LAVTWWNRSG | | LLIGISNVVLN | |
| KNVPEKIHT | | KNVPEKIHT | | LAYCNTDLGT | | LLIGVSNVGLN | |
| KNVPEKIRT | | KNVPEKIRT | | LAYDKICIGY | | LLILLENERTL | |
| KNVPEKIRV | | KNVPEKIRV | | LCAGIPSDTP | | LLISDGGPNLY | |
| KNVTVTHAK | | KNVTVTHAK | | LCAGIPTDTP | | LLKERGFFGAI | |
| KNVTVTHAQ | | KNVTVTHAQ | | LCAGLPSDTP | | LLKHRFEIIEG | |

Fig. 83-199

| Block size 8 | SIN | Block size 9 | SIN | Block size 10 | SIN | Block size 11 | SIN |
|---|---|---|---|---|---|---|---|
| KNVTVTHAV | | KNVTVTHAV | | LCAVNSWHIL | | LLLAFILWACQ | |
| KNVTVTHSI | | KNVTVTHSI | | LCEVNSWHIF | | LLLAFMLWACQ | |
| KNVTVTHSV | | KNVTVTHSV | | LCEVNSWHIL | | LLLAFVLWACQ | |
| KNVTVTHTQ | | KNVTVTHTQ | | LCEVSSWHIL | | LLLATGMKNVP | |
| KNWILWISF | | KNWILWISF | | LCFPGELDNN | | LLLATGMRNIP | |
| KNWSGYSGA | | KNWSGYSGA | | LCFPGEVDNN | | LLLATGMRNVP | |
| KNWSGYSGS | | KNWSGYSGS | | LCGSKEQLGS | | LLLLQANLCRF | |
| KPCFWVELI | | KPCFWVELI | | LCGSKERLGS | | LLLMIIGGFIF | |
| KPDIYDFNE | | KPDIYDFNE | | LCGSKKRLGS | | LLLNKSLCNVE | |
| KPDTYDFNE | | KPDTYDFNE | | LCGSPFPVGS | | LLLNKSLCSVE | |
| KPFHNISRI | | KPFHNISRI | | LCGSPISVGS | | LLLQANLCRFL | |
| KPFQNASRH | | KPFQNASRH | | LCGSPVPVGS | | LLLQIISLCSI | |
| KPFQNASRY | | KPFQNASRY | | LCGSPVSVGS | | LLLQITSLCSI | |
| KPFQNICKP | | KPFQNICKP | | LCGSRERLGS | | LLLQVTSLCSI | |
| KPFQNISRI | | KPFQNISRI | | LCIGYHANNS | | LLLTFILWACQ | |
| KPFQNISRV | | KPFQNISRV | | LCKIEGWVVV | | LLMDALKLSIE | |
| KPFQNTSKH | | KPFQNTSKH | | LCKLNGIPPL | | LLMDSLKLSIE | |
| KPFQNTSRH | | KPFQNTSRH | | LCKVEGWVVV | | LLMIIGGFIFG | |
| KPFQNVNKI | | KPFQNVNKI | | LCLAILIAGG | | LLMNELGGPFH | |
| KPFQNVNKV | | KPFQNVNKV | | LCLAILVAGG | | LLMNELGIPFH | |
| KPFQNVNRI | | KPFQNVNRI | | LCLAVLIAGG | | LLMNELGVPFH | |
| KPFQNVSRI | | KPFQNVSRI | | LCLGHHAVAN | | LLMNELGVPFY | |
| KPFQNVSRT | | KPFQNVSRT | | LCLGHHAVQN | | LLMNELGVPLH | |
| KPGETLKVE | | KPGETLKVE | | LCLGHHAVQN | | LLMNELGVSFH | |
| KPGETLNIE | | KPGETLNIE | | LCLGHHAVSN | | LLMSELGVPFH | |
| KPGETLNVE | | KPGETLNVE | | LCNPLNPFVN | | LLMSTNAYDRI | |
| KPGQTLRIR | | KPGQTLRIR | | LCNPLNPFVS | | LLNASCAAMDD | |
| KPGQTLRVK | | KPGQTLRVK | | LCNPLNPFVT | | LLNASCAAMDE | |
| KPGQTLRVR | | KPGQTLRVR | | LCNPMNPFVS | | LLNASCAAMED | |
| KPGQTVKIK | | KPGQTVKIK | | LCNVEGWVVI | | LLNASWFNSFL | |
| KPGQTVKIQ | | KPGQTVKIQ | | LCNVEGWVVV | | LLNDKHSNETV | |
| KPKFLPDLY | | KPKFLPDLY | | LCPFKGFFPF | | LLNDKHSNGTA | |
| KPKSLPDLY | | KPKSLPDLY | | LCPFQGFFPF | | LLNDKHSNGTI | |
| KPKYLPDLY | | KPKYLPDLY | | LCPFRGFFPF | | LLNDKHSNGTV | |
| KPLCAVNSW | | KPLCAVNSW | | LCPIKGWAPL | | LLNDKHSNNTV | |
| KPLCEVNSW | | KPLCEVNSW | | LCPIRGWAPL | | LLNDRHSNGTI | |
| KPLCEVSSW | | KPLCEVSSW | | LCPKPLKLVD | | LLNDRHSNGTV | |
| KPLILGDCS | | KPLILGDCS | | LCPSPLKLID | | LLNKSLCNVEG | |
| KPLILKDCS | | KPLILKDCS | | LCPSPLKLVD | | LLNKSLCSVEG | |
| KPLILRDCS | | KPLILRDCS | | LCPSPLRLID | | LLNPFVSHKEI | |
| KPLKLVDGQ | | KPLKLVDGQ | | LCPSPLRLVD | | LLNRLNINPVK | |
| KPLQNASRH | | KPLQNASRH | | LCPVKGWAPL | | LLNRLNINPVT | |
| KPLQNTSKH | | KPLQNTSKH | | LCQVECVCRD | | LLNRLNINSVK | |
| KPNGCIEGK | | KPNGCIEGK | | LCRLRGIPPL | | LLNRLSINPVK | |
| KPNIGPRPF | | KPNIGPRPF | | LCRLSGIPPL | | LLNSSCAAMDD | |
| KPNIGPRPL | | KPNIGPRPL | | LCSGLVGDTP | | LLPFAAAPPEQ | |
| KPPLPLCPF | | KPPLPLCPF | | LCSIWFSHYN | | LLPFAAAPPKQ | |
| KPQCEITGF | | KPQCEITGF | | LCSKILTDTS | | LLPFAAAPPVQ | |
| KPQCHITGF | | KPQCHITGF | | LCSKTLTDTS | | LLPFASAPPEQ | |
| KPQCKITGF | | KPQCKITGF | | LCSKVLTDTS | | LLQANLCRFLE | |
| KPQCLITGF | | KPQCLITGF | | LCSRILTDTS | | LLQIISLCSIW | |
| KPQCQIAGF | | KPQCQIAGF | | LCSRVLTDTS | | LLQITSLCSIW | |
| KPQCQITGF | | KPQCQITGF | | LCSVEGWVVI | | LLQSAILSLQT | |
| KPQCQITGS | | KPQCQITGS | | LCSVEYASKT | | LLQSLQQIESI | |
| KPQCQVTGF | | KPQCQVTGF | | LCTGILTDTS | | LLQSLQQIESM | |
| KPRFLPDLY | | KPRFLPDLY | | LCTGVLTDTS | | LLRENAEEDGT | |
| KPRGLFGAI | | KPRGLFGAI | | LCTINSWHIF | | LLRHFQKDAKI | |
| KPRPRRGLF | | KPRPRRGLF | | LCTINSWHIH | | LLRHFQKDAKM | |
| KPRYLPDLY | | KPRYLPDLY | | LCTINSWHIY | | LLRHFQKDAKV | |
| KPSLPLCPF | | KPSLPLCPF | | LCVGWSSTSC | | LLRHFQKDARV | |
| KPWARNILR | | KPWARNILR | | LCYPGELDNN | | LLRHFQKNAKV | |
| KPYIGKCPK | | KPYIGKCPK | | LCYPGELNNN | | LLSLLEMCHST | |

Fig. 83-200

| Block size 8 | SIN | Block size 9 | SIN | Block size 10 | SIN | Block size 11 | SIN |
|---|---|---|---|---|---|---|---|
| KQAKGLFGA | | KQAKGLFGA | | LCYPGEVDNN | | LLSPEEISETQ | |
| KQASYKIFK | | KQASYKIFK | | LCYPGNFNDY | | LLSPEEVSEAQ | |
| KQDGKSSAC | | KQDGKSSAC | | LCYPGSFNDY | | LLSPEEVSETQ | |
| KQEFKMNPN | | KQEFKMNPN | | LCYPGSFNNY | | LLSRLNINPVK | |
| KQEIEGIKL | | KQEIEGIKL | | LCYPGSLNDY | | LLSSKANQVFP | |
| KQEIKMNPN | | KQEIKMNPN | | LDDCSLEGII | | LLSSKDNQVFP | |
| KQESLLLAT | | KQESLLLAT | | LDDCSLEGLI | | LLTEVETYVLS | |
| KQESLMLAT | | KQESLMLAT | | LDDCSLEGLV | | LLVADGGPNLY | |
| KQETRVWWT | | KQETRVWWT | | LDDCSLKGLI | | LLVAIENQHTI | |
| KQFELIDNE | | KQFELIDNE | | LDEESRARIK | | LLVALENQHTI | |
| KQGKTKATK | | KQGKTKATK | | LDEHDANVRN | | LLVALENQNTI | |
| KQGNSVWAG | | KQGNSVWAG | | LDEHDSNVEN | | LLVAMENQHTI | |
| KQGSLKLAT | | KQGSLKLAT | | LDEHDSNVKN | | LLVLIENDRTL | |
| KQGSLMLAT | | KQGSLMLAT | | LDEIGEDIAP | | LLVLIENERTL | |
| KQGSLRLAT | | KQGSLRLAT | | LDEIGEDLAP | | LLVLIENQKTL | |
| KQIDTIMEK | | KQIDTIMEK | | LDEIGEDVAP | | LLVLLEDERTL | |
| KQIGNVINW | | KQIGNVINW | | LDEQNKLYGA | | LLVLLENDKTL | |
| KQILRTQES | | KQILRTQES | | LDEQNKLYGT | | LLVLLENDRTL | |
| KQKSLLLAT | | KQKSLLLAT | | LDFHDSNVKN | | LLVLLENEKTL | |
| KQKTLKLAT | | KQKTLKLAT | | LDFHDSNVKS | | LLVLLENERTL | |
| KQLGNVINW | | KQLGNVINW | | LDFHDSNVRN | | LLVLLENGRTL | |
| KQLRENAED | | KQLRENAED | | LDFHDSSVKN | | LLVLLENQKIL | |
| KQLRENAEE | | KQLRENAEE | | LDGKAPISLG | | LLVLLENQKPL | |
| KQLRQNAEE | | KQLRQNAEE | | LDGVTASCLD | | LLVLLENQKTL | |
| KQLTHHMRK | | KQLTHHMRK | | LDGVTASCRD | | LLVLLGNQKTL | |
| KQMTRGLFG | | KQMTRGLFG | | LDIRTATREG | | LLVLMENEITL | |
| KQNGKSGAC | | KQNGKSGAC | | LDIWTYNAEL | | LLVLMENEMTL | |
| KQNGKSSAC | | KQNGKSSAC | | LDKHDSNVKN | | LLVLMENERTL | |
| KQNPTEEQA | | KQNPTEEQA | | LDKICLGHHA | | LLVMLENQKTL | |
| KQNTLKLAT | | KQNTLKLAT | | LDLHDANVKN | | LLVSDGGPNLY | |
| KQPISLGDC | | KQPISLGDC | | LDLHDANVRN | | LLVSLGAIGFW | |
| KQSRMQFSS | | KQSRMQFSS | | LDLHDSNVKN | | LLVSLGAISFW | |
| KQSSLPLAL | | KQSSLPLAL | | LDLHDSNVRN | | LLVSLGAVSFW | |
| KQSTLKLAT | | KQSTLKLAT | | LDLHDSNVRS | | LLVSTNAYDRI | |
| KQTKTMTIT | | KQTKTMTIT | | LDLHDSNVTN | | LLVWLENEKTL | |
| KQTRGIFGA | | KQTRGIFGA | | LDLNMGQPFY | | LMDALKLSIED | |
| KQTRGLFGA | | KQTRGLFGA | | LDMHDANVKN | | LMDALKLSIEN | |
| KQTSLLLAT | | KQTSLLLAT | | LDMHDANVRN | | LMDALLGDPHC | |
| KQVCAAWSS | | KQVCAAWSS | | LDNEPGSGHW | | LMDSLKLSIED | |
| KQVCIAWSS | | KQVCIAWSS | | LDNEPGSGNW | | LMENEMTLDFH | |
| KQVCIAYSS | | KQVCIAYSS | | LDNKHSNDTI | | LMENERTLDFH | |
| KQVCMAWSS | | KQVCMAWSS | | LDNKHSNDTV | | LMENERTLDLH | |
| KQVCVAWSS | | KQVCVAWSS | | LDNKHSNGTI | | LMENERTLDYH | |
| KQVDTIMEK | | KQVDTIMEK | | LDNLQAYQKR | | LMENERTLEFH | |
| KRCINRCFY | | KRCINRCFY | | LDNNGELRHL | | LMENERTLGFH | |
| KRDSSILTD | | KRDSSILTD | | LDPGDTVTFT | | LMENERTLYFH | |
| KREITFHGA | | KREITFHGA | | LDQNFRNIRK | | LMETERTLDFH | |
| KREMTFHGA | | KREMTFHGA | | LDRICLGHHA | | LMEWIKTRPIL | |
| KRFADQELG | | KRFADQELG | | LDRLRRDQKS | | LMEWLKTRPIL | |
| KRGETLKIR | | KRGETLKIR | | LDTGDGCFEI | | LMIIGGFIFGC | |
| KRGGSGIMK | | KRGGSGIMK | | LDTINFESTG | | LMIWHSNLNDA | |
| KRGINDRNF | | KRGINDRNF | | LDVWTYNAEI | | LMLATGMKNVP | |
| KRGLFGAIA | | KRGLFGAIA | | LDVWTYNAEL | | LMLATGMRNIP | |
| KRGNSGIMK | | KRGNSGIMK | | LDVWTYNTEL | | LMLATGMRNVP | |
| KRGSSGIMK | | KRGSSGIMK | | LDYHDSNVKN | | LMLNKSLCKIE | |
| KRGSSGIVK | | KRGSSGIVK | | LDYQIGYICS | | LMLNKSLCKVE | |
| KRGSSGVMK | | KRGSSGVMK | | LDYQIGYVCS | | LMLQSRTREIL | |
| KRGVNDRNF | | KRGVNDRNF | | LEALMEWIKT | | LMLSKSLCKVE | |
| KRIENLNKK | | KRIENLNKK | | LEALMEWLKT | | LMMAYMLEREL | |
| KRIGSCTSP | | KRIGSCTSP | | LEAMAFLEDS | | LMNELGIPFHL | |
| KRINMIADR | | KRINMIADR | | LEAMAFLEES | | LMNELGVPFHL | |
| KRINMINDK | | KRINMINDK | | LEAMAFLEKS | | LMNELGVPFYL | |

Fig. 83-201

| Block size 8 | SIN | Block size 9 | SIN | Block size 10 | SIN | Block size 11 | SIN |
|---|---|---|---|---|---|---|---|
| KRINMISDK | | KRINMISDK | | LEAMAFLENS | | LMNELGVSFHL | |
| KRINMLADR | | KRINMLADR | | LEAMALLEES | | LMQGSTLPRRS | |
| KRINMLADW | | KRINMLADW | | LECKTFFLTQ | | LMSCHIGVAPS | |
| KRINVINDK | | KRINVINDK | | LECRTFFLTH | | LMSCPIGEAPS | |
| KRIRLFDYS | | KRIRLFDYS | | LECRTFFLTQ | | LMSCPIGEVPS | |
| KRKKRGLFG | | KRKKRGLFG | | LEDEQMYQKC | | LMSCPIGVAPS | |
| KRKRDSSIL | | KRKRDSSIL | | LEDEQMYQRC | | LMSCPLGEAPS | |
| KRKRGLFGA | | KRKRGLFGA | | LEECSCYMDI | | LMSCPMGVAPS | |
| KRKRKTRGL | | KRKRKTRGL | | LEECSCYVDI | | LMSCPVGEAPS | |
| KRKRNSSIL | | KRKRNSSIL | | LEECSCYVDT | | LMSCPVGVAPS | |
| KRKTRGLFG | | KRKTRGLFG | | LEECSCYVDV | | LMSELGVPFHL | |
| KRLAVLGKD | | KRLAVLGKD | | LEEESDEALK | | LMSLSRTREIL | |
| KRLCKVEGW | | KRLCKVEGW | | LEEHPNAGKD | | LMSQSRTREIL | |
| KRLCTINSW | | KRLCTINSW | | LEEHPSAGKD | | LMSQSRTRGIL | |
| KRLENLDKK | | KRLENLDKK | | LEEHPSAGRD | | LMSTNAYDRIC | |
| KRLENLNKK | | KRLENLNKK | | LEEHPSTGKD | | LMSTPLGTPPT | |
| KRLGNLNKK | | KRLGNLNKK | | LEELRFVFSI | | LMSVLLGSSPN | |
| KRLGSWSWH | | KRLGSWSWH | | LEELRFVFSN | | LMSVPLGSSPN | |
| KRLLRENAE | | KRLLRENAE | | LEELRFVFSS | | LMSVPLGSSSN | |
| KRLTIIGKD | | KRLTIIGKD | | LEENPSAGKD | | LMTDGPSDAQA | |
| KRLTILGKD | | KRLTILGKD | | LEENSTYKIL | | LMTELGVPFHL | |
| KRLTTTIKT | | KRLTTTIKT | | LEENTSYKIL | | LMVAYMLEREL | |
| KRLTVLGKD | | KRLTVLGKD | | LEENTTYKIL | | LMWALGENMAP | |
| KRLVLATGL | | KRLVLATGL | | LEENTTYRIL | | LMWEINGPESV | |
| KRMGLQMQR | | KRMGLQMQR | | LEESHPGIFE | | LNASCAAMDDF | |
| KRMGVQIQR | | KRMGVQIQR | | LEESHPGIFG | | LNASCAAMDEF | |
| KRMGVQLQR | | KRMGVQLQR | | LEESHPGLFE | | LNASCAAMEDF | |
| KRMGVQMHR | | KRMGVQMHR | | LEFEPFQSLV | | LNASWFNSFLA | |
| KRMGVQMQR | | KRMGVQMQR | | LEFIAEQFTW | | LNASWFNSFLI | |
| KRMTRGLFG | | KRMTRGLFG | | LEFKADLIIE | | LNASWFNSFLK | |
| KRNEIKGVE | | KRNEIKGVE | | LEGFSAESRK | | LNASWFNSFLT | |
| KRNEIKGVK | | KRNEIKGVK | | LEGIILGNPK | | LNASWFNSFLV | |
| KRNITEIVY | | KRNITEIVY | | LEGLILGNPK | | LNDATYQRTRA | |
| KRNRSILNT | | KRNRSILNT | | LEGLILSNPK | | LNDKHSNGTAK | |
| KRNSSILTD | | KRNSSILTD | | LEGLVLGNPK | | LNDKHSNGTIK | |
| KRPVTEINT | | KRPVTEINT | | LEGTTASCQN | | LNDKHSNGTVK | |
| KRQEIDGIK | | KRQEIDGIK | | LEHTSKYVCT | | LNDKHSNNTVK | |
| KRQEIEGIK | | KRQEIEGIK | | LEHTSRYICT | | LNDKHSNNTVR | |
| KRQEIEGIR | | KRQEIEGIR | | LEHTSRYVCT | | LNDRHSNGTIK | |
| KRQEINGIK | | KRQEINGIK | | LEICFMYSDF | | LNDRHSNGTVK | |
| KRQLRENAE | | KRQLRENAE | | LEIGARIGEG | | LNDTTYQRTRA | |
| KRRAIATPG | | KRRAIATPG | | LEIGTRIGDG | | LNEGIMNTSKP | |
| KRRIRDNMT | | KRRIRDNMT | | LEKAHNGKLC | | LNEGVINTSKP | |
| KRRKKRGLF | | KRRKKRGLF | | LEKNITVTHS | | LNEGVMNTSKP | |
| KRRPVAKAG | | KRRPVAKAG | | LEKNVTVTHA | | LNEITTKINNI | |
| KRRVRDNIT | | KRRVRDNIT | | LEKNVTVTHS | | LNFVNRANQRL | |
| KRRVRDNMT | | KRRVRDNMT | | LEKRIENLNK | | LNGIPPLELGD | |
| KRRVRDNVT | | KRRVRDNVT | | LEKRLENLNK | | LNGISPIHLGD | |
| KRRVRDSMT | | KRRVRDSMT | | LEKRLGNLNK | | LNGISPVHLGD | |
| KRSHEQMET | | KRSHEQMET | | LEKSHPGIFE | | LNGNGDPNNMD | |
| KRSYEQMET | | KRSYEQMET | | LEKSRINGVK | | LNGNGDPSNMD | |
| KRSYNNTSG | | KRSYNNTSG | | LEKTHNGKLC | | LNGREWSYIVE | |
| KRTNMINDK | | KRTNMINDK | | LEKTHNGRLC | | LNGTAKHIEEC | |
| KRTVSSFYS | | KRTVSSFYS | | LEKVHNGKLC | | LNGVSPIHLGD | |
| KRVRLFDYS | | KRVRLFDYS | | LEKYVEDTKI | | LNGVSPVHLGD | |
| KRYELEIGA | | KRYELEIGA | | LEKYVEDTKV | | LNHLIGKTNQQ | |
| KRYELEIGT | | KRYELEIGT | | LELGDCSIAG | | LNIESNGNLIA | |
| KRYERVKMF | | KRYERVKMF | | LELGDCSITG | | LNINPVKLSSG | |
| KRYGPALSI | | KRYGPALSI | | LELIRMIKRG | | LNINPVTLSSG | |
| KSCINRCFY | | KSCINRCFY | | LELRDCKIEA | | LNINSVKLSSG | |
| KSCLPACAY | | KSCLPACAY | | LELRDCKVEA | | LNITAASLNDD | |
| KSCLPACIY | | KSCLPACIY | | LELRDCSIAG | | LNKKIDDGFLD | |

Fig. 83-202

| Block size 8 | SIN | Block size 9 | SIN | Block size 10 | SIN | Block size 11 | SIN |
|---|---|---|---|---|---|---|---|
| KSCLPACVY | | KSCLPACVY | | LELRSGYWAI | | LNKKMEDGFLD | |
| KSCVNRCFY | | KSCVNRCFY | | LELRSKYWAI | | LNKKMEDGFLN | |
| KSDKICIGY | | KSDKICIGY | | LELRSRYWAI | | LNKKVDDGFID | |
| KSDKICLGH | | KSDKICLGH | | LEMCHGTQIG | | LNKKVDDGFLD | |
| KSDKRIGSC | | KSDKRIGSC | | LEMCHSTQIG | | LNKKVDDGLLD | |
| KSDQLKLAT | | KSDQLKLAT | | LEMCHSTQVG | | LNKNEIKGVKL | |
| KSDRICIGY | | KSDRICIGY | | LEMCHSTRIG | | LNKSLCKIEGW | |
| KSDRLVLAT | | KSDRLVLAT | | LEMIRGKPEE | | LNKSLCKVEEW | |
| KSDVLVTRE | | KSDVLVTRE | | LEMIRGKPKE | | LNKSLCKVEGW | |
| KSEDNVYKV | | KSEDNVYKV | | LEMIRGRPEE | | LNKSLCNVEGW | |
| KSEKLVLAT | | KSEKLVLAT | | LENDKTLDLH | | LNKSLCSVEGW | |
| KSEQFPVQT | | KSEQFPVQT | | LENDKTLDMH | | LNLIIGISNVG | |
| KSERLVLAT | | KSERLVLAT | | LENDKTLNMH | | LNLLIGISNIG | |
| KSFSRTELI | | KSFSRTELI | | LENDRTLDLH | | LNLLIGISNVG | |
| KSFSRTQLI | | KSFSRTQLI | | LENDVPVTSS | | LNLLIGISNVV | |
| KSFYRNLVW | | KSFYRNLVW | | LENEKTLDLH | | LNLLIGVSNVG | |
| KSGACKRAD | | KSGACKRAD | | LENERTLDFH | | LNLYDRVRKQL | |
| KSGACKRAN | | KSGACKRAN | | LENERTLDLH | | LNLYERVRKQL | |
| KSGQFPVQT | | KSGQFPVQT | | LENERTLDYH | | LNMGQPFYSHR | |
| KSGQLKLAT | | KSGQLKLAT | | LENGRTLDLH | | LNMHDANVRNL | |
| KSHGRILKN | | KSHGRILKN | | LENGRTLGLH | | LNNEIRWPPHW | |
| KSHGRVLKN | | KSHGRVLKN | | LENGVPVTSS | | LNNEPGSGNWP | |
| KSITQTLVS | | KSITQTLVS | | LENGVPVTST | | LNNKHSNGTIH | |
| KSKLFTLSG | | KSKLFTLSG | | LENKHSNGTK | | LNNKHWSGYSG | |
| KSKRLVLAT | | KSKRLVLAT | | LENLDKKMED | | LNNKNWSGYSG | |
| KSLCEVNSW | | KSLCEVNSW | | LENLNKKMED | | LNNMNWSGYSG | |
| KSLCKIEGW | | KSLCKIEGW | | LENLNKKVED | | LNNNGELRHLF | |
| KSLCKVEGW | | KSLCKVEGW | | LENLQAYQKR | | LNNRNWSGYSG | |
| KSLCNVEGW | | KSLCNVEGW | | LENLQTYQKR | | LNNTEPLCDVS | |
| KSLCSVEGW | | KSLCSVEGW | | LENLSKRMED | | LNNTEPLCEVS | |
| KSLESRRGF | | KSLESRRGF | | LENNVPVTSS | | LNNTEPLCNVS | |
| KSLESRSGF | | KSLESRSGF | | LENQHTIDLA | | LNNVIDKMNKQ | |
| KSLFSSIKK | | KSLFSSIKK | | LENQHTIDLT | | LNNVIDKMNNQ | |
| KSLGIQSDA | | KSLGIQSDA | | LENQHTIDMT | | LNNVIDKMYKQ | |
| KSLIWLWLV | | KSLIWLWLV | | LENQHTIDVT | | LNPMHQLLRHF | |
| KSLKLASGL | | KSLKLASGL | | LENQHTIHLT | | LNQTYRNNRKE | |
| KSLKLATGL | | KSLKLATGL | | LENQKILDEH | | LNQTYRNTRKE | |
| KSLKLATGP | | KSLKLATGP | | LENQKPLDEH | | LNRFIEKTNQQ | |
| KSLKLVTGL | | KSLKLVTGL | | LENQKTLDEH | | LNRIIEKTNQQ | |
| KSLLLATGM | | KSLLLATGM | | LENQKTLDKH | | LNRKMEDGFLD | |
| KSLMLATGM | | KSLMLATGM | | LENQNTIDLT | | LNRKVDDGFLD | |
| KSLPDLYDY | | KSLPDLYDY | | LENSHPGIFE | | LNRLIDKTNQQ | |
| KSLRGRGST | | KSLRGRGST | | LENYVEDTKI | | LNRLIDRTNHQ | |
| KSLTQTLVS | | KSLTQTLVS | | LEPGTFDIEG | | LNRLIEKTNDK | |
| KSLYDKVRM | | KSLYDKVRM | | LEPGTFDIGG | | LNRLIEKTNEK | |
| KSNAIDEGD | | KSNAIDEGD | | LEPGTFDLEG | | LNRLIEKTNKQ | |
| KSNGNLIAP | | KSNGNLIAP | | LEPGTFDLGG | | LNRLIEKTNQQ | |
| KSPLPLCPF | | KSPLPLCPF | | LEQNVTVTHA | | LNRLIEKTNTE | |
| KSQLIWMAC | | KSQLIWMAC | | LEQSGLPVGG | | LNRLIEKTNTQ | |
| KSQLVWMAC | | KSQLVWMAC | | LERELVRKTR | | LNRLIERTNEK | |
| KSRGYKMNI | | KSRGYKMNI | | LERNVTVTHA | | LNRLIERTNQQ | |
| KSRGYKMNN | | KSRGYKMNN | | LERNVTVTHS | | LNRLIGKTNQQ | |
| KSRGYKMNT | | KSRGYKMNT | | LERRIENLNK | | LNRLISKTNQQ | |
| KSRINGVKL | | KSRINGVKL | | LERRIENLNR | | LNRLNINPVKL | |
| KSRSIIFNM | | KSRSIIFNM | | LERRIESLNK | | LNRLNINPVTL | |
| KSRSNIFNM | | KSRSNIFNM | | LERRLENLNK | | LNRLNINSVKL | |
| KSRVDNHSM | | KSRVDNHSM | | LERRLENLSK | | LNRLSINPVKL | |
| KSSACKRAN | | KSSACKRAN | | LERSKINEVK | | LNRNEIKGVKL | |
| KSSLPLCPF | | KSSLPLCPF | | LERSKINGVI | | LNRNQPAATAL | |
| KSTKSTVLK | | KSTKSTVLK | | LERSKINGVK | | LNRQEIEGVKL | |
| KSTPSAIDQ | | KSTPSAIDQ | | LERSKINGVR | | LNRQEIGGVKL | |
| KSTQAAIDK | | KSTQAAIDK | | LERTHNGKLC | | LNSSCAAMDDF | |

Fig. 83-203

| Block size 8 | SIN | Block size 9 | SIN | Block size 10 | SIN | Block size 11 | SIN |
|---|---|---|---|---|---|---|---|
| KSTQAAIDQ | | KSTQAAIDQ | | LERYVEDTKI | | LNTDWSGYSGS | |
| KSTQAAINQ | | KSTQAAINQ | | LESDVPVTSS | | LNTMHQLLRHF | |
| KSTQAAVDQ | | KSTQAAVDQ | | LESRSGFEMI | | LNTMTKDAERG | |
| KSTQAAVNQ | | KSTQAAVNQ | | LESRSGFEMV | | LNTSQRGILED | |
| KSTQEAIDK | | KSTQEAIDK | | LETGYICSKF | | LNTSQRGVLED | |
| KSTQEAIEK | | KSTQEAIEK | | LETGYVCGKF | | LNTTLPFHNIH | |
| KSTQEAIGK | | KSTQEAIGK | | LETGYVCSKF | | LNVESNGNLIA | |
| KSTQEAINK | | KSTQEAINK | | LEVCFMYSDF | | LNVESNGNLVA | |
| KSTQKAIDG | | KSTQKAIDG | | LEVGTRWMKI | | LNVWTYNAELL | |
| KSTQKTIDQ | | KSTQKTIDQ | | LFALSGMAIA | | LNWLTKATNGN | |
| KSTQSAIDQ | | KSTQSAIDQ | | LFALSGVAIA | | LNWLTKETNGN | |
| KSTQSAINQ | | KSTQSAINQ | | LFALSGVAIT | | LNWSGYSGSFT | |
| KSTQSAVDQ | | KSTQSAVDQ | | LFALSGVAVA | | LNYHYEECSCY | |
| KSTQSAVNQ | | KSTQSAVNQ | | LFASSGIAIA | | LPDGAQIQYFS | |
| KSTQTAIDQ | | KSTQTAIDQ | | LFASSGIAIV | | LPDLYDYKEDR | |
| KSTVLKSDK | | KSTVLKSDK | | LFDEVKRRLS | | LPDLYDYKENR | |
| KSVFNCLYA | | KSVFNCLYA | | LFDEVRRRLS | | LPDLYDYKESR | |
| KSVFNNLYA | | KSVFNNLYA | | LFDYSGWNVT | | LPDLYDYKKNR | |
| KSVFNSIYA | | KSVFNSIYA | | LFDYSKWNVS | | LPFAAAPPEQS | |
| KSVFNSLYA | | KSVFNSLYA | | LFDYSKWNVT | | LPFAAAPPKQS | |
| KSVFNSLYS | | KSVFNSLYS | | LFDYSRWNVT | | LPFAAAPPVQS | |
| KSVTQTLVS | | KSVTQTLVS | | LFEKFFPSSS | | LPFASAPPEQS | |
| KSVTVSHAQ | | KSVTVSHAQ | | LFERVKRQLR | | LPFHNIHPLAI | |
| KSWKGNIMR | | KSWKGNIMR | | LFERVRHQLR | | LPFHNIHPLTI | |
| KSWRKDILR | | KSWRKDILR | | LFERVRRQLR | | LPFHNVHPLAI | |
| KSWRRDILR | | KSWRRDILR | | LFFFCLKNGN | | LPFHNVHPLTI | |
| KSWSKPQCQ | | KSWSKPQCQ | | LFFWMCSNGS | | LPFQNIDSRAV | |
| KSYFANLKG | | KSYFANLKG | | LFGAIAGFIE | | LPFQNIDSWAV | |
| KSYINKTGT | | KSYINKTGT | | LFGAKAGFIE | | LPFQNLSPRTV | |
| KSYINRTGT | | KSYINRTGT | | LFHKCDDDCM | | LPLALGMKNVP | |
| KTAYELTDS | | KTAYELTDS | | LFIKDYRYTY | | LPLCPFKGFFP | |
| KTDGATSAC | | KTDGATSAC | | LFLAFILWAC | | LPLCPFQGFFP | |
| KTEDNIYKI | | KTEDNIYKI | | LFLVCVSLLQ | | LPLCPFRGFFP | |
| KTEDNVYKI | | KTEDNVYKI | | LFLWMCSNGS | | LPQSGRIVVDY | |
| KTEDNVYKV | | KTEDNVYKV | | LFLYVRTNGT | | LPRRSGAAGAA | |
| KTFFGWKEP | | KTFFGWKEP | | LFMIIGGFIF | | LPSFGVSGINE | |
| KTFFGWREP | | KTFFGWREP | | LFNTIGNLIA | | LPSFGVSGVNE | |
| KTFFLTQGA | | KTFFLTQGA | | LFQDILMRMS | | LPTFDSLNITA | |
| KTFQNIDKN | | KTFQNIDKN | | LFQGGHIEEC | | LPVGGNEKKAK | |
| KTFQNIDRN | | KTFQNIDRN | | LFQQMRDILG | | LQALQLLLEVE | |
| KTFQNIEKN | | KTFQNIEKN | | LFQQMRDVLG | | LQANLCRFLET | |
| KTFQNIERN | | KTFQNIERN | | LFSGIKSFSR | | LQATGMKNVPE | |
| KTFQNISPV | | KTFQNISPV | | LFSGIRSFSR | | LQAYQKRMGLQ | |
| KTFQNVSPI | | KTFQNVSPI | | LFSGVNSFSR | | LQAYQKRMGVQ | |
| KTFQNVSPL | | KTFQNVSPL | | LFSSIKKYER | | LQCRICIDFRD | |
| KTFQNVSPV | | KTFQNVSPV | | LFSSIKRYER | | LQCRICILDQN | |
| KTGGPIYKK | | KTGGPIYKK | | LFTIRQELAS | | LQCRICIRADG | |
| KTGGPIYKR | | KTGGPIYKR | | LFTIRQEMAG | | LQDNAKDEGNG | |
| KTGGPIYRR | | KTGGPIYRR | | LFTIRQEMAI | | LQDTTWDVFIE | |
| KTGTFEFTS | | KTGTFEFTS | | LFTIRQEMAN | | LQGSARHIEEC | |
| KTGTYDYPK | | KTGTYDYPK | | LFTIRQEMAS | | LQGTKRSYEQM | |
| KTGVDEYSS | | KTGVDEYSS | | LFTLSGVAIA | | LQIISLCSIWF | |
| KTHIHIFSF | | KTHIHIFSF | | LFVLMENERT | | LQITSLCSIWF | |
| KTHNGKLCK | | KTHNGKLCK | | LFVQSYFQLF | | LQLFIKDYRYT | |
| KTHNGKLCR | | KTHNGKLCR | | LGAIAGFIEG | | LQLKDNAKELG | |
| KTHNGRLCK | | KTHNGRLCK | | LGAINTTLPF | | LQLKDNARELG | |
| KTIDQVTGK | | KTIDQVTGK | | LGAISFWMCS | | LQLNPIDGPLP | |
| KTITIGSVS | | KTITIGSVS | | LGALNTTLPF | | LQLRDNAKELG | |
| KTIWTSGSS | | KTIWTSGSS | | LGAPLELRDC | | LQLRDNARELG | |
| KTKATKMEA | | KTKATKMEA | | LGAPLVLDDC | | LQNASRHYMGE | |
| KTKATKMKA | | KTKATKMKA | | LGAVSFWMCS | | LQNNAIDEGDG | |
| KTKCQTYAG | | KTKCQTYAG | | LGCKMYALHQ | | LQNRIMINPVK | |

Fig. 83-204

| Block size 8 | SIN | Block size 9 | SIN | Block size 10 | SIN | Block size 11 | SIN |
|---|---|---|---|---|---|---|---|
| KTKKMTITF | | KTKKMTITF | | LGCKTYALHQ | | LQNRIQIDPVK | |
| KTKLPFQNL | | KTKLPFQNL | | LGCRMYALHQ | | LQNRIQIDQVK | |
| KTLDEHDAN | | KTLDEHDAN | | LGDAPFLDRL | | LQNRIQIDSVK | |
| KTLDEHDSN | | KTLDEHDSN | | LGDCNFEGWI | | LQNTSKHYIGK | |
| KTLDEHDTN | | KTLDEHDTN | | LGDCPKYIKS | | LQQIESIIEAE | |
| KTLDEHEAN | | KTLDEHEAN | | LGDCRFEGWI | | LQQIESMIEAE | |
| KTLDEHVAN | | KTLDEHVAN | | LGDCSFAGWI | | LQQIESMVEAE | |
| KTLDKHDSN | | KTLDKHDSN | | LGDCSFEGWI | | LQQVESMIEAE | |
| KTLDLHDAN | | KTLDLHDAN | | LGDCSFTGWI | | LQRRRFIQNAL | |
| KTLDLHDSN | | KTLDLHDSN | | LGDCSIAGWL | | LQRRRFVQNAL | |
| KTLDMHDAN | | KTLDMHDAN | | LGDCSVAGWL | | LQSLQQIESII | |
| KTLKLATGM | | KTLKLATGM | | LGEAPSPYNS | | LQSLQQIESMI | |
| KTLNMHDAN | | KTLNMHDAN | | LGECPKYIKS | | LQSLQQIESMV | |
| KTLTDNHVE | | KTLTDNHVE | | LGENIAPEKV | | LQSSDDFALIL | |
| KTLTDTSRP | | KTLTDTSRP | | LGENMAPEKI | | LQSSDDFALIV | |
| KTLTNEHEE | | KTLTNEHEE | | LGENMAPEKM | | LQTYQKRMGVQ | |
| KTLTNEKEE | | KTLTNEKEE | | LGENMAPEKV | | LRDCKIEAVIY | |
| KTLTNEKEK | | KTLTNEKEK | | LGFIMWACQK | | LRDCKVEAVIY | |
| KTLTNEQEE | | KTLTNEQEE | | LGFIMWACQR | | LRDCSIAGWLL | |
| KTLTSEKEE | | KTLTSEKEE | | LGFIMWTCQK | | LRDCSVAGWLL | |
| KTMTITFLI | | KTMTITFLI | | LGFIVWACQR | | LRDDLEPGTFD | |
| KTNDKYHQI | | KTNDKYHQI | | LGFVFTLTVP | | LRDNAKDEGNG | |
| KTNEKFHQI | | KTNEKFHQI | | LGFVLWACQN | | LRDNAKDLGNG | |
| KTNEKYHQI | | KTNEKYHQI | | LGFVMWACQK | | LRDNAKEIGNG | |
| KTNGNLIAP | | KTNGNLIAP | | LGGCSFAGWI | | LRDNAKELGNG | |
| KTNKQFELI | | KTNKQFELI | | LGGTISPRSR | | LRDNAMILGNG | |
| KTNLYGFII | | KTNLYGFII | | LGHHAIPNGT | | LRDNANDLGNG | |
| KTNLYGFIV | | KTNLYGFIV | | LGHHAVANGT | | LRDNLEPGTFD | |
| KTNQQFELD | | KTNQQFELD | | LGHHAVENGT | | LRDNVKELGNG | |
| KTNQQFELI | | KTNQQFELI | | LGHHAVPNGT | | LRDQGWSYIVE | |
| KTNQQFEMI | | KTNQQFEMI | | LGHHAVQNGT | | LRDSLEPGTFD | |
| KTNQQFKLI | | KTNQQFKLI | | LGHHAVSNGT | | LREHLSSVSSF | |
| KTNTEFESI | | KTNTEFESI | | LGHHAVTNGT | | LRELWQCYYLL | |
| KTNTQFELI | | KTNTQFELI | | LGIINLLIGI | | LRENAEDIGNG | |
| KTPYRSLIR | | KTPYRSLIR | | LGIITGPPQC | | LRENAEDKGNG | |
| KTRFLPVAG | | KTRFLPVAG | | LGILTGPPQC | | LRENAEDLGNG | |
| KTRFLPVSG | | KTRFLPVSG | | LGINMSKKKS | | LRENAEDMGDG | |
| KTRFLPVTG | | KTRFLPVTG | | LGIPFHLGTK | | LRENAEDMGGG | |
| KTRGLFGAI | | KTRGLFGAI | | LGIQSDAQID | | LRENAEDMGNG | |
| KTRLFTIRQ | | KTRLFTIRQ | | LGITGPDATA | | LRENAEDQGNG | |
| KTRPILSPL | | KTRPILSPL | | LGITGPDSTA | | LRENAEDRGNG | |
| KTSIWTSSS | | KTSIWTSSS | | LGITGPDTTA | | LRENAEEDCTG | |
| KTSTQKAIN | | KTSTQKAIN | | LGKCPRYVKQ | | LRENAEEDGNG | |
| KTSWSYIVE | | KTSWSYIVE | | LGKGYMFESK | | LRENAEEDGTA | |
| KTTVDHMAI | | KTTVDHMAI | | LGKVECVCRD | | LRENAEEDGTG | |
| KTVINNITT | | KTVINNITT | | LGLDIRTATR | | LRENAEEMGNG | |
| KTVVHLNST | | KTVVHLNST | | LGLHDANVRN | | LREQKQEFKMN | |
| KTWAGKILR | | KTWAGKILR | | LGLNIGLHLK | | LREQLSSVSSF | |
| KTWAGNILR | | KTWAGNILR | | LGLNIGLHLR | | LREQLSTVSSF | |
| KTWAKNILR | | KTWAKNILR | | LGLNVGLHLK | | LRFLFSSIKKY | |
| KTWARNILR | | KTWARNILR | | LGLRISSSFS | | LRFVFSIAASY | |
| KTYNNTTGR | | KTYNNTTGR | | LGLRNTPSIE | | LRFVFSNAASY | |
| KVARLGKGY | | KVARLGKGY | | LGLSMVKSDK | | LRFVFSSAASY | |
| KVATGRVTV | | KVATGRVTV | | LGLSMVRSDK | | LRGFLIIGKED | |
| KVCRALLAK | | KVCRALLAK | | LGLVCATCEQ | | LRGFLILGKED | |
| KVCRTLLAK | | KVCRTLLAK | | LGMKNVPEKI | | LRGFLILGKEN | |
| KVCTKGKKA | | KVCTKGKKA | | LGMQNGSCRC | | LRGFLILGRED | |
| KVDGSSSAC | | KVDGSSSAC | | LGMQNGSYRC | | LRGGRNSFFSR | |
| KVDLWSYNA | | KVDLWSYNA | | LGNCPKYIKS | | LRGIPPLELGD | |
| KVDTIIENN | | KVDTIIENN | | LGNCSIAGWL | | LRGQHANGTIH | |
| KVDTIIESN | | KVDTIIESN | | LGNGCFEFWH | | LRGRGSTLGLD | |
| KVDTILERN | | KVDTILERN | | LGNGCFEFYH | | LRGRHANGTIH | |

Fig. 83-205

| Block size 8 | SIN | Block size 9 | SIN | Block size 10 | SIN | Block size 11 | SIN |
|---|---|---|---|---|---|---|---|
| KVDTLTEKG | | KVDTLTEKG | | LGNILLSPEE | | LRGRHANGTIN | |
| KVDTLTENG | | KVDTLTENG | | LGNLNKKMED | | LRGRHANGTMH | |
| KVDTLTETG | | KVDTLTETG | | LGNPECDILL | | LRGSARHIEEC | |
| KVEAVIYGN | | KVEAVIYGN | | LGNPECDLFL | | LRGSIAHKSCL | |
| KVECICRDN | | KVECICRDN | | LGNPECDLLL | | LRGSVAHKSCL | |
| KVECIGWSS | | KVECIGWSS | | LGNPECDRLL | | LRHFQKDAKIL | |
| KVECVCRDN | | KVECVCRDN | | LGNPKCDLYL | | LRHFQKDAKML | |
| KVEFEPFQS | | KVEFEPFQS | | LGNPKCDPYL | | LRHFQKDAKVL | |
| KVEGWVVVA | | KVEGWVVVA | | LGNPKCDRLL | | LRHFQKDARVL | |
| KVESNGNLI | | KVESNGNLI | | LGNPMCDDLI | | LRHFQKNAKVL | |
| KVGVDEYSS | | KVGVDEYSS | | LGNPMCDELI | | LRHLFSGIKSF | |
| KVGYLCAGI | | KVGYLCAGI | | LGNPMCDNLI | | LRHLFSGIRSF | |
| KVKEIGNGC | | KVKEIGNGC | | LGNPMCDYLI | | LRHLFSGVNSF | |
| KVKMKWGME | | KVKMKWGME | | LGNPRCDDLI | | LRISSSFSFGG | |
| KVLAIYSCI | | KVLAIYSCI | | LGNQKTLDEH | | LRLAIGLRNTP | |
| KVLSIYSCI | | KVLSIYSCI | | LGNVINWTRD | | LRLALGLRNTP | |
| KVLTDTSRP | | KVLTDTSRP | | LGNYKEICIA | | LRLATGLRNIP | |
| KVLYFHKGI | | KVLYFHKGI | | LGNYKEICVA | | LRLATGLRNVP | |
| KVLYFHKGL | | KVLYFHKGL | | LGNYKEIRIA | | LRLATGMRNIP | |
| KVMYFHKGL | | KVMYFHKGL | | LGNYKEMCAA | | LRLATGMRNVP | |
| KVNGQAGRI | | KVNGQAGRI | | LGNYREICIA | | LRLAVGLRNTP | |
| KVNGQSGRI | | KVNGQSGRI | | LGPATAQMAL | | LRMATGLRNIP | |
| KVNGVKLEE | | KVNGVKLEE | | LGQFPVQTDE | | LRMATGLRNVP | |
| KVNNIVDKM | | KVNNIVDKM | | LGQGTTLDNE | | LRMKWMMAMKY | |
| KVNSIIDKM | | KVNSIIDKM | | LGQGTTLDNK | | LRMKWMMAMRY | |
| KVNSIIEKM | | KVNSIIEKM | | LGQGTTLENK | | LRMVTGLRNIP | |
| KVNSIIGKM | | KVNSIIGKM | | LGQGTTLNNK | | LRNDTDVVNFL | |
| KVNSIINKM | | KVNSIINKM | | LGQGTTLYNK | | LRNDTDVVNFV | |
| KVNSVIEKM | | KVNSVIEKM | | LGQVECVCRD | | LRNDTDVVNYV | |
| KVNSVVEKM | | KVNSVVEKM | | LGQWDWPDGA | | LRNGNMRCTIC | |
| KVNTIIENN | | KVNTIIENN | | LGQWNWPDGA | | LRNIPSIQSRG | |
| KVNTLTEKG | | KVNTLTEKG | | LGRGYMFESK | | LRNIPSVQSRG | |
| KVNTLTERE | | KVNTLTERE | | LGRTFSPRSR | | LRNTPSIDPKG | |
| KVNTLTERG | | KVNTLTERG | | LGRTINTASR | | LRNTPSIEPKG | |
| KVNTQFEAV | | KVNTQFEAV | | LGRTISIASR | | LRNTPSIEPRG | |
| KVPAQNAIS | | KVPAQNAIS | | LGRTISKDLR | | LRNTPSVEPKG | |
| KVPEWSYIV | | KVPEWSYIV | | LGRTISKDSR | | LRNTPSVEPRG | |
| KVPNAEKDP | | KVPNAEKDP | | LGRTISKDTR | | LRNVPSIQSRG | |
| KVPNAGTDP | | KVPNAGTDP | | LGRTISPKLR | | LRPGETLNVES | |
| KVPNALIDD | | KVPNALIDD | | LGRTISPRLR | | LRPGQTLRVRS | |
| KVPNALTDD | | KVPNALTDD | | LGRTISPRSR | | LRQIIRESGGI | |
| KVPNALTDE | | KVPNALTDE | | LGRTISTASR | | LRQILRESGGI | |
| KVPNALTDN | | KVPNALTDN | | LGRTISTRSR | | LRQILRGSGGI | |
| KVPVQNAIS | | KVPVQNAIS | | LGRTLNTASR | | LRQILRGSGGV | |
| KVPVTQTME | | KVPVTQTME | | LGRTTSKDSR | | LRQILRKSGGI | |
| KVQHLEECS | | KVQHLEECS | | LGRTVSINGR | | LRQILRRSGGI | |
| KVRHQLRDN | | KVRHQLRDN | | LGRTVSISGR | | LRQKIMESGGI | |
| KVRLQLKDN | | KVRLQLKDN | | LGRTVSNSGR | | LRQKIMESGGV | |
| KVRLQLRDN | | KVRLQLRDN | | LGRTVSTSGR | | LRQKVMESGGI | |
| KVRMQLKDN | | KVRMQLKDN | | LGSAQHVEEC | | LRQNAEEDGKG | |
| KVRMQLRDN | | KVRMQLRDN | | LGSCGILGTI | | LRQNAEEDGRG | |
| KVRNGTYDH | | KVRNGTYDH | | LGSPGCDRLQ | | LRQNPTEEQAV | |
| KVRRQLREN | | KVRRQLREN | | LGSPLELRDC | | LRQVLRESGGI | |
| KVSCVCRDN | | KVSCVCRDN | | LGSPLVLDDC | | LRQVLRRSGGI | |
| KVSTQKAIN | | KVSTQKAIN | | LGSPPIVSNS | | LRRCLLQSLQQ | |
| KVSTQKALN | | KVSTQKALN | | LGSPPMVSNS | | LRRDQKSLRGR | |
| KVTCVCRDN | | KVTCVCRDN | | LGSPPVVSNS | | LRRQKSLIWLW | |
| KVTHRENLL | | KVTHRENLL | | LGSSFYAEMK | | LRRQKWWVWLW | |
| KVTNATETV | | KVTNATETV | | LGSSPNAYQA | | LRSGFEMLKIP | |
| KVVHISPLS | | KVVHISPLS | | LGSSSNAYQA | | LRSGYEMLKVP | |
| KVWWTSNSI | | KVWWTSNSI | | LGSWSWHDGA | | LRSGYETFKVI | |
| KWALGENMA | | KWALGENMA | | LGTIIGPPQC | | LRSGYWAIRTR | |

Fig. 83-206

| Block size 8 | SIN | Block size 9 | SIN | Block size 10 | SIN | Block size 11 | SIN |
|---|---|---|---|---|---|---|---|
| KWEKYCILE | | KWEKYCILE | | LGTITGPPQC | | LRSILANNGKF | |
| KWEKYCVIE | | KWEKYCVIE | | LGTKQVCAAW | | LRSILANNGRF | |
| KWEKYCVLE | | KWEKYCVLE | | LGTKQVCIAW | | LRSILASSGSL | |
| KWEPLAGTA | | KWEPLAGTA | | LGTKQVCMAW | | LRSIVASSGTL | |
| KWEPLTGTA | | KWEPLTGTA | | LGTKQVCVAW | | LRSIVASSGTV | |
| KWERYCVLE | | KWERYCVLE | | LGTLIGPPQC | | LRSKYWAIRTR | |
| KWESLAGTA | | KWESLAGTA | | LGTPLELRDC | | LRSLFSSIKKY | |
| KWESLNGTA | | KWESLNGTA | | LGTPPTVSNS | | LRSLFSSIKRY | |
| KWESLTGTA | | KWESLTGTA | | LGTRQVCIAW | | LRSLIASSGTL | |
| KWGDILDGV | | KWGDILDGV | | LGTRQVCMAW | | LRSLVASSGNL | |
| KWGDILEGT | | KWGDILEGT | | LGTRQVCVAW | | LRSLVASSGTL | |
| KWGDVLDGV | | KWGDVLDGV | | LGTVTGPPQC | | LRSNAPSGIEY | |
| KWGMELRRC | | KWGMELRRC | | LGVPFHLATK | | LRSNAPSGVEY | |
| KWGMEMRRC | | KWGMEMRRC | | LGVPFHLGTK | | LRSRYWAIRTR | |
| KWGNVLDGV | | KWGNVLDGV | | LGVPFHLGTR | | LRTHESECVCI | |
| KWLISKSKE | | KWLISKSKE | | LGVPFYLGTK | | LRTQDSECVSH | |
| KWLLSNADN | | KWLLSNADN | | LGVPFYLGTR | | LRTQESECACI | |
| KWLLSNNDN | | KWLLSNNDN | | LGVSFHLGTK | | LRTQESECACV | |
| KWLLSNSDN | | KWLLSNSDN | | LGVSILNLGQ | | LRTQESECICI | |
| KWLLSNSNN | | KWLLSNSNN | | LGVSVLNLGQ | | LRTQESECLCI | |
| KWLLSNTDN | | KWLLSNTDN | | LGVWTYNAEL | | LRTQESECQCI | |
| KWLLSSKAN | | KWLLSSKAN | | LGYGVKGFGF | | LRTQESECQCL | |
| KWLLSSKDN | | KWLLSSKDN | | LGYICSGVFG | | LRTQESECVCH | |
| KWLLSSSDN | | KWLLSSSDN | | LGYSTGALAS | | LRTQESECVCI | |
| KWLLSSTDN | | KWLLSSTDN | | LHAYISFRNL | | LRTQESECVCM | |
| KWLSSSGNN | | KWLSSSGNN | | LHDANVKNLH | | LRTQESECVCV | |
| KWLSSSMNN | | KWLSSSMNN | | LHDANVRNLH | | LRTQESECVRH | |
| KWLTLKSGQ | | KWLTLKSGQ | | LHDSNVKNLY | | LRTQESSCTCI | |
| KWLVSKDKG | | KWLVSKDKG | | LHDSNVRNLH | | LRTQESSCVCI | |
| KWLVSKNKG | | KWLVSKNKG | | LHDSNVRSLH | | LRTQESSCVCM | |
| KWLVSKSKG | | KWLVSKSKG | | LHDSNVTNLH | | LRTQESSCVCV | |
| KWLVSKTKG | | KWLVSKTKG | | LHERVRKQLR | | LRWALGENMAP | |
| KWMMAMKYP | | KWMMAMKYP | | LHICVTGDDR | | LSADGDIWVTR | |
| KWMMAMRYP | | KWMMAMRYP | | LHIPEAGLKW | | LSAFDERRNKY | |
| KWNENQNPR | | KWNENQNPR | | LHIPEVCLKW | | LSAFDERRNRY | |
| KWNVTHTGT | | KWNVTHTGT | | LHKCDNECME | | LSAGGAIWVTR | |
| KWNVTYTGI | | KWNVTYTGI | | LHKCDNKCME | | LSAGGDIWATR | |
| KWNVTYTGT | | KWNVTYTGT | | LHKCNDSCMD | | LSAGGDIWITR | |
| KWREQLSQK | | KWREQLSQK | | LHKCNDSCME | | LSAGGDIWVMR | |
| KWSGYSGSF | | KWSGYSGSF | | LHKCNNECME | | LSAGGDIWVTR | |
| KWTLGENMA | | KWTLGENMA | | LHKCNNSCME | | LSAGGHIWVTR | |
| KWVLGENMA | | KWVLGENMA | | LHKCNNTCME | | LSAGGNIWITR | |
| KWWVWLWLV | | KWWVWLWLV | | LHLEFKADLI | | LSASGDIWITR | |
| KYDGIITDT | | KYDGIITDT | | LHLTGKWDTL | | LSASGDIWVTR | |
| KYDNGVWIG | | KYDNGVWIG | | LHLTGMWDTL | | LSEQNVPVTQV | |
| KYEEESKLK | | KYEEESKLK | | LHLTGTWDTL | | LSFQGRGVFEL | |
| KYEEESKLN | | KYEEESKLN | | LHLTQGACWE | | LSFTITGDNTK | |
| KYEEESRLN | | KYEEESRLN | | LHLTQGTCWE | | LSFTVTGDNTK | |
| KYERVKMFD | | KYERVKMFD | | LHNIHPLTIG | | LSFWMCSNGPL | |
| KYGDGVWIG | | KYGDGVWIG | | LHQGTTIRNK | | LSFWMCSNGSI | |
| KYGNGAWIG | | KYGNGAWIG | | LHQGTTIRNR | | LSFWMCSNGSL | |
| KYGNGVWIG | | KYGNGVWIG | | LHVCITGDDR | | LSGGAQHVEEC | |
| KYGNGVWMG | | KYGNGVWMG | | LHVCVTGDDG | | LSGGYKDIILW | |
| KYGPALSIN | | KYGPALSIN | | LHVCVTGDDK | | LSGGYKDVILW | |
| KYGSGRIFQ | | KYGSGRIFQ | | LHVCVTGDDR | | LSGIPPLELGD | |
| KYGTGRIFQ | | KYGTGRIFQ | | LIAFVLWACQ | | LSGNAQHVEEC | |
| KYGYIIEEY | | KYGYIIEEY | | LIAGGLILGM | | LSGNGDPNNMD | |
| KYHQIEKEF | | KYHQIEKEF | | LIAGWYGFQH | | LSGREWSYIVE | |
| KYHWNLALD | | KYHWNLALD | | LIALCGSPFP | | LSGSAQHIEEC | |
| KYIKQGSLK | | KYIKQGSLK | | LIALCGSPFS | | LSGSAQHVEEC | |
| KYIKSDQLK | | KYIKSDQLK | | LIAMENQHTI | | LSGVAIALSIL | |
| KYIKSGQLK | | KYIKSGQLK | | LIAPDRVSKL | | LSGVAIALSVL | |

Fig. 83-207

| Block size 8 | SIN | Block size 9 | SIN | Block size 10 | SIN | Block size 11 | SIN |
|---|---|---|---|---|---|---|---|
| KYIPSGSLK | | KYIPSGSLK | | LIAPEFGYLL | | LSHTAYSQITN | |
| KYIPSNSLK | | KYIPSNSLK | | LIAPEYGFKI | | LSIAPIMFSNK | |
| KYIPSRSLK | | KYIPSRSLK | | LIAPEYGFRI | | LSIEDPDHEGE | |
| KYISSGSLK | | KYISSGSLK | | LIAPEYGHLI | | LSIEDPNHEGE | |
| KYKGIITDT | | KYKGIITDT | | LIAPEYGHLT | | LSIEDPSHEGE | |
| KYKGIITGT | | KYKGIITGT | | LIAPEYGHLV | | LSIEEPSHEGE | |
| KYKIFKNGK | | KYKIFKNGK | | LIAPEYGYLI | | LSIENPSHEGE | |
| KYLEEHPNA | | KYLEEHPNA | | LIAPRGHYKI | | LSIIPSGPLKA | |
| KYLEEHPSA | | KYLEEHPSA | | LIAPRGHYKL | | LSILNLLIGIS | |
| KYLEEHPST | | KYLEEHPST | | LIAPRGHYRL | | LSINPVKLSSG | |
| KYLPDLYDY | | KYLPDLYDY | | LIAPRGYFKI | | LSISIGSSTYQ | |
| KYMNVKSLK | | KYMNVKSLK | | LIAPRGYFKM | | LSISVESSTYQ | |
| KYNDIITDT | | KYNDIITDT | | LIAPRGYFKV | | LSISVGSSIYQ | |
| KYNGIITDT | | KYNGIITDT | | LIAPRGYFRI | | LSISVGSSTYQ | |
| KYNGIITET | | KYNGIITET | | LIAPRGYYKM | | LSIVPSGPLKA | |
| KYNGIITGT | | KYNGIITGT | | LIAPRYGYII | | LSIYSCIASSI | |
| KYNGLITDT | | KYNGLITDT | | LIAPSRVSKL | | LSIYSCIASSL | |
| KYNGMITDT | | KYNGMITDT | | LIAPSRVTKL | | LSIYSCIASST | |
| KYNGVITDT | | KYNGVITDT | | LIASSGTLEF | | LSIYSCIASSV | |
| KYQQSFSPS | | KYQQSFSPS | | LICATCEQIA | | LSIYSCVASSL | |
| KYQQSFTPS | | KYQQSFTPS | | LIDALLGDPH | | LSIYSSVASSL | |
| KYREEAMQN | | KYREEAMQN | | LIDALLGDPQ | | LSIYSTAASSL | |
| KYRQSFSPS | | KYRQSFSPS | | LIDGWYGFKH | | LSIYSTVAASL | |
| KYRTESLQN | | KYRTESLQN | | LIDGWYGFRH | | LSIYSTVASSL | |
| KYSRADKIC | | KYSRADKIC | | LIDGWYGYHH | | LSIYSTVSSSL | |
| KYTSARQEK | | KYTSARQEK | | LIDGWYGYKH | | LSIYSTVTSSL | |
| KYTSGRQEK | | KYTSGRQEK | | LIDGWYGYRH | | LSIYSTVVSSL | |
| KYVEDTKID | | KYVEDTKID | | LIDKTNQQFE | | LSKDNAIRIGE | |
| KYVEDTKVD | | KYVEDTKVD | | LIDNEFTEVE | | LSKDNGIRIGS | |
| KYVEWTSNS | | KYVEWTSNS | | LIDSIGSWSQ | | LSKSLCKVEGW | |
| KYVKQGSLK | | KYVKQGSLK | | LIDSLLGDPH | | LSLAIMIAGIF | |
| KYVKQGSLM | | KYVKQGSLM | | LIEDPAAPHG | | LSLAIMIAGIS | |
| KYVKQGSLR | | KYVKQGSLR | | LIEDPGAPHG | | LSLAIMMAGIF | |
| KYVKSDRLV | | KYVKSDRLV | | LIEDPNAPHK | | LSLAIMMAGIS | |
| KYVKSEKLV | | KYVKSEKLV | | LIEDPNAPNK | | LSLAIMVAGIS | |
| KYVKSERLV | | KYVKSERLV | | LIEDPSAPHG | | LSLIMRTVIAL | |
| KYVKSKRLV | | KYVKSKRLV | | LIEDPSAPHR | | LSLLEMCHSTQ | |
| KYVNIKSLK | | KYVNIKSLK | | LIEDPTAPHG | | LSLYSTVASSL | |
| KYVNNTTII | | KYVNNTTII | | LIEKTNDKYH | | LSMAPIMFSNK | |
| KYVNVKSLK | | KYVNVKSLK | | LIEKTNEKYH | | LSMEFSLTDPR | |
| KYVNVRSLK | | KYVNVRSLK | | LIEKTNKQFE | | LSMVKSDKICL | |
| KYVRSEKLV | | KYVRSEKLV | | LIEKTNQQFE | | LSMVRSDKICL | |
| KYVWWASNS | | KYVWWASNS | | LIEKTNTEFE | | LSNMGIYQILA | |
| KYVWWTSNS | | KYVWWTSNS | | LIEKTNTQFE | | LSNMGVYQILA | |
| KYWAIRTRS | | KYWAIRTRS | | LIENDRTLDL | | LSNMGVYQVLA | |
| LAAGGDIWV | | LAAGGDIWV | | LIENERTLDL | | LSNNATDTVDT | |
| LAAICTHLE | | LAAICTHLE | | LIENLQAYQK | | LSNNSSDTVDT | |
| LAATVTLHF | | LAATVTLHF | | LIENQKTLDE | | LSNNSTDKIDT | |
| LADQSLPPN | | LADQSLPPN | | LIENTYVNNT | | LSNNSTDKVDT | |
| LADRIDDAV | | LADRIDDAV | | LIEQKVPVTQ | | LSNNSTDKVNT | |
| LADRVDDAV | | LADRVDDAV | | LIEQNIPVTQ | | LSNNSTDTVDT | |
| LADSEMDKL | | LADSEMDKL | | LIEQNVPVTQ | | LSNNSTEKVDT | |
| LADSEMKKL | | LADSEMKKL | | LIERTNEKYH | | LSNNSTERVDT | |
| LADSEMNKL | | LADSEMNKL | | LIERTNQQFE | | LSNPKCDLYLN | |
| LADSEMSKL | | LADSEMSKL | | LIETNHTGTY | | LSPEEISETQG | |
| LADWVDDAV | | LADWVDDAV | | LIETTHTGTY | | LSPEEVSEAQG | |
| LAEKAMKEH | | LAEKAMKEH | | LIFLARSALI | | LSPEEVSETQG | |
| LAEKAMKEY | | LAEKAMKEY | | LIFMARSALI | | LSPGMMMGMFN | |
| LAEKTMKEY | | LAEKTMKEY | | LIFMCVKNGN | | LSPLTKGILGF | |
| LAERAMKEY | | LAERAMKEY | | LIFSARSALI | | LSPLTKGMLGF | |
| LAFICIKNG | | LAFICIKNG | | LIGISNIGLN | | LSPNVYQARFE | |
| LAFILWACQ | | LAFILWACQ | | LIGISNMSLN | | LSPRTVGQCPK | |

Fig. 83-208

| Block size 8 | SIN | Block size 9 | SIN | Block size 10 | SIN | Block size 11 | SIN |
|---|---|---|---|---|---|---|---|
| LAFILWACS | | LAFILWACS | | LIGISNVGLN | | LSQGTTIRGKH | |
| LAFIMWACS | | LAFIMWACS | | LIGISNVVLN | | LSQGTTIRGRH | |
| LAFMLWACQ | | LAFMLWACQ | | LIGKNSWSYI | | LSQGTTLKGRH | |
| LAFNTVIHE | | LAFNTVIHE | | LIGKTNQQFE | | LSQGTTLRGQH | |
| LAFVLWACQ | | LAFVLWACQ | | LIGKTSWSYI | | LSQGTTLRGRH | |
| LAGSAQHVE | | LAGSAQHVE | | LIGQGDIVLV | | LSQKFEEIRWL | |
| LAGTAKHIE | | LAGTAKHIE | | LIGQGDVVLV | | LSRCRETRGLF | |
| LAHALKLVV | | LAHALKLVV | | LIGRTNQQFE | | LSRCRKTRGLF | |
| LAIAMGLIF | | LAIAMGLIF | | LIGVSNVGLN | | LSRLNINPVKL | |
| LAIAMGLVF | | LAIAMGLVF | | LIIAARNIVR | | LSSGYKDIILW | |
| LAIGECPKY | | LAIGECPKY | | LIIAARSIVR | | LSSGYKDVIIW | |
| LAIGLRNTP | | LAIGLRNTP | | LIIERKEGTD | | LSSGYKDVILW | |
| LAIGLRNVP | | LAIGLRNVP | | LIIERREGAD | | LSSGYKEVILW | |
| LAIGPRNVP | | LAIGPRNVP | | LIIERREGND | | LSSKANQVFPQ | |
| LAIIIAGLS | | LAIIIAGLS | | LIIERREGSD | | LSSKDNQVFPQ | |
| LAILIAGGL | | LAILIAGGL | | LIIERREGTD | | LSSMGIYQILA | |
| LAILVAGGL | | LAILVAGGL | | LIIERRNSSD | | LSSMGVYQILA | |
| LAIMIAGIF | | LAIMIAGIF | | LIIGISGPDN | | LSSRISFYWTI | |
| LAIMIAGIS | | LAIMIAGIS | | LIIGISNVGL | | LSSSGNNQVFP | |
| LAIMIAGLF | | LAIMIAGLF | | LIIWGIHHPS | | LSSSMNNQVFP | |
| LAIMIAGLS | | LAIMIAGLS | | LIKHENRMVL | | LSSVNTNTINR | |
| LAIMMAGIF | | LAIMMAGIF | | LILAFILWAC | | LSSVSSFEKFE | |
| LAIMMAGIS | | LAIMMAGIS | | LILAFIMWAC | | LSSVSSFERFE | |
| LAIMMAGLS | | LAIMMAGLS | | LILAFIMWTC | | LSSVSSFKRFE | |
| LAIMVAGIS | | LAIMVAGIS | | LILFNTIGNL | | LSSVTTNTINR | |
| LAIMVAGLS | | LAIMVAGLS | | LILGFVLWAC | | LSTIALFIGVG | |
| LAIVMGLVF | | LAIVMGLVF | | LILGMQNGSC | | LSTIALIIGVG | |
| LAIYATVAG | | LAIYATVAG | | LILGMQNGSY | | LSTIALLIGIG | |
| LAIYSCIAS | | LAIYSCIAS | | LILGNPKCDL | | LSTIALLIGVG | |
| LAIYSTAAS | | LAIYSTAAS | | LILGNPKCDP | | LSTKALLIGIG | |
| LAIYSTISS | | LAIYSTISS | | LILKDCSIAG | | LSTNSSDKVDT | |
| LAIYSTVAS | | LAIYSTVAS | | LILKDCSVAG | | LSTNSSEKVDT | |
| LAIYSTVSS | | LAIYSTVSS | | LILLENERTL | | LSTNSSEKVNT | |
| LAJVMGLVF | | LAJVMGLVF | | LILRDCSVAG | | LSTNSSERVDT | |
| LAKCNTKCQ | | LAKCNTKCQ | | LILRGAVAHK | | LSTNSTEKVDT | |
| LAKGEKANV | | LAKGEKANV | | LILRGSIAHK | | LSTRGIQIASN | |
| LAKSVFNCL | | LAKSVFNCL | | LILRGSVAHK | | LSTRGVQIASN | |
| LAKSVFNNL | | LAKSVFNNL | | LILSFIMWAC | | LSTRGVQQASN | |
| LAKSVFNSL | | LAKSVFNSL | | LILSNPKCDL | | LSTVLGVSILN | |
| LALGLRNTP | | LALGLRNTP | | LILTFIMWAC | | LSTVLGVSVLN | |
| LALGMKNVP | | LALGMKNVP | | LILVALALSH | | LSTVSSFERFE | |
| LALSHTAYS | | LALSHTAYS | | LIMRTVIALS | | LSVAPIMFSNK | |
| LAMITYITK | | LAMITYITK | | LIMWGIHHPS | | LSVIPSGPLKA | |
| LAMITYITR | | LAMITYITR | | LINDPWVLLN | | LSVLNLLIGIS | |
| LANLGLNIG | | LANLGLNIG | | LINGALGSPG | | LSVLNLLIGVS | |
| LANLGLNVG | | LANLGLNVG | | LINGWYGFQH | | LSVYSTVASSL | |
| LANNGKFEF | | LANNGKFEF | | LINGWYGFRH | | LSYKVGYLCAG | |
| LANNGRFEF | | LANNGRFEF | | LINTYQWIIR | | LSYQVGYLCAG | |
| LANQSLPPN | | LANQSLPPN | | LIPMISKCKT | | LSYRVGYLCAG | |
| LANSEMNKL | | LANSEMNKL | | LIPMISKCRT | | LSYSAGALASC | |
| LANTIEIFR | | LANTIEIFR | | LIPMISKSRT | | LSYSTGALASC | |
| LANTIEVFR | | LANTIEVFR | | LIQFPIGTAP | | LSYSVGYLCAG | |
| LANVVRKMM | | LANVVRKMM | | LIQFPMGTAP | | LSYTVGYLCAG | |
| LANYSLPPN | | LANYSLPPN | | LIQGYKDIIL | | LTDKGSIQSDK | |
| LAPGYAFEI | | LAPGYAFEI | | LIRALTLNTM | | LTDNHVEVVSA | |
| LAPKYGYII | | LAPKYGYII | | LIRFPIGTAP | | LTDNPRPNDPA | |
| LAPRYAFEI | | LAPRYAFEI | | LIRFPIGVAP | | LTDNPRPNDPN | |
| LAPRYAFEL | | LAPRYAFEL | | LIRFPVGTAP | | LTDNPRPNDPS | |
| LAPRYALEL | | LAPRYALEL | | LIRGNSPIFN | | LTDNPRPNDPT | |
| LAPRYGYII | | LAPRYGYII | | LIRGNSPVFN | | LTDNPRPNDPV | |
| LAQGALLGT | | LAQGALLGT | | LIRGQQGRMD | | LTDSEMNKLFD | |
| LAQGALVGT | | LAQGALVGT | | LIRGRPEEAK | | LTDSEMNKLFE | |

Fig. 83-209

| Block size 8 | SIN | Block size 9 | SIN | Block size 10 | SIN | Block size 11 | SIN |
|---|---|---|---|---|---|---|---|
| LAQGTLLGT | | LAQGTLLGT | | LIRGRPEEVK | | LTDSEMNKLYE | |
| LAQGVLLGT | | LAQGVLLGT | | LIRGRPKEDK | | LTDSEMSKLFE | |
| LAQGYKDII | | LAQGYKDII | | LIRGRPKEDR | | LTDSQTATKRI | |
| LARCICEKL | | LARCICEKL | | LIRGRPKEEK | | LTDSQTATKRL | |
| LARGEKANV | | LARGEKANV | | LIRHENRMVI | | LTDWSGYSGSF | |
| LARNICEKL | | LARNICEKL | | LIRHENRMVL | | LTEIWSYNAEL | |
| LARRICEKL | | LARRICEKL | | LIRMIKRGIN | | LTEKGIEVVNA | |
| LARSALILR | | LARSALILR | | LIRMIKRGVN | | LTEKGVEVVNA | |
| LARSICEKL | | LARSICEKL | | LIRMVKRGIN | | LTENGVPVTSS | |
| LASCMGLIY | | LASCMGLIY | | LIRTLTLNTM | | LTEQNVPVTQV | |
| LASGLRNVP | | LASGLRNVP | | LISDGGPNLY | | LTEREVEVVNA | |
| LASLLEMCH | | LASLLEMCH | | LISKTNQQFE | | LTERGIEVVNA | |
| LASSGSLEF | | LASSGSLEF | | LISTPLGSPP | | LTERGVEVVDA | |
| LASTNAHDR | | LASTNAHDR | | LISTPLGTPP | | LTERGVEVVNA | |
| LASTNAYDR | | LASTNAYDR | | LISWEMGLAP | | LTETGVPVTSS | |
| LASTTAKAM | | LASTTAKAM | | LISWEMGQAP | | LTEVETYVLSI | |
| LATGLKNVP | | LATGLKNVP | | LISWGMGQAP | | LTEVETYVLSV | |
| LATGLRNAH | | LATGLRNAH | | LISWPLSSPP | | LTFLARSALIL | |
| LATGLRNIP | | LATGLRNIP | | LISWPQSSPP | | LTGGQSFYRSI | |
| LATGLRNVP | | LATGLRNVP | | LITDGPSDAQ | | LTGIWDTLIER | |
| LATGMKNVP | | LATGMKNVP | | LITDGPSNAQ | | LTGMWDTLIER | |
| LATGMRNIP | | LATGMRNIP | | LITGKSHGRI | | LTGRGIEVVNA | |
| LATGMRNVP | | LATGMRNVP | | LITGKSHGRV | | LTGTAKHIEEC | |
| LATGPRNVP | | LATGPRNVP | | LITQESECVC | | LTGTWDTLIER | |
| LATRGVQIA | | LATRGVQIA | | LITVGSSKYQ | | LTHALRELWQC | |
| LATTITLHF | | LATTITLHF | | LITVGSSKYR | | LTHGALLNDKH | |
| LATTVTLHF | | LATTVTLHF | | LITWGIHHPS | | LTHGSLLNDKH | |
| LAVGLRNTP | | LAVGLRNTP | | LIVFNTIGNL | | LTHHMRKKRGL | |
| LAVLIAGGL | | LAVLIAGGL | | LIVLLENQKT | | LTHIMIWHSNL | |
| LAVNVRGSG | | LAVNVRGSG | | LIVSLGAISF | | LTHLMIWHSNL | |
| LAVTWWNRK | | LAVTWWNRK | | LIVWGIHHPS | | LTHMMIWHSNL | |
| LAVTWWNRN | | LAVTWWNRN | | LIVWGVHHSS | | LTIGECPKYIK | |
| LAVTWWNRS | | LAVTWWNRS | | LIWLWLVLRE | | LTIGECPKYVK | |
| LAVVMGLVF | | LAVVMGLVF | | LIWMACHSAA | | LTIGECPKYVR | |
| LAYCNTDLG | | LAYCNTDLG | | LIYNRMGAVT | | LTIGECPRYVK | |
| LAYDKICIG | | LAYDKICIG | | LIYNRMGTIT | | LTIGISGPDDG | |
| LCAGIPSDT | | LCAGIPSDT | | LIYNRMGTVA | | LTIGISGPDNE | |
| LCAGIPTDT | | LCAGIPTDT | | LIYNRMGTVT | | LTIGISGPDNG | |
| LCAGLPSDT | | LCAGLPSDT | | LKAEIAQKLE | | LTIGITGPDAT | |
| LCAVNSWHI | | LCAVNSWHI | | LKAEIAQRLE | | LTIGKCPKYVK | |
| LCDVSGFAI | | LCDVSGFAI | | LKDCSIAGWL | | LTIIYSSSMMW | |
| LCEISGFAI | | LCEISGFAI | | LKDCSVAGWL | | LTITYSSPMMW | |
| LCEVNSWHI | | LCEVNSWHI | | LKDCSVSGWL | | LTITYSSSLMW | |
| LCEVSGFAI | | LCEVSGFAI | | LKDEEKIPKT | | LTITYSSSMMW | |
| LCEVSGFVI | | LCEVSGFVI | | LKDNAIDEGD | | LTIYSTAASSL | |
| LCEVSSWHI | | LCEVSSWHI | | LKDNAKDEGN | | LTIYSTVASSF | |
| LCFPGELDN | | LCFPGELDN | | LKDNAKDLGN | | LTIYSTVASSI | |
| LCFPGEVDN | | LCFPGEVDN | | LKDNAKELGN | | LTIYSTVASSL | |
| LCGSKEQLG | | LCGSKEQLG | | LKDNANDLGN | | LTKATNGNYGP | |
| LCGSKERLG | | LCGSKERLG | | LKDNARELGN | | LTKETNGNYGP | |
| LCGSKKRLG | | LCGSKKRLG | | LKDNLEPGTF | | LTKGEKANVLI | |
| LCGSPFPVG | | LCGSPFPVG | | LKDQAWSYIV | | LTKGILGFVFT | |
| LCGSPISVG | | LCGSPISVG | | LKDQDWSYIV | | LTKGLCIINSW | |
| LCGSPVPVG | | LCGSPVPVG | | LKDQGWSYIV | | LTKGLCTINSW | |
| LCGSPVSVG | | LCGSPVSVG | | LKDQSWSYIV | | LTKGMLGFVFT | |
| LCGSRERLG | | LCGSRERLG | | LKEQLSTVSS | | LTKGVLGFVFT | |
| LCIGYHANN | | LCIGYHANN | | LKFKADLIIE | | LTKITVDHMAI | |
| LCKIEGWVV | | LCKIEGWVV | | LKGKFQTAAQ | | LTKKEPDTYDF | |
| LCKLNGIPP | | LCKLNGIPP | | LKGLILGNPK | | LTKKKNPEAYN | |
| LCKVEGWVV | | LCKVEGWVV | | LKGNAKDEGN | | LTKKKPDIYDF | |
| LCLAILIAG | | LCLAILIAG | | LKGRHANGTI | | LTKKKPDTYDF | |
| LCLAILVAG | | LCLAILVAG | | LKGSAKHIEE | | LTKRLCTINSW | |

Fig. 83-210

| Block size 8 | SIN | Block size 9 | SIN | Block size 10 | SIN | Block size 11 | SIN |
|---|---|---|---|---|---|---|---|
| LCLAVLIAG | | LCLAVLIAG | | LKGSARHIEE | | LTKTTVDHMAI | |
| LCLGHHAVA | | LCLGHHAVA | | LKHNPTEEQA | | LTKTTVDHMAV | |
| LCLGHHAVP | | LCLGHHAVP | | LKHRFEIIEG | | LTLGITGPDAT | |
| LCLGHHAVQ | | LCLGHHAVQ | | LKIHNAGTDP | | LTLGITGPDST | |
| LCLGHHAVS | | LCLGHHAVS | | LKIPNAETDP | | LTLGITGPDTT | |
| LCLKNGNMR | | LCLKNGNMR | | LKIPNAGIDP | | LTLKLGQFPVQ | |
| LCMCSNGSL | | LCMCSNGSL | | LKIPNAGTDP | | LTLKSEQFPVQ | |
| LCNPLNPFV | | LCNPLNPFV | | LKIRTNGNLI | | LTLKSGQFPVQ | |
| LCNPMNPFV | | LCNPMNPFV | | LKISSSFSFG | | LTLNTMTKDAE | |
| LCNVEGWVV | | LCNVEGWVV | | LKITENSFEQ | | LTMGECPKYVK | |
| LCNVSGFAI | | LCNVSGFAI | | LKKQEIEGIK | | LTMGYKDIILW | |
| LCPFKGFFP | | LCPFKGFFP | | LKLAIGLRNV | | LTNSEMNKLYE | |
| LCPFQGFFP | | LCPFQGFFP | | LKLAIGPRNV | | LTQGACWEQLY | |
| LCPFRGFFP | | LCPFRGFFP | | LKLASGLRNV | | LTQGALLNDKH | |
| LCPIKGWAP | | LCPIKGWAP | | LKLATGLKNV | | LTQGALLNDRH | |
| LCPIRGWAP | | LCPIRGWAP | | LKLATGLRNI | | LTQGRQTFDWT | |
| LCPKPLKLV | | LCPKPLKLV | | LKLATGLRNV | | LTQGRQTYDWT | |
| LCPSPLKLI | | LCPSPLKLI | | LKLATGMRNI | | LTQGSLLNDKH | |
| LCPSPLKLV | | LCPSPLKLV | | LKLATGMRNV | | LTQGSLLNDRH | |
| LCPSPLRLI | | LCPSPLRLI | | LKLATGPRNV | | LTQGTCWEQLY | |
| LCPSPLRLV | | LCPSPLRLV | | LKLGQFPVQT | | LTQGTCWEQMY | |
| LCPVKGWAP | | LCPVKGWAP | | LKLSIEDPDH | | LTQGYKDIILW | |
| LCRLRGIPP | | LCRLRGIPP | | LKLSIEDPNH | | LTQGYKDVILW | |
| LCRLSGIPP | | LCRLSGIPP | | LKLSIEDPSH | | LTQTLVSNNDW | |
| LCSGLVGDT | | LCSGLVGDT | | LKLSIEEPSH | | LTRELCTINSW | |
| LCSIWFSHY | | LCSIWFSHY | | LKLSIENPSH | | LTRGLCTINSW | |
| LCSKILTDT | | LCSKILTDT | | LKLVDGQDCD | | LTRTTVDHMAI | |
| LCSKTLTDT | | LCSKTLTDT | | LKLVTGLRNV | | LTSLPFQNIHP | |
| LCSKVLTDT | | LCSKVLTDT | | LKMPASRYLT | | LTSVTTNTINR | |
| LCSRILTDT | | LCSRILTDT | | LKMSLLTEVE | | LTTGKSHGRIL | |
| LCSRVLTDT | | LCSRVLTDT | | LKMTIASDIL | | LTTIGLLLQIT | |
| LCSVEGWVV | | LCSVEGWVV | | LKNGNMRCTI | | LTTIGPLLQIT | |
| LCSVEYASK | | LCSVEYASK | | LKNNAIDEGD | | LTTRGVQIASN | |
| LCTGILTDT | | LCTGILTDT | | LKNNAKDEGN | | LTTTIKPWARN | |
| LCTGVLTDT | | LCTGVLTDT | | LKPGETLKVE | | LTTTIKTWAGK | |
| LCTINSWHI | | LCTINSWHI | | LKPGETLNIE | | LTTTIKTWAGN | |
| LCVGWSSTS | | LCVGWSSTS | | LKPGETLNVE | | LTTTIKTWAKN | |
| LCYPGELDN | | LCYPGELDN | | LKPGQTLRII | | LTTTIKTWARN | |
| LCYPGELNN | | LCYPGELNN | | LKPGQTLRIR | | LTTTIRTWAKN | |
| LCYPGEVDN | | LCYPGEVDN | | LKPGQTLRVK | | LTTTPTKSYFA | |
| LCYPGNFND | | LCYPGNFND | | LKPGQTLRVR | | LTTTVKTWAGN | |
| LCYPGSFND | | LCYPGSFND | | LKPGQTVKIK | | LTTVGLLLQII | |
| LCYPGSFNN | | LCYPGSFNN | | LKPGQTVKIQ | | LTTVGLLLQIT | |
| LCYPGSLND | | LCYPGSLND | | LKPQCQITGF | | LTTVGLLLQVT | |
| LDDCSLEGI | | LDDCSLEGI | | LKQNPTEEQA | | LTVEVPYVCTE | |
| LDDCSLEGL | | LDDCSLEGL | | LKREITFHGA | | LTVNRGSGLR | |
| LDDCSLKGL | | LDDCSLKGL | | LKREMTFHGA | | LTVNRGSMR | |
| LDEESRARI | | LDEESRARI | | LKRGETLKIR | | LTVNRGTGMR | |
| LDEHDANAN | | LDEHDANAN | | LKRNEIKGVE | | LTVPSERGLQR | |
| LDEHDANVH | | LDEHDANVH | | LKRNEIKGVK | | LTVSVRGSGMR | |
| LDEHDANVN | | LDEHDANVN | | LKRQEIDGIK | | LTVTHSVNLLE | |
| LDEHDANVR | | LDEHDANVR | | LKRQEIEGIK | | LVADGGPNLYN | |
| LDEHDSNVE | | LDEHDSNVE | | LKRQEIEGIR | | LVAGGLILGMQ | |
| LDEHDSNVK | | LDEHDSNVK | | LKRQEINGIK | | LVAGWYGFQHQ | |
| LDEHDSNVN | | LDEHDSNVN | | LKRRAIATPG | | LVAGWYGFQHS | |
| LDEHVANVN | | LDEHVANVN | | LKSDKRIGSC | | LVAGWYGFQHT | |
| LDEIGEDIA | | LDEIGEDIA | | LKSEDNVYKV | | LVAIENQHTID | |
| LDEIGEDLA | | LDEIGEDLA | | LKSEQFPVQT | | LVALALSHTAY | |
| LDEIGEDVA | | LDEIGEDVA | | LKSGQFPVQT | | LVALCGSPISV | |
| LDEQNKLYG | | LDEQNKLYG | | LKSLFSSIKK | | LVALCGSPVPV | |
| LDFHDSNVK | | LDFHDSNVK | | LKSNAIDEGD | | LVALCGSPVSV | |
| LDFHDSNVR | | LDFHDSNVR | | LKSTQAAIDK | | LVALENQHTID | |

Fig. 83-211

| Block size 8 | SIN | Block size 9 | SIN | Block size 10 | SIN | Block size 11 | SIN |
|---|---|---|---|---|---|---|---|
| LDGVKPLIL | | LDGVKPLIL | | LKSTQAAIDQ | | LVALENQHTIH | |
| LDGVRPLIL | | LDGVRPLIL | | LKSTQAAINQ | | LVALENQNTID | |
| LDGVTASCL | | LDGVTASCL | | LKSTQAAITQ | | LVAMENQHTID | |
| LDGVTASCR | | LDGVTASCR | | LKSTQAAVNQ | | LVAPEYGFKIS | |
| LDIRTATRE | | LDIRTATRE | | LKSTQTAIDQ | | LVAVENQHTID | |
| LDIWTYNAE | | LDIWTYNAE | | LKSWKGNIMR | | LVCATCEQIAD | |
| LDKHDSNVK | | LDKHDSNVK | | LKTEDNIYKI | | LVCVSLLQSAI | |
| LDKICLGHH | | LDKICLGHH | | LKTEDNVYHH | | LVDALLGDPHC | |
| LDKKMEDGF | | LDKKMEDGF | | LKTEDNVYKV | | LVDGQDCDLIN | |
| LDLHDANVK | | LDLHDANVK | | LKTQEYECVC | | LVDGWYGFRHQ | |
| LDLHDANVR | | LDLHDANVR | | LKTRPILSPL | | LVDSIGSWSQN | |
| LDLHDSNVK | | LDLHDSNVK | | LKVESNGNLI | | LVDSIVSWSQN | |
| LDLHDSNVR | | LDLHDSNVR | | LKVPNAEKDP | | LVETNHTDELC | |
| LDLNMGQPF | | LDLNMGQPF | | LKVPNAGTDP | | LVETNHTGTYC | |
| LDMHDANVK | | LDMHDANVK | | LKVPNALIDD | | LVETSHTGTYC | |
| LDMHDANVR | | LDMHDANVR | | LKVPNALTDD | | LVFFCLKNGNM | |
| LDMHDVNVK | | LDMHDVNVK | | LKVPNALTDN | | LVFFCLRNGNM | |
| LDNCHPIGM | | LDNCHPIGM | | LKWALGENMA | | LVFICIKNGNM | |
| LDNEHSNGT | | LDNEHSNGT | | LKWLISKSKE | | LVFICIKNGNV | |
| LDNEPGSGK | | LDNEPGSGK | | LKWLVSKDKG | | LVFICMKNGNM | |
| LDNEPGSGN | | LDNEPGSGN | | LKWLVSKNKG | | LVFICVKNGNM | |
| LDNKHSNDT | | LDNKHSNDT | | LKWLVSKSKG | | LVFMCVKNGNM | |
| LDNKHSNGT | | LDNKHSNGT | | LKWLVSKTKG | | LVFREQKQEFK | |
| LDNKNWSGY | | LDNKNWSGY | | LKWTLGENMA | | LVGDTPRNDDG | |
| LDNLQAYQK | | LDNLQAYQK | | LKWVLGENMA | | LVGDTPRNDDI | |
| LDNNGELRH | | LDNNGELRH | | LKYKGIITGT | | LVGDTPRNDDR | |
| LDPGDTVTF | | LDPGDTVTF | | LKYNDIITDT | | LVGDTPRNDDS | |
| LDPNDTVTF | | LDPNDTVTF | | LKYNGIITDT | | LVGDTPRNEDG | |
| LDQHDANVK | | LDQHDANVK | | LKYNGIITET | | LVGDTPRNEDS | |
| LDQNFRNIR | | LDQNFRNIR | | LKYNGIITGT | | LVGDTPRNGDS | |
| LDRICLGHH | | LDRICLGHH | | LKYNGVITDT | | LVGDTPRNNDS | |
| LDRLRRDQK | | LDRLRRDQK | | LLAFILWACQ | | LVGDTPRSDDS | |
| LDTDWSGYS | | LDTDWSGYS | | LLAFMLWACQ | | LVGIDPFKLLQ | |
| LDTGDGCFE | | LDTGDGCFE | | LLAFVLWACQ | | LVGIDPFRLLQ | |
| LDTINFEST | | LDTINFEST | | LLAIAMGLGF | | LVGINMSKKKS | |
| LDVWTYNAE | | LDVWTYNAE | | LLAIAMGLIF | | LVGINMSKRKS | |
| LDVWTYNTE | | LDVWTYNTE | | LLAIAMGLVF | | LVGLILAFILW | |
| LDYHDSNVK | | LDYHDSNVK | | LLAIVMGLVF | | LVGLILAFIMW | |
| LDYQIGYIC | | LDYQIGYIC | | LLAJVMGLVF | | LVGLILSFIMW | |
| LDYQIGYVC | | LDYQIGYVC | | LLAKSVFNCL | | LVGLILTFIMW | |
| LEALMEWIK | | LEALMEWIK | | LLAKSVFNNL | | LVGPILSFIMW | |
| LEALMEWLK | | LEALMEWLK | | LLAKSVFNSL | | LVGVDPFKLLQ | |
| LEAMAFLED | | LEAMAFLED | | LLAPKYGYII | | LVGVDPFRLLQ | |
| LEAMAFLEE | | LEAMAFLEE | | LLAPRYGYII | | LVIAARNIVRR | |
| LEAMAFLEK | | LEAMAFLEK | | LLASTNAHDR | | LVLATGLRNAH | |
| LEAMAFLEN | | LEAMAFLEN | | LLASTNAYDR | | LVLATGLRNIP | |
| LEAMALLEE | | LEAMALLEE | | LLATGMKNVP | | LVLATGLRNVP | |
| LECKTFFLT | | LECKTFFLT | | LLATGMRNIP | | LVLATGPRNVP | |
| LECRTFFLT | | LECRTFFLT | | LLATGMRNVP | | LVLDDCSLEGI | |
| LEDEQMYQK | | LEDEQMYQK | | LLAVVMGLVF | | LVLDDCSLEGL | |
| LEDEQMYQR | | LEDEQMYQR | | LLDNLQAYQK | | LVLDDCSLKGL | |
| LEDVFAGKN | | LEDVFAGKN | | LLDPGDTVTF | | LVLGDCSIAGW | |
| LEDVFSGKN | | LEDVFSGKN | | LLDVWTYNAE | | LVLGLSMVKSD | |
| LEECSCYMD | | LEECSCYMD | | LLEKNVTVTH | | LVLGLSMVRSD | |
| LEECSCYTD | | LEECSCYTD | | LLEMCHGTQI | | LVLGNPKCDLY | |
| LEECSCYVD | | LEECSCYVD | | LLEMCHSTQI | | LVLIENDRTLD | |
| LEEESDEAL | | LEEESDEAL | | LLEMCHSTRI | | LVLIENERTLD | |
| LEEHPNAGK | | LEEHPNAGK | | LLENDKTLDL | | LVLIENQKTLD | |
| LEEHPSAGK | | LEEHPSAGK | | LLENDKTLDM | | LVLLEDERTLD | |
| LEEHPSAGR | | LEEHPSAGR | | LLENDKTLNM | | LVLLENDKTLD | |
| LEEHPSTGK | | LEEHPSTGK | | LLENDRTLDL | | LVLLENDKTLN | |
| LEELRFVFS | | LEELRFVFS | | LLENDVPVTS | | LVLLENDRTLD | |

Fig. 83-212

| Block size 8 | SIN | Block size 9 | SIN | Block size 10 | SIN | Block size 11 | SIN |
|---|---|---|---|---|---|---|---|
| LEENPSAGK | | LEENPSAGK | | LLENEKTLDL | | LVLLENEKTLD | |
| LEENSTYKI | | LEENSTYKI | | LLENERTLDF | | LVLLENERTLD | |
| LEENTSYKI | | LEENTSYKI | | LLENERTLDL | | LVLLENGRTLD | |
| LEENTTYKI | | LEENTTYKI | | LLENERTLDY | | LVLLENGRTLG | |
| LEENTTYRI | | LEENTTYRI | | LLENGRTLDL | | LVLLENQKILD | |
| LEESHPGIF | | LEESHPGIF | | LLENGRTLGL | | LVLLENQKPLD | |
| LEESHPGLF | | LEESHPGLF | | LLENGVPVTS | | LVLLENQKTLD | |
| LEFIAEQFT | | LEFIAEQFT | | LLENLQAYQK | | LVLLETKKKLD | |
| LEFKADLII | | LEFKADLII | | LLENLQTYQK | | LVLLFMIIGGF | |
| LEGFSAESR | | LEGFSAESR | | LLENNVPVTS | | LVLLGNQKTLD | |
| LEGIILGNP | | LEGIILGNP | | LLENQKILDE | | LVLLLMIIGGF | |
| LEGLILGNP | | LEGLILGNP | | LLENQKTLDD | | LVLMENEMTLD | |
| LEGLILSNP | | LEGLILSNP | | LLENQKTLDE | | LVLMENERILD | |
| LEGLVLGNP | | LEGLVLGNP | | LLENQKTLDK | | LVLMENERTLD | |
| LEGRIENLN | | LEGRIENLN | | LLESDVPVTS | | LVLMENERTLG | |
| LEGTTASCQ | | LEGTTASCQ | | LLEVGTRWMK | | LVLMENERTLY | |
| LEGVFAGKN | | LEGVFAGKN | | LLFMIIGGFI | | LVLNKSLCKVE | |
| LEGVKPLIL | | LEGVKPLIL | | LLFQDILMRM | | LVLWGIHHPDS | |
| LEHTSKYVC | | LEHTSKYVC | | LLGAIAGFIE | | LVLWGIHHPDT | |
| LEHTSRYIC | | LEHTSRYIC | | LLGIITGPPQ | | LVMGQQGRMDY | |
| LEHTSRYVC | | LEHTSRYVC | | LLGINMSKKK | | LVMKRKRDSSI | |
| LEICFMYSD | | LEICFMYSD | | LLGNPECDIL | | LVMKRKRNSSI | |
| LEIGARIGE | | LEIGARIGE | | LLGNPECDLF | | LVMWGIHHPSS | |
| LEIGTRIGD | | LEIGTRIGD | | LLGNPECDLL | | LVNPGDSIIFN | |
| LEIGTRIGE | | LEIGTRIGE | | LLGNPECDRL | | LVNTYQWIIKN | |
| LEIGVTRRE | | LEIGVTRRE | | LLGNPKCDRL | | LVNTYQWIIRN | |
| LEKAHNGKL | | LEKAHNGKL | | LLGNPLCDEF | | LVNTYQWVIRN | |
| LEKANKIKS | | LEKANKIKS | | LLGNPMCDEF | | LVPCEPIIIER | |
| LEKANKIKT | | LEKANKIKT | | LLGNPMCDKF | | LVPCFWLEMIR | |
| LEKASKIKS | | LEKASKIKS | | LLGNPTCDEF | | LVPCFWVEMIR | |
| LEKNITVTH | | LEKNITVTH | | LLGNQKTLDE | | LVREQQGRMDY | |
| LEKNVTVTH | | LEKNVTVTH | | LLGSAQHVEE | | LVRGNSPAFNY | |
| LEKRIENLN | | LEKRIENLN | | LLGSSPNAYQ | | LVRGNSPVFNH | |
| LEKRLENLD | | LEKRLENLD | | LLGTITGPPQ | | LVRGNSPVFNY | |
| LEKRLENLN | | LEKRLENLN | | LLGTKHSNGT | | LVRGQQGRMDY | |
| LEKRLGNLN | | LEKRLGNLN | | LLGTLIGPPQ | | LVRGQQGTMDY | |
| LEKSHPGIF | | LEKSHPGIF | | LLGTNHSNGT | | LVRGQQGWMDY | |
| LEKSRINGV | | LEKSRINGV | | LLGTRHSNGT | | LVRKTRFLPVA | |
| LEKTHNGKL | | LEKTHNGKL | | LLGTVTGPPQ | | LVRKTRFLPVS | |
| LEKVHNGKL | | LEKVHNGKL | | LLHKCNDSCM | | LVRKTRFLPVT | |
| LEKYVEDTK | | LEKYVEDTK | | LLHKCNNSCM | | LVRKTRFLPVV | |
| LELDEIGED | | LELDEIGED | | LLHKCNNTCM | | LVRMIKRGIND | |
| LELGDCSIA | | LELGDCSIA | | LLIAFVLWAC | | LVRSGMDPRMC | |
| LELGDCSIT | | LELGDCSIT | | LLIAMENQHT | | LVRTGMDPRMC | |
| LELIRGRPQ | | LELIRGRPQ | | LLIGISNIGL | | LVSDGGPNLYN | |
| LELIRMIKR | | LELIRMIKR | | LLIGISNMSL | | LVSLGAIGFWM | |
| LELRDCKIE | | LELRDCKIE | | LLIGISNVGL | | LVSLGAISFWM | |
| LELRDCKVE | | LELRDCKVE | | LLIGISNVVL | | LVSLGAVSFWM | |
| LELRDCSIA | | LELRDCSIA | | LLIGVSNVGL | | LVSLLEMCHST | |
| LELRSGYWA | | LELRSGYWA | | LLILLENERT | | LVSNDDWSGYS | |
| LELRSKYWA | | LELRSKYWA | | LLISDGGPNL | | LVSNNDWSGYS | |
| LELRSRYWA | | LELRSRYWA | | LLKERGFFGA | | LVSNSDWSGYS | |
| LEMCHGTQI | | LEMCHGTQI | | LLKHRFEIIE | | LVSTKEWSKRY | |
| LEMCHSTQI | | LEMCHSTQI | | LLKIRKGKIV | | LVSTKEWSRRY | |
| LEMCHSTRI | | LEMCHSTRI | | LLLAFILWAC | | LVSTNAYDRIC | |
| LEMIRGKPE | | LEMIRGKPE | | LLLAFMLWAC | | LVSWEMGQAPS | |
| LEMIRGKPK | | LEMIRGKPK | | LLLAFVLWAC | | LVSWPLSSPPT | |
| LEMIRGRPE | | LEMIRGRPE | | LLLATGMKNV | | LVTDGPSDAQA | |
| LENDKTLDL | | LENDKTLDL | | LLLATGMRNI | | LVTGKSHGRIL | |
| LENDKTLDM | | LENDKTLDM | | LLLATGMRNV | | LVTREPYISCD | |
| LENDKTLNM | | LENDKTLNM | | LLLLQANLCR | | LVTREPYLSCD | |
| LENDRTLDL | | LENDRTLDL | | LLLMIIGGFI | | LVTREPYLSCG | |

Fig. 83-213

| Block size 8 | SIN | Block size 9 | SIN | Block size 10 | SIN | Block size 11 | SIN |
|---|---|---|---|---|---|---|---|
| LENDVPVTS | | LENDVPVTS | | LLLNKSLCNV | | LVTREPYVSCD | |
| LENEKTLDL | | LENEKTLDL | | LLLNKSLCSV | | LVTREPYVSCE | |
| LENERTLDF | | LENERTLDF | | LLLQANLCRF | | LVTTVTLHFKQ | |
| LENERTLDL | | LENERTLDL | | LLLQIISLCS | | LVVFCGTSGTY | |
| LENERTLDY | | LENERTLDY | | LLLQITSLCS | | LVVSLGAISFW | |
| LENGRTLDL | | LENGRTLDL | | LLLWMCSNGS | | LVWLENEKTLD | |
| LENGRTLGL | | LENGRTLGL | | LLMDALKLSI | | LVWMACHSAAF | |
| LENGVPVTS | | LENGVPVTS | | LLMDSLKLSI | | LVWMACNSAAF | |
| LENKHSNGT | | LENKHSNGT | | LLMIIGGFIF | | LWACQNGNIRC | |
| LENLDKKME | | LENLDKKME | | LLMNELGIPF | | LWACQNGNIRW | |
| LENLNKKME | | LENLNKKME | | LLMNELGVPF | | LWACQNGNLRC | |
| LENLNKKVE | | LENLNKKVE | | LLMNELGVPL | | LWACQNGNVRC | |
| LENLQAYQK | | LENLQAYQK | | LLMNELGVSF | | LWACQTGNIRC | |
| LENLQTYQK | | LENLQTYQK | | LLMSELGVPF | | LWACSSGNCRF | |
| LENLSKRME | | LENLSKRME | | LLMSTNAYDR | | LWAYNAELLVL | |
| LENNVPVTS | | LENNVPVTS | | LLNASCAAMD | | LWCKIVTTVGW | |
| LENQHTIDL | | LENQHTIDL | | LLNASCAAME | | LWDPFRQSERG | |
| LENQHTIDM | | LENQHTIDM | | LLNASWFNSF | | LWDSFRQSERG | |
| LENQHTIDV | | LENQHTIDV | | LLNDKHSNET | | LWFSFGASCFF | |
| LENQHTIHL | | LENQHTIHL | | LLNDKHSNGT | | LWFSFGASCFI | |
| LENQKILDE | | LENQKILDE | | LLNDKHSNNT | | LWFSFGASCFL | |
| LENQKPLDE | | LENQKPLDE | | LLNDKHSSGT | | LWFSFGASCFT | |
| LENQKTLDE | | LENQKTLDE | | LLNDRHSNGT | | LWFSFGASCFV | |
| LENQKTLDK | | LENQKTLDK | | LLNKSLCNVE | | LWFSFGASCLI | |
| LENQNTIDL | | LENQNTIDL | | LLNKSLCSVE | | LWFSFGASCVM | |
| LENSHPGIF | | LENSHPGIF | | LLNPFVSHKE | | LWFSFGASSFV | |
| LENVFAGKN | | LENVFAGKN | | LLNRININPV | | LWFSLGASCFL | |
| LENYVEDTK | | LENYVEDTK | | LLNRLNINPV | | LWGIHHPDSET | |
| LEPGTFDIE | | LEPGTFDIE | | LLNRLNINSV | | LWGIHHPDTEA | |
| LEPGTFDIG | | LEPGTFDIG | | LLNRLSINPV | | LWGIHHPDTEE | |
| LEPGTFDLE | | LEPGTFDLE | | LLPDLYDYKE | | LWGIHHPDTET | |
| LEPGTFDLG | | LEPGTFDLG | | LLPFAAAPPE | | LWGIHHPPDAK | |
| LEQNVTVTH | | LEQNVTVTH | | LLPFAAAPPK | | LWGIHHPPDET | |
| LEQSGLPVG | | LEQSGLPVG | | LLPFAAAPPV | | LWGIHHPPDTK | |
| LERELVRKT | | LERELVRKT | | LLPFASAPPE | | LWGIHHPPNTK | |
| LERNVTVTH | | LERNVTVTH | | LLQANLCRFL | | LWGVHHPSSDN | |
| LERRIENLN | | LERRIENLN | | LLQIISLCSI | | LWHVRKRFADQ | |
| LERRIESLN | | LERRIESLN | | LLQITSLCSI | | LWISFAISCFL | |
| LERRLENLN | | LERRLENLN | | LLQSAILSLQ | | LWISFAISCLL | |
| LERRLENLS | | LERRLENLS | | LLQSLQQIES | | LWISFAMSCFL | |
| LERSKINEV | | LERSKINEV | | LLRENAEEDG | | LWISFATSCFL | |
| LERSKINGV | | LERSKINGV | | LLRHFQKDAK | | LWISFSISCFL | |
| LERTHNGKL | | LERTHNGKL | | LLRHFQKDAR | | LWISFSMSCFV | |
| LERYVEDTK | | LERYVEDTK | | LLRHFQKNAK | | LWMCFNGSLQC | |
| LESDVPVTS | | LESDVPVTS | | LLSLLEMCHS | | LWMCSHGSLQC | |
| LESRSGFEM | | LESRSGFEM | | LLSPEEVSET | | LWMCSNGSLQC | |
| LESVFAGKN | | LESVFAGKN | | LLSSKANQVF | | LWMCSNGSYNA | |
| LETGYICSK | | LETGYICSK | | LLSSKDNQVF | | LWSYNADVLVA | |
| LETGYVCGK | | LETGYVCGK | | LLTEVETYVL | | LWSYNAELLIA | |
| LETGYVCSK | | LETGYVCSK | | LLTFILWACQ | | LWSYNAELLVA | |
| LEVCFMYSD | | LEVCFMYSD | | LLVADGGPNL | | LWSYNAGLLVA | |
| LEVGTRWMK | | LEVGTRWMK | | LLVAIENQHT | | LWSYNAQLLVL | |
| LFALSGVAI | | LFALSGVAI | | LLVALENQHT | | LWTSNSIVALC | |
| LFALSGVAV | | LFALSGVAV | | LLVALENQNT | | LWTSNSIVVFC | |
| LFASSGIAI | | LFASSGIAI | | LLVAMENQHT | | LWTSNSVVALC | |
| LFDEVKRRL | | LFDEVKRRL | | LLVLIENDRT | | LWTYNAELLIL | |
| LFDEVRRRL | | LFDEVRRRL | | LLVLIENERT | | LWVEMIRGQPK | |
| LFDYSGWNV | | LFDYSGWNV | | LLVLIENQKT | | LWVSFSISCFL | |
| LFDYSKWNV | | LFDYSKWNV | | LLVLLEDERT | | LYASKNPYTLV | |
| LFDYSRWNV | | LFDYSRWNV | | LLVLLENDKT | | LYASPQLEGFS | |
| LFEKFFPSS | | LFEKFFPSS | | LLVLLENDRT | | LYASSQLEGFS | |
| LFENSCLET | | LFENSCLET | | LLVLLENEKT | | LYDAIEECLIN | |

Fig. 83-214

| Block size 8 | SIN | Block size 9 | SIN | Block size 10 | SIN | Block size 11 | SIN |
|---|---|---|---|---|---|---|---|
| LFERVKRQL | | LFERVKRQL | | LLVLLENERT | | LYDKVRLQLKD | |
| LFERVRHQL | | LFERVRHQL | | LLVLLENGRT | | LYDKVRLQLRD | |
| LFERVRRQL | | LFERVRRQL | | LLVLLENQKI | | LYDKVRMQLKD | |
| LFFFCLKNG | | LFFFCLKNG | | LLVLLENQKP | | LYDKVRMQLRD | |
| LFFWMCSNG | | LFFWMCSNG | | LLVLLENQKT | | LYDRVKQLRQ | |
| LFGAIAGFI | | LFGAIAGFI | | LLVLLGNQKT | | LYDRVRLQLRD | |
| LFGAIAGFL | | LFGAIAGFL | | LLVLMENEIT | | LYDRVRMQLRD | |
| LFGAKAGFI | | LFGAKAGFI | | LLVLMENEMT | | LYEAIEECLIN | |
| LFHKCDDDC | | LFHKCDDDC | | LLVLMENERT | | LYEAVEECLIN | |
| LFIKDYRYT | | LFIKDYRYT | | LLVLMETERT | | LYEKVRLQLRD | |
| LFLAFILWA | | LFLAFILWA | | LLVSDGGPNL | | LYEKVRMQLRD | |
| LFLVCVSLL | | LFLVCVSLL | | LLVSLGAIGF | | LYEKVRRQLRE | |
| LFLWMCSNG | | LFLWMCSNG | | LLVSLGAISF | | LYERVKKQLRE | |
| LFLYVRTNG | | LFLYVRTNG | | LLVSLGAVSF | | LYERVKRQLRE | |
| LFMIIGGFI | | LFMIIGGFI | | LLVSTNAYDR | | LYERVRKQLRE | |
| LFNTIGNLI | | LFNTIGNLI | | LLVWLENEKT | | LYERVRKQLRQ | |
| LFQDILMRM | | LFQDILMRM | | LLWMCSNGSL | | LYERVRRQLRE | |
| LFQGGHIEE | | LFQGGHIEE | | LMDALKLSIE | | LYESIEECLIN | |
| LFQQMRDIL | | LFQQMRDIL | | LMDALLGDPH | | LYFHDSNVKNL | |
| LFQQMRDVL | | LFQQMRDVL | | LMDSLKLSIE | | LYGAGNKLITV | |
| LFSGIKSFS | | LFSGIKSFS | | LMENEITLDF | | LYGAIEECLIN | |
| LFSGIRSFS | | LFSGIRSFS | | LMENEMTLDF | | LYGAQSLSISV | |
| LFSGVNSFS | | LFSGVNSFS | | LMENERTLDF | | LYGFIIKGRSH | |
| LFSGYKDII | | LFSGYKDII | | LMENERTLDL | | LYGFIVKGRSH | |
| LFSSIKKYE | | LFSSIKKYE | | LMENERTLDY | | LYGSENKLITV | |
| LFSSIKRYE | | LFSSIKRYE | | LMENERTLEF | | LYGSGAKLITV | |
| LFTIRQELA | | LFTIRQELA | | LMENERTLGF | | LYGSGNKLITV | |
| LFTIRQEMA | | LFTIRQEMA | | LMENERTLYF | | LYGSGNKLVTV | |
| LFTLSGVAI | | LFTLSGVAI | | LMEQNVPVTQ | | LYGSGSKLITV | |
| LFVLMENER | | LFVLMENER | | LMEWIKTRPI | | LYGTGNKLITV | |
| LFVQSYFQL | | LFVQSYFQL | | LMEWLKTRPI | | LYGTQPLSISV | |
| LGAIAGFIE | | LGAIAGFIE | | LMIIGGFIFG | | LYGTQSLSISI | |
| LGAINSSMP | | LGAINSSMP | | LMIWHSNLND | | LYGTQSLSISV | |
| LGAINTTLP | | LGAINTTLP | | LMLATGMKNV | | LYIRTNGTSKI | |
| LGAISFWMC | | LGAISFWMC | | LMLATGMRNI | | LYIWGVHHPST | |
| LGALNTTLP | | LGALNTTLP | | LMLATGMRNV | | LYKKLKREITF | |
| LGAPLELRD | | LGAPLELRD | | LMLNKSLCKI | | LYKKLKREMTF | |
| LGAPLVLDD | | LGAPLVLDD | | LMLNKSLCKV | | LYKNANTLSSV | |
| LGCKMYALH | | LGCKMYALH | | LMLQSRTREI | | LYKNANTLSV | |
| LGCKTYALH | | LGCKTYALH | | LMLSKSLCKV | | LYKNTNTLSSV | |
| LGCRMYALH | | LGCRMYALH | | LMNELGIPFH | | LYKVATGRVTV | |
| LGDAPFLDR | | LGDAPFLDR | | LMNELGVPFH | | LYLNGREWSYI | |
| LGDCNFEGW | | LGDCNFEGW | | LMNELGVPFY | | LYLSGREWSYI | |
| LGDCPKYIK | | LGDCPKYIK | | LMNELGVPLH | | LYLTGTWDTLI | |
| LGDCRFEGW | | LGDCRFEGW | | LMNELGVSFH | | LYLWGVHHPSS | |
| LGDCSFAGW | | LGDCSFAGW | | LMQGSTLPRR | | LYNIRNLHIPE | |
| LGDCSFEGW | | LGDCSFEGW | | LMSCHIGVAP | | LYNKIEFEPFQ | |
| LGDCSIAGW | | LGDCSIAGW | | LMSCPIGEAP | | LYNKLEFEPFQ | |
| LGDCSITGW | | LGDCSITGW | | LMSCPIGEVP | | LYNKMEFEPFQ | |
| LGDCSVAGW | | LGDCSVAGW | | LMSCPIGVAP | | LYNKVEFEPFQ | |
| LGEAPSPYN | | LGEAPSPYN | | LMSCPLGEAP | | LYNKVRMQLRD | |
| LGECPKYIK | | LGECPKYIK | | LMSCPMGVAP | | LYRKLKREITF | |
| LGENMAPEK | | LGENMAPEK | | LMSCPVGEAP | | LYSGFVRTLFQ | |
| LGFHDSNVK | | LGFHDSNVK | | LMSCPVGVAP | | LYSSPQLEGFS | |
| LGFIMWACQ | | LGFIMWACQ | | LMSELGVPFH | | LYTRVKRQLRE | |
| LGFIMWTCQ | | LGFIMWTCQ | | LMSELGVPFN | | LYVNKNPYTLV | |
| LGFIVWACQ | | LGFIVWACQ | | LMSELGVPFY | | LYVRTNGTSKI | |
| LGFVFTLTV | | LGFVFTLTV | | LMSQSRTREI | | LYVRTNGTSKV | |
| LGFVLWACQ | | LGFVLWACQ | | LMSQSRTRGI | | LYWHLMHPGER | |
| LGFVMWACQ | | LGFVMWACQ | | LMSTNAYDRI | | LYWHLMRPGER | |
| LGGCSFAGW | | LGGCSFAGW | | LMSTPLGSPP | | LYWHLMSPGER | |
| LGGTISPRS | | LGGTISPRS | | LMSVPLGSSP | | MAADKESTQKA | |

Fig. 83-215

| Block size 8 | SIN | Block size 9 | SIN | Block size 10 | SIN | Block size 11 | SIN |
|---|---|---|---|---|---|---|---|
| LGHHAIPNG | | LGHHAIPNG | | LMSVPLGSSS | | MAADQKSTQEA | |
| LGHHAVANG | | LGHHAVANG | | LMSVPMGSSP | | MACHSAAFEDL | |
| LGHHAVENG | | LGHHAVENG | | LMTDGPSDAQ | | MACNSAAFEDL | |
| LGHHAVPNG | | LGHHAVPNG | | LMVAYMLERE | | MADSEMLNLYD | |
| LGHHAVQNG | | LGHHAVQNG | | LMWALGENMA | | MADSEMLNLYE | |
| LGHHAVSNG | | LGHHAVSNG | | LMWEINGPES | | MADSIKSWRKD | |
| LGHHAVTNG | | LGHHAVTNG | | LNASCAAMDD | | MADSTMLNLYE | |
| LGIINLLIG | | LGIINLLIG | | LNASCAAMDE | | MAGLSFWMCSN | |
| LGIITGPPQ | | LGIITGPPQ | | LNASCAAMED | | MAGSNEQAAEA | |
| LGILTGPPQ | | LGILTGPPQ | | LNASWFNSFL | | MAGSSEQAAEA | |
| LGINMSKKK | | LGINMSKKK | | LNDATYQRTR | | MAIDNMQNKLN | |
| LGIPFHLGT | | LGIPFHLGT | | LNDKHSNETV | | MAIIKKYTSAR | |
| LGIQSDAQI | | LGIQSDAQI | | LNDKHSNGTA | | MAIIKKYTSGR | |
| LGITGPDAT | | LGITGPDAT | | LNDKHSNGTI | | MAIIKRYTSGR | |
| LGITGPDST | | LGITGPDST | | LNDKHSNGTV | | MAKCNTKCQTS | |
| LGITGPDTT | | LGITGPDTT | | LNDKHSNNTV | | MALQGTKRSYE | |
| LGIVECVCR | | LGIVECVCR | | LNDRHSNGTI | | MALQLFIKDYR | |
| LGIYQILAI | | LGIYQILAI | | LNDRHSNGTV | | MAPIMFSNKMA | |
| LGKCPRYVK | | LGKCPRYVK | | LNDTTYQRTR | | MARAVKLYKKL | |
| LGKGYMFES | | LGKGYMFES | | LNDYEELKHL | | MARCNTKCQTS | |
| LGKVECVCR | | LGKVECVCR | | LNEGIMNTSK | | MARLGKGYMFE | |
| LGLDIRTAT | | LGLDIRTAT | | LNEGVINTSK | | MARLGRGYMFE | |
| LGLHDANVR | | LGLHDANVR | | LNEGVMNTSK | | MARSALILRGS | |
| LGLNIGLHL | | LGLNIGLHL | | LNEITTKINN | | MASIRNNSYDH | |
| LGLNVGLHL | | LGLNVGLHL | | LNFVNRANQR | | MASIRNNTYDH | |
| LGLRISSSF | | LGLRISSSF | | LNGIPPLELG | | MASIRNNTYNH | |
| LGLRNTPSI | | LGLRNTPSI | | LNGISPIHLG | | MASIRNSTYDH | |
| LGLSMVKSD | | LGLSMVKSD | | LNGISPVHLG | | MASQGTKRPYE | |
| LGLSMVRSD | | LGLSMVRSD | | LNGNGDPNNM | | MASQGTKRSHE | |
| LGLVCATCE | | LGLVCATCE | | LNGREWSYIV | | MASQGTKRSYE | |
| LGMKNVPEK | | LGMKNVPEK | | LNGTAKHIEE | | MATLCLGHHAV | |
| LGMQNGSCR | | LGMQNGSCR | | LNGVSPIHLG | | MAWSSSSCHDG | |
| LGMQNGSYR | | LGMQNGSYR | | LNGVSPVHLG | | MCAAWSSSSCF | |
| LGNCHPIGI | | LGNCHPIGI | | LNHLIGKTNQ | | MCFNGSLQCRI | |
| LGNCHPIGM | | LGNCHPIGM | | LNIESNGNLI | | MCNILKGKFQT | |
| LGNCHPVGM | | LGNCHPVGM | | LNINPVKLSS | | MCSGHSCRICI | |
| LGNCPKYIK | | LGNCPKYIK | | LNINPVTLSS | | MCSGLVGDTPR | |
| LGNGCFEFW | | LGNGCFEFW | | LNINSVKLSS | | MCSLMQGSTLP | |
| LGNGCFEFY | | LGNGCFEFY | | LNITAASLND | | MCSNGSLHGRI | |
| LGNILLSPE | | LGNILLSPE | | LNKKIDDGFL | | MCSNGSLQCKI | |
| LGNLNKKME | | LGNLNKKME | | LNKKMEDGFL | | MCSNGSLQCRI | |
| LGNPECDIL | | LGNPECDIL | | LNKKVDDGFI | | MCSNGSLQCRV | |
| LGNPECDLF | | LGNPECDLF | | LNKKVDDGFL | | MCSNGSLQCTI | |
| LGNPECDLL | | LGNPECDLL | | LNKKVDDGLL | | MCSNGSLQFRI | |
| LGNPECDRL | | LGNPECDRL | | LNKRLCKVEG | | MCSNGSLRCRI | |
| LGNPKCDLY | | LGNPKCDLY | | LNKSLCKIEG | | MCSSTEFLGQW | |
| LGNPKCDPY | | LGNPKCDPY | | LNKSLCKVEG | | MCSWSLQCRIC | |
| LGNPKCDRL | | LGNPKCDRL | | LNKSLCNVEG | | MCVCRDNWHGS | |
| LGNPLCDEF | | LGNPLCDEF | | LNKSLCSVEG | | MCVGWSSTTCH | |
| LGNPMCDDL | | LGNPMCDDL | | LNLIIGISNV | | MCVKNGNLRCT | |
| LGNPMCDEF | | LGNPMCDEF | | LNLLIGISNI | | MCVKNGNMRCT | |
| LGNPMCDEL | | LGNPMCDEL | | LNLLIGISNV | | MCYPGFVENLE | |
| LGNPMCDKF | | LGNPMCDKF | | LNLLIGVSNV | | MCYPGSIENLE | |
| LGNPMCDNL | | LGNPMCDNL | | LNLYDRVRKQ | | MCYPGSVENLE | |
| LGNPMCDYL | | LGNPMCDYL | | LNLYERVRKQ | | MDAGNGCFDIL | |
| LGNPRCDDL | | LGNPRCDDL | | LNMGQPFYSH | | MDALKLSIEDP | |
| LGNPTCDEF | | LGNPTCDEF | | LNMHDANVRN | | MDALLGDPHCD | |
| LGNQKTLDE | | LGNQKTLDE | | LNNEIRWPPH | | MDDFQLIPMIS | |
| LGNVINWTR | | LGNVINWTR | | LNNEPGSGNW | | MDEFQLIPMIS | |
| LGNYKEICI | | LGNYKEICI | | LNNKHSNGTI | | MDGVTNKVNSI | |
| LGNYKEICV | | LGNYKEICV | | LNNKHWSGYS | | MDGWYGFRHQN | |
| LGNYKEMCA | | LGNYKEMCA | | LNNKNWSGYS | | MDHTSQYLCTG | |

Fig. 83-216

| Block size 8 | SIN | Block size 9 | SIN | Block size 10 | SIN | Block size 11 | SIN |
|---|---|---|---|---|---|---|---|
| LGNYREICI | | LGNYREICI | | LNNMWSGYS | | MDKAVKLYKKL | |
| LGNYREVCI | | LGNYREVCI | | LNNNGELRHL | | MDKAVKLYRKL | |
| LGPATAQMA | | LGPATAQMA | | LNNRNWSGYS | | MDKQTKTMTIT | |
| LGQCGFLGT | | LGQCGFLGT | | LNNTEPLCDV | | MDNKTKKMTIT | |
| LGQCGILGI | | LGQCGILGI | | LNNTEPLCEV | | MDNQTKKMTIT | |
| LGQCGLLGI | | LGQCGLLGI | | LNNTEPLCNV | | MDNQTKTMTIT | |
| LGQCGLLGT | | LGQCGLLGT | | LNNVIDKMNK | | MDPRMCSLMQG | |
| LGQFPVQTD | | LGQFPVQTD | | LNNVIDKMNN | | MDQVREGRNPG | |
| LGQGTPLNN | | LGQGTPLNN | | LNNVIDKMYK | | MDQVRESRNPG | |
| LGQGTTLDH | | LGQGTTLDH | | LNPIDGPLPD | | MDRAVKLYKKL | |
| LGQGTTLDN | | LGQGTTLDN | | LNPIDGPLPE | | MDRAVKLYRKL | |
| LGQGTTLDS | | LGQGTTLDS | | LNPIDGPLPK | | MDSLKLSIEDP | |
| LGQGTTLEN | | LGQGTTLEN | | LNPIDGPLPV | | MDSRSGYETFR | |
| LGQGTTLKN | | LGQGTTLKN | | LNPMHQLLRH | | MDTIRNGTYNH | |
| LGQGTTLNN | | LGQGTTLNN | | LNQTYRNNRK | | MDTVNRTHQYS | |
| LGQGTTLSN | | LGQGTTLSN | | LNQTYRNTRK | | MDTVSRTHQYS | |
| LGQGTTLYN | | LGQGTTLYN | | LNRFIEKTNQ | | MDVNPTLLFLE | |
| LGQVECVCR | | LGQVECVCR | | LNRIIEKTNQ | | MDVNPTLLFLK | |
| LGQWDWPDG | | LGQWDWPDG | | LNRKMEDGFL | | MDVWTYNAELL | |
| LGQWNWPDG | | LGQWNWPDG | | LNRKVDDGFL | | MDYYWAILKPG | |
| LGRCGLLGT | | LGRCGLLGT | | LNRLIDKTNQ | | MDYYWAVLKPG | |
| LGRGYMFES | | LGRGYMFES | | LNRLIDRTNH | | MDYYWGILKRG | |
| LGRTISIAS | | LGRTISIAS | | LNRLIEKTND | | MEAIRNGTYNH | |
| LGRTISKDL | | LGRTISKDL | | LNRLIEKTNE | | MEAMVSRARID | |
| LGRTISKDS | | LGRTISKDS | | LNRLIEKTNK | | MECRTFFLTQG | |
| LGRTISKDT | | LGRTISKDT | | LNRLIEKTNQ | | MEDFQLIPMIS | |
| LGRTISPHS | | LGRTISPHS | | LNRLIEKTNT | | MEDFVRQCFNP | |
| LGRTISPKL | | LGRTISPKL | | LNRLIERTNE | | MEDGFIDVWTY | |
| LGRTISPRL | | LGRTISPRL | | LNRLIERTNQ | | MEDGFLDVWTY | |
| LGRTISPRS | | LGRTISPRS | | LNRLIGKTNQ | | MEDGFLGVWTY | |
| LGRTISTAS | | LGRTISTAS | | LNRLISKTNQ | | MEDGLLDVWTY | |
| LGRTTSKDS | | LGRTTSKDS | | LNRLNINPVK | | MEEFVRQCFNP | |
| LGRTTSTAS | | LGRTTSTAS | | LNRLNINPVR | | MEEGSIGKVCR | |
| LGRTVSING | | LGRTVSING | | LNRLNINPVT | | MEEVTNATETV | |
| LGRTVSISG | | LGRTVSISG | | LNRLNINSVK | | MEFEPFQSLIP | |
| LGRTVSNSG | | LGRTVSNSG | | LNRLSINPVK | | MEFEPFQSLVP | |
| LGRTVSTSG | | LGRTVSTSG | | LNRNEIKGIK | | MEFSLTDPKLE | |
| LGSAQHVEE | | LGSAQHVEE | | LNRNEIKGVK | | MEFSLTDPRFE | |
| LGSCGILGT | | LGSCGILGT | | LNRNQPAATA | | MEFSLTDPRLE | |
| LGSCHPIGM | | LGSCHPIGM | | LNRQEIEGVK | | MEFSLVDPRLE | |
| LGSPGCDHL | | LGSPGCDHL | | LNRQEIGGVK | | MEGFVRQCFNP | |
| LGSPGCDRL | | LGSPGCDRL | | LNSSCAAMDD | | MEGICYPGSIE | |
| LGSPLELRD | | LGSPLELRD | | LNTDWSGYSG | | MEGICYPGSVE | |
| LGSPLVLDD | | LGSPLVLDD | | LNTMHQLLRH | | MEGVCYPGSIE | |
| LGSPPIVSN | | LGSPPIVSN | | LNTMTKDAER | | MEGVCYPGSIK | |
| LGSPPMVSN | | LGSPPMVSN | | LNTSQRGILE | | MEHTSQYLCTG | |
| LGSPPVVSN | | LGSPPVVSN | | LNTSQRGVLE | | MEKNITVTHAQ | |
| LGSSFYAEM | | LGSSFYAEM | | LNTTLPFHNI | | MEKNVTVTHAK | |
| LGSSPNAYQ | | LGSSPNAYQ | | LNVESNGNLI | | MEKNVTVTHAQ | |
| LGSWSWHDG | | LGSWSWHDG | | LNVESNGNLV | | MELIRMIKRGI | |
| LGTIIGPPQ | | LGTIIGPPQ | | LNVWTYNAEL | | MELIRMIKRGV | |
| LGTITGPPQ | | LGTITGPPQ | | LNWLTKATNG | | MELIRMVKRGI | |
| LGTKHSNGT | | LGTKHSNGT | | LNWLTKETNG | | MELPSFGVSGI | |
| LGTKQVCAA | | LGTKQVCAA | | LNWSGYSGSF | | MELPSFGVSGV | |
| LGTKQVCIA | | LGTKQVCIA | | LPDGAQIQYF | | MELRRCLLQSL | |
| LGTKQVCMA | | LGTKQVCMA | | LPDLYDYKED | | MELVRMIKRGI | |
| LGTKQVCVA | | LGTKQVCVA | | LPDLYDYKEN | | MEMRRCLLQSL | |
| LGTLIGPPQ | | LGTLIGPPQ | | LPDLYDYKES | | MENEMTLDFHD | |
| LGTNHSNGT | | LGTNHSNGT | | LPDLYDYKKN | | MENERILDFHD | |
| LGTPLELRD | | LGTPLELRD | | LPFAAAPPEQ | | MENERTLDFHD | |
| LGTPPTVSN | | LGTPPTVSN | | LPFAAAPPKQ | | MENERTLDLHD | |
| LGTRHSNGT | | LGTRHSNGT | | LPFAAAPPVQ | | MENERTLDYHD | |

Fig. 83-217

| Block size 8 | SIN | Block size 9 | SIN | Block size 10 | SIN | Block size 11 | SIN |
|---|---|---|---|---|---|---|---|
| LGTRQVCIA | | LGTRQVCIA | | LPFASAPPEQ | | MENERTLYFHD | |
| LGTRQVCMA | | LGTRQVCMA | | LPFDFDKISQ | | MENFVRQCFNP | |
| LGTRQVCVA | | LGTRQVCVA | | LPFDIDKIIT | | MENLNKKVDDG | |
| LGTVTGPPQ | | LGTVTGPPQ | | LPFHNIHPLA | | MENQHTIDLAD | |
| LGVKGFGFK | | LGVKGFGFK | | LPFHNIHPLT | | MENQHTIDLTD | |
| LGVPFHLAT | | LGVPFHLAT | | LPFHNVHPLT | | MENQHTIDMAD | |
| LGVPFHLGT | | LGVPFHLGT | | LPFQNIDSRA | | MENQHTIEMTD | |
| LGVPFYLGT | | LGVPFYLGT | | LPFQNIDSWA | | MEQMAGSSEQA | |
| LGVSFHLGT | | LGVSFHLGT | | LPFQNINPRT | | MEQVAGSSEQA | |
| LGVSILNLG | | LGVSILNLG | | LPFQNINSRA | | MERIRNNTYDH | |
| LGVSVLNLG | | LGVSVLNLG | | LPFQNINSRT | | MERNVTVTHAQ | |
| LGVWTYNAE | | LGVWTYNAE | | LPFQNINSRV | | MESGGIDKIGT | |
| LGVYQILAI | | LGVYQILAI | | LPFQNLSPRT | | MESGGIDKIST | |
| LGYETFKVI | | LGYETFKVI | | LPFQNVNSRA | | MESGGIDKVST | |
| LGYETFKVV | | LGYETFKVV | | LPLALGMKNV | | MESGGISKIST | |
| LGYGVKGFG | | LGYGVKGFG | | LPLCPFKGFF | | MESGGISKMST | |
| LGYSTGALA | | LGYSTGALA | | LPLCPFQGFF | | MESIKNGTYDY | |
| LHAYISFRN | | LHAYISFRN | | LPLCPFRGFF | | MESIRDNTYDH | |
| LHDANVKNL | | LHDANVKNL | | LPNDKHSNGT | | MESIRNGTYDH | |
| LHDANVRNL | | LHDANVRNL | | LPQSGRIVVD | | MESIRNNTYDH | |
| LHDSNVKNL | | LHDSNVKNL | | LPRRSGAAGA | | MESIRNNTYNH | |
| LHDSNVRNL | | LHDSNVRNL | | LPSDTPRGED | | MESRGLFGAIA | |
| LHDSNVRSL | | LHDSNVRSL | | LPSFGVSGIN | | MESVKNGTYDY | |
| LHEKIRRML | | LHEKIRRML | | LPSFGVSGVN | | MESVKNGTYNY | |
| LHEKVRQML | | LHEKVRQML | | LPTFDSLNIT | | MESVRNGTYDY | |
| LHEKVRRIL | | LHEKVRRIL | | LPVGGNEKKA | | METIKNGTYDH | |
| LHEKVRRML | | LHEKVRRML | | LQALQLLLEV | | METIKNGTYNH | |
| LHERVRRML | | LHERVRRML | | LQANLCRFLE | | METIKNGTYNR | |
| LHFKQHDCD | | LHFKQHDCD | | LQAYQKRMGL | | METIRNGTYDH | |
| LHFKQHECD | | LHFKQHECD | | LQAYQKRMGV | | METIRNGTYNH | |
| LHFKQHECN | | LHFKQHECN | | LQCRICIDFR | | MEVCFMYSDFH | |
| LHFKQHKCD | | LHFKQHKCD | | LQCRICILDQ | | MEVVFPNEVGA | |
| LHFKQNECS | | LHFKQNECS | | LQCRICIRAD | | MEWIKTRPILS | |
| LHICVTGDD | | LHICVTGDD | | LQDNAKDEGN | | MEWLKTRPILS | |
| LHIPEAGLK | | LHIPEAGLK | | LQDTTWDVFI | | MEYDAVATTHS | |
| LHIPEVCLK | | LHIPEVCLK | | LQGSARHIEE | | MFALSQGTTLK | |
| LHKCDNECM | | LHKCDNECM | | LQGTKRSYEQ | | MFALSQGTTLR | |
| LHKCDNKCM | | LHKCDNKCM | | LQIISLCSIW | | MFDFIKWNVTY | |
| LHKCNDSCM | | LHKCNDSCM | | LQITSLCSIW | | MFDFSKWNVTY | |
| LHKCNNECM | | LHKCNNECM | | LQLFIKDYRY | | MFDFTKWNVTH | |
| LHKCNNSCM | | LHKCNNSCM | | LQLKDNAKEL | | MFDFTKWNVTY | |
| LHKCNNTCM | | LHKCNNTCM | | LQLKDNAREL | | MFESNGGLIAP | |
| LHLEFKADL | | LHLEFKADL | | LQLLFEVEQE | | MFESNGGLLAP | |
| LHLTGKWDT | | LHLTGKWDT | | LQLLLEVENE | | MFLYIRTNGTS | |
| LHLTGMWDT | | LHLTGMWDT | | LQLLLEVEQE | | MFLYMRTNGTS | |
| LHLTGTWDT | | LHLTGTWDT | | LQLLLEVESE | | MFLYVRTNGTS | |
| LHLTQGACW | | LHLTQGACW | | LQLNPIDGPL | | MFNMLSTVLGV | |
| LHLTQGTCW | | LHLTQGTCW | | LQLRDNAKEL | | MFSNKMARLGK | |
| LHNGGLIAP | | LHNGGLIAP | | LQLRDNAREL | | MFSNKMARLGR | |
| LHNIHPLTI | | LHNIHPLTI | | LQNASRHYMG | | MFSNKVARLGK | |
| LHQGTTIRN | | LHQGTTIRN | | LQNNAIDEGD | | MGDFVRQCFNP | |
| LHVCITGDD | | LHVCITGDD | | LQNRIMINPV | | MGEAMVSRARI | |
| LHVCVTGDD | | LHVCVTGDD | | LQNRIQIDPV | | MGECPKYVKSD | |
| LIAFVLWAC | | LIAFVLWAC | | LQNRIQIDQV | | MGFRYSGIKTD | |
| LIAGGLILG | | LIAGGLILG | | LQNRIQIDSV | | MGFRYSGIRTD | |
| LIAGWYGFQ | | LIAGWYGFQ | | LQNTSKHYIG | | MGIYQILAIYA | |
| LIALCGSPF | | LIALCGSPF | | LQQIESIIEA | | MGKCNTKCQTS | |
| LIALCGSPI | | LIALCGSPI | | LQQIESMIEA | | MGKVECVCRDN | |
| LIALCGSPV | | LIALCGSPV | | LQQIESMVEA | | MGLFFFCLKNG | |
| LIAMENQHT | | LIAMENQHT | | LQQVESMIEA | | MGLIFMCVKNG | |
| LIAPEFGYL | | LIAPEFGYL | | LQRRRFIQNA | | MGLIYNRMGAV | |
| LIAPEYGFK | | LIAPEYGFK | | LQRRRFVQNA | | MGLIYNRMGTI | |

Fig. 83-218

| Block size 8 | SIN | Block size 9 | SIN | Block size 10 | SIN | Block size 11 | SIN |
|---|---|---|---|---|---|---|---|
| LIAPEYGFR | | LIAPEYGFR | | LQSLQQIESI | | MGLIYNRMGTV | |
| LIAPEYGHL | | LIAPEYGHL | | LQSLQQIESM | | MGLKISSSFSF | |
| LIAPEYGYL | | LIAPEYGYL | | LQSRTREILT | | MGLRISSSFSF | |
| LIAPRGHYK | | LIAPRGHYK | | LQSSDDFALI | | MGLVFFCLKNG | |
| LIAPRGHYR | | LIAPRGHYR | | LQTYQKRMGV | | MGLVFFCLRNG | |
| LIAPRGYFK | | LIAPRGYFK | | LRDCKIEAVI | | MGLVFICIKNG | |
| LIAPRGYFR | | LIAPRGYFR | | LRDCKVEAVI | | MGLVFICMKNG | |
| LIAPRGYYK | | LIAPRGYYK | | LRDCSIAGWL | | MGLVFICVKNG | |
| LIAPRYGYI | | LIAPRYGYI | | LRDCSVAGWL | | MGLVFMCVKNG | |
| LIAPSRVSK | | LIAPSRVSK | | LRDNAKDEGN | | MGMAADKESTQ | |
| LIAPSRVTK | | LIAPSRVTK | | LRDNAKDLGN | | MGMFNMLSTVL | |
| LIAPWYAFR | | LIAPWYAFR | | LRDNAKEIGN | | MGMRISSSFSF | |
| LIAPWYAYK | | LIAPWYAYK | | LRDNAKELGN | | MGNGCFEFYHK | |
| LIAPWYAYR | | LIAPWYAYR | | LRDNAMILGN | | MGNGCFKIYHK | |
| LIASSGTLE | | LIASSGTLE | | LRDNANDLGN | | MGNGCFRIYHK | |
| LICATCEQI | | LICATCEQI | | LRDNLEPGTF | | MGNGCFTIYHK | |
| LIDALLGDP | | LIDALLGDP | | LRDNVKELGD | | MGNGCLKIYHK | |
| LIDAMLGDP | | LIDAMLGDP | | LRDNVKELGN | | MGQAADLKSTQ | |
| LIDFLKDVI | | LIDFLKDVI | | LRDQGWSYIV | | MGQQGRMDYYW | |
| LIDFLKDVM | | LIDFLKDVM | | LRDSLEPGTF | | MGRTISKDSRS | |
| LIDFLKDVT | | LIDFLKDVT | | LREHLSSVSS | | MGRTISMDSRS | |
| LIDFLKDVV | | LIDFLKDVV | | LRELWQCYYL | | MGRTISRDSRS | |
| LIDGWYGFK | | LIDGWYGFK | | LRENAEDIGN | | MGSIRNNTYDH | |
| LIDGWYGFR | | LIDGWYGFR | | LRENAEDKGN | | MGVAPSPSNSR | |
| LIDGWYGYH | | LIDGWYGYH | | LRENAEDMGD | | MGVQMQRFRRP | |
| LIDGWYGYK | | LIDGWYGYK | | LRENAEDMGG | | MGVYQILAIYA | |
| LIDGWYGYR | | LIDGWYGYR | | LRENAEDMGN | | MGVYQILVIYA | |
| LIDKTNQQF | | LIDKTNQQF | | LRENAEDQGN | | MGYICSGIFGD | |
| LIDNEFTEV | | LIDNEFTEV | | LRENAEDRGN | | MGYICSGVFGD | |
| LIDQSGTYP | | LIDQSGTYP | | LRENAEEDCT | | MGYKDIILWIS | |
| LIDRTNHQF | | LIDRTNHQF | | LRENAEEDGN | | MHDANVKNLHE | |
| LIDSIGSWS | | LIDSIGSWS | | LRENAEEDGT | | MHDANVRNLHD | |
| LIEDPAAPH | | LIEDPAAPH | | LRENAEEMGN | | MHDANVRNLHE | |
| LIEDPGAPH | | LIEDPGAPH | | LREQKQEFKM | | MHDRTKIRQLP | |
| LIEDPNAPH | | LIEDPNAPH | | LREQLSSVSS | | MHQLLRHFQKD | |
| LIEDPNAPN | | LIEDPNAPN | | LREQLSTVSS | | MHQLLRHFQKN | |
| LIEDPSAPH | | LIEDPSAPH | | LRFLFSSIKK | | MIADRVDDAVT | |
| LIEDPTAPH | | LIEDPTAPH | | LRFVFSIAAS | | MIALILVALAL | |
| LIEKTNDKY | | LIEKTNDKY | | LRFVFSNAAS | | MIDGWYGFHHS | |
| LIEKTNEKY | | LIEKTNEKY | | LRFVFSSAAS | | MIDGWYGFRHQ | |
| LIEKTNKQF | | LIEKTNKQF | | LRGFLIIGKE | | MIDGWYGYHHE | |
| LIEKTNQQF | | LIEKTNQQF | | LRGFLILGKE | | MIDGWYGYHHQ | |
| LIEKTNTEF | | LIEKTNTEF | | LRGFLILGRE | | MIDGWYGYHHS | |
| LIEKTNTQF | | LIEKTNTQF | | LRGGRNSFFS | | MIEAESSIKEK | |
| LIEKTSWSY | | LIEKTSWSY | | LRGIPPLELG | | MIEAESSVKEK | |
| LIENDRTLD | | LIENDRTLD | | LRGQHANGTI | | MIEAESSVREK | |
| LIENERTLD | | LIENERTLD | | LRGRGSTLGL | | MIIGGFIFGCQ | |
| LIENLQAYQ | | LIENLQAYQ | | LRGRHANGTI | | MIKAVRGDLNF | |
| LIENQKTLD | | LIENQKTLD | | LRGRHANGTM | | MIKRGINDRNF | |
| LIENTYVNN | | LIENTYVNN | | LRGSARHIEE | | MIKRGVNDRNF | |
| LIEQKVPVT | | LIEQKVPVT | | LRGSIAHKSC | | MILGNGCFEFW | |
| LIEQNIPVT | | LIEQNIPVT | | LRGSVAHKSC | | MINDKIDDQIE | |
| LIEQNVPVT | | LIEQNVPVT | | LRHFQKDAKI | | MINDKINDQIE | |
| LIERTNEKY | | LIERTNEKY | | LRHFQKDAKM | | MINNDLGPATA | |
| LIERTNQQF | | LIERTNQQF | | LRHFQKDAKV | | MINPVKLSGGY | |
| LIETNHTGT | | LIETNHTGT | | LRHFQKDARV | | MINPVKLSSGY | |
| LIETTHTGT | | LIETTHTGT | | LRHFQKNAKV | | MIRGQPKEKAI | |
| LIFLARSAL | | LIFLARSAL | | LRHLFSGIKS | | MIRGQPKEKTI | |
| LIFMARSAL | | LIFMARSAL | | LRHLFSGIRS | | MIRGQPNERTI | |
| LIFMCVKNG | | LIFMCVKNG | | LRHLFSGVNS | | MISDKIDDQIE | |
| LIFNTVIHE | | LIFNTVIHE | | LRILIRGNSP | | MISKCKTKEGR | |
| LIFNTVIHG | | LIFNTVIHG | | LRILVRGNSP | | MISKCRTKEGR | |

Fig. 83-219

| Block size 8 | SIN | Block size 9 | SIN | Block size 10 | SIN | Block size 11 | SIN |
|---|---|---|---|---|---|---|---|
| LIFSARSAL | | LIFSARSAL | | LRIPNAGIDP | | MISKCRTREGR | |
| LIGISNIGL | | LIGISNIGL | | LRISSSFSFG | | MISKSRTKEGR | |
| LIGISNMSL | | LIGISNMSL | | LRKILRKSGG | | MISNCRTKEGR | |
| LIGISNVGL | | LIGISNVGL | | LRLAIGLRNT | | MISPLAVTWWN | |
| LIGISNVVL | | LIGISNVVL | | LRLALGLRNT | | MISRARIDARI | |
| LIGKTNQQF | | LIGKTNQQF | | LRLATGLRNI | | MIWDANGWVST | |
| LIGKTSWSY | | LIGKTSWSY | | LRLATGLRNV | | MIWHSNLNDAT | |
| LIGQGDIVL | | LIGQGDIVL | | LRLATGMRNI | | MIWHSNLNDTT | |
| LIGQGDVVL | | LIGQGDVVL | | LRLAVGLRNT | | MKAVRGDLNFV | |
| LIGVSNVGL | | LIGVSNVGL | | LRMATGLRNI | | MKDRSPYRTLM | |
| LIHQSETYP | | LIHQSETYP | | LRMATGLRNV | | MKHTSQYICSP | |
| LIHQSGTYP | | LIHQSGTYP | | LRMKWMMAMK | | MKHTSQYLCTG | |
| LIIAARNIV | | LIIAARNIV | | LRMKWMMAMR | | MKIIRVGCVIL | |
| LIIAARSIV | | LIIAARSIV | | LRMVTGLRNI | | MKIYWHLMHPG | |
| LIIERKEGT | | LIIERKEGT | | LRNDTDVVNF | | MKLYWHLMHPG | |
| LIIERREGA | | LIIERREGA | | LRNDTDVVNY | | MKLYWHLMRPG | |
| LIIERREGN | | LIIERREGN | | LRNGNMRCTI | | MKLYWHLMSPG | |
| LIIERREGS | | LIIERREGS | | LRNIPSIQSR | | MKNGNMQCTIC | |
| LIIERREGT | | LIIERREGT | | LRNIPSVQSR | | MKNVPEKIHTR | |
| LIIERRNSS | | LIIERRNSS | | LRNTPSIDPK | | MKNVPEKIRTR | |
| LIIGISNVG | | LIIGISNVG | | LRNTPSIEPK | | MKNVPEKIRVK | |
| LIISPDLSY | | LIISPDLSY | | LRNTPSIEPR | | MKRKRDSSILT | |
| LIIWGIHHP | | LIIWGIHHP | | LRNTPSVEPK | | MKRKRNSSILT | |
| LIIWGIHHS | | LIIWGIHHS | | LRNTPSVEPR | | MKSRGYKMNTQ | |
| LIIWGVHHP | | LIIWGVHHP | | LRNVPSIQSR | | MKTIIIVLSCI | |
| LIIWGVHHS | | LIIWGVHHS | | LRPGETLNVE | | MKWGMELRRCL | |
| LIKHENRMV | | LIKHENRMV | | LRPGQTLRVR | | MKWGMEMRRCL | |
| LILAAIIMG | | LILAAIIMG | | LRQIIRESGG | | MKWLLSSKANQ | |
| LILAFILWA | | LILAFILWA | | LRQILRESGG | | MKWLLSSKDNQ | |
| LILAFIMWA | | LILAFIMWA | | LRQILRGSGG | | MKWLSSSGNNQ | |
| LILAFIMWT | | LILAFIMWT | | LRQILRKSGG | | MKWLSSSMNNQ | |
| LILATGLRN | | LILATGLRN | | LRQILRRSGG | | MKWLTLKSGQF | |
| LILATGVRN | | LILATGVRN | | LRQKIMESGG | | MKWMMAMKYPI | |
| LILFNTIGN | | LILFNTIGN | | LRQKVMESGG | | MKWMMAMRYPI | |
| LILGFVLWA | | LILGFVLWA | | LRQNAEEDGK | | MLADRIDDAVT | |
| LILGMQNGS | | LILGMQNGS | | LRQNAEEDGR | | MLADRVDDAVT | |
| LILGNPKCD | | LILGNPKCD | | LRQNPTEEQA | | MLADWVDDAVT | |
| LILKDCSIA | | LILKDCSIA | | LRQVLRESGG | | MLATGMKNVPE | |
| LILKDCSVA | | LILKDCSVA | | LRRCLLQSLQ | | MLATGMRNIPG | |
| LILLENERT | | LILLENERT | | LRRDQKSLRG | | MLATGMRNVPE | |
| LILRDCSVA | | LILRDCSVA | | LRRQKSLIWL | | MLCLGHHAVPN | |
| LILRGAVAH | | LILRGAVAH | | LRRQKWWVWL | | MLERELVRKTR | |
| LILRGSIAH | | LILRGSIAH | | LRSGYFEMLKI | | MLFVQSYFQLF | |
| LILRGSVAH | | LILRGSVAH | | LRSGYEMLKV | | MLGFVFTLTVP | |
| LILSFIMWA | | LILSFIMWA | | LRSGYETFKV | | MLKIHNAGTDP | |
| LILSNPKCD | | LILSNPKCD | | LRSGYWAIRT | | MLKIPNAETDP | |
| LILTFIMWA | | LILTFIMWA | | LRSILANNGK | | MLKIPNAGIDP | |
| LILVALALS | | LILVALALS | | LRSILANNGR | | MLKIPNAGTDP | |
| LIMRTVIAL | | LIMRTVIAL | | LRSILASSGS | | MLKMSLLTEVE | |
| LIMWGIHHP | | LIMWGIHHP | | LRSIVASSGT | | MLKVPNAGTDP | |
| LINDPWVLL | | LINDPWVLL | | LRSKYWAIRT | | MLKVPNALTDD | |
| LINGALGSP | | LINGALGSP | | LRSLFSSIKK | | MLKVPNALTDN | |
| LINGWYGFQ | | LINGWYGFQ | | LRSLFSSIKR | | MLKVPNALTND | |
| LINGWYGFR | | LINGWYGFR | | LRSLIASSGT | | MLLAIAMGLIF | |
| LINTYQWII | | LINTYQWII | | LRSLVASSGN | | MLLDPGDTVTF | |
| LIPMISKCK | | LIPMISKCK | | LRSLVASSGT | | MLNASCAAMDD | |
| LIPMISKCR | | LIPMISKCR | | LRSNAPSGIE | | MLNKSLCKIEG | |
| LIQFPIGTA | | LIQFPIGTA | | LRSNAPSGVE | | MLNKSLCKVEG | |
| LIQFPMGTA | | LIQFPMGTA | | LRSRYWAIRT | | MLNLYDRVRKQ | |
| LIQGYKDII | | LIQGYKDII | | LRTHESECVC | | MLNLYERVRKQ | |
| LIQLIVSGK | | LIQLIVSGK | | LRTQDSECVS | | MLQSRTREILT | |
| LIQLIVSGR | | LIQLIVSGR | | LRTQESDCVC | | MLRIPNAGIDP | |

Fig. 83-220

| Block size 8 | SIN | Block size 9 | SIN | Block size 10 | SIN | Block size 11 | SIN |
|---|---|---|---|---|---|---|---|
| LIQNSITIE | | LIQNSITIE | | LRTQESECAC | | MLSLIMRTVIA | |
| LIQNSLTIE | | LIQNSLTIE | | LRTQESECIC | | MLSTVLGVSIL | |
| LIQNSMTIE | | LIQNSMTIE | | LRTQESECLC | | MLSTVLGVSVL | |
| LIRALTLNT | | LIRALTLNT | | LRTQESECQC | | MMAMKYPITAD | |
| LIRFPIGTA | | LIRFPIGTA | | LRTQESECVC | | MMAMKYPITAE | |
| LIRFPIGVA | | LIRFPIGVA | | LRTQESECVR | | MMAMKYPITAN | |
| LIRFPVGTA | | LIRFPVGTA | | LRTQESSCTC | | MMAMRYPITAD | |
| LIRGMPKES | | LIRGMPKES | | LRTQESSCVC | | MMAYMLERELV | |
| LIRGMPQET | | LIRGMPQET | | LRVPNALTDD | | MMDGWYGFRHQ | |
| LIRGNSPIF | | LIRGNSPIF | | LRWALGENMA | | MMDQVREGRNP | |
| LIRGNSPVF | | LIRGNSPVF | | LSADGDIWVT | | MMDQVRESRNP | |
| LIRGQQGRM | | LIRGQQGRM | | LSAFDERRNK | | MMEAMVSRARI | |
| LIRGRPEEA | | LIRGRPEEA | | LSAFDERRNR | | MMGMFNMLSTV | |
| LIRGRPEEV | | LIRGRPEEV | | LSAGGAIWVT | | MMIWHSNLNDA | |
| LIRGRPKED | | LIRGRPKED | | LSAGGDIWAT | | MMIWHSNLNDT | |
| LIRGRPKEE | | LIRGRPKEE | | LSAGGDIWIT | | MMKAVRGDLNF | |
| LIRGRPKEN | | LIRGRPKEN | | LSAGGDIWVM | | MMMGMFNMLST | |
| LIRGRPKES | | LIRGRPKES | | LSAGGDIWVT | | MMSRARIDARI | |
| LIRGRPKET | | LIRGRPKET | | LSAGGHIWVT | | MMTHTSQYICS | |
| LIRGRPQEN | | LIRGRPQEN | | LSAGGNIWIT | | MMWEINGPDSV | |
| LIRGRPQET | | LIRGRPQET | | LSASGDIWIT | | MMWEINGPESV | |
| LIRGRPRES | | LIRGRPRES | | LSEQNVPVTQ | | MMWEVNGPESV | |
| LIRHENRMV | | LIRHENRMV | | LSFQGRGVFE | | MNELGIPFHLG | |
| LIRMIKRGI | | LIRMIKRGI | | LSFQVDCFLW | | MNELGVPFHLA | |
| LIRMIKRGV | | LIRMIKRGV | | LSFTITGDNT | | MNELGVPFHLG | |
| LIRMVKRGI | | LIRMVKRGI | | LSFTVTGDNT | | MNELGVPFHMG | |
| LIRTLTLNT | | LIRTLTLNT | | LSFWMCSNGS | | MNELGVPFYLG | |
| LISDGGPNL | | LISDGGPNL | | LSGGAQHVEE | | MNELGVSFHLG | |
| LISKTNQQF | | LISKTNQQF | | LSGGGDIWVT | | MNGNYDSIRGE | |
| LISTPLGSP | | LISTPLGSP | | LSGGYKDIIL | | MNGQSGRIDFH | |
| LISTPLGTP | | LISTPLGTP | | LSGGYKDVIL | | MNGQSGRIDFY | |
| LISWEMGLA | | LISWEMGLA | | LSGIPPLELG | | MNIQFEAVGRE | |
| LISWEMGQA | | LISWEMGQA | | LSGNAQHVEE | | MNIQFTAVGKE | |
| LISWGMGQA | | LISWGMGQA | | LSGNGDPNNM | | MNIQFTSVGKE | |
| LISWPLSSP | | LISWPLSSP | | LSGREWSYIV | | MNKLFERVRRQ | |
| LISWPQSSP | | LISWPQSSP | | LSGSAQHIEE | | MNKLYEKVRRQ | |
| LITDGPSDA | | LITDGPSDA | | LSGSAQHVEE | | MNKLYERVKRQ | |
| LITDGPSNA | | LITDGPSNA | | LSGVAIALSI | | MNKLYERVKQ | |
| LITDTIKSW | | LITDTIKSW | | LSGVAIALSV | | MNKLYERVRRQ | |
| LITGKSHGR | | LITGKSHGR | | LSHTAYSQIT | | MNLLIGISNVG | |
| LITQESECV | | LITQESECV | | LSIAPIMFSN | | MNNEGSYFFGD | |
| LITVGSSKY | | LITVGSSKY | | LSICSCIASS | | MNNETILETGY | |
| LITWGIHHP | | LITWGIHHP | | LSIEDPDHEG | | MNNQVFPQLNQ | |
| LIVFNTIGN | | LIVFNTIGN | | LSIEDPNHEG | | MNPNQKIICIS | |
| LIVLLENQK | | LIVLLENQK | | LSIEDPSHEG | | MNPNQKIITID | |
| LIVPEWSYI | | LIVPEWSYI | | LSIEEPSHEG | | MNPNQKIITIG | |
| LIVSLGAIS | | LIVSLGAIS | | LSIENPSHEG | | MNPNQKILCAS | |
| LIVWGIHHP | | LIVWGIHHP | | LSIIALLIGI | | MNPNQKILCTS | |
| LIVWGIHHS | | LIVWGIHHS | | LSIIPSGPLK | | MNPNQKILFAS | |
| LIVWGVHHS | | LIVWGVHHS | | LSILNLLIGI | | MNPNQKIMCIS | |
| LIWLWLVLR | | LIWLWLVLR | | LSINPVKLSS | | MNPNQKITCIS | |
| LIWMACHSA | | LIWMACHSA | | LSISIGSSTY | | MNPNQKLFALS | |
| LIYGNPFCD | | LIYGNPFCD | | LSISVESSTY | | MNPNQKLFASS | |
| LIYGNPSCD | | LIYGNPSCD | | LSISVGSSTY | | MNPNQKLFTLS | |
| LIYGNPSCN | | LIYGNPSCN | | LSIVPSGPLK | | MNPNQKTITIG | |
| LIYNRMGAV | | LIYNRMGAV | | LSIYSCIASS | | MNPNQMIITIG | |
| LIYNRMGTI | | LIYNRMGTI | | LSIYSSVASS | | MNPNQNLFTLS | |
| LIYNRMGTV | | LIYNRMGTV | | LSIYSTAASS | | MNPNQRILCTS | |
| LKAEIAQKL | | LKAEIAQKL | | LSIYSTVAAS | | MNPNQSIITIG | |
| LKAEIAQRL | | LKAEIAQRL | | LSIYSTVASS | | MNPSQKLFALS | |
| LKDCSIAGW | | LKDCSIAGW | | LSIYSTVSSS | | MNREFEVMNHE | |
| LKDCSVAGW | | LKDCSVAGW | | LSIYSTVTSS | | MNREFEVVDHE | |

Fig. 83-221

| Block size 8 | SIN | Block size 9 | SIN | Block size 10 | SIN | Block size 11 | SIN |
|---|---|---|---|---|---|---|---|
| LKDCSVSGW | | LKDCSVSGW | | LSIYSTVVSS | | MNREFEVVNHE | |
| LKDEEKIPK | | LKDEEKIPK | | LSKDNAIRIG | | MNREFGVVNHE | |
| LKDNAIDEG | | LKDNAIDEG | | LSKDNGIRIG | | MNTALLNASCA | |
| LKDNAKDEG | | LKDNAKDEG | | LSKSLCKVEG | | MNTQFEAIGRE | |
| LKDNAKDLG | | LKDNAKDLG | | LSLAIMIAGI | | MNTQFEAVGKE | |
| LKDNAKELG | | LKDNAKELG | | LSLAIMMAGI | | MNTQFEAVGRE | |
| LKDNAKEVG | | LKDNAKEVG | | LSLAIMVAGI | | MNTQFETVGKE | |
| LKDNANDLG | | LKDNANDLG | | LSLCMCSNGS | | MNTQFTAVGKE | |
| LKDNARELG | | LKDNARELG | | LSLIMRTVIA | | MNTQFTSVGKE | |
| LKDNLEPGT | | LKDNLEPGT | | LSLLEMCHST | | MNTQFTVVGKE | |
| LKDQAWSYI | | LKDQAWSYI | | LSLWMCFNGS | | MNTQIIVILVL | |
| LKDQDWSYI | | LKDQDWSYI | | LSLWMCSNGS | | MNTSKPFQNIC | |
| LKDQGWSYI | | LKDQGWSYI | | LSMAPIMFSN | | MNTSKPFQNTS | |
| LKDQSWSYI | | LKDQSWSYI | | LSMEFSLTDP | | MNTSKPLQNTS | |
| LKEQLSTVS | | LKEQLSTVS | | LSMVKSDKIC | | MPASRYLTDMT | |
| LKFKADLII | | LKFKADLII | | LSMVRSDKIC | | MPFHNIHPLTI | |
| LKGKFQTAA | | LKGKFQTAA | | LSNMGIYQIL | | MPFHNVHPLTI | |
| LKGLILGNP | | LKGLILGNP | | LSNMGVYQIL | | MPLHNIHPLTI | |
| LKGNAKDEG | | LKGNAKDEG | | LSNNATDTVD | | MQALQLLFEVE | |
| LKGRHANGT | | LKGRHANGT | | LSNNSSDTVD | | MQALQLLLEVE | |
| LKGSAKHIE | | LKGSAKHIE | | LSNNSTDKID | | MQFSSFTVNVR | |
| LKGSARHIE | | LKGSARHIE | | LSNNSTDKVD | | MQFSSLAVNVR | |
| LKGVRPLIL | | LKGVRPLIL | | LSNNSTDKVN | | MQFSSLTVNVR | |
| LKHNPTEEQ | | LKHNPTEEQ | | LSNNSTDTVD | | MQFSSLTVSVR | |
| LKHRFEIIE | | LKHRFEIIE | | LSNNSTEKVD | | MQGSTLPRRSG | |
| LKIHNAGTD | | LKIHNAGTD | | LSNNSTERVD | | MQIRGFVHFVE | |
| LKIKKGKIM | | LKIKKGKIM | | LSNPKCDLYL | | MQIRGFVYFVE | |
| LKIKKGKIV | | LKIKKGKIV | | LSPEEVSEAQ | | MQLKDNAKEVG | |
| LKIPNAETD | | LKIPNAETD | | LSPEEVSETQ | | MQLRDNAKEIG | |
| LKIPNAGID | | LKIPNAGID | | LSPGMMMGMF | | MQLRDNAKELG | |
| LKIPNAGTD | | LKIPNAGTD | | LSPLTKGILG | | MQLRDNAKETG | |
| LKIRKGKIM | | LKIRKGKIM | | LSPLTKGMLG | | MQLRDNVKELG | |
| LKIRKGKIV | | LKIRKGKIV | | LSPNVYQARF | | MQNGSCRCMFC | |
| LKIRTNGNL | | LKIRTNGNL | | LSPRTVGQCP | | MQNGSYRCMFC | |
| LKISSSFSF | | LKISSSFSF | | LSQGTTIRGK | | MQNKLNNVIDK | |
| LKITENSFE | | LKITENSFE | | LSQGTTIRGR | | MQNRIQIDPVK | |
| LKIYHKCDN | | LKIYHKCDN | | LSQGTTLKGR | | MQNRLNNVIDK | |
| LKKQEIEGI | | LKKQEIEGI | | LSQGTTLRGQ | | MQRFRRPDSSW | |
| LKLAIGLRN | | LKLAIGLRN | | LSQGTTLRGR | | MRCTISLVKTT | |
| LKLAIGPRN | | LKLAIGPRN | | LSQKFEEIRW | | MRDSIKSWRNN | |
| LKLASGLRN | | LKLASGLRN | | LSRCRETRGL | | MREPFISCSHF | |
| LKLATGLKN | | LKLATGLKN | | LSRCRKTRGL | | MREPFISCSHL | |
| LKLATGLRN | | LKLATGLRN | | LSRTREILTK | | MRINNETILET | |
| LKLATGMRN | | LKLATGMRN | | LSSGYKDIIL | | MRINNETIVET | |
| LKLATGPRN | | LKLATGPRN | | LSSGYKDVIL | | MRISNETILET | |
| LKLAVGLKN | | LKLAVGLKN | | LSSGYKEIIL | | MRISSSFSFGG | |
| LKLAVGLRN | | LKLAVGLRN | | LSSGYKEVIL | | MRKKRGLFGAI | |
| LKLAVGMRN | | LKLAVGMRN | | LSSKANQVFP | | MRKKRGLFGAK | |
| LKLAVGPRN | | LKLAVGPRN | | LSSKDNQVFP | | MRNIPEKQTRG | |
| LKLGQFPVQ | | LKLGQFPVQ | | LSSMGIYQIL | | MRNIPERQTRG | |
| LKLSIEDPD | | LKLSIEDPD | | LSSMGVYQIL | | MRNIPGKQAKG | |
| LKLSIEDPN | | LKLSIEDPN | | LSSPPTVYNN | | MRNVPEKQTRG | |
| LKLSIEDPS | | LKLSIEDPS | | LSSPPTVYNS | | MRNVPERQTRG | |
| LKLSIENPS | | LKLSIENPS | | LSSPPTVYNT | | MRNVPETQTRG | |
| LKLVDGQDC | | LKLVDGQDC | | LSSRISFYWT | | MRPCFWVELIR | |
| LKMATGLRN | | LKMATGLRN | | LSSSGNNQVF | | MRPCFWVELVR | |
| LKMPASRYL | | LKMPASRYL | | LSSSMNNQVF | | MRRCLLQSLQQ | |
| LKMSLLTEV | | LKMSLLTEV | | LSSSYKDIIL | | MRTPIAFLTSS | |
| LKMTIASDI | | LKMTIASDI | | LSSVNTNTIN | | MRTQESECACV | |
| LKNGNMRCT | | LKNGNMRCT | | LSSVSSFEKF | | MRTQESECVCQ | |
| LKNNAIDEG | | LKNNAIDEG | | LSSVSSFERF | | MRTQESSCTCI | |
| LKNNAKDEG | | LKNNAKDEG | | LSSVSSFKRF | | MRWLTLKLGQF | |

Fig. 83-222

| Block size 8 | SIN | Block size 9 | SIN | Block size 10 | SIN | Block size 11 | SIN |
|---|---|---|---|---|---|---|---|
| LKPGETLKV | | LKPGETLKV | | LSSVTTNTIN | | MRWLTLKSEQF | |
| LKPGETLNI | | LKPGETLNI | | LSTIALFIGV | | MRWLTLKSGQF | |
| LKPGETLNV | | LKPGETLNV | | LSTIALIIGV | | MSCFVFVALIL | |
| LKPGQTLRI | | LKPGQTLRI | | LSTIALLIGI | | MSCHIGVAPSP | |
| LKPGQTLRV | | LKPGQTLRV | | LSTIALLIGV | | MSCPIGEAPSP | |
| LKPGQTVKI | | LKPGQTVKI | | LSTNSSDKVD | | MSCPIGEVPSP | |
| LKPQCQITG | | LKPQCQITG | | LSTNSSEKVD | | MSCPIGVAPSP | |
| LKQNPTEEQ | | LKQNPTEEQ | | LSTNSSEKVN | | MSCPLGEAPSP | |
| LKREITFHG | | LKREITFHG | | LSTNSSERVD | | MSCPMGVAPSP | |
| LKREMTFHG | | LKREMTFHG | | LSTNSTEKVD | | MSCPVGEAPSP | |
| LKRGETLKI | | LKRGETLKI | | LSTRGIQIAS | | MSCPVGVAPSP | |
| LKRNEIKGV | | LKRNEIKGV | | LSTRGVQIAS | | MSDIEAMASQG | |
| LKRQEIDGI | | LKRQEIDGI | | LSTRGVQVAS | | MSDIEIMASQG | |
| LKRQEIEGI | | LKRQEIEGI | | LSTVLGVSIL | | MSDIGAMASQG | |
| LKRQEINGI | | LKRQEINGI | | LSTVSSFERF | | MSDINIMASQG | |
| LKRRAIATP | | LKRRAIATP | | LSVAPIMFSN | | MSDSIKSWRKD | |
| LKSDKRIGS | | LKSDKRIGS | | LSVIPSGPLK | | MSELGVPFHLG | |
| LKSEDNVYK | | LKSEDNVYK | | LSVLNLLIGI | | MSFQGRGVFEL | |
| LKSEQFPVQ | | LKSEQFPVQ | | LSVLNLLIGV | | MSGPNDNASAV | |
| LKSGQFPVQ | | LKSGQFPVQ | | LSVYSTVASS | | MSGPNNNASAV | |
| LKSLFSSIK | | LKSLFSSIK | | LSYKVGYLCA | | MSGYSGIFSVE | |
| LKSNAIDEG | | LKSNAIDEG | | LSYQVGYLCA | | MSICISGPNNN | |
| LKSTQAAID | | LKSTQAAID | | LSYRVGYLCA | | MSICMSGPNDN | |
| LKSTQAAIN | | LKSTQAAIN | | LSYSAGALAS | | MSICMSGPNNN | |
| LKSTQAAIT | | LKSTQAAIT | | LSYSTGALAS | | MSICVSGPNNN | |
| LKSTQAAVN | | LKSTQAAVN | | LSYSVGYLCA | | MSIGITVIKNN | |
| LKSTQTAID | | LKSTQTAID | | LSYTVGYLCA | | MSIGVAVIKNN | |
| LKSWKGNIM | | LKSWKGNIM | | LTDAEMNKLF | | MSIGVTVIKNN | |
| LKTEDNIYK | | LKTEDNIYK | | LTDKGSIQSD | | MSIGVTVIRNN | |
| LKTEDNVYK | | LKTEDNVYK | | LTDNHVEVVS | | MSKEGSYFFGD | |
| LKTRPILSP | | LKTRPILSP | | LTDNPRPNDP | | MSKKKSYINKT | |
| LKVESNGNL | | LKVESNGNL | | LTDSEMNKLF | | MSKKKSYINRT | |
| LKVPNAEKD | | LKVPNAEKD | | LTDSEMNKLY | | MSKRKSYINKT | |
| LKVPNAGTD | | LKVPNAGTD | | LTDSEMSKLF | | MSLLTEVETYV | |
| LKVPNALTD | | LKVPNALTD | | LTDSEMSKLY | | MSLSRTREILT | |
| LKWALGENM | | LKWALGENM | | LTDSQTATKR | | MSNEGSYFFGD | |
| LKWLISKSK | | LKWLISKSK | | LTDTSKPSDK | | MSNNSTEKVDT | |
| LKWLVSKDK | | LKWLVSKDK | | LTDTSRPGDK | | MSQPRTREILT | |
| LKWLVSKNK | | LKWLVSKNK | | LTDTSRPGDR | | MSQSRTREILT | |
| LKWLVSKSK | | LKWLVSKSK | | LTDTSRPKDK | | MSQSRTRGILT | |
| LKWLVSKTK | | LKWLVSKTK | | LTDTSRPNDP | | MSRARIDARID | |
| LKWTLGENM | | LKWTLGENM | | LTDTSRPSDK | | MSTNAYDRICI | |
| LKWVLGENM | | LKWVLGENM | | LTDTSRPSDP | | MSTPLGTPPTV | |
| LKYKGIITG | | LKYKGIITG | | LTDTSRPSDR | | MSVCISGPNNN | |
| LKYNDIITD | | LKYNDIITD | | LTDTSRPTDP | | MSVCMSGPNNN | |
| LKYNGIITD | | LKYNGIITD | | LTDWSGYSGS | | MSVGVTVIKNN | |
| LKYNGIITE | | LKYNGIITE | | LTEIWSYNAE | | MSVLLGSSPNA | |
| LKYNGIITG | | LKYNGIITG | | LTEKGIEVVN | | MSVPLGSSPNA | |
| LKYNGVITD | | LKYNGVITD | | LTEKGVEVVN | | MSVPMGSSPNA | |
| LLAFILWAC | | LLAFILWAC | | LTENGVPVTS | | MTDGNASGKAD | |
| LLAFMLWAC | | LLAFMLWAC | | LTEQNVPVTQ | | MTDGPANKQAS | |
| LLAFVLWAC | | LLAFVLWAC | | LTEREVEVVN | | MTDGPANNQAS | |
| LLAIAMGLG | | LLAIAMGLG | | LTERGIEVVN | | MTDGPANSQAS | |
| LLAIAMGLI | | LLAIAMGLI | | LTERGVEVVD | | MTDGPASNQAS | |
| LLAIAMGLV | | LLAIAMGLV | | LTERGVEVVN | | MTDGPASSQAY | |
| LLAIVMGLV | | LLAIVMGLV | | LTETGVPVTS | | MTDGPSDAQAF | |
| LLAJVMGLV | | LLAJVMGLV | | LTEVETYVLS | | MTDGSANSQAY | |
| LLAKSVFNC | | LLAKSVFNC | | LTFILWACQN | | MTDGSASGKAD | |
| LLAKSVFNN | | LLAKSVFNN | | LTFLARSALI | | MTDGSASGKAE | |
| LLAKSVFNS | | LLAKSVFNS | | LTGGQSFYRS | | MTDGSASGQAY | |
| LLAPKYGYI | | LLAPKYGYI | | LTGIWDTLIE | | MTDGSASGRAD | |
| LLAPRYGYI | | LLAPRYGYI | | LTGKWDTLIE | | MTDGSASRKAD | |

Fig. 83-223

| Block size 8 | SIN | Block size 9 | SIN | Block size 10 | SIN | Block size 11 | SIN |
|---|---|---|---|---|---|---|---|
| LLASTNAHD | | LLASTNAHD | | LTGNLQALKI | | MTDGSASSQAH | |
| LLASTNAYD | | LLASTNAYD | | LTGNLQTLKI | | MTDGSASSQAY | |
| LLATGMKNV | | LLATGMKNV | | LTGNLQTLKL | | MTDSEMLNLYE | |
| LLATGMRNI | | LLATGMRNI | | LTGNLQTLKV | | MTDSEMNKLFE | |
| LLATGMRNV | | LLATGMRNV | | LTGNLQTLRI | | MTDSIKSWRKD | |
| LLAVVMGLV | | LLAVVMGLV | | LTGRGIEVVN | | MTDSIKSWRRD | |
| LLDNLQAYQ | | LLDNLQAYQ | | LTGTAKHIEE | | MTEIWSYNAEL | |
| LLDPGDTVT | | LLDPGDTVT | | LTGTWDTLIE | | MTEVWSYNAEF | |
| LLDPNDTVT | | LLDPNDTVT | | LTHALRELWQ | | MTEVWSYNAEL | |
| LLDVWTYNA | | LLDVWTYNA | | LTHGALLNDK | | MTHTSQYICSP | |
| LLEDERTLD | | LLEDERTLD | | LTHGSLLNDK | | MTIASDILKRM | |
| LLEKNVTVT | | LLEKNVTVT | | LTHHMRKKRG | | MTIASDILTRM | |
| LLEMCHGTQ | | LLEMCHGTQ | | LTHIMIWHSN | | MTICIQGNNDN | |
| LLEMCHSTQ | | LLEMCHSTQ | | LTHLMIWHSN | | MTICVQGKNDN | |
| LLEMCHSTR | | LLEMCHSTR | | LTHMMIWHSN | | MTICVQGNNDN | |
| LLENDKTLD | | LLENDKTLD | | LTIGECPKYI | | MTICVQGNNKN | |
| LLENDKTLN | | LLENDKTLN | | LTIGECPKYV | | MTICVQGNNNN | |
| LLENDRTLD | | LLENDRTLD | | LTIGECPRYV | | MTKDAERGKLK | |
| LLENDVPVT | | LLENDVPVT | | LTIGISGPDD | | MTLDFHDSNVK | |
| LLENEKTLD | | LLENEKTLD | | LTIGISGPDN | | MTRGLFGAIAG | |
| LLENERTLD | | LLENERTLD | | LTIGISGPDS | | MTSIRNNTYDH | |
| LLENGRTLD | | LLENGRTLD | | LTIGITGPDA | | MVAYMLERELV | |
| LLENGRTLG | | LLENGRTLG | | LTIGKCPKYV | | MVDGWYGFHHS | |
| LLENGVPVT | | LLENGVPVT | | LTIGVSGPDN | | MVDGWYGFRHH | |
| LLENLQAYQ | | LLENLQAYQ | | LTIIYSSSMM | | MVDGWYGFRHQ | |
| LLENLQTYQ | | LLENLQTYQ | | LTITYSSPMM | | MVDGWYGYHHE | |
| LLENNVPVT | | LLENNVPVT | | LTITYSSSLM | | MVDGWYGYHHN | |
| LLENQKILD | | LLENQKILD | | LTITYSSSMM | | MVDGWYGYHHQ | |
| LLENQKPLD | | LLENQKPLD | | LTIYSTAASS | | MVDGWYGYHHS | |
| LLENQKTLD | | LLENQKTLD | | LTIYSTVASS | | MVDQVRESRNP | |
| LLESDVPVT | | LLESDVPVT | | LTKATNGNYG | | MVDTILERNVT | |
| LLEVGTRWM | | LLEVGTRWM | | LTKETNGNYG | | MVEAESSVKEK | |
| LLFLEVPAQ | | LLFLEVPAQ | | LTKGEKANVL | | MVEAMISRARI | |
| LLFLKIPAQ | | LLFLKIPAQ | | LTKGILGFVF | | MVEAMMSRARI | |
| LLFLKIPVQ | | LLFLKIPVQ | | LTKGLCTINS | | MVEAMVSRARI | |
| LLFLKVPAQ | | LLFLKVPAQ | | LTKGMLGFVF | | MVFCGVSGEVP | |
| LLFLKVPVQ | | LLFLKVPVQ | | LTKGVLGFVF | | MVGLILAFIMW | |
| LLFMIIGGF | | LLFMIIGGF | | LTKITVDHMA | | MVIASTTAKAM | |
| LLFQDILMR | | LLFQDILMR | | LTKKEPDTYD | | MVKAVRGDLNF | |
| LLGAIAGFI | | LLGAIAGFI | | LTKKKNPEAY | | MVKRGINDRNF | |
| LLGIITGPP | | LLGIITGPP | | LTKKKPDIYD | | MVKSDKICLGH | |
| LLGILIGPP | | LLGILIGPP | | LTKKKPDTYD | | MVLASTTAKAM | |
| LLGINMSKK | | LLGINMSKK | | LTKRLCTINS | | MVLSAFDERRN | |
| LLGNPECDI | | LLGNPECDI | | LTKTTVDHMA | | MVNERTLDFHD | |
| LLGNPECDL | | LLGNPECDL | | LTLGITGPDA | | MVNGWYGFRHQ | |
| LLGNPECDR | | LLGNPECDR | | LTLGITGPDS | | MVRSDKICLGH | |
| LLGNPKCDR | | LLGNPKCDR | | LTLGITGPDT | | MVSPLAITWWN | |
| LLGNPLCDE | | LLGNPLCDE | | LTLKLGQFPV | | MVSPLAVTWWN | |
| LLGNPMCDA | | LLGNPMCDA | | LTLKSEQFPV | | MVSRARIDARI | |
| LLGNPMCDE | | LLGNPMCDE | | LTLKSGQFPV | | MVSRARIDARV | |
| LLGNPMCDK | | LLGNPMCDK | | LTLNTMTKDA | | MVTFCGLDNEP | |
| LLGNQKTLD | | LLGNQKTLD | | LTMGECPKYV | | MVWDANGWVST | |
| LLGSAQHVE | | LLGSAQHVE | | LTMGYKDIIL | | MVWDANGWVTA | |
| LLGTITGPP | | LLGTITGPP | | LTNSEMNKLY | | MWACNSGNCRF | |
| LLGTKHSNG | | LLGTKHSNG | | LTQGACWEQL | | MWACQKGNIKC | |
| LLGTLIGPP | | LLGTLIGPP | | LTQGALLNDK | | MWACQKGNIRC | |
| LLGTLTGPP | | LLGTLTGPP | | LTQGALLNDR | | MWACQRGNIRC | |
| LLGTNHSNG | | LLGTNHSNG | | LTQGRQTFDW | | MWACSNGNCRF | |
| LLGTRHSNG | | LLGTRHSNG | | LTQGRQTYDW | | MWACSNGSCRF | |
| LLGTVTGPP | | LLGTVTGPP | | LTQGSLLNDK | | MWACSSGNCRF | |
| LLHKCNDSC | | LLHKCNDSC | | LTQGSLLNDR | | MWALGENMAPE | |
| LLHKCNNSC | | LLHKCNNSC | | LTQGSLPNDK | | MWEINGPDSVL | |

Fig. 83-224

| Block size 8 | SIN | Block size 9 | SIN | Block size 10 | SIN | Block size 11 | SIN |
|---|---|---|---|---|---|---|---|
| LLHKCNNTC | | LLHKCNNTC | | LTQGTCWEQL | | MWEINGPESVL | |
| LLIAFVLWA | | LLIAFVLWA | | LTQGTCWEQM | | MWEVNGPESVL | |
| LLIAMENQH | | LLIAMENQH | | LTQGYKDIIL | | MWTCNSGNCRF | |
| LLIAQALRD | | LLIAQALRD | | LTRELCTINS | | MWTYNAELLVL | |
| LLIGISNIG | | LLIGISNIG | | LTRGLCKINS | | MYALHQGTTIR | |
| LLIGISNMS | | LLIGISNMS | | LTRGLCTINS | | MYQKCCNLFEK | |
| LLIGISNVG | | LLIGISNVG | | LTRTTVDHMA | | MYQKCCNLFER | |
| LLIGISNVV | | LLIGISNVV | | LTSLPFQNIH | | MYQKCCSLFEK | |
| LLIGVSNVG | | LLIGVSNVG | | LTSVTTNTIN | | MYQKCCTLFEK | |
| LLIIWGIHH | | LLIIWGIHH | | LTTDWSGYSG | | MYQRCCNLFEK | |
| LLILLENER | | LLILLENER | | LTTGKSHGRI | | MYSDFHFIDEQ | |
| LLILWGIHH | | LLILWGIHH | | LTTIGLLLQI | | MYSDFHFIDER | |
| LLISDGGPN | | LLISDGGPN | | LTTIGPLLQI | | MYSDFHFINEL | |
| LLITQALRD | | LLITQALRD | | LTTRGVQIAS | | MYSDFHFINEQ | |
| LLIVQAFRD | | LLIVQAFRD | | LTTTIKPWAR | | MYSDFHFINER | |
| LLIVQALRD | | LLIVQALRD | | LTTTIKTWAG | | NAALGSPGCDH | |
| LLKERGFFG | | LLKERGFFG | | LTTTIKTWAK | | NAASYKRIRLF | |
| LLKGESHCR | | LLKGESHCR | | LTTTIKTWAR | | NADHRIYWIRK | |
| LLKGESHGK | | LLKGESHGK | | LTTTIRTWAK | | NADKICLGHHA | |
| LLKGESHGR | | LLKGESHGR | | LTTTPTKSYF | | NADLEALMEWL | |
| LLKGESYGR | | LLKGESYGR | | LTTTVKTWAG | | NADLLVAMENQ | |
| LLKHRFEII | | LLKHRFEII | | LTTVGLLLQI | | NADVLVALENQ | |
| LLKPGQTLR | | LLKPGQTLR | | LTVEVPYVCT | | NAEDKGNGCFE | |
| LLLAFILWA | | LLLAFILWA | | LTVNVRGSGL | | NAEDLGNGCFK | |
| LLLAFMLWA | | LLLAFMLWA | | LTVNVRGSGM | | NAEDMGNGCFK | |
| LLLAFVLWA | | LLLAFVLWA | | LTVNVRGTGM | | NAEDMGNGCFR | |
| LLLATGMKN | | LLLATGMKN | | LTVPSERGLQ | | NAEDMGNGCFT | |
| LLLATGMRN | | LLLATGMRN | | LTVSVRGSGM | | NAEDMGNGCLK | |
| LLLLQANLC | | LLLLQANLC | | LVADGGPNLY | | NAEDQGNGCFE | |
| LLLMIIGGF | | LLLMIIGGF | | LVAGGLILGM | | NAEDRGNGCFE | |
| LLLNKSLCN | | LLLNKSLCN | | LVAGWYGFQH | | NAEEDCTGCFE | |
| LLLNKSLCS | | LLLNKSLCS | | LVAIENQHTI | | NAEEDGKGCFE | |
| LLLQANLCR | | LLLQANLCR | | LVALALSHTA | | NAEEDGNGCFE | |
| LLLQIISLC | | LLLQIISLC | | LVALCGSPIS | | NAEEDGRGCFE | |
| LLLQITSLC | | LLLQITSLC | | LVALCGSPVP | | NAEEDGTGCFE | |
| LLLQVTSLC | | LLLQVTSLC | | LVALCGSPVS | | NAEFFVLMENE | |
| LLLWMCSNG | | LLLWMCSNG | | LVALENQHTI | | NAEFLVALENQ | |
| LLMDALKLS | | LLMDALKLS | | LVALENQNTI | | NAEFLVAMENQ | |
| LLMDSLKLS | | LLMDSLKLS | | LVAMENQHTI | | NAEFLVAVENQ | |
| LLMIIGGFI | | LLMIIGGFI | | LVAPEYGFKI | | NAEGIGIAADR | |
| LLMNELGIP | | LLMNELGIP | | LVAPRGHYKL | | NAEGTGIAADR | |
| LLMNELGVP | | LLMNELGVP | | LVASSGNLEF | | NAEGTGMAADQ | |
| LLMNELGVS | | LLMNELGVS | | LVASSGTLEF | | NAEGTGMAADR | |
| LLMSELGVP | | LLMSELGVP | | LVAVENQHTI | | NAEGTGTAADL | |
| LLMSTNAYD | | LLMSTNAYD | | LVCATCEQIA | | NAEIEDLIFLA | |
| LLNASCAAM | | LLNASCAAM | | LVCVSLLQSA | | NAEIEDLIFLT | |
| LLNASWFNS | | LLNASWFNS | | LVDALLGDPH | | NAEIEDLIFMA | |
| LLNDKHFNG | | LLNDKHFNG | | LVDGQDCDLI | | NAEIEDLIFSA | |
| LLNDKHSNE | | LLNDKHSNE | | LVDGWYGFRH | | NAEIEDLTFLA | |
| LLNDKHSNG | | LLNDKHSNG | | LVDGWYGYHH | | NAEILVALENQ | |
| LLNDKHSNN | | LLNDKHSNN | | LVDSIGSWSQ | | NAEILVLMENE | |
| LLNDKHSSG | | LLNDKHSSG | | LVDSIVSWSQ | | NAELFVLMENE | |
| LLNDRHSNG | | LLNDRHSNG | | LVETNHTDEL | | NAELIVLLENQ | |
| LLNKSLCNV | | LLNKSLCNV | | LVETNHTGTY | | NAELLIAMENQ | |
| LLNKSLCSV | | LLNKSLCSV | | LVETSHTGTY | | NAELLILLENE | |
| LLNPFVSHK | | LLNPFVSHK | | LVFFCLKNGN | | NAELLVALENQ | |
| LLNRININP | | LLNRININP | | LVFFCLRNGN | | NAELLVAMENQ | |
| LLNRLNINP | | LLNRLNINP | | LVFICIKNGN | | NAELLVLIENE | |
| LLNRLNINS | | LLNRLNINS | | LVFICMKNGN | | NAELLVLIENQ | |
| LLNRLSINP | | LLNRLSINP | | LVFICVKNGN | | NAELLVLLEDE | |
| LLPFAAAPP | | LLPFAAAPP | | LVFMCVKNGN | | NAELLVLLENE | |
| LLPFASAPP | | LLPFASAPP | | LVFREQKQEF | | NAELLVLLENG | |

Fig. 83-225

| Block size 8 | SIN | Block size 9 | SIN | Block size 10 | SIN | Block size 11 | SIN |
|---|---|---|---|---|---|---|---|
| LLQANLCRF | | LLQANLCRF | | LVGDTPRNDD | | NAELLVLLENQ | |
| LLQIISLCS | | LLQIISLCS | | LVGDTPRNED | | NAELLVLLGNQ | |
| LLQITSLCS | | LLQITSLCS | | LVGDTPRNGD | | NAELLVLMENE | |
| LLQSAILSL | | LLQSAILSL | | LVGDTPRNND | | NAEVLVLMENE | |
| LLQSLQQIE | | LLQSLQQIE | | LVGIDPFKLL | | NAGKDPKKTGG | |
| LLRENAEED | | LLRENAEED | | LVGIDPFRLL | | NAGLLVALENQ | |
| LLRGESHGR | | LLRGESHGR | | LVGINMSKKK | | NAHDRICIGYQ | |
| LLRHFQKDA | | LLRHFQKDA | | LVGINMSKRK | | NAHILVTREPY | |
| LLRHFQKNA | | LLRHFQKNA | | LVGLILAFIL | | NAIDAGDGCFE | |
| LLSLLEMCH | | LLSLLEMCH | | LVGLILAFIM | | NAIDAGNGCFD | |
| LLSPEEVSE | | LLSPEEVSE | | LVGLILSFIM | | NAIDEGDGCFN | |
| LLSSKANQV | | LLSSKANQV | | LVGLILTFIM | | NAIDEGDGCFS | |
| LLSSKDNQV | | LLSSKDNQV | | LVGPILSFIM | | NAIDEGNGCFE | |
| LLTEVETYV | | LLTEVETYV | | LVGTKHSNGT | | NAIDNGDGCFE | |
| LLVADGGPN | | LLVADGGPN | | LVGVDPFKLL | | NAIDTGDGCFE | |
| LLVALENQH | | LLVALENQH | | LVGVDPFRLL | | NAIDTGKGCFD | |
| LLVALENQN | | LLVALENQN | | LVIAARNIVR | | NAIDTGNGCFD | |
| LLVAMENQH | | LLVAMENQH | | LVLAIGLRNV | | NAIGDCPKYIK | |
| LLVLIENDR | | LLVLIENDR | | LVLATGLRNI | | NAINEGNGCFE | |
| LLVLIENER | | LLVLIENER | | LVLATGLRNV | | NAIRFGEGEQI | |
| LLVLIENQK | | LLVLIENQK | | LVLATGPRNV | | NAIRFGESEQI | |
| LLVLLEDER | | LLVLLEDER | | LVLDDCSLEG | | NAIRFGESEQV | |
| LLVLLENDK | | LLVLLENDK | | LVLDDCSLKG | | NAISTTFPYTG | |
| LLVLLENDR | | LLVLLENDR | | LVLGDCSIAG | | NAITRSGQNHG | |
| LLVLLENEK | | LLVLLENEK | | LVLGLSMVKS | | NAKDEGNGCFP | |
| LLVLLENER | | LLVLLENER | | LVLGLSMVRS | | NAKDEGNGCFT | |
| LLVLLENGR | | LLVLLENGR | | LVLGNPKCDL | | NAKDLGNGCFE | |
| LLVLLENQK | | LLVLLENQK | | LVLIENDRTL | | NAKEIGNGCFE | |
| LLVLLGNQK | | LLVLLGNQK | | LVLIENERTL | | NAKEIGNGCFK | |
| LLVLMENEM | | LLVLMENEM | | LVLIENQKTL | | NAKELGNGCFE | |
| LLVLMENER | | LLVLMENER | | LVLLEDERTL | | NAKEMGNGCFE | |
| LLVLMETER | | LLVLMETER | | LVLLENDKTL | | NAKETGNGCFE | |
| LLVLWGIHH | | LLVLWGIHH | | LVLLENDRTL | | NAKEVGNGCFE | |
| LLVLWGVHH | | LLVLWGVHH | | LVLLENEKTL | | NAKEWGNGCFE | |
| LLVMWGIHH | | LLVMWGIHH | | LVLLENERTL | | NAKLLVLIEND | |
| LLVSDGGPN | | LLVSDGGPN | | LVLLENGRTL | | NAKLLVLLEND | |
| LLVSLGAIS | | LLVSLGAIS | | LVLLENQKIL | | NAKLLVLLENG | |
| LLVSLGAVS | | LLVSLGAVS | | LVLLENQKPL | | NALDTGDGCFE | |
| LLVSTNAYD | | LLVSTNAYD | | LVLLENQKTL | | NALGDCPKYIK | |
| LLVVQALRD | | LLVVQALRD | | LVLLFMIIGG | | NALGECPKYIK | |
| LLVWLENEK | | LLVWLENEK | | LVLLGNQKTL | | NALGNCPKYIK | |
| LLWMCSNGS | | LLWMCSNGS | | LVLLLMIIGG | | NALLKHRFEII | |
| LMDALKLSI | | LMDALKLSI | | LVLMENEMTL | | NALNGNGDPNN | |
| LMDALLGDP | | LMDALLGDP | | LVLMENERTL | | NALSGNGDPNN | |
| LMDFLKDVM | | LMDFLKDVM | | LVLNKSLCKV | | NALSIAPIMFS | |
| LMDSLKLSI | | LMDSLKLSI | | LVLWGIHHPD | | NALTGGQSFYR | |
| LMENEMTLD | | LMENEMTLD | | LVMGQQGRMD | | NAMDAGNGCFD | |
| LMENERILD | | LMENERILD | | LVMKRKRDSS | | NANDLGNGCFE | |
| LMENERTLD | | LMENERTLD | | LVMKRKRNSS | | NANTLSSVNTN | |
| LMENERTLY | | LMENERTLY | | LVMWGIHHPS | | NANTLSSVTTN | |
| LMEQNVPVT | | LMEQNVPVT | | LVNPGDSIIF | | NANTLTSVTTN | |
| LMEWIKTRP | | LMEWIKTRP | | LVNTYQWIIK | | NAPHKLCFPGE | |
| LMEWLKTRP | | LMEWLKTRP | | LVNTYQWIIR | | NAPHKLCYPGE | |
| LMIIGGFIF | | LMIIGGFIF | | LVNTYQWVIR | | NAPNKFCYPGE | |
| LMIWHSNLN | | LMIWHSNLN | | LVPCEPIIE | | NAPNKLCFPGE | |
| LMLATGMKN | | LMLATGMKN | | LVPCFWLEMI | | NAPNKLCYPGE | |
| LMLATGMRN | | LMLATGMRN | | LVPCFWVEMI | | NAPSGIEYNGK | |
| LMLNKSLCK | | LMLNKSLCK | | LVREQQGRMD | | NAPSGVEYNGK | |
| LMLQSRTRE | | LMLQSRTRE | | LVRGNSPAFN | | NAQAFYKILKI | |
| LMLSKSLCK | | LMLSKSLCK | | LVRGNSPVFN | | NAQEIGNGCFE | |
| LMNELGIPF | | LMNELGIPF | | LVRGQQGRMD | | NAQGEGIAADY | |
| LMNELGVPF | | LMNELGVPF | | LVRGQQGTMD | | NAQGEGTAADY | |

Fig. 83-226

| Block size 8 | SIN | Block size 9 | SIN | Block size 10 | SIN | Block size 11 | SIN |
|---|---|---|---|---|---|---|---|
| LMNELGVPL | | LMNELGVPL | | LVRGQQGWMD | | NAQGIGQAADY | |
| LMNELGVSF | | LMNELGVSF | | LVRKTRFLPV | | NAQGQGTAADY | |
| LMQGSTLPR | | LMQGSTLPR | | LVRMIKRGIN | | NAQGSGYAADL | |
| LMSCPIGEA | | LMSCPIGEA | | LVRSGMDPRM | | NAQGTGQAADY | |
| LMSCPIGEV | | LMSCPIGEV | | LVRTGMDPRM | | NAQHIEECSCY | |
| LMSCPIGVA | | LMSCPIGVA | | LVSDGGPNLY | | NAQHVEECSCY | |
| LMSCPIGVV | | LMSCPIGVV | | LVSLGAIGFW | | NAQLLVLLENE | |
| LMSCPLGEA | | LMSCPLGEA | | LVSLGAISFW | | NAQLLVWLENE | |
| LMSCPMGVA | | LMSCPMGVA | | LVSLGAVSFW | | NARELGNGCFE | |
| LMSCPVGEA | | LMSCPVGEA | | LVSNDDWSGY | | NARLLVLLEND | |
| LMSCPVGVA | | LMSCPVGVA | | LVSNNDWSGY | | NARLLVLLENE | |
| LMSELGVPF | | LMSELGVPF | | LVSNSDWSGY | | NASCAAMDDFQ | |
| LMSQSRTRE | | LMSQSRTRE | | LVSTKEWSKR | | NASCAAMDEFQ | |
| LMSQSRTRG | | LMSQSRTRG | | LVSTKEWSRR | | NASCAAMEDFQ | |
| LMSTNAYDR | | LMSTNAYDR | | LVSTNAYDRI | | NASRHHMGECP | |
| LMSTPLGTP | | LMSTPLGTP | | LVSWEMGQAP | | NASRHYMGECP | |
| LMSVLLGSS | | LMSVLLGSS | | LVSWPLSSPP | | NASRYYMGECP | |
| LMSVPLGSS | | LMSVPLGSS | | LVTDGPSDAQ | | NASTGAQSFYR | |
| LMTDGPSDA | | LMTDGPSDA | | LVTGKSHGRI | | NASTGGQAFYR | |
| LMVAYMLER | | LMVAYMLER | | LVTGLRNVPA | | NASTGGQSFYR | |
| LMWALGENM | | LMWALGENM | | LVTREPYISC | | NASWFNSFLAH | |
| LMWEINGPE | | LMWEINGPE | | LVTREPYLSC | | NASWFNSFLIH | |
| LNASCAAMD | | LNASCAAMD | | LVTREPYVSC | | NASWFNSFLKH | |
| LNASCAAME | | LNASCAAME | | LVTTVTLHFK | | NASWFNSFLTH | |
| LNASWFNSF | | LNASWFNSF | | LVVPEYGFKI | | NASWFNSFLVH | |
| LNDATYQRT | | LNDATYQRT | | LVVSLGAISF | | NATATVYYDRR | |
| LNDKHFNGT | | LNDKHFNGT | | LVWLENEKTL | | NATATVYYERR | |
| LNDKHSNET | | LNDKHSNET | | LVWMACHSAA | | NATATVYYNGR | |
| LNDKHSNGT | | LNDKHSNGT | | LVWMACNSAA | | NATATVYYNKR | |
| LNDKHSNNT | | LNDKHSNNT | | LWACQNGNIR | | NATATVYYNRR | |
| LNDRHSNGT | | LNDRHSNGT | | LWACQNGNLR | | NATDTVDTLTE | |
| LNDTTYQRT | | LNDTTYQRT | | LWACQNGNVR | | NATETVEITGI | |
| LNDYEELKH | | LNDYEELKH | | LWACQTGNIR | | NAVDEGNGCFE | |
| LNEGIMNTS | | LNEGIMNTS | | LWACSSGNCR | | NAVDTGDGCFE | |
| LNEGVINTS | | LNEGVINTS | | LWAYNAELLV | | NAVDTGNGCFD | |
| LNEGVMNTS | | LNEGVMNTS | | LWCKIVTTVG | | NAVRFGESEQI | |
| LNEITTKIN | | LNEITTKIN | | LWDPFRQSER | | NAYDRICIGYQ | |
| LNFVNRANQ | | LNFVNRANQ | | LWDSFRQSER | | NCDTKCQTPLG | |
| LNGIPPLEL | | LNGIPPLEL | | LWFSFGASCF | | NCEIKCQTPLG | |
| LNGISPIHL | | LNGISPIHL | | LWFSFGASCV | | NCETKCQSPLG | |
| LNGISPVHL | | LNGISPVHL | | LWFSFGASSF | | NCETKCQTPLG | |
| LNGNGDPNN | | LNGNGDPNN | | LWFSLGASCF | | NCIESIRNGTY | |
| LNGREWSYI | | LNGREWSYI | | LWGIHHPDSE | | NCIKPCFWVEL | |
| LNGTAKHIE | | LNGTAKHIE | | LWGIHHPDTE | | NCINRCFYVEL | |
| LNGVKPLIL | | LNGVKPLIL | | LWGIHHPPDA | | NCIRPCFWVEL | |
| LNGVPPLEL | | LNGVPPLEL | | LWGIHHPPDE | | NCLYASPQLEG | |
| LNGVSPIHL | | LNGVSPIHL | | LWGIHHPPDT | | NCMERIRNNTY | |
| LNGVSPVHL | | LNGVSPVHL | | LWGIHHPPNT | | NCMESIRNNTY | |
| LNIESNGNL | | LNIESNGNL | | LWGVHHPSSD | | NCMRPCFWVEL | |
| LNIGLHLKP | | LNIGLHLKP | | LWHVRKRFAD | | NCPKYIKSGQL | |
| LNIGLHLRP | | LNIGLHLRP | | LWISFAISCF | | NCPKYVKQGSL | |
| LNINPVKLS | | LNINPVKLS | | LWISFAMSCF | | NCTIPCFWVEM | |
| LNINPVTLS | | LNINPVTLS | | LWISFATSCF | | NCTVPCFWVEM | |
| LNINSVKLS | | LNINSVKLS | | LWISFSISCF | | NCWSFALAQGA | |
| LNITAASLN | | LNITAASLN | | LWISFSMSCF | | NCWSFALAQGV | |
| LNKKIDDGF | | LNKKIDDGF | | LWLVLREKMP | | NCYQFALGQGT | |
| LNKKMEDDF | | LNKKMEDDF | | LWMCFNGSLQ | | NCYWVMTDGPA | |
| LNKKMEDGF | | LNKKMEDGF | | LWMCSNGALQ | | NDATYQRTRAL | |
| LNKKMEEGF | | LNKKMEEGF | | LWMCSNGSLQ | | NDAYAVIHYGG | |
| LNKKVDDGF | | LNKKVDDGF | | LWMCSNGSYN | | NDDIDQSLIIA | |
| LNKKVDDGL | | LNKKVDDGL | | LWSYNADVLV | | NDDVDQSLIIA | |
| LNKKVEDGF | | LNKKVEDGF | | LWSYNAELLI | | NDDVDQSLVIA | |

Fig. 83-227

| Block size 8 | SIN | Block size 9 | SIN | Block size 10 | SIN | Block size 11 | SIN |
|---|---|---|---|---|---|---|---|
| LNKNEIKGV | | LNKNEIKGV | | LWSYNAELLV | | NDERGNPGVKG | |
| LNKRMEDGF | | LNKRMEDGF | | LWSYNAGLLV | | NDEVDQSLIIA | |
| LNKRMEDGL | | LNKRMEDGL | | LWSYNAQLLV | | NDGKVECVCRD | |
| LNKRMENGF | | LNKRMENGF | | LWTSNSIVAL | | NDKHSNGTIKD | |
| LNKRMQDGF | | LNKRMQDGF | | LWTSNSIVEF | | NDKHSNGTMKD | |
| LNKSLCKIE | | LNKSLCKIE | | LWTSNSIVVF | | NDKHSNGTVKD | |
| LNKSLCKVE | | LNKSLCKVE | | LWTSNSMVAL | | NDKHSNNTVKD | |
| LNKSLCNVE | | LNKSLCNVE | | LWTYNAELLI | | NDKTLDLHDAN | |
| LNKSLCSVE | | LNKSLCSVE | | LWVSFSISCF | | NDKTLDMHDAN | |
| LNLGQKEYT | | LNLGQKEYT | | LYASKNPYTL | | NDKTLNMHDAN | |
| LNLGQKKYT | | LNLGQKKYT | | LYASPQLEGF | | NDKYHQIEKEF | |
| LNLGQKRHT | | LNLGQKRHT | | LYASSQLEGF | | NDLGNGCFEFW | |
| LNLGQKRYT | | LNLGQKRYT | | LYDAIEECLI | | NDLGPATAQMA | |
| LNLGQRKYT | | LNLGQRKYT | | LYDKVRLQLK | | NDLYGAQSLSI | |
| LNLIIGISN | | LNLIIGISN | | LYDKVRLQLR | | NDLYGTQPLSI | |
| LNLLIGISN | | LNLLIGISN | | LYDKVRMQLK | | NDLYGTQSLSI | |
| LNLLIGVSN | | LNLLIGVSN | | LYDKVRMQLR | | NDNATATVYYD | |
| LNLYDRVRK | | LNLYDRVRK | | LYDRVRKQLR | | NDNATATVYYN | |
| LNLYERVRK | | LNLYERVRK | | LYDRVRLQLR | | NDNWSGYSGSF | |
| LNMGQPFYS | | LNMGQPFYS | | LYDVRMQLR | | NDPSGYAQTDC | |
| LNMHDANVR | | LNMHDANVR | | LYEAIEECLI | | NDPWVLLNASW | |
| LNNEIRWPP | | LNNEIRWPP | | LYEKVRLQLR | | NDPYPGNNBNG | |
| LNNEPGSGN | | LNNEPGSGN | | LYEKVRMQLR | | NDPYPGNNNGV | |
| LNNKHSNGT | | LNNKHSNGT | | LYEKVRRQLR | | NDPYPGNNNKG | |
| LNNKHWSGY | | LNNKHWSGY | | LYENNPGRVT | | NDPYPGNNNNG | |
| LNNKMEDGF | | LNNKMEDGF | | LYERVKKQLR | | NDQGAGYAADK | |
| LNNKNWSGY | | LNNKNWSGY | | LYERVKRQLR | | NDQGSGYAADK | |
| LNNKVDDGF | | LNNKVDDGF | | LYERVRKQLR | | NDQGTGQAADY | |
| LNNMNWSGY | | LNNMNWSGY | | LYERVRRQLR | | NDQIEDLWAYN | |
| LNNNGELRH | | LNNNGELRH | | LYESIEECLI | | NDQITDIWAYN | |
| LNNTEPLCD | | LNNTEPLCD | | LYFHDSNVKN | | NDRHSNGTVKD | |
| LNNTEPLCE | | LNNTEPLCE | | LYGAGNKLIT | | NDRHSNNTVKD | |
| LNNTEPLCN | | LNNTEPLCN | | LYGAIEECLI | | NDRNFWRGDNG | |
| LNNVIDKMN | | LNNVIDKMN | | LYGAQSLSIS | | NDRNFWRGENG | |
| LNNVIDKMY | | LNNVIDKMY | | LYGFIIKGRS | | NDRSPFRALVS | |
| LNPIDGPLP | | LNPIDGPLP | | LYGFIVKGRS | | NDRSPHRTLMS | |
| LNPMHQLLR | | LNPMHQLLR | | LYGNGNKLIT | | NDRTLDLHDAN | |
| LNPNDTITF | | LNPNDTITF | | LYGSGAKLIT | | NDSCMDTIRNG | |
| LNPNDTVIF | | LNPNDTVIF | | LYGSGNKLIT | | NDSCMEAIRNG | |
| LNPNDTVTF | | LNPNDTVTF | | LYGSGNKLVT | | NDSCMETIRNG | |
| LNPNGTITF | | LNPNGTITF | | LYGSGSKLIT | | NDTDVVNFLSM | |
| LNQTYRNNR | | LNQTYRNNR | | LYGTGNKLIT | | NDTDVVNFVSM | |
| LNQTYRNTR | | LNQTYRNTR | | LYGTQPLSIS | | NDTDVVNYVSM | |
| LNRFIEKTN | | LNRFIEKTN | | LYGTQSLSIS | | NDTINYYNETF | |
| LNRIIEKTN | | LNRIIEKTN | | LYIRTNGTSK | | NDTITFSFNGA | |
| LNRKMEDGF | | LNRKMEDGF | | LYIWGVHHPS | | NDTTYQRTRAL | |
| LNRKVDDGF | | LNRKVDDGF | | LYKKLKREIT | | NDTVNFSFNGA | |
| LNRLIDKTN | | LNRLIDKTN | | LYKKLKREMT | | NDTVTFIFNGA | |
| LNRLIDRTN | | LNRLIDRTN | | LYKNANTLSS | | NDTVTFNFNGA | |
| LNRLIEKTN | | LNRLIEKTN | | LYKNANTLTS | | NDTVTFSFNGA | |
| LNRLIERTN | | LNRLIERTN | | LYKNNPGRVS | | NDTVTFTFNGA | |
| LNRLIGKTN | | LNRLIGKTN | | LYKNNPGRVT | | NDVWLGRTVSN | |
| LNRLISKTN | | LNRLISKTN | | LYKNSPGRVT | | NDVWLGRTVST | |
| LNRLNINPV | | LNRLNINPV | | LYKNTNTLSS | | NDVWMGRTISK | |
| LNRLNINSV | | LNRLNINSV | | LYKSNPGRVT | | NDWSGYSGSFI | |
| LNRLSINPV | | LNRLSINPV | | LYKVATGRVT | | NDWSGYSGSFS | |
| LNRNEIKGV | | LNRNEIKGV | | LYLNGREWSY | | NDWSGYSGSFT | |
| LNRNQPAAT | | LNRNQPAAT | | LYLSGREWSY | | NDWSGYSGSFV | |
| LNRQEIEGV | | LNRQEIEGV | | LYLTGTWDTL | | NECIEKIRNGT | |
| LNRQEIGGV | | LNRQEIGGV | | LYLWGVHHPS | | NECIEKVRNGT | |
| LNTASRSGY | | LNTASRSGY | | LYNIRNLHIP | | NECIERVRNGT | |
| LNTDWSGYS | | LNTDWSGYS | | LYNKIEFEPF | | NECMETIKNGT | |

Fig. 83-228

| Block size 8 | SIN | Block size 9 | SIN | Block size 10 | SIN | Block size 11 | SIN |
|---|---|---|---|---|---|---|---|
| LNTMHQLLR | | LNTMHQLLR | | LYNKLEFEPF | | NECRFYALSQG | |
| LNTMTKDAE | | LNTMTKDAE | | LYNKMEFEPF | | NECRTFFLTQG | |
| LNTSQRGIL | | LNTSQRGIL | | LYNKVEFEPF | | NECYNPCFYVE | |
| LNTSQRGVL | | LNTSQRGVL | | LYNKVRMQLR | | NEDGDIIFLWG | |
| LNTTLPFHN | | LNTTLPFHN | | LYQEVGTYVS | | NEDGNIIFLWG | |
| LNVESNGNL | | LNVESNGNL | | LYQKVGTYVS | | NEEALRQIIRE | |
| LNVGLHLKP | | LNVGLHLKP | | LYQNVETYVS | | NEEALRQKIME | |
| LNVPEWSYI | | LNVPEWSYI | | LYQNVGTYVS | | NEEGDIIFLWG | |
| LNVWTYNAE | | LNVWTYNAE | | LYRKLKREIT | | NEEGTGIAADK | |
| LNWLTKATN | | LNWLTKATN | | LYSGFVRTLF | | NEEGTGIAADR | |
| LNWLTKETN | | LNWLTKETN | | LYSSPQLEGF | | NEEGTGVAADK | |
| LNWSGYSGS | | LNWSGYSGS | | LYVNKNPYTL | | NEERGNPGVKG | |
| LPACAYGPA | | LPACAYGPA | | LYVRTNGTSK | | NEERGSPGVKG | |
| LPACIYGLV | | LPACIYGLV | | LYWHLMHPGE | | NEFNEIEQQIG | |
| LPACVYGLA | | LPACVYGLA | | LYWHLMRPGE | | NEFNEVEQQIG | |
| LPACVYGLV | | LPACVYGLV | | LYWHLMSPGE | | NEFNKACELTD | |
| LPACVYGPA | | LPACVYGPA | | MAADKESTQK | | NEFSEIEQQIG | |
| LPDGAQIQY | | LPDGAQIQY | | MAADQKSTQE | | NEFTEIEQQIG | |
| LPDLYDYKE | | LPDLYDYKE | | MACHSAAFED | | NEFTEVEKQIG | |
| LPFAAAPPE | | LPFAAAPPE | | MACNSAAFED | | NEFTEVEQQIG | |
| LPFAAAPPK | | LPFAAAPPK | | MADSEMLNLY | | NEGALRQKIME | |
| LPFAAAPPV | | LPFAAAPPV | | MADSIKSWRK | | NEGHIEECSCY | |
| LPFDFDKIS | | LPFDFDKIS | | MAFLEDSHPG | | NEGIMNTSKPF | |
| LPFDIDKII | | LPFDIDKII | | MAFLEESHPG | | NEGKVECICRD | |
| LPFHNIHPL | | LPFHNIHPL | | MAFLEKSHPG | | NEGKVECVCRD | |
| LPFHNISKY | | LPFHNISKY | | MAFLENSHPG | | NEGNGCFELLH | |
| LPFHNVHPF | | LPFHNVHPF | | MAGLSFWMCS | | NEGSYFFGDNA | |
| LPFHNVHPL | | LPFHNVHPL | | MAGSSEQAAE | | NEGSYFFGDSA | |
| LPFHNVSKY | | LPFHNVSKY | | MAIDNMQNKL | | NEGVINTSKPF | |
| LPFQNIDSR | | LPFQNIDSR | | MAIIKKYTSA | | NEGVMNTSKPF | |
| LPFQNIDSW | | LPFQNIDSW | | MAIIKKYTSG | | NEGVMNTSKPL | |
| LPFQNINPK | | LPFQNINPK | | MAIIKRYTSG | | NEHSNGTIHDR | |
| LPFQNINPR | | LPFQNINPR | | MAKCNTKCQT | | NEHSNGTTHDR | |
| LPFQNINSR | | LPFQNINSR | | MALLEESHPG | | NEIEHQIGNVI | |
| LPFQNISKY | | LPFQNISKY | | MALQGTKRSY | | NEIEQQIGNVI | |
| LPFQNISPR | | LPFQNISPR | | MALQLFIKDY | | NEIEYQIGNVI | |
| LPFQNLSPR | | LPFQNLSPR | | MAMKYPITAD | | NEIKGVELSSM | |
| LPFQNVNSR | | LPFQNVNSR | | MAMKYPITAE | | NEIKGVKLSNM | |
| LPFQNVSKY | | LPFQNVSKY | | MAMKYPITAN | | NEIKGVKLSSM | |
| LPFQNVSRY | | LPFQNVSRY | | MAMRYPITAD | | NEITTKINNII | |
| LPFQSINPR | | LPFQSINPR | | MANIRNNTYD | | NEKFHQIEKEF | |
| LPLALGMKN | | LPLALGMKN | | MAPIMFSNKM | | NEKGNPGVKGW | |
| LPLCPFKGF | | LPLCPFKGF | | MARAVKLYKK | | NEKGNQGVKGW | |
| LPLCPFQGF | | LPLCPFQGF | | MARCNTKCQT | | NEKKAKLANVV | |
| LPLCPFRGF | | LPLCPFRGF | | MARLGKGYMF | | NEKTLDLHDSN | |
| LPQSGRIVV | | LPQSGRIVV | | MARLGRGYMF | | NEKYHQIEKEF | |
| LPRRSGAAG | | LPRRSGAAG | | MARSALILRG | | NELGIPFHLGT | |
| LPSDTPRGE | | LPSDTPRGE | | MASIRNNSYD | | NELGNGCFEFY | |
| LPSFGVSGI | | LPSFGVSGI | | MASIRNNTYD | | NELGVPFHLAT | |
| LPSFGVSGV | | LPSFGVSGV | | MASIRNNTYN | | NELGVPFHLGT | |
| LPTFDSLNI | | LPTFDSLNI | | MASIRNSTYD | | NELGVPFYLGT | |
| LPVAGGTGS | | LPVAGGTGS | | MASQGTKRPY | | NELGVSFHLGT | |
| LPVAGGTSS | | LPVAGGTSS | | MASQGTKRSH | | NELYGTQSLSI | |
| LPVGGNEKK | | LPVGGNEKK | | MASQGTKRSY | | NEMTLDFHDSN | |
| LPVSGGTSS | | LPVSGGTSS | | MATGLRNIPS | | NENATATVYYN | |
| LPVTGGTSS | | LPVTGGTSS | | MATGLRNVPS | | NENGDIIFLWG | |
| LQALQLLLE | | LQALQLLLE | | MATLCLGHHA | | NENPAHKSQLI | |
| LQANLCRFL | | LQANLCRFL | | MAWSSSSCHD | | NENPAHKSQLV | |
| LQAYQKRMG | | LQAYQKRMG | | MCAAWSSSSC | | NENPVHKSQLI | |
| LQDNAKDEG | | LQDNAKDEG | | MCLNGSMQCR | | NENPVHKSQLV | |
| LQDTTWDVF | | LQDTTWDVF | | MCNILKGKFQ | | NENQNPRIFLA | |
| LQGSARHIE | | LQGSARHIE | | MCPNGSLQCK | | NENQNPRMFLA | |

Fig. 83-229

| Block size 8 | SIN | Block size 9 | SIN | Block size 10 | SIN | Block size 11 | SIN |
|---|---|---|---|---|---|---|---|
| LQGTKRSYE | | LQGTKRSYE | | MCSGHSCRIC | | NENQNPRVFLA | |
| LQIISLCSI | | LQIISLCSI | | MCSGLVGDTP | | NENQNPRVFLT | |
| LQITSLCSI | | LQITSLCSI | | MCSHGSLQCR | | NENQSPRMFLA | |
| LQLFIKDYR | | LQLFIKDYR | | MCSLMQGSTL | | NEPGSGDWPDG | |
| LQLKDNAKE | | LQLKDNAKE | | MCSNGSLHGR | | NEPGSGNWPDG | |
| LQLKDNARE | | LQLKDNARE | | MCSNGSLQCK | | NEPNGYAQTDC | |
| LQLLFEVEQ | | LQLLFEVEQ | | MCSNGSLQCR | | NEPSGYAQTDC | |
| LQLLLEVEN | | LQLLLEVEN | | MCSNGSLQCT | | NEPTGYAQTDC | |
| LQLLLEVEQ | | LQLLLEVEQ | | MCSNGSLRCR | | NEPYPGNNNNG | |
| LQLLLEVES | | LQLLLEVES | | MCSNGSMQCK | | NEQAAEAMEVA | |
| LQLNPIDGP | | LQLNPIDGP | | MCSNGSMQCN | | NEQGMGMAADK | |
| LQLRDNAKE | | LQLRDNAKE | | MCSNGSMQCR | | NEQGSGYAADK | |
| LQLRDNARE | | LQLRDNARE | | MCSNSSMQCR | | NEQGSGYAADL | |
| LQNASRHYM | | LQNASRHYM | | MCSSTEFLGQ | | NEQGSGYAADQ | |
| LQNNAIDEG | | LQNNAIDEG | | MCVCRDNWHA | | NEQGSGYAADR | |
| LQNRIMINP | | LQNRIMINP | | MCVCRDNWHG | | NEQGTGIAADK | |
| LQNRIQIDP | | LQNRIQIDP | | MCVGWSSTTC | | NEQGTGIAAEK | |
| LQNRIQIDQ | | LQNRIQIDQ | | MCVKNGNLRC | | NEQGVGIAADK | |
| LQNRIQIDS | | LQNRIQIDS | | MCVKNGNMRC | | NEQGVGMAADK | |
| LQNTSKHYI | | LQNTSKHYI | | MCYPGFVENL | | NEQTDLYKVAT | |
| LQQIESIIE | | LQQIESIIE | | MCYPGSIENL | | NERGLFGAIAG | |
| LQQIESMIE | | LQQIESMIE | | MCYPGSVENL | | NERGNPGVKGW | |
| LQQIESMVE | | LQQIESMVE | | MDAGNGCFDI | | NERGNQGVKGW | |
| LQRRRFIQN | | LQRRRFIQN | | MDALKLSIED | | NERGTQGVKGW | |
| LQRRRFVQN | | LQRRRFVQN | | MDALLGDPHC | | NERGYPGVKGW | |
| LQSFTPSPG | | LQSFTPSPG | | MDDFQLIPMI | | NERILDFHDSN | |
| LQSLQQIES | | LQSLQQIES | | MDEFQLIPMI | | NERTIWTSGSS | |
| LQSRTREIL | | LQSRTREIL | | MDGVTNKVNS | | NERTLDFHDFN | |
| LQSSDDFAL | | LQSSDDFAL | | MDGWYGFRHQ | | NERTLDFHDSN | |
| LQTYQKRMG | | LQTYQKRMG | | MDHTSQYLCT | | NERTLDLHDAN | |
| LRDCKIEAV | | LRDCKIEAV | | MDKAVKLYKK | | NERTLDLHDSN | |
| LRDCKVEAV | | LRDCKVEAV | | MDKAVKLYRK | | NERTLDMHDAN | |
| LRDCSIAGW | | LRDCSIAGW | | MDKQTKTMTI | | NERTLDMHDVN | |
| LRDCSVAGW | | LRDCSVAGW | | MDNKTKKMTI | | NERTLDQHDAN | |
| LRDNAKDEG | | LRDNAKDEG | | MDNQTKKMTI | | NERTLDYHDSH | |
| LRDNAKDLG | | LRDNAKDLG | | MDNQTKTMTI | | NERTLDYHDSN | |
| LRDNAKEIG | | LRDNAKEIG | | MDPRMCSLMQ | | NERTLEFHDSN | |
| LRDNAKELG | | LRDNAKELG | | MDQVREGRNP | | NERTLGFHDSN | |
| LRDNAKETG | | LRDNAKETG | | MDQVRESRNP | | NERTLYFHDSN | |
| LRDNAMILG | | LRDNAMILG | | MDRAVKLYKK | | NESADMSIGIT | |
| LRDNANDLG | | LRDNANDLG | | MDRAVKLYRK | | NESADMSIGVT | |
| LRDNLEPGT | | LRDNLEPGT | | MDSLKLSIED | | NESGRLIDFLK | |
| LRDNVKELG | | LRDNVKELG | | MDSRSGYETF | | NESGRLMDFLK | |
| LRDQGWSYI | | LRDQGWSYI | | MDTIRNGTYN | | NETCSALFVYS | |
| LRDSLEPGT | | LRDSLEPGT | | MDTVNRTHQY | | NETFVNMTNVQ | |
| LREHLSSVS | | LREHLSSVS | | MDTVSRTHQY | | NETFVNVTHVQ | |
| LRELWQCYY | | LRELWQCYY | | MDVNPTLLFL | | NETFVNVTNVQ | |
| LRENAEDIG | | LRENAEDIG | | MDVWTYNAEL | | NETIIETGYVC | |
| LRENAEDKG | | LRENAEDKG | | MDYYWAILKP | | NETIILETGYIC | |
| LRENAEDLG | | LRENAEDLG | | MDYYWAVLKP | | NETILETGYVC | |
| LRENAEDMG | | LRENAEDMG | | MDYYWGILKR | | NETILETRYVC | |
| LRENAEDQG | | LRENAEDQG | | MEAIRNGTYN | | NETIVETGYVC | |
| LRENAEDRG | | LRENAEDRG | | MEAMVSRARI | | NEVEQQIGNVI | |
| LRENAEEDC | | LRENAEEDC | | MECRTFFLTQ | | NEVGAKILTSE | |
| LRENAEEDG | | LRENAEEDG | | MEDFQLIPMI | | NEVGARIITSE | |
| LREQKQEFK | | LREQKQEFK | | MEDFVRQCFN | | NEVGARILASE | |
| LREQLSSVS | | LREQLSSVS | | MEDGFIDVWT | | NEVGARILTSE | |
| LREQLSTVS | | LREQLSTVS | | MEDGFLDVWT | | NEVKLEENTTY | |
| LRFLFSSIK | | LRFLFSSIK | | MEDGFLGVWT | | NEWSGYSGSFV | |
| LRFVFSIAA | | LRFVFSIAA | | MEDGFRDVWT | | NFDSNGNFIAP | |
| LRFVFSNAA | | LRFVFSNAA | | MEEFVRQCFN | | NFEGWIVGNPA | |
| LRFVFSSAA | | LRFVFSSAA | | MEEGSIGKVC | | NFEKEGYSLVG | |

Fig. 83-230

| Block size 8 | SIN | Block size 9 | SIN | Block size 10 | SIN | Block size 11 | SIN |
|---|---|---|---|---|---|---|---|
| LRGFLIIGK | | LRGFLIIGK | | MEEVTNATET | | NFESNGNFIAP | |
| LRGFLILGK | | LRGFLILGK | | MEFEPFQSLI | | NFESNGNFITP | |
| LRGFLILGR | | LRGFLILGR | | MEFEPFQSLV | | NFESNGNLIAP | |
| LRGGRNSFF | | LRGGRNSFF | | MEFSLTDPKL | | NFESTGNLIAP | |
| LRGIPPLEL | | LRGIPPLEL | | MEFSLTDPRF | | NFESTGNLVAP | |
| LRGQHANGT | | LRGQHANGT | | MEFSLTDPRL | | NFFHKCNDSCM | |
| LRGRGSTLG | | LRGRGSTLG | | MEGFVRQCFN | | NFHYEECSCYP | |
| LRGRHANGT | | LRGRHANGT | | MEGICYPGSI | | NFIAPENAYKI | |
| LRGSARHIE | | LRGSARHIE | | MEGICYPGSV | | NFIAPEYAFKI | |
| LRGSIAHKS | | LRGSIAHKS | | MEGVCYPGSI | | NFIAPEYAYIV | |
| LRGSVAHKS | | LRGSVAHKS | | MEHTSQYLCT | | NFIAPEYAYKI | |
| LRHFQKDAK | | LRHFQKDAK | | MEKNITVTHA | | NFIAPEYAYKV | |
| LRHFQKDAR | | LRHFQKDAR | | MEKNVAVTHA | | NFIAPEYAYRI | |
| LRHFQKNAK | | LRHFQKNAK | | MEKNVTVTHA | | NFITPEYAYKI | |
| LRHLFSGIK | | LRHLFSGIK | | MEKNVTVTQA | | NFKPNIGPRPF | |
| LRHLFSGIR | | LRHLFSGIR | | MELIRMIKRG | | NFLSMEFSLTD | |
| LRHLFSGVN | | LRHLFSGVN | | MELIRMVKRG | | NFPQTANTYRN | |
| LRIISNGNL | | LRIISNGNL | | MELPSFGVSG | | NFPQTTNTYRN | |
| LRILIRGNS | | LRILIRGNS | | MELRRCLLQS | | NFPRTTNTYRN | |
| LRILVRGNS | | LRILVRGNS | | MELVRMIKRG | | NFQPNIGPRPL | |
| LRIPNAGID | | LRIPNAGID | | MEMRRCLLQS | | NFSFNGAFIAP | |
| LRIRSNENL | | LRIRSNENL | | MENEMTLDFH | | NFSMELPSFGV | |
| LRIRSNGNL | | LRIRSNGNL | | MENERILDFH | | NFVNRANQRLN | |
| LRISSSFSF | | LRISSSFSF | | MENERTLDFH | | NFVPVVGARPQ | |
| LRKILRKSG | | LRKILRKSG | | MENERTLDLH | | NFVSMEFSLTD | |
| LRLAIGLRN | | LRLAIGLRN | | MENERTLDYH | | NFWRGDNGRRT | |
| LRLALGLRN | | LRLALGLRN | | MENERTLEFH | | NFWRGENGRKT | |
| LRLATGLRN | | LRLATGLRN | | MENERTLYFH | | NFWRGENGRRT | |
| LRLAVGLRN | | LRLAVGLRN | | MENFVRQCFN | | NFYYEECSCYP | |
| LRMARGLRN | | LRMARGLRN | | MENLNKKVDD | | NGAFIAPDRAS | |
| LRMATGLRN | | LRMATGLRN | | MENQHTIDLA | | NGAFIAPDRAT | |
| LRMKWMMAM | | LRMKWMMAM | | MENQHTIDLT | | NGAFIAPDRVS | |
| LRMVTGLRN | | LRMVTGLRN | | MENQHTIDMA | | NGAFIAPNRAS | |
| LRNDTDVVN | | LRNDTDVVN | | MENQHTIEMT | | NGAFVAPDRAS | |
| LRNGNMRCT | | LRNGNMRCT | | MEQMAGSSEQ | | NGAFVAPDRVS | |
| LRNIPSIQS | | LRNIPSIQS | | MEQVAGSSEQ | | NGAKVNTLTER | |
| LRNIPSVQS | | LRNIPSVQS | | MERIRNNTYD | | NGALGSPGCDH | |
| LRNTPSIDP | | LRNTPSIDP | | MERNVTVTHA | | NGALGSPGCDR | |
| LRNTPSIEP | | LRNTPSIEP | | MESGGIDKIG | | NGAVAVLKYKG | |
| LRNTPSVEP | | LRNTPSVEP | | MESGGIDKIS | | NGAVAVLKYND | |
| LRNVPSIQS | | LRNVPSIQS | | MESGGIDKVS | | NGAVAVLKYNG | |
| LRPGETLNV | | LRPGETLNV | | MESGGISKIS | | NGCFDILHKCD | |
| LRPGQTLRV | | LRPGQTLRV | | MESGGISKMS | | NGCFDILHKCN | |
| LRQIIRESG | | LRQIIRESG | | MESIKNGTYD | | NGCFEFWHKCD | |
| LRQILRESG | | LRQILRESG | | MESIRDNTYD | | NGCFEFWHKCN | |
| LRQILRGSG | | LRQILRGSG | | MESIRNGTYD | | NGCFEFYHKCD | |
| LRQILRKSG | | LRQILRKSG | | MESIRNNTYD | | NGCFEFYHKCN | |
| LRQILRRSG | | LRQILRRSG | | MESIRNNTYN | | NGCFEFYHRCD | |
| LRQKIMESG | | LRQKIMESG | | MESRGLFGAI | | NGCFEIFHKCD | |
| LRQNAEEDG | | LRQNAEEDG | | MESVKNGTYD | | NGCFEIFHQCD | |
| LRQNPTEEQ | | LRQNPTEEQ | | MESVKNGTYN | | NGCFEIFHRCD | |
| LRQVLRESG | | LRQVLRESG | | MESVRNGTYD | | NGCFELLHKCN | |
| LRRCLLQSL | | LRRCLLQSL | | METIKNGTYD | | NGCFKIYHKCD | |
| LRRDQKSLR | | LRRDQKSLR | | METIKNGTYN | | NGCFKIYHKCN | |
| LRRIWRQAN | | LRRIWRQAN | | METIRNGTYD | | NGCFTFYHKCD | |
| LRRQKSLIW | | LRRQKSLIW | | METIRNGTYN | | NGCFTFYHKCN | |
| LRRQKWWVW | | LRRQKWWVW | | MEVCFMYSDF | | NGCFTFYHRCD | |
| LRSGFEMLK | | LRSGFEMLK | | MEVVFPNEVG | | NGCFTIYHKCD | |
| LRSGYEMLK | | LRSGYEMLK | | MEWIKTRPIL | | NGCIEGKLSQM | |
| LRSGYETFK | | LRSGYETFK | | MEWLKTRPIL | | NGCIESKLSQM | |
| LRSGYWAIR | | LRSGYWAIR | | MEYDAVATTH | | NGCLKIYHKCD | |
| LRSILANNG | | LRSILANNG | | MFALSQGTTL | | NGDDVWMGRTI | |

Fig. 83-231

| Block size 8 | SIN | Block size 9 | SIN | Block size 10 | SIN | Block size 11 | SIN |
|---|---|---|---|---|---|---|---|
| LRSILASSG | | LRSILASSG | | MFDFIKWNVT | | NGDGCFEILHK | |
| LRSIVASSG | | LRSIVASSG | | MFDFSKWNVT | | NGDIIFLWGIH | |
| LRSKYWAIR | | LRSKYWAIR | | MFDFTKWNVT | | NGDPNNMDKAV | |
| LRSLFSSIK | | LRSLFSSIK | | MFESNGGLIA | | NGDPNNMDRAV | |
| LRSLIASSG | | LRSLIASSG | | MFESNGGLLA | | NGDPSNMDRAV | |
| LRSLVASSG | | LRSLVASSG | | MFLAMITYIT | | NGDYARLYIWG | |
| LRSNAPSGI | | LRSNAPSGI | | MFLYIRTNGT | | NGDYTRLYIWG | |
| LRSNAPSGV | | LRSNAPSGV | | MFLYVRTNGT | | NGELRHLFSGI | |
| LRSRYWAIR | | LRSRYWAIR | | MFNMLSTVLG | | NGELRHLFSGV | |
| LRTHESECV | | LRTHESECV | | MFSNKMARLG | | NGEPGVKGFGF | |
| LRTQDSECV | | LRTQDSECV | | MFSNKVARLG | | NGFAPFSKDNS | |
| LRTQESECA | | LRTQESECA | | MGARPQVNGQ | | NGFCFTVMTDG | |
| LRTQESECI | | LRTQESECI | | MGAYQILAIY | | NGFEILLIEDG | |
| LRTQESECQ | | LRTQESECQ | | MGDFVRQCFN | | NGFEMLKIPNA | |
| LRTQESECV | | LRTQESECV | | MGDSEMLNLY | | NGFLDVWTYNA | |
| LRTQESSCT | | LRTQESSCT | | MGEAMVSRAR | | NGGFLAPRYGY | |
| LRTQESSCV | | LRTQESSCV | | MGECPEYVKK | | NGGHIEECSCY | |
| LRVKDQQGN | | LRVKDQQGN | | MGECPKYAKK | | NGGLGVKGFGF | |
| LRVKSNGNL | | LRVKSNGNL | | MGECPKYVKK | | NGGLIAPDRVS | |
| LRVPEWSYI | | LRVPEWSYI | | MGECPKYVKS | | NGGLIAPRYGY | |
| LRVPNALTD | | LRVPNALTD | | MGECPKYVRK | | NGGLIAPSRVS | |
| LRVRDQLGN | | LRVRDQLGN | | MGECPNYVKK | | NGGLIAPSRVT | |
| LRVRDQMGN | | LRVRDQMGN | | MGFRYSGIKT | | NGGLLAPKYGY | |
| LRVRDQQGN | | LRVRDQQGN | | MGFRYSGIRT | | NGGLLAPRYGY | |
| LRVRDQRGN | | LRVRDQRGN | | MGFTYSGIRT | | NGGPGVKGFGF | |
| LRVRSDGNL | | LRVRSDGNL | | MGFTYTGVRT | | NGICPVVFTDG | |
| LRVRSNGNL | | LRVRSNGNL | | MGIYQILAIY | | NGICTVVMTDG | |
| LRWALGENM | | LRWALGENM | | MGKCNTKCQT | | NGIITDTFKSW | |
| LSAFDERRN | | LSAFDERRN | | MGKVECVCRD | | NGIITDTLKSW | |
| LSAGGAIWV | | LSAGGAIWV | | MGLFFFCLKN | | NGIKVDTLTEK | |
| LSAGGAVWV | | LSAGGAVWV | | MGLIFMCVKN | | NGIPPLELGDC | |
| LSAGGDIWI | | LSAGGDIWI | | MGLIYNRMGA | | NGIRIGSKGDV | |
| LSAGGDIWV | | LSAGGDIWV | | MGLIYNRMGT | | NGIRIGSKGHV | |
| LSAGGHIWV | | LSAGGHIWV | | MGLKISSSFS | | NGIRIGSRGEV | |
| LSAGGNIWI | | LSAGGNIWI | | MGLRISSSFS | | NGIRIGSRGHI | |
| LSASGDIWI | | LSASGDIWI | | MGLTYNGIRT | | NGIRIGSRGHV | |
| LSASGDIWV | | LSASGDIWV | | MGLVFFCLKN | | NGIRVGSRGHV | |
| LSEQNVPVT | | LSEQNVPVT | | MGLVFFCLRN | | NGISPIHLGDC | |
| LSFQGRGVF | | LSFQGRGVF | | MGLVFICIKN | | NGISPVHLGDC | |
| LSFQVDCFL | | LSFQVDCFL | | MGLVFICMKN | | NGKAPISLGDC | |
| LSFTITGDN | | LSFTITGDN | | MGLVFICVKN | | NGKEPISLGDC | |
| LSFTVTGDN | | LSFTVTGDN | | MGLVFMCVKN | | NGKFEFIAEDF | |
| LSFWMCSNG | | LSFWMCSNG | | MGMAADKEST | | NGKFEFIAEEF | |
| LSGGAQHVE | | LSGGAQHVE | | MGMFNMLSTV | | NGKFEFIVEKF | |
| LSGGGDIWV | | LSGGGDIWV | | MGNGCFEFYH | | NGKGRYGVKGF | |
| LSGGYKDII | | LSGGYKDII | | MGNGCFKIYH | | NGKLCKLNGIP | |
| LSGGYKDVI | | LSGGYKDVI | | MGNGCFRIYH | | NGKLCRLRGIP | |
| LSGIPPLEL | | LSGIPPLEL | | MGNGCFTIYH | | NGKLCRLSGIP | |
| LSGIPPLVL | | LSGIPPLVL | | MGNGCLKIYH | | NGKLEFIAEEF | |
| LSGMAIALS | | LSGMAIALS | | MGQAADLKST | | NGKLNRLIEKT | |
| LSGNAQHIE | | LSGNAQHIE | | MGQQGRMDYY | | NGKLNRLIERT | |
| LSGNAQHVE | | LSGNAQHVE | | MGRTISKDSR | | NGKQPISLGDC | |
| LSGNGDPNN | | LSGNGDPNN | | MGRTISMDSR | | NGKSGACKRAD | |
| LSGREWSYI | | LSGREWSYI | | MGRTISRDSR | | NGKSGACKRAN | |
| LSGSAQHIE | | LSGSAQHIE | | MGSIRNNTYD | | NGKSLGIQSDA | |
| LSGSAQHVE | | LSGSAQHVE | | MGTAPVLGNY | | NGKSSACKRAN | |
| LSGVAIALN | | LSGVAIALN | | MGVAPSPSNS | | NGKVECICRDN | |
| LSGVAIALS | | LSGVAIALS | | MGVDEYSNAE | | NGKWREQLSQK | |
| LSGVAISLS | | LSGVAISLS | | MGVDEYSSAE | | NGKYPVIKGDY | |
| LSGVAVALS | | LSGVAVALS | | MGVDEYSSTE | | NGNDVWMGRTI | |
| LSHTAYSQI | | LSHTAYSQI | | MGVQMQRFRR | | NGNFIAPENAY | |
| LSIAPIMFS | | LSIAPIMFS | | MGVYQILAIY | | NGNFIAPEYAF | |

Fig. 83-232

| Block size 8 | SIN | Block size 9 | SIN | Block size 10 | SIN | Block size 11 | SIN |
|---|---|---|---|---|---|---|---|
| LSIEDPDHE | | LSIEDPDHE | | MGVYQILVIY | | NGNFIAPEYAY | |
| LSIEDPNHE | | LSIEDPNHE | | MGYICSGIFG | | NGNFITPEYAY | |
| LSIEDPSHE | | LSIEDPSHE | | MGYICSGVFG | | NGNGDPNNMDK | |
| LSIEEPSHE | | LSIEEPSHE | | MGYKDIILWI | | NGNGDPNNMDR | |
| LSIENPSHE | | LSIENPSHE | | MHDANVKNLH | | NGNGDPSNMDR | |
| LSIIPSGPL | | LSIIPSGPL | | MHDANVRNLH | | NGNLIAPEFGY | |
| LSILNLLIG | | LSILNLLIG | | MHDRSPFRAL | | NGNLIAPEYGF | |
| LSINPVKLS | | LSINPVKLS | | MHDRTKIRQL | | NGNLIAPEYGH | |
| LSISIGSST | | LSISIGSST | | MHQLLRHFQK | | NGNLIAPEYGY | |
| LSISVESST | | LSISVESST | | MIADRVDDAV | | NGNLIAPRGYF | |
| LSISVGSST | | LSISVGSST | | MIALILVALA | | NGNLIAPRGYY | |
| LSIVPSGPL | | LSIVPSGPL | | MIDGWYGFHH | | NGNLIAPWYAF | |
| LSIYSCIAS | | LSIYSCIAS | | MIDGWYGFRH | | NGNLIAPWYAY | |
| LSIYSCVAS | | LSIYSCVAS | | MIDGWYGYHH | | NGNLVAPRGYF | |
| LSIYSSVAS | | LSIYSSVAS | | MIEAESSIKE | | NGNLVAPWYAY | |
| LSIYSTAAS | | LSIYSTAAS | | MIEAESSVKE | | NGNMRCTISLV | |
| LSIYSTVAA | | LSIYSTVAA | | MIEAESSVRE | | NGNYARLYIWG | |
| LSIYSTVAS | | LSIYSTVAS | | MIIGGFIFGC | | NGNYDSIRGEF | |
| LSIYSTVTS | | LSIYSTVTS | | MIKAVRGDLN | | NGNYGPINVTK | |
| LSIYSTVVS | | LSIYSTVVS | | MIKRGINDRN | | NGPDSVLVNTY | |
| LSKDNAIRI | | LSKDNAIRI | | MIKRGVNDRN | | NGPESVLINTY | |
| LSKDNGIRI | | LSKDNGIRI | | MINDKIDDQI | | NGPESVLVNTY | |
| LSKDNSIRL | | LSKDNSIRL | | MINDKINDQI | | NGQAGRIDFHW | |
| LSKRMEDGF | | LSKRMEDGF | | MINNDLGPAT | | NGQAGRMTFYW | |
| LSKSLCKVE | | LSKSLCKVE | | MINPVKLSGG | | NGQFGRIDFHW | |
| LSLAIMIAG | | LSLAIMIAG | | MINPVKLSSG | | NGQFGRINFHW | |
| LSLAIMMAG | | LSLAIMMAG | | MIRGQPKEKA | | NGQGSGYAADK | |
| LSLAIMVAG | | LSLAIMVAG | | MIRGQPKEKT | | NGQGSGYAADQ | |
| LSLIMRTVI | | LSLIMRTVI | | MIRGQPNERT | | NGQKSWMKIYW | |
| LSLLEMCHS | | LSLLEMCHS | | MISDKIDDQI | | NGQKSWTKIYW | |
| LSLWMCSNG | | LSLWMCSNG | | MISKCKTKEG | | NGQRGRIDFHW | |
| LSMAPIMFS | | LSMAPIMFS | | MISKCRTKEG | | NGQRSWMKIYW | |
| LSMEFSLTD | | LSMEFSLTD | | MISKCRTREG | | NGQSGRIDFHW | |
| LSMVKSDKI | | LSMVKSDKI | | MISKSRTKEG | | NGQSGRIDFYW | |
| LSMVRSDKI | | LSMVRSDKI | | MISPLAVTWW | | NGQSGRIEFHW | |
| LSNMGIYQI | | LSNMGIYQI | | MISRARIDAR | | NGQSGRINFHW | |
| LSNNATDTV | | LSNNATDTV | | MITQRTIGKK | | NGQSGRIVFHW | |
| LSNNSSDTV | | LSNNSSDTV | | MIWDANGWVS | | NGQTGRIDFHW | |
| LSNNSTDKI | | LSNNSTDKI | | MIWHSNLNDA | | NGRAPISLGDC | |
| LSNNSTDKV | | LSNNSTDKV | | MIWHSNLNDT | | NGREWSYIVER | |
| LSNNSTDTV | | LSNNSTDTV | | MKDRSPYRTL | | NGRFEFIAEEF | |
| LSNNSTEKV | | LSNNSTEKV | | MKGVYINTAL | | NGRLTTTIKTW | |
| LSNNSTERV | | LSNNSTERV | | MKGVYINTAM | | NGRSSFFRNVV | |
| LSNPKCDLY | | LSNPKCDLY | | MKGVYMNTAL | | NGRTLDLHDAN | |
| LSPEEVSET | | LSPEEVSET | | MKGVYVNTAL | | NGRTLDMHDAN | |
| LSPGMMMGM | | LSPGMMMGM | | MKHTSQYICS | | NGRTLGLHDAN | |
| LSPLTKGIL | | LSPLTKGIL | | MKHTSQYLCT | | NGSCAVVMTDG | |
| LSPLTKGML | | LSPLTKGML | | MKIIRVGCVI | | NGSCFTIMTDG | |
| LSPNVYQAR | | LSPNVYQAR | | MKIYWHLMHP | | NGSCFTLMTDG | |
| LSPRTVGQC | | LSPRTVGQC | | MKLYWHLMHP | | NGSCFTVLTDG | |
| LSQCGLLGT | | LSQCGLLGT | | MKLYWHLMRP | | NGSCFTVMTDG | |
| LSQGTTIRG | | LSQGTTIRG | | MKLYWHLMSP | | NGSCTVVMTDG | |
| LSQGTTLKG | | LSQGTTLKG | | MKNVPEKIHT | | NGSIPNDKPFQ | |
| LSQGTTLRG | | LSQGTTLRG | | MKNVPEKIRT | | NGSIPNEKPFQ | |
| LSQKFEEIR | | LSQKFEEIR | | MKNVPEKIRV | | NGSIPNGKPFQ | |
| LSRCRETRG | | LSRCRETRG | | MKRKRDSSIL | | NGSIPNNKPFQ | |
| LSRCRKTRG | | LSRCRKTRG | | MKRKRNSSIL | | NGSISNDKPFQ | |
| LSSGYKDII | | LSSGYKDII | | MKSRGYKMNT | | NGSMQCRICIG | |
| LSSGYKDVI | | LSSGYKDVI | | MKTIIVLSC | | NGTAKHIEECS | |
| LSSGYKEVI | | LSSGYKEVI | | MKWGMELRRC | | NGTCAVVMTDG | |
| LSSKANQVF | | LSSKANQVF | | MKWGMEMRRC | | NGTCTVIMTDG | |
| | | | | MKWLLSNADN | | NGTCTVVMTDG | |

Fig. 83-233

| Block size 8 | SIN | Block size 9 | SIN | Block size 10 | SIN | Block size 11 | SIN |
|---|---|---|---|---|---|---|---|
| LSSKDNQVF | | LSSKDNQVF | | MKWLLSNNDN | | NGTCVVIMTDG | |
| LSSMGIYQI | | LSSMGIYQI | | MKWLLSNSDN | | NGTCVVVMTDG | |
| LSSMGVYQI | | LSSMGVYQI | | MKWLLSNSNN | | NGTIHDRAAFR | |
| LSSPPTVYN | | LSSPPTVYN | | MKWLLSNTDN | | NGTIHDRSPFR | |
| LSSRISFYW | | LSSRISFYW | | MKWLLSSKAN | | NGTIHDRSPYR | |
| LSSSGNNQV | | LSSSGNNQV | | MKWLLSSKDN | | NGTIHDRSQFR | |
| LSSSMNNQV | | LSSSMNNQV | | MKWLLSSSDN | | NGTIHDRSQYR | |
| LSSVNTNTI | | LSSVNTNTI | | MKWLLSSTDN | | NGTIHDRTAFR | |
| LSSVSSFEK | | LSSVSSFEK | | MKWLSSSGNN | | NGTIHDRTTFR | |
| LSSVSSFER | | LSSVSSFER | | MKWLSSSMNN | | NGTIIKTLTNE | |
| LSSVSSFKR | | LSSVSSFKR | | MKWLTLKSGQ | | NGTIKDRSPYR | |
| LSSVTTNTI | | LSSVTTNTI | | MKWMMAMKYP | | NGTINDRSPFR | |
| LSTIALFIG | | LSTIALFIG | | MKWMMAMRYP | | NGTIVKTLTNE | |
| LSTIALIIG | | LSTIALIIG | | MLADRIDDAV | | NGTIVKTLTSE | |
| LSTIALLIG | | LSTIALLIG | | MLADRVDDAV | | NGTKINTLTER | |
| LSTKALLIG | | LSTKALLIG | | MLADWVDDAV | | NGTKVDTLTEK | |
| LSTNSSDKV | | LSTNSSDKV | | MLATGMKNVP | | NGTKVNTLTEK | |
| LSTNSSEKV | | LSTNSSEKV | | MLATGMRNIP | | NGTKVNTLTER | |
| LSTNSSERV | | LSTNSSERV | | MLATGMRNVP | | NGTMHDRSPFR | |
| LSTNSTEKV | | LSTNSTEKV | | MLCLGHHAVP | | NGTMKDRSPYR | |
| LSTNSTETV | | LSTNSTETV | | MLERELVRKT | | NGTSKIKMKWG | |
| LSTRGIQIA | | LSTRGIQIA | | MLFVQSYFQL | | NGTSKVKMKWG | |
| LSTRGVQIA | | LSTRGVQIA | | MLGFVFTLTV | | NGTSVKTLTDN | |
| LSTRGVQVA | | LSTRGVQVA | | MLKIHNAGTD | | NGTTGNPIICL | |
| LSTVLGVSI | | LSTVLGVSI | | MLKIPNAETD | | NGTTHDRTAFR | |
| LSTVSSFER | | LSTVSSFER | | MLKIPNAGID | | NGTVKDRSPFR | |
| LSVAPIMFS | | LSVAPIMFS | | MLKIPNAGTD | | NGTVKDRSPYR | |
| LSVIPSGPL | | LSVIPSGPL | | MLKMSLLTEV | | NGTWAVVMTDG | |
| LSVLNLLIG | | LSVLNLLIG | | MLKVPNAGTD | | NGTYDHKDFEE | |
| LSVPEWSYI | | LSVPEWSYI | | MLKVPNALID | | NGTYDHKDYEE | |
| LSVVNLLIG | | LSVVNLLIG | | MLKVPNALTD | | NGTYDHKEFEE | |
| LSVVSLLIG | | LSVVSLLIG | | MLLAIAMGLI | | NGTYDHKEFEK | |
| LSVVSLLVG | | LSVVSLLVG | | MLLDPGDTVT | | NGTYDHKEYEE | |
| LSVYSTVAS | | LSVYSTVAS | | MLNASCAAMD | | NGTYDHNIYRD | |
| LSYKVGYLC | | LSYKVGYLC | | MLNKSLCKIE | | NGTYDYPKYEE | |
| LSYQVGYLC | | LSYQVGYLC | | MLNKSLCKVE | | NGTYDYPKYSE | |
| LSYRVGYLC | | LSYRVGYLC | | MLNLYDRVRK | | NGTYDYPKYSK | |
| LSYSAGALA | | LSYSAGALA | | MLNLYERVRK | | NGTYDYSKYEE | |
| LSYSTGALA | | LSYSTGALA | | MLQSRTREIL | | NGTYNHEDYKE | |
| LSYSVGYLC | | LSYSVGYLC | | MLRIPNAGID | | NGTYNHEDYRE | |
| LSYTVGYLC | | LSYTVGYLC | | MLSKSLCKVE | | NGTYNHKDYEE | |
| LTDAEMNKL | | LTDAEMNKL | | MLSLIMRTVI | | NGTYNHKEYEE | |
| LTDKGSIQS | | LTDKGSIQS | | MLSTVLGVSI | | NGTYNRKEYEE | |
| LTDNHVEVV | | LTDNHVEVV | | MLTGNLQTLK | | NGTYNYPKYEE | |
| LTDNPRPND | | LTDNPRPND | | MMAMKYPITA | | NGTYNYPKYSE | |
| LTDSEMNKL | | LTDSEMNKL | | MMAMRYPITA | | NGTYYYPKYEE | |
| LTDSEMSKL | | LTDSEMSKL | | MMAYMLEREL | | NGVCPVVFTDG | |
| LTDSQTATK | | LTDSQTATK | | MMDGWYGFRH | | NGVILEENTTY | |
| LTDTSRPGD | | LTDTSRPGD | | MMDQVREGRN | | NGVITDTLKSW | |
| LTDTSRPKD | | LTDTSRPKD | | MMDQVRESRN | | NGVKGFAYLDG | |
| LTDTSRPND | | LTDTSRPND | | MMEAMVSRAR | | NGVKGFSYLDE | |
| LTDTSRPSD | | LTDTSRPSD | | MMGMFNMLST | | NGVKGFSYLDG | |
| LTDTSRPTD | | LTDTSRPTD | | MMIWHSNLND | | NGVKGFSYLNG | |
| LTDWSGYSG | | LTDWSGYSG | | MMKAVRGDLN | | NGVKLEENSTY | |
| LTEIWSYNA | | LTEIWSYNA | | MMMGMFNMLS | | NGVKLEENTSY | |
| LTEKGIEVV | | LTEKGIEVV | | MMSRARIDAR | | NGVKLEENTTY | |
| LTEKGVEVV | | LTEKGVEVV | | MMTHTSQYIC | | NGVKVDGSSSA | |
| LTENGVPVT | | LTENGVPVT | | MMWEINGPDS | | NGVPVTSSIDL | |
| LTEQNVPVT | | LTEQNVPVT | | MMWEINGPES | | NGVPVTSSVDL | |
| LTEREVEVV | | LTEREVEVV | | MMWEVNGPES | | NGVQDIIDNDN | |
| LTERGIEVV | | LTERGIEVV | | MNELGIPFHL | | NGVQDIIDNNN | |
| LTERGVEVV | | LTERGVEVV | | MNELGVPFHL | | NGVRIGSKGDV | |

Fig. 83-234

| Block size 8 | SIN | Block size 9 | SIN | Block size 10 | SIN | Block size 11 | SIN |
|---|---|---|---|---|---|---|---|
| LTETGVPVT | | LTETGVPVT | | MNELGVPFYL | | NGVRLEENTTY | |
| LTEVETYVL | | LTEVETYVL | | MNELGVSFHL | | NGVSPIHLGDC | |
| LTFLARSAL | | LTFLARSAL | | MNGNYDSIRG | | NGVSPVHLGDC | |
| LTGGQSFYR | | LTGGQSFYR | | MNGQSGRIDF | | NGVTNKVNSII | |
| LTGIWDTLI | | LTGIWDTLI | | MNIQFEAVGR | | NGWEGLIDGWY | |
| LTGMWDTLI | | LTGMWDTLI | | MNIQFTAVGK | | NGWEGLINGWY | |
| LTGNLQTLK | | LTGNLQTLK | | MNIQFTSVGK | | NGWEGLVDGWY | |
| LTGNLQTLR | | LTGNLQTLR | | MNKLFERVRR | | NGWEGMIDGWY | |
| LTGRGIEVV | | LTGRGIEVV | | MNKLYEKVRR | | NGWEGMMDGWY | |
| LTGSAQHIE | | LTGSAQHIE | | MNKLYERVKR | | NGWEGMVDGWY | |
| LTGTAKHIE | | LTGTAKHIE | | MNKLYERVRK | | NGWEGMVNGWY | |
| LTGTWDTLI | | LTGTWDTLI | | MNKLYERVRR | | NGWQGLIDGWY | |
| LTHALRELW | | LTHALRELW | | MNLLIGISNV | | NGWVSTDKDSN | |
| LTHGSLLND | | LTHGSLLND | | MNNEGSYFFG | | NGWVSTDKNSN | |
| LTHHMRKKR | | LTHHMRKKR | | MNNETILETG | | NGWVTADKDSN | |
| LTHIMIWHS | | LTHIMIWHS | | MNNQVFPQLN | | NGWYGFQHQNE | |
| LTHLMIWHS | | LTHLMIWHS | | MNPNQKIICI | | NGWYGFQHRND | |
| LTHMMIWHS | | LTHMMIWHS | | MNPNQKIITI | | NGWYGFQHRNE | |
| LTHQSGTYP | | LTHQSGTYP | | MNPNQKILCA | | NGWYGFRHQNA | |
| LTIAMGLVF | | LTIAMGLVF | | MNPNQKILCT | | NGWYGFRHQNS | |
| LTIGECPKY | | LTIGECPKY | | MNPNQKILFA | | NGYIEGKLSQM | |
| LTIGECPRY | | LTIGECPRY | | MNPNQKIMCI | | NGYKDVILWFS | |
| LTIGISGPD | | LTIGISGPD | | MNPNQKITCI | | NHEDYKEESQL | |
| LTIGITGPD | | LTIGITGPD | | MNPNQKLFAL | | NHEDYREESQL | |
| LTIGKCPKY | | LTIGKCPKY | | MNPNQKLFAS | | NHEGEGIPLYD | |
| LTIGVSGPD | | LTIGVSGPD | | MNPNQKLFTL | | NHGICAVATTH | |
| LTIIYSSSM | | LTIIYSSSM | | MNPNQKTITI | | NHGSLVLSLWM | |
| LTILGKDAG | | LTILGKDAG | | MNPNQMIITI | | NHKDYEEEAKL | |
| LTITYSSPM | | LTITYSSPM | | MNPNQNLFTL | | NHKEYEEEAKL | |
| LTITYSSSL | | LTITYSSSL | | MNPNQRILCT | | NHLIGKTNQQF | |
| LTITYSSSM | | LTITYSSSM | | MNPNQSIITI | | NHQFELIDNEF | |
| LTIYSTAAS | | LTIYSTAAS | | MNPSQKLFAL | | NHSMSDIEAMA | |
| LTIYSTVAS | | LTIYSTVAS | | MNREFEVMNH | | NHTDELCPSPL | |
| LTKATNGNY | | LTKATNGNY | | MNREFEVVDH | | NHTEYRQEALQ | |
| LTKELCTIN | | LTKELCTIN | | MNREFEVVNH | | NHTGTYCSLNG | |
| LTKETNGNY | | LTKETNGNY | | MNREFGVVNH | | NHTTINNITNV | |
| LTKGEKANV | | LTKGEKANV | | MNTALLNASC | | NHVEVVSAKEL | |
| LTKGILGFV | | LTKGILGFV | | MNTQFEAIGR | | NICEKLEQSGL | |
| LTKGLCTIN | | LTKGLCTIN | | MNTQFEAVGK | | NICKPYIGKCP | |
| LTKGMLGFV | | LTKGMLGFV | | MNTQFEAVGR | | NIDKNALGDCP | |
| LTKGVLGFV | | LTKGVLGFV | | MNTQFETVGK | | NIDKNALGECP | |
| LTKINNGDY | | LTKINNGDY | | MNTQFTAVGK | | NIDRFLRVRDQ | |
| LTKITVDHM | | LTKITVDHM | | MNTQFTSVGK | | NIDRNAIGDCP | |
| LTKKEPDTY | | LTKKEPDTY | | MNTQFTVVGK | | NIDRNALGDCP | |
| LTKKKNPEA | | LTKKKNPEA | | MNTQIIVILV | | NIDSRAVGKCP | |
| LTKKKPDIY | | LTKKKPDIY | | MNTSKPFQNI | | NIDSWAVGRCP | |
| LTKKKPDTY | | LTKKKPDTY | | MNTSKPFQNT | | NIEKNALGDCP | |
| LTKRLCTIN | | LTKRLCTIN | | MNTSKPLQNT | | NIERNALGDCP | |
| LTKTNNGDY | | LTKTNNGDY | | MNWSGYSGSF | | NIERNALGNCP | |
| LTKTTVDHM | | LTKTTVDHM | | MPASRYLTDM | | NIESNGNLIAP | |
| LTKVNNGDY | | LTKVNNGDY | | MPFHNIHPLT | | NIEVTNATELV | |
| LTKVNNGNY | | LTKVNNGNY | | MPFHNVHPLT | | NIFNMERIKEL | |
| LTKVNSGDY | | LTKVNSGDY | | MPLHNIHPLT | | NIGPRALVRGQ | |
| LTLGITGPD | | LTLGITGPD | | MQALQLLFEV | | NIGPRPFVRGQ | |
| LTLKLGQFP | | LTLKLGQFP | | MQALQLLLEV | | NIGPRPLIRGQ | |
| LTLKSEQFP | | LTLKSEQFP | | MQFSSFTVNV | | NIGPRPLVMGQ | |
| LTLKSGQFP | | LTLKSGQFP | | MQFSSLAVNV | | NIGPRPLVREQ | |
| LTLNTMTKD | | LTLNTMTKD | | MQFSSLTVNV | | NIGPRPLVRGQ | |
| LTMGECPKY | | LTMGECPKY | | MQFSSLTVSV | | NIGSRPRVRNQ | |
| LTMGYKDII | | LTMGYKDII | | MQGSTLPRRS | | NIHPLAIGECP | |
| LTMITYITR | | LTMITYITR | | MQIRGFVHFV | | NIHPLTIGECP | |
| LTNSEMNKL | | LTNSEMNKL | | MQIRGFVYFV | | NIHPLTIGKCP | |

Fig. 83-235

| Block size 8 | SIN | Block size 9 | SIN | Block size 10 | SIN | Block size 11 | SIN |
|---|---|---|---|---|---|---|---|
| LTQGACWEQ | | LTQGACWEQ | | MQLKDNAKEV | | NIIDKMNGNYD | |
| LTQGALLND | | LTQGALLND | | MQLRDNAKEI | | NIIEKMNGNYD | |
| LTQGRQTFD | | LTQGRQTFD | | MQLRDNAKEL | | NIIFLWGIHHP | |
| LTQGRQTYD | | LTQGRQTYD | | MQLRDNAKET | | NIIFSHNGGLI | |
| LTQGSLLND | | LTQGSLLND | | MQLRDNVKEL | | NILEKTHNGKL | |
| LTQGSLPND | | LTQGSLPND | | MQNGSCRCMF | | NILKGKFQTAA | |
| LTQGTCWEQ | | LTQGTCWEQ | | MQNGSYRCMF | | NILLSPEEVSE | |
| LTQGYKDII | | LTQGYKDII | | MQNKLNNVID | | NILRTHESECV | |
| LTQISNTNI | | LTQISNTNI | | MQNRIQIDPV | | NILRTQDSECV | |
| LTQTLVSNN | | LTQTLVSNN | | MQNRLNNVID | | NILRTQESECI | |
| LTRELCTIN | | LTRELCTIN | | MQRFRRPDSS | | NILRTQESECQ | |
| LTREPYVSC | | LTREPYVSC | | MRCTISLVKT | | NILRTQESECV | |
| LTRGLCTIN | | LTRGLCTIN | | MRDILGTFDT | | NILRTQESSCT | |
| LTRTTVDHM | | LTRTTVDHM | | MRDSIKSWRN | | NILSIAPIMFS | |
| LTSLPFQNI | | LTSLPFQNI | | MRDVIGTFDT | | NILSMAPIMFS | |
| LTSVTTNTI | | LTSVTTNTI | | MRDVLGTFDT | | NIMASQGTKRS | |
| LTTGKSHGR | | LTTGKSHGR | | MREPFISCSH | | NIMRTQESECV | |
| LTTIGLLLQ | | LTTIGLLLQ | | MRFTYSGIRT | | NINFMPYISFA | |
| LTTRGVQIA | | LTTRGVQIA | | MRILIRGNSP | | NINIREWSYLI | |
| LTTTIKPWA | | LTTTIKPWA | | MRILVRGNSP | | NINPVKLSSGY | |
| LTTTIKTWA | | LTTTIKTWA | | MRINNETILE | | NINPVTLSSGY | |
| LTTTIRTWA | | LTTTIRTWA | | MRISNETILE | | NINRITYGACP | |
| LTTTPTKSY | | LTTTPTKSY | | MRIWRQANNG | | NINSVKLSSGY | |
| LTTTVKTWA | | LTTTVKTWA | | MRKKRGLFGA | | NIPGKQAKGLF | |
| LTTVGLLLQ | | LTTVGLLLQ | | MRNIPEKQTR | | NIPQIESRGLF | |
| LTVEVPYVC | | LTVEVPYVC | | MRNIPERQTR | | NIPSIQSRGLF | |
| LTVLGKDAG | | LTVLGKDAG | | MRNIPGKQAK | | NIPSVQSRGLF | |
| LTVNVRGSG | | LTVNVRGSG | | MRNVPEKQTR | | NIPVTQTMELV | |
| LTVNVRGTG | | LTVNVRGTG | | MRNVPERQTR | | NIPVTQVEELV | |
| LTVPEWSYI | | LTVPEWSYI | | MRNVPETQTR | | NIQFEAVGREF | |
| LTVPSERGL | | LTVPSERGL | | MRPCFWVELI | | NIQFTAVGKEF | |
| LTVSVRGSG | | LTVSVRGSG | | MRPCFWVELV | | NIQFTSVGKEF | |
| LVADGGPNL | | LVADGGPNL | | MRRCLLQSLQ | | NIREWSYLIED | |
| LVAGGLILG | | LVAGGLILG | | MRTPIAFLTS | | NIRIGSKGDVF | |
| LVAGWYGFQ | | LVAGWYGFQ | | MRTQESECAC | | NIRNLHIPEAG | |
| LVAIENQHT | | LVAIENQHT | | MRTQESECVC | | NIRNLHIPEVC | |
| LVALALSHT | | LVALALSHT | | MRTQESSCTC | | NITAASLNDDG | |
| LVALCGSPI | | LVALCGSPI | | MRVLIRGNSP | | NITEIVYLNHT | |
| LVALCGSPV | | LVALCGSPV | | MRWLTKLGQ | | NITEIVYLNNT | |
| LVALENQHT | | LVALENQHT | | MRWLTLKSEQ | | NITEIVYLNST | |
| LVALENQNT | | LVALENQNT | | MRWLTLKSGQ | | NITFLHNGGLI | |
| LVAMENQHT | | LVAMENQHT | | MSCFVFVALI | | NITFSDNGGLI | |
| LVAPEYGFK | | LVAPEYGFK | | MSCPIGEAPS | | NITFSHNGGLI | |
| LVAPRGHYK | | LVAPRGHYK | | MSCPIGEVPS | | NITKIVYLNST | |
| LVAPRGYFK | | LVAPRGYFK | | MSCPIGVAPS | | NITVTHAKDIL | |
| LVAPSRVSK | | LVAPSRVSK | | MSCPIGVVPS | | NITVTHAQDIL | |
| LVAPWYAYK | | LVAPWYAYK | | MSCPLGEAPS | | NITVTHSVELL | |
| LVAPWYAYR | | LVAPWYAYR | | MSCPMGVAPS | | NITVTHSVNLL | |
| LVASSGNLE | | LVASSGNLE | | MSCPVGEAPS | | NITVTSSVELV | |
| LVASSGTLE | | LVASSGTLE | | MSCPVGVAPS | | NIVDKMNREFE | |
| LVAVENQHT | | LVAVENQHT | | MSDIEAMASQ | | NIVDKMNREFG | |
| LVCATCEQI | | LVCATCEQI | | MSDIEAMATQ | | NIVRRAAVSAD | |
| LVCVSLLQS | | LVCVSLLQS | | MSDIEIMASQ | | NIVRRAIVSAD | |
| LVDALLGDP | | LVDALLGDP | | MSDINIMASQ | | NIVRRATVSAD | |
| LVDGQDCDL | | LVDGQDCDL | | MSELGVPFHL | | NIVRRATVSTD | |
| LVDGWYGFR | | LVDGWYGFR | | MSFQGRGVFE | | NIWAYNAELLV | |
| LVDGWYGYH | | LVDGWYGYH | | MSGPNDNASA | | NIWITREPYVS | |
| LVDSIGSWS | | LVDSIGSWS | | MSGPNNNASA | | NIWSYNAQLLV | |
| LVDSIVSWS | | LVDSIVSWS | | MSGYSGIFSV | | NIYKILSIYSC | |
| LVETNHTDE | | LVETNHTDE | | MSICISGPNN | | NIYRDEAINNR | |
| LVETNHTGT | | LVETNHTGT | | MSICMSGPND | | NKACELTDSIW | |
| LVETSHTGT | | LVETSHTGT | | MSICMSGPNN | | NKACELTDSSW | |

Fig. 83-236

| Block size 8 | SIN | Block size 9 | SIN | Block size 10 | SIN | Block size 11 | SIN |
|---|---|---|---|---|---|---|---|
| LVFFCLKNG | | LVFFCLKNG | | MSICVSGPNN | | NKACELTDSTW | |
| LVFFCLRNG | | LVFFCLRNG | | MSIGITVIKN | | NKACELTDSVW | |
| LVFICIKNG | | LVFICIKNG | | MSIGVAVIKN | | NKACELTGSSW | |
| LVFICMKNG | | LVFICMKNG | | MSIGVTVIKN | | NKCIERVRNGT | |
| LVFICVKNG | | LVFICVKNG | | MSIGVTVIRN | | NKCIESIRNGT | |
| LVFMCVKNG | | LVFMCVKNG | | MSKEGSYFFG | | NKCMETIKNGT | |
| LVFNTVIHE | | LVFNTVIHE | | MSKKKSYINK | | NKCYQFALGQG | |
| LVFNTVIHG | | LVFNTVIHG | | MSKKKSYINR | | NKDGDIIFLWG | |
| LVFREQKQE | | LVFREQKQE | | MSKRKSYINK | | NKFAAICTHLE | |
| LVGDTPRND | | LVGDTPRND | | MSLLTEVETH | | NKFAAICTHME | |
| LVGDTPRNE | | LVGDTPRNE | | MSLLTEVETL | | NKFASICTHLE | |
| LVGDTPRNG | | LVGDTPRNG | | MSLLTEVETP | | NKHSNDTIHDR | |
| LVGDTPRNN | | LVGDTPRNN | | MSLLTEVETY | | NKHSNDTVHDR | |
| LVGDTPRSD | | LVGDTPRSD | | MSNEGSYFFG | | NKHSNGTIHDR | |
| LVGIDPFKL | | LVGIDPFKL | | MSNNSTEKVD | | NKHSNGTKHDR | |
| LVGIDPFRL | | LVGIDPFRL | | MSQLTEVETP | | NKHSNGTTHDR | |
| LVGINMSKK | | LVGINMSKK | | MSQSRTREIL | | NKHSNSTTHDR | |
| LVGINMSKR | | LVGINMSKR | | MSQSRTRGIL | | NKHWSGYSGSF | |
| LVGLILAFI | | LVGLILAFI | | MSRARIDARI | | NKIEFEPFQSL | |
| LVGLILSFI | | LVGLILSFI | | MSTNAYDRIC | | NKINNIVDKMN | |
| LVGLILTFI | | LVGLILTFI | | MSTPLGTPPT | | NKINSIIDKMN | |
| LVGPILSFI | | LVGPILSFI | | MSVCISGPNN | | NKITNKVNNIV | |
| LVGSSTYQN | | LVGSSTYQN | | MSVCMSGPNN | | NKKMEDGFLDI | |
| LVGTKHSNG | | LVGTKHSNG | | MSVPLGSSPN | | NKKMEDGFLDV | |
| LVGVDPFKL | | LVGVDPFKL | | MSVPLGSSSN | | NKKMEDGFLNV | |
| LVGVDPFRL | | LVGVDPFRL | | MSVPMGSSPN | | NKLAAICTHLE | |
| LVHQSGTYP | | LVHQSGTYP | | MTDGNASGKA | | NKLEFEPFQSL | |
| LVIAARNIV | | LVIAARNIV | | MTDGPANKQA | | NKLFERVRRQL | |
| LVISPDLSY | | LVISPDLSY | | MTDGPANNQA | | NKLITVGSSKY | |
| LVISSDLSY | | LVISSDLSY | | MTDGPANRQA | | NKLNNVIDKMN | |
| LVISTDLSY | | LVISTDLSY | | MTDGPANSQA | | NKLNNVIDKMY | |
| LVIWGIHHP | | LVIWGIHHP | | MTDGPASNQA | | NKLYEKVRRQL | |
| LVIWGVHHP | | LVIWGVHHP | | MTDGPASSQA | | NKLYERVKRQL | |
| LVIWGVHHS | | LVIWGVHHS | | MTDGPSDAQA | | NKLYERVRKQL | |
| LVLAAGLRN | | LVLAAGLRN | | MTDGSANSQA | | NKLYERVRRQL | |
| LVLAAIIMG | | LVLAAIIMG | | MTDGSASGKA | | NKLYGAGNKLI | |
| LVLAALIMG | | LVLAALIMG | | MTDGSASGQA | | NKLYGTGNKLI | |
| LVLAALNMG | | LVLAALNMG | | MTDGSASGRA | | NKLYVNKNPYT | |
| LVLAASIMG | | LVLAASIMG | | MTDGSASRKA | | NKMARLGKGYM | |
| LVLATGLRN | | LVLATGLRN | | MTDGSASSQA | | NKMARLGRGYM | |
| LVLATGPRN | | LVLATGPRN | | MTDGSASSRA | | NKMEFEPFQSL | |
| LVLDDCSLE | | LVLDDCSLE | | MTDSEMLNLY | | NKNATATVYYD | |
| LVLDDCSLK | | LVLDDCSLK | | MTDSEMNKLF | | NKNEIKGVKLS | |
| LVLGDCSIA | | LVLGDCSIA | | MTDSIKSWRK | | NKNPYTLVSTK | |
| LVLGLSMVK | | LVLGLSMVK | | MTDSIKSWRR | | NKNWSGYSGAF | |
| LVLGLSMVR | | LVLGLSMVR | | MTEIWSYNAE | | NKNWSGYSGSF | |
| LVLGNPKCD | | LVLGNPKCD | | MTELGVPFHL | | NKQASYKIFKS | |
| LVLIENDRT | | LVLIENDRT | | MTEVWSYNAE | | NKQFELIDNEF | |
| LVLIENERT | | LVLIENERT | | MTHISKYLCS | | NKRLCKVEGWV | |
| LVLIENQKT | | LVLIENQKT | | MTHMSKYLCS | | NKSLCKIEGWV | |
| LVLIVSLGA | | LVLIVSLGA | | MTHSSKYLCS | | NKSLCKVEGWV | |
| LVLLEDERT | | LVLLEDERT | | MTHTSKYLCS | | NKSLCNVEGWV | |
| LVLLENDKT | | LVLLENDKT | | MTHTSQYICS | | NKSLCSVEGWV | |
| LVLLENDRT | | LVLLENDRT | | MTHTSRYLCS | | NKTFQNIDKNA | |
| LVLLENEKT | | LVLLENEKT | | MTIASDILKR | | NKTFQNIDRNA | |
| LVLLENERT | | LVLLENERT | | MTIASDILTR | | NKTFQNIEKNA | |
| LVLLENGRT | | LVLLENGRT | | MTICIQGNND | | NKTFQNIERNA | |
| LVLLENQKI | | LVLLENQKI | | MTICVQGKND | | NKTFQNISPVW | |
| LVLLENQKP | | LVLLENQKP | | MTICVQGNND | | NKTFQNVSPIW | |
| LVLLENQKT | | LVLLENQKT | | MTICVQGNNK | | NKTFQNVSPLW | |
| LVLLFMIIG | | LVLLFMIIG | | MTICVQGNNN | | NKTFQNVSPVW | |
| LVLLGNQKT | | LVLLGNQKT | | MTKDAERGKL | | NKTGTFEFTSF | |

Fig. 83-237

| Block size 8 | SIN | Block size 9 | SIN | Block size 10 | SIN | Block size 11 | SIN |
|---|---|---|---|---|---|---|---|
| LVLLLMIIG | | LVLLLMIIG | | MTLDFHDSNV | | NKTKKMTITFL | |
| LVLLVSLGA | | LVLLVSLGA | | MTRGLFGAIA | | NKTVINNITTT | |
| LVLMENEMT | | LVLMENEMT | | MVAYMLEREL | | NKVARLGKGYM | |
| LVLMENERT | | LVLMENERT | | MVDGWYGFHH | | NKVCTKGKKAV | |
| LVLNKSLCK | | LVLNKSLCK | | MVDGWYGFRH | | NKVEFEPFQSL | |
| LVLVVSLGA | | LVLVVSLGA | | MVDGWYGFRY | | NKVKEIGNGCF | |
| LVLWAIHHP | | LVLWAIHHP | | MVDGWYGYHH | | NKVNNIVDKMN | |
| LVLWGIHHP | | LVLWGIHHP | | MVDQVRESRN | | NKVNSIIDKMN | |
| LVLWGVHHP | | LVLWGVHHP | | MVEAESSVKE | | NKVNSIIEKMN | |
| LVMGQQGRM | | LVMGQQGRM | | MVEAMISRAR | | NKVNSIIGKMN | |
| LVMKRKRDS | | LVMKRKRDS | | MVEAMMSRAR | | NKVNSIINKMN | |
| LVMKRKRNS | | LVMKRKRNS | | MVEAMVSRAR | | NKVNSVIEKMN | |
| LVMWGIHHP | | LVMWGIHHP | | MVFSQEDCMI | | NKVNSVVEKMN | |
| LVMWGLHHP | | LVMWGLHHP | | MVFSQEDCMM | | NKVNTVIEKMN | |
| LVNGQRGRI | | LVNGQRGRI | | MVFSQEDCMV | | NKVRMQLRDNV | |
| LVNLGLNIG | | LVNLGLNIG | | MVFSQEECMI | | NKWGDILDGVT | |
| LVNPGDSII | | LVNPGDSII | | MVGLILAFIM | | NKWGNVLDGVT | |
| LVNTYQWII | | LVNTYQWII | | MVHAMRTIGT | | NKWSGYSGSFI | |
| LVNTYQWVI | | LVNTYQWVI | | MVIASTTAKA | | NKYLEEHPNAG | |
| LVPCEPIII | | LVPCEPIII | | MVKAVRGDLN | | NKYLEEHPSAG | |
| LVPCFWLEM | | LVPCFWLEM | | MVKRGINDRN | | NKYLEEHPSTG | |
| LVPCFWVEM | | LVPCFWVEM | | MVKSDKICLG | | NLCQVECVCRD | |
| LVQLIVSGK | | LVQLIVSGK | | MVLASTTAKA | | NLCRFLETRTV | |
| LVQLIVSGR | | LVQLIVSGR | | MVLLQCRICI | | NLDLNMGQPFY | |
| LVQNSITIE | | LVQNSITIE | | MVLSAFDERR | | NLDYQIGYVCS | |
| LVREQQGRM | | LVREQQGRM | | MVNERTLDFH | | NLEELRFVFSI | |
| LVRGNSPAF | | LVRGNSPAF | | MVNGWYGFRH | | NLEELRFVFSN | |
| LVRGNSPVF | | LVRGNSPVF | | MVQAMRAIGT | | NLEELRFVFSS | |
| LVRGQQGRM | | LVRGQQGRM | | MVQAMRAVGT | | NLEKRLENLNK | |
| LVRGQQGTM | | LVRGQQGTM | | MVQAMRTIGT | | NLEKRLGNLNK | |
| LVRGQQGWM | | LVRGQQGWM | | MVQAMRTVGT | | NLERRLENLNK | |
| LVRGRPKES | | LVRGRPKES | | MVRSDKICLG | | NLERRLENLSK | |
| LVRGRPQET | | LVRGRPQET | | MVSPLAITWW | | NLESRSGFEMV | |
| LVRKTRFLP | | LVRKTRFLP | | MVSPLAVTWW | | NLFDEVKRRLS | |
| LVRMIKRGI | | LVRMIKRGI | | MVSRARIDAR | | NLFDEVRRRLS | |
| LVRSGMDPR | | LVRSGMDPR | | MVTFCGLDNE | | NLFEKFFPSSS | |
| LVRTGMDPR | | LVRTGMDPR | | MVTGLRNIPS | | NLFTLSGVAIA | |
| LVSDGGPNL | | LVSDGGPNL | | MVTQRTIGKK | | NLGKVECVCRD | |
| LVSLGAIGF | | LVSLGAIGF | | MVTQRTIGKR | | NLGLNIGLHLK | |
| LVSLGAISF | | LVSLGAISF | | MVTQRTMGKK | | NLGLNIGLHLR | |
| LVSLGAVSF | | LVSLGAVSF | | MVTQRTVGKK | | NLGLNVGLHLK | |
| LVSNNDWSG | | LVSNNDWSG | | MVVYAELLVA | | NLGQVECVCRD | |
| LVSNSDWSG | | LVSNSDWSG | | MVWDANGWVS | | NLHAYISFRNL | |
| LVSTKEWSK | | LVSTKEWSK | | MVWDANGWVT | | NLHIPEAGLKW | |
| LVSTKEWSR | | LVSTKEWSR | | MWACNSGNCR | | NLHIPEVCLKW | |
| LVSTNAYDR | | LVSTNAYDR | | MWACQKGNIK | | NLIAPEFGYLL | |
| LVSWEMGQA | | LVSWEMGQA | | MWACQKGNIR | | NLIAPEYGFKI | |
| LVSWPLSSP | | LVSWPLSSP | | MWACQRGNIR | | NLIAPEYGFRI | |
| LVTDGPSDA | | LVTDGPSDA | | MWACSNGNCR | | NLIAPEYGHLI | |
| LVTGKSHGR | | LVTGKSHGR | | MWACSNGSCR | | NLIAPEYGHLT | |
| LVTREPYIS | | LVTREPYIS | | MWACSSGNCR | | NLIAPEYGHLV | |
| LVTREPYLS | | LVTREPYLS | | MWAIHHPPTS | | NLIAPEYGYLI | |
| LVTREPYVS | | LVTREPYVS | | MWALGENMAP | | NLIAPRGHYKI | |
| LVTTVTLHF | | LVTTVTLHF | | MWEINGPDSV | | NLIAPRGHYKL | |
| LVVPEYGFK | | LVVPEYGFK | | MWEINGPESV | | NLIAPRGHYRL | |
| LVVSLGAIS | | LVVSLGAIS | | MWEVNGPESV | | NLIAPRGYFKI | |
| LVVSPDLSY | | LVVSPDLSY | | MWTCNSGNCR | | NLIAPRGYFKM | |
| LVWLENEKT | | LVWLENEKT | | MYALHQGTTI | | NLIAPRGYFKV | |
| LVWMACHSA | | LVWMACHSA | | MYQKCCNLFE | | NLIAPRGYFRI | |
| LVWMACNSA | | LVWMACNSA | | MYQKCCSLFE | | NLIAPRGYYKM | |
| LVYGNPACD | | LVYGNPACD | | MYQKCCTLFE | | NLIGKTSWSYI | |
| LVYGNPSCD | | LVYGNPSCD | | MYQRCCNLFE | | NLIIGISNVGL | |

Fig. 83-238

| Block size 8 | SIN | Block size 9 | SIN | Block size 10 | SIN | Block size 11 | SIN |
|---|---|---|---|---|---|---|---|
| LWACQNGNI | | LWACQNGNI | | MYSDFHFIDE | | NLIVFNTIGNL | |
| LWACQNGNL | | LWACQNGNL | | MYSDFHFINE | | NLKLATGLRNV | |
| LWACQNGNV | | LWACQNGNV | | NAALGSPGCD | | NLLHKCNDSCM | |
| LWACQTGNI | | LWACQTGNI | | NAASYKRIRL | | NLLIGISNIGL | |
| LWACSSGNC | | LWACSSGNC | | NADHRIYWIR | | NLLIGISNMSL | |
| LWAYNAELL | | LWAYNAELL | | NADHRVYWIR | | NLLIGISNVGL | |
| LWCKIVTTV | | LWCKIVTTV | | NADKICLGHH | | NLLIGISNVVL | |
| LWDSFRQSE | | LWDSFRQSE | | NADLEALMEW | | NLLIGVSNVGL | |
| LWFSFGASC | | LWFSFGASC | | NADLLVAMEN | | NLNDATYQRTR | |
| LWFSFGASS | | LWFSFGASS | | NADVLVALEN | | NLNDTTYQRTR | |
| LWFSLGASC | | LWFSLGASC | | NAEDIGNGCF | | NLNKKIDDGFL | |
| LWGIHHPDS | | LWGIHHPDS | | NAEDKGNGCF | | NLNKKMEDGFL | |
| LWGIHHPDT | | LWGIHHPDT | | NAEDMGDGCF | | NLNKKVDDGFI | |
| LWGIHHPPD | | LWGIHHPPD | | NAEDMGGGCF | | NLNKKVDDGFL | |
| LWGIHHPPN | | LWGIHHPPN | | NAEDMGNGCF | | NLNKKVDDGLL | |
| LWGVHHPSS | | LWGVHHPSS | | NAEDMGNGCL | | NLNRKMEDGFL | |
| LWHVRKRFA | | LWHVRKRFA | | NAEDQGNGCF | | NLNRKVDDGFL | |
| LWISFAISC | | LWISFAISC | | NAEDRGNGCF | | NLNWSGYSGSF | |
| LWISFAMSC | | LWISFAMSC | | NAEEDCTGCF | | NLQAYQKRMGL | |
| LWISFATSC | | LWISFATSC | | NAEEDGKGCF | | NLQAYQKRMGV | |
| LWISFSISC | | LWISFSISC | | NAEEDGNGCF | | NLQTYQKRMGV | |
| LWISFSMSC | | LWISFSMSC | | NAEEDGRGCF | | NLSGYSGSFID | |
| LWLVLREKM | | LWLVLREKM | | NAEEDGTGCF | | NLSPRTVGQCP | |
| LWMCFNGSL | | LWMCFNGSL | | NAEEMGNGCF | | NLTKELCTINS | |
| LWMCSNGSL | | LWMCSNGSL | | NAEFFVLMEN | | NLTKGLCTINS | |
| LWMCSNGSY | | LWMCSNGSY | | NAEFLVALEN | | NLTKRLCTINS | |
| LWSYNAELL | | LWSYNAELL | | NAEFLVAVEN | | NLTRELCTINS | |
| LWSYNAGLL | | LWSYNAGLL | | NAEGIGIAAD | | NLTRGLCTINS | |
| LWSYNAQLL | | LWSYNAQLL | | NAEGTGIAAD | | NLVAPEYGFKI | |
| LWTSNSIVA | | LWTSNSIVA | | NAEGTGMAAD | | NLVAPRGHYKL | |
| LWTSNSIVV | | LWTSNSIVV | | NAEGTGTAAD | | NLWAYNAELLV | |
| LWTSNSMVA | | LWTSNSMVA | | NAEIEDLIFL | | NLYASKNPYTL | |
| LWTSNSVVA | | LWTSNSVVA | | NAEIEDLIFM | | NLYDKVRLQLK | |
| LWTYNAELL | | LWTYNAELL | | NAEIEDLIFS | | NLYDKVRLQLR | |
| LWVSFSISC | | LWVSFSISC | | NAEIEDLTFL | | NLYDKVRMQLK | |
| LYASKNPYT | | LYASKNPYT | | NAEILVALEN | | NLYDKVRMQLR | |
| LYASPQLEG | | LYASPQLEG | | NAEILVLMEN | | NLYDRVRKQLR | |
| LYASSQLEG | | LYASSQLEG | | NAELFVLMEN | | NLYDRVRLQLR | |
| LYDAIEECL | | LYDAIEECL | | NAELIVLLEN | | NLYEKVRLQLR | |
| LYDKVRFQL | | LYDKVRFQL | | NAELLIALEN | | NLYEKVRMQLR | |
| LYDKVRHQL | | LYDKVRHQL | | NAELLIAMEN | | NLYERVRKQLR | |
| LYDKVRLQL | | LYDKVRLQL | | NAELLILLEN | | NLYGFIIKGRS | |
| LYDKVRMQL | | LYDKVRMQL | | NAELLVALEN | | NLYGFIVKGRS | |
| LYDRVRKQL | | LYDRVRKQL | | NAELLVAMEN | | NLYNIRNLHIP | |
| LYDRVRLQL | | LYDRVRLQL | | NAELLVLIEN | | NLYNKVRMQLR | |
| LYDRVRMQL | | LYDRVRMQL | | NAELLVLLED | | NLYVNKNPYTL | |
| LYDYKEDRF | | LYDYKEDRF | | NAELLVLLEN | | NMARAVKLYKK | |
| LYDYKENRF | | LYDYKENRF | | NAELLVLLGN | | NMDKAVKLYKK | |
| LYDYKESRF | | LYDYKESRF | | NAELLVLMEN | | NMDKAVKLYRK | |
| LYDYKKNRF | | LYDYKKNRF | | NAEVLVLMEN | | NMDRAVKLYKK | |
| LYEAIEECL | | LYEAIEECL | | NAGKDPKKTG | | NMDRAVKLYRK | |
| LYEKVRLQL | | LYEKVRLQL | | NAGLLVALEN | | NMERIKELRDL | |
| LYEKVRMQL | | LYEKVRMQL | | NAHDRICIGY | | NMERIKELRYL | |
| LYEKVRRQL | | LYEKVRRQL | | NAHILVTREP | | NMGIYQILAIY | |
| LYENNPGRV | | LYENNPGRV | | NAHKMESRGL | | NMGKVECVCRD | |
| LYERVKKQL | | LYERVKKQL | | NAIDAGDGCF | | NMGVYQILAIY | |
| LYERVKRQL | | LYERVKRQL | | NAIDAGNGCF | | NMGVYQVLAIY | |
| LYERVRKQL | | LYERVRKQL | | NAIDEGDGCF | | NMHDANVRNLH | |
| LYERVRRQL | | LYERVRRQL | | NAIDEGNGCF | | NMIADRVDDAV | |
| LYESIEECL | | LYESIEECL | | NAIDNGDGCF | | NMINDKIDDQI | |
| LYFWGIHHP | | LYFWGIHHP | | NAIDTGDGCF | | NMINDKINDQI | |
| LYFWGVHHP | | LYFWGVHHP | | NAIDTGKGCF | | NMINNDLGPAT | |

Fig. 83-239

| Block size 8 | SIN | Block size 9 | SIN | Block size 10 | SIN | Block size 11 | SIN |
|---|---|---|---|---|---|---|---|
| LYGAGNKLI | | LYGAGNKLI | | NAIDTGNGCF | | NMISDKIDDQI | |
| LYGAIEECL | | LYGAIEECL | | NAIGDCPKYI | | NMLADRIDDAV | |
| LYGAQSLSI | | LYGAQSLSI | | NAINEGNGCF | | NMLADRVDDAV | |
| LYGFIIKGR | | LYGFIIKGR | | NAIRFGEGEQ | | NMLADWVDDAV | |
| LYGFIVKGR | | LYGFIVKGR | | NAIRFGESEQ | | NMLSTVLGVSI | |
| LYGNGAKLI | | LYGNGAKLI | | NAIRIGEDAH | | NMLSTVLGVSV | |
| LYGNGNKLI | | LYGNGNKLI | | NAIRIGEEAH | | NMNWSGYSGSF | |
| LYGNGNKLV | | LYGNGNKLV | | NAIRIGEGAH | | NMQNKLNNVID | |
| LYGSGAKLI | | LYGSGAKLI | | NAIRIGENAH | | NMQNRLNNVID | |
| LYGSGNKLI | | LYGSGNKLI | | NAISTTFPYT | | NMRCTISLVKT | |
| LYGSGNKLV | | LYGSGNKLV | | NAITRSGQNH | | NMSKKKSYINK | |
| LYGSGSKLI | | LYGSGSKLI | | NAKDEGNGCF | | NMSKKKSYINR | |
| LYGTGNKLI | | LYGTGNKLI | | NAKDLGNGCF | | NMSKRKSYINK | |
| LYGTQPLSI | | LYGTQPLSI | | NAKEIGNGCF | | NMTNVQNNYTT | |
| LYGTQSLSI | | LYGTQSLSI | | NAKELGNGCF | | NNADHRIYWIR | |
| LYIRTNGTS | | LYIRTNGTS | | NAKEMGNGCF | | NNADHRVYWIR | |
| LYIWGIHHP | | LYIWGIHHP | | NAKETGNGCF | | NNAIDEGDGCF | |
| LYIWGVHHP | | LYIWGVHHP | | NAKEVGNGCF | | NNAKDEGNGCF | |
| LYKKDISYV | | LYKKDISYV | | NAKEWGNGCF | | NNAKEIGNGCF | |
| LYKKDNSYV | | LYKKDNSYV | | NAKLLVLIEN | | NNAKELGNGCF | |
| LYKKDSSHV | | LYKKDSSHV | | NAKLLVLLEN | | NNAKEVGNGCF | |
| LYKKDSSYI | | LYKKDSSYI | | NALDTGDGCF | | NNAQEIGNGCF | |
| LYKKDSSYV | | LYKKDSSYV | | NALGDCPKYI | | NNATATVYYDR | |
| LYKKLKREI | | LYKKLKREI | | NALGECPKYI | | NNATATVYYER | |
| LYKKLKREM | | LYKKLKREM | | NALGNCPKYI | | NNATDTVDTLT | |
| LYKNANTLS | | LYKNANTLS | | NALIDDRSKP | | NNBNGVKGFSY | |
| LYKNANTLT | | LYKNANTLT | | NALLKHRFEI | | NNCIESIRNGK | |
| LYKNNPGRV | | LYKNNPGRV | | NALNGNGDPN | | NNCIESIRNGT | |
| LYKNSPGRV | | LYKNSPGRV | | NALSGNGDPN | | NNCMESIRNNT | |
| LYKNTNTLS | | LYKNTNTLS | | NALSIAPIMF | | NNDLGPATAQM | |
| LYKSNPGRV | | LYKSNPGRV | | NALTDDKSKP | | NNDNATATVYY | |
| LYKVATGRV | | LYKVATGRV | | NALTDDRSKP | | NNDWSGYSGSF | |
| LYLNGREWS | | LYLNGREWS | | NALTDERSKP | | NNECMETIKNG | |
| LYLSGREWS | | LYLSGREWS | | NALTDNRSKP | | NNEDGDIIFLW | |
| LYLTGTWDT | | LYLTGTWDT | | NALTGGQSFY | | NNEDGNIIFLW | |
| LYLWGVHHP | | LYLWGVHHP | | NALYGTQSLS | | NNEEGDIIFLW | |
| LYNIRNLHI | | LYNIRNLHI | | NAMDAGNGCF | | NNEGSYFFGDN | |
| LYNKHSNGT | | LYNKHSNGT | | NANDLGNGCF | | NNEKGNPGVKG | |
| LYNKIEFEP | | LYNKIEFEP | | NANTLSSVNT | | NNEKGNQGVKG | |
| LYNKLEFEP | | LYNKLEFEP | | NANTLSSVTT | | NNENATATVYY | |
| LYNKMEFEP | | LYNKMEFEP | | NANTLTSVTT | | NNENGDIIFLW | |
| LYNKVEFEP | | LYNKVEFEP | | NAPHKLCFPG | | NNEPGSGNWPD | |
| LYNKVRLQL | | LYNKVRLQL | | NAPHKLCYPG | | NNEQGSGYAAD | |
| LYNKVRMQL | | LYNKVRMQL | | NAPNKFCYPG | | NNERGNHGVKG | |
| LYQEVGTYV | | LYQEVGTYV | | NAPNKLCFPG | | NNERGNPGVKG | |
| LYQKVGTYV | | LYQKVGTYV | | NAPNKLCYPG | | NNERGNQGVKG | |
| LYQNVETYV | | LYQNVETYV | | NAPSGIEYNG | | NNERGTQGVKG | |
| LYQNVGTYV | | LYQNVGTYV | | NAPSGVEYNG | | NNETIIETGYV | |
| LYRKLKREI | | LYRKLKREI | | NAQAFYKILK | | NNETILETGYI | |
| LYSGFVRTL | | LYSGFVRTL | | NAQEIGNGCF | | NNETILETGYV | |
| LYSSPQLEG | | LYSSPQLEG | | NAQGEGIAAD | | NNETILETRYV | |
| LYVNKNPYT | | LYVNKNPYT | | NAQGEGTAAD | | NNETIVETGYV | |
| LYVRTNGTS | | LYVRTNGTS | | NAQGIGQAAD | | NNFVPVIGARP | |
| LYVWGVHHP | | LYVWGVHHP | | NAQGQGTAAD | | NNFVPVMGARP | |
| LYWHLMHPG | | LYWHLMHPG | | NAQGTGQAAD | | NNFVPVVGARP | |
| LYWHLMRPG | | LYWHLMRPG | | NAQGTGQVAD | | NNFVPVVRARP | |
| LYWHLMSPG | | LYWHLMSPG | | NAQHIEECSC | | NNGDYARLYIW | |
| MAADKESTQ | | MAADKESTQ | | NAQHVEECSC | | NNGDYTRLYIW | |
| MAADQKSTQ | | MAADQKSTQ | | NAQLLVLLEN | | NNGELRHLFSG | |
| MAADRDSTQ | | MAADRDSTQ | | NAQLLVWLEN | | NNGKFEFIAED | |
| MACHSAAFE | | MACHSAAFE | | NARELGNGCF | | NNGKFEFIAEE | |
| MACNSAAFE | | MACNSAAFE | | NARLLVLLEN | | NNGKFEFIVEK | |

Fig. 83-240

| Block size 8 | SIN | Block size 9 | SIN | Block size 10 | SIN | Block size 11 | SIN |
|---|---|---|---|---|---|---|---|
| MADSEMLNL | | MADSEMLNL | | NASCAAMDDF | | NNGKGRYGVKG | |
| MADSIKSWR | | MADSIKSWR | | NASCAAMDEF | | NNGKLEFIAEE | |
| MADSTMLNL | | MADSTMLNL | | NASCAAMEDF | | NNGKVECICRD | |
| MAFLEDSHP | | MAFLEDSHP | | NASRHHMGEC | | NNGNYARLYIW | |
| MAFLEESHP | | MAFLEESHP | | NASRHYMGEC | | NNGRFEFIAEE | |
| MAFLEKSHP | | MAFLEKSHP | | NASRYYMGEC | | NNGSCRCTICI | |
| MAFLENSHP | | MAFLENSHP | | NASTGAQSFY | | NNGVKGFAYLD | |
| MAGLSFWMC | | MAGLSFWMC | | NASTGGQAFY | | NNGVKGFSYLD | |
| MAGSSEQAA | | MAGSSEQAA | | NASTGGQSFY | | NNGVKGFSYLN | |
| MAIDNMQNK | | MAIDNMQNK | | NASWFNSFLA | | NNHTTINNITN | |
| MAIIKKYTS | | MAIIKKYTS | | NASWFNSFLI | | NNIIDKMNGNY | |
| MAIIKRYTS | | MAIIKRYTS | | NASWFNSFLK | | NNIIEKMNGNY | |
| MAINWGRIV | | MAINWGRIV | | NASWFNSFLT | | NNILRTQESEC | |
| MAKCNTKCQ | | MAKCNTKCQ | | NASWFNSFLV | | NNIRIGSKGDV | |
| MALLEESHP | | MALLEESHP | | NATASFIYDG | | NNIVDKMNREF | |
| MALQGTKRS | | MALQGTKRS | | NATASFIYEG | | NNKDGDIIFLW | |
| MALQLFIKD | | MALQLFIKD | | NATASFIYGG | | NNKHSNGTIHD | |
| MALSVVSLL | | MALSVVSLL | | NATASFIYNE | | NNKHWSGYSGS | |
| MAMKYPITA | | MAMKYPITA | | NATASFIYNG | | NNKNATATVYY | |
| MAMRYPITA | | MAMRYPITA | | NATASFVYDG | | NNKNWSGYSGA | |
| MANIRNNTY | | MANIRNNTY | | NATASLIYDG | | NNKNWSGYSGS | |
| MAPEKIDFE | | MAPEKIDFE | | NATATVYYDR | | NNLTKGLCTIN | |
| MAPEKMDFE | | MAPEKMDFE | | NATATVYYER | | NNLTKRLCTIN | |
| MAPEKVDFD | | MAPEKVDFD | | NATATVYYNG | | NNLTRELCTIN | |
| MAPEKVDFE | | MAPEKVDFE | | NATATVYYNK | | NNLTRGLCKIN | |
| MAPIMFSNK | | MAPIMFSNK | | NATATVYYNR | | NNLTRGLCTIN | |
| MARAVKLYK | | MARAVKLYK | | NATDTVDTLT | | NNMINNDLGPA | |
| MARCNTKCQ | | MARCNTKCQ | | NATETVEITG | | NNMNWSGYSGS | |
| MARLGKGYM | | MARLGKGYM | | NAVDEGNGCF | | NNMVNNDLGPA | |
| MARLGRGYM | | MARLGRGYM | | NAVDTGDGCF | | NNNASAIIWYN | |
| MARSALILR | | MARSALILR | | NAVDTGNGCF | | NNNASAIVWYN | |
| MASIRNNTY | | MASIRNNTY | | NAVRFGESEQ | | NNNASAVIWYK | |
| MASIRNSTY | | MASIRNSTY | | NAVRIGEDAH | | NNNASAVIWYN | |
| MASQGTKRP | | MASQGTKRP | | NAYDRICIGY | | NNNASAVVWYN | |
| MASQGTKRS | | MASQGTKRS | | NAYQAKFESV | | NNNATATVYYD | |
| MATGLRNIP | | MATGLRNIP | | NAYQAQFESV | | NNNATATVYYN | |
| MATGLRNVP | | MATGLRNVP | | NAYQARFESV | | NNNGELRHLFS | |
| MATIRNGTY | | MATIRNGTY | | NCDTKCQTPL | | NNNGVKGFAYL | |
| MATLCLGHH | | MATLCLGHH | | NCETKCQSPL | | NNNGVKGFSYL | |
| MATNECRII | | MATNECRII | | NCETKCQTPL | | NNNKGAVFKSN | |
| MAWSSSSCH | | MAWSSSSCH | | NCETQCQTPL | | NNNLSGYSGSF | |
| MCFNGSLQC | | MCFNGSLQC | | NCIESIRNGT | | NNNNATATVYY | |
| MCHGTQIGG | | MCHGTQIGG | | NCIKPCFWVE | | NNNNGVKGFAY | |
| MCHSTQIGG | | MCHSTQIGG | | NCINRCFYVE | | NNNNGVKGFSY | |
| MCHSTRIGG | | MCHSTRIGG | | NCIRPCFWVE | | NNNNNTATLCL | |
| MCLNGSMQC | | MCLNGSMQC | | NCKDPNNERG | | NNNWFGYFGIF | |
| MCNILKGKF | | MCNILKGKF | | NCLVPCFWVE | | NNNWSGYSGIF | |
| MCPNGSLQC | | MCPNGSLQC | | NCLYASPQLE | | NNNWSGYSGSF | |
| MCSGHSCRI | | MCSGHSCRI | | NCMERIRNNT | | NNPITGSPEAP | |
| MCSGLVGDT | | MCSGLVGDT | | NCMESIRDNT | | NNPITGSPGAP | |
| MCSLMQGST | | MCSLMQGST | | NCMESIRNNT | | NNPNWSGYSGA | |
| MCSNGSLHG | | MCSNGSLHG | | NCMRPCFWVE | | NNQASYKIFKS | |
| MCSNGSLQC | | MCSNGSLQC | | NCPKYIKSGQ | | NNQASYRIFKS | |
| MCSNGSLRC | | MCSNGSLRC | | NCPKYVKQGS | | NNQDWSGYSGA | |
| MCSNGSMQC | | MCSNGSMQC | | NCRDPNNERG | | NNQKWSGYSGA | |
| MCSNSSMQC | | MCSNSSMQC | | NCRNPNNEKG | | NNQNWSGYSGA | |
| MCSSTEFLG | | MCSSTEFLG | | NCRNPNNERG | | NNQNWSGYSGS | |
| MCTELKLND | | MCTELKLND | | NCSIAGWLLG | | NNQVFPQLNQT | |
| MCTELKLSD | | MCTELKLSD | | NCTIPCFWVE | | NNRIKINPVTL | |
| MCTELKLSE | | MCTELKLSE | | NCTVPCFWVE | | NNRKEPALIVW | |
| MCTELQLSD | | MCTELQLSD | | NCWSFALAQG | | NNRNWSGYSGS | |
| MCVCRDNWH | | MCVCRDNWH | | NCYQFALGQG | | NNRSGYSGIFS | |

Fig. 83-241

| Block size 8 | SIN | Block size 9 | SIN | Block size 10 | SIN | Block size 11 | SIN |
|---|---|---|---|---|---|---|---|
| MCVGWSSTT | | MCVGWSSTT | | NCYWVMTDGP | | NNSCMETIRNG | |
| MCVKNGNLR | | MCVKNGNLR | | NDATYQRTRA | | NNSSDTVDTLT | |
| MCVKNGNMR | | MCVKNGNMR | | NDAYAVIHYG | | NNSTATLCLGH | |
| MCYPGFVEN | | MCYPGFVEN | | NDDIDQSLII | | NNSTDKIDTLT | |
| MCYPGSIEN | | MCYPGSIEN | | NDDSSSNSNC | | NNSTDKVDTII | |
| MCYPGSVEN | | MCYPGSVEN | | NDDSSSSSNC | | NNSTDKVDTLT | |
| MDAGNGCFD | | MDAGNGCFD | | NDDVDQSLII | | NNSTDKVNTII | |
| MDALKLSIE | | MDALKLSIE | | NDDVDQSLVI | | NNSTDTVDTIL | |
| MDALLGDPH | | MDALLGDPH | | NDDVSWASNS | | NNSTDTVDTLI | |
| MDDFQLIPM | | MDDFQLIPM | | NDDVSWTSNS | | NNSTDTVDTLL | |
| MDEFQLIPM | | MDEFQLIPM | | NDEGTGIAAD | | NNSTDTVDTLT | |
| MDGVTNKVN | | MDGVTNKVN | | NDERGNPGVK | | NNSTDTVDTVL | |
| MDGWYGFRH | | MDGWYGFRH | | NDEVDQSLII | | NNSTDTVNTLI | |
| MDHTSQYLC | | MDHTSQYLC | | NDEVSWTSNS | | NNSTDTVNTLM | |
| MDKAVKLYK | | MDKAVKLYK | | NDFFKRLNWL | | NNSTDTVNTLT | |
| MDKAVKLYR | | MDKAVKLYR | | NDFFNRLNWL | | NNSTEHVDTIM | |
| MDKLFERVR | | MDKLFERVR | | NDFFRRLNWL | | NNSTEKVDTII | |
| MDKQTKTMT | | MDKQTKTMT | | NDGKVECVCR | | NNSTEQVDTIM | |
| MDNKTKKMT | | MDNKTKKMT | | NDKHSNGTAK | | NNSTERVDTII | |
| MDNQTKKMT | | MDNQTKKMT | | NDKHSNGTIK | | NNSTERVDTIM | |
| MDNQTKTMT | | MDNQTKTMT | | NDKHSNGTMK | | NNSTETVNTLI | |
| MDPRMCSLM | | MDPRMCSLM | | NDKHSNGTVK | | NNSTETVNTLS | |
| MDQVREGRN | | MDQVREGRN | | NDKHSNNTVK | | NNSTETVNTLT | |
| MDQVRESRN | | MDQVRESRN | | NDKHSNNTVR | | NNSTKQVDTIM | |
| MDRAVKLYK | | MDRAVKLYK | | NDKPFQNVNK | | NNSTNTVNTLI | |
| MDRAVKLYR | | MDRAVKLYR | | NDKPFQNVNR | | NNSTVQVDTIM | |
| MDSLKLSIE | | MDSLKLSIE | | NDKTLDLHDA | | NNSWSGYSGIF | |
| MDSRSGYET | | MDSRSGYET | | NDKTLDMHDA | | NNTCMETIRNG | |
| MDSVKNGTY | | MDSVKNGTY | | NDKTLNMHDA | | NNTEPLCDVSG | |
| MDSVRNGTY | | MDSVRNGTY | | NDKYHQIEKE | | NNTEPLCEVSG | |
| MDTIRNGTY | | MDTIRNGTY | | NDLGNGCFEF | | NNTEPLCNVSG | |
| MDTVNRTHQ | | MDTVNRTHQ | | NDLGPATAQM | | NNTNGEQILII | |
| MDTVSRTHQ | | MDTVSRTHQ | | NDLYGTQPLS | | NNTSGEQMLII | |
| MDVNPTLLF | | MDVNPTLLF | | NDLYGTQSLS | | NNTSGEQMLVI | |
| MDVWTYNAE | | MDVWTYNAE | | NDNASAVVWY | | NNTSGKQMLII | |
| MDYYWAILK | | MDYYWAILK | | NDNATATVYY | | NNTTGRDVLVI | |
| MDYYWAVLK | | MDYYWAVLK | | NDNVSWTSNS | | NNTTGRDVLVL | |
| MDYYWGILK | | MDYYWGILK | | NDNWSGYSGS | | NNTTGRDVLVM | |
| MEAIRNGTY | | MEAIRNGTY | | NDPSGYAQTD | | NNTTLIENTYV | |
| MEAMVSRAR | | MEAMVSRAR | | NDPWVLLNAS | | NNTTNYYNETF | |
| MECRTFFLT | | MECRTFFLT | | NDPYPGNNNK | | NNTTVVENTYV | |
| MEDFVRQCF | | MEDFVRQCF | | NDPYPGNNNN | | NNTVINNITTT | |
| MEDGFIDVW | | MEDGFIDVW | | NDPYPGNSNN | | NNTVKDRSPYR | |
| MEDGFLDVW | | MEDGFLDVW | | NDPYPGSNNN | | NNTVVNNITTT | |
| MEDGFLGVW | | MEDGFLGVW | | NDQGAGYAAD | | NNTWLGRTISP | |
| MEDGFRDVW | | MEDGFRDVW | | NDQGSGYAAD | | NNTYDHAQYRE | |
| MEEFVRQCF | | MEEFVRQCF | | NDQIEDLWAY | | NNTYDHSHYRE | |
| MEEGSIGKV | | MEEGSIGKV | | NDQITDIWAY | | NNTYDHSQYRE | |
| MEEVTNATE | | MEEVTNATE | | NDRHSNGTIK | | NNTYDHTQYRE | |
| MEFEPFQSL | | MEFEPFQSL | | NDRHSNGTVK | | NNTYNHTEYRQ | |
| MEFSLTDPK | | MEFSLTDPK | | NDRNFWRGDN | | NNTYNHTQYRE | |
| MEFSLTDPR | | MEFSLTDPR | | NDRNFWRGEN | | NNVIDKMNKQF | |
| MEGFVRQCF | | MEGFVRQCF | | NDRSPFRALV | | NNVIDKMNKQL | |
| MEGICYPGS | | MEGICYPGS | | NDRSPHRTLM | | NNVIDKMNNQF | |
| MEGVCYPGS | | MEGVCYPGS | | NDRTLDLHDA | | NNVIDKMYKQF | |
| MEHTSQYLC | | MEHTSQYLC | | NDSCMDTIRN | | NNVTVTSSVEL | |
| MEKANKIKS | | MEKANKIKS | | NDSCMEAIRN | | NNWFGYFGIFF | |
| MEKFIILST | | MEKFIILST | | NDSCMETIRN | | NNWSGYSGIFS | |
| MEKFITLST | | MEKFITLST | | NDTDVVNFLS | | NNWSGYSGSFI | |
| MEKFIVLSI | | MEKFIVLSI | | NDTDVVNFVS | | NNWSGYSGSFS | |
| MEKFIVLSV | | MEKFIVLSV | | NDTDVVNYVS | | NNYGVKGFGFR | |
| MEKNITVTH | | MEKNITVTH | | NDTINYYNET | | NPAHKSQLIWM | |

Fig. 83-242

| Block size 8 | SIN | Block size 9 | SIN | Block size 10 | SIN | Block size 11 | SIN |
|---|---|---|---|---|---|---|---|
| MEKNVTVTH | | MEKNVTVTH | | NDTITFSFNG | | NPAHKSQLVWM | |
| MELDEIGED | | MELDEIGED | | NDTTYQRTRA | | NPALRMKWMMA | |
| MELIRMIKR | | MELIRMIKR | | NDTVIFSFNG | | NPCFYVELIRG | |
| MELIRMVKR | | MELIRMVKR | | NDTVNFSFNG | | NPDPGVKGFAF | |
| MELPSFGVS | | MELPSFGVS | | NDTVTFIFNG | | NPEAYNFNEGS | |
| MELRRCLLQ | | MELRRCLLQ | | NDTVTFNFNG | | NPGDSIIFNSI | |
| MELVEAEKH | | MELVEAEKH | | NDTVTFSFNG | | NPGNAEIEDLI | |
| MELVETEKH | | MELVETEKH | | NDTVTFTFNG | | NPGNAEIEDLT | |
| MELVETEKN | | MELVETEKN | | NDTVTGSFNG | | NPGVKGWAFDN | |
| MELVETKKH | | MELVETKKH | | NDVWLGRTIS | | NPGVKGWAFDS | |
| MELVRMIKR | | MELVRMIKR | | NDVWLGRTVS | | NPGVKGWAFDY | |
| MEMRRCLLQ | | MEMRRCLLQ | | NDVWLGRTVT | | NPIICLGHHAV | |
| MENEMTLDF | | MENEMTLDF | | NDVWMGRTIS | | NPITGSPCAPG | |
| MENERILDF | | MENERILDF | | NDWSGYSGSF | | NPITGSPGAPG | |
| MENERTLDF | | MENERTLDF | | NDYEELKHLL | | NPITGSPGSPG | |
| MENERTLDL | | MENERTLDL | | NDYEELKHLM | | NPITGSPGVPG | |
| MENERTLDY | | MENERTLDY | | NEAINNRFQI | | NPITGSPSAPG | |
| MENERTLYF | | MENERTLYF | | NECIEKIRNG | | NPKCDIHLKDQ | |
| MENFVRQCF | | MENFVRQCF | | NECIEKVRNG | | NPKCDIHLRDQ | |
| MENLNKKVD | | MENLNKKVD | | NECIERVRNG | | NPKCDLYLNGR | |
| MENQHIIDL | | MENQHIIDL | | NECMETIKNG | | NPKCDLYLSGR | |
| MENQHTIDL | | MENQHTIDL | | NECRFYALSQ | | NPKCDPYLNGR | |
| MENQHTIDM | | MENQHTIDM | | NECRTFFLTQ | | NPKCDTHLKDQ | |
| MEQMAGSSE | | MEQMAGSSE | | NECYNPCFYV | | NPKCDVHLKDQ | |
| MEQNVPVTQ | | MEQNVPVTQ | | NEDGDIIFLW | | NPKSKLFTLSG | |
| MEQVAGSSE | | MEQVAGSSE | | NEDGNIIFLW | | NPLIKHENRMV | |
| MERIRNNTY | | MERIRNNTY | | NEDGSSSSNC | | NPLIRHENRMV | |
| MERNVTVTH | | MERNVTVTH | | NEDSSSNSNC | | NPMHQLLRHFQ | |
| MESGGIDKI | | MESGGIDKI | | NEDSSSSSNC | | NPNQKIICISA | |
| MESGGIDKV | | MESGGIDKV | | NEEALRQIIR | | NPNQKIICIST | |
| MESGGISKI | | MESGGISKI | | NEEALRQILR | | NPNQKIITIDS | |
| MESGGISKM | | MESGGISKM | | NEEALRQKIM | | NPNQKIITIGS | |
| MESIKNGTY | | MESIKNGTY | | NEEGDIIFLW | | NPNQKIITMGS | |
| MESIRNGTY | | MESIRNGTY | | NEEGTGIAAD | | NPNQKILCASA | |
| MESIRNNTY | | MESIRNNTY | | NEEGTGVAAD | | NPNQKILCTSA | |
| MESRGLFGA | | MESRGLFGA | | NEEPLRQILR | | NPNQKILFASA | |
| MESVKNGTY | | MESVKNGTY | | NEERGNPGVK | | NPNQKIMCISA | |
| MESVRNGTY | | MESVRNGTY | | NEERGSPGVK | | NPNQKITCISA | |
| METERTLDF | | METERTLDF | | NEESLRQIIR | | NPNQKLFALSE | |
| METIKNGTY | | METIKNGTY | | NEESLRQILR | | NPNQKLFALSG | |
| METIRNGTY | | METIRNGTY | | NEFNEIEQQI | | NPNQKLFASSG | |
| METTRNGTY | | METTRNGTY | | NEFNEVEQQI | | NPNQKLFTLSG | |
| MEVCFMYSD | | MEVCFMYSD | | NEFNKACELT | | NPNQKTITIGS | |
| MEVVFPNEV | | MEVVFPNEV | | NEFSEIEQQI | | NPNQMIITIGS | |
| MEWIKTRPI | | MEWIKTRPI | | NEFTEIEQQI | | NPNQRILCTSA | |
| MEWLKTRPI | | MEWLKTRPI | | NEFTEVEKQI | | NPNQSIITIGS | |
| MEYDAVATT | | MEYDAVATT | | NEFTEVEQQI | | NPNWSGYSGAF | |
| MFALSQGTT | | MFALSQGTT | | NEGALRQKIM | | NPNWSGYSGSF | |
| MFDFIKWNV | | MFDFIKWNV | | NEGHIEECSC | | NPRIFLAMITY | |
| MFDFSKWNV | | MFDFSKWNV | | NEGIMNTSKP | | NPRMFLAMITY | |
| MFDFTKWNV | | MFDFTKWNV | | NEGKVECICR | | NPRVFLAMITY | |
| MFESNGGLI | | MFESNGGLI | | NEGKVECVCR | | NPRVFLTMITY | |
| MFESNGGLL | | MFESNGGLL | | NEGNGCFELL | | NPSAGKDPKKT | |
| MFLAMITYI | | MFLAMITYI | | NEGSYFFGDN | | NPSCASNINIR | |
| MFLYIRTNG | | MFLYIRTNG | | NEGSYFFGDS | | NPSCATNINIR | |
| MFLYVRTNG | | MFLYVRTNG | | NEGVINTSKP | | NPSHEGEGIPL | |
| MFNMLSTVL | | MFNMLSTVL | | NEGVMNTSKP | | NPSLRMKWMMA | |
| MFSNKMARL | | MFSNKMARL | | NEHSNGTIHD | | NPSQKLFALSG | |
| MFSNKVARL | | MFSNKVARL | | NEHSNGTTHD | | NPTEEQAVDIC | |
| MGAINSSMP | | MGAINSSMP | | NEIEHQIGNV | | NPTEEQAVEIC | |
| MGARPQVNG | | MGARPQVNG | | NEIEQQIGNV | | NPTEEQAVGIC | |
| MGAVNSSMP | | MGAVNSSMP | | NEIEYQIGNV | | NPTEEQAVNIC | |

Fig. 83-243

| Block size 8 | SIN | Block size 9 | SIN | Block size 10 | SIN | Block size 11 | SIN |
|---|---|---|---|---|---|---|---|
| MGEAMVSRA | | MGEAMVSRA | | NEIKGVELSS | | NPVHKSQLIWM | |
| MGECPEYVK | | MGECPEYVK | | NEIKGVKLSN | | NPVHKSQLVWM | |
| MGECPKYAK | | MGECPKYAK | | NEIKGVKLSS | | NPVICLGHHAV | |
| MGECPKYVK | | MGECPKYVK | | NEIRASVGRM | | NPVICLGHHSV | |
| MGECPKYVR | | MGECPKYVR | | NEITTKINNI | | NPVICMGHHAV | |
| MGECPNYVK | | MGECPNYVK | | NEKFHQIEKE | | NPVKLSGGYKD | |
| MGFRYSGIK | | MGFRYSGIK | | NEKGNPGVKG | | NPVKLSSGYKD | |
| MGFRYSGIR | | MGFRYSGIR | | NEKGNQGVKG | | NPVRLSSGYKD | |
| MGFTYSGIR | | MGFTYSGIR | | NEKKAKLANV | | NPVTLSSGYKD | |
| MGFTYTGVR | | MGFTYTGVR | | NEKPFQNVNK | | NPVTLTMGYKD | |
| MGIYQILAI | | MGIYQILAI | | NEKTLDLHDS | | NPYTLVSTKEW | |
| MGKCNTKCQ | | MGKCNTKCQ | | NEKYHQIEKE | | NQCMESIRNNT | |
| MGKVECVCR | | MGKVECVCR | | NELGIPFHLG | | NQDSFYRSMKW | |
| MGLAPSPYN | | MGLAPSPYN | | NELGNGCFEF | | NQDWSGYSGAF | |
| MGLFFFCLK | | MGLFFFCLK | | NELGVPFHLA | | NQEELKSLFSS | |
| MGLIFMCVK | | MGLIFMCVK | | NELGVPFHLG | | NQEELRFLFSS | |
| MGLIYNRMG | | MGLIYNRMG | | NELGVPFHMG | | NQEELRSLFSS | |
| MGLKISSSF | | MGLKISSSF | | NELGVPFYLG | | NQEYTSGRQEK | |
| MGLQMQRFK | | MGLQMQRFK | | NELGVSFHLG | | NQFALGQGTTL | |
| MGLRISSSF | | MGLRISSSF | | NELYGTQSLS | | NQGSFYRNMRW | |
| MGLVFFCLK | | MGLVFFCLK | | NEMTLDFHDS | | NQGSFYRSIRW | |
| MGLVFFCLR | | MGLVFFCLR | | NENATATVYY | | NQGSFYRSMRW | |
| MGLVFICIK | | MGLVFICIK | | NENGDIIFLW | | NQHIIDLADSE | |
| MGLVFICMK | | MGLVFICMK | | NENPAHKSQL | | NQHTIDLADSE | |
| MGLVFICVK | | MGLVFICVK | | NENPVHKSQL | | NQHTIDLAESE | |
| MGLVFMCVK | | MGLVFMCVK | | NENQNPRIFL | | NQHTIDLTDAE | |
| MGMAADKES | | MGMAADKES | | NENQNPRMFL | | NQHTIDLTDSE | |
| MGMFNMLST | | MGMFNMLST | | NENQNPRVFL | | NQHTIDMADSE | |
| MGNGCFEFY | | MGNGCFEFY | | NEPGSGDWPD | | NQHTIDMADST | |
| MGNGCFKIY | | MGNGCFKIY | | NEPGSGNWPD | | NQHTIDMTDSE | |
| MGNGCFRIY | | MGNGCFRIY | | NEPNGYAQTD | | NQHTIDSTDSE | |
| MGNGCFTIY | | MGNGCFTIY | | NEPSGYAQTD | | NQHTIDVADSE | |
| MGNGCLKIY | | MGNGCLKIY | | NEPTGYAQTD | | NQHTIDVTDSE | |
| MGQAADLKS | | MGQAADLKS | | NEPYPGNNNN | | NQHTIEMTDSE | |
| MGQAPSPYN | | MGQAPSPYN | | NEQAAEAMEV | | NQHTIHLTDSE | |
| MGQAPSPYT | | MGQAPSPYT | | NEQGMGMAAD | | NQITGKLNRII | |
| MGQCGLLGT | | MGQCGLLGT | | NEQGSGFAAD | | NQITGKLNRLI | |
| MGQQGRMDY | | MGQQGRMDY | | NEQGSGYAAD | | NQKIITIGFVS | |
| MGRTISKDS | | MGRTISKDS | | NEQGSGYAAN | | NQKIITIGSAS | |
| MGRTISMDS | | MGRTISMDS | | NEQGTGIAAD | | NQKIITIGSIS | |
| MGRTISRDS | | MGRTISRDS | | NEQGTGIAAE | | NQKIITIGSVS | |
| MGSIRNNTY | | MGSIRNNTY | | NEQGVGIAAD | | NQKIITMGSVS | |
| MGSSPNAYQ | | MGSSPNAYQ | | NEQGVGMAAD | | NQKILCASATA | |
| MGTAPVLGN | | MGTAPVLGN | | NEQGYGYAAD | | NQKILCTSAIA | |
| MGTIRNGTY | | MGTIRNGTY | | NEQTDLYKVA | | NQKILCTSATA | |
| MGVAPSPSN | | MGVAPSPSN | | NERGLFGAIA | | NQKILDEHDSN | |
| MGVDEYSNA | | MGVDEYSNA | | NERGNPGVKG | | NQKILFASATA | |
| MGVDEYSSA | | MGVDEYSSA | | NERGNQGVKG | | NQKIMTIGSVS | |
| MGVDEYSST | | MGVDEYSST | | NERGTQGVKG | | NQKLFALSGVA | |
| MGVQIQRFK | | MGVQIQRFK | | NERGYPGVKG | | NQKLFASSGIA | |
| MGVQLQRFK | | MGVQLQRFK | | NERTIWTSGS | | NQKLFTLSGVA | |
| MGVQMHRFK | | MGVQMHRFK | | NERTLDFHDF | | NQKTITIGSVS | |
| MGVQMQRFK | | MGVQMQRFK | | NERTLDFHDL | | NQKTLDEHDAN | |
| MGVYQILAI | | MGVYQILAI | | NERTLDFHDS | | NQKTLDEHDSN | |
| MGVYQILVI | | MGVYQILVI | | NERTLDLHDA | | NQKTLDKHDSN | |
| MGYICSGIF | | MGYICSGIF | | NERTLDLHDS | | NQNNTTVVENK | |
| MGYICSGVF | | MGYICSGVF | | NERTLDMHDA | | NQNNTTVVENT | |
| MGYKDIILW | | MGYKDIILW | | NERTLDMHDV | | NQNPRIFLAMI | |
| MHDANVKNL | | MHDANVKNL | | NERTLDQHDA | | NQNPRMFLAMI | |
| MHDANVRNL | | MHDANVRNL | | NERTLDYHDF | | NQNPRVFLAMI | |
| MHDRSPFRA | | MHDRSPFRA | | NERTLDYHDS | | NQNPRVFLTMI | |
| MHDRTKIRQ | | MHDRTKIRQ | | NERTLGFHDS | | NQNQNPRMFLA | |

Fig. 83-244

| Block size 8 | SIN | Block size 9 | SIN | Block size 10 | SIN | Block size 11 | SIN |
|---|---|---|---|---|---|---|---|
| MHQLLRHFQ | | MHQLLRHFQ | | NERTLYFHDS | | NQNSTWVSQTY | |
| MIADRVDDA | | MIADRVDDA | | NESADMSIGI | | NQNTIDLTDSE | |
| MIALILVAL | | MIALILVAL | | NESADMSIGV | | NQNWSGYSGAF | |
| MIDGWYGFH | | MIDGWYGFH | | NESGRLIDFL | | NQNWSGYSGSF | |
| MIDGWYGFR | | MIDGWYGFR | | NESGRLMDFL | | NQPAATALANT | |
| MIDGWYGYH | | MIDGWYGYH | | NETFVNMTHV | | NQQFELIDNEF | |
| MIEAESSIK | | MIEAESSIK | | NETFVNVTHV | | NQQFELIDNKF | |
| MIEAESSVK | | MIEAESSVK | | NETFVNVTNV | | NQQFELIDSEF | |
| MIEAESSVR | | MIEAESSVR | | NETIIETGYV | | NQQFELIGNEF | |
| MIICIQGNN | | MIICIQGNN | | NETILETGYI | | NQQFELINNEF | |
| MIIGGFIFG | | MIIGGFIFG | | NETILETGYV | | NQQFEMIDNEF | |
| MIKAVRGDL | | MIKAVRGDL | | NETIVETGYV | | NQQFGLIDNEF | |
| MIKRGINDR | | MIKRGINDR | | NEVEQQIGNV | | NQQFKLIDNEF | |
| MIKRGVNDR | | MIKRGVNDR | | NEVGAKILTS | | NQRGILEDEQM | |
| MILSVVSLL | | MILSVVSLL | | NEVGARIITS | | NQRLNPMHQLL | |
| MINDKIDDQ | | MINDKIDDQ | | NEVGARILTS | | NQRLNTMHQLL | |
| MINDKINDQ | | MINDKINDQ | | NEVKLEENTT | | NQSGRISIYWT | |
| MINNDLGPA | | MINNDLGPA | | NEWSGYSGSF | | NQSPRMFLAMI | |
| MINPVKLSG | | MINPVKLSG | | NFDSNGNFIA | | NQTKKMTITFL | |
| MINPVKLSS | | MINPVKLSS | | NFEGWIVGNP | | NQTKTMTITFL | |
| MINSKIDDQ | | MINSKIDDQ | | NFEKEGYSLV | | NQTLVSNNDWS | |
| MINSKIEDQ | | MINSKIEDQ | | NFESNGNFIA | | NQTYRNNRKEP | |
| MINSKINDQ | | MINSKINDQ | | NFESNGNFIT | | NQTYRNTRKEP | |
| MINSQIDDQ | | MINSQIDDQ | | NFESNGNLIA | | NQVEKRINMIA | |
| MIQLIVSGR | | MIQLIVSGR | | NFESTGNLIA | | NQVEKRINMLA | |
| MIRGKPEEG | | MIRGKPEEG | | NFESTGNLVA | | NQVENRINMLA | |
| MIRGKPEER | | MIRGKPEER | | NFFHKCNDSC | | NQVEQRINMLA | |
| MIRGKPKER | | MIRGKPKER | | NFHYEECSCY | | NQVFPQLNQTY | |
| MIRGQPKEK | | MIRGQPKEK | | NFIAPENAYK | | NRANQRLNPMH | |
| MIRGQPNER | | MIRGQPNER | | NFIAPEYAFK | | NRANQRLNTMH | |
| MIRGRPEER | | MIRGRPEER | | NFIAPEYAYI | | NRCFYVELIRG | |
| MISDKIDDQ | | MISDKIDDQ | | NFIAPEYAYK | | NRCFYVELVRG | |
| MISKCKTKE | | MISKCKTKE | | NFIAPEYAYR | | NRCYQFALGQQ | |
| MISKCRTKE | | MISKCRTKE | | NFITPEYAYK | | NRDITIGSICM | |
| MISKCRTRE | | MISKCRTRE | | NFKPNIGPRP | | NREFEVMNHEF | |
| MISKSRTKE | | MISKSRTKE | | NFLSMEFSLT | | NREFEVVDHEF | |
| MISPLAVTW | | MISPLAVTW | | NFPQTANTYR | | NREFEVVNHEF | |
| MISRARIDA | | MISRARIDA | | NFPQTTNTYR | | NREFGVVNHEF | |
| MITDTIKSW | | MITDTIKSW | | NFPRTTNTYR | | NRFIEKTNQQF | |
| MITQRTIGK | | MITQRTIGK | | NFQPNIGPRP | | NRFYRTCKLLG | |
| MIWDANGWV | | MIWDANGWV | | NFSFNGAFIA | | NRFYRTCKLVG | |
| MIWDPDGWT | | MIWDPDGWT | | NFSMELPSFG | | NRGLFGAIAGF | |
| MIWDPNGWT | | MIWDPNGWT | | NFVIEKMNTQ | | NRGLFGAKAGF | |
| MIWHSNLND | | MIWHSNLND | | NFVNRANQRL | | NRGSFYRSMRW | |
| MKDRSPYRT | | MKDRSPYRT | | NFVPVIGARP | | NRHSNGTIHDR | |
| MKGVYINTA | | MKGVYINTA | | NFVPVMGARP | | NRIFQPNIGPR | |
| MKGVYMNTA | | MKGVYMNTA | | NFVPVVGARP | | NRIFRPNIGPR | |
| MKGVYVNTA | | MKGVYVNTA | | NFVPVVRARP | | NRIIEKTNQQF | |
| MKHTSQYIC | | MKHTSQYIC | | NFVRQCFNPM | | NRIKINPVTLT | |
| MKHTSQYLC | | MKHTSQYLC | | NFVSMEFSLT | | NRIMINPVKLS | |
| MKIIRVGCV | | MKIIRVGCV | | NFWRGDNGRR | | NRINMLADRID | |
| MKIYWHLMH | | MKIYWHLMH | | NFWRGENGRK | | NRIQIDPVKLS | |
| MKKFIILST | | MKKFIILST | | NFWRGENGRR | | NRIQIDQVKLS | |
| MKKLYERVR | | MKKLYERVR | | NFYYEECSCY | | NRIQIDSVKLS | |
| MKLYWHLMH | | MKLYWHLMH | | NGAFIAPDRA | | NRKEPALIVWG | |
| MKLYWHLMR | | MKLYWHLMR | | NGAFIAPDRV | | NRKEYEEEAKL | |
| MKLYWHLMS | | MKLYWHLMS | | NGAFIAPNRA | | NRKMEDGFLDV | |
| MKNGNMQCT | | MKNGNMQCT | | NGAFVAPDRV | | NRLIDKTNQQF | |
| MKNVPEIPK | | MKNVPEIPK | | NGAKVNTLTE | | NRLIDRTNHQF | |
| MKNVPEIPR | | MKNVPEIPR | | NGALGSPGCD | | NRLIEKTNDKY | |
| MKNVPEKIH | | MKNVPEKIH | | NGAVAVLKYK | | NRLIEKTNEKY | |
| MKNVPEKIR | | MKNVPEKIR | | NGAVAVLKYN | | NRLIEKTNKQF | |

Fig. 83-245

| Block size 8 | SIN | Block size 9 | SIN | Block size 10 | SIN | Block size 11 | SIN |
|---|---|---|---|---|---|---|---|
| MKNVPETPK | | MKNVPETPK | | NGAWIGRTKS | | NRLIEKTNQQF | |
| MKRKRDSSI | | MKRKRDSSI | | NGCFDILHKC | | NRLIEKTNTEF | |
| MKRKRNSSI | | MKRKRNSSI | | NGCFEFWHKC | | NRLIEKTNTQF | |
| MKSRGYKMN | | MKSRGYKMN | | NGCFEFYHKC | | NRLIERTNEKY | |
| MKTIIIVLS | | MKTIIIVLS | | NGCFEFYHRC | | NRLIERTNQQF | |
| MKWGMELRR | | MKWGMELRR | | NGCFEIFHKC | | NRLIGKTNQQF | |
| MKWGMEMRR | | MKWGMEMRR | | NGCFEIFHQC | | NRLISKTNQQF | |
| MKWLLSNAD | | MKWLLSNAD | | NGCFEIFHRC | | NRLNINPVKLS | |
| MKWLLSNND | | MKWLLSNND | | NGCFELLHKC | | NRLNINPVTLS | |
| MKWLLSNSD | | MKWLLSNSD | | NGCFELYHKC | | NRLNINSVKLS | |
| MKWLLSNTD | | MKWLLSNTD | | NGCFKIYHKC | | NRLNNVIDKMN | |
| MKWLLSSKA | | MKWLLSSKA | | NGCFPFYHKC | | NRLSINPVKLS | |
| MKWLLSSKD | | MKWLLSSKD | | NGCFTFYHKC | | NRMVIASTTAK | |
| MKWLLSSSD | | MKWLLSSSD | | NGCFTIYHKC | | NRMVLASTTAK | |
| MKWLLSSTD | | MKWLLSSTD | | NGCIEGKLSQ | | NRNEIKGVKLS | |
| MKWLSSSGN | | MKWLSSSGN | | NGCIESKLSQ | | NRNFKPNIGPR | |
| MKWLSSSMN | | MKWLSSSMN | | NGCLKIYHKC | | NRNFQPNIGPR | |
| MKWLTLKSG | | MKWLTLKSG | | NGDDVWMGRT | | NRNQPAATALA | |
| MKWMMAMKY | | MKWMMAMKY | | NGDGCFEILH | | NRNWSGYSGSF | |
| MKWMMAMRY | | MKWMMAMRY | | NGDIIFLWGI | | NRPWIRFNSDL | |
| MLADRIDDA | | MLADRIDDA | | NGDPNNMDKA | | NRPWIRFNSDP | |
| MLADRVDDA | | MLADRVDDA | | NGDPNNMDRA | | NRPWIRFNSNL | |
| MLADWVDDA | | MLADWVDDA | | NGDPSNMDRA | | NRPWIRINNET | |
| MLATGMKNV | | MLATGMKNV | | NGDYARLYIW | | NRPWISFDQNL | |
| MLATGMRNI | | MLATGMRNI | | NGDYTRLYIW | | NRPWMRINNET | |
| MLATGMRNV | | MLATGMRNV | | NGEALRQILR | | NRPWMRISNET | |
| MLERELVRK | | MLERELVRK | | NGELRHLFSG | | NRPWVRINNET | |
| MLFVQSYFQ | | MLFVQSYFQ | | NGEPGVKGFG | | NRPWVRMNNET | |
| MLGFVFTLT | | MLGFVFTLT | | NGEQILIIWG | | NRPWVSFDQNL | |
| MLKIHNAGT | | MLKIHNAGT | | NGFCFTVMTD | | NRPWVSFNHNL | |
| MLKIPNAET | | MLKIPNAET | | NGFEMLKIPN | | NRPWVSFNQDL | |
| MLKIPNAGI | | MLKIPNAGI | | NGFLDVWTYN | | NRPWVSFNQNL | |
| MLKIPNAGT | | MLKIPNAGT | | NGGFLAPRYG | | NRQEIEGARLD | |
| MLKMSLLTE | | MLKMSLLTE | | NGGHIEECSC | | NRQEIEGVKLD | |
| MLKPGETLN | | MLKPGETLN | | NGGLGVKGFG | | NRQEIEGVKLN | |
| MLKVPNAGT | | MLKVPNAGT | | NGGLIAPDRV | | NRQEIEGVRLD | |
| MLKVPNALI | | MLKVPNALI | | NGGLIAPNRV | | NRQEIGGVKLD | |
| MLKVPNALT | | MLKVPNALT | | NGGLIAPRYG | | NRRLTTTIKPW | |
| MLLAIAMGL | | MLLAIAMGL | | NGGLIAPSRV | | NRRLTTTIKTW | |
| MLLDPGDTV | | MLLDPGDTV | | NGGLLAPKYG | | NRSFKPNIGPR | |
| MLNASCAAM | | MLNASCAAM | | NGGLLAPRYG | | NRSFQPNIGPR | |
| MLNKSLCKI | | MLNKSLCKI | | NGGLVAPSRV | | NRSFRPNIGPR | |
| MLNKSLCKV | | MLNKSLCKV | | NGGPGVKGFG | | NRSGYSGIFSV | |
| MLNLYDRVR | | MLNLYDRVR | | NGGRIAPSRV | | NRSGYSGSFID | |
| MLNLYERVR | | MLNLYERVR | | NGICPVAFTD | | NRSILNTSQRG | |
| MLNPNDTIT | | MLNPNDTIT | | NGICPVVFTD | | NRSPYRALMSC | |
| MLNPNDTVI | | MLNPNDTVI | | NGICTVVMTD | | NRTFQNIDKNA | |
| MLNPNDTVT | | MLNPNDTVT | | NGICYPGILE | | NRTFQNIDRNA | |
| MLQSRTREI | | MLQSRTREI | | NGICYPGSLD | | NRTFQNVSPLW | |
| MLRIPNAGI | | MLRIPNAGI | | NGICYPGTLE | | NRTGTFEFTSF | |
| MLSKSLCKV | | MLSKSLCKV | | NGICYPGTLG | | NRTHQYSEKGK | |
| MLSLIMRTV | | MLSLIMRTV | | NGIITDTFKS | | NRTHQYSEKGR | |
| MLSTVLGVS | | MLSTVLGVS | | NGIITDTLKS | | NRTHQYSERGK | |
| MLTGNLQTL | | MLTGNLQTL | | NGIKVDTLTE | | NRTHQYSERGR | |
| MLWACQNGN | | MLWACQNGN | | NGIPPLELGD | | NRYLEEHPSAG | |
| MMAMKYPIT | | MMAMKYPIT | | NGIRIGSKGD | | NRYLEENPSAG | |
| MMAMRYPIT | | MMAMRYPIT | | NGIRIGSKGH | | NSADHRIYWIR | |
| MMDGWYGFR | | MMDGWYGFR | | NGIRIGSRGE | | NSADHRVYWIR | |
| MMDQVREGR | | MMDQVREGR | | NGIRIGSRGH | | NSAHHRVYWIR | |
| MMDQVRESR | | MMDQVRESR | | NGIRVGSRGH | | NSALGSPGCDH | |
| MMEAMVSRA | | MMEAMVSRA | | NGISPIHLGD | | NSCIESIRNGT | |
| MMGMFNMLS | | MMGMFNMLS | | NGISPVHLGD | | NSCMETIRNGT | |

Fig. 83-246

| Block size 8 | SIN | Block size 9 | SIN | Block size 10 | SIN | Block size 11 | SIN |
|---|---|---|---|---|---|---|---|
| MMIWHSNLN | | MMIWHSNLN | | NGKAPISLGD | | NSDFICVGWSS | |
| MMKAVRGDL | | MMKAVRGDL | | NGKEPISLGD | | NSDFLCVGWSS | |
| MMMGMFNML | | MMMGMFNML | | NGKFEFIAED | | NSDFMCVGWSS | |
| MMSRARIDA | | MMSRARIDA | | NGKFEFIAEE | | NSDLDYQIGYI | |
| MMTHTSQYI | | MMTHTSQYI | | NGKFEFIVEK | | NSDLDYQIGYV | |
| MMTNSQDTE | | MMTNSQDTE | | NGKGRYGVKG | | NSDLEALMEWL | |
| MMTSSQDTE | | MMTSSQDTE | | NGKLCKLNGI | | NSDLNYQIGYI | |
| MMWEINGPD | | MMWEINGPD | | NGKLCRLRGI | | NSDVLVTREPY | |
| MMWEINGPE | | MMWEINGPE | | NGKLCRLSGI | | NSDWSGYSGSF | |
| MMWEVNGPE | | MMWEVNGPE | | NGKLEFIAEE | | NSEFICVGWSS | |
| MNELGIPFH | | MNELGIPFH | | NGKLNRLIEK | | NSEFLCVGWSS | |
| MNELGVPFH | | MNELGVPFH | | NGKLNRLIER | | NSEGIGQAADL | |
| MNELGVPFN | | MNELGVPFN | | NGKPFQNVNR | | NSEGMGQAADL | |
| MNELGVPFY | | MNELGVPFY | | NGKQPISLGD | | NSEGRGQAADL | |
| MNELGVPLH | | MNELGVPLH | | NGKSGACKRA | | NSEGTGIAADR | |
| MNELGVSFH | | MNELGVSFH | | NGKSLGIQSD | | NSEGTGIVADR | |
| MNGNYDSIR | | MNGNYDSIR | | NGKSSACKRA | | NSEGTGMAADQ | |
| MNGQSGRID | | MNGQSGRID | | NGKVECICRD | | NSEGTGQAADL | |
| MNIQFTAVG | | MNIQFTAVG | | NGKWREQLSQ | | NSEGTGQAGDL | |
| MNIQFTSVG | | MNIQFTSVG | | NGKYPVIKGD | | NSEGTGTAADL | |
| MNKLFERIR | | MNKLFERIR | | NGNCRFNVCI | | NSEMNKLYERV | |
| MNKLFERVK | | MNKLFERVK | | NGNDVWMGRT | | NSFEQITFIQA | |
| MNKLFERVR | | MNKLFERVR | | NGNFIAPENA | | NSFEQITFLQA | |
| MNKLYEKVR | | MNKLYEKVR | | NGNFIAPEYA | | NSFEQITFMQA | |
| MNKLYERVK | | MNKLYERVK | | NGNFITPEYA | | NSFFSRLNWLT | |
| MNKLYERVR | | MNKLYERVR | | NGNGCFELYH | | NSFLAHALKLV | |
| MNKRMEDGF | | MNKRMEDGF | | NGNGDPNNMD | | NSFLTHALRFL | |
| MNLLIGISN | | MNLLIGISN | | NGNGDPSNMD | | NSFSRTELINP | |
| MNNEGSYFF | | MNNEGSYFF | | NGNHAVHYCI | | NSFSRTELIPP | |
| MNNETILET | | MNNETILET | | NGNIRCQICI | | NSFSRTELISP | |
| MNNQVFPQL | | MNNQVFPQL | | NGNIRCTFCI | | NSFVPVVGARP | |
| MNPIKKIIT | | MNPIKKIIT | | NGNLIAPEFG | | NSFYAELKWLI | |
| MNPKSKLFT | | MNPKSKLFT | | NGNLIAPEYG | | NSFYAELKWLV | |
| MNPNKKIIT | | MNPNKKIIT | | NGNLIAPRGY | | NSGDYARLYIW | |
| MNPNQKIIA | | MNPNQKIIA | | NGNLIAPWYA | | NSGKVECVCRD | |
| MNPNQKIIC | | MNPNQKIIC | | NGNLRCQICI | | NSGYKDIILWF | |
| MNPNQKIIT | | MNPNQKIIT | | NGNLRCTICI | | NSHYEECSCYP | |
| MNPNQKILC | | MNPNQKILC | | NGNLVAPRGY | | NSIAVFCGTSG | |
| MNPNQKILF | | MNPNQKILF | | NGNLVAPWYA | | NSIGNLIAPRG | |
| MNPNQKIMC | | MNPNQKIMC | | NGNMQCTICI | | NSIIDKMNTQF | |
| MNPNQKIQC | | MNPNQKIQC | | NGNMRCTICI | | NSIIEKMNIQF | |
| MNPNQKITC | | MNPNQKITC | | NGNMRGTNWI | | NSIIEKMNTQF | |
| MNPNQKIVT | | MNPNQKIVT | | NGNVRCQICI | | NSIIGKMNTQF | |
| MNPNQKLFA | | MNPNQKLFA | | NGNVRCTFCI | | NSIINKMNTQF | |
| MNPNQKLFT | | MNPNQKLFT | | NGNYARLYIW | | NSIISMCSSTE | |
| MNPNQKTIT | | MNPNQKTIT | | NGNYDSIRGE | | NSIIVFCGTSG | |
| MNPNQRIIT | | MNPNQRIIT | | NGNYGPINVT | | NSIRIGSKGDI | |
| MNPNQSIIT | | MNPNQSIIT | | NGPDSVLVNT | | NSIRIGSKGDV | |
| MNPSQKLFA | | MNPSQKLFA | | NGPESVLINT | | NSIRIGSRGDV | |
| MNREFEVMN | | MNREFEVMN | | NGPESVLVNT | | NSIRLAAGGAI | |
| MNREFEVVD | | MNREFEVVD | | NGQAGRIDFH | | NSIRLAAGGDI | |
| MNREFEVVN | | MNREFEVVN | | NGQAGRMTFY | | NSIRLSADGDI | |
| MNREFGVVN | | MNREFGVVN | | NGQFGRIDFH | | NSIRLSAGGAI | |
| MNRLFERVR | | MNRLFERVR | | NGQFGRINFH | | NSIRLSAGGAV | |
| MNSVKNGTY | | MNSVKNGTY | | NGQGSGYAAD | | NSIRLSAGGDI | |
| MNSVKTGTY | | MNSVKTGTY | | NGQKSWMKIY | | NSIRLSAGGHI | |
| MNSVRNGTY | | MNSVRNGTY | | NGQKSWTKIY | | NSIRLSAGGNI | |
| MNTALLNAS | | MNTALLNAS | | NGQRGRIDFH | | NSIRLSASGDI | |
| MNTQFEAIG | | MNTQFEAIG | | NGQRSWMKIY | | NSIRVSAGGDI | |
| MNTQFEAVG | | MNTQFEAVG | | NGQSGRIDFH | | NSIVAFCGTSG | |
| MNTQFTAVG | | MNTQFTAVG | | NGQSGRIDFY | | NSIVALCGSKE | |
| MNTQFTSVG | | MNTQFTSVG | | NGQSGRIEFH | | NSIVALCGSKK | |

Fig. 83-247

| Block size 8 | SIN | Block size 9 | SIN | Block size 10 | SIN | Block size 11 | SIN |
|---|---|---|---|---|---|---|---|
| MNTQFTVVG | | MNTQFTVVG | | NGQSGRINFH | | NSIVALCGSRE | |
| MNTQIIVIL | | MNTQIIVIL | | NGQSGRIVFH | | NSIVSMCSSTE | |
| MNTRFEAVG | | MNTRFEAVG | | NGQTGRIDFH | | NSIVTFCGLBN | |
| MNTSKPFQN | | MNTSKPFQN | | NGREWSYIVE | | NSIVTFCGLDN | |
| MNTSKPLQN | | MNTSKPLQN | | NGRFEFIAEE | | NSIVTFCGLNN | |
| MNVKSLKLA | | MNVKSLKLA | | NGRLTTTIKT | | NSIVVFCGASG | |
| MNWSGYSGS | | MNWSGYSGS | | NGRSSFFRNV | | NSIVVFCGTPG | |
| MPASRYLTD | | MPASRYLTD | | NGRTLDLHDA | | NSIVVFCGTSA | |
| MPESMREEY | | MPESMREEY | | NGRTLDMHDA | | NSIVVFCGTSG | |
| MPFHNIHPL | | MPFHNIHPL | | NGRTLGLHDA | | NSIVVFWGTSG | |
| MPFHNVHPF | | MPFHNVHPF | | NGSCAVVMTD | | NSIWTSSSSTV | |
| MPFHNVHPL | | MPFHNVHPL | | NGSCFTIMTD | | NSIYASPQLEG | |
| MPLHNIHPL | | MPLHNIHPL | | NGSCFTLMTD | | NSKFESVAWSA | |
| MPTDVVRSW | | MPTDVVRSW | | NGSCFTVLTD | | NSLIALCGSPF | |
| MQALQLLFE | | MQALQLLFE | | NGSCFTVMTD | | NSLIALCGSPI | |
| MQALQLLLE | | MQALQLLLE | | NGSCRCMFCI | | NSLIALCGSPV | |
| MQCRICIGS | | MQCRICIGS | | NGSCRCTICI | | NSLKLAIGLRN | |
| MQFSSLAVN | | MQFSSLAVN | | NGSCRFNVCI | | NSLVALCGSPI | |
| MQFSSLTVN | | MQFSSLTVN | | NGSCTVVMTD | | NSLVALCGSPV | |
| MQFSSLTVS | | MQFSSLTVS | | NGSIPNDKPF | | NSLYASPQLEG | |
| MQGSTLPRR | | MQGSTLPRR | | NGSIPNEKPF | | NSLYASSQLEG | |
| MQIRGFVHF | | MQIRGFVHF | | NGSIPNGKPF | | NSLYSSPQLEG | |
| MQIRGFVYF | | MQIRGFVYF | | NGSIPNNKPF | | NSMVTFCGLDN | |
| MQLKDNAKE | | MQLKDNAKE | | NGSISNDKPF | | NSNAITRSGQN | |
| MQLRDNAKE | | MQLRDNAKE | | NGSLQCKICI | | NSNGVQDIIDN | |
| MQLRDNVKE | | MQLRDNVKE | | NGSLQCRICI | | NSNLDYQIGYV | |
| MQNGSCRCM | | MQNGSCRCM | | NGSLQCRVCI | | NSNNGVKGFSY | |
| MQNGSYRCM | | MQNGSYRCM | | NGSLQCTICI | | NSNWSGYSGIF | |
| MQNKLNNVI | | MQNKLNNVI | | NGSLRCRICI | | NSNWSGYSGSF | |
| MQNRIQIDP | | MQNRIQIDP | | NGSMQCKICI | | NSPLPFQNIDS | |
| MQNRLNNVI | | MQNRLNNVI | | NGSMQCNVCI | | NSQASYKIFKS | |
| MQRFRRPDS | | MQRFRRPDS | | NGSMQCRICI | | NSQGEGTAADY | |
| MRCTISLVK | | MRCTISLVK | | NGSMQCRVCI | | NSQGSGYAADK | |
| MRDILGTFD | | MRDILGTFD | | NGSYRCMFCI | | NSQGSGYAADR | |
| MRDVIGTFD | | MRDVIGTFD | | NGTAKHIEEC | | NSRFESVAWSA | |
| MRDVLGTFD | | MRDVLGTFD | | NGTCAVVMTD | | NSSCAAMDDFQ | |
| MREPFISCS | | MREPFISCS | | NGTCTVIMTD | | NSSDICYPGKF | |
| MRFTYSGIR | | MRFTYSGIR | | NGTCTVVMTD | | NSSDICYPGRF | |
| MRILIRGNS | | MRILIRGNS | | NGTCVVIMTD | | NSSDKVDTLLE | |
| MRILVRGNS | | MRILVRGNS | | NGTCVVVMTD | | NSSDTVDTLTE | |
| MRINNETIL | | MRINNETIL | | NGTIHDRAAF | | NSSEKVDTLLE | |
| MRISNETIL | | MRISNETIL | | NGTIHDRSPF | | NSSEKVNTLLE | |
| MRIWRQANN | | MRIWRQANN | | NGTIHDRSPY | | NSSERVDTLLE | |
| MRKKRGLFG | | MRKKRGLFG | | NGTIHDRSQF | | NSSILTDSQTA | |
| MRNIPEKPK | | MRNIPEKPK | | NGTIHDRSQY | | NSSKPFQNASR | |
| MRNIPEKQT | | MRNIPEKQT | | NGTIHDRTAF | | NSSKPFQNTSR | |
| MRNIPENPK | | MRNIPENPK | | NGTIHDRTTF | | NSSKPLQNASR | |
| MRNIPERQT | | MRNIPERQT | | NGTIIKTLTN | | NSSLTHALREL | |
| MRNIPGKQA | | MRNIPGKQA | | NGTIKDRSPY | | NSSMPFHNIHP | |
| MRNVPEKPK | | MRNVPEKPK | | NGTINDRSPF | | NSSMPFHNVHP | |
| MRNVPEKQT | | MRNVPEKQT | | NGTIVKTLTD | | NSSMPLHNIHP | |
| MRNVPENPK | | MRNVPENPK | | NGTIVKTLTN | | NSSRPFQNASR | |
| MRNVPERQT | | MRNVPERQT | | NGTIVKTLTS | | NSSYVCSGLVG | |
| MRNVPETQT | | MRNVPETQT | | NGTKINTLTE | | NSTCVVVMTDG | |
| MRPCFWVEL | | MRPCFWVEL | | NGTKVDTLTE | | NSTDKIDTLTE | |
| MRRCLLQSL | | MRRCLLQSL | | NGTKVDTLTG | | NSTDKVDTIIE | |
| MRTFSFQLI | | MRTFSFQLI | | NGTKVNTLTE | | NSTDKVDTLTE | |
| MRTPIAFLT | | MRTPIAFLT | | NGTMHDRSPF | | NSTDKVNTIIE | |
| MRTQESECA | | MRTQESECA | | NGTMKDRSPY | | NSTDTVDTILE | |
| MRTQESECV | | MRTQESECV | | NGTMVKTLAD | | NSTDTVDTLIE | |
| MRTQESSCT | | MRTQESSCT | | NGTMVKTLTD | | NSTDTVDTLLE | |
| MRWLTLKLG | | MRWLTLKLG | | NGTMVKTLTG | | NSTDTVDTLTE | |

Fig. 83-248

| Block size 8 | SIN | Block size 9 | SIN | Block size 10 | SIN | Block size 11 | SIN |
|---|---|---|---|---|---|---|---|
| MRWLTLKSE | | MRWLTLKSE | | NGTRVNTLTE | | NSTDTVDTVLE | |
| MRWLTLKSG | | MRWLTLKSG | | NGTSKIKMKW | | NSTDTVDTVRE | |
| MSCFVFVAL | | MSCFVFVAL | | NGTSKVKMKW | | NSTDTVNTLIE | |
| MSCHIGVAP | | MSCHIGVAP | | NGTSVKTLTD | | NSTDTVNTLME | |
| MSCPIGEAP | | MSCPIGEAP | | NGTTGNPIIC | | NSTDTVNTLTE | |
| MSCPIGEVP | | MSCPIGEVP | | NGTTHDRTAF | | NSTEKVDTIIE | |
| MSCPIGVAP | | MSCPIGVAP | | NGTVKDRSPF | | NSTEKVDTLLE | |
| MSCPLGEAP | | MSCPLGEAP | | NGTVKDRSPY | | NSTERVDTIIE | |
| MSCPMGVAP | | MSCPMGVAP | | NGTVVKTLTD | | NSTETVNTLIE | |
| MSCPVGEAP | | MSCPVGEAP | | NGTWAVVMTD | | NSTETVNTLSE | |
| MSCPVGVAP | | MSCPVGVAP | | NGTYDHKDFE | | NSTETVNTLTE | |
| MSDIEAMAS | | MSDIEAMAS | | NGTYDHKDYE | | NSTNTVNTLIE | |
| MSDIEAMAT | | MSDIEAMAT | | NGTYDHKEFE | | NSTTHDRTAFR | |
| MSDIGAMAS | | MSDIGAMAS | | NGTYDHKEYE | | NSTVVNNITTT | |
| MSDINIMAS | | MSDINIMAS | | NGTYDHNIYR | | NSTYKILSIYS | |
| MSDSIKSWR | | MSDSIKSWR | | NGTYDYIKYE | | NSVIEKMNIQF | |
| MSELGVPFH | | MSELGVPFH | | NGTYDYKYE | | NSVIEKMNTQF | |
| MSELGVPFN | | MSELGVPFN | | NGTYDYPKYQ | | NSVKLSSGYKD | |
| MSFQGRGVF | | MSFQGRGVF | | NGTYDYPKYS | | NSVRIGSKGDV | |
| MSGPNDNAS | | MSGPNDNAS | | NGTYDYSKYE | | NSVRLSAGGDI | |
| MSGPNNNAS | | MSGPNNNAS | | NGTYKYPKYQ | | NSVRLSASGDI | |
| MSGYSGIFS | | MSGYSGIFS | | NGTYNHEDYK | | NSVVEKMNTQF | |
| MSICISGPN | | MSICISGPN | | NGTYNHEDYR | | NSVVVFCGTSG | |
| MSICMSGPN | | MSICMSGPN | | NGTYNHKDYE | | NSWHIFGKDNA | |
| MSICVSGPN | | MSICVSGPN | | NGTYNHKEYE | | NSWHIFSKDNA | |
| MSIGITVIK | | MSIGITVIK | | NGTYNRKEYE | | NSWHILSKDNA | |
| MSIGVTVIK | | MSIGVTVIK | | NGTYNYPKYE | | NSWHIYGKDNA | |
| MSIGVTVIR | | MSIGVTVIR | | NGTYNYPKYH | | NSWLGRTISKD | |
| MSKEGSYFF | | MSKEGSYFF | | NGTYNYPKYQ | | NSWLGRTTSKD | |
| MSKKKSYIN | | MSKKKSYIN | | NGTYNYPKYS | | NSWSGYSGIFS | |
| MSKLYERVK | | MSKLYERVK | | NGTYYYPKYE | | NSWSYIVEKPN | |
| MSKLYERVR | | MSKLYERVR | | NGVCPVVFTD | | NTALLNASCAA | |
| MSKRKSYIN | | MSKRKSYIN | | NGVILEENTT | | NTALSTIALLI | |
| MSLLTEVET | | MSLLTEVET | | NGVITDTLKS | | NTAMLNASCAA | |
| MSLNISLYS | | MSLNISLYS | | NGVKGFAYLD | | NTASRSGYEML | |
| MSNEGSYFF | | MSNEGSYFF | | NGVKGFSYLD | | NTCIESIRNGT | |
| MSNNSTEKV | | MSNNSTEKV | | NGVKGFSYLN | | NTCMETIRNGT | |
| MSQSRTREI | | MSQSRTREI | | NGVKLEENST | | NTDLEALMEWI | |
| MSQSRTRGI | | MSQSRTRGI | | NGVKLEENTS | | NTDLEALMEWL | |
| MSRARIDAR | | MSRARIDAR | | NGVKLEENTT | | NTDLEVLMEWL | |
| MSSVKNGTY | | MSSVKNGTY | | NGVKVDGSSS | | NTDLGAPLELR | |
| MSTNAYDRI | | MSTNAYDRI | | NGVPVTSSID | | NTDLGSPLELR | |
| MSTPLGTPP | | MSTPLGTPP | | NGVPVTSSVD | | NTDLGTPLELR | |
| MSVCISGPN | | MSVCISGPN | | NGVQDIIDND | | NTDWSGYSGSF | |
| MSVCMSGPN | | MSVCMSGPN | | NGVQDIIDNN | | NTEFESIESEF | |
| MSVLLGSSP | | MSVLLGSSP | | NGVRIGSKGD | | NTELLVLMENE | |
| MSVPLGSSP | | MSVPLGSSP | | NGVRLEENTT | | NTEPLCDVSGF | |
| MSVPLGSSS | | MSVPLGSSS | | NGVSPIHLGD | | NTEPLCEVSGF | |
| MTDGNASGK | | MTDGNASGK | | NGVSPVHLGD | | NTEPLCNVSGF | |
| MTDGPANKQ | | MTDGPANKQ | | NGVTNKVNSI | | NTFGDCPKYVN | |
| MTDGPANNQ | | MTDGPANNQ | | NGVWIGRTKN | | NTGSYVRLYLW | |
| MTDGPANRQ | | MTDGPANRQ | | NGVWIGRTKS | | NTIDLTDSEMN | |
| MTDGPANSQ | | MTDGPANSQ | | NGVWMGRTKS | | NTIGDCPKYMN | |
| MTDGPASNQ | | MTDGPASNQ | | NGWEGLIDGW | | NTIGDCPKYVN | |
| MTDGPASSQ | | MTDGPASSQ | | NGWEGLINGW | | NTIGNCPKYVN | |
| MTDGPSDAQ | | MTDGPSDAQ | | NGWEGLVDGW | | NTIGNLIAPRG | |
| MTDGSANSQ | | MTDGSANSQ | | NGWEGMIDGW | | NTIGNLVAPRG | |
| MTDGSASGK | | MTDGSASGK | | NGWEGMMDGW | | NTIIENNVTVT | |
| MTDGSASGQ | | MTDGSASGQ | | NGWEGMVDGW | | NTIIESNVTVT | |
| MTDGSASGR | | MTDGSASGR | | NGWEGMVNGW | | NTILEKNVTVT | |
| MTDGSASRK | | MTDGSASRK | | NGWQGLIDGW | | NTINRIFQPNI | |
| MTDGSASSQ | | MTDGSASSQ | | NGWVSTDKDS | | NTINRNFQPNI | |

Fig. 83-249

| Block size 8 | SIN | Block size 9 | SIN | Block size 10 | SIN | Block size 11 | SIN |
|---|---|---|---|---|---|---|---|
| MTDGSASSR | | MTDGSASSR | | NGWVSTDKNS | | NTINRSFQPNI | |
| MTDSEMLNL | | MTDSEMLNL | | NGWVTADKDS | | NTINRSFRPNI | |
| MTDSEMNKL | | MTDSEMNKL | | NGWYGFQHQN | | NTKCQTSLGGI | |
| MTDSIKSWR | | MTDSIKSWR | | NGWYGFQHRN | | NTKCQTSLGGV | |
| MTEIWSYNA | | MTEIWSYNA | | NGWYGFRHQN | | NTKCQTSMGGI | |
| MTEVWSYNA | | MTEVWSYNA | | NGYIEGKLSQ | | NTKCQTSMGGV | |
| MTFHGAKEV | | MTFHGAKEV | | NGYKDVILWF | | NTKCQTSVGGI | |
| MTHISKYLC | | MTHISKYLC | | NHEDYKEESQ | | NTKLPFQNLSP | |
| MTHMSKYLC | | MTHMSKYLC | | NHEDYREESQ | | NTKWNENQNPR | |
| MTHSSKYLC | | MTHSSKYLC | | NHEGEGIPLY | | NTLIEQNIPVT | |
| MTHTSKYLC | | MTHTSKYLC | | NHGICAVATT | | NTLIEQNVPVT | |
| MTHTSQYIC | | MTHTSQYIC | | NHGSLVLSLW | | NTLKLATGMRN | |
| MTHTSRYLC | | MTHTSRYLC | | NHGVKGWAFD | | NTLLENDVPVT | |
| MTIASDILK | | MTIASDILK | | NHKDYEEEAK | | NTLLKHRFEII | |
| MTIASDILT | | MTIASDILT | | NHKEYEEEAK | | NTLSEQNVPVT | |
| MTICIQGNN | | MTICIQGNN | | NHLIGKTNQQ | | NTLSSVNTNTI | |
| MTICVQGDN | | MTICVQGDN | | NHQFELIDNE | | NTLSSVTTNTI | |
| MTICVQGNN | | MTICVQGNN | | NHSMSDIEAM | | NTLTEKGIEVV | |
| MTKDAERGK | | MTKDAERGK | | NHSNGTIHDR | | NTLTEKGVEVV | |
| MTLDFHDSN | | MTLDFHDSN | | NHTDELCPSP | | NTLTEQNVPVT | |
| MTLSVVSLL | | MTLSVVSLL | | NHTEYRQEAL | | NTLTEREVEVV | |
| MTNVQNNYT | | MTNVQNNYT | | NHTGTYCSLN | | NTLTERGIEVV | |
| MTRGLFGAI | | MTRGLFGAI | | NHTTINNITN | | NTLTERGVEVV | |
| MTSIRNNTY | | MTSIRNNTY | | NHVEVVSAKE | | NTLTSVTTNTI | |
| MVAYMLERE | | MVAYMLERE | | NICEKLEQSG | | NTMHQLLRHFQ | |
| MVDGWYGFH | | MVDGWYGFH | | NICKPYIGKC | | NTMTKDAERGK | |
| MVDGWYGFR | | MVDGWYGFR | | NIDKNALGDC | | NTNGEQILIIW | |
| MVDGWYGYH | | MVDGWYGYH | | NIDKNALGEC | | NTNKTFQNIDR | |
| MVDQVRESR | | MVDQVRESR | | NIDRFLRVRD | | NTNKTFQNIEK | |
| MVDTILERN | | MVDTILERN | | NIDRNAIGDC | | NTNKTFQNIER | |
| MVEAESSVK | | MVEAESSVK | | NIDRNALGDC | | NTNRTFQNIDK | |
| MVEAMISRA | | MVEAMISRA | | NIDSRAVGKC | | NTNRTFQNIDR | |
| MVEAMMSRA | | MVEAMMSRA | | NIDSWAVGRC | | NTNTINRSFQP | |
| MVEAMVSRA | | MVEAMVSRA | | NIECVCRDNW | | NTNTLSSVTTN | |
| MVFSQEDCM | | MVFSQEDCM | | NIEKNALGDC | | NTPSIDPKGLF | |
| MVFSQEDCV | | MVFSQEDCV | | NIERNALGDC | | NTPSIEPKGLF | |
| MVFSQEECM | | MVFSQEECM | | NIERNALGNC | | NTPSIEPRGLF | |
| MVGLILAFI | | MVGLILAFI | | NIESNGNLIA | | NTPSVEPKGLF | |
| MVHAMRTIG | | MVHAMRTIG | | NIFNMERIKE | | NTPSVEPRGLF | |
| MVIASTTAK | | MVIASTTAK | | NIGLNVSLHL | | NTQFEAIGREF | |
| MVKAVRGDL | | MVKAVRGDL | | NIGPRALVRG | | NTQFEAVGKEF | |
| MVKRGINDR | | MVKRGINDR | | NIGPRPFVRG | | NTQFEAVGREF | |
| MVKSDKICL | | MVKSDKICL | | NIGPRPLIRG | | NTQFELIDNEF | |
| MVLASTTAK | | MVLASTTAK | | NIGPRPLVMG | | NTQFETVGKEF | |
| MVLSAFDER | | MVLSAFDER | | NIGPRPLVRE | | NTQFTAVGKEF | |
| MVNERTLDF | | MVNERTLDF | | NIGPRPLVRG | | NTQFTSVGKEF | |
| MVNGWYGFR | | MVNGWYGFR | | NIGSRPRVRN | | NTQFTVVGKEF | |
| MVQAMRAIG | | MVQAMRAIG | | NIHPLAIGEC | | NTQGEGTAADY | |
| MVQAMRAVG | | MVQAMRAVG | | NIHPLTIGEC | | NTQIIVILVLG | |
| MVQAMRTIG | | MVQAMRTIG | | NIHPLTIGKC | | NTRCQTSVGGI | |
| MVQAMRTVG | | MVQAMRTVG | | NIIDKMNGNY | | NTRKEPALIVW | |
| MVRSDKICL | | MVRSDKICL | | NIIEKMNGNY | | NTRLPFQNLSP | |
| MVSPLAITW | | MVSPLAITW | | NIIFLWGIHH | | NTSGEQMLIIW | |
| MVSPLAVTW | | MVSPLAVTW | | NIIFSHNGGL | | NTSGEQMLVIW | |
| MVSRARIDA | | MVSRARIDA | | NIKSLKLATG | | NTSGKQMLIIW | |
| MVTFCGLDN | | MVTFCGLDN | | NILEKTHNGK | | NTSKHYIGKCP | |
| MVTGLRNIP | | MVTGLRNIP | | NILEKTHNGR | | NTSKPFQNICK | |
| MVTQRTIGK | | MVTQRTIGK | | NILITQESEC | | NTSKPFQNTSK | |
| MVTQRTMGK | | MVTQRTMGK | | NILKGKFQTA | | NTSKPFQNTSR | |
| MVTQRTVGK | | MVTQRTVGK | | NILLSPEEVS | | NTSKPLQNTSK | |
| MVVYAELLV | | MVVYAELLV | | NILRSQESEC | | NTSQRGILEDE | |
| MVWDANGWV | | MVWDANGWV | | NILRTQDSEC | | NTSQRGVLEDE | |

Fig. 83-250

| Block size 8 | SIN | Block size 9 | SIN | Block size 10 | SIN | Block size 11 | SIN |
|---|---|---|---|---|---|---|---|
| MVWDPNGWT | | MVWDPNGWT | | NILRTQESEC | | NTSRHYIGKCP | |
| MWACNSGNC | | MWACNSGNC | | NILRTQESSC | | NTSRHYMGECP | |
| MWACQKGNI | | MWACQKGNI | | NILSIAPIMF | | NTSYKILSIYS | |
| MWACQRGNI | | MWACQRGNI | | NILSMAPIMF | | NTTGRDVLVIW | |
| MWACSNGNC | | MWACSNGNC | | NIMASQGTKR | | NTTGRDVLVLW | |
| MWACSNGSC | | MWACSNGSC | | NIMRTQESEC | | NTTGRDVLVMW | |
| MWACSSGNC | | MWACSSGNC | | NINFMPYISF | | NTTLIENTYVN | |
| MWAIHHPPT | | MWAIHHPPT | | NINIREWSYL | | NTTLPFHNIHP | |
| MWALGENMA | | MWALGENMA | | NINPVKLSSG | | NTTLPFHNVHP | |
| MWDTLIERD | | MWDTLIERD | | NINPVTLSSG | | NTTLSTIALFI | |
| MWEINGPDS | | MWEINGPDS | | NINRITYGAC | | NTTLSTIALII | |
| MWEINGPES | | MWEINGPES | | NINSVKLSSG | | NTTLSTIALLI | |
| MWEVNGPES | | MWEVNGPES | | NIPGKQAKGL | | NTTNYYNETFV | |
| MWGIHHPSS | | MWGIHHPSS | | NIPQIESRGL | | NTTVVENTYVN | |
| MWSYNAELL | | MWSYNAELL | | NIPSIQSRGL | | NTTYKILSIYS | |
| MWTCNSGNC | | MWTCNSGNC | | NIPSVQSRGL | | NTTYRILSIYS | |
| MWTCQKGNI | | MWTCQKGNI | | NIPVTQTMEL | | NTVINNITTTI | |
| MYALHQGTT | | MYALHQGTT | | NIPVTQVEEL | | NTVKDRSPYRA | |
| MYQKCCNLF | | MYQKCCNLF | | NIQFTAVGKE | | NTVLSIIALLI | |
| MYQKCCSLF | | MYQKCCSLF | | NIQFTSVGKE | | NTVVNNITTTI | |
| MYQKCCTLF | | MYQKCCTLF | | NIREWSYLIE | | NTWARNILRTQ | |
| MYQRCCNLF | | MYQRCCNLF | | NIRIGSKGDV | | NTWLGGTISPR | |
| MYSDFHFID | | MYSDFHFID | | NIRNLHIPEA | | NTWLGRTISIA | |
| MYSDFHFIN | | MYSDFHFIN | | NIRNLHIPEV | | NTWLGRTISPH | |
| NAASYKRIR | | NAASYKRIR | | NIRNNTYDHS | | NTWLGRTISPK | |
| NADHRIYWI | | NADHRIYWI | | NITAASLNDD | | NTWLGRTISPR | |
| NADHRVYWI | | NADHRVYWI | | NITEIVYLNH | | NTWLGRTISTA | |
| NADKICLGH | | NADKICLGH | | NITEIVYLNN | | NTWLGRTISTR | |
| NADLEALME | | NADLEALME | | NITEIVYLNS | | NTWLGRTLNTA | |
| NADLLVAME | | NADLLVAME | | NITFLHNGGL | | NTWLGRTTSTA | |
| NADVLVALE | | NADVLVALE | | NITFSHNGGL | | NTYDHAQYREE | |
| NAEDIGNGC | | NAEDIGNGC | | NITFSHNGGR | | NTYDHSHYREE | |
| NAEDKGNGC | | NAEDKGNGC | | NITKIVYLNS | | NTYDHSQYREE | |
| NAEDMGDGC | | NAEDMGDGC | | NITNVQNNYT | | NTYDHTQYREE | |
| NAEDMGGGC | | NAEDMGGGC | | NITVTHAKDI | | NTYNHTEYRQE | |
| NAEDMGNGC | | NAEDMGNGC | | NITVTHAQDI | | NTYNHTQYREE | |
| NAEDQGNGC | | NAEDQGNGC | | NITVTHSVEL | | NTYQWIIKNWE | |
| NAEDRGNGC | | NAEDRGNGC | | NITVTHSVNL | | NTYQWIIRNWE | |
| NAEEDCTGC | | NAEEDCTGC | | NITVTSSVEL | | NTYQWVIRNWE | |
| NAEEDGKGC | | NAEEDGKGC | | NIVDKMNREF | | NVEGWVVIAKD | |
| NAEEDGNGC | | NAEEDGNGC | | NIVRRAAVSA | | NVELLVLMENE | |
| NAEEDGRGC | | NAEEDGRGC | | NIVRRAIVSA | | NVENLFDEVRR | |
| NAEEDGTGC | | NAEEDGTGC | | NIVRRATVSA | | NVESNGNLIAP | |
| NAEEMGNGC | | NAEEMGNGC | | NIWAYNAELL | | NVESNGNLVAP | |
| NAEEYRRLR | | NAEEYRRLR | | NIWITREPYV | | NVGLNISLHLK | |
| NAEFLVALE | | NAEFLVALE | | NIWSYNAQLL | | NVGLNVSLHLK | |
| NAEFLVAME | | NAEFLVAME | | NIYKILSIYS | | NVGLNVSLHLR | |
| NAEFLVAVE | | NAEFLVAVE | | NIYRDEAINN | | NVGYLCAGIPT | |
| NAEGIGIAA | | NAEGIGIAA | | NKACELTDSI | | NVHPLAIGECP | |
| NAEGTGIAA | | NAEGTGIAA | | NKACELTDSS | | NVHPLTIGECP | |
| NAEGTGMAA | | NAEGTGMAA | | NKACELTDST | | NVHRNAIGDCP | |
| NAEGTGTAA | | NAEGTGTAA | | NKACELTDSV | | NVHRNTIGDCP | |
| NAEIEDLIF | | NAEIEDLIF | | NKACELTGSS | | NVHRNTIGNCP | |
| NAEIEDLTF | | NAEIEDLTF | | NKADHRIYWI | | NVHRSTIGDCP | |
| NAEILVALE | | NAEILVALE | | NKCIERVRNG | | NVINDKIDDQI | |
| NAEILVLME | | NAEILVLME | | NKCIESIRNG | | NVINWTKDSIT | |
| NAELFVLME | | NAELFVLME | | NKCMETIKNG | | NVINWTQDAMT | |
| NAELIVLLE | | NAELIVLLE | | NKCYQFALGQ | | NVINWTRDAMT | |
| NAELLIAME | | NAELLIAME | | NKDGDIIFLW | | NVINWTRDSII | |
| NAELLILLE | | NAELLILLE | | NKFAAICTHL | | NVINWTRDSIT | |
| NAELLVALE | | NAELLVALE | | NKFAAICTHM | | NVINWTRDSLT | |
| NAELLVAME | | NAELLVAME | | NKFASICTHL | | NVINWTRDSMT | |

Fig. 83-251

| Block size 8 | SIN | Block size 9 | SIN | Block size 10 | SIN | Block size 11 | SIN |
|---|---|---|---|---|---|---|---|
| NAELLVLIE | | NAELLVLIE | | NKHSNDTIHD | | NVINWTRDSVT | |
| NAELLVLLE | | NAELLVLLE | | NKHSNDTVHD | | NVKELGNGCFE | |
| NAELLVLLG | | NAELLVLLG | | NKHSNGTIHD | | NVKNLFDEVKR | |
| NAELLVLME | | NAELLVLME | | NKHSNGTKHD | | NVKNLFDEVRR | |
| NAEVLVLME | | NAEVLVLME | | NKHSNGTTHD | | NVKNLHDQIKR | |
| NAFRGLIST | | NAFRGLIST | | NKHSNSTTHD | | NVKNLHEQVKR | |
| NAGKDPKKT | | NAGKDPKKT | | NKHWSGYSGS | | NVKNLYDKVRL | |
| NAGLLVALE | | NAGLLVALE | | NKIEFEPFQS | | NVKNLYDRVRL | |
| NAHDRICIG | | NAHDRICIG | | NKIEGRVQDL | | NVKNLYEKVRL | |
| NAHILVTRE | | NAHILVTRE | | NKINNIVDKM | | NVKVTHRENLL | |
| NAIDAGDGC | | NAIDAGDGC | | NKINSIIDKM | | NVLDGVTASCL | |
| NAIDAGNGC | | NAIDAGNGC | | NKITNKVNNI | | NVLIGQGDIVL | |
| NAIDEGDGC | | NAIDEGDGC | | NKKIDDGFLD | | NVLIGQGDVVL | |
| NAIDEGNGC | | NAIDEGNGC | | NKKMEDGFLD | | NVLLKHRFEII | |
| NAIDNGDGC | | NAIDNGDGC | | NKKMEDGFLN | | NVLLSPEEVSE | |
| NAIDTGDGC | | NAIDTGDGC | | NKKVDDGFID | | NVLSIAPIMFS | |
| NAIDTGKGC | | NAIDTGKGC | | NKKVDDGFLD | | NVLSVAPIMFS | |
| NAIDTGNGC | | NAIDTGNGC | | NKKVDDGLLD | | NVNKITYGACP | |
| NAIGDCPKY | | NAIGDCPKY | | NKKYGPALSI | | NVNRITYGACP | |
| NAINEGNGC | | NAINEGNGC | | NKLAAICTHL | | NVNRITYGPCP | |
| NAIRFGEGE | | NAIRFGEGE | | NKLEFEPFQS | | NVNRITYGVCP | |
| NAIRFGESE | | NAIRFGESE | | NKLFERVRRQ | | NVPEKIHTRGL | |
| NAIRIGEDA | | NAIRIGEDA | | NKLITVGSSK | | NVPEKIRTRGL | |
| NAIRIGEDS | | NAIRIGEDS | | NKLNNVIDKM | | NVPEKIRVKRR | |
| NAIRIGEEA | | NAIRIGEEA | | NKLYEKVRRQ | | NVPEWSYIVEK | |
| NAIRIGEGA | | NAIRIGEGA | | NKLYERVKRQ | | NVPQAQDRGLF | |
| NAIRIGENA | | NAIRIGENA | | NKLYERVRKQ | | NVPQAQNRGLF | |
| NAIRIGENS | | NAIRIGENS | | NKLYERVRRQ | | NVPQIEARGLF | |
| NAIRIGGNS | | NAIRIGGNS | | NKLYGAGNKL | | NVPQIEPRGLF | |
| NAIRLGENK | | NAIRLGENK | | NKLYGTGNKL | | NVPQIESRGLF | |
| NAIRPGENK | | NAIRPGENK | | NKLYVNKNPY | | NVPQIQNRGLF | |
| NAISTTFPY | | NAISTTFPY | | NKMARLGKGY | | NVPQMESRGLF | |
| NAITRSGQN | | NAITRSGQN | | NKMARLGRGY | | NVPQVQDRGLF | |
| NAKDEGNGC | | NAKDEGNGC | | NKMEFEPFQS | | NVPQVQNRGLF | |
| NAKDLGNGC | | NAKDLGNGC | | NKNATATVYY | | NVPSIQSRGLF | |
| NAKEIGNGC | | NAKEIGNGC | | NKNEIKGVKL | | NVPSVQSRGLF | |
| NAKELGNGC | | NAKELGNGC | | NKNPYTLVST | | NVPVTQAMELV | |
| NAKEMGNGC | | NAKEMGNGC | | NKNWSGYSGA | | NVPVTQTMELV | |
| NAKETGNGC | | NAKETGNGC | | NKNWSGYSGS | | NVPQTQVEELV | |
| NAKEVGNGC | | NAKEVGNGC | | NKQASYKIFK | | NVRCVCRDNWK | |
| NAKLLVLIE | | NAKLLVLIE | | NKQFELIDNE | | NVRNLHDQIKR | |
| NAKLLVLLE | | NAKLLVLLE | | NKRYGPALSI | | NVRNLHDQVKR | |
| NALDTGDGC | | NALDTGDGC | | NKSLCKIEGW | | NVRNLHDRIRR | |
| NALGDCPKY | | NALGDCPKY | | NKSLCKVEEW | | NVRNLHDRTRR | |
| NALGECPKY | | NALGECPKY | | NKSLCKVEGW | | NVRNLHDRVKR | |
| NALGNCPKY | | NALGNCPKY | | NKSLCNVEGW | | NVRNLHDRVRR | |
| NALIDDRSK | | NALIDDRSK | | NKSLCSVEGW | | NVRNLHEQIKR | |
| NALLKHRFE | | NALLKHRFE | | NKTFQNIDKN | | NVRNLHERIRR | |
| NALNGNGDP | | NALNGNGDP | | NKTFQNIDRN | | NVRNLYDKVRL | |
| NALRLAENK | | NALRLAENK | | NKTFQNIEKN | | NVSEWSYIVEK | |
| NALSGNGDP | | NALSGNGDP | | NKTFQNIERN | | NVSRIAIGNCP | |
| NALSIAPIM | | NALSIAPIM | | NKTFQNISPV | | NVSSSGTSKAC | |
| NALTDDKSK | | NALTDDKSK | | NKTFQNVSPI | | NVSWTSNSIVT | |
| NALTDDRSK | | NALTDDRSK | | NKTFQNVSPL | | NVTETLYLNHT | |
| NALTDNRSK | | NALTDNRSK | | NKTFQNVSPV | | NVTHTGTSKAC | |
| NALTGGQSF | | NALTGGQSF | | NKTGTFEFTS | | NVTHVQNNYTT | |
| NALTNDRSK | | NALTNDRSK | | NKTKKMTITF | | NVTKENTGSYV | |
| NALYGTQSL | | NALYGTQSL | | NKTVINNITT | | NVTNVQNDYTT | |
| NAMDAGNGC | | NAMDAGNGC | | NKVARLGKGY | | NVTNVQNNYTT | |
| NANDLGNGC | | NANDLGNGC | | NKVCTKGKKA | | NVTRSGTSKAC | |
| NANTLSSVN | | NANTLSSVN | | NKVEFEPFQS | | NVTSSGTSKAC | |
| NANTLSSVT | | NANTLSSVT | | NKVKEIGNGC | | NVTVTHAKDIL | |

Fig. 83-252

| Block size 8 | SIN | Block size 9 | SIN | Block size 10 | SIN | Block size 11 | SIN |
|---|---|---|---|---|---|---|---|
| NANTLTSVT | | NANTLTSVT | | NKVNNIVDKM | | NVTVTHAKNIL | |
| NAPHKLCFP | | NAPHKLCFP | | NKVNSIIDKM | | NVTVTHAQDIL | |
| NAPHKLCYP | | NAPHKLCYP | | NKVNSIIEKM | | NVTVTHAQNIL | |
| NAPNKFCYP | | NAPNKFCYP | | NKVNSIINKM | | NVTVTHSIELL | |
| NAPNKLCFP | | NAPNKLCFP | | NKVNSVIEKM | | NVTVTHSINLL | |
| NAPNKLCYP | | NAPNKLCYP | | NKVNSVVEKM | | NVTVTHSVDLL | |
| NAPSGIEYN | | NAPSGIEYN | | NKVNTVIEKM | | NVTVTHSVELL | |
| NAPSGVEYN | | NAPSGVEYN | | NKVRMQLRDN | | NVTVTHSVNIL | |
| NAQAFYKIL | | NAQAFYKIL | | NKWGDILDGV | | NVTVTHSVNLF | |
| NAQGEGIAA | | NAQGEGIAA | | NKWGNVLDGV | | NVTVTHSVNLL | |
| NAQGEGTAA | | NAQGEGTAA | | NKWSGYSGSF | | NVTVTSSIELV | |
| NAQGIGQAA | | NAQGIGQAA | | NKYLEEHPNA | | NVTVTSSVELV | |
| NAQGQGTAA | | NAQGQGTAA | | NKYLEEHPSA | | NVTYTGISKAC | |
| NAQGSGYAA | | NAQGSGYAA | | NKYLEEHPST | | NVTYTGTSKAC | |
| NAQGTGLAA | | NAQGTGLAA | | NKYVNNTTII | | NVTYTGTSRAC | |
| NAQGTGQAA | | NAQGTGQAA | | NLAFNAVIHG | | NVVRKMMTNSH | |
| NAQHIEECS | | NAQHIEECS | | NLCRFLETRT | | NVVRKMMTNSQ | |
| NAQHVEECS | | NAQHVEECS | | NLDKKMEDGF | | NVVRKMMTSSQ | |
| NAQLLVLLE | | NAQLLVLLE | | NLDLNMGQPF | | NVWTYNAELLV | |
| NAQLLVWLE | | NAQLLVWLE | | NLDYQIGYVC | | NVYKALSIYSC | |
| NARELGNGC | | NARELGNGC | | NLEELRFVFS | | NVYKILSIYSC | |
| NARLLVLLE | | NARLLVLLE | | NLEKRLENLN | | NVYKVLAIYSC | |
| NASAIVWYN | | NASAIVWYN | | NLEKRLGNLN | | NVYKVLSIYSC | |
| NASAVIWYK | | NASAVIWYK | | NLERRLENLN | | NVYRALSIYSC | |
| NASAVIWYN | | NASAVIWYN | | NLERRLENLS | | NWFGYFGIFFV | |
| NASAVVWYN | | NASAVVWYN | | NLFDEVKRRL | | NWHASNRPWIS | |
| NASCAAMDD | | NASCAAMDD | | NLFDEVRRRL | | NWHASNRPWVS | |
| NASCAAMDE | | NASCAAMDE | | NLFEKFFPSS | | NWHGANRPWVS | |
| NASCAAMED | | NASCAAMED | | NLGIVECVCR | | NWHGSNRPWIS | |
| NASPVIWYN | | NASPVIWYN | | NLGKVECVCR | | NWHGSNRPWLS | |
| NASRHHMGE | | NASRHHMGE | | NLGLNIGLHL | | NWHGSNRPWVS | |
| NASRHYMGE | | NASRHYMGE | | NLGLNVGLHL | | NWIGTNRPVLV | |
| NASRYYMGE | | NASRYYMGE | | NLGQVECVCR | | NWILWISFAIS | |
| NASTGAQSF | | NASTGAQSF | | NLHAYISFRN | | NWKGANRPIIT | |
| NASTGGQAF | | NASTGGQAF | | NLHIPEAGLK | | NWKGANRPVII | |
| NASTGGQSF | | NASTGGQSF | | NLHIPEVCLK | | NWKGANRPVIT | |
| NASWFNSFL | | NASWFNSFL | | NLIAPEFGYL | | NWKGSNRPIID | |
| NATASFIYD | | NATASFIYD | | NLIAPEYGFK | | NWKGSNRPIVD | |
| NATASFIYE | | NATASFIYE | | NLIAPEYGFR | | NWKGSNRPVID | |
| NATASFIYG | | NATASFIYG | | NLIAPEYGHL | | NWKGSNRPVVD | |
| NATASFIYN | | NATASFIYN | | NLIAPEYGYL | | NWKGSNRPWIR | |
| NATASFVYD | | NATASFVYD | | NLIAPRGHYK | | NWKGSNRPWMR | |
| NATASLIYD | | NATASLIYD | | NLIAPRGHYR | | NWKGSNRPWVR | |
| NATASLIYN | | NATASLIYN | | NLIAPRGYFK | | NWLTIGISGPD | |
| NATATVYYD | | NATATVYYD | | NLIAPRGYFR | | NWLTKATNGNY | |
| NATATVYYN | | NATATVYYN | | NLIAPRGYYK | | NWLTKETNGNY | |
| NATDTVDTL | | NATDTVDTL | | NLIAPWYAFR | | NWLTKKEPDTY | |
| NATETVEIT | | NATETVEIT | | NLIAPWYAYK | | NWLTKKKNPEA | |
| NATETVENK | | NATETVENK | | NLIAPWYAYR | | NWLTKKKPDIY | |
| NATETVERT | | NATETVERT | | NLIFNTVIHE | | NWLTKKKPDTY | |
| NATETVESK | | NATETVESK | | NLIFNTVIHG | | NWPDGAEIEYF | |
| NATETVESR | | NATETVESR | | NLIGKTSWSY | | NWPDGAKIETL | |
| NATETVEST | | NATETVEST | | NLIIGISNVG | | NWPDGAKIEYF | |
| NATETVETA | | NATETVETA | | NLKLATGLRN | | NWPDGSDIGFM | |
| NATETVETT | | NATETVETT | | NLLENLQAYQ | | NWPDGSNIGFM | |
| NATETVETV | | NATETVETV | | NLLHKCNDSC | | NWPSSSGGLEW | |
| NAVDEGNGC | | NAVDEGNGC | | NLLIGISNIG | | NWQGANRPIIE | |
| NAVDTGDGC | | NAVDTGDGC | | NLLIGISNMS | | NWQGANRPVIE | |
| NAVDTGNGC | | NAVDTGNGC | | NLLIGISNVG | | NWQGANRPVIK | |
| NAVRFGESE | | NAVRFGESE | | NLLIGISNVV | | NWQGSNRPVIQ | |
| NAVRIGEDA | | NAVRIGEDA | | NLLIGVSNVG | | NWQGSNRPVIR | |
| NAVRIGEDS | | NAVRIGEDS | | NLNDATYQRT | | NWQGSNRPWIR | |

Fig. 83-253

| Block size 8 | SIN | Block size 9 | SIN | Block size 10 | SIN | Block size 11 | SIN |
|---|---|---|---|---|---|---|---|
| NAVRIGENS | | NAVRIGENS | | NLNDTTYQRT | | NWRGANRPVIT | |
| NAYDRICIG | | NAYDRICIG | | NLNKKIDDGF | | NWRGSNRPIVD | |
| NAYQAKFES | | NAYQAKFES | | NLNKKMEDGF | | NWRGSNRPWIR | |
| NAYQARFES | | NAYQARFES | | NLNKKMEDGL | | NWSGYSGAFTI | |
| NBNGVKGFS | | NBNGVKGFS | | NLNKKVDDGF | | NWSGYSGAFTV | |
| NCDAKCQTP | | NCDAKCQTP | | NLNKKVDDGL | | NWSGYSGIFSI | |
| NCDTKCQTP | | NCDTKCQTP | | NLNKKVEDGF | | NWSGYSGIFSV | |
| NCETKCQSP | | NCETKCQSP | | NLNRKMEDGF | | NWSGYSGSFID | |
| NCETKCQTP | | NCETKCQTP | | NLNRKVDDGF | | NWSGYSGSFSI | |
| NCETQCQTP | | NCETQCQTP | | NLNWSGYSGS | | NWSGYSGSFTI | |
| NCHTKCQTY | | NCHTKCQTY | | NLPFQNINSR | | NWSGYSGSFTL | |
| NCIESIRNG | | NCIESIRNG | | NLPFQNVNSR | | NWSGYSGVFSV | |
| NCIKPCFWV | | NCIKPCFWV | | NLQAYQKRMG | | NWSWHDGAILP | |
| NCINRCFYV | | NCINRCFYV | | NLQTYQKRMG | | NWTGTNRPILA | |
| NCIRPCFWV | | NCIRPCFWV | | NLSGYSGSFI | | NWTGTNRPILV | |
| NCKDPNNER | | NCKDPNNER | | NLSKRMEDGF | | NWTGTNRPVLI | |
| NCKTKCQTY | | NCKTKCQTY | | NLSPRTVGQC | | NWTGTNRPVLV | |
| NCLVPCFWV | | NCLVPCFWV | | NLTKGLCTIN | | NWTKDSITDIW | |
| NCLYASPQL | | NCLYASPQL | | NLTKINNGDY | | NWTQDAMTEVW | |
| NCMERIRNN | | NCMERIRNN | | NLTKRLCTIN | | NWTRDAMTEIW | |
| NCMESIRDN | | NCMESIRDN | | NLTKTNNGDY | | NWTRDAMTEVW | |
| NCMESIRNN | | NCMESIRNN | | NLTKVNNGDY | | NWTRDSITEVW | |
| NCMRPCFWV | | NCMRPCFWV | | NLTKVNNGNY | | NWTRDSLTEIW | |
| NCNAKCQTP | | NCNAKCQTP | | NLTKVNSGDY | | NWTRDSMTEVW | |
| NCNTKCQTP | | NCNTKCQTP | | NLTRELCTIN | | NYARLYIWGVH | |
| NCNTKCQTY | | NCNTKCQTY | | NLTRGLCKIN | | NYDSIRGEFNQ | |
| NCPKYIKSG | | NCPKYIKSG | | NLTRGLCTIN | | NYDSIRGEFSQ | |
| NCPKYVKQG | | NCPKYVKQG | | NLVAPEYGFK | | NYEELREHLSS | |
| NCRDPNNEK | | NCRDPNNEK | | NLVAPRGHYK | | NYEELREQLSS | |
| NCRDPNNER | | NCRDPNNER | | NLVAPRGYFK | | NYGPINVTKEN | |
| NCRDPNNES | | NCRDPNNES | | NLVAPWYAYK | | NYGVKGFGFRQ | |
| NCRDSNNER | | NCRDSNNER | | NLVAPWYAYR | | NYHQSFVPSPG | |
| NCRNPNNEK | | NCRNPNNEK | | NLVFNTVIHE | | NYHYEECSCYP | |
| NCRNPNNER | | NCRNPNNER | | NLVFNTVIHG | | NYKEICIAWSS | |
| NCTIPCFWV | | NCTIPCFWV | | NLVVPEYGFK | | NYKEICVAWSS | |
| NCTVPCFWV | | NCTVPCFWV | | NLWAYNAELL | | NYKEIRIAWSS | |
| NCWSFALAQ | | NCWSFALAQ | | NLYASKNPYT | | NYKEMCAAWSS | |
| NCYPGATVN | | NCYPGATVN | | NLYDKVRFQL | | NYLIRALTLNT | |
| NCYQFALGQ | | NCYQFALGQ | | NLYDKVRHQL | | NYLLLNKSLCS | |
| NCYTKCQTY | | NCYTKCQTY | | NLYDKVRLQL | | NYLMLNKSLCK | |
| NCYWVMTDG | | NCYWVMTDG | | NLYDKVRMQL | | NYQQSFVPSPG | |
| NDATYQRTR | | NDATYQRTR | | NLYDRVRKQL | | NYQSLRSILAN | |
| NDAYAVIHY | | NDAYAVIHY | | NLYDRVRLQL | | NYREICIAWSS | |
| NDCESKCFW | | NDCESKCFW | | NLYDRVRMQL | | NYVCSGLVGDT | |
| NDDIDQSLI | | NDDIDQSLI | | NLYEKVRLQL | | NYVSMEFSLTD | |
| NDDSSSNSN | | NDDSSSNSN | | NLYEKVRMQL | | NYYNETFVNMT | |
| NDDSSSSSN | | NDDSSSSSN | | NLYERVRKQL | | NYYNETFVNVT | |
| NDDVDQSLI | | NDDVDQSLI | | NLYGFIIKGR | | NYYYEECSCYP | |
| NDDVDQSLV | | NDDVDQSLV | | NLYGFIVKGR | | PAANNADHRIY | |
| NDDVSWASN | | NDDVSWASN | | NLYNIRNLHI | | PAANNADHRVY | |
| NDDVSWTSN | | NDDVSWTSN | | NLYNKVRLQL | | PAANSADHRIY | |
| NDEGTGIAA | | NDEGTGIAA | | NLYNKVRMQL | | PAANSADHRVY | |
| NDERGNPGV | | NDERGNPGV | | NLYVNKNPYT | | PAANSAHHRVY | |
| NDEVSWTSN | | NDEVSWTSN | | NMARAVKLYK | | PAAPHGLCYPG | |
| NDFFKRLNW | | NDFFKRLNW | | NMDKAVKLYK | | PAATALANTIE | |
| NDFFNRLNW | | NDFFNRLNW | | NMDKAVKLYR | | PAECRTFFLTQ | |
| NDFFRRLNW | | NDFFRRLNW | | NMDRAVKLYK | | PAFSVQRNLPF | |
| NDGKVECVC | | NDGKVECVC | | NMDRAVKLYR | | PAHKSQLIWMA | |
| NDIWMGRTI | | NDIWMGRTI | | NMERIKELRD | | PAHKSQLVWMA | |
| NDKHSNETV | | NDKHSNETV | | NMERIKELRY | | PAKLLKERGFF | |
| NDKHSNGTA | | NDKHSNGTA | | NMGIYQILAI | | PALIIWGIHHS | |
| NDKHSNGTI | | NDKHSNGTI | | NMGKVECVCR | | PALIIWGVHHS | |

Fig. 83-254

| Block size 8 | SIN | Block size 9 | SIN | Block size 10 | SIN | Block size 11 | SIN |
|---|---|---|---|---|---|---|---|
| NDKHSNGTM | | NDKHSNGTM | | NMGVYQILAI | | PALIVWGIHHS | |
| NDKHSNGTV | | NDKHSNGTV | | NMGVYQVLAI | | PALIVWGVHHS | |
| NDKHSNNTV | | NDKHSNNTV | | NMHDANVRNL | | PALRMKWMMAM | |
| NDKIDDQIE | | NDKIDDQIE | | NMIADRVDDA | | PANKQASYKIF | |
| NDKINDQIE | | NDKINDQIE | | NMINDKIDDQ | | PANNQASYKIF | |
| NDKPFQNVN | | NDKPFQNVN | | NMINDKINDQ | | PANNQASYRIF | |
| NDKTLDLHD | | NDKTLDLHD | | NMINNDLGPA | | PANSQASYKIF | |
| NDKTLDMHD | | NDKTLDMHD | | NMINSKIDDQ | | PAQNAISITFP | |
| NDKTLNMHD | | NDKTLNMHD | | NMINSKIEDQ | | PAQNAISTTFP | |
| NDKYHQIEK | | NDKYHQIEK | | NMINSKINDQ | | PASNQASYKIF | |
| NDLGNGCFE | | NDLGNGCFE | | NMINSQIDDQ | | PASRYLIDMTL | |
| NDLGPATAQ | | NDLGPATAQ | | NMISDKIDDQ | | PASRYLTDMTL | |
| NDLWMGRTI | | NDLWMGRTI | | NMLADRIDDA | | PATAQMALQLF | |
| NDLYGTQPL | | NDLYGTQPL | | NMLADRVDDA | | PATIGECPKYV | |
| NDLYGTQSL | | NDLYGTQSL | | NMLADWVDDA | | PAYCNTDLGAP | |
| NDNASAVVW | | NDNASAVVW | | NMLSTVLGVS | | PAYCNTDLGSP | |
| NDNATATVY | | NDNATATVY | | NMQNKLNNVI | | PAYCNTDLGTP | |
| NDNCMESIR | | NDNCMESIR | | NMQNRLNNVI | | PCFWIELIRGR | |
| NDNVSWTSN | | NDNVSWTSN | | NMRCTISLVK | | PCFWLEMIRGK | |
| NDNWSGYSG | | NDNWSGYSG | | NMSKKKSYIN | | PCFWLEMIRGR | |
| NDPSGYAQT | | NDPSGYAQT | | NMSKRKSYIN | | PCFWVELIRGQ | |
| NDPWVLLNA | | NDPWVLLNA | | NMSLNISLYS | | PCFWVELIRGR | |
| NDPYPGNNN | | NDPYPGNNN | | NNADHRIYWI | | PCFWVELVRGL | |
| NDPYPGNSN | | NDPYPGNSN | | NNAIDEGDGC | | PCFWVELVRGR | |
| NDQGAGYAA | | NDQGAGYAA | | NNAKDEGNGC | | PCFWVEMIRGE | |
| NDQGSGYAA | | NDQGSGYAA | | NNAKEIGNGC | | PCFWVEMIRGK | |
| NDQIEDLWA | | NDQIEDLWA | | NNAKELGNGC | | PCFWVEMIRGQ | |
| NDQITDIWA | | NDQITDIWA | | NNAKEVGNGC | | PCFWVEMIRGR | |
| NDRHSNGTI | | NDRHSNGTI | | NNAQEIGNGC | | PCFYIELIRGK | |
| NDRHSNGTV | | NDRHSNGTV | | NNAREIGNGC | | PCFYIELIRGR | |
| NDRNFWRGD | | NDRNFWRGD | | NNASAIVWYN | | PCFYVELIRGM | |
| NDRNFWRGE | | NDRNFWRGE | | NNASAVIWYK | | PCFYVELIRGR | |
| NDRSPFRAL | | NDRSPFRAL | | NNASAVIWYN | | PCFYVELTRGV | |
| NDRSPHRTL | | NDRSPHRTL | | NNASAVVWYN | | PCLTDKGSIQS | |
| NDRTLDLHD | | NDRTLDLHD | | NNASTVIWYN | | PCMESIRNNTY | |
| NDRTPYRSL | | NDRTPYRSL | | NNATATVYYD | | PDATAVAVLKY | |
| NDSCMDTIR | | NDSCMDTIR | | NNATATVYYN | | PDATAVVLKY | |
| NDSCMEAIR | | NDSCMEAIR | | NNATDTVDTL | | PDDGAVAVLKY | |
| NDSCMETIR | | NDSCMETIR | | NNCIESIRNG | | PDECRFYALSQ | |
| NDTDVVNFL | | NDTDVVNFL | | NNCMESIRNN | | PDGADINFMPI | |
| NDTDVVNFV | | NDTDVVNFV | | NNDLGPATAQ | | PDGALLPFDID | |
| NDTDVVNYV | | NDTDVVNYV | | NNDNATATVY | | PDGANIDFMPV | |
| NDTINYYNE | | NDTINYYNE | | NNDWSGYSGS | | PDGANIGFMPK | |
| NDTITFSFN | | NDTITFSFN | | NNECMETIKN | | PDGANINFMPI | |
| NDTTYQRTR | | NDTTYQRTR | | NNEDGDIIFL | | PDGANINLMPI | |
| NDTVIFSFN | | NDTVIFSFN | | NNEDGNIIFL | | PDGANTNFMPI | |
| NDTVNFSFN | | NDTVNFSFN | | NNEEGDIIFL | | PDGCRFYALSQ | |
| NDTVTFIFN | | NDTVTFIFN | | NNEGSYFFGD | | PDGSDIGFMPK | |
| NDTVTFNFN | | NDTVTFNFN | | NNEKGNPGVK | | PDGSNIGFMPK | |
| NDTVTFSFN | | NDTVTFSFN | | NNEKGNQGVK | | PDHEGEGIPLY | |
| NDTVTFTFN | | NDTVTFTFN | | NNENATATVY | | PDIYDFNEGSY | |
| NDVWLGRTI | | NDVWLGRTI | | NNENGDIIFL | | PDLYDYKEDRF | |
| NDVWLGRTV | | NDVWLGRTV | | NNEPGSGNWP | | PDLYDYKENRF | |
| NDVWMGRTI | | NDVWMGRTI | | NNEPSGYAQT | | PDLYDYKESRF | |
| NDWSGYSGS | | NDWSGYSGS | | NNEQGSGYAA | | PDLYDYKKNRF | |
| NDYEELKHF | | NDYEELKHF | | NNERGNHGVK | | PDNEAVAVLKY | |
| NDYEELKHL | | NDYEELKHL | | NNERGNPGVK | | PDNGAVAVLKY | |
| NDYEELKLL | | NDYEELKLL | | NNERGNQGVK | | PDNGAVAVVKY | |
| NDYEELKYL | | NDYEELKYL | | NNERGTQGVK | | PDPFRLLQNSQ | |
| NEAINNRFQ | | NEAINNRFQ | | NNETIIETGY | | PDPGVKGFAFL | |
| NEALNNRFQ | | NEALNNRFQ | | NNETILETGY | | PDRATFLRSNA | |
| NEAVAVLKY | | NEAVAVLKY | | NNETILETRY | | PDSGAVAVLKY | |

Fig. 83-255

| Block size 8 | SIN | Block size 9 | SIN | Block size 10 | SIN | Block size 11 | SIN |
|---|---|---|---|---|---|---|---|
| NECIEKIRN | | NECIEKIRN | | NNETIVETGY | | PDSTAVAVIKY | |
| NECIEKVRN | | NECIEKVRN | | NNFVPVIGAR | | PDSVLVNTYQW | |
| NECIERVRN | | NECIERVRN | | NNFVPVMGAR | | PDTTAVAVLKY | |
| NECMETIKN | | NECMETIKN | | NNFVPVVGAR | | PDTYDFNEGAY | |
| NECRFYALS | | NECRFYALS | | NNFVPVVRAR | | PDTYDFNEGSY | |
| NECRTFFLT | | NECRTFFLT | | NNGDYARLYI | | PDTYDFNEGTY | |
| NECYNPCFY | | NECYNPCFY | | NNGDYTRLYI | | PDVRCICRDNW | |
| NEDGDIIFL | | NEDGDIIFL | | NNGELRHLFS | | PDVRCTCRDNW | |
| NEDGNIIFL | | NEDGNIIFL | | NNGKFEFIAE | | PDVRCVCRDNW | |
| NEDGSSSSN | | NEDGSSSSN | | NNGKFEFIVE | | PDYHYEECSCY | |
| NEDIPIENC | | NEDIPIENC | | NNGKGRYGVK | | PDYQIGYVCSG | |
| NEDIPIGNC | | NEDIPIGNC | | NNGKLEFIAE | | PDYQSIRSILA | |
| NEDIPIGSC | | NEDIPIGSC | | NNGKVECICR | | PDYQSLRSILA | |
| NEDSSSNSN | | NEDSSSNSN | | NNGNYARLYI | | PEAGLKWELMD | |
| NEDSSSSSN | | NEDSSSSSN | | NNGRFEFIAE | | PEAYNFNEGSY | |
| NEEALRQII | | NEEALRQII | | NNGSCRCTIC | | PEEAKYVEWTS | |
| NEEALRQIL | | NEEALRQIL | | NNGVKGFAYL | | PEEAKYVWWAS | |
| NEEALRQKI | | NEEALRQKI | | NNGVKGFSYL | | PEEAKYVWWTS | |
| NEEGDIIFL | | NEEGDIIFL | | NNIDRAVKLY | | PEEGTSIWTSS | |
| NEEGTGIAA | | NEEGTGIAA | | NNIIDKMNGN | | PEEISETQGTE | |
| NEEPLRQIL | | NEEPLRQIL | | NNIIEKMNGN | | PEEKTSIWTSS | |
| NEERGNPGV | | NEERGNPGV | | NNILRTQESE | | PEERNSIWTSS | |
| NEERGSPGV | | NEERGSPGV | | NNIRIGSKGD | | PEERTSIWTSS | |
| NEESLRQIL | | NEESLRQIL | | NNIVDKMNRE | | PEEVKYVWWTS | |
| NEESLRQVL | | NEESLRQVL | | NNKDGDIIFL | | PEEVSEAQGTE | |
| NEFNEIEQQ | | NEFNEIEQQ | | NNKHSNGTIH | | PEEVSETQGIE | |
| NEFNEVEQQ | | NEFNEVEQQ | | NNKNATATVY | | PEEVSETQGME | |
| NEFNKACEL | | NEFNKACEL | | NNKNWSGYSG | | PEEVSETQGTE | |
| NEFSEIEQQ | | NEFSEIEQQ | | NNKPFQNVNK | | PEFGYLLKGES | |
| NEFTEIEQQ | | NEFTEIEQQ | | NNKWSGYSGS | | PEFGYLLRGES | |
| NEFTEVEKQ | | NEFTEVEKQ | | NNLEKRLENL | | PEGMCYPGFVE | |
| NEFTEVEQQ | | NEFTEVEQQ | | NNLERRLENL | | PEGMCYPGSIE | |
| NEGALRQKI | | NEGALRQKI | | NNLSGYSGSF | | PEGMCYPGSVE | |
| NEGHIEECS | | NEGHIEECS | | NNLTKGLCII | | PEKIHTRGLFG | |
| NEGIMNTSK | | NEGIMNTSK | | NNLTKGLCTI | | PEKIRTRGLFG | |
| NEGKVECIC | | NEGKVECIC | | NNLTKRLCTI | | PEKIRVKRRPV | |
| NEGKVECVC | | NEGKVECVC | | NNLTRELCTI | | PEKQTRGIFGA | |
| NEGNGCFEL | | NEGNGCFEL | | NNLTRGLCTI | | PEKQTRGLFGA | |
| NEGRLIQNS | | NEGRLIQNS | | NNMARAVKLY | | PERQTRGIFGA | |
| NEGRTSDMR | | NEGRTSDMR | | NNMDKAVKLY | | PERQTRGLFGA | |
| NEGSYFFGD | | NEGSYFFGD | | NNMDRAVKLY | | PESVLINTYQW | |
| NEGVINTSK | | NEGVINTSK | | NNMINNDLGP | | PESVLVNTYQW | |
| NEGVMNTSK | | NEGVMNTSK | | NNMNWSGYSG | | PETQTRGIFGA | |
| NEHSNGTIH | | NEHSNGTIH | | NNNASAIVWY | | PEVCLKWDLMD | |
| NEHSNGTTH | | NEHSNGTTH | | NNNASAVIWY | | PEVCLKWELMD | |
| NEIEHQIGN | | NEIEHQIGN | | NNNASAVVWY | | PEWSYIIEKEN | |
| NEIEQQIGN | | NEIEQQIGN | | NNNASTVIWY | | PEWSYIMEKEN | |
| NEIEYQIGN | | NEIEYQIGN | | NNNATATVYY | | PEWSYIVEKAN | |
| NEIGVPFHL | | NEIGVPFHL | | NNNGELRHLF | | PEWSYIVEKDK | |
| NEIKGVELS | | NEIKGVELS | | NNNGVKGFAY | | PEWSYIVEKDN | |
| NEIKGVKLS | | NEIKGVKLS | | NNNGVKGFSY | | PEWSYIVEKDS | |
| NEIRASVGR | | NEIRASVGR | | NNNKGAVFKS | | PEWSYIVEKEN | |
| NEITTKINN | | NEITTKINN | | NNNNATATVY | | PEWSYIVEKNN | |
| NEKFHQIEK | | NEKFHQIEK | | NNNNGVKGFA | | PEWSYIVEREN | |
| NEKGNPGVK | | NEKGNPGVK | | NNNNGVKGFS | | PEWSYIVERET | |
| NEKGNQGVK | | NEKGNQGVK | | NNNNNTATLC | | PEYGFKISKRG | |
| NEKKAKLAN | | NEKKAKLAN | | NNNWFGYFGI | | PEYGFRISKRG | |
| NEKPFQNVN | | NEKPFQNVN | | NNNWSGYSGI | | PEYGHLITGKS | |
| NEKTLDLHD | | NEKTLDLHD | | NNNWSGYSGS | | PEYGHLTTGKS | |
| NEKYHQIEK | | NEKYHQIEK | | NNPGRVSVST | | PEYGHLVTGKS | |
| NELGIPFHL | | NELGIPFHL | | NNPGRVTVST | | PEYGYLITGKS | |
| NELGVPFHL | | NELGVPFHL | | NNPITGSPGA | | PEYQSLRSILA | |

Fig. 83-256

| Block size 8 | SIN | Block size 9 | SIN | Block size 10 | SIN | Block size 11 | SIN |
|---|---|---|---|---|---|---|---|
| NELGVPFHM | | NELGVPFHM | | NNQASYKIFK | | PFAKDNSIRLS | |
| NELGVPFNL | | NELGVPFNL | | NNQASYRIFK | | PFDVPDYQSLR | |
| NELGVPFYL | | NELGVPFYL | | NNQDWSGYSG | | PFHKDNAIRLG | |
| NELGVPLHL | | NELGVPLHL | | NNQNWSGYSG | | PFHKDNALRLA | |
| NELGVSFHL | | NELGVSFHL | | NNQVFPQLNQ | | PFHKDNAVRLG | |
| NELYGTQSL | | NELYGTQSL | | NNRIKINPVT | | PFHKGNSARLI | |
| NEMTLDFHD | | NEMTLDFHD | | NNRKEPALIV | | PFHLGTKQVCI | |
| NENATATVY | | NENATATVY | | NNRNWSGYSG | | PFHLGTKQVCM | |
| NENGDIIFL | | NENGDIIFL | | NNRSGYSGIF | | PFHLGTKQVCV | |
| NENPAHKSQ | | NENPAHKSQ | | NNSCMETIRN | | PFHLGTRQVCI | |
| NENPVHKSQ | | NENPVHKSQ | | NNSKKQIDTI | | PFHLGTRQVCM | |
| NENQNPRIF | | NENQNPRIF | | NNSSDTVDTL | | PFHNIHPLAIG | |
| NENQNPRMF | | NENQNPRMF | | NNSTATLCLG | | PFHNIHPLTIG | |
| NENQNPRVF | | NENQNPRVF | | NNSTDKIDTL | | PFHNIHPLTMG | |
| NEPGSGDWP | | NEPGSGDWP | | NNSTDKVDTI | | PFHNVHPFTIG | |
| NEPGSGNWP | | NEPGSGNWP | | NNSTDKVDTL | | PFHNVHPLAIG | |
| NEPSGYAQT | | NEPSGYAQT | | NNSTDKVNTI | | PFHNVHPLTIG | |
| NEPTGYAQT | | NEPTGYAQT | | NNSTDTVDTI | | PFISCSHLECR | |
| NEPYPGNNN | | NEPYPGNNN | | NNSTDTVDTL | | PFISCSHMECR | |
| NEQGGGYAA | | NEQGGGYAA | | NNSTDTVDTV | | PFISCSHSECR | |
| NEQGMGMAA | | NEQGMGMAA | | NNSTDTVNTL | | PFISCSYLECR | |
| NEQGSGFAA | | NEQGSGFAA | | NNSTEHVDTI | | PFKGFFPFHKD | |
| NEQGSGYAA | | NEQGSGYAA | | NNSTEKVDTI | | PFLDRLRRDQK | |
| NEQGTGIAA | | NEQGTGIAA | | NNSTEQVDTI | | PFPVGSGSFPD | |
| NEQGVGIAA | | NEQGVGIAA | | NNSTERVDTI | | PFQGFFPFHKD | |
| NEQGVGMAA | | NEQGVGMAA | | NNSTETVNTL | | PFQNASRHHMG | |
| NEQTDLYKV | | NEQTDLYKV | | NNSTKQIDTI | | PFQNASRHYMG | |
| NERGLFGAI | | NERGLFGAI | | NNSTKQVDTI | | PFQNASRYYMG | |
| NERGNHGVK | | NERGNHGVK | | NNSTNTVNTL | | PFQNICKPYIG | |
| NERGNPGVK | | NERGNPGVK | | NNSTTKVDTI | | PFQNIDSRAVG | |
| NERGNQGVK | | NERGNQGVK | | NNSTTQIDTI | | PFQNIDSWAVG | |
| NERGTQGVK | | NERGTQGVK | | NNSTTQVDTI | | PFQNIHPATIG | |
| NERILDFHD | | NERILDFHD | | NNSTTQVDTL | | PFQNIHPITIG | |
| NERTLDFHD | | NERTLDFHD | | NNSTTQVNTI | | PFQNIHPVTIG | |
| NERTLDLHD | | NERTLDLHD | | NNSTVQVDTI | | PFQNLSPRTVG | |
| NERTLDMHD | | NERTLDMHD | | NNSWSGYSGI | | PFQNTSKHYIG | |
| NERTLDQHD | | NERTLDQHD | | NNTCMETIRN | | PFQNTSRHYIG | |
| NERTLDYHD | | NERTLDYHD | | NNTEPLCDVS | | PFQNTSRHYMG | |
| NERTLYFHD | | NERTLYFHD | | NNTEPLCEVS | | PFQNVHPITIG | |
| NESADMSIG | | NESADMSIG | | NNTEPLCNVS | | PFQNVHPVTIG | |
| NESGRLIDF | | NESGRLIDF | | NNTNGEQILI | | PFQNVNKITYG | |
| NESGRLMDF | | NESGRLMDF | | NNTSGEQMLI | | PFQNVNKVTYG | |
| NETFVNMTN | | NETFVNMTN | | NNTSGEQMLV | | PFQNVNRITYG | |
| NETFVNVTH | | NETFVNVTH | | NNTSGEQVLV | | PFQNVSRIAIG | |
| NETFVNVTN | | NETFVNVTN | | NNTTGRDVLV | | PFRALISWEMG | |
| NETIIETGY | | NETIIETGY | | NNTTIIENTY | | PFRALISWGMG | |
| NETILETGY | | NETILETGY | | NNTTNYYNET | | PFRALVSWEMG | |
| NETIVETGY | | NETIVETGY | | NNTTVVENKY | | PFRGFFPFHKD | |
| NETVKDRSP | | NETVKDRSP | | NNTTVVENTY | | PFRTLMSCPIG | |
| NEVEQQIGN | | NEVEQQIGN | | NNTVINNITT | | PFRTLMSCPMG | |
| NEVGAKILT | | NEVGAKILT | | NNTVKDRSPY | | PFRTLMSCPVG | |
| NEVGARIIT | | NEVGARIIT | | NNTVVNNITT | | PFSKDNGIRIG | |
| NEVGARILT | | NEVGARILT | | NNTWLGRTIS | | PFSKDNSIQLS | |
| NEVKLEENT | | NEVKLEENT | | NNTYDHAQYR | | PFSKDNSIRLA | |
| NEWSGYSGS | | NEWSGYSGS | | NNTYDHKKYR | | PFSKDNSIRLS | |
| NFDSNGNFI | | NFDSNGNFI | | NNTYDHRKYK | | PFSKDNSIRVS | |
| NFEGWIVGN | | NFEGWIVGN | | NNTYDHSHYR | | PFSKDNSVRLS | |
| NFEKEGYSL | | NFEKEGYSL | | NNTYDHSKYR | | PFSVGSGSFPD | |
| NFESNGNFI | | NFESNGNFI | | NNTYDHSQYR | | PFVACGPAECR | |
| NFESNGNLI | | NFESNGNLI | | NNTYDHSRYR | | PFVACGPSECR | |
| NFESTGNLI | | NFESTGNLI | | NNTYDHSTYR | | PFVACGPTECR | |
| NFESTGNLV | | NFESTGNLV | | NNTYDHTKYR | | PFVACSPSECR | |

Fig. 83-257

| Block size 8 | SIN | Block size 9 | SIN | Block size 10 | SIN | Block size 11 | SIN |
|---|---|---|---|---|---|---|---|
| NFFHKCNDS | | NFFHKCNDS | | NNTYDHTQYR | | PFVRGQQGRMD | |
| NFHYEECSC | | NFHYEECSC | | NNTYNHTEYR | | PFVSCGPSECR | |
| NFIAPENAY | | NFIAPENAY | | NNTYNHTQYR | | PFVSCSHLECR | |
| NFIAPEYAF | | NFIAPEYAF | | NNVIDKMNKQ | | PGAPGVKGFGF | |
| NFIAPEYAY | | NFIAPEYAY | | NNVIDKMNNQ | | PGAPHGLCYPG | |
| NFKPNIGPR | | NFKPNIGPR | | NNVIDKMYKQ | | PGARPKVNGQA | |
| NFLSMEFSL | | NFLSMEFSL | | NNVTVTSSVE | | PGATINEEALR | |
| NFMPYISFA | | NFMPYISFA | | NNWFGYFGIF | | PGATVNEEALR | |
| NFNDYEELK | | NFNDYEELK | | NNWSGYSGIF | | PGATVNEGALR | |
| NFNGAFIAP | | NFNGAFIAP | | NNWSGYSGSF | | PGCDRLQDTTW | |
| NFNGAFVAP | | NFNGAFVAP | | NNWSGYSGVF | | PGDHITFSHNG | |
| NFPQTANTY | | NFPQTANTY | | NNYEELKHLL | | PGDIIVFNTIG | |
| NFPQTTNTY | | NFPQTTNTY | | NNYGVKGFGF | | PGDLILFNTIG | |
| NFPRTTNTY | | NFPRTTNTY | | NPAHKSQLIW | | PGDLIVFNTIG | |
| NFQPNIGPR | | NFQPNIGPR | | NPAHKSQLVW | | PGDNIIFSHNG | |
| NFRAYVDGF | | NFRAYVDGF | | NPALRMKWMM | | PGDNITFSDNG | |
| NFRTYVDGF | | NFRTYVDGF | | NPANGICYPG | | PGDNITFSHNG | |
| NFRVYVDGF | | NFRVYVDGF | | NPAYCNTDLG | | PGDRPKVNGQA | |
| NFSFNGAFI | | NFSFNGAFI | | NPCFYVELIR | | PGDSIIFNSIG | |
| NFSMELPSF | | NFSMELPSF | | NPDPGVKGFA | | PGDSITFSHNG | |
| NFVIEKMNT | | NFVIEKMNT | | NPEAYNFNEG | | PGDTVTFTFNG | |
| NFVNRANQR | | NFVNRANQR | | NPGDSIIFNS | | PGDVIVFNTIG | |
| NFVPVIGAR | | NFVPVIGAR | | NPGNAEIEDL | | PGELDNNGELR | |
| NFVPVMGAR | | NFVPVMGAR | | NPGRVSVSTK | | PGELNNNGELR | |
| NFVPVVGAR | | NFVPVVGAR | | NPGRVTVSTK | | PGERIMFESNG | |
| NFVPVVRAR | | NFVPVVRAR | | NPGRVTVSTQ | | PGERITFESNG | |
| NFVRQCFNP | | NFVRQCFNP | | NPGRVTVSTR | | PGERITFESSG | |
| NFVSMEFSL | | NFVSMEFSL | | NPGVKGWAFD | | PGERTTFESNG | |
| NFWRGDNGR | | NFWRGDNGR | | NPIICLGHHA | | PGETLKVESNG | |
| NFWRGENGR | | NFWRGENGR | | NPINGICYPG | | PGETLNIESNG | |
| NFYYEECSC | | NFYYEECSC | | NPITGSPCAP | | PGETLNVESNG | |
| NGAFIAPDR | | NGAFIAPDR | | NPITGSPGAP | | PGEVDNNGELR | |
| NGAFIAPNR | | NGAFIAPNR | | NPITGSPGSP | | PGFHFEECSCY | |
| NGAFIAPRY | | NGAFIAPRY | | NPITGSPGVP | | PGFVENLEELR | |
| NGAFLAPGY | | NGAFLAPGY | | NPITGSPSAP | | PGHNITFSHNG | |
| NGAFLAPRY | | NGAFLAPRY | | NPKCDIHLKD | | PGIKGFAFLDG | |
| NGAFVAPDR | | NGAFVAPDR | | NPKCDIHLRD | | PGIKGFGFLNE | |
| NGAKVNTLT | | NGAKVNTLT | | NPKCDLYLNG | | PGKFTNEEALR | |
| NGALGSPGC | | NGALGSPGC | | NPKCDLYLSG | | PGKQAKGLFGA | |
| NGALLAPRY | | NGALLAPRY | | NPKCDPYLNG | | PGLINGWYGFQ | |
| NGAQIQYFS | | NGAQIQYFS | | NPKCDTHLKD | | PGLVAGWYGFQ | |
| NGAVAVLKY | | NGAVAVLKY | | NPKCDVHLKD | | PGMMMGMFNML | |
| NGAVAVVKY | | NGAVAVVKY | | NPKSKLFTLS | | PGMQIRGFVHF | |
| NGAWIGRTK | | NGAWIGRTK | | NPLIKHENRM | | PGMQIRGFVYF | |
| NGCFDILHK | | NGCFDILHK | | NPLIRHENRM | | PGNAEIEDLIF | |
| NGCFEFWHK | | NGCFEFWHK | | NPMCDDLIGK | | PGNAEIEDLTF | |
| NGCFEFYHK | | NGCFEFYHK | | NPMCDELIGK | | PGNFNDYEELK | |
| NGCFEFYHR | | NGCFEFYHR | | NPMCDNLIGK | | PGNLIVFNTIG | |
| NGCFEIFHK | | NGCFEIFHK | | NPMCDYLIGK | | PGNNBNGVKGF | |
| NGCFEIFHQ | | NGCFEIFHQ | | NPMHQLLRHF | | PGNNNGVKGFS | |
| NGCFEIFHR | | NGCFEIFHR | | NPNQKIICIS | | PGNNNNGVKGF | |
| NGCFELLHK | | NGCFELLHK | | NPNQKIITID | | PGQTVKIKTNG | |
| NGCFELYHK | | NGCFELYHK | | NPNQKIITIG | | PGQTVKIQTNG | |
| NGCFKIYHK | | NGCFKIYHK | | NPNQKILCAS | | PGQTVKIQTSG | |
| NGCFPFYHK | | NGCFPFYHK | | NPNQKILCTS | | PGRFTNEEALR | |
| NGCFQPCFY | | NGCFQPCFY | | NPNQKILFAS | | PGSFNDYEELK | |
| NGCFTFYHK | | NGCFTFYHK | | NPNQKIMCIS | | PGSFNNYEELK | |
| NGCFTIYHK | | NGCFTIYHK | | NPNQKIQCTS | | PGSFPDGAQIQ | |
| NGCIEGKLS | | NGCIEGKLS | | NPNQKITCIS | | PGSGHWPDGSN | |
| NGCIESKLS | | NGCIESKLS | | NPNQKIVTIG | | PGSGNWPDGSD | |
| NGCLKIYHK | | NGCLKIYHK | | NPNQKLFALS | | PGSGNWPDGSN | |
| NGDDVWMGR | | NGDDVWMGR | | NPNQKLFASS | | PGSIENLEELR | |

Fig. 83-258

| Block size 8 | SIN | Block size 9 | SIN | Block size 10 | SIN | Block size 11 | SIN |
|---|---|---|---|---|---|---|---|
| NGDGCFEIL | | NGDGCFEIL | | NPNQKLFTLS | | PGSIENQEELK | |
| NGDIIFLWG | | NGDIIFLWG | | NPNQKTITIG | | PGSIENQEELR | |
| NGDPNNMDK | | NGDPNNMDK | | NPNQMIITIG | | PGSIKNQEELR | |
| NGDPNNMDR | | NGDPNNMDR | | NPNWSGYSGS | | PGSLNDYEELK | |
| NGDYARLYI | | NGDYARLYI | | NPRCDDLIGK | | PGSNNNGVKGF | |
| NGDYTRLYI | | NGDYTRLYI | | NPRIFLAMIT | | PGSTVNEEALR | |
| NGEALRQIL | | NGEALRQIL | | NPRMFLAMIT | | PGSVENLEELR | |
| NGELRHLFS | | NGELRHLFS | | NPRVFLAMIT | | PGSVENQEELR | |
| NGEPGVKGF | | NGEPGVKGF | | NPRVFLTMIT | | PGTKGFGFLNE | |
| NGEQILIIW | | NGEQILIIW | | NPSAGKDPKK | | PGTTVNEEALR | |
| NGFAPFSKD | | NGFAPFSKD | | NPSCASNINI | | PGVKGFAFLDE | |
| NGFCFTVMT | | NGFCFTVMT | | NPSCATNINI | | PGVKGFAFLDG | |
| NGFEMLKIP | | NGFEMLKIP | | NPSHEGEGIP | | PGVKGFAFLDR | |
| NGFLDVWTY | | NGFLDVWTY | | NPSLRMKWMM | | PGVKGFAFLNG | |
| NGGFLAPRY | | NGGFLAPRY | | NPSQKLFALS | | PGVKGFGFLDG | |
| NGGHIEECS | | NGGHIEECS | | NPTEEQAVDI | | PGVKGFGFLDN | |
| NGGLGVKGF | | NGGLGVKGF | | NPTEEQAVEI | | PGVKGFGFLDS | |
| NGGLIAPDR | | NGGLIAPDR | | NPTEEQAVGI | | PGVKGFGFLNG | |
| NGGLIAPNR | | NGGLIAPNR | | NPTEEQAVNI | | PGVKGFGFLSG | |
| NGGLIAPRY | | NGGLIAPRY | | NPTLLFLEVP | | PGVKGWAFDDG | |
| NGGLIAPSR | | NGGLIAPSR | | NPTLLFLKIP | | PGVKGWAFDNG | |
| NGGLLAPKY | | NGGLLAPKY | | NPTLLFLKMP | | PGVKGWAFDSG | |
| NGGLLAPRY | | NGGLLAPRY | | NPTLLFLKVP | | PGVKGWAFDYG | |
| NGGPGVKGF | | NGGPGVKGF | | NPTNGICYPG | | PGVRCICRDNW | |
| NGGRIAPSR | | NGGRIAPSR | | NPVELSSGYK | | PGWLTIGITGP | |
| NGICPVVFT | | NGICPVVFT | | NPVHKSQLIW | | PGWLTLGITGP | |
| NGICTVVMT | | NGICTVVMT | | NPVICLGHHA | | PGWSWDDGAIL | |
| NGICYPGIL | | NGICYPGIL | | NPVICLGHHS | | PGWSWGDGAIL | |
| NGICYPGSL | | NGICYPGSL | | NPVICMGHHA | | PGYNGQKSWMK | |
| NGICYPGTL | | NGICYPGTL | | NPVKLNSGYK | | PGYNGQKSWTK | |
| NGIITDTFK | | NGIITDTFK | | NPVKLSGGYK | | PGYNGQRSWMK | |
| NGIITDTLK | | NGIITDTLK | | NPVKLSSGYK | | PGYQSLRSILA | |
| NGIKVDTLT | | NGIKVDTLT | | NPVNGICYPG | | PHGLCYPGELD | |
| NGIPPLELG | | NGIPPLELG | | NPVTLSSGYK | | PHGLCYPGELN | |
| NGIRIGSKG | | NGIRIGSKG | | NPVTLTMGYK | | PHLTGTWDTLI | |
| NGIRIGSRG | | NGIRIGSRG | | NPYTLVSTKE | | PHRLCYPGELD | |
| NGIRVGSRG | | NGIRVGSRG | | NQASYKIFKS | | PHRTLLMNEIG | |
| NGISPIHLG | | NGISPIHLG | | NQASYRIFKS | | PHRTLLMNELG | |
| NGISPVHLG | | NGISPVHLG | | NQCMESIRNN | | PHRTLLMSELG | |
| NGITNKVNS | | NGITNKVNS | | NQDSFYRSMK | | PIAFLTSSIVC | |
| NGKAPISLG | | NGKAPISLG | | NQDWSGYSGA | | PIGCKMYALHQ | |
| NGKEPISLG | | NGKEPISLG | | NQEELKSLFS | | PIGEAPSPYNS | |
| NGKFEFIAE | | NGKFEFIAE | | NQEELRFLFS | | PIGEVPSPYNS | |
| NGKFEFIVE | | NGKFEFIVE | | NQEELRSLFS | | PIGISSMVEAM | |
| NGKGRYGVK | | NGKGRYGVK | | NQEYTSGRQE | | PIGSGFFPDGP | |
| NGKLCKLNG | | NGKLCKLNG | | NQFALGQGTT | | PIGTAPILGNY | |
| NGKLCKLSG | | NGKLCKLSG | | NQGSFYRNMR | | PIGTAPVLGNY | |
| NGKLCRLNG | | NGKLCRLNG | | NQGSFYRSIR | | PIGVAPSPSNS | |
| NGKLCRLRG | | NGKLCRLRG | | NQGSFYRSMR | | PIGVAPVLGNY | |
| NGKLCRLSG | | NGKLCRLSG | | NQGVKGWAFD | | PIHLGDCSFEG | |
| NGKLEFIAE | | NGKLEFIAE | | NQHIIDLADS | | PIICLGHHAVE | |
| NGKLNRLIE | | NGKLNRLIE | | NQHTIDLADS | | PIKGWAPLSKD | |
| NGKPFQNVN | | NGKPFQNVN | | NQHTIDLAES | | PILNTSQRGIL | |
| NGKQPISLG | | NGKQPISLG | | NQHTIDLTDA | | PILSPLTKGIL | |
| NGKSGACKR | | NGKSGACKR | | NQHTIDLTDS | | PILSPLTKGML | |
| NGKSLGIQS | | NGKSLGIQS | | NQHTIDLTNS | | PIMFSNKMAKL | |
| NGKSSACKR | | NGKSSACKR | | NQHTIDMADS | | PIMFSNKMARL | |
| NGKVECICR | | NGKVECICR | | NQHTIDMGDS | | PIMFSNKVARL | |
| NGKWREQLS | | NGKWREQLS | | NQHTIDMTDS | | PINNGKGRYGV | |
| NGKYPVIKG | | NGKYPVIKG | | NQHTIDSTDS | | PINVTKENTGS | |
| NGNCRFNVC | | NGNCRFNVC | | NQHTIDVADS | | PIRGWAPLSKD | |
| NGNDVWMGR | | NGNDVWMGR | | NQHTIDVTDS | | PISLGDCSFAG | |

Fig. 83-259

| Block size 8 | SIN | Block size 9 | SIN | Block size 10 | SIN | Block size 11 | SIN |
|---|---|---|---|---|---|---|---|
| NGNFIAPEN | | NGNFIAPEN | | NQHTIHLTDS | | PISLGDCSFTG | |
| NGNFIAPEY | | NGNFIAPEY | | NQIKIRRRVD | | PISVGSGSFPD | |
| NGNFITPEY | | NGNFITPEY | | NQITGKLNRI | | PITEINTWARN | |
| NGNGCFELY | | NGNGCFELY | | NQITGKLNRL | | PITGSPGAPGV | |
| NGNGDPNNM | | NGNGDPNNM | | NQKIITIGFV | | PITGSPSAPGV | |
| NGNHAVHYC | | NGNHAVHYC | | NQKIITIGSA | | PITIGECPKYV | |
| NGNIRCQIC | | NGNIRCQIC | | NQKIITIGSI | | PKCDLYLNGRE | |
| NGNIRCTFC | | NGNIRCTFC | | NQKIITIGSV | | PKCDLYLSGRE | |
| NGNLIAPEF | | NGNLIAPEF | | NQKIITMGSV | | PKCDPYLNGRE | |
| NGNLIAPEY | | NGNLIAPEY | | NQKILCASAT | | PKEDEVWWTSN | |
| NGNLIAPLY | | NGNLIAPLY | | NQKILCTSAI | | PKEDKVWWTSN | |
| NGNLIAPRG | | NGNLIAPRG | | NQKILCTSAT | | PKEDRVWWTSN | |
| NGNLIAPWF | | NGNLIAPWF | | NQKILDEHDS | | PKEEKVWWTSN | |
| NGNLIAPWY | | NGNLIAPWY | | NQKILFASAT | | PKEIEGICYPG | |
| NGNLRCQIC | | NGNLRCQIC | | NQKIMTIGSV | | PKEKAIWTSGS | |
| NGNLRCTIC | | NGNLRCTIC | | NQKIQCTSAT | | PKEKTIWTSGS | |
| NGNLVAPRG | | NGNLVAPRG | | NQKLFALSEV | | PKEMEGICYPG | |
| NGNLVAPWY | | NGNLVAPWY | | NQKLFALSGV | | PKEMEGVCYPG | |
| NGNMQCTIC | | NGNMQCTIC | | NQKLFASSGI | | PKENPAHKSQL | |
| NGNMRCTIC | | NGNMRCTIC | | NQKLFTLSGV | | PKERTIWTSGS | |
| NGNMRCTIL | | NGNMRCTIL | | NQKTITIGSV | | PKERTSIWTSS | |
| NGNMRCTSC | | NGNMRCTSC | | NQKTLDEHDA | | PKETRVWWTSN | |
| NGNVRCQIC | | NGNVRCQIC | | NQKTLDEHDS | | PKFLPDLYDYK | |
| NGNVRCTFC | | NGNVRCTFC | | NQKTLDKHDS | | PKGLFGAIAGF | |
| NGNYARLYI | | NGNYARLYI | | NQNNTTVVEN | | PKGRGLFGAIA | |
| NGNYDSIRG | | NGNYDSIRG | | NQNPRIFLAM | | PKKRGLFGAIA | |
| NGNYGPINV | | NGNYGPINV | | NQNPRMFLAM | | PKKTGGPIYKK | |
| NGPDSVLVN | | NGPDSVLVN | | NQNPRVFLAM | | PKKTGGPIYKR | |
| NGPESVLIN | | NGPESVLIN | | NQNPRVFLTM | | PKKTGGPIYRR | |
| NGPESVLVN | | NGPESVLVN | | NQNQNPRMFL | | PKLRSGFEMLK | |
| NGQAGRIDF | | NGQAGRIDF | | NQNSTWVSQT | | PKPRGLFGAIA | |
| NGQAGRMTF | | NGQAGRMTF | | NQNTIDLTDS | | PKRNRSILNTS | |
| NGQFGRIDF | | NGQFGRIDF | | NQNWSGYSGA | | PKSKLFTLSGV | |
| NGQFGRINF | | NGQFGRINF | | NQNWSGYSGS | | PKSLPDLYDYK | |
| NGQGSGYAA | | NGQGSGYAA | | NQNWSGYSGV | | PKTRGLFGAIA | |
| NGQKSWMKI | | NGQKSWMKI | | NQPAATALAN | | PKVNGQAGRID | |
| NGQKSWTKI | | NGQKSWTKI | | NQQFELIDNE | | PKYEEESKLKR | |
| NGQRGRIDF | | NGQRGRIDF | | NQQFELIDNK | | PKYEEESKLNK | |
| NGQRSWMKI | | NGQRSWMKI | | NQQFELIDSE | | PKYEEESKLNR | |
| NGQSGRIDF | | NGQSGRIDF | | NQQFELINNE | | PKYEEESRLNR | |
| NGQSGRIEF | | NGQSGRIEF | | NQQFEMIDNE | | PKYEKESKLNR | |
| NGQSGRINF | | NGQSGRINF | | NQQFGLIDNE | | PKYGYIIEEYG | |
| NGQSGRIVF | | NGQSGRIVF | | NQQFKLIDNE | | PKYIKQGSLKL | |
| NGQTGRIDF | | NGQTGRIDF | | NQRGILEDEQ | | PKYIKSDQLKL | |
| NGREWSYIV | | NGREWSYIV | | NQRLNPMHQL | | PKYIKSGQLKL | |
| NGRFEFIAE | | NGRFEFIAE | | NQRLNTMHQL | | PKYIPSGSLKL | |
| NGRSGFEVI | | NGRSGFEVI | | NQSGRISIYW | | PKYIPSNSLKL | |
| NGRSSFFRN | | NGRSSFFRN | | NQSPRMFLAM | | PKYIPSRSLKL | |
| NGRTLDLHD | | NGRTLDLHD | | NQTKKMTITF | | PKYISSGSLKL | |
| NGRTLDMHD | | NGRTLDMHD | | NQTKTMTITF | | PKYLPDLYDYK | |
| NGRTLGLHD | | NGRTLGLHD | | NQTLVSNNDW | | PKYMNVKSLKL | |
| NGSCAVVMT | | NGSCAVVMT | | NQTYRNNRKE | | PKYVKQGSLKL | |
| NGSCFTIMT | | NGSCFTIMT | | NQTYRNTRKE | | PKYVKQGSLML | |
| NGSCFTVLT | | NGSCFTVLT | | NQVEKRINMI | | PKYVKQGSLRL | |
| NGSCFTVMT | | NGSCFTVMT | | NQVEKRINML | | PKYVKSDRLVL | |
| NGSCRCMFC | | NGSCRCMFC | | NQVENRINML | | PKYVKSEKLVL | |
| NGSCRCTIC | | NGSCRCTIC | | NQVEQRINML | | PKYVKSERLVL | |
| NGSCRFNVC | | NGSCRFNVC | | NQVFPQLNQT | | PKYVNIKSLKL | |
| NGSCTVVMT | | NGSCTVVMT | | NQVKIRRRVD | | PKYVNVKSLKL | |
| NGSIPNDKP | | NGSIPNDKP | | NRANQRLNPM | | PKYVNVRSLKL | |
| NGSIPNEKP | | NGSIPNEKP | | NRANQRLNTM | | PKYVRSEKLVL | |
| NGSIPNGKP | | NGSIPNGKP | | NRCFYVELIR | | PLAGSAQHVEE | |

Fig. 83-260

| Block size 8 | SIN | Block size 9 | SIN | Block size 10 | SIN | Block size 11 | SIN |
|---|---|---|---|---|---|---|---|
| NGSIPNNKP | | NGSIPNNKP | | NRCFYVELVR | | PLAIGECPKYV | |
| NGSISNDKP | | NGSISNDKP | | NRCYQFALGQ | | PLAITWWNRNG | |
| NGSLHGRIC | | NGSLHGRIC | | NRDITIGSIC | | PLALGMKNVPE | |
| NGSLQCKIC | | NGSLQCKIC | | NREFEVMNHE | | PLASLLEMCHG | |
| NGSLQCRIA | | NGSLQCRIA | | NREFEVVDHE | | PLASLLEMCHS | |
| NGSLQCRIC | | NGSLQCRIC | | NREFEVVNHE | | PLAVTWWNRKG | |
| NGSLQCRVC | | NGSLQCRVC | | NREFGVVNHE | | PLAVTWWNRNG | |
| NGSLQCTIC | | NGSLQCTIC | | NRFIEKTNQQ | | PLAVTWWNRSG | |
| NGSLRCRIC | | NGSLRCRIC | | NRFQIQGIKL | | PLCAVNSWHIL | |
| NGSYRCMFC | | NGSYRCMFC | | NRFQIQGVKL | | PLCEVNSWHIF | |
| NGTAKDRSP | | NGTAKDRSP | | NRFQIQGVRL | | PLCEVNSWHIL | |
| NGTAKHIEE | | NGTAKHIEE | | NRFYRTCKLL | | PLCEVSSWHIL | |
| NGTCAVVMT | | NGTCAVVMT | | NRFYRTCKLV | | PLCPFKGFFPF | |
| NGTCTVIMT | | NGTCTVIMT | | NRGLFGAIAG | | PLCPFQGFFPF | |
| NGTCTVVMT | | NGTCTVVMT | | NRGLFGAKAG | | PLCPFRGFFPF | |
| NGTCVVIMT | | NGTCVVIMT | | NRGSFYRSMR | | PLELGDCSIAG | |
| NGTCVVVMT | | NGTCVVVMT | | NRHSNGTIHD | | PLELGNCSIAG | |
| NGTIHDRAA | | NGTIHDRAA | | NRIFQPNIGP | | PLELRDCKIEA | |
| NGTIHDRSP | | NGTIHDRSP | | NRIFRPNIGP | | PLELRDCKVEA | |
| NGTIHDRSQ | | NGTIHDRSQ | | NRIIEKTNQQ | | PLELRDCSIAG | |
| NGTIHDRTA | | NGTIHDRTA | | NRIKINPVTL | | PLGAINTTLPF | |
| NGTIHDRTT | | NGTIHDRTT | | NRIMINPVKL | | PLGALNTTLPF | |
| NGTIKDRSP | | NGTIKDRSP | | NRINMLADRI | | PLGCKMYALHQ | |
| NGTINDRSP | | NGTINDRSP | | NRIQIDPVKL | | PLGCRMYALHQ | |
| NGTIVKTIT | | NGTIVKTIT | | NRIQIDQVKL | | PLGEAPSPYNS | |
| NGTIVKTLT | | NGTIVKTLT | | NRIQIDSVKL | | PLGSPPIVSNS | |
| NGTIVRTIT | | NGTIVRTIT | | NRIQINPVKL | | PLGSPPMVSNS | |
| NGTIVTTLT | | NGTIVTTLT | | NRIRIDPVKL | | PLGSPPVVSNS | |
| NGTKINTLT | | NGTKINTLT | | NRKEPALIVW | | PLGSSPNAYQA | |
| NGTKVDTLT | | NGTKVDTLT | | NRKEYEEEAK | | PLGTPPTVSNS | |
| NGTKVNTLT | | NGTKVNTLT | | NRKMEDGFLD | | PLHNIHPLTIG | |
| NGTLVKTIT | | NGTLVKTIT | | NRKVDDGFLD | | PLIKHENRMVL | |
| NGTMHDRSP | | NGTMHDRSP | | NRLIDKTNQQ | | PLILKDCSIAG | |
| NGTMKDRSP | | NGTMKDRSP | | NRLIDRTNHQ | | PLILKDCSVAG | |
| NGTMVKTLA | | NGTMVKTLA | | NRLIEKTNDK | | PLILRDCSVAG | |
| NGTMVKTLT | | NGTMVKTLT | | NRLIEKTNEK | | PLIRGQQGRMD | |
| NGTRVNTLT | | NGTRVNTLT | | NRLIEKTNKQ | | PLIRHENRMVI | |
| NGTSKIKMK | | NGTSKIKMK | | NRLIEKTNQQ | | PLIRHENRMVL | |
| NGTSKVKMK | | NGTSKVKMK | | NRLIEKTNTE | | PLKAEIAQKLE | |
| NGTSVKTLT | | NGTSVKTLT | | NRLIEKTNTQ | | PLKAEIAQRLE | |
| NGTTGNPII | | NGTTGNPII | | NRLIERTNEK | | PLKLVDGQDCD | |
| NGTTHDRTA | | NGTTHDRTA | | NRLIERTNQQ | | PLLSLLEMCHS | |
| NGTTVKTLT | | NGTTVKTLT | | NRLIGKTNQQ | | PLMVAYMLERE | |
| NGTVKDRSP | | NGTVKDRSP | | NRLISKTNQQ | | PLPFQNIDSRA | |
| NGTVNDRSP | | NGTVNDRSP | | NRLNINPVKL | | PLPFQNIDSWA | |
| NGTVVKTIT | | NGTVVKTIT | | NRLNINPVRL | | PLPLCPFKGFF | |
| NGTVVKTLT | | NGTVVKTLT | | NRLNINPVTL | | PLPLCPFRGFF | |
| NGTWAVVMT | | NGTWAVVMT | | NRLNINSVKL | | PLQNASRHYMG | |
| NGTYDHKDY | | NGTYDHKDY | | NRLNNVIDKM | | PLQNTSKHYIG | |
| NGTYDHKEF | | NGTYDHKEF | | NRLSINPVKL | | PLSGSAQHIEE | |
| NGTYDHKEY | | NGTYDHKEY | | NRMQFSSLTV | | PLSGSAQHVEE | |
| NGTYDHNIY | | NGTYDHNIY | | NRMQINPVKL | | PLSISVGSSTY | |
| NGTYDYPHY | | NGTYDYPHY | | NRMVIASTTA | | PLSKDNGIRIG | |
| NGTYDYPKY | | NGTYDYPKY | | NRMVLASTTA | | PLSSPPTVYNN | |
| NGTYDYPQY | | NGTYDYPQY | | NRNEIKGVKL | | PLSSPPTVYNS | |
| NGTYDYPRY | | NGTYDYPRY | | NRNFKPNIGP | | PLSSPPTVYNT | |
| NGTYDYSKY | | NGTYDYSKY | | NRNFQPNIGP | | PLTIGECPKYI | |
| NGTYNHEDY | | NGTYNHEDY | | NRNQPAATAL | | PLTIGECPKYV | |
| NGTYNHKDY | | NGTYNHKDY | | NRNWSGYSGS | | PLTIGECPRYV | |
| NGTYNHKEY | | NGTYNHKEY | | NRPIIEIDMN | | PLTIGKCPKYV | |
| NGTYNRKEY | | NGTYNRKEY | | NRPIIEIDMS | | PLTKGILGFVF | |
| NGTYNYPKY | | NGTYNYPKY | | NRPIIEIDMT | | PLTKGMLGFVF | |

Fig. 83-261

| Block size 8 | SIN | Block size 9 | SIN | Block size 10 | SIN | Block size 11 | SIN |
|---|---|---|---|---|---|---|---|
| NGTYNYPQY | | NGTYNYPQY | | NRPVIEIDMN | | PLTTTPTKSYF | |
| NGTYNYSKY | | NGTYNYSKY | | NRPVIEIDMS | | PLVLDDCSLEG | |
| NGTYSYPQY | | NGTYSYPQY | | NRPWIRFNSD | | PLVLDDCSLKG | |
| NGTYYYPKY | | NGTYYYPKY | | NRPWIRFNSN | | PLVLGDCSIAG | |
| NGVCPVVFT | | NGVCPVVFT | | NRPWIRINNE | | PLVMGQQGRMD | |
| NGVILEENT | | NGVILEENT | | NRPWISFDQN | | PLVPCEPIIIE | |
| NGVITDTLK | | NGVITDTLK | | NRPWMRINNE | | PLVREQQGRMD | |
| NGVKGFAYL | | NGVKGFAYL | | NRPWMRISNE | | PLVRGQQGRMD | |
| NGVKGFSYL | | NGVKGFSYL | | NRPWVRINNE | | PLVRGQQGTMD | |
| NGVKLEENS | | NGVKLEENS | | NRPWVRMNNE | | PLVRGQQGWMD | |
| NGVKLEENT | | NGVKLEENT | | NRPWVSFDQN | | PMGFRYSGIKT | |
| NGVKVDGSS | | NGVKVDGSS | | NRPWVSFNHN | | PMGSSPNAYQA | |
| NGVPVTSSI | | NGVPVTSSI | | NRPWVSFNQD | | PMGTAPVLGNY | |
| NGVPVTSSV | | NGVPVTSSV | | NRPWVSFNQN | | PMGVAPSPSNS | |
| NGVQDIIDN | | NGVQDIIDN | | NRQEIEGARL | | PMHQLLRHFQK | |
| NGVRLEENT | | NGVRLEENT | | NRQEIEGVKL | | PMISKCKTKEG | |
| NGVSPIHLG | | NGVSPIHLG | | NRQEIEGVRL | | PMISKCRTKEG | |
| NGVSPVHLG | | NGVSPVHLG | | NRQEIGGVKL | | PMISKCRTREG | |
| NGVTNKVNS | | NGVTNKVNS | | NRRLTTTIKP | | PMISKSRTKEG | |
| NGVWIGRTK | | NGVWIGRTK | | NRRLTTTIKT | | PMISNCRTKEG | |
| NGVWMGRTK | | NGVWMGRTK | | NRRPTTTIKT | | PMMWEINGPES | |
| NGWEGLIDG | | NGWEGLIDG | | NRSFKPNIGP | | PMRTPIAFLTS | |
| NGWEGLING | | NGWEGLING | | NRSFQPNIGP | | PNAGKDPKKTG | |
| NGWEGLVDG | | NGWEGLVDG | | NRSFRPNIGP | | PNALLKHRFEI | |
| NGWEGMIDG | | NGWEGMIDG | | NRSGYSGIFS | | PNALTDDKSKP | |
| NGWEGMMDG | | NGWEGMMDG | | NRSGYSGSFI | | PNALTDDRSKP | |
| NGWEGMVDG | | NGWEGMVDG | | NRSILNTSQR | | PNALTDERSKP | |
| NGWEGMVNG | | NGWEGMVNG | | NRSPYRALMS | | PNALTDNRSKP | |
| NGWQGLIDG | | NGWQGLIDG | | NRTFQNIDKN | | PNALTNDRSKP | |
| NGWVSTDKD | | NGWVSTDKD | | NRTFQNIDRN | | PNAPHKLCFPG | |
| NGWVSTDKN | | NGWVSTDKN | | NRTFQNVSPL | | PNAPHKLCYPG | |
| NGWVTADKD | | NGWVTADKD | | NRTGTFEFTS | | PNAPNKFCYPG | |
| NGWYGFQHQ | | NGWYGFQHQ | | NRTHQYSEKG | | PNAPNKLCFPG | |
| NGWYGFQHR | | NGWYGFQHR | | NRTHQYSERG | | PNAPNKLCYPG | |
| NGWYGFRHQ | | NGWYGFRHQ | | NRVKIDPVKL | | PNAYQAKFESV | |
| NGYCFTVMT | | NGYCFTVMT | | NRVWWTSNSI | | PNAYQAQFESV | |
| NGYIEGKLS | | NGYIEGKLS | | NRYLEEHPSA | | PNAYQARFESV | |
| NGYKDVILW | | NGYKDVILW | | NRYLEENPSA | | PNDERGNPGVK | |
| NHEDYKEES | | NHEDYKEES | | NSAAFEDLRV | | PNDGKVECVCR | |
| NHEDYREES | | NHEDYREES | | NSADHRIYWI | | PNDGQVLYFLI | |
| NHEGEGIPL | | NHEGEGIPL | | NSADHRVYWI | | PNDNASAVVWY | |
| NHGICAVAT | | NHGICAVAT | | NSAHHRVYWI | | PNECRFYALSQ | |
| NHGSLVLSL | | NHGSLVLSL | | NSALGSPGCD | | PNEERGNPGVK | |
| NHGVKGWAF | | NHGVKGWAF | | NSCIESIRNG | | PNEERGSPGVK | |
| NHKDYEEEA | | NHKDYEEEA | | NSCMETIRNG | | PNEGKVECICR | |
| NHKEYEEEA | | NHKEYEEEA | | NSDFICVGWS | | PNEGKVECVCR | |
| NHLIGKTNQ | | NHLIGKTNQ | | NSDFLCVGWS | | PNENPAHKSQL | |
| NHQFELIDN | | NHQFELIDN | | NSDFMCVGWS | | PNENPVHKSQL | |
| NHSMSDIEA | | NHSMSDIEA | | NSDLDYQIGY | | PNEVGAKILTS | |
| NHSNGTIHD | | NHSNGTIHD | | NSDLEALMEW | | PNEVGARIITS | |
| NHTDELCPS | | NHTDELCPS | | NSDLNYQIGY | | PNEVGARILTS | |
| NHTEYRQEA | | NHTEYRQEA | | NSDVLVTREP | | PNFHYEECSCY | |
| NHTGTYCSL | | NHTGTYCSL | | NSDWSGYSGS | | PNFYYEECSCY | |
| NHTTINNIT | | NHTTINNIT | | NSEFICVGWS | | PNGCIEGKLSQ | |
| NHVEVVSAK | | NHVEVVSAK | | NSEFLCVGWS | | PNGCIESKLSQ | |
| NIAEYSIDS | | NIAEYSIDS | | NSEGIGQAAD | | PNGTKVNTLTE | |
| NIAPEKVDF | | NIAPEKVDF | | NSEGMGQAAD | | PNGYIEGKLSQ | |
| NICEKLEQS | | NICEKLEQS | | NSEGRGQAAD | | PNHEGEGIPLY | |
| NICKPYIGK | | NICKPYIGK | | NSEGTGIAAD | | PNIGPRALVRG | |
| NIDKNALGD | | NIDKNALGD | | NSEGTGIVAD | | PNIGPRPFVRG | |
| NIDKNALGE | | NIDKNALGE | | NSEGTGMAAD | | PNIGPRPLIRG | |
| NIDRFLRVR | | NIDRFLRVR | | NSEGTGQAAD | | PNIGPRPLVMG | |

Fig. 83-262

| Block size 8 | SIN | Block size 9 | SIN | Block size 10 | SIN | Block size 11 | SIN |
|---|---|---|---|---|---|---|---|
| NIDRNAIGD | | NIDRNAIGD | | NSEGTGTAAD | | PNIGPRPLVRE | |
| NIDRNALGD | | NIDRNALGD | | NSEMNKLYER | | PNIGPRPLVRG | |
| NIDSRAVGK | | NIDSRAVGK | | NSFEQITFIQ | | PNIGSRPRVRN | |
| NIDSWAVGR | | NIDSWAVGR | | NSFEQITFLQ | | PNKWGDILDGV | |
| NIECVCRDN | | NIECVCRDN | | NSFEQITFMQ | | PNKWGNVLDGV | |
| NIEKNALGD | | NIEKNALGD | | NSFFSRLNWL | | PNLGIVECVCR | |
| NIERNALGD | | NIERNALGD | | NSFLAHALKL | | PNLGKVECVCR | |
| NIERNALGN | | NIERNALGN | | NSFLTHALRF | | PNLGQVECVCR | |
| NIESNGNLI | | NIESNGNLI | | NSFLVHALKS | | PNLYNIRNLHI | |
| NIFNMERIK | | NIFNMERIK | | NSFSRTELIN | | PNMGKVECVCR | |
| NIGLNVSLH | | NIGLNVSLH | | NSFSRTELIP | | PNNEKGNPGVK | |
| NIGPRALVR | | NIGPRALVR | | NSFSRTELIS | | PNNEKGNQGVK | |
| NIGPRPFVR | | NIGPRPFVR | | NSFVPVVGAR | | PNNERGNPGVK | |
| NIGPRPLIR | | NIGPRPLIR | | NSFYAELKWL | | PNNERGNQGVK | |
| NIGPRPLVM | | NIGPRPLVM | | NSGDYARLYI | | PNNERGTQGVK | |
| NIGPRPLVR | | NIGPRPLVR | | NSGKVECVCR | | PNNERGYPGVK | |
| NIGSRPRVR | | NIGSRPRVR | | NSGVKGWAFD | | PNNGKVECICR | |
| NIHPLAIGE | | NIHPLAIGE | | NSGVLVTREP | | PNNIDRAVKLY | |
| NIHPLTIGE | | NIHPLTIGE | | NSGYKDIILW | | PNNMARAVKLY | |
| NIHPLTIGK | | NIHPLTIGK | | NSHYEECSCY | | PNNMDKAVKLY | |
| NIIDKMNGN | | NIIDKMNGN | | NSIAVFCGTS | | PNNMDRAVKLY | |
| NIIEKMNGN | | NIIEKMNGN | | NSIGNLIAPR | | PNNNASAIVWY | |
| NIIFLWGIH | | NIIFLWGIH | | NSIIAFCGTS | | PNNNASAVIWY | |
| NIIFSHNGG | | NIIFSHNGG | | NSIIDKMNTQ | | PNNNASAVVWY | |
| NIKSLKLAT | | NIKSLKLAT | | NSIIEKMNTQ | | PNNNASPVIWY | |
| NILEKTHNG | | NILEKTHNG | | NSIIGKMNTQ | | PNQKIICISAA | |
| NILITQESE | | NILITQESE | | NSIINKMNTQ | | PNQKIICISAT | |
| NILKGKFQT | | NILKGKFQT | | NSIISMCSST | | PNQKIICISTT | |
| NILKTQESE | | NILKTQESE | | NSIIVFCGTS | | PNQKIITIGSA | |
| NILLHIASI | | NILLHIASI | | NSIRIGSKGD | | PNQKIITIGSI | |
| NILLHIVSI | | NILLHIVSI | | NSIRIGSRGD | | PNQKIITIGSM | |
| NILLHVASI | | NILLHVASI | | NSIRLAAGGD | | PNQKIITIGSV | |
| NILLSPEEV | | NILLSPEEV | | NSIRLSADGD | | PNQKILCASAT | |
| NILRTQDSE | | NILRTQDSE | | NSIRLSAGGA | | PNQKILCTSAI | |
| NILRTQESE | | NILRTQESE | | NSIRLSAGGD | | PNQKILCTSAT | |
| NILRTQESS | | NILRTQESS | | NSIRLSAGGH | | PNQKILFASAT | |
| NILSIAPIM | | NILSIAPIM | | NSIRLSAGGN | | PNQKIMCISAT | |
| NILSMAPIM | | NILSMAPIM | | NSIRLSASGD | | PNQKITCISAT | |
| NIMASQGTK | | NIMASQGTK | | NSIVAFCGTS | | PNQKLFALSGV | |
| NIMRTQESE | | NIMRTQESE | | NSIVALCGSK | | PNQKLFASSGI | |
| NINFMPYIS | | NINFMPYIS | | NSIVALCGSR | | PNQKLFTLSGV | |
| NINIREWSY | | NINIREWSY | | NSIVSMCSST | | PNQMIITIGSA | |
| NINPVKLSS | | NINPVKLSS | | NSIVTFCGLD | | PNQRILCTSAT | |
| NINPVTLSS | | NINPVTLSS | | NSIVTFCGLN | | PNQSIITIGSA | |
| NINRITYGA | | NINRITYGA | | NSIVVFCGTP | | PNSGKVECVCR | |
| NINSVKLSS | | NINSVKLSS | | NSIVVFCGTS | | PNSHYEECSCY | |
| NIPEKQTRG | | NIPEKQTRG | | NSIVVFCSTS | | PNTLLKHRFEI | |
| NIPERQTRG | | NIPERQTRG | | NSIWTSSSST | | PNVLLKHRFEI | |
| NIPGKQAKG | | NIPGKQAKG | | NSIYASPQLE | | PNVRCVCRDNW | |
| NIPQIESRG | | NIPQIESRG | | NSKFESVAWS | | PNWSGYSGSFT | |
| NIPSIQSRG | | NIPSIQSRG | | NSLIALCGSP | | PNYHYEECSCY | |
| NIPSVQSRG | | NIPSVQSRG | | NSLKLAIGLR | | PNYQSLRSILA | |
| NIPVTQTME | | NIPVTQTME | | NSLVALCGSP | | PNYYYEECSCY | |
| NIPVTQVEE | | NIPVTQVEE | | NSLYASPQLE | | PPEQSKMQFSS | |
| NIQFEAVGR | | NIQFEAVGR | | NSLYASSQLE | | PPEQSRMQFSS | |
| NIQFTAVGK | | NIQFTAVGK | | NSLYSSPQLE | | PPKQSRMQFSS | |
| NIQFTSVGK | | NIQFTSVGK | | NSMVTFCGLD | | PPLELGDCSIA | |
| NIREWSYLI | | NIREWSYLI | | NSNAITRSGQ | | PPLELGDCSIT | |
| NIRIGSKGD | | NIRIGSKGD | | NSNCKDPNNE | | PPLELRDCSIA | |
| NIRNLHIPE | | NIRNLHIPE | | NSNCRDPNNE | | PPLVLGDCSIA | |
| NISSRSGFE | | NISSRSGFE | | NSNCRNPNNE | | PPQCDLHLEFK | |
| NITAASLND | | NITAASLND | | NSNGVQDIID | | PPQCDSHLKFK | |

Fig. 83-263

| Block size 8 | SIN | Block size 9 | SIN | Block size 10 | SIN | Block size 11 | SIN |
|---|---|---|---|---|---|---|---|
| NITEIVYLN | | NITEIVYLN | | NSNLDYQIGY | | PPVNGQSGRID | |
| NITFSDNGG | | NITFSDNGG | | NSNNGVKGFS | | PPVQSKMQFSS | |
| NITFSHNGG | | NITFSHNGG | | NSNWSGYSGI | | PPVQSRMQFSS | |
| NITKIVYLN | | NITKIVYLN | | NSNWSGYSGS | | PPYSHGTGTGY | |
| NITVTHAQD | | NITVTHAQD | | NSPGRVTVST | | PQAQDRGLFGA | |
| NITVTHSVE | | NITVTHSVE | | NSPLPFQNID | | PQAQNRGLFGA | |
| NITVTHSVN | | NITVTHSVN | | NSQASYKIFK | | PQCDLHLEFKA | |
| NITVTSSVE | | NITVTSSVE | | NSQDTEISFT | | PQCDSHLKFKA | |
| NIVDKMNRE | | NIVDKMNRE | | NSQDTELSFT | | PQCEITGFAPF | |
| NIVRRAAVS | | NIVRRAAVS | | NSQDTEVSFT | | PQCKITGFAPF | |
| NIVRRAIVS | | NIVRRAIVS | | NSQGEGTAAD | | PQCQIAGFAPF | |
| NIVRRATVS | | NIVRRATVS | | NSQGSGYAAD | | PQCQITGFAPF | |
| NIWAYNAEL | | NIWAYNAEL | | NSRFESVAWS | | PQCQVTGFAPF | |
| NIWITREPY | | NIWITREPY | | NSSCAAMDDF | | PQENRVWWTSN | |
| NIWSYNAQL | | NIWSYNAQL | | NSSDICYPGK | | PQETKVWWTSN | |
| NIYKILSIY | | NIYKILSIY | | NSSDICYPGR | | PQETRVWWTSN | |
| NIYRDEAIN | | NIYRDEAIN | | NSSDKVDTLL | | PQETRVWWTSS | |
| NKACELTDS | | NKACELTDS | | NSSDTVDTLT | | PQIEARGLFGA | |
| NKADHRIYW | | NKADHRIYW | | NSSEKVDTLL | | PQIEPRGLFGA | |
| NKCIERVRN | | NKCIERVRN | | NSSEKVNTLL | | PQIESRGLFGA | |
| NKCIESIRN | | NKCIESIRN | | NSSERVDTLL | | PQINGQSGRID | |
| NKCMETIKN | | NKCMETIKN | | NSSILTDSQT | | PQIQNRGLFGA | |
| NKCYQFALG | | NKCYQFALG | | NSSKPFQNAS | | PQLEGFSAESR | |
| NKDGDIIFL | | NKDGDIIFL | | NSSKPFQNTS | | PQLNPIDGPLP | |
| NKFAAICTH | | NKFAAICTH | | NSSKPLQNAS | | PQLNQTYRNNR | |
| NKFASICTH | | NKFASICTH | | NSSLTHALRE | | PQLNQTYRNTR | |
| NKHSNDTIH | | NKHSNDTIH | | NSSMPFHNIH | | PQMESRGLFGA | |
| NKHSNDTVH | | NKHSNDTVH | | NSSMPFHNVH | | PQMNGQSGRID | |
| NKHSNGTIH | | NKHSNGTIH | | NSSMPLHNIH | | PQSGRIVVDYM | |
| NKHSNGTKH | | NKHSNGTKH | | NSSMQCRICI | | PQSSPPTVYNS | |
| NKHSNGTTH | | NKHSNGTTH | | NSSRPFQNAS | | PQTANTYRNTD | |
| NKHSNSTTH | | NKHSNSTTH | | NSSYVCSGLV | | PQTESRGLFGA | |
| NKHWSGYSG | | NKHWSGYSG | | NSTCVVVMTD | | PQTTNTYRNTD | |
| NKIEFEPFQ | | NKIEFEPFQ | | NSTDKIDTLT | | PQVNGQFGRID | |
| NKINNIVDK | | NKINNIVDK | | NSTDKVDTII | | PQVNGQSGRID | |
| NKITNKVNN | | NKITNKVNN | | NSTDKVDTLT | | PQVNGQSGRIN | |
| NKITYGACP | | NKITYGACP | | NSTDKVNTII | | PQVQDRGLFGA | |
| NKKIDDGFL | | NKKIDDGFL | | NSTDTVDTIL | | PQVQNRGLFGA | |
| NKKMEDGFL | | NKKMEDGFL | | NSTDTVDTLI | | PQYPNVRCVCR | |
| NKKVDDGFI | | NKKVDDGFI | | NSTDTVDTLL | | PRALVRGQQGR | |
| NKKVDDGFL | | NKKVDDGFL | | NSTDTVDTLT | | PRFLPDLYDYK | |
| NKKVDDGLL | | NKKVDDGLL | | NSTDTVDTVL | | PRGHYKISKST | |
| NKKYGPALS | | NKKYGPALS | | NSTDTVNTLI | | PRGLFGAIAGF | |
| NKLAAICTH | | NKLAAICTH | | NSTDTVNTLM | | PRGLLEVGTRW | |
| NKLEFEPFQ | | NKLEFEPFQ | | NSTDTVNTLT | | PRIFLAMITYI | |
| NKLFERVRR | | NKLFERVRR | | NSTEHVDTIM | | PRLLQNSQVFS | |
| NKLITVGSS | | NKLITVGSS | | NSTEKVDTII | | PRLRSGFEMLK | |
| NKLNNVIDK | | NKLNNVIDK | | NSTEKVDTLL | | PRMCSLMQGST | |
| NKLYEKVRR | | NKLYEKVRR | | NSTEQVDTIM | | PRMFLAMITYI | |
| NKLYERVKR | | NKLYERVKR | | NSTERVDTII | | PRNDDSSSNSN | |
| NKLYERVRK | | NKLYERVRK | | NSTERVDTIM | | PRNDDSSSSSN | |
| NKLYERVRR | | NKLYERVRR | | NSTETVNTLI | | PRNEDGSSSSN | |
| NKLYGAGNK | | NKLYGAGNK | | NSTETVNTLS | | PRNEDSSSNSN | |
| NKLYGTGNK | | NKLYGTGNK | | NSTETVNTLT | | PRNEDSSSSSN | |
| NKLYVNKNP | | NKLYVNKNP | | NSTKQVDTIM | | PRPFVRGQQGR | |
| NKMARLGKG | | NKMARLGKG | | NSTNTVNTLI | | PRPLIRGQQGR | |
| NKMARLGRG | | NKMARLGRG | | NSTTHDRTAF | | PRPLVMGQQGR | |
| NKMEFEPFQ | | NKMEFEPFQ | | NSTVQVDTIM | | PRPLVREQQGR | |
| NKMNTQFEA | | NKMNTQFEA | | NSTVVNNITT | | PRPLVRGQQGR | |
| NKNATATVY | | NKNATATVY | | NSTYKILSIY | | PRPLVRGQQGT | |
| NKNEIKGVK | | NKNEIKGVK | | NSVIEKINTQ | | PRPLVRGQQGW | |
| NKNPYTLVS | | NKNPYTLVS | | NSVIEKMNIQ | | PRPRRGLFGAI | |

Fig. 83-264

| Block size 8 | SIN | Block size 9 | SIN | Block size 10 | SIN | Block size 11 | SIN |
|---|---|---|---|---|---|---|---|
| NKNWSGYSG | | NKNWSGYSG | | NSVIEKMNTQ | | PRRGLFGAIAG | |
| NKPFQNVNK | | NKPFQNVNK | | NSVKLFSGYK | | PRRSGAAGAAI | |
| NKQASYKIF | | NKQASYKIF | | NSVKLSSGYK | | PRRSGAAGAAV | |
| NKQFELIDN | | NKQFELIDN | | NSVRIGSKGD | | PRSRNGFEMLK | |
| NKRLCKVEG | | NKRLCKVEG | | NSVRLSAGGD | | PRSRSGFEMLK | |
| NKRMEDGFL | | NKRMEDGFL | | NSVVEKMNTQ | | PRSRSGFEMLR | |
| NKRMEDGLL | | NKRMEDGLL | | NSVVVFCGTS | | PRTFLAMITYI | |
| NKRMENGFL | | NKRMENGFL | | NSWHIFGKDN | | PRTREILTKTT | |
| NKRMQDGFL | | NKRMQDGFL | | NSWHIFSKDN | | PRTTNTYRNTD | |
| NKRMQDGFM | | NKRMQDGFM | | NSWHILSKDN | | PRTVGQCPKYV | |
| NKRYGPALS | | NKRYGPALS | | NSWHIYGKDN | | PRVFLAMITYI | |
| NKSLCKIEG | | NKSLCKIEG | | NSWLGRTISK | | PRVFLTMITYI | |
| NKSLCKVEG | | NKSLCKVEG | | NSWLGRTTSK | | PRVRNQSGRIS | |
| NKSLCNVEG | | NKSLCNVEG | | NSWSYIVEKP | | PRYGYIIEEYG | |
| NKSLCSVEG | | NKSLCSVEG | | NTALLNASCA | | PRYGYIIEKYG | |
| NKTFQNIDK | | NKTFQNIDK | | NTALSTIALL | | PRYIPSGSLKL | |
| NKTFQNIDR | | NKTFQNIDR | | NTAMLNASCA | | PRYLPDLYDYK | |
| NKTFQNIEK | | NKTFQNIEK | | NTASRSGYEM | | PRYNGQRSWMK | |
| NKTFQNIER | | NKTFQNIER | | NTCIESIRNG | | PRYPDVRCVCR | |
| NKTFQNISP | | NKTFQNISP | | NTCMETIRNG | | PRYPNVRCVCR | |
| NKTFQNVSP | | NKTFQNVSP | | NTDLEALMEW | | PRYVKQGSLKL | |
| NKTGTFEFT | | NKTGTFEFT | | NTDLEVLMEW | | PRYVKQSSLPL | |
| NKTKKMTIT | | NKTKKMTIT | | NTDLGAPLEL | | PRYVKSEKLVL | |
| NKTVINNIT | | NKTVINNIT | | NTDLGSPLEL | | PSAGKDPKKTG | |
| NKVARLGKG | | NKVARLGKG | | NTDLGTPLEL | | PSAGRDPKKTG | |
| NKVCTKGKK | | NKVCTKGKK | | NTDWSGYSGS | | PSAIDQITGKL | |
| NKVEFEPFQ | | NKVEFEPFQ | | NTEFESIESE | | PSAPEGMCYPG | |
| NKVKEIGNG | | NKVKEIGNG | | NTELLVLMEN | | PSAPGVKGFGF | |
| NKVNNIVDK | | NKVNNIVDK | | NTEPLCDVSG | | PSAPHGLCYPG | |
| NKVNSIIDK | | NKVNSIIDK | | NTEPLCEVSG | | PSAPHRLCYPG | |
| NKVNSIIEK | | NKVNSIIEK | | NTEPLCNVSG | | PSCASNINIRE | |
| NKVNSIIGK | | NKVNSIIGK | | NTFGDCPKYV | | PSCATNINIRE | |
| NKVNSIINK | | NKVNSIINK | | NTGSYVRLYL | | PSDAQAFYKIL | |
| NKVNSVIEK | | NKVNSVIEK | | NTIDLTDSEM | | PSDAQAFYKLL | |
| NKVNSVVEK | | NKVNSVVEK | | NTIGDCPKYM | | PSDTPRGEDAQ | |
| NKVRMQLRD | | NKVRMQLRD | | NTIGDCPKYV | | PSDTPRGEDGQ | |
| NKWGDILDG | | NKWGDILDG | | NTIGNCPKYV | | PSDTPRGEDNQ | |
| NKWGNVLDG | | NKWGNVLDG | | NTIGNLIAPR | | PSDTPRGEDSQ | |
| NKYLEEHPN | | NKYLEEHPN | | NTIGNLVAPR | | PSECRTFFLTQ | |
| NKYLEEHPS | | NKYLEEHPS | | NTIIENNVTV | | PSERGLQRRRF | |
| NKYVNNTTI | | NKYVNNTTI | | NTIIESNVTV | | PSFFRNMIWLT | |
| NLAFNAVIH | | NLAFNAVIH | | NTILEKNVTV | | PSFFRNMVWLT | |
| NLALDIVDS | | NLALDIVDS | | NTILSTKALL | | PSFGVSGINES | |
| NLCQVECVC | | NLCQVECVC | | NTINRIFQPN | | PSFGVSGVNES | |
| NLCRFLETR | | NLCRFLETR | | NTINRNFQPN | | PSFYAEMKWLL | |
| NLCYPGSLN | | NLCYPGSLN | | NTINRSFQPN | | PSGCKMYALHQ | |
| NLDLNMGQP | | NLDLNMGQP | | NTINRSFRPN | | PSGIEYNGKSL | |
| NLDYQIGYV | | NLDYQIGYV | | NTINSKIDDQ | | PSGPLKAEIAQ | |
| NLEELRFVF | | NLEELRFVF | | NTKCQTSLGG | | PSGSLKLAIGL | |
| NLEKRLENL | | NLEKRLENL | | NTKCQTSMGG | | PSGSLKLAIGP | |
| NLEPGTFDI | | NLEPGTFDI | | NTKCQTSVGG | | PSGVEYNGKSL | |
| NLEPGTFDL | | NLEPGTFDL | | NTKCQTYAGA | | PSGYAQTDCVL | |
| NLERRLENL | | NLERRLENL | | NTKLPFQNLS | | PSHEGEGIPLC | |
| NLFDEVKRR | | NLFDEVKRR | | NTKWNENQNP | | PSHEGEGIPLH | |
| NLFDEVRRR | | NLFDEVRRR | | NTLAERGVEV | | PSHEGEGIPLY | |
| NLFEKFFPS | | NLFEKFFPS | | NTLIEQNIPV | | PSIDPKGLFGA | |
| NLGKVECVC | | NLGKVECVC | | NTLIEQNVPV | | PSIEPKGLFGA | |
| NLGLNIGIH | | NLGLNIGIH | | NTLKLATGMR | | PSIEPRGLFGA | |
| NLGLNIGLH | | NLGLNIGLH | | NTLLENDVPV | | PSIMSCDSPSN | |
| NLGLNVGLH | | NLGLNVGLH | | NTLRTQESEC | | PSIQSRGLFGA | |
| NLGQVECVC | | NLGQVECVC | | NTLSEQNVPV | | PSIWTSSSSTV | |
| NLHAYISFR | | NLHAYISFR | | NTLSSVNTNT | | PSKWGDILEGT | |

Fig. 83-265

| Block size 8 | SIN | Block size 9 | SIN | Block size 10 | SIN | Block size 11 | SIN |
|---|---|---|---|---|---|---|---|
| NLHIPEAGL | | NLHIPEAGL | | NTLSSVTTNT | | PSKWGDVLDGV | |
| NLHIPEVCL | | NLHIPEVCL | | NTLTEKGIEV | | PSKWGNVLDGV | |
| NLIAPEFGY | | NLIAPEFGY | | NTLTEKGVEV | | PSLRMKWMMAM | |
| NLIAPEYGF | | NLIAPEYGF | | NTLTEQNVPV | | PSNAQAFYKIL | |
| NLIAPEYGH | | NLIAPEYGH | | NTLTEREVEV | | PSNMDRAVKLY | |
| NLIAPEYGY | | NLIAPEYGY | | NTLTERGIEV | | PSNSLKLAIGL | |
| NLIAPLYGH | | NLIAPLYGH | | NTLTERGVEV | | PSNSRFESVAW | |
| NLIAPRGHY | | NLIAPRGHY | | NTLTSVTTNT | | PSPGARPKVNG | |
| NLIAPRGYF | | NLIAPRGYF | | NTMHQLLRHF | | PSPGDRPKVNG | |
| NLIAPRGYY | | NLIAPRGYY | | NTMTKDAERG | | PSPLKLVDGQD | |
| NLIAPWFGH | | NLIAPWFGH | | NTNGEQILII | | PSPSNSRFESV | |
| NLIAPWYAF | | NLIAPWYAF | | NTNKTFQNID | | PSPYNSKFESV | |
| NLIAPWYAY | | NLIAPWYAY | | NTNKTFQNIE | | PSPYNSRFESV | |
| NLIAPWYGH | | NLIAPWYGH | | NTNRTFQNID | | PSQKLFALSGV | |
| NLIAPWYGY | | NLIAPWYGY | | NTNTINRSFQ | | PSRSLKLAIGL | |
| NLIFNAVIH | | NLIFNAVIH | | NTNTLSSVTT | | PSSAQEKNDLY | |
| NLIFNTVIH | | NLIFNTVIH | | NTPSIDPKGL | | PSSDNEQTDLY | |
| NLIGKTSWS | | NLIGKTSWS | | NTPSIEPKGL | | PSSSYRRPIGI | |
| NLIIERREG | | NLIIERREG | | NTPSIEPRGL | | PSSSYRRPVGI | |
| NLIIERSEG | | NLIIERSEG | | NTPSVEPKGL | | PSSTKEKNDLY | |
| NLIIGISNV | | NLIIGISNV | | NTPSVEPRGL | | PSSTKEKNELY | |
| NLIVERREG | | NLIVERREG | | NTQFEAIGRE | | PSSTQEKNDLY | |
| NLIVFNTIG | | NLIVFNTIG | | NTQFEAVGKE | | PSSTQERNDLY | |
| NLKLATGLR | | NLKLATGLR | | NTQFEAVGRE | | PSTGKDPKKTG | |
| NLLENLQAY | | NLLENLQAY | | NTQFELIDNE | | PSTGNHGSLVL | |
| NLLHKCNDS | | NLLHKCNDS | | NTQFETVGKE | | PSTISCDSPSN | |
| NLLIGISNI | | NLLIGISNI | | NTQFTAVGKE | | PSTMSCDSPSN | |
| NLLIGISNM | | NLLIGISNM | | NTQFTSVGKE | | PSTVSCDSPSN | |
| NLLIGISNV | | NLLIGISNV | | NTQFTVVGKE | | PSVEPKGLFGA | |
| NLLIGVSNV | | NLLIGVSNV | | NTQGEGTAAD | | PSVEPRGLFGA | |
| NLNDATYQR | | NLNDATYQR | | NTQIIVILVL | | PSVKLPMGAIN | |
| NLNDTTYQR | | NLNDTTYQR | | NTRCQTSVGG | | PSVQSRGLFGA | |
| NLNKKIDDG | | NLNKKIDDG | | NTRKEPALIV | | PSVVSCDSPSN | |
| NLNKKMEDG | | NLNKKMEDG | | NTRLPFQNLS | | PSWAGNILRTQ | |
| NLNKKVDDG | | NLNKKVDDG | | NTSGEQMLII | | PSWAGNVLRTQ | |
| NLNKKVEDG | | NLNKKVEDG | | NTSGEQMLVI | | PSWEGNILRTQ | |
| NLNKRMEDG | | NLNKRMEDG | | NTSGEQVLVI | | PTAPHGLCYPG | |
| NLNKRMENG | | NLNKRMENG | | NTSKHYIGKC | | PTAVDTCYPFD | |
| NLNKRMQDG | | NLNKRMQDG | | NTSKPFQNIC | | PTDTPRGEDSQ | |
| NLNKRVDDG | | NLNKRVDDG | | NTSKPFQNTS | | PTDVIRSWRKQ | |
| NLNRKMEDG | | NLNRKMEDG | | NTSKPLQNTS | | PTDVVRSWKKQ | |
| NLNRKVDDG | | NLNRKVDDG | | NTSQRGILED | | PTDVVRSWRKK | |
| NLNWSGYSG | | NLNWSGYSG | | NTSQRGVLED | | PTDVVRSWRKQ | |
| NLPFQNINS | | NLPFQNINS | | NTSRHYIGKC | | PTDVVRSWRRQ | |
| NLPFQNVHP | | NLPFQNVHP | | NTSRHYMGEC | | PTECRTFFLTQ | |
| NLPFQNVNS | | NLPFQNVNS | | NTSYKILSIY | | PTEEQAVDICK | |
| NLQAYQKRM | | NLQAYQKRM | | NTTGRDVLVI | | PTEEQAVEICK | |
| NLQTYQKRM | | NLQTYQKRM | | NTTGRDVLVL | | PTEEQAVGICK | |
| NLSGYSGSF | | NLSGYSGSF | | NTTGRDVLVM | | PTEEQAVNICK | |
| NLSKRMEDG | | NLSKRMEDG | | NTTLIENTYV | | PTFDSLNITAA | |
| NLSPRTVGQ | | NLSPRTVGQ | | NTTLPFHNIH | | PTFSVQRNLPF | |
| NLTKELCTI | | NLTKELCTI | | NTTLPFHNVH | | PTFSVQRSLPF | |
| NLTKGLCTI | | NLTKGLCTI | | NTTLSTIALF | | PTGCKMYALHQ | |
| NLTKINNGD | | NLTKINNGD | | NTTLSTIALI | | PTGYAQTDCVL | |
| NLTKRLCTI | | NLTKRLCTI | | NTTLSTIALL | | PTKSYFANLKG | |
| NLTKTNNGD | | NLTKTNNGD | | NTTNYYNETF | | PTTEINTWARN | |
| NLTKVNNGD | | NLTKVNNGD | | NTTVVENTYV | | PTWAGNILRTQ | |
| NLTKVNNGN | | NLTKVNNGN | | NTTYKILSIY | | PVAEINTWARN | |
| NLTKVNSGD | | NLTKVNSGD | | NTTYRILSIY | | PVAKAGFIENG | |
| NLTRELCTI | | NLTRELCTI | | NTVINNITTT | | PVGEAPSPYNS | |
| NLTRGLCTI | | NLTRGLCTI | | NTVKDRSPYR | | PVGGNEKKAKL | |
| NLVAPEYGF | | NLVAPEYGF | | NTVVNNITTT | | PVGISSMGEAM | |

Fig. 83-266

| Block size 8 | SIN | Block size 9 | SIN | Block size 10 | SIN | Block size 11 | SIN |
|---|---|---|---|---|---|---|---|
| NLVAPRGHY | | NLVAPRGHY | | NTWARNILRT | | PVGISSMMEAM | |
| NLVAPRGYF | | NLVAPRGYF | | NTWLGRTFSP | | PVGISSMVEAM | |
| NLVAPWYAY | | NLVAPWYAY | | NTWLGRTISI | | PVGPGSFPDGA | |
| NLVAPWYGH | | NLVAPWYGH | | NTWLGRTISP | | PVGSGSFPDGA | |
| NLVFNTVIH | | NLVFNTVIH | | NTWLGRTIST | | PVGTAPVLGNY | |
| NLWAYNAEL | | NLWAYNAEL | | NTWLGRTLNT | | PVGVAPSPSNS | |
| NLYASKNPY | | NLYASKNPY | | NTWVGRTISI | | PVHFQNQVKIR | |
| NLYDKVRFQ | | NLYDKVRFQ | | NTYDHAQYRE | | PVHFRNQIKIR | |
| NLYDKVRHQ | | NLYDKVRHQ | | NTYDHSHYRE | | PVHFRNQVKIR | |
| NLYDKVRLQ | | NLYDKVRLQ | | NTYDHSQYRE | | PVHFRSQVKIR | |
| NLYDKVRMQ | | NLYDKVRMQ | | NTYDHTQYRE | | PVHKSQLIWMA | |
| NLYDRVRKQ | | NLYDRVRKQ | | NTYINNATII | | PVHKSQLVWMA | |
| NLYDRVRLQ | | NLYDRVRLQ | | NTYINNTTII | | PVHLGDCNFEG | |
| NLYDRVRMQ | | NLYDRVRMQ | | NTYNHTEYRQ | | PVHLGDCRFEG | |
| NLYEKVRLQ | | NLYEKVRLQ | | NTYNHTQYRE | | PVHLGDCSFEG | |
| NLYEKVRMQ | | NLYEKVRMQ | | NTYQWIIKNW | | PVIGARPQVNG | |
| NLYERVRKQ | | NLYERVRKQ | | NTYQWIIRNW | | PVKGWAPLSKD | |
| NLYGFIIKG | | NLYGFIIKG | | NTYQWVIRNW | | PVKLSGGYKDI | |
| NLYGFIVKG | | NLYGFIVKG | | NTYVNKTTVI | | PVKLSGGYKDV | |
| NLYNIRNLH | | NLYNIRNLH | | NTYVNNTTII | | PVKLSSGYKDI | |
| NLYNKVRLQ | | NLYNKVRLQ | | NTYVNNTTVI | | PVKLSSGYKDV | |
| NLYNKVRMQ | | NLYNKVRMQ | | NVECVCRDNW | | PVLTDNPRPND | |
| NLYVNKNPY | | NLYVNKNPY | | NVEGWVVIAK | | PVMGARPQVNG | |
| NMADYSIDS | | NMADYSIDS | | NVELLVLMEN | | PVNGQSGRIDF | |
| NMAPEKIDF | | NMAPEKIDF | | NVENLFDEVR | | PVNNGKGRYGV | |
| NMAPEKMDF | | NMAPEKMDF | | NVESNGNLIA | | PVPVGSGSFPD | |
| NMAPEKVDF | | NMAPEKVDF | | NVESNGNLVA | | PVQGFFPFHKD | |
| NMARAVKLY | | NMARAVKLY | | NVGLNISLHL | | PVQNAISTTFP | |
| NMDKAVKLY | | NMDKAVKLY | | NVGLNMSLHL | | PVQTDEYKNTG | |
| NMDRAVKLY | | NMDRAVKLY | | NVGLNVSLHL | | PVQTDEYKNTR | |
| NMEDYSIDS | | NMEDYSIDS | | NVGYLCAGIP | | PVSVGSGSFPD | |
| NMERIKELR | | NMERIKELR | | NVHPLAIGEC | | PVTEINTWARN | |
| NMGIYQILA | | NMGIYQILA | | NVHPLTIGEC | | PVTIGECPKYV | |
| NMGKVECVC | | NMGKVECVC | | NVHRNAIGDC | | PVTIGKCPKYV | |
| NMGVYQILA | | NMGVYQILA | | NVHRNTIGDC | | PVTLTMGYKDI | |
| NMGVYQVLA | | NMGVYQVLA | | NVHRNTIGNC | | PVTQAMELVEA | |
| NMHDANVRN | | NMHDANVRN | | NVHRSTIGDC | | PVTQTMELVEA | |
| NMIADRVDD | | NMIADRVDD | | NVIDKMNKQF | | PVTQTMELVET | |
| NMINDKIDD | | NMINDKIDD | | NVIDKMNKQL | | PVTQVEELVHG | |
| NMINDKIND | | NMINDKIND | | NVIDKMNNQF | | PVTQVEELVHR | |
| NMINNDLGP | | NMINNDLGP | | NVIDKMYKQF | | PVTSSIDLIET | |
| NMINSKIDD | | NMINSKIDD | | NVILWFSFGA | | PVTSSIDLVET | |
| NMINSKIED | | NMINSKIED | | NVINDKIDDQ | | PVTSSVDLIET | |
| NMINSKIND | | NMINSKIND | | NVINWTKDSI | | PVTSSVDLVET | |
| NMINSQIDD | | NMINSQIDD | | NVINWTQDAM | | PVTSTIDLIET | |
| NMISDKIDD | | NMISDKIDD | | NVINWTRDAM | | PVVFTDGSATG | |
| NMLADRIDD | | NMLADRIDD | | NVINWTRDSI | | PVVGARPKVNG | |
| NMLADRVDD | | NMLADRVDD | | NVINWTRDSL | | PVVGARPQVNG | |
| NMLADWVDD | | NMLADWVDD | | NVINWTRDSM | | PVVRARPQVNG | |
| NMLSTVLGV | | NMLSTVLGV | | NVINWTRDSV | | PWARNILRTQE | |
| NMNKRMEDG | | NMNKRMEDG | | NVKELGNGCF | | PWIRFNSDLDY | |
| NMNWSGYSG | | NMNWSGYSG | | NVKNLFDEVK | | PWIRFNSDPDY | |
| NMQNKLNNV | | NMQNKLNNV | | NVKNLFDEVR | | PWIRFNSNLDY | |
| NMQNRLNNV | | NMQNRLNNV | | NVKNLHDQIK | | PWIRINNETIL | |
| NMRCTISLV | | NMRCTISLV | | NVKNLHEQVK | | PWMRINNETIL | |
| NMRWLTLKS | | NMRWLTLKS | | NVKNLHEQVR | | PWMRINNETIV | |
| NMSKKKSYI | | NMSKKKSYI | | NVKNLYDKVR | | PWMRISNETIL | |
| NMSKRKSYI | | NMSKRKSYI | | NVKNLYDRVR | | PWVLLNASWFN | |
| NMSLNISLY | | NMSLNISLY | | NVKNLYEKVR | | PWVRFNSDLDY | |
| NMTNVQNNY | | NMTNVQNNY | | NVKNLYNKVR | | PWVRINNETIL | |
| NMVDYSIDS | | NMVDYSIDS | | NVKSLKLAIG | | PYIGKCPKYIP | |
| NNADHRIYW | | NNADHRIYW | | NVKSLKLASG | | PYLNGREWSYI | |

Fig. 83-267

| Block size 8 | SIN | Block size 9 | SIN | Block size 10 | SIN | Block size 11 | SIN |
|---|---|---|---|---|---|---|---|
| NNADHRVYW | | NNADHRVYW | | NVKSLKLATG | | PYNSKFESVAW | |
| NNAIDEGDG | | NNAIDEGDG | | NVLDGVTASC | | PYNSRFESVAW | |
| NNAKDEGNG | | NNAKDEGNG | | NVLIGQGDIV | | PYPGNNBNGVK | |
| NNAKEIGNG | | NNAKEIGNG | | NVLIGQGDVV | | PYPGNNNKGVK | |
| NNAKELGNG | | NNAKELGNG | | NVLLKHRFEI | | PYPGNNNNGVK | |
| NNAKEVGNG | | NNAKEVGNG | | NVLLSPEEVS | | PYPGSNNNGVK | |
| NNAQEIGNG | | NNAQEIGNG | | NVLRTQESEC | | PYRALISWEMG | |
| NNARELGNG | | NNARELGNG | | NVLSIAPIMF | | PYRALMSVPLG | |
| NNASAIVWY | | NNASAIVWY | | NVLSVAPIMF | | PYRALMSVPMG | |
| NNASAVIWY | | NNASAVIWY | | NVNKITYGAC | | PYRSLIQFPIG | |
| NNASAVVWY | | NNASAVVWY | | NVNRITYGAC | | PYRSLIQFPMG | |
| NNASTVIWY | | NNASTVIWY | | NVNRITYGPC | | PYRSLIRFPIG | |
| NNATASFIY | | NNATASFIY | | NVNRITYGVC | | PYRSLIRFPVG | |
| NNATATVYY | | NNATATVYY | | NVPEKIHTRG | | PYRTLLMNELG | |
| NNATDTVDT | | NNATDTVDT | | NVPEKIRTRG | | PYRTLLMSELG | |
| NNBNGVKGF | | NNBNGVKGF | | NVPEKIRVKR | | PYSHGTGTGYT | |
| NNCESKCFW | | NNCESKCFW | | NVPEWSYIVE | | PYTGDPPYSHG | |
| NNCIESIRN | | NNCIESIRN | | NVPQAQDRGL | | PYTLVSTGSWS | |
| NNCMESIRN | | NNCMESIRN | | NVPQAQNRGL | | PYTLVSTKEWS | |
| NNDLGPATA | | NNDLGPATA | | NVPQIEPRGL | | PYTLVSTKSWS | |
| NNDNATATV | | NNDNATATV | | NVPQIESRGL | | PYTLVSTRSWS | |
| NNDWSGYSG | | NNDWSGYSG | | NVPQIQNRGL | | PYTLVSTSSWS | |
| NNECMETIK | | NNECMETIK | | NVPQMESRGL | | PYTLVTTSSWS | |
| NNEDGDIIF | | NNEDGDIIF | | NVPQVQDRGL | | PYVSCDPDECR | |
| NNEDGNIIF | | NNEDGNIIF | | NVPQVQNRGL | | PYVSCDPDGCR | |
| NNEEGDIIF | | NNEEGDIIF | | NVPSIQSRGL | | PYVSCDPLGCK | |
| NNEGSYFFG | | NNEGSYFFG | | NVPVTQAMEL | | PYVSCDPLGCR | |
| NNEKGNPGV | | NNEKGNPGV | | NVPVTQTMEL | | PYVSCDPNECR | |
| NNEKGNQGV | | NNEKGNQGV | | NVPVTQVEEL | | PYVSCDPSGCK | |
| NNENATATV | | NNENATATV | | NVRCVCRDNW | | PYVSCDPTGCK | |
| NNENGDIIF | | NNENGDIIF | | NVRGSGLRIL | | PYVSCEPDECR | |
| NNEPGSGNW | | NNEPGSGNW | | NVRGSGMRIL | | QAADLKSTQAA | |
| NNEPSGYAQ | | NNEPSGYAQ | | NVRGSGMRVL | | QAADLKSTQTA | |
| NNEQGSGYA | | NNEQGSGYA | | NVRGTGMRIL | | QAADYESTQAA | |
| NNERGNPGV | | NNERGNPGV | | NVRNLHDQIK | | QAADYKSTQAA | |
| NNERGNQGV | | NNERGNQGV | | NVRNLHDQIR | | QAADYKSTQAT | |
| NNERGTQGV | | NNERGTQGV | | NVRNLHDQVK | | QAADYKSTQKT | |
| NNERGYPGV | | NNERGYPGV | | NVRNLHDQVR | | QAADYKSTQTA | |
| NNETIIETG | | NNETIIETG | | NVRNLHDRIR | | QAAIDQINGKL | |
| NNETILETG | | NNETILETG | | NVRNLHDRTR | | QAAIDQISGKL | |
| NNETIVETG | | NNETIVETG | | NVRNLHDRVK | | QAAIDQITGKL | |
| NNFVPVIGA | | NNFVPVIGA | | NVRNLHDRVR | | QAAIDQVNGKL | |
| NNFVPVMGA | | NNFVPVMGA | | NVRNLHEQIK | | QAAVDQITGKL | |
| NNFVPVVGA | | NNFVPVVGA | | NVRNLHEQVR | | QADEICIGYLS | |
| NNFVPVVRA | | NNFVPVVRA | | NVRNLHERIR | | QADEICIGYMS | |
| NNGDYARLY | | NNGDYARLY | | NVRNLYDKVR | | QAELLVAMENQ | |
| NNGDYTRLY | | NNGDYTRLY | | NVRSLKLATG | | QAFRDNLEPGT | |
| NNGELRHLF | | NNGELRHLF | | NVSEWSYIVE | | QAFYKILKIKK | |
| NNGKFEFIA | | NNGKFEFIA | | NVSRIAIGNC | | QAFYKILKIRK | |
| NNGKFEFIV | | NNGKFEFIV | | NVSSSGTSKA | | QAFYRSINWLT | |
| NNGKGRYGV | | NNGKGRYGV | | NVSWTSNSIV | | QAGRIDFHWML | |
| NNGKLEFIA | | NNGKLEFIA | | NVTETLYLNH | | QAGRMTFYWAI | |
| NNGNYARLY | | NNGNYARLY | | NVTHTGTSKA | | QAGRMTFYWII | |
| NNGRFEFIA | | NNGRFEFIA | | NVTHVQNNYT | | QAGRMTFYWKI | |
| NNGSCRCTI | | NNGSCRCTI | | NVTKENTGSY | | QAGRMTFYWTI | |
| NNGVKGFAY | | NNGVKGFAY | | NVTNVQNDYT | | QAGRMTFYWTM | |
| NNGVKGFSY | | NNGVKGFSY | | NVTNVQNNYT | | QAGVDRFYRIC | |
| NNIIDKMNG | | NNIIDKMNG | | NVTRSGTSKA | | QAGVDRFYRTC | |
| NNIIEKMNG | | NNIIEKMNG | | NVTSSGTSKA | | QAGVNRFYRTC | |
| NNIKGRDVL | | NNIKGRDVL | | NVTVTHAKDI | | QAHTKILYFHK | |
| NNILRTQES | | NNILRTQES | | NVTVTHAKNI | | QAHTKVLYFHK | |
| NNIRIGSKG | | NNIRIGSKG | | NVTVTHAQDI | | QAKFEAVAWSA | |

Fig. 83-268

| Block size 8 | SIN | Block size 9 | SIN | Block size 10 | SIN | Block size 11 | SIN |
|---|---|---|---|---|---|---|---|
| NNITTTIIA | | NNITTTIIA | | NVTVTHAQDL | | QAKFESVAWSA | |
| NNITTTIIT | | NNITTTIIT | | NVTVTHAQNI | | QAKGLFGAIAG | |
| NNITTTITT | | NNITTTITT | | NVTVTHAVNL | | QALKDNLEPGT | |
| NNITTTIVT | | NNITTTIVT | | NVTVTHSIEL | | QALQLLFEVEQ | |
| NNIVDKMNR | | NNIVDKMNR | | NVTVTHSINL | | QALQLLLEVEN | |
| NNKDGDIIF | | NNKDGDIIF | | NVTVTHSVDL | | QALQLLLEVEQ | |
| NNKHSNGTI | | NNKHSNGTI | | NVTVTHSVEL | | QALQLLLEVES | |
| NNKHWSGYS | | NNKHWSGYS | | NVTVTHSVNI | | QALRDNLEPGT | |
| NNKNATATV | | NNKNATATV | | NVTVTHSVNL | | QALRDSLEPGT | |
| NNKNWSGYS | | NNKNWSGYS | | NVTVTSSIEL | | QAMELVEAEKH | |
| NNKPFQNVN | | NNKPFQNVN | | NVTVTSSVEL | | QANLCRFLETR | |
| NNLEKRLEN | | NNLEKRLEN | | NVTYTGISKA | | QARFEAVAWSA | |
| NNLERRLEN | | NNLERRLEN | | NVTYTGTSKA | | QARFESVAWSA | |
| NNLPFQNIN | | NNLPFQNIN | | NVTYTGTSRA | | QASPSCLVVRK | |
| NNLSGYSGS | | NNLSGYSGS | | NVVLNVSLHL | | QATIDQITGKL | |
| NNLTKGLCT | | NNLTKGLCT | | NVVRKMMTNS | | QAVDICKAAIG | |
| NNLTKRLCT | | NNLTKRLCT | | NVVRKMMTSS | | QAVDICKAALG | |
| NNLTRELCT | | NNLTRELCT | | NVWTYNAELL | | QAVDICKAAMG | |
| NNLTRGLCK | | NNLTRGLCK | | NVYKALSIYS | | QAVGICKAAMG | |
| NNLTRGLCT | | NNLTRGLCT | | NVYKILSIYS | | QAVNICKAAMG | |
| NNMARAVKL | | NNMARAVKL | | NVYKVLAIYS | | QAWSYIVERPS | |
| NNMDKAVKL | | NNMDKAVKL | | NVYKVLSIYS | | QAYQKRMGLQM | |
| NNMDRAVKL | | NNMDRAVKL | | NVYQAKFEAV | | QAYQKRMGVQI | |
| NNMINNDLG | | NNMINNDLG | | NVYQAKFESV | | QAYQKRMGVQL | |
| NNMTTTIIN | | NNMTTTIIN | | NVYQARFEAV | | QAYQKRMGVQM | |
| NNNASAIVW | | NNNASAIVW | | NVYQARFESV | | QAYTKIMYFHK | |
| NNNASAVIW | | NNNASAVIW | | NVYQSRFEAV | | QAYTKVLYFHK | |
| NNNASAVVW | | NNNASAVVW | | NVYRALSIYS | | QAYTKVMYFHK | |
| NNNASPVIW | | NNNASPVIW | | NWFGYFGIFF | | QCDLHLEFKAD | |
| NNNATATVY | | NNNATATVY | | NWHASNRPWI | | QCDNNCIESIR | |
| NNNGELRHL | | NNNGELRHL | | NWHASNRPWV | | QCDSHLKFKAD | |
| NNNGVKGFA | | NNNGVKGFA | | NWHGANRPWV | | QCFNPMIAELA | |
| NNNGVKGFS | | NNNGVKGFS | | NWHGSNRPWI | | QCFNPMIIELA | |
| NNNKGAVFK | | NNNKGAVFK | | NWHGSNRPWL | | QCFNPMIVELA | |
| NNNLSGYSG | | NNNLSGYSG | | NWHGSNRPWV | | QCFNPMTVELA | |
| NNNNATATV | | NNNNATATV | | NWILWISFAI | | QCFNPMVVELA | |
| NNNNGVKGF | | NNNNGVKGF | | NWKGANRPII | | QCHITGFAPFS | |
| NNNNNTATL | | NNNNNTATL | | NWKGANRPVI | | QCKITGFAPFS | |
| NNNWFGYFG | | NNNWFGYFG | | NWKGSNRPII | | QCMESIRNNTY | |
| NNNWSGYSG | | NNNWSGYSG | | NWKGSNRPIV | | QCQITGFAPFS | |
| NNPGRVSVS | | NNPGRVSVS | | NWKGSNRPVI | | QCQTPLGAINT | |
| NNPGRVTVS | | NNPGRVTVS | | NWKGSNRPVV | | QCRICIDFRDM | |
| NNPITGSPG | | NNPITGSPG | | NWKGSNRPWI | | QCRICILDQNF | |
| NNQASYKIF | | NNQASYKIF | | NWKGSNRPWM | | QDAMTEVWSYN | |
| NNQASYRIF | | NNQASYRIF | | NWKGSNRPWV | | QDCDLINGALG | |
| NNQDWSGYS | | NNQDWSGYS | | NWLTIGISGP | | QDEFCYTLITD | |
| NNQNWSGYS | | NNQNWSGYS | | NWLTKATNGN | | QDEFCYTLMTD | |
| NNQVFPQLN | | NNQVFPQLN | | NWLTKETNGN | | QDEFCYTLVTD | |
| NNRFQIQGI | | NNRFQIQGI | | NWLTKKEPDT | | QDGKSSACKRA | |
| NNRFQIQGV | | NNRFQIQGV | | NWLTKKKNPE | | QDIIDNDNWSG | |
| NNRIKINPV | | NNRIKINPV | | NWLTKKKPDI | | QDIIDNNNWSG | |
| NNRKEPALI | | NNRKEPALI | | NWLTKKKPDT | | QDIWAYNAELL | |
| NNRNWSGYS | | NNRNWSGYS | | NWNGMNRPIL | | QDLEEYVEDTK | |
| NNRSGYSGI | | NNRSGYSGI | | NWNGMNRPVL | | QDLEKYIEDTK | |
| NNSCMETIR | | NNSCMETIR | | NWPDGAEIEY | | QDLEKYVEDTK | |
| NNSKKQIDT | | NNSKKQIDT | | NWPDGAKIEY | | QDLENYVEDTK | |
| NNSSDTVDT | | NNSSDTVDT | | NWPDGSDIGF | | QDLERYVEDTK | |
| NNSTATLCL | | NNSTATLCL | | NWPDGSNIGF | | QDLWAYNAELL | |
| NNSTDKIDT | | NNSTDKIDT | | NWPSSSGGLE | | QDNAIRFGESE | |
| NNSTDKVDT | | NNSTDKVDT | | NWQGANRPII | | QDNAKDEGNGC | |
| NNSTDKVNT | | NNSTDKVNT | | NWQGANRPVI | | QDRGLFGAIAG | |
| NNSTDTIDT | | NNSTDTIDT | | NWQGSNRPVI | | QDRGLFGAKAG | |

Fig. 83-269

| Block size 8 | SIN | Block size 9 | SIN | Block size 10 | SIN | Block size 11 | SIN |
|---|---|---|---|---|---|---|---|
| NNSTDTVDT | | NNSTDTVDT | | NWRGANRPVI | | QDSECVSHNGT | |
| NNSTDTVNT | | NNSTDTVNT | | NWRGSNRPIV | | QDSFYRSMKWL | |
| NNSTEHVDT | | NNSTEHVDT | | NWRGSNRPWI | | QDTEISFTITG | |
| NNSTEKIDT | | NNSTEKIDT | | NWRGSNRPWV | | QDTELSFTITG | |
| NNSTEKVDT | | NNSTEKVDT | | NWSGYSGAFI | | QDTELSFTVTG | |
| NNSTEMVDT | | NNSTEMVDT | | NWSGYSGAFM | | QDTEVSFTITG | |
| NNSTEQVDT | | NNSTEQVDT | | NWSGYSGAFT | | QDTTWDVFIER | |
| NNSTERVDT | | NNSTERVDT | | NWSGYSGAFV | | QDVIMEIVFPN | |
| NNSTETVDT | | NNSTETVDT | | NWSGYSGIFS | | QDVIMEVVFPN | |
| NNSTETVNT | | NNSTETVNT | | NWSGYSGSFI | | QDVWAYNAELL | |
| NNSTKKVDT | | NNSTKKVDT | | NWSGYSGSFS | | QDWSYIVERPS | |
| NNSTKQIDT | | NNSTKQIDT | | NWSGYSGSFT | | QEAIDKITNKI | |
| NNSTKQVDT | | NNSTKQVDT | | NWSGYSGVFS | | QEAIDKITNKV | |
| NNSTNTVNT | | NNSTNTVNT | | NWSWHDGAIL | | QEAIEKITNKV | |
| NNSTTKVDT | | NNSTTKVDT | | NWTGTNRPIL | | QEAIGKITNKV | |
| NNSTTQIDT | | NNSTTQIDT | | NWTGTNRPVL | | QEAINKITNKV | |
| NNSTTQVDT | | NNSTTQVDT | | NWTKDSITDI | | QEALQNRIMIN | |
| NNSTTQVNT | | NNSTTQVNT | | NWTQDAMTEV | | QEARVWWTSNS | |
| NNSTVQVDT | | NNSTVQVDT | | NWTRDAMTEI | | QEELKSLFSSI | |
| NNSYDHSKY | | NNSYDHSKY | | NWTRDAMTEV | | QEELRFLFSSI | |
| NNTCMETIR | | NNTCMETIR | | NWTRDSITEL | | QEELRSLFSSI | |
| NNTEPLCDV | | NNTEPLCDV | | NWTRDSITEV | | QEEVTNATETV | |
| NNTEPLCEV | | NNTEPLCEV | | NWTRDSLTEI | | QEFKMNPNKKI | |
| NNTEPLCNV | | NNTEPLCNV | | NWTRDSMTEI | | QEFKMNPNQKI | |
| NNTKGGDVL | | NNTKGGDVL | | NWTRDSMTEV | | QEIEGIKLKSE | |
| NNTKGRDVL | | NNTKGRDVL | | NWTRDSVTEL | | QEIEGIKLKTE | |
| NNTKGRYVL | | NNTKGRYVL | | NYARLYIWGV | | QEIKMNPNQKI | |
| NNTNGEQIL | | NNTNGEQIL | | NYDSIRGEFN | | QEIVDNKNWSG | |
| NNTSGEQIL | | NNTSGEQIL | | NYDSIRGEFS | | QEIVDNNNWSG | |
| NNTSGEQML | | NNTSGEQML | | NYEELKHLLS | | QEIVDNSNWSG | |
| NNTSGEQVL | | NNTSGEQVL | | NYEELREHLS | | QEIVGNDNWSG | |
| NNTSGKQML | | NNTSGKQML | | NYEELREQLS | | QEIVSNDNWSG | |
| NNTTGRDVL | | NNTTGRDVL | | NYGPINVTKE | | QEKNPALRMKW | |
| NNTTLIENT | | NNTTLIENT | | NYGVKGFGFR | | QEKNPSLRMKW | |
| NNTTNYYNE | | NNTTNYYNE | | NYHQSFVPSP | | QELGDAPFLDR | |
| NNTTVVENT | | NNTTVVENT | | NYHYEECSCY | | QENRVWWTSNS | |
| NNTVINNIT | | NNTVINNIT | | NYKEICIAWS | | QERGLFGAIAG | |
| NNTVKDRSP | | NNTVKDRSP | | NYKEICVAWS | | QESECACINGS | |
| NNTVVNNIT | | NNTVVNNIT | | NYKEIRIAWS | | QESECACVNGS | |
| NNTWLGRTI | | NNTWLGRTI | | NYKEMCAAWS | | QESECICINGT | |
| NNTWVNQTF | | NNTWVNQTF | | NYLIRALTLN | | QESECVCHDGV | |
| NNTWVNQTY | | NNTWVNQTY | | NYLLLNKSLC | | QESECVCHKGI | |
| NNTYDHAQY | | NNTYDHAQY | | NYLMLNKSLC | | QESECVCHKGV | |
| NNTYDHKKY | | NNTYDHKKY | | NYPKYEEESR | | QESECVCHNGI | |
| NNTYDHSHY | | NNTYDHSHY | | NYQQSFVPSP | | QESECVCHNGT | |
| NNTYDHSKY | | NNTYDHSKY | | NYQSLRSILA | | QESECVCHNGV | |
| NNTYDHSQY | | NNTYDHSQY | | NYREICIAWS | | QESECVCHNST | |
| NNTYDHSRY | | NNTYDHSRY | | NYVCSGLVGD | | QESECVCHSGI | |
| NNTYDHSTY | | NNTYDHSTY | | NYVSMEFSLT | | QESECVCINGI | |
| NNTYDHTKY | | NNTYDHTKY | | NYYNETFVNI | | QESECVCINGS | |
| NNTYDHTQY | | NNTYDHTQY | | NYYNETFVNV | | QESECVCINGT | |
| NNTYNHTEY | | NNTYNHTEY | | NYYYEECSCY | | QESECVCISGT | |
| NNTYNHTQY | | NNTYNHTQY | | PAANNADHRI | | QESECVCMNGS | |
| NNVIDKMNK | | NNVIDKMNK | | PAANSADHRI | | QESECVCQDEF | |
| NNVIDKMNN | | NNVIDKMNN | | PAANSADHRV | | QESECVCQNGV | |
| NNVIDKMYK | | NNVIDKMYK | | PAANSAHHRV | | QESECVCVNGS | |
| NNVTVTSSV | | NNVTVTSSV | | PAAPHGLCYP | | QESECVRHNGT | |
| NNWFGYFGI | | NNWFGYFGI | | PAATALANTI | | QESLLLATGMK | |
| NNWSGYSGI | | NNWSGYSGI | | PADNKADHRI | | QESLMLATGMK | |
| NNWSGYSGS | | NNWSGYSGS | | PAECRTFFLT | | QETRVWWTSNS | |
| NNYEELKHL | | NNYEELKHL | | PAFSVQRNLP | | QETRVWWTSSS | |
| NNYGVKGFG | | NNYGVKGFG | | PAHKSQLIWM | | QFALGQGTTLD | |

Fig. 83-270

| Block size 8 | SIN | Block size 9 | SIN | Block size 10 | SIN | Block size 11 | SIN |
|---|---|---|---|---|---|---|---|
| NPAHKSQLI | | NPAHKSQLI | | PAHKSQLVWM | | QFALGQGTTLE | |
| NPAHKSQLV | | NPAHKSQLV | | PAKLLKERGF | | QFALGQGTTLK | |
| NPALRMKWM | | NPALRMKWM | | PALIIWGIHH | | QFALGQGTTLN | |
| NPANGICYP | | NPANGICYP | | PALIIWGVHH | | QFALGQGTTLS | |
| NPAYCNTDL | | NPAYCNTDL | | PALITWGIHH | | QFALGQGTTLY | |
| NPCFYVELI | | NPCFYVELI | | PALIVWGIHH | | QFELIDNEFNE | |
| NPDPGVKGF | | NPDPGVKGF | | PALIVWGVHH | | QFELIDNEFSE | |
| NPEAYNFNE | | NPEAYNFNE | | PALRMKWMMA | | QFELIDNEFTE | |
| NPECDRFLS | | NPECDRFLS | | PANKQASYKI | | QFEMIDNEFNE | |
| NPECDRLLN | | NPECDRLLN | | PANNQASYKI | | QFGRIDFHWLM | |
| NPECDRLLR | | NPECDRLLR | | PANNQASYRI | | QFKLIDNEFTE | |
| NPECDRLLS | | NPECDRLLS | | PANSQASYKI | | QFPLGQGTTLD | |
| NPECDRLLT | | NPECDRLLT | | PAQNAISITF | | QFPVQTDEYKN | |
| NPGDSIIFN | | NPGDSIIFN | | PAQNAISTTF | | QFRALISWEMG | |
| NPGNAEIED | | NPGNAEIED | | PASNQASYKI | | QFSSLAVNVRG | |
| NPGRVSVST | | NPGRVSVST | | PASRYLIDMT | | QFSSLTVNVRG | |
| NPGRVTVST | | NPGRVTVST | | PASRYLTDMT | | QFSSLTVSVRG | |
| NPGVKGWAF | | NPGVKGWAF | | PATAQMALQL | | QFTWNGVKVDG | |
| NPIDGPLPD | | NPIDGPLPD | | PATIGECPKY | | QGACWEQLYTP | |
| NPIDGPLPE | | NPIDGPLPE | | PAYCNTDLGA | | QGAGYAADKES | |
| NPIDGPLPK | | NPIDGPLPK | | PAYCNTDLGS | | QGALLGTKHSN | |
| NPIDGPLPV | | NPIDGPLPV | | PAYCNTDLGT | | QGALLGTNHSN | |
| NPIICLGHH | | NPIICLGHH | | PCEPIIEKN | | QGALLGTRHSN | |
| NPINGICYP | | NPINGICYP | | PCEPIIERN | | QGALLNDKHSN | |
| NPITGSPCA | | NPITGSPCA | | PCEPIIVERN | | QGALLNDRHSN | |
| NPITGSPEA | | NPITGSPEA | | PCEPTIIERN | | QGALVGTKHSN | |
| NPITGSPGA | | NPITGSPGA | | PCFWLEMIRG | | QGANRPAIEID | |
| NPITGSPGS | | NPITGSPGS | | PCFWVELIRG | | QGANRPIIEID | |
| NPITGSPGV | | NPITGSPGV | | PCFWVELVRG | | QGANRPVIEID | |
| NPITGSPSA | | NPITGSPSA | | PCFWVEMIRG | | QGANRPVIEIN | |
| NPIVPSFDM | | NPIVPSFDM | | PCFYIELIRG | | QGANRPVIKID | |
| NPIVPSFEM | | NPIVPSFEM | | PCFYVELIRG | | QGDIVLVMKRK | |
| NPKCDIHLK | | NPKCDIHLK | | PCFYVELTRG | | QGDNENATATV | |
| NPKCDIHLR | | NPKCDIHLR | | PCLTDKGSIQ | | QGDVVLVMKRK | |
| NPKCDLYLN | | NPKCDLYLN | | PCMESIRNNT | | QGEGIAADYKS | |
| NPKCDLYLS | | NPKCDLYLS | | PDATAVAVLK | | QGEGTAADYKS | |
| NPKCDPYLN | | NPKCDPYLN | | PDATAVVVLK | | QGFAPFSKDNG | |
| NPKCDTHLK | | NPKCDTHLK | | PDDGAVAVLK | | QGFFPFHKDNA | |
| NPKCDVHLK | | NPKCDVHLK | | PDECRFYALS | | QGGHIEECSCY | |
| NPKSKLFTL | | NPKSKLFTL | | PDGADINFMP | | QGIGQAADYKS | |
| NPLIKHENR | | NPLIKHENR | | PDGADLPFTI | | QGIKLTQGYKD | |
| NPLIRHENR | | NPLIRHENR | | PDGAEIEYFL | | QGKTKATKMEA | |
| NPLNPFVGH | | NPLNPFVGH | | PDGAELPFAI | | QGKTKATKMKA | |
| NPLNPFVNH | | NPLNPFVNH | | PDGAELPFII | | QGLIDGWYGFR | |
| NPLNPFVSH | | NPLNPFVSH | | PDGAELPFTI | | QGLVDGWYGYH | |
| NPLNPFVTH | | NPLNPFVTH | | PDGAKIEYFL | | QGMGMAADKES | |
| NPMCDDLIG | | NPMCDDLIG | | PDGAKIKYFL | | QGMIDGWYGYH | |
| NPMCDELIG | | NPMCDELIG | | PDGAKIQYFS | | QGMVDGWYGFH | |
| NPMCDNLIG | | NPMCDNLIG | | PDGAKLPFTI | | QGMVDGWYGYH | |
| NPMCDYLIG | | NPMCDYLIG | | PDGALLPFDI | | QGNGCFEIFHQ | |
| NPMHQLLRH | | NPMHQLLRH | | PDGANIDFMP | | QGNNDNATATV | |
| NPMIAELAE | | NPMIAELAE | | PDGANIGFMP | | QGNNENATATV | |
| NPMIIELAE | | NPMIIELAE | | PDGANIGLCP | | QGNNKNATATV | |
| NPMIVELAE | | NPMIVELAE | | PDGANINFMA | | QGNNNNATATV | |
| NPMNPFVSH | | NPMNPFVSH | | PDGANINFMP | | QGNNVWAGRTV | |
| NPMTVELAE | | NPMTVELAE | | PDGANINLMP | | QGNSVWAGRTI | |
| NPMVVELAE | | NPMVVELAE | | PDGANTNFMP | | QGNSVWAGRTM | |
| NPNQKIICI | | NPNQKIICI | | PDGAQIKYFS | | QGNSVWAGRTV | |
| NPNQKIITI | | NPNQKIITI | | PDGAQIQYFS | | QGQGTAADYKS | |
| NPNQKILCA | | NPNQKILCA | | PDGARIQYFS | | QGQIIVLNTDW | |
| NPNQKILCT | | NPNQKILCT | | PDGCRFYALS | | QGQTIVLNTDW | |
| NPNQKILFA | | NPNQKILFA | | PDGGNINFMP | | QGQTIVLTTDW | |

Fig. 83-271

| Block size 8 | SIN | Block size 9 | SIN | Block size 10 | SIN | Block size 11 | SIN |
|---|---|---|---|---|---|---|---|
| NPNQKIMCI | | NPNQKIMCI | | PDGPQIQYFS | | QGQTVVLNTDW | |
| NPNQKIQCT | | NPNQKIQCT | | PDGSDIGFMP | | QGRGLFGAIAG | |
| NPNQKITCI | | NPNQKITCI | | PDGSKIGFMP | | QGRGLFGAKAG | |
| NPNQKIVTI | | NPNQKIVTI | | PDGSNIGFMP | | QGRGVFEFSDE | |
| NPNQKLFAL | | NPNQKLFAL | | PDHEGEGIPL | | QGRGVFELSDE | |
| NPNQKLFAS | | NPNQKLFAS | | PDIYDFNEGS | | QGRLCNPLNPF | |
| NPNQKLFTL | | NPNQKLFTL | | PDLYDYKEDR | | QGRLCNPMNPF | |
| NPNQKTITI | | NPNQKTITI | | PDLYDYKENR | | QGRMDYYWAIL | |
| NPNQMIITI | | NPNQMIITI | | PDLYDYKESR | | QGRMDYYWAVL | |
| NPNWSGYSG | | NPNWSGYSG | | PDLYDYKKNR | | QGRMDYYWGIL | |
| NPRCDDLIG | | NPRCDDLIG | | PDNEAVAVLK | | QGRQTFDWTLN | |
| NPRIFLAMI | | NPRIFLAMI | | PDNGAVAVLK | | QGRQTYDWTLN | |
| NPRMFLAMI | | NPRMFLAMI | | PDNGAVAVVK | | QGSARHIEECS | |
| NPRVFLAMI | | NPRVFLAMI | | PDPFRLLQNS | | QGSFYRNMRWL | |
| NPRVFLTMI | | NPRVFLTMI | | PDPGVKGFAF | | QGSFYRSIRWL | |
| NPSAGKDPK | | NPSAGKDPK | | PDRATFLRSN | | QGSFYRSMRWL | |
| NPSCASNIN | | NPSCASNIN | | PDSGAVAVLK | | QGSGYAADKAS | |
| NPSCATNIN | | NPSCATNIN | | PDSTAVAVIK | | QGSGYAADKES | |
| NPSHEGEGI | | NPSHEGEGI | | PDSVLVNTYQ | | QGSGYAADKKS | |
| NPSLRMKWM | | NPSLRMKWM | | PDTTAVAVLK | | QGSGYAADLKS | |
| NPSQKLFAL | | NPSQKLFAL | | PDTYDFNEGA | | QGSGYAADQES | |
| NPTEEQAVD | | NPTEEQAVD | | PDTYDFNEGS | | QGSGYAADQKS | |
| NPTEEQAVE | | NPTEEQAVE | | PDTYDFNEGT | | QGSGYAADRES | |
| NPTEEQAVG | | NPTEEQAVG | | PDVRCICKDN | | QGSGYAADRKS | |
| NPTEEQAVN | | NPTEEQAVN | | PDVRCICRDN | | QGSLKLATGMR | |
| NPTLLFLEV | | NPTLLFLEV | | PDVRCVCRDN | | QGSLLNDKHFN | |
| NPTLLFLKI | | NPTLLFLKI | | PDYHYEECSC | | QGSLLNDKHSN | |
| NPTLLFLKM | | NPTLLFLKM | | PDYQIGYVCS | | QGSLLNDRHSN | |
| NPTLLFLKV | | NPTLLFLKV | | PDYQSIRSIL | | QGSLMLATGMR | |
| NPTNGICYP | | NPTNGICYP | | PDYQSLRSIL | | QGSLPNDKHSN | |
| NPVELSSGY | | NPVELSSGY | | PEAGLKWELM | | QGSLRLATGMR | |
| NPVHKSQLI | | NPVHKSQLI | | PEAYNFNEGS | | QGSNRPVIQID | |
| NPVICLGHH | | NPVICLGHH | | PEDLIVFNTI | | QGSNRPVIQIN | |
| NPVICMGHH | | NPVICMGHH | | PEEAKYVEWT | | QGSNRPVIRID | |
| NPVKLNSGY | | NPVKLNSGY | | PEEAKYVWWA | | QGSNRPWIRFN | |
| NPVKLSGGY | | NPVKLSGGY | | PEEAKYVWWT | | QGSTLPRRSGA | |
| NPVKLSSGY | | NPVKLSSGY | | PEEGTSIWTS | | QGSYNNTSGEQ | |
| NPVKLSSSY | | NPVKLSSSY | | PEEISETQGT | | QGTAADYKSTQ | |
| NPVNGICYP | | NPVNGICYP | | PEEKTSIWTS | | QGTCWEQLYTP | |
| NPVTLSSGY | | NPVTLSSGY | | PEERPSIWTS | | QGTCWEQMYTP | |
| NPVTLTMGY | | NPVTLTMGY | | PEERTSIWTS | | QGTGIAADKAS | |
| NPVVPSFDM | | NPVVPSFDM | | PEEVKYVWWT | | QGTGIAADKES | |
| NPYTLVSTK | | NPYTLVSTK | | PEEVSEAQGT | | QGTGIAADKTS | |
| NQASYKIFK | | NQASYKIFK | | PEEVSETQGI | | QGTGIAADKVS | |
| NQASYRIFK | | NQASYRIFK | | PEEVSETQGM | | QGTGIAAEKES | |
| NQCMESIRN | | NQCMESIRN | | PEEVSETQGT | | QGTGQAADYES | |
| NQDSFYRSM | | NQDSFYRSM | | PEFGYLLKGE | | QGTGQAADYKS | |
| NQDWSGYSG | | NQDWSGYSG | | PEFGYLLRGE | | QGTKRSHEQME | |
| NQEELKSLF | | NQEELKSLF | | PEGMCYPGFV | | QGTKRSYEQME | |
| NQEELRFLF | | NQEELRFLF | | PEGMCYPGSI | | QGTMDYYWGIL | |
| NQEELRSLF | | NQEELRSLF | | PEGMCYPGSV | | QGTSVWAGRTI | |
| NQEYTSGRQ | | NQEYTSGRQ | | PEKIHTRGLF | | QGTTIRGKHSN | |
| NQFALGQGT | | NQFALGQGT | | PEKIRTRGLF | | QGTTIRGRHSN | |
| NQGSFYRNM | | NQGSFYRNM | | PEKIRVKRRP | | QGTTIRNKHSN | |
| NQGSFYRSI | | NQGSFYRSI | | PEKQTRGIFG | | QGTTIRNRHSN | |
| NQGSFYRSM | | NQGSFYRSM | | PEKQTRGLFG | | QGTTLDNEHSN | |
| NQGVKGWAF | | NQGVKGWAF | | PEQSKMQFSS | | QGTTLDNKHSN | |
| NQHTIDLAD | | NQHTIDLAD | | PEQSRMQFSS | | QGTTLENKHSN | |
| NQHTIDLAE | | NQHTIDLAE | | PERQTRGIFG | | QGTTLKGRHAN | |
| NQHTIDLTD | | NQHTIDLTD | | PERQTRGLFG | | QGTTLNNKHSN | |
| NQHTIDLTN | | NQHTIDLTN | | PESVLINTYQ | | QGTTLRGQHAN | |
| NQHTIDMAD | | NQHTIDMAD | | PESVLVNTYQ | | QGTTLRGRHAN | |

Fig. 83-272

| Block size 8 | SIN | Block size 9 | SIN | Block size 10 | SIN | Block size 11 | SIN |
|---|---|---|---|---|---|---|---|
| NQHTIDMTD | | NQHTIDMTD | | PETQTRGIFG | | QGTTLYNKHSN | |
| NQHTIDSTD | | NQHTIDSTD | | PEVCLKWDLM | | QGVGIAADKES | |
| NQHTIDVTD | | NQHTIDVTD | | PEVCLKWELM | | QGVGMAADKES | |
| NQHTIHLTD | | NQHTIHLTD | | PEWSWDDGAI | | QGVKGWAFDNG | |
| NQIKIRRRV | | NQIKIRRRV | | PEWSYIIEKE | | QGVKLAQGYKD | |
| NQINGKLNR | | NQINGKLNR | | PEWSYIMEKE | | QGVKLIQGYKD | |
| NQITGKLNR | | NQITGKLNR | | PEWSYIMEKK | | QGVKLTQGYKD | |
| NQKIICISA | | NQKIICISA | | PEWSYIVEKA | | QGVLLGTKHSN | |
| NQKIICIST | | NQKIICIST | | PEWSYIVEKD | | QGVRLTQGYKD | |
| NQKIITIDS | | NQKIITIDS | | PEWSYIVEKE | | QGWMDYYWGIL | |
| NQKIITIGS | | NQKIITIGS | | PEWSYIVEKN | | QGWSYIVERPS | |
| NQKIITMGS | | NQKIITMGS | | PEWSYIVERE | | QGYGVKGFGFR | |
| NQKILCASA | | NQKILCASA | | PEYGFKISKR | | QGYKDIILWFS | |
| NQKILCTSA | | NQKILCTSA | | PEYGFKISRR | | QGYKDIILWIS | |
| NQKILDEHD | | NQKILDEHD | | PEYGFRISKR | | QGYKDIILWVS | |
| NQKILFASA | | NQKILFASA | | PEYGHLITGK | | QHANGTIHDRS | |
| NQKIMCISA | | NQKIMCISA | | PEYGHLTTGK | | QHIEECSCYGA | |
| NQKITCISA | | NQKITCISA | | PEYGHLVTGK | | QHIEECSCYGS | |
| NQKIVTIGS | | NQKIVTIGS | | PEYGYLITGK | | QHIEECSCYPQ | |
| NQKLFALSG | | NQKLFALSG | | PEYQSLRSIL | | QHIEECSCYPR | |
| NQKLFASSG | | NQKLFASSG | | PFAAAPPEQS | | QHIEEGSVYPR | |
| NQKLFTLSG | | NQKLFTLSG | | PFAAAPPKQS | | QHIIDLADSEM | |
| NQKPLDEHD | | NQKPLDEHD | | PFAAAPPVQS | | QHLEECSCYMD | |
| NQKTITIGS | | NQKTITIGS | | PFAKDNSIRL | | QHLEECSCYTD | |
| NQKTLDEHD | | NQKTLDEHD | | PFASAPPEQS | | QHLEECSCYVD | |
| NQKTLDEHE | | NQKTLDEHE | | PFDDRLRRDQ | | QHPELTGLDCI | |
| NQKTLDEHV | | NQKTLDEHV | | PFDVPDYQSL | | QHPELTGLDCM | |
| NQKTLDKHD | | NQKTLDKHD | | PFHKDNAIRL | | QHPELTGLNCI | |
| NQMIITIGS | | NQMIITIGS | | PFHKDNALRL | | QHPELTGMDCI | |
| NQNNTTVVE | | NQNNTTVVE | | PFHKDNAVRL | | QHPELTGMNCI | |
| NQNPRIFLA | | NQNPRIFLA | | PFHKGNSARL | | QHQNAEGIGIA | |
| NQNPRMFLA | | NQNPRMFLA | | PFHLATKQVC | | QHQNAEGTGIA | |
| NQNPRVFLA | | NQNPRVFLA | | PFHLGTKQVC | | QHQNAEGTGMA | |
| NQNPRVFLT | | NQNPRVFLT | | PFHLGTRQVC | | QHQNEQGMGMA | |
| NQNQNPRMF | | NQNQNPRMF | | PFHNIHPLAI | | QHQNEQGTGIA | |
| NQNSTWVSQ | | NQNSTWVSQ | | PFHNIHPLTI | | QHQNEQGVGIA | |
| NQNWSGYSG | | NQNWSGYSG | | PFHNVHPFTI | | QHQNEQGVGMA | |
| NQPAATALA | | NQPAATALA | | PFHNVHPLAI | | QHQNSEGTGIA | |
| NQQFELIDH | | NQQFELIDH | | PFHNVHPLTI | | QHQNSEGTGIV | |
| NQQFELIDN | | NQQFELIDN | | PFIDRLRRDQ | | QHRNDEGTGIA | |
| NQQFELINN | | NQQFELINN | | PFISCSHFEC | | QHRNEEGTGIA | |
| NQQFEMIDN | | NQQFEMIDN | | PFISCSHLEC | | QHRNEEGTGVA | |
| NQQFKLIDN | | NQQFKLIDN | | PFISCSHMEC | | QHTIDLADSEM | |
| NQRLNPMHQ | | NQRLNPMHQ | | PFISCSHSEC | | QHTIDLAESEM | |
| NQRLNTMHQ | | NQRLNTMHQ | | PFISCSPLEC | | QHTIDLTDAEM | |
| NQSGRISIY | | NQSGRISIY | | PFISCSQLEC | | QHTIDLTDSEM | |
| NQSLPPNFS | | NQSLPPNFS | | PFISCSYLEC | | QHTIDMADSEM | |
| NQTIINNYY | | NQTIINNYY | | PFKGFFPFHK | | QHTIDMGDSEM | |
| NQTKKMTIT | | NQTKKMTIT | | PFKLLQNSQI | | QHTIDMTDSEM | |
| NQTKTMTIT | | NQTKTMTIT | | PFKLLQNSQV | | QHTIDQADSEM | |
| NQTLVSNND | | NQTLVSNND | | PFKLLQTSQV | | QHTIDSTDSEM | |
| NQTYRNNRK | | NQTYRNNRK | | PFLDRIRRDQ | | QHTIDVADSEM | |
| NQTYRNTRK | | NQTYRNTRK | | PFLDRLRRDQ | | QHTIDVTDSEM | |
| NQVEKRINM | | NQVEKRINM | | PFLDRVRRDQ | | QHTIHLTDSEM | |
| NQVENRINM | | NQVENRINM | | PFPVGSGSFP | | QHVEECSCYPQ | |
| NQVEQRINM | | NQVEQRINM | | PFQGFFPFHK | | QHVEECSCYPR | |
| NQVFPQLNQ | | NQVFPQLNQ | | PFQNASRHHM | | QHVEECSCYPS | |
| NQVKIRRRV | | NQVKIRRRV | | PFQNASRHYM | | QIADAQHRSHR | |
| NRANQRLNP | | NRANQRLNP | | PFQNASRYYM | | QIADSHHRSHR | |
| NRANQRLNT | | NRANQRLNT | | PFQNICKPYI | | QIADSQHKSHR | |
| NRCFYVELI | | NRCFYVELI | | PFQNIDSRAV | | QIADSQHRSHR | |
| NRCFYVELV | | NRCFYVELV | | PFQNIDSWAV | | QIAGSSEQAAE | |

Fig. 83-273

| Block size 8 | SIN | Block size 9 | SIN | Block size 10 | SIN | Block size 11 | SIN |
|---|---|---|---|---|---|---|---|
| NRCYQFALG | | NRCYQFALG | | PFQNIHPATI | | QIAILAATVTL | |
| NRDITIGSI | | NRDITIGSI | | PFQNIHPITI | | QIAILATTITL | |
| NREFEVMNH | | NREFEVMNH | | PFQNIHPVTI | | QIAILATTVTL | |
| NREFEVVDH | | NREFEVVDH | | PFQNLSPRTV | | QIAILVTTVTL | |
| NREFEVVNH | | NREFEVVNH | | PFQNTSKHYI | | QICIGHHANNS | |
| NREFGVVNH | | NREFGVVNH | | PFQNTSRHYI | | QICIGYHANNS | |
| NRFIEKTNQ | | NRFIEKTNQ | | PFQNTSRHYM | | QICIGYHSNNS | |
| NRFQIQGIK | | NRFQIQGIK | | PFQNVHPITI | | QICVGYHANNS | |
| NRFQIQGVK | | NRFQIQGVK | | PFQNVHPVTI | | QICVGYHSNNS | |
| NRFQIQGVR | | NRFQIQGVR | | PFQNVNKITY | | QIDESCEGECF | |
| NRFYRTCKL | | NRFYRTCKL | | PFQNVNKVTY | | QIDPVKLSGGY | |
| NRGLFGAIA | | NRGLFGAIA | | PFQNVNRITY | | QIDPVKLSSGY | |
| NRGLFGAKA | | NRGLFGAKA | | PFQNVSRIAI | | QIDQVKLSSGY | |
| NRGSFYRSM | | NRGSFYRSM | | PFRALISWEM | | QIDSVKLSSGY | |
| NRHSNGTIH | | NRHSNGTIH | | PFRALISWGM | | QIEARGLFGAI | |
| NRIFQPNIG | | NRIFQPNIG | | PFRALVSWEM | | QIEDLWAYNAE | |
| NRIFRPNIG | | NRIFRPNIG | | PFRGFFPFHK | | QIEELWAYNAE | |
| NRIIEKTNQ | | NRIIEKTNQ | | PFRLLQNSQV | | QIEGLWAYNAE | |
| NRIKINPVT | | NRIKINPVT | | PFRLLQSSQV | | QIEKEFEQVEG | |
| NRIMINPVK | | NRIMINPVK | | PFRTLMSCPI | | QIEKEFGQVEG | |
| NRINMLADR | | NRINMLADR | | PFRTLMSCPM | | QIEKEFSEIEG | |
| NRIQIDPVK | | NRIQIDPVK | | PFRTLMSCPV | | QIEKEFSEVEG | |
| NRIQIDQVK | | NRIQIDQVK | | PFSKDNGIRI | | QIEKEFTEVEG | |
| NRIQIDSVK | | NRIQIDSVK | | PFSKDNSIQL | | QIENLWAYNAE | |
| NRIQINPVK | | NRIQINPVK | | PFSKDNSIRL | | QIEPRGLFGAI | |
| NRIRIDPVK | | NRIRIDPVK | | PFSKDNSVRL | | QIESIIEAESS | |
| NRITYGACP | | NRITYGACP | | PFTIGECPKY | | QIESMIEAESS | |
| NRITYGPCP | | NRITYGPCP | | PFTIGECPRY | | QIESMVEAESS | |
| NRITYGVCP | | NRITYGVCP | | PFTKDNSIRL | | QIESRGLFGAI | |
| NRKEPALIV | | NRKEPALIV | | PFVACGPAEC | | QIEVTNATELV | |
| NRKEYEEEA | | NRKEYEEEA | | PFVACGPSEC | | QIGNVINWTKD | |
| NRKMEDGFL | | NRKMEDGFL | | PFVACGPTEC | | QIGNVINWTQD | |
| NRKVDDGFL | | NRKVDDGFL | | PFVACSPSEC | | QIGNVINWTRD | |
| NRLIDKTNQ | | NRLIDKTNQ | | PFVRGQQGRM | | QIGYICSGVFG | |
| NRLIDRTNH | | NRLIDRTNH | | PFVSCGPSEC | | QIGYVCSGIFG | |
| NRLIEKTND | | NRLIEKTND | | PFVSCSHLEC | | QIGYVCSGVFG | |
| NRLIEKTNE | | NRLIEKTNE | | PFYLGTKQVC | | QIIDIWAYNAE | |
| NRLIEKTNK | | NRLIEKTNK | | PFYLGTRQVC | | QIIKLLPFAAA | |
| NRLIEKTNQ | | NRLIEKTNQ | | PGAPGVKGFG | | QIIKLLPFASA | |
| NRLIEKTNT | | NRLIEKTNT | | PGAPHGLCYP | | QIIKMLPFAAA | |
| NRLIERTNE | | NRLIERTNE | | PGARPKVNGQ | | QIIRESGGIDK | |
| NRLIERTNQ | | NRLIERTNQ | | PGARPQVNGQ | | QIISLCSIWFS | |
| NRLIGKTNQ | | NRLIGKTNQ | | PGARRIDFHW | | QIIVILVLGLS | |
| NRLISKTNQ | | NRLISKTNQ | | PGARRIDFNW | | QIIVTREPYVS | |
| NRLNINPVK | | NRLNINPVK | | PGATINEEAL | | QIKIRRRVDIN | |
| NRLNINPVR | | NRLNINPVR | | PGATVNEEAL | | QILAIYATVAG | |
| NRLNINPVT | | NRLNINPVT | | PGATVNEGAL | | QILAIYSTAAS | |
| NRLNINSVK | | NRLNINSVK | | PGCDRLQDTT | | QILAIYSTVAS | |
| NRLNNVIDK | | NRLNNVIDK | | PGDIIVFNTI | | QILAIYSTVSS | |
| NRLSINPVK | | NRLSINPVK | | PGDLILFNTI | | QILRTQESSCV | |
| NRMQFSSLT | | NRMQFSSLT | | PGDLIVFNTI | | QILSIYSTAAS | |
| NRMQINPVK | | NRMQINPVK | | PGDNIIFSHN | | QILSIYSTVAS | |
| NRMTICVQG | | NRMTICVQG | | PGDNITFLHN | | QILSIYSTVSS | |
| NRMVIASTT | | NRMVIASTT | | PGDNITFSDN | | QILSIYSTVTS | |
| NRMVLASTT | | NRMVLASTT | | PGDNITFSHN | | QILSIYSTVVS | |
| NRNEIKGVK | | NRNEIKGVK | | PGDRPKVNGQ | | QINGKLNRLIE | |
| NRNFKPNIG | | NRNFKPNIG | | PGDSIIFNSI | | QINGQSGRIDF | |
| NRNFQPNIG | | NRNFQPNIG | | PGDSITFSHN | | QIQDIWAYNAE | |
| NRNQPAATA | | NRNQPAATA | | PGDTVTFTFN | | QIQDLWAYNAE | |
| NRNWSGYSG | | NRNWSGYSG | | PGELDNNGEL | | QIQDVWAYNAE | |
| NRPIIDINM | | NRPIIDINM | | PGELNNNGEL | | QIQGIKLTQGY | |
| NRPIIEIDM | | NRPIIEIDM | | PGERIMFESN | | QIQGVKLAQGY | |

Fig. 83-274

| Block size 8 | SIN | Block size 9 | SIN | Block size 10 | SIN | Block size 11 | SIN |
|---|---|---|---|---|---|---|---|
| NRPIIEINM | | NRPIIEINM | | PGERITFESN | | QIQGVKLIQGY | |
| NRPVIDINM | | NRPVIDINM | | PGERITFESS | | QIQGVKLTQGY | |
| NRPVIDVNM | | NRPVIDVNM | | PGERTTFESN | | QIQGVRLTQGY | |
| NRPVIEIDM | | NRPVIEIDM | | PGETLKVESN | | QIQNIWAYNAE | |
| NRPVIEINM | | NRPVIEINM | | PGETLNIESN | | QIRGFVHFVEA | |
| NRPVIKIDM | | NRPVIKIDM | | PGETLNVESN | | QIRGFVYFVEA | |
| NRPVIQIDP | | NRPVIQIDP | | PGEVDNNGEL | | QIRGFVYFVEI | |
| NRPVIQINP | | NRPVIQINP | | PGFHFEECSC | | QIRGFVYFVET | |
| NRPVIRIDP | | NRPVIRIDP | | PGFVENLEEL | | QIRGVVYFVET | |
| NRPWIRFNS | | NRPWIRFNS | | PGHNITFSHN | | QISGKLNRLIE | |
| NRPWIRINN | | NRPWIRINN | | PGIFENSCIE | | QISIVPNIGSR | |
| NRPWISFDQ | | NRPWISFDQ | | PGIFENSCLE | | QITDIWAYNAE | |
| NRPWISFNQ | | NRPWISFNQ | | PGIFESSCLE | | QITFIQALQLL | |
| NRPWLSFNQ | | NRPWLSFNQ | | PGIFGNSCLE | | QITFLQALQLL | |
| NRPWMRINN | | NRPWMRINN | | PGIKGFAFLD | | QITFMQALQLL | |
| NRPWMRISN | | NRPWMRISN | | PGIKGFGFLN | | QITGFAPFSKD | |
| NRPWVRINN | | NRPWVRINN | | PGKFTNEEAL | | QITGKLNRFIE | |
| NRPWVRMNN | | NRPWVRMNN | | PGKQAKGLFG | | QITGKLNRIIE | |
| NRPWVSFDQ | | NRPWVSFDQ | | PGLFENSCLE | | QITGKLNRLID | |
| NRPWVSFNH | | NRPWVSFNH | | PGLINGWYGF | | QITGKLNRLIE | |
| NRPWVSFNQ | | NRPWVSFNQ | | PGLVAGWYGF | | QITGKLNRLIG | |
| NRPWVSFTQ | | NRPWVSFTQ | | PGMMMGMFNM | | QITGKLNRLIS | |
| NRQEIEGAR | | NRQEIEGAR | | PGMQIRGFVH | | QITGTLNRLID | |
| NRQEIEGVK | | NRQEIEGVK | | PGMQIRGFVY | | QITNGTTGNPI | |
| NRQEIEGVR | | NRQEIEGVR | | PGNAEIEDLI | | QITSLCSIWFS | |
| NRQEIGGVK | | NRQEIGGVK | | PGNAEIEDLT | | QITTKINNIID | |
| NRRLTTTIK | | NRRLTTTIK | | PGNFNDYEEL | | QITTKINNIIE | |
| NRRPTTTIK | | NRRPTTTIK | | PGNLIVFNTI | | QIVVTREPYVS | |
| NRSFKPNIG | | NRSFKPNIG | | PGNNBNGVKG | | QKAIDEITTKI | |
| NRSFQPNIG | | NRSFQPNIG | | PGNNNKGVKG | | QKAIDIMQNKL | |
| NRSFRPNIG | | NRSFRPNIG | | PGNNNNGVKG | | QKAIDNMQNKL | |
| NRSGYSGIF | | NRSGYSGIF | | PGQTLRIRSN | | QKAIDNMQNRL | |
| NRSGYSGSF | | NRSGYSGSF | | PGQTLRVKSN | | QKAIDQITTKI | |
| NRSILNTSQ | | NRSILNTSQ | | PGQTLRVRSD | | QKAIDRITTKI | |
| NRSPYRALM | | NRSPYRALM | | PGQTLRVRSN | | QKAINEITTKI | |
| NRTFQNIDK | | NRTFQNIDK | | PGQTVKIKTN | | QKALNEITTKI | |
| NRTFQNIDR | | NRTFQNIDR | | PGQTVKIQTN | | QKAMMDQVRES | |
| NRTFQNVSP | | NRTFQNVSP | | PGQTVKIQTS | | QKATCVCRDNW | |
| NRTGTFEFT | | NRTGTFEFT | | PGRFTNEEAL | | QKCCNLFEKFF | |
| NRTHQYSEK | | NRTHQYSEK | | PGSFNDYEEL | | QKCCSLFEKFF | |
| NRTHQYSER | | NRTHQYSER | | PGSFNNYEEL | | QKCCTLFEKFF | |
| NRVKIDPVK | | NRVKIDPVK | | PGSFPDGAQI | | QKGILEDEQMY | |
| NRVWWTSNS | | NRVWWTSNS | | PGSGDWPDGS | | QKGNIKCNICI | |
| NRYLEEHPS | | NRYLEEHPS | | PGSGNWPDGA | | QKGNIRCDICI | |
| NRYLEENPS | | NRYLEENPS | | PGSGNWPDGP | | QKGNIRCNICI | |
| NSAAFEDLR | | NSAAFEDLR | | PGSGNWPDGS | | QKGNIRCNICV | |
| NSADHRIYW | | NSADHRIYW | | PGSIENLEEL | | QKIITIDSVSL | |
| NSADHRVYW | | NSADHRVYW | | PGSIENQEEL | | QKIITIGSASL | |
| NSALGSPGC | | NSALGSPGC | | PGSIKNQEEL | | QKIITIGSISL | |
| NSARLIHHT | | NSARLIHHT | | PGSLNDYEEL | | QKIITIGSVSL | |
| NSCESKCFW | | NSCESKCFW | | PGSNNNGVKG | | QKIITMGSVSL | |
| NSCIESIRN | | NSCIESIRN | | PGSTVNEEAL | | QKILCASATAI | |
| NSCMETIRN | | NSCMETIRN | | PGSVENLEEL | | QKILCTSAIAI | |
| NSDFICVGW | | NSDFICVGW | | PGSVENQEEL | | QKILCTSATAI | |
| NSDFLCVGW | | NSDFLCVGW | | PGTFDIEGLY | | QKILCTSATAL | |
| NSDFMCVGW | | NSDFMCVGW | | PGTFDIGGLY | | QKILDEHDSNV | |
| NSDLDYQIG | | NSDLDYQIG | | PGTFDLEGLY | | QKILFASATAI | |
| NSDLEALME | | NSDLEALME | | PGTFDLGGLY | | QKIMESGGIDK | |
| NSDPDYQIG | | NSDPDYQIG | | PGTKGFGFLN | | QKIMESGGISK | |
| NSDVLVTRE | | NSDVLVTRE | | PGTRRIDFHW | | QKIMTIGSVSL | |
| NSDWSGYSG | | NSDWSGYSG | | PGTTVNEEAL | | QKINGVKLEEN | |
| NSEFICVGW | | NSEFICVGW | | PGVKGFAFLD | | QKISGVKLEEN | |

Fig. 83-275

| Block size 8 | SIN | Block size 9 | SIN | Block size 10 | SIN | Block size 11 | SIN |
|---|---|---|---|---|---|---|---|
| NSEFLCVGW | | NSEFLCVGW | | PGVKGFAFLN | | QKITCVCRDNW | |
| NSEGIGQAA | | NSEGIGQAA | | PGVKGFGFLD | | QKKDKRYGPAL | |
| NSEGMGQAA | | NSEGMGQAA | | PGVKGFGFLN | | QKLFALSEVAI | |
| NSEGRGQAA | | NSEGRGQAA | | PGVKGFGFLS | | QKLFALSGVAI | |
| NSEGTGIAA | | NSEGTGIAA | | PGVKGWAFDD | | QKLFALSGVAV | |
| NSEGTGIVA | | NSEGTGIVA | | PGVKGWAFDN | | QKLFASSGIAI | |
| NSEGTGMAA | | NSEGTGMAA | | PGVKGWAFDS | | QKLFTLSGVAI | |
| NSEGTGQAA | | NSEGTGQAA | | PGVKGWAFDY | | QKQEFKMNPNK | |
| NSEMNKLYE | | NSEMNKLYE | | PGVRCICRDN | | QKQEFKMNPNQ | |
| NSETGAPQL | | NSETGAPQL | | PGWLTIGITG | | QKQEIKMNPNQ | |
| NSFEQITFI | | NSFEQITFI | | PGWLTLGITG | | QKQMTRGLFGA | |
| NSFEQITFL | | NSFEQITFL | | PGWSWDDGAI | | QKRGLFGAIAG | |
| NSFEQITFM | | NSFEQITFM | | PGYNGQKSWM | | QKRMTRGLFGA | |
| NSFFSRLNW | | NSFFSRLNW | | PGYNGQKSWT | | QKSLIWLWLVL | |
| NSFSRTELI | | NSFSRTELI | | PGYNGQRSWM | | QKSLLLATGMR | |
| NSFVPVVGA | | NSFVPVVGA | | PGYQSLRSIL | | QKSLRGRGSTL | |
| NSFYAELKW | | NSFYAELKW | | PHGLCYPGEL | | QKSTQEAIDKI | |
| NSFYRNLIW | | NSFYRNLIW | | PHLTGTWDTL | | QKSTQEAIEKI | |
| NSGDYARLY | | NSGDYARLY | | PHRLCYPGEL | | QKSTQEAIGKI | |
| NSGKVECVC | | NSGKVECVC | | PHRTLLMNEL | | QKSTQEAINKI | |
| NSGVKGWAF | | NSGVKGWAF | | PHRTLLMSEL | | QKTIDQVTGKL | |
| NSHYEECSC | | NSHYEECSC | | PIAFLTSSIV | | QKTITIGSVSL | |
| NSIAVFCGT | | NSIAVFCGT | | PIEHIASIRR | | QKTLDEHDANV | |
| NSIGNLIAP | | NSIGNLIAP | | PIEHIASMRR | | QKTLDEHDSNV | |
| NSIIAFCGT | | NSIIAFCGT | | PIEHVASMRR | | QKTLDKHDSNV | |
| NSIIDKMNI | | NSIIDKMNI | | PIEYIASMRR | | QKTLKLATGMR | |
| NSIIDKMNT | | NSIIDKMNT | | PIEYVASMRR | | QKVNGVKLEEN | |
| NSIIDKVNT | | NSIIDKVNT | | PIFLYVRTNG | | QKVPVTQTMEL | |
| NSIIEKMNT | | NSIIEKMNT | | PIGEAPSPYN | | QKVTCVCRDNW | |
| NSIIGKMNT | | NSIIGKMNT | | PIGEVPSPYN | | QKWWVWLWLVL | |
| NSIINKMNT | | NSIINKMNT | | PIGISSMVEA | | QLEGFSAESRK | |
| NSIIVFCGT | | NSIIVFCGT | | PIGSGFFPDG | | QLFIKDYRYTY | |
| NSIQLSAGG | | NSIQLSAGG | | PIGTAPILGN | | QLFLVCVSLLQ | |
| NSIRIGSKG | | NSIRIGSKG | | PIGTAPVLGN | | QLGNVINWTRD | |
| NSIRIGSRG | | NSIRIGSRG | | PIGVAPSPSN | | QLGSWSWHDGA | |
| NSIRLAAGG | | NSIRLAAGG | | PIGVAPVLGN | | QLIPMISKCKT | |
| NSIRLSADG | | NSIRLSADG | | PIHLGDCSFE | | QLIPMISKCRT | |
| NSIRLSAGG | | NSIRLSAGG | | PIICLGHHAV | | QLIPMISKSRT | |
| NSIRLSASG | | NSIRLSASG | | PIKGWAPLSK | | QLIWMACHSAA | |
| NSIVAFCGT | | NSIVAFCGT | | PILGNYKEIC | | QLKDNAKEIGN | |
| NSIVALCGS | | NSIVALCGS | | PILNTSQRGI | | QLKDNAKELGN | |
| NSIVEFCGT | | NSIVEFCGT | | PILSFIMWAG | | QLKDNARELGN | |
| NSIVSMCSS | | NSIVSMCSS | | PILSPLTKGI | | QLKKQEIEGIK | |
| NSIVTFCGL | | NSIVTFCGL | | PILSPLTKGM | | QLKLATGLKNV | |
| NSIVVFCGT | | NSIVVFCGT | | PIMFSNKMAK | | QLKLATGLRNI | |
| NSIVVFCST | | NSIVVFCST | | PIMFSNKMAR | | QLKLATGLRNV | |
| NSIVVFVAP | | NSIVVFVAP | | PIMFSNKVAR | | QLKRQEIEGIK | |
| NSIWTSSSS | | NSIWTSSSS | | PINNGKGRYG | | QLLRHFQKDAK | |
| NSIYASPQL | | NSIYASPQL | | PINVTKENTG | | QLLRHFQKDAR | |
| NSKFESVAW | | NSKFESVAW | | PIRGWAPLSK | | QLLRHFQKNAK | |
| NSKKQIDTI | | NSKKQIDTI | | PIRLSGGGDI | | QLLVLLENEKT | |
| NSLIALCGS | | NSLIALCGS | | PISLGDCSFA | | QLLVWLENEKT | |
| NSLKLAIGL | | NSLKLAIGL | | PISLGGCSFA | | QLNEGIMNTSK | |
| NSLVALCGS | | NSLVALCGS | | PISVGSGSFP | | QLNEGVINTSK | |
| NSLYASPQL | | NSLYASPQL | | PITEINTWAR | | QLNEGVMNTSK | |
| NSLYASSQL | | NSLYASSQL | | PITGSPCAPG | | QLNPIDGPLPD | |
| NSLYSSPQL | | NSLYSSPQL | | PITGSPGAPG | | QLNPIDGPLPE | |
| NSMVTFCGL | | NSMVTFCGL | | PITGSPGSPG | | QLNPIDGPLPK | |
| NSNAITRSG | | NSNAITRSG | | PITGSPGVPG | | QLNPIDGPLPV | |
| NSNCKDPNN | | NSNCKDPNN | | PITGSPSAPG | | QLNQTYRNNRK | |
| NSNCRDPNN | | NSNCRDPNN | | PITIGECPKY | | QLNQTYRNTRK | |
| NSNCRNPNN | | NSNCRNPNN | | PIVPSFDMNN | | QLRDNAKEIGN | |

Fig. 83-276

| Block size 8 | SIN | Block size 9 | SIN | Block size 10 | SIN | Block size 11 | SIN |
|---|---|---|---|---|---|---|---|
| NSNGVQDII | | NSNGVQDII | | PIVPSFDMSK | | QLRDNAKELGN | |
| NSNLDYQIG | | NSNLDYQIG | | PIVPSFDMSN | | QLRDNARELGN | |
| NSNNGVKGF | | NSNNGVKGF | | PIVPSFEMSN | | QLRDNVKELGN | |
| NSNWSGYSG | | NSNWSGYSG | | PKCDIHLKDQ | | QLRENAEDIGN | |
| NSPAFNYNK | | NSPAFNYNK | | PKCDIHLRDQ | | QLRENAEDKGN | |
| NSPGRVTVS | | NSPGRVTVS | | PKCDLYLNGR | | QLRENAEDLGN | |
| NSPIFNYNK | | NSPIFNYNK | | PKCDLYLSGR | | QLRENAEDMGD | |
| NSPLPFQNI | | NSPLPFQNI | | PKCDPYLNGR | | QLRENAEDMGG | |
| NSPVFNYNK | | NSPVFNYNK | | PKCDTHLKDQ | | QLRENAEDMGN | |
| NSPVFNYNR | | NSPVFNYNR | | PKCDVHLKDQ | | QLRENAEDQGN | |
| NSQASYKIF | | NSQASYKIF | | PKEDEVWWTS | | QLRENAEDRGN | |
| NSQDTEISF | | NSQDTEISF | | PKEDKVWWTS | | QLRENAEEDCT | |
| NSQDTELSF | | NSQDTELSF | | PKEDRVWWTS | | QLRENAEEDGN | |
| NSQDTEVSF | | NSQDTEVSF | | PKEEKVWWTS | | QLRENAEEDGT | |
| NSQGEGTAA | | NSQGEGTAA | | PKEIEGICYP | | QLRENAEEMGN | |
| NSQGSGYAA | | NSQGSGYAA | | PKEKAIWTSG | | QLRQNAEEDGK | |
| NSRFESVAW | | NSRFESVAW | | PKEKTIWTSG | | QLRQNAEEDGR | |
| NSRFQIQGV | | NSRFQIQGV | | PKEMEGICYP | | QLSQKFEEIRW | |
| NSSCAAMDD | | NSSCAAMDD | | PKEMEGVCYP | | QLSSVSSFEKF | |
| NSSDICYPG | | NSSDICYPG | | PKENPAHKSQ | | QLSSVSSFERF | |
| NSSDKVDTL | | NSSDKVDTL | | PKERTIWTSG | | QLSSVSSFKRF | |
| NSSDTVDTL | | NSSDTVDTL | | PKERTSIWTS | | QLSTVSSFERF | |
| NSSEKVDTL | | NSSEKVDTL | | PKETRVWWTS | | QLTEVETYVLS | |
| NSSEKVNTL | | NSSEKVNTL | | PKFLPDLYDY | | QLTHHMRKKRG | |
| NSSERVDTL | | NSSERVDTL | | PKGLFGAIAG | | QLVWMACHSAA | |
| NSSILTDSQ | | NSSILTDSQ | | PKGRGLFGAI | | QLVWMACNSAA | |
| NSSKPFQNA | | NSSKPFQNA | | PKKRGLFGAI | | QMAGSNEQAAE | |
| NSSKPFQNT | | NSSKPFQNT | | PKKTGGPIYK | | QMAGSSEQAAE | |
| NSSKPLQNA | | NSSKPLQNA | | PKKTGGPIYR | | QMAIDNMQNKL | |
| NSSMPFHNI | | NSSMPFHNI | | PKLRSGFEML | | QMALQLFIKDY | |
| NSSMPFHNV | | NSSMPFHNV | | PKPRGLFGAI | | QMEKIVLLFAI | |
| NSSMPLHNI | | NSSMPLHNI | | PKQSRMQFSS | | QMESRGLFGAI | |
| NSSRPFQNA | | NSSRPFQNA | | PKRNRSILNT | | QMNGQSGRIDF | |
| NSSVSRMST | | NSSVSRMST | | PKSKLFTLSG | | QMQRFRRPDSS | |
| NSSYVCSGL | | NSSYVCSGL | | PKSLPDLYDY | | QMRDILGTFDT | |
| NSTCVVVMT | | NSTCVVVMT | | PKTRGLFGAI | | QMRDVIGTFDT | |
| NSTDKIDTL | | NSTDKIDTL | | PKVNGQAGRI | | QMRDVLGTFDT | |
| NSTDKVDTI | | NSTDKVDTI | | PKVNGQSGRI | | QMTRGLFGAIA | |
| NSTDKVDTL | | NSTDKVDTL | | PKYEEESKLK | | QNAEEDGKGCF | |
| NSTDKVNTI | | NSTDKVNTI | | PKYEEESKLN | | QNAEEDGRGCF | |
| NSTDTVDTI | | NSTDTVDTI | | PKYEEESRLN | | QNAEGIGIAAD | |
| NSTDTVDTL | | NSTDTVDTL | | PKYEKESKLN | | QNAEGTGIAAD | |
| NSTDTVDTV | | NSTDTVDTV | | PKYGYIIEEY | | QNAEGTGMAAD | |
| NSTDTVNTL | | NSTDTVNTL | | PKYIKQGSLK | | QNAEGTGTAAD | |
| NSTEHVDTI | | NSTEHVDTI | | PKYIKSDQLK | | QNAISTTFPYT | |
| NSTEKVDTI | | NSTEKVDTI | | PKYIKSGQLK | | QNALLKHRFEI | |
| NSTEKVDTL | | NSTEKVDTL | | PKYIPSGSLK | | QNALNGNGDPN | |
| NSTEQVDTI | | NSTEQVDTI | | PKYIPSNSLK | | QNALSGNGDPN | |
| NSTERVDTI | | NSTERVDTI | | PKYIPSRSLK | | QNAQGEGIAAD | |
| NSTETVNTL | | NSTETVNTL | | PKYISSGSLK | | QNAQGEGTAAD | |
| NSTKQIDTI | | NSTKQIDTI | | PKYLPDLYDY | | QNAQGIGQAAD | |
| NSTKQVDTI | | NSTKQVDTI | | PKYMNVKSLK | | QNAQGQGTAAD | |
| NSTNTVNTL | | NSTNTVNTL | | PKYVKQGSLK | | QNAQGSGYAAD | |
| NSTTHDRTA | | NSTTHDRTA | | PKYVKQGSLM | | QNAQGTGLAAD | |
| NSTTKVDTI | | NSTTKVDTI | | PKYVKQGSLR | | QNAQGTGQAAD | |
| NSTTQIDTI | | NSTTQIDTI | | PKYVKSDRLV | | QNASRHHMGEC | |
| NSTTQVDTI | | NSTTQVDTI | | PKYVKSEKLV | | QNASRHYMGEC | |
| NSTTQVDTL | | NSTTQVDTL | | PKYVKSERLV | | QNASRYYMGEC | |
| NSTTQVNTI | | NSTTQVNTI | | PKYVKSKRLV | | QNEFNKACELT | |
| NSTVQVDTI | | NSTVQVDTI | | PKYVNIKSLK | | QNEQGMGMAAD | |
| NSTVVNNIT | | NSTVVNNIT | | PKYVNVKSLK | | QNEQGSGYAAD | |
| NSTWVSQTY | | NSTWVSQTY | | PKYVNVRSLK | | QNEQGTGIAAD | |

Fig. 83-277

| Block size 8 | SIN | Block size 9 | SIN | Block size 10 | SIN | Block size 11 | SIN |
|---|---|---|---|---|---|---|---|
| NSTYKILSI | | NSTYKILSI | | PKYVRSEKLV | | QNEQGTGIAAE | |
| NSVIEKINT | | NSVIEKINT | | PLAGSAQHVE | | QNEQGVGIAAD | |
| NSVIEKMNI | | NSVIEKMNI | | PLAIGECPKY | | QNEQGVGMAAD | |
| NSVIEKMNT | | NSVIEKMNT | | PLAITWWNRN | | QNFPQTANTYR | |
| NSVKLSSGY | | NSVKLSSGY | | PLALGMKNVP | | QNFPQTTNTYR | |
| NSVRIGSKG | | NSVRIGSKG | | PLASLLEMCH | | QNFPRTTNTYR | |
| NSVRLSAGG | | NSVRLSAGG | | PLAVTWWNRK | | QNGKSGACKRA | |
| NSVRLSASG | | NSVRLSASG | | PLAVTWWNRN | | QNGKSSACKRA | |
| NSVVEKMNT | | NSVVEKMNT | | PLAVTWWNRS | | QNGNIRCQICI | |
| NSVVVFCGT | | NSVVVFCGT | | PLCAVNSWHI | | QNGNIRCTFCI | |
| NSVWAGRTI | | NSVWAGRTI | | PLCDVSGFAI | | QNGNLRCQICI | |
| NSVWAGRTM | | NSVWAGRTM | | PLCEISGFAI | | QNGNVRCQICI | |
| NSVWAGRTV | | NSVWAGRTV | | PLCEVNSWHI | | QNGNVRCTFCI | |
| NSWHIFGKD | | NSWHIFGKD | | PLCEVSGFAI | | QNGQGSGYAAD | |
| NSWHIFSKD | | NSWHIFSKD | | PLCEVSGFAV | | QNGSCRCMFCI | |
| NSWHILSKD | | NSWHILSKD | | PLCEVSSWHI | | QNGSYRCMFCI | |
| NSWHIYGKD | | NSWHIYGKD | | PLCNVSGFAI | | QNHGICAVATT | |
| NSWLGRTIS | | NSWLGRTIS | | PLCPFKGFFP | | QNICKPYIGKC | |
| NSWLGRTTS | | NSWLGRTTS | | PLCPFQGFFP | | QNIDKNALGDC | |
| NSWSGYSGI | | NSWSGYSGI | | PLCPFRGFFP | | QNIDKNALGEC | |
| NTALLNASC | | NTALLNASC | | PLELGDCSIA | | QNIDRNAIGDC | |
| NTALSTIAL | | NTALSTIAL | | PLELGNCSIA | | QNIDRNALGDC | |
| NTASRSGYE | | NTASRSGYE | | PLELRDCKIE | | QNIDSRAVGKC | |
| NTCMETIRN | | NTCMETIRN | | PLELRDCKVE | | QNIDSWAVGRC | |
| NTDLEALME | | NTDLEALME | | PLELRDCSIA | | QNIEKNALGDC | |
| NTDLEVLME | | NTDLEVLME | | PLFLYVRTNG | | QNIERNALGDC | |
| NTDLGAPLE | | NTDLGAPLE | | PLGAINTTLP | | QNIERNALGNC | |
| NTDLGSPLE | | NTDLGSPLE | | PLGALNTTLP | | QNILRTQESEC | |
| NTDLGTPLE | | NTDLGTPLE | | PLGCKMYALH | | QNINRITYGAC | |
| NTDWSGYSG | | NTDWSGYSG | | PLGCKTYALH | | QNIPVTQTMEL | |
| NTEFESIES | | NTEFESIES | | PLGCRMYALH | | QNIPVTQVEEL | |
| NTEIGAPQL | | NTEIGAPQL | | PLGEAPSPYN | | QNIWAYNAELL | |
| NTELLVLME | | NTELLVLME | | PLGSPPIVSN | | QNKLNNVIDKM | |
| NTEPLCDVS | | NTEPLCDVS | | PLGSPPMVSN | | QNKLYGAGNKL | |
| NTEPLCEVS | | NTEPLCEVS | | PLGSPPVVSN | | QNKLYGTGNKL | |
| NTEPLCNVS | | NTEPLCNVS | | PLGSSPNAYQ | | QNLFTLSGVAI | |
| NTETGALQL | | NTETGALQL | | PLGSSSNAYQ | | QNLSPRTVGQC | |
| NTETGAPQL | | NTETGAPQL | | PLGTPPTVSN | | QNLTKINNGDY | |
| NTETKAPQL | | NTETKAPQL | | PLHNIHPLTI | | QNLTKTNNGDY | |
| NTFGDCPKY | | NTFGDCPKY | | PLIKHENRMV | | QNLTKVNNGDY | |
| NTGSYVRLY | | NTGSYVRLY | | PLILKDCSIA | | QNLTKVNNGNY | |
| NTHIHIFSF | | NTHIHIFSF | | PLILKDCSVA | | QNLTKVNSGDY | |
| NTIDLTDSE | | NTIDLTDSE | | PLILRDCSVA | | QNNAIDEGDGC | |
| NTIEIFRSN | | NTIEIFRSN | | PLIRGQQGRM | | QNNFVPVIGAR | |
| NTIEVFKSN | | NTIEVFKSN | | PLIRHENRMV | | QNNFVPVVGAR | |
| NTIEVFRLN | | NTIEVFRLN | | PLKAEIAQKL | | QNNTTLIENTY | |
| NTIEVFRSN | | NTIEVFRSN | | PLKAEIAQRL | | QNNTTVVENTY | |
| NTIGDCPKY | | NTIGDCPKY | | PLKLVDGQDC | | QNPRIFLAMIT | |
| NTIGNCPKY | | NTIGNCPKY | | PLLQITSLCS | | QNPRMFLAMIT | |
| NTIGNLIAP | | NTIGNLIAP | | PLLSLLEMCH | | QNPRVFLAMIT | |
| NTIGNLVAP | | NTIGNLVAP | | PLMVAYMLER | | QNPRVFLTMIT | |
| NTIIENNVT | | NTIIENNVT | | PLPFQNIDSR | | QNPTEEQAVDI | |
| NTIIESNVT | | NTIIESNVT | | PLPFQNIDSW | | QNPTEEQAVEI | |
| NTILEKNVT | | NTILEKNVT | | PLPFQNINPR | | QNPTEEQAVGI | |
| NTILSTKAL | | NTILSTKAL | | PLPLCPFKGF | | QNPTEEQAVNI | |
| NTINRIFQP | | NTINRIFQP | | PLPLCPFRGF | | QNQNPRMFLAM | |
| NTINRNFQP | | NTINRNFQP | | PLQNASRHYM | | QNQVKIRRRVD | |
| NTINRSFQP | | NTINRSFQP | | PLQNTSKHYI | | QNRGLFGAIAG | |
| NTINRSFRP | | NTINRSFRP | | PLSGSAQHIE | | QNRGLFGAKAG | |
| NTINSKIDD | | NTINSKIDD | | PLSGSAQHVE | | QNRIMINPVKL | |
| NTKCQTSLG | | NTKCQTSLG | | PLSISVGSST | | QNRIQIDPVKL | |
| NTKCQTSMG | | NTKCQTSMG | | PLSKDNGIRI | | QNRIQIDQVKL | |

Fig. 83-278

| Block size 8 | SIN | Block size 9 | SIN | Block size 10 | SIN | Block size 11 | SIN |
|---|---|---|---|---|---|---|---|
| NTKCQTSVG | | NTKCQTSVG | | PLSKDNSIRL | | QNRIQIDSVKL | |
| NTKCQTYAG | | NTKCQTYAG | | PLSSPPTVYN | | QNRIQINPVKL | |
| NTKLPFQNL | | NTKLPFQNL | | PLTIGECPKY | | QNRIRIDPVKL | |
| NTKWNENQN | | NTKWNENQN | | PLTIGECPRY | | QNRLNNVIDKM | |
| NTLAERGVE | | NTLAERGVE | | PLTIGKCPKY | | QNRMQFSSLTV | |
| NTLIEQNIP | | NTLIEQNIP | | PLTKGILGFV | | QNRMQINPVKL | |
| NTLIEQNVP | | NTLIEQNVP | | PLTKGMLGFV | | QNRVKIDPVKL | |
| NTLKLATGM | | NTLKLATGM | | PLTTTPTKSY | | QNSEGTGIAAD | |
| NTLLENDVP | | NTLLENDVP | | PLVLDDCSLE | | QNSEGTGIVAD | |
| NTLRTQESE | | NTLRTQESE | | PLVLDDCSLK | | QNSEGTGTAAD | |
| NTLSEQNVP | | NTLSEQNVP | | PLVLGDCSIA | | QNSFVPVVGAR | |
| NTLSSVNTN | | NTLSSVNTN | | PLVMGQQGRM | | QNSQGEGTAAD | |
| NTLSSVTTN | | NTLSSVTTN | | PLVNGQSGRI | | QNTIDLTDSEM | |
| NTLTEKGIE | | NTLTEKGIE | | PLVPCEPIII | | QNTLKLATGMR | |
| NTLTEKGVE | | NTLTEKGVE | | PLVREQQGRM | | QNTQGEGTAAD | |
| NTLTEQNVP | | NTLTEQNVP | | PLVRGQQGRM | | QNTSKHYIGKC | |
| NTLTEREVE | | NTLTEREVE | | PLVRGQQGTM | | QNTSRHYIGKC | |
| NTLTERGIE | | NTLTERGIE | | PLVRGQQGWM | | QNTSRHYMGEC | |
| NTLTERGVE | | NTLTERGVE | | PMFLYIRTNG | | QNVNKITYGAC | |
| NTLTSVTTN | | NTLTSVTTN | | PMFLYVRTNG | | QNVNRITYGAC | |
| NTMHQLLRH | | NTMHQLLRH | | PMGFRYSGIK | | QNVNRITYGPC | |
| NTMTKDAER | | NTMTKDAER | | PMGTAPVLGN | | QNVNRITYGVC | |
| NTNGEQILI | | NTNGEQILI | | PMGVAPSPSN | | QNVPVTQAMEL | |
| NTNKTFQNI | | NTNKTFQNI | | PMHQLLRHFQ | | QNVPVTQTMEL | |
| NTNRTFQNI | | NTNRTFQNI | | PMISKCKTKE | | QNVPVTQVEEL | |
| NTNTINRSF | | NTNTINRSF | | PMISKCRTKE | | QNVSRIAIGNC | |
| NTNTLSSVT | | NTNTLSSVT | | PMISKCRTRE | | QPAATALANTI | |
| NTPSIDPKG | | NTPSIDPKG | | PMISKSRTKE | | QPAFSVQRNLP | |
| NTPSIEPKG | | NTPSIEPKG | | PMMWEINGPE | | QPCFYIELIRG | |
| NTPSIEPRG | | NTPSIEPRG | | PMRTPIAFLT | | QPCFYVELIRG | |
| NTPSVEPKG | | NTPSVEPKG | | PNAGKDPKKT | | QPCFYVELTRG | |
| NTPSVEPRG | | NTPSVEPRG | | PNALLKHRFE | | QPGDNITFLHN | |
| NTQFEAIGR | | NTQFEAIGR | | PNALTDDKSK | | QPGDNITFSDN | |
| NTQFEAVGK | | NTQFEAVGK | | PNALTDDRSK | | QPGDNITFSHN | |
| NTQFEAVGR | | NTQFEAVGR | | PNALTDDRST | | QPISLGDCSFA | |
| NTQFELIDN | | NTQFELIDN | | PNALTDNRSK | | QPKEKAIWTSG | |
| NTQFTAVGK | | NTQFTAVGK | | PNALTNDRSK | | QPKEKTIWTSG | |
| NTQFTSVGK | | NTQFTSVGK | | PNAPHKLCFP | | QPLSISVGSST | |
| NTQGEGTAA | | NTQGEGTAA | | PNAPHKLCYP | | QPNDGQVLYFL | |
| NTQIIVILV | | NTQIIVILV | | PNAPNKFCYP | | QPNERTIWTSG | |
| NTRCQTSVG | | NTRCQTSVG | | PNAPNKLCFP | | QPNIGPRALVR | |
| NTRKEPALI | | NTRKEPALI | | PNAPNKLCYP | | QPNIGPRPLVR | |
| NTRLPFQNL | | NTRLPFQNL | | PNAYQAKFES | | QPTFSVQRNLP | |
| NTSGEQMLI | | NTSGEQMLI | | PNAYQARFES | | QPTFSVQRSLP | |
| NTSGEQMLV | | NTSGEQMLV | | PNDERGNPGV | | QQFELIDNEFN | |
| NTSGKQMLI | | NTSGKQMLI | | PNDGKVECVC | | QQFELIDNEFS | |
| NTSKHYIGK | | NTSKHYIGK | | PNDGQVLYFL | | QQFELIDNEFT | |
| NTSKPFQNI | | NTSKPFQNI | | PNDKPFQNVN | | QQFEMIDNEFN | |
| NTSKPFQNT | | NTSKPFQNT | | PNDNASAVVW | | QQFKLIDNEFT | |
| NTSKPLQNT | | NTSKPLQNT | | PNECRFYALS | | QQGRMDYYWAI | |
| NTSQRGILE | | NTSQRGILE | | PNEERGNPGV | | QQGRMDYYWAV | |
| NTSQRGVLE | | NTSQRGVLE | | PNEERGSPGV | | QQGRMDYYWGI | |
| NTSRHYIGK | | NTSRHYIGK | | PNEGKVECIC | | QQGTMDYYWGI | |
| NTSRHYMGE | | NTSRHYMGE | | PNEGKVECVC | | QQGWMDYYWGI | |
| NTSYKILSI | | NTSYKILSI | | PNEKPFQNVN | | QQIESIIEAES | |
| NTTGRDVLV | | NTTGRDVLV | | PNENPAHKSQ | | QQIESMIEAES | |
| NTTGWSWPD | | NTTGWSWPD | | PNENPVHKSQ | | QQIESMVEAES | |
| NTTLIENTY | | NTTLIENTY | | PNEVGAKILT | | QQIGNVINWTQ | |
| NTTLPFHNI | | NTTLPFHNI | | PNEVGARIIT | | QQIGNVINWTR | |
| NTTLPFHNV | | NTTLPFHNV | | PNEVGARILT | | QQMRDILGTFD | |
| NTTLSTIAL | | NTTLSTIAL | | PNFHYEECSC | | QQMRDVIGTFD | |
| NTTNYYNET | | NTTNYYNET | | PNFYYEECSC | | QQMRDVLGTFD | |

Fig. 83-279

| Block size 8 | SIN | Block size 9 | SIN | Block size 10 | SIN | Block size 11 | SIN |
|---|---|---|---|---|---|---|---|
| NTTVVENTY | | NTTVVENTY | | PNGCIEGKLS | | QQSFSPSPGAR | |
| NTTWVNQTY | | NTTWVNQTY | | PNGCIESKLS | | QQSFSPSPGDR | |
| NTTYKILSI | | NTTYKILSI | | PNGKPFQNVN | | QQTRVDKLTQG | |
| NTTYRILSI | | NTTYRILSI | | PNGSIPNDKP | | QQTRVDRLTQG | |
| NTVINNITT | | NTVINNITT | | PNGSIPNEKP | | QQVESMIEAES | |
| NTVINNMTT | | NTVINNMTT | | PNGSIPNGKP | | QRAIDNMQNKL | |
| NTVKDRSPY | | NTVKDRSPY | | PNGSIPNNKP | | QRAMMDQVREG | |
| NTVNTLIEQ | | NTVNTLIEQ | | PNGSISNDKP | | QRAMMDQVRES | |
| NTVVNNITT | | NTVVNNITT | | PNGTIVKTIT | | QRAMVDQVRES | |
| NTWARNILR | | NTWARNILR | | PNGTIVKTLT | | QRCCNLFEKFF | |
| NTWLGGTIS | | NTWLGGTIS | | PNGTIVRTIT | | QRFRRPDSSWL | |
| NTWLGRTIS | | NTWLGRTIS | | PNGTKVNTLT | | QRGILEDEQMY | |
| NTWLGRTTS | | NTWLGRTTS | | PNGTLVKTIT | | QRGNIRCNICI | |
| NTWVGRTIS | | NTWVGRTIS | | PNGTMVKTIT | | QRGVLEDEQMY | |
| NTYDHAQYR | | NTYDHAQYR | | PNGTVVKTIT | | QRINGVKLEEN | |
| NTYDHKKYR | | NTYDHKKYR | | PNGYIEGKLS | | QRINMLADRID | |
| NTYDHRKYK | | NTYDHRKYK | | PNHEGEGIPL | | QRLNPMHQLLR | |
| NTYDHSHYR | | NTYDHSHYR | | PNIGPRALVR | | QRLNTMHQLLR | |
| NTYDHSKYR | | NTYDHSKYR | | PNIGPRPFVR | | QRRRFIQNALN | |
| NTYDHSQYR | | NTYDHSQYR | | PNIGPRPLIR | | QRRRFVQNALN | |
| NTYDHSRYR | | NTYDHSRYR | | PNIGPRPLVM | | QRRRFVQNALS | |
| NTYDHSTYR | | NTYDHSTYR | | PNIGPRPLVR | | QRSKFLLMDAL | |
| NTYDHTKYR | | NTYDHTKYR | | PNIGSRPRVR | | QRSKFLLMDSL | |
| NTYDHTQYR | | NTYDHTQYR | | PNKWGDILDG | | QRSWMKIYWHL | |
| NTYINNATI | | NTYINNATI | | PNKWGNVLDG | | QRSWMKLYWHL | |
| NTYINNTTI | | NTYINNTTI | | PNLGIVECVC | | QRTRALVRSGM | |
| NTYNHTEYR | | NTYNHTEYR | | PNLGKVECVC | | QRTRALVRTGM | |
| NTYNHTQYR | | NTYNHTQYR | | PNLGQVECVC | | QSAIDQITGKL | |
| NTYQWIIKN | | NTYQWIIKN | | PNLYNIRNLH | | QSAIDQITRKL | |
| NTYQWIIRN | | NTYQWIIRN | | PNMGKVECVC | | QSAIDQVTGKL | |
| NTYQWVIRN | | NTYQWVIRN | | PNNEKGNPGV | | QSAINQITGKL | |
| NTYVNNTTI | | NTYVNNTTI | | PNNEKGNQGV | | QSAVDQITGKL | |
| NTYVNNTTV | | NTYVNNTTV | | PNNERGNHGV | | QSAVNQITGKL | |
| NVECVCRDN | | NVECVCRDN | | PNNERGNPGV | | QSDAQIDESCE | |
| NVEGWVVIA | | NVEGWVVIA | | PNNERGNQGV | | QSDKPFQNVSR | |
| NVELLVLME | | NVELLVLME | | PNNERGTQGV | | QSEFNKACELT | |
| NVENLFDEV | | NVENLFDEV | | PNNGKVECIC | | QSERGEDTIEE | |
| NVESNGNLI | | NVESNGNLI | | PNNIDRAVKL | | QSERGEETIEE | |
| NVESNGNLV | | NVESNGNLV | | PNNKPFQNVN | | QSERGEETVEE | |
| NVGLKVSLH | | NVGLKVSLH | | PNNMARAVKL | | QSFPQTTNTYR | |
| NVGLNMSLH | | NVGLNMSLH | | PNNMDKAVKL | | QSFSPSPGARP | |
| NVGLNVSLH | | NVGLNVSLH | | PNNMDRAVKL | | QSFSPSPGDRP | |
| NVGYLCAGI | | NVGYLCAGI | | PNNNASAIVW | | QSFYRSINWLT | |
| NVHPLAIGE | | NVHPLAIGE | | PNNNASAVIW | | QSGHIEECSCY | |
| NVHPLTIGE | | NVHPLTIGE | | PNNNASAVVW | | QSGLPVGGNEK | |
| NVHRNTIGD | | NVHRNTIGD | | PNNNASTVIW | | QSGRIDFHWLI | |
| NVHRNTIGN | | NVHRNTIGN | | PNQKIICISA | | QSGRIDFHWLL | |
| NVHRSTIGD | | NVHRSTIGD | | PNQKIICIST | | QSGRIDFHWLM | |
| NVIDKMNKQ | | NVIDKMNKQ | | PNQKIITIDS | | QSGRIDFHWLV | |
| NVIDKMNNQ | | NVIDKMNNQ | | PNQKIITIGF | | QSGRISFYWTI | |
| NVIDKMYKQ | | NVIDKMYKQ | | PNQKIITIGS | | QSGRISIYWTL | |
| NVINDKIDD | | NVINDKIDD | | PNQKIITMGS | | QSGRVSFYWTI | |
| NVINWTKDS | | NVINWTKDS | | PNQKILCASA | | QSKGLFGAIAG | |
| NVINWTQDA | | NVINWTQDA | | PNQKILCTSA | | QSKMQFSSLTV | |
| NVINWTRDA | | NVINWTRDA | | PNQKILFASA | | QSLIIAARNIV | |
| NVINWTRDS | | NVINWTRDS | | PNQKIMCISA | | QSLIIAARSIV | |
| NVIVTREPY | | NVIVTREPY | | PNQKITCISA | | QSLQQIESIIE | |
| NVKELGNGC | | NVKELGNGC | | PNQKIVTIGS | | QSLQQIESMIE | |
| NVKNLFDEV | | NVKNLFDEV | | PNQKLFALSG | | QSLQQIESMVE | |
| NVKNLHDQI | | NVKNLHDQI | | PNQKLFASSG | | QSLRSILANNG | |
| NVKNLHEQV | | NVKNLHEQV | | PNQKLFTLSG | | QSLRSILASSG | |
| NVKNLYDKV | | NVKNLYDKV | | PNQKTITIGS | | QSLSISIGSST | |

Fig. 83-280

| Block size 8 | SIN | Block size 9 | SIN | Block size 10 | SIN | Block size 11 | SIN |
|---|---|---|---|---|---|---|---|
| NVKNLYDRV | | NVKNLYDRV | | PNQRILCTSA | | QSLSISVESST | |
| NVKNLYEKV | | NVKNLYEKV | | PNQSIITIGS | | QSLSISVGSST | |
| NVKNLYNKV | | NVKNLYNKV | | PNSGKVECVC | | QSLVIAARNIV | |
| NVKSLKLAS | | NVKSLKLAS | | PNSHYEECSC | | QSNNSTDTVDT | |
| NVKSLKLAT | | NVKSLKLAT | | PNTLLKHRFE | | QSNNSTDTVNT | |
| NVKSLKLVT | | NVKSLKLVT | | PNVLLKHRFE | | QSNNSTNTVNT | |
| NVLDGVTAS | | NVLDGVTAS | | PNVRCVCRDN | | QSPLGAINTTL | |
| NVLIGQGDI | | NVLIGQGDI | | PNVYQAKFEA | | QSPNVYQAKFE | |
| NVLIGQGDV | | NVLIGQGDV | | PNVYQAKFES | | QSPNVYQARFE | |
| NVLLKHRFE | | NVLLKHRFE | | PNVYQARFEA | | QSPNVYQSRFE | |
| NVLLSPEEV | | NVLLSPEEV | | PNVYQARFES | | QSPRMFLAMIT | |
| NVLRTQESE | | NVLRTQESE | | PNVYQSRFEA | | QSRFEAVAWSA | |
| NVLSIAPIM | | NVLSIAPIM | | PNWSGYSGSF | | QSRGLFGAIAG | |
| NVLSVAPIM | | NVLSVAPIM | | PNYHYEECSC | | QSRMQFSSFTV | |
| NVNKITYGA | | NVNKITYGA | | PNYQSLRSIL | | QSRMQFSSLAV | |
| NVNRITYGA | | NVNRITYGA | | PNYYYEECSC | | QSRMQFSSLTV | |
| NVNRITYGP | | NVNRITYGP | | PPEQSKMQFS | | QSSDDFALILN | |
| NVNRITYGV | | NVNRITYGV | | PPEQSRMQFS | | QSSDDFALIVN | |
| NVPEKIHTR | | NVPEKIHTR | | PPHCDQFLEF | | QSSLPLALGMK | |
| NVPEKIRTR | | NVPEKIRTR | | PPKQSRMQFS | | QSTLKLATGMR | |
| NVPEKIRVK | | NVPEKIRVK | | PPLELGDCSI | | QSWSYIVERPS | |
| NVPEKQTRG | | NVPEKQTRG | | PPLELRDCSI | | QSYFQLFLVCV | |
| NVPERQTRG | | NVPERQTRG | | PPLVLGDCSI | | QTAAQKAMMDQ | |
| NVPETQTRG | | NVPETQTRG | | PPQCDKFLEF | | QTAAQRAMMDQ | |
| NVPEWSYIV | | NVPEWSYIV | | PPQCDLFLEF | | QTAAQRAMVDQ | |
| NVPQAQDRG | | NVPQAQDRG | | PPQCDLHLEF | | QTAIDQINGKL | |
| NVPQAQNRG | | NVPQAQNRG | | PPQCDQFLEF | | QTAIDQITGKL | |
| NVPQIEARG | | NVPQIEARG | | PPQCDRFLEF | | QTALYKNANTL | |
| NVPQIEPRG | | NVPQIEPRG | | PPQCDSHLKF | | QTANTYRNTDS | |
| NVPQIESRG | | NVPQIESRG | | PPVNGQSGRI | | QTATKRIRLAI | |
| NVPQIQNRG | | NVPQIQNRG | | PPVQSKMQFS | | QTATKRIRMAI | |
| NVPQMESRG | | NVPQMESRG | | PPVQSRMQFS | | QTATKRIRMAT | |
| NVPQVQDRG | | NVPQVQDRG | | PPYSHGTGTG | | QTATKRLRMAI | |
| NVPQVQNRG | | NVPQVQNRG | | PQAQDRGLFG | | QTDCVLEAMAF | |
| NVPSIQSRG | | NVPSIQSRG | | PQAQNRGLFG | | QTDCVLEAMAL | |
| NVPVTQAME | | NVPVTQAME | | PQCDLHLEFK | | QTDEYKNTGDS | |
| NVPVTQTME | | NVPVTQTME | | PQCDSHLKFK | | QTDEYKNTRDS | |
| NVPVTQVEE | | NVPVTQVEE | | PQCEITGFAP | | QTDLYKVATGR | |
| NVQNDYTTV | | NVQNDYTTV | | PQCKITGFAP | | QTESRGLFGAI | |
| NVQNNYTTI | | NVQNNYTTI | | PQCQIAGFAP | | QTFDWTLNRNQ | |
| NVQNNYTTV | | NVQNNYTTV | | PQCQITGFAP | | QTIVLDTDWSG | |
| NVRCVCRDN | | NVRCVCRDN | | PQCQVTGFAP | | QTIVLNTDWSG | |
| NVRGSGLRI | | NVRGSGLRI | | PQEARVWWTS | | QTIVLTTDWSG | |
| NVRGSGMRI | | NVRGSGMRI | | PQENRVWWTS | | QTKKMTITFLI | |
| NVRGTGMRI | | NVRGTGMRI | | PQETGVWWTS | | QTKLYGNGNKL | |
| NVRNLHDQI | | NVRNLHDQI | | PQETRVWWTS | | QTKLYGSGNKL | |
| NVRNLHDQV | | NVRNLHDQV | | PQIEARGLFG | | QTKLYGSGSKL | |
| NVRNLHDRI | | NVRNLHDRI | | PQIEPRGLFG | | QTKLYKNTNTL | |
| NVRNLHDRT | | NVRNLHDRT | | PQIESRGLFG | | QTKTMTITFLI | |
| NVRNLHDRV | | NVRNLHDRV | | PQINGQSGRI | | QTLVANNDWSG | |
| NVRNLHEQI | | NVRNLHEQI | | PQIQNRGLFG | | QTLVSNDDWSG | |
| NVRNLHEQV | | NVRNLHEQV | | PQLEGFSAES | | QTLVSNNDWSG | |
| NVRNLHERI | | NVRNLHERI | | PQLNPIDGPL | | QTLVSNSDWSG | |
| NVRNLYDKV | | NVRNLYDKV | | PQLNQTYRNN | | QTMELVEAEKH | |
| NVRSLKLAT | | NVRSLKLAT | | PQLNQTYRNT | | QTMELVETEKH | |
| NVSEWSYIV | | NVSEWSYIV | | PQMESRGLFG | | QTMELVETEKN | |
| NVSRIAIGN | | NVSRIAIGN | | PQMNGQSGRI | | QTMELVETKKH | |
| NVSSSGTSK | | NVSSSGTSK | | PQSGRIVVDY | | QTNGNLIAPEY | |
| NVSWTSNSI | | NVSWTSNSI | | PQSSPPTVYN | | QTNNSTDTVNT | |
| NVTETLYLN | | NVTETLYLN | | PQTANTYRNT | | QTNNSTETVNT | |
| NVTHTGTSK | | NVTHTGTSK | | PQTESRGLFG | | QTNTTLIENTY | |
| NVTHVQNNY | | NVTHVQNNY | | PQTTNTYRNT | | QTPLGAINTTL | |

Fig. 83-281

| Block size 8 | SIN | Block size 9 | SIN | Block size 10 | SIN | Block size 11 | SIN |
|---|---|---|---|---|---|---|---|
| NVTKENTGS | | NVTKENTGS | | PQVNGQFGRI | | QTPLGALNTTL | |
| NVTNVQNDY | | NVTNVQNDY | | PQVNGQSGRI | | QTRGIFGAIAG | |
| NVTNVQNNY | | NVTNVQNNY | | PQVNGQSGRV | | QTRGLFGAIAG | |
| NVTRSGTSK | | NVTRSGTSK | | PQVQDRGLFG | | QTRVDKLTQGR | |
| NVTSSGTSK | | NVTSSGTSK | | PQVQNRGLFG | | QTRVDRLTQGR | |
| NVTVTHAKD | | NVTVTHAKD | | PQYPNVRCVC | | QTSGNLIAPEY | |
| NVTVTHAKN | | NVTVTHAKN | | PRALVRGQQG | | QTSLLLATGMR | |
| NVTVTHAQD | | NVTVTHAQD | | PRFLPDLYDY | | QTSVGGIDTNK | |
| NVTVTHAQN | | NVTVTHAQN | | PRGHYKISKS | | QTSVGGINTNK | |
| NVTVTHARD | | NVTVTHARD | | PRGLFGAIAG | | QTSVGGINTNR | |
| NVTVTHSIE | | NVTVTHSIE | | PRGLLEVGTR | | QTTLYKNANTL | |
| NVTVTHSIN | | NVTVTHSIN | | PRIFLAMITY | | QTTNTYRNTDP | |
| NVTVTHSVD | | NVTVTHSVD | | PRLLQNSQVF | | QTTNTYRNTDS | |
| NVTVTHSVE | | NVTVTHSVE | | PRLRSGFEML | | QTTNTYRNTDT | |
| NVTVTHSVN | | NVTVTHSVN | | PRMCSLMQGS | | QTVKIKTNGNL | |
| NVTVTQAQD | | NVTVTQAQD | | PRMFLAMITY | | QTVKIQTNGNL | |
| NVTVTSSIE | | NVTVTSSIE | | PRNDDSSSNS | | QTVKIQTSGNL | |
| NVTVTSSVE | | NVTVTSSVE | | PRNDDSSSSS | | QTVVLNTDWSG | |
| NVTYTGISK | | NVTYTGISK | | PRNEDGSSSS | | QTYAGAINSSK | |
| NVTYTGTSK | | NVTYTGTSK | | PRNEDSSSNS | | QTYAGAINSSR | |
| NVTYTGTSR | | NVTYTGTSR | | PRNEDSSSSS | | QTYAGAVNSSK | |
| NVVLNVSLH | | NVVLNVSLH | | PRPADGTGSC | | QTYDWTLNRNQ | |
| NVVRKMMTN | | NVVRKMMTN | | PRPFVRGQQG | | QTYQKRMGVQM | |
| NVVRKMMTS | | NVVRKMMTS | | PRPLIRGQQG | | QTYRNNRKEPA | |
| NVWAGRTVS | | NVWAGRTVS | | PRPLVMGQQG | | QTYRNTRKEPA | |
| NVWTYNAEL | | NVWTYNAEL | | PRPLVREQQG | | QTYTGAINSSK | |
| NVYKALSIY | | NVYKALSIY | | PRPLVRGQQG | | QTYTGAINSSR | |
| NVYKILSIC | | NVYKILSIC | | PRPMDSTGSC | | QVAGSSEQAAE | |
| NVYKILSIY | | NVYKILSIY | | PRPRRGLFGA | | QVCAAWSSSSC | |
| NVYKVLAIY | | NVYKVLAIY | | PRPVDGIGSC | | QVCIAWSSASC | |
| NVYKVLSIY | | NVYKVLSIY | | PRPVDGTGSC | | QVCIAWSSSSC | |
| NVYQAKFEA | | NVYQAKFEA | | PRRGLFGAIA | | QVCMAWSSSSC | |
| NVYQAKFES | | NVYQAKFES | | PRRSGAAGAA | | QVCVAWSSSSC | |
| NVYQARFEA | | NVYQARFEA | | PRSRNGFEML | | QVDCFLWHVRK | |
| NVYQARFES | | NVYQARFES | | PRSRSGFEML | | QVDTIMEKNIT | |
| NVYQSRFEA | | NVYQSRFEA | | PRSRSGFEVL | | QVDTIMEKNVT | |
| NVYRALSIY | | NVYRALSIY | | PRSVDGTGSC | | QVDTIMERNVT | |
| NWFGYFGIF | | NWFGYFGIF | | PRTTNTYRNT | | QVECVCRDNWN | |
| NWHASNRPW | | NWHASNRPW | | PRTVGQCPKY | | QVEELVHGGID | |
| NWHGSNRPW | | NWHGSNRPW | | PRVFLAMITY | | QVEELVHGGIN | |
| NWILWISFA | | NWILWISFA | | PRVFLTMITY | | QVEELVHGGVD | |
| NWKGANRPI | | NWKGANRPI | | PRVRNQSGRI | | QVEELVHGQVN | |
| NWKGANRPV | | NWKGANRPV | | PRYGYIIEEY | | QVEELVHRGID | |
| NWKGSNRPI | | NWKGSNRPI | | PRYGYIIEKY | | QVEGRIQDLEK | |
| NWKGSNRPV | | NWKGSNRPV | | PRYIPSGSLK | | QVEKRINMIAD | |
| NWKGSNRPW | | NWKGSNRPW | | PRYLPDLYDY | | QVEKRINMLAD | |
| NWKSSNRPV | | NWKSSNRPV | | PRYNGQRSWM | | QVENRINMLAD | |
| NWLTIGISG | | NWLTIGISG | | PRYPDVRCVC | | QVEQRINMLAD | |
| NWLTKATNG | | NWLTKATNG | | PRYPNVRCVC | | QVERRINMLAD | |
| NWLTKETNG | | NWLTKETNG | | PRYVKQGSLK | | QVESMIEAESS | |
| NWLTKKEPD | | NWLTKKEPD | | PRYVKQSSLP | | QVEVTNATELV | |
| NWLTKKKNP | | NWLTKKKNP | | PSAGKDPKKT | | QVFPQLNQTYR | |
| NWLTKKKPD | | NWLTKKKPD | | PSAGRDPKKT | | QVIKLLPFAAA | |
| NWMGSNRPV | | NWMGSNRPV | | PSAIDQITGK | | QVIVTREPYVS | |
| NWNGMNRPI | | NWNGMNRPI | | PSAPEGMCYP | | QVKIRRRVDIN | |
| NWNGMNRPV | | NWNGMNRPV | | PSAPGVKGFG | | QVKIRRRVDMN | |
| NWPDGAEIE | | NWPDGAEIE | | PSAPHGLCYP | | QVKIRRRVDTN | |
| NWPDGAKIE | | NWPDGAKIE | | PSAPHRLCYP | | QVKIRRRVDVN | |
| NWPDGANIG | | NWPDGANIG | | PSCASNINIR | | QVKLSSGYKDI | |
| NWPDGSNIG | | NWPDGSNIG | | PSCATNINIR | | QVLAIYATVAG | |
| NWPSSSGGL | | NWPSSSGGL | | PSDAQAFYKI | | QVNGQFGRIDF | |
| NWQGANRPI | | NWQGANRPI | | PSDAQAFYKL | | QVNGQSGRIDF | |

Fig. 83-282

| Block size 8 | SIN | Block size 9 | SIN | Block size 10 | SIN | Block size 11 | SIN |
|---|---|---|---|---|---|---|---|
| NWQGANRPV | | NWQGANRPV | | PSDTPRGEDA | | QVNGQSGRINF | |
| NWQGSNRPV | | NWQGSNRPV | | PSDTPRGEDG | | QVREGRNPGNA | |
| NWRGANRPV | | NWRGANRPV | | PSDTPRGEDN | | QVRESRNPGNA | |
| NWRGSNRPI | | NWRGSNRPI | | PSDTPRGEDS | | QVTDIWAYNAE | |
| NWRGSNRPV | | NWRGSNRPV | | PSECRTFFLT | | QVTGKLNRLIE | |
| NWRGSNRPW | | NWRGSNRPW | | PSERGLQRRR | | QWDWPDGAKIE | |
| NWRQANNGE | | NWRQANNGE | | PSFFRNMIWL | | QWNWPDGAEIE | |
| NWSGYSGAF | | NWSGYSGAF | | PSFFRNMVWL | | QWNWPDGAKIE | |
| NWSGYSGIF | | NWSGYSGIF | | PSFFRNVVWL | | QYICSPVLTDN | |
| NWSGYSGSF | | NWSGYSGSF | | PSFGVSGINE | | QYLCTGILTDT | |
| NWSGYSGVF | | NWSGYSGVF | | PSFGVSGVNE | | QYLCTGVLTDT | |
| NWSKPQCQI | | NWSKPQCQI | | PSFYAEMKWL | | QYLLFQDILMR | |
| NWSWHDGAI | | NWSWHDGAI | | PSFYRNLLWI | | QYPNVRCVCRD | |
| NWSWPDGAE | | NWSWPDGAE | | PSGCKMYALH | | QYRALISWPLS | |
| NWTGTNRPI | | NWTGTNRPI | | PSGIEYNGKS | | QYRALISWPQS | |
| NWTGTNRPV | | NWTGTNRPV | | PSGPLKAEIA | | QYRALVSWPLS | |
| NWTKDSITD | | NWTKDSITD | | PSGSLKLAIG | | QYREEALLNRI | |
| NWTQDAMTE | | NWTQDAMTE | | PSGVEYNGKS | | QYREEALLNRL | |
| NWTRDAMTE | | NWTRDAMTE | | PSGYAQTDCV | | QYREESLLNRL | |
| NWTRDSIIE | | NWTRDSIIE | | PSHEGEGIPL | | QYRSLISWPLS | |
| NWTRDSITE | | NWTRDSITE | | PSIDPKGLFG | | QYRTESLQNRI | |
| NWTRDSLTE | | NWTRDSLTE | | PSIEPKGLFG | | QYSGFVRTLFQ | |
| NWTRDSMTE | | NWTRDSMTE | | PSIEPRGLFG | | RAAVSADPLAS | |
| NWTRDSVTE | | NWTRDSVTE | | PSIMSCDSPS | | RACFYVELIRG | |
| NYARLYIWG | | NYARLYIWG | | PSIQSRGLFG | | RADEICIGYLS | |
| NYDSIRGEF | | NYDSIRGEF | | PSKWGDILEG | | RADKICIGYLS | |
| NYEELKHLL | | NYEELKHLL | | PSKWGDVLDG | | RAGYEMLKVPN | |
| NYEELREHL | | NYEELREHL | | PSKWGNVLDG | | RAIATPGMQIR | |
| NYEELREQL | | NYEELREQL | | PSLRMKWMMA | | RAIDNMQNKLN | |
| NYGPINVTK | | NYGPINVTK | | PSNAQAFYKI | | RAIVSADPLAS | |
| NYGVKGFGF | | NYGVKGFGF | | PSNMDRAVKL | | RALISWEMGLA | |
| NYHQSFVPS | | NYHQSFVPS | | PSNSLKLAIG | | RALISWEMGQA | |
| NYHYEECSC | | NYHYEECSC | | PSNSRFESVA | | RALISWGMGQA | |
| NYKEICIAW | | NYKEICIAW | | PSPGARPKVN | | RALISWPLSSP | |
| NYKEICVAW | | NYKEICVAW | | PSPGDRPKVN | | RALISWPQSSP | |
| NYKEIRIAW | | NYKEIRIAW | | PSPLKLVDGQ | | RALLAKSVFNS | |
| NYLIRALTL | | NYLIRALTL | | PSPSNSRFES | | RALMSVLLGSS | |
| NYLLLNKSL | | NYLLLNKSL | | PSPYNSKFES | | RALMSVPLGSS | |
| NYLMLNKSL | | NYLMLNKSL | | PSPYNSRFES | | RALSIYSCIAS | |
| NYPKYEEES | | NYPKYEEES | | PSQKLFALSG | | RALTLNTMTKD | |
| NYPKYSEES | | NYPKYSEES | | PSQTLRVRSN | | RALVRGQQGRM | |
| NYQQSFVPS | | NYQQSFVPS | | PSRSLKLAIG | | RALVRSGMDPR | |
| NYQSLRSIL | | NYQSLRSIL | | PSSAQEKNDL | | RALVRTGMDPR | |
| NYREICIAW | | NYREICIAW | | PSSDNEQTDL | | RALVSWEMGQA | |
| NYREVCIAW | | NYREVCIAW | | PSSSYRRPIG | | RALVSWPLSSP | |
| NYSKYEEES | | NYSKYEEES | | PSSSYRRPVG | | RAMMDQVREGR | |
| NYSLPPNFS | | NYSLPPNFS | | PSSTKEKNDL | | RAMMDQVRESR | |
| NYVCSGLVG | | NYVCSGLVG | | PSSTKEKNEL | | RAMVDQVRESR | |
| NYVSMEFSL | | NYVSMEFSL | | PSSTQEKNDL | | RANQRLNPMHQ | |
| NYYNETFVN | | NYYNETFVN | | PSSTQERNDL | | RANQRLNTMHQ | |
| NYYYEECSC | | NYYYEECSC | | PSTGKDPKKT | | RAPYRSLIRFP | |
| PAANNADHR | | PAANNADHR | | PSTGNHGSLV | | RARIDARIDFE | |
| PAANSADHR | | PAANSADHR | | PSTISCDSPS | | RARIDARVDFE | |
| PAANSAHHR | | PAANSAHHR | | PSTMSCDSPS | | RARIDARVDSE | |
| PAAPHGLCY | | PAAPHGLCY | | PSTVSCDSPS | | RARIKTRLFTI | |
| PAATALANT | | PAATALANT | | PSVEPKGLFG | | RARPQVNGQSG | |
| PACAYGPAV | | PACAYGPAV | | PSVEPRGLFG | | RATEYIIKGVY | |
| PACDLHLTG | | PACDLHLTG | | PSVKLPMGAI | | RATEYIMKGVY | |
| PACDLYLTG | | PACDLYLTG | | PSVQSRGLFG | | RATEYMMKGVY | |
| PACIYGLVV | | PACIYGLVV | | PSVVSCDSPS | | RATFLRSNAPS | |
| PACVYGLAV | | PACVYGLAV | | PSWAGNILRT | | RATVSADPLAS | |
| PACVYGLVV | | PACVYGLVV | | PSWAGNVLRT | | RATVSADPLLS | |

Fig. 83-283

| Block size 8 | SIN | Block size 9 | SIN | Block size 10 | SIN | Block size 11 | SIN |
|---|---|---|---|---|---|---|---|
| PACVYGPAV | | PACVYGPAV | | PSWEGNILRT | | RATVSADPLVS | |
| PADTRIYYF | | PADTRIYYF | | PTAPHGLCYP | | RAVDGTIAGFI | |
| PADTRVYYF | | PADTRVYYF | | PTAVDTCYPF | | RAVGKCPRYVK | |
| PAECRTFFL | | PAECRTFFL | | PTDTPRGEDS | | RAVKLYKKLKR | |
| PAETRIYYF | | PAETRIYYF | | PTDTPRIQDS | | RAVKLYRKLKR | |
| PAETRVYYF | | PAETRVYYF | | PTDTPRVQDD | | RAWLHVCVTGD | |
| PAFSVQRNL | | PAFSVQRNL | | PTDTPRVQDG | | RCCNLFEKFFP | |
| PAHKSQLIW | | PAHKSQLIW | | PTDTPRVQDN | | RCDDQCMESIR | |
| PAHKSQLVW | | PAHKSQLVW | | PTDTPRVQDS | | RCFYVELIRGK | |
| PAKLLKERG | | PAKLLKERG | | PTDVIRSWRK | | RCFYVELIRGM | |
| PALIIWGIH | | PALIIWGIH | | PTDVVRSWKK | | RCFYVELIRGR | |
| PALIIWGVH | | PALIIWGVH | | PTDVVRSWRK | | RCFYVELIRGS | |
| PALITWGIH | | PALITWGIH | | PTDVVRSWRR | | RCFYVELTRGR | |
| PALIVWGIH | | PALIVWGIH | | PTECRTFFLT | | RCFYVELVRGR | |
| PALIVWGVH | | PALIVWGVH | | PTEEQAVDIC | | RCICEKLEQSG | |
| PALRMKWMM | | PALRMKWMM | | PTEEQAVGIC | | RCICRDNWKGS | |
| PALSINELG | | PALSINELG | | PTEEQAVNIC | | RCINRCFYVEL | |
| PALSINELS | | PALSINELS | | PTFDSLNITA | | RCLLQSLQQIE | |
| PALSISELS | | PALSISELS | | PTFSVQRNLP | | RCNTKCQTSLG | |
| PANGICYPG | | PANGICYPG | | PTFSVQRSLP | | RCNTKCQTSVG | |
| PANKQASYK | | PANKQASYK | | PTGCKMYALH | | RCNTRCQTSVG | |
| PANNQASYK | | PANNQASYK | | PTGYAQTDCV | | RCPRYVKQSSL | |
| PANNQASYR | | PANNQASYR | | PTKSYFANLK | | RCQTPLGAINT | |
| PANSQASYK | | PANSQASYK | | PTTEINTWAR | | RCQTSVGGINT | |
| PANSQAYTK | | PANSQAYTK | | PTTTIKTWAR | | RCRETRGLFGA | |
| PAQNAISIT | | PAQNAISIT | | PVAEINTWAR | | RCRKTRGLFGA | |
| PAQNAISTT | | PAQNAISTT | | PVAKAGFIEN | | RCTCRDNWKGS | |
| PASNQASYK | | PASNQASYK | | PVELSSGYKD | | RCTISLVKTTL | |
| PASRYLIDM | | PASRYLIDM | | PVGEAPSPYN | | RCVCRDNWKGS | |
| PASRYLTDM | | PASRYLTDM | | PVGGNEKKAK | | RCVCRDNWMGS | |
| PASSQAYTK | | PASSQAYTK | | PVGISSMGEA | | RCVCRDNWRGS | |
| PATAQMALQ | | PATAQMALQ | | PVGISSMMEA | | RCYQFALGQGT | |
| PATIGECPK | | PATIGECPK | | PVGISSMVEA | | RDAMTEIWSYN | |
| PAYCNTDLG | | PAYCNTDLG | | PVGPGSFPDG | | RDAMTEVWSYN | |
| PCEPIIIEK | | PCEPIIIEK | | PVGSGSFPDG | | RDCKIEAVIYG | |
| PCEPIIIER | | PCEPIIIER | | PVGTAPVLGN | | RDCKVEAVIYG | |
| PCEPIIVER | | PCEPIIVER | | PVGVAPSPSN | | RDCSIAGWLLG | |
| PCEPTIIER | | PCEPTIIER | | PVHFQNQVKI | | RDCSVAGWLLG | |
| PCFWLEMIR | | PCFWLEMIR | | PVHFRNQIKI | | RDDAINNRFQI | |
| PCFWVELIR | | PCFWVELIR | | PVHFRNQVKI | | RDDLEPGTFDI | |
| PCFWVELVR | | PCFWVELVR | | PVHFRSQVKI | | RDEAINNRFQI | |
| PCFWVEMIR | | PCFWVEMIR | | PVHKSQLIWM | | RDEAINNRIKI | |
| PCFYIELIR | | PCFYIELIR | | PVHKSQLVWM | | RDEAINSRFQI | |
| PCFYVELIR | | PCFYVELIR | | PVHLGDCNFE | | RDEAISNRFQI | |
| PCFYVELTR | | PCFYVELTR | | PVHLGDCRFE | | RDEGNGCFTFY | |
| PCLTDKGSI | | PCLTDKGSI | | PVHLGDCSFE | | RDILRTQESEC | |
| PDATAVAVL | | PDATAVAVL | | PVICLGHHAV | | RDILRTQESSC | |
| PDATAVVVL | | PDATAVVVL | | PVICLGHHSV | | RDITIGSICMV | |
| PDDGAVAVL | | PDDGAVAVL | | PVICMGHHAV | | RDLGNCHPIGM | |
| PDECRFYAL | | PDECRFYAL | | PVIGARPQVN | | RDNAKDEGNGC | |
| PDGADINFM | | PDGADINFM | | PVIMTDGPAN | | RDNAKDLGNGC | |
| PDGADLPFT | | PDGADLPFT | | PVKGWAPLSK | | RDNAKEIGNGC | |
| PDGAEIEYF | | PDGAEIEYF | | PVKLNSGYKD | | RDNAKELGNGC | |
| PDGAELPFA | | PDGAELPFA | | PVKLSGGYKD | | RDNAMILGNGC | |
| PDGAELPFI | | PDGAELPFI | | PVKLSNGYKD | | RDNANDLGNGC | |
| PDGAELPFT | | PDGAELPFT | | PVKLSSGYKD | | RDNLEPGTFDI | |
| PDGAKIEYF | | PDGAKIEYF | | PVKLSSGYKE | | RDNLEPGTFDL | |
| PDGAKIEYS | | PDGAKIEYS | | PVLGNYKEIC | | RDNVKELGDGC | |
| PDGAKIKYF | | PDGAKIKYF | | PVLGNYKEMC | | RDNVKELGNGC | |
| PDGAKIQYF | | PDGAKIQYF | | PVLGNYREIC | | RDNWHASNRPW | |
| PDGAKLPFT | | PDGAKLPFT | | PVLGNYREVC | | RDNWHGSNRPW | |
| PDGALLPFD | | PDGALLPFD | | PVLTDNPRPN | | RDNWKGANRPI | |

Fig. 83-284

| Block size 8 | SIN | Block size 9 | SIN | Block size 10 | SIN | Block size 11 | SIN |
|---|---|---|---|---|---|---|---|
| PDGALLPLT | | PDGALLPLT | | PVMGARPQVN | | RDNWKGANRPV | |
| PDGANIDFM | | PDGANIDFM | | PVNGQSGRID | | RDNWKGSNRPI | |
| PDGANIDFV | | PDGANIDFV | | PVNNGKGRYG | | RDNWKGSNRPV | |
| PDGANIGFM | | PDGANIGFM | | PVPVGSGSFP | | RDNWKGSNRPW | |
| PDGANIGLC | | PDGANIGLC | | PVQNAISTTF | | RDNWKSSNRPV | |
| PDGANINFM | | PDGANINFM | | PVQSKMQFSS | | RDNWMGSNRPV | |
| PDGANINLM | | PDGANINLM | | PVQSRMQFSS | | RDNWNGMNRPI | |
| PDGANISFM | | PDGANISFM | | PVQTDEYKNT | | RDNWNGMNRPV | |
| PDGAQIKYF | | PDGAQIKYF | | PVRLSSGYKD | | RDNWQGANRPI | |
| PDGAQIQYF | | PDGAQIQYF | | PVSVGSGSFP | | RDNWQGANRPV | |
| PDGARIQYF | | PDGARIQYF | | PVTEINTWAR | | RDNWQGSNRPV | |
| PDGCRFYAL | | PDGCRFYAL | | PVTIGECPKY | | RDNWRGANRPV | |
| PDGPQIQYF | | PDGPQIQYF | | PVTIGKCPKY | | RDNWRGSNRPI | |
| PDGSDIGFM | | PDGSDIGFM | | PVTLSSGYKD | | RDNWRGSNRPV | |
| PDGSNIGFM | | PDGSNIGFM | | PVTLTMGYKD | | RDNWRGSNRPW | |
| PDGSNIGFV | | PDGSNIGFV | | PVTQAMELVE | | RDNWTGTNRPI | |
| PDHEGEGIP | | PDHEGEGIP | | PVTQTMELVE | | RDNWTGTNRPV | |
| PDIYDFNEG | | PDIYDFNEG | | PVTQVEELVH | | RDQGWSYIVER | |
| PDLYDYKED | | PDLYDYKED | | PVTSSIDLIE | | RDQKSLRGRGS | |
| PDLYDYKEN | | PDLYDYKEN | | PVTSSIDLVE | | RDSIKSWRNNI | |
| PDLYDYKES | | PDLYDYKES | | PVTSSVDLIE | | RDSITEVWSYN | |
| PDLYDYKKN | | PDLYDYKKN | | PVTSSVDLVE | | RDSLEPGTFDL | |
| PDNEAVAVL | | PDNEAVAVL | | PVTSTIDLIE | | RDSLTEIWSYN | |
| PDNGAVAVL | | PDNGAVAVL | | PVVFTDGSAT | | RDSMTEIWSYN | |
| PDNGAVAVV | | PDNGAVAVV | | PVVGARPKVN | | RDSMTEVWSYN | |
| PDPFRLLQN | | PDPFRLLQN | | PVVGARPQVN | | RDSRSGYETFK | |
| PDPGVKGFA | | PDPGVKGFA | | PVVMTDGPAD | | RDSRSGYETFR | |
| PDRASFFKG | | PDRASFFKG | | PVVMTDGPAN | | RDSSILTDSQT | |
| PDRASFFRG | | PDRASFFRG | | PVVMTDGPAS | | RDSTQKAIDIM | |
| PDRASFLRG | | PDRASFLRG | | PVVPSFDMSN | | RDSTQKAIDNM | |
| PDRATFLRS | | PDRATFLRS | | PVVRARPQVN | | RDSTQMAIDNM | |
| PDSGAVAVL | | PDSGAVAVL | | PWARNILRTQ | | RDSTQRAIDNM | |
| PDSSWLFGG | | PDSSWLFGG | | PWIRFNSDLD | | RDSVTELWSYN | |
| PDSTAVAVI | | PDSTAVAVI | | PWIRFNSDLN | | RDVLVIWGIHH | |
| PDSVLVNTY | | PDSVLVNTY | | PWIRFNSNLD | | RDVLVLWGIHH | |
| PDTTAVAVL | | PDTTAVAVL | | PWIRINNETI | | RDVLVMWGIHH | |
| PDTYDFNEG | | PDTYDFNEG | | PWMRINNETI | | RDVLVMWGLHH | |
| PDVRCICRD | | PDVRCICRD | | PWMRISNETI | | RDVWTYNAELL | |
| PDVRCTCRD | | PDVRCTCRD | | PWVLLNASWF | | RECFNPCFYVE | |
| PDVRCVCRD | | PDVRCVCRD | | PWVRFNSDLD | | REEALLNRLNI | |
| PDWFRNVLS | | PDWFRNVLS | | PWVRINNETI | | REEALLNRLSI | |
| PDYHYEECS | | PDYHYEECS | | PWVRMNNETI | | REEALLSRLNI | |
| PDYQIGYVC | | PDYQIGYVC | | PYIGKCPKYI | | REEAMQNRIQI | |
| PDYQSIRSI | | PDYQSIRSI | | PYLNGREWSY | | REESLLNRLSI | |
| PDYQSLRSI | | PDYQSLRSI | | PYNSKFESVA | | REESQLKKQEI | |
| PEAGLKWEL | | PEAGLKWEL | | PYNSRFESVA | | REESQLKRQEI | |
| PEAYNFNEG | | PEAYNFNEG | | PYPGNNNGVK | | REEVTNATETV | |
| PEDLIVFNT | | PEDLIVFNT | | PYPGNNNNGV | | REFEVMNHEFS | |
| PEEAKYVEW | | PEEAKYVEW | | PYPGNSNNGV | | REFEVVDHEFS | |
| PEEAKYVWW | | PEEAKYVWW | | PYPGSNNNGV | | REFEVVNHEFS | |
| PEEGTSIWT | | PEEGTSIWT | | PYRALISWEM | | REFGVVNHEFS | |
| PEERNSIWT | | PEERNSIWT | | PYRALMSVPL | | REGKHIVERIL | |
| PEERPSIWT | | PEERPSIWT | | PYRALMSVPM | | REGLILEYYFV | |
| PEERTSIWT | | PEERTSIWT | | PYRSLIQFPI | | REGRNPGNAEI | |
| PEEVKYVWW | | PEEVKYVWW | | PYRSLIQFPM | | REGRRKTNLYG | |
| PEEVSEAQG | | PEEVSEAQG | | PYRSLIRFPI | | REGYSLVGIDP | |
| PEEVSETQG | | PEEVSETQG | | PYRSLIRFPV | | REIGNGCFEFY | |
| PEFGYLLKG | | PEFGYLLKG | | PYRTLLMNEL | | REILTKITVDH | |
| PEFGYLLRG | | PEFGYLLRG | | PYRTLLMSEL | | REILTKTTVDH | |
| PEGMCYPGF | | PEGMCYPGF | | PYSHGTGTGY | | REILTRTTVDH | |
| PEGMCYPGS | | PEGMCYPGS | | PYTGDPPYSH | | REITFHGAKEI | |
| PEKIHTRGL | | PEKIHTRGL | | PYTLVSTGSW | | REITFHGAKEV | |

Fig. 83-285

| Block size 8 | SIN | Block size 9 | SIN | Block size 10 | SIN | Block size 11 | SIN |
|---|---|---|---|---|---|---|---|
| PEKIRTRGL | | PEKIRTRGL | | PYTLVSTKEW | | REITFHRAKEV | |
| PEKIRVKRR | | PEKIRVKRR | | PYTLVSTKSW | | REITFYGAKEI | |
| PEKQTRGIF | | PEKQTRGIF | | PYTLVSTRSW | | REKNVTVTHSV | |
| PEKQTRGLF | | PEKQTRGLF | | PYTLVSTSSW | | RELCTINSWHI | |
| PELTGLDCI | | PELTGLDCI | | PYTLVTTSSW | | RELGNGCFEFY | |
| PELTGLDCM | | PELTGLDCM | | PYVSCDPDEC | | RELVRKTRFLP | |
| PELTGLNCI | | PELTGLNCI | | PYVSCDPDGC | | REMTFHGAKEV | |
| PELTGMDCI | | PELTGMDCI | | PYVSCDPLGC | | RENAEDIGNGC | |
| PELTGMNCI | | PELTGMNCI | | PYVSCDPNEC | | RENAEDKGNGC | |
| PENAYKIVK | | PENAYKIVK | | PYVSCDPSGC | | RENAEDLGNGC | |
| PEQSKMQFS | | PEQSKMQFS | | PYVSCDPTGC | | RENAEDMGDGC | |
| PEQSRMQFS | | PEQSRMQFS | | PYVSCEPDEC | | RENAEDMGGGC | |
| PERQTRGIF | | PERQTRGIF | | QAADLKSTQA | | RENAEDMGNGC | |
| PERQTRGLF | | PERQTRGLF | | QAADLKSTQT | | RENAEDQGNGC | |
| PESMREEYQ | | PESMREEYQ | | QAADYESTQA | | RENAEDRGNGC | |
| PESMREEYR | | PESMREEYR | | QAADYKSTQA | | RENAEEDCTGC | |
| PESVLINTY | | PESVLINTY | | QAADYKSTQK | | RENAEEDGNGC | |
| PESVLVNTY | | PESVLVNTY | | QAADYKSTQT | | RENAEEDGTAC | |
| PETQTRGIF | | PETQTRGIF | | QAAIDQINGK | | RENAEEDGTGC | |
| PEVCLKWDL | | PEVCLKWDL | | QAAIDQISGK | | REPFISCSHFE | |
| PEVCLKWEL | | PEVCLKWEL | | QAAIDQITGK | | REPFISCSHLE | |
| PEWFRNILS | | PEWFRNILS | | QAAIDQVNGK | | REPFISCSPLE | |
| PEWFRNVLS | | PEWFRNVLS | | QAAVDQITGK | | REPFISCSQLE | |
| PEWSYIIEK | | PEWSYIIEK | | QADEICIGYL | | REPFVACGPAE | |
| PEWSYIMEK | | PEWSYIMEK | | QADEICIGYM | | REPFVACGPSE | |
| PEWSYIVEK | | PEWSYIVEK | | QADSEMNKLY | | REPFVACGPTE | |
| PEWSYIVER | | PEWSYIVER | | QAELLIAMEN | | REPFVACSPSE | |
| PEYAFKIAK | | PEYAFKIAK | | QAELLVAMEN | | REPFVSCGPSE | |
| PEYAYIVKK | | PEYAYIVKK | | QAFRDNLEPG | | REPYVSCDPDE | |
| PEYAYKIAK | | PEYAYKIAK | | QAFYKILKIK | | REPYVSCDPDG | |
| PEYAYKIIK | | PEYAYKIIK | | QAFYKILKIR | | REPYVSCDPLG | |
| PEYAYKIVK | | PEYAYKIVK | | QAFYRSINWL | | REPYVSCDPNE | |
| PEYAYKVVK | | PEYAYKVVK | | QAGRIDFHWM | | REPYVSCDPSG | |
| PEYAYRIIK | | PEYAYRIIK | | QAGRMTFYWA | | REPYVSCDPTG | |
| PEYGFKISK | | PEYGFKISK | | QAGRMTFYWK | | REPYVSCEPDE | |
| PEYGFKISR | | PEYGFKISR | | QAGRMTFYWT | | REQKQEFKMNP | |
| PEYGFRISK | | PEYGFRISK | | QAGVDRFYRI | | REQLSQKFEEI | |
| PEYGHLITG | | PEYGHLITG | | QAGVDRFYRT | | REQQGRMDYYW | |
| PEYGHLTTG | | PEYGHLTTG | | QAGVNRFYRT | | REREGGRRRKR | |
| PEYGHLVTG | | PEYGHLVTG | | QAHTKVLYFH | | RERLGSWSWHD | |
| PEYGYLITG | | PEYGYLITG | | QAKFEAVAWS | | RESGGIDKEPM | |
| PEYQSLRSI | | PEYQSLRSI | | QAKFESVAWS | | RESGGIDKESM | |
| PFAAAPPEQ | | PFAAAPPEQ | | QAKGLFGAIA | | RESRNPGNAEI | |
| PFAAAPPKQ | | PFAAAPPKQ | | QALKDNLEPG | | RESRSPGNAEI | |
| PFAAAPPVQ | | PFAAAPPVQ | | QALQLLFEVE | | RETRGLFGAIA | |
| PFAKDNSIR | | PFAKDNSIR | | QALQLLLEVE | | REVEVVNATET | |
| PFDDRLRRD | | PFDDRLRRD | | QALRDNLEPG | | REWSYIVERPK | |
| PFDFDKISQ | | PFDFDKISQ | | QALRDSLEPG | | REWSYIVERTK | |
| PFDIDKIIT | | PFDIDKIIT | | QAMELVEAEK | | REWSYLIEDPA | |
| PFDVPDYQS | | PFDVPDYQS | | QANLCRFLET | | REWSYLIEDPG | |
| PFDVPEYQS | | PFDVPEYQS | | QAQDRGLFGA | | REWSYLIEDPN | |
| PFDVPGYQS | | PFDVPGYQS | | QAQNRGLFGA | | REWSYLIEDPS | |
| PFDVPNYQS | | PFDVPNYQS | | QARFEAVAWS | | REWSYLIEDPT | |
| PFHKDNAIR | | PFHKDNAIR | | QARFESVAWS | | RFADQELGDAP | |
| PFHKDNALR | | PFHKDNALR | | QASPSCLVVR | | RFEAVAWSATA | |
| PFHKDNAVR | | PFHKDNAVR | | QASYKIFKSH | | RFEGWIVGNPA | |
| PFHKGNSAR | | PFHKGNSAR | | QASYKIFKSQ | | RFEIIEGRDRA | |
| PFHLATKQV | | PFHLATKQV | | QASYKIFKSR | | RFEIIEGRDRI | |
| PFHLGTKQV | | PFHLGTKQV | | QASYKIFKSY | | RFEIIEGRDRN | |
| PFHLGTRQV | | PFHLGTRQV | | QASYRIFKSH | | RFEIIEGRDRT | |
| PFHNIHPLA | | PFHNIHPLA | | QATIDQITGK | | RFESVAWSASA | |
| PFHNIHPLT | | PFHNIHPLT | | QAVDICKAAI | | RFESVAWSATA | |

Fig. 83-286

| Block size 8 | SIN | Block size 9 | SIN | Block size 10 | SIN | Block size 11 | SIN |
|---|---|---|---|---|---|---|---|
| PFHNVHPFT | | PFHNVHPFT | | QAVDICKAAL | | RFGEGEQIIVT | |
| PFHNVHPLT | | PFHNVHPLT | | QAVDICKAAM | | RFGESEQIIVT | |
| PFILKDCSV | | PFILKDCSV | | QAVGICKAAM | | RFGESEQIVVT | |
| PFISCSHFE | | PFISCSHFE | | QAVNICKAAM | | RFGESEQVIVT | |
| PFISCSHLE | | PFISCSHLE | | QAWSYIVERP | | RFIEIGVTRRE | |
| PFISCSHME | | PFISCSHME | | QAYQKRMGLQ | | RFIQNALNGNG | |
| PFISCSHSE | | PFISCSHSE | | QAYQKRMGVQ | | RFLEIGVTRRE | |
| PFISCSPLE | | PFISCSPLE | | QAYTKILYFH | | RFLFSSIKKYE | |
| PFISCSQLE | | PFISCSQLE | | QAYTKIMYFH | | RFLPVAGGTGS | |
| PFISCSYLE | | PFISCSYLE | | QAYTKVLYFH | | RFLPVAGGTSS | |
| PFKGFFPFH | | PFKGFFPFH | | QAYTKVMYFH | | RFLPVSGGTSS | |
| PFKLLQNSQ | | PFKLLQNSQ | | QCDLHLEFKA | | RFLPVTGGTSS | |
| PFKLLQTSQ | | PFKLLQTSQ | | QCDNNCIESI | | RFNSDLDYQIG | |
| PFLDRIRRD | | PFLDRIRRD | | QCDSHLKFKA | | RFNSDPDYQIG | |
| PFLDRLRRD | | PFLDRLRRD | | QCEITGFAPF | | RFNSNLDYQIG | |
| PFPVGSGSF | | PFPVGSGSF | | QCFNPMIAEL | | RFQIQGIKLTQ | |
| PFQGFFPFH | | PFQGFFPFH | | QCFNPMIIEL | | RFQIQGVKLAQ | |
| PFQNASRHH | | PFQNASRHH | | QCFNPMIVEL | | RFQIQGVKLIQ | |
| PFQNASRHY | | PFQNASRHY | | QCFNPMTVEL | | RFQIQGVKLTQ | |
| PFQNASRYY | | PFQNASRYY | | QCFNPMVVEL | | RFQIQGVRLTQ | |
| PFQNICKPY | | PFQNICKPY | | QCKITGFAPF | | RFRRPDSSWLF | |
| PFQNIDSRA | | PFQNIDSRA | | QCMESIRNNT | | RFSYVFCLALG | |
| PFQNIDSWA | | PFQNIDSWA | | QCQIAGFAPF | | RFTEIGVTRRE | |
| PFQNIHPAT | | PFQNIHPAT | | QCQITGFAPF | | RFTNEEALRQI | |
| PFQNIHPIT | | PFQNIHPIT | | QCQTPLGAIN | | RFTYSGIRTNG | |
| PFQNIHPVT | | PFQNIHPVT | | QCQVTGFAPF | | RFVEIGVTRRE | |
| PFQNINPRT | | PFQNINPRT | | QCRICIDFRD | | RFVFSIAASYK | |
| PFQNINSRA | | PFQNINSRA | | QCRICILDQN | | RFVFSNAASYK | |
| PFQNINSRT | | PFQNINSRT | | QCRICIRADG | | RFVFSSAASYK | |
| PFQNINSRV | | PFQNINSRV | | QDAMTEVWSY | | RFVQNALNGNG | |
| PFQNISRIA | | PFQNISRIA | | QDCDLINGAL | | RFVQNALSGNG | |
| PFQNISRIS | | PFQNISRIS | | QDEFCYTLIT | | RFYALSQGTTI | |
| PFQNISRVS | | PFQNISRVS | | QDEFCYTLMT | | RFYIQMCTELK | |
| PFQNLSPRT | | PFQNLSPRT | | QDEFCYTLVT | | RFYIQMCTELQ | |
| PFQNTSKHY | | PFQNTSKHY | | QDGKSSACKR | | RFYRICKLVGI | |
| PFQNTSRHY | | PFQNTSRHY | | QDIIDNDNWS | | RFYRTCKLLGI | |
| PFQNVHPIT | | PFQNVHPIT | | QDIIDNNNWS | | RFYRTCKLVGI | |
| PFQNVHPVT | | PFQNVHPVT | | QDILEKTHNG | | RFYVQMCTELK | |
| PFQNVNKIT | | PFQNVNKIT | | QDIWAYNAEL | | RGAYERMCNIL | |
| PFQNVNKVT | | PFQNVNKVT | | QDLEEYVEDT | | RGDKICLGHHA | |
| PFQNVNRIT | | PFQNVNRIT | | QDLEKYVEDT | | RGDLNFVNRAN | |
| PFQNVNSRA | | PFQNVNSRA | | QDLERYVEDT | | RGDQICIGYHA | |
| PFQNVSRIA | | PFQNVSRIA | | QDLWAYNAEL | | RGDQICIGYHS | |
| PFQNVSRTA | | PFQNVSRTA | | QDNAIRFGES | | RGDQICVGYHS | |
| PFQSLIPKA | | PFQSLIPKA | | QDNAKDEGNG | | RGDYNNTTGRD | |
| PFQSLVPKA | | PFQSLVPKA | | QDRGLFGAIA | | RGEDTIEERFE | |
| PFQSLVPRA | | PFQSLVPRA | | QDRGLFGAKA | | RGEETIEEKFE | |
| PFRALISWE | | PFRALISWE | | QDSECVSHNG | | RGEETIEERFA | |
| PFRALISWG | | PFRALISWG | | QDSFYRSMKW | | RGEETIEERFE | |
| PFRALVSWE | | PFRALVSWE | | QDTEISFTIT | | RGEETVEERFE | |
| PFRGFFPFH | | PFRGFFPFH | | QDTELSFTIT | | RGEFNQVEKRI | |
| PFRLLQNSQ | | PFRLLQNSQ | | QDTELSFTVT | | RGEFNQVENRI | |
| PFRLLQSSQ | | PFRLLQSSQ | | QDTEVSFTIT | | RGEFNQVEQRI | |
| PFRTLMSCP | | PFRTLMSCP | | QDTTWDVFIE | | RGEFSQVEQRI | |
| PFRTLMSVE | | PFRTLMSVE | | QDVIMEVVFP | | RGEFSQVERRI | |
| PFRTLMSVK | | PFRTLMSVK | | QDVWAYNAEL | | RGEKANVLIGQ | |
| PFSKDNGIR | | PFSKDNGIR | | QDWSGYSGAF | | RGETLKIRTNG | |
| PFSKDNSIQ | | PFSKDNSIQ | | QDWSYIVERP | | RGETTGRNCTI | |
| PFSKDNSIR | | PFSKDNSIR | | QEAIDKITNK | | RGETTGRNCTV | |
| PFSKDNSVR | | PFSKDNSVR | | QEAIEKITNK | | RGEVFVIREPF | |
| PFTIGECPK | | PFTIGECPK | | QEAIGKITNK | | RGEVSVIREPF | |
| PFTIGECPR | | PFTIGECPR | | QEAINKITNK | | RGFAPFSKDNG | |

Fig. 83-287

| Block size 8 | SIN | Block size 9 | SIN | Block size 10 | SIN | Block size 11 | SIN |
|---|---|---|---|---|---|---|---|
| PFTKDNSIR | | PFTKDNSIR | | QEALQNRIMI | | RGFFGAIAGFI | |
| PFVACGPAE | | PFVACGPAE | | QEARVWWTSN | | RGFFPFHKDNA | |
| PFVACGPSE | | PFVACGPSE | | QEDCMIKAVR | | RGFLIIGKEDR | |
| PFVACGPTE | | PFVACGPTE | | QEDCMMKAVR | | RGFLILGKEDK | |
| PFVACSPSE | | PFVACSPSE | | QEDCMVKAVR | | RGFLILGKEDR | |
| PFVRGQQGR | | PFVRGQQGR | | QEDRMIKAVR | | RGFLILGKENK | |
| PFVSCGPSE | | PFVSCGPSE | | QEECMIKAVR | | RGFLILGREDK | |
| PFVSCSHLE | | PFVSCSHLE | | QEELKSLFSS | | RGFVHFVEALA | |
| PFYLGTKQV | | PFYLGTKQV | | QEELRFLFSS | | RGFVYFVEALA | |
| PFYLGTRQV | | PFYLGTRQV | | QEELRSLFSS | | RGFVYFVEILA | |
| PGAPGVKGF | | PGAPGVKGF | | QEEVTNATET | | RGFVYFVETLA | |
| PGAPHGLCY | | PGAPHGLCY | | QEFKMNPNKK | | RGGRNSFFSRL | |
| PGARPKVNG | | PGARPKVNG | | QEFKMNPNQK | | RGGSINTKLPF | |
| PGARPQVNG | | PGARPQVNG | | QEIDGIKLKS | | RGGSINTRLPF | |
| PGARRIDFH | | PGARRIDFH | | QEIEGIKLES | | RGHIFVIREPF | |
| PGARRIDFN | | PGARRIDFN | | QEIEGIKLKS | | RGHVFVIREPF | |
| PGATINEEA | | PGATINEEA | | QEIEGIKLKT | | RGHYKISKSTK | |
| PGATVNEEA | | PGATVNEEA | | QEIEGIRLKS | | RGIEVVNATET | |
| PGATVNEGA | | PGATVNEGA | | QEIGNGCFEF | | RGIFGAIAGFI | |
| PGCDRLQDT | | PGCDRLQDT | | QEIKMNPNQK | | RGILEDEQMYQ | |
| PGDHITFSH | | PGDHITFSH | | QEINGIKLKS | | RGILTKTTVDH | |
| PGDIIVFNT | | PGDIIVFNT | | QEIVDNKNWS | | RGINDRNFWRG | |
| PGDLILFNT | | PGDLILFNT | | QEIVDNNNWS | | RGIPPLELGDC | |
| PGDLIVFNT | | PGDLIVFNT | | QEIVDNSNWS | | RGKHSNGTIHD | |
| PGDNIIFSH | | PGDNIIFSH | | QEIVGNDNWS | | RGKLKRRAIAT | |
| PGDNITFSD | | PGDNITFSD | | QEIVSNDNWS | | RGLCKINSWHI | |
| PGDNITFSH | | PGDNITFSH | | QEKNDLYGAQ | | RGLCTINSWHI | |
| PGDRPKVNG | | PGDRPKVNG | | QEKNDLYGTQ | | RGLFGAIAGFI | |
| PGDSIIFNS | | PGDSIIFNS | | QEKNPALRMK | | RGLFGAKAGFI | |
| PGDSITFSH | | PGDSITFSH | | QEKNPSLRMK | | RGLISTPLGSP | |
| PGDTVTFTF | | PGDTVTFTF | | QELGDAPFLD | | RGLISTPLGTP | |
| PGELDNNGE | | PGELDNNGE | | QENRVWWTSN | | RGLLEVGTRWM | |
| PGELNNNGE | | PGELNNNGE | | QERGLFGAIA | | RGLLGAIAGFI | |
| PGERIMFES | | PGERIMFES | | QERNDLYGTQ | | RGLMSTPLGSP | |
| PGERITFES | | PGERITFES | | QESECACANG | | RGLQRRRFIQN | |
| PGERTTFES | | PGERTTFES | | QESECACING | | RGLQRRRFVQN | |
| PGETLKVES | | PGETLKVES | | QESECACVNG | | RGLSSRISFYW | |
| PGETLNIES | | PGETLNIES | | QESECICING | | RGLWDPFRQSE | |
| PGETLNVES | | PGETLNVES | | QESECICINR | | RGLWDSFRQSE | |
| PGEVDNNGE | | PGEVDNNGE | | QESECLCIDG | | RGNGCFEIFHK | |
| PGFHFEECS | | PGFHFEECS | | QESECQCIDG | | RGNHGVKGWAF | |
| PGFVENLEE | | PGFVENLEE | | QESECQCIGG | | RGNPGVKGWAF | |
| PGIFENSCI | | PGIFENSCI | | QESECQCISG | | RGNQGVKGWAF | |
| PGIFENSCL | | PGIFENSCL | | QESECQRIDG | | RGNSPAFNYNK | |
| PGIFESSCL | | PGIFESSCL | | QESECVCHDG | | RGNSPIFNYNK | |
| PGIFGNSCL | | PGIFGNSCL | | QESECVCHKG | | RGNSPVFNYNK | |
| PGIKGFGFL | | PGIKGFGFL | | QESECVCHNG | | RGNSPVFNYNR | |
| PGKFTNEEA | | PGKFTNEEA | | QESECVCHNS | | RGNSPVFNYSK | |
| PGKQAKGLF | | PGKQAKGLF | | QESECVCHSG | | RGQAADLKSTQ | |
| PGLFENSCL | | PGLFENSCL | | QESECVCING | | RGQHANGTIHD | |
| PGLINGWYG | | PGLINGWYG | | QESECVCISG | | RGQPKEKAIWT | |
| PGLVAGWYG | | PGLVAGWYG | | QESECVCMNG | | RGQPKEKTIWT | |
| PGMMMGMFN | | PGMMMGMFN | | QESECVCQDE | | RGQPKERTIWT | |
| PGMQIRGFV | | PGMQIRGFV | | QESECVCVNG | | RGQQGRMDYYW | |
| PGNAEIEDL | | PGNAEIEDL | | QESECVRHNG | | RGQQGTMDYYW | |
| PGNFNDYEE | | PGNFNDYEE | | QESLLATGM | | RGQQGWMDYYW | |
| PGNNBNGVK | | PGNNBNGVK | | QESLMLATGM | | RGQSGRISFYW | |
| PGNNNGVKG | | PGNNNGVKG | | QESSCTCIKG | | RGQSGRVSFYW | |
| PGNNNNGVK | | PGNNNNGVK | | QESSCTCILG | | RGRGSTLGLDI | |
| PGQTLRIRS | | PGQTLRIRS | | QESSCTCIQG | | RGRGVFELSDE | |
| PGQTLRVKS | | PGQTLRVKS | | QESSCTCIRG | | RGRHANGTIHD | |
| PGQTLRVRS | | PGQTLRVRS | | QESSCVCIKG | | RGRHANGTIND | |

Fig. 83-288

| Block size 8 | SIN | Block size 9 | SIN | Block size 10 | SIN | Block size 11 | SIN |
|---|---|---|---|---|---|---|---|
| PGQTVKIKT | | PGQTVKIKT | | QESSCVCMKG | | RGRHANGTMHD | |
| PGQTVKIQT | | PGQTVKIQT | | QESSCVCMNG | | RGRHSNGTIHD | |
| PGRFTNEEA | | PGRFTNEEA | | QESSCVCVKG | | RGRLCNPLNPF | |
| PGRVSVSTK | | PGRVSVSTK | | QETRVWWTSN | | RGRPEEAKYVE | |
| PGRVTVSTK | | PGRVTVSTK | | QFALGHGTTL | | RGRPEEAKYVW | |
| PGRVTVSTQ | | PGRVTVSTQ | | QFALGQGATL | | RGRPEEVKYVW | |
| PGRVTVSTR | | PGRVTVSTR | | QFALGQGTTL | | RGRPKEDEVWW | |
| PGSFNDYEE | | PGSFNDYEE | | QFEAIGREFN | | RGRPKEDKVWW | |
| PGSFNNYEE | | PGSFNNYEE | | QFEAVGKEFN | | RGRPKEDRVWW | |
| PGSFPDGAQ | | PGSFPDGAQ | | QFEAVGREFN | | RGRPKEEKVWW | |
| PGSGDWPDG | | PGSGDWPDG | | QFEAVGREFS | | RGSARHIEECS | |
| PGSGNWPDG | | PGSGNWPDG | | QFELIDNEFN | | RGSFYRSMRWL | |
| PGSIENLEE | | PGSIENLEE | | QFELIDNEFS | | RGSGLRILIRG | |
| PGSIENQEE | | PGSIENQEE | | QFELIDNEFT | | RGSGLRILVRG | |
| PGSIKNQEE | | PGSIKNQEE | | QFELIDNKFN | | RGSGMRILIRG | |
| PGSLNDYEE | | PGSLNDYEE | | QFEMIDNEFN | | RGSGMRILVRG | |
| PGSNNNGVK | | PGSNNNGVK | | QFGRIDFHWL | | RGSIAHKSCLP | |
| PGSTVNEEA | | PGSTVNEEA | | QFGRINFHWL | | RGSNRPWIRFN | |
| PGSVENLEE | | PGSVENLEE | | QFPVQTDEYK | | RGSPGVKGWAF | |
| PGSVENQEE | | PGSVENQEE | | QFRALISWEM | | RGSTLGLDIRT | |
| PGTFDIEGL | | PGTFDIEGL | | QFSSLAVNVR | | RGSTQKAIDNM | |
| PGTFDIGGL | | PGTFDIGGL | | QFSSLTVNVR | | RGSVAHKSCLP | |
| PGTFDLEGL | | PGTFDLEGL | | QFSSLTVSVR | | RGSYNNTSGEQ | |
| PGTFDLGGL | | PGTFDLGGL | | QFTAVGKEFN | | RGTGMRILVRG | |
| PGTKGFGFL | | PGTKGFGFL | | QFTAVGKEFS | | RGTQGVKGWAF | |
| PGTRRIDFH | | PGTRRIDFH | | QFTSVGKEFN | | RGVEVVDATET | |
| PGTTVNEEA | | PGTTVNEEA | | QFTWNGVKVD | | RGVEVVNATET | |
| PGVKGFAFL | | PGVKGFAFL | | QGACWEQLYT | | RGVFEFSDERA | |
| PGVKGFGFK | | PGVKGFGFK | | QGAGYAADKE | | RGVFELSDEKA | |
| PGVKGFGFL | | PGVKGFGFL | | QGALLGTKHS | | RGVFELSDERA | |
| PGVKGFGFR | | PGVKGFGFR | | QGALLGTNHS | | RGVLEDEQMYQ | |
| PGVKGWAFD | | PGVKGWAFD | | QGALLGTRHS | | RGVNDRNFWRG | |
| PGVKGWGFD | | PGVKGWGFD | | QGALLNDKHS | | RGVVYFVETLA | |
| PGVRCICRD | | PGVRCICRD | | QGALLNDRHS | | RGWAPLSKDNG | |
| PGWFRNVLS | | PGWFRNVLS | | QGALVGTKHS | | RGYKMNIQILI | |
| PGWLTIGIT | | PGWLTIGIT | | QGANRPIIEI | | RGYKMNNQILI | |
| PGWLTLGIT | | PGWLTLGIT | | QGANRPVIEI | | RGYKMNTKILV | |
| PGWSWDDGA | | PGWSWDDGA | | QGANRPVIKI | | RGYKMNTQILI | |
| PGWSWGDGA | | PGWSWGDGA | | QGDIVLVMKR | | RGYKMNTQILV | |
| PGYNGQKSW | | PGYNGQKSW | | QGDNENATAT | | RGYKMNTRILI | |
| PGYNGQRSW | | PGYNGQRSW | | QGDVVLVMKR | | RHANGTIHDRS | |
| PGYQSLRSI | | PGYQSLRSI | | QGEGIAADYK | | RHANGTINDRS | |
| PHGLCYPGE | | PHGLCYPGE | | QGEGTAADYK | | RHANGTMHDRS | |
| PHKLCFPGE | | PHKLCFPGE | | QGFAPFSKDN | | RHCSKYHWNLA | |
| PHKLCYPGE | | PHKLCYPGE | | QGFFPFHKDN | | RHENRMVIAST | |
| PHLTGTWDT | | PHLTGTWDT | | QGGHIEECSC | | RHENRMVLAST | |
| PHRALMSCP | | PHRALMSCP | | QGIGQAADYK | | RHIEECPCYGH | |
| PHRLCYPGE | | PHRLCYPGE | | QGIKLTQGYK | | RHIEECSCYGD | |
| PHRSLMSCP | | PHRSLMSCP | | QGKTKATKME | | RHIEECSCYGH | |
| PHRTLLMNE | | PHRTLLMNE | | QGKTKATKMK | | RHIEEWSCYGH | |
| PHRTLLMSE | | PHRTLLMSE | | QGLIDGWYGF | | RHLEECSCYVD | |
| PHRTLMSCP | | PHRTLMSCP | | QGLVDGWYGY | | RHLFSGIKSFS | |
| PIAFLTSSI | | PIAFLTSSI | | QGMGMAADKE | | RHLFSGIRSFS | |
| PIEHIASIR | | PIEHIASIR | | QGMIDGWYGY | | RHLFSGVNSFS | |
| PIEHIASMR | | PIEHIASMR | | QGMVDGWYGF | | RHQLRDNAKEL | |
| PIEHVASMR | | PIEHVASMR | | QGMVDGWYGY | | RHQLRENAEDK | |
| PIEYIASMR | | PIEYIASMR | | QGNGCFEIFH | | RHQNAEGTGTA | |
| PIEYVASMR | | PIEYVASMR | | QGNILLSPEE | | RHQNAQGEGIA | |
| PIFLYVRTN | | PIFLYVRTN | | QGNNDNATAT | | RHQNAQGEGTA | |
| PIGCKMYAL | | PIGCKMYAL | | QGNNENATAT | | RHQNAQGIGQA | |
| PIGEAPSPY | | PIGEAPSPY | | QGNNKNATAT | | RHQNAQGQGTA | |
| PIGEVPSPY | | PIGEVPSPY | | QGNNNNATAT | | RHQNAQGTGQA | |

Fig. 83-289

| Block size 8 | SIN | Block size 9 | SIN | Block size 10 | SIN | Block size 11 | SIN |
|---|---|---|---|---|---|---|---|
| PIGISSMVE | | PIGISSMVE | | QGNSVWAGRT | | RHQNAQGTGQV | |
| PIGSGFFPD | | PIGSGFFPD | | QGNVLLSPEE | | RHQNSEGTGTA | |
| PIGTAPILG | | PIGTAPILG | | QGQGTAADYK | | RHQNSQGEGTA | |
| PIGTAPVLG | | PIGTAPVLG | | QGQIIVLNTD | | RHQNTQGEGTA | |
| PIGVAPSPS | | PIGVAPSPS | | QGQTIVLNTD | | RHRLKITENSF | |
| PIGVAPVLG | | PIGVAPVLG | | QGQTIVLTTD | | RHSNGTIHDRS | |
| PIGVVPSPS | | PIGVVPSPS | | QGQTVVLNTD | | RHSNGTIHDRT | |
| PIHLGDCSF | | PIHLGDCSF | | QGRGLFGAIA | | RHSNGTVKDRS | |
| PIICLGHHA | | PIICLGHHA | | QGRGLFGAKA | | RHSNNTVKDRS | |
| PIKGWAPLS | | PIKGWAPLS | | QGRGVFEFSD | | RHYIGKCPKYI | |
| PILGNYKEI | | PILGNYKEI | | QGRGVFELSD | | RIAIGNCPKYV | |
| PILNTSQRG | | PILNTSQRG | | QGRLCNPLNP | | RIAWSSSSCFD | |
| PILSFIMWA | | PILSFIMWA | | QGRLCNPMNP | | RIAYERMCNIL | |
| PILSPLTKG | | PILSPLTKG | | QGRMDYYWAI | | RICEKLEQSGL | |
| PILYFWGVH | | PILYFWGVH | | QGRMDYYWAV | | RICIDFRDMRK | |
| PIMFSNKMA | | PIMFSNKMA | | QGRMDYYWGI | | RICIGYHANNS | |
| PINGICYPG | | PINGICYPG | | QGRQTFDWTL | | RICIGYLSTNS | |
| PINNGKGRY | | PINNGKGRY | | QGRQTYDWTL | | RICIGYQSNNS | |
| PINVTKENT | | PINVTKENT | | QGSARHIEEC | | RICILDQNFRN | |
| PIQNLTKVN | | PIQNLTKVN | | QGSFYRNMRW | | RICKLVGINMS | |
| PIRGWAPLS | | PIRGWAPLS | | QGSFYRSIRW | | RICLGHHAVAN | |
| PISLGDCSF | | PISLGDCSF | | QGSFYRSMRW | | RICVGYHANNS | |
| PISVGSGSF | | PISVGSGSF | | QGSGYAADKA | | RICVGYLSTNS | |
| PITEINTWA | | PITEINTWA | | QGSGYAADKE | | RIDARIDFESG | |
| PITGSPCAP | | PITGSPCAP | | QGSGYAADKK | | RIDARVDFESG | |
| PITGSPEAP | | PITGSPEAP | | QGSGYAADLK | | RIDARVDSESG | |
| PITGSPGAP | | PITGSPGAP | | QGSGYAADQE | | RIDDAVTDIWS | |
| PITGSPGSP | | PITGSPGSP | | QGSGYAADQK | | RIDDAVTDVWS | |
| PITGSPGVP | | PITGSPGVP | | QGSGYAADRE | | RIDFHWMLLDP | |
| PITGSPSAP | | PITGSPSAP | | QGSGYAADRK | | RIECIGWSSTS | |
| PITIGECPK | | PITIGECPK | | QGSLKLATGM | | RIENLNKKIDD | |
| PITIGKCPK | | PITIGKCPK | | QGSLLNDKHF | | RIENLNKKMED | |
| PITIGKCSK | | PITIGKCSK | | QGSLLNDKHS | | RIENLNKKVDD | |
| PIVPSFDMN | | PIVPSFDMN | | QGSLLNDRHS | | RIENLNRKMED | |
| PIVPSFDMS | | PIVPSFDMS | | QGSLMLATGM | | RIENLNRKVDD | |
| PIVPSFEMS | | PIVPSFEMS | | QGSLRLATGM | | RIESLNKKMED | |
| PKCDIHLKD | | PKCDIHLKD | | QGSNRPVIQI | | RIESLNNKVDD | |
| PKCDIHLRD | | PKCDIHLRD | | QGSNRPVIRI | | RIEVTNATELV | |
| PKCDLYLNG | | PKCDLYLNG | | QGSTLPRRSG | | RIFLAMITYIT | |
| PKCDLYLSG | | PKCDLYLSG | | QGSYNNTSGE | | RIFQPNIGPRP | |
| PKCDPYLNG | | PKCDPYLNG | | QGTAADYKST | | RIFRPNIGPRP | |
| PKCDTHLKD | | PKCDTHLKD | | QGTCWEQLYT | | RIGDGQRSWMK | |
| PKCDVHLKD | | PKCDVHLKD | | QGTCWEQMYT | | RIGEDSDILVT | |
| PKEDEVWWT | | PKEDEVWWT | | QGTGIAADKA | | RIGEDSDVLVT | |
| PKEDKVWWT | | PKEDKVWWT | | QGTGIAADKE | | RIGEGQRSWMK | |
| PKEDRVWWT | | PKEDRVWWT | | QGTGIAADKT | | RIGENSDVLVT | |
| PKEEKVWWT | | PKEEKVWWT | | QGTGIAADKV | | RIGENSGVLVT | |
| PKEIEGICY | | PKEIEGICY | | QGTGIAAEKE | | RIGESSDVLVT | |
| PKEKAIWTS | | PKEKAIWTS | | QGTGQAADYE | | RIGSCTSPCLT | |
| PKEKTIWTS | | PKEKTIWTS | | QGTGQAADYK | | RIGSKGDIFVI | |
| PKEMEGICY | | PKEMEGICY | | QGTKRSHEQM | | RIGSKGDIFVM | |
| PKEMEGVCY | | PKEMEGVCY | | QGTKRSYEQM | | RIGSKGDVFVI | |
| PKENPAHKS | | PKENPAHKS | | QGTMDYYWGI | | RIGSKGDVFVM | |
| PKERTIWTS | | PKERTIWTS | | QGTSVWAGRT | | RIGSKGHVFVI | |
| PKERTSIWT | | PKERTSIWT | | QGTTIRGKHS | | RIGSRGEVFVI | |
| PKETRVWWT | | PKETRVWWT | | QGTTIRGRHS | | RIGSRGHIFVI | |
| PKFLPDLYD | | PKFLPDLYD | | QGTTIRNKHS | | RIGSRGHVFVI | |
| PKGLFGAIA | | PKGLFGAIA | | QGTTIRNRHS | | RIIQNEDIPIE | |
| PKGRGLFGA | | PKGRGLFGA | | QGTTLDNEHS | | RIIQNEDIPIG | |
| PKKRGLFGA | | PKKRGLFGA | | QGTTLDNKHS | | RIKINPVTLTM | |
| PKKTGGPIY | | PKKTGGPIY | | QGTTLENKHS | | RIKTRLFTIRQ | |
| PKLRSGFEM | | PKLRSGFEM | | QGTTLKGRHA | | RILDFHDSNVK | |

Fig. 83-290

| Block size 8 | SIN | Block size 9 | SIN | Block size 10 | SIN | Block size 11 | SIN |
|---|---|---|---|---|---|---|---|
| PKPRGLFGA | | PKPRGLFGA | | QGTTLNNKHS | | RILEEESDEAL | |
| PKQSRMQFS | | PKQSRMQFS | | QGTTLRGQHA | | RILSIYSTVAA | |
| PKRNRSILN | | PKRNRSILN | | QGTTLRGRHA | | RIMINPVKLSG | |
| PKSLPDLYD | | PKSLPDLYD | | QGTTLYNKHS | | RIMINPVKLSS | |
| PKSMREEYR | | PKSMREEYR | | QGVGIAADKE | | RINGVKLEENS | |
| PKTRGLFGA | | PKTRGLFGA | | QGVGMAADKE | | RINGVKLEENT | |
| PKVNGQAGR | | PKVNGQAGR | | QGVKGWAFDN | | RINMIADRVDD | |
| PKWFRNVLS | | PKWFRNVLS | | QGVKLAQGYK | | RINMINSKIDD | |
| PKYEEESKL | | PKYEEESKL | | QGVKLIQGYK | | RINMINSKIED | |
| PKYEEESRL | | PKYEEESRL | | QGVKLTQGYK | | RINMINSKIND | |
| PKYGYIIEE | | PKYGYIIEE | | QGVLLGTKHS | | RINMINSQIDD | |
| PKYIKQGSL | | PKYIKQGSL | | QGVRLTQGYK | | RINMLADRIDD | |
| PKYIKSDQL | | PKYIKSDQL | | QGWMDYYWGI | | RINMLADRVDD | |
| PKYIKSGQL | | PKYIKSGQL | | QGWSYIVERP | | RINMLADWVDD | |
| PKYIPSGSL | | PKYIPSGSL | | QGYGVKGFGF | | RINNETILETG | |
| PKYIPSNSL | | PKYIPSNSL | | QGYKDIILWF | | RINNETILETR | |
| PKYIPSRSL | | PKYIPSRSL | | QGYKDIILWI | | RINTINSKIDD | |
| PKYISSGSL | | PKYISSGSL | | QGYKDIILWV | | RIPHRTLLMNE | |
| PKYLPDLYD | | PKYLPDLYD | | QHANGTIHDR | | RIPHRTLLMSE | |
| PKYMNVKSL | | PKYMNVKSL | | QHIEECSCYG | | RIQDIWAYNAE | |
| PKYSEEAKL | | PKYSEEAKL | | QHIEECSCYP | | RIQDLEKYIED | |
| PKYSEESKL | | PKYSEESKL | | QHIIDLADSE | | RIQDLEKYVED | |
| PKYSEESRL | | PKYSEESRL | | QHIIDVTDSE | | RIQDLERYVED | |
| PKYSKEAKL | | PKYSKEAKL | | QHLEECSCYM | | RIQHLEECSCY | |
| PKYSKESKL | | PKYSKESKL | | QHLEECSCYT | | RIQIDPVKLSG | |
| PKYVKQGSL | | PKYVKQGSL | | QHLEECSCYV | | RIQIDPVKLSS | |
| PKYVKSDRL | | PKYVKSDRL | | QHPELTGLDC | | RIQIDQVKLSS | |
| PKYVKSEKL | | PKYVKSEKL | | QHPELTGLNC | | RIQIDSVKLSS | |
| PKYVKSERL | | PKYVKSERL | | QHPELTGMDC | | RIRLFDYSGWN | |
| PKYVNIKSL | | PKYVNIKSL | | QHPELTGMNC | | RIRLFDYSKWN | |
| PKYVNVKSL | | PKYVNVKSL | | QHPELTGVDC | | RIRLFDYSRWN | |
| PKYVNVRSL | | PKYVNVRSL | | QHPEMTGLDC | | RIRMAINWGRI | |
| PKYVRSEKL | | PKYVRSEKL | | QHQNAEGIGI | | RIRMATNECRI | |
| PLAGSAQHV | | PLAGSAQHV | | QHQNAEGTGI | | RIRNNTYDHTQ | |
| PLAIGECPK | | PLAIGECPK | | QHQNEQGMGM | | RISFYWTIVDP | |
| PLALGMKNV | | PLALGMKNV | | QHQNEQGMGI | | RISFYWTIVEP | |
| PLASLLEMC | | PLASLLEMC | | QHQNEQGTGI | | RISHRTLLMNE | |
| PLAVTWWNR | | PLAVTWWNR | | QHQNEQGVGI | | RISIYWTLVNP | |
| PLCAVNSWH | | PLCAVNSWH | | QHQNEQGVGM | | RISKRGSSGIM | |
| PLCDVSGFA | | PLCDVSGFA | | QHQNSEGTGI | | RISNETILETG | |
| PLCEVNSWH | | PLCEVNSWH | | QHRDEEGTGI | | RISSSFSFGGF | |
| PLCEVSGFA | | PLCEVSGFA | | QHRNEEGTGI | | RISVYWTIVEP | |
| PLCEVSGFV | | PLCEVSGFV | | QHRNEEGTGV | | RITTKINNIIE | |
| PLCEVSSWH | | PLCEVSSWH | | QHSEECSCYV | | RKASLRLAVGL | |
| PLCNVSGFA | | PLCNVSGFA | | QHTIDLADSE | | RKDILRTQESE | |
| PLCPFKGFF | | PLCPFKGFF | | QHTIDLTDAE | | RKEPALIVWGV | |
| PLCPFQGFF | | PLCPFQGFF | | QHTIDLTDSE | | RKEYEEEAKLE | |
| PLCPFRGFF | | PLCPFRGFF | | QHTIDLTNSE | | RKGLILEYYSL | |
| PLELGDCSI | | PLELGDCSI | | QHTIDMADSE | | RKKILRTQESS | |
| PLELRDCKI | | PLELRDCKI | | QHTIDMADST | | RKKRGLFGAIA | |
| PLELRDCKV | | PLELRDCKV | | QHTIDMTDSE | | RKKRGLFGAKA | |
| PLELRDCSI | | PLELRDCSI | | QHTIDSTDSE | | RKLKREITFHG | |
| PLFLYVRTN | | PLFLYVRTN | | QHTIDVTDSE | | RKLKREMTFHG | |
| PLGAINTTL | | PLGAINTTL | | QHTIEMTDSE | | RKMEDGFLDVW | |
| PLGALNTTL | | PLGALNTTL | | QHTIHLTDSE | | RKMMTNSQDTE | |
| PLGCKMYAL | | PLGCKMYAL | | QHVEECSCYP | | RKMMTNSRDTE | |
| PLGCRMYAL | | PLGCRMYAL | | QIADAQHRSH | | RKMMTSSQDTE | |
| PLGEAPSPY | | PLGEAPSPY | | QIADSHHRSH | | RKQILRTQESS | |
| PLGSAQATE | | PLGSAQATE | | QIADSQHKSH | | RKQLRENAEED | |
| PLGSPPIVS | | PLGSPPIVS | | QIADSQHRSH | | RKQLRQNAEED | |
| PLGSPPMVS | | PLGSPPMVS | | QIAGFAPFSK | | RKRDSSILTDS | |
| PLGSPPVVS | | PLGSPPVVS | | QIAGSSEQAA | | RKRFADQELGD | |

Fig. 83-291

| Block size 8 | SIN | Block size 9 | SIN | Block size 10 | SIN | Block size 11 | SIN |
|---|---|---|---|---|---|---|---|
| PLGSSPNAY | | PLGSSPNAY | | QIAILAATVT | | RKRGLFGAIAG | |
| PLGSSSNAY | | PLGSSSNAY | | QIAILATTIT | | RKRKRKTRGLF | |
| PLGTPPTVS | | PLGTPPTVS | | QIAILATTVT | | RKRKTRGLFGA | |
| PLHNIHPLT | | PLHNIHPLT | | QIAILVTTVT | | RKRMTRGLFGA | |
| PLIKHENRM | | PLIKHENRM | | QICIGHHANN | | RKRNSSILTDS | |
| PLILGDCSV | | PLILGDCSV | | QICIGYHANN | | RKTNLYGFIIK | |
| PLILKDCSI | | PLILKDCSI | | QICIGYHSNN | | RKTNLYGFIVK | |
| PLILKDCSV | | PLILKDCSV | | QICVGYHANN | | RKTRFLPVAGG | |
| PLILRDCSV | | PLILRDCSV | | QICVGYHSNN | | RKTRFLPVSGG | |
| PLIRGQQGR | | PLIRGQQGR | | QIDESCEGEC | | RKTRFLPVTGG | |
| PLIRHENRM | | PLIRHENRM | | QIDPVKLSGG | | RKTRFLPVVGG | |
| PLKAEIAQK | | PLKAEIAQK | | QIDPVKLSSG | | RKTRGLFGAIA | |
| PLKAEIAQR | | PLKAEIAQR | | QIDQVKLSSG | | RLAAGGAIWVT | |
| PLKLVDGQD | | PLKLVDGQD | | QIDSVKLSSG | | RLAAGGDIWVT | |
| PLLSLLEMC | | PLLSLLEMC | | QIDTIMEKNV | | RLAIGLRNTPS | |
| PLMVAYMLE | | PLMVAYMLE | | QIEARGLFGA | | RLAKCNTKCQT | |
| PLPFQNIDS | | PLPFQNIDS | | QIEDLWAYNA | | RLALGLRNTPS | |
| PLPFQNINP | | PLPFQNINP | | QIEELWAYNA | | RLATGLRNIPQ | |
| PLPLCPFKG | | PLPLCPFKG | | QIEGLWAYNA | | RLATGLRNIPS | |
| PLPLCPFRG | | PLPLCPFRG | | QIEGRIQDLE | | RLATGLRNVPK | |
| PLQNASRHY | | PLQNASRHY | | QIEKEFEQVE | | RLATGLRNVPQ | |
| PLQNLTKIN | | PLQNLTKIN | | QIEKEFGQVE | | RLATGLRNVPS | |
| PLQNLTKTN | | PLQNLTKTN | | QIEKEFSEIE | | RLATGMRNIPE | |
| PLQNLTKVN | | PLQNLTKVN | | QIEKEFSEVE | | RLAVGLRNTPS | |
| PLQNTSKHY | | PLQNTSKHY | | QIENLWAYNA | | RLCNPLNPFVG | |
| PLSGSAQHI | | PLSGSAQHI | | QIEPRGLFGA | | RLCNPLNPFVN | |
| PLSGSAQHV | | PLSGSAQHV | | QIESIIEAES | | RLCNPLNPFVS | |
| PLSISVGSS | | PLSISVGSS | | QIESMIEAES | | RLCNPLNPFVT | |
| PLSKDNGIR | | PLSKDNGIR | | QIESMVEAES | | RLCNPMNPFVS | |
| PLSKDNSIR | | PLSKDNSIR | | QIESRGLFGA | | RLCTINSWHIY | |
| PLSSPPTVY | | PLSSPPTVY | | QIEVTNATEL | | RLCYPGELDNN | |
| PLTGSAQHI | | PLTGSAQHI | | QIGNVINWTK | | RLEENTTYKIL | |
| PLTIGECPK | | PLTIGECPK | | QIGNVINWTQ | | RLENLDKKMED | |
| PLTIGECPR | | PLTIGECPR | | QIGNVINWTR | | RLENLNKKMED | |
| PLTIGKCPK | | PLTIGKCPK | | QIGYICSGVF | | RLENLNKKVED | |
| PLTKGILGF | | PLTKGILGF | | QIGYVCSGIF | | RLENLSKRMED | |
| PLTKGMLGF | | PLTKGMLGF | | QIGYVCSGVF | | RLFDYSGWNVT | |
| PLTMGECPK | | PLTMGECPK | | QIIDIWAYNA | | RLFDYSKWNVS | |
| PLTTTPTKS | | PLTTTPTKS | | QIIKLLPFAA | | RLFDYSKWNVT | |
| PLVLDDCSL | | PLVLDDCSL | | QIIKLLPFAS | | RLFDYSRWNVT | |
| PLVLGDCSI | | PLVLGDCSI | | QIIRESGGID | | RLFERVRRQLR | |
| PLVMGQQGR | | PLVMGQQGR | | QIISLCSIWF | | RLFTIRQELAS | |
| PLVNGQRGR | | PLVNGQRGR | | QIIVILVLGL | | RLFTIRQEMAG | |
| PLVPCEPII | | PLVPCEPII | | QIIVLNTDWS | | RLFTIRQEMAI | |
| PLVREQQGR | | PLVREQQGR | | QIIVTREPYV | | RLFTIRQEMAN | |
| PLVRGQQGR | | PLVRGQQGR | | QIKIRRRVDI | | RLFTIRQEMAS | |
| PLVRGQQGT | | PLVRGQQGT | | QILAIYATVA | | RLGKGYMFESK | |
| PLVRGQQGW | | PLVRGQQGW | | QILAIYSTAA | | RLGNLNKKMED | |
| PLVRGQSGR | | PLVRGQSGR | | QILAIYSTIS | | RLGPSFYAEMK | |
| PLVRSQSGR | | PLVRSQSGR | | QILAIYSTVA | | RLGRGYMFESK | |
| PMCDDLIGK | | PMCDDLIGK | | QILAIYSTVS | | RLGSSFYAEMK | |
| PMCDELIGK | | PMCDELIGK | | QILRTQESEC | | RLGSWSWHDGA | |
| PMCDNLIGK | | PMCDNLIGK | | QILRTQESSC | | RLIDKTNQQFE | |
| PMCDYLIGK | | PMCDYLIGK | | QILSIYSTAA | | RLIEKTNDKYH | |
| PMFLYIRTN | | PMFLYIRTN | | QILSIYSTVA | | RLIEKTNEKYH | |
| PMFLYVRTN | | PMFLYVRTN | | QILSIYSTVT | | RLIEKTNKQFE | |
| PMGEAPSPY | | PMGEAPSPY | | QILSIYSTVV | | RLIEKTNQQFE | |
| PMGFRYSGI | | PMGFRYSGI | | QILSLYSTVA | | RLIEKTNTEFE | |
| PMGSSPNAY | | PMGSSPNAY | | QILVIYATVA | | RLIEKTNTQFE | |
| PMGTAPVLG | | PMGTAPVLG | | QINGKLNRLI | | RLIERTNEKYH | |
| PMGVAPSPS | | PMGVAPSPS | | QINGQSGRID | | RLIERTNQQFE | |
| PMHQLLRHF | | PMHQLLRHF | | QINPVKLSSG | | RLKITENSFEQ | |

Fig. 83-292

| Block size 8 | SIN | Block size 9 | SIN | Block size 10 | SIN | Block size 11 | SIN |
|---|---|---|---|---|---|---|---|
| PMIAELAEK | | PMIAELAEK | | QIQDIWAYNA | | RLLRENAEEDG | |
| PMIIELAEK | | PMIIELAEK | | QIQDLWAYNA | | RLLVLLENDKT | |
| PMISKCKTK | | PMISKCKTK | | QIQDVWAYNA | | RLLVLLENEKT | |
| PMISKCRTK | | PMISKCRTK | | QIQGIKLTQG | | RLNINPVKLSS | |
| PMISKCRTR | | PMISKCRTR | | QIQGVKLAQG | | RLNINPVTLSS | |
| PMISKSRTK | | PMISKSRTK | | QIQGVKLIQG | | RLNINSVKLSS | |
| PMIVELAEK | | PMIVELAEK | | QIQGVKLTQG | | RLNNVIDKMNK | |
| PMMWEINGP | | PMMWEINGP | | QIQGVRLTQG | | RLNPMHQLLRH | |
| PMRTPIAFL | | PMRTPIAFL | | QIQNIWAYNA | | RLNRNEIKGVK | |
| PMTVELAEK | | PMTVELAEK | | QIQNRGLFGA | | RLNTMHQLLRH | |
| PMVVELAEK | | PMVVELAEK | | QIRGFVHFVE | | RLNWLTKATNG | |
| PNAETDPNS | | PNAETDPNS | | QIRGFVYFVE | | RLNWLTKETNG | |
| PNAETDPSS | | PNAETDPSS | | QISGKLNRLI | | RLPFQNLSPRT | |
| PNAGIDPNS | | PNAGIDPNS | | QISIVPNIGS | | RLQDTTWDVFI | |
| PNAGKDPKK | | PNAGKDPKK | | QITDIWAYNA | | RLQLKDNAKEL | |
| PNAGTDPNS | | PNAGTDPNS | | QITFIQALQL | | RLQLKDNAREL | |
| PNALLKHRF | | PNALLKHRF | | QITFLQALQL | | RLQLRDNAKEL | |
| PNALTDDKS | | PNALTDDKS | | QITFMQALQL | | RLQLRDNAREL | |
| PNALTDDRS | | PNALTDDRS | | QITGFAPFSK | | RLRGIPPLELG | |
| PNALTDERS | | PNALTDERS | | QITGKLNHLI | | RLRRDQKSLRG | |
| PNALTDNRS | | PNALTDNRS | | QITGKLNRII | | RLRSGFEMLKI | |
| PNAPHKLCF | | PNAPHKLCF | | QITGKLNRLI | | RLSAGGAIWVT | |
| PNAPHKLCY | | PNAPHKLCY | | QITGTLNRLI | | RLSAGGDIWAT | |
| PNAPNKFCY | | PNAPNKFCY | | QITNGTTGNP | | RLSAGGDIWIT | |
| PNAPNKLCF | | PNAPNKLCF | | QITSLCSIWF | | RLSAGGDIWVM | |
| PNAPNKLCY | | PNAPNKLCY | | QITTKINNII | | RLSAGGDIWVT | |
| PNAYQAKFE | | PNAYQAKFE | | QIVVTREPYV | | RLSAGGHIWVT | |
| PNAYQAQFE | | PNAYQAQFE | | QKAIDEITTK | | RLSAGGNIWIT | |
| PNAYQARFE | | PNAYQARFE | | QKAIDGITNK | | RLSASGDIWIT | |
| PNDERGNPG | | PNDERGNPG | | QKAIDGVTNK | | RLSASGDIWVT | |
| PNDGKVECV | | PNDGKVECV | | QKAIDIMQNK | | RLSGGGDIWVT | |
| PNDGQVLYF | | PNDGQVLYF | | QKAIDNMQNK | | RLSGIPPLELG | |
| PNDKHSNGT | | PNDKHSNGT | | QKAIDNMQNR | | RLSINPVKLSS | |
| PNDKPFQNV | | PNDKPFQNV | | QKAIDQITTK | | RLSSGYKDIIL | |
| PNDNASAVV | | PNDNASAVV | | QKAIDRITTK | | RLTITYSSSMM | |
| PNECRFYAL | | PNECRFYAL | | QKAINEITTK | | RLTQGRQTYDW | |
| PNEERGNPG | | PNEERGNPG | | QKAINGVTNK | | RLTQGYKDIIL | |
| PNEERGSPG | | PNEERGSPG | | QKALNEITTK | | RLTTTIKPWAR | |
| PNEGKVECI | | PNEGKVECI | | QKAMMDQVRE | | RLTTTIKTWAG | |
| PNEGKVECV | | PNEGKVECV | | QKAQGEGTAA | | RLTTTIKTWAK | |
| PNEKPFQNV | | PNEKPFQNV | | QKCCNLFEKF | | RLTTTIKTWAR | |
| PNENPAHKS | | PNENPAHKS | | QKCCSLFEKF | | RLTTTIRTWAK | |
| PNENPVHKS | | PNENPVHKS | | QKCCTLFEKF | | RLTTTVKTWAG | |
| PNEVGAKIL | | PNEVGAKIL | | QKGILEDEQM | | RLVLATGLRNI | |
| PNEVGARIL | | PNEVGARIL | | QKGNIKCNIC | | RLVLATGLRNV | |
| PNFHYEECS | | PNFHYEECS | | QKGNIRCDIC | | RLVRFRHQNSE | |
| PNFYYEECS | | PNFYYEECS | | QKGNIRCNIC | | RLYIWGVHHPS | |
| PNGAQIQYF | | PNGAQIQYF | | QKIITIDSVS | | RLYLWGVHHPS | |
| PNGCIEGKL | | PNGCIEGKL | | QKIITIGSAS | | RLYVNKNPYTL | |
| PNGCIESKL | | PNGCIESKL | | QKIITIGSIS | | RMAKCNTKCQT | |
| PNGKPFQNV | | PNGKPFQNV | | QKIITIGSMS | | RMARCNTKCQT | |
| PNGSIPNDK | | PNGSIPNDK | | QKIITIGSVS | | RMATGLRNIPS | |
| PNGSIPNEK | | PNGSIPNEK | | QKIITMGSVS | | RMATGLRNVPS | |
| PNGSIPNGK | | PNGSIPNGK | | QKILCASATA | | RMCNILKGKFQ | |
| PNGSIPNNK | | PNGSIPNNK | | QKILCTSAIA | | RMCSLMQGSTL | |
| PNGSISNDK | | PNGSISNDK | | QKILCTSATA | | RMDYYWAILKP | |
| PNGTIVKTI | | PNGTIVKTI | | QKILDEHDSN | | RMDYYWAVLKP | |
| PNGTIVKTL | | PNGTIVKTL | | QKILFASATA | | RMDYYWGILKR | |
| PNGTIVRTI | | PNGTIVRTI | | QKIMESGGID | | RMENLNKKVDD | |
| PNGTKVNTL | | PNGTKVNTL | | QKIMESGGIS | | RMFALSQGTTL | |
| PNGTLVKTI | | PNGTLVKTI | | QKINGVKLEE | | RMFLAMITYIT | |
| PNGTMVKTI | | PNGTMVKTI | | QKISGVKLEE | | RMGKCNTKCQT | |

Fig. 83-293

| Block size 8 | SIN | Block size 9 | SIN | Block size 10 | SIN | Block size 11 | SIN |
|---|---|---|---|---|---|---|---|
| PNGTVVKTI | | PNGTVVKTI | | QKITCVCRDN | | RMGVQMQRFRR | |
| PNGYIEGKL | | PNGYIEGKL | | QKKDKRYGPA | | RMIICIQGNND | |
| PNHEGEGIP | | PNHEGEGIP | | QKLEDVFAGK | | RMIKAVRGDLN | |
| PNIGPRALV | | PNIGPRALV | | QKLFALSEVA | | RMIKRGINDRN | |
| PNIGPRPFV | | PNIGPRPFV | | QKLFALSGVA | | RMIKRGVNDRN | |
| PNIGPRPLI | | PNIGPRPLI | | QKLFASSGIA | | RMKWMMAMKYP | |
| PNIGPRPLV | | PNIGPRPLV | | QKLFTLSGVA | | RMKWMMAMRYP | |
| PNIGSRPRV | | PNIGSRPRV | | QKQEFKMNPN | | RMNNETILETG | |
| PNKFCYPGE | | PNKFCYPGE | | QKQEIKMNPN | | RMQFSSFTVNV | |
| PNKLCFPGE | | PNKLCFPGE | | QKQMTRGLFG | | RMQFSSLAVNV | |
| PNKLCYPGE | | PNKLCYPGE | | QKRGLFGAIA | | RMQFSSLTVNV | |
| PNKWGDILD | | PNKWGDILD | | QKRMGLQMQR | | RMQFSSLTVSV | |
| PNKWGNVLD | | PNKWGNVLD | | QKRMGVQIQR | | RMQLRDNAKEI | |
| PNLGIVECV | | PNLGIVECV | | QKRMGVQLQR | | RMQLRDNAKEL | |
| PNLGKVECV | | PNLGKVECV | | QKRMGVQMHR | | RMQLRDNVKEL | |
| PNLGQVECV | | PNLGQVECV | | QKRMGVQMQR | | RMSICISGPNN | |
| PNLYNIRNL | | PNLYNIRNL | | QKRMTRGLFG | | RMSICMSGPND | |
| PNMGKVECV | | PNMGKVECV | | QKSLIWLWLV | | RMSICMSGPNN | |
| PNNEKGNPG | | PNNEKGNPG | | QKSLLLATGM | | RMSICVSGPNN | |
| PNNEKGNQG | | PNNEKGNQG | | QKSLRGRGST | | RMSVCISGPNN | |
| PNNERGNPG | | PNNERGNPG | | QKSTQEAIDK | | RMSVCMSGPNN | |
| PNNERGNQG | | PNNERGNQG | | QKSTQEAIEK | | RMTICIQGNND | |
| PNNERGTQG | | PNNERGTQG | | QKSTQEAIGK | | RMTICVQGNND | |
| PNNERGYPG | | PNNERGYPG | | QKSTQEAINK | | RMTICVQGNNK | |
| PNNGKVECI | | PNNGKVECI | | QKTIDQVTGK | | RMTICVQGNNN | |
| PNNKPFQNV | | PNNKPFQNV | | QKTITIGSVS | | RMTRGLFGAIA | |
| PNNMARAVK | | PNNMARAVK | | QKTLDEHDAN | | RMVIASTTAKA | |
| PNNMDKAVK | | PNNMDKAVK | | QKTLDEHDSN | | RMVKRGINDRN | |
| PNNMDRAVK | | PNNMDRAVK | | QKTLDKHDSN | | RMVLASTTAKA | |
| PNNNASAII | | PNNNASAII | | QKTLKLATGM | | RMVLSAFDERR | |
| PNNNASAIV | | PNNNASAIV | | QKVNGVKLEE | | RMVTGLRNIPS | |
| PNNNASAVI | | PNNNASAVI | | QKVPVTQTME | | RMYALHQGTTI | |
| PNNNASAVV | | PNNNASAVV | | QKVTCVCRDN | | RNAHKMESRGL | |
| PNQKIICIS | | PNQKIICIS | | QKWSGYSGAF | | RNAIGDCPKYI | |
| PNQKIITIG | | PNQKIITIG | | QKWVVWLWLV | | RNAIGDCPKYV | |
| PNQKIITMG | | PNQKIITMG | | QLEGFSAESR | | RNALGDCPKYI | |
| PNQKILCAS | | PNQKILCAS | | QLFIKDYRYT | | RNALGNCPKYI | |
| PNQKILCTS | | PNQKILCTS | | QLFLVCVSLL | | RNALSIAPIMF | |
| PNQKILFAS | | PNQKILFAS | | QLGNVINWTR | | RNCTIPCFWVE | |
| PNQKIMCIS | | PNQKIMCIS | | QLGSWSWHDG | | RNCTVPCFWVE | |
| PNQKITCIS | | PNQKITCIS | | QLIPMISKCK | | RNDDSSSNSNC | |
| PNQKLFALS | | PNQKLFALS | | QLIPMISKCR | | RNDDSSSSSNC | |
| PNQKLFASS | | PNQKLFASS | | QLIWMACHSA | | RNDEGTGIAAD | |
| PNQKLFTLS | | PNQKLFTLS | | QLKDNAKELG | | RNDTDVVNFLS | |
| PNQKTITIG | | PNQKTITIG | | QLKDNAKEVG | | RNDTDVVNFVS | |
| PNQMIITIG | | PNQMIITIG | | QLKDNARELG | | RNDTDVVNYVS | |
| PNQNLFTLS | | PNQNLFTLS | | QLKKQEIEGI | | RNEAINNRFQI | |
| PNQRILCTS | | PNQRILCTS | | QLKLATGLKN | | RNEDGSSSSNC | |
| PNQSIITIG | | PNQSIITIG | | QLKLATGLRN | | RNEDSSSNSNC | |
| PNRASFFRG | | PNRASFFRG | | QLKRQEIEGI | | RNEDSSSSSNC | |
| PNSGKVECV | | PNSGKVECV | | QLLRHFQKDA | | RNEEGTGIAAD | |
| PNSHYEECS | | PNSHYEECS | | QLLRHFQKNA | | RNEEGTGVAAD | |
| PNVLLKHRF | | PNVLLKHRF | | QLLVLLENEK | | RNEIKGIKLSN | |
| PNVRCVCRD | | PNVRCVCRD | | QLLVWLENEK | | RNEIKGVELSS | |
| PNVYQAKFE | | PNVYQAKFE | | QLNEGIMNTS | | RNEIKGVKLSN | |
| PNVYQARFE | | PNVYQARFE | | QLNEGVINTS | | RNEIKGVKLSS | |
| PNVYQSRFE | | PNVYQSRFE | | QLNEGVMNTS | | RNFKPNIGPRP | |
| PNWSGYSGS | | PNWSGYSGS | | QLNPIDGPLP | | RNFPQTTNTYR | |
| PNYHYEECS | | PNYHYEECS | | QLNQTYRNNR | | RNFQPNIGPRP | |
| PNYQSLRSI | | PNYQSLRSI | | QLNQTYRNTR | | RNFWRGDNGRR | |
| PNYYYEECS | | PNYYYEECS | | QLRDNAKEIG | | RNFWRGENGRK | |
| PPEQSKMQF | | PPEQSKMQF | | QLRDNAKELG | | RNFWRGENGRR | |

Fig. 83-294

| Block size 8 | SIN | Block size 9 | SIN | Block size 10 | SIN | Block size 11 | SIN |
|---|---|---|---|---|---|---|---|
| PPEQSRMQF | | PPEQSRMQF | | QLRDNAKETG | | RNGFEMLKIPN | |
| PPHCDQFLE | | PPHCDQFLE | | QLRDNVKELG | | RNGKWREQLSQ | |
| PPIVSNSDF | | PPIVSNSDF | | QLRENAEDIG | | RNGNMRCTICI | |
| PPIVSNSEF | | PPIVSNSEF | | QLRENAEDKG | | RNGTYDHKEFE | |
| PPKQSRMQF | | PPKQSRMQF | | QLRENAEDLG | | RNGTYDHKEFK | |
| PPLELGDCS | | PPLELGDCS | | QLRENAEDMG | | RNGTYDHNIYR | |
| PPLELRDCS | | PPLELRDCS | | QLRENAEDQG | | RNGTYDYPKYE | |
| PPLGSAQAT | | PPLGSAQAT | | QLRENAEDRG | | RNGTYDYPKYS | |
| PPLVLGDCS | | PPLVLGDCS | | QLRENAEEDC | | RNGTYNHEDYK | |
| PPMVSNSDF | | PPMVSNSDF | | QLRENAEEDG | | RNGTYNHEDYR | |
| PPQCDKFLE | | PPQCDKFLE | | QLRENAEEMG | | RNGTYNYPKYE | |
| PPQCDLFLE | | PPQCDLFLE | | QLRMATGLRN | | RNICEKLEQSG | |
| PPQCDLHLE | | PPQCDLHLE | | QLRQNAEEDG | | RNILRTQDSEC | |
| PPQCDQFLE | | PPQCDQFLE | | QLSQKFEEIR | | RNILRTQESEC | |
| PPQCDRFLE | | PPQCDRFLE | | QLSSVSSFEK | | RNILSIAPIMF | |
| PPQCDSHLK | | PPQCDSHLK | | QLSSVSSFER | | RNILSMAPIMF | |
| PPTVSNSDF | | PPTVSNSDF | | QLSSVSSFKR | | RNIPGKQAKGL | |
| PPVNGQSGR | | PPVNGQSGR | | QLSTVSSFER | | RNIPQIESRGL | |
| PPVQSKMQF | | PPVQSKMQF | | QLTEVETYVL | | RNIPSIQSRGL | |
| PPVQSRMQF | | PPVQSRMQF | | QLTHHMRKKR | | RNIPSVQSRGL | |
| PPVVSNSDF | | PPVVSNSDF | | QLVWMACHSA | | RNITVTHSVNL | |
| PPYSHGTGT | | PPYSHGTGT | | QLVWMACNSA | | RNIVRRAAVSA | |
| PQAQDRGLF | | PQAQDRGLF | | QMAGSSEQAA | | RNIVRRAIVSA | |
| PQAQNRGLF | | PQAQNRGLF | | QMAIDNMQNK | | RNIVRRATVSA | |
| PQCDKFLEF | | PQCDKFLEF | | QMALQLFIKD | | RNIVRRATVST | |
| PQCDLFLEF | | PQCDLFLEF | | QMCTELKLND | | RNKHSNGTIHD | |
| PQCDLHLEF | | PQCDLHLEF | | QMCTELKLSD | | RNKHSNGTTHD | |
| PQCDQFLEF | | PQCDQFLEF | | QMCTELKLSE | | RNKHSNSTTHD | |
| PQCDRFLEF | | PQCDRFLEF | | QMCTELQLSD | | RNKYLEEHPNA | |
| PQCDSHLKF | | PQCDSHLKF | | QMEKIVLLFA | | RNKYLEEHPSA | |
| PQCEITGFA | | PQCEITGFA | | QMESRGLFGA | | RNKYLEEHPST | |
| PQCHITGFA | | PQCHITGFA | | QMNGQSGRID | | RNLHIPEAGLK | |
| PQCKITGFA | | PQCKITGFA | | QMQRFRRPDS | | RNLHIPEVCLK | |
| PQCLITGFA | | PQCLITGFA | | QMRDILGTFD | | RNLYDKVRLQL | |
| PQCQIAGFA | | PQCQIAGFA | | QMRDVIGTFD | | RNLYDKVRMQL | |
| PQCQITGFA | | PQCQITGFA | | QMRDVLGTFD | | RNNMINNDLGP | |
| PQCQITGFV | | PQCQITGFV | | QMTRGLFGAI | | RNNRKEPALIV | |
| PQCQITGSA | | PQCQITGSA | | QMYQKCCNLF | | RNNSYDHSKYR | |
| PQCQVTGFA | | PQCQVTGFA | | QMYQKCCSLF | | RNNTYDHAQYR | |
| PQEARVWWT | | PQEARVWWT | | QMYQKCCTLF | | RNNTYDHKKYR | |
| PQEDRVWWT | | PQEDRVWWT | | QMYQRCCNLF | | RNNTYDHSHYR | |
| PQENRVWWT | | PQENRVWWT | | QNAEEDGKGC | | RNNTYDHSKYR | |
| PQETRVWWT | | PQETRVWWT | | QNAEEDGRGC | | RNNTYDHSQYR | |
| PQIEARGLF | | PQIEARGLF | | QNAEGIGIAA | | RNNTYDHSRYR | |
| PQIEPRGLF | | PQIEPRGLF | | QNAEGTGIAA | | RNNTYDHSTYR | |
| PQIESRGLF | | PQIESRGLF | | QNAEGTGMAA | | RNNTYDHTKYR | |
| PQINGQSGR | | PQINGQSGR | | QNAISTTFPY | | RNNTYDHTQYR | |
| PQIQNRGLF | | PQIQNRGLF | | QNALNGNGDP | | RNNTYNHTEYR | |
| PQLEGFSAE | | PQLEGFSAE | | QNALSGNGDP | | RNNTYNHTQYR | |
| PQLNPIDGP | | PQLNPIDGP | | QNAQGEGIAA | | RNPGNAEIEDL | |
| PQLNQTYRN | | PQLNQTYRN | | QNAQGEGTAA | | RNQIKIRRRVD | |
| PQMESRGLF | | PQMESRGLF | | QNAQGIGQAA | | RNQPAATALAN | |
| PQMNGQSGR | | PQMNGQSGR | | QNAQGQGTAA | | RNQSGRISIYW | |
| PQMTKSYKN | | PQMTKSYKN | | QNAQGSGYAA | | RNQVKIRRRVD | |
| PQMTKSYRN | | PQMTKSYRN | | QNAQGTGLAA | | RNRHSNGTIHD | |
| PQMTRSYKN | | PQMTRSYKN | | QNAQGTGQAA | | RNRSILNTSQR | |
| PQRTLMSCP | | PQRTLMSCP | | QNASRHHMGE | | RNRYLEEHPSA | |
| PQSGRIVVD | | PQSGRIVVD | | QNASRHYMGE | | RNRYLEENPSA | |
| PQSSPPTVY | | PQSSPPTVY | | QNASRYYMGE | | RNSFFSRLNWL | |
| PQTANTYRN | | PQTANTYRN | | QNDVWLGRTI | | RNSFYAELKWL | |
| PQTESRGLF | | PQTESRGLF | | QNEDIPIENC | | RNSIWTSSSST | |
| PQTTKSYKN | | PQTTKSYKN | | | | RNSSDICYPGK | |

Fig. 83-295

| Block size 8 | SIN | Block size 9 | SIN | Block size 10 | SIN | Block size 11 | SIN |
|---|---|---|---|---|---|---|---|
| PQTTNTYRN | | PQTTNTYRN | | QNEDIPIGNC | | RNSSDICYPGR | |
| PQVNGQFGR | | PQVNGQFGR | | QNEDIPIGSC | | RNSSILTDSQT | |
| PQVNGQRGR | | PQVNGQRGR | | QNEFNKACEL | | RNTFGDCPKYV | |
| PQVNGQSGR | | PQVNGQSGR | | QNEQGMGMAA | | RNTIGDCPKYM | |
| PQVQDRGLF | | PQVQDRGLF | | QNEQGSGYAA | | RNTIGDCPKYV | |
| PQVQNRGLF | | PQVQNRGLF | | QNEQGTGIAA | | RNTPSIDPKGL | |
| PQYPNVRCV | | PQYPNVRCV | | QNEQGVGIAA | | RNTPSIEPKGL | |
| PRALVRGQQ | | PRALVRGQQ | | QNEQGVGMAA | | RNTPSIEPRGL | |
| PRCDDLIGK | | PRCDDLIGK | | QNFPQTANTY | | RNTPSVEPKGL | |
| PRFLPDLYD | | PRFLPDLYD | | QNFPQTTNTY | | RNTPSVEPRGL | |
| PRGHYKISK | | PRGHYKISK | | QNFPRTTNTY | | RNTRKEPALIV | |
| PRGKLSTRG | | PRGKLSTRG | | QNGKSGACKR | | RNVLSIAPIMF | |
| PRGLFGAIA | | PRGLFGAIA | | QNGKSSACKR | | RNVLSVAPIMF | |
| PRGLLEVGT | | PRGLLEVGT | | QNGNIRCQIC | | RNVPQAQDRGL | |
| PRGQLATRG | | PRGQLATRG | | QNGNIRCTFC | | RNVPQAQNRGL | |
| PRGQLSTRG | | PRGQLSTRG | | QNGNLRCQIC | | RNVPQIEPRGL | |
| PRGQLTTRG | | PRGQLTTRG | | QNGNVRCQIC | | RNVPQIESRGL | |
| PRGRLSTRG | | PRGRLSTRG | | QNGNVRCTFC | | RNVPQIQNRGL | |
| PRIFLAMIT | | PRIFLAMIT | | QNGQGSGYAA | | RNVPQMESRGL | |
| PRLLQNSQV | | PRLLQNSQV | | QNGSCRCMFC | | RNVPQVQDRGL | |
| PRLRSGFEM | | PRLRSGFEM | | QNGSYRCMFC | | RNVPQVQNRGL | |
| PRMCSLMQG | | PRMCSLMQG | | QNGVCPVVFT | | RNVPSIQSRGL | |
| PRMFLAMIT | | PRMFLAMIT | | QNHGICAVAT | | RNVPSVQSRGL | |
| PRNDDSSSN | | PRNDDSSSN | | QNICKPYIGK | | RNVTVTHAKDI | |
| PRNDDSSSS | | PRNDDSSSS | | QNIDKNALGD | | RNVTVTHAKNI | |
| PRNEDGSSS | | PRNEDGSSS | | QNIDKNALGE | | RNVTVTHAQDI | |
| PRNEDSSSN | | PRNEDSSSN | | QNIDRNAIGD | | RNVTVTHSVEL | |
| PRNEDSSSS | | PRNEDSSSS | | QNIDRNALGD | | RNVTVTHSVNL | |
| PRPADGTGS | | PRPADGTGS | | QNIDSRAVGK | | RNWSGYSGSFI | |
| PRPFVRGQQ | | PRPFVRGQQ | | QNIDSWAVGR | | RNWSGYSGSFT | |
| PRPLIRGQQ | | PRPLIRGQQ | | QNIEKNALGD | | RPCFWVELIRG | |
| PRPLVMGQQ | | PRPLVMGQQ | | QNIERNALGD | | RPCFWVELVRG | |
| PRPLVREQQ | | PRPLVREQQ | | QNIERNALGN | | RPEEAKYVEWT | |
| PRPLVRGQQ | | PRPLVRGQQ | | QNILEKTHNG | | RPEEAKYVWWA | |
| PRPMDGTGS | | PRPMDGTGS | | QNILRTHESE | | RPEEAKYVWWT | |
| PRPMDSTGS | | PRPMDSTGS | | QNILRTQESE | | RPEEVKYVWWT | |
| PRPRRGLFG | | PRPRRGLFG | | QNINRITYGA | | RPFQNVNKITY | |
| PRPVDGIGS | | PRPVDGIGS | | QNIPVTQTME | | RPFVRGQQGRM | |
| PRPVDGTGS | | PRPVDGTGS | | QNIPVTQVEE | | RPGDNITFSHN | |
| PRRGLFGAI | | PRRGLFGAI | | QNIWAYNAEL | | RPGETLNVESN | |
| PRRSGAAGA | | PRRSGAAGA | | QNKLNNVIDK | | RPGYNGQKSWM | |
| PRSRNGFEM | | PRSRNGFEM | | QNKLYGAGNK | | RPGYNGQKSWT | |
| PRSRSGFEM | | PRSRSGFEM | | QNKLYGTGNK | | RPGYNGQRSWM | |
| PRTTNTYRN | | PRTTNTYRN | | QNLFTLSGVA | | RPHPEDLNGMI | |
| PRTVGQCPK | | PRTVGQCPK | | QNLSPRTVGQ | | RPIGISSMVEA | |
| PRVFLAMIT | | PRVFLAMIT | | QNLTKINNGD | | RPILSPLTKGI | |
| PRVFLTMIT | | PRVFLTMIT | | QNLTKTNNGD | | RPILSPLTKGM | |
| PRVRNQSGR | | PRVRNQSGR | | QNLTKVNNGD | | RPITEINTWAR | |
| PRYAFEIVS | | PRYAFEIVS | | QNLTKVNNGN | | RPKEDEVWWTS | |
| PRYAFELVF | | PRYAFELVF | | QNLTKVNSGD | | RPKEDKVWWTS | |
| PRYAFELVS | | PRYAFELVS | | QNNAIDEGDG | | RPKEDRVWWTS | |
| PRYALELVS | | PRYALELVS | | QNNFVPVIGA | | RPKEEKVWWTS | |
| PRYGYIIEE | | PRYGYIIEE | | QNNFVPVVGA | | RPKEIEGICYP | |
| PRYGYIIEK | | PRYGYIIEK | | QNNTTLIENT | | RPKEMEGICYP | |
| PRYIPSGSL | | PRYIPSGSL | | QNNTTVVENT | | RPKEMEGVCYP | |
| PRYLPDLYD | | PRYLPDLYD | | QNPRIFLAMI | | RPKENPAHKSQ | |
| PRYNGQRSW | | PRYNGQRSW | | QNPRMFLAMI | | RPKVNGQAGRI | |
| PRYPDVRCV | | PRYPDVRCV | | QNPRVFLAMI | | RPLILKDCSIA | |
| PRYPNVRCV | | PRYPNVRCV | | QNPRVFLTMI | | RPLILKDCSVA | |
| PRYSFELVS | | PRYSFELVS | | QNPTEEQAVD | | RPLILRDCSVA | |
| PRYVKQGSL | | PRYVKQGSL | | QNPTEEQAVE | | RPLIRGQQGRM | |
| PRYVKQSSL | | PRYVKQSSL | | QNPTEEQAVG | | RPLVMGQQGRM | |

Fig. 83-296

| Block size 8 | SIN | Block size 9 | SIN | Block size 10 | SIN | Block size 11 | SIN |
|---|---|---|---|---|---|---|---|
| PRYVKSEKL | | PRYVKSEKL | | QNPTEEQAVN | | RPLVNGQRGRI | |
| PSAGKDPKK | | PSAGKDPKK | | QNQNPRMFLA | | RPLVNGQSGRI | |
| PSAGRDPKK | | PSAGRDPKK | | QNQVKIRRRV | | RPLVREQQGRM | |
| PSAIDQITG | | PSAIDQITG | | QNRGLFGAIA | | RPLVRGQQGRM | |
| PSAPEGMCY | | PSAPEGMCY | | QNRGLFGAKA | | RPLVRGQQGTM | |
| PSAPGVKGF | | PSAPGVKGF | | QNRIMINPVK | | RPLVRGQQGWM | |
| PSAPHGLCY | | PSAPHGLCY | | QNRIQIDPVK | | RPNENPAHKSQ | |
| PSAPHRLCY | | PSAPHRLCY | | QNRIQIDQVK | | RPNENPVHKSQ | |
| PSCASNINI | | PSCASNINI | | QNRIQIDSVK | | RPNIGPRPLIR | |
| PSCATNINI | | PSCATNINI | | QNRIQINPVK | | RPNIGPRPLVR | |
| PSCDLHLTG | | PSCDLHLTG | | QNRIRIDPVK | | RPPVNGQSGRI | |
| PSDAQAFYK | | PSDAQAFYK | | QNRLNNVIDK | | RPQINGQSGRI | |
| PSDTPRGED | | PSDTPRGED | | QNRMQFSSLT | | RPQMNGQSGRI | |
| PSECRTFFL | | PSECRTFFL | | QNRMQINPVK | | RPQVNGQRGRI | |
| PSERGLQRR | | PSERGLQRR | | QNRVKIDPVK | | RPQVNGQSGRI | |
| PSFDMNNEG | | PSFDMNNEG | | QNSEGTGIAA | | RPRRGLFGAIA | |
| PSFDMSKEG | | PSFDMSKEG | | QNSEGTGIVA | | RPRVRNQSGRI | |
| PSFDMSNDG | | PSFDMSNDG | | QNSEGTGTAA | | RPRYNGQRSWM | |
| PSFDMSNEG | | PSFDMSNEG | | QNSFVPVVGA | | RPSAPEGMCYP | |
| PSFEMSNEG | | PSFEMSNEG | | QNSQGEGTAA | | RPSIWTSSSST | |
| PSFFRNMIW | | PSFFRNMIW | | QNTIDLTDSE | | RPTAVDTCYPF | |
| PSFFRNMVW | | PSFFRNMVW | | QNTLKLATGM | | RPTRNGWGCKC | |
| PSFFRNVVW | | PSFFRNVVW | | QNTQGEGTAA | | RPTTEINTWAR | |
| PSFGVSGIN | | PSFGVSGIN | | QNTSKHYIGK | | RPTTTIKTWAR | |
| PSFGVSGVN | | PSFGVSGVN | | QNTSRHYIGK | | RPVAEINTWAR | |
| PSFYAEMKW | | PSFYAEMKW | | QNTSRHYMGE | | RPVAKAGFIEN | |
| PSFYRNLLW | | PSFYRNLLW | | QNVNKITYGA | | RPVGISSMGEA | |
| PSGCKMYAL | | PSGCKMYAL | | QNVNRITYGA | | RPVGISSMMEA | |
| PSGIEYNGK | | PSGIEYNGK | | QNVNRITYGP | | RPVGISSMVEA | |
| PSGPLKAEI | | PSGPLKAEI | | QNVNRITYGV | | RPVTEINTWAR | |
| PSGSLKLAI | | PSGSLKLAI | | QNVPVTQAME | | RPWIRFNSDLD | |
| PSGVEYNGK | | PSGVEYNGK | | QNVPVTQTME | | RPWIRFNSDPD | |
| PSGYAQTDC | | PSGYAQTDC | | QNVPVTQVEE | | RPWIRFNSNLD | |
| PSHEGEGIP | | PSHEGEGIP | | QNVSRIAIGN | | RPWIRINNETI | |
| PSIDPKGLF | | PSIDPKGLF | | QNWSGYSGAF | | RPWMRINNETI | |
| PSIEPKGLF | | PSIEPKGLF | | QNWSGYSGSF | | RPWMRISNETI | |
| PSIEPRGLF | | PSIEPRGLF | | QPAATALANT | | RPWVRFNSDLD | |
| PSIMSCDSP | | PSIMSCDSP | | QPAFSVQRNL | | RPWVRINNETI | |
| PSIQSRGLF | | PSIQSRGLF | | QPCFYIELIR | | RPWVRMNNETI | |
| PSKWGDILE | | PSKWGDILE | | QPCFYVELIR | | RQASPSCLVVR | |
| PSKWGDVLD | | PSKWGDVLD | | QPCFYVELTR | | RQCFNPMIAEL | |
| PSKWGNVLD | | PSKWGNVLD | | QPDWFRNVLS | | RQCFNPMIIEL | |
| PSLRMKWMM | | PSLRMKWMM | | QPEWFRNILS | | RQCFNPMIVEL | |
| PSNAQAFYK | | PSNAQAFYK | | QPEWFRNVLS | | RQCFNPMTVEL | |
| PSNMDRAVK | | PSNMDRAVK | | QPGDNIIFSH | | RQCFNPMVVEL | |
| PSNSLKLAI | | PSNSLKLAI | | QPGDNITFSD | | RQEALQNRIMI | |
| PSNSRFESV | | PSNSRFESV | | QPGDNITFSH | | RQEIDGIKLKS | |
| PSPGARPKV | | PSPGARPKV | | QPGWFRNVLS | | RQEIEGIKLES | |
| PSPGDRPKV | | PSPGDRPKV | | QPISLGDCSF | | RQEIEGIKLKS | |
| PSPLKLVDG | | PSPLKLVDG | | QPKEKAIWTS | | RQEIEGIKLKT | |
| PSPSNSRFE | | PSPSNSRFE | | QPKEKTIWTS | | RQEIEGIRLKS | |
| PSPYNSKFE | | PSPYNSKFE | | QPKERTIWTS | | RQEINGIKLKS | |
| PSPYNSRFE | | PSPYNSRFE | | QPKWFRNVLS | | RQEIVDNKNWS | |
| PSQKLFALS | | PSQKLFALS | | QPLSISVGSS | | RQEIVDNNNWS | |
| PSRSLKLAI | | PSRSLKLAI | | QPNDGQVLYF | | RQEIVDNSNWS | |
| PSRVSKLIG | | PSRVSKLIG | | QPNIGPRALV | | RQEIVGNDNWS | |
| PSRVSKLKG | | PSRVSKLKG | | QPNIGPRPLV | | RQEIVSNDNWS | |
| PSRVSKLRG | | PSRVSKLRG | | QPRTREILTK | | RQEKNPALRMK | |
| PSRVSKLTG | | PSRVSKLTG | | QPTFSVQRNL | | RQEKNPSLRMK | |
| PSRVTKLKG | | PSRVTKLKG | | QPTFSVQRSL | | RQGNSVWAGRT | |
| PSSAQEKND | | PSSAQEKND | | QQETRVWWTS | | RQGTSVWAGRT | |
| PSSDNEQTD | | PSSDNEQTD | | QQFELIDNEF | | RQIGNVINWTR | |

Fig. 83-297

| Block size 8 | SIN | Block size 9 | SIN | Block size 10 | SIN | Block size 11 | SIN |
|---|---|---|---|---|---|---|---|
| PSSSYRRPI | | PSSSYRRPI | | QQFELIDNKF | | RQIIRESGGID | |
| PSSSYRRPV | | PSSSYRRPV | | QQFELIDSEF | | RQILRTQESSC | |
| PSSTKEKND | | PSSTKEKND | | QQFELINNEF | | RQKIMESGGID | |
| PSSTKEKNE | | PSSTKEKNE | | QQFEMIDNEF | | RQKIMESGGIS | |
| PSSTQEKNA | | PSSTQEKNA | | QQFKLIDNEF | | RQKINGVKLEE | |
| PSSTQEKND | | PSSTQEKND | | QQGRMDYYWA | | RQKISGVKLEE | |
| PSTGKDPKK | | PSTGKDPKK | | QQGRMDYYWG | | RQKRGLFGAIA | |
| PSTGNHGSL | | PSTGNHGSL | | QQGTMDYYWG | | RQKSLIWLWLV | |
| PSTISCDSP | | PSTISCDSP | | QQGWMDYYWG | | RQKVNGVKLEE | |
| PSTMSCDSP | | PSTMSCDSP | | QQIESIIEAE | | RQKWWVWLWLV | |
| PSTVSCDSP | | PSTVSCDSP | | QQIESMIEAE | | RQLRENAEDIG | |
| PSVEPKGLF | | PSVEPKGLF | | QQIESMVEAE | | RQLRENAEDKG | |
| PSVEPRGLF | | PSVEPRGLF | | QQIGNVINWT | | RQLRENAEDMG | |
| PSVKLPMGA | | PSVKLPMGA | | QQMRDILGTF | | RQLRENAEDQG | |
| PSVQSRGLF | | PSVQSRGLF | | QQMRDVLGTF | | RQLRENAEDRG | |
| PSVVSCDSP | | PSVVSCDSP | | QQSFSPSPGA | | RQLRENAEEDC | |
| PSWAGNILR | | PSWAGNILR | | QQSFSPSPGD | | RQLRENAEEDG | |
| PSWAGNVLR | | PSWAGNVLR | | QQTRVDKLTQ | | RQNAEEDGKGC | |
| PSWEGNILR | | PSWEGNILR | | QQTRVDRLTQ | | RQNAEEDGRGC | |
| PTAPHGLCY | | PTAPHGLCY | | QQVESMIEAE | | RQRINGVKLEE | |
| PTAVDTCYP | | PTAVDTCYP | | QRAIDGVTNK | | RQSERGEDTIE | |
| PTDTPRGED | | PTDTPRGED | | QRAIDNMQNK | | RQSERGEETIE | |
| PTDTPRIQD | | PTDTPRIQD | | QRAMMDQVRE | | RQSERGEETVE | |
| PTDTPRVQD | | PTDTPRVQD | | QRAMVDQVRE | | RQSFSPSPGAR | |
| PTDVIRSWR | | PTDVIRSWR | | QRCCNLFEKF | | RQTFDWTLNRN | |
| PTDVVRSWK | | PTDVVRSWK | | QRFELIDNEF | | RQTRGIFGAIA | |
| PTDVVRSWR | | PTDVVRSWR | | QRFRRPDSSW | | RQTRGLFGAIA | |
| PTECRTFFL | | PTECRTFFL | | QRGILEDEQM | | RQTYDWTLNRN | |
| PTEEQAVDI | | PTEEQAVDI | | QRGNIRCNIC | | RQVCIAWSSSS | |
| PTEEQAVGI | | PTEEQAVGI | | QRGVLEDEQM | | RQVCMAWSSSS | |
| PTEEQAVNI | | PTEEQAVNI | | QRINGVKLEE | | RQVCVAWSSSS | |
| PTFDSLNIT | | PTFDSLNIT | | QRINMLADRI | | RRAAVSADPLA | |
| PTFSVQRNL | | PTFSVQRNL | | QRLEDVFAGK | | RRAEIIKMESA | |
| PTFSVQRSL | | PTFSVQRSL | | QRLEGVFAGK | | RRAIATPGMQI | |
| PTGCKMYAL | | PTGCKMYAL | | QRLENVFAGK | | RRAIVSADPLA | |
| PTGYAQTDC | | PTGYAQTDC | | QRLESVFAGK | | RRATVSADPLA | |
| PTKSYFANL | | PTKSYFANL | | QRLNPMHQLL | | RRATVSADPLL | |
| PTLLFLEVP | | PTLLFLEVP | | QRLNTMHQLL | | RRATVSADPLV | |
| PTLLFLKIP | | PTLLFLKIP | | QRRRFIQNAL | | RRCLLQSLQQI | |
| PTLLFLKMP | | PTLLFLKMP | | QRRRFVQNAL | | RRDILRTQESE | |
| PTLLFLKVP | | PTLLFLKVP | | QRSKFLLMDA | | RRDQKSLRGRG | |
| PTNGICYPG | | PTNGICYPG | | QRSKFLLMDS | | RREIHIYYLEK | |
| PTTEINTWA | | PTTEINTWA | | QRSWMKIYWH | | RREVHIYYLEK | |
| PVAEINTWA | | PVAEINTWA | | QRSWMKLYWH | | RREVHMYYLEK | |
| PVAKAGFIE | | PVAKAGFIE | | QRTRALVRSG | | RREVHTYYLEK | |
| PVCDPHLTG | | PVCDPHLTG | | QRTRALVRTG | | RREVHVYYLEK | |
| PVELSSGYK | | PVELSSGYK | | QSAIDQITGK | | RRFIQNALNGN | |
| PVGEAPSPY | | PVGEAPSPY | | QSAIDQITGT | | RRFVQNALNGN | |
| PVGEVPSPY | | PVGEVPSPY | | QSAIDQITRK | | RRFVQNALSGN | |
| PVGGNEKKA | | PVGGNEKKA | | QSAIDQVTGK | | RRGLFGAIAGF | |
| PVGISSMGE | | PVGISSMGE | | QSAINQITGK | | RRGQGHLDEKA | |
| PVGISSMME | | PVGISSMME | | QSAVDQITGK | | RRICEKLEQSG | |
| PVGISSMVE | | PVGISSMVE | | QSAVNQITGK | | RRIDFHWLFLD | |
| PVGPGSFPD | | PVGPGSFPD | | QSCFYVELIR | | RRIDFHWLLLD | |
| PVGSGSFPD | | PVGSGSFPD | | QSDAQIDESC | | RRIDFHWLLLE | |
| PVGTAPVLG | | PVGTAPVLG | | QSDKPFQNVS | | RRIDFNWLLLD | |
| PVGVAPSPS | | PVGVAPSPS | | QSEFNKACEL | | RRIENLNKKME | |
| PVGVAPSPY | | PVGVAPSPY | | QSERGEDTIE | | RRIENLNRKME | |
| PVHFQNQVK | | PVHFQNQVK | | QSERGEETIE | | RRIESLNKKME | |
| PVHFRNQIK | | PVHFRNQIK | | QSERGEETVE | | RRINMLADRID | |
| PVHFRNQVK | | PVHFRNQVK | | QSFPQTTNTY | | RRKKRGLFGAI | |
| PVHFRSQVK | | PVHFRSQVK | | QSFSPSPGAR | | RRKRGLFGAIA | |

Fig. 83-298

| Block size 8 | SIN | Block size 9 | SIN | Block size 10 | SIN | Block size 11 | SIN |
|---|---|---|---|---|---|---|---|
| PVHKSQLIW | | PVHKSQLIW | | QSFSPSPGDR | | RRKTNLYGFII | |
| PVHLGDCNF | | PVHLGDCNF | | QSFTPSPGAR | | RRKTNLYGFIV | |
| PVHLGDCRF | | PVHLGDCRF | | QSFTPSPGTR | | RRKTNLYGFLI | |
| PVHLGDCSF | | PVHLGDCSF | | QSFVPSPGAR | | RRLTTTIKPWA | |
| PVICLGHHA | | PVICLGHHA | | QSFVPSPGSR | | RRLTTTIKTWA | |
| PVICLGHHS | | PVICLGHHS | | QSFVPSPGVR | | RRLTTTIRTWA | |
| PVICMGHHA | | PVICMGHHA | | QSFYRSINWL | | RRLTTTVKTWA | |
| PVIGARPQV | | PVIGARPQV | | QSGHIEECSC | | RRLTVLGKDAG | |
| PVKGWAPLS | | PVKGWAPLS | | QSGLPVGGNE | | RRNKYLEEHPN | |
| PVKLNSGYK | | PVKLNSGYK | | QSGRIDFHWA | | RRNKYLEEHPS | |
| PVKLSGGYK | | PVKLSGGYK | | QSGRIDFHWL | | RRNRYLEEHPS | |
| PVKLSNGYK | | PVKLSNGYK | | QSGRIDFHWM | | RRNRYLEENPS | |
| PVKLSSGYK | | PVKLSSGYK | | QSGRIDFHWT | | RRNSSDICYPG | |
| PVKLSSSYK | | PVKLSSSYK | | QSGRIDFYWL | | RRPDSSWLFGG | |
| PVLGNYKEI | | PVLGNYKEI | | QSGRINFHWL | | RRPIGISSMVE | |
| PVLGNYREI | | PVLGNYREI | | QSGRINFHWT | | RRPVAKAGFIE | |
| PVLGNYREV | | PVLGNYREV | | QSGRISFYWT | | RRPVGISSMGE | |
| PVLKPGQTL | | PVLKPGQTL | | QSGRISIYWT | | RRPVGISSMME | |
| PVLTDNPRP | | PVLTDNPRP | | QSGRVSFYWT | | RRPVGISSMVE | |
| PVLYFWGVH | | PVLYFWGVH | | QSKGLFGAIA | | RRQILRTQESS | |
| PVMGARPQV | | PVMGARPQV | | QSKMQFSSLT | | RRQKRGLFGAI | |
| PVNGICYPG | | PVNGICYPG | | QSLIIAARNI | | RRQKSLIWLWL | |
| PVNGQSGRI | | PVNGQSGRI | | QSLIIAARSI | | RRQKWVVWLWL | |
| PVNNGKGRY | | PVNNGKGRY | | QSLQQIESII | | RRQLRENAEDK | |
| PVPVGSGSF | | PVPVGSGSF | | QSLQQIESMI | | RRQLRENAEDQ | |
| PVQNAISTT | | PVQNAISTT | | QSLQQIESMV | | RRQLRENAEDR | |
| PVQSKMQFS | | PVQSKMQFS | | QSLRSILANN | | RRQLRENAEED | |
| PVQSRMQFS | | PVQSRMQFS | | QSLRSILASS | | RRRFIQNALNG | |
| PVQTDEYKN | | PVQTDEYKN | | QSLSISIGSS | | RRRFVQNALNG | |
| PVSVGSGSF | | PVSVGSGSF | | QSLSISVESS | | RRRFVQNALSG | |
| PVTEINTWA | | PVTEINTWA | | QSLSISVGSS | | RRRGLFGAIAG | |
| PVTIGECPK | | PVTIGECPK | | QSLVIAARNI | | RRRKKRGLFGA | |
| PVTIGKCPK | | PVTIGKCPK | | QSNNSTDTVD | | RRRTNLYGFII | |
| PVTLSSGYK | | PVTLSSGYK | | QSNNSTDTVN | | RRRVDINPGHA | |
| PVTLTMGYK | | PVTLTMGYK | | QSNNSTNTVN | | RRRVDINPGHS | |
| PVTQAMELV | | PVTQAMELV | | QSPLGAINTT | | RRRVDMNPGHA | |
| PVTQTMELV | | PVTQTMELV | | QSPNVYQAKF | | RRRVDTNPGHA | |
| PVTQVEELV | | PVTQVEELV | | QSPNVYQARF | | RRRVDVNPGHA | |
| PVTSSIDLI | | PVTSSIDLI | | QSPNVYQSRF | | RRSGAAGAAIK | |
| PVTSSIDLV | | PVTSSIDLV | | QSPRMFLAMI | | RRSGAAGAAVK | |
| PVTSSVDLI | | PVTSSVDLI | | QSRFEAVAWS | | RRTNLYGFIIK | |
| PVTSSVDLV | | PVTSSVDLV | | QSRGLFGAIA | | RRVENLNKKME | |
| PVTSTIDLI | | PVTSTIDLI | | QSRMQFSSLA | | RRYELEIGTRI | |
| PVVFTDGSA | | PVVFTDGSA | | QSRMQFSSLT | | RRYGPALSINE | |
| PVVGARPKV | | PVVGARPKV | | QSRTREILTK | | RRYGPALSISE | |
| PVVGARPQV | | PVVGARPQV | | QSRTREILTR | | RSALILRGAVA | |
| PVVMTDGPA | | PVVMTDGPA | | QSRTRGILTK | | RSALILRGSIA | |
| PVVPSFDMS | | PVVPSFDMS | | QSSDDFALIL | | RSALILRGSVA | |
| PVVRARPQV | | PVVRARPQV | | QSSDDFALIV | | RSAYERMCNIL | |
| PWARNILRT | | PWARNILRT | | QSSLPLALGM | | RSDKICIGYHA | |
| PWIRFNSDL | | PWIRFNSDL | | QSSPPTVYNS | | RSDKICLGHHA | |
| PWIRFNSDP | | PWIRFNSDP | | QSTLKLATGM | | RSDQISIVPNI | |
| PWIRFNSNL | | PWIRFNSNL | | QSWSYIVERP | | RSESSFYAEME | |
| PWIRINNET | | PWIRINNET | | QSYFQLFLVC | | RSFKPNIGPRP | |
| PWISFDQNL | | PWISFDQNL | | QTAAQKAMMD | | RSFQPNIGPRA | |
| PWMRINNET | | PWMRINNET | | QTAAQRAMMD | | RSFQPNIGPRP | |
| PWMRISNET | | PWMRISNET | | QTAAQRAMVD | | RSFRPNIGPRP | |
| PWVLLNASW | | PWVLLNASW | | QTAIDQINGK | | RSFSRTELIAP | |
| PWVRGQSGR | | PWVRGQSGR | | QTAIDQITGK | | RSFSRTELIPP | |
| PWVRINNET | | PWVRINNET | | QTALYKNANT | | RSGAAGAAIKG | |
| PWVRMNNET | | PWVRMNNET | | QTANTYRNTD | | RSGAAGAAVKG | |
| PWVSFDQNL | | PWVSFDQNL | | QTATKRIRMA | | RSGFEIIWDPN | |

Fig. 83-299

| Block size 8 | SIN | Block size 9 | SIN | Block size 10 | SIN | Block size 11 | SIN |
|---|---|---|---|---|---|---|---|
| PWVSFNHNL | | PWVSFNHNL | | QTATKRLRMA | | RSGFEILLIED | |
| PWVSFNQDL | | PWVSFNQDL | | QTDCVLEAMA | | RSGFEILLIEE | |
| PWVSFNQNL | | PWVSFNQNL | | QTDEYKNTGD | | RSGFEMIWDAN | |
| PYIGKCPKY | | PYIGKCPKY | | QTDEYKNTRD | | RSGFEMIWDPD | |
| PYLNGREWS | | PYLNGREWS | | QTDLYKVATG | | RSGFEMIWDPN | |
| PYNSKFESV | | PYNSKFESV | | QTESRGLFGA | | RSGFEMLKIHN | |
| PYNSRFESV | | PYNSRFESV | | QTFDWTLNRN | | RSGFEMLKIPN | |
| PYPGNNBNG | | PYPGNNBNG | | QTGRIDFHWL | | RSGFEMLKVPN | |
| PYPGNNNKG | | PYPGNNNKG | | QTGRMTFYWT | | RSGFEMLRIPN | |
| PYPGNNNNG | | PYPGNNNNG | | QTIINNYHNE | | RSGFEMVWDAN | |
| PYPGNSNNG | | PYPGNSNNG | | QTIINNYYND | | RSGFEMVWDDN | |
| PYRALISWE | | PYRALISWE | | QTIINNYYNE | | RSGFEMVWDPN | |
| PYRALMSCP | | PYRALMSCP | | QTIINNYYNK | | RSGFEVLFIED | |
| PYRALMSVP | | PYRALMSVP | | QTIVLNTDWS | | RSGFEVLKVPN | |
| PYRSLIKFP | | PYRSLIKFP | | QTIVLTTDWS | | RSGFEVLLIED | |
| PYRSLIQFP | | PYRSLIQFP | | QTKKMTITFL | | RSGFEVLLIEN | |
| PYRSLIRFP | | PYRSLIRFP | | QTKLYGNGNK | | RSGMDPRMCSL | |
| PYRTLLMNE | | PYRTLLMNE | | QTKLYGSGNK | | RSGPSFYAEMK | |
| PYRTLLMSE | | PYRTLLMSE | | QTKLYGSGSK | | RSGQNHGICAV | |
| PYRTLMSCP | | PYRTLMSCP | | QTKLYKNTNT | | RSGSSFYAELK | |
| PYRTLMSVE | | PYRTLMSVE | | QTKTMTITFL | | RSGSSFYAEMK | |
| PYRTLMSVK | | PYRTLMSVK | | QTLRIISNGN | | RSGTSKACNAL | |
| PYSHGTGTG | | PYSHGTGTG | | QTLRIRSNGN | | RSGTSKACNAS | |
| PYTGDPPYS | | PYTGDPPYS | | QTLRVKSNGN | | RSGYEILKVPN | |
| PYTLVSTGS | | PYTLVSTGS | | QTLRVRSDGN | | RSGYEMLKVPD | |
| PYTLVSTKE | | PYTLVSTKE | | QTLRVRSNGN | | RSGYEMLKVPN | |
| PYTLVSTKS | | PYTLVSTKS | | QTLVANNDWS | | RSGYETFKVIG | |
| PYTLVSTRS | | PYTLVSTRS | | QTLVSNDDWS | | RSGYETFRVID | |
| PYTLVSTSS | | PYTLVSTSS | | QTLVSNNDWS | | RSGYETFRVIG | |
| PYTLVTTSS | | PYTLVTTSS | | QTLVSNSDWS | | RSGYETFRVIS | |
| PYVSCDPDE | | PYVSCDPDE | | QTMELVEAEK | | RSGYETFRVTG | |
| PYVSCDPDG | | PYVSCDPDG | | QTMELVETEK | | RSGYEVLKVPD | |
| PYVSCDPLG | | PYVSCDPLG | | QTMELVETKK | | RSGYEVLKVPN | |
| PYVSCDPNE | | PYVSCDPNE | | QTNGNLIAPE | | RSGYEVLRVPN | |
| PYVSCDPSG | | PYVSCDPSG | | QTNNSTDTVN | | RSGYSGIFSVE | |
| PYVSCDPTG | | PYVSCDPTG | | QTNNSTETVN | | RSGYSGSFIDY | |
| PYVSCEPDE | | PYVSCEPDE | | QTNTTLIENT | | RSGYSGVFSVE | |
| QAADLKSTQ | | QAADLKSTQ | | QTPLGAINTT | | RSGYWAIRTRS | |
| QAADYESTQ | | QAADYESTQ | | QTPLGALNTT | | RSHKICIGYHA | |
| QAADYKSTQ | | QAADYKSTQ | | QTRGIFGAIA | | RSHLRNDTDVV | |
| QAAEAIEVA | | QAAEAIEVA | | QTRGLFGAIA | | RSICEKLEQSG | |
| QAAEAMEIA | | QAAEAMEIA | | QTRVDKLTQG | | RSIEEKFEITG | |
| QAAEAMEVA | | QAAEAMEVA | | QTRVDRLTQG | | RSIIFNMERIK | |
| QAAIDKING | | QAAIDKING | | QTSGNLIAPE | | RSILANNGKFE | |
| QAAIDQING | | QAAIDQING | | QTSLLLATGM | | RSILANNGRFE | |
| QAAIDQITG | | QAAIDQITG | | QTSVGGIDTN | | RSILASSGSLE | |
| QAAIDQVNG | | QAAIDQVNG | | QTSVGGINTN | | RSILNTSQRGI | |
| QAAVDQITG | | QAAVDQITG | | QTTLYKNANT | | RSILNTSQRGV | |
| QADEICIGY | | QADEICIGY | | QTTNTYRNTD | | RSINWLTKKEP | |
| QADSEMNKL | | QADSEMNKL | | QTVINNYYNE | | RSINWLTKKKN | |
| QAELLVAME | | QAELLVAME | | QTVKIKTNGN | | RSINWLTKKKP | |
| QAFRDNLEP | | QAFRDNLEP | | QTVKIQTNGN | | RSIVASSGTLE | |
| QAFYKILKI | | QAFYKILKI | | QTVKIQTSGN | | RSIVRRATVSA | |
| QAFYRSINW | | QAFYRSINW | | QTVVLNTDWS | | RSKFLLMDALK | |
| QAGRIDFHW | | QAGRIDFHW | | QTYAGAINSS | | RSKFLLMDSLK | |
| QAGRMTFYW | | QAGRMTFYW | | QTYAGAVNSS | | RSKINEVKLEE | |
| QAGVDRFYR | | QAGVDRFYR | | QTYDWTLNRN | | RSKINGVILEE | |
| QAGVNRFYR | | QAGVNRFYR | | QTYQKRMGVQ | | RSKINGVKLEE | |
| QAHTKVLYF | | QAHTKVLYF | | QTYRNNRKEP | | RSKINGVRLEE | |
| QAKFEAVAW | | QAKFEAVAW | | QTYRNTRKEP | | RSKYWAIRTRS | |
| QAKFESVAW | | QAKFESVAW | | QTYTGAINSS | | RSLFSSIKKYE | |
| QAKGLFGAI | | QAKGLFGAI | | QVAGSSEQAA | | RSLFSSIKRYE | |

Fig. 83-300

| Block size 8 | SIN | Block size 9 | SIN | Block size 10 | SIN | Block size 11 | SIN |
|---|---|---|---|---|---|---|---|
| QALKDNLEP | | QALKDNLEP | | QVCAAWSSSS | | RSLIASSGTLE | |
| QALQLLFEV | | QALQLLFEV | | QVCIAWSSAS | | RSLIQFPIGTA | |
| QALQLLLEV | | QALQLLLEV | | QVCIAWSSSS | | RSLIQFPMGTA | |
| QALRDNLEP | | QALRDNLEP | | QVCMAWSSSS | | RSLIRFPIGTA | |
| QALRDSLEP | | QALRDSLEP | | QVCVAWSSSS | | RSLIRFPIGVA | |
| QAMELVEAE | | QAMELVEAE | | QVDCFIWHIR | | RSLIRFPVGTA | |
| QANLCRFLE | | QANLCRFLE | | QVDCFLWHIR | | RSLISWPLSSP | |
| QAQDRGLFG | | QAQDRGLFG | | QVDCFLWHVR | | RSLKLAIGLRN | |
| QAQNRGLFG | | QAQNRGLFG | | QVDCFLWYVR | | RSLKLATGLRN | |
| QARFEAVAW | | QARFEAVAW | | QVDCYLWHIR | | RSLLLATGMRN | |
| QARFESVAW | | QARFESVAW | | QVDTIMEKIV | | RSLMLATGMRN | |
| QASPSCLVV | | QASPSCLVV | | QVDTIMEKNI | | RSLVASSGNLE | |
| QASYKIFKS | | QASYKIFKS | | QVDTIMEKNV | | RSLVASSGTLE | |
| QASYRIFKS | | QASYRIFKS | | QVDTIMERNV | | RSLWDSFRQSE | |
| QATIDQITG | | QATIDQITG | | QVDTIREKNV | | RSNAPSGIEYN | |
| QAVDICKAA | | QAVDICKAA | | QVECVCRDNW | | RSNAPSGVEYN | |
| QAVGICKAA | | QAVGICKAA | | QVEELVHGGI | | RSNENPAHKSQ | |
| QAVNICKAA | | QAVNICKAA | | QVEELVHGGV | | RSNIFNMERIK | |
| QAWSYIVER | | QAWSYIVER | | QVEELVHGQV | | RSPFRALISWE | |
| QAYQKRMGL | | QAYQKRMGL | | QVEELVHRGI | | RSPFRALISWG | |
| QAYQKRMGV | | QAYQKRMGV | | QVEGRIQDLE | | RSPFRALVSWE | |
| QAYTKILYF | | QAYTKILYF | | QVEGRIQNLE | | RSPFRTLMSCP | |
| QAYTKIMYF | | QAYTKIMYF | | QVEGRIQYLE | | RSPFRTLMSVE | |
| QAYTKVLYF | | QAYTKVLYF | | QVEGRTQDLE | | RSPFRTLMSVK | |
| QAYTKVMYF | | QAYTKVMYF | | QVEKRINMIA | | RSPGNAEIEDL | |
| QCDLHLEFK | | QCDLHLEFK | | QVEKRINMLA | | RSPHRALMSCP | |
| QCDNNCIES | | QCDNNCIES | | QVENRINMLA | | RSPHRSLMSCP | |
| QCDSHLKFK | | QCDSHLKFK | | QVEQRINMLA | | RSPHRTLLMNE | |
| QCEITGFAP | | QCEITGFAP | | QVERRINMLA | | RSPHRTLMSCP | |
| QCFNPMIAE | | QCFNPMIAE | | QVESMIEAES | | RSPQRTLMSCP | |
| QCFNPMIIE | | QCFNPMIIE | | QVEVTNATEL | | RSPYRALISWE | |
| QCFNPMIVE | | QCFNPMIVE | | QVFPQLNQTY | | RSPYRALMSCP | |
| QCFNPMTVE | | QCFNPMTVE | | QVIKLLPFAA | | RSPYRALMSVP | |
| QCFNPMVVE | | QCFNPMVVE | | QVIVTREPYV | | RSPYRTLMSCP | |
| QCHITGFAP | | QCHITGFAP | | QVKIRRRVDI | | RSPYRTLMSVE | |
| QCKITGFAP | | QCKITGFAP | | QVKIRRRVDM | | RSPYRTLMSVG | |
| QCLITGFAP | | QCLITGFAP | | QVKIRRRVDT | | RSPYRTLMSVK | |
| QCMESIRNN | | QCMESIRNN | | QVKIRRRVDV | | RSQFRALISWE | |
| QCQIAGFAP | | QCQIAGFAP | | QVKLSSGYKD | | RSQSGRISFYW | |
| QCQIIGFAP | | QCQIIGFAP | | QVNGQFGRID | | RSQYRALISWP | |
| QCQIRGFAP | | QCQIRGFAP | | QVNGQSGRID | | RSQYRALVSWP | |
| QCQISGFAP | | QCQISGFAP | | QVNGQSGRIN | | RSQYRSLISWP | |
| QCQITGFAP | | QCQITGFAP | | QVQDRGLFGA | | RSRNGFEMLKI | |
| QCQITGFVP | | QCQITGFVP | | QVQNRGLFGA | | RSRSGFEMLKI | |
| QCQITGSAP | | QCQITGSAP | | QVREGRNPGN | | RSRSGFEMLKV | |
| QCQTPLGAI | | QCQTPLGAI | | QVRESRNPGN | | RSRSGFEMLRI | |
| QCQVTGFAP | | QCQVTGFAP | | QVTDIWAYNA | | RSRSSFYAEMK | |
| QCRICIDFR | | QCRICIDFR | | QVTGKLNRLI | | RSRYWAIRTRS | |
| QCRICILDQ | | QCRICILDQ | | QWDWPDGAKI | | RSSCHDGKAWL | |
| QCRICIRAD | | QCRICIRAD | | QWNWPDGAEI | | RSSFYAEMKWL | |
| QCRITGFAP | | QCRITGFAP | | QWNWPDGAKI | | RSSSSFYAEMK | |
| QDAMTEVWS | | QDAMTEVWS | | QYICSPVLTD | | RSTIGDCPKYV | |
| QDCDLINGA | | QDCDLINGA | | QYLCTGILTD | | RSWKKQILRTQ | |
| QDEFCYTLI | | QDEFCYTLI | | QYLCTGVLTD | | RSWMKIYWHLM | |
| QDEFCYTLM | | QDEFCYTLM | | QYLEKYVEDT | | RSWMKLYWHLM | |
| QDEFCYTLV | | QDEFCYTLV | | QYLLFQDILM | | RSWRKKILRTQ | |
| QDGKSSACK | | QDGKSSACK | | QYPNVRCVCR | | RSWRKQILRTQ | |
| QDIIDNDNW | | QDIIDNDNW | | QYRAESLQNR | | RSWRRQILRTQ | |
| QDIIDNNNW | | QDIIDNNNW | | QYRALISWPL | | RSYNNTSGEQM | |
| QDILEKTHN | | QDILEKTHN | | QYRALISWPQ | | RTAFRGLISTP | |
| QDIWAYNAE | | QDIWAYNAE | | QYRALVSWPL | | RTAFRGLMSTP | |
| QDLEKYVED | | QDLEKYVED | | QYREEALLNR | | RTATREGKHIV | |

Fig. 83-301

| Block size 8 | SIN | Block size 9 | SIN | Block size 10 | SIN | Block size 11 | SIN |
|---|---|---|---|---|---|---|---|
| QDLENYVED | | QDLENYVED | | QYREESLLNR | | RTAYERMCNIL | |
| QDLERYVED | | QDLERYVED | | QYRSLISWPL | | RTCKLLGINMS | |
| QDLWAYNAE | | QDLWAYNAE | | QYRTESLQNR | | RTCKLVGINMS | |
| QDNAIRFGE | | QDNAIRFGE | | QYRTGSLQNR | | RTDGATSACKR | |
| QDNAKDEGN | | QDNAKDEGN | | QYSGFVRTLF | | RTEESECVCHN | |
| QDRGLFGAI | | QDRGLFGAI | | RAAFRGLIST | | RTELINPNKWG | |
| QDRGLFGAK | | QDRGLFGAK | | RAAVSADPLA | | RTELINPSKWG | |
| QDSECVSHN | | QDSECVSHN | | RACFYVELIR | | RTELIPPSKWG | |
| QDSFYRSMK | | QDSFYRSMK | | RADEICIGYL | | RTELISPNKWG | |
| QDTEISFTI | | QDTEISFTI | | RADKICIGYL | | RTELISPSKWG | |
| QDTELSFTI | | QDTELSFTI | | RAGYEMLKVP | | RTESLQNRIQI | |
| QDTELSFTV | | QDTELSFTV | | RAIATPGMQI | | RTFFITQGSLL | |
| QDTEVSFTI | | QDTEVSFTI | | RAIDNMQNKL | | RTFFLTHGALL | |
| QDTTWDVFI | | QDTTWDVFI | | RAIVSADPLA | | RTFFLTHGSLL | |
| QDVIMEVVF | | QDVIMEVVF | | RALISWEMGQ | | RTFFLTQGALL | |
| QDVWAYNAE | | QDVWAYNAE | | RALISWGMGQ | | RTFFLTQGSLL | |
| QDWSGYSGA | | QDWSGYSGA | | RALISWPLSS | | RTFFLTQGSLP | |
| QDWSYIVER | | QDWSYIVER | | RALISWPQSS | | RTFLAMITYIT | |
| QEAIDKITN | | QEAIDKITN | | RALMSCPIGE | | RTFQNIDKNAL | |
| QEAIEKITN | | QEAIEKITN | | RALMSCPLGE | | RTFQNIDRNAL | |
| QEAIGKITN | | QEAIGKITN | | RALMSCPVGE | | RTFSFQLINNK | |
| QEAINKITN | | QEAINKITN | | RALMSVLLGS | | RTGMDPRMCSL | |
| QEALQNRIM | | QEALQNRIM | | RALMSVPLGS | | RTGSLQNRIQI | |
| QEARVWWTS | | QEARVWWTS | | RALSIYSCIA | | RTGTFEFTSFF | |
| QEDCMIKAV | | QEDCMIKAV | | RALTLNTMTK | | RTHQYSEKGKW | |
| QEDCMMKAV | | QEDCMMKAV | | RALVRGQQGR | | RTHQYSEKGRW | |
| QEDCMVKAV | | QEDCMVKAV | | RALVRSGMDP | | RTHQYSERGKW | |
| QEDRMIKAV | | QEDRMIKAV | | RALVRTGMDP | | RTHQYSERGRW | |
| QEECMIKAV | | QEECMIKAV | | RALVSWEMGQ | | RTIQNEDIPIG | |
| QEELKSLFS | | QEELKSLFS | | RALVSWPLSS | | RTISIASRSGY | |
| QEELRFLFS | | QEELRFLFS | | RAMMDQVREG | | RTISKDLRSGY | |
| QEELRSLFS | | QEELRSLFS | | RAMMDQVRES | | RTISKDSRSGY | |
| QEEVTNATE | | QEEVTNATE | | RAMVDQVRES | | RTISKDTRSGY | |
| QEFKMNPNK | | QEFKMNPNK | | RANQRLNPMH | | RTISMDSRSGY | |
| QEFKMNPNQ | | QEFKMNPNQ | | RANQRLNTMH | | RTISPHSRSGF | |
| QEGRLIQNS | | QEGRLIQNS | | RAPFISCSYL | | RTISPKLRSGF | |
| QEIDGIKLK | | QEIDGIKLK | | RAPISLGDCS | | RTISPRLRSGF | |
| QEIEGARLD | | QEIEGARLD | | RAPYRSLIRF | | RTISPRSRNGF | |
| QEIEGIKLE | | QEIEGIKLE | | RARIDARIDF | | RTISPRSRSGF | |
| QEIEGIKLK | | QEIEGIKLK | | RARIDARVDF | | RTISRDSRSGY | |
| QEIEGIRLK | | QEIEGIRLK | | RARIDARVDS | | RTISTASRAGY | |
| QEIEGVKLD | | QEIEGVKLD | | RARIKTRLFT | | RTISTASRSGY | |
| QEIEGVKLN | | QEIEGVKLN | | RARPQVNGQS | | RTISTASRYGY | |
| QEIEGVRLD | | QEIEGVRLD | | RATEYIMKGV | | RTIWTSGSSIA | |
| QEIGGVKLD | | QEIGGVKLD | | RATEYMMKGV | | RTKEGRRKTNL | |
| QEIGNGCFE | | QEIGNGCFE | | RATFLRSNAP | | RTKEGRRRTNL | |
| QEIKMNPNQ | | QEIKMNPNQ | | RATVSADPLA | | RTKEMEGICYP | |
| QEINGIKLK | | QEINGIKLK | | RATVSADPLL | | RTKSLESRRGF | |
| QEIVDNKNW | | QEIVDNKNW | | RATVSADPLV | | RTKSLESRSGF | |
| QEIVDNNNW | | QEIVDNNNW | | RAVDGTIAGF | | RTLDFHDSNVK | |
| QEIVDNSNW | | QEIVDNSNW | | RAVGKCPRYV | | RTLDFHDSNVR | |
| QEIVGNDNW | | QEIVGNDNW | | RAVKLYKKLK | | RTLDFHDSSVK | |
| QEIVSNDNW | | QEIVSNDNW | | RAVKLYRKLK | | RTLDLHDANVK | |
| QEKNDLYGA | | QEKNDLYGA | | RAWLHVCVTG | | RTLDLHDANVR | |
| QEKNDLYGT | | QEKNDLYGT | | RAYVDGFEPN | | RTLDLHDSNVK | |
| QEKNPALRM | | QEKNPALRM | | RAYVDGFKPN | | RTLFQQMRDIL | |
| QEKNPSLRM | | QEKNPSLRM | | RCCNLFEKFF | | RTLFQQMRDVI | |
| QELGDAPFL | | QELGDAPFL | | RCDDQCMESI | | RTLFQQMRDVL | |
| QENRVWWTS | | QENRVWWTS | | RCFYVELIRG | | RTLGLHDANVR | |
| QERGLFGAI | | QERGLFGAI | | RCFYVELVRG | | RTLISWEMGQA | |
| QERNDLYGT | | QERNDLYGT | | RCICEKLEQS | | RTLLAKSVFNC | |
| QESECACAN | | QESECACAN | | RCICKDNWKG | | RTLLAKSVFNN | |

Fig. 83-302

| Block size 8 | SIN | Block size 9 | SIN | Block size 10 | SIN | Block size 11 | SIN |
|---|---|---|---|---|---|---|---|
| QESECACIN | | QESECACIN | | RCICRDNWKG | | RTLLAKSVFNS | |
| QESECACVN | | QESECACVN | | RCINRCFYVE | | RTLLMNELGIP | |
| QESECICIN | | QESECICIN | | RCLLQSLQQI | | RTLLMNELGVP | |
| QESECQCID | | QESECQCID | | RCNTKCQTSL | | RTLLMNELGVS | |
| QESECQCIG | | QESECQCIG | | RCNTKCQTSV | | RTLLMSELGVP | |
| QESECQCIS | | QESECQCIS | | RCNTRCQTSV | | RTLMSCHIGVA | |
| QESECQCLY | | QESECQCLY | | RCPRYVKQSS | | RTLMSCPIGVA | |
| QESECQRID | | QESECQRID | | RCQTPLGAIN | | RTLMSCPMGVA | |
| QESECVCHK | | QESECVCHK | | RCQTSVGGIN | | RTLMSCPVGVA | |
| QESECVCHN | | QESECVCHN | | RCRETRGLFG | | RTLNTASRSGY | |
| QESECVCHS | | QESECVCHS | | RCRKTRGLFG | | RTLTLNTMTKD | |
| QESECVCID | | QESECVCID | | RCTISLVKTT | | RTLYFHDSNVK | |
| QESECVCIN | | QESECVCIN | | RCVCRDNWKG | | RTNEKFHQIEK | |
| QESECVCIS | | QESECVCIS | | RCVCRDNWMG | | RTNEKYHQIEK | |
| QESECVCMN | | QESECVCMN | | RCVCRDNWRG | | RTNGNLIAPEF | |
| QESECVCQD | | QESECVCQD | | RCYQFALGQG | | RTNGTSKIKMK | |
| QESECVCVN | | QESECVCVN | | RDAMTEIWSY | | RTNGTSKVKMK | |
| QESECVRHN | | QESECVRHN | | RDAMTEVWSY | | RTNHQFELIDN | |
| QESLLLATG | | QESLLLATG | | RDCKIEAVIY | | RTNLYGFIIKG | |
| QESLMLATG | | QESLMLATG | | RDCKVEAVIY | | RTNQQFELIDN | |
| QESSCTCIK | | QESSCTCIK | | RDCSIAGWLL | | RTPHRTLLMNE | |
| QESSCTCIL | | QESSCTCIL | | RDCSVAGWLL | | RTPIAFLTSSI | |
| QESSCTCIQ | | QESSCTCIQ | | RDDAINNRFQ | | RTPYRSLIKFP | |
| QESSCTCIR | | QESSCTCIR | | RDDLEPGTFD | | RTPYRSLIQFP | |
| QESSCVCIK | | QESSCVCIK | | RDEAINNRFQ | | RTPYRSLIRFP | |
| QESSCVCMK | | QESSCVCMK | | RDEAINNRIK | | RTPYRTLLMNE | |
| QESSCVCMN | | QESSCVCMN | | RDEAINSRFQ | | RTQDSECVSHN | |
| QESSCVCVK | | QESSCVCVK | | RDEAISNRFQ | | RTQESECACAN | |
| QETKVWWTS | | QETKVWWTS | | RDEALNNRFQ | | RTQESECACIN | |
| QETRVWWTS | | QETRVWWTS | | RDEALNNRSQ | | RTQESECACVN | |
| QFALGHGTT | | QFALGHGTT | | RDEALSNRFQ | | RTQESECICIN | |
| QFALGQGAT | | QFALGQGAT | | RDEAVNNRFQ | | RTQESECLCID | |
| QFALGQGTT | | QFALGQGTT | | RDEEGTGIAA | | RTQESECQCID | |
| QFEAIGREF | | QFEAIGREF | | RDEGNGCFTF | | RTQESECQCIG | |
| QFEAVGKEF | | QFEAVGKEF | | RDILRTQESE | | RTQESECQCIS | |
| QFEAVGREF | | QFEAVGREF | | RDITIGSICM | | RTQESECQRID | |
| QFELIDHEF | | QFELIDHEF | | RDLGNCHPIG | | RTQESECVCHK | |
| QFELIDNEF | | QFELIDNEF | | RDNAKDEGNG | | RTQESECVCHN | |
| QFELIDNKF | | QFELIDNKF | | RDNAKDLGNG | | RTQESECVCHS | |
| QFELINNEF | | QFELINNEF | | RDNAKEIGNG | | RTQESECVCID | |
| QFEMIDNEF | | QFEMIDNEF | | RDNAKELGNG | | RTQESECVCIN | |
| QFGLIDNEF | | QFGLIDNEF | | RDNAMILGNG | | RTQESECVCIS | |
| QFGRIDFHW | | QFGRIDFHW | | RDNANDLGNG | | RTQESECVCQD | |
| QFGRINFHW | | QFGRINFHW | | RDNLEPGTFD | | RTQESECVCVN | |
| QFKLIDNEF | | QFKLIDNEF | | RDNVKELGDG | | RTQESECVRHN | |
| QFPVQTDEY | | QFPVQTDEY | | RDNVKELGNG | | RTQESSCTCIK | |
| QFRALISWE | | QFRALISWE | | RDNWHASNRP | | RTQESSCTCIL | |
| QFSSLAVNV | | QFSSLAVNV | | RDNWHGSNRP | | RTQESSCTCIQ | |
| QFSSLTVNV | | QFSSLTVNV | | RDNWKGANRP | | RTQESSCTCIR | |
| QFSSLTVSV | | QFSSLTVSV | | RDNWKGSNRP | | RTQESSCVCIK | |
| QFTAVGKEF | | QFTAVGKEF | | RDNWMGSNRP | | RTQESSCVCMK | |
| QFTSVGKEF | | QFTSVGKEF | | RDNWNGMNRP | | RTQESSCVCMN | |
| QFTWNGVKV | | QFTWNGVKV | | RDNWQGANRP | | RTQESSCVCVK | |
| QGACWEQLY | | QGACWEQLY | | RDNWQGSNRP | | RTRALVRSGMD | |
| QGAGYAADK | | QGAGYAADK | | RDNWRGANRP | | RTRALVRTGMD | |
| QGALLGTKH | | QGALLGTKH | | RDNWRGSNRP | | RTREGRRKTNL | |
| QGALLGTNH | | QGALLGTNH | | RDNWTGTNRP | | RTREILTKITV | |
| QGALLGTRH | | QGALLGTRH | | RDQGWSYIVE | | RTREILTKTTV | |
| QGALLNDKH | | QGALLNDKH | | RDQKSLRGRG | | RTREILTRTTV | |
| QGALLNDRH | | QGALLNDRH | | RDRTPYRSLI | | RTRGILTKTTV | |
| QGALVGTKH | | QGALVGTKH | | RDSIKSWRNN | | RTRGLFGAIAG | |
| QGANRPIIE | | QGANRPIIE | | RDSITELWSY | | RTSHRTLLMNE | |

Fig. 83-303

| Block size 8 | SIN | Block size 9 | SIN | Block size 10 | SIN | Block size 11 | SIN |
|---|---|---|---|---|---|---|---|
| QGANRPVIE | | QGANRPVIE | | RDSITEVWSY | | RTSISCLYKLS | |
| QGANRPVIK | | QGANRPVIK | | RDSLEPGTFD | | RTSIWTSSSSM | |
| QGDIVLVMK | | QGDIVLVMK | | RDSLTEIWSY | | RTSIWTSSSST | |
| QGDNENATA | | QGDNENATA | | RDSMTEIWSY | | RTSYRSLIRFP | |
| QGDVVLVMK | | QGDVVLVMK | | RDSMTEVWSY | | RTTNTYRNTDS | |
| QGEGIAADY | | QGEGIAADY | | RDSRSGYETF | | RTTSKDSRSGY | |
| QGEGTAADY | | QGEGTAADY | | RDSSILTDSQ | | RTTVDHMAIIK | |
| QGFAPFSKD | | QGFAPFSKD | | RDSTQKAIDI | | RTVGQCPKYVK | |
| QGFFPFHKD | | QGFFPFHKD | | RDSTQKAIDN | | RTVGQCPKYVN | |
| QGGHIEECS | | QGGHIEECS | | RDSTQMAIDN | | RTVGQCPKYVS | |
| QGIGQAADY | | QGIGQAADY | | RDSTQRAIDN | | RTVSSFYSEMK | |
| QGKTKATKM | | QGKTKATKM | | RDSVTELWSY | | RTWAKNILRTQ | |
| QGLIDGWYG | | QGLIDGWYG | | RDVLVIWGIH | | RTYNNTTGRDV | |
| QGLVDGWYG | | QGLVDGWYG | | RDVLVLWGIH | | RVARCNTKCQT | |
| QGMGMAADK | | QGMGMAADK | | RDVLVMWGIH | | RVAYERMCNIL | |
| QGMIDGWYG | | QGMIDGWYG | | RDVLVMWGLH | | RVDDAVTDIWS | |
| QGMVDGWYG | | QGMVDGWYG | | RDWSKPQCQI | | RVDDAVTDVWS | |
| QGNGCFEIF | | QGNGCFEIF | | RDYEELKHLM | | RVDKLTQGRQT | |
| QGNILLSPE | | QGNILLSPE | | RECFNPCFYV | | RVDNHSMSDIE | |
| QGNNDNATA | | QGNNDNATA | | REDKRYGPAL | | RVDRLTQGRQT | |
| QGNNENATA | | QGNNENATA | | REEALLNRIN | | RVDTIIESNVT | |
| QGNNKNATA | | QGNNKNATA | | REEALLNRLN | | RVDTIMEKNVT | |
| QGNNNNATA | | QGNNNNATA | | REEALLNRLS | | RVECIGWSSTS | |
| QGNSVWAGR | | QGNSVWAGR | | REEAMQNRIQ | | RVENLNKKMED | |
| QGNVLLSPE | | QGNVLLSPE | | REESLLNRLS | | RVFLAMITYIT | |
| QGQGTAADY | | QGQGTAADY | | REESQLKKQE | | RVFLTMITYIT | |
| QGQIIVLNT | | QGQIIVLNT | | REESQLKRQE | | RVGCVILLNPF | |
| QGQTIVLNT | | QGQTIVLNT | | REFEVMNHEF | | RVGSRGHVFVI | |
| QGQTIVSNT | | QGQTIVSNT | | REFEVVDHEF | | RVKKQLRENAE | |
| QGQTVVLNT | | QGQTVVLNT | | REFEVVNHEF | | RVKMFDFIKWN | |
| QGRGLFGAI | | QGRGLFGAI | | REFGVVNHEF | | RVKMFDFSKWN | |
| QGRGLFGAK | | QGRGLFGAK | | REGKHIVERI | | RVKMFDFTKWN | |
| QGRGVFEFS | | QGRGVFEFS | | REGLILEYYF | | RVKRQLRENAE | |
| QGRGVFELS | | QGRGVFELS | | REGRNPGNAE | | RVKRRPVAKAG | |
| QGRLCNPLN | | QGRLCNPLN | | REGRRKTNLY | | RVRHQLRENAE | |
| QGRLCNPMN | | QGRLCNPMN | | REGYSLVGID | | RVRKQLRENAE | |
| QGRMDYYWA | | QGRMDYYWA | | REHLSSVSSF | | RVRKQLRQNAE | |
| QGRMDYYWG | | QGRMDYYWG | | REIHIYYLEK | | RVRLFDYSRWN | |
| QGRQTFDWT | | QGRQTFDWT | | REILTKITVD | | RVRLQLRDNAK | |
| QGRQTYDWT | | QGRQTYDWT | | REILTKTTVD | | RVRMQLRDNAK | |
| QGSARHIEE | | QGSARHIEE | | REILTRTTVD | | RVRNGTYDHKE | |
| QGSFYRNMR | | QGSFYRNMR | | REITFHGAKE | | RVRNQSGRISI | |
| QGSFYRSIR | | QGSFYRSIR | | REITFYGAKE | | RVRRQLRENAE | |
| QGSFYRSMR | | QGSFYRSMR | | REKDMTKEFF | | RVSAGGDIWVT | |
| QGSGYAADK | | QGSGYAADK | | RELCTINSWH | | RVSFYWTIVEP | |
| QGSGYAADL | | QGSGYAADL | | RELGNGCFEF | | RVTVSTRSDQI | |
| QGSGYAADQ | | QGSGYAADQ | | RELVRKTRFL | | RVWWTSNSIAV | |
| QGSGYAADR | | QGSGYAADR | | RELWQCYYLL | | RVWWTSNSIIV | |
| QGSLKLATG | | QGSLKLATG | | REMTFHGAKE | | RVWWTSNSIVA | |
| QGSLLNDKH | | QGSLLNDKH | | RENAEDIGNG | | RVWWTSNSIVS | |
| QGSLLNDRH | | QGSLLNDRH | | RENAEDKGNG | | RVWWTSNSIVV | |
| QGSLMLATG | | QGSLMLATG | | RENAEDMGDG | | RVWWTTNSIVV | |
| QGSLRLATG | | QGSLRLATG | | RENAEDMGGG | | RWALGENMAPE | |
| QGSNRPVIQ | | QGSNRPVIQ | | RENAEDMGNG | | RWETTGRNCTV | |
| QGSNRPVIR | | QGSNRPVIR | | RENAEDQGNG | | RWKHVTNTILL | |
| QGSNRPWIR | | QGSNRPWIR | | RENAEDRGNG | | RWLTLKLGQFP | |
| QGSTLPRRS | | QGSTLPRRS | | RENAEEDCTG | | RWLTLKSEQFP | |
| QGSYNNTSG | | QGSYNNTSG | | RENAEEDGNG | | RWLTLKSGQFP | |
| QGTAADYKS | | QGTAADYKS | | RENAEEDGTA | | RWMKIIRVGCV | |
| QGTCWEQLY | | QGTCWEQLY | | RENAEEDGTG | | RWPGLVAGWYG | |
| QGTCWEQMY | | QGTCWEQMY | | RENAEEMGNG | | RYELEIGARIG | |
| QGTGIAADK | | QGTGIAADK | | REPFISCSHF | | RYELEIGTRIG | |

Fig. 83-304

| Block size 8 | SIN | Block size 9 | SIN | Block size 10 | SIN | Block size 11 | SIN |
|---|---|---|---|---|---|---|---|
| QGTGIAAEK | | QGTGIAAEK | | REPFISCSHL | | RYERVKMFDFT | |
| QGTGQAADY | | QGTGQAADY | | REPFISCSHM | | RYGDGVWIGRT | |
| QGTKRSHEQ | | QGTKRSHEQ | | REPFISCSHS | | RYGFVANFSME | |
| QGTKRSYEQ | | QGTKRSYEQ | | REPFISCSPL | | RYGNGVWIGRT | |
| QGTMDYYWG | | QGTMDYYWG | | REPFISCSQL | | RYGPALSINEL | |
| QGTSVWAGR | | QGTSVWAGR | | REPFVACGPA | | RYGPALSISEL | |
| QGTTIRGKH | | QGTTIRGKH | | REPFVACGPS | | RYGVKGFSFRY | |
| QGTTIRGRH | | QGTTIRGRH | | REPFVACGPT | | RYGYIIEEYGK | |
| QGTTIRNKH | | QGTTIRNKH | | REPFVACSPS | | RYGYIIEEYGR | |
| QGTTIRNRH | | QGTTIRNRH | | REPFVSCGPS | | RYGYIIEKYGS | |
| QGTTLDNEH | | QGTTLDNEH | | REPFVSCSHL | | RYGYIIEKYGT | |
| QGTTLDNKH | | QGTTLDNKH | | REPYVSCDPD | | RYICSGLVGDT | |
| QGTTLENKH | | QGTTLENKH | | REPYVSCDPI | | RYIPSGSLKLA | |
| QGTTLKGRH | | QGTTLKGRH | | REPYVSCDPK | | RYNGQRSWMKI | |
| QGTTLNNKH | | QGTTLNNKH | | REPYVSCDPL | | RYPDVRCVCRD | |
| QGTTLRGQH | | QGTTLRGQH | | REPYVSCDPN | | RYPNVRCVCRD | |
| QGTTLRGRH | | QGTTLRGRH | | REPYVSCDPS | | RYREEAMQNRI | |
| QGTTLYNKH | | QGTTLYNKH | | REPYVSCDPT | | RYSGFVRTLFQ | |
| QGVGIAADK | | QGVGIAADK | | REPYVSCEPD | | RYSGIKTDGAT | |
| QGVGMAADK | | QGVGMAADK | | REQKQEFKMN | | RYSGIRTDGAT | |
| QGVKGWAFD | | QGVKGWAFD | | REQLSQKFEE | | RYSIADKICIG | |
| QGVKLAQGY | | QGVKLAQGY | | REQLSSVSSF | | RYSKADKICIG | |
| QGVKLIQGY | | QGVKLIQGY | | REQLSTVSSF | | RYSRADKICIG | |
| QGVKLTQGY | | QGVKLTQGY | | REQQGRMDYY | | RYTYRCHKGDT | |
| QGVLLGTKH | | QGVLLGTKH | | REREGGRRRK | | RYTYRCHRGDM | |
| QGVRLTQGY | | QGVRLTQGY | | RERLGSWSWH | | RYTYRCHRGDT | |
| QGWMDYYWG | | QGWMDYYWG | | RESGGIDKEP | | RYVCSGLVGDT | |
| QGWSYIVER | | QGWSYIVER | | RESGGIDKES | | RYVCTGILTDT | |
| QGYGVKGFG | | QGYGVKGFG | | RESRNPGNAE | | RYVEDTKIDLW | |
| QGYKDIILW | | QGYKDIILW | | RETRGLFGAI | | RYVKQGSLKLA | |
| QHANGTIHD | | QHANGTIHD | | REVEVVNATE | | RYVKQSSLPLA | |
| QHIEECSCY | | QHIEECSCY | | REVHIYYLEK | | RYWAIRTRSGG | |
| QHIIDLADS | | QHIIDLADS | | REVHMYYLEK | | SAASYKRIRLF | |
| QHIIDVTDS | | QHIIDVTDS | | REVHTYYLEK | | SAASYKRVRLF | |
| QHKSHRQMV | | QHKSHRQMV | | REVHVYYLEK | | SACKRTVSSFY | |
| QHLEECSCY | | QHLEECSCY | | REWSYIVERP | | SACLRGGRNSF | |
| QHPELTGLD | | QHPELTGLD | | REWSYIVERT | | SACYNPCFYVE | |
| QHPELTGLN | | QHPELTGLN | | REWSYLIEDP | | SADGDIWVTRE | |
| QHPELTGMD | | QHPELTGMD | | RFADQELGDA | | SADHRIYWIRE | |
| QHPELTGMN | | QHPELTGMN | | RFEAVAWSAT | | SADHRVYWIRE | |
| QHPELTGVD | | QHPELTGVD | | RFEGWIVGNP | | SADMSIGITVI | |
| QHPEMTGLD | | QHPEMTGLD | | RFEIIEGRDR | | SADMSIGVAVI | |
| QHQNAEGIG | | QHQNAEGIG | | RFESVAWSAS | | SADMSIGVTVI | |
| QHQNEQGMG | | QHQNEQGMG | | RFESVAWSAT | | SADPLASLLEM | |
| QHQNEQGTG | | QHQNEQGTG | | RFGEGEQIIV | | SADPLLSLLEM | |
| QHQNEQGVG | | QHQNEQGVG | | RFGESEQIIV | | SADPLVSLLEM | |
| QHQNSEGTG | | QHQNSEGTG | | RFGESEQIVV | | SAEHIEECSCY | |
| QHRNDEGTG | | QHRNDEGTG | | RFGESEQIVI | | SAFDERRNKYL | |
| QHRNEEGTG | | QHRNEEGTG | | RFIEIGVTRR | | SAFDERRNRYL | |
| QHRSHRQMA | | QHRSHRQMA | | RFIEKTNQQF | | SAGALASCMGL | |
| QHRSHRQMV | | QHRSHRQMV | | RFIQNALNGN | | SAGGAIWVTRE | |
| QHTIDLADS | | QHTIDLADS | | RFLEIGVTRR | | SAGGDIWATRE | |
| QHTIDLAES | | QHTIDLAES | | RFLFSSIKKY | | SAGGDIWITRE | |
| QHTIDLTDA | | QHTIDLTDA | | RFLPDLYDYK | | SAGGDIWVMRE | |
| QHTIDLTDS | | QHTIDLTDS | | RFLPVAGGTG | | SAGGDIWVTRE | |
| QHTIDLTNS | | QHTIDLTNS | | RFLPVAGGTS | | SAGGDIWVTRK | |
| QHTIDMADS | | QHTIDMADS | | RFLPVSGGTS | | SAGGDIWVTRV | |
| QHTIDMTDS | | QHTIDMTDS | | RFLPVTGGTS | | SAGGHIWVTRE | |
| QHTIDSTDS | | QHTIDSTDS | | RFLRVKDQQG | | SAGGNIWITRE | |
| QHTIDVTDS | | QHTIDVTDS | | RFLRVRDQLG | | SAGKDPKKTGG | |
| QHTIHLTDS | | QHTIHLTDS | | RFLRVRDQMG | | SAGRDPKKTGG | |
| | | | | RFLRVRDQQG | | SAHHRVYWIRE | |

Fig. 83-305

| Block size 8 | SIN | Block size 9 | SIN | Block size 10 | SIN | Block size 11 | SIN |
|---|---|---|---|---|---|---|---|
| QHVEECSCY | | QHVEECSCY | | RFLRVRDQRG | | SAIDQITGKLN | |
| QIADAQHRS | | QIADAQHRS | | RFNSDLDYQI | | SAIDQITRKLN | |
| QIADSHHRS | | QIADSHHRS | | RFNSDPDYQI | | SAIDQVTGKLN | |
| QIADSQHKS | | QIADSQHKS | | RFNSNLDYQI | | SAINQITGKLN | |
| QIADSQHRS | | QIADSQHRS | | RFQIQGIKLT | | SAKELVETNHT | |
| QIAILAATV | | QIAILAATV | | RFQIQGVKLA | | SAKHIEECSCY | |
| QIAILATTI | | QIAILATTI | | RFQIQGVKLI | | SAKHVEECSCY | |
| QIAILATTV | | QIAILATTV | | RFQIQGVKLT | | SALGSPGCDHL | |
| QIAILVTTV | | QIAILVTTV | | RFQIQGVRLT | | SALILRGAVAH | |
| QICIGHHAN | | QICIGHHAN | | RFRRPDSSWL | | SALILRGSIAH | |
| QICIGYHAN | | QICIGYHAN | | RFSYVFCLAL | | SALILRGSVAH | |
| QICIGYHSN | | QICIGYHSN | | RFTEIGVTRR | | SAPEGMCYPGF | |
| QICVGYHAN | | QICVGYHAN | | RFTNEEALRQ | | SAPEGMCYPGS | |
| QICVGYHSN | | QICVGYHSN | | RFTYSGIRTN | | SAPGVKGFGFL | |
| QIDESCEGE | | QIDESCEGE | | RFVEIGVTRR | | SAPHGLCYPGE | |
| QIDPVKLSG | | QIDPVKLSG | | RFVFSIAASY | | SAPHRLCYPGE | |
| QIDPVKLSS | | QIDPVKLSS | | RFVFSNAASY | | SAQATEECSRY | |
| QIDQVKLSS | | QIDQVKLSS | | RFVFSSAASY | | SAQHIEECSCY | |
| QIDSVKLSS | | QIDSVKLSS | | RFVQNALNGN | | SAQHIEGCSCY | |
| QIDTIMEKN | | QIDTIMEKN | | RFVQNALSGN | | SAQHVEECSCY | |
| QIEARGLFG | | QIEARGLFG | | RFYALSQGTT | | SARHIEECSCY | |
| QIEDLWAYN | | QIEDLWAYN | | RFYIQMCTEL | | SARHIEEWSCY | |
| QIEELWAYN | | QIEELWAYN | | RFYRICKLVG | | SARHVEECSCY | |
| QIEGLWAYN | | QIEGLWAYN | | RFYRTCKLLG | | SARQEKNPALR | |
| QIEKEFEQV | | QIEKEFEQV | | RFYRTCKLVG | | SARSALILRGS | |
| QIEKEFGQV | | QIEKEFGQV | | RFYVQMCTEL | | SASACHDGASW | |
| QIEKEFSEI | | QIEKEFSEI | | RGANRPVITI | | SASACHDGISW | |
| QIEKEFSEV | | QIEKEFSEV | | RGAYERMCNI | | SASACHDGSSW | |
| QIENLWAYN | | QIENLWAYN | | RGCFEIYHKC | | SASACHDGTNW | |
| QIEPRGLFG | | QIEPRGLFG | | RGDKICLGHH | | SASACHDGTSW | |
| QIESIIEAE | | QIESIIEAE | | RGDLNFVNRA | | SASALILRGSV | |
| QIESMIEAE | | QIESMIEAE | | RGDQICIGYH | | SASCHDGRAWL | |
| QIESMVEAE | | QIESMVEAE | | RGDQICVGYH | | SASGDIWITRE | |
| QIESRGLFG | | QIESRGLFG | | RGDYNNTTGR | | SASGKADTRIL | |
| QIEVTNATE | | QIEVTNATE | | RGEDTIEERF | | SASGRADTKIL | |
| QIGNVINWT | | QIGNVINWT | | RGEETIEEKF | | SASGRADTRIL | |
| QIGYICSGV | | QIGYICSGV | | RGEETIEERF | | SASSISFCGVN | |
| QIGYVCSGI | | QIGYVCSGI | | RGEETVEERF | | SASTGGQSFYR | |
| QIGYVCSGV | | QIGYVCSGV | | RGEFNQVEKR | | SATACHDGKEW | |
| QIIDIWAYN | | QIIDIWAYN | | RGEFNQVENR | | SATACHDGKGW | |
| QIIKLLPFA | | QIIKLLPFA | | RGEFNQVEQR | | SATACHDGKKW | |
| QIIRESGGI | | QIIRESGGI | | RGEFSQVEQR | | SATACHDGRKW | |
| QIIRRSGGI | | QIIRRSGGI | | RGEFSQVERR | | SATACSDGPGW | |
| QIISLCSIW | | QIISLCSIW | | RGEKANVLIG | | SATACSDGSGW | |
| QIIVDNNNW | | QIIVDNNNW | | RGETLKIRTN | | SATGPADTRIY | |
| QIIVILVLG | | QIIVILVLG | | RGETTGRNCT | | SATGPADTRVY | |
| QIIVLNTDW | | QIIVLNTDW | | RGEVFVIREP | | SATGPAETRIY | |
| QIIVTREPY | | QIIVTREPY | | RGFAPFSKDN | | SATGPAETRVY | |
| QIKIRRRVD | | QIKIRRRVD | | RGFEMVWDAN | | SAVDQITGKLN | |
| QILAIYATV | | QILAIYATV | | RGFFGAIAGF | | SAVLRGFLIIG | |
| QILAIYSTA | | QILAIYSTA | | RGFFPFHKDN | | SAVLRGFLILG | |
| QILAIYSTV | | QILAIYSTV | | RGFLIIGKED | | SAVNQITGKLN | |
| QILRESGGI | | QILRESGGI | | RGFLILGKED | | SAYCNTDLGAP | |
| QILRGSGGI | | QILRGSGGI | | RGFLILGKEN | | SAYERMCNILK | |
| QILRGSGGV | | QILRGSGGV | | RGFLILGRED | | SCAAMDDFQLI | |
| QILRKSGGI | | QILRKSGGI | | RGFVHFVEAL | | SCAAMDDYQLI | |
| QILRRSGGI | | QILRRSGGI | | RGFVYFVEAL | | SCAAMDEFQLI | |
| QILRTQESE | | QILRTQESE | | RGFVYFVEIL | | SCAAMEDFQLI | |
| QILRTQESS | | QILRTQESS | | RGFVYFVETL | | SCASNINIREW | |
| QILSIYSTA | | QILSIYSTA | | RGGRNSFFSR | | SCATNINIREW | |
| QILSIYSTV | | QILSIYSTV | | RGGSGIMKTE | | SCAVVMTDGSA | |
| QILSLYSTV | | QILSLYSTV | | RGGSINTKLP | | SCDPDECRFYA | |

Fig. 83-306

| Block size 8 | SIN | Block size 9 | SIN | Block size 10 | SIN | Block size 11 | SIN |
|---|---|---|---|---|---|---|---|
| QINGKLNRL | | QINGKLNRL | | RGGSINTRLP | | SCDPDGCRFYA | |
| QINGQSGRI | | QINGQSGRI | | RGHIFVIREP | | SCDPIGCKMYA | |
| QIQDIWAYN | | QIQDIWAYN | | RGHVFVIREP | | SCDPLGCKMYA | |
| QIQDLWAYN | | QIQDLWAYN | | RGHYKISKST | | SCDPLGCRMYA | |
| QIQDVWAYN | | QIQDVWAYN | | RGIEVVNATE | | SCDPNECRFYA | |
| QIQGIKLTQ | | QIQGIKLTQ | | RGIFGAIAGF | | SCDPSGCKMYA | |
| QIQGVKLAQ | | QIQGVKLAQ | | RGILEDEQMY | | SCDPTGCKMYA | |
| QIQGVKLIQ | | QIQGVKLIQ | | RGINDRNFWR | | SCDSPSNINGE | |
| QIQGVKLTQ | | QIQGVKLTQ | | RGIPPLELGD | | SCDSPSNINGG | |
| QIQGVRLTQ | | QIQGVRLTQ | | RGIQIASNEN | | SCDSPSNVKGG | |
| QIQNIWAYN | | QIQNIWAYN | | RGKHSNGTIH | | SCDSPSNVNGG | |
| QIQNRGLFG | | QIQNRGLFG | | RGKLKRRAIA | | SCEGECFYSGG | |
| QIQTKRSFE | | QIQTKRSFE | | RGLCKINSWH | | SCEPDECRFYA | |
| QIQTRRAFE | | QIQTRRAFE | | RGLCTINSWH | | SCFDGKEWLHV | |
| QIQTRRSFE | | QIQTRRSFE | | RGLFGAIAGF | | SCFDGKEWMHI | |
| QIRGFVHFV | | QIRGFVHFV | | RGLFGAKAGF | | SCFDGKEWMHV | |
| QIRGFVYFV | | QIRGFVYFV | | RGLISTPLGS | | SCFDGREWMHV | |
| QISIVPNIG | | QISIVPNIG | | RGLISTPLGT | | SCFTIMTDGPN | |
| QITDIWAYN | | QITDIWAYN | | RGLLEVGTRW | | SCFTIMTDGPS | |
| QITFLQALQ | | QITFLQALQ | | RGLLGAIAGF | | SCFTVLTDGPS | |
| QITFMQALQ | | QITFMQALQ | | RGLMSTPLGT | | SCFTVMTDGPS | |
| QITGFAPFS | | QITGFAPFS | | RGLQRRRFIQ | | SCFVFVALILG | |
| QITGKLNHL | | QITGKLNHL | | RGLQRRRFVQ | | SCGILGTIIGP | |
| QITGKLNRI | | QITGKLNRI | | RGLSSRISFY | | SCGPSECRTFF | |
| QITGKLNRL | | QITGKLNRL | | RGLWDPFRQS | | SCHDGIGRMTI | |
| QITNGTTGN | | QITNGTTGN | | RGLWDSFRQS | | SCHDGKAWLHI | |
| QITRKLNRL | | QITRKLNRL | | RGNGCFEIFH | | SCHDGKAWLHV | |
| QITSLCSIW | | QITSLCSIW | | RGNILLSPEE | | SCHDGKSWLHV | |
| QITTKINNI | | QITTKINNI | | RGNIRCNICI | | SCHDGRAWLHV | |
| QIVVTREPY | | QIVVTREPY | | RGNPGVKGWA | | SCHDGVGRMTI | |
| QKAIDEITT | | QKAIDEITT | | RGNQGVKGWA | | SCHIGVAPSPS | |
| QKAIDGITN | | QKAIDGITN | | RGNSPAFNYN | | SCIASSIVLVG | |
| QKAIDGVTN | | QKAIDGVTN | | RGNSPIFNYN | | SCIASSIVMVG | |
| QKAIDIMQN | | QKAIDIMQN | | RGNSPVFNYN | | SCIASSLILAA | |
| QKAIDNMQN | | QKAIDNMQN | | RGNVLLSPEE | | SCIASSLVLAA | |
| QKAIDQITT | | QKAIDQITT | | RGQAADLKST | | SCIASSTVLVG | |
| QKAIDRITT | | QKAIDRITT | | RGQHANGTIH | | SCIASSTVMVG | |
| QKAINEITT | | QKAINEITT | | RGQPKEKAIW | | SCIASSVVLVG | |
| QKAINGVTN | | QKAINGVTN | | RGQPKEKTIW | | SCIESIRNGTY | |
| QKALNEITT | | QKALNEITT | | RGQPKERTIW | | SCINRCFYVEL | |
| QKAMMDQVR | | QKAMMDQVR | | RGQQGRMDYY | | SCINRCFYVES | |
| QKAQGEGTA | | QKAQGEGTA | | RGQQGTMDYY | | SCKMYALHQGT | |
| QKCCNLFEK | | QKCCNLFEK | | RGQQGWMDYY | | SCLPACAYGPA | |
| QKCCSLFEK | | QKCCSLFEK | | RGQSGRISFY | | SCLPACIYGLV | |
| QKCCTLFEK | | QKCCTLFEK | | RGQSGRVSFY | | SCLPACVYGLA | |
| QKFEEIKWL | | QKFEEIKWL | | RGRGSTLGLD | | SCLPACVYGLV | |
| QKFEEIRWL | | QKFEEIRWL | | RGRGVFELSD | | SCLPACVYGPA | |
| QKFEEIRWM | | QKFEEIRWM | | RGRHANGTIH | | SCMDTIRNGTY | |
| QKFEEMRWL | | QKFEEMRWL | | RGRHANGTIN | | SCMEAIRNGTY | |
| QKFEEVRWL | | QKFEEVRWL | | RGRHANGTMH | | SCMERIRNNTY | |
| QKGNIKCNI | | QKGNIKCNI | | RGRHSNGTIH | | SCMESIRNNTY | |
| QKGNIRCDI | | QKGNIRCDI | | RGRIFQSRIR | | SCMETIRNGTY | |
| QKGNIRCNI | | QKGNIRCNI | | RGRLCNPLNP | | SCMGLIYNRMG | |
| QKIITIDSV | | QKIITIDSV | | RGRPEEAKYV | | SCPIGEAPSPY | |
| QKIITIGSA | | QKIITIGSA | | RGRPEEVKYV | | SCPIGEVPSPY | |
| QKIITIGSI | | QKIITIGSI | | RGRPKEDEVW | | SCPIGVAPSPS | |
| QKIITIGSM | | QKIITIGSM | | RGRPKEDKVW | | SCPLGEAPSPY | |
| QKIITIGSV | | QKIITIGSV | | RGRPKEDRVW | | SCPMGVAPSPS | |
| QKIITMGSV | | QKIITMGSV | | RGRPKEEKVW | | SCPVGEAPSPY | |
| QKILCASAT | | QKILCASAT | | RGSARHIEEC | | SCPVGVAPSPS | |
| QKILCTSAI | | QKILCTSAI | | RGSFYRSMRW | | SCSHLECRTFF | |
| QKILCTSAT | | QKILCTSAT | | RGSGLRILIR | | SCSHLECRTFS | |

Fig. 83-307

| Block size 8 | SIN | Block size 9 | SIN | Block size 10 | SIN | Block size 11 | SIN |
|---|---|---|---|---|---|---|---|
| QKILDEHDS | | QKILDEHDS | | RGSGLRILVR | | SCSHMECRTFF | |
| QKILFASAT | | QKILFASAT | | RGSGMRILIR | | SCSHSECRTFF | |
| QKIMESGEI | | QKIMESGEI | | RGSGMRILVR | | SCSIDECRTFF | |
| QKIMESGGI | | QKIMESGGI | | RGSIAHKSCL | | SCSIHECRTFF | |
| QKIMESGGV | | QKIMESGGV | | RGSNRPIVDI | | SCSINECRTFF | |
| QKINGVKLE | | QKINGVKLE | | RGSNRPWIRF | | SCSISECRTFF | |
| QKISGVKLE | | QKISGVKLE | | RGSNRPWVRF | | SCSSPSGIEGR | |
| QKITCVCRD | | QKITCVCRD | | RGSPGVKGWA | | SCSVSECRTFF | |
| QKKDKRYGP | | QKKDKRYGP | | RGSSGIMKTE | | SCSYLECRTFF | |
| QKLEDVFAG | | QKLEDVFAG | | RGSSGIMKTG | | SCTSPCLTDKG | |
| QKLFALSGV | | QKLFALSGV | | RGSSGVMKTE | | SCTVVMTDGNA | |
| QKLFASSGI | | QKLFASSGI | | RGSTLGLDIR | | SCTVVMTDGSA | |
| QKLFTLSGV | | QKLFTLSGV | | RGSTQKAIDN | | SCVCRDNWQGA | |
| QKQEFKMNP | | QKQEFKMNP | | RGSVAHKSCL | | SCVMLLAIAMG | |
| QKQEIKMNP | | QKQEIKMNP | | RGSYNNTSGE | | SCVNRCFYVEL | |
| QKQMTRGLF | | QKQMTRGLF | | RGTGMRILVR | | SCYDGKAWLHI | |
| QKRGLFGAI | | QKRGLFGAI | | RGTIVSSLPF | | SCYDGKAWLHV | |
| QKRMGLQMQ | | QKRMGLQMQ | | RGTNSFYRNL | | SCYPNDGKVEC | |
| QKRMGVQIQ | | QKRMGVQIQ | | RGTQGVKGWA | | SCYPNEGKVEC | |
| QKRMGVQLQ | | QKRMGVQLQ | | RGVEVVDATE | | SCYPNLGIVEC | |
| QKRMGVQMH | | QKRMGVQMH | | RGVEVVNATE | | SCYPNLGKVEC | |
| QKRMGVQMQ | | QKRMGVQMQ | | RGVFEFSDER | | SCYPNLGQVEC | |
| QKRMTRGLF | | QKRMTRGLF | | RGVFELSDEK | | SCYPNMGKVEC | |
| QKSLIWLWL | | QKSLIWLWL | | RGVFELSDER | | SCYPNNGKVEC | |
| QKSLLLATG | | QKSLLLATG | | RGVLEDEQMY | | SCYPNSGKVEC | |
| QKSLRGRGS | | QKSLRGRGS | | RGVNDRNFWR | | SCYPQYPNVRC | |
| QKSTQEAID | | QKSTQEAID | | RGVQIASNEN | | SCYPRYPDVRC | |
| QKSTQEAIE | | QKSTQEAIE | | RGVQVASNEN | | SCYPRYPGVRC | |
| QKSTQEAIG | | QKSTQEAIG | | RGWAPLSKDN | | SCYPRYPNVRC | |
| QKSTQEAIN | | QKSTQEAIN | | RGYKMNIQIL | | SCYSRYPNVRC | |
| QKSWMKIYW | | QKSWMKIYW | | RGYKMNNQIL | | SDAPFLDRLRR | |
| QKSWTKIYW | | QKSWTKIYW | | RGYKMNTKIL | | SDAQAFYKILK | |
| QKTIDQVTG | | QKTIDQVTG | | RGYKMNTQIL | | SDAQAFYKLLK | |
| QKTITIGSV | | QKTITIGSV | | RGYKMNTRIL | | SDAQIDESCEG | |
| QKTLDEHDA | | QKTLDEHDA | | RGYPGVKGWA | | SDDFALILNAP | |
| QKTLDEHDS | | QKTLDEHDS | | RHANGTIHDR | | SDDFALIVNAL | |
| QKTLDEHDT | | QKTLDEHDT | | RHANGTINDR | | SDDFALIVNAP | |
| QKTLDEHEA | | QKTLDEHEA | | RHANGTMHDR | | SDDFALIVNAS | |
| QKTLDEHVA | | QKTLDEHVA | | RHCSKYHWNL | | SDDNVYKALSI | |
| QKTLDKHDS | | QKTLDKHDS | | RHENRMVIAS | | SDDSVYKALSI | |
| QKTLKLATG | | QKTLKLATG | | RHENRMVLAS | | SDEALKMTIAS | |
| QKVNGVKLE | | QKVNGVKLE | | RHFQKDAKIL | | SDFICVGWSST | |
| QKVPVTQTM | | QKVPVTQTM | | RHFQKDAKML | | SDFLCVGWSST | |
| QKVTCVCRD | | QKVTCVCRD | | RHFQKDAKVL | | SDFMCVGWSST | |
| QKWSGYSGA | | QKWSGYSGA | | RHFQKDARVL | | SDGGPNLYNIR | |
| QKWWVWLWL | | QKWWVWLWL | | RHFQKNAKVL | | SDGPGWLTIGI | |
| QLEGFSAES | | QLEGFSAES | | RHHMGECPKY | | SDGPGWLTLGI | |
| QLFIKDYRY | | QLFIKDYRY | | RHHNSEGTGQ | | SDGSGWLTLGI | |
| QLFLVCVSL | | QLFLVCVSL | | RHIEECPCYG | | SDHICIGYHAN | |
| QLGNVINWT | | QLGNVINWT | | RHIEECSCYG | | SDICYPGKFTN | |
| QLGSWSWHD | | QLGSWSWHD | | RHIEEWSCYG | | SDICYPGRFTN | |
| QLIPMISKC | | QLIPMISKC | | RHLEECSCYV | | SDIEAMASQGT | |
| QLIWMACHS | | QLIWMACHS | | RHLFSGIKSF | | SDIEIMASQGT | |
| QLKDNAKEL | | QLKDNAKEL | | RHLFSGIRSF | | SDIGAMASQGT | |
| QLKDNAKEV | | QLKDNAKEV | | RHLFSGVNSF | | SDILVTREPYV | |
| QLKDNAREL | | QLKDNAREL | | RHQLRENAED | | SDINIMASQGT | |
| QLKKQEIEG | | QLKKQEIEG | | RHQNAEGTGT | | SDKICIGYHAN | |
| QLKLATGLK | | QLKLATGLK | | RHQNAQGEGI | | SDKICLGHHAV | |
| QLKLATGLR | | QLKLATGLR | | RHQNAQGEGT | | SDKLYIWGVHH | |
| QLKRQEIEG | | QLKRQEIEG | | RHQNAQGIGQ | | SDKPFQNVSRI | |
| QLLFEVEQE | | QLLFEVEQE | | RHQNAQGQGT | | SDKRIGSCTSP | |
| QLLLEVENE | | QLLLEVENE | | RHQNAQGTGQ | | SDLDYQIGYIC | |

Fig. 83-308

| Block size 8 | SIN | Block size 9 | SIN | Block size 10 | SIN | Block size 11 | SIN |
|---|---|---|---|---|---|---|---|
| QLLLEVEQE | | QLLLEVEQE | | RHQNSEGIGQ | | SDLDYQIGYVC | |
| QLLLEVESE | | QLLLEVESE | | RHQNSEGMGQ | | SDLEALMEWLK | |
| QLLRHFQKD | | QLLRHFQKD | | RHQNSEGRGQ | | SDLNYQIGYIC | |
| QLLVLLENE | | QLLVLLENE | | RHQNSEGTGQ | | SDNADKICLGH | |
| QLLVWLENE | | QLLVWLENE | | RHQNSEGTGT | | SDNEQTDLYKV | |
| QLNEGIMNT | | QLNEGIMNT | | RHQNSQGEGT | | SDNRSGYSGIF | |
| QLNEGVINT | | QLNEGVINT | | RHQNTQGEGT | | SDQICIGYHAN | |
| QLNEGVMNT | | QLNEGVMNT | | RHRLKITENS | | SDQICVGYHAN | |
| QLNPIDGPL | | QLNPIDGPL | | RHSNGTIHDR | | SDQISIVPNIG | |
| QLNQTYRNN | | QLNQTYRNN | | RHSNGTVKDR | | SDQLKLATGLR | |
| QLNQTYRNT | | QLNQTYRNT | | RHVEECSCYG | | SDRICIGYHAN | |
| QLRDNAKEI | | QLRDNAKEI | | RHYIGKCPKY | | SDRLVLATGLR | |
| QLRDNAKEL | | QLRDNAKEL | | RHYMGECPEY | | SDSIKSWRKDI | |
| QLRDNAKET | | QLRDNAKET | | RHYMGECPKY | | SDSSFYAEMKW | |
| QLRDNVKEL | | QLRDNVKEL | | RHYMGECPNY | | SDTPRGEDAQF | |
| QLRENAEDI | | QLRENAEDI | | RIAIGNCPKY | | SDTPRGEDGQF | |
| QLRENAEDK | | QLRENAEDK | | RIAWSSSSCF | | SDTPRGEDNQF | |
| QLRENAEDM | | QLRENAEDM | | RIAYERMCNI | | SDTPRGEDSQF | |
| QLRENAEDQ | | QLRENAEDQ | | RICEKLEQSG | | SDTTCWSWPDG | |
| QLRENAEDR | | QLRENAEDR | | RICIDFRDMR | | SDTTGWPWPDG | |
| QLRENAEED | | QLRENAEED | | RICIGYHANN | | SDTTGWSWPDG | |
| QLRENAEEM | | QLRENAEEM | | RICIGYLSTN | | SDTTSWSWPDG | |
| QLRMATGLR | | QLRMATGLR | | RICIGYQSNN | | SDTVDTLTENG | |
| QLRQNAEED | | QLRQNAEED | | RICILDQNFR | | SDVLVTREPYV | |
| QLSAGGDIW | | QLSAGGDIW | | RICKLVGINM | | SDVWLGRTVST | |
| QLSQKFEEI | | QLSQKFEEI | | RICLGHHAVA | | SDWSGYSGSFI | |
| QLSSVSSFE | | QLSSVSSFE | | RICVGYHANN | | SECICINGTCT | |
| QLSSVSSFK | | QLSSVSSFK | | RICVGYLSTN | | SECRTFFLTQG | |
| QLSTVSSFE | | QLSTVSSFE | | RIDARIDFES | | SECVCHKGICP | |
| QLTHHMRKK | | QLTHHMRKK | | RIDARVDFES | | SECVCHKGVCP | |
| QLVWMACHS | | QLVWMACHS | | RIDARVDSES | | SECVCHNGICP | |
| QLVWMACNS | | QLVWMACNS | | RIDDAVTDIW | | SECVCHNGTCA | |
| QLYTPGGEV | | QLYTPGGEV | | RIDDAVTDVW | | SECVCHNGTCG | |
| QMAGSSEQA | | QMAGSSEQA | | RIDFHWMLLD | | SECVCHNGTCV | |
| QMAIDNMQN | | QMAIDNMQN | | RIECIGWSST | | SECVCHNGVCP | |
| QMALQLFIK | | QMALQLFIK | | RIENLNKKID | | SECVCHNSTCV | |
| QMCTELKLN | | QMCTELKLN | | RIENLNKKME | | SECVCHSGICP | |
| QMCTELKLS | | QMCTELKLS | | RIENLNKKVD | | SECVCINGICT | |
| QMCTELQLS | | QMCTELQLS | | RIENLNRKME | | SECVCINGSCA | |
| QMEKIVLLF | | QMEKIVLLF | | RIENLNRKVD | | SECVCINGSCI | |
| QMESRGLFG | | QMESRGLFG | | RIESLNKKME | | SECVCINGSCT | |
| QMETDGDRQ | | QMETDGDRQ | | RIESLNNKVD | | SECVCINGTCA | |
| QMETDGERQ | | QMETDGERQ | | RIEVTNATEL | | SECVCINGTCT | |
| QMETGERQN | | QMETGERQN | | RIFLAMITYI | | SECVCISGTCA | |
| QMETGGERQ | | QMETGGERQ | | RIFQPNIGPR | | SECVCQDEFCY | |
| QMETSGERQ | | QMETSGERQ | | RIFQSGIRMA | | SECVCQNGVCP | |
| QMNGQSGRI | | QMNGQSGRI | | RIFQSGVRLA | | SECVRHNGTCA | |
| QMQRFRRPD | | QMQRFRRPD | | RIFQSGVRMA | | SECVSHNGTWA | |
| QMRDILGTF | | QMRDILGTF | | RIFQSGVRVA | | SECYNPCFYVE | |
| QMRDVLGTF | | QMRDVLGTF | | RIFQSRIRMG | | SEDGVYKALSI | |
| QMTRGLFGA | | QMTRGLFGA | | RIFRPNIGPR | | SEDNVYKALSI | |
| QMYQKCCNL | | QMYQKCCNL | | RIGDGQRSWM | | SEDNVYKVLSI | |
| QMYQKCCSL | | QMYQKCCSL | | RIGEDSDILV | | SEDNVYRALSI | |
| QMYQKCCTL | | QMYQKCCTL | | RIGEDSDVLV | | SEEALRQKIME | |
| QMYQRCCNL | | QMYQRCCNL | | RIGEGQRSWM | | SEECSCYVDID | |
| QMYTPGGEV | | QMYTPGGEV | | RIGEKSDVLV | | SEFICVGWSST | |
| QMYTPGGGV | | QMYTPGGGV | | RIGENSDVLV | | SEFLCVGWSST | |
| QMYTPGGKV | | QMYTPGGKV | | RIGENSGVLV | | SEFNEIEHQIG | |
| QNAEEDGKG | | QNAEEDGKG | | RIGSCTSPCL | | SEFNEIEYQIG | |
| QNAEEDGRG | | QNAEEDGRG | | RIGSKGDIFV | | SEFNKACELTD | |
| QNAEGIGIA | | QNAEGIGIA | | RIGSKGDVFV | | SEFNKACELTG | |
| QNAEGTGIA | | QNAEGTGIA | | RIGSKGHVFV | | SEFSEIEHQIG | |

Fig. 83-309

| Block size 8 | SIN | Block size 9 | SIN | Block size 10 | SIN | Block size 11 | SIN |
|---|---|---|---|---|---|---|---|
| QNAEGTGMA | | QNAEGTGMA | | RIGSRGDVFI | | SEFSEIEHQIS | |
| QNAEGTGTA | | QNAEGTGTA | | RIGSRGDVFV | | SEFSETEHQIG | |
| QNAISTTFP | | QNAISTTFP | | RIGSRGEVFV | | SEGIGQAADLK | |
| QNALNGNGD | | QNALNGNGD | | RIGSRGHIFV | | SEGMGQAADLK | |
| QNALSGNGD | | QNALSGNGD | | RIGSRGHVFV | | SEGRGQAADLK | |
| QNAQGEGIA | | QNAQGEGIA | | RIIEKTNQQF | | SEGTGMAADQK | |
| QNAQGEGTA | | QNAQGEGTA | | RIIQNEDIPI | | SEGTGQAADLK | |
| QNAQGIGQA | | QNAQGIGQA | | RIKINPVTLT | | SEGTGQAGDLK | |
| QNAQGQGTA | | QNAQGQGTA | | RIKTRLFTIR | | SEGTGTAADLK | |
| QNAQGSGYA | | QNAQGSGYA | | RILDFHDSNV | | SEHTAYSQITN | |
| QNAQGTGLA | | QNAQGTGLA | | RILEEESDEA | | SEIEGRIQDLE | |
| QNAQGTGQA | | QNAQGTGQA | | RILRTQESEC | | SEIEHQIGNVI | |
| QNASRHHMG | | QNASRHHMG | | RILSIYSTVA | | SEIEHQISNVI | |
| QNASRHYMG | | QNASRHYMG | | RIMFESNGGL | | SEIEQQIGNVI | |
| QNASRYYMG | | QNASRYYMG | | RIMINPVKLS | | SEKLVLATGLR | |
| QNDVWLGRT | | QNDVWLGRT | | RINGVKLEEN | | SEKLVLATGPR | |
| QNEDIPIEN | | QNEDIPIEN | | RINMIADRVD | | SELGVPFHLGT | |
| QNEDIPIGN | | QNEDIPIGN | | RINMINSKID | | SEMKKLYERVR | |
| QNEDIPIGS | | QNEDIPIGS | | RINMINSKIE | | SEMKWLLSSKA | |
| QNEFNKACE | | QNEFNKACE | | RINMINSKIN | | SEMKWLLSSKD | |
| QNEQGMGMA | | QNEQGMGMA | | RINMINSQID | | SEMKWLSSSGN | |
| QNEQGSGYA | | QNEQGSGYA | | RINMLADRID | | SEMKWLSSSMN | |
| QNEQGTGIA | | QNEQGTGIA | | RINMLADRVD | | SEMLNLYDRVR | |
| QNEQGVGIA | | QNEQGVGIA | | RINMLADWVD | | SEMLNLYERVR | |
| QNEQGVGMA | | QNEQGVGMA | | RINNETILET | | SEMNKLFERVR | |
| QNFPQTANT | | QNFPQTANT | | RINTINSKID | | SEMNKLYEKVR | |
| QNFPQTTNT | | QNFPQTTNT | | RIPHRTLLMN | | SEMNKLYERVK | |
| QNFPRTTNT | | QNFPRTTNT | | RIPHRTLLMS | | SEMNKLYERVR | |
| QNGKSGACK | | QNGKSGACK | | RIQDIWAYNA | | SEMSKLYERVK | |
| QNGKSSACK | | QNGKSSACK | | RIQDLEKYIE | | SEMSKLYERVR | |
| QNGNIRCQI | | QNGNIRCQI | | RIQDLEKYVE | | SEQAAEAIEVA | |
| QNGNIRCTF | | QNGNIRCTF | | RIQDLERYVE | | SEQAAEAMDIA | |
| QNGNIRWPD | | QNGNIRWPD | | RIQHLEECSC | | SEQAAEAMEIA | |
| QNGNLRCQI | | QNGNLRCQI | | RIQIDPVKLS | | SEQAAEAMEVA | |
| QNGNVRCQI | | QNGNVRCQI | | RIQIDQVKLS | | SEQFPVQTDEY | |
| QNGNVRCTF | | QNGNVRCTF | | RIQIDSVKLS | | SEQIIVTREPY | |
| QNGQGSGYA | | QNGQGSGYA | | RIRLFDYSGW | | SEQIVVTREPY | |
| QNGSCRCMF | | QNGSCRCMF | | RIRLFDYSKW | | SEQMETGGERQ | |
| QNGSYRCMF | | QNGSYRCMF | | RIRLFDYSRW | | SEQNVPVTQVE | |
| QNHGICAVA | | QNHGICAVA | | RIRMAINWGR | | SEQVIVTREPY | |
| QNICKPYIG | | QNICKPYIG | | RIRMATNECR | | SERGEDTIEER | |
| QNIDKNALG | | QNIDKNALG | | RISFYWTIVD | | SERGEETIEEK | |
| QNIDRNAIG | | QNIDRNAIG | | RISFYWTIVE | | SERGEETIEER | |
| QNIDRNALG | | QNIDRNALG | | RISFYWTIVK | | SERGEETVEER | |
| QNIDSRAVG | | QNIDSRAVG | | RISHRTLLMN | | SERGLFGAIAG | |
| QNIDSWAVG | | QNIDSWAVG | | RISIYWTLVN | | SERGLQRRRFI | |
| QNIEKNALG | | QNIEKNALG | | RISKMGVDEY | | SERGLQRRRFV | |
| QNIERNALG | | QNIERNALG | | RISKRGSSGI | | SERLVLATGLR | |
| QNIHPATIG | | QNIHPATIG | | RISNETILET | | SESGRLIDFLK | |
| QNIHPITIG | | QNIHPITIG | | RISSSFSFGG | | SESRSNIFNME | |
| QNIHPVTIG | | QNIHPVTIG | | RITFESNGGL | | SESSFYAEMEW | |
| QNIIQIDPV | | QNIIQIDPV | | RITFESSGGL | | SETEHQIGNVI | |
| QNILEKTHN | | QNILEKTHN | | RITTKINNII | | SEVEGRIQDLE | |
| QNILRTQES | | QNILRTQES | | RIWRQANNGD | | SEVEGRIQNLE | |
| QNIPVTQTM | | QNIPVTQTM | | RIWRQANNGE | | SEVPEWSWDDG | |
| QNIPVTQVE | | QNIPVTQVE | | RIWSKPQCQI | | SEVPGWSWDDG | |
| QNISKYAFG | | QNISKYAFG | | RKASLRLAVG | | SEVPGWSWGDG | |
| QNISPVWIG | | QNISPVWIG | | RKDILRTQES | | SEVRGDQMAHC | |
| QNIWAYNAE | | QNIWAYNAE | | RKEPALIVWG | | SEVRRDQMAHC | |
| QNKLNNVID | | QNKLNNVID | | RKEYEEEAKL | | SFAGWILGNPM | |
| QNKLYGAGN | | QNKLYGAGN | | RKGLILEYYS | | SFAGWILGNPR | |
| QNKLYGTGN | | QNKLYGTGN | | RKKILRTQES | | SFALAQGALLG | |

Fig. 83-310

| Block size 8 | SIN | Block size 9 | SIN | Block size 10 | SIN | Block size 11 | SIN |
|---|---|---|---|---|---|---|---|
| QNLFTLSGV | | QNLFTLSGV | | RKKRGLFGAI | | SFALAQGALVG | |
| QNLSPRTVG | | QNLSPRTVG | | RKKRGLFGAK | | SFALAQGTLLG | |
| QNLTKINNG | | QNLTKINNG | | RKLKREITFH | | SFALAQGVLLG | |
| QNLTKTNNG | | QNLTKTNNG | | RKLNRLIEKT | | SFALSQGALLG | |
| QNLTKVNNG | | QNLTKVNNG | | RKMEDGFLDV | | SFEGWIGGNPA | |
| QNLTKVNSG | | QNLTKVNSG | | RKMMTNSQDT | | SFEGWIVGNPA | |
| QNNAIDEGD | | QNNAIDEGD | | RKMMTNSRDT | | SFEGWIVGNPS | |
| QNNFVPVIG | | QNNFVPVIG | | RKMMTSSQDT | | SFEQITFIQAL | |
| QNNFVPVMG | | QNNFVPVMG | | RKQILRTQES | | SFEQITFLQAL | |
| QNNFVPVVG | | QNNFVPVVG | | RKQLRENAED | | SFEQITFMQAL | |
| QNNFVPVVR | | QNNFVPVVR | | RKQLRENAEE | | SFESNGGLLAP | |
| QNNTTLIEN | | QNNTTLIEN | | RKQLRQNAEE | | SFESNGNFIAP | |
| QNNTTVVEN | | QNNTTVVEN | | RKRDSSILTD | | SFESTGNLIAP | |
| QNPRIFLAM | | QNPRIFLAM | | RKRFADQELG | | SFESTGNLVAP | |
| QNPRMFLAM | | QNPRMFLAM | | RKRGLFGAIA | | SFFRNIVWLIK | |
| QNPRVFLAM | | QNPRVFLAM | | RKRKRKTRGL | | SFFRNVVWLIK | |
| QNPRVFLTM | | QNPRVFLTM | | RKRKTRGLFG | | SFFRNVVWLTK | |
| QNPTEEQAV | | QNPTEEQAV | | RKRMTRGLFG | | SFFRNVVWLVK | |
| QNQNPRMFL | | QNQNPRMFL | | RKRNSSILTD | | SFFSRLNWLTK | |
| QNQVKIRRR | | QNQVKIRRR | | RKTNLYGFII | | SFFYRYGFVAN | |
| QNRGLFGAI | | QNRGLFGAI | | RKTNLYGFIV | | SFGASCFIFLA | |
| QNRGLFGAK | | QNRGLFGAK | | RKTRFLPVAG | | SFGASCFILLA | |
| QNRIMINPV | | QNRIMINPV | | RKTRFLPVSG | | SFGASCFLFLA | |
| QNRIQIDAV | | QNRIQIDAV | | RKTRFLPVTG | | SFGASCFLLIA | |
| QNRIQIDPV | | QNRIQIDPV | | RKTRFLPVVG | | SFGASCFLLLA | |
| QNRIQIDQV | | QNRIQIDQV | | RKTRGLFGAI | | SFGASCFVLLA | |
| QNRIQIDSV | | QNRIQIDSV | | RLAAGGAIWV | | SFGASCVMLLA | |
| QNRIQINPV | | QNRIQINPV | | RLAAGGDIWV | | SFGASSFVLLA | |
| QNRIRIDPV | | QNRIRIDPV | | RLAIGLRNTP | | SFGGFTFKRTK | |
| QNRLNNVID | | QNRLNNVID | | RLAKCNTKCQ | | SFGGFTFKRTN | |
| QNRMQFSSL | | QNRMQFSSL | | RLALGLRNTP | | SFGGFTFKRTS | |
| QNRMQINPV | | QNRMQINPV | | RLATGLRNIP | | SFGSFTFKRTS | |
| QNRVKIDPV | | QNRVKIDPV | | RLATGLRNVP | | SFGVSGINESA | |
| QNSEGTGIA | | QNSEGTGIA | | RLATGMRNIP | | SFGVSGVNESA | |
| QNSEGTGIV | | QNSEGTGIV | | RLAVGLRNTP | | SFIQHPELTGL | |
| QNSEGTGTA | | QNSEGTGTA | | RLCNPLNPFV | | SFKPNIGPRPF | |
| QNSFVPVVG | | QNSFVPVVG | | RLCNPMNPFV | | SFKPNIGPRPL | |
| QNSITIERM | | QNSITIERM | | RLCTINSWHI | | SFLAHALKLVV | |
| QNSLTIEKM | | QNSLTIEKM | | RLCYPGELDN | | SFNGAFIAPDR | |
| QNSLTIERM | | QNSLTIERM | | RLEENTTYKI | | SFNGAFVAPDR | |
| QNSMTIERM | | QNSMTIERM | | RLENLDKKME | | SFPDGAKIQYF | |
| QNSQGEGTA | | QNSQGEGTA | | RLENLNKKME | | SFPDGAQIKYF | |
| QNSTWVSQT | | QNSTWVSQT | | RLENLNKKVE | | SFPDGAQIQYF | |
| QNTIDLTDS | | QNTIDLTDS | | RLENLNKRME | | SFPDGARIQYF | |
| QNTLKLATG | | QNTLKLATG | | RLFDYSGWNV | | SFPNGAQIQYF | |
| QNTQGEGTA | | QNTQGEGTA | | RLFDYSKWNV | | SFPQTTNTYRN | |
| QNTSKHYIG | | QNTSKHYIG | | RLFDYSRWNV | | SFQGGHIEECS | |
| QNTSRHYIG | | QNTSRHYIG | | RLFERVRRQL | | SFQGRGVFEFS | |
| QNTSRHYMG | | QNTSRHYMG | | RLFTIRQELA | | SFQGRGVFELS | |
| QNVHPITIG | | QNVHPITIG | | RLFTIRQEMA | | SFQPNIGPRAL | |
| QNVNKITYG | | QNVNKITYG | | RLGKGYMFES | | SFQPNIGPRPL | |
| QNVNKVTYG | | QNVNKVTYG | | RLGNLNKKME | | SFRGGHIEECS | |
| QNVNRITYG | | QNVNRITYG | | RLGRGYMFES | | SFRGRGVFELS | |
| QNVPVTQAM | | QNVPVTQAM | | RLGSSFYAEM | | SFRPNIGPRPL | |
| QNVPVTQTM | | QNVPVTQTM | | RLGSWSWHDG | | SFRQSERGEDT | |
| QNVPVTQVE | | QNVPVTQVE | | RLGYETFKVI | | SFRQSERGEET | |
| QNVSKYAFG | | QNVSKYAFG | | RLGYETFKVV | | SFRYGDGVWIG | |
| QNVSPIWIG | | QNVSPIWIG | | RLIDFLKDVI | | SFSFGGFTFKR | |
| QNVSPLWIG | | QNVSPLWIG | | RLIDFLKDVM | | SFSIRGETTGR | |
| QNVSPLWVG | | QNVSPLWVG | | RLIDFLKDVT | | SFSIRWETTGR | |
| QNVSPVWIG | | QNVSPVWIG | | RLIDFLKDVV | | SFSISCFLLAA | |
| | | | | RLIDKTNQQF | | SFSISCFLLIA | |

Fig. 83-311

| Block size 8 | SIN | Block size 9 | SIN | Block size 10 | SIN | Block size 11 | SIN |
|---|---|---|---|---|---|---|---|
| QNVSRIAIG | | QNVSRIAIG | | RLIDRTNHQF | | SFSISCFLLVA | |
| QNVSRYAFG | | QNVSRYAFG | | RLIEKTNDKY | | SFSMSCFVFVA | |
| QNVTVTHAK | | QNVTVTHAK | | RLIEKTNEKY | | SFSPSPGARPK | |
| QNWSGYSGA | | QNWSGYSGA | | RLIEKTNKQF | | SFSPSPGDRPK | |
| QNWSGYSGS | | QNWSGYSGS | | RLIEKTNQQF | | SFSRTELINPN | |
| QPAATALAN | | QPAATALAN | | RLIEKTNTEF | | SFSRTELINPS | |
| QPAFSVQRN | | QPAFSVQRN | | RLIEKTNTQF | | SFSRTELIPPS | |
| QPCFYIELI | | QPCFYIELI | | RLIERTNEKY | | SFSRTELISPN | |
| QPCFYVELI | | QPCFYVELI | | RLIERTNQQF | | SFSRTELISPS | |
| QPCFYVELT | | QPCFYVELT | | RLIGKTNQQF | | SFTGWILGNPM | |
| QPEWFRNIL | | QPEWFRNIL | | RLILATGLRN | | SFTITGDNTKW | |
| QPEWFRNVL | | QPEWFRNVL | | RLIQNSITIE | | SFVPVVGARPQ | |
| QPGDNIIFS | | QPGDNIIFS | | RLIQNSLTIE | | SFVQHPELTGL | |
| QPGDNITFS | | QPGDNITFS | | RLIQNSMTIE | | SFVQHPELTGM | |
| QPGWFRNVL | | QPGWFRNVL | | RLISKTNQQF | | SFVQHPELTGV | |
| QPISLGDCS | | QPISLGDCS | | RLKITENSFE | | SFVQHPEMTGL | |
| QPKEKAIWT | | QPKEKAIWT | | RLLRENAEED | | SFWMCPNGSLQ | |
| QPKEKTIWT | | QPKEKTIWT | | RLLVLLENDK | | SFWMCSGHSCR | |
| QPKWFRNVL | | QPKWFRNVL | | RLMDFLKDVM | | SFWMCSNGSLH | |
| QPLSISVGS | | QPLSISVGS | | RLNINPVKLS | | SFWMCSNGSLQ | |
| QPNDGQVLY | | QPNDGQVLY | | RLNINPVTLS | | SFWMCSNGSLR | |
| QPNERTIWT | | QPNERTIWT | | RLNINSVKLS | | SFWRCSNGSLQ | |
| QPNIGPRAL | | QPNIGPRAL | | RLNNVIDKMN | | SFYAELKWLIS | |
| QPNIGPRPL | | QPNPMHQLLR | | RLNPMHQLLR | | SFYAELKWLVS | |
| QPTFSVQRN | | QPTFSVQRN | | RLNRNEIKGI | | SFYAEMEWLLS | |
| QPTFSVQRS | | QPTFSVQRS | | RLNRNEIKGV | | SFYAEMKWLLS | |
| QQETRVWWT | | QQETRVWWT | | RLNTMHQLLR | | SFYRNLIWLVK | |
| QQFELIDNE | | QQFELIDNE | | RLNWLTKATN | | SFYRNLIWLVN | |
| QQFELIDNK | | QQFELIDNK | | RLNWLTKETN | | SFYRNLIWLVQ | |
| QQFELIDSE | | QQFELIDSE | | RLPFQNLSPR | | SFYRNLVWIVK | |
| QQFELINNE | | QQFELINNE | | RLQDTTWDVF | | SFYRNLVWLVK | |
| QQFEMIDNE | | QQFEMIDNE | | RLQLKDNAKE | | SFYRNMRWLTL | |
| QQFKLIDNE | | QQFKLIDNE | | RLQLKDNARE | | SFYRNVVWLIK | |
| QQGRMDYYW | | QQGRMDYYW | | RLQLRDNAKE | | SFYRSINWLTK | |
| QQGTMDYYW | | QQGTMDYYW | | RLQLRDNARE | | SFYRSIRWLTL | |
| QQGWMDYYW | | QQGWMDYYW | | RLRGIPPLEL | | SFYRSMKWLTL | |
| QQIESIIEA | | QQIESIIEA | | RLRMATGLRN | | SFYRSMRWLTL | |
| QQIESMIEA | | QQIESMIEA | | RLRRDQKSLR | | SFYSEMKWLLS | |
| QQIESMVEA | | QQIESMVEA | | RLRSGFEMLK | | SFYSEMKWLSS | |
| QQIGNVINC | | QQIGNVINC | | RLSADGDIWV | | SFYWTIVDPGD | |
| QQIGNVINW | | QQIGNVINW | | RLSAGGAIWV | | SFYWTIVEPED | |
| QQMRDILGT | | QQMRDILGT | | RLSAGGAVWV | | SFYWTIVEPGD | |
| QQMRDVLGT | | QQMRDVLGT | | RLSAGGDIWI | | SFYWTIVEPGN | |
| QQSFSPSPG | | QQSFSPSPG | | RLSAGGDIWV | | SGAAGAAIKGV | |
| QQSFTPSPG | | QQSFTPSPG | | RLSAGGAVWV | | SGAAGAAVKGI | |
| QQSFVPSPG | | QQSFVPSPG | | RLSAGGNIWI | | SGAAGAAVKGV | |
| QQTRVDKLT | | QQTRVDKLT | | RLSASGDIWI | | SGADDDAYAVI | |
| QQTRVDRLT | | QQTRVDRLT | | RLSASGDIWV | | SGADDEAYAVI | |
| QQVCIAWSS | | QQVCIAWSS | | RLSASGDVWV | | SGADNDAYAVI | |
| QRAIDGVTN | | QRAIDGVTN | | RLSGIPPLEL | | SGCKMYALHQG | |
| QRAIDNMQN | | QRAIDNMQN | | RLSINPVKLS | | SGDDVWMGRTI | |
| QRAMMDQVR | | QRAMMDQVR | | RLSSGYKDII | | SGDIWITREPY | |
| QRAMVDQVR | | QRAMVDQVR | | RLTIIGKDAG | | SGDIWVTREPY | |
| QRCCNLFEK | | QRCCNLFEK | | RLTILGKDAG | | SGDYARLYIWG | |
| QRFRRPDSS | | QRFRRPDSS | | RLTITYSSSM | | SGEVPGWSWDD | |
| QRGILEDEQ | | QRGILEDEQ | | RLTQGRQTYD | | SGFAIFSKDNG | |
| QRGNIRCNI | | QRGNIRCNI | | RLTQGYKDII | | SGFAIISKDNG | |
| QRGRIDFHW | | QRGRIDFHW | | RLTTTIKPWA | | SGFAIVSKDNG | |
| QRGVLEDEQ | | QRGVLEDEQ | | RLTTTIKTWA | | SGFAVVSKDNG | |
| QRINGVKLE | | QRINGVKLE | | RLTTTIRTWA | | SGFEIIWDPNG | |
| QRINMLADR | | QRINMLADR | | RLTTTVKTWA | | SGFEILLIEDG | |
| QRKRRIRDN | | QRKRRIRDN | | RLTVLGKDAG | | SGFEILLIEEG | |

Fig. 83-312

| Block size 8 | SIN | Block size 9 | SIN | Block size 10 | SIN | Block size 11 | SIN |
|---|---|---|---|---|---|---|---|
| QRKRRVRDN | | QRKRRVRDN | | RLVLATGLRN | | SGFEMIWDANG | |
| QRLEDVFAG | | QRLEDVFAG | | RLVQNSITIE | | SGFEMIWDPDG | |
| QRLEGVFAG | | QRLEGVFAG | | RLVRFRHQNS | | SGFEMIWDPNG | |
| QRLENVFAG | | QRLENVFAG | | RLYIWGVHHP | | SGFEMLKIHNA | |
| QRLESVFAG | | QRLESVFAG | | RLYLWGVHHP | | SGFEMLKIPNA | |
| QRLNPMHQL | | QRLNPMHQL | | RLYVNKNPYT | | SGFEMLKVPNA | |
| QRLNTMHQL | | QRLNTMHQL | | RMAINWGRIV | | SGFEMLRIPNA | |
| QRRRFIQNA | | QRRRFIQNA | | RMAKCNTKCQ | | SGFEMVWDANG | |
| QRRRFVQNA | | QRRRFVQNA | | RMARCNTKCQ | | SGFEMVWDDNG | |
| QRSKFLLMD | | QRSKFLLMD | | RMATGLRNIP | | SGFEMVWDPNG | |
| QRSWMKIYW | | QRSWMKIYW | | RMATGLRNVP | | SGFEVLFIEDG | |
| QRSWMKLYW | | QRSWMKLYW | | RMATNECRII | | SGFEVLKVPNA | |
| QRTIGKKKH | | QRTIGKKKH | | RMCNILKGKF | | SGFEVLLIEDG | |
| QRTIGKKKQ | | QRTIGKKKQ | | RMCSLMQGST | | SGFFPDGPQIQ | |
| QRTIGKRKQ | | QRTIGKRKQ | | RMDYYWAILK | | SGFVIVSKDNG | |
| QRTMGKKKQ | | QRTMGKKKQ | | RMDYYWAVLK | | SGFVRTLFQQM | |
| QRTRALVRS | | QRTRALVRS | | RMDYYWGILK | | SGGGDIWVTRE | |
| QRTRALVRT | | QRTRALVRT | | RMENLNKKVD | | SGGHIEECSCY | |
| QRTVGKKKQ | | QRTVGKKKQ | | RMFALSQGTT | | SGGIDKEPMGF | |
| QRWSYIVER | | QRWSYIVER | | RMFLAMITYI | | SGGIDKESMGF | |
| QSAIDQITG | | QSAIDQITG | | RMGKCNTKCQ | | SGGLLAPRYGY | |
| QSAIDQITR | | QSAIDQITR | | RMGLQMQRFK | | SGGTINSPLPF | |
| QSAIDQVTG | | QSAIDQVTG | | RMGVQIQRFK | | SGGYKDIILWF | |
| QSAINQITG | | QSAINQITG | | RMGVQLQRFK | | SGGYKDVILWF | |
| QSAVDQITG | | QSAVDQITG | | RMGVQMHRFK | | SGHWPDGSNIG | |
| QSCFYVELI | | QSCFYVELI | | RMGVQMQRFK | | SGIAIALGIIN | |
| QSDAQIDES | | QSDAQIDES | | RMIKAVRGDL | | SGIAIVLGIIN | |
| QSDKPFQNV | | QSDKPFQNV | | RMIKRGINDR | | SGICPVVFTDG | |
| QSEFNKACE | | QSEFNKACE | | RMIKRGVNDR | | SGIEYNGKSLG | |
| QSEIGGINT | | QSEIGGINT | | RMKWMMAMKY | | SGIKSFSRTEL | |
| QSEIGGIST | | QSEIGGIST | | RMKWMMAMRY | | SGIKSFSRTQL | |
| QSEIGWINT | | QSEIGWINT | | RMNNETILET | | SGIKTDGATSA | |
| QSERGEDTI | | QSERGEDTI | | RMQFSSLAVN | | SGINESADMSI | |
| QSERGEETI | | QSERGEETI | | RMQFSSLTVN | | SGIPPLELGDC | |
| QSERGEETV | | QSERGEETV | | RMQFSSLTVS | | SGIRSFSRTEL | |
| QSFPQTTNT | | QSFPQTTNT | | RMQLKDNAKE | | SGIRTDGATSA | |
| QSFSPSPGA | | QSFSPSPGA | | RMQLRDNAKE | | SGKADTRILFI | |
| QSFSPSPGD | | QSFSPSPGD | | RMQLRDNVKE | | SGKADTRILFV | |
| QSFTPSPGA | | QSFTPSPGA | | RMSDSIKSWR | | SGKNTDLEALM | |
| QSFTPSPGT | | QSFTPSPGT | | RMSICISGPN | | SGKVECVCRDN | |
| QSFVPSPGA | | QSFVPSPGA | | RMSICMSGPN | | SGLIAGWYGFQ | |
| QSFVPSPGS | | QSFVPSPGS | | RMSICVSGPN | | SGLPVGGNEKK | |
| QSFVPSPGV | | QSFVPSPGV | | RMSVCISGPN | | SGLTHIMIWHS | |
| QSFYRSINW | | QSFYRSINW | | RMSVCMSGPN | | SGLVAGWYGFQ | |
| QSGHIEECS | | QSGHIEECS | | RMTDSIKSWR | | SGLVGDTPRND | |
| QSGLPVGGN | | QSGLPVGGN | | RMTICIQGNN | | SGLVGDTPRNE | |
| QSGRIDFHW | | QSGRIDFHW | | RMTICVQGDN | | SGLVGDTPRNG | |
| QSGRIDFYW | | QSGRIDFYW | | RMTICVQGKN | | SGLVGDTPRNN | |
| QSGRIEFHW | | QSGRIEFHW | | RMTICVQGNN | | SGLVGDTPRSD | |
| QSGRINFHW | | QSGRINFHW | | RMTRGLFGAI | | SGMDPRMCSLM | |
| QSGRISFYW | | QSGRISFYW | | RMVIASTTAK | | SGMIDGWYGFH | |
| QSGRISIYW | | QSGRISIYW | | RMVKRGINDR | | SGMSANGDILM | |
| QSGRIVFHW | | QSGRIVFHW | | RMVLASTTAK | | SGNAQHVEECS | |
| QSGRVSFYW | | QSGRVSFYW | | RMVLSAFDER | | SGNGDPNNMDR | |
| QSKGLFGAI | | QSKGLFGAI | | RMVTGLRNIP | | SGNLIAPEYGH | |
| QSKMQFSSL | | QSKMQFSSL | | RMYALHQGTT | | SGNNQVFPQLN | |
| QSLIIAARN | | QSLIIAARN | | RMYQKCCNLF | | SGNWPDGANIG | |
| QSLIIAARS | | QSLIIAARS | | RNAFRGLIST | | SGNWPDGSNIG | |
| QSLPPNFPS | | QSLPPNFPS | | RNAHKMESRG | | SGPDDGAVAVL | |
| QSLPPNFSC | | QSLPPNFSC | | RNAIGDCPKY | | SGPDNEAVAVL | |
| QSLPPNFSS | | QSLPPNFSS | | RNALGDCPKY | | SGPDNGAVAVL | |
| QSLQQIESI | | QSLQQIESI | | RNALGNCPKY | | SGPDNGAVAVV | |

Fig. 83-313

| Block size 8 | SIN | Block size 9 | SIN | Block size 10 | SIN | Block size 11 | SIN |
|---|---|---|---|---|---|---|---|
| QSLQQIESM | | QSLQQIESM | | RNALSIAPIM | | SGPDSGAVAVL | |
| QSLRSILAN | | QSLRSILAN | | RNCTIPCFWV | | SGPLKAEIAQK | |
| QSLRSILAS | | QSLRSILAS | | RNCTVPCFWV | | SGPLKAEIAQR | |
| QSLSISIGS | | QSLSISIGS | | RNDDSSSNSN | | SGPNDNASAVV | |
| QSLSISVES | | QSLSISVES | | RNDDSSSSSN | | SGPNNNASAIV | |
| QSLSISVGS | | QSLSISVGS | | RNDLYGTQSL | | SGPNNNASAVI | |
| QSLVIAARN | | QSLVIAARN | | RNDTDVVNFL | | SGPNNNASAVV | |
| QSNNSTDTV | | QSNNSTDTV | | RNDTDVVNFV | | SGPNNNASTVI | |
| QSNNSTNTV | | QSNNSTNTV | | RNDTDVVNYV | | SGPSFYAEMKW | |
| QSPLGAINT | | QSPLGAINT | | RNEAINNRFQ | | SGQFPVQTDEY | |
| QSPNVYQAK | | QSPNVYQAK | | RNEALNNRFQ | | SGQLKLATGLK | |
| QSPNVYQAR | | QSPNVYQAR | | RNEDGSSSSN | | SGQLKLATGLR | |
| QSPNVYQSR | | QSPNVYQSR | | RNEDSSSNSN | | SGQNHGICAVA | |
| QSPRMFLAM | | QSPRMFLAM | | RNEDSSSSSN | | SGRADTKILFI | |
| QSRFEAVAW | | QSRFEAVAW | | RNEEGTGIAA | | SGRADTRILFI | |
| QSRGLFGAI | | QSRGLFGAI | | RNEEGTGVAA | | SGREWSYIVER | |
| QSRMQFSSL | | QSRMQFSSL | | RNEIKGIKLS | | SGRIDFHWLIL | |
| QSRTREILT | | QSRTREILT | | RNEIKGVELS | | SGRIDFHWLLL | |
| QSRTRGILT | | QSRTRGILT | | RNEIKGVKLS | | SGRIDFHWLML | |
| QSSDDFALI | | QSSDDFALI | | RNFKPNIGPR | | SGRIDFHWLVL | |
| QSSLPLALG | | QSSLPLALG | | RNFPQTTNTY | | SGRISFYWTIV | |
| QSSPPTVYN | | QSSPPTVYN | | RNFQPNIGPR | | SGRISIYWTLV | |
| QSTLKLATG | | QSTLKLATG | | RNFWRGDNGR | | SGRLIDFLKDV | |
| QSTNSTEAV | | QSTNSTEAV | | RNFWRGENGR | | SGRLMDFLKDV | |
| QSTNSTETV | | QSTNSTETV | | RNGFEMLKIP | | SGRQEKNPALR | |
| QSWSCIVER | | QSWSCIVER | | RNGKWREQLS | | SGRQEKNPSLR | |
| QSWSYIVER | | QSWSYIVER | | RNGNMRCTIC | | SGRSSFFRNVV | |
| QSWSYVVER | | QSWSYVVER | | RNGTYDHKEF | | SGRVSFYWTIV | |
| QSYFQLFLV | | QSYFQLFLV | | RNGTYDHNIY | | SGSAQHIEECS | |
| QTAAQKAMM | | QTAAQKAMM | | RNGTYDYPKY | | SGSAQHVEECS | |
| QTAAQRAMM | | QTAAQRAMM | | RNGTYNHEDY | | SGSFIDYWAEG | |
| QTAAQRAMV | | QTAAQRAMV | | RNGTYNYPKY | | SGSFIDYWAKE | |
| QTAIDQING | | QTAIDQING | | RNICEKLEQS | | SGSFIDYWAKG | |
| QTAIDQITG | | QTAIDQITG | | RNILRTQDSE | | SGSFIQHPELT | |
| QTALYKNAN | | QTALYKNAN | | RNILRTQESE | | SGSFMDYWAEG | |
| QTANTYRNT | | QTANTYRNT | | RNILSIAPIM | | SGSFPDGAKIQ | |
| QTATKRIRM | | QTATKRIRM | | RNILSMAPIM | | SGSFPDGAQIK | |
| QTATKRLRM | | QTATKRLRM | | RNIPEKQTRG | | SGSFPDGAQIQ | |
| QTDCVLEAM | | QTDCVLEAM | | RNIPERQTRG | | SGSFPNGAQIQ | |
| QTDEYKNTG | | QTDEYKNTG | | RNIPGKQAKG | | SGSFSIRGETT | |
| QTDEYKNTR | | QTDEYKNTR | | RNIPQIESRG | | SGSFSIRWETT | |
| QTDLYKVAT | | QTDLYKVAT | | RNIPSIQSRG | | SGSFVDYWAEG | |
| QTEIGGINT | | QTEIGGINT | | RNIPSVQSRG | | SGSFVQHPELT | |
| QTESRGLFG | | QTESRGLFG | | RNITEIVYLN | | SGSFVQHPEMT | |
| QTEVGGINT | | QTEVGGINT | | RNIVRRAAVS | | SGSIISFCGVN | |
| QTFDWTLNR | | QTFDWTLNR | | RNIVRRAIVS | | SGSINTKLPFQ | |
| QTGRIDFHW | | QTGRIDFHW | | RNIVRRATVS | | SGSLEFIAEQF | |
| QTIINNYHN | | QTIINNYHN | | RNKHSNGTIH | | SGSLKLAIGLR | |
| QTIINNYYN | | QTIINNYYN | | RNKHSNGTTH | | SGSLKLAIGPR | |
| QTIVLNTDW | | QTIVLNTDW | | RNKHSNSTTH | | SGSQKQEFKMN | |
| QTIVSNTDW | | QTIVSNTDW | | RNKYLEEHPN | | SGSSFYAELKW | |
| QTKKMTITF | | QTKKMTITF | | RNKYLEEHPS | | SGSSFYAEMKW | |
| QTKLYGNGN | | QTKLYGNGN | | RNLHIPEAGL | | SGSSIAFCGVD | |
| QTKLYGSGN | | QTKLYGSGN | | RNLHIPEVCL | | SGSSIAFCGVN | |
| QTKLYGSGS | | QTKLYGSGS | | RNLYDKVRLQ | | SGSSISFCGVD | |
| QTKLYKNTN | | QTKLYKNTN | | RNLYDKVRMQ | | SGSSISFCGVN | |
| QTKRSFELK | | QTKRSFELK | | RNMRWLTLKS | | SGSSISFCGVS | |
| QTKTMTITF | | QTKTMTITF | | RNMINNDLG | | SGTCAVVMTDG | |
| QTLRIRSNE | | QTLRIRSNE | | RNNRKEPALI | | SGTDNYGVKGF | |
| QTLRIRSNG | | QTLRIRSNG | | RNNTYDHAQY | | SGTNNYGVKGF | |
| QTLRVKSNG | | QTLRVKSNG | | RNNTYDHKKY | | SGTSKACNALT | |
| QTLRVRSDG | | QTLRVRSDG | | RNNTYDHRKY | | SGTSKACNAST | |

Fig. 83-314

| Block size 8 | SIN | Block size 9 | SIN | Block size 10 | SIN | Block size 11 | SIN |
|---|---|---|---|---|---|---|---|
| QTLRVRSNG | | QTLRVRSNG | | RNNTYDHSHY | | SGTSKACSAST | |
| QTLVANNDW | | QTLVANNDW | | RNNTYDHSKY | | SGTVKDRSPFR | |
| QTLVSNDDW | | QTLVSNDDW | | RNNTYDHSQY | | SGTYGAGSWPD | |
| QTLVSNNDW | | QTLVSNNDW | | RNNTYDHSRY | | SGTYGSGSWPD | |
| QTLVSNSDW | | QTLVSNSDW | | RNNTYDHSTY | | SGTYGTGSWPD | |
| QTMELVEAE | | QTMELVEAE | | RNNTYDHTKY | | SGTYGTGTWPD | |
| QTMELVETE | | QTMELVETE | | RNNTYDHTQY | | SGVAIALSILN | |
| QTMELVETK | | QTMELVETK | | RNNTYNHTEY | | SGVAIALSVLN | |
| QTNGNLIAP | | QTNGNLIAP | | RNNTYNHTQY | | SGVESAVLRGF | |
| QTNNSTDTV | | QTNNSTDTV | | RNPGNAEIED | | SGVEYNGKSLG | |
| QTNNSTETV | | QTNNSTETV | | RNPGVKGWAF | | SGVKLEENSTY | |
| QTPIGAINS | | QTPIGAINS | | RNQIKIRRRV | | SGVNESADMSI | |
| QTPLGAINS | | QTPLGAINS | | RNQPAATALA | | SGVNSFSRTEL | |
| QTPLGAINT | | QTPLGAINT | | RNQSGRISIY | | SGWLLGNPMCD | |
| QTPLGALNT | | QTPLGALNT | | RNQVKIRRRV | | SGWLTLGITGP | |
| QTPMGAINS | | QTPMGAINS | | RNRHSNGTIH | | SGYAADKASTQ | |
| QTPMGAVNS | | QTPMGAVNS | | RNRSILNTSQ | | SGYAADKESSQ | |
| QTPVGAINS | | QTPVGAINS | | RNRYLEEHPS | | SGYAADKESTQ | |
| QTRGIFGAI | | QTRGIFGAI | | RNRYLEENPS | | SGYAADKKSTQ | |
| QTRGLFGAI | | QTRGLFGAI | | RNSFFSRLNW | | SGYAADLKSTQ | |
| QTRRAFELK | | QTRRAFELK | | RNSFYAELKW | | SGYAADQESTQ | |
| QTRRSFEIK | | QTRRSFEIK | | RNSIWTSSSS | | SGYAADQKSTQ | |
| QTRRSFELK | | QTRRSFELK | | RNSSDICYPG | | SGYAADRESTQ | |
| QTRRSFELR | | QTRRSFELR | | RNSSILTDSQ | | SGYAADRKSTQ | |
| QTRVDKLTQ | | QTRVDKLTQ | | RNTFGDCPKY | | SGYAANKESTQ | |
| QTRVDRLTQ | | QTRVDRLTQ | | RNTIGDCPKY | | SGYAQTDCVLE | |
| QTSGNLIAP | | QTSGNLIAP | | RNTIGNCPKY | | SGYEILKVPNA | |
| QTSIVPNIG | | QTSIVPNIG | | RNTPSIDPKG | | SGYEMLKVPDA | |
| QTSLLLATG | | QTSLLLATG | | RNTPSIEPKG | | SGYEMLKVPNA | |
| QTSVGGIDT | | QTSVGGIDT | | RNTPSIEPRG | | SGYETFKVIGG | |
| QTSVGGINT | | QTSVGGINT | | RNTPSVEPKG | | SGYETFRVIDG | |
| QTSVIPNIG | | QTSVIPNIG | | RNTPSVEPRG | | SGYETFRVIGG | |
| QTSVVPDIG | | QTSVVPDIG | | RNTRKEPALI | | SGYETFRVISG | |
| QTSVVPNID | | QTSVVPNID | | RNVLSIAPIM | | SGYEVLKVPDA | |
| QTSVVPNIG | | QTSVVPNIG | | RNVLSVAPIM | | SGYEVLKVPNA | |
| QTTLYKNAN | | QTTLYKNAN | | RNVPEKQTRG | | SGYGEDNESTQ | |
| QTTNTYRNT | | QTTNTYRNT | | RNVPERQTRG | | SGYKDIILWFS | |
| QTVINNYYN | | QTVINNYYN | | RNVPETQTRG | | SGYKDVILWFS | |
| QTVKIKTNG | | QTVKIKTNG | | RNVPQAQDRG | | SGYKEIILWFS | |
| QTVKIQTNG | | QTVKIQTNG | | RNVPQAQNRG | | SGYKEVILWFS | |
| QTVKIQTSG | | QTVKIQTSG | | RNVPQIEPRG | | SGYSGAFIDYW | |
| QTVVLNTDW | | QTVVLNTDW | | RNVPQIESRG | | SGYSGAFMDYW | |
| QTYAGAINS | | QTYAGAINS | | RNVPQIQNRG | | SGYSGAFTIPI | |
| QTYAGAVNS | | QTYAGAVNS | | RNVPQMESRG | | SGYSGAFTIPT | |
| QTYDWTLNR | | QTYDWTLNR | | RNVPQVQDRG | | SGYSGAFTIPV | |
| QTYQKRMGV | | QTYQKRMGV | | RNVPQVQNRG | | SGYSGAFTVPI | |
| QTYRNNRKE | | QTYRNNRKE | | RNVPSIQSRG | | SGYSGAFVDYW | |
| QTYRNTRKE | | QTYRNTRKE | | RNVTETLYLN | | SGYSGIFSVEG | |
| QTYTGAINS | | QTYTGAINS | | RNVTVTHAKD | | SGYSGIFSVEH | |
| QVAGSSEQA | | QVAGSSEQA | | RNVTVTHAKN | | SGYSGIFSVEN | |
| QVCAAWSSS | | QVCAAWSSS | | RNVTVTHAQD | | SGYSGIFSVES | |
| QVCIAWSSA | | QVCIAWSSA | | RNVTVTHSVE | | SGYSGSFIDYW | |
| QVCIAWSSS | | QVCIAWSSS | | RNVTVTHSVN | | SGYSGSFIQHP | |
| QVCMAWSSS | | QVCMAWSSS | | RNWRQANNGE | | SGYSGSFMDYW | |
| QVCVAWSSS | | QVCVAWSSS | | RNWSKPQCQI | | SGYSGSFSIRG | |
| QVDCFIWHI | | QVDCFIWHI | | RPCFWVELIR | | SGYSGSFSIRW | |
| QVDCFLWHI | | QVDCFLWHI | | RPCFWVELVR | | SGYSGSFTIPT | |
| QVDCFLWHV | | QVDCFLWHV | | RPDSSWLFGG | | SGYSGSFTLPI | |
| QVDCFLWYV | | QVDCFLWYV | | RPEEAKYVEW | | SGYSGSFTLPV | |
| QVDCYLWHI | | QVDCYLWHI | | RPEEAKYVWW | | SGYSGSFVDYW | |
| QVDGQSGRI | | QVDGQSGRI | | RPEEVKYVWW | | SGYSGSFVQHP | |
| QVDTIMEKI | | QVDTIMEKI | | RPFQNVNKIT | | SGYSGVFSVEG | |

Fig. 83-315

| Block size 8 | SIN | Block size 9 | SIN | Block size 10 | SIN | Block size 11 | SIN |
|---|---|---|---|---|---|---|---|
| QVDTIMEKN | | QVDTIMEKN | | RPFVRGQQGR | | SGYVCSGLVGD | |
| QVDTIMERN | | QVDTIMERN | | RPGDNITFSH | | SGYWAIRTRSG | |
| QVDTIVEKN | | QVDTIVEKN | | RPGETLNVES | | SHCRATEYIIK | |
| QVECVCRDN | | QVECVCRDN | | RPGQTLRVRS | | SHCRATEYIMK | |
| QVEELVHGG | | QVEELVHGG | | RPGSSFYAEM | | SHCRATEYMMK | |
| QVEELVHGQ | | QVEELVHGQ | | RPGYNGQKSW | | SHCRIIQNEDI | |
| QVEELVHRG | | QVEELVHRG | | RPGYNGQRSW | | SHEGEGIPLCD | |
| QVEGRIQDL | | QVEGRIQDL | | RPHPEDLNGM | | SHEGEGIPLHD | |
| QVEGRIQYL | | QVEGRIQYL | | RPIGISSMVE | | SHEGEGIPLYD | |
| QVEGRTQDL | | QVEGRTQDL | | RPILSPLTKG | | SHGKIIQNEDI | |
| QVEKRINMI | | QVEKRINMI | | RPITEINTWA | | SHGRIIQNEDI | |
| QVEKRINML | | QVEKRINML | | RPKEDEVWWT | | SHGRILKNDLP | |
| QVENRINML | | QVENRINML | | RPKEDKVWWT | | SHGRILKNNLP | |
| QVEQRINML | | QVEQRINML | | RPKEDRVWWT | | SHGRTIQNEDI | |
| QVERRINML | | QVERRINML | | RPKEEKVWWT | | SHGRVLKNNLP | |
| QVESMIEAE | | QVESMIEAE | | RPKEIEGICY | | SHGTGTGYTMD | |
| QVEVTNATE | | QVEVTNATE | | RPKEMEGICY | | SHISPLSGSAQ | |
| QVFPQLNQT | | QVFPQLNQT | | RPKEMEGVCY | | SHKICIGYHAN | |
| QVIKLLPFA | | QVIKLLPFA | | RPKENPAHKS | | SHLECRTFFLA | |
| QVIVDNNNW | | QVIVDNNNW | | RPKVNGQAGR | | SHLECRTFFLT | |
| QVIVDNNSW | | QVIVDNNSW | | RPKVNGQSGR | | SHLKFKADLII | |
| QVIVDNSNW | | QVIVDNSNW | | RPLILKDCSI | | SHLRNDTDVVN | |
| QVIVTREPY | | QVIVTREPY | | RPLILKDCSV | | SHMECRTFFLT | |
| QVKIRRRVD | | QVKIRRRVD | | RPLILRDCSV | | SHNGGLIAPDR | |
| QVKLSSGYK | | QVKLSSGYK | | RPLIRGQQGR | | SHNGGLIAPSR | |
| QVLAIYATV | | QVLAIYATV | | RPLVMGQQGR | | SHNGGLVAPSR | |
| QVLRESGGI | | QVLRESGGI | | RPLVNGQSGR | | SHPGIFENSCI | |
| QVMVDNNNW | | QVMVDNNNW | | RPLVREQQGR | | SHPGIFENSCL | |
| QVNGQFGRI | | QVNGQFGRI | | RPLVRGQQGR | | SHPGIFESSCL | |
| QVNGQSGRI | | QVNGQSGRI | | RPLVRGQQGT | | SHPGIFGNSCL | |
| QVNGQSGRV | | QVNGQSGRV | | RPLVRGQQGW | | SHPGLFENSCL | |
| QVNGQTGRI | | QVNGQTGRI | | RPLVRGQSGR | | SHRTLLMNELG | |
| QVQDRGLFG | | QVQDRGLFG | | RPLVRSQSGR | | SHSECRTFFLT | |
| QVQNRGLFG | | QVQNRGLFG | | RPNENPAHKS | | SHTAYSQITNG | |
| QVREGRNPG | | QVREGRNPG | | RPNENPVHKS | | SHYVCSGLVGD | |
| QVRESRNPG | | QVRESRNPG | | RPNIGPRPLI | | SIAASYKRIRL | |
| QVTDIWAYN | | QVTDIWAYN | | RPNIGPRPLV | | SIADKICIGYL | |
| QVTGKLNRL | | QVTGKLNRL | | RPPVNGQSGR | | SIAFCGVDSDT | |
| QWDWPDGAK | | QWDWPDGAK | | RPQINGQSGR | | SIAFCGVNFDL | |
| QWNWPDGAE | | QWNWPDGAE | | RPQMNGQSGR | | SIAFCGVNSDT | |
| QWNWPDGAK | | QWNWPDGAK | | RPQVNGQSGR | | SIAGWLLGNPE | |
| QYICSPVLT | | QYICSPVLT | | RPRRGLFGAI | | SIAGWLLGNPK | |
| QYLCTGILT | | QYLCTGILT | | RPRVRNQSGR | | SIAGWLLGNPM | |
| QYLCTGVLT | | QYLCTGVLT | | RPRYNGQRSW | | SIAHKSCLPAC | |
| QYLEKYVED | | QYLEKYVED | | RPSAPEGMCY | | SIAPIMFSNKM | |
| QYLLFQDIL | | QYLLFQDIL | | RPTAVDTCYP | | SIAPIMFSNKV | |
| QYPNVRCVC | | QYPNVRCVC | | RPTRNGWGCK | | SIASRSGYEIL | |
| QYRAESLQN | | QYRAESLQN | | RPTTEINTWA | | SIASRSGYEML | |
| QYRALISWP | | QYRALISWP | | RPVAEINTWA | | SIAVFCGTSGT | |
| QYRALVSWP | | QYRALVSWP | | RPVAKAGFIE | | SICEKLEQSGL | |
| QYREEALLN | | QYREEALLN | | RPVGISSMGE | | SICISGPNNNA | |
| QYREESLLN | | QYREESLLN | | RPVGISSMME | | SICMSGPNDNA | |
| QYRSLISWP | | QYRSLISWP | | RPVGISSMVE | | SICMSGPNNNA | |
| QYRTESLQN | | QYRTESLQN | | RPVTEINTWA | | SICSCIASSLV | |
| QYRTGSLQN | | QYRTGSLQN | | RPWIRFNSDL | | SICTHLEVCFM | |
| QYSGFVRTL | | QYSGFVRTL | | RPWIRFNSDP | | SICVSGPNNNA | |
| RAAFRGLIS | | RAAFRGLIS | | RPWIRFNSNL | | SIDECRTFFLT | |
| RAAVSADPL | | RAAVSADPL | | RPWIRINNET | | SIDGKAPISLG | |
| RACFYVELI | | RACFYVELI | | RPWISFDQNL | | SIDLVETNHTG | |
| RADEICIGY | | RADEICIGY | | RPWMRINNET | | SIDPKGLFGAI | |
| RADKICIGY | | RADKICIGY | | RPWMRISNET | | SIDRFLRVKDQ | |
| RADTKILFI | | RADTKILFI | | RPWVRGLSSR | | SIDRFLRVRDQ | |

Fig. 83-316

| Block size 8 | SIN | Block size 9 | SIN | Block size 10 | SIN | Block size 11 | SIN |
|---|---|---|---|---|---|---|---|
| RADTRILFI | | RADTRILFI | | RPWVRGQSGR | | SIDSGYVCSGL | |
| RAESLQNRI | | RAESLQNRI | | RPWVRINNET | | SIDSNYVCSGL | |
| RAGYEMLKV | | RAGYEMLKV | | RPWVRMNNET | | SIDSSYICSGL | |
| RAGYETFKV | | RAGYETFKV | | RPWVSFDQNL | | SIDSSYVCSGL | |
| RAGYETFRV | | RAGYETFRV | | RPWVSFNHNL | | SIEDPDHEGEG | |
| RAIATPGMQ | | RAIATPGMQ | | RPWVSFNQDL | | SIEDPNHEGEG | |
| RAIDGVTNK | | RAIDGVTNK | | RPWVSFNQNL | | SIEDPSHEGEG | |
| RAIDNMQNK | | RAIDNMQNK | | RQASPSCLVV | | SIEECLINDPW | |
| RAIVSADPL | | RAIVSADPL | | RQCFNPMIAE | | SIEEPSHEGEG | |
| RALISWEMG | | RALISWEMG | | RQCFNPMIIE | | SIENLEELRFV | |
| RALISWGMG | | RALISWGMG | | RQCFNPMIVE | | SIENPSHEGEG | |
| RALISWPLS | | RALISWPLS | | RQCFNPMTVE | | SIENQEELKSL | |
| RALISWPQS | | RALISWPQS | | RQCFNPMVVE | | SIENQEELRFL | |
| RALMSCPIG | | RALMSCPIG | | RQEALQNRIM | | SIENQEELRSL | |
| RALMSCPLG | | RALMSCPLG | | RQEIDGIKLK | | SIEPKGLFGAI | |
| RALMSCPVG | | RALMSCPVG | | RQEIEGIKLE | | SIEPRGLFGAI | |
| RALMSVPLG | | RALMSVPLG | | RQEIEGIKLK | | SIESEFNEIEH | |
| RALMSVPMG | | RALMSVPMG | | RQEIEGIRLK | | SIESEFNEIEY | |
| RALSIYSCI | | RALSIYSCI | | RQEIEGVKLD | | SIESEFSEIEH | |
| RALTLNTMT | | RALTLNTMT | | RQEIEGVKLN | | SIESEFSETEH | |
| RALVRGQQG | | RALVRGQQG | | RQEIEGVRLD | | SIGITVIKNNM | |
| RALVRSGMD | | RALVRSGMD | | RQEIGGVKLD | | SIGKVCRALLA | |
| RALVRTGMD | | RALVRTGMD | | RQEINGIKLK | | SIGKVCRTLLA | |
| RALVSWEMG | | RALVSWEMG | | RQEIVDNKNW | | SIGNLIAPRGH | |
| RALVSWPLS | | RALVSWPLS | | RQEIVDNNNW | | SIGSSTYQNNF | |
| RAMMDQVRE | | RAMMDQVRE | | RQEIVDNSNW | | SIGSWSHNILR | |
| RAMVDQVRE | | RAMVDQVRE | | RQEIVGNDNW | | SIGSWSQNILR | |
| RANQRLNPM | | RANQRLNPM | | RQEIVSNDNW | | SIGTSTLNQRL | |
| RANQRLNTM | | RANQRLNTM | | RQEKNPALRM | | SIGVAVIKNNM | |
| RAPISLGDC | | RAPISLGDC | | RQEKNPSLRM | | SIGVTVIKNNM | |
| RAPYRSLIR | | RAPYRSLIR | | RQEVEGVKLD | | SIGVTVIRNNM | |
| RARIDARID | | RARIDARID | | RQGNNVWAGR | | SIHECRTFFLT | |
| RARIDARVD | | RARIDARVD | | RQGNSVWAGR | | SIHSRGLFGAI | |
| RARIKTRLF | | RARIKTRLF | | RQGTSVWAGR | | SIHWTIVKPGD | |
| RARPQVNGQ | | RARPQVNGQ | | RQIGNVINWT | | SIIALLIGIGN | |
| RATAIFRKA | | RATAIFRKA | | RQIIRESGGI | | SIIDKMNTQFE | |
| RATAIIRKA | | RATAIIRKA | | RQIIVDNNNW | | SIIDKMNTRFE | |
| RATAILKKA | | RATAILKKA | | RQILRESGGI | | SIIEKMNIQFT | |
| RATAILRKA | | RATAILRKA | | RQILRGSGGI | | SIIEKMNTQFT | |
| RATEYIMKG | | RATEYIMKG | | RQILRGSGGV | | SIIFNMERIKE | |
| RATEYMMKG | | RATEYMMKG | | RQILRKSGGI | | SIIFNSIGNLI | |
| RATFLRSNA | | RATFLRSNA | | RQILRRSGGI | | SIIGKMNTQFE | |
| RATVSADPL | | RATVSADPL | | RQILRTQESS | | SIINKMNTQFE | |
| RAVDGTIAG | | RAVDGTIAG | | RQKIMESGGI | | SIIPSGPLKAE | |
| RAVGKCPRY | | RAVGKCPRY | | RQKIMESGGV | | SIISMCSSTEF | |
| RAVKLYKKL | | RAVKLYKKL | | RQKIMKSGGI | | SIITELPFQNL | |
| RAVKLYRKL | | RAVKLYRKL | | RQKINGVKLE | | SIIVFCGTSGT | |
| RAWLHVCVT | | RAWLHVCVT | | RQKISGVKLE | | SIKKYERVKMF | |
| RAYVDGFEP | | RAYVDGFEP | | RQKRGLFGAI | | SIKNGTYDYPK | |
| RAYVDGFKP | | RAYVDGFKP | | RQKSLIWLWL | | SIKNQEELRSL | |
| RCCNLFEKF | | RCCNLFEKF | | RQKVNGVKLE | | SIKRYERVKMF | |
| RCDDQCMES | | RCDDQCMES | | RQKWWVWLWL | | SIKSWRKDILR | |
| RCFYVELIR | | RCFYVELIR | | RQLRENAEDI | | SIKSWRRDILR | |
| RCFYVELVR | | RCFYVELVR | | RQLRENAEDK | | SIKTKLPFQNL | |
| RCHKGDTQI | | RCHKGDTQI | | RQLRENAEDM | | SILANNGKFEF | |
| RCHRGDAQI | | RCHRGDAQI | | RQLRENAEDQ | | SILANNGRFEF | |
| RCHRGDMQI | | RCHRGDMQI | | RQLRENAEDR | | SILASSGSLEF | |
| RCHRGDTHI | | RCHRGDTHI | | RQLRENAEED | | SILHKCNDSCM | |
| RCHRGDTQI | | RCHRGDTQI | | RQNAEEDGKG | | SILLATGMRNV | |
| RCICEKLEQ | | RCICEKLEQ | | RQNAEEDGRG | | SILNLLIGISN | |
| RCICRDNWK | | RCICRDNWK | | RQNPTEEQAV | | SILNTSQRGIL | |
| RCINRCFYV | | RCINRCFYV | | RQRINGVKLE | | SILNTSQRGVL | |

Fig. 83-317

| Block size 8 | SIN | Block size 9 | SIN | Block size 10 | SIN | Block size 11 | SIN |
|---|---|---|---|---|---|---|---|
| RCLLQSLQQ | | RCLLQSLQQ | | RQSERGEDTI | | SILTDSQTATK | |
| RCMKTFFGW | | RCMKTFFGW | | RQSERGEETI | | SINECRTFFLT | |
| RCNTKCQTS | | RCNTKCQTS | | RQSERGEETV | | SINGKAPISLG | |
| RCNTRCQTS | | RCNTRCQTS | | RQSFSPSPGA | | SINGKEPISLG | |
| RCPRYVKQS | | RCPRYVKQS | | RQTFDWTLNR | | SINGKQPISLG | |
| RCQSEIGGI | | RCQSEIGGI | | RQTRGIFGAI | | SINPVKLSSGY | |
| RCQTPLGAI | | RCQTPLGAI | | RQTRGLFGAI | | SINTKLPFQNL | |
| RCQTSVGGI | | RCQTSVGGI | | RQTYDWTLNR | | SINTRLPFQNL | |
| RCQYSGFVR | | RCQYSGFVR | | RQVCIAWSSS | | SINWLTKKEPD | |
| RCRETRGLF | | RCRETRGLF | | RQVCMAWSSS | | SINWLTKKKNP | |
| RCRKTRGLF | | RCRKTRGLF | | RQVCVAWSSS | | SINWLTKKKPD | |
| RCTCRDNWK | | RCTCRDNWK | | RQVIVDNNNR | | SIQPTFSVQRN | |
| RCTISLVKT | | RCTISLVKT | | RQVIVDNNNW | | SIQSDKPFQNV | |
| RCVCRDNWK | | RCVCRDNWK | | RQVIVDNNSW | | SIQSKGLFGAI | |
| RCVCRDNWM | | RCVCRDNWM | | RQVIVDNSNW | | SIQSRGLFGAI | |
| RCVCRDNWR | | RCVCRDNWR | | RQVLRESGGI | | SIQTRGLFGAI | |
| RCYQFALGQ | | RCYQFALGQ | | RQVLRRSGGI | | SIRGEFNQVEK | |
| RDAMTEIWS | | RDAMTEIWS | | RRAAVSADPL | | SIRGEFNQVEN | |
| RDAMTEVWS | | RDAMTEVWS | | RRAEIIKMES | | SIRGEFNQVEQ | |
| RDCKIEAVI | | RDCKIEAVI | | RRAIATPGMQ | | SIRGEFSQVEQ | |
| RDCKVEAVI | | RDCKVEAVI | | RRAIVSADPL | | SIRGEFSQVER | |
| RDCSIAGWL | | RDCSIAGWL | | RRATVSADPL | | SIRGETTGRNC | |
| RDCSVAGWL | | RDCSVAGWL | | RRCLLQSLQQ | | SIRIGSKGDIF | |
| RDEAINNRF | | RDEAINNRF | | RRDILRTQES | | SIRIGSKGDVF | |
| RDEAINNRI | | RDEAINNRI | | RRDQKALKGR | | SIRIGSRGDVF | |
| RDEAINSRF | | RDEAINSRF | | RRDQKSLKGR | | SIRLAAGGAIW | |
| RDEAISNRF | | RDEAISNRF | | RRDQKSLRGR | | SIRLAAGGDIW | |
| RDEALNNRF | | RDEALNNRF | | RRDQMAHCRM | | SIRLSADGDIW | |
| RDEALNNRS | | RDEALNNRS | | RRDQRALKGR | | SIRLSAGGAIW | |
| RDEAVNNRF | | RDEAVNNRF | | RRDQRSLRGR | | SIRLSAGGDIW | |
| RDEEGTGIA | | RDEEGTGIA | | RRDYFTAEVS | | SIRLSAGGHIW | |
| RDEGNGCFT | | RDEGNGCFT | | RREIHIYYLE | | SIRLSAGGNIW | |
| RDILGTFDT | | RDILGTFDT | | RREVHIYYLE | | SIRLSASGDIW | |
| RDILRTQES | | RDILRTQES | | RREVHMYYLE | | SIRNGTYDHNI | |
| RDITIGSIC | | RDITIGSIC | | RREVHTYYLE | | SIRNNTYDHAQ | |
| RDLGNCHPI | | RDLGNCHPI | | RREVHVYYLE | | SIRNNTYDHSK | |
| RDNAKDEGN | | RDNAKDEGN | | RRFIQNALNG | | SIRNNTYDHSQ | |
| RDNAKDLGN | | RDNAKDLGN | | RRFVQNALNG | | SIRNNTYDHSR | |
| RDNAKEIGN | | RDNAKEIGN | | RRFVQNALSG | | SIRNNTYDHTK | |
| RDNAKELGN | | RDNAKELGN | | RRGLFGAIAG | | SIRNNTYDHTQ | |
| RDNAMILGN | | RDNAMILGN | | RRGQGHLDEK | | SIRNNTYNHTE | |
| RDNANDLGN | | RDNANDLGN | | RRICEKLEQS | | SIRNNTYNHTQ | |
| RDNLEPGTF | | RDNLEPGTF | | RRIDFHWLFL | | SIRVSAGGDIW | |
| RDNVKELGN | | RDNVKELGN | | RRIDFHWLLL | | SIRWETTGRNC | |
| RDNWHASNR | | RDNWHASNR | | RRIDFNWLLL | | SISCFLLAALL | |
| RDNWHGSNR | | RDNWHGSNR | | RRIENLNKKM | | SISCFLLIALL | |
| RDNWKGANR | | RDNWKGANR | | RRIENLNRKM | | SISCFLLVALF | |
| RDNWKGSNR | | RDNWKGSNR | | RRIESLNKKM | | SISCFLLVALL | |
| RDNWMGSNR | | RDNWMGSNR | | RRINMLADRI | | SISCLYKLSQF | |
| RDNWNGMNR | | RDNWNGMNR | | RRIWRQANNG | | SISECRTFFLT | |
| RDNWQGANR | | RDNWQGANR | | RRIWRQANSG | | SISIGSSTYQN | |
| RDNWQGSNR | | RDNWQGSNR | | RRKKRGLFGA | | SISSWSQNILR | |
| RDNWRGANR | | RDNWRGANR | | RRKRGLFGAI | | SISVESSTYQN | |
| RDNWRGSNR | | RDNWRGSNR | | RRKRRGLFGA | | SISVGSSTYHN | |
| RDNWTGTNR | | RDNWTGTNR | | RRKTNLYGFI | | SISVGSSTYQN | |
| RDQGWSYIV | | RDQGWSYIV | | RRLTTTIKPW | | SISVGSSTYQS | |
| RDQKALKGR | | RDQKALKGR | | RRLTTTIKTW | | SITDIWTYQAE | |
| RDQKSLKGR | | RDQKSLKGR | | RRLTTTIRTW | | SITELWSYNAE | |
| RDQKSLRGR | | RDQKSLRGR | | RRLTTTVKTW | | SITEVWSYNAE | |
| RDQMAHCRM | | RDQMAHCRM | | RRLTVLGKDA | | SITQTLVSNDD | |
| RDQRALKGR | | RDQRALKGR | | RRNKYLEEHP | | SITQTLVSNND | |
| RDQRSLRGR | | RDQRSLRGR | | RRNRYLEEHP | | SITQTLVSNSD | |

Fig. 83-318

| Block size 8 | SIN | Block size 9 | SIN | Block size 10 | SIN | Block size 11 | SIN |
|---|---|---|---|---|---|---|---|
| RDRTPYRSL | | RDRTPYRSL | | RRNSSDICYP | | SITYIWTYQAE | |
| RDSIKSWRN | | RDSIKSWRN | | RRNWRQANNG | | SIVAFCGTSGT | |
| RDSITEVWS | | RDSITEVWS | | RRNYFTAEIS | | SIVALCGSKEQ | |
| RDSLEPGTF | | RDSLEPGTF | | RRNYFTAEVS | | SIVALCGSKER | |
| RDSLTEIWS | | RDSLTEIWS | | RRNYFTTEVS | | SIVALCGSKKR | |
| RDSMTEIWS | | RDSMTEIWS | | RRPDSSWLFG | | SIVALCGSRER | |
| RDSMTEVMV | | RDSMTEVMV | | RRPIGISSMV | | SIVASSGTLEF | |
| RDSMTEVWS | | RDSMTEVWS | | RRPVAEINTW | | SIVEFCGTSGT | |
| RDSRSGYET | | RDSRSGYET | | RRPVAKAGFI | | SIVLVGLILAF | |
| RDSSILTDS | | RDSSILTDS | | RRPVGISSMG | | SIVMVGLILAF | |
| RDSTQKAID | | RDSTQKAID | | RRPVGISSMM | | SIVPNIGSRPR | |
| RDSTQMAID | | RDSTQMAID | | RRPVGISSMV | | SIVPSGPLKAE | |
| RDSTQRAID | | RDSTQRAID | | RRPVTEINTW | | SIVRRATVSAD | |
| RDSVTELWS | | RDSVTELWS | | RRQILRTQES | | SIVSMCSSTEF | |
| RDVIGTFDT | | RDVIGTFDT | | RRQKRGLFGA | | SIVSWSQNILR | |
| RDVLGTFDT | | RDVLGTFDT | | RRQKSLIWLW | | SIVTFCGLBNE | |
| RDVLVIWGI | | RDVLVIWGI | | RRQKWWVWLW | | SIVTFCGLDNE | |
| RDVLVLWGI | | RDVLVLWGI | | RRQLRENAED | | SIVTFCGLNNE | |
| RDVLVMWGI | | RDVLVMWGI | | RRQLRENAEE | | SIVVFCGTPGT | |
| RDVLVMWGL | | RDVLVMWGL | | RRRFIQNALN | | SIVVFCGTSGI | |
| RDVWTYNAE | | RDVWTYNAE | | RRRFVQNALN | | SIVVFCGTSGT | |
| RDWSKPQCQ | | RDWSKPQCQ | | RRRFVQNALS | | SIVVFCGTSRT | |
| RDYFTAEVS | | RDYFTAEVS | | RRRGLFGAIA | | SIVVFWGTSGT | |
| RECFNPCFY | | RECFNPCFY | | RRRKKRGLFG | | SIWFSHYNQIT | |
| REDKRYGPA | | REDKRYGPA | | RRRKRGLFGA | | SIWFSHYNQMK | |
| REEALLNRI | | REEALLNRI | | RRRTNLYGFI | | SIWFSHYNQMT | |
| REEALLNRL | | REEALLNRL | | RRRVDINPGH | | SIWFSHYNQVT | |
| REEAMQNRI | | REEAMQNRI | | RRRVDMNPGH | | SIWMCSNGSLQ | |
| REEAMQNRM | | REEAMQNRM | | RRRVDTNPGH | | SIWTSSSSTVF | |
| REEAMQNRV | | REEAMQNRV | | RRRVDVNPGH | | SIYASPQLEGF | |
| REESLLNRL | | REESLLNRL | | RRSGAAGAAI | | SIYIEVLHLTQ | |
| REESQLKKQ | | REESQLKKQ | | RRSGAAGAAV | | SIYQNSFVPVV | |
| REESQLKRQ | | REESQLKRQ | | RRSYFTAEVS | | SIYSCIASSIV | |
| REEVTNATE | | REEVTNATE | | RRTNLYGFII | | SIYSCIASSLI | |
| REFEVMNHE | | REFEVMNHE | | RRVDINPGHA | | SIYSCIASSLV | |
| REFEVVDHE | | REFEVVDHE | | RRVDINPGHS | | SIYSCIASSTV | |
| REFEVVNHE | | REFEVVNHE | | RRVDMNPGHA | | SIYSCIASSVV | |
| REFGVVNHE | | REFGVVNHE | | RRVDTNPGHA | | SIYSSVASSLV | |
| REGKHIVER | | REGKHIVER | | RRVDVNPGHA | | SIYSTVAASLC | |
| REGLILEYY | | REGLILEYY | | RRVENLNKKM | | SIYWTIVKPGD | |
| REGRNPGNA | | REGRNPGNA | | RRVWRQANNG | | SIYWTLVNPGD | |
| REGRRKTNL | | REGRRKTNL | | RRYELEIGTR | | SIYWTVVKPGD | |
| REGYSLVGI | | REGYSLVGI | | RRYGPALSIN | | SKACNALTGGQ | |
| REHLSSVSS | | REHLSSVSS | | RRYGPALSIS | | SKACNASTGAQ | |
| REICIAWSS | | REICIAWSS | | RSALILRGAV | | SKACNASTGGQ | |
| REIHIYYLE | | REIHIYYLE | | RSALILRGSI | | SKACSASTGGQ | |
| REILTKITV | | REILTKITV | | RSALILRGSV | | SKADKICIGYL | |
| REILTKTTV | | REILTKTTV | | RSAYERMCNI | | SKANQVFPQLN | |
| REILTRTTV | | REILTRTTV | | RSDKICIGYH | | SKCFWKGGSIK | |
| REITFHGAK | | REITFHGAK | | RSDKICLGHH | | SKCFWKGGSIN | |
| REKDMTKEF | | REKDMTKEF | | RSDQISIVPN | | SKCFWKSGSIN | |
| RELCTINSW | | RELCTINSW | | RSEKLVLATG | | SKCFWRGGSII | |
| RELGNGCFE | | RELGNGCFE | | RSESSFYAEM | | SKCFWRGGSIN | |
| RELVRKTRF | | RELVRKTRF | | RSFKPNIGPR | | SKCKTKEGRRK | |
| RELWQCYYL | | RELWQCYYL | | RSFQPNIGPR | | SKCQQSFTPSP | |
| REMTFHGAK | | REMTFHGAK | | RSFRPNIGPR | | SKCRTKEGRRK | |
| RENAEDIGN | | RENAEDIGN | | RSFSRTELIA | | SKCRTKEGRRR | |
| RENAEDKGN | | RENAEDKGN | | RSFSRTELIP | | SKCRTREGRRK | |
| RENAEDLGN | | RENAEDLGN | | RSGAAGAAIK | | SKCYNPCFYVE | |
| RENAEDMGD | | RENAEDMGD | | RSGAAGAAVK | | SKCYQFALGQG | |
| RENAEDMGG | | RENAEDMGG | | RSGFEIIWDP | | SKDNAIRIGED | |
| RENAEDMGN | | RENAEDMGN | | RSGFEILLIE | | SKDNAIRIGEE | |

Fig. 83-319

| Block size 8 | SIN | Block size 9 | SIN | Block size 10 | SIN | Block size 11 | SIN |
|---|---|---|---|---|---|---|---|
| RENAEDQGN | | RENAEDQGN | | RSGFEMIWDA | | SKDNAIRIGEG | |
| RENAEDRGN | | RENAEDRGN | | RSGFEMIWDP | | SKDNAIRIGEN | |
| RENAEEDCT | | RENAEEDCT | | RSGFEMLKIH | | SKDNAVRIGED | |
| RENAEEDGN | | RENAEEDGN | | RSGFEMLKIP | | SKDNGIRIGSK | |
| RENAEEDGT | | RENAEEDGT | | RSGFEMLKVP | | SKDNGIRIGSR | |
| REPFISCSH | | REPFISCSH | | RSGFEMLRIP | | SKDNGIRVGSR | |
| REPFISCSI | | REPFISCSI | | RSGFEMVWDA | | SKDNGVRIGSK | |
| REPFISCSP | | REPFISCSP | | RSGFEMVWDD | | SKDNNIRIGSK | |
| REPFISCSQ | | REPFISCSQ | | RSGFEMVWDP | | SKDNQVFPQLN | |
| REPFISCSV | | REPFISCSV | | RSGFEVLFIE | | SKDNSIQLSAG | |
| REPFVACGP | | REPFVACGP | | RSGFEVLLIE | | SKDNSIRIGSK | |
| REPFVACSP | | REPFVACSP | | RSGMDPRMCS | | SKDNSIRIGSR | |
| REPFVSCGP | | REPFVSCGP | | RSGPSFYAEM | | SKDNSIRLAAG | |
| REPFVSCSH | | REPFVSCSH | | RSGQNHGICA | | SKDNSIRLSAD | |
| REPFVSCSI | | REPFVSCSI | | RSGSSFYAEL | | SKDNSIRLSAG | |
| REPFVSCSP | | REPFVSCSP | | RSGSSFYAEM | | SKDNSIRLSAS | |
| REPYISCDN | | REPYISCDN | | RSGTSKACNA | | SKDNSVRIGSK | |
| REPYLSCDP | | REPYLSCDP | | RSGYEILKVP | | SKDNSVRLSAG | |
| REPYLSCGP | | REPYLSCGP | | RSGYEMLKVP | | SKDNSVRLSAS | |
| REPYVSCDN | | REPYVSCDN | | RSGYETFKVI | | SKDSRSGYETF | |
| REPYVSCDP | | REPYVSCDP | | RSGYETFRII | | SKEAQDVIMEV | |
| REPYVSCDS | | REPYVSCDS | | RSGYETFRVI | | SKEGSYFFGDN | |
| REPYVSCDT | | REPYVSCDT | | RSGYETFRVL | | SKEQGSGYAAD | |
| REPYVSCDY | | REPYVSCDY | | RSGYETFRVT | | SKEQLGSWSWH | |
| REPYVSCEP | | REPYVSCEP | | RSGYEVLKVP | | SKERLGSWSWH | |
| REPYVSCGP | | REPYVSCGP | | RSGYSGIFSV | | SKFESVAWSAS | |
| REPYVSCNP | | REPYVSCNP | | RSGYSGSFID | | SKFHSDTPRPA | |
| REPYVSCSL | | REPYVSCSL | | RSGYSGVFSV | | SKFHSDTPRPD | |
| REPYVSCSP | | REPYVSCSP | | RSGYWAIRTR | | SKFHSDTPRPT | |
| REQKQEFKM | | REQKQEFKM | | RSHEQMETGG | | SKFHSDTPRPV | |
| REQLSQKFE | | REQLSQKFE | | RSHKICIGYH | | SKFLLMDALKL | |
| REQLSSVSS | | REQLSSVSS | | RSHLRNDTDV | | SKFLLMDSLKL | |
| REQLSTVSS | | REQLSTVSS | | RSICEKLEQS | | SKGDIFVIREP | |
| REQQGRMDY | | REQQGRMDY | | RSIEEKFEIT | | SKGDIFVMREP | |
| REREGGRRR | | REREGGRRR | | RSIIFNMERI | | SKGDVFVIREP | |
| RERLGSWSW | | RERLGSWSW | | RSILANNGKF | | SKGDVFVMREP | |
| RESGGIDKE | | RESGGIDKE | | RSILANNGRF | | SKGHVFVIREP | |
| RESRNPGNA | | RESRNPGNA | | RSILASSGSL | | SKGLFGAIAGF | |
| RETRGLFGA | | RETRGLFGA | | RSILNTSQRG | | SKGSSKQQHKE | |
| REVCIAWSS | | REVCIAWSS | | RSINWLTKKE | | SKHYIGKCPKY | |
| REVEVVNAT | | REVEVVNAT | | RSINWLTKKK | | SKHYIGKCPRY | |
| REVHIYYLE | | REVHIYYLE | | RSIRWLTLKS | | SKIKMKWGMEL | |
| REVHMYYLE | | REVHMYYLE | | RSIVASSGTL | | SKIKMKWGMEM | |
| REVHTYYLE | | REVHTYYLE | | RSIVASSGTV | | SKINEVKLEEN | |
| REVHVYYLE | | REVHVYYLE | | RSIVRRATVS | | SKINGVILEEN | |
| REWSYIVER | | REWSYIVER | | RSKFLLMDAL | | SKINGVKLEEN | |
| REWSYLIED | | REWSYLIED | | RSKFLLMDSL | | SKINGVRLEEN | |
| RFADQELGD | | RFADQELGD | | RSKINEVKLE | | SKITLKFAFNM | |
| RFEAVAWSA | | RFEAVAWSA | | RSKINGVILE | | SKKKSYINKTG | |
| RFEFIAEEF | | RFEFIAEEF | | RSKINGVKLE | | SKKKSYINRTG | |
| RFEGWIVGN | | RFEGWIVGN | | RSKINGVRLE | | SKKRLGSWSWH | |
| RFEIIEGRD | | RFEIIEGRD | | RSKYWAIRTR | | SKLKRNEIKGV | |
| RFESVAWSA | | RFESVAWSA | | RSLFSSIKKY | | SKLKRQEIDGI | |
| RFGEGEQII | | RFGEGEQII | | RSLFSSIKRY | | SKLKRQEIEGI | |
| RFGESEQII | | RFGESEQII | | RSLIASSGTL | | SKLKRQEINGI | |
| RFGESEQIV | | RFGESEQIV | | RSLIQFPIGT | | SKLNRNEIKGV | |
| RFGESEQVI | | RFGESEQVI | | RSLIQFPMGT | | SKNILRTQESE | |
| RFIEIGVTR | | RFIEIGVTR | | RSLIRFPIGT | | SKNPYTLVSTK | |
| RFIEKTNQQ | | RFIEKTNQQ | | RSLIRFPIGV | | SKNSRSGYETF | |
| RFIQNALNG | | RFIQNALNG | | RSLIRFPVGT | | SKPFQNICKPY | |
| RFLEIGVTR | | RFLEIGVTR | | RSLISWPLSS | | SKPFQNTSKHY | |
| RFLFSSIKK | | RFLFSSIKK | | RSLKLAIGLR | | SKPFQNTSRHY | |

Fig. 83-320

| Block size 8 | SIN | Block size 9 | SIN | Block size 10 | SIN | Block size 11 | SIN |
|---|---|---|---|---|---|---|---|
| RFLPDLYDY | | RFLPDLYDY | | RSLKLATGLR | | SKPLQNTSKHY | |
| RFLPVAGGT | | RFLPVAGGT | | RSLLLATGMR | | SKPQCKITGFA | |
| RFLPVSGGT | | RFLPVSGGT | | RSLMLATGMR | | SKPQCQIAGFA | |
| RFLPVTGGT | | RFLPVTGGT | | RSLVASSGNL | | SKPQCQITGFA | |
| RFLRVKDQQ | | RFLRVKDQQ | | RSLVASSGTL | | SKRGGSGIMKT | |
| RFLRVRDQL | | RFLRVRDQL | | RSLWDSFRQS | | SKRGNSGIMKT | |
| RFLRVRDQM | | RFLRVRDQM | | RSMKWLTLKS | | SKRGSSGIMKT | |
| RFLRVRDQQ | | RFLRVRDQQ | | RSMRWLTLKL | | SKRGSSGIVKT | |
| RFLRVRDQR | | RFLRVRDQR | | RSMRWLTLKS | | SKRGSSGVMKT | |
| RFNSDLDYQ | | RFNSDLDYQ | | RSNAPSGIEY | | SKRKSYINKTG | |
| RFNSDPDYQ | | RFNSDPDYQ | | RSNAPSGVEY | | SKRLVLATGLR | |
| RFNSNLDYQ | | RFNSNLDYQ | | RSNENPAHKS | | SKRYELEIGAR | |
| RFQIQGIKL | | RFQIQGIKL | | RSNIFNMERI | | SKRYELEIGTR | |
| RFQIQGVKL | | RFQIQGVKL | | RSPFRALISW | | SKSLCKVEGWV | |
| RFQIQGVRL | | RFQIQGVRL | | RSPFRALVSW | | SKSRGYKMNIQ | |
| RFRRPDSSW | | RFRRPDSSW | | RSPFRTLMSC | | SKSRGYKMNNQ | |
| RFSYVFCLA | | RFSYVFCLA | | RSPFRTLMSV | | SKSRGYKMNTK | |
| RFTEIGVTR | | RFTEIGVTR | | RSPGNAEIED | | SKSRGYKMNTQ | |
| RFTNEEALR | | RFTNEEALR | | RSPHRALMSC | | SKSRGYKMNTR | |
| RFTYSGIRT | | RFTYSGIRT | | RSPHRSLMSC | | SKSRSIIFNME | |
| RFVEIGVTR | | RFVEIGVTR | | RSPHRTLLMN | | SKSRSNIFNME | |
| RFVFSIAAS | | RFVFSIAAS | | RSPHRTLMSC | | SKSRTKEGRRK | |
| RFVFSNAAS | | RFVFSNAAS | | RSPQRTLMSC | | SKSRVDNHSMS | |
| RFVFSSAAS | | RFVFSSAAS | | RSPYRALISW | | SKSTKSTVLKS | |
| RFVNSDCSK | | RFVNSDCSK | | RSPYRALMSC | | SKTQCQITGFA | |
| RFVQNALNG | | RFVQNALNG | | RSPYRALMSV | | SKVKMKWGMEM | |
| RFVQNALSG | | RFVQNALSG | | RSPYRTLMSC | | SKVTCVCRDNW | |
| RFYALSQGT | | RFYALSQGT | | RSPYRTLMSV | | SKWGDILEGTT | |
| RFYIQMCTE | | RFYIQMCTE | | RSQFRALISW | | SKWGDVLDGVT | |
| RFYRICKLV | | RFYRICKLV | | RSQSGRISFY | | SKWGNVLDGVT | |
| RFYRTCKLL | | RFYRTCKLL | | RSQYRALISW | | SKWNVTYTGTS | |
| RFYRTCKLV | | RFYRTCKLV | | RSQYRALVSW | | SKYEEESKLNR | |
| RFYVQMCTE | | RFYVQMCTE | | RSQYRSLISW | | SKYHWNLALDI | |
| RGANRPVIT | | RGANRPVIT | | RSRNGFEMLK | | SKYLQSFTPSP | |
| RGAYERMCN | | RGAYERMCN | | RSRSGFEMLK | | SKYQQSFSPSP | |
| RGCFEIYHK | | RGCFEIYHK | | RSRSGFEMLR | | SKYQQSFTPSP | |
| RGDKICLGH | | RGDKICLGH | | RSRSSFYAEM | | SKYRQSFSPSP | |
| RGDLNFVNR | | RGDLNFVNR | | RSRYWAIRTR | | SKYWAIRTRSG | |
| RGDNGRRTR | | RGDNGRRTR | | RSSCHDGKAW | | SLAVNVRGSGM | |
| RGDQICIGY | | RGDQICIGY | | RSSFYAEMKW | | SLCEVNSWHIL | |
| RGDQICVGY | | RGDQICVGY | | RSSSSFYAEM | | SLCKIEGWVVV | |
| RGDYNNTTG | | RGDYNNTTG | | RSTIGDCPKY | | SLCKVEEWVVV | |
| RGEDTIEER | | RGEDTIEER | | RSWKKQILRT | | SLCKVEGWVVV | |
| RGEETIEEK | | RGEETIEEK | | RSWMKIYWHL | | SLCLAILIAGG | |
| RGEETIEER | | RGEETIEER | | RSWMKLYWHL | | SLCLAILVAGG | |
| RGEETVEER | | RGEETVEER | | RSWRKKILRT | | SLCLAVLIAGG | |
| RGEFNQVEK | | RGEFNQVEK | | RSWRKQILRT | | SLCNVEGWVVI | |
| RGEFNQVEN | | RGEFNQVEN | | RSWRRQILRT | | SLCNVEGWVVV | |
| RGEFNQVEQ | | RGEFNQVEQ | | RSWSKPQCQI | | SLCSIWFSHYN | |
| RGEFSQVEQ | | RGEFSQVEQ | | RSYEQMETDG | | SLCSVEGWVVI | |
| RGEFSQVER | | RGEFSQVER | | RSYEQMETGE | | SLDEQNKLYGA | |
| RGENGRKTR | | RGENGRKTR | | RSYEQMETGG | | SLDEQNKLYGT | |
| RGENGRRTR | | RGENGRRTR | | RSYEQMETSG | | SLDGKAPISLG | |
| RGETLKIRT | | RGETLKIRT | | RSYNNTSGEQ | | SLDKICLGHHA | |
| RGETTGRNC | | RGETTGRNC | | RSYNNTSGKQ | | SLEFIAEQFTW | |
| RGEVFVIRE | | RGEVFVIRE | | RTAFRGLIST | | SLEGIILGNPK | |
| RGFAPFSKD | | RGFAPFSKD | | RTAFRGLMST | | SLEGLILGNPK | |
| RGFEMVWDA | | RGFEMVWDA | | RTATREGKHI | | SLEGLILSNPK | |
| RGFFGAIAG | | RGFFGAIAG | | RTAYERMCNI | | SLEGLVLGNPK | |
| RGFFPFHKD | | RGFFPFHKD | | RTCKLLGINM | | SLERRLENLNK | |
| RGFLIIGKE | | RGFLIIGKE | | RTCKLVGINM | | SLESRSGFEMI | |
| RGFLILGKE | | RGFLILGKE | | RTDGATSACK | | SLESRSGFEMV | |

Fig. 83-321

| Block size 8 | SIN | Block size 9 | SIN | Block size 10 | SIN | Block size 11 | SIN |
|---|---|---|---|---|---|---|---|
| RGFLILGRE | | RGFLILGRE | | RTELINPNKW | | SLFEKFFPSSS | |
| RGFVHFVEA | | RGFVHFVEA | | RTELINPSKW | | SLFSSIKKYER | |
| RGFVYFVEA | | RGFVYFVEA | | RTELIPPSKW | | SLFSSIKRYER | |
| RGFVYFVEI | | RGFVYFVEI | | RTELISPNKW | | SLGAISFWMCS | |
| RGFVYFVET | | RGFVYFVET | | RTELISPSKW | | SLGAVSFWMCS | |
| RGGRNSFFS | | RGGRNSFFS | | RTESLQNRIQ | | SLGDCSFAGWI | |
| RGGSGIMKT | | RGGSGIMKT | | RTFFLTHGAL | | SLGDCSFAGWL | |
| RGGSINTKL | | RGGSINTKL | | RTFFLTHGSL | | SLGDCSFTGWI | |
| RGGSINTRL | | RGGSINTRL | | RTFFLTQGAL | | SLGIQSDAQID | |
| RGHIFVIRE | | RGHIFVIRE | | RTFFLTQGSL | | SLIALCGSPFP | |
| RGHVFVIRE | | RGHVFVIRE | | RTFLAMITYI | | SLIALCGSPFS | |
| RGHYKISKS | | RGHYKISKS | | RTFQNIDKNA | | SLIASSGTLEF | |
| RGIEVVNAT | | RGIEVVNAT | | RTFQNIDRNA | | SLIIAARNIVR | |
| RGIFGAIAG | | RGIFGAIAG | | RTFQNVSPLW | | SLIIAARSIVR | |
| RGILEDEQM | | RGILEDEQM | | RTFSFQLILI | | SLIMRTVIALS | |
| RGINDRNFW | | RGINDRNFW | | RTFSFQLILL | | SLIQFPIGTAP | |
| RGIPPLELG | | RGIPPLELG | | RTFSFQLINN | | SLIQFPMGTAP | |
| RGIQIASNE | | RGIQIASNE | | RTFSPRSRSG | | SLIRFPIGTAP | |
| RGKHSNGTI | | RGKHSNGTI | | RTGMDPRMCS | | SLIRFPIGVAP | |
| RGKLKRRAI | | RGKLKRRAI | | RTGSLQNRIQ | | SLIRFPVGTAP | |
| RGLCTINSW | | RGLCTINSW | | RTGTFEFTSF | | SLISWPLSSPP | |
| RGLFGAIAG | | RGLFGAIAG | | RTHESECVCI | | SLIWLWLVLRE | |
| RGLFGAKAG | | RGLFGAKAG | | RTHQYSEKGK | | SLKGLILGNPK | |
| RGLISTHLG | | RGLISTHLG | | RTHQYSEKGR | | SLKLAIGLRNV | |
| RGLISTPLG | | RGLISTPLG | | RTHQYSERGK | | SLKLAIGPRNV | |
| RGLISTQLG | | RGLISTQLG | | RTHQYSERGR | | SLKLASGLRNV | |
| RGLLEVGTR | | RGLLEVGTR | | RTINTASRSG | | SLKLATGLRNI | |
| RGLLGAIAG | | RGLLGAIAG | | RTIQNEDIPI | | SLKLATGLRNV | |
| RGLLSTPLG | | RGLLSTPLG | | RTISIASRSG | | SLKLATGMRNI | |
| RGLMSTPLG | | RGLMSTPLG | | RTISKDLRSG | | SLKLATGPRNV | |
| RGLQRRRFI | | RGLQRRRFI | | RTISKDSRSG | | SLKLVTGLRNV | |
| RGLQRRRFV | | RGLQRRRFV | | RTISKDTRSG | | SLLEMCHGTQI | |
| RGLSSRISF | | RGLSSRISF | | RTISMDSRSG | | SLLEMCHSTQI | |
| RGLWDPFRQ | | RGLWDPFRQ | | RTISPKLRSG | | SLLEMCHSTRI | |
| RGLWDSFRQ | | RGLWDSFRQ | | RTISPRLRSG | | SLLHKCNDSCM | |
| RGNGCFEIF | | RGNGCFEIF | | RTISPRSRNG | | SLLLATGMKNV | |
| RGNILLSPE | | RGNILLSPE | | RTISPRSRSG | | SLLLATGMRNI | |
| RGNIRCNIC | | RGNIRCNIC | | RTISRDSRSG | | SLLLATGMRNV | |
| RGNPGVKGW | | RGNPGVKGW | | RTISTASRAG | | SLLLLQANLCR | |
| RGNQGVKGW | | RGNQGVKGW | | RTISTASRSG | | SLLLQANLCRF | |
| RGNSGIMKT | | RGNSGIMKT | | RTISTASRYG | | SLLNDKHSNGT | |
| RGNSPAFNY | | RGNSPAFNY | | RTIWTSGSSI | | SLLNDKHSSGT | |
| RGNSPIFNY | | RGNSPIFNY | | RTKEGRRKTN | | SLLNDRHSNGT | |
| RGNSPVFNY | | RGNSPVFNY | | RTKEGRRRTN | | SLLNRLSINPV | |
| RGNVLLSPE | | RGNVLLSPE | | RTKEMEGICY | | SLLQSAILSLQ | |
| RGQAADLKS | | RGQAADLKS | | RTKNLESRSG | | SLLTEVETYVL | |
| RGQHANGTI | | RGQHANGTI | | RTKSGGNTNQ | | SLMLATGMKNV | |
| RGQPKEKAI | | RGQPKEKAI | | RTKSLESRSG | | SLMLATGMRNI | |
| RGQPKEKTI | | RGQPKEKTI | | RTLDFHDFNV | | SLMLATGMRNV | |
| RGQPKERTI | | RGQPKERTI | | RTLDFHDLNV | | SLMQGSTLPRR | |
| RGQQGRMDY | | RGQQGRMDY | | RTLDFHDSNV | | SLMWEINGPES | |
| RGQQGTMDY | | RGQQGTMDY | | RTLDLHDANV | | SLNGISPIHLG | |
| RGQQGWMDY | | RGQQGWMDY | | RTLDLHDSNV | | SLNGISPVHLG | |
| RGQSGRISF | | RGQSGRISF | | RTLDMHDANV | | SLNGVSPIHLG | |
| RGQSGRVSF | | RGQSGRVSF | | RTLDQHDANV | | SLNGVSPVHLG | |
| RGQYSGFVR | | RGQYSGFVR | | RTLDYHDSNV | | SLNILRTQESE | |
| RGRGSTLGL | | RGRGSTLGL | | RTLEFHDSNV | | SLNITAASLND | |
| RGRGVFELS | | RGRGVFELS | | RTLFQQMRDI | | SLNKKMEDGFL | |
| RGRHANGTI | | RGRHANGTI | | RTLFQQMRDV | | SLPLALGMKNV | |
| RGRHANGTM | | RGRHANGTM | | RTLGFHDSNV | | SLPLCPFKGFF | |
| RGRHSNGTI | | RGRHSNGTI | | RTLGLHDANV | | SLPLCPFQGFF | |
| RGRIDYFWS | | RGRIDYFWS | | RTLISWEMGQ | | SLPLCPFRGFF | |

Fig. 83-322

| Block size 8 | SIN | Block size 9 | SIN | Block size 10 | SIN | Block size 11 | SIN |
|---|---|---|---|---|---|---|---|
| RGRIDYYWS | | RGRIDYYWS | | RTLLAKSVFN | | SLPNDKHSNGT | |
| RGRIFQSRI | | RGRIFQSRI | | RTLLMNELGI | | SLQCRICIDFR | |
| RGRLCNPLN | | RGRLCNPLN | | RTLLMNELGV | | SLQCRICILDQ | |
| RGRPEEAKY | | RGRPEEAKY | | RTLLMSELGV | | SLQCRICIRAD | |
| RGRPEEVKY | | RGRPEEVKY | | RTLMSCPIGE | | SLQNRIQIDPV | |
| RGRPKEDEV | | RGRPKEDEV | | RTLMSCPIGV | | SLQNRIQIDQV | |
| RGRPKEDKV | | RGRPKEDKV | | RTLMSCPMGV | | SLQNRIQIDSV | |
| RGRPKEDRV | | RGRPKEDRV | | RTLMSCPVGE | | SLQQIESIIEA | |
| RGRPKEEKV | | RGRPKEEKV | | RTLMSCPVGV | | SLQQIESMIEA | |
| RGSARHIEE | | RGSARHIEE | | RTLMSVEIGQ | | SLQQIESMVEA | |
| RGSFYRSMR | | RGSFYRSMR | | RTLMSVEVGQ | | SLQQVESMIEA | |
| RGSGGIDKE | | RGSGGIDKE | | RTLMSVGIGQ | | SLRGRGSTLGL | |
| RGSGLRILI | | RGSGLRILI | | RTLMSVKIGQ | | SLRLAIGLRNT | |
| RGSGLRILV | | RGSGLRILV | | RTLMSVKVGQ | | SLRLALGLRNT | |
| RGSGMRILI | | RGSGMRILI | | RTLTLNTMTK | | SLRLATGLRNI | |
| RGSGMRILV | | RGSGMRILV | | RTLYFHDSNV | | SLRLATGLRNV | |
| RGSIAHKSC | | RGSIAHKSC | | RTNEKFHQIE | | SLRLATGMRNI | |
| RGSNRPIVD | | RGSNRPIVD | | RTNEKYHQIE | | SLRLAVGLRNT | |
| RGSNRPWIR | | RGSNRPWIR | | RTNGNLIAPE | | SLRMKWMMAMK | |
| RGSPGVKGW | | RGSPGVKGW | | RTNGTSKIKM | | SLRSILANNGK | |
| RGSSGIMKT | | RGSSGIMKT | | RTNGTSKVKM | | SLRSILANNGR | |
| RGSSGIVKT | | RGSSGIVKT | | RTNHQFELID | | SLRSILASSGS | |
| RGSSGVMKT | | RGSSGVMKT | | RTNLYGFIIK | | SLRSIVASSGT | |
| RGSTLGLDI | | RGSTLGLDI | | RTNQQFELID | | SLRSLIASSGT | |
| RGSTQKAID | | RGSTQKAID | | RTPHRTLLMN | | SLRSLVASSGT | |
| RGSVAHKSC | | RGSVAHKSC | | RTPIAFLTSS | | SLRSLVGSSGT | |
| RGSYNNTSG | | RGSYNNTSG | | RTPYRSLIKF | | SLSISIGSSTY | |
| RGTGMRILV | | RGTGMRILV | | RTPYRSLIQF | | SLSISVESSTY | |
| RGTNSFYRN | | RGTNSFYRN | | RTPYRSLIRF | | SLSISVGSSTY | |
| RGTQGVKGW | | RGTQGVKGW | | RTPYRTLLMN | | SLSLAIMIAGI | |
| RGVEVVDAT | | RGVEVVDAT | | RTQDSECVSH | | SLSLAIMMAGI | |
| RGVEVVNAT | | RGVEVVNAT | | RTQESECACI | | SLSLAIMVAGI | |
| RGVFEFSDE | | RGVFEFSDE | | RTQESECACV | | SLSPGMMMGMF | |
| RGVFELSDE | | RGVFELSDE | | RTQESECICI | | SLSYSAGALAS | |
| RGVKGFGFK | | RGVKGFGFK | | RTQESECLCI | | SLSYSTGALAS | |
| RGVLEDEQM | | RGVLEDEQM | | RTQESECQCI | | SLTEIWSYNAE | |
| RGVNDRNFW | | RGVNDRNFW | | RTQESECQCL | | SLTHALRELWQ | |
| RGVQIASNE | | RGVQIASNE | | RTQESECQRI | | SLTKGVLGFVF | |
| RGVQVASNE | | RGVQVASNE | | RTQESECVCH | | SLTSLPFQNIH | |
| RGWAPLSKD | | RGWAPLSKD | | RTQESECVCI | | SLTVNVRGSGL | |
| RGYKMNIQI | | RGYKMNIQI | | RTQESECVCM | | SLTVNVRGSGM | |
| RGYKMNNQI | | RGYKMNNQI | | RTQESECVCQ | | SLTVNVRGTGM | |
| RGYKMNTKI | | RGYKMNTKI | | RTQESECVCV | | SLTVSVRGSGM | |
| RGYKMNTQI | | RGYKMNTQI | | RTQESECVRH | | SLVALCGSPIS | |
| RGYKMNTRI | | RGYKMNTRI | | RTQESSCTCI | | SLVALCGSPVP | |
| RGYPGVKGW | | RGYPGVKGW | | RTQESSCVCI | | SLVALCGSPVS | |
| RHANGTIHD | | RHANGTIHD | | RTQESSCVCM | | SLVASSGNLEF | |
| RHANGTIND | | RHANGTIND | | RTQESSCVCV | | SLVASSGTLEF | |
| RHANGTMHD | | RHANGTMHD | | RTRALVRSGM | | SLVGIDPFKLL | |
| RHCSKYHWN | | RHCSKYHWN | | RTRALVRTGM | | SLVGIDPFRLL | |
| RHENRMVIA | | RHENRMVIA | | RTREGRRKTN | | SLVGVDPFKLL | |
| RHENRMVLA | | RHENRMVLA | | RTREILTKIT | | SLVGVDPFRLL | |
| RHFEKVKIL | | RHFEKVKIL | | RTREILTKTT | | SLVIAARNIVR | |
| RHFQKDAKI | | RHFQKDAKI | | RTREILTRTT | | SLVLLFMIIGG | |
| RHFQKDAKM | | RHFQKDAKM | | RTRGILTKTT | | SLVLLLMIIGG | |
| RHFQKDAKV | | RHFQKDAKV | | RTRGLFGAIA | | SLWDSFRQSER | |
| RHFQKDARV | | RHFQKDARV | | RTRSGGNNNQ | | SLWMCSNGSLQ | |
| RHFQKNAKV | | RHFQKNAKV | | RTRSGGNTNH | | SLYASPQLEGF | |
| RHHMGECPK | | RHHMGECPK | | RTRSGGNTNQ | | SLYASSQLEGF | |
| RHHNSEGTG | | RHHNSEGTG | | RTRSGGNTSQ | | SLYDKVRMQLR | |
| RHIEECPCY | | RHIEECPCY | | RTSDMRAEII | | SLYSSPQLEGF | |
| RHIEECSCY | | RHIEECSCY | | RTSDMRTEII | | SLYWTIVEPGD | |

Fig. 83-323

| Block size 8 | SIN | Block size 9 | SIN | Block size 10 | SIN | Block size 11 | SIN |
|---|---|---|---|---|---|---|---|
| RHIEEWSCY | | RHIEEWSCY | | RTSDMRTEVI | | SMAPIMFSNKM | |
| RHLEECSCY | | RHLEECSCY | | RTSHRTLLMN | | SMCSSTEFLGQ | |
| RHLFSGIKS | | RHLFSGIKS | | RTSISCLYKL | | SMDSRSGYETF | |
| RHLFSGIRS | | RHLFSGIRS | | RTSIWTSSSS | | SMEFSLTDPKL | |
| RHLFSGVNS | | RHLFSGVNS | | RTSYRSLIRF | | SMEFSLTDPRF | |
| RHQLRENAE | | RHQLRENAE | | RTTFESNGGL | | SMEFSLTDPRL | |
| RHQNAEGTG | | RHQNAEGTG | | RTTFRGLIST | | SMELPSFGVSG | |
| RHQNAQGEG | | RHQNAQGEG | | RTTFRGLLST | | SMGEAMVSRAR | |
| RHQNAQGIG | | RHQNAQGIG | | RTTNTYRNTD | | SMGFRYSGIRT | |
| RHQNAQGQG | | RHQNAQGQG | | RTTSKDSRSG | | SMGIYQILAIY | |
| RHQNAQGTG | | RHQNAQGTG | | RTTVDHMAII | | SMGVYQILAIY | |
| RHQNSEGIG | | RHQNSEGIG | | RTVGQCPKYV | | SMMEAMVSRAR | |
| RHQNSEGMG | | RHQNSEGMG | | RTVSSFYSEM | | SMMWEINGPDS | |
| RHQNSEGRG | | RHQNSEGRG | | RTWAKNILRT | | SMMWEINGPES | |
| RHQNSEGTG | | RHQNSEGTG | | RTYNNTTGRD | | SMMWEVNGPES | |
| RHQNSQGEG | | RHQNSQGEG | | RTYVDGFEPN | | SMNNQVFPQLN | |
| RHRLKITEN | | RHRLKITEN | | RTYVDGFKPN | | SMPFHNIHPHT | |
| RHSNEQGSG | | RHSNEQGSG | | RVARCNTKCQ | | SMPFHNIHPLT | |
| RHSNGTIHD | | RHSNGTIHD | | RVAYERMCNI | | SMPFHNVHPLT | |
| RHSNGTVKD | | RHSNGTVKD | | RVDDAVTDIW | | SMPLHNIHPLT | |
| RHYIGKCPK | | RHYIGKCPK | | RVDDAVTDVW | | SMSCFVFVALI | |
| RHYMGECPE | | RHYMGECPE | | RVDINPGHAD | | SMSDIEAMASQ | |
| RHYMGECPK | | RHYMGECPK | | RVDINPGHSD | | SMSGFRSNLPG | |
| RHYMGECPN | | RHYMGECPN | | RVDKLTQGRQ | | SMTEIWSYNAE | |
| RIAIGNCPK | | RIAIGNCPK | | RVDMNPGHAD | | SMTEVWSYNAE | |
| RIAWSSSSC | | RIAWSSSSC | | RVDNHSMSDI | | SMVEAMISRAR | |
| RIAYERMCN | | RIAYERMCN | | RVDRLTQGRQ | | SMVEAMMSRAR | |
| RICEKLEQS | | RICEKLEQS | | RVDTIIESNV | | SMVEAMVSRAR | |
| RICIDFRDM | | RICIDFRDM | | RVDTIMEKNV | | SMVFCGVSGEV | |
| RICIGYHAN | | RICIGYHAN | | RVDTNPGHAD | | SMVKSDKICLG | |
| RICIGYLST | | RICIGYLST | | RVDVNPGHAD | | SMVRSDKICLG | |
| RICIGYQSN | | RICIGYQSN | | RVECIGWSST | | SMVTFCGLDNE | |
| RICILDQNF | | RICILDQNF | | RVFLAMITYI | | SNAASYKRIRL | |
| RICKLVGIN | | RICKLVGIN | | RVFLTMITYI | | SNAEGTGMAAD | |
| RICLGHHAV | | RICLGHHAV | | RVGCVILLNP | | SNAIDEGDGCF | |
| RICVGYHAN | | RICVGYHAN | | RVGSRGHVFV | | SNAITRSGQNH | |
| RICVGYLST | | RICVGYLST | | RVKKQLRENA | | SNALLKHRFEI | |
| RIDARIDFE | | RIDARIDFE | | RVKMFDFIKW | | SNAPSGIEYNG | |
| RIDARVDFE | | RIDARVDFE | | RVKMFDFSKW | | SNAPSGVEYNG | |
| RIDDAVTDI | | RIDDAVTDI | | RVKMFDFTKW | | SNAQAFYKILK | |
| RIDDAVTDV | | RIDDAVTDV | | RVKRQLRENA | | SNAYQAKFESV | |
| RIDFESGRI | | RIDFESGRI | | RVKRRPVAKA | | SNCKDPNNERG | |
| RIDFESGRM | | RIDFESGRM | | RVRHQLRENA | | SNCRDPNNERG | |
| RIDFESGRV | | RIDFESGRV | | RVRKQLRENA | | SNCRNPNNEKG | |
| RIDFHWLFL | | RIDFHWLFL | | RVRKQLRQNA | | SNCRNPNNERG | |
| RIDFHWLIL | | RIDFHWLIL | | RVRLFDYSRW | | SNDNWSGYSGS | |
| RIDFHWLLL | | RIDFHWLLL | | RVRLQLRDNA | | SNDQGAGYAAD | |
| RIDFHWLML | | RIDFHWLML | | RVRMQLRDNA | | SNDQGSGYAAD | |
| RIDFHWMLL | | RIDFHWMLL | | RVRNGTYDHK | | SNDTINYYNET | |
| RIDFNWLLL | | RIDFNWLLL | | RVRNQSGRIS | | SNEGSYFFGDN | |
| RIDYFWSIL | | RIDYFWSIL | | RVRRQLRENA | | SNEGSYFFGDS | |
| RIDYYWSFL | | RIDYYWSFL | | RVSFYWTIVE | | SNENPAHKSQL | |
| RIDYYWSIL | | RIDYYWSIL | | RVSKMGVDEY | | SNEQGSGYAAD | |
| RIDYYWSML | | RIDYYWSML | | RVSKTGVDEY | | SNETILETGYV | |
| RIDYYWSVL | | RIDYYWSVL | | RVSKVGVDEY | | SNGGFLAPRYG | |
| RIECIGWSS | | RIECIGWSS | | RVSRMGVDEY | | SNGGLIAPRYG | |
| RIENLNKKI | | RIENLNKKI | | RVTCVCRDNW | | SNGGLLAPKYG | |
| RIENLNKKM | | RIENLNKKM | | RVTDSIKSWR | | SNGGLLAPRYG | |
| RIENLNKKV | | RIENLNKKV | | RVTVSTRSDQ | | SNGNCRFNVCI | |
| RIENLNRKM | | RIENLNRKM | | RVWRQANNGE | | SNGNFIAPENA | |
| RIENLNRKV | | RIENLNRKV | | RVWWTSNSIA | | SNGNFIAPEYA | |
| RIESLNKKM | | RIESLNKKM | | RVWWTSNSII | | SNGNFITPEYA | |

Fig. 83-324

| Block size 8 | SIN | Block size 9 | SIN | Block size 10 | SIN | Block size 11 | SIN |
|---|---|---|---|---|---|---|---|
| RIFLAMITY | | RIFLAMITY | | RVWWTSNSIV | | SNGNLIAPEYG | |
| RIFQPNIGP | | RIFQPNIGP | | RVWWTTNSIV | | SNGNLIAPRGY | |
| RIFQSGIRM | | RIFQSGIRM | | RVYVDGFEPN | | SNGNLIAPWYA | |
| RIFQSGVRL | | RIFQSGVRL | | RWALGENMAP | | SNGNLVAPRGY | |
| RIFQSGVRM | | RIFQSGVRM | | RWETTGRNCT | | SNGNLVAPWYA | |
| RIFQSGVRV | | RIFQSGVRV | | RWKHVTNTIL | | SNGQGSGYAAD | |
| RIFQSRIRM | | RIFQSRIRM | | RWLTLKLGQF | | SNGSCRCTICI | |
| RIFRPNIGP | | RIFRPNIGP | | RWLTLKSEQF | | SNGSCRFNVCI | |
| RIGDGQRSW | | RIGDGQRSW | | RWLTLKSGQF | | SNGSLQCKICI | |
| RIGEDAHIL | | RIGEDAHIL | | RWMKIIRVGC | | SNGSLQCRICI | |
| RIGEDAHVL | | RIGEDAHVL | | RWPGLVAGWY | | SNGSLQCRVCI | |
| RIGEDSDIL | | RIGEDSDIL | | RYELEIGARI | | SNGSLQCTICI | |
| RIGEDSDVL | | RIGEDSDVL | | RYELEIGTRI | | SNGSLQFRICI | |
| RIGEEAHIL | | RIGEEAHIL | | RYERVKMFDF | | SNGSLRCRICI | |
| RIGEGAHIL | | RIGEGAHIL | | RYGDGVWIGR | | SNGTIHDRAAF | |
| RIGEGQRSW | | RIGEGQRSW | | RYGFVANFSM | | SNGTIHDRSQY | |
| RIGENAHIL | | RIGENAHIL | | RYGNGVWIGR | | SNGTIHDRTAF | |
| RIGENSDVL | | RIGENSDVL | | RYGPALSINE | | SNGTIHDRTTF | |
| RIGENSGVL | | RIGENSGVL | | RYGPALSISE | | SNGTIKDRSPY | |
| RIGGNSDVL | | RIGGNSDVL | | RYGVKGFSFR | | SNGTKINTLTE | |
| RIGSCTSPC | | RIGSCTSPC | | RYGYIIEEYG | | SNGTKVNTLTE | |
| RIGSKGDIF | | RIGSKGDIF | | RYGYIIEKYG | | SNGTMKDRSPY | |
| RIGSKGDVF | | RIGSKGDVF | | RYICSGLVGD | | SNGTTHDRTAF | |
| RIGSKGHVF | | RIGSKGHVF | | RYIPSGSLKL | | SNGTVKDRSPF | |
| RIGSRGDVF | | RIGSRGDVF | | RYLEEHPSAG | | SNGTVKDRSPY | |
| RIGSRGEVF | | RIGSRGEVF | | RYLEENPSAG | | SNGVQDIIDND | |
| RIGSRGHIF | | RIGSRGHIF | | RYLPDLYDYK | | SNGVQDIIDNN | |
| RIGSRGHVF | | RIGSRGHVF | | RYNGQRSWMK | | SNIFNMERIKE | |
| RIIEKTNQQ | | RIIEKTNQQ | | RYPDVRCVCR | | SNIGLNVSLHL | |
| RIIQNEDIP | | RIIQNEDIP | | RYPNVRCVCR | | SNINIREWSYL | |
| RIITSESQL | | RIITSESQL | | RYREEAMQNR | | SNKMARLGKGY | |
| RIKINPVTL | | RIKINPVTL | | RYSGFVRTLF | | SNKMARLGRGY | |
| RIKTRLFTI | | RIKTRLFTI | | RYSGIKTDGA | | SNKVARLGKGY | |
| RILASESQL | | RILASESQL | | RYSGIRTDGA | | SNLDYQIGYVC | |
| RILCTSATA | | RILCTSATA | | RYSIADKICI | | SNLNDATYQRT | |
| RILEEESDE | | RILEEESDE | | RYSKADKICI | | SNLNDTTYQRT | |
| RILFIEEGK | | RILFIEEGK | | RYSRADKICI | | SNLYNIRNLHI | |
| RILFIKEGK | | RILFIKEGK | | RYTYRCHKGD | | SNMGIYQILAI | |
| RILFIREGK | | RILFIREGK | | RYTYRCHRGD | | SNMGVYQILAI | |
| RILFVKEGK | | RILFVKEGK | | RYVCSGLVGD | | SNMGVYQVLAI | |
| RILIRGNSP | | RILIRGNSP | | RYVCSKFHSD | | SNMSLNISLYS | |
| RILKENAID | | RILKENAID | | RYVCTGILTD | | SNNATDTVDTL | |
| RILKENALD | | RILKENALD | | RYVEDTKIDL | | SNNDWSGYSGS | |
| RILRTQESE | | RILRTQESE | | RYVKQGSLKL | | SNNGVKGFSYL | |
| RILSIYSTV | | RILSIYSTV | | RYVKQSSLPL | | SNNRSGYSGIF | |
| RILTDTSRP | | RILTDTSRP | | RYWAIRTRSG | | SNNSSDTVDTL | |
| RILTSESQL | | RILTSESQL | | RYYMGECPKY | | SNNSTDKIDTL | |
| RILTSESQM | | RILTSESQM | | SAAFEDLRIS | | SNNSTDKVDTI | |
| RILVRGNSP | | RILVRGNSP | | SAAFEDLRLL | | SNNSTDKVDTL | |
| RIMFESNGG | | RIMFESNGG | | SAAFEDLRVL | | SNNSTDKVNTI | |
| RIMINPVKL | | RIMINPVKL | | SAAFEDLRVS | | SNNSTDTVDTL | |
| RINGVKLEE | | RINGVKLEE | | SAASYKRIRL | | SNNSTDTVNTL | |
| RINMIADRV | | RINMIADRV | | SAASYKRVRL | | SNNSTEKVDTI | |
| RINMINDKI | | RINMINDKI | | SACHDGASWL | | SNNSTERVDTI | |
| RINMINSKI | | RINMINSKI | | SACHDGISWL | | SNNSTNTVNTL | |
| RINMINSQI | | RINMINSQI | | SACHDGSSWL | | SNNTTNYYNET | |
| RINMISDKI | | RINMISDKI | | SACHDGTNWL | | SNNTVKDRSPY | |
| RINMLADRI | | RINMLADRI | | SACHDGTSWL | | SNNWSGYSGIF | |
| RINMLADRV | | RINMLADRV | | SACITPNGSI | | SNPITGSPGAP | |
| RINMLADWV | | RINMLADWV | | SACKRTVSSF | | SNPITGSPSAP | |
| RINNETILE | | RINNETILE | | SACLRGGRNS | | SNPKCDLYLNG | |
| RINNETIVE | | RINNETIVE | | SACYNPCFYV | | SNQASYKIFKS | |

Fig. 83-325

| Block size 8 | SIN | Block size 9 | SIN | Block size 10 | SIN | Block size 11 | SIN |
|---|---|---|---|---|---|---|---|
| RINRQEIEG | | RINRQEIEG | | SADHRIYWIR | | SNQDSFYRSMK | |
| RINTINSKI | | RINTINSKI | | SADHRVYWIR | | SNQGSFYRNMR | |
| RINVINDKI | | RINVINDKI | | SADMSIGITV | | SNQGSFYRSIR | |
| RIPHRTLLM | | RIPHRTLLM | | SADMSIGVAV | | SNQGSFYRSMR | |
| RIPNAGIDP | | RIPNAGIDP | | SADMSIGVTV | | SNRGSFYRSMR | |
| RIQDIWAYN | | RIQDIWAYN | | SADPLASLLE | | SNRPWIRFNSD | |
| RIQDLEKYV | | RIQDLEKYV | | SADPLLSLLE | | SNRPWIRFNSN | |
| RIQDLERYV | | RIQDLERYV | | SADPLVSLLE | | SNRPWIRINNE | |
| RIQHLEECS | | RIQHLEECS | | SAEHIEECSC | | SNRPWMRINNE | |
| RIQIDPVKL | | RIQIDPVKL | | SAESRKLLLI | | SNRPWMRISNE | |
| RIQIDQVKL | | RIQIDQVKL | | SAESRKLLLV | | SNRPWVRINNE | |
| RIQIDSVKL | | RIQIDSVKL | | SAESRKMLLI | | SNRPWVRMNNE | |
| RIQINPVKL | | RIQINPVKL | | SAFDERRNKY | | SNRSGYSGSFI | |
| RIRIDPVKL | | RIRIDPVKL | | SAFDERRNRY | | SNSDFICVGWS | |
| RIRLFDYSG | | RIRLFDYSG | | SAGALASCMG | | SNSDFLCVGWS | |
| RIRLFDYSK | | RIRLFDYSK | | SAGGAIWVTR | | SNSDFMCVGWS | |
| RIRLFDYSR | | RIRLFDYSR | | SAGGAVWVTR | | SNSDWSGYSGS | |
| RIRMAINLV | | RIRMAINLV | | SAGGDIWITR | | SNSEFICVGWS | |
| RIRMAINQC | | RIRMAINQC | | SAGGDIWVMR | | SNSEFLCVGWS | |
| RIRMAINWG | | RIRMAINWG | | SAGGDIWVTR | | SNSEGTGMAAD | |
| RIRMAINYS | | RIRMAINYS | | SAGGHIWVTR | | SNSIAVFCGTS | |
| RIRMATNEC | | RIRMATNEC | | SAGGNIWITR | | SNSIISMCSST | |
| RIRNNTYDH | | RIRNNTYDH | | SAGKDPKKTG | | SNSIIVFCGTS | |
| RIRRDQKSL | | RIRRDQKSL | | SAGRDPKKTG | | SNSIVAFCGTS | |
| RISFYWTIV | | RISFYWTIV | | SAHHRVYWIR | | SNSIVALCGSK | |
| RISHRTLLM | | RISHRTLLM | | SAIDQITGKL | | SNSIVALCGSR | |
| RISIYWTLV | | RISIYWTLV | | SAIDQITRKL | | SNSIVSMCSST | |
| RISKMGVDE | | RISKMGVDE | | SAIDQVTGKL | | SNSIVTFCGLD | |
| RISKRGSSG | | RISKRGSSG | | SAINQITGKL | | SNSIVTFCGLN | |
| RISNETILE | | RISNETILE | | SAKELVETNH | | SNSIVVFCGAS | |
| RISSSFSFG | | RISSSFSFG | | SAKHIEECSC | | SNSIVVFCGTP | |
| RITFESNGG | | RITFESNGG | | SAKHVEECSC | | SNSIVVFCGTS | |
| RITFESSGG | | RITFESSGG | | SALFVYSLRK | | SNSIVVFVAPS | |
| RITTKINNI | | RITTKINNI | | SALGSPGCDH | | SNSLIALCGSP | |
| RIWRQANNG | | RIWRQANNG | | SALILRGAVA | | SNSLKLAIGLR | |
| RIWSKPQCQ | | RIWSKPQCQ | | SALILRGSIA | | SNSLVALCGSP | |
| RIYWIREGK | | RIYWIREGK | | SALILRGSVA | | SNSLVTFCGLD | |
| RIYWIREGR | | RIYWIREGR | | SAPEGMCYPG | | SNSMVTFCGLD | |
| RIYWIRKGR | | RIYWIRKGR | | SAPGVKGFGF | | SNSNCKDPNNE | |
| RKASLRLAV | | RKASLRLAV | | SAPHGLCYPG | | SNSNCRDPNNE | |
| RKATKRLIQ | | RKATKRLIQ | | SAPHRLCYPG | | SNSNCRNPNNE | |
| RKATRRLIQ | | RKATRRLIQ | | SAQATEECSR | | SNSRFESVAWS | |
| RKATRRLVQ | | RKATRRLVQ | | SAQEKNDLYG | | SNSTTHDRTAF | |
| RKATRRMIQ | | RKATRRMIQ | | SAQHIEECSC | | SNSVVVFCGTS | |
| RKDILRTQE | | RKDILRTQE | | SAQHVEECSC | | SNTDWSGYSGS | |
| RKEAMQNRI | | RKEAMQNRI | | SARHIEECSC | | SNTWLGRTISP | |
| RKEPALIVW | | RKEPALIVW | | SARHIEEWSC | | SNVENLFDEVR | |
| RKEYEEEAK | | RKEYEEEAK | | SARHVEECSC | | SNVGLNISLHL | |
| RKGLILEYY | | RKGLILEYY | | SARQEKNPAL | | SNVGLNMSLHL | |
| RKILRKSGG | | RKILRKSGG | | SARSALILRG | | SNVGLNVSLHL | |
| RKKILRTQE | | RKKILRTQE | | SASACHDGAS | | SNVKKLYDRVR | |
| RKKRGLFGA | | RKKRGLFGA | | SASACHDGIS | | SNVKNLFDEVK | |
| RKLKREITF | | RKLKREITF | | SASACHDGSS | | SNVKNLFDEVR | |
| RKLLLIAQA | | RKLLLIAQA | | SASACHDGTN | | SNVKNLYDKVR | |
| RKLLLITQA | | RKLLLITQA | | SASACHDGTS | | SNVKNLYDRVR | |
| RKLLLIVQA | | RKLLLIVQA | | SASALILRGS | | SNVKNLYEKVR | |
| RKLLLVVQA | | RKLLLVVQA | | SASCHDGRAW | | SNVKNLYNKVR | |
| RKMEDGFLD | | RKMEDGFLD | | SASGDIWITR | | SNVRNLYDKVR | |
| RKMLLIVQA | | RKMLLIVQA | | SASGDIWVTR | | SNVTVTNSVEL | |
| RKMMTNSQD | | RKMMTNSQD | | SASGKADTRI | | SNVTVTSSIEL | |
| RKMMTSSQD | | RKMMTSSQD | | SASGRADTKI | | SNVTVTSSVEL | |
| RKQILRTQE | | RKQILRTQE | | SASGRADTRI | | SNVVLNVSLHL | |

Fig. 83-326

| Block size 8 | SIN | Block size 9 | SIN | Block size 10 | SIN | Block size 11 | SIN |
|---|---|---|---|---|---|---|---|
| RKQLRENAE | | RKQLRENAE | | SASSISFCGV | | SNWSGYSGIFS | |
| RKQLRQNAE | | RKQLRQNAE | | SASTGGQSFY | | SNWSGYSGSFI | |
| RKRDSSILT | | RKRDSSILT | | SATACHDGKE | | SNWSGYSGSFT | |
| RKRFADQEL | | RKRFADQEL | | SATACHDGKG | | SNYHQSFVPSP | |
| RKRGLFGAI | | RKRGLFGAI | | SATACHDGKK | | SNYQQSFVPSP | |
| RKRKRKTRG | | RKRKRKTRG | | SATACHDGRK | | SNYVCSGLVGD | |
| RKRKTRGLF | | RKRKTRGLF | | SATACSDGPG | | SPCLTDKGSIQ | |
| RKRMTRGLF | | RKRMTRGLF | | SATACSDGSG | | SPDPGVKGFAF | |
| RKRNSSILT | | RKRNSSILT | | SATGMALSVV | | SPEEISETQGT | |
| RKRRIRDNM | | RKRRIRDNM | | SATGMILSVV | | SPEEVSEAQGT | |
| RKRRVRDNI | | RKRRVRDNI | | SATGMTLSVV | | SPEEVSETQGI | |
| RKRRVRDNM | | RKRRVRDNM | | SATGPADTRI | | SPEEVSETQGM | |
| RKRRVRDNV | | RKRRVRDNV | | SATGPADTRV | | SPEEVSETQGT | |
| RKRRVRDSM | | RKRRVRDSM | | SATGPAETRI | | SPFPVGSGSFP | |
| RKSGGIGKE | | RKSGGIGKE | | SATGPAETRV | | SPFRALISWEM | |
| RKTNLYGFI | | RKTNLYGFI | | SATGVTLSVV | | SPFRALISWGM | |
| RKTRFLPVA | | RKTRFLPVA | | SAVDQITGKL | | SPFRALVSWEM | |
| RKTRFLPVS | | RKTRFLPVS | | SAVLRGFLII | | SPFRTLMSCPI | |
| RKTRFLPVT | | RKTRFLPVT | | SAVLRGFLIL | | SPFRTLMSCPM | |
| RKTRGLFGA | | RKTRGLFGA | | SAVNQITGKL | | SPFRTLMSCPV | |
| RKVDDGFLD | | RKVDDGFLD | | SAYCNTDLGA | | SPGAPGVKGFG | |
| RLAAAGDIW | | RLAAAGDIW | | SAYERMCNIL | | SPGARPKVNGQ | |
| RLAAGGDIW | | RLAAGGDIW | | SCAAMDDFQL | | SPGCDRLQDTT | |
| RLAIGLRNT | | RLAIGLRNT | | SCAAMDEFQL | | SPGDRPKVNGQ | |
| RLAKCNTKC | | RLAKCNTKC | | SCAAMEDFQL | | SPGMMMGMFNM | |
| RLALGLRNT | | RLALGLRNT | | SCASNINIRE | | SPGNAEIEDLI | |
| RLATGLRNI | | RLATGLRNI | | SCATNINIRE | | SPGVKGWAFDS | |
| RLATGLRNV | | RLATGLRNV | | SCAVVMTDGS | | SPHRTLLMNEL | |
| RLATGMRNI | | RLATGMRNI | | SCDPDECRFY | | SPHSRSGFEML | |
| RLAVGLRNT | | RLAVGLRNT | | SCDPDGCRFY | | SPIHLGDCSFE | |
| RLCNPLNPF | | RLCNPLNPF | | SCDPLGCKMY | | SPINNGKGRYG | |
| RLCTINSWH | | RLCTINSWH | | SCDPLGCKTY | | SPISVGSGSFP | |
| RLCYPGELD | | RLCYPGELD | | SCDPLGCRMY | | SPKLRSGFEML | |
| RLEDVFAGK | | RLEDVFAGK | | SCDPNECRFY | | SPKYQQSFTPS | |
| RLEENTTYK | | RLEENTTYK | | SCDPSGCKMY | | SPLAGSAQHVE | |
| RLEGVFAGK | | RLEGVFAGK | | SCDPTGCKMY | | SPLAITWWNRN | |
| RLENLDKKM | | RLENLDKKM | | SCDSPSNANG | | SPLAVTWWNRK | |
| RLENLNKKM | | RLENLNKKM | | SCDSPSNING | | SPLAVTWWNRN | |
| RLENLNKKV | | RLENLNKKV | | SCDSPSNVKG | | SPLAVTWWNRS | |
| RLENLNKRM | | RLENLNKRM | | SCDSPSNVNG | | SPLELGDCSIA | |
| RLENVFAGK | | RLENVFAGK | | SCEGECFYSG | | SPLELRDCKIE | |
| RLESVFAGK | | RLESVFAGK | | SCEPDECRFY | | SPLGAINTTLP | |
| RLFDYSGWN | | RLFDYSGWN | | SCFDGKEWLH | | SPLKLVDGQDC | |
| RLFDYSKWN | | RLFDYSKWN | | SCFDGKEWMH | | SPLMVAYMLER | |
| RLFDYSRWN | | RLFDYSRWN | | SCFDGREWMH | | SPLPFQNIDSR | |
| RLFERVRRQ | | RLFERVRRQ | | SCFLLAALLL | | SPLPFQNIDSW | |
| RLFTIRQEL | | RLFTIRQEL | | SCFLLIALLL | | SPLSGSAQHIE | |
| RLFTIRQEM | | RLFTIRQEM | | SCFLLVALFL | | SPLSGSAQHVE | |
| RLGKGYMFE | | RLGKGYMFE | | SCFLLVALLI | | SPLSRCRETRG | |
| RLGNLNKKM | | RLGNLNKKM | | SCFLLVALLL | | SPLSRCRKTRG | |
| RLGRGYMFE | | RLGRGYMFE | | SCFTIMTDGP | | SPLTKGILGFV | |
| RLGSSFYAE | | RLGSSFYAE | | SCFTLMTDGP | | SPLTKGMLGFV | |
| RLGSWSWHD | | RLGSWSWHD | | SCFTVLTDGP | | SPLVLDDCSLE | |
| RLGYETFKV | | RLGYETFKV | | SCFTVMTDGP | | SPLVLDDCSLK | |
| RLIDFLKDV | | RLIDFLKDV | | SCFVFVALIL | | SPMMWEINGPE | |
| RLIDKTNQQ | | RLIDKTNQQ | | SCGILGTIIG | | SPNAYQAKFES | |
| RLIDRTNHQ | | RLIDRTNHQ | | SCGPSECRTF | | SPNAYQAQFES | |
| RLIEKTNDK | | RLIEKTNDK | | SCHDGIGRMT | | SPNAYQARFES | |
| RLIEKTNEK | | RLIEKTNEK | | SCHDGISRMS | | SPQLEGFSAES | |
| RLIEKTNKQ | | RLIEKTNKQ | | SCHDGKARMS | | SPQNILRTQES | |
| RLIEKTNQQ | | RLIEKTNQQ | | SCHDGKAWLH | | SPRLRSGFEML | |
| RLIEKTNTE | | RLIEKTNTE | | SCHDGKEWLH | | SPRMFLAMITY | |

Fig. 83-327

| Block size 8 | SIN | Block size 9 | SIN | Block size 10 | SIN | Block size 11 | SIN |
|---|---|---|---|---|---|---|---|
| RLIEKTNTQ | | RLIEKTNTQ | | SCHDGKFRMS | | SPRSRNGFEML | |
| RLIERTNEK | | RLIERTNEK | | SCHDGKSRMS | | SPRSRSGFEML | |
| RLIERTNQQ | | RLIERTNQQ | | SCHDGKSWLH | | SPRTVGQCPKY | |
| RLIGKTNQQ | | RLIGKTNQQ | | SCHDGMSRMS | | SPSAPGVKGFG | |
| RLILATGLR | | RLILATGLR | | SCHDGNAWLH | | SPSECRTFFLT | |
| RLIQLIVSG | | RLIQLIVSG | | SCHDGRARMS | | SPSNSRFESVA | |
| RLIQNSITI | | RLIQNSITI | | SCHDGRAWLH | | SPSPGARPKVN | |
| RLIQNSLTI | | RLIQNSLTI | | SCHDGRSRMS | | SPSPGDRPKVN | |
| RLIQNSMTI | | RLIQNSMTI | | SCHDGVGRMT | | SPVHLGDCNFE | |
| RLISKTNQQ | | RLISKTNQQ | | SCHDGVSRMS | | SPVHLGDCRFE | |
| RLKITENSF | | RLKITENSF | | SCIASSIVLV | | SPVHLGDCSFE | |
| RLKVNGQSG | | RLKVNGQSG | | SCIASSIVMV | | SPVLTDNPRPN | |
| RLLRENAEE | | RLLRENAEE | | SCIASSLILA | | SPVNNGKGRYG | |
| RLLVLLEND | | RLLVLLEND | | SCIASSLVLA | | SPVPVGSGSFP | |
| RLMDFLKDV | | RLMDFLKDV | | SCIASSTVLV | | SPVSVGSGSFP | |
| RLNINPVKL | | RLNINPVKL | | SCIASSTVMV | | SPYNSKFESVA | |
| RLNINPVTL | | RLNINPVTL | | SCIASSVVLV | | SPYNSRFESVA | |
| RLNINSVKL | | RLNINSVKL | | SCIESIRNGT | | SPYRALISWEM | |
| RLNNVIDKM | | RLNNVIDKM | | SCINRCFYVE | | SPYRALMSVPL | |
| RLNPMHQLL | | RLNPMHQLL | | SCKMYALHQG | | SPYRALMSVPM | |
| RLNRNEIKG | | RLNRNEIKG | | SCLPACAYGP | | SQDTEISFTIT | |
| RLNRQEIEG | | RLNRQEIEG | | SCLPACIYGL | | SQDTELSFTIT | |
| RLNTMHQLL | | RLNTMHQLL | | SCLPACVYGL | | SQDTELSFTVT | |
| RLNWLTKAT | | RLNWLTKAT | | SCLPACVYGP | | SQDTEVSFTIT | |
| RLNWLTKET | | RLNWLTKET | | SCLVPCFWVE | | SQFRALISWEM | |
| RLPFQNLSP | | RLPFQNLSP | | SCMDTIRNGT | | SQGEGTAADYK | |
| RLPLPLCPF | | RLPLPLCPF | | SCMEAIRNGT | | SQGSGYAADKE | |
| RLQDTTWDV | | RLQDTTWDV | | SCMESIRNNT | | SQGSGYAADRE | |
| RLQLKDNAK | | RLQLKDNAK | | SCMETIRNGT | | SQGTKRPYEQM | |
| RLQLKDNAR | | RLQLKDNAR | | SCMGLIYNRM | | SQGTKRSHEQM | |
| RLQLRDNAK | | RLQLRDNAK | | SCPIGEAPSP | | SQGTKRSYEQM | |
| RLQLRDNAR | | RLQLRDNAR | | SCPIGEVPSP | | SQGTTIRGKHS | |
| RLRGIPPLE | | RLRGIPPLE | | SCPIGVAPSP | | SQGTTIRGRHS | |
| RLRMATGLR | | RLRMATGLR | | SCPIGVVPSP | | SQGTTLKGRHA | |
| RLRRDQKAL | | RLRRDQKAL | | SCPLGEAPSP | | SQGTTLRGQHA | |
| RLRRDQKSL | | RLRRDQKSL | | SCPMGVAPSP | | SQGTTLRGRHA | |
| RLRRDQRAL | | RLRRDQRAL | | SCPVGEAPSP | | SQITNGTTGNP | |
| RLRRDQRSL | | RLRRDQRSL | | SCPVGVAPSP | | SQKGILEDEQM | |
| RLRSGFEML | | RLRSGFEML | | SCSHLECRTF | | SQKILCTSATA | |
| RLSADGDIW | | RLSADGDIW | | SCSHMECRTF | | SQKLFALSGVA | |
| RLSAGGAIW | | RLSAGGAIW | | SCSHSECRTF | | SQKQEFKMNPN | |
| RLSAGGDIW | | RLSAGGDIW | | SCSIDECRTF | | SQLEGFSAESR | |
| RLSAGGGIW | | RLSAGGGIW | | SCSIHECRTF | | SQLIWMACHSA | |
| RLSAGGHIW | | RLSAGGHIW | | SCSINECRTF | | SQLKKQEIEGI | |
| RLSAGGNIW | | RLSAGGNIW | | SCSISECRTF | | SQLKRQEIEGI | |
| RLSAGGSIW | | RLSAGGSIW | | SCSVSECRTF | | SQLTEVETYVL | |
| RLSASGDIW | | RLSASGDIW | | SCSYLECRTF | | SQLVWMACHSA | |
| RLSGGGDIW | | RLSGGGDIW | | SCTSPCLTDK | | SQLVWMACNSA | |
| RLSGIPPLE | | RLSGIPPLE | | SCTVVMTDGN | | SQNILRTHESE | |
| RLSINPVKL | | RLSINPVKL | | SCTVVMTDGS | | SQNILRTQESE | |
| RLSSGYKDI | | RLSSGYKDI | | SCVCRDNWQG | | SQRGILEDEQM | |
| RLTIIGKDA | | RLTIIGKDA | | SCVMLLAIAM | | SQRGVLEDEQM | |
| RLTILGKDA | | RLTILGKDA | | SCVNRCFYVE | | SQSGRISFYWT | |
| RLTITYSSS | | RLTITYSSS | | SCYDGKAWLH | | SQTATKRIRLA | |
| RLTQGRQTY | | RLTQGRQTY | | SCYMDIDVYC | | SQTATKRIRMA | |
| RLTQGYKDI | | RLTQGYKDI | | SCYPNDGKVE | | SQTATKRLRMA | |
| RLTTTIKPW | | RLTTTIKPW | | SCYPNEGKVE | | SQVEQRINMLA | |
| RLTTTIKTW | | RLTTTIKTW | | SCYPNLCQVE | | SQVERRINMLA | |
| RLTTTIRTW | | RLTTTIRTW | | SCYPNLGKVE | | SQYICSPVLTD | |
| RLTTTVKTW | | RLTTTVKTW | | SCYPNLGQVE | | SQYLCTGILTD | |
| RLTVLGKDA | | RLTVLGKDA | | SCYPNMGKVE | | SQYLCTGVLTD | |
| RLVLATGLR | | RLVLATGLR | | SCYPNNGKVE | | SQYRALISWPL | |

Fig. 83-328

| Block size 8 | SIN | Block size 9 | SIN | Block size 10 | SIN | Block size 11 | SIN |
|---|---|---|---|---|---|---|---|
| RLVQLIVSG | | RLVQLIVSG | | SCYPNSGKVE | | SQYRALISWPQ | |
| RLVQNSITI | | RLVQNSITI | | SCYPQYPNVR | | SQYRALVSWPL | |
| RLVRFRHQN | | RLVRFRHQN | | SCYPRYPDVR | | SQYREEALLNR | |
| RLYGSENKL | | RLYGSENKL | | SCYPRYPGVR | | SQYRSLISWPL | |
| RLYGSGNKL | | RLYGSGNKL | | SCYPRYPNVR | | SRADKICIGYL | |
| RLYIWGVHH | | RLYIWGVHH | | SCYSRYPNVR | | SRAGYEMLKVP | |
| RLYLWGVHH | | RLYLWGVHH | | SCYVDIDIYC | | SRARIDARIDF | |
| RLYVNKNPY | | RLYVNKNPY | | SCYVDIDVYC | | SRARIDARVDF | |
| RMADSIKSW | | RMADSIKSW | | SCYVDTDVYC | | SRARIDARVDS | |
| RMAINWGRI | | RMAINWGRI | | SCYVDVDVYC | | SRARIKTRLFT | |
| RMAKCNTKC | | RMAKCNTKC | | SDAPFLDRLR | | SRAVGKCPRYV | |
| RMARCNTKC | | RMARCNTKC | | SDAQAFYKIL | | SRCRETRGLFG | |
| RMATGLRNI | | RMATGLRNI | | SDAQAFYKLL | | SRCRKTRGLFG | |
| RMATGLRNV | | RMATGLRNV | | SDAQIDESCE | | SRDSRSGYETF | |
| RMATNECRI | | RMATNECRI | | SDDFALILNA | | SRERLGSWSWH | |
| RMCNILKGK | | RMCNILKGK | | SDDFALIVNA | | SRFEAVAWSAT | |
| RMCSLMQGS | | RMCSLMQGS | | SDDNVYKALS | | SRFESVAWSAS | |
| RMDYYWAIL | | RMDYYWAIL | | SDDSVYKALS | | SRFESVAWSAT | |
| RMDYYWAVL | | RMDYYWAVL | | SDEALKMTIA | | SRGEVFVIREP | |
| RMDYYWGIL | | RMDYYWGIL | | SDFICVGWSS | | SRGHIFVIREP | |
| RMEFFWTLL | | RMEFFWTLL | | SDFLCVGWSS | | SRGHVFVIREP | |
| RMEFSWILL | | RMEFSWILL | | SDFMCVGWSS | | SRGLFGAIAGF | |
| RMEFSWTIL | | RMEFSWTIL | | SDGAFLAPRY | | SRGLFGAKAGF | |
| RMEFSWTLL | | RMEFSWTLL | | SDGGPNLYNI | | SRGYKMNIQIL | |
| RMENLNKKV | | RMENLNKKV | | SDGNLIAPWY | | SRGYKMNNQIL | |
| RMFALSQGT | | RMFALSQGT | | SDGPGWLTIG | | SRGYKMNTKIL | |
| RMFLAMITY | | RMFLAMITY | | SDGPGWLTLG | | SRGYKMNTQIL | |
| RMGKCNTKC | | RMGKCNTKC | | SDGSGWLTLG | | SRGYKMNTRIL | |
| RMGLQMQRF | | RMGLQMQRF | | SDHICIGYHA | | SRHCSKYHWNL | |
| RMGVDEYSS | | RMGVDEYSS | | SDICYPGKFT | | SRHHMGECPKY | |
| RMGVQIQRF | | RMGVQIQRF | | SDICYPGRFT | | SRHYIGKCPKY | |
| RMGVQLQRF | | RMGVQLQRF | | SDIEAMASQG | | SRHYMGECPEY | |
| RMGVQMQRF | | RMGVQMQRF | | SDIEAMATQG | | SRHYMGECPKY | |
| RMIKAVRGD | | RMIKAVRGD | | SDIEIMASQG | | SRHYMGECPNY | |
| RMIKRGIND | | RMIKRGIND | | SDILVTREPY | | SRIAIGNCPKY | |
| RMIKRGVND | | RMIKRGVND | | SDINIMASQG | | SRINGVKLEEN | |
| RMIQLIVSG | | RMIQLIVSG | | SDKICIGYHA | | SRISFYWTIVE | |
| RMITQRTIG | | RMITQRTIG | | SDKICLGHHA | | SRLNINPVKLS | |
| RMKWMMAMK | | RMKWMMAMK | | SDKLYIWGVH | | SRLNRNEIKGI | |
| RMKWMMAMR | | RMKWMMAMR | | SDKPFQNVSR | | SRLNRNEIKGV | |
| RMQFSSLAV | | RMQFSSLAV | | SDKRIGSCTS | | SRLNWLTKATN | |
| RMQFSSLTV | | RMQFSSLTV | | SDLDYQIGYI | | SRLNWLTKETN | |
| RMQINPVKL | | RMQINPVKL | | SDLDYQIGYV | | SRMSICISGPN | |
| RMQLKDNAK | | RMQLKDNAK | | SDLEALMEWL | | SRMSICMSGPN | |
| RMQLRDNAK | | RMQLRDNAK | | SDLIIERKEG | | SRMSICVSGPN | |
| RMQLRDNVK | | RMQLRDNVK | | SDLIIERREG | | SRMSVCMSGPN | |
| RMSDSIKSW | | RMSDSIKSW | | SDNADKICLG | | SRNGFEMLKIP | |
| RMSICISGP | | RMSICISGP | | SDNEQTDLYK | | SRNGKWREQLS | |
| RMSICMSGP | | RMSICMSGP | | SDNGGLIAPS | | SRNPGNAEIED | |
| RMSICVSGP | | RMSICVSGP | | SDNRSGYSGI | | SRPRVRNQSGR | |
| RMSVCISGP | | RMSVCISGP | | SDPDYQIGYV | | SRRGFEMIWDP | |
| RMSVCMSGP | | RMSVCMSGP | | SDQICIGYHA | | SRRYELEIGTR | |
| RMTDSIKSW | | RMTDSIKSW | | SDQICVGYHA | | SRSGFEIIWDP | |
| RMTFYWAIV | | RMTFYWAIV | | SDQISIVPNI | | SRSGFEILLIE | |
| RMTFYWKIV | | RMTFYWKIV | | SDQLKLATGL | | SRSGFEMIWDA | |
| RMTFYWTII | | RMTFYWTII | | SDRICIGYHA | | SRSGFEMIWDP | |
| RMTFYWTIV | | RMTFYWTIV | | SDRLVLAIGL | | SRSGFEMIWDS | |
| RMTFYWTMV | | RMTFYWTMV | | SDRLVLATGL | | SRSGFEMLKIH | |
| RMTICIQGN | | RMTICIQGN | | SDSIKSWRKD | | SRSGFEMLKIP | |
| RMTICVQGD | | RMTICVQGD | | SDSSFYAEMK | | SRSGFEMLKVP | |
| RMTICVQGK | | RMTICVQGK | | SDTPRGEDAQ | | SRSGFEMLRIP | |
| RMTICVQGN | | RMTICVQGN | | SDTPRGEDGQ | | SRSGFEMVWDA | |

Fig. 83-329

| Block size 8 | SIN | Block size 9 | SIN | Block size 10 | SIN | Block size 11 | SIN |
|---|---|---|---|---|---|---|---|
| RMTRGLFGA | | RMTRGLFGA | | SDTPRGEDNQ | | SRSGFEMVWDD | |
| RMVIASTTA | | RMVIASTTA | | SDTPRGEDSQ | | SRSGFEMVWDP | |
| RMVKRGIND | | RMVKRGIND | | SDTPRPADPS | | SRSGFEVLFIE | |
| RMVLASTTA | | RMVLASTTA | | SDTPRPDDPS | | SRSGFEVLKVP | |
| RMVLSAFDE | | RMVLSAFDE | | SDTPRPSDPS | | SRSGFEVLLIE | |
| RMVTGLRNI | | RMVTGLRNI | | SDTPRPTDPS | | SRSGYEILKVP | |
| RMVTQRTIG | | RMVTQRTIG | | SDTPRPVDPS | | SRSGYEMLKVP | |
| RMYALHQGT | | RMYALHQGT | | SDTTCWSWPD | | SRSGYETFKVI | |
| RMYQKCCNL | | RMYQKCCNL | | SDTTGWPWPD | | SRSGYETFRII | |
| RNAFRGLIS | | RNAFRGLIS | | SDTTGWSWPD | | SRSGYETFRVI | |
| RNAHKMESR | | RNAHKMESR | | SDTTSWSWPD | | SRSGYETFRVL | |
| RNAIGDCPK | | RNAIGDCPK | | SDTVDTLTEN | | SRSGYETFRVT | |
| RNALGDCPK | | RNALGDCPK | | SDVLVTREPY | | SRSGYEVLKVP | |
| RNALGNCPK | | RNALGNCPK | | SDVWLGRTVS | | SRSIIFNMERI | |
| RNALSIAPI | | RNALSIAPI | | SDWSGYSGSF | | SRSLKLAIGLR | |
| RNATASFIY | | RNATASFIY | | SDYEELKHLM | | SRSNIFNMERI | |
| RNATASFVY | | RNATASFVY | | SEAPGWSWDD | | SRSPGNAEIED | |
| RNATASLIY | | RNATASLIY | | SECACINGSC | | SRSSCHDGKAW | |
| RNCTIPCFW | | RNCTIPCFW | | SECACVNGSC | | SRSSFYAEMKW | |
| RNCTVPCFW | | RNCTVPCFW | | SECICINGTC | | SRTELINPNKW | |
| RNDDIDQSL | | RNDDIDQSL | | SECITPNGSI | | SRTELINPSKW | |
| RNDDSSSNS | | RNDDSSSNS | | SECRTFFLTQ | | SRTELIPPSKW | |
| RNDDSSSSS | | RNDDSSSSS | | SECVCHDGTC | | SRTELISPNKW | |
| RNDDVDQSL | | RNDDVDQSL | | SECVCHDGVC | | SRTELISPSKW | |
| RNDEGTGIA | | RNDEGTGIA | | SECVCHKGIC | | SRTHQYSEKGK | |
| RNDLYGTQS | | RNDLYGTQS | | SECVCHKGVC | | SRTREILTKIT | |
| RNDTDVVNF | | RNDTDVVNF | | SECVCHNGIC | | SRTREILTKTT | |
| RNDTDVVNY | | RNDTDVVNY | | SECVCHNGTC | | SRTREILTRTT | |
| RNEAINNRF | | RNEAINNRF | | SECVCHNGVC | | SRTRGILTKTT | |
| RNEALNNRF | | RNEALNNRF | | SECVCHNSTC | | SRVDNHSMSDI | |
| RNEDGSSSS | | RNEDGSSSS | | SECVCHSGIC | | SRYICSGLVGD | |
| RNEDSSSNS | | RNEDSSSNS | | SECVCINGIC | | SRYSKADKICI | |
| RNEDSSSSS | | RNEDSSSSS | | SECVCINGSC | | SRYVCSGLVGD | |
| RNEEGTGIA | | RNEEGTGIA | | SECVCINGTC | | SRYVCTGILTD | |
| RNEHGQTLW | | RNEHGQTLW | | SECVCISGTC | | SRYWAIRTRSG | |
| RNEIKGVEL | | RNEIKGVEL | | SECVCMNGSC | | SRYYMGECPKY | |
| RNEIKGVKL | | RNEIKGVKL | | SECVCQDEFC | | SSAASYKRIRL | |
| RNEQGQALW | | RNEQGQALW | | SECVCVNGSC | | SSAASYKRVRL | |
| RNEQGQILW | | RNEQGQILW | | SECVRHNGTC | | SSACLRGGRNS | |
| RNEQGQMLW | | RNEQGQMLW | | SECVSHNGTW | | SSAQEKNDLYG | |
| RNEQGQTLW | | RNEQGQTLW | | SECYNPCFYV | | SSASCHDGRAW | |
| RNFKPNIGP | | RNFKPNIGP | | SEDGVYKALS | | SSCAAMDDFQL | |
| RNFPQTTNT | | RNFPQTTNT | | SEDNVYKALS | | SSCFDGKEWLH | |
| RNFQPNIGP | | RNFQPNIGP | | SEDNVYKVLS | | SSCFDGKEWMH | |
| RNFWRGDNG | | RNFWRGDNG | | SEDNVYRALS | | SSCFDGREWMH | |
| RNFWRGENG | | RNFWRGENG | | SEDSRSGYET | | SSCHDGKAWLH | |
| RNGFEMLKI | | RNGFEMLKI | | SEEALRQKIM | | SSCHDGKSWLH | |
| RNGKWREQL | | RNGKWREQL | | SEECSCYVDI | | SSCHDGNAWLH | |
| RNGNMRCTI | | RNGNMRCTI | | SEFICVGWSS | | SSCHDGRAWLH | |
| RNGTYDHKE | | RNGTYDHKE | | SEFLCVGWSS | | SSCYDGKAWLH | |
| RNGTYDHNI | | RNGTYDHNI | | SEFNEIEHQI | | SSDDFALILNA | |
| RNGTYDYPK | | RNGTYDYPK | | SEFNEIEYQI | | SSDDFALIVNA | |
| RNGTYNHED | | RNGTYNHED | | SEFNKACELT | | SSDICYPGKFT | |
| RNGTYNYPK | | RNGTYNYPK | | SEFSEIEHQI | | SSDICYPGRFT | |
| RNICEKLEQ | | RNICEKLEQ | | SEFSETEHQI | | SSDNEQTDLYK | |
| RNILRTQDS | | RNILRTQDS | | SEGIGQAADL | | SSEVPEWSWDD | |
| RNILRTQES | | RNILRTQES | | SEGMGQAADL | | SSEVPGWSWDD | |
| RNILSIAPI | | RNILSIAPI | | SEGRGQAADL | | SSEVPGWSWGD | |
| RNILSMAPI | | RNILSMAPI | | SEGTGIAADR | | SSFEKFEIFPK | |
| RNIPEKQTR | | RNIPEKQTR | | SEGTGIVADR | | SSFEQITFMQA | |
| RNIPERQTR | | RNIPERQTR | | SEGTGMAADQ | | SSFERFEIFPK | |
| RNIPGKQAK | | RNIPGKQAK | | SEGTGQAADL | | SSFERFEIFPN | |

Fig. 83-330

| Block size 8 | SIN | Block size 9 | SIN | Block size 10 | SIN | Block size 11 | SIN |
|---|---|---|---|---|---|---|---|
| RNIPQIESR | | RNIPQIESR | | SEGTGQAGDL | | SSFERFEMFPK | |
| RNIPSIQSR | | RNIPSIQSR | | SEGTGTAADL | | SSFFRNMVWLT | |
| RNIPSVQSR | | RNIPSVQSR | | SEHTAYSQIT | | SSFKRFEIFPK | |
| RNITEIVYL | | RNITEIVYL | | SEIEGRIQDL | | SSFSFGGFTFK | |
| RNIVRRAAV | | RNIVRRAAV | | SEIEHQIGNV | | SSFYAEMEWLL | |
| RNIVRRAIV | | RNIVRRAIV | | SEIEHQISNV | | SSFYAEMKWLL | |
| RNIVRRATV | | RNIVRRATV | | SEIEQQIGNV | | SSFYSEMKWLL | |
| RNKHSNGTI | | RNKHSNGTI | | SEKLVLATGL | | SSFYSEMKWLS | |
| RNKHSNGTT | | RNKHSNGTT | | SEKLVLATGP | | SSGGLLAPRYG | |
| RNKHSNSTT | | RNKHSNSTT | | SELGVPFHLG | | SSGIAIALGII | |
| RNKYLEEHP | | RNKYLEEHP | | SEMDKLFERV | | SSGIAIVLGII | |
| RNLHDQIKR | | RNLHDQIKR | | SEMDKLYERV | | SSGNCRFNVCI | |
| RNLHDQVKR | | RNLHDQVKR | | SEMDKLYTRV | | SSGNCRFSVCI | |
| RNLHDRIRR | | RNLHDRIRR | | SEMKKLYERV | | SSGNNQVFPQL | |
| RNLHDRTRR | | RNLHDRTRR | | SEMKWLLSSK | | SSGSLEFIAEQ | |
| RNLHDRVKR | | RNLHDRVKR | | SEMKWLSSSG | | SSGSLKLAIGL | |
| RNLHDRVRR | | RNLHDRVRR | | SEMKWLSSSM | | SSGTSKACNAL | |
| RNLHEQIKR | | RNLHEQIKR | | SEMLNLYDRV | | SSGTSKACNAS | |
| RNLHERIRR | | RNLHERIRR | | SEMLNLYERV | | SSGTSKACSAS | |
| RNLHIPEVC | | RNLHIPEVC | | SEMNKLFEKT | | SSGTVKDRSPF | |
| RNLYDKVRL | | RNLYDKVRL | | SEMNKLFERI | | SSGYKDIILWF | |
| RNLYDKVRM | | RNLYDKVRM | | SEMNKLFERT | | SSGYKDVIIWF | |
| RNMRWLTLK | | RNMRWLTLK | | SEMNKLFERV | | SSGYKDVILWF | |
| RNNMINNDL | | RNNMINNDL | | SEMNKLYEKV | | SSGYKEVILWF | |
| RNNRKEPAL | | RNNRKEPAL | | SEMNKLYERV | | SSGYKNVILWF | |
| RNNSYDHSK | | RNNSYDHSK | | SEMNNLYERV | | SSIAFCGVDSD | |
| RNNTYDHAQ | | RNNTYDHAQ | | SEMNRLFERV | | SSIAFCGVNSD | |
| RNNTYDHKK | | RNNTYDHKK | | SEMSKLFEKT | | SSIAFCGVNSN | |
| RNNTYDHSH | | RNNTYDHSH | | SEMSKLFERT | | SSIDLVETNHT | |
| RNNTYDHSK | | RNNTYDHSK | | SEMSKLFERV | | SSIGKVCRTLL | |
| RNNTYDHSQ | | RNNTYDHSQ | | SEMSKLYERV | | SSIKKYERVKM | |
| RNNTYDHSR | | RNNTYDHSR | | SEQAAEAIEV | | SSIKRYERVKM | |
| RNNTYDHST | | RNNTYDHST | | SEQAAEAMDI | | SSILTDSQTAT | |
| RNNTYDHTK | | RNNTYDHTK | | SEQAAEAMEI | | SSIVLVGLILA | |
| RNNTYDHTQ | | RNNTYDHTQ | | SEQAAEAMEV | | SSIVMVGLILA | |
| RNNTYNHTE | | RNNTYNHTE | | SEQFPVQTDE | | SSIYIEVLHLT | |
| RNNTYNHTQ | | RNNTYNHTQ | | SEQIIVTREP | | SSKANQVFPQL | |
| RNPGNAEIE | | RNPGNAEIE | | SEQIVVTREP | | SSKCQQSFTPS | |
| RNQIKIRRR | | RNQIKIRRR | | SEQMETGGER | | SSKDNQVFPQL | |
| RNQPAATAL | | RNQPAATAL | | SEQNVPVTQV | | SSKPFQNASRH | |
| RNQSGRISI | | RNQSGRISI | | SEQVIVTREP | | SSKPFQNASRY | |
| RNQVKIRRR | | RNQVKIRRR | | SERGEDTIEE | | SSKPFQNTSRH | |
| RNRHSNGTI | | RNRHSNGTI | | SERGEETIEE | | SSKPLQNASRH | |
| RNRSILNTS | | RNRSILNTS | | SERGEETVEE | | SSKYQQSFSPS | |
| RNRYLEEHP | | RNRYLEEHP | | SERGLFGAIA | | SSKYQQSFTPS | |
| RNSFFSRLN | | RNSFFSRLN | | SERGLQRRRF | | SSKYRQSFSPS | |
| RNSFYAELK | | RNSFYAELK | | SERLVLATGL | | SSLAVNVRGSG | |
| RNSIWTSSS | | RNSIWTSSS | | SESGRLIDFL | | SSLDEQNKLYG | |
| RNSSDICYP | | RNSSDICYP | | SESRSNIFNM | | SSLILAAIIMG | |
| RNSSILTDS | | RNSSILTDS | | SESSFYAEME | | SSLILAALIMG | |
| RNTFGDCPK | | RNTFGDCPK | | SETEHQIGNV | | SSLLLQANLCR | |
| RNTIGDCPK | | RNTIGDCPK | | SETGAPQLNP | | SSLMWEINGPE | |
| RNTIGNCPK | | RNTIGNCPK | | SEVEGRIQDL | | SSLPLALGMKN | |
| RNTPSIDPK | | RNTPSIDPK | | SEVPEWSWDD | | SSLTHALRELW | |
| RNTPSIEPK | | RNTPSIEPK | | SEVPGWSWDD | | SSLTKGVLGFV | |
| RNTPSIEPR | | RNTPSIEPR | | SFAGWILGNP | | SSLTVNVRGSG | |
| RNTPSVEPK | | RNTPSVEPK | | SFAISCFLLC | | SSLTVNVRGTG | |
| RNTPSVEPR | | RNTPSVEPR | | SFALAQGALL | | SSLTVSVRGSG | |
| RNTRKEPAL | | RNTRKEPAL | | SFALAQGALV | | SSLVLAAIIMG | |
| RNVLSIAPI | | RNVLSIAPI | | SFALAQGTLL | | SSLVLAALIMG | |
| RNVLSVAPI | | RNVLSVAPI | | SFALAQGVLL | | SSLVLAASIMG | |
| RNVPEKQTR | | RNVPEKQTR | | SFAMSCFLLC | | SSLVLIVSLGA | |

Fig. 83-331

| Block size 8 | SIN | Block size 9 | SIN | Block size 10 | SIN | Block size 11 | SIN |
|---|---|---|---|---|---|---|---|
| RNVPERQTR | | RNVPERQTR | | SFATSCFLLC | | SSLVLLFMIIG | |
| RNVPETQTR | | RNVPETQTR | | SFEGWIGGNP | | SSLVLLLMIIG | |
| RNVPQAQDR | | RNVPQAQDR | | SFEGWIVGNP | | SSLVLLVSLGA | |
| RNVPQAQNR | | RNVPQAQNR | | SFEKFEIFPK | | SSLVLVVSLGA | |
| RNVPQIEAR | | RNVPQIEAR | | SFEQITFIQA | | SSMGEAMVSRA | |
| RNVPQIESR | | RNVPQIESR | | SFEQITFLQA | | SSMGIYQILAI | |
| RNVPQIQNR | | RNVPQIQNR | | SFEQITFMQA | | SSMGVYQILAI | |
| RNVPQMESR | | RNVPQMESR | | SFERFEIFPK | | SSMMEAMVSRA | |
| RNVPQVQDR | | RNVPQVQDR | | SFERFEIFPN | | SSMMWEINGPD | |
| RNVPQVQNR | | RNVPQVQNR | | SFERFEMFPK | | SSMMWEINGPE | |
| RNVPSIQSR | | RNVPSIQSR | | SFESNGGLLA | | SSMMWEVNGPE | |
| RNVTETLYL | | RNVTETLYL | | SFESNGNFIA | | SSMNNQVFPQL | |
| RNVTVTHAK | | RNVTVTHAK | | SFESTGNLIA | | SSMPFHNIHPF | |
| RNVTVTHAQ | | RNVTVTHAQ | | SFESTGNLVA | | SSMPFHNIHPL | |
| RNVTVTHSV | | RNVTVTHSV | | SFFRHMVWLI | | SSMPFHNVHPL | |
| RNVVWLIKK | | RNVVWLIKK | | SFFRNIVWLI | | SSMPLHNIHPL | |
| RNVVWLTKK | | RNVVWLTKK | | SFFRNMIWLI | | SSMVEAMISRA | |
| RNVVWLVKK | | RNVVWLVKK | | SFFRNMIWLT | | SSMVEAMMSRA | |
| RNWRQANNG | | RNWRQANNG | | SFFRNMVWLI | | SSMVEAMVSRA | |
| RNWSGYSGS | | RNWSGYSGS | | SFFRNMVWLT | | SSMVFCGVSGE | |
| RNWSKPQCQ | | RNWSKPQCQ | | SFFRNMVWLV | | SSMYIEVLHLT | |
| RNYFTAEIS | | RNYFTAEIS | | SFFRNVVWLI | | SSNGAFIAPDR | |
| RNYFTAEVS | | RNYFTAEVS | | SFFRNVVWLT | | SSNYHQSFVPS | |
| RNYFTTEVS | | RNYFTTEVS | | SFFRNVVWLV | | SSNYQQSFVPS | |
| RPADGTGSC | | RPADGTGSC | | SFFSRLNWLT | | SSPMMWEINGP | |
| RPCFWVELI | | RPCFWVELI | | SFFYRYGFVA | | SSPNAYQAKFE | |
| RPCFWVELV | | RPCFWVELV | | SFGASCFIFL | | SSPNAYQARFE | |
| RPDSSWLFG | | RPDSSWLFG | | SFGASCFILL | | SSPQNILRTQE | |
| RPEEAKYVE | | RPEEAKYVE | | SFGASCFLFL | | SSQLEGFSAES | |
| RPEEAKYVW | | RPEEAKYVW | | SFGASCFLLI | | SSRHCSKYHWN | |
| RPEEVKYVW | | RPEEVKYVW | | SFGASCFLLL | | SSRISFYWTIV | |
| RPFQNASRH | | RPFQNASRH | | SFGASCFVLL | | SSRNGFEILLI | |
| RPFVRGQQG | | RPFVRGQQG | | SFGASCVMLL | | SSRPFQNASRH | |
| RPGDNITFS | | RPGDNITFS | | SFGASSFVLL | | SSRSGFEILLI | |
| RPGETLNVE | | RPGETLNVE | | SFGGFTFKRT | | SSRSGFEVLLI | |
| RPGQTLRVR | | RPGQTLRVR | | SFGVSGINES | | SSSACLRGGRN | |
| RPGVKGFGF | | RPGVKGFGF | | SFGVSGVNES | | SSSCFDGKEWL | |
| RPGYNGQKS | | RPGYNGQKS | | SFHLGTKQVC | | SSSCFDGKEWM | |
| RPGYNGQRS | | RPGYNGQRS | | SFIGEEMATK | | SSSCFDGREWM | |
| RPHPEDLNG | | RPHPEDLNG | | SFIQHPELTG | | SSSCHDGKAWL | |
| RPIGISSMV | | RPIGISSMV | | SFKPNIGPRP | | SSSCHDGKEWL | |
| RPIIEIDMN | | RPIIEIDMN | | SFLAHALKLV | | SSSCHDGKSWL | |
| RPIIEIDMS | | RPIIEIDMS | | SFLTHALRFL | | SSSCHDGNAWL | |
| RPIIEIDMT | | RPIIEIDMT | | SFNGAFIAPD | | SSSCHDGRAWL | |
| RPILSPLTK | | RPILSPLTK | | SFNGAFVAPD | | SSSCYDGKAWL | |
| RPITEINTW | | RPITEINTW | | SFNGEEMATK | | SSSFSFGGFTF | |
| RPKEDEVWW | | RPKEDEVWW | | SFPDGAQIKY | | SSSFYAEMKWL | |
| RPKEDKVWW | | RPKEDKVWW | | SFPDGAQIQY | | SSSGNNQVFPQ | |
| RPKEDRVWW | | RPKEDRVWW | | SFPDGARIQY | | SSSGTSKACNA | |
| RPKEEKVWW | | RPKEEKVWW | | SFPNGAQIQY | | SSSIVMCGVDH | |
| RPKEIEGIC | | RPKEIEGIC | | SFPQTTNTYR | | SSSIVMCGVDY | |
| RPKEMEGIC | | RPKEMEGIC | | SFQGGHIEEC | | SSSIVMCGVEH | |
| RPKEMEGVC | | RPKEMEGVC | | SFQGRGVFEF | | SSSIVMCGVNY | |
| RPKENPAHK | | RPKENPAHK | | SFQGRGVFEL | | SSSLDEQNKLY | |
| RPKVNGQAG | | RPKVNGQAG | | SFQLINNKKP | | SSSLMWEINGP | |
| RPKVNGQSG | | RPKVNGQSG | | SFQPNIGPRA | | SSSMMWEINGP | |
| RPLILKDCS | | RPLILKDCS | | SFQPNIGPRP | | SSSMMWEVNGP | |
| RPLILRDCS | | RPLILRDCS | | SFQSGHIEEC | | SSSMNNQVFPQ | |
| RPLIRGQQG | | RPLIRGQQG | | SFQVDCFIWH | | SSSMPFHNIHP | |
| RPLVMGQQG | | RPLVMGQQG | | SFQVDCFLWH | | SSSNAYQAKFE | |
| RPLVNGQRG | | RPLVNGQRG | | SFQVDCYLWH | | SSSNCKDPNNE | |
| RPLVNGQSG | | RPLVNGQSG | | SFRGRGVFEL | | SSSNCRDPNNE | |

Fig. 83-332

| Block size 8 | SIN | Block size 9 | SIN | Block size 10 | SIN | Block size 11 | SIN |
|---|---|---|---|---|---|---|---|
| RPLVREQQG | | RPLVREQQG | | SFRPNIGPRP | | SSSNCRDSNNE | |
| RPLVRGQQG | | RPLVRGQQG | | SFRQSERGED | | SSSNCRNPNNE | |
| RPLVRGQSG | | RPLVRGQSG | | SFRQSERGEE | | SSSSCFDGKEW | |
| RPLVRSQSG | | RPLVRSQSG | | SFRYGDGVWI | | SSSSCFDGREW | |
| RPMDGTGSC | | RPMDGTGSC | | SFSFGGFTFK | | SSSSCHDGKAW | |
| RPMDSTGSC | | RPMDSTGSC | | SFSIRGETTG | | SSSSCHDGKSW | |
| RPNENPAHK | | RPNENPAHK | | SFSIRWETTG | | SSSSCHDGNAW | |
| RPNENPVHK | | RPNENPVHK | | SFSISCFLLA | | SSSSCHDGRAW | |
| RPNIGPRPL | | RPNIGPRPL | | SFSISCFLLI | | SSSSCYDGKAW | |
| RPPVNGQSG | | RPPVNGQSG | | SFSISCFLLV | | SSSSFYAEMKW | |
| RPQINGQSG | | RPQINGQSG | | SFSMSCFVFV | | SSSSIVMCGVD | |
| RPQMNGQSG | | RPQMNGQSG | | SFSPSPGARP | | SSSSIVMCGVN | |
| RPQVNGQRG | | RPQVNGQRG | | SFSPSPGDRP | | SSSSTVFCGVS | |
| RPQVNGQSG | | RPQVNGQSG | | SFSRTELIAP | | SSSSVVMCGVD | |
| RPRRGLFGA | | RPRRGLFGA | | SFSRTELINP | | SSSTVFCGVSG | |
| RPRVNGQSG | | RPRVNGQSG | | SFSRTELIPP | | SSSTVFCGVSS | |
| RPRVRNQSG | | RPRVRNQSG | | SFSRTELISP | | SSSVLLVSLGA | |
| RPRYNGQRS | | RPRYNGQRS | | SFSRTQLIAP | | SSSVVMCGVDH | |
| RPSAPEGMC | | RPSAPEGMC | | SFTGEEMASK | | SSSYRRPIGIS | |
| RPTAVDTCY | | RPTAVDTCY | | SFTGEEMATK | | SSSYRRPVGIS | |
| RPTRNGWGC | | RPTRNGWGC | | SFTGEEMATR | | SSTEFLGQWDW | |
| RPTTEINTW | | RPTTEINTW | | SFTGWILGNP | | SSTEFLGQWNW | |
| RPTTTIKTW | | RPTTTIKTW | | SFTITGDNTK | | SSTKEKNDLYG | |
| RPVAEINTW | | RPVAEINTW | | SFVPVVGARP | | SSTKEKNELYG | |
| RPVAKAGFI | | RPVAKAGFI | | SFVQHPELTG | | SSTQEKNALYG | |
| RPVDGIGSC | | RPVDGIGSC | | SFVQHPEMTG | | SSTQEKNDLYG | |
| RPVDGTGSC | | RPVDGTGSC | | SFWMCPNGSL | | SSTSCFDGKEW | |
| RPVGISSMG | | RPVGISSMG | | SFWMCSGHSC | | SSTSCHDGIGR | |
| RPVGISSMM | | RPVGISSMM | | SFWMCSNGSL | | SSTSCHDGISR | |
| RPVGISSMV | | RPVGISSMV | | SFWRCSNGSL | | SSTSCHDGKAR | |
| RPVIEIDMN | | RPVIEIDMN | | SFYAELKWLI | | SSTSCHDGKFR | |
| RPVIEIDMS | | RPVIEIDMS | | SFYAELKWLV | | SSTSCHDGKSR | |
| RPVTEINTW | | RPVTEINTW | | SFYAEMEWLL | | SSTSCHDGKTR | |
| RPWIRFNSD | | RPWIRFNSD | | SFYAEMKWLL | | SSTSCHDGMSR | |
| RPWIRFNSN | | RPWIRFNSN | | SFYRNLIWLV | | SSTSCHDGRAR | |
| RPWIRINNE | | RPWIRINNE | | SFYRNLVWIV | | SSTSCHDGRSR | |
| RPWISFDQN | | RPWISFDQN | | SFYRNLVWLV | | SSTSCHDGVGR | |
| RPWMRINNE | | RPWMRINNE | | SFYRNMRWLT | | SSTSCHDGVSR | |
| RPWMRISNE | | RPWMRISNE | | SFYRNVVWLI | | SSTTCHDGIGR | |
| RPWVRGLSS | | RPWVRGLSS | | SFYRSINWLT | | SSTVFCGVSSE | |
| RPWVRGQSG | | RPWVRGQSG | | SFYRSIRWLT | | SSTVLVGLILA | |
| RPWVRINNE | | RPWVRINNE | | SFYRSMKWLT | | SSTVMVGLILA | |
| RPWVRMNNE | | RPWVRMNNE | | SFYRSMRWLT | | SSTYHNSFVPV | |
| RPWVSFDQN | | RPWVSFDQN | | SFYSEMKWLL | | SSTYQNNFVPV | |
| RPWVSFNHN | | RPWVSFNHN | | SFYSEMKWLS | | SSTYQNSFVPV | |
| RPWVSFNQD | | RPWVSFNQD | | SFYWTIVDPG | | SSVASSLVLLF | |
| RPWVSFNQN | | RPWVSFNQN | | SFYWTIVEPE | | SSVASSLVLLL | |
| RQANNGDDA | | RQANNGDDA | | SFYWTIVEPG | | SSVDLVETNHT | |
| RQANNGEDA | | RQANNGEDA | | SFYWTIVKPG | | SSVNTNTINRS | |
| RQANNGEDS | | RQANNGEDS | | SGAAGAAIKG | | SSVSSFEKFEI | |
| RQANNGEEA | | RQANNGEEA | | SGAAGAAVKG | | SSVSSFERFEI | |
| RQANSGEDA | | RQANSGEDA | | SGADDDAYAV | | SSVSSFERFEM | |
| RQASPSCLV | | RQASPSCLV | | SGADDEAYAV | | SSVSSFKRFEI | |
| RQCFNPMII | | RQCFNPMII | | SGADNDAYAV | | SSVTTNTINRI | |
| RQCFNPMIV | | RQCFNPMIV | | SGCITPNGSI | | SSVTTNTINRS | |
| RQCFNPMTV | | RQCFNPMTV | | SGCKMYALHQ | | SSVVLVGLILA | |
| RQCFNPMVV | | RQCFNPMVV | | SGDDVWMGRT | | SSVYIEVLHLT | |
| RQEALQNRI | | RQEALQNRI | | SGDIWITREP | | SSVYVEVLHLT | |
| RQEIDGIKL | | RQEIDGIKL | | SGDIWVTREP | | SSWHILSKDNA | |
| RQEIEGARL | | RQEIEGARL | | SGDYARLYIW | | SSYICSGLVGD | |
| RQEIEGIKL | | RQEIEGIKL | | SGEQMLIIWG | | SSYLCSGLVGD | |
| RQEIEGIRL | | RQEIEGIRL | | SGEQMLVIWG | | SSYMCSGLVGD | |

Fig. 83-333

| Block size 8 | SIN | Block size 9 | SIN | Block size 10 | SIN | Block size 11 | SIN |
|---|---|---|---|---|---|---|---|
| RQEIEGVKL | | RQEIEGVKL | | SGEQVLVIWG | | SSYRRPIGISS | |
| RQEIEGVRL | | RQEIEGVRL | | SGEVPGWSWD | | SSYRRPVGISS | |
| RQEIGGVKL | | RQEIGGVKL | | SGFAIFSKDN | | SSYVCSGLVGD | |
| RQEINGIKL | | RQEINGIKL | | SGFAIISKDN | | STAASSLALAI | |
| RQEIVDNKN | | RQEIVDNKN | | SGFAIVSKDN | | STASRSGYEML | |
| RQEIVDNNN | | RQEIVDNNN | | SGFAVVSKDN | | STASRSGYEVL | |
| RQEIVDNSN | | RQEIVDNSN | | SGFEIIWDPN | | STAVAVIKYNG | |
| RQEIVGNDN | | RQEIVGNDN | | SGFEILLIED | | STDKDSNGVQD | |
| RQEIVSNDN | | RQEIVSNDN | | SGFEILLIEE | | STDKNSNGVQD | |
| RQEKNPALR | | RQEKNPALR | | SGFEMIWDAN | | STDKVDTIIEN | |
| RQEKNPSLR | | RQEKNPSLR | | SGFEMIWDPD | | STDKVNTIIEN | |
| RQGNSVWAG | | RQGNSVWAG | | SGFEMIWDPN | | STDSEMNKLYE | |
| RQGTSVWAG | | RQGTSVWAG | | SGFEMLKIHN | | STDTVDTILEK | |
| RQIGNVINW | | RQIGNVINW | | SGFEMLKIPN | | STDTVDTLIEQ | |
| RQIIRESGG | | RQIIRESGG | | SGFEMLKVPN | | STDTVDTLLEK | |
| RQIIVDNNN | | RQIIVDNNN | | SGFEMLRIPN | | STDTVDTVLEK | |
| RQILRESGG | | RQILRESGG | | SGFEMVWDAN | | STDTVDTVLER | |
| RQILRGSGG | | RQILRGSGG | | SGFEMVWDPN | | STDTVDTVREK | |
| RQILRKSGG | | RQILRKSGG | | SGFEVLFIED | | STDTVNTLIEQ | |
| RQILRRSGG | | RQILRRSGG | | SGFEVLLIED | | STDTVNTLMEQ | |
| RQILRTQES | | RQILRTQES | | SGFEVLLIEN | | STDTVNTLTEQ | |
| RQKIMESGG | | RQKIMESGG | | SGFFGDNPRP | | STECRTFFLTQ | |
| RQKINGVKL | | RQKINGVKL | | SGFFPDGPQI | | STEFLGQWDWP | |
| RQKISGVKL | | RQKISGVKL | | SGFVIVSKDN | | STEFLGQWNWP | |
| RQKRGLFGA | | RQKRGLFGA | | SGFVRTLFQQ | | STEKVDTIIES | |
| RQKSLIWLW | | RQKSLIWLW | | SGGGDIWVTR | | STEKVNTIIES | |
| RQKVMESGG | | RQKVMESGG | | SGGHIEECSC | | STERVDTIIES | |
| RQKVNGVKL | | RQKVNGVKL | | SGGIDKEPMG | | STETVNTLIEQ | |
| RQKWWVWLW | | RQKWWVWLW | | SGGIDKESMG | | STETVNTLSEQ | |
| RQLRENAED | | RQLRENAED | | SGGLLAPRYG | | STETVNTLTEQ | |
| RQLRENAEE | | RQLRENAEE | | SGGTINSPLP | | STGALASCMGL | |
| RQMVHAMRT | | RQMVHAMRT | | SGGYKDIILW | | STGAQSFYRSI | |
| RQMVQAMRA | | RQMVQAMRA | | SGGYKDVILW | | STGGQAFYRSI | |
| RQMVQAMRT | | RQMVQAMRT | | SGIAIALGII | | STGGQSFYRSI | |
| RQNAEEDGK | | RQNAEEDGK | | SGIAIVLGII | | STGKDPKKTGG | |
| RQNAEEDGR | | RQNAEEDGR | | SGICPVVFTD | | STGNFIAPEYA | |
| RQNPTEEQA | | RQNPTEEQA | | SGIEYNGKSL | | STGNHGSLVLS | |
| RQRINGVKL | | RQRINGVKL | | SGIFGDNPRP | | STGNLIAPEYG | |
| RQSERGEDT | | RQSERGEDT | | SGIFGDSPRP | | STGNLIAPRGY | |
| RQSERGEET | | RQSERGEET | | SGIGRFYIQM | | STGNLVAPEYG | |
| RQSFSPSPG | | RQSFSPSPG | | SGIKSFSRTE | | STIALFIGVGN | |
| RQTFDWTLN | | RQTFDWTLN | | SGIKSFSRTQ | | STIALIIGVGN | |
| RQTRGIFGA | | RQTRGIFGA | | SGIKTDGATS | | STIALLIGIGN | |
| RQTRGLFGA | | RQTRGLFGA | | SGIMKTEGTL | | STIALLIGVGN | |
| RQTYDWTLN | | RQTYDWTLN | | SGIMKTEKTL | | STIGDCPKYVN | |
| RQVCIAWSS | | RQVCIAWSS | | SGIMKTERTL | | STKEWSKRYEL | |
| RQVCMAWSS | | RQVCMAWSS | | SGIMKTGGTL | | STKEWSRRYEL | |
| RQVCVAWSS | | RQVCVAWSS | | SGINESADMS | | STKSTVLKSDK | |
| RQVIVDNNN | | RQVIVDNNN | | SGIPPLELGD | | STLGLDIRTAT | |
| RQVIVDNNS | | RQVIVDNNS | | SGIRSFSRTE | | STLKLATGMRN | |
| RQVIVDNSN | | RQVIVDNSN | | SGIRTDGATS | | STLPRRSGAAG | |
| RQVLRESGG | | RQVLRESGG | | SGKADTRILF | | STLVLLVSLGA | |
| RRAAVSADP | | RRAAVSADP | | SGKNTDLEAL | | STMLNLYERVR | |
| RRAEIIKME | | RRAEIIKME | | SGKVECVCRD | | STNAHDRICIG | |
| RRAIATPGM | | RRAIATPGM | | SGLIAGWYGF | | STNAYDRICIG | |
| RRAIVSADP | | RRAIVSADP | | SGLPVGGNEK | | STNSSDKVDTL | |
| RRATVSADP | | RRATVSADP | | SGLTHIMIWH | | STNSSEKVDTL | |
| RRCLLQSLQ | | RRCLLQSLQ | | SGLVAGWYGF | | STNSSEKVNTL | |
| RRDILRTQE | | RRDILRTQE | | SGLVGDTPRD | | STNSSERVDTL | |
| RRDQKALKG | | RRDQKALKG | | SGLVGDTPRE | | STNSTEKVDTL | |
| RRDQKSLKG | | RRDQKSLKG | | SGLVGDTPRG | | STNTVNTLIEQ | |
| RRDQKSLRG | | RRDQKSLRG | | SGLVGDTPRK | | STPLGSPPIVS | |

Fig. 83-334

| Block size 8 | SIN | Block size 9 | SIN | Block size 10 | SIN | Block size 11 | SIN |
|---|---|---|---|---|---|---|---|
| RRDQMAHCR | | RRDQMAHCR | | SGLVGDTPRN | | STPLGSPPMVS | |
| RRDQRALKG | | RRDQRALKG | | SGLVGDTPRS | | STPLGSPPVVS | |
| RRDQRSLRG | | RRDQRSLRG | | SGLVGDTPRT | | STPLGTPPTVS | |
| RRDYFTAEV | | RRDYFTAEV | | SGMDPRMCSL | | STPSAIDQITG | |
| RREIHIYYL | | RREIHIYYL | | SGMIDGWYGF | | STQAAIDQING | |
| RREVHIYYL | | RREVHIYYL | | SGMSANGDIL | | STQAAIDQITG | |
| RREVHMYYL | | RREVHMYYL | | SGNAQHVEEC | | STQAAIDQMTG | |
| RREVHTYYL | | RREVHTYYL | | SGNCRFNVCI | | STQAAVDQITG | |
| RREVHVYYL | | RREVHVYYL | | SGNCRFSVCI | | STQEAIDKITN | |
| RRFIQNALN | | RRFIQNALN | | SGNGDPNNMD | | STQEAIEKITN | |
| RRFVQNALN | | RRFVQNALN | | SGNLIAPEYG | | STQEAIGKITN | |
| RRFVQNALS | | RRFVQNALS | | SGNNQVFPQL | | STQEAINKITN | |
| RRGLFGAIA | | RRGLFGAIA | | SGNWPDGANI | | STQKAIDEITT | |
| RRGQGHLDE | | RRGQGHLDE | | SGNWPDGSDI | | STQKAIDGITN | |
| RRGVKGFGF | | RRGVKGFGF | | SGNWPDGSNI | | STQKAIDGVTN | |
| RRICEKLEQ | | RRICEKLEQ | | SGPDDGAVAV | | STQKAIDIMQN | |
| RRIDFHWLF | | RRIDFHWLF | | SGPDNEAVAV | | STQKAIDNMQN | |
| RRIDFHWLL | | RRIDFHWLL | | SGPDNGAVAV | | STQKAIDQITT | |
| RRIDFNWLL | | RRIDFNWLL | | SGPDSGAVAV | | STQKAIDRITT | |
| RRIENLNKK | | RRIENLNKK | | SGPLKAEIAQ | | STQKAINEITT | |
| RRIENLNRK | | RRIENLNRK | | SGPNDNASAV | | STQKAINGVTN | |
| RRIESLNKK | | RRIESLNKK | | SGPNNNASAI | | STQKALNEITT | |
| RRINMLADR | | RRINMLADR | | SGPNNNASAV | | STQKAMDGVTN | |
| RRIWRQANN | | RRIWRQANN | | SGPSFYAEMK | | STQKTIDQVTG | |
| RRKKRGLFG | | RRKKRGLFG | | SGQFPVQTDE | | STQMAIDNMQN | |
| RRKRGLFGA | | RRKRGLFGA | | SGQLKLATGL | | STQPTFSVQRN | |
| RRKRRGLFG | | RRKRRGLFG | | SGQNHGICAV | | STQRAIDGVTN | |
| RRKTNLYGF | | RRKTNLYGF | | SGRADTKILF | | STQRAIDNMQN | |
| RRLENLNKK | | RRLENLNKK | | SGRADTRILF | | STQSAIDQITG | |
| RRLENLNKR | | RRLENLNKR | | SGREWSYIVE | | STQSAIDQITR | |
| RRLENLSKR | | RRLENLSKR | | SGRIDFHWLI | | STQSAIDQVTG | |
| RRLSANAID | | RRLSANAID | | SGRIDFHWLL | | STQSAINQITG | |
| RRLSANAVD | | RRLSANAVD | | SGRIDFHWLM | | STQSAVDQITG | |
| RRLSTNAID | | RRLSTNAID | | SGRIDFHWLV | | STQSAVNQITG | |
| RRLSTNAMD | | RRLSTNAMD | | SGRIFQSGVR | | STRGIQIASNE | |
| RRLSVNAID | | RRLSVNAID | | SGRISFYWTI | | STRGVQIASNE | |
| RRLTTTIKP | | RRLTTTIKP | | SGRISIYWTL | | STRGVQVASNE | |
| RRLTTTIKT | | RRLTTTIKT | | SGRLIDFLKD | | STRSDQISIVP | |
| RRLTTTIRT | | RRLTTTIRT | | SGRLMDFLKD | | STRSRSGFEML | |
| RRLTTTVKT | | RRLTTTVKT | | SGRQEKNPAL | | STSCFDGKEWM | |
| RRLTVLGKD | | RRLTVLGKD | | SGRQEKNPSL | | STSCHDGIGRM | |
| RRMVQAMRA | | RRMVQAMRA | | SGRSSFFRNV | | STSCHDGISRM | |
| RRNKYLEEH | | RRNKYLEEH | | SGRVSFYWTI | | STSCHDGKARM | |
| RRNRYLEEH | | RRNRYLEEH | | SGSAQHIEEC | | STSCHDGKFRM | |
| RRNSSDICY | | RRNSSDICY | | SGSAQHVEEC | | STSCHDGKSRM | |
| RRNWRQANN | | RRNWRQANN | | SGSFIDYWAE | | STSCHDGKTRM | |
| RRNYFTAEI | | RRNYFTAEI | | SGSFIDYWAK | | STSCHDGMSRM | |
| RRNYFTAEV | | RRNYFTAEV | | SGSFIDYWDD | | STSCHDGRARM | |
| RRNYFTTEV | | RRNYFTTEV | | SGSFIDYWDE | | STSCHDGRSRM | |
| RRPDSSWLF | | RRPDSSWLF | | SGSFIDYWND | | STSCHDGVGRM | |
| RRPIGISSM | | RRPIGISSM | | SGSFIQHPEL | | STSCHDGVSRM | |
| RRPVAEINT | | RRPVAEINT | | SGSFMDYWAE | | STTAKAMEQMA | |
| RRPVAKAGF | | RRPVAKAGF | | SGSFPDGAQI | | STTAKAMEQVA | |
| RRPVGISSM | | RRPVGISSM | | SGSFPDGARI | | STTCHDGIGRM | |
| RRPVTEINT | | RRPVTEINT | | SGSFPNGAQI | | STTFPYTGDPP | |
| RRQILRTQE | | RRQILRTQE | | SGSFSIRGET | | STTHDRTAFRG | |
| RRQKRGLFG | | RRQKRGLFG | | SGSFSIRWET | | STVAASLCLAI | |
| RRQKSLIWL | | RRQKSLIWL | | SGSFTLPIEL | | STVAASLCLAV | |
| RRQKWWVWL | | RRQKWWVWL | | SGSFTLPVEL | | STVASSLALAI | |
| RRQLRENAE | | RRQLRENAE | | SGSFTLPVEM | | STVASSLTLAI | |
| RRRFIQNAL | | RRRFIQNAL | | SGSFTLPVGL | | STVASSLVLAI | |
| RRRFVQNAL | | RRRFVQNAL | | SGSFVDYWAE | | STVFCGVSGEV | |

Fig. 83-335

| Block size 8 | SIN | Block size 9 | SIN | Block size 10 | SIN | Block size 11 | SIN |
|---|---|---|---|---|---|---|---|
| RRRGLFGAI | | RRRGLFGAI | | SGSFVQHPEL | | STVFCGVSSEV | |
| RRRKKRGLF | | RRRKKRGLF | | SGSFVQHPEM | | STVLGVSILNL | |
| RRRKRGLFG | | RRRKRGLFG | | SGSIISFCGV | | STVLGVSVLNL | |
| RRRTNLYGF | | RRRTNLYGF | | SGSLEFIAEQ | | STVLKSDKRIG | |
| RRRVDINPG | | RRRVDINPG | | SGSLKLAIGL | | STVLVGLILAF | |
| RRRVDMNPG | | RRRVDMNPG | | SGSLKLAIGP | | STVMVGLILAF | |
| RRRVDTNPG | | RRRVDTNPG | | SGSLPDGAQI | | STVNEEALRQK | |
| RRRVDVNPG | | RRRVDVNPG | | SGSLQCRICI | | STVSSFERFEI | |
| RRSGAAGAA | | RRSGAAGAA | | SGSQKQEFKM | | STVSSGLVLVG | |
| RRSGGIGKE | | RRSGGIGKE | | SGSSFYAELK | | STVSSSLVLAG | |
| RRSGGISKE | | RRSGGISKE | | SGSSFYAEMK | | STVSSSLVLVG | |
| RRSYFTAEV | | RRSYFTAEV | | SGSSIAFCGV | | STVVNNITTTI | |
| RRTNLYGFI | | RRTNLYGFI | | SGSSISFCGV | | STVVSSLALAI | |
| RRVDINPGH | | RRVDINPGH | | SGTCAVVMTD | | STWLGRTISPR | |
| RRVDMNPGH | | RRVDMNPGH | | SGTDNYGVKG | | STYHNSFVPVV | |
| RRVDTNPGH | | RRVDTNPGH | | SGTNNYGVKG | | STYKILSIYSS | |
| RRVDVNPGH | | RRVDVNPGH | | SGTSKACNAL | | STYQNNFVPVI | |
| RRVWRQANN | | RRVWRQANN | | SGTSKACNAS | | STYQNNFVPVM | |
| RRYELEIGT | | RRYELEIGT | | SGTSKACSAS | | STYQNNFVPVV | |
| RRYGPALSI | | RRYGPALSI | | SGTYGAGSWP | | STYQNSFVPVV | |
| RSALILRGA | | RSALILRGA | | SGTYGKGSWP | | SVAGWLLGNPL | |
| RSALILRGS | | RSALILRGS | | SGTYGSGSWP | | SVAGWLLGNPM | |
| RSAYERMCN | | RSAYERMCN | | SGTYGTGSWP | | SVAHKSCLPAC | |
| RSDGNLIAP | | RSDGNLIAP | | SGTYGTGTWP | | SVAPIMFSNKM | |
| RSDKICIGY | | RSDKICIGY | | SGVAIALSIL | | SVASSLVLLFM | |
| RSDKICLGH | | RSDKICLGH | | SGVAIALSVL | | SVASSLVLLLM | |
| RSDQISIVP | | RSDQISIVP | | SGVESAVLRG | | SVAWSASACHD | |
| RSEKLVLAT | | RSEKLVLAT | | SGVEYNGKSL | | SVAWSATACHD | |
| RSESSFYAE | | RSESSFYAE | | SGVFGDNPRP | | SVAWSATACSD | |
| RSFKPNIGP | | RSFKPNIGP | | SGVFGDNPRS | | SVCISGPNNNA | |
| RSFQPNIGP | | RSFQPNIGP | | SGVFGDSPRP | | SVCMSGPNNNA | |
| RSFRPNIGP | | RSFRPNIGP | | SGVFGDTPRP | | SVCYNPCFYVE | |
| RSFSRTELI | | RSFSRTELI | | SGVKLEENST | | SVDLVETNHTG | |
| RSGAAGAAI | | RSGAAGAAI | | SGVLGDNPRP | | SVEGWVVIAKD | |
| RSGAAGAAV | | RSGAAGAAV | | SGVMKTEGTL | | SVENLEELRFV | |
| RSGFEIIKV | | RSGFEIIKV | | SGVNESADMS | | SVENQEELRSL | |
| RSGFEIIRV | | RSGFEIIRV | | SGVNSFSRTE | | SVEPKGLFGAI | |
| RSGFEIIWD | | RSGFEIIWD | | SGWLLGNPMC | | SVEPRGLFGAI | |
| RSGFEILLI | | RSGFEILLI | | SGWLTLGITG | | SVESSTYQNNF | |
| RSGFEMIWD | | RSGFEMIWD | | SGWTTANSKS | | SVEWSATACHD | |
| RSGFEMLKI | | RSGFEMLKI | | SGYAADKAST | | SVEYASKTRIS | |
| RSGFEMLKV | | RSGFEMLKV | | SGYAADKESS | | SVGGIDTNKTF | |
| RSGFEMLRI | | RSGFEMLRI | | SGYAADKEST | | SVGGINTNKTF | |
| RSGFEMVWD | | RSGFEMVWD | | SGYAADKKST | | SVGGINTNRTF | |
| RSGFEVIKV | | RSGFEVIKV | | SGYAADLKST | | SVGSGSFPDGA | |
| RSGFEVIRV | | RSGFEVIRV | | SGYAADQEST | | SVGSSTYHNSF | |
| RSGFEVLFI | | RSGFEVLFI | | SGYAADQKST | | SVGSSTYQNNF | |
| RSGFEVLKV | | RSGFEVLKV | | SGYAADREST | | SVGSSTYQNSF | |
| RSGFEVLLI | | RSGFEVLLI | | SGYAADRKST | | SVGTSTLNRL | |
| RSGMDPRMC | | RSGMDPRMC | | SGYAANKEST | | SVGTSTLNQRL | |
| RSGPSFYAE | | RSGPSFYAE | | SGYAQTDCVL | | SVGTSTLNQRM | |
| RSGQNHGIC | | RSGQNHGIC | | SGYEILKVPN | | SVGTSTLNQRS | |
| RSGSSFYAE | | RSGSSFYAE | | SGYEMLKVPD | | SVGWSATACHD | |
| RSGTSKACN | | RSGTSKACN | | SGYEMLKVPN | | SVHRNTIGDCP | |
| RSGYEILKV | | RSGYEILKV | | SGYETFKVIG | | SVIEKMNIQFT | |
| RSGYEMLKV | | RSGYEMLKV | | SGYETFRVID | | SVIEKMNTQFT | |
| RSGYETFKV | | RSGYETFKV | | SGYETFRVIG | | SVIPSGPLKAE | |
| RSGYETFRV | | RSGYETFRV | | SGYETFRVIS | | SVIREPFISCS | |
| RSGYEVLKV | | RSGYEVLKV | | SGYETFRVTG | | SVKLSSGYKDI | |
| RSGYSGIFS | | RSGYSGIFS | | SGYEVLKVPD | | SVKMEKIVLLL | |
| RSGYSGSFI | | RSGYSGSFI | | SGYEVLKVPN | | SVKNGTYDYPK | |
| RSGYSGVFS | | RSGYSGVFS | | SGYFGVFSVE | | SVKNGTYNYPK | |

Fig. 83-336

| Block size 8 | SIN | Block size 9 | SIN | Block size 10 | SIN | Block size 11 | SIN |
|---|---|---|---|---|---|---|---|
| RSGYWAIRT | | RSGYWAIRT | | SGYKDIILWF | | SVKTLTDNHVE | |
| RSHEQMETG | | RSHEQMETG | | SGYKDVIIWF | | SVLINTYQWII | |
| RSHKICIGY | | RSHKICIGY | | SGYKDVILWF | | SVLNLLIGISN | |
| RSHLRNDTD | | RSHLRNDTD | | SGYKEVILWF | | SVLNLLIGVSN | |
| RSICEKLEQ | | RSICEKLEQ | | SGYSGAFIDY | | SVLVNTYQWII | |
| RSIEEKFEI | | RSIEEKFEI | | SGYSGAFMDY | | SVLVNTYQWVI | |
| RSIIFNMER | | RSIIFNMER | | SGYSGAFTIP | | SVNTNTINRSF | |
| RSILANNGK | | RSILANNGK | | SGYSGAFTVP | | SVPASRYLIDM | |
| RSILANNGR | | RSILANNGR | | SGYSGAFVDY | | SVPASRYLTDM | |
| RSILASSGS | | RSILASSGS | | SGYSGIFSIE | | SVPLGSSPNAY | |
| RSILNTSQR | | RSILNTSQR | | SGYSGIFSVE | | SVPLGSSSNAY | |
| RSINWLTKK | | RSINWLTKK | | SGYSGSFIDY | | SVPMGSSPNAY | |
| RSIRWLTLK | | RSIRWLTLK | | SGYSGSFIQH | | SVQPAFSVQRN | |
| RSIVASSGT | | RSIVASSGT | | SGYSGSFMDY | | SVQPTFSVQRN | |
| RSIVRRATV | | RSIVRRATV | | SGYSGSFSIR | | SVQPTFSVQRS | |
| RSKFLLMDA | | RSKFLLMDA | | SGYSGSFTIP | | SVQSRGLFGAI | |
| RSKFLLMDS | | RSKFLLMDS | | SGYSGSFTLP | | SVRIGSKGDVF | |
| RSKIITIGS | | RSKIITIGS | | SGYSGSFVDY | | SVRLSAGGDIW | |
| RSKINEVKL | | RSKINEVKL | | SGYSGSFVQH | | SVRLSASGDIW | |
| RSKINGVIL | | RSKINGVIL | | SGYSGVFSVE | | SVRNGTYDYPK | |
| RSKINGVKL | | RSKINGVKL | | SGYVCSGLVG | | SVSECRTFFLT | |
| RSKINGVRL | | RSKINGVRL | | SGYWAIRTRS | | SVSGWLLGNPM | |
| RSKVNGQSG | | RSKVNGQSG | | SHCRATEYIM | | SVSSFEKFEIF | |
| RSKYWAIRT | | RSKYWAIRT | | SHCRATEYMM | | SVSSFERFEIF | |
| RSLFSSIKK | | RSLFSSIKK | | SHEGEGIPLC | | SVSSFERFEMF | |
| RSLFSSIKR | | RSLFSSIKR | | SHEGEGIPLH | | SVSSFKRFEIF | |
| RSLIASSGT | | RSLIASSGT | | SHEGEGIPLY | | SVTELWSYNAE | |
| RSLIQFPIG | | RSLIQFPIG | | SHGKIIQNED | | SVTQTLVSNND | |
| RSLIQFPMG | | RSLIQFPMG | | SHGRIIQNED | | SVTTNTINRIF | |
| RSLIRFPIG | | RSLIRFPIG | | SHGRILKNDL | | SVTTNTINRNF | |
| RSLIRFPVG | | RSLIRFPVG | | SHGRILKNNL | | SVTTNTINRSF | |
| RSLISWPLS | | RSLISWPLS | | SHGRTIQNED | | SVVEKMNTQFT | |
| RSLKLAIGL | | RSLKLAIGL | | SHGRVLKNNL | | SVVLVGLILAF | |
| RSLKLATGL | | RSLKLATGL | | SHGTGTGYTM | | SVYIEVLHLTQ | |
| RSLLLATGM | | RSLLLATGM | | SHGVKGWAFD | | SVYKALSIYSC | |
| RSLMLATGM | | RSLMLATGM | | SHISPLSGSA | | SVYVEVLHLTQ | |
| RSLMSCPVG | | RSLMSCPVG | | SHKICIGYHA | | SVYWTIVKPGD | |
| RSLVASSGN | | RSLVASSGN | | SHLECRTFFL | | SVYWTVVKPGD | |
| RSLVASSGT | | RSLVASSGT | | SHLKFKADLI | | SWAGNILRTQE | |
| RSLWDSFRQ | | RSLWDSFRQ | | SHLRNDTDVV | | SWASNSIVTFC | |
| RSLYSGFVR | | RSLYSGFVR | | SHMECRTFFL | | SWAVGRCPRYV | |
| RSMKWLTLK | | RSMKWLTLK | | SHNGGLIAPD | | SWDDGAILPFD | |
| RSMRWLTLK | | RSMRWLTLK | | SHNGGLIAPS | | SWDDGAILPLT | |
| RSNAPSGIE | | RSNAPSGIE | | SHNGGLVAPS | | SWEGNILRTQE | |
| RSNAPSGVE | | RSNAPSGVE | | SHPGIFENSC | | SWEMGLAPSPY | |
| RSNENLIAP | | RSNENLIAP | | SHPGIFESSC | | SWEMGQAPSPY | |
| RSNENPAHK | | RSNENPAHK | | SHPGIFGNSC | | SWGDGAILPFD | |
| RSNGNLIAP | | RSNGNLIAP | | SHPGLFENSC | | SWGMGQAPSPY | |
| RSNGNLVAP | | RSNGNLVAP | | SHRTLLMNEL | | SWHDGAEIIYF | |
| RSNIFNMER | | RSNIFNMER | | SHSECRTFFL | | SWHDGAEITYF | |
| RSPFRALIS | | RSPFRALIS | | SHTAYSQITN | | SWHIFGKDNAI | |
| RSPFRALVS | | RSPFRALVS | | SHYEECSCYP | | SWHIFGKDNAV | |
| RSPFRTLMS | | RSPFRTLMS | | SHYVCSGLVG | | SWHIFSKDNAI | |
| RSPGNAEIE | | RSPGNAEIE | | SIAASYKRIR | | SWHILSKDNAI | |
| RSPHRALMS | | RSPHRALMS | | SIADKICIGY | | SWHILSKDNAV | |
| RSPHRTLLM | | RSPHRTLLM | | SIAFCGVDSD | | SWHIYGKDNAI | |
| RSPHRTLMS | | RSPHRTLMS | | SIAFCGVNSD | | SWHIYGKDNAV | |
| RSPQRTLMS | | RSPQRTLMS | | SIAFCGVNSN | | SWIPKRNRSIL | |
| RSPYRALIS | | RSPYRALIS | | SIAGWLLGNP | | SWKGNIMRTQE | |
| RSPYRALMS | | RSPYRALMS | | SIAHKSCLPA | | SWKKQILRTQE | |
| RSPYRTLLM | | RSPYRTLLM | | SIAPIMFSNK | | SWLGRTISKDL | |
| RSPYRTLMS | | RSPYRTLMS | | | | SWLGRTISKDS | |

Fig. 83-337

| Block size 8 | SIN | Block size 9 | SIN | Block size 10 | SIN | Block size 11 | SIN |
|---|---|---|---|---|---|---|---|
| RSQFRALIS | | RSQFRALIS | | SIASRSGYEI | | SWLGRTISKDT | |
| RSQSGRISF | | RSQSGRISF | | SIASRSGYEM | | SWLGRTTSKDS | |
| RSQYRALIS | | RSQYRALIS | | SIAVFCGTSG | | SWLTIGISGPD | |
| RSQYRALVS | | RSQYRALVS | | SIAWSATACH | | SWLTIGVSGPD | |
| RSQYRSLIS | | RSQYRSLIS | | SICEKLEQSG | | SWMKIYWHLMH | |
| RSQYSGFVR | | RSQYSGFVR | | SICISGPNNN | | SWMKLYWHLMH | |
| RSRIDYYWS | | RSRIDYYWS | | SICMSGPNDN | | SWMKLYWHLMR | |
| RSRNGFEML | | RSRNGFEML | | SICMSGPNNN | | SWMKLYWHLMS | |
| RSRSGFEML | | RSRSGFEML | | SICTHLEVCF | | SWPDGADINFM | |
| RSRSGFEVL | | RSRSGFEVL | | SICVSGPNNN | | SWPDGALFPLT | |
| RSRSSFYAE | | RSRSSFYAE | | SIDECRTFFL | | SWPDGALLPFD | |
| RSRYSGFVR | | RSRYSGFVR | | SIDGKAPISL | | SWPDGALLPLT | |
| RSRYWAIRT | | RSRYWAIRT | | SIDLVETNHT | | SWPDGANIDFM | |
| RSSCHDGKA | | RSSCHDGKA | | SIDPKGLFGA | | SWPDGANIDFV | |
| RSSFEIIKV | | RSSFEIIKV | | SIDRFLRVKD | | SWPDGANINFM | |
| RSSFYAEMK | | RSSFYAEMK | | SIDRFLRVRD | | SWPDGANINLM | |
| RSSSSFYAE | | RSSSSFYAE | | SIDSGYVCSG | | SWPDGANISFM | |
| RSTIGDCPK | | RSTIGDCPK | | SIDSNYVCSG | | SWPLSSPPTVY | |
| RSWKKQILR | | RSWKKQILR | | SIDSSYICSG | | SWPQSSPPTVY | |
| RSWMKIYWH | | RSWMKIYWH | | SIDSSYVCSG | | SWRKDILRTQE | |
| RSWMKLYWH | | RSWMKLYWH | | SIEDPDHEGE | | SWRKKILRTQE | |
| RSWRKKILR | | RSWRKKILR | | SIEDPNHEGE | | SWRKQILRTQE | |
| RSWRKQILR | | RSWRKQILR | | SIEDPSHEGE | | SWRRDILRTQE | |
| RSWRRQILR | | RSWRRQILR | | SIEECLINDP | | SWRRQILRTQE | |
| RSWSKPQCQ | | RSWSKPQCQ | | SIEEPSHEGE | | SWSGYSGIFSV | |
| RSWSYIVER | | RSWSYIVER | | SIENLEELRF | | SWSHNILRTQE | |
| RSYEQMETD | | RSYEQMETD | | SIENPSHEGE | | SWSKNILRTQE | |
| RSYEQMETG | | RSYEQMETG | | SIENQEELKS | | SWSQNILRTQE | |
| RSYEQMETS | | RSYEQMETS | | SIENQEELRF | | SWSWHDGAEII | |
| RSYFTAEVS | | RSYFTAEVS | | SIENQEELRS | | SWSWHDGAEIT | |
| RSYNNTSGE | | RSYNNTSGE | | SIEPKGLFGA | | SWSWHDGAILP | |
| RSYNNTSGG | | RSYNNTSGG | | SIEPRGLFGA | | SWSWHDGAVLP | |
| RSYNNTSGK | | RSYNNTSGK | | SIESEFNEIE | | SWSWPDGALLP | |
| RTAFRGLIS | | RTAFRGLIS | | SIESEFSEIE | | SWSYIVEKLNP | |
| RTAFRGLMS | | RTAFRGLMS | | SIESEFSETE | | SWSYIVEKPNP | |
| RTATREGKH | | RTATREGKH | | SIGITVIKNN | | SWSYIVEKTNP | |
| RTAYERMCN | | RTAYERMCN | | SIGKVCRALL | | SWSYIVERPNP | |
| RTCKLLGIN | | RTCKLLGIN | | SIGKVCRTLL | | SWSYIVERPSA | |
| RTCKLVGIN | | RTCKLVGIN | | SIGNLIAPRG | | SWTPKRNRSIL | |
| RTDGATSAC | | RTDGATSAC | | SIGSSTYQNN | | SWTSNSIITFC | |
| RTELINPNK | | RTELINPNK | | SIGSWSQNIL | | SWTSNSIVTFC | |
| RTELINPSK | | RTELINPSK | | SIGTSTLNQR | | SWTSNSMVTFC | |
| RTELIPPSK | | RTELIPPSK | | SIGVAVIKNN | | SWVPILNTSQR | |
| RTELISPNK | | RTELISPNK | | SIGVTVIKNN | | SWVPKRNRSIL | |
| RTELISPSK | | RTELISPSK | | SIGVTVIRNN | | SYCRATEYIMK | |
| RTESLQNRI | | RTESLQNRI | | SIHECRTFFL | | SYFANLKGTRT | |
| RTFFGWKEP | | RTFFGWKEP | | SIHSRGLFGA | | SYFFGDNAEEF | |
| RTFFLTHGA | | RTFFLTHGA | | SIHWTIVKPG | | SYFFGDNAEEY | |
| RTFFLTHGS | | RTFFLTHGS | | SIIAFCGTSG | | SYFFGDNAKEY | |
| RTFFLTQGA | | RTFFLTQGA | | SIIALLIGIG | | SYFFGDSAEEY | |
| RTFFLTQGS | | RTFFLTQGS | | SIIDKMNTQF | | SYFQLFLVCVS | |
| RTFQNIDKN | | RTFQNIDKN | | SIIEAESSVK | | SYGRIIQNEDI | |
| RTFQNIDRN | | RTFQNIDRN | | SIIEKMNTQF | | SYICSGLVGDT | |
| RTFQNVSPL | | RTFQNVSPL | | SIIFNMERIK | | SYIIRALTLNT | |
| RTFSFQLIL | | RTFSFQLIL | | SIIFNSIGNL | | SYINKTGTFEF | |
| RTFSFQLIN | | RTFSFQLIN | | SIIGKMNTQF | | SYINRTGTFEF | |
| RTFSPRSRS | | RTFSPRSRS | | SIINKMNTQF | | SYIVERPKEIE | |
| RTGMDPRMC | | RTGMDPRMC | | SIIPSGPLKA | | SYIVERPKEME | |
| RTGTFEFTS | | RTGTFEFTS | | SIISFCGVNS | | SYIVERPSAPE | |
| RTHESECVC | | RTHESECVC | | SIISMCSSTE | | SYIVERTKEME | |
| RTHIHIFSF | | RTHIHIFSF | | SIITELPFQN | | SYKILSIYSTV | |
| RTHQYSEKG | | RTHQYSEKG | | SIITFCGLDN | | SYKRIRLFDYS | |

Fig. 83-338

| Block size 8 | SIN | Block size 9 | SIN | Block size 10 | SIN | Block size 11 | SIN |
|---|---|---|---|---|---|---|---|
| RTHQYSERG | | RTHQYSERG | | SIIVFCGTSG | | SYKRVRLFDYS | |
| RTINTASRS | | RTINTASRS | | SIKKYERVKM | | SYLCSGLVGDT | |
| RTIQNEDIP | | RTIQNEDIP | | SIKNQEELRS | | SYLECRTFFLT | |
| RTISIASRS | | RTISIASRS | | SIKRYERVKM | | SYLIEDPAAPH | |
| RTISKDLRS | | RTISKDLRS | | SIKSWRKDIL | | SYLIEDPGAPH | |
| RTISKDSRS | | RTISKDSRS | | SIKSWRRDIL | | SYLIEDPNAPH | |
| RTISKDTRS | | RTISKDTRS | | SIKTKLPFQN | | SYLIEDPNAPN | |
| RTISMDSRS | | RTISMDSRS | | SILANNGKFE | | SYLIEDPSAPH | |
| RTISPKLRS | | RTISPKLRS | | SILANNGRFE | | SYLIEDPTAPH | |
| RTISPRLRS | | RTISPRLRS | | SILASSGSLE | | SYLIRALTLNT | |
| RTISPRSRN | | RTISPRSRN | | SILHKCNDSC | | SYLIRTLTLNT | |
| RTISPRSRS | | RTISPRSRS | | SILNLLIGIS | | SYLLLNKSLCN | |
| RTISRDSRS | | RTISRDSRS | | SILNTSQRGI | | SYLNVRCVCRD | |
| RTISTASRS | | RTISTASRS | | SILNTSQRGV | | SYMCSGLVGDT | |
| RTISYSSRS | | RTISYSSRS | | SILRTQESEC | | SYNADLLVAME | |
| RTIWTSGSS | | RTIWTSGSS | | SILTDSQTAT | | SYNADVLVALE | |
| RTKEGRRKT | | RTKEGRRKT | | SIMSCDSPSN | | SYNAEFLVALE | |
| RTKEGRRRT | | RTKEGRRRT | | SINECRTFFL | | SYNAEFLVAME | |
| RTKEMEGIC | | RTKEMEGIC | | SINGKAPISL | | SYNAEFLVAVE | |
| RTKNLESRS | | RTKNLESRS | | SINGKQPISL | | SYNAEILVALE | |
| RTKSGGNTN | | RTKSGGNTN | | SINGRAPISL | | SYNAELLIALE | |
| RTKSLESRS | | RTKSLESRS | | SINPVKLSSG | | SYNAELLIAME | |
| RTLDFHDFN | | RTLDFHDFN | | SINTKLPFQN | | SYNAELLVAIE | |
| RTLDFHDSN | | RTLDFHDSN | | SINTRLPFQN | | SYNAELLVALE | |
| RTLDFHDSS | | RTLDFHDSS | | SINWLTKKEP | | SYNAELLVAME | |
| RTLDLHDAN | | RTLDLHDAN | | SINWLTKKKN | | SYNAELLVLME | |
| RTLDLHDSN | | RTLDLHDSN | | SINWLTKKKP | | SYNAGLLVALE | |
| RTLDMHDAN | | RTLDMHDAN | | SIPNDKPFQN | | SYNAKLLVLIE | |
| RTLDQHDAN | | RTLDQHDAN | | SIPNEKPFQN | | SYNAKLLVLLE | |
| RTLDYHDSH | | RTLDYHDSH | | SIPNGKPFQN | | SYNAQLLVLLE | |
| RTLDYHDSN | | RTLDYHDSN | | SIPNNKPFQN | | SYNAQLLVWLE | |
| RTLFQQMRD | | RTLFQQMRD | | SIQPTFSVQR | | SYNARLLVLLE | |
| RTLGFHDSN | | RTLGFHDSN | | SIQSDKPFQN | | SYNNTNGEQIL | |
| RTLGLHDAN | | RTLGLHDAN | | SIQSKGLFGA | | SYNNTSGEQIL | |
| RTLLAKSVF | | RTLLAKSVF | | SIQSRGLFGA | | SYNNTSGEQML | |
| RTLLMNELG | | RTLLMNELG | | SIQTRGLFGA | | SYNNTSGEQVL | |
| RTLLMSELG | | RTLLMSELG | | SIRDNTYDHT | | SYNNTSGKQML | |
| RTLMSCPIG | | RTLMSCPIG | | SIRGEFNQVE | | SYPNVRCVCRD | |
| RTLMSCPMG | | RTLMSCPMG | | SIRGEFSQVE | | SYRRPIGISSM | |
| RTLMSCPVG | | RTLMSCPVG | | SIRGETTGRN | | SYRRPVGISSM | |
| RTLMSVEIG | | RTLMSVEIG | | SIRIGSKGDI | | SYRSLIRFPIG | |
| RTLMSVEVG | | RTLMSVEVG | | SIRIGSKGDV | | SYRTLLMNELG | |
| RTLMSVKIG | | RTLMSVKIG | | SIRIGSRGDV | | SYRTLLMSELG | |
| RTLMSVKVG | | RTLMSVKVG | | SIRLAAGGAI | | SYSAGALASCM | |
| RTLNTASRS | | RTLNTASRS | | SIRLAAGGDI | | SYSTGALASCM | |
| RTLTLNTMT | | RTLTLNTMT | | SIRLSADGDI | | SYVCSGLVGDT | |
| RTLYFHDSN | | RTLYFHDSN | | SIRLSAGGAI | | SYVRLYLWGVH | |
| RTNEKFHQI | | RTNEKFHQI | | SIRLSAGGDI | | SYWWDGLQSSD | |
| RTNEKYHQI | | RTNEKYHQI | | SIRLSAGGHI | | TAADLKSTQAA | |
| RTNGNLIAP | | RTNGNLIAP | | SIRLSAGGNI | | TAADLKSTQTA | |
| RTNGTSKIK | | RTNGTSKIK | | SIRLSASGDV | | TAADYKSTPSA | |
| RTNGTSKVK | | RTNGTSKVK | | SIRNETYDHD | | TAADYKSTQAA | |
| RTNLYGFII | | RTNLYGFII | | SIRNGTYDHD | | TAADYKSTQSA | |
| RTNMINDKI | | RTNMINDKI | | SIRNGTYDHN | | TAAQKAMMDQV | |
| RTNQQFELI | | RTNQQFELI | | SIRNGTYNHD | | TAAQRAMMDQV | |
| RTPHRTLLM | | RTPHRTLLM | | SIRNGTYNHN | | TAAQRAMVDQV | |
| RTPIAFLTS | | RTPIAFLTS | | SIRNNTYDHA | | TACSDGPGWLT | |
| RTPYRSLIK | | RTPYRSLIK | | SIRNNTYDHK | | TACSDGSGWLT | |
| RTPYRSLIQ | | RTPYRSLIQ | | SIRNNTYDHN | | TADKDSNGVQD | |
| RTPYRSLIR | | RTPYRSLIR | | SIRNNTYDHR | | TAEISHCRATE | |
| RTPYRTLLM | | RTPYRTLLM | | SIRNNTYDHS | | TAEVSHCRATE | |
| RTQDSECVS | | RTQDSECVS | | SIRNNTYDHT | | TAEVSYCRATE | |

Fig. 83-339

| Block size 8 | SIN | Block size 9 | SIN | Block size 10 | SIN | Block size 11 | SIN |
|---|---|---|---|---|---|---|---|
| RTQESECAC | | RTQESECAC | | SIRNNTYNHT | | TAFRGLISTPL | |
| RTQESECIC | | RTQESECIC | | SIRNSTYDHS | | TAFRGLMSTPL | |
| RTQESECQC | | RTQESECQC | | SIRWETTGRN | | TAFSGMSANGD | |
| RTQESECQR | | RTQESECQR | | SISCFLLAAL | | TAIDQINGKLN | |
| RTQESECVC | | RTQESECVC | | SISCFLLIAL | | TAIDQITGKLN | |
| RTQESECVR | | RTQESECVR | | SISCFLLVAL | | TAKAMEQMAGS | |
| RTQESGCVC | | RTQESGCVC | | SISCLYKLSQ | | TAKAMEQVAGS | |
| RTQESSCTC | | RTQESSCTC | | SISECRTFFL | | TAKHIEECSCY | |
| RTQESSCVC | | RTQESSCVC | | SISIGSSTYQ | | TAKHIEECSSY | |
| RTRALVRSG | | RTRALVRSG | | SISNDKPFQN | | TALANTIEIFR | |
| RTRALVRTG | | RTRALVRTG | | SISSWSQNIL | | TALANTIEVFR | |
| RTREGRRKT | | RTREGRRKT | | SISVESSTYQ | | TALLNASCAAM | |
| RTREILTKI | | RTREILTKI | | SISVGSSIYQ | | TALSTIALLIG | |
| RTREILTKT | | RTREILTKT | | SISVGSSTYQ | | TALYKNANTLS | |
| RTREILTRT | | RTREILTRT | | SITDIWTYQA | | TAMDDFQLIPM | |
| RTRGILTKT | | RTRGILTKT | | SITELWSYNA | | TAMLCLGHHAV | |
| RTRGLFGAI | | RTRGLFGAI | | SITEVWSYNA | | TAMLNASCAAM | |
| RTRSGGNNN | | RTRSGGNNN | | SITFSHNGGL | | TANSIIVFCGT | |
| RTRSGGNTN | | RTRSGGNTN | | SITQTLVSNN | | TAPHGLCYPGE | |
| RTRSGGNTS | | RTRSGGNTS | | SITQTLVSNS | | TAQMALQLFIK | |
| RTSDMRAEI | | RTSDMRAEI | | SITYIWTYQA | | TASLPGMMMG | |
| RTSDMRTEI | | RTSDMRTEI | | SIVAFCGTSG | | TASRAGYEMLK | |
| RTSDMRTEV | | RTSDMRTEV | | SIVALCGSKE | | TASRSGYEMLK | |
| RTSHRTLLM | | RTSHRTLLM | | SIVALCGSKK | | TATLCLGHHAV | |
| RTSISCLYK | | RTSISCLYK | | SIVALCGSRE | | TATREGKHIVE | |
| RTSIWTSSS | | RTSIWTSSS | | SIVASSGTLE | | TATVYYDRRLT | |
| RTSYRSLIR | | RTSYRSLIR | | SIVASSGTVE | | TATVYYNGRLT | |
| RTSYRTLLM | | RTSYRTLLM | | SIVEFCGTSG | | TATVYYNKRLT | |
| RTTFESNGG | | RTTFESNGG | | SIVLVGLILA | | TATVYYNRRLT | |
| RTTFRGLIS | | RTTFRGLIS | | SIVMVGLILA | | TATVYYNRRPT | |
| RTTFRGLLS | | RTTFRGLLS | | SIVPNIGSRP | | TAVAVIKYNGI | |
| RTTNTYRNT | | RTTNTYRNT | | SIVPSGPLKA | | TAVAVLKYNGI | |
| RTTSKDSRS | | RTTSKDSRS | | SIVRRATVSA | | TAVAVLKYNGV | |
| RTTSTASRS | | RTTSTASRS | | SIVSMCSSTE | | TAVDTCYPFDV | |
| RTTVDHMAI | | RTTVDHMAI | | SIVSWSQNIL | | TAYELTDSSWI | |
| RTVGQCPKY | | RTVGQCPKY | | SIVTFCGLDN | | TAYERMCNILK | |
| RTVSINGRS | | RTVSINGRS | | SIVTFCGLNN | | TAYSQITNGTT | |
| RTVSISGRS | | RTVSISGRS | | SIVVFCGTSA | | TAYWWDGLQSS | |
| RTVSNSGRS | | RTVSNSGRS | | SIVVFCGTSG | | TCAVVMTDGSA | |
| RTVSSFYSE | | RTVSSFYSE | | SIWFSHYNQM | | TCEQIADAQHR | |
| RTVSTSGRS | | RTVSTSGRS | | SIWFSHYNQV | | TCEQIADSHHR | |
| RTWAKNILR | | RTWAKNILR | | SIWMCSNGSL | | TCEQIADSQHK | |
| RTYNNTTGR | | RTYNNTTGR | | SIWTSSSSTV | | TCEQIADSQHR | |
| RTYVDGFEP | | RTYVDGFEP | | SIYASPQLEG | | TCGCRDNWQGA | |
| RTYVDGFKP | | RTYVDGFKP | | SIYIEVLHLT | | TCHDGIGRMTI | |
| RVARCNTKC | | RVARCNTKC | | SIYSCIASSI | | TCHDGVGRMTI | |
| RVAYERMCN | | RVAYERMCN | | SIYSCIASSL | | TCIESIRNGTY | |
| RVDDAVTDI | | RVDDAVTDI | | SIYSCIASST | | TCIVAVTDGPA | |
| RVDDAVTDV | | RVDDAVTDV | | SIYSCIASSV | | TCKLLGINMSK | |
| RVDFESGRI | | RVDFESGRI | | SIYSCVASSL | | TCKLVGINMSK | |
| RVDINPGHA | | RVDINPGHA | | SIYSSVASSL | | TCMETIRNGTY | |
| RVDINPGHS | | RVDINPGHS | | SIYSTAASSL | | TCRDNWQGSNR | |
| RVDKLTQGR | | RVDKLTQGR | | SIYSTVAASL | | TCSALFVYSLR | |
| RVDMNPGHA | | RVDMNPGHA | | SIYSTVASSL | | TCSNGSCRCTI | |
| RVDNHSMSD | | RVDNHSMSD | | SIYSTVSSSL | | TCTCRDNWQGS | |
| RVDRLTQGR | | RVDRLTQGR | | SIYSTVTSSL | | TCTVIMTDGSA | |
| RVDSESGRI | | RVDSESGRI | | SIYSTVVSSL | | TCTVVMTDGNA | |
| RVDTIIESN | | RVDTIIESN | | SIYWTIVKPG | | TCTVVMTDGSA | |
| RVDTIMEKN | | RVDTIMEKN | | SIYWTLVNPG | | TCVCRDNWHGS | |
| RVDTNPGHA | | RVDTNPGHA | | SIYWTVVKPG | | TCVCRDNWKSS | |
| RVDVNPGHA | | RVDVNPGHA | | SKACNALTGG | | TCVCRDNWQGA | |
| RVECIGWSS | | RVECIGWSS | | SKACNASTGA | | TCVCRDNWRGA | |

Fig. 83-340

| Block size 8 | SIN | Block size 9 | SIN | Block size 10 | SIN | Block size 11 | SIN |
|---|---|---|---|---|---|---|---|
| RVEEGSIGK | | RVEEGSIGK | | SKACNASTGG | | TCVCRDSWHGS | |
| RVFLAMITY | | RVFLAMITY | | SKACSASTGG | | TCVVAVTDGPA | |
| RVFLTMITY | | RVFLTMITY | | SKADKICIGY | | TCVVIMTDGPA | |
| RVGCVILLN | | RVGCVILLN | | SKANQVFPQL | | TCVVIMTDGSA | |
| RVGSRGHVF | | RVGSRGHVF | | SKCFWKGGSI | | TCWTVTDGPA | |
| RVKIDPVKL | | RVKIDPVKL | | SKCFWREGSI | | TCVVVMTDGSA | |
| RVKKQLREN | | RVKKQLREN | | SKCFWRGGSI | | TCWEQLYTPGG | |
| RVKMFDFIK | | RVKMFDFIK | | SKCITPNGSI | | TCWEQMYTPGG | |
| RVKMFDFSK | | RVKMFDFSK | | SKCCKTKEGRR | | TCYPFDVPDYQ | |
| RVKMFDFTK | | RVKMFDFTK | | SKCQQSFTPS | | TDCVLEAMAFL | |
| RVKRQLREN | | RVKRQLREN | | SKCRTKEGRR | | TDCVLEAMALL | |
| RVKRRPVAK | | RVKRRPVAK | | SKCRTREGRR | | TDELCPSPLKL | |
| RVLIRGNSP | | RVLIRGNSP | | SKCYNPCFYV | | TDEYKNTGDSD | |
| RVLKENAID | | RVLKENAID | | SKCYQFALGQ | | TDEYKNTRDSD | |
| RVLRENAID | | RVLRENAID | | SKDNAIRIGE | | TDEYKNTRDSN | |
| RVLRENAVD | | RVLRENAVD | | SKDNGIRIGS | | TDGATSACKRT | |
| RVLTDTSRP | | RVLTDTSRP | | SKDNGIRVGS | | TDGNASGKADT | |
| RVNSIIDKM | | RVNSIIDKM | | SKDNNIRIGS | | TDGPAANNADH | |
| RVRHQLREN | | RVRHQLREN | | SKDNQVFPQL | | TDGPAANSADH | |
| RVRKQLREN | | RVRKQLREN | | SKDNSIQLSA | | TDGPADNKADH | |
| RVRKQLRQN | | RVRKQLRQN | | SKDNSIRIGS | | TDGPANKQASY | |
| RVRLFDYSR | | RVRLFDYSR | | SKDNSIRLAA | | TDGPANNQASY | |
| RVRLQLRDN | | RVRLQLRDN | | SKDNSIRLSA | | TDGPANSQASY | |
| RVRMQLRDN | | RVRMQLRDN | | SKDNSVRIGS | | TDGPASNQASY | |
| RVRNGTYDH | | RVRNGTYDH | | SKDNSVRLSA | | TDGPASSQAYT | |
| RVRNQSGRI | | RVRNQSGRI | | SKDSRSGYET | | TDGPSDAQAFY | |
| RVRRQLREN | | RVRRQLREN | | SKEAQDVIME | | TDGPSNAQAFY | |
| RVSAGGDIW | | RVSAGGDIW | | SKEGSYFFGD | | TDGSANSQAYT | |
| RVSFYWTIV | | RVSFYWTIV | | SKEQGSGYAA | | TDGSASGKADT | |
| RVSKMGVDE | | RVSKMGVDE | | SKEQLGSWSW | | TDGSASGKAET | |
| RVSKTGVDE | | RVSKTGVDE | | SKERLGSWSW | | TDGSASGQAYT | |
| RVSKVGVDE | | RVSKVGVDE | | SKFESVAWSA | | TDGSASGRADT | |
| RVSRMGVDE | | RVSRMGVDE | | SKFHSDTPRP | | TDGSASRKADT | |
| RVTCVCRDN | | RVTCVCRDN | | SKFLLMDALK | | TDGSASSQAHT | |
| RVTVSTRSD | | RVTVSTRSD | | SKFLLMDSLK | | TDGSASSQAYT | |
| RVWRQANNG | | RVWRQANNG | | SKGDIFVIRE | | TDGSATGPADT | |
| RVWWTSNSI | | RVWWTSNSI | | SKGDIFVMRE | | TDGSATGPAET | |
| RVWWTTNSI | | RVWWTTNSI | | SKGDVFVIRE | | TDIWAYNAELI | |
| RVYVDGFEP | | RVYVDGFEP | | SKGDVFVMRE | | TDIWAYNAELL | |
| RVYWIREGK | | RVYWIREGK | | SKGHVFVIRE | | TDIWSYNAKLL | |
| RVYWIREGR | | RVYWIREGR | | SKGLFGAIAG | | TDIWSYNARLL | |
| RWALGENMA | | RWALGENMA | | SKGSSKQQHK | | TDIWTYQAELL | |
| RWETTGRNC | | RWETTGRNC | | SKHYIGKCPK | | TDKDSNGVQDI | |
| RWKHVTNTI | | RWKHVTNTI | | SKHYIGKCPR | | TDKGSIQSDKP | |
| RWLTLKLGQ | | RWLTLKLGQ | | SKIKMKWGME | | TDKIDTLTETG | |
| RWLTLKSEQ | | RWLTLKSEQ | | SKILTDTSRP | | TDKNSNGVQDI | |
| RWLTLKSGQ | | RWLTLKSGQ | | SKINEVKLEE | | TDKVDTIIENN | |
| RWMKIIRVG | | RWMKIIRVG | | SKINGVILEE | | TDKVDTLTENG | |
| RWPGLVAGW | | RWPGLVAGW | | SKINGVKLEE | | TDKVDTLTETG | |
| RWSYIVERP | | RWSYIVERP | | SKINGVRLEE | | TDKVNTIIENN | |
| RYELEIGAR | | RYELEIGAR | | SKINRQEIEG | | TDLEALMEWIK | |
| RYELEIGTR | | RYELEIGTR | | SKITLKFAFN | | TDLEALMEWLK | |
| RYERVKMFD | | RYERVKMFD | | SKKKSYINKT | | TDLEVLMEWLK | |
| RYGDGVWIG | | RYGDGVWIG | | SKKKSYINRT | | TDLGAPLELRD | |
| RYGFVANFS | | RYGFVANFS | | SKKRLGSWSW | | TDLGSPLELRD | |
| RYGNGVWIG | | RYGNGVWIG | | SKLKRNEIKG | | TDLGTPLELRD | |
| RYGPALSIN | | RYGPALSIN | | SKLKRQEIDG | | TDLYKVATGRV | |
| RYGPALSIS | | RYGPALSIS | | SKLKRQEIEG | | TDNHVEVVSAK | |
| RYGVKGFSF | | RYGVKGFSF | | SKLKRQEING | | TDNYGVKGFGF | |
| RYGYIIEEY | | RYGYIIEEY | | SKLNRNEIKG | | TDSEMDKLFER | |
| RYGYIIEKY | | RYGYIIEKY | | SKLNRQEIEG | | TDSEMLNLYER | |
| RYICSGLVG | | RYICSGLVG | | SKLNRQEIGG | | TDSEMNKLFDR | |

Fig. 83-341

| Block size 8 | SIN | Block size 9 | SIN | Block size 10 | SIN | Block size 11 | SIN |
|---|---|---|---|---|---|---|---|
| RYIPSGSLK | | RYIPSGSLK | | SKLNRSEIKG | | TDSEMNKLFEK | |
| RYLEEHPSA | | RYLEEHPSA | | SKLNRTEIKG | | TDSEMNKLFER | |
| RYLEENPSA | | RYLEENPSA | | SKMGVDEYSN | | TDSEMNKLYEK | |
| RYLPDLYDY | | RYLPDLYDY | | SKMGVDEYSS | | TDSEMNKLYER | |
| RYNGQRSWM | | RYNGQRSWM | | SKMQFSSLTV | | TDSEMNRLFER | |
| RYPDVRCIC | | RYPDVRCIC | | SKNILRTQES | | TDSEMSKLFEK | |
| RYPDVRCTC | | RYPDVRCTC | | SKNPYTLVST | | TDSEMSKLFER | |
| RYPDVRCVC | | RYPDVRCVC | | SKNSRSGYET | | TDSIKSWRKDI | |
| RYPGVRCIC | | RYPGVRCIC | | SKPFQNASRH | | TDSIKSWRRDI | |
| RYPNVRCVC | | RYPNVRCVC | | SKPFQNASRY | | TDSQTATKRIR | |
| RYREEAMQN | | RYREEAMQN | | SKPFQNICKP | | TDSQTATKRLR | |
| RYSGFVRTL | | RYSGFVRTL | | SKPFQNTSKH | | TDTFKSWKGNI | |
| RYSGIKTDG | | RYSGIKTDG | | SKPFQNTSRH | | TDTLKSWKGNI | |
| RYSGIRTDG | | RYSGIRTDG | | SKPLQNASRH | | TDTPRGEDSQF | |
| RYSIADKIC | | RYSIADKIC | | SKPLQNTSKH | | TDTVDTILEKN | |
| RYSKADKIC | | RYSKADKIC | | SKPQCHITGF | | TDTVDTLLEKN | |
| RYSRADKIC | | RYSRADKIC | | SKPQCKITGF | | TDTVDTLTENG | |
| RYTYRCHKG | | RYTYRCHKG | | SKPQCLITGF | | TDTVDTVLEKN | |
| RYTYRCHRG | | RYTYRCHRG | | SKPQCQIAGF | | TDTVDTVLERN | |
| RYVCSGLVG | | RYVCSGLVG | | SKPQCQITGF | | TDTVDTVREKN | |
| RYVCSKFHS | | RYVCSKFHS | | SKPQCQITGS | | TDTVNTLIEQN | |
| RYVCTGILT | | RYVCTGILT | | SKRGGSGIMK | | TDTVNTLTEQN | |
| RYVEDTKID | | RYVEDTKID | | SKRGNSGIMK | | TDVIRSWRKQI | |
| RYVKQGSLK | | RYVKQGSLK | | SKRGSSGIMK | | TDVVNFLSMEF | |
| RYVKQSSLP | | RYVKQSSLP | | SKRGSSGIVK | | TDVVNFVSMEF | |
| RYWAIRTRS | | RYWAIRTRS | | SKRGSSGVMK | | TDVVNYVSMEF | |
| RYYMGECPK | | RYYMGECPK | | SKRKSYINKT | | TDVVRSWKKQI | |
| SAAFEDLRI | | SAAFEDLRI | | SKRYELEIGA | | TDVVRSWRKKI | |
| SAAFEDLRL | | SAAFEDLRL | | SKRYELEIGT | | TDVVRSWRKQI | |
| SAAFEDLRV | | SAAFEDLRV | | SKSLCKVEGW | | TDVVRSWRRQI | |
| SAASYKRIR | | SAASYKRIR | | SKSRGYKMNI | | TDVWSYNAKLL | |
| SAASYKRVR | | SAASYKRVR | | SKSRGYKMNN | | TDVYCICRDNW | |
| SACHDGASW | | SACHDGASW | | SKSRGYKMNT | | TDWSGYSGSFI | |
| SACHDGISW | | SACHDGISW | | SKSRSIIFNM | | TDWSGYSGSFM | |
| SACHDGSSW | | SACHDGSSW | | SKSRSNIFNM | | TDWSGYSGSFV | |
| SACHDGTNW | | SACHDGTNW | | SKSRVDNHSM | | TECQLNEGIMN | |
| SACHDGTSW | | SACHDGTSW | | SKSTKSTVLK | | TECQLNEGVIN | |
| SACITPNGS | | SACITPNGS | | SKTGVDEYSS | | TECQLNEGVMN | |
| SACKRTVSS | | SACKRTVSS | | SKTLTDTSRP | | TECRTFFLTQG | |
| SACLRGGRN | | SACLRGGRN | | SKTNQQFELI | | TEDNIYKILSI | |
| SACYNPCFY | | SACYNPCFY | | SKTQCQITGF | | TEDNVYKILSI | |
| SADGDIWVT | | SADGDIWVT | | SKVGVDEYSS | | TEDNVYKVLAI | |
| SADHRIYWI | | SADHRIYWI | | SKVKMKWGME | | TEDNVYKVLSI | |
| SADHRVYWI | | SADHRVYWI | | SKVLTDTSRP | | TEEQAVDICKA | |
| SADMSIGIT | | SADMSIGIT | | SKVTCICRDN | | TEEQAVEICKA | |
| SADMSIGVT | | SADMSIGVT | | SKVTCVCRDN | | TEEQAVGICKA | |
| SADPLASLL | | SADPLASLL | | SKWGDILEGT | | TEEQAVNICKA | |
| SADPLLSLL | | SADPLLSLL | | SKWGDVLDGV | | TEESECVCHNG | |
| SAEHIEECS | | SAEHIEECS | | SKWGNVLDGV | | TEEVSHCRATE | |
| SAESRKLLL | | SAESRKLLL | | SKWNVTYTGT | | TEFESIESEFN | |
| SAESRKMLL | | SAESRKMLL | | SKYEEESKLN | | TEFESIESEFS | |
| SAFDERRNK | | SAFDERRNK | | SKYHWNLALD | | TEFLGQWDWPD | |
| SAFDERRNR | | SAFDERRNR | | SKYLQSFTPS | | TEFLGQWNWPD | |
| SAGALASCM | | SAGALASCM | | SKYQQSFSPS | | TEGHIEECSCY | |
| SAGGAIWVT | | SAGGAIWVT | | SKYQQSFTPS | | TEHQIGNVINW | |
| SAGGDIWIT | | SAGGDIWIT | | SKYRQSFSPS | | TEIASWAGNIL | |
| SAGGDIWVT | | SAGGDIWVT | | SKYWAIRTRS | | TEIEQQIGNVI | |
| SAGGHIWVT | | SAGGHIWVT | | SLAIMIAGIF | | TEIIRMMENA | |
| SAGGNIWIT | | SAGGNIWIT | | SLAIMIAGIS | | TEINTWARNIL | |
| SAGKDPKKT | | SAGKDPKKT | | SLAIMMAGIF | | TEIPSWAGNIL | |
| SAGQISIQP | | SAGQISIQP | | SLAIMMAGIS | | TEIPSWAGNVL | |
| SAGQISTQP | | SAGQISTQP | | SLAIMVAGIS | | TEIPSWEGNIL | |

Fig. 83-342

| Block size 8 | SIN | Block size 9 | SIN | Block size 10 | SIN | Block size 11 | SIN |
|---|---|---|---|---|---|---|---|
| SAGQISVQP | | SAGQISVQP | | SLAVNVRGSG | | TEISFTITGDN | |
| SAGQTSVQP | | SAGQTSVQP | | SLCEVNSWHI | | TEIWSYNAELL | |
| SAGQVSVQP | | SAGQVSVQP | | SLCKIEGWVV | | TEKGIEVVNAT | |
| SAGRDPKKT | | SAGRDPKKT | | SLCKVEEWVV | | TEKGVEVVNAT | |
| SAIDQITGK | | SAIDQITGK | | SLCKVEGWVV | | TEKVDTIIENN | |
| SAIDQITGT | | SAIDQITGT | | SLCLAILIAG | | TEKVDTIIESN | |
| SAIDQITRK | | SAIDQITRK | | SLCLAILVAG | | TELGAPLVLDD | |
| SAIDQVTGK | | SAIDQVTGK | | SLCLAVLIAG | | TELGSPLVLDD | |
| SAINQITGK | | SAINQITGK | | SLCNVEGWVV | | TELGVPFHLGT | |
| SAKELVETN | | SAKELVETN | | SLCSIWFSHY | | TELPFQNLSPR | |
| SAKHIEECS | | SAKHIEECS | | SLCSVEGWVV | | TELSFTITGDN | |
| SAKHVEECS | | SAKHVEECS | | SLDEQNKLYG | | TELSFTVTGDN | |
| SALFVYSLR | | SALFVYSLR | | SLDGKAPISL | | TELWSYNAELL | |
| SALGSPGCD | | SALGSPGCD | | SLDKICLGHH | | TEMWSYNAELL | |
| SALILRGAV | | SALILRGAV | | SLEFIAEQFT | | TENGVPVTSSI | |
| SALILRGSI | | SALILRGSI | | SLEGIILGNP | | TENGVPVTSSV | |
| SALILRGSV | | SALILRGSV | | SLEGLILGNP | | TENPVICLGHH | |
| SAMHIEECS | | SAMHIEECS | | SLEGLILSNP | | TENSFEQITFI | |
| SAPEGMCYP | | SAPEGMCYP | | SLEGLVLGNP | | TENSFEQITFL | |
| SAPGVKGFG | | SAPGVKGFG | | SLERRLENLN | | TENSFEQITFM | |
| SAPHGLCYP | | SAPHGLCYP | | SLESRRGFEM | | TEPLCDVSGFA | |
| SAPHRLCYP | | SAPHRLCYP | | SLESRSGFEM | | TEPLCEVSGFA | |
| SAPPEQSRM | | SAPPEQSRM | | SLFEKFFPSS | | TEPLCEVSGFV | |
| SAQEKNDLY | | SAQEKNDLY | | SLFSSIKKYE | | TEPLCNVSGFA | |
| SAQHIEECS | | SAQHIEECS | | SLFSSIKRYE | | TEQNVPVTQVE | |
| SAQHVEECS | | SAQHVEECS | | SLGAISFWMC | | TEQTKLYKNTN | |
| SARHIEECP | | SARHIEECP | | SLGAVSFWMC | | TEREVEVVNAT | |
| SARHIEECS | | SARHIEECS | | SLGDCSFAGW | | TERGIEVVNAT | |
| SARHIEEWS | | SARHIEEWS | | SLGGCSFAGW | | TERGVEVVDAT | |
| SARHVEECS | | SARHVEECS | | SLGIQSDAQI | | TERGVEVVNAT | |
| SARQEKNPA | | SARQEKNPA | | SLIALCGSPF | | TERVDTIIESN | |
| SARSALILR | | SARSALILR | | SLIALCGSPI | | TESLQNRIQID | |
| SASACHDGI | | SASACHDGI | | SLIALCGSPV | | TESRGLFGAIA | |
| SASACHDGL | | SASACHDGL | | SLIASSGTLE | | TESSFEQITFM | |
| SASACHDGM | | SASACHDGM | | SLIIAARNIV | | TETGVPVTSSV | |
| SASACHDGS | | SASACHDGS | | SLIIAARSIV | | TETVEITGIDK | |
| SASACHDGT | | SASACHDGT | | SLILAAIIMG | | TETVEITGINK | |
| SASACHDGV | | SASACHDGV | | SLIMRTVIAL | | TETVNTLIEQN | |
| SASALILRG | | SASALILRG | | SLIQFPIGTA | | TETVNTLSEQN | |
| SASCHDGRA | | SASCHDGRA | | SLIQFPMGTA | | TETVNTLTEQN | |
| SASGDIWIT | | SASGDIWIT | | SLIRFPIGTA | | TEVEGRIQDLE | |
| SASGDIWVT | | SASGDIWVT | | SLIRFPIGVA | | TEVEKQIGNVI | |
| SASGKADTR | | SASGKADTR | | SLIRFPVGTA | | TEVEQQIGNVI | |
| SASGQAYTK | | SASGQAYTK | | SLISWPLSSP | | TEVETYVLSII | |
| SASGRADTK | | SASGRADTK | | SLIWLWLVLR | | TEVETYVLSIV | |
| SASGRADTR | | SASGRADTR | | SLKGLILGNP | | TEVETYVLSVI | |
| SASSISFCG | | SASSISFCG | | SLKLAIGLRN | | TEVSHCRATEY | |
| SASSQAHTK | | SASSQAHTK | | SLKLAIGPRN | | TEVWSYNADLL | |
| SASSQAYTK | | SASSQAYTK | | SLKLASGLRN | | TEVWSYNAELL | |
| SASTGGQSF | | SASTGGQSF | | SLKLATGLRN | | TEWSGYSGSFV | |
| SATACHDGK | | SATACHDGK | | SLKLATGMRN | | TEYRQEALQNR | |
| SATACHDGR | | SATACHDGR | | SLKLATGPRN | | TFCGLDNEPGS | |
| SATACSDGP | | SATACSDGP | | SLKLAVGLKN | | TFCGLNNEPGS | |
| SATACSDGS | | SATACSDGS | | SLKLAVGLRN | | TFDSLNITAAS | |
| SATGMALSV | | SATGMALSV | | SLKLAVGMRN | | TFDWTLNRNQP | |
| SATGMILSV | | SATGMILSV | | SLKLAVGPRN | | TFEFTSFFYRY | |
| SATGMTLSV | | SATGMTLSV | | SLLEMCHGTQ | | TFESDGAFLAP | |
| SATGPADTR | | SATGPADTR | | SLLEMCHSTQ | | TFESNGAFIAP | |
| SATGPAETR | | SATGPAETR | | SLLEMCHSTR | | TFESNGAFLAP | |
| SATGVTLSV | | SATGVTLSV | | SLLHKCNDSC | | TFESNGALLAP | |
| SAVDQITGK | | SAVDQITGK | | SLLLATGMKN | | TFESNGGFLAP | |
| SAVLRGFLI | | SAVLRGFLI | | SLLLATGMKN | | TFESNGGLIAP | |

Fig. 83-343

| Block size 8 | SIN | Block size 9 | SIN | Block size 10 | SIN | Block size 11 | SIN |
|---|---|---|---|---|---|---|---|
| SAVNQITGK | | SAVNQITGK | | SLLLLQANLC | | TFESNGGLLAP | |
| SAYCNTDLG | | SAYCNTDLG | | SLLLQANLCR | | TFESNGVFLAP | |
| SAYERMCNI | | SAYERMCNI | | SLLNDKHSNG | | TFESSGGLLAP | |
| SCAAMDDFQ | | SCAAMDDFQ | | SLLNDKHSSG | | TFFITQGSLLN | |
| SCAAMDEFQ | | SCAAMDEFQ | | SLLNDRHSNG | | TFFLTHGALLN | |
| SCAAMEDFQ | | SCAAMEDFQ | | SLLNRLSINP | | TFFLTHGSLLN | |
| SCASNINIR | | SCASNINIR | | SLLQSAILSL | | TFFLTQGALLN | |
| SCATNINIR | | SCATNINIR | | SLLTEVETYV | | TFFLTQGSLLN | |
| SCAVVMTDG | | SCAVVMTDG | | SLMLATGMKN | | TFFLTQGSLPN | |
| SCDPDECRF | | SCDPDECRF | | SLMLATGMRN | | TFGDCPKYVNV | |
| SCDPDGCRF | | SCDPDGCRF | | SLMQGSTLPR | | TFIFNGAFIAP | |
| SCDPIGCKM | | SCDPIGCKM | | SLMWEINGPE | | TFIQALQLLLE | |
| SCDPLGCKM | | SCDPLGCKM | | SLNGISPIHL | | TFKSWKGNIMR | |
| SCDPLGCRM | | SCDPLGCRM | | SLNGISPVHL | | TFLARSALILR | |
| SCDPNECRF | | SCDPNECRF | | SLNGVSPIHL | | TFLQALQLLLE | |
| SCDPSGCKM | | SCDPSGCKM | | SLNGVSPVHL | | TFLRSNAPSGI | |
| SCDPTGCKM | | SCDPTGCKM | | SLNITAASLN | | TFLRSNAPSGV | |
| SCDSPSNIN | | SCDSPSNIN | | SLNKKMEDGF | | TFMQALQLLFE | |
| SCDSPSNVK | | SCDSPSNVK | | SLPDLYDYKE | | TFMQALQLLLE | |
| SCDSPSNVN | | SCDSPSNVN | | SLPFQNINPR | | TFNFNGAFVAP | |
| SCEGECFYS | | SCEGECFYS | | SLPFQNINSR | | TFNGAFIAPDR | |
| SCEPDECRF | | SCEPDECRF | | SLPLALGMKN | | TFNGAFIAPNR | |
| SCFDGKEWL | | SCFDGKEWL | | SLPLCPFKGF | | TFPYTGDPPYS | |
| SCFDGKEWM | | SCFDGKEWM | | SLPLCPFQGF | | TFQNIDKNALG | |
| SCFDGREWM | | SCFDGREWM | | SLPLCPFRGF | | TFQNIDRNAIG | |
| SCFILLAIA | | SCFILLAIA | | SLPNDKHSNG | | TFQNIDRNALG | |
| SCFILLAIV | | SCFILLAIV | | SLQNRIQIDP | | TFQNIEKNALG | |
| SCFILLAVI | | SCFILLAVI | | SLQNRIQIDQ | | TFQNIERNALG | |
| SCFLLAALL | | SCFLLAALL | | SLQNRIQIDS | | TFRGLISTPLG | |
| SCFLLIALL | | SCFLLIALL | | SLQQIESIIE | | TFSDNGGLIAP | |
| SCFLLLAIA | | SCFLLLAIA | | SLQQIESMIE | | TFSFNGAFIAP | |
| SCFLLLAIV | | SCFLLLAIV | | SLQQIESMVE | | TFSFNGAFVAP | |
| SCFLLLAVV | | SCFLLLAVV | | SLRGRGSTLG | | TFSFQLINNKK | |
| SCFLLVALF | | SCFLLVALF | | SLRLAIGLRN | | TFSHNGGLIAP | |
| SCFLLVALL | | SCFLLVALL | | SLRLALGLRN | | TFSHNGGLVAP | |
| SCFTIMTDG | | SCFTIMTDG | | SLRLATGLRN | | TFSHNGGRIAP | |
| SCFTLMTDG | | SCFTLMTDG | | SLRLAVGLRN | | TFSPRSRSGFE | |
| SCFTVLTDG | | SCFTVLTDG | | SLRMKWMMAM | | TFSVQRNLPFD | |
| SCFTVMTDG | | SCFTVMTDG | | SLRSILANNG | | TFSVQRNLPFE | |
| SCFVFVALI | | SCFVFVALI | | SLRSILASSG | | TFSVQRSLPFE | |
| SCFVLLAAI | | SCFVLLAAI | | SLRSIVASSG | | TFTFNGAFIAP | |
| SCFVLLAIV | | SCFVLLAIV | | SLRSLIASSG | | TFVNMTNVQNN | |
| SCFVLLAVI | | SCFVLLAVI | | SLRSLVASSG | | TFVNVTHVQNN | |
| SCFVLLAVV | | SCFVLLAVV | | SLSISIGSST | | TFVNVTNVQND | |
| SCGILGTII | | SCGILGTII | | SLSISVESST | | TFVNVTNVQNN | |
| SCGPSECRT | | SCGPSECRT | | SLSISVGSST | | TGALASCMGLI | |
| SCHDGIGRM | | SCHDGIGRM | | SLSLAIMIAG | | TGALQLNPIDG | |
| SCHDGISRM | | SCHDGISRM | | SLSLAIMMAG | | TGAPQLNPIDG | |
| SCHDGKARM | | SCHDGKARM | | SLSLAIMVAG | | TGAPQLNPVDG | |
| SCHDGKAWL | | SCHDGKAWL | | SLSPGMMMGM | | TGAQSFYRSIN | |
| SCHDGKEWL | | SCHDGKEWL | | SLSRTREILT | | TGCFEIFHKCD | |
| SCHDGKFRM | | SCHDGKFRM | | SLSYSAGALA | | TGCFEIFHRCD | |
| SCHDGKSRM | | SCHDGKSRM | | SLSYSTGALA | | TGCFELFHKCD | |
| SCHDGKSWL | | SCHDGKSWL | | SLTEIWSYNA | | TGCKMYALHQG | |
| SCHDGMSRM | | SCHDGMSRM | | SLTHALRELW | | TGCQLNEGVMN | |
| SCHDGNAWL | | SCHDGNAWL | | SLTKGVLGFV | | TGDDKNATASF | |
| SCHDGRARM | | SCHDGRARM | | SLTQTLVSNN | | TGDDRNATASF | |
| SCHDGRAWL | | SCHDGRAWL | | SLTSLPFQNI | | TGDDRNATASL | |
| SCHDGRSRM | | SCHDGRSRM | | SLTVNVRGSG | | TGDGCFEILHK | |
| SCHDGVGRM | | SCHDGVGRM | | SLTVNVRGTG | | TGDGCFEILHR | |
| SCHDGVSRM | | SCHDGVSRM | | SLTVSVRGSG | | TGDNTKWNENQ | |
| SCHIGVAPS | | SCHIGVAPS | | SLVALCGSPI | | TGDPPYSHGTG | |

Fig. 83-344

| Block size 8 | SIN | Block size 9 | SIN | Block size 10 | SIN | Block size 11 | SIN |
|---|---|---|---|---|---|---|---|
| SCHTKCQTY | | SCHTKCQTY | | SLVALCGSPV | | TGFAPFSKDNS | |
| SCIASSIVL | | SCIASSIVL | | SLVASSGNLE | | TGFHFEECSCY | |
| SCIASSIVM | | SCIASSIVM | | SLVASSGTLE | | TGFHLEECSCY | |
| SCIASSLIL | | SCIASSLIL | | SLVGIDPFKL | | TGGQAFYRSIN | |
| SCIASSLVL | | SCIASSLVL | | SLVGIDPFRL | | TGGQSFYRSIN | |
| SCIASSTVL | | SCIASSTVL | | SLVGVDPFKL | | TGIAADKASTQ | |
| SCIASSTVM | | SCIASSTVM | | SLVGVDPFRL | | TGIAADKESTQ | |
| SCIASSVVL | | SCIASSVVL | | SLVIAARNIV | | TGIAADKTSTQ | |
| SCIESIRNG | | SCIESIRNG | | SLVLAAIIMG | | TGIAADKVSTQ | |
| SCINRCFYV | | SCINRCFYV | | SLVLAALIMG | | TGIAADRDSTQ | |
| SCKMYALHQ | | SCKMYALHQ | | SLVLAALNMG | | TGIAADRESTQ | |
| SCLPACAYG | | SCLPACAYG | | SLVLAASIMG | | TGIAADRGSTQ | |
| SCLPACIYG | | SCLPACIYG | | SLVLIVSLGA | | TGIAAEKESTQ | |
| SCLPACVYG | | SCLPACVYG | | SLVLLFMIIG | | TGIDKVCTKGK | |
| SCLVPCFWV | | SCLVPCFWV | | SLVLLLMIIG | | TGILTDTSRPG | |
| SCLYKLSQF | | SCLYKLSQF | | SLVLLVSLGA | | TGILTDTSRPS | |
| SCMDTIRNG | | SCMDTIRNG | | SLVLVVSLGA | | TGINKVCTKGK | |
| SCMEAIRNG | | SCMEAIRNG | | SLWDSFRQSE | | TGIVADRDSTQ | |
| SCMERIRNN | | SCMERIRNN | | SLWMCSNGSL | | TGKDPKKTGGP | |
| SCMESIRNN | | SCMESIRNN | | SLWMCSNGSY | | TGKGCFDILHK | |
| SCMETIRNG | | SCMETIRNG | | SLYASPQLEG | | TGKLNRFIEKT | |
| SCMGLIYNR | | SCMGLIYNR | | SLYASSQLEG | | TGKLNRIIEKT | |
| SCPIGEAPS | | SCPIGEAPS | | SLYDKVRMQL | | TGKLNRLIDKT | |
| SCPIGEVPS | | SCPIGEVPS | | SLYSSPQLEG | | TGKLNRLIDRT | |
| SCPIGVAPS | | SCPIGVAPS | | SMAPIMFSNK | | TGKLNRLIEKT | |
| SCPLGEAPS | | SCPLGEAPS | | SMCSSTEFLG | | TGKLNRLIERT | |
| SCPMGVAPS | | SCPMGVAPS | | SMDSRSGYET | | TGKLNRLIGKT | |
| SCPVGEAPS | | SCPVGEAPS | | SMEFSLTDPK | | TGKLNRLISKT | |
| SCPVGVAPS | | SCPVGVAPS | | SMEFSLTDPR | | TGKSHGRILKN | |
| SCSHLECRT | | SCSHLECRT | | SMELPSFGVS | | TGKSHGRVLKN | |
| SCSHMECRT | | SCSHMECRT | | SMFLYVRTNG | | TGKWDTLIERE | |
| SCSHSECRT | | SCSHSECRT | | SMGEAMVSRA | | TGLIDGWYGYH | |
| SCSIDECRT | | SCSIDECRT | | SMGFRYSGIR | | TGLRNIPSIQS | |
| SCSIHECRT | | SCSIHECRT | | SMGIYQILAI | | TGLRNIPSVQS | |
| SCSINECRT | | SCSINECRT | | SMGVYQILAI | | TGLRNVPSIQS | |
| SCSISECRT | | SCSISECRT | | SMIEAESSIK | | TGMAADQKSTQ | |
| SCSQNILRT | | SCSQNILRT | | SMIEAESSVK | | TGMAADRDSTQ | |
| SCSSPSGIE | | SCSSPSGIE | | SMIEAESSVR | | TGMDPRMCSLM | |
| SCSVSECRT | | SCSVSECRT | | SMMEAMVSRA | | TGMIDGWYGYH | |
| SCSYLECRT | | SCSYLECRT | | SMMWEINGPD | | TGMKNVPEIPK | |
| SCTSPCLTD | | SCTSPCLTD | | SMMWEINGPE | | TGMKNVPEIPR | |
| SCTVVMTDG | | SCTVVMTDG | | SMMWEVNGPE | | TGMKNVPETPK | |
| SCVCRDNWQ | | SCVCRDNWQ | | SMNNQVFPQL | | TGMRNIPEKPK | |
| SCVMLLAIA | | SCVMLLAIA | | SMPFHNIHPL | | TGMRNIPEKQT | |
| SCVNRCFYV | | SCVNRCFYV | | SMPFHNVHPL | | TGMRNIPENPK | |
| SCYDGKAWL | | SCYDGKAWL | | SMPLHNIHPL | | TGMRNIPERQT | |
| SCYMDIDVY | | SCYMDIDVY | | SMQCRICIGS | | TGMRNIPGKQA | |
| SCYPNDGKV | | SCYPNDGKV | | SMSCFVFVAL | | TGMRNVPEKPK | |
| SCYPNEGKV | | SCYPNEGKV | | SMSDIEAMAS | | TGMRNVPEKQT | |
| SCYPNLGIV | | SCYPNLGIV | | SMSGFRSNLP | | TGMRNVPENPK | |
| SCYPNLGKV | | SCYPNLGKV | | SMTEIWSYNA | | TGMRNVPERQT | |
| SCYPNLGQV | | SCYPNLGQV | | SMTEVWSYNA | | TGMRNVPETQT | |
| SCYPNMGKV | | SCYPNMGKV | | SMVEAESSVK | | TGMVDGWYGYH | |
| SCYPNNGKV | | SCYPNNGKV | | SMVEAMISRA | | TGMWDTLIERD | |
| SCYPNSGKV | | SCYPNSGKV | | SMVEAMMSRA | | TGNFIAPEYAY | |
| SCYPQYPDV | | SCYPQYPDV | | SMVEAMVSRA | | TGNGCFDILHK | |
| SCYPQYPNV | | SCYPQYPNV | | SMVKSDKICL | | TGNGCFEFYHK | |
| SCYPRYPDV | | SCYPRYPDV | | SMVRSDKICL | | TGNHGSLVLSL | |
| SCYPRYPGV | | SCYPRYPGV | | SMVTFCGLDN | | TGNKLITVGSS | |
| SCYPRYPNV | | SCYPRYPNV | | SNAASYKRIR | | TGNLIAPEYGF | |
| SCYVDIDIY | | SCYVDIDIY | | SNAEGTGMAA | | TGNLIAPRGYF | |
| SCYVDIDVY | | SCYVDIDVY | | SNAIDEGDGC | | TGNLVAPEYGF | |

Fig. 83-345

| Block size 8 | SIN | Block size 9 | SIN | Block size 10 | SIN | Block size 11 | SIN |
|---|---|---|---|---|---|---|---|
| SCYVDTDVY | | SCYVDTDVY | | SNAITRSGQN | | TGNPIICLGHH | |
| SCYVDVDVY | | SCYVDVDVY | | SNALLKHRFE | | TGNPVICLGHH | |
| SDAPFLDRL | | SDAPFLDRL | | SNAPSGIEYN | | TGNPVICMGHH | |
| SDAQAFYKI | | SDAQAFYKI | | SNAPSGVEYN | | TGNPVMCLGHH | |
| SDAQAFYKL | | SDAQAFYKL | | SNAQAFYKIL | | TGPADTRIYYF | |
| SDAQIDESC | | SDAQIDESC | | SNAYQAKFES | | TGPADTRVYYF | |
| SDDFALILN | | SDDFALILN | | SNCKDPNNER | | TGPAETRIYYF | |
| SDDFALIVN | | SDDFALIVN | | SNCRDPNNEK | | TGPAETRVYYF | |
| SDDNVYKAL | | SDDNVYKAL | | SNCRDPNNER | | TGPDATAVAVI | |
| SDDSVYKAL | | SDDSVYKAL | | SNCRDPNNES | | TGPDATAVAVL | |
| SDEALKMTI | | SDEALKMTI | | SNCRDSNNER | | TGPDSTAVAVI | |
| SDFHFIDEQ | | SDFHFIDEQ | | SNCRNPNNEK | | TGPDTTAVAVL | |
| SDFHFIDER | | SDFHFIDER | | SNCRNPNNER | | TGPPQCDLFLE | |
| SDFHFINEL | | SDFHFINEL | | SNDKPFQNVN | | TGPPQCDQFLE | |
| SDFHFINEQ | | SDFHFINEQ | | SNDNWSGYSG | | TGQAADLKSTQ | |
| SDFHFINER | | SDFHFINER | | SNDQGAGYAA | | TGQAADYESTQ | |
| SDFICVGWS | | SDFICVGWS | | SNDQGSGYAA | | TGQAADYKSTQ | |
| SDFLCVGWS | | SDFLCVGWS | | SNDTINYYNE | | TGRDVLVIWGI | |
| SDFMCVGWS | | SDFMCVGWS | | SNDVWLGRTV | | TGRDVLVLWGI | |
| SDGAFLAPR | | SDGAFLAPR | | SNEGSYFFGD | | TGRDVLVMWGI | |
| SDGGPNLYN | | SDGGPNLYN | | SNENLIAPWY | | TGRDVLVMWGL | |
| SDGNLIAPW | | SDGNLIAPW | | SNENPAHKSQ | | TGRGIEVVNAT | |
| SDGPGWLTI | | SDGPGWLTI | | SNEQAAEAME | | TGRNCTIPCFW | |
| SDGPGWLTL | | SDGPGWLTL | | SNEQGSGYAA | | TGRNCTVPCFW | |
| SDGSGWLTL | | SDGSGWLTL | | SNETILETGY | | TGRSSFFRNVV | |
| SDHICIGYH | | SDHICIGYH | | SNETVKDRSP | | TGRVTVSTRSD | |
| SDICYPGKF | | SDICYPGKF | | SNGAFIAPRY | | TGSPGAPGVKG | |
| SDICYPGRF | | SDICYPGRF | | SNGAFLAPGY | | TGSPSAPGVKG | |
| SDIEAMASQ | | SDIEAMASQ | | SNGAFLAPRY | | TGSVYIEVLHL | |
| SDIEAMATQ | | SDIEAMATQ | | SNGGFLAPRY | | TGSWPDGADIN | |
| SDIGAMASQ | | SDIGAMASQ | | SNGGLIAPRY | | TGSWPDGANID | |
| SDILVTREP | | SDILVTREP | | SNGGLLAPKY | | TGSWPDGANII | |
| SDINIMASQ | | SDINIMASQ | | SNGGLLAPRY | | TGSWPDGANIN | |
| SDKICIGYH | | SDKICIGYH | | SNGNCRFNVC | | TGSWPDGANIS | |
| SDKICLGHH | | SDKICLGHH | | SNGNFIAPEN | | TGSWPDGANTN | |
| SDKIDDQIE | | SDKIDDQIE | | SNGNFIAPEY | | TGSYVRLYLWG | |
| SDKLYIWGV | | SDKLYIWGV | | SNGNFITPEY | | TGTAADLKSTQ | |
| SDKPFQNVS | | SDKPFQNVS | | SNGNLIAPEY | | TGTAKHIEECS | |
| SDKRIGSCT | | SDKRIGSCT | | SNGNLIAPLY | | TGTAKQNYLML | |
| SDKVDTLLE | | SDKVDTLLE | | SNGNLIAPRG | | TGTFEFTSFFY | |
| SDLDYQIGY | | SDLDYQIGY | | SNGNLIAPWF | | TGTGYTMDTVN | |
| SDLEALMEW | | SDLEALMEW | | SNGNLIAPWY | | TGTGYTMDTVS | |
| SDLIIERKE | | SDLIIERKE | | SNGNLVAPRG | | TGTWDTLIERD | |
| SDLIIERRE | | SDLIIERRE | | SNGNLVAPWY | | TGTWDTLIERE | |
| SDLNYQIGY | | SDLNYQIGY | | SNGQGSGYAA | | TGTWDTLIERG | |
| SDMRAEIIK | | SDMRAEIIK | | SNGSCRCTIC | | TGTYCSLNGIS | |
| SDMRAEIIR | | SDMRAEIIR | | SNGSCRFNVC | | TGTYCSLNGVS | |
| SDMRTEIIK | | SDMRTEIIK | | SNGSLQCKIC | | TGTYDYPKYEE | |
| SDMRTEIIR | | SDMRTEIIR | | SNGSLQCRIA | | TGVESAVLRGF | |
| SDMRTEVIR | | SDMRTEVIR | | SNGSLQCRIC | | TGVLTDTSRPG | |
| SDNADKICL | | SDNADKICL | | SNGSLQCRVC | | TGVLTDTSRPK | |
| SDNEQTDLY | | SDNEQTDLY | | SNGSLQCTIC | | TGVLTDTSRPS | |
| SDNGGLIAP | | SDNGGLIAP | | SNGSLRCRIC | | TGVPVTSSVDL | |
| SDNRSGYSG | | SDNRSGYSG | | SNGTAKDRSP | | TGWPWPDGALL | |
| SDQICIGHH | | SDQICIGHH | | SNGTIHDRAA | | TGWSWPDGALF | |
| SDQICIGYH | | SDQICIGYH | | SNGTIHDRSQ | | TGWSWPDGALL | |
| SDQICVGYH | | SDQICVGYH | | SNGTIHDRTA | | TGYAQTDCVLE | |
| SDQISIVPN | | SDQISIVPN | | SNGTIHDRTT | | TGYEKNATASF | |
| SDQLKLATG | | SDQLKLATG | | SNGTIIKTLT | | TGYHFEECSCY | |
| SDRICIGYH | | SDRICIGYH | | SNGTIKDRSP | | TGYICSKFHSD | |
| SDRLVLAIG | | SDRLVLAIG | | SNGTIVKTLT | | TGYTMDTVNRT | |
| SDRLVLATG | | SDRLVLATG | | SNGTKINTLT | | TGYTMDTVSRT | |

Fig. 83-346

| Block size 8 | SIN | Block size 9 | SIN | Block size 10 | SIN | Block size 11 | SIN |
|---|---|---|---|---|---|---|---|
| SDSIKSWRK | | SDSIKSWRK | | SNGTKVNTLT | | TGYVCGKFHSD | |
| SDTPRGEDA | | SDTPRGEDA | | SNGTMKDRSP | | TGYVCSKFHSD | |
| SDTPRGEDG | | SDTPRGEDG | | SNGTTHDRTA | | THAKDILEKAH | |
| SDTPRGEDN | | SDTPRGEDN | | SNGTVKDRSP | | THAKDILEKTH | |
| SDTPRGEDS | | SDTPRGEDS | | SNGTVNDRSP | | THAKNILEKTH | |
| SDTPRPADP | | SDTPRPADP | | SNGVFLAPRY | | THALRELWQCY | |
| SDTPRPDDP | | SDTPRPDDP | | SNGVQDIIDN | | THAQDILEKTH | |
| SDTPRPSDP | | SDTPRPSDP | | SNIFNMERIK | | THAQDILERTH | |
| SDTPRPTDP | | SDTPRPTDP | | SNIGLNVSLH | | THESECVCING | |
| SDTPRPVDP | | SDTPRPVDP | | SNINIREWSY | | THFHRKRRVRD | |
| SDTTCWSWP | | SDTTCWSWP | | SNKMARLGKG | | THFQRKRRIRD | |
| SDTTGWPWP | | SDTTGWPWP | | SNKMARLGRG | | THFQRKRRVRD | |
| SDTTGWSWP | | SDTTGWSWP | | SNKVARLGKG | | THGALLNDKHS | |
| SDTTSWSWP | | SDTTSWSWP | | SNLDYQIGYV | | THGSLLNDKHS | |
| SDTVDTLTE | | SDTVDTLTE | | SNLEKRLENL | | THHMRKKRGLF | |
| SDVLVTREP | | SDVLVTREP | | SNLERRLENL | | THIHIFSFNGE | |
| SDVWLGRTV | | SDVWLGRTV | | SNLNDATYQR | | THIHIFSFTGE | |
| SDVWMGRTI | | SDVWMGRTI | | SNLNDTTYQR | | THIMIWHSNLN | |
| SDWSGYSGS | | SDWSGYSGS | | SNLPFQNINS | | THISVGTSTLN | |
| SDYEELKHL | | SDYEELKHL | | SNMDRAVKLY | | THKILTIYSTV | |
| SEAPGWSWD | | SEAPGWSWD | | SNMGIYQILA | | THKQLTHHMRK | |
| SECACINGS | | SECACINGS | | SNMGVYQILA | | THLEICFMYSD | |
| SECACVNGS | | SECACVNGS | | SNMSLNISLY | | THLEVCFMYSD | |
| SECICINGT | | SECICINGT | | SNNATDTVDT | | THLMIWHSNLN | |
| SECITPNGS | | SECITPNGS | | SNNDWSGYSG | | THMEVCFMYSD | |
| SECRTFFLT | | SECRTFFLT | | SNNGVKGFSY | | THMMIWHSNLN | |
| SECVCHDGT | | SECVCHDGT | | SNNNGVKGFS | | THNGKLCKLNG | |
| SECVCHKGI | | SECVCHKGI | | SNNRSGYSGI | | THNGKLCRLRG | |
| SECVCHKGV | | SECVCHKGV | | SNNSSDTVDT | | THNGKLCRLSG | |
| SECVCHNGI | | SECVCHNGI | | SNNSTDKIDT | | THSWIPKRNRS | |
| SECVCHNGT | | SECVCHNGT | | SNNSTDKVDT | | THSWTPKRNRS | |
| SECVCHNGV | | SECVCHNGV | | SNNSTDKVNT | | THSWVPILNTS | |
| SECVCHNST | | SECVCHNST | | SNNSTDTVDT | | THSWVPKRNRS | |
| SECVCHSGI | | SECVCHSGI | | SNNSTDTVNT | | THTSQYICSPI | |
| SECVCINGI | | SECVCINGI | | SNNSTEKVDT | | THTSQYICSPV | |
| SECVCINGS | | SECVCINGS | | SNNSTERVDT | | TIAGFIEGGWP | |
| SECVCINGT | | SECVCINGT | | SNNSTNTVNT | | TIALFIGVGNL | |
| SECVCISGT | | SECVCISGT | | SNNTTNYYNE | | TIALIIGVGNL | |
| SECVCMNGS | | SECVCMNGS | | SNNTVKDRSP | | TIALLIGIGNL | |
| SECVCQDEF | | SECVCQDEF | | SNNWSGYSGI | | TIALLIGVGNL | |
| SECVCQNGV | | SECVCQNGV | | SNPGRVTVST | | TIASDILKRMS | |
| SECVCVNGS | | SECVCVNGS | | SNPITGSPGA | | TIASDILTRMS | |
| SECVRHNGT | | SECVRHNGT | | SNPITGSPSA | | TIASSLPFQNI | |
| SECVSHNGT | | SECVSHNGT | | SNPKCDLYLN | | TICIGYHANNS | |
| SECYNPCFY | | SECYNPCFY | | SNQASYKIFK | | TICIQGNNDNA | |
| SEDGVYKAL | | SEDGVYKAL | | SNQDSFYRSM | | TICVGYHANNS | |
| SEDNVYKAL | | SEDNVYKAL | | SNQGSFYRNM | | TICVQGKNDNA | |
| SEDNVYKVL | | SEDNVYKVL | | SNQGSFYRSI | | TICVQGNNDNA | |
| SEDNVYRAL | | SEDNVYRAL | | SNQGSFYRSM | | TICVQGNNKNA | |
| SEDSRSGYE | | SEDSRSGYE | | SNRGSFYRSM | | TICVQGNNNNA | |
| SEEALRQKI | | SEEALRQKI | | SNRPIIDINM | | TIDEESRARIK | |
| SEFICVGWS | | SEFICVGWS | | SNRPVIDINM | | TIDLADSEMDK | |
| SEFLCVGWS | | SEFLCVGWS | | SNRPVIDVNM | | TIDLADSEMLN | |
| SEFNEIEHQ | | SEFNEIEHQ | | SNRPVIQIDP | | TIDLADSEMNK | |
| SEFNEIEYQ | | SEFNEIEYQ | | SNRPVIQINP | | TIDLADSEMNN | |
| SEFNKACEL | | SEFNKACEL | | SNRPVIRIDP | | TIDLAESEMNK | |
| SEFSEIEHQ | | SEFSEIEHQ | | SNRPVVDINM | | TIDLTDSEMNK | |
| SEFSETEHQ | | SEFSETEHQ | | SNRPWIRFNS | | TIDLTDSEMSK | |
| SEGIGQAAD | | SEGIGQAAD | | SNRPWIRINN | | TIDMADSEMLN | |
| SEGMGQAAD | | SEGMGQAAD | | SNRPWISFDQ | | TIDMADSTMLN | |
| SEGRGQAAD | | SEGRGQAAD | | SNRPWMRINN | | TIDMTDSEMNK | |
| SEGRTSDMR | | SEGRTSDMR | | SNRPWMRISN | | TIDQADSEMNK | |

Fig. 83-347

| Block size 8 | SIN | Block size 9 | SIN | Block size 10 | SIN | Block size 11 | SIN |
|---|---|---|---|---|---|---|---|
| SEGTGIAAD | | SEGTGIAAD | | SNRPWVRINN | | TIDQVTGKLNR | |
| SEGTGIVAD | | SEGTGIVAD | | SNRPWVRMNN | | TIDSTDSEMNK | |
| SEGTGMAAD | | SEGTGMAAD | | SNRPWVSFDQ | | TIDVTDSEMNK | |
| SEGTGQAAD | | SEGTGQAAD | | SNRPWVSFNQ | | TIEELRRQKSL | |
| SEGTGTAAD | | SEGTGTAAD | | SNRSGYSGSF | | TIEELRRQKWW | |
| SEHTAYSQI | | SEHTAYSQI | | SNSDFICVGW | | TIEKMVLSAFD | |
| SEIEGRIQD | | SEIEGRIQD | | SNSDFLCVGW | | TIERMVLSAFD | |
| SEIEHQIGN | | SEIEHQIGN | | SNSDFMCVGW | | TIGDCPKYMNV | |
| SEIEHQISN | | SEIEHQISN | | SNSDWSGYSG | | TIGDCPKYVNI | |
| SEIEQQIGN | | SEIEQQIGN | | SNSEFICVGW | | TIGDCPKYVNV | |
| SEKLVLATG | | SEKLVLATG | | SNSEFLCVGW | | TIGECPKYIKS | |
| SEKVDTLLE | | SEKVDTLLE | | SNSEGTGMAA | | TIGECPKYVKS | |
| SEKVNTLLE | | SEKVNTLLE | | SNSIAVFCGT | | TIGECPKYVRS | |
| SELGVPFHL | | SELGVPFHL | | SNSIIAFCGT | | TIGECPRYVKS | |
| SEMDKLFER | | SEMDKLFER | | SNSIIVFCGT | | TIGISGPDDGA | |
| SEMDKLYER | | SEMDKLYER | | SNSIVAFCGT | | TIGISGPDNEA | |
| SEMDKLYTR | | SEMDKLYTR | | SNSIVALCGS | | TIGISGPDNGA | |
| SEMKKLYER | | SEMKKLYER | | SNSIVSMCSS | | TIGISGPDSGA | |
| SEMKWLLSS | | SEMKWLLSS | | SNSIVTFCGL | | TIGITGPDATA | |
| SEMKWLSSS | | SEMKWLSSS | | SNSIVVFCGA | | TIGKCPKYVKS | |
| SEMLNLYDR | | SEMLNLYDR | | SNSIVVFCGT | | TIGKCSKYVKS | |
| SEMLNLYER | | SEMLNLYER | | SNSIVVFCST | | TIGLLLQITSL | |
| SEMNKLFEK | | SEMNKLFEK | | SNSIVVFVAP | | TIGNLIAPRGH | |
| SEMNKLFER | | SEMNKLFER | | SNSKSRDPNN | | TIGNLVAPRGH | |
| SEMNKLHER | | SEMNKLHER | | SNSLIALCGS | | TIGPLLQITSL | |
| SEMNKLYEK | | SEMNKLYEK | | SNSLKLAIGL | | TIGSVSLIIAT | |
| SEMNKLYER | | SEMNKLYER | | SNSLVALCGS | | TIGSVSLTIAA | |
| SEMNRLFER | | SEMNRLFER | | SNSMVTFCGL | | TIGSVSLTIAI | |
| SEMSKLFEK | | SEMSKLFEK | | SNSNCKDPNN | | TIGSVSLTIAT | |
| SEMSKLFER | | SEMSKLFER | | SNSNCRDPNN | | TIGSVSLTITT | |
| SEMSKLYER | | SEMSKLYER | | SNSNCRNPNN | | TIGVSGPDNGA | |
| SEQAAEAIE | | SEQAAEAIE | | SNSRFESVAW | | TIHDRAAFRGL | |
| SEQAAEAMD | | SEQAAEAMD | | SNSTTHDRTA | | TIHDRIPHRTL | |
| SEQAAEAME | | SEQAAEAME | | SNSVVVFCGT | | TIHDRNAFRGL | |
| SEQFPVQTD | | SEQFPVQTD | | SNTWLGRTIS | | TIHDRSPFRAL | |
| SEQIIVTRE | | SEQIIVTRE | | SNVENLFDEV | | TIHDRSPHRTL | |
| SEQIVVTRE | | SEQIVVTRE | | SNVGLKVSLH | | TIHDRSPYRAL | |
| SEQMETGGE | | SEQMETGGE | | SNVGLNMSLH | | TIHDRSQFRAL | |
| SEQNVPVTQ | | SEQNVPVTQ | | SNVGLNVSLH | | TIHDRSQYRAL | |
| SEQTKLYGN | | SEQTKLYGN | | SNVKNLFDEV | | TIHDRSQYRSL | |
| SEQTKLYGS | | SEQTKLYGS | | SNVKNLYDKV | | TIHDRTAFRGL | |
| SEQVIVTRE | | SEQVIVTRE | | SNVKNLYDRV | | TIHDRTPHRTL | |
| SERGEDTIE | | SERGEDTIE | | SNVKNLYEKV | | TIHDRTTFRGL | |
| SERGEETIE | | SERGEETIE | | SNVKNLYNKV | | TIHLTDSEMNK | |
| SERGEETVE | | SERGEETVE | | SNVRNLYDKV | | TIIENNVTVTS | |
| SERGLFGAI | | SERGLFGAI | | SNVTVTNSVE | | TIIESNITVTS | |
| SERGLQRRR | | SERGLQRRR | | SNVTVTSSIE | | TIIESNVTVTS | |
| SERLVLATG | | SERLVLATG | | SNVTVTSSVE | | TIIETGYVCSK | |
| SERVDTLLE | | SERVDTLLE | | SNVVLNVSLH | | TIIGPPQCDLH | |
| SESGRLIDF | | SESGRLIDF | | SNWSGYSGIF | | TIIGPPQCDSH | |
| SESRSNIFN | | SESRSNIFN | | SNWSGYSGSF | | TIIKTLTNEKE | |
| SESSFYAEM | | SESSFYAEM | | SNYHQSFVPS | | TIISNLPFQNI | |
| SETEHQIGN | | SETEHQIGN | | SNYQQSFVPS | | TIISSLPFQNI | |
| SETGAPQLN | | SETGAPQLN | | SNYVCSGLVG | | TIIYSSSMMWE | |
| SEVEGRIQD | | SEVEGRIQD | | SPCLTDKGSI | | TIKDRSPYRTL | |
| SEVPEWSWD | | SEVPEWSWD | | SPDPGVKGFA | | TIKNGTYDHKD | |
| SEVPGWSWD | | SEVPGWSWD | | SPEEVSEAQG | | TIKNGTYDHKE | |
| SEVPGWSWG | | SEVPGWSWG | | SPEEVSETQG | | TIKNGTYNHKD | |
| SEWSYIVEK | | SEWSYIVEK | | SPFPVGSGSF | | TIKNGTYNHKE | |
| SFAGWILGN | | SFAGWILGN | | SPFRALISWE | | TIKNGTYNRKE | |
| SFAISCFLI | | SFAISCFLI | | SPFRALISWG | | TIKPWARNILR | |
| SFAISCFLL | | SFAISCFLL | | SPFRALVSWE | | TIKQNGKSGAC | |

Fig. 83-348

| Block size 8 | SIN | Block size 9 | SIN | Block size 10 | SIN | Block size 11 | SIN |
|---|---|---|---|---|---|---|---|
| SFAISCLLL | | SFAISCLLL | | SPFRTLMSCP | | TIKTWAGKILR | |
| SFALAQGAL | | SFALAQGAL | | SPFRTLMSVE | | TIKTWAGNILR | |
| SFALAQGTL | | SFALAQGTL | | SPFRTLMSVK | | TIKTWAKNILR | |
| SFALAQGVL | | SFALAQGVL | | SPGAPGVKGF | | TIKTWARNILR | |
| SFAMSCFLL | | SFAMSCFLL | | SPGARPKVNG | | TILEKNITVTH | |
| SFATSCFLL | | SFATSCFLL | | SPGCDRLQDT | | TILEKNVTVTH | |
| SFCLKNGNM | | SFCLKNGNM | | SPGDRPKVNG | | TILEQNVTVTH | |
| SFEGWIGGN | | SFEGWIGGN | | SPGMMMGMFN | | TILERNVTVTH | |
| SFEGWIVGN | | SFEGWIVGN | | SPGNAEIEDL | | TILETGYICSK | |
| SFEKFEIFP | | SFEKFEIFP | | SPGRVTVSTK | | TILETGYVCGK | |
| SFEQITFIQ | | SFEQITFIQ | | SPGVKGFGFL | | TILETGYVCSK | |
| SFEQITFLQ | | SFEQITFLQ | | SPGVKGWAFD | | TILETRYVCSK | |
| SFEQITFMQ | | SFEQITFMQ | | SPHRALMSCP | | TILSTKALLIG | |
| SFERFEIFP | | SFERFEIFP | | SPHRSLMSCP | | TIMEKNITVTH | |
| SFERFEMFP | | SFERFEMFP | | SPHRTLLMNE | | TIMEKNVTVTH | |
| SFESNGGLL | | SFESNGGLL | | SPHRTLMSCP | | TIMERNVTVTH | |
| SFESNGNFI | | SFESNGNFI | | SPIHLGDCSF | | TINDRSPFRAL | |
| SFESTGNLI | | SFESTGNLI | | SPINNGKGRY | | TINDRTAFRGL | |
| SFESTGNLV | | SFESTGNLV | | SPISVGSGSF | | TINEEALRQKI | |
| SFFRHMVWL | | SFFRHMVWL | | SPKLRSGFEM | | TINFESTGNLI | |
| SFFRNIVWL | | SFFRNIVWL | | SPLAGSAQHV | | TINFESTGNLV | |
| SFFRNMIWL | | SFFRNMIWL | | SPLAVTWWNR | | TINRIFQPNIG | |
| SFFRNMVWL | | SFFRNMVWL | | SPLELRDCKI | | TINRNFQPNIG | |
| SFFRNVIWL | | SFFRNVIWL | | SPLGAINTTL | | TINRSFQPNIG | |
| SFFRNVVWI | | SFFRNVVWI | | SPLKLVDGQD | | TINRSFRPNIG | |
| SFFRNVVWL | | SFFRNVVWL | | SPLMVAYMLE | | TINSPLPFQNI | |
| SFFSKLNWL | | SFFSKLNWL | | SPLPFQNIDS | | TINSWHIFGKD | |
| SFFSRLNWL | | SFFSRLNWL | | SPLSGSAQHI | | TINSWHIHGKD | |
| SFFYRYGFV | | SFFYRYGFV | | SPLSGSAQHV | | TINSWHIYGKD | |
| SFGASCFIL | | SFGASCFIL | | SPLSRCRETR | | TINYYNETFVN | |
| SFGASCFLF | | SFGASCFLF | | SPLSRCRKTR | | TIPCFWVEMIR | |
| SFGASCFLL | | SFGASCFLL | | SPLTKGILGF | | TIQNEDIPIGN | |
| SFGASCFTL | | SFGASCFTL | | SPLTKGMLGF | | TIRGKHSNGTI | |
| SFGASCFVL | | SFGASCFVL | | SPLVLDDCSL | | TIRGRHSNGTI | |
| SFGASCLIL | | SFGASCLIL | | SPMMWEINGP | | TIRNGTYNHED | |
| SFGASCVML | | SFGASCVML | | SPNAYQAKFE | | TIRNKHSNGTI | |
| SFGASSFVL | | SFGASSFVL | | SPNAYQAQFE | | TIRNKHSNGTT | |
| SFGGFTFKR | | SFGGFTFKR | | SPNAYQARFE | | TIRNKHSNSTT | |
| SFGVSGINE | | SFGVSGINE | | SPNVYQAKFE | | TIRNRHSNGTI | |
| SFGVSGVNE | | SFGVSGVNE | | SPNVYQARFE | | TIRTWAKNILR | |
| SFHLGTKQV | | SFHLGTKQV | | SPNVYQSRFE | | TISFESTGNLV | |
| SFIDYWAEG | | SFIDYWAEG | | SPPIVSNSDF | | TISIASRSGYE | |
| SFIDYWAKE | | SFIDYWAKE | | SPPIVSNSEF | | TISKDLRSGYE | |
| SFIDYWAKG | | SFIDYWAKG | | SPPMVSNSDF | | TISKDSRSGYE | |
| SFIGEEMAT | | SFIGEEMAT | | SPPVVSNSDF | | TISKDTRSGYE | |
| SFIQHPELT | | SFIQHPELT | | SPQLEGFSAE | | TISLVKTTLFL | |
| SFKPNIGPR | | SFKPNIGPR | | SPQRTLMSCP | | TISMDSRSGYE | |
| SFKYGNGVW | | SFKYGNGVW | | SPRLRSGFEM | | TISPHSRSGFE | |
| SFLAHALKL | | SFLAHALKL | | SPRMFLAMIT | | TISPKLRSGFE | |
| SFLTHALRF | | SFLTHALRF | | SPRSRNGFEM | | TISPRLRSGFE | |
| SFLVHALKS | | SFLVHALKS | | SPRSRSGFEM | | TISPRSRNGFE | |
| SFMDYWAEG | | SFMDYWAEG | | SPRSRSGFEV | | TISPRSRSGFE | |
| SFNDYEELK | | SFNDYEELK | | SPRTVGQCPK | | TISRDSRSGYE | |
| SFNGAFIAP | | SFNGAFIAP | | SPSAPGVKGF | | TISSSLVLVGL | |
| SFNGAFVAP | | SFNGAFVAP | | SPSECRTFFL | | TISTASRAGYE | |
| SFNGEEMAT | | SFNGEEMAT | | SPSNSRFESV | | TISTASRSGYE | |
| SFNNYEELK | | SFNNYEELK | | SPSPGARPKV | | TISTASRYGYE | |
| SFPDGAKIQ | | SFPDGAKIQ | | SPSPGDRPKV | | TITGDNTKWNE | |
| SFPDGAQIK | | SFPDGAQIK | | SPVHLGDCNF | | TITLHFKQNEC | |
| SFPDGAQIQ | | SFPDGAQIQ | | SPVHLGDCRF | | TITNPLIRHEN | |
| SFPDGARIQ | | SFPDGARIQ | | SPVHLGDCSF | | TITSNLPFQNV | |
| SFPQTTNTY | | SFPQTTNTY | | SPVLTDNPRP | | TITSPLPFQNI | |

Fig. 83-349

| Block size 8 | SIN | Block size 9 | SIN | Block size 10 | SIN | Block size 11 | SIN |
|---|---|---|---|---|---|---|---|
| SFQGGHIEE | | SFQGGHIEE | | SPVNNGKGRY | | TITYSSPMMWE | |
| SFQGRGVFE | | SFQGRGVFE | | SPVPVGSGSF | | TITYSSSLMWE | |
| SFQLINNKK | | SFQLINNKK | | SPVSVGSGSF | | TITYSSSMMWE | |
| SFQPNIGPR | | SFQPNIGPR | | SPYNSKFESV | | TIVETGYVCSK | |
| SFQSGHIEE | | SFQSGHIEE | | SPYNSRFESV | | TIVKTLTNEKE | |
| SFQVDCFLW | | SFQVDCFLW | | SPYRALISWE | | TIVKTLTNEQE | |
| SFQVDCYLW | | SFQVDCYLW | | SPYRALMSCP | | TIVKTLTNERE | |
| SFRAYVDGF | | SFRAYVDGF | | SPYRALMSVP | | TIVKTLTSEKE | |
| SFRGRGVFE | | SFRGRGVFE | | SPYRTLMSCP | | TIVLDTDWSGY | |
| SFRPNIGPR | | SFRPNIGPR | | SPYRTLMSVE | | TIVLNTDWSGY | |
| SFRQSERGE | | SFRQSERGE | | SPYRTLMSVG | | TIVLTTDWSGY | |
| SFRYGDGVW | | SFRYGDGVW | | SPYRTLMSVK | | TIVSSLPFQNI | |
| SFRYGNGVW | | SFRYGNGVW | | SQASYKIFKS | | TIVSSLPFQSI | |
| SFSFGGFTF | | SFSFGGFTF | | SQDTEISFTI | | TIWASGSSISF | |
| SFSIRGETT | | SFSIRGETT | | SQDTELSFTI | | TIWTSASSISF | |
| SFSIRWETT | | SFSIRWETT | | SQDTELSFTV | | TIWTSGSIISF | |
| SFSISCFLL | | SFSISCFLL | | SQDTEVSFTI | | TIWTSGSSIAF | |
| SFSMSCFVF | | SFSMSCFVF | | SQETRVWWTS | | TIWTSGSSISF | |
| SFSPSPGAR | | SFSPSPGAR | | SQFRALISWE | | TIWTSSSSIVM | |
| SFSPSPGDR | | SFSPSPGDR | | SQGEGTAADY | | TIWTSSSSVVM | |
| SFSRTELIA | | SFSRTELIA | | SQGSGYAADK | | TIYWWDGLQSS | |
| SFSRTELIN | | SFSRTELIN | | SQGSGYAADR | | TKAPQLNPIDG | |
| SFSRTELIP | | SFSRTELIP | | SQGTKRPYEQ | | TKATKMEAILV | |
| SFSRTELIS | | SFSRTELIS | | SQGTKRSHEQ | | TKATKMKAIIV | |
| SFSRTQLIA | | SFSRTQLIA | | SQGTKRSYEQ | | TKATKMKAILV | |
| SFTGEEMAS | | SFTGEEMAS | | SQGTTIRGKH | | TKATNGNYGPI | |
| SFTGEEMAT | | SFTGEEMAT | | SQGTTIRGRH | | TKCQLNEGVMN | |
| SFTGWILGN | | SFTGWILGN | | SQGTTLKGRH | | TKCQSPLGAIN | |
| SFTITGDNT | | SFTITGDNT | | SQGTTLRGQH | | TKCQTPLGAIN | |
| SFTPSPGAR | | SFTPSPGAR | | SQGTTLRGRH | | TKCQTPLGALN | |
| SFTPSPGTR | | SFTPSPGTR | | SQGVKGWAFD | | TKCQTSVGGID | |
| SFVDYWAEG | | SFVDYWAEG | | SQITNGTTGN | | TKCQTSVGGIN | |
| SFVPSPGAR | | SFVPSPGAR | | SQKGILEDEQ | | TKCQTYAGAIN | |
| SFVPSPGSR | | SFVPSPGSR | | SQKLFALSGV | | TKCQTYAGAVN | |
| SFVPSPGVR | | SFVPSPGVR | | SQKQEFKMNP | | TKCQTYTGAIN | |
| SFVPVVGAR | | SFVPVVGAR | | SQLEGFSAES | | TKDAERGKLKR | |
| SFVQHPELT | | SFVQHPELT | | SQLIWMACHS | | TKDNSIRIGSK | |
| SFVQHPEMT | | SFVQHPEMT | | SQLKKQEIEG | | TKDSITDIWTY | |
| SFWMCPNGS | | SFWMCPNGS | | SQLKRQEIEG | | TKEAQDVIMEV | |
| SFWMCSGHS | | SFWMCSGHS | | SQLVWMACHS | | TKEGRRKTNLY | |
| SFWMCSNGS | | SFWMCSNGS | | SQLVWMACNS | | TKEGRRRTNLY | |
| SFYAELKWL | | SFYAELKWL | | SQNILRTHES | | TKEMEGICYPG | |
| SFYAELRWL | | SFYAELRWL | | SQNILRTQEP | | TKENTGSYVRL | |
| SFYAEMEWL | | SFYAEMEWL | | SQNILRTQES | | TKEQTALYKNA | |
| SFYAEMKWL | | SFYAEMKWL | | SQRGILEDEQ | | TKEQTTLYKNA | |
| SFYAEVKWL | | SFYAEVKWL | | SQRGVLEDEQ | | TKETNGNYGPI | |
| SFYGELKWL | | SFYGELKWL | | SQRSKFLLMD | | TKEWSKRYELE | |
| SFYRNLAWF | | SFYRNLAWF | | SQSGRISFYW | | TKEWSRRYELE | |
| SFYRNLIWF | | SFYRNLIWF | | SQSRTREILT | | TKGDKICLGHH | |
| SFYRNLIWL | | SFYRNLIWL | | SQSRTRGILT | | TKGEKANVLIG | |
| SFYRNLLWI | | SFYRNLLWI | | SQTATKRIRM | | TKGILGFVFTL | |
| SFYRNLLWM | | SFYRNLLWM | | SQTATKRLRM | | TKGKKAVDLGS | |
| SFYRNLVWF | | SFYRNLVWF | | SQTIINNYHN | | TKGLCIINSWH | |
| SFYRNLVWI | | SFYRNLVWI | | SQTIINNYYN | | TKGLCTINSWH | |
| SFYRNLVWL | | SFYRNLVWL | | SQTVINNYYN | | TKGMLGFVFTL | |
| SFYRNMRWL | | SFYRNMRWL | | SQVEQRINML | | TKGVLGFVFTL | |
| SFYRNVVWL | | SFYRNVVWL | | SQVERRINML | | TKHDRIPHRTL | |
| SFYRSINWL | | SFYRSINWL | | SQYICSPVLT | | TKIDLWSYNAE | |
| SFYRSIRWL | | SFYRSIRWL | | SQYLCTGILT | | TKIDLWSYNAG | |
| SFYRSMKWL | | SFYRSMKWL | | SQYLCTGVLT | | TKINNIIDKMN | |
| SFYRSMRWL | | SFYRSMRWL | | SQYRALISWP | | TKINNIIEKMN | |
| SFYSEMKWL | | SFYSEMKWL | | SQYRALVSWP | | TKINTLTERGV | |

Fig. 83-350

| Block size 8 | SIN | Block size 9 | SIN | Block size 10 | SIN | Block size 11 | SIN |
|---|---|---|---|---|---|---|---|
| SFYTELKWL | | SFYTELKWL | | SQYREEALLN | | TKITVDHMAII | |
| SFYWTIVDP | | SFYWTIVDP | | SQYRSLISWP | | TKKEPDTYDFN | |
| SFYWTIVEP | | SFYWTIVEP | | SRADKICIGY | | TKKKNPEAYNF | |
| SGAAGAAIK | | SGAAGAAIK | | SRARIDARID | | TKKKPDIYDFN | |
| SGAAGAAVK | | SGAAGAAVK | | SRARIDARVD | | TKKKPDTYDFN | |
| SGADDDAYA | | SGADDDAYA | | SRARIKTRLF | | TKKMTITFLIL | |
| SGADDEAYA | | SGADDEAYA | | SRAVGKCPRY | | TKKQLRENAED | |
| SGADNDAYA | | SGADNDAYA | | SRCRETRGLF | | TKLGSPLVLDD | |
| SGAVAVLKY | | SGAVAVLKY | | SRCRKTRGLF | | TKLPFQNLSPR | |
| SGCITPNGS | | SGCITPNGS | | SRDSRSGYET | | TKLYGNGNKLI | |
| SGCKMYALH | | SGCKMYALH | | SRERLGSWSW | | TKLYGNGNKLV | |
| SGDDVWMGR | | SGDDVWMGR | | SRFEAVAWSA | | TKLYGSGNKLI | |
| SGDIWITRE | | SGDIWITRE | | SRFESVAWSA | | TKLYGSGNKLV | |
| SGDIWVTRE | | SGDIWVTRE | | SRFQIQGVKL | | TKLYGSGSKLI | |
| SGDVWVTRE | | SGDVWVTRE | | SRGEVFVIRE | | TKLYKNTNTLS | |
| SGDYARLYI | | SGDYARLYI | | SRGHIFVIRE | | TKLYVNKNPYT | |
| SGEQMLIIW | | SGEQMLIIW | | SRGHVFVIRE | | TKMEAILVVLL | |
| SGEQMLVIW | | SGEQMLVIW | | SRGLFGAIAG | | TKMKAIIVVLL | |
| SGEVPGWSW | | SGEVPGWSW | | SRGLFGAKAG | | TKMKAILVVLL | |
| SGFAIASKD | | SGFAIASKD | | SRGYKMNIQI | | TKNLESRSGFE | |
| SGFAIFSKD | | SGFAIFSKD | | SRGYKMNNQI | | TKPRPRRGLFG | |
| SGFAIISKD | | SGFAIISKD | | SRGYKMNTKI | | TKQVCAAWSSS | |
| SGFAIVSKD | | SGFAIVSKD | | SRGYKMNTQI | | TKQVCIAWSSS | |
| SGFAVVSKD | | SGFAVVSKD | | SRGYKMNTRI | | TKQVCMAWSSS | |
| SGFEIIWDP | | SGFEIIWDP | | SRHCSKYHWN | | TKQVCVAWSSS | |
| SGFEILLIE | | SGFEILLIE | | SRHHMGECPK | | TKRIRMAINLV | |
| SGFEMIWDA | | SGFEMIWDA | | SRHYIGKCPK | | TKRIRMAINQC | |
| SGFEMIWDP | | SGFEMIWDP | | SRHYMGECPE | | TKRIRMAINWG | |
| SGFEMLKIH | | SGFEMLKIH | | SRHYMGECPK | | TKRIRMAINYS | |
| SGFEMLKIP | | SGFEMLKIP | | SRHYMGECPN | | TKRLCTINSWH | |
| SGFEMLKVP | | SGFEMLKVP | | SRIAIGNCPK | | TKRQLRENAED | |
| SGFEMLRIP | | SGFEMLRIP | | SRILTDTSRP | | TKRSHEQMETG | |
| SGFEMVWDA | | SGFEMVWDA | | SRINGVKLEE | | TKRSYEQMETD | |
| SGFEMVWDP | | SGFEMVWDP | | SRINMINSKI | | TKRSYEQMETG | |
| SGFEVLFIE | | SGFEVLFIE | | SRINMINSQI | | TKRSYEQMETS | |
| SGFEVLKVP | | SGFEVLKVP | | SRINRQEIEG | | TKSLESRSGFE | |
| SGFEVLLIE | | SGFEVLLIE | | SRINTINSKI | | TKSTVLKSDKR | |
| SGFFGDNPR | | SGFFGDNPR | | SRISFYWTIV | | TKSYFANLKGT | |
| SGFFPDGPQ | | SGFFPDGPQ | | SRKLLLIAQA | | TKTMTITFLIL | |
| SGFVRTLFQ | | SGFVRTLFQ | | SRKLLLITQA | | TKTTVDHMAII | |
| SGGGDIWVT | | SGGGDIWVT | | SRKLLLIVQA | | TKTTVDHMAVI | |
| SGGHIEECS | | SGGHIEECS | | SRKLLLVVQA | | TKVDLWSYNAE | |
| SGGIDKEPM | | SGGIDKEPM | | SRKMLLIVQA | | TKVNTLTEKGI | |
| SGGIDKESM | | SGGIDKESM | | SRLNRNEIKG | | TKVNTLTEKGV | |
| SGGIDKIGT | | SGGIDKIGT | | SRLNRQEIEG | | TKVNTLTERGI | |
| SGGIDKIST | | SGGIDKIST | | SRLNWLTKAT | | TKVNTLTERGV | |
| SGGIDKVST | | SGGIDKVST | | SRLNWLTKET | | TKWNENQNPRI | |
| SGGISKIST | | SGGISKIST | | SRMGVDEYSS | | TKWNENQNPRM | |
| SGGISKMST | | SGGISKMST | | SRMQFSSLAV | | TKWNENQNPRV | |
| SGGLLAPRY | | SGGLLAPRY | | SRMQFSSLTV | | TKWNVTHTGTS | |
| SGGTINSPL | | SGGTINSPL | | SRMSICISGP | | TKWNVTYTGIS | |
| SGGYKDIIL | | SGGYKDIIL | | SRMSICMSGP | | TKWNVTYTGTS | |
| SGGYKDVIL | | SGGYKDVIL | | SRMSVCMSGP | | TLCICYHANNS | |
| SGHDFEREG | | SGHDFEREG | | SRNGFEMLKI | | TLCIGYHANNS | |
| SGHSCRICI | | SGHSCRICI | | SRNGKWREQL | | TLCLGHHAVAN | |
| SGHWPDGSN | | SGHWPDGSN | | SRNPGNAEIE | | TLCLGHHAVPN | |
| SGIAIALGI | | SGIAIALGI | | SRPFQNASRH | | TLCLGHHAVQN | |
| SGIAIVLGI | | SGIAIVLGI | | SRPRVRNQSG | | TLCLGHHAVSN | |
| SGICPVVFT | | SGICPVVFT | | SRRYELEIGT | | TLDEESRARIK | |
| SGIEYNGKS | | SGIEYNGKS | | SRSGFEIIWD | | TLDEHDANVRN | |
| SGIFGDNPR | | SGIFGDNPR | | SRSGFEILLI | | TLDEHDSNVEN | |
| SGIFSVEGK | | SGIFSVEGK | | SRSGFEMIWD | | TLDEHDSNVKN | |

Fig. 83-351

| Block size 8 | SIN | Block size 9 | SIN | Block size 10 | SIN | Block size 11 | SIN |
|---|---|---|---|---|---|---|---|
| SGIFSVEHK | | SGIFSVEHK | | SRSGFEMLKI | | TLDFHDSNVKN | |
| SGIFSVENK | | SGIFSVENK | | SRSGFEMLKV | | TLDFHDSNVKS | |
| SGIFSVESK | | SGIFSVESK | | SRSGFEMLRI | | TLDFHDSNVRN | |
| SGIGRFYIQ | | SGIGRFYIQ | | SRSGFEMVWD | | TLDFHDSSVKN | |
| SGIKSFSRT | | SGIKSFSRT | | SRSGFEVLFI | | TLDKHDSNVKN | |
| SGIKTDGAT | | SGIKTDGAT | | SRSGFEVLLI | | TLDLHDANVKN | |
| SGIMKTEGT | | SGIMKTEGT | | SRSGYEILKV | | TLDLHDANVRN | |
| SGIMKTEKT | | SGIMKTEKT | | SRSGYEMLKV | | TLDLHDSNVKN | |
| SGIMKTGGT | | SGIMKTGGT | | SRSGYETFKV | | TLDLHDSNVRN | |
| SGINESADM | | SGINESADM | | SRSGYETFRV | | TLDLHDSNVRS | |
| SGIPPLELG | | SGIPPLELG | | SRSGYEVLKV | | TLDMHDANVKN | |
| SGIRSFSRT | | SGIRSFSRT | | SRSIIFNMER | | TLDMHDANVRN | |
| SGIRTDGAT | | SGIRTDGAT | | SRSLKLAIGL | | TLDNKHSNDTI | |
| SGKADTRIL | | SGKADTRIL | | SRSNIFNMER | | TLDNKHSNDTV | |
| SGKQMLIIW | | SGKQMLIIW | | SRSPGNAEIE | | TLDNKHSNGTI | |
| SGKVECVCR | | SGKVECVCR | | SRSSCHDGKA | | TLEHTSRYVCT | |
| SGLIAGWYG | | SGLIAGWYG | | SRSSFYAEMK | | TLELRSGYWAI | |
| SGLPVGGNE | | SGLPVGGNE | | SRTELINPNK | | TLELRSKYWAI | |
| SGLRILIRG | | SGLRILIRG | | SRTELINPSK | | TLELRSRYWAI | |
| SGLRILVRG | | SGLRILVRG | | SRTELIPPSK | | TLENKHSNGTK | |
| SGLRNVPAI | | SGLRNVPAI | | SRTELISPNK | | TLFEKFFPSSS | |
| SGLTHIMIW | | SGLTHIMIW | | SRTELISPSK | | TLFQQMRDILG | |
| SGLVAGWYG | | SGLVAGWYG | | SRTHQYSEKG | | TLFQQMRDVIG | |
| SGLVGDTPR | | SGLVGDTPR | | SRTIINNYYN | | TLFQQMRDVLG | |
| SGMDPRMCS | | SGMDPRMCS | | SRTREILTKI | | TLGITGPDATA | |
| SGMIDGWYG | | SGMIDGWYG | | SRTREILTKT | | TLGITGPDSTA | |
| SGMRILIRG | | SGMRILIRG | | SRTREILTRT | | TLGITGPDTTA | |
| SGMRILVRG | | SGMRILVRG | | SRTRGILTKT | | TLGLDIRTATR | |
| SGMSANGDI | | SGMSANGDI | | SRVDNHSMSD | | TLGLHDANVRN | |
| SGNAQHVEE | | SGNAQHVEE | | SRVLTDTSRP | | TLIDALLGDPH | |
| SGNCRFNVC | | SGNCRFNVC | | SRYGYEMLKV | | TLIDALLGDPQ | |
| SGNCRFSVC | | SGNCRFSVC | | SRYICSGLVG | | TLIDSLLGDPH | |
| SGNGDPNNM | | SGNGDPNNM | | SRYSKADKIC | | TLIENTYVNNT | |
| SGNLIAPEY | | SGNLIAPEY | | SRYVCSGLVG | | TLIEQKVPVTQ | |
| SGNNQVFPQ | | SGNNQVFPQ | | SRYVCTGILT | | TLIEQNIPVTQ | |
| SGNWPDGSD | | SGNWPDGSD | | SRYWAIRTRS | | TLIEQNVPVTQ | |
| SGNWPDGSN | | SGNWPDGSN | | SRYYMGECPK | | TLISWEMGQAP | |
| SGPDDGAVA | | SGPDDGAVA | | SSAASYKRIR | | TLITDGPSDAQ | |
| SGPDNEAVA | | SGPDNEAVA | | SSAASYKRVR | | TLITDGPSNAQ | |
| SGPDNGAVA | | SGPDNGAVA | | SSACLRGGRN | | TLKGRHANGTI | |
| SGPDSGAVA | | SGPDSGAVA | | SSAQEKNDLY | | TLKIRTNGNLI | |
| SGPLKAEIA | | SGPLKAEIA | | SSASCHDGRA | | TLKLATGMRNI | |
| SGPNDNASA | | SGPNDNASA | | SSCAAMDDFQ | | TLKLATGMRNV | |
| SGPNNNASA | | SGPNNNASA | | SSCFDGKEWL | | TLKLGQFPVQT | |
| SGPSFYAEM | | SGPSFYAEM | | SSCFDGKEWM | | TLKSEQFPVQT | |
| SGQFPVQTD | | SGQFPVQTD | | SSCFDGREWM | | TLKSGQFPVQT | |
| SGQLKLATG | | SGQLKLATG | | SSCHDGKAWL | | TLKSWKGNIMR | |
| SGQNHGICA | | SGQNHGICA | | SSCHDGKEWL | | TLKVESNGNLI | |
| SGRADTKIL | | SGRADTKIL | | SSCHDGKSWL | | TLLAKSVFNCL | |
| SGRADTRIL | | SGRADTRIL | | SSCHDGNAWL | | TLLAKSVFNNL | |
| SGREWSYIV | | SGREWSYIV | | SSCHDGRAWL | | TLLAKSVFNSI | |
| SGRIDFHWA | | SGRIDFHWA | | SSCYDGKAWL | | TLLAKSVFNSL | |
| SGRIDFHWL | | SGRIDFHWL | | SSDDFALILN | | TLLEKNVTVTH | |
| SGRIDFHWM | | SGRIDFHWM | | SSDDFALIVN | | TLLENDVPVTS | |
| SGRIDFHWT | | SGRIDFHWT | | SSDICYPGKF | | TLLENGVPVTS | |
| SGRIDFYWL | | SGRIDFYWL | | SSDICYPGRF | | TLLENNVPVTS | |
| SGRIFQSGV | | SGRIFQSGV | | SSDKVDTLLE | | TLLESDVPVTS | |
| SGRINFHWL | | SGRINFHWL | | SSDNEQTDLY | | TLLKHRFEIIE | |
| SGRINFHWT | | SGRINFHWT | | SSDTVDTLTE | | TLLMNELGIPF | |
| SGRISFYWT | | SGRISFYWT | | SSDVLVTREP | | TLLMNELGVPF | |
| SGRISIYWT | | SGRISIYWT | | SSEAPGWSWD | | TLLMNELGVPL | |
| SGRLGFEII | | SGRLGFEII | | SSEKVDTLLE | | TLLMNELGVSF | |

Fig. 83-352

| Block size 8 | SIN | Block size 9 | SIN | Block size 10 | SIN | Block size 11 | SIN |
|---|---|---|---|---|---|---|---|
| SGRLIDFLK | | SGRLIDFLK | | SSEKVNTLLE | | TLLMSELGVPF | |
| SGRLMDFLK | | SGRLMDFLK | | SSEQAAEAIE | | TLMDALLGDPH | |
| SGRQEKNPA | | SGRQEKNPA | | SSEQAAEAMD | | TLMEQNVPVTQ | |
| SGRQEKNPS | | SGRQEKNPS | | SSEQAAEAME | | TLMSCHIGVAP | |
| SGRSGFEII | | SGRSGFEII | | SSERVDTLLE | | TLMSCPIGVAP | |
| SGRSGFEVI | | SGRSGFEVI | | SSEVPEWSWD | | TLMSCPMGVAP | |
| SGRSSFEII | | SGRSSFEII | | SSEVPGWSWD | | TLMSCPVGVAP | |
| SGRSSFFRN | | SGRSSFFRN | | SSEVPGWSWG | | TLMTDGPSDAQ | |
| SGRVSFYWT | | SGRVSFYWT | | SSFEKFEIFP | | TLNIESNGNLI | |
| SGSAQHIEE | | SGSAQHIEE | | SSFEQITFMQ | | TLNMHDANVRN | |
| SGSAQHVEE | | SGSAQHVEE | | SSFERFEIFP | | TLNNKHSNGTI | |
| SGSFIDYWA | | SGSFIDYWA | | SSFERFEMFP | | TLNRNQPAATA | |
| SGSFIDYWD | | SGSFIDYWD | | SSFFRNIVWL | | TLNTASRSGYE | |
| SGSFIDYWN | | SGSFIDYWN | | SSFFRNMVWL | | TLNTMTKDAER | |
| SGSFIQHPE | | SGSFIQHPE | | SSFFRNVVWL | | TLNVESNGNLI | |
| SGSFMDYWA | | SGSFMDYWA | | SSFQVDCFIW | | TLNVESNGNLV | |
| SGSFPDGAK | | SGSFPDGAK | | SSFQVDCFLW | | TLPFHNIHPLA | |
| SGSFPDGAQ | | SGSFPDGAQ | | SSFSFGGFTF | | TLPFHNIHPLT | |
| SGSFPNGAQ | | SGSFPNGAQ | | SSFYAEMEWL | | TLPFHNVHPLT | |
| SGSFSIRGE | | SGSFSIRGE | | SSFYAEMKWL | | TLPRRSGAAGA | |
| SGSFSIRWE | | SGSFSIRWE | | SSFYRNLLWI | | TLRGQHANGTI | |
| SGSFTLPIE | | SGSFTLPIE | | SSFYRNLLWM | | TLRGRHANGTI | |
| SGSFTLPVE | | SGSFTLPVE | | SSFYRNLVWI | | TLRGRHANGTM | |
| SGSFTLPVG | | SGSFTLPVG | | SSFYRNVVWL | | TLRSLVASSGN | |
| SGSFVDYWA | | SGSFVDYWA | | SSFYRSLLWI | | TLRTQESECAC | |
| SGSFVQHPE | | SGSFVQHPE | | SSFYSEMKWL | | TLSEQNVPVTQ | |
| SGSIISFCG | | SGSIISFCG | | SSGGLLAPRY | | TLSGVAIALSV | |
| SGSLEFIAE | | SGSLEFIAE | | SSGIAIALGI | | TLSSGYKDIIL | |
| SGSLKLAIG | | SGSLKLAIG | | SSGIAIVLGI | | TLSSVNTNTIN | |
| SGSLPDGAQ | | SGSLPDGAQ | | SSGNCRFNVC | | TLSSVTTNTIN | |
| SGSQKQEFK | | SGSQKQEFK | | SSGNCRFSVC | | TLTDNHVEVVS | |
| SGSSFYAEL | | SGSSFYAEL | | SSGNNQVFPQ | | TLTEKGIEVVN | |
| SGSSFYAEM | | SGSSFYAEM | | SSGSLEFIAE | | TLTEKGVEVVN | |
| SGSSIAFCG | | SGSSIAFCG | | SSGSLKLAIG | | TLTENGVPVTS | |
| SGSSISFCG | | SGSSISFCG | | SSGTSKACNA | | TLTEQNVPVTQ | |
| SGSWPDGAD | | SGSWPDGAD | | SSGTSKACSA | | TLTEREVEVVN | |
| SGTCAVVMT | | SGTCAVVMT | | SSGTVKDRSP | | TLTERGIEVVN | |
| SGTDNYGVK | | SGTDNYGVK | | SSGYKDIILW | | TLTERGVEVVD | |
| SGTNNYGVK | | SGTNNYGVK | | SSGYKDVIIW | | TLTERGVEVVN | |
| SGTSKACNA | | SGTSKACNA | | SSGYKDVILW | | TLTETGVPVTS | |
| SGTSKACSA | | SGTSKACSA | | SSGYKEVILW | | TLTGRGIEVVN | |
| SGTYGAGSW | | SGTYGAGSW | | SSIAFCGVDS | | TLTLNTMTKDA | |
| SGTYGSGSW | | SGTYGSGSW | | SSIAFCGVNS | | TLTMGYKDIIL | |
| SGTYGTGSW | | SGTYGTGSW | | SSIDLVETNH | | TLTSVTTNTIN | |
| SGTYGTGTW | | SGTYGTGTW | | SSIGKVCRTL | | TLTVPSERGLQ | |
| SGVAIALSI | | SGVAIALSI | | SSIKEKDMTK | | TLVANNDWSGY | |
| SGVAIALSV | | SGVAIALSV | | SSIKKYERVK | | TLVDALLGDPH | |
| SGVCPVVFT | | SGVCPVVFT | | SSIKRYERVK | | TLVNPGDSIIF | |
| SGVESAVLR | | SGVESAVLR | | SSILTDSQTA | | TLVSNNDWSGY | |
| SGVEYNGKS | | SGVEYNGKS | | SSISFCGVDS | | TLVSNSDWSGY | |
| SGVFGDNPR | | SGVFGDNPR | | SSISFCGVNG | | TLVSTKEWSKR | |
| SGVFGDSPR | | SGVFGDSPR | | SSISFCGVNS | | TLVSTKEWSRR | |
| SGVFGDTPR | | SGVFGDTPR | | SSISFCGVSS | | TLVTDGPSDAQ | |
| SGVFSVEGK | | SGVFSVEGK | | SSIVLVGLIL | | TLYFHDSNVKN | |
| SGVKGWAFD | | SGVKGWAFD | | SSIVMCGVDH | | TLYKNANTLSS | |
| SGVKLEENS | | SGVKLEENS | | SSIVMCGVDY | | TLYKNANTLTS | |
| SGVLGDNPR | | SGVLGDNPR | | SSIVMCGVEH | | TMDTVNRTHQY | |
| SGVMKTEGT | | SGVMKTEGT | | SSIVMCGVNY | | TMDTVSRTHQY | |
| SGVNESADM | | SGVNESADM | | SSIVMVGLIL | | TMDYYWGILKR | |
| SGVNSFSRT | | SGVNSFSRT | | SSIVVFCGTS | | TMGYKDIILWI | |
| SGWLLGNPM | | SGWLLGNPM | | SSIYIEVLHL | | TMHDRSPFRAL | |
| SGWLTLGIT | | SGWLTLGIT | | SSIYQNSFVP | | TMHQLLRHFQK | |

Fig. 83-353

| Block size 8 | SIN | Block size 9 | SIN | Block size 10 | SIN | Block size 11 | SIN |
|---|---|---|---|---|---|---|---|
| SGWTTANSK | | SGWTTANSK | | SSKANQVFPQ | | TMKDRSPYRTL | |
| SGYAADKAS | | SGYAADKAS | | SSKCQQSFTP | | TMLNLYERVRK | |
| SGYAADKES | | SGYAADKES | | SSKDNQVFPQ | | TMTHTSQYICS | |
| SGYAADKKS | | SGYAADKKS | | SSKPFQNASR | | TMTITFLILLF | |
| SGYAADLKS | | SGYAADLKS | | SSKPFQNTSR | | TMTKDAERGKL | |
| SGYAADQES | | SGYAADQES | | SSKPLQNASR | | TNADKICLGHH | |
| SGYAADQKS | | SGYAADQKS | | SSKYLQSFTP | | TNAHDRICIGY | |
| SGYAADRES | | SGYAADRES | | SSKYQQSFSP | | TNAYDRICIGY | |
| SGYAADRKS | | SGYAADRKS | | SSKYQQSFTP | | TNDKYHQIEKE | |
| SGYAQTDCV | | SGYAQTDCV | | SSKYRQSFSP | | TNEEALRQIIR | |
| SGYDFEKEG | | SGYDFEKEG | | SSLAVNVRGS | | TNEKFHQIEKE | |
| SGYDFEREG | | SGYDFEREG | | SSLDEQNKLY | | TNEKYHQIEKE | |
| SGYEILKVP | | SGYEILKVP | | SSLILAAIIM | | TNGEQILIIWG | |
| SGYEMLKVP | | SGYEMLKVP | | SSLILAALIM | | TNGNLIAPEFG | |
| SGYETFKVI | | SGYETFKVI | | SSLLLQANLC | | TNGNLIAPEYG | |
| SGYETFRII | | SGYETFRII | | SSLMWEINGP | | TNGNYGPINVT | |
| SGYETFRVI | | SGYETFRVI | | SSLPFQNINP | | TNGTSKIKMKW | |
| SGYETFRVL | | SGYETFRVL | | SSLPFQNINS | | TNGTSKVKMKW | |
| SGYETFRVT | | SGYETFRVT | | SSLPFQNISP | | TNGTTGNPIIC | |
| SGYEVLKVP | | SGYEVLKVP | | SSLPLALGMK | | TNHQFELIDNE | |
| SGYEVLRVP | | SGYEVLRVP | | SSLTHALREL | | TNHTDELCPSP | |
| SGYFGVFSV | | SGYFGVFSV | | SSLTVNVRGS | | TNHTGTYCSLN | |
| SGYGEDNES | | SGYGEDNES | | SSLTVNVRGT | | TNINIREWSYL | |
| SGYKDIILW | | SGYKDIILW | | SSLTVSVRGS | | TNKFAAICTHL | |
| SGYKDVILW | | SGYKDVILW | | SSLVLAAIIM | | TNKFAAICTHM | |
| SGYKEIILW | | SGYKEIILW | | SSLVLAALIM | | TNKFAAVCTHL | |
| SGYKEVILW | | SGYKEVILW | | SSLVLAALNM | | TNKFASICTHL | |
| SGYNFEKEG | | SGYNFEKEG | | SSLVLIVSLG | | TNKINNIVDKM | |
| SGYSGAFID | | SGYSGAFID | | SSLVLLFMII | | TNKINSIIDKM | |
| SGYSGAFMD | | SGYSGAFMD | | SSLVLLLMII | | TNKLAAICTHL | |
| SGYSGAFTI | | SGYSGAFTI | | SSLVLLVSLG | | TNKQFELIDNE | |
| SGYSGAFTV | | SGYSGAFTV | | SSLVLVVSLG | | TNKTFQNIDKN | |
| SGYSGAFVD | | SGYSGAFVD | | SSMGEAMVSR | | TNKTFQNIDRN | |
| SGYSGIFSI | | SGYSGIFSI | | SSMGIYQILA | | TNKTFQNIEKN | |
| SGYSGIFSV | | SGYSGIFSV | | SSMGVYQILA | | TNKTFQNIERN | |
| SGYSGSFID | | SGYSGSFID | | SSMGVYQILV | | TNKVNNIVDKM | |
| SGYSGSFII | | SGYSGSFII | | SSMMEAMVSR | | TNKVNSIIDKM | |
| SGYSGSFIQ | | SGYSGSFIQ | | SSMMWEINGP | | TNKVNSIIGKM | |
| SGYSGSFIV | | SGYSGSFIV | | SSMMWEVNGP | | TNKVNSIINKM | |
| SGYSGSFMD | | SGYSGSFMD | | SSMNNQVFPQ | | TNLGLNIGLHL | |
| SGYSGSFSI | | SGYSGSFSI | | SSMPFHNIHP | | TNLYGFIIKGR | |
| SGYSGSFSV | | SGYSGSFSV | | SSMPFHNVHP | | TNLYGFIVKGR | |
| SGYSGSFTI | | SGYSGSFTI | | SSMPLHNIHP | | TNLYVNKNPYT | |
| SGYSGSFTL | | SGYSGSFTL | | SSMVEAMISR | | TNMINDKIDDQ | |
| SGYSGSFVD | | SGYSGSFVD | | SSMVEAMMSR | | TNNSTDTVNTL | |
| SGYSGSFVI | | SGYSGSFVI | | SSMVEAMVSR | | TNNSTETVNTL | |
| SGYSGSFVM | | SGYSGSFVM | | SSNCKDPNNE | | TNNYGVKGFGF | |
| SGYSGSFVQ | | SGYSGSFVQ | | SSNCRDPNNE | | TNPLIKHENRM | |
| SGYSGSFVQ | | SGYSGSFVQ | | SSNCRDSNNE | | TNPLIRHENRM | |
| SGYSGVFSV | | SGYSGVFSV | | SSNCRNPNNE | | TNQQFELIDNE | |
| SGYVCSGLV | | SGYVCSGLV | | SSNGAFIAPD | | TNQQFELIDNK | |
| SGYWAIRTR | | SGYWAIRTR | | SSNYHQSFVP | | TNQQFELIGNE | |
| SHCRATEYI | | SHCRATEYI | | SSNYQQSFVP | | TNQQFELINNE | |
| SHCRIIQNE | | SHCRIIQNE | | SSPMMWEING | | TNQQFEMIDNE | |
| SHEGEGIPL | | SHEGEGIPL | | SSPNAYQAKF | | TNQQFGLIDNE | |
| SHEQMETGG | | SHEQMETGG | | SSPNAYQARF | | TNQQFKLIDNE | |
| SHGKIIQNE | | SHGKIIQNE | | SSPPTVYNNR | | TNQRGILEDEQ | |
| SHGRIIQNE | | SHGRIIQNE | | SSPPTVYNSK | | TNRTFQNIDKN | |
| SHGRILKND | | SHGRILKND | | SSPPTVYNSR | | TNRTFQNIDRN | |
| SHGRILKNN | | SHGRILKNN | | SSPPTVYNTR | | TNSIVVFCGTS | |
| SHGRTIQNE | | SHGRTIQNE | | SSPPTVYSSR | | TNSSDKVDTLL | |
| SHGRVLKNN | | SHGRVLKNN | | SSQDTELSFT | | TNSSEKVDTLL | |
| SHGSLQCRI | | SHGSLQCRI | | | | | |

Fig. 83-354

| Block size 8 | SIN | Block size 9 | SIN | Block size 10 | SIN | Block size 11 | SIN |
|---|---|---|---|---|---|---|---|
| SHGTGTGYT | | SHGTGTGYT | | SSQLEGFSAE | | TNSSEKVNTLL | |
| SHGVKGWAF | | SHGVKGWAF | | SSRHCSKYHW | | TNSSERVDTLL | |
| SHHRSHRQM | | SHHRSHRQM | | SSRISFYWTI | | TNSTEKVDTLL | |
| SHISPLSGS | | SHISPLSGS | | SSRNGFEILL | | TNTEFESIESE | |
| SHKICIGYH | | SHKICIGYH | | SSRPFQNASR | | TNTINRIFQPN | |
| SHLECRTFF | | SHLECRTFF | | SSRSGFEILL | | TNTINRNFQPN | |
| SHLKFKADL | | SHLKFKADL | | SSRSGFEVLF | | TNTINRSFQPN | |
| SHLRNDTDV | | SHLRNDTDV | | SSRSGFEVLL | | TNTINRSFRPN | |
| SHMECRTFF | | SHMECRTFF | | SSSACLRGGR | | TNTLSSVTTNT | |
| SHNGGLIAP | | SHNGGLIAP | | SSSCFDGKEW | | TNTQFELIDNE | |
| SHNGGLVAP | | SHNGGLVAP | | SSSCFDGREW | | TNTTLIENTYV | |
| SHNGGRIAP | | SHNGGRIAP | | SSSCHDGKAW | | TNWSGYSGSFV | |
| SHPGIFENS | | SHPGIFENS | | SSSCHDGKSW | | TNYYNETFVNM | |
| SHPGIFESS | | SHPGIFESS | | SSSCHDGNAW | | TNYYNETFVNV | |
| SHPGIFGNS | | SHPGIFGNS | | SSSCHDGRAW | | TPDPGVKGFAF | |
| SHPGLFENS | | SHPGLFENS | | SSSCYDGKAW | | TPGMQIRGFVH | |
| SHRTLLMNE | | SHRTLLMNE | | SSSFSFGGFT | | TPGMQIRGFVY | |
| SHSECRTFF | | SHSECRTFF | | SSSFYAEMKW | | TPHRTLLMNEL | |
| SHTAYSQIT | | SHTAYSQIT | | SSSGNNQVFP | | TPIAFLTSSIV | |
| SHTGTYCSL | | SHTGTYCSL | | SSSGTSKACN | | TPKRNRSILNT | |
| SHYEECSCY | | SHYEECSCY | | SSSIVMCGVD | | TPLELRDCKIE | |
| SHYNQITQT | | SHYNQITQT | | SSSIVMCGVN | | TPLGAINTTLP | |
| SHYNQMKQA | | SHYNQMKQA | | SSSLDEQNKL | | TPLGALNTTLP | |
| SHYNQMTQA | | SHYNQMTQA | | SSSLMWEING | | TPLGSPPIVSN | |
| SHYNQVTQP | | SHYNQVTQP | | SSSLVLAGLI | | TPLGSPPMVSN | |
| SHYNQVTQT | | SHYNQVTQT | | SSSLVLMGLI | | TPLGSPPVVSN | |
| SHYREEALL | | SHYREEALL | | SSSLVLVGLI | | TPLGTPPTVSN | |
| SHYVCSGLV | | SHYVCSGLV | | SSSLVLVGLV | | TPNGSIPNDKP | |
| SIAASYKRI | | SIAASYKRI | | SSSMMWEING | | TPNGSIPNEKP | |
| SIADKICIG | | SIADKICIG | | SSSMMWEVNG | | TPNGSIPNGKP | |
| SIAFCGVDS | | SIAFCGVDS | | SSSMNNQVFP | | TPNGSIPNNKP | |
| SIAFCGVNS | | SIAFCGVNS | | SSSNAYQAKF | | TPNGSISNDKP | |
| SIAGWLLGN | | SIAGWLLGN | | SSSNCKDPNN | | TPRNDDSSSNS | |
| SIAHKSCLP | | SIAHKSCLP | | SSSNCRDPNN | | TPRNDDSSSSS | |
| SIAPIMFSN | | SIAPIMFSN | | SSSNCRDSNN | | TPRNEDGSSSS | |
| SIASRSGYE | | SIASRSGYE | | SSSSCFDGKE | | TPRNEDSSSNS | |
| SIAVFCGTS | | SIAVFCGTS | | SSSSCFDGRE | | TPRNEDSSSSS | |
| SIAWSATAC | | SIAWSATAC | | SSSSCHDGKA | | TPSAIDQITGK | |
| SICEKLEQS | | SICEKLEQS | | SSSSCHDGKS | | TPSIDPKGLFG | |
| SICISGPNN | | SICISGPNN | | SSSSCHDGNA | | TPSIEPKGLFG | |
| SICMSGPND | | SICMSGPND | | SSSSCHDGRA | | TPSIEPRGLFG | |
| SICMSGPNN | | SICMSGPNN | | SSSSCYDGKA | | TPSVEPKGLFG | |
| SICTHLEVC | | SICTHLEVC | | SSSSFYAEMK | | TPSVEPRGLFG | |
| SICVSGPNN | | SICVSGPNN | | SSSSIVMCGV | | TPTKSYFANLK | |
| SIDECRTFF | | SIDECRTFF | | SSSSTVFCGV | | TPYRSLIQFPI | |
| SIDGKAPIS | | SIDGKAPIS | | SSSSVVMCGV | | TPYRSLIQFPM | |
| SIDLVETNH | | SIDLVETNH | | SSSTVFCGVS | | TPYRSLIRFPI | |
| SIDPKGLFG | | SIDPKGLFG | | SSSVLLVSLG | | TPYRSLIRFPV | |
| SIDRFLRVK | | SIDRFLRVK | | SSSVVMCGVD | | TPYRTLLMNEL | |
| SIDRFLRVR | | SIDRFLRVR | | SSSYRRPIGI | | TQAAIDQINGK | |
| SIDSGYVCS | | SIDSGYVCS | | SSSYRRPVGI | | TQAAIDQITGK | |
| SIDSNYVCS | | SIDSNYVCS | | SSTEFLGQWD | | TQAAIDQVNGK | |
| SIDSSYICS | | SIDSSYICS | | SSTEFLGQWN | | TQAAINQINGK | |
| SIDSSYVCS | | SIDSSYVCS | | SSTKEKNDLY | | TQAAVDQITGK | |
| SIECVCRDN | | SIECVCRDN | | SSTKEKNELY | | TQAMELVEAEK | |
| SIEDPDHEG | | SIEDPDHEG | | SSTQEKNDLY | | TQATIDQITGK | |
| SIEDPNHEG | | SIEDPNHEG | | SSTQERNDLY | | TQCQITGFAPF | |
| SIEDPSHEG | | SIEDPSHEG | | SSTSCFDGKE | | TQCQTPLGAIN | |
| SIEECLIND | | SIEECLIND | | SSTSCHDGIG | | TQDAMTEVWSY | |
| SIEEPSHEG | | SIEEPSHEG | | SSTSCHDGIS | | TQDSECVSHNG | |
| SIENLEELR | | SIENLEELR | | SSTSCHDGKA | | TQEAIDKITNK | |
| SIENPSHEG | | SIENPSHEG | | SSTSCHDGKF | | TQEAIEKITNK | |

Fig. 83-355

| Block size 8 | SIN | Block size 9 | SIN | Block size 10 | SIN | Block size 11 | SIN |
|---|---|---|---|---|---|---|---|
| SIENQEELK | | SIENQEELK | | SSTSCHDGKS | | TQEAIGKITNK | |
| SIENQEELR | | SIENQEELR | | SSTSCHDGKT | | TQEAINKITNK | |
| SIEPKGLFG | | SIEPKGLFG | | SSTSCHDGMS | | TQESECACANG | |
| SIEPRGLFG | | SIEPRGLFG | | SSTSCHDGRA | | TQESECACING | |
| SIESEFNEI | | SIESEFNEI | | SSTSCHDGRS | | TQESECACVNG | |
| SIESEFSEI | | SIESEFSEI | | SSTSCHDGVG | | TQESECICING | |
| SIESEFSET | | SIESEFSET | | SSTSCHDGVS | | TQESECLCIDG | |
| SIGITVIKN | | SIGITVIKN | | SSTTCHDGIG | | TQESECQCIDG | |
| SIGKVCRTL | | SIGKVCRTL | | SSTVFCGVSG | | TQESECQCIGG | |
| SIGNLIAPR | | SIGNLIAPR | | SSTVFCGVSS | | TQESECQCISG | |
| SIGSSTYQN | | SIGSSTYQN | | SSTVLVGLIL | | TQESECQCLYG | |
| SIGSWSHNI | | SIGSWSHNI | | SSTVMVGLIL | | TQESECVCHKG | |
| SIGSWSQNI | | SIGSWSQNI | | SSTYQNNFVP | | TQESECVCHNG | |
| SIGTSTLNQ | | SIGTSTLNQ | | SSTYQNSFVP | | TQESECVCHNS | |
| SIGVTVIKN | | SIGVTVIKN | | SSVASSLVLL | | TQESECVCHSG | |
| SIGVTVIRN | | SIGVTVIRN | | SSVDLVETNH | | TQESECVCING | |
| SIHECRTFF | | SIHECRTFF | | SSVKEKDLTK | | TQESECVCISG | |
| SIHSRGLFG | | SIHSRGLFG | | SSVKEKDMTK | | TQESECVCQDE | |
| SIHWTIVKP | | SIHWTIVKP | | SSVKEKDMTR | | TQESECVCVNG | |
| SIIAFCGTS | | SIIAFCGTS | | SSVLLVSLGA | | TQESECVRHNG | |
| SIIDKMNTQ | | SIIDKMNTQ | | SSVNTNTINR | | TQESSCTCIKG | |
| SIIEAESSV | | SIIEAESSV | | SSVREKDMTK | | TQESSCTCILG | |
| SIIEKMNTQ | | SIIEKMNTQ | | SSVSSFEKFE | | TQESSCTCIQG | |
| SIIFNMERI | | SIIFNMERI | | SSVSSFERFE | | TQESSCTCIRG | |
| SIIFNSIGN | | SIIFNSIGN | | SSVSSFKRFE | | TQESSCVCIKG | |
| SIIGKMNTQ | | SIIGKMNTQ | | SSVTTNTINR | | TQESSCVCMKG | |
| SIINKMNTQ | | SIINKMNTQ | | SSVVLVGLIL | | TQESSCVCMNG | |
| SIIPSGPLK | | SIIPSGPLK | | SSVVLVGPIL | | TQESSCVCVKG | |
| SIISFCGVN | | SIISFCGVN | | SSVVMCGVDH | | TQFELIDNEFT | |
| SIISMCSST | | SIISMCSST | | SSVYIEVLHL | | TQGACWEQLYT | |
| SIITELPFQ | | SIITELPFQ | | SSVYYEVLHL | | TQGALLNDKHS | |
| SIIVFCGTS | | SIIVFCGTS | | SSWHILSKDN | | TQGALLNDRHS | |
| SIKEKDMTK | | SIKEKDMTK | | SSWSQNILRT | | TQGEGTAADYK | |
| SIKKYERVK | | SIKKYERVK | | SSYICSGLVG | | TQGRQTFDWTL | |
| SIKNGTYDY | | SIKNGTYDY | | SSYLCSGLVG | | TQGRQTYDWTL | |
| SIKNQEELR | | SIKNQEELR | | SSYMCSGLVG | | TQGSLLNDKHF | |
| SIKRYERVK | | SIKRYERVK | | SSYRRPIGIS | | TQGSLLNDKHS | |
| SIKSWRKDI | | SIKSWRKDI | | SSYRRPVGIS | | TQGSLLNDRHS | |
| SIKSWRRDI | | SIKSWRRDI | | SSYVCSGLVG | | TQGTCWEQLYT | |
| SIKTKLPFQ | | SIKTKLPFQ | | STAASSLALA | | TQGTCWEQMYT | |
| SILANNGKF | | SILANNGKF | | STASRSGYEM | | TQIIVILVLGL | |
| SILANNGRF | | SILANNGRF | | STASRSGYEV | | TQKAIDEITTK | |
| SILASSGSL | | SILASSGSL | | STAVAVIKYN | | TQKAIDGITNK | |
| SILHKCNDS | | SILHKCNDS | | STCVVVMTDG | | TQKAIDGVTNK | |
| SILKPGETL | | SILKPGETL | | STDKDSNGVQ | | TQKAIDIMQNK | |
| SILKPGQTL | | SILKPGQTL | | STDKIDTLTE | | TQKAIDNMQNK | |
| SILNLLIGI | | SILNLLIGI | | STDKNSNGVQ | | TQKAIDNMQNR | |
| SILNTSQRG | | SILNTSQRG | | STDKVDTIIE | | TQKAIDQITTK | |
| SILRTQESE | | SILRTQESE | | STDKVDTLTE | | TQKAIDRITTK | |
| SILTDSQTA | | SILTDSQTA | | STDKVNTIIE | | TQKAINEITTK | |
| SILYFWGVH | | SILYFWGVH | | STDTVDTILE | | TQKAINGVTNK | |
| SIMSCDSPS | | SIMSCDSPS | | STDTVDTLIE | | TQKALNEITTK | |
| SINECRTFF | | SINECRTFF | | STDTVDTLLE | | TQKAMDGVTNK | |
| SINGKAPIS | | SINGKAPIS | | STDTVDTLTE | | TQKTIDQVTGK | |
| SINGKEPIS | | SINGKEPIS | | STDTVDTVLE | | TQMAIDNMQNK | |
| SINGKQPIS | | SINGKQPIS | | STDTVDTVRE | | TQNNTTLIENT | |
| SINGRAPIS | | SINGRAPIS | | STDTVNTLIE | | TQNNTTVVENT | |
| SINPVKLSS | | SINPVKLSS | | STDTVNTLME | | TQPLSISVGSS | |
| SINTKLPFQ | | SINTKLPFQ | | STDTVNTLTE | | TQPTFSVQRNL | |
| SINTRLPFQ | | SINTRLPFQ | | STEFLGQWDW | | TQRAIDGVTNK | |
| SINWLTKKE | | SINWLTKKE | | STEFLGQWNW | | TQRAIDNMQNK | |
| SINWLTKKK | | SINWLTKKK | | STEHVDTIME | | TQSAIDQITGK | |

Fig. 83-356

| Block size 8 | SIN | Block size 9 | SIN | Block size 10 | SIN | Block size 11 | SIN |
|---|---|---|---|---|---|---|---|
| SIPNDKPFQ | | SIPNDKPFQ | | STEKVDTIIE | | TQSAIDQITGT | |
| SIPNEKPFQ | | SIPNEKPFQ | | STEKVDTLLE | | TQSAIDQVTGK | |
| SIPNGKPFQ | | SIPNGKPFQ | | STEQVDTIME | | TQSAINQITGK | |
| SIPNNKPFQ | | SIPNNKPFQ | | STERVDTIIE | | TQSAVDQITGK | |
| SIQPTFSVQ | | SIQPTFSVQ | | STERVDTIME | | TQSAVNQITGK | |
| SIQSDKPFQ | | SIQSDKPFQ | | STETVNTLIE | | TQSLSISIGSS | |
| SIQSKGLFG | | SIQSKGLFG | | STETVNTLSE | | TQSLSISVESS | |
| SIQSRGLFG | | SIQSRGLFG | | STETVNTLTE | | TQSLSISVGSS | |
| SIQTRGLFG | | SIQTRGLFG | | STGALASCMG | | TQTAIDQINGK | |
| SIRDNTYDH | | SIRDNTYDH | | STGAQSFYRS | | TQTAIDQITGK | |
| SIRGEFNQV | | SIRGEFNQV | | STGGQAFYRS | | TQTLVANNDWS | |
| SIRGEFSQV | | SIRGEFSQV | | STGGQSFYRS | | TQTLVSNNDWS | |
| SIRGETTGR | | SIRGETTGR | | STGKDPKKTG | | TQTLVSNSDWS | |
| SIRIGSKGD | | SIRIGSKGD | | STGNFIAPEY | | TQTMELVEAEK | |
| SIRIGSRGD | | SIRIGSRGD | | STGNHGSLVL | | TQTMELVETEK | |
| SIRLAAGGD | | SIRLAAGGD | | STGNLIAPEY | | TQTMELVETKK | |
| SIRLSADGD | | SIRLSADGD | | STGNLIAPRG | | TQTRGIFGAIA | |
| SIRLSAGGA | | SIRLSAGGA | | STGNLVAPEY | | TQVEELVHGGI | |
| SIRLSAGGD | | SIRLSAGGD | | STIALFIGVG | | TQVEELVHGGV | |
| SIRLSAGGH | | SIRLSAGGH | | STIALIIGVG | | TQVEELVHGQV | |
| SIRLSAGGN | | SIRLSAGGN | | STIALLIGIG | | TQVEELVHRGI | |
| SIRLSASGD | | SIRLSASGD | | STIALLIGVG | | TQYREEALLNR | |
| SIRNETYDH | | SIRNETYDH | | STIGDCPKYV | | TRALVRSGMDP | |
| SIRNGTYDH | | SIRNGTYDH | | STISCDSPSN | | TRALVRTGMDP | |
| SIRNGTYDY | | SIRNGTYDY | | STKEKNDLYG | | TRCQTPLGAIN | |
| SIRNGTYNH | | SIRNGTYNH | | STKEKNELYG | | TRCQTSVGGIN | |
| SIRNGTYNY | | SIRNGTYNY | | STKEWSKRYE | | TRDAMTEIWSY | |
| SIRNGTYSY | | SIRNGTYSY | | STKEWSRRYE | | TRDAMTEVWSY | |
| SIRNNSYDH | | SIRNNSYDH | | STKQVDTIME | | TRDSITEVWSY | |
| SIRNNTYDH | | SIRNNTYDH | | STKSTVLKSD | | TRDSLTEIWSY | |
| SIRNNTYNH | | SIRNNTYNH | | STLGLDIRTA | | TRDSMTEIWSY | |
| SIRNSTYDH | | SIRNSTYDH | | STLKLATGMR | | TRDSMTEVWSY | |
| SIRTGTYDH | | SIRTGTYDH | | STLPRRSGAA | | TRDSVTELWSY | |
| SIRWETTGR | | SIRWETTGR | | STLVLLVSLG | | TREGKHIVERI | |
| SIRWLTLKS | | SIRWLTLKS | | STMLNLYERV | | TREGRRKTNLY | |
| SISCFLLAA | | SISCFLLAA | | STMSCDSPSN | | TREILTKITVD | |
| SISCFLLIA | | SISCFLLIA | | STNAHDRICI | | TREILTKTTVD | |
| SISCFLLVA | | SISCFLLVA | | STNAYDRICI | | TREILTRTTVD | |
| SISCLYKLS | | SISCLYKLS | | STNSSDKVDT | | TRELCTINSWH | |
| SISECRTFF | | SISECRTFF | | STNSSEKVDT | | TREPYVSCDPD | |
| SISFCGVDS | | SISFCGVDS | | STNSSEKVNT | | TREPYVSCDPI | |
| SISFCGVNG | | SISFCGVNG | | STNSSERVDT | | TREPYVSCDPK | |
| SISFCGVNS | | SISFCGVNS | | STNSTEKVDT | | TREPYVSCDPL | |
| SISFCGVSS | | SISFCGVSS | | STNTVNTLIE | | TREPYVSCDPN | |
| SISIGSSTY | | SISIGSSTY | | STPLGSPPIV | | TREPYVSCDPS | |
| SISNDKPFQ | | SISNDKPFQ | | STPLGSPPMV | | TREPYVSCDPT | |
| SISSRNGFE | | SISSRNGFE | | STPLGSPPVV | | TREPYVSCEPD | |
| SISSRSGFE | | SISSRSGFE | | STPLGTPPTV | | TREWSYLIEDP | |
| SISVESSTY | | SISVESSTY | | STPSAIDQIT | | TRFLPVAGGTG | |
| SISVGSSTY | | SISVGSSTY | | STQAAIDQIN | | TRFLPVAGGTS | |
| SITDIWTYQ | | SITDIWTYQ | | STQAAIDQIT | | TRFLPVSGGTS | |
| SITEVWSYN | | SITEVWSYN | | STQAAIDQMT | | TRFLPVTGGTS | |
| SITFSHNGG | | SITFSHNGG | | STQAAVDQIT | | TRFLPVVGGTS | |
| SITIGKCPK | | SITIGKCPK | | STQEAIDKIT | | TRGAYERMCNI | |
| SITQTLVSN | | SITQTLVSN | | STQEAIEKIT | | TRGIFGAIAGF | |
| SITYIWTYQ | | SITYIWTYQ | | STQEAIGKIT | | TRGILTKTTVD | |
| SIVAFCGTS | | SIVAFCGTS | | STQEAINKIT | | TRGIQIASNEN | |
| SIVALCGSK | | SIVALCGSK | | STQEKNALYG | | TRGLCTINSWH | |
| SIVALCGSR | | SIVALCGSR | | STQEKNDLYG | | TRGLFGAIAGF | |
| SIVASSGTL | | SIVASSGTL | | STQKAIDEIT | | TRGVQIASNEN | |
| SIVASSGTV | | SIVASSGTV | | STQKAIDGIT | | TRGVQVASNEN | |
| SIVLVGLIL | | SIVLVGLIL | | STQKAIDGVT | | TRIAYERMCNI | |

Fig. 83-357

| Block size 8 | SIN | Block size 9 | SIN | Block size 10 | SIN | Block size 11 | SIN |
|---|---|---|---|---|---|---|---|
| SIVMCGVDH | | SIVMCGVDH | | STQKAIDIMQ | | TRIGDGQRSWM | |
| SIVMCGVDY | | SIVMCGVDY | | STQKAIDNMQ | | TRKEPALIVWG | |
| SIVMCGVEH | | SIVMCGVEH | | STQKAIDQIT | | TRKLNRLIEKT | |
| SIVMCGVNY | | SIVMCGVNY | | STQKAIDRIT | | TRKQLRENAED | |
| SIVMVGLIL | | SIVMVGLIL | | STQKAINEIT | | TRLFTIRQELA | |
| SIVPNIGSR | | SIVPNIGSR | | STQKAINGIT | | TRLFTIRQEMA | |
| SIVPSGPLK | | SIVPSGPLK | | STQKAINGVT | | TRLPFQNLSPR | |
| SIVRRATVS | | SIVRRATVS | | STQKALNEIT | | TRLYIWGVHHP | |
| SIVSMCSST | | SIVSMCSST | | STQKAVDGIT | | TRLYVNKNPYT | |
| SIVSWSQNI | | SIVSWSQNI | | STQKTIDQVT | | TRPGYNGQKSW | |
| SIVTFCGLD | | SIVTFCGLD | | STQMAIDNMQ | | TRPILSPLTKG | |
| SIVTFCGLN | | SIVTFCGLN | | STQPTFSVQR | | TRQASPSCLVV | |
| SIVVFCGTP | | SIVVFCGTP | | STQRAIDGIT | | TRQVCIAWSSS | |
| SIVVFCGTS | | SIVVFCGTS | | STQRAIDGVT | | TRQVCMAWSSS | |
| SIWFSHYNQ | | SIWFSHYNQ | | STQRAIDNMQ | | TRQVCVAWSSS | |
| SIWMCSNGS | | SIWMCSNGS | | STQSAIDQIT | | TRREIHIYYLE | |
| SIWTSSSST | | SIWTSSSST | | STQSAIDQVT | | TRREVHIYYLE | |
| SIYASPQLE | | SIYASPQLE | | STQSAINQIT | | TRREVHMYYLE | |
| SIYIEVLHL | | SIYIEVLHL | | STQSAVDQIT | | TRREVHTYYLE | |
| SIYQNSFVP | | SIYQNSFVP | | STQSAVNQIT | | TRREVHVYYLE | |
| SIYSCIASS | | SIYSCIASS | | STRGIQIASN | | TRRIDFHWLLL | |
| SIYSCVASS | | SIYSCVASS | | STRGVQIASN | | TRRQKRGLFGA | |
| SIYSSVASS | | SIYSSVASS | | STRGVQASN | | TRRQLRENAED | |
| SIYSTAASS | | SIYSTAASS | | STRSDQISIV | | TRSAYERMCNI | |
| SIYSTVAAS | | SIYSTVAAS | | STSCFDGKEW | | TRSDQISIVPN | |
| SIYSTVASS | | SIYSTVASS | | STSCHDGIGR | | TRSGQNHGICA | |
| SIYSTVSSS | | SIYSTVSSS | | STSCHDGISR | | TRSGTSKACNA | |
| SIYSTVTSS | | SIYSTVTSS | | STSCHDGKAR | | TRSGYEMLKVP | |
| SIYSTVVSS | | SIYSTVVSS | | STSCHDGKFR | | TRTAYERMCNI | |
| SIYWTIVKP | | SIYWTIVKP | | STSCHDGKSR | | TRTTVDHMAII | |
| SIYWTLVNP | | SIYWTLVNP | | STSCHDGKTR | | TRVAYERMCNI | |
| SIYWTVVKP | | SIYWTVVKP | | STSCHDGMSR | | TRVDKLTQGRQ | |
| SKACNALTG | | SKACNALTG | | STSCHDGRAR | | TRVDRLTQGRQ | |
| SKACNASTG | | SKACNASTG | | STSCHDGRSR | | TRVKRQLRENA | |
| SKACNDISN | | SKACNDISN | | STSCHDGVGR | | TRVWWTSNSIA | |
| SKACNDTSN | | SKACNDTSN | | STSCHDGVSR | | TRVWWTSNSIV | |
| SKACNNTSN | | SKACNNTSN | | STTAKAMEQM | | TRWMKIIRVGC | |
| SKACNSISN | | SKACNSISN | | STTAKAMEQV | | TRYVCSKFHSD | |
| SKACSASTG | | SKACSASTG | | STTCHDGIGR | | TSACKRTVSSF | |
| SKADKICIG | | SKADKICIG | | STTFPYTGDP | | TSARQEKNPAL | |
| SKANQVFPQ | | SKANQVFPQ | | STTGMTLSVV | | TSASSISFCGV | |
| SKCFWKGGS | | SKCFWKGGS | | STTHDRTAFR | | TSCFDGKEWMH | |
| SKCFWKGGT | | SKCFWKGGT | | STVAASLCLA | | TSCHDGIGRMT | |
| SKCFWRGGS | | SKCFWRGGS | | STVASSLALA | | TSCHDGISRMS | |
| SKCHTDKGS | | SKCHTDKGS | | STVASSLTLA | | TSCHDGKARMS | |
| SKCHTDRGS | | SKCHTDRGS | | STVASSLVLA | | TSCHDGKFRMS | |
| SKCHTEKGS | | SKCHTEKGS | | STVFCGVSGE | | TSCHDGKSRMS | |
| SKCHTNRGS | | SKCHTNRGS | | STVFCGVSSE | | TSCHDGKTRMS | |
| SKCKTKEGR | | SKCKTKEGR | | STVLGVSILN | | TSCHDGMSRMS | |
| SKCQQSFTP | | SKCQQSFTP | | STVLGVSVLN | | TSCHDGRARMS | |
| SKCRTKEGR | | SKCRTKEGR | | STVLKSDKRI | | TSCHDGRSRMS | |
| SKCRTREGR | | SKCRTREGR | | STVLVGLILA | | TSCHDGVGRMT | |
| SKCYNPCFY | | SKCYNPCFY | | STVMVGLILA | | TSCHDGVSRMS | |
| SKCYQFALG | | SKCYQFALG | | STVNEEALRQ | | TSFFYRYGFVA | |
| SKDLRSGYE | | SKDLRSGYE | | STVQVDTIME | | TSGEQMLIIWG | |
| SKDNAIRIG | | SKDNAIRIG | | STVSCDSPSN | | TSGEQMLVIWG | |
| SKDNGIRIG | | SKDNGIRIG | | STVSSFERFE | | TSGKQMLIIWG | |
| SKDNGIRVG | | SKDNGIRVG | | STVSSGLVLV | | TSGNLIAPEYG | |
| SKDNNIRIG | | SKDNNIRIG | | STVSSSLVLA | | TSGRQEKNPAL | |
| SKDNQVFPQ | | SKDNQVFPQ | | STVSSSLVLV | | TSGRQEKNPSL | |
| SKDNSIQLS | | SKDNSIQLS | | STVVNNITTT | | TSGSIISFCGV | |
| SKDNSIRIG | | SKDNSIRIG | | STVVSSLALA | | TSGSSIAFCGV | |

Fig. 83-358

| Block size 8 | SIN | Block size 9 | SIN | Block size 10 | SIN | Block size 11 | SIN |
|---|---|---|---|---|---|---|---|
| SKDNSIRLA | | SKDNSIRLA | | STWLGRTISP | | TSGSSISFCGV | |
| SKDNSIRLS | | SKDNSIRLS | | STYHNSFVPV | | TSGTYGAGSWP | |
| SKDNSVRIG | | SKDNSVRIG | | STYKILSIYS | | TSGTYGKGSWP | |
| SKDNSVRLS | | SKDNSVRLS | | STYQNNFVPV | | TSGTYGSGSWP | |
| SKDSRSGYE | | SKDSRSGYE | | STYQNSFVPV | | TSGTYGTGSWP | |
| SKDTRSGYE | | SKDTRSGYE | | SVAGWLLGNP | | TSGTYGTGTWP | |
| SKEAQDVIM | | SKEAQDVIM | | SVAHKSCLPA | | TSHRTLLMNEL | |
| SKEGSYFFG | | SKEGSYFFG | | SVAPIMFSNK | | TSISCLYKLSQ | |
| SKEQGSGYA | | SKEQGSGYA | | SVASSLVLLF | | TSIWTSSSSTV | |
| SKEQLGSWS | | SKEQLGSWS | | SVASSLVLLL | | TSKACNALTGG | |
| SKERLGSWS | | SKERLGSWS | | SVAWSASACH | | TSKACNASTGA | |
| SKFESVAWS | | SKFESVAWS | | SVAWSATACH | | TSKACNASTGG | |
| SKFHSDTPR | | SKFHSDTPR | | SVAWSATACS | | TSKACSASTGG | |
| SKFLLMDAL | | SKFLLMDAL | | SVCISGPNNN | | TSKHYIGKCPK | |
| SKFLLMDSL | | SKFLLMDSL | | SVCMSGPNNN | | TSKHYIGKCPR | |
| SKGDIFVIR | | SKGDIFVIR | | SVCYNPCFYV | | TSKIKMKWGME | |
| SKGDIFVMR | | SKGDIFVMR | | SVDLVETNHT | | TSKPFQNICKP | |
| SKGDVFVIR | | SKGDVFVIR | | SVECVCRDNW | | TSKPFQNTSKH | |
| SKGDVFVMR | | SKGDVFVMR | | SVEGWVVIAK | | TSKPFQNTSRH | |
| SKGHVFVIR | | SKGHVFVIR | | SVENLEELRF | | TSKPLQNTSKH | |
| SKGLFGAIA | | SKGLFGAIA | | SVENQEELRS | | TSKVKMKWGME | |
| SKGSSKQQH | | SKGSSKQQH | | SVEPKGLFGA | | TSLCSIWFSHY | |
| SKHYIGKCP | | SKHYIGKCP | | SVEPRGLFGA | | TSLLLATGMRN | |
| SKIKMKWGM | | SKIKMKWGM | | SVESSTYQNN | | TSLTSLPFQNI | |
| SKILTDTSR | | SKILTDTSR | | SVEYASKTRI | | TSMPFHNIHPL | |
| SKINEVKLE | | SKINEVKLE | | SVFNCLYASP | | TSNSIAVFCGT | |
| SKINGVILE | | SKINGVILE | | SVFNSIYASP | | TSNSIIAFCGT | |
| SKINGVKLE | | SKINGVKLE | | SVFNSLYASP | | TSNSIIVFCGT | |
| SKINGVRLE | | SKINGVRLE | | SVFNSLYASS | | TSNSIVAFCGT | |
| SKINRQEIE | | SKINRQEIE | | SVFNSLYSSP | | TSNSIVALCGS | |
| SKITLKFAF | | SKITLKFAF | | SVGGIDTNKT | | TSNSIVSMCSS | |
| SKKKSYINK | | SKKKSYINK | | SVGGINTNKT | | TSNSIVTFCGL | |
| SKKKSYINR | | SKKKSYINR | | SVGGINTNRT | | TSNSIVVFCAT | |
| SKKRLGSWS | | SKKRLGSWS | | SVGKEFSNLE | | TSNSIVVFCGA | |
| SKLKRNEIK | | SKLKRNEIK | | SVGSGSFPDG | | TSNSIVVFCGT | |
| SKLKRQEID | | SKLKRQEID | | SVGSSIYQNS | | TSNSIVVFCST | |
| SKLKRQEIE | | SKLKRQEIE | | SVGSSTYQNN | | TSNSLIALCGS | |
| SKLKRQEIN | | SKLKRQEIN | | SVGSSTYQNS | | TSNSLVALCGS | |
| SKLNRNEIK | | SKLNRNEIK | | SVGSWSQNIL | | TSNSMVTFCGL | |
| SKLNRQEIE | | SKLNRQEIE | | SVGTSTLNLR | | TSNSVVVFCGT | |
| SKLNRQEIG | | SKLNRQEIG | | SVGTSTLNQK | | TSPCLTDKGSI | |
| SKLNRSEIK | | SKLNRSEIK | | SVGTSTLNQR | | TSQKGILEDEQ | |
| SKLNRTEIK | | SKLNRTEIK | | SVGWSATACH | | TSQRGILEDEQ | |
| SKLPFQNIN | | SKLPFQNIN | | SVHRNTIGDC | | TSQRGVLEDEQ | |
| SKMGVDEYS | | SKMGVDEYS | | SVIEKMNIQF | | TSQYICSPVLT | |
| SKMQFSSLT | | SKMQFSSLT | | SVIEKMNTQF | | TSQYLCTGILT | |
| SKNILRTQE | | SKNILRTQE | | SVIPSGPLKA | | TSQYLCTGVLT | |
| SKNPYTLVS | | SKNPYTLVS | | SVIREPFISC | | TSRHYIGKCPK | |
| SKNSRSGYE | | SKNSRSGYE | | SVKLSSGYKD | | TSRYVCTGILT | |
| SKPFQNASR | | SKPFQNASR | | SVKMEKIVLL | | TSSGTSKACNA | |
| SKPFQNICK | | SKPFQNICK | | SVKNGTYDYP | | TSSGTSKACSA | |
| SKPFQNTSK | | SKPFQNTSK | | SVKNGTYNYP | | TSSIDLVETNH | |
| SKPFQNTSR | | SKPFQNTSR | | SVKTLTDNHV | | TSSIYIEVLHL | |
| SKPLQNASR | | SKPLQNASR | | SVLINTYQWI | | TSSMYIEVLHL | |
| SKPLQNTSK | | SKPLQNTSK | | SVLNLLIGIS | | TSSSIVVFCGT | |
| SKPQCHITG | | SKPQCHITG | | SVLNLLIGVS | | TSSSSIVMCGV | |
| SKPQCKITG | | SKPQCKITG | | SVLVNTYQWI | | TSSSSTVFCGV | |
| SKPQCLITG | | SKPQCLITG | | SVLVNTYQWV | | TSSSSVVMCGV | |
| SKPQCQIAG | | SKPQCQIAG | | SVNTNTINRS | | TSSVDLVETNH | |
| SKPQCQIIG | | SKPQCQIIG | | SVNTVLSIIA | | TSSVYIEVLHL | |
| SKPQCQIRG | | SKPQCQIRG | | SVPASRYLID | | TSSVYVEVLHL | |
| SKPQCQISG | | SKPQCQISG | | SVPASRYLTD | | TSTQKAINEIT | |

Fig. 83-359

| Block size 8 | SIN | Block size 9 | SIN | Block size 10 | SIN | Block size 11 | SIN |
|---|---|---|---|---|---|---|---|
| SKPQCQITG | | SKPQCQITG | | SVPLGSSPNA | | TSVGGIDTNKT | |
| SKRGGSGIM | | SKRGGSGIM | | SVPLGSSSNA | | TSVGGINTNKT | |
| SKRGNSGIM | | SKRGNSGIM | | SVPMGSSPNA | | TSVGGINTNRT | |
| SKRGSSGIM | | SKRGSSGIM | | SVQPAFSVQR | | TSVKTLTDNHV | |
| SKRGSSGIV | | SKRGSSGIV | | SVQPTFSVQR | | TSVTTNTINRN | |
| SKRGSSGVM | | SKRGSSGVM | | SVQRNLPFDK | | TSWSWPDGALL | |
| SKRYELEIG | | SKRYELEIG | | SVQRNLPFEK | | TSWSYIVEKPN | |
| SKSDKICIG | | SKSDKICIG | | SVQRNLPFER | | TSWSYIVEKSN | |
| SKSDRICIG | | SKSDRICIG | | SVQRSLPFER | | TSWSYIVEKTN | |
| SKSLCKVEG | | SKSLCKVEG | | SVQSRGLFGA | | TSWSYIVERPN | |
| SKSRGYKMN | | SKSRGYKMN | | SVRGSGMRIL | | TSYKILSIYST | |
| SKSRSIIFN | | SKSRSIIFN | | SVRIGSKGDV | | TSYRSLIRFPI | |
| SKSRSNIFN | | SKSRSNIFN | | SVRLSAGGDI | | TSYWWDGLQSS | |
| SKSRVDNHS | | SKSRVDNHS | | SVRLSASGDI | | TTAKAMEQMAG | |
| SKSTKSTVL | | SKSTKSTVL | | SVRNGTYDYP | | TTAKAMEQVAG | |
| SKTGVDEYS | | SKTGVDEYS | | SVSECRTFFL | | TTAVAVLKYNG | |
| SKTLTDTSR | | SKTLTDTSR | | SVSSFEKFEI | | TTCHDGIGRMT | |
| SKTNQQFEL | | SKTNQQFEL | | SVSSFERFEI | | TTCHDGVGRMT | |
| SKTQCQITG | | SKTQCQITG | | SVSSFERFEM | | TTCWSWPDGAL | |
| SKVGVDEYS | | SKVGVDEYS | | SVSSFKRFEI | | TTDWSGYSGSF | |
| SKVKMKWGM | | SKVKMKWGM | | SVTDGPAANS | | TTEINTWARNI | |
| SKVLTDTSR | | SKVLTDTSR | | SVTELWSYNA | | TTEVSHCRATE | |
| SKVTCICRD | | SKVTCICRD | | SVTQTLVSNN | | TTFPYTGDPPY | |
| SKVTCVCRD | | SKVTCVCRD | | SVTTNTINRI | | TTGKSHGRILK | |
| SKWGDILEG | | SKWGDILEG | | SVTTNTINRN | | TTGNPIICLGH | |
| SKWGDVLDG | | SKWGDVLDG | | SVTTNTINRS | | TTGRDVLVIWG | |
| SKWGNVLDG | | SKWGNVLDG | | SVVEKMNTQF | | TTGRDVLVLWG | |
| SKWNVTYTG | | SKWNVTYTG | | SVVLVGLILA | | TTGRDVLVMWG | |
| SKYEEESKL | | SKYEEESKL | | SVVSCDSPSN | | TTGRNCTIPCF | |
| SKYHWNLAL | | SKYHWNLAL | | SVVVFCGTSG | | TTGRNCTVPCF | |
| SKYQQSFSP | | SKYQQSFSP | | SVYIEVLHLT | | TTGWSWPDGAL | |
| SKYQQSFTP | | SKYQQSFTP | | SVYKALSIYS | | TTHDRTAFRGL | |
| SKYRQSFSP | | SKYRQSFSP | | SVYSTVASSL | | TTHSWIPKRNR | |
| SKYWAIRTR | | SKYWAIRTR | | SVYVEVLHLT | | TTHSWTPKRNR | |
| SLAIMIAGI | | SLAIMIAGI | | SVYWTIVKPG | | TTHSWVPILNT | |
| SLAIMMAGI | | SLAIMMAGI | | SVYWTVVKPG | | TTHSWVPKRNR | |
| SLAIMVAGI | | SLAIMVAGI | | SWAGNILRTQ | | TTIGLLLQIIS | |
| SLAVNVRGS | | SLAVNVRGS | | SWAGNVLRTQ | | TTIGLLLQITS | |
| SLCEVNSWH | | SLCEVNSWH | | SWASNSIVTF | | TTIKPWARNIL | |
| SLCKIEGWV | | SLCKIEGWV | | SWAVGRCPRY | | TTIKTWAGKIL | |
| SLCKVEEWV | | SLCKVEEWV | | SWDDGAILPF | | TTIKTWAGNIL | |
| SLCKVEGWV | | SLCKVEGWV | | SWDDGAILPL | | TTIKTWAKNIL | |
| SLCLAILIA | | SLCLAILIA | | SWEGNILRTQ | | TTIKTWARNIL | |
| SLCLAILVA | | SLCLAILVA | | SWEMGLAPSP | | TTINNITNVVL | |
| SLCLAVLIA | | SLCLAVLIA | | SWEMGQAPSP | | TTIRGKHSNGT | |
| SLCMCSNGS | | SLCMCSNGS | | SWGMGQAPSP | | TTIRGRHSNGT | |
| SLCNVEGWV | | SLCNVEGWV | | SWHDGAEIIY | | TTIRNKHSNGT | |
| SLCSIWFSH | | SLCSIWFSH | | SWHDGAEITY | | TTIRNKHSNST | |
| SLCSVEGWV | | SLCSVEGWV | | SWHDGAILPF | | TTIRNRHSNGT | |
| SLCYPGNFN | | SLCYPGNFN | | SWHDGAILPL | | TTIRTWAKNIL | |
| SLCYPGSFN | | SLCYPGSFN | | SWHDGAVLPF | | TTIWTSGSSIS | |
| SLCYPGSLN | | SLCYPGSLN | | SWHIFGKDNA | | TTKINNIIDKM | |
| SLDEQNKLY | | SLDEQNKLY | | SWHIFSKDNA | | TTKINNIIEKM | |
| SLDKICLGH | | SLDKICLGH | | SWHILSKDNA | | TTLDNEHSNGT | |
| SLEFIAEQF | | SLEFIAEQF | | SWHIYGKDNA | | TTLDNKHSNDT | |
| SLEGIILGN | | SLEGIILGN | | SWIPKRNRSI | | TTLDNKHSNGT | |
| SLEGLILGN | | SLEGLILGN | | SWKGNIMRTQ | | TTLENKHSNGT | |
| SLEGLILSN | | SLEGLILSN | | SWKKQILRTQ | | TTLIENTYVNK | |
| SLEGLVLGN | | SLEGLVLGN | | SWLGRTISKD | | TTLIENTYVNN | |
| SLEPGTFDL | | SLEPGTFDL | | SWLGRTTSKD | | TTLKGRHANGT | |
| SLERRLENL | | SLERRLENL | | SWLIIGISGP | | TTLNNKHSNGT | |
| SLESRRGFE | | SLESRRGFE | | SWLTIGISGP | | TTLPFHNIHPL | |

Fig. 83-360

| Block size 8 | SIN | Block size 9 | SIN | Block size 10 | SIN | Block size 11 | SIN |
|---|---|---|---|---|---|---|---|
| SLESRSGFE | | SLESRSGFE | | SWLTIGVSGP | | TTLPFHNVHPL | |
| SLFEKFFPS | | SLFEKFFPS | | SWMKIYWHLM | | TTLRGQHANGT | |
| SLFSSIKKY | | SLFSSIKKY | | SWMKLYWHLM | | TTLRGRHANGT | |
| SLFSSIKRY | | SLFSSIKRY | | SWPDDAELPF | | TTLSTIALFIG | |
| SLGAISFWM | | SLGAISFWM | | SWPDGADINF | | TTLSTIALIIG | |
| SLGASCFLL | | SLGASCFLL | | SWPDGADLPF | | TTLSTIALLIG | |
| SLGAVSFWM | | SLGAVSFWM | | SWPDGAELPF | | TTLYKNANTLS | |
| SLGDCSFAG | | SLGDCSFAG | | SWPDGAELPS | | TTLYKNANTLT | |
| SLGGCSFAG | | SLGGCSFAG | | SWPDGAEVPF | | TTLYNKHSNGT | |
| SLGIQSDAQ | | SLGIQSDAQ | | SWPDGAKLPF | | TTNPLIKHENR | |
| SLIALCGSP | | SLIALCGSP | | SWPDGALFPL | | TTNPLIRHENR | |
| SLIASSGTL | | SLIASSGTL | | SWPDGALLPF | | TTNSIVVFCGT | |
| SLIIAARNI | | SLIIAARNI | | SWPDGALLPL | | TTNTINRIFQP | |
| SLIIAARSI | | SLIIAARSI | | SWPDGANIDF | | TTNTINRNFQP | |
| SLILAAIIM | | SLILAAIIM | | SWPDGANINF | | TTNTINRSFQP | |
| SLILAALIM | | SLILAALIM | | SWPDGANINL | | TTNTINRSFRP | |
| SLIMRTVIA | | SLIMRTVIA | | SWPDGANISF | | TTNYYNETFVN | |
| SLIQFPIGT | | SLIQFPIGT | | SWPDRAELPF | | TTPTKSYFANL | |
| SLIQFPMGT | | SLIQFPMGT | | SWPLSSPPTV | | TTRGVQIASNE | |
| SLIRFPIGT | | SLIRFPIGT | | SWPQSSPPTV | | TTRQASPSCLV | |
| SLIRFPIGV | | SLIRFPIGV | | SWQDGAILPF | | TTSKDSRSGYE | |
| SLIRFPVGT | | SLIRFPVGT | | SWRKDILRTQ | | TTSWSWPDGAL | |
| SLIRPKENP | | SLIRPKENP | | SWRKKILRTQ | | TTTIKPWARNI | |
| SLIRPNENP | | SLIRPNENP | | SWRKQILRTQ | | TTTIKTWAGKI | |
| SLIRSNENP | | SLIRSNENP | | SWRRDILRTQ | | TTTIKTWAGNI | |
| SLISWPLSS | | SLISWPLSS | | SWRRQILRTQ | | TTTIKTWAKNI | |
| SLIWLWLVL | | SLIWLWLVL | | SWSHNILRTQ | | TTTIKTWARNI | |
| SLKGLILGN | | SLKGLILGN | | SWSKNILRTQ | | TTTIRTWAKNI | |
| SLKLAIGLR | | SLKLAIGLR | | SWSLNILRTQ | | TTTNPLIRHEN | |
| SLKLAIGPR | | SLKLAIGPR | | SWSLQCRICI | | TTTPTKSYFAN | |
| SLKLASGLR | | SLKLASGLR | | SWSQNILRTQ | | TTTTIINNNTQ | |
| SLKLATGLR | | SLKLATGLR | | SWSWHDGAEI | | TTTVKTWAGNI | |
| SLKLATGMR | | SLKLATGMR | | SWSWHDGAIL | | TTVDHMAIIKK | |
| SLKLATGPR | | SLKLATGPR | | SWSWHDGAVL | | TTVDHMAIIKR | |
| SLKLAVGLK | | SLKLAVGLK | | SWSWPDGALL | | TTVGLLLQIIS | |
| SLKLAVGLR | | SLKLAVGLR | | SWSYIVEKLN | | TTVGLLLQITS | |
| SLKLAVGMR | | SLKLAVGMR | | SWSYIVEKPN | | TTVGLLLQVTS | |
| SLKLAVGPR | | SLKLAVGPR | | SWSYIVEKSN | | TTVGWSWPDGA | |
| SLKLSIEDP | | SLKLSIEDP | | SWSYIVEKTN | | TTVKTWAGNIL | |
| SLKLVTGLR | | SLKLVTGLR | | SWSYIVERPS | | TTVNEEALRQK | |
| SLLEMCHST | | SLLEMCHST | | SWTPKRNRSI | | TTVVENTYVNN | |
| SLLGDPHCD | | SLLGDPHCD | | SWTSNSIITF | | TTWDVFIERPT | |
| SLLHKCNDS | | SLLHKCNDS | | SWTSNSIVTF | | TTYKILSIYST | |
| SLLLATGMK | | SLLLATGMK | | SWTSNSMVTF | | TTYQRTRALVR | |
| SLLLATGMR | | SLLLATGMR | | SWVPILNTSQ | | TTYRILSIYST | |
| SLLLLQANL | | SLLLLQANL | | SWVPKRNRSI | | TTYWWDGLQSS | |
| SLLLQANLC | | SLLLQANLC | | SYCRATEYIM | | TVAASLCLAIL | |
| SLLNDKHSN | | SLLNDKHSN | | SYFANLKGTR | | TVAASLCLAVL | |
| SLLNDKHSS | | SLLNDKHSS | | SYFFGDNAED | | TVAGSLSLAIM | |
| SLLNDRHSN | | SLLNDRHSN | | SYFFGDNAEE | | TVDHMAIIKKY | |
| SLLNRLSIN | | SLLNRLSIN | | SYFFGDNAKE | | TVDHMAIIKRY | |
| SLLQSAILS | | SLLQSAILS | | SYFFGDSAEE | | TVDTILEKNVT | |
| SLLRDNAKD | | SLLRDNAKD | | SYFQLFLVCV | | TVDTILERNVT | |
| SLLTEVETH | | SLLTEVETH | | SYGRIIQNED | | TVDTLLEKNVT | |
| SLLTEVETL | | SLLTEVETL | | SYICSGLVGD | | TVDTLTENGVP | |
| SLLTEVETP | | SLLTEVETP | | SYIIRALTLN | | TVDTVLEKNVT | |
| SLLTEVETY | | SLLTEVETY | | SYINKTGTFE | | TVDTVLERNVT | |
| SLMLATGMK | | SLMLATGMK | | SYINRTGTFE | | TVDTVREKNVT | |
| SLMLATGMR | | SLMLATGMR | | SYIVERPKEI | | TVEITGIDKVC | |
| SLMQGSTLP | | SLMQGSTLP | | SYIVERPKEM | | TVEITGINKVC | |
| SLMRPNENP | | SLMRPNENP | | SYIVERPSAP | | TVERMVLSAFD | |
| SLMWEINGP | | SLMWEINGP | | SYIVERTKEM | | TVFCGVSGEVP | |

Fig. 83-361

| Block size 8 | SIN | Block size 9 | SIN | Block size 10 | SIN | Block size 11 | SIN |
|---|---|---|---|---|---|---|---|
| SLNDYEELK | | SLNDYEELK | | SYKILSIYST | | TVFCGVSSEVP | |
| SLNGISPIH | | SLNGISPIH | | SYKRIRLFDY | | TVGKCPRYIKQ | |
| SLNGISPVH | | SLNGISPVH | | SYKRVRLFDY | | TVGKCPRYVKQ | |
| SLNGVSPIH | | SLNGVSPIH | | SYKVGYLCAG | | TVGLLLQIISL | |
| SLNGVSPVH | | SLNGVSPVH | | SYLCSGLVGD | | TVGLLLQITSL | |
| SLNISLYSK | | SLNISLYSK | | SYLECRTFFL | | TVGLLLQVTSL | |
| SLNITAASL | | SLNITAASL | | SYLIEDPAAP | | TVGQCPKYVNK | |
| SLNKKMEDG | | SLNKKMEDG | | SYLIEDPGAP | | TVGQCPKYVNQ | |
| SLNKRMEDG | | SLNKRMEDG | | SYLIEDPNAP | | TVGQCPKYVSK | |
| SLNNKVDDG | | SLNNKVDDG | | SYLIEDPSAP | | TVGQCPKYVSQ | |
| SLPDGAQIQ | | SLPDGAQIQ | | SYLIEDPTAP | | TVGRCPRYVKQ | |
| SLPDLYDYK | | SLPDLYDYK | | SYLIRALTLN | | TVGSSKYQQSF | |
| SLPFHNIHP | | SLPFHNIHP | | SYLIRTLTLN | | TVGSSKYRQSF | |
| SLPFHNVHP | | SLPFHNVHP | | SYLLLNKSLC | | TVHDRIPHRTL | |
| SLPFQNIHP | | SLPFQNIHP | | SYLNVRCVCR | | TVIKNNMINND | |
| SLPFQNIHS | | SLPFQNIHS | | SYMCSGLVGD | | TVIKNNMVNND | |
| SLPFQNINP | | SLPFQNINP | | SYNADLLVAM | | TVINNITTTII | |
| SLPFQNINS | | SLPFQNINS | | SYNADVLVAL | | TVINNITTTIT | |
| SLPFQNISP | | SLPFQNISP | | SYNAEFLVAL | | TVIRNNMINND | |
| SLPFQNVHP | | SLPFQNVHP | | SYNAEFLVAV | | TVKDRSPFRTL | |
| SLPLALGMK | | SLPLALGMK | | SYNAEILVAL | | TVKDRSPYRAL | |
| SLPLCPFKG | | SLPLCPFKG | | SYNAELLIAM | | TVKDRSPYRTL | |
| SLPLCPFQG | | SLPLCPFQG | | SYNAELLVAI | | TVKIKTNGNLI | |
| SLPLCPFRG | | SLPLCPFRG | | SYNAELLVAL | | TVKIQTNGNLI | |
| SLPNDKHSN | | SLPNDKHSN | | SYNAELLVAM | | TVKIQTSGNLI | |
| SLQNRIQID | | SLQNRIQID | | SYNAGLLVAL | | TVKQDGKSSAC | |
| SLQQIESII | | SLQQIESII | | SYNAKLLVLI | | TVKQNGKSGAC | |
| SLQQIESMI | | SLQQIESMI | | SYNAKLLVLL | | TVKQNGKSSAC | |
| SLQQIESMV | | SLQQIESMV | | SYNAQLLVLL | | TVKTWAGNILR | |
| SLRGRGSTL | | SLRGRGSTL | | SYNAQLLVWL | | TVLEKNVTVTH | |
| SLRLAIGLR | | SLRLAIGLR | | SYNARLLVLL | | TVLERNVTVTH | |
| SLRLALGLR | | SLRLALGLR | | SYNNTNGEQI | | TVLGVSILNLG | |
| SLRLATGLR | | SLRLATGLR | | SYNNTSGEQI | | TVLGVSVLNLG | |
| SLRLAVGLR | | SLRLAVGLR | | SYNNTSGEQM | | TVLKSDKRIGS | |
| SLRMKWMMA | | SLRMKWMMA | | SYNNTSGEQV | | TVLVGLILAFI | |
| SLRSILANN | | SLRSILANN | | SYNNTSGKQM | | TVMVGLILAFI | |
| SLRSILASS | | SLRSILASS | | SYPNVRCVCR | | TVNEEALRQKI | |
| SLRSIVASS | | SLRSIVASS | | SYQVGYLCAG | | TVNEGALRQKI | |
| SLRSLIASS | | SLRSLIASS | | SYRRPIGISS | | TVNRTHQYSEK | |
| SLRSLVASS | | SLRSLVASS | | SYRRPVGISS | | TVNRTHQYSER | |
| SLSGSAQHI | | SLSGSAQHI | | SYRSLIRFPI | | TVNTLIEQNIP | |
| SLSISIGSS | | SLSISIGSS | | SYRTLLMNEL | | TVNTLIEQNVP | |
| SLSISVESS | | SLSISVESS | | SYRTLLMSEL | | TVNTLSEQNVP | |
| SLSISVGSS | | SLSISVGSS | | SYRVGYLCAG | | TVNTLTEQNVP | |
| SLSLAIMIA | | SLSLAIMIA | | SYSAGALASC | | TVNVRGSGLRI | |
| SLSLAIMMA | | SLSLAIMMA | | SYSTGALASC | | TVNVRGSGMRI | |
| SLSLAIMVA | | SLSLAIMVA | | SYSVGYLCAG | | TVNVRGSGMRV | |
| SLSPGMMMG | | SLSPGMMMG | | SYTVGYLCAG | | TVNVRGTGMRI | |
| SLSYSTGAL | | SLSYSTGAL | | SYVCSGLVGD | | TVPCFWVEMIR | |
| SLTEIWSYN | | SLTEIWSYN | | SYVRLYLWGV | | TVPSERGLQRR | |
| SLTHALREL | | SLTHALREL | | SYWMCSNGSL | | TVREKNVTVTH | |
| SLTSLPFQN | | SLTSLPFQN | | SYWWDGLQSS | | TVSLSPGMMMG | |
| SLTVNVRGS | | SLTVNVRGS | | TAADLKSTQA | | TVSRTHQYSEK | |
| SLTVNVRGT | | SLTVNVRGT | | TAADLKSTQT | | TVSSFERFEIF | |
| SLTVSVRGS | | SLTVSVRGS | | TAADYKSTPS | | TVSSFYSEMKW | |
| SLVALCGSP | | SLVALCGSP | | TAADYKSTQA | | TVSSGLVLVGL | |
| SLVASSGNL | | SLVASSGNL | | TAADYKSTQS | | TVSSSLVLAGL | |
| SLVASSGTL | | SLVASSGTL | | TAAQKAMMDQ | | TVSSSLVLVGL | |
| SLVGIDPFK | | SLVGIDPFK | | TAAQRAMMDQ | | TVSTRSDQISI | |
| SLVGVDPFK | | SLVGVDPFK | | TAAQRAMVDQ | | TVSVRGSGMRI | |
| SLVIAARNI | | SLVIAARNI | | TAASSLALAI | | TVTDGPAANSA | |
| | | | | TACFEIFHKC | | TVTFIFNGAFI | |

Fig. 83-362

| Block size 8 | SIN | Block size 9 | SIN | Block size 10 | SIN | Block size 11 | SIN |
|---|---|---|---|---|---|---|---|
| SLVKTTLFL | | SLVKTTLFL | | TACHDGKEWL | | TVTFNFNGAFI | |
| SLVLAAIIM | | SLVLAAIIM | | TACHDGKEWM | | TVTFSFNGAFI | |
| SLVLAALIM | | SLVLAALIM | | TACHDGKGWL | | TVTFTFNGAFI | |
| SLVLAASIM | | SLVLAASIM | | TACHDGKKWL | | TVTHAKDILEK | |
| SLVLIVSLG | | SLVLIVSLG | | TACHDGKKWM | | TVTHAKDILER | |
| SLVLLFMII | | SLVLLFMII | | TACHDGKKWT | | TVTHAKNILEK | |
| SLVLLLMII | | SLVLLLMII | | TACHDGNKWM | | TVTHAQDILEK | |
| SLVLLVSLG | | SLVLLVSLG | | TACHDGRKWM | | TVTHAQDILER | |
| SLVLVVSLG | | SLVLVVSLG | | TACSDGPGWL | | TVTHAQNILEK | |
| SLWDSFRQS | | SLWDSFRQS | | TACSDGSGWL | | TVTHSIELLEN | |
| SLWMCSNGS | | SLWMCSNGS | | TADKDSNGVQ | | TVTHSIELLES | |
| SLYASPQLE | | SLYASPQLE | | TAEISHCRAT | | TVTHSVELLED | |
| SLYASSQLE | | SLYASSQLE | | TAEVSHCRAT | | TVTHSVELLEN | |
| SLYDKVRMQ | | SLYDKVRMQ | | TAEVSYCRAT | | TVTHSVELLES | |
| SLYSSPQLE | | SLYSSPQLE | | TAFRGLISTP | | TVTLHFKQHDC | |
| SLYWTIVEP | | SLYWTIVEP | | TAFRGLMSTP | | TVTLHFKQHEC | |
| SMAPIMFSN | | SMAPIMFSN | | TAFSGMSANG | | TVTLHFKQHKC | |
| SMCSSTEFL | | SMCSSTEFL | | TAIDQINGKL | | TVTLHFKQNEC | |
| SMDSRSGYE | | SMDSRSGYE | | TAIDQITGKL | | TVTSSIELVEN | |
| SMEDYSIDS | | SMEDYSIDS | | TAKAMEQMAG | | TVTSSVELVEN | |
| SMEFSLTDP | | SMEFSLTDP | | TAKAMEQVAG | | TVTSSVELVET | |
| SMELPSFGV | | SMELPSFGV | | TAKHIEECSC | | TVVENKYVNNT | |
| SMFLYVRTN | | SMFLYVRTN | | TAKHIEECSS | | TVVENTYVNNT | |
| SMGEAMVSR | | SMGEAMVSR | | TALANTIEIF | | TVVLNTDWSGY | |
| SMGFRYSGI | | SMGFRYSGI | | TALANTIEVF | | TVVMTDGNASG | |
| SMGIYQILA | | SMGIYQILA | | TALLNASCAA | | TVVMTDGSASD | |
| SMGVYQILA | | SMGVYQILA | | TALSTIALLI | | TVVMTDGSASE | |
| SMIEAESSI | | SMIEAESSI | | TALYKNANTL | | TVVMTDGSASG | |
| SMIEAESSV | | SMIEAESSV | | TAMDDFQLIP | | TVVNNITTTII | |
| SMKWLTLKS | | SMKWLTLKS | | TAMLCLGHHA | | TVVNNITTTIV | |
| SMLKPGETL | | SMLKPGETL | | TAMLNASCAA | | TVWTSGSSISF | |
| SMMEAMVSR | | SMMEAMVSR | | TANSIIVFCG | | TVWTSSSSIVM | |
| SMMWEINGP | | SMMWEINGP | | TANTYRNTDS | | TVYWWDGLQSS | |
| SMMWEVNGP | | SMMWEVNGP | | TAPHGLCYPG | | TVYYDRRLTTT | |
| SMNNQVFPQ | | SMNNQVFPQ | | TAPILGNYKE | | TVYYERRLTTT | |
| SMPFHNIHP | | SMPFHNIHP | | TAPVLGNYKE | | TVYYNGRLTTT | |
| SMPFHNVHP | | SMPFHNVHP | | TAPVLGNYRE | | TVYYNKRLTTT | |
| SMPLHNIHP | | SMPLHNIHP | | TAQIIKLLPF | | TVYYNRRLTTT | |
| SMQCRICIG | | SMQCRICIG | | TAQMALQLFI | | TWAGKILRTQE | |
| SMREEYQQE | | SMREEYQQE | | TASLSPGMMM | | TWAGNILRTQE | |
| SMREEYREE | | SMREEYREE | | TASRAGYEML | | TWAKNILRTQE | |
| SMREEYRKE | | SMREEYRKE | | TASRSGYEML | | TWARNILRTQD | |
| SMREEYRQE | | SMREEYRQE | | TATKRIRLAI | | TWARNILRTQE | |
| SMREEYRQK | | SMREEYRQK | | TATKRIRMAI | | TWDVFIERPTA | |
| SMRWLTLKL | | SMRWLTLKL | | TATKRIRMAT | | TWLGRTFSPRS | |
| SMRWLTLKS | | SMRWLTLKS | | TATKRLRMAI | | TWLGRTISIAS | |
| SMSCFVFVA | | SMSCFVFVA | | TATLCLGHHA | | TWLGRTISPHS | |
| SMSDIEAMA | | SMSDIEAMA | | TATREGKHIV | | TWLGRTISPKL | |
| SMSGFRSNL | | SMSGFRSNL | | TATVYYDRRL | | TWLGRTISPRL | |
| SMTEIWSYN | | SMTEIWSYN | | TATVYYERRL | | TWLGRTISPRS | |
| SMTEVWSYN | | SMTEVWSYN | | TATVYYNGRL | | TWLGRTISTAS | |
| SMVEAESSV | | SMVEAESSV | | TATVYYNKRL | | TWLGRTLNTAS | |
| SMVEAMISR | | SMVEAMISR | | TATVYYNRRL | | TWLGRTTSTAS | |
| SMVEAMMSR | | SMVEAMMSR | | TATVYYNRRP | | TWNGVKVDGSS | |
| SMVEAMVSR | | SMVEAMVSR | | TAVAVIKYNG | | TWSQNILRTQE | |
| SMVKSDKIC | | SMVKSDKIC | | TAVAVLKYNG | | TYAGAINSSKP | |
| SMVRSDKIC | | SMVRSDKIC | | TAVDTCYPFD | | TYAGAINSSRP | |
| SMVTFCGLD | | SMVTFCGLD | | TAYELTDSSW | | TYAGAVNSSKP | |
| SNAASYKRI | | SNAASYKRI | | TAYERMCNIL | | TYCSLNGISPI | |
| SNAEGTGMA | | SNAEGTGMA | | TAYSQITNGT | | TYCSLNGISPV | |
| SNAIDEGDG | | SNAIDEGDG | | TAYWWDGLQS | | TYCSLNGVSPI | |
| SNAITRSGQ | | SNAITRSGQ | | TCAVVMTDGS | | TYCSLNGVSPV | |

Fig. 83-363

| Block size 8 | SIN | Block size 9 | SIN | Block size 10 | SIN | Block size 11 | SIN |
|---|---|---|---|---|---|---|---|
| SNALLKHRF | | SNALLKHRF | | TCEQIADAQH | | TYDHAQYREEA | |
| SNAPSGIEY | | SNAPSGIEY | | TCEQIADSHH | | TYDHKDYEEEA | |
| SNAPSGVEY | | SNAPSGVEY | | TCEQIADSQH | | TYDHKEFEEES | |
| SNAQAFYKI | | SNAQAFYKI | | TCGCRDNWQG | | TYDHKEFEKES | |
| SNCKDPNEE | | SNCKDPNEE | | TCHDGIGRMT | | TYDHKEFKEES | |
| SNCKDPNNE | | SNCKDPNNE | | TCHDGVGRMT | | TYDHKEYEEEA | |
| SNCRDPNDE | | SNCRDPNDE | | TCICRDNWQG | | TYDHNIYRDEA | |
| SNCRDPNEE | | SNCRDPNEE | | TCIESIRNGT | | TYDHSQYREEA | |
| SNCRDPNNE | | SNCRDPNNE | | TCIVAVTDGP | | TYDHTQYREEA | |
| SNCRDSNNE | | SNCRDSNNE | | TCKLLGINMS | | TYDWTLNRNQP | |
| SNCRNPNNE | | SNCRNPNNE | | TCKLVGINMS | | TYDYPKYEEES | |
| SNDDWSGYS | | SNDDWSGYS | | TCMETIRNGT | | TYDYPKYSEEA | |
| SNDKPFQNV | | SNDKPFQNV | | TCRDNWKGSN | | TYDYPKYSEES | |
| SNDNWSGYS | | SNDNWSGYS | | TCRDNWQGSN | | TYDYPKYSKES | |
| SNDQGAGYA | | SNDQGAGYA | | TCSALFVYSL | | TYDYSKYEEES | |
| SNDQGSGYA | | SNDQGSGYA | | TCSNGSCRCT | | TYGAGSWPDGA | |
| SNDTIHDRT | | SNDTIHDRT | | TCTCRDNWQG | | TYGSGSWPDGA | |
| SNDTINYYN | | SNDTINYYN | | TCTVIMTDGS | | TYGTGSWPDGA | |
| SNDVWLGRT | | SNDVWLGRT | | TCTVVMTDGN | | TYGTGSWPDGG | |
| SNEGSYFFG | | SNEGSYFFG | | TCTVVMTDGS | | TYGTGTWPDGA | |
| SNENLIAPW | | SNENLIAPW | | TCVCRDNWHG | | TYHNSFVPVVG | |
| SNENPAHKS | | SNENPAHKS | | TCVCRDNWKS | | TYISIGTSTLN | |
| SNEQGSGYA | | SNEQGSGYA | | TCVCRDNWQG | | TYISVGTSTLN | |
| SNETILETG | | SNETILETG | | TCVCRDSWHG | | TYIWTYQAELL | |
| SNETVKDRS | | SNETVKDRS | | TCVVAVTDGP | | TYKILSIYSSV | |
| SNGAFIAPR | | SNGAFIAPR | | TCVVIMTDGP | | TYKILSIYSTV | |
| SNGAFLAPG | | SNGAFLAPG | | TCVVIMTDGS | | TYKILTIYSTA | |
| SNGAFLAPR | | SNGAFLAPR | | TCVVTVTDGP | | TYKILTIYSTV | |
| SNGALLAPR | | SNGALLAPR | | TCVVVMTDGS | | TYNAEILVLME | |
| SNGGFLAPR | | SNGGFLAPR | | TCWEQLYTPG | | TYNAELFVLME | |
| SNGGLIAPR | | SNGGLIAPR | | TCWEQMYTPG | | TYNAELLILLE | |
| SNGGLLAPK | | SNGGLLAPK | | TCYPFDVPDH | | TYNAELLVLIE | |
| SNGGLLAPR | | SNGGLLAPR | | TCYPFDVPDY | | TYNAELLVLLE | |
| SNGNCRFNV | | SNGNCRFNV | | TCYPFDVPEY | | TYNAELLVLME | |
| SNGNFIAPE | | SNGNFIAPE | | TCYPFDVPGY | | TYNAEVLVLME | |
| SNGNFITPE | | SNGNFITPE | | TCYPFDVPNY | | TYNHEDYKEES | |
| SNGNLIAPE | | SNGNLIAPE | | TDAEMNKLFE | | TYNHEDYREES | |
| SNGNLIAPL | | SNGNLIAPL | | TDCVLEAMAF | | TYNHKDYEEEA | |
| SNGNLIAPR | | SNGNLIAPR | | TDCVLEAMAL | | TYNHKEYEEEA | |
| SNGNLIAPW | | SNGNLIAPW | | TDELCPSPLK | | TYNHTEYRQEA | |
| SNGNLVAPR | | SNGNLVAPR | | TDEYKNTGDS | | TYNKTVINNIT | |
| SNGNLVAPW | | SNGNLVAPW | | TDEYKNTRDS | | TYNNTTGRDVL | |
| SNGQGSGYA | | SNGQGSGYA | | TDGATSACKR | | TYNNTVINNIT | |
| SNGSCRCTI | | SNGSCRCTI | | TDGNASGKAD | | TYNNTVINNMT | |
| SNGSCRFNV | | SNGSCRFNV | | TDGPAANNAD | | TYNNTVVNNIT | |
| SNGSLHGRI | | SNGSLHGRI | | TDGPAANSAD | | TYNRKEYEEEA | |
| SNGSLQCKI | | SNGSLQCKI | | TDGPADNKAD | | TYNSTVVNNIT | |
| SNGSLQCRI | | SNGSLQCRI | | TDGPANKQAS | | TYNTELLVLME | |
| SNGSLQCRV | | SNGSLQCRV | | TDGPANNQAS | | TYNVELLVLME | |
| SNGSLQCTI | | SNGSLQCTI | | TDGPANSQAS | | TYNYPKYEEES | |
| SNGSLQFRI | | SNGSLQFRI | | TDGPANSQAY | | TYNYPKYSEES | |
| SNGSLRCRI | | SNGSLRCRI | | TDGPASNQAS | | TYNYSKYEEES | |
| SNGTAKDRS | | SNGTAKDRS | | TDGPASSQAY | | TYQAELLIAME | |
| SNGTIEDRT | | SNGTIEDRT | | TDGPSDAQAF | | TYQAELLVAME | |
| SNGTIHDGT | | SNGTIHDGT | | TDGPSNAQAF | | TYQEELLVAME | |
| SNGTIHDRA | | SNGTIHDRA | | TDGSANSQAY | | TYQNNFVPVIG | |
| SNGTIHDRI | | SNGTIHDRI | | TDGSASGKAD | | TYQNNFVPVVG | |
| SNGTIHDRN | | SNGTIHDRN | | TDGSASGKAE | | TYQNSFVPVVG | |
| SNGTIHDRS | | SNGTIHDRS | | TDGSASGRAD | | TYQRTRALVRS | |
| SNGTIHDRT | | SNGTIHDRT | | TDGSASRKAD | | TYQRTRALVRT | |
| SNGTIIKTL | | SNGTIIKTL | | TDGSASSQAH | | TYREEAMQNRL | |
| SNGTIKDRS | | SNGTIKDRS | | TDGSASSQAY | | TYRILSIYSTV | |

Fig. 83-364

| Block size 8 | SIN | Block size 9 | SIN | Block size 10 | SIN | Block size 11 | SIN |
|---|---|---|---|---|---|---|---|
| SNGTIKDRT | | SNGTIKDRT | | TDGSATGPAD | | TYRNNRKEPAL | |
| SNGTIRDRT | | SNGTIRDRT | | TDGSATGPAE | | TYRNTRKEPAL | |
| SNGTIVKTL | | SNGTIVKTL | | TDIWAYNAEL | | TYSSPMMWEIN | |
| SNGTKINTL | | SNGTKINTL | | TDIWSYNAKL | | TYSSSLMWEIN | |
| SNGTKVNTL | | SNGTKVNTL | | TDIWSYNARL | | TYSSSMMWEIN | |
| SNGTMKDRS | | SNGTMKDRS | | TDIWTYQAEL | | TYSSSMMWEVN | |
| SNGTNKDRT | | SNGTNKDRT | | TDKDSNGVQD | | TYTGAINSSKP | |
| SNGTTHDRI | | SNGTTHDRI | | TDKGSIQSDK | | TYTGAINSSRP | |
| SNGTTHDRT | | SNGTTHDRT | | TDKIDTLTET | | TYVLSIIPSGP | |
| SNGTVKBRS | | SNGTVKBRS | | TDKNSNGVQD | | TYVLSIVPSGP | |
| SNGTVKDRS | | SNGTVKDRS | | TDKSSNGVQD | | TYVLSVIPSGP | |
| SNGTVKDRT | | SNGTVKDRT | | TDKVDTIIEN | | TYVSIGTSTLN | |
| SNGTVKNRS | | SNGTVKNRS | | TDKVDTLTEN | | TYVSVGTSTLN | |
| SNGTVNDRS | | SNGTVNDRS | | TDKVDTLTET | | TYWWDGLQSSD | |
| SNGVQDIID | | SNGVQDIID | | TDKVNTIIEN | | TYYYPKYEEES | |
| SNGYKDVIL | | SNGYKDVIL | | TDLEALMEWI | | VAASLCLAILI | |
| SNIFNMERI | | SNIFNMERI | | TDLEALMEWL | | VAASLCLAILV | |
| SNIGLNVSL | | SNIGLNVSL | | TDLEVLMEWL | | VAASLCLAVLI | |
| SNINIREWS | | SNINIREWS | | TDLGAPLELR | | VACGPAECRTF | |
| SNITVTSSV | | SNITVTSSV | | TDLGQCGILG | | VACGPSECRTF | |
| SNKMARLGK | | SNKMARLGK | | TDLGQCGLLG | | VACGPTECRTF | |
| SNKMARLGR | | SNKMARLGR | | TDLGSPLELR | | VACSPSECRTF | |
| SNKVARLGK | | SNKVARLGK | | TDLGTPLELR | | VADGGPNLYNI | |
| SNKVNSVIE | | SNKVNSVIE | | TDLYKVATGR | | VADRDSTQKAI | |
| SNLDYQIGY | | SNLDYQIGY | | TDMGQCGLLG | | VAEINTWARNI | |
| SNLEKRLEN | | SNLEKRLEN | | TDNHVEVVSA | | VAFCGTSGTYG | |
| SNLERRLEN | | SNLERRLEN | | TDNPRPNDPA | | VAGGLILGMQN | |
| SNLNDATYQ | | SNLNDATYQ | | TDNPRPNDPN | | VAGLSFWMCSN | |
| SNLNDTTYQ | | SNLNDTTYQ | | TDNPRPNDPS | | VAGLSLWMCSN | |
| SNLPFQNIN | | SNLPFQNIN | | TDNPRPNDPT | | VAGSLSLAIMI | |
| SNLPFQNVN | | SNLPFQNVN | | TDNPRPNDPV | | VAGSLSLAIMM | |
| SNMDRAVKL | | SNMDRAVKL | | TDNYGVKGFG | | VAGSLSLAIMV | |
| SNMGIYQIL | | SNMGIYQIL | | TDSEMDKLFE | | VAGSSEQAAEA | |
| SNMGVYQIL | | SNMGVYQIL | | TDSEMNKLFD | | VAGWILGNPEC | |
| SNMSLNISL | | SNMSLNISL | | TDSEMNKLFE | | VAGWILGNPKC | |
| SNNATDTVD | | SNNATDTVD | | TDSEMNKLYE | | VAGWLLGNPEC | |
| SNNDWSGYS | | SNNDWSGYS | | TDSEMNRLFE | | VAGWLLGNPLC | |
| SNNRSGYSG | | SNNRSGYSG | | TDSEMSKLFE | | VAGWLLGNPMC | |
| SNNSSDTVD | | SNNSSDTVD | | TDSIKSWRKD | | VAGWYGFQHQN | |
| SNNSTDKID | | SNNSTDKID | | TDSIKSWRRD | | VAGWYGFQHSN | |
| SNNSTDKVD | | SNNSTDKVD | | TDSQTATKRI | | VAGWYGFQHTN | |
| SNNSTDKVN | | SNNSTDKVN | | TDSQTATKRL | | VAHKSCLPACA | |
| SNNSTDTVD | | SNNSTDTVD | | TDTFKSWKGN | | VAHKSCLPACI | |
| SNNSTDTVN | | SNNSTDTVN | | TDTLKSWKGN | | VAHKSCLPACV | |
| SNNSTEKVD | | SNNSTEKVD | | TDTPRGEDSQ | | VAIALSILNLL | |
| SNNSTERVD | | SNNSTERVD | | TDTVDTILEK | | VAIALSVLNLL | |
| SNNSTNTVN | | SNNSTNTVN | | TDTVDTLIEQ | | VAIENQHTIDL | |
| SNNTTNYYN | | SNNTTNYYN | | TDTVDTLLEK | | VAIVFSQEDCM | |
| SNNTVKDRS | | SNNTVKDRS | | TDTVDTLTEN | | VAKAGFIENGW | |
| SNNWSGYSG | | SNNWSGYSG | | TDTVDTVLEK | | VAKDNAIRFGE | |
| SNPGRVTVS | | SNPGRVTVS | | TDTVDTVLER | | VALALSHTAYS | |
| SNPITGSPC | | SNPITGSPC | | TDTVDTVREK | | VALCGSKEQLG | |
| SNPITGSPG | | SNPITGSPG | | TDTVNTLIEQ | | VALCGSKERLG | |
| SNPITGSPS | | SNPITGSPS | | TDTVNTLMEQ | | VALCGSKKRLG | |
| SNPKCDLYL | | SNPKCDLYL | | TDTVNTLTEQ | | VALCGSPISVG | |
| SNQASYKIF | | SNQASYKIF | | TDVIRSWRKQ | | VALCGSPVPVG | |
| SNQDSFYRS | | SNQDSFYRS | | TDVVNFLSME | | VALCGSPVSVG | |
| SNQGSFYRN | | SNQGSFYRN | | TDVVNFVSME | | VALCGSRERLG | |
| SNQGSFYRS | | SNQGSFYRS | | TDVVNYVSME | | VALENQHTIDL | |
| SNQKIITIG | | SNQKIITIG | | TDVVRSWKKQ | | VALENQHTIDM | |
| SNRFQIQGV | | SNRFQIQGV | | TDVVRSWRKK | | VALENQHTIDV | |
| SNRGSFYRS | | SNRGSFYRS | | TDVVRSWRKQ | | VALENQHTIHL | |

Fig. 83-365

| Block size 8 | SIN | Block size 9 | SIN | Block size 10 | SIN | Block size 11 | SIN |
|---|---|---|---|---|---|---|---|
| SNRPIIDIN | | SNRPIIDIN | | TDVVRSWRRQ | | VALENQNTIDL | |
| SNRPIVDIN | | SNRPIVDIN | | TDVWSYNAKL | | VALILGFVLWA | |
| SNRPVIDIN | | SNRPVIDIN | | TDVYCICRDN | | VAMENQHIIDL | |
| SNRPVIDVN | | SNRPVIDVN | | TDWSGYSGSF | | VAMENQHTIDL | |
| SNRPVIQID | | SNRPVIQID | | TECQLNEGIM | | VAMENQHTIDM | |
| SNRPVIQIN | | SNRPVIQIN | | TECQLNEGVI | | VAMVFSQEDCM | |
| SNRPVIRID | | SNRPVIRID | | TECQLNEGVM | | VAMVFSQEDCV | |
| SNRPVLDIS | | SNRPVLDIS | | TECRTFFLTQ | | VAMVFSQEDRM | |
| SNRPVVDIN | | SNRPVVDIN | | TEDNIYKILS | | VAMVFSQEECM | |
| SNRPVVDIR | | SNRPVVDIR | | TEDNVYKILS | | VANFSMELPSF | |
| SNRPWIRFN | | SNRPWIRFN | | TEDNVYKVLA | | VANGTKVNTLT | |
| SNRPWIRIN | | SNRPWIRIN | | TEDNVYKVLS | | VAPEYGFKISK | |
| SNRPWISFD | | SNRPWISFD | | TEEQAVDICK | | VAPIMFSNKMA | |
| SNRPWISFN | | SNRPWISFN | | TEEQAVGICK | | VAPSPSNSRFE | |
| SNRPWLSFN | | SNRPWLSFN | | TEEQAVNICK | | VAPSPYNSRFE | |
| SNRPWMRIN | | SNRPWMRIN | | TEEVSHCRAT | | VARCNTKCQTS | |
| SNRPWMRIS | | SNRPWMRIS | | TEFESIESEF | | VARLGKGYMFE | |
| SNRPWVRIN | | SNRPWVRIN | | TEFLGQWDWP | | VASSLVLLFMI | |
| SNRPWVRMN | | SNRPWVRMN | | TEFLGQWNWP | | VASSLVLLLMI | |
| SNRPWVSFD | | SNRPWVSFD | | TEGHIEECSC | | VATGRVTVSTR | |
| SNRPWVSFN | | SNRPWVSFN | | TEHQIGNVIN | | VATTHSWIPKR | |
| SNRSGYSGS | | SNRSGYSGS | | TEIASWAGNI | | VATTHSWTPKR | |
| SNSDFICVG | | SNSDFICVG | | TEIGAPQLNP | | VATTHSWVPIL | |
| SNSDFLCVG | | SNSDFLCVG | | TEIIRMMEN | | VATTHSWVPKR | |
| SNSDFMCVG | | SNSDFMCVG | | TEINTWARNI | | VAVAKDNAIRF | |
| SNSDWSGYS | | SNSDWSGYS | | TEIPSWAGNI | | VAVENQHTIDL | |
| SNSEFICVG | | SNSEFICVG | | TEIPSWAGNV | | VAVIKYNGIIT | |
| SNSEFLCVG | | SNSEFLCVG | | TEIPSWEGNI | | VAVLKYKGIIT | |
| SNSEGTGMA | | SNSEGTGMA | | TEIPTWAGNI | | VAVLKYNDIIT | |
| SNSIAVFCG | | SNSIAVFCG | | TEIRASVGKM | | VAVLKYNGIIT | |
| SNSIIAFCG | | SNSIIAFCG | | TEIRASVGRM | | VAVLKYNGVIT | |
| SNSIIVFCG | | SNSIIVFCG | | TEIRSSVGKM | | VAVTDGPAANN | |
| SNSIVAFCG | | SNSIVAFCG | | TEIRTSVGRM | | VAVTDGPAANS | |
| SNSIVALCG | | SNSIVALCG | | TEISFTITGD | | VAVTHSVNLLE | |
| SNSIVSMCS | | SNSIVSMCS | | TEIWSYNAEL | | VAWSASACHDG | |
| SNSIVTFCG | | SNSIVTFCG | | TEIYNETVRL | | VAWSATACHDG | |
| SNSIVVFCG | | SNSIVVFCG | | TEKGIEVVNA | | VAWSATACSDG | |
| SNSLIALCG | | SNSLIALCG | | TEKGVEVVNA | | VAWSSSSCFDG | |
| SNSLKLAIG | | SNSLKLAIG | | TEKVDTIIEN | | VAWSSSSCHDG | |
| SNSLVALCG | | SNSLVALCG | | TEKVDTIIES | | VAWSSTSCFDG | |
| SNSMVTFCG | | SNSMVTFCG | | TELGAPLVLD | | VAYDKICIGYQ | |
| SNSNCKDPN | | SNSNCKDPN | | TELGSPLVLD | | VAYERMCNILK | |
| SNSNCRDPN | | SNSNCRDPN | | TELINPNKWG | | VAYMLERELVR | |
| SNSNCRNPN | | SNSNCRNPN | | TELINPSKWG | | VCAAWSSSSCH | |
| SNSRFESVA | | SNSRFESVA | | TELIPPSKWG | | VCATCEQIADA | |
| SNSTTHDRT | | SNSTTHDRT | | TELISPNKWG | | VCATCEQIADS | |
| SNTWLGRTI | | SNTWLGRTI | | TELISPSKWG | | VCFMYSDFHFI | |
| SNVENLFDE | | SNVENLFDE | | TELLVLMENE | | VCHNGICPVVF | |
| SNVGLKVSL | | SNVGLKVSL | | TELPFQNLSP | | VCHNGTCAVVM | |
| SNVGLNMSL | | SNVGLNMSL | | TELSFTITGD | | VCHNGTCVVIM | |
| SNVGLNVSL | | SNVGLNVSL | | TELSFTVTGD | | VCHNGTCVVVM | |
| SNVKNLFDE | | SNVKNLFDE | | TELWSYNAEL | | VCHNGVCPVVF | |
| SNVKNLHEK | | SNVKNLHEK | | TEMWSYNAEL | | VCHSGICPVVF | |
| SNVKNLYDK | | SNVKNLYDK | | TEMYNETVRV | | VCHSGVCPVVF | |
| SNVKNLYDR | | SNVKNLYDR | | TENGVPVTSS | | VCIAWSRSSCH | |
| SNVKNLYEK | | SNVKNLYEK | | TENPVICLGH | | VCIAWSSASCH | |
| SNVKNLYNK | | SNVKNLYNK | | TENSFEQITF | | VCIAWSSSSCH | |
| SNVRNLHEK | | SNVRNLHEK | | TEPLCDVSGF | | VCIAWSSSSCY | |
| SNVRNLHER | | SNVRNLHER | | TEPLCEVSGF | | VCIKFVSSDCS | |
| SNVRNLYDK | | SNVRNLYDK | | TEPLCNVSGF | | VCINGICTVVM | |
| SNVRSLHEK | | SNVRSLHEK | | TEQNVPVTQV | | VCINGSCAVVM | |
| SNVTVTSSI | | SNVTVTSSI | | TEQTKLYKNT | | VCINGSCIVVM | |

Fig. 83-366

| Block size 8 | SIN | Block size 9 | SIN | Block size 10 | SIN | Block size 11 | SIN |
|---|---|---|---|---|---|---|---|
| SNVTVTSSV | | SNVTVTSSV | | TEQVDTIMEK | | VCINGSCTVVM | |
| SNVVLNVSL | | SNVVLNVSL | | TEQVDTIMER | | VCINGTCAVVM | |
| SNWSGYSGI | | SNWSGYSGI | | TEREVEVVNA | | VCINGTCTVVM | |
| SNWSGYSGS | | SNWSGYSGS | | TERGIEVVNA | | VCISGPNNNAS | |
| SNYHQSFVP | | SNYHQSFVP | | TERGVEVVDA | | VCISGTCAVVM | |
| SNYQQSFVP | | SNYQQSFVP | | TERGVEVVNA | | VCITGDDRNAT | |
| SNYVCSGLV | | SNYVCSGLV | | TERVDTIIES | | VCMAWSSSSCH | |
| SPCLTDKGS | | SPCLTDKGS | | TERVDTIMEK | | VCMESVRNGTY | |
| SPDPGVKGF | | SPDPGVKGF | | TESLQNRIQI | | VCMSGPNNNAS | |
| SPEEVSEAQ | | SPEEVSEAQ | | TESRGLFGAI | | VCPVIMTDGPA | |
| SPEEVSETQ | | SPEEVSETQ | | TESSFEQITF | | VCPVVFTDGSA | |
| SPFPVGSGS | | SPFPVGSGS | | TETGALQLNP | | VCPVVMTDGPA | |
| SPFRALISW | | SPFRALISW | | TETGAPQLNP | | VCQDEFCYTLI | |
| SPFRALVSW | | SPFRALVSW | | TETGVPVTSS | | VCQDEFCYTLM | |
| SPFRTLMSC | | SPFRTLMSC | | TETKAPQLNP | | VCQDEFCYTLV | |
| SPFRTLMSV | | SPFRTLMSV | | TETVEITGID | | VCQNGVCPVVF | |
| SPGAPGVKG | | SPGAPGVKG | | TETVEITGIN | | VCRALLAKSVF | |
| SPGARPKVN | | SPGARPKVN | | TETVNTLIEQ | | VCRDNWHASNR | |
| SPGCDRLQD | | SPGCDRLQD | | TETVNTLSEQ | | VCRDNWHGSNR | |
| SPGDRPKVN | | SPGDRPKVN | | TETVNTLTEQ | | VCRDNWKGANR | |
| SPGMMMGMF | | SPGMMMGMF | | TEVEGRIQDL | | VCRDNWKGSNR | |
| SPGNAEIED | | SPGNAEIED | | TEVEKQIGNV | | VCRDNWMGSNR | |
| SPGRVTVST | | SPGRVTVST | | TEVEQQIGNV | | VCRDNWNGMNR | |
| SPGVKGFGF | | SPGVKGFGF | | TEVETYVLSI | | VCRDNWQGANR | |
| SPGVKGWAF | | SPGVKGWAF | | TEVETYVLSV | | VCRDNWRGANR | |
| SPHRALMSC | | SPHRALMSC | | TEVSHCRATE | | VCRDNWRGFNR | |
| SPHRSLMSC | | SPHRSLMSC | | TEVWSYNADL | | VCRDNWRGSNR | |
| SPHRTLLMN | | SPHRTLLMN | | TEVWSYNAEL | | VCRDNWTGTNR | |
| SPHRTLMSC | | SPHRTLMSC | | TEVYNETVRL | | VCRDSWHGSNR | |
| SPIHLGDCS | | SPIHLGDCS | | TEVYNETVRV | | VCRTLLAKSVF | |
| SPINNGKGR | | SPINNGKGR | | TEVYSETVRV | | VCSGIFGDNPR | |
| SPISVGSGS | | SPISVGSGS | | TEWSGYSGSF | | VCSGLVGDTPR | |
| SPIVPSFDM | | SPIVPSFDM | | TEYRQEALQN | | VCSGVFGDNPR | |
| SPKLRSGFE | | SPKLRSGFE | | TFCGLDNEPG | | VCSKFHSDTPR | |
| SPLAGSAQH | | SPLAGSAQH | | TFCGLNNEPG | | VCSNGSCRCTI | |
| SPLAVTWWN | | SPLAVTWWN | | TFDSLNITAA | | VCTGILTDTSR | |
| SPLELRDCK | | SPLELRDCK | | TFDWTLNRNQ | | VCTGVLTDTSR | |
| SPLGAINTT | | SPLGAINTT | | TFEFTSFFYR | | VCTKGKKAVDL | |
| SPLKLIDGQ | | SPLKLIDGQ | | TFESDGAFLA | | VCVAWSSSSCH | |
| SPLKLVDGQ | | SPLKLVDGQ | | TFESNGAFIA | | VCVSLLQSAIL | |
| SPLMVAYML | | SPLMVAYML | | TFESNGAFLA | | VCVTGDDGNAT | |
| SPLPFQNID | | SPLPFQNID | | TFESNGALLA | | VCVTGDDKNAT | |
| SPLPFQNIN | | SPLPFQNIN | | TFESNGGFLA | | VCVTGDDRNAT | |
| SPLRLIDGQ | | SPLRLIDGQ | | TFESNGGLIA | | VCWDNWRGSNR | |
| SPLRLVDGQ | | SPLRLVDGQ | | TFESGGLLA | | VCYNPCFYVEL | |
| SPLSGNAQH | | SPLSGNAQH | | TFESSGGLLA | | VCYPGSIENQE | |
| SPLSGSAQH | | SPLSGSAQH | | TFFITQGSLL | | VCYPGSIKNQE | |
| SPLSRCRET | | SPLSRCRET | | TFFLTHGALL | | VDALLGDPHCD | |
| SPLSRCRKT | | SPLSRCRKT | | TFFLTHGSLL | | VDCFLWHVRKR | |
| SPLTGSAQH | | SPLTGSAQH | | TFFLTQGALL | | VDDAVTDIWSY | |
| SPLTKGILG | | SPLTKGILG | | TFFLTQGILL | | VDDAVTDVWSY | |
| SPLTKGMLG | | SPLTKGMLG | | TFFLTQGSLP | | VDEGNGCFELL | |
| SPLVLDDCS | | SPLVLDDCS | | TFGPVHFQNQ | | VDGFEPNGCIE | |
| SPMMWEING | | SPMMWEING | | TFGPVHFRNQ | | VDGFEPNGSIE | |
| SPNAYQAKF | | SPNAYQAKF | | TFGPVHFRSQ | | VDGFEPNGYIE | |
| SPNAYQAQF | | SPNAYQAQF | | TFIFNGAFIA | | VDGFKPNGCIE | |
| SPNAYQARF | | SPNAYQARF | | TFILWACQNG | | VDGQDCDLING | |
| SPNVYQAKF | | SPNVYQAKF | | TFIQALQLLL | | VDGQSGRIDFH | |
| SPNVYQARF | | SPNVYQARF | | TFKSWKGNIM | | VDGSSSACLRG | |
| SPNVYQSRF | | SPNVYQSRF | | TFKVIGGWST | | VDGTIAGFIEG | |
| SPPIVSNSD | | SPPIVSNSD | | TFKVIGGWTT | | VDGWYGFHHSN | |
| SPPIVSNSE | | SPPIVSNSE | | TFLAMITYIT | | VDGWYGFRHHN | |

Fig. 83-367

| Block size 8 | SIN | Block size 9 | SIN | Block size 10 | SIN | Block size 11 | SIN |
|---|---|---|---|---|---|---|---|
| SPPMVSNSD | | SPPMVSNSD | | TFLARSALIL | | VDGWYGFRHQN | |
| SPPTVYNNR | | SPPTVYNNR | | TFLHNGGLIA | | VDGWYGYHHEN | |
| SPPTVYNSK | | SPPTVYNSK | | TFLQALQLLL | | VDGWYGYHHIN | |
| SPPTVYNSR | | SPPTVYNSR | | TFLRSNAPSG | | VDGWYGYHHNN | |
| SPPTVYNTR | | SPPTVYNTR | | TFMQALQLLF | | VDGWYGYHHQN | |
| SPPTVYSSR | | SPPTVYSSR | | TFMQALQLLL | | VDGWYGYHHSK | |
| SPPVVSNSD | | SPPVVSNSD | | TFNFNGAFVA | | VDGWYGYHHSN | |
| SPQLEGFSA | | SPQLEGFSA | | TFNGAFIAPD | | VDGWYGYHHTN | |
| SPQRTLMSC | | SPQRTLMSC | | TFNGAFIAPN | | VDHMAIIKKYT | |
| SPRLRSGFE | | SPRLRSGFE | | TFPYTGDPPY | | VDHMAIIKRYT | |
| SPRMFLAMI | | SPRMFLAMI | | TFQNIDKNAL | | VDKLTQGRQTF | |
| SPRSRNGFE | | SPRSRNGFE | | TFQNIDRNAI | | VDKLTQGRQTY | |
| SPRSRSGFE | | SPRSRSGFE | | TFQNIDRNAL | | VDKMNREFEVM | |
| SPRTVGQCP | | SPRTVGQCP | | TFQNIEKNAL | | VDKMNREFEVV | |
| SPSAPGVKG | | SPSAPGVKG | | TFQNIERNAL | | VDKMNREFGVV | |
| SPSECRTFF | | SPSECRTFF | | TFRGLISTPL | | VDLGSCGILGT | |
| SPSNSRFES | | SPSNSRFES | | TFRVIGGWAT | | VDLVETNHTGT | |
| SPSPGARPK | | SPSPGARPK | | TFRVIGGWTT | | VDLWSYNAELL | |
| SPSPGDRPK | | SPSPGDRPK | | TFRVIGGWVT | | VDNHSMSDIEA | |
| SPVHLGDCN | | SPVHLGDCN | | TFSDNGGLIA | | VDNKNWSGYSG | |
| SPVHLGDCR | | SPVHLGDCR | | TFSFNGAFIA | | VDNNGELRHLF | |
| SPVHLGDCS | | SPVHLGDCS | | TFSFNGAFVA | | VDNNNWFGYFG | |
| SPVLTDNPR | | SPVLTDNPR | | TFSFQLINNK | | VDNNNWSGYSG | |
| SPVNNGKGR | | SPVNNGKGR | | TFSHNGGLIA | | VDNNSWSGYSG | |
| SPVPVGSGS | | SPVPVGSGS | | TFSHNGGLVA | | VDNSNWSGYSG | |
| SPVSVGSGS | | SPVSVGSGS | | TFSHNGGRIA | | VDQITGKLNRL | |
| SPYNSKFES | | SPYNSKFES | | TFSPRSRSGF | | VDQSLIIAARN | |
| SPYNSRFES | | SPYNSRFES | | TFSVQRNLPF | | VDQSLIIAARS | |
| SPYRALISW | | SPYRALISW | | TFSVQRSLPF | | VDQSLVIAARN | |
| SPYRALMSC | | SPYRALMSC | | TFTFNGAFIA | | VDQVRESRNPG | |
| SPYRALMSV | | SPYRALMSV | | TFVNITNVQN | | VDRLTQGRQTY | |
| SPYRTLMSC | | SPYRTLMSC | | TFVNVTHVQN | | VDSIGWSWSQNI | |
| SPYRTLMSV | | SPYRTLMSV | | TFVNVTNVQN | | VDSIVSWSQNI | |
| SQASYKIFK | | SQASYKIFK | | TGALASCMGL | | VDTCYPFDVPD | |
| SQDTEISFT | | SQDTEISFT | | TGALQLNPID | | VDTGDGCFEIL | |
| SQDTELSFT | | SQDTELSFT | | TGAPQLNPID | | VDTGNGCFDIL | |
| SQEDCMIKA | | SQEDCMIKA | | TGAPQLNPVD | | VDTIIENNVTV | |
| SQEDCMMKA | | SQEDCMMKA | | TGAQSFYRSI | | VDTIIESNITV | |
| SQEDCMVKA | | SQEDCMVKA | | TGARRIDFHW | | VDTIIESNVTV | |
| SQEDRMIKA | | SQEDRMIKA | | TGCFEIFHKC | | VDTILEKNITV | |
| SQEECMIKA | | SQEECMIKA | | TGCFEIFHRC | | VDTILEKNVTV | |
| SQETRVWWT | | SQETRVWWT | | TGCKMYALHQ | | VDTILERNVTV | |
| SQFRALISW | | SQFRALISW | | TGCQLNEGVM | | VDTIMEKNITV | |
| SQGEGTAAD | | SQGEGTAAD | | TGDDKNATAS | | VDTIMEKNVTV | |
| SQGSGYAAD | | SQGSGYAAD | | TGDDRNATAS | | VDTIMERNVTV | |
| SQGTKRPYE | | SQGTKRPYE | | TGDGCFEILH | | VDTLLEKNVTV | |
| SQGTKRSHE | | SQGTKRSHE | | TGDNTKWNEN | | VDTLLENDVPV | |
| SQGTKRSYE | | SQGTKRSYE | | TGDPPYSHGT | | VDTLLENGVPV | |
| SQGTTIRGK | | SQGTTIRGK | | TGFAPFSEDN | | VDTLLENNVPV | |
| SQGTTIRGR | | SQGTTIRGR | | TGFAPFSKDN | | VDTLLESDVPV | |
| SQGTTLKGR | | SQGTTLKGR | | TGFHFEECSC | | VDTLTEKGIEV | |
| SQGTTLRGQ | | SQGTTLRGQ | | TGFTYSGIRT | | VDTLTENGVPV | |
| SQGTTLRGR | | SQGTTLRGR | | TGGQAFYRSI | | VDTLTETGVPV | |
| SQGVKGWAF | | SQGVKGWAF | | TGGQSFYRSI | | VDTNLERNVTV | |
| SQHKSHRQM | | SQHKSHRQM | | TGIAADKAST | | VDTVLEKNVTV | |
| SQHRSHRQM | | SQHRSHRQM | | TGIAADKEST | | VDTVLERNVTV | |
| SQITNGTTG | | SQITNGTTG | | TGIAADKTST | | VDTVREKNVTV | |
| SQKILCTSA | | SQKILCTSA | | TGIAADKVST | | VDVYCICRDNW | |
| SQKLFALSG | | SQKLFALSG | | TGIAADRDST | | VEAESSVKEKD | |
| SQKQEFKMN | | SQKQEFKMN | | TGIAADREST | | VEAMISRARID | |
| SQLEGFSAE | | SQLEGFSAE | | TGIAADRGST | | VEAMMSRARID | |
| SQLIWMACH | | SQLIWMACH | | TGIAAEKEST | | VEAMVSRARID | |

Fig. 83-368

| Block size 8 | SIN | Block size 9 | SIN | Block size 10 | SIN | Block size 11 | SIN |
|---|---|---|---|---|---|---|---|
| SQLKDNAKD | | SQLKDNAKD | | TGIDKVCTKG | | VEAVIYGNPKC | |
| SQLKDNAND | | SQLKDNAND | | TGILTDTSRP | | VECICRDNWTG | |
| SQLKKQEIE | | SQLKKQEIE | | TGINKVCTKG | | VECIGWSSTSC | |
| SQLKRQEIE | | SQLKRQEIE | | TGIVADRDST | | VECVCRDNWNG | |
| SQLRDNAKD | | SQLRDNAKD | | TGIWDTLIER | | VECVCRDNWRG | |
| SQLRDNAND | | SQLRDNAND | | TGKDPKKTGG | | VECVCRDNWTG | |
| SQLTEVETP | | SQLTEVETP | | TGKGCFDILH | | VECVGWSSTSC | |
| SQLVWMACH | | SQLVWMACH | | TGKLNRFIEK | | VEDGFLDVWTY | |
| SQLVWMACN | | SQLVWMACN | | TGKLNRIIEK | | VEDGSIGKVCR | |
| SQNILRTHE | | SQNILRTHE | | TGKLNRLIDK | | VEDTKIDLWSY | |
| SQNILRTQE | | SQNILRTQE | | TGKLNRLIDR | | VEDTKVDLWSY | |
| SQRGILEDE | | SQRGILEDE | | TGKLNRLIEK | | VEECLINDPWV | |
| SQRGVLEDE | | SQRGVLEDE | | TGKLNRLIER | | VEECSCYPRFP | |
| SQRSKFLLM | | SQRSKFLLM | | TGKLNRLIGK | | VEECSCYPRSP | |
| SQSGRISFY | | SQSGRISFY | | TGKLNRLISK | | VEECSCYPRYP | |
| SQSRTREIL | | SQSRTREIL | | TGKSHGRILK | | VEECSCYPRYS | |
| SQSRTRGIL | | SQSRTRGIL | | TGKSHGRVLK | | VEEGSIGKVCR | |
| SQTATKRIR | | SQTATKRIR | | TGLIDGWYGY | | VEELVHGGIDP | |
| SQTATKRLR | | SQTATKRLR | | TGLRNIPQIE | | VEELVHGGINP | |
| SQTIINNYH | | SQTIINNYH | | TGLRNIPSIQ | | VEELVHGGVDP | |
| SQTIINNYY | | SQTIINNYY | | TGLRNIPSVQ | | VEELVHGQVNP | |
| SQTVINNYY | | SQTVINNYY | | TGLRNVPQIE | | VEELVHRGIDP | |
| SQVEQRINM | | SQVEQRINM | | TGLRNVPQME | | VEESSIGKVCR | |
| SQVERRINM | | SQVERRINM | | TGLRNVPSIQ | | VEFCGTSGTYG | |
| SQYICSPVL | | SQYICSPVL | | TGMAADQKST | | VEFEPFQSLVP | |
| SQYLCTGIL | | SQYLCTGIL | | TGMAADRDST | | VEGRIQDLEKY | |
| SQYLCTGVL | | SQYLCTGVL | | TGMALSVVSL | | VEGRIQDLERY | |
| SQYRALISW | | SQYRALISW | | TGMDPRMCSL | | VEGWVVIAKDN | |
| SQYRALVSW | | SQYRALVSW | | TGMIDGWYGY | | VEGWVVIAQDN | |
| SQYREEALL | | SQYREEALL | | TGMILSVVSL | | VEGWVVIEKDN | |
| SQYRSLISW | | SQYRSLISW | | TGMKNVPEIP | | VEGWVVVAKDN | |
| SRACNNTSN | | SRACNNTSN | | TGMKNVPETP | | VEITGIDKVCT | |
| SRADKICIG | | SRADKICIG | | TGMRNIPEKP | | VEITGINKVCT | |
| SRAGDILRT | | SRAGDILRT | | TGMRNIPEKQ | | VEKQIGNVINW | |
| SRAGYEMLK | | SRAGYEMLK | | TGMRNIPENP | | VEKQLGNVINW | |
| SRARIDARI | | SRARIDARI | | TGMRNIPERQ | | VEKRINMIADR | |
| SRARIDARV | | SRARIDARV | | TGMRNIPGKQ | | VEKRINMLADR | |
| SRARIKTRL | | SRARIKTRL | | TGMRNVPEKP | | VEKRINMLADW | |
| SRAVGKCPR | | SRAVGKCPR | | TGMRNVPEKQ | | VEKTNEKFHQI | |
| SRCHTDKGS | | SRCHTDKGS | | TGMRNVPENP | | VELIRGRPEEA | |
| SRCRETRGL | | SRCRETRGL | | TGMRNVPERQ | | VELIRGRPEEV | |
| SRCRKTRGL | | SRCRKTRGL | | TGMRNVPETQ | | VELIRGRPKED | |
| SRDSRSGYE | | SRDSRSGYE | | TGMTLSVVNL | | VELIRGRPKEE | |
| SRERLGSWS | | SRERLGSWS | | TGMTLSVVSL | | VELLVLMENER | |
| SRFEAVAWS | | SRFEAVAWS | | TGMVDGWYGY | | VELSSGYKDVI | |
| SRFESVAWS | | SRFESVAWS | | TGMVNGWYGY | | VELSSMGVYQI | |
| SRFQIQGVK | | SRFQIQGVK | | TGMWDTLIER | | VEMIRGQPKEK | |
| SRGEVFVIR | | SRGEVFVIR | | TGNFIAPEYA | | VEMIRGQPNER | |
| SRGHIFVIR | | SRGHIFVIR | | TGNGCFDILH | | VENGTSVKTLT | |
| SRGHVFVIR | | SRGHVFVIR | | TGNGCFEFYH | | VENLEELRFVF | |
| SRGLFGAIA | | SRGLFGAIA | | TGNHGSLVLS | | VENLFDEVRRR | |
| SRGLFGAKA | | SRGLFGAKA | | TGNKLITVGS | | VENLNKKMEDG | |
| SRGYKMNIQ | | SRGYKMNIQ | | TGNLIAPEYG | | VENQEELRSLF | |
| SRGYKMNNQ | | SRGYKMNNQ | | TGNLIAPRGY | | VENRINMLADR | |
| SRGYKMNTK | | SRGYKMNTK | | TGNLVAPEYG | | VENTYVNNTTI | |
| SRGYKMNTQ | | SRGYKMNTQ | | TGNPIICLGH | | VEPKGLFGAIA | |
| SRGYKMNTR | | SRGYKMNTR | | TGNPVICLGH | | VEPRGLFGAIA | |
| SRHCSKYHW | | SRHCSKYHW | | TGNPVICMGH | | VEQQIGNVINW | |
| SRHHMGECP | | SRHHMGECP | | TGPADTRIYY | | VEQRINMLADR | |
| SRHYIGKCP | | SRHYIGKCP | | TGPADTRVYY | | VERGLFGAIAG | |
| SRHYMGECP | | SRHYMGECP | | TGPAETRIYY | | VERILEEESDE | |
| SRIAIGNCP | | SRIAIGNCP | | TGPAETRVYY | | VERMVLSAFDE | |

Fig. 83-369

| Block size 8 | SIN | Block size 9 | SIN | Block size 10 | SIN | Block size 11 | SIN |
|---|---|---|---|---|---|---|---|
| SRILTDTSR | | SRILTDTSR | | TGPDATAVAV | | VERPKEIEGIC | |
| SRINGVKLE | | SRINGVKLE | | TGPDSTAVAV | | VERPKEMEGIC | |
| SRINMINSK | | SRINMINSK | | TGPDTTAVAV | | VERPKEMEGVC | |
| SRINMINSQ | | SRINMINSQ | | TGPPQCDLFL | | VERPSAPEGMC | |
| SRINRQEIE | | SRINRQEIE | | TGPPQCDQFL | | VERQIGNVINW | |
| SRINTINSK | | SRINTINSK | | TGPRNVPQIE | | VERRINMLADR | |
| SRISFYWTI | | SRISFYWTI | | TGQAADLKST | | VERTKEMEGIC | |
| SRKLLLIAQ | | SRKLLLIAQ | | TGQAADYEST | | VESAVLRGFLI | |
| SRKLLLITQ | | SRKLLLITQ | | TGQAADYKST | | VESMIEAESSV | |
| SRKLLLIVQ | | SRKLLLIVQ | | TGRDVLVIWG | | VESNGNLIAPW | |
| SRKLLLVVQ | | SRKLLLVVQ | | TGRDVLVLWG | | VESNGNLVAPW | |
| SRKMLLIVQ | | SRKMLLIVQ | | TGRDVLVMWG | | VESSTYQNNFV | |
| SRLNRNEIK | | SRLNRNEIK | | TGRGIEVVNA | | VETGYVCSKFH | |
| SRLNRQEIE | | SRLNRQEIE | | TGRIFQSGIR | | VETNHTDELCP | |
| SRLNWLTKA | | SRLNWLTKA | | TGRIFQSGVR | | VETNHTGTYCS | |
| SRLNWLTKE | | SRLNWLTKE | | TGRIFQSRIR | | VETSHTGTYCS | |
| SRMGVDEYS | | SRMGVDEYS | | TGRNCTIPCF | | VETYVLSIIPS | |
| SRMQFSSLA | | SRMQFSSLA | | TGRNCTVPCF | | VETYVLSIVPS | |
| SRMQFSSLT | | SRMQFSSLT | | TGRSSFFRNV | | VETYVLSVIPS | |
| SRMSICISG | | SRMSICISG | | TGRVTVSTRS | | VEVITAQELVE | |
| SRMSICMSG | | SRMSICMSG | | TGSFCSIDGK | | VEVLHLTQGTC | |
| SRMSVCMSG | | SRMSVCMSG | | TGSFCSINGK | | VEVTNATELVQ | |
| SRMTICVQG | | SRMTICVQG | | TGSFCSINGR | | VEVVAAQELVE | |
| SRNGFEMLK | | SRNGFEMLK | | TGSFCSLDGK | | VEVVDATETVE | |
| SRNGKWREQ | | SRNGKWREQ | | TGSIYIEVLH | | VEVVNATETVE | |
| SRNPGNAEI | | SRNPGNAEI | | TGSPGAPGVK | | VEVVSAKELVE | |
| SRPFQNASR | | SRPFQNASR | | TGSPSAPGVK | | VEVVTAQELVE | |
| SRPRVRNQS | | SRPRVRNQS | | TGSVYIEVLH | | VEWSATACHDG | |
| SRRYELEIG | | SRRYELEIG | | TGSWPDGADI | | VEWTSNSLIAL | |
| SRSGFEIIW | | SRSGFEIIW | | TGSWPDGANI | | VEYASKTRISE | |
| SRSGFEILL | | SRSGFEILL | | TGSYVRLYLW | | VEYDAVATTHS | |
| SRSGFEMIW | | SRSGFEMIW | | TGTAADLKST | | VEYNGKSLGIQ | |
| SRSGFEMLK | | SRSGFEMLK | | TGTAKHIEEC | | VFAGKNADLEA | |
| SRSGFEMLR | | SRSGFEMLR | | TGTAKQNYLM | | VFAGKNSDLEA | |
| SRSGFEMVW | | SRSGFEMVW | | TGTFEFTSFF | | VFAGKNTDLEA | |
| SRSGFEVLF | | SRSGFEVLF | | TGTGYTMDTV | | VFAGKNTDLEV | |
| SRSGFEVLL | | SRSGFEVLL | | TGTLNRLIDK | | VFCGTSGTYGA | |
| SRSGYEILK | | SRSGYEILK | | TGTNRPILVI | | VFCGTSGTYGK | |
| SRSGYEMLK | | SRSGYEMLK | | TGTNRPVLII | | VFCGTSGTYGS | |
| SRSGYETFK | | SRSGYETFK | | TGTNRPVLVI | | VFCGTSGTYGT | |
| SRSGYETFR | | SRSGYETFR | | TGTNRPVLVV | | VFCGVSGEVPG | |
| SRSGYEVLK | | SRSGYEVLK | | TGTNSFYRNL | | VFCGVSSEAPG | |
| SRSIIFNME | | SRSIIFNME | | TGTSSFYRNL | | VFCGVSSEVPG | |
| SRSLKLAIG | | SRSLKLAIG | | TGTWDTLIER | | VFFCLKNGNMR | |
| SRSNIFNME | | SRSNIFNME | | TGTYCSLNGI | | VFFCLRNGNMR | |
| SRSPGNAEI | | SRSPGNAEI | | TGTYCSLNGV | | VFICIKNGNMQ | |
| SRSSCHDGK | | SRSSCHDGK | | TGTYDYPKYE | | VFICIKNGNMR | |
| SRSSFYAEM | | SRSSFYAEM | | TGVDEYSSTE | | VFICMKNGNMQ | |
| SRTELINPN | | SRTELINPN | | TGVESAVLRG | | VFICVKNGNMR | |
| SRTELINPS | | SRTELINPS | | TGVLTDTSRP | | VFIERPTAVDT | |
| SRTELIPPS | | SRTELIPPS | | TGVPVTSSVD | | VFIIREPFVSC | |
| SRTELISPN | | SRTELISPN | | TGVTLSVVSL | | VFMCVKNGNMR | |
| SRTELISPS | | SRTELISPS | | TGVWWTSNSI | | VFNTIGNLIAP | |
| SRTHQYSEK | | SRTHQYSEK | | TGWILGNPMC | | VFNTIGNLVAP | |
| SRTREILTK | | SRTREILTK | | TGWPWPDGAL | | VFPNEVGAKIL | |
| SRTREILTR | | SRTREILTR | | TGWSWPDGAL | | VFPNEVGARII | |
| SRTRGILTK | | SRTRGILTK | | TGYAQTDCVL | | VFPNEVGARIL | |
| SRVDNHSMS | | SRVDNHSMS | | TGYEKNATAS | | VFPQLNQTYRN | |
| SRVLTDTSR | | SRVLTDTSR | | TGYHFEECSC | | VFREQKQEFKM | |
| SRYGYEMLK | | SRYGYEMLK | | TGYICSKFHS | | VFSGKNTDLEA | |
| SRYICSGLV | | SRYICSGLV | | TGYTMDTVNR | | VFSIAASYKRI | |
| SRYSKADKI | | SRYSKADKI | | TGYTMDTVSR | | VFSNAASYKRI | |

Fig. 83-370

| Block size 8 | SIN | Block size 9 | SIN | Block size 10 | SIN | Block size 11 | SIN |
|---|---|---|---|---|---|---|---|
| SRYVCSGLV | | SRYVCSGLV | | TGYVCSKFHS | | VFSSAASYKRI | |
| SRYVCTGIL | | SRYVCTGIL | | THAKDILEKA | | VFSSAASYKRV | |
| SRYWAIRTR | | SRYWAIRTR | | THAKDILEKT | | VFTDGSATGPA | |
| SRYYMGECP | | SRYYMGECP | | THAKNILEKT | | VFTLTVPSERG | |
| SSAASYKRI | | SSAASYKRI | | THALRELWQC | | VFVALILGFVL | |
| SSAASYKRV | | SSAASYKRV | | THAQDILEKT | | VFVIREPCISC | |
| SSACLRGGR | | SSACLRGGR | | THAQDILERT | | VFVIREPFISC | |
| SSAQEKNDL | | SSAQEKNDL | | THDRTAFRGL | | VFVIREPFVAC | |
| SSASCHDGR | | SSASCHDGR | | THESECVCIN | | VFVIREPFVSC | |
| SSCAAMDDF | | SSCAAMDDF | | THFHRKRRVR | | VFWGTSGTYGT | |
| SSCFDGKEW | | SSCFDGKEW | | THFQRKRRIR | | VFWTSNSIVAL | |
| SSCFDGREW | | SSCFDGREW | | THFQRKRRVR | | VGAKILTSESQ | |
| SSCHDGKAW | | SSCHDGKAW | | THGALLNDKH | | VGARIITSESQ | |
| SSCHDGKSW | | SSCHDGKSW | | THGSLLNDKH | | VGARILASESQ | |
| SSCHDGNAW | | SSCHDGNAW | | THHMRKKRGL | | VGARILTSESQ | |
| SSCHDGRAW | | SSCHDGRAW | | THIHIFSFNG | | VGARPQVNGQS | |
| SSCYDGKAW | | SSCYDGKAW | | THIHIFSFTG | | VGCVILLNPFV | |
| SSDDFALIL | | SSDDFALIL | | THIMIWHSNL | | VGDTPRNDDRF | |
| SSDDFALIV | | SSDDFALIV | | THISVGTSTL | | VGDTPRNDDRS | |
| SSDICYPGK | | SSDICYPGK | | THKQLTHHMR | | VGDTPRNDDSS | |
| SSDICYPGR | | SSDICYPGR | | THLEICFMYS | | VGDTPRNEDGS | |
| SSDKVDTLL | | SSDKVDTLL | | THLEVCFMYS | | VGDTPRNEDSS | |
| SSDNEQTDL | | SSDNEQTDL | | THLMIWHSNL | | VGDTPRNGDSS | |
| SSDTVDTLT | | SSDTVDTLT | | THMEVCFMYS | | VGDTPRNNDGS | |
| SSEAPGWSW | | SSEAPGWSW | | THMMIWHSNL | | VGGIDTNKTFQ | |
| SSEKVDTLL | | SSEKVDTLL | | THNGKLCKLN | | VGGINTNKTFQ | |
| SSEKVNTLL | | SSEKVNTLL | | THNGKLCRLR | | VGGINTNRTFQ | |
| SSEQAAEAI | | SSEQAAEAI | | THNGKLCRLS | | VGGNEKKAKLA | |
| SSEQAAEAM | | SSEQAAEAM | | THQYSEKGKW | | VGGSGTDNYGV | |
| SSERVDTLL | | SSERVDTLL | | THQYSEKGRW | | VGGSGTNNYGV | |
| SSEVPEWSW | | SSEVPEWSW | | THQYSERGKW | | VGIAADKESTQ | |
| SSEVPGWSW | | SSEVPGWSW | | THQYSERGRW | | VGINMSKKKSY | |
| SSFEKFEIF | | SSFEKFEIF | | THSWIPKRNR | | VGINMSKRKSY | |
| SSFEQITFM | | SSFEQITFM | | THSWTPKRNR | | VGKCNDPYPGN | |
| SSFERFEIF | | SSFERFEIF | | THSWVPILNT | | VGKCNEPYPGN | |
| SSFERFEMF | | SSFERFEMF | | THSWVPKRNR | | VGKCPRYVKQS | |
| SSFFRNIVW | | SSFFRNIVW | | THTERGVEVV | | VGLILAFILWA | |
| SSFFRNMVW | | SSFFRNMVW | | THTGTSKACN | | VGLILAFIMWA | |
| SSFFRNVVW | | SSFFRNVVW | | THTSQYICSP | | VGLILAFIMWT | |
| SSFQVDCFI | | SSFQVDCFI | | THVQNNYTTI | | VGLILSFIMWA | |
| SSFQVDCFL | | SSFQVDCFL | | THVQNNYTTV | | VGLILTFIMWA | |
| SSFSFGGFT | | SSFSFGGFT | | TIAGFIEGGW | | VGLLLQIISLC | |
| SSFYAEMEW | | SSFYAEMEW | | TIALFIGVGN | | VGLLLQITSLC | |
| SSFYAEMKW | | SSFYAEMKW | | TIALIIGVGN | | VGLLLQVTSLC | |
| SSFYRNLIW | | SSFYRNLIW | | TIALLIGIGN | | VGLRNTPSIDP | |
| SSFYRNLLW | | SSFYRNLLW | | TIALLIGVGN | | VGLRNTPSIEP | |
| SSFYRNLVW | | SSFYRNLVW | | TIASDILKRM | | VGLRNTPSVEP | |
| SSFYRNVVW | | SSFYRNVVW | | TIASDILTRM | | VGLVFFCLKNG | |
| SSFYSEMKW | | SSFYSEMKW | | TIASSLPFQN | | VGMAADKESTQ | |
| SSGGLLAPR | | SSGGLLAPR | | TICIGYHANN | | VGNDNWSGYSG | |
| SSGIAIALG | | SSGIAIALG | | TICIQGNNDN | | VGNGCFEFYHK | |
| SSGIAIVLG | | SSGIAIVLG | | TICVGYHANN | | VGNLAFNTVIH | |
| SSGNCRFNV | | SSGNCRFNV | | TICVQGNNDN | | VGNLIFNTVIH | |
| SSGNCRFSV | | SSGNCRFSV | | TICVQGNNKN | | VGNLVFNTVIH | |
| SSGNNQVFP | | SSGNNQVFP | | TICVQGNNNN | | VGNPSCASNIN | |
| SSGSLEFIA | | SSGSLEFIA | | TIDEESRARI | | VGNPSCATNIN | |
| SSGSLKLAI | | SSGSLKLAI | | TIDLADSEMD | | VGPGSFPDGAQ | |
| SSGTSKACN | | SSGTSKACN | | TIDLADSEML | | VGPILSFIMWA | |
| SSGTSKACS | | SSGTSKACS | | TIDLADSEMN | | VGRCPRYVKQS | |
| SSGTVKDRS | | SSGTVKDRS | | TIDLAESEMN | | VGRMTICIQGN | |
| SSGYKDIIL | | SSGYKDIIL | | TIDLANSEMN | | VGRMTICVQGN | |
| SSGYKDVII | | SSGYKDVII | | TIDLTDAEMN | | VGSGSFPDGAK | |

Fig. 83-371

| Block size 8 | SIN | Block size 9 | SIN | Block size 10 | SIN | Block size 11 | SIN |
|---|---|---|---|---|---|---|---|
| SSGYKDVIL | | SSGYKDVIL | | TIDLTDSEMN | | VGSGSFPDGAQ | |
| SSGYKEVIL | | SSGYKEVIL | | TIDLTDSEMS | | VGSGSFPDGAR | |
| SSIAFCGVD | | SSIAFCGVD | | TIDLTNSEMN | | VGSGSFPNGAQ | |
| SSIAFCGVN | | SSIAFCGVN | | TIDMADSEML | | VGSRGHVFVIR | |
| SSIDLVETN | | SSIDLVETN | | TIDMTDSEMN | | VGSSIYQNSFV | |
| SSIGKVCRT | | SSIGKVCRT | | TIDQVTGKLN | | VGSSKYQQSFS | |
| SSIKEKDMT | | SSIKEKDMT | | TIDVADSEMN | | VGSSKYRQSFS | |
| SSIKKYERV | | SSIKKYERV | | TIDVTDSEMD | | VGSSTYHNSFV | |
| SSIKRYERV | | SSIKRYERV | | TIDVTDSEMN | | VGSSTYQNNFV | |
| SSILTDSQT | | SSILTDSQT | | TIDVTDSEMS | | VGSSTYQNSFV | |
| SSISFCGVD | | SSISFCGVD | | TIEKMVLSAF | | VGSWSQNILRT | |
| SSISFCGVN | | SSISFCGVN | | TIEMTDSEML | | VGTRWMKIIRV | |
| SSISFCGVS | | SSISFCGVS | | TIERMVLSAF | | VGVAPSPSNSR | |
| SSIVLVGLI | | SSIVLVGLI | | TIGDCPKYMN | | VGWSATACHDG | |
| SSIVMCGVD | | SSIVMCGVD | | TIGDCPKYVN | | VGWSSTSCHDG | |
| SSIVMCGVN | | SSIVMCGVN | | TIGECPKYIK | | VGWSSTTCHDG | |
| SSIVMVGLI | | SSIVMVGLI | | TIGECPKYVK | | VGWTSNSIVVF | |
| SSIYIEVLH | | SSIYIEVLH | | TIGECPKYVR | | VGYHANNSTDT | |
| SSIYQNSFV | | SSIYQNSFV | | TIGECPRYVK | | VGYHANNSTKQ | |
| SSKANQVFP | | SSKANQVFP | | TIGISGPDDG | | VGYHSNNSTEK | |
| SSKCQQSFT | | SSKCQQSFT | | TIGISGPDNE | | VGYICSGVFGD | |
| SSKDNQVFP | | SSKDNQVFP | | TIGISGPDNG | | VGYLCAGIPSD | |
| SSKPFHNIH | | SSKPFHNIH | | TIGISGPDSG | | VGYLCAGIPTD | |
| SSKPFQNAS | | SSKPFQNAS | | TIGITGPDAT | | VGYLCAGLPSD | |
| SSKPFQNTS | | SSKPFQNTS | | TIGKCPKYVK | | VGYLSTNSSDK | |
| SSKPLQNAS | | SSKPLQNAS | | TIGKCSKYVK | | VGYLSTNSSEK | |
| SSKYQQSFS | | SSKYQQSFS | | TIGLLLQIIS | | VGYLSTNSSER | |
| SSKYQQSFT | | SSKYQQSFT | | TIGLLLQITS | | VGYLSTNSTEK | |
| SSKYRQSFS | | SSKYRQSFS | | TIGNCPKYVN | | VHDRIPHRTLL | |
| SSLAVNVRG | | SSLAVNVRG | | TIGNLIAPRG | | VHFQNQVKIRR | |
| SSLDEQNKL | | SSLDEQNKL | | TIGNLVAPRG | | VHFRNQIKIRR | |
| SSLILAAII | | SSLILAAII | | TIGPLLQITS | | VHFRNQVKIRR | |
| SSLILAALI | | SSLILAALI | | TIGSVSLIIA | | VHFRSQVKIRR | |
| SSLLLQANL | | SSLLLQANL | | TIGSVSLTIA | | VHHPSSDNEQT | |
| SSLMWEING | | SSLMWEING | | TIGSVSLTIT | | VHHSSSLDEQN | |
| SSLPFHNVH | | SSLPFHNVH | | TIGVSGPDNG | | VHIGPLSGSAQ | |
| SSLPFQNIN | | SSLPFQNIN | | TIHDGTAFRG | | VHISPLAGSAQ | |
| SSLPFQNIS | | SSLPFQNIS | | TIHDRAAFRG | | VHISPLSGSAQ | |
| SSLPLALGM | | SSLPLALGM | | TIHDRIPHRT | | VHISSLSGSAQ | |
| SSLSGSAQH | | SSLSGSAQH | | TIHDRSPFRA | | VHKSQLIWMAC | |
| SSLTHALRE | | SSLTHALRE | | TIHDRSPHRT | | VHKSQLVWMAC | |
| SSLTVNVRG | | SSLTVNVRG | | TIHDRSPYRA | | VHLGDCNFEGW | |
| SSLTVSVRG | | SSLTVSVRG | | TIHDRSQFRA | | VHLGDCRFEGW | |
| SSLVLAAII | | SSLVLAAII | | TIHDRSQYRA | | VHLGDCSFEGW | |
| SSLVLAALI | | SSLVLAALI | | TIHDRSQYRS | | VHPLTIGECPK | |
| SSLVLAALN | | SSLVLAALN | | TIHDRTAFRG | | VHPLTIGECPR | |
| SSLVLIVSL | | SSLVLIVSL | | TIHDRTPHRT | | VHRNAIGDCPK | |
| SSLVLLFMI | | SSLVLLFMI | | TIHDRTTFRG | | VHRNTFGDCPK | |
| SSLVLLLMI | | SSLVLLLMI | | TIHLTDSEMN | | VHRNTIGDCPK | |
| SSLVLLVSL | | SSLVLLVSL | | TIIENNVTVT | | VHRSTIGDCPK | |
| SSLVLMGLI | | SSLVLMGLI | | TIIESNVTVT | | VHVSPLSGSAQ | |
| SSLVLVGLI | | SSLVLVGLI | | TIIETGYVCS | | VIAARNIVRRA | |
| SSLVLVGLV | | SSLVLVGLV | | TIIFEANGNL | | VIAKDNAIRFG | |
| SSLVLVVSL | | SSLVLVVSL | | TIIFEASGNL | | VIAKDNAVRFG | |
| SSMGEAMVS | | SSMGEAMVS | | TIIFEATGNL | | VIAQDNAIRFG | |
| SSMGIYQIL | | SSMGIYQIL | | TIIGPPQCDL | | VIASTTAKAME | |
| SSMGVYQIL | | SSMGVYQIL | | TIIGPPQCDS | | VIDGWTTANSK | |
| SSMMEAMVS | | SSMMEAMVS | | TIIKTLTNEK | | VIDWTRDSVTE | |
| SSMMWEING | | SSMMWEING | | TIINNYHNET | | VIEKDNAVRFG | |
| SSMMWEVNG | | SSMMWEVNG | | TIINNYYNDT | | VIGARPQVNGQ | |
| SSMNNQVFP | | SSMNNQVFP | | TIINNYYNET | | VIGGWATANSK | |
| SSMPFHNIH | | SSMPFHNIH | | TIINNYYNKT | | VIGGWTIANSK | |

Fig. 83-372

| Block size 8 | SIN | Block size 9 | SIN | Block size 10 | SIN | Block size 11 | SIN |
|---|---|---|---|---|---|---|---|
| SSMPFHNVH | | SSMPFHNVH | | TIISNLPFQN | | VIGGWTTANSK | |
| SSMPLHNIH | | SSMPLHNIH | | TIISSLPFQN | | VIHYGGIPTDV | |
| SSMQCRICI | | SSMQCRICI | | TIIYSSSMMW | | VIHYGGMPTDV | |
| SSMVEAMIS | | SSMVEAMIS | | TIKDRSPYRT | | VIHYGGVPTDV | |
| SSMVEAMMS | | SSMVEAMMS | | TIKNGTYDHK | | VIITREPYVSC | |
| SSMVEAMVS | | SSMVEAMVS | | TIKNGTYNHK | | VIKLLPFAAAP | |
| SSNCKDPNN | | SSNCKDPNN | | TIKNGTYNHQ | | VIKNNMINNDL | |
| SSNCRDPNN | | SSNCRDPNN | | TIKNGTYNRK | | VIKNNMVNNDL | |
| SSNCRDSNN | | SSNCRDSNN | | TIKPWARNIL | | VIKYNGIITDT | |
| SSNCRNPNN | | SSNCRNPNN | | TIKQNGKSGA | | VILEENTTYKI | |
| SSNYHQSFV | | SSNYHQSFV | | TIKTWAGKIL | | VILLNPFVSHK | |
| SSNYQQSFV | | SSNYQQSFV | | TIKTWAGNIL | | VILVLGLSMVK | |
| SSPMMWEIN | | SSPMMWEIN | | TIKTWAKNIL | | VILVLGLSMVR | |
| SSPNAYQAK | | SSPNAYQAK | | TIKTWARNIL | | VILWFSFGASC | |
| SSPNAYQAR | | SSPNAYQAR | | TILEKNITVT | | VILWFSLGASC | |
| SSPPTVYNN | | SSPPTVYNN | | TILEKNVTVT | | VIMEVVFPNEV | |
| SSPPTVYNS | | SSPPTVYNS | | TILEQNVTVT | | VIMTDGPANSQ | |
| SSPPTVYNT | | SSPPTVYNT | | TILERNVTVT | | VIMTDGPASSQ | |
| SSQDTELSF | | SSQDTELSF | | TILETGYICS | | VIMTDGSANSQ | |
| SSQLEGFSA | | SSQLEGFSA | | TILETGYVCG | | VIMTDGSASSQ | |
| SSRHCSKYH | | SSRHCSKYH | | TILETGYVCS | | VINDKIDDQIE | |
| SSRISFYWT | | SSRISFYWT | | TILETRYVCS | | VINFESTGNLI | |
| SSRNGFEIL | | SSRNGFEIL | | TILRTQESEC | | VINTSKPFQNT | |
| SSRPFQNAS | | SSRPFQNAS | | TIMEKNITVT | | VINWTKDSITD | |
| SSRSGFEIL | | SSRSGFEIL | | TIMEKNVIFT | | VINWTQDAMTE | |
| SSRSGFEVL | | SSRSGFEVL | | TIMEKNVTVT | | VINWTRDAMTE | |
| SSSACLRGG | | SSSACLRGG | | TIMEKSVTVS | | VINWTRDSIIE | |
| SSSCFDGKE | | SSSCFDGKE | | TIMERNVTVT | | VINWTRDSITE | |
| SSSCFDGRE | | SSSCFDGRE | | TINDRSPFRA | | VINWTRDSLTE | |
| SSSCHDGKA | | SSSCHDGKA | | TINDRTAFRG | | VINWTRDSMTE | |
| SSSCHDGKS | | SSSCHDGKS | | TINEEALRQK | | VINWTRDSVTE | |
| SSSCHDGNA | | SSSCHDGNA | | TINFESTGNL | | VIPLTTTPTKS | |
| SSSCHDGRA | | SSSCHDGRA | | TINNITNVVL | | VIPSGPLKAEI | |
| SSSCYDGKA | | SSSCYDGKA | | TINRIFQPNI | | VIREPFISCSH | |
| SSSFSFGGF | | SSSFSFGGF | | TINRNFQPNI | | VIREPFISCSI | |
| SSSFYAEMK | | SSSFYAEMK | | TINRSFQPNI | | VIREPFISCSP | |
| SSSGNNQVF | | SSSGNNQVF | | TINRSFRPNI | | VIREPFISCSQ | |
| SSSGTSKAC | | SSSGTSKAC | | TINSPLPFQN | | VIREPFISCSV | |
| SSSIVMCGV | | SSSIVMCGV | | TINSWHIFGK | | VIREPFVACGP | |
| SSSIVVFCG | | SSSIVVFCG | | TINSWHIYGK | | VIREPFVACSP | |
| SSSLDEQNK | | SSSLDEQNK | | TINYYNETFV | | VIREPFVSCGP | |
| SSSLMWEIN | | SSSLMWEIN | | TIPCFWVEMI | | VIREPFVSCSI | |
| SSSLVLAGL | | SSSLVLAGL | | TIQIIKLLPF | | VIREPFVSCSP | |
| SSSLVLMGL | | SSSLVLMGL | | TIQNEDIPIG | | VIRNNMINNDL | |
| SSSLVLVGL | | SSSLVLVGL | | TIRGKHSNGT | | VIRSWRKQILR | |
| SSSMMWEIN | | SSSMMWEIN | | TIRGRHSNGT | | VISFESTGNLI | |
| SSSMMWEVN | | SSSMMWEVN | | TIRNGTYDHT | | VISGWTTANSK | |
| SSSMNNQVF | | SSSMNNQVF | | TIRNGTYNHA | | VITDTLKSWKG | |
| SSSNAYQAK | | SSSNAYQAK | | TIRNGTYNHE | | VIVTREPYISC | |
| SSSNCKDPN | | SSSNCKDPN | | TIRNGTYNHI | | VIVTREPYVSC | |
| SSSNCRDPN | | SSSNCRDPN | | TIRNGTYNHK | | VIYGNPKCDIH | |
| SSSNCRDSN | | SSSNCRDSN | | TIRNGTYNHQ | | VIYGNPKCDTH | |
| SSSNCRNPN | | SSSNCRNPN | | TIRNGTYNHR | | VIYGNPKCDVH | |
| SSSSCFDGK | | SSSSCFDGK | | TIRNGTYNHS | | VKAVRGDLNFV | |
| SSSSCFDGR | | SSSSCFDGR | | TIRNGTYNHT | | VKCICRDNWKG | |
| SSSSCHDGK | | SSSSCHDGK | | TIRNKHSNGT | | VKCVCRDNWKG | |
| SSSSCHDGN | | SSSSCHDGN | | TIRNKHSNST | | VKCYQFALGQG | |
| SSSSCHDGR | | SSSSCHDGR | | TIRNRHSNGT | | VKDRSPFRTLM | |
| SSSSCYDGK | | SSSSCYDGK | | TIRTGTYNHR | | VKDRSPYRALM | |
| SSSSFYAEM | | SSSSFYAEM | | TIRTWAKNIL | | VKDRSPYRTLM | |
| SSSSIVMCG | | SSSSIVMCG | | TISFESTGNL | | VKEAQDVIMEV | |
| SSSSTVFCG | | SSSSTVFCG | | TISIASRSGY | | VKEIGNGCFEF | |

Fig. 83-373

| Block size 8 | SIN | Block size 9 | SIN | Block size 10 | SIN | Block size 11 | SIN |
|---|---|---|---|---|---|---|---|
| SSSSVVMCG | | SSSSVVMCG | | TISKDLRSGY | | VKELGNGCFEF | |
| SSSTVFCGV | | SSSTVFCGV | | TISKDSRSGY | | VKGDKICLGHH | |
| SSSVLLVSL | | SSSVLLVSL | | TISKDTRSGY | | VKGDQICIGYH | |
| SSSVVMCGV | | SSSVVMCGV | | TISLVKTTLF | | VKGDRICIGYH | |
| SSSYRRPIG | | SSSYRRPIG | | TISMDSRSGY | | VKGDYNNTTGR | |
| SSSYRRPVG | | SSSYRRPVG | | TISPHSRSGF | | VKGEYNNTTGR | |
| SSTEFLGQW | | SSTEFLGQW | | TISPKLRSGF | | VKGFAFKQGNS | |
| SSTKEKNDL | | SSTKEKNDL | | TISPRLRSGF | | VKGFGFRQGDD | |
| SSTKEKNEL | | SSTKEKNEL | | TISPRSRNGF | | VKGFGFRQGND | |
| SSTQEKNDL | | SSTQEKNDL | | TISPRSRSGF | | VKGFGFRQGNS | |
| SSTQERNDL | | SSTQERNDL | | TISRDSRSGY | | VKGFGFRQGSD | |
| SSTSCFDGK | | SSTSCFDGK | | TISTASRAGY | | VKGFGFRQGTD | |
| SSTSCHDGI | | SSTSCHDGI | | TISTASRSGY | | VKGFGFRQGTS | |
| SSTSCHDGK | | SSTSCHDGK | | TITFEATGNL | | VKGFSFRYGDG | |
| SSTSCHDGM | | SSTSCHDGM | | TITFSFNGAF | | VKGRSHLRNDT | |
| SSTSCHDGR | | SSTSCHDGR | | TITGDNTKWN | | VKGWAFDNGDD | |
| SSTSCHDGV | | SSTSCHDGV | | TITLHFKQNE | | VKGWAFDNGND | |
| SSTTCHDGI | | SSTTCHDGI | | TITNPLIRHE | | VKGWAFDSGDD | |
| SSTTCHDGV | | SSTTCHDGV | | TITSNLPFQN | | VKGWAFDYGND | |
| SSTVFCGVS | | SSTVFCGVS | | TITSPLPFQN | | VKGWAFDYGSD | |
| SSTVLVGLI | | SSTVLVGLI | | TITYSSPMMW | | VKGWAPLSKDN | |
| SSTVMVGLI | | SSTVMVGLI | | TITYSSSLMW | | VKIKTNGNLIA | |
| SSTYHNSFV | | SSTYHNSFV | | TITYSSSMMW | | VKIQTNGNLIA | |
| SSTYQNNFV | | SSTYQNNFV | | TIVEKNVTVT | | VKIQTSGNLIA | |
| SSTYQNSFV | | SSTYQNSFV | | TIVETGYVCS | | VKIRRRVDINP | |
| SSVASSLVL | | SSVASSLVL | | TIVKTLTNEK | | VKIRRRVDMNP | |
| SSVDLVETN | | SSVDLVETN | | TIVKTLTNEQ | | VKIRRRVDTNP | |
| SSVKEKDLT | | SSVKEKDLT | | TIVKTLTSEK | | VKIRRRVDVNP | |
| SSVKEKDMT | | SSVKEKDMT | | TIVLDTDWSG | | VKKQLRENAEE | |
| SSVLLVSLG | | SSVLLVSLG | | TIVLNTDWSG | | VKLEENSTYKI | |
| SSVNTNTIN | | SSVNTNTIN | | TIVSNTDWSG | | VKLEENTSYKI | |
| SSVREKDMT | | SSVREKDMT | | TIVSSLPFQN | | VKLEENTTYKI | |
| SSVSSFEKF | | SSVSSFEKF | | TIVSSLPFQS | | VKLEENTTYRI | |
| SSVSSFERF | | SSVSSFERF | | TIWASGSSIS | | VKLSGGYKDII | |
| SSVSSFKRF | | SSVSSFKRF | | TIWTSASSIS | | VKLSGGYKDVI | |
| SSVTTNTIN | | SSVTTNTIN | | TIWTSGSIIS | | VKLSNMGIYQI | |
| SSVVLVGLI | | SSVVLVGLI | | TIWTSGSSIA | | VKLSNMGVYQI | |
| SSVVLVGPI | | SSVVLVGPI | | TIWTSGSSIS | | VKLSSGYKDII | |
| SSVVMCGVD | | SSVVMCGVD | | TIWTSSSSIV | | VKLSSGYKDVI | |
| SSVYIEVLH | | SSVYIEVLH | | TIWTSSSSVV | | VKLSSGYKEVI | |
| SSVYVEVLH | | SSVYVEVLH | | TIYSTAASSL | | VKLSSGYKNVI | |
| SSWHILSKD | | SSWHILSKD | | TIYSTVASPL | | VKLSSMGIYQI | |
| SSYICSGLV | | SSYICSGLV | | TIYSTVASSF | | VKLSSMGVYQI | |
| SSYLCSGLV | | SSYLCSGLV | | TIYSTVASSI | | VKLYKKLKREI | |
| SSYMCSGLV | | SSYMCSGLV | | TIYSTVASSL | | VKLYKKLKREM | |
| SSYRRPIGI | | SSYRRPIGI | | TIYWWDGLQS | | VKLYRKLKREI | |
| SSYRRPVGI | | SSYRRPVGI | | TKALLIGIGN | | VKMEKIVLLLA | |
| SSYVCSGLV | | SSYVCSGLV | | TKAPQLNPID | | VKMFDFIKWNV | |
| STAASSLAL | | STAASSLAL | | TKATKMEAIL | | VKMFDFSKWNV | |
| STAASSLVL | | STAASSLVL | | TKATKMKAII | | VKMFDFTKWNV | |
| STASRSGYE | | STASRSGYE | | TKATKMKAIL | | VKMKWGMEMRR | |
| STAVAVIKY | | STAVAVIKY | | TKATNGNYGP | | VKMNPNQKIIT | |
| STCVVVMTD | | STCVVVMTD | | TKCQLNEGVM | | VKMQLRDNAKE | |
| STDKDSNGV | | STDKDSNGV | | TKCQSPLGAI | | VKNGNHAVHYC | |
| STDKIDTLT | | STDKIDTLT | | TKCQTPLGAI | | VKNGNLRCTIC | |
| STDKNSNGV | | STDKNSNGV | | TKCQTPLGAL | | VKNGNMQCTIC | |
| STDKVDTII | | STDKVDTII | | TKCQTSLGGI | | VKNGNMRCTIC | |
| STDKVDTLT | | STDKVDTLT | | TKCQTSLGGV | | VKNGNMRGTNW | |
| STDKVNTII | | STDKVNTII | | TKCQTSMGGI | | VKNGTYDYPKY | |
| STDSEMNKL | | STDSEMNKL | | TKCQTSMGGV | | VKNGTYNYPKY | |
| STDTVDTIL | | STDTVDTIL | | TKCQTSVGGI | | VKNLFDEVKRR | |
| STDTVDTLI | | STDTVDTLI | | TKCQTYAGAI | | VKNLFDEVRRR | |

Fig. 83-374

| Block size 8 | SIN | Block size 9 | SIN | Block size 10 | SIN | Block size 11 | SIN |
|---|---|---|---|---|---|---|---|
| STDTVDTLL | | STDTVDTLL | | TKCQTYAGAV | | VKNLYDKVRLQ | |
| STDTVDTLT | | STDTVDTLT | | TKCQTYTGAI | | VKNLYDKVRMQ | |
| STDTVDTVL | | STDTVDTVL | | TKDAERGKLK | | VKNLYDRVRLQ | |
| STDTVNTLI | | STDTVNTLI | | TKDNSIRIGS | | VKNLYEKVRLQ | |
| STDTVNTLM | | STDTVNTLM | | TKDNSIRLSA | | VKNLYEKVRMQ | |
| STDTVNTLT | | STDTVNTLT | | TKDSITDIWT | | VKNLYNKVRMQ | |
| STEFLGQWD | | STEFLGQWD | | TKEAQDVIME | | VKQDGKSSACK | |
| STEFLGQWN | | STEFLGQWN | | TKEGRRKTNL | | VKQESLLLATG | |
| STEKVDTII | | STEKVDTII | | TKEGRRRTNL | | VKQESLMLATG | |
| STEKVDTLL | | STEKVDTLL | | TKEMEGICYP | | VKQGSLKLATG | |
| STEQVDTIM | | STEQVDTIM | | TKENTGSYVR | | VKQGSLMLATG | |
| STERVDTII | | STERVDTII | | TKEQTALYKN | | VKQGSLRLATG | |
| STERVDTIM | | STERVDTIM | | TKEQTTLYKN | | VKQKSILLATG | |
| STETVNTLI | | STETVNTLI | | TKETNGNYGP | | VKQKSLLLATG | |
| STETVNTLS | | STETVNTLS | | TKEWSKRYEL | | VKQKTLKLATG | |
| STETVNTLT | | STETVNTLT | | TKEWSRRYEL | | VKQNGKSGACK | |
| STGALASCM | | STGALASCM | | TKGDKICLGH | | VKQNGKSSACK | |
| STGAQSFYR | | STGAQSFYR | | TKGEKANVLI | | VKQNTLKLATG | |
| STGGQAFYR | | STGGQAFYR | | TKGILGFVFT | | VKQSSLPLALG | |
| STGGQSFYR | | STGGQSFYR | | TKGKKAVDLG | | VKQSTLKLATG | |
| STGKDPKKT | | STGKDPKKT | | TKGLCTINSW | | VKQTSLLLATG | |
| STGNFIAPE | | STGNFIAPE | | TKGMLGFVFT | | VKRGINDRNFW | |
| STGNHGSLV | | STGNHGSLV | | TKGVLGFVFT | | VKRLLRENAEE | |
| STGNLIAPE | | STGNLIAPE | | TKHDRIPHRT | | VKRQLRENAED | |
| STGNLIAPR | | STGNLIAPR | | TKIDLWSYNA | | VKRQLRENAEE | |
| STGNLVAPE | | STGNLVAPE | | TKILFIEEGK | | VKRRPVAKAGF | |
| STIALFIGV | | STIALFIGV | | TKILYFHKGL | | VKSDKICLGHH | |
| STIALIIGV | | STIALIIGV | | TKIMYFHKGL | | VKSDRLVLAIG | |
| STIALLIGI | | STIALLIGI | | TKINNIIDKM | | VKSDRLVLATG | |
| STIALLIGV | | STIALLIGV | | TKINNIIEKM | | VKSEKLVLATG | |
| STIGDCPKY | | STIGDCPKY | | TKINTLTERG | | VKSERLVLATG | |
| STISCDSPS | | STISCDSPS | | TKITVDHMAI | | VKSITQTLVSN | |
| STKALLIGI | | STKALLIGI | | TKKEPDTYDF | | VKSLYDKVRMQ | |
| STKEKNDLY | | STKEKNDLY | | TKKKNPEAYN | | VKSVTQTLVSN | |
| STKEKNELY | | STKEKNELY | | TKKKPDIYDF | | VKTLTDNHVEV | |
| STKEWSKRY | | STKEWSKRY | | TKKKPDTYDF | | VKTWAGNILRT | |
| STKEWSRRY | | STKEWSRRY | | TKKMTITFLI | | VKVDGSSSACL | |
| STKQVDTIM | | STKQVDTIM | | TKKQLRENAE | | VKYSRADKICI | |
| STKSTVLKS | | STKSTVLKS | | TKLGSPLVLD | | VKYVWWTSNSL | |
| STLGLDIRT | | STLGLDIRT | | TKLPFQNLSP | | VLAIGLRNVPQ | |
| STLKLATGM | | STLKLATGM | | TKLYGNGNKL | | VLAIYSCIASS | |
| STLPRRSGA | | STLPRRSGA | | TKLYGSGNKL | | VLASTTAKAME | |
| STLVLLVSL | | STLVLLVSL | | TKLYGSGSKL | | VLATGLRNIPQ | |
| STMLNLYER | | STMLNLYER | | TKLYKNTNTL | | VLATGLRNVPQ | |
| STMSCDSPS | | STMSCDSPS | | TKLYVNKNPY | | VLATGPRNVPQ | |
| STNAHDRIC | | STNAHDRIC | | TKMEAILVVL | | VLDDCSLEGII | |
| STNAYDRIC | | STNAYDRIC | | TKMKAIIVVL | | VLDDCSLEGLI | |
| STNSSDKVD | | STNSSDKVD | | TKMKAILVVL | | VLDDCSLEGLV | |
| STNSSEKVD | | STNSSEKVD | | TKPRPRRGLF | | VLDDCSLKGLI | |
| STNSSEKVN | | STNSSEKVN | | TKQMCIAWSS | | VLDGVTASCLD | |
| STNSSERVD | | STNSSERVD | | TKQVCAAWSS | | VLDNKNWSGYS | |
| STNSTEKVD | | STNSTEKVD | | TKQVCIAWSS | | VLEAMAFLEDS | |
| STNTVNTLI | | STNTVNTLI | | TKQVCMAWSS | | VLEAMAFLEES | |
| STPLGSPPI | | STPLGSPPI | | TKQVCVAWSS | | VLEAMAFLEKS | |
| STPLGSPPM | | STPLGSPPM | | TKQVDTIMEK | | VLEAMAFLENS | |
| STPLGSPPV | | STPLGSPPV | | TKRLCTINSW | | VLEAMALLEES | |
| STPLGTPPT | | STPLGTPPT | | TKRQLRENAE | | VLEDEQMYQKC | |
| STPSAIDQI | | STPSAIDQI | | TKRSHEQMET | | VLEKNVTVTHS | |
| STQAAIDKI | | STQAAIDKI | | TKRSYEQMET | | VLELIRMIKRG | |
| STQAAIDQI | | STQAAIDQI | | TKSLESRRGF | | VLERNVTVTHS | |
| STQAAIDQV | | STQAAIDQV | | TKSLESRSGF | | VLFQGGHIEEC | |
| STQAAINQI | | STQAAINQI | | TKSTVLKSDK | | VLGDCSIAGWL | |

Fig. 83-375

| Block size 8 | SIN | Block size 9 | SIN | Block size 10 | SIN | Block size 11 | SIN |
|---|---|---|---|---|---|---|---|
| STQAAVDQI | | STQAAVDQI | | TKSYFANLKG | | VLGIINLLIGI | |
| STQAAVNQI | | STQAAVNQI | | TKTMTITFLI | | VLGLSMVKSDK | |
| STQATIDQI | | STQATIDQI | | TKTTVDHMAI | | VLGLSMVRSDK | |
| STQEAIDKI | | STQEAIDKI | | TKVDLWSYNA | | VLGNPKCDLYL | |
| STQEAIEKI | | STQEAIEKI | | TKVLYFHKGI | | VLGVSILNLGQ | |
| STQEAIGKI | | STQEAIGKI | | TKVLYFHKGL | | VLGVSVLNLGQ | |
| STQEAINKI | | STQEAINKI | | TKVMYFHKGL | | VLHLTQGACWE | |
| STQEKNDLY | | STQEKNDLY | | TKVNTLTEKG | | VLHLTQGTCWE | |
| STQERNDLY | | STQERNDLY | | TKVNTLTERG | | VLIAGGLILGM | |
| STQKAIDEI | | STQKAIDEI | | TKWNENQNPR | | VLIENDRTLDL | |
| STQKAIDGI | | STQKAIDGI | | TKWNVTHTGT | | VLIENQKTLDE | |
| STQKAIDGV | | STQKAIDGV | | TKWNVTYTGI | | VLIGQGDIVLV | |
| STQKAIDIM | | STQKAIDIM | | TKWNVTYTGT | | VLIGQGDVVLV | |
| STQKAIDNM | | STQKAIDNM | | TLCICYHANN | | VLINTYQWIIR | |
| STQKAIDQI | | STQKAIDQI | | TLCIGYHANN | | VLKPGQTVKIK | |
| STQKAIDRI | | STQKAIDRI | | TLCLGHHAVA | | VLKPGQTVKIQ | |
| STQKAINEI | | STQKAINEI | | TLCLGHHAVP | | VLKSDKRIGSC | |
| STQKAINGI | | STQKAINGI | | TLCLGHHAVQ | | VLKYKGIITGT | |
| STQKAINGV | | STQKAINGV | | TLCLGHHAVS | | VLKYNDIITDT | |
| STQKALNEI | | STQKALNEI | | TLDEESRARI | | VLKYNGIITDT | |
| STQKAVDGI | | STQKAVDGI | | TLDEHDANVR | | VLKYNGIITET | |
| STQKTIDQV | | STQKTIDQV | | TLDEHDSNVE | | VLKYNGIITGT | |
| STQMAIDNM | | STQMAIDNM | | TLDEHDSNVK | | VLKYNGVITDT | |
| STQPTFSVQ | | STQPTFSVQ | | TLDFHDSNVK | | VLLENDKTLDL | |
| STQRAIDGI | | STQRAIDGI | | TLDFHDSNVR | | VLLENDKTLDM | |
| STQRAIDGV | | STQRAIDGV | | TLDFHDSSVK | | VLLENDKTLNM | |
| STQRAIDNM | | STQRAIDNM | | TLDKHDSNVK | | VLLENDRTLDL | |
| STQSAIDQI | | STQSAIDQI | | TLDLHDANVK | | VLLENEKTLDL | |
| STQSAIDQV | | STQSAIDQV | | TLDLHDANVR | | VLLENERTLDF | |
| STQSAINQI | | STQSAINQI | | TLDLHDSNVK | | VLLENERTLDL | |
| STQSAVDQI | | STQSAVDQI | | TLDLHDSNVR | | VLLENERTLDY | |
| STQSAVNQI | | STQSAVNQI | | TLDMHDANVK | | VLLENGRTLDL | |
| STQTAIDQI | | STQTAIDQI | | TLDMHDANVR | | VLLENGRTLGL | |
| STRGIQIAS | | STRGIQIAS | | TLDMHDVNVK | | VLLENQKILDE | |
| STRGVQIAS | | STRGVQIAS | | TLDNEHSNGT | | VLLENQKPLDE | |
| STRGVQVAS | | STRGVQVAS | | TLDNKHSNDT | | VLLENQKTLDD | |
| STRSDQISI | | STRSDQISI | | TLDNKHSNGT | | VLLENQKTLDE | |
| STRSRSGFE | | STRSRSGFE | | TLDQHDANVK | | VLLENQKTLDK | |
| STSCFDGKE | | STSCFDGKE | | TLDYHDSNVK | | VLLFMIIGGFI | |
| STSCHDGIG | | STSCHDGIG | | TLEHTSRYVC | | VLLGNQKTLDE | |
| STSCHDGIS | | STSCHDGIS | | TLELRSGYWA | | VLLGSSPNAYQ | |
| STSCHDGKA | | STSCHDGKA | | TLELRSKYWA | | VLLGTKHSNGT | |
| STSCHDGKF | | STSCHDGKF | | TLELRSRYWA | | VLLKHRFEIIE | |
| STSCHDGKS | | STSCHDGKS | | TLENKHSNGT | | VLLLMIIGGFI | |
| STSCHDGKT | | STSCHDGKT | | TLFEKFFPSS | | VLLNASWFNSF | |
| STSCHDGMS | | STSCHDGMS | | TLFQQMRDIL | | VLLNDKHSNNT | |
| STSCHDGRA | | STSCHDGRA | | TLFQQMRDVI | | VLLSPEEVSEA | |
| STSCHDGRS | | STSCHDGRS | | TLFQQMRDVL | | VLLSPEEVSET | |
| STSCHDGVG | | STSCHDGVG | | TLGENMAPEK | | VLMENEITLDF | |
| STSCHDGVS | | STSCHDGVS | | TLGITGPDAT | | VLMENEMTLDF | |
| STSIVVFCG | | STSIVVFCG | | TLGITGPDST | | VLMENERILDF | |
| STSSRSGFE | | STSSRSGFE | | TLGITGPDTT | | VLMENERTLDF | |
| STTAKAMEQ | | STTAKAMEQ | | TLGLDIRTAT | | VLMENERTLDL | |
| STTCHDGIG | | STTCHDGIG | | TLGLHDANVR | | VLMENERTLDY | |
| STTFPYTGD | | STTFPYTGD | | TLHFKQHDCD | | VLMENERTLGF | |
| STTGMTLSV | | STTGMTLSV | | TLHFKQHECD | | VLMENERTLYF | |
| STTHDRTAF | | STTHDRTAF | | TLHFKQHECN | | VLMETERTLDF | |
| STVAASLCL | | STVAASLCL | | TLHFKQHKCD | | VLNLLIGISNI | |
| STVASSLAL | | STVASSLAL | | TLHFKQNECS | | VLNLLIGISNV | |
| STVASSLIL | | STVASSLIL | | TLIDALLGDP | | VLNLLIGVSNV | |
| STVASSLTL | | STVASSLTL | | TLIDAMLGDP | | VLNNKNWSGYS | |
| STVASSLVL | | STVASSLVL | | TLIENTYVNN | | VLNNMNWSGYS | |

Fig. 83-376

| Block size 8 | SIN | Block size 9 | SIN | Block size 10 | SIN | Block size 11 | SIN |
|---|---|---|---|---|---|---|---|
| STVASSSVL | | STVASSSVL | | TLIEQKVPVT | | VLNNRNWSGYS | |
| STVFCGVSG | | STVFCGVSG | | TLIEQNIPVT | | VLNTDWSGYSG | |
| STVFCGVSS | | STVFCGVSS | | TLIEQNVPVT | | VLRGFLIIGKE | |
| STVLGVSIL | | STVLGVSIL | | TLISWEMGQA | | VLRGFLILGKE | |
| STVLKSDKR | | STVLKSDKR | | TLITDGPSDA | | VLRGFLILGRE | |
| STVLVGLIL | | STVLVGLIL | | TLITDGPSNA | | VLRTQESECAC | |
| STVMVGLIL | | STVMVGLIL | | TLKGRHANGT | | VLSAFDERRNK | |
| STVNEEALR | | STVNEEALR | | TLKIRTNGNL | | VLSAFDERRNR | |
| STVQVDTIM | | STVQVDTIM | | TLKLATGMRN | | VLSCIFCLAFG | |
| STVSCDSPS | | STVSCDSPS | | TLKLGQFPVQ | | VLSIAPIMFSN | |
| STVSSFERF | | STVSSFERF | | TLKSEQFPVQ | | VLSIIPSGPLK | |
| STVSSSLVL | | STVSSSLVL | | TLKSGQFPVQ | | VLSIVPSGPLK | |
| STVVNNITT | | STVVNNITT | | TLKSWKGNIM | | VLSIYSCIASS | |
| STVVSSLAL | | STVVSSLAL | | TLKVESNGNL | | VLSVAPIMFSN | |
| STWLGRTIS | | STWLGRTIS | | TLLAKSVFNC | | VLSVIPSGPLK | |
| STYKILSIY | | STYKILSIY | | TLLAKSVFNN | | VLTDNPRPNDP | |
| STYQNNFVP | | STYQNNFVP | | TLLAKSVFNS | | VLTDTSKPSDK | |
| STYQNSFVP | | STYQNSFVP | | TLLEKNVTVT | | VLTDTSRPGDK | |
| SVAGWLLGN | | SVAGWLLGN | | TLLENDVPVT | | VLTDTSRPKDK | |
| SVAHKSCLP | | SVAHKSCLP | | TLLENGVPVT | | VLTDTSRPSDK | |
| SVAPIMFSN | | SVAPIMFSN | | TLLENNVPVT | | VLTDTSRPSDR | |
| SVASSLVLL | | SVASSLVLL | | TLLESDVPVT | | VLVALENQHTI | |
| SVAWSASAC | | SVAWSASAC | | TLLKHRFEII | | VLVGLILAFIL | |
| SVAWSATAC | | SVAWSATAC | | TLLMNELGIP | | VLVGLILAFIM | |
| SVCISGPNN | | SVCISGPNN | | TLLMNELGVP | | VLVGLILSFIM | |
| SVCMSGPNN | | SVCMSGPNN | | TLLMNELGVS | | VLVGLILTFIM | |
| SVCYNPCFY | | SVCYNPCFY | | TLLMSELGVP | | VLVGPILSFIM | |
| SVDLVETNH | | SVDLVETNH | | TLMDALLGDP | | VLVLMENERTL | |
| SVEGWVVIA | | SVEGWVVIA | | TLMEQNVPVT | | VLVLWGIHHPD | |
| SVENGTYDY | | SVENGTYDY | | TLMSCPIGVA | | VLVMKRKRDSS | |
| SVENLEELR | | SVENLEELR | | TLMSCPIGVV | | VLVMKRKRNSS | |
| SVENQEELR | | SVENQEELR | | TLMSCPMGVA | | VLVNTYQWIIK | |
| SVEPKGLFG | | SVEPKGLFG | | TLMSCPVGVA | | VLVNTYQWIIR | |
| SVEPRGLFG | | SVEPRGLFG | | TLMTDGPSDA | | VLVNTYQWVIR | |
| SVESSTYQN | | SVESSTYQN | | TLNIESNGNL | | VLVTREPYISC | |
| SVEYASKTR | | SVEYASKTR | | TLNMHDANVR | | VLVTREPYLSC | |
| SVFNCLYAS | | SVFNCLYAS | | TLNNKHSNGT | | VLVTREPYVSC | |
| SVFNNLYAS | | SVFNNLYAS | | TLNRNQPAAT | | VLWACQNGNIR | |
| SVFNSLYAS | | SVFNSLYAS | | TLNTASRSGY | | VLWGIHHPDSE | |
| SVFNSLYSS | | SVFNSLYSS | | TLNTMTKDAE | | VLWGIHHPDTE | |
| SVGGIDTNK | | SVGGIDTNK | | TLNVESNGNL | | VLWISFAISCF | |
| SVGGINTNK | | SVGGINTNK | | TLPFHNIHPL | | VLWTSNSIVAL | |
| SVGGINTNR | | SVGGINTNR | | TLPFHNVHPL | | VLWTSNSIVVF | |
| SVGKEFSNL | | SVGKEFSNL | | TLPRRSGAAG | | VLWTSNSMVAL | |
| SVGSGSFPD | | SVGSGSFPD | | TLRGQHANGT | | VMEHTSQYLCT | |
| SVGSSIYQN | | SVGSSIYQN | | TLRGRHANGT | | VMELIRMIKRG | |
| SVGSSTYHN | | SVGSSTYHN | | TLRIISNGNL | | VMELIRMVKRG | |
| SVGSSTYQN | | SVGSSTYQN | | TLRIRSNGNL | | VMELVRMIKRG | |
| SVGSWSQNI | | SVGSWSQNI | | TLRSLVASSG | | VMGARPQVNGQ | |
| SVGTSTLNL | | SVGTSTLNL | | TLRTQESECA | | VMGLVFFCLKN | |
| SVGTSTLNQ | | SVGTSTLNQ | | TLRVKSNGNL | | VMGLVFICIKN | |
| SVGWSATAC | | SVGWSATAC | | TLRVRSDGNL | | VMGQASYKIFK | |
| SVHRNTFGD | | SVHRNTFGD | | TLRVRSNGNL | | VMGQQGRMDYY | |
| SVHRNTIGD | | SVHRNTIGD | | TLSEQNVPVT | | VMKRKRDSSIL | |
| SVIEKINTQ | | SVIEKINTQ | | TLSGVAIALS | | VMKRKRNSSIL | |
| SVIEKMNIQ | | SVIEKMNIQ | | TLSSGYKDII | | VMLLAIAMGLI | |
| SVIEKMNTQ | | SVIEKMNTQ | | TLSSVNTNTI | | VMNTSKPFQNI | |
| SVKEKDLTK | | SVKEKDLTK | | TLSSVTTNTI | | VMNTSKPFQNT | |
| SVKEKDMTK | | SVKEKDMTK | | TLSTIALFIG | | VMNTSKPLQNT | |
| SVKEKDMTR | | SVKEKDMTR | | TLSTIALIIG | | VMREPFISCSH | |
| SVKKGTYDY | | SVKKGTYDY | | TLSTIALLIG | | VMTDGNASGKA | |
| SVKLSSGYK | | SVKLSSGYK | | TLTDNHVEVV | | VMTDGPANKQA | |

Fig. 83-377

| Block size 8 | SIN | Block size 9 | SIN | Block size 10 | SIN | Block size 11 | SIN |
|---|---|---|---|---|---|---|---|
| SVKMEKIVL | | SVKMEKIVL | | TLTEKGIEVV | | VMTDGPANNQA | |
| SVKNGTYDY | | SVKNGTYDY | | TLTEKGVEVV | | VMTDGPANRQA | |
| SVKNGTYEY | | SVKNGTYEY | | TLTENGVPVT | | VMTDGPANSQA | |
| SVKNGTYNY | | SVKNGTYNY | | TLTEQNVPVT | | VMTDGPASNQA | |
| SVKNGTYYY | | SVKNGTYYY | | TLTEREVEVV | | VMTDGSASGKA | |
| SVKTGTYDY | | SVKTGTYDY | | TLTERGIEVV | | VMTDGSASGQA | |
| SVKTLTDNH | | SVKTLTDNH | | TLTERGVEVV | | VMTDGSASGRA | |
| SVLINTYQW | | SVLINTYQW | | TLTETGVPVT | | VMTDGSASRKA | |
| SVLKPGETL | | SVLKPGETL | | TLTGRGIEVV | | VMTDGSASSQA | |
| SVLKPGQTL | | SVLKPGQTL | | TLTLNTMTKD | | VMTHTSQYICS | |
| SVLLGSSPN | | SVLLGSSPN | | TLTMGYKDII | | VMVGLILAFIM | |
| SVLLVSLGA | | SVLLVSLGA | | TLTSVTTNTI | | VMVVYAELLVA | |
| SVLNLLIGI | | SVLNLLIGI | | TLTVPSERGL | | VNAALGSPGCD | |
| SVLNLLIGV | | SVLNLLIGV | | TLVANNDWSG | | VNATETVEITG | |
| SVLQPGETL | | SVLQPGETL | | TLVDALLGDP | | VNDRNFWRGEN | |
| SVLRPGETL | | SVLRPGETL | | TLVLLVSLGA | | VNEEALRQKIM | |
| SVLRPGQTL | | SVLRPGQTL | | TLVNPGDSII | | VNEGALRQKIM | |
| SVLVNTYQW | | SVLVNTYQW | | TLVSNNDWSG | | VNERTLDFHDS | |
| SVLYFWGIH | | SVLYFWGIH | | TLVSNSDWSG | | VNESADMSIGI | |
| SVLYFWGVH | | SVLYFWGVH | | TLVSTKEWSK | | VNESADMSIGV | |
| SVNTNTINR | | SVNTNTINR | | TLVSTKEWSR | | VNFLSMEFSLT | |
| SVNTVLSII | | SVNTVLSII | | TLVTDGPSDA | | VNFVSMEFSLT | |
| SVPASRYLI | | SVPASRYLI | | TLYFHDSNVK | | VNGALGSPGCD | |
| SVPASRYLT | | SVPASRYLT | | TLYKNANTLS | | VNGKLNRLIEK | |
| SVPLGSSPN | | SVPLGSSPN | | TLYKNANTLT | | VNGPESVLVNT | |
| SVPMGSSPN | | SVPMGSSPN | | TLYNKHSNGT | | VNGQAGRIDFH | |
| SVQPAFSVQ | | SVQPAFSVQ | | TMDTVNRTHQ | | VNGQAGRMTFY | |
| SVQPTFSVQ | | SVQPTFSVQ | | TMDTVSRTHQ | | VNGQFGRIDFH | |
| SVQRNLPFD | | SVQRNLPFD | | TMDYYWGILK | | VNGQFGRINFH | |
| SVQRNLPFE | | SVQRNLPFE | | TMELVEAEKH | | VNGQRGRIDFH | |
| SVQRSLPFE | | SVQRSLPFE | | TMELVETEKH | | VNGQSGRIDFH | |
| SVQSRGLFG | | SVQSRGLFG | | TMELVETEKN | | VNGQSGRIEFH | |
| SVREKDMTK | | SVREKDMTK | | TMELVETKKH | | VNGQSGRINFH | |
| SVRGSGMRI | | SVRGSGMRI | | TMGYKDIILW | | VNGQSGRIVFH | |
| SVRIGSKGD | | SVRIGSKGD | | TMHDRSPFRA | | VNGQTGRIDFH | |
| SVRLSASGD | | SVRLSASGD | | TMHQLLRHFQ | | VNGVKLEENST | |
| SVRNGTYDY | | SVRNGTYDY | | TMKDRSPYRT | | VNGWYGFRHQN | |
| SVRNGTYKY | | SVRNGTYKY | | TMLNLYERVR | | VNIDRFLRVRD | |
| SVRNGTYNY | | SVRNGTYNY | | TMTHTSQYIC | | VNITNVQNNYT | |
| SVSECRTFF | | SVSECRTFF | | TMTITFLILL | | VNKNPYTLVST | |
| SVSSFEKFE | | SVSSFEKFE | | TMTKDAERGK | | VNLGLNIGLHL | |
| SVSSFERFE | | SVSSFERFE | | TNADKICLGH | | VNNGKGRYGVK | |
| SVSSFKRFE | | SVSSFKRFE | | TNAHDRICIG | | VNNIVDKMNRE | |
| SVSSRSGFE | | SVSSRSGFE | | TNATETVENK | | VNNNNWSGYSG | |
| SVTELWSYN | | SVTELWSYN | | TNATETVESK | | VNNPNWSGYSG | |
| SVTQTLVSN | | SVTQTLVSN | | TNATETVESR | | VNNQDWSGYSG | |
| SVTTNTINR | | SVTTNTINR | | TNATETVEST | | VNNQNWSGYSG | |
| SVVEKMNTQ | | SVVEKMNTQ | | TNAYDRICIG | | VNPGDSIIFNS | |
| SVVLVGLIL | | SVVLVGLIL | | TNDKYHQIEK | | VNQITGKLNRL | |
| SVVLVGPIL | | SVVLVGPIL | | TNEEALRQII | | VNRANQRLNPM | |
| SVVMCGVDH | | SVVMCGVDH | | TNEKFHQIEK | | VNRANQRLNTM | |
| SVVSCDSPS | | SVVSCDSPS | | TNEKYHQIEK | | VNRCFYVELIR | |
| SVVVFCGTS | | SVVVFCGTS | | TNGEQILIIW | | VNRTHQYSEKG | |
| SVWAGRTIS | | SVWAGRTIS | | TNGNLIAPEF | | VNRTHQYSERG | |
| SVWAGRTMS | | SVWAGRTMS | | TNGNLIAPEY | | VNSALGSPGCD | |
| SVWAGRTVS | | SVWAGRTVS | | TNGNYGPINV | | VNSFSRTELIN | |
| SVYIEVLHL | | SVYIEVLHL | | TNGTIVKTLT | | VNSFSRTELIP | |
| SVYKALSIY | | SVYKALSIY | | TNGTSKIKMK | | VNSFSRTELIS | |
| SVYSTVASS | | SVYSTVASS | | TNGTSKVKMK | | VNSIIDKMNTQ | |
| SVYVEVLHL | | SVYVEVLHL | | TNGTTGNPII | | VNSIIGKMNTQ | |
| SVYWTIVKP | | SVYWTIVKP | | TNHQFELIDN | | VNSIINKMNTQ | |
| SVYWTVVKP | | SVYWTVVKP | | TNHTDELCPS | | VNSSKPFQNAS | |

Fig. 83-378

| Block size 8 | SIN | Block size 9 | SIN | Block size 10 | SIN | Block size 11 | SIN |
|---|---|---|---|---|---|---|---|
| SWAGDILRT | | SWAGDILRT | | TNHTGTYCSL | | VNSSMPFHNIH | |
| SWAGDIMRT | | SWAGDIMRT | | TNINIREWSY | | VNSWHIFSKDN | |
| SWAGNILRT | | SWAGNILRT | | TNKFAAICTH | | VNSWHILSKDN | |
| SWASNSIVT | | SWASNSIVT | | TNKFAAVCTH | | VNTALLNASCA | |
| SWAVGRCPR | | SWAVGRCPR | | TNKFASICTH | | VNTIIENNVTV | |
| SWDDGAILP | | SWDDGAILP | | TNKINNIVDK | | VNTILEKNVTV | |
| SWEGDILRT | | SWEGDILRT | | TNKINSIIDK | | VNTILSTKALL | |
| SWEGNILRT | | SWEGNILRT | | TNKLAAICTH | | VNTLIEQNIPV | |
| SWEMGLAPS | | SWEMGLAPS | | TNKQFELIDN | | VNTLIEQNVPV | |
| SWEMGQAPS | | SWEMGQAPS | | TNKTFQNASP | | VNTLLENDVPV | |
| SWFNSFLAH | | SWFNSFLAH | | TNKTFQNIDK | | VNTLSEQNVPV | |
| SWFNSFLIH | | SWFNSFLIH | | TNKTFQNIDR | | VNTLTEKGIEV | |
| SWFNSFLKH | | SWFNSFLKH | | TNKTFQNIEK | | VNTLTEKGVEV | |
| SWFNSFLTH | | SWFNSFLTH | | TNKTFQNIER | | VNTLTEQNVPV | |
| SWFNSFLVH | | SWFNSFLVH | | TNKTFQNISP | | VNTLTEREVEV | |
| SWGMGQAPS | | SWGMGQAPS | | TNKTFQNVSP | | VNTLTERGIEV | |
| SWHDGAEII | | SWHDGAEII | | TNKVNNIVDK | | VNTLTERGVEV | |
| SWHDGAEIT | | SWHDGAEIT | | TNKVNSIIDK | | VNTLTGRGIEV | |
| SWHDGAILP | | SWHDGAILP | | TNKVNSIINK | | VNTNKTFQNIE | |
| SWHDGAVLP | | SWHDGAVLP | | TNLGLNIGLH | | VNTNTINRSFQ | |
| SWHIFGKDN | | SWHIFGKDN | | TNLYGFIIKG | | VNTTLSTIALF | |
| SWHIFSKDN | | SWHIFSKDN | | TNLYGFIVKG | | VNTTLSTIALI | |
| SWHILSKDN | | SWHILSKDN | | TNLYVNKNPY | | VNTTLSTIALL | |
| SWHIYGKDN | | SWHIYGKDN | | TNMINDKIDD | | VNTVLSIIALL | |
| SWIPKRNRS | | SWIPKRNRS | | TNNSTDTVNT | | VNTYQWIIKNW | |
| SWKGNIMRT | | SWKGNIMRT | | TNNSTETVNT | | VNTYQWIIRNW | |
| SWKKQILRT | | SWKKQILRT | | TNNYGVKGFG | | VNTYQWVIRNW | |
| SWLGRTISK | | SWLGRTISK | | TNPLIKHENR | | VNVRGSGLRIL | |
| SWLGRTTSK | | SWLGRTTSK | | TNPLIRHENR | | VNVRGSGMRIL | |
| SWLHVCVTG | | SWLHVCVTG | | TNQQFELIDN | | VNVRGSGMRVL | |
| SWLTIGISG | | SWLTIGISG | | TNQQFELIDS | | VNVRGTGMRIL | |
| SWLTIGVSG | | SWLTIGVSG | | TNQQFELINN | | VNVTHVQNNYT | |
| SWMKIYWDL | | SWMKIYWDL | | TNQQFEMIDN | | VNVTNVQNDYT | |
| SWMKIYWHL | | SWMKIYWHL | | TNQQFGLIDN | | VNVTNVQNNYT | |
| SWMKIYWSL | | SWMKIYWSL | | TNQQFKLIDN | | VNYVSMEFSLT | |
| SWMKIYWVL | | SWMKIYWVL | | TNRTFQNIDK | | VPASRYLIDMT | |
| SWMKIYWYL | | SWMKIYWYL | | TNRTFQNIDR | | VPASRYLTDMT | |
| SWMKLYWHL | | SWMKLYWHL | | TNRTFQNVSP | | VPCFWLEMIRG | |
| SWPDDAELP | | SWPDDAELP | | TNSEMNKLYE | | VPCFWVEMIRG | |
| SWPDGADIN | | SWPDGADIN | | TNSIVVFCGT | | VPDYQSIRSIL | |
| SWPDGADLP | | SWPDGADLP | | TNSSDKVDTL | | VPDYQSLRSIL | |
| SWPDGAELP | | SWPDGAELP | | TNSSEKVDTL | | VPEKIHTRGLF | |
| SWPDGAEVP | | SWPDGAEVP | | TNSSEKVNTL | | VPEKIRTRGLF | |
| SWPDGAKLP | | SWPDGAKLP | | TNSSERVDTL | | VPEKIRVKRRP | |
| SWPDGALFP | | SWPDGALFP | | TNSTEKVDTL | | VPEWSWDDGAI | |
| SWPDGALLP | | SWPDGALLP | | TNTEFESIES | | VPEWSYIIEKE | |
| SWPDGANID | | SWPDGANID | | TNTINRIFQP | | VPEWSYIMEKE | |
| SWPDGANIN | | SWPDGANIN | | TNTINRNFQP | | VPEWSYIMEKK | |
| SWPDGANIS | | SWPDGANIS | | TNTINRSFQP | | VPEWSYIMERE | |
| SWPLSSPPT | | SWPLSSPPT | | TNTINRSFRP | | VPEWSYIVEKE | |
| SWPQSSPPT | | SWPQSSPPT | | TNTLSSVTTN | | VPEWSYIVERE | |
| SWRKDILRT | | SWRKDILRT | | TNTQFELIDN | | VPEYGFKISKR | |
| SWRKKILRT | | SWRKKILRT | | TNTVNTLIEQ | | VPEYQSLRSIL | |
| SWRKQILRT | | SWRKQILRT | | TNVQNDYTTV | | VPFHLATKQVC | |
| SWRRDILRT | | SWRRDILRT | | TNVQNNYTTI | | VPFHLGTKQVC | |
| SWRRQILRT | | SWRRQILRT | | TNVQNNYTTV | | VPFHLGTRQVC | |
| SWSCIVERP | | SWSCIVERP | | TNWSGYSGSF | | VPFYLGTKQVC | |
| SWSGYSGIF | | SWSGYSGIF | | TNYYNETFVN | | VPGVKGFGFLN | |
| SWSKNILRT | | SWSKNILRT | | TPACDLHLTG | | VPGWSWDDGAI | |
| SWSKPQCQI | | SWSKPQCQI | | TPACDLYLTG | | VPGYQSLRSIL | |
| SWSLQCRIC | | SWSLQCRIC | | TPCVLLNDKH | | VPILNTSQRGI | |
| SWSQNILKK | | SWSQNILKK | | TPDPGVKGFA | | VPKRNRSILNT | |

Fig. 83-379

| Block size 8 | SIN | Block size 9 | SIN | Block size 10 | SIN | Block size 11 | SIN |
|---|---|---|---|---|---|---|---|
| SWSQNILRT | | SWSQNILRT | | TPEWSYIVEK | | VPLGSSPNAYQ | |
| SWSWHDGAE | | SWSWHDGAE | | TPGMQIRGFV | | VPLVPCEPIII | |
| SWSWHDGAI | | SWSWHDGAI | | TPHRTLLMNE | | VPMGSSPNAYQ | |
| SWSWHDGAV | | SWSWHDGAV | | TPIAFLTSSI | | VPNALIDDRSK | |
| SWSWPDDAE | | SWSWPDDAE | | TPKRNRSILN | | VPNALTDDKSK | |
| SWSWPDGAD | | SWSWPDGAD | | TPLELRDCKI | | VPNALTDDRSK | |
| SWSWPDGAE | | SWSWPDGAE | | TPLGAINTTL | | VPNALTDNRSK | |
| SWSWPDGAL | | SWSWPDGAL | | TPLGALNTTL | | VPNALTNDRSK | |
| SWSYIVEKL | | SWSYIVEKL | | TPLGSPPIVS | | VPNGTIVKTIT | |
| SWSYIVEKP | | SWSYIVEKP | | TPLGSPPMVS | | VPNGTIVRTIT | |
| SWSYIVEKS | | SWSYIVEKS | | TPLGSPPVVS | | VPNGTKVNTLT | |
| SWSYIVEKT | | SWSYIVEKT | | TPLGTPPTVS | | VPNGTLVKTIT | |
| SWSYIVERL | | SWSYIVERL | | TPNGSIPNDK | | VPNGTMVKTIT | |
| SWSYIVERP | | SWSYIVERP | | TPNGSIPNEK | | VPNGTVVKTIT | |
| SWSYVVERP | | SWSYVVERP | | TPNGSIPNGK | | VPNIGSRPRVR | |
| SWTKIYWYL | | SWTKIYWYL | | TPNGSIPNNK | | VPNYQSLRSIL | |
| SWTPKRNRS | | SWTPKRNRS | | TPNGSISNDK | | VPPLELGDCSI | |
| SWTSNSIVT | | SWTSNSIVT | | TPPLELGDCS | | VPQAQDRGLFG | |
| SWTSNSMVT | | SWTSNSMVT | | TPPTVSNSDF | | VPQAQNRGLFG | |
| SWVPILNTS | | SWVPILNTS | | TPRNDDSSSN | | VPQIEARGLFG | |
| SWVPKRNRS | | SWVPKRNRS | | TPRNDDSSSS | | VPQIEPRGLFG | |
| SYCRATEYI | | SYCRATEYI | | TPRNEDGSSS | | VPQIESRGLFG | |
| SYEQMETDG | | SYEQMETDG | | TPRNEDSSSN | | VPQIQNRGLFG | |
| SYEQMETGE | | SYEQMETGE | | TPRNEDSSSS | | VPQMESRGLFG | |
| SYEQMETGG | | SYEQMETGG | | TPSAIDQITG | | VPQVQDRGLFG | |
| SYEQMETSG | | SYEQMETSG | | TPSIDPKGLF | | VPQVQNRGLFG | |
| SYFANLKGT | | SYFANLKGT | | TPSIEPKGLF | | VPSERGLQRRR | |
| SYFFGDNAE | | SYFFGDNAE | | TPSIEPRGLF | | VPSGPLKAEIA | |
| SYFFGDNAK | | SYFFGDNAK | | TPSVEPKGLF | | VPSIQSRGLFG | |
| SYFQLFLVC | | SYFQLFLVC | | TPSVEPRGLF | | VPSPYNSRFES | |
| SYGRIIQNE | | SYGRIIQNE | | TPTKSYFANL | | VPSVQSRGLFG | |
| SYGTGSWPD | | SYGTGSWPD | | TPVCDPHLTG | | VPVGSGSFPDG | |
| SYICSGLVG | | SYICSGLVG | | TPYRSLIKFP | | VPVIGARPQVN | |
| SYIIEKENP | | SYIIEKENP | | TPYRSLIQFP | | VPVMGARPQVN | |
| SYIIERPSA | | SYIIERPSA | | TPYRSLIRFP | | VPVTQAMELVE | |
| SYIIRALTL | | SYIIRALTL | | TPYRTLLMNE | | VPVTQTMELVE | |
| SYIMEKENP | | SYIMEKENP | | TQAAIDQING | | VPVTQVEELVH | |
| SYINKTGTF | | SYINKTGTF | | TQAAIDQITG | | VPVTSSIDLIE | |
| SYINRTGTF | | SYINRTGTF | | TQAAIDQVNG | | VPVTSSIDLVE | |
| SYIVEKANP | | SYIVEKANP | | TQAAINQING | | VPVTSSVDLIE | |
| SYIVEKDKP | | SYIVEKDKP | | TQAAVDQITG | | VPVTSSVDLVE | |
| SYIVEKDNP | | SYIVEKDNP | | TQAMELVEAE | | VPVTSTIDLIE | |
| SYIVEKDSP | | SYIVEKDSP | | TQATIDQITG | | VPVVGARPKVN | |
| SYIVEKENP | | SYIVEKENP | | TQCQITGFAP | | VPVVGARPQVN | |
| SYIVEKNNP | | SYIVEKNNP | | TQCQTPLGAI | | VPVVRARPQVN | |
| SYIVEKPNP | | SYIVEKPNP | | TQDAMTEVWS | | VQAGVDRFYRT | |
| SYIVEKSNP | | SYIVEKSNP | | TQDSECVSHN | | VQDIIDNDNWS | |
| SYIVEKTNP | | SYIVEKTNP | | TQEAIDKITN | | VQDIIDNNNWS | |
| SYIVERENP | | SYIVERENP | | TQEAIEKITN | | VQGFFPFHKDN | |
| SYIVERETP | | SYIVERETP | | TQEAIGKITN | | VQGNNDNATAT | |
| SYIVERPKE | | SYIVERPKE | | TQEAINKITN | | VQGNNKNATAT | |
| SYIVERPNP | | SYIVERPNP | | TQESECACAN | | VQGNNNNATAT | |
| SYIVERPSA | | SYIVERPSA | | TQESECACIN | | VQHLEECSCYV | |
| SYIVERPTA | | SYIVERPTA | | TQESECACVN | | VQHPELTGLDC | |
| SYIVERQSA | | SYIVERQSA | | TQESECICIN | | VQHPELTGLNC | |
| SYIVERSSA | | SYIVERSSA | | TQESECQCID | | VQHPELTGMDC | |
| SYIVERSSP | | SYIVERSSP | | TQESECQCIG | | VQHPELTGMNC | |
| SYIVERTKE | | SYIVERTKE | | TQESECQCIS | | VQHPELTGVDC | |
| SYKILSIYS | | SYKILSIYS | | TQESECQCLY | | VQHPEMTGLDC | |
| SYKRIRLFD | | SYKRIRLFD | | TQESECQRID | | VQITGKLNRLI | |
| SYKRVRLFD | | SYKRVRLFD | | TQESECVCHD | | VQMQRFRRPDS | |
| SYKVGYLCA | | SYKVGYLCA | | TQESECVCHK | | VQNAISTTFPY | |

Fig. 83-380

| Block size 8 | SIN | Block size 9 | SIN | Block size 10 | SIN | Block size 11 | SIN |
|---|---|---|---|---|---|---|---|
| SYKYDNGVW | | SYKYDNGVW | | TQESECVCHN | | VQNALNGNGDP | |
| SYKYGNGVW | | SYKYGNGVW | | TQESECVCHS | | VQNALSGNGDP | |
| SYLCSGLVG | | SYLCSGLVG | | TQESECVCID | | VQNEFNKACEL | |
| SYLECRTFF | | SYLECRTFF | | TQESECVCIN | | VQPAFSVQRNL | |
| SYLIEDPAA | | SYLIEDPAA | | TQESECVCIS | | VQPGDNITFLH | |
| SYLIEDPGA | | SYLIEDPGA | | TQESECVCMN | | VQPGDNITFSD | |
| SYLIEDPNA | | SYLIEDPNA | | TQESECVCQD | | VQPGDNITFSH | |
| SYLIEDPSA | | SYLIEDPSA | | TQESECVCQN | | VQPTFSVQRNL | |
| SYLIEDPTA | | SYLIEDPTA | | TQESECVCVN | | VQPTFSVQRSL | |
| SYLIRALTL | | SYLIRALTL | | TQESECVRHN | | VQQTRMDKLTQ | |
| SYLIRTLTL | | SYLIRTLTL | | TQESSCTCIK | | VQQTRVDKLTQ | |
| SYLLLNKSL | | SYLLLNKSL | | TQESSCTCIL | | VQQTRVDRLTQ | |
| SYLNVRCVC | | SYLNVRCVC | | TQESSCTCIQ | | VQSEFNKACEL | |
| SYMCSGLVG | | SYMCSGLVG | | TQESSCTCIR | | VQSRGLFGAIA | |
| SYNADLLVA | | SYNADLLVA | | TQESSCVCIK | | VQSYFQLFLVC | |
| SYNADVLVA | | SYNADVLVA | | TQESSCVCMK | | VQTDEYKNTGD | |
| SYNAEFLVA | | SYNAEFLVA | | TQESSCVCMN | | VQTDEYKNTRD | |
| SYNAELLIA | | SYNAELLIA | | TQESSCVCVK | | VRCICRDNWKG | |
| SYNAELLVA | | SYNAELLVA | | TQFEAIGREF | | VRCICRDNWRG | |
| SYNAGLLVA | | SYNAGLLVA | | TQFEAVGKEF | | VRCTCRDNWKG | |
| SYNAKLLVL | | SYNAKLLVL | | TQFEAVGREF | | VRCVCRDNWKG | |
| SYNAQLLVL | | SYNAQLLVL | | TQFELIDNEF | | VRCVCRDNWMG | |
| SYNAQLLVW | | SYNAQLLVW | | TQFTAVGKEF | | VRCVCRDNWRG | |
| SYNARLLVL | | SYNARLLVL | | TQFTSVGKEF | | VREGRNPGNAE | |
| SYNNTNGEQ | | SYNNTNGEQ | | TQFTVVGKEF | | VREKNVTVTHS | |
| SYNNTSGEQ | | SYNNTSGEQ | | TQGACWEQLY | | VREQQGRMDYY | |
| SYNNTSGKQ | | SYNNTSGKQ | | TQGALLNDKH | | VRESRNPGNAE | |
| SYNYHQSFV | | SYNYHQSFV | | TQGALLNDRH | | VREWSYLIEDP | |
| SYPNVRCVC | | SYPNVRCVC | | TQGEGTAADY | | VRFGESEQIIV | |
| SYQVGYLCA | | SYQVGYLCA | | TQGRQTFDWT | | VRFNSDLDYQI | |
| SYRRPIGIS | | SYRRPIGIS | | TQGRQTYDWT | | VRGDLNFVNRA | |
| SYRRPVGIS | | SYRRPVGIS | | TQGSLLNDKH | | VRGDQICIGYH | |
| SYRSLIRFP | | SYRSLIRFP | | TQGSLLNDRH | | VRGDQICVGYH | |
| SYRTLLMNE | | SYRTLLMNE | | TQGTCWEQLY | | VRGDYNNTTGR | |
| SYRTLLMSE | | SYRTLLMSE | | TQGTCWEQMY | | VRGLSSRISFY | |
| SYRVGYLCA | | SYRVGYLCA | | TQGVKGWAFD | | VRGNSPAFNYN | |
| SYRYGNGVW | | SYRYGNGVW | | TQGYKDIILW | | VRGNSPVFNYN | |
| SYSAGALAS | | SYSAGALAS | | TQGYKDVILW | | VRGNSPVFNYS | |
| SYSTGALAS | | SYSTGALAS | | TQIIKLLPFA | | VRGQQGRMDYY | |
| SYSVGYLCA | | SYSVGYLCA | | TQIIVILVLG | | VRGQQGTMDYY | |
| SYTVGYLCA | | SYTVGYLCA | | TQKAIDEITT | | VRGQQGWMDYY | |
| SYVCSGLVG | | SYVCSGLVG | | TQKAIDGITN | | VRGQSGRISFY | |
| SYVRLYLWG | | SYVRLYLWG | | TQKAIDGVTN | | VRGQSGRVSFY | |
| SYWWDGLQS | | SYWWDGLQS | | TQKAIDIMQN | | VRGQSSRISFY | |
| TAADLKSTQ | | TAADLKSTQ | | TQKAIDNMQN | | VRHQLRDNAKE | |
| TAADYKSTP | | TAADYKSTP | | TQKAIDQITT | | VRHQLRENAED | |
| TAADYKSTQ | | TAADYKSTQ | | TQKAIDRITT | | VRHRLKITENS | |
| TAAQKAMMD | | TAAQKAMMD | | TQKAINEITT | | VRIGSKGDVFV | |
| TAAQRAMMD | | TAAQRAMMD | | TQKAINGVTN | | VRINNETILET | |
| TAAQRAMVD | | TAAQRAMVD | | TQKALNEITT | | VRKMMTNSHDT | |
| TAASSLALA | | TAASSLALA | | TQKTIDQVTG | | VRKMMTNSQDT | |
| TACFEIFHK | | TACFEIFHK | | TQMAIDNMQN | | VRKMMTNSRDT | |
| TACHDGKEW | | TACHDGKEW | | TQNNTTLIEN | | VRKMMTSSQDT | |
| TACHDGKGW | | TACHDGKGW | | TQNNTTVVEN | | VRKQLRENAEE | |
| TACHDGKKW | | TACHDGKKW | | TQPLSISVGS | | VRKQLRQNAEE | |
| TACHDGRKW | | TACHDGRKW | | TQPTFSVQRN | | VRKRFADQELG | |
| TACSDGPGW | | TACSDGPGW | | TQQVCIAWSS | | VRKTRFLPVAG | |
| TACSDGSGW | | TACSDGSGW | | TQRAIDGVTN | | VRKTRFLPVSG | |
| TADKDSNGV | | TADKDSNGV | | TQRAIDNMQN | | VRKTRFLPVTG | |
| TAEISHCRA | | TAEISHCRA | | TQRTIGKKKH | | VRKTRFLPVVG | |
| TAEVSHCRA | | TAEVSHCRA | | TQRTIGKKKQ | | VRLEENTTYKI | |
| TAEVSYCRA | | TAEVSYCRA | | TQRTIGKRKQ | | VRLFDYSRWNV | |

Fig. 83-381

| Block size 8 | SIN | Block size 9 | SIN | Block size 10 | SIN | Block size 11 | SIN |
|---|---|---|---|---|---|---|---|
| TAFRGLIST | | TAFRGLIST | | TQRTMGKKKQ | | VRLQLKDNAKE | |
| TAFRGLMST | | TAFRGLMST | | TQRTVGKKKQ | | VRLQLKDNARE | |
| TAFSGMSAN | | TAFSGMSAN | | TQSAIDQITG | | VRLQLRDNAKE | |
| TAIDQINGK | | TAIDQINGK | | TQSAIDQITR | | VRLQLRDNARE | |
| TAIDQITGK | | TAIDQITGK | | TQSAIDQVTG | | VRLYLWGVHHP | |
| TAIFRKATR | | TAIFRKATR | | TQSAINQITG | | VRMIKRGINDR | |
| TAIIRKATR | | TAIIRKATR | | TQSAVDQITG | | VRMQLKDNAKE | |
| TAILKKATR | | TAILKKATR | | TQSAVNQITG | | VRMQLRDNAKE | |
| TAILRKATK | | TAILRKATK | | TQSLSISIGS | | VRMQLRDNVKE | |
| TAILRKATR | | TAILRKATR | | TQSLSISVES | | VRNGTYDHKEF | |
| TAKAMEQMA | | TAKAMEQMA | | TQSLSISVGS | | VRNGTYDYPKY | |
| TAKAMEQVA | | TAKAMEQVA | | TQTAIDQING | | VRNLYDKVRLQ | |
| TAKHIEECS | | TAKHIEECS | | TQTAIDQITG | | VRNLYDKVRMQ | |
| TALANTIEI | | TALANTIEI | | TQTLVANNDW | | VRNQSGRISIY | |
| TALANTIEV | | TALANTIEV | | TQTLVSNDDW | | VRPGDNITFSH | |
| TALLNASCA | | TALLNASCA | | TQTLVSNNDW | | VRPGYNGQKSW | |
| TALSTIALL | | TALSTIALL | | TQTLVSNSDW | | VRPGYNGQRSW | |
| TALYKNANT | | TALYKNANT | | TQTMELVEAE | | VRPRYNGQRSW | |
| TAMLCLGHH | | TAMLCLGHH | | TQTMELVETE | | VRQNTLKLATG | |
| TAMLNASCA | | TAMLNASCA | | TQTMELVETK | | VRRAAVSADPL | |
| TANSIIVFC | | TANSIIVFC | | TQTRGIFGAI | | VRRAIVSADPL | |
| TANTYRNTD | | TANTYRNTD | | TQVEELVHGG | | VRRATVSADPL | |
| TAPHGLCYP | | TAPHGLCYP | | TQVEELVHGQ | | VRRDQMAHCRM | |
| TAPILGNYK | | TAPILGNYK | | TQVEELVHRG | | VRRQLRENAED | |
| TAPVLGNYK | | TAPVLGNYK | | TQYREEALLN | | VRRQLRENAEE | |
| TAPVLGNYR | | TAPVLGNYR | | TRALVRSGMD | | VRSDKICLGHH | |
| TAQELVEAQ | | TAQELVEAQ | | TRALVRTGMD | | VRSEKLVLATG | |
| TAQELVEPQ | | TAQELVEPQ | | TRCQTPLGAI | | VRSGMDPRMCS | |
| TAQELVESK | | TAQELVESK | | TRCQTSVGGI | | VRSQSGRISFY | |
| TAQELVESQ | | TAQELVESQ | | TRDAMTEIWS | | VRSWKKQILRT | |
| TAQHIEECS | | TAQHIEECS | | TRDAMTEVWS | | VRSWRKKILRT | |
| TAQIIKLLP | | TAQIIKLLP | | TRDSITEVWS | | VRSWRKQILRT | |
| TAQMALQLF | | TAQMALQLF | | TRDSLTEIWS | | VRSWRRQILRT | |
| TASCLDKGA | | TASCLDKGA | | TRDSMTEIWS | | VRTGMDPRMCS | |
| TASCLDRGA | | TASCLDRGA | | TRDSMTEVMV | | VRTLFQQMRDI | |
| TASCLDRGT | | TASCLDRGT | | TRDSMTEVWS | | VRTLFQQMRDV | |
| TASCQNRGA | | TASCQNRGA | | TRDSVTELWS | | VRTNGTSKIKM | |
| TASCRDNGA | | TASCRDNGA | | TREGKHIVER | | VRTNGTSKVKM | |
| TASLSPGMM | | TASLSPGMM | | TREGRRKTNL | | VSADPLASLLE | |
| TASRAGYEM | | TASRAGYEM | | TREILTKITV | | VSADPLLSLLE | |
| TASRSGYEM | | TASRSGYEM | | TREILTKTTV | | VSADPLVSLLE | |
| TASRSGYEV | | TASRSGYEV | | TREILTRTTV | | VSAGGDIWVTR | |
| TATKRIRMA | | TATKRIRMA | | TRELCTINSW | | VSAKELVETNH | |
| TATKRLRMA | | TATKRLRMA | | TREPFISCSH | | VSCDPDECRFY | |
| TATLCLGHH | | TATLCLGHH | | TREPYISCDN | | VSCDPDGCRFY | |
| TATREGKHI | | TATREGKHI | | TREPYLSCDP | | VSCDPLGCKMY | |
| TATVYYDRR | | TATVYYDRR | | TREPYLSCGP | | VSCDPLGCKTY | |
| TATVYYNGR | | TATVYYNGR | | TREPYVSCDN | | VSCDPLGCRMY | |
| TATVYYNKR | | TATVYYNKR | | TREPYVSCDP | | VSCDPNECRFY | |
| TATVYYNRR | | TATVYYNRR | | TREPYVSCDS | | VSCDPSGCKMY | |
| TAVAVIKYN | | TAVAVIKYN | | TREPYVSCDT | | VSCDPTGCKMY | |
| TAVAVLKYN | | TAVAVLKYN | | TREPYVSCDY | | VSCEPDECRFY | |
| TAVDTCYPF | | TAVDTCYPF | | TREPYVSCEP | | VSCGPSECRTF | |
| TAYELTDSS | | TAYELTDSS | | TREPYVSCGP | | VSCSHLECRTF | |
| TAYERMCNI | | TAYERMCNI | | TREPYVSCSL | | VSCSIHECRTF | |
| TAYSQITNG | | TAYSQITNG | | TREPYVSCSP | | VSCVCRDNWQG | |
| TAYWWDGLQ | | TAYWWDGLQ | | TREWSYLIED | | VSDGGPNLYNI | |
| TCAVVMTDG | | TCAVVMTDG | | TRFLPVAGGT | | VSECRTFFLTQ | |
| TCEQIADAQ | | TCEQIADAQ | | TRFLPVSGGT | | VSFESNGGLLA | |
| TCEQIADSH | | TCEQIADSH | | TRFLPVTGGT | | VSFHLGTKQVC | |
| TCEQIADSQ | | TCEQIADSQ | | TRGAYERMCN | | VSFQGGHIEEC | |
| TCGCRDNWQ | | TCGCRDNWQ | | TRGIFGAIAG | | VSFQGRGVFEF | |

Fig. 83-382

| Block size 8 | SIN | Block size 9 | SIN | Block size 10 | SIN | Block size 11 | SIN |
|---|---|---|---|---|---|---|---|
| TCHDGIGRM | | TCHDGIGRM | | TRGILTKTTV | | VSFQGRGVFEL | |
| TCICRDNWQ | | TCICRDNWQ | | TRGIQIASNE | | VSFRGRGVFEL | |
| TCIVAVTDG | | TCIVAVTDG | | TRGLCKINSW | | VSFSISCFLLV | |
| TCKLLGINM | | TCKLLGINM | | TRGLCTINSW | | VSFWMCSNGSL | |
| TCKLVGINM | | TCKLVGINM | | TRGLFGAIAG | | VSFYWTIVEPG | |
| TCMETIRNG | | TCMETIRNG | | TRGVQIASNE | | VSGADDDAYAV | |
| TCNSGNCRF | | TCNSGNCRF | | TRGVQVASNE | | VSGADNDAYAV | |
| TCRDNWKGS | | TCRDNWKGS | | TRIAYERMCN | | VSGEVPGWSWD | |
| TCRDNWQGS | | TCRDNWQGS | | TRIGDGQRSW | | VSGINESADMS | |
| TCSALFVYS | | TCSALFVYS | | TRILFIEEGK | | VSGPDNGAVAV | |
| TCSNGSCRC | | TCSNGSCRC | | TRILFIKEGK | | VSGPNNNASAV | |
| TCTCRDNWQ | | TCTCRDNWQ | | TRILFIREGK | | VSGTDDDAYAV | |
| TCTVIMTDG | | TCTVIMTDG | | TRILFVKEGK | | VSGVNESADMS | |
| TCTVVMTDG | | TCTVVMTDG | | TRINMINSKI | | VSGWLLGNPMC | |
| TCVAVMTDG | | TCVAVMTDG | | TRKEPALIVW | | VSHCRATEYII | |
| TCVCRDNWH | | TCVCRDNWH | | TRKQLRENAE | | VSHCRATEYIM | |
| TCVCRDNWK | | TCVCRDNWK | | TRLFTIRQEL | | VSHCRATEYMM | |
| TCVCRDNWQ | | TCVCRDNWQ | | TRLFTIRQEM | | VSIDRFLRVKD | |
| TCVCRDSWH | | TCVCRDSWH | | TRLPFQNLSP | | VSIDRFLRVRD | |
| TCVVAVTDG | | TCVVAVTDG | | TRLYIWGVHH | | VSIGTSTLNQR | |
| TCVVIMTDG | | TCVVIMTDG | | TRLYVNKNPY | | VSKDNGIRIGS | |
| TCVVTVTDG | | TCVVTVTDG | | TRPGYNGQKS | | VSKDNGIRVGS | |
| TCVVVMTDG | | TCVVVMTDG | | TRPILSPLTK | | VSLGAISFWMC | |
| TCWEQLYTP | | TCWEQLYTP | | TRQASPSCLV | | VSLGAVSFWMC | |
| TCWEQMYTP | | TCWEQMYTP | | TRQVCIAWSS | | VSLLEMCHSTQ | |
| TCWSWPDGA | | TCWSWPDGA | | TRQVCMAWSS | | VSLLQSAILSL | |
| TCYPFDVPD | | TCYPFDVPD | | TRQVCVAWSS | | VSLSPGMMMGM | |
| TCYPFDVPE | | TCYPFDVPE | | TRREIHIYYL | | VSMCSSTEFLG | |
| TCYPFDVPG | | TCYPFDVPG | | TRREVHIYYL | | VSMEFSLTDPK | |
| TCYPFDVPN | | TCYPFDVPN | | TRREVHMYYL | | VSMEFSLTDPR | |
| TDAEMNKLF | | TDAEMNKLF | | TRREVHTYYL | | VSNDNWSGYSG | |
| TDCVLEAMA | | TDCVLEAMA | | TRREVHVYYL | | VSNGTKINTLT | |
| TDDPAANSA | | TDDPAANSA | | TRRIDFHWLL | | VSNGTKVNTLT | |
| TDELCPSPL | | TDELCPSPL | | TRRQKRGLFG | | VSNNDWSGYSG | |
| TDEYKNTGD | | TDEYKNTGD | | TRRQLRENAE | | VSNSDFICVGW | |
| TDEYKNTRD | | TDEYKNTRD | | TRSAYERMCN | | VSNSDFLCVGW | |
| TDGATSACK | | TDGATSACK | | TRSDQISIVP | | VSNSDFMCVGW | |
| TDGNASGKA | | TDGNASGKA | | TRSGQNHGIC | | VSNSDWSGYSG | |
| TDGNASGRA | | TDGNASGRA | | TRSGTSKACN | | VSNSEFLCVGW | |
| TDGPAANNA | | TDGPAANNA | | TRSGYEMLKV | | VSNTDWSGYSG | |
| TDGPAANSA | | TDGPAANSA | | TRTAYERMCN | | VSPIHLGDCSF | |
| TDGPAASSA | | TDGPAASSA | | TRTTVDHMAI | | VSPLAITWWNR | |
| TDGPADNKA | | TDGPADNKA | | TRVAYERMCN | | VSPLAVTWWNR | |
| TDGPANDRA | | TDGPANDRA | | TRVDKLTQGR | | VSPLSGSAQHI | |
| TDGPANKQA | | TDGPANKQA | | TRVDRLTQGR | | VSPVHLGDCNF | |
| TDGPANNKA | | TDGPANNKA | | TRVKRQLREN | | VSPVHLGDCRF | |
| TDGPANNQA | | TDGPANNQA | | TRVWWTSNSI | | VSPVHLGDCSF | |
| TDGPANNRA | | TDGPANNRA | | TRWMKIIRVG | | VSRARIDARID | |
| TDGPANRQA | | TDGPANRQA | | TRYVCSKFHS | | VSRARIDARTD | |
| TDGPANSQA | | TDGPANSQA | | TSACKRTVSS | | VSRARIDARVD | |
| TDGPANSRA | | TDGPANSRA | | TSARQEKNPA | | VSRIAIGNCPK | |
| TDGPASNKA | | TDGPASNKA | | TSCFDGKEWM | | VSRTHQYSEKG | |
| TDGPASNQA | | TDGPASNQA | | TSCHDGIGRM | | VSSEAPGWSWD | |
| TDGPASSQA | | TDGPASSQA | | TSCHDGISRM | | VSSEVPEWSWD | |
| TDGPSDAQA | | TDGPSDAQA | | TSCHDGKARM | | VSSEVPGWSWD | |
| TDGPSNAQA | | TDGPSNAQA | | TSCHDGKFRM | | VSSEVPGWSWG | |
| TDGSANSQA | | TDGSANSQA | | TSCHDGKSRM | | VSSFEKFEIFP | |
| TDGSASGKA | | TDGSASGKA | | TSCHDGKTRM | | VSSFERFEIFP | |
| TDGSASGQA | | TDGSASGQA | | TSCHDGMSRM | | VSSFERFEMFP | |
| TDGSASGRA | | TDGSASGRA | | TSCHDGRARM | | VSSFKRFEIFP | |
| TDGSASRKA | | TDGSASRKA | | TSCHDGRSRM | | VSSFYSEMKWL | |
| TDGSASSQA | | TDGSASSQA | | TSCHDGVGRM | | VSSGLVLVGLI | |

Fig. 83-383

| Block size 8 | SIN | Block size 9 | SIN | Block size 10 | SIN | Block size 11 | SIN |
|---|---|---|---|---|---|---|---|
| TDGSASSRA | | TDGSASSRA | | TSCHDGVSRM | | VSSSGTSKACN | |
| TDGSATGKA | | TDGSATGKA | | TSFFYRYGFV | | VSSSLVLAGLI | |
| TDGSATGPA | | TDGSATGPA | | TSFQVDCYLW | | VSSSLVLVGLI | |
| TDIWAYNAE | | TDIWAYNAE | | TSGEQMLIIW | | VSSSLVLVGLV | |
| TDIWSYNAK | | TDIWSYNAK | | TSGEQMLVIW | | VSSWHILSKDN | |
| TDIWSYNAR | | TDIWSYNAR | | TSGKQMLIIW | | VSTDKDSNGVQ | |
| TDIWTYQAE | | TDIWTYQAE | | TSGNLIAPEY | | VSTDKNSNGVQ | |
| TDKDSNGVQ | | TDKDSNGVQ | | TSGRQEKNPA | | VSTKEWSKRYE | |
| TDKGSIQSD | | TDKGSIQSD | | TSGRQEKNPS | | VSTKEWSRRYE | |
| TDKIDTLTE | | TDKIDTLTE | | TSGSIISFCG | | VSTNAYDRICI | |
| TDKNSNGVQ | | TDKNSNGVQ | | TSGSSIAFCG | | VSTQKAINEIT | |
| TDKVDTIIE | | TDKVDTIIE | | TSGSSISFCG | | VSTQKALNEIT | |
| TDKVDTLTE | | TDKVDTLTE | | TSGTYGAGSW | | VSTRSDQISIV | |
| TDKVNTIIE | | TDKVNTIIE | | TSGTYGSGSW | | VSVGSGSFPDG | |
| TDLEALMEW | | TDLEALMEW | | TSGTYGTGSW | | VSVGTSTLNQR | |
| TDLGAPLEL | | TDLGAPLEL | | TSGTYGTGTW | | VSVRGSGMRIL | |
| TDLGQCGIL | | TDLGQCGIL | | TSHRTLLMNE | | VSVTDGPAANS | |
| TDLGQCGLL | | TDLGQCGLL | | TSHTGTYCSL | | VSWASNSIVTF | |
| TDLGSPLEL | | TDLGSPLEL | | TSIRNNTYDH | | VSWEMGQAPSP | |
| TDLGTPLEL | | TDLGTPLEL | | TSISCLYKLS | | VSWPLSSPPTV | |
| TDLYKVATG | | TDLYKVATG | | TSIVVFCGTS | | VSWSQNILRTQ | |
| TDMGQCGLL | | TDMGQCGLL | | TSIWTSSSSM | | VSWTSNSIITF | |
| TDNHVEVVS | | TDNHVEVVS | | TSIWTSSSST | | VSWTSNSIVTF | |
| TDNPRPNDP | | TDNPRPNDP | | TSKACNALTG | | VSWTSNSMVTF | |
| TDNYGVKGF | | TDNYGVKGF | | TSKACNASTG | | VSYCRATEYIM | |
| TDSEMDKLF | | TDSEMDKLF | | TSKACSASTG | | VTADKDSNGVQ | |
| TDSEMLNLY | | TDSEMLNLY | | TSKDSRSGYE | | VTCGCRDNWQG | |
| TDSEMNKLF | | TDSEMNKLF | | TSKHYIGKCP | | VTCICRDNWQG | |
| TDSEMNKLY | | TDSEMNKLY | | TSKIKMKWGM | | VTCTCRDNWQG | |
| TDSEMNRLF | | TDSEMNRLF | | TSKPFQNICK | | VTCVCRDNWKS | |
| TDSEMSKLF | | TDSEMSKLF | | TSKPFQNTSK | | VTCVCRDNWQG | |
| TDSEMSKLY | | TDSEMSKLY | | TSKPFQNTSR | | VTDGPAANNAD | |
| TDSIKSWRK | | TDSIKSWRK | | TSKPLQNTSK | | VTDGPAANSAD | |
| TDSIKSWRR | | TDSIKSWRR | | TSKVKMKWGM | | VTDGPADNKAD | |
| TDSQTATKR | | TDSQTATKR | | TSLCSIWFSH | | VTDGPSDAQAF | |
| TDTFKSWKG | | TDTFKSWKG | | TSLLLATGMR | | VTDIWAYNAEL | |
| TDTLKSWKG | | TDTLKSWKG | | TSLTSLPFQN | | VTDIWSYNAKL | |
| TDTPRGEDS | | TDTPRGEDS | | TSNLPFQNVN | | VTDIWSYNARL | |
| TDTPRIQDS | | TDTPRIQDS | | TSNQDSFYRS | | VTDSEMNKLFE | |
| TDTPRVQDD | | TDTPRVQDD | | TSNQGSFYRS | | VTDVWSYNAKL | |
| TDTPRVQDG | | TDTPRVQDG | | TSNRGSFYRS | | VTEINTWARNI | |
| TDTPRVQDN | | TDTPRVQDN | | TSNSIAVFCG | | VTELWSYNAEL | |
| TDTPRVQDS | | TDTPRVQDS | | TSNSIIAFCG | | VTFCGLDNEPD | |
| TDTSKPSDK | | TDTSKPSDK | | TSNSIIVFCG | | VTFCGLDNEPG | |
| TDTSRPGDK | | TDTSRPGDK | | TSNSIIVLCG | | VTFCGLNNEPG | |
| TDTSRPGDR | | TDTSRPGDR | | TSNSIVAFCG | | VTFIFNGAFIA | |
| TDTSRPKDK | | TDTSRPKDK | | TSNSIVALCG | | VTFSFNGAFIA | |
| TDTSRPNDP | | TDTSRPNDP | | TSNSIVSMCS | | VTFTFNGAFIA | |
| TDTSRPSDK | | TDTSRPSDK | | TSNSIVTFCG | | VTGDDENATAS | |
| TDTSRPSDP | | TDTSRPSDP | | TSNSIVVFCG | | VTGDDKNATAS | |
| TDTSRPSDR | | TDTSRPSDR | | TSNSLIALCG | | VTGDDRNATAS | |
| TDTSRPTDP | | TDTSRPTDP | | TSNSLVALCG | | VTGFAPFSKDN | |
| TDTVDTILE | | TDTVDTILE | | TSNSMVTFCG | | VTGKLNRLIEK | |
| TDTVDTLIE | | TDTVDTLIE | | TSNSVVVFCG | | VTGKSHGRILK | |
| TDTVDTLLE | | TDTVDTLLE | | TSPCLTDKGS | | VTGLRNIPSIQ | |
| TDTVDTLTE | | TDTVDTLTE | | TSPLPFQNIN | | VTGLRNVPSIQ | |
| TDTVDTVLE | | TDTVDTVLE | | TSQRGILEDE | | VTHAKDILEKA | |
| TDTVDTVRE | | TDTVDTVRE | | TSQRGVLEDE | | VTHAKDILEKT | |
| TDTVNTLIE | | TDTVNTLIE | | TSQYICSPVL | | VTHAKNILEKT | |
| TDTVNTLME | | TDTVNTLME | | TSQYLCTGIL | | VTHAQDILEKT | |
| TDTVNTLTE | | TDTVNTLTE | | TSQYLCTGVL | | VTHAQNILEKT | |
| TDVIRSWRK | | TDVIRSWRK | | TSRHYIGKCP | | VTHTGTSKACN | |

Fig. 83-384

| Block size 8 | SIN | Block size 9 | SIN | Block size 10 | SIN | Block size 11 | SIN |
|---|---|---|---|---|---|---|---|
| TDVVNFLSM | | TDVVNFLSM | | TSRHYMGECP | | VTIGECPKYVK | |
| TDVVNFVSM | | TDVVNFVSM | | TSRYVCTGIL | | VTIGECPKYVR | |
| TDVVNYVSM | | TDVVNYVSM | | TSSGTSKACN | | VTIGKCPKYVK | |
| TDVVRSWKK | | TDVVRSWKK | | TSSGTSKACS | | VTKENTGSYVR | |
| TDVVRSWRK | | TDVVRSWRK | | TSSIDLVETN | | VTLSSGYKDII | |
| TDVVRSWRR | | TDVVRSWRR | | TSSIYIEVLH | | VTLTMGYKDII | |
| TDVWSYNAK | | TDVWSYNAK | | TSSSIVVFCG | | VTNATETVENK | |
| TDVYCICRD | | TDVYCICRD | | TSSSSIVMCG | | VTNATETVESK | |
| TDWSGYSGS | | TDWSGYSGS | | TSSSSTVFCG | | VTNATETVESR | |
| TECQLNEGI | | TECQLNEGI | | TSSSSVVMCG | | VTNATETVEST | |
| TECQLNEGV | | TECQLNEGV | | TSSVDLVETN | | VTNKVNSIIDK | |
| TECRTFFLT | | TECRTFFLT | | TSSVYIEVLH | | VTNKVNSIIGK | |
| TEDNIYKIL | | TEDNIYKIL | | TSSVYVEVLH | | VTNKVNSIINK | |
| TEDNVYKIL | | TEDNVYKIL | | TSTASRSGYE | | VTQAMELVEAE | |
| TEDNVYKVL | | TEDNVYKVL | | TSTQKAINEI | | VTQTLVSNNDW | |
| TEEQAVDIC | | TEEQAVDIC | | TSVGGIDTNK | | VTQTMELVEAE | |
| TEEQAVGIC | | TEEQAVGIC | | TSVGGINTNK | | VTQTMELVETE | |
| TEEQAVNIC | | TEEQAVNIC | | TSVGGINTNR | | VTQTMELVETK | |
| TEFESIESE | | TEFESIESE | | TSVKTLTDNH | | VTQVEELVHGG | |
| TEFLGQWDW | | TEFLGQWDW | | TSVTTNTINR | | VTQVEELVHGQ | |
| TEFLGQWNW | | TEFLGQWNW | | TSWSWPDGAL | | VTQVEELVHRG | |
| TEGHIEECS | | TEGHIEECS | | TSWSYIVEKL | | VTREPYISCDN | |
| TEGRTSDMR | | TEGRTSDMR | | TSWSYIVEKP | | VTREPYLSCDP | |
| TEHQIGNVI | | TEHQIGNVI | | TSWSYIVEKS | | VTREPYLSCEP | |
| TEIASWAGN | | TEIASWAGN | | TSWSYIVERP | | VTREPYLSCGP | |
| TEIGAPQLN | | TEIGAPQLN | | TSYKILSIYS | | VTREPYVSCDN | |
| TEIGVTRRE | | TEIGVTRRE | | TSYRSLIRFP | | VTREPYVSCDP | |
| TEIIIRMME | | TEIIIRMME | | TSYWWDGLQS | | VTREPYVSCDS | |
| TEIMYLNNT | | TEIMYLNNT | | TTAKAMEQMA | | VTREPYVSCDY | |
| TEINTWARN | | TEINTWARN | | TTAKAMEQVA | | VTREPYVSCEP | |
| TEIPSWAGN | | TEIPSWAGN | | TTASCQNRGA | | VTRREIHIYYL | |
| TEIPSWEGN | | TEIPSWEGN | | TTAVAVLKYN | | VTRREVHIYYL | |
| TEIRASVGK | | TEIRASVGK | | TTCHDGIGRM | | VTRREVHMYYL | |
| TEIRASVGR | | TEIRASVGR | | TTDWSGYSGS | | VTRREVHTYYL | |
| TEIRSSVGK | | TEIRSSVGK | | TTEINTWARN | | VTRREVHVYYL | |
| TEIRTSVGR | | TEIRTSVGR | | TTEIYNETVR | | VTRSGTSKACN | |
| TEISFTITG | | TEISFTITG | | TTEMYNETVR | | VTSSGTSKACN | |
| TEIVYLNDT | | TEIVYLNDT | | TTEVSHCRAT | | VTSSGTSKACS | |
| TEIVYLNHT | | TEIVYLNHT | | TTEVYNETVR | | VTSSIDLVETN | |
| TEIVYLNNT | | TEIVYLNNT | | TTEVYSETVR | | VTSSVDLVETN | |
| TEIVYLNST | | TEIVYLNST | | TTFPYTGDPP | | VTTNTINRIFQ | |
| TEIWSYNAE | | TEIWSYNAE | | TTGKSHGRIL | | VTTNTINRNFQ | |
| TEIYNETVR | | TEIYNETVR | | TTGNPIICLG | | VTTNTINRSFQ | |
| TEKGIEVVN | | TEKGIEVVN | | TTGRDVLVIW | | VTTNTINRSFR | |
| TEKGVEVVN | | TEKGVEVVN | | TTGRDVLVLW | | VTTRQASPSCL | |
| TEKVDTIIE | | TEKVDTIIE | | TTGRDVLVMW | | VTTVGWSWPDG | |
| TEKVDTLLE | | TEKVDTLLE | | TTGRNCTIPC | | VTTVTLHFKQH | |
| TELGAPLVL | | TELGAPLVL | | TTGRNCTVPC | | VTVSTRSDQIS | |
| TELGSPLVL | | TELGSPLVL | | TTGWPWDGA | | VTVTDGPAANS | |
| TELINPNKW | | TELINPNKW | | TTGWSWPDGA | | VTVTHAKDILE | |
| TELINPSKW | | TELINPSKW | | TTHDRTAFRG | | VTVTHAKNILE | |
| TELIPPSKW | | TELIPPSKW | | TTHFHRKRRV | | VTVTHAQDILE | |
| TELISPNKW | | TELISPNKW | | TTHFQRKRRI | | VTVTHAQNILE | |
| TELISPSKW | | TELISPSKW | | TTHFQRKRRV | | VTVTHSIELLE | |
| TELLVLMEN | | TELLVLMEN | | TTHSWIPKRN | | VTVTHSINLLE | |
| TELPFQNLS | | TELPFQNLS | | TTHSWTPKRN | | VTVTHSVDLLE | |
| TELSFTITG | | TELSFTITG | | TTHSWVPILN | | VTVTHSVELLE | |
| TELSFTVTG | | TELSFTVTG | | TTHSWVPKRN | | VTVTHSVNILE | |
| TELWSYNAE | | TELWSYNAE | | TTHTGTYCSL | | VTVTHSVNLLE | |
| TEMWSYNAE | | TEMWSYNAE | | TTIGLLLQII | | VTVTNSVELVE | |
| TENGVPVTS | | TENGVPVTS | | TTIGLLLQIT | | VTVTSSIELVE | |
| TENPVICLG | | TENPVICLG | | TTIGPLLQIT | | VTVTSSVELVE | |

Fig. 83-385

| Block size 8 | SIN | Block size 9 | SIN | Block size 10 | SIN | Block size 11 | SIN |
|---|---|---|---|---|---|---|---|
| TENSFEQIT | | TENSFEQIT | | TTIKPWARNI | | VTYQILSIYST | |
| TEPLCDVSG | | TEPLCDVSG | | TTIKTWAGKI | | VTYTGISKACN | |
| TEPLCEVSG | | TEPLCEVSG | | TTIKTWAGNI | | VTYTGTSKACN | |
| TEPLCNVSG | | TEPLCNVSG | | TTIKTWAKNI | | VTYTGTSRACN | |
| TEQNVPVTQ | | TEQNVPVTQ | | TTIKTWARNI | | VVAKDNAIRFG | |
| TEQTKLYGS | | TEQTKLYGS | | TTINNITNVV | | VVAMVFSQEDC | |
| TEQTKLYKN | | TEQTKLYKN | | TTIRGKHSNG | | VVAVTDGPAAN | |
| TEQVDTIME | | TEQVDTIME | | TTIRGRHSNG | | VVAVTDGPADN | |
| TEREVEVVN | | TEREVEVVN | | TTIRNKHSNG | | VVENKYVNNTT | |
| TERGIEVVN | | TERGIEVVN | | TTIRNKHSNS | | VVENTYVNNTT | |
| TERGVEVVD | | TERGVEVVD | | TTIRNRHSNG | | VVFCGASGTYG | |
| TERGVEVVN | | TERGVEVVN | | TTIRTWAKNI | | VVFCGTSGIYG | |
| TERQEIVDN | | TERQEIVDN | | TTITLHFKQN | | VVFCGTSGTYG | |
| TERQEIVGN | | TERQEIVGN | | TTIWTSGSSI | | VVFCSTSGTYG | |
| TERVDTIIE | | TERVDTIIE | | TTKINNIIDK | | VVFPNEVGAKI | |
| TERVDTIME | | TERVDTIME | | TTKINNIIEK | | VVFPNEVGARI | |
| TESLQNRIQ | | TESLQNRIQ | | TTKPRPRRGL | | VVFTDGSATGP | |
| TESRGLFGA | | TESRGLFGA | | TTLDNEHSNG | | VVGARPLVNGQ | |
| TESSFEQIT | | TESSFEQIT | | TTLDNKHSND | | VVGARPQVNGQ | |
| TETGALQLN | | TETGALQLN | | TTLDNKHSNG | | VVHISPLSGSA | |
| TETGAPQLN | | TETGAPQLN | | TTLENKHSNG | | VVIAKDNAVRF | |
| TETGVPVTS | | TETGVPVTS | | TTLIENTYVN | | VVIAQDNAIRF | |
| TETKAPQLN | | TETKAPQLN | | TTLKGRHANG | | VVIEKDNAVRF | |
| TETLYLNHT | | TETLYLNHT | | TTLNNKHSNG | | VVLENQHTIDL | |
| TETVEITGI | | TETVEITGI | | TTLPFHNIHP | | VVLNTDWSGYS | |
| TETVNTLIE | | TETVNTLIE | | TTLPFHNVHP | | VVLVGLILAFI | |
| TETVNTLSE | | TETVNTLSE | | TTLRGQHANG | | VVLVMKRKRDS | |
| TETVNTLTE | | TETVNTLTE | | TTLRGRHANG | | VVLVMKRKRNS | |
| TEVEGRIQD | | TEVEGRIQD | | TTLSTIALFI | | VVMTDGNASGK | |
| TEVEKQIGN | | TEVEKQIGN | | TTLSTIALII | | VVMTDGSASGK | |
| TEVEQQIGN | | TEVEQQIGN | | TTLSTIALLI | | VVMTDGSASGR | |
| TEVERQIGN | | TEVERQIGN | | TTLYKNANTL | | VVMTDGSASRK | |
| TEVETYVLS | | TEVETYVLS | | TTLYNKHSNG | | VVMTDGSASSQ | |
| TEVSHCRAT | | TEVSHCRAT | | TTNPLIKHEN | | VVNATETVEIT | |
| TEVWSYNAD | | TEVWSYNAD | | TTNPLIRHEN | | VVNATETVERT | |
| TEVWSYNAE | | TEVWSYNAE | | TTNSIVVFCG | | VVNATETVETA | |
| TEVYNETVR | | TEVYNETVR | | TTNTINRIFQ | | VVNATETVETT | |
| TEVYSETVR | | TEVYSETVR | | TTNTINRNFQ | | VVNATETVETV | |
| TEWSGYSGS | | TEWSGYSGS | | TTNTINRSFQ | | VVNFLSMEFSL | |
| TEYIIKGVY | | TEYIIKGVY | | TTNTINRSFR | | VVNFVSMEFSL | |
| TEYIMKGVY | | TEYIMKGVY | | TTNTYRNTDP | | VVNTALSTIAL | |
| TEYMMKGVY | | TEYMMKGVY | | TTNTYRNTDS | | VVNTILSTKAL | |
| TEYRQEALQ | | TEYRQEALQ | | TTNTYRNTDT | | VVNTTLSTIAL | |
| TFCGLDNEP | | TFCGLDNEP | | TTNYYNETFV | | VVNYVSMEFSL | |
| TFCGLNNEP | | TFCGLNNEP | | TTPTKSYFAN | | VVRARPQVNGQ | |
| TFDSLNITA | | TFDSLNITA | | TTQIIKLLPF | | VVRKMMTNSQD | |
| TFDTAQIIK | | TFDTAQIIK | | TTRGVQIASN | | VVRKMMTNSRD | |
| TFDTIQIIK | | TFDTIQIIK | | TTRQASPSCL | | VVRKMMTSSQD | |
| TFDTTQIIK | | TFDTTQIIK | | TTSKDSRSGY | | VVRSWKKQILR | |
| TFDTVQIIK | | TFDTVQIIK | | TTSTASRSGY | | VVRSWRKKILR | |
| TFDTVQVIK | | TFDTVQVIK | | TTSWSWPDGA | | VVRSWRKQILR | |
| TFDWTLNRN | | TFDWTLNRN | | TTTIKPWARN | | VVRSWRRQILR | |
| TFEFTSFFY | | TFEFTSFFY | | TTTIKTWAGK | | VVSAKELVETN | |
| TFESDGAFL | | TFESDGAFL | | TTTIKTWAGN | | VVSLGAISFWM | |
| TFESNGAFI | | TFESNGAFI | | TTTIKTWAKN | | VVTREPYVSCD | |
| TFESNGAFL | | TFESNGAFL | | TTTIKTWARN | | VVTVTDGPAAN | |
| TFESNGALL | | TFESNGALL | | TTTIRTWAKN | | VVVAKDNAIRF | |
| TFESNGGFL | | TFESNGGFL | | TTTNPLIRHE | | VWACQRGNIRC | |
| TFESNGGLI | | TFESNGGLI | | TTTPTKSYFA | | VWAYNAELLVL | |
| TFESNGGLL | | TFESNGGLL | | TTTTIINNNT | | VWDANGWVSTD | |
| TFESNGVFL | | TFESNGVFL | | TTTVKTWAGN | | VWDDNGWVSTD | |
| TFESSGGLL | | TFESSGGLL | | TTVDHMAIIK | | VWDDNGWVSTD | |

Fig. 83-386

| Block size 8 | SIN | Block size 9 | SIN | Block size 10 | SIN | Block size 11 | SIN |
|---|---|---|---|---|---|---|---|
| TFFLTHGAL | | TFFLTHGAL | | TTVGLLLQII | | VWGVHHSSSLD | |
| TFFLTHGSL | | TFFLTHGSL | | TTVGLLLQIT | | VWIGRTKSLES | |
| TFFLTQGAL | | TFFLTQGAL | | TTVGWSWPDG | | VWLENEKTLDL | |
| TFFLTQGSL | | TFFLTQGSL | | TTVKTWAGNI | | VWLGRTVSING | |
| TFGDCPKYV | | TFGDCPKYV | | TTVNEEALRQ | | VWLGRTVSISG | |
| TFGPVHFQN | | TFGPVHFQN | | TTVTLHFKQH | | VWLGRTVSNSG | |
| TFGPVHFRN | | TFGPVHFRN | | TTVTLHFKQN | | VWLGRTVSTSG | |
| TFGPVHFRS | | TFGPVHFRS | | TTVVENTYVN | | VWLWLVLREKM | |
| TFHGAKEIA | | TFHGAKEIA | | TTVWWTSNSI | | VWMACHSAAFE | |
| TFHGAKEIS | | TFHGAKEIS | | TTWDVFIERP | | VWMACNSAAFE | |
| TFHGAKEVA | | TFHGAKEVA | | TTYKILSIYS | | VWMGRTISKDS | |
| TFHGAKEVS | | TFHGAKEVS | | TTYQRTRALV | | VWMGRTISMDS | |
| TFIFNGAFI | | TFIFNGAFI | | TTYRILSIYS | | VWMGRTISRDS | |
| TFILWACQN | | TFILWACQN | | TTYWWDGLQS | | VWSYNAELLVA | |
| TFIQALQLL | | TFIQALQLL | | TVAASLCLAI | | VWSYNAKLLVL | |
| TFKRTKGFS | | TFKRTKGFS | | TVAASLCLAV | | VWTSGSIISFC | |
| TFKRTKGSS | | TFKRTKGSS | | TVAGSLSLAI | | VWTSGSSISFC | |
| TFKRTSGSS | | TFKRTSGSS | | TVASSLALAI | | VWTYNAEILVL | |
| TFKRTSGTS | | TFKRTSGTS | | TVASSLTLAI | | VWTYNAELFVL | |
| TFKSWKGNI | | TFKSWKGNI | | TVASSLVLAI | | VWTYNAELLIL | |
| TFKVIGGWS | | TFKVIGGWS | | TVDHMAIIKK | | VWTYNAELLVL | |
| TFKVIGGWT | | TFKVIGGWT | | TVDTILEKNV | | VWTYNAEVLVL | |
| TFLAMITYI | | TFLAMITYI | | TVDTILERNV | | VWTYNTELLVL | |
| TFLARSALI | | TFLARSALI | | TVDTLLEKNV | | VWTYNVELLVL | |
| TFLHNGGLI | | TFLHNGGLI | | TVDTLTENGV | | VWVTREPYVSC | |
| TFLQALQLL | | TFLQALQLL | | TVDTVLEKNV | | VWWASNSLIAL | |
| TFLRSNAPS | | TFLRSNAPS | | TVDTVLERNV | | VWWTSNSIAVF | |
| TFMQALQLL | | TFMQALQLL | | TVDTVREKNV | | VWWTSNSIISM | |
| TFNFNGAFV | | TFNFNGAFV | | TVEITGIDKV | | VWWTSNSIIVF | |
| TFNGAFIAP | | TFNGAFIAP | | TVEITGINKV | | VWWTSNSIVAF | |
| TFPYTGDPP | | TFPYTGDPP | | TVERMVLSAF | | VWWTSNSIVAL | |
| TFQNIDKNA | | TFQNIDKNA | | TVFCGVSGEV | | VWWTSNSIVSM | |
| TFQNIDRNA | | TFQNIDRNA | | TVFCGVSSEA | | VWWTSNSIVVF | |
| TFQNIEKNA | | TFQNIEKNA | | TVFCGVSSEV | | VWWTSNSLIAL | |
| TFQNIERNA | | TFQNIERNA | | TVGKCPRYIK | | VWWTSNSLVAL | |
| TFQNISPVW | | TFQNISPVW | | TVGKCPRYVK | | VWWTSTSIVVF | |
| TFQNVSPIW | | TFQNVSPIW | | TVGLLLQIIS | | VWWTTNSIVVF | |
| TFQNVSPLW | | TFQNVSPLW | | TVGLLLQITS | | VYCICRDNWKG | |
| TFQNVSPVW | | TFQNVSPVW | | TVGQCPKYVK | | VYCVCRDNWKG | |
| TFRGLLSTP | | TFRGLLSTP | | TVGQCPKYVN | | VYIEVLHLTQG | |
| TFRVIDGWT | | TFRVIDGWT | | TVGQCPKYVS | | VYINTALLNAS | |
| TFRVIGGWA | | TFRVIGGWA | | TVGRCPRYVK | | VYINTALLNSS | |
| TFRVIGGWT | | TFRVIGGWT | | TVGSSKYQQS | | VYINTAMLNAS | |
| TFRVIGGWV | | TFRVIGGWV | | TVGSSKYRQS | | VYKALSIYSCI | |
| TFRVISGWT | | TFRVISGWT | | TVGSSNYQQS | | VYKILSIYSCI | |
| TFSDNGGLI | | TFSDNGGLI | | TVHDRIPHRT | | VYKILSIYSCV | |
| TFSFNGAFI | | TFSFNGAFI | | TVIKNNMINN | | VYKVLAIYSCI | |
| TFSFNGAFV | | TFSFNGAFV | | TVIKNNMVNN | | VYKVLSIYSCI | |
| TFSFQLILI | | TFSFQLILI | | TVIMIDGSAS | | VYMNTALLNAS | |
| TFSFQLILL | | TFSFQLILL | | TVIMTDGSAS | | VYNNTTGRDVL | |
| TFSFQLINN | | TFSFQLINN | | TVINNITTTI | | VYQAKFEAVAW | |
| TFSHNGGLI | | TFSHNGGLI | | TVINNYYNET | | VYQAKFESVAW | |
| TFSHNGGRI | | TFSHNGGRI | | TVIRNNMINN | | VYQARFEAVAW | |
| TFSPRSRSG | | TFSPRSRSG | | TVKDRSPFRT | | VYQARFESVAW | |
| TFSVQRNLP | | TFSVQRNLP | | TVKDRSPYRA | | VYQILAIYATV | |
| TFSVQRSLP | | TFSVQRSLP | | TVKDRSPYRT | | VYQILAIYSTI | |
| TFTFNGAFI | | TFTFNGAFI | | TVKIKTNGNL | | VYQILAIYSTV | |
| TFVNITNVQ | | TFVNITNVQ | | TVKIQTNGNL | | VYQILSIYSTV | |
| TFVNVTHVQ | | TFVNVTHVQ | | TVKIQTSGNL | | VYQSRFEAVAW | |
| TFVNVTNVQ | | TFVNVTNVQ | | TVKQDGKSSA | | VYQVLAIYATV | |
| TGAINSSKP | | TGAINSSKP | | TVKQNGKSGA | | VYRALSIYSCI | |
| TGAINSSRP | | TGAINSSRP | | TVKQNGKSSA | | VYRDNWKGSNR | |

Fig. 83-387

| Block size 8 | SIN | Block size 9 | SIN | Block size 10 | SIN | Block size 11 | SIN |
|---|---|---|---|---|---|---|---|
| TGALASCMG | | TGALASCMG | | TVKTWAGNIL | | VYVEVLHLTQG | |
| TGALQLNPI | | TGALQLNPI | | TVLEKNVTVT | | VYVNTALLNAS | |
| TGAPQLNPI | | TGAPQLNPI | | TVLERNVTVT | | VYWWDGLQSSD | |
| TGAPQLNPV | | TGAPQLNPV | | TVLGVSILNL | | VYYDRRLTTTI | |
| TGAQSFYRS | | TGAQSFYRS | | TVLGVSVLNL | | VYYDRRLTTTV | |
| TGARRIDFH | | TGARRIDFH | | TVLKSDKRIG | | VYYNGRLTTTI | |
| TGCFEIFHK | | TGCFEIFHK | | TVLSIIALLI | | VYYNKRLTTTI | |
| TGCFEIFHR | | TGCFEIFHR | | TVLVGLILAF | | VYYNRRLTTTI | |
| TGCKMYALH | | TGCKMYALH | | TVMVGLILAF | | VYYNRRPTTTI | |
| TGCQLNEGV | | TGCQLNEGV | | TVNEEALRQK | | WACGNGSCRCT | |
| TGDDGNATA | | TGDDGNATA | | TVNEGALRQK | | WACNNGSCRCT | |
| TGDDKNATA | | TGDDKNATA | | TVNFSFNGAF | | WACQKGNIKCN | |
| TGDDRKATA | | TGDDRKATA | | TVNRTHQYSE | | WACQKGNIRCD | |
| TGDDRNATA | | TGDDRNATA | | TVNTLIEQNI | | WACQKGNIRCN | |
| TGDGCFEIL | | TGDGCFEIL | | TVNTLIEQNV | | WACQNGNIRCQ | |
| TGDNTKWNE | | TGDNTKWNE | | TVNTLSEQNV | | WACQNGNLRCQ | |
| TGDPPYSHG | | TGDPPYSHG | | TVNTLTEQNV | | WACQNGNVRCQ | |
| TGFAPFSKD | | TGFAPFSKD | | TVNVRGSGLR | | WACQRGNIRCN | |
| TGFASFSKD | | TGFASFSKD | | TVNVRGSGMR | | WACQTGNIRCQ | |
| TGFHFEECS | | TGFHFEECS | | TVNVRGTGMR | | WACSNGNCRFN | |
| TGFTYSGIR | | TGFTYSGIR | | TVPCFWVEMI | | WACSNGSCRCT | |
| TGGQAFYRS | | TGGQAFYRS | | TVPSERGLQR | | WACSNGSCRFN | |
| TGGQSFYRS | | TGGQSFYRS | | TVQIIKLLPF | | WACSSGNCRFN | |
| TGIAADKAS | | TGIAADKAS | | TVQVDTIMEK | | WACSSGNCRFS | |
| TGIAADKES | | TGIAADKES | | TVQVIKLLPF | | WAEGDCYRACF | |
| TGIAADKTS | | TGIAADKTS | | TVSADPLASL | | WAEGECYRACF | |
| TGIAADKVS | | TGIAADKVS | | TVSADPLLSL | | WAGKILRTQES | |
| TGIAADRDS | | TGIAADRDS | | TVSADPLVSL | | WAGNILRTQES | |
| TGIAADRES | | TGIAADRES | | TVSIDRFLRV | | WAIHHPPTSAE | |
| TGIAADRGS | | TGIAADRGS | | TVSLSPGMMM | | WAIHHPPTSDE | |
| TGIAAEKES | | TGIAAEKES | | TVSSFERFEI | | WAIHHPPTSNE | |
| TGIDKVCTK | | TGIDKVCTK | | TVSSFYSEMK | | WAIHHPPTTDE | |
| TGILTDTSR | | TGILTDTSR | | TVSSGLVLVG | | WAILKPGQTVK | |
| TGINKVCTK | | TGINKVCTK | | TVSSSLVLAG | | WAIRTKSGGNT | |
| TGIVADRDS | | TGIVADRDS | | TVSSSLVLVG | | WAIRTRSGGNT | |
| TGIWDTLIE | | TGIWDTLIE | | TVSTRSDQIS | | WAKEECYRACF | |
| TGKDPKKTG | | TGKDPKKTG | | TVSVRGSGMR | | WAKGDCYRACF | |
| TGKGCFDIL | | TGKGCFDIL | | TVTDGPAANS | | WAKGECYRACF | |
| TGKLNRFIE | | TGKLNRFIE | | TVTFIFNGAF | | WAKNILRTQES | |
| TGKLNRIIE | | TGKLNRIIE | | TVTFNFNGAF | | WALGENMAPEK | |
| TGKLNRLID | | TGKLNRLID | | TVTFSFNGAF | | WAPLSKDNGIR | |
| TGKLNRLIE | | TGKLNRLIE | | TVTFTFNGAF | | WARNILRTQDS | |
| TGKLNRLIG | | TGKLNRLIG | | TVTHAKDILE | | WARNILRTQES | |
| TGKLNRLIS | | TGKLNRLIS | | TVTHAKNILE | | WASGSSISFCG | |
| TGKSHGRIL | | TGKSHGRIL | | TVTHAQDILE | | WASNSIVTFCG | |
| TGKSHGRVL | | TGKSHGRVL | | TVTHAQDILG | | WASNSLIALCG | |
| TGLDCIRPC | | TGLDCIRPC | | TVTHAQDLLE | | WAVGRCPRYVK | |
| TGLIDGWYG | | TGLIDGWYG | | TVTHAQNILE | | WAVLKPGQTVK | |
| TGLNCIRPC | | TGLNCIRPC | | TVTHSIELLE | | WAYNAELIVLL | |
| TGLNCMRPC | | TGLNCMRPC | | TVTHSINLLE | | WAYNAELLVLI | |
| TGLRNAHKM | | TGLRNAHKM | | TVTHSVDLLE | | WAYNAELLVLL | |
| TGLRNIPAI | | TGLRNIPAI | | TVTHSVELLE | | WCGMIDGWYGF | |
| TGLRNIPQI | | TGLRNIPQI | | TVTHSVNILE | | WCKIVTTVGWS | |
| TGLRNIPSI | | TGLRNIPSI | | TVTHSVNLLE | | WDANGWVSTDK | |
| TGLRNVPAI | | TGLRNVPAI | | TVTLHFKQHD | | WDANGWVTADK | |
| TGLRNVPIP | | TGLRNVPIP | | TVTLHFKQHE | | WDDGAILPFDI | |
| TGLRNVPQI | | TGLRNVPQI | | TVTLHFKQHK | | WDDGAILPFGI | |
| TGLRNVPQM | | TGLRNVPQM | | TVTLHFKQNE | | WDDGAILPLTS | |
| TGLRNVPSI | | TGLRNVPSI | | TVTSSIELVE | | WDGLQSSDDFA | |
| TGLRNVPSV | | TGLRNVPSV | | TVTSSVELVE | | WDSFRQSERGE | |
| TGMAADQKS | | TGMAADQKS | | TVVENKYVNN | | WDTINFESTGN | |
| | | | | TVVENTYVNN | | WDTISFESTGN | |

Fig. 83-388

| Block size 8 | SIN | Block size 9 | SIN | Block size 10 | SIN | Block size 11 | SIN |
|---|---|---|---|---|---|---|---|
| TGMAADRDS | | TGMAADRDS | | TVVKTLTNEH | | WDVFIERPTAV | |
| TGMALSVVS | | TGMALSVVS | | TVVLNTDWSG | | WDVINFESTGN | |
| TGMDPRMCS | | TGMDPRMCS | | TVVMTDGNAS | | WDVISFESTGN | |
| TGMIDGWYG | | TGMIDGWYG | | TVVMTDGSAS | | WDWPDGAKIEY | |
| TGMILSVVS | | TGMILSVVS | | TVVMTDGSVS | | WEGLIDGWYGF | |
| TGMKNVPEI | | TGMKNVPEI | | TVVNNITTTI | | WEGLIDGWYGY | |
| TGMKNVPET | | TGMKNVPET | | TVVSSLALAI | | WEGLINGWYGF | |
| TGMRILVRG | | TGMRILVRG | | TVWSSKYQQS | | WEGLVDGWYGF | |
| TGMRNIPEK | | TGMRNIPEK | | TVWSSKYQRS | | WEGMIDGWYGF | |
| TGMRNIPEN | | TGMRNIPEN | | TVWSSKYRRS | | WEGMMDGWYGF | |
| TGMRNIPER | | TGMRNIPER | | TVWTSGSSIS | | WEGMVDGWYGF | |
| TGMRNIPGK | | TGMRNIPGK | | TVWTSSSSIV | | WEGMVNGWYGF | |
| TGMRNVPEI | | TGMRNVPEI | | TVWWTSNSIV | | WEGNILRTQES | |
| TGMRNVPEK | | TGMRNVPEK | | TVYWWDGLQS | | WEINGPDSVLV | |
| TGMRNVPEN | | TGMRNVPEN | | TVYYDRRLTT | | WEINGPESVLI | |
| TGMRNVPER | | TGMRNVPER | | TVYYERRLTT | | WEINGPESVLV | |
| TGMRNVPET | | TGMRNVPET | | TVYYNGRLTT | | WEKNCTLIDAL | |
| TGMRNVPEV | | TGMRNVPEV | | TVYYNKRLTT | | WEMGLAPSPYN | |
| TGMTLSVVN | | TGMTLSVVN | | TVYYNRRLTT | | WEMGQAPSPCN | |
| TGMTLSVVS | | TGMTLSVVS | | TVYYNRRPTT | | WEMGQAPSPYN | |
| TGMVDGWYG | | TGMVDGWYG | | TWAGKILRTQ | | WEMGQAPSPYT | |
| TGMVNGWYG | | TGMVNGWYG | | TWAGNILRTQ | | WEQLYTPGGEV | |
| TGMWDTLIE | | TGMWDTLIE | | TWAIHHPPTS | | WEQMYNPGGEV | |
| TGNDRNATA | | TGNDRNATA | | TWAIHHPPTT | | WEQMYTPGGEV | |
| TGNFIAPEY | | TGNFIAPEY | | TWAKNILRTQ | | WEQMYTPGGGV | |
| TGNGCFDIL | | TGNGCFDIL | | TWARNILRTQ | | WEQMYTPGGKV | |
| TGNGCFEFY | | TGNGCFEFY | | TWDTLIERDN | | WETTGRNCTVP | |
| TGNHGSLVL | | TGNHGSLVL | | TWDTLIEREN | | WEVNGPESVLV | |
| TGNKLITVG | | TGNKLITVG | | TWDTLIERGS | | WFGYFGIFFVE | |
| TGNLIAPEY | | TGNLIAPEY | | TWDVFIERPT | | WFRNALSIAPI | |
| TGNLIAPRG | | TGNLIAPRG | | TWLGGTISPR | | WFRNILSIAPI | |
| TGNLQALKI | | TGNLQALKI | | TWLGRTFSPR | | WFRNILSMAPI | |
| TGNLQTLKI | | TGNLQTLKI | | TWLGRTISIA | | WFRNVLSIAPI | |
| TGNLQTLKL | | TGNLQTLKL | | TWLGRTISPH | | WFRNVLSVAPI | |
| TGNLQTLKV | | TGNLQTLKV | | TWLGRTISPK | | WFSFGASCFIF | |
| TGNLQTLRI | | TGNLQTLRI | | TWLGRTISPR | | WFSFGASCFIL | |
| TGNLVAPEY | | TGNLVAPEY | | TWLGRTISTA | | WFSFGASCFLF | |
| TGNPIICLG | | TGNPIICLG | | TWLGRTTSTA | | WFSFGASCFLL | |
| TGNPVICLG | | TGNPVICLG | | TWLHVCVTGD | | WFSFGASCFTL | |
| TGNPVICMG | | TGNPVICMG | | TWNGVKVDGS | | WFSFGASCFVL | |
| TGPADTRIY | | TGPADTRIY | | TWSQNILRTQ | | WFSFGASCLIL | |
| TGPADTRVY | | TGPADTRVY | | TWVGRTISIA | | WFSFGASCVML | |
| TGPAETRIY | | TGPAETRIY | | TYAGAINSSK | | WFSFGASSFVL | |
| TGPAETRVY | | TGPAETRVY | | TYAGAINSSR | | WFSHYNQMKQA | |
| TGPDATAVA | | TGPDATAVA | | TYAGAVNSSK | | WFSHYNQMTQA | |
| TGPDSTAVA | | TGPDSTAVA | | TYCSLNGISP | | WFSHYNQVAQT | |
| TGPDTTAVA | | TGPDTTAVA | | TYCSLNGVSP | | WFSHYNQVTQP | |
| TGPPQCDLF | | TGPPQCDLF | | TYDHAQYREE | | WFSHYNQVTQT | |
| TGPPQCDQF | | TGPPQCDQF | | TYDHKDFEEE | | WFSLGASCFLL | |
| TGPRNVPAI | | TGPRNVPAI | | TYDHKDYEEE | | WGDILDGVTAS | |
| TGPRNVPQI | | TGPRNVPQI | | TYDHKEFEEE | | WGDILEGTTAS | |
| TGQAADLKS | | TGQAADLKS | | TYDHKEFEKE | | WGDVLDGVTAS | |
| TGQAADYES | | TGQAADYES | | TYDHKEYEEE | | WGIHHPDSETT | |
| TGQAADYKS | | TGQAADYKS | | TYDHNIYRDE | | WGIHHPDTEAT | |
| TGRDVLVIW | | TGRDVLVIW | | TYDHSHYREE | | WGIHHPDTEAV | |
| TGRDVLVLW | | TGRDVLVLW | | TYDHSQYREE | | WGIHHPDTEEV | |
| TGRDVLVMW | | TGRDVLVMW | | TYDHTQYREE | | WGIHHPDTETT | |
| TGRGIEVVN | | TGRGIEVVN | | TYDWTLNRNQ | | WGIHHPPDAKE | |
| TGRIDFHWL | | TGRIDFHWL | | TYDYPKYEEE | | WGIHHPPDETE | |
| TGRIFQSGI | | TGRIFQSGI | | TYDYPKYEKE | | WGIHHPPDTKE | |
| TGRIFQSGV | | TGRIFQSGV | | TYDYPKYSEE | | WGIHHPPNTKE | |
| TGRIFQSRI | | TGRIFQSRI | | TYDYPKYSKE | | WGIHHPSSAQE | |

Fig. 83-389

| Block size 8 | SIN | Block size 9 | SIN | Block size 10 | SIN | Block size 11 | SIN |
|---|---|---|---|---|---|---|---|
| TGRNCTIPC | | TGRNCTIPC | | TYDYSKYEEE | | WGIHHPSSTKE | |
| TGRNCTVPC | | TGRNCTVPC | | TYGAGSWPDG | | WGIHHPSSTQE | |
| TGRQEIVDN | | TGRQEIVDN | | TYGSGSWPDG | | WGILKRGETLK | |
| TGRSSFFRN | | TGRSSFFRN | | TYGTGSWPDG | | WGMELRRCLLQ | |
| TGRVTVSTR | | TGRVTVSTR | | TYGTGTWPDG | | WGMEMRRCLLQ | |
| TGSFCSIDG | | TGSFCSIDG | | TYHNSFVPVV | | WGMGQAPSPYN | |
| TGSFCSING | | TGSFCSING | | TYISIGTSTL | | WGNGCFEFYHK | |
| TGSIYIEVL | | TGSIYIEVL | | TYISVGTSTL | | WGNVLDGVTAS | |
| TGSPGAPGV | | TGSPGAPGV | | TYIWTYQAEL | | WGTIVSSLPFQ | |
| TGSPSAPGV | | TGSPSAPGV | | TYKILSIYSS | | WGVHHPSSDNE | |
| TGSSFYAEM | | TGSSFYAEM | | TYKILSIYST | | WGVHHPSTDAE | |
| TGSVYIEVL | | TGSVYIEVL | | TYKILTIYST | | WGVHHPSTDKE | |
| TGSWADGAN | | TGSWADGAN | | TYNAELFVLM | | WGVHHPSTDTE | |
| TGSWPDGAD | | TGSWPDGAD | | TYNAELLILL | | WGVHHSSSLDE | |
| TGSWPDGAE | | TGSWPDGAE | | TYNAELLVAM | | WHASNRPWISF | |
| TGSWPDGAN | | TGSWPDGAN | | TYNAELLVLI | | WHASNRPWVSF | |
| TGSYVRLYL | | TGSYVRLYL | | TYNAELLVLL | | WHDGAEIIYFE | |
| TGTAADLKS | | TGTAADLKS | | TYNAELLVLM | | WHDGAEIIYFK | |
| TGTAKHIEE | | TGTAKHIEE | | TYNAEVLVLM | | WHDGAEITYFK | |
| TGTAKQNYL | | TGTAKQNYL | | TYNGIRTNGA | | WHGANRPWVSF | |
| TGTFCSING | | TGTFCSING | | TYNHEDYKEE | | WHGSNRPWISF | |
| TGTFEFTSF | | TGTFEFTSF | | TYNHEDYREE | | WHGSNRPWLSF | |
| TGTGYTMDT | | TGTGYTMDT | | TYNHKDYEEE | | WHGSNRPWVSF | |
| TGTLNRLID | | TGTLNRLID | | TYNHKEYEEE | | WHIFGKDNAIR | |
| TGTNRPILV | | TGTNRPILV | | TYNHTEYRQE | | WHIFGKDNAVR | |
| TGTNRPVLI | | TGTNRPVLI | | TYNHTQYREE | | WHIFSKDNAIR | |
| TGTNRPVLV | | TGTNRPVLV | | TYNKTVINNI | | WHILSKDNAIR | |
| TGTNRPVVV | | TGTNRPVVV | | TYNNTTGRDV | | WHILSKDNAVR | |
| TGTNSFYRN | | TGTNSFYRN | | TYNNTVINNI | | WHIYGKDNAIR | |
| TGTSSFYRN | | TGTSSFYRN | | TYNNTVINNM | | WHIYGKDNAVR | |
| TGTWDTLIE | | TGTWDTLIE | | TYNNTVVNNI | | WHSNLNDATYQ | |
| TGTYCSLDG | | TGTYCSLDG | | TYNRKEYEEE | | WHSNLNDTTYQ | |
| TGTYCSLGG | | TGTYCSLGG | | TYNSTVVNNI | | WHVRKRFADQE | |
| TGTYCSLNG | | TGTYCSLNG | | TYNTELLVLM | | WICMGHHAVAN | |
| TGTYCSLSG | | TGTYCSLSG | | TYNVELLVLM | | WIELIRGRPKE | |
| TGVDCIRPC | | TGVDCIRPC | | TYNYPKYEEE | | WIGRTKSLESR | |
| TGVDEYSST | | TGVDEYSST | | TYNYPKYSEE | | WIKTRPILSPL | |
| TGVESAVLR | | TGVESAVLR | | TYQAELLIAM | | WILGNPMCDDL | |
| TGVLTDTSR | | TGVLTDTSR | | TYQAELLVAM | | WILGNPMCDEL | |
| TGVPVTSSV | | TGVPVTSSV | | TYQILSIYST | | WILGNPMCDNL | |
| TGVTLSVVS | | TGVTLSVVS | | TYQKRMGVQM | | WILGNPMCDYL | |
| TGWSWPDGA | | TGWSWPDGA | | TYQNNFVPVI | | WILGNPRCDDL | |
| TGYAQTDCV | | TGYAQTDCV | | TYQNNFVPVM | | WILWISFAISC | |
| TGYEKNATA | | TGYEKNATA | | TYQNNFVPVV | | WILWISFAMSC | |
| TGYHFEECS | | TGYHFEECS | | TYQNSFVPVV | | WILWISFATSC | |
| TGYICSKFH | | TGYICSKFH | | TYQRTRALVR | | WIPKRNRSILN | |
| TGYTMDTVN | | TGYTMDTVN | | TYQSNFVPVV | | WIQNEFNKACE | |
| TGYTMDTVS | | TGYTMDTVS | | TYQWIIKNWE | | WIQSEFNKACE | |
| TGYVCSKFH | | TGYVCSKFH | | TYQWIIRNWE | | WIRFNSDLDYQ | |
| THAEDILEK | | THAEDILEK | | TYQWVIRNWE | | WIRFNSDPDYQ | |
| THAKDILEK | | THAKDILEK | | TYRCHKGDTQ | | WIRFNSNLDYQ | |
| THAKNILEK | | THAKNILEK | | TYRCHRGDAQ | | WIRINNETILE | |
| THALRELWQ | | THALRELWQ | | TYRCHRGDMQ | | WISFAISCFLL | |
| THAQDILEK | | THAQDILEK | | TYRCHRGDTH | | WISFAISCLLL | |
| THAQDILER | | THAQDILER | | TYRCHRGDTQ | | WISFAMSCFLL | |
| THAQDLLEK | | THAQDLLEK | | TYREEAMQNR | | WISFATSCFLL | |
| THAQNILEK | | THAQNILEK | | TYRILSIYST | | WISFSISCFLL | |
| THDRTAFRG | | THDRTAFRG | | TYRNNRKEPA | | WISFSMSCFVF | |
| THESECVCI | | THESECVCI | | TYRNTRKEPA | | WITIGISGPDD | |
| THFEKIKIL | | THFEKIKIL | | TYSGIRTNGA | | WITIGISGPDN | |
| THFEKVKIL | | THFEKVKIL | | TYSGIRTNGT | | WITREPYVSCD | |
| THFQRKRRI | | THFQRKRRI | | TYSGIRTNGV | | WIVGNPSCASN | |

Fig. 83-390

| Block size 8 | SIN | Block size 9 | SIN | Block size 10 | SIN | Block size 11 | SIN |
|---|---|---|---|---|---|---|---|
| THFQRKRRV | | THFQRKRRV | | TYSSPMMWEI | | WIVGNPSCATN | |
| THGALLNDK | | THGALLNDK | | TYSSSLMWEI | | WKGANRPIITI | |
| THGSLLNDK | | THGSLLNDK | | TYSSSMMWEI | | WKGANRPVIII | |
| THGTGSWPD | | THGTGSWPD | | TYSSSMMWEV | | WKGANRPVITI | |
| THHMRKKRG | | THHMRKKRG | | TYTGAINSSK | | WKGGSIKTKLP | |
| THIHIFSFN | | THIHIFSFN | | TYTGAINSSR | | WKGGSINTKLP | |
| THIHIFSFT | | THIHIFSFT | | TYTGISKACN | | WKGNIMRTQES | |
| THIMIWHSN | | THIMIWHSN | | TYTGTSKACN | | WKGSNRPIIDI | |
| THISKYLCS | | THISKYLCS | | TYTGTSRACN | | WKGSNRPIVDI | |
| THISVGTST | | THISVGTST | | TYVDGFEPNG | | WKGSNRPVIDI | |
| THKQLTHHM | | THKQLTHHM | | TYVDGFKPNG | | WKGSNRPVIDV | |
| THLEICFMY | | THLEICFMY | | TYVLSIIPSG | | WKGSNRPVVDI | |
| THLEVCFMY | | THLEVCFMY | | TYVLSIVPSG | | WKGSNRPWIRI | |
| THLMIWHSN | | THLMIWHSN | | TYVLSVIPSG | | WKGSNRPWMKI | |
| THMEVCFMY | | THMEVCFMY | | TYVSIGTSTL | | WKGSNRPWMRI | |
| THMMIWHSN | | THMMIWHSN | | TYVSVGTSTL | | WKGSNRPWVRI | |
| THMSKYLCS | | THMSKYLCS | | TYWWDGLQSS | | WKGSNRPWVRM | |
| THNGKLCKL | | THNGKLCKL | | TYYYPKYEEE | | WKHVTNTILLV | |
| THNGKLCRL | | THNGKLCRL | | VAASLCLAIL | | WKKQILRTQES | |
| THNGRLCKL | | THNGRLCKL | | VAASLCLAVL | | WLEMIRGKPEE | |
| THQYSEKGK | | THQYSEKGK | | VACGPAECRT | | WLEMIRGKPKE | |
| THQYSEKGR | | THQYSEKGR | | VACGPSECRT | | WLEMIRGRPEE | |
| THQYSERGK | | THQYSERGK | | VACGPTECRT | | WLENEKTLDLH | |
| THQYSERGR | | THQYSERGR | | VACSPSECRT | | WLGGTISPRSR | |
| THSIELLEN | | THSIELLEN | | VADGGPNLYN | | WLGRTFSPRSR | |
| THSIELLES | | THSIELLES | | VADRDSTQKA | | WLGRTISIASR | |
| THSSKYLCS | | THSSKYLCS | | VADYKSTQAA | | WLGRTISKDLR | |
| THSVELLED | | THSVELLED | | VAEINTWARN | | WLGRTISKDSR | |
| THSVELLEN | | THSVELLEN | | VAFCGTSGTY | | WLGRTISKDTR | |
| THSVELLES | | THSVELLES | | VAGGLILGMQ | | WLGRTISPHSR | |
| THSWIPKRN | | THSWIPKRN | | VAGLSFWMCS | | WLGRTISPKLR | |
| THSWTPKRN | | THSWTPKRN | | VAGLSFWRCS | | WLGRTISPRLR | |
| THSWVPILN | | THSWVPILN | | VAGSLSLAIM | | WLGRTISPRSR | |
| THSWVPKRN | | THSWVPKRN | | VAGSSEQAAE | | WLGRTISTASR | |
| THTGTSKAC | | THTGTSKAC | | VAGWILGNPE | | WLGRTLNTASR | |
| THTGTYCSL | | THTGTYCSL | | VAGWILGNPK | | WLGRTTSKDSR | |
| THTSKYLCS | | THTSKYLCS | | VAGWLLGNPE | | WLGRTTSTASR | |
| THTSQYICS | | THTSQYICS | | VAGWLLGNPL | | WLGRTVSINGR | |
| THTSRYLCS | | THTSRYLCS | | VAGWLLGNPM | | WLGRTVSISGR | |
| THVQNNYTT | | THVQNNYTT | | VAGWYGFQHQ | | WLGRTVSNSGR | |
| TIAGFIEGG | | TIAGFIEGG | | VAGWYGFQHS | | WLGRTVSTSGR | |
| TIALFIGVG | | TIALFIGVG | | VAGWYGFQHT | | WLHICVTGDDR | |
| TIALIIGVG | | TIALIIGVG | | VAHKSCLPAC | | WLHVCITGDDR | |
| TIALLIGIG | | TIALLIGIG | | VAIALSILNL | | WLHVCVTGDDG | |
| TIALLIGVG | | TIALLIGVG | | VAIALSVLNL | | WLHVCVTGDDK | |
| TIASDILKR | | TIASDILKR | | VAIENQHTID | | WLHVCVTGDDR | |
| TIASDILTR | | TIASDILTR | | VAIVFSQEDC | | WLIIGISGPDN | |
| TIASSLPFQ | | TIASSLPFQ | | VAKAGFIENG | | WLKTRPILSPL | |
| TICIGYHAN | | TICIGYHAN | | VAKDNAIRFG | | WLLGNPECDIL | |
| TICIQGNND | | TICIQGNND | | VALALSHTAY | | WLLGNPECDLF | |
| TICVGYHAN | | TICVGYHAN | | VALCGSKEQL | | WLLGNPECDLL | |
| TICVQGNND | | TICVQGNND | | VALCGSKERL | | WLLGNPECDRL | |
| TICVQGNNK | | TICVQGNNK | | VALCGSPISV | | WLLGNPKCDRL | |
| TICVQGNNN | | TICVQGNNN | | VALCGSPVPV | | WLLGNPLCDEF | |
| TIDEESRAR | | TIDEESRAR | | VALCGSPVSV | | WLLGNPMCDEF | |
| TIDLADSEM | | TIDLADSEM | | VALCGSRERL | | WLLGNPMCDKF | |
| TIDLTDAEM | | TIDLTDAEM | | VALENQHTID | | WLLGNPTCDEF | |
| TIDLTDSEM | | TIDLTDSEM | | VALENQHTIH | | WLLSSKANQVF | |
| TIDLTNSEM | | TIDLTNSEM | | VALENQNTID | | WLLSSKDNQVF | |
| TIDMADSEM | | TIDMADSEM | | VALGYSTGAL | | WLSSSGNNQVF | |
| TIDMTDSEM | | TIDMTDSEM | | VALILGFVLW | | WLSSSMNNQVF | |
| TIDQITGKL | | TIDQITGKL | | VALSYSAGAL | | WLTIGISGPDD | |

Fig. 83-391

| Block size 8 | SIN | Block size 9 | SIN | Block size 10 | SIN | Block size 11 | SIN |
|---|---|---|---|---|---|---|---|
| TIDQVTGKL | | TIDQVTGKL | | VALSYSTGAL | | WLTIGISGPDN | |
| TIDSTDSEM | | TIDSTDSEM | | VAMENQHTID | | WLTIGISGPDS | |
| TIDVTDSEM | | TIDVTDSEM | | VAMVFSQEDC | | WLTIGITGPDA | |
| TIEKMVLSA | | TIEKMVLSA | | VAMVFSQEDR | | WLTIGVSGPDN | |
| TIEMTDSEM | | TIEMTDSEM | | VAMVFSQEEC | | WLTKATNGNYG | |
| TIERMVLSA | | TIERMVLSA | | VANFSMELPS | | WLTKETNGNYG | |
| TIGDCPKYM | | TIGDCPKYM | | VANGTKVNTL | | WLTKKEPDTYD | |
| TIGDCPKYV | | TIGDCPKYV | | VAPEYGFKIS | | WLTKKKNPEAY | |
| TIGECPKYI | | TIGECPKYI | | VAPIMFSNKM | | WLTKKKPDIYD | |
| TIGECPKYV | | TIGECPKYV | | VAPSPSNSRF | | WLTKKKPDTYD | |
| TIGECPRYV | | TIGECPRYV | | VAPSPYNSRF | | WLTLGITGPDA | |
| TIGISGPDD | | TIGISGPDD | | VAPVLGNYKE | | WLTLGITGPDS | |
| TIGISGPDN | | TIGISGPDN | | VARCNTKCQT | | WLTLGITGPDT | |
| TIGISGPDS | | TIGISGPDS | | VARLGKGYMF | | WLTLKLGQFPV | |
| TIGITGPDA | | TIGITGPDA | | VASMRRNYFT | | WLTLKSEQFPV | |
| TIGKCPKYV | | TIGKCPKYV | | VASSLVLLFM | | WLTLKSGQFPV | |
| TIGKCSKYV | | TIGKCSKYV | | VASSLVLLLM | | WLWLVLREKMP | |
| TIGLLLQII | | TIGLLLQII | | VATGRVTVST | | WMACHSAAFED | |
| TIGLLLQIT | | TIGLLLQIT | | VATTHSWIPK | | WMACNSAAFED | |
| TIGNLIAPR | | TIGNLIAPR | | VATTHSWTPK | | WMCFNGSLQCR | |
| TIGNLVAPR | | TIGNLVAPR | | VATTHSWVPI | | WMCLNGSMQCR | |
| TIGSASLGL | | TIGSASLGL | | VATTHSWVPK | | WMCPNGSLQCT | |
| TIGSISLGL | | TIGSISLGL | | VAVAKDNAIR | | WMCSGHSCRIC | |
| TIGSMSLAL | | TIGSMSLAL | | VAVENQHTID | | WMCSNGSLHGR | |
| TIGSVSLAL | | TIGSVSLAL | | VAVIKYNGII | | WMCSNGSLQCK | |
| TIGSVSLII | | TIGSVSLII | | VAVLKYKGII | | WMCSNGSLQCR | |
| TIGSVSLTI | | TIGSVSLTI | | VAVLKYNDII | | WMCSNGSLQCT | |
| TIGSVSLTL | | TIGSVSLTL | | VAVLKYNGII | | WMCSNGSLQSK | |
| TIGVSGPDN | | TIGVSGPDN | | VAVLKYNGVI | | WMCSNGSLRCR | |
| TIHDGTAFR | | TIHDGTAFR | | VAVTDGPAAN | | WMCSNGSMQCK | |
| TIHDRAAFR | | TIHDRAAFR | | VAWSASACHD | | WMCSNGSMQCN | |
| TIHDRIPHR | | TIHDRIPHR | | VAWSATACHD | | WMCSNGSMQCR | |
| TIHDRSPFR | | TIHDRSPFR | | VAWSATACSD | | WMCSNSSMQCR | |
| TIHDRSPHR | | TIHDRSPHR | | VAWSSSSCFD | | WMDYYWGILKR | |
| TIHDRSPYR | | TIHDRSPYR | | VAWSSSSCHD | | WMGRTISKDSR | |
| TIHDRSQFR | | TIHDRSQFR | | VAWSSTSCFD | | WMGRTISMDSR | |
| TIHDRSQYR | | TIHDRSQYR | | VAYDKICIGY | | WMGRTISRDSR | |
| TIHDRTAFR | | TIHDRTAFR | | VAYERMCNIL | | WMKIIRVGCVI | |
| TIHDRTPHR | | TIHDRTPHR | | VAYMLERELV | | WMKIYWHLMHP | |
| TIHDRTTFR | | TIHDRTTFR | | VCAAWSSSSC | | WMKLYWHLMHP | |
| TIHLTDSEM | | TIHLTDSEM | | VCATCEQIAD | | WMKLYWHLMRP | |
| TIIENNVTV | | TIIENNVTV | | VCFMYSDFHF | | WMKLYWHLMSP | |
| TIIESNVTV | | TIIESNVTV | | VCHKGICPVV | | WMLLDPGDTVT | |
| TIIETGYVC | | TIIETGYVC | | VCHKGVCPVI | | WMMAMKYPITA | |
| TIIFEANGN | | TIIFEANGN | | VCHKGVCPVV | | WMMAMRYPITA | |
| TIIFEASGN | | TIIFEASGN | | VCHNGICPVV | | WMRINNETILE | |
| TIIFEATGN | | TIIFEATGN | | VCHNGTCAVV | | WMRISNETILE | |
| TIIGPPQCD | | TIIGPPQCD | | VCHNGTCVVI | | WNENQNPRIFL | |
| TIINNYHNE | | TIINNYHNE | | VCHNGTCVVV | | WNENQNPRMFL | |
| TIINNYYND | | TIINNYYND | | VCHNGVCPVV | | WNENQNPRVFL | |
| TIINNYYNE | | TIINNYYNE | | VCHSGICPVV | | WNGVKVDGSSS | |
| TIINNYYNK | | TIINNYYNK | | VCHSGVCPVV | | WNVSSSGTSKA | |
| TIISNLPFQ | | TIISNLPFQ | | VCIAWSSASC | | WNVTHTGTSKA | |
| TIISSLPFQ | | TIISSLPFQ | | VCIAWSSSSC | | WNVTRSGTSKA | |
| TIIYSSSMM | | TIIYSSSMM | | VCINGICTVV | | WNVTSSGTSKA | |
| TIKDRSPYR | | TIKDRSPYR | | VCINGSCAVV | | WNVTYTGISKA | |
| TIKNGTYDH | | TIKNGTYDH | | VCINGSCIVV | | WNVTYTGTSKA | |
| TIKNGTYNH | | TIKNGTYNH | | VCINGSCTVV | | WNVTYTGTSRA | |
| TIKNGTYNR | | TIKNGTYNR | | VCINGTCAVV | | WNWPDGAEIEY | |
| TIKPWARNI | | TIKPWARNI | | VCINGTCTVI | | WNWPDGAKIET | |
| TIKQNGKSG | | TIKQNGKSG | | VCINGTCTVV | | WNWPDGAKIEY | |
| TIKTWAGKI | | TIKTWAGKI | | VCISGPNNNA | | WPDGADINFMP | |

Fig. 83-392

| Block size 8 | SIN | Block size 9 | SIN | Block size 10 | SIN | Block size 11 | SIN |
|---|---|---|---|---|---|---|---|
| TIKTWAGNI | | TIKTWAGNI | | VCISGTCAVV | | WPDGADINYMP | |
| TIKTWAKNI | | TIKTWAKNI | | VCITGDDRNA | | WPDGAEIEYFL | |
| TIKTWARNI | | TIKTWARNI | | VCMAWSSSSC | | WPDGAKIEYFL | |
| TILEKNITV | | TILEKNITV | | VCMESVRNGT | | WPDGAKIKYFL | |
| TILEKNVTV | | TILEKNVTV | | VCMSGPNNNA | | WPDGALLPFDI | |
| TILEQNVTV | | TILEQNVTV | | VCPVVFTDGS | | WPDGANIDFMP | |
| TILERNVTV | | TILERNVTV | | VCPVVMTDGP | | WPDGANIGFMP | |
| TILETGYIC | | TILETGYIC | | VCQDEFCYTL | | WPDGANIGLCP | |
| TILETGYVC | | TILETGYVC | | VCQNGVCPVV | | WPDGANINFMA | |
| TILETRYVC | | TILETRYVC | | VCRALLAKSV | | WPDGANINFMP | |
| TILRTQESE | | TILRTQESE | | VCRDNWHASN | | WPDGANINLMP | |
| TIMEKNVTV | | TIMEKNVTV | | VCRDNWHGSN | | WPDGANTNFMP | |
| TIMERNVTV | | TIMERNVTV | | VCRDNWKGAN | | WPDGSDIGFMP | |
| TINDRSPFR | | TINDRSPFR | | VCRDNWKGCN | | WPDGSNIGFMP | |
| TINEEALRQ | | TINEEALRQ | | VCRDNWKGSN | | WPDGSNIGLCP | |
| TINFESTGN | | TINFESTGN | | VCRDNWMGSN | | WPGLINGWYGF | |
| TINRIFQPN | | TINRIFQPN | | VCRDNWNGMN | | WPGLVAGWYGF | |
| TINRNFQPN | | TINRNFQPN | | VCRDNWQGAN | | WPLSSPPTVYN | |
| TINRSFQPN | | TINRSFQPN | | VCRDNWRGSN | | WPQSSPPTVYN | |
| TINRSFRPN | | TINRSFRPN | | VCRDNWTGTN | | WQGANRPIIEI | |
| TINSKIDDQ | | TINSKIDDQ | | VCRTLLAKSV | | WQGANRPVIEI | |
| TINSPLPFQ | | TINSPLPFQ | | VCSGIFGDNP | | WQGANRPVIKI | |
| TINSWHIFG | | TINSWHIFG | | VCSGIFGDSP | | WQGLIDGWYGF | |
| TINSWHIYG | | TINSWHIYG | | VCSGLVGDTP | | WQGLVDGWYGY | |
| TINTASRSG | | TINTASRSG | | VCSGVFGDNP | | WQGMIDGWYGY | |
| TINYYNETF | | TINYYNETF | | VCSKFHSDTP | | WQGMVDGWYGF | |
| TIPCFWVEM | | TIPCFWVEM | | VCSNGSCRCT | | WQGMVDGWYGY | |
| TIPINNTIY | | TIPINNTIY | | VCTGILTDTS | | WQGSNRPVIQI | |
| TIPINNTVY | | TIPINNTVY | | VCTGVLTDTS | | WQGSNRPVIRI | |
| TIPVNNTIY | | TIPVNNTIY | | VCTKGKKAVD | | WQGSNRPWIRF | |
| TIQIIKLLP | | TIQIIKLLP | | VCVAWSSSSC | | WREQLSQKFEE | |
| TIQNEDIPI | | TIQNEDIPI | | VCVCRDNWHA | | WRGANRPVITI | |
| TIREKNVTV | | TIREKNVTV | | VCVSLLQSAI | | WRGGSINTKLP | |
| TIRGKHSNG | | TIRGKHSNG | | VCVTGDDGNA | | WRGGSINTRLP | |
| TIRGRHSNG | | TIRGRHSNG | | VCVTGDDKNA | | WRGSNRPIVDI | |
| TIRNGTYDH | | TIRNGTYDH | | VCVTGDDRNA | | WRGSNRPWIRF | |
| TIRNGTYNH | | TIRNGTYNH | | VCWSFALAQG | | WRKDILRTQES | |
| TIRNKHSNG | | TIRNKHSNG | | VCYNPCFYVE | | WRKKILRTQES | |
| TIRNKHSNS | | TIRNKHSNS | | VCYPGSIENQ | | WRKQILRTQES | |
| TIRNRHSNG | | TIRNRHSNG | | VCYPGSIKNQ | | WRRDILRTQES | |
| TIRQELASR | | TIRQELASR | | VDALLGDPHC | | WRRQILRTQES | |
| TIRQEMAIR | | TIRQEMAIR | | VDCFLWHVRK | | WSASACHDGAS | |
| TIRQEMANR | | TIRQEMANR | | VDDAVTDIWS | | WSASACHDGIS | |
| TIRQEMASK | | TIRQEMASK | | VDDAVTDVWS | | WSASACHDGSS | |
| TIRQEMASR | | TIRQEMASR | | VDEGNGCFEL | | WSASACHDGTN | |
| TIRTGTYNH | | TIRTGTYNH | | VDGFEPNGCI | | WSASACHDGTS | |
| TIRTWAKNI | | TIRTWAKNI | | VDGFEPNGSI | | WSATACHDGKE | |
| TISCDSPSN | | TISCDSPSN | | VDGFEPNGYI | | WSATACHDGKG | |
| TISFESTGN | | TISFESTGN | | VDGFKPNGCI | | WSATACHDGKK | |
| TISIASRSG | | TISIASRSG | | VDGQDCDLIN | | WSATACHDGRK | |
| TISKDLRSG | | TISKDLRSG | | VDGQSGRIDF | | WSATACSDGPG | |
| TISKDSRSG | | TISKDSRSG | | VDGSSSACLR | | WSATACSDGSG | |
| TISKDTRSG | | TISKDTRSG | | VDGTIAGFIE | | WSFALAQGALL | |
| TISLVKTTL | | TISLVKTTL | | VDGWYGFHHS | | WSFALAQGALV | |
| TISMDSRSG | | TISMDSRSG | | VDGWYGFRHH | | WSFALAQGTLL | |
| TISPHSRSG | | TISPHSRSG | | VDGWYGFRHQ | | WSFALAQGVLL | |
| TISPKLRSG | | TISPKLRSG | | VDGWYGYHHE | | WSGLIAGWYGF | |
| TISPRLRSG | | TISPRLRSG | | VDGWYGYHHI | | WSGLVAGWYGF | |
| TISPRSRNG | | TISPRSRNG | | VDGWYGYHHN | | WSGMIDGWYGF | |
| TISPRSRSG | | TISPRSRSG | | VDGWYGYHHQ | | WSGYSGAFIDY | |
| TISRDSRSG | | TISRDSRSG | | VDGWYGYHHS | | WSGYSGAFINY | |
| TISTASRAG | | TISTASRAG | | VDGWYGYHHT | | WSGYSGAFMDY | |

Fig. 83-393

| Block size 8 | SIN | Block size 9 | SIN | Block size 10 | SIN | Block size 11 | SIN |
|---|---|---|---|---|---|---|---|
| TISTASRSG | | TISTASRSG | | VDHMAIIKKY | | WSGYSGAFTIP | |
| TISTASRYG | | TISTASRYG | | VDKLTQGRQT | | WSGYSGAFTVP | |
| TITFEATGN | | TITFEATGN | | VDKMNREFEV | | WSGYSGAFVDY | |
| TITFSFNGA | | TITFSFNGA | | VDKMNREFGV | | WSGYSGIFSIE | |
| TITGDNTKW | | TITGDNTKW | | VDLGQCGLLG | | WSGYSGIFSVE | |
| TITGPPQCD | | TITGPPQCD | | VDLGSCGILG | | WSGYSGSFIDY | |
| TITIGSVSL | | TITIGSVSL | | VDLVETNHTG | | WSGYSGSFIQH | |
| TITLHFKQN | | TITLHFKQN | | VDLWSYNAEL | | WSGYSGSFMDY | |
| TITNPLIRH | | TITNPLIRH | | VDNHSMSDIE | | WSGYSGSFSIR | |
| TITSNLPFQ | | TITSNLPFQ | | VDNKNWSGYS | | WSGYSGSFTIP | |
| TITSPLPFQ | | TITSPLPFQ | | VDNNGELRHL | | WSGYSGSFTLP | |
| TITYSSPMM | | TITYSSPMM | | VDNNNWFGYF | | WSGYSGSFVDY | |
| TITYSSSLM | | TITYSSSLM | | VDNNNWSGYS | | WSGYSGSFVQH | |
| TITYSSSMM | | TITYSSSMM | | VDNNSWSGYS | | WSGYSGVFSVE | |
| TIVEKNVTV | | TIVEKNVTV | | VDNQNWSGYS | | WSHNILRTQES | |
| TIVETGYVC | | TIVETGYVC | | VDNSNWSGYS | | WSKNILRTQES | |
| TIVKTLTNE | | TIVKTLTNE | | VDQITGKLNR | | WSKPQCHITGF | |
| TIVKTLTSE | | TIVKTLTSE | | VDQSLIIAAR | | WSKPQCKITGF | |
| TIVLNTDWS | | TIVLNTDWS | | VDQSLVIAAR | | WSKPQCQIAGF | |
| TIVLTTDWS | | TIVLTTDWS | | VDQVRESRNP | | WSKPQCQITGF | |
| TIVSNTDWS | | TIVSNTDWS | | VDRFYRICKL | | WSKRYELEIGA | |
| TIVSSLPFQ | | TIVSSLPFQ | | VDRFYRTCKL | | WSKRYELEIGT | |
| TIWASGSSI | | TIWASGSSI | | VDRLTQGRQT | | WSQNILKKQES | |
| TIWTSASSI | | TIWTSASSI | | VDSIGSWSQN | | WSQNILRTQES | |
| TIWTSGSII | | TIWTSGSII | | VDSIVSWSQN | | WSRRYELEIGT | |
| TIWTSGSSI | | TIWTSGSSI | | VDTCYPFDVP | | WSRSSCHDGKA | |
| TIWTSSSSI | | TIWTSSSSI | | VDTGDGCFEI | | WSSASCHDGRA | |
| TIWTSSSSV | | TIWTSSSSV | | VDTGNGCFDI | | WSSSSCFDGKE | |
| TIYSTAASS | | TIYSTAASS | | VDTIIENNVT | | WSSSSCFDGRE | |
| TIYSTVASS | | TIYSTVASS | | VDTIIESNVT | | WSSSSCHDGKA | |
| TIYWWDGLQ | | TIYWWDGLQ | | VDTILEKNIT | | WSSSSCHDGKS | |
| TKAPQLNPI | | TKAPQLNPI | | VDTILEKNVT | | WSSSSCHDGNA | |
| TKATKMEAI | | TKATKMEAI | | VDTILERNVT | | WSSSSCHDGRA | |
| TKATKMKAI | | TKATKMKAI | | VDTIMEKNIT | | WSSSSCYDGKA | |
| TKATNGNYG | | TKATNGNYG | | VDTIMEKNVT | | WSSTSCFDGKE | |
| TKCQLNEGV | | TKCQLNEGV | | VDTIMERNVT | | WSSTSCHDGIG | |
| TKCQSPLGA | | TKCQSPLGA | | VDTLLEKNVT | | WSSTSCHDGKA | |
| TKCQTPLGA | | TKCQTPLGA | | VDTLLENDVP | | WSSTSCHDGKF | |
| TKCQTSLGG | | TKCQTSLGG | | VDTLLENGVP | | WSSTSCHDGKS | |
| TKCQTSMGG | | TKCQTSMGG | | VDTLLENNVP | | WSSTSCHDGKT | |
| TKCQTSVGG | | TKCQTSVGG | | VDTLLESDVP | | WSSTSCHDGRA | |
| TKCQTYAGA | | TKCQTYAGA | | VDTLTEKGIE | | WSSTSCHDGVG | |
| TKCQTYTGA | | TKCQTYTGA | | VDTLTENGVP | | WSSTTCHDGIG | |
| TKDAERGKL | | TKDAERGKL | | VDTLTETGVP | | WSWDDGAILPF | |
| TKDNSIRIG | | TKDNSIRIG | | VDTLTGRGIE | | WSWDDGAILPL | |
| TKDNSIRLS | | TKDNSIRLS | | VDTVLEKNVT | | WSWHDGAEIIY | |
| TKDSITDIW | | TKDSITDIW | | VDTVLERNVT | | WSWHDGAEITY | |
| TKEAQDVIM | | TKEAQDVIM | | VDTVREKNVT | | WSWHDGAILPF | |
| TKEGRRKTN | | TKEGRRKTN | | VDVYCICRDN | | WSWHDGAILPL | |
| TKEGRRRTN | | TKEGRRRTN | | VEAESSVKEK | | WSWHDGAVLPF | |
| TKEKNDLYG | | TKEKNDLYG | | VEAMISRARI | | WSWPDDAELPF | |
| TKEKNELYG | | TKEKNELYG | | VEAMMSRARI | | WSWPDDAELPL | |
| TKEMEGICY | | TKEMEGICY | | VEAMVSRARI | | WSWPDGADLPF | |
| TKENTGSYV | | TKENTGSYV | | VEAVIYGNPK | | WSWPDGAELPF | |
| TKEQTALYK | | TKEQTALYK | | VECICRDNWT | | WSWPDGAELPS | |
| TKEQTTLYK | | TKEQTTLYK | | VECIGWSSTS | | WSWPDGAEVPF | |
| TKETNGNYG | | TKETNGNYG | | VECVCRDNWN | | WSWPDGAKLPF | |
| TKEWSKRYE | | TKEWSKRYE | | VECVCRDNWR | | WSWPDGALFPL | |
| TKEWSRRYE | | TKEWSRRYE | | VECVCRDNWT | | WSWPDGALLPF | |
| TKGDKICLG | | TKGDKICLG | | VECVGWSSTS | | WSWPDGALLPL | |
| TKGEKANVL | | TKGEKANVL | | VEDGFLDVWT | | WSWQDGAILPF | |
| TKGFGFLNE | | TKGFGFLNE | | VEDGSIGKVC | | WSYIVERPKEI | |

Fig. 83-394

| Block size 8 | SIN | Block size 9 | SIN | Block size 10 | SIN | Block size 11 | SIN |
|---|---|---|---|---|---|---|---|
| TKGILGFVF | | TKGILGFVF | | VEDTKIDLWS | | WSYIVERPKEM | |
| TKGKKAVDL | | TKGKKAVDL | | VEDTKVDLWS | | WSYIVERPSAP | |
| TKGLCIINS | | TKGLCIINS | | VEECLINDPW | | WSYIVERTKEM | |
| TKGLCTINS | | TKGLCTINS | | VEECSCYGHN | | WSYLIEDPAAP | |
| TKGLFGAIA | | TKGLFGAIA | | VEECSCYPRF | | WSYLIEDPGAP | |
| TKGMLGFVF | | TKGMLGFVF | | VEECSCYPRS | | WSYLIEDPNAP | |
| TKGVLGFVF | | TKGVLGFVF | | VEECSCYPRY | | WSYLIEDPSAP | |
| TKHDRIPHR | | TKHDRIPHR | | VEEGSIGKVC | | WSYLIEDPTAP | |
| TKIDLWSYN | | TKIDLWSYN | | VEELVHGGID | | WSYNADLLVAM | |
| TKILFIEEG | | TKILFIEEG | | VEELVHGGIN | | WSYNADVLVAL | |
| TKILYFHKG | | TKILYFHKG | | VEELVHGGVD | | WSYNAEFLVAL | |
| TKIMYFHKG | | TKIMYFHKG | | VEELVHGQVN | | WSYNAEFLVAM | |
| TKINNIIDK | | TKINNIIDK | | VEELVHRGID | | WSYNAEFLVAV | |
| TKINNIIEK | | TKINNIIEK | | VEESSIGKVC | | WSYNAEILVAL | |
| TKINTLTER | | TKINTLTER | | VEFEPFQSLV | | WSYNAELLIAM | |
| TKITVDHMA | | TKITVDHMA | | VEGRIQDLEK | | WSYNAELLVAI | |
| TKIVYLNST | | TKIVYLNST | | VEGRIQDLER | | WSYNAELLVAL | |
| TKKEPDTYD | | TKKEPDTYD | | VEGWVVIAKD | | WSYNAELLVAM | |
| TKKKNPEAY | | TKKKNPEAY | | VEGWVVIAQD | | WSYNAGLLVAL | |
| TKKKPDIYD | | TKKKPDIYD | | VEGWVVIEKD | | WSYNAKLLVLI | |
| TKKKPDTYD | | TKKKPDTYD | | VEGWVVVAKD | | WSYNAKLLVLL | |
| TKKMITQRT | | TKKMITQRT | | VEIRINMINS | | WSYNAQLLVLL | |
| TKKMTITFL | | TKKMTITFL | | VEITGIDKVC | | WSYNAQLLVWL | |
| TKKMVTQRT | | TKKMVTQRT | | VEITGINKVC | | WSYNARLLVLL | |
| TKKQLRENA | | TKKQLRENA | | VEKMNTQFTA | | WTCSNGSCRCT | |
| TKLGSPLVL | | TKLGSPLVL | | VEKQIGNVIN | | WTGLIDGWYGY | |
| TKLPFQNLS | | TKLPFQNLS | | VEKQLGNVIN | | WTGMIDGWYGY | |
| TKLYGNGNK | | TKLYGNGNK | | VEKRINMIAD | | WTGMVDGWYGY | |
| TKLYGSGNK | | TKLYGSGNK | | VEKRINMLAD | | WTGMVNGWYGY | |
| TKLYGSGSK | | TKLYGSGSK | | VEKTNEKFHQ | | WTGTNRPILVI | |
| TKLYKNTNT | | TKLYKNTNT | | VELAEKAMKE | | WTGTNRPVLII | |
| TKLYVNKNP | | TKLYVNKNP | | VELAEKTMKE | | WTGTNRPVLMI | |
| TKMEAILVV | | TKMEAILVV | | VELAERAMKE | | WTGTNRPVLVI | |
| TKMKAIIVV | | TKMKAIIVV | | VELIRGMPKE | | WTGTNRPVLVV | |
| TKMKAILVV | | TKMKAILVV | | VELIRGMPQE | | WTKDSITDIWT | |
| TKNLESRSG | | TKNLESRSG | | VELIRGQPKE | | WTLGENMAPEK | |
| TKPRPRRGL | | TKPRPRRGL | | VELIRGRKQE | | WTLNRNQPAAT | |
| TKQLCIAWS | | TKQLCIAWS | | VELIRGRPEE | | WTLVNPGDSII | |
| TKQVCAAWS | | TKQVCAAWS | | VELIRGRPKE | | WTPKRNRSILN | |
| TKQVCIAWS | | TKQVCIAWS | | VELIRGRPQE | | WTQDAMTEVWS | |
| TKQVCMAWS | | TKQVCMAWS | | VELIRGRPRE | | WTRDAMTEIWS | |
| TKQVCVAWS | | TKQVCVAWS | | VELIRGRQQE | | WTRDAMTEVWS | |
| TKQVDTIME | | TKQVDTIME | | VELIRGRSQE | | WTRDSITEVWS | |
| TKRLAVLGK | | TKRLAVLGK | | VELLVLMENE | | WTRDSLTEIWS | |
| TKRLCTINS | | TKRLCTINS | | VELSSGYKDV | | WTRDSMTEIWS | |
| TKRLIQLIV | | TKRLIQLIV | | VELSSMGVYQ | | WTRDSMTEVWS | |
| TKRLTIIGK | | TKRLTIIGK | | VELTRGRPQE | | WTRDSVTELWS | |
| TKRLTILGK | | TKRLTILGK | | VELVRGRPKE | | WTSGSIISFCG | |
| TKRLTVLGK | | TKRLTVLGK | | VEMIRGEPEE | | WTSGSSIAFCG | |
| TKRMVTQRT | | TKRMVTQRT | | VEMIRGKPEE | | WTSGSSISFCG | |
| TKRSHEQME | | TKRSHEQME | | VEMIRGQPKE | | WTSNSIAVFCG | |
| TKRSYEQME | | TKRSYEQME | | VEMIRGRPEE | | WTSNSIISMCS | |
| TKSLESRSG | | TKSLESRSG | | VENGTSVKTL | | WTSNSIIVFCG | |
| TKSTVLKSD | | TKSTVLKSD | | VENLEELRFV | | WTSNSIVAFCG | |
| TKSYFANLK | | TKSYFANLK | | VENLFDEVRR | | WTSNSIVALCG | |
| TKTMTITFL | | TKTMTITFL | | VENLNKKMED | | WTSNSIVSMCS | |
| TKTTVDHMA | | TKTTVDHMA | | VENQEELRSL | | WTSNSIVTFCG | |
| TKVDLWSYN | | TKVDLWSYN | | VENQHTIDLT | | WTSNSIVVFCA | |
| TKVDTLTEK | | TKVDTLTEK | | VENQHTIDST | | WTSNSIVVFCG | |
| TKVLYFHKG | | TKVLYFHKG | | VENRINMLAD | | WTSNSLIALCG | |
| TKVMYFHKG | | TKVMYFHKG | | VENTYVNNTT | | WTSNSLVALCG | |
| TKVNTLTEK | | TKVNTLTEK | | VEPKGLFGAI | | WTSNSMVTFCG | |

Fig. 83-395

| Block size 8 | SIN | Block size 9 | SIN | Block size 10 | SIN | Block size 11 | SIN |
|---|---|---|---|---|---|---|---|
| TKVNTLTER | | TKVNTLTER | | VEPRGLFGAI | | WTSNSVVVFCG | |
| TKVWWTSNS | | TKVWWTSNS | | VEQQIGNVIN | | WTSSSIVVFCG | |
| TKVYNETVR | | TKVYNETVR | | VEQRINMLAD | | WTSSSSIVMCG | |
| TKWNENQNP | | TKWNENQNP | | VERGLFGAIA | | WTSSSSTVFCG | |
| TKWNVTHTG | | TKWNVTHTG | | VERILEEESD | | WTSSSSVVMCG | |
| TKWNVTYTG | | TKWNVTYTG | | VERMVLSAFD | | WTSTSIVVFCG | |
| TLCICYHAN | | TLCICYHAN | | VERPKEIEGI | | WTTNSIVVFCG | |
| TLCIGYHAN | | TLCIGYHAN | | VERPKEMEGI | | WTYNAELFVLM | |
| TLCLGHHAV | | TLCLGHHAV | | VERPKEMEGV | | WTYNAELLILL | |
| TLDEESRAR | | TLDEESRAR | | VERPSAPEGM | | WTYNAELLVLI | |
| TLDEHDANV | | TLDEHDANV | | VERQIGNVIN | | WTYNAELLVLL | |
| TLDEHDSNV | | TLDEHDSNV | | VERRINMLAD | | WTYNAELLVLM | |
| TLDFHDFNV | | TLDFHDFNV | | VERTKEMEGI | | WTYNAEVLVLM | |
| TLDFHDSNV | | TLDFHDSNV | | VESAVLRGFL | | WTYNTELLVLM | |
| TLDFHDSSV | | TLDFHDSSV | | VESMIEAESS | | WTYNVELLVLM | |
| TLDKHDSNV | | TLDKHDSNV | | VESNGNLIAP | | WTYQAELLIAM | |
| TLDLHDANV | | TLDLHDANV | | VESNGNLVAP | | WTYQAELLVAM | |
| TLDLHDSNV | | TLDLHDSNV | | VESRINMINS | | WTYQEELLVAM | |
| TLDMHDANV | | TLDMHDANV | | VESRINTINS | | WVAVAKDNAIR | |
| TLDNEHSNG | | TLDNEHSNG | | VESSTYQNNF | | WVCSNGSCRCT | |
| TLDNKHSND | | TLDNKHSND | | VETGYVCSKF | | WVDDAVTDIWS | |
| TLDNKHSNG | | TLDNKHSNG | | VETIRGKPEE | | WVELIRGQPKE | |
| TLDQHDANV | | TLDQHDANV | | VETNHTDELC | | WVELIRGRPEE | |
| TLDYHDSNV | | TLDYHDSNV | | VETNHTGTYC | | WVELIRGRPKE | |
| TLEFHDSNV | | TLEFHDSNV | | VETRINMINS | | WVELVRGRPKE | |
| TLEHTSRYV | | TLEHTSRYV | | VETSHTGTYC | | WVEMIRGEPEE | |
| TLELRSGYW | | TLELRSGYW | | VETYVLSIIP | | WVEMIRGKPEE | |
| TLELRSKYW | | TLELRSKYW | | VETYVLSIVP | | WVEMIRGQPKE | |
| TLELRSRYW | | TLELRSRYW | | VETYVLSVIP | | WVEMIRGRPEE | |
| TLENKHSNG | | TLENKHSNG | | VEVITAQELV | | WVETIRGKPEE | |
| TLFEKFFPS | | TLFEKFFPS | | VEVLHLTQGT | | WVLGENMAPEK | |
| TLFQQMRDI | | TLFQQMRDI | | VEVTNATELV | | WVLLNASWFNS | |
| TLFQQMRDV | | TLFQQMRDV | | VEVVAAQELV | | WVLWISFAISC | |
| TLGENMAPE | | TLGENMAPE | | VEVVDATETV | | WVMREPYVSCN | |
| TLGITGPDA | | TLGITGPDA | | VEVVNATETV | | WVMTDGPANKQ | |
| TLGITGPDS | | TLGITGPDS | | VEVVSAKELV | | WVMTDGPANNQ | |
| TLGITGPDT | | TLGITGPDT | | VEVVTAQELV | | WVMTDGPANRQ | |
| TLGLDIRTA | | TLGLDIRTA | | VEWSATACHD | | WVMTDGPANSQ | |
| TLGLHDANV | | TLGLHDANV | | VEWTSNSLIA | | WVMTDGPASNQ | |
| TLHFKQHDC | | TLHFKQHDC | | VEYASKTRIS | | WVPILNTSQRG | |
| TLHFKQHEC | | TLHFKQHEC | | VEYDAVATTH | | WVPKRNRSILN | |
| TLHFKQHKC | | TLHFKQHKC | | VEYNGKSLGI | | WVQNEFNKACE | |
| TLHFKQNEC | | TLHFKQNEC | | VFAGKNADLE | | WVQSEFNKACE | |
| TLIDALLGD | | TLIDALLGD | | VFAGKNSDLE | | WVRFNSDLDYQ | |
| TLIDAMLGD | | TLIDAMLGD | | VFAGKNTDLE | | WVRINNETILE | |
| TLIENTYVN | | TLIENTYVN | | VFCGASGTYG | | WVRMNNETILE | |
| TLIEQKVPV | | TLIEQKVPV | | VFCGTSGIYG | | WVSFSISCFLL | |
| TLIEQNIPV | | TLIEQNIPV | | VFCGTSGNYG | | WVSTDKDSNGV | |
| TLIEQNVPV | | TLIEQNVPV | | VFCGTSGTYG | | WVSTDKNSNGV | |
| TLIGPPQCD | | TLIGPPQCD | | VFCGVSGEVP | | WVTADKDSNGV | |
| TLITDGPSD | | TLITDGPSD | | VFCGVSSEVP | | WVTRELYVSCD | |
| TLITDGPSN | | TLITDGPSN | | VFCSTSGTYG | | WVTREPYVSCD | |
| TLKGRHANG | | TLKGRHANG | | VFEFSDERAA | | WVTREPYVSCG | |
| TLKIRTNGN | | TLKIRTNGN | | VFELSDEKAA | | WVTREPYVSCS | |
| TLKLATGMR | | TLKLATGMR | | VFELSDEKAT | | WVTRESYVSCG | |
| TLKLGQFPV | | TLKLGQFPV | | VFELSDERAA | | WVVIAKDNAIR | |
| TLKSEQFPV | | TLKSEQFPV | | VFELSDERAT | | WVVIAKDNAVR | |
| TLKSGQFPV | | TLKSGQFPV | | VFFCLKNGNM | | WVVIAQDNAIR | |
| TLKSWKGNI | | TLKSWKGNI | | VFFCLRNGNM | | WVVIEKDNAVR | |
| TLKVESNGN | | TLKVESNGN | | VFICIKNGNM | | WVVVAKDNAIR | |
| TLLAKSVFN | | TLLAKSVFN | | VFICIKNGNV | | WVWLWLVLREK | |
| TLLEKNVTV | | TLLEKNVTV | | VFICVKNGNM | | WWASNSLIALC | |

Fig. 83-396

| Block size 8 | SIN | Block size 9 | SIN | Block size 10 | SIN | Block size 11 | SIN |
|---|---|---|---|---|---|---|---|
| TLLENDVPV | | TLLENDVPV | | VFIERPTAVD | | WWDGLQSSDDF | |
| TLLENGVPV | | TLLENGVPV | | VFIIREPFVS | | WWTSNSIAVFC | |
| TLLENNVPV | | TLLENNVPV | | VFLAMITYIT | | WWTSNSIISMC | |
| TLLESDVPV | | TLLESDVPV | | VFLTMITYIT | | WWTSNSIIVFC | |
| TLLMNELGI | | TLLMNELGI | | VFMCVKNGNM | | WWTSNSIVAFC | |
| TLLMNELGV | | TLLMNELGV | | VFNTIGNLIA | | WWTSNSIVALC | |
| TLLMSELGV | | TLLMSELGV | | VFNTIGNLVA | | WWTSNSIVSMC | |
| TLMDALLGD | | TLMDALLGD | | VFPNEVGAKI | | WWTSNSIVVFC | |
| TLMEQNVPV | | TLMEQNVPV | | VFPNEVGARI | | WWTSNSLIALC | |
| TLMSCPIGE | | TLMSCPIGE | | VFPQLNQTYR | | WWTSNSLVALC | |
| TLMSCPIGV | | TLMSCPIGV | | VFREQKQEFK | | WWTSSSIVVFC | |
| TLMSCPMGV | | TLMSCPMGV | | VFSGKNTDLE | | WWTTNSIVVFC | |
| TLMSCPVGE | | TLMSCPVGE | | VFSIAASYKR | | WWVWLWLVLRE | |
| TLMSCPVGV | | TLMSCPVGV | | VFSNAASYKR | | WYGFHHSNAEG | |
| TLMSVEIGQ | | TLMSVEIGQ | | VFSQEDCMIK | | WYGFHHSNSEG | |
| TLMSVEVGQ | | TLMSVEVGQ | | VFSQEDCMMK | | WYGFKHQNAQG | |
| TLMSVGIGQ | | TLMSVGIGQ | | VFSQEDCMVK | | WYGFQHQNAEG | |
| TLMSVKIGQ | | TLMSVKIGQ | | VFSQEDRMIK | | WYGFQHQNEQG | |
| TLMSVKVGQ | | TLMSVKVGQ | | VFSQEECMIK | | WYGFQHQNSEG | |
| TLMTDGPSD | | TLMTDGPSD | | VFSSAASYKR | | WYGFQHRDEEG | |
| TLNIESNGN | | TLNIESNGN | | VFTDGSATGP | | WYGFQHRNEEG | |
| TLNMHDANV | | TLNMHDANV | | VFTLTVPSER | | WYGFQHSNAQG | |
| TLNNKHSNG | | TLNNKHSNG | | VFVALILGFV | | WYGFQHSNDQG | |
| TLNRNQPAA | | TLNRNQPAA | | VFVIREPFIS | | WYGFQHSNEQG | |
| TLNTMTKDA | | TLNTMTKDA | | VFVIREPFVA | | WYGFQHTNDQG | |
| TLNVESNGN | | TLNVESNGN | | VFVIREPFVS | | WYGFRHHNSEG | |
| TLPFHNIHP | | TLPFHNIHP | | VFWTSNSIVA | | WYGFRHLNSEG | |
| TLPFHNVHP | | TLPFHNVHP | | VGAKILTSES | | WYGFRHQKAQG | |
| TLPRRSGAA | | TLPRRSGAA | | VGARIITSES | | WYGFRHQNAEG | |
| TLRGQHANG | | TLRGQHANG | | VGARILASES | | WYGFRHQNAQG | |
| TLRGRHANG | | TLRGRHANG | | VGARILTSES | | WYGFRHQNSEG | |
| TLRIISNGN | | TLRIISNGN | | VGARPLVNGQ | | WYGFRHQNSQG | |
| TLRIRSNEN | | TLRIRSNEN | | VGARPQVNGQ | | WYGFRHQNTQG | |
| TLRIRSNGN | | TLRIRSNGN | | VGCVILLNPF | | WYGFRYQNSEG | |
| TLRSLVASS | | TLRSLVASS | | VGDTPRNDDG | | WYGYHHENSQG | |
| TLRTQESEC | | TLRTQESEC | | VGDTPRNDDI | | WYGYHHQNAQG | |
| TLRVKSNGN | | TLRVKSNGN | | VGDTPRNDDR | | WYGYHHQNEQG | |
| TLRVRSDGN | | TLRVRSDGN | | VGDTPRNDDS | | WYGYHHQNGQG | |
| TLRVRSNGN | | TLRVRSNGN | | VGDTPRNEDG | | WYGYHHSNDQG | |
| TLSEQNVPV | | TLSEQNVPV | | VGDTPRNEDS | | WYGYKHQNAQG | |
| TLSGVAIAL | | TLSGVAIAL | | VGDTPRNGDS | | WYGYRHQNAQG | |
| TLSSGYKDI | | TLSSGYKDI | | VGDTPRNNDG | | YAADKASTQKA | |
| TLSSVNTNT | | TLSSVNTNT | | VGDTPRNNDS | | YAADKESTQKA | |
| TLSSVTTNT | | TLSSVTTNT | | VGEAPSPYNS | | YAADKESTQRA | |
| TLSTIALFI | | TLSTIALFI | | VGECPRYVKQ | | YAADKKSTQKA | |
| TLSTIALII | | TLSTIALII | | VGEVPSPYNS | | YAADQESTQKA | |
| TLSTIALLI | | TLSTIALLI | | VGGIDTNKTF | | YAADRESTQKA | |
| TLTDNHVEV | | TLTDNHVEV | | VGGINTNKTF | | YAADRESTQRA | |
| TLTEKGIEV | | TLTEKGIEV | | VGGINTNRTF | | YAADRKSTQKA | |
| TLTEKGVEV | | TLTEKGVEV | | VGGNEKKAKL | | YAEESKLKRQE | |
| TLTENGVPV | | TLTENGVPV | | VGGSGTDNYG | | YAEGQESPPKA | |
| TLTEQNVPV | | TLTEQNVPV | | VGGSGTNNYG | | YAELIRGRPKE | |
| TLTEREVEV | | TLTEREVEV | | VGIAADKEST | | YAELKWLISKS | |
| TLTERGIEV | | TLTERGIEV | | VGIDPFKLLQ | | YAELKWLVSKD | |
| TLTERGVEV | | TLTERGVEV | | VGIDPFRLLQ | | YAELKWLVSKN | |
| TLTETGVPV | | TLTETGVPV | | VGINMSKKKS | | YAELKWLVSKS | |
| TLTGRGIEV | | TLTGRGIEV | | VGINMSKRKS | | YAELKWLVSKT | |
| TLTMGYKDI | | TLTMGYKDI | | VGISSMGEAM | | YAEMKWLLSNA | |
| TLTNEHEEV | | TLTNEHEEV | | VGISSMMEAM | | YAEMKWLLSNN | |
| TLTNEKEEV | | TLTNEKEEV | | VGISSMVEAM | | YAEMKWLLSNS | |
| TLTNEQEEV | | TLTNEQEEV | | VGKCNDPYPG | | YAEMKWLLSNT | |
| TLTNEREEV | | TLTNEREEV | | VGKCNEPYPG | | YAEMKWLLSSS | |

Fig. 83-397

| Block size 8 | SIN | Block size 9 | SIN | Block size 10 | SIN | Block size 11 | SIN |
|---|---|---|---|---|---|---|---|
| TLTSEKEEV | | TLTSEKEEV | | VGKCPKYVKQ | | YAEMKWLLSST | |
| TLTSVTTNT | | TLTSVTTNT | | VGKCPRYIKQ | | YALHQGTTIRN | |
| TLTVPSERG | | TLTVPSERG | | VGKCPRYVKQ | | YALSQGTTIRG | |
| TLVANNDWS | | TLVANNDWS | | VGKCPRYVRQ | | YAQTDCVLEAM | |
| TLVDALLGD | | TLVDALLGD | | VGLILAFILW | | YARLYIWGVHH | |
| TLVLLVSLG | | TLVLLVSLG | | VGLILAFIMW | | YASKNPYTLVS | |
| TLVNPGDSI | | TLVNPGDSI | | VGLILSFIMW | | YASPQLEGFSA | |
| TLVSNNDWS | | TLVSNNDWS | | VGLILTFIMW | | YASSQLEGFSA | |
| TLVSNSDWS | | TLVSNSDWS | | VGLKVSLHLK | | YATVAGSLSLA | |
| TLVSTGSWS | | TLVSTGSWS | | VGLLLQIISL | | YAVIHYGGIPT | |
| TLVSTKEWS | | TLVSTKEWS | | VGLLLQITSL | | YAVIHYGGMPT | |
| TLVSTKSWS | | TLVSTKSWS | | VGLLLQVTSL | | YAVIHYGGVPT | |
| TLVSTRSWS | | TLVSTRSWS | | VGLNISLHLK | | YCICRDNWKGS | |
| TLVSTSSWS | | TLVSTSSWS | | VGLNVSLHLK | | YCNTDLGAPLE | |
| TLVTDGPSD | | TLVTDGPSD | | VGLRNTPSID | | YCNTDLGSPLE | |
| TLVTTSSWS | | TLVTTSSWS | | VGLRNTPSIE | | YCNTDLGTPLE | |
| TLYFHDSNV | | TLYFHDSNV | | VGLRNTPSVE | | YCRATEYIMKG | |
| TLYKNANTL | | TLYKNANTL | | VGLVFFCLKN | | YCSLNGISPIH | |
| TLYNKHSNG | | TLYNKHSNG | | VGMAADKEST | | YCSLNGISPVH | |
| TMDTVNRTH | | TMDTVNRTH | | VGNDNWSGYS | | YCSLNGVSPIH | |
| TMDYYWGIL | | TMDYYWGIL | | VGNGCFEFYH | | YCSLNGVSPVH | |
| TMELVEAEK | | TMELVEAEK | | VGNLIFNTVI | | YCVCRDNWKGS | |
| TMELVETEK | | TMELVETEK | | VGNLVFNTVI | | YDAIEECLIND | |
| TMELVETKK | | TMELVETKK | | VGNPSCASNI | | YDAVATTHSWI | |
| TMGYKDIIL | | TMGYKDIIL | | VGNPSCATNI | | YDAVATTHSWT | |
| TMHDRSPFR | | TMHDRSPFR | | VGPGSFPDGA | | YDAVATTHSWV | |
| TMHQLLRHF | | TMHQLLRHF | | VGPILSFIMW | | YDFEKEGYSLV | |
| TMKDRSPYR | | TMKDRSPYR | | VGQCPKYVNK | | YDFEREGYSLV | |
| TMLNLYERV | | TMLNLYERV | | VGQCPKYVNQ | | YDHAQYREEAL | |
| TMSCDSPSN | | TMSCDSPSN | | VGQCPKYVSK | | YDHKDYEEEAK | |
| TMTHTSQYI | | TMTHTSQYI | | VGQCPKYVSQ | | YDHKEFEEESK | |
| TMTITFLIL | | TMTITFLIL | | VGQSPNVYQA | | YDHKEFEEESR | |
| TMTKDAERG | | TMTKDAERG | | VGRCPRYVKQ | | YDHKEFEKESK | |
| TNADKICLG | | TNADKICLG | | VGRMTICIQG | | YDHKEFEKESR | |
| TNAHDRICI | | TNAHDRICI | | VGRMTICVQG | | YDHKEFKEESK | |
| TNATELVQG | | TNATELVQG | | VGSGSFPDGA | | YDHKEYEEEAK | |
| TNATELVQI | | TNATELVQI | | VGSGSFPNGA | | YDHNIYRDEAI | |
| TNATELVQN | | TNATELVQN | | VGSRGHVFVI | | YDHSQYREEAL | |
| TNATELVQS | | TNATELVQS | | VGSRINMINS | | YDHTQYREEAL | |
| TNATETVEN | | TNATETVEN | | VGSSKYQQSF | | YDKICIGYQTN | |
| TNATETVES | | TNATETVES | | VGSSKYRQSF | | YDKVRLQLKDN | |
| TNAYDRICI | | TNAYDRICI | | VGSSTYHNSF | | YDKVRLQLRDN | |
| TNDKYHQIE | | TNDKYHQIE | | VGSSTYQNNF | | YDKVRMQLKDN | |
| TNEEALRQI | | TNEEALRQI | | VGSSTYQNSF | | YDKVRMQLRDN | |
| TNEEPLRQI | | TNEEPLRQI | | VGSSTYQSNF | | YDNGVWIGRTK | |
| TNEESLRQI | | TNEESLRQI | | VGSWSQNILR | | YDRICIGYQSN | |
| TNEKFHQIE | | TNEKFHQIE | | VGTAPVLGNY | | YDRRLTTTIKT | |
| TNEKYHQIE | | TNEKYHQIE | | VGTRWMKIIR | | YDRVRKQLRQN | |
| TNGEQILII | | TNGEQILII | | VGTSTLNLRL | | YDRVRLQLRDN | |
| TNGNLIAPE | | TNGNLIAPE | | VGTSTLNQRL | | YDRVRMQLRDN | |
| TNGNYGPIN | | TNGNYGPIN | | VGTSTLNQRS | | YDSIRGEFNQV | |
| TNGTSKIKM | | TNGTSKIKM | | VGVAPSPSNS | | YDSIRGEFSQV | |
| TNGTSKVKM | | TNGTSKVKM | | VGVDEYSSTE | | YDVGYLCAGIP | |
| TNGTTGNPI | | TNGTTGNPI | | VGVDPFKLLQ | | YDWTLNRNQPA | |
| TNGVKGFSF | | TNGVKGFSF | | VGVDPFRLLQ | | YDYPKYEEESK | |
| TNHQFELID | | TNHQFELID | | VGWSATACHD | | YDYPKYEEESR | |
| TNHTDELCP | | TNHTDELCP | | VGWSSTSCHD | | YDYSKYEEESK | |
| TNHTGTYCS | | TNHTGTYCS | | VGWSSTTCHD | | YEAIEECLIND | |
| TNINIREWS | | TNINIREWS | | VGWTSNSIVV | | YEAVEECLIND | |
| TNKFAAICT | | TNKFAAICT | | VGYHANNSTD | | YEDESRIERQK | |
| TNKFAAVCT | | TNKFAAVCT | | VGYHANNSTE | | YEECSCYPDAG | |
| TNKFASICT | | TNKFASICT | | VGYHANNSTK | | YEECSCYPDAS | |

Fig. 83-398

| Block size 8 | SIN | Block size 9 | SIN | Block size 10 | SIN | Block size 11 | SIN |
|---|---|---|---|---|---|---|---|
| TNKINNIVD | | TNKINNIVD | | VGYHSNNSTE | | YEECSCYPDSG | |
| TNKINSIID | | TNKINSIID | | VGYICSGVFG | | YEECSCYPNAG | |
| TNKLAAICT | | TNKLAAICT | | VGYLCAGIPS | | YEEEAKLEKSR | |
| TNKQFELID | | TNKQFELID | | VGYLCAGIPT | | YEEEAKLERSK | |
| TNKTFQNAS | | TNKTFQNAS | | VGYLCAGLPS | | YEEESKIERQK | |
| TNKTFQNID | | TNKTFQNID | | VGYLSTNSSD | | YEEESKLERQK | |
| TNKTFQNIE | | TNKTFQNIE | | VGYLSTNSSE | | YEEESKLERQR | |
| TNKTFQNIS | | TNKTFQNIS | | VGYLSTNSTE | | YEEESKLKRNE | |
| TNKTFQNVS | | TNKTFQNVS | | VHDRIPHRTL | | YEEESKLKRQE | |
| TNKVNNIVD | | TNKVNNIVD | | VHFQNQVKIR | | YEEESKLNRNE | |
| TNKVNSIID | | TNKVNSIID | | VHFRNQIKIR | | YEEESKLNRSE | |
| TNKVNSIIE | | TNKVNSIIE | | VHFRNQVKIR | | YEEESKLNRTE | |
| TNKVNSIIG | | TNKVNSIIG | | VHFRSQVKIR | | YEEESRIERQK | |
| TNKVNSIIN | | TNKVNSIIN | | VHHPSSDNEQ | | YEEESRLNRNE | |
| TNKVNSVIE | | TNKVNSVIE | | VHHPSTDAEQ | | YEELKEQLSTV | |
| TNKVNSVVE | | TNKVNSVVE | | VHHPSTDKEQ | | YEELKHLLNRI | |
| TNKVNTVIE | | TNKVNTVIE | | VHHPSTDTEQ | | YEELKHLLSRI | |
| TNLGLNIGL | | TNLGLNIGL | | VHHSSSLDEQ | | YEELKHLLSRT | |
| TNLYGFIIK | | TNLYGFIIK | | VHIGPLSGSA | | YEELKHLLSST | |
| TNLYGFIVK | | TNLYGFIVK | | VHISPLAGSA | | YEELKHLMSST | |
| TNLYVNKNP | | TNLYVNKNP | | VHISPLSGSA | | YEELREHLSSV | |
| TNMINDKID | | TNMINDKID | | VHKSQLIWMA | | YEELREQLSSV | |
| TNNSTDTVN | | TNNSTDTVN | | VHKSQLVWMA | | YEELREQLSTV | |
| TNNSTETVN | | TNNSTETVN | | VHLGDCNFEG | | YEKESKLNRNE | |
| TNNYGVKGF | | TNNYGVKGF | | VHLGDCRFEG | | YEKVRLQLRDN | |
| TNPIVPSFD | | TNPIVPSFD | | VHLGDCSFEG | | YEKVRMQLRDN | |
| TNPIVPSFE | | TNPIVPSFE | | VHPLTIGECP | | YEKVRRQLREN | |
| TNPLIKHEN | | TNPLIKHEN | | VHQILAIYST | | YELEIGARIGE | |
| TNPLIRHEN | | TNPLIRHEN | | VHRNAIGDCP | | YELEIGTRIGD | |
| TNPVVPSFD | | TNPVVPSFD | | VHRNTFGDCP | | YELEIGTRIGE | |
| TNQQFELID | | TNQQFELID | | VHRNTIGDCP | | YEMLKVPNALT | |
| TNQQFELIN | | TNQQFELIN | | VHRSTIGDCP | | YENNTWGNQTY | |
| TNQQFEMID | | TNQQFEMID | | VHVSPLSGSA | | YENNTWVNQTF | |
| TNQQFGLID | | TNQQFGLID | | VIAARNIVRR | | YENNTWVNQTY | |
| TNQQFKLID | | TNQQFKLID | | VIAKDNAIRF | | YERMCNILKGK | |
| TNRPILVIS | | TNRPILVIS | | VIAKDNAVRF | | YERRLTTTIKT | |
| TNRPVLIIS | | TNRPVLIIS | | VIAQDNAIRF | | YERVKKQLREN | |
| TNRPVLVIS | | TNRPVLVIS | | VIASTTAKAM | | YERVKMFDFIK | |
| TNRPVLVVS | | TNRPVLVVS | | VIDGWTTANS | | YERVKMFDFSK | |
| TNRTFQNID | | TNRTFQNID | | VIEKDNAVRF | | YERVKMFDFTK | |
| TNRTFQNVS | | TNRTFQNVS | | VIEKMNIQFT | | YERVKRQLREN | |
| TNRVNSIID | | TNRVNSIID | | VIEKMNTQFT | | YERVRKQLREN | |
| TNSIVVFCG | | TNSIVVFCG | | VIGARPQVNG | | YERVRKQLRQN | |
| TNSQDTEIS | | TNSQDTEIS | | VIGGWATANS | | YERVRRQLREN | |
| TNSQDTELS | | TNSQDTELS | | VIGGWTIANS | | YESIEECLIND | |
| TNSQDTEVS | | TNSQDTEVS | | VIGGWTTANS | | YESTQAAIDQI | |
| TNSSDKVDT | | TNSSDKVDT | | VIHYGGIPTD | | YETFKVIGGWS | |
| TNSSEKVDT | | TNSSEKVDT | | VIHYGGMPTD | | YETFKVIGGWT | |
| TNSSEKVNT | | TNSSEKVNT | | VIHYGGVPTD | | YETFRVIDGWT | |
| TNSSERVDT | | TNSSERVDT | | VIITREPYVS | | YETFRVIGGWA | |
| TNSTDTVDT | | TNSTDTVDT | | VIKLLPFAAA | | YETFRVIGGWT | |
| TNSTEAVDT | | TNSTEAVDT | | VIKNNMINND | | YETFRVIGGWV | |
| TNSTEKVDT | | TNSTEKVDT | | VIKNNMVNND | | YETFRVISGWT | |
| TNSTETVDT | | TNSTETVDT | | VIKYNGIITD | | YEVGYLCAGIP | |
| TNSTETVGT | | TNSTETVGT | | VILEENTTYK | | YEVLRVPNALT | |
| TNSTETVNT | | TNSTETVNT | | VILLNPFVSH | | YFFLKVPVQNA | |
| TNSTETVYT | | TNSTETVYT | | VILVLGLSMV | | YFHDSNVKNLY | |
| TNTEFESIE | | TNTEFESIE | | VILWFSFGAS | | YFHKGIVIKEE | |
| TNTINRIFQ | | TNTINRIFQ | | VILWFSLGAS | | YFHKGLIIKEE | |
| TNTINRNFQ | | TNTINRNFQ | | VIMEVVFPNE | | YFHKGLLIKEE | |
| TNTINRSFQ | | TNTINRSFQ | | VIMTDGPANS | | YFHKGLVIKEE | |
| TNTINRSFR | | TNTINRSFR | | VIMTDGPASS | | YFHKGLVVKEE | |

Fig. 83-399

| Block size 8 | SIN | Block size 9 | SIN | Block size 10 | SIN | Block size 11 | SIN |
|---|---|---|---|---|---|---|---|
| TNTLSSVTT | | TNTLSSVTT | | VIMTDGSANS | | YFQLFLVCVSL | |
| TNTQFELID | | TNTQFELID | | VIMTDGSASG | | YFTAEISHCRA | |
| TNTTLIENT | | TNTTLIENT | | VIMTDGSASS | | YFTAEVSHCRA | |
| TNTVNTLIE | | TNTVNTLIE | | VINDKIDDQI | | YFTAEVSYCRA | |
| TNTYRNTDP | | TNTYRNTDP | | VINFESTGNL | | YFTEEVSHCRA | |
| TNTYRNTDS | | TNTYRNTDS | | VINNITTTII | | YFTTEVSHCRA | |
| TNTYRNTDT | | TNTYRNTDT | | VINNMTTTII | | YFVKEGKIVHI | |
| TNVQNDYTT | | TNVQNDYTT | | VINNYYNETN | | YGAGNKLITVG | |
| TNVQNNYTT | | TNVQNNYTT | | VINTSKPFQN | | YGAGSWPDGAN | |
| TNWSGYSGS | | TNWSGYSGS | | VINWTKDSIT | | YGAIEECLIND | |
| TNYYNETFV | | TNYYNETFV | | VINWTQDAMT | | YGAQSLSISVG | |
| TPACDLHLT | | TPACDLHLT | | VINWTRDAMT | | YGDGVWIGRTK | |
| TPACDLYLT | | TPACDLYLT | | VINWTRDSII | | YGFHHSNAEGT | |
| TPCVLLNDK | | TPCVLLNDK | | VINWTRDSIT | | YGFHHSNSEGT | |
| TPDPGVKGF | | TPDPGVKGF | | VINWTRDSLT | | YGFIIKGRSHL | |
| TPEWSYIVE | | TPEWSYIVE | | VINWTRDSMT | | YGFIVKGRSHL | |
| TPGGEVIND | | TPGGEVIND | | VINWTRDSVT | | YGFKHQNAQGE | |
| TPGGEVKND | | TPGGEVKND | | VIPLTTTPTK | | YGFKISKRGGS | |
| TPGGEVRND | | TPGGEVRND | | VIPSGPLKAE | | YGFKISKRGNS | |
| TPGGGVRND | | TPGGGVRND | | VIREPCISCS | | YGFKISKRGSS | |
| TPGGKVRND | | TPGGKVRND | | VIREPFISCS | | YGFKISRRGNS | |
| TPGMQIRGF | | TPGMQIRGF | | VIREPFVACG | | YGFQHQNAEGI | |
| TPHRTLLMN | | TPHRTLLMN | | VIREPFVACS | | YGFQHQNAEGT | |
| TPIAFLTSS | | TPIAFLTSS | | VIREPFVSCG | | YGFQHQNEQGM | |
| TPIGAINSS | | TPIGAINSS | | VIREPFVSCS | | YGFQHQNEQGT | |
| TPIVPSFDM | | TPIVPSFDM | | VIRNNMINND | | YGFQHQNEQGV | |
| TPKRNRSIL | | TPKRNRSIL | | VIRSWRKQIL | | YGFQHQNSEGT | |
| TPLELRDCK | | TPLELRDCK | | VISFESTGNL | | YGFQHRNDEGT | |
| TPLGAINSS | | TPLGAINSS | | VISGWTTANS | | YGFQHRNEEGT | |
| TPLGAINTT | | TPLGAINTT | | VITAQELVES | | YGFRHQKAQGE | |
| TPLGALNTT | | TPLGALNTT | | VITDTLKSWK | | YGFRHQNAEGT | |
| TPLGSPPIV | | TPLGSPPIV | | VIVSKDNGIR | | YGFRHQNAQGE | |
| TPLGSPPMV | | TPLGSPPMV | | VIVTREPYIS | | YGFRHQNAQGI | |
| TPLGSPPVV | | TPLGSPPVV | | VIVTREPYVS | | YGFRHQNAQGQ | |
| TPLGTPPTV | | TPLGTPPTV | | VIYGNPKCDI | | YGFRHQNAQGT | |
| TPMGAINSS | | TPMGAINSS | | VIYGNPKCDT | | YGFRHQNSEGT | |
| TPMGAVNSS | | TPMGAVNSS | | VIYGNPKCDV | | YGFRHQNSQGE | |
| TPNGSIPND | | TPNGSIPND | | VKAVRGDLNF | | YGFRHQNTQGE | |
| TPNGSIPNE | | TPNGSIPNE | | VKCICRDNWK | | YGFRISKRGSS | |
| TPNGSIPNG | | TPNGSIPNG | | VKCVCRDNWK | | YGFVANFSMEL | |
| TPNGSIPNN | | TPNGSIPNN | | VKCYQFALGQ | | YGGIPTDVVRS | |
| TPNGSISND | | TPNGSISND | | VKDRSPFRTL | | YGGLNKSKPYY | |
| TPPTVSNSD | | TPPTVSNSD | | VKDRSPYRAL | | YGGMPTDVVRS | |
| TPRGEDAQF | | TPRGEDAQF | | VKDRSPYRTL | | YGGVPTDVIRS | |
| TPRGEDGQF | | TPRGEDGQF | | VKEAQDVIME | | YGGVPTDVMRS | |
| TPRGEDNQF | | TPRGEDNQF | | VKEIGNGCFE | | YGGVPTDVVRS | |
| TPRGEDSQF | | TPRGEDSQF | | VKELGNGCFE | | YGHLITGKSHG | |
| TPRNDDRFS | | TPRNDDRFS | | VKGDKICLGH | | YGHLTTGKSHG | |
| TPRNDDRSS | | TPRNDDRSS | | VKGDQICIGY | | YGHLVTGKSHG | |
| TPRNDDSSS | | TPRNDDSSS | | VKGDRICIGY | | YGKDNAIRIGE | |
| TPRNEDGSS | | TPRNEDGSS | | VKGDYNNTTG | | YGKDNAVRIGE | |
| TPRNEDSSS | | TPRNEDSSS | | VKGEYNNTTG | | YGKGRIFQSHI | |
| TPRNGDSSS | | TPRNGDSSS | | VKGFGFRQGD | | YGKGRIFQSPI | |
| TPRSDDSSS | | TPRSDDSSS | | VKGFGFRQGN | | YGKGRIFQSRI | |
| TPSAIDQIT | | TPSAIDQIT | | VKGFGFRQGT | | YGNCDAKCQTP | |
| TPSIDPKGL | | TPSIDPKGL | | VKGFSFRYGD | | YGNCDTKCQTP | |
| TPSIEPKGL | | TPSIEPKGL | | VKGQSGRISF | | YGNCNAKCQTP | |
| TPSIEPRGL | | TPSIEPRGL | | VKGRSHLRND | | YGNCNTKCQTP | |
| TPSVEPKGL | | TPSVEPKGL | | VKGWAFDNGD | | YGNDVWMGRTI | |
| TPSVEPRGL | | TPSVEPRGL | | VKGWAFDNGN | | YGNGAWIGRTK | |
| TPTKSYFAN | | TPTKSYFAN | | VKGWAFDSGD | | YGNGVWIGRTK | |
| TPVCDPHLT | | TPVCDPHLT | | VKGWAFDYGN | | YGNGVWMGRTK | |

Fig. 83-400

| Block size 8 | SIN | Block size 9 | SIN | Block size 10 | SIN | Block size 11 | SIN |
|---|---|---|---|---|---|---|---|
| TPVGAINSS | | TPVGAINSS | | VKGWAFDYGS | | YGNPKCDIHLK | |
| TPYRSLIKF | | TPYRSLIKF | | VKGWAPLSKD | | YGNPKCDIHLR | |
| TPYRSLIQF | | TPYRSLIQF | | VKHFEKVKIL | | YGNPKCDTHLK | |
| TPYRSLIRF | | TPYRSLIRF | | VKHFEKVRIL | | YGNPKCDVHLK | |
| TPYRTLLMN | | TPYRTLLMN | | VKIKTNGNLI | | YGPALSINELG | |
| TQAAIDKIN | | TQAAIDKIN | | VKIQTNGNLI | | YGPALSINELS | |
| TQAAIDQIN | | TQAAIDQIN | | VKIQTSGNLI | | YGPALSISELS | |
| TQAAIDQIT | | TQAAIDQIT | | VKIRRRVDIN | | YGPINVTKENT | |
| TQAAIDQMT | | TQAAIDQMT | | VKIRRRVDMN | | YGRGRIFQSRI | |
| TQAAIDQVN | | TQAAIDQVN | | VKIRRRVDTN | | YGRIIQNEDIP | |
| TQAAVDQIT | | TQAAVDQIT | | VKIRRRVDVN | | YGSDVWMGRTI | |
| TQAMELVEA | | TQAMELVEA | | VKKQLRENAE | | YGSGRIFQSGV | |
| TQCQITGFA | | TQCQITGFA | | VKLEENSTYK | | YGSGSWPDGAD | |
| TQCQTPLGA | | TQCQTPLGA | | VKLEENTSYK | | YGTGNKLITVG | |
| TQDAMTEVW | | TQDAMTEVW | | VKLEENTTYK | | YGTGRIFQSGI | |
| TQDSECVSH | | TQDSECVSH | | VKLEENTTYR | | YGTGRIFQSGV | |
| TQEAIDKIT | | TQEAIDKIT | | VKLSGGYKDI | | YGTGRIFQSRI | |
| TQEAIEKIT | | TQEAIEKIT | | VKLSGGYKDV | | YGTGSWADGAN | |
| TQEAIGKIT | | TQEAIGKIT | | VKLSNMGIYQ | | YGTGSWPDGAD | |
| TQEAINKIT | | TQEAINKIT | | VKLSNMGVYQ | | YGTGSWPDGAE | |
| TQEKNDLYG | | TQEKNDLYG | | VKLSSGYKDI | | YGTGSWPDGAN | |
| TQERNDLYG | | TQERNDLYG | | VKLSSGYKDV | | YGTQPLSISVG | |
| TQESDCVCI | | TQESDCVCI | | VKLSSGYKEV | | YGTQSLSISIG | |
| TQESECACI | | TQESECACI | | VKLSSGYKNV | | YGTQSLSISVE | |
| TQESECACV | | TQESECACV | | VKLSSMGIYQ | | YGTQSLSISVG | |
| TQESECICI | | TQESECICI | | VKLSSMGVYQ | | YGVKGFGFRQG | |
| TQESECLCI | | TQESECLCI | | VKLYKKLKRE | | YGVKGFSFRYG | |
| TQESECQCI | | TQESECQCI | | VKLYRKLKRE | | YGYEMLKVPNA | |
| TQESECQCL | | TQESECQCL | | VKMEKIVLLL | | YGYHHENSQGS | |
| TQESECQRI | | TQESECQRI | | VKMFDFIKWN | | YGYHHQNAQGS | |
| TQESECVCH | | TQESECVCH | | VKMFDFSKWN | | YGYHHQNEQGS | |
| TQESECVCI | | TQESECVCI | | VKMFDFTKWN | | YGYHHQNGQGS | |
| TQESECVCM | | TQESECVCM | | VKMKWGMEMR | | YGYHHSNDQGA | |
| TQESECVCQ | | TQESECVCQ | | VKMNPNQKII | | YGYHHSNDQGS | |
| TQESECVCV | | TQESECVCV | | VKMQLRDNAK | | YGYIIEEYGKG | |
| TQESECVRH | | TQESECVRH | | VKNDDIDQSL | | YGYIIEEYGRG | |
| TQESSCTCI | | TQESSCTCI | | VKNDDVDQSL | | YGYIIEKYGSG | |
| TQESSCVCI | | TQESSCVCI | | VKNDEVDQSL | | YGYIIEKYGTG | |
| TQESSCVCM | | TQESSCVCM | | VKNGNHAVHY | | YGYKHQNAQGE | |
| TQESSCVCV | | TQESSCVCV | | VKNGNLRCTI | | YGYLITGKSHG | |
| TQEYECVCI | | TQEYECVCI | | VKNGNMQCTI | | YGYRHQNAQGE | |
| TQFEAIGRE | | TQFEAIGRE | | VKNGNMRCTI | | YHANNSKKQID | |
| TQFEAVGKE | | TQFEAVGKE | | VKNGNMRCTS | | YHANNSTDTID | |
| TQFEAVGRE | | TQFEAVGRE | | VKNGTYDYPK | | YHANNSTDTVD | |
| TQFELIDNE | | TQFELIDNE | | VKNGTYNYPK | | YHANNSTEQVD | |
| TQFTAVGKE | | TQFTAVGKE | | VKNLFDEVKR | | YHANNSTETVD | |
| TQFTSVGKE | | TQFTSVGKE | | VKNLFDEVRR | | YHANNSTKQID | |
| TQFTVVGKE | | TQFTVVGKE | | VKNLHDQIKR | | YHANNSTKQVD | |
| TQGACWEQL | | TQGACWEQL | | VKNLHEQVKR | | YHANNSTTKVD | |
| TQGALLNDK | | TQGALLNDK | | VKNLYDKVRL | | YHANNSTTQID | |
| TQGALLNDR | | TQGALLNDR | | VKNLYDKVRM | | YHANNSTTQVD | |
| TQGEGTAAD | | TQGEGTAAD | | VKNLYDRVRL | | YHANNSTTQVN | |
| TQGRQTFDW | | TQGRQTFDW | | VKNLYEKVRL | | YHFEECSCYPS | |
| TQGRQTYDW | | TQGRQTYDW | | VKNLYEKVRM | | YHHENSQGSGY | |
| TQGSLLNDK | | TQGSLLNDK | | VKNLYNKVRM | | YHHQNAQGSGY | |
| TQGSLLNDR | | TQGSLLNDR | | VKPLILKDCS | | YHHQNEQGSGY | |
| TQGTCWEQL | | TQGTCWEQL | | VKPLILRDCS | | YHHQNGQGSGY | |
| TQGTCWEQM | | TQGTCWEQM | | VKPLILRNCS | | YHHSNDQGAGY | |
| TQGVKGWAF | | TQGVKGWAF | | VKQDGKSSAC | | YHHSNDQGSGY | |
| TQGYKDIIL | | TQGYKDIIL | | VKQESLLLAT | | YHKCDDECMDS | |
| TQIIKLLPF | | TQIIKLLPF | | VKQESLMLAT | | YHKCDDECMNS | |
| TQIIVILVL | | TQIIVILVL | | VKQGSLKLAT | | YHKCDDECMSS | |

Fig. 83-401

| Block size 8 | SIN | Block size 9 | SIN | Block size 10 | SIN | Block size 11 | SIN |
|---|---|---|---|---|---|---|---|
| TQKAIDEIT | | TQKAIDEIT | | VKQGSLMLAT | | YHKCDNECMDS | |
| TQKAIDGIT | | TQKAIDGIT | | VKQGSLRLAT | | YHKCNDECMNS | |
| TQKAIDGVT | | TQKAIDGVT | | VKQKSILLAT | | YHNSFVPVVGA | |
| TQKAIDIMQ | | TQKAIDIMQ | | VKQKSLLLAT | | YHQIEKEFEQV | |
| TQKAIDNMQ | | TQKAIDNMQ | | VKQKTLKLAT | | YHQIEKEFGQV | |
| TQKAIDQIT | | TQKAIDQIT | | VKQNGKSGAC | | YHTGRSSFFRN | |
| TQKAIDRIT | | TQKAIDRIT | | VKQNGKSSAC | | YHWNLALDIVD | |
| TQKAINEIT | | TQKAINEIT | | VKQNTLKLAT | | YHYEECSCYPD | |
| TQKAINGIT | | TQKAINGIT | | VKQSSLPLAL | | YHYEECSCYPN | |
| TQKAINGVT | | TQKAINGVT | | VKQSTLKLAT | | YICSGFFGDNP | |
| TQKALNEIT | | TQKALNEIT | | VKQTSLLLAT | | YICSGIFGDNP | |
| TQKAVDGIT | | TQKAVDGIT | | VKRGINDRNF | | YICSGLVGDTP | |
| TQKTIDQVT | | TQKTIDQVT | | VKRLLRENAE | | YICSGVFGDNP | |
| TQMAIDNMQ | | TQMAIDNMQ | | VKRQLRENAE | | YICSGVFGDSP | |
| TQNNTTLIE | | TQNNTTLIE | | VKRRPVAKAG | | YICSGVFGDTP | |
| TQNNTTVVE | | TQNNTTVVE | | VKSDKICLGH | | YICSGVLGDNP | |
| TQPLSISVG | | TQPLSISVG | | VKSDRLVLAI | | YICSKFHSDTP | |
| TQPTFSVQR | | TQPTFSVQR | | VKSDRLVLAT | | YICSPVLTDNP | |
| TQQVCIAWS | | TQQVCIAWS | | VKSEKLVLAT | | YICTGILTDTS | |
| TQRAIDGIT | | TQRAIDGIT | | VKSERLVLAT | | YICTGVLTDTS | |
| TQRAIDGVT | | TQRAIDGVT | | VKSITQTLVS | | YIEGKLSQMSK | |
| TQRAIDNMQ | | TQRAIDNMQ | | VKSLYDKVRM | | YIEGKLSQMSR | |
| TQRTIGKKK | | TQRTIGKKK | | VKSVTQTLVS | | YIEVLHLTQGA | |
| TQRTIGKRK | | TQRTIGKRK | | VKTLTDNHVE | | YIEVLHLTQGT | |
| TQRTMGKKK | | TQRTMGKKK | | VKTWAGNILR | | YIGKCPKYIPS | |
| TQRTVGKKK | | TQRTVGKKK | | VKVDGSSSAC | | YIGKCPKYISS | |
| TQSAIDQIT | | TQSAIDQIT | | VKYSRADKIC | | YIGKCPRYIPS | |
| TQSAIDQVT | | TQSAIDQVT | | VKYVWWTSNS | | YIGNPVICMGH | |
| TQSAINQIT | | TQSAINQIT | | VLAIYATVAG | | YIIEEYGKGRI | |
| TQSAVDQIT | | TQSAVDQIT | | VLAIYSCIAS | | YIIEEYGRGRI | |
| TQSAVNQIT | | TQSAVNQIT | | VLASTTAKAM | | YIIEKYGSGRI | |
| TQSLSISIG | | TQSLSISIG | | VLATGLRNAH | | YIIEKYGTGRI | |
| TQSLSISVE | | TQSLSISVE | | VLATGLRNIP | | YIIRALTLNTM | |
| TQSLSISVG | | TQSLSISVG | | VLATGLRNVP | | YIKQGSLKLAT | |
| TQTAIDQIN | | TQTAIDQIN | | VLATGPRNVP | | YIKQNTLKLAT | |
| TQTAIDQIT | | TQTAIDQIT | | VLDDCSLEGI | | YIKSDQLKLAT | |
| TQTLVANND | | TQTLVANND | | VLDDCSLEGL | | YIKSGQLKLAT | |
| TQTLVSNND | | TQTLVSNND | | VLDDCSLKGL | | YILDEESRARI | |
| TQTLVSNSD | | TQTLVSNSD | | VLDGVTASCL | | YINKTGTFEFT | |
| TQTMELVEA | | TQTMELVEA | | VLDNKNWSGY | | YINRTGTFEFT | |
| TQTMELVET | | TQTMELVET | | VLEAMAFLED | | YINTALLNASC | |
| TQTRGIFGA | | TQTRGIFGA | | VLEAMAFLEE | | YINTALLNSSC | |
| TQVEELVHG | | TQVEELVHG | | VLEAMAFLEK | | YINTAMLNASC | |
| TQVEELVHR | | TQVEELVHR | | VLEAMAFLEN | | YIPSGSLKLAI | |
| TQYREEALL | | TQYREEALL | | VLEAMALLEE | | YIPSNSLKLAI | |
| TQYREESLL | | TQYREESLL | | VLEDEQMYQK | | YIPSRSLKLAI | |
| TRALVRSGM | | TRALVRSGM | | VLEKNVTVTH | | YIQMCTELKLN | |
| TRALVRTGM | | TRALVRTGM | | VLELIRMIKR | | YIQMCTELKLS | |
| TRCQTPLGA | | TRCQTPLGA | | VLERNVTVTH | | YIQMCTELQLS | |
| TRCQTSVGG | | TRCQTSVGG | | VLFQGGHIEE | | YIRTNGTSKIK | |
| TRDAMTEIW | | TRDAMTEIW | | VLGDCSIAGW | | YISSGSLKLAI | |
| TRDAMTEVW | | TRDAMTEVW | | VLGENMAPEK | | YIVERPKEIEG | |
| TRDSITELW | | TRDSITELW | | VLGIINLLIG | | YIVERPKEMEG | |
| TRDSITEVW | | TRDSITEVW | | VLGLSMVKSD | | YIVERPSAPEG | |
| TRDSLTEIW | | TRDSLTEIW | | VLGLSMVRSD | | YIVERTKEMEG | |
| TRDSMTEIW | | TRDSMTEIW | | VLGNPKCDLY | | YIWGVHHPSTD | |
| TRDSMTEVW | | TRDSMTEVW | | VLGVSILNLG | | YIWTYQAELLV | |
| TRDSVTELW | | TRDSVTELW | | VLGVSVLNLG | | YKALSIYSCIA | |
| TREGKHIVE | | TREGKHIVE | | VLHLTQGACW | | YKDIILWFSFG | |
| TREGRRKTN | | TREGRRKTN | | VLHLTQGTCW | | YKDIILWISFS | |
| TREILTKIT | | TREILTKIT | | VLIAGGLILG | | YKDIILWVSFS | |
| TREILTKTT | | TREILTKTT | | VLIENDRTLD | | YKDVILWFSFG | |

Fig. 83-402

| Block size 8 | SIN | Block size 9 | SIN | Block size 10 | SIN | Block size 11 | SIN |
|---|---|---|---|---|---|---|---|
| TREILTRTT | | TREILTRTT | | VLIENERTLD | | YKDVILWFSLG | |
| TRELCTINS | | TRELCTINS | | VLIENQKTLD | | YKDVILWISFS | |
| TRELYVSCD | | TRELYVSCD | | VLIGQGDIVL | | YKDWFLWISFA | |
| TREPFISCS | | TREPFISCS | | VLIGQGDVVL | | YKDWILWISFA | |
| TREPYISCD | | TREPYISCD | | VLINTYQWII | | YKDWVLWISFA | |
| TREPYLSCD | | TREPYLSCD | | VLKPGQTVKI | | YKEESQLKRQE | |
| TREPYLSCG | | TREPYLSCG | | VLKSDKRIGS | | YKEIILWFSFG | |
| TREPYVSCD | | TREPYVSCD | | VLKYKGIITG | | YKEVILWFSFG | |
| TREPYVSCE | | TREPYVSCE | | VLKYNDIITD | | YKGRLCNPLNP | |
| TREPYVSCG | | TREPYVSCG | | VLKYNGIITD | | YKILKIKKGKI | |
| TREPYVSCK | | TREPYVSCK | | VLKYNGIITE | | YKILKIKKGKL | |
| TREPYVSCS | | TREPYVSCS | | VLKYNGIITG | | YKILKIRKGKI | |
| TREWSYLIE | | TREWSYLIE | | VLKYNGVITD | | YKILSIYSCIA | |
| TRFLPVAGG | | TRFLPVAGG | | VLLEDERTLD | | YKILSIYSCVA | |
| TRFLPVSGG | | TRFLPVSGG | | VLLENDKTLD | | YKILSIYSSVA | |
| TRFLPVTGG | | TRFLPVTGG | | VLLENDKTLN | | YKILSIYSTVA | |
| TRFTYSGIR | | TRFTYSGIR | | VLLENDRTLD | | YKILTIYSTAA | |
| TRGAYERMC | | TRGAYERMC | | VLLENEKTLD | | YKILTIYSTVA | |
| TRGIFGAIA | | TRGIFGAIA | | VLLENERTLD | | YKISKSTKSTV | |
| TRGILTKTT | | TRGILTKTT | | VLLENGRTLD | | YKKLKREITFH | |
| TRGIQIASN | | TRGIQIASN | | VLLENGRTLG | | YKKLKREMTFH | |
| TRGLCTINS | | TRGLCTINS | | VLLENQKILD | | YKMNIQILILA | |
| TRGLFGAIA | | TRGLFGAIA | | VLLENQKPLD | | YKMNNQILILA | |
| TRGLFGAKA | | TRGLFGAKA | | VLLENQKTLD | | YKMNTKILVLA | |
| TRGVQIASN | | TRGVQIASN | | VLLFMIIGGF | | YKMNTQILIFA | |
| TRGVQVASN | | TRGVQVASN | | VLLGNQKTLD | | YKMNTQILIFT | |
| TRIAYERMC | | TRIAYERMC | | VLLGSSPNAY | | YKMNTQILILA | |
| TRIGDGQRS | | TRIGDGQRS | | VLLGTKHSNG | | YKMNTQILVFA | |
| TRILFIEEG | | TRILFIEEG | | VLLKHRFEII | | YKMNTRILILT | |
| TRILFIKEG | | TRILFIKEG | | VLLLMIIGGF | | YKNANTLSSVN | |
| TRILFIREG | | TRILFIREG | | VLLNASWFNS | | YKNANTLSSVT | |
| TRILFVKEG | | TRILFVKEG | | VLLNDKHSNN | | YKNANTLTSVT | |
| TRINMINSK | | TRINMINSK | | VLLSPEEVSE | | YKNNTWVNQTY | |
| TRIYYFKEG | | TRIYYFKEG | | VLMENEMTLD | | YKNTNTLSSVT | |
| TRKEPALIV | | TRKEPALIV | | VLMENERTLD | | YKNWILWISFA | |
| TRKLIQLIV | | TRKLIQLIV | | VLMENERTLE | | YKRIRLFDYSG | |
| TRKMVTQRT | | TRKMVTQRT | | VLMENERTLG | | YKRIRLFDYSK | |
| TRKQLRENA | | TRKQLRENA | | VLMENERTLY | | YKRIRLFDYSR | |
| TRLFTIRQE | | TRLFTIRQE | | VLNKSLCKVE | | YKRVRLFDYSR | |
| TRLPFQNLS | | TRLPFQNLS | | VLNLLIGISN | | YKSTPSAIDQI | |
| TRLYIWGVH | | TRLYIWGVH | | VLNLLIGVSN | | YKSTQAAIDQI | |
| TRLYVNKNP | | TRLYVNKNP | | VLNNKNWSGY | | YKSTQAAVDQI | |
| TRPGYNGQK | | TRPGYNGQK | | VLNNMNWSGY | | YKSTQATIDQI | |
| TRPILSPLT | | TRPILSPLT | | VLNNRNWSGY | | YKSTQKTIDQV | |
| TRQASPSCL | | TRQASPSCL | | VLNTDWSGYS | | YKSTQSAIDQI | |
| TRQMVHAMR | | TRQMVHAMR | | VLRGFLIIGK | | YKSTQSAIDQV | |
| TRQMVQAMR | | TRQMVQAMR | | VLRGFLILGK | | YKSTQSAINQI | |
| TRQVCIAWS | | TRQVCIAWS | | VLRGFLILGR | | YKSTQSAVDQI | |
| TRQVCMAWS | | TRQVCMAWS | | VLRTQESECA | | YKSTQSAVNQI | |
| TRQVCVAWS | | TRQVCVAWS | | VLRVPNALTD | | YKSWSKPQCQI | |
| TRREIHIYY | | TRREIHIYY | | VLSAFDERRN | | YKVATGRVTVS | |
| TRREVHIYY | | TRREVHIYY | | VLSCIFCLAF | | YKVGYLCAGIP | |
| TRREVHTYY | | TRREVHTYY | | VLSIAPIMFS | | YKVLAIYSCIA | |
| TRREVHVYY | | TRREVHVYY | | VLSIIALLIG | | YKVLSIYSCIA | |
| TRRIDFHWL | | TRRIDFHWL | | VLSIIPSGPL | | YKYGNGVWIGR | |
| TRRLIQLIV | | TRRLIQLIV | | VLSIVPSGPL | | YKYKIFKNGKK | |
| TRRLTVLGK | | TRRLTVLGK | | VLSIYSCIAS | | YLCAGIPSDTP | |
| TRRLVQLIV | | TRRLVQLIV | | VLSVAPIMFS | | YLCAGIPTDTP | |
| TRRMIQLIV | | TRRMIQLIV | | VLSVIPSGPL | | YLCAGLPSDTP | |
| TRRQKRGLF | | TRRQKRGLF | | VLTDNPRPND | | YLCSGLVADTP | |
| TRRQLRENA | | TRRQLRENA | | VLTDTSRPGD | | YLCSGLVGDTP | |
| TRSAYERMC | | TRSAYERMC | | VLTDTSRPKD | | YLCSKILTDTS | |

Fig. 83-403

| Block size 8 | SIN | Block size 9 | SIN | Block size 10 | SIN | Block size 11 | SIN |
|---|---|---|---|---|---|---|---|
| TRSDQISIV | | TRSDQISIV | | VLTDTSRPSD | | YLCSKTLTDTS | |
| TRSGGNNNQ | | TRSGGNNNQ | | VLTGNLQALK | | YLCSKVLTDTS | |
| TRSGGNTNH | | TRSGGNTNH | | VLTGNLQTLK | | YLCSRILTDTS | |
| TRSGGNTNQ | | TRSGGNTNQ | | VLTGNLQTLR | | YLCSRVLTDTS | |
| TRSGGNTSQ | | TRSGGNTSQ | | VLVALENQHT | | YLCTGILTDTS | |
| TRSGQNHGI | | TRSGQNHGI | | VLVGLILAFI | | YLCTGVLTDTS | |
| TRSGTSKAC | | TRSGTSKAC | | VLVGLILSFI | | YLEEHPNAGKD | |
| TRSGYEMLK | | TRSGYEMLK | | VLVGLILTFI | | YLEEHPSAGKD | |
| TRSRSGFEM | | TRSRSGFEM | | VLVGPILSFI | | YLEEHPSAGRD | |
| TRTAYERMC | | TRTAYERMC | | VLVIWGIHHP | | YLEEHPSTGKD | |
| TRTTVDHMA | | TRTTVDHMA | | VLVLMENERT | | YLEENPSAGKD | |
| TRVAYERMC | | TRVAYERMC | | VLVLWGIHHP | | YLEKYVEDTKI | |
| TRVDKLTQG | | TRVDKLTQG | | VLVMKRKRDS | | YLELIRGRPQE | |
| TRVDRLTQG | | TRVDRLTQG | | VLVMKRKRNS | | YLIEDPAAPHG | |
| TRVKRQLRE | | TRVKRQLRE | | VLVMWGIHHP | | YLIEDPGAPHG | |
| TRVWWTSNS | | TRVWWTSNS | | VLVMWGLHHP | | YLIEDPNAPHK | |
| TRVYYFKEG | | TRVYYFKEG | | VLVNTYQWII | | YLIEDPNAPNK | |
| TRVYYFKGG | | TRVYYFKGG | | VLVNTYQWVI | | YLIEDPSAPHG | |
| TRVYYFKKG | | TRVYYFKKG | | VLVTREPYIS | | YLIEDPSAPHR | |
| TRVYYFREG | | TRVYYFREG | | VLVTREPYLS | | YLIEDPTAPHG | |
| TRWMKIIRV | | TRWMKIIRV | | VLVTREPYVS | | YLIGKTSWSYI | |
| TRYVCSKFH | | TRYVCSKFH | | VLWACQNGNI | | YLIRALTLNTM | |
| TSACKRTVS | | TSACKRTVS | | VLWGIHHPDS | | YLIRTLTLNTM | |
| TSARQEKNP | | TSARQEKNP | | VLWGIHHPDT | | YLITGKSHGRI | |
| TSCFDGKEW | | TSCFDGKEW | | VLWISFAISC | | YLLFQDILMRM | |
| TSCHDGIGR | | TSCHDGIGR | | VLWTSNSIVA | | YLLLNKSLCNV | |
| TSCHDGISR | | TSCHDGISR | | VLWTSNSIVV | | YLLLNKSLCSV | |
| TSCHDGKAR | | TSCHDGKAR | | VLWTSNSMVA | | YLMLNKSLCKI | |
| TSCHDGKFR | | TSCHDGKFR | | VLYFWGIHHP | | YLMLNKSLCKV | |
| TSCHDGKSR | | TSCHDGKSR | | VLYFWGVHHP | | YLMLSKSLCKV | |
| TSCHDGKTR | | TSCHDGKTR | | VMCVCRDNWH | | YLNGREWSYIV | |
| TSCHDGMSR | | TSCHDGMSR | | VMEHTSQYLC | | YLSGREWSYIV | |
| TSCHDGRAR | | TSCHDGRAR | | VMELIRMIKR | | YLSNNATDTVD | |
| TSCHDGRSR | | TSCHDGRSR | | VMELIRMVKR | | YLSNNSSDTVD | |
| TSCHDGVGR | | TSCHDGVGR | | VMELVRMIKR | | YLSNNSTDKID | |
| TSCHDGVSR | | TSCHDGVSR | | VMGARPQVNG | | YLSNNSTDKVD | |
| TSDMRAEII | | TSDMRAEII | | VMGLVFFCLK | | YLSNNSTDTVD | |
| TSDMRTEII | | TSDMRTEII | | VMGLVFICIK | | YLSTNSSDKVD | |
| TSDMRTEVI | | TSDMRTEVI | | VMGQASYKIF | | YLSTNSSEKVD | |
| TSFFYRYGF | | TSFFYRYGF | | VMGQQGRMDY | | YLSTNSSEKVN | |
| TSFQVDCYL | | TSFQVDCYL | | VMKRKRDSSI | | YLSTNSSERVD | |
| TSGEQMLII | | TSGEQMLII | | VMKRKRNSSI | | YLSTNSTEKVD | |
| TSGEQMLVI | | TSGEQMLVI | | VMLLAIAMGL | | YLTGTWDTLIE | |
| TSGEQVLVI | | TSGEQVLVI | | VMNTSKPFQN | | YLVLNKSLCKV | |
| TSGNLIAPE | | TSGNLIAPE | | VMNTSKPLQN | | YLWGVHHPSSD | |
| TSGRQEKNP | | TSGRQEKNP | | VMREPFISCS | | YMCSGLVGDTP | |
| TSGSIISFC | | TSGSIISFC | | VMREPYVSCN | | YMLERELVRKT | |
| TSGSSIAFC | | TSGSSIAFC | | VMTDGNASGK | | YMNTALLNASC | |
| TSGSSISFC | | TSGSSISFC | | VMTDGPANKQ | | YNADLLVAMEN | |
| TSGTYGAGS | | TSGTYGAGS | | VMTDGPANNQ | | YNADVLVALEN | |
| TSGTYGSGS | | TSGTYGSGS | | VMTDGPANRQ | | YNAEFFVLMEN | |
| TSGTYGTGS | | TSGTYGTGS | | VMTDGPANSQ | | YNAEFLVALEN | |
| TSGTYGTGT | | TSGTYGTGT | | VMTDGPASNQ | | YNAEFLVAMEN | |
| TSHRTLLMN | | TSHRTLLMN | | VMTDGSASGK | | YNAEFLVAVEN | |
| TSHTGTYCS | | TSHTGTYCS | | VMTDGSASGQ | | YNAEILVALEN | |
| TSIRNNTYD | | TSIRNNTYD | | VMTDGSASGR | | YNAEILVLMEN | |
| TSISCLYKL | | TSISCLYKL | | VMTDGSASRK | | YNAELFVLMEN | |
| TSIWTSSSS | | TSIWTSSSS | | VMTDGSASSQ | | YNAELIVLLEN | |
| TSKACNALT | | TSKACNALT | | VMTHTSQYIC | | YNAELLIALEN | |
| TSKACNAST | | TSKACNAST | | VMVGLILAFI | | YNAELLIAMEN | |
| TSKACSAST | | TSKACSAST | | VNATETVEIT | | YNAELLILLEN | |
| TSKDSRSGY | | TSKDSRSGY | | VNATETVERT | | YNAELLVALEN | |

Fig. 83-404

| Block size 8 | SIN | Block size 9 | SIN | Block size 10 | SIN | Block size 11 | SIN |
|---|---|---|---|---|---|---|---|
| TSKHYIGKC | | TSKHYIGKC | | VNATETVETA | | YNAELLVAMEN | |
| TSKIKMKWG | | TSKIKMKWG | | VNATETVETT | | YNAELLVLIEN | |
| TSKPFQNIC | | TSKPFQNIC | | VNATETVETV | | YNAELLVLLED | |
| TSKPFQNTS | | TSKPFQNTS | | VNDRNFWRGE | | YNAELLVLLEN | |
| TSKPLQNTS | | TSKPLQNTS | | VNEEALRQKI | | YNAELLVLLGN | |
| TSKVKMKWG | | TSKVKMKWG | | VNEGALRQKI | | YNAELLVLMEN | |
| TSLCSIWFS | | TSLCSIWFS | | VNESADMSIG | | YNAEVLVLMEN | |
| TSLLLATGM | | TSLLLATGM | | VNFESNGNFI | | YNAGLLVALEN | |
| TSLTSLPFQ | | TSLTSLPFQ | | VNFLSMEFSL | | YNAKLLVLIEN | |
| TSNLPFQNV | | TSNLPFQNV | | VNFVSMEFSL | | YNAKLLVLLEN | |
| TSNQDSFYR | | TSNQDSFYR | | VNGALGSPGC | | YNAQLLVLLEN | |
| TSNQGSFYR | | TSNQGSFYR | | VNGKLNRLIE | | YNAQLLVWLEN | |
| TSNRGSFYR | | TSNRGSFYR | | VNGPESVLVN | | YNARLLVLLEN | |
| TSNSIAVFC | | TSNSIAVFC | | VNGQAGRIDF | | YNETFVNMTNV | |
| TSNSIIAFC | | TSNSIIAFC | | VNGQAGRMTF | | YNETFVNVTHV | |
| TSNSIIVFC | | TSNSIIVFC | | VNGQFGRIDF | | YNETFVNVTNV | |
| TSNSIVAFC | | TSNSIVAFC | | VNGQFGRINF | | YNFEKEGYSLV | |
| TSNSIVALC | | TSNSIVALC | | VNGQRGRIDF | | YNGIITDTFKS | |
| TSNSIVSMC | | TSNSIVSMC | | VNGQSGRIDF | | YNGIITDTLKS | |
| TSNSIVTFC | | TSNSIVTFC | | VNGQSGRIEF | | YNGKSLGIQSD | |
| TSNSIVVFC | | TSNSIVVFC | | VNGQSGRINF | | YNGQKSWMKIY | |
| TSNSIVVFV | | TSNSIVVFV | | VNGQSGRIVF | | YNGQKSWTKIY | |
| TSNSLIALC | | TSNSLIALC | | VNGQTGRIDF | | YNGQRSWMKIY | |
| TSNSLVALC | | TSNSLVALC | | VNGVKLEENS | | YNGVITDTLKS | |
| TSNSMVTFC | | TSNSMVTFC | | VNGWYGFRHQ | | YNHEDYKEESQ | |
| TSNSVVVFC | | TSNSVVVFC | | VNIDRFLRVR | | YNHEDYREESQ | |
| TSPCLTDKG | | TSPCLTDKG | | VNKITYGACP | | YNHKDYEEEAK | |
| TSPIVPSFD | | TSPIVPSFD | | VNKNPYTLVS | | YNHKEYEEEAK | |
| TSPLPFQNI | | TSPLPFQNI | | VNLGLNIGLH | | YNHTEYRQEAL | |
| TSQRGILED | | TSQRGILED | | VNMTNVQNNY | | YNIRNLHIPEA | |
| TSQRGVLED | | TSQRGVLED | | VNNGKGRYGV | | YNIRNLHIPEV | |
| TSQYICSPV | | TSQYICSPV | | VNNIVDKMNR | | YNKIEFEPFQS | |
| TSQYLCTGI | | TSQYLCTGI | | VNNNNWSGYS | | YNKLEFEPFQS | |
| TSQYLCTGV | | TSQYLCTGV | | VNNQDWSGYS | | YNKMEFEPFQS | |
| TSRHYIGKC | | TSRHYIGKC | | VNNQNWSGYS | | YNKTVINNITT | |
| TSRHYMGEC | | TSRHYMGEC | | VNPGDSIIFN | | YNKVEFEPFQS | |
| TSRYVCTGI | | TSRYVCTGI | | VNPTLLFLEV | | YNKVRMQLRDN | |
| TSSGTSKAC | | TSSGTSKAC | | VNPTLLFLKI | | YNNTNGEQILI | |
| TSSIDLIET | | TSSIDLIET | | VNPTLLFLKM | | YNNTSGEQMLI | |
| TSSIDLVET | | TSSIDLVET | | VNPTLLFLKV | | YNNTSGEQMLV | |
| TSSIELVEN | | TSSIELVEN | | VNPTLLFLRV | | YNNTSGEQVLV | |
| TSSIYIEVL | | TSSIYIEVL | | VNQITGKLNR | | YNNTTGRDVLV | |
| TSSQDTEIS | | TSSQDTEIS | | VNRANQRLNP | | YNNTVINNITT | |
| TSSQDTELS | | TSSQDTELS | | VNRANQRLNT | | YNNTVVNNITT | |
| TSSSSIVMC | | TSSSSIVMC | | VNRCFYVELI | | YNPCFYVELIR | |
| TSSSSTVFC | | TSSSSTVFC | | VNRFYRTCKL | | YNRKEYEEEAK | |
| TSSSSVVMC | | TSSSSVVMC | | VNRITYGACP | | YNRRLTTTIKP | |
| TSSVDLIET | | TSSVDLIET | | VNRITYGPCP | | YNRRLTTTIKT | |
| TSSVDLVET | | TSSVDLVET | | VNRITYGVCP | | YNRRPTTTIKT | |
| TSSVELVEN | | TSSVELVEN | | VNRTHQYSEK | | YNSKFESVAWS | |
| TSSVELVET | | TSSVELVET | | VNRTHQYSER | | YNSRFESVAWS | |
| TSSVYIEVL | | TSSVYIEVL | | VNSALGSPGC | | YNSTVVNNITT | |
| TSSVYVEVL | | TSSVYVEVL | | VNSFSRTELI | | YNTELLVLMEN | |
| TSTIDLIET | | TSTIDLIET | | VNSIIDKMNI | | YNVELLVLMEN | |
| TSTQKAINE | | TSTQKAINE | | VNSIIDKMNT | | YNVGYLCAGIP | |
| TSVGGIDTN | | TSVGGIDTN | | VNSIIGKMNT | | YNYPKYEEESR | |
| TSVGGINTN | | TSVGGINTN | | VNSIINKMNT | | YPDVRCICRDN | |
| TSVKTLTDN | | TSVKTLTDN | | VNSSKPFQNA | | YPDVRCTCRDN | |
| TSVTTNTIN | | TSVTTNTIN | | VNSSMPFHNI | | YPDVRCVCRDN | |
| TSVWAGRTI | | TSVWAGRTI | | VNSWHIFSKD | | YPFDVPDYQSL | |
| TSVWAGRTV | | TSVWAGRTV | | VNSWHILSKD | | YPGATINEEAL | |
| TSWSWPDGA | | TSWSWPDGA | | VNTALLNASC | | YPGATVNEEAL | |

Fig. 83-405

| Block size 8 | SIN | Block size 9 | SIN | Block size 10 | SIN | Block size 11 | SIN |
|---|---|---|---|---|---|---|---|
| TSWSYIVEK | | TSWSYIVEK | | VNTIIENNVT | | YPGATVNEGAL | |
| TSWSYIVER | | TSWSYIVER | | VNTIIESNVT | | YPGELDNNGEL | |
| TSYKILSIY | | TSYKILSIY | | VNTILEKNVT | | YPGELNNNGEL | |
| TSYRSLIRF | | TSYRSLIRF | | VNTILSTKAL | | YPGEVDNNGEL | |
| TSYWWDGLQ | | TSYWWDGLQ | | VNTLIEQNIP | | YPGFVENLEEL | |
| TTAKAMEQM | | TTAKAMEQM | | VNTLIEQNVP | | YPGKFTNEEAL | |
| TTAKAMEQV | | TTAKAMEQV | | VNTLLENDVP | | YPGNFNDYEEL | |
| TTASCQNRG | | TTASCQNRG | | VNTLSEQNVP | | YPGNNNGVKGF | |
| TTAVAVLKY | | TTAVAVLKY | | VNTLTEKGIE | | YPGNNNKGVKG | |
| TTCHDGIGR | | TTCHDGIGR | | VNTLTEKGVE | | YPGNNNNGVKG | |
| TTCWSWPDG | | TTCWSWPDG | | VNTLTEQNVP | | YPGRFTNEEAL | |
| TTDWSGYSG | | TTDWSGYSG | | VNTLTEREVE | | YPGSFNDYEEL | |
| TTEINTWAR | | TTEINTWAR | | VNTLTERGIE | | YPGSFNNYEEL | |
| TTEIRASVG | | TTEIRASVG | | VNTLTERGVE | | YPGSIENLEEL | |
| TTEIYNETV | | TTEIYNETV | | VNTNKTFQNI | | YPGSIENQEEL | |
| TTEVSHCRA | | TTEVSHCRA | | VNTNTINRSF | | YPGSIKNQEEL | |
| TTEVYNETV | | TTEVYNETV | | VNTTLSTIAL | | YPGSLNDYEEL | |
| TTEVYSETV | | TTEVYSETV | | VNTVLSIIAL | | YPGSNNNGVKG | |
| TTFESNGGL | | TTFESNGGL | | VNTYQWIIKN | | YPGSTVNEEAL | |
| TTFPYTGDP | | TTFPYTGDP | | VNTYQWIIRN | | YPGSVENLEEL | |
| TTFRGLIST | | TTFRGLIST | | VNTYQWVIRN | | YPGSVENQEEL | |
| TTFRGLLST | | TTFRGLLST | | VNVRGSGLRI | | YPGTTVNEEAL | |
| TTGKSHGRI | | TTGKSHGRI | | VNVRGSGMRI | | YPGVRCICRDN | |
| TTGMTLSVV | | TTGMTLSVV | | VNVRGTGMRI | | YPKYEEESKLK | |
| TTGNPIICL | | TTGNPIICL | | VNVTHVQNNY | | YPKYEEESKLN | |
| TTGRDVLVI | | TTGRDVLVI | | VNVTNVQNDY | | YPKYEEESRLN | |
| TTGRDVLVL | | TTGRDVLVL | | VNVTNVQNNY | | YPNDGKVECVC | |
| TTGRDVLVM | | TTGRDVLVM | | VNYVSMEFSL | | YPNEGKVECIC | |
| TTGRNCTIP | | TTGRNCTIP | | VPASRYLIDM | | YPNEGKVECVC | |
| TTGRNCTVP | | TTGRNCTVP | | VPASRYLTDM | | YPNLCQVECVC | |
| TTGWSWPDG | | TTGWSWPDG | | VPCFWLEMIR | | YPNLGKVECVC | |
| TTHDRTAFR | | TTHDRTAFR | | VPCFWVEMIR | | YPNLGQVECVC | |
| TTHFQRKRR | | TTHFQRKRR | | VPDYQSIRSI | | YPNMGKVECVC | |
| TTHSWIPKR | | TTHSWIPKR | | VPDYQSLRSI | | YPNNGKVECIC | |
| TTHSWTPKR | | TTHSWTPKR | | VPEKIHTRGL | | YPNSGKVECVC | |
| TTHSWVPIL | | TTHSWVPIL | | VPEKIRTRGL | | YPNVRCVCRDN | |
| TTHSWVPKR | | TTHSWVPKR | | VPEKIRVKRR | | YPQYPNVRCVC | |
| TTHTGTYCS | | TTHTGTYCS | | VPEWSYIIEK | | YPRYPDVRCVC | |
| TTIGLLLQI | | TTIGLLLQI | | VPEWSYIMEK | | YPRYPNVRCVC | |
| TTIKPWARN | | TTIKPWARN | | VPEWSYIVEK | | YQAELLIAMEN | |
| TTIKTWAGK | | TTIKTWAGK | | VPEWSYIVER | | YQAELLVAMEN | |
| TTIKTWAGN | | TTIKTWAGN | | VPEYGFKISK | | YQAKFEAVAWS | |
| TTIKTWAKN | | TTIKTWAKN | | VPEYQSLRSI | | YQAKFESVAWS | |
| TTIKTWARN | | TTIKTWARN | | VPFHLATKQV | | YQARFEAVAWS | |
| TTINNITNV | | TTINNITNV | | VPFHLGTKQV | | YQARFESVAWS | |
| TTIRGKHSN | | TTIRGKHSN | | VPFHLGTRQV | | YQFALGHGTTL | |
| TTIRGRHSN | | TTIRGRHSN | | VPFYLGTKQV | | YQFALGQGATL | |
| TTIRNKHSN | | TTIRNKHSN | | VPGVKGFGFL | | YQFALGQGTTL | |
| TTIRNRHSN | | TTIRNRHSN | | VPGWSWDDGA | | YQGRLCNPLNP | |
| TTIRTWAKN | | TTIRTWAKN | | VPGWSWGDGA | | YQGRLCNPMNP | |
| TTITLHFKQ | | TTITLHFKQ | | VPGYQSLRSI | | YQIGNVINWTK | |
| TTIWTSGSS | | TTIWTSGSS | | VPILNTSQRG | | YQIGYICSGVF | |
| TTKINNIID | | TTKINNIID | | VPKRNRSILN | | YQIGYVCSGIF | |
| TTKINNIIE | | TTKINNIIE | | VPLGSSPNAY | | YQIGYVCSGVF | |
| TTLDNEHSN | | TTLDNEHSN | | VPLGSSSNAY | | YQILAIYATVA | |
| TTLDNKHSN | | TTLDNKHSN | | VPLVPCEPII | | YQILAIYSTAA | |
| TTLENKHSN | | TTLENKHSN | | VPNAGTDPNS | | YQILAIYSTVA | |
| TTLIENTYV | | TTLIENTYV | | VPNALTDDKS | | YQILAIYSTVS | |
| TTLKGRHAN | | TTLKGRHAN | | VPNALTDDRS | | YQILSIYSTAA | |
| TTLNNKHSN | | TTLNNKHSN | | VPNALTDERS | | YQILSIYSTVA | |
| TTLPFHNIH | | TTLPFHNIH | | VPNALTDNRS | | YQILSIYSTVS | |
| TTLPFHNVH | | TTLPFHNVH | | VPNGTIVKTI | | YQILSIYSTVT | |

Fig. 83-406

| Block size 8 | SIN | Block size 9 | SIN | Block size 10 | SIN | Block size 11 | SIN |
|---|---|---|---|---|---|---|---|
| TTLRGQHAN | | TTLRGQHAN | | VPNGTIVRTI | | YQILSIYSTVV | |
| TTLRGRHAN | | TTLRGRHAN | | VPNGTKVNTL | | YQKCCNLFEKF | |
| TTLSTIALF | | TTLSTIALF | | VPNGTLVKTI | | YQKCCSLFEKF | |
| TTLSTIALI | | TTLSTIALI | | VPNGTMVKTI | | YQKCCTLFEKF | |
| TTLSTIALL | | TTLSTIALL | | VPNGTVVKTI | | YQKQMTRGLFG | |
| TTLYKNANT | | TTLYKNANT | | VPNIGSRPRV | | YQKRMGLQMQR | |
| TTLYNKHSN | | TTLYNKHSN | | VPNYQSLRSI | | YQKRMGVQIQR | |
| TTMEKNVTV | | TTMEKNVTV | | VPPLELGDCS | | YQKRMGVQLQR | |
| TTNPLIKHE | | TTNPLIKHE | | VPQAQDRGLF | | YQKRMGVQMHR | |
| TTNPLIRHE | | TTNPLIRHE | | VPQAQNRGLF | | YQKRMGVQMQR | |
| TTNSIVVFC | | TTNSIVVFC | | VPQIEARGLF | | YQKRMTRGLFG | |
| TTNTINRIF | | TTNTINRIF | | VPQIESRGLF | | YQNNFVPVVGA | |
| TTNTINRNF | | TTNTINRNF | | VPQIQNRGLF | | YQNSFVPVVGA | |
| TTNTINRSF | | TTNTINRSF | | VPQMESRGLF | | YQQSFSPSPGA | |
| TTNTYRNTD | | TTNTYRNTD | | VPQVQDRGLF | | YQQSFSPSPGD | |
| TTNYYNETF | | TTNYYNETF | | VPQVQNRGLF | | YQRCCNLFEKF | |
| TTPTKSYFA | | TTPTKSYFA | | VPSERGLQRR | | YQRTRALVRSG | |
| TTQIIKLLP | | TTQIIKLLP | | VPSGPLKAEI | | YQRTRALVRTG | |
| TTRQASPSC | | TTRQASPSC | | VPSIQSRGLF | | YQSIRSILANN | |
| TTSKDSRSG | | TTSKDSRSG | | VPSPYNSRFE | | YQSLRSILANN | |
| TTSWSWPDG | | TTSWSWPDG | | VPSVQSRGLF | | YQSLRSILASS | |
| TTTIKPWAR | | TTTIKPWAR | | VPVGSGSFPD | | YQSNNSTDTVD | |
| TTTIKTWAG | | TTTIKTWAG | | VPVIGARPQV | | YQSNNSTDTVN | |
| TTTIKTWAK | | TTTIKTWAK | | VPVMGARPQV | | YQSNNSTNTVN | |
| TTTIKTWAR | | TTTIKTWAR | | VPVTQAMELV | | YQSRFEAVAWS | |
| TTTIRTWAK | | TTTIRTWAK | | VPVTQTMELV | | YQTNNSTDTVN | |
| TTTNPLIRH | | TTTNPLIRH | | VPVTQVEELV | | YQTNNSTETVN | |
| TTTPTKSYF | | TTTPTKSYF | | VPVTSSIDLI | | YQVLAIYATVA | |
| TTTTIINNN | | TTTTIINNN | | VPVTSSIDLV | | YRACFYVELIR | |
| TTTVKTWAG | | TTTVKTWAG | | VPVTSSVDLI | | YRALISWEMGQ | |
| TTVDHMAII | | TTVDHMAII | | VPVTSSVDLV | | YRALISWPLSS | |
| TTVGLLLQI | | TTVGLLLQI | | VPVTSTIDLI | | YRALISWPQSS | |
| TTVGLLLQV | | TTVGLLLQV | | VPVVGARPLV | | YRALMSVLLGS | |
| TTVGWSWPD | | TTVGWSWPD | | VPVVGARPQV | | YRALMSVPLGS | |
| TTVKTWAGN | | TTVKTWAGN | | VPVVRARPQV | | YRALSIYSCIA | |
| TTVNEEALR | | TTVNEEALR | | VQDIIDNDNW | | YRALVSWPLSS | |
| TTVTLHFKQ | | TTVTLHFKQ | | VQDIIDNNNW | | YRDDAINNRFQ | |
| TTVVENTYV | | TTVVENTYV | | VQGFFPFHKD | | YRDEAINNRFQ | |
| TTVWWTSNS | | TTVWWTSNS | | VQGNNDNATA | | YRDEAINNRIK | |
| TTWDVFIER | | TTWDVFIER | | VQGNNKNATA | | YRDEAINSRFQ | |
| TTYKILSIY | | TTYKILSIY | | VQGNNNNATA | | YRDEAISNRFQ | |
| TTYQRTRAL | | TTYQRTRAL | | VQHLEECSCY | | YRDEALNNRFQ | |
| TTYRILSIY | | TTYRILSIY | | VQHPELTGLD | | YRDEALNNRSQ | |
| TTYWWDGLQ | | TTYWWDGLQ | | VQHPELTGLN | | YRDEALSNRFQ | |
| TVAASLCLA | | TVAASLCLA | | VQHPELTGMD | | YRDEAVNNRFQ | |
| TVAGSLSLA | | TVAGSLSLA | | VQHPELTGMN | | YRDNWKGSNRP | |
| TVASSLALA | | TVASSLALA | | VQHPELTGVD | | YRDWSKPQCQI | |
| TVASSLTLA | | TVASSLTLA | | VQHPEMTGLD | | YREEALLNRLN | |
| TVASSLVLA | | TVASSLVLA | | VQIIKLLPFA | | YREEALLNRLS | |
| TVDHMAIIK | | TVDHMAIIK | | VQITGKLNRL | | YREEALLSRLN | |
| TVDTILEKN | | TVDTILEKN | | VQMCTELKLN | | YREEAMQNRIQ | |
| TVDTILERN | | TVDTILERN | | VQMCTELKLS | | YREESLLNRLS | |
| TVDTLIEQN | | TVDTLIEQN | | VQMQRFRRPD | | YREESQLKKQE | |
| TVDTLLEKN | | TVDTLLEKN | | VQNAISTTFP | | YREESQLKRQE | |
| TVDTLTENG | | TVDTLTENG | | VQNALNGNGD | | YRGRLCNPLNP | |
| TVDTVLEKN | | TVDTVLEKN | | VQNALSGNGD | | YRICKLVGINM | |
| TVDTVLERN | | TVDTVLERN | | VQNEFNKACE | | YRILSIYSTVA | |
| TVEITGIDK | | TVEITGIDK | | VQPAFSVQRN | | YRIWSKPQCQI | |
| TVEITGINK | | TVEITGINK | | VQPGDNIIFS | | YRKEAMQNRIQ | |
| TVERMVLSA | | TVERMVLSA | | VQPGDNITFS | | YRKLKREITFH | |
| TVFCGVSGE | | TVFCGVSGE | | VQPTFSVQRN | | YRKRMTRGLFG | |
| TVFCGVSSE | | TVFCGVSSE | | VQPTFSVQRS | | YRNEAINNRFQ | |

Fig. 83-407

| Block size 8 | SIN | Block size 9 | SIN | Block size 10 | SIN | Block size 11 | SIN |
|---|---|---|---|---|---|---|---|
| TVGKCPRYI | | TVGKCPRYI | | VQQTRMDKLT | | YRNEALNNRFQ | |
| TVGKCPRYV | | TVGKCPRYV | | VQQTRVDKLT | | YRNMRWLTLKS | |
| TVGLLLQII | | TVGLLLQII | | VQQTRVDRLT | | YRNNRKEPALI | |
| TVGLLLQIT | | TVGLLLQIT | | VQSEFNKACE | | YRNTRKEPALI | |
| TVGLLLQVT | | TVGLLLQVT | | VQSRGLFGAI | | YRNWSKPQCQI | |
| TVGQCPKYV | | TVGQCPKYV | | VQSYFQLFLV | | YRQEALQNRIM | |
| TVGRCPRYV | | TVGRCPRYV | | VQTDEYKNTG | | YRQSFSPSPGA | |
| TVGSSKYQQ | | TVGSSKYQQ | | VQTDEYKNTR | | YRRPIGISSMV | |
| TVGSSKYRQ | | TVGSSKYRQ | | VQVDTIMEKN | | YRRPVGISSMG | |
| TVGSSNYQQ | | TVGSSNYQQ | | VQVIKLLPFA | | YRRPVGISSMM | |
| TVHDRIPHR | | TVHDRIPHR | | VRARPQVNGQ | | YRRPVGISSMV | |
| TVIKNNMIN | | TVIKNNMIN | | VRCICRDNWK | | YRSINWLTKKE | |
| TVIKNNMVN | | TVIKNNMVN | | VRCICRDNWR | | YRSINWLTKKK | |
| TVIMTDGSA | | TVIMTDGSA | | VRCTCRDNWK | | YRSIRWLTLKS | |
| TVINNITTT | | TVINNITTT | | VRCVCRDNWK | | YRSLIQFPIGT | |
| TVINNYYNE | | TVINNYYNE | | VRCVCRDNWM | | YRSLIQFPMGT | |
| TVIRNNMIN | | TVIRNNMIN | | VRCVCRDNWR | | YRSLIRFPIGT | |
| TVKDRSPFR | | TVKDRSPFR | | VREGRNPGNA | | YRSLIRFPIGV | |
| TVKDRSPYR | | TVKDRSPYR | | VREKNVTVTH | | YRSLIRFPVGT | |
| TVKIKTNGN | | TVKIKTNGN | | VREPFISCSH | | YRSLISWPLSS | |
| TVKIQTNGN | | TVKIQTNGN | | VREQQGRMDY | | YRSMKWLTLKS | |
| TVKIQTSGN | | TVKIQTSGN | | VRESRNPGNA | | YRSMRWLTLKL | |
| TVKQDGKSS | | TVKQDGKSS | | VREWSYLIED | | YRSMRWLTLKS | |
| TVKQNGKSG | | TVKQNGKSG | | VRFGESEQII | | YRSWSKPQCQI | |
| TVKQNGKSS | | TVKQNGKSS | | VRGDLNFVNR | | YRTCKLLGINM | |
| TVKTWAGNI | | TVKTWAGNI | | VRGDQICIGY | | YRTCKLVGINM | |
| TVLEKNVTV | | TVLEKNVTV | | VRGDQICVGY | | YRTESLQNRIQ | |
| TVLERNVTV | | TVLERNVTV | | VRGDYNNTTG | | YRTLLMNELGI | |
| TVLGVSILN | | TVLGVSILN | | VRGLSSRISF | | YRTLLMNELGV | |
| TVLKSDKRI | | TVLKSDKRI | | VRGNSPAFNY | | YRTLLMSELGV | |
| TVLSIIALL | | TVLSIIALL | | VRGNSPVFNY | | YRYGFVANFSM | |
| TVLVGLILA | | TVLVGLILA | | VRGQQGRMDY | | YRYTYRCHKGD | |
| TVMVGLILA | | TVMVGLILA | | VRGQQGTMDY | | YRYTYRCHRGD | |
| TVNEEALRQ | | TVNEEALRQ | | VRGQQGWMDY | | YSAGALASCMG | |
| TVNEGALRQ | | TVNEGALRQ | | VRGQSGRISF | | YSCIASSIVLV | |
| TVNFSFNGA | | TVNFSFNGA | | VRGQSGRVSF | | YSCIASSIVMV | |
| TVNRTHQYS | | TVNRTHQYS | | VRHFEKVKIL | | YSCIASSLILA | |
| TVNTLIEQK | | TVNTLIEQK | | VRHQLRDNAK | | YSCIASSLVLA | |
| TVNTLIEQN | | TVNTLIEQN | | VRHQLRENAE | | YSCIASSTVLV | |
| TVNTLMEQN | | TVNTLMEQN | | VRHRLKITEN | | YSCIASSTVMV | |
| TVNTLSEQN | | TVNTLSEQN | | VRIGSKGDVF | | YSCIASSVVLV | |
| TVNTLTEQN | | TVNTLTEQN | | VRINNETILE | | YSCVASSLVLA | |
| TVNVRGSGL | | TVNVRGSGL | | VRKMMTNSQD | | YSEMKWLLSSK | |
| TVNVRGSGM | | TVNVRGSGM | | VRKMMTNSRD | | YSEMKWLSSSG | |
| TVNVRGTGM | | TVNVRGTGM | | VRKMMTSSQD | | YSEMKWLSSSM | |
| TVPCFWVEM | | TVPCFWVEM | | VRKQLRENAE | | YSGFVRTLFQQ | |
| TVPSERGLQ | | TVPSERGLQ | | VRKQLRQNAE | | YSGGTINSPLP | |
| TVQIIKLLP | | TVQIIKLLP | | VRKRFADQEL | | YSGIKTDGATS | |
| TVQVDTIME | | TVQVDTIME | | VRKTRFLPVA | | YSGIRTDGATS | |
| TVQVIKLLP | | TVQVIKLLP | | VRKTRFLPVS | | YSGSFIDYWAE | |
| TVSADPLAS | | TVSADPLAS | | VRKTRFLPVT | | YSGSFIDYWAK | |
| TVSADPLLS | | TVSADPLLS | | VRKTRFLPVV | | YSGSFIDYWDD | |
| TVSADPLVS | | TVSADPLVS | | VRLEENTTYK | | YSGSFIDYWDE | |
| TVSCDSPSN | | TVSCDSPSN | | VRLFDYSRWN | | YSGSFIDYWND | |
| TVSIDRFLR | | TVSIDRFLR | | VRLQLKDNAK | | YSGSFIQHPEL | |
| TVSLSPGMM | | TVSLSPGMM | | VRLQLKDNAR | | YSGSFMDYWAE | |
| TVSSFERFE | | TVSSFERFE | | VRLQLRDNAK | | YSGSFSIRGET | |
| TVSSFYSEM | | TVSSFYSEM | | VRLQLRDNAR | | YSGSFSIRWET | |
| TVSSGLVLV | | TVSSGLVLV | | VRLSAGGDIW | | YSGSFTLPIEL | |
| TVSSSLVLA | | TVSSSLVLA | | VRLSASGDIW | | YSGSFTLPVEL | |
| TVSSSLVLV | | TVSSSLVLV | | VRLYLWGVHH | | YSGSFTLPVEM | |
| TVSTRSDQI | | TVSTRSDQI | | VRMIKRGIND | | YSGSFTLPVGL | |

Fig. 83-408

| Block size 8 | SIN | Block size 9 | SIN | Block size 10 | SIN | Block size 11 | SIN |
|---|---|---|---|---|---|---|---|
| TVSVRGSM | | TVSVRGSM | | VRMNNETILE | | YSGSFVDYWAE | |
| TVTDGPAAN | | TVTDGPAAN | | VRMQLKDNAK | | YSGSFVQHPEL | |
| TVTFIFNGA | | TVTFIFNGA | | VRMQLRDNAK | | YSGSFVQHPEM | |
| TVTFNFNGA | | TVTFNFNGA | | VRMQLRDNVK | | YSHGTGTGYTM | |
| TVTFSFNGA | | TVTFSFNGA | | VRNDDIDQSL | | YSIADKICIGY | |
| TVTFTFNGA | | TVTFTFNGA | | VRNDDVDQSL | | YSIDSGYVCSG | |
| TVTGPPQCD | | TVTGPPQCD | | VRNGTYDHKE | | YSIDSNYVCSG | |
| TVTHAKDIL | | TVTHAKDIL | | VRNGTYDYPK | | YSIDSSYICSG | |
| TVTHAKNIL | | TVTHAKNIL | | VRNLHDQIKR | | YSIDSSYVCSG | |
| TVTHAQDIL | | TVTHAQDIL | | VRNLHDQVKR | | YSKADKICIGY | |
| TVTHAQDLL | | TVTHAQDLL | | VRNLHDRIRR | | YSKDNGIRIGS | |
| TVTHAQNIL | | TVTHAQNIL | | VRNLHDRTRR | | YSKDNSIRIGS | |
| TVTHSIELL | | TVTHSIELL | | VRNLHDRVKR | | YSKYEEESKLN | |
| TVTHSINLL | | TVTHSINLL | | VRNLHDRVRR | | YSLVGIDPFKL | |
| TVTHSVDLL | | TVTHSVDLL | | VRNLHEQIKR | | YSLVGIDPFRL | |
| TVTHSVELL | | TVTHSVELL | | VRNLHERIRR | | YSLVGVDPFKL | |
| TVTHSVNIL | | TVTHSVNIL | | VRNLYDKVRL | | YSLVGVDPFRL | |
| TVTHSVNLL | | TVTHSVNLL | | VRNLYDKVRM | | YSQITNGTTGN | |
| TVTLHFKQH | | TVTLHFKQH | | VRNQSGRISI | | YSRADKICIGY | |
| TVTLHFKQN | | TVTLHFKQN | | VRPGDNITFS | | YSSPMMWEING | |
| TVTSSIELV | | TVTSSIELV | | VRPGYNGQKS | | YSSPQLEGFSA | |
| TVTSSVELV | | TVTSSVELV | | VRPGYNGQRS | | YSSSLMWEING | |
| TVVENTYVN | | TVVENTYVN | | VRPLILKDCS | | YSSSMMWEING | |
| TVVKTLTNE | | TVVKTLTNE | | VRPLILRDCS | | YSSSMMWEVNG | |
| TVVLNTDWS | | TVVLNTDWS | | VRPRYNGQRS | | YSSVASSLVLL | |
| TVVMTDGNA | | TVVMTDGNA | | VRQCFNPMIA | | YSTAASSLALA | |
| TVVMTDGSA | | TVVMTDGSA | | VRQCFNPMII | | YSTGALASCMG | |
| TVVNNITTT | | TVVNNITTT | | VRQCFNPMIV | | YSTISSSLVLM | |
| TVVSSLALA | | TVVSSLALA | | VRQCFNPMTV | | YSTVAASLCLA | |
| TVWSSKYQQ | | TVWSSKYQQ | | VRQCFNPMVV | | YSTVASSLALA | |
| TVWSSKYQR | | TVWSSKYQR | | VRQNTLKLAT | | YSTVASSLTLA | |
| TVWSSKYRR | | TVWSSKYRR | | VRRAAVSADP | | YSTVASSLVLA | |
| TVWTSGSII | | TVWTSGSII | | VRRAIVSADP | | YSTVSSGLVLV | |
| TVWTSGSSI | | TVWTSGSSI | | VRRATVSADP | | YSTVSSSLVLA | |
| TVWTSSSSI | | TVWTSSSSI | | VRRDQMAHCR | | YSTVSSSLVLV | |
| TVYWWDGLQ | | TVYWWDGLQ | | VRRQLRENAE | | YSTVVSSLALA | |
| TVYYDRRLT | | TVYYDRRLT | | VRSDKICLGH | | YTENPVICLGH | |
| TVYYERRLT | | TVYYERRLT | | VRSEKLVLAT | | YTGDPPYSHGT | |
| TVYYNGRLT | | TVYYNGRLT | | VRSGMDPRMC | | YTGNPVICLGH | |
| TVYYNKRLT | | TVYYNKRLT | | VRSQSGRISF | | YTGNPVICMGH | |
| TVYYNRRLT | | TVYYNRRLT | | VRSWKKQILR | | YTGSFCSIDGK | |
| TVYYNRRPT | | TVYYNRRPT | | VRSWRKKILR | | YTIDEESRARI | |
| TWAGKILRT | | TWAGKILRT | | VRSWRKQILR | | YTLDEESRARI | |
| TWAGNILRT | | TWAGNILRT | | VRSWRRQILR | | YTLITDGPSDA | |
| TWAIHHPPT | | TWAIHHPPT | | VRTGMDPRMC | | YTLITDGPSNA | |
| TWAKNILRT | | TWAKNILRT | | VRTLFQQMRD | | YTLMTDGPSDA | |
| TWARNILRT | | TWARNILRT | | VRTNGTSKIK | | YTLVSTKEWSK | |
| TWAVVMTDG | | TWAVVMTDG | | VRTNGTSKVK | | YTLVSTKEWSR | |
| TWDTLIERD | | TWDTLIERD | | VSADPLASLL | | YTLVTDGPSDA | |
| TWDTLIERE | | TWDTLIERE | | VSADPLLSLL | | YTMDTVNRTHQ | |
| TWDTLIERG | | TWDTLIERG | | VSADPLVSLL | | YTMDTVSRTHQ | |
| TWDVFIERP | | TWDVFIERP | | VSAGGDIWVT | | YTRLYIWGVHH | |
| TWGIHHPSS | | TWGIHHPSS | | VSAKELVETN | | YTSARQEKNPA | |
| TWLGRTFSP | | TWLGRTFSP | | VSCDPDECRF | | YTSGRQEKNPA | |
| TWLGRTISI | | TWLGRTISI | | VSCDPDGCRF | | YTSGRQEKNPS | |
| TWLGRTISP | | TWLGRTISP | | VSCDPLGCKM | | YTYRCHKGDTQ | |
| TWLGRTIST | | TWLGRTIST | | VSCDPLGCKT | | YTYRCHRGDAQ | |
| TWLGRTLNT | | TWLGRTLNT | | VSCDPLGCRM | | YTYRCHRGDMQ | |
| TWLGRTTST | | TWLGRTTST | | VSCDPNECRF | | YTYRCHRGDTH | |
| TWNGVKVDG | | TWNGVKVDG | | VSCDPSGCKM | | YTYRCHRGDTQ | |
| TYAGAINSS | | TYAGAINSS | | VSCDPTGCKM | | YVCSGIFGDNP | |
| TYAGAVNSS | | TYAGAVNSS | | VSCEPDECRF | | YVCSGIFGDSP | |

Fig. 83-409

| Block size 8 | SIN | Block size 9 | SIN | Block size 10 | SIN | Block size 11 | SIN |
|---|---|---|---|---|---|---|---|
| TYCSLNGIS | | TYCSLNGIS | | VSCGPSECRT | | YVCSGLVGDTP | |
| TYCSLNGVS | | TYCSLNGVS | | VSCSHLECRT | | YVCSGVFGDNP | |
| TYDFNEGAY | | TYDFNEGAY | | VSCVCRDNWQ | | YVCSKFHSDTP | |
| TYDFNEGSY | | TYDFNEGSY | | VSDGGPNLYN | | YVCTGILTDTS | |
| TYDFNEGTY | | TYDFNEGTY | | VSECRTFFLT | | YVCTGVLTDTS | |
| TYDHAQYRE | | TYDHAQYRE | | VSEWSYIVEK | | YVDGFEPNGCI | |
| TYDHKDFEE | | TYDHKDFEE | | VSFESNGGLL | | YVDGFEPNGSI | |
| TYDHKDYEE | | TYDHKDYEE | | VSFHLGTKQV | | YVDGFEPNGYI | |
| TYDHKEFEE | | TYDHKEFEE | | VSFQGGHIEE | | YVDGFKPNGCI | |
| TYDHKEFEK | | TYDHKEFEK | | VSFQGRGVFE | | YVEDTKIDLWS | |
| TYDHKEYEE | | TYDHKEYEE | | VSFRGGHIEE | | YVEDTKVDLWS | |
| TYDHNIYRD | | TYDHNIYRD | | VSFRGRGVFE | | YVELIRGMPKE | |
| TYDHSYRE | | TYDHSYRE | | VSFSISCFLL | | YVELIRGMPQE | |
| TYDHSQYRE | | TYDHSQYRE | | VSFWMCSNGS | | YVELIRGRKQE | |
| TYDHTQYRE | | TYDHTQYRE | | VSFYWTIVEP | | YVELIRGRPEE | |
| TYDWTLNRN | | TYDWTLNRN | | VSGADDDAYA | | YVELIRGRPKE | |
| TYDYPKYEE | | TYDYPKYEE | | VSGADNDAYA | | YVELIRGRPQE | |
| TYDYPKYEK | | TYDYPKYEK | | VSGEVPGWSW | | YVELIRGRPRE | |
| TYDYPKYSE | | TYDYPKYSE | | VSGINESADM | | YVELIRGRQQE | |
| TYDYPKYSK | | TYDYPKYSK | | VSGPDNGAVA | | YVELIRGRRQE | |
| TYDYSKYEE | | TYDYSKYEE | | VSGPNNNASA | | YVELIRGRSQE | |
| TYGACPKYI | | TYGACPKYI | | VSGTDDDAYA | | YVEVLHLTQGT | |
| TYGACPKYV | | TYGACPKYV | | VSGVNESADM | | YVEWTSNSLIA | |
| TYGACPRYI | | TYGACPRYI | | VSGWLLGNPM | | YVKQGSLKLAT | |
| TYGACPRYV | | TYGACPRYV | | VSHCRATEYI | | YVKQGSLMLAT | |
| TYGAGSWPD | | TYGAGSWPD | | VSHCRATEYM | | YVKQGSLRLAT | |
| TYGKGSWPD | | TYGKGSWPD | | VSIDRFLRVK | | YVKQKTLKLAT | |
| TYGPCPRYV | | TYGPCPRYV | | VSIDRFLRVR | | YVKQNTLKLAT | |
| TYGSGSWPD | | TYGSGSWPD | | VSIGTSTLNQ | | YVKQSSLPLAL | |
| TYGTGSWAD | | TYGTGSWAD | | VSKDNGIRIG | | YVKQSTLKLAT | |
| TYGTGSWPD | | TYGTGSWPD | | VSKDNGIRVG | | YVKSDRLVLAT | |
| TYGTGTWPD | | TYGTGTWPD | | VSLGAISFWM | | YVKSEKLVLAT | |
| TYHNSFVPV | | TYHNSFVPV | | VSLGAVSFWM | | YVKSERLVLAT | |
| TYINNATII | | TYINNATII | | VSLLQSAILS | | YVKSKRLVLAT | |
| TYINNTTII | | TYINNTTII | | VSLSPGMMMG | | YVLSIIPSGPL | |
| TYISIGTST | | TYISIGTST | | VSLSYSTGAL | | YVLSIVPSGPL | |
| TYISVGTST | | TYISVGTST | | VSMCSSTEFL | | YVLSVIPSGPL | |
| TYIWTYQAE | | TYIWTYQAE | | VSMEFSLTDP | | YVNKNPYTLVS | |
| TYKILSIYS | | TYKILSIYS | | VSNDNWSGYS | | YVNTALLNASC | |
| TYKILTIYS | | TYKILTIYS | | VSNGTKINTL | | YVQMCTELKLN | |
| TYNAELFVL | | TYNAELFVL | | VSNGTKVNTL | | YVQMCTELKLS | |
| TYNAELLIL | | TYNAELLIL | | VSNNDWSGYS | | YVRLYLWGVHH | |
| TYNAELLVA | | TYNAELLVA | | VSNSDFICVG | | YVRQNTLKLAT | |
| TYNAELLVL | | TYNAELLVL | | VSNSDFLCVG | | YVRSEKLVLAT | |
| TYNAEVLVL | | TYNAEVLVL | | VSNSDFMCVG | | YVRTNGTSKIK | |
| TYNGIRTNG | | TYNGIRTNG | | VSNSDWSGYS | | YVRTNGTSKVK | |
| TYNHEDYKE | | TYNHEDYKE | | VSNSEFLCVG | | YVSCDPDECRF | |
| TYNHEDYRE | | TYNHEDYRE | | VSNTDWSGYS | | YVSCDPDGCRF | |
| TYNHKDYEE | | TYNHKDYEE | | VSPIHLGDCS | | YVSCDPLGCKM | |
| TYNHKEYEE | | TYNHKEYEE | | VSPLAVTWWN | | YVSCDPLGCKT | |
| TYNHTEYRQ | | TYNHTEYRQ | | VSPLSGSAQH | | YVSCDPLGCRM | |
| TYNHTQYRE | | TYNHTQYRE | | VSPVHLGDCN | | YVSCDPNECRF | |
| TYNKTVINN | | TYNKTVINN | | VSPVHLGDCR | | YVSCDPSGCKM | |
| TYNNTTGRD | | TYNNTTGRD | | VSPVHLGDCS | | YVSCDPTGCKM | |
| TYNNTVINN | | TYNNTVINN | | VSRARIDARI | | YVSCEPDECRF | |
| TYNNTVVNN | | TYNNTVVNN | | VSRARIDARV | | YVSMEFSLTDP | |
| TYNRKEYEE | | TYNRKEYEE | | VSRIAIGNCP | | YVWWASNSLIA | |
| TYNSTVVNN | | TYNSTVVNN | | VSRTHQYSEK | | YVWWTSNSLIA | |
| TYNTELLVL | | TYNTELLVL | | VSSEAPGWSW | | YVWWTSNSLVA | |
| TYNVELLVL | | TYNVELLVL | | VSSEVPGCTM | | YWAEGDCYRAC | |
| TYNYPKYEE | | TYNYPKYEE | | VSSEVPGWSW | | YWAEGECYRAC | |
| TYNYPKYSE | | TYNYPKYSE | | VSSFEKFEIF | | YWAILKPGQTV | |

Fig. 83-410

| Block size 8 | SIN | Block size 9 | SIN | Block size 10 | SIN | Block size 11 | SIN |
|---|---|---|---|---|---|---|---|
| TYQAELLIA | | TYQAELLIA | | VSSFERFEIF | | YWAIRTRSGGN | |
| TYQAELLVA | | TYQAELLVA | | VSSFERFEMF | | YWAKEECYRAC | |
| TYQILSIYS | | TYQILSIYS | | VSSFKRFEIF | | YWAKGDCYRAC | |
| TYQILSVYS | | TYQILSVYS | | VSSFYSEMKW | | YWAKGECYRAC | |
| TYQKRMGVQ | | TYQKRMGVQ | | VSSGLVLVGL | | YWAVLKPGQTV | |
| TYQNNFVPV | | TYQNNFVPV | | VSSLPFQNIN | | YWGILKRGETL | |
| TYQNSFVPV | | TYQNSFVPV | | VSSLPFQNIS | | YWHLMHPGERI | |
| TYQRTRALV | | TYQRTRALV | | VSSLPFQSIN | | YWHLMRPGERI | |
| TYQWIIKNW | | TYQWIIKNW | | VSSSGTSKAC | | YWHLMRPGERT | |
| TYQWIIRNW | | TYQWIIRNW | | VSSSLVLAGL | | YWHLMSPGERI | |
| TYQWVIRNW | | TYQWVIRNW | | VSSSLVLVGL | | YWTLVNPGDSI | |
| TYRCHKGDT | | TYRCHKGDT | | VSSWHILSKD | | YWVMTDGPANK | |
| TYRCHRGDM | | TYRCHRGDM | | VSTDKDSNGV | | YWVMTDGPANN | |
| TYRCHRGDT | | TYRCHRGDT | | VSTDKNSNGV | | YWVMTDGPANS | |
| TYREEAMQN | | TYREEAMQN | | VSTKEWSKRY | | YWVMTDGPASN | |
| TYRILSIYS | | TYRILSIYS | | VSTKEWSRRY | | YWWDGLQSSDD | |
| TYRNNRKEP | | TYRNNRKEP | | VSTNAYDRIC | | YYDRRLTTTIK | |
| TYRNTRKEP | | TYRNTRKEP | | VSTQKAINEI | | YYEECSCYPDA | |
| TYSEIRTNG | | TYSEIRTNG | | VSTQKALNEI | | YYFVKEGKIVH | |
| TYSGIRTDG | | TYSGIRTDG | | VSTRSDQISI | | YYLEKANKIKS | |
| TYSGIRTNG | | TYSGIRTNG | | VSVGSGSFPD | | YYLEKANKIKT | |
| TYSSPMMWE | | TYSSPMMWE | | VSVGTSTLNQ | | YYLEKASKIKS | |
| TYSSSLMWE | | TYSSSLMWE | | VSVIREPFIS | | YYMEKANKIKS | |
| TYSSSMMWE | | TYSSSMMWE | | VSVRGSGMRI | | YYNETFVNITN | |
| TYTGAINSS | | TYTGAINSS | | VSVTDGPAAN | | YYNETFVNVTH | |
| TYTGISKAC | | TYTGISKAC | | VSWASNSIVT | | YYNETFVNVTN | |
| TYTGTSKAC | | TYTGTSKAC | | VSWEMGQAPS | | YYNGRLTTTIK | |
| TYTGTSRAC | | TYTGTSRAC | | VSWPLSSPPT | | YYNGRSSFFRN | |
| TYTGVRTDG | | TYTGVRTDG | | VSWSQNILRT | | YYNRRLTTTIK | |
| TYTGVRTNG | | TYTGVRTNG | | VSWTGNSIVT | | YYNRRPTTTIK | |
| TYVDGFEPN | | TYVDGFEPN | | VSWTSNSIVT | | YYPKYEEESKL | |
| TYVLSIIPS | | TYVLSIIPS | | VSWTSNSMVT | | YYWAILKPGQT | |
| TYVLSIVPS | | TYVLSIVPS | | VSYCRATEYI | | YYWAVLKPGQT | |
| TYVLSVIPS | | TYVLSVIPS | | VTADKDSNGV | | YYWGILKRGET | |
| TYVNNTTII | | TYVNNTTII | | VTASCLDKGA | | YYYEECSCYPD | |
| TYVNNTTVI | | TYVNNTTVI | | VTASCLDRGA | | YYYPKYEEESK | |
| TYVSIGTST | | TYVSIGTST | | VTASCLDRGT | | | |
| TYVSVGTST | | TYVSVGTST | | VTASCRDNGA | | | |
| TYWWDGLQS | | TYWWDGLQS | | VTCGCRDNWQ | | | |
| TYYYPKYEE | | TYYYPKYEE | | VTCTCRDNWQ | | | |
| VAAQELVES | | VAAQELVES | | VTCVCRDNWK | | | |
| VAASLCLAI | | VAASLCLAI | | VTCVCRDNWQ | | | |
| VAASLCLAV | | VAASLCLAV | | VTCVCRDNWR | | | |
| VACGPAECR | | VACGPAECR | | VTDGPAANNA | | | |
| VACGPSECR | | VACGPSECR | | VTDGPAANSA | | | |
| VACGPTECR | | VACGPTECR | | VTDGPSDAQA | | | |
| VACSPSECR | | VACSPSECR | | VTDIWAYNAE | | | |
| VADGGPNLY | | VADGGPNLY | | VTDIWSYNAK | | | |
| VADRDSTQK | | VADRDSTQK | | VTDIWSYNAR | | | |
| VADSEMNKL | | VADSEMNKL | | VTDSEMDKLF | | | |
| VAEGWINSP | | VAEGWINSP | | VTDSEMNKLF | | | |
| VAEINTWAR | | VAEINTWAR | | VTDSEMNRLF | | | |
| VAFCGTSGT | | VAFCGTSGT | | VTDSEMSKLF | | | |
| VAGGLILGM | | VAGGLILGM | | VTDSIKSWRK | | | |
| VAGLSFWMC | | VAGLSFWMC | | VTDVWSYNAK | | | |
| VAGLSLWMC | | VAGLSLWMC | | VTEINTWARN | | | |
| VAGSLSLAI | | VAGSLSLAI | | VTELWSYNAE | | | |
| VAGSSEQAA | | VAGSSEQAA | | VTETLYLNHT | | | |
| VAGWILGNP | | VAGWILGNP | | VTFCGLDNEP | | | |
| VAGWLLGNP | | VAGWLLGNP | | VTFCGLNNEP | | | |
| VAGWYGFQH | | VAGWYGFQH | | VTFIFNGAFI | | | |
| VAHKSCLPA | | VAHKSCLPA | | VTFSFNGAFI | | | |

Fig. 83-411

| Block size 8 | SIN | Block size 9 | SIN | Block size 10 | SIN | Block size 11 | SIN |
|---|---|---|---|---|---|---|---|
| VAIALSILN | | VAIALSILN | | VTFTFNGAFI | | | |
| VAIALSVLN | | VAIALSVLN | | VTGDDKNATA | | | |
| VAIENQHTI | | VAIENQHTI | | VTGDDRNATA | | | |
| VAKAGFIEN | | VAKAGFIEN | | VTGFAPFSKD | | | |
| VAKDNAIRF | | VAKDNAIRF | | VTGKLNRLIE | | | |
| VAKDNAVRF | | VAKDNAVRF | | VTGKSHGRIL | | | |
| VAKGSYNNT | | VAKGSYNNT | | VTGLRNIPSI | | | |
| VAKRSYNNT | | VAKRSYNNT | | VTGLRNVPSI | | | |
| VALALSHTA | | VALALSHTA | | VTGYEKNATA | | | |
| VALCGSKEQ | | VALCGSKEQ | | VTHAKDILEK | | | |
| VALCGSKER | | VALCGSKER | | VTHAKDILER | | | |
| VALCGSPIS | | VALCGSPIS | | VTHAKNILEK | | | |
| VALCGSPVP | | VALCGSPVP | | VTHAQDILEK | | | |
| VALCGSPVS | | VALCGSPVS | | VTHAQDILER | | | |
| VALCGSRER | | VALCGSRER | | VTHAQDLLEK | | | |
| VALENQHTI | | VALENQHTI | | VTHAQNILEK | | | |
| VALENQNTI | | VALENQNTI | | VTHFEKIKIL | | | |
| VALGYSTGA | | VALGYSTGA | | VTHFEKVKIL | | | |
| VALILGFVL | | VALILGFVL | | VTHFQRKRRV | | | |
| VALSYSAGA | | VALSYSAGA | | VTHSIELLEN | | | |
| VALSYSTGA | | VALSYSTGA | | VTHSIELLES | | | |
| VAMENQHTI | | VAMENQHTI | | VTHSVELLED | | | |
| VAMVFSQED | | VAMVFSQED | | VTHSVELLEN | | | |
| VAMVFSQEE | | VAMVFSQEE | | VTHSVELLES | | | |
| VANFSMELP | | VANFSMELP | | VTHTGTSKAC | | | |
| VANGTIVKT | | VANGTIVKT | | VTHVQNNYTT | | | |
| VANGTKVNT | | VANGTKVNT | | VTIGECPKYV | | | |
| VANGTMVKT | | VANGTMVKT | | VTIGKCPKYV | | | |
| VANLGLNIG | | VANLGLNIG | | VTKENTGSYV | | | |
| VAPDRVSFF | | VAPDRVSFF | | VTLHFKQHDC | | | |
| VAPEYGFKI | | VAPEYGFKI | | VTLHFKQHEC | | | |
| VAPIMFSNK | | VAPIMFSNK | | VTLHFKQHKC | | | |
| VAPRGHYKL | | VAPRGHYKL | | VTLHFKQNEC | | | |
| VAPSPSNSR | | VAPSPSNSR | | VTLSSGYKDI | | | |
| VAPSPYNSR | | VAPSPYNSR | | VTLTMGYKDI | | | |
| VAPSRVSKL | | VAPSRVSKL | | VTNATELVQG | | | |
| VAPVLGNYK | | VAPVLGNYK | | VTNATELVQI | | | |
| VAQGSYNNT | | VAQGSYNNT | | VTNATELVQN | | | |
| VARCNTKCQ | | VARCNTKCQ | | VTNATELVQS | | | |
| VAREPYVSC | | VAREPYVSC | | VTNATETVEN | | | |
| VARGSYNNT | | VARGSYNNT | | VTNATETVES | | | |
| VARLGKGYM | | VARLGKGYM | | VTNKVNSIID | | | |
| VASMRRNYF | | VASMRRNYF | | VTNKVNSIIG | | | |
| VASSGNLEF | | VASSGNLEF | | VTNKVNSIIN | | | |
| VASSGTLEF | | VASSGTLEF | | VTNVQNDYTT | | | |
| VASSGTVEF | | VASSGTVEF | | VTNVQNNYTT | | | |
| VASSLALAI | | VASSLALAI | | VTQAMELVEA | | | |
| VASSLTLAI | | VASSLTLAI | | VTQTLVSNND | | | |
| VASSLVLAI | | VASSLVLAI | | VTQTMELVEA | | | |
| VASSLVLLF | | VASSLVLLF | | VTQTMELVET | | | |
| VASSLVLLL | | VASSLVLLL | | VTQVEELVHG | | | |
| VATGRVTVS | | VATGRVTVS | | VTQVEELVHR | | | |
| VATTHSWIP | | VATTHSWIP | | VTRELYVSCD | | | |
| VATTHSWTP | | VATTHSWTP | | VTREPYISCD | | | |
| VATTHSWVP | | VATTHSWVP | | VTREPYLSCD | | | |
| VAVAKDNAI | | VAVAKDNAI | | VTREPYLSCG | | | |
| VAVENQHTI | | VAVENQHTI | | VTREPYVSCD | | | |
| VAVIKYNGI | | VAVIKYNGI | | VTREPYVSCE | | | |
| VAVLKYKGI | | VAVLKYKGI | | VTREPYVSCG | | | |
| VAVLKYNDI | | VAVLKYNDI | | VTREPYVSCS | | | |
| VAVLKYNGI | | VAVLKYNGI | | VTRREIHIYY | | | |
| VAVLKYNGV | | VAVLKYNGV | | VTRREVHIYY | | | |

Fig. 83-412

| Block size 8 | SIN | Block size 9 | SIN | Block size 10 | SIN | Block size 11 | SIN |
|---|---|---|---|---|---|---|---|
| VAVTDGPAA | | VAVTDGPAA | | VTRREVHMYY | | | |
| VAWSASACH | | VAWSASACH | | VTRREVHTYY | | | |
| VAWSATACH | | VAWSATACH | | VTRREVHVYY | | | |
| VAWSATACS | | VAWSATACS | | VTRSGTSKAC | | | |
| VAWSSSSCF | | VAWSSSSCF | | VTSSGTSKAC | | | |
| VAWSSSSCH | | VAWSSSSCH | | VTSSIDLIET | | | |
| VAWSSTSCF | | VAWSSTSCF | | VTSSIDLVET | | | |
| VAYDKICIG | | VAYDKICIG | | VTSSIELVEN | | | |
| VAYERMCNI | | VAYERMCNI | | VTSSVDLIET | | | |
| VAYMLEREL | | VAYMLEREL | | VTSSVDLVET | | | |
| VCAAWSSSS | | VCAAWSSSS | | VTSSVELVEN | | | |
| VCATCEQIA | | VCATCEQIA | | VTSSVELVET | | | |
| VCFMYSDFH | | VCFMYSDFH | | VTSTIDLIET | | | |
| VCHKGICPV | | VCHKGICPV | | VTTHFHRKRR | | | |
| VCHKGVCPV | | VCHKGVCPV | | VTTHFQRKRR | | | |
| VCHNGICPV | | VCHNGICPV | | VTTNTINRIF | | | |
| VCHNGTCAV | | VCHNGTCAV | | VTTNTINRNF | | | |
| VCHNGTCVV | | VCHNGTCVV | | VTTNTINRSF | | | |
| VCHNGVCPV | | VCHNGVCPV | | VTTRQASPSC | | | |
| VCHNSTCVV | | VCHNSTCVV | | VTTVGWSWPD | | | |
| VCHSGICPV | | VCHSGICPV | | VTTVTLHFKQ | | | |
| VCHSGVCPV | | VCHSGVCPV | | VTVIKNNMIN | | | |
| VCIAWSSAS | | VCIAWSSAS | | VTVIKNNMVN | | | |
| VCIAWSSSS | | VCIAWSSSS | | VTVIRNNMIN | | | |
| VCINGICTV | | VCINGICTV | | VTVSTRSDQI | | | |
| VCINGSCAV | | VCINGSCAV | | VTVTDGPAAN | | | |
| VCINGSCIV | | VCINGSCIV | | VTVTHAKDIL | | | |
| VCINGSCTV | | VCINGSCTV | | VTVTHAKNIL | | | |
| VCINGTCAV | | VCINGTCAV | | VTVTHAQDIL | | | |
| VCINGTCTV | | VCINGTCTV | | VTVTHAQDLL | | | |
| VCISGPNNN | | VCISGPNNN | | VTVTHAQNIL | | | |
| VCISGTCAV | | VCISGTCAV | | VTVTHAVNLL | | | |
| VCITGDDRN | | VCITGDDRN | | VTVTHSIELL | | | |
| VCLKWDLMD | | VCLKWDLMD | | VTVTHSINLL | | | |
| VCLKWELMD | | VCLKWELMD | | VTVTHSVDLL | | | |
| VCMAWSSSS | | VCMAWSSSS | | VTVTHSVELL | | | |
| VCMESVRNG | | VCMESVRNG | | VTVTHSVNIL | | | |
| VCMSGPNNN | | VCMSGPNNN | | VTVTHSVNLF | | | |
| VCPVVFTDG | | VCPVVFTDG | | VTVTHSVNLL | | | |
| VCPVVMTDG | | VCPVVMTDG | | VTVTSSIELV | | | |
| VCQDEFCYT | | VCQDEFCYT | | VTVTSSVELV | | | |
| VCRALLAKS | | VCRALLAKS | | VTYNNTVINN | | | |
| VCRDNWHAS | | VCRDNWHAS | | VTYQILSIYS | | | |
| VCRDNWHGS | | VCRDNWHGS | | VTYTGISKAC | | | |
| VCRDNWKGA | | VCRDNWKGA | | VTYTGTSKAC | | | |
| VCRDNWKGS | | VCRDNWKGS | | VTYTGTSRAC | | | |
| VCRDNWMGS | | VCRDNWMGS | | VVAAQELVES | | | |
| VCRDNWNGM | | VCRDNWNGM | | VVAKDNAIRF | | | |
| VCRDNWQGA | | VCRDNWQGA | | VVAMVFSQED | | | |
| VCRDNWRGS | | VCRDNWRGS | | VVAVTDGPAA | | | |
| VCRDNWTGT | | VCRDNWTGT | | VVAVTDGPAD | | | |
| VCRTLLAKS | | VCRTLLAKS | | VVCVCRDNWH | | | |
| VCSGIFGDN | | VCSGIFGDN | | VVDATETVER | | | |
| VCSGLVGDT | | VCSGLVGDT | | VVEKMNTQFT | | | |
| VCSGVFGDN | | VCSGVFGDN | | VVENKYVNNT | | | |
| VCSKFHSDT | | VCSKFHSDT | | VVENTYVNNT | | | |
| VCSNGSCRC | | VCSNGSCRC | | VVFCGASGTY | | | |
| VCTGILTDT | | VCTGILTDT | | VVFCGTPGTY | | | |
| VCTGVLTDT | | VCTGVLTDT | | VVFCGTSATY | | | |
| VCTKGKKAV | | VCTKGKKAV | | VVFCGTSGIY | | | |
| VCVAWSSSS | | VCVAWSSSS | | VVFCGTSGTC | | | |
| VCVCRDNWH | | VCVCRDNWH | | VVFCGTSGTY | | | |

Fig. 83-413

| Block size 8 | SIN | Block size 9 | SIN | Block size 10 | SIN | Block size 11 | SIN |
|---|---|---|---|---|---|---|---|
| VCVSLLQSA | | VCVSLLQSA | | VVFPNEVGAK | | | |
| VCVTGDDGN | | VCVTGDDGN | | VVFPNEVGAR | | | |
| VCVTGDDKN | | VCVTGDDKN | | VVFTDGSATG | | | |
| VCVTGDDRN | | VCVTGDDRN | | VVGARPQVNG | | | |
| VCWDNWRGS | | VCWDNWRGS | | VVGDRPLVNG | | | |
| VCWSFALAQ | | VCWSFALAQ | | VVHISPLSGS | | | |
| VCYNPCFYV | | VCYNPCFYV | | VVIAKDNAIR | | | |
| VCYPGKFAN | | VCYPGKFAN | | VVIAKDNAVR | | | |
| VCYPGKFSN | | VCYPGKFSN | | VVIAQDNAIR | | | |
| VCYPGKFTN | | VCYPGKFTN | | VVIEKDNAVR | | | |
| VCYPGKFVN | | VCYPGKFVN | | VVIMTDGPAN | | | |
| VCYPGSIEN | | VCYPGSIEN | | VVIMTDGPAS | | | |
| VCYPGSIKN | | VCYPGSIKN | | VVIMTDGSAS | | | |
| VDALLGDPH | | VDALLGDPH | | VVITDGSASG | | | |
| VDATETVER | | VDATETVER | | VVLNTDWSGY | | | |
| VDCFIWHIR | | VDCFIWHIR | | VVLVGLILAF | | | |
| VDCFLWHIR | | VDCFLWHIR | | VVLVMKRKRD | | | |
| VDCFLWHVR | | VDCFLWHVR | | VVLVMKRKRN | | | |
| VDCFLWYVR | | VDCFLWYVR | | VVMTDGNASG | | | |
| VDCYLWHIR | | VDCYLWHIR | | VVMTDGPANN | | | |
| VDDAVTDIW | | VDDAVTDIW | | VVMTDGPASS | | | |
| VDDAVTDVW | | VDDAVTDVW | | VVMTDGSALG | | | |
| VDEGNGCFE | | VDEGNGCFE | | VVMTDGSASD | | | |
| VDEYSNAEK | | VDEYSNAEK | | VVMTDGSASE | | | |
| VDEYSNAER | | VDEYSNAER | | VVMTDGSASG | | | |
| VDEYSSAER | | VDEYSSAER | | VVMTDGSASR | | | |
| VDEYSSTEK | | VDEYSSTEK | | VVMTDGSASS | | | |
| VDEYSSTER | | VDEYSSTER | | VVMTDGSVSG | | | |
| VDGFEPNGC | | VDGFEPNGC | | VVNATETVEI | | | |
| VDGFEPNGY | | VDGFEPNGY | | VVNATETVEN | | | |
| VDGFKPNGC | | VDGFKPNGC | | VVNATETVEQ | | | |
| VDGQDCDLI | | VDGQDCDLI | | VVNATETVER | | | |
| VDGQSGRID | | VDGQSGRID | | VVNATETVET | | | |
| VDGSSSACL | | VDGSSSACL | | VVNFLSMEFS | | | |
| VDGTIAGFI | | VDGTIAGFI | | VVNFVSMEFS | | | |
| VDGWYGFHH | | VDGWYGFHH | | VVNIDRFLRV | | | |
| VDGWYGFRH | | VDGWYGFRH | | VVNITTTII | | | |
| VDGWYGFRY | | VDGWYGFRY | | VVNNITTTIV | | | |
| VDGWYGYHH | | VDGWYGYHH | | VVNTALSTIA | | | |
| VDHMAIIKK | | VDHMAIIKK | | VVNTTLSTIA | | | |
| VDICKAAIG | | VDICKAAIG | | VVNYVSMEFS | | | |
| VDICKAALG | | VDICKAALG | | VVPEYGFKIS | | | |
| VDICKAAMG | | VDICKAAMG | | VVRARPQVNG | | | |
| VDINPGHAD | | VDINPGHAD | | VVREPFISCS | | | |
| VDINPGHSD | | VDINPGHSD | | VVRKMMTNSQ | | | |
| VDKLTQGRQ | | VDKLTQGRQ | | VVRKMMTNSR | | | |
| VDKMNREFE | | VDKMNREFE | | VVRKMMTSSQ | | | |
| VDKMNREFG | | VDKMNREFG | | VVRSWKKQIL | | | |
| VDLGQCGLL | | VDLGQCGLL | | VVRSWRKKIL | | | |
| VDLGSCGIL | | VDLGSCGIL | | VVRSWRKQIL | | | |
| VDLVETNHT | | VDLVETNHT | | VVRSWRRQIL | | | |
| VDLWSYNAE | | VDLWSYNAE | | VVSAKELVET | | | |
| VDMNPGHAD | | VDMNPGHAD | | VVSIDRFLRV | | | |
| VDNHSMSDI | | VDNHSMSDI | | VVSLGAISFW | | | |
| VDNKNWSGY | | VDNKNWSGY | | VVTAQELVEA | | | |
| VDNNGELRH | | VDNNGELRH | | VVTAQELVES | | | |
| VDNNNWFGY | | VDNNNWFGY | | VVTREPYVSC | | | |
| VDNNNWSGY | | VDNNNWSGY | | VVTVTDGPAA | | | |
| VDNNSWSGY | | VDNNSWSGY | | VVVAKDNAIR | | | |
| VDNSNWSGY | | VDNSNWSGY | | VVVAKDNAVR | | | |
| VDQITGKLN | | VDQITGKLN | | VVVFCGTSGT | | | |
| VDQSLIIAA | | VDQSLIIAA | | VVVMTDGPAN | | | |

Fig. 83-414

| Block size 8 | SIN | Block size 9 | SIN | Block size 10 | SIN | Block size 11 | SIN |
|---|---|---|---|---|---|---|---|
| VDQSLVIAA | | VDQSLVIAA | | VVVMTDGSAS | | | |
| VDQVRESRN | | VDQVRESRN | | VVYAELLVAM | | | |
| VDRFYRICK | | VDRFYRICK | | VWACQRGNIR | | | |
| VDRFYRTCK | | VDRFYRTCK | | VWAYNAELLV | | | |
| VDRLTQGRQ | | VDRLTQGRQ | | VWDANGWVST | | | |
| VDSIGSWSQ | | VDSIGSWSQ | | VWDDNGWVST | | | |
| VDSIVSWSQ | | VDSIVSWSQ | | VWGVHHSSSL | | | |
| VDTCYPFDV | | VDTCYPFDV | | VWIGRTKSLE | | | |
| VDTGDGCFE | | VDTGDGCFE | | VWLENEKTLD | | | |
| VDTGNGCFD | | VDTGNGCFD | | VWLGRTVSIN | | | |
| VDTIIENNV | | VDTIIENNV | | VWLGRTVSIS | | | |
| VDTIIESNI | | VDTIIESNI | | VWLGRTVSNS | | | |
| VDTIIESNV | | VDTIIESNV | | VWLGRTVSTS | | | |
| VDTILEKNI | | VDTILEKNI | | VWLWLVLREK | | | |
| VDTILEKNV | | VDTILEKNV | | VWMACHSAAF | | | |
| VDTILERNV | | VDTILERNV | | VWMACNSAAF | | | |
| VDTIMEKIV | | VDTIMEKIV | | VWMGRTISKD | | | |
| VDTIMEKNV | | VDTIMEKNV | | VWMGRTISMD | | | |
| VDTIMERNV | | VDTIMERNV | | VWMGRTISRD | | | |
| VDTIREKNV | | VDTIREKNV | | VWSYNAELLI | | | |
| VDTLLEKNV | | VDTLLEKNV | | VWSYNAELLV | | | |
| VDTLLENDV | | VDTLLENDV | | VWSYNAKLLV | | | |
| VDTLLENGV | | VDTLLENGV | | VWTSGSIISF | | | |
| VDTLLENNV | | VDTLLENNV | | VWTSGSSISF | | | |
| VDTLLESDV | | VDTLLESDV | | VWTYNAEILV | | | |
| VDTLTEKGI | | VDTLTEKGI | | VWTYNAELFV | | | |
| VDTLTENGV | | VDTLTENGV | | VWTYNAELLI | | | |
| VDTLTETGV | | VDTLTETGV | | VWTYNAELLV | | | |
| VDTNLERNV | | VDTNLERNV | | VWTYNAEVLV | | | |
| VDTNPGHAD | | VDTNPGHAD | | VWTYNTELLV | | | |
| VDTVLEKNV | | VDTVLEKNV | | VWTYNVELLV | | | |
| VDTVLERNV | | VDTVLERNV | | VWTREPYVS | | | |
| VDTVREKNV | | VDTVREKNV | | VWWASNSLIA | | | |
| VDVNPGHAD | | VDVNPGHAD | | VWWTSNSIAV | | | |
| VDVYCICRD | | VDVYCICRD | | VWWTSNSIIS | | | |
| VEAESSVKE | | VEAESSVKE | | VWWTSNSIIV | | | |
| VEALARSIC | | VEALARSIC | | VWWTSNSIVA | | | |
| VEAMISRAR | | VEAMISRAR | | VWWTSNSIVS | | | |
| VEAMMSRAR | | VEAMMSRAR | | VWWTSNSIVV | | | |
| VEAMVSRAR | | VEAMVSRAR | | VWWTSNSLIA | | | |
| VEAVIYGNP | | VEAVIYGNP | | VWWTSNSLVA | | | |
| VECICRDNW | | VECICRDNW | | VWWTSNSVVV | | | |
| VECIGWSST | | VECIGWSST | | VWWTSTSIVV | | | |
| VECVCRDNW | | VECVCRDNW | | VWWTTNSIVV | | | |
| VECVGWSST | | VECVGWSST | | VYAELLVAME | | | |
| VEDGFLDVW | | VEDGFLDVW | | VYCICRDNWK | | | |
| VEDGSIGKV | | VEDGSIGKV | | VYCVCRDNWK | | | |
| VEDTKIDLW | | VEDTKIDLW | | VYIEVLHLTQ | | | |
| VEDTKVDLW | | VEDTKVDLW | | VYINTALLNA | | | |
| VEECLINDP | | VEECLINDP | | VYINTALLNS | | | |
| VEECSCYPQ | | VEECSCYPQ | | VYINTAMLNA | | | |
| VEECSCYPR | | VEECSCYPR | | VYKALSIYSC | | | |
| VEECSCYPS | | VEECSCYPS | | VYKILSIYSC | | | |
| VEEGSIGKV | | VEEGSIGKV | | VYKVLAIYSC | | | |
| VEELVHGGI | | VEELVHGGI | | VYKVLSIYSC | | | |
| VEELVHGGV | | VEELVHGGV | | VYMNTALLNA | | | |
| VEELVHGQV | | VEELVHGQV | | VYNNTTGRDV | | | |
| VEELVHRGI | | VEELVHRGI | | VYQAKFEAVA | | | |
| VEESSIGKV | | VEESSIGKV | | VYQAKFESVA | | | |
| VEFCGTSGT | | VEFCGTSGT | | VYQARFEAVA | | | |
| VEFEPFQSL | | VEFEPFQSL | | VYQARFESVA | | | |
| VEGLIYGNP | | VEGLIYGNP | | VYQILAIYAT | | | |

Fig. 83-415

| Block size 8 | SIN | Block size 9 | SIN | Block size 10 | SIN | Block size 11 | SIN |
|---|---|---|---|---|---|---|---|
| VEGLVYGNP | | VEGLVYGNP | | VYQILAIYST | | | |
| VEGRIQDLE | | VEGRIQDLE | | VYQILSIYST | | | |
| VEGRIQYLE | | VEGRIQYLE | | VYQILVIYAT | | | |
| VEGRTQDLE | | VEGRTQDLE | | VYQSRFEAVA | | | |
| VEGWVVIAK | | VEGWVVIAK | | VYRALSIYSC | | | |
| VEGWVVIAQ | | VEGWVVIAQ | | VYRDNWKGSN | | | |
| VEGWVVIEK | | VEGWVVIEK | | VYVDGFEPNG | | | |
| VEGWVVVAK | | VEGWVVVAK | | VYVEVLHLTQ | | | |
| VEIGVTRRE | | VEIGVTRRE | | VYVNTALLNA | | | |
| VEIRINMIN | | VEIRINMIN | | VYWTIVKPGD | | | |
| VEITGIDKV | | VEITGIDKV | | VYWTVVKPGD | | | |
| VEITGINKV | | VEITGINKV | | VYWWDGLQSS | | | |
| VEKEFSNLE | | VEKEFSNLE | | VYYDRRLTTT | | | |
| VEKQIGNVI | | VEKQIGNVI | | VYYNGRLTTT | | | |
| VEKQLGNVI | | VEKQLGNVI | | VYYNKRLTTT | | | |
| VEKRINMIA | | VEKRINMIA | | VYYNRRLTTT | | | |
| VEKRINMLA | | VEKRINMLA | | VYYNRRPTTT | | | |
| VEKTNEKFH | | VEKTNEKFH | | WACGNGSCRC | | | |
| VELAEKAMK | | VELAEKAMK | | WACNNGSCRC | | | |
| VELAEKTMK | | VELAEKTMK | | WACNSGNCRF | | | |
| VELAERAMK | | VELAERAMK | | WACQKGNIKC | | | |
| VELDEIGED | | VELDEIGED | | WACQKGNIRC | | | |
| VELIRGMPK | | VELIRGMPK | | WACQNGNIRC | | | |
| VELIRGMPQ | | VELIRGMPQ | | WACQNGNIRW | | | |
| VELIRGQPK | | VELIRGQPK | | WACQNGNLRC | | | |
| VELIRGRKQ | | VELIRGRKQ | | WACQNGNVRC | | | |
| VELIRGRLN | | VELIRGRLN | | WACQRGNIRC | | | |
| VELIRGRPE | | VELIRGRPE | | WACSNGNCRF | | | |
| VELIRGRPG | | VELIRGRPG | | WACSNGSCRC | | | |
| VELIRGRPI | | VELIRGRPI | | WACSNGSCRF | | | |
| VELIRGRPK | | VELIRGRPK | | WACSSGNCRF | | | |
| VELIRGRPN | | VELIRGRPN | | WAEGDCYRAC | | | |
| VELIRGRPQ | | VELIRGRPQ | | WAEGECYRAC | | | |
| VELIRGRPR | | VELIRGRPR | | WAGKILRTQE | | | |
| VELIRGRQQ | | VELIRGRQQ | | WAGNILRTQE | | | |
| VELIRGRRQ | | VELIRGRRQ | | WAIHHPPTSA | | | |
| VELIRGRSQ | | VELIRGRSQ | | WAIHHPPTSD | | | |
| VELLVLMEN | | VELLVLMEN | | WAIHHPPTSN | | | |
| VELSSGYKD | | VELSSGYKD | | WAIHHPPTTD | | | |
| VELSSMGVY | | VELSSMGVY | | WAILKPGQTV | | | |
| VELVRGRPK | | VELVRGRPK | | WAIRTRSGGN | | | |
| VEMIRGEPE | | VEMIRGEPE | | WAKEECYRAC | | | |
| VEMIRGKPE | | VEMIRGKPE | | WAKGDCYRAC | | | |
| VEMIRGQPK | | VEMIRGQPK | | WAKGECYRAC | | | |
| VEMIRGRPE | | VEMIRGRPE | | WAKNILRTQE | | | |
| VENEIRTFS | | VENEIRTFS | | WALGENMAPE | | | |
| VENGTSVKT | | VENGTSVKT | | WAPLSKDNGI | | | |
| VENLEELRF | | VENLEELRF | | WARNILRTQD | | | |
| VENLFDEVR | | VENLFDEVR | | WARNILRTQE | | | |
| VENQEELRS | | VENQEELRS | | WASGSSISFC | | | |
| VENQHTIDL | | VENQHTIDL | | WASNSIVTFC | | | |
| VENRINMLA | | VENRINMLA | | WASNSLIALC | | | |
| VENTYVNNT | | VENTYVNNT | | WAVGRCPRYV | | | |
| VEPKGLFGA | | VEPKGLFGA | | WAVLKPGQTV | | | |
| VEPRGLFGA | | VEPRGLFGA | | WAYNAELIVL | | | |
| VEQEIRAFS | | VEQEIRAFS | | WAYNAELLVL | | | |
| VEQEIRTFS | | VEQEIRTFS | | WCGMIDWYG | | | |
| VEQEMRTFS | | VEQEMRTFS | | WCKIVTTVGW | | | |
| VEQQIGNVI | | VEQQIGNVI | | WDANGWVSTD | | | |
| VEQRINMLA | | VEQRINMLA | | WDANGWVTAD | | | |
| VERGLFGAI | | VERGLFGAI | | WDDGAILPFD | | | |
| VERILEEES | | VERILEEES | | WDDGAILPLT | | | |

Fig. 83-416

| Block size 8 | SIN | Block size 9 | SIN | Block size 10 | SIN | Block size 11 | SIN |
|---|---|---|---|---|---|---|---|
| VERMVLSAF | | VERMVLSAF | | WDGLQSSDDF | | | |
| VERPKEIEG | | VERPKEIEG | | WDSFRQSERG | | | |
| VERPKEMEG | | VERPKEMEG | | WDTINFESTG | | | |
| VERPSAPEG | | VERPSAPEG | | WDTISFESTG | | | |
| VERQIGNVI | | VERQIGNVI | | WDTLIERDNA | | | |
| VERRINMLA | | VERRINMLA | | WDTLIERDNS | | | |
| VERTKEMEG | | VERTKEMEG | | WDTLIERENA | | | |
| VESAVLRGF | | VESAVLRGF | | WDTLIERENS | | | |
| VESEIRTFS | | VESEIRTFS | | WDTLIERGSS | | | |
| VESMIEAES | | VESMIEAES | | WDVFIERPTA | | | |
| VESNGNLIA | | VESNGNLIA | | WDVINFESTG | | | |
| VESNGNLVA | | VESNGNLVA | | WDVISFESTG | | | |
| VESRINMIN | | VESRINMIN | | WDWPDGAKIE | | | |
| VESRINTIN | | VESRINTIN | | WEGLIDGWYG | | | |
| VESSNYQQS | | VESSNYQQS | | WEGLINGWYG | | | |
| VESSTYQNN | | VESSTYQNN | | WEGLVDGWYG | | | |
| VETGYVCSK | | VETGYVCSK | | WEGMIDGWYG | | | |
| VETLARCIC | | VETLARCIC | | WEGMMDGWYG | | | |
| VETLARNIC | | VETLARNIC | | WEGMVDGWYG | | | |
| VETLARRIC | | VETLARRIC | | WEGMVNGWYG | | | |
| VETLARSIC | | VETLARSIC | | WEGNILRTQE | | | |
| VETNHTDEL | | VETNHTDEL | | WEINGPDSVL | | | |
| VETNHTGTY | | VETNHTGTY | | WEINGPESVL | | | |
| VETRINMIN | | VETRINMIN | | WEKNCTLIDA | | | |
| VETSHTGTY | | VETSHTGTY | | WEMGLAPSPY | | | |
| VETYVLSII | | VETYVLSII | | WEMGQAPSPY | | | |
| VETYVLSIV | | VETYVLSIV | | WEQLYTPGGE | | | |
| VETYVLSVI | | VETYVLSVI | | WEQMYTPGGE | | | |
| VEVITAQEL | | VEVITAQEL | | WEQMYTPGGG | | | |
| VEVLHLTQG | | VEVLHLTQG | | WEQMYTPGGK | | | |
| VEVTNATEL | | VEVTNATEL | | WETTGRNCTV | | | |
| VEVVAAQEL | | VEVVAAQEL | | WEVNGPESVL | | | |
| VEVVDATET | | VEVVDATET | | WFGYFGIFFV | | | |
| VEVVNATET | | VEVVNATET | | WFRNILSIAP | | | |
| VEVVSAKEL | | VEVVSAKEL | | WFRNILSMAP | | | |
| VEVVTAQEL | | VEVVTAQEL | | WFRNVLSIAP | | | |
| VEWTSNSLI | | VEWTSNSLI | | WFRNVLSVAP | | | |
| VEYASKTRI | | VEYASKTRI | | WFSFGASCFI | | | |
| VEYDAVATT | | VEYDAVATT | | WFSFGASCFL | | | |
| VEYNGKSLG | | VEYNGKSLG | | WFSFGASCFT | | | |
| VFAGKNADL | | VFAGKNADL | | WFSFGASCFV | | | |
| VFAGKNSDL | | VFAGKNSDL | | WFSFGASCLI | | | |
| VFAGKNTDL | | VFAGKNTDL | | WFSFGASCVM | | | |
| VFCGTPGTY | | VFCGTPGTY | | WFSFGASSFV | | | |
| VFCGTSGNY | | VFCGTSGNY | | WFSHYNQMKQ | | | |
| VFCGTSGTC | | VFCGTSGTC | | WFSHYNQMTQ | | | |
| VFCGTSGTY | | VFCGTSGTY | | WFSHYNQVAQ | | | |
| VFCGVSGEV | | VFCGVSGEV | | WFSHYNQVTQ | | | |
| VFCGVSSEV | | VFCGVSSEV | | WFSLGASCFL | | | |
| VFCSTSGTY | | VFCSTSGTY | | WGDGAILPFD | | | |
| VFEFSDERA | | VFEFSDERA | | WGDILDGVTA | | | |
| VFELSDEKA | | VFELSDEKA | | WGDILEGTTA | | | |
| VFELSDERA | | VFELSDERA | | WGDVLDGVTA | | | |
| VFFCLKNGN | | VFFCLKNGN | | WGIHHPDSET | | | |
| VFFCLRNGN | | VFFCLRNGN | | WGIHHPDTEA | | | |
| VFICIKNGN | | VFICIKNGN | | WGIHHPDTEE | | | |
| VFICVKNGN | | VFICVKNGN | | WGIHHPDTET | | | |
| VFIERPTAV | | VFIERPTAV | | WGIHHPPDAK | | | |
| VFIIREPFV | | VFIIREPFV | | WGIHHPPDET | | | |
| VFLAMITYI | | VFLAMITYI | | WGIHHPPDTK | | | |
| VFLTMITYI | | VFLTMITYI | | WGIHHPPNTK | | | |
| VFMCVKNGN | | VFMCVKNGN | | WGIHHPSSAQ | | | |

Fig. 83-417

| Block size 8 | SIN | Block size 9 | SIN | Block size 10 | SIN | Block size 11 | SIN |
|---|---|---|---|---|---|---|---|
| VFNCLYASP | | VFNCLYASP | | WGIHHPSSTK | | | |
| VFNSIYASP | | VFNSIYASP | | WGIHHPSSTQ | | | |
| VFNSLYASP | | VFNSLYASP | | WGILKRGETL | | | |
| VFNSLYASS | | VFNSLYASS | | WGMELRRCLL | | | |
| VFNSLYSSP | | VFNSLYSSP | | WGMEMRRCLL | | | |
| VFNTIGNLI | | VFNTIGNLI | | WGMGQAPSPY | | | |
| VFNTIGNLV | | VFNTIGNLV | | WGNGCFEFYH | | | |
| VFPNEVGAK | | VFPNEVGAK | | WGNVLDGVTA | | | |
| VFPNEVGAR | | VFPNEVGAR | | WGVHHPSSDN | | | |
| VFPQLNQTY | | VFPQLNQTY | | WGVHHPSTDA | | | |
| VFREQKQEF | | VFREQKQEF | | WGVHHPSTDK | | | |
| VFSIAASYK | | VFSIAASYK | | WGVHHPSTDT | | | |
| VFSNAASYK | | VFSNAASYK | | WGVHHSSSLD | | | |
| VFSQEDCMI | | VFSQEDCMI | | WHASNRPWIS | | | |
| VFSQEDCMM | | VFSQEDCMM | | WHASNRPWVS | | | |
| VFSQEDCMV | | VFSQEDCMV | | WHDGAEIIYF | | | |
| VFSQEECMI | | VFSQEECMI | | WHDGAEITYF | | | |
| VFSSAASYK | | VFSSAASYK | | WHGANRPWVS | | | |
| VFTDGSATG | | VFTDGSATG | | WHGSNRPWIS | | | |
| VFTLTVPSE | | VFTLTVPSE | | WHGSNRPWLS | | | |
| VFVALILGF | | VFVALILGF | | WHGSNRPWVS | | | |
| VFVIREPCI | | VFVIREPCI | | WHIFGKDNAI | | | |
| VFVIREPFI | | VFVIREPFI | | WHIFGKDNAV | | | |
| VFVIREPFV | | VFVIREPFV | | WHIFSKDNAI | | | |
| VFWTSNSIV | | VFWTSNSIV | | WHILSKDNAI | | | |
| VGAINSSMP | | VGAINSSMP | | WHILSKDNAV | | | |
| VGAKILTSE | | VGAKILTSE | | WHIYGKDNAI | | | |
| VGARIITSE | | VGARIITSE | | WHIYGKDNAV | | | |
| VGARILASE | | VGARILASE | | WHLMHPGERI | | | |
| VGARILTSE | | VGARILTSE | | WHLMRPGERI | | | |
| VGARPKVNG | | VGARPKVNG | | WHLMRPGERT | | | |
| VGARPQVNG | | VGARPQVNG | | WHLMSPGERI | | | |
| VGCVILLNP | | VGCVILLNP | | WHSNLNDATY | | | |
| VGDTPRNDD | | VGDTPRNDD | | WHSNLNDTTY | | | |
| VGDTPRNED | | VGDTPRNED | | WHVRKRFADQ | | | |
| VGDTPRNGD | | VGDTPRNGD | | WICMGHHAVA | | | |
| VGDTPRNND | | VGDTPRNND | | WIDSPNHAKS | | | |
| VGEAPSPYN | | VGEAPSPYN | | WIEFDEIGED | | | |
| VGECPRYVK | | VGECPRYVK | | WIELDEIGED | | | |
| VGEVPSPYN | | VGEVPSPYN | | WIELIRGRPK | | | |
| VGGIDTNKT | | VGGIDTNKT | | WIGRTKSLES | | | |
| VGGINTNKT | | VGGINTNKT | | WIKTRPILSP | | | |
| VGGINTNRT | | VGGINTNRT | | WILGNPMCDD | | | |
| VGGNEKKAK | | VGGNEKKAK | | WILGNPMCDE | | | |
| VGGSGTDNY | | VGGSGTDNY | | WILGNPMCDN | | | |
| VGGSGTNNY | | VGGSGTNNY | | WILGNPMCDY | | | |
| VGIAADKES | | VGIAADKES | | WILGNPRCDD | | | |
| VGICKAAMG | | VGICKAAMG | | WILWISFAIS | | | |
| VGIDPFKLL | | VGIDPFKLL | | WILWISFAMS | | | |
| VGIDPFRLL | | VGIDPFRLL | | WILWISFATS | | | |
| VGINMSKKK | | VGINMSKKK | | WINSPNHAKS | | | |
| VGINMSKRK | | VGINMSKRK | | WINSPNHVKS | | | |
| VGISSMGEA | | VGISSMGEA | | WINSPSQAKS | | | |
| VGISSMMEA | | VGISSMMEA | | WIPKRNRSIL | | | |
| VGISSMVEA | | VGISSMVEA | | WIQNEFNKAC | | | |
| VGKCNDPYP | | VGKCNDPYP | | WIQSEFNKAC | | | |
| VGKCNEPYP | | VGKCNEPYP | | WIRFNSDLDY | | | |
| VGKCPKYVK | | VGKCPKYVK | | WIRFNSDLNY | | | |
| VGKCPRYIK | | VGKCPRYIK | | WIRFNSNLDY | | | |
| VGKCPRYVK | | VGKCPRYVK | | WIRINNETIL | | | |
| VGKCPRYVR | | VGKCPRYVR | | WISFAISCFL | | | |
| VGKEFGNLE | | VGKEFGNLE | | WISFAMSCFL | | | |

Fig. 83-418

| Block size 8 | SIN | Block size 9 | SIN | Block size 10 | SIN | Block size 11 | SIN |
|---|---|---|---|---|---|---|---|
| VGKEFNNLE | | VGKEFNNLE | | WISFATSCFL | | | |
| VGKEFNSLE | | VGKEFNSLE | | WISFSISCFL | | | |
| VGKEFSNLE | | VGKEFSNLE | | WISFSMSCFV | | | |
| VGLILAFIL | | VGLILAFIL | | WITIGISGPD | | | |
| VGLILAFIM | | VGLILAFIM | | WITREPYVSC | | | |
| VGLILSFIM | | VGLILSFIM | | WIVGNPSCAS | | | |
| VGLILTFIM | | VGLILTFIM | | WIVGNPSCAT | | | |
| VGLLLQIIS | | VGLLLQIIS | | WKGANRPIIT | | | |
| VGLLLQITS | | VGLLLQITS | | WKGANRPVII | | | |
| VGLNISLHL | | VGLNISLHL | | WKGANRPVIT | | | |
| VGLNMSLHL | | VGLNMSLHL | | WKGGSIKTKL | | | |
| VGLNVSLHL | | VGLNVSLHL | | WKGGSINTKL | | | |
| VGLRNTPSI | | VGLRNTPSI | | WKGNIMRTQE | | | |
| VGLRNTPSV | | VGLRNTPSV | | WKGSNRPIID | | | |
| VGLVFFCLK | | VGLVFFCLK | | WKGSNRPIVD | | | |
| VGMAADKES | | VGMAADKES | | WKGSNRPVID | | | |
| VGNDNWSGY | | VGNDNWSGY | | WKGSNRPVVD | | | |
| VGNGCFEFY | | VGNGCFEFY | | WKGSNRPWIR | | | |
| VGNLAFNTV | | VGNLAFNTV | | WKGSNRPWMR | | | |
| VGNLIFNTV | | VGNLIFNTV | | WKGSNRPWVR | | | |
| VGNLVFNTV | | VGNLVFNTV | | WKHVTNTILL | | | |
| VGNPSCASN | | VGNPSCASN | | WKKQILRTQE | | | |
| VGNPSCATN | | VGNPSCATN | | WLELDEIGED | | | |
| VGPGSFPDG | | VGPGSFPDG | | WLEMIRGKPE | | | |
| VGPILSFIM | | VGPILSFIM | | WLEMIRGKPK | | | |
| VGQCPKYVK | | VGQCPKYVK | | WLEMIRGRPE | | | |
| VGQCPKYVN | | VGQCPKYVN | | WLEMIRGRPE | | | |
| VGQCPKYVS | | VGQCPKYVS | | WLENEKTLDL | | | |
| VGQSPNVYQ | | VGQSPNVYQ | | WLGRTFSPRS | | | |
| VGRCPRYVK | | VGRCPRYVK | | WLGRTINTAS | | | |
| VGRMTICIQ | | VGRMTICIQ | | WLGRTISIAS | | | |
| VGRMTICVQ | | VGRMTICVQ | | WLGRTISKDL | | | |
| VGRSGTNNY | | VGRSGTNNY | | WLGRTISKDS | | | |
| VGRTISIAS | | VGRTISIAS | | WLGRTISKDT | | | |
| VGSGSFPDG | | VGSGSFPDG | | WLGRTISPHS | | | |
| VGSGSFPNG | | VGSGSFPNG | | WLGRTISPKL | | | |
| VGSRGHVFV | | VGSRGHVFV | | WLGRTISPRL | | | |
| VGSRINMIN | | VGSRINMIN | | WLGRTISPRS | | | |
| VGSSIYQNS | | VGSSIYQNS | | WLGRTISTAS | | | |
| VGSSKYQQS | | VGSSKYQQS | | WLGRTTSKDS | | | |
| VGSSKYRQS | | VGSSKYRQS | | WLGRTTSTAS | | | |
| VGSSNYQQS | | VGSSNYQQS | | WLGRTVSING | | | |
| VGSSTYHNS | | VGSSTYHNS | | WLGRTVSISG | | | |
| VGSSTYQNN | | VGSSTYQNN | | WLGRTVSNSG | | | |
| VGSSTYQNS | | VGSSTYQNS | | WLGRTVSTSG | | | |
| VGSWSQNIL | | VGSWSQNIL | | WLHICVTGDD | | | |
| VGTAPVLGN | | VGTAPVLGN | | WLHVCITGDD | | | |
| VGTKHSNGT | | VGTKHSNGT | | WLHVCVTGDD | | | |
| VGTRWMKII | | VGTRWMKII | | WLIDQSGTYP | | | |
| VGTSTLNLR | | VGTSTLNLR | | WLIHQSETYP | | | |
| VGTSTLNQR | | VGTSTLNQR | | WLIHQSGTYP | | | |
| VGVAPSPSN | | VGVAPSPSN | | WLIYQSGTYP | | | |
| VGVDEYSST | | VGVDEYSST | | WLKPQCQITG | | | |
| VGVDPFKLL | | VGVDPFKLL | | WLKTRPILSP | | | |
| VGVDPFRLL | | VGVDPFRLL | | WLLGNPECDI | | | |
| VGWSATACH | | VGWSATACH | | WLLGNPECDL | | | |
| VGWSSTSCH | | VGWSSTSCH | | WLLGNPECDR | | | |
| VGWSSTTCH | | VGWSSTTCH | | WLLGNPKCDR | | | |
| VGWTSNSIV | | VGWTSNSIV | | WLLGNPLCDE | | | |
| VGYHANNST | | VGYHANNST | | WLLGNPMCDA | | | |
| VGYHSNNST | | VGYHSNNST | | WLLGNPMCDE | | | |
| VGYICSGVF | | VGYICSGVF | | WLLGNPMCDK | | | |
| | | | | WLLSSKANQV | | | |

Fig. 83-419

| Block size 8 | SIN | Block size 9 | SIN | Block size 10 | SIN | Block size 11 | SIN |
|---|---|---|---|---|---|---|---|
| VGYLCAGIP | | VGYLCAGIP | | WLLSSKDNQV | | | |
| VGYLCAGLP | | VGYLCAGLP | | WLSSSGNNQV | | | |
| VGYLSTNSS | | VGYLSTNSS | | WLSSSMNNQV | | | |
| VGYLSTNST | | VGYLSTNST | | WLTIGISGPD | | | |
| VHAMRTIGT | | VHAMRTIGT | | WLTIGITGPD | | | |
| VHDRIPHRT | | VHDRIPHRT | | WLTIGVSGPD | | | |
| VHFQNQVKI | | VHFQNQVKI | | WLTKATNGNY | | | |
| VHFRNQIKI | | VHFRNQIKI | | WLTKETNGNY | | | |
| VHFRNQVKI | | VHFRNQVKI | | WLTKKEPDTY | | | |
| VHFRSQVKI | | VHFRSQVKI | | WLTKKKNPEA | | | |
| VHFVEALAR | | VHFVEALAR | | WLTKKKPDIY | | | |
| VHHPSSDNE | | VHHPSSDNE | | WLTKKKPDTY | | | |
| VHHPSTDAE | | VHHPSTDAE | | WLTLGITGPD | | | |
| VHHPSTDKE | | VHHPSTDKE | | WLTLKLGQFP | | | |
| VHHPSTDTE | | VHHPSTDTE | | WLTLKSEQFP | | | |
| VHHSSSLDE | | VHHSSSLDE | | WLTLKSGQFP | | | |
| VHIGPLSGS | | VHIGPLSGS | | WLVHQSGTYP | | | |
| VHISPLAGS | | VHISPLAGS | | WLWLVLREKM | | | |
| VHISPLSGS | | VHISPLSGS | | WMACHSAAFE | | | |
| VHIYYLEKA | | VHIYYLEKA | | WMACNSAAFE | | | |
| VHKSQLIWM | | VHKSQLIWM | | WMCFNGSLQC | | | |
| VHLGDCNFE | | VHLGDCNFE | | WMCLNGSMQC | | | |
| VHLGDCRFE | | VHLGDCRFE | | WMCPNGSLQC | | | |
| VHLGDCSFE | | VHLGDCSFE | | WMCSGHSCRI | | | |
| VHMYYLEKA | | VHMYYLEKA | | WMCSNGSLHG | | | |
| VHNGKLCRL | | VHNGKLCRL | | WMCSNGSLQC | | | |
| VHPLAIGEC | | VHPLAIGEC | | WMCSNGSLRC | | | |
| VHPLTIGEC | | VHPLTIGEC | | WMCSNGSMQC | | | |
| VHQILAIYS | | VHQILAIYS | | WMCSNGSYNA | | | |
| VHQSTNSTE | | VHQSTNSTE | | WMCSNSSMQC | | | |
| VHRNAIGDC | | VHRNAIGDC | | WMDYYWGILK | | | |
| VHRNTFGDC | | VHRNTFGDC | | WMELDEIGED | | | |
| VHRNTIGDC | | VHRNTIGDC | | WMGRTISKDS | | | |
| VHRSTIGDC | | VHRSTIGDC | | WMGRTISMDS | | | |
| VHTYYLEKA | | VHTYYLEKA | | WMGRTISRDS | | | |
| VHVSPLSGS | | VHVSPLSGS | | WMKIIRVGCV | | | |
| VHVYYLEKA | | VHVYYLEKA | | WMKIYWHLMH | | | |
| VIAARNIVR | | VIAARNIVR | | WMKLYWHLMH | | | |
| VIAKDNAIR | | VIAKDNAIR | | WMKLYWHLMR | | | |
| VIAKDNAVR | | VIAKDNAVR | | WMKLYWHLMS | | | |
| VIAQDNAIR | | VIAQDNAIR | | WMLLDPGDTV | | | |
| VIASTTAKA | | VIASTTAKA | | WMMAMKYPIT | | | |
| VICLGHHAV | | VICLGHHAV | | WMMAMRYPIT | | | |
| VICLGHHSV | | VICLGHHSV | | WMRINNETIL | | | |
| VICMGHHAV | | VICMGHHAV | | WMRISNETIL | | | |
| VIDGWTTAN | | VIDGWTTAN | | WNENQNPRIF | | | |
| VIDKMNKQF | | VIDKMNKQF | | WNENQNPRMF | | | |
| VIDKMNKQL | | VIDKMNKQL | | WNENQNPRVF | | | |
| VIDKMNNQF | | VIDKMNNQF | | WNGVKVDGSS | | | |
| VIDKMYKQF | | VIDKMYKQF | | WNLALDIVDS | | | |
| VIEGWINSP | | VIEGWINSP | | WNVSSSGTSK | | | |
| VIEKDNAVR | | VIEKDNAVR | | WNVTHTGTSK | | | |
| VIEKMNIQF | | VIEKMNIQF | | WNVTRSGTSK | | | |
| VIEKMNTQF | | VIEKMNTQF | | WNVTSSGTSK | | | |
| VIGARPQVN | | VIGARPQVN | | WNVTYTGISK | | | |
| VIGGWATAN | | VIGGWATAN | | WNVTYTGTSK | | | |
| VIGGWTIAN | | VIGGWTIAN | | WNVTYTGTSR | | | |
| VIGGWTTAN | | VIGGWTTAN | | WNWPDGAEIE | | | |
| VIHYGGIPT | | VIHYGGIPT | | WNWPDGAKIE | | | |
| VIHYGGMPT | | VIHYGGMPT | | WPDGADINFM | | | |
| VIHYGGVPT | | VIHYGGVPT | | WPDGADLPFT | | | |
| VIITREPYV | | VIITREPYV | | WPDGAEIEYF | | | |

Fig. 83-420

| Block size 8 | SIN | Block size 9 | SIN | Block size 10 | SIN | Block size 11 | SIN |
|---|---|---|---|---|---|---|---|
| VIKLLPFAA | | VIKLLPFAA | | WPDGAELPFA | | | |
| VIKNNMINN | | VIKNNMINN | | WPDGAELPFI | | | |
| VIKNNMVNN | | VIKNNMVNN | | WPDGAELPFT | | | |
| VIKYNGIIT | | VIKYNGIIT | | WPDGAKIETL | | | |
| VILEENTTY | | VILEENTTY | | WPDGAKIEYF | | | |
| VILLNPFVS | | VILLNPFVS | | WPDGAKIEYS | | | |
| VILVLGLSM | | VILVLGLSM | | WPDGAKLPFT | | | |
| VILWFSFGA | | VILWFSFGA | | WPDGALLPFD | | | |
| VILWFSLGA | | VILWFSLGA | | WPDGALLPLT | | | |
| VIMEVVFPN | | VIMEVVFPN | | WPDGANIDFM | | | |
| VIMTDGPAN | | VIMTDGPAN | | WPDGANIDFV | | | |
| VIMTDGPAS | | VIMTDGPAS | | WPDGANIGFM | | | |
| VIMTDGSAN | | VIMTDGSAN | | WPDGANIGLC | | | |
| VIMTDGSAS | | VIMTDGSAS | | WPDGANINFM | | | |
| VINDKIDDQ | | VINDKIDDQ | | WPDGANINLM | | | |
| VINFESTGN | | VINFESTGN | | WPDGANISFM | | | |
| VINNITTTI | | VINNITTTI | | WPDGANTNFM | | | |
| VINNMTTTI | | VINNMTTTI | | WPDGSDIGFM | | | |
| VINNYYNET | | VINNYYNET | | WPDGSNIGFM | | | |
| VINTSKPFQ | | VINTSKPFQ | | WPDGYNIGFM | | | |
| VINWTKDSI | | VINWTKDSI | | WPGLINGWYG | | | |
| VINWTQDAM | | VINWTQDAM | | WPGLVAGWYG | | | |
| VINWTRDAM | | VINWTRDAM | | WPLSSPPTVY | | | |
| VINWTRDSI | | VINWTRDSI | | WPQSSPPTVY | | | |
| VINWTRDSL | | VINWTRDSL | | WQGANRPIIE | | | |
| VINWTRDSM | | VINWTRDSM | | WQGANRPVIE | | | |
| VINWTRDSV | | VINWTRDSV | | WQGANRPVIK | | | |
| VIPLTTTPT | | VIPLTTTPT | | WQGLIDGWYG | | | |
| VIPVNNTIY | | VIPVNNTIY | | WQGLVDGWYG | | | |
| VIREPCISC | | VIREPCISC | | WQGMIDGWYG | | | |
| VIREPFISC | | VIREPFISC | | WQGMVDGWYG | | | |
| VIREPFVAC | | VIREPFVAC | | WQGSNRPVIQ | | | |
| VIREPFVSC | | VIREPFVSC | | WQGSNRPVIR | | | |
| VIRNNMINN | | VIRNNMINN | | WQGSNRPWIR | | | |
| VIRSWRKQI | | VIRSWRKQI | | WREQLSQKFE | | | |
| VISFESTGN | | VISFESTGN | | WRGANRPVIT | | | |
| VISGWTTAN | | VISGWTTAN | | WRGDNGRRTR | | | |
| VITDTIKSW | | VITDTIKSW | | WRGENGRKTR | | | |
| VITDTLKSW | | VITDTLKSW | | WRGENGRRTR | | | |
| VIVTREPYI | | VIVTREPYI | | WRGGSINTKL | | | |
| VIVTREPYV | | VIVTREPYV | | WRGGSINTRL | | | |
| VIYGNPKCD | | VIYGNPKCD | | WRGSNRPIVD | | | |
| VKAVRGDLN | | VKAVRGDLN | | WRGSNRPWIR | | | |
| VKCICRDNW | | VKCICRDNW | | WRKDILRTQE | | | |
| VKCYQFALG | | VKCYQFALG | | WRKKILRTQE | | | |
| VKDRSPFRT | | VKDRSPFRT | | WRKQILRTQE | | | |
| VKDRSPYRA | | VKDRSPYRA | | WRQANNGDDA | | | |
| VKDRSPYRT | | VKDRSPYRT | | WRQANNGEDA | | | |
| VKEAQDVIM | | VKEAQDVIM | | WRQANNGEDS | | | |
| VKEKDLTKE | | VKEKDLTKE | | WRQANNGEEA | | | |
| VKEKDMTKE | | VKEKDMTKE | | WRQANSGEDA | | | |
| VKEKDMTRE | | VKEKDMTRE | | WRRDILRTQE | | | |
| VKELGNGCF | | VKELGNGCF | | WRRQILRTQE | | | |
| VKGDKICLG | | VKGDKICLG | | WSASACHDGI | | | |
| VKGDQICIG | | VKGDQICIG | | WSASACHDGL | | | |
| VKGDRICIG | | VKGDRICIG | | WSASACHDGM | | | |
| VKGDYNNTT | | VKGDYNNTT | | WSASACHDGS | | | |
| VKGEYNNTT | | VKGEYNNTT | | WSASACHDGT | | | |
| VKGFAFKYG | | VKGFAFKYG | | WSASACHDGV | | | |
| VKGFAFLDE | | VKGFAFLDE | | WSATACHDGK | | | |
| VKGFAFLDG | | VKGFAFLDG | | WSATACHDGR | | | |
| VKGFAFLDR | | VKGFAFLDR | | WSATACSDGP | | | |

Fig. 83-421

| Block size 8 | SIN | Block size 9 | SIN | Block size 10 | SIN | Block size 11 | SIN |
|---|---|---|---|---|---|---|---|
| VKGFAFLNG | | VKGFAFLNG | | WSATACSDGS | | | |
| VKGFAYLDG | | VKGFAYLDG | | WSFALAQGAL | | | |
| VKGFGFKAG | | VKGFGFKAG | | WSFALAQGTL | | | |
| VKGFGFKKG | | VKGFGFKKG | | WSFALAQGVL | | | |
| VKGFGFKSG | | VKGFGFKSG | | WSFALSQGAL | | | |
| VKGFGFKTG | | VKGFGFKTG | | WSGLIAGWYG | | | |
| VKGFGFKVG | | VKGFGFKVG | | WSGLVAGWYG | | | |
| VKGFGFLDG | | VKGFGFLDG | | WSGMIDGWYG | | | |
| VKGFGFLDN | | VKGFGFLDN | | WSGYSGAFID | | | |
| VKGFGFLDS | | VKGFGFLDS | | WSGYSGAFMD | | | |
| VKGFGFLNG | | VKGFGFLNG | | WSGYSGAFTI | | | |
| VKGFGFLSG | | VKGFGFLSG | | WSGYSGAFTV | | | |
| VKGFGFRQG | | VKGFGFRQG | | WSGYSGAFVD | | | |
| VKGFSFKYG | | VKGFSFKYG | | WSGYSGIFSI | | | |
| VKGFSFRYG | | VKGFSFRYG | | WSGYSGIFSV | | | |
| VKGFSYKYD | | VKGFSYKYD | | WSGYSGSFID | | | |
| VKGFSYKYG | | VKGFSYKYG | | WSGYSGSFII | | | |
| VKGFSYLDG | | VKGFSYLDG | | WSGYSGSFIQ | | | |
| VKGFSYLNG | | VKGFSYLNG | | WSGYSGSFIV | | | |
| VKGFSYRYG | | VKGFSYRYG | | WSGYSGSFMD | | | |
| VKGRSHLRN | | VKGRSHLRN | | WSGYSGSFSI | | | |
| VKGWAFDDG | | VKGWAFDDG | | WSGYSGSFSV | | | |
| VKGWAFDNE | | VKGWAFDNE | | WSGYSGSFTI | | | |
| VKGWAFDNG | | VKGWAFDNG | | WSGYSGSFTL | | | |
| VKGWAFDSG | | VKGWAFDSG | | WSGYSGSFTV | | | |
| VKGWAFDYG | | VKGWAFDYG | | WSGYSGSFVD | | | |
| VKGWAPLSK | | VKGWAPLSK | | WSGYSGSFVI | | | |
| VKHFEKVKI | | VKHFEKVKI | | WSGYSGSFVQ | | | |
| VKHFEKVRI | | VKHFEKVRI | | WSGYSGVFSV | | | |
| VKIDPVELS | | VKIDPVELS | | WSHNILRTQE | | | |
| VKIDPVKLS | | VKIDPVKLS | | WSILKPGETL | | | |
| VKIKTNGNL | | VKIKTNGNL | | WSKNILRTQE | | | |
| VKIQTNGNL | | VKIQTNGNL | | WSKPQCHITG | | | |
| VKIQTSGNL | | VKIQTSGNL | | WSKPQCKITG | | | |
| VKIRRRVDI | | VKIRRRVDI | | WSKPQCLITG | | | |
| VKIRRRVDM | | VKIRRRVDM | | WSKPQCQIAG | | | |
| VKIRRRVDT | | VKIRRRVDT | | WSKPQCQIIG | | | |
| VKIRRRVDV | | VKIRRRVDV | | WSKPQCQISG | | | |
| VKKASLRLA | | VKKASLRLA | | WSKPQCQITG | | | |
| VKKESLRLA | | VKKESLRLA | | WSKRYELEIG | | | |
| VKKQLRENA | | VKKQLRENA | | WSMLKPGETL | | | |
| VKLAQGYKD | | VKLAQGYKD | | WSQNILRTHE | | | |
| VKLEENSTY | | VKLEENSTY | | WSQNILRTQE | | | |
| VKLEENTSY | | VKLEENTSY | | WSRRYELEIG | | | |
| VKLEENTTY | | VKLEENTTY | | WSSASCHDGR | | | |
| VKLIQGYKD | | VKLIQGYKD | | WSSSSCFDGK | | | |
| VKLNSGYKD | | VKLNSGYKD | | WSSSSCFDGR | | | |
| VKLSGGYKD | | VKLSGGYKD | | WSSSSCHDGK | | | |
| VKLSNGYKD | | VKLSNGYKD | | WSSSSCHDGN | | | |
| VKLSNMGIY | | VKLSNMGIY | | WSSSSCHDGR | | | |
| VKLSNMGVY | | VKLSNMGVY | | WSSSSCYDGK | | | |
| VKLSSGYKD | | VKLSSGYKD | | WSSTSCFDGK | | | |
| VKLSSGYKE | | VKLSSGYKE | | WSSTSCHDGI | | | |
| VKLSSGYKN | | VKLSSGYKN | | WSSTSCHDGK | | | |
| VKLSSMGIY | | VKLSSMGIY | | WSSTSCHDGM | | | |
| VKLSSMGVY | | VKLSSMGVY | | WSSTSCHDGR | | | |
| VKLSSSYKD | | VKLSSSYKD | | WSSTSCHDGV | | | |
| VKLTQGYKD | | VKLTQGYKD | | WSSTTCHDGI | | | |
| VKLYKKLKR | | VKLYKKLKR | | WSSTTCHDGV | | | |
| VKLYRKLKR | | VKLYRKLKR | | WSVLKPGETL | | | |
| VKMEKIVLL | | VKMEKIVLL | | WSVLQPGETL | | | |
| VKMFDFIKW | | VKMFDFIKW | | WSVLRPGETL | | | |

Fig. 83-422

| Block size 8 | SIN | Block size 9 | SIN | Block size 10 | SIN | Block size 11 | SIN |
|---|---|---|---|---|---|---|---|
| VKMFDSKW | | VKMFDSKW | | WSWDDGAILP | | | |
| VKMFDTKW | | VKMFDTKW | | WSWHDGAEII | | | |
| VKMKWGMEM | | VKMKWGMEM | | WSWHDGAEIT | | | |
| VKMNPNQKI | | VKMNPNQKI | | WSWHDGAILP | | | |
| VKNDDIDQS | | VKNDDIDQS | | WSWHDGAVLP | | | |
| VKNDDVDQS | | VKNDDVDQS | | WSWPDDAELP | | | |
| VKNDEVDQS | | VKNDEVDQS | | WSWPDGADLP | | | |
| VKNGNHAVH | | VKNGNHAVH | | WSWPDGAELP | | | |
| VKNGNLRCT | | VKNGNLRCT | | WSWPDGAEVP | | | |
| VKNGNMQCT | | VKNGNMQCT | | WSWPDGAKLP | | | |
| VKNGNMRCT | | VKNGNMRCT | | WSWPDGALFP | | | |
| VKNGTYDYP | | VKNGTYDYP | | WSWPDGALLP | | | |
| VKNGTYNYP | | VKNGTYNYP | | WSYIIEKENP | | | |
| VKNLFDEVK | | VKNLFDEVK | | WSYIMEKENP | | | |
| VKNLFDEVR | | VKNLFDEVR | | WSYIVEKANP | | | |
| VKNLHDQIK | | VKNLHDQIK | | WSYIVEKDKP | | | |
| VKNLHEQVK | | VKNLHEQVK | | WSYIVEKDNP | | | |
| VKNLHEQVR | | VKNLHEQVR | | WSYIVEKDSP | | | |
| VKNLYDKVR | | VKNLYDKVR | | WSYIVEKENP | | | |
| VKNLYDRVR | | VKNLYDRVR | | WSYIVEKLNP | | | |
| VKNLYEKVR | | VKNLYEKVR | | WSYIVEKNNP | | | |
| VKNLYNKVR | | VKNLYNKVR | | WSYIVEKPNP | | | |
| VKPLILKDC | | VKPLILKDC | | WSYIVEKSNP | | | |
| VKPLILRDC | | VKPLILRDC | | WSYIVEKTNP | | | |
| VKPLILRNC | | VKPLILRNC | | WSYIVERENP | | | |
| VKQDGKSSA | | VKQDGKSSA | | WSYIVERETP | | | |
| VKQESLLLA | | VKQESLLLA | | WSYIVERPKE | | | |
| VKQESLMLA | | VKQESLMLA | | WSYIVERPSA | | | |
| VKQGSLKLA | | VKQGSLKLA | | WSYIVERTKE | | | |
| VKQGSLMLA | | VKQGSLMLA | | WSYLIEDPAA | | | |
| VKQGSLRLA | | VKQGSLRLA | | WSYLIEDPGA | | | |
| VKQKSILLA | | VKQKSILLA | | WSYLIEDPNA | | | |
| VKQKSLLLA | | VKQKSLLLA | | WSYLIEDPSA | | | |
| VKQKTLKLA | | VKQKTLKLA | | WSYLIEDPTA | | | |
| VKQNGKSGA | | VKQNGKSGA | | WSYNADLLVA | | | |
| VKQNGKSSA | | VKQNGKSSA | | WSYNADVLVA | | | |
| VKQNTLKLA | | VKQNTLKLA | | WSYNAEFLVA | | | |
| VKQSSLPLA | | VKQSSLPLA | | WSYNAELLIA | | | |
| VKQSTLKLA | | VKQSTLKLA | | WSYNAELLVA | | | |
| VKQTSLLLA | | VKQTSLLLA | | WSYNAGLLVA | | | |
| VKRGINDRN | | VKRGINDRN | | WSYNAKLLVL | | | |
| VKRLLRENA | | VKRLLRENA | | WSYNAQLLVL | | | |
| VKRQLRENA | | VKRQLRENA | | WSYNAQLLVW | | | |
| VKRRLSANA | | VKRRLSANA | | WSYNARLLVL | | | |
| VKRRLSTNA | | VKRRLSTNA | | WTANSIIVFC | | | |
| VKRRPVAKA | | VKRRPVAKA | | WTCNSGNCRF | | | |
| VKSDKICLG | | VKSDKICLG | | WTCSNGSCRC | | | |
| VKSDRLVLA | | VKSDRLVLA | | WTGLIDGWYG | | | |
| VKSEKLVLA | | VKSEKLVLA | | WTGMIDGWYG | | | |
| VKSERLVLA | | VKSERLVLA | | WTGMVDGWYG | | | |
| VKSITQTLV | | VKSITQTLV | | WTGMVNGWYG | | | |
| VKSLKLAIG | | VKSLKLAIG | | WTGTNRPILV | | | |
| VKSLKLASG | | VKSLKLASG | | WTGTNRPVLI | | | |
| VKSLKLATG | | VKSLKLATG | | WTGTNRPVLV | | | |
| VKSLLRDNA | | VKSLLRDNA | | WTGTNRPVVV | | | |
| VKSLYDKVR | | VKSLYDKVR | | WTKDSITDIW | | | |
| VKSNGNLIA | | VKSNGNLIA | | WTLGENMAPE | | | |
| VKSQLKDNA | | VKSQLKDNA | | WTLNRNQPAA | | | |
| VKSQLRDNA | | VKSQLRDNA | | WTLVNPGDSI | | | |
| VKSVTQTLV | | VKSVTQTLV | | WTPKRNRSIL | | | |
| VKTLTDNHV | | VKTLTDNHV | | WTQDAMTEVW | | | |
| VKTLTNEHE | | VKTLTNEHE | | WTRDAMTEIW | | | |

Fig. 83-423

| Block size 8 | SIN | Block size 9 | SIN | Block size 10 | SIN | Block size 11 | SIN |
|---|---|---|---|---|---|---|---|
| VKTLTNEKE | | VKTLTNEKE | | WTRDAMTEVW | | | |
| VKTLTNEQE | | VKTLTNEQE | | WTRDSITEVW | | | |
| VKTLTSEKE | | VKTLTSEKE | | WTRDSLTEIW | | | |
| VKTWAGNIL | | VKTWAGNIL | | WTRDSMTEIW | | | |
| VKVDGSSSA | | VKVDGSSSA | | WTRDSMTEVW | | | |
| VKVTHRENL | | VKVTHRENL | | WTRDSVTELW | | | |
| VKYSRADKI | | VKYSRADKI | | WTSGSIISFC | | | |
| VKYVWWTSN | | VKYVWWTSN | | WTSGSSIAFC | | | |
| VLAIYSCIA | | VLAIYSCIA | | WTSGSSISFC | | | |
| VLASTTAKA | | VLASTTAKA | | WTSNSIAVFC | | | |
| VLATGLRNA | | VLATGLRNA | | WTSNSIIAFC | | | |
| VLATGLRNI | | VLATGLRNI | | WTSNSIISMC | | | |
| VLATGLRNV | | VLATGLRNV | | WTSNSIIVFC | | | |
| VLATGPRNV | | VLATGPRNV | | WTSNSIVAFC | | | |
| VLDDCSLEG | | VLDDCSLEG | | WTSNSIVALC | | | |
| VLDDCSLKG | | VLDDCSLKG | | WTSNSIVSMC | | | |
| VLDGVTASC | | VLDGVTASC | | WTSNSIVTFC | | | |
| VLDNKNWSG | | VLDNKNWSG | | WTSNSIVVFC | | | |
| VLDTDWSGY | | VLDTDWSGY | | WTSNSLIALC | | | |
| VLEAMAFLE | | VLEAMAFLE | | WTSNSLVALC | | | |
| VLEAMALLE | | VLEAMALLE | | WTSNSMVTFC | | | |
| VLEDEQMYQ | | VLEDEQMYQ | | WTSSSIVVFC | | | |
| VLEKNVTVT | | VLEKNVTVT | | WTSSSSIVMC | | | |
| VLELIRMIK | | VLELIRMIK | | WTSSSSTVFC | | | |
| VLERNVTVT | | VLERNVTVT | | WTSSSSVVMC | | | |
| VLFQGGHIE | | VLFQGGHIE | | WTTNSIVVFC | | | |
| VLGDCSIAG | | VLGDCSIAG | | WTYNAELFVL | | | |
| VLGENMAPE | | VLGENMAPE | | WTYNAELLIL | | | |
| VLGIINLLI | | VLGIINLLI | | WTYNAELLVA | | | |
| VLGLSMVKS | | VLGLSMVKS | | WTYNAELLVL | | | |
| VLGLSMVRS | | VLGLSMVRS | | WTYNAEVLVL | | | |
| VLGNPKCDL | | VLGNPKCDL | | WTYNTELLVL | | | |
| VLGNYKEIC | | VLGNYKEIC | | WTYNVELLVL | | | |
| VLGNYKEIR | | VLGNYKEIR | | WTYQAELLVA | | | |
| VLGNYREIC | | VLGNYREIC | | WTYQEELLVA | | | |
| VLGNYREVC | | VLGNYREVC | | WVAVAKDNAI | | | |
| VLGVSILNL | | VLGVSILNL | | WVCSNGSCRC | | | |
| VLGVSVLNL | | VLGVSVLNL | | WVDDAVTDIW | | | |
| VLHLTQGAC | | VLHLTQGAC | | WVELDEIGED | | | |
| VLHLTQGTC | | VLHLTQGTC | | WVELIRGQPK | | | |
| VLIAGGLIL | | VLIAGGLIL | | WVELIRGRPE | | | |
| VLIENDRTL | | VLIENDRTL | | WVELIRGRPK | | | |
| VLIENERTL | | VLIENERTL | | WVELVRGRPK | | | |
| VLIENQKTL | | VLIENQKTL | | WVEMIRGEPE | | | |
| VLIGQGDIV | | VLIGQGDIV | | WVEMIRGKPE | | | |
| VLIGQGDVV | | VLIGQGDVV | | WVEMIRGQPK | | | |
| VLINTYQWI | | VLINTYQWI | | WVEMIRGRPE | | | |
| VLIVSLGAI | | VLIVSLGAI | | WVGENMAPE | | | |
| VLKPGETLK | | VLKPGETLK | | WVLLNASWFN | | | |
| VLKPGETLN | | VLKPGETLN | | WVLWISFAIS | | | |
| VLKPGQTLR | | VLKPGQTLR | | WVMTDGPANK | | | |
| VLKPGQTVK | | VLKPGQTVK | | WVMTDGPANN | | | |
| VLKSDKRIG | | VLKSDKRIG | | WVMTDGPANR | | | |
| VLKYKGIIT | | VLKYKGIIT | | WVMTDGPANS | | | |
| VLKYNGIIT | | VLKYNGIIT | | WVMTDGPASN | | | |
| VLKYNGMIT | | VLKYNGMIT | | WVPILNTSQR | | | |
| VLKYNGVIT | | VLKYNGVIT | | WVPKRNRSIL | | | |
| VLLEDERTL | | VLLEDERTL | | WVQNEFNKAC | | | |
| VLLENDKTL | | VLLENDKTL | | WVQSEFNKAC | | | |
| VLLENDRTL | | VLLENDRTL | | WVRFNSDLDY | | | |
| VLLENEKTL | | VLLENEKTL | | WVRINNETIL | | | |
| VLLENERTL | | VLLENERTL | | WVRMNNETIL | | | |

Fig. 83-424

| Block size 8 | SIN | Block size 9 | SIN | Block size 10 | SIN | Block size 11 | SIN |
|---|---|---|---|---|---|---|---|
| VLLENGRTL | | VLLENGRTL | | WVSFSISCFL | | | |
| VLLENQKIL | | VLLENQKIL | | WVSTDKDSNG | | | |
| VLLENQKPL | | VLLENQKPL | | WVSTDKNSNG | | | |
| VLLENQKTL | | VLLENQKTL | | WVSTDKSSNG | | | |
| VLLFMIIGG | | VLLFMIIGG | | WVTRELYVSC | | | |
| VLLGNQKTL | | VLLGNQKTL | | WVTREPYVSC | | | |
| VLLGSSPNA | | VLLGSSPNA | | WVVIAKDNAI | | | |
| VLLGTKHSN | | VLLGTKHSN | | WVVIAKDNAV | | | |
| VLLKHRFEI | | VLLKHRFEI | | WVVIAQDNAI | | | |
| VLLLMIIGG | | VLLLMIIGG | | WVVIEKDNAV | | | |
| VLLNASWFN | | VLLNASWFN | | WVVVAKDNAI | | | |
| VLLSPEEVS | | VLLSPEEVS | | WVVVAKDNAV | | | |
| VLLVSLGAI | | VLLVSLGAI | | WVWLWLVLRE | | | |
| VLLVSLGAV | | VLLVSLGAV | | WWASNSLIAL | | | |
| VLMENEMTL | | VLMENEMTL | | WWDGLQSSDD | | | |
| VLMENERTL | | VLMENERTL | | WWTSNSIAVF | | | |
| VLNKSLCKV | | VLNKSLCKV | | WWTSNSIISM | | | |
| VLNLLIGIS | | VLNLLIGIS | | WWTSNSIIVF | | | |
| VLNLLIGVS | | VLNLLIGVS | | WWTSNSIVAF | | | |
| VLNNKHWSG | | VLNNKHWSG | | WWTSNSIVAL | | | |
| VLNNKNWSG | | VLNNKNWSG | | WWTSNSIVSM | | | |
| VLNNMNWSG | | VLNNMNWSG | | WWTSNSIVVF | | | |
| VLNTDWSGY | | VLNTDWSGY | | WWTSNSLIAL | | | |
| VLNVSLHLK | | VLNVSLHLK | | WWTSNSLVAL | | | |
| VLRGFLIIG | | VLRGFLIIG | | WWTTNSIVVF | | | |
| VLRGFLILG | | VLRGFLILG | | WWVWLWLVLR | | | |
| VLRPGETLN | | VLRPGETLN | | WYGFHHSNAE | | | |
| VLRPGQTLR | | VLRPGQTLR | | WYGFHHSNSE | | | |
| VLSAFDERR | | VLSAFDERR | | WYGFKHQNAQ | | | |
| VLSCIFCLA | | VLSCIFCLA | | WYGFQHQNAE | | | |
| VLSIAPIMF | | VLSIAPIMF | | WYGFQHQNEQ | | | |
| VLSIIALLI | | VLSIIALLI | | WYGFQHQNSE | | | |
| VLSIIPSGP | | VLSIIPSGP | | WYGFQHRNDE | | | |
| VLSIVPSGP | | VLSIVPSGP | | WYGFQHRNEE | | | |
| VLSIYSCIA | | VLSIYSCIA | | WYGFQHSNAQ | | | |
| VLSVAPIMF | | VLSVAPIMF | | WYGFQHSNDQ | | | |
| VLTDNPRPN | | VLTDNPRPN | | WYGFQHSNEQ | | | |
| VLTDTSRPG | | VLTDTSRPG | | WYGFQHTNDQ | | | |
| VLTDTSRPK | | VLTDTSRPK | | WYGFRHHNSE | | | |
| VLTDTSRPS | | VLTDTSRPS | | WYGFRHLNSE | | | |
| VLTGNLQAL | | VLTGNLQAL | | WYGFRHQKAQ | | | |
| VLTGNLQTL | | VLTGNLQTL | | WYGFRHQNAE | | | |
| VLVALENQH | | VLVALENQH | | WYGFRHQNAQ | | | |
| VLVGLILAF | | VLVGLILAF | | WYGFRHQNSE | | | |
| VLVGLILSF | | VLVGLILSF | | WYGFRHQNSQ | | | |
| VLVGLILTF | | VLVGLILTF | | WYGFRHQNTQ | | | |
| VLVGPILSF | | VLVGPILSF | | WYGFRYQNSE | | | |
| VLVIWGIHH | | VLVIWGIHH | | WYGYHHENSQ | | | |
| VLVIWGVHH | | VLVIWGVHH | | WYGYHHQNEQ | | | |
| VLVLWAIHH | | VLVLWAIHH | | WYGYHHQNGQ | | | |
| VLVLWGIHH | | VLVLWGIHH | | WYGYHHSNDQ | | | |
| VLVLWGVHH | | VLVLWGVHH | | WYGYKHQNAQ | | | |
| VLVMKRKRD | | VLVMKRKRD | | WYGYRHQNAQ | | | |
| VLVMKRKRN | | VLVMKRKRN | | YAADKASTQK | | | |
| VLVMWGIHH | | VLVMWGIHH | | YAADKESTQK | | | |
| VLVMWGLHH | | VLVMWGLHH | | YAADKESTQR | | | |
| VLVNTYQWI | | VLVNTYQWI | | YAADKKSTQK | | | |
| VLVNTYQWV | | VLVNTYQWV | | YAADQESTQK | | | |
| VLVTREPYI | | VLVTREPYI | | YAADRESTQK | | | |
| VLVTREPYL | | VLVTREPYL | | YAADRESTQR | | | |
| VLVTREPYV | | VLVTREPYV | | YAADRKSTQK | | | |
| VLVVSLGAI | | VLVVSLGAI | | YAEESKLKRQ | | | |

Fig. 83-425

| Block size 8 | SIN | Block size 9 | SIN | Block size 10 | SIN | Block size 11 | SIN |
|---|---|---|---|---|---|---|---|
| VLWACQNGN | | VLWACQNGN | | YAELKWLISK | | | |
| VLWGIHHPD | | VLWGIHHPD | | YAELKWLVSK | | | |
| VLWISFAIS | | VLWISFAIS | | YAELLVAMEN | | | |
| VLWTSNSIV | | VLWTSNSIV | | YAEMEWLLSN | | | |
| VLWTSNSMV | | VLWTSNSMV | | YAEMKWLLSD | | | |
| VLWTSNSVV | | VLWTSNSVV | | YAEMKWLLSN | | | |
| VLYFWGIHH | | VLYFWGIHH | | YAEMKWLLSS | | | |
| VLYFWGVHH | | VLYFWGVHH | | YAGAINSSKP | | | |
| VMCVCRDNW | | VMCVCRDNW | | YAGAINSSRP | | | |
| VMEHTSQYL | | VMEHTSQYL | | YAGAVNSSKP | | | |
| VMELIRMIK | | VMELIRMIK | | YAKKASLRLA | | | |
| VMELIRMVK | | VMELIRMVK | | YALHQGTTIR | | | |
| VMELVRMIK | | VMELVRMIK | | YALSQGTTIR | | | |
| VMGARPQVN | | VMGARPQVN | | YAQTDCVLEA | | | |
| VMGLVFFCL | | VMGLVFFCL | | YARLYIWGVH | | | |
| VMGLVFICI | | VMGLVFICI | | YASKNPYTLV | | | |
| VMGQASYKI | | VMGQASYKI | | YASKTRISEI | | | |
| VMGQQGRMD | | VMGQQGRMD | | YASPQLEGFS | | | |
| VMKRKRDSS | | VMKRKRDSS | | YASSQLEGFS | | | |
| VMKRKRNSS | | VMKRKRNSS | | YATVAGSLSL | | | |
| VMLLAIAMG | | VMLLAIAMG | | YAVIHYGGIP | | | |
| VMNTSKPFQ | | VMNTSKPFQ | | YAVIHYGGMP | | | |
| VMNTSKPLQ | | VMNTSKPLQ | | YAVIHYGGVP | | | |
| VMREPFISC | | VMREPFISC | | YCFTVMTDGP | | | |
| VMTDGNASG | | VMTDGNASG | | YCICRDNWKG | | | |
| VMTDGPANK | | VMTDGPANK | | YCNTDLGAPL | | | |
| VMTDGPANN | | VMTDGPANN | | YCNTDLGSPL | | | |
| VMTDGPANR | | VMTDGPANR | | YCNTDLGTPL | | | |
| VMTDGPANS | | VMTDGPANS | | YCRATEYIMK | | | |
| VMTDGPASN | | VMTDGPASN | | YCSLNGISPI | | | |
| VMTDGPASS | | VMTDGPASS | | YCSLNGISPV | | | |
| VMTDGSALG | | VMTDGSALG | | YCSLNGVSPI | | | |
| VMTDGSASD | | VMTDGSASD | | YCSLNGVSPV | | | |
| VMTDGSASE | | VMTDGSASE | | YCVCRDNWKG | | | |
| VMTDGSASG | | VMTDGSASG | | YCYPGATMNE | | | |
| VMTDGSASR | | VMTDGSASR | | YCYPGATVNE | | | |
| VMTDGSASS | | VMTDGSASS | | YCYPGSTVNE | | | |
| VMTDGSATG | | VMTDGSATG | | YCYPGTTVNE | | | |
| VMTHTSQYI | | VMTHTSQYI | | YDAIEECLIN | | | |
| VMVGLILAF | | VMVGLILAF | | YDAVATTHSW | | | |
| VNATETVEI | | VNATETVEI | | YDFEKEGYSL | | | |
| VNATETVEN | | VNATETVEN | | YDFEREGYSL | | | |
| VNATETVEQ | | VNATETVEQ | | YDGKAWLHIC | | | |
| VNATETVER | | VNATETVER | | YDGKAWLHVC | | | |
| VNATETVET | | VNATETVET | | YDHAQYREEA | | | |
| VNDRNFWRG | | VNDRNFWRG | | YDHKDYEEEA | | | |
| VNEEALRQI | | VNEEALRQI | | YDHKEFEEES | | | |
| VNEEALRQK | | VNEEALRQK | | YDHKEFEKES | | | |
| VNEGALRQK | | VNEGALRQK | | YDHKEFKEES | | | |
| VNESADMSI | | VNESADMSI | | YDHKEYEEEA | | | |
| VNFLSMEFS | | VNFLSMEFS | | YDHNIYRDEA | | | |
| VNFSFNGAF | | VNFSFNGAF | | YDHSQYREEA | | | |
| VNFVIEKMN | | VNFVIEKMN | | YDHTQYREEA | | | |
| VNFVSMEFS | | VNFVSMEFS | | YDKICIGYQT | | | |
| VNGALGSPG | | VNGALGSPG | | YDKVRLQLKD | | | |
| VNGEALRQI | | VNGEALRQI | | YDKVRLQLRD | | | |
| VNGPESVLV | | VNGPESVLV | | YDKVRMQLKD | | | |
| VNGQAGRID | | VNGQAGRID | | YDKVRMQLRD | | | |
| VNGQAGRMT | | VNGQAGRMT | | YDNGVWIGRT | | | |
| VNGQFGRID | | VNGQFGRID | | YDRICIGYQS | | | |
| VNGQFGRIN | | VNGQFGRIN | | YDRRLTTTIK | | | |
| VNGQRGRID | | VNGQRGRID | | YDRVRKQLRQ | | | |

Fig. 83-426

| Block size 8 | SIN | Block size 9 | SIN | Block size 10 | SIN | Block size 11 | SIN |
|---|---|---|---|---|---|---|---|
| VNGQSGRID | | VNGQSGRID | | YDRVRLQLRD | | | |
| VNGQSGRIE | | VNGQSGRIE | | YDRVRMQLRD | | | |
| VNGQSGRIN | | VNGQSGRIN | | YDSIRGEFNQ | | | |
| VNGQSGRIV | | VNGQSGRIV | | YDSIRGEFSQ | | | |
| VNGQTGRID | | VNGQTGRID | | YDVGYLCAGI | | | |
| VNGVKLEEN | | VNGVKLEEN | | YDWTLNRNQP | | | |
| VNGWYGFRH | | VNGWYGFRH | | YDYIKYEEES | | | |
| VNICKAAMG | | VNICKAAMG | | YDYPKYEEES | | | |
| VNIDRFLRV | | VNIDRFLRV | | YDYPKYSEEA | | | |
| VNIKSLKLA | | VNIKSLKLA | | YDYPKYSEES | | | |
| VNKITYGAC | | VNKITYGAC | | YDYPKYSKES | | | |
| VNKNPYTLV | | VNKNPYTLV | | YDYSKYEEES | | | |
| VNKTTVINK | | VNKTTVINK | | YEAIEECLIN | | | |
| VNLGLNIGL | | VNLGLNIGL | | YEAVEECLIN | | | |
| VNMTNVQNN | | VNMTNVQNN | | YEDESRIERQ | | | |
| VNNGKGRYG | | VNNGKGRYG | | YEECSCYPDA | | | |
| VNNITTTII | | VNNITTTII | | YEECSCYPDS | | Blocksize | |
| VNNITTTIV | | VNNITTTIV | | YEECSCYPDT | | 8 | |
| VNNIVDKMN | | VNNIVDKMN | | YEECSCYPES | | 9 | |
| VNNPNWSGY | | VNNPNWSGY | | YEECSCYPNA | | 10 | |
| VNNQDWSGY | | VNNQDWSGY | | YEEEAKLEKS | | 11 | |
| VNNQNWSGY | | VNNQNWSGY | | YEEEAKLERS | | Total | |
| VNNTTIINK | | VNNTTIINK | | YEEESKIERQ | | | |
| VNNTTIISK | | VNNTTIISK | | YEEESKLERQ | | | |
| VNNTTIITK | | VNNTTIITK | | YEEESKLKRN | | | |
| VNNTTVINK | | VNNTTVINK | | YEEESKLKRQ | | | |
| VNPGDSIIF | | VNPGDSIIF | | YEEESKLNKN | | | |
| VNPTLLFLE | | VNPTLLFLE | | YEEESKLNRN | | | |
| VNPTLLFLK | | VNPTLLFLK | | YEEESKLNRS | | | |
| VNQITGKLN | | VNQITGKLN | | YEEESKLNRT | | | |
| VNRANQRLN | | VNRANQRLN | | YEEESRIERQ | | | |
| VNRCFYVEL | | VNRCFYVEL | | YEEESRLNRN | | | |
| VNREPYVSC | | VNREPYVSC | | YEELKEQLST | | | |
| VNRFYRTCK | | VNRFYRTCK | | YEELKHLLNR | | | |
| VNRITYGAC | | VNRITYGAC | | YEELKHLLSR | | | |
| VNRITYGPC | | VNRITYGPC | | YEELKHLLSS | | | |
| VNRITYGVC | | VNRITYGVC | | YEELKHLMSS | | | |
| VNRTHQYSE | | VNRTHQYSE | | YEELREHLSS | | | |
| VNSALGSPG | | VNSALGSPG | | YEELREQLSS | | | |
| VNSFSRTEL | | VNSFSRTEL | | YEELREQLST | | | |
| VNSIIDKMN | | VNSIIDKMN | | YEFSNLERRI | | | |
| VNSIIEKMN | | VNSIIEKMN | | YEILKVPNAE | | | |
| VNSIIGKMN | | VNSIIGKMN | | YEKNATASFI | | | |
| VNSIINKMN | | VNSIINKMN | | YEKVRLQLRD | | | |
| VNSSKPFQN | | VNSSKPFQN | | YEKVRMQLRD | | | |
| VNSSMPFHN | | VNSSMPFHN | | YEKVRRQLRE | | | |
| VNSVIEKIN | | VNSVIEKIN | | YELEIGARIG | | | |
| VNSVIEKMN | | VNSVIEKMN | | YELEIGTRIG | | | |
| VNSVVEKMN | | VNSVVEKMN | | YEMLKVPDAE | | | |
| VNSWHIFSK | | VNSWHIFSK | | YEMLKVPNAE | | | |
| VNSWHILSK | | VNSWHILSK | | YEMLKVPNAL | | | |
| VNTALLNAS | | VNTALLNAS | | YENNTWVNQT | | | |
| VNTIIENNV | | VNTIIENNV | | YENTTWVNQT | | | |
| VNTILEKNV | | VNTILEKNV | | YEQMETDGDR | | | |
| VNTILSTKA | | VNTILSTKA | | YEQMETDGER | | | |
| VNTLAERGV | | VNTLAERGV | | YEQMETGGER | | | |
| VNTLIEQNI | | VNTLIEQNI | | YEQMETSGER | | | |
| VNTLIEQNV | | VNTLIEQNV | | YERMCNILKG | | | |
| VNTLLENDV | | VNTLLENDV | | YERRLTTTIK | | | |
| VNTLSEQNV | | VNTLSEQNV | | YERVKKQLRE | | | |
| VNTLTEKGI | | VNTLTEKGI | | YERVKMFDFI | | | |
| VNTLTEKGV | | VNTLTEKGV | | YERVKMFDFS | | | |

Fig. 83-427

| Block size 8 | SIN | Block size 9 | SIN | Block size 10 | SIN | Block size 11 | SIN |
|---|---|---|---|---|---|---|---|
| VNTLTEQNV | | VNTLTEQNV | | YERVKMFDFT | | | |
| VNTLTEREV | | VNTLTEREV | | YERVKRQLRE | | | |
| VNTLTERGI | | VNTLTERGI | | YERVRKQLRA | | | |
| VNTLTERGV | | VNTLTERGV | | YERVRKQLRE | | | |
| VNTNKTFQN | | VNTNKTFQN | | YERVRKQLRQ | | | |
| VNTNTINRS | | VNTNTINRS | | YERVRRQLRE | | | |
| VNTTLSTIA | | VNTTLSTIA | | YESIEECLIN | | | |
| VNTVLSIIA | | VNTVLSIIA | | YESTQAAIDQ | | | |
| VNTYQWIIK | | VNTYQWIIK | | YETFKVIGGW | | | |
| VNTYQWIIR | | VNTYQWIIR | | YETFRVIDGW | | | |
| VNTYQWVIR | | VNTYQWVIR | | YETFRVIGGW | | | |
| VNVKSLKLA | | VNVKSLKLA | | YETFRVISGW | | | |
| VNVRGSGLR | | VNVRGSGLR | | YEVGYLCAGI | | | |
| VNVRGSGMR | | VNVRGSGMR | | YEVLKVPDAE | | | |
| VNVRGTGMR | | VNVRGTGMR | | YEVLKVPNAE | | | |
| VNVRSLKLA | | VNVRSLKLA | | YFFGDNAEEF | | | |
| VNVTHVQNN | | VNVTHVQNN | | YFFGDNAEEY | | | |
| VNVTNVQND | | VNVTNVQND | | YFFGDNAKEY | | | |
| VNVTNVQNN | | VNVTNVQNN | | YFFGDSAEEY | | | |
| VNYVSMEFS | | VNYVSMEFS | | YFFLKVPVQN | | | |
| VPAQNAISI | | VPAQNAISI | | YFHDSNVKNL | | | |
| VPAQNAIST | | VPAQNAIST | | YFHKGIVIKE | | | |
| VPASRYLID | | VPASRYLID | | YFHKGLIIKE | | | |
| VPASRYLTD | | VPASRYLTD | | YFHKGLLIKE | | | |
| VPCFWLEMI | | VPCFWLEMI | | YFHKGLVIKE | | | |
| VPCFWVEMI | | VPCFWVEMI | | YFHKGLVVKE | | | |
| VPDYQSIRS | | VPDYQSIRS | | YFLDVFAGDT | | | |
| VPDYQSLRS | | VPDYQSLRS | | YFQLFLVCVS | | | |
| VPEKIHTRG | | VPEKIHTRG | | YFTAEISHCR | | | |
| VPEKIRTRG | | VPEKIRTRG | | YFTAEVSHCR | | | |
| VPEKIRVKR | | VPEKIRVKR | | YFTAEVSYCR | | | |
| VPERNEQGQ | | VPERNEQGQ | | YFTTEVSHCR | | | |
| VPESMREEY | | VPESMREEY | | YFVKEGKIVH | | | |
| VPEWSWDDG | | VPEWSWDDG | | YGAGNKLITV | | | |
| VPEWSYIIE | | VPEWSYIIE | | YGAGSWPDGA | | | |
| VPEWSYIME | | VPEWSYIME | | YGAIEECLIN | | | |
| VPEWSYIVE | | VPEWSYIVE | | YGAQSLSISV | | | |
| VPEYQSLRS | | VPEYQSLRS | | YGDGVWIGRT | | | |
| VPFHLATKQ | | VPFHLATKQ | | YGFHHSNAEG | | | |
| VPFHLGTKQ | | VPFHLGTKQ | | YGFHHSNSEG | | | |
| VPFHLGTRQ | | VPFHLGTRQ | | YGFIIKGRSH | | | |
| VPFSKDNSI | | VPFSKDNSI | | YGFIVKGRSH | | | |
| VPFYLGTKQ | | VPFYLGTKQ | | YGFKHQNAQG | | | |
| VPGVKGFGF | | VPGVKGFGF | | YGFKISKRGG | | | |
| VPGWSWDDG | | VPGWSWDDG | | YGFKISKRGN | | | |
| VPGYQSLRS | | VPGYQSLRS | | YGFKISKRGS | | | |
| VPILNTSQR | | VPILNTSQR | | YGFQHQNAEG | | | |
| VPKRNRSIL | | VPKRNRSIL | | YGFQHQNEQG | | | |
| VPKSMREEY | | VPKSMREEY | | YGFQHQNSEG | | | |
| VPLGSSPNA | | VPLGSSPNA | | YGFQHRDEEG | | | |
| VPLVPCEPI | | VPLVPCEPI | | YGFQHRNEEG | | | |
| VPMGSSPNA | | VPMGSSPNA | | YGFQHSNAQG | | | |
| VPNAGTDPN | | VPNAGTDPN | | YGFQHSNDQG | | | |
| VPNALTDDK | | VPNALTDDK | | YGFQHSNEQG | | | |
| VPNALTDDR | | VPNALTDDR | | YGFQHTNDQG | | | |
| VPNALTDER | | VPNALTDER | | YGFRHHNSEG | | | |
| VPNALTDNR | | VPNALTDNR | | YGFRHLNSEG | | | |
| VPNGTIVKT | | VPNGTIVKT | | YGFRHQKAQG | | | |
| VPNGTIVRT | | VPNGTIVRT | | YGFRHQNAEG | | | |
| VPNGTKVNT | | VPNGTKVNT | | YGFRHQNAQG | | | |
| VPNGTLVKT | | VPNGTLVKT | | YGFRHQNSEG | | | |
| VPNGTMVKT | | VPNGTMVKT | | YGFRHQNSQG | | | |

Fig. 83-428

| Block size 8 | SIN | Block size 9 | SIN | Block size 10 | SIN | Block size 11 | SIN |
|---|---|---|---|---|---|---|---|
| VPNGTVVKT | | VPNGTVVKT | | YGFRHQNTQG | | | |
| VPNIGSRPR | | VPNIGSRPR | | YGFRISKRGS | | | |
| VPNYQSLRS | | VPNYQSLRS | | YGFRYQNSEG | | | |
| VPPLELGDC | | VPPLELGDC | | YGFVANFSME | | | |
| VPPLGSAQA | | VPPLGSAQA | | YGGIPTDVVR | | | |
| VPQAQDRGL | | VPQAQDRGL | | YGGLNKSKPY | | | |
| VPQAQNRGL | | VPQAQNRGL | | YGGMPTDVVR | | | |
| VPQIEARGL | | VPQIEARGL | | YGGVPTDVIR | | | |
| VPQIEPRGL | | VPQIEPRGL | | YGGVPTDVMR | | | |
| VPQIESRGL | | VPQIESRGL | | YGGVPTDVVR | | | |
| VPQIQNRGL | | VPQIQNRGL | | YGHLITGKSH | | | |
| VPQMESRGL | | VPQMESRGL | | YGHLTTGKSH | | | |
| VPQVQDRGL | | VPQVQDRGL | | YGHLVTGKSH | | | |
| VPQVQNRGL | | VPQVQNRGL | | YGKDNAIRIG | | | |
| VPSERGLQR | | VPSERGLQR | | YGKDNAVRIG | | | |
| VPSFDMNNE | | VPSFDMNNE | | YGKGRIFQSH | | | |
| VPSFDMSKE | | VPSFDMSKE | | YGKGRIFQSP | | | |
| VPSFDMSND | | VPSFDMSND | | YGKGRIFQSR | | | |
| VPSFDMSNE | | VPSFDMSNE | | YGNCDAKCQT | | | |
| VPSFEMSNE | | VPSFEMSNE | | YGNCDTKCQT | | | |
| VPSGPLKAE | | VPSGPLKAE | | YGNCNAKCQT | | | |
| VPSIQSRGL | | VPSIQSRGL | | YGNCNTKCQT | | | |
| VPSPYNSRF | | VPSPYNSRF | | YGNDVWMGRT | | | |
| VPTDVIRSW | | VPTDVIRSW | | YGNGAWIGRT | | | |
| VPTDVMRSW | | VPTDVMRSW | | YGNGVWIGRT | | | |
| VPTDVVRSW | | VPTDVVRSW | | YGNGVWMGRT | | | |
| VPVGSGSFP | | VPVGSGSFP | | YGNPKCDIHL | | | |
| VPVIGARPQ | | VPVIGARPQ | | YGNPKCDTHL | | | |
| VPVMGARPQ | | VPVMGARPQ | | YGNPKCDVHL | | | |
| VPVQNAIST | | VPVQNAIST | | YGPALSINEL | | | |
| VPVTQAMEL | | VPVTQAMEL | | YGPALSISEL | | | |
| VPVTQTMEL | | VPVTQTMEL | | YGPINVTKEN | | | |
| VPVTQVEEL | | VPVTQVEEL | | YGRGRIFQSR | | | |
| VPVTSSIDL | | VPVTSSIDL | | YGRIIQNEDI | | | |
| VPVTSSVDL | | VPVTSSVDL | | YGSDVWMGRT | | | |
| VPVTSTIDL | | VPVTSTIDL | | YGSENKLITV | | | |
| VPVVGARPQ | | VPVVGARPQ | | YGSGAKLITV | | | |
| VPVVGDRPL | | VPVVGDRPL | | YGSGNKLITV | | | |
| VPVVRARPQ | | VPVVRARPQ | | YGSGNKLVTV | | | |
| VQAMRAIGT | | VQAMRAIGT | | YGSGRIFQSG | | | |
| VQAMRAVGT | | VQAMRAVGT | | YGSGSKLITV | | | |
| VQAMRTIGT | | VQAMRTIGT | | YGSGSWPDGA | | | |
| VQAMRTVGT | | VQAMRTVGT | | YGTGNKLITV | | | |
| VQDIIDNDN | | VQDIIDNDN | | YGTGRIFQSG | | | |
| VQDIIDNNN | | VQDIIDNNN | | YGTGRIFQSR | | | |
| VQDRGLFGA | | VQDRGLFGA | | YGTGSWPDGA | | | |
| VQGNNDNAT | | VQGNNDNAT | | YGTGTWPDGA | | | |
| VQGNNKNAT | | VQGNNKNAT | | YGTQPLSISV | | | |
| VQGNNNNAT | | VQGNNNNAT | | YGTQSLSISI | | | |
| VQHLEECSC | | VQHLEECSC | | YGTQSLSISV | | | |
| VQHPELTGL | | VQHPELTGL | | YGVKGFGFRQ | | | |
| VQHPELTGM | | VQHPELTGM | | YGVKGFSFRY | | | |
| VQHPEMTGL | | VQHPEMTGL | | YGYHHENSQG | | | |
| VQIIKLLPF | | VQIIKLLPF | | YGYHHNEQG | | | |
| VQITGKLNR | | VQITGKLNR | | YGYHHQNGQG | | | |
| VQMCTELKL | | VQMCTELKL | | YGYHHSNDQG | | | |
| VQMQRFRRP | | VQMQRFRRP | | YGYIIEEYGK | | | |
| VQNAISTTF | | VQNAISTTF | | YGYIIEEYGR | | | |
| VQNALNGNG | | VQNALNGNG | | YGYIIEKYGS | | | |
| VQNALSGNG | | VQNALSGNG | | YGYIIEKYGT | | | |
| VQNEFNKAC | | VQNEFNKAC | | YGYKHQNAQG | | | |
| VQNRGLFGA | | VQNRGLFGA | | YGYLITGKSH | | | |

Fig. 83-429

| Block size 8 | SIN | Block size 9 | SIN | Block size 10 | SIN | Block size 11 | SIN |
|---|---|---|---|---|---|---|---|
| VQPAFSVQR | | VQPAFSVQR | | YGYRHQNAQG | | | |
| VQPGDNITF | | VQPGDNITF | | YHANNSKKQI | | | |
| VQPTFSVQR | | VQPTFSVQR | | YHANNSTDTI | | | |
| VQQTRVDKL | | VQQTRVDKL | | YHANNSTDTV | | | |
| VQQTRVDRL | | VQQTRVDRL | | YHANNSTEQV | | | |
| VQRNLPFDK | | VQRNLPFDK | | YHANNSTETV | | | |
| VQRNLPFEK | | VQRNLPFEK | | YHANNSTKQI | | | |
| VQRNLPFER | | VQRNLPFER | | YHANNSTKQV | | | |
| VQRSLPFER | | VQRSLPFER | | YHANNSTTKV | | | |
| VQSEFNKAC | | VQSEFNKAC | | YHANNSTTQI | | | |
| VQSKMQFSS | | VQSKMQFSS | | YHANNSTTQV | | | |
| VQSRGLFGA | | VQSRGLFGA | | YHDSNVKNLY | | | |
| VQSRMQFSS | | VQSRMQFSS | | YHFEECSCYP | | | |
| VQSYFQLFL | | VQSYFQLFL | | YHHENSQGSG | | | |
| VQTDEYKNT | | VQTDEYKNT | | YHHQNAQGSG | | | |
| VQVDTIMEK | | VQVDTIMEK | | YHHQNEQGSG | | | |
| VQVIKLLPF | | VQVIKLLPF | | YHHQNGQGSG | | | |
| VRARPQVNG | | VRARPQVNG | | YHHSNDQGAG | | | |
| VRCICKDNW | | VRCICKDNW | | YHHSNDQGSG | | | |
| VRCICRDNW | | VRCICRDNW | | YHKCDDECIE | | | |
| VRCVCRDNW | | VRCVCRDNW | | YHKCDDECMD | | | |
| VREGRNPGN | | VREGRNPGN | | YHKCDDECMN | | | |
| VREKDMTKE | | VREKDMTKE | | YHKCDDECMS | | | |
| VREPFISCS | | VREPFISCS | | YHKCDNECIE | | | |
| VREQQGRMD | | VREQQGRMD | | YHKCDNECMD | | | |
| VRESRNPGN | | VRESRNPGN | | YHKCDNGCIE | | | |
| VREWSYLIE | | VREWSYLIE | | YHKCDNKCIE | | | |
| VRFGESEQI | | VRFGESEQI | | YHKCNDECMN | | | |
| VRFNSDLDY | | VRFNSDLDY | | YHKCNNECIE | | | |
| VRFQLKDNA | | VRFQLKDNA | | YHQIEKEFEQ | | | |
| VRGDLNFVN | | VRGDLNFVN | | YHQIEKEFGQ | | | |
| VRGDQICIG | | VRGDQICIG | | YHQSFVPSPG | | | |
| VRGDQICVG | | VRGDQICVG | | YHTGRSSFFR | | | |
| VRGDQMAHC | | VRGDQMAHC | | YHWNLALDIV | | | |
| VRGDYNNTT | | VRGDYNNTT | | YHYEECSCYP | | | |
| VRGLSSRIS | | VRGLSSRIS | | YICSGFFGDN | | | |
| VRGNSPAFN | | VRGNSPAFN | | YICSGIFGDN | | | |
| VRGNSPVFN | | VRGNSPVFN | | YICSGLVGDT | | | |
| VRGQQGRMD | | VRGQQGRMD | | YICSGVFGDN | | | |
| VRGQQGTMD | | VRGQQGTMD | | YICSGVFGDS | | | |
| VRGQQGWMD | | VRGQQGWMD | | YICSGVFGDT | | | |
| VRGQSGRIS | | VRGQSGRIS | | YICSGVLGDN | | | |
| VRGQSGRVS | | VRGQSGRVS | | YICSKFHSDT | | | |
| VRGSGLRIL | | VRGSGLRIL | | YICSPVLTDN | | | |
| VRGSGMRIL | | VRGSGMRIL | | YICTGILTDT | | | |
| VRGTGMRIL | | VRGTGMRIL | | YICTGVLTDT | | | |
| VRHFEKVKI | | VRHFEKVKI | | YIEGKLSQMS | | | |
| VRHNGTCAV | | VRHNGTCAV | | YIELIRGKPN | | | |
| VRHQLRDNA | | VRHQLRDNA | | YIELIRGRPN | | | |
| VRHQLRENA | | VRHQLRENA | | YIEVLHLTQG | | | |
| VRHRLKITE | | VRHRLKITE | | YIGKCPKYIP | | | |
| VRIGSKGDV | | VRIGSKGDV | | YIGKCPKYIS | | | |
| VRINNETIL | | VRINNETIL | | YIGKCPRYIP | | | |
| VRKASLRLA | | VRKASLRLA | | YIIEEYGKGR | | | |
| VRKMMTNSH | | VRKMMTNSH | | YIIEEYGRGR | | | |
| VRKMMTNSQ | | VRKMMTNSQ | | YIIEKYGSGR | | | |
| VRKMMTSSQ | | VRKMMTSSQ | | YIIEKYGTGR | | | |
| VRKQLRENA | | VRKQLRENA | | YIIRALTLNT | | | |
| VRKQLRQNA | | VRKQLRQNA | | YIKQGSLKLA | | | |
| VRKRFADQE | | VRKRFADQE | | YIKQNTLKLA | | | |
| VRKTRFLPV | | VRKTRFLPV | | YIKSDQLKLA | | | |
| VRLEENTTY | | VRLEENTTY | | YIKSGQLKLA | | | |

Fig. 83-430

| Block size 8 | SIN | Block size 9 | SIN | Block size 10 | SIN | Block size 11 | SIN |
|---|---|---|---|---|---|---|---|
| VRLFDYSRW | | VRLFDYSRW | | YINKTGTFEF | | | |
| VRLQLKDNA | | VRLQLKDNA | | YINRTGTFEF | | | |
| VRLQLRDNA | | VRLQLRDNA | | YINTALLNAS | | | |
| VRLQLRNNA | | VRLQLRNNA | | YINTAMLNAS | | | |
| VRLSAGGDI | | VRLSAGGDI | | YIPSGSLKLA | | | |
| VRLSASGDI | | VRLSASGDI | | YIPSNSLKLA | | | |
| VRLSSGYKD | | VRLSSGYKD | | YIPSRSLKLA | | | |
| VRLTQGYKD | | VRLTQGYKD | | YIQMCTELKL | | | |
| VRLYLWGVH | | VRLYLWGVH | | YIQMCTELQL | | | |
| VRMIKRGIN | | VRMIKRGIN | | YIRTNGTSKI | | | |
| VRMNNETIL | | VRMNNETIL | | YISIGTSTLN | | | |
| VRMQLKDNA | | VRMQLKDNA | | YISSGSLKLA | | | |
| VRMQLRDNA | | VRMQLRDNA | | YISVGTSTLN | | | |
| VRMQLRDNV | | VRMQLRDNV | | YIVERPKEIE | | | |
| VRNDDIDQS | | VRNDDIDQS | | YIVERPKEME | | | |
| VRNDDVDQS | | VRNDDVDQS | | YIVERPSAPE | | | |
| VRNGTYDHK | | VRNGTYDHK | | YIVERTKEME | | | |
| VRNGTYDYP | | VRNGTYDYP | | YIWGVHHPST | | | |
| VRNLHDQIK | | VRNLHDQIK | | YIWTYQAELL | | | |
| VRNLHDQIR | | VRNLHDQIR | | YKALSIYSCI | | | |
| VRNLHDQVK | | VRNLHDQVK | | YKDIILWFSF | | | |
| VRNLHDQVR | | VRNLHDQVR | | YKDIILWISF | | | |
| VRNLHDRIR | | VRNLHDRIR | | YKDIILWVSF | | | |
| VRNLHDRTR | | VRNLHDRTR | | YKDVIIWFSF | | | |
| VRNLHDRVK | | VRNLHDRVK | | YKDVILWFSF | | | |
| VRNLHDRVR | | VRNLHDRVR | | YKDVILWFSL | | | |
| VRNLHEQIK | | VRNLHEQIK | | YKDWILWISF | | | |
| VRNLHEQVR | | VRNLHEQVR | | YKDWVLWISF | | | |
| VRNLHERIR | | VRNLHERIR | | YKEESQLKRQ | | | |
| VRNLYDKVR | | VRNLYDKVR | | YKEICIAWSS | | | |
| VRNQSGRIS | | VRNQSGRIS | | YKEICVAWSS | | | |
| VRPGDNITF | | VRPGDNITF | | YKEIRIAWSS | | | |
| VRPGYNGQK | | VRPGYNGQK | | YKEVILWFSF | | | |
| VRPGYNGQR | | VRPGYNGQR | | YKGRLCNPLN | | | |
| VRPLILKDC | | VRPLILKDC | | YKHQNAQGEG | | | |
| VRPLILRDC | | VRPLILRDC | | YKILKIKKGK | | | |
| VRPRYNGQR | | VRPRYNGQR | | YKILKIRKGK | | | |
| VRQCFNPMI | | VRQCFNPMI | | YKILSICSCI | | | |
| VRQCFNPMT | | VRQCFNPMT | | YKILSIYSCI | | | |
| VRQCFNPMV | | VRQCFNPMV | | YKILSIYSSV | | | |
| VRRAAVSAD | | VRRAAVSAD | | YKILSIYSTV | | | |
| VRRAIVSAD | | VRRAIVSAD | | YKILTIYSTA | | | |
| VRRATVSAD | | VRRATVSAD | | YKILTIYSTV | | | |
| VRRDQMAHC | | VRRDQMAHC | | YKISKSTKST | | | |
| VRRIWRQAN | | VRRIWRQAN | | YKKLKREITF | | | |
| VRRQLRENA | | VRRQLRENA | | YKKLKREMTF | | | |
| VRRRLSANA | | VRRRLSANA | | YKMNIQILIL | | | |
| VRRRLSTNA | | VRRRLSTNA | | YKMNNQILIL | | | |
| VRRRLSVNA | | VRRRLSVNA | | YKMNTKILVL | | | |
| VRSDGNLIA | | VRSDGNLIA | | YKMNTQILIF | | | |
| VRSDKICLG | | VRSDKICLG | | YKMNTQILIL | | | |
| VRSEKLVLA | | VRSEKLVLA | | YKMNTQILVF | | | |
| VRSGMDPRM | | VRSGMDPRM | | YKMNTRILIL | | | |
| VRSLKLATG | | VRSLKLATG | | YKNANTLSSV | | | |
| VRSNGNLIA | | VRSNGNLIA | | YKNANTLTSV | | | |
| VRSQLRDNA | | VRSQLRDNA | | YKNNTWVNQT | | | |
| VRSQSGRIS | | VRSQSGRIS | | YKNTNTLSSV | | | |
| VRSWKKQIL | | VRSWKKQIL | | YKNWILWISF | | | |
| VRSWRKKIL | | VRSWRKKIL | | YKRIRLFDYS | | | |
| VRSWRKQIL | | VRSWRKQIL | | YKRVRLFDYS | | | |
| VRSWRRQIL | | VRSWRRQIL | | YKSTPSAIDQ | | | |
| VRTGMDPRM | | VRTGMDPRM | | YKSTQAAIDQ | | | |

Fig. 83-431

| Block size 8 | SIN | Block size 9 | SIN | Block size 10 | SIN | Block size 11 | SIN |
|---|---|---|---|---|---|---|---|
| VRTLFQQMR | | VRTLFQQMR | | YKSTQAAVDQ | | | |
| VRTNGTSKI | | VRTNGTSKI | | YKSTQKTIDQ | | | |
| VRTNGTSKV | | VRTNGTSKV | | YKSTQSAIDQ | | | |
| VSADPLASL | | VSADPLASL | | YKSTQSAINQ | | | |
| VSADPLLSL | | VSADPLLSL | | YKSTQSAVDQ | | | |
| VSAGGDIWV | | VSAGGDIWV | | YKSTQSAVNQ | | | |
| VSAKELVET | | VSAKELVET | | YKSWSKPQCQ | | | |
| VSCDPDECR | | VSCDPDECR | | YKVATGRVTV | | | |
| VSCDPDGCR | | VSCDPDGCR | | YKVGYLCAGI | | | |
| VSCDPLGCK | | VSCDPLGCK | | YKVLAIYSCI | | | |
| VSCDPLGCR | | VSCDPLGCR | | YKVLSIYSCI | | | |
| VSCDPNECR | | VSCDPNECR | | YKYGNGVWIG | | | |
| VSCDPSGCK | | VSCDPSGCK | | YKYKIFKNGK | | | |
| VSCDPTGCK | | VSCDPTGCK | | YLCAGIPSDT | | | |
| VSCEPDECR | | VSCEPDECR | | YLCAGIPTDT | | | |
| VSCGPSECR | | VSCGPSECR | | YLCAGLPSDT | | | |
| VSCSHLECR | | VSCSHLECR | | YLCSGLVGDT | | | |
| VSCVCRDNW | | VSCVCRDNW | | YLCSKILTDT | | | |
| VSDGGPNLY | | VSDGGPNLY | | YLCSKTLTDT | | | |
| VSECRTFFL | | VSECRTFFL | | YLCSKVLTDT | | | |
| VSEEALRQK | | VSEEALRQK | | YLCSRILTDT | | | |
| VSEWSYIVE | | VSEWSYIVE | | YLCSRVLTDT | | | |
| VSFESNGGL | | VSFESNGGL | | YLCTGILTDT | | | |
| VSFHLGTKQ | | VSFHLGTKQ | | YLCTGVLTDT | | | |
| VSFQGGHIE | | VSFQGGHIE | | YLECRTFFLT | | | |
| VSFQGRGVF | | VSFQGRGVF | | YLEEHPNAGK | | | |
| VSFRGRGVF | | VSFRGRGVF | | YLEEHPSAGK | | | |
| VSFSISCFL | | VSFSISCFL | | YLEEHPSAGR | | | |
| VSFWMCSNG | | VSFWMCSNG | | YLEEHPSTGK | | | |
| VSFYWTIVE | | VSFYWTIVE | | YLEENPSAGK | | | |
| VSGADDDAY | | VSGADDDAY | | YLEKANKIKS | | | |
| VSGADNDAY | | VSGADNDAY | | YLEKANKIKT | | | |
| VSGEVPGWS | | VSGEVPGWS | | YLEKASKIKS | | | |
| VSGINESAD | | VSGINESAD | | YLIEDPAAPH | | | |
| VSGPDNGAV | | VSGPDNGAV | | YLIEDPGAPH | | | |
| VSGPNNNAS | | VSGPNNNAS | | YLIEDPNAPH | | | |
| VSGTDDDAY | | VSGTDDDAY | | YLIEDPNAPN | | | |
| VSGVNESAD | | VSGVNESAD | | YLIEDPSAPH | | | |
| VSHCRATEY | | VSHCRATEY | | YLIEDPTAPH | | | |
| VSHNGTWAV | | VSHNGTWAV | | YLIGKTSWSY | | | |
| VSIDRFLRV | | VSIDRFLRV | | YLIRALTLNT | | | |
| VSIGTSTLN | | VSIGTSTLN | | YLIRTLTLNT | | | |
| VSILNLGQK | | VSILNLGQK | | YLITGKSHGR | | | |
| VSILNLGQR | | VSILNLGQR | | YLLFQDILMR | | | |
| VSKDNGIRI | | VSKDNGIRI | | YLLKGESHCR | | | |
| VSKDNGIRV | | VSKDNGIRV | | YLLKGESHGK | | | |
| VSKMGVDEY | | VSKMGVDEY | | YLLKGESHGR | | | |
| VSKTGVDEY | | VSKTGVDEY | | YLLKGESYGR | | | |
| VSKVGVDEY | | VSKVGVDEY | | YLLLNKSLCN | | | |
| VSLGAISFW | | VSLGAISFW | | YLLLNKSLCS | | | |
| VSLGAVSFW | | VSLGAVSFW | | YLLRGESHGR | | | |
| VSLLQSAIL | | VSLLQSAIL | | YLMLNKSLCK | | | |
| VSLSPGMMM | | VSLSPGMMM | | YLMLSKSLCK | | | |
| VSLSYSTGA | | VSLSYSTGA | | YLNGREWSYI | | | |
| VSMCSSTEF | | VSMCSSTEF | | YLPDLYDYKE | | | |
| VSMEFSLTD | | VSMEFSLTD | | YLQSFTPSPG | | | |
| VSNDNWSGY | | VSNDNWSGY | | YLSGREWSYI | | | |
| VSNGTKINT | | VSNGTKINT | | YLSNNATDTV | | | |
| VSNGTKVNT | | VSNGTKVNT | | YLSNNSSDTV | | | |
| VSNGTMVKT | | VSNGTMVKT | | YLSNNSTDKI | | | |
| VSNNDWSGY | | VSNNDWSGY | | YLSNNSTDKV | | | |
| VSNSDFICV | | VSNSDFICV | | YLSNNSTDTV | | | |

Fig. 83-432

| Block size 8 | SIN | Block size 9 | SIN | Block size 10 | SIN | Block size 11 | SIN |
|---|---|---|---|---|---|---|---|
| VSNSDFLCV | | VSNSDFLCV | | YLSNNSTEKV | | | |
| VSNSDFMCV | | VSNSDFMCV | | YLSNNSTERV | | | |
| VSNSDWSGY | | VSNSDWSGY | | YLSTNSSDKV | | | |
| VSNSEFLCV | | VSNSEFLCV | | YLSTNSSEKV | | | |
| VSPIHLGDC | | VSPIHLGDC | | YLSTNSSERV | | | |
| VSPLAVTWW | | VSPLAVTWW | | YLSTNSTEKV | | | |
| VSPLSGSAQ | | VSPLSGSAQ | | YLSTNSTETV | | | |
| VSPVHLGDC | | VSPVHLGDC | | YLTGTWDTLI | | | |
| VSRARIDAR | | VSRARIDAR | | YLVLNKSLCK | | | |
| VSRIAIGNC | | VSRIAIGNC | | YLWGVHHPSS | | | |
| VSRMGVDEY | | VSRMGVDEY | | YMCSGLVGDT | | | |
| VSSEAPGWS | | VSSEAPGWS | | YMEKANKIKS | | | |
| VSSEVPGCT | | VSSEVPGCT | | YMLERELVRK | | | |
| VSSEVPGWS | | VSSEVPGWS | | YMNTALLNAS | | | |
| VSSFEKFEI | | VSSFEKFEI | | YMNVKSLKLA | | | |
| VSSFERFEI | | VSSFERFEI | | YMSNNSTEKV | | | |
| VSSFERFEM | | VSSFERFEM | | YNADLLVAME | | | |
| VSSFKRFEI | | VSSFKRFEI | | YNADVLVALE | | | |
| VSSFYSEMK | | VSSFYSEMK | | YNAEFLVALE | | | |
| VSSGLVLVG | | VSSGLVLVG | | YNAEFLVAVE | | | |
| VSSLALAIM | | VSSLALAIM | | YNAEILVALE | | | |
| VSSLPFQNI | | VSSLPFQNI | | YNAEILVLME | | | |
| VSSLPFQSI | | VSSLPFQSI | | YNAELFVLME | | | |
| VSSSGTSKA | | VSSSGTSKA | | YNAELIVLLE | | | |
| VSSSLVLAG | | VSSSLVLAG | | YNAELLIAME | | | |
| VSSSLVLVG | | VSSSLVLVG | | YNAELLILLE | | | |
| VSSWHILSK | | VSSWHILSK | | YNAELLVALE | | | |
| VSTDKDSNG | | VSTDKDSNG | | YNAELLVAME | | | |
| VSTDKNSNG | | VSTDKNSNG | | YNAELLVLIE | | | |
| VSTDKSSNG | | VSTDKSSNG | | YNAELLVLLE | | | |
| VSTKEWSKR | | VSTKEWSKR | | YNAELLVLLG | | | |
| VSTKEWSRR | | VSTKEWSRR | | YNAELLVLME | | | |
| VSTNAYDRI | | VSTNAYDRI | | YNAEVLVLME | | | |
| VSTQKAINE | | VSTQKAINE | | YNAGLLVALE | | | |
| VSTQKALNE | | VSTQKALNE | | YNAKLLVLIE | | | |
| VSTRSDQIS | | VSTRSDQIS | | YNAKLLVLLE | | | |
| VSVGSGSFP | | VSVGSGSFP | | YNAQLLVLLE | | | |
| VSVGTSTLN | | VSVGTSTLN | | YNAQLLVWLE | | | |
| VSVLNLGQK | | VSVLNLGQK | | YNARLLVLLE | | | |
| VSVTDGPAA | | VSVTDGPAA | | YNETFVNITN | | | |
| VSWASNSIV | | VSWASNSIV | | YNETFVNVTH | | | |
| VSWEMGQAP | | VSWEMGQAP | | YNETFVNVTN | | | |
| VSWPLSSPP | | VSWPLSSPP | | YNFEKEGYSL | | | |
| VSWSQNILR | | VSWSQNILR | | YNGIITDTFK | | | |
| VSWTSNSII | | VSWTSNSII | | YNGIITDTLK | | | |
| VSWTSNSIV | | VSWTSNSIV | | YNGKSLGIQS | | | |
| VSWTSNSMV | | VSWTSNSMV | | YNGQKSWMKI | | | |
| VTAQELVEA | | VTAQELVEA | | YNGQKSWTKI | | | |
| VTAQELVES | | VTAQELVES | | YNGQRSWMKI | | | |
| VTASCLDKG | | VTASCLDKG | | YNGVITDTLK | | | |
| VTASCLDRG | | VTASCLDRG | | YNHEDYKEES | | | |
| VTASCRDNG | | VTASCRDNG | | YNHEDYREES | | | |
| VTCGCRDNW | | VTCGCRDNW | | YNHKDYEEEA | | | |
| VTCICRDNW | | VTCICRDNW | | YNHKEYEEEA | | | |
| VTCTCRDNW | | VTCTCRDNW | | YNHTEYRQEA | | | |
| VTCVCRDNW | | VTCVCRDNW | | YNIRNLHIPE | | | |
| VTDGPAANN | | VTDGPAANN | | YNKIEFEPFQ | | | |
| VTDGPAANS | | VTDGPAANS | | YNKLEFEPFQ | | | |
| VTDGPSDAQ | | VTDGPSDAQ | | YNKMEFEPFQ | | | |
| VTDGWINSP | | VTDGWINSP | | YNKTVINNIT | | | |
| VTDIWAYNA | | VTDIWAYNA | | YNKVEFEPFQ | | | |
| VTDIWSYNA | | VTDIWSYNA | | YNKVRMQLRD | | | |

Fig. 83-433

| Block size 8 | SIN | Block size 9 | SIN | Block size 10 | SIN | Block size 11 | SIN |
|---|---|---|---|---|---|---|---|
| VTDSEMDKL | | VTDSEMDKL | | YNNTNGEQIL | | | |
| VTDSEMNKL | | VTDSEMNKL | | YNNTSGEQIL | | | |
| VTDSEMNRL | | VTDSEMNRL | | YNNTSGEQML | | | |
| VTDSIKSWR | | VTDSIKSWR | | YNNTSGEQVL | | | |
| VTDVWSYNA | | VTDVWSYNA | | YNNTSGKQML | | | |
| VTDWSGYSG | | VTDWSGYSG | | YNNTTGRDVL | | | |
| VTEGWIDSP | | VTEGWIDSP | | YNNTVINNIT | | | |
| VTEGWINSP | | VTEGWINSP | | YNNTVINNMT | | | |
| VTEINTWAR | | VTEINTWAR | | YNNTVVNNIT | | | |
| VTELWSYNA | | VTELWSYNA | | YNPCFYVELI | | | |
| VTETLYLNH | | VTETLYLNH | | YNRKEYEEEA | | | |
| VTFCGLDNE | | VTFCGLDNE | | YNRRLTTTIK | | | |
| VTFCGLNNE | | VTFCGLNNE | | YNRRPTTTIK | | | |
| VTFHGAKEV | | VTFHGAKEV | | YNSKFESVAW | | | |
| VTFIFNGAF | | VTFIFNGAF | | YNSRFESVAW | | | |
| VTFNFNGAF | | VTFNFNGAF | | YNSTVVNNIT | | | |
| VTFSFNGAF | | VTFSFNGAF | | YNTELLVLME | | | |
| VTFTFNGAF | | VTFTFNGAF | | YNVELLVLME | | | |
| VTGDDKNAT | | VTGDDKNAT | | YNVGYLCAGI | | | |
| VTGDDRNAT | | VTGDDRNAT | | YNYPKYEEES | | | |
| VTGFAPFSK | | VTGFAPFSK | | YNYPKYSEES | | | |
| VTGKLNRLI | | VTGKLNRLI | | YPDVRCICRD | | | |
| VTGKSHGRI | | VTGKSHGRI | | YPDVRCTCRD | | | |
| VTGLRNIPS | | VTGLRNIPS | | YPDVRCVCRD | | | |
| VTGLRNVPA | | VTGLRNVPA | | YPFDVPDYQS | | | |
| VTGYEKNAT | | VTGYEKNAT | | YPFDVPEYQS | | | |
| VTHAKDILE | | VTHAKDILE | | YPFDVPGYQS | | | |
| VTHAKNILE | | VTHAKNILE | | YPFDVPNYQS | | | |
| VTHAQDILE | | VTHAQDILE | | YPGATINEEA | | | |
| VTHAQDLLE | | VTHAQDLLE | | YPGATVNEEA | | | |
| VTHAQNILE | | VTHAQNILE | | YPGATVNEGA | | | |
| VTHFEKIKI | | VTHFEKIKI | | YPGELDNNGE | | | |
| VTHFEKVKI | | VTHFEKVKI | | YPGELNNNGE | | | |
| VTHFQRKRR | | VTHFQRKRR | | YPGEVDNNGE | | | |
| VTHSIELLE | | VTHSIELLE | | YPGFVENLEE | | | |
| VTHSINLLE | | VTHSINLLE | | YPGKFTNEEA | | | |
| VTHSVELLE | | VTHSVELLE | | YPGNFNDYEE | | | |
| VTHSVNILE | | VTHSVNILE | | YPGNNNKGVK | | | |
| VTHSVNLLE | | VTHSVNLLE | | YPGNNNNGVK | | | |
| VTHTGTSKA | | VTHTGTSKA | | YPGNPVICLG | | | |
| VTHVQNNYT | | VTHVQNNYT | | YPGNSNNGVK | | | |
| VTIGECPKY | | VTIGECPKY | | YPGRFTNEEA | | | |
| VTIGKCPKY | | VTIGKCPKY | | YPGSFNDYEE | | | |
| VTKENTGSY | | VTKENTGSY | | YPGSFNNYEE | | | |
| VTKVYNETV | | VTKVYNETV | | YPGSIENLEE | | | |
| VTLHFKQHD | | VTLHFKQHD | | YPGSIENQEE | | | |
| VTLHFKQHE | | VTLHFKQHE | | YPGSIKNQEE | | | |
| VTLHFKQHK | | VTLHFKQHK | | YPGSLNDYEE | | | |
| VTLHFKQNE | | VTLHFKQNE | | YPGSNNNGVK | | | |
| VTLSSGYKD | | VTLSSGYKD | | YPGSTVNEEA | | | |
| VTLSVVSLL | | VTLSVVSLL | | YPGSVENLEE | | | |
| VTLTMGYKD | | VTLTMGYKD | | YPGSVENQEE | | | |
| VTNATELVQ | | VTNATELVQ | | YPGTTVNEEA | | | |
| VTNATETVE | | VTNATETVE | | YPGVKGWAFD | | | |
| VTNGTMVKT | | VTNGTMVKT | | YPGVRCICRD | | | |
| VTNKVNSII | | VTNKVNSII | | YPIQNLTKVN | | | |
| VTNVQNDYT | | VTNVQNDYT | | YPKYEEESKL | | | |
| VTNVQNNYT | | VTNVQNNYT | | YPKYEEESRL | | | |
| VTQAMELVE | | VTQAMELVE | | YPKYSEEAKL | | | |
| VTQINNTNI | | VTQINNTNI | | YPKYSEESKL | | | |
| VTQISNTNI | | VTQISNTNI | | YPKYSEESRL | | | |
| VTQRTIGKK | | VTQRTIGKK | | YPKYSKEAKL | | | |

Fig. 83-434

| Block size 8 | SIN | Block size 9 | SIN | Block size 10 | SIN | Block size 11 | SIN |
|---|---|---|---|---|---|---|---|
| VTQRTIGKR | | VTQRTIGKR | | YPKYSKESKL | | | |
| VTQRTVGKK | | VTQRTVGKK | | YPLQNLTKIN | | | |
| VTQTLVSNN | | VTQTLVSNN | | YPLQNLTKTN | | | |
| VTQTMELVE | | VTQTMELVE | | YPLQNLTKVN | | | |
| VTQVEELVH | | VTQVEELVH | | YPNDGKVECV | | | |
| VTRELYVSC | | VTRELYVSC | | YPNEGKVECI | | | |
| VTREPYISC | | VTREPYISC | | YPNEGKVECV | | | |
| VTREPYLSC | | VTREPYLSC | | YPNLGIVECV | | | |
| VTREPYVSC | | VTREPYVSC | | YPNLGKVECV | | | |
| VTRREIHIY | | VTRREIHIY | | YPNLGQVECV | | | |
| VTRREVHIY | | VTRREVHIY | | YPNMGKVECV | | | |
| VTRREVHMY | | VTRREVHMY | | YPNNGKVECI | | | |
| VTRREVHTY | | VTRREVHTY | | YPNSGKVECV | | | |
| VTRREVHVY | | VTRREVHVY | | YPNVRCVCRD | | | |
| VTRSGTSKA | | VTRSGTSKA | | YPQYPNVRCV | | | |
| VTSSGTSKA | | VTSSGTSKA | | YPRYPDVRCV | | | |
| VTSSIDLIE | | VTSSIDLIE | | YPRYPNVRCV | | | |
| VTSSIDLVE | | VTSSIDLVE | | YQAELLIAME | | | |
| VTSSIELVE | | VTSSIELVE | | YQAELLVAME | | | |
| VTSSVDLIE | | VTSSVDLIE | | YQAKFEAVAW | | | |
| VTSSVDLVE | | VTSSVDLVE | | YQAKFESVAW | | | |
| VTSSVELVE | | VTSSVELVE | | YQARFEAVAW | | | |
| VTSTIDLIE | | VTSTIDLIE | | YQARFESVAW | | | |
| VTTHFQRKR | | VTTHFQRKR | | YQFALGHGTT | | | |
| VTTNTINRI | | VTTNTINRI | | YQFALGQGAT | | | |
| VTTNTINRN | | VTTNTINRN | | YQFALGQGTT | | | |
| VTTNTINRS | | VTTNTINRS | | YQGRLCNPLN | | | |
| VTTRQASPS | | VTTRQASPS | | YQGRLCNPMN | | | |
| VTTVGWSWP | | VTTVGWSWP | | YQIGNVINWT | | | |
| VTTVTLHFK | | VTTVTLHFK | | YQIGYICSGV | | | |
| VTVIKNNMI | | VTVIKNNMI | | YQIGYVCSGI | | | |
| VTVIKNNMV | | VTVIKNNMV | | YQIGYVCSGV | | | |
| VTVIRNNMI | | VTVIRNNMI | | YQILAIYATV | | | |
| VTVSTRSDQ | | VTVSTRSDQ | | YQILAIYSTA | | | |
| VTVTDGPAA | | VTVTDGPAA | | YQILAIYSTV | | | |
| VTVTHAEDI | | VTVTHAEDI | | YQILSIYSTA | | | |
| VTVTHAKDI | | VTVTHAKDI | | YQILSIYSTV | | | |
| VTVTHAKNI | | VTVTHAKNI | | YQILSLYSTV | | | |
| VTVTHAQDI | | VTVTHAQDI | | YQILVIYATV | | | |
| VTVTHAQDL | | VTVTHAQDL | | YQKCCNLFEK | | | |
| VTVTHAQNI | | VTVTHAQNI | | YQKCCSLFEK | | | |
| VTVTHSIEL | | VTVTHSIEL | | YQKCCTLFEK | | | |
| VTVTHSINL | | VTVTHSINL | | YQKQMTRGLF | | | |
| VTVTHSVDL | | VTVTHSVDL | | YQKRMGLQMQ | | | |
| VTVTHSVEL | | VTVTHSVEL | | YQKRMGVQIQ | | | |
| VTVTHSVNI | | VTVTHSVNI | | YQKRMGVQLQ | | | |
| VTVTHSVNL | | VTVTHSVNL | | YQKRMGVQMH | | | |
| VTVTSSIEL | | VTVTSSIEL | | YQKRMGVQMQ | | | |
| VTVTSSVEL | | VTVTSSVEL | | YQKRMTRGLF | | | |
| VTWWNRKGP | | VTWWNRKGP | | YQNNFVPVIG | | | |
| VTWWNRNGP | | VTWWNRNGP | | YQNNFVPVMG | | | |
| VTWWNRSGP | | VTWWNRSGP | | YQNNFVPVVG | | | |
| VTYNNTVIN | | VTYNNTVIN | | YQNNFVPVVR | | | |
| VTYQILSIY | | VTYQILSIY | | YQNSFVPVVG | | | |
| VTYTGISKA | | VTYTGISKA | | YQQSFSPSPG | | | |
| VTYTGTSKA | | VTYTGTSKA | | YQQSFTPSPE | | | |
| VTYTGTSRA | | VTYTGTSRA | | YQQSFTPSPG | | | |
| VVAAQELVE | | VVAAQELVE | | YQQSFVPSPG | | | |
| VVAKDNAIR | | VVAKDNAIR | | YQRCCNLFEK | | | |
| VVAMVFSQE | | VVAMVFSQE | | YQRSKFLLMD | | | |
| VVAVTDGPA | | VVAVTDGPA | | YQRTRALVRS | | | |
| VVCVCRDNW | | VVCVCRDNW | | YQRTRALVRT | | | |

Fig. 83-435

| Block size 8 | SIN | Block size 9 | SIN | Block size 10 | SIN | Block size 11 | SIN |
|---|---|---|---|---|---|---|---|
| VVDATETVE | | VVDATETVE | | YQSIRSILAN | | | |
| VVENKYVNN | | VVENKYVNN | | YQSLRSILAN | | | |
| VVENTYVNN | | VVENTYVNN | | YQSLRSILAS | | | |
| VVFCGTSGI | | VVFCGTSGI | | YQSNNSTDTV | | | |
| VVFCGTSGN | | VVFCGTSGN | | YQSNNSTNTV | | | |
| VVFCGTSGT | | VVFCGTSGT | | YQSRFEAVAW | | | |
| VVFPNEVGA | | VVFPNEVGA | | YQSTNSTEAV | | | |
| VVFTDGSAT | | VVFTDGSAT | | YQSTNSTEIV | | | |
| VVGARPQVN | | VVGARPQVN | | YQSTNSTETV | | | |
| VVGDRPLVN | | VVGDRPLVN | | YQTNNSTDTV | | | |
| VVGWISGNP | | VVGWISGNP | | YQTNNSTETV | | | |
| VVHISPLSG | | VVHISPLSG | | YRACFYVELI | | | |
| VVIAKDNAI | | VVIAKDNAI | | YRAESLQNRI | | | |
| VVIAKDNAV | | VVIAKDNAV | | YRALISWEMG | | | |
| VVIAQDNAI | | VVIAQDNAI | | YRALISWPLS | | | |
| VVIEKDNAV | | VVIEKDNAV | | YRALISWPQS | | | |
| VVIMTDGPA | | VVIMTDGPA | | YRALMSVPLG | | | |
| VVIMTDGSA | | VVIMTDGSA | | YRALMSVPMG | | | |
| VVKTLTNEH | | VVKTLTNEH | | YRALSIYSCI | | | |
| VVKYNGIIT | | VVKYNGIIT | | YRALVSWPLS | | | |
| VVLNTDWSG | | VVLNTDWSG | | YRCHKGDTQI | | | |
| VVLNVSLHL | | VVLNVSLHL | | YRCHRGDAQI | | | |
| VVLVGLILA | | VVLVGLILA | | YRCHRGDMQI | | | |
| VVLVMKRKR | | VVLVMKRKR | | YRCHRGDTHI | | | |
| VVMGLVFIC | | VVMGLVFIC | | YRCHRGDTQI | | | |
| VVMTDGNAS | | VVMTDGNAS | | YRDEAINNRF | | | |
| VVMTDGPAD | | VVMTDGPAD | | YRDEAINNRI | | | |
| VVMTDGPAN | | VVMTDGPAN | | YRDEAINSRF | | | |
| VVMTDGPAS | | VVMTDGPAS | | YRDEAISNRF | | | |
| VVMTDGSAS | | VVMTDGSAS | | YRDEALNNRF | | | |
| VVMTDGSAT | | VVMTDGSAT | | YRDEALNNRS | | | |
| VVMTDGSVS | | VVMTDGSVS | | YRDEAVNNRF | | | |
| VVNATETVE | | VVNATETVE | | YRDNWKGSNR | | | |
| VVNFLSMEF | | VVNFLSMEF | | YRDWSKPQCQ | | | |
| VVNFVSMEF | | VVNFVSMEF | | YREEALLNRI | | | |
| VVNIDRFLR | | VVNIDRFLR | | YREEALLNRL | | | |
| VVNNITTTI | | VVNNITTTI | | YREEAMQNRI | | | |
| VVNTALSTI | | VVNTALSTI | | YREEAMQNRL | | | |
| VVNTTLSTI | | VVNTTLSTI | | YREEAMQNRM | | | |
| VVNYVSMEF | | VVNYVSMEF | | YREEAMQNRV | | | |
| VVPEYGFKI | | VVPEYGFKI | | YREESLLNRL | | | |
| VVPSFDMSN | | VVPSFDMSN | | YREESQLKKQ | | | |
| VVRARPQVN | | VVRARPQVN | | YREESQLKRQ | | | |
| VVREPFISC | | VVREPFISC | | YREICIAWSS | | | |
| VVRKMMTNS | | VVRKMMTNS | | YREVCIAWSS | | | |
| VVRKMMTSS | | VVRKMMTSS | | YRGRLCNPLN | | | |
| VVRSWKKQI | | VVRSWKKQI | | YRHQNAQGEG | | | |
| VVRSWRKKI | | VVRSWRKKI | | YRICKLVGIN | | | |
| VVRSWRKQI | | VVRSWRKQI | | YRILSIYSTV | | | |
| VVRSWRRQI | | VVRSWRRQI | | YRIWSKPQCQ | | | |
| VVSAKELVE | | VVSAKELVE | | YRKLKREITF | | | |
| VVSCDSPSN | | VVSCDSPSN | | YRKRMTRGLF | | | |
| VVSIDRFLR | | VVSIDRFLR | | YRNEAINNRF | | | |
| VVSLGAISF | | VVSLGAISF | | YRNEALNNRF | | | |
| VVSSLALAI | | VVSSLALAI | | YRNMRWLTLK | | | |
| VVSSLVLAI | | VVSSLVLAI | | YRNNRKEPAL | | | |
| VVTAQELVE | | VVTAQELVE | | YRNTRKEPAL | | | |
| VVTFCGLDN | | VVTFCGLDN | | YRNVVWLIKK | | | |
| VVTREPYVS | | VVTREPYVS | | YRNWSKPQCQ | | | |
| VVTVTDGPA | | VVTVTDGPA | | YRQEALQNRI | | | |
| VVVAKDNAI | | VVVAKDNAI | | YRQSFSPSPG | | | |
| VVVFCGTSG | | VVVFCGTSG | | YRRPIGISSM | | | |

Fig. 83-436

| Block size 8 | SIN | Block size 9 | SIN | Block size 10 | SIN | Block size 11 | SIN |
|---|---|---|---|---|---|---|---|
| VVVMTDGPA | | VVVMTDGPA | | YRRPVGISSM | | | |
| VVVMTDGSA | | VVVMTDGSA | | YRSINWLTKK | | | |
| VWACQRGNI | | VWACQRGNI | | YRSIRWLTLK | | | |
| VWAYNAELL | | VWAYNAELL | | YRSLIKFPIG | | | |
| VWDANGWVS | | VWDANGWVS | | YRSLIQFPIG | | | |
| VWDANGWVT | | VWDANGWVT | | YRSLIQFPMG | | | |
| VWGIHHPSS | | VWGIHHPSS | | YRSLIRFPIG | | | |
| VWGVHHSSS | | VWGVHHSSS | | YRSLIRFPVG | | | |
| VWIGRTKSA | | VWIGRTKSA | | YRSLISWPLS | | | |
| VWIGRTKSI | | VWIGRTKSI | | YRSMKWLTLK | | | |
| VWIGRTKSL | | VWIGRTKSL | | YRSMRWLTLK | | | |
| VWIGRTKSN | | VWIGRTKSN | | YRSWSKPQCQ | | | |
| VWIGRTKSP | | VWIGRTKSP | | YRTCKLLGIN | | | |
| VWIGRTKST | | VWIGRTKST | | YRTCKLVGIN | | | |
| VWLENEKTL | | VWLENEKTL | | YRTESLQNRI | | | |
| VWLGRTVSI | | VWLGRTVSI | | YRTLLMNELG | | | |
| VWLGRTVSN | | VWLGRTVSN | | YRTLLMSELG | | | |
| VWLGRTVST | | VWLGRTVST | | YRYGFVANFS | | | |
| VWLWLVLRE | | VWLWLVLRE | | YRYTYRCHKG | | | |
| VWMACHSAA | | VWMACHSAA | | YRYTYRCHRG | | | |
| VWMACNSAA | | VWMACNSAA | | YSAGALASCM | | | |
| VWMGRTISK | | VWMGRTISK | | YSCIASSIVL | | | |
| VWMGRTISM | | VWMGRTISM | | YSCIASSIVM | | | |
| VWMGRTISR | | VWMGRTISR | | YSCIASSLIL | | | |
| VWMGRTKSN | | VWMGRTKSN | | YSCIASSLVL | | | |
| VWRQANNGE | | VWRQANNGE | | YSCIASSTVL | | | |
| VWSSKYQQS | | VWSSKYQQS | | YSCIASSTVM | | | |
| VWSSKYQRS | | VWSSKYQRS | | YSCIASSVVL | | | |
| VWSYNADLL | | VWSYNADLL | | YSDFHFIDEQ | | | |
| VWSYNAEFL | | VWSYNAEFL | | YSDFHFIDER | | | |
| VWSYNAELL | | VWSYNAELL | | YSDFHFINEL | | | |
| VWSYNAKLL | | VWSYNAKLL | | YSDFHFINEQ | | | |
| VWTSGSIIS | | VWTSGSIIS | | YSDFHFINER | | | |
| VWTSGSSIS | | VWTSGSSIS | | YSEMKWLLSS | | | |
| VWTYNAELF | | VWTYNAELF | | YSEMKWLSSS | | | |
| VWTYNAELL | | VWTYNAELL | | YSGFVRTLFQ | | | |
| VWTYNAEVL | | VWTYNAEVL | | YSGGTINSPL | | | |
| VWTYNTELL | | VWTYNTELL | | YSGIFSVEGK | | | |
| VWTYNVELL | | VWTYNVELL | | YSGIFSVEHK | | | |
| VWVTREPYV | | VWVTREPYV | | YSGIFSVENK | | | |
| VWWASNSLI | | VWWASNSLI | | YSGIFSVESK | | | |
| VWWTANSII | | VWWTANSII | | YSGIKTDGAT | | | |
| VWWTSNSIA | | VWWTSNSIA | | YSGIRTDGAT | | | |
| VWWTSNSII | | VWWTSNSII | | YSGSFIDYWA | | | |
| VWWTSNSIV | | VWWTSNSIV | | YSGSFIDYWD | | | |
| VWWTSNSLI | | VWWTSNSLI | | YSGSFIDYWN | | | |
| VWWTSNSLV | | VWWTSNSLV | | YSGSFIQHPE | | | |
| VYCICRDNW | | VYCICRDNW | | YSGSFMDYWA | | | |
| VYCVCRDNW | | VYCVCRDNW | | YSGSFSIRGE | | | |
| VYFVEALAR | | VYFVEALAR | | YSGSFSIRWE | | | |
| VYFVEILAR | | VYFVEILAR | | YSGSFTLPIE | | | |
| VYFVETLAK | | VYFVETLAK | | YSGSFTLPVE | | | |
| VYFVETLAR | | VYFVETLAR | | YSGSFTLPVG | | | |
| VYIEVLHLT | | VYIEVLHLT | | YSGSFVDYWA | | | |
| VYINTALLN | | VYINTALLN | | YSGSFVQHPE | | | |
| VYINTAMLN | | VYINTAMLN | | YSGVFSVEGK | | | |
| VYKALSIYS | | VYKALSIYS | | YSHGTGTGYT | | | |
| VYKILSIYS | | VYKILSIYS | | YSIADKICIG | | | |
| VYKVLAIYS | | VYKVLAIYS | | YSIDSGYVCS | | | |
| VYKVLSIYS | | VYKVLSIYS | | YSIDSNYVCS | | | |
| VYMNTALLN | | VYMNTALLN | | YSIDSSYICS | | | |
| VYNETVRLE | | VYNETVRLE | | YSIDSSYVCS | | | |

Fig. 83-437

| Block size 8 | SIN | Block size 9 | SIN | Block size 10 | SIN | Block size 11 | SIN |
|---|---|---|---|---|---|---|---|
| VYNETVRVE | | VYNETVRVE | | YSKADKICIG | | | |
| VYNETVRVK | | VYNETVRVK | | YSKDNGIRIG | | | |
| VYNNTTGRD | | VYNNTTGRD | | YSKDNSIRIG | | | |
| VYQAKFEAV | | VYQAKFEAV | | YSKYEEESKL | | | |
| VYQAKFESV | | VYQAKFESV | | YSLVGIDPFK | | | |
| VYQARFEAV | | VYQARFEAV | | YSLVGIDPFR | | | |
| VYQARFESV | | VYQARFESV | | YSLVGVDPFK | | | |
| VYQILAIYA | | VYQILAIYA | | YSQITNGTTG | | | |
| VYQILAIYS | | VYQILAIYS | | YSRADKICIG | | | |
| VYQILSIYS | | VYQILSIYS | | YSSPMMWEIN | | | |
| VYQILVIYA | | VYQILVIYA | | YSSPQLEGFS | | | |
| VYQSRFEAV | | VYQSRFEAV | | YSSSLMWEIN | | | |
| VYRALSIYS | | VYRALSIYS | | YSSSMMWEIN | | | |
| VYRDNWKGS | | VYRDNWKGS | | YSSSMMWEVN | | | |
| VYSETVRVE | | VYSETVRVE | | YSSVASSLVL | | | |
| VYSTVASSL | | VYSTVASSL | | YSTAASSLAL | | | |
| VYVDGFEPN | | VYVDGFEPN | | YSTAASSLVL | | | |
| VYVEVLHLT | | VYVEVLHLT | | YSTGALASCM | | | |
| VYVNTALLN | | VYVNTALLN | | YSTISSSLVL | | | |
| VYWTIVKPG | | VYWTIVKPG | | YSTVAASLCL | | | |
| VYWTVVKPG | | VYWTVVKPG | | YSTVASSLAL | | | |
| VYWWDGLQS | | VYWWDGLQS | | YSTVASSLIL | | | |
| VYYDRRLTT | | VYYDRRLTT | | YSTVASSLTL | | | |
| VYYERRLTT | | VYYERRLTT | | YSTVASSLVL | | | |
| VYYNGRLTT | | VYYNGRLTT | | YSTVASSSVL | | | |
| VYYNKRLTT | | VYYNKRLTT | | YSTVSSSLVL | | | |
| VYYNRRLTT | | VYYNRRLTT | | YSTVVSSLAL | | | |
| WACGNGSCR | | WACGNGSCR | | YTENPVICLG | | | |
| WACNNGSCR | | WACNNGSCR | | YTGAINSSKP | | | |
| WACNSGNCR | | WACNSGNCR | | YTGAINSSRP | | | |
| WACQKGNIK | | WACQKGNIK | | YTGDPPYSHG | | | |
| WACQKGNIR | | WACQKGNIR | | YTGNPVICLG | | | |
| WACQNGNIR | | WACQNGNIR | | YTGNPVICMG | | | |
| WACQNGNLR | | WACQNGNLR | | YTIDEESRAR | | | |
| WACQNGNVR | | WACQNGNVR | | YTKCQTYAGA | | | |
| WACQRGNIR | | WACQRGNIR | | YTKILYFHKG | | | |
| WACSNGNCR | | WACSNGNCR | | YTKIMYFHKG | | | |
| WACSNGSCR | | WACSNGSCR | | YTKVLYFHKG | | | |
| WACSSGNCR | | WACSSGNCR | | YTKVMYFHKG | | | |
| WAEGDCYRA | | WAEGDCYRA | | YTLDEESRAR | | | |
| WAEGECYRA | | WAEGECYRA | | YTLITDGPSD | | | |
| WAGKILRTQ | | WAGKILRTQ | | YTLITDGPSN | | | |
| WAGNILRTQ | | WAGNILRTQ | | YTLMTDGPSD | | | |
| WAIHHPPTS | | WAIHHPPTS | | YTLVSTGSWS | | | |
| WAIHHPPTT | | WAIHHPPTT | | YTLVSTKEWS | | | |
| WAIHTKDNS | | WAIHTKDNS | | YTLVSTKSWS | | | |
| WAILKPGQT | | WAILKPGQT | | YTLVSTRSWS | | | |
| WAIRTRSGG | | WAIRTRSGG | | YTLVSTSSWS | | | |
| WAIYSKDNG | | WAIYSKDNG | | YTLVTDGPSD | | | |
| WAIYSKDNS | | WAIYSKDNS | | YTLVTTSSWS | | | |
| WAIYTKDNS | | WAIYTKDNS | | YTMDTVNRTH | | | |
| WAKEECYRA | | WAKEECYRA | | YTMDTVSRTH | | | |
| WAKGDCYRA | | WAKGDCYRA | | YTPGGEVIND | | | |
| WAKGECYRA | | WAKGECYRA | | YTPGGEVKND | | | |
| WAKNILRTQ | | WAKNILRTQ | | YTPGGEVRND | | | |
| WALGENMAP | | WALGENMAP | | YTPGGGVRND | | | |
| WAPLSKDNG | | WAPLSKDNG | | YTPGGKVRND | | | |
| WARNILRTQ | | WARNILRTQ | | YTRLYIWGVH | | | |
| WASGSSISF | | WASGSSISF | | YTSARQEKNP | | | |
| WASNSIVTF | | WASNSIVTF | | YTSGRQEKNP | | | |
| WASNSLIAL | | WASNSLIAL | | YTYRCHKGDT | | | |
| WATANSKSQ | | WATANSKSQ | | YTYRCHRGDM | | | |

Fig. 83-438

| Block size 8 | SIN | Block size 9 | SIN | Block size 10 | SIN | Block size 11 | SIN |
|---|---|---|---|---|---|---|---|
| WAVGRCPRY | | WAVGRCPRY | | YTYRCHRGDT | | | |
| WAVLKPGQT | | WAVLKPGQT | | YVCSGIFGDN | | | |
| WAYNAELIV | | WAYNAELIV | | YVCSGLVGDT | | | |
| WAYNAELLV | | WAYNAELLV | | YVCSGVFGDN | | | |
| WCGMIDGWY | | WCGMIDGWY | | YVCSKFHSDT | | | |
| WCKIVTTVG | | WCKIVTTVG | | YVCTGILTDT | | | |
| WDANGWVST | | WDANGWVST | | YVCTGVLTDT | | | |
| WDDGAILPF | | WDDGAILPF | | YVDGFEPNGC | | | |
| WDDGAILPL | | WDDGAILPL | | YVDGFEPNGS | | | |
| WDDNGWVST | | WDDNGWVST | | YVDGFEPNGY | | | |
| WDGLQSSDD | | WDGLQSSDD | | YVDGFKPNGC | | | |
| WDILRTQES | | WDILRTQES | | YVEDTKIDLW | | | |
| WDSFRQSER | | WDSFRQSER | | YVEDTKVDLW | | | |
| WDTINFEST | | WDTINFEST | | YVELIRGMPK | | | |
| WDTISFEST | | WDTISFEST | | YVELIRGMPQ | | | |
| WDTLIERDN | | WDTLIERDN | | YVELIRGRKQ | | | |
| WDTLIEREN | | WDTLIEREN | | YVELIRGRLN | | | |
| WDTLIERGS | | WDTLIERGS | | YVELIRGRPE | | | |
| WDVFIERPT | | WDVFIERPT | | YVELIRGRPI | | | |
| WDVINFEST | | WDVINFEST | | YVELIRGRPK | | | |
| WDVISFEST | | WDVISFEST | | YVELIRGRPN | | | |
| WDWPDGAKI | | WDWPDGAKI | | YVELIRGRPQ | | | |
| WEGLIDGWY | | WEGLIDGWY | | YVELIRGRPR | | | |
| WEGLINGWY | | WEGLINGWY | | YVELIRGRQQ | | | |
| WEGLVDGWY | | WEGLVDGWY | | YVELIRGRSQ | | | |
| WEGMIDGWY | | WEGMIDGWY | | YVEMIRGRPK | | | |
| WEGMMDGWY | | WEGMMDGWY | | YVEVLHLTQG | | | |
| WEGMVDGWY | | WEGMVDGWY | | YVEWTSNSLI | | | |
| WEGMVNGWY | | WEGMVNGWY | | YVKKASLRLA | | | |
| WEGNILRTQ | | WEGNILRTQ | | YVKKESLRLA | | | |
| WEINGPDSV | | WEINGPDSV | | YVKQGSLKLA | | | |
| WEINGPESV | | WEINGPESV | | YVKQGSLMLA | | | |
| WEKNCTLID | | WEKNCTLID | | YVKQGSLRLA | | | |
| WEMGLAPSP | | WEMGLAPSP | | YVKQKTLKLA | | | |
| WEMGQAPSP | | WEMGQAPSP | | YVKQNTLKLA | | | |
| WEQLYTPGG | | WEQLYTPGG | | YVKQSSLPLA | | | |
| WEQMYTPGG | | WEQMYTPGG | | YVKQSTLKLA | | | |
| WETTGRNCT | | WETTGRNCT | | YVKSDRLVLA | | | |
| WEVNGPESV | | WEVNGPESV | | YVKSEKLVLA | | | |
| WFGYFGIFF | | WFGYFGIFF | | YVKSERLVLA | | | |
| WFRNILSIA | | WFRNILSIA | | YVLSIIPSGP | | | |
| WFRNILSMA | | WFRNILSMA | | YVLSIVPSGP | | | |
| WFRNVLSIA | | WFRNVLSIA | | YVLSVIPSGP | | | |
| WFRNVLSVA | | WFRNVLSVA | | YVNIKSLKLA | | | |
| WFSFGASCF | | WFSFGASCF | | YVNKNPYTLV | | | |
| WFSFGASCV | | WFSFGASCV | | YVNKTTVINK | | | |
| WFSFGASSF | | WFSFGASSF | | YVNNTTIISK | | | |
| WFSHYNQMK | | WFSHYNQMK | | YVNNTTIITK | | | |
| WFSHYNQMT | | WFSHYNQMT | | YVNNTTVINK | | | |
| WFSHYNQVA | | WFSHYNQVA | | YVNNTTVISK | | | |
| WFSHYNQVT | | WFSHYNQVT | | YVNTALLNAS | | | |
| WFSLGASCF | | WFSLGASCF | | YVNVKSLKLA | | | |
| WGDILDGVT | | WGDILDGVT | | YVNVRSLKLA | | | |
| WGDILEGTT | | WGDILEGTT | | YVQMCTELKL | | | |
| WGDVLDGVT | | WGDVLDGVT | | YVRKASLRLA | | | |
| WGIHHPDSE | | WGIHHPDSE | | YVRLYLWGVH | | | |
| WGIHHPDTE | | WGIHHPDTE | | YVRQNTLKLA | | | |
| WGIHHPNDD | | WGIHHPNDD | | YVRSEKLVLA | | | |
| WGIHHPNDE | | WGIHHPNDE | | YVRTNGTSKI | | | |
| WGIHHPPDA | | WGIHHPPDA | | YVRTNGTSKV | | | |
| WGIHHPPDE | | WGIHHPPDE | | YVSCDPDECR | | | |
| WGIHHPPDT | | WGIHHPPDT | | YVSCDPDGCR | | | |

Fig. 83-439

| Block size 8 | SIN | Block size 9 | SIN | Block size 10 | SIN | Block size 11 | SIN |
|---|---|---|---|---|---|---|---|
| WGIHHPPNT | | WGIHHPPNT | | YVSCDPLGCK | | | |
| WGIHHPSNT | | WGIHHPSNT | | YVSCDPLGCR | | | |
| WGIHHPSSA | | WGIHHPSSA | | YVSCDPNECR | | | |
| WGIHHPSSI | | WGIHHPSSI | | YVSCDPSGCK | | | |
| WGIHHPSST | | WGIHHPSST | | YVSCDPTGCK | | | |
| WGILKRGET | | WGILKRGET | | YVSCEPDECR | | | |
| WGMELRRCL | | WGMELRRCL | | YVSIGTSTLN | | | |
| WGMEMRRCL | | WGMEMRRCL | | YVSMEFSLTD | | | |
| WGMGQAPSP | | WGMGQAPSP | | YVSVGTSTLN | | | |
| WGNGCFEFY | | WGNGCFEFY | | YVWWASNSLI | | | |
| WGNVLDGVT | | WGNVLDGVT | | YVWWTSNSLI | | | |
| WGVHHPIDE | | WGVHHPIDE | | YVWWTSNSLV | | | |
| WGVHHPKDE | | WGVHHPKDE | | YWAEGDCYRA | | | |
| WGVHHPNDE | | WGVHHPNDE | | YWAEGECYRA | | | |
| WGVHHPSSD | | WGVHHPSSD | | YWAILKPGQT | | | |
| WGVHHPSTD | | WGVHHPSTD | | YWAIRTRSGG | | | |
| WGVHHSSSL | | WGVHHSSSL | | YWAKEECYRA | | | |
| WHASNRPWI | | WHASNRPWI | | YWAKGDCYRA | | | |
| WHASNRPWV | | WHASNRPWV | | YWAKGECYRA | | | |
| WHDGAEIIY | | WHDGAEIIY | | YWAVLKPGQT | | | |
| WHDGAEITY | | WHDGAEITY | | YWGILKRGET | | | |
| WHDGAILPF | | WHDGAILPF | | YWHLMHPGER | | | |
| WHDGAILPL | | WHDGAILPL | | YWHLMRPGER | | | |
| WHDGAVLPF | | WHDGAVLPF | | YWHLMSPGER | | | |
| WHGSNRPWI | | WHGSNRPWI | | YWTLVNPGDS | | | |
| WHGSNRPWL | | WHGSNRPWL | | YWVMTDGPAN | | | |
| WHGSNRPWV | | WHGSNRPWV | | YWVMTDGPAS | | | |
| WHIFGKDNA | | WHIFGKDNA | | YWWDGLQSSD | | | |
| WHIFSKDNA | | WHIFSKDNA | | YYDRRLTTTI | | | |
| WHILSKDNA | | WHILSKDNA | | YYDRRLTTTV | | | |
| WHIYGKDNA | | WHIYGKDNA | | YYEECSCYPD | | | |
| WHLMHPGER | | WHLMHPGER | | YYERRLTTTI | | | |
| WHLMRPGER | | WHLMRPGER | | YYFVKEGKIV | | | |
| WHLMSPGER | | WHLMSPGER | | YYLEKANKIK | | | |
| WHSNLNDAT | | WHSNLNDAT | | YYLEKASKIK | | | |
| WHSNLNDTT | | WHSNLNDTT | | YYNETFVNMT | | | |
| WHVRKRFAD | | WHVRKRFAD | | YYNETFVNVT | | | |
| WICMGHHAV | | WICMGHHAV | | YYNGRLTTTI | | | |
| WIDSPNHAK | | WIDSPNHAK | | YYNGRSSFFR | | | |
| WIELDEIGE | | WIELDEIGE | | YYNKRLTTTI | | | |
| WIELIRGRP | | WIELIRGRP | | YYNRRLTTTI | | | |
| WIGECPKYV | | WIGECPKYV | | YYPKYEEESK | | | |
| WIGGCPKYV | | WIGGCPKYV | | YYWAILKPGQ | | | |
| WIGKCPKYV | | WIGKCPKYV | | YYWAVLKPGQ | | | |
| WIGRTKSLE | | WIGRTKSLE | | YYWGILKRGE | | | |
| WIKTRPILS | | WIKTRPILS | | YYYEECSCYP | | | |
| WILGNPKCD | | WILGNPKCD | | YYYPKYEEES | | | |
| WILGNPMCD | | WILGNPMCD | | | | | |
| WILGNPQCD | | WILGNPQCD | | | | | |
| WILGNPRCD | | WILGNPRCD | | | | | |
| WILGNPRCG | | WILGNPRCG | | | | | |
| WILWISFAI | | WILWISFAI | | | | | |
| WILWISFAM | | WILWISFAM | | | | | |
| WILWISFAT | | WILWISFAT | | | | | |
| WINSPNHAK | | WINSPNHAK | | | | | |
| WINSPNHVK | | WINSPNHVK | | | | | |
| WINSPSQAK | | WINSPSQAK | | | | | |
| WIPKRNRSI | | WIPKRNRSI | | | | | |
| WIQNEFNKA | | WIQNEFNKA | | | | | |
| WIQSEFNKA | | WIQSEFNKA | | | | | |
| WIRFNSDLD | | WIRFNSDLD | | | | | |
| WIRFNSDPD | | WIRFNSDPD | | | | | |

Fig. 83-440

| Block size 8 | SIN | Block size 9 | SIN | Block size 10 | SIN | Block size 11 | SIN |
|---|---|---|---|---|---|---|---|
| WIRFNSNLD | | WIRFNSNLD | | | | | |
| WIRINNETI | | WIRINNETI | | | | | |
| WISFAISCF | | WISFAISCF | | | | | |
| WISFAMSCF | | WISFAMSCF | | | | | |
| WISFATSCF | | WISFATSCF | | | | | |
| WISFSISCF | | WISFSISCF | | | | | |
| WISFSMSCF | | WISFSMSCF | | | | | |
| WITIGISGP | | WITIGISGP | | | | | |
| WITREPYVS | | WITREPYVS | | | | | |
| WIVGNPSCA | | WIVGNPSCA | | | | | |
| WKGANRPII | | WKGANRPII | | | | | |
| WKGANRPVI | | WKGANRPVI | | | | | |
| WKGGSIKTK | | WKGGSIKTK | | | | | |
| WKGGSINTK | | WKGGSINTK | | | | | |
| WKGNIMRTQ | | WKGNIMRTQ | | | | | |
| WKGSNRPII | | WKGSNRPII | | | | | |
| WKGSNRPIV | | WKGSNRPIV | | | | | |
| WKGSNRPVI | | WKGSNRPVI | | | | | |
| WKGSNRPVV | | WKGSNRPVV | | | | | |
| WKGSNRPWI | | WKGSNRPWI | | | | | |
| WKGSNRPWM | | WKGSNRPWM | | | | | |
| WKGSNRPWV | | WKGSNRPWV | | | | | |
| WKHVTNTIL | | WKHVTNTIL | | | | | |
| WKKQILRTQ | | WKKQILRTQ | | | | | |
| WLELDEIGE | | WLELDEIGE | | | | | |
| WLEMIRGKP | | WLEMIRGKP | | | | | |
| WLEMIRGRP | | WLEMIRGRP | | | | | |
| WLENEKTLD | | WLENEKTLD | | | | | |
| WLGGTISPR | | WLGGTISPR | | | | | |
| WLGRTFSPR | | WLGRTFSPR | | | | | |
| WLGRTISIA | | WLGRTISIA | | | | | |
| WLGRTISKD | | WLGRTISKD | | | | | |
| WLGRTISPK | | WLGRTISPK | | | | | |
| WLGRTISPR | | WLGRTISPR | | | | | |
| WLGRTISTA | | WLGRTISTA | | | | | |
| WLGRTISTR | | WLGRTISTR | | | | | |
| WLGRTLNTA | | WLGRTLNTA | | | | | |
| WLGRTTSKD | | WLGRTTSKD | | | | | |
| WLGRTTSTA | | WLGRTTSTA | | | | | |
| WLGRTVSIN | | WLGRTVSIN | | | | | |
| WLGRTVSIS | | WLGRTVSIS | | | | | |
| WLGRTVSNS | | WLGRTVSNS | | | | | |
| WLGRTVSTS | | WLGRTVSTS | | | | | |
| WLHICVTGD | | WLHICVTGD | | | | | |
| WLHVCITGD | | WLHVCITGD | | | | | |
| WLHVCVTGD | | WLHVCVTGD | | | | | |
| WLIDQSGTY | | WLIDQSGTY | | | | | |
| WLIHQSETY | | WLIHQSETY | | | | | |
| WLIHQSGTY | | WLIHQSGTY | | | | | |
| WLILNPNDT | | WLILNPNDT | | | | | |
| WLISKSKEQ | | WLISKSKEQ | | | | | |
| WLIYQSGTY | | WLIYQSGTY | | | | | |
| WLKPQCQIT | | WLKPQCQIT | | | | | |
| WLKTRPILS | | WLKTRPILS | | | | | |
| WLLGNPECD | | WLLGNPECD | | | | | |
| WLLGNPKCD | | WLLGNPKCD | | | | | |
| WLLGNPLCD | | WLLGNPLCD | | | | | |
| WLLGNPMCD | | WLLGNPMCD | | | | | |
| WLLLDPNDT | | WLLLDPNDT | | | | | |
| WLLSSKANQ | | WLLSSKANQ | | | | | |
| WLLSSKDNQ | | WLLSSKDNQ | | | | | |
| WLMLNPNDT | | WLMLNPNDT | | | | | |

Fig. 83-441

| Block size 8 | SIN | Block size 9 | SIN | Block size 10 | SIN | Block size 11 | SIN |
|---|---|---|---|---|---|---|---|
| WLMLNPNGT | | WLMLNPNGT | | | | | |
| WLMLNSNDT | | WLMLNSNDT | | | | | |
| WLSSSGNNQ | | WLSSSGNNQ | | | | | |
| WLSSSMNNQ | | WLSSSMNNQ | | | | | |
| WLTIGISGP | | WLTIGISGP | | | | | |
| WLTIGITGP | | WLTIGITGP | | | | | |
| WLTIGVSGP | | WLTIGVSGP | | | | | |
| WLTKATNGN | | WLTKATNGN | | | | | |
| WLTKETNGN | | WLTKETNGN | | | | | |
| WLTKKEPDT | | WLTKKEPDT | | | | | |
| WLTKKKNPE | | WLTKKKNPE | | | | | |
| WLTKKKPDI | | WLTKKKPDI | | | | | |
| WLTKKKPDT | | WLTKKKPDT | | | | | |
| WLTLGITGP | | WLTLGITGP | | | | | |
| WLTLKLGQF | | WLTLKLGQF | | | | | |
| WLTLKSEQF | | WLTLKSEQF | | | | | |
| WLTLKSGQF | | WLTLKSGQF | | | | | |
| WLVHQSGTY | | WLVHQSGTY | | | | | |
| WLVLREKMP | | WLVLREKMP | | | | | |
| WLVSKDKGR | | WLVSKDKGR | | | | | |
| WLVSKNKGQ | | WLVSKNKGQ | | | | | |
| WLVSKSKGQ | | WLVSKSKGQ | | | | | |
| WLVSKTKGQ | | WLVSKTKGQ | | | | | |
| WLWLVLREK | | WLWLVLREK | | | | | |
| WMACHSAAF | | WMACHSAAF | | | | | |
| WMACNSAAF | | WMACNSAAF | | | | | |
| WMCFNGSLQ | | WMCFNGSLQ | | | | | |
| WMCLNGSMQ | | WMCLNGSMQ | | | | | |
| WMCPNGSLQ | | WMCPNGSLQ | | | | | |
| WMCSNGALQ | | WMCSNGALQ | | | | | |
| WMCSNGSLQ | | WMCSNGSLQ | | | | | |
| WMCSNGSLR | | WMCSNGSLR | | | | | |
| WMCSNGSMP | | WMCSNGSMP | | | | | |
| WMCSNGSMQ | | WMCSNGSMQ | | | | | |
| WMCSNGSYN | | WMCSNGSYN | | | | | |
| WMCSNSSMQ | | WMCSNSSMQ | | | | | |
| WMDYYWGIL | | WMDYYWGIL | | | | | |
| WMELDEIGE | | WMELDEIGE | | | | | |
| WMGRTISKD | | WMGRTISKD | | | | | |
| WMGRTISMD | | WMGRTISMD | | | | | |
| WMGRTISRD | | WMGRTISRD | | | | | |
| WMKIIRVGC | | WMKIIRVGC | | | | | |
| WMKIYWHLM | | WMKIYWHLM | | | | | |
| WMKLYWHLM | | WMKLYWHLM | | | | | |
| WMLLDPGDT | | WMLLDPGDT | | | | | |
| WMMAMKYPI | | WMMAMKYPI | | | | | |
| WMMAMRYPI | | WMMAMRYPI | | | | | |
| WMRINNETI | | WMRINNETI | | | | | |
| WMRISNETI | | WMRISNETI | | | | | |
| WNENQNPRI | | WNENQNPRI | | | | | |
| WNENQNPRM | | WNENQNPRM | | | | | |
| WNENQNPRV | | WNENQNPRV | | | | | |
| WNGECPKYV | | WNGECPKYV | | | | | |
| WNGMNRPIL | | WNGMNRPIL | | | | | |
| WNGMNRPVL | | WNGMNRPVL | | | | | |
| WNGVKVDGS | | WNGVKVDGS | | | | | |
| WNLALDIVD | | WNLALDIVD | | | | | |
| WNVSSSGTS | | WNVSSSGTS | | | | | |
| WNVTHTGTS | | WNVTHTGTS | | | | | |
| WNVTRSGTS | | WNVTRSGTS | | | | | |
| WNVTSSGTS | | WNVTSSGTS | | | | | |
| WNVTYTGIS | | WNVTYTGIS | | | | | |

Fig. 83-442

| Block size 8 | SIN | Block size 9 | SIN | Block size 10 | SIN | Block size 11 | SIN |
|---|---|---|---|---|---|---|---|
| WNVTYTGTS | | WNVTYTGTS | | | | | |
| WNWPDGAEI | | WNWPDGAEI | | | | | |
| WNWPDGAKI | | WNWPDGAKI | | | | | |
| WPDDAELPF | | WPDDAELPF | | | | | |
| WPDDAELPL | | WPDDAELPL | | | | | |
| WPDGADINF | | WPDGADINF | | | | | |
| WPDGADLPF | | WPDGADLPF | | | | | |
| WPDGAEIEY | | WPDGAEIEY | | | | | |
| WPDGAELPF | | WPDGAELPF | | | | | |
| WPDGAELPS | | WPDGAELPS | | | | | |
| WPDGAEVPF | | WPDGAEVPF | | | | | |
| WPDGAKIET | | WPDGAKIET | | | | | |
| WPDGAKIEY | | WPDGAKIEY | | | | | |
| WPDGAKLPF | | WPDGAKLPF | | | | | |
| WPDGALLPF | | WPDGALLPF | | | | | |
| WPDGALLPL | | WPDGALLPL | | | | | |
| WPDGANIDF | | WPDGANIDF | | | | | |
| WPDGANIGF | | WPDGANIGF | | | | | |
| WPDGANINF | | WPDGANINF | | | | | |
| WPDGANINL | | WPDGANINL | | | | | |
| WPDGANISF | | WPDGANISF | | | | | |
| WPDGANTNF | | WPDGANTNF | | | | | |
| WPDGSDIGF | | WPDGSDIGF | | | | | |
| WPDGSNIGF | | WPDGSNIGF | | | | | |
| WPDGYNIGF | | WPDGYNIGF | | | | | |
| WPDRAELPF | | WPDRAELPF | | | | | |
| WPGLINGWY | | WPGLINGWY | | | | | |
| WPGLVAGWY | | WPGLVAGWY | | | | | |
| WPIGESPEG | | WPIGESPEG | | | | | |
| WPIGESPKG | | WPIGESPKG | | | | | |
| WPIGESPKR | | WPIGESPKR | | | | | |
| WPIGESPRG | | WPIGESPRG | | | | | |
| WPLSSPPTV | | WPLSSPPTV | | | | | |
| WPQSSPPTV | | WPQSSPPTV | | | | | |
| WPVGESPKG | | WPVGESPKG | | | | | |
| WPWPDGALL | | WPWPDGALL | | | | | |
| WQGANRPII | | WQGANRPII | | | | | |
| WQGANRPVI | | WQGANRPVI | | | | | |
| WQGLIDGWY | | WQGLIDGWY | | | | | |
| WQGLVDGWY | | WQGLVDGWY | | | | | |
| WQGMIDGWY | | WQGMIDGWY | | | | | |
| WQGMVDGWY | | WQGMVDGWY | | | | | |
| WQGSNRPVI | | WQGSNRPVI | | | | | |
| WREQLSQKF | | WREQLSQKF | | | | | |
| WRGANRPVI | | WRGANRPVI | | | | | |
| WRGDNGRRT | | WRGDNGRRT | | | | | |
| WRGENGRKT | | WRGENGRKT | | | | | |
| WRGENGRRT | | WRGENGRRT | | | | | |
| WRGGSINTK | | WRGGSINTK | | | | | |
| WRGGSINTR | | WRGGSINTR | | | | | |
| WRGSNRPIV | | WRGSNRPIV | | | | | |
| WRGSNRPWI | | WRGSNRPWI | | | | | |
| WRGSNRPWV | | WRGSNRPWV | | | | | |
| WRKDILRTQ | | WRKDILRTQ | | | | | |
| WRKKILRTQ | | WRKKILRTQ | | | | | |
| WRKQILRTQ | | WRKQILRTQ | | | | | |
| WRQANNGDD | | WRQANNGDD | | | | | |
| WRQANNGED | | WRQANNGED | | | | | |
| WRQANNGEE | | WRQANNGEE | | | | | |
| WRRDILRTQ | | WRRDILRTQ | | | | | |
| WRRQILRTQ | | WRRQILRTQ | | | | | |
| WSASACHDG | | WSASACHDG | | | | | |

Fig. 83-443

| Block size 8 | SIN | Block size 9 | SIN | Block size 10 | SIN | Block size 11 | SIN |
|---|---|---|---|---|---|---|---|
| WSATACHDG | | WSATACHDG | | | | | |
| WSATACSDG | | WSATACSDG | | | | | |
| WSFALAQGA | | WSFALAQGA | | | | | |
| WSFALAQGT | | WSFALAQGT | | | | | |
| WSFALAQGV | | WSFALAQGV | | | | | |
| WSFALSQGA | | WSFALSQGA | | | | | |
| WSGLIAGWY | | WSGLIAGWY | | | | | |
| WSGLVAGWY | | WSGLVAGWY | | | | | |
| WSGMIDGWY | | WSGMIDGWY | | | | | |
| WSGYSGAFI | | WSGYSGAFI | | | | | |
| WSGYSGAFM | | WSGYSGAFM | | | | | |
| WSGYSGAFT | | WSGYSGAFT | | | | | |
| WSGYSGAFV | | WSGYSGAFV | | | | | |
| WSGYSGIFS | | WSGYSGIFS | | | | | |
| WSGYSGSFI | | WSGYSGSFI | | | | | |
| WSGYSGSFM | | WSGYSGSFM | | | | | |
| WSGYSGSFS | | WSGYSGSFS | | | | | |
| WSGYSGSFT | | WSGYSGSFT | | | | | |
| WSGYSGSFV | | WSGYSGSFV | | | | | |
| WSGYSGVFS | | WSGYSGVFS | | | | | |
| WSHNILRTQ | | WSHNILRTQ | | | | | |
| WSILKPGET | | WSILKPGET | | | | | |
| WSKNILRTQ | | WSKNILRTQ | | | | | |
| WSKPQCHIT | | WSKPQCHIT | | | | | |
| WSKPQCKIT | | WSKPQCKIT | | | | | |
| WSKPQCLIT | | WSKPQCLIT | | | | | |
| WSKPQCQIA | | WSKPQCQIA | | | | | |
| WSKPQCQII | | WSKPQCQII | | | | | |
| WSKPQCQIR | | WSKPQCQIR | | | | | |
| WSKPQCQIS | | WSKPQCQIS | | | | | |
| WSKPQCQIT | | WSKPQCQIT | | | | | |
| WSKPQCRIT | | WSKPQCRIT | | | | | |
| WSKRYELEI | | WSKRYELEI | | | | | |
| WSKTQCQIT | | WSKTQCQIT | | | | | |
| WSLQCRICI | | WSLQCRICI | | | | | |
| WSMLKPGET | | WSMLKPGET | | | | | |
| WSQNILRTQ | | WSQNILRTQ | | | | | |
| WSRRYELEI | | WSRRYELEI | | | | | |
| WSSASCHDG | | WSSASCHDG | | | | | |
| WSSSSCFDG | | WSSSSCFDG | | | | | |
| WSSSSCHDG | | WSSSSCHDG | | | | | |
| WSSSSCYDG | | WSSSSCYDG | | | | | |
| WSSTSCFDG | | WSSTSCFDG | | | | | |
| WSSTSCHDG | | WSSTSCHDG | | | | | |
| WSSTTCHDG | | WSSTTCHDG | | | | | |
| WSVLKPGET | | WSVLKPGET | | | | | |
| WSVLQPGET | | WSVLQPGET | | | | | |
| WSVLRPGET | | WSVLRPGET | | | | | |
| WSWDDGAIL | | WSWDDGAIL | | | | | |
| WSWHDGAEI | | WSWHDGAEI | | | | | |
| WSWHDGAIL | | WSWHDGAIL | | | | | |
| WSWHDGAVL | | WSWHDGAVL | | | | | |
| WSWPDDAEL | | WSWPDDAEL | | | | | |
| WSWPDGADL | | WSWPDGADL | | | | | |
| WSWPDGAEL | | WSWPDGAEL | | | | | |
| WSWPDGAEV | | WSWPDGAEV | | | | | |
| WSWPDGAKL | | WSWPDGAKL | | | | | |
| WSWPDGALL | | WSWPDGALL | | | | | |
| WSYIIEKEN | | WSYIIEKEN | | | | | |
| WSYIMEKEN | | WSYIMEKEN | | | | | |
| WSYIVEKAN | | WSYIVEKAN | | | | | |
| WSYIVEKDK | | WSYIVEKDK | | | | | |

Fig. 83-444

| Block size 8 | SIN | Block size 9 | SIN | Block size 10 | SIN | Block size 11 | SIN |
|---|---|---|---|---|---|---|---|
| WSYIVEKDN | | WSYIVEKDN | | | | | |
| WSYIVEKDS | | WSYIVEKDS | | | | | |
| WSYIVEKEN | | WSYIVEKEN | | | | | |
| WSYIVEKNN | | WSYIVEKNN | | | | | |
| WSYIVEKPN | | WSYIVEKPN | | | | | |
| WSYIVEKSN | | WSYIVEKSN | | | | | |
| WSYIVEKTN | | WSYIVEKTN | | | | | |
| WSYIVEREN | | WSYIVEREN | | | | | |
| WSYIVERET | | WSYIVERET | | | | | |
| WSYIVERPK | | WSYIVERPK | | | | | |
| WSYIVERPL | | WSYIVERPL | | | | | |
| WSYIVERPN | | WSYIVERPN | | | | | |
| WSYIVERPS | | WSYIVERPS | | | | | |
| WSYIVERPT | | WSYIVERPT | | | | | |
| WSYIVERSS | | WSYIVERSS | | | | | |
| WSYIVERTK | | WSYIVERTK | | | | | |
| WSYLIEDPA | | WSYLIEDPA | | | | | |
| WSYLIEDPG | | WSYLIEDPG | | | | | |
| WSYLIEDPN | | WSYLIEDPN | | | | | |
| WSYLIEDPS | | WSYLIEDPS | | | | | |
| WSYLIEDPT | | WSYLIEDPT | | | | | |
| WSYNADLLV | | WSYNADLLV | | | | | |
| WSYNADVLV | | WSYNADVLV | | | | | |
| WSYNAEFLV | | WSYNAEFLV | | | | | |
| WSYNAELLI | | WSYNAELLI | | | | | |
| WSYNAELLV | | WSYNAELLV | | | | | |
| WSYNAGLLV | | WSYNAGLLV | | | | | |
| WSYNAKLLV | | WSYNAKLLV | | | | | |
| WSYNAQLLV | | WSYNAQLLV | | | | | |
| WSYNARLLV | | WSYNARLLV | | | | | |
| WTANSIIVF | | WTANSIIVF | | | | | |
| WTCNSGNCR | | WTCNSGNCR | | | | | |
| WTCSNGSCR | | WTCSNGSCR | | | | | |
| WTGLIDGWY | | WTGLIDGWY | | | | | |
| WTGMIDGWY | | WTGMIDGWY | | | | | |
| WTGMVDGWY | | WTGMVDGWY | | | | | |
| WTGMVNGWY | | WTGMVNGWY | | | | | |
| WTGTNRPIL | | WTGTNRPIL | | | | | |
| WTGTNRPVL | | WTGTNRPVL | | | | | |
| WTIANSKSQ | | WTIANSKSQ | | | | | |
| WTKDSITDI | | WTKDSITDI | | | | | |
| WTLGENMAP | | WTLGENMAP | | | | | |
| WTLNRNQPA | | WTLNRNQPA | | | | | |
| WTLVNPGDS | | WTLVNPGDS | | | | | |
| WTPKRNRSI | | WTPKRNRSI | | | | | |
| WTQDAMTEV | | WTQDAMTEV | | | | | |
| WTRDAMTEI | | WTRDAMTEI | | | | | |
| WTRDAMTEV | | WTRDAMTEV | | | | | |
| WTRDSITEV | | WTRDSITEV | | | | | |
| WTRDSLTEI | | WTRDSLTEI | | | | | |
| WTRDSMTEI | | WTRDSMTEI | | | | | |
| WTRDSMTEV | | WTRDSMTEV | | | | | |
| WTRDSVTEL | | WTRDSVTEL | | | | | |
| WTSGSIISF | | WTSGSIISF | | | | | |
| WTSGSSIAF | | WTSGSSIAF | | | | | |
| WTSGSSISF | | WTSGSSISF | | | | | |
| WTSNSIAVF | | WTSNSIAVF | | | | | |
| WTSNSIIAF | | WTSNSIIAF | | | | | |
| WTSNSIISM | | WTSNSIISM | | | | | |
| WTSNSIIVF | | WTSNSIIVF | | | | | |
| WTSNSIVAF | | WTSNSIVAF | | | | | |
| WTSNSIVAL | | WTSNSIVAL | | | | | |

Fig. 83-445

| Block size 8 | SIN | Block size 9 | SIN | Block size 10 | SIN | Block size 11 | SIN |
|---|---|---|---|---|---|---|---|
| WTSNSIVSM | | WTSNSIVSM | | | | | |
| WTSNSIVTF | | WTSNSIVTF | | | | | |
| WTSNSIVVF | | WTSNSIVVF | | | | | |
| WTSNSLIAL | | WTSNSLIAL | | | | | |
| WTSNSLVAL | | WTSNSLVAL | | | | | |
| WTSNSMVTF | | WTSNSMVTF | | | | | |
| WTSNSVVVF | | WTSNSVVVF | | | | | |
| WTSSSSIVM | | WTSSSSIVM | | | | | |
| WTSSSSTVF | | WTSSSSTVF | | | | | |
| WTSSSSVVM | | WTSSSSVVM | | | | | |
| WTTANSKSK | | WTTANSKSK | | | | | |
| WTTANSKSQ | | WTTANSKSQ | | | | | |
| WTTNSIVVF | | WTTNSIVVF | | | | | |
| WTYNAELFV | | WTYNAELFV | | | | | |
| WTYNAELLI | | WTYNAELLI | | | | | |
| WTYNAELLV | | WTYNAELLV | | | | | |
| WTYNAEVLV | | WTYNAEVLV | | | | | |
| WTYNTELLV | | WTYNTELLV | | | | | |
| WTYNVELLV | | WTYNVELLV | | | | | |
| WTYQAELLI | | WTYQAELLI | | | | | |
| WTYQAELLV | | WTYQAELLV | | | | | |
| WTYQEELLV | | WTYQEELLV | | | | | |
| WVAVAKDNA | | WVAVAKDNA | | | | | |
| WVCSNGSCR | | WVCSNGSCR | | | | | |
| WVDDAVTDI | | WVDDAVTDI | | | | | |
| WVELDEIGE | | WVELDEIGE | | | | | |
| WVELIRGQP | | WVELIRGQP | | | | | |
| WVELIRGRP | | WVELIRGRP | | | | | |
| WVELVRGLP | | WVELVRGLP | | | | | |
| WVELVRGRP | | WVELVRGRP | | | | | |
| WVEMIRGEP | | WVEMIRGEP | | | | | |
| WVEMIRGKP | | WVEMIRGKP | | | | | |
| WVEMIRGQP | | WVEMIRGQP | | | | | |
| WVEMIRGRP | | WVEMIRGRP | | | | | |
| WVGECPKYV | | WVGECPKYV | | | | | |
| WVLGENMAP | | WVLGENMAP | | | | | |
| WVLLNASWF | | WVLLNASWF | | | | | |
| WVLWISFAI | | WVLWISFAI | | | | | |
| WVMTDGPAN | | WVMTDGPAN | | | | | |
| WVMTDGPAS | | WVMTDGPAS | | | | | |
| WVPILNTSQ | | WVPILNTSQ | | | | | |
| WVPKRNRSI | | WVPKRNRSI | | | | | |
| WVQNEFNKA | | WVQNEFNKA | | | | | |
| WVQSEFNKA | | WVQSEFNKA | | | | | |
| WVRFNSDLD | | WVRFNSDLD | | | | | |
| WVRINNETI | | WVRINNETI | | | | | |
| WVRMNNETI | | WVRMNNETI | | | | | |
| WVSFSISCF | | WVSFSISCF | | | | | |
| WVSTDKDSN | | WVSTDKDSN | | | | | |
| WVSTDKNSN | | WVSTDKNSN | | | | | |
| WVSTDKSSN | | WVSTDKSSN | | | | | |
| WVTRELYVS | | WVTRELYVS | | | | | |
| WVTREPYVS | | WVTREPYVS | | | | | |
| WVVIAKDNA | | WVVIAKDNA | | | | | |
| WVVIAQDNA | | WVVIAQDNA | | | | | |
| WVVIEKDNA | | WVVIEKDNA | | | | | |
| WVVVAKDNA | | WVVVAKDNA | | | | | |
| WVWLWLVLR | | WVWLWLVLR | | | | | |
| WWASNSLIA | | WWASNSLIA | | | | | |
| WWDGLQSSD | | WWDGLQSSD | | | | | |
| WWTSNSIAV | | WWTSNSIAV | | | | | |
| WWTSNSIIS | | WWTSNSIIS | | | | | |

Fig. 83-446

| Block size 8 | SIN | Block size 9 | SIN | Block size 10 | SIN | Block size 11 | SIN |
|---|---|---|---|---|---|---|---|
| WWTSNSIIV | | WWTSNSIIV | | | | | |
| WWTSNSIVA | | WWTSNSIVA | | | | | |
| WWTSNSIVS | | WWTSNSIVS | | | | | |
| WWTSNSIVV | | WWTSNSIVV | | | | | |
| WWTSNSLIA | | WWTSNSLIA | | | | | |
| WWTSNSLVA | | WWTSNSLVA | | | | | |
| WWTSNSVVV | | WWTSNSVVV | | | | | |
| WWVVWLWLVL | | WWVVWLWLVL | | | | | |
| WYGFHHSNA | | WYGFHHSNA | | | | | |
| WYGFHHSNE | | WYGFHHSNE | | | | | |
| WYGFHHSNS | | WYGFHHSNS | | | | | |
| WYGFKHQNA | | WYGFKHQNA | | | | | |
| WYGFQHQNA | | WYGFQHQNA | | | | | |
| WYGFQHQNE | | WYGFQHQNE | | | | | |
| WYGFQHQNS | | WYGFQHQNS | | | | | |
| WYGFQHRND | | WYGFQHRND | | | | | |
| WYGFQHRNE | | WYGFQHRNE | | | | | |
| WYGFQHSNA | | WYGFQHSNA | | | | | |
| WYGFQHSND | | WYGFQHSND | | | | | |
| WYGFQHSNE | | WYGFQHSNE | | | | | |
| WYGFQHTND | | WYGFQHTND | | | | | |
| WYGFRHHNS | | WYGFRHHNS | | | | | |
| WYGFRHLNS | | WYGFRHLNS | | | | | |
| WYGFRHQKA | | WYGFRHQKA | | | | | |
| WYGFRHQNA | | WYGFRHQNA | | | | | |
| WYGFRHQNS | | WYGFRHQNS | | | | | |
| WYGFRHQNT | | WYGFRHQNT | | | | | |
| WYGFRYQNS | | WYGFRYQNS | | | | | |
| WYGYHHENS | | WYGYHHENS | | | | | |
| WYGYHHNNE | | WYGYHHNNE | | | | | |
| WYGYHHQNE | | WYGYHHQNE | | | | | |
| WYGYHHQNG | | WYGYHHQNG | | | | | |
| WYGYHHSKE | | WYGYHHSKE | | | | | |
| WYGYHHSND | | WYGYHHSND | | | | | |
| WYGYHHSNE | | WYGYHHSNE | | | | | |
| WYGYHHSNG | | WYGYHHSNG | | | | | |
| WYGYKHQNA | | WYGYKHQNA | | | | | |
| WYGYRHQNA | | WYGYRHQNA | | | | | |
| YAADKASTQ | | YAADKASTQ | | | | | |
| YAADKESTQ | | YAADKESTQ | | | | | |
| YAADKKSTQ | | YAADKKSTQ | | | | | |
| YAADLKSTQ | | YAADLKSTQ | | | | | |
| YAADQESTQ | | YAADQESTQ | | | | | |
| YAADQKSTQ | | YAADQKSTQ | | | | | |
| YAADRESTQ | | YAADRESTQ | | | | | |
| YAADRKSTQ | | YAADRKSTQ | | | | | |
| YAEESKLKR | | YAEESKLKR | | | | | |
| YAELKWLIS | | YAELKWLIS | | | | | |
| YAELKWLVS | | YAELKWLVS | | | | | |
| YAEMEWLLS | | YAEMEWLLS | | | | | |
| YAEMKWLLS | | YAEMKWLLS | | | | | |
| YAFGICPKY | | YAFGICPKY | | | | | |
| YAFGNCPKY | | YAFGNCPKY | | | | | |
| YAFGNCPMY | | YAFGNCPMY | | | | | |
| YAFGNCSKY | | YAFGNCSKY | | | | | |
| YAFGTCPKY | | YAFGTCPKY | | | | | |
| YAGAINSSK | | YAGAINSSK | | | | | |
| YAGAINSSR | | YAGAINSSR | | | | | |
| YAGAVNSSK | | YAGAVNSSK | | | | | |
| YAKKASLRL | | YAKKASLRL | | | | | |
| YALHQGTTI | | YALHQGTTI | | | | | |
| YALSQGTTI | | YALSQGTTI | | | | | |

Fig. 83-447

| Block size 8 | SIN | Block size 9 | SIN | Block size 10 | SIN | Block size 11 | SIN |
|---|---|---|---|---|---|---|---|
| YAQTDCVLE | | YAQTDCVLE | | | | | |
| YARLYIWGV | | YARLYIWGV | | | | | |
| YASKNPYTL | | YASKNPYTL | | | | | |
| YASKTRISE | | YASKTRISE | | | | | |
| YASPQLEGF | | YASPQLEGF | | | | | |
| YASSQLEGF | | YASSQLEGF | | | | | |
| YATVAGSLS | | YATVAGSLS | | | | | |
| YAVIHYGGI | | YAVIHYGGI | | | | | |
| YAVIHYGGM | | YAVIHYGGM | | | | | |
| YAVIHYGGV | | YAVIHYGGV | | | | | |
| YCFTVMTDG | | YCFTVMTDG | | | | | |
| YCICRDNWK | | YCICRDNWK | | | | | |
| YCNTDLGAP | | YCNTDLGAP | | | | | |
| YCNTDLGSP | | YCNTDLGSP | | | | | |
| YCNTDLGTP | | YCNTDLGTP | | | | | |
| YCRATEYIM | | YCRATEYIM | | | | | |
| YCSLNGISP | | YCSLNGISP | | | | | |
| YCSLNGVSP | | YCSLNGVSP | | | | | |
| YCVCRDNWK | | YCVCRDNWK | | | | | |
| YCYPGATVN | | YCYPGATVN | | | | | |
| YCYPGSTVN | | YCYPGSTVN | | | | | |
| YCYPGTTVN | | YCYPGTTVN | | | | | |
| YDAIEECLI | | YDAIEECLI | | | | | |
| YDAVATTHS | | YDAVATTHS | | | | | |
| YDFEKEGYS | | YDFEKEGYS | | | | | |
| YDFEREGYS | | YDFEREGYS | | | | | |
| YDGIITDTI | | YDGIITDTI | | | | | |
| YDGKAWLHI | | YDGKAWLHI | | | | | |
| YDGKAWLHV | | YDGKAWLHV | | | | | |
| YDGRLIQNS | | YDGRLIQNS | | | | | |
| YDHAQYREE | | YDHAQYREE | | | | | |
| YDHKDYEEE | | YDHKDYEEE | | | | | |
| YDHKEFEEE | | YDHKEFEEE | | | | | |
| YDHKEFEKE | | YDHKEFEKE | | | | | |
| YDHKEFKEE | | YDHKEFKEE | | | | | |
| YDHKEYEEE | | YDHKEYEEE | | | | | |
| YDHNIYRDE | | YDHNIYRDE | | | | | |
| YDHSHYREE | | YDHSHYREE | | | | | |
| YDHSQYREE | | YDHSQYREE | | | | | |
| YDHTQYREE | | YDHTQYREE | | | | | |
| YDKICIGYQ | | YDKICIGYQ | | | | | |
| YDKVRLQLK | | YDKVRLQLK | | | | | |
| YDKVRLQLR | | YDKVRLQLR | | | | | |
| YDKVRMQLK | | YDKVRMQLK | | | | | |
| YDKVRMQLR | | YDKVRMQLR | | | | | |
| YDNGVWIGR | | YDNGVWIGR | | | | | |
| YDRICIGYQ | | YDRICIGYQ | | | | | |
| YDRRLTTTI | | YDRRLTTTI | | | | | |
| YDRRLTTTV | | YDRRLTTTV | | | | | |
| YDRVRKQLR | | YDRVRKQLR | | | | | |
| YDRVRLQLR | | YDRVRLQLR | | | | | |
| YDRVRMQLR | | YDRVRMQLR | | | | | |
| YDSIRGEFN | | YDSIRGEFN | | | | | |
| YDSIRGEFS | | YDSIRGEFS | | | | | |
| YDVGYLCAG | | YDVGYLCAG | | | | | |
| YDWTLNRNQ | | YDWTLNRNQ | | | | | |
| YDYPKYEEE | | YDYPKYEEE | | | | | |
| YDYPKYEKE | | YDYPKYEKE | | | | | |
| YDYPKYSEE | | YDYPKYSEE | | | | | |
| YDYPKYSKE | | YDYPKYSKE | | | | | |
| YDYSKYEEE | | YDYSKYEEE | | | | | |
| YEAIEECLI | | YEAIEECLI | | | | | |

Fig. 83-448

| Block size 8 | SIN | Block size 9 | SIN | Block size 10 | SIN | Block size 11 | SIN |
|---|---|---|---|---|---|---|---|
| YEDESRIER | | YEDESRIER | | | | | |
| YEECSCYPD | | YEECSCYPD | | | | | |
| YEECSCYPE | | YEECSCYPE | | | | | |
| YEECSCYPN | | YEECSCYPN | | | | | |
| YEEEAKLEK | | YEEEAKLEK | | | | | |
| YEEEAKLER | | YEEEAKLER | | | | | |
| YEEESKIER | | YEEESKIER | | | | | |
| YEEESKLER | | YEEESKLER | | | | | |
| YEEESKLKR | | YEEESKLKR | | | | | |
| YEEESKLNK | | YEEESKLNK | | | | | |
| YEEESKLNR | | YEEESKLNR | | | | | |
| YEEESRIER | | YEEESRIER | | | | | |
| YEEESRLNR | | YEEESRLNR | | | | | |
| YEELKEQLS | | YEELKEQLS | | | | | |
| YEELKHLLN | | YEELKHLLN | | | | | |
| YEELKHLLS | | YEELKHLLS | | | | | |
| YEELKHLMS | | YEELKHLMS | | | | | |
| YEELREHLS | | YEELREHLS | | | | | |
| YEELREQLN | | YEELREQLN | | | | | |
| YEELREQLS | | YEELREQLS | | | | | |
| YEELREQMS | | YEELREQMS | | | | | |
| YEGRLIQNS | | YEGRLIQNS | | | | | |
| YEILKVPNA | | YEILKVPNA | | | | | |
| YEKVRLQLR | | YEKVRLQLR | | | | | |
| YEKVRMQLR | | YEKVRMQLR | | | | | |
| YEKVRRQLR | | YEKVRRQLR | | | | | |
| YELEIGARI | | YELEIGARI | | | | | |
| YELEIGTRI | | YELEIGTRI | | | | | |
| YEMLKVPDA | | YEMLKVPDA | | | | | |
| YEMLKVPNA | | YEMLKVPNA | | | | | |
| YENNPGRVT | | YENNPGRVT | | | | | |
| YENNTWVNQ | | YENNTWVNQ | | | | | |
| YENTTWVNQ | | YENTTWVNQ | | | | | |
| YEQMETDGD | | YEQMETDGD | | | | | |
| YEQMETDGE | | YEQMETDGE | | | | | |
| YEQMETGGE | | YEQMETGGE | | | | | |
| YEQMETSGE | | YEQMETSGE | | | | | |
| YERMCNILK | | YERMCNILK | | | | | |
| YERRLTTTI | | YERRLTTTI | | | | | |
| YERVKKQLR | | YERVKKQLR | | | | | |
| YERVKMFDF | | YERVKMFDF | | | | | |
| YERVKRQLR | | YERVKRQLR | | | | | |
| YERVRKQLR | | YERVRKQLR | | | | | |
| YERVRRQLR | | YERVRRQLR | | | | | |
| YESIEECLI | | YESIEECLI | | | | | |
| YESSINPAG | | YESSINPAG | | | | | |
| YESTQAAID | | YESTQAAID | | | | | |
| YETFKVIGG | | YETFKVIGG | | | | | |
| YETFRVIDG | | YETFRVIDG | | | | | |
| YETFRVIGG | | YETFRVIGG | | | | | |
| YETFRVISG | | YETFRVISG | | | | | |
| YEVGYLCAG | | YEVGYLCAG | | | | | |
| YEVLKVPDA | | YEVLKVPDA | | | | | |
| YEVLKVPNA | | YEVLKVPNA | | | | | |
| YFFGDNAEE | | YFFGDNAEE | | | | | |
| YFFGDNAKE | | YFFGDNAKE | | | | | |
| YFFGDSAEE | | YFFGDSAEE | | | | | |
| YFFLKVPVQ | | YFFLKVPVQ | | | | | |
| YFHDSNVKN | | YFHDSNVKN | | | | | |
| YFHKGIVIK | | YFHKGIVIK | | | | | |
| YFHKGLIIK | | YFHKGLIIK | | | | | |
| YFHKGLLIK | | YFHKGLLIK | | | | | |

Fig. 83-449

| Block size 8 | SIN | Block size 9 | SIN | Block size 10 | SIN | Block size 11 | SIN |
|---|---|---|---|---|---|---|---|
| YFHKGLVIK | | YFHKGLVIK | | | | | |
| YFHKGLVVK | | YFHKGLVVK | | | | | |
| YFLDVFAGD | | YFLDVFAGD | | | | | |
| YFQLFLVCV | | YFQLFLVCV | | | | | |
| YFTAEISHC | | YFTAEISHC | | | | | |
| YFTAEVSHC | | YFTAEVSHC | | | | | |
| YFTAEVSYC | | YFTAEVSYC | | | | | |
| YFTTEVSHC | | YFTTEVSHC | | | | | |
| YFVKEGKIV | | YFVKEGKIV | | | | | |
| YGAGNKLIT | | YGAGNKLIT | | | | | |
| YGAGSWPDG | | YGAGSWPDG | | | | | |
| YGAIEECLI | | YGAIEECLI | | | | | |
| YGAQSLSIS | | YGAQSLSIS | | | | | |
| YGASINSAG | | YGASINSAG | | | | | |
| YGDGVWIGR | | YGDGVWIGR | | | | | |
| YGFHHSNAE | | YGFHHSNAE | | | | | |
| YGFHHSNSE | | YGFHHSNSE | | | | | |
| YGFIIKGRS | | YGFIIKGRS | | | | | |
| YGFIVKGRS | | YGFIVKGRS | | | | | |
| YGFKHQNAQ | | YGFKHQNAQ | | | | | |
| YGFKISKRG | | YGFKISKRG | | | | | |
| YGFQHQNAE | | YGFQHQNAE | | | | | |
| YGFQHQNEQ | | YGFQHQNEQ | | | | | |
| YGFQHQNSE | | YGFQHQNSE | | | | | |
| YGFQHRNDE | | YGFQHRNDE | | | | | |
| YGFQHRNEE | | YGFQHRNEE | | | | | |
| YGFQHSNAQ | | YGFQHSNAQ | | | | | |
| YGFQHSNDQ | | YGFQHSNDQ | | | | | |
| YGFQHSNEQ | | YGFQHSNEQ | | | | | |
| YGFQHTNDQ | | YGFQHTNDQ | | | | | |
| YGFRHHNSE | | YGFRHHNSE | | | | | |
| YGFRHLNSE | | YGFRHLNSE | | | | | |
| YGFRHQKAQ | | YGFRHQKAQ | | | | | |
| YGFRHQNAE | | YGFRHQNAE | | | | | |
| YGFRHQNAQ | | YGFRHQNAQ | | | | | |
| YGFRHQNSE | | YGFRHQNSE | | | | | |
| YGFRHQNSQ | | YGFRHQNSQ | | | | | |
| YGFRHQNTQ | | YGFRHQNTQ | | | | | |
| YGFRISKRG | | YGFRISKRG | | | | | |
| YGFRYQNSE | | YGFRYQNSE | | | | | |
| YGFVANFSM | | YGFVANFSM | | | | | |
| YGGIPTDVI | | YGGIPTDVI | | | | | |
| YGGIPTDVV | | YGGIPTDVV | | | | | |
| YGGLNKSKP | | YGGLNKSKP | | | | | |
| YGGMPTDVV | | YGGMPTDVV | | | | | |
| YGGVPTDVI | | YGGVPTDVI | | | | | |
| YGGVPTDVV | | YGGVPTDVV | | | | | |
| YGHDSKVTC | | YGHDSKVTC | | | | | |
| YGHLITGKS | | YGHLITGKS | | | | | |
| YGHLTTGKS | | YGHLTTGKS | | | | | |
| YGHLVTGKS | | YGHLVTGKS | | | | | |
| YGHNQKITC | | YGHNQKITC | | | | | |
| YGHNSKVTC | | YGHNSKVTC | | | | | |
| YGHSQKATC | | YGHSQKATC | | | | | |
| YGHSQKVTC | | YGHSQKVTC | | | | | |
| YGKDNAIRI | | YGKDNAIRI | | | | | |
| YGKDNAVRI | | YGKDNAVRI | | | | | |
| YGKGRIFQS | | YGKGRIFQS | | | | | |
| YGNCDAKCQ | | YGNCDAKCQ | | | | | |
| YGNCDTKCQ | | YGNCDTKCQ | | | | | |
| YGNCNAKCQ | | YGNCNAKCQ | | | | | |
| YGNCNTKCQ | | YGNCNTKCQ | | | | | |

Fig. 83-450

| Block size 8 | SIN | Block size 9 | SIN | Block size 10 | SIN | Block size 11 | SIN |
|---|---|---|---|---|---|---|---|
| YGNDVWMGR | | YGNDVWMGR | | | | | |
| YGNGAWIGR | | YGNGAWIGR | | | | | |
| YGNGVWIGR | | YGNGVWIGR | | | | | |
| YGNGVWMGR | | YGNGVWMGR | | | | | |
| YGNPKCDIH | | YGNPKCDIH | | | | | |
| YGNPKCDTH | | YGNPKCDTH | | | | | |
| YGNPKCDVH | | YGNPKCDVH | | | | | |
| YGPALSINE | | YGPALSINE | | | | | |
| YGPALSISE | | YGPALSISE | | | | | |
| YGPINVTKE | | YGPINVTKE | | | | | |
| YGRGRIFQS | | YGRGRIFQS | | | | | |
| YGRIIQNED | | YGRIIQNED | | | | | |
| YGSDVWMGR | | YGSDVWMGR | | | | | |
| YGSENKLIT | | YGSENKLIT | | | | | |
| YGSGAKLIT | | YGSGAKLIT | | | | | |
| YGSGNKLIT | | YGSGNKLIT | | | | | |
| YGSGNKLVT | | YGSGNKLVT | | | | | |
| YGSGRIFQS | | YGSGRIFQS | | | | | |
| YGSGSKLIT | | YGSGSKLIT | | | | | |
| YGSGSWPDG | | YGSGSWPDG | | | | | |
| YGSSINSAG | | YGSSINSAG | | | | | |
| YGSSITSAG | | YGSSITSAG | | | | | |
| YGTGNKLIT | | YGTGNKLIT | | | | | |
| YGTGRIFQS | | YGTGRIFQS | | | | | |
| YGTGSWPDG | | YGTGSWPDG | | | | | |
| YGTGSWPDV | | YGTGSWPDV | | | | | |
| YGTGTWPDG | | YGTGTWPDG | | | | | |
| YGTQPLSIS | | YGTQPLSIS | | | | | |
| YGTQSLSIS | | YGTQSLSIS | | | | | |
| YGVKGFGFR | | YGVKGFGFR | | | | | |
| YGVKGFSFR | | YGVKGFSFR | | | | | |
| YGYHHENSQ | | YGYHHENSQ | | | | | |
| YGYHHQNEQ | | YGYHHQNEQ | | | | | |
| YGYHHQNGQ | | YGYHHQNGQ | | | | | |
| YGYHHSNDQ | | YGYHHSNDQ | | | | | |
| YGYIIEEYG | | YGYIIEEYG | | | | | |
| YGYIIEKYG | | YGYIIEKYG | | | | | |
| YGYKHQNAQ | | YGYKHQNAQ | | | | | |
| YGYLITGKS | | YGYLITGKS | | | | | |
| YGYRHQNAQ | | YGYRHQNAQ | | | | | |
| YHANNSKKQ | | YHANNSKKQ | | | | | |
| YHANNSTDT | | YHANNSTDT | | | | | |
| YHANNSTEH | | YHANNSTEH | | | | | |
| YHANNSTEK | | YHANNSTEK | | | | | |
| YHANNSTEQ | | YHANNSTEQ | | | | | |
| YHANNSTER | | YHANNSTER | | | | | |
| YHANNSTET | | YHANNSTET | | | | | |
| YHANNSTKQ | | YHANNSTKQ | | | | | |
| YHANNSTTK | | YHANNSTTK | | | | | |
| YHANNSTTQ | | YHANNSTTQ | | | | | |
| YHANNSTVQ | | YHANNSTVQ | | | | | |
| YHDSNVKNL | | YHDSNVKNL | | | | | |
| YHFEECSCY | | YHFEECSCY | | | | | |
| YHHENSQGS | | YHHENSQGS | | | | | |
| YHHQNAQGS | | YHHQNAQGS | | | | | |
| YHHQNEQGS | | YHHQNEQGS | | | | | |
| YHHQNGQGS | | YHHQNGQGS | | | | | |
| YHHSNDQGA | | YHHSNDQGA | | | | | |
| YHHSNDQGS | | YHHSNDQGS | | | | | |
| YHKCDDECI | | YHKCDDECI | | | | | |
| YHKCDDECM | | YHKCDDECM | | | | | |
| YHKCDNECI | | YHKCDNECI | | | | | |

Fig. 83-451

| Block size 8 | SIN | Block size 9 | SIN | Block size 10 | SIN | Block size 11 | SIN |
|---|---|---|---|---|---|---|---|
| YHKCDNECM | | YHKCDNECM | | | | | |
| YHKCDNGCI | | YHKCDNGCI | | | | | |
| YHKCDNKCI | | YHKCDNKCI | | | | | |
| YHKCNDECM | | YHKCNDECM | | | | | |
| YHKCNNECI | | YHKCNNECI | | | | | |
| YHQIEKEFE | | YHQIEKEFE | | | | | |
| YHQIEKEFG | | YHQIEKEFG | | | | | |
| YHQSFVPSP | | YHQSFVPSP | | | | | |
| YHSNNSTEK | | YHSNNSTEK | | | | | |
| YHSNNSTKK | | YHSNNSTKK | | | | | |
| YHTGRSSFF | | YHTGRSSFF | | | | | |
| YHWNLALDI | | YHWNLALDI | | | | | |
| YHYEECSCY | | YHYEECSCY | | | | | |
| YICSGFFGD | | YICSGFFGD | | | | | |
| YICSGIFGD | | YICSGIFGD | | | | | |
| YICSGLVGD | | YICSGLVGD | | | | | |
| YICSGVFGD | | YICSGVFGD | | | | | |
| YICSKFHSD | | YICSKFHSD | | | | | |
| YICSPVLTD | | YICSPVLTD | | | | | |
| YICTGILTD | | YICTGILTD | | | | | |
| YICTGVLTD | | YICTGVLTD | | | | | |
| YICVKNGNM | | YICVKNGNM | | | | | |
| YIEGKLSQM | | YIEGKLSQM | | | | | |
| YIELIRGKP | | YIELIRGKP | | | | | |
| YIELIRGRP | | YIELIRGRP | | | | | |
| YIEVLHLTQ | | YIEVLHLTQ | | | | | |
| YIGKCPKYI | | YIGKCPKYI | | | | | |
| YIGKCPRYI | | YIGKCPRYI | | | | | |
| YIIEEYGKG | | YIIEEYGKG | | | | | |
| YIIEEYGRG | | YIIEEYGRG | | | | | |
| YIIEKYGSG | | YIIEKYGSG | | | | | |
| YIIEKYGTG | | YIIEKYGTG | | | | | |
| YIIRALTLN | | YIIRALTLN | | | | | |
| YIKQGSLKL | | YIKQGSLKL | | | | | |
| YIKQNTLKL | | YIKQNTLKL | | | | | |
| YIKSDQLKL | | YIKSDQLKL | | | | | |
| YIKSGQLKL | | YIKSGQLKL | | | | | |
| YINKTGTFE | | YINKTGTFE | | | | | |
| YINRTGTFE | | YINRTGTFE | | | | | |
| YINTALLNA | | YINTALLNA | | | | | |
| YINTAMLNA | | YINTAMLNA | | | | | |
| YIPSGSLKL | | YIPSGSLKL | | | | | |
| YIPSNSLKL | | YIPSNSLKL | | | | | |
| YIPSRSLKL | | YIPSRSLKL | | | | | |
| YIQMCTELK | | YIQMCTELK | | | | | |
| YIQMCTELQ | | YIQMCTELQ | | | | | |
| YIRTNGTSK | | YIRTNGTSK | | | | | |
| YISIGTSTL | | YISIGTSTL | | | | | |
| YISSGSLKL | | YISSGSLKL | | | | | |
| YISVGTSTL | | YISVGTSTL | | | | | |
| YIVERPKEI | | YIVERPKEI | | | | | |
| YIVERPKEM | | YIVERPKEM | | | | | |
| YIVERPSAP | | YIVERPSAP | | | | | |
| YIVERTKEM | | YIVERTKEM | | | | | |
| YIVKKGDSA | | YIVKKGDSA | | | | | |
| YIWGVHHPS | | YIWGVHHPS | | | | | |
| YIWTYQAEL | | YIWTYQAEL | | | | | |
| YKALSIYSC | | YKALSIYSC | | | | | |
| YKDIILWFS | | YKDIILWFS | | | | | |
| YKDIILWIS | | YKDIILWIS | | | | | |
| YKDIILWVS | | YKDIILWVS | | | | | |
| YKDLDNCHP | | YKDLDNCHP | | | | | |

Fig. 83-452

| Block size 8 | SIN | Block size 9 | SIN | Block size 10 | SIN | Block size 11 | SIN |
|---|---|---|---|---|---|---|---|
| YKDLGNCHP | | YKDLGNCHP | | | | | |
| YKDLGSCHP | | YKDLGSCHP | | | | | |
| YKDVILWFS | | YKDVILWFS | | | | | |
| YKDWILWIS | | YKDWILWIS | | | | | |
| YKDWVLWIS | | YKDWVLWIS | | | | | |
| YKEESQLKR | | YKEESQLKR | | | | | |
| YKEICIAWS | | YKEICIAWS | | | | | |
| YKEICVAWS | | YKEICVAWS | | | | | |
| YKEIILWFS | | YKEIILWFS | | | | | |
| YKEIRIAWS | | YKEIRIAWS | | | | | |
| YKEVILWFS | | YKEVILWFS | | | | | |
| YKGIITDTI | | YKGIITDTI | | | | | |
| YKGRLCNPL | | YKGRLCNPL | | | | | |
| YKHQNAQGE | | YKHQNAQGE | | | | | |
| YKIGYICSG | | YKIGYICSG | | | | | |
| YKIIKKGDS | | YKIIKKGDS | | | | | |
| YKILKIKKG | | YKILKIKKG | | | | | |
| YKILKIRKG | | YKILKIRKG | | | | | |
| YKILSIYSC | | YKILSIYSC | | | | | |
| YKILSIYSS | | YKILSIYSS | | | | | |
| YKILSIYST | | YKILSIYST | | | | | |
| YKILTIYST | | YKILTIYST | | | | | |
| YKISKSTKS | | YKISKSTKS | | | | | |
| YKIVKEGDS | | YKIVKEGDS | | | | | |
| YKIVKKGDS | | YKIVKKGDS | | | | | |
| YKIVKTGDS | | YKIVKTGDS | | | | | |
| YKKLKREIT | | YKKLKREIT | | | | | |
| YKKLKREMT | | YKKLKREMT | | | | | |
| YKMNIQILI | | YKMNIQILI | | | | | |
| YKMNNQILI | | YKMNNQILI | | | | | |
| YKMNTKILV | | YKMNTKILV | | | | | |
| YKMNTQILI | | YKMNTQILI | | | | | |
| YKMNTQILV | | YKMNTQILV | | | | | |
| YKMNTRILI | | YKMNTRILI | | | | | |
| YKNANTLSS | | YKNANTLSS | | | | | |
| YKNANTLTS | | YKNANTLTS | | | | | |
| YKNNPGRVS | | YKNNPGRVS | | | | | |
| YKNNPGRVT | | YKNNPGRVT | | | | | |
| YKNNTWVNQ | | YKNNTWVNQ | | | | | |
| YKNSPGRVT | | YKNSPGRVT | | | | | |
| YKNTGDSDI | | YKNTGDSDI | | | | | |
| YKNTNTLSS | | YKNTNTLSS | | | | | |
| YKNTRDSDI | | YKNTRDSDI | | | | | |
| YKNTRDSNI | | YKNTRDSNI | | | | | |
| YKNWILWIS | | YKNWILWIS | | | | | |
| YKNWSKPQC | | YKNWSKPQC | | | | | |
| YKRIRLFDY | | YKRIRLFDY | | | | | |
| YKRVRLFDY | | YKRVRLFDY | | | | | |
| YKSNPGRVT | | YKSNPGRVT | | | | | |
| YKSTPSAID | | YKSTPSAID | | | | | |
| YKSTQAAID | | YKSTQAAID | | | | | |
| YKSTQAAVD | | YKSTQAAVD | | | | | |
| YKSTQKTID | | YKSTQKTID | | | | | |
| YKSTQSAID | | YKSTQSAID | | | | | |
| YKSTQSAIN | | YKSTQSAIN | | | | | |
| YKSTQSAVD | | YKSTQSAVD | | | | | |
| YKVATGRVT | | YKVATGRVT | | | | | |
| YKVGYLCAG | | YKVGYLCAG | | | | | |
| YKVLAIYSC | | YKVLAIYSC | | | | | |
| YKVLSIYSC | | YKVLSIYSC | | | | | |
| YKYGNGVWI | | YKYGNGVWI | | | | | |
| YKYKIFKNG | | YKYKIFKNG | | | | | |

Fig. 83-453

| Block size 8 | SIN | Block size 9 | SIN | Block size 10 | SIN | Block size 11 | SIN |
|---|---|---|---|---|---|---|---|
| YLCAGIPSD | | YLCAGIPSD | | | | | |
| YLCAGIPTD | | YLCAGIPTD | | | | | |
| YLCAGLPSD | | YLCAGLPSD | | | | | |
| YLCSGLVGD | | YLCSGLVGD | | | | | |
| YLCSKILTD | | YLCSKILTD | | | | | |
| YLCSKTLTD | | YLCSKTLTD | | | | | |
| YLCSKVLTD | | YLCSKVLTD | | | | | |
| YLCSRILTD | | YLCSRILTD | | | | | |
| YLCSRVLTD | | YLCSRVLTD | | | | | |
| YLCTGILTD | | YLCTGILTD | | | | | |
| YLCTGVLTD | | YLCTGVLTD | | | | | |
| YLECRTFFL | | YLECRTFFL | | | | | |
| YLEEHPNAG | | YLEEHPNAG | | | | | |
| YLEEHPSAG | | YLEEHPSAG | | | | | |
| YLEEHPSTG | | YLEEHPSTG | | | | | |
| YLEENPSAG | | YLEENPSAG | | | | | |
| YLEKANKIK | | YLEKANKIK | | | | | |
| YLEKASKIK | | YLEKASKIK | | | | | |
| YLEKYVEDT | | YLEKYVEDT | | | | | |
| YLIEDPAAP | | YLIEDPAAP | | | | | |
| YLIEDPGAP | | YLIEDPGAP | | | | | |
| YLIEDPNAP | | YLIEDPNAP | | | | | |
| YLIEDPSAP | | YLIEDPSAP | | | | | |
| YLIEDPTAP | | YLIEDPTAP | | | | | |
| YLIGKTSWS | | YLIGKTSWS | | | | | |
| YLIRALTLN | | YLIRALTLN | | | | | |
| YLIRTLTLN | | YLIRTLTLN | | | | | |
| YLITGKSHG | | YLITGKSHG | | | | | |
| YLLFQDILM | | YLLFQDILM | | | | | |
| YLLKGESHC | | YLLKGESHC | | | | | |
| YLLKGESHG | | YLLKGESHG | | | | | |
| YLLKGESYG | | YLLKGESYG | | | | | |
| YLLLNKSLC | | YLLLNKSLC | | | | | |
| YLLRGESHG | | YLLRGESHG | | | | | |
| YLMLNKSLC | | YLMLNKSLC | | | | | |
| YLMLSKSLC | | YLMLSKSLC | | | | | |
| YLNGREWSY | | YLNGREWSY | | | | | |
| YLPDLYDYK | | YLPDLYDYK | | | | | |
| YLSGREWSY | | YLSGREWSY | | | | | |
| YLSNNATDT | | YLSNNATDT | | | | | |
| YLSNNSSDT | | YLSNNSSDT | | | | | |
| YLSNNSTDK | | YLSNNSTDK | | | | | |
| YLSNNSTDT | | YLSNNSTDT | | | | | |
| YLSNNSTEK | | YLSNNSTEK | | | | | |
| YLSNNSTER | | YLSNNSTER | | | | | |
| YLSTNSSDK | | YLSTNSSDK | | | | | |
| YLSTNSSEK | | YLSTNSSEK | | | | | |
| YLSTNSSER | | YLSTNSSER | | | | | |
| YLSTNSTEK | | YLSTNSTEK | | | | | |
| YLSTNSTET | | YLSTNSTET | | | | | |
| YLTGTWDTL | | YLTGTWDTL | | | | | |
| YLVLNKSLC | | YLVLNKSLC | | | | | |
| YLWGVHHPS | | YLWGVHHPS | | | | | |
| YMCSGLVGD | | YMCSGLVGD | | | | | |
| YMGECPEYV | | YMGECPEYV | | | | | |
| YMGECPKYA | | YMGECPKYA | | | | | |
| YMGECPKYV | | YMGECPKYV | | | | | |
| YMGECPNYV | | YMGECPNYV | | | | | |
| YMLERELVR | | YMLERELVR | | | | | |
| YMNTALLNA | | YMNTALLNA | | | | | |
| YMNVKSLKL | | YMNVKSLKL | | | | | |
| YMSNNSTEK | | YMSNNSTEK | | | | | |

Fig. 83-454

| Block size 8 | SIN | Block size 9 | SIN | Block size 10 | SIN | Block size 11 | SIN |
|---|---|---|---|---|---|---|---|
| YNADLLVAM | | YNADLLVAM | | | | | |
| YNADVLVAL | | YNADVLVAL | | | | | |
| YNAEFLVAL | | YNAEFLVAL | | | | | |
| YNAEFLVAM | | YNAEFLVAM | | | | | |
| YNAEFLVAV | | YNAEFLVAV | | | | | |
| YNAEILVAL | | YNAEILVAL | | | | | |
| YNAELFVLM | | YNAELFVLM | | | | | |
| YNAELIVLL | | YNAELIVLL | | | | | |
| YNAELLIAM | | YNAELLIAM | | | | | |
| YNAELLILL | | YNAELLILL | | | | | |
| YNAELLVAL | | YNAELLVAL | | | | | |
| YNAELLVAM | | YNAELLVAM | | | | | |
| YNAELLVLI | | YNAELLVLI | | | | | |
| YNAELLVLL | | YNAELLVLL | | | | | |
| YNAELLVLM | | YNAELLVLM | | | | | |
| YNAEVLVLM | | YNAEVLVLM | | | | | |
| YNAGLLVAL | | YNAGLLVAL | | | | | |
| YNAKLLVLI | | YNAKLLVLI | | | | | |
| YNAKLLVLL | | YNAKLLVLL | | | | | |
| YNAQLLVLL | | YNAQLLVLL | | | | | |
| YNAQLLVWL | | YNAQLLVWL | | | | | |
| YNARLLVLL | | YNARLLVLL | | | | | |
| YNETFVNIT | | YNETFVNIT | | | | | |
| YNETFVNVT | | YNETFVNVT | | | | | |
| YNETVRLET | | YNETVRLET | | | | | |
| YNETVRVEI | | YNETVRVEI | | | | | |
| YNETVRVET | | YNETVRVET | | | | | |
| YNETVRVKT | | YNETVRVKT | | | | | |
| YNFEKEGYS | | YNFEKEGYS | | | | | |
| YNGIITDTF | | YNGIITDTF | | | | | |
| YNGIITDTI | | YNGIITDTI | | | | | |
| YNGIITDTL | | YNGIITDTL | | | | | |
| YNGIRTNGA | | YNGIRTNGA | | | | | |
| YNGKSLGIQ | | YNGKSLGIQ | | | | | |
| YNGLITDTI | | YNGLITDTI | | | | | |
| YNGMITDTI | | YNGMITDTI | | | | | |
| YNGQKSWMK | | YNGQKSWMK | | | | | |
| YNGQKSWTK | | YNGQKSWTK | | | | | |
| YNGQRSWMK | | YNGQRSWMK | | | | | |
| YNGRLTTTI | | YNGRLTTTI | | | | | |
| YNGVITDTL | | YNGVITDTL | | | | | |
| YNHEDYKEE | | YNHEDYKEE | | | | | |
| YNHEDYREE | | YNHEDYREE | | | | | |
| YNHKDYEEE | | YNHKDYEEE | | | | | |
| YNHKEYEEE | | YNHKEYEEE | | | | | |
| YNHTEYRQE | | YNHTEYRQE | | | | | |
| YNHTQYREE | | YNHTQYREE | | | | | |
| YNIRNLHIP | | YNIRNLHIP | | | | | |
| YNKIEFEPF | | YNKIEFEPF | | | | | |
| YNKLEFEPF | | YNKLEFEPF | | | | | |
| YNKMEFEPF | | YNKMEFEPF | | | | | |
| YNKRLTTTI | | YNKRLTTTI | | | | | |
| YNKTVINNI | | YNKTVINNI | | | | | |
| YNKVEFEPF | | YNKVEFEPF | | | | | |
| YNKVRMQLR | | YNKVRMQLR | | | | | |
| YNNTNGEQI | | YNNTNGEQI | | | | | |
| YNNTSGEQI | | YNNTSGEQI | | | | | |
| YNNTSGEQM | | YNNTSGEQM | | | | | |
| YNNTSGEQV | | YNNTSGEQV | | | | | |
| YNNTSGKQM | | YNNTSGKQM | | | | | |
| YNNTTGRDV | | YNNTTGRDV | | | | | |
| YNNTVINNI | | YNNTVINNI | | | | | |

Fig. 83-455

| Block size 8 | SIN | Block size 9 | SIN | Block size 10 | SIN | Block size 11 | SIN |
|---|---|---|---|---|---|---|---|
| YNNTVINNM | | YNNTVINNM | | | | | |
| YNNTVVNNI | | YNNTVVNNI | | | | | |
| YNPCFYVEL | | YNPCFYVEL | | | | | |
| YNRKEYEEE | | YNRKEYEEE | | | | | |
| YNRRLTTTI | | YNRRLTTTI | | | | | |
| YNRRPTTTI | | YNRRPTTTI | | | | | |
| YNSKFESVA | | YNSKFESVA | | | | | |
| YNSRFESVA | | YNSRFESVA | | | | | |
| YNSTVVNNI | | YNSTVVNNI | | | | | |
| YNTELLVLM | | YNTELLVLM | | | | | |
| YNVELLVLM | | YNVELLVLM | | | | | |
| YNVGYLCAG | | YNVGYLCAG | | | | | |
| YNYHQSFVP | | YNYHQSFVP | | | | | |
| YNYPKYEEE | | YNYPKYEEE | | | | | |
| YNYPKYSEE | | YNYPKYSEE | | | | | |
| YNYSKYEEE | | YNYSKYEEE | | | | | |
| YPDVRCICR | | YPDVRCICR | | | | | |
| YPDVRCTCR | | YPDVRCTCR | | | | | |
| YPDVRCVCR | | YPDVRCVCR | | | | | |
| YPFDVPDYQ | | YPFDVPDYQ | | | | | |
| YPFDVPEYQ | | YPFDVPEYQ | | | | | |
| YPFDVPGYQ | | YPFDVPGYQ | | | | | |
| YPFDVPNYQ | | YPFDVPNYQ | | | | | |
| YPGATINEE | | YPGATINEE | | | | | |
| YPGATVNEE | | YPGATVNEE | | | | | |
| YPGATVNEG | | YPGATVNEG | | | | | |
| YPGELDNNG | | YPGELDNNG | | | | | |
| YPGELNNNG | | YPGELNNNG | | | | | |
| YPGEVDNNG | | YPGEVDNNG | | | | | |
| YPGFVENLE | | YPGFVENLE | | | | | |
| YPGKFANEE | | YPGKFANEE | | | | | |
| YPGKFTNEE | | YPGKFTNEE | | | | | |
| YPGKFVNEE | | YPGKFVNEE | | | | | |
| YPGKFVNGE | | YPGKFVNGE | | | | | |
| YPGNFNDYE | | YPGNFNDYE | | | | | |
| YPGNNNGVK | | YPGNNNGVK | | | | | |
| YPGNNNKGV | | YPGNNNKGV | | | | | |
| YPGNNNNGV | | YPGNNNNGV | | | | | |
| YPGNSNNGV | | YPGNSNNGV | | | | | |
| YPGRFTNEE | | YPGRFTNEE | | | | | |
| YPGSFNDYE | | YPGSFNDYE | | | | | |
| YPGSFNNYE | | YPGSFNNYE | | | | | |
| YPGSIENLE | | YPGSIENLE | | | | | |
| YPGSIENQE | | YPGSIENQE | | | | | |
| YPGSIKNQE | | YPGSIKNQE | | | | | |
| YPGSLNDYE | | YPGSLNDYE | | | | | |
| YPGSTVNEE | | YPGSTVNEE | | | | | |
| YPGSVENLE | | YPGSVENLE | | | | | |
| YPGSVENQE | | YPGSVENQE | | | | | |
| YPGTTVNEE | | YPGTTVNEE | | | | | |
| YPGVRCICR | | YPGVRCICR | | | | | |
| YPIQNLTKV | | YPIQNLTKV | | | | | |
| YPKIYKTYF | | YPKIYKTYF | | | | | |
| YPKVYKPYF | | YPKVYKPYF | | | | | |
| YPKVYKTYF | | YPKVYKTYF | | | | | |
| YPKVYRTYF | | YPKVYRTYF | | | | | |
| YPKYEEESK | | YPKYEEESK | | | | | |
| YPKYEEESR | | YPKYEEESR | | | | | |
| YPKYEKESK | | YPKYEKESK | | | | | |
| YPKYSEEAK | | YPKYSEEAK | | | | | |
| YPKYSEESK | | YPKYSEESK | | | | | |
| YPKYSEESR | | YPKYSEESR | | | | | |

Fig. 83-456

| Block size 8 | SIN | Block size 9 | SIN | Block size 10 | SIN | Block size 11 | SIN |
|---|---|---|---|---|---|---|---|
| YPKYSKESK | | YPKYSKESK | | | | | |
| YPLQNLTKI | | YPLQNLTKI | | | | | |
| YPLQNLTKT | | YPLQNLTKT | | | | | |
| YPLQNLTKV | | YPLQNLTKV | | | | | |
| YPNDGKVEC | | YPNDGKVEC | | | | | |
| YPNEGKVEC | | YPNEGKVEC | | | | | |
| YPNLCQVEC | | YPNLCQVEC | | | | | |
| YPNLGKVEC | | YPNLGKVEC | | | | | |
| YPNLGQVEC | | YPNLGQVEC | | | | | |
| YPNMGKVEC | | YPNMGKVEC | | | | | |
| YPNNGKVEC | | YPNNGKVEC | | | | | |
| YPNSGKVEC | | YPNSGKVEC | | | | | |
| YPNVRCVCR | | YPNVRCVCR | | | | | |
| YPQYPDVRC | | YPQYPDVRC | | | | | |
| YPQYPNVRC | | YPQYPNVRC | | | | | |
| YPRYPDVRC | | YPRYPDVRC | | | | | |
| YPRYPGVRC | | YPRYPGVRC | | | | | |
| YPRYPNVRC | | YPRYPNVRC | | | | | |
| YQAELLVAM | | YQAELLVAM | | | | | |
| YQAKFEAVA | | YQAKFEAVA | | | | | |
| YQAKFESVA | | YQAKFESVA | | | | | |
| YQARFEAVA | | YQARFEAVA | | | | | |
| YQARFESVA | | YQARFESVA | | | | | |
| YQEVGTYVS | | YQEVGTYVS | | | | | |
| YQFALGHGT | | YQFALGHGT | | | | | |
| YQFALGQGA | | YQFALGQGA | | | | | |
| YQFALGQGT | | YQFALGQGT | | | | | |
| YQGRLCNPL | | YQGRLCNPL | | | | | |
| YQGRLCNPM | | YQGRLCNPM | | | | | |
| YQIGNVINW | | YQIGNVINW | | | | | |
| YQIGYICSG | | YQIGYICSG | | | | | |
| YQIGYVCSG | | YQIGYVCSG | | | | | |
| YQILAIYAT | | YQILAIYAT | | | | | |
| YQILAIYST | | YQILAIYST | | | | | |
| YQILSIYST | | YQILSIYST | | | | | |
| YQILSVYST | | YQILSVYST | | | | | |
| YQKCCNLFE | | YQKCCNLFE | | | | | |
| YQKCCSLFE | | YQKCCSLFE | | | | | |
| YQKCCTLFE | | YQKCCTLFE | | | | | |
| YQKQMTRGL | | YQKQMTRGL | | | | | |
| YQKRMGLQM | | YQKRMGLQM | | | | | |
| YQKRMGVQI | | YQKRMGVQI | | | | | |
| YQKRMGVQL | | YQKRMGVQL | | | | | |
| YQKRMGVQM | | YQKRMGVQM | | | | | |
| YQKRMTRGL | | YQKRMTRGL | | | | | |
| YQKVGTYVS | | YQKVGTYVS | | | | | |
| YQMGYICSG | | YQMGYICSG | | | | | |
| YQNNFVPVI | | YQNNFVPVI | | | | | |
| YQNNFVPVM | | YQNNFVPVM | | | | | |
| YQNNFVPVV | | YQNNFVPVV | | | | | |
| YQNSFVPVV | | YQNSFVPVV | | | | | |
| YQNVETYVS | | YQNVETYVS | | | | | |
| YQNVGTYVS | | YQNVGTYVS | | | | | |
| YQQSFSPSP | | YQQSFSPSP | | | | | |
| YQQSFTPSP | | YQQSFTPSP | | | | | |
| YQQSFVPSP | | YQQSFVPSP | | | | | |
| YQRCCNLFE | | YQRCCNLFE | | | | | |
| YQRSKFLLM | | YQRSKFLLM | | | | | |
| YQRTRALVR | | YQRTRALVR | | | | | |
| YQSGTYPVI | | YQSGTYPVI | | | | | |
| YQSIRSILA | | YQSIRSILA | | | | | |
| YQSLRSILA | | YQSLRSILA | | | | | |

Fig. 83-457

| Block size 8 | SIN | Block size 9 | SIN | Block size 10 | SIN | Block size 11 | SIN |
|---|---|---|---|---|---|---|---|
| YQSNNSTDT | | YQSNNSTDT | | | | | |
| YQSNNSTNT | | YQSNNSTNT | | | | | |
| YQSRFEAVA | | YQSRFEAVA | | | | | |
| YQSTNSTEA | | YQSTNSTEA | | | | | |
| YQSTNSTEI | | YQSTNSTEI | | | | | |
| YQSTNSTET | | YQSTNSTET | | | | | |
| YQTNNSTDT | | YQTNNSTDT | | | | | |
| YQTNNSTET | | YQTNNSTET | | | | | |
| YQVGYICSG | | YQVGYICSG | | | | | |
| YQVGYLCAG | | YQVGYLCAG | | | | | |
| YQVLAIYAT | | YQVLAIYAT | | | | | |
| YQWIIKNWE | | YQWIIKNWE | | | | | |
| YQWIIRNWE | | YQWIIRNWE | | | | | |
| YQWVIRNWE | | YQWVIRNWE | | | | | |
| YRACFYVEL | | YRACFYVEL | | | | | |
| YRAESLQNR | | YRAESLQNR | | | | | |
| YRALISWEM | | YRALISWEM | | | | | |
| YRALISWPL | | YRALISWPL | | | | | |
| YRALISWPQ | | YRALISWPQ | | | | | |
| YRALMSVLL | | YRALMSVLL | | | | | |
| YRALMSVPL | | YRALMSVPL | | | | | |
| YRALSIYSC | | YRALSIYSC | | | | | |
| YRALVSWPL | | YRALVSWPL | | | | | |
| YRCHKGDTQ | | YRCHKGDTQ | | | | | |
| YRCHRGDAQ | | YRCHRGDAQ | | | | | |
| YRCHRGDMQ | | YRCHRGDMQ | | | | | |
| YRCHRGDTH | | YRCHRGDTH | | | | | |
| YRCHRGDTQ | | YRCHRGDTQ | | | | | |
| YRDEAINNR | | YRDEAINNR | | | | | |
| YRDEAINSR | | YRDEAINSR | | | | | |
| YRDEAISNR | | YRDEAISNR | | | | | |
| YRDEALNNR | | YRDEALNNR | | | | | |
| YRDEALSNR | | YRDEALSNR | | | | | |
| YRDEAVNNR | | YRDEAVNNR | | | | | |
| YRDLGNCHP | | YRDLGNCHP | | | | | |
| YRDNWKGSN | | YRDNWKGSN | | | | | |
| YRDWSKPQC | | YRDWSKPQC | | | | | |
| YREEAIQNR | | YREEAIQNR | | | | | |
| YREEALLNR | | YREEALLNR | | | | | |
| YREEAMQNR | | YREEAMQNR | | | | | |
| YREESLLNR | | YREESLLNR | | | | | |
| YREESQLKK | | YREESQLKK | | | | | |
| YREESQLKR | | YREESQLKR | | | | | |
| YREICIAWS | | YREICIAWS | | | | | |
| YREVCIAWS | | YREVCIAWS | | | | | |
| YRGRLCNPL | | YRGRLCNPL | | | | | |
| YRHQNAQGE | | YRHQNAQGE | | | | | |
| YRICKLVGI | | YRICKLVGI | | | | | |
| YRIGYICSG | | YRIGYICSG | | | | | |
| YRILSIYST | | YRILSIYST | | | | | |
| YRIWSKPQC | | YRIWSKPQC | | | | | |
| YRKEAIQNR | | YRKEAIQNR | | | | | |
| YRKLKREIT | | YRKLKREIT | | | | | |
| YRKRMTRGL | | YRKRMTRGL | | | | | |
| YRKWSKPQC | | YRKWSKPQC | | | | | |
| YRNEAINNR | | YRNEAINNR | | | | | |
| YRNEALNNR | | YRNEALNNR | | | | | |
| YRNLIWLVK | | YRNLIWLVK | | | | | |
| YRNLIWLVN | | YRNLIWLVN | | | | | |
| YRNLIWLVQ | | YRNLIWLVQ | | | | | |
| YRNLVWIVK | | YRNLVWIVK | | | | | |
| YRNLVWLVK | | YRNLVWLVK | | | | | |

Fig. 83-458

| Block size 8 | SIN | Block size 9 | SIN | Block size 10 | SIN | Block size 11 | SIN |
|---|---|---|---|---|---|---|---|
| YRNMRWLTL | | YRNMRWLTL | | | | | |
| YRNNRKEPA | | YRNNRKEPA | | | | | |
| YRNTRKEPA | | YRNTRKEPA | | | | | |
| YRNVVWLIK | | YRNVVWLIK | | | | | |
| YRNWAKPQC | | YRNWAKPQC | | | | | |
| YRNWSKPQC | | YRNWSKPQC | | | | | |
| YRNWSMPQC | | YRNWSMPQC | | | | | |
| YRNWTKPQC | | YRNWTKPQC | | | | | |
| YRQEALQNR | | YRQEALQNR | | | | | |
| YRQSFSPSP | | YRQSFSPSP | | | | | |
| YRRPIGISS | | YRRPIGISS | | | | | |
| YRRPVGISS | | YRRPVGISS | | | | | |
| YRSINWLTK | | YRSINWLTK | | | | | |
| YRSIRWLTL | | YRSIRWLTL | | | | | |
| YRSLIKFPI | | YRSLIKFPI | | | | | |
| YRSLIQFPI | | YRSLIQFPI | | | | | |
| YRSLIQFPM | | YRSLIQFPM | | | | | |
| YRSLIRFPI | | YRSLIRFPI | | | | | |
| YRSLIRFPV | | YRSLIRFPV | | | | | |
| YRSLISWPL | | YRSLISWPL | | | | | |
| YRSMKWLTL | | YRSMKWLTL | | | | | |
| YRSMRWLTL | | YRSMRWLTL | | | | | |
| YRSWSKPQC | | YRSWSKPQC | | | | | |
| YRTCKLLGI | | YRTCKLLGI | | | | | |
| YRTCKLVGI | | YRTCKLVGI | | | | | |
| YRTESLQNR | | YRTESLQNR | | | | | |
| YRTLLMNEL | | YRTLLMNEL | | | | | |
| YRTLLMSEL | | YRTLLMSEL | | | | | |
| YRVGYLCAG | | YRVGYLCAG | | | | | |
| YRYGFVANF | | YRYGFVANF | | | | | |
| YRYTYRCHK | | YRYTYRCHK | | | | | |
| YRYTYRCHR | | YRYTYRCHR | | | | | |
| YSAGALASC | | YSAGALASC | | | | | |
| YSCIASSIV | | YSCIASSIV | | | | | |
| YSCIASSLI | | YSCIASSLI | | | | | |
| YSCIASSLV | | YSCIASSLV | | | | | |
| YSCIASSTV | | YSCIASSTV | | | | | |
| YSCIASSVV | | YSCIASSVV | | | | | |
| YSCVASSLV | | YSCVASSLV | | | | | |
| YSDFHFIDE | | YSDFHFIDE | | | | | |
| YSDFHFINE | | YSDFHFINE | | | | | |
| YSEMKWLLS | | YSEMKWLLS | | | | | |
| YSEMKWLSS | | YSEMKWLSS | | | | | |
| YSETVRVET | | YSETVRVET | | | | | |
| YSGAFIDYW | | YSGAFIDYW | | | | | |
| YSGAFMDYW | | YSGAFMDYW | | | | | |
| YSGAFTIPI | | YSGAFTIPI | | | | | |
| YSGAFTIPT | | YSGAFTIPT | | | | | |
| YSGAFTIPV | | YSGAFTIPV | | | | | |
| YSGAFTVPI | | YSGAFTVPI | | | | | |
| YSGAFVDYW | | YSGAFVDYW | | | | | |
| YSGFVRTLF | | YSGFVRTLF | | | | | |
| YSGGTINSP | | YSGGTINSP | | | | | |
| YSGIFSVEG | | YSGIFSVEG | | | | | |
| YSGIFSVEH | | YSGIFSVEH | | | | | |
| YSGIFSVEN | | YSGIFSVEN | | | | | |
| YSGIFSVES | | YSGIFSVES | | | | | |
| YSGIKTDGA | | YSGIKTDGA | | | | | |
| YSGIRTDGA | | YSGIRTDGA | | | | | |
| YSGIRTNGA | | YSGIRTNGA | | | | | |
| YSGIRTNGT | | YSGIRTNGT | | | | | |
| YSGIRTNGV | | YSGIRTNGV | | | | | |

Fig. 83-459

| Block size 8 | SIN | Block size 9 | SIN | Block size 10 | SIN | Block size 11 | SIN |
|---|---|---|---|---|---|---|---|
| YSGSFIDYW | | YSGSFIDYW | | | | | |
| YSGSFIQHP | | YSGSFIQHP | | | | | |
| YSGSFMDYW | | YSGSFMDYW | | | | | |
| YSGSFSIRG | | YSGSFSIRG | | | | | |
| YSGSFSIRW | | YSGSFSIRW | | | | | |
| YSGSFTIPT | | YSGSFTIPT | | | | | |
| YSGSFTLPI | | YSGSFTLPI | | | | | |
| YSGSFTLPV | | YSGSFTLPV | | | | | |
| YSGSFVDYW | | YSGSFVDYW | | | | | |
| YSGSFVQHP | | YSGSFVQHP | | | | | |
| YSGVFSVEG | | YSGVFSVEG | | | | | |
| YSHGTGTGY | | YSHGTGTGY | | | | | |
| YSIADKICI | | YSIADKICI | | | | | |
| YSIDSGYVC | | YSIDSGYVC | | | | | |
| YSIDSNYVC | | YSIDSNYVC | | | | | |
| YSIDSSYIC | | YSIDSSYIC | | | | | |
| YSIDSSYVC | | YSIDSSYVC | | | | | |
| YSKADKICI | | YSKADKICI | | | | | |
| YSKDNGIRI | | YSKDNGIRI | | | | | |
| YSKDNSIRI | | YSKDNSIRI | | | | | |
| YSKDNSVRI | | YSKDNSVRI | | | | | |
| YSKVYKTYF | | YSKVYKTYF | | | | | |
| YSKYEEESK | | YSKYEEESK | | | | | |
| YSLPPNFSS | | YSLPPNFSS | | | | | |
| YSLVGIDPF | | YSLVGIDPF | | | | | |
| YSLVGVDPF | | YSLVGVDPF | | | | | |
| YSQITNGTT | | YSQITNGTT | | | | | |
| YSRADKICI | | YSRADKICI | | | | | |
| YSSPMMWEI | | YSSPMMWEI | | | | | |
| YSSPQLEGF | | YSSPQLEGF | | | | | |
| YSSSLMWEI | | YSSSLMWEI | | | | | |
| YSSSMMWEI | | YSSSMMWEI | | | | | |
| YSSSMMWEV | | YSSSMMWEV | | | | | |
| YSSVASSLV | | YSSVASSLV | | | | | |
| YSTAASSLA | | YSTAASSLA | | | | | |
| YSTAASSLV | | YSTAASSLV | | | | | |
| YSTGALASC | | YSTGALASC | | | | | |
| YSTISSSLV | | YSTISSSLV | | | | | |
| YSTVAASLC | | YSTVAASLC | | | | | |
| YSTVASSLA | | YSTVASSLA | | | | | |
| YSTVASSLT | | YSTVASSLT | | | | | |
| YSTVASSLV | | YSTVASSLV | | | | | |
| YSTVASSSV | | YSTVASSSV | | | | | |
| YSTVSSSLV | | YSTVSSSLV | | | | | |
| YSTVVSSLA | | YSTVVSSLA | | | | | |
| YSVGYLCAG | | YSVGYLCAG | | | | | |
| YTENPVICL | | YTENPVICL | | | | | |
| YTGAINSSK | | YTGAINSSK | | | | | |
| YTGAINSSR | | YTGAINSSR | | | | | |
| YTGDPPYSH | | YTGDPPYSH | | | | | |
| YTGISKACN | | YTGISKACN | | | | | |
| YTGNLVICL | | YTGNLVICL | | | | | |
| YTGNPVICL | | YTGNPVICL | | | | | |
| YTGNPVICM | | YTGNPVICM | | | | | |
| YTGSFCSID | | YTGSFCSID | | | | | |
| YTGTSKACN | | YTGTSKACN | | | | | |
| YTGTSRACN | | YTGTSRACN | | | | | |
| YTIDEESRA | | YTIDEESRA | | | | | |
| YTKCQTYAG | | YTKCQTYAG | | | | | |
| YTKDNSIRI | | YTKDNSIRI | | | | | |
| YTKIMYFHK | | YTKIMYFHK | | | | | |
| YTKVLYFHK | | YTKVLYFHK | | | | | |

Fig. 83-460

| Block size 8 | SIN | Block size 9 | SIN | Block size 10 | SIN | Block size 11 | SIN |
|---|---|---|---|---|---|---|---|
| YTKVMYFHK | | YTKVMYFHK | | | | | |
| YTLDEESRA | | YTLDEESRA | | | | | |
| YTLITDGPS | | YTLITDGPS | | | | | |
| YTLMTDGPS | | YTLMTDGPS | | | | | |
| YTLVSTGSW | | YTLVSTGSW | | | | | |
| YTLVSTKEW | | YTLVSTKEW | | | | | |
| YTLVSTKSW | | YTLVSTKSW | | | | | |
| YTLVSTRSW | | YTLVSTRSW | | | | | |
| YTLVSTSSW | | YTLVSTSSW | | | | | |
| YTLVTDGPS | | YTLVTDGPS | | | | | |
| YTLVTTSSW | | YTLVTTSSW | | | | | |
| YTMDTVNRT | | YTMDTVNRT | | | | | |
| YTMDTVSRT | | YTMDTVSRT | | | | | |
| YTPGGEVIN | | YTPGGEVIN | | | | | |
| YTPGGEVKN | | YTPGGEVKN | | | | | |
| YTPGGEVRN | | YTPGGEVRN | | | | | |
| YTPGGGVRN | | YTPGGGVRN | | | | | |
| YTPGGKVRN | | YTPGGKVRN | | | | | |
| YTRLYIWGV | | YTRLYIWGV | | | | | |
| YTSARQEKN | | YTSARQEKN | | | | | |
| YTSGRQEKN | | YTSGRQEKN | | | | | |
| YTVGYLCAG | | YTVGYLCAG | | | | | |
| YTYRCHKGD | | YTYRCHKGD | | | | | |
| YTYRCHRGD | | YTYRCHRGD | | | | | |
| YVCSGIFGD | | YVCSGIFGD | | | | | |
| YVCSGLVGD | | YVCSGLVGD | | | | | |
| YVCSGVFGD | | YVCSGVFGD | | | | | |
| YVCSKFHSD | | YVCSKFHSD | | | | | |
| YVCTGILTD | | YVCTGILTD | | | | | |
| YVCTGVLTD | | YVCTGVLTD | | | | | |
| YVDGFEPNG | | YVDGFEPNG | | | | | |
| YVDGFKPNG | | YVDGFKPNG | | | | | |
| YVEDTKIDL | | YVEDTKIDL | | | | | |
| YVEDTKVDL | | YVEDTKVDL | | | | | |
| YVELIRGKP | | YVELIRGKP | | | | | |
| YVELIRGMP | | YVELIRGMP | | | | | |
| YVELIRGRE | | YVELIRGRE | | | | | |
| YVELIRGRK | | YVELIRGRK | | | | | |
| YVELIRGRL | | YVELIRGRL | | | | | |
| YVELIRGRN | | YVELIRGRN | | | | | |
| YVELIRGRP | | YVELIRGRP | | | | | |
| YVELIRGRQ | | YVELIRGRQ | | | | | |
| YVELIRGRR | | YVELIRGRR | | | | | |
| YVELIRGRS | | YVELIRGRS | | | | | |
| YVELVRGRP | | YVELVRGRP | | | | | |
| YVEMIRGRP | | YVEMIRGRP | | | | | |
| YVEVLHLTQ | | YVEVLHLTQ | | | | | |
| YVEWTSNSL | | YVEWTSNSL | | | | | |
| YVKKASLRL | | YVKKASLRL | | | | | |
| YVKKESLRL | | YVKKESLRL | | | | | |
| YVKQGSLKL | | YVKQGSLKL | | | | | |
| YVKQGSLML | | YVKQGSLML | | | | | |
| YVKQGSLRL | | YVKQGSLRL | | | | | |
| YVKQKTLKL | | YVKQKTLKL | | | | | |
| YVKQNTLKL | | YVKQNTLKL | | | | | |
| YVKQSSLPL | | YVKQSSLPL | | | | | |
| YVKQSTLKL | | YVKQSTLKL | | | | | |
| YVKSDRLVL | | YVKSDRLVL | | | | | |
| YVKSEKLVL | | YVKSEKLVL | | | | | |
| YVKSERLVL | | YVKSERLVL | | | | | |
| YVLSIIPSG | | YVLSIIPSG | | | | | |
| YVLSIVPSG | | YVLSIVPSG | | | | | |

Fig. 83-461

| Block size 8 | SIN | Block size 9 | SIN | Block size 10 | SIN | Block size 11 | SIN |
|---|---|---|---|---|---|---|---|
| YVLSVIPSG | | YVLSVIPSG | | | | | |
| YVNIKSLKL | | YVNIKSLKL | | | | | |
| YVNKNPYTL | | YVNKNPYTL | | | | | |
| YVNNTTIIN | | YVNNTTIIN | | | | | |
| YVNNTTIIS | | YVNNTTIIS | | | | | |
| YVNNTTIIT | | YVNNTTIIT | | | | | |
| YVNNTTVIN | | YVNNTTVIN | | | | | |
| YVNNTTVIS | | YVNNTTVIS | | | | | |
| YVNTALLNA | | YVNTALLNA | | | | | |
| YVNVKSLKL | | YVNVKSLKL | | | | | |
| YVNVRSLKL | | YVNVRSLKL | | | | | |
| YVQMCTELK | | YVQMCTELK | | | | | |
| YVRKASLRL | | YVRKASLRL | | | | | |
| YVRLYLWGV | | YVRLYLWGV | | | | | |
| YVRQNTLKL | | YVRQNTLKL | | | | | |
| YVRSEKLVL | | YVRSEKLVL | | | | | |
| YVRTNGTSK | | YVRTNGTSK | | | | | |
| YVSCDPDEC | | YVSCDPDEC | | | | | |
| YVSCDPDGC | | YVSCDPDGC | | | | | |
| YVSCDPLGC | | YVSCDPLGC | | | | | |
| YVSCDPSGC | | YVSCDPSGC | | | | | |
| YVSCDPTGC | | YVSCDPTGC | | | | | |
| YVSCEPDEC | | YVSCEPDEC | | | | | |
| YVSIGTSTL | | YVSIGTSTL | | | | | |
| YVSMEFSLT | | YVSMEFSLT | | | | | |
| YVSVGTSTL | | YVSVGTSTL | | | | | |
| YVWWASNSL | | YVWWASNSL | | | | | |
| YVWWTSNSL | | YVWWTSNSL | | | | | |
| YWAEGDCYR | | YWAEGDCYR | | | | | |
| YWAEGECYR | | YWAEGECYR | | | | | |
| YWAILKPGQ | | YWAILKPGQ | | | | | |
| YWAIRTRSG | | YWAIRTRSG | | | | | |
| YWAKEECYR | | YWAKEECYR | | | | | |
| YWAKGDCYR | | YWAKGDCYR | | | | | |
| YWAKGECYR | | YWAKGECYR | | | | | |
| YWAVLKPGQ | | YWAVLKPGQ | | | | | |
| YWGILKRGE | | YWGILKRGE | | | | | |
| YWHLMHPGE | | YWHLMHPGE | | | | | |
| YWHLMRPGE | | YWHLMRPGE | | | | | |
| YWHLMSPGE | | YWHLMSPGE | | | | | |
| YWMCSNGSL | | YWMCSNGSL | | | | | |
| YWNWSKPQC | | YWNWSKPQC | | | | | |
| YWTIVDPGD | | YWTIVDPGD | | | | | |
| YWTIVEPED | | YWTIVEPED | | | | | |
| YWTIVEPGD | | YWTIVEPGD | | | | | |
| YWTIVKPGD | | YWTIVKPGD | | | | | |
| YWTIVKSGD | | YWTIVKSGD | | | | | |
| YWTLVNPGD | | YWTLVNPGD | | | | | |
| YWTVVKPGD | | YWTVVKPGD | | | | | |
| YWVMTDGPA | | YWVMTDGPA | | | | | |
| YWWDGLQSS | | YWWDGLQSS | | | | | |
| YYDRRLTTT | | YYDRRLTTT | | | | | |
| YYEECSCYP | | YYEECSCYP | | | | | |
| YYFVKEGKI | | YYFVKEGKI | | | | | |
| YYLEKANKI | | YYLEKANKI | | | | | |
| YYLEKASKI | | YYLEKASKI | | | | | |
| YYMGECPKY | | YYMGECPKY | | | | | |
| YYNETFVNI | | YYNETFVNI | | | | | |
| YYNETFVNV | | YYNETFVNV | | | | | |
| YYNGRLTTT | | YYNGRLTTT | | | | | |
| YYNGRSSFF | | YYNGRSSFF | | | | | |
| YYNKRLTTT | | YYNKRLTTT | | | | | |

Fig. 83-462

| Block size 8 | SIN | Block size 9 | SIN | Block size 10 | SIN | Block size 11 | SIN |
|---|---|---|---|---|---|---|---|
| YYNRRLTTT | | YYNRRLTTT | | | | | |
| YYNRRPTTT | | YYNRRPTTT | | | | | |
| YYPKYEEES | | YYPKYEEES | | | | | |
| YYWAILKPG | | YYWAILKPG | | | | | |
| YYWAVLKPG | | YYWAVLKPG | | | | | |
| YYWGILKRG | | YYWGILKRG | | | | | |
| YYYEECSCY | | YYYEECSCY | | | | | |
| YYYPKYEEE | | YYYPKYEEE | | | | | |

IDENTIFICATION OF CONSERVED PEPTIDE BLOCKS IN HOMOLOGOUS POLYPEPTIDES

RELATED APPLICATIONS

The present application claims the benefit of U.S. Provisional Patent Application Ser. Nos. 61/493,226 and 61/493,399, both filed Jun. 3, 2011, which are herein incorporated by reference in their entireties.

SEQUENCE LISTING

The instant application contains a "lengthy" Sequence Listing which has been submitted via CD-R in lieu of a printed paper copy, and is hereby incorporated by reference in its entirety. Said CD-R, recorded on Oct. 24, 2012, are labeled "CRF," "Copy 1" and "Copy 2," respectively, and each contains only one identical 109,748,224 bytes file (53289001.txt).

STATEMENT REGARDING FEDERALLY SPONSORED RESEARCH

The research described in this application was supported in part by a grant (No. U01 AI090043) from the National Institutes of Health. Thus, the government has certain rights in the invention.

TECHNICAL FIELD

Methods for identifying at least one conserved peptide block in three or more homologous polypeptides are provided and compositions comprising conserved peptides are provided. More particularly, methods for selecting conserved peptides in variable viral polypeptides for use in immunogenic compositions are provided.

BACKGROUND

Dengue disease is caused by 4 antigenically distinct serotypes of dengue virus (DENV-1-4) transmitted by *Aedes* mosquitoes, principally *Aedes aegypti*. Dengue disease affects 50-100 million people annually, causing 25,000 deaths and more than a half-million hospitalizations. Dengue is endemic or sporadic in >100 countries worldwide; *Aedes aegypti* inhabits tropical and subtropical regions and some temperate areas, and its range is expanding. Dengue virus can cause a continuum of disease: dengue fever causes biphasic fever, rash, extreme muscle or joint pain, headache, and eye pain; dengue hemorrhagic fever causes abnormal homeostasis and increased vascular permeability, with severe cases leading to dengue shock syndrome. Exposure generates life-long, serotype-specific immunity, but subsequent infections with other serotypes may increase the risk of severe disease. Complex disease presentation and sudden development of hemorrhagic symptoms in seemingly stable patients can cause fatal outcomes even in well-prepared hospitals. No vaccine or treatment exists; mosquito control and personal protection are the primary defenses. The scale of the problem and the cost of protective measures make vaccine development a public health priority.

Antigenic variability is a major reason preventing development of efficient vaccines against DENV as well as against other highly variable pathogens (e.g., viral pathogens from the Retroviridae, Picornaviridae, Caliciviridae, Togaviridae, Flaviridae, Coronaviridae, Rhabdoviridae, Filoviridae, Paramyxoviridae, Orthomyxoviridae, Bunyaviridae, Arenaviridae, Reoviridae, Birnaviridae, Hepadnaviridae, Parvoviridae, Papovaviridae, Adenoviridae, Herperviridae, Poxyiridae, and Iridoviridae families). Current approaches focus on regular reformulation of vaccines (such as influenza), combining multiple variants (such as influenza or HPV), or using existing vaccines that provide variable levels of protection (e.g., rotavirus, yellow fever). For most viral diseases in humans, however, currently vaccines are not available.

Epitope-based vaccines against highly-variable viral pathogens require broad coverage. Traditional approaches to assembling broadly covering sets of peptides are commonly based on assembling highly conserved peptides—i.e. peptides present in a given fraction of the viral population (typically 90% or higher). Therefore, it is often observed that low frequency peptides are purposely omitted from vaccine designs, despite the fact that low frequency antigenic peptides can be excellent immunogens and when combined with high frequency peptides could therefore provide broader coverage of viral variants and, therefore, more effective vaccines. There therefore exists a need in the art to provide methods for identifying novel peptidic targets for immunogenic compositions, such as vaccines and immunotherapies. This invention addresses these and other needs as described in detail below.

SUMMARY OF THE INVENTION

The document is based in part on the observation that traditional methods for performing conservation analysis on homologous polypeptides, which are based on determining the conservation of individual amino acids, lead to the exclusion of many variant sequences within a given population (e.g., viral population). As disclosed herein, however, it is observed that including variant sequences in groups of conserved sequences is advantageous for identification of new target epitopes (conserved peptide epitopes). Thus, as described in detail, below, this document provides novel methods for performing conservation analysis that permit inclusion of variants and lead to an at least 10-fold expansion in the number of identified targets. Thus, also provided are the target peptides and peptide epitopes identified according to the methods described herein.

A preferred method for identifying at least one conserved peptide block in three or more homologous polypeptides can comprise steps of (a) identifying blocks of peptides in three or more homologous polypeptides in a multiple sequence alignment (MSA), each peptide being 8-11 amino acids in length; (b) for each block of peptides, determining a minimum required number of unique peptides in the block of peptides such that the cumulative fraction of homologous polypeptides in the MSA comprising (1) one or more of the unique peptides is at least 95 percent (%); and (c) identifying a peptide block as conserved if the minimum required number of unique peptides determined in step (b) is 7 or fewer. In some embodiments, the cumulative fraction of homologous polypeptides in the MSA comprising (1) one or more of the unique peptides is at least 97%, at least 98%, or at least 99%. In certain embodiments, the minimum required number of unique peptides determined in step (b) is 6 or fewer, 5 or fewer, 4 or fewer, 3 or fewer, or 2 or fewer. The MSA can comprise polypeptides derived from a plurality of species; wherein a peptide block is identified as conserved if said 7 or fewer unique peptides also represent a cumulative fraction of at least 99% within each species of homologous polypeptides in the MSA. Further, the plurality of species can comprise different serotypes of a virus. The viruses can be dengue virus (DENV), such as one or more DENV serotypes selected from DENV-1, DENV-2, DENV-3, and DENV-4, or all of DENV serotypes 1-4. In other aspects, the virus can be an influenza virus.

The polypeptides in the MSA can be derived from a virus. The virus can be from a family selected from the group consisting of: Retroviridae, Picornaviridae, Caliciviridae, Togaviridae, Flaviridae, Coronaviridae, Rhabdoviridae, Filoviridae, Paramyxoviridae, Orthomyxoviridae, Bunyaviridae, Arena viridae, Reoviridae, Birnaviridae, Hepadnaviridae, Parvoviridae, Papovaviridae, Adenoviridae, Herperviridae, Poxyiridae, and Iridoviridae. The virus can be dengue virus (DENV), yellow fever virus (YFV), Japanese encephalitis virus (JEV), West Nile virus (WNV), and Tick-borne encephalitis virus (TBEV). The virus can also be a norovirus, an influenza virus, or a human immunodeficiency virus.

The present disclosure also provides a method for designing an immunogenic peptide composition. The method for designing an immunogenic peptide composition can comprise steps of: (a) predicting which peptides within at least one conserved peptide block identified according to a method provided herein in a plurality of homologous polypeptides bind to a major histocompatibility (MHC) molecule; and (b) selecting one or more peptides predicted to bind to an MHC molecule in step (a) for use in the immunogenic peptide composition. The one or more peptides selected in step (b) can bind to an MHC class I molecule or a MHC class II molecule. The one (1) or more peptides selected in step (b) can bind to the same MHC molecule and can bind to the same MHC molecule with the same or similar binding affinity. In some embodiments, the method for designing an immunogenic peptide composition further comprises (c) testing the one (1) or more peptides selected in step (b) in an MHC binding assay, wherein one or more peptides determined to bind to an MHC molecule in the assay are selected for use in the immunogenic peptide composition.

Preferably, the method for designing an immunogenic peptide composition can comprise steps of: (a) predicting which peptides within at least one conserved peptide block bind to a major histocompatibility (MHC) molecule, wherein the conserved peptide block was previously identified as conserved by (i) identifying blocks of peptides in three or more homologous polypeptides in a multiple sequence alignment (MSA), each peptide being 8-11 amino acids in length; (ii) for each block of peptides, determining a minimum required number of unique peptides in the block of peptides such that the cumulative fraction of homologous polypeptides in the MSA comprising (1) one or more of the unique peptides is at least 95 percent (%); and (iii) identifying a peptide block as conserved if the minimum required number of unique peptides determined in step (b) is 7 or fewer; and (b) selecting one or more peptides predicted to bind to an MHC molecule in step (a) for use in the immunogenic peptide composition. The one or more peptides selected in step (b) can bind to an MHC class I molecule or a MHC class II molecule, and can bind to the same MHC molecule and can bind to the same MHC molecule with the same or similar binding affinity. In some embodiments, the method for designing an immunogenic peptide composition further comprises (c) testing the one (1) or more peptides selected in step (b) in an MHC binding assay, wherein one or more peptides determined to bind to an MHC molecule in the assay are selected for use in the immunogenic peptide composition. In some embodiments, the cumulative fraction of homologous polypeptides in the MSA comprising (1) one or more of the unique peptides is at least 97%, at least 98%, or at least 99%. In certain embodiments, the minimum required number of unique peptides determined in step (ii) is 6 or fewer, 5 or fewer, 4 or fewer, 3 or fewer, or 2 or fewer. The MSA can comprise polypeptides derived from a plurality of species; wherein a peptide block is identified as conserved if the 7 or fewer, 6 or fewer, 5 or fewer, 4 or fewer, 3 or fewer, or 2 or fewer unique peptides also represent a cumulative fraction of at least 99% within each species of homologous polypeptides in the MSA. Further, the plurality of species can comprise different serotypes of a virus. The viruses can be dengue virus (DENV), such as one or more DENV serotypes selected from DENV-1, DENV-2, DENV-3, and DENV-4, or all of DENV serotypes 1-4.

The method for designing an immunogenic peptide composition can also comprise steps of: (a) determining which peptides within at least one conserved peptide block identified according to a method provided herein bind to a major histocompatibility (MHC) molecule using an MHC binding assay; and (b) selecting one or more peptides determined to bind to an MHC molecule in step (b) for use in the immunogenic peptide composition. Preferably, the method for designing an immunogenic peptide composition comprises steps of (a) determining which peptides within at least one conserved peptide block identified bind to a major histocompatibility (MHC) molecule using an MHC binding assay, wherein, the conserved peptide block was previously identified as conserved by (i) identifying blocks of peptides in three or more homologous polypeptides in a multiple sequence alignment (MSA), each peptide being 8-11 amino acids in length; (ii) for each block of peptides, determining a minimum required number of unique peptides in the block of peptides such that the cumulative fraction of homologous polypeptides in the MSA comprising (1) one or more of the unique peptides is at least 95 percent (%); and (iii) identifying a peptide block as conserved if the minimum required number of unique peptides determined in step (b) is 7 or fewer; and (b) selecting one or more peptides determined to bind to an MHC molecule in step (b) for use in the immunogenic peptide composition. In certain embodiments, the MHC binding assay is an in vitro assay. The MHC binding assay can also be approximated by a functional assay for identification of immunogenicity. In some embodiments, the cumulative fraction of homologous polypeptides in the MSA comprising (1) one or more of the unique peptides is at least 97%, at least 98%, or at least 99%. In certain embodiments, the minimum required number of unique peptides determined in step (ii) is 6 or fewer, 5 or fewer, 4 or fewer, 3 or fewer, or 2 or fewer. The MSA can comprise polypeptides derived from a plurality of species; wherein a peptide block is identified as conserved if the 7 or fewer, 6 or fewer, 5 or fewer, 4 or fewer, 3 or fewer, or 2 or fewer unique peptides also represent a cumulative fraction of at least 99% within each species of homologous polypeptides in the MSA. Further, the plurality of species can comprise different serotypes of a virus. The viruses can be dengue virus (DENV), such as one or more DENV serotypes selected from DENV-1, DENV-2, DENV-3, and DENV-4, or all of DENV serotypes 1-4.

A preferred immunogenic composition of the present disclosure comprises one (1) or more, 5 or more, 20 or more, 50 or more, or 200 or more peptides comprising an amino acid sequence shown in a group of Figures selected from FIGS. 2-5, FIGS. 6-9, FIGS. 10-13, FIGS. 14-17, FIGS. 18-21, FIGS. 23-26, FIGS. 27-30, FIGS. 31-34, FIGS. 35-38, FIGS. 39-42, FIGS. 43-46, FIGS. 48-50, FIGS. 72-75, FIGS. 78-81, and FIG. 83. Another preferred immunogenic composition comprises one (1) or more, 2 or more, 3 or more, 4 or more, or 5 or more peptide strings, each peptide string comprising a sequence shown in a Figure selected from the group consisting of FIG. 54, FIG. 55, FIG. 56, FIG. 57, FIG. 58, FIG. 59, FIG. 60, FIG. 61, FIG. 62, FIG. 63, FIG. 64, FIG. 76, and FIG. 77.

The present disclosure also provides a method for treating or preventing a *flavivirus* infection in a subject, wherein the method comprises administering a therapeutically or prophylactically effective amount of a preferred composition of the present disclosure to a subject suspected of or at risk of having a *flavivirus* infection. The preferred composition can comprise one (I) or more, 5 or more, 20 or more, 50 or more, or 200 or more peptides comprising an amino acid sequence shown in a group of Figures selected from FIGS. 2-5, FIGS. 6-9, FIGS. 10-13, FIGS. 14-17, FIGS. 18-21, FIGS. 23-26, FIGS. 27-30, FIGS. 31-34, FIGS. 35-38, FIGS. 39-42, FIGS. 43-46 and FIGS. 48-50, or can comprise one (1) or more, 2 or more, 3 or more, 4 or more, or 5 or more peptide strings, each peptide string comprising a sequence shown in a Figure selected from the group consisting of: FIG. 54, FIG. 55, FIG. 56, FIG. 57, FIG. 58, FIG. 59, FIG. 60, FIG. 61, FIG. 62, FIG. 63, and FIG. 64. The *flavivirus* can be selected from the group consisting of dengue virus (DENV), yellow fever virus (YFV), Japanese encephalitis virus (JEV), West Nile virus (WNV), and Tick-borne encephalitis virus (TBEV). The subject to be treated can be a patient, preferably a mammal and more preferably a human.

Another preferred immunogenic composition of the present disclosure comprises one (1), 5 or more, 20 or more, 50 or more, or 200 or more peptides comprising an amino acid sequence shown in FIG. 65. Yet another preferred immunogenic composition of the present disclosure comprises one (1) or more, 2 or more, 3 or more, 4 or more, or 5 or more peptide strings, each peptide string comprising a peptide string sequence shown in FIG. 53. Still another preferred immunogenic composition comprises at least one (1), at least 5, at least 20, at least 50, or at least 200 peptide(s) comprising an amino acid sequence of a peptide shown in one or more of the peptide strings shown in FIG. 53.

The present disclosure also provides a method for treating or preventing a norovirus infection in a subject, the method comprising administering a therapeutically or prophylactically effective amount of a preferred composition of the disclosure to a subject suspected of or at risk of having a norovirus infection. The preferred composition can comprises one (1), 5 or more, 20 or more, 50 or more, or 200 or more peptides comprising an amino acid sequence shown in FIG. 65, or one (1) or more, 2 or more, 3 or more, 4 or more, or 5 or more peptide strings, each peptide string comprising a peptide string sequence shown in FIG. 53, or at least one (1), at least 5, at least 20, at least 50, or at least 200 peptide(s) comprising an amino acid sequence of a peptide shown in one or more of the peptide strings shown in FIG. 53. The subject to be treated can be a patient, preferably a mammal and more preferably a human.

The present disclosure also provides a method for treating or preventing a influenza infection in a subject, the method comprising administering a therapeutically or prophylactically effective amount of a preferred composition of the disclosure to a subject suspected of or at risk of having an influenza virus infection. The preferred composition can comprises one (1), 5 or more, 20 or more, 50 or more, or 200 or more peptides comprising an amino acid sequence shown in any one or more of FIGS. 72-75 and FIGS. 78-81, or one (1) or more, 2 or more, 3 or more, 4 or more, or 5 or more peptide strings, each peptide string comprising a peptide string sequence shown in FIG. 76 and/or FIG. 77, or at least one (1), at least 5, at least 20, at least 50, or at least 200 peptide(s) comprising an amino acid sequence of a peptide shown in one or more of the peptide strings shown in FIG. 76 and/or FIG. 77. The subject to be treated can be a patient, preferably a mammal and more preferably a human.

The preferred immunogenic peptide compositions of the disclosure can further comprise a pharmaceutically acceptable carrier.

Unless otherwise defined, all technical and scientific terms used herein have the same meaning as commonly understood by one of ordinary skill in the art to which this invention pertains. In case of conflict, the present document, including definitions, will control.

All publications, patent applications, patents, GenBank® Accession numbers, protocols and other references mentioned herein are incorporated by reference in their entirety for all purposes. The materials, methods, and examples disclosed herein are illustrative only and not intended to be limiting.

The details of one or more embodiments of the invention are set forth in the accompanying drawings and the description below. Preferred methods and materials are described below, although methods and materials similar or equivalent to those described herein can also be used in the practice or testing of the present invention. Other features, objects, and advantages of the invention will be apparent from the description and drawings, and from the claims.

DESCRIPTION OF DRAWINGS

FIG. 2: Column ("Col.") 1: 16-3223, Col. 2, 3224-4788, Col. 3: 4789-5581, Col. 4: 5582-5898, Col. 5: 5899-6006; FIG. 3: Col. 1: 6007-9156, Col. 2: 9157-10793, Col. 3: 10794-11670, Col. 4: 11671-12044, Col. 5: 12045-12170; FIG. 4: Col. 1: 12171-15259, Col. 2: 15260-16957, Col. 3: 16958-17898, Col. 4: 17899-18339, Col. 5: 18340-18489; FIG. 5: Col. 1:

18490-21518, Col. 2: 21519-23266, Col. 3: 23267-24267, Col. 4: 24268-24780, Col. 5: 24781-24958; FIG. 6: Col. 1: 24959-28098; Col. 2: 28099-29930; Col. 3: 29931-30875; Col. 4: 30876-31343; Col. 5: 31344-31530; FIG. 7: Col. 1: 31531-34596; Col. 2: 34597-36499; Col. 3: 36500-37518; Col. 4: 37519-; 38044; Col. 5: 38045-38274; FIG. 8: Col. 1: 38275-41251; Col. 2: 41252-43199; Col. 3: 43200-44275; Col. 4: 44276-44841; Col. 5: 44842-45101; FIG. 9: Col. 1: 45102-47968; Col. 2: 47969-49922; Col. 3: 49923-51019; Col. 4: 51020-51609; Col. 5: 51610-51878; FIG. 10: Col. 1: 51879-55159; Col. 2: 55160-56578; Col. 3: 56579-57150; Col. 4: 57151-57398; Col. 5: 57399-57482; FIG. 11: Col. 1: 57843-60717; Col. 2: 60718-62227; Col. 3: 62228-62857; Col. 4: 62858-63150; Col. 5: 63151-63238; FIG. 12: Col. 1: 63239-66431; Col. 2: 66432-68030; Col. 3: 68031-68720; Col. 4: 68721-69060; Col. 5: 69061-69167; FIG. 13: Col. 1: 69168-72314; Col. 2: 72315-73989; Col. 3: 73990-74736; Col. 4: 74737-75129; Col. 5: 75130-75261; FIG. 14: Col. 1: 75262-78583; Col. 2: 78584-80359; Col. 3: 80360-81112; Col. 4: 81113-81369; Col. 5: 81370-81450; FIG. 15: Col. 1: 81451-84742; Col. 2: 84743-86611; Col. 3: 86612-87432; Col. 4: 87433-87719; Col. 5: 87720-87805; FIG. 16: Col. 1: 87806-91073; Col. 2: 91074-93028; Col. 3: 93029-93926; Col. 4: 93927-94252; Col. 5: 94253-94353; FIG. 17: Col. 1: 94354-97596; Col. 2: 97597-99629; Col. 3: 99630-100601; Col. 4: 100602-100967; Col. 5: 100968-101085; FIG. 18: Col. 1: 101086-102992; Col. 2: 102993-104695; Col. 3: 104696-106018; Col. 4: 106019-106922; Col. 5: 106923-107292; FIG. 19: Col. 1: 107293-109025; Col. 2: 109026-110613; Col. 3: 110614-111856; Col. 4: 111857-112726; Col. 5:112727-113089; FIG. 20: Col. 1: 113090-114661; Col. 2: 114662-116130; Col. 3: 116131-117294; Col. 4: 117295-118131; Col. 5: 118132-118483; and FIG. 21: Col. 1: 118484-119901; Col. 2: 119902-121243; Col. 3: 121244-122331; Col. 4: 122332-123119; Col. 5: 123120-123451.

FIG. 23: Column ("Col.") 1: 123452-126519; Col. 2: 126520-128735; Col. 3: 128736-130001; Col. 4: 130002-130646; Col. 5: 130647-130867; FIG. 24: Col. 1: 130868-133847; Col. 2: 133848-136116; Col. 3: 136117-137474; Col. 4: 137475-138189; Col. 5: 138190-138454; FIG. 25: Col. 1: 138455-141341; Col. 2: 141342-143633; Col. 3: 143634-145079; Col. 4: 145080-145859; Col. 5: 145860-146164; FIG. 26: Col. 1: 146165-148950; Col. 2: 148951-151246; Col. 3: 151247-152754; Col. 4: 152755-153597; Col. 5: 153598-153935; FIG. 27: Col. 1: 153936-157284; Col. 2: 157285-159277; Col. 3: 159278-160063; Col. 4: 160064-160311; Col. 5: 160312-160371; FIG. 28: Col. 1: 160372-163707; Col. 2: 163708-165825; Col. 3: 165826-166726; Col. 4: 166727-167024; Col. 5:167025-167099; FIG. 29: Col. 1: 167100-170421; Col. 2: 170422-172639; Col. 3: 172640-173660; Col. 4: 173661-174013; Col. 5: 174014-174105; FIG. 30: Col. 1: 174106-177413; Col. 2: 177414-179718; Col. 3: 179719-180855; Col. 4: 180856-181270; Col. 5: 181271-181385; FIG. 31: Col. 1: 181386-184491; Col. 2: 184492-186678; Col. 3: 186679-187859; Col. 4: 187860-188397; Col. 5: 188398-188588; FIG. 32: Col. 1: 188589-191694; Col. 2: 191695-193881; Col. 3: 193882-195062; Col. 4: 195063-195600; Col. 5: 195601-195791; FIG. 33: Col. 1: 195792-198836; Col. 2:198837-201071; Col. 201072-202337; Col. 202338-202938; Col. 5: 202939-203156; FIG. 34: Col. 1: 203157-206140; Col. 2: 206141-208412; Col. 3: 208413-209745; Col. 4: 209746-210413; Col. 5: 210414-210662; FIG. 35: Col. 1: 210663-213933; Col. 2: 213934-216402; Col. 3: 216403-217780; Col. 4: 217781-218351; Col. 5: 218352-218529; FIG. 36: Col. 1: 218530-221752; Col. 2: 221753-224305; Col. 3: 224306-225817; Col. 4: 225818-226479; Col. 5: 226480-226699; FIG. 37: Col. 1: 226700-229867; Col. 2: 229868-232477; Col. 3: 232478-234099; Col. 4: 234100-234852; Col. 5: 234853-235111; FIG. 38: Col. 1: 235112-238221; Col. 2: 238222-240865; Col. 3: 240866-242579; Col. 4: 242580-243421; Col. 5: 243422-243722; FIG. 39: Col. 1: 243723-244177; Col. 2: 244178-244610; Col. 3: 244611-244976; Col. 4: 244977-245272; Col. 5: 245273-245473; FIG. 40: Col. 1: 245474-245831; Col. 2: 245832-246177; Col. 3: 246178-246471; Col. 4: 246472-246705; Col. 5: 246706-246876; FIG. 41: Col. 1: 246877-247157; Col. 2: 247158-247431; Col. 3: 247432-247665; Col. 4: 247666-247855; Col. 5: 247856-247995; FIG. 42: Col. 1: 247996-248212; Col. 2: 248213-248426; Col. 3: 248427-248608; Col. 4: 248609-248758; Col. 5: 248759-248870; FIG. 43: Col. 1: 248871-249016; Col. 2: 249017-249150; Col. 3: 249151-249229; Col. 4: 249230-249273; Col. 5: 249274-249298; FIG. 44: Col. 1: 249299-249406; Col. 2: 249407-249509; Col. 3: 249510-249566; Col. 4:

249567-249595; Col. 5: 249596-249613; FIG. 45: Col. 1: 249614-249698; Col. 2: 249699-249781; Col. 3: 249782-249830; Col. 4: 249831-249854; Col. 5: 249855-249867; and FIG. 46: Col. 1: 249868-249933; Col. 2: 249934-249999; Col. 3: 250000-250041; Col. 4: 250042-250060; Col. 5: 250061-250068.

FIG. 53: 265677-265696; FIG. 54: 265697-265716; FIG. 55: 265717-265736; FIG. 56: 265737-265756; FIG. 57: 265757-265776; FIG. 58: 265777-265796; FIG. 59: 265797-265816; FIG. 60: 265817-265836; FIG. 61: 265837-265856; FIG. 62: 265857-265876; FIG. 63: 265877-265896; and FIG. 64: 265897-265916.

Figure 1:
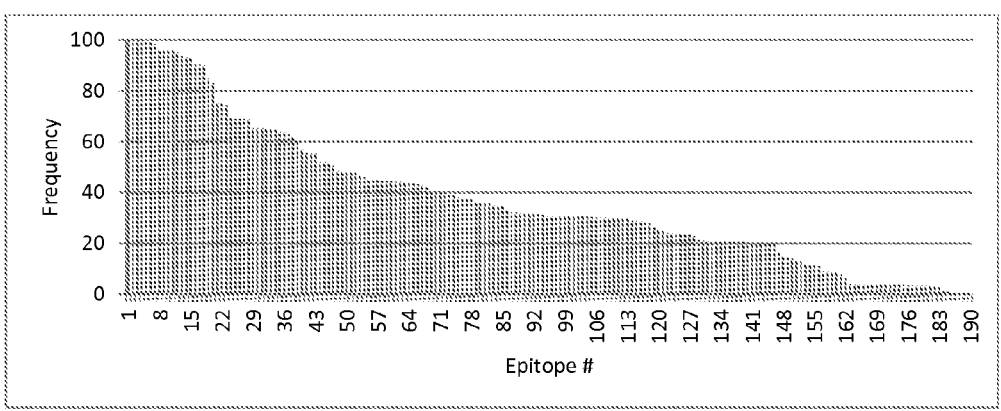
FIG. 1 is a graph depicting the sorted frequency of the 190 known DENV epitopes.

Compositions including immunogenic compositions comprising the peptides and peptide strings described herein are also provided.

Definitions

As used herein, the terms "block of peptides" and "peptide block" are used interchangeably and refer to the region in a multiple sequence alignment (MSA) of three or more homologous polypeptides selected for analysis. A peptide block, for example, can comprise homologous peptides of, e.g., 8 amino acids in length.

As used herein, the term "cumulative fraction", as used, e.g., in the phrase, "the cumulative fraction of homologous polypeptides in the MSA comprising (1) one or more of said unique peptides is at least 95 percent (%)" refers to the sum of each unique peptide's individual frequency in the polypeptides in the MSA. For example, in a peptide block that has 4 unique peptides (i.e., all of the polypeptides in the MSA contain any 1 of those 4 peptides' amino acid sequences in that particular block), wherein the individual frequency of each unique peptide is 25% (i.e., is found in 25% of the polypeptides aligned in the MSA), the cumulative fraction of homologous polypeptides having one (1) of those four (4) unique peptides will be 100% (25%+25%+25+25%). The minimum number of peptides required to 'achieve a cumulative fraction of X %' of the homologous polypeptides in the MSA" (wherein X is a number, e.g., 90%, 91%, 92%, 93%, 94%, 95%, 96%, 97%, 98%, 99%, etc.), is also referred to herein using the phrase, "the minimum number of peptides required to "cover X % of a block."' Thus, in the Examples disclosed herein, for example, the minimum number of unique peptides required to "cover 99% of a block" refers to the minimum number of unique peptides required to achieve a cumulative fraction of polypeptides in the MSA containing those unique peptides of at least 99%.

As used herein, the term "species", e.g., when referring to a "plurality of species" in an MSA, refers to different serotypes or subtypes of a virus, (for example, and without limitation, DENV1, DENV2, DENV3, and DENV4 are different serotypes of Dengue virus). If a virus has a single subtype, then that virus is considered a species, such as, but not limited to, WNV or JEV. As used herein, "polypeptides derived from a plurality of species" in an MSA, for example, means that the polypeptide sequences used in the MSA are obtained from more than one species; accordingly, polypeptides derived from a plurality of species can, although do not necessarily, have different amino acid sequences. By "different amino acid sequences" is meant that at least one amino acid in a polypeptide sequence is different than the amino acid residue at the same position in another polypeptide sequence in the MSA.

As used herein, the term "all *flaviviruses*" is used interchangeably with the term "panFLAVI", and includes all *flavivirus* species for which polyprotein sequences were available in GenBank® and/or Swissprot/Uniprot, including sequences from the following *flavivirus* species: Aedes *flavivirus*, Alfuy virus, Alkhurma hemorrhagic fever virus, Apoi virus, Aroa virus, Bagaza virus, Banzi virus, Batu Cave virus, Bouboui virus, Bukalasa bat virus, Bussuquara virus, Cacipacore virus, Calbertado virus, Carey Island virus, Chaoyang virus, Cowbone Ridge virus, Culex *flavivirus* virus, Dakar bat virus, Deer tick virus, Dengue virus 1, Dengue virus 2, Dengue virus 3, Dengue virus 4, Edge Hill virus, Entebbe bat virus, Gadgets Gully virus, Greek goat encephalitis virus, Iguape virus, Ilheus virus, Israel turkey meningoencephalomyelitis virus, Japanese encephalitis virus, Jugra virus, Jutiapa virus, Kadam virus, Kamiti River virus, Karshi virus, Kedougou virus, Kokobera virus, Koutango virus, Kumlinge virus, Kunjin virus, Kyasanur forest disease virus, Langat virus, Louping ill virus, Meaban virus, Modoc virus, Montana myotis leukoencephalitis virus, Mosquito *flavivirus* virus, Murray Valley encephalitis virus, Naranjal virus, Negishi virus, New Mapoon virus, Ngoye virus, Nounane virus, Ntaya virus, Omsk hemorrhagic fever virus, Phnom Penh bat virus, Potiskum virus, Powassan virus, Quang Binh virus, Rio Bravo virus, Rocio virus, Royal Farm virus, Saboya virus, Sal Vieja virus, San Perlita virus, Saumarez Reef virus, Sepik virus, Sitiawan virus, Sokoluk virus, Spanish sheep encephalitis virus, Spondweni virus, St. Louis encephalitis virus, Stratford virus, Tamana bat virus, Tembusu virus, THo virus, Tick-borne encephalitis virus, Turkish sheep encephalitis virus, Tyuleniy virus, Uganda S virus, Usutu virus, Wang Thong virus, Wesselsbron virus, West Nile virus, Yaounde virus, Yellow fever virus, Yokose virus, and Zika virus.

As used herein, a "cytotoxic T lymphocyte" ("CTL") is a CD8 T lymphocyte that can kill a target cell expressing on its surface a peptide epitope-major histocompatibility complex (MHC) molecular complex for which the TCR of the CTL is specific. Typically, the peptide-MHC molecular complex recognized by CTLs are formed by MHC class I molecules. On the other hand, CD4 T cells (T helper cells) generally recognize peptide epitopes in the context of MHC class II molecules.

As used herein, "immune response" refers to the development of a humoral (antibody mediated), cellular (mediated by antigen-specific T cells or their secretion products) or both humoral and cellular response directed against a pathogen or immunogen (e.g., a peptide described herein) in a recipient patient.

As used herein, "immunogenic" means capable of eliciting a functional immune response. By "immunize" is meant to stimulate an immune response, e.g., such that may render immune a recipient of an immunogenic composition (e.g., a vaccine). For example, an immunogenic composition of the invention may be used to immunize a mammal, such as a human, against current or subsequent infection caused by a virus or other pathogen.

An "immunogenic peptide" is a peptide which comprises an allele-specific motif or other sequence such that the peptide will bind an MHC molecule and induce a cytotoxic T lymphocyte ("CTL") response, a CD4 T Helper response and/or a B cell response (e.g. antibody production) against the antigen from which the immunogenic peptide is derived.

As used herein, "antigenic" means capable of being recognized by an effector lymphocyte or an antibody molecule. Thus a substance is antigenic if it is recognized by an antigen specific receptor on, for example, a CTL, a CD4+ helper T cell, or a B lymphocyte producing antibody molecules or by an antibody molecule physically unassociated with a B lymphocyte.

A conserved peptide block is further considered to be "immunofunctionally conserved" when all peptides in the block that are required to "cover a certain percentage of sequences" (i.e., achieve a cumulative frequency of at least 90%, at least 91%, at least 92%, at least 93%, at least 94%, at least 95%, at least 96%, at least 97%, at least 98%, at least 99%, or greater) share MHC restriction. The term "share MHC restriction" in the context of peptides that share MHC restriction means that those peptides can each be recognized by a T cell in the context of the same MHC (e.g., HLA) molecule. It is further to be understood that though sharing MHC restriction, those peptides may, although not necessarily, also bind to other MHC molecules. Moreover, the additional MHC molecules they may bind to may be the same or different for the various peptides. Preferably, the peptides from immunofunctionally conserved blocks bind to an MHC molecule for which they share MHC restriction with the same or similar binding affinity.

"Polypeptide," "protein," and "peptide" are used interchangeably and mean any peptide-linked chain of amino acids regardless of post-translational modification. While polypeptides and proteins can be any length, peptides are generally shorter polypeptides or proteins, i.e., shorter than 100 amino acid residues.

As used herein, "homologous polypeptides" refer to polypeptides derived from a common ancestor and are typically, although not necessarily, proteins having one or more similar functions. Typically, homologous polypeptides will have a degree of sequence identity to one another across the entire length of each polypeptide sequence that is at least 50%, at least 55%, at least 60%, at least 65%, at least 70%, at least 75%, at least 80%, at least 85%, at least 90%, at least 91%, at least 92%, at least 93%, at least 94%, at least 95%, at least 96%, at least 97%, at least 98%, at least 99%, or greater. For example, homologous polypeptides derived from variants of Dengue virus typically, although not necessarily, have a sequence identity that is greater than 80% across the entire length of each homologous polypeptide.

By "variant polypeptide" is intended a polypeptide derived from the native protein by deletion (so-called truncation), addition of one or more amino acids of the native protein, or amino acid substitution. Addition or deletion can be to the N-terminal and/or C-terminal end of the native protein; or deletion or addition of one or more amino acids at one or more sites in the native protein. Substitution of one or more amino acids can be at one or more sites in the native protein. Such variants may result from, for example, genetic polymorphism, mutation, other biological processes, or from human manipulation. Methods for such manipulations are generally known in the art.

The terms "subject" and "patient" mean any animal, including mammals and, in particular, humans.

"Treatment" or "treating a subject" is defined as the application or administration of a therapeutic agent to a patient, or application or administration of a therapeutic agent to an isolated tissue or cell line from a patient, who has a disease, a symptom of disease or a predisposition toward a disease. Treatment can slow, cure, heal, alleviate, relieve, alter, remedy, ameliorate, improve or affect the disease, the symptoms of disease or the predisposition toward disease. For example, treatment of a subject, e.g., a human subject, with a peptide or composition described herein, can prevent, slow, improve, or stop viral infection, or infection with another pathogenic organism.

"Preventing a disease" in a subject means for example, to stop the development of one or more symptoms of a disease in a subject before they occur or are detectable, e.g., by the patient or the patient's doctor. Preferably, the disease does not develop at all, i.e. no symptoms of the disease are detectable. However, it can also be delaying or slowing the onset of one or more symptoms of the disease. In certain embodiments, preventing a disease involves "preventing an infection." For example, Dengue virus infection can cause several forms of Dengue disease, and thus prevention of infection with Dengue virus can prevent development of Dengue disease or delay or slow the onset of one or more symptoms of Dengue disease. An infection may be prevented or the effects of the infection (e.g., development of disease) reduced, for example, by immunizing a subject with an immunogenic composition in order to produce protective immunity in the subject against the target (i.e., the pathogen capable of causing the infection). In a specific embodiment, a subject may be immunized with a composition comprising peptide epitopes of, e.g., Dengue virus, in order to induce protective immunity against infection with Dengue virus. The present disclosure provides methods for designing immunogenic compositions, i.e., identifying peptide epitope targets for use in immunogenic compositions, of any pathogen, and in particular of pathogens having highly variable amino acid sequences across strains.

A "therapeutically effective amount" is a quantity of a composition or a cell to achieve a desired effect in a subject being treated. For instance, this can be the amount necessary to induce an immune response against a target antigen or pathogen. When administered to a subject, a dosage will generally be used that will achieve target tissue concentrations (for example, in lymphocytes) that has been shown to achieve an in vitro effect.

A "prophylactically effective amount" is a quantity of a composition or a cell to achieve a desired effect in a subject being treated, wherein the desired effect is the prevention or the delay or slowing of the onset of an infection and/or disease in the subject.

The peptides provided herein may be operably linked to an amino acid sequence for a therapeutic agent (e.g., as a peptide string). An amino acid or nucleic acid is "operably linked" when it is placed into a functional relationship with another amino acid or nucleic acid sequence. For example, DNA a pre-sequence or secretory leader is operably linked to DNA for a polypeptide if it is expressed as a pre-protein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Linking is accomplished by ligation at convenient restriction sites. If such sites do not exist, the synthetic oligonucleotide adaptors or linkers are used in accordance with conventional practice.

The term "nucleic acid" refers to deoxyribonucleotides or ribonucleotides and polymers thereof in either single- or double-stranded form, composed of monomers (nucleotides) containing a sugar, phosphate and a base which is either a purine or pyrimidine. Unless specifically limited, the term encompasses nucleic acids containing known analogs of natural nucleotides which have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions) and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucl. Acids Res.,* 19:508 (1991); Ohtsuka et al., *JBC,* 260:2605 (1985); Rossolini et al., *Mol. Cell. Probes,* 8:91 (1994)). A "nucleic acid fragment" is a fraction of a given nucleic acid molecule. Deoxyribonucleic acid (DNA) in the majority of organisms is the genetic material while ribonucleic acid (RNA) is involved in the transfer of information contained within DNA into proteins. The term "nucleotide sequence" refers to a polymer of DNA or RNA which can be single- or double-stranded, optionally containing synthetic, non-natural or altered nucleotide bases capable of incorporation into DNA or RNA polymers. The terms "nucleic acid", "nucleic acid molecule", "nucleic acid fragment", "nucleic acid sequence or segment", or "polynucleotide" may also be used interchangeably with gene, cDNA, DNA and RNA encoded by a gene.

The invention encompasses isolated or substantially purified nucleic acid or polypeptide compositions. In the context of the present invention, an "isolated" or "purified" DNA molecule or an "isolated" or "purified" polypeptide is a DNA molecule or polypeptide that exists apart from its native environment and is therefore not a product of nature. An isolated DNA molecule or polypeptide may exist in a purified form or may exist in a non-native environment such as, for example, a transgenic host cell. For example, an "isolated" or "purified" nucleic acid molecule or protein, or biologically active portion thereof, is substantially free of other cellular material, or culture medium when produced by recombinant techniques, or substantially free of chemical precursors or other chemicals when chemically synthesized. In one embodiment, an "isolated" nucleic acid is free of sequences that naturally flank the nucleic acid (i.e., sequences located at the 5' and 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. A protein that is substantially free of cellular material includes preparations of protein or polypeptide having less than about 30%, 20%, 10%, 5%, 4%, 3%, 2%, or 1% (by dry weight) of contaminating protein. When the polypeptide of the invention, or biologically active portion thereof, is recombinantly produced, preferably culture medium represents less than about 30%, 20%, 10%, 5%, 4%, 3%, 2%, or 1% (by dry weight) of chemical precursors or non-protein-of-interest chemicals. Fragments and variants of the disclosed nucleotide sequences and proteins or partial-length proteins encoded thereby are also encompassed by the present invention. By "fragment" or "portion" is meant a full length or less than full length of the nucleotide sequence encoding, or the amino acid sequence of, a polypeptide or protein.

In accordance with the present invention, there may be employed conventional molecular biology, microbiology, and recombinant DNA techniques within the skill of the art. See, e.g., Sambrook, Fritsch and Maniatis, Molecular Cloning: A Laboratory Manual, 2nd ed., Cold Spring Harbor Laboratory Press, Cold Spring Harbor, N.Y., 1989 (herein "Sambrook et al., 1989"); DNA Cloning: A Practical Approach, Volumes I and II (Glover ed. 1985); Oligonucleotide Synthesis (Gait ed. 1984); Nucleic Acid Hybridization (Hames and Higgins eds. 1985); Transcription And Translation (Hames and Higgins eds. 1984); Animal Cell Culture (Freshney ed. 1986); Immobilized Cells And Enzymes (IRL Press, 1986); B. Perbal, A Practical Guide To Molecular Cloning (1984); Ausubel et al. eds., Current Protocols in Molecular Biology, John Wiley and Sons, Inc. 1994; among others.

Methods for Identifying Conserved Peptide Blocks

In certain embodiments, methods are provided for identifying at least one conserved peptide block in three or more homologous polypeptides, the method comprising:
  (a) identifying blocks of peptides in three or more homologous polypeptides in a multiple sequence alignment (MSA), each peptide being 8-11 amino acids in length;
  (b) for each block of peptides, determining a minimum required number of unique peptides in the block of peptides such that the cumulative fraction of homologous polypeptides in the MSA comprising (1) one or more of said unique peptides is at least 95 percent (%); and
  (c) identifying a peptide block as conserved if said minimum required number of unique peptides determined in step (b) is 7 or fewer.

Preferably, a polypeptide MSA comprises three or more polypeptide amino acids sequences. For identification of conserved peptides in, for example, a highly variable virus, it is preferable that all known sequences (e.g., sequences isolated from different strains of an organism, e.g., a virus) are included, in order to identify the broadest number of conserved peptide epitopes, although fewer than all known sequences can be included (i.e., some may be excluded). The excluded sequences may include, for example, but not limited to, duplicate, erroneous or irrelevant, sequences. For example, in certain embodiments, when it is desirable to identify conserved epitopes within a specific variant of a pathogen, or within a specific serotype of, e.g., a virus, only those relevant sequences (e.g., of the variant or serotypes) may be included in the MSA.

In order to determine the "minimum required number" of unique peptides in a given block to achieve a cumulative fraction of polypeptides in a MSA of a certain desired percentage (e.g., at least 95%), the following analysis can be carried out. First, the frequency of each unique peptide within the polypeptides in the MSA is calculated. For example, if 100 polypeptides are aligned in a MSA, and in a particular block, 75 of the 100 polypeptides have a peptide in the block with the amino acid sequence KTFDTEYQK (SEQ ID NO: 1), then that unique peptide (i.e., peptide sequence) is determined to have a frequency of 75%. If 20 polypeptides in the MSA have a peptide in the block with the amino acid sequence KTFDTEYQR (SEQ ID NO: 12), then that unique peptide (i.e., peptide sequence) has a frequency of 20%. If the remaining 5 polypeptides each have a peptide in the block with a unique sequence, then each of those remaining unique peptides are determined to have a frequency of 1%. Next, the individual frequencies of each unique peptide are added up to obtain a cumulative fraction of polypeptides in a MSA of at least 95%, and the fewest number of unique peptides required to reach at least 95% is the "minimum required number". In this particular example, the minimum number of unique peptides (i.e., unique peptide sequences) required to achieve a 95% cumulative fraction is two, since the cumulative fraction of the first two peptides (75%+20%) totals 95%.

As another example, if a third peptide were required in the set of minimum required peptides in order to achieve a cumulative fraction of at least 95% (i.e., if the cumulative fraction of the two most frequent peptides was, e.g., 94.9%), then the peptide with the next highest frequency after the first two peptides typically would be selected. It is preferred to select the peptide with the next highest frequency in the polypeptides in the MSA in order to obtain the broadest possible coverage of all sequences with the fewest number of peptides. If, for example, however, there are multiple unique peptides with the next highest frequency (i.e., they all have the same frequency), and therefore only one of those peptides is needed to achieve the desired cumulative fraction (e.g., at least 95%), typically, although not necessarily, all peptides having that same frequency will be included in the conserved block. However, any one of those individual peptides can also be arbitrarily selected and included alone as the third peptide in a set of three peptides, rather than including all the peptides with the same frequency. Similarly, if a minimum of two peptides is required, and the second peptide (i.e. the second most frequent peptide) has the same frequency as other peptides in the block, just one of those peptides, or all of those peptides with the same frequency, can be included in the set of peptides. If a minimum of four (4) peptides is required, and the fourth peptide (i.e. the fourth most frequent peptide) has the same frequency as other peptides in the block, just one of those peptides, or all of those peptides with the same frequency, can be included in the set of peptides. If a minimum of five (5) peptides is required, and the fifth peptide (i.e. the fifth most frequent peptide) has the same frequency as other peptides in the block, just one of those peptides, or all of those peptides with the same frequency, can be included in the set of peptides.

In the Examples provided herein, the cumulative fraction of homologous polypeptides in an MSA for determining that a peptide block is conserved (i.e., the "conservation threshold") is at least 99%; however, it is to be understood that the instant methods contemplate a range of cumulative fraction (percentages) that is not limited to at least 99% for determining that a peptide block is conserved. In a preferred embodiment, the cumulative fraction is at least 95% or greater. In certain embodiments, it is preferable that the cumulative fraction is at least 90%, at least 91%, at least 92%, at least 93%, at least 94%, at least 95%, at least 96%, at least 97%, at least 98%, at least 99%, or greater.

Further, in some embodiments, for a peptide block to be determined to be conserved, the minimum number of unique peptides required to achieve the desired cumulative fraction of homologous polypeptides in the MSA (e.g., at least 95%, at least 96%, etc.) is 10 or fewer, 9 or fewer, 8 or fewer, 7 or fewer, 6 or fewer, 5 or fewer, 4 or fewer, or 3 or fewer. Preferably, the minimum required number of unique peptides is 7 or fewer, more preferably 6 or fewer, and still more preferably 5 or fewer. While not intending to be bound by one particular theory or mechanism, it is preferable that the minimum required number of peptides be limited to 10 or fewer, 9 or fewer, 8 or fewer, 7 or fewer, 6 or fewer, 5 or fewer, or 4 or fewer, as described above, since predicting the cross-protective capacity of a peptide-based immunogenic composition (e.g., vaccine) gets more difficult as the number of peptides increases. Furthermore, the larger the combinatorial space needed to cover the diversity of the target pathogen (e.g., multiple serotypes or strains of a virus); the more complex the task to combine all of the peptides in one vaccine without compromising its efficacy.

In certain embodiments, when the MSA comprises polypeptides derived from a plurality of species, preferably a peptide block is identified as conserved if the minimum required number of unique peptides (e.g. 7 or fewer, 6 or fewer, 5 or fewer, etc.) represents a cumulative fraction of at least 90% within each species and at least 95% of all peptides in the MSA. In one embodiment, when the MSA comprises polypeptides derived from a plurality of species, a peptide block is identified as conserved if the minimum required number of unique peptides (e.g. 7 or fewer, 6 or fewer, 5 or fewer, etc.) represents a cumulative fraction of at least 95% within each species and at least 95% of all peptides in the MSA. In another embodiment, a peptide block is identified as conserved if the minimum required number of unique peptides (e.g. 7 or fewer, 6 or fewer, 5 or fewer, etc.) represents a cumulative fraction of at least 90%, at least 91%, at least 92%, at least 93%, at least 94%, at least 95% or greater within each species, and at least 90%, at least 91%, at least 92%, at least 93%, at least 94%, at least 95%, at least 96%, at least 97%, at least 98%, at least 99% or greater of all peptides in the MSA.

In certain embodiments, each peptide in a peptide block can have a length of anywhere from about 8 to about 15 amino acid residues, although fewer or greater numbers of residues are also possible. For example, each peptide in a peptide block can have a length of about 5, 6, 7, 8, 9, 10, 11, 12, 13, 14, 15 or more residues. Preferably, a peptide in a peptide block has a length of about 8, 9, 10, or 11 residues. Typically, since the peptide block is formed by alignment of homologous polypeptide sequences, each peptide in the block will have an amino acid sequence that is similar to the sequences of the other peptides in the block, i.e. will typically although not necessarily have a percent sequence identity of about 50%, 55%, 60%, 65%, 70%, 75%, 80%, 85%, 90%, 95%, 96%, 97%, 98%, 99%, or 100% with other peptides in the block. The percent sequence identity of the peptides in the block will depend on the amount of amino acid sequence variation present in the sequences of the polypeptides included in the MSA.

As used herein, "sequence identity" or "identity" in the context of two nucleic acid or polypeptide sequences makes reference to a specified percentage of residues in the two sequences that are identical when aligned for maximum correspondence over a specified comparison window, as measured by sequence comparison algorithms or by visual inspection. When percentage of sequence identity is used in reference to polypeptides it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity." Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.). Polypeptides with substitutions will generally have not more than 50 (e.g., not more than one, two, three, four, five, six, seven, eight, nine, ten, 12, 15, 20, 25, 30, 35, 40, or 50) conservative amino acid substitutions, although more are possible. A conservative substitution is the substitution of one amino acid for another with similar characteristics. Conservative substitutions include substitutions within the following groups: valine, alanine and glycine; leucine, valine, and isoleucine; aspartic acid and glutamic acid; asparagine and glutamine; serine, cysteine, and threonine; lysine and arginine; and phenylalanine and tyrosine. The non-polar hydrophobic amino acids include alanine, leucine, isoleucine, valine, proline, phenylalanine, tryptophan and methionine. The polar neutral amino acids include glycine, serine, threonine, cysteine, tyrosine, asparagine and glutamine. The positively charged (basic) amino acids include arginine, lysine and histidine. The negatively charged (acidic) amino acids include aspartic acid and glutamic acid. Any substitution of one member of the above-mentioned polar, basic or acidic groups by another member of the same group can be deemed a conservative substitution. By contrast, a non-conservative substitution is a substitution of one amino acid for another with dissimilar characteristics.

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

The term "substantial identity" in the context of a peptide indicates that a peptide comprises a sequence with at least 70%, 71%, 72%, 73%, 74%, 75%, 76%, 77%, 78%, or 79%, preferably 80%, 81%, 82%, 83%, 84%, 85%, 86%, 87%, 88%, or 89%, more preferably at least 90%, 91%, 92%, 93%, or 94%, or even more preferably, 95%, 96%, 97%, 98% or 99%, sequence identity to the reference sequence over a specified comparison window. Preferably, optimal alignment is conducted using the homology alignment algorithm of Needleman and Wunsch, J. Mol. Biol. 48:443 (1970). An indication that two peptide sequences are substantially identical is that one peptide is immunologically reactive with antibodies raised against the second peptide. Thus, a peptide is substantially identical to a second peptide, for example, where the two peptides differ only by a conservative substitution. One of skill in the art will recognize that these values can be appropriately adjusted to determine corresponding identity of proteins encoded by two nucleotide sequences by taking into account codon degeneracy, amino acid similarity, reading frame positioning, and the like. Substantial identity of amino acid sequences for these purposes normally means sequence identity of at least 70%, more preferably at least 80%, 90%, and most preferably at least 95%.

Methods for alignment of sequences for comparison are well known in the art. For example, the determination of percent identity between any two sequences can be accomplished using a mathematical algorithm. Non-limiting examples of such mathematical algorithms are the algorithm of Myers and Miller, CABIOS, 4:11 (1988); the local homology algorithm of Smith et al., Adv. Appl. Math., 2:482 (1981); the homology alignment algorithm of Needleman and Wunsch, JMB, 48:443 (1970); the search-for-similarity-method of Pearson and Lipman, Proc. Natl. Acad. Sci. USA, 85:2444 (1988); the algorithm of Karlin and Altschul, Proc. Natl. Acad. Sci. USA, 87:2264 (1990), modified as in Karlin and Altschul, Proc. Natl. Acad. Sci. USA, 90:5873 (1993).

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the Wisconsin Genetics Software Package, Version 8 (available from Genetics Computer Group (GCG), 575 Science Drive, Madison, Wis., USA). Alignments using these programs can be performed using the default parameters. The CLUSTAL program is well described by Higgins et al., Gene, 73:237 (1988); Higgins et al., CABIOS, 5:151 (1989); Corpet et al., Nucl. Acids Res., 16:10881 (1988); Huang et al., CABIOS, 8:155 (1992); and Pearson et al., Meth. Mol. Biol., 24:307 (1994). The ALIGN program is based on the algorithm of Myers and Miller, supra. The BLAST programs of Altschul et al., JMB, 215:403 (1990); Nucl. Acids Res., 25:3389 (1990), are based on the algorithm of Karlin and Altschul supra.

Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold. These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative-scoring residue alignments, or the end of either sequence is reached.

In addition to calculating percent sequence identity, the BLAST algorithm also performs a statistical analysis of the similarity between two sequences. One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is less than about 0.1, more preferably less than about 0.01, and most preferably less than about 0.001.

To obtain gapped alignments for comparison purposes, Gapped BLAST (in BLAST 2.0) can be utilized as described in Altschul et al., Nucleic Acids Res. 25:3389 (1997). Alternatively, PSI-BLAST (in BLAST 2.0) can be used to perform an iterated search that detects distant relationships between molecules. See Altschul et al., supra. When utilizing BLAST, Gapped BLAST, PSI-BLAST, the default parameters of the respective programs (e.g. BLASTN for nucleotide sequences, BLASTX for proteins) can be used. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix. Alignment may also be performed manually by inspection.

In certain embodiments, it is preferable that peptides in a block of peptides do not contain gaps. Gap insertions in the alignment correspond to insertion or deletion ("indel") variation in one or more sequences in the dataset. For example, the DENV diversity is generally caused by substitution mutations rather than indels, but some gaps can be observed. Indels of residues can lead to significant change of binding potential or, if both variants are binders, completely different T-cell recognition [see, Riemer A B, et al: A conserved E7-derived cytotoxic T lymphocyte epitope expressed on human papillomavirus 16-transformed HLA-A2+ epithelial cancers. J Biol Chem 2010, 285:29608-29622]. Thus, in the Examples disclosed herein, peptide blocks with gaps were considered problematic. In most cases gaps in the alignment were caused by a fraction of the sequences lower than 1% (rare sequences) and those rare sequences were removed from the MSA. In the Examples, if gaps could not be eliminated by removing rare sequences, the blocks in which more than 10% of the peptides contained gaps were considered too variable and were classified as not conserved. Similarly, peptides containing ambiguous amino acid characters (such as "X") were omitted from the analysis. Ambiguous characters can occur when the amino acid residue at a given position could not be precisely determined.

In certain embodiments, the present invention provides methods for identifying conserved peptides in highly variable viruses (e.g., DENV, WNV, YFV, TBEV, JEV, norovirus, influenza virus, human immunodeficiency virus, and/or others). It is to be understood that the examples of viral peptides are exemplary and not meant to be limiting. The instant methods can be used to identify conserved peptide blocks from other organisms, such as but not limited to bacteria, protists and fungi. In a preferred embodiment, the methods are useful for identifying conserved peptides in infectious organisms (i.e., pathogens), and still more preferably, in pathogens expressing polypeptides having a high degree of variability across different strains or species of the organisms and/or within the same strain or species.

Examples of infectious viruses include but are not limited to: Retroviridae (e.g., human immunodeficiency viruses, such as HIV-1, also referred to as HTLV-III, LAV or HTLV-III/LAV, or HIV-III; and other isolates, such as HIV-LP; Picornaviridae (e.g., polio viruses, hepatitis A virus; enteroviruses, human coxsackie viruses, rhinoviruses, echoviruses); Caliciviridae (e.g., strains that cause gastroenteritis); Togaviridae (e.g., equine encephalitis viruses, rubella viruses); to Flaviridae (e.g., dengue viruses, encephalitis viruses (e.g., St. Louis encephalitis virus, Japanese encephalitis virus, Tick-borne encephalitis virus, Powassan virus), yellow fever viruses, West Nile virus, Kunjin virus, Murray Valley virus); Coronaviridae (e.g., coronaviruses); Rhabdoviridae (e.g., vesicular stomatitis viruses, rabies viruses); Filoviridae (e.g., ebola viruses); Paramyxoviridae (e.g., parainfluenza viruses, mumps virus, measles virus, respiratory syncytial virus); Orthomyxoviridae (e.g., influenza viruses); Bunyaviridae (e.g., Hantaan viruses, bunga viruses, phleboviruses and Nairo viruses); Arena viridae (hemorrhagic fever virus); Reoviridae (e.g., reoviruses, orbiviruses and rotaviruses); Birnaviridae; Hepadnaviridae (Hepatitis B virus); Parvoviridae (parvoviruses); Papovaviridae (papilloma viruses, polyoma viruses); Adenoviridae (most adenoviruses); Herpesviridae (herpes simplex virus (HSV) 1 and 2, varicella zoster virus, cytomegalovirus (CMV), herpes viruses); Poxyiridae (variola viruses, vaccinia viruses, pox viruses); and Iridoviridae (e.g., African swine fever virus); and unclassified viruses (e.g., the etiological agents of Spongiform encephalopathies, the agent of delta hepatitides (thought to be a defective satellite of hepatitis B virus), the agents of non-A, non-B hepatitis (class 0—internally transmitted; class 2—parenterally transmitted (i.e., Hepatitis C); Norwalk and related viruses (noroviruses), and astroviruses).

Thus, in certain embodiments, a virus is from a family selected from the group consisting of: Retroviridae, Picornaviridae, Caliciviridae, Togaviridae, Flaviridae, Coronaviridae, Rhabdoviridae, Filoviridae, Paramyxoviridae, Orthomyxoviridae, Bungaviridae, Arena viridae, Reoviridae, Birnaviridae, Hepadnaviridae, Parvoviridae, Papovaviridae, Adenoviridae, Herperviridae, Poxyiridae, and Iridoviridae.

Examples of infectious bacteria include but are not limited to: *Helicobacter pyloris, Borelia burgdorferi, Legionella pneumophilia, Mycobacteria* sps (e.g., *M. tuberculosis, M. avium, M. Intracellulare, M. kansaii, M. gordonae*), *Staphylococcus aureus, Neisseria gonorrhoeae, Neisseria meningitidis, Listeria monocytogenes, Streptococcus pyogenes* (Group A *Streptococcus*), *Streptococcus agalactiae* (Group B *Streptococcus*), *Streptococcus* (*viridans* group), *Streptococcus faecalis, Streptococcus bovis, Streptococcus* (anaerobic sps), *Streptococcus pneumoniae,* pathogenic *Campylobacter* sp., *Enterococcus* sp., *Haemophilus influenzae, Bacillus antracis, corynebacterium diphtheriae, corynebacterium* sp., *Erysipelothrix rhusiopathiae, Clostridium perfringers, Clostridium tetani, Enterobacter erogenes, Klebsiella pneuomiae, Pasturella multicoda, Bacteroides* sp., *Fusobacterium nucleatum, Sreptobacillus moniliformis, Treponema pallidium, Treponema pertenue, Leptospira,* and *Actinomeyces israelli.*

Examples of infectious fungi include but are not limited to: *Cryptococcus neoformans, Histoplasma capsulatum, Coccidioides immitis, Blastomyces dermatitidis, Chlamydia trachomatis,* and *Candida albicans.* Examples of other infectious organisms include but are not limited to protists (e.g., *Plasmodium falciparum, Toxoplasma gondii,* and *Trypanosomes* (e.g., *Trypanosoma brucei*)).

Figures 3, 6:
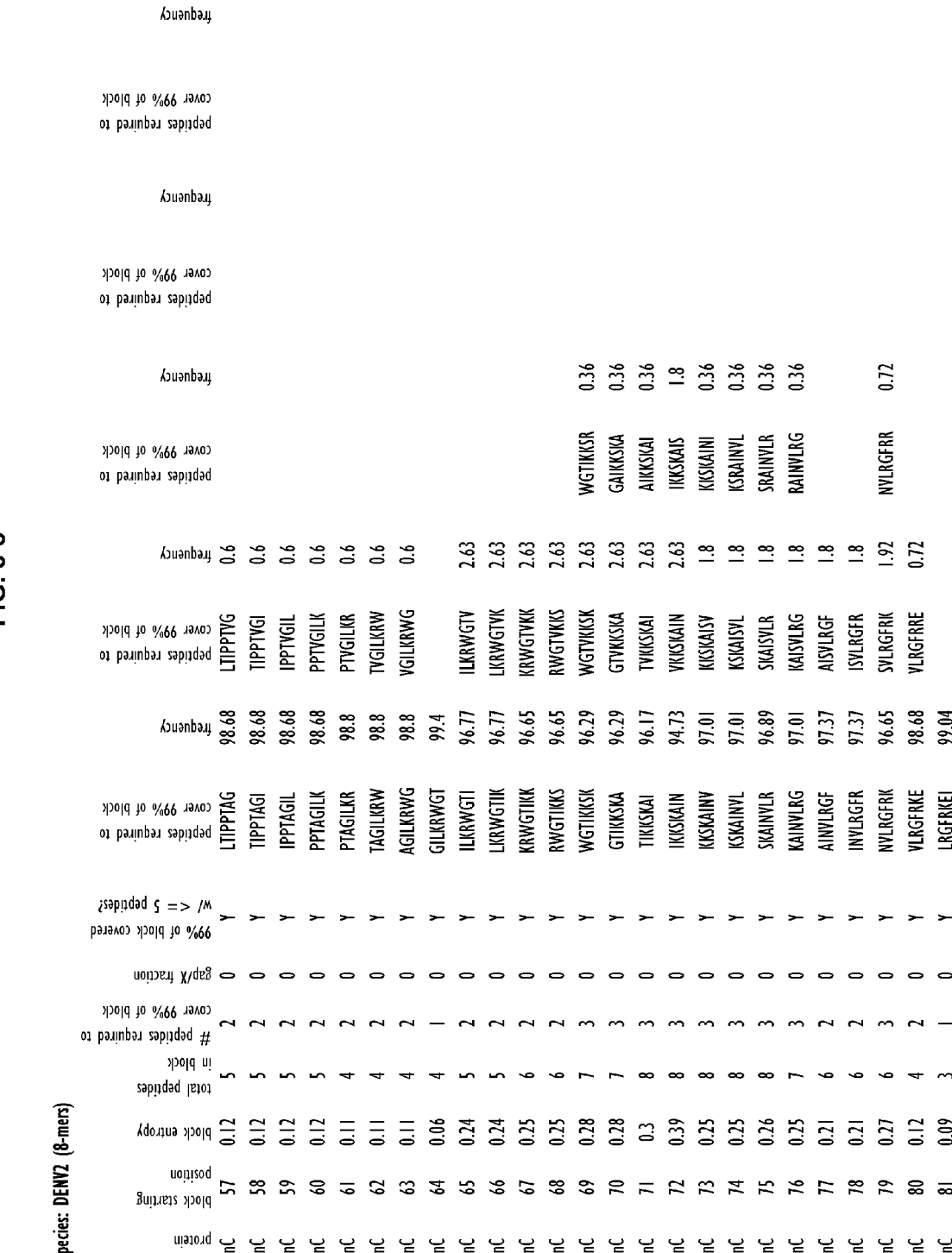
Figures 6, 7:
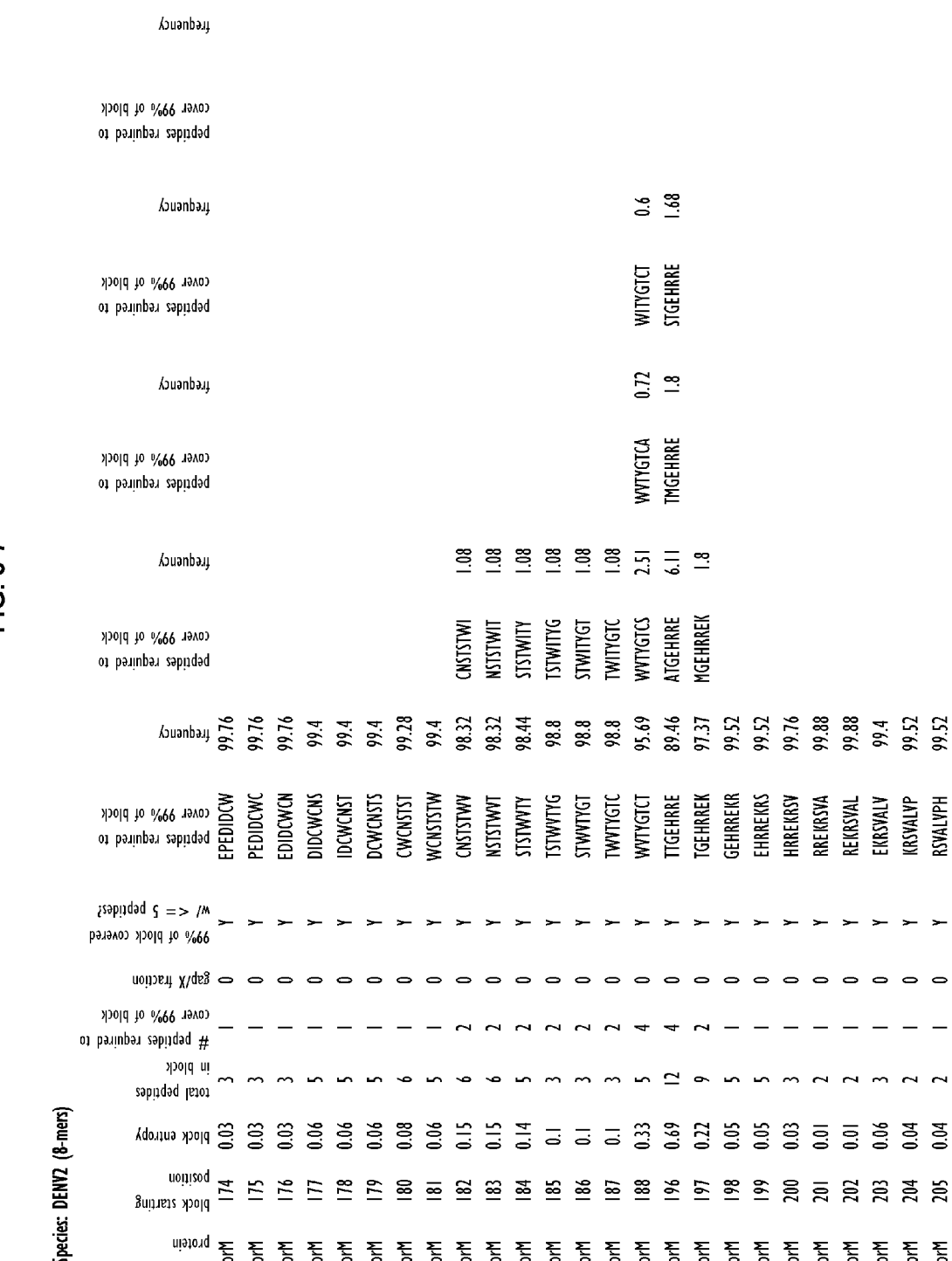
Figures 6, 7, 8:
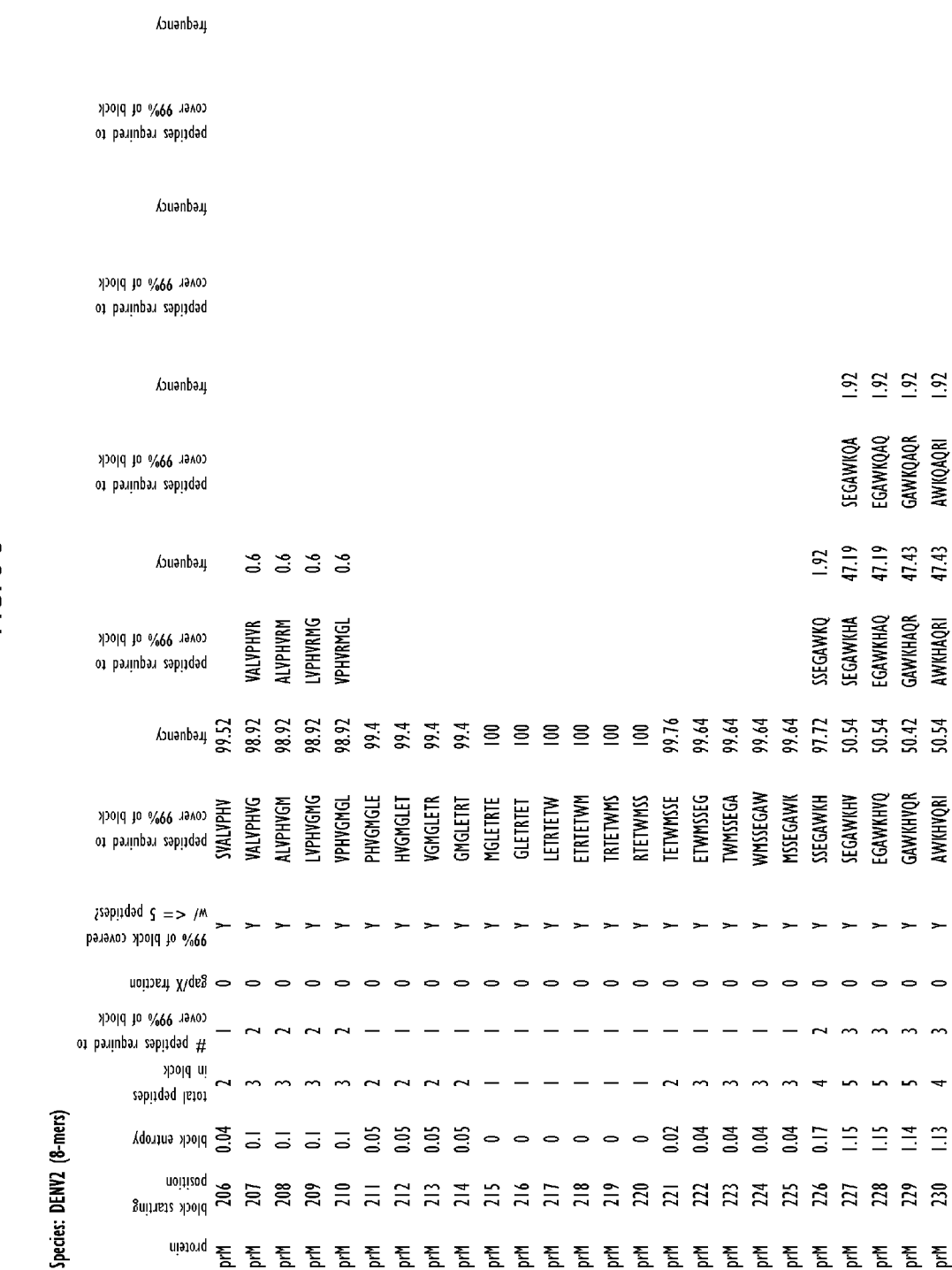
Figures 6, 64:
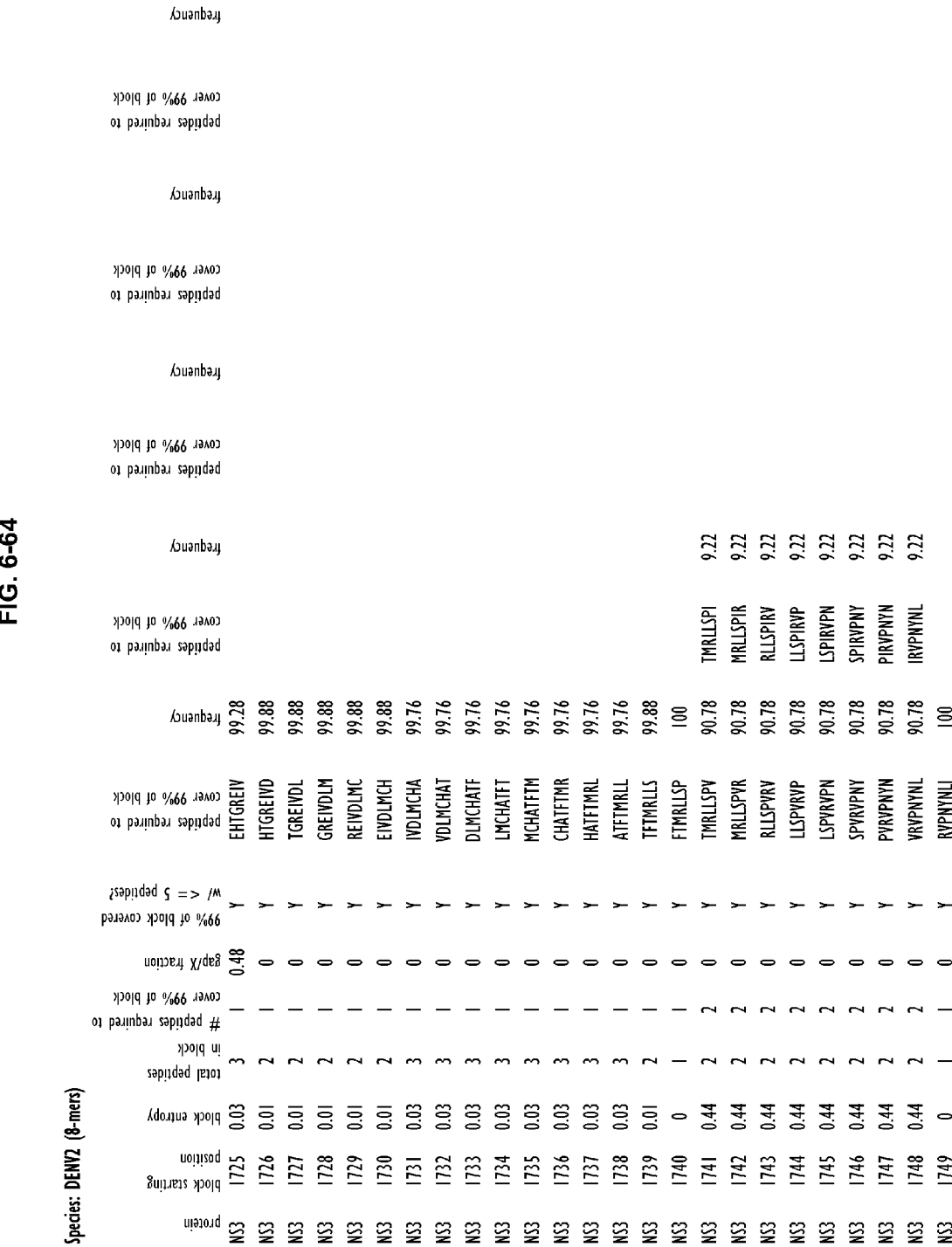
Figures 6, 70:
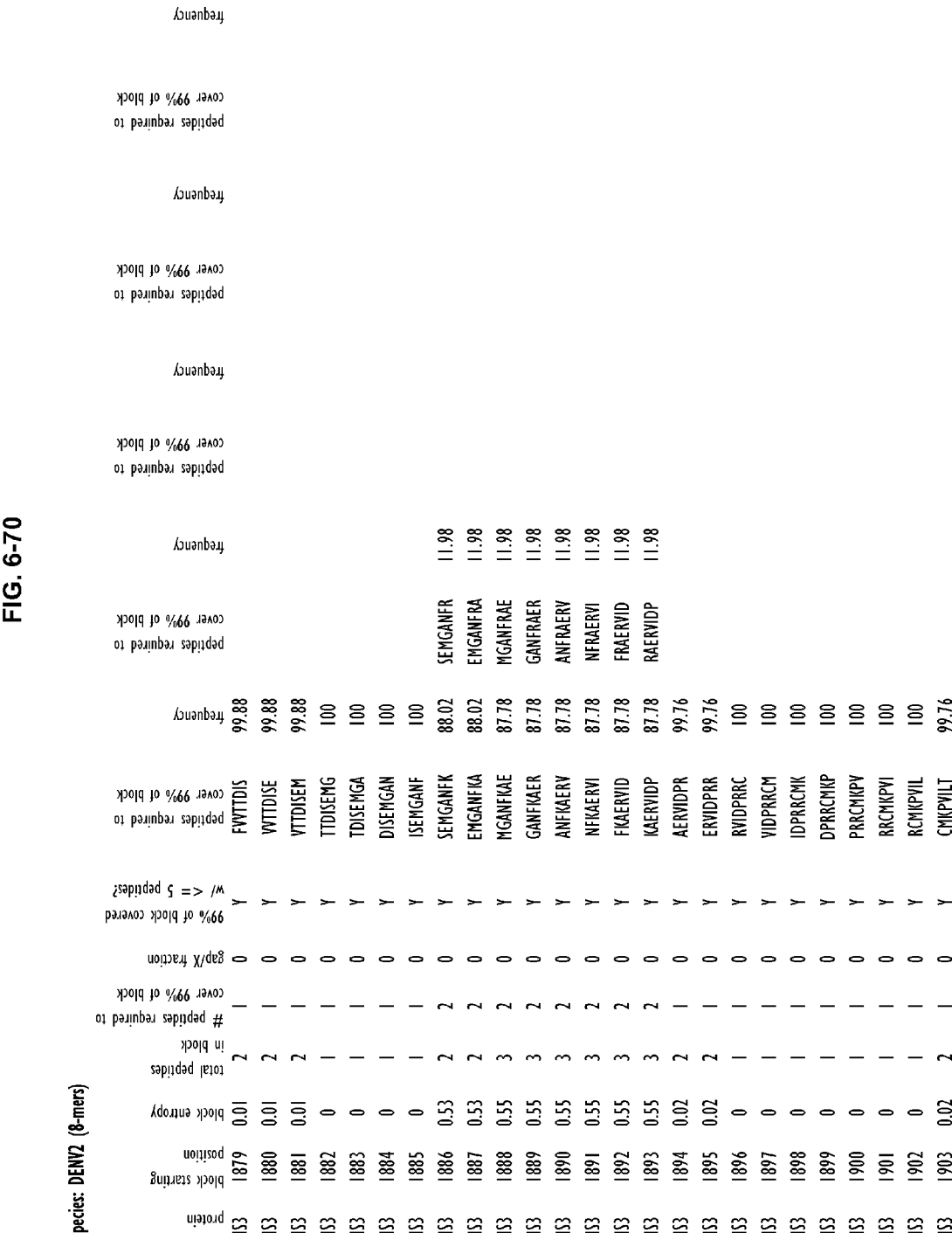
FIG. 70 shows the GenBank® Accession numbers for each polyprotein aligned in the MSAs for panFlavi (all of the sequences referenced by Accession number in FIG. 70), panFIVE (including all DENV serotype sequences (DENV), WNV, YFV, TBEV and JEV), or in the MSA of individual viruses (e.g., WNV, YFV, JEV, and TBEV). The following abbreviations were used for the viruses: "ADV" is *Aedes flavivirus*, "AFV" is Alfuy virus, "AHFV" is Alkhurma hemorrhagic fever virus, "APV" is Apoi virus, "ARV" is Aroa virus, "BAV" is Bagaza virus, "BNV" is Banzi virus, "BUY" is Bouboui virus, "BQV" is Bussuquara virus, "CYV" is Chaoyang virus, "DTV" is Deer Tick virus, "DENV" is Dengue virus, "EHV" is Edge Hill virus, "EBV" is Entebbe bat virus, "GGV" is Gadgets Gully virus, "GGEV" is Greek goat encephalitis virus, "IGV" is Iguape virus, "IV" is Ilheus virus, "JEV" is Japanese encephalitis virus, "JV" is Jugra virus, "KV" is Kadam virus, "KRV" is Kamiti River virus, "KAV" is Karshi virus, "KOV" is Kedougou virus, "KKV" is Kokobera virus, "KJV" is Kunjin virus, "KFDV" is Kyasanur forest disease virus, "LV" is Langat virus, "MMLV" is Montana myotis leukoencephalitis virus, "MVEV" is Murray Valley encephalitis virus, "MV" is Meaban virus, "MOV" is Modoc virus, "LIV" is Louping ill virus, "NOV" is Nounane virus, "OHFV" is Omsk hemorrhagic fever virus, "POV" is Powassan virus, "PSV" is Potiskum virus, "RBV" is Rio Bravo virus, "ROV" is Rocio virus, "RFV" is Royal Farm virus, "SAV" is Saboya virus, "SRV" is Saumarez Reef virus, "SEV" is Sepik virus, "SSEV" is Spanish Sheep encephalitis virus, "SPV" is Spondweni virus, "SLEV" is St. Louis encephalitis virus, "TBEV" is Tick-borne encephalitis virus, "TMBV" is Tamana bat virus, "TSEV" is Turkish Sheep encephalitis virus, "TUV" is Tyuleniy virus, "USV" is Uganda S virus, "UTV" is Usutu virus, :WBV" is Wesselsbron virus, "WNV" is West Nile virus, "YFV" is Yellow Fever Virus, and "ZKV" is Zika virus.
Figures 6, 71:
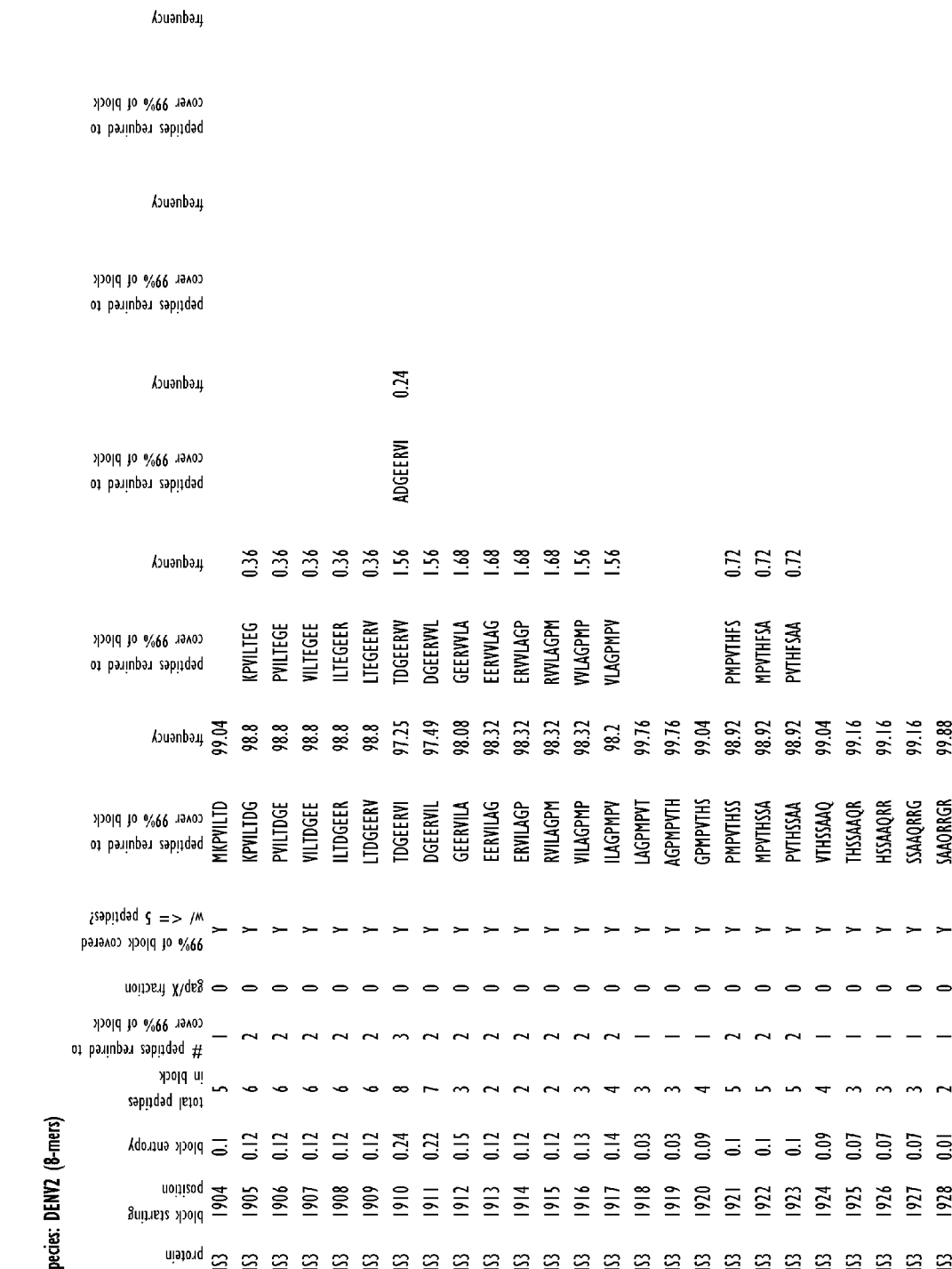
Figures 6, 80:
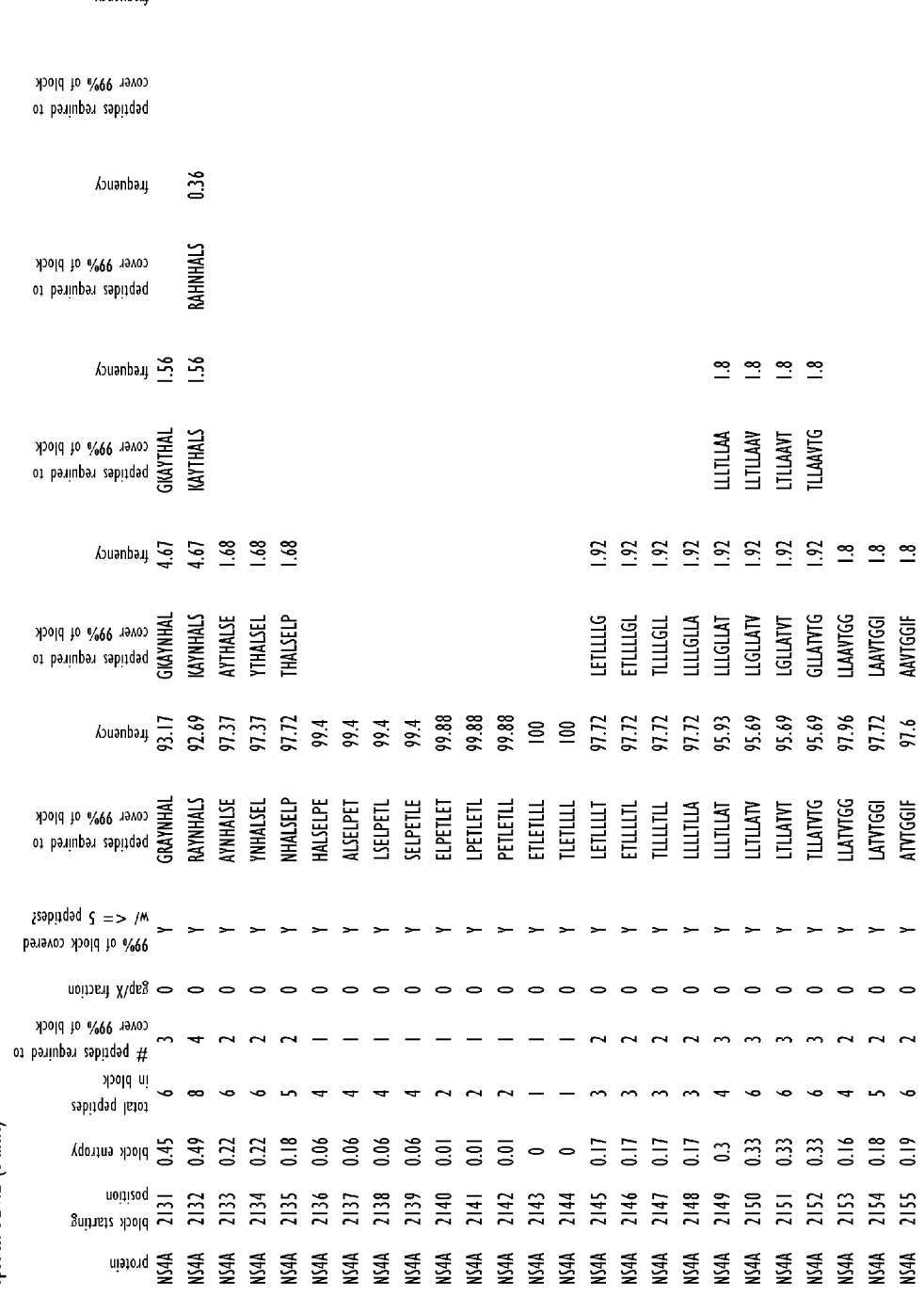
Figures 6, 82:
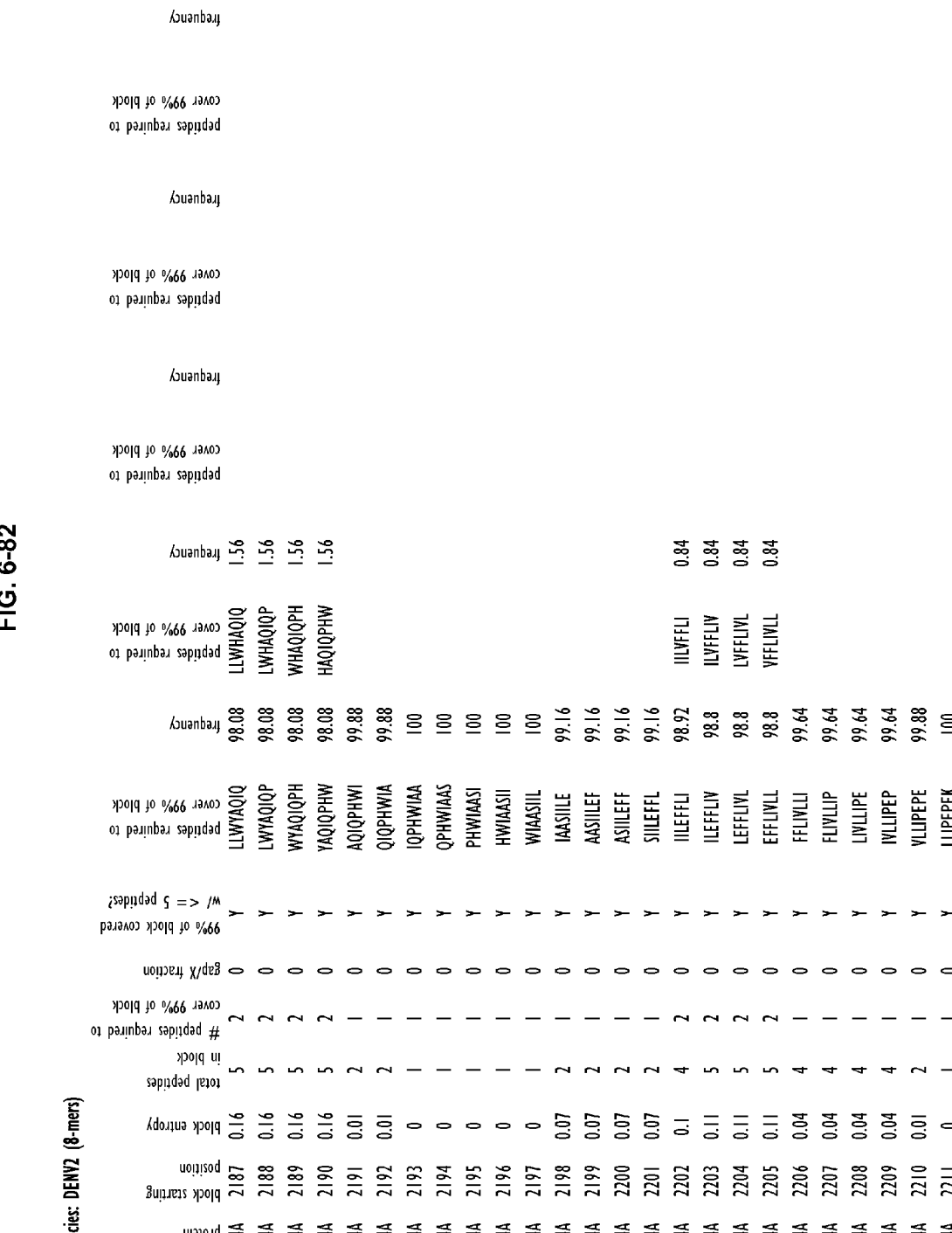
Figures 6, 83:
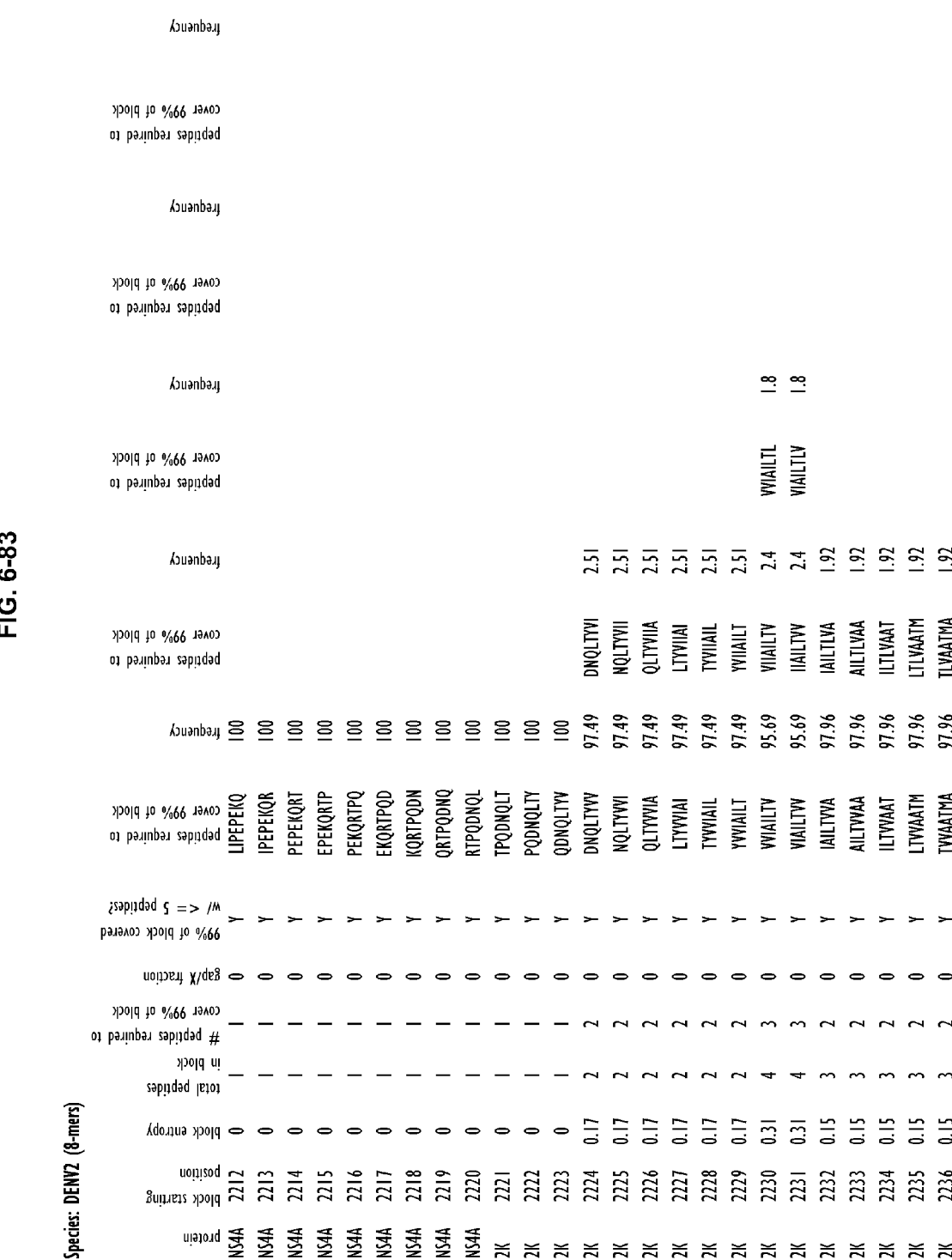
Figures 6, 85:
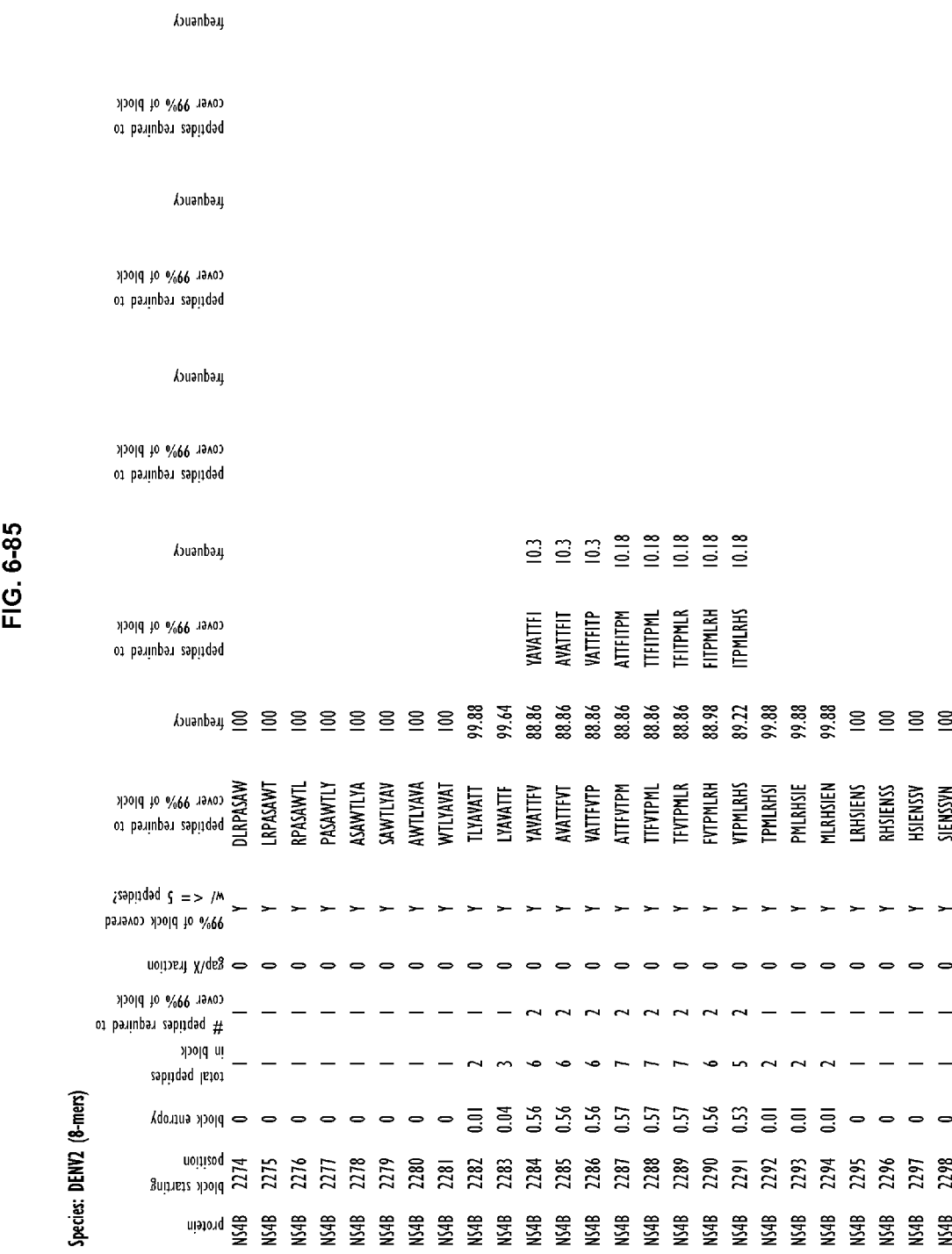
Figures 6, 86:
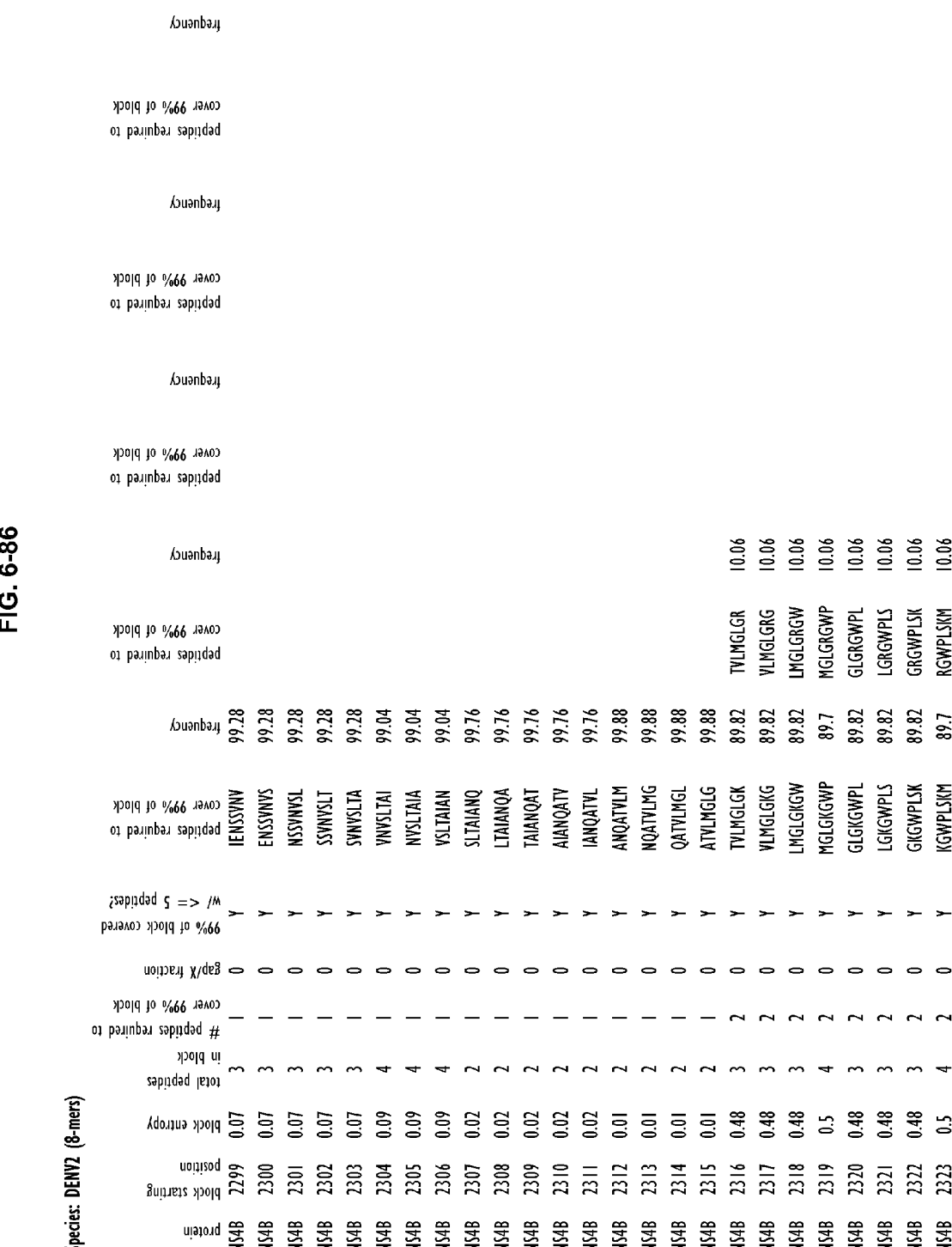
Figures 6, 87:
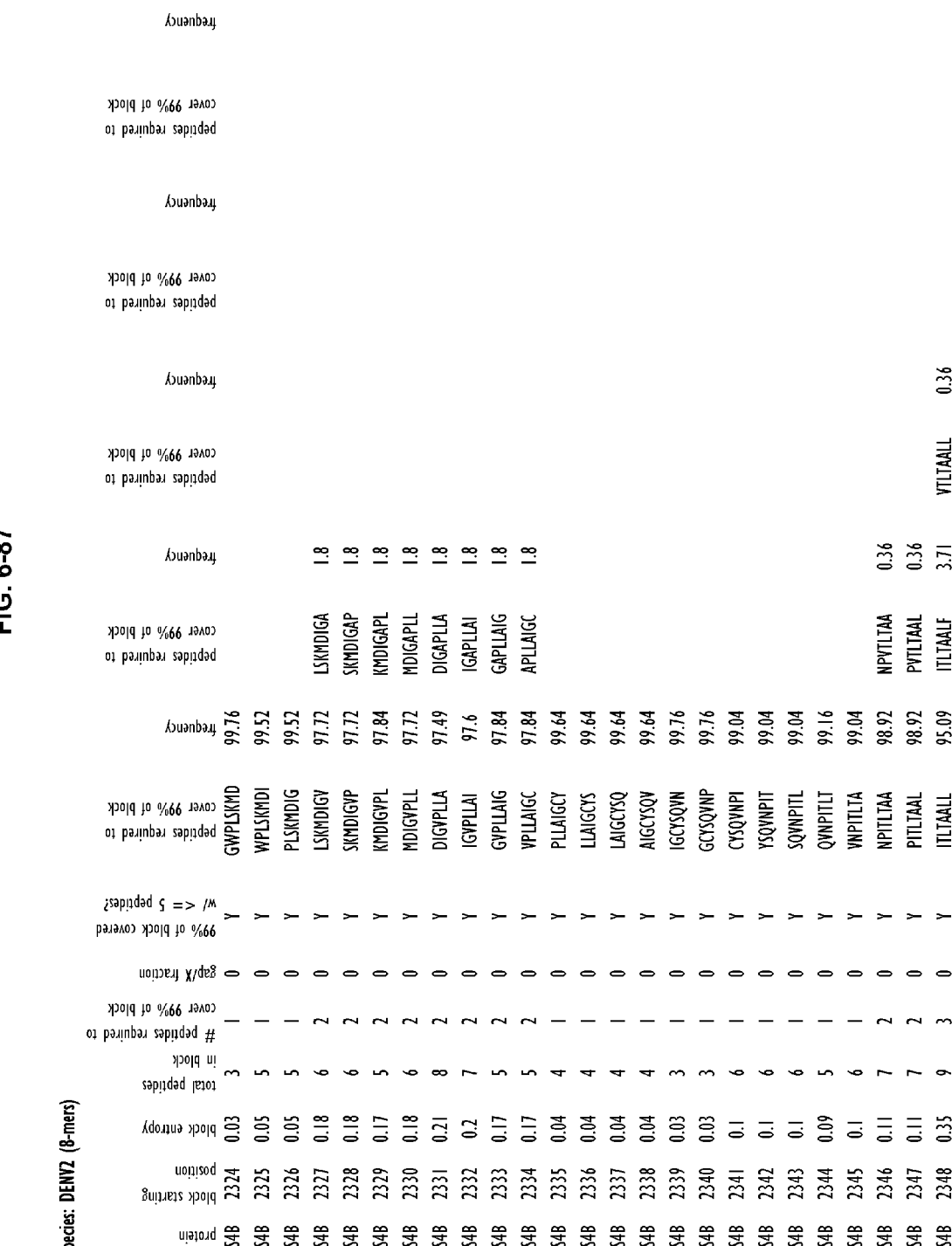
Figures 6, 90:
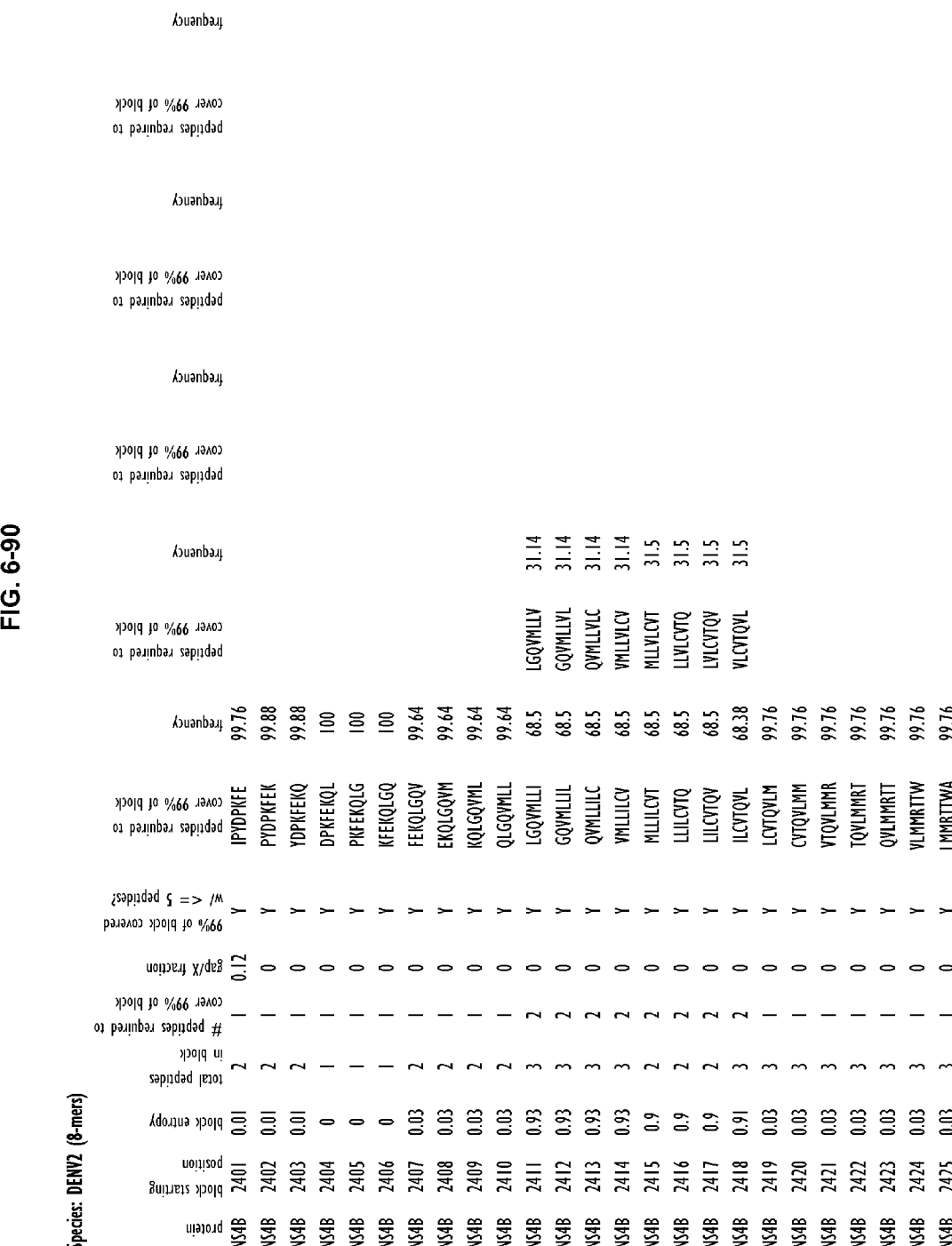
Figures 6, 92:
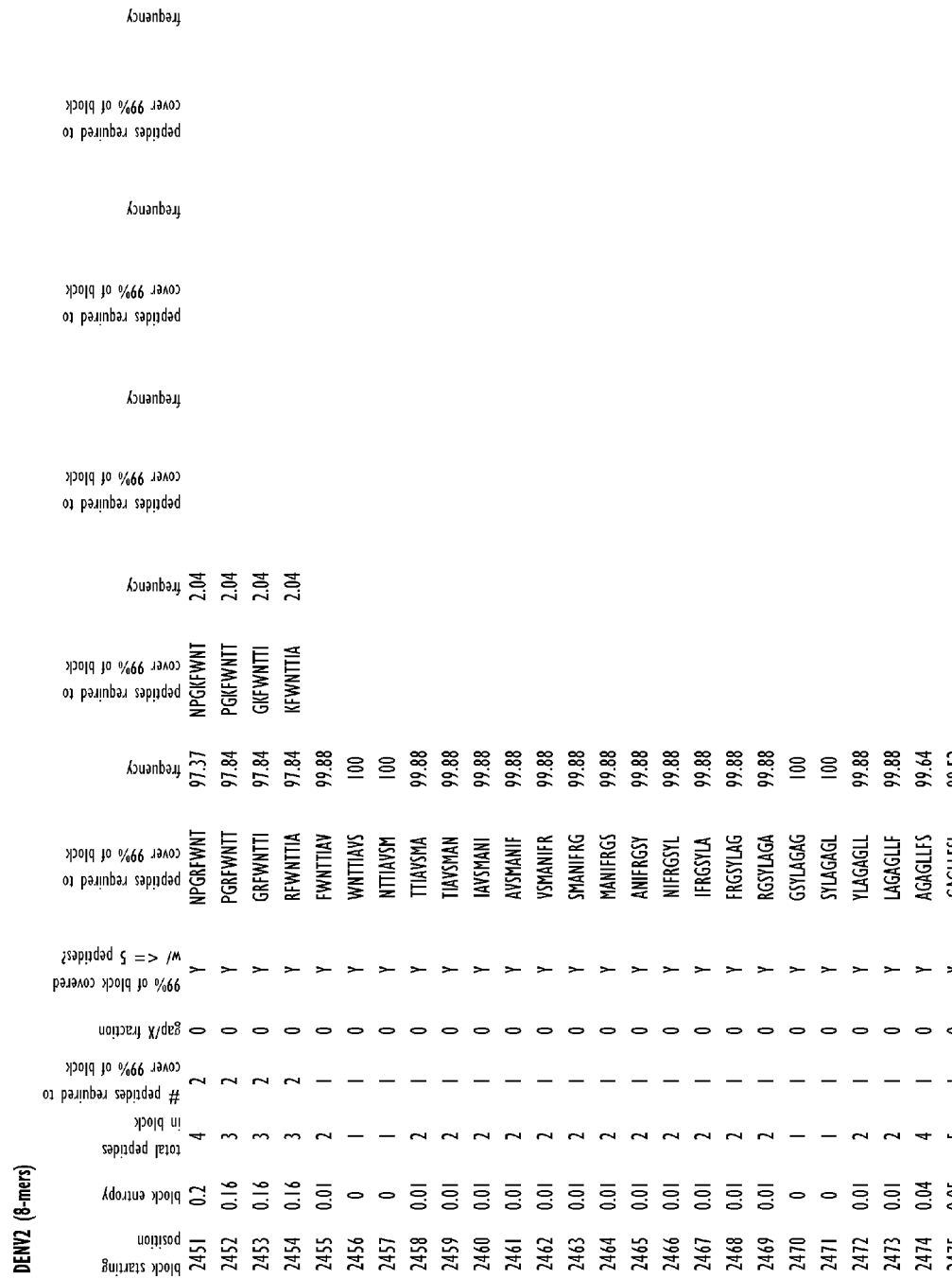
Figures 6, 99:
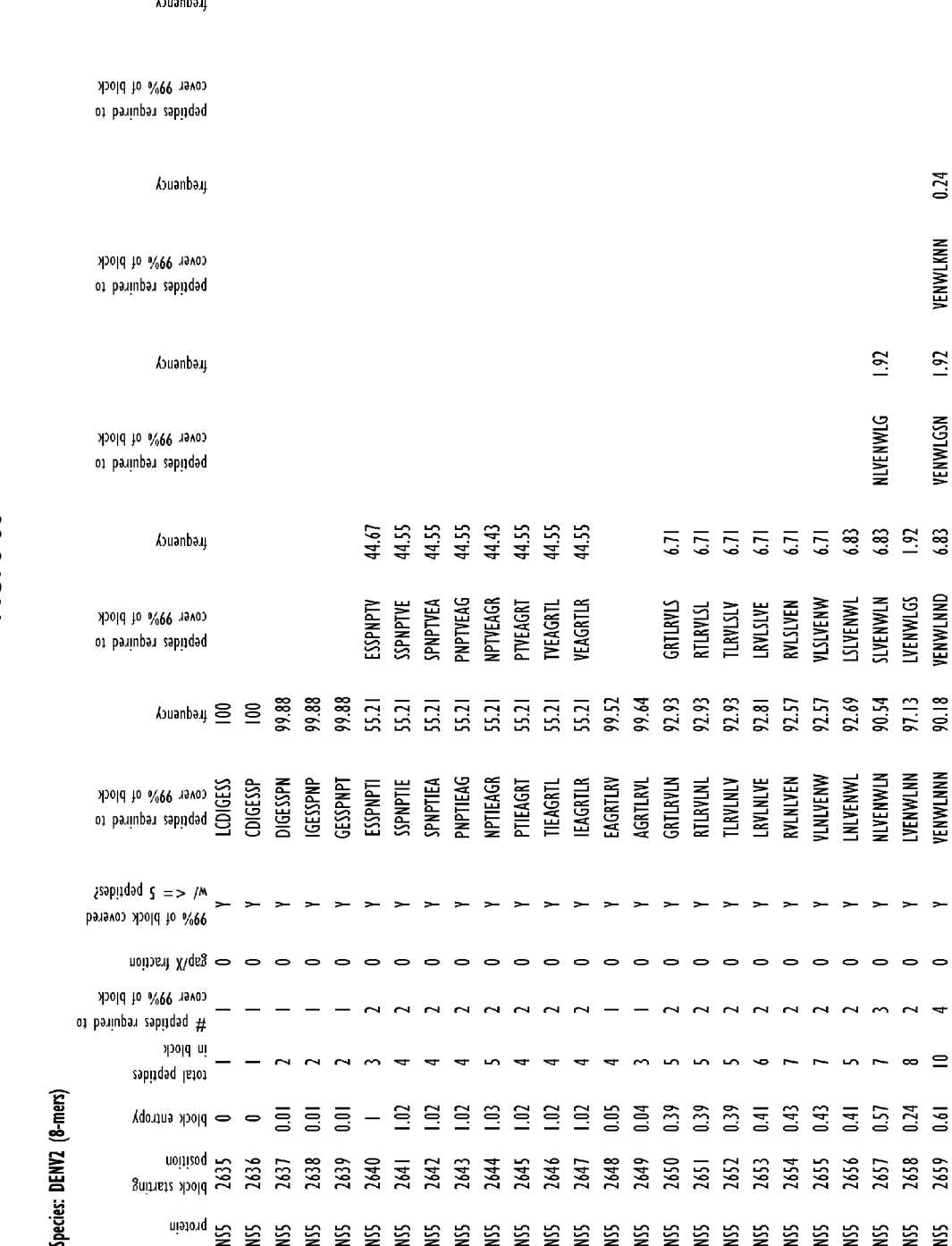
Figures 6, 101:
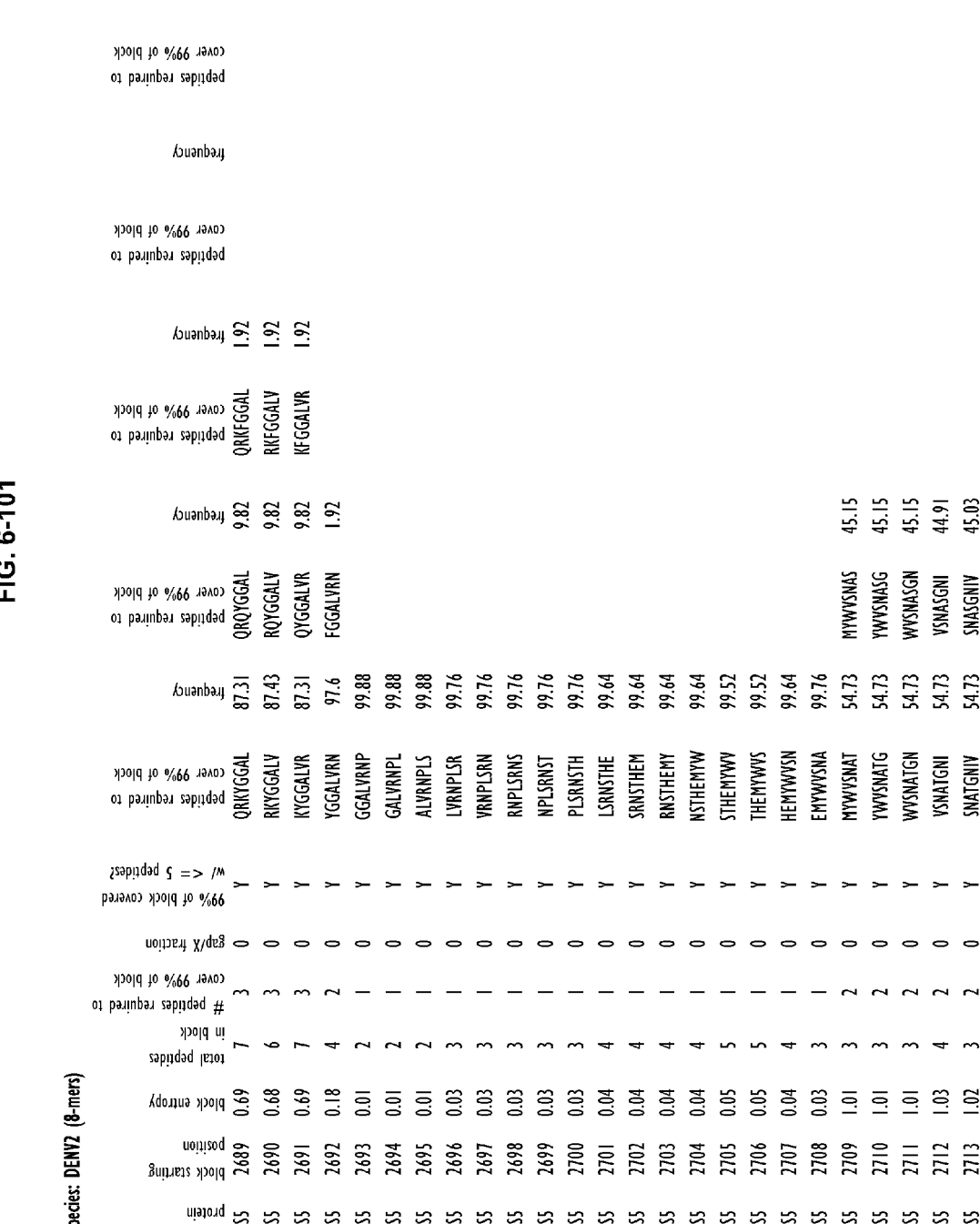
Figures 6, 105:
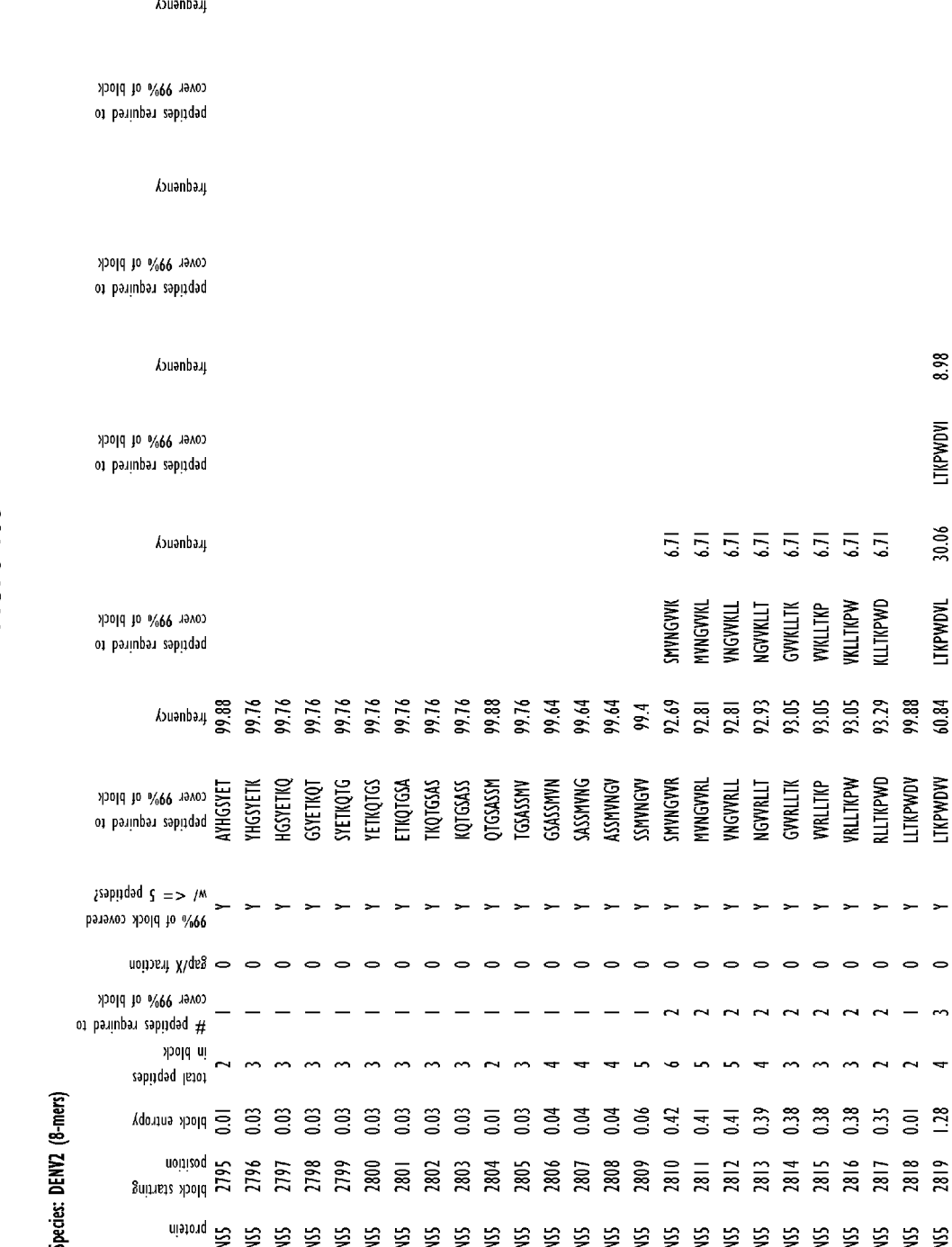
Figures 6, 107:
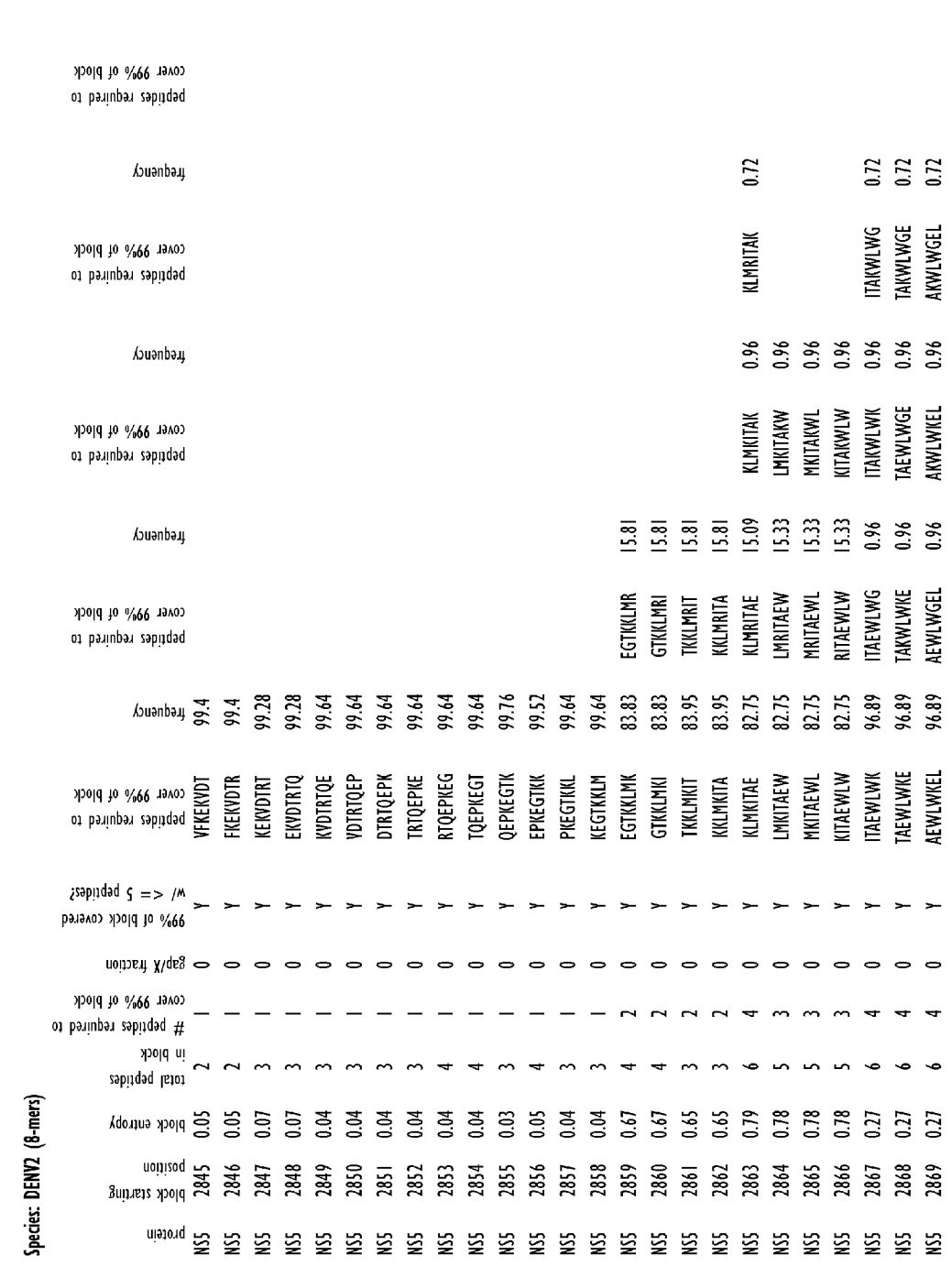
Figures 6, 112:
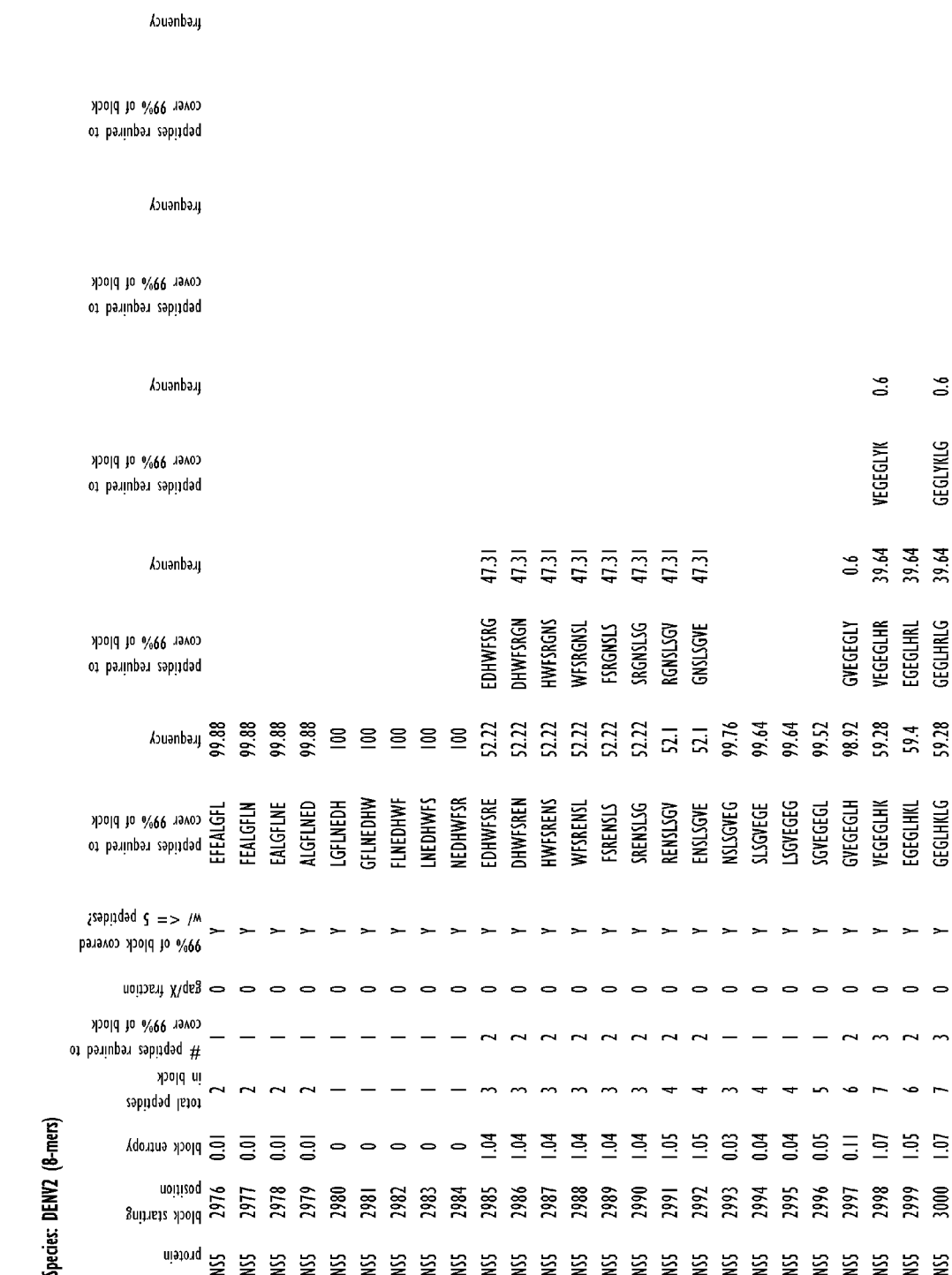
Figures 6, 121:
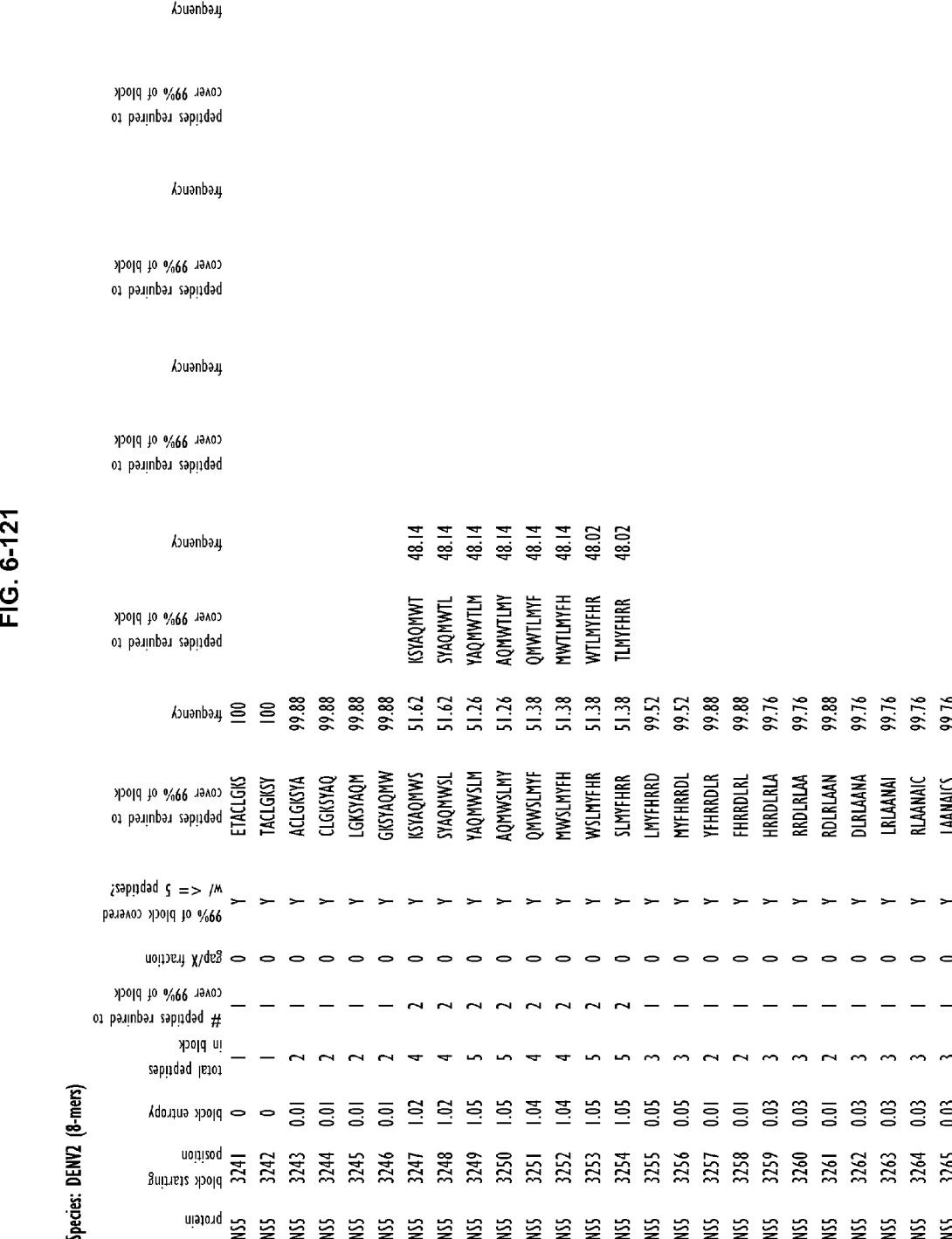
Figures 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48:
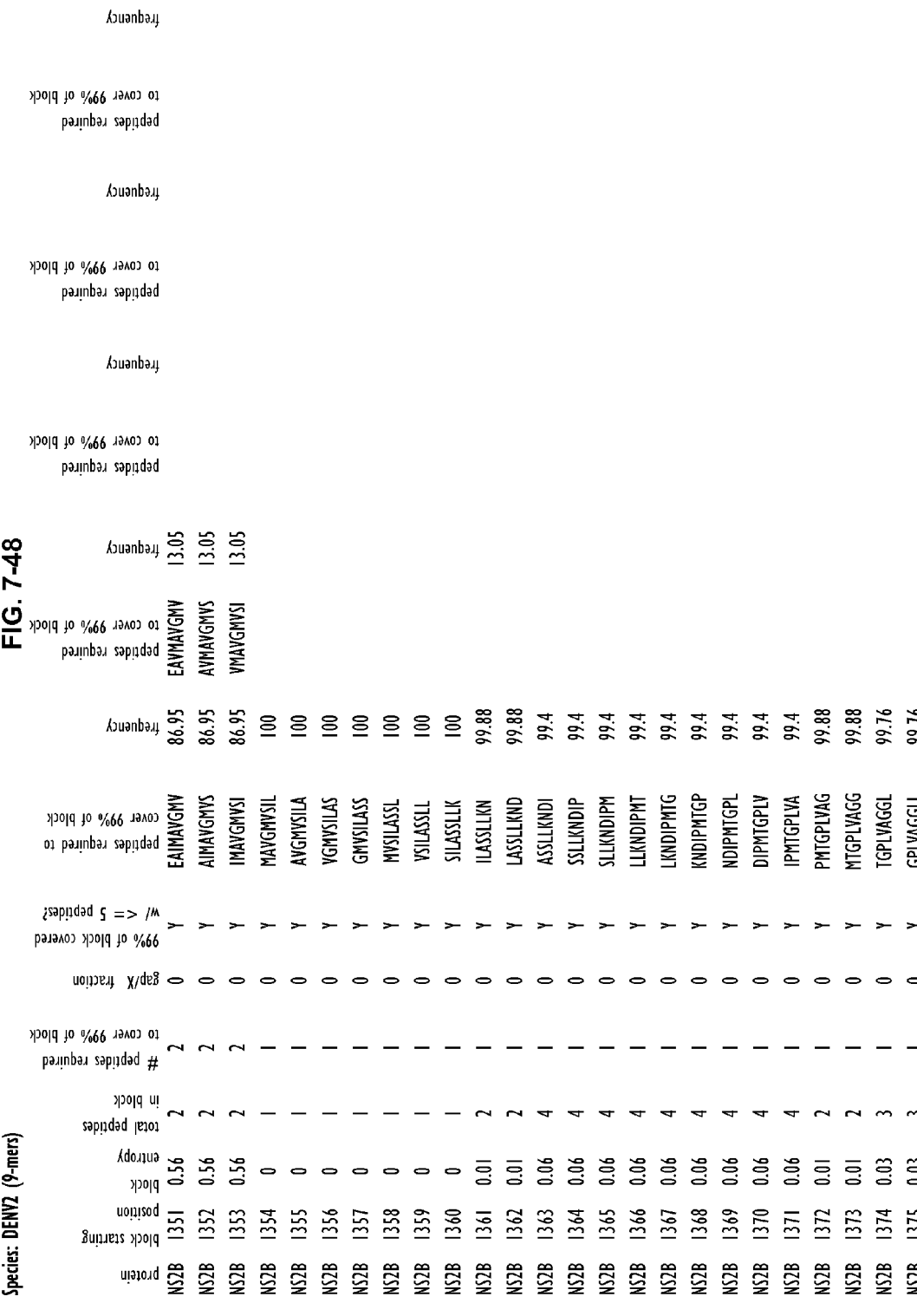
Figures 1, 8:
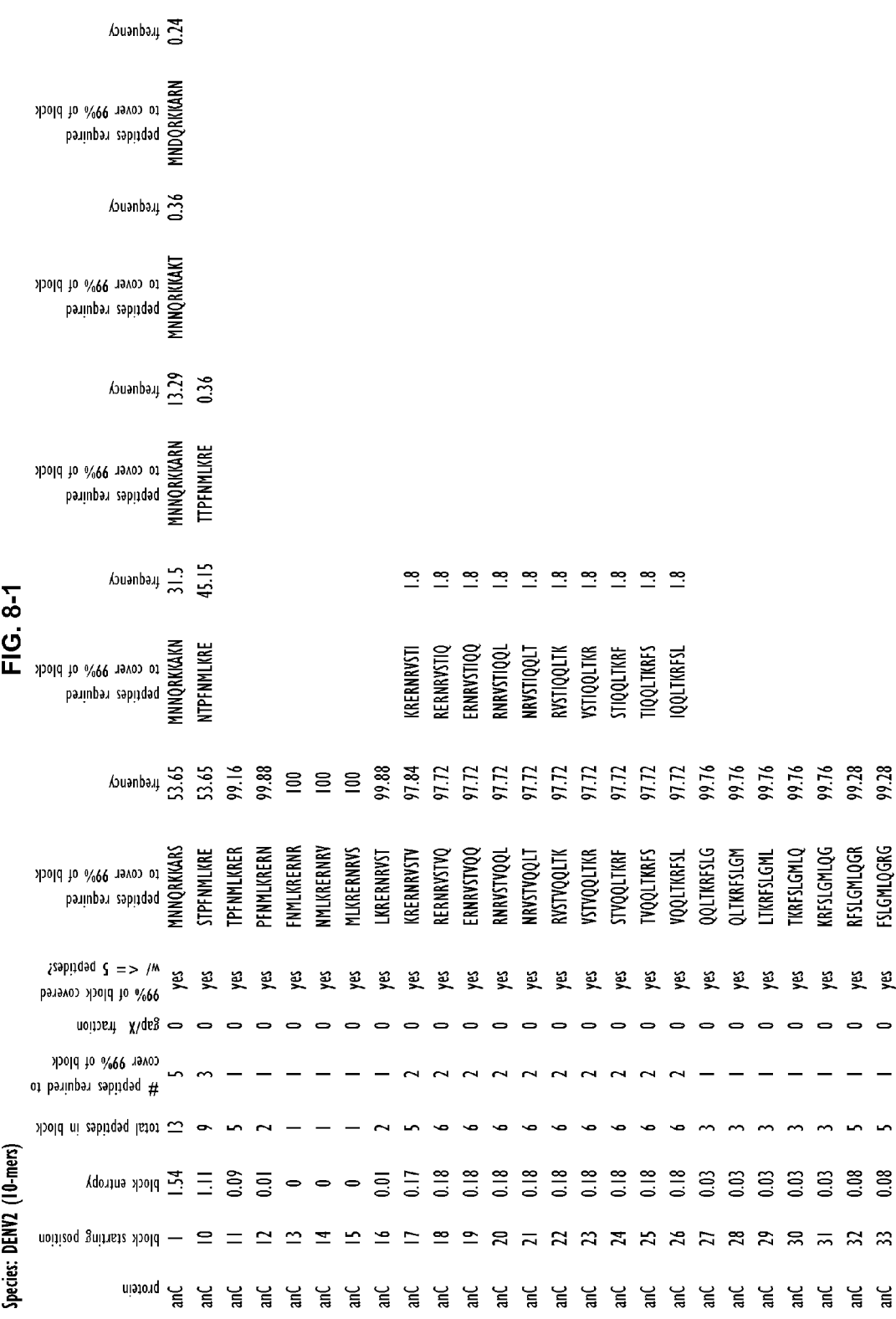
Figures 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38:
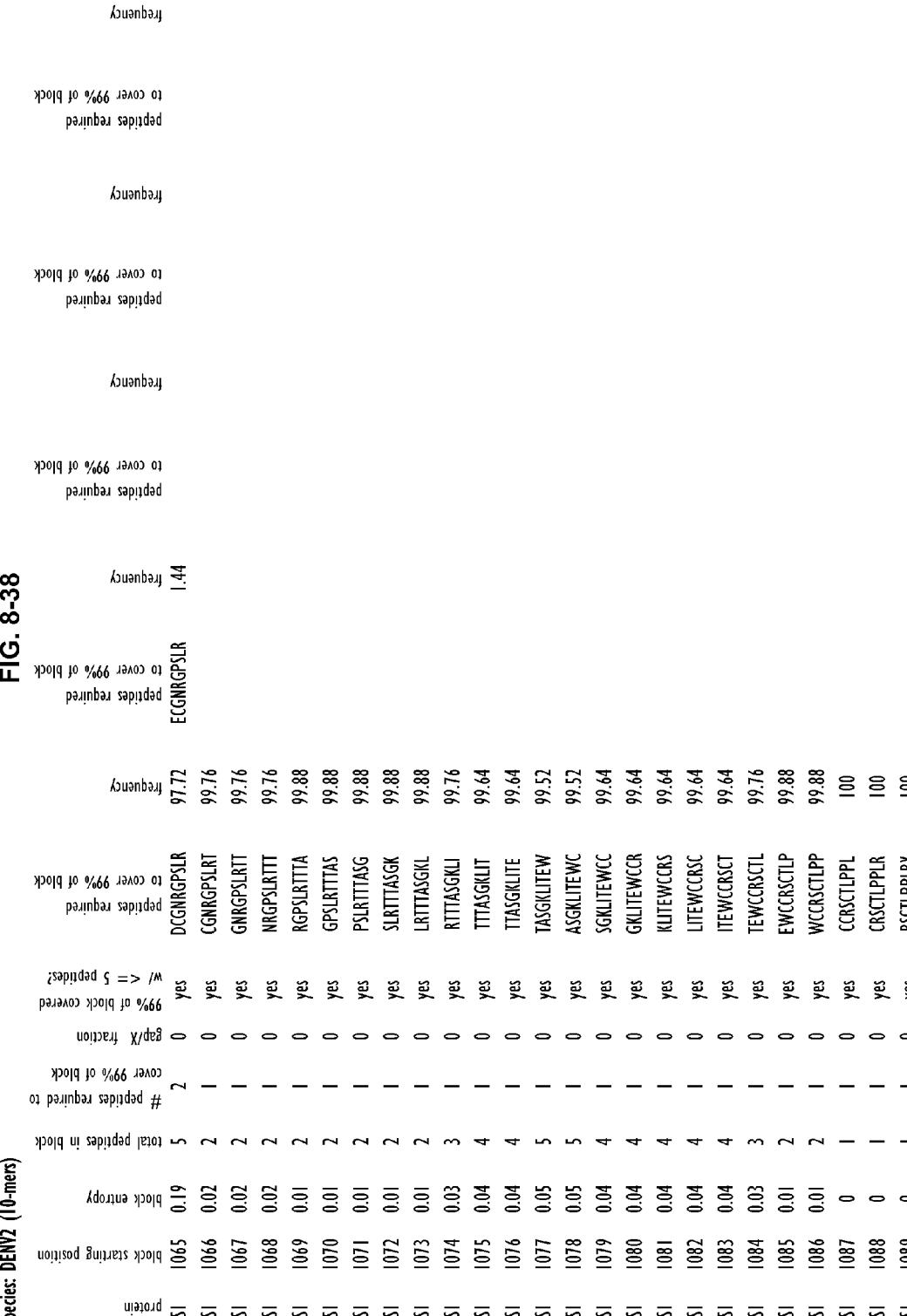
Figures 8, 60:
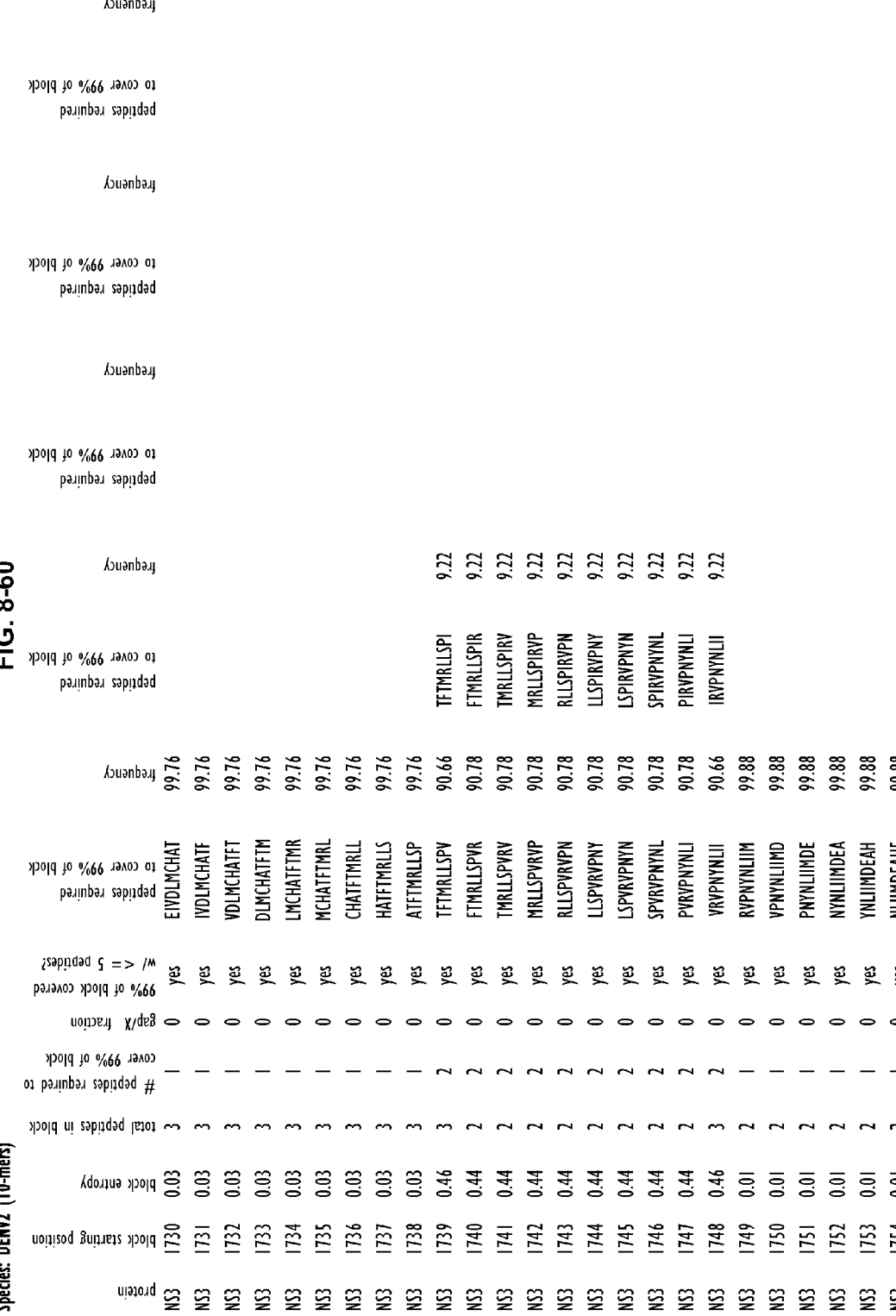
Figures 8, 69:
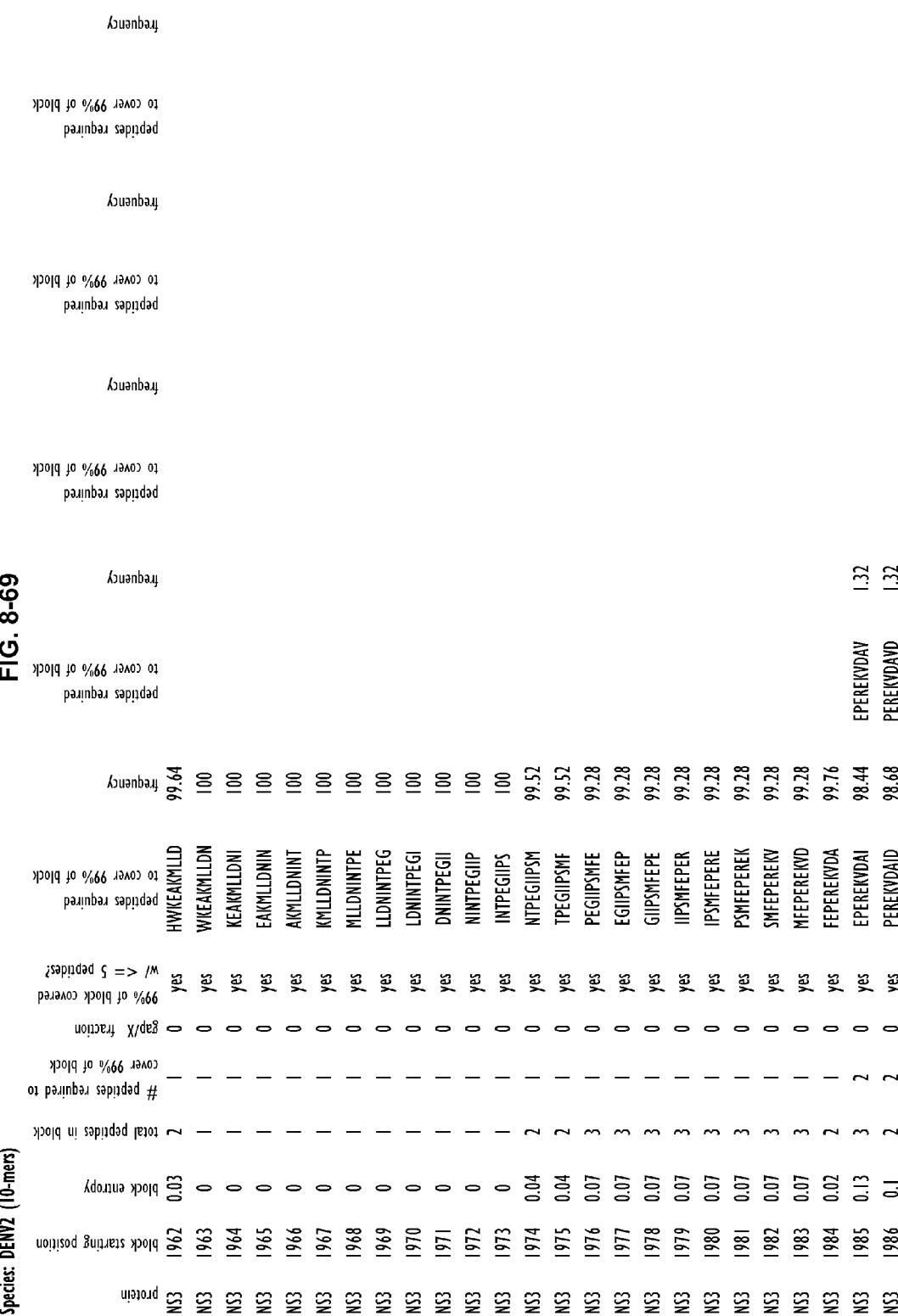
Figures 8, 80:
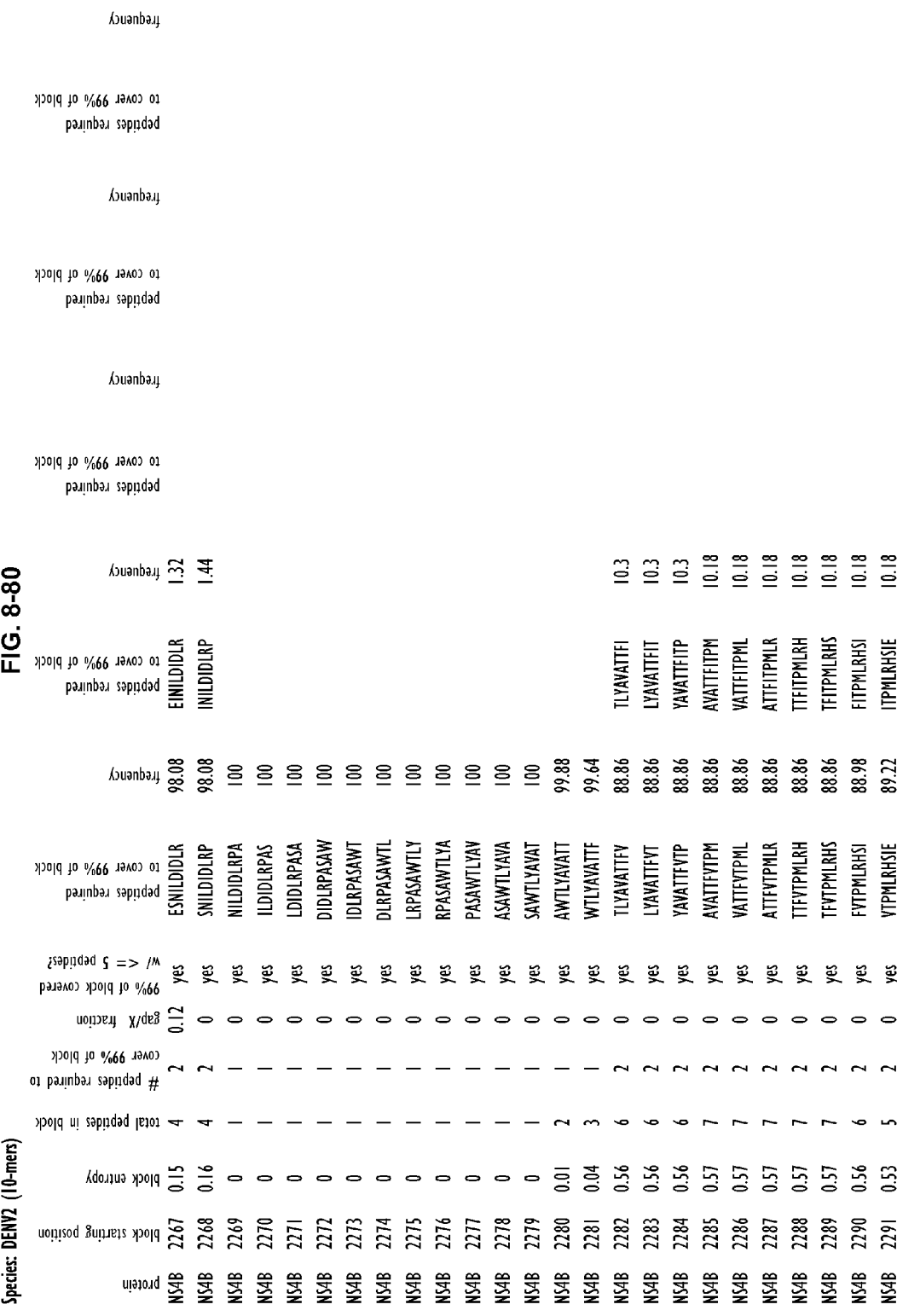
Figures 8, 81:
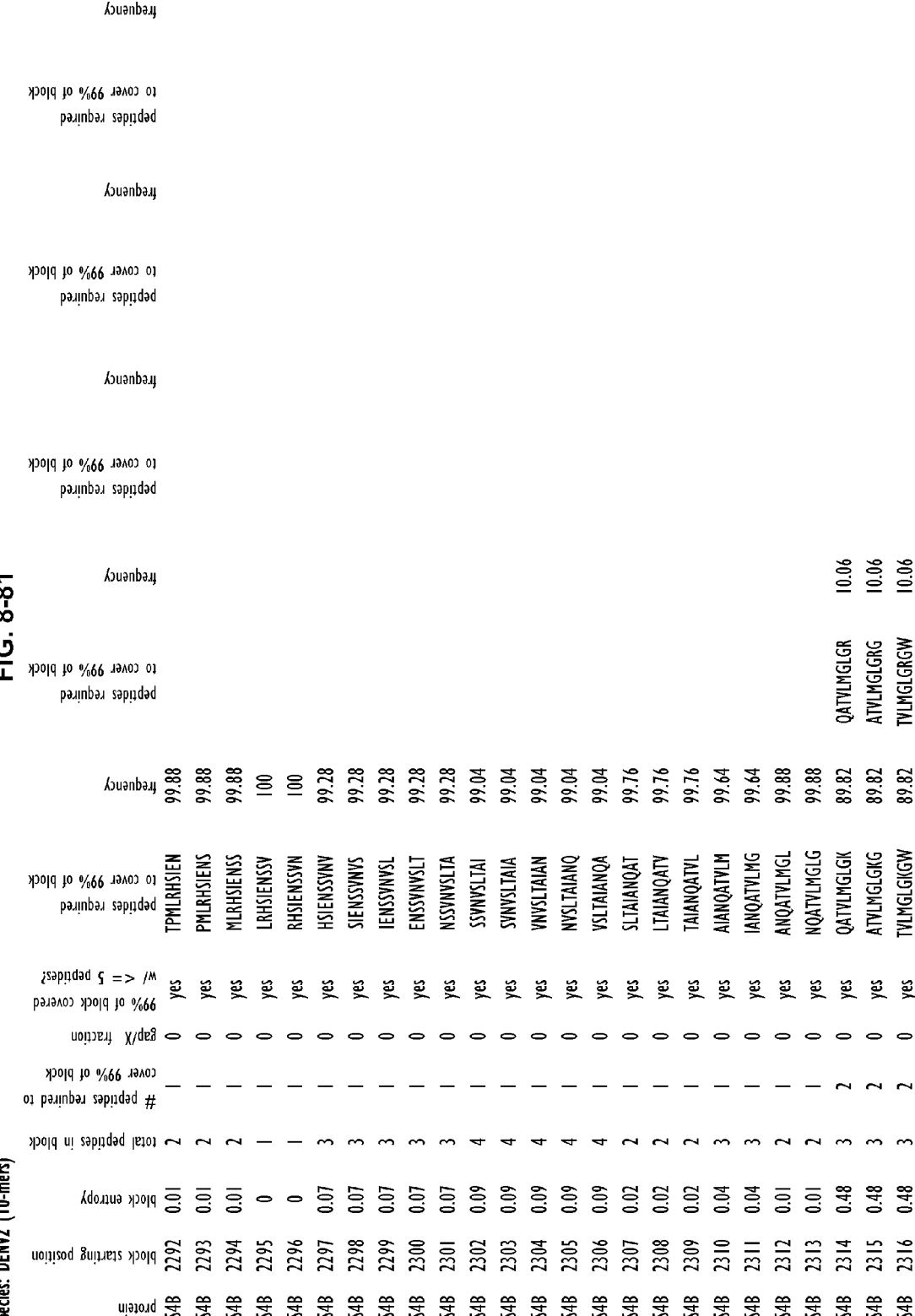
Figures 8, 96:
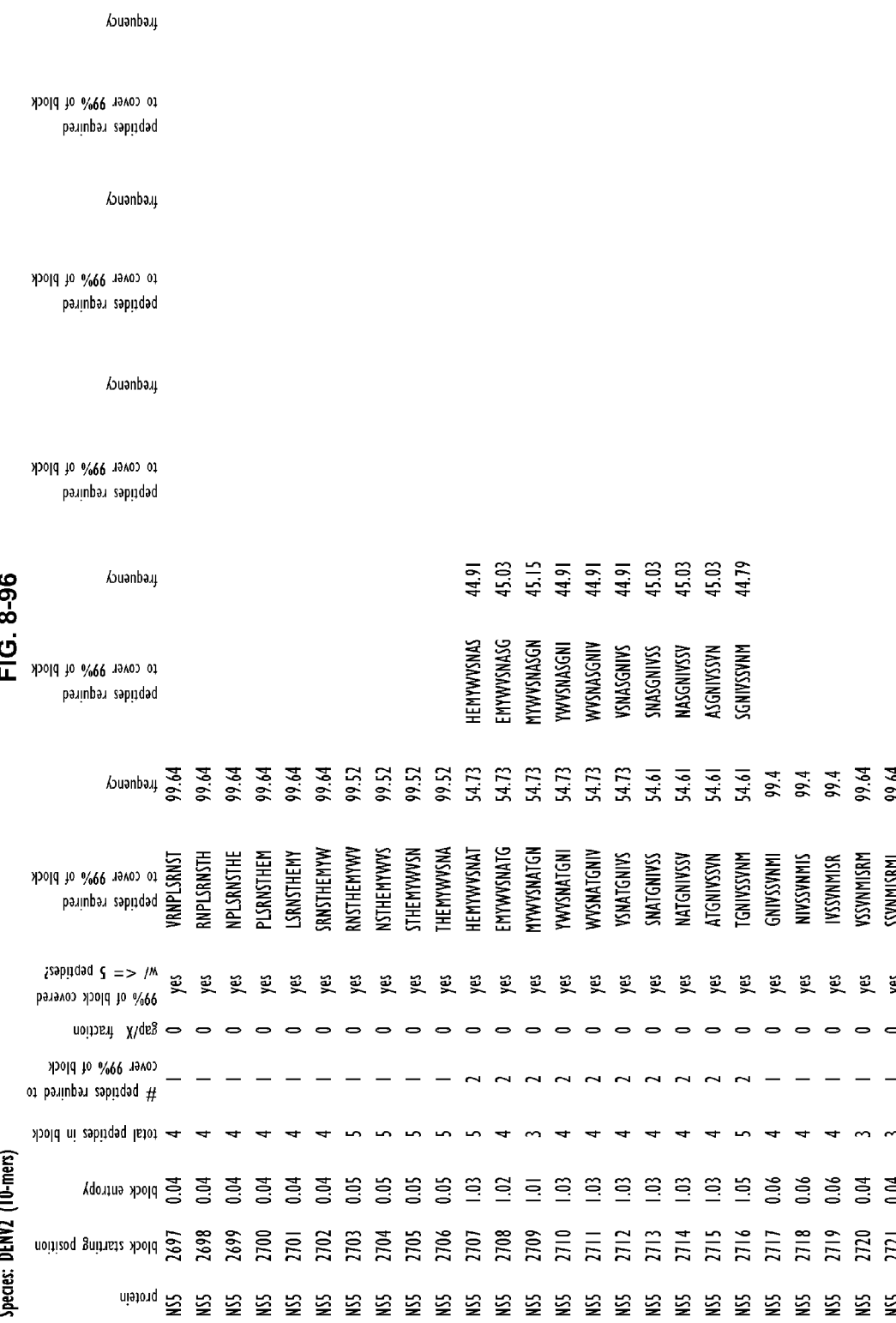
Figures 8, 106:
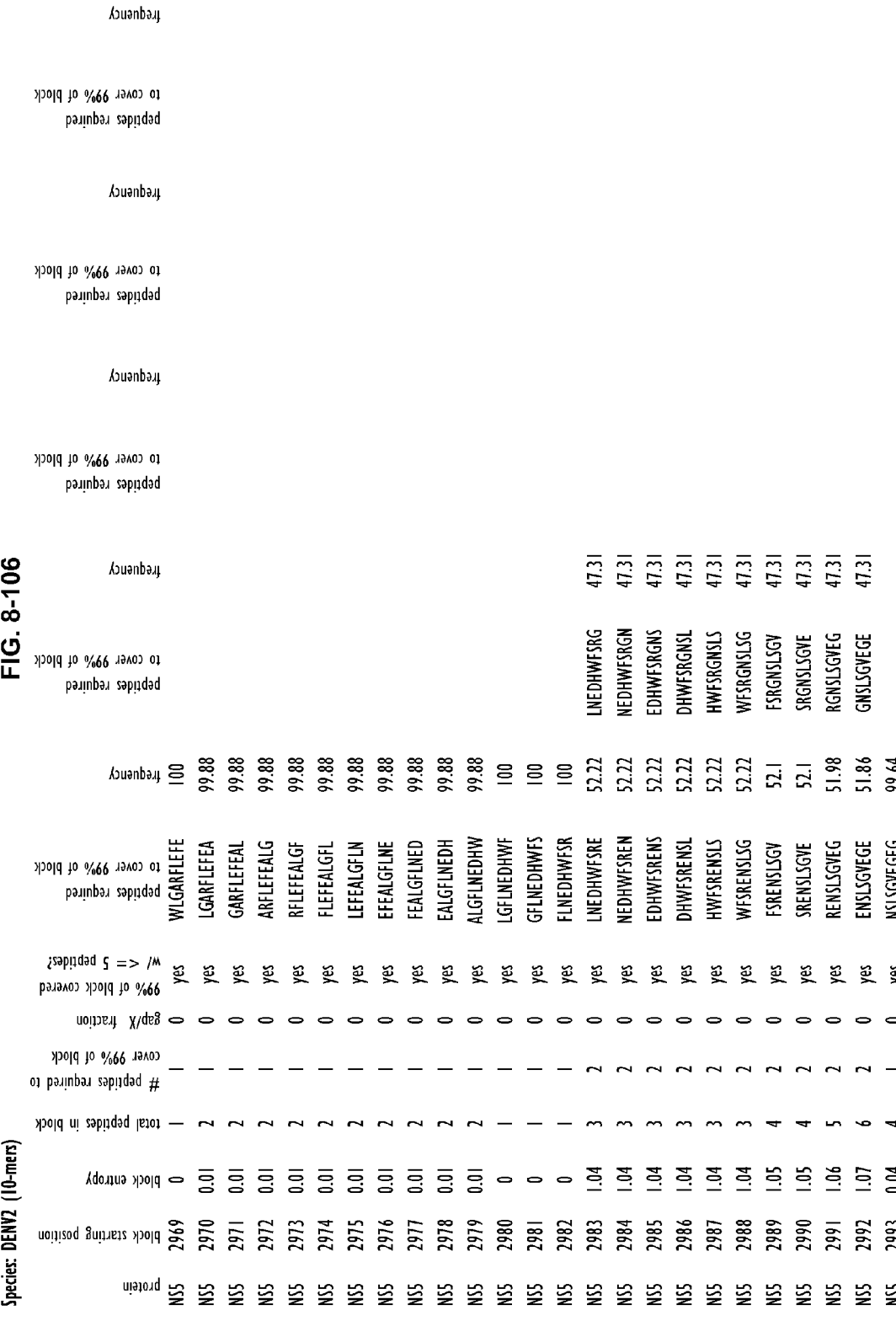
Figures 9, 98:
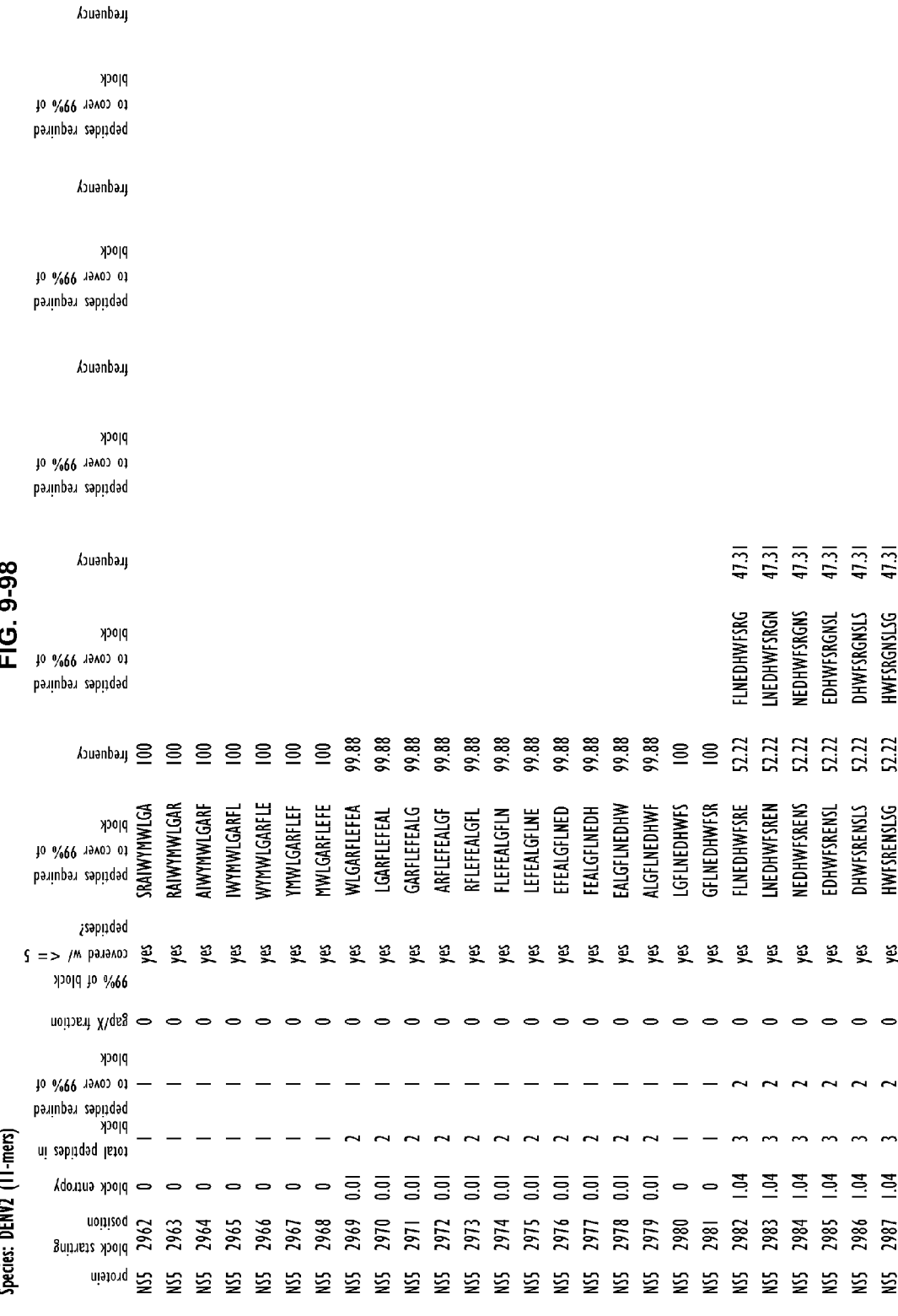

Polypeptide sequences for use in an MSA according to the methods described herein may be obtained from any suitable database or source. For example, known amino acid sequences can be obtained for example and without limitation from GenBank®, Protein Information Resource (PIR), and Swiss-Prot. In the Examples, below, all polyprotein sequences were obtained from GenBank® and supplemented with data and information from Swissprot/Uniprot, when available. The GenBank® Accession numbers for polyprotein (polypeptide) sequences used in the MSAs described in the Examples, below, are shown in FIGS. 66-71. FIGS. 66-69 show the GenBank® Accession numbers for each polyprotein aligned in the DENV1 (FIG. 66), DENV2 (FIG. 67), DENV3 (FIG. 68) and DENV4 (FIG. 69) MSAs. FIG. 70 shows the GenBank® Accession numbers for each polyprotein (polypeptide) aligned in the panFlavi MSA or in the individual virus MSAs (e.g., DENV1, DENV-2, DENV-3, DENV-4, WNV, YFV, JEV, and TBEV).

In certain embodiments, the Shannon entropy (H(x)) of a peptide block is calculated. H stands for Shannon entropy measured in bits (binary digits) and is given by the following formula:

$$H(x) = -\sum_{i=1}^{l} P_i(x)\log_2(P_i(x))$$

In the above formula, since $\log_2$ was used (variations of this formula use $\log_{10}$), the resulting value is given in units of "bits". In information theory, one bit is typically defined as the uncertainty of a binary random variable that is 0 or 1 with equal probability, or the information that is gained when the value of such a variable becomes known. As an example, 2 binary "questions" need to be asked in order to determine which nucleic acid (A, T, G or C) occurs at a given position in a DNA sequence. Specifically, Question 1 could be: Is it A or T? If the answer is no, Question 2 would be: Is it G? Depending on the answer to Q2, it can be determined which nucleotide is present at the given position. Hence, the maximum information content (Shannon entropy) on a position in a DNA sequence is 2. For amino acid sequences, the maximum information content is 4.32 bits (corresponding to an equal distribution of all 20 amino acids).

When calculating the entropy of individual residues (i.e., using traditional approaches), an entropy value >1 indicates a highly variable position [see, Koo QY, et al: Conservation and variability of West Nile virus proteins. PLoS One 2009, 4:e5352]. In the present Examples, the average entropy for blocks of 9-mer peptides was 1.70 with a standard deviation of 0.71 (see, Example 2). Therefore, the concept of using peptide block conservation analysis to identify a broader range of conserved peptide epitopes may seem counterintuitive; since according to traditional methods, peptides with entropies of greater than 1 would be excluded (i.e. identified as not conserved). However, the instant methods do not exclude peptides based on the entropy calculation, and the criteria used in the instant methods to identify conserved epitopes based on conservation of whole peptides proved to be very robust against high entropies. As seen in FIG. 22C (Example 2), the number of unique peptides (i.e., unique peptide sequences) required to cover 99% of a block (i.e. to achieve a cumulative fraction of polypeptides in the MSA, by adding together each unique peptide's frequency within the polypeptides in the MSA, of at least 99%) of a block was stably lower than five for entropies of up to approximately 2. This indicates that the block conservation is less sensitive to entropy, thus making it possible to achieve high conservation at relatively high entropies, using the approach described herein.

Binding to MHC Class I and MHC Class II Molecules and Immune Function Conservation In certain embodiments, a method for designing an immunogenic peptide composition is provided, the method comprising: (a) predicting which peptides within at least one conserved peptide block identified according to the methods described above in a plurality of homologous polypeptides bind to a major histocompatibility (MHC) molecule; and (b) selecting one or more peptides predicted to bind to an MHC molecule in step (a) for use in the immunogenic peptide composition.

In a specific embodiment, a method for designing an immunogenic peptide composition is provided, the method comprising: (a) predicting which peptides within at least one conserved peptide block in a plurality of homologous polypeptides bind to a major histocompatibility (MHC) molecule; wherein the at least one conserved peptide block has been previously identified as conserved according to a method comprising: i) identifying blocks of peptides in three or more homologous polypeptides in a multiple sequence alignment (MSA), each peptide being 8-11 amino acids in length; (ii) for each block of peptides, determining a minimum required number of unique peptides in the block of peptides such that the cumulative fraction of homologous polypeptides in the MSA comprising (1) one or more of said unique peptides is at least 95 percent (%); and (iii) identifying a peptide block as conserved if said minimum required number of unique peptides determined in step (ii) is 7 or fewer; and (b) selecting one or more peptides predicted to bind to one or more MHC molecule in step (a) for use in the immunogenic peptide composition.

In certain embodiments, a peptide selected in step (b) above binds to an MHC class I or MHC class II molecule. In some embodiments, the one or more peptides selected in step (b) bind to the same MHC molecule and, optionally, bind to the MHC molecule with the same or similar binding affinity.

In certain embodiments, the methods for designing an immunogenic peptide composition described above further comprise: step (c) testing the one or more peptides selected in step (b) in an MHC binding assay, wherein one or more peptides determined to bind to an MHC molecule in the assay are selected for use in the immunogenic peptide composition.

Thus, in a specific embodiment, a method for designing an immunogenic peptide composition is provided, the method comprising: (a) predicting which peptides within at least one conserved peptide block identified according to the methods described above in a plurality of homologous polypeptides bind to a major histocompatibility (MHC) molecule; (b) selecting one or more peptides predicted to bind to an MHC molecule in step (a) for use in the immunogenic peptide composition; and (c) testing the one or more peptides selected in step (b) in an MHC binding assay, wherein one or more peptides determined to bind to an MHC molecule in the assay are selected for use in the immunogenic peptide composition.

In yet another specific embodiment, a method for designing an immunogenic peptide composition is provided, the method comprising: (a) predicting which peptides within at least one conserved peptide block in a plurality of homologous polypeptides bind to a major histocompatibility (MHC) molecule; wherein the at least one conserved peptide block was previously identified as conserved according to the method comprising: i) identifying blocks of peptides in three or more homologous polypeptides in a multiple sequence alignment (MSA), each peptide being 8-11 amino acids in length; (ii) for each block of peptides, determining a minimum required number of unique peptides in the block of peptides such that the cumulative fraction of homologous polypeptides in the MSA comprising (1) one or more of said unique peptides is at least 95 percent (%); and (iii) identifying a peptide block as conserved if said minimum required number of unique peptides determined in step (ii) is 7 or fewer; (b) selecting one or more peptides predicted to bind to an MHC molecule in step (a) for use in the immunogenic peptide composition; and (c) testing the one or more peptides selected in step (b) in an MHC binding assay, wherein one or more peptides determined to bind to an MHC molecule in the assay are selected for use in the immunogenic peptide composition.

In certain embodiments, a peptide selected in step (c) in the methods described above binds to an MHC class I and/or class II molecule. In certain embodiments, the WIC molecules is an HLA molecule (human MHC molecule).

In still another embodiment, a method for designing an immunogenic peptide composition is provided, the method comprising: (a) determining which peptides within at least one conserved peptide block identified according to the methods described herein bind to a major histocompatibility (MHC) molecule using an MHC binding assay; and (b) selecting one or more peptides determined to bind to an MHC molecule in step (b) for use in the immunogenic peptide composition.

In a specific embodiment, a method for designing an immunogenic peptide composition is provided, the method comprising: (a) determining which peptides within at least one conserved peptide block bind to a major histocompatibility (MHC) molecule using an MHC binding assay; wherein the at least one conserved peptide block was previously identified as conserved according to the method comprising: i) identifying blocks of peptides in three or more homologous polypeptides in a multiple sequence alignment (MSA), each peptide being 8-11 amino acids in length; (ii) for each block of peptides, determining a minimum required number of unique peptides in the block of peptides such that the cumulative fraction of homologous polypeptides in the MSA comprising (1) one or more of said unique peptides is at least 95 percent (%); and (iii) identifying a peptide block as conserved if said minimum required number of unique peptides determined in step (ii) is 7 or fewer; and (b) selecting one or more peptides determined to bind to one or more MHC molecule in step (b) for use in the immunogenic peptide composition.

In certain embodiments, it is preferable that the cumulative fraction in the above described methods for designing an immunogenic peptide composition is at least 90%, at least 91%, at least 92%, at least 93%, at least 94%, at least 95%, at least 96%, at least 97%, at least 98%, at least 99%, or greater. In a preferred embodiment, the cumulative fraction is at least 95% or greater. Further, in some embodiments, the minimum required number of unique peptides in a block of conserved peptides is 10 or fewer, 9 or fewer, 8 or fewer, 7 or fewer, 6 or fewer, 5 or fewer, 4 or fewer, or 3 or fewer. Preferably, the minimum required number of unique peptides in a block of conserved peptides is 7 or fewer, more preferably 6 or fewer, and still more preferably 5 or fewer, or 4 or fewer. In certain embodiments, each peptide in a peptide block can have a length of anywhere from about 5 to about 15 amino acid residues, although fewer or greater numbers of residues are also possible. For example, each peptide in a peptide block can have a length of about 5, 6, 7, 8, 9, 10, 11, 12, 13, 14, 15 or more residues. Preferably, a peptide in a peptide block has a length of about 8, 9, 10, or 11 residues.

The ability to bind to an MHC molecule, and preferably with high affinity, is an important feature of an immunogenic peptide, since peptides are presented to T cells as peptide/MHC complexes on antigen presenting cells in order to induce an immune response. Peptides that bind to class I MHC molecules are presented to CD8 T cells and peptides that bind to class II MHC molecules are presented to CD4 T cells. Typically, a particular peptide sequence will be restricted to either MHC class I or class II. In the present invention, immunologically relevant conserved peptide epitopes are identified (i.e., peptides that are predicted and/or determined to bind to MHC molecules). Typically, peptides that bind to MHC class I molecules range in length from about 8 to about 11 amino acid residues. Because the antigen-binding groove of MHC class II molecules is open at both ends, peptides can extend beyond the binding groove and are typically longer, about 15-25 residues; however, peptide binding to the MHC class II molecule is determined by a shorter, "core sequence" ranging in length from about 9 to about 10 amino acids thus, the conserved peptide epitopes identified herein, ranging in length from 8 to 11 amino acid can bind to MHC class I molecules and can also represent the core peptide sequence of MHC class II binders.

In certain embodiments, peptide epitopes selected for, e.g., use in an immunogenic composition, are determined to be "immunofunctionally conserved" when peptides in a conserved block bind to MHC with similar affinity and share HLA restriction. The term "similar affinity" means that both peptides are capable of being recognized by T cells in an MHC restricted manner. Typically but not always, peptides that have a binding affinity to a particular MHC molecule of <500 nM will be considered to have similar binding affinity. As demonstrated in Example 2, below, 1,732, 1,551, 1,394, and 1,245 conserved blocks of 8, 9, 10, and 11-meric DENV-1 peptides respectively, were identified using the methods provided herein, as opposed to the results obtained using traditional criteria for conservation (i.e., conservation of individual amino acids, which yielded only 206, 165, 118, and 88 conserved 8, 9, 10, and 11-meric peptides respectively (see, Khan A M, et al. (2008) Conservation and Variability of Dengue Virus Proteins: Implications for Vaccine Design. PLoS Negl Trop Dis 2(8): e272. doi:10.1371/journal.pntd.0000272)). Out of the 1,551 blocks of 9-mer peptides, 110 blocks consisting of 333 peptides were predicted to be immunofunctionally conserved, based on their predicted binding affinity to MHC class I (see, FIG. 48).

Typically, algorithms are used to determine the "binding threshold" of peptides to select those with scores that give them a high probability of binding at a certain affinity and will be immunogenic. The algorithms are based either on the effects on MHC binding of a particular amino acid at a particular position, the effects on antibody binding of a particular amino acid at a particular position, or the effects on binding of a particular substitution in a motif-containing peptide. Immunogenic peptides can also be identified by measuring their binding to a specific MHC protein (e.g. HLA-A02.01) and by their ability to stimulate CD4 and/or CD8 when presented in the context of the MHC protein. MHC class I binding affinity of peptides can be predicted using computer software, such as, e.g., NetMHC 3.2 (see, Examples 1 and 5). For example, as described in Example 5, binding affinity to HLA class I was predicted for peptides of 9 residues long for the following HLA alleles: HLA-A*0201, HLA-A*0301, HLA-A*1101, HLA-A*2402, HLA-B*0702, HLA-B*0801, HLA-B*1501. NetMHC achieves highly accurate prediction of 9-mer binding affinity for those alleles [see, Lin H H, Ray S, Tongchusak S, Reinherz E L, Brusic V: Evaluation of MHC class I peptide binding prediction servers: applications for vaccine research. *BMC Immunol* 2008, 9:8]. The default thresholds for binding level (affinity ($IC_{50}$) >50 nM and <500 nM for weak binders and <50 nM for strong binders) were used for binding classification in this study. Thus, a minimum binding affinity of 500 nM was required for a peptide to be considered a binder.

The software MULTIPRED2 can also be used to predict peptide binding to MHC class I and class II molecules. Specifically, MULTIPRED2 is a computational system for facile prediction of peptide binding to multiple alleles belonging to human leukocyte antigen (HLA) class I and class II DR molecules. It enables prediction of peptide binding to products of individual HLA alleles, combination of alleles, or HLA supertypes. NetMHCpan and NetMHCIIpan are used as prediction engines. The 13 HLA Class I supertypes are A1, A2, A3, A24, B7, B8, B27, B44, B58, B62, C1, and C4. The 13 HLA Class II DR supertypes are DR1, DR3, DR4, DR6, DR7, DR8, DR9, DR11, DR12, DR13, DR14, DR15, and DR16. In total, MULTIPRED2 enables prediction of peptide binding to 1077 variants representing 26 HLA supertypes [see, Zhang G L, et al.: MULTIPRED2: A computational system for large-scale identification of peptides predicted to bind to HLA supertypes and alleles. J Immunol Methods 2010; see also, Nielsen M, Lundegaard C, Lund O (2007) Prediction of MHC class II binding affinity using SMM-align, a novel stabilization matrix alignment method. BMC Bioinformatics 8: 238; Rajapakse M, Schmidt B, Feng L, Brusic V (2007) Predicting peptides binding to MHC class II molecules using multi-objective evolutionary algorithms. BMC Bioinformatics 8: 459; EL-Manzalawy Y, Dobbs D, Honavar V (2008) On Evaluating MHC-II Binding Peptide Prediction Methods. PLoS ONE 3(9): e3268. doi:10.1371/journal.pone.0003268.]

Binding to MHC class I and MHC class II molecules can be tested using various binding assays. For in vitro detection of MHC class I binding, a T2 peptide binding assay may be used. MHC class I antigen presentation and cell surface expression depend primarily on peptide transport into the ER/Golgi by the transporter associated with antigen transport (TAP). T2 cell lines are deficient in TAP but still express low amounts of MHC class I on the surface of the cells. The T2 binding assay is based upon the ability of peptides to stabilize the MHC class I complex on the surface of the T2 cell line. Briefly, T2 cells are incubated with a specific peptide, then stabilized MHC class I complex is detected using a pan-HLA class I antibody, and analysis is carried out by flow cytometry and binding is assessed in relation to a non-binding negative control.

Competitive binding assays may also be used to quantitate peptide binding affinity to MHC molecules. In such assays, which are well known in the art, the half maximal inhibitory concentration ($IC_{50}$), which is a measure of the effectiveness of a compound in inhibiting biological or biochemical function, is determined. This quantitative measure indicates how much of a particular drug or other substance (e.g., peptide) is needed to inhibit a given biological process (or component of a process, e.g., peptide binding to an MHC molecule) by half. In other words, it is the half maximal (50%) inhibitory concentration (IC) of a substance (50% IC, or $IC_{50}$).

To perform the assay, a single concentration of radioligand (e.g., radiolabeled peptide) is used in every assay tube. The radioligand is used at a low concentration, usually at or below its IQ value. The level of specific binding to an MHC molecule (e.g., expressed on a cell engineered to express a certain MHC molecule on its surface) of the radioligand is then determined in the presence of a range of concentrations of competing non-radioactive compounds (unlabeled peptides), in order to measure the potency with which the radiolabeled and unlabeled peptides compete for the binding of the radioligand. Competition curves may also be computer-fitted to a logistic function. In this situation the $IC_{50}$ is the concentration of competing ligand (unlabeled peptide) which displaces 50% of the specific binding of the radioligand. In the Examples described below, a peptide can be determined to bind to a certain MHC molecule if it has an $IC_{50}$ of 500 nM or less. A peptide is considered to be a weak binder if the $IC_{50}$ value is >50 nM and <500 nM, and a strong binder if the $IC_{50}$ value is <50 nM. It is to be understood that labels other than radiolabels can be used to label a ligand in the competitive binding assay and one of skill in the art would know how to modify this assay to use another suitable label (e.g., fluorescent label or other).

Commercial assays for quantitating peptide binding to MHC class I and/or class II molecules are also available. For example, peptide binding to MHC class I can be quantitated using the iTopia™—epitope discovery assay from Beckman Coulter [see, Wulf et al. "Identification of Human MHC Class I Binding Peptides using the iTOPIA™—Epitope Discovery System"; pp. 361-367; Ulrich Reineke and Mike Schutkowski (eds.), Methods in Molecular Biology, Epitope Mapping Protocols, vol. 524 © Humana Press, a part of Springer Science+Business Media, LLC 2009]. Briefly, the assay is an affinity assay that allows for the identification and mapping of MHC class I epitopes. This particular assay is useful for peptides that range from 8-10 amino acids in length. Peptide binding to MHC class I can also be quantitated using the ProImmune Class I REVEAL & ProVE® Rapid Epitope Discovery System (ProImmune, Sarasota, Fla.), and MHC class II binding can be quantitated using the ProImmune REVEAL™ Class II Rapid Epitope Discovery System, which is a cell-free in vitro assay that can rapidly predict CD4+ T cell epitopes in any polypeptide sequence. Similarly binding affinities of peptides to multiple MHC molecules can be identified using iTopia system (see Wulf M, Hoehn P, Trinder P. Identification of human MHC class I binding peptides using the iTOPIA—epitope discovery system. Methods Mol Biol. 2009; 524:361-7.

In certain embodiments, an MHC binding assay can be "approximated by a functional assay" for identification of immunogenicity. In other words, the ability of a peptide to bind to an MHC molecule can be determined indirectly by determining the immunogenicity of the peptides experimentally (i.e., if the peptide is immunogenic, it is capable of being presented to T cells in the context of an MHC molecule and therefore necessarily binds to an MHC molecule). For example, in one embodiment, ex vivo T-cell activation assays are used to experimentally quantitate immunogenicity. In this method, antigen presenting cells (APCs) and naive T cells from matched donors are challenged with a peptide or peptide string or other composition comprising peptide(s) of interest one or more times. Then, T cell activation can be detected using a number of methods, for example by monitoring production of cytokines or measuring uptake of tritiated thymidine. In one embodiment, interferon gamma production is monitored using Elispot assays (Schmittel et. al., 2000, J. Immunol. Meth., 24: 17-24). If sera are available from patients who have raised an immune response to protein, it is possible to detect mature T cells that respond to specific epitopes. In a preferred embodiment, interferon gamma or IL-5 production by activated T-cells is monitored using Elispot assays, although it is also possible to use other indicators of T cell activation or proliferation such as tritiated thymidine incorporation or production of other cytokines. Other suitable T cell assays include those disclosed in Meidenbauer et al., 2000, Prostate 43, 88-100; Schultes & Whiteside, 2003, J. Immunol. Methods 279, 1-15; and Stickler et al., 200, J. Immunotherapy, 23, 654-660.

In an alternate embodiment, immunogenicity is measured in transgenic mouse systems. For example, mice expressing fully or partially human class I or class II MHC molecules may be used. In an alternate embodiment, immunogenicity is tested by administering the peptides to one or more animals, including rodents and primates, and monitoring for antibody formation. Nonhuman primates with defined MHC haplotypes may be especially useful, as the sequences and hence peptide binding specificities of the MHC molecules in non-human primates may be very similar to the sequences and peptide binding specificities of humans. Similarly, genetically engineered mouse models expressing human MHC peptide-binding domains may be used (see for example Sonderstrup et al., 1999, Immunol. Rev. 172: 335-343; and Forsthuber et al., 2001, J. Immunol. 167: 119-125).

The biological properties of the peptides of the present invention may be characterized in cell, tissue, and whole organism experiments. As is known in the art, drugs are often tested in animals, including but not limited to mice, rats, rabbits, dogs, cats, pigs, and monkeys, in order to measure a drug's efficacy for treatment against a disease or disease model, or to measure a drug's pharmacokinetics, toxicity, and other properties. The animals may be referred to as disease models. Therapeutics are often tested in mice, including but not limited to nude mice, SCID mice, xenograft mice, and transgenic mice (including knockins and knockouts). Such experimentation may provide meaningful data for determination of the potential of the peptide, polypeptide, peptide string, or composition comprising a peptide, polypeptide or peptide string, to be used as a therapeutic. Any organism, preferably mammals, may be used for testing. For example because of their genetic similarity to humans, monkeys can be suitable therapeutic models, and thus may be used to test the efficacy, toxicity, pharmacokinetics, or other property of the proteins of the present invention. Tests of the peptides in humans are ultimately required for approval as drugs, and thus of course these experiments are contemplated. Thus the polypeptides, peptides (including but not limited to peptide strings) and peptide-based compositions of the present invention may be tested in humans to determine their therapeutic efficacy, toxicity, immunogenicity, pharmacokinetics, and/or other clinical properties.

Peptides and Peptide Strings

In certain embodiments, the present disclosure provides peptide epitopes identified according to the methods of the present invention. Non-limiting examples of amino acid sequences of the peptide epitopes, e.g., for DENV1, are: KTFDTEYQK (SEQ ID NO: 1), KTFDSEYVK (SEQ ID NO: 2), KTFDTEYPK (SEQ ID NO: 3), KTFDSEYIK (SEQ ID NO: 4), KTFDTEYTK (SEQ ID NO: 5), KTFDSEYAK (SEQ ID NO: 6), KTFDTEYIK (SEQ ID NO: 7), RTFDTEYQK (SEQ ID NO: 8), KTFETEYQK (SEQ ID NO: 9), KTFDAEYVK (SEQ ID NO: 10), KTFNTEYQK (SEQ ID NO: 11), KTFDTEYQR (SEQ ID NO: 12), and KTFDFEYIK (SEQ ID NO: 13). These sequences were identified in block 388 of the NS3 protein of DENV1 (see, Example 4).

In other embodiments, the present disclosure provides peptides comprising the amino acid sequences shown in one or more of FIGS. 2-21 and FIGS. 23-46.

In certain embodiment, peptide strings are provided. Peptide strings are constructed by linking conserved peptides from blocks of peptides identified as conserved. In certain embodiments, peptide strings are useful for forming immunogenic compositions, by linking together immunogenic peptides. In some embodiments, strings are formed by linking together immunofunctionally conserved peptides.

In one embodiment, conserved peptides can be linked together by arbitrary sequences. Examples of such arbitrary sequences include but are not limited to random amino acid sequences, sequences comprising proteolytic cleavage sites (e.g., furin recognition sites), which can promote processing of the polypeptide into peptides for presentation on MHC molecules, synthetic linkers including, but not limited to, furin-sensitive linker RVKR (SEQ ID NO: 14) or furin-resistant linker VRVV (SEQ ID NO: 15) (Lu et al. *J Immunol* 2004; 172; 4575-82); tert-Butyl acrylate, acryloyl chloride, TFA/anisole, or DCC/NHS/THF (Dziadek et al. Chem Eur J 2008; 14:5908-17), $G_4S$ repeats (SEQ ID NO: 544030) (Li et al. Vaccine 2010; 288: 1911-8), or naturally observed viral sequences. It is also possible that peptide strings can comprise some conserved peptides and some non-conserved peptides. In a preferred embodiment, a peptide strings comprises conserved peptides but not non-conserved peptides, wherein the conserved peptides are linked by arbitrary sequences, as described above.

In one embodiment, a linker sequence can include or consists of a conserved peptide sequence, as determined according to the methods described herein. In another embodiment, a linker sequence can include or consists of another immunogenic peptide sequence that is not necessarily a conserved peptide sequence.

In certain embodiments, peptide strings are constructed which have a length that is similar or the same as the length of the naturally occurring polypeptide in which the conserved peptides are found. Further, in a preferred embodiment, the distance (i.e., number of amino acids) between conserved peptides in a polypeptide is preserved in a peptide string containing those conserved peptides by inserting the same number of arbitrary amino acid residues as the number of naturally occurring residues removed from the peptide string. For example, if, in a polypeptide, each block of conserved peptides is separated from the next conserved peptide block on either side by 5 non-conserved residues, then a peptide string can be constructed by inserting 5 arbitrary residues (XXXXX) between each of those conserved peptide sequences. Preferably, although not necessarily, the overall length of the polypeptides is substantially the same as the length of the peptide string. Further, preferably, although not necessarily, the order of the conserved peptides in the string is the same as the order of the peptide block from which the peptide is derived in the naturally occurring polypeptides. In other embodiments, peptides can be linked in any random order with linkers of any arbitrary length or size. While not intending to be bound by one particular theory or mechanism of action, it is thought that peptide strings which maintain a similar size and peptide order as the original polypeptides from which the peptides are derived may be more efficiently taken up by antigen presenting cells and/or processed and/or presented on MHC molecules compared to peptide strings containing randomly ordered peptides and/or having altered lengths.

Figures 4, 60:
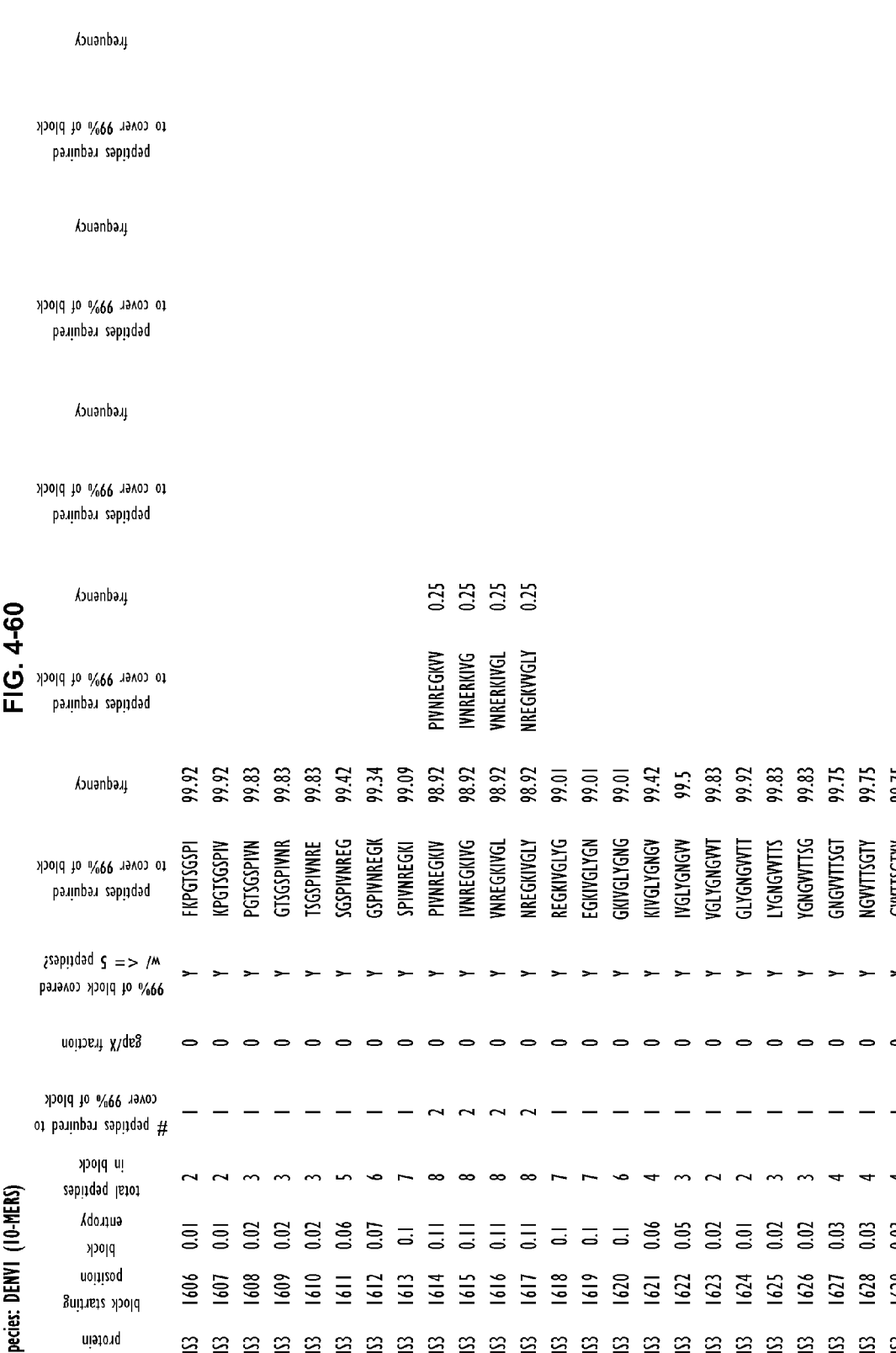
FIGS. 53-64 show the sequences of peptide strings assembled from blocks of conserved peptides identified herein. Five peptide strings for each of peptide 8-mers, 9-mers, 10-mers and 11-mers of Norovirus ("panNV") (FIG. 53), DENV1 (FIG. 54), DENV2 (FIG. 55), DENV3 (FIG. 56), DENV4 (FIG. 57), WNV (FIG. 58), YFV (FIG. 59), TBEV (FIG. 60), JEV (FIG. 61), DENVall (FIG. 62), panFIVE (FIG. 63), and panFLAVI (FIG. 64) are shown. The peptide strings shown in each Figure have the following SEQ ID NOs (in numerical order from top to bottom)
Figures 4, 66:
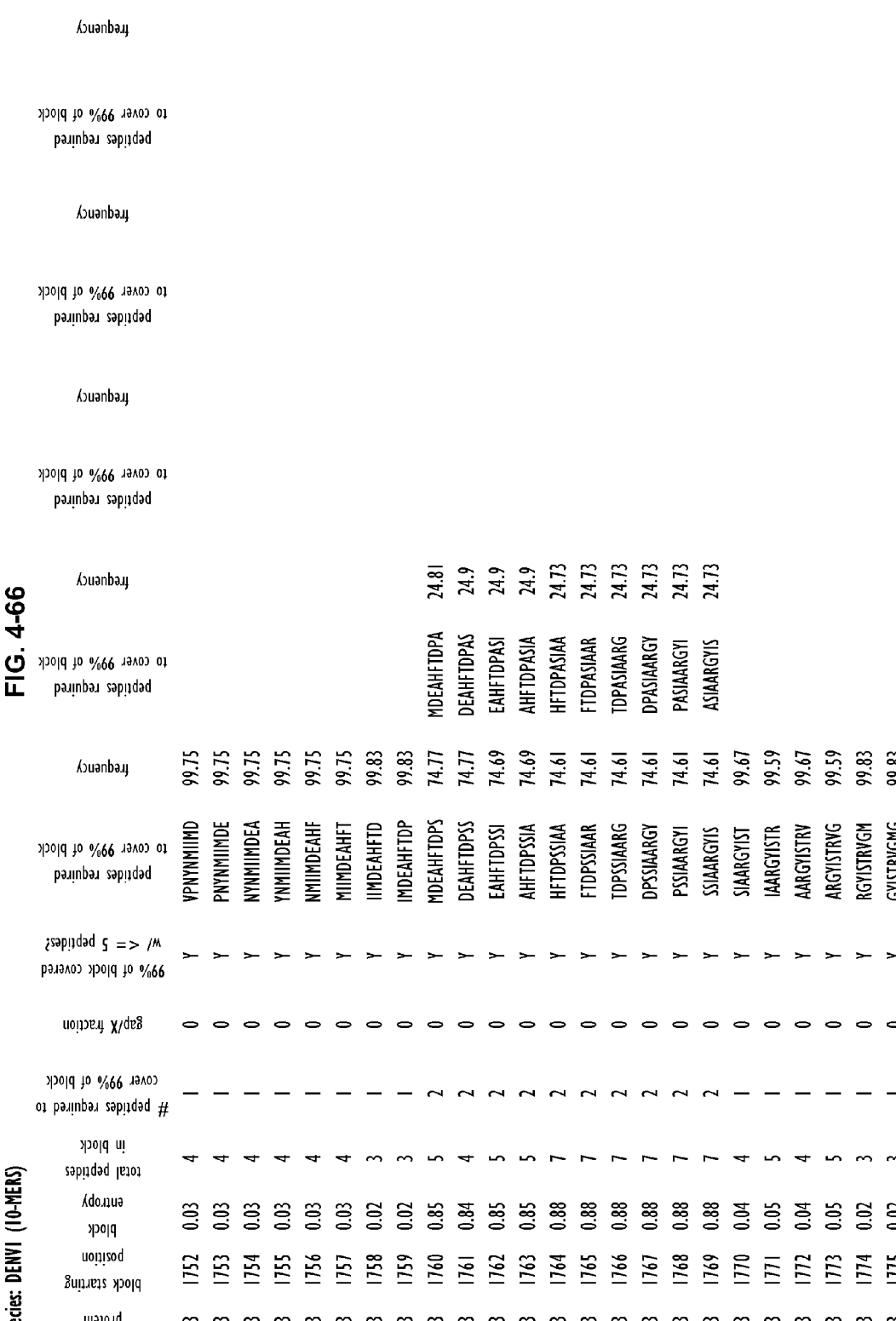
FIGS. 66-69 show the GenBank® Accession numbers for each protein (polypeptide) aligned in the DENV1 (FIG. 66), DENV2 (FIG. 67), DENV3 (FIG. 68) and DENV4 (FIG. 69) MSAs. For the "DENVall" (DENV1-4) MSA, all of the sequences referenced by their GenBank® accession numbers in FIGS. 66-69 were combined.
Figures 4, 71:
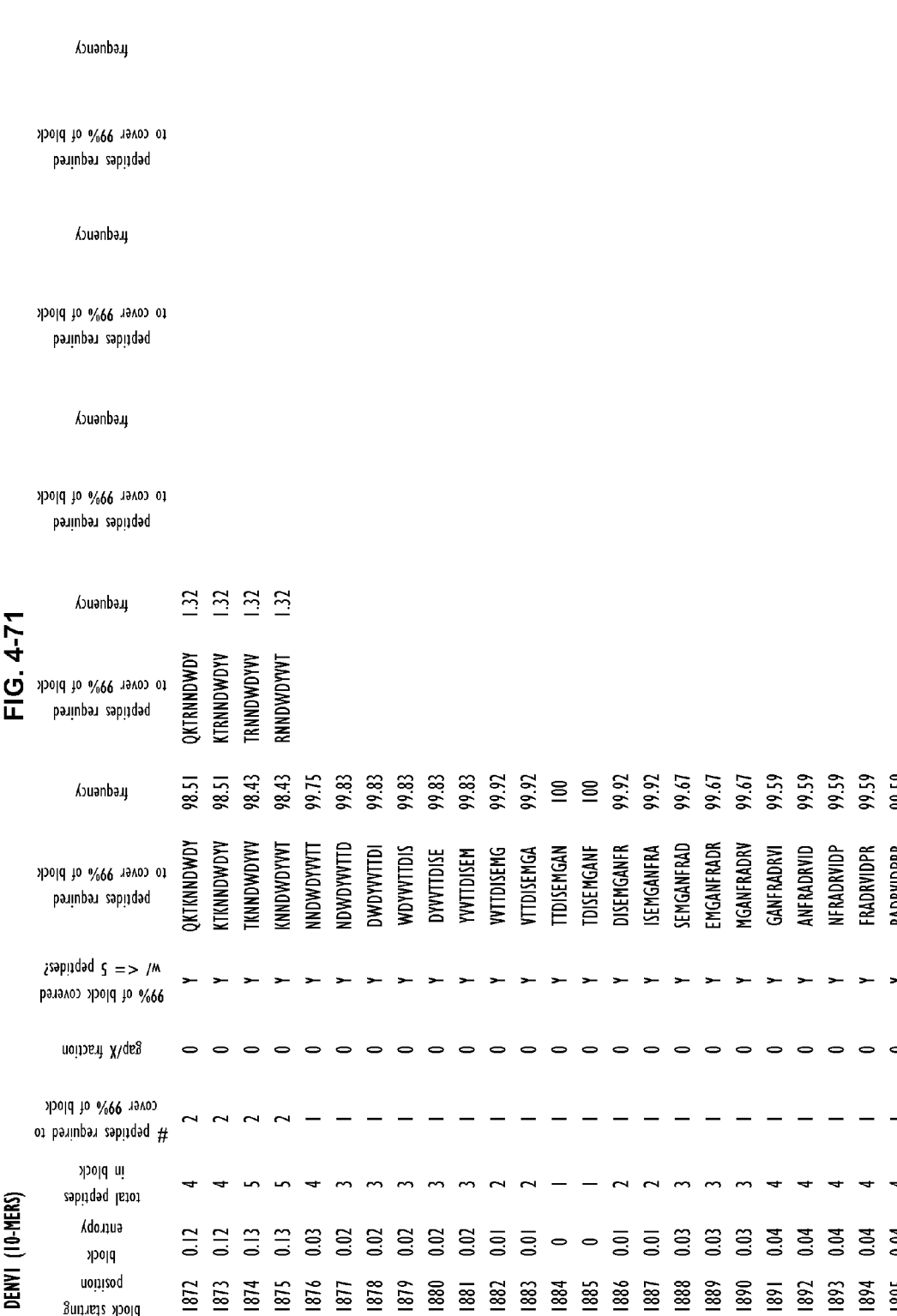
FIG. 71 shows the GenBank® Accession numbers for each protein aligned in the norovirus ("NV") MSA.
Figures 4, 75:
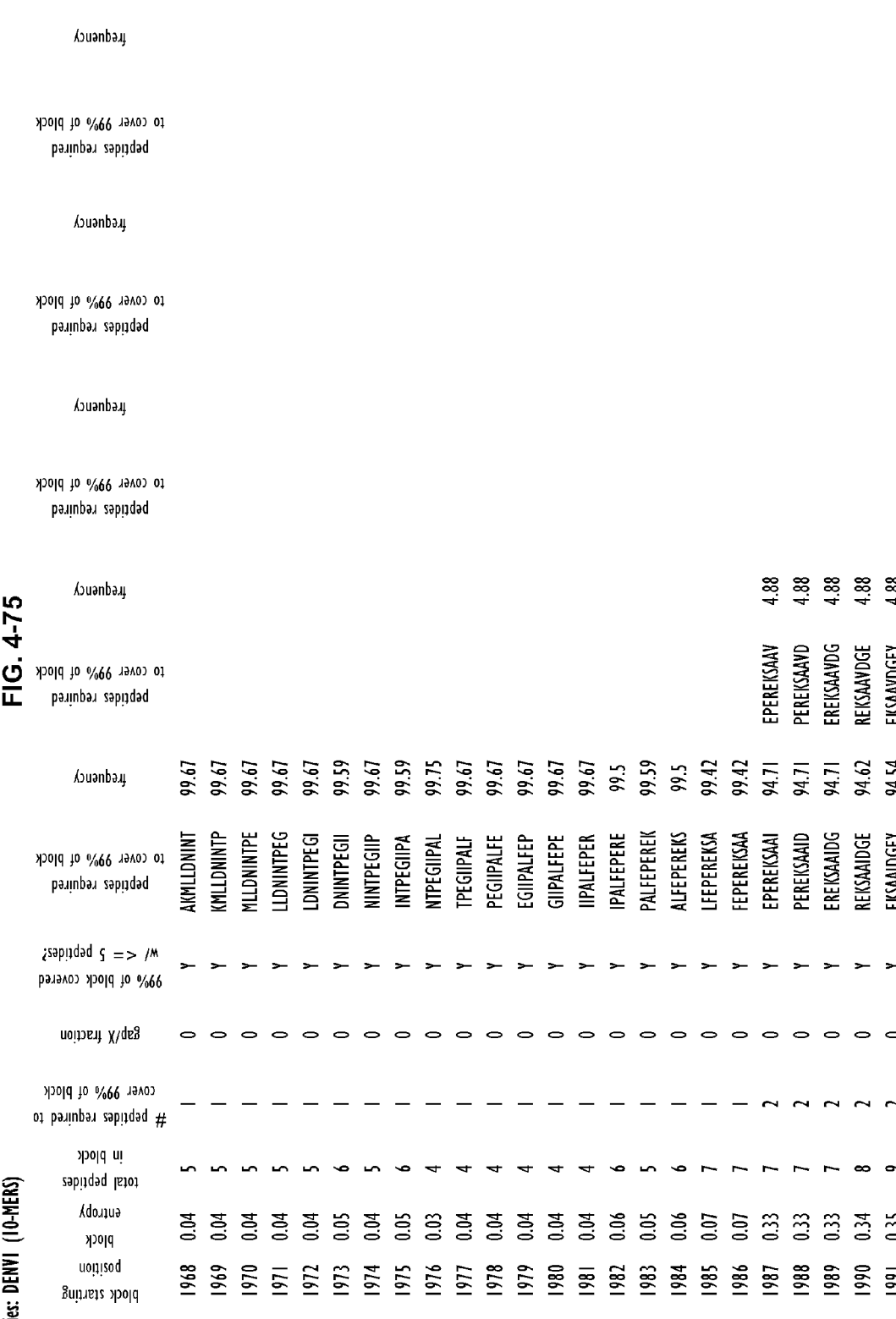
FIGS. 72-75 show the results of the analysis of blocks of peptide 8-mers, 9-mers, 10-mers and 11-mers, respectively, in which 5 or fewer peptides were required to "cover 99% of the block" (i.e. to achieve a cumulative fraction of polypeptides in the MSA, by adding together each unique peptide's frequency within the polypeptides in the MSA, of at least 99%) for influenza virus. Subtypes of influenza virus are shown (e.g., N1-N9, H10, H10N7, H11, H12, H13, H14, H15, H16, H1, H1N1, etc.) in the second column from the left. The sub (YFV), tick-borne encephalitis virus (TBEV), Japanese encephalitis virus (JEV) and norovirus.
Figures 4, 88:
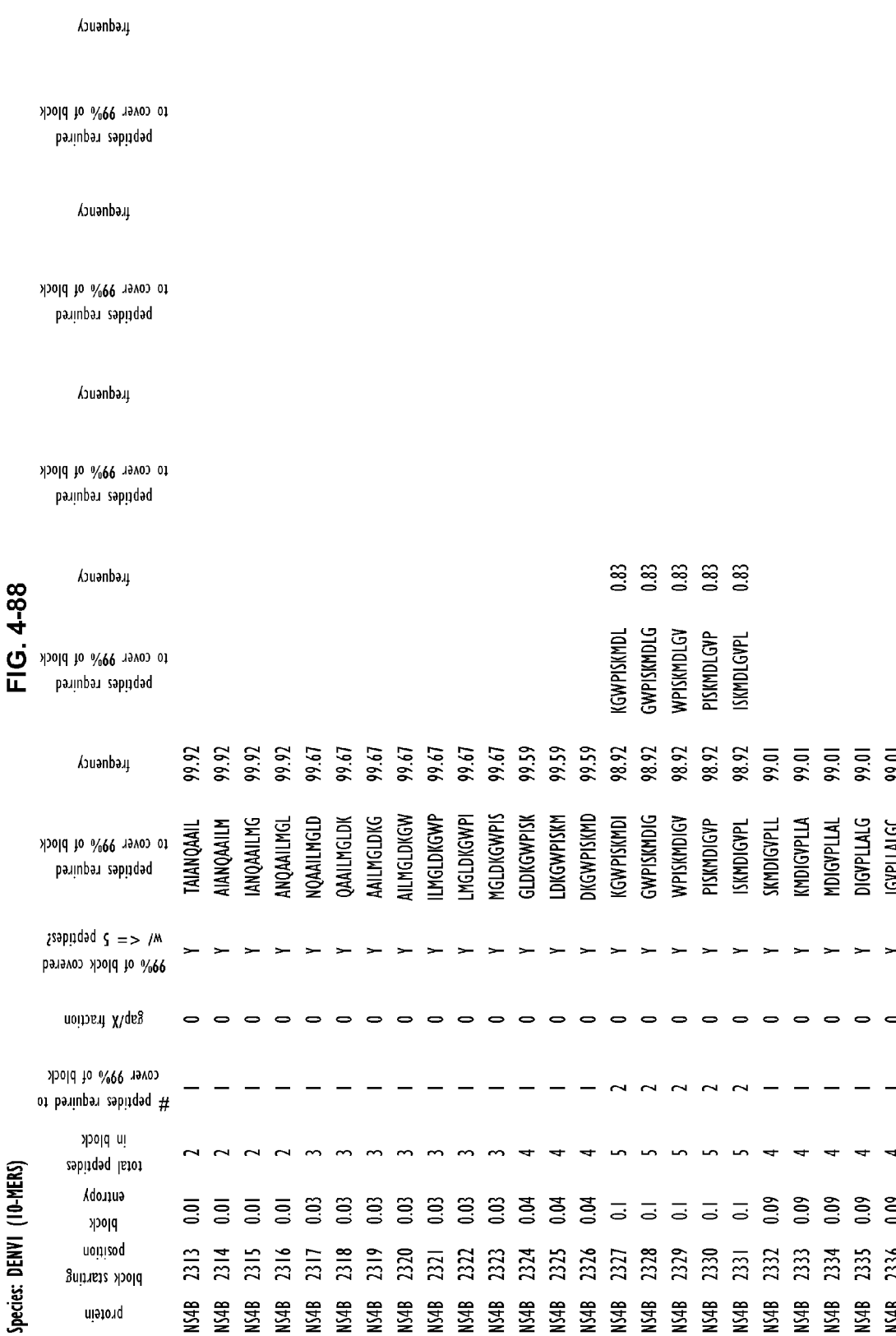
Figures 4, 104:
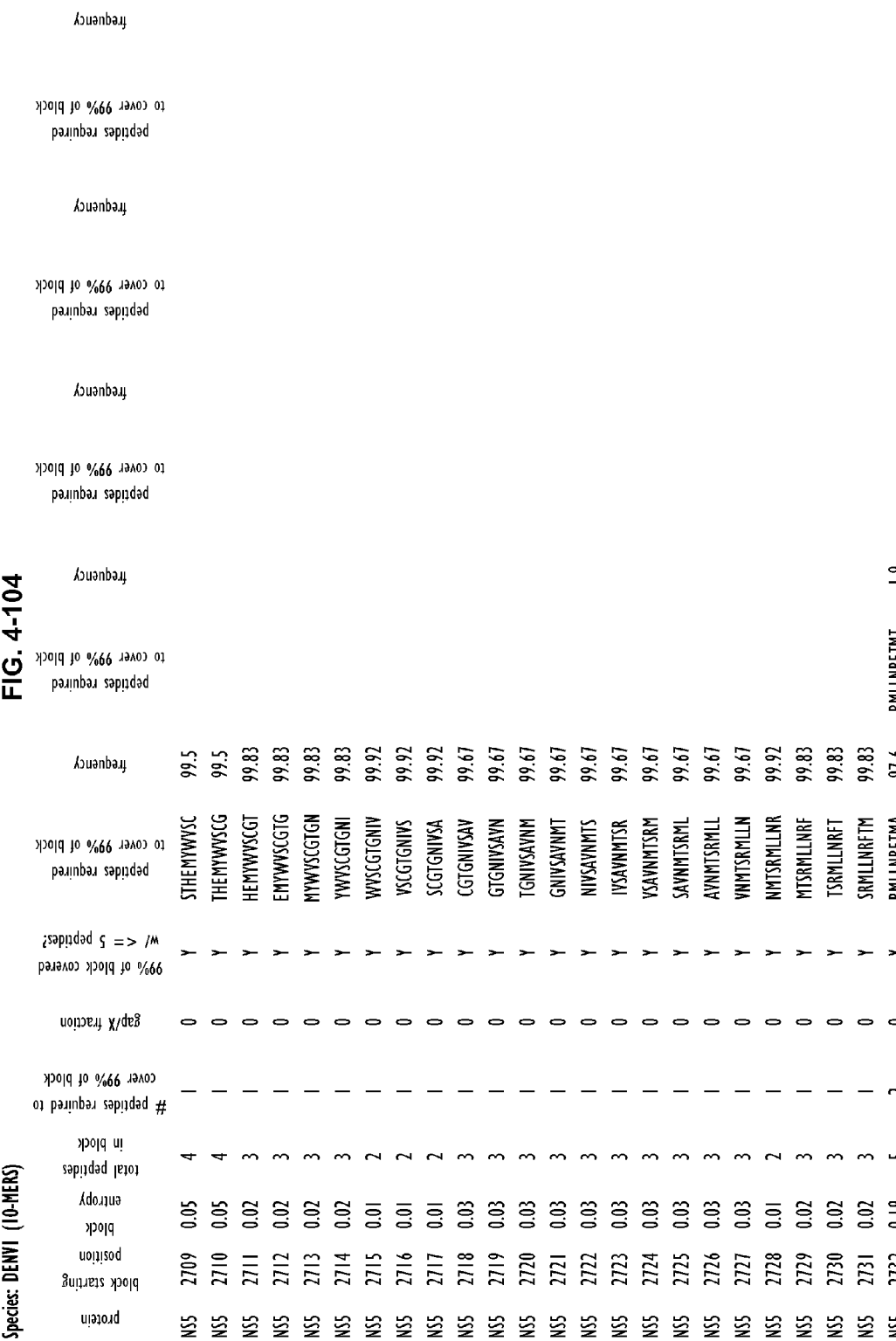
Figures 4, 109:
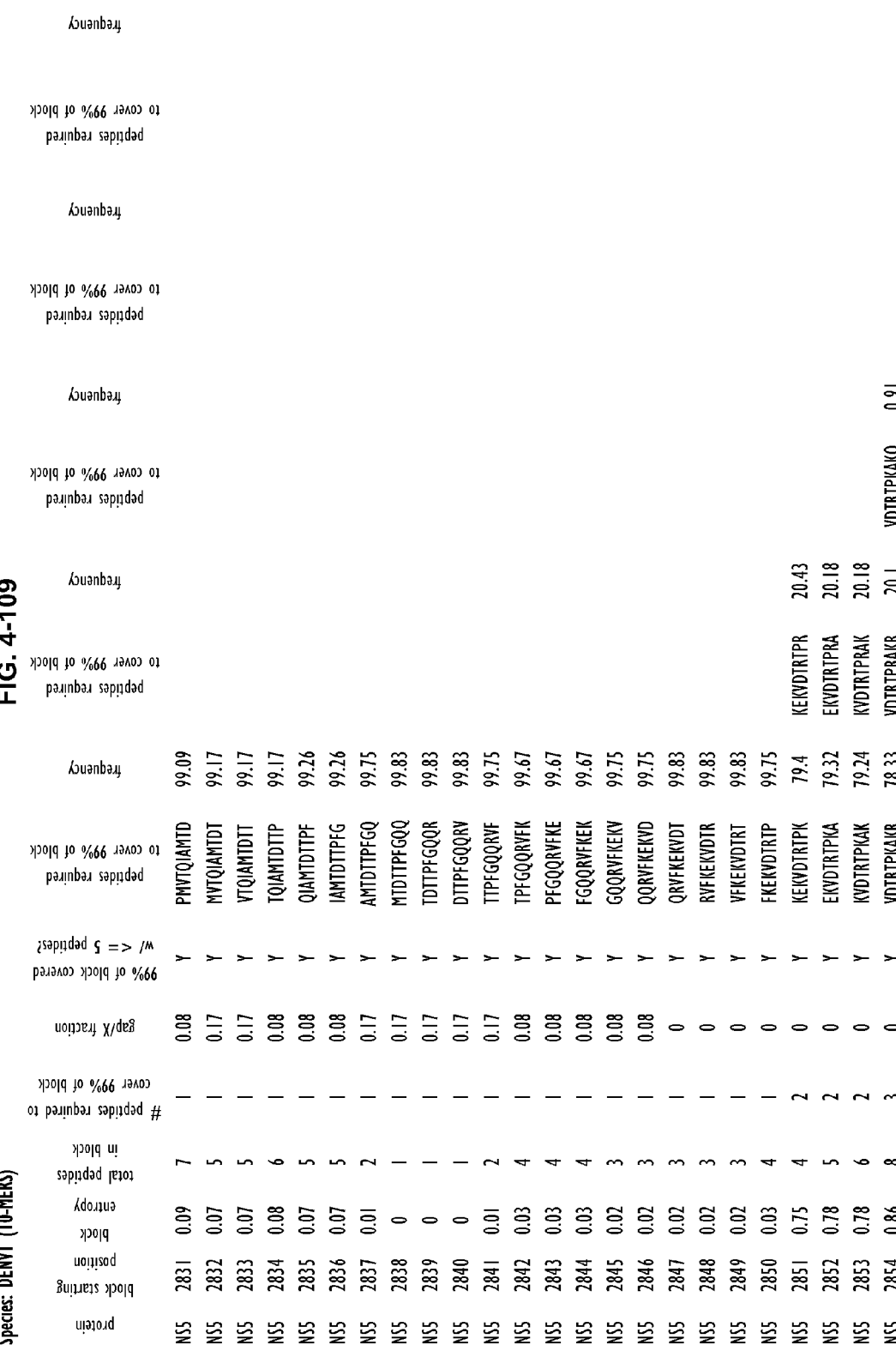
Figures 3, 5:
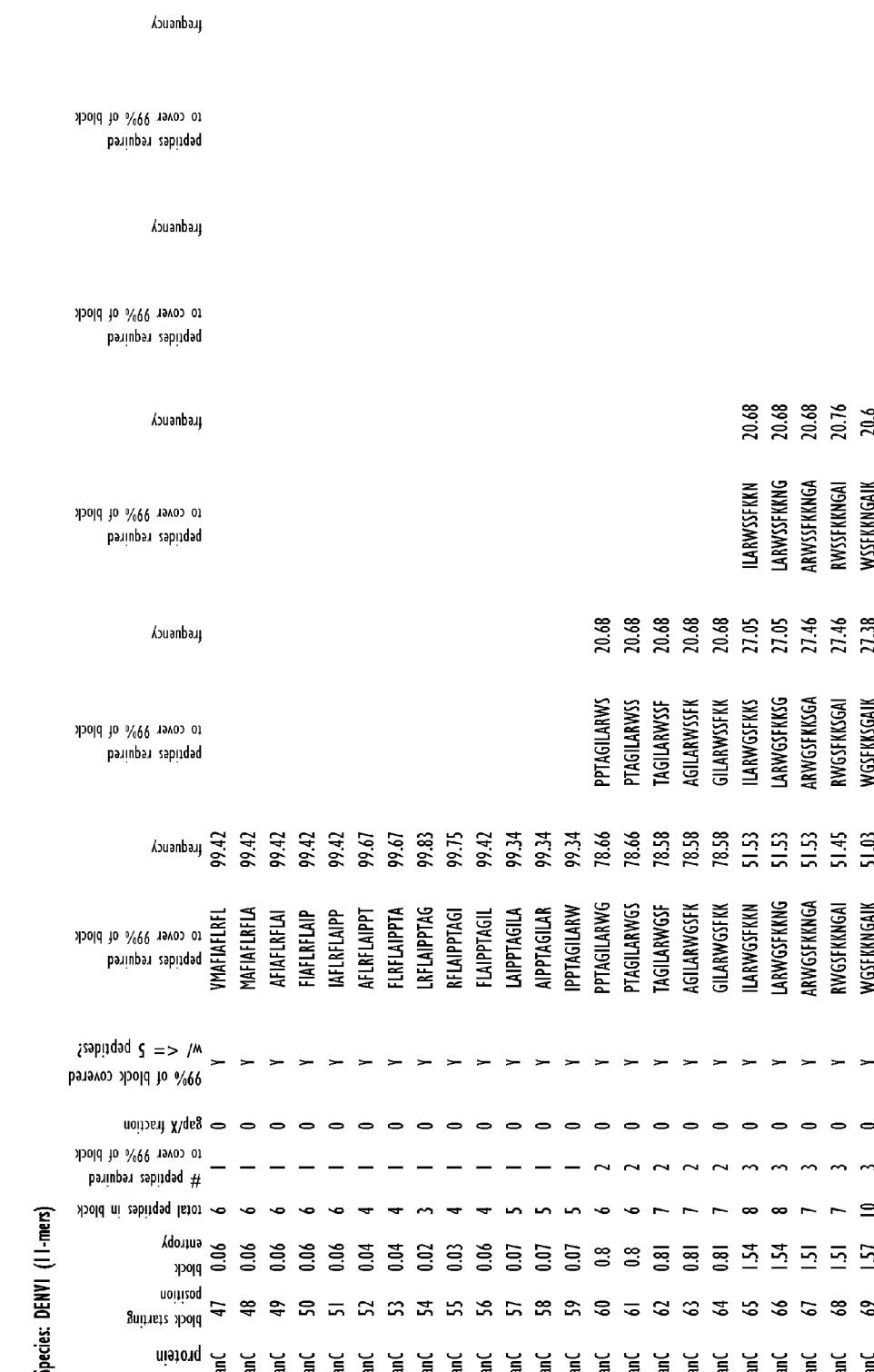
Figures 5, 58:
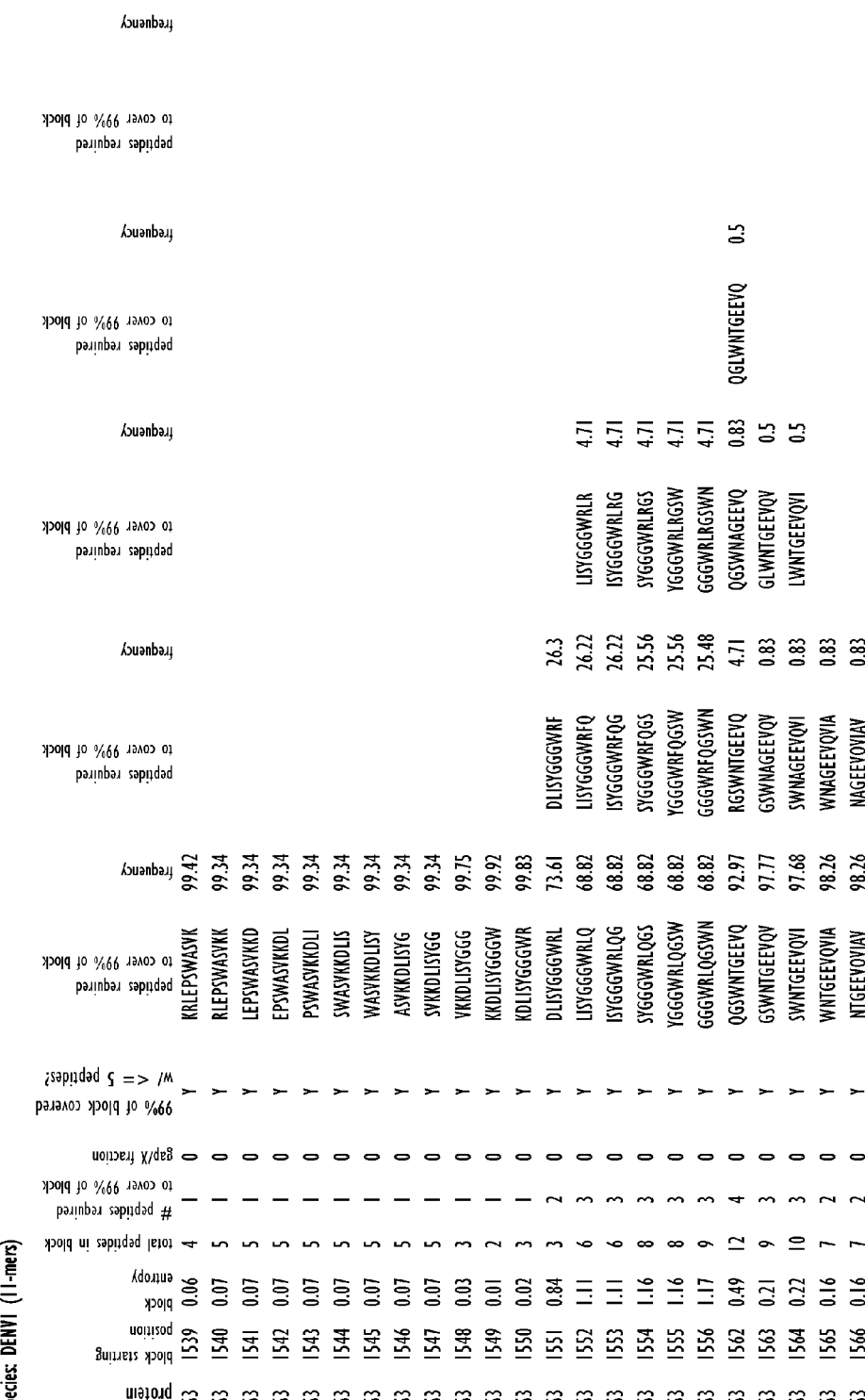
Figures 5, 63:
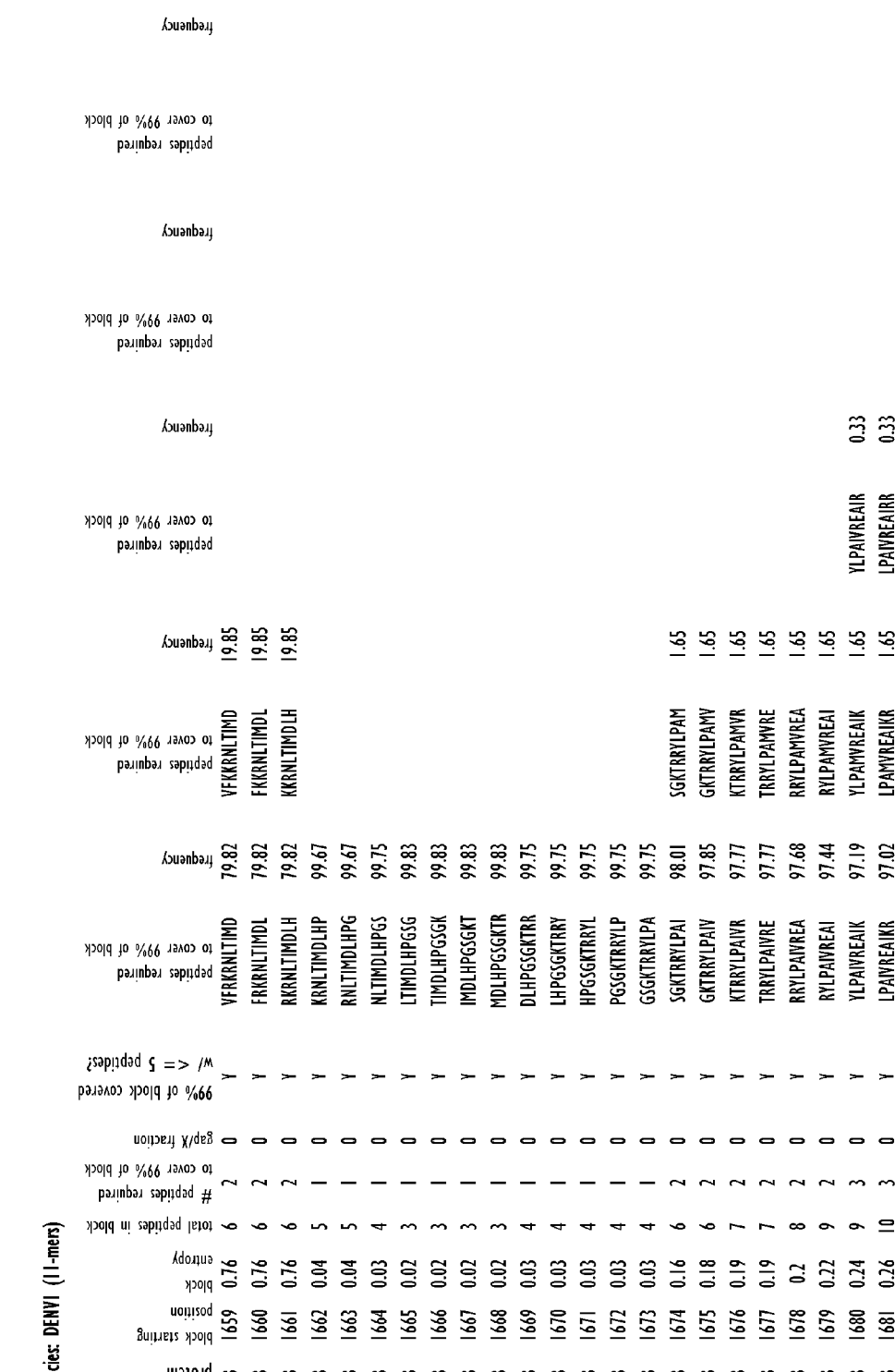
Figures 5, 92:
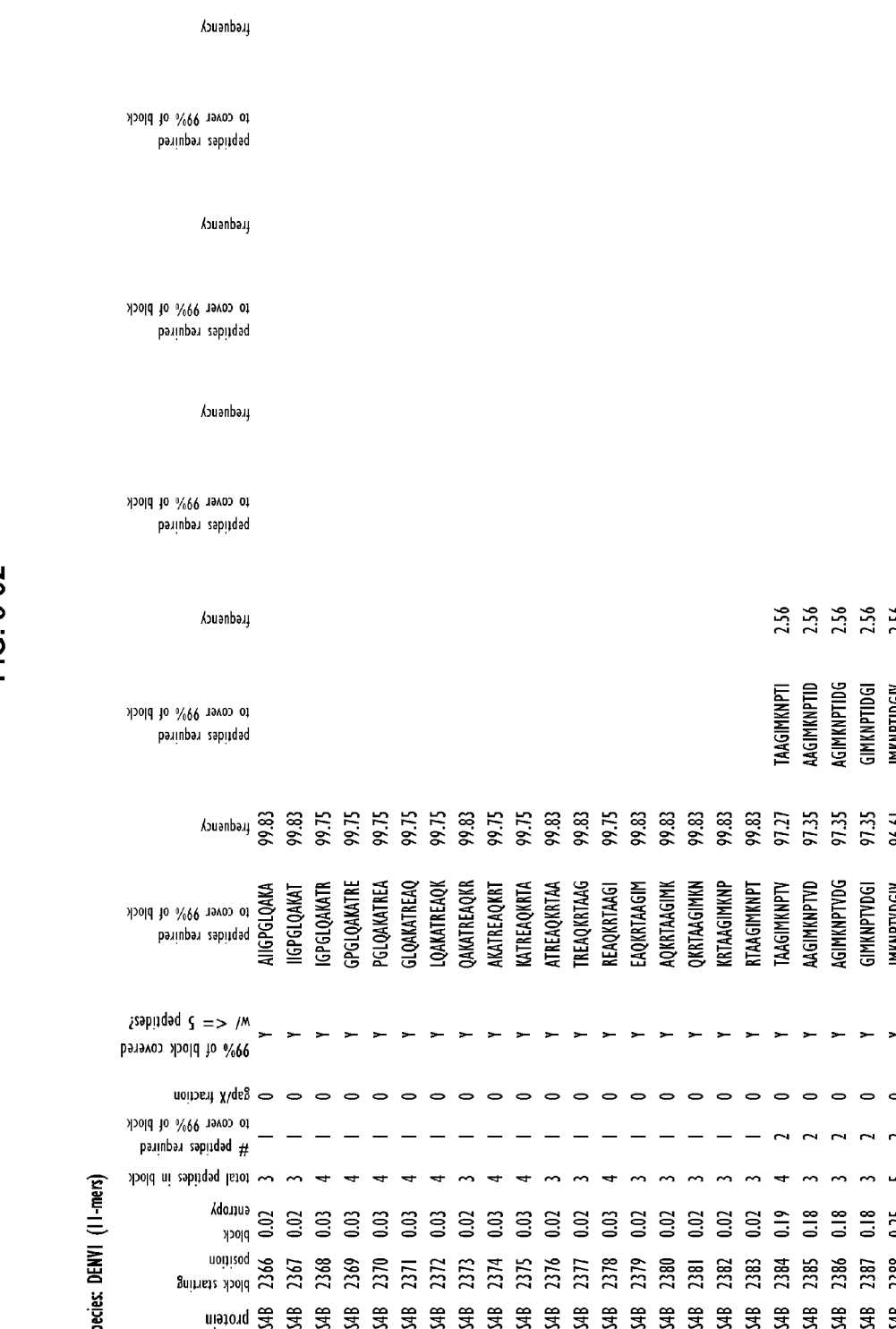
Figures 5, 104:
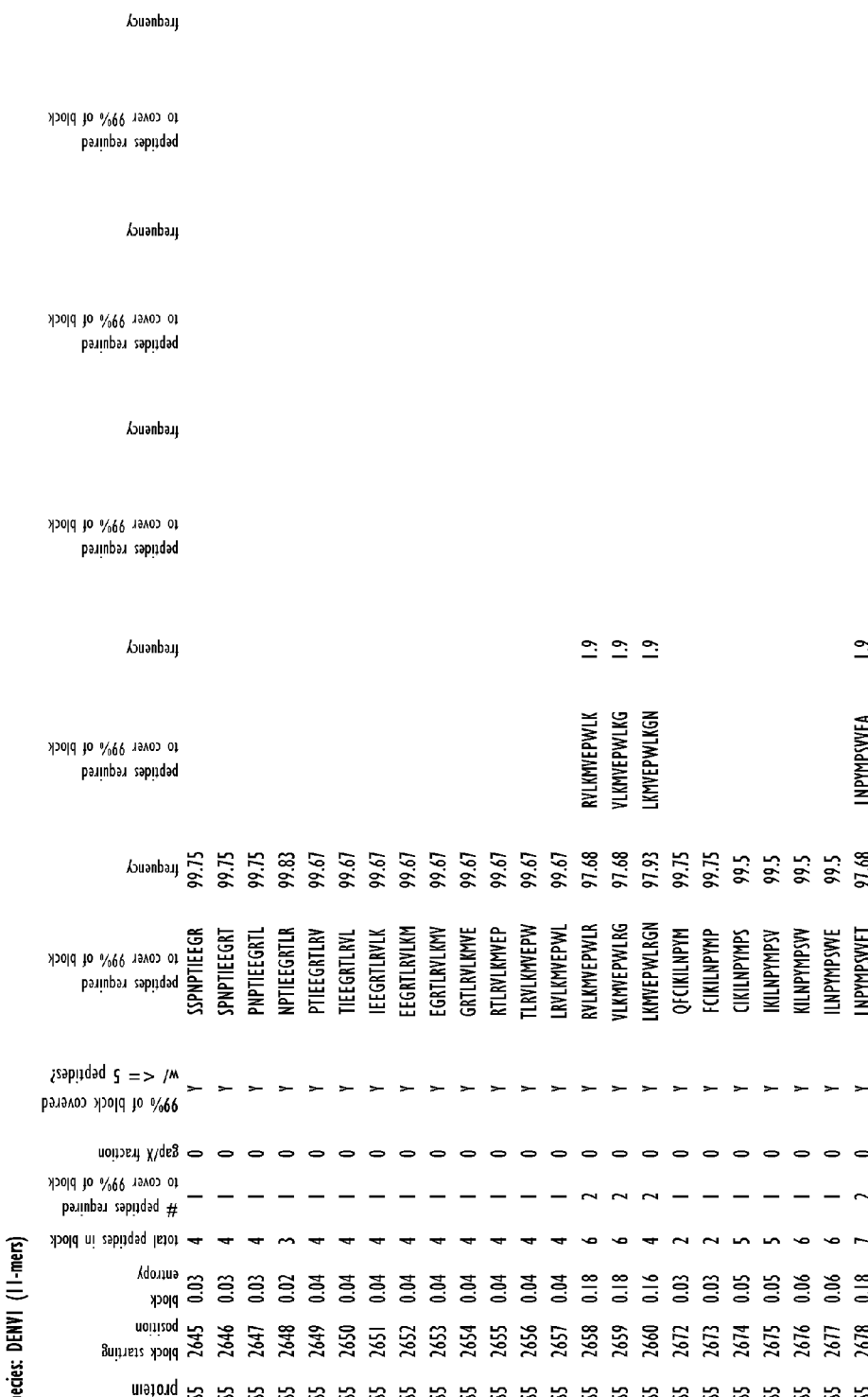
Figures 5, 110:
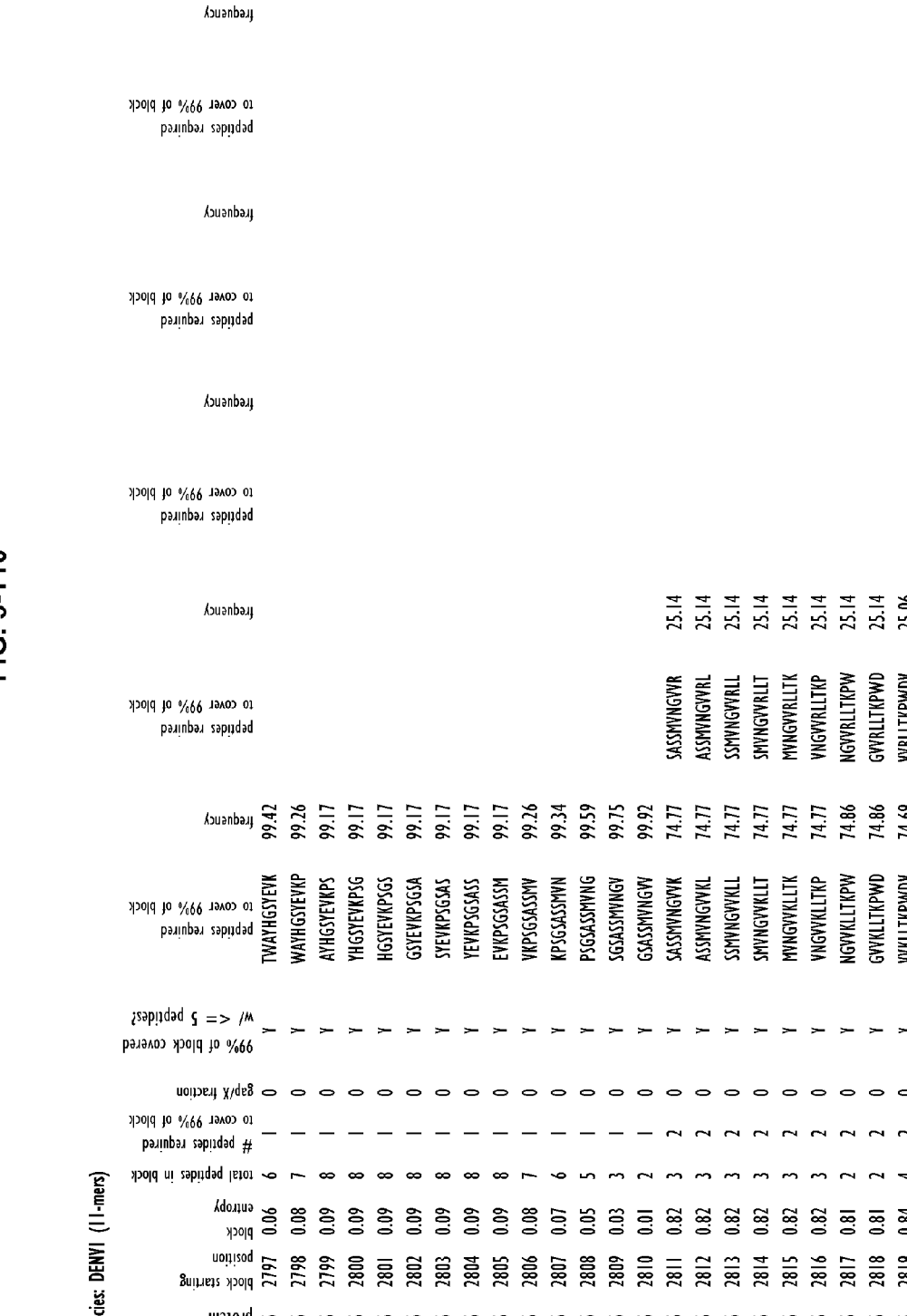
Figures 5, 114:
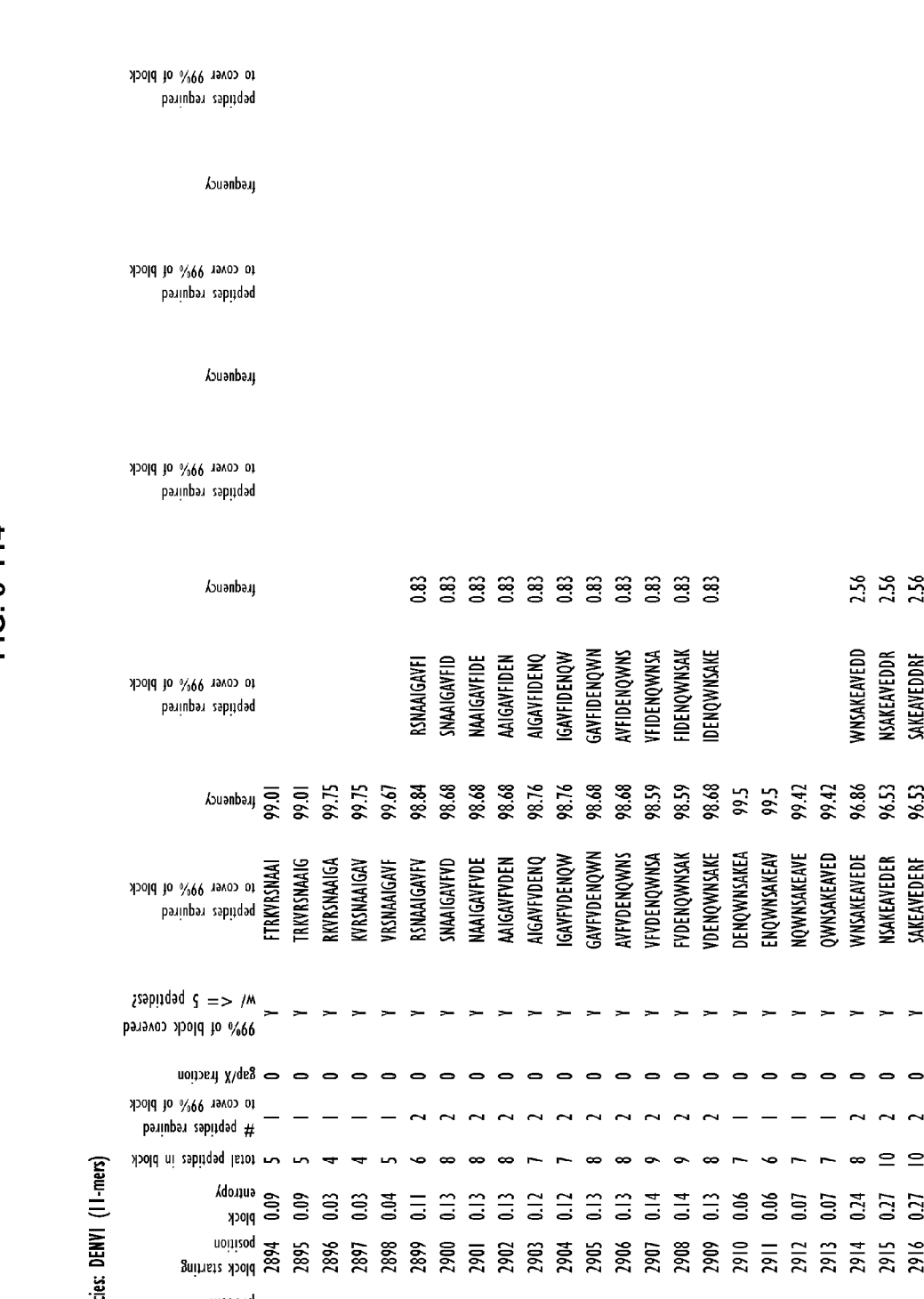
Figures 5, 128:
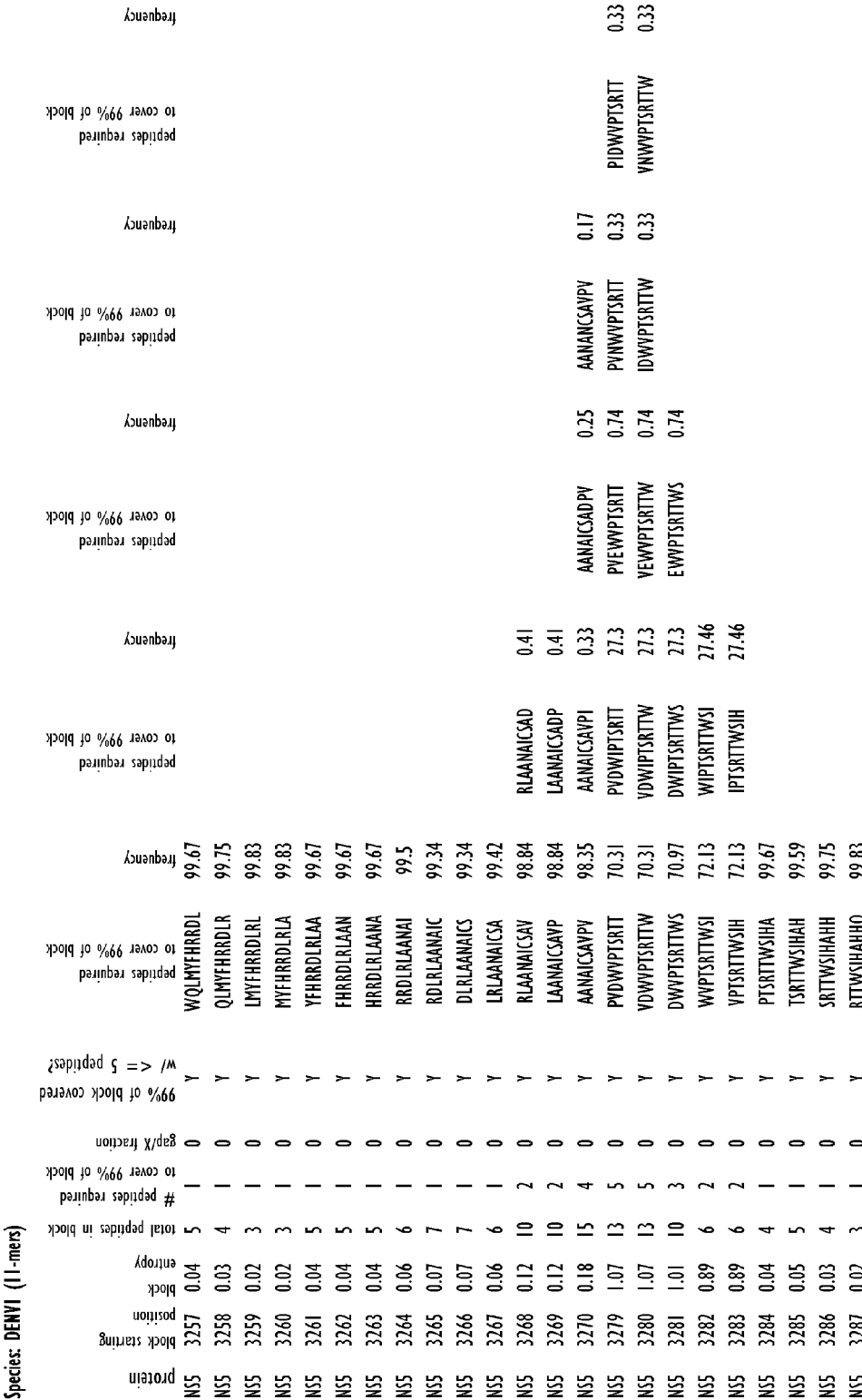
Figures 1, 10:
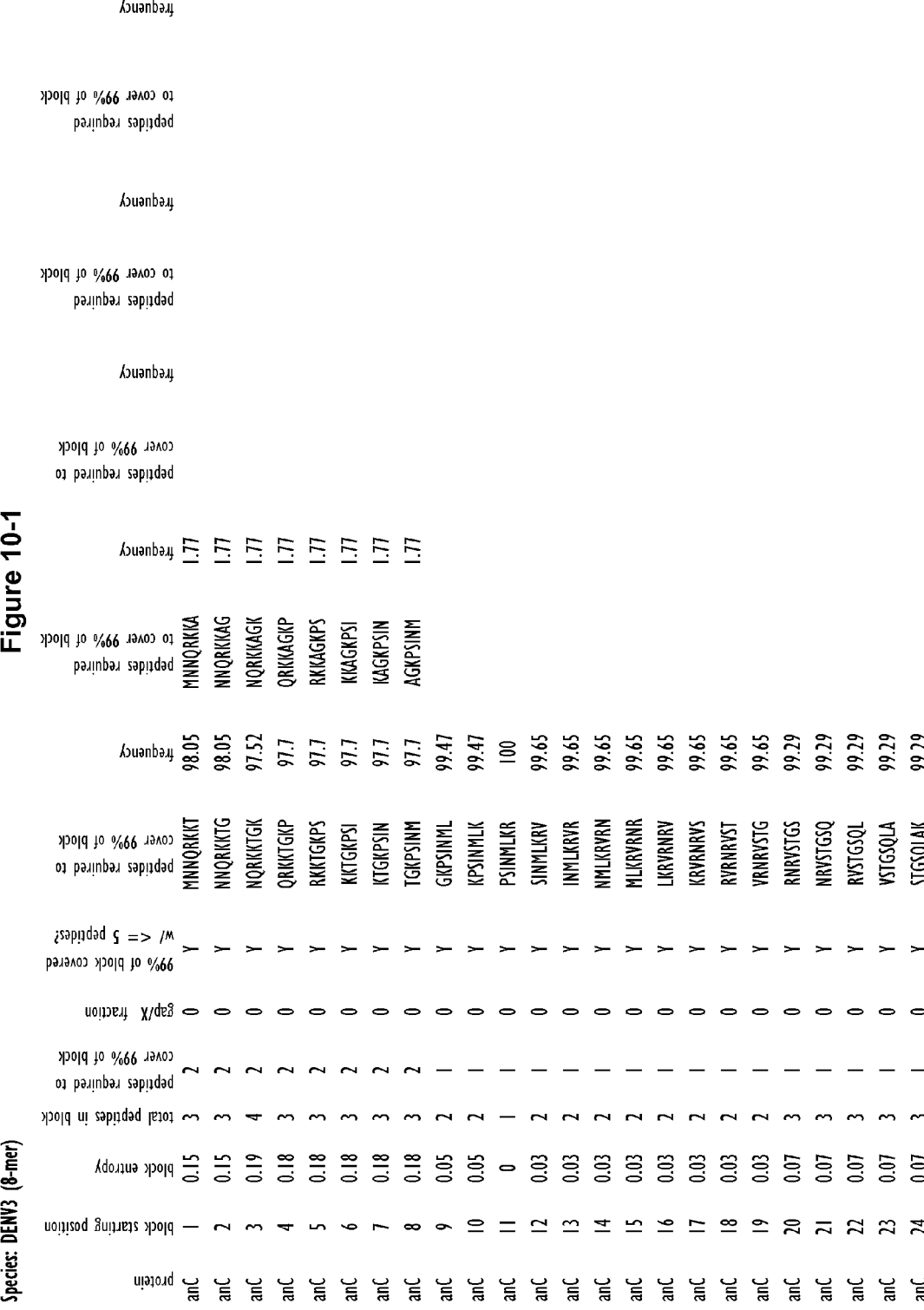
Figures 3, 10:
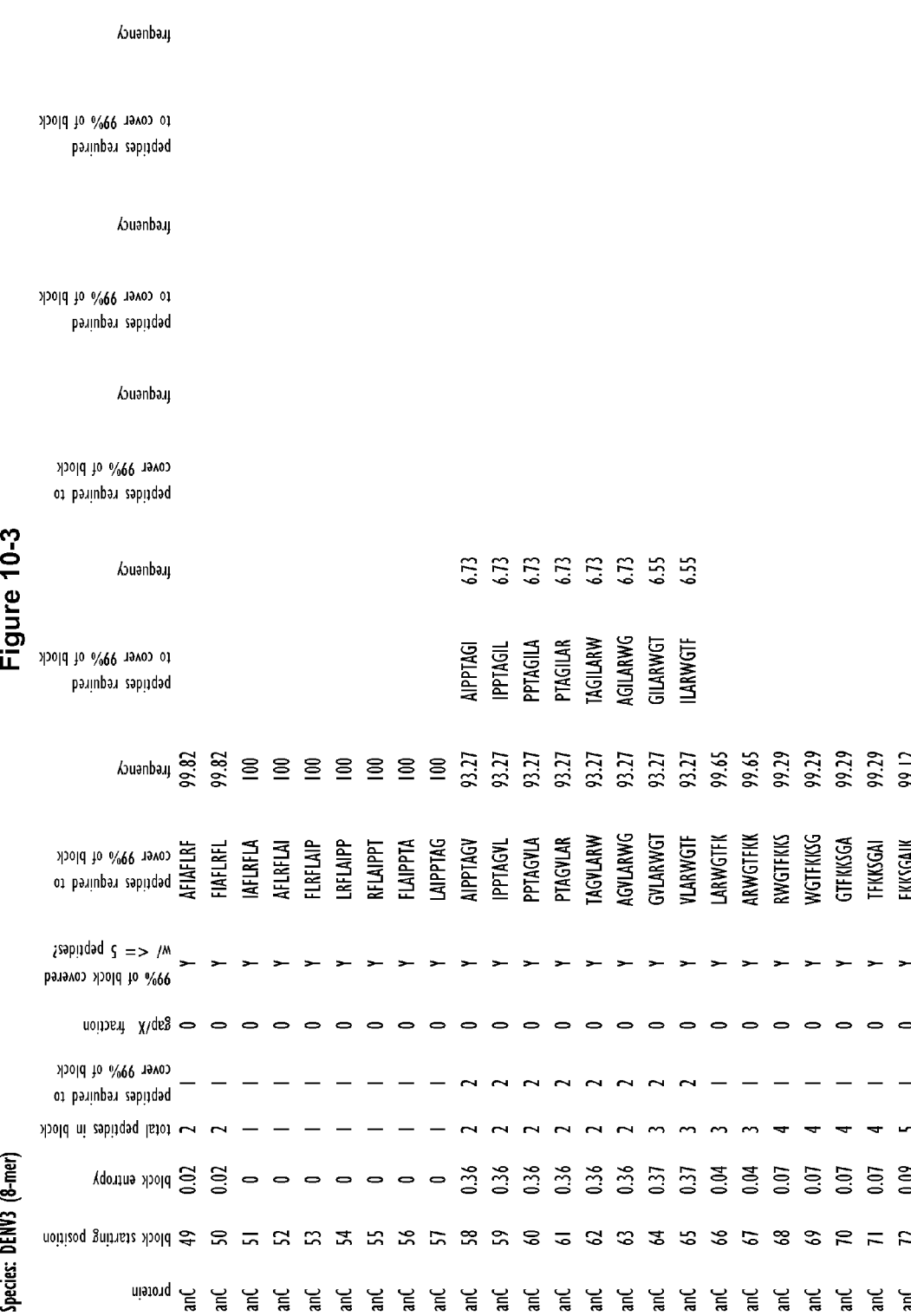
Figures 8, 10:
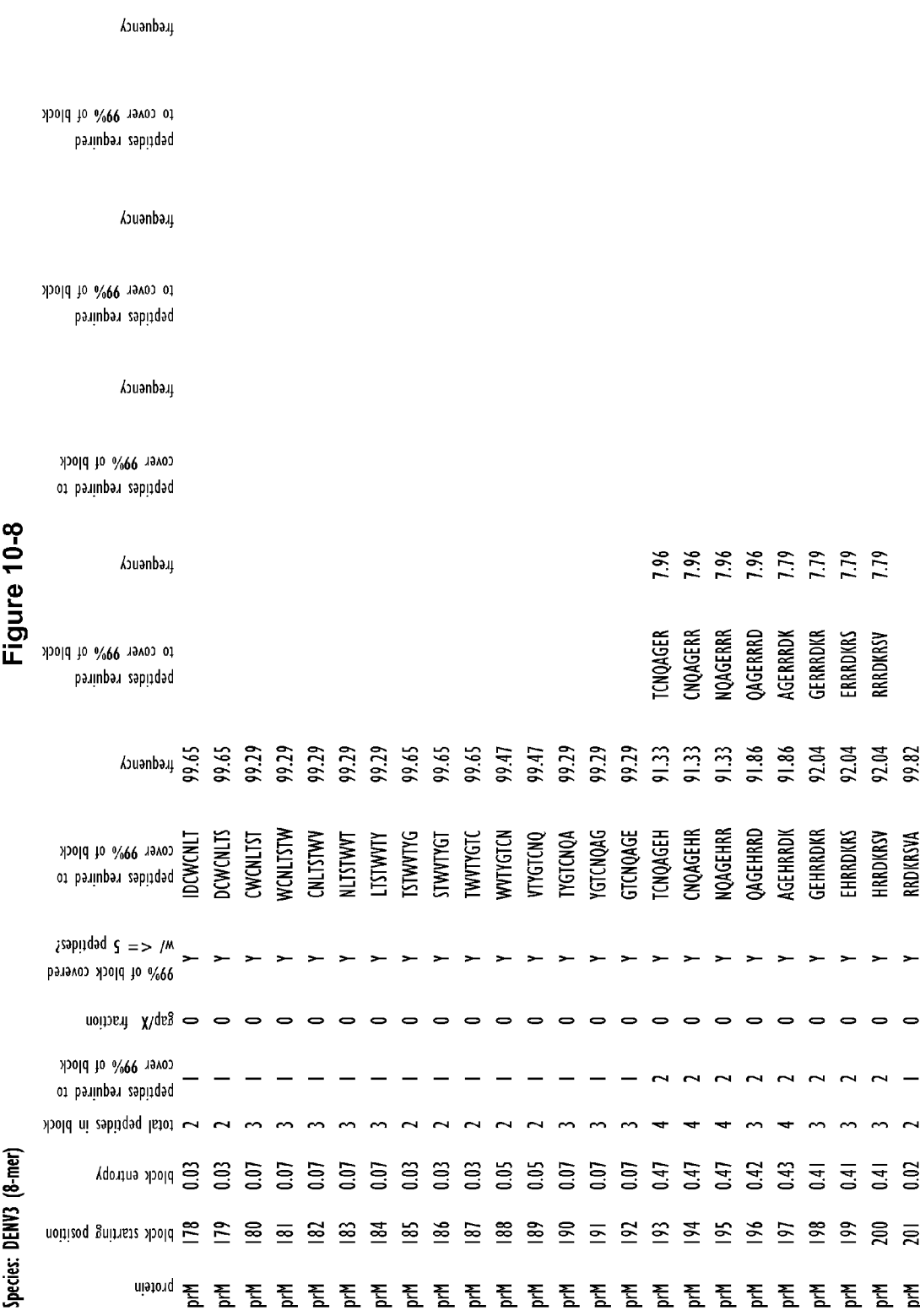
Figures 9, 10:
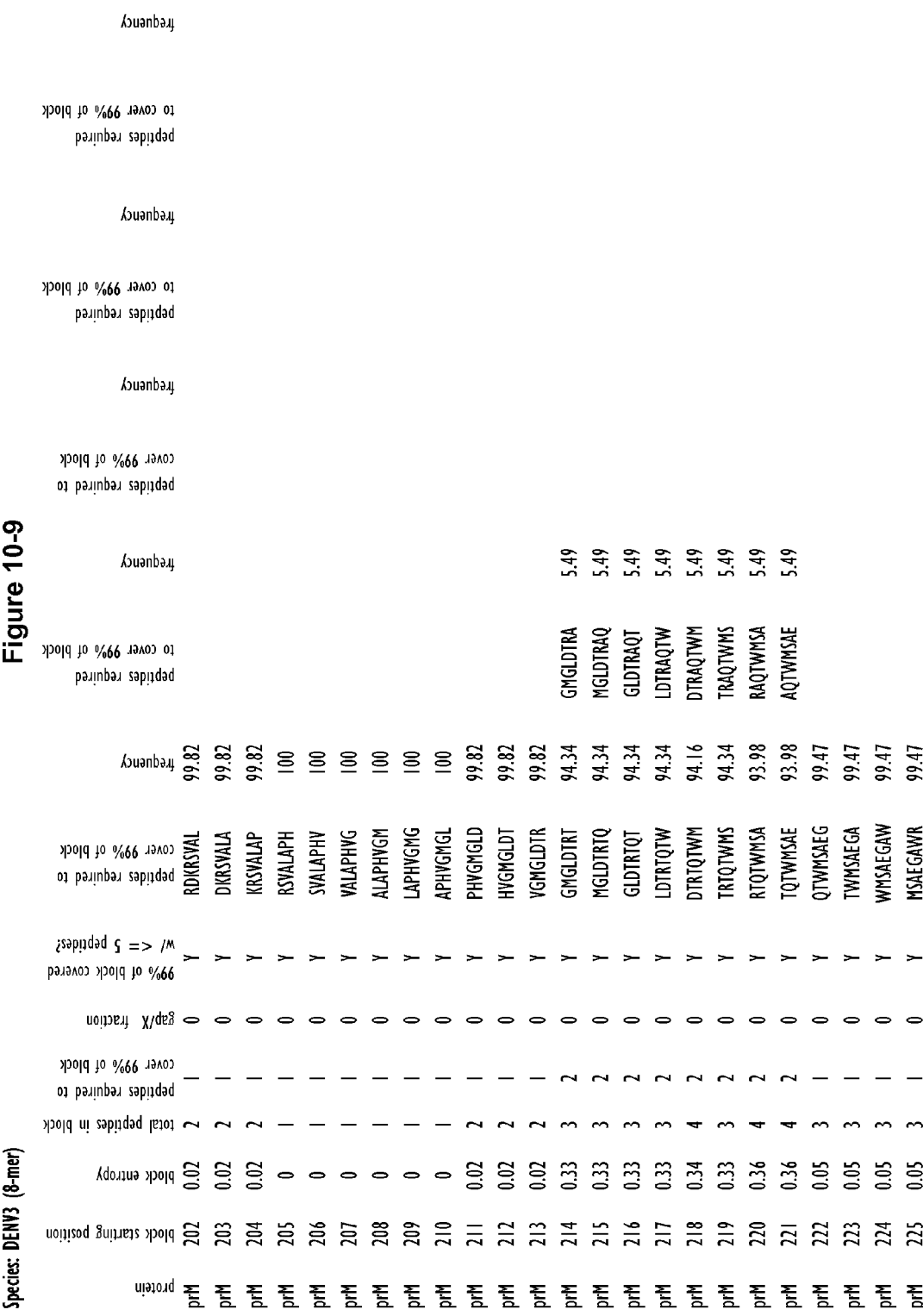
Figure 10:
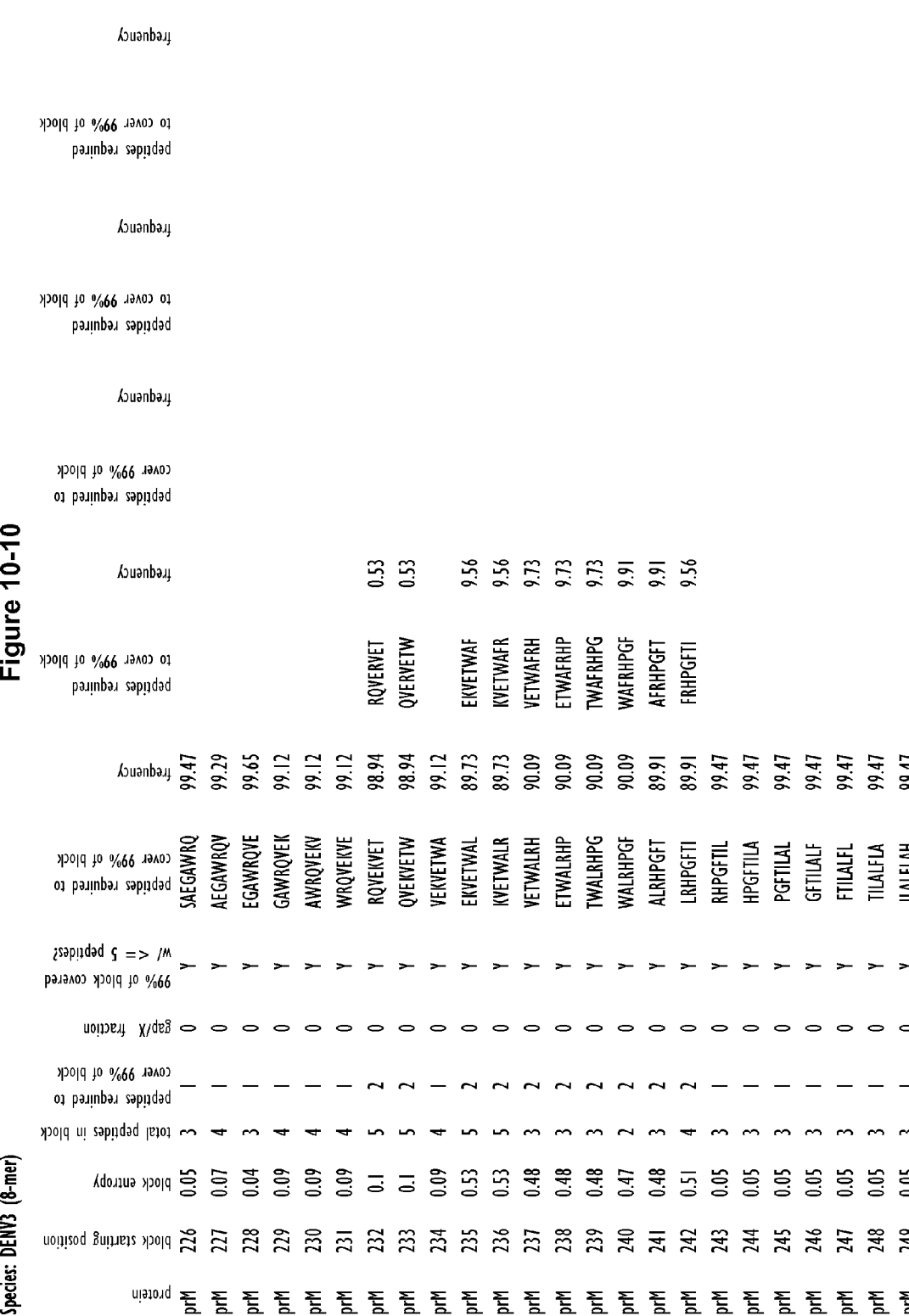
Figures 10, 11, 12, 13:
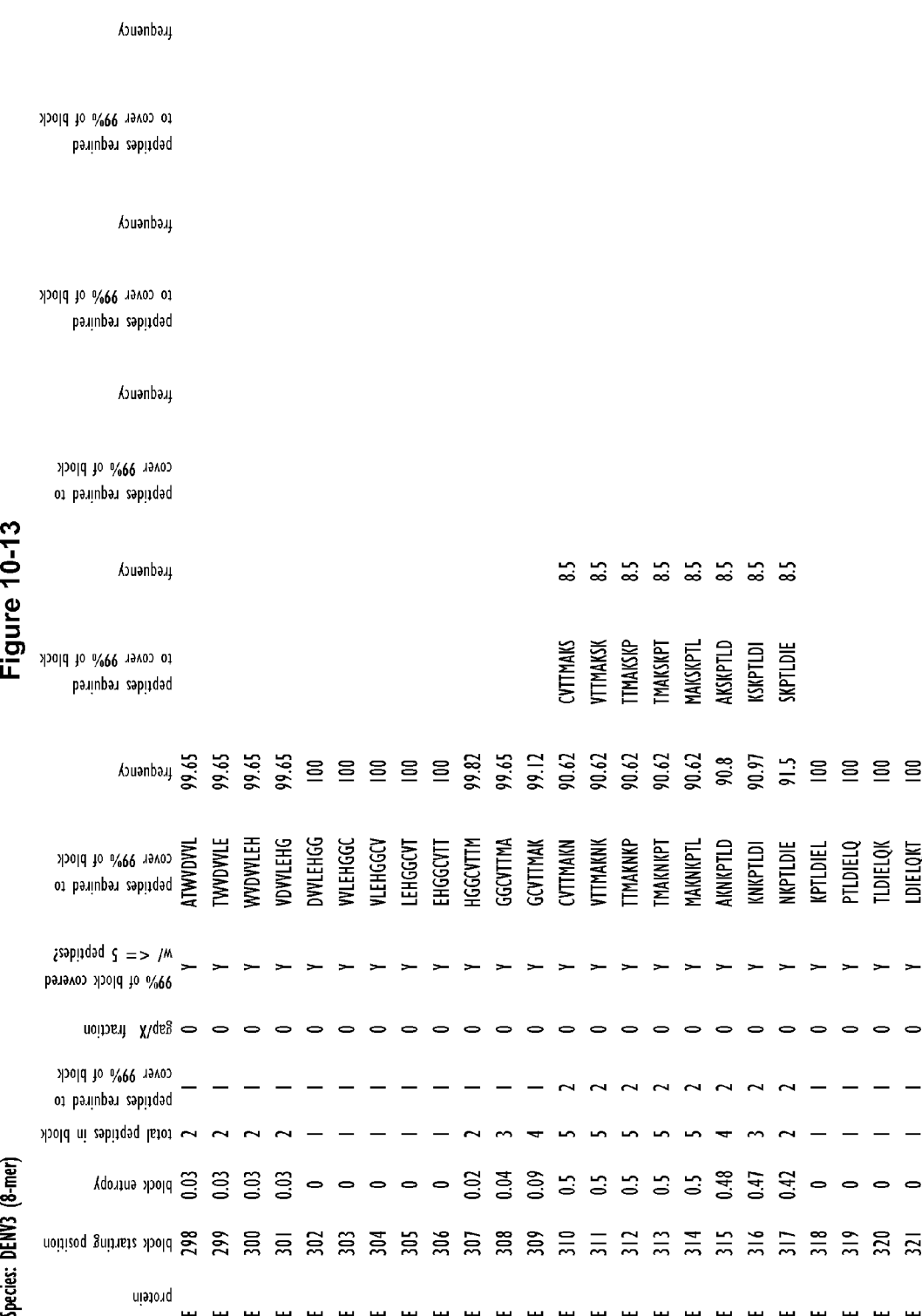
Figures 10, 11, 12, 13, 14:
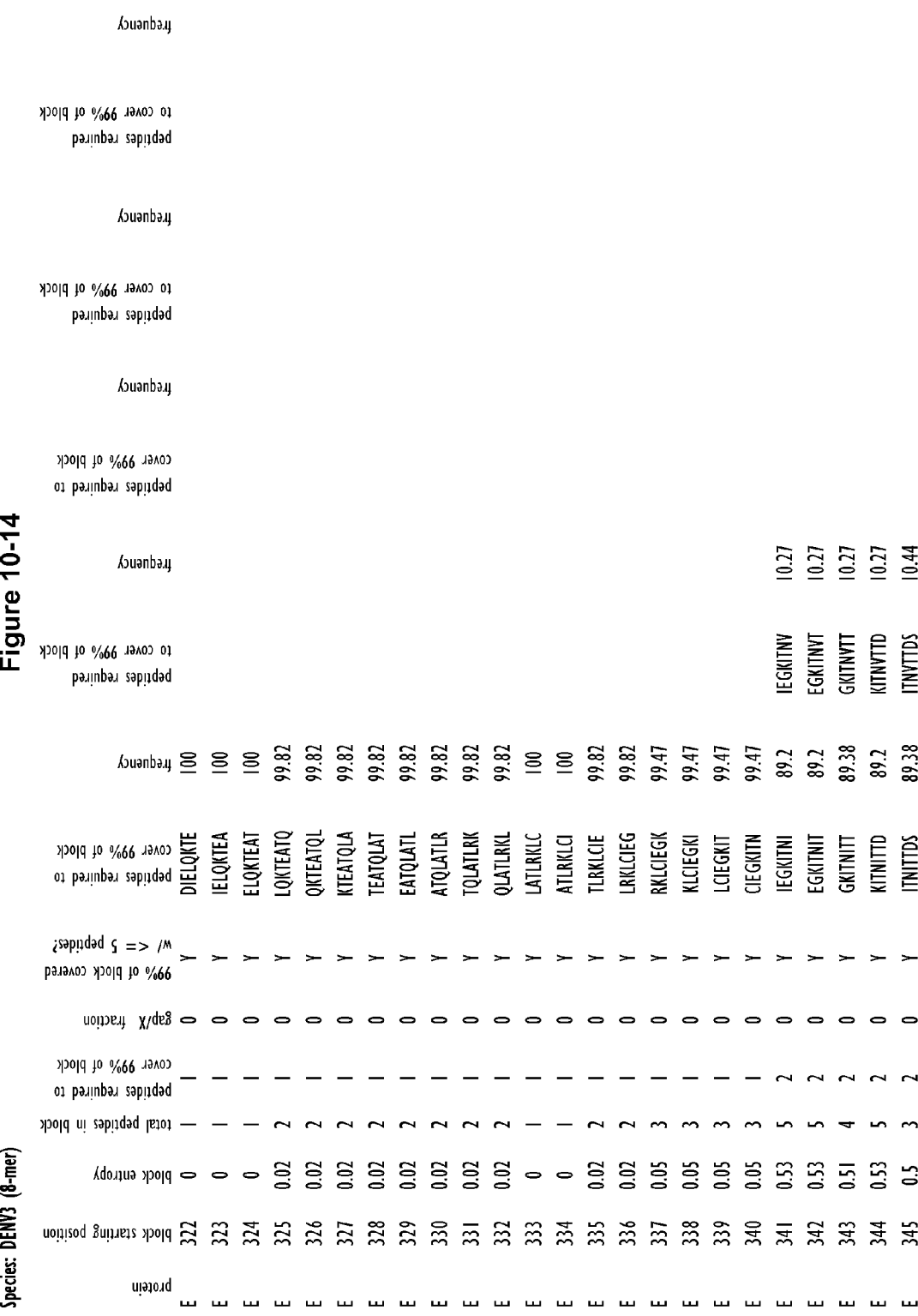
Figures 10, 11, 12, 13, 14, 15, 16, 17, 18, 19, 20, 21, 22, 23, 24, 25, 26, 27, 28, 29, 30, 31, 32, 33, 34:
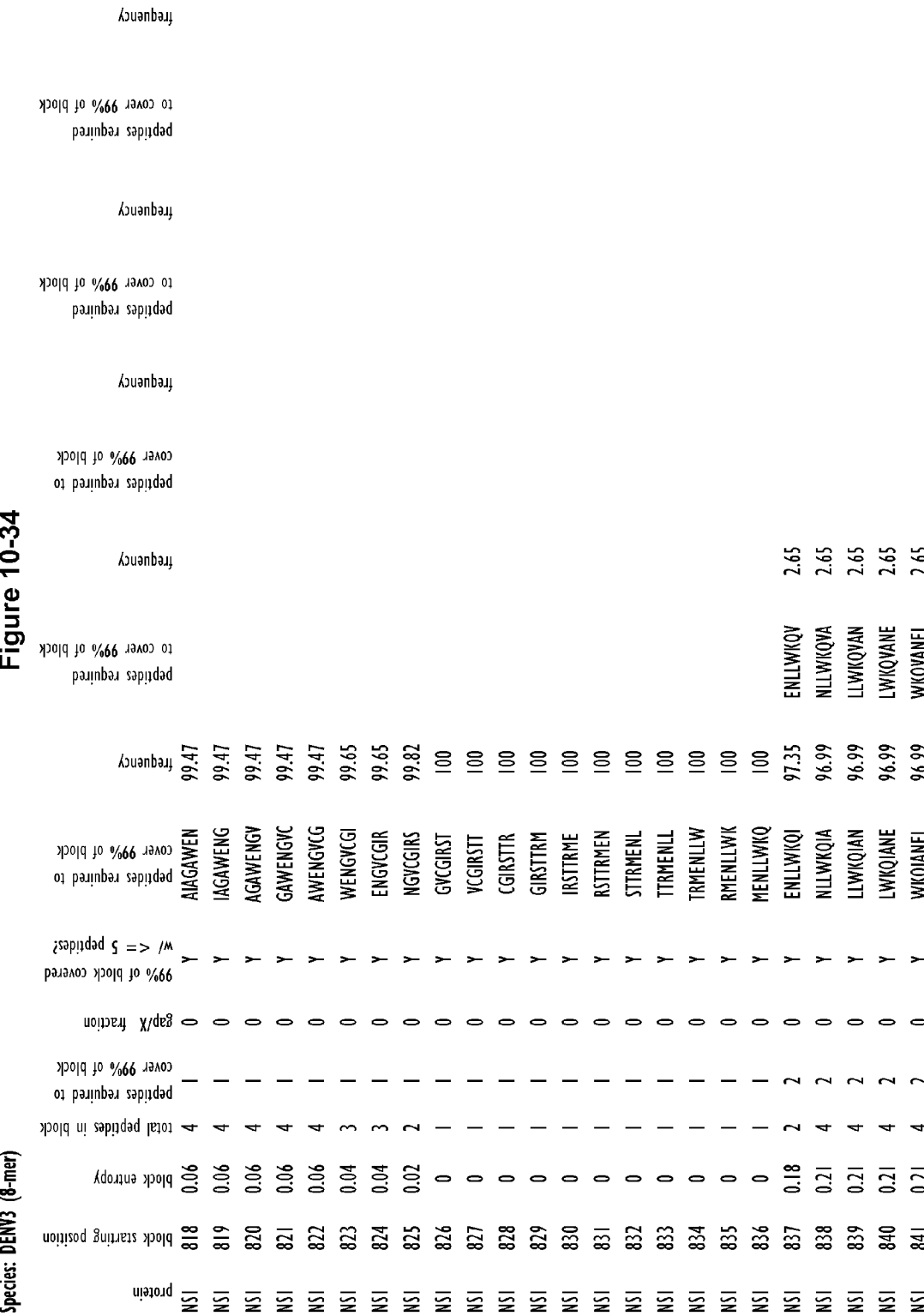
Figures 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44:
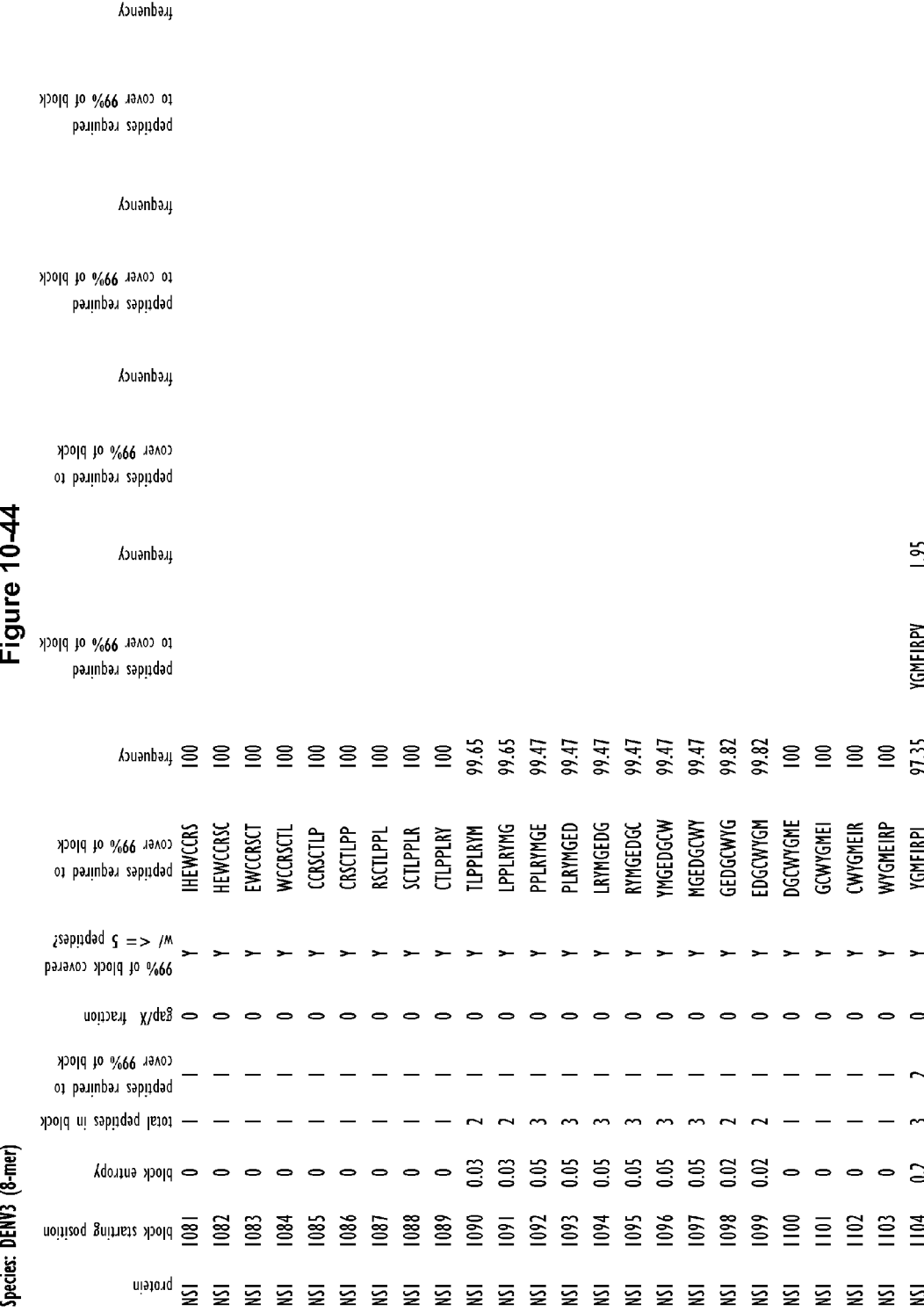
Figures 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54:
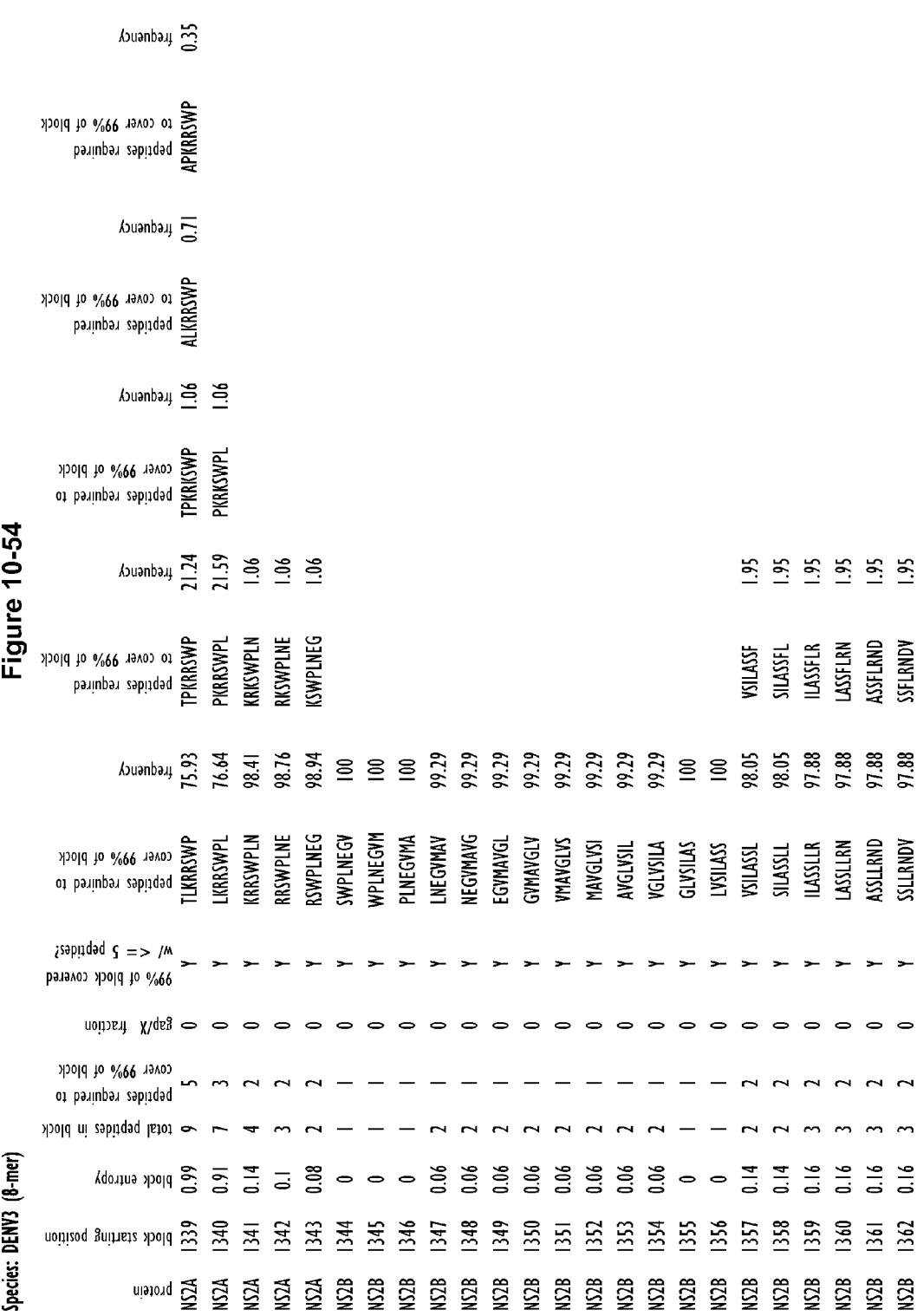
FIG. 51 is a graph of the number of 9-mer peptides required to "cover 99% of the block" (i.e. to achieve a cumulative fraction of polypeptides in the MSA, by adding together each unique peptide's frequency within the polypeptides in the MSA, of at least 99%) in norovirus peptide blocks, for each possible start position in the proteome.
FIG. 52 is a graph of the number of 9-mer peptides required to "cover 99% of the block" (i.e. to achieve a cumulative fraction of polypeptides in the MSA, by adding together each unique peptide's frequency within the polypeptides in the MSA, of at least 99%) in a norovirus peptide block, sorted in increasing order of required number of peptides.
Figures 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55:
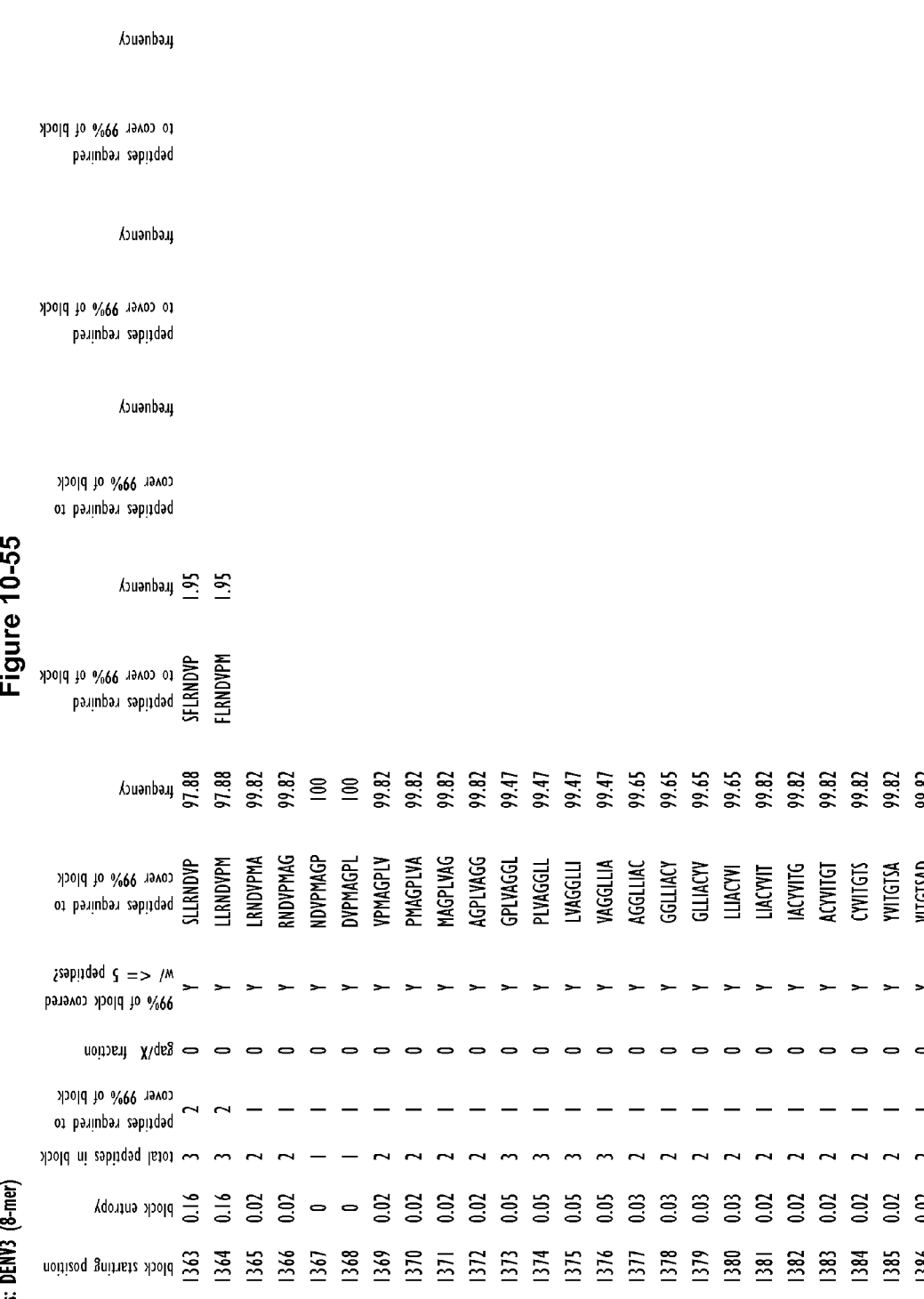
Figures 10, 75:
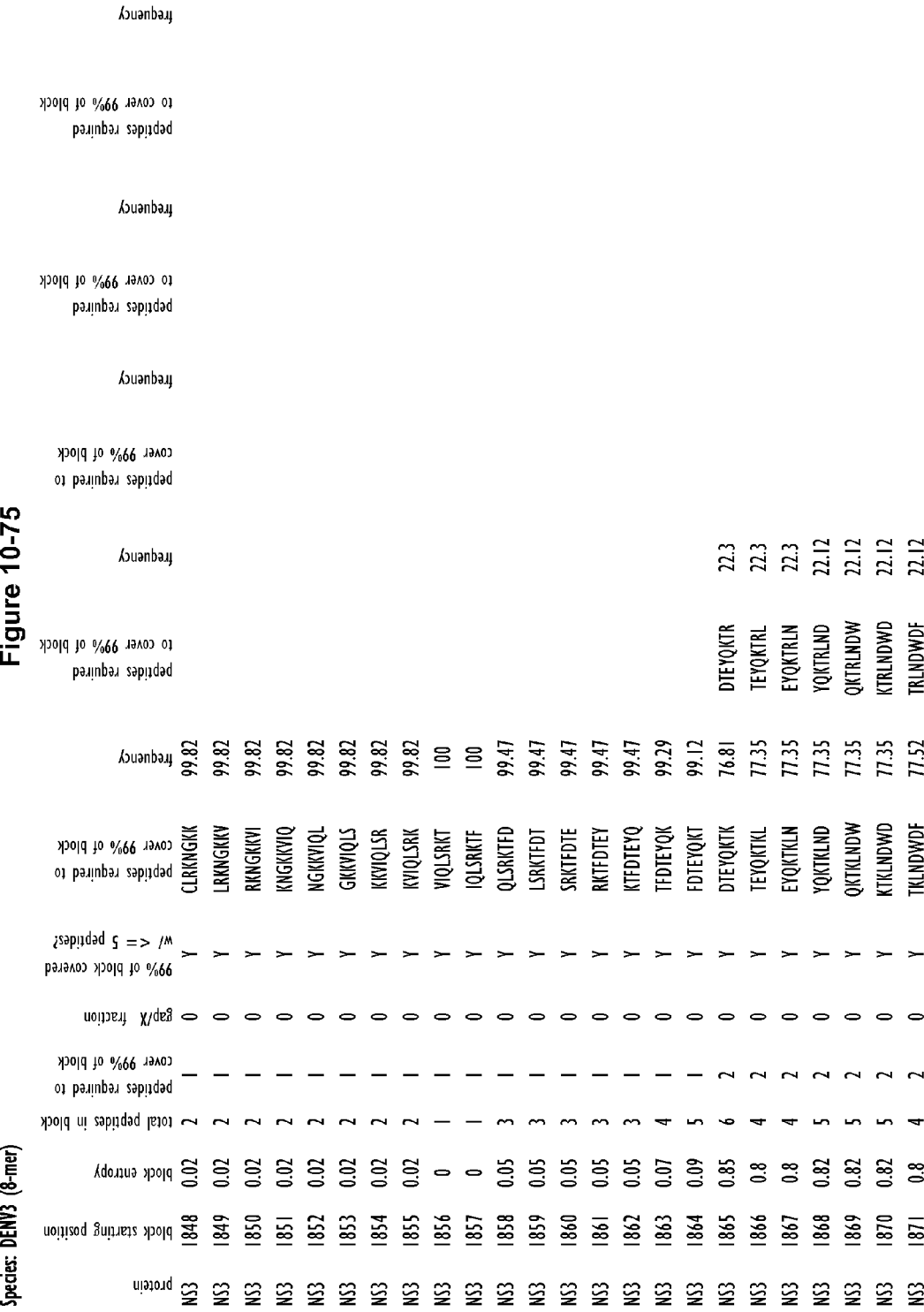
Figures 10, 77:
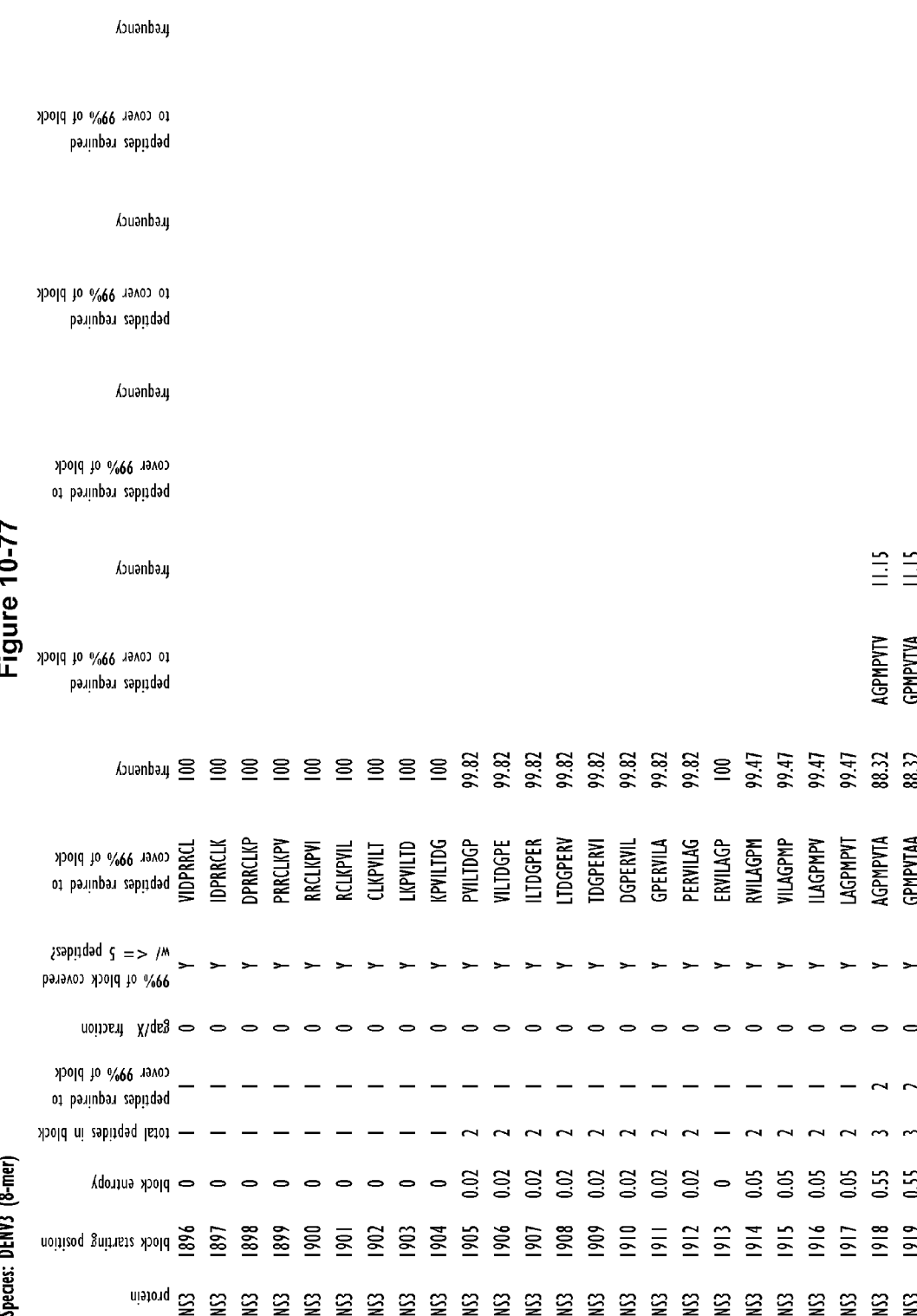
Figures 10, 81:
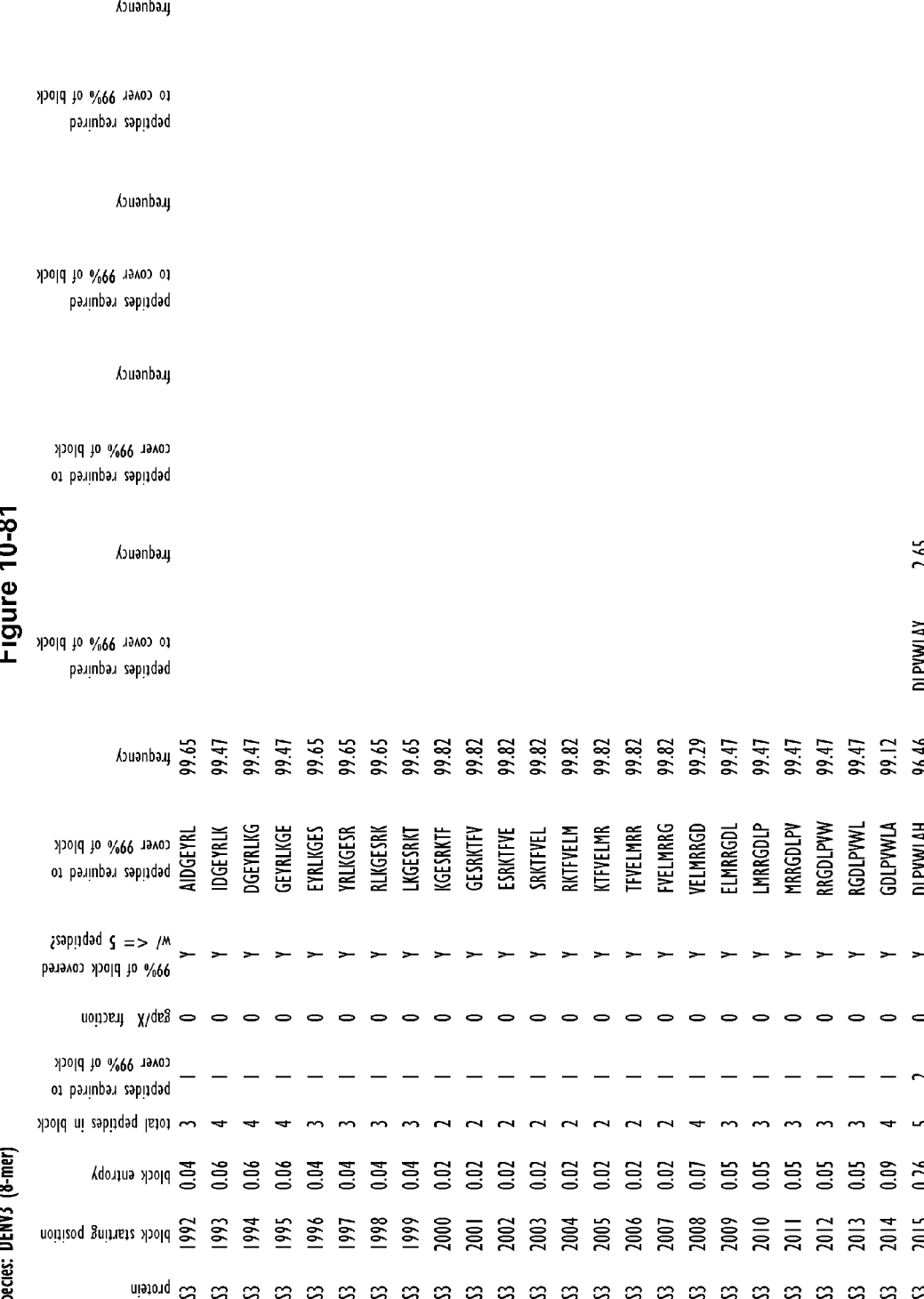
Figures 10, 84:
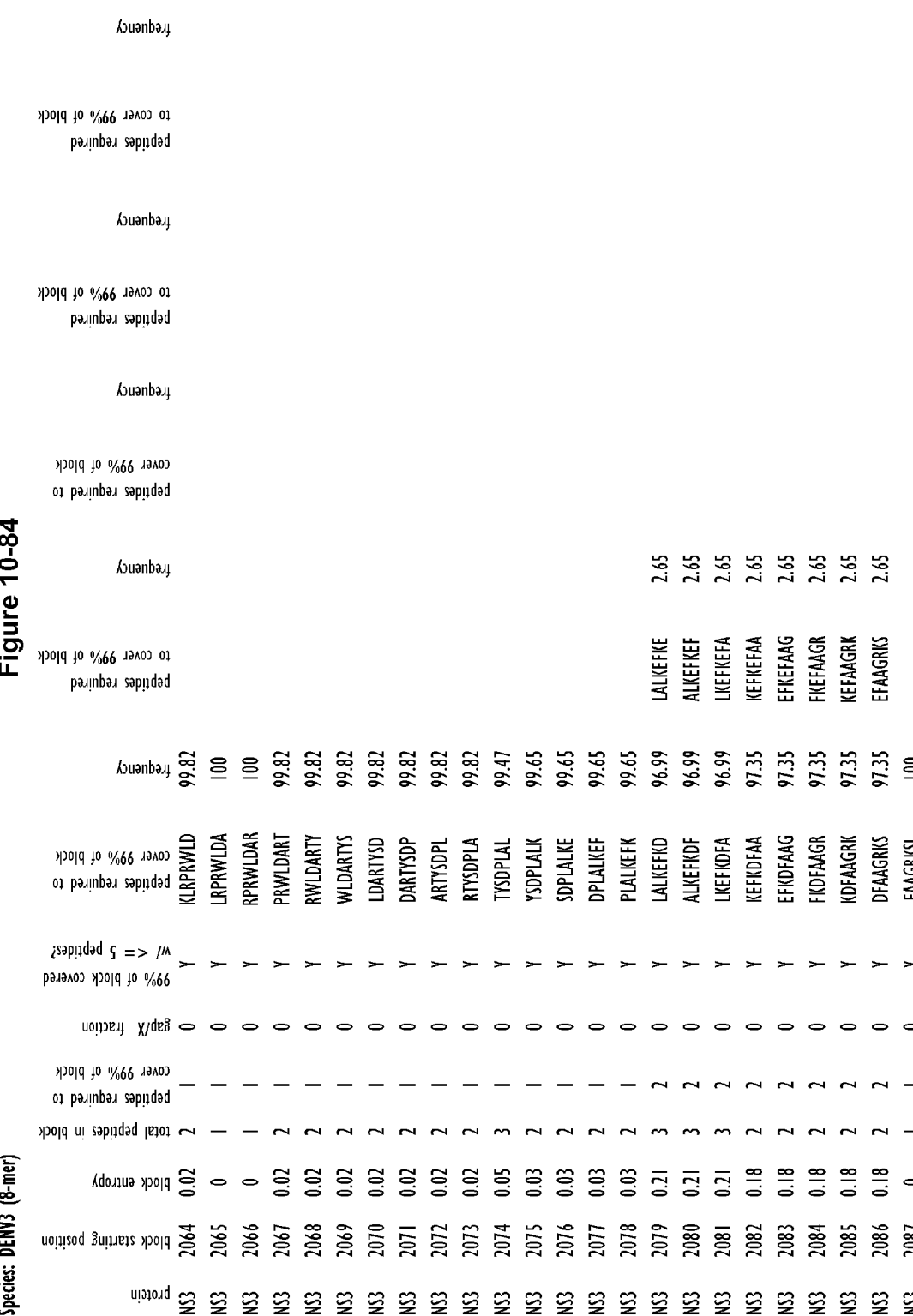
Figures 10, 96:
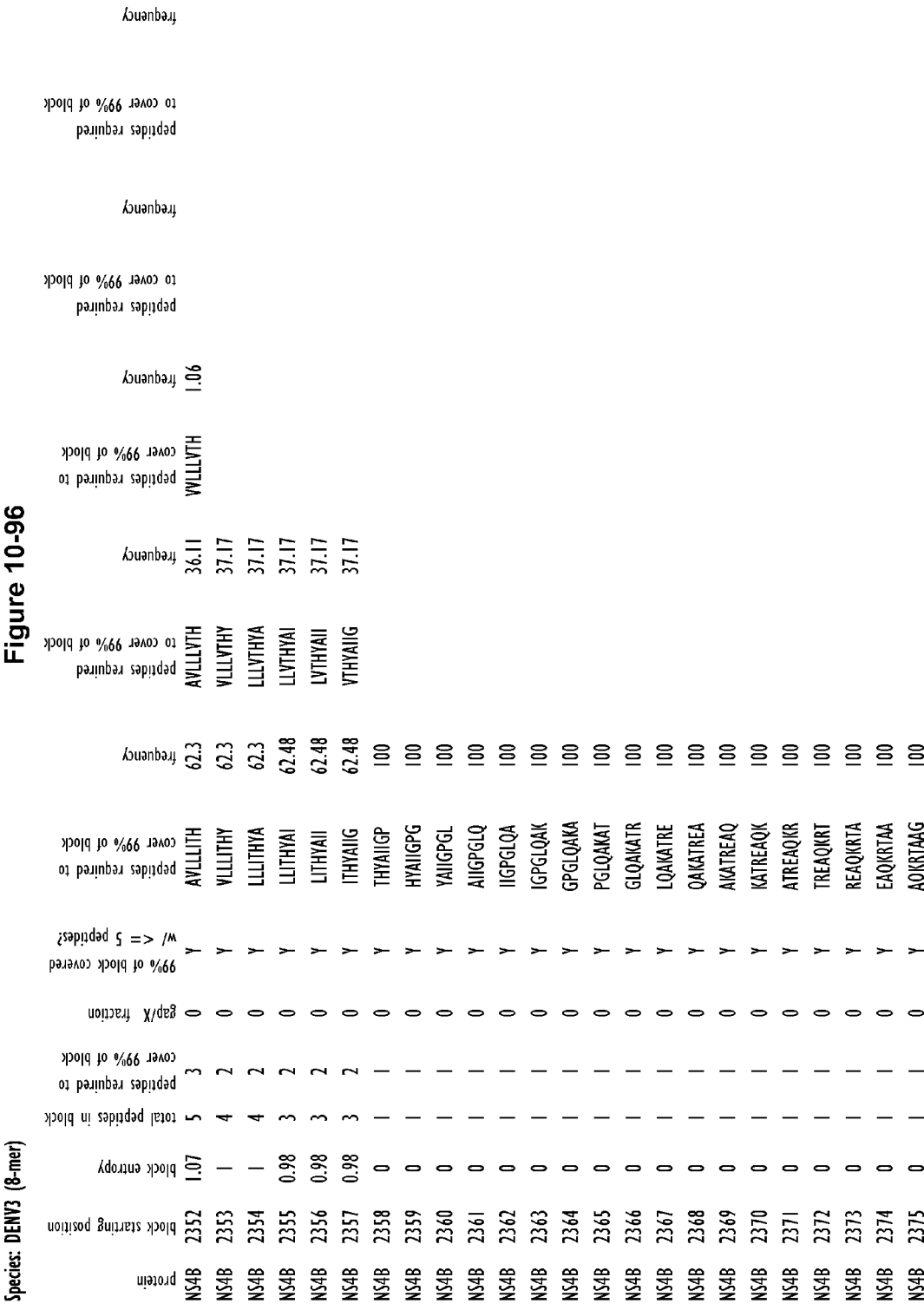
Figures 10, 110:
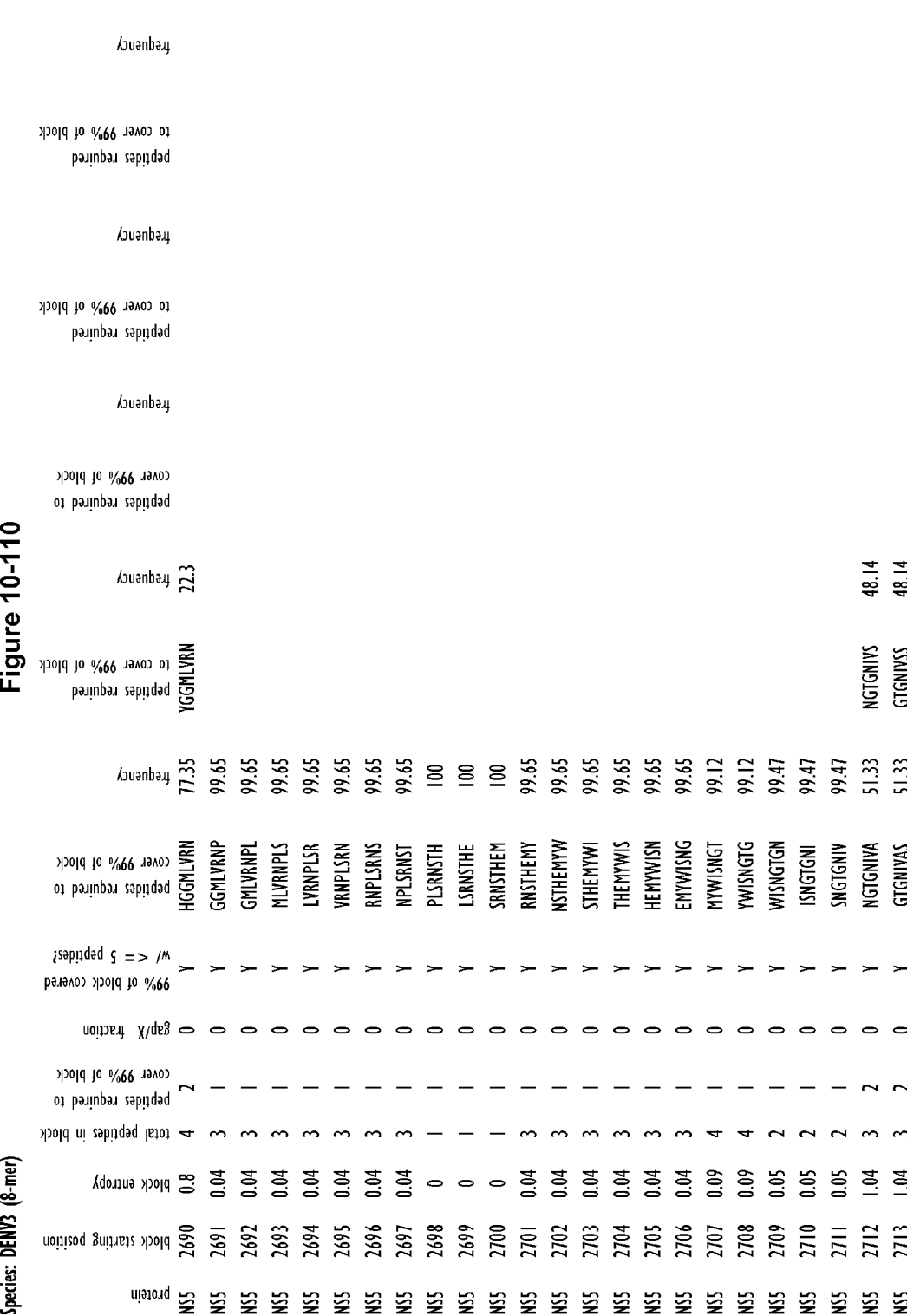
Figures 10, 128:
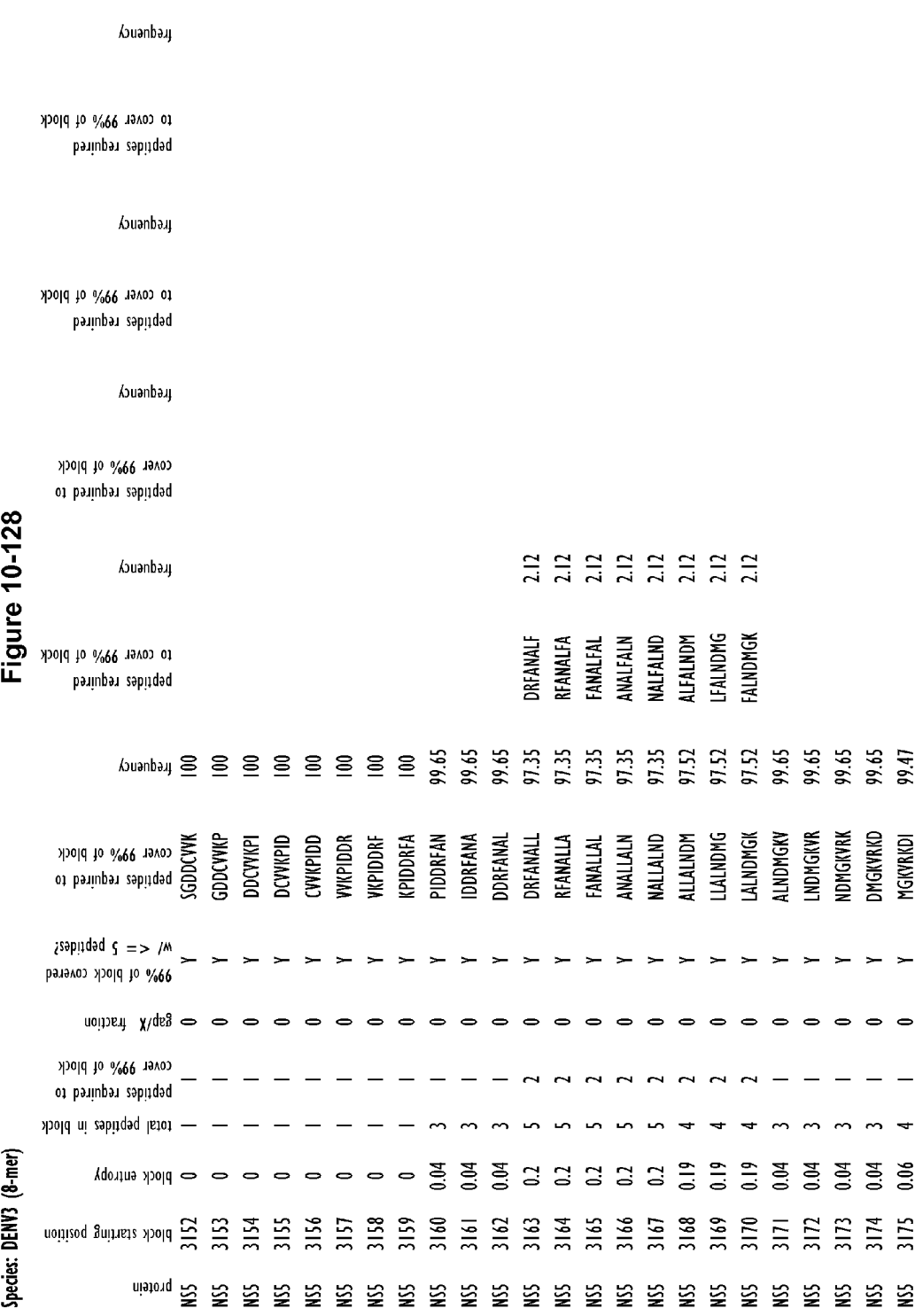
Figures 3, 11:
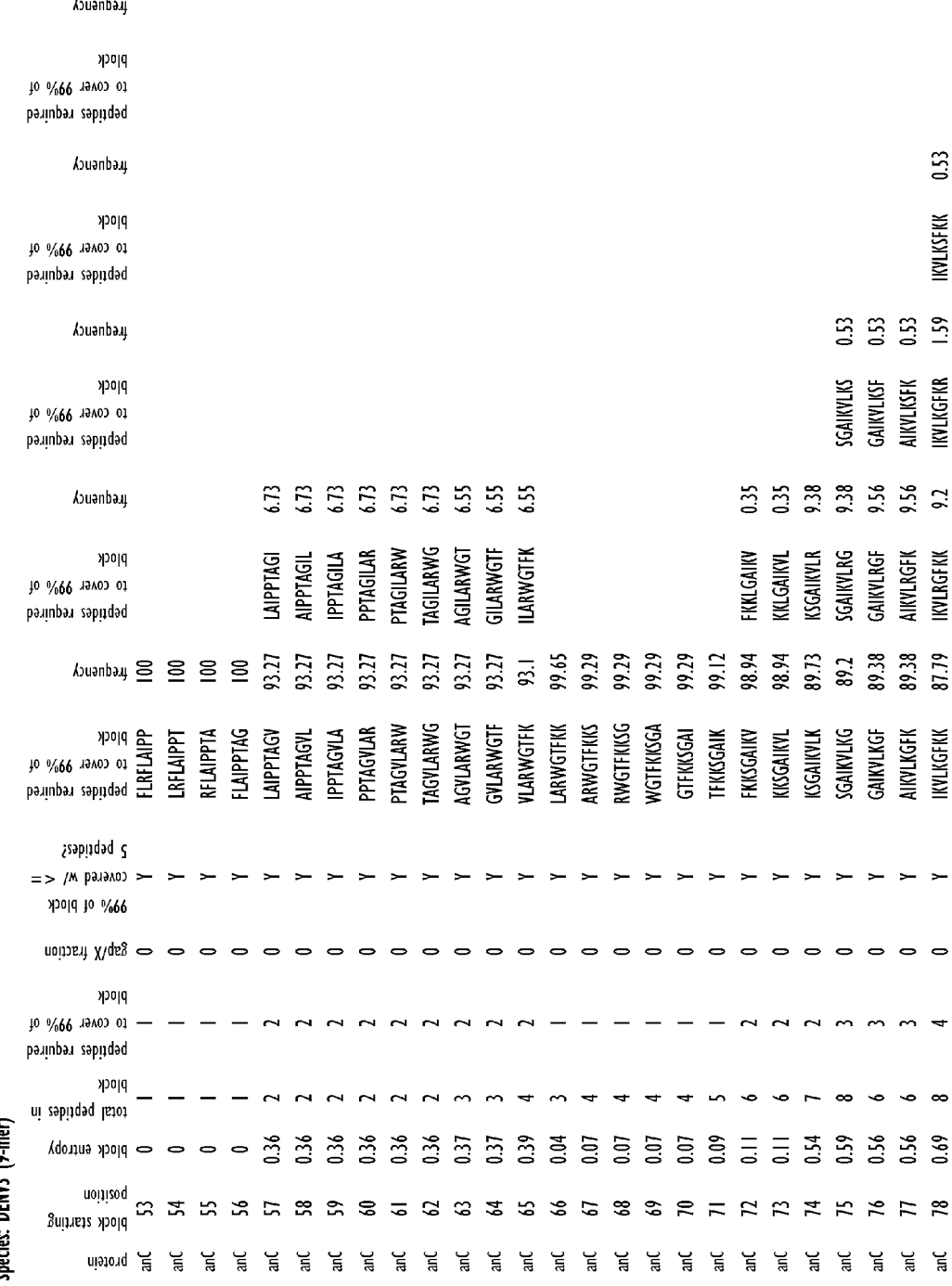
Figures 7, 11:
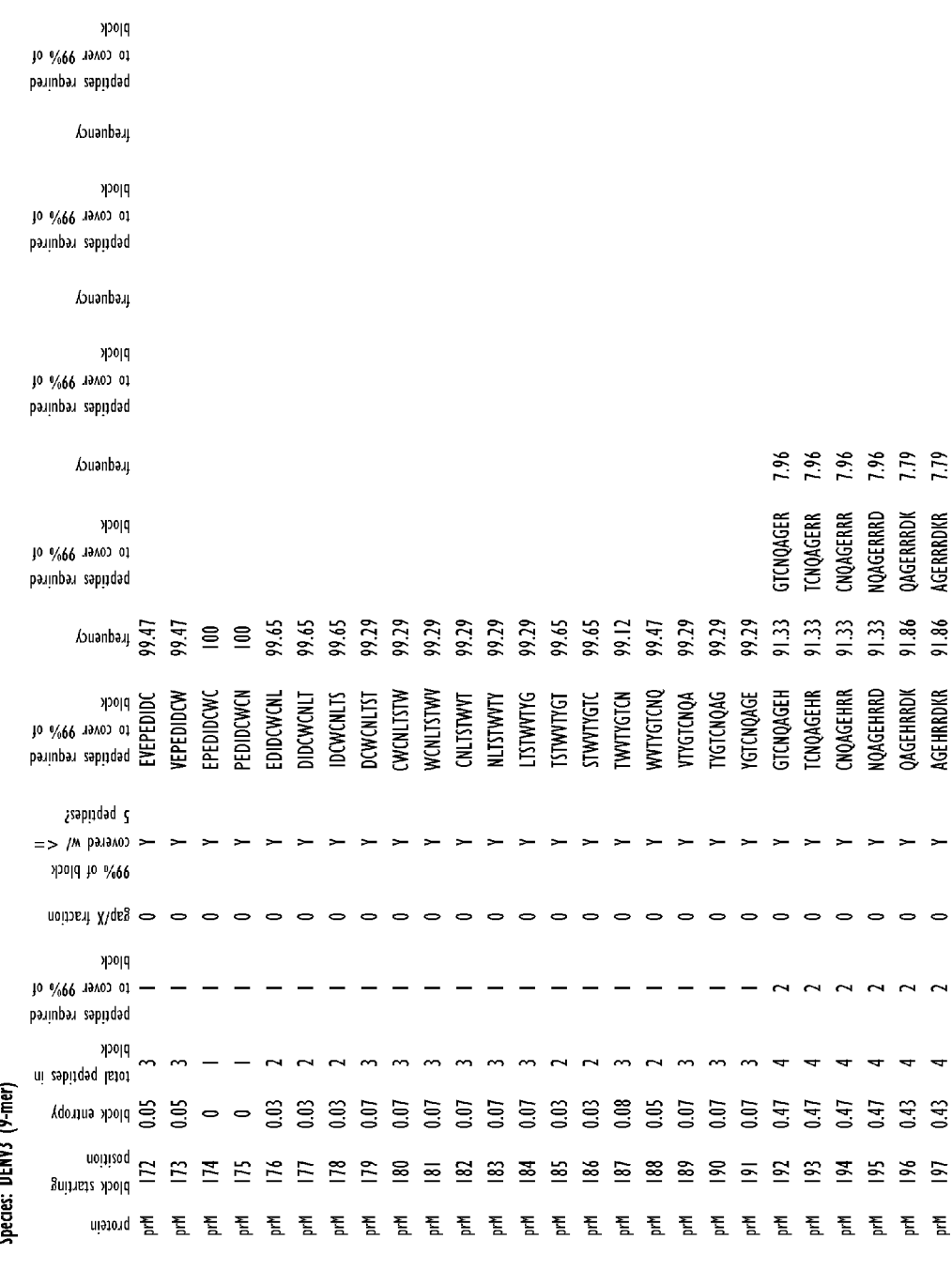
Figures 9, 11:
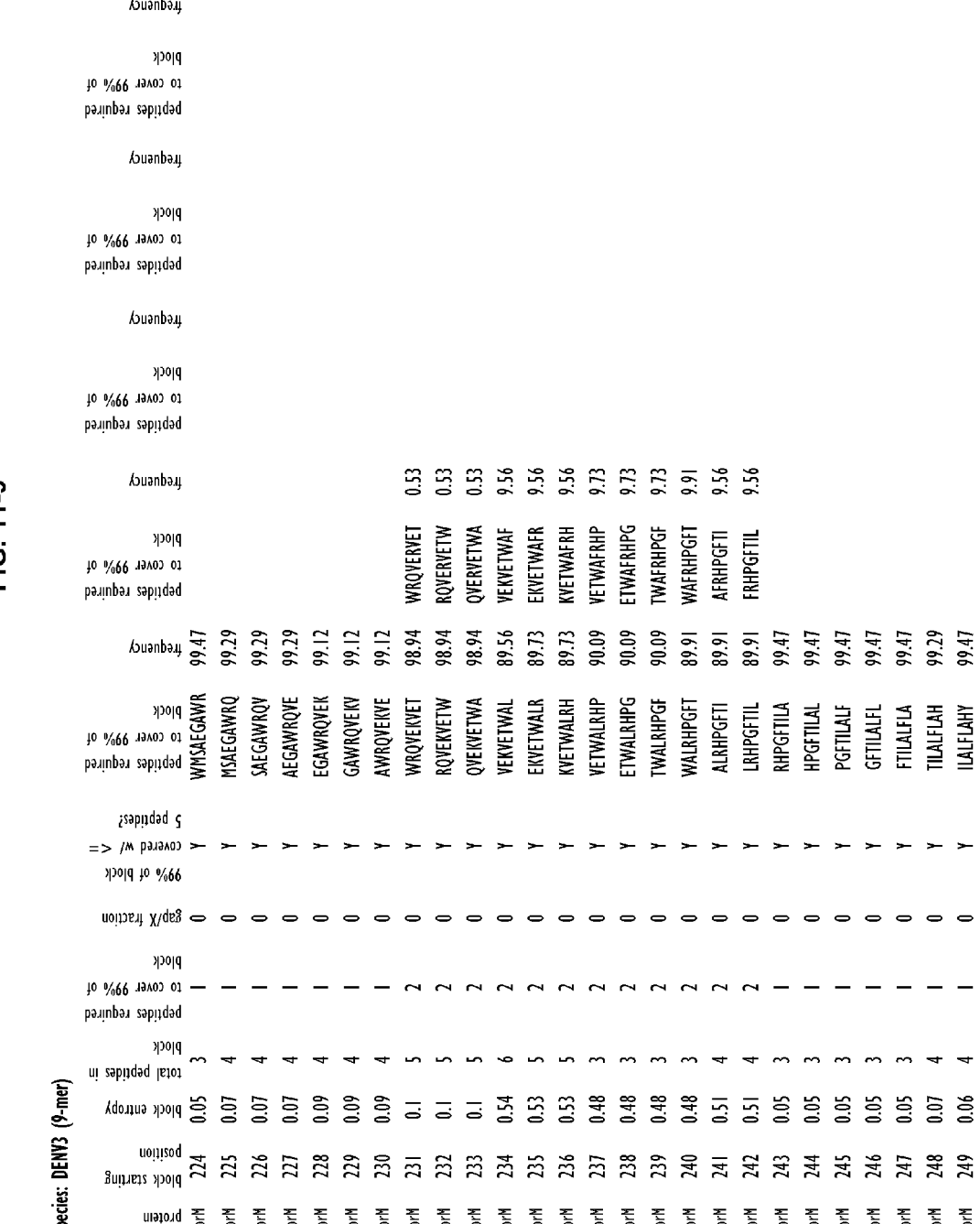
Figures 11, 12, 13:
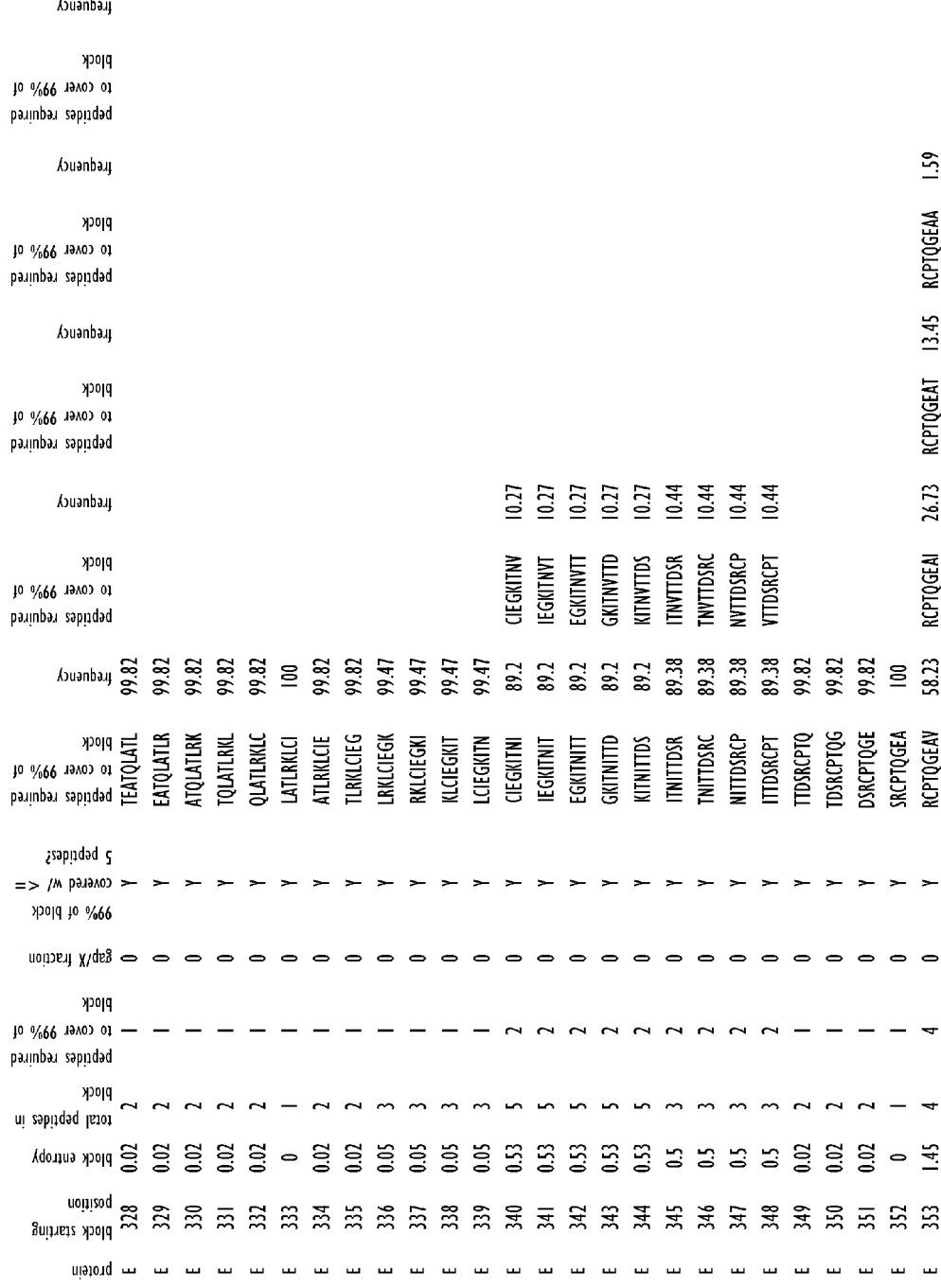
Figures 11, 12, 13, 14, 15:
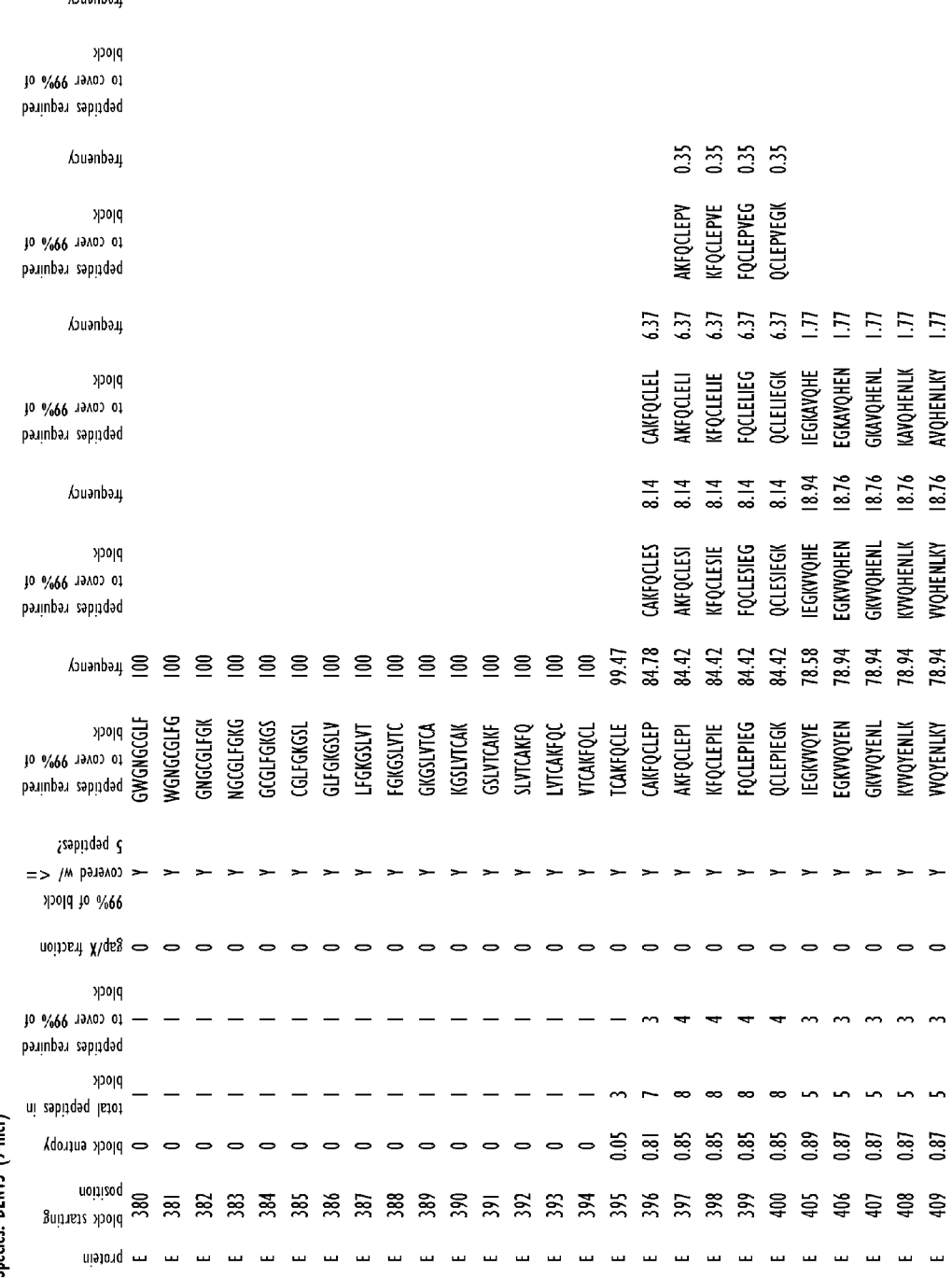
Figures 11, 12, 13, 14, 15, 16, 17, 18:
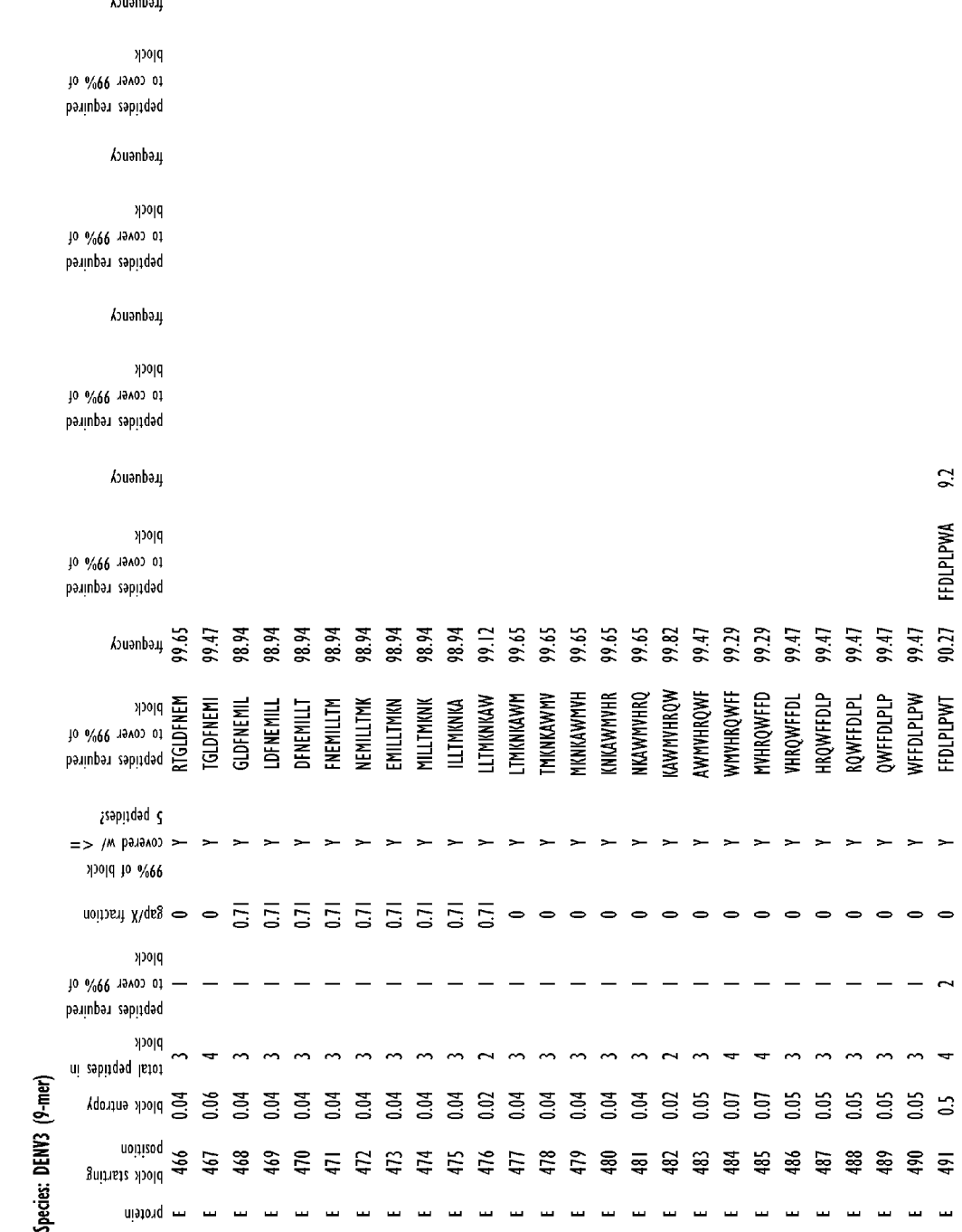
Figures 11, 12, 13, 14, 15, 16, 17, 18, 19, 20, 21, 22, 23, 24, 25, 26:
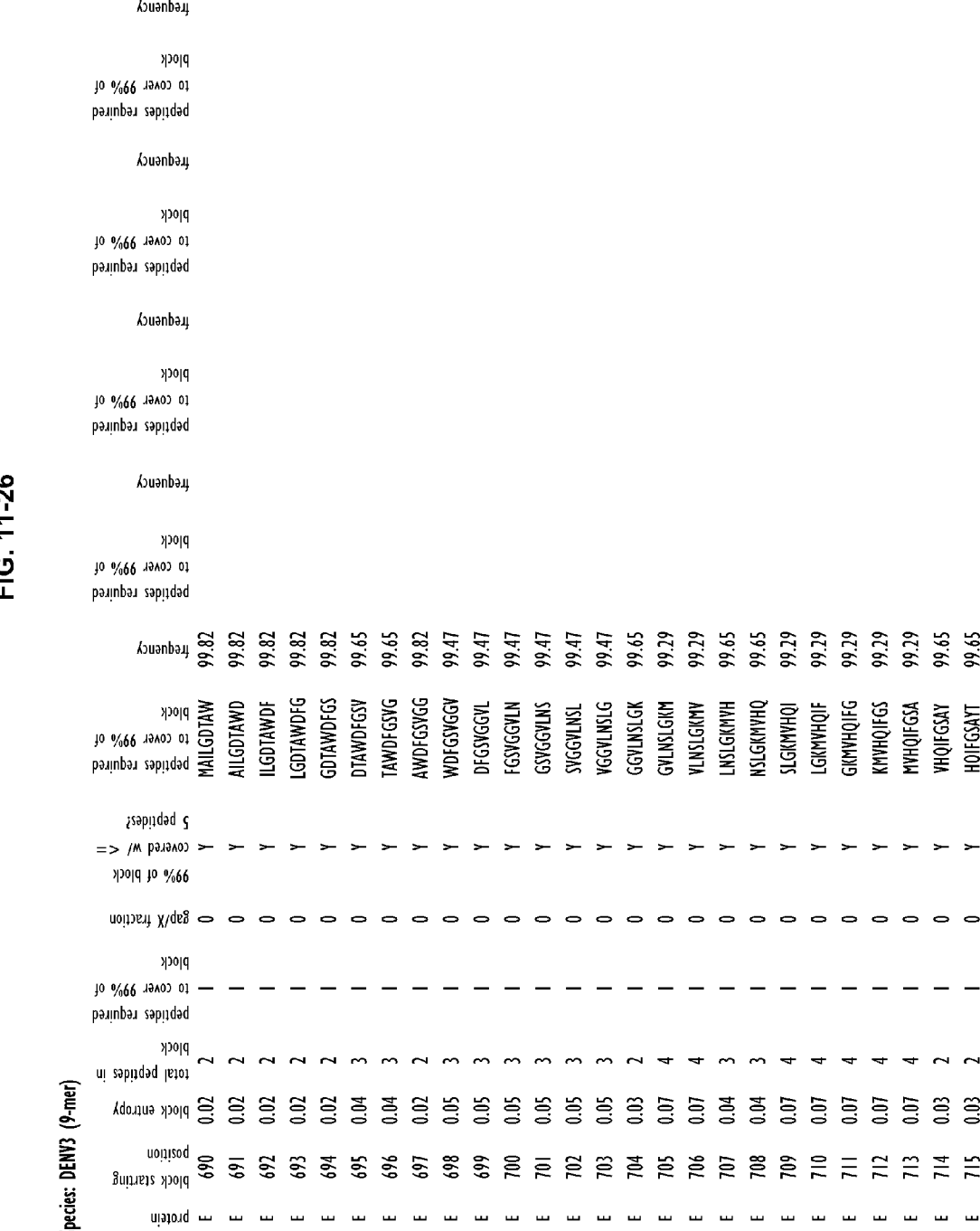
Figures 11, 12, 13, 14, 15, 16, 17, 18, 19, 20, 21, 22, 23, 24, 25, 26, 27, 28, 29, 30, 31:
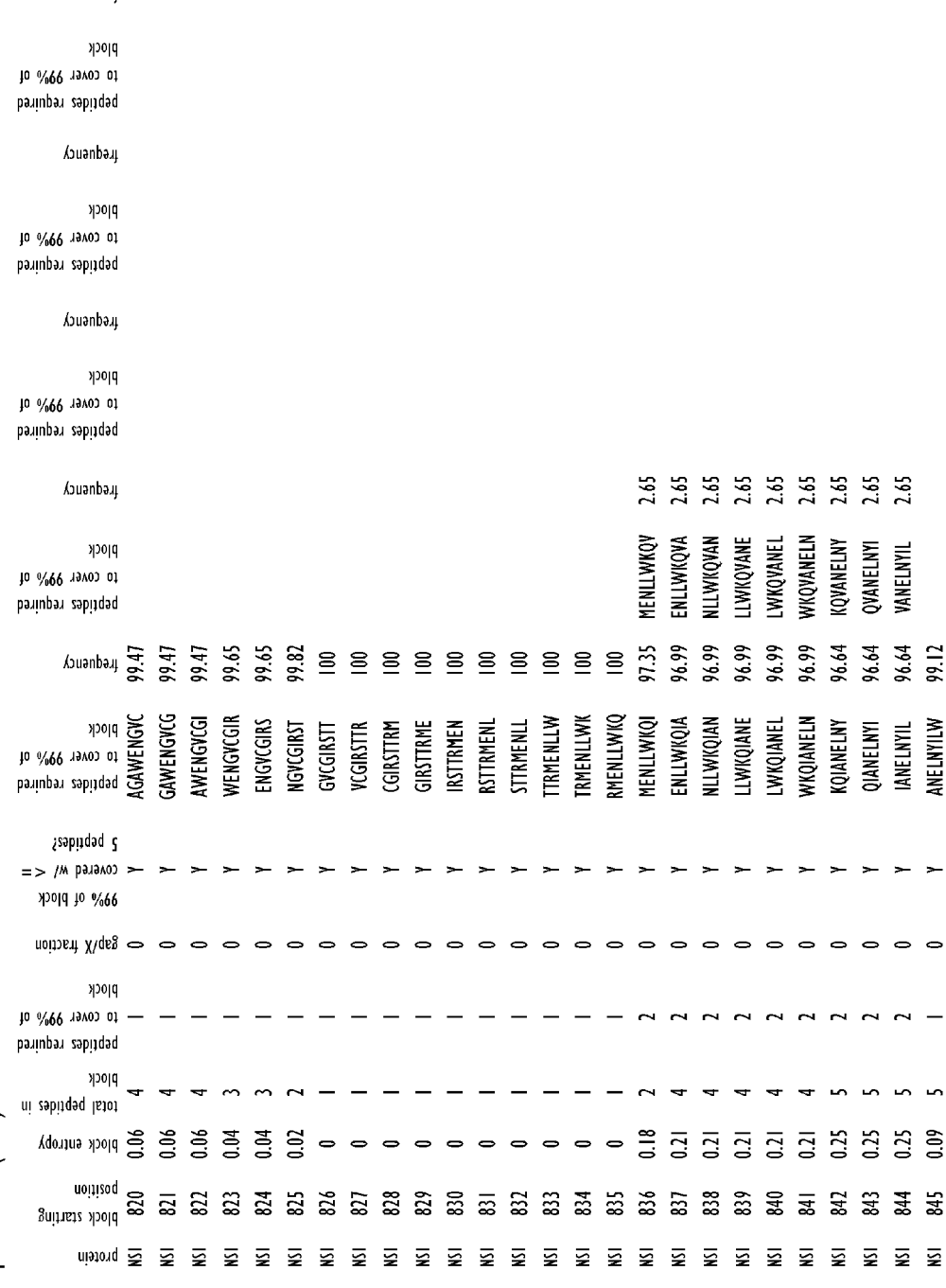
Figures 11, 12, 13, 14, 15, 16, 17, 18, 19, 20, 21, 22, 23, 24, 25, 26, 27, 28, 29, 30, 31, 32, 33, 34:
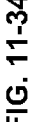
Figures 11, 12, 13, 14, 15, 16, 17, 18, 19, 20, 21, 22, 23, 24, 25, 26, 27, 28, 29, 30, 31, 32, 33, 34, 35, 36:
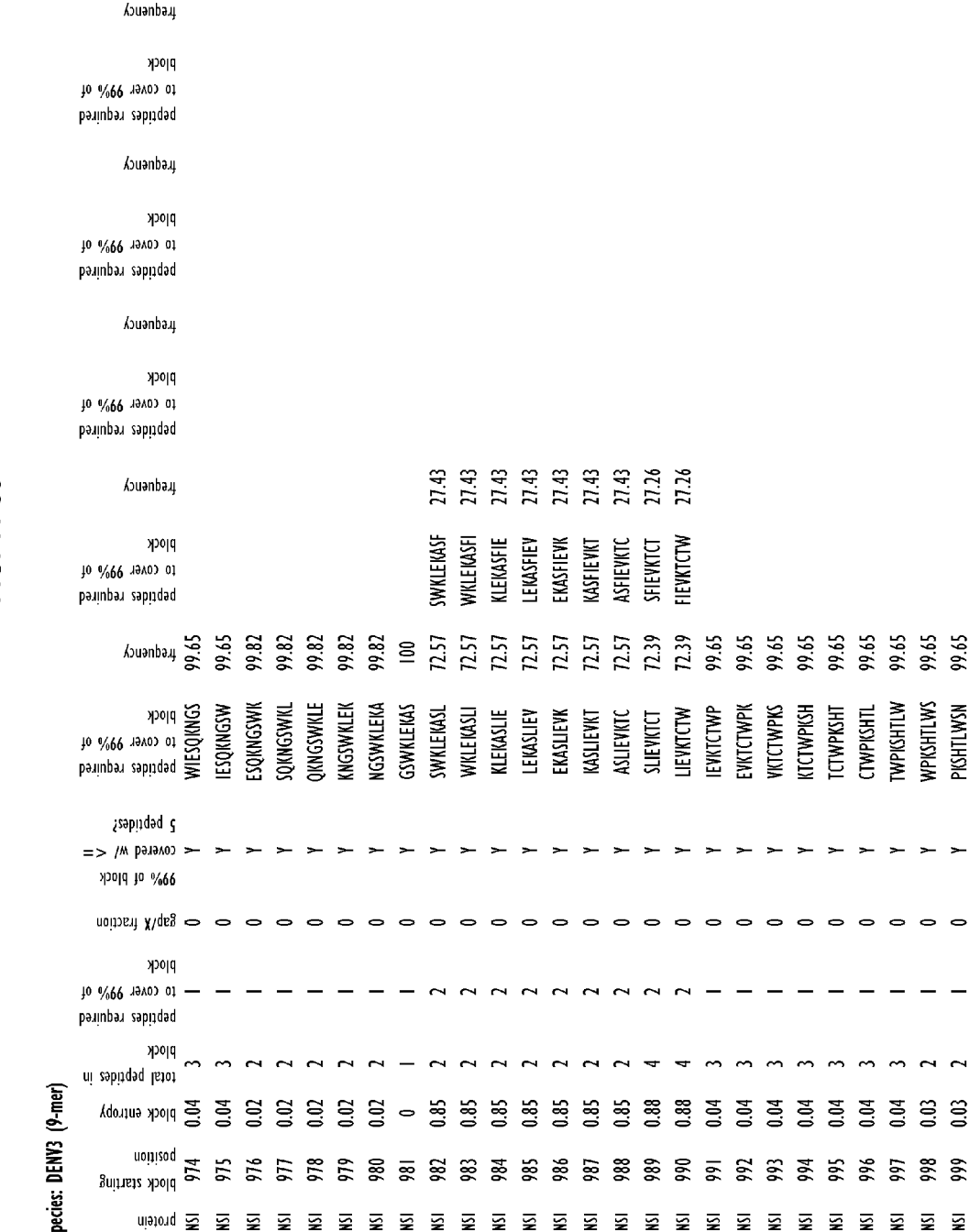
Figures 11, 12, 13, 14, 15, 16, 17, 18, 19, 20, 21, 22, 23, 24, 25, 26, 27, 28, 29, 30, 31, 32, 33, 34, 35, 36, 37:
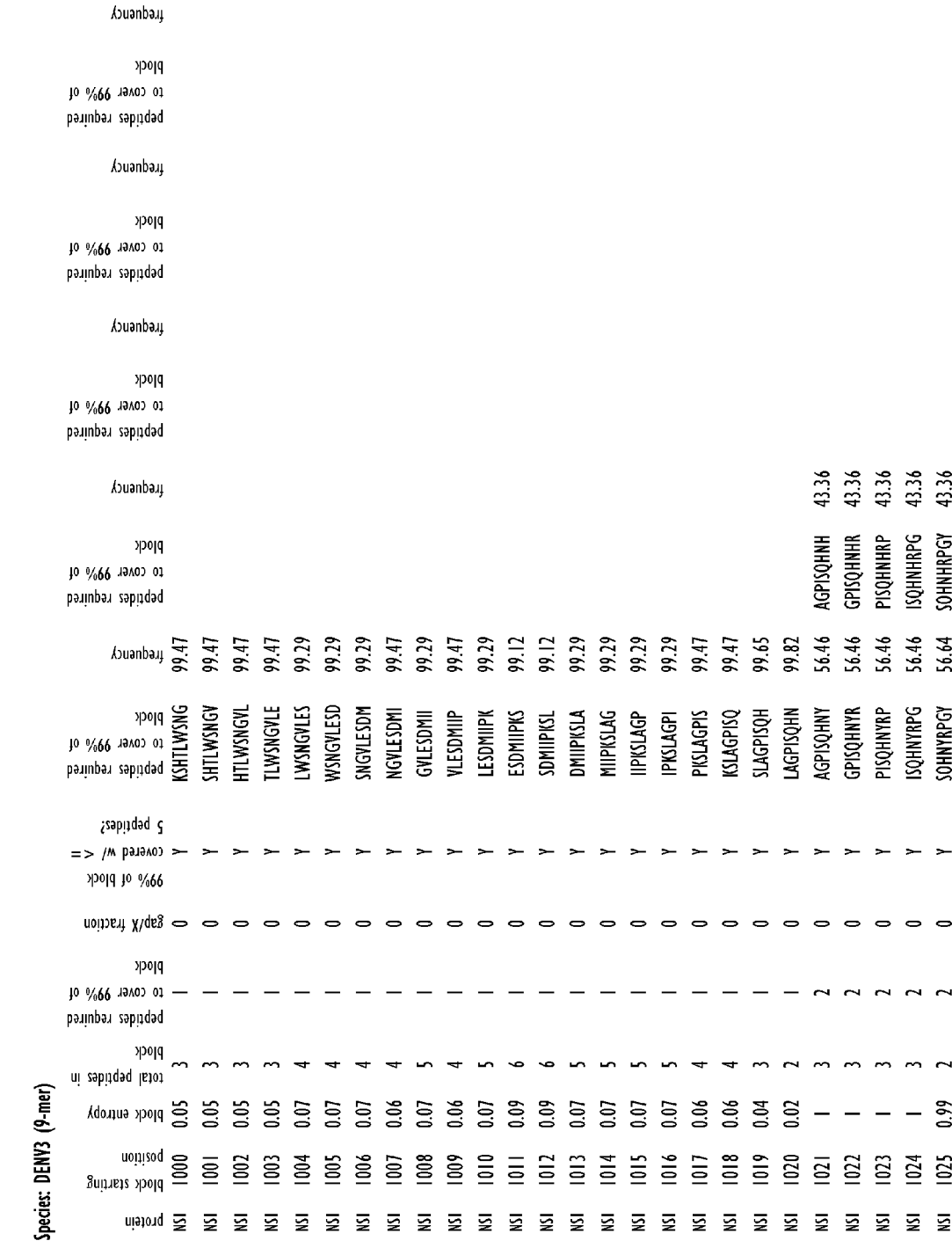
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40:
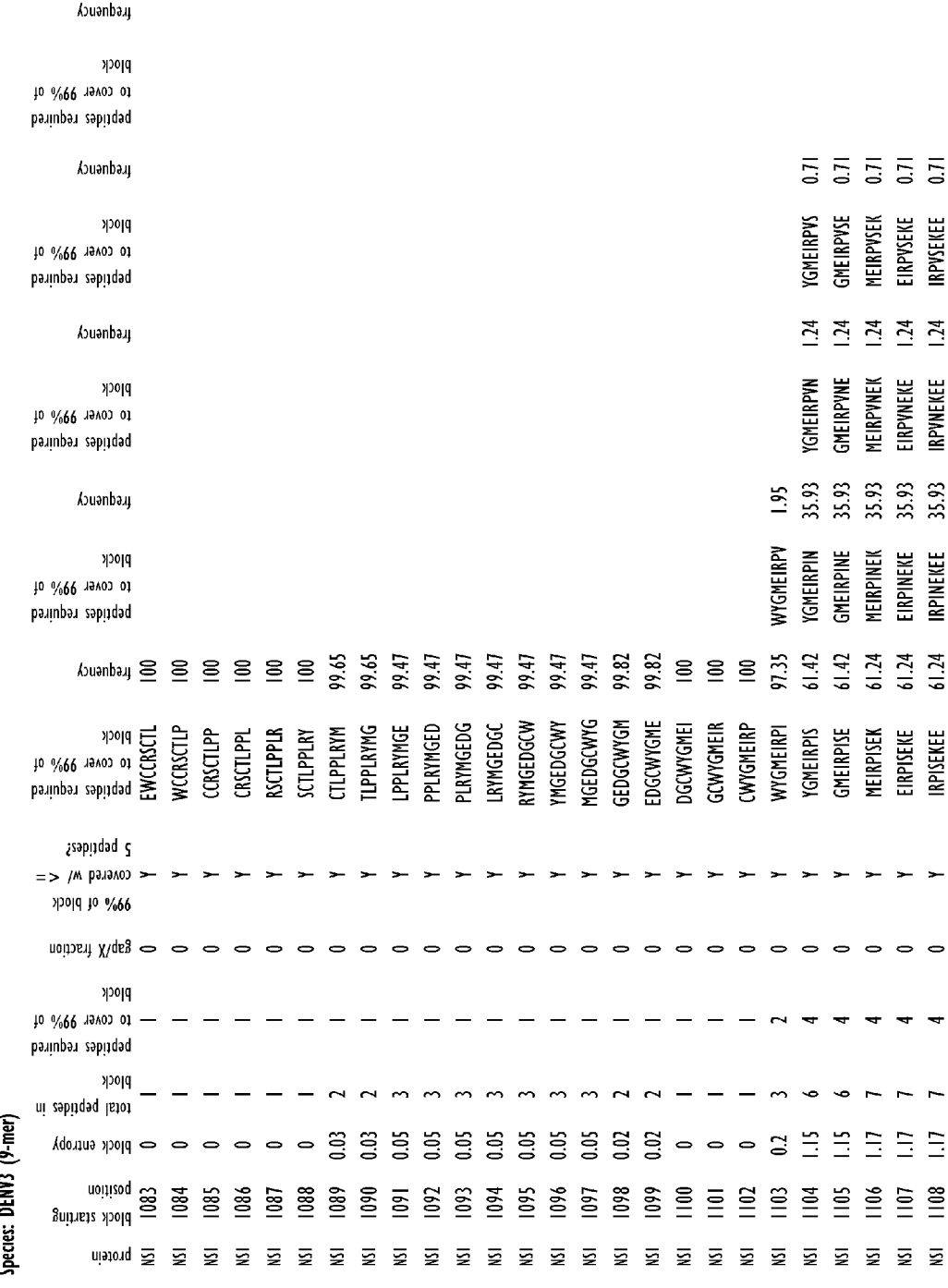
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42:
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44:
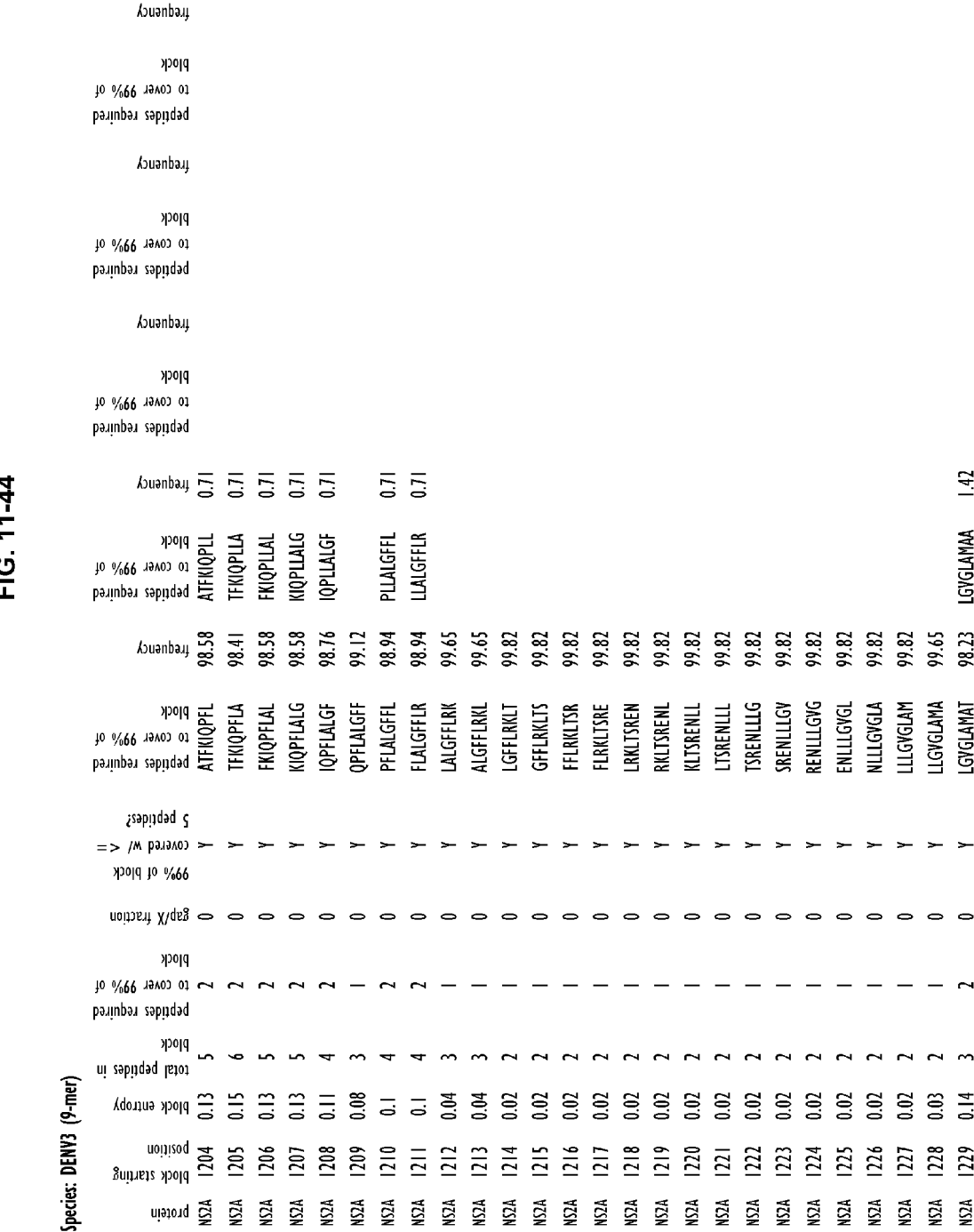
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49:
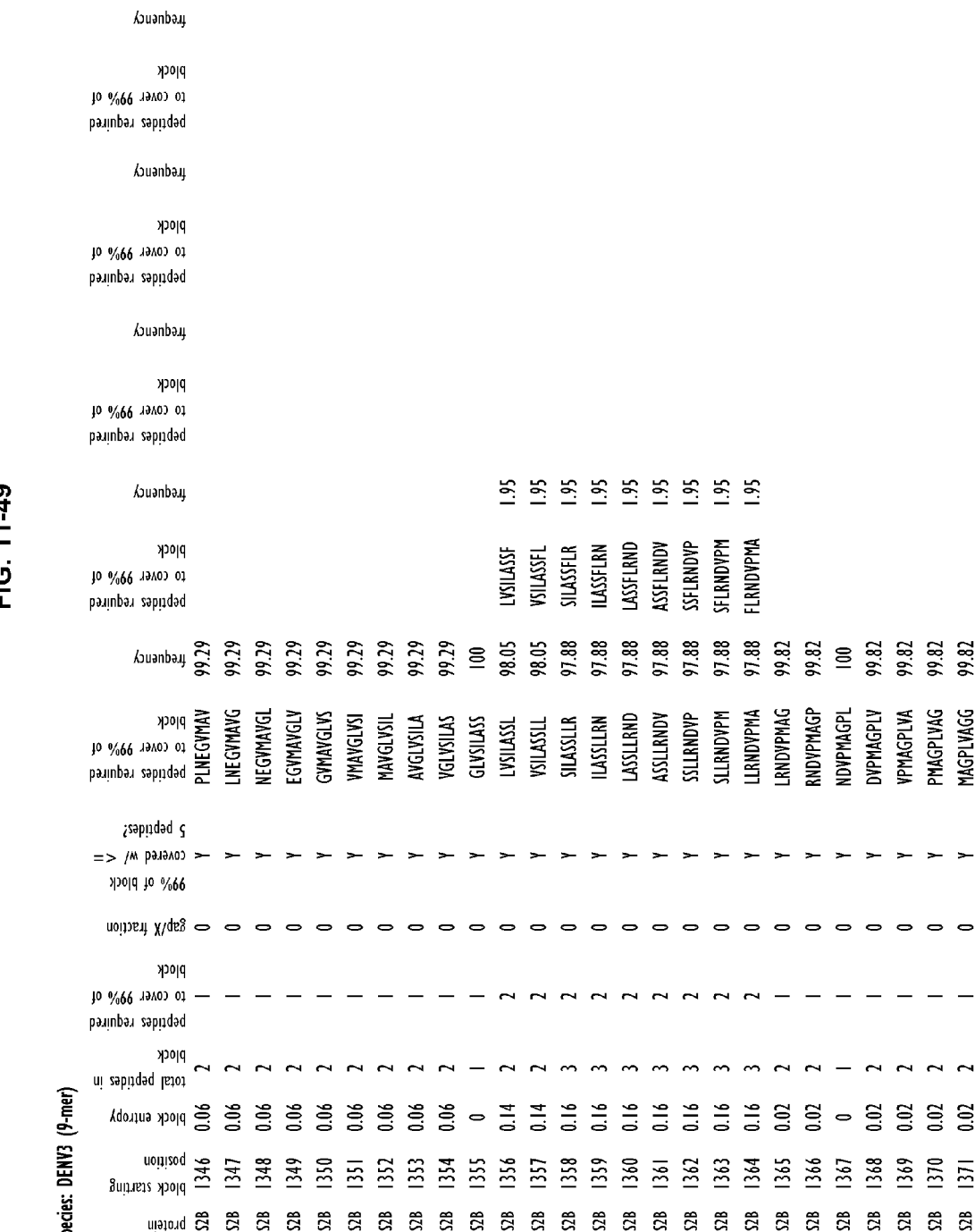
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51:
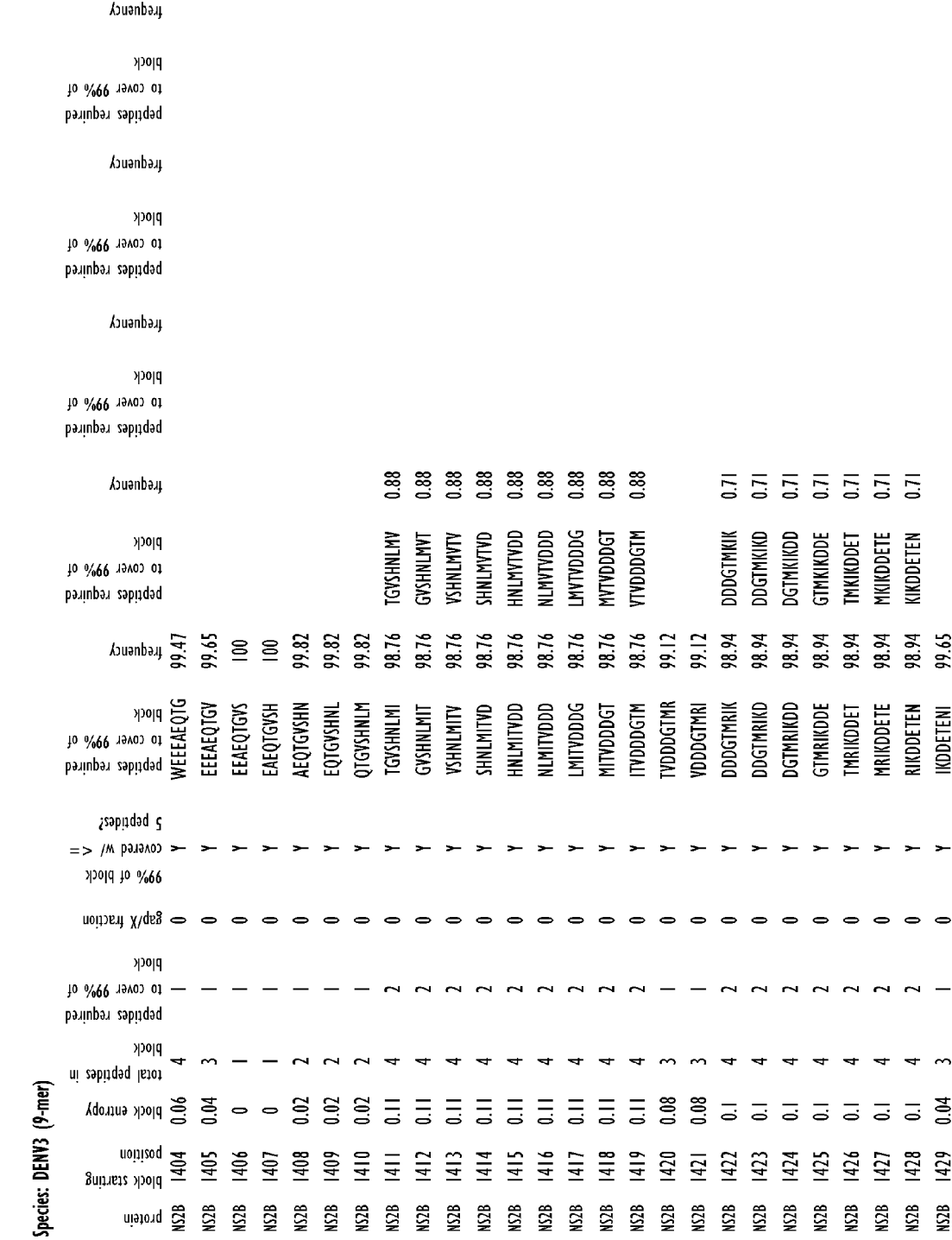
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52:
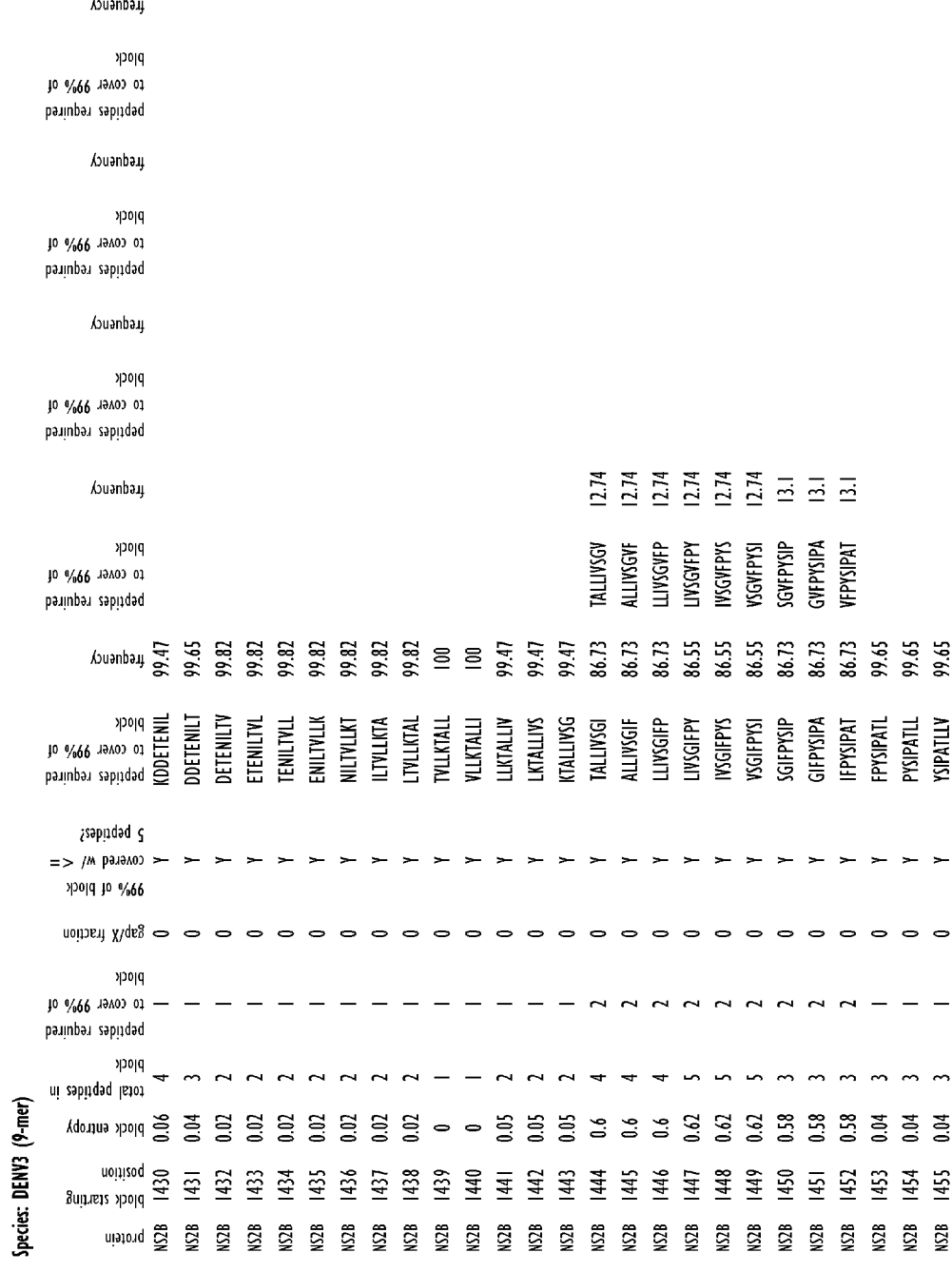
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53:
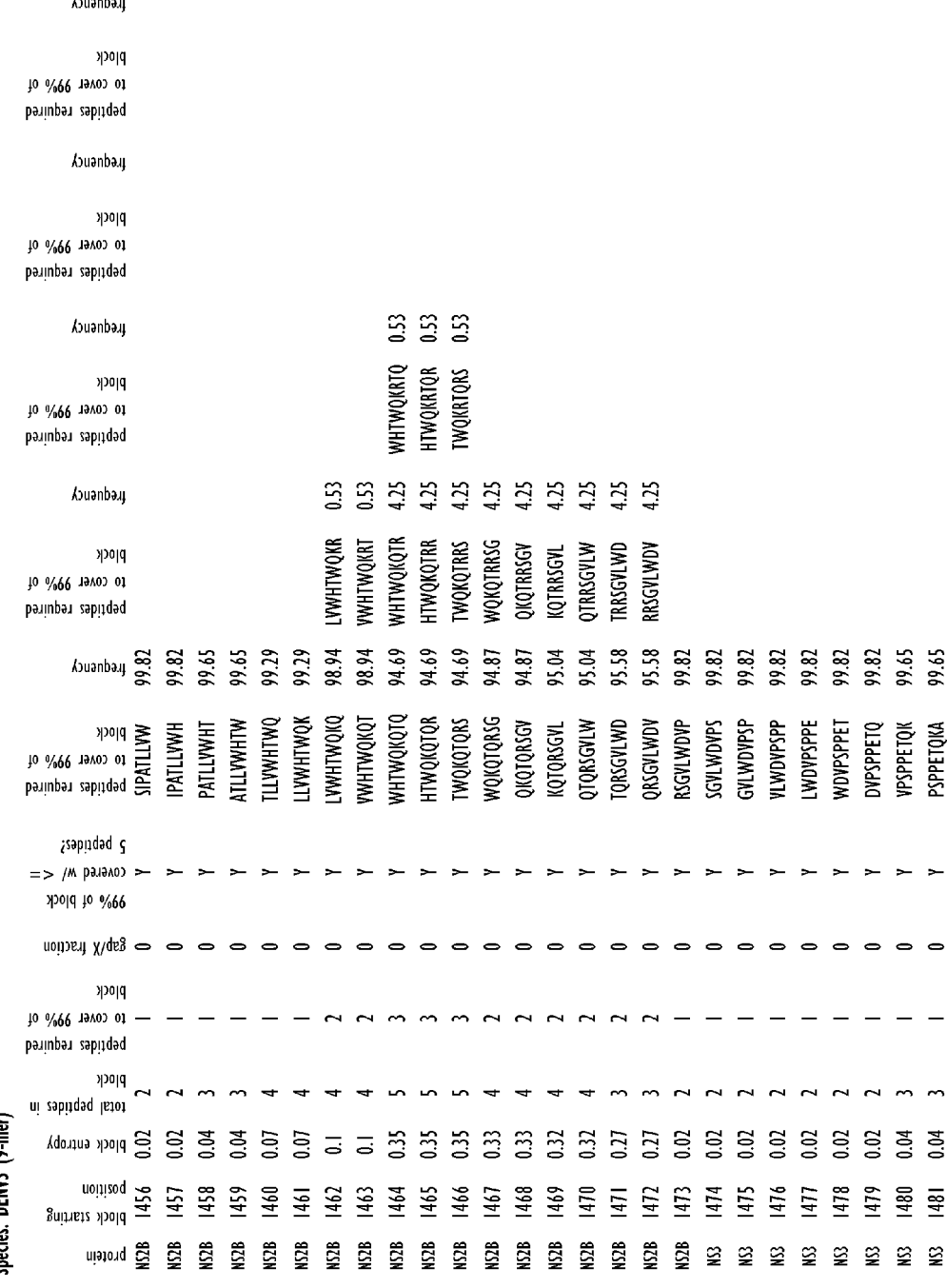
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57:
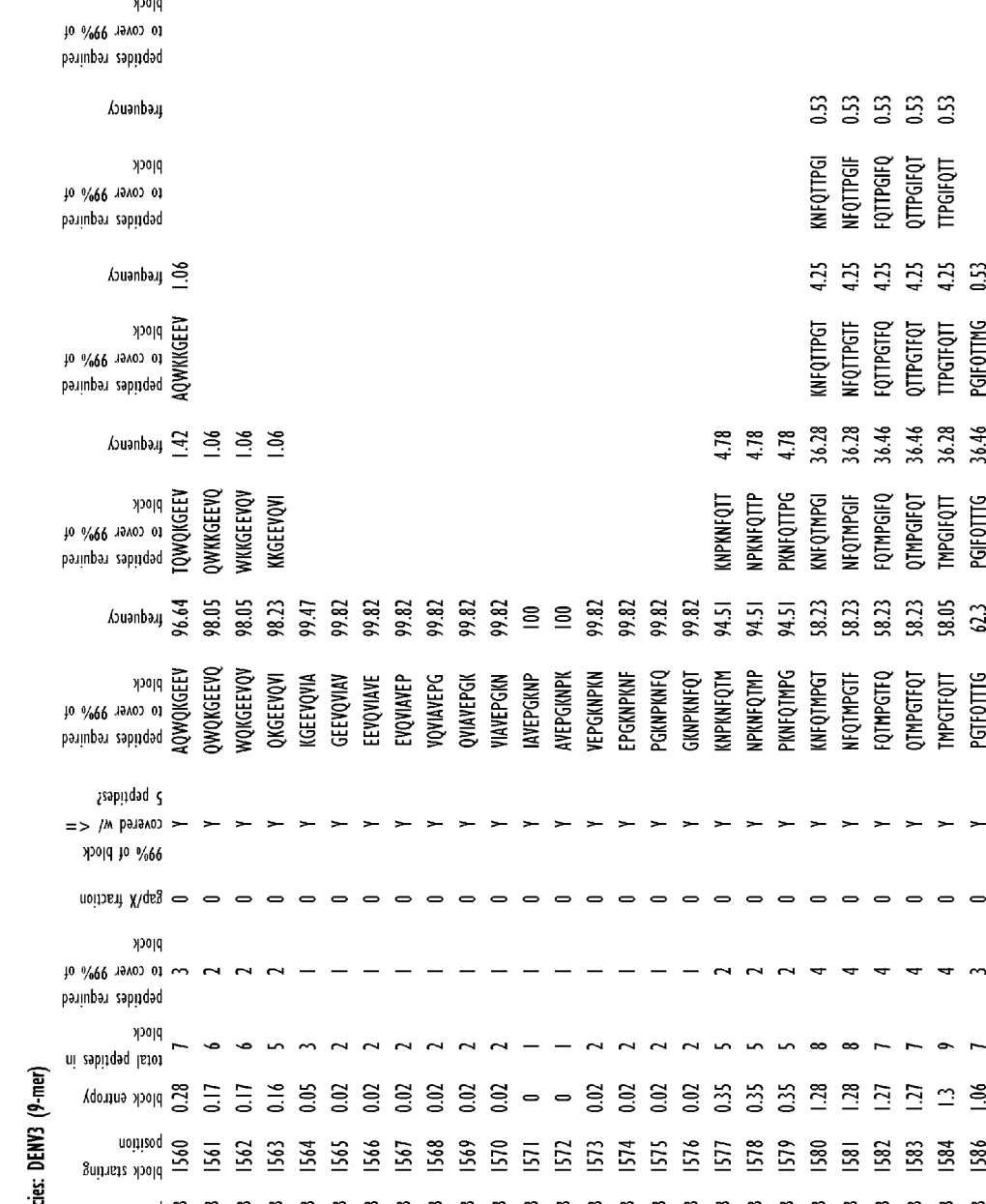
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60:
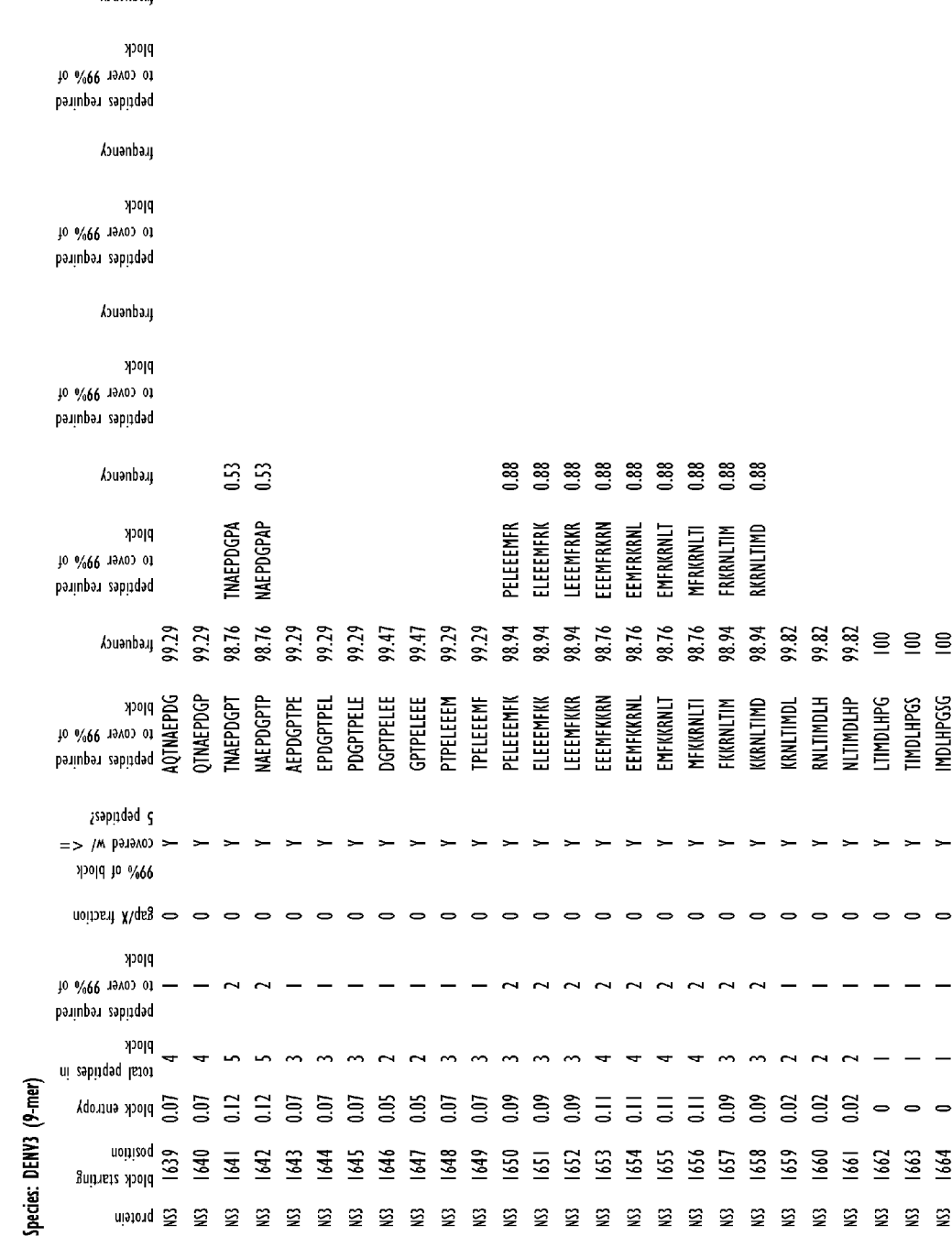
Figures 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61:
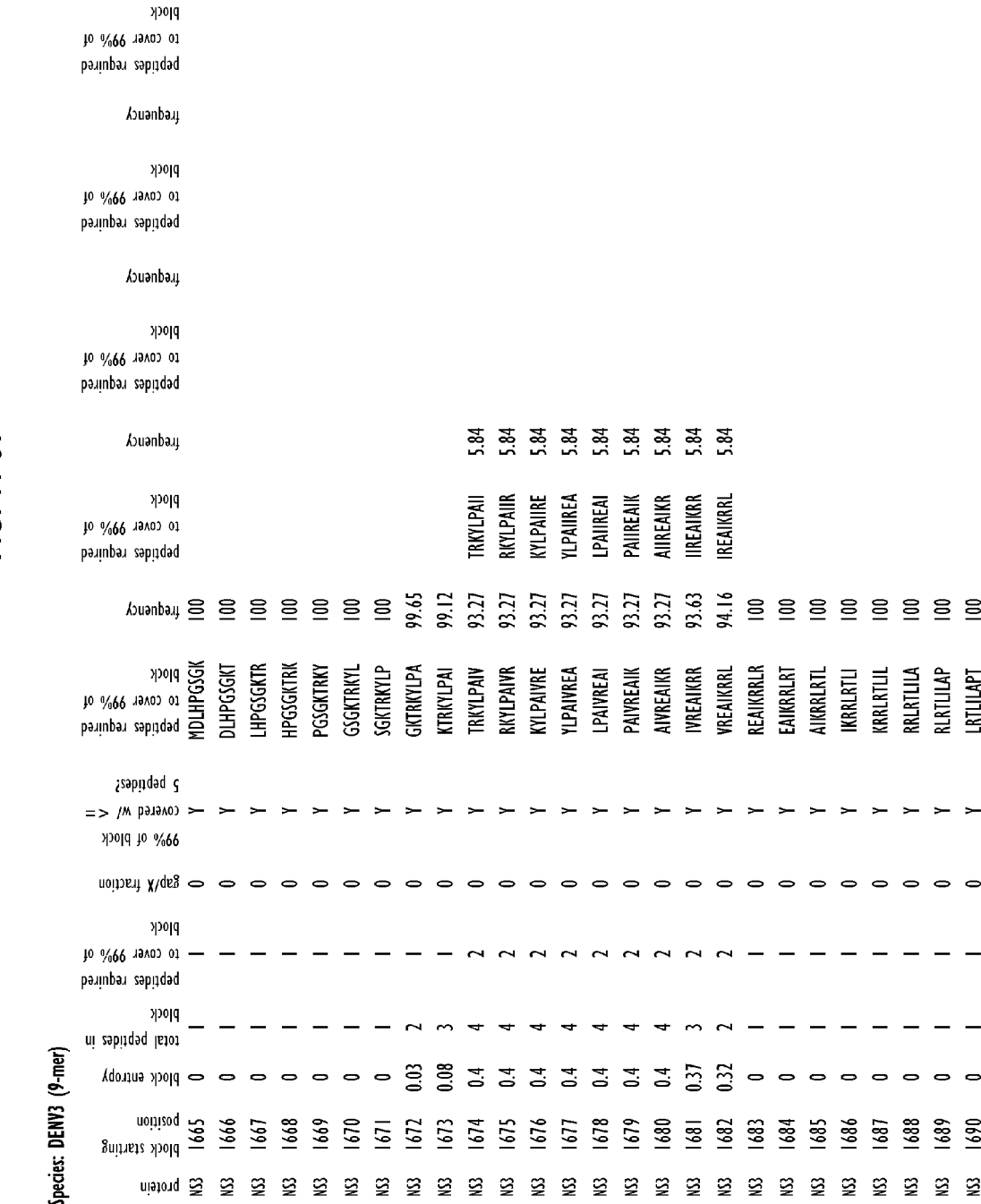
Figures 72, 73, 74, 75:
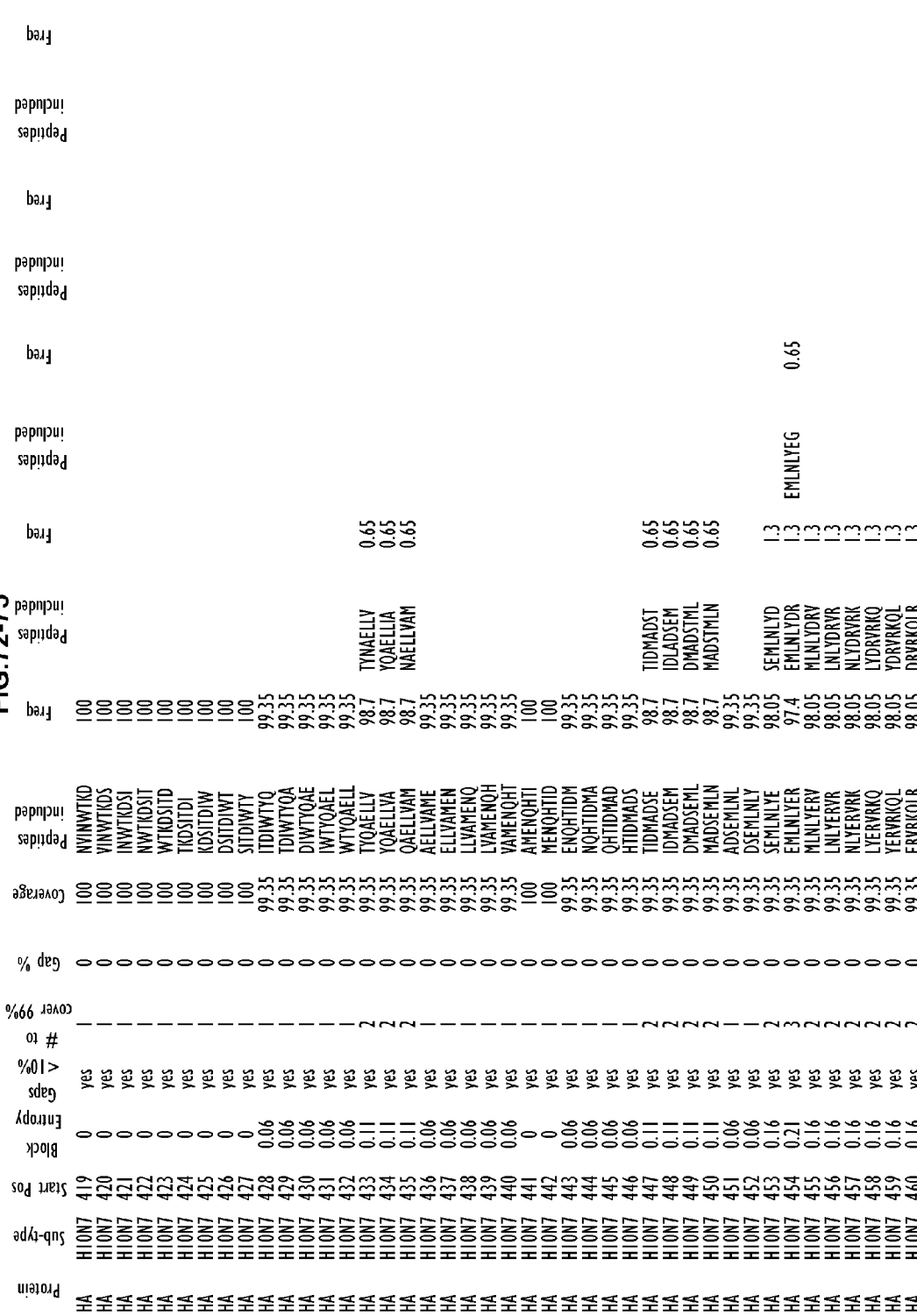
Figures 72, 73, 74, 75, 76, 77:
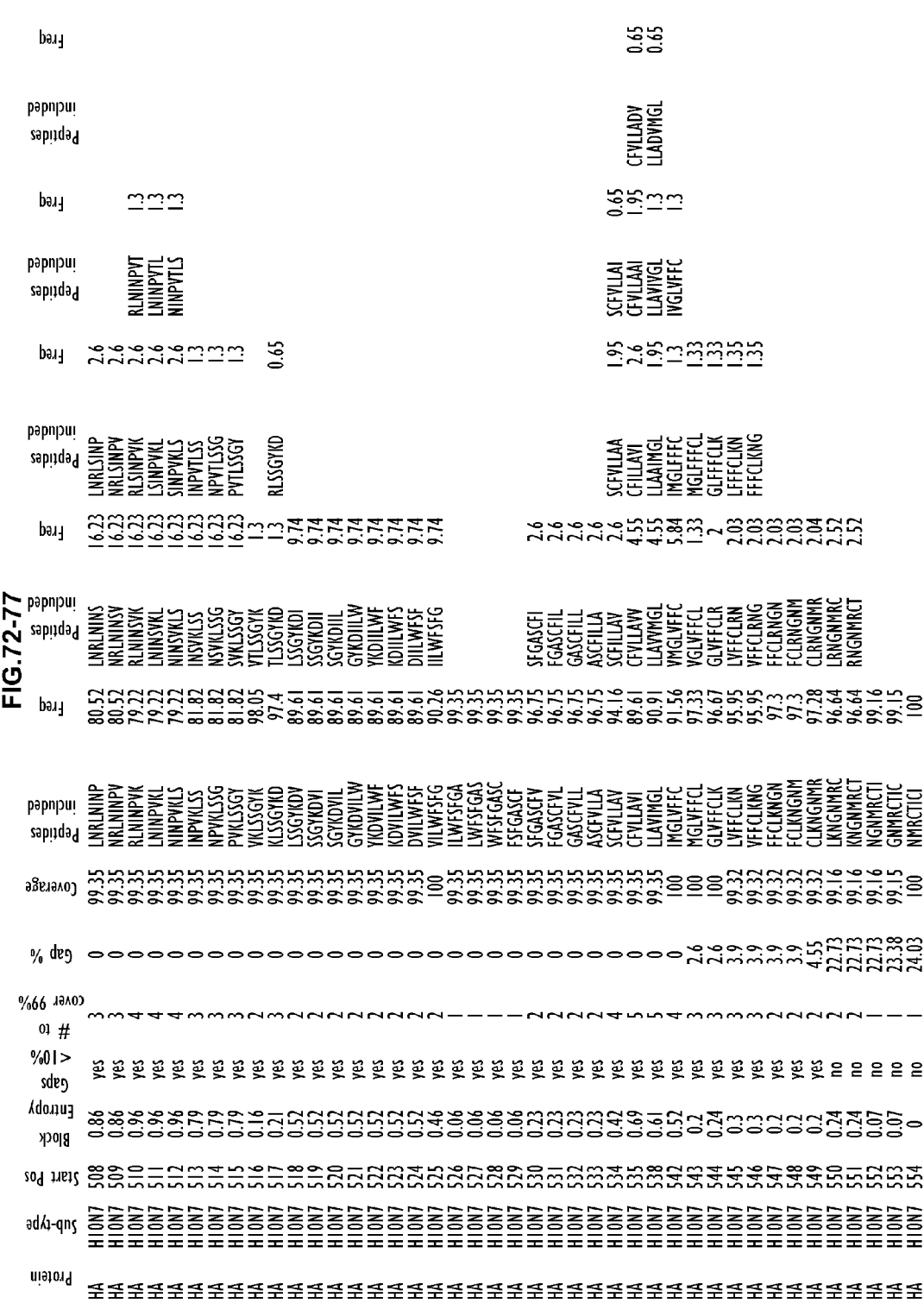
Figures 72, 123:
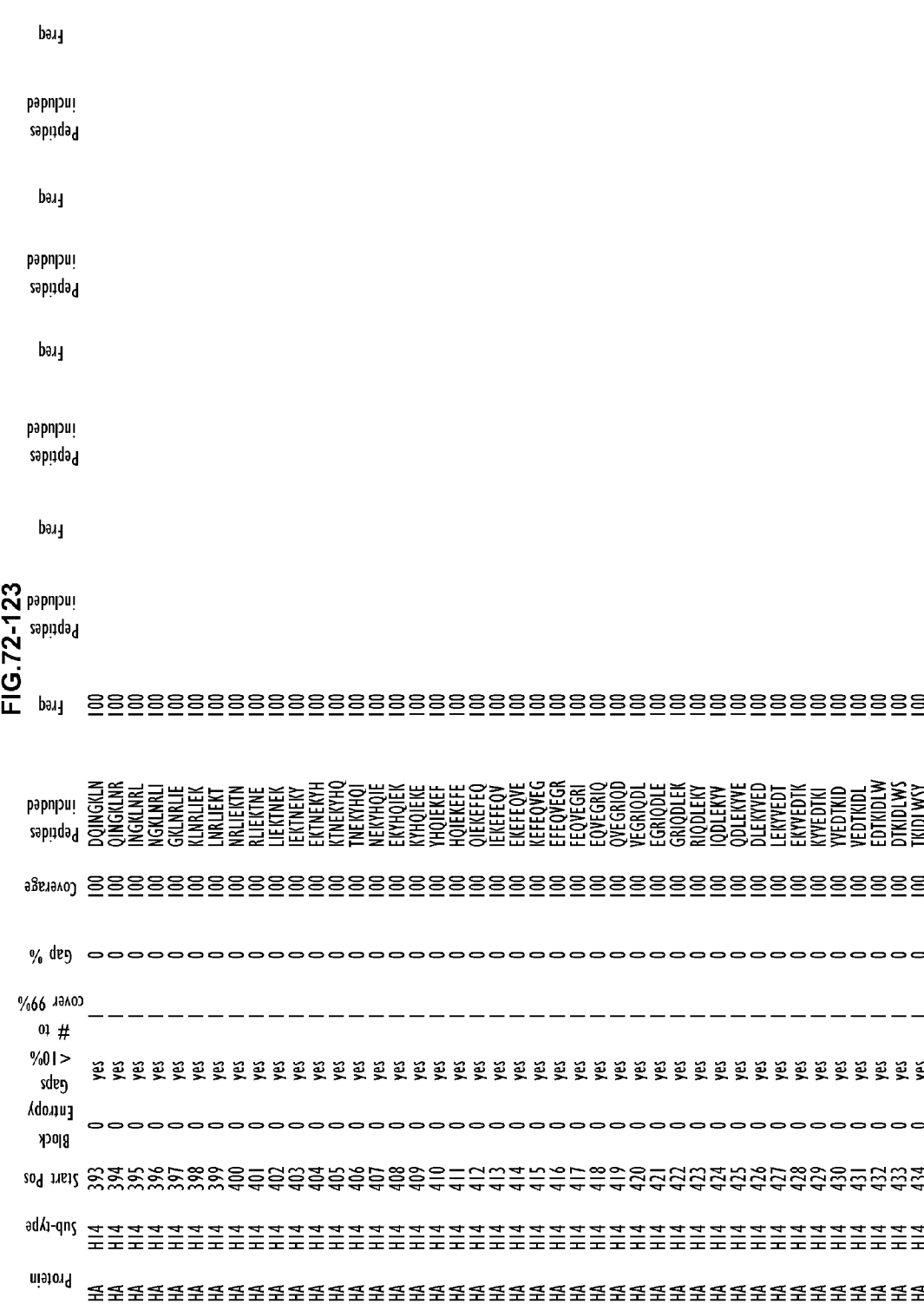
Figures 72, 371:
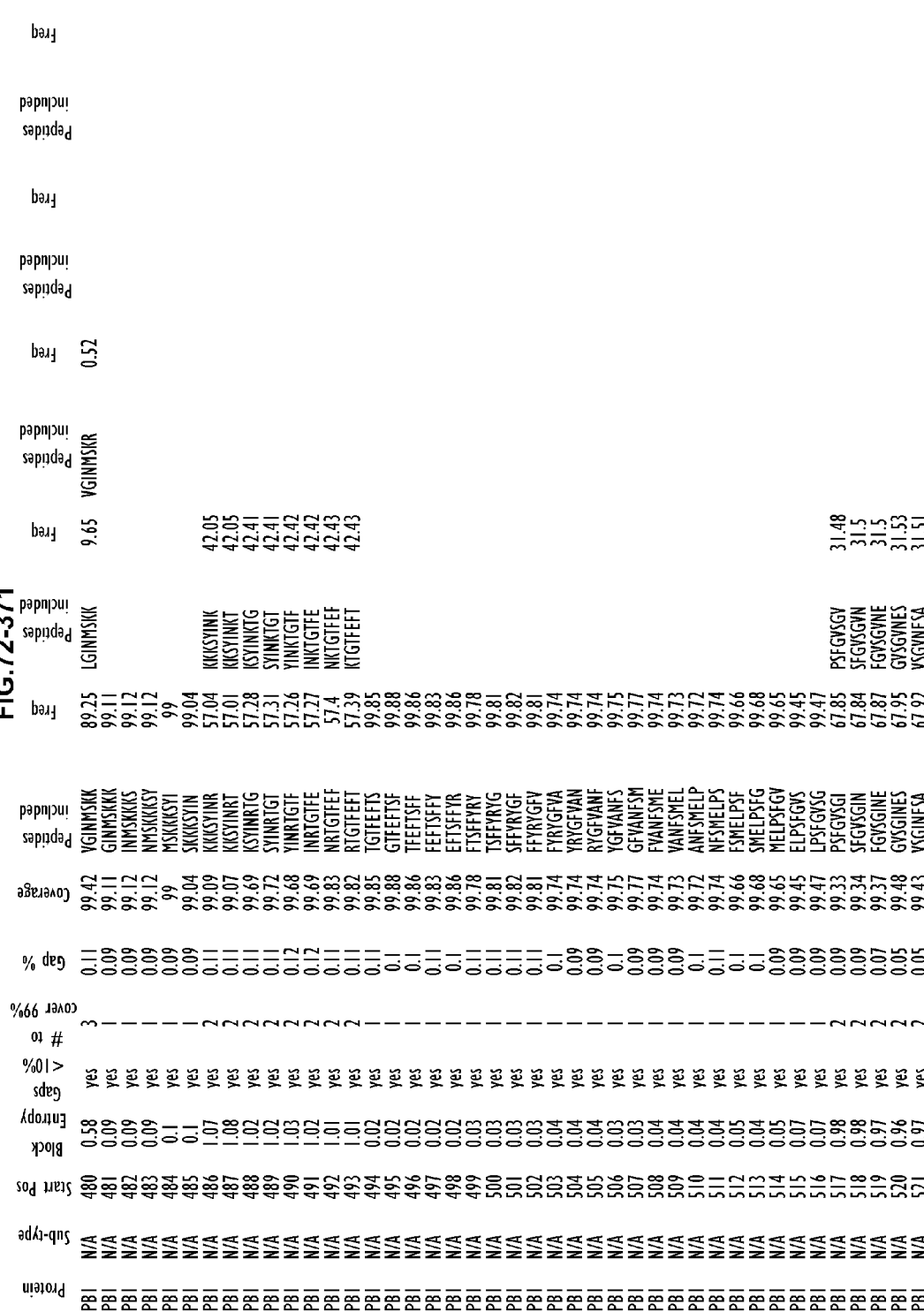
Figures 72, 375:
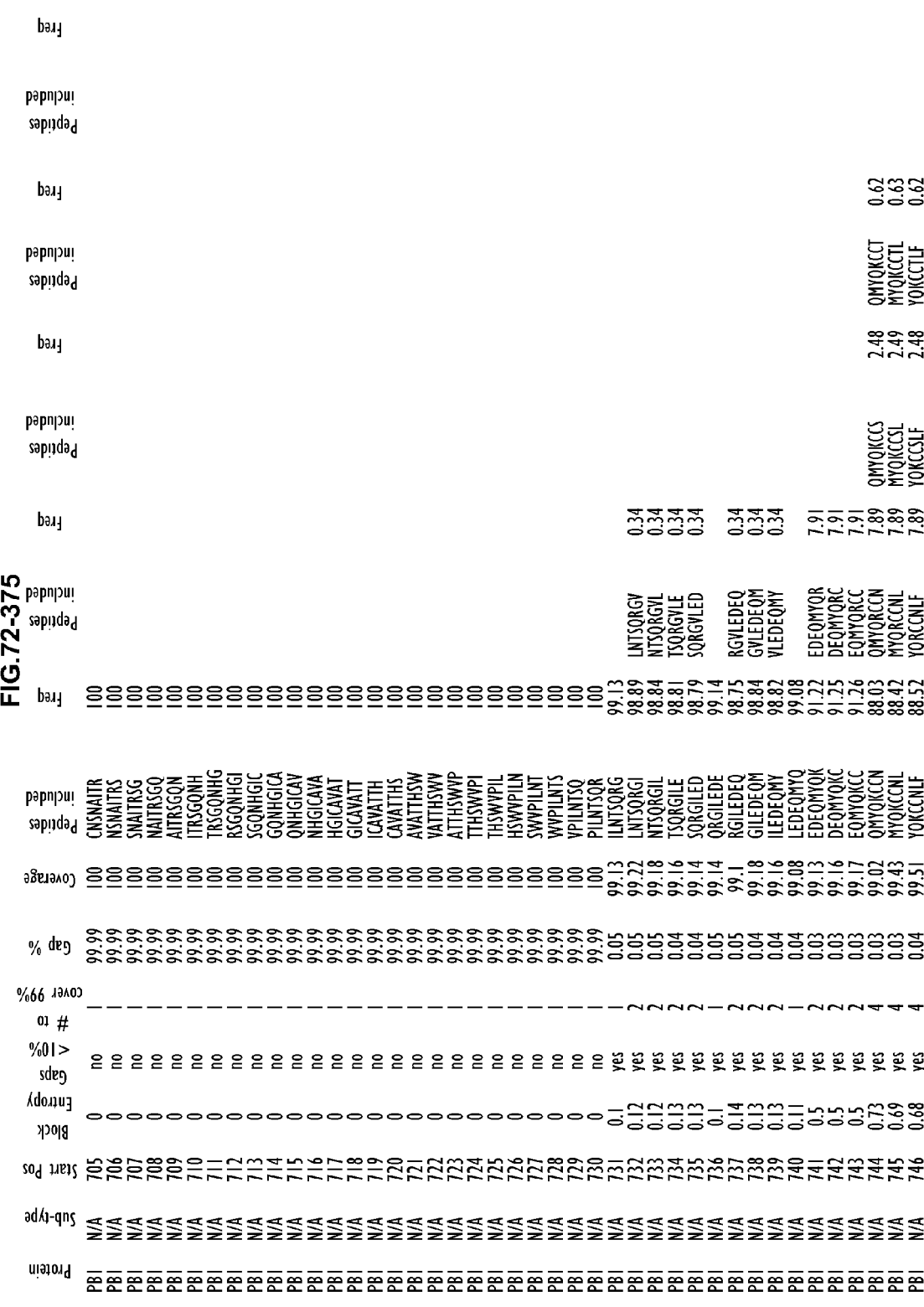

Examples of peptide strings are provided for 8-mers, 9-mers, 10-mers and 11-mers of norovirus (NV) (FIG. 53), DENV1 (FIG. 54), DENV2 (FIG. 55), DENV3 (FIG. 56), DENV4 (FIG. 57), WNV (FIG. 58), YFV (FIG. 59), TBEV (FIG. 60), JEV (FIG. 61), DENVall (FIG. 62), panFIVE (FIG. 63), panFLAVI (FIG. 64), and influenza virus (FIGS. 76-77).

Typically, and as shown in FIGS. 53-64 and 76-77, peptides are assembled in sets of strings. Preferably the number of strings in a set is 5, although the set can contain 1 or more, 2 or more, 3 or more, 4 or more, 5 or more, 6 or more, 7 or more, 8 or more, 9 or more, or 10 or more strings. Typically, the string in which a peptide is placed depends on its frequency. For example, the most frequent peptide in a set of minimum required peptides (to achieve a desired "cumulative fraction," as described herein) can be placed in string 1, the second most frequent peptide can be placed in string 2, the third most frequent peptide can be placed in string 3, and so on. Thus, using this approach, only one (1) peptide from each conserved block is included in any one particular string (multiple peptides from the same conserved block are not linked together in the same string). In certain embodiments, however, the peptides can be arbitrarily placed in any string in the set. Thus, in some embodiments, multiple peptides from the same conserved block can be linked together in the same string.

Preferably, in one embodiment, each string in a set of peptide strings is derived from conserved sequences of 8-mers, 9-mers, 10-mers, or 11-mers. In another embodiment, each string in a set of peptide strings is derived from conserved sequences of 8-mers, 9-mers, 10-mers, and 11-mers.

In the peptide strings shown in FIGS. 53-64 and 76-77 for 8-mers, 9-mers, 10-mers and 11-mers, the peptide amino acid sequence can have varying lengths that are longer than 8 residues for 8-mers, longer than 9 residues for 9-mers, etc. This occurs because, when extracting blocks from a polypeptide MSA, a "reading window" is panned across the proteome in increments of residues. If the window size (peptide length) is 8, there are three possible blocks of that length in a MSA of polypeptides of length 10. This overlap means that if 3 blocks in a row are conserved, the extended block will be of length 10. Thus, a segment of 12 amino acids, for example, is the product of 5 consecutive conserved blocks of 8-mer peptides.

It is to be understood, however, that the methods provided herein allow one to identify conserved peptide sequences of any homologous polypeptides; thus, the invention is not meant to be limited to the particular examples of peptide epitopes and peptide strings provided herein.

Peptide Preparation

The polypeptides (including peptides, polypeptides, peptide strings and/or proteins) described herein can be manufactured by standard in vitro recombinant DNA techniques and in vivo transgenesis using nucleotide sequences encoding the appropriate polypeptides. Methods well-known to those skilled in the art can be used to introduce mutations and construct expression vectors containing relevant coding sequences and appropriate transcriptional/translational regulatory elements. See, for example, the techniques described in Sambrook et al., Molecular Cloning: A Laboratory Manual (2nd Ed.) [Cold Spring Harbor Laboratory, N.Y., 1989], and Ausubel et al., Current Protocols in Molecular Biology [Green Publishing Associates and Wiley Interscience, N.Y., 1989].

The transcriptional/translational regulatory elements referred to above include but are not limited to inducible and non-inducible promoters, enhancers, operators and other elements that are known to those skilled in the art and that drive or otherwise regulate gene expression. Such regulatory elements include but are not limited to the cytomegalovirus hCMV immediate early gene, the early or late promoters of SV40 adenovirus, the lac system, the trp system, the TAC system, the TRC system, the major operator and promoter regions of phage A, the control regions of fd coat protein, the promoter for 3 phosphoglycerate kinase, the promoters of acid phosphatase, and the promoters of the yeast α mating factors.

The expression systems that may be used for purposes of the invention include but are not limited to microorganisms such as bacteria (for example, *E. coli* and *B. subtilis*) transformed with recombinant bacteriophage DNA, plasmid DNA, or cosmid DNA expression vectors containing nucleic acid molecules encoding enhancing agents or immunogenic stimuli; yeast (for example, *Saccharomyces* and *Pichia*) transformed with recombinant yeast expression vectors containing a nucleic acid encoding enhancing agents or immunogenic stimuli; insect cell systems infected with recombinant virus expression vectors (for example, baculovirus) containing a nucleic acid encoding enhancing agents or immunogenic stimuli; plant cell systems infected with recombinant virus expression vectors (for example, cauliflower mosaic virus (CaMV) or tobacco mosaic virus (TMV)) or transformed with recombinant plasmid expression vectors (for example, Ti plasmid) containing a nucleotide sequence encoding; or mammalian cell systems (for example, COS, CHO, BHK, 293, VERO, HeLa, MDCK, WI38, and NIH 3T3 cells) harboring recombinant expression constructs containing promoters derived from the genome of mammalian cells (for example, the metallothionein promoter) or from mammalian viruses (for example, the adenovirus late promoter and the vaccinia virus 7.5K promoter). Also useful as host cells are primary or secondary cells obtained directly from a mammal and transfected with a plasmid vector or infected with a viral vector.

Cells transfected or transduced with the expression vectors described herein can then be used, for example, for large or small scale in vitro manufacture of polypeptides by methods known in the art. In essence, such methods involve culturing the cells under conditions that maximize production of the polypeptide and isolating the polypeptide from the culture, i.e., the cells and/or the culture medium. Methods for purifying biological macromolecules (e.g., proteins) are known in the art. For example, polypeptides described herein can be purified by combinations of ethanol precipitation and isoelectric focusing from culture fluids of clones containing the mutated genes. See, Blomster-Hautamaa and Schlievert, *Methods Enzymol* 165:37-43 (11) (1988). The degree of purity of the macromolecules can be measured by any appropriate method, e.g., column chromatography, polyacrylamide gel electrophoresis, or HPLC analysis.

In other embodiments, polypeptides, peptides, as well as salts thereof may be synthesized, e.g., using solid-phase or liquid-phase synthesis, according to any known suitable method of peptide synthesis (see, e.g., *Chemistry of Peptide Synthesis*; N. L. Benoiton; CRC Press, 2006, 290 pages).

Immunogenic Compositions

In certain embodiments, the present invention provides immunogenic compositions comprising immunogen(s), such as one or more peptide strings (e.g. polypeptides comprising peptides linked together by linking sequences) as described herein. In other embodiments, the immunogenic compositions provided herein comprise one or more individual peptides.

Thus, in one embodiment, an immunogenic composition comprises 1 or more peptides comprising an amino acid sequence shown in a group of Figures selected from FIGS. 2-5, FIGS. 6-9, FIGS. 10-13, FIGS. 14-17, FIGS. 18-21, FIGS. 23-26, FIGS. 27-30, FIGS. 31-34, FIGS. 35-38, FIGS. 39-42, FIGS. 43-46, FIGS. 48-50 and FIGS. 72-75, FIGS. 78-81 and FIG. 83. In other embodiments, the immunogenic composition comprises 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, 23 or more, 24 or more, 25 or more, 26 or more, 27 or more, 28 or more, 29 or more, 30 or more, 35 or more, 40 or more, 45 or more, 50 or more, 55 or more, 60 or more, 65 or more, 70 or more, 75 or more, 80 or more, 85 or more, 90 or more, 95 or more, 100 or more, 125 or more, 150 or more, 175 or more, 200 or more, 250 or more, 300 or more, 350 or more, 400 or more, 450 or more, or 500 or more peptides comprising an amino acid sequence shown in a group of Figures selected from FIGS. 2-5, FIGS. 6-9, FIGS. 10-13, FIGS. 14-17, FIGS. 18-21, FIGS. 23-26, FIGS. 27-30, FIGS. 31-34, FIGS. 35-38, FIGS. 39-42, FIGS. 43-46 and FIGS. 48-50, FIGS. 72-75, FIGS. 78-81 and FIG. 83.

In another embodiment, an immunogenic composition comprises one (1) or more peptide strings, each peptide string comprising a sequence shown in a Figure selected from the group consisting of: FIG. 54, FIG. 55, FIG. 56, FIG. 57, FIG. 58, FIG. 59, FIG. 60, FIG. 61, FIG. 62, FIG. 63, FIG. 64, FIG. 76, and FIG. 77. In another embodiment, an immunogenic composition comprises 2 or more, 3 or more, 4 or more, or 5 or more peptide strings, each peptide string comprising a sequence shown in a Figure selected from the group consisting of: FIG. 54, FIG. 55, FIG. 56, FIG. 57, FIG. 58, FIG. 59, FIG. 60, FIG. 61, FIG. 62, FIG. 63, and FIG. 64, FIG. 76, and FIG. 77. Preferably, each of the peptides strings in an immunogenic composition is derived from the same group of strings (e.g., strings derived from 8-mers, 9-mers, 10-mers or 11-mers). However, in certain embodiments, the composition can comprise strings from different sets of strings, e.g., from any of 8-mer, 9-mer, 10-mer and 11-mer strings shown, e.g., in each of FIGS. 54-64, or different sets of strings, e.g., from any of 8-mer, 9-mer, 10-mer and 11-mer strings shown, e.g., in each of FIGS. 76-77.

Figures 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66:
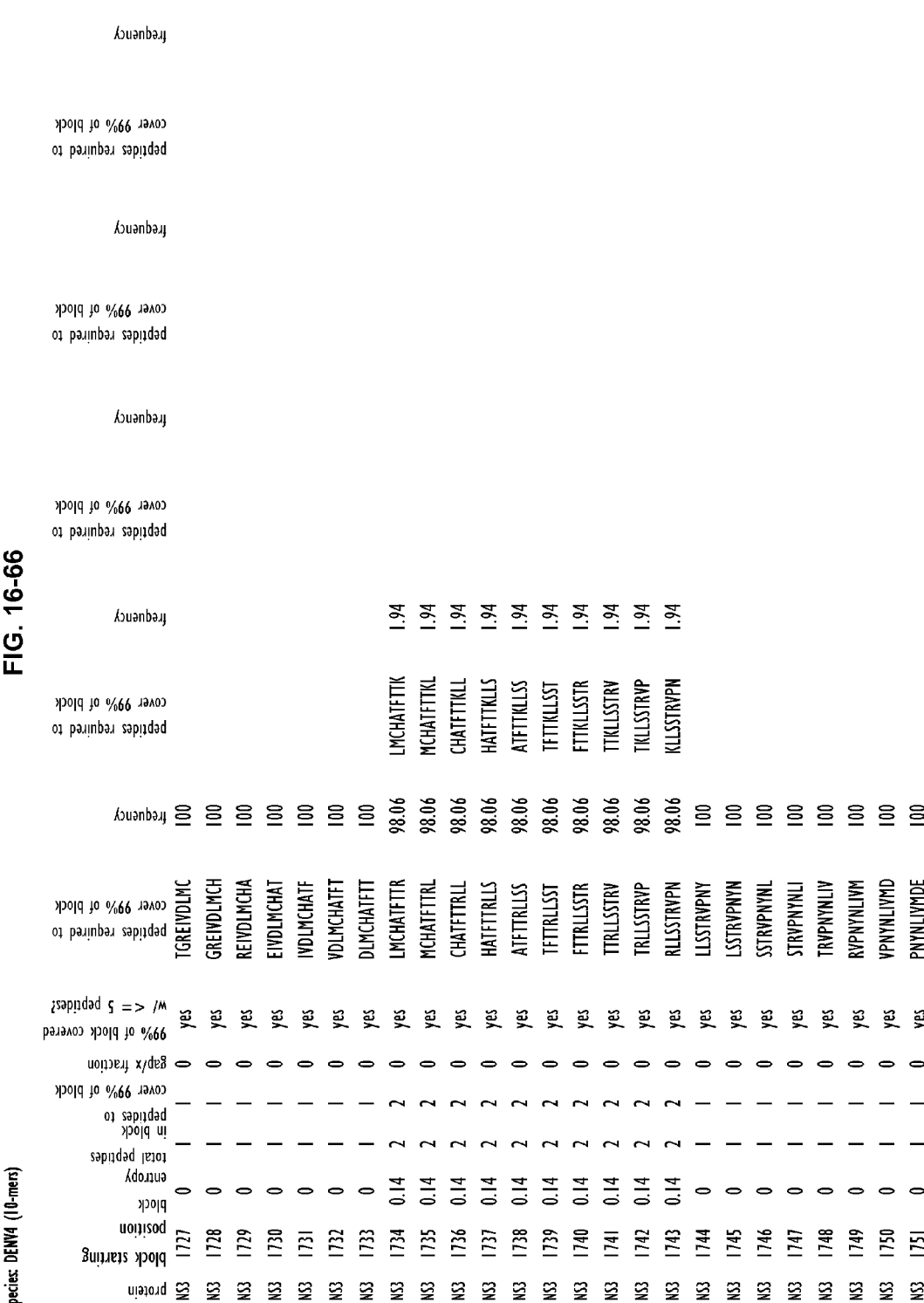
FIG. 65 shows MHC class I binding affinity for each peptide found in all blocks identified as conserved in norovirus polypeptides. For each peptide sequence, binding affinity ($IC_{50}$) (nM) is given in parentheses next to the HLA type (e.g., A1101, B1501, etc.) for each HLA molecule the peptide was predicted to bind to with at least weak affinity (≤500 nM) (i.e., negative binding predictions are not shown). The sequences shown in the figure have the following SEQ ID NOs (the columns containing sequences are numbered 1 through 2 from left to right and the sequence identifiers are in numerical order from the top to the bottom of each column): Column ("Col.") 1: 265917-266055; and Col. 2: 266056-266102.
Figures 16, 72:
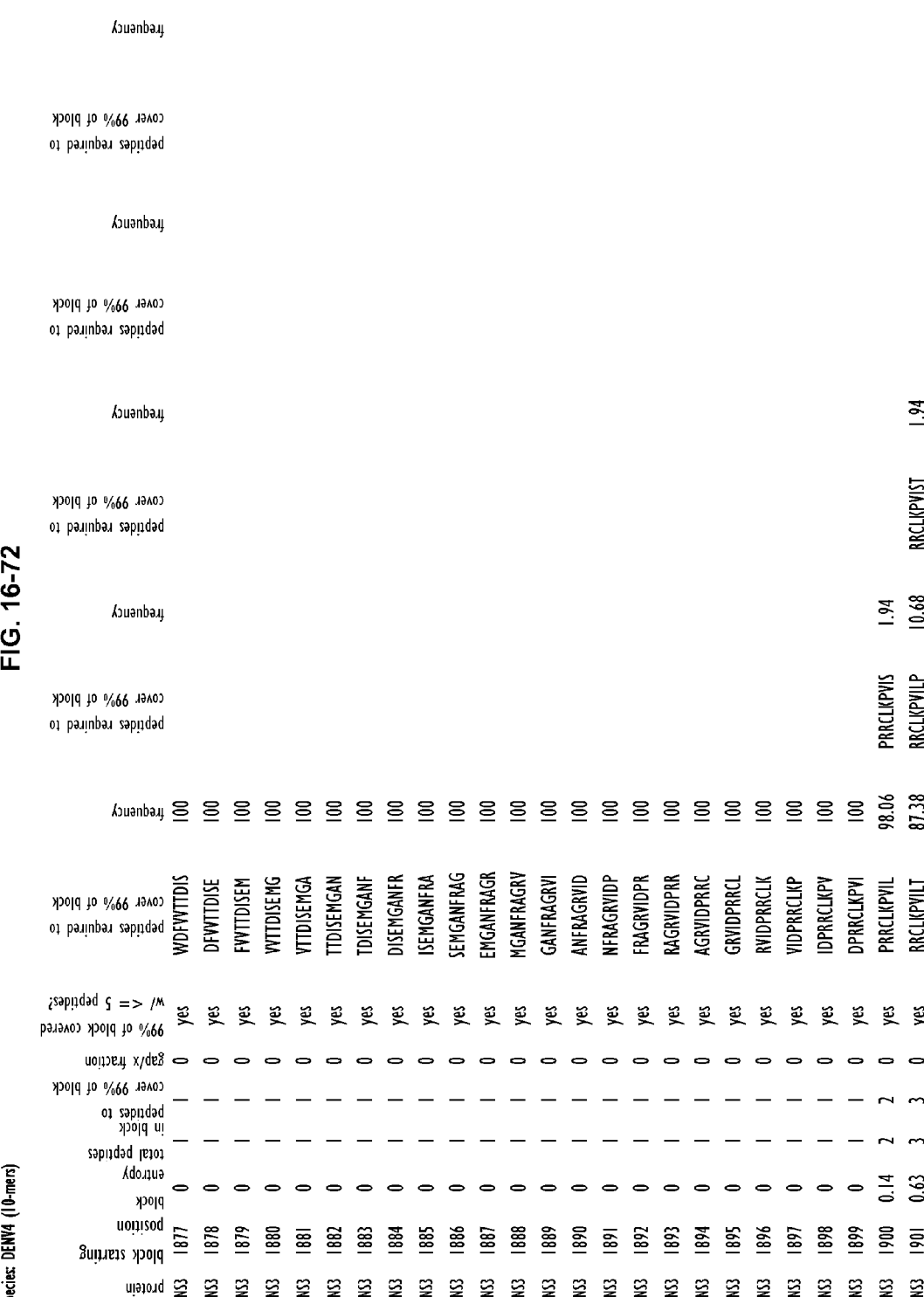
Figures 16, 103:
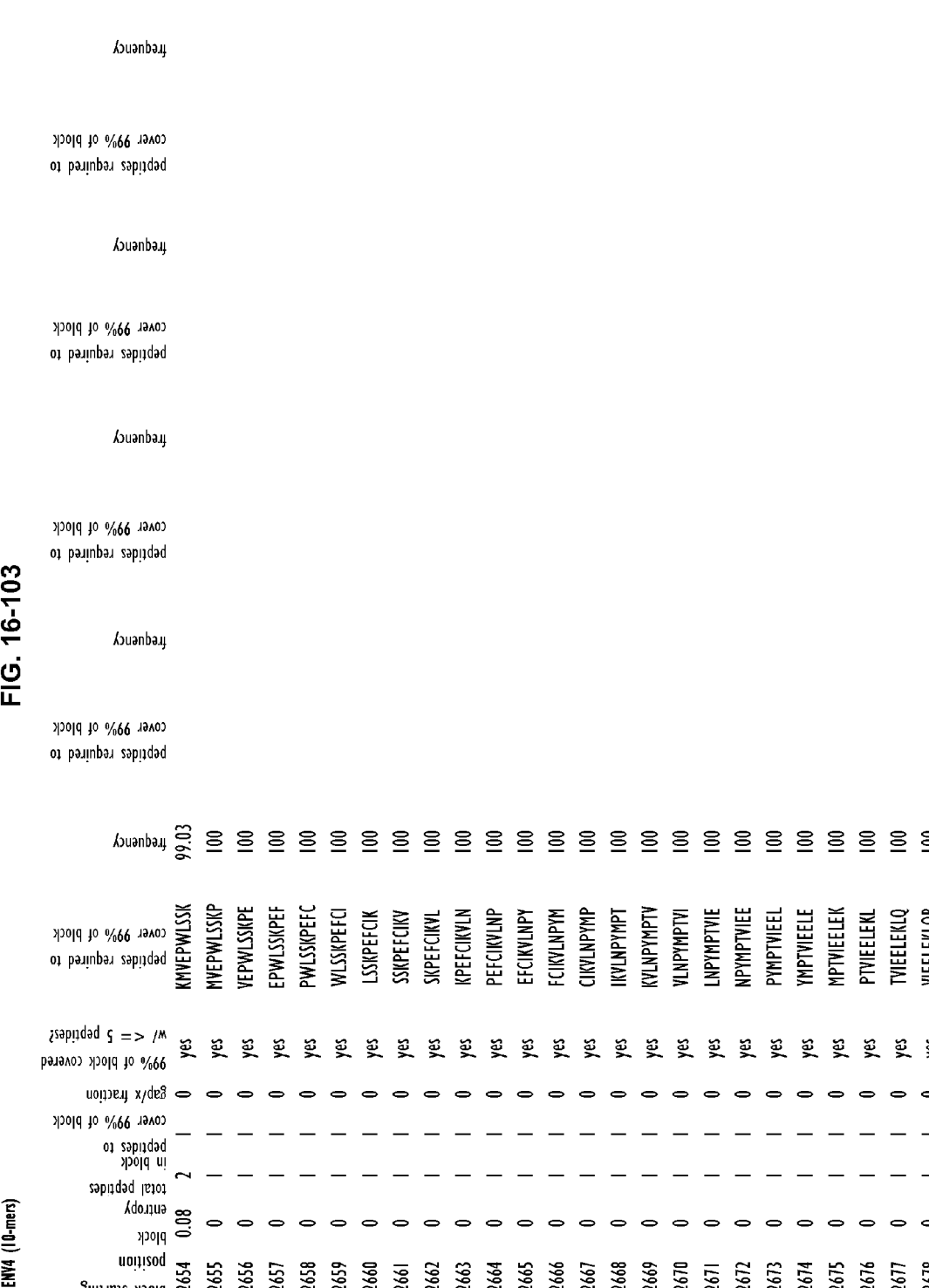
Figures 16, 112:
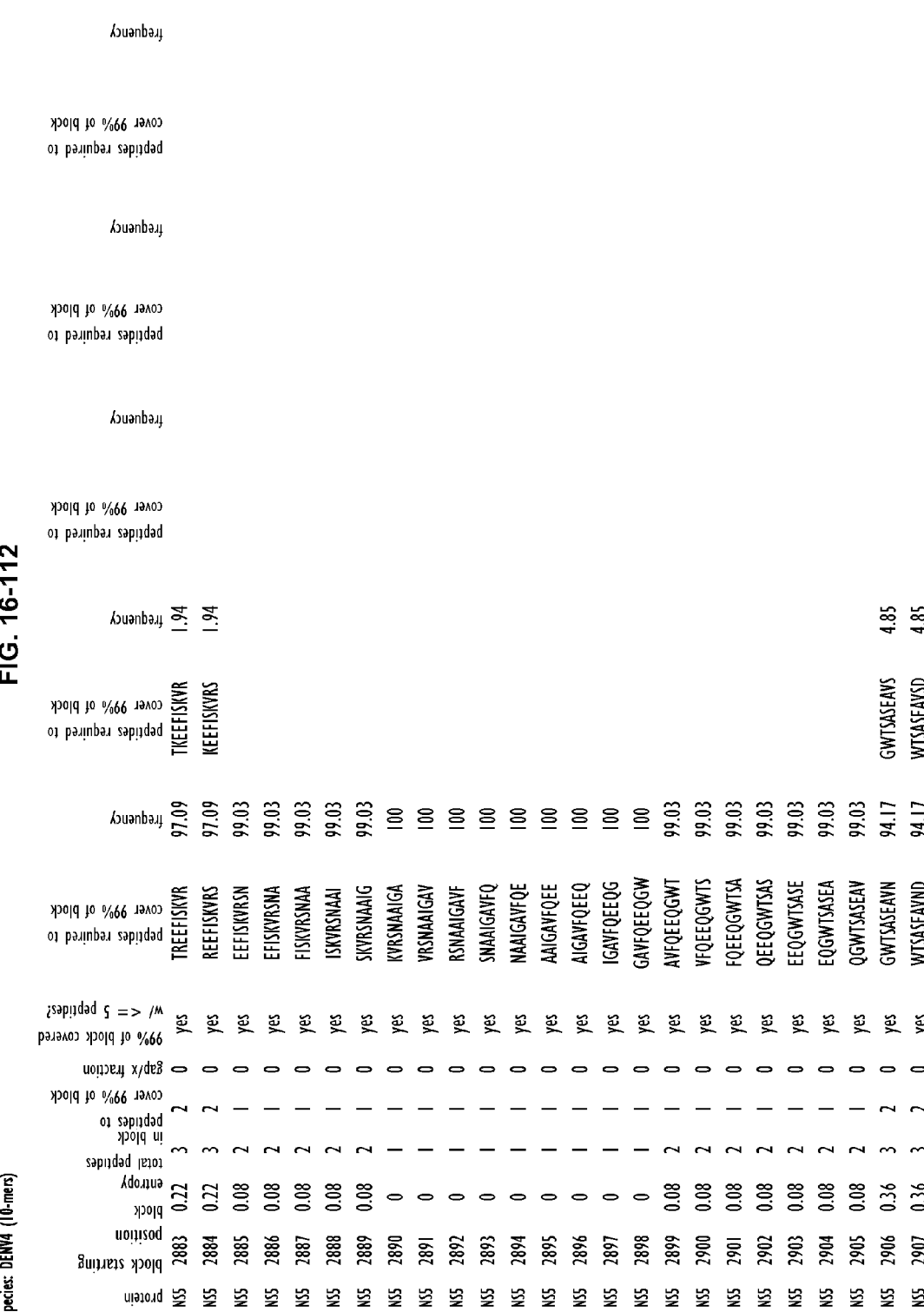
Figures 16, 115:
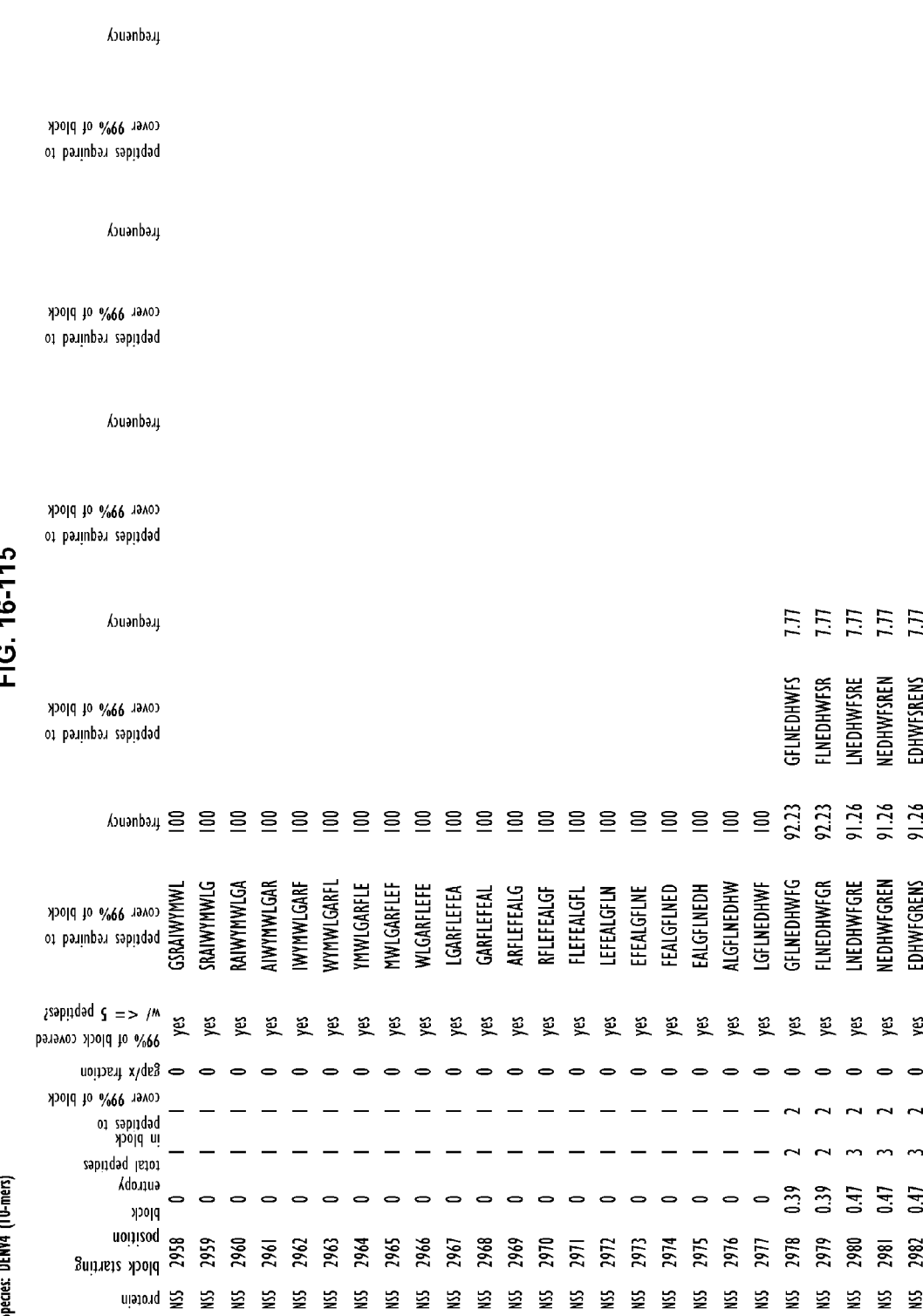
Figures 16, 127:
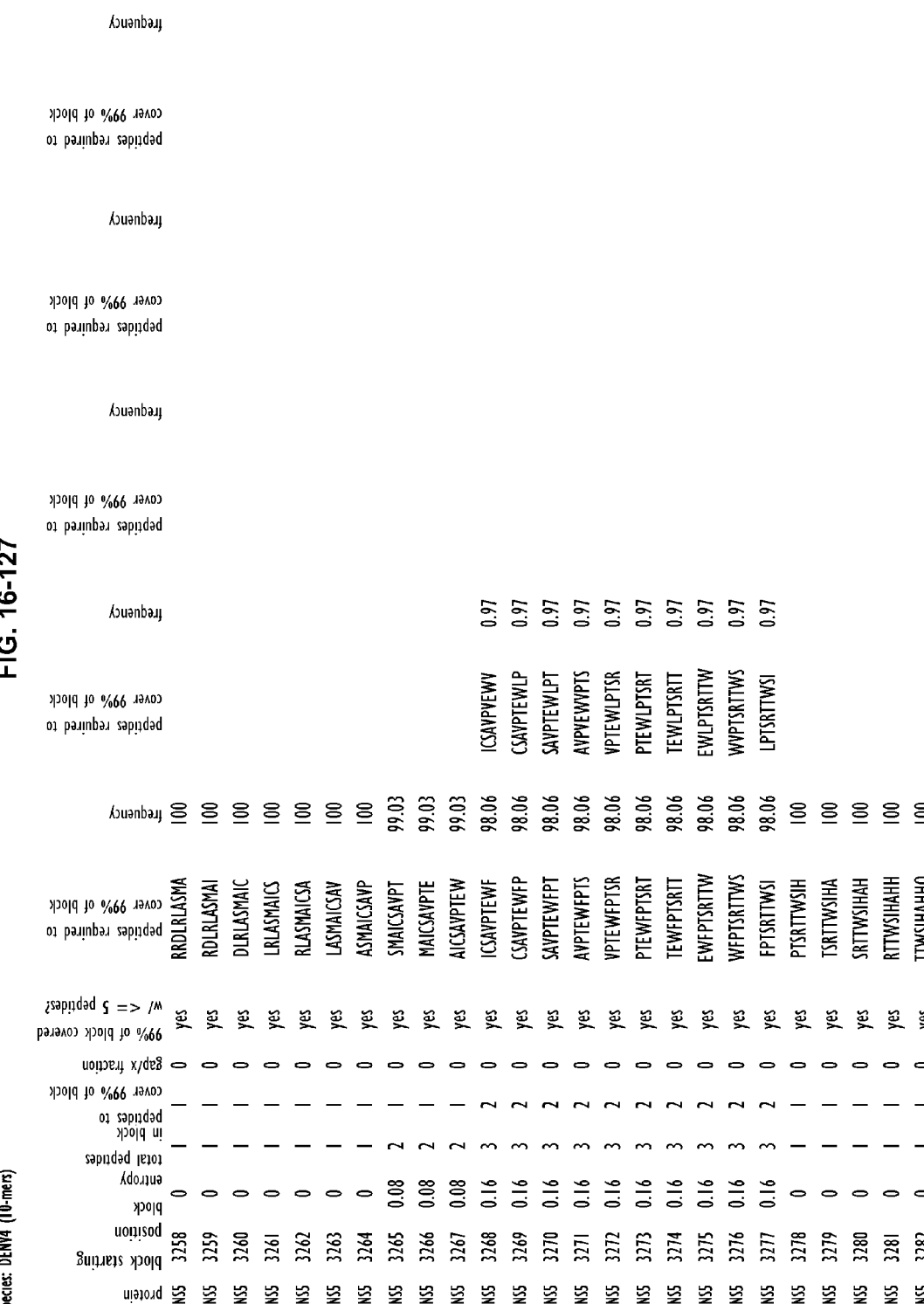
Figures 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66:
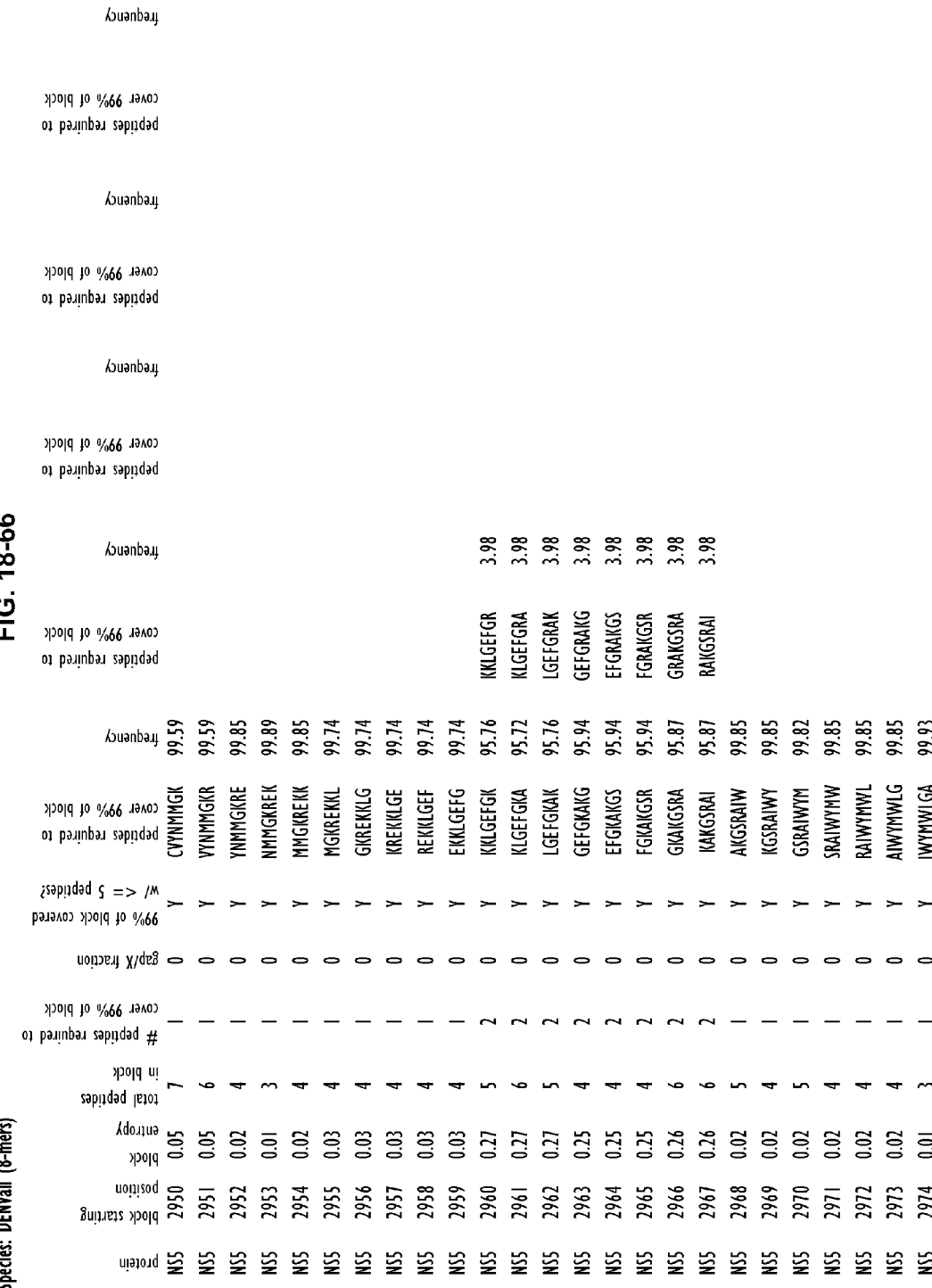

In one embodiment, an immunogenic composition comprises one (1) or more peptides comprising an amino acid sequence shown in FIG. 65. In other embodiments, the immunogenic composition comprises 2 or more, 3 or more, 4 or more, 5 or more, 6 or more, 7 or more, 8 or more, 9 or more, 10 or more, 11 or more, 12 or more, 13 or more, 14 or more, 15 or more, 16 or more, 17 or more, 18 or more, 19 or more, 20 or more, 21 or more, 22 or more, 23 or more, 24 or more, 25 or more, 26 or more, 27 or more, 28 or more, 29 or more, 30 or more, 35 or more, 40 or more, 50 or more, 55 or more, 60 or more, 65 or more, 70 or more, 75 or more, 80 or more, 85 or more, 90 or more, 95 or more, 100 or more, 125 or more, 150 or more, 175 or more, 200 or more, 250 or more, 300 or more, 350 or more, 400 or more, 450 or more, or 500 or more peptides comprising an amino acid sequence shown in FIG. 65.

In another embodiment, an immunogenic composition comprises one (1) or more peptide strings, each peptide string comprising a peptide string sequence shown in FIG. 53. In another embodiment, an immunogenic composition comprises 2 or more, 3 or more, 4 or more, or 5 or more peptide strings, each peptide string comprising a sequence shown in FIG. 53. Preferably, each of the peptides strings in an immunogenic composition is derived from the same group of strings (e.g., strings derived from 8-mers, 9-mers, 10-mers or 11-mers). However, in certain embodiments, the composition can comprise strings from different sets of strings, e.g., from any of the 8-mer, 9-mer, 10-mer and 11-mer strings shown, e.g., in FIG. 53.

In another embodiment, an immunogenic composition comprises at least 1 peptide comprising an amino acid sequence of a peptide shown in one or more of the peptide strings shown in FIG. 53, wherein each peptide in the peptide strings is separated by a linking sequence (denoted by XXXX). In other embodiments, the immunogenic composition comprises at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, at least 21, at least 22, at least 23, at least 24, at least 25, at least 26, at least 27, at least 28, at least 29, at least 30, at least 35, at least 40, at least 45, at least 50, at least 55, at least 60, at least 65, at least 70, at least 75, at least 80, at least 85, at least 90, at least 95, at least 100, at least 125, at least 150, at least 175, at least 200, at least 250, at least 300, at least 350, at least 400, at least 450, or at least 500 peptides comprising an amino acid sequence shown in FIG. 53.

While it is possible for the immunogen (e.g. peptide or peptide string) to be administered in a pure or substantially pure form, it is preferable to present it as a pharmaceutical composition, formulation or preparation, e.g., together with one or more pharmaceutically acceptable carriers and, optionally, other therapeutic ingredients. The carrier(s) must be "acceptable" in the sense of being compatible with the other ingredients of the formulation and not deleterious to the recipient thereof. The formulations may conveniently be presented in unit dosage form and may be prepared by any method well-known in the pharmaceutical art.

All methods include the step of bringing into association the active ingredient with the carrier which constitutes one or more accessory ingredients. In general, the formulations are prepared by uniformly and intimately bringing into association the active ingredient with liquid carriers or finely divided solid carriers or both, and then, if necessary, shaping the product into the desired formulation.

Compositions described herein can include a pharmaceutically acceptable excipient, such as phosphate buffered saline or bicarbonate (e.g., 0.24 M NaHCO3). Suitable excipients can be chosen by one of ordinary skill in the art on the basis of the mode and route of administration, and standard pharmaceutical practice. Pharmaceutical excipients and diluents, as well as pharmaceutical necessities for their use, are described, e.g., in Remington's Pharmaceutical Sciences. Non-limiting examples of pharmaceutical excipients include solvent (e.g., water or physiological saline), solubilizing agent (e.g., ethanol, polysorbates, or Cremophor EL7), agent for achieving isotonicity, preservative, antioxidizing agent, lactose, starch, crystalline cellulose, mannitol, maltose, calcium hydrogen phosphate, light silicic acid anhydride, calcium carbonate, binder (e.g., starch, polyvinylpyrrolidone, hydroxypropyl cellulose, ethyl cellulose, carboxy methyl cellulose, or gum arabic), lubricant (e.g., magnesium stearate, talc, or hardened oils), or stabilizer (e.g., lactose, mannitol, maltose, polysorbates, macrogols, or polyoxyethylene hardened castor oils). If desired, glycerin, dimethylacetamide, 70% sodium lactate, surfactant, or basic substance such as sodium hydroxide, ethylenediamine, ethanolamine, sodium bicarbonate, arginine, meglumine, or trisaminomethane can be added. Biodegradable polymers such as poly-D,L-lactide-co-glycolide or polyglycolide can be used as a bulk matrix if slow release of the composition is desired (see e.g., U.S. Pat. Nos. 5,417,986, 4,675,381, and 4,450,150). Pharmaceutical preparations such as solutions, tablets, granules or capsules can be formed with these components. If the composition is administered orally, flavorings and/or colors can be added.

The formulations of the present invention may incorporate a stabilizer. Illustrative stabilizers are polyethylene glycol, proteins, saccharides, amino acids, inorganic acids, and organic acids which may be used either on their own or as admixtures. These stabilizers are preferably incorporated in an amount of 0.11-10,000 parts by weight per part by weight of immunogen. If two or more stabilizers are to be used, their total amount is preferably within the range specified above. These stabilizers are used in aqueous solutions at the appropriate concentration and pH. The specific osmotic pressure of such aqueous solutions is generally in the range of 0.1-3.0 osmoles, preferably in the range of 0.8-1.2. The pH of the aqueous solution is adjusted to be within the range of 5.0-9.0, preferably within the range of 6-8. In formulating the immunogen of the present invention, anti-adsorption agent may be used.

Additional pharmaceutical methods may be employed to control the duration of action. Controlled release preparations may be achieved through the use of polymer to complex or absorb the proteins or their derivatives. The controlled delivery may be exercised by selecting appropriate macromolecules (for example polyester, polyamino acids, polyvinyl, pyrrolidone, ethylenevinylacetate, methylcellulose, carboxymethylcellulose, or protamine sulfate) and the concentration of macromolecules as well as the methods of incorporation in order to control release. Another possible method to control the duration of action by controlled-release preparations is to incorporate the peptides or peptide strings of the invention into particles of a polymeric material such as polyesters, polyamino acids, hydrogels, poly(lactic acid) or ethylene vinylacetate copolymers. Alternatively, instead of incorporating these agents into polymeric particles, it is possible to entrap these materials in microcapsules prepared, for example, by coacervation techniques or by interfacial polymerization, for example, hydroxy-methylcellulose or gelatin-microcapsules and poly(methylmethacylate) microcapsules, respectively, or in colloidal drug delivery systems, for example, liposomes, albumin microspheres, microemulsions, nanoparticles, and nanocapsules or in macroemulsions.

In some embodiments, immunogenic peptide compositions of the invention can comprise an adjuvant. An "adjuvant" is an immunological compound that can enhance an immune response against a particular antigen such as a polypeptide. Suitable types and amounts of adjuvants can be selected based, for example, on the route of administration and number of administrations. Non-limiting examples of adjuvants include mineral oil adjuvants such as Freund's complete and incomplete adjuvant, and Montanide incomplete seppic adjuvant (ISA, available from Seppic, Inc., Paris, France); oil-in-water emulsion adjuvants such as the Ribi adjuvant system (RAS); TiterMax®, and syntax adjuvant formulation containing muramyl dipeptide; squalene; or aluminum salt adjuvants (e.g., aluminum phosphate, aluminum hydroxide, or Alum). Other suitable adjuvants include but are not limited to surfactants, e.g., hexadecylamine, octadecylamine, lysolecithin, dimethyldioctadecylammonium bromide, N,N-dioctadecyl-N'—N-bis(2-hydroxyethyl-propane di-amine), methoxyhexadecyl-glycerol, and pluronic polyols; polanions, e.g., pyran, dextran sulfate, poly IC, polyacrylic acid, carbopol; peptides, e.g., muramyl dipeptide, MPL, aimethylglycine, tuftsin, and mixtures thereof. Other potential adjuvants include the B peptide subunits of *E. coli* heat labile toxin or of the cholera toxin [see, McGhee, J. R., et al., "On vaccine development," Sem. Hematol., 30:3-15 (1993)]. Finally, the immunogenic composition may be incorporated into liposomes for use in a vaccine formulation. The peptides of the present invention can also be conjugated or linked to another peptide or to a polysaccharide. For example, immunogenic proteins well-known in the art, also known as "carriers," may be employed. Useful immunogenic proteins include keyhole limpet hemocyanin (KLH), bovine serum albumin (BSA), ovalbumin, human serum albumin, human gamma globulin, chicken immunoglobulin G and bovine gamma globulin.

Methods of Treatment

In certain embodiments, the immunogenic compositions provided herein are useful for treating or preventing infections with pathogenic agents (e.g., viruses, bacteria, fungi and protists).

For example, in a specific embodiment, a method for treating or preventing a *flavivirus* infection in a subject is provided, the method comprising administering a therapeutically or prophylactically effective amount of an immunogenic composition disclosed herein to a subject suspected of or at risk of having a *flavivirus* infection. As discussed in detail, above, *flaviviruses* can include but are not limited to dengue viruses, encephalitis viruses (e.g., St. Louis encephalitis virus, Japanese encephalitis virus, Tick-borne encephalitis virus, Powassan virus) yellow fever viruses, West Nile virus, Kunjin virus, and Murray Valley virus.

In another embodiment, a method for treating or preventing a norovirus infection in a subject is provided, the method comprising administering a therapeutically or prophylactically effective amount of a composition comprising 1 or more, 5 or more, 20 or more, or 50 or more peptides comprising an amino acid sequence shown in FIG. 65 to a subject suspected of or at risk of having a norovirus infection.

In another embodiment, a method for treating or preventing an influenza virus infection in a subject is provided, the method comprising administering a therapeutically or prophylactically effective amount of a composition comprising 1 or more, 5 or more, 20 or more, or 50 or more peptides comprising an amino acid sequence shown in one or more of FIGS. 72-75 and 78-81 to a subject suspected of or at risk of having an influenza virus infection.

In other embodiments, infection with a virus wherein the virus is from a family selected from the group consisting of: Retroviridae, Picornaviridae, Caliciviridae, Togaviridae, Flaviridae, Coronaviridae, Rhabdoviridae, Filoviridae, Paramyxoviridae, Orthomyxoviridae, Bungaviridae, Arenaviridae, Reoviridae, Birnaviridae, Hepadnaviridae, Parvoviridae, Papovaviridae, Adenoviridae, Herperviridae, Poxyiridae, and Iridoviridae may be treated or prevented using an immunogenic composition disclosed herein.

Suitable doses of the composition elicit an immune response in the subject. The dose required to elicit an immune response depends on the route of administration, the nature of the composition, the subject's size, weight, surface area, age, and sex, other drugs being administered, and the judgment of the attending physician. Wide variations in the needed dose are to be expected in view of differing efficiencies of various routes of administration. For example, oral administration would be expected to require higher doses than administration by intravenous injection. Variations in these dose levels can be adjusted using standard empirical routines for optimization, as is well understood in the art. Encapsulation of the composition in a suitable delivery vehicle (e.g., polymeric microparticles or implantable devices) may increase the efficiency of delivery, particularly for oral delivery.

Generally, the composition to be administered can be suspended in a pharmaceutically-acceptable excipient (e.g., physiological saline) and administered orally, transdermally, intravenously, subcutaneously, intramuscularly, intraocularly, intraperitoneally, intrarectally, intravaginally, intranasally, intragastrically, intratracheally, intrapulmonarily, or any combination thereof. For example, the composition can be administered intranasally and subcutaneously. If desired, booster immunizations may be given once or several times (e.g., 2, 3, or 4 times) at various intervals (e.g., three months apart or three years apart). For example, for a prophylactic vaccine, a priming dose can be followed by one or several booster immunizations (e.g., three booster doses) at various intervals (e.g., spaced one week apart). For example, a booster shot can be given at 8 to 12 weeks after the first immunization, and a second booster can be given at 16 to 20 weeks, using the same formulation.

To determine if an immune response was induced in the subject, a biological sample from the subject can be examined to determine if it contains detectable amounts of antibodies having specific binding affinity for one or more of the peptides the subject was vaccinated against. The biological sample can be blood (e.g., serum) or a mucosal sample (e.g., saliva). Methods for detecting antibodies, including IgG, IgM, and IgA, are known, and can include, for example, enzyme-linked immunosorbent assays (ELISA) or Western blotting.

When oral preparations are desired, the compositions may be combined with typical carriers, such as lactose, sucrose, starch, talc magnesium stearate, crystalline cellulose, methyl cellulose, carboxymethyl cellulose, glycerin, sodium alginate or gum arabic among others.

The proteins of the present invention may be supplied in the form of a kit, alone, or in the form of a pharmaceutical composition as described above.

The following examples are meant to illustrate, not limit, the invention.

EXAMPLES

Example 1

Materials and methods

This example includes a description of Materials and Methods.

Criteria for Peptide Block Conservation (Conservation Thresholds)

Four variables were used to determine the classification of a peptide block in a polypeptide MSA as conserved or not conserved:

1. The minimum number of unique peptides, w, present in the block that were required to "cover" at least a certain percentage x of the block being analyzed (i.e., to achieve a cumulative fraction of polypeptides in the MSA, adding together each unique peptide's frequency within the polypeptides in the MSA, of at least x %);
2. The minimum percentage, $y_x$, of the block that must be "covered" by the subset of peptides, $S_w$, in a block for the block to be considered conserved;
3. The maximum allowed fraction, $g_x$, of peptides in the block containing gaps; and
4. The minimum percentage with which each species should be "covered" individually, $s_x$.

In the analysis described in the Examples below, w=5, $y_x$=99%, $g_x$=0.1, and $s_x$=0.9. Variations which were only present in 1% of all sequences (i.e., 100-$y_x$) were considered unlikely to be stable peptides that can be useful antigens. Specifically, it was assumed that those variants represented variants of low fitness, sequencing errors, and rare viable variants. Thus, the resulting 99% or greater "coverage" (i.e., cumulative fraction of polypeptides in the MSA comprising 5 or fewer unique peptides was at least 99%) was considered to represent a reasonable threshold for determination of complete conservation (although lower thresholds, e.g. 95% or greater, are also possible).

Alignment Gaps and Ambiguous Characters in the MSA

Gap insertions in the alignment correspond to insertion or deletion (indel) variation in one or more sequences in the dataset. The DENV diversity is generally caused by substitution mutations rather than indels, but some gaps were observed. Indels of residues lead to significant change of binding potential or, if both variants are binders, completely different T-cell recognition [see, Riemer A B, et al: A conserved E7-derived cytotoxic T lymphocyte epitope expressed on human papillomavirus 16-transformed HLA-A2+ epithelial cancers. J Biol Chem 2010, 285:29608-29622]. Blocks with gaps were considered problematic. In most cases gaps in the alignment were caused by a fraction of the sequences lower than 1% (rare sequences) and were removed. If gaps could not be eliminated in this way, the blocks in which more than 10% of the peptides contained gaps were considered too variable and were classified as not conserved. Similarly, peptides containing ambiguous amino acid characters (such as "X") were omitted from the analysis.

Prediction of Peptide Binding to MHC Class I and MHC Class II Molecules

The identification of conserved blocks was combined with the assessment of HLA binding potential for each peptide in each block. Blocks in which all peptides, w, in $S_w$ showed similar binding affinity with the same HLA restriction, were classified as "immunofunctionally conserved". Blocks in which not all w in Sw were predicted binders were discarded. HLA binding affinity of peptides in conserved blocks was predicted using NetMHC 3.2, as described in the Materials and Methods section (Example 1), above.

Binding affinity to HLA class I was predicted for peptides of 9 residues long for the following HLA alleles: HLA-A*0201, HLA-A*0301, HLA-A*1101, HLA-A*2402, HLA-B*0702, HLA-B*0801, HLA-B*1501. It has been shown that NetMHC achieves highly accurate prediction of 9-mer binding affinity for the listed alleles [see, Lin H H, Ray S, Tongchusak S, Reinherz E L, Brusic V: Evaluation of MHC class I peptide binding prediction servers: applications for vaccine research. *BMC Immunol* 2008, 9:8]. The default thresholds for binding level (affinity ($IC_{50}$) better than 500 nM for weak binders and better than 50 nM for strong binders) were used for binding classification in this study. Thus, a minimum binding affinity of 500 nM was required for a peptide to be considered a binder.

While MHC class II binding peptides are longer, typically 15-25 amino acids in length, peptide binding to the MHC class II molecule is typically determined by a shorter, "core sequence" ranging in length from about 9 to about 10 amino acids. Thus, binding to HLA class II molecules was predicted for core sequences contained in 15-mer peptides using NetMHC 3.2. 15-mer peptides typically contained 1 to 3 core sequences, for which binding to DRB1*0101, DRB1*0401, DRB1*0701, and DRB1*1101 was predicted. MHC class II binding peptide cores were classified either as weak binders ($IC_{50}$>50 nM and <500 nM) or strong binders ($IC_{50}$<50 nM).

Variability and Conservation Metrics

The calculation of information content of residues in a multiple sequence alignment (MSA) of homologous protein sequences is based on the calculation of Shannon entropy [see, Shannon C E: A mathematical theory of communication. Bell System Technical Journal 1948, 27:379-423. 623-656] using the following formula:

$$H(x) = -\sum_{i=1}^{l} P_i(x)\log_2(P_i(x))$$

where H is the entropy (in units called bits), x is the position in the MSA, i represent individual amino acids at position x, l is the number of different amino acids on position x, and Pi(x) is the frequency of the given amino acid on position x. The conservation of a given position is defined as the frequency of the consensus amino acid (most frequent at a given position).

Block Entropy

Shannon entropy can similarly be calculated for each peptide in a block. Each block contains W unique peptides of length l in a dataset of N sequences of length L. Thus. L-l blocks, B, of N or fewer unique peptides can be extracted. The application in conservation analysis is the identification of peptides, which together as a subset, $S_w$, of W represents a given fraction of W. The formula for calculation of block entropy is:

$$H(B_x) = -\sum_{w=1}^{W} P_w(x)\log_2(P_w(x))$$

where $H(B_x)$ is the total entropy of a block of peptides starting at position x, w is a unique peptide in the space of W unique peptides in block $B_x$. $P_w(x)$ is the frequency of peptide w at position x.

Sequence Logos

Sequence logos were used to visualize the information content (measured in bits) in each position within the blocks [see, Schneider T D, Stephens R M: Sequence logos: a new way to display consensus sequences. Nucleic Acids Res 1990, 18:6097-6100]. Sequence logos are visual representations of the Shannon entropy of the positions within a given sequence. The theoretical maximum entropy of a position in a protein sequence is $\log_2 20 \approx 4.32$ (corresponding to equal representation of all 20 amino acids), so each amino acid on a position can be represented by its fractional information content of the maximum. To generate sequence logos WebLogo was used [see, Crooks G E, et al.: WebLogo: a sequence logo generator. Genome Res 2004, 14:1188-1190].

Block Logos

A logo was designed for visualizing information content of blocks by modifying the sequence logo representation. Sequence logos are very informative about the occurrence of residues in each position, but do not carry valuable information about the frequencies of peptides. Since the theoretical maximum entropy of a block of unlimited size is $\log_2 20^9 \approx 39$ (corresponding to an equal representation of all possible 9-mers), the total entropy, H(B), of a block was used as the maximum bit on the Y-axis. The information content of each unique peptide, w, in each block, $B_x$, can be calculated as follows:

$$H(w) = P_w(x)H(B_x)$$

where H(w) is the entropy of peptide w, $P_w(x)$ is the frequency of peptide w, and $H(B_x)$ is the total entropy of the block, B, starting at position, x, in the MSA. The peptides were displayed from most to least frequent starting from the base of the X-axis.

Sequence and Epitope Data

The Immune Epitope Database (IEDB) [see Vita R, Zarebski L, Greenbaum J A, Emami H, Hoof I, Salimi N, Damle R, Sette A, Peters B: The immune epitope database 2.0. Nucleic Acids Res 2010, 38:D854-862.] was mined for known DENV MHC class I binders. For the block entropy analysis only complete DENV protein sequences extracted from GenPept were used[see, Benson D A, Karsch-Mizrachi I, Lipman D J, Ostell J, Sayers E W: GenBank. Nucleic Acids Res 2010, 38:D46-51]. These sequences were aligned using MAFFT [see, Katoh K, Toh H: Recent developments in the MAFFT multiple sequence alignment program. Brief Bioinform 2008, 9:286-298]. Only a small fraction (roughly 30%) of the retrieved polyprotein sequences from NCBI was annotated into protein products. The remaining proteomes were annotated using annotation from GenPept reference sequences within the MAFFT alignments. The numbers of sequences classified by protein and serotype are listed in Table 1, below.

TABLE 1

Sequence data used in analysis

| Protein | DENV serotype | | | | |
|---|---|---|---|---|---|
| | 1 | 2 | 3 | 4 | total |
| anC | 1235 | 872 | 739 | 189 | 3035 |
| prM | 1235 | 933 | 742 | 194 | 3104 |
| E | 1759 | 1487 | 1011 | 409 | 4666 |
| NS1 | 1226 | 912 | 595 | 106 | 2839 |
| NS2A | 1241 | 839 | 565 | 105 | 2750 |
| NS2B | 1241 | 838 | 565 | 105 | 2749 |
| NS3 | 1214 | 838 | 565 | 105 | 2722 |
| NS4A | 1214 | 837 | 566 | 105 | 2722 |
| 2K | 1214 | 838 | 566 | 105 | 2723 |
| NS4B | 1213 | 838 | 566 | 105 | 2722 |
| NS5 | 1209 | 835 | 566 | 105 | 2715 |
| total | 14001 | 10067 | 7046 | 1633 | 32747 |

The difference in sequence data availability between the four DENV serotypes meant that extra care was required to ensure broad coverage (i.e., to ensure the maximum number of conserved epitopes across different serotypes are identified). The dataset of DENV was adjusted so that all four serotypes were equally represented in the analysis. This was done by multiplying the dataset of each serotype X-fold, until the number of sequences included in the analysis for each serotype was within +/−10% of each other.

The main sources of viral sequences used in the analysis were GenBank® database and UNIPROT databases.

Example 2

Identification of Conserved DENV Peptide Blocks

This example describes identification of conserved peptide blocks in DENV1-4 polypeptides.

DENV polyprotein sequences were aligned in MSAs. FIGS. 66-69 show the GenBank® Accession numbers for each protein (polypeptide) aligned in the DENV1 (FIG. 66), DENV2 (FIG. 67), DENV3 (FIG. 68) and DENV4 (FIG. 69) MSAs. The sequences referenced in FIGS. 66-69 were combined for the "DENVall" MSA.

A search of the IEDB for experimentally determined DENV CD8+ T-cell epitopes resulted in a list of 190 verified 9-mer epitopes. The average % presence of known T-cell epitopes across the DENV1-4 proteins is 37.13%. Only 18 (9.47%) of all known epitopes were present in >90% of the DENV1-4 sequences (FIG. 1). Thus only 9.47% of the known epitopes would be included as potential vaccine targets when using traditional criteria for epitope selection (i.e., >90% conservation of individual amino acids). Thus, in the present Example it was sought to broaden the number of potential targets (immunogenic epitopes) identified using a new approach to conservation analysis.

By using the conservation thresholds defined in the Materials and Methods section (Example 1), above, each protein was examined for conservation of blocks. All blocks of 8, 9, 10, and 11 residues in length (8-, 9-, 10- and 11-mers) found in the MSA of DENV polyproteins were analyzed. For each block, the block entropy, the number of peptides needed to "cover 99% of a block" (achieve a cumulative fraction of at least 99%), the coverage of each of the four DENV serotypes, and the total number of peptides in each block was determined. The data for DENV1-4 and DENVall (all 4 serotypes) 8-mers, 9-mers, 10-mers and 11-mers are shown in tables shown in FIGS. 2-21. In each of the figures, the tables list by column the polypeptides analyzed in the MSAs, the starting position in the block of polypeptides, the calculated block entropy, the total number of unique peptides in the block, the number of unique peptides that were required to "cover 99% of the block" (i.e. to achieve a cumulative fraction of polypeptides in the MSA, by adding together each unique peptide's frequency within the polypeptides in the MSA, of 99%), the gap/X fraction (i.e., the fraction of polypeptide sequences in the MSA that contained a gap in the indicated peptide block), an affirmation that 5 or fewer peptides were required ("Y"='yes') (to "cover 99% of the block"), the amino acid sequences of the 5 or fewer peptides in the block that were required to "cover 99% of the block", and the frequency of each unique peptide within the polypeptides in the MSA.

The conservation data for 8-mer, 9-mer, 10-mer, and 11-mer blocks are further summarized in Table 2, below.

TABLE 2

Summary of Conserved DENV Peptide Blocks

| Peptide length | Total number of blocks | Blocks with 99% coverage with <=5 peptides | Distribution of number of peptides in blocks | | | | |
|---|---|---|---|---|---|---|---|
| | | | 1 peptide | 2 peptides | 3 peptides | 4 peptides | 5 peptides |
| 8 | 3393 | 1732 | 199 | 355 | 388 | 460 | 330 |
| 9 | 3392 | 1551 | 142 | 319 | 341 | 435 | 314 |
| 10 | 3391 | 1394 | 102 | 278 | 295 | 418 | 301 |
| 11 | 3390 | 1245 | 75 | 228 | 266 | 386 | 290 |

As summarized in Table 2, above, it was determined that there were 1,732, 1,551, 1,394, and 1,245 conserved blocks of 8, 9, 10, and 11-meric peptides, respectively, in DENV1-4 polypeptides. In contrast, previously, just 206, 165, 118, and 88 conserved 8, 9, 10, and 11-meric peptides, respectively, had been identified (see, Khan et al. (2008)). Thus a ~10-fold expansion of the target space (number of target peptide epitopes) was achieved; thereby providing greater numbers of potential T-cell epitope candidates for further examination, compared to traditional approaches. Further, conserved blocks were identified in the proteins anC, prM, NS2A, NS2B, NS4A, and 2K, proteins which have previously been considered too variable for mapping T-cell epitope candidates with cross-protective potential.

Figure 22A:
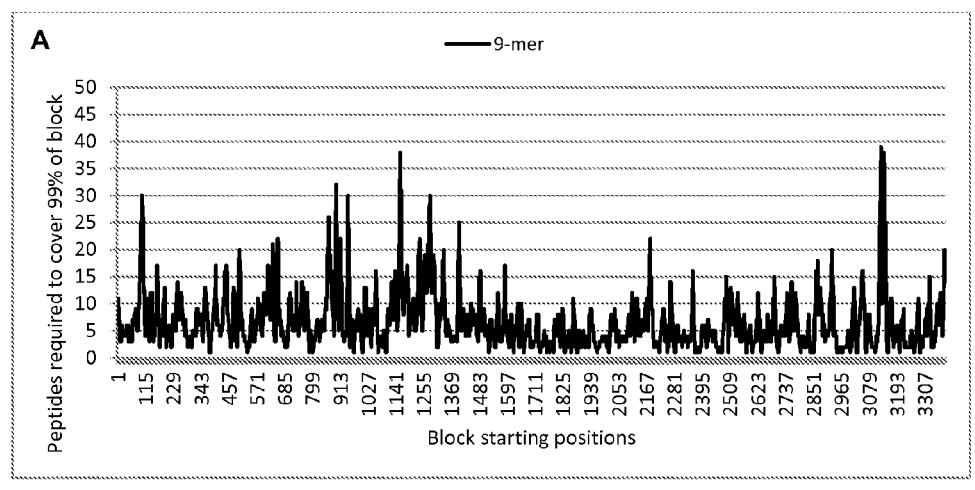
FIG. 22A is a graph depicting the number of 9-mer peptides required to "cover 99% of a block" (i.e. to achieve a cumulative fraction of polypeptides in the MSA, by adding together each unique peptide's frequency within the polypeptides in the MSA, of at least 99%), for each possible start position in the MSA that corresponds to all DENV proteomes.
Figure 22B:
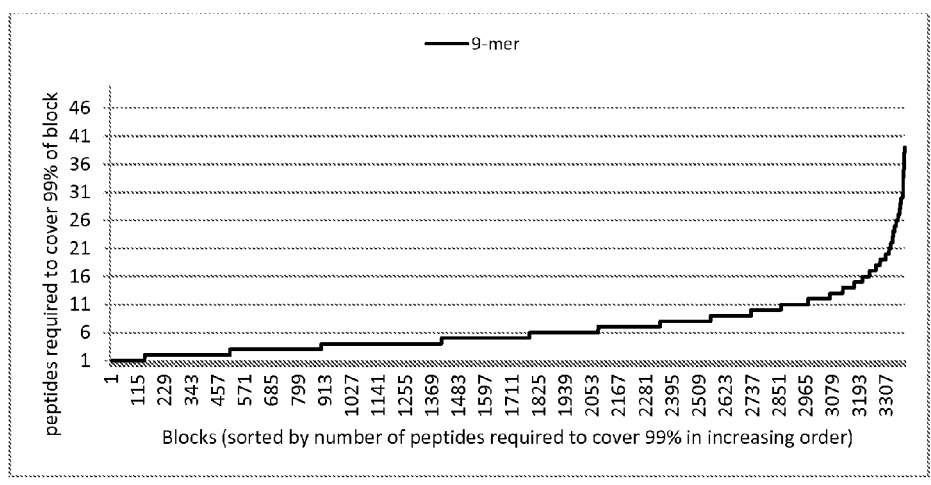
FIG. 22B is a graph depicting the number of 9-mer peptides in all DENV proteomes required to "cover 99% of a block" (i.e. to achieve a cumulative fraction of polypeptides in the MSA, by adding together each unique peptide's frequency within the polypeptides in the MSA, of at least 99%), sorted in increasing order of required number of peptides.
Figure 22C:
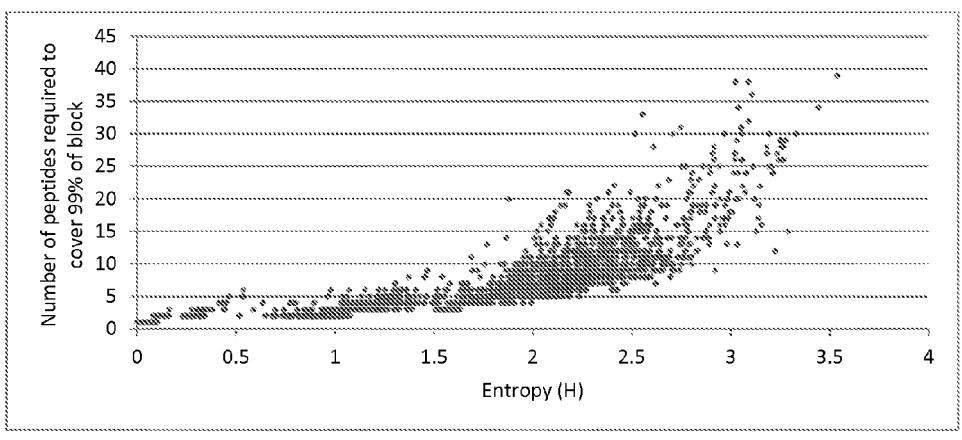
FIG. 22C is an X, Y scatter plot of the number of peptides required to "cover 99% of a block" (i.e. to achieve a cumulative fraction of polypeptides in the MSA, by adding together each unique peptide's frequency within the polypeptides in the MSA, of at least 99%), against the entropy of each given block from all DENV proteomes.
Figures 23, 108:
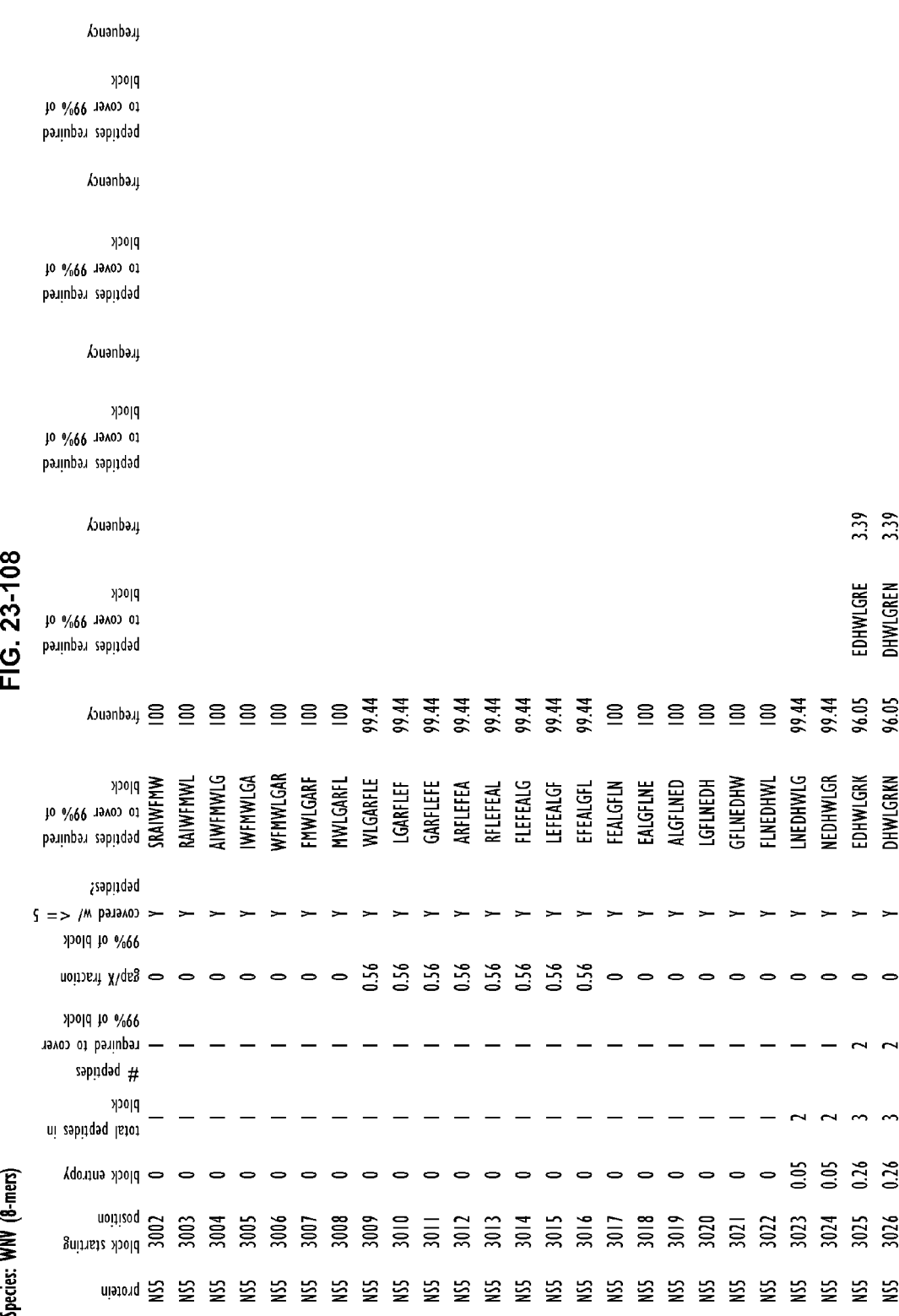
Figures 24, 100:
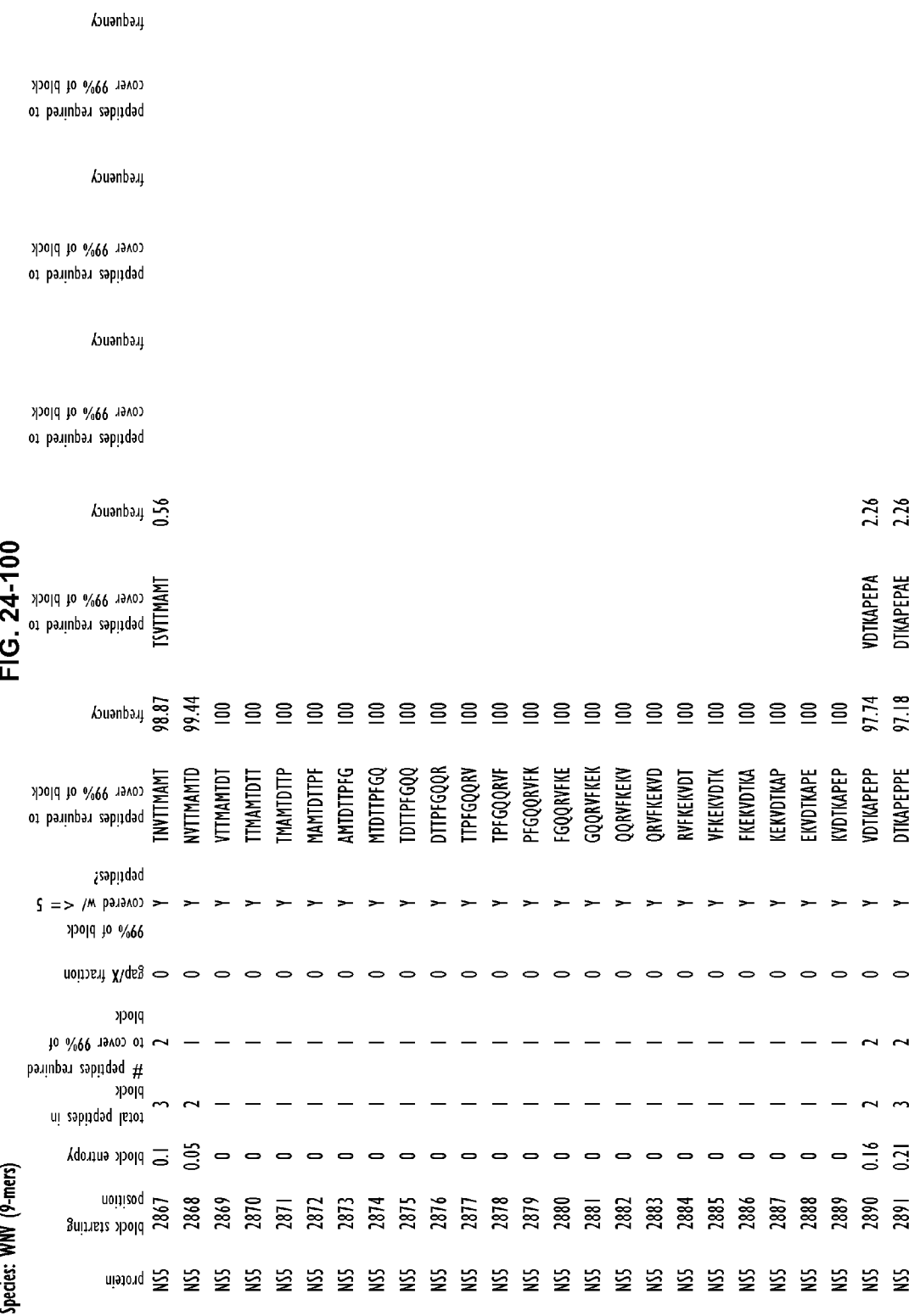
Figures 25, 111:
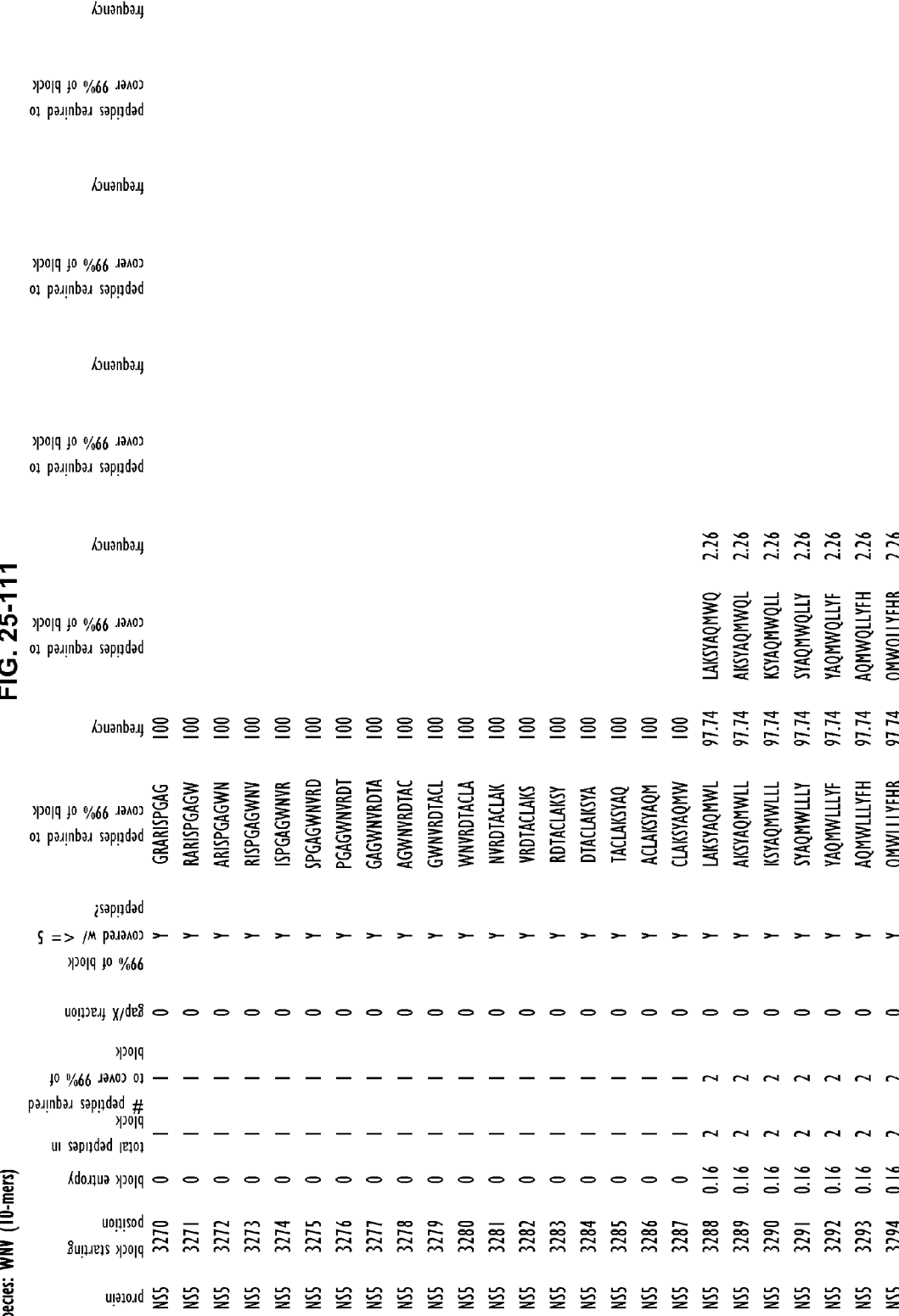
Figures 9, 27:
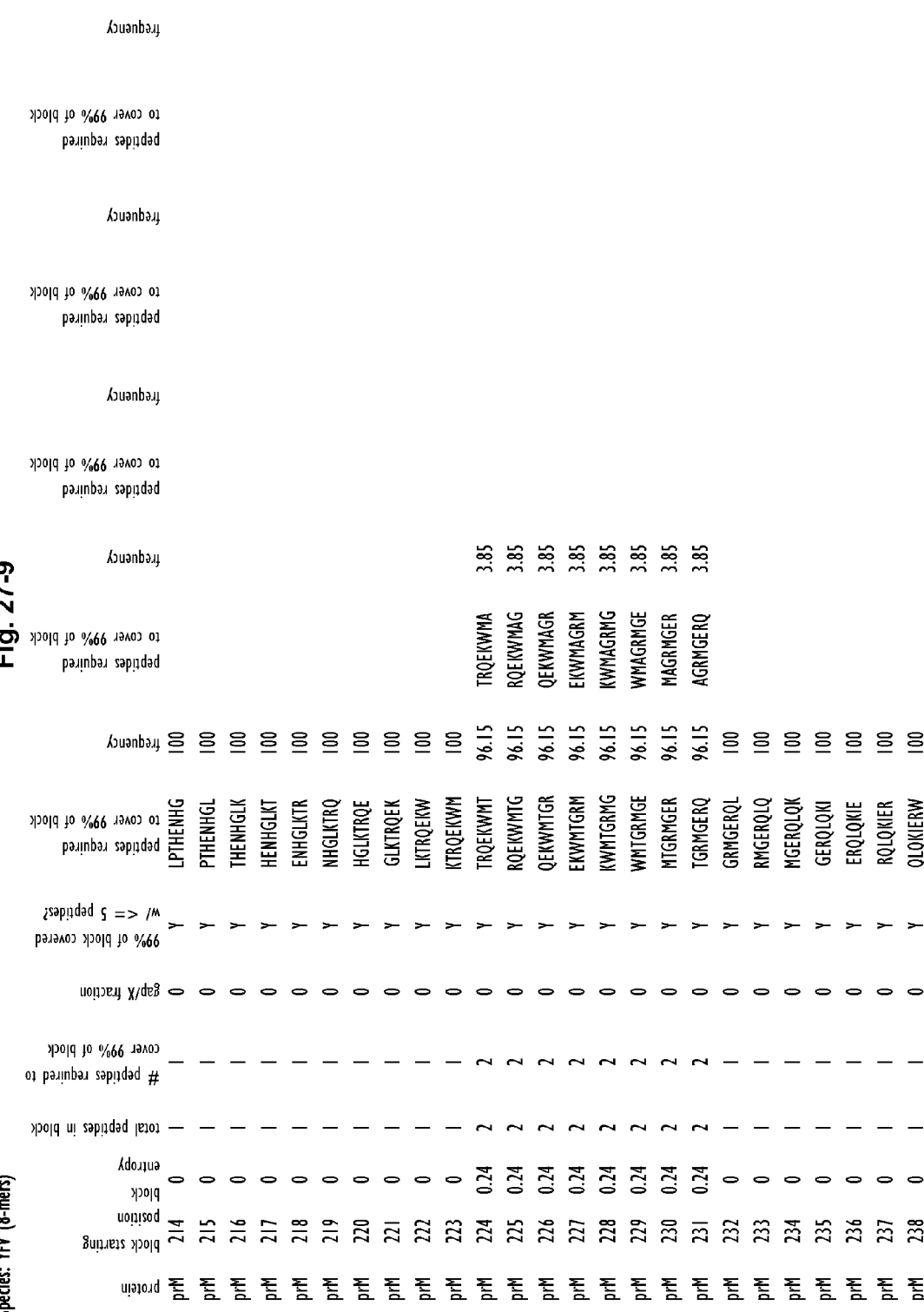
Figures 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71:
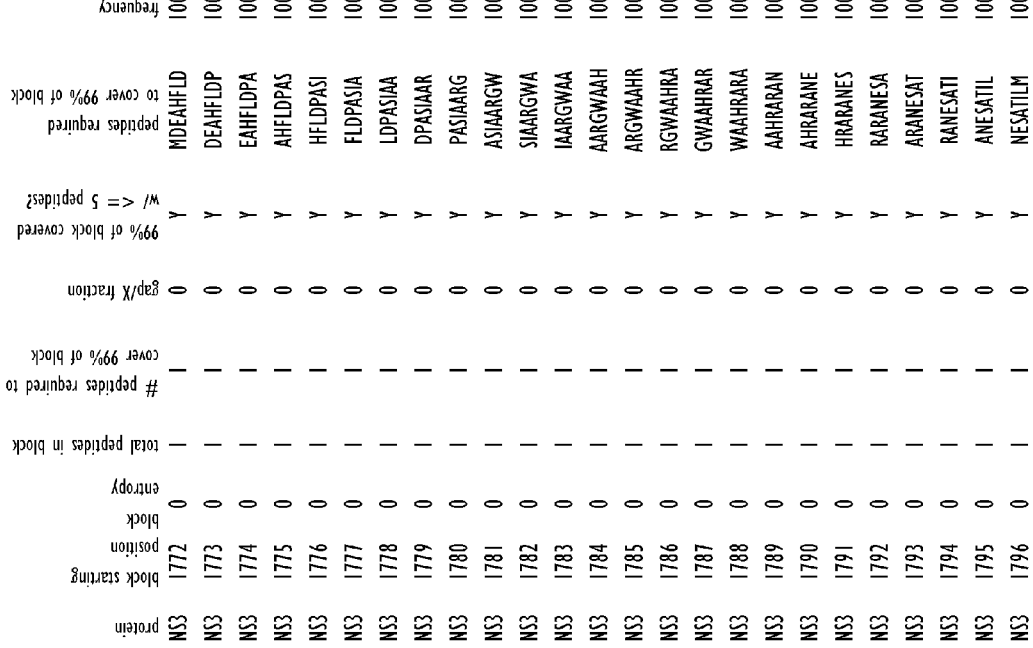
Figures 27, 108:
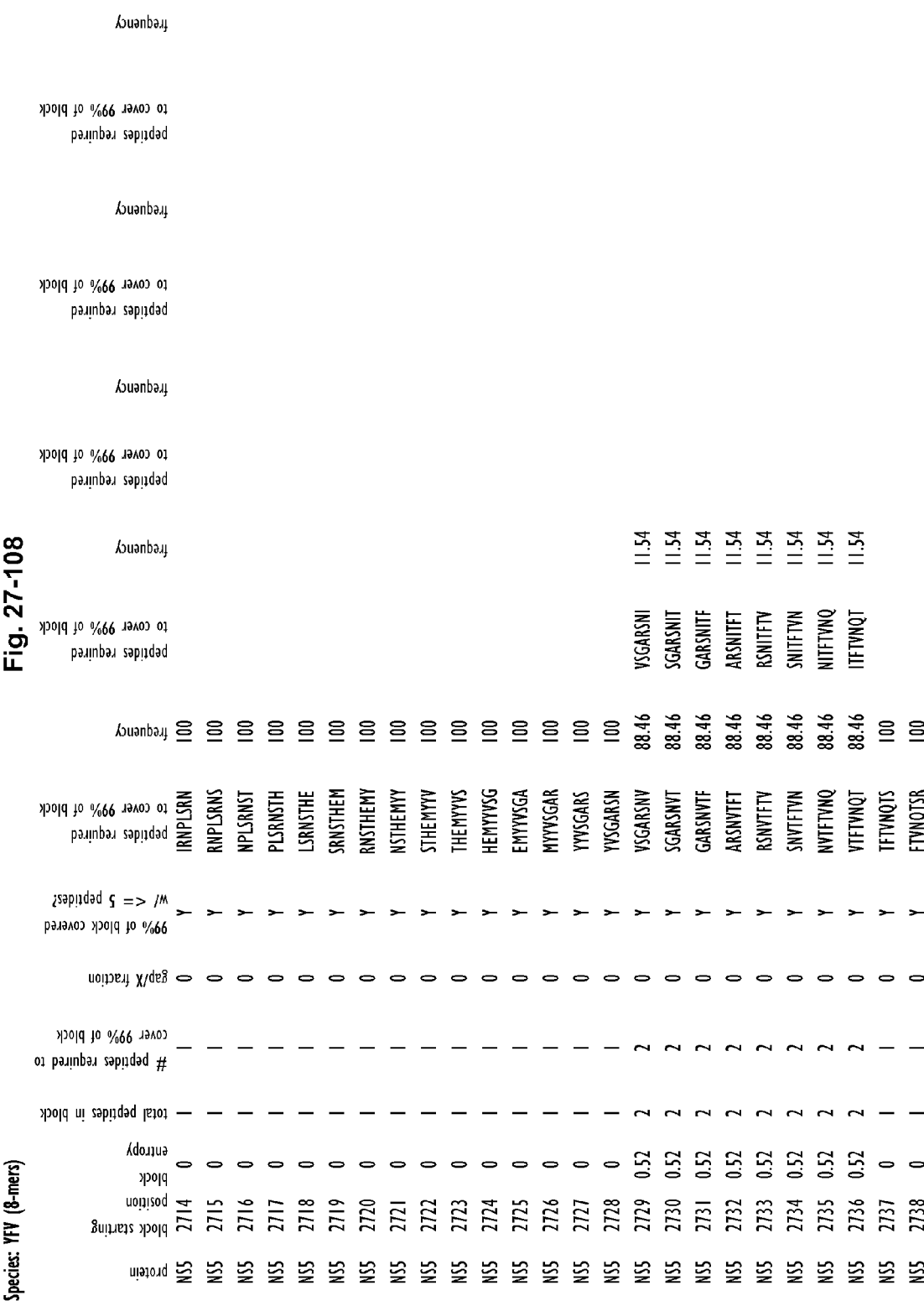
Figures 1, 28:
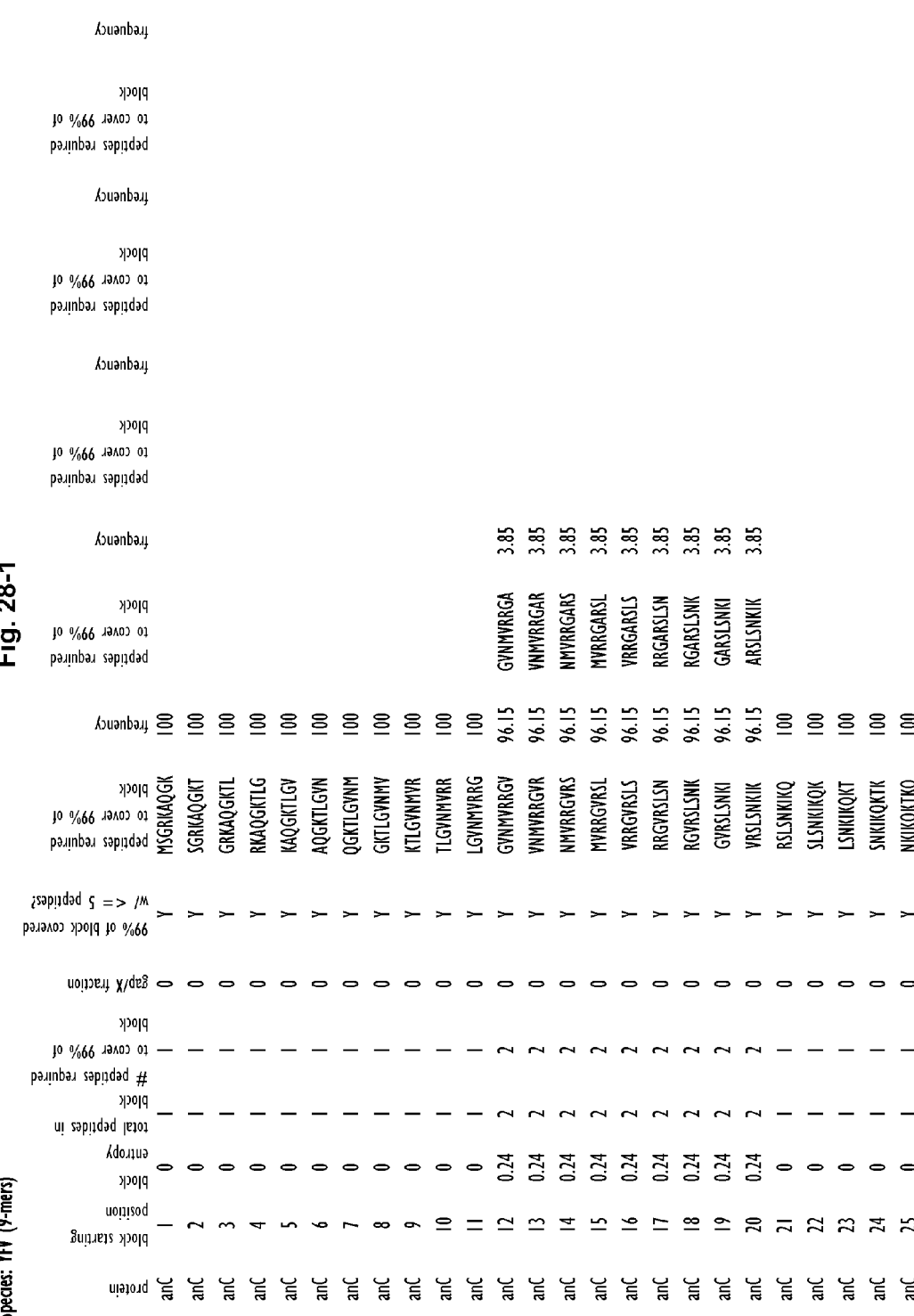
Figures 11, 28:
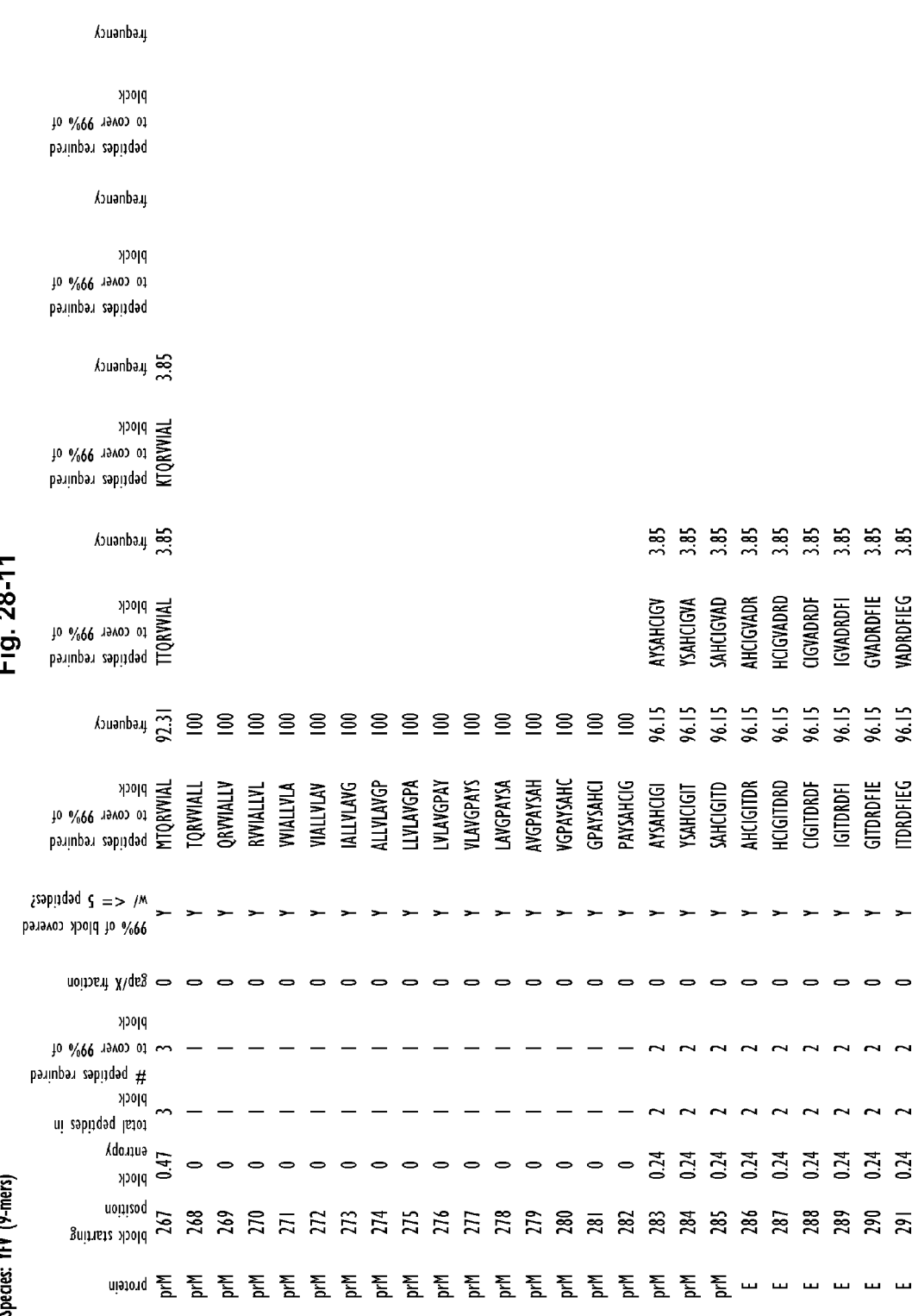
Figures 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72:
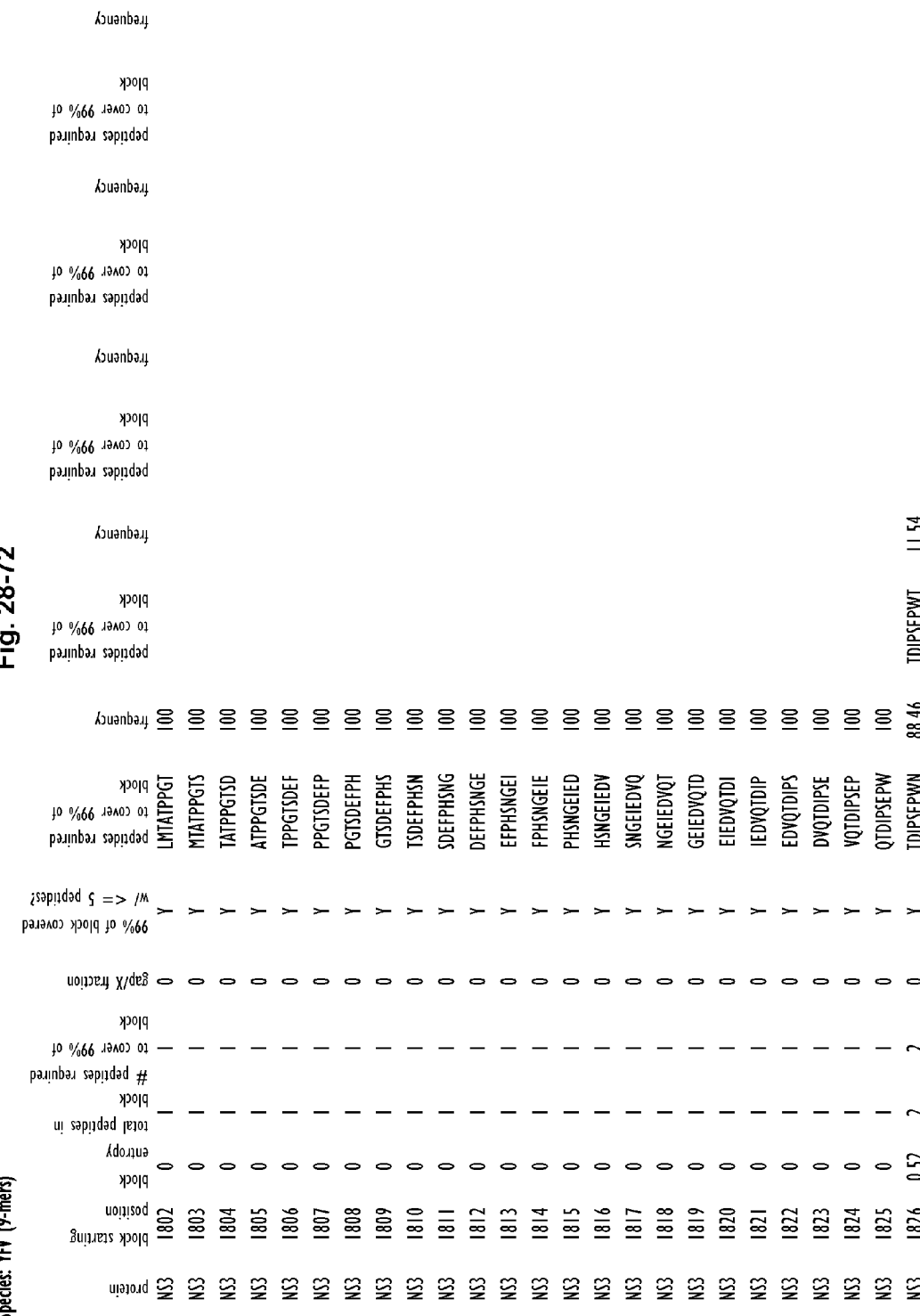
Figures 28, 91:
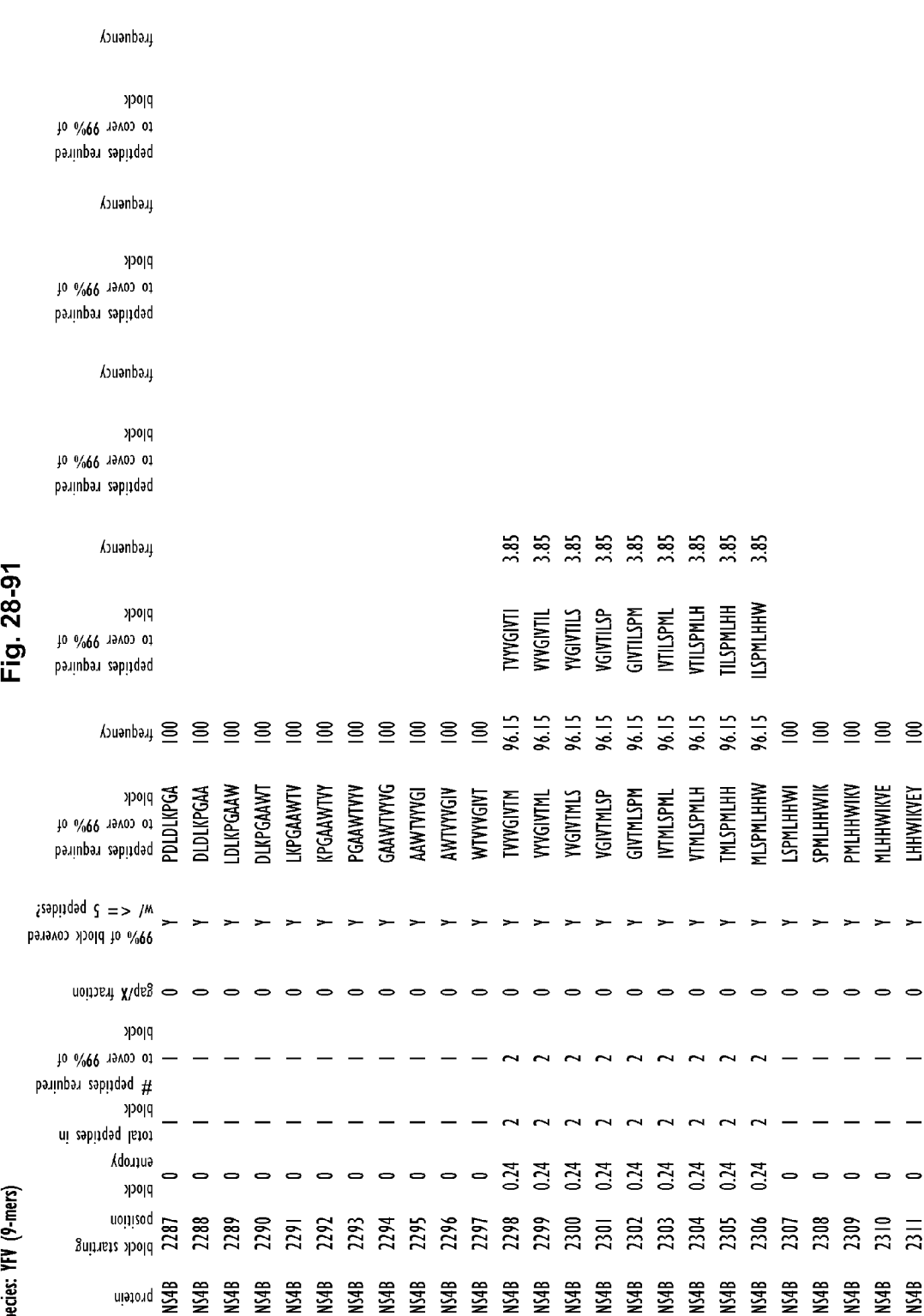
Figures 6, 30:
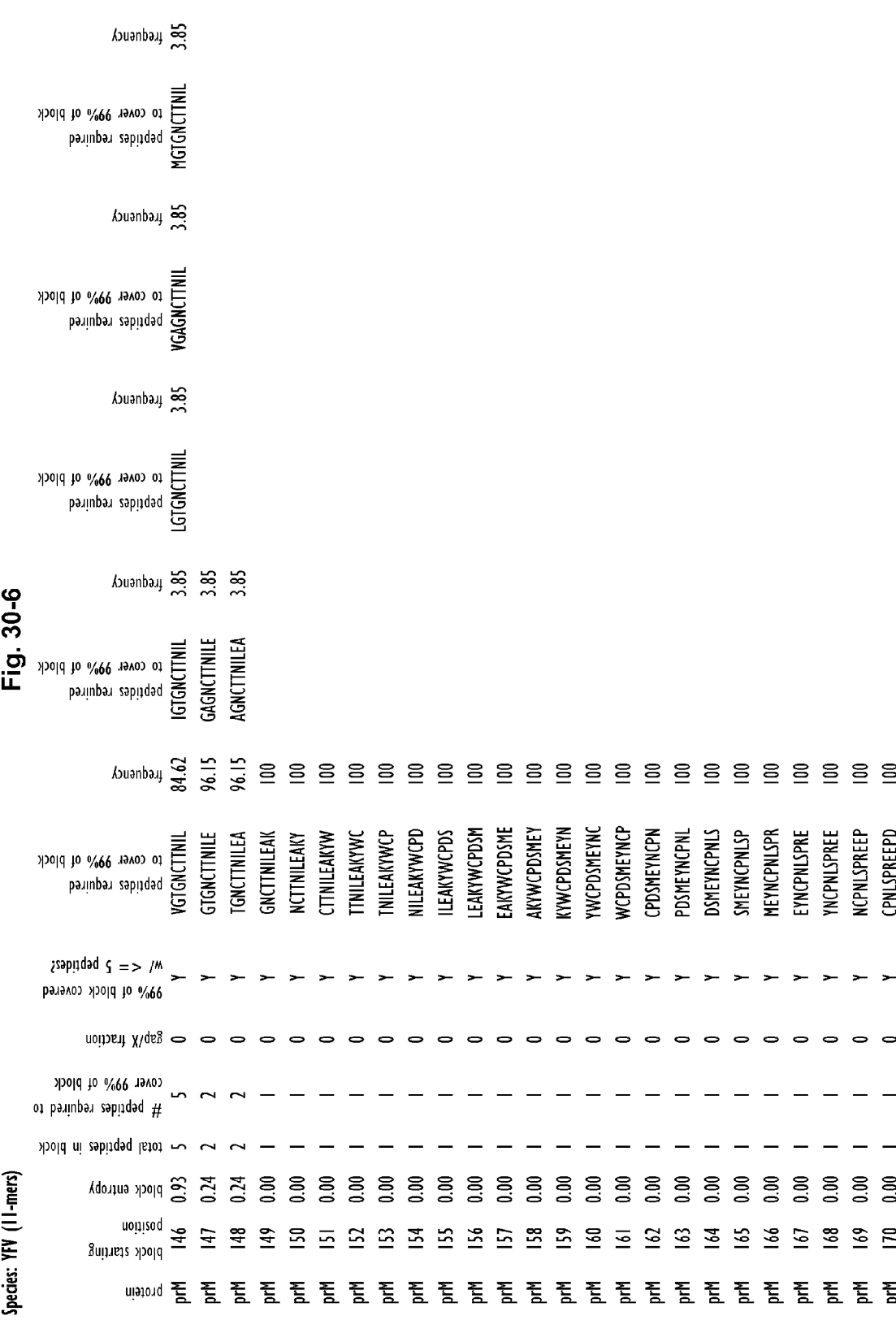
Figures 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70:
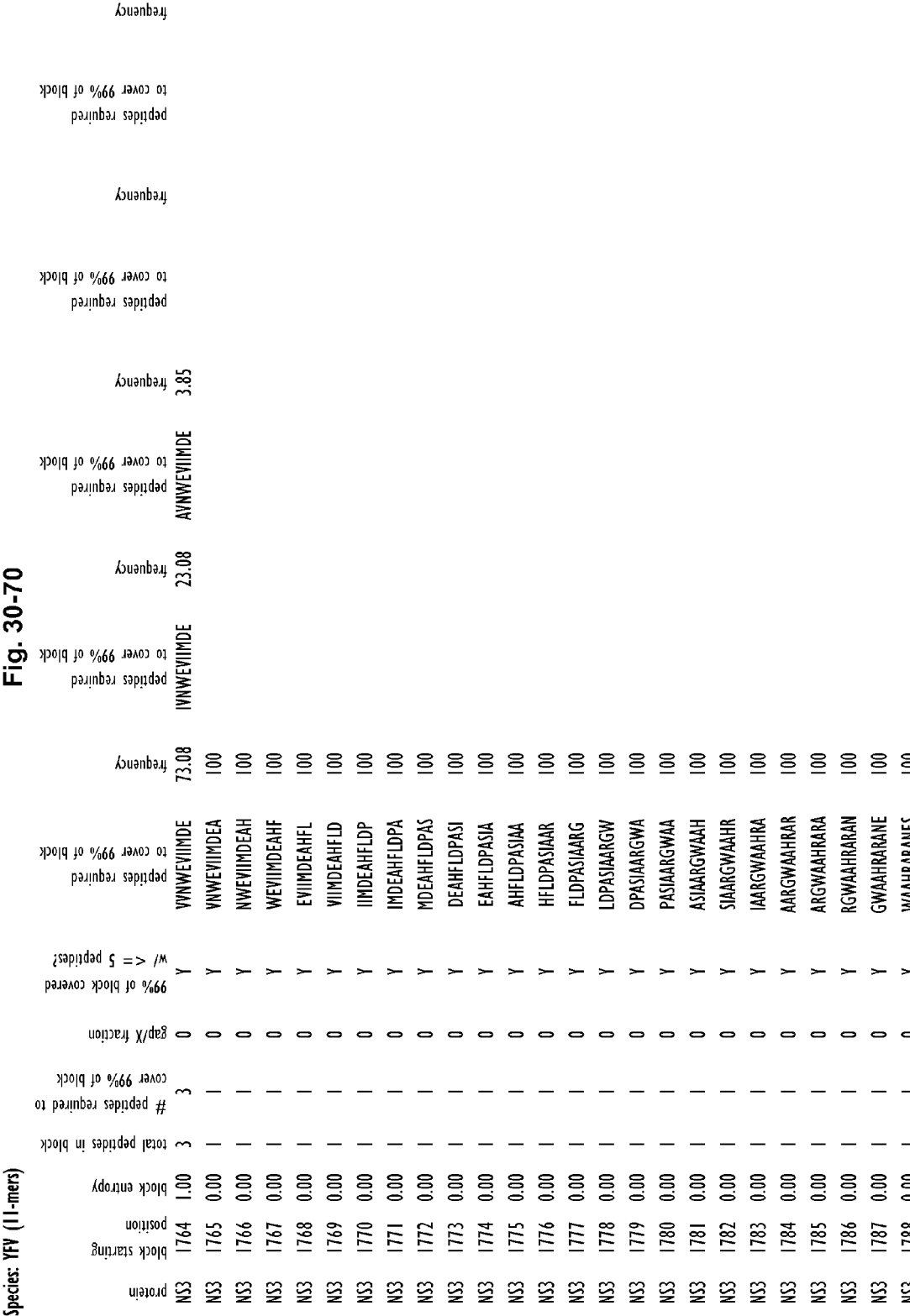
Figures 32, 33, 34, 35, 36, 37, 38, 39, 40, 41, 42, 43, 44, 45, 46, 47, 48, 49, 50, 51, 52, 53, 54, 55, 56, 57, 58, 59, 60, 61:
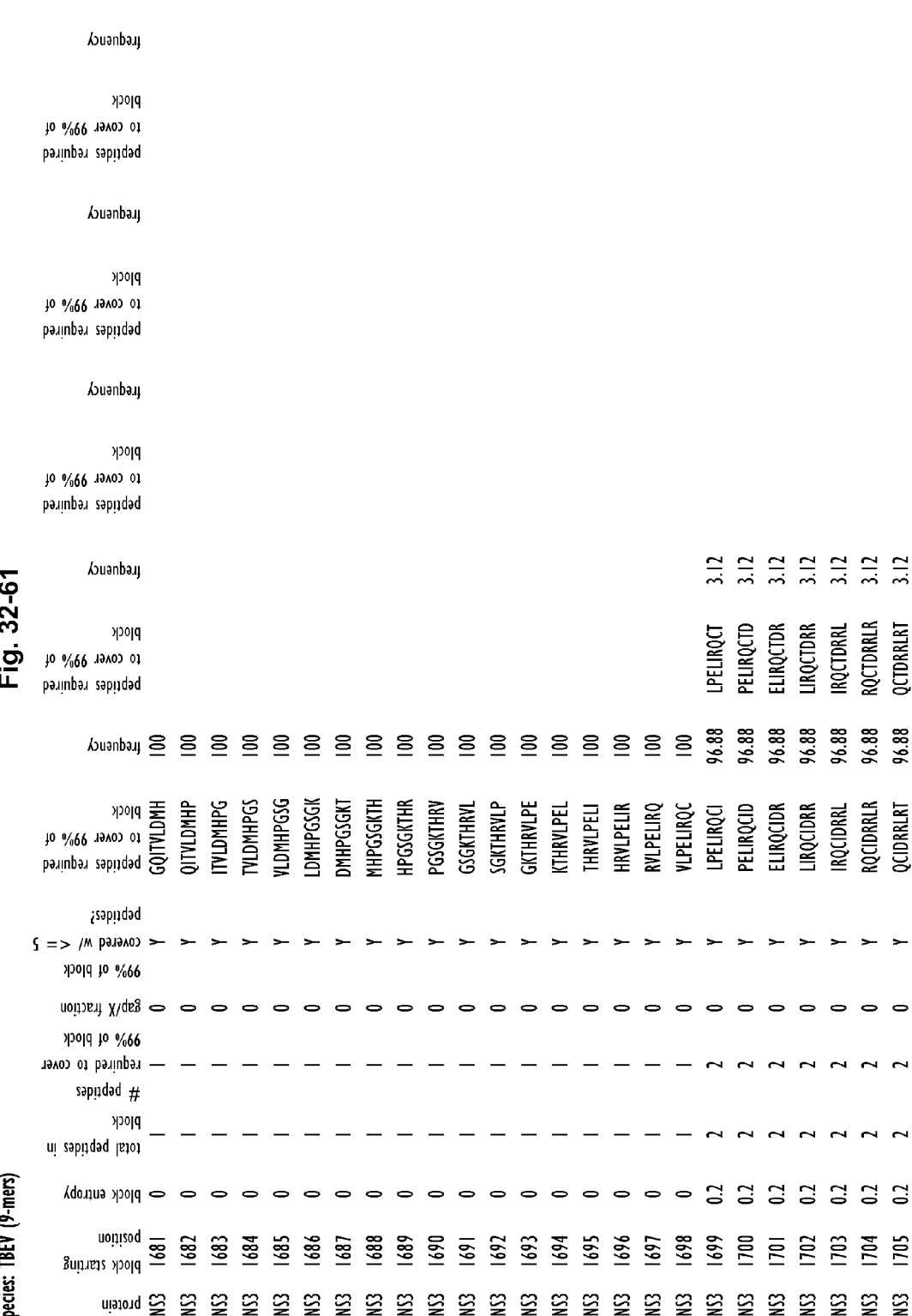
Figures 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71:
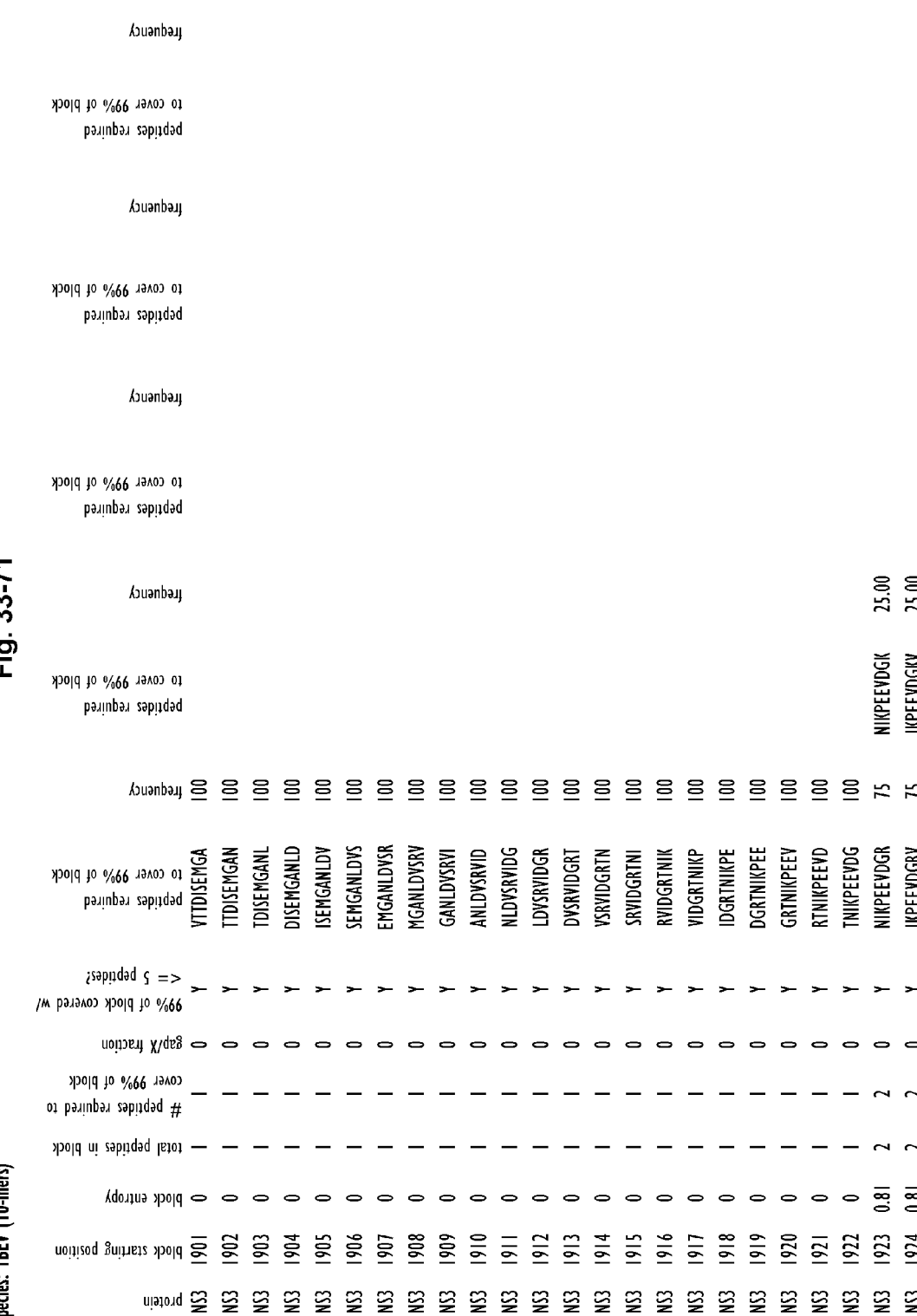
Figures 33, 90:
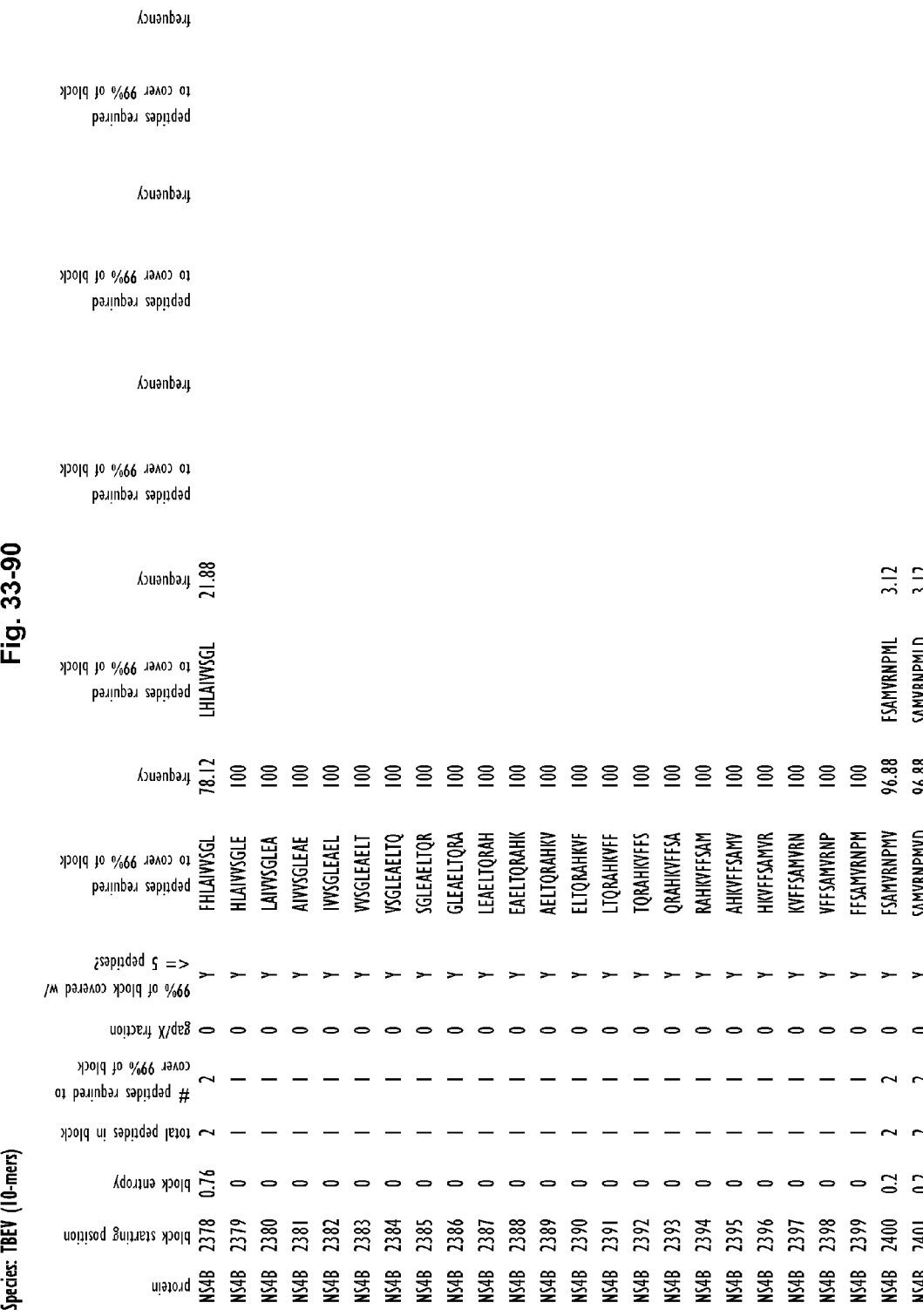
Figures 33, 97:
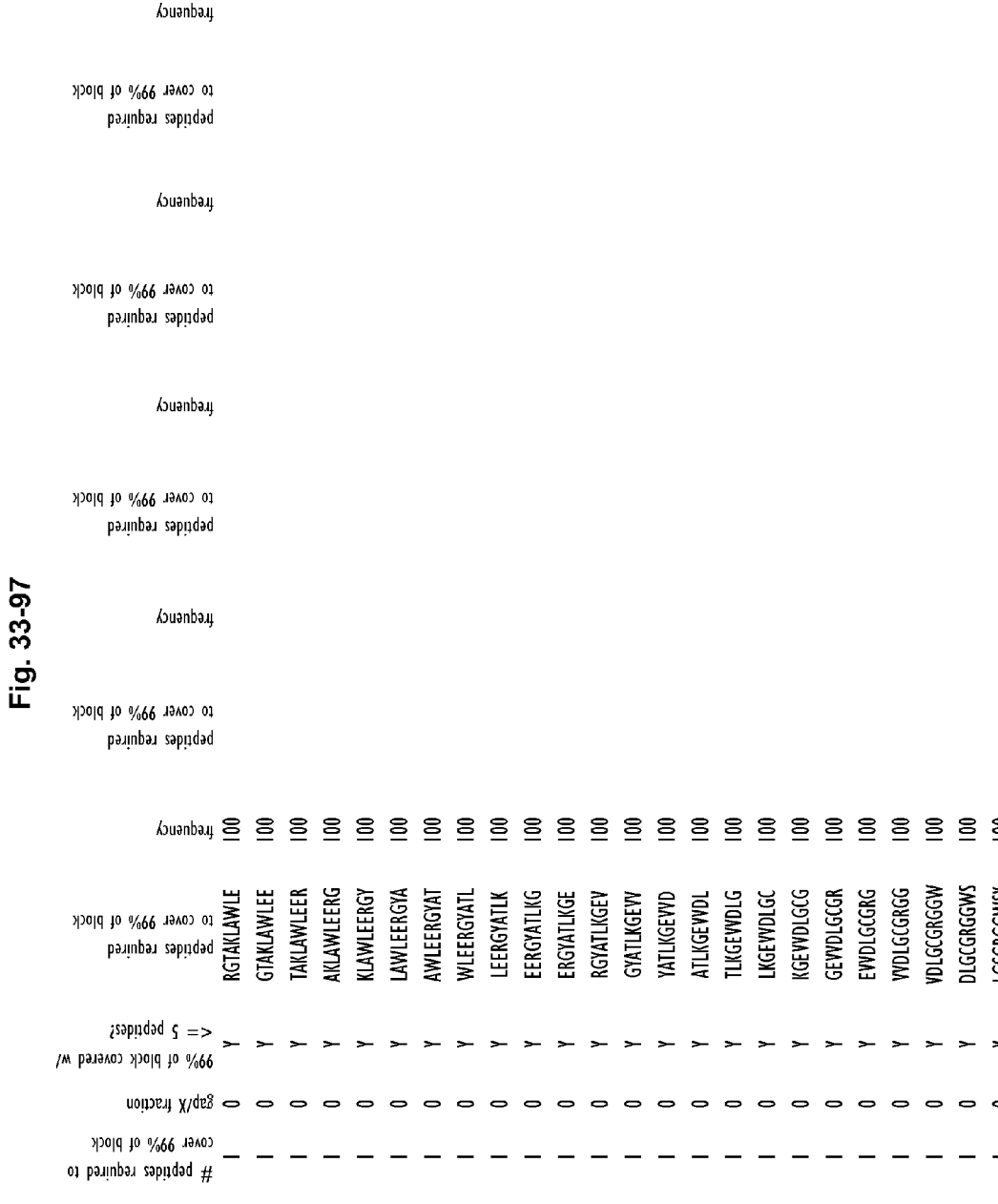
Figures 30, 34:
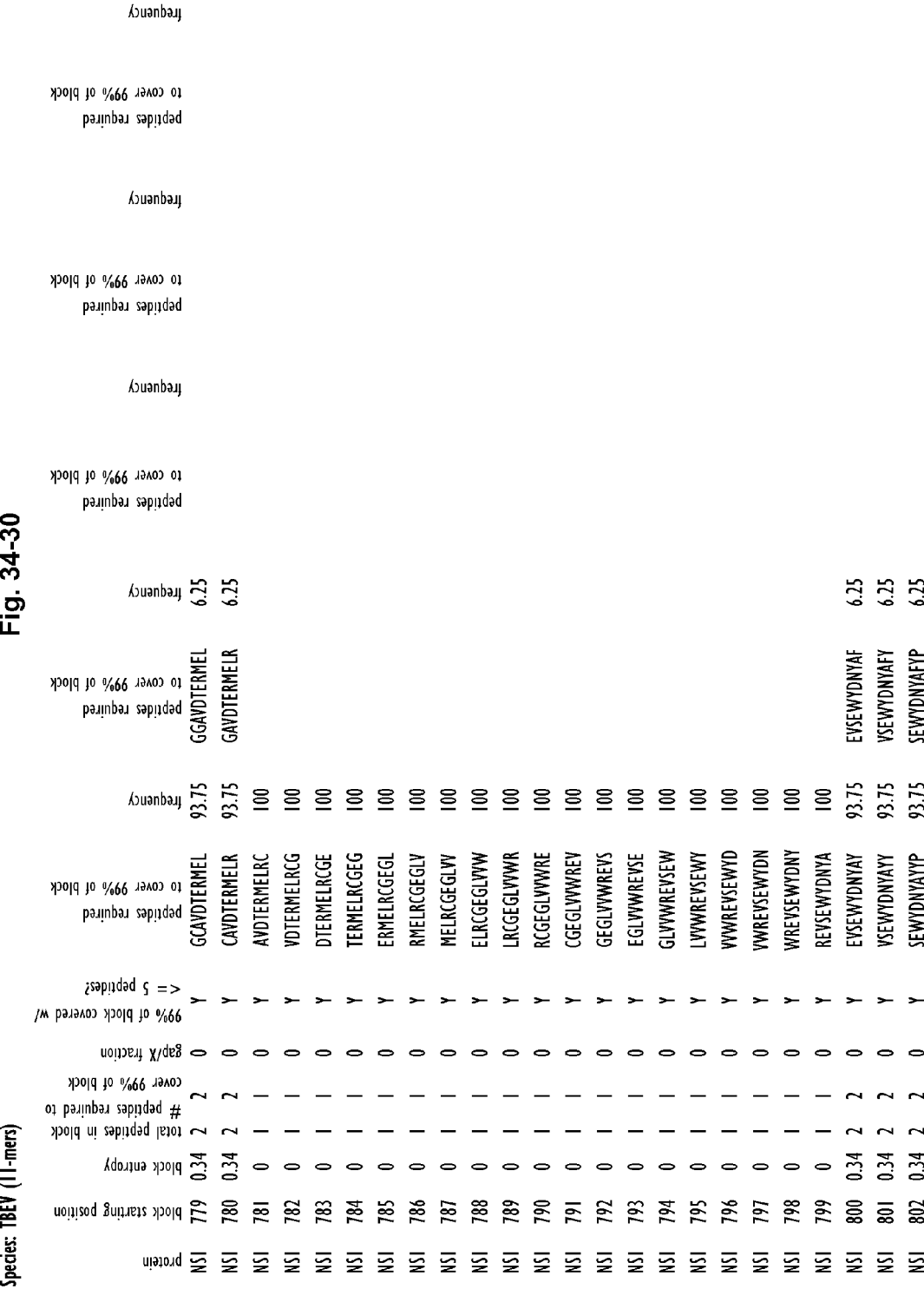
Figures 34, 95:
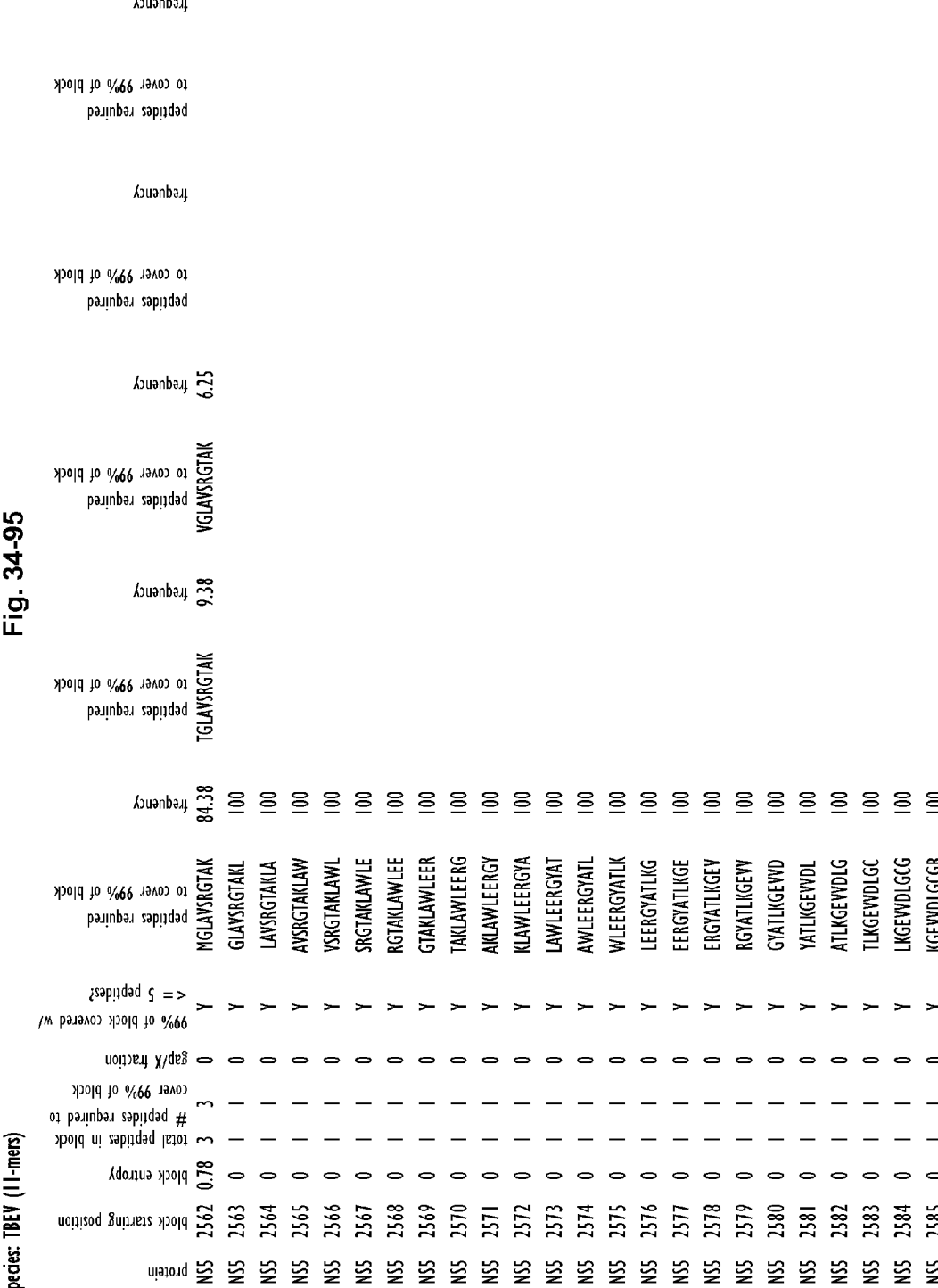
Figures 36, 113:
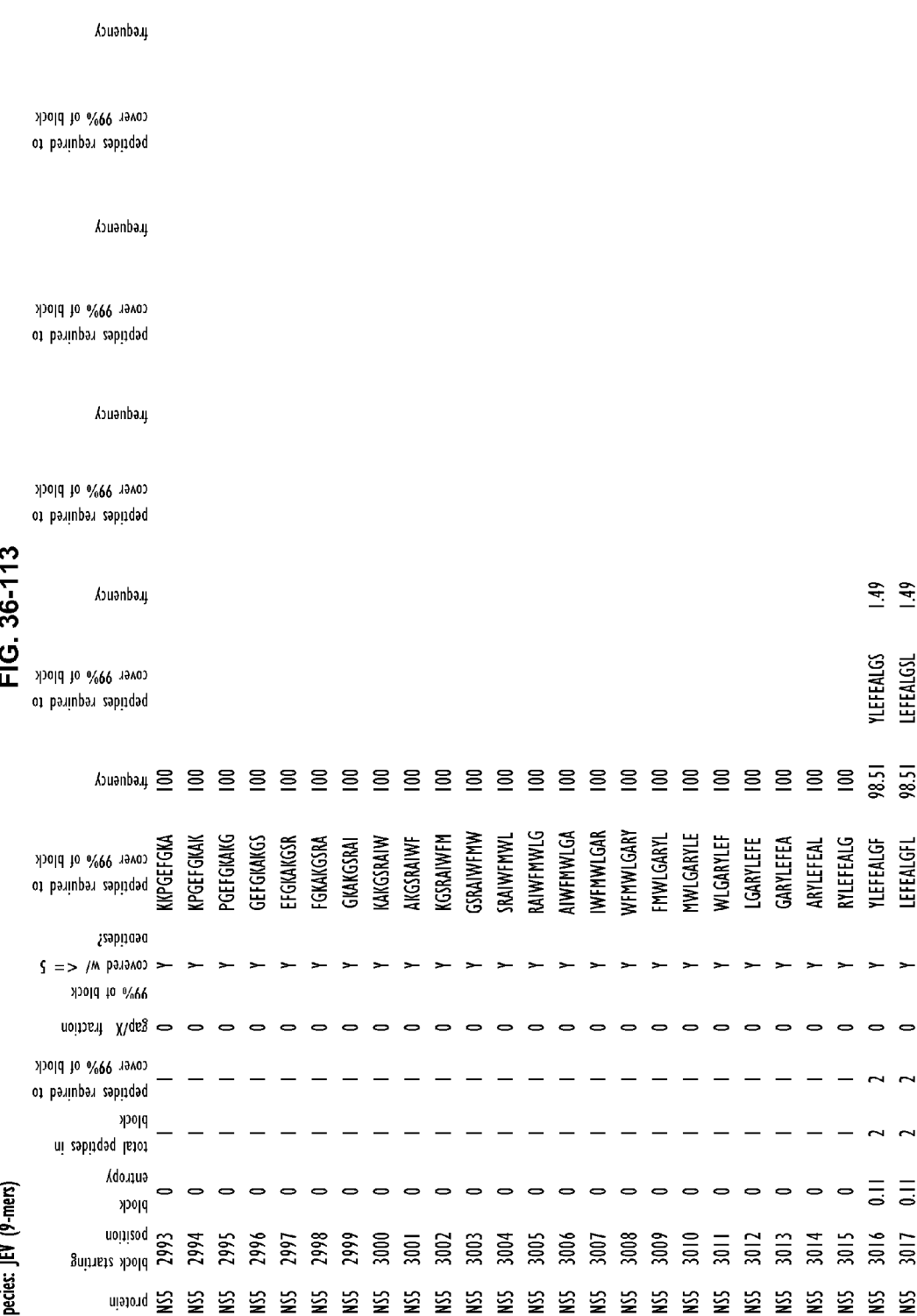
Figures 37, 111:
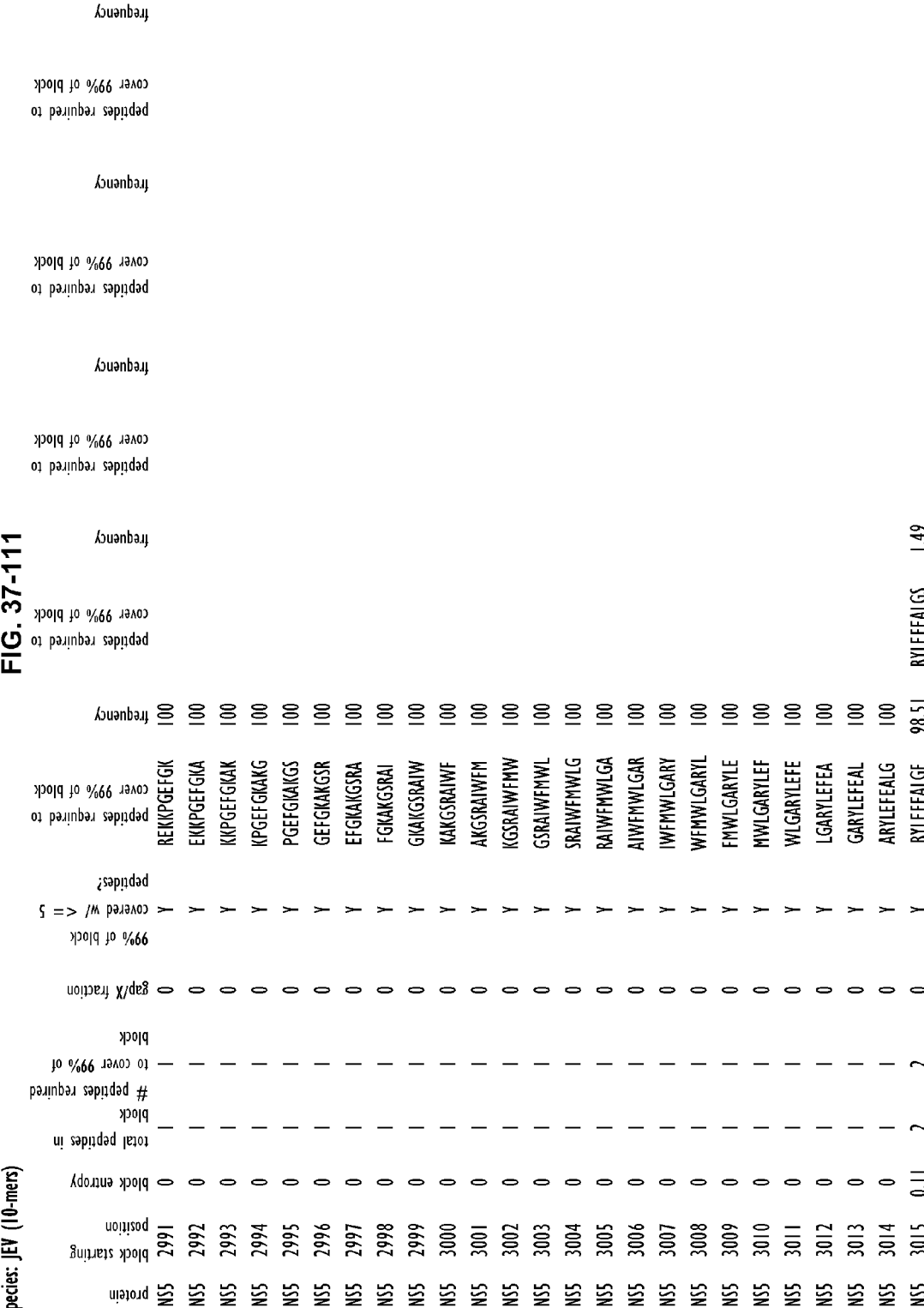

The number of peptides required to "cover 99% of the block" (i.e., to achieve a cumulative fraction of polypeptides in the MSA, by adding together each unique peptide's frequency within the polypeptides in the MSA, of 99%) for each position in the proteome is shown in FIGS. 22A and 22B. FIG. 22A plots the number of 9-mer peptides required to "cover 99% of the blocks" as a function of the block starting position, and FIG. 22B plots the number of peptides required to "cover 99% of the block" on the Y-axis versus the number of blocks sorted by increasing numbers of peptides required to cover 99% in increasing order of the number of peptides. The analysis was also carried out for 8-mers, 10-mers and 11-mers, with the data showing the same trends as those shown for 9-mers in FIGS. 22A and 22B. Peptide block conservation relative to protein length was highest in the NS4B and lowest in NS2A proteins. In NS4B, 166 blocks of 9-mers (69.1% of blocks in this protein) were conserved whereas NS2A showed only 8.83% block conservation. The average entropy for blocks of 9-mer peptides was 1.70 with a standard deviation of 0.71 (FIG. 22C).

Example 3

Identification of Conserved Peptide Blocks in WNV, YFV, TBEV, JEV, panFIVE and panFLAVI This example describes identification of conserved peptide blocks in MSAs of polypeptides from WNV, YFV, TBEV, JEV, "panFIVE" (DENV1-4, WNV, YFV, TBEV and JEV) and "panFLAVI" (all flaviruses).

Identification of conserved peptide blocks was carried out as described in Example 2, above. All blocks of 8-mers, 9-mers, 10-mers, and 11-mers found in the MSA of each of WNV, YFV, TBEV, JEV, panFIVE and panFLAVI polyproteins were analyzed. For each block, the block entropy, the number of peptides needed to "cover 99% of a block" (i.e. to achieve a cumulative fraction of polypeptides in the MSA, by adding together each unique peptide's frequency within the polypeptides in the MSA, of 99%), and the total number of peptides in each block was determined. The data are shown in FIGS. 23-26 for WNV 8-mers, 9-mers, 10-mers and 11-mers, respectively; FIGS. 27-30 for YFV 8-mers, 9-mers, 10-mers and 11-mers, respectively; FIGS. 31-34 for TBEV 8-mers, 9-mers, 10-mers and 11-mers, respectively; FIGS. 35-38 for JEV 8-mers, 9-mers, 10-mers and 11-mers, respectively; FIGS. 39-42 for panFIVE 8-mers, 9-mers, 10-mers and 11-mers, respectively; and FIGS. 43-46 for panFLAVI 8-mers, 9-mers, 10-mers and 11-mers, respectively.

The GenBank® Accession numbers for polyprotein sequences used in the WNV, YFV, TBEV, JEV, "panFIVE" (DENV1-4, WNV, YFV, TVE and JEV) and "panFLAVI" (all flaviruses) MSAs are shown in FIG. 70.

Example 4

Block Information Content

This example describes the block information content of DENV1-4 polypeptides.

The information content of individual blocks was examined. In Table 3, below, an example of a representative 9-mer block (number 388 of the NS3 protein) is shown.

TABLE 3

Information content of individual DENV peptide blocks

| # Peptide | Frequency | Acc. frequency | H (bits) | Serotypes containing peptide |
|---|---|---|---|---|
| 1 KTFDTEYQK (SEQ ID NO: 1) | 65.03 | 65.03 | 0.84 | DENV1(99.67%) DENV3(99.95%) |
| 2 KTFDSEYVK (SEQ ID NO: 2) | 28.69 | 93.72 | 0.37 | DENV1(0.08%) DENV2(92.64%) |
| 3 KTFDTEYPK (SEQ ID NO: 3) | 3.82 | 97.54 | 0.05 | DENV4(100%) |
| 4 KTFDSEYIK (SEQ ID NO: 4) | 1.18 | 98.71 | 0.02 | DENV2(3.84%) |
| 5 KTFDTEYTK (SEQ ID NO: 5) | 0.29 | 99.01 | 0.00 | DENV2(0.95%) |
| 6 KTFDSEYAK (SEQ ID NO: 6) | 0.29 | 99.30 | 0.00 | DENV2(0.95%) |
| 7 KTFDTEYIK (SEQ ID NO: 7) | 0.26 | 99.56 | 0.00 | DENV2(0.90%) |
| 8 RTFDTEYQK (SEQ ID NO: 8) | 0.11 | 99.67 | 0.00 | DENV1(0.24%) |
| 9 KTFETEYQK (SEQ ID NO: 9) | 0.11 | 99.78 | 0.00 | DENV1(0.16%) DENV3(0.17%) |
| 10 KTFDAEYVK (SEQ ID NO: 10) | 0.07 | 99.85 | 0.00 | DENV2(0.25%) |

TABLE 3 -continued

Information content of individual DENV peptide blocks

| # Peptide | | | | Frequency | Acc. frequency | H (bits) | Serotypes containing peptide |
|---|---|---|---|---|---|---|---|
| 11 KTFNTEYQK | (SEQ ID NO: | 11) | | 0.07 | 99.93 | 0.00 | DENV3 (0.34%) |
| 12 KTFDTEYQR | (SEQ ID NO: | 12) | | 0.04 | 99.96 | 0.00 | DENV3 (0.17%) |
| 13 KTFDFEYIK | (SEQ ID NO: | 13) | | 0.04 | 100 | 0.00 | DENV2 (0.12%) |

The frequency and information content of each peptide in the block was calculated and serotype distribution of these peptides was assessed. Five peptides were needed to cover >99% of the sequences within this block, covering approximately 65.03%, 28.69%, 3.82%, 1.18% and 0.29% (totaling 99.01%) of sequenced DENV strains, respectively. None of these peptides would have been included in a traditional conservation analysis, in which 80-90% (see, e.g., Khan et al., 2008) is a typical conservation threshold. Peptide 1 (KTFDTEYQK) (SEQ ID NO: 1) is a known ligand for HLA-03, -11, and -31. Peptides 2-5 (SEQ ID NOs: 2-5) are predicted to have similar binding affinity to peptide 1 for HLA-A3 supertype alleles using MULTIPRED2 [see, Zhang G L, et al.: MULTIPRED2: A computational system for large-scale identification of peptides predicted to bind to HLA supertypes and alleles. J Immunol Methods 2010]. This analysis also draws insight into the effects of threshold selection; if a loose block conservation threshold had been used (90%), the three least frequent peptides would also have been excluded, which would have excluded DENV4 peptides from the target set. The instant method, in contrast, includes DENV4 peptide KTFDTEYPK (SEQ ID NO: 3), present in 100% of DENV4 polyproteins. The 99% threshold on the other hand does exclude a set of rare peptides across DENV1-3 serotypes. Peptide number 5 was only found in five strains isolated in Senegal in the late sixties and three strains from Nigeria in the late nineties. Peptide 5 therefore appeared to be a low-fitness variant. Peptides 3 and 4 were found in strains isolated almost every year from 1944 to present and from 1983 to present, respectively. Both peptides were found distributed across Asia and Australasia and peptide 3 was also seen in Latin America and some parts of South America. It is therefore highly likely that strains containing these peptides will resurface again and proliferate in other parts of the world, as the geographic barriers of infection are dissolving in the wake of climate changes and increased recreational travel [see, Mackenzie J S, et al.: Emerging *flaviviruses*: the spread and resurgence of Japanese encephalitis, West Nile and dengue viruses. Nat Med 2004, 10:S98-109; Franco C, et al.: The dengue threat to the United States. Biosecur Bioterror 2010, 8:273-276]. The likeliness of resurgence of strains having rare peptides clearly demonstrates both the value of including variants, e.g., in peptide-based vaccines for DENV and other *flaviviruses*, and the limitations of simple conservation analysis (e.g., that described by Khan et al., 2008, and others), which would have excluded these rare peptides.

Figures 47A, 47B:
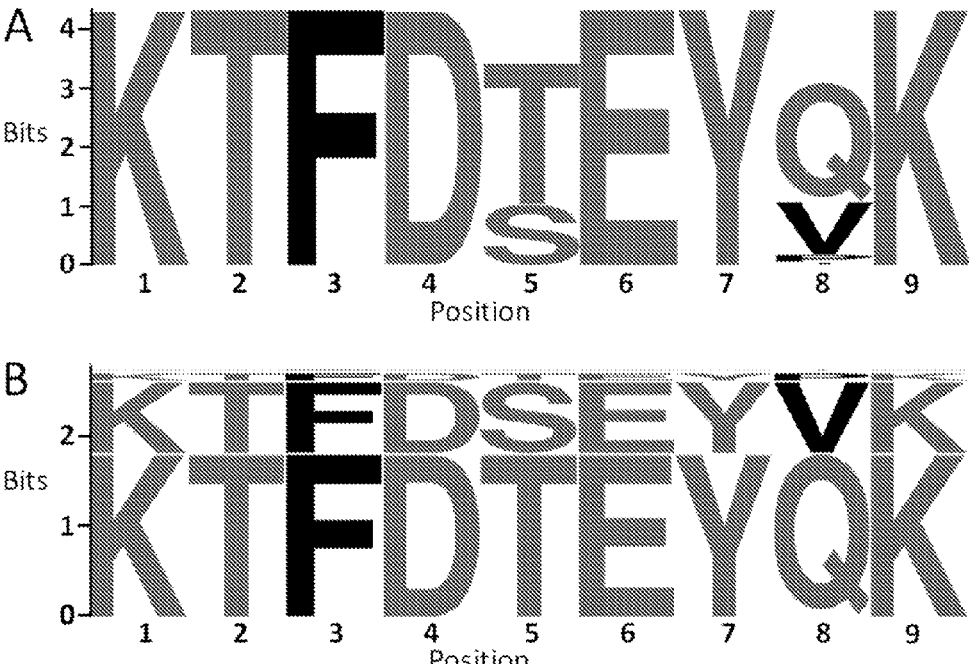
FIG. 47A is a sequence logo plot of the residues in the block starting at position 388 of the NS3 and FIG. 47B is a peptide block logo of the peptides in the same block.
Figure 51:
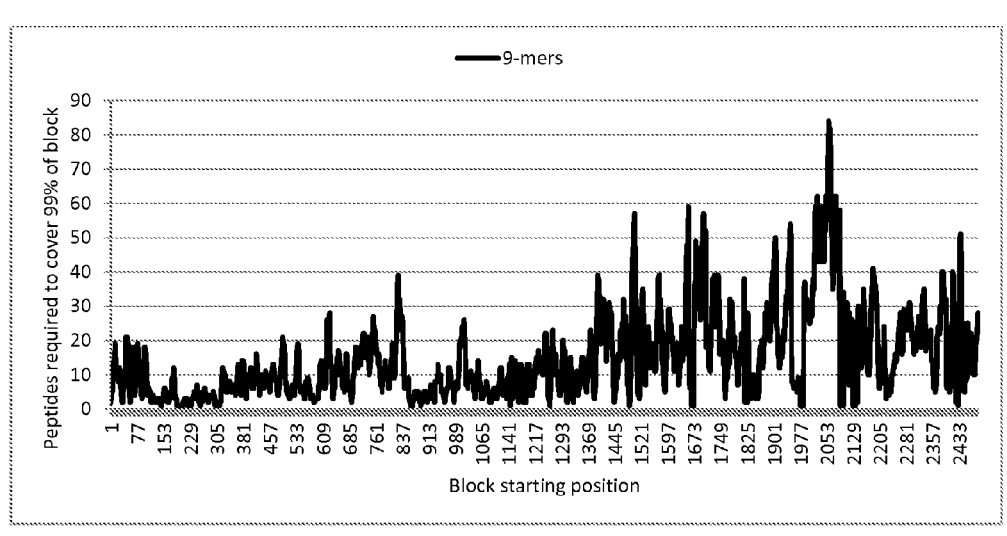
Figure 52:
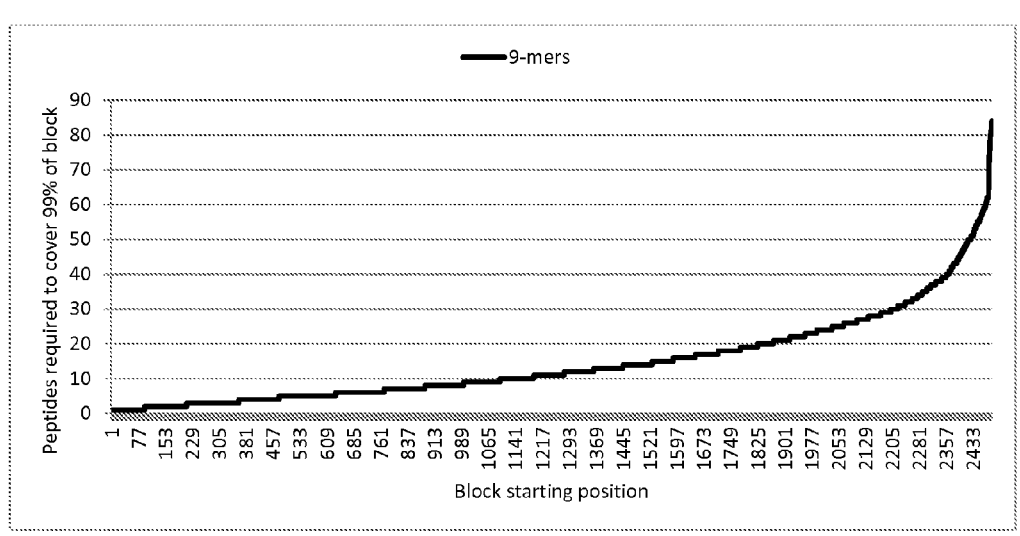
Figures 5, 64:
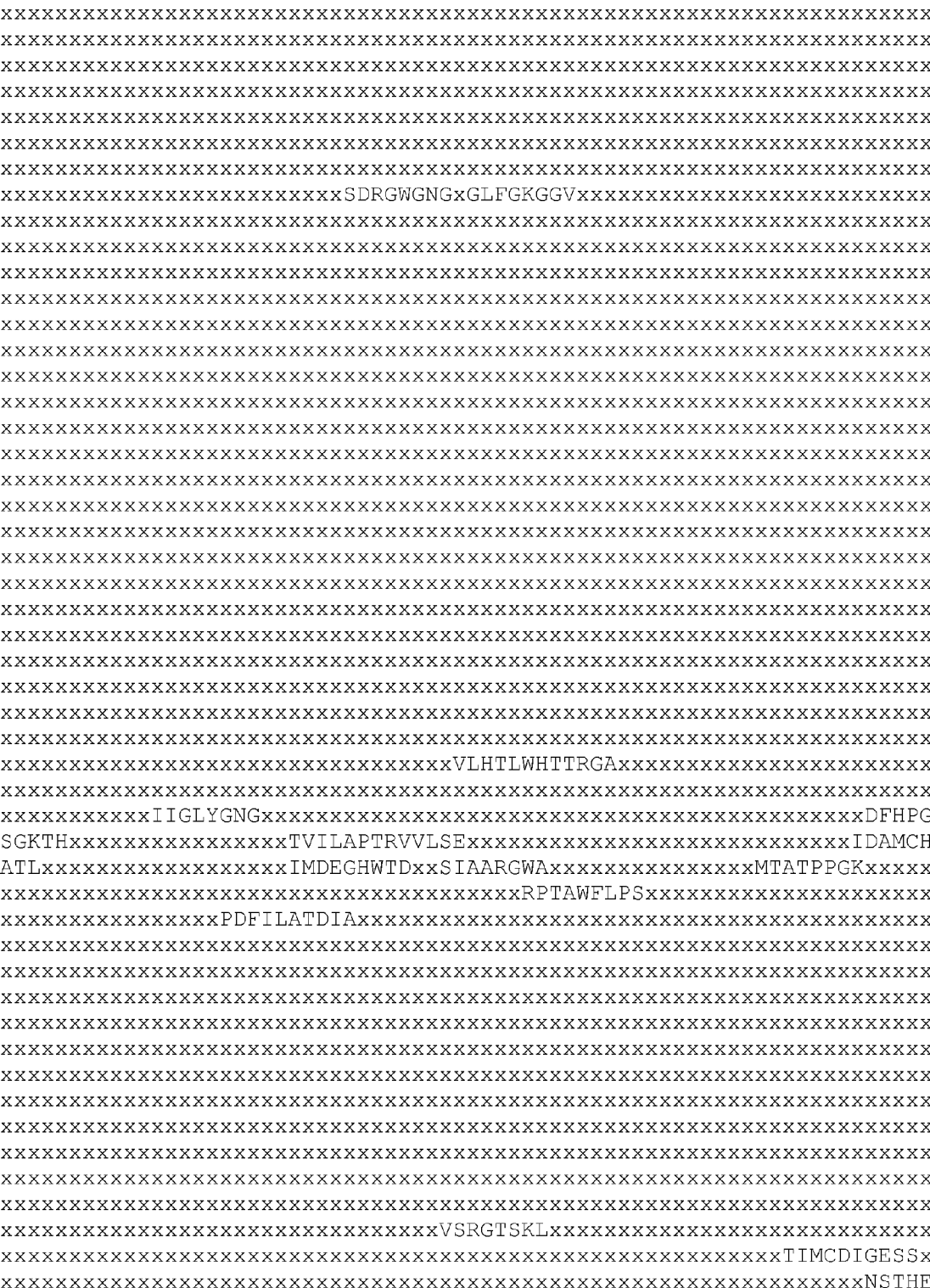

Conservation analysis based on peptide block conservation can be compared with conservation based on frequency of individual amino acids. This comparison can be supported by visualization tools; e.g., the sequence logo and a new tool, described herein: the block logo (see FIG. 47). FIG. 47A is a sequence logo plot of the residues in the block starting at position 388 of the NS3 and FIG. 47B is a peptide block logo of the peptides in the same block. From the sequence logo in FIG. 47A, one can picture a combinatorial space in which up to six different peptides are represented. As seen from the block logo in FIG. 47B, only two different peptides cover 94% while only four peptides within the block show any notable presence.

Example 5

Prediction of HLA Binding of Conserved DENV Peptide Blocks

This example demonstrates prediction of binding affinity to class I and class II HLA molecules for individual peptides in conserved blocks of the DENV proteome (all subtypes 1-4).

Figures 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50:
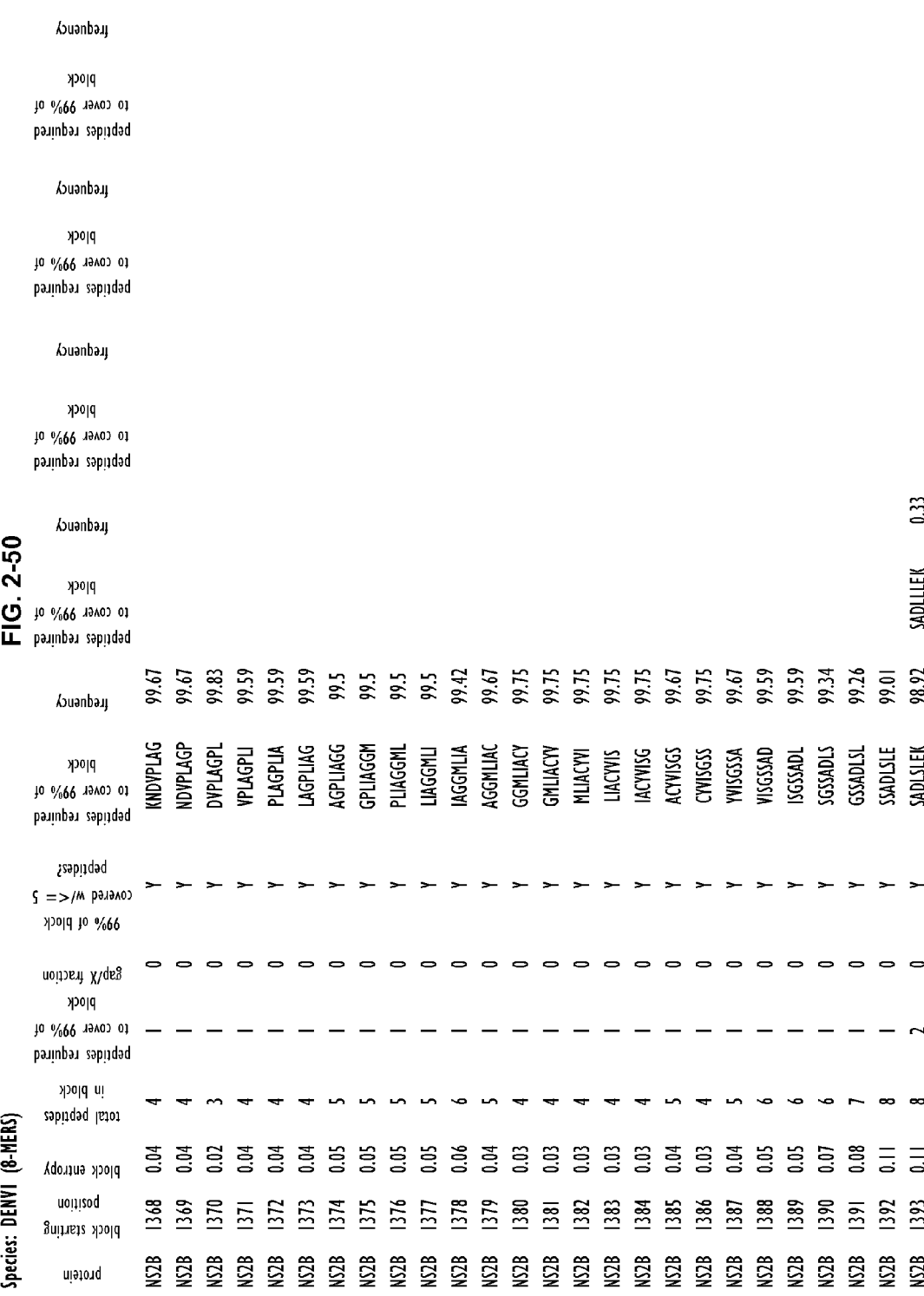
FIGS. 2-21 show the results of the analysis of peptide blocks in which 5 or fewer peptides were required to achieve a cumulative fraction of polypeptides, adding together each unique peptide's individual frequency within the polypeptides in the MSA, of at least (i.e., equal to or greater than 99%) (referred to in the Figures and Examples as 5 or fewer peptides "covering 99% of a block") in each of the anC, prM, E, NS1, NS2A, NS2B, NS3, NS4A, 2K, NS4B, and NS5 proteins of the DENV1 (FIGS. 2-5), DENV2 (FIGS. 6-9), DENV3 (FIGS. 10-13), DENV4 (FIGS. 14-17) and DENV1-4 (all DENV) (FIGS. 18-21) for peptide 8-mers, 9-mers, 10-mers and 11-mers, respectively, within each group. In each of the figures, the tables list by column the polypeptides analyzed in the MSAs, the starting position in the block of polypeptides, the calculated block entropy, the total number of unique peptides in the block, the number of unique peptides that were required to "cover 99% of the block" (i.e. to achieve a cumulative fraction of polypeptides in the MSA, by adding together each unique peptide's frequency within the polypeptides in the MSA, of at least 99%), the gap/X fraction (i.e., the fraction of polypeptide sequences in the MSA that contained a gap in the indicated peptide block), an affirmation that 5 or fewer peptides were required ("Y"='yes') (to "cover 99% of the block"), the amino acid sequences of the 5 or fewer peptides in the block that were required to "cover 99% of the block", and the frequency of each unique peptide within the polypeptides in the MSA. The sequences shown in FIGS. 2-21 have the following SEQ ID NOs (the columns containing sequences are numbered 1 through 5 from left to right and the sequence identifiers are in numerical order from the top to the bottom of each column)
FIGS. 23-46 show the results of the analysis of blocks of peptide 8-mers, 9-mers, 10-mers and 11-mers in which 5 or fewer peptides were required to "cover 99% of the block" (i.e. to achieve a cumulative fraction of polypeptides in the MSA, by adding together each unique peptide's frequency within the polypeptides in the MSA, of at least 99%) for WNV proteins (FIGS. 23-26, respectively); YFV proteins (FIGS. 27-30, respectively); TBEV proteins (FIGS. 31-34, respectively); JEV proteins (FIGS. 35-38, respectively); all proteins of DENV1-4, WNV, YFV, and TBEV ("panFIVE") (FIGS. 39-42, respectively); and all *flaviviruses* ("panFLAVI") (FIGS. 43-46, respectively). In each of the figures, the tables list by column the polypeptides analyzed in the MSAs, the starting position in the block of polypeptides, the calculated block entropy, the total number of unique peptides in the block, the number of unique peptides that were required to "cover 99% of the block" (i.e. to achieve a cumulative fraction of polypeptides in the MSA, by adding together each unique peptide's frequency within the polypeptides in the MSA, of at least 99%), the gap/X fraction (i.e., the fraction of polypeptide sequences in the MSA that contained a gap in the indicated peptide block), an affirmation that 5 or fewer peptides were required ("Y"='yes') (to "cover 99% of the block"), the amino acid sequences of the 5 or fewer peptides in the block that were required to "cover 99% of the block", and the frequency of each unique peptide within the polypeptides in the MSA. The sequences shown in FIGS. 23-46 have the following SEQ ID NOs (the columns containing sequences are numbered 1 through 5 from left to right and the sequence identifiers are in numerical order from the top to the bottom of each column)
FIG. 48 shows the predicted MHC class I binding affinity for each peptide found in all blocks identified as conserved in DENVall (DENV1-4). For each peptide sequence, binding affinity ($IC_{50}$) (nM) is given in parentheses next to the HLA type (e.g., A1101, B1501, etc.) for each HLA molecule the peptide was predicted to bind to with at least weak affinity (<500 nM) (i.e., negative binding predictions are not shown). The sequences shown in the figure have the following SEQ ID NOs (the columns containing sequences are numbered 1 through 2 from left to right and the sequence identifiers are in numerical order from the top to the bottom of each column): Column ("Col.") 1: 250069-251082, 251085-251103; Col. 2: 251104-252137; and Col. 3: 252138-253153.
FIG. 49 shows the predicted MHC class I binding affinity for each peptide found in blocks identified as immunofunctionally conserved in DENVall (DENV1-4). The sequences shown in the figure have the following SEQ ID NOs (the columns containing sequences are numbered 1 through 2 from left to right and the sequence identifiers are in numerical order from the top to the bottom of each column): Column ("Col.") 1: 253154-253317; and Col. 2: 253318-253481.
FIG. 50 shows the amino acid sequences of peptides from conserved peptide blocks in the DENV proteome in the first column and the one or more core MHC class II binding sequences within each peptide in the adjacent columns. The predicted binding affinity ($IC_{50}$ (nM)) for each predicted MHC class II core binding sequence is given for the following HLA molecules next to the core sequence: DRB1*0101, DRB1*0401, DRB1*0701, and DRB1*1101. These are representative predictions, while predictions for other HLA class II alleles can also be performed. In these examples the binding affinity to a particular HLA molecule is only shown for a peptide core if the core was determined to bind at least weakly (i.e., have a binding affinity ($IC_{50}$) of ≤500 nM to an HLA molecule (i.e., negative binding predictions are not shown). The sequences shown in the figure have the following SEQ ID NOs (the columns containing sequences are numbered 1 through 5 from left to right and the sequence identifiers are in numerical order from the top to the bottom of each column): Column ("Col.") 1: 253482-256,043, 256,045-257334; Col. 2: 257335-259,896, 259,898-261187; Col. 3: 261188-263628; Col. 4: 263629-265087; and Col. 5: 265088-265676.
Figures 2, 94:
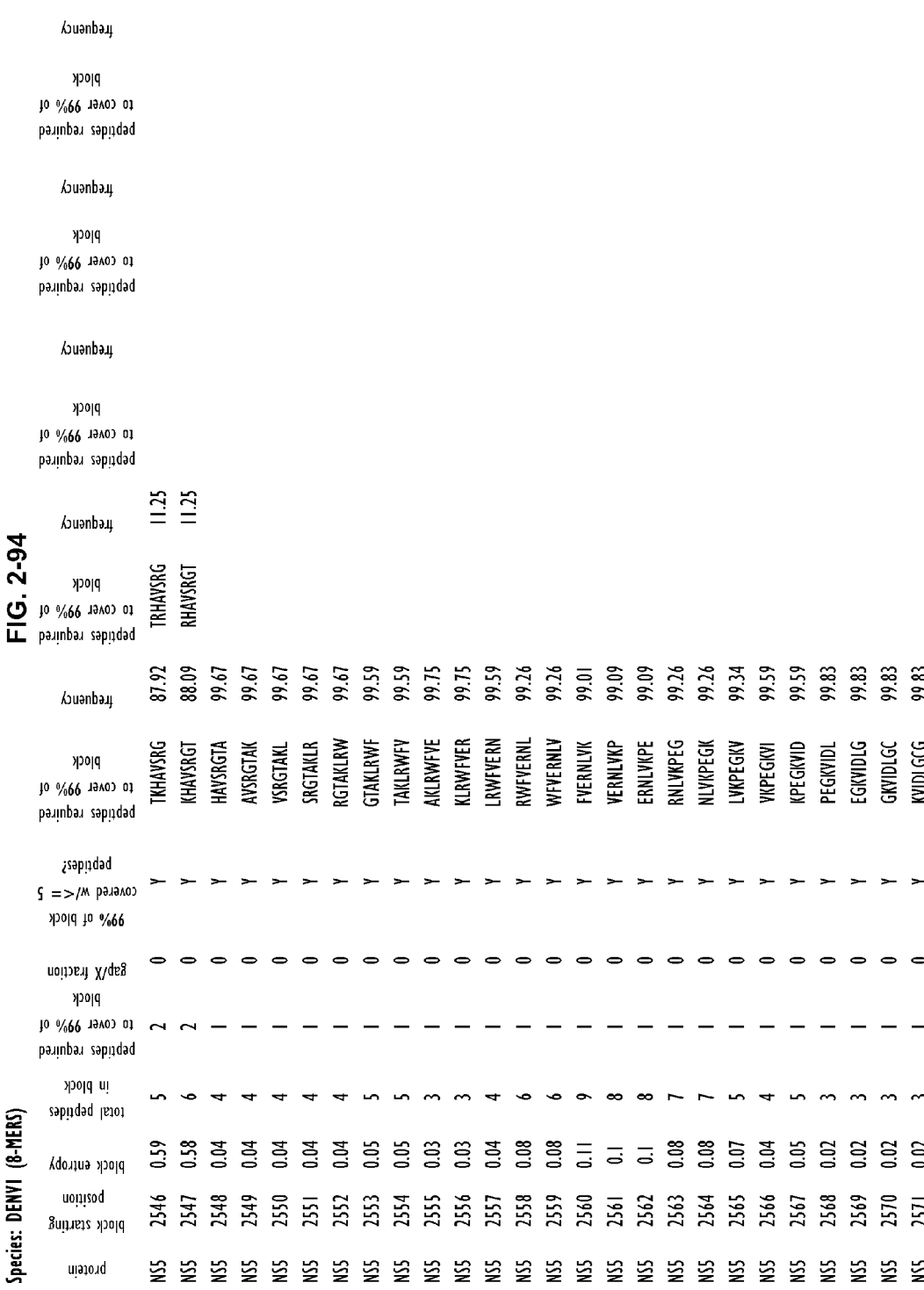
Figures 2, 100:
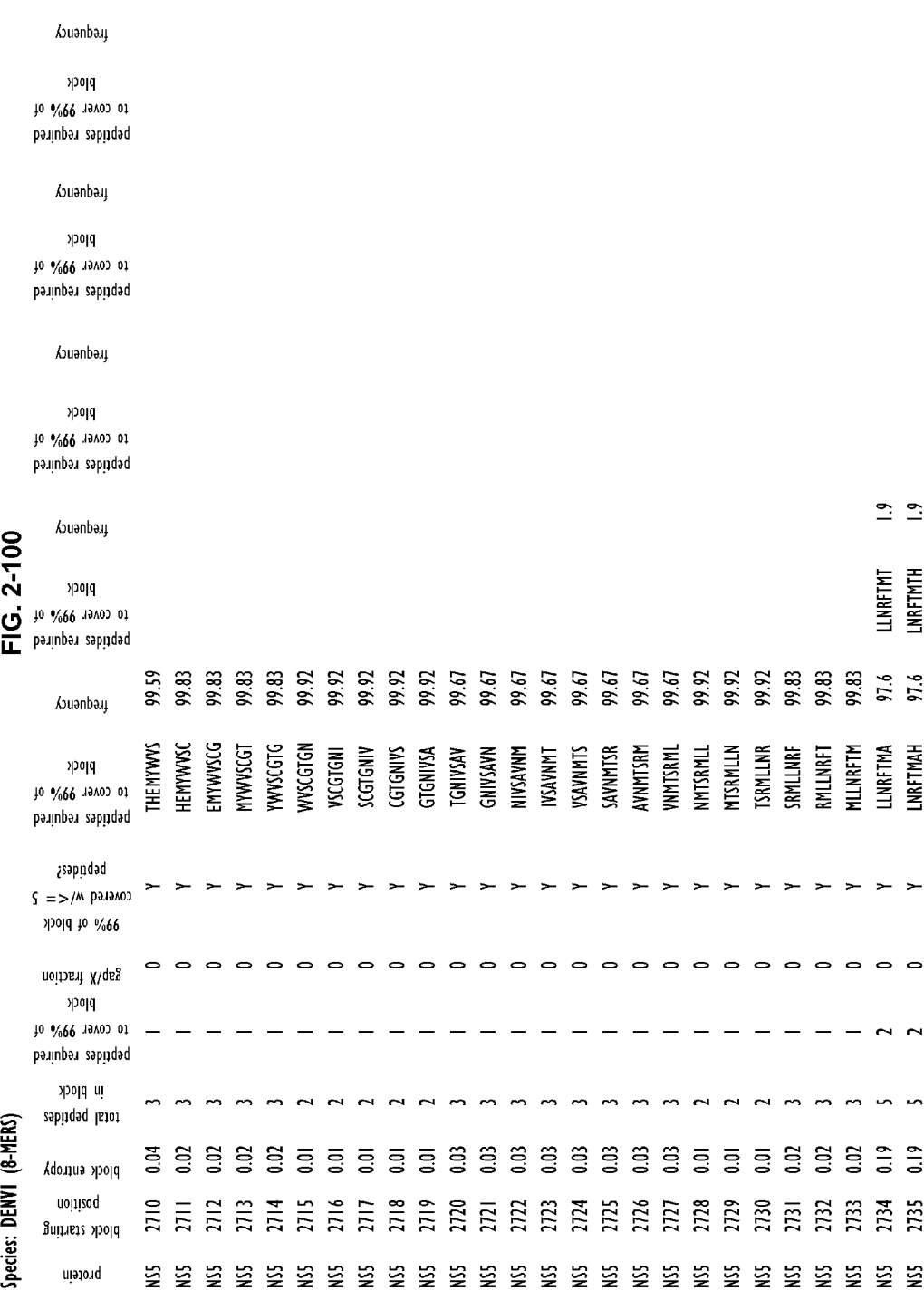
Figures 2, 107:
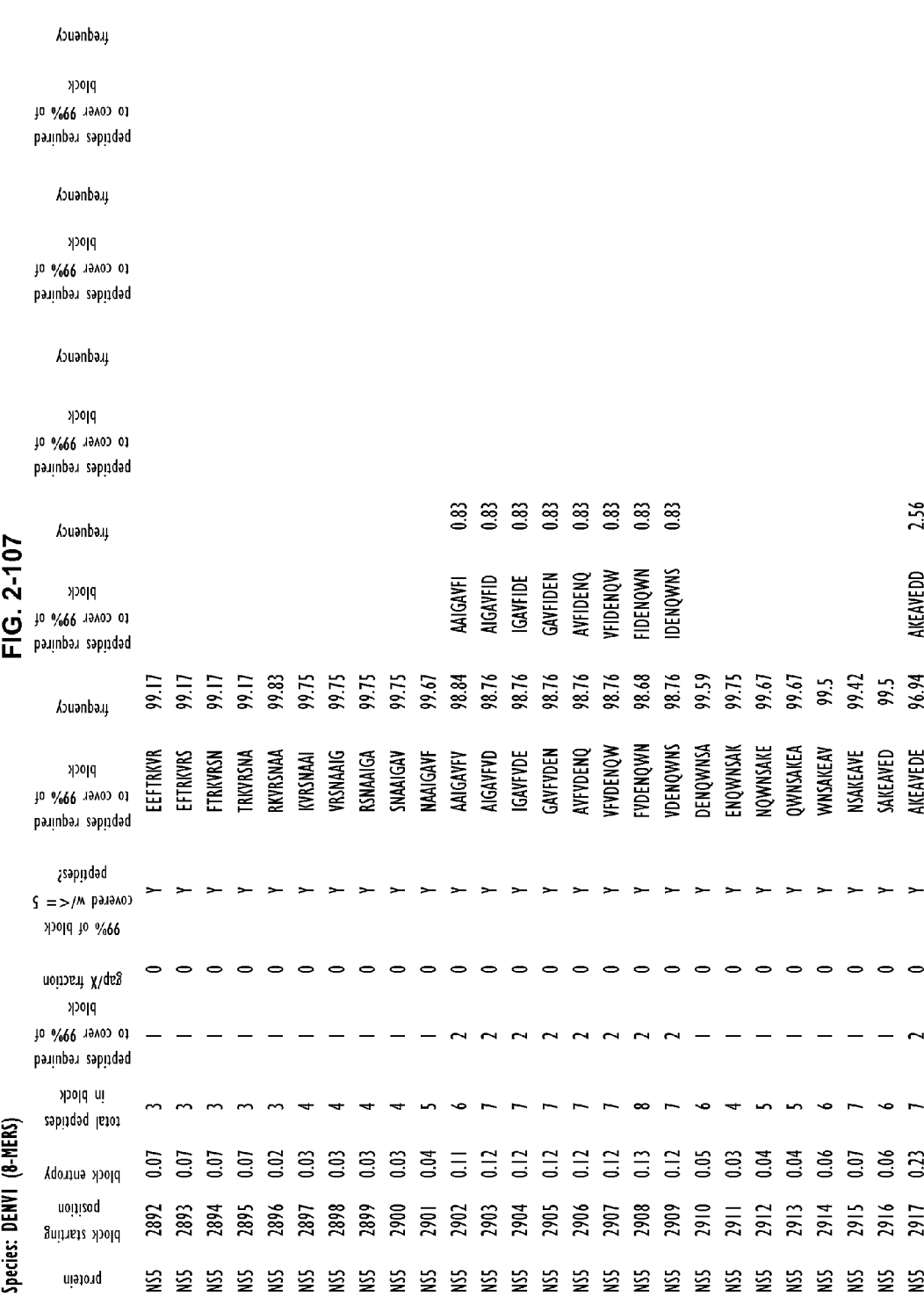
Figures 2, 114:
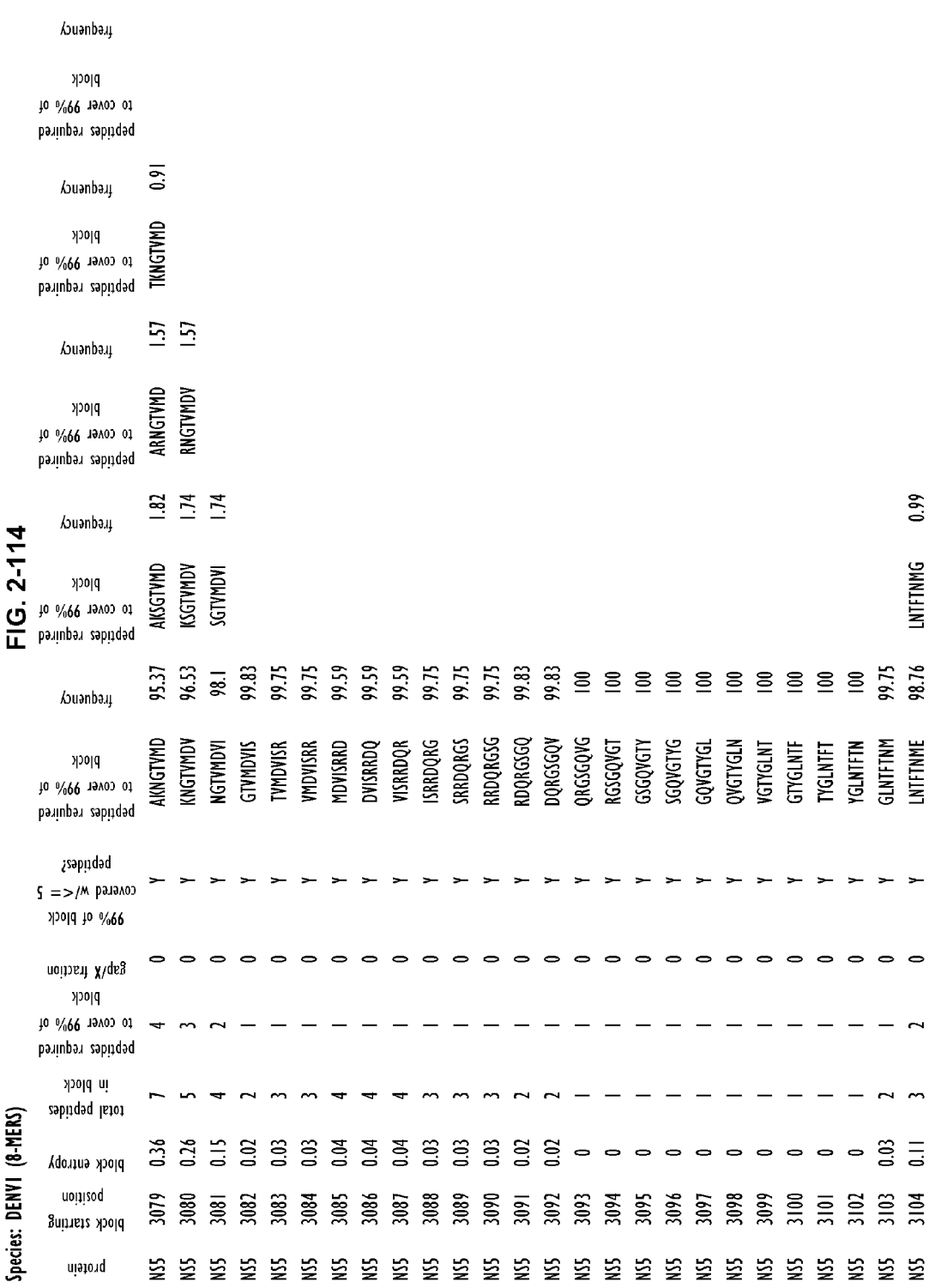
Figures 3, 4, 5, 6, 7, 8, 9, 10, 11, 12, 13, 14, 15, 16, 17, 18, 19, 20:
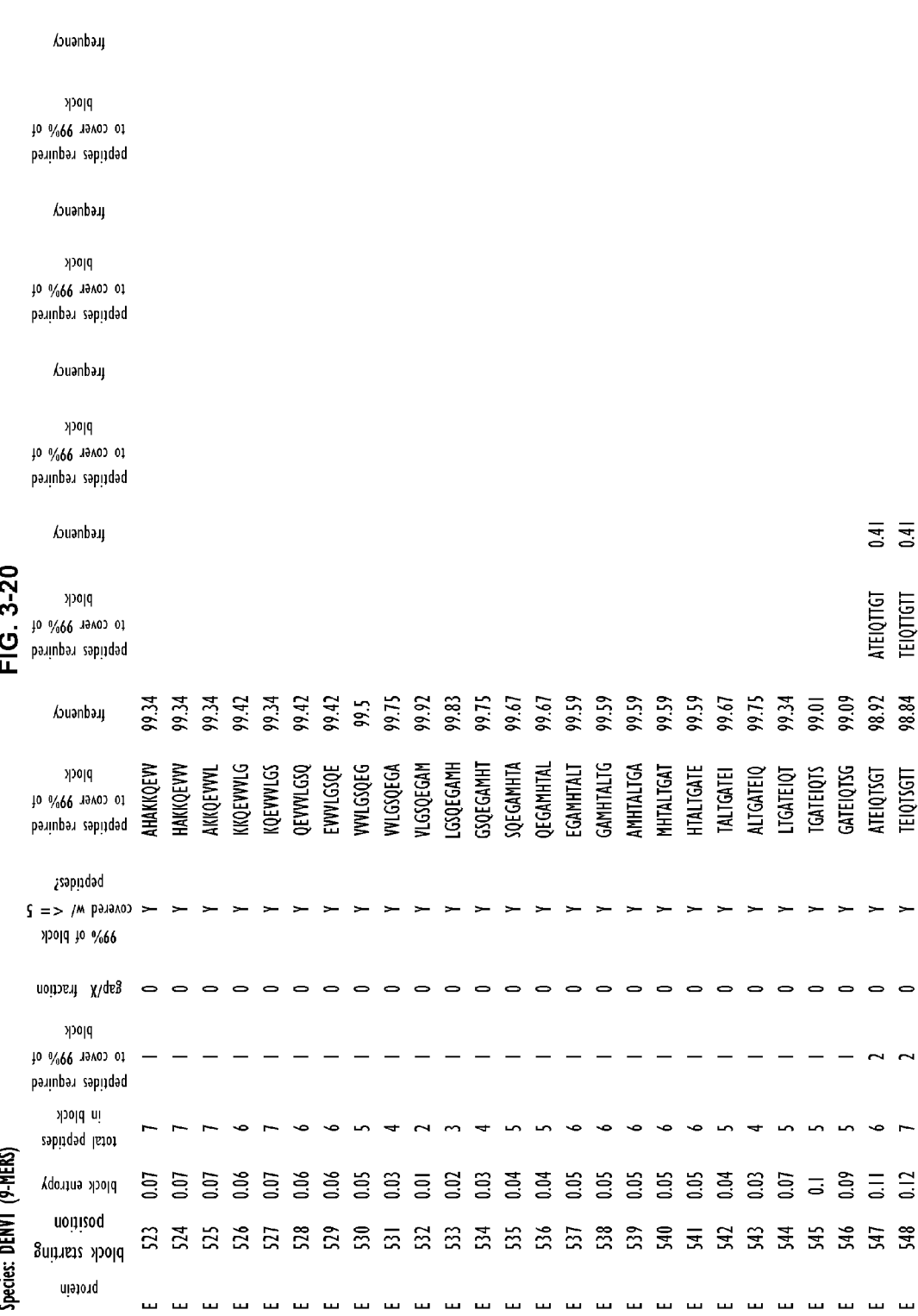
Figures 3, 83:
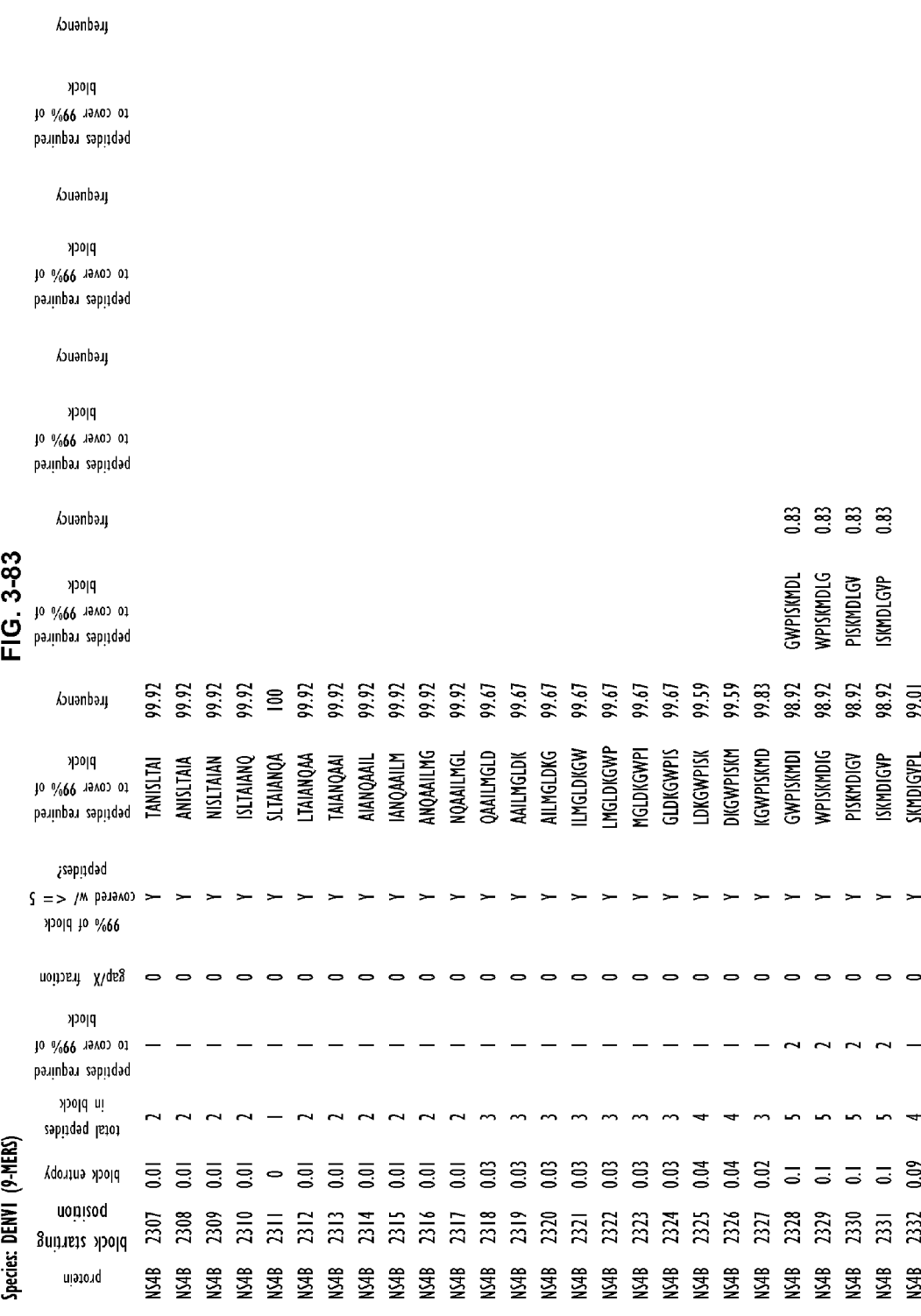
Figures 3, 90:
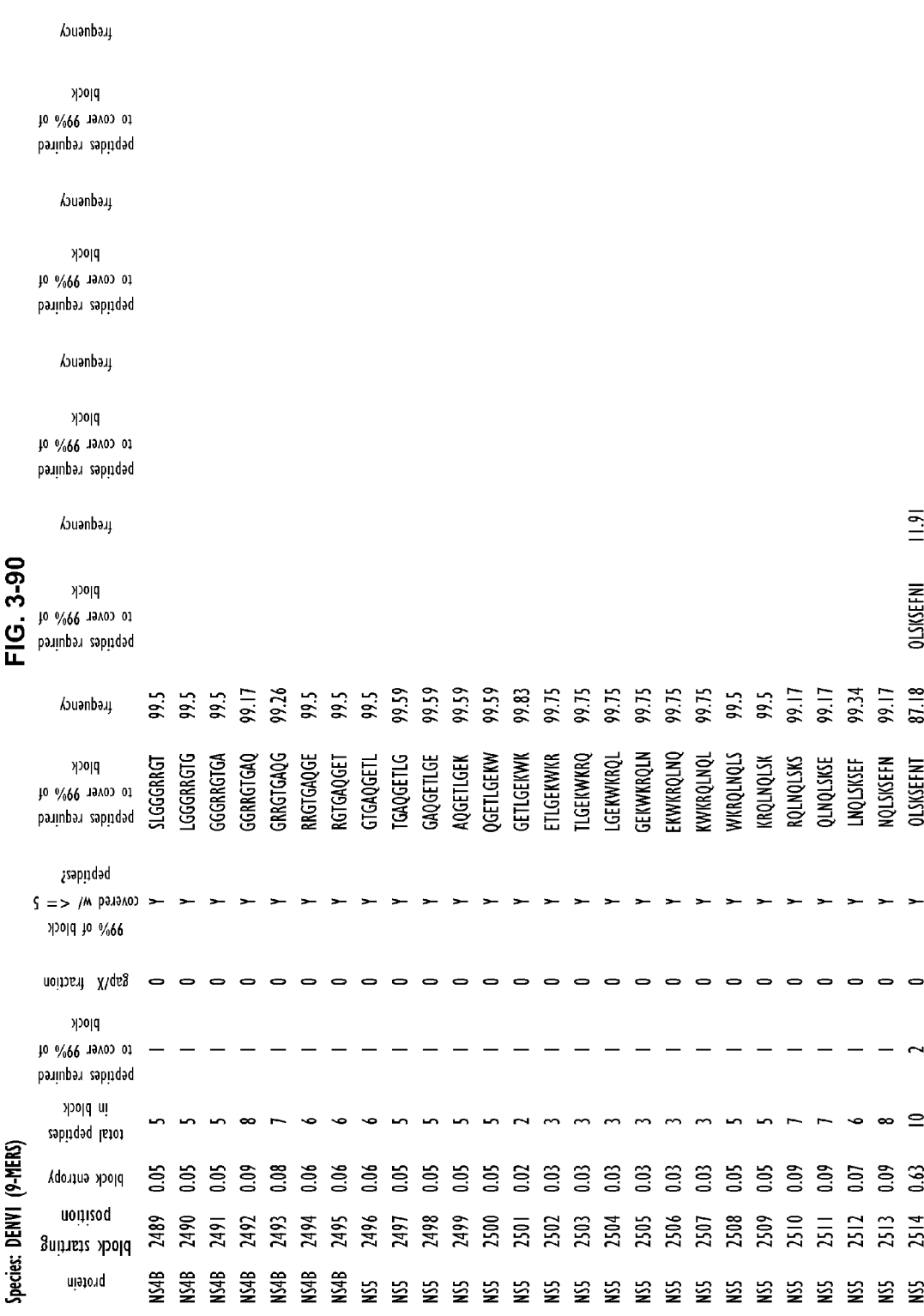
Figures 3, 96:
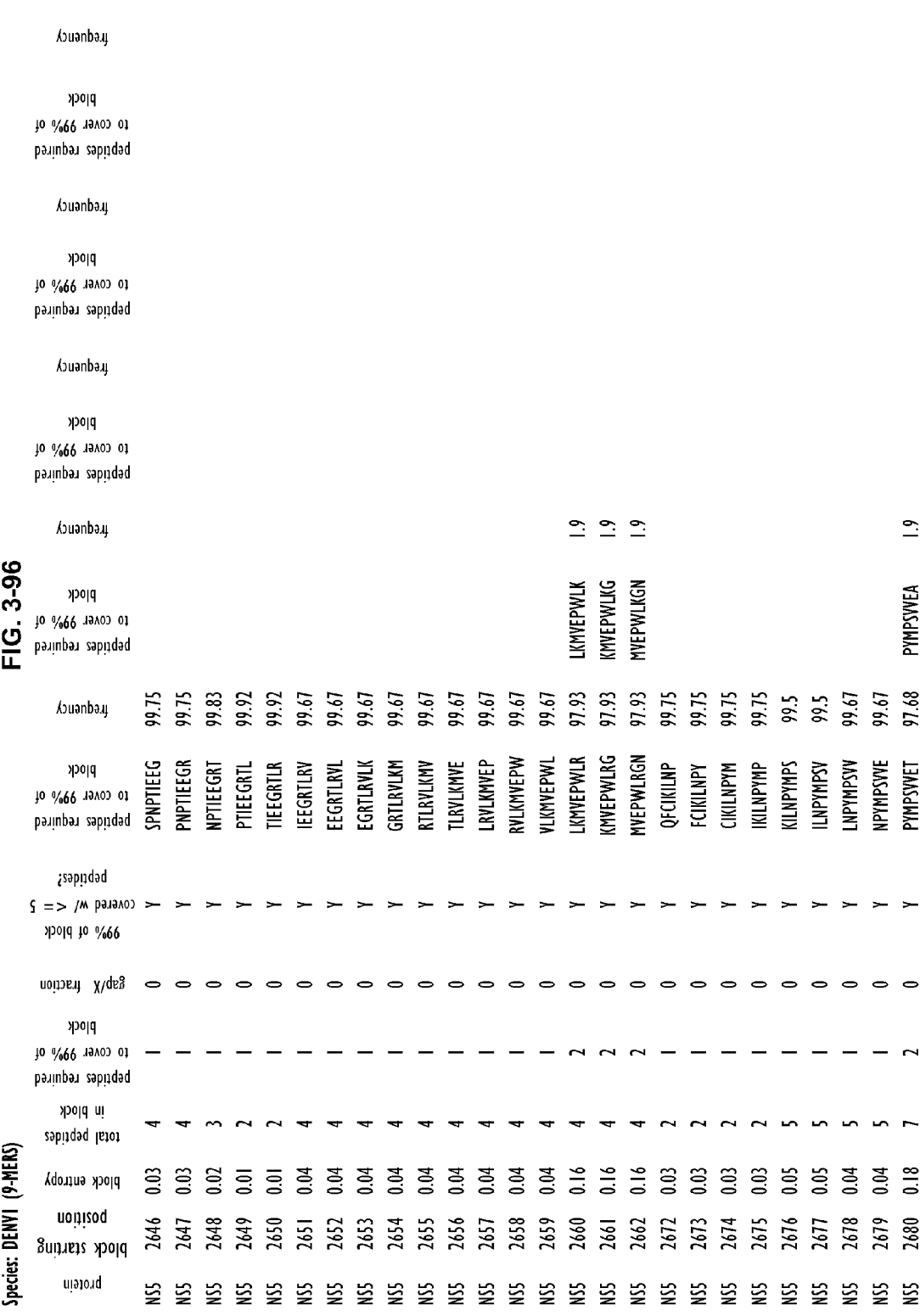
Figures 3, 108:
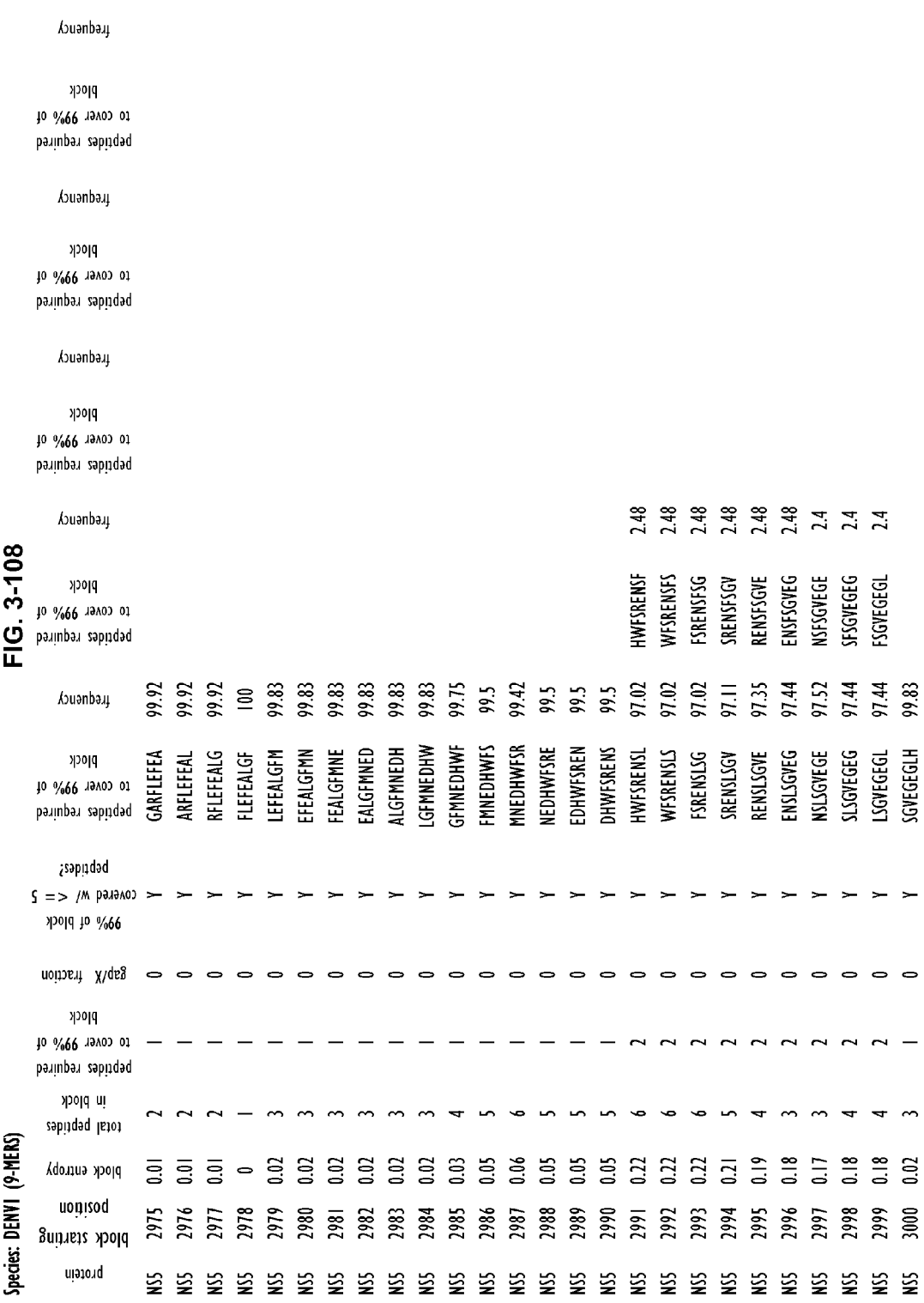
Figures 3, 115:
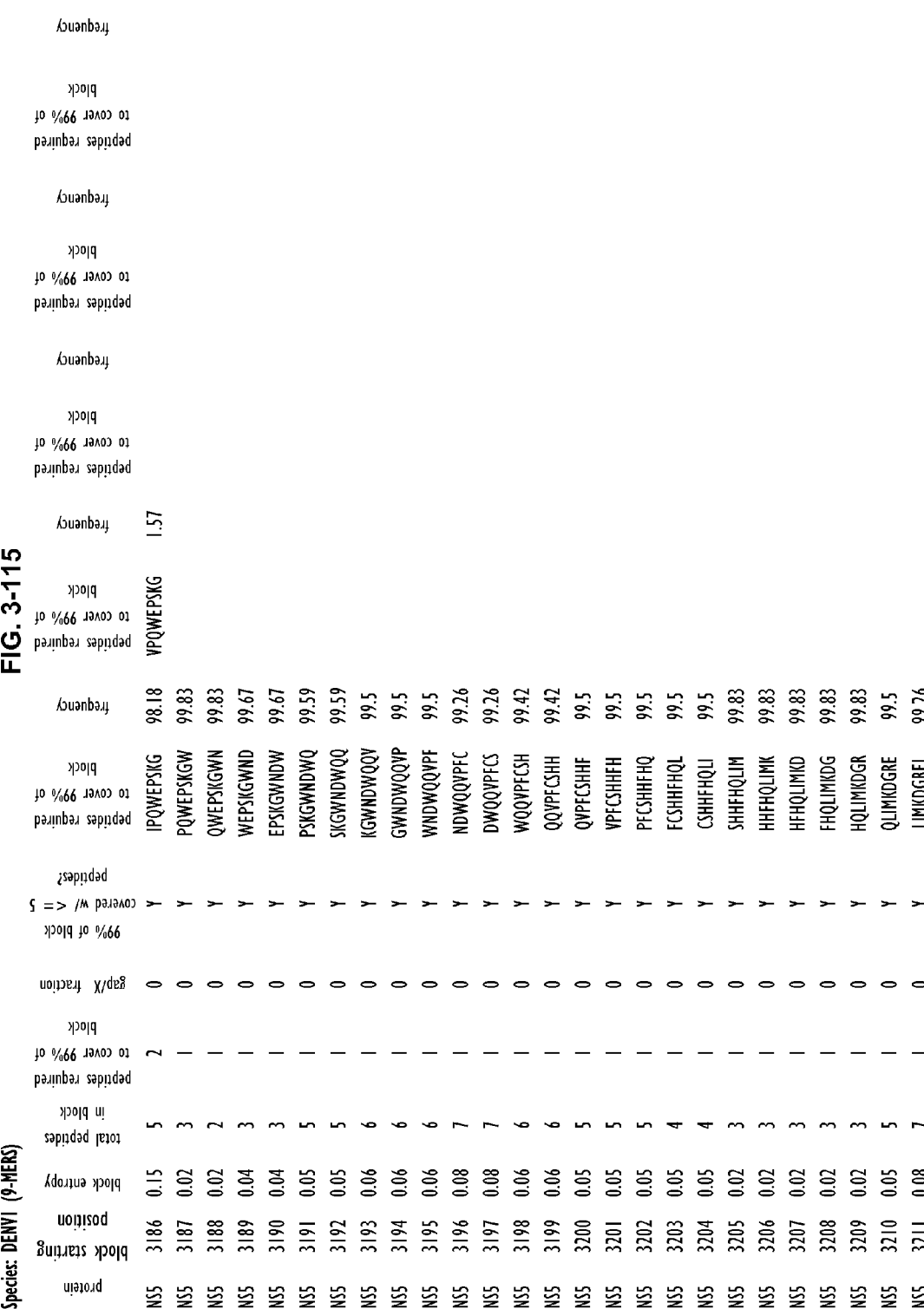

Binding affinity was predicted for each of the 5,113 peptides in the 1,551 blocks of conserved 9-mer peptides using NetMHC 3.2 software, as described in the Materials and Methods section (Example 1), above. The binding affinity for peptides in peptide blocks identified as conserved is shown in FIG. 48. If all peptides in a block were predicted to bind to the same HLA class I molecule, the block was considered immunofunctionally conserved. In total, 112 blocks consisting of 328 peptides were predicted to be immunofunctionally conserved for MHC class I binders. HLA binding affinity for each peptide identified as immunofunctionally conserved is shown in FIG. 49. Peptides that had a binding affinity ($IC_{50}$) of <50 nM were considered to be strong binders and peptides that had a binding affinity of >50 nM and <500 nM were considered to be weak binders.

Figures 11, 62:
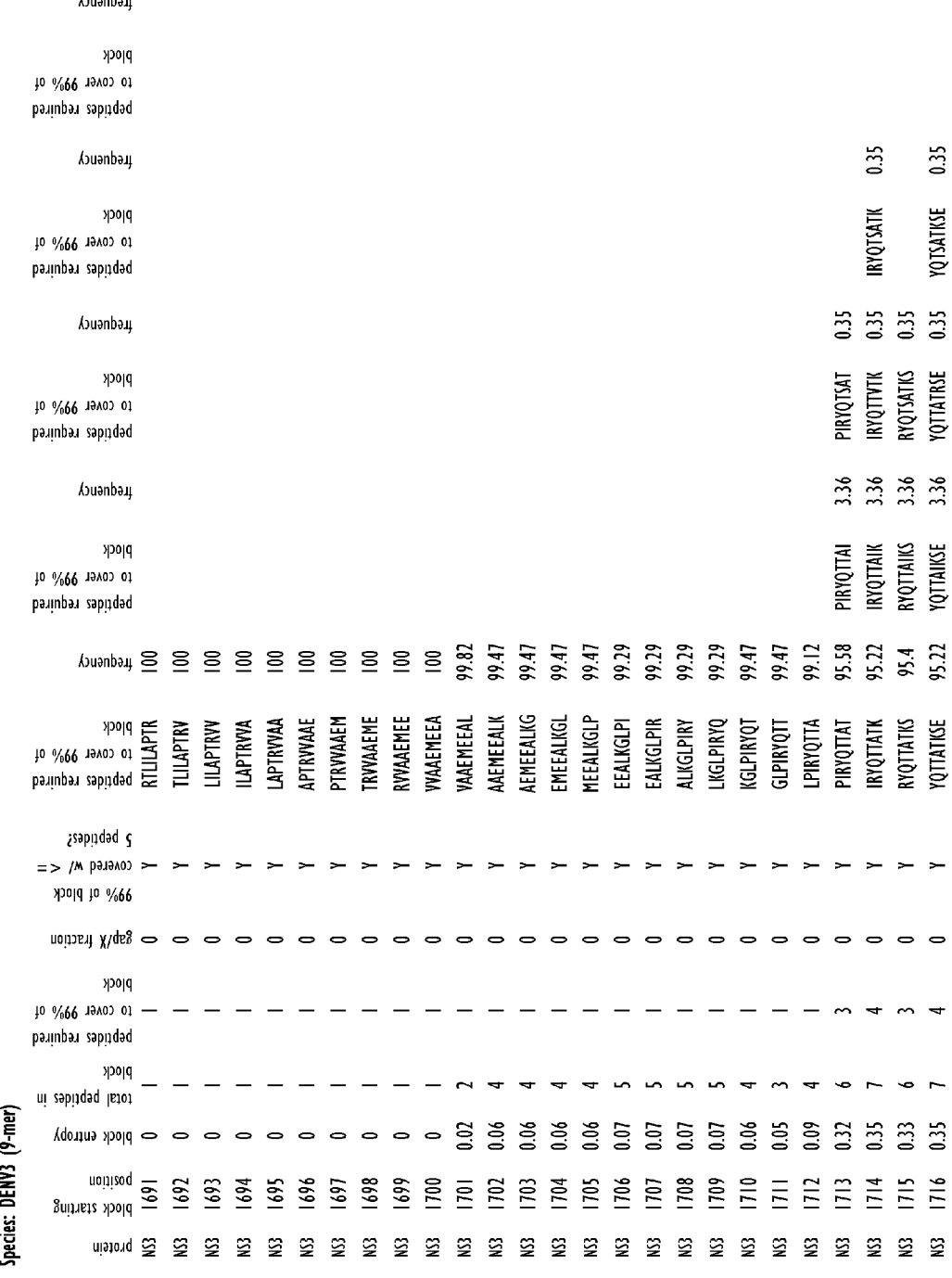
Figures 11, 68:
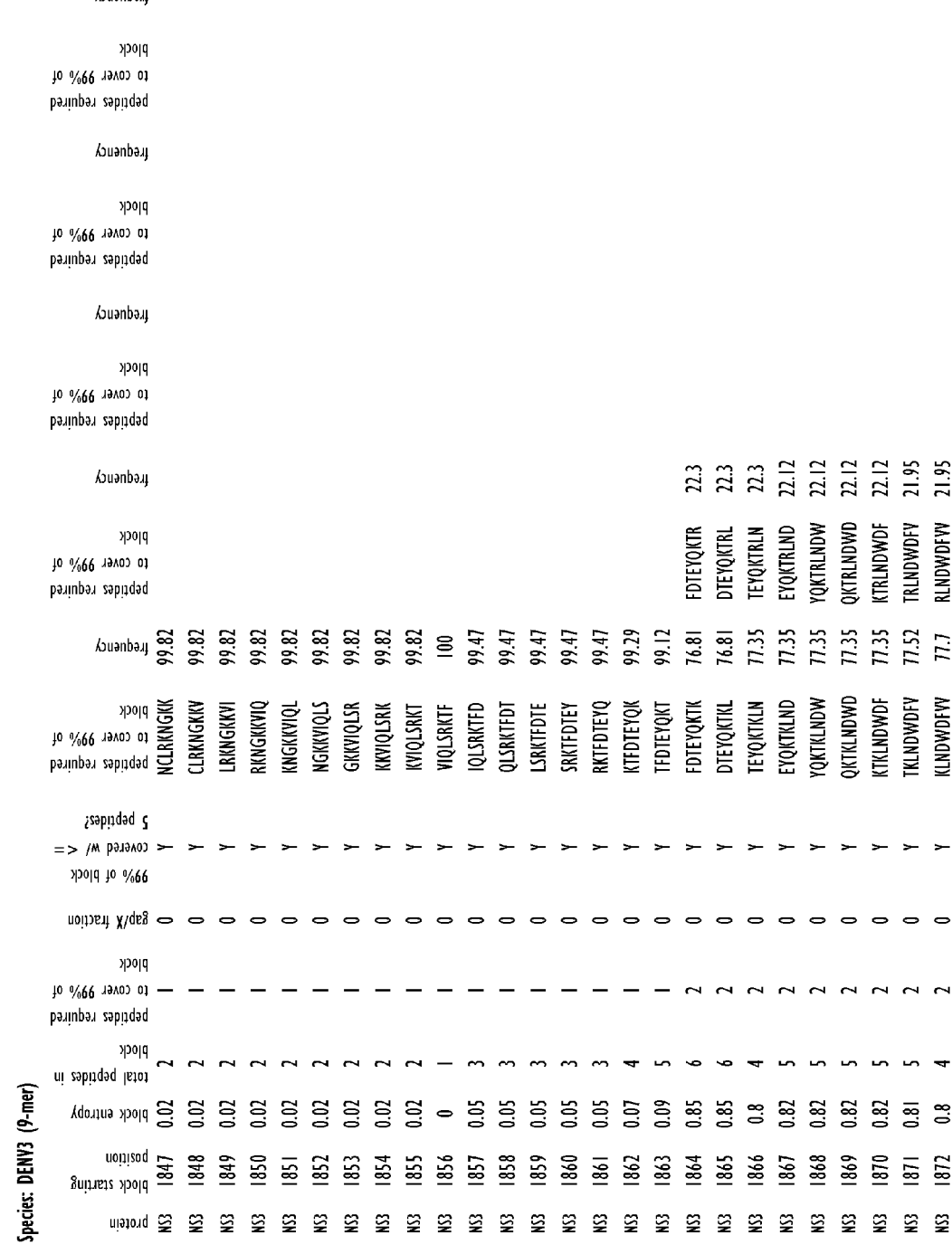
Figures 11, 69:
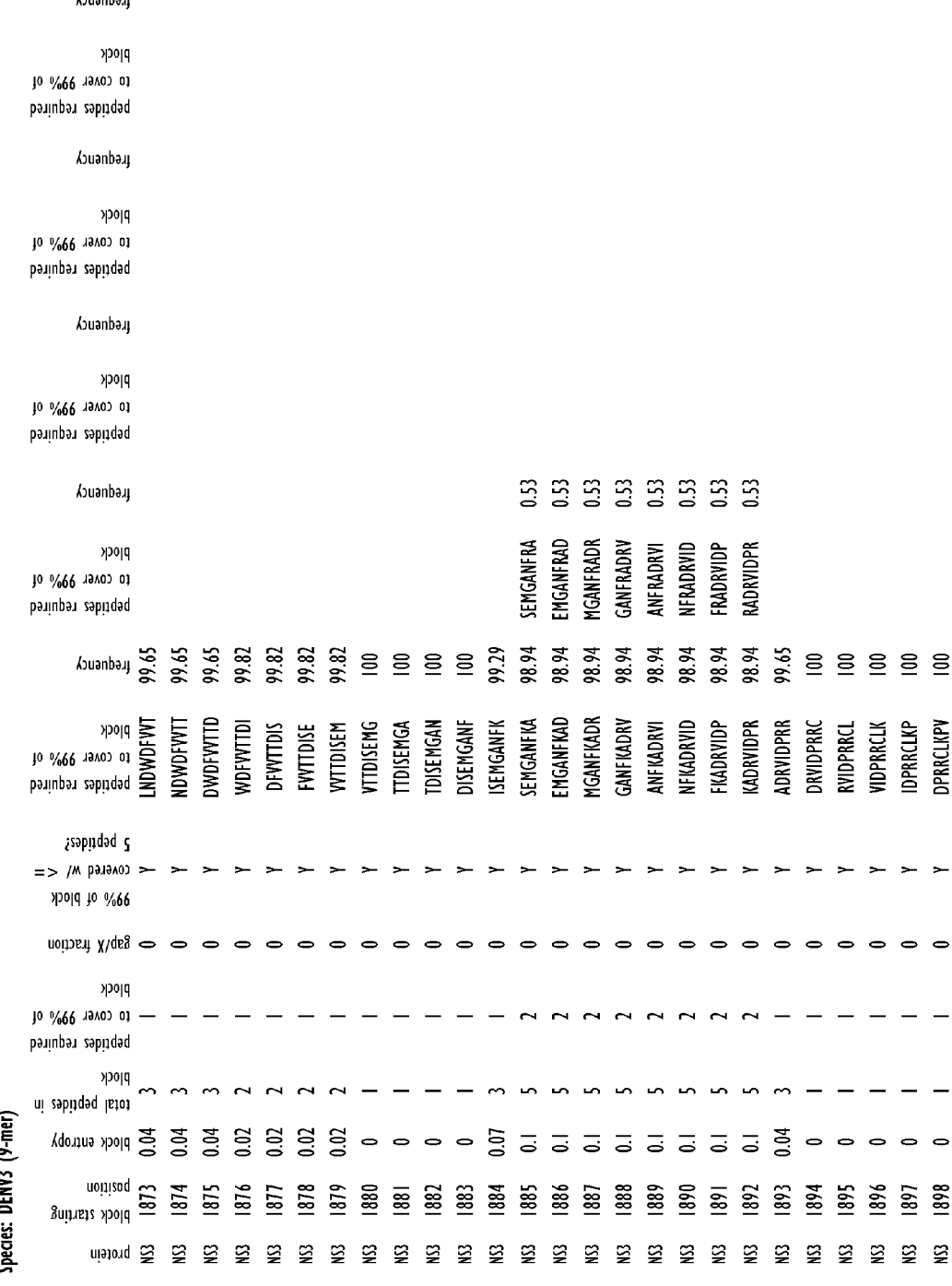
Figures 11, 70:
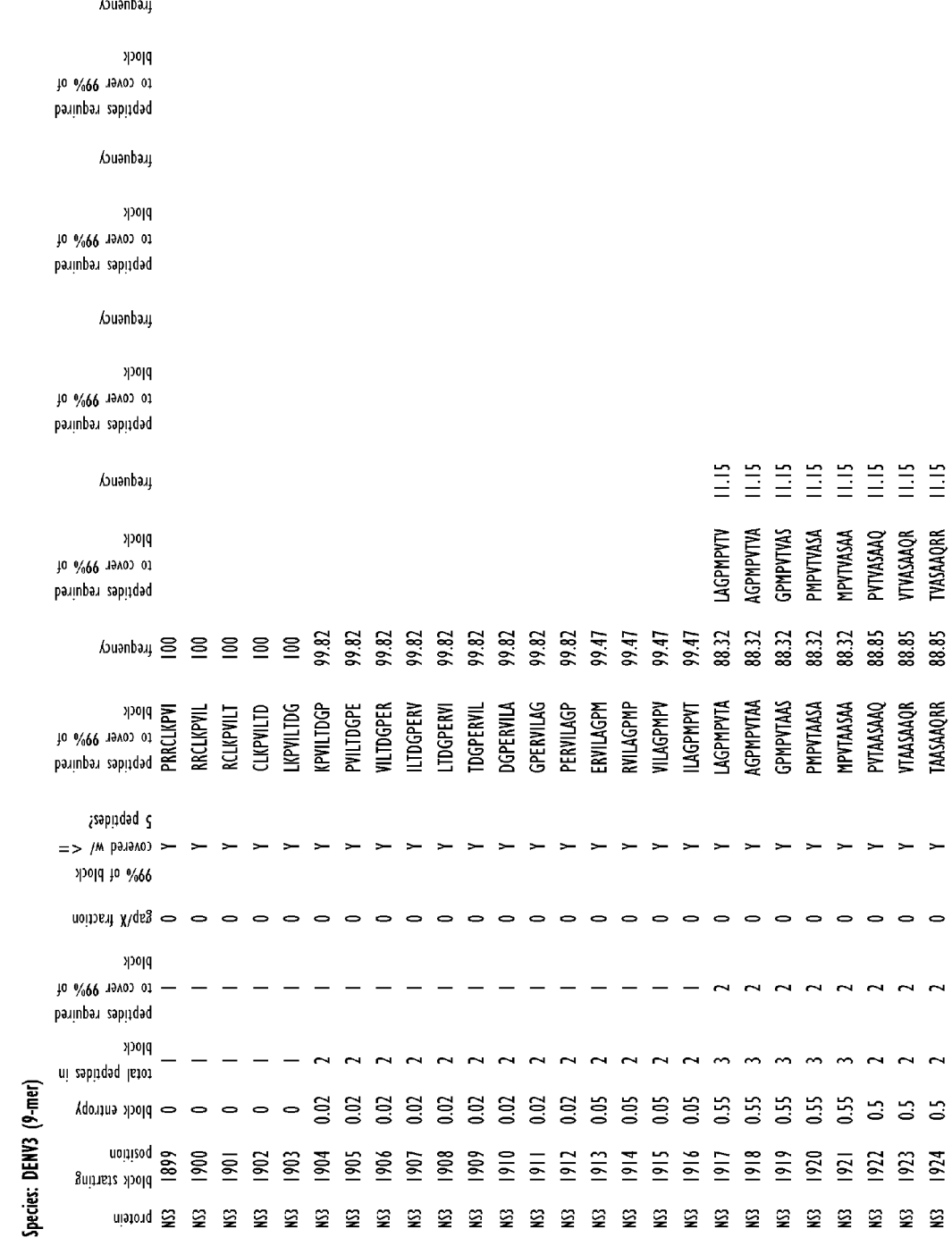
Figures 11, 71:
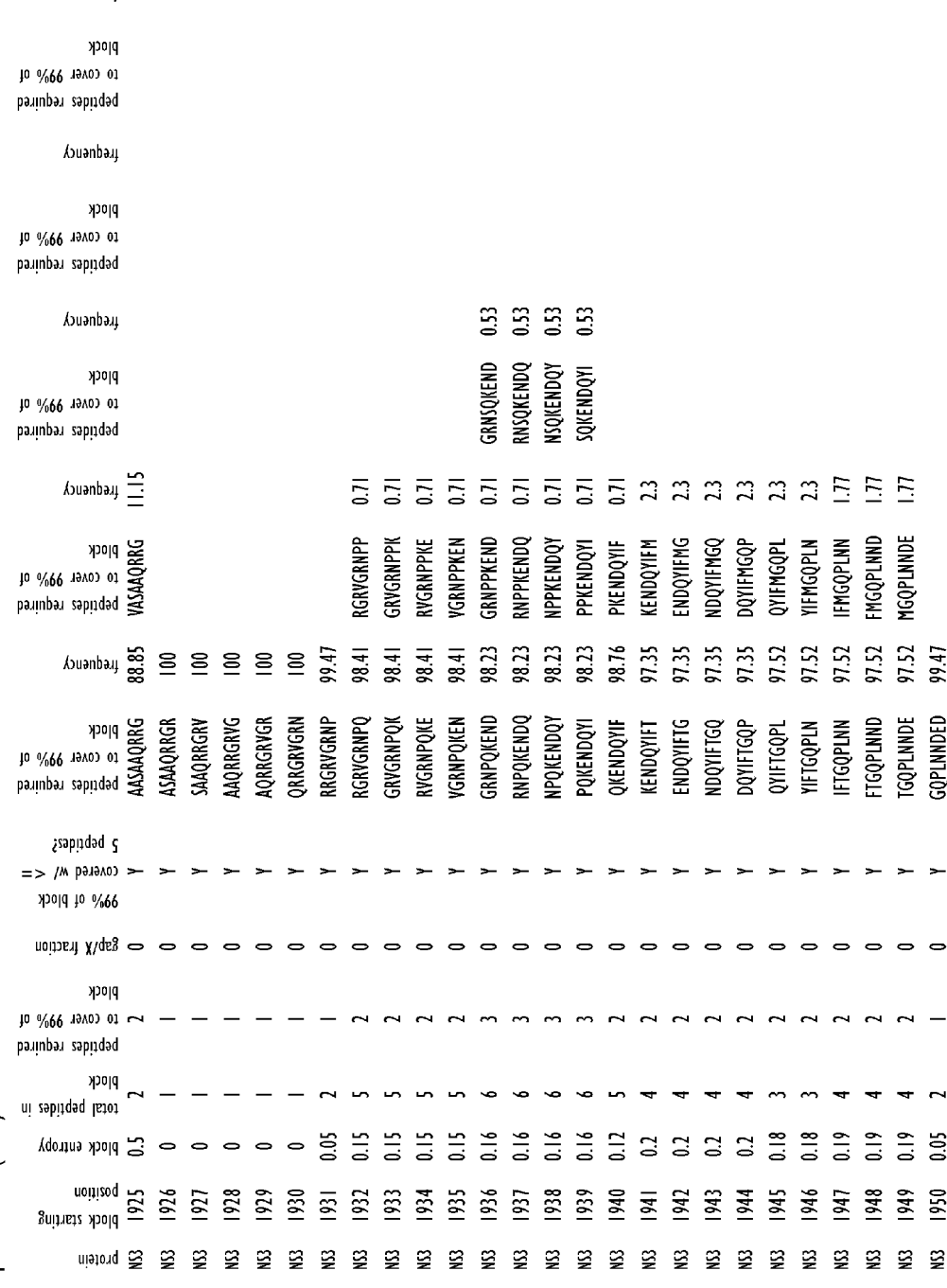
Figures 11, 72:
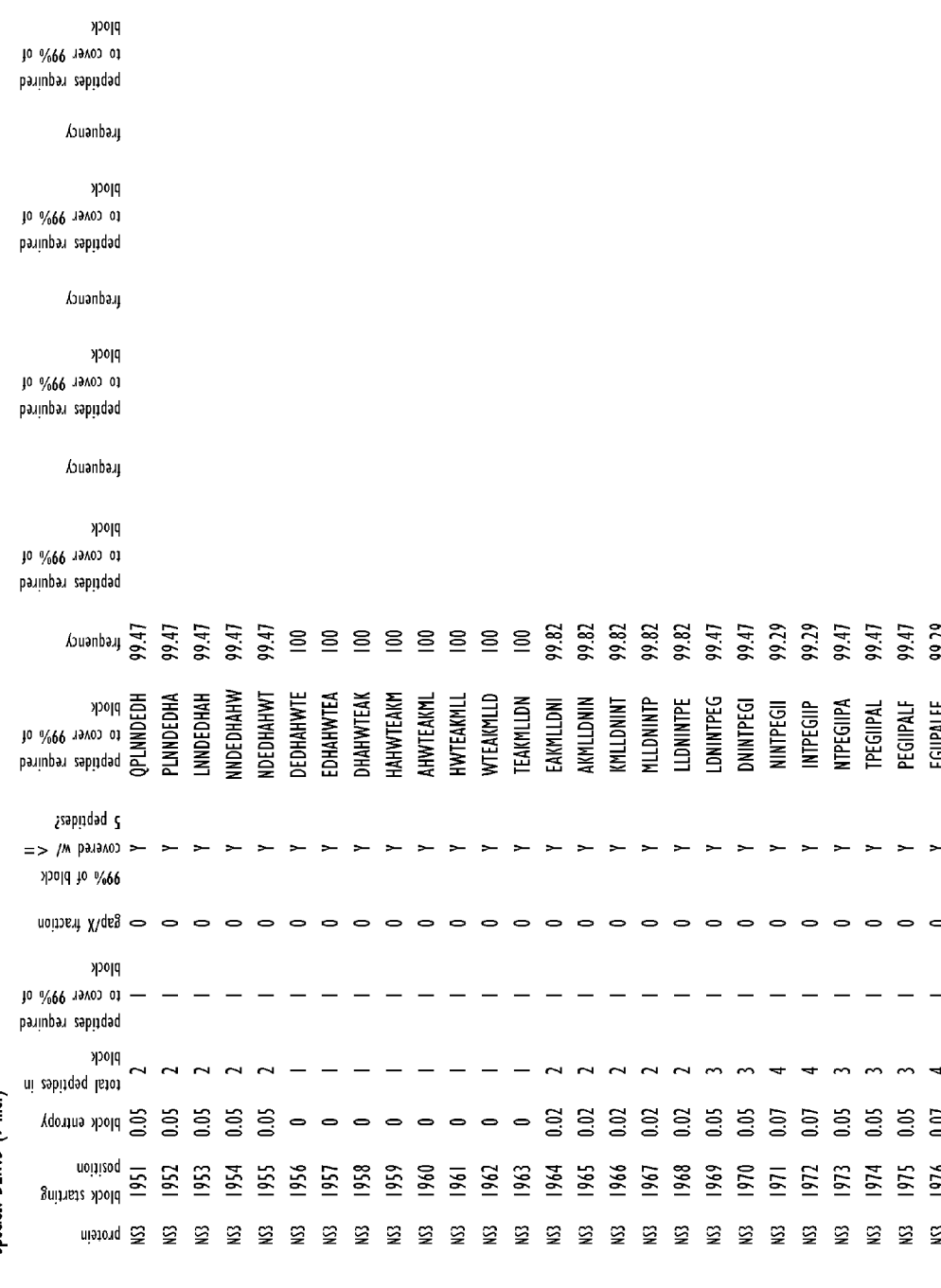
Figures 11, 73:
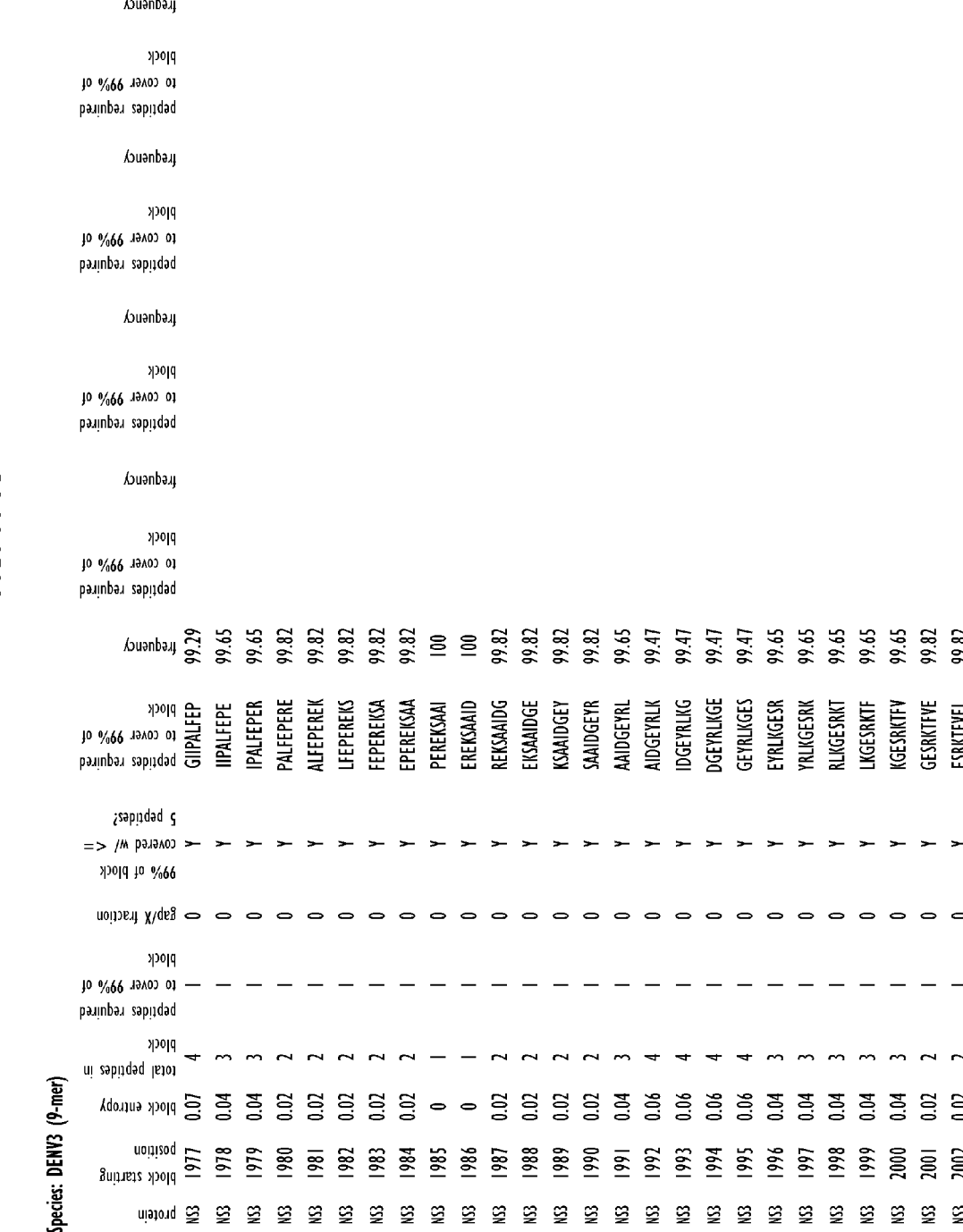
Figures 11, 74:
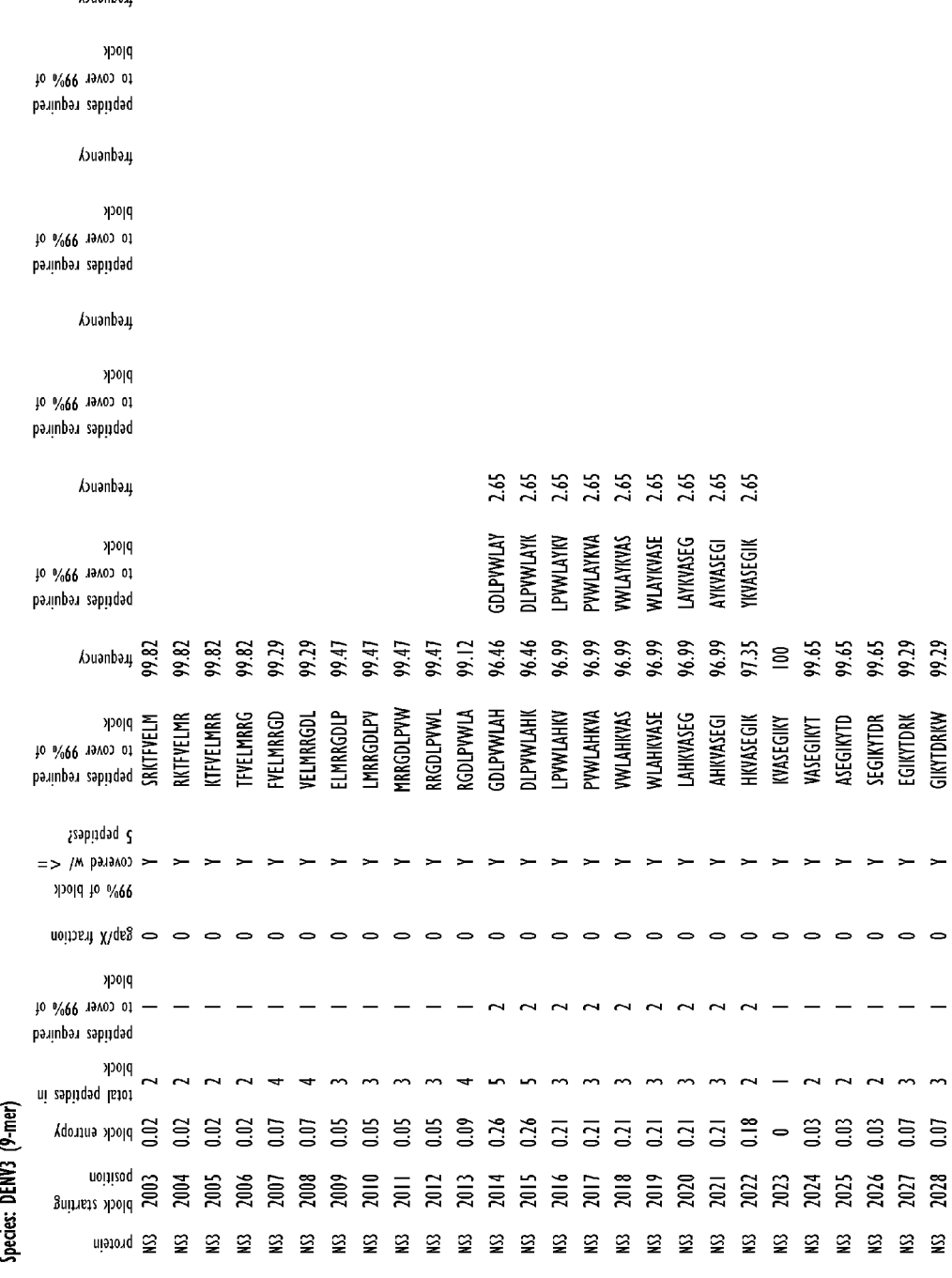
Figures 11, 75:
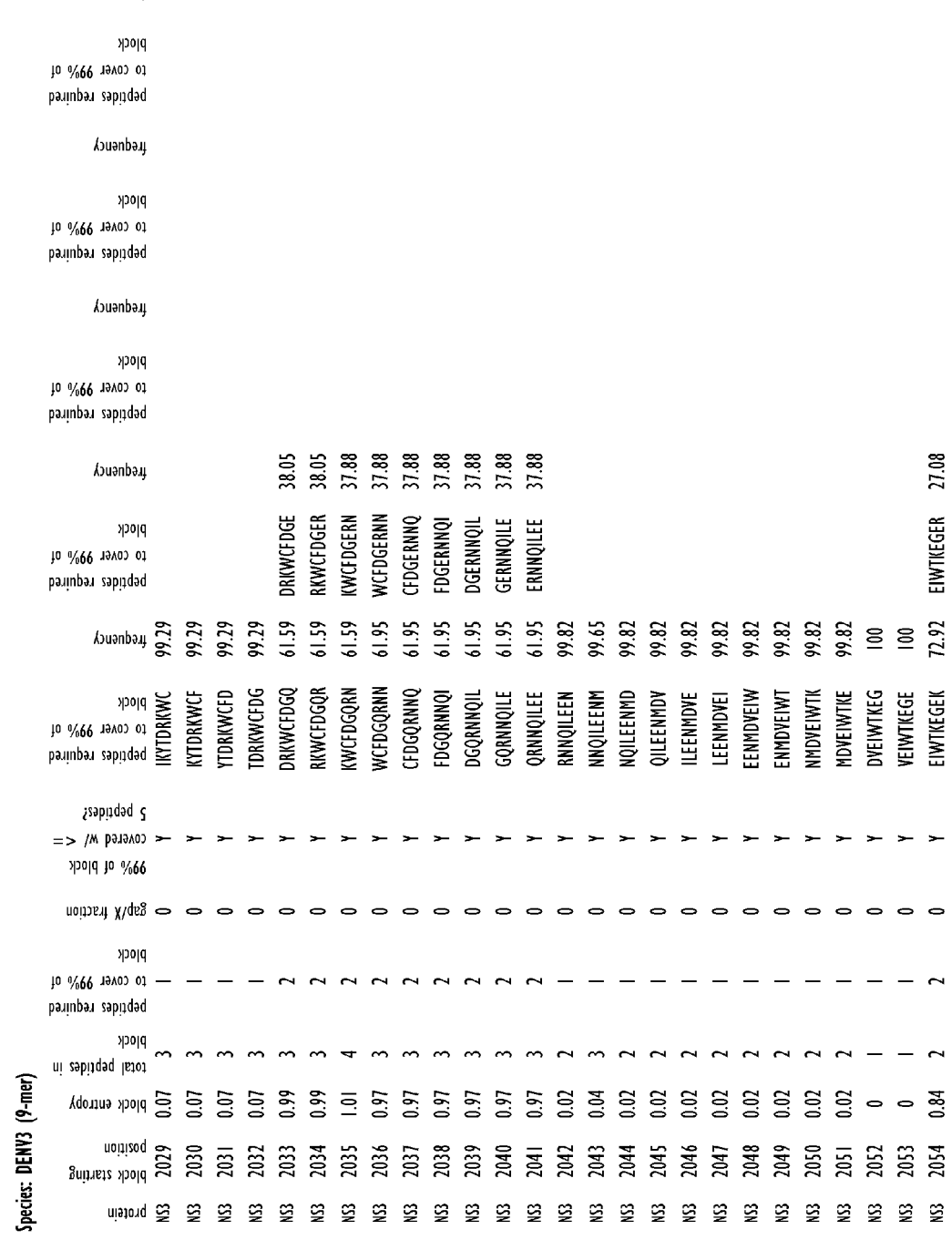
Figures 11, 79:
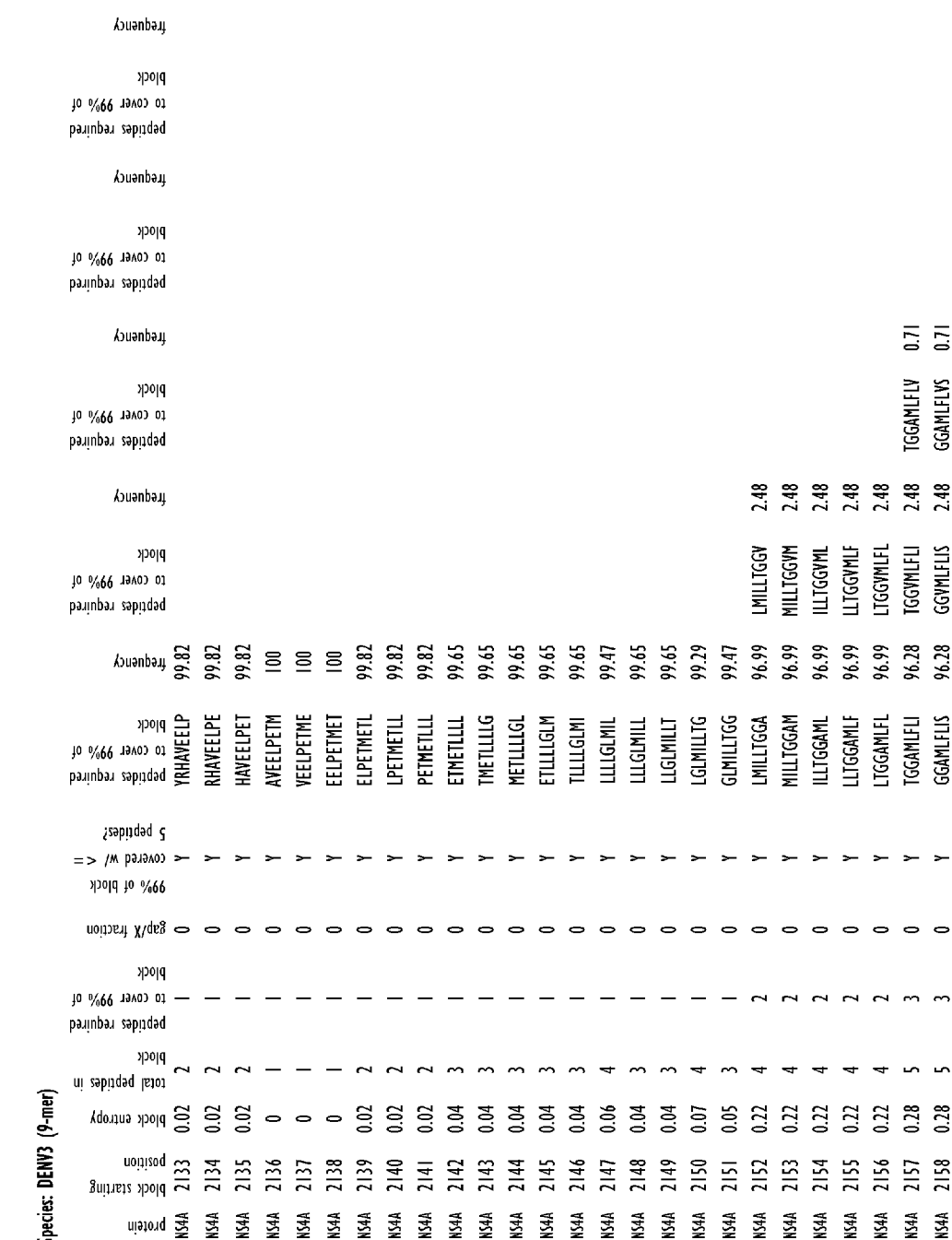
Figures 11, 82:
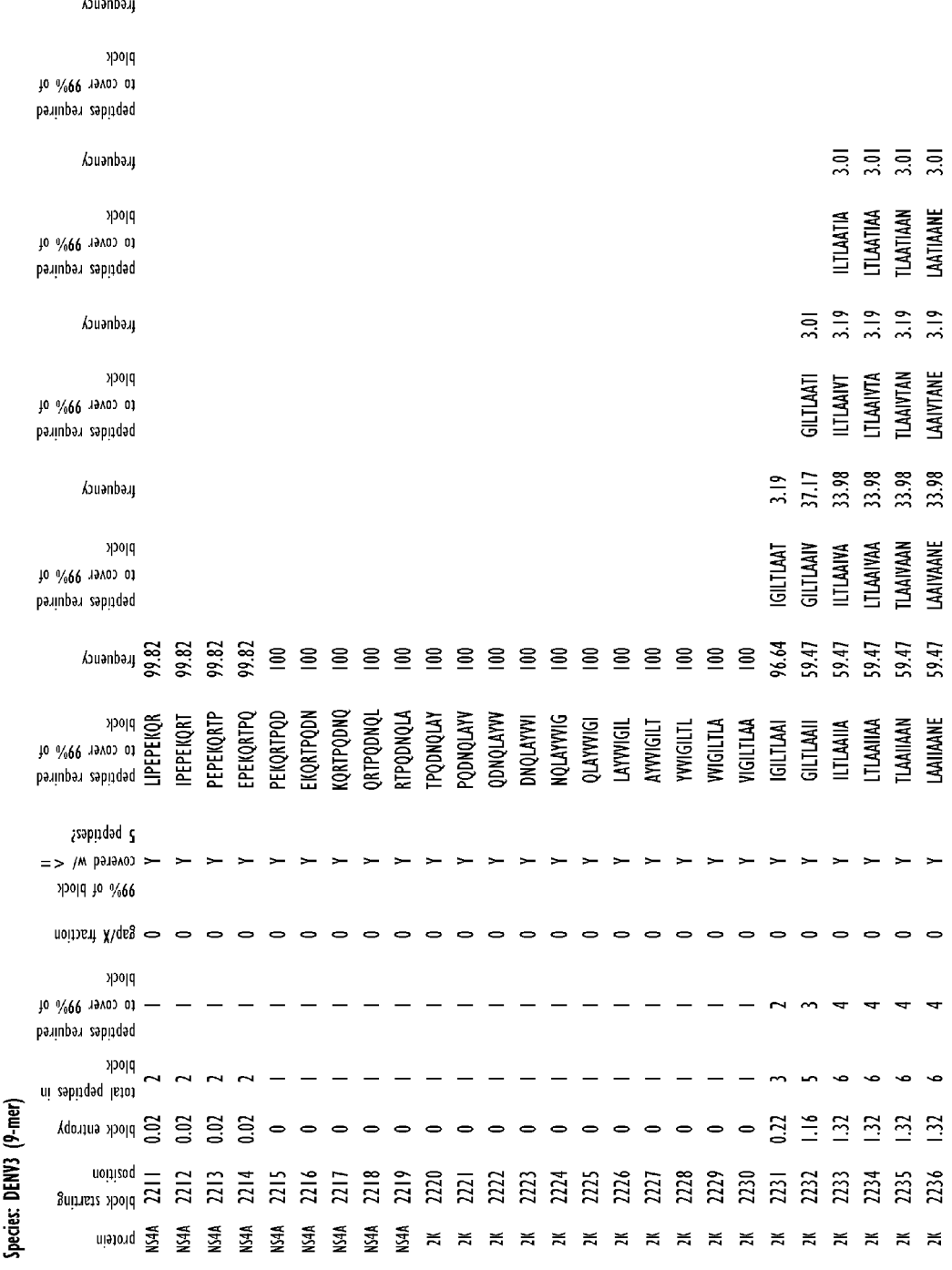
Figures 11, 84:
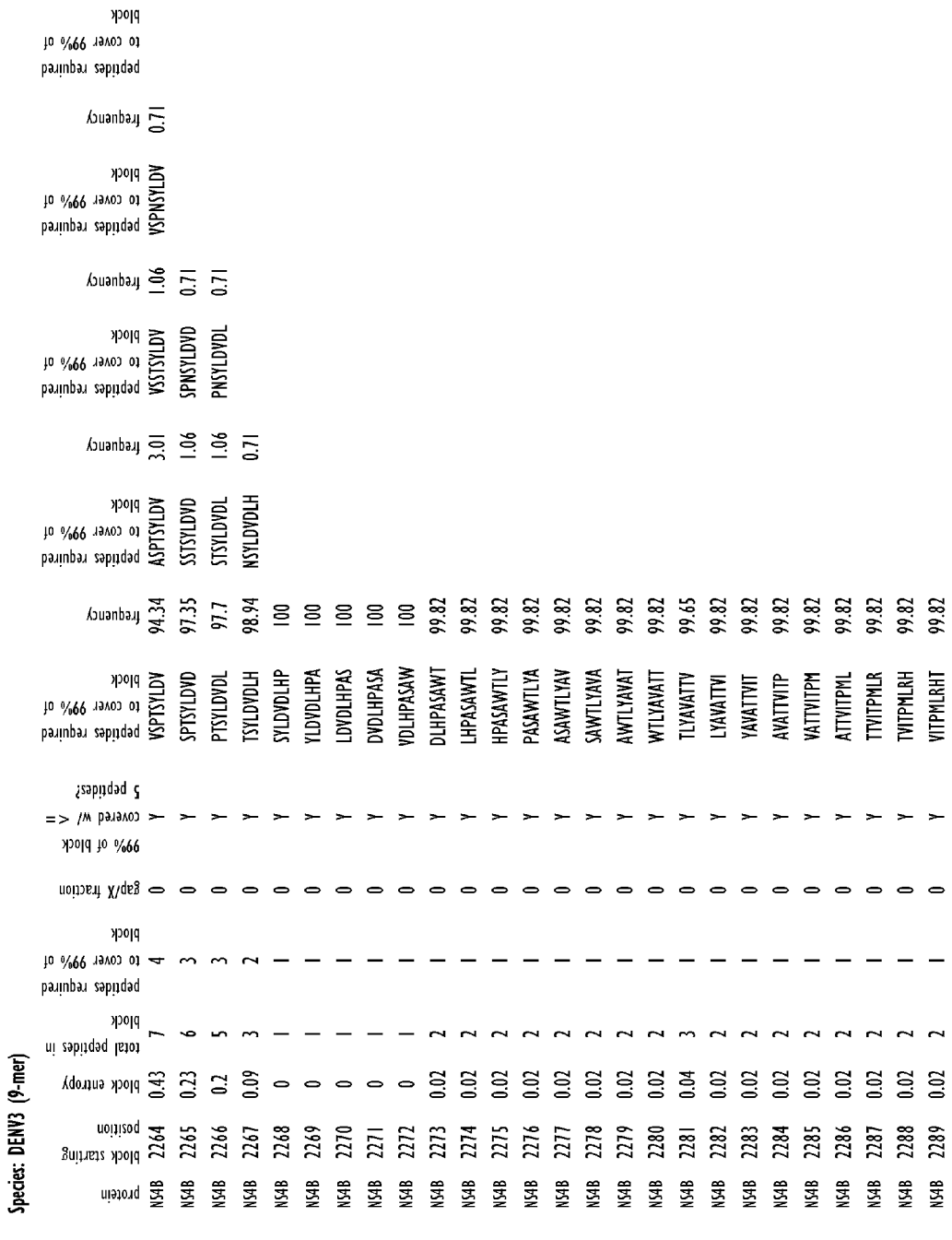
Figures 11, 89:
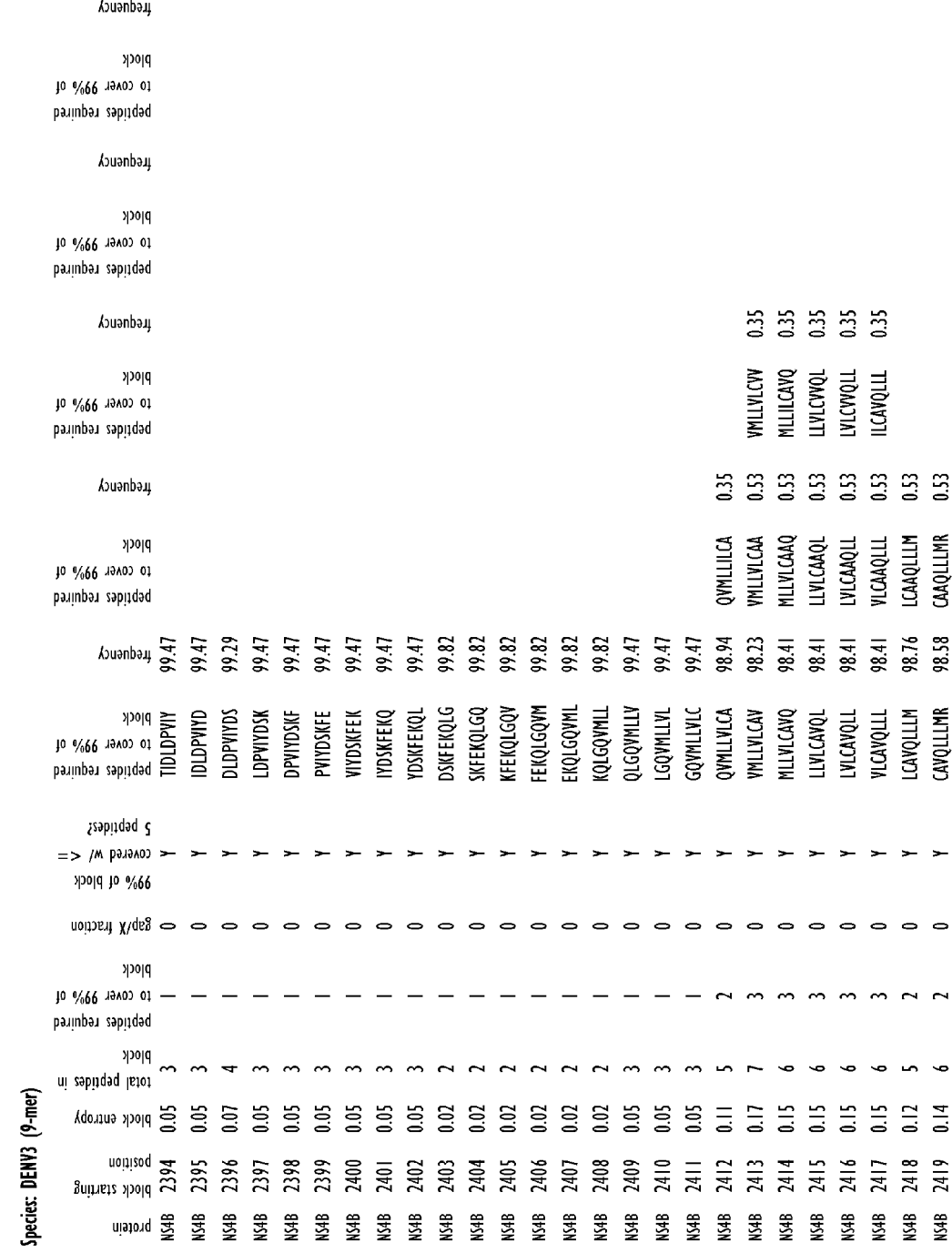
Figures 11, 90:
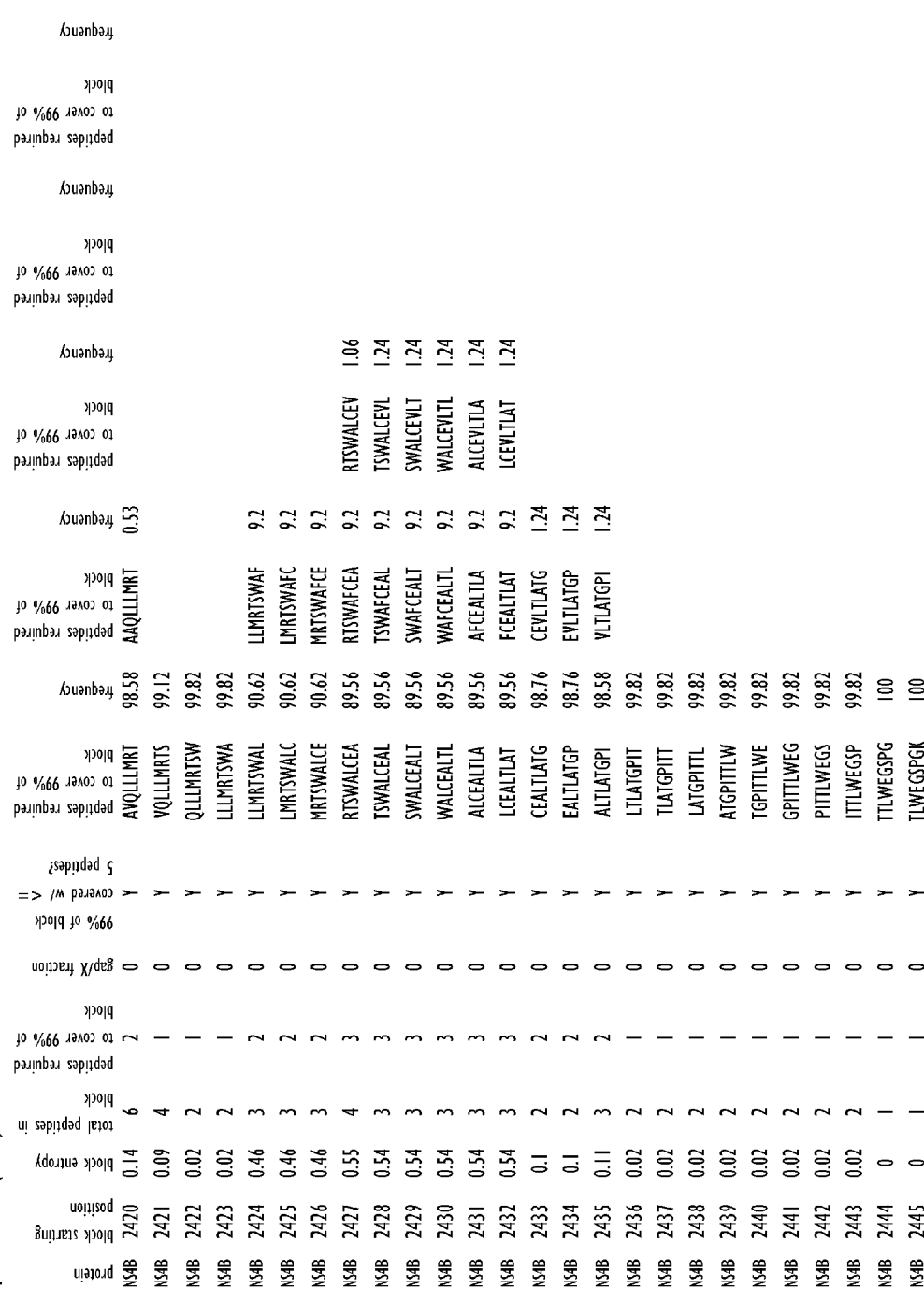
Figures 11, 91:
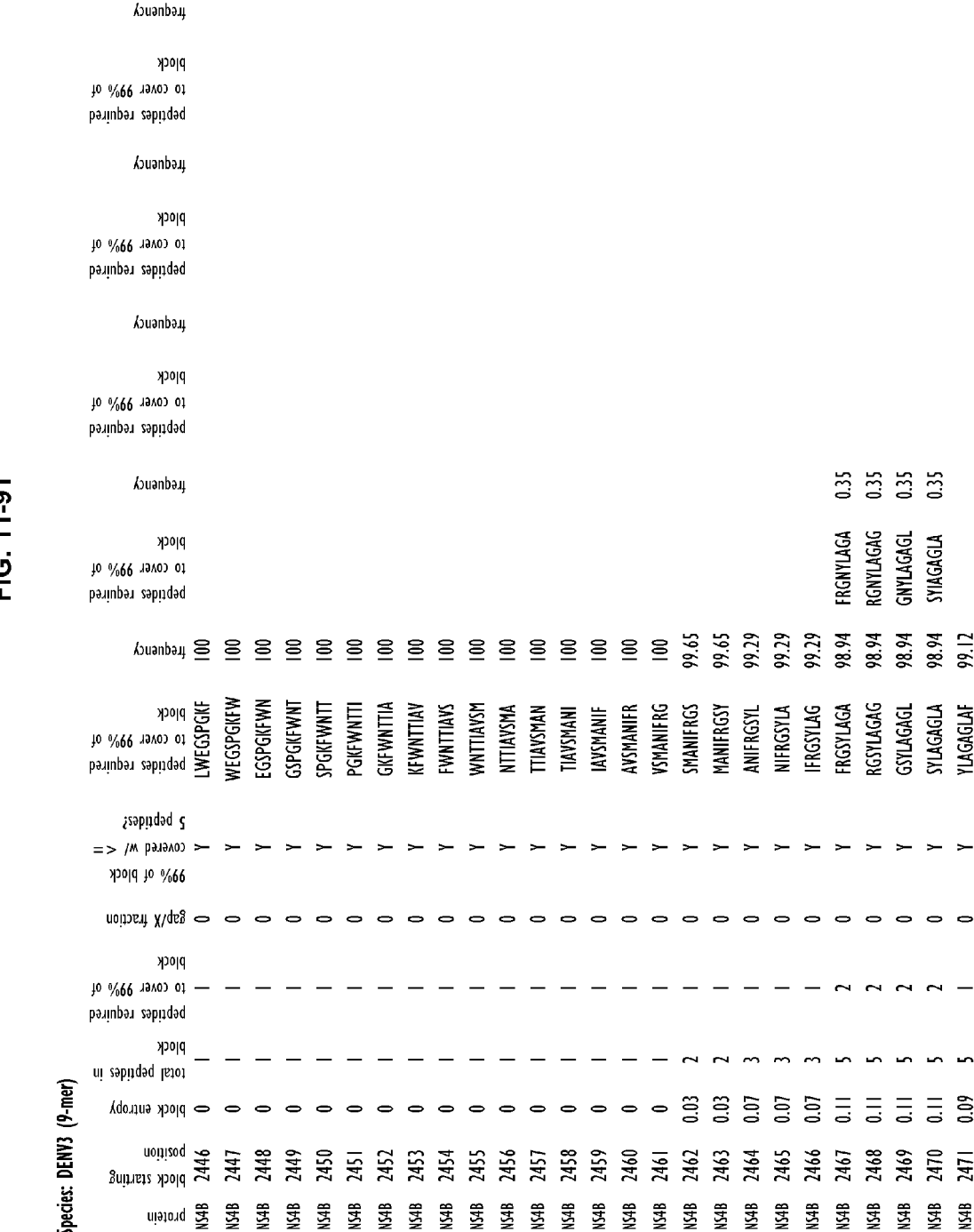
Figures 11, 98:
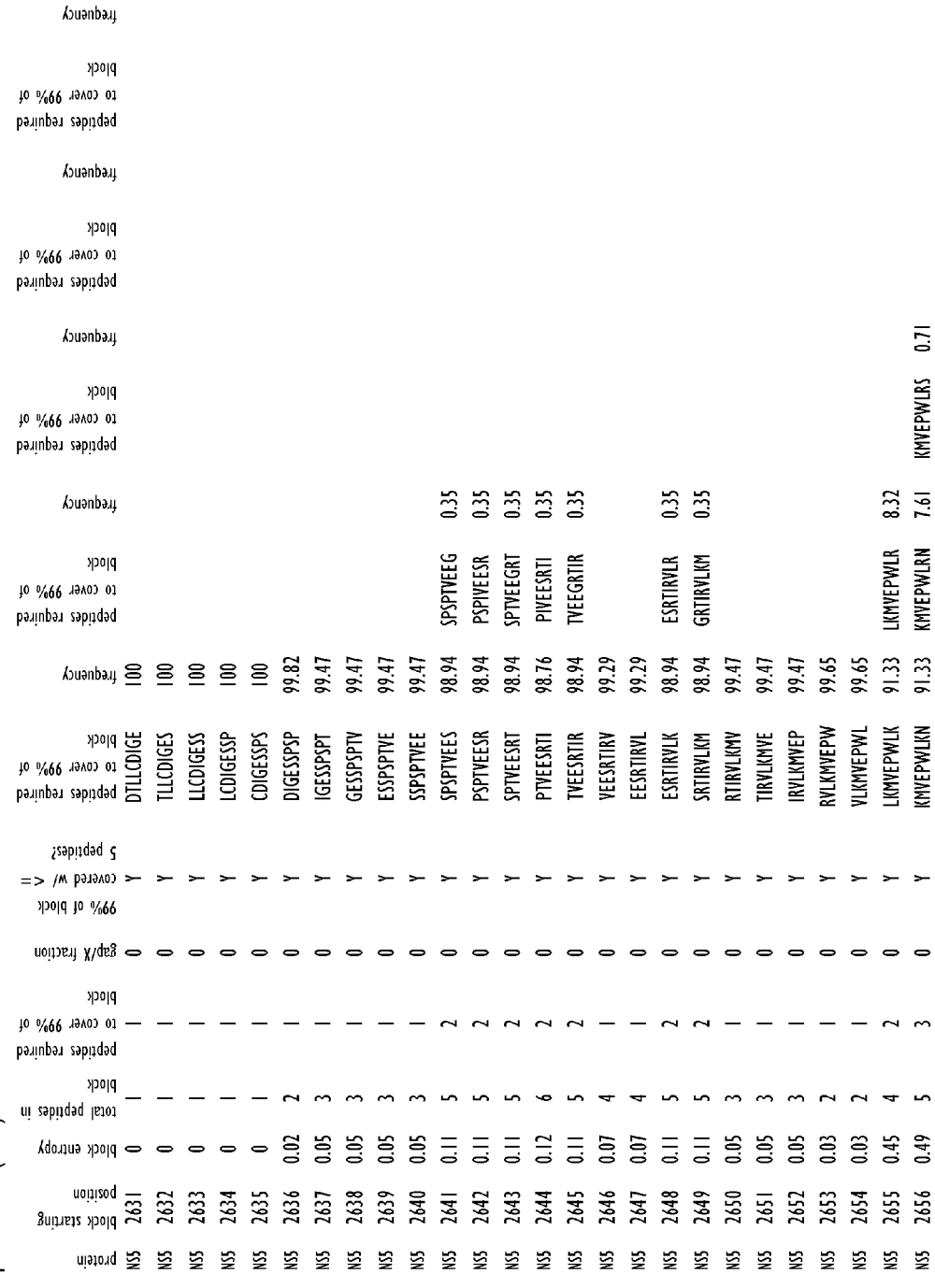
Figures 11, 101:
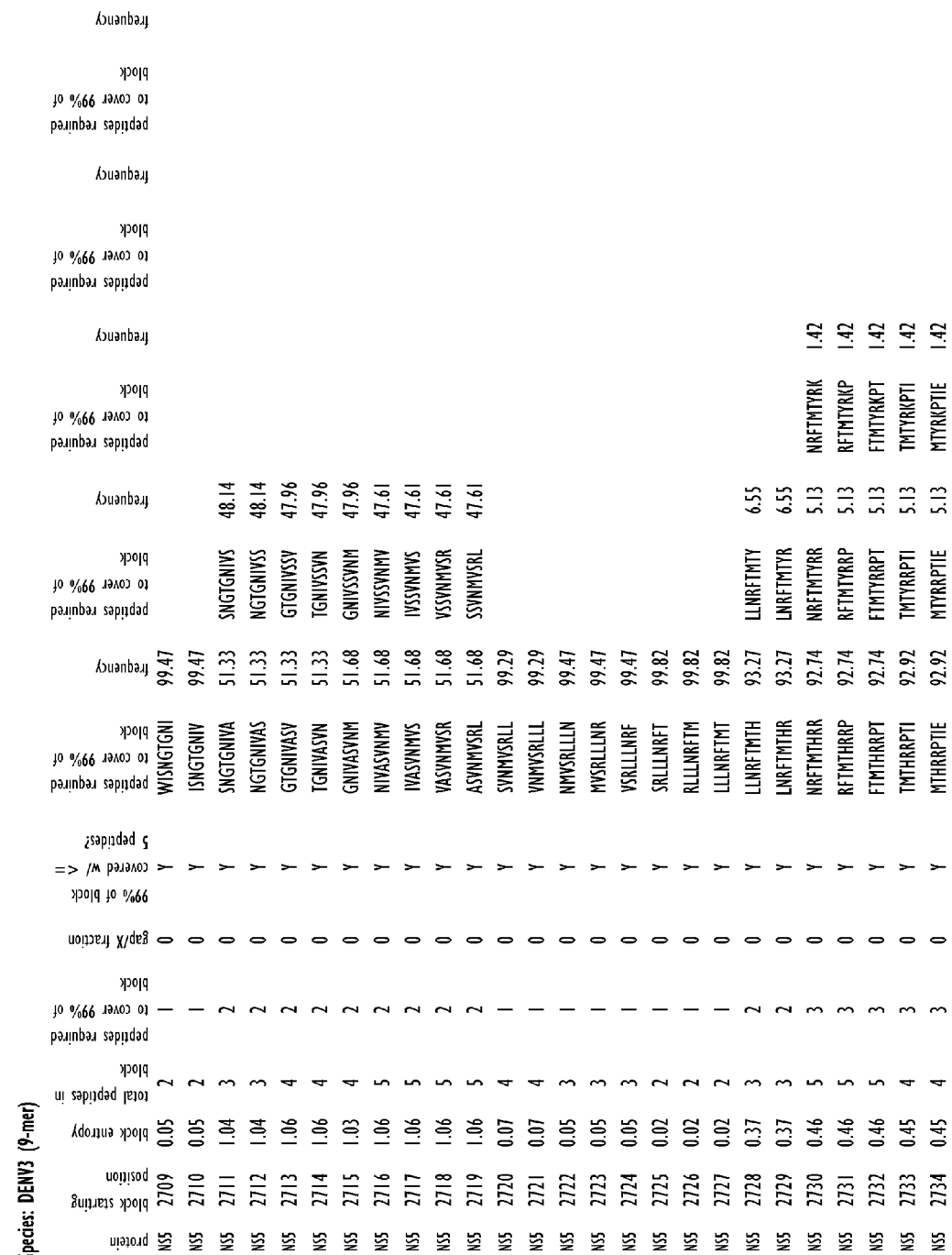
Figures 11, 104:
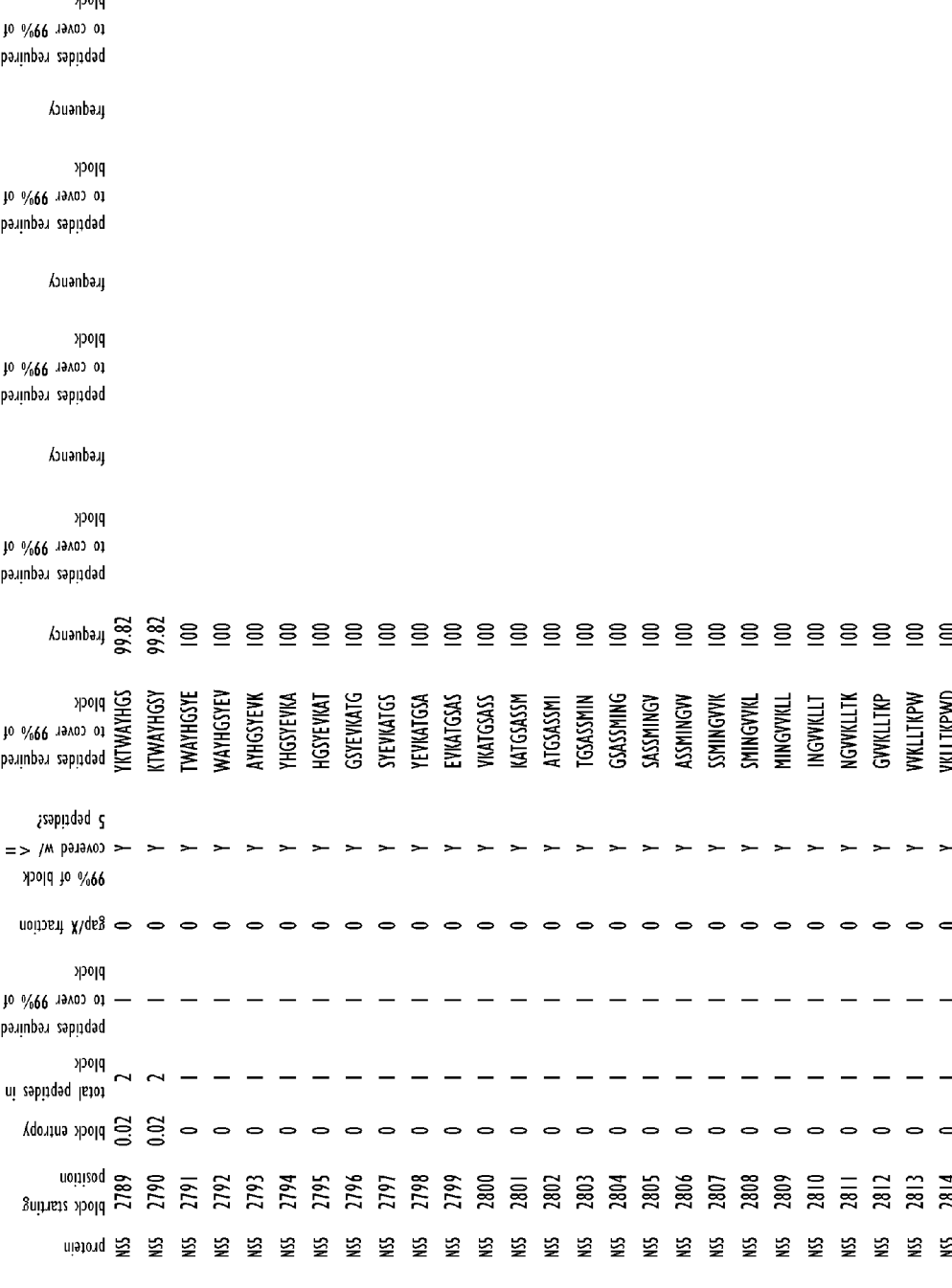
Figures 11, 107:
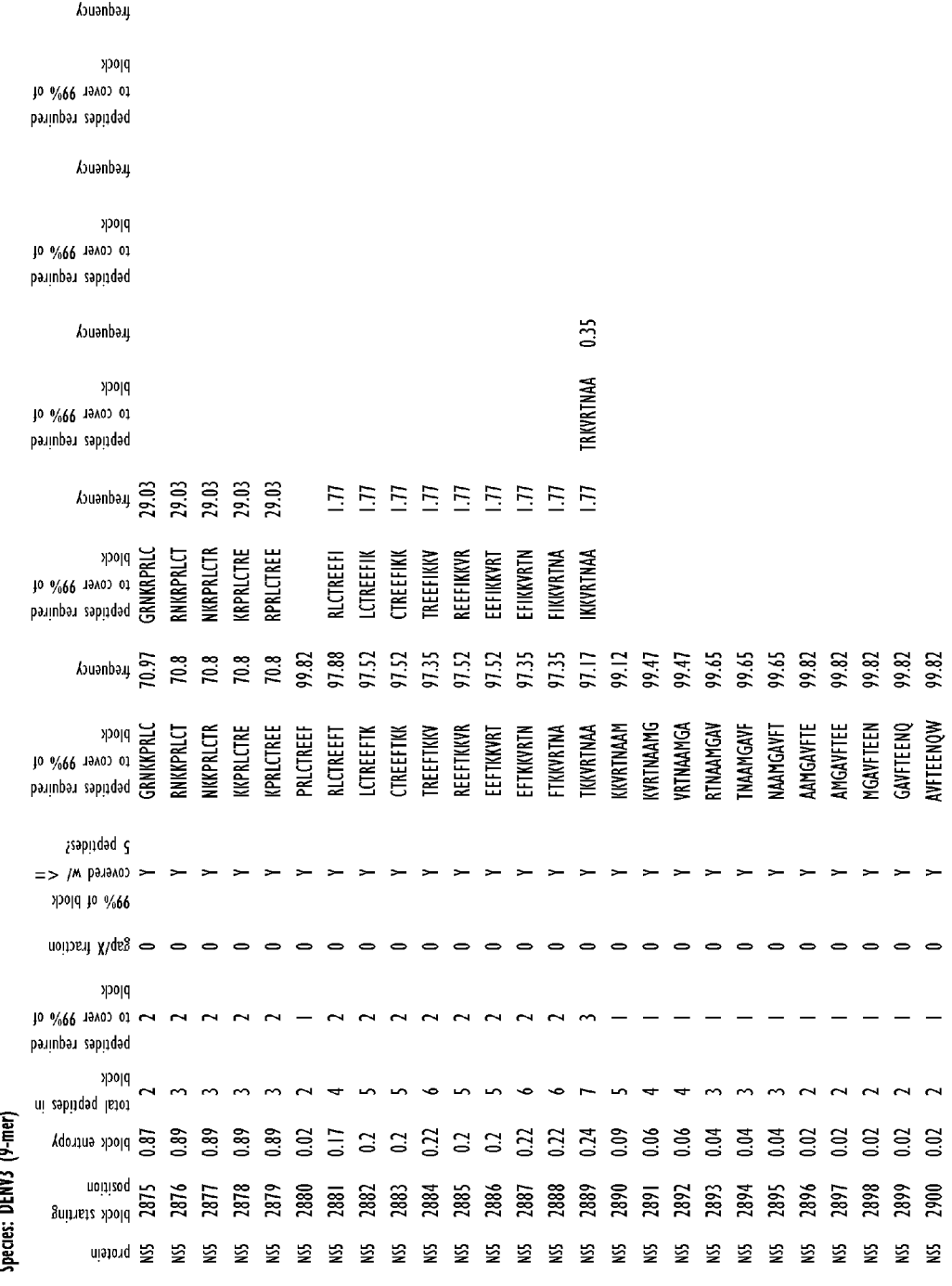
Figures 11, 110:
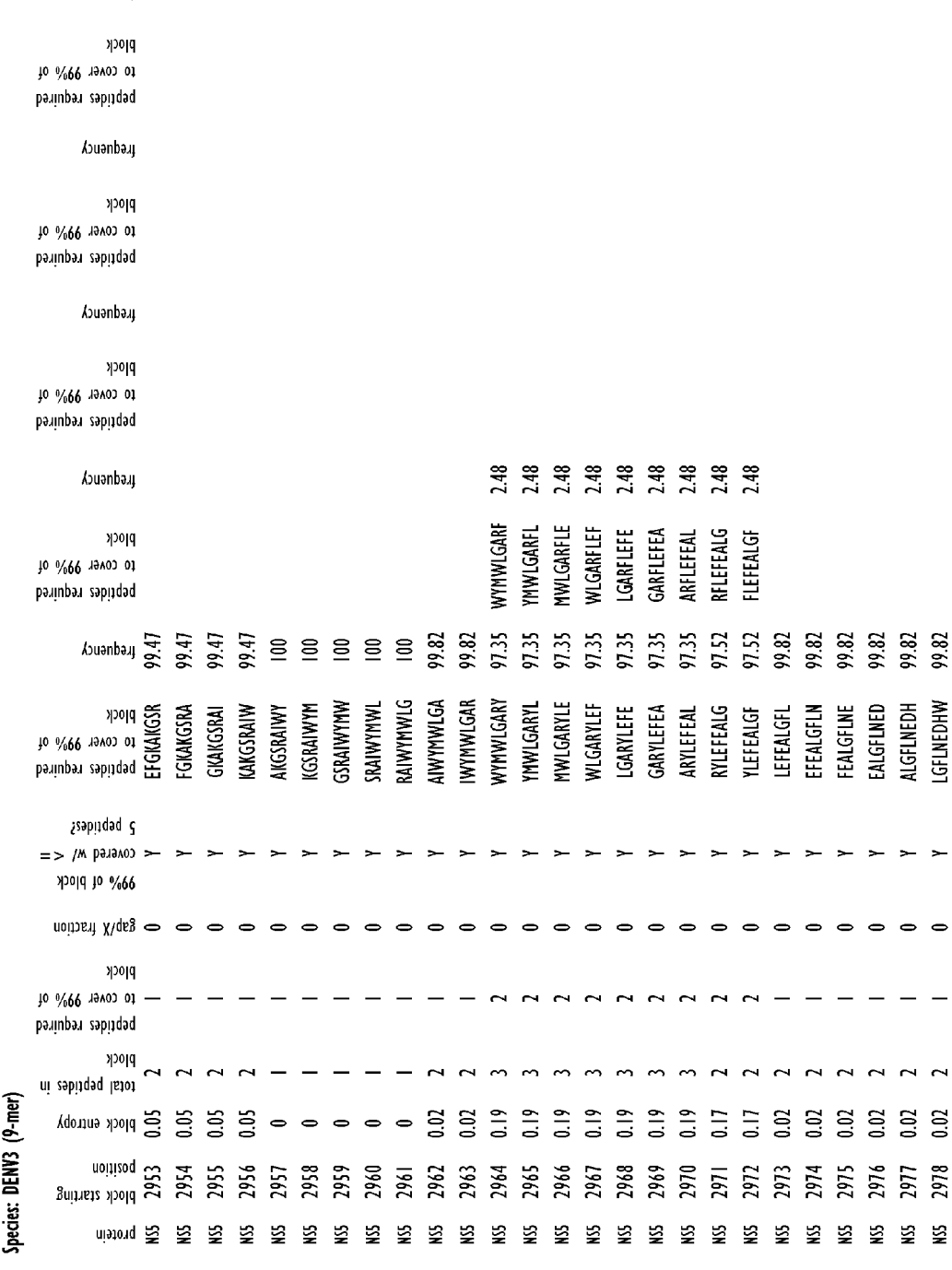
Figures 11, 111:
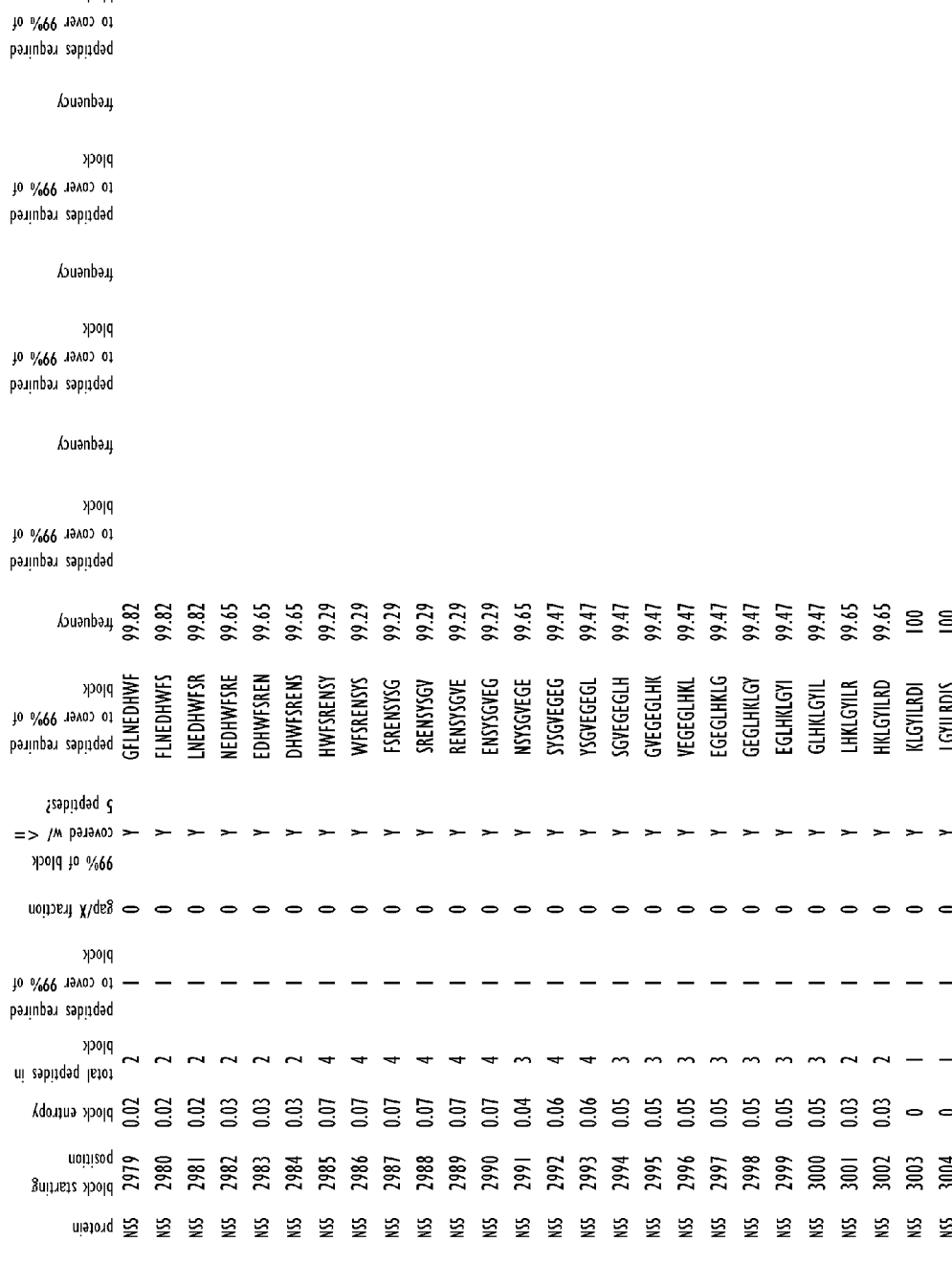
Figures 11, 112:
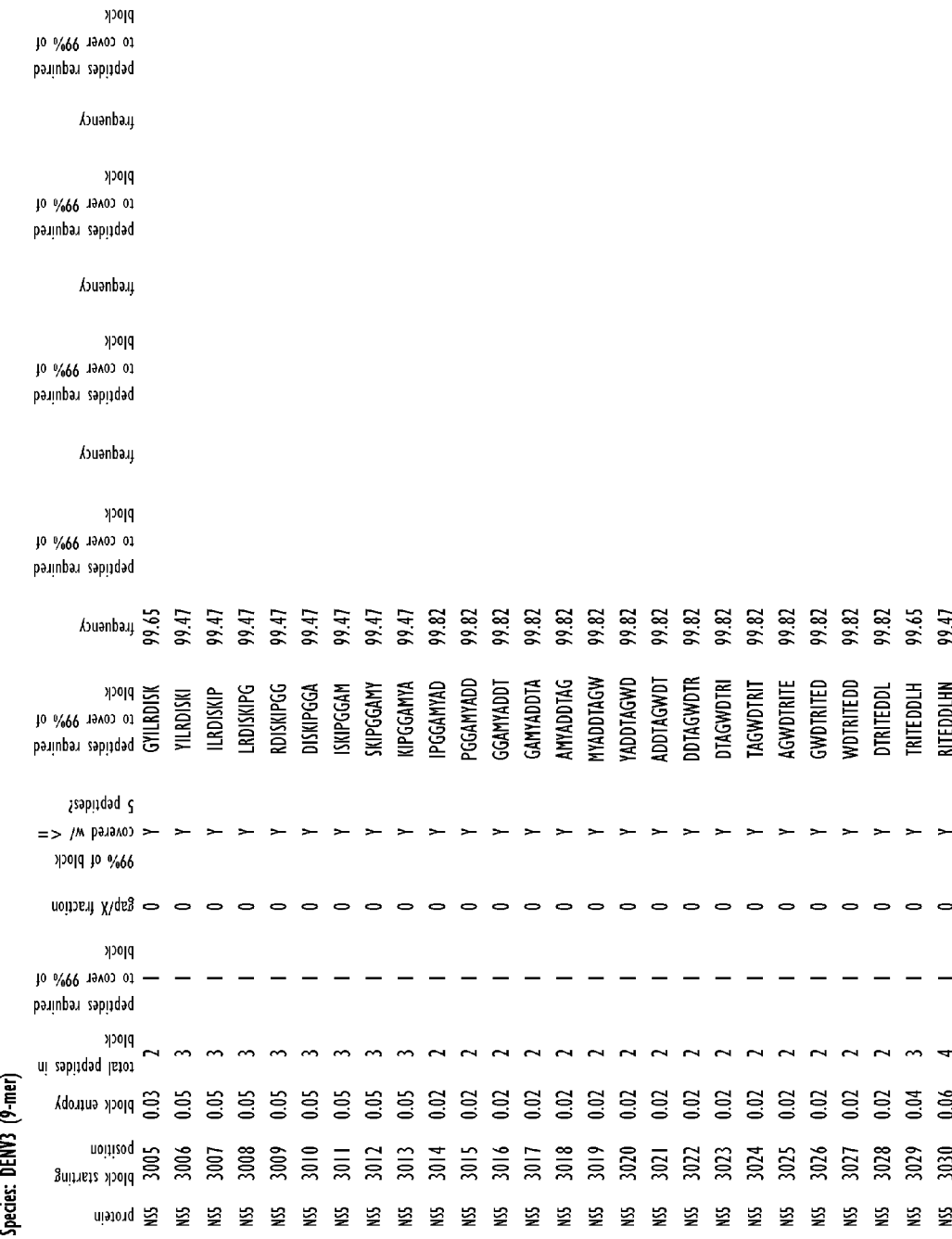
Figures 11, 114:
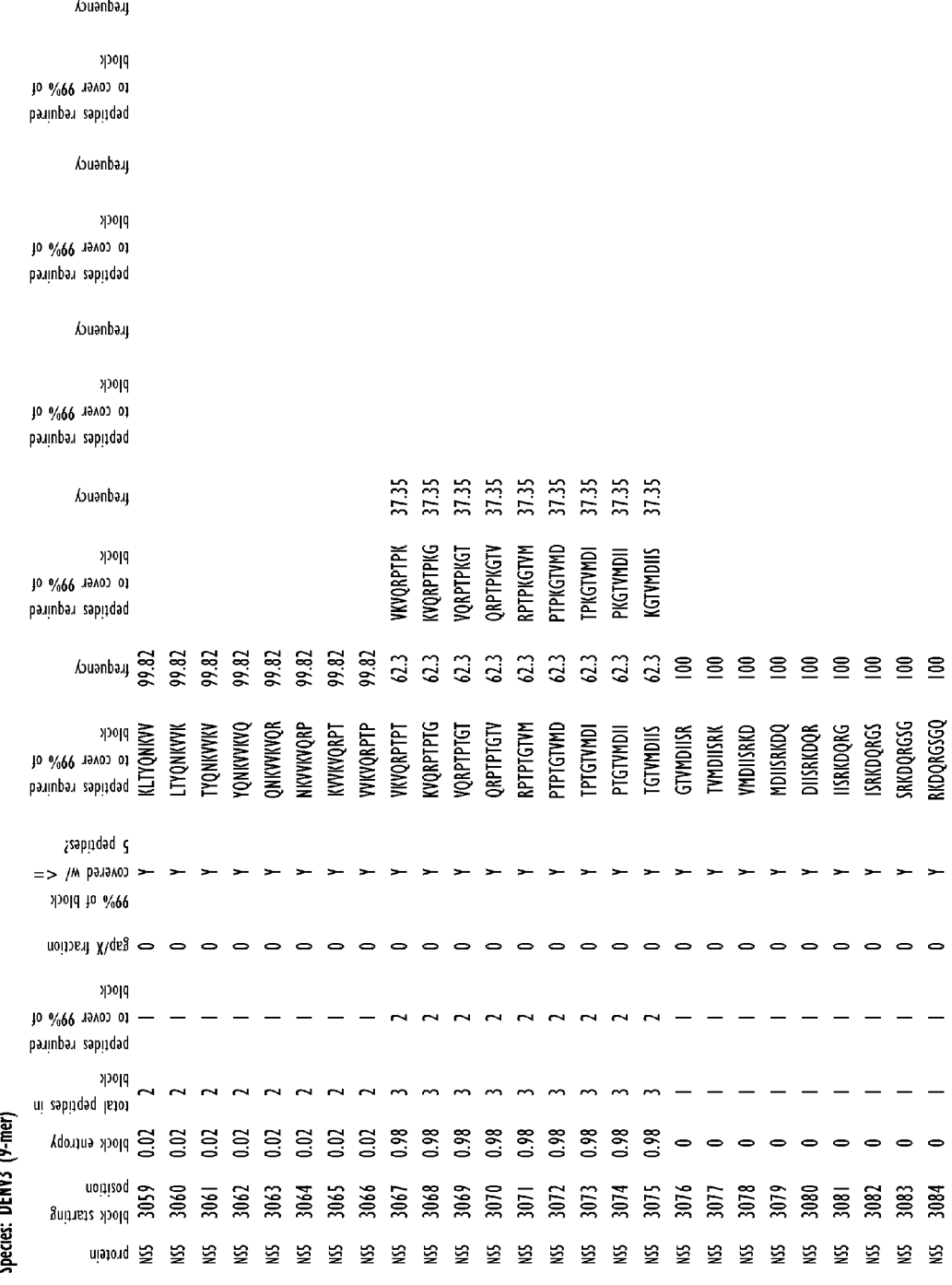
Figures 11, 120:
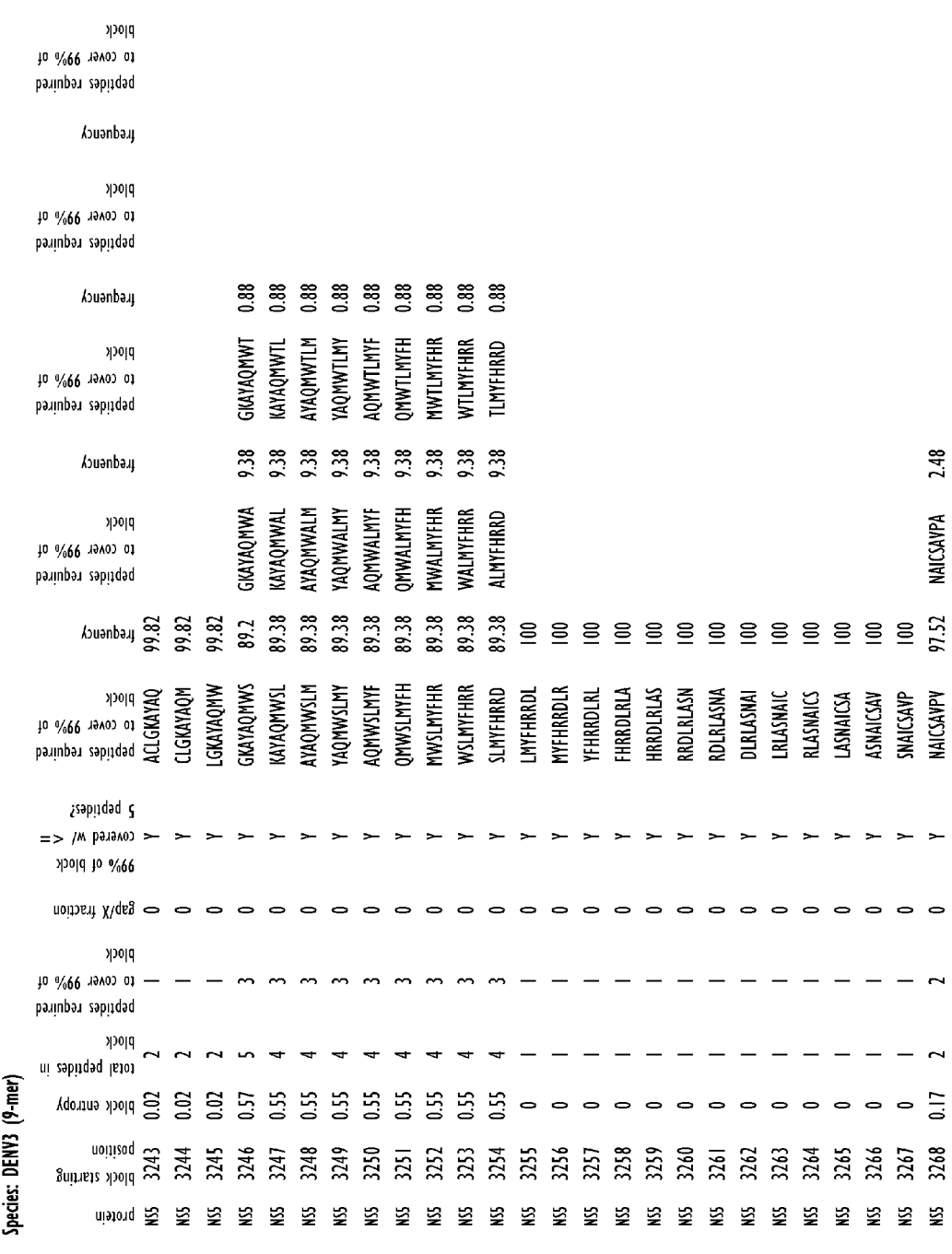
Figures 11, 121:
Figures 7, 12:
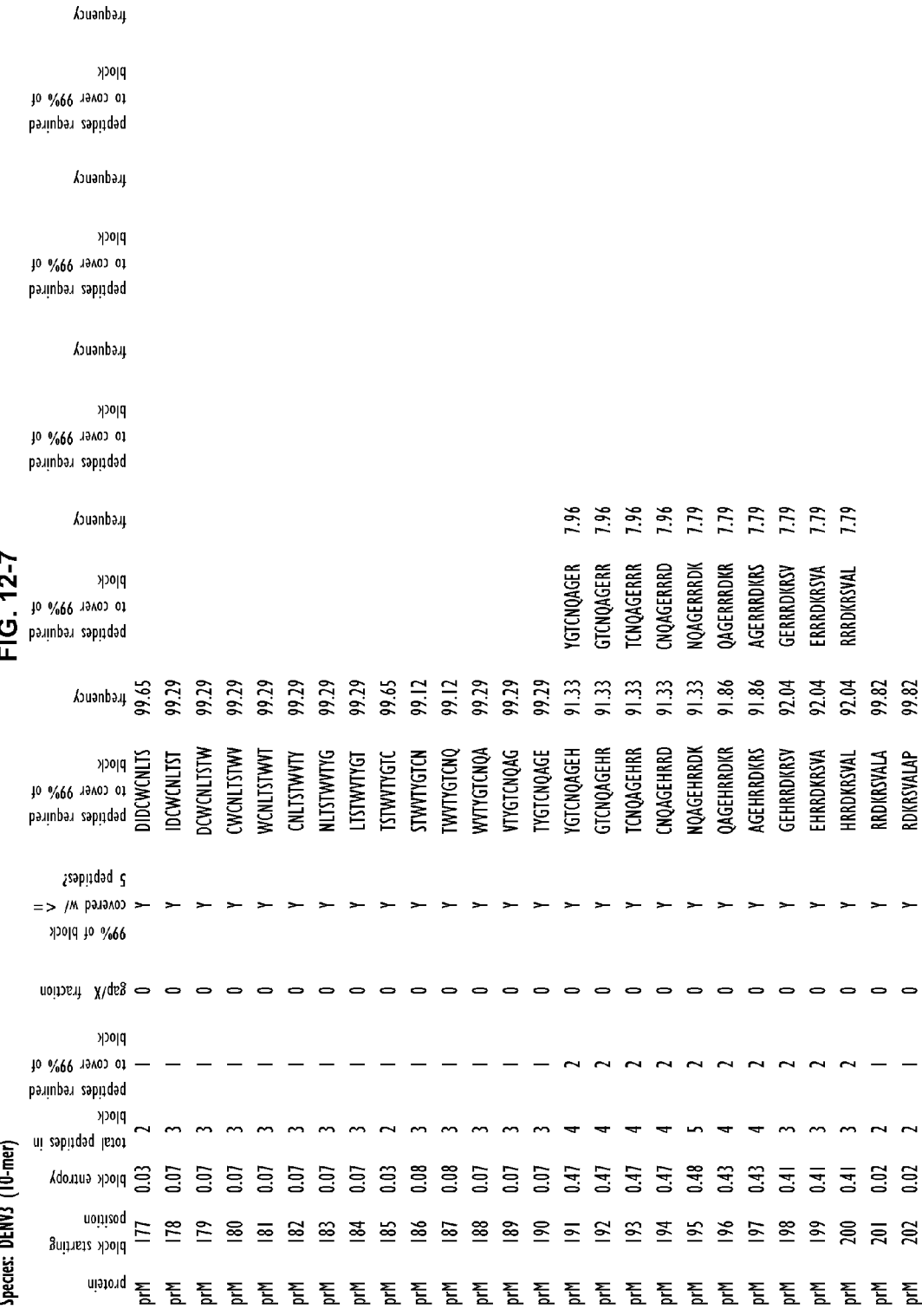
Figures 12, 117:
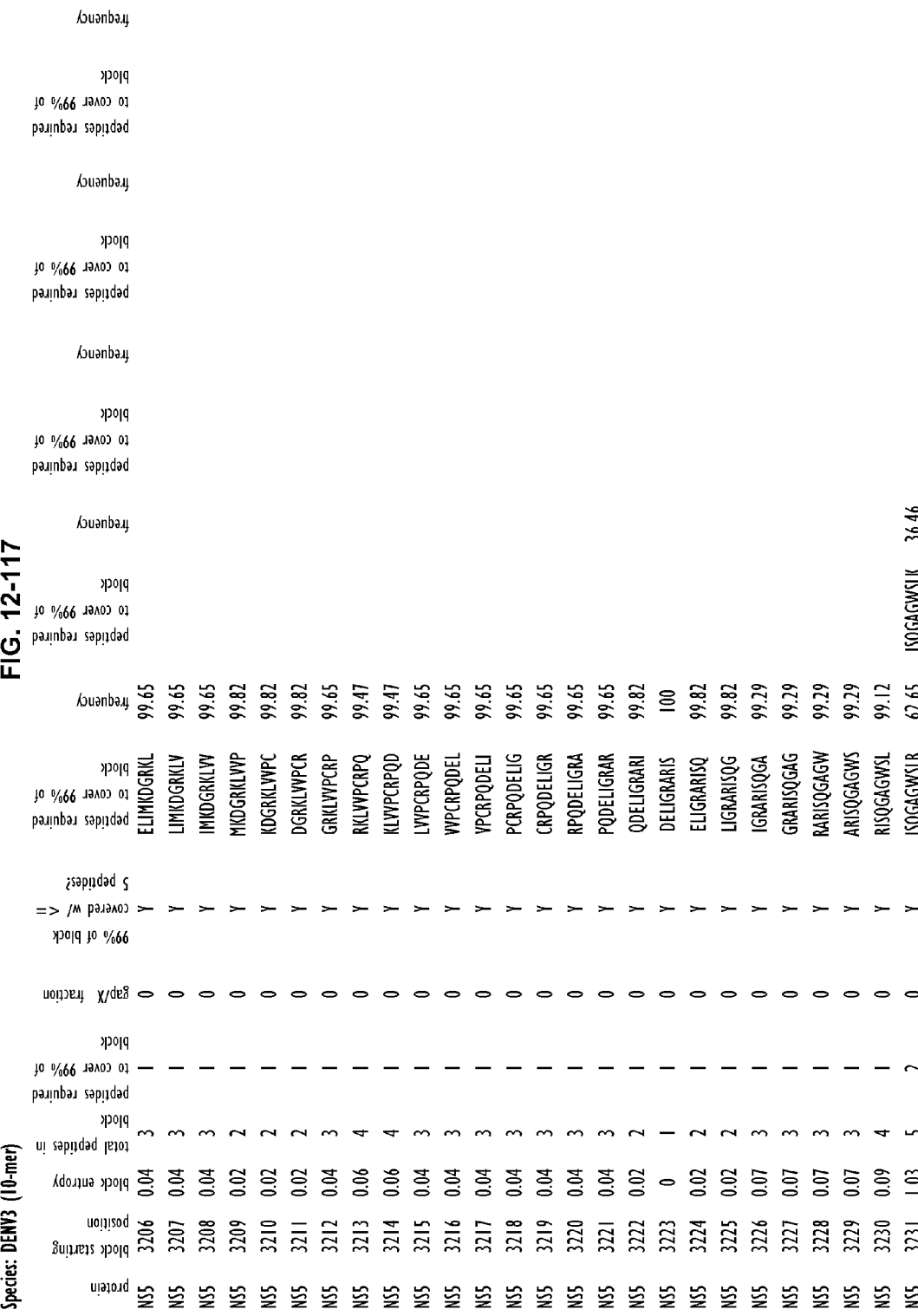
Figures 13, 102:
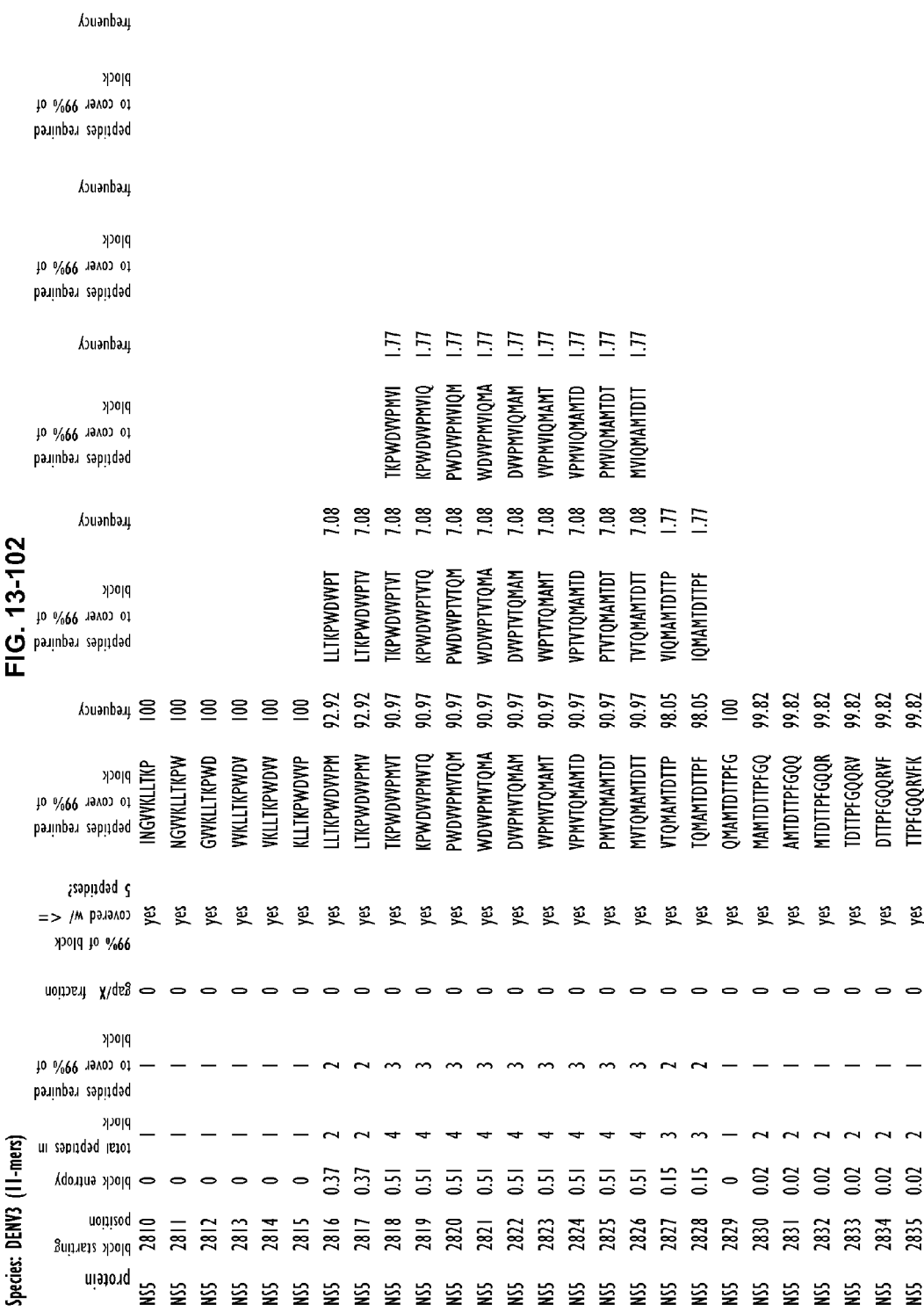
Figures 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50:
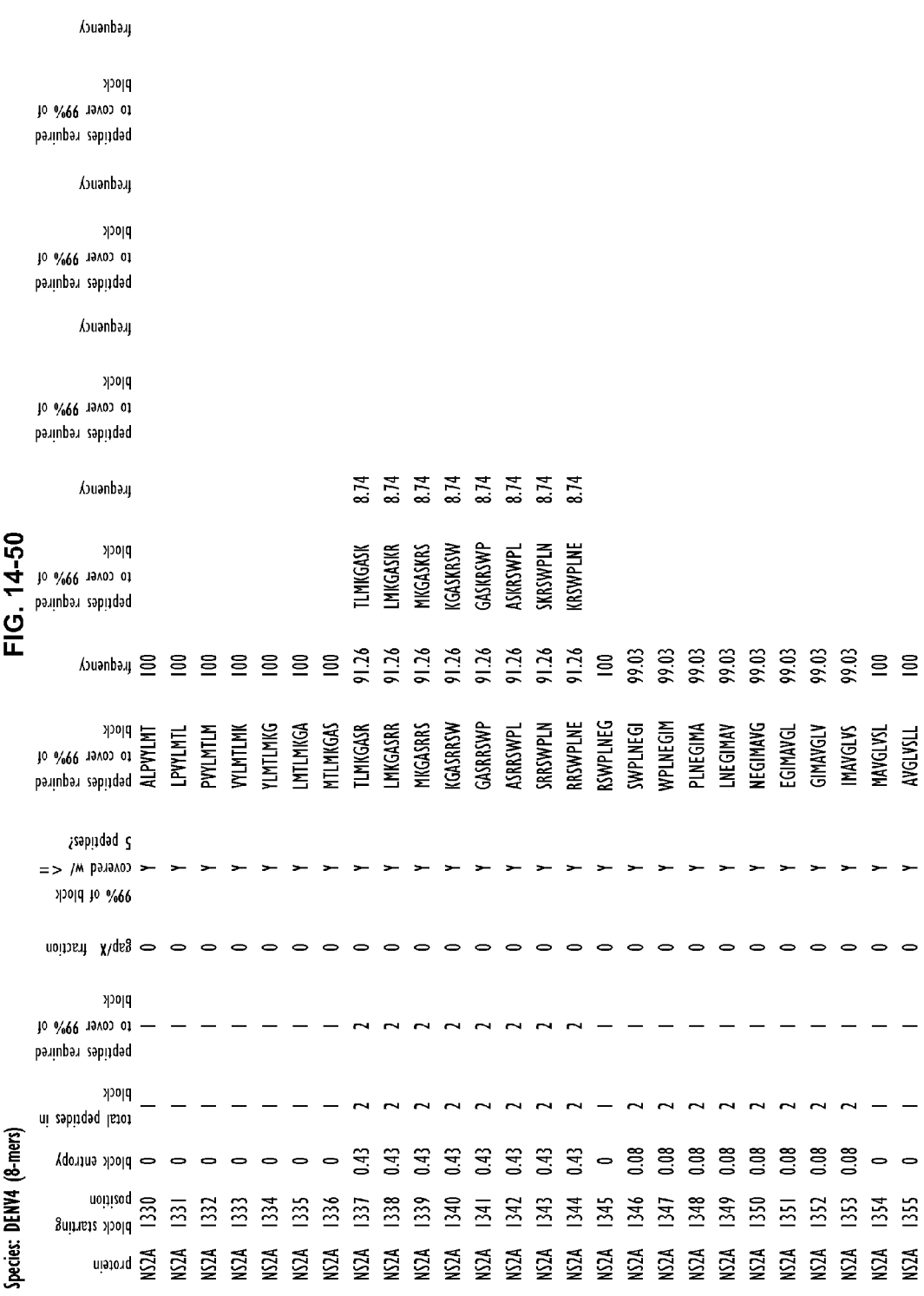
Figures 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53:
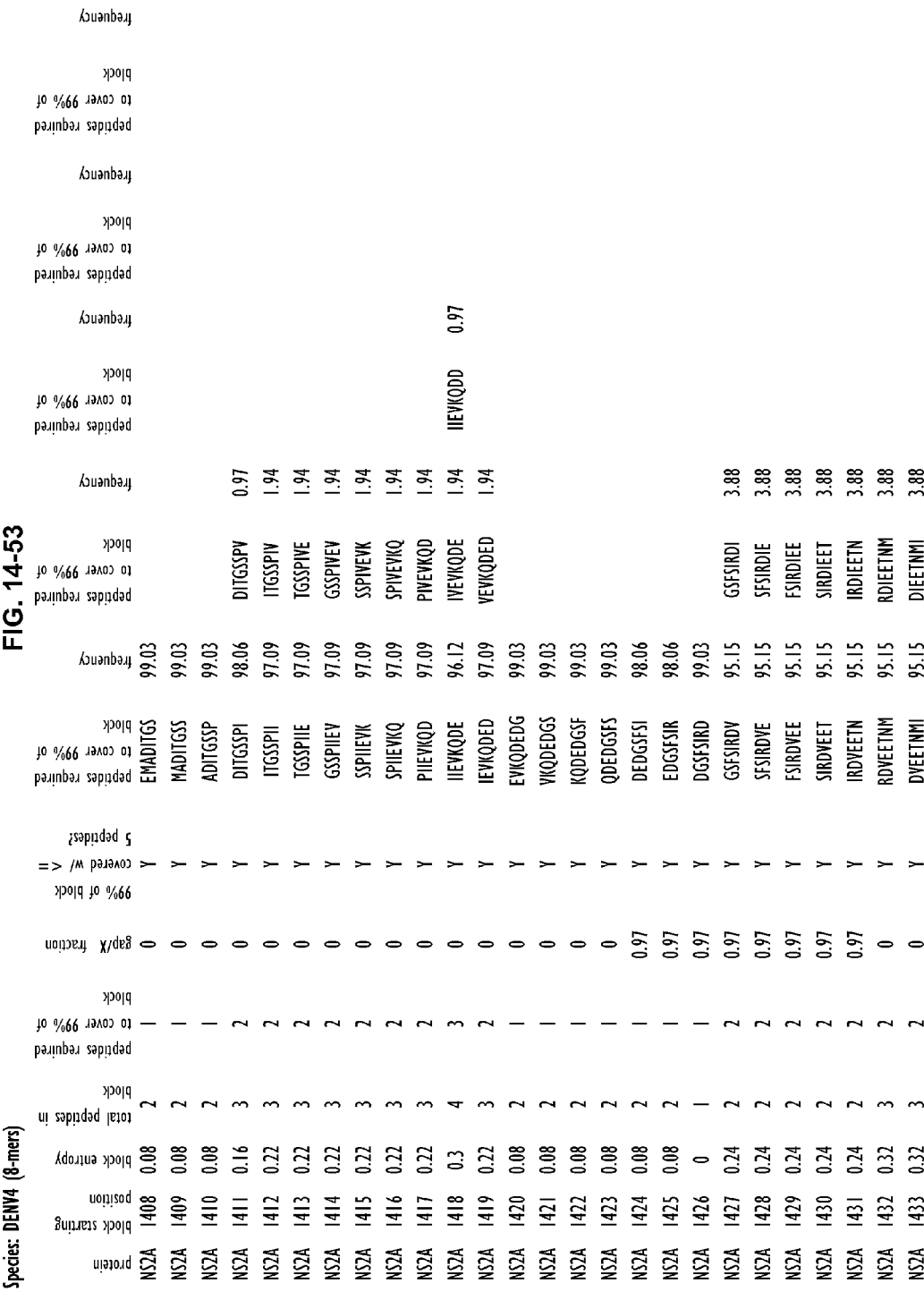
Figures 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61:
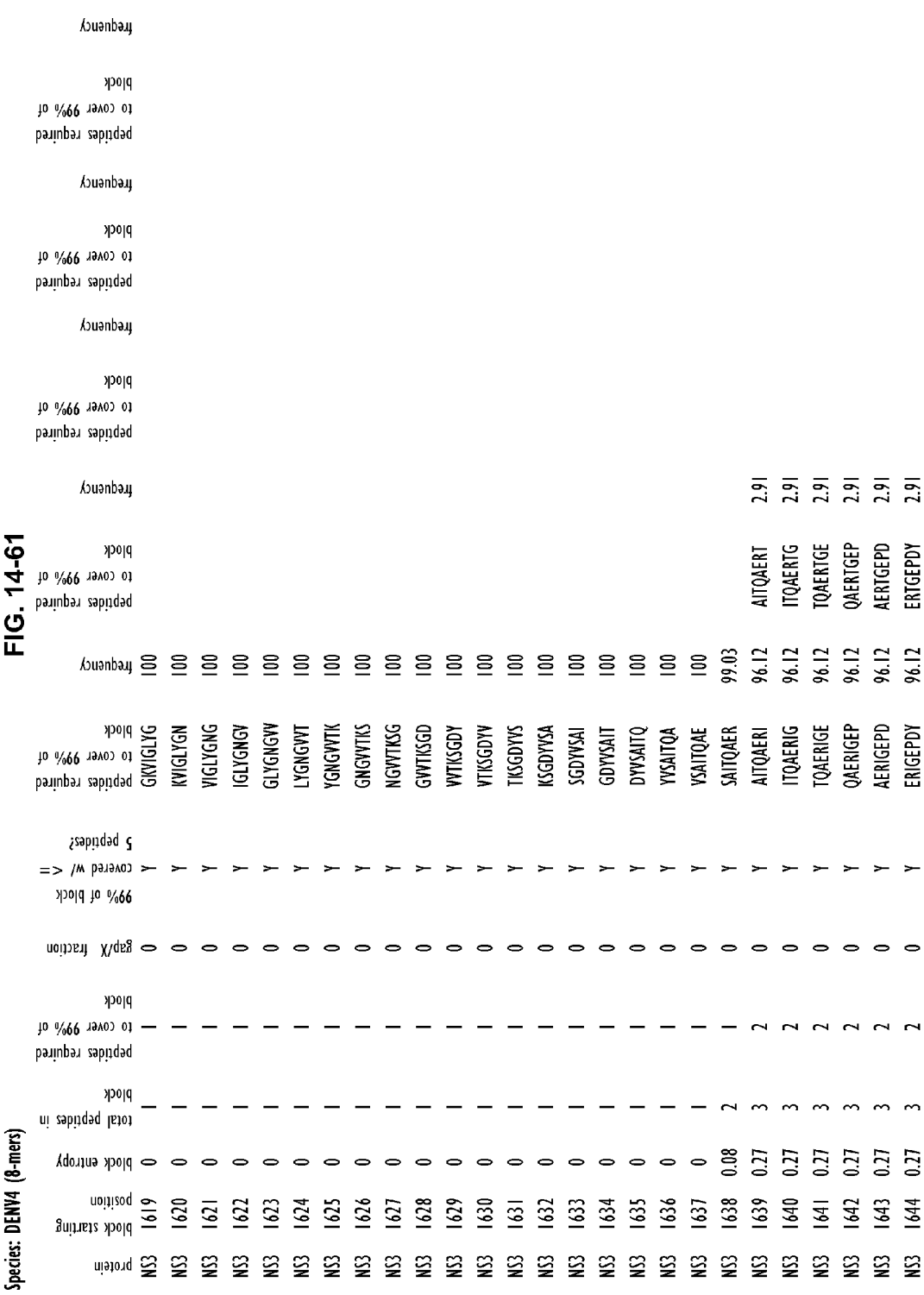
Figures 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64:
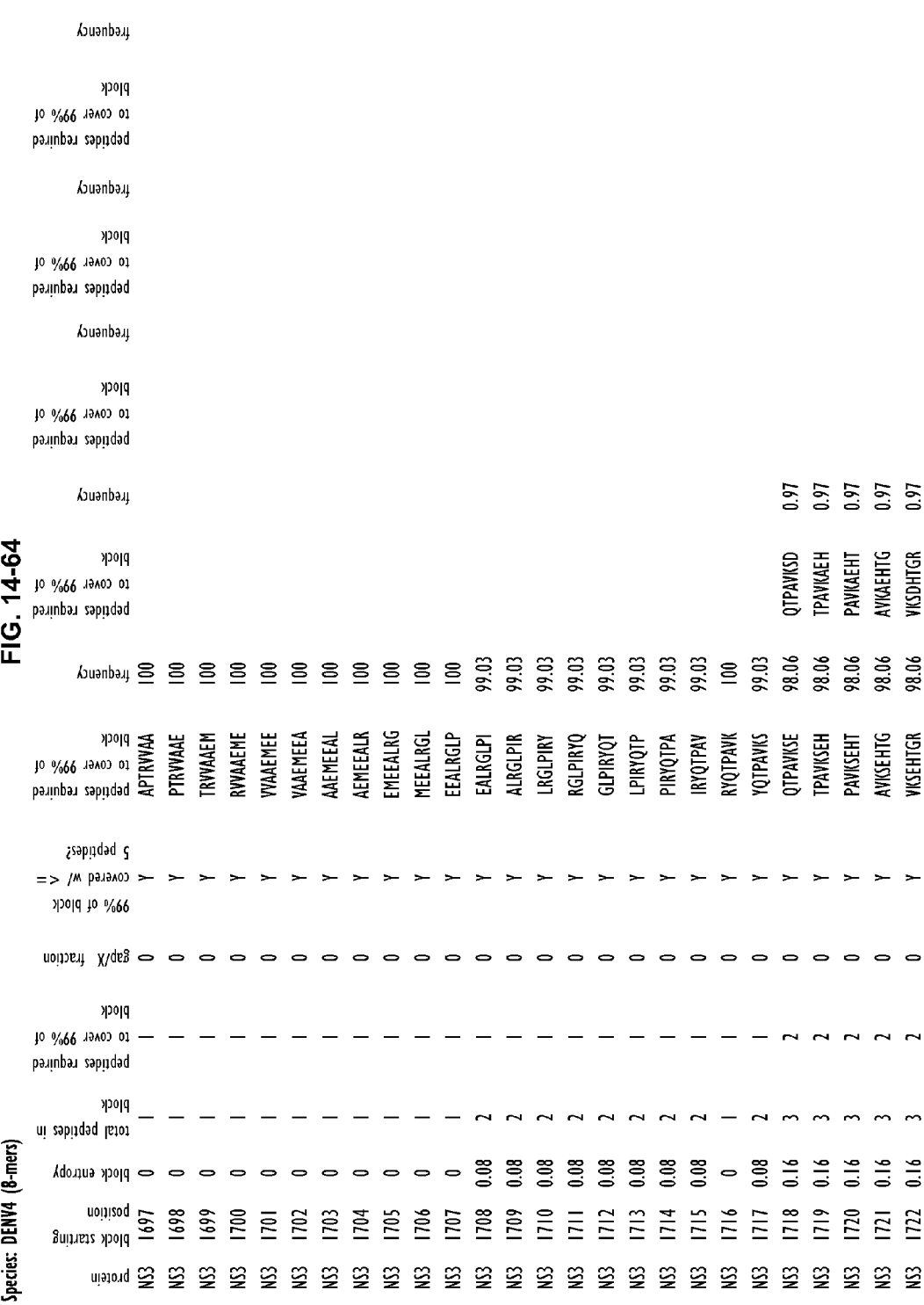
Figures 14, 66:
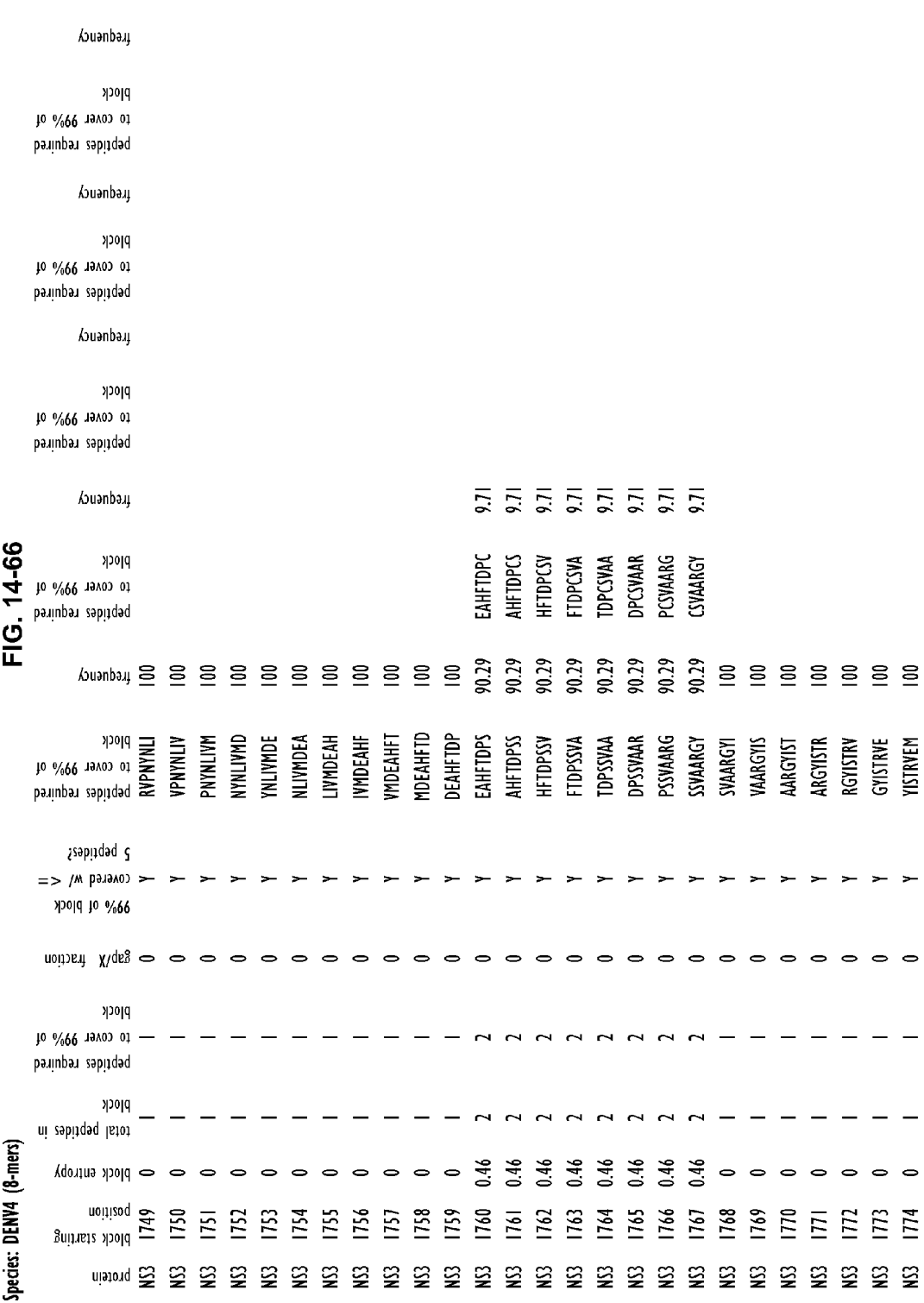
Figures 14, 71:
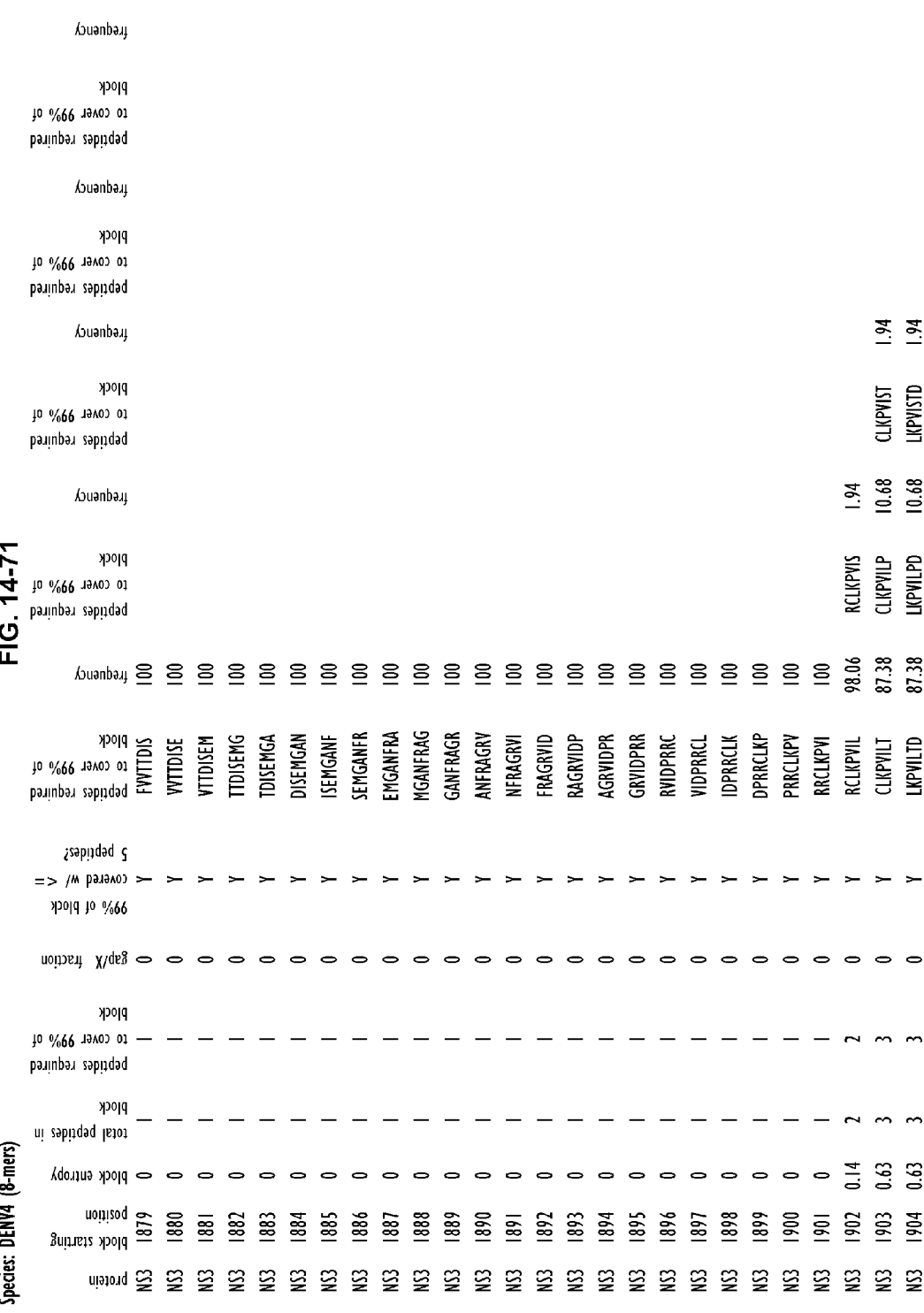
Figures 14, 121:
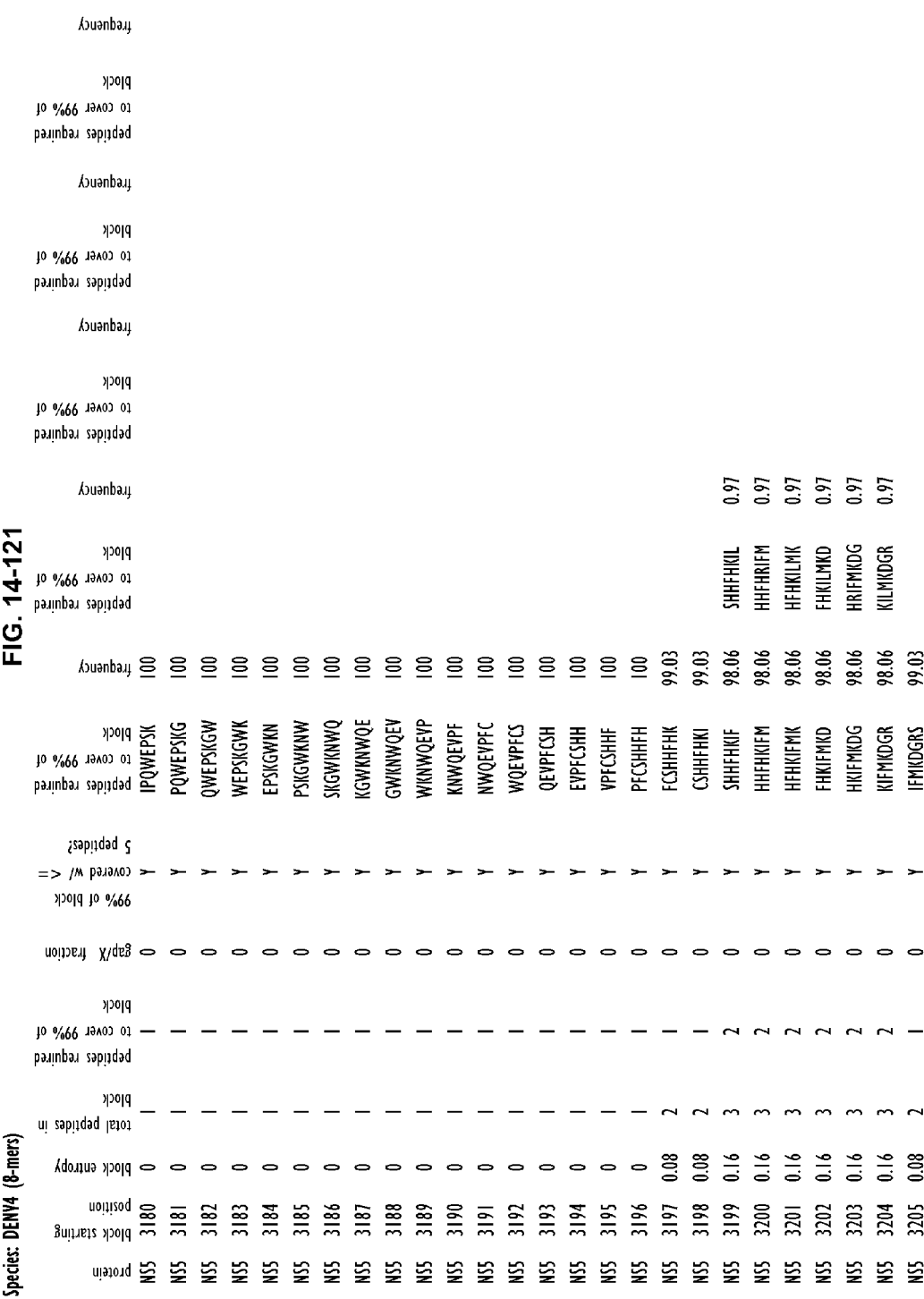
Figures 14, 125:
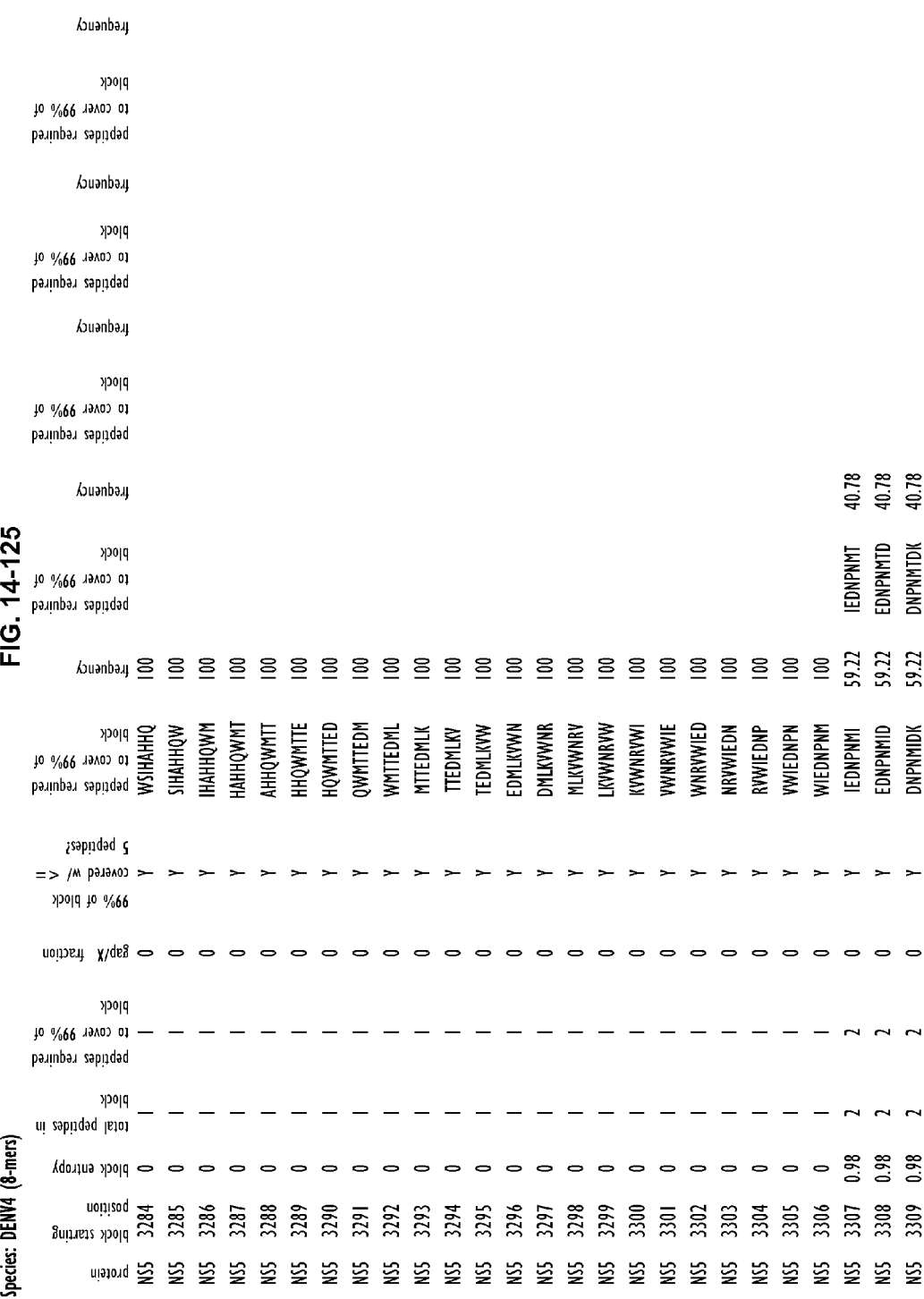
Figures 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63:
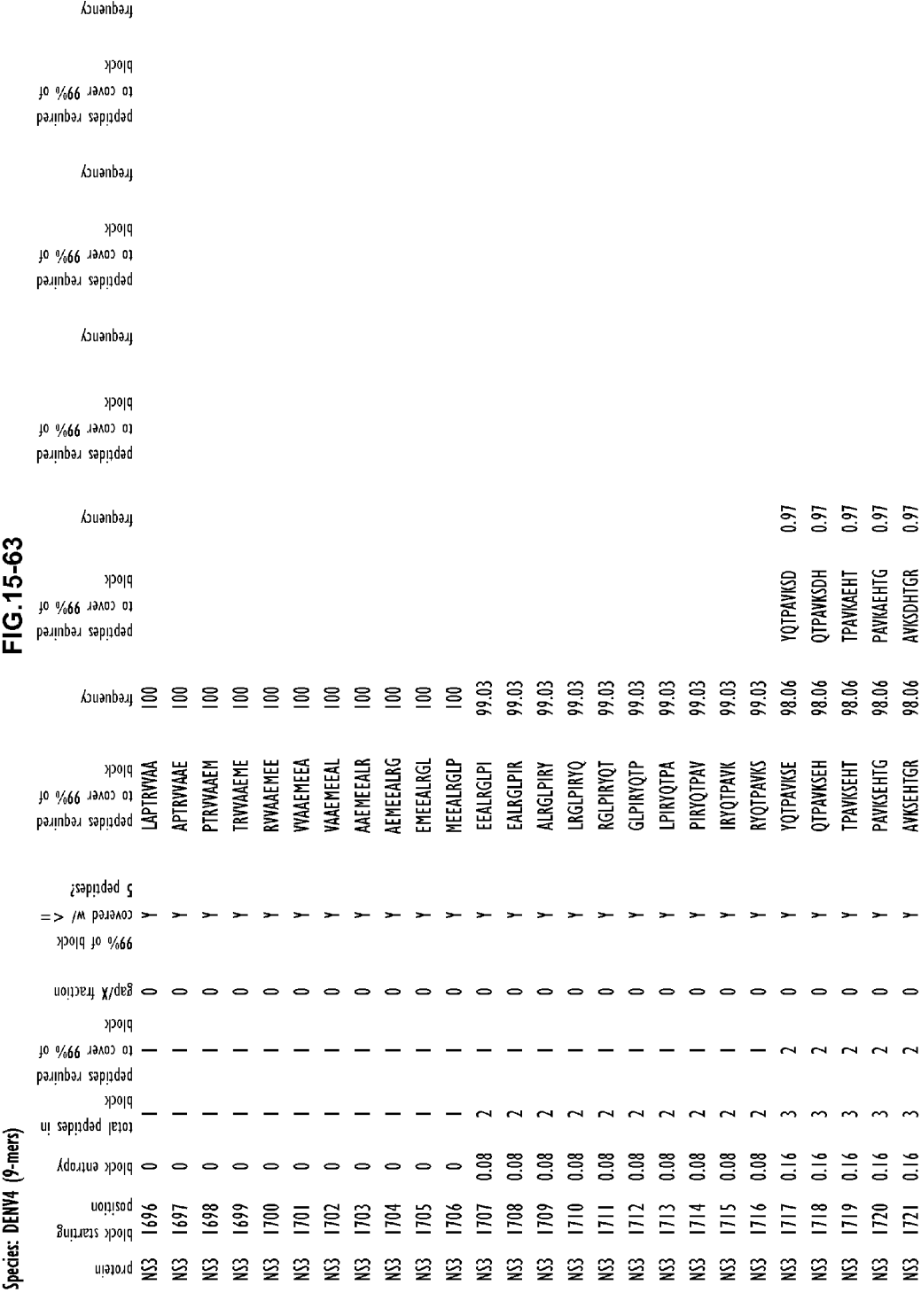
Figures 15, 111:
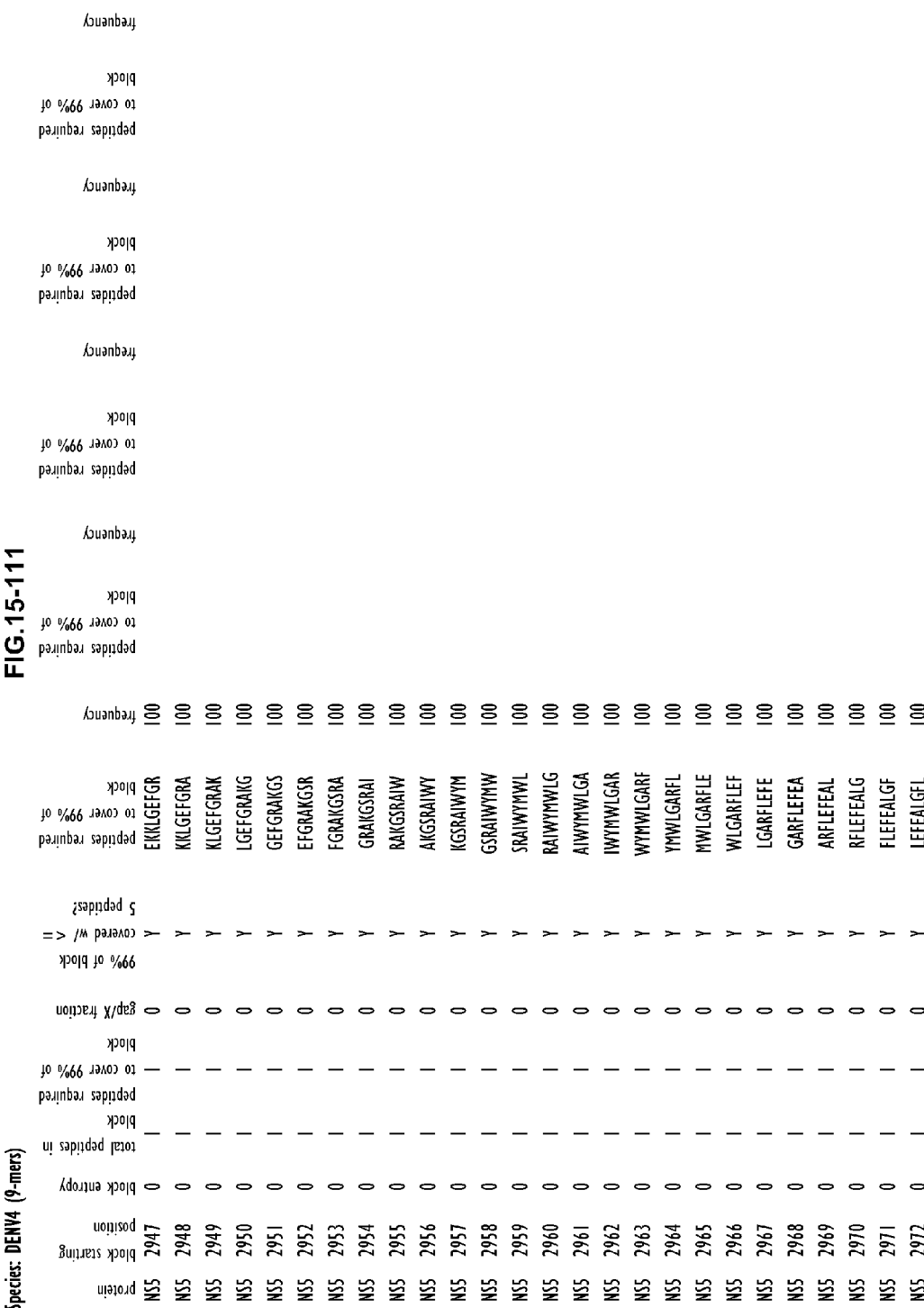

MHC class II binders were predicted from the DENVall peptide strings (constructed from 8, 9, 10, and 11-mers, as shown in FIG. 62). All MHC class II binding predictions were based on the core of the epitope (typically the middle 9 residues), which meant that it was possible for a 15-mer to harbor at least 3 different binding cores, due to the flexibility of the MHC class II molecule, which is open at both ends. The one or more amino acid sequences of the MHC class II epitope core for each conserved peptide (listed by amino acid sequence) and the binding affinity for each core are shown in FIG. 50. In FIG. 50, binding affinity to a particular HLA molecule is only shown for a peptide core if the core was determined to bind at least weakly (i.e., have a binding affinity ($IC_{50}$) of ≤500 nM) to that HLA molecule (i.e., negative binding predictions are not shown).

The antigenic potential differed among individual proteins, as shown by the number of predicted epitope blocks relative to the size of the protein in Table 4, below. The conservation to size ratio was calculated by dividing the number of blocks predicted to be immunofunctionally conserved, divided by the relative size (in %) of each protein. The "fraction of proteome" indicated in Table 4 quantifies size of individual proteins as percent (%) of the complete polyprotein.

TABLE 4

Ratio of conservation to size of each DENV protein

| protein | Fraction of proteome | Immuno-functionally conserved blocks | Immuno-functional conservation:Size ratio |
|---|---|---|---|
| anC | 3.36% | 3.64% | 1.08 |
| prM | 4.89% | 0.00% | 0.00 |
| E | 14.59% | 7.27% | 0.50 |
| NS1 | 10.38% | 9.09% | 0.88 |
| NS2A | 6.43% | 0.00% | 0.00 |
| NS2B | 3.83% | 4.55% | 1.19 |
| NS3 | 18.25% | 29.09% | 1.59 |
| NS4A | 3.74% | 2.73% | 0.73 |
| 2K | 0.68% | 0.91% | 1.34 |
| NS4B | 7.34% | 4.55% | 0.62 |
| NS5 | 26.50% | 38.18% | 1.44 |

A protein that has a high conservation to size ratio was assumed to have high antigenic potential. NS3, NS5, NS2B, and anC proteins have high antigenic potential while others, particularly prM and NS2A, have low antigenic potential. The 2K protein was also predicted to have one immunofunctionally conserved block, but it was comparatively very small in size (23 amino acids), thus resulting in a high ratio.

Example 6

Summary of Conserved Norovirus Peptide Blocks

This example describes the identification of conserved norovirus peptide blocks using block entropy analysis.

Norovirus proteins were aligned in an MSA. The GenBank® accession numbers for the protein sequences used in the MSA are listed in FIG. 71. All blocks of 8, 9, 10, and 11-mer peptides found in the MSA of norovirus proteins were analyzed. For each block the block entropy and the number of peptides needed to cover 99% of a block were calculated, and the total number of peptides in each block was identified. The conservation for 8-mer, 9-mer, 10-mer, and 11-mer blocks is summarized in Table 5, which shows the total number of blocks that cover 99% of the sequences with 5 peptides or less, as well as the relative distribution of numbers of peptides in each block.

TABLE 5

Summary of Conserved Norovirus Peptide Blocks

| peptide length | total number of blocks | blocks with 99% coverage from <=5 peptides | Distribution of number of peptides in blocks | | | | |
|---|---|---|---|---|---|---|---|
| | | | 1 peptide | 2 peptides | 3 peptides | 4 peptides | 5 peptides |
| 8 | 2549 | 676 | 78 | 134 | 163 | 135 | 166 |
| 9 | 2548 | 571 | 61 | 99 | 144 | 113 | 154 |
| 10 | 2547 | 474 | 49 | 75 | 122 | 94 | 134 |
| 11 | 2446 | 391 | 38 | 59 | 103 | 79 | 112 |

Using the conservation thresholds defined in the Materials and Methods (Example 1), each protein was examined for conservation of blocks. The number of peptides required to "cover 99% of the block" (i.e. to achieve a cumulative fraction of polypeptides in the MSA, by adding together each unique peptide's frequency within the polypeptides in the MSA, of 99%) for each position in the proteome (i.e. starting position of each block) is shown in FIG. 51 and FIG. 52. The peptides from blocks identified as conserved were assembled in peptide strings for 8-mers, 9-mers, 10-mers and 11-mers (FIG. 53).

Sequence and Epitope Data

The Immune Epitope Database (IEDB) was searched for known norovirus MHC class I binders, however, no experimentally validated norovirus MHC class I binders are published in the IEDB. For the block entropy analysis complete norovirus protein sequences were used as well as protein fragment sequences extracted from GenPept. These sequences were aligned using MAFFT. Only a small fraction (roughly 40%) of the retrieved polyprotein sequences from NCBI was annotated into their protein products. The remaining proteins were annotated using annotation from GenPept reference sequences within the MAFFT alignments. The numbers of sequences classified by protein and serotype are listed in Table 6, below:

TABLE 6

Norovirus sequence data

| Protein | GI | GII | GIV | unspecified human pathogen | total |
|---|---|---|---|---|---|
| p48 | 5 | 220 | 0 | 13 | 238 |
| NTPase | 25 | 225 | 0 | 16 | 266 |
| p22 | 16 | 225 | 0 | 15 | 256 |
| VPg | 17 | 224 | 0 | 16 | 257 |
| PRO | 27 | 225 | 0 | 16 | 268 |
| POL | 416 | 1593 | 24 | 837 | 2870 |
| VP1 | 1031 | 2158 | 20 | 757 | 3966 |
| VP2 | 41 | 306 | 1 | 22 | 370 |
| Total | 1578 | 5176 | 45 | 1692 | 8491 |

Binding affinity was predicted for each peptide in blocks of conserved 9-mer norovirus peptides using NetMHC 3.2 software, as described in the Materials and Methods section (Example 1), above. The sequences of 186 peptides from 83 conserved blocks and the binding affinity ($IC_{50}$) to MHC class I molecules is shown in FIG. 65.

Example 7

Summary of Conserved Influenza Virus Peptide Blocks

This example describes the identification of conserved influenza virus peptide blocks using block entropy analysis.

Influenza virus proteins were aligned in an MSA. All blocks of 8, 9, 10, and 11-mer peptides found in the MSA of influenza virus proteins were analyzed. For each block the block entropy and the number of peptides needed to cover 99% of a block were calculated, and the total number of peptides in each block was identified. The conservation for 8-mer, 9-mer, 10-mer, and 11-mer blocks is summarized in Table 7, which shows the total number of blocks that cover 99% of the sequences with 5 peptides or less, as well as the relative distribution of numbers of peptides in each block.

Figures 1, 73:
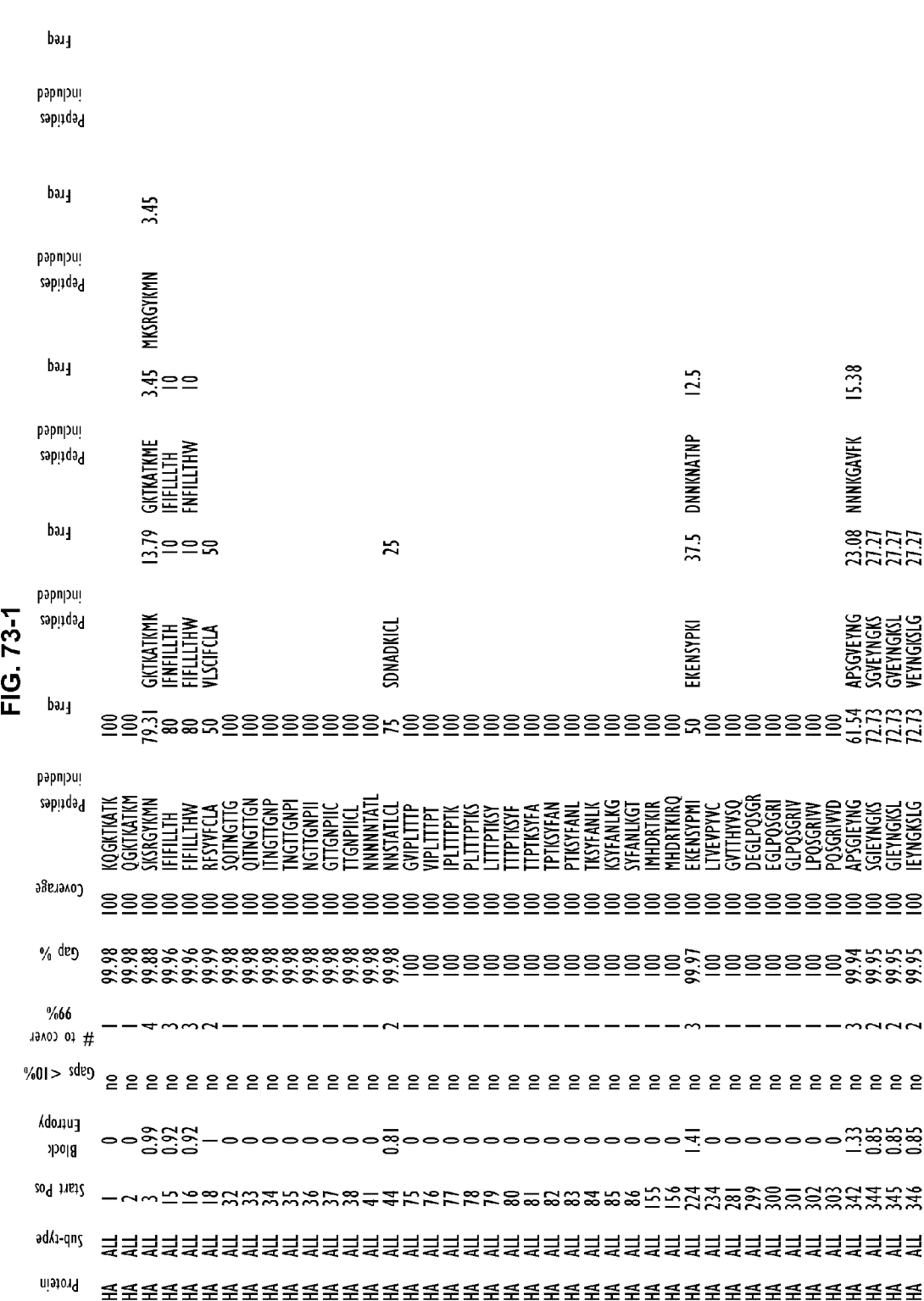
Figures 3, 73:
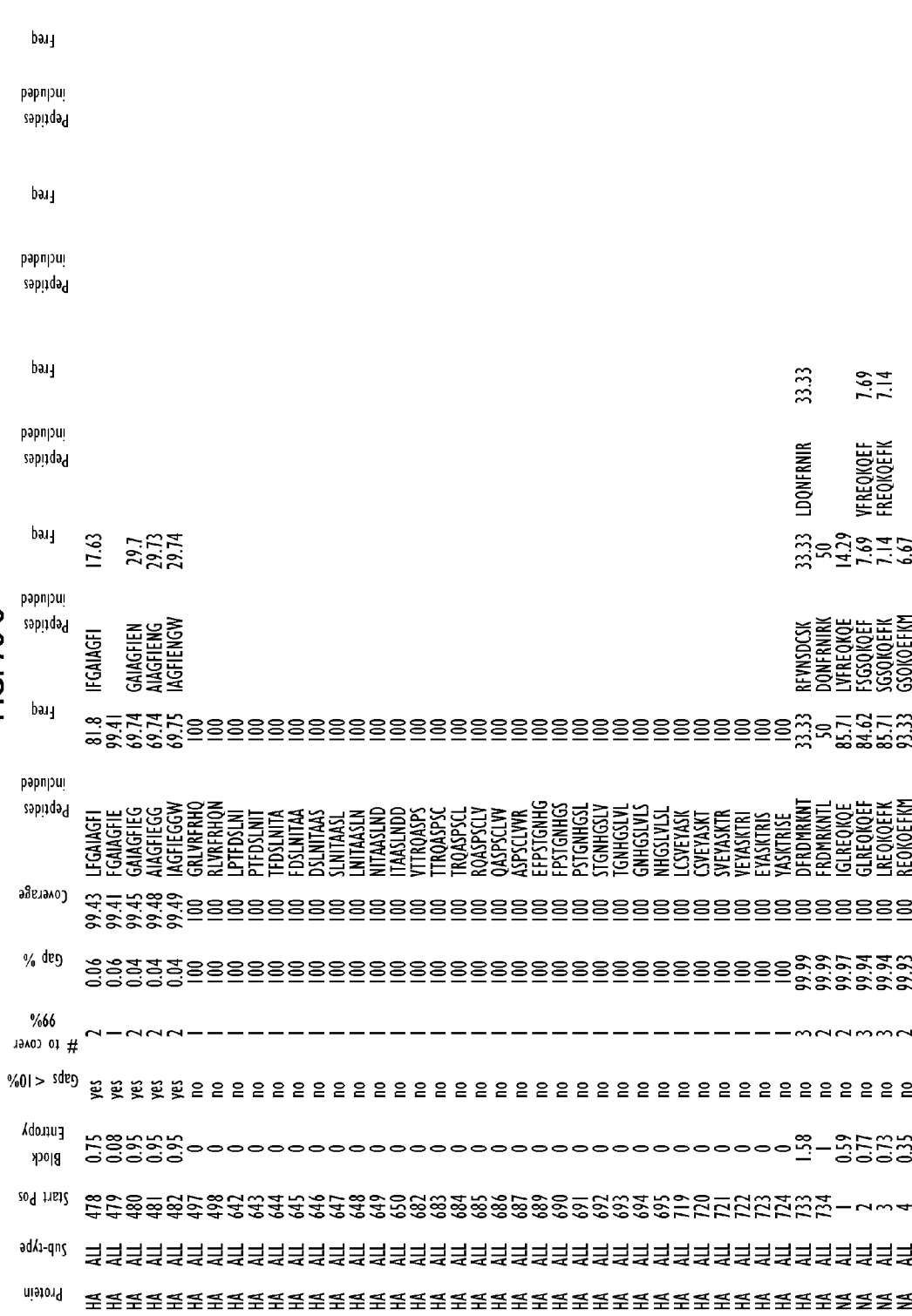
Figures 17, 73:
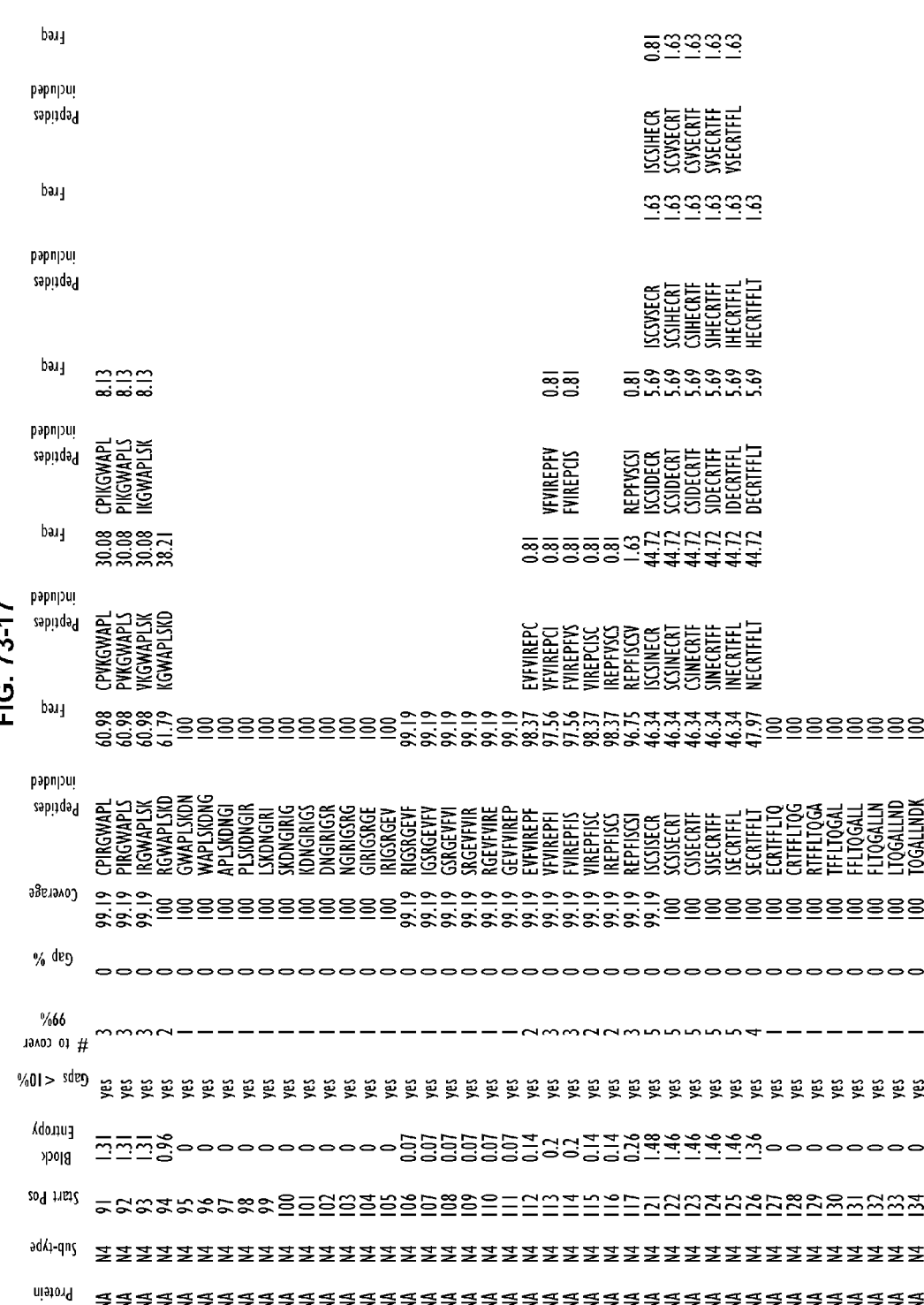
Figures 22, 73:
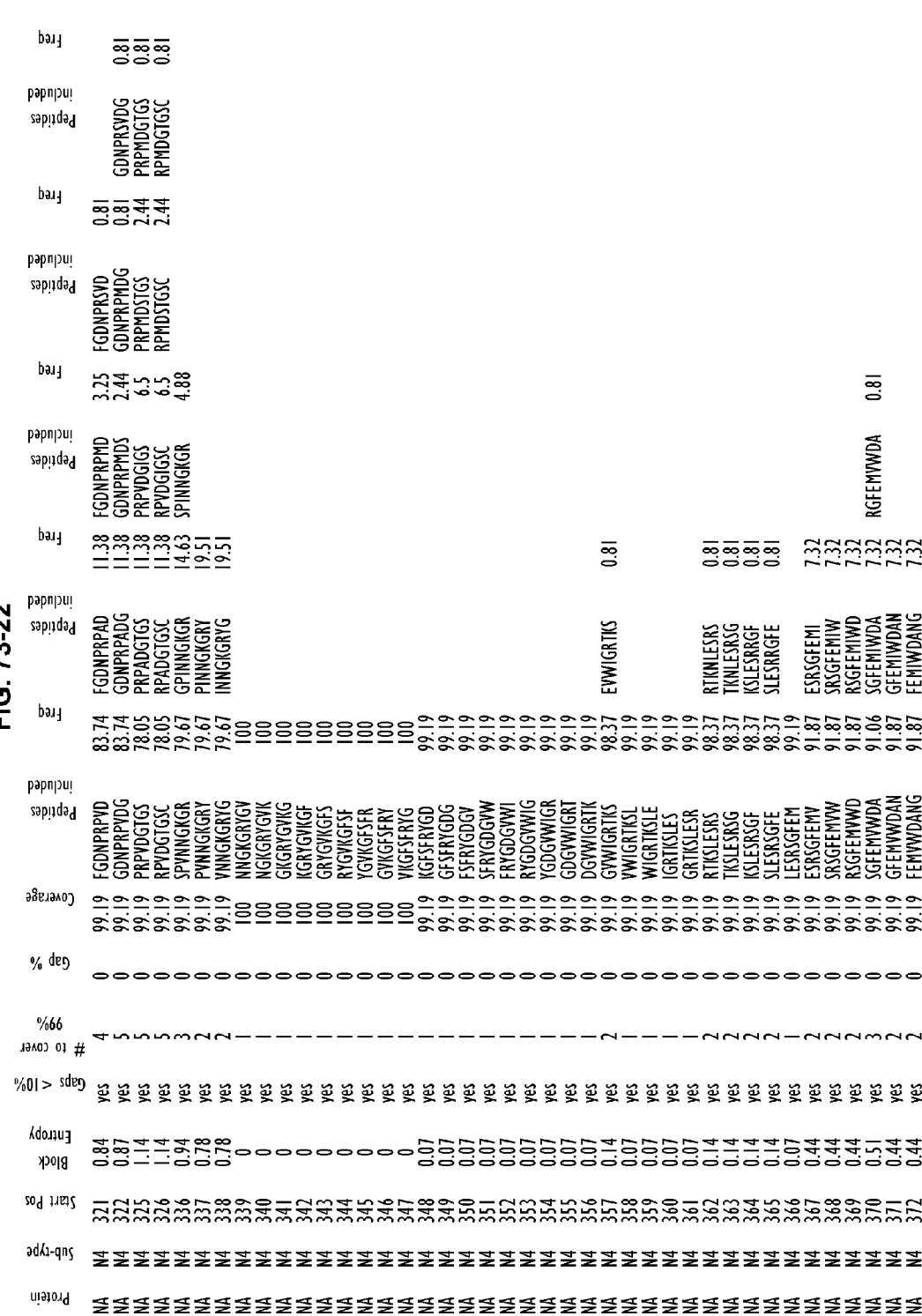
Figures 27, 73:
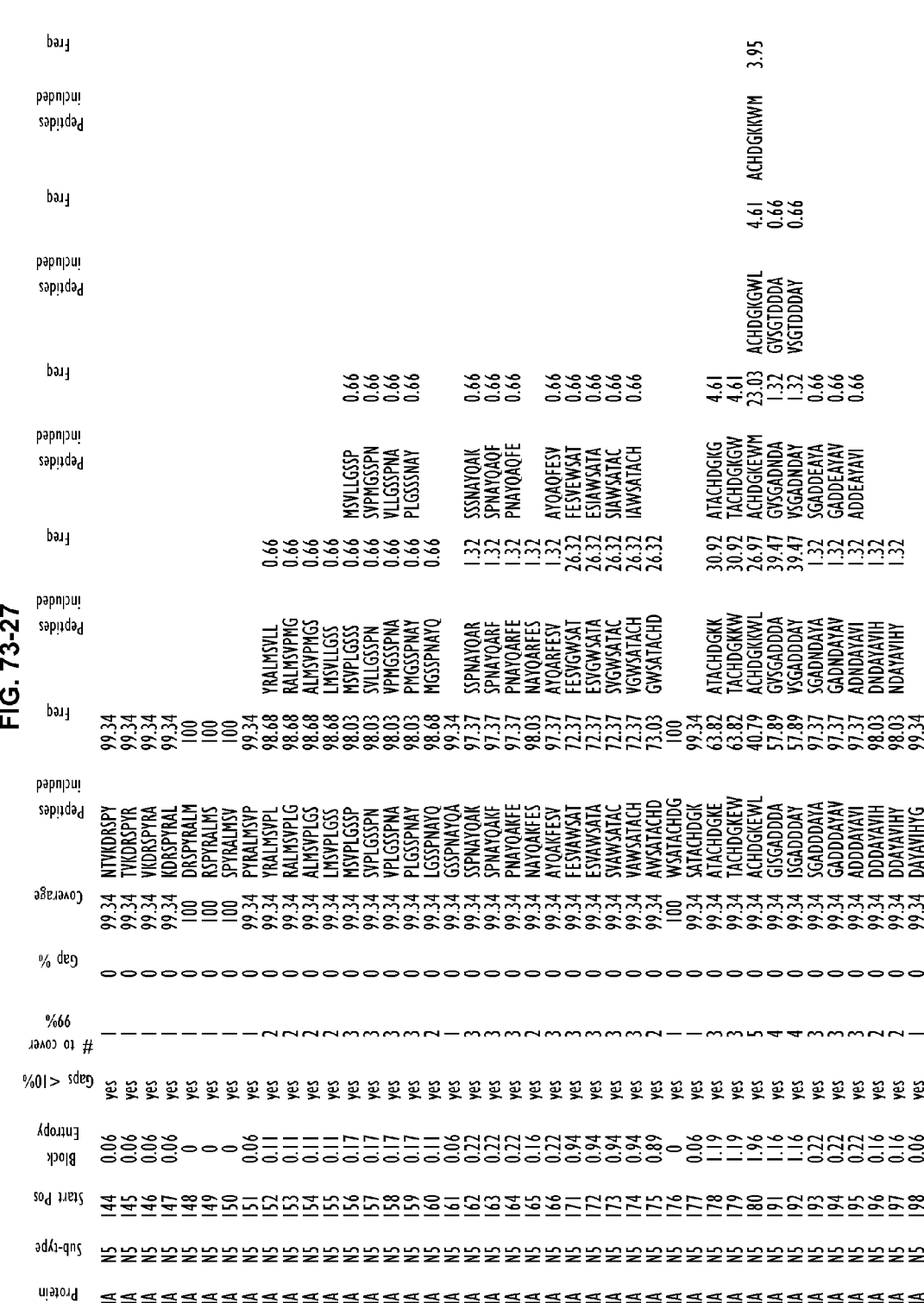
Figures 31, 73:
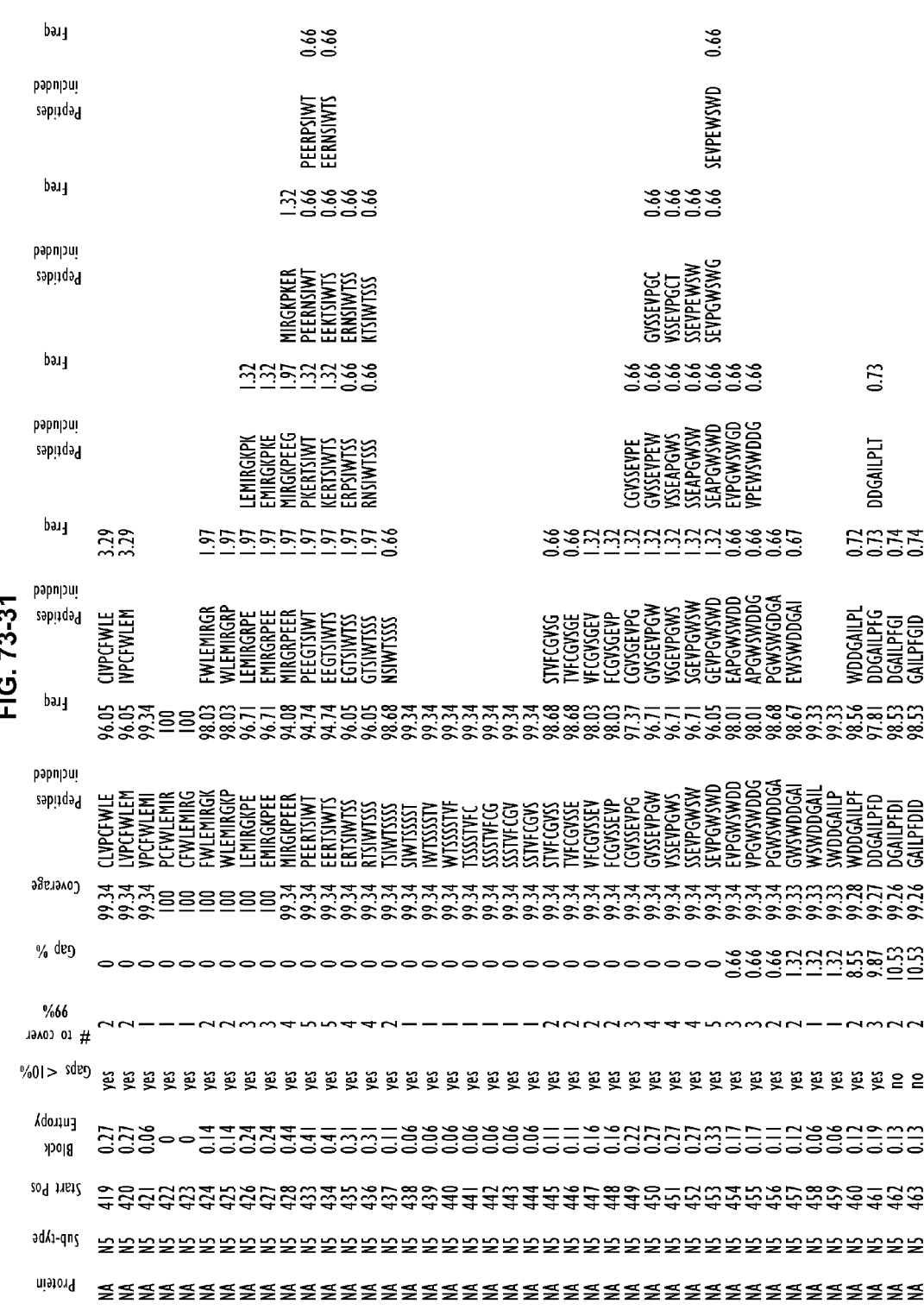
Figures 49, 73:
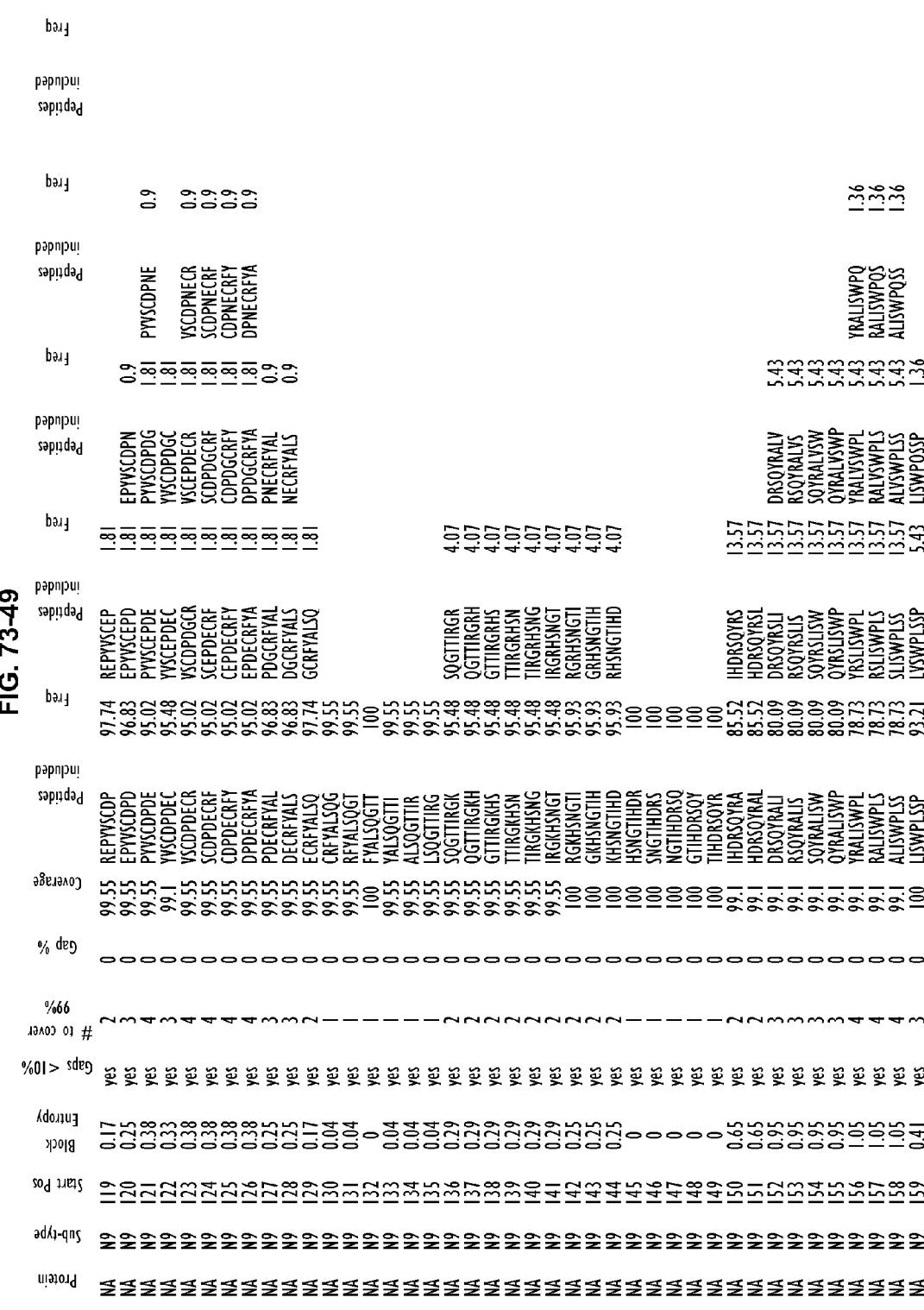
Figures 68, 73:
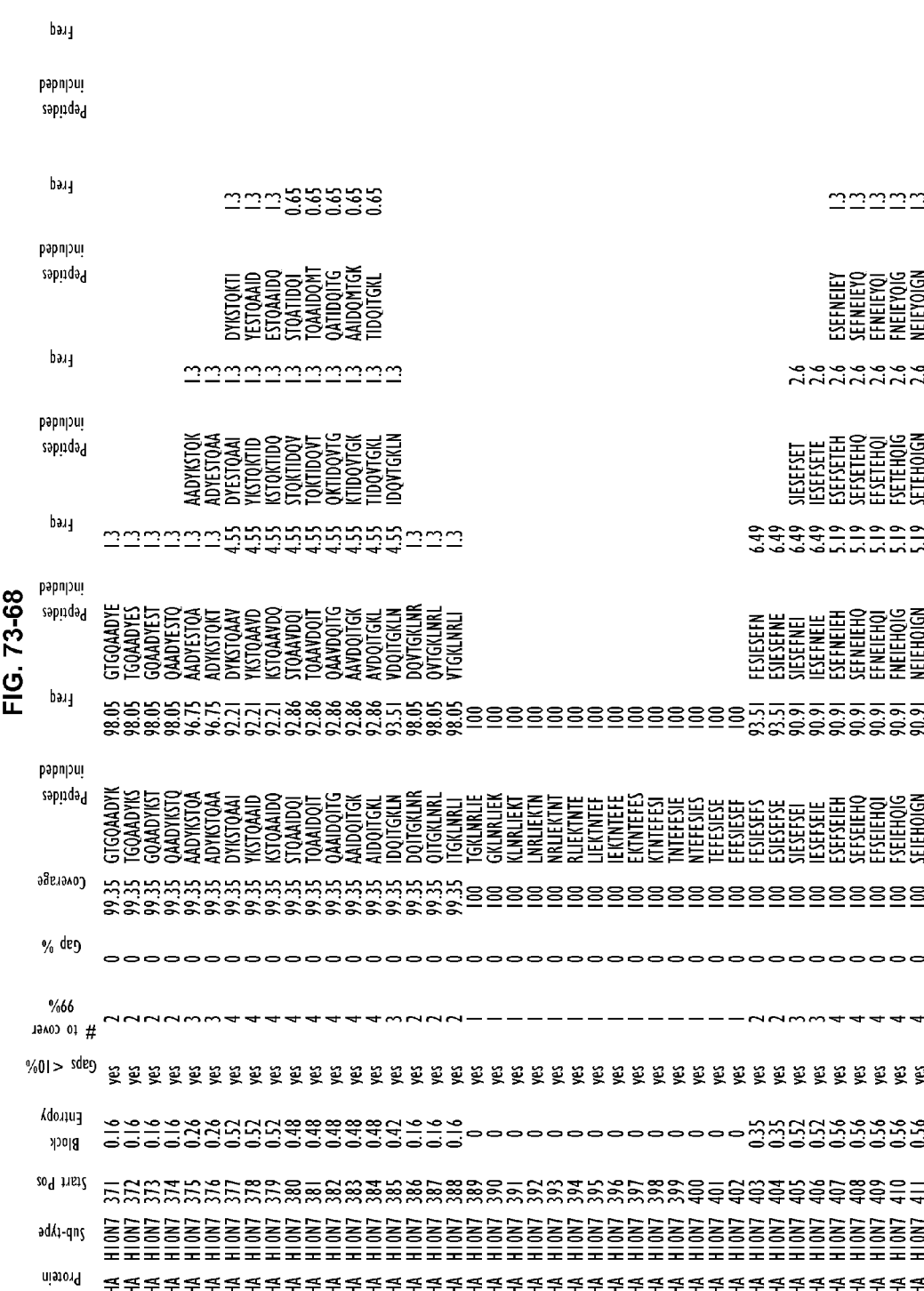
Figures 69, 73:
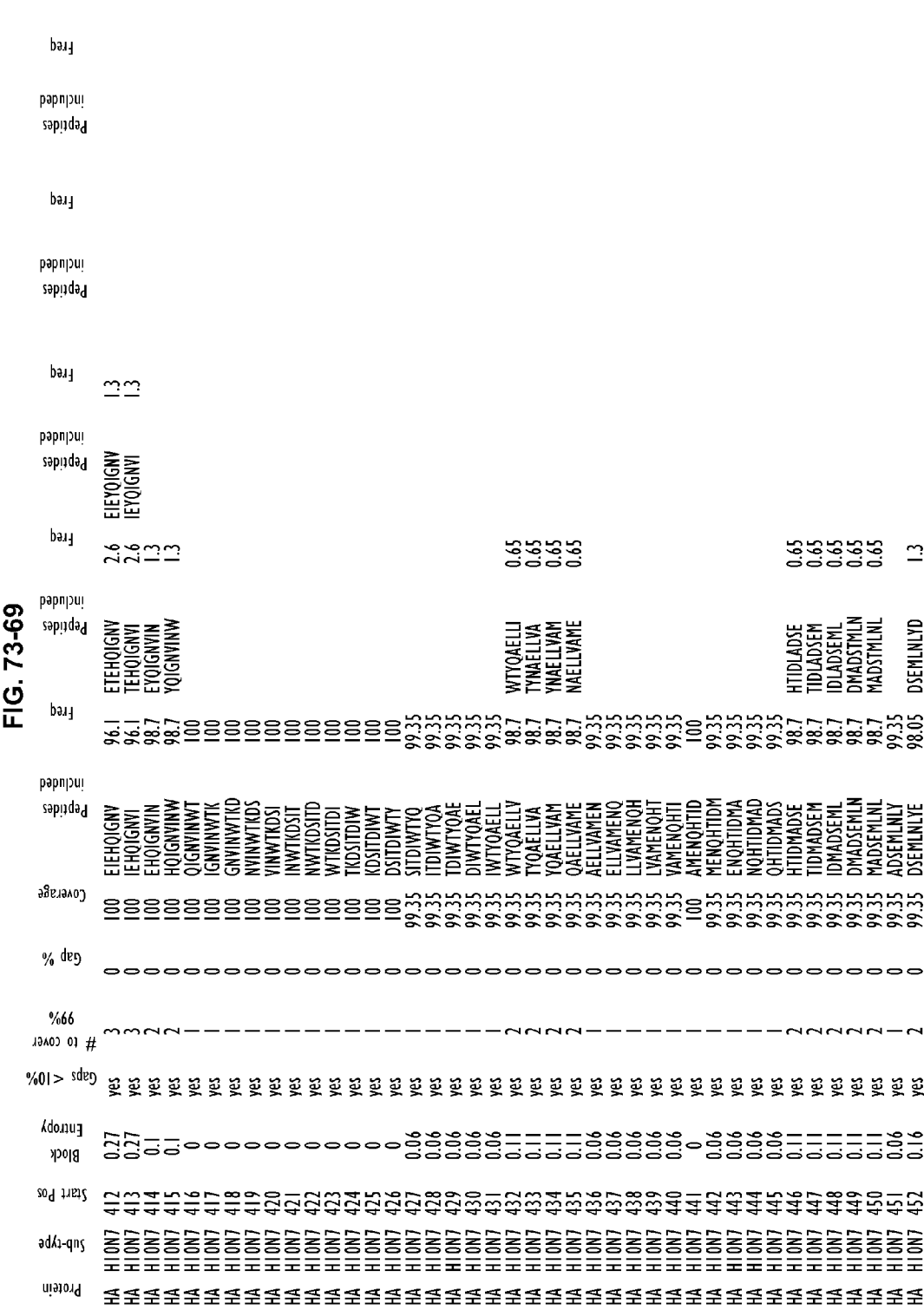
Figures 71, 73:
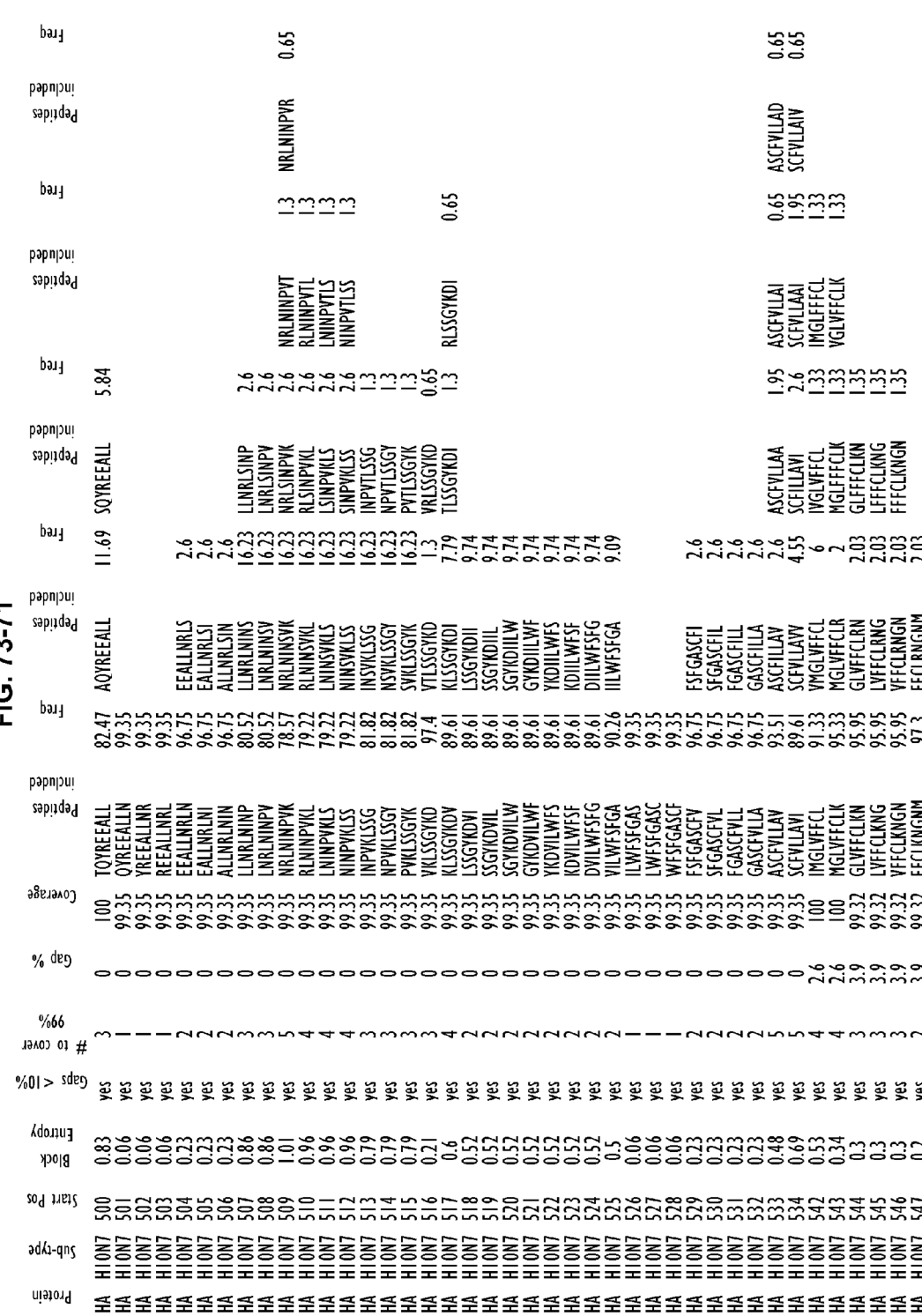
Figures 73, 74:
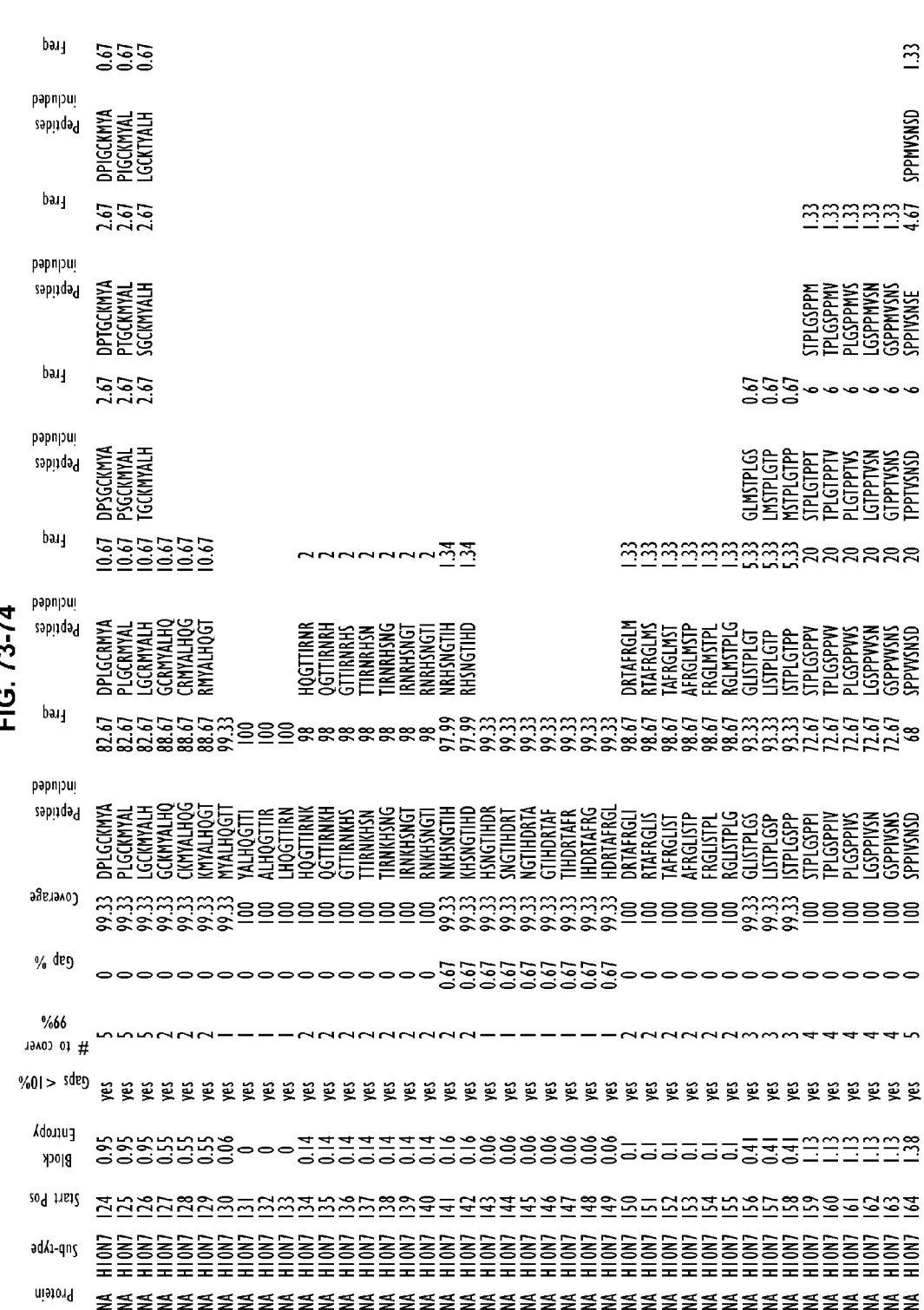
Figures 73, 74, 75:
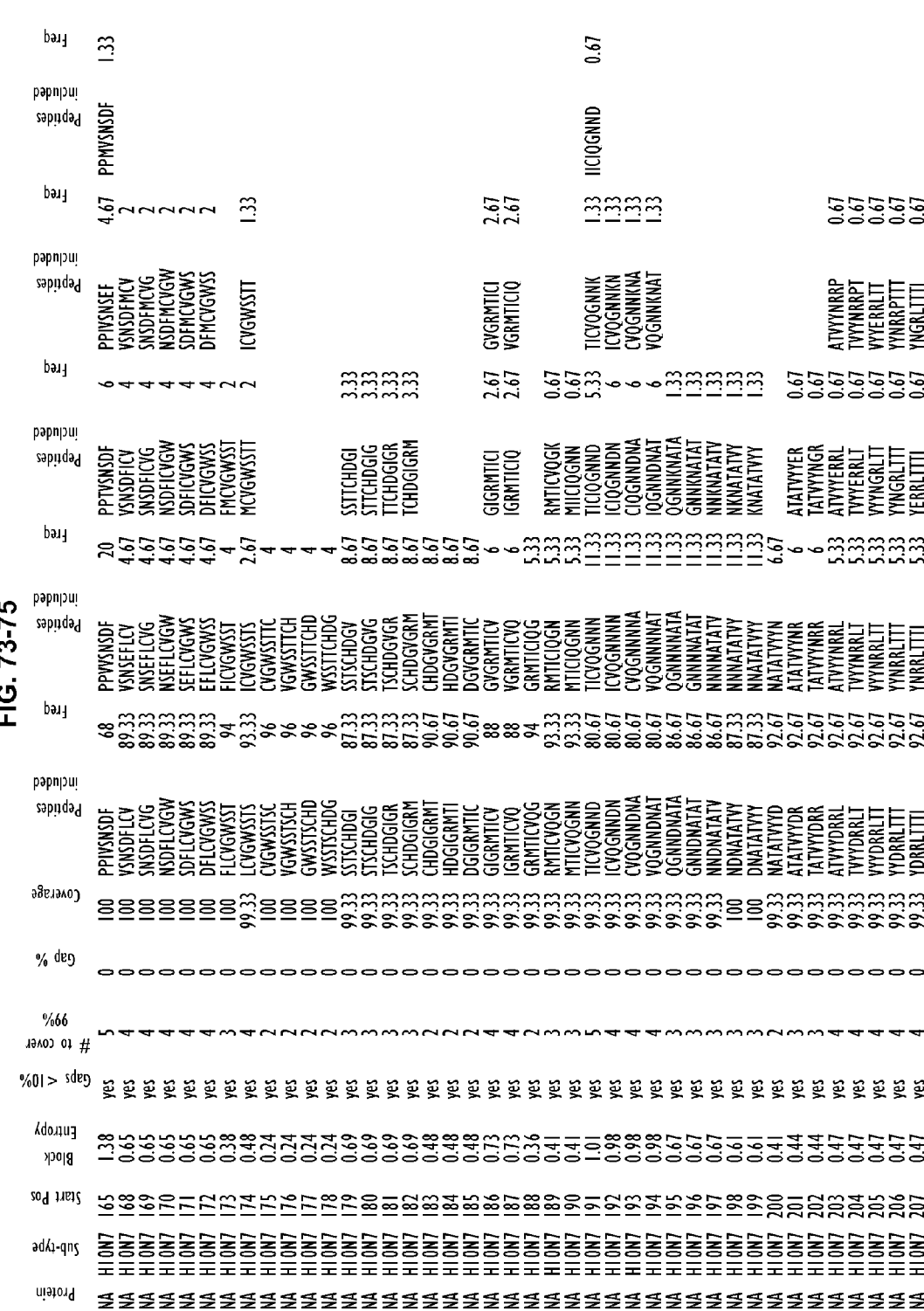
Figures 73, 74, 75, 76:
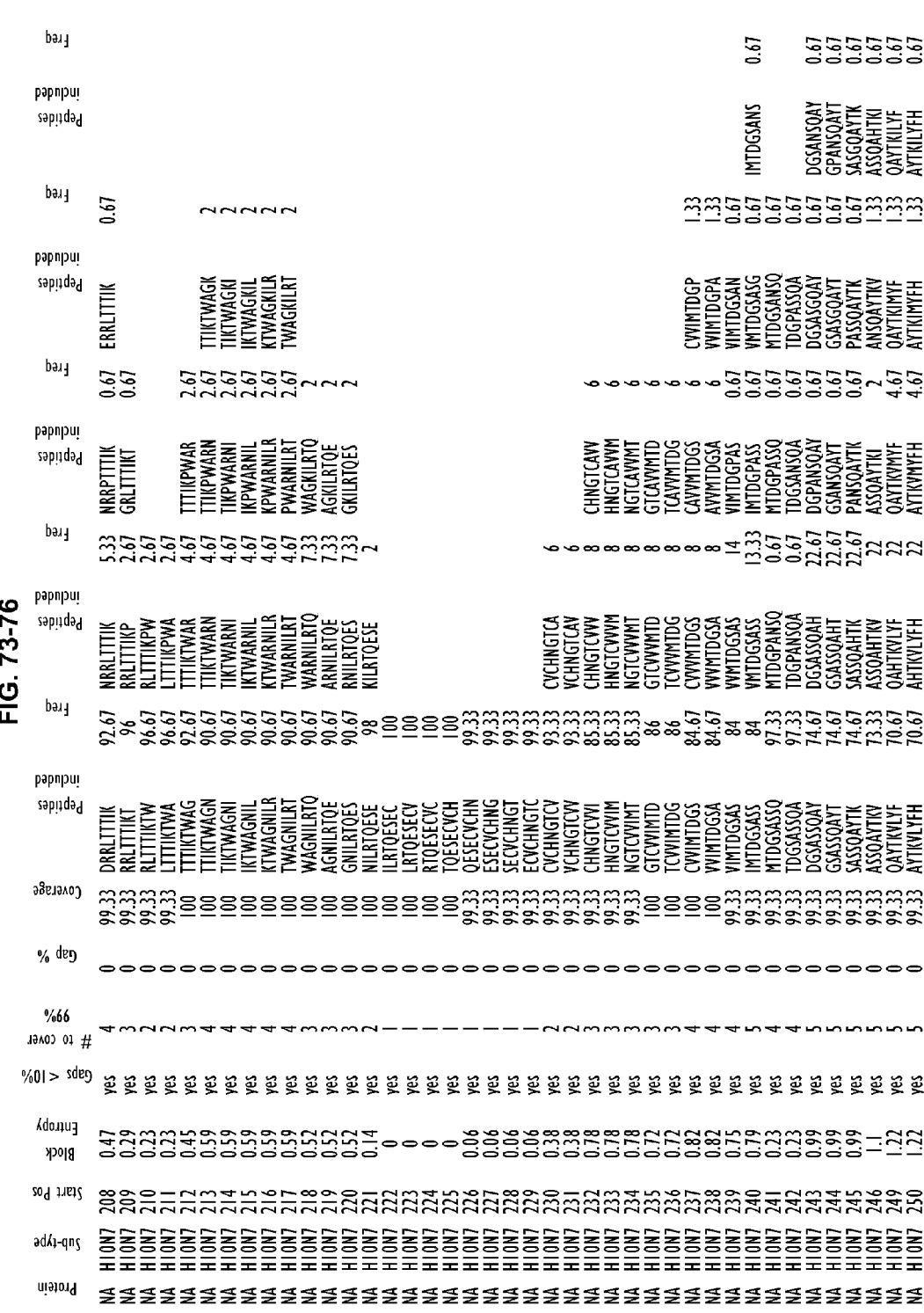
Figures 73, 74, 75, 76, 77, 78, 79, 80, 81, 82, 83, 84, 85, 86, 87, 88:
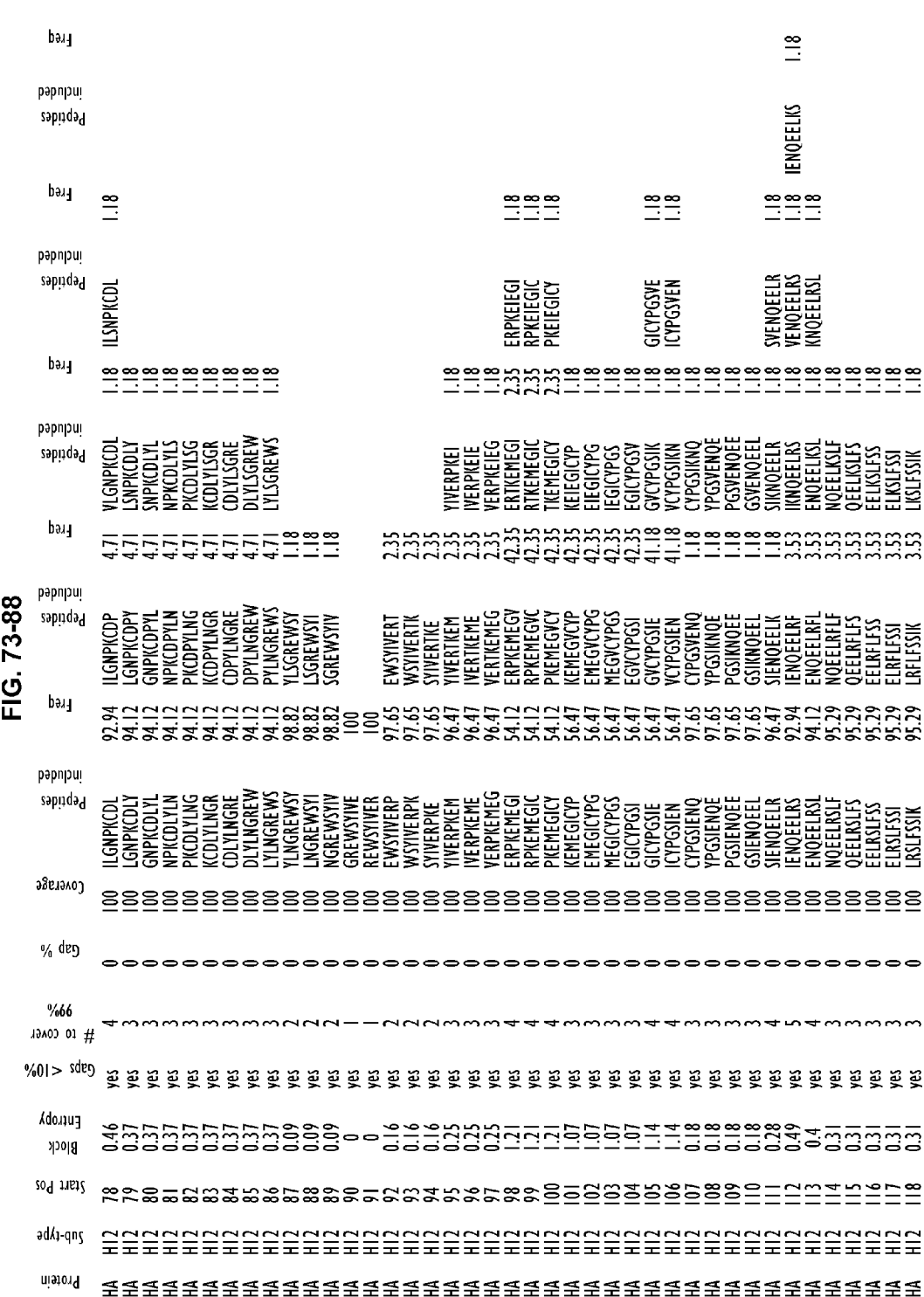
Figures 73, 74, 75, 76, 77, 78, 79, 80, 81, 82, 83, 84, 85, 86, 87, 88, 89:
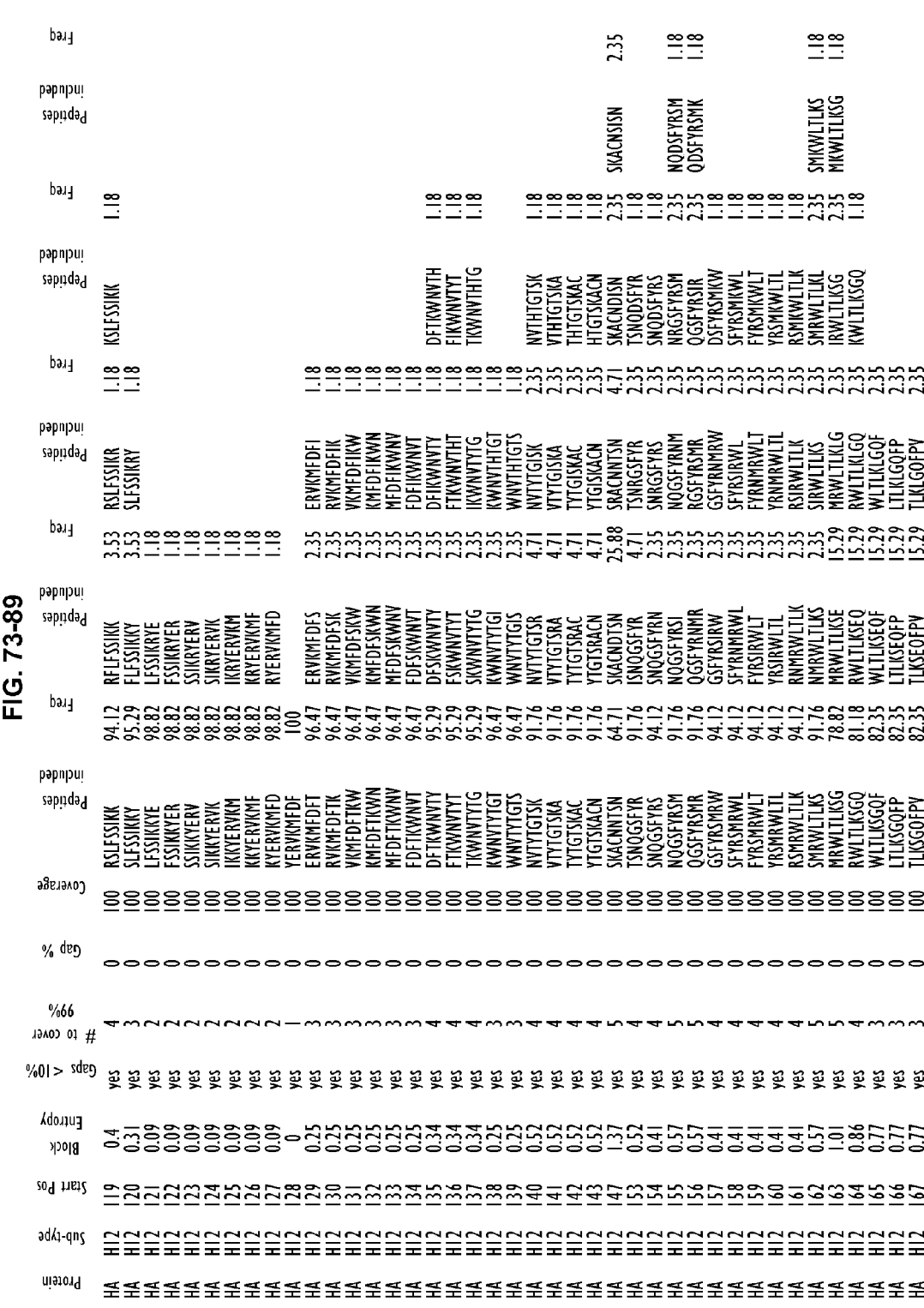
Figures 73, 74, 75, 76, 77, 78, 79, 80, 81, 82, 83, 84, 85, 86, 87, 88, 89, 90, 91, 92, 93, 94, 95, 96:
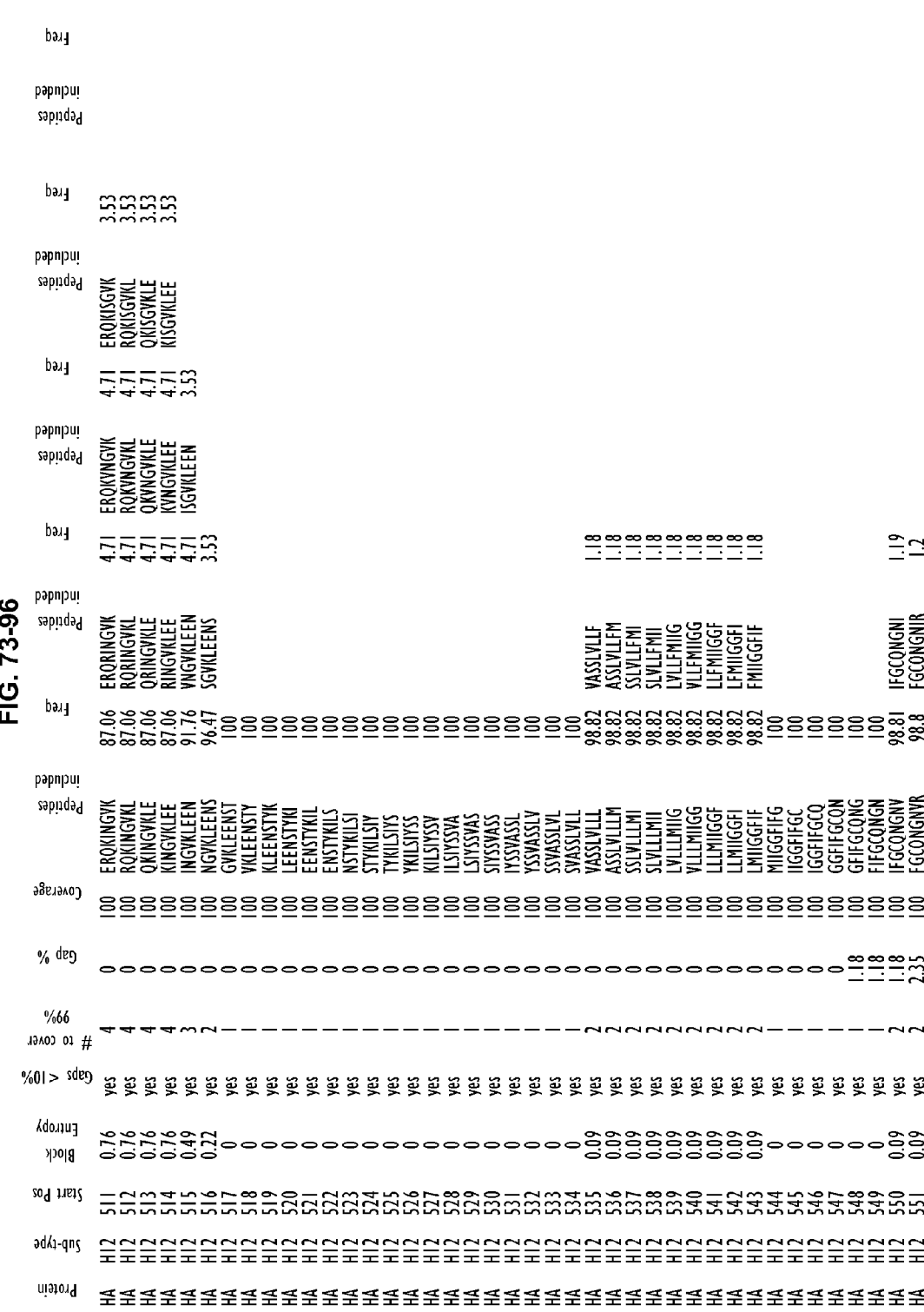
Figures 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113:
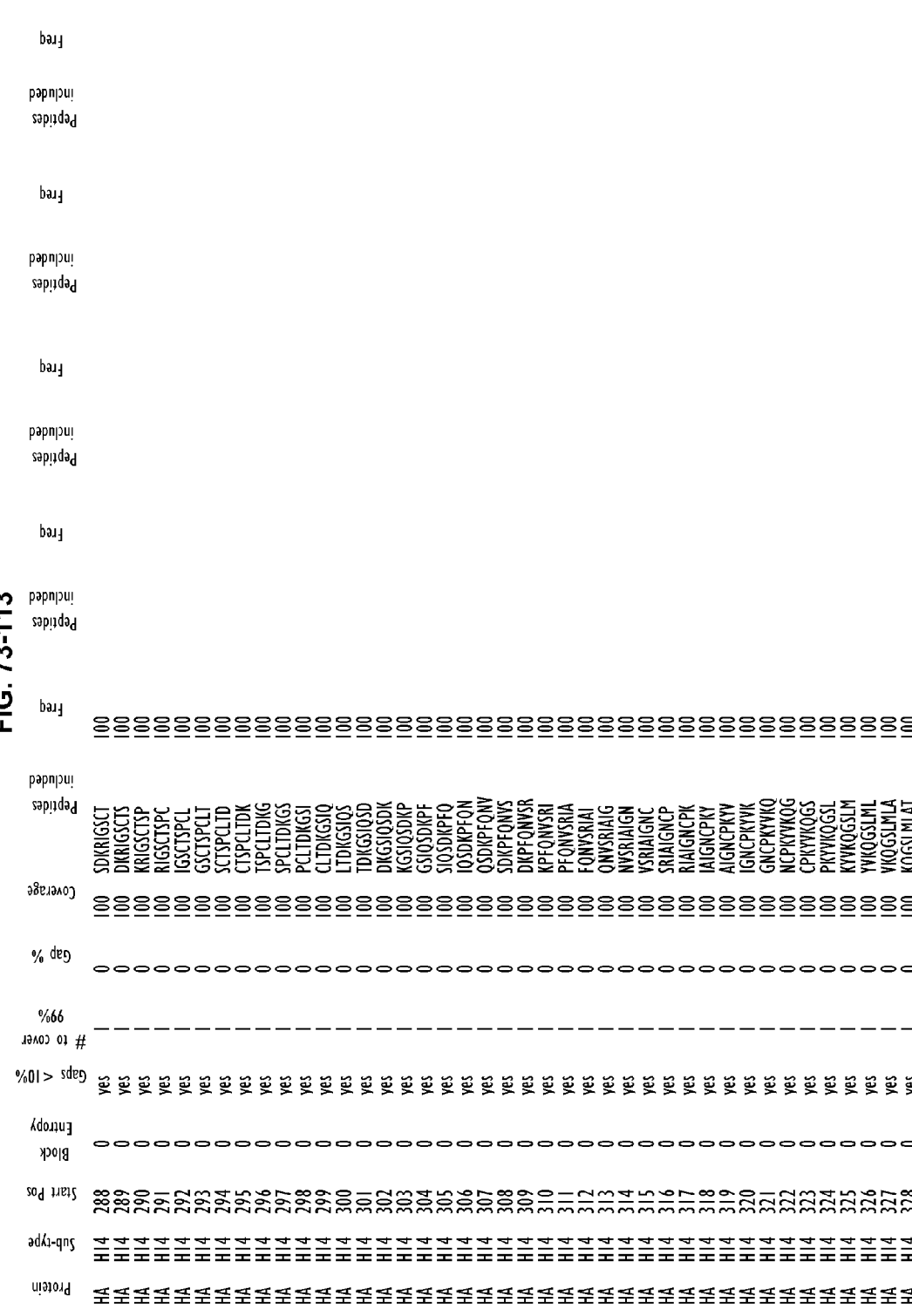
Figures 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119:
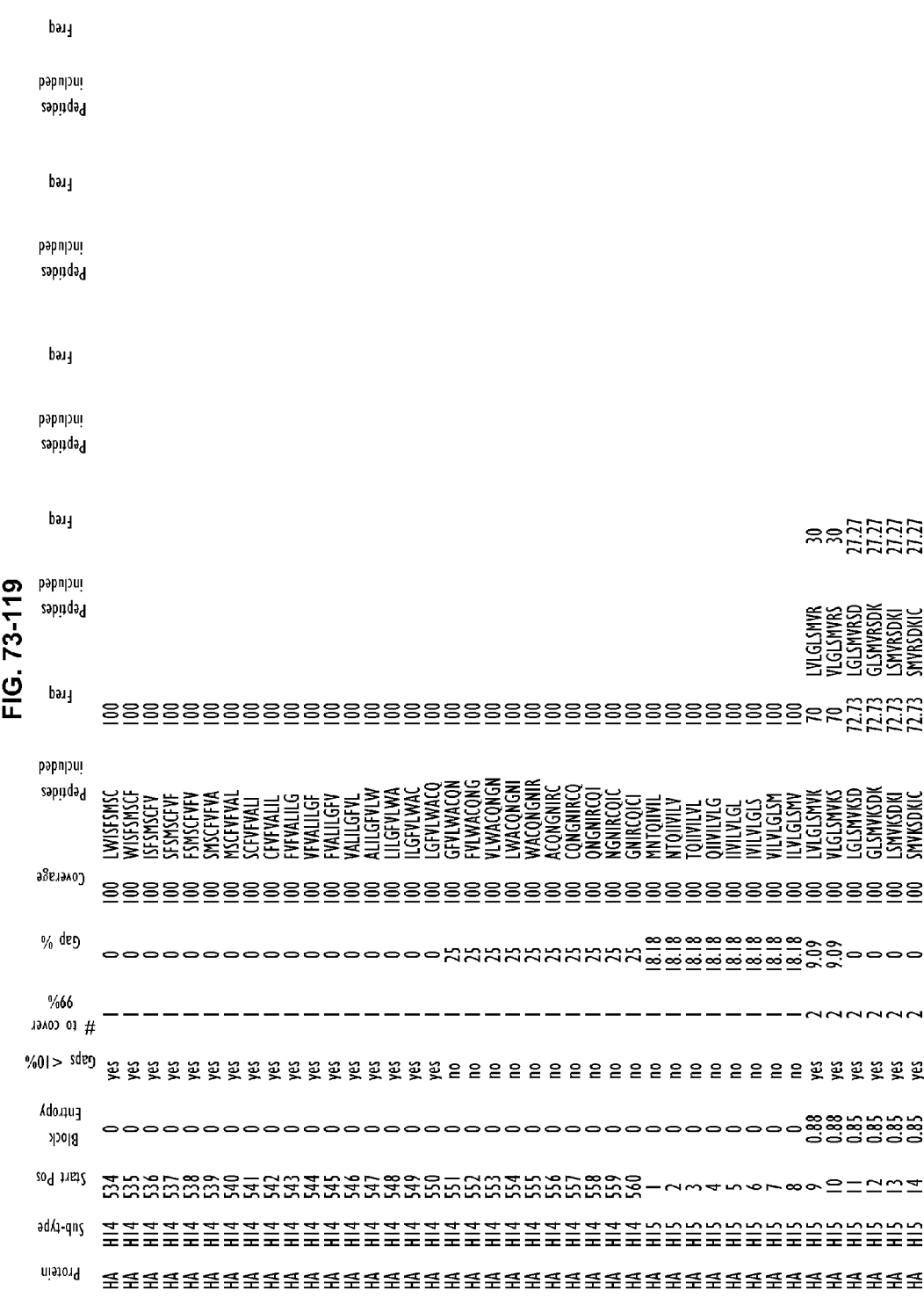
Figures 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123:
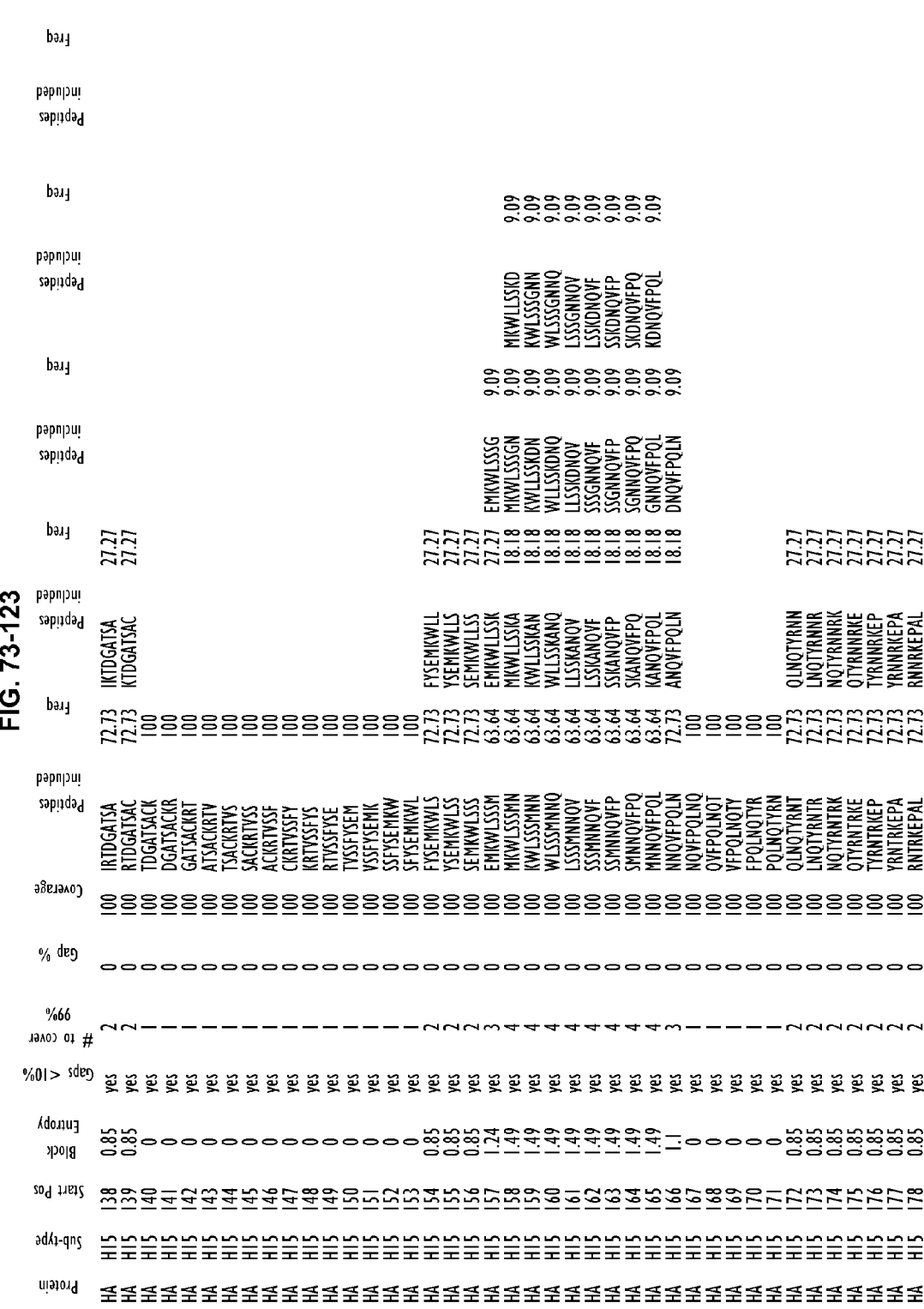
Figures 73, 127:
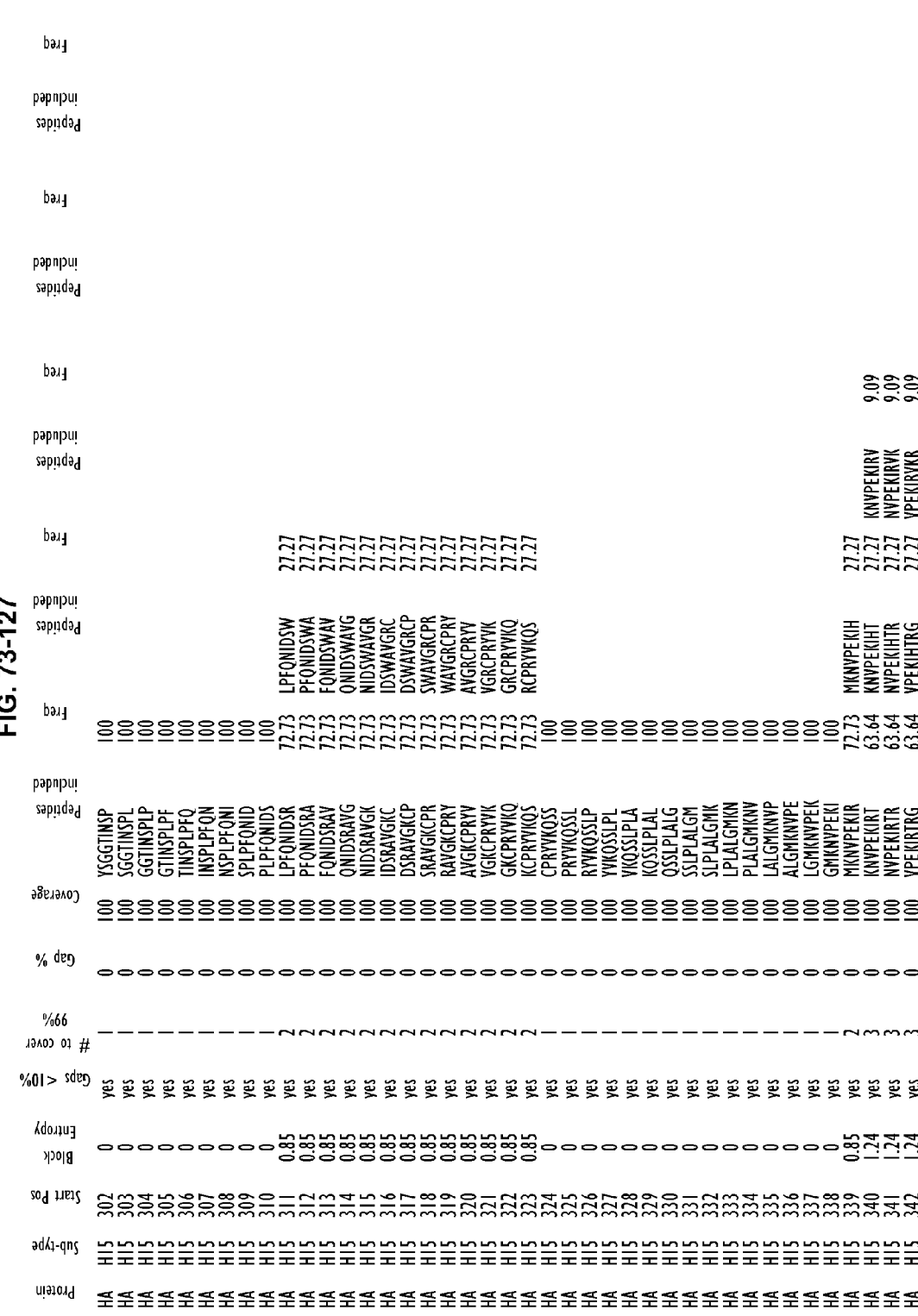
Figures 73, 137:
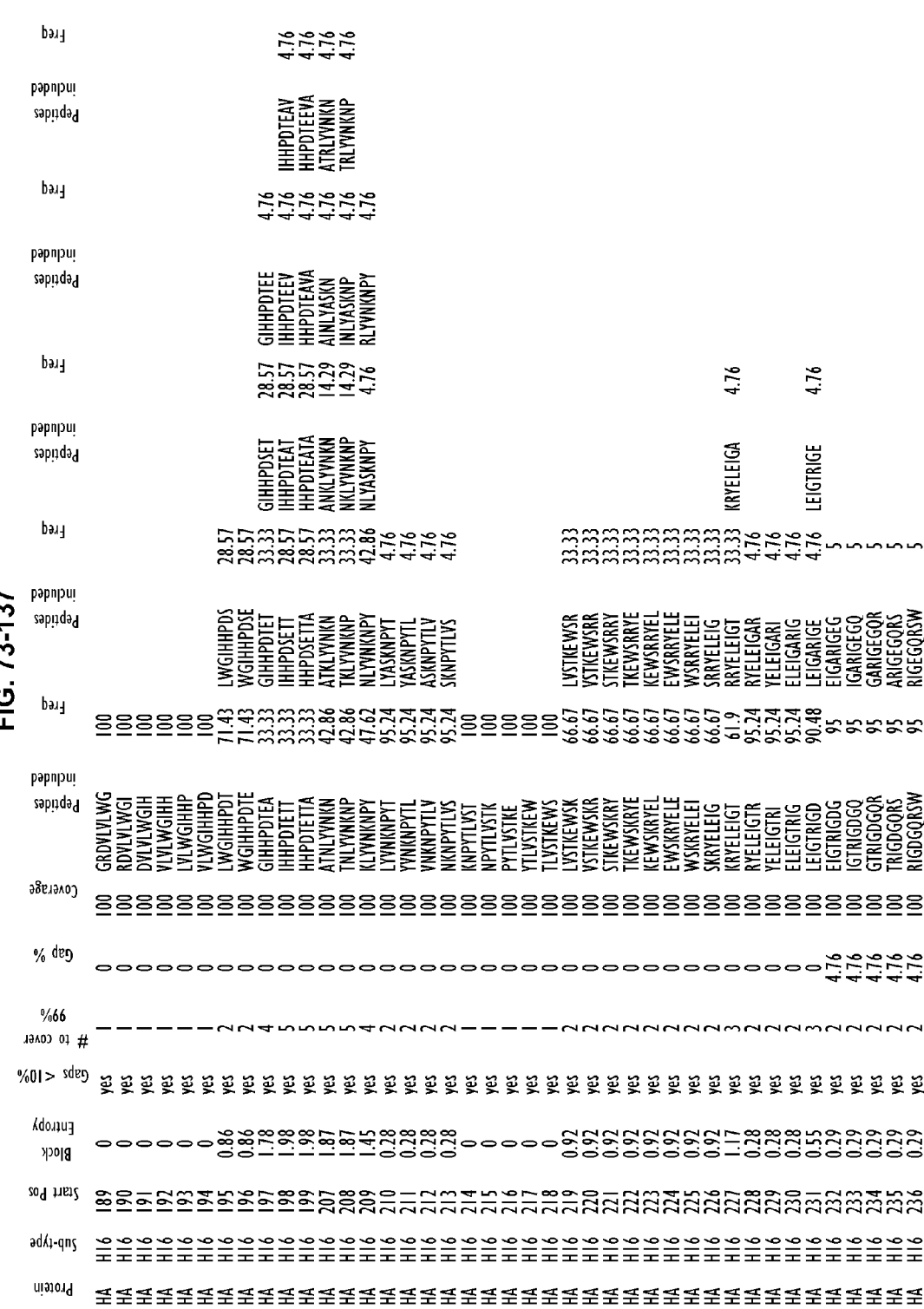
Figures 73, 141:
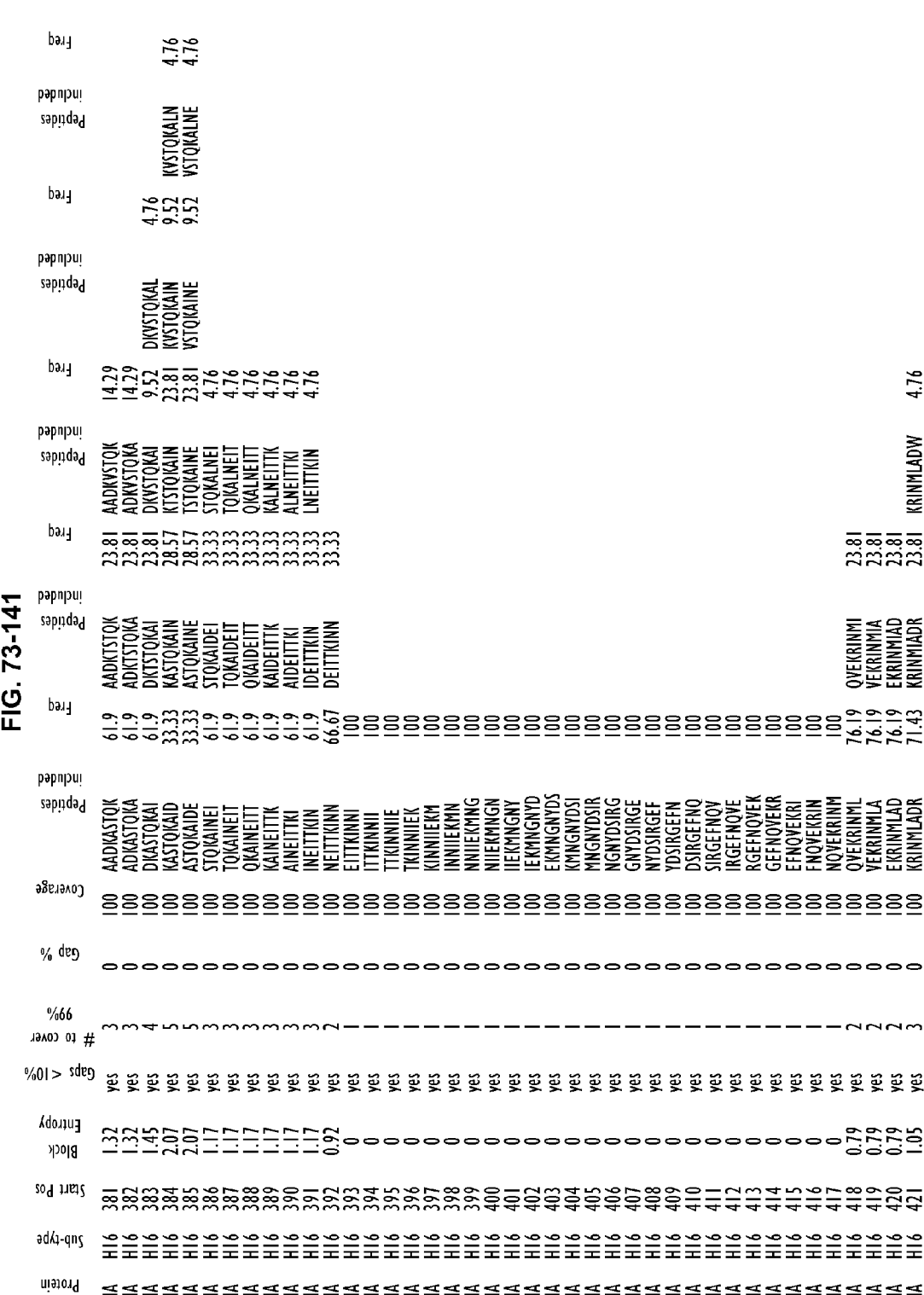
Figures 73, 206:
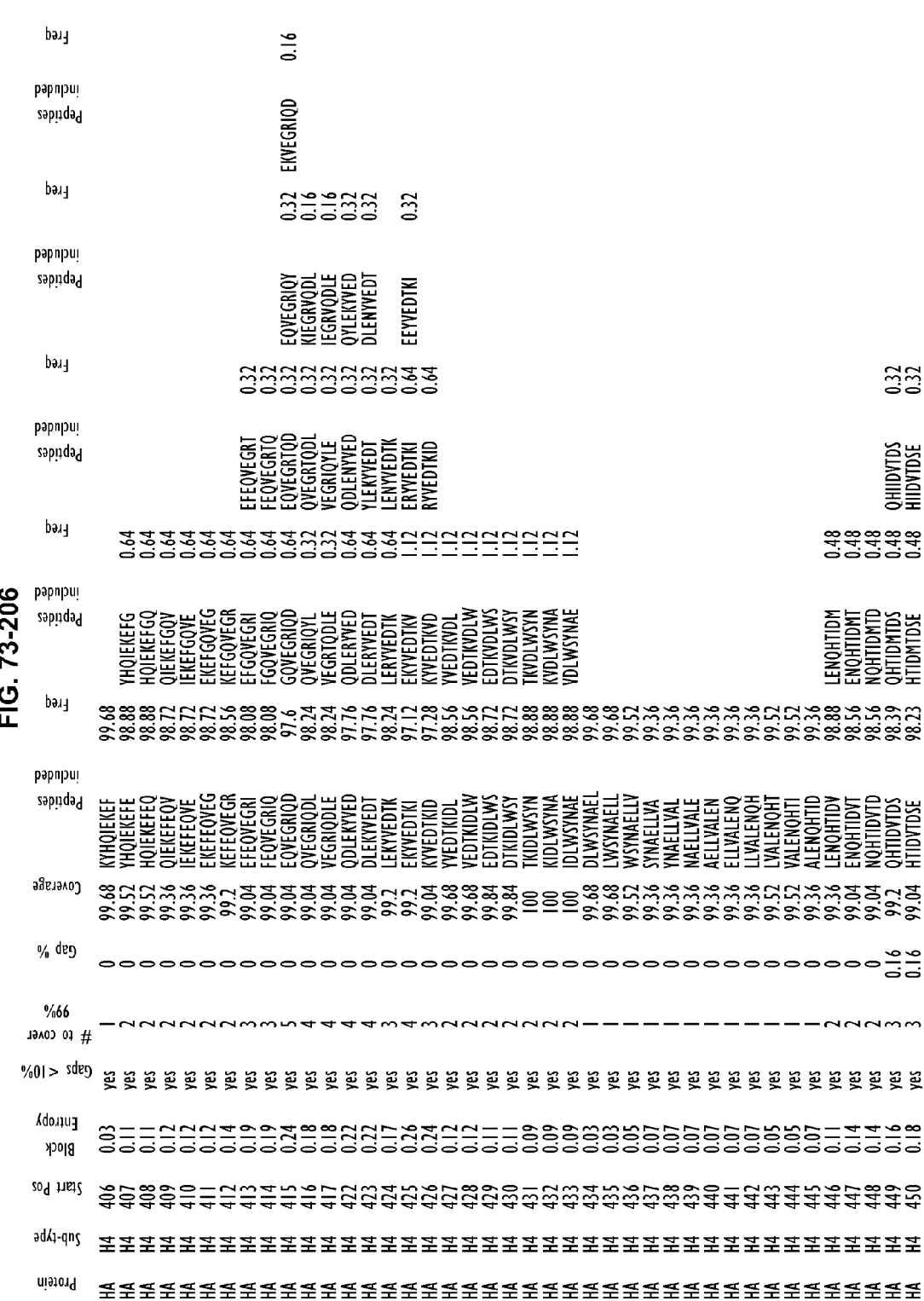
Figures 73, 218:
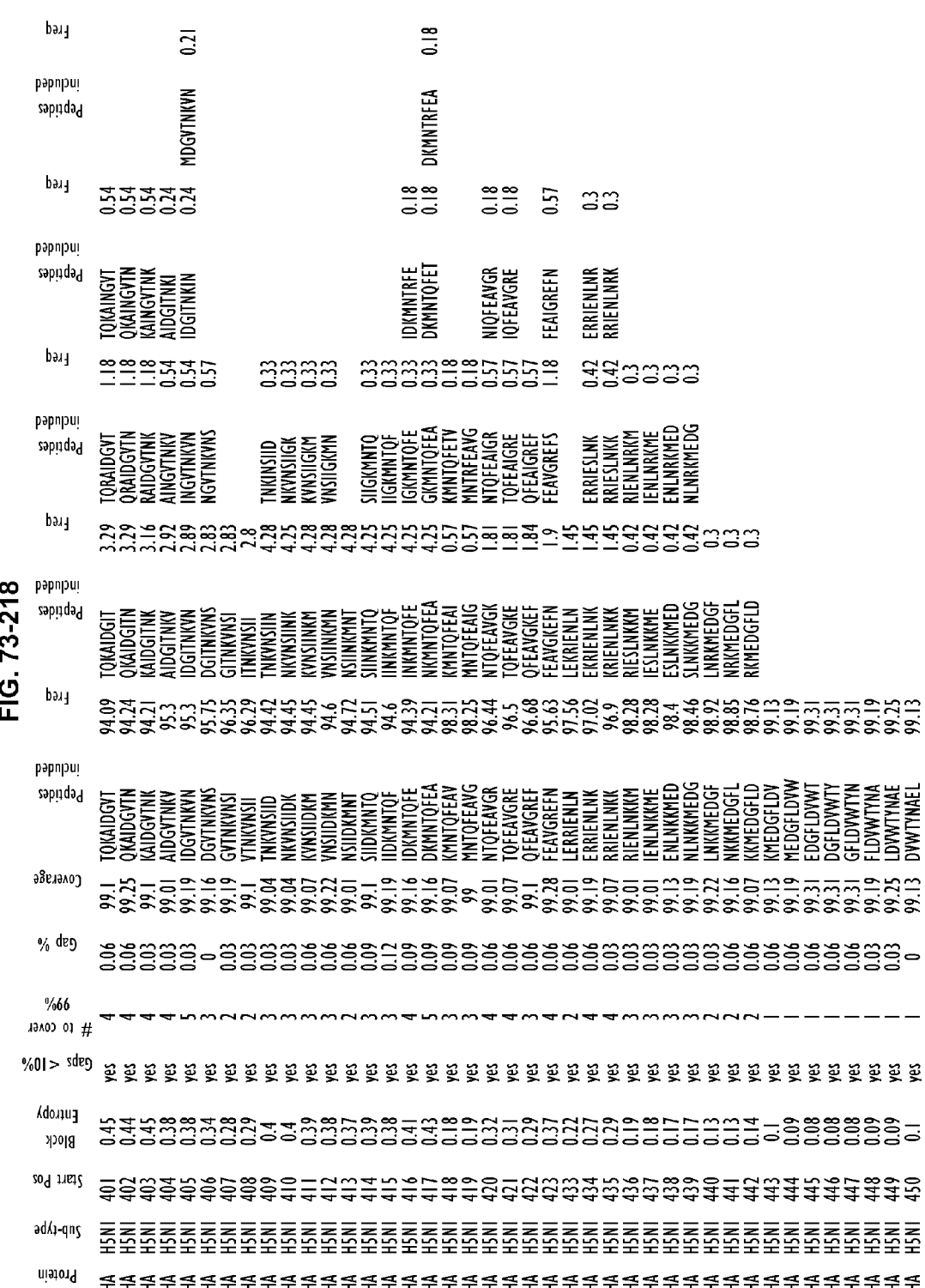
Figures 73, 219:
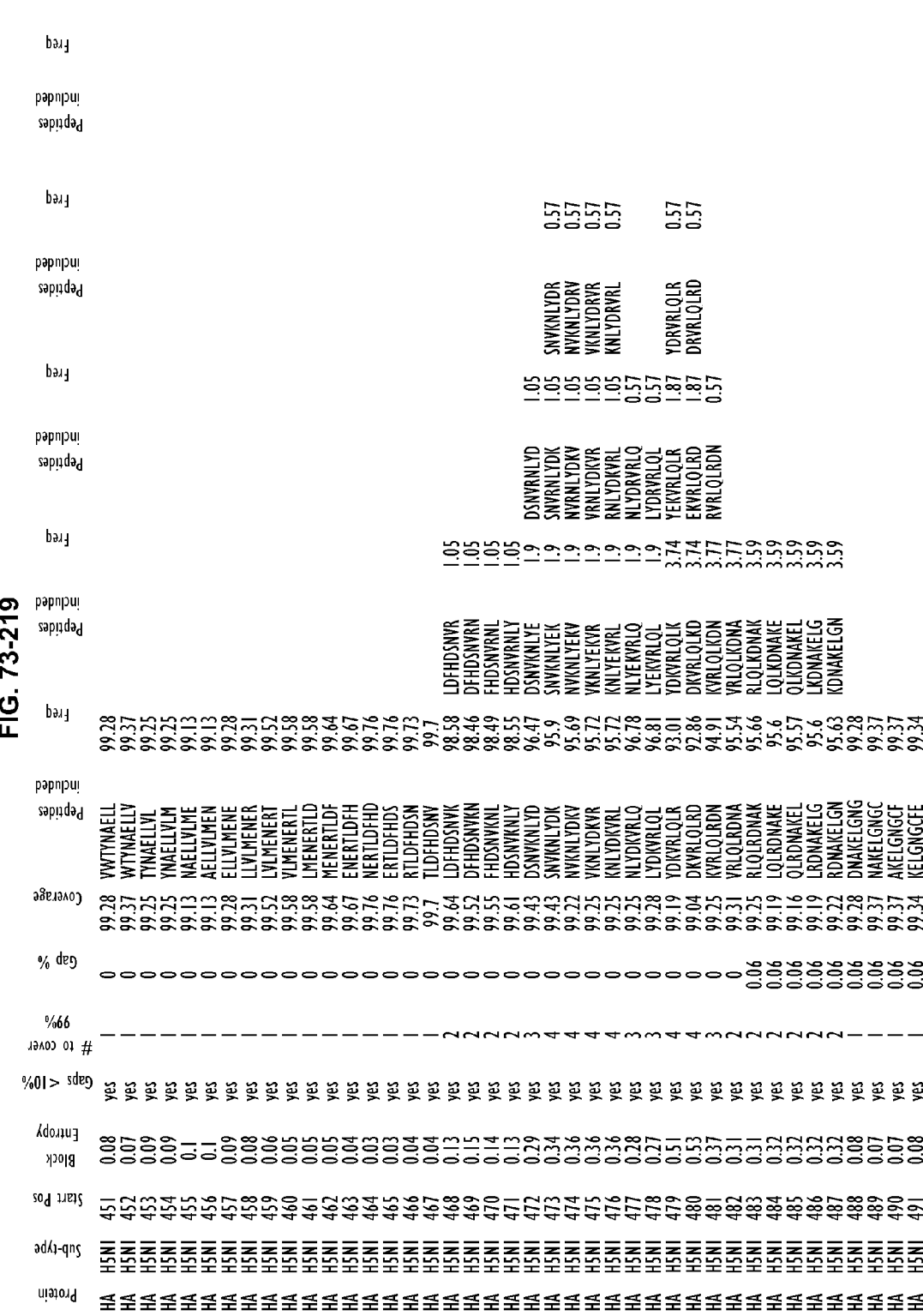
Figures 73, 247:
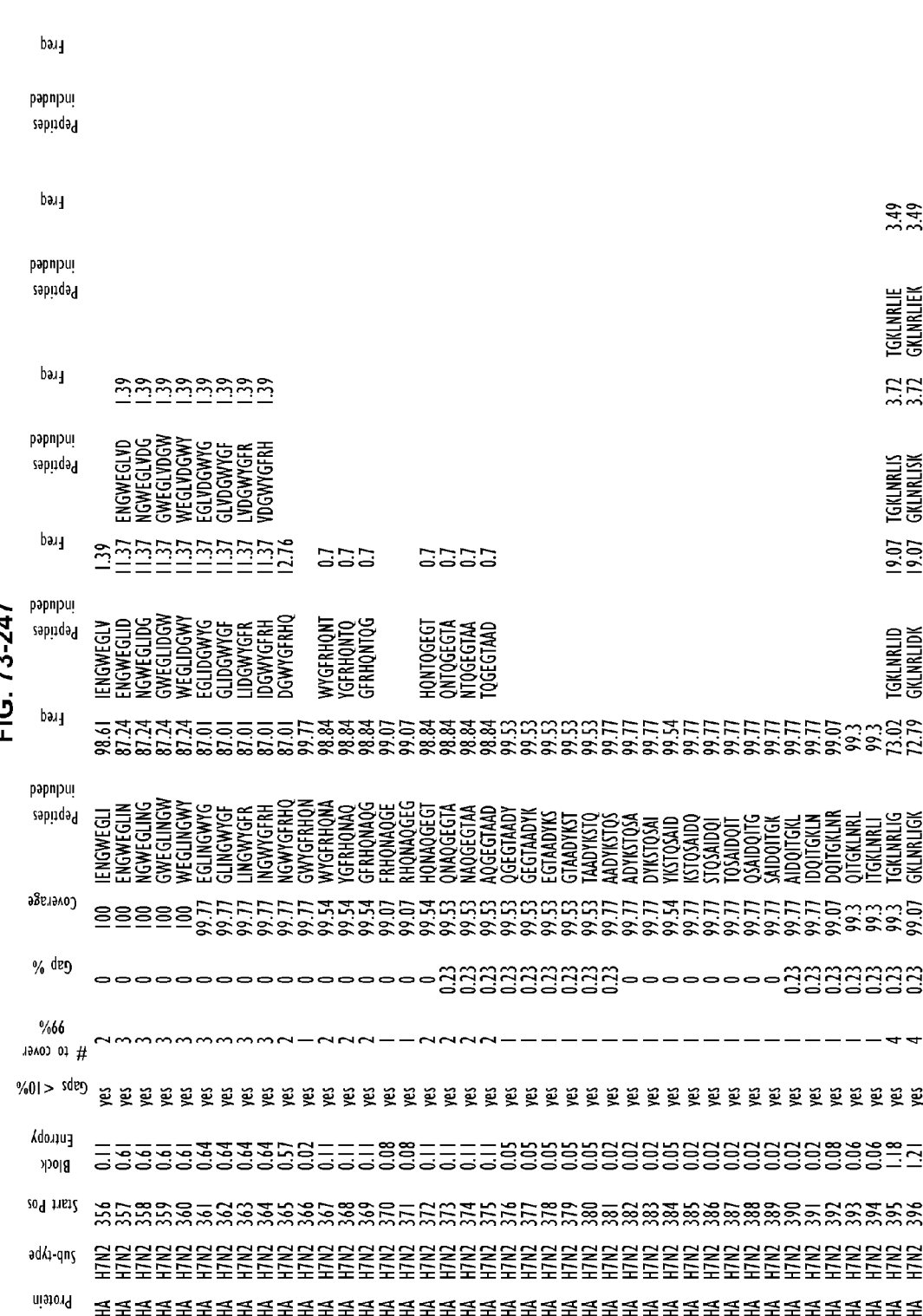
Figures 73, 254:
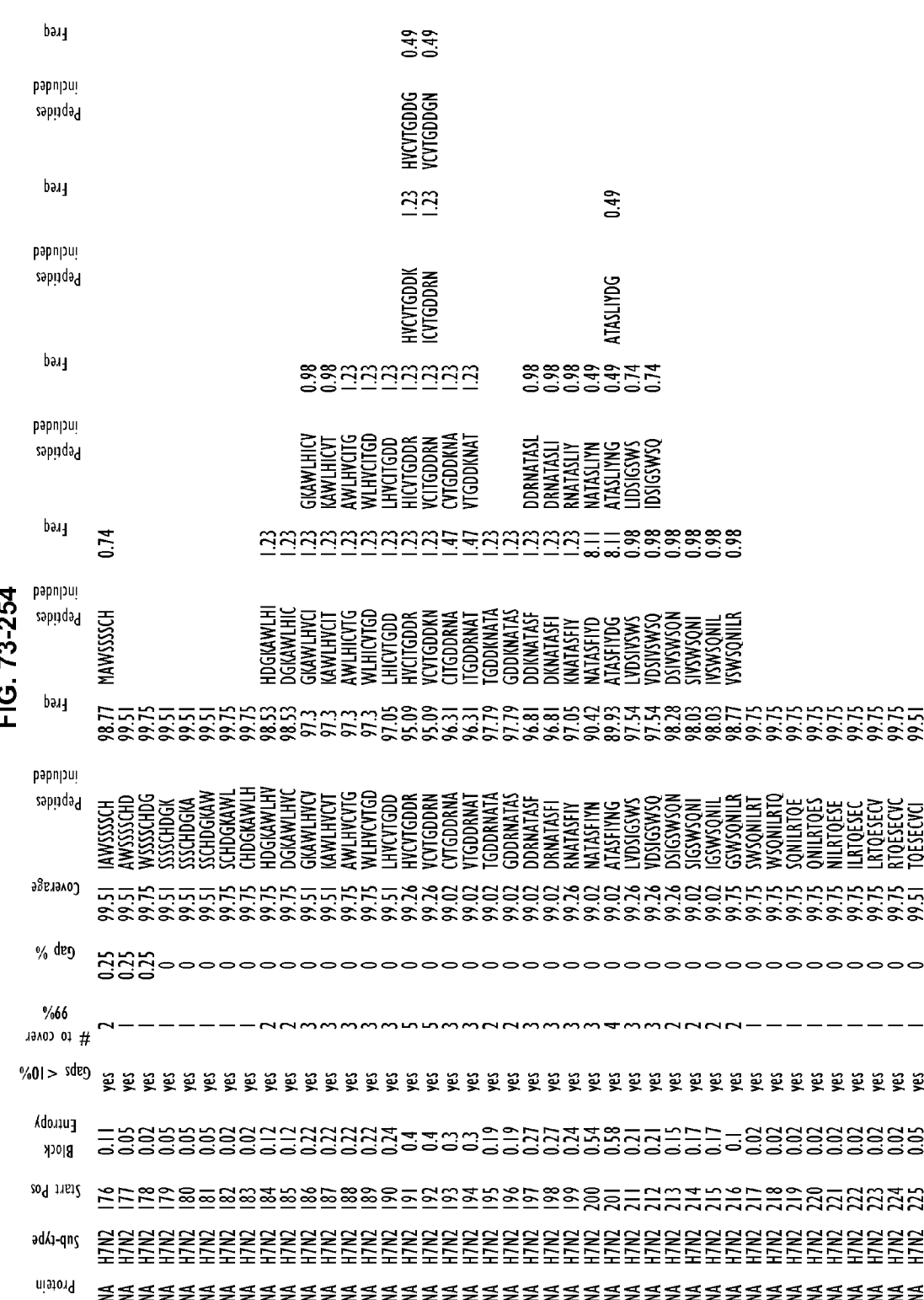
Figures 73, 313:
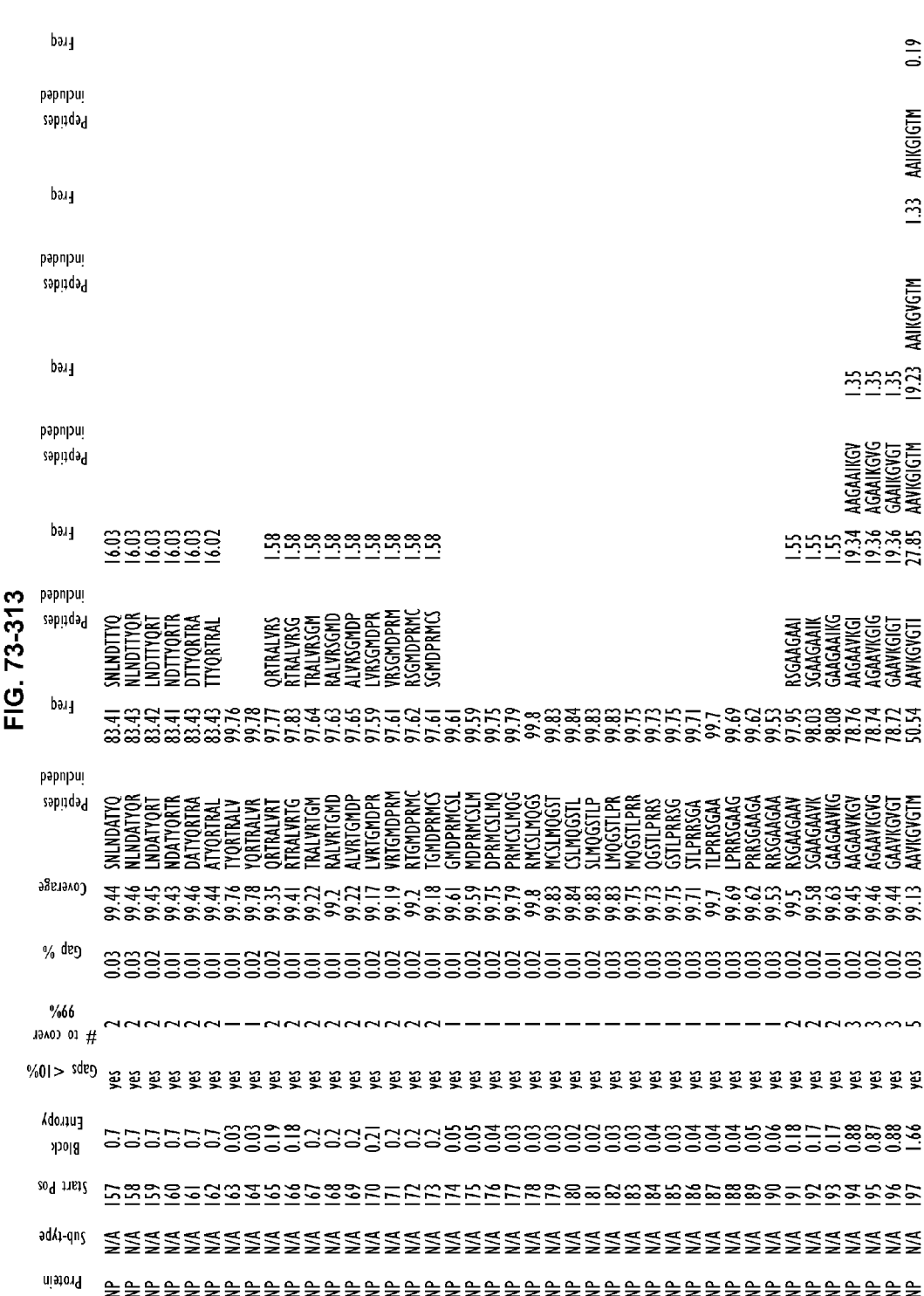
Figures 73, 342:
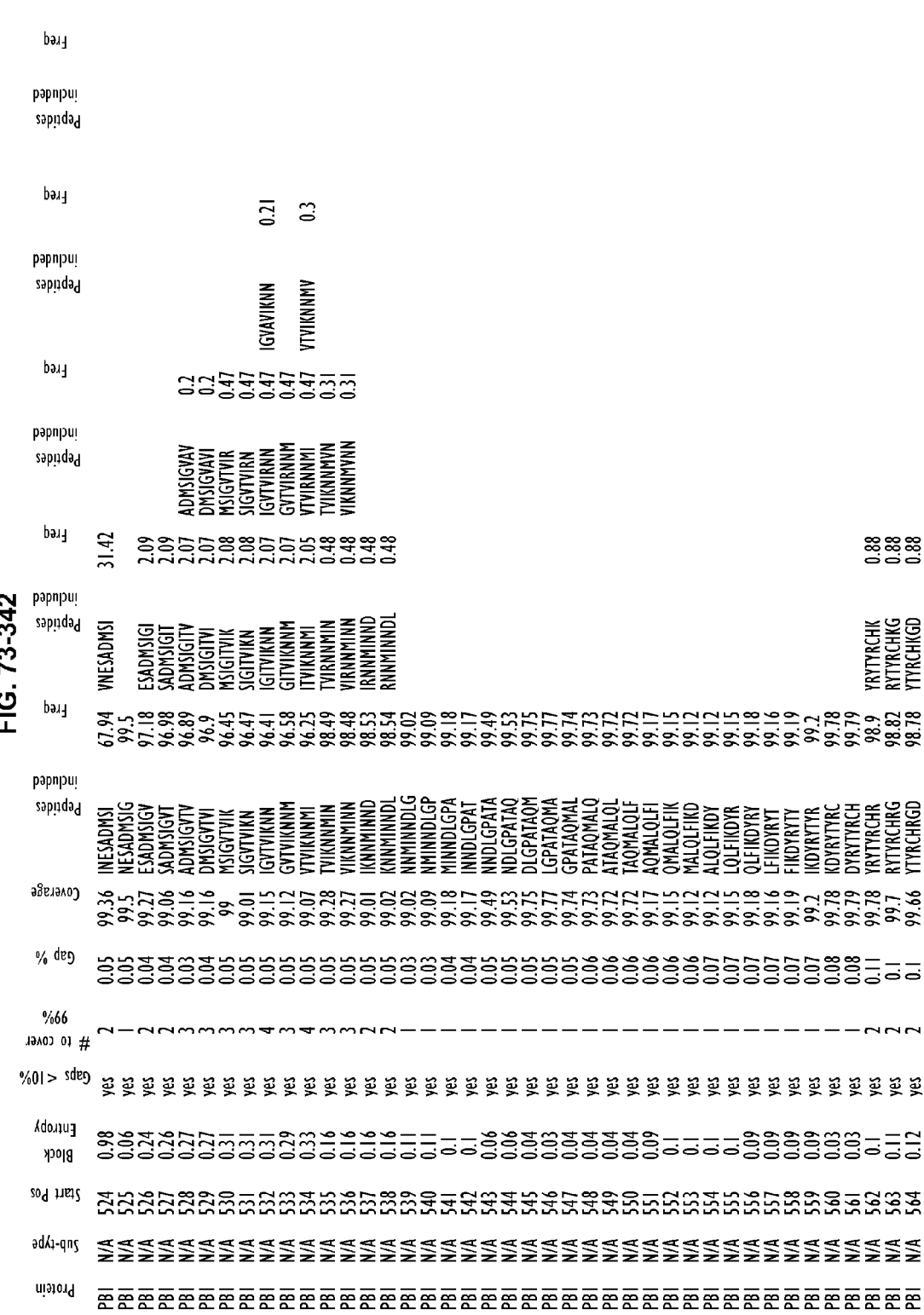
Figures 73, 344:
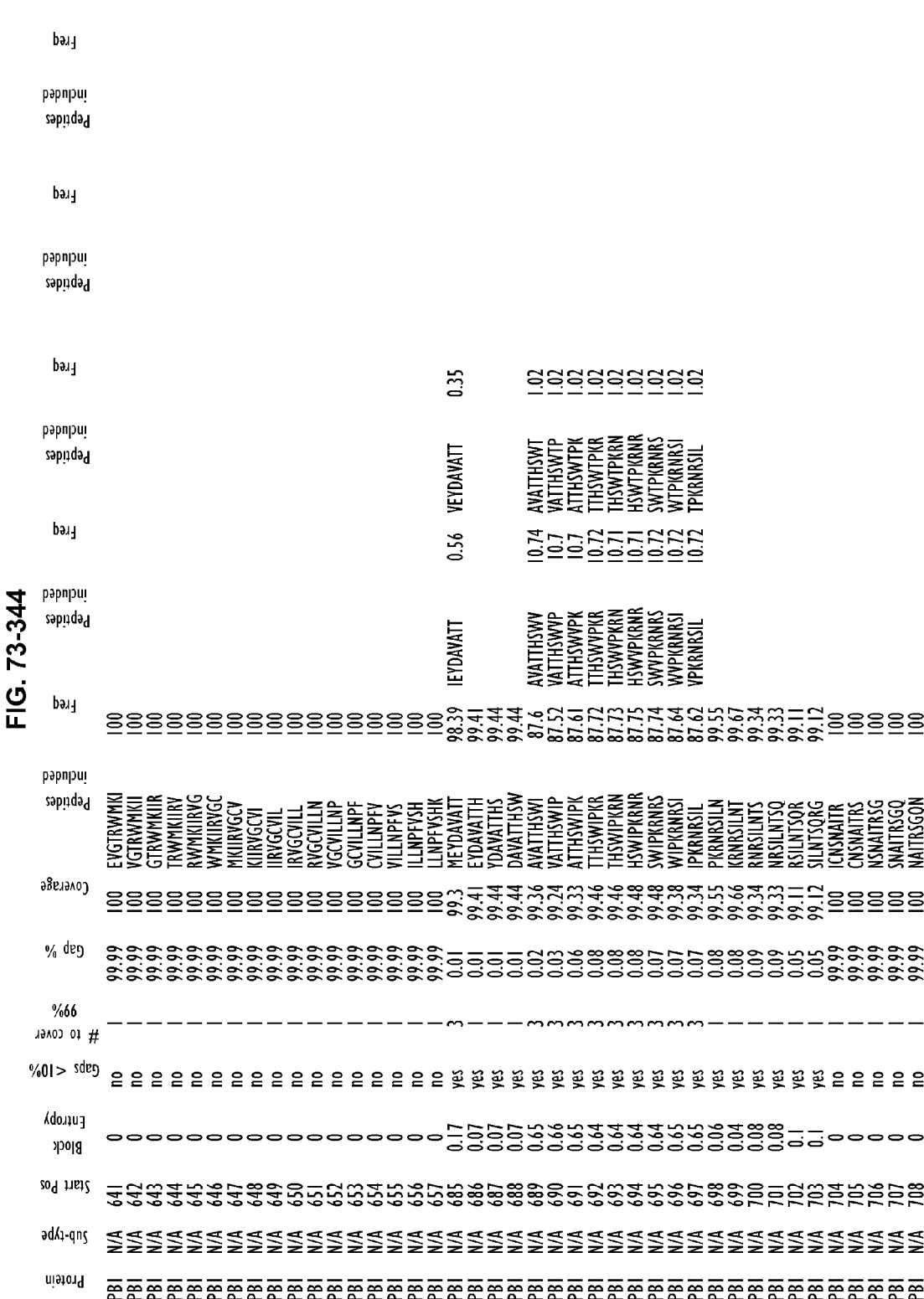
Figures 73, 345:
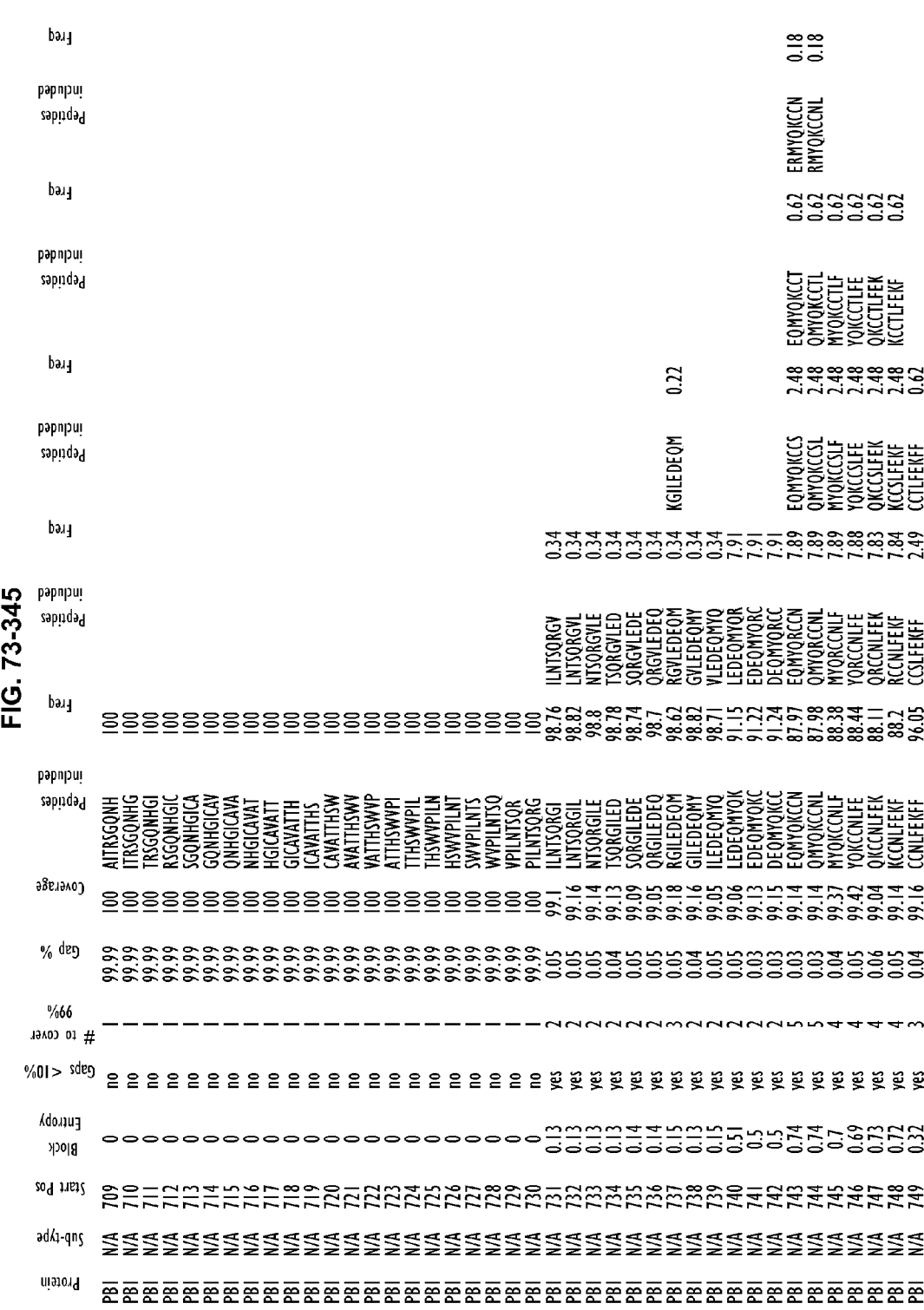
Figures 17, 74:
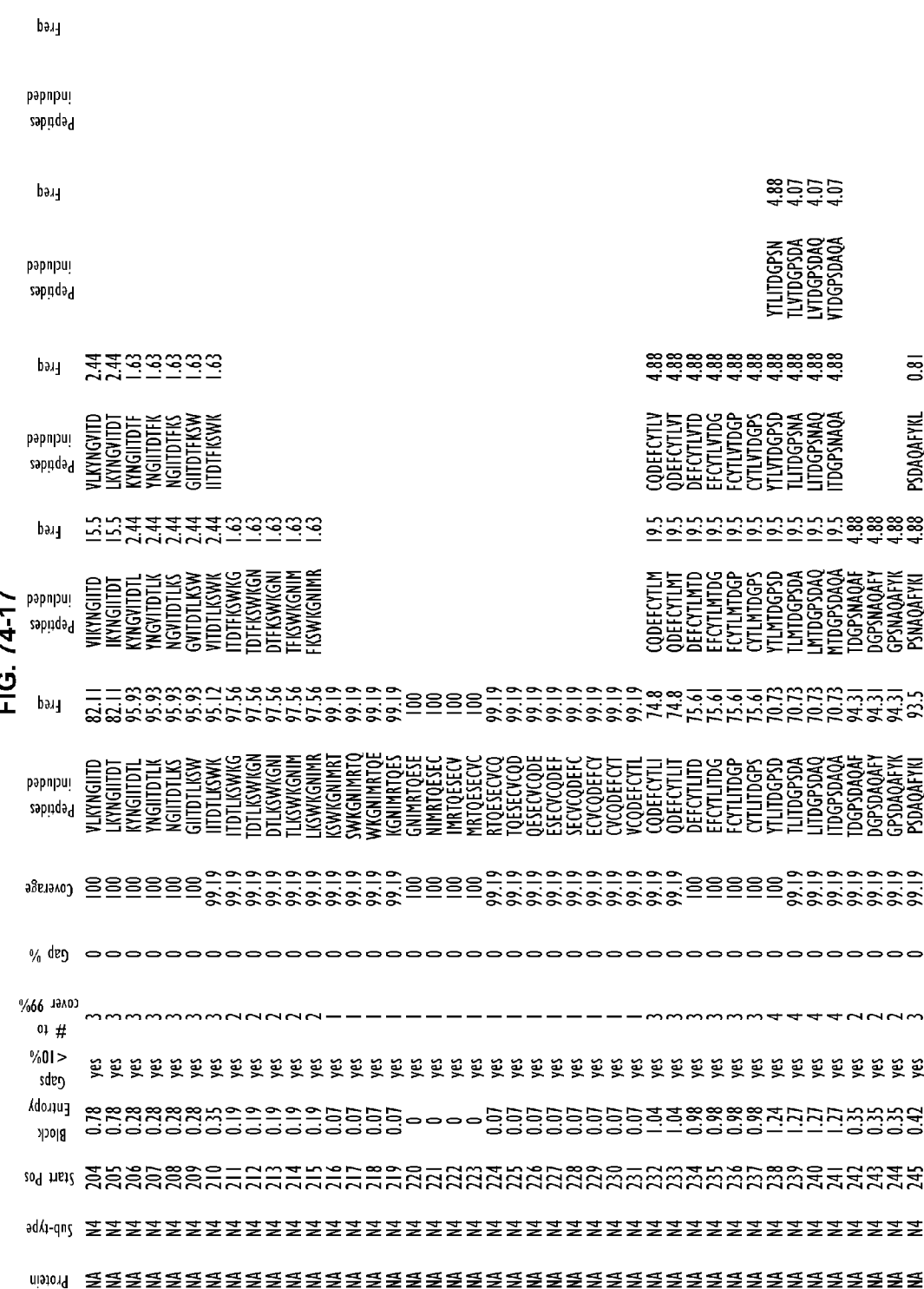
Figures 20, 74:
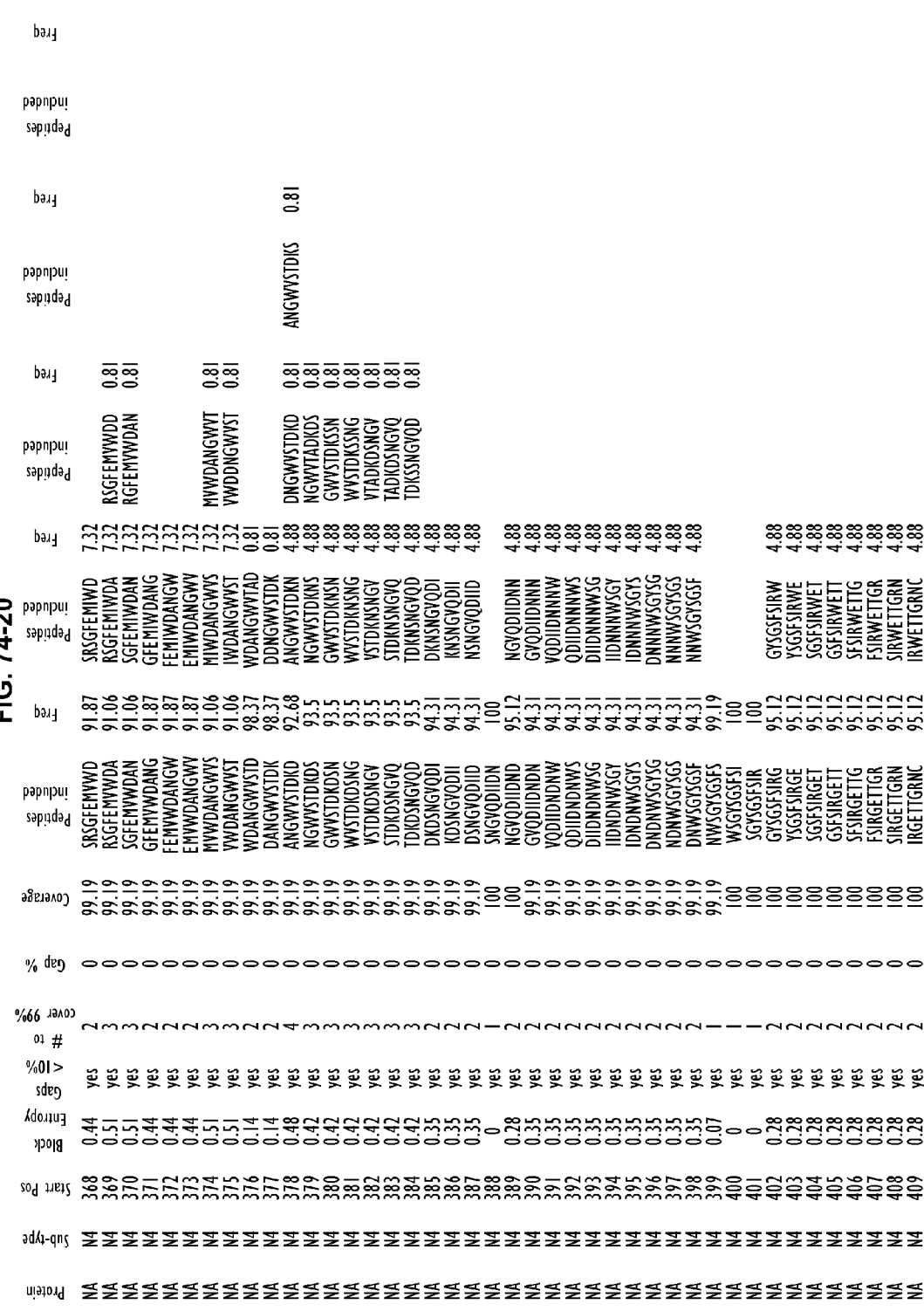
Figures 61, 74:
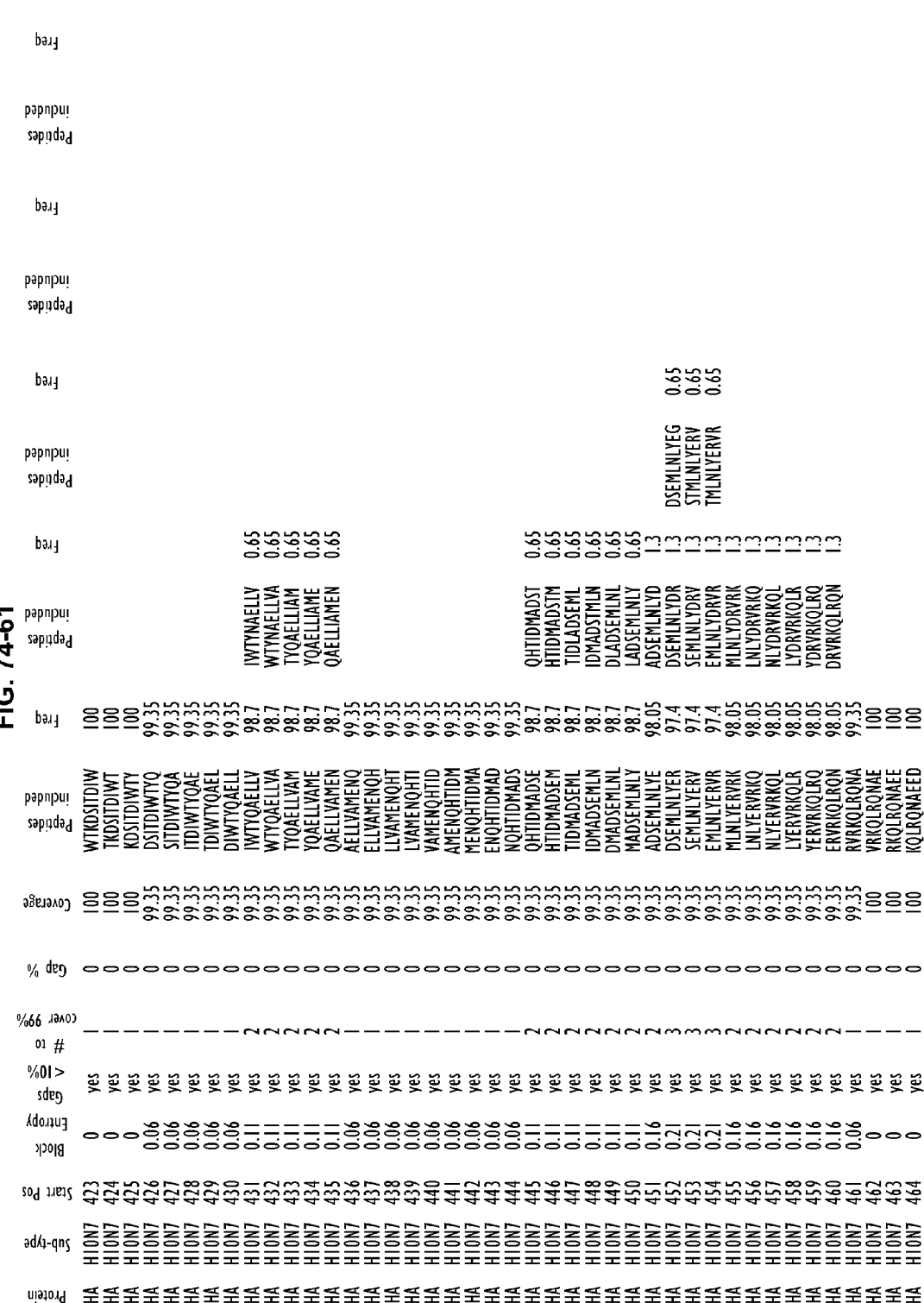
Figures 67, 74:
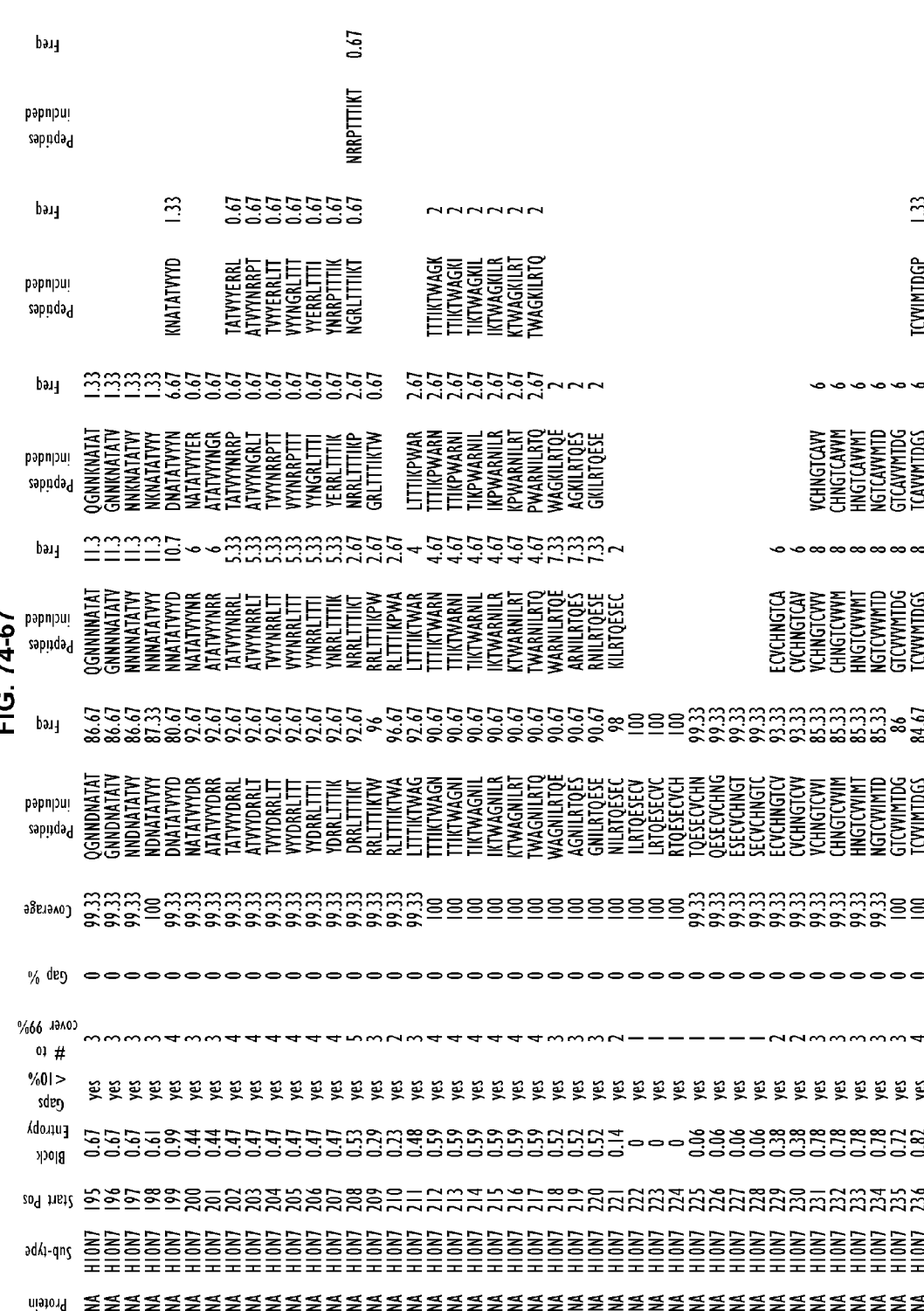
Figures 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104:
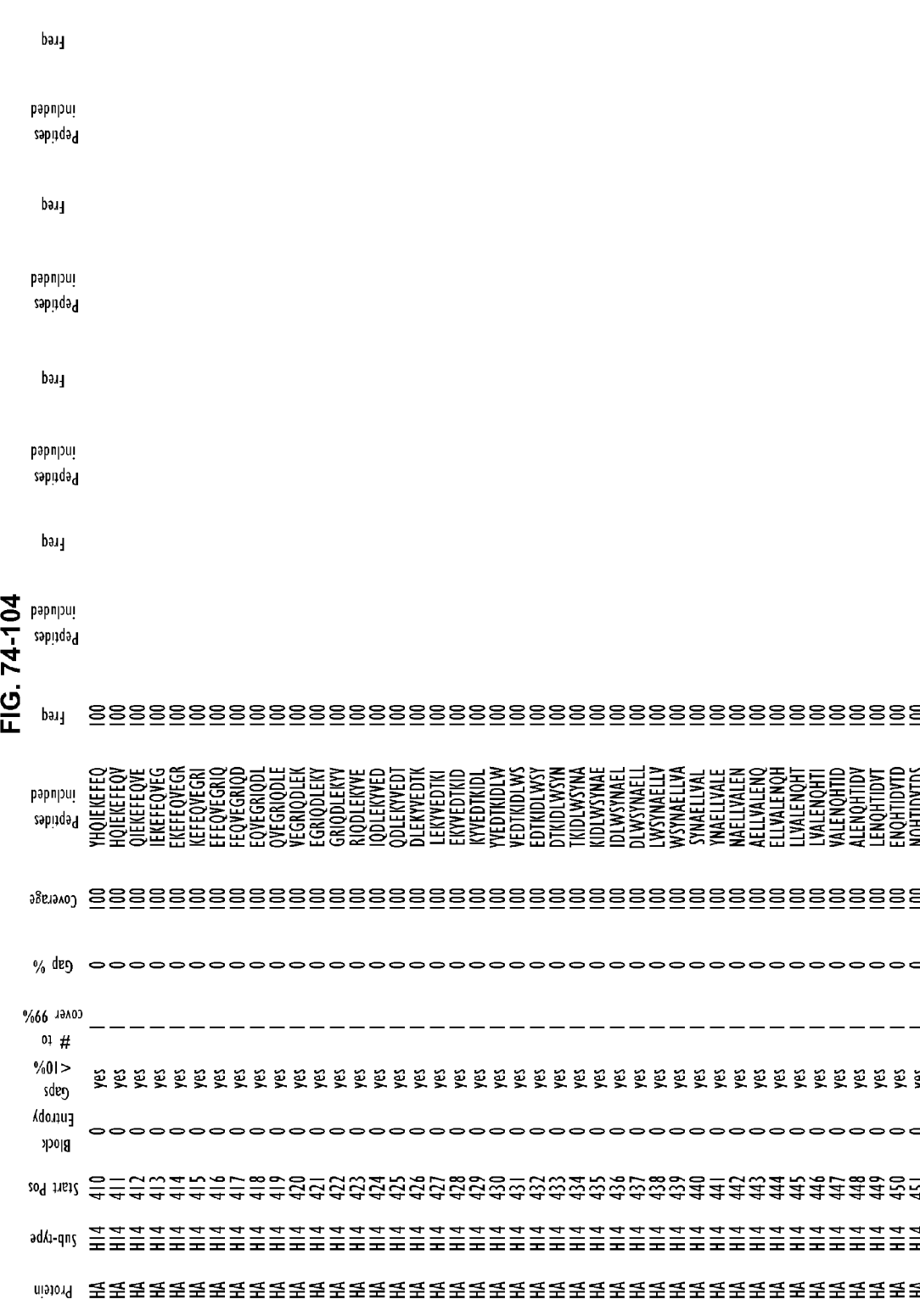
Figures 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111:
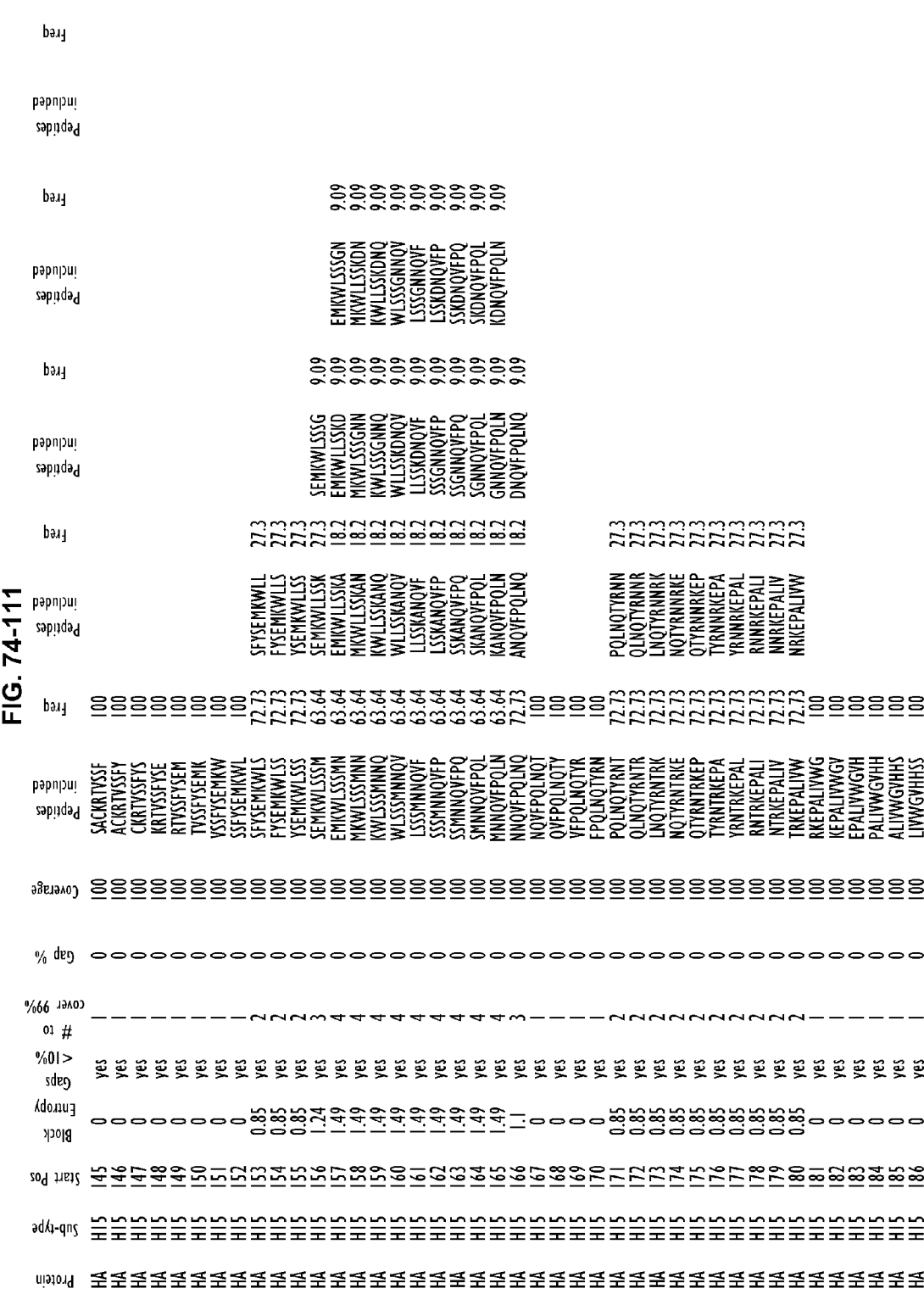
Figures 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112:
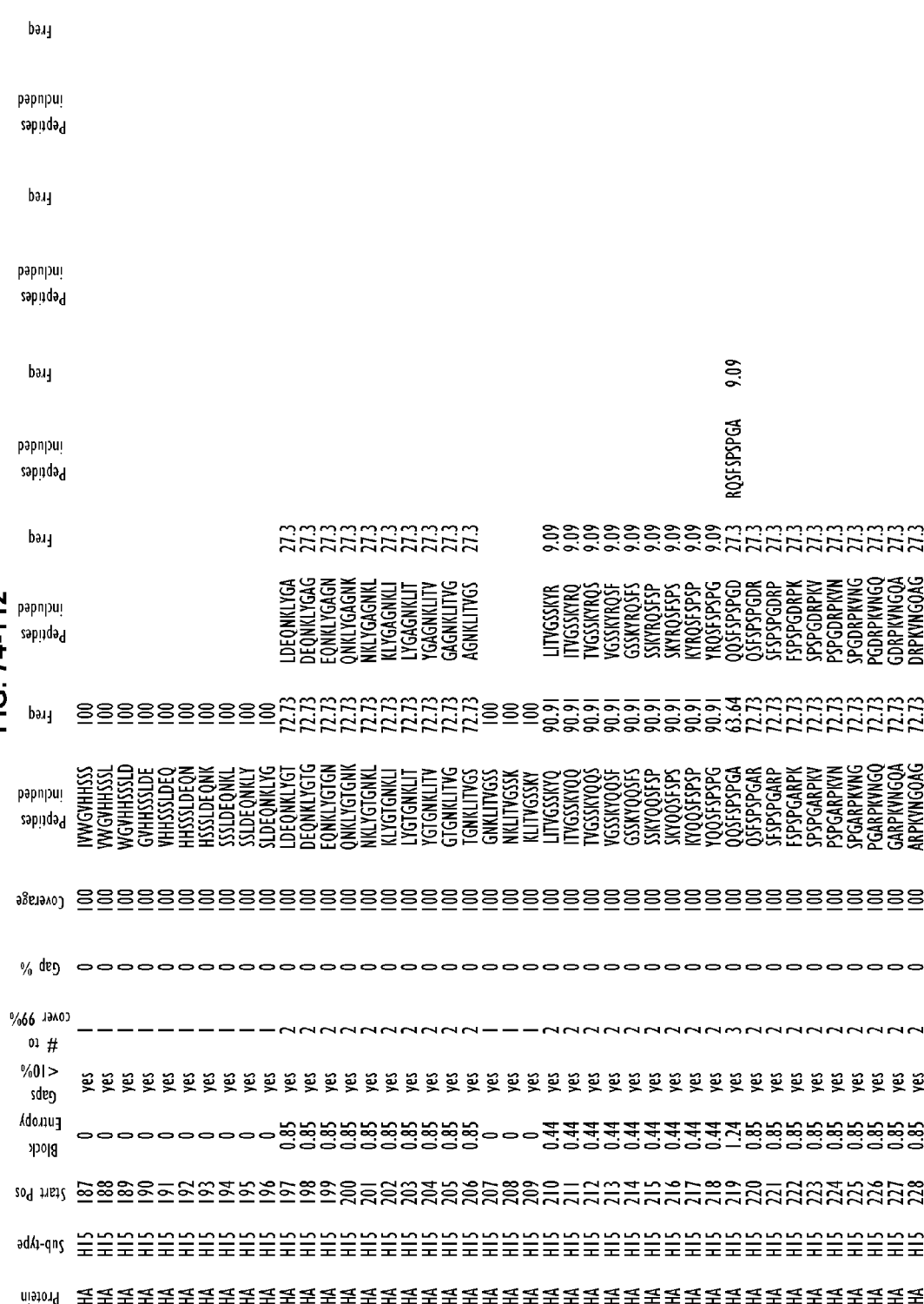
Figures 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119:
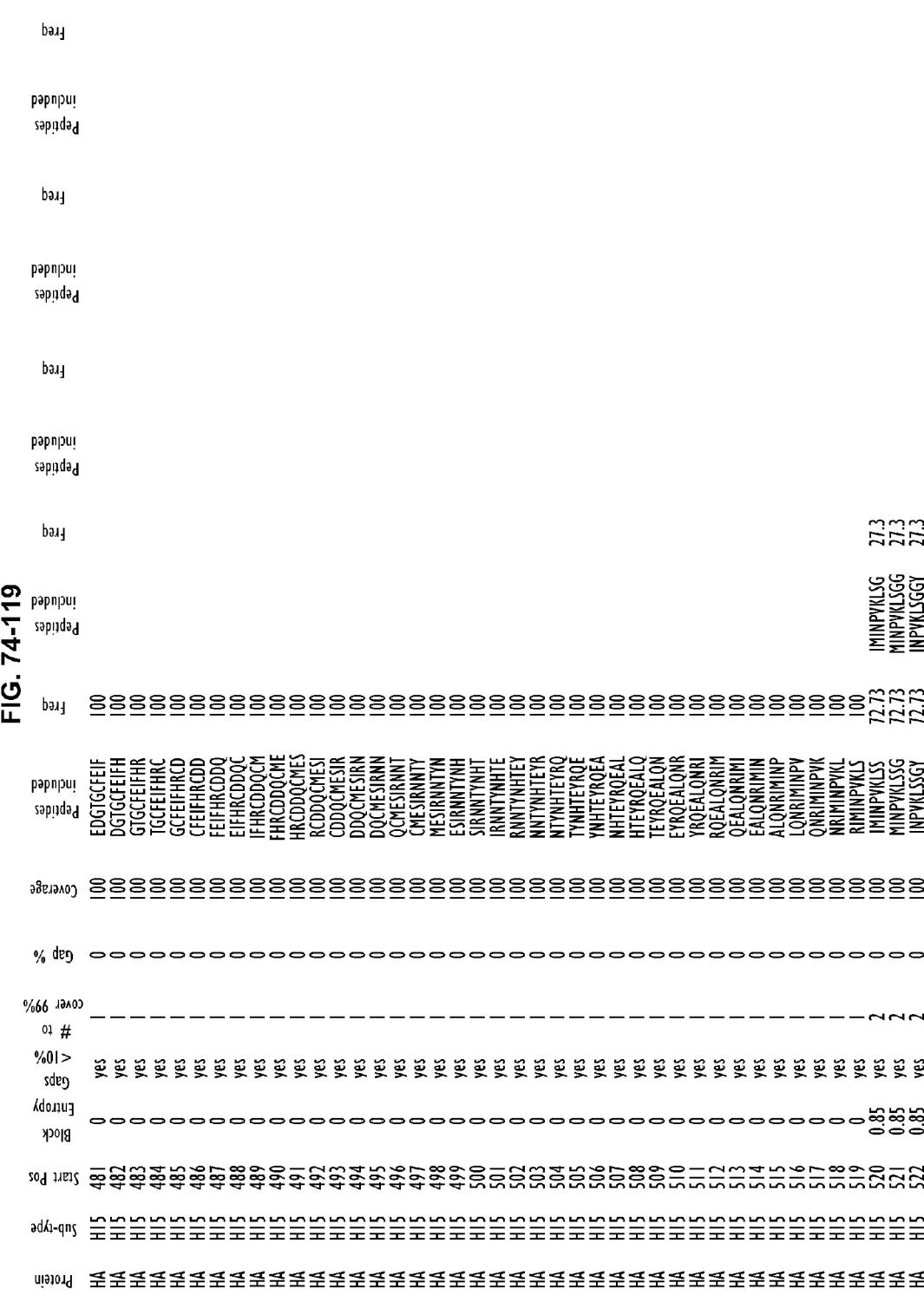
Figures 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120:
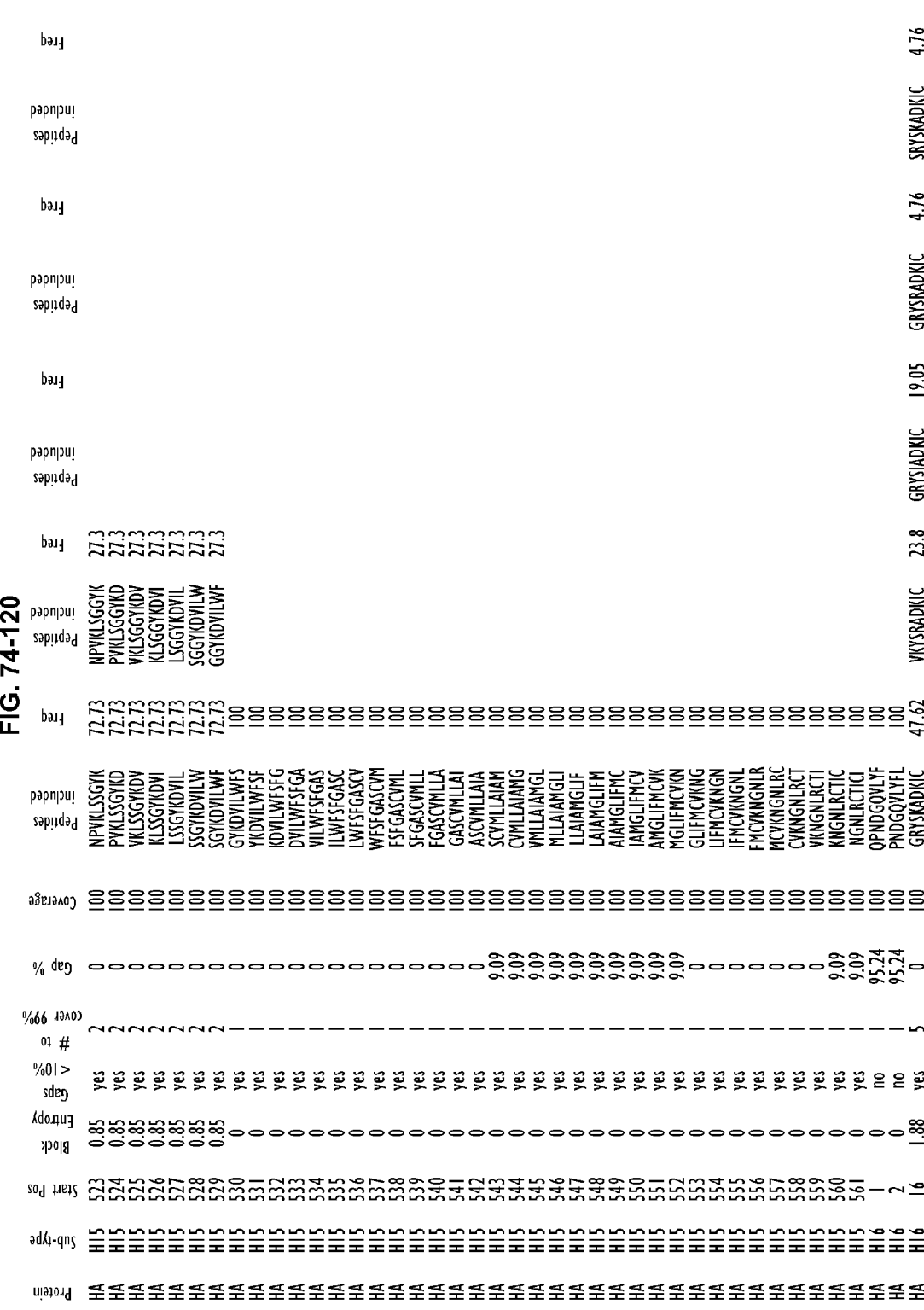
Figures 74, 282:
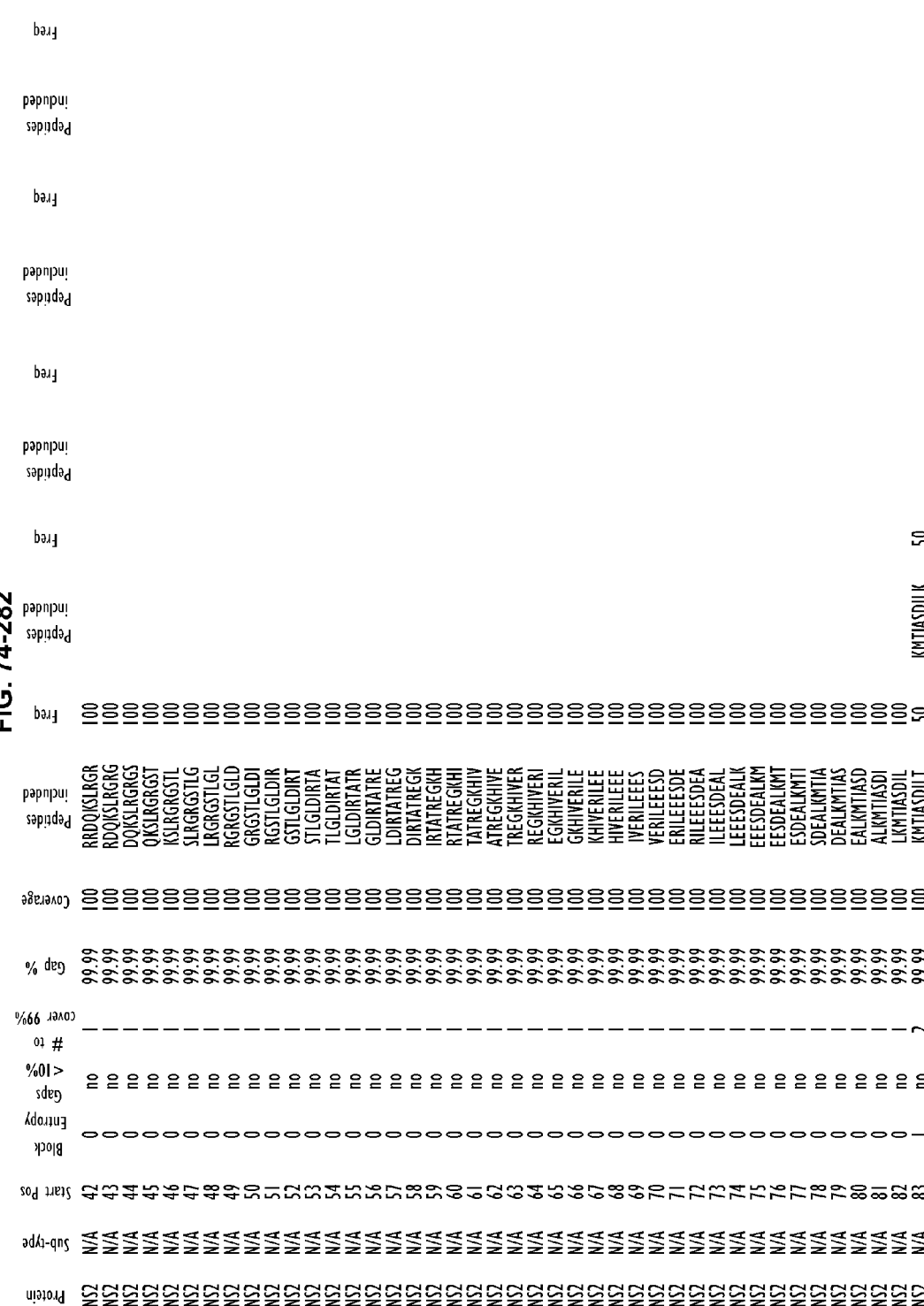
Figures 74, 299:
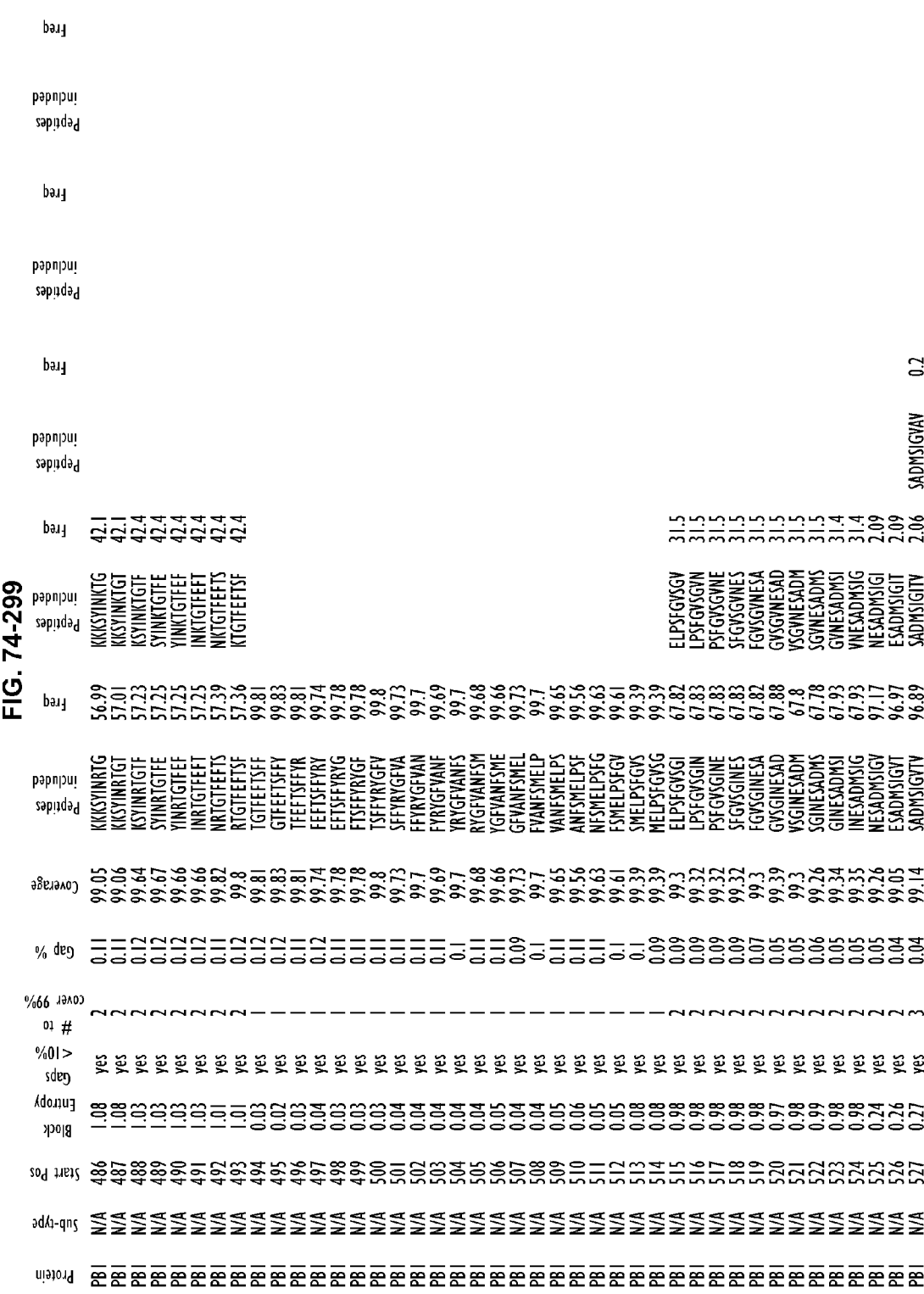
Figures 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124:
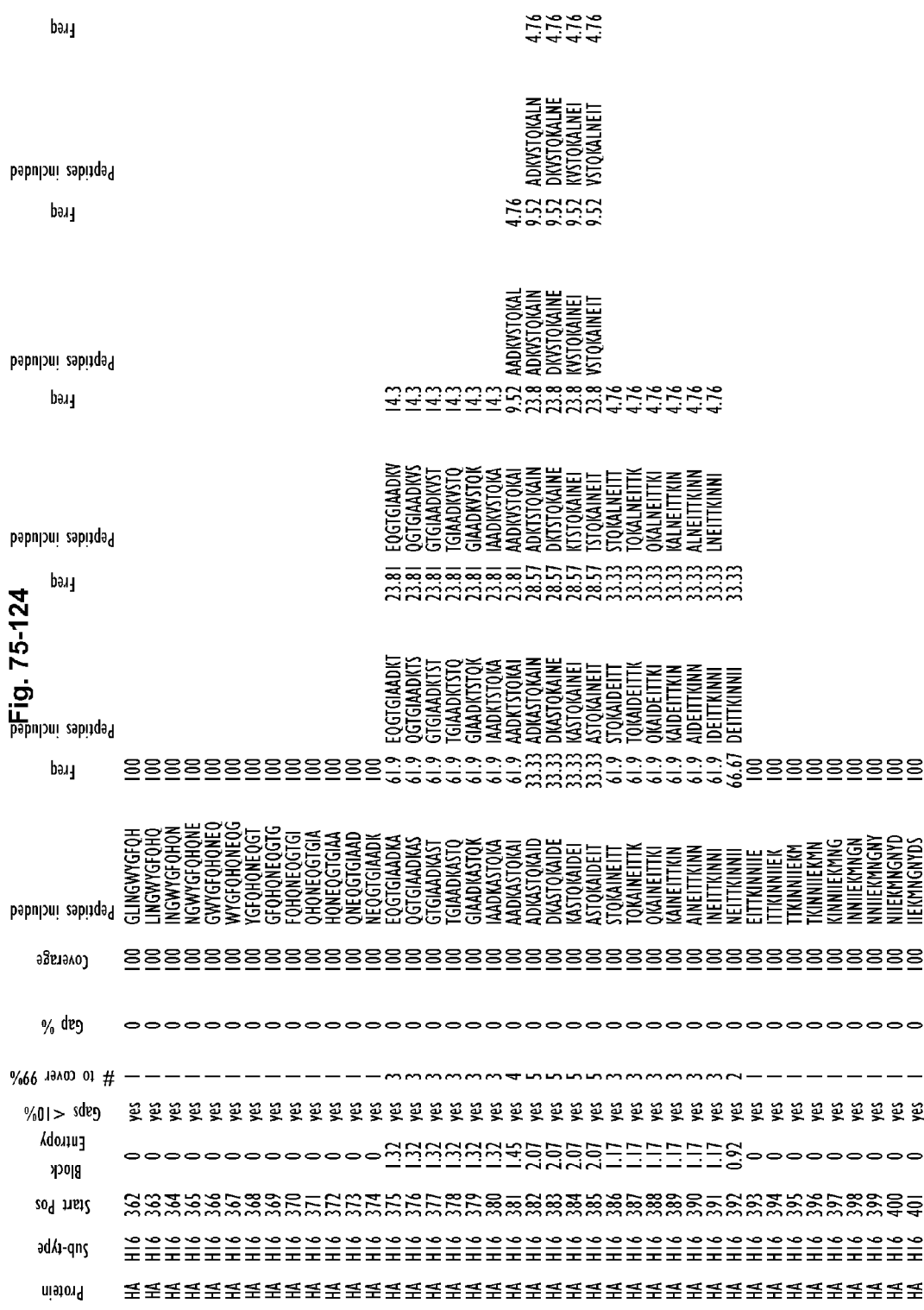
Figures 3, 76:
Figures 45, 76:
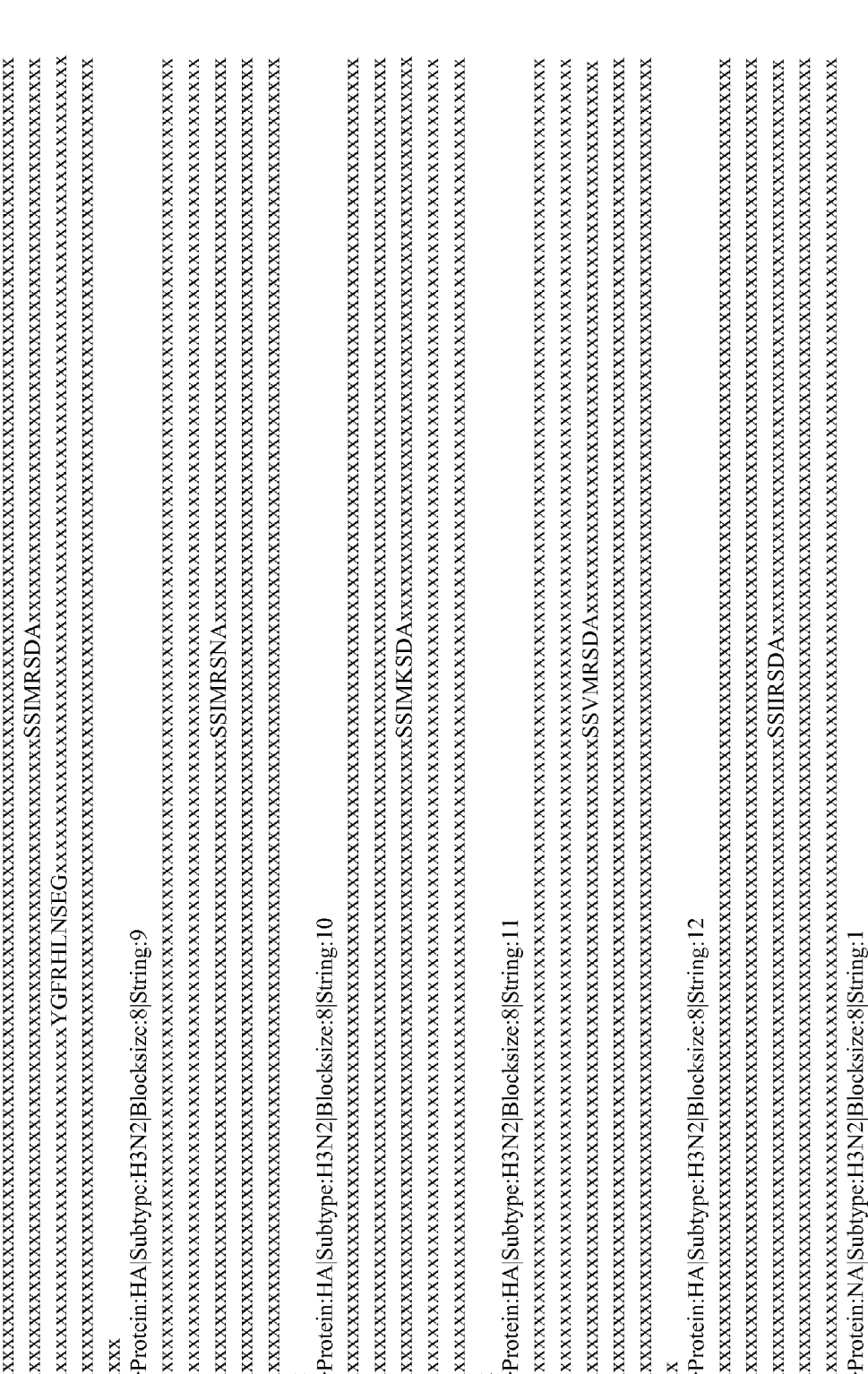
Figures 76, 180:
Figures 76, 182:
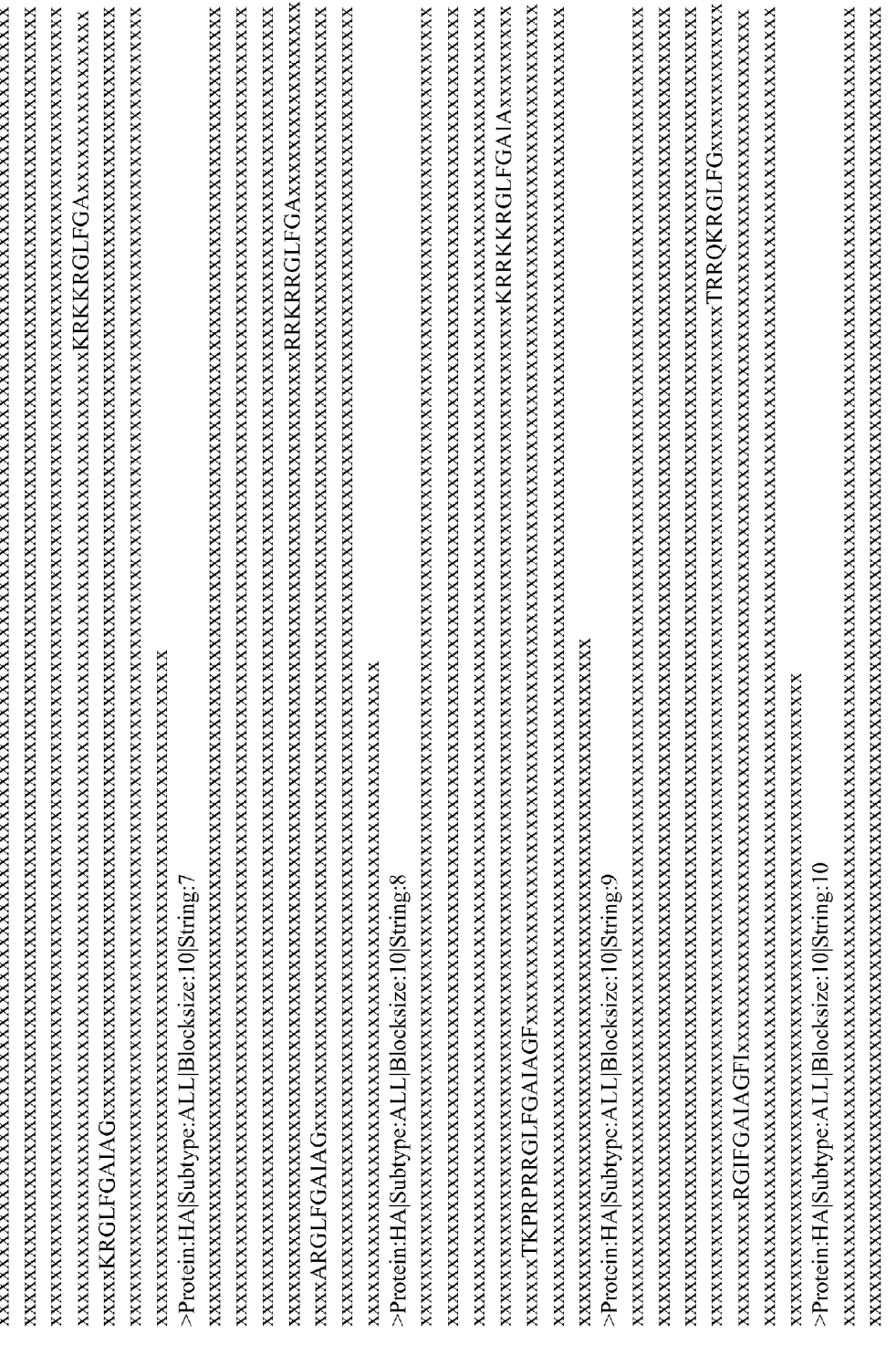
Figures 1, 77:
Figures 2, 77:
Figures 19, 77:
Figures 54, 77:
Figures 59, 77:
Figures 60, 77:
Figure 77:
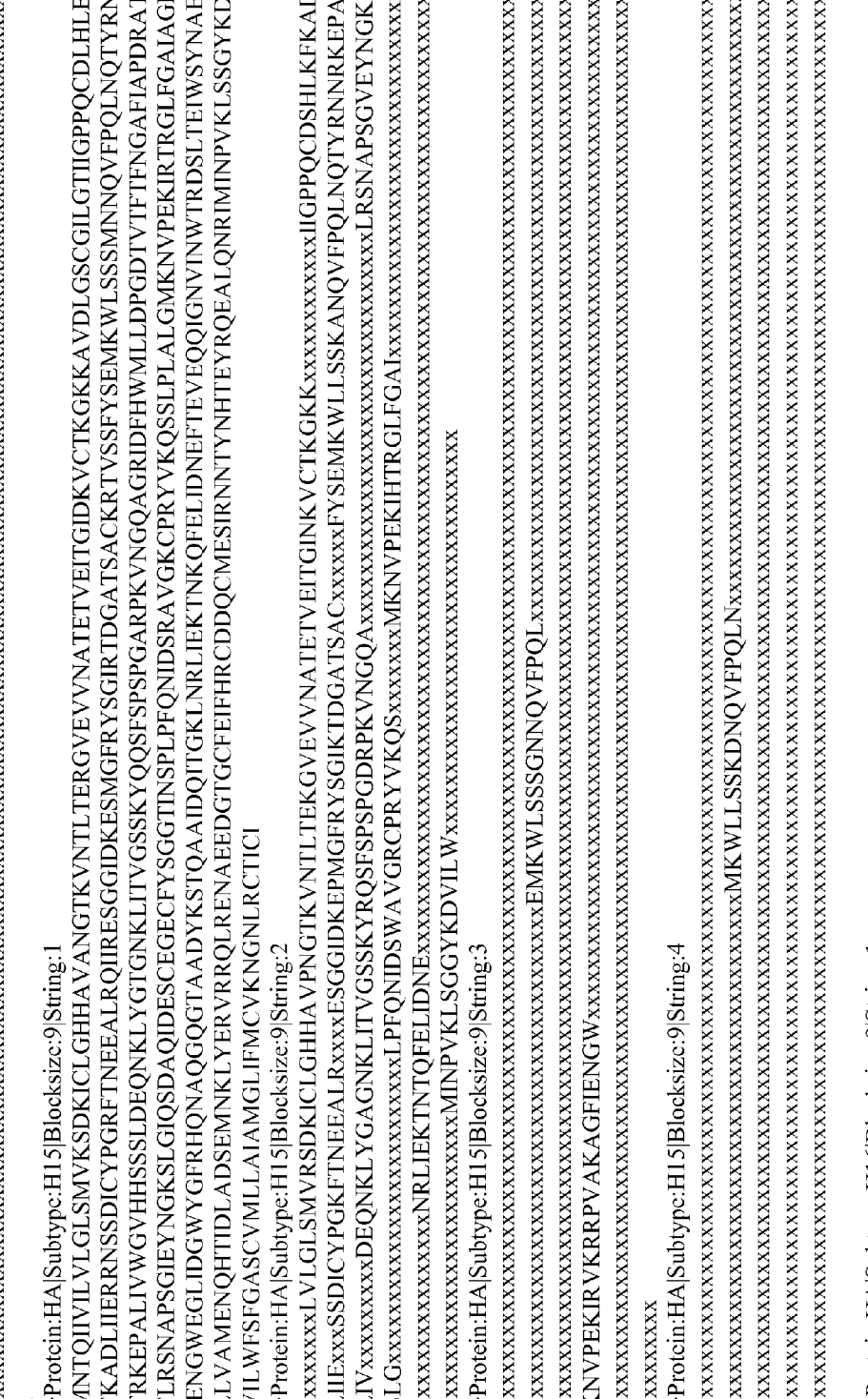
Figures 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118:
Figures 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119:
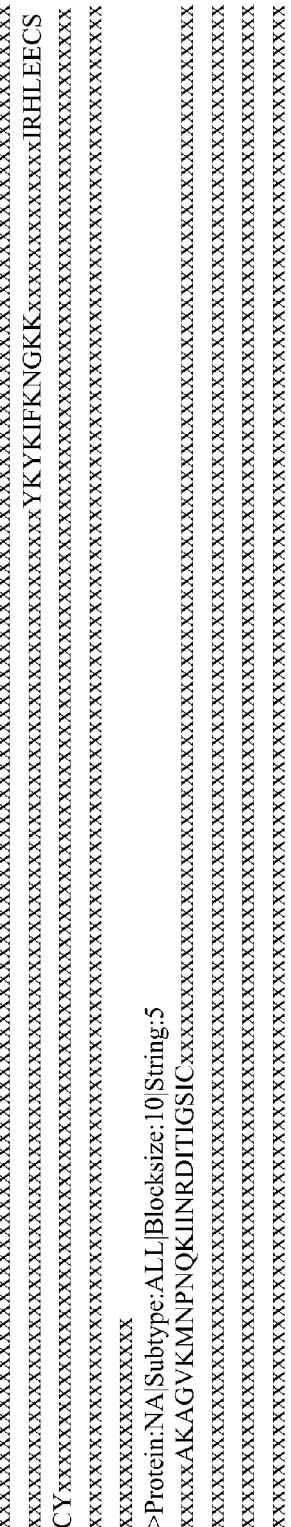
Figures 77, 175:
Figures 77, 176:
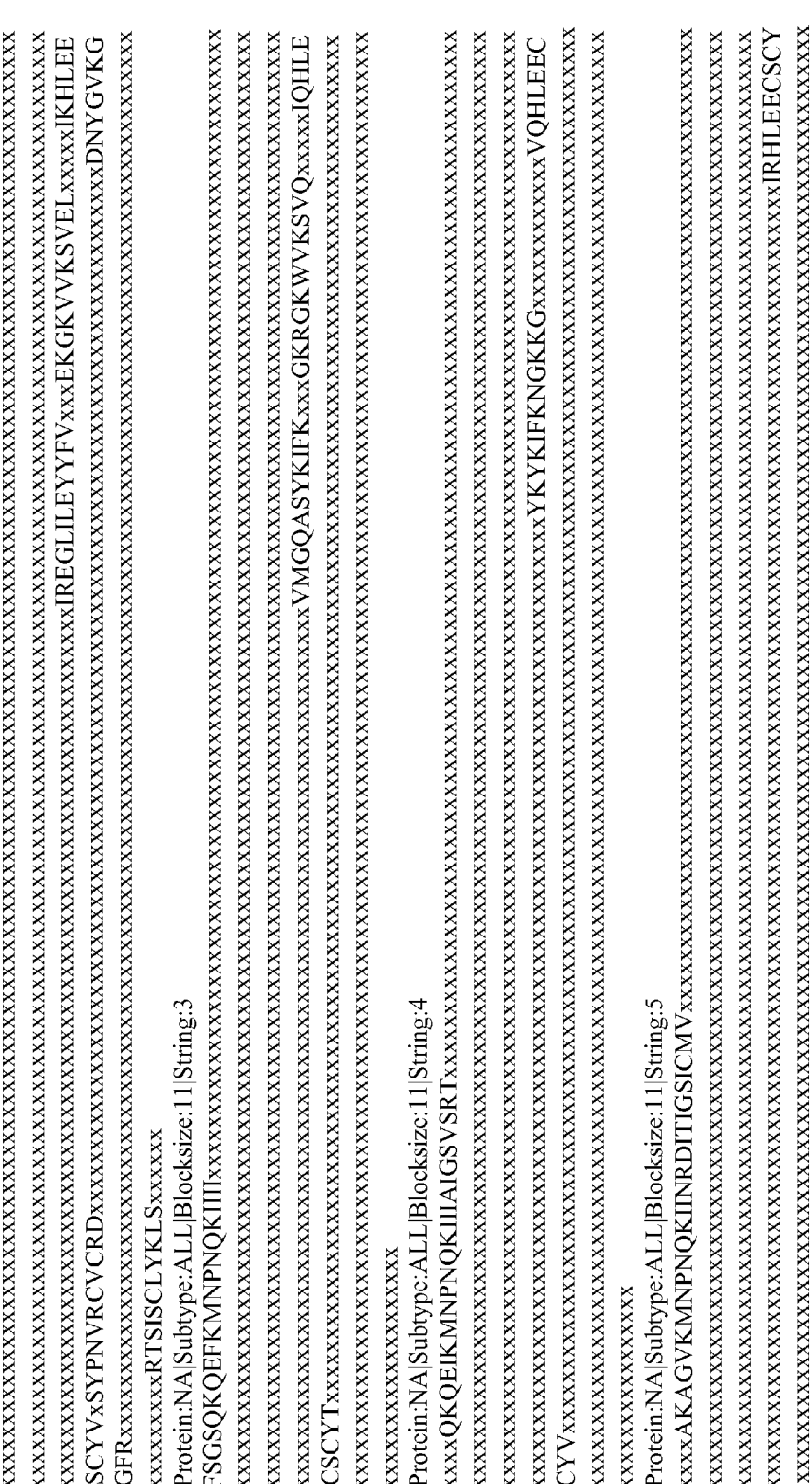
Figures 1, 80:
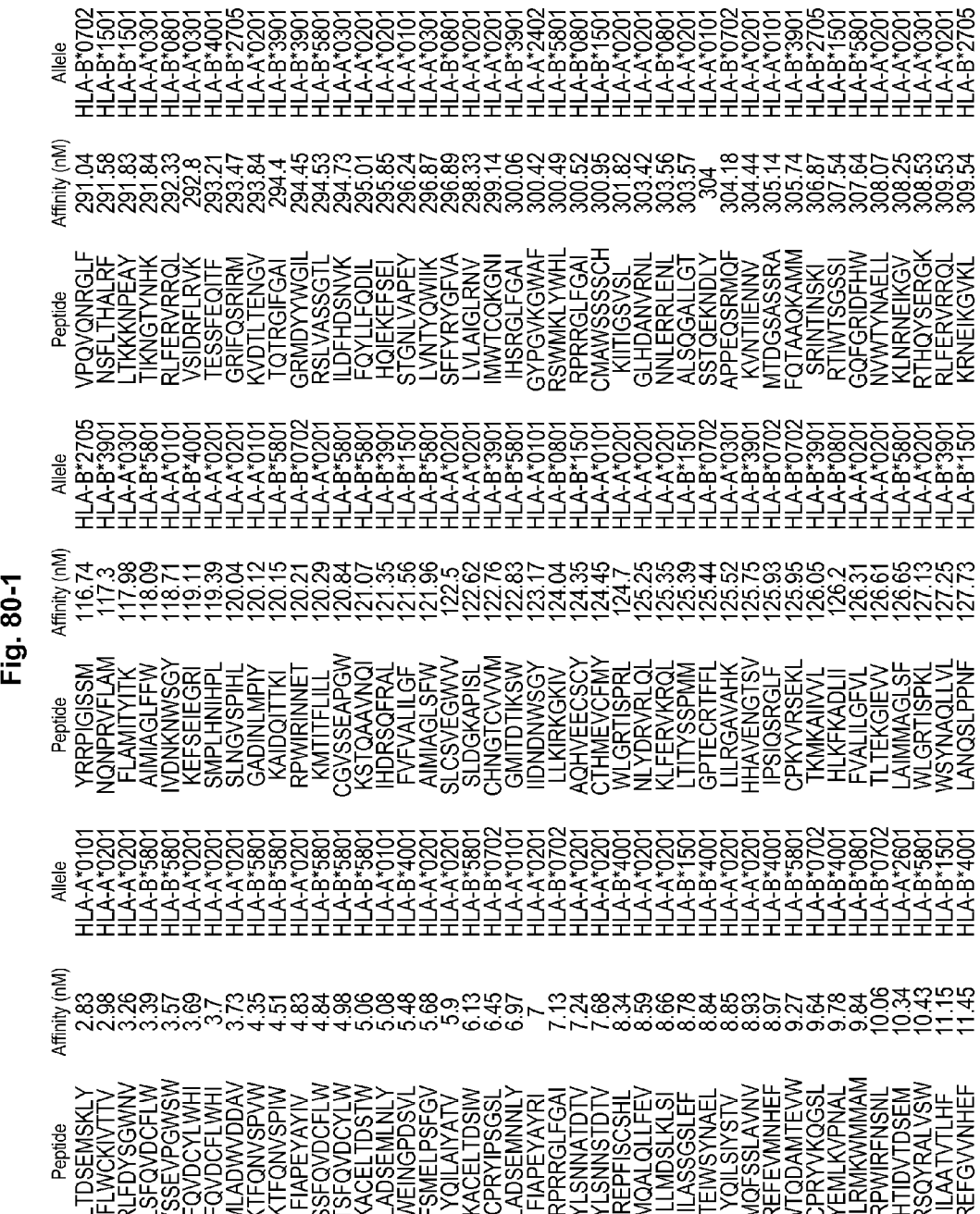
Figures 2, 80:
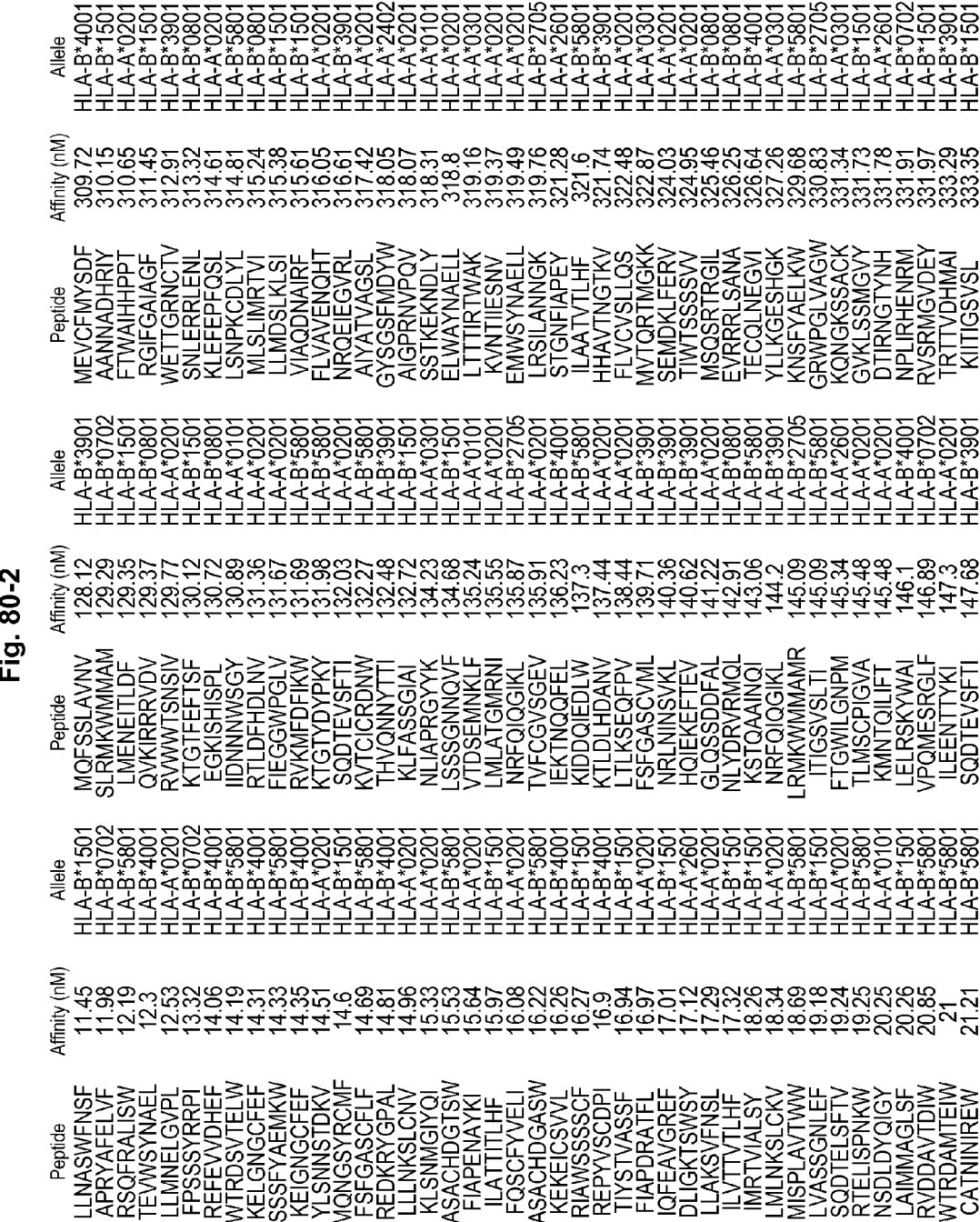
Figures 3, 80:
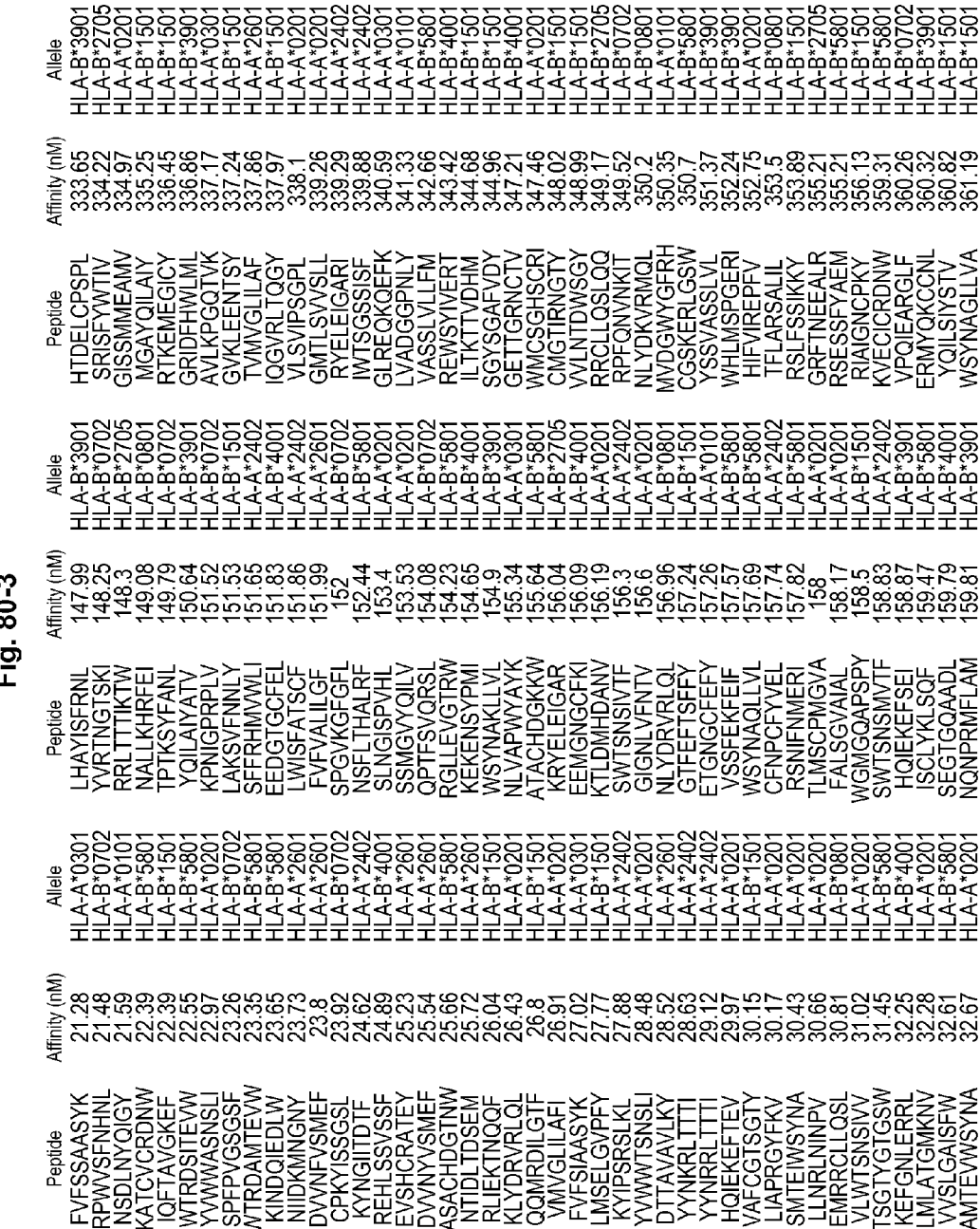
Figures 4, 80:
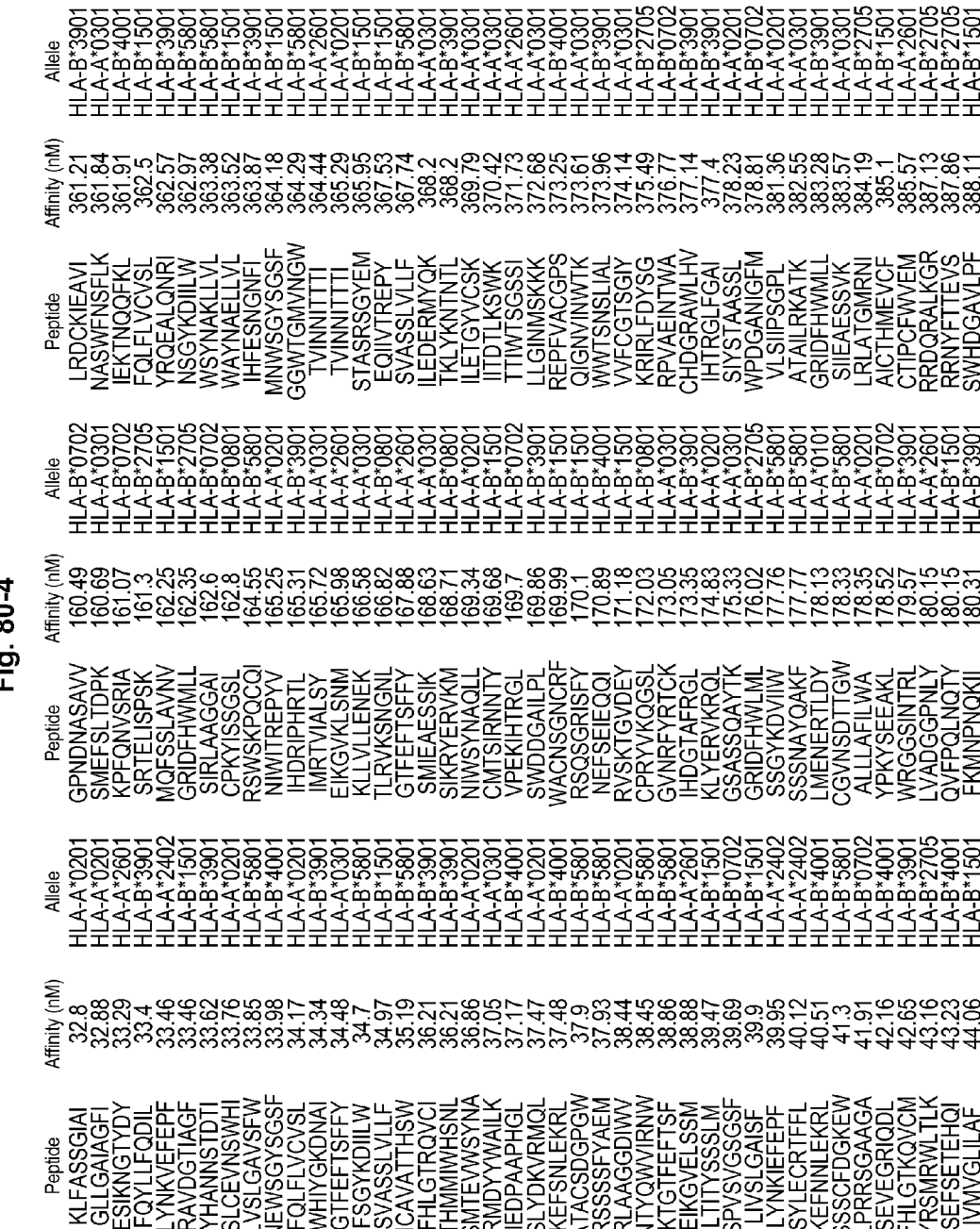
Figures 6, 80:
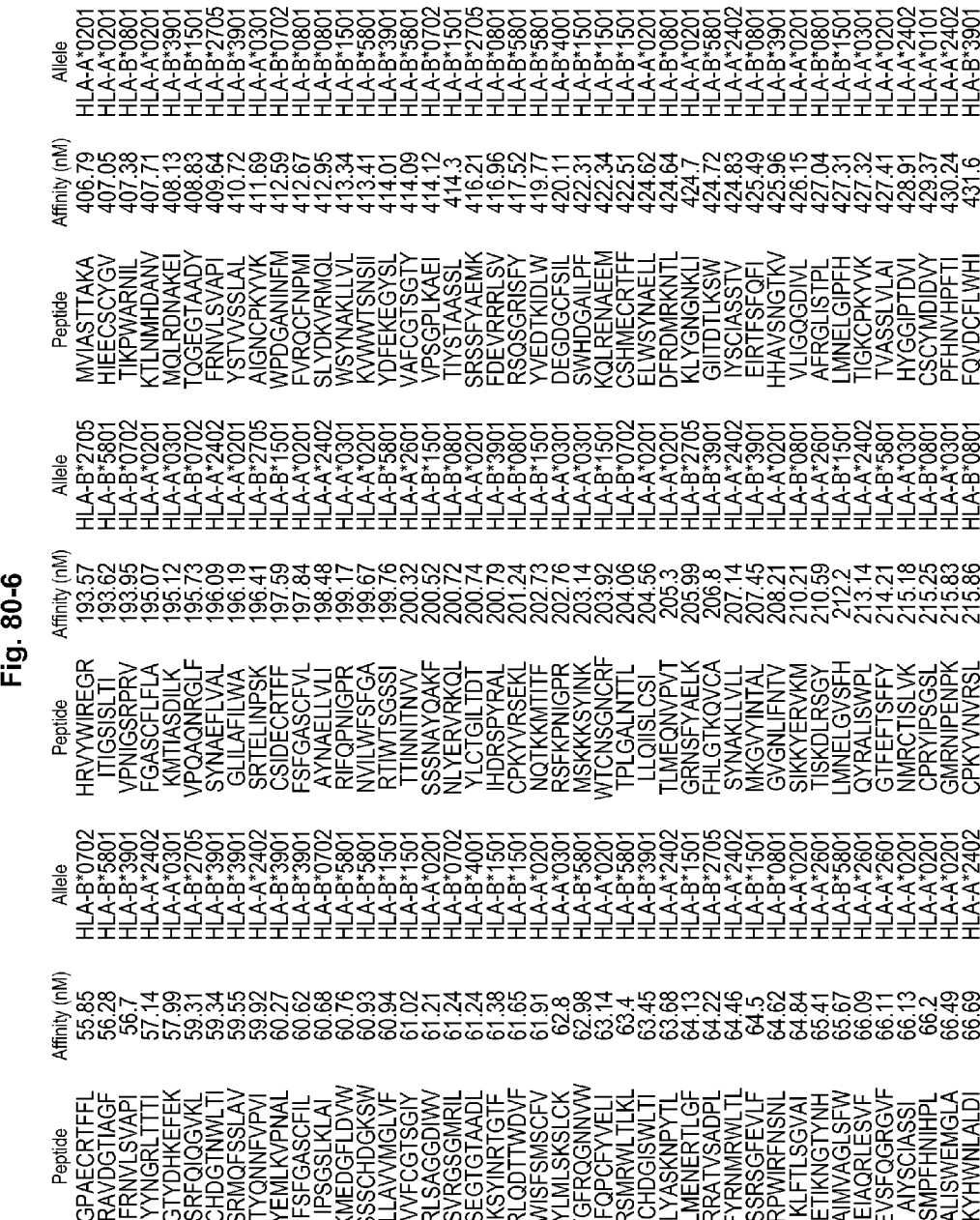
Figures 7, 80:
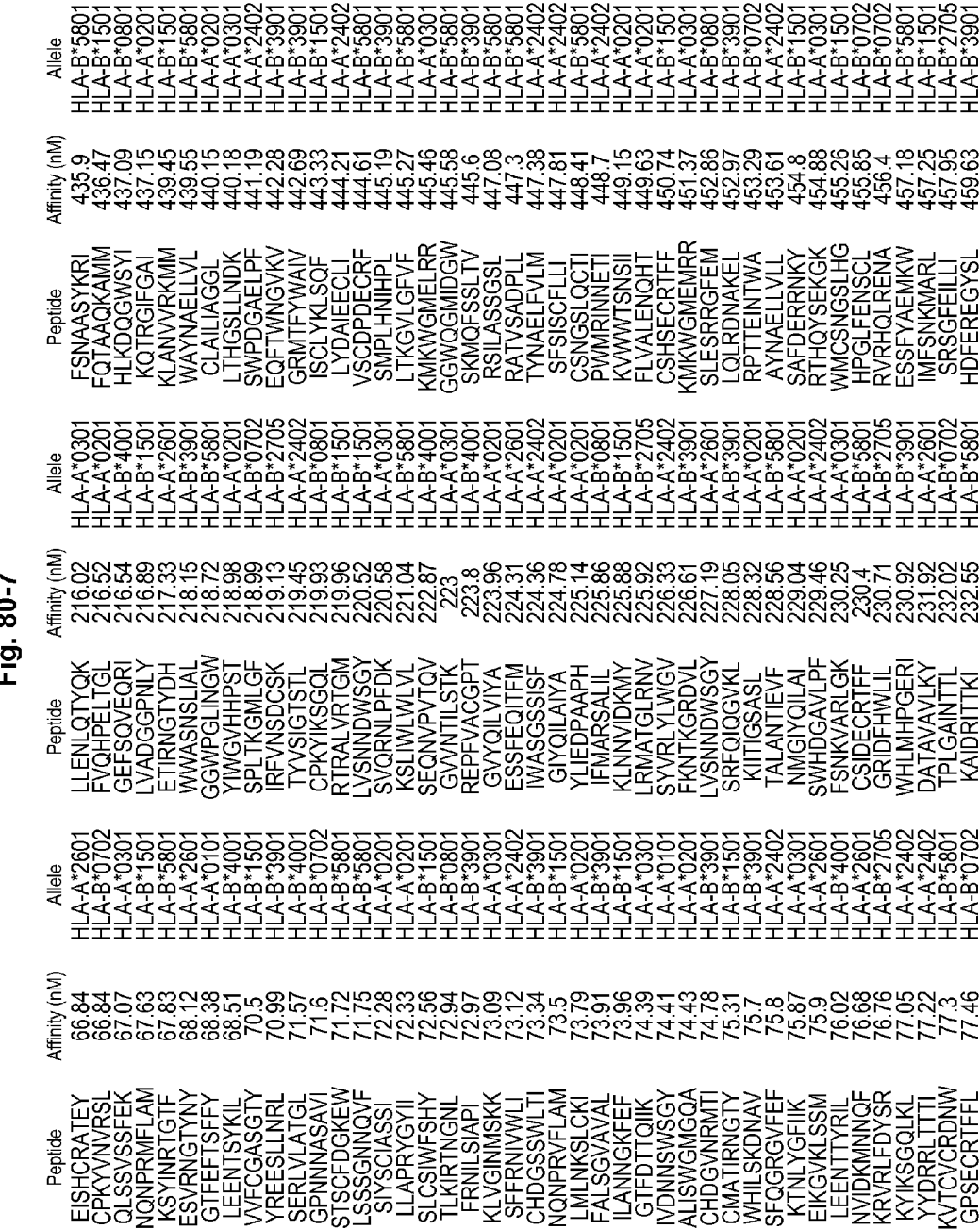
Figures 8, 80:
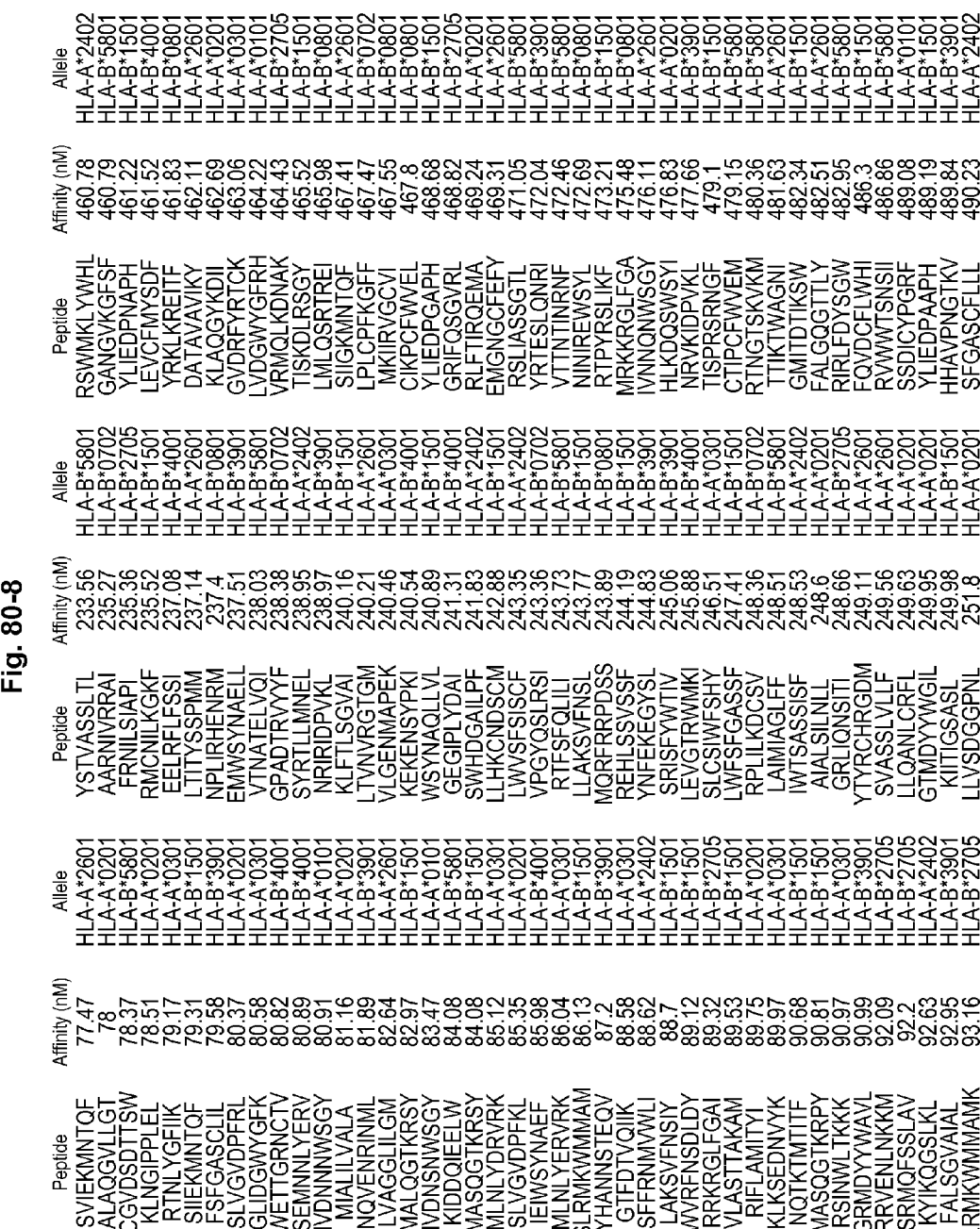
Figures 9, 80:
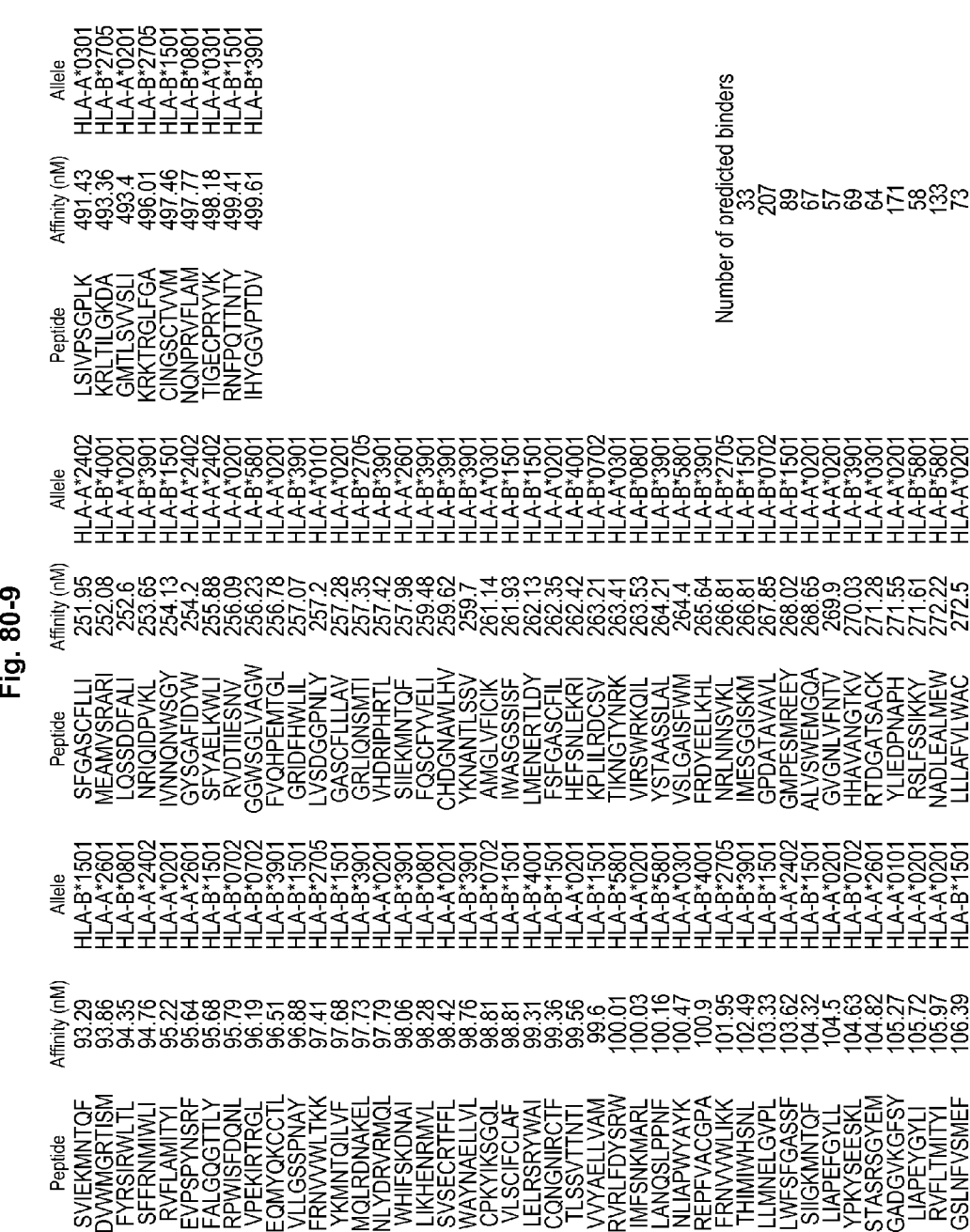
Figures 10, 80:
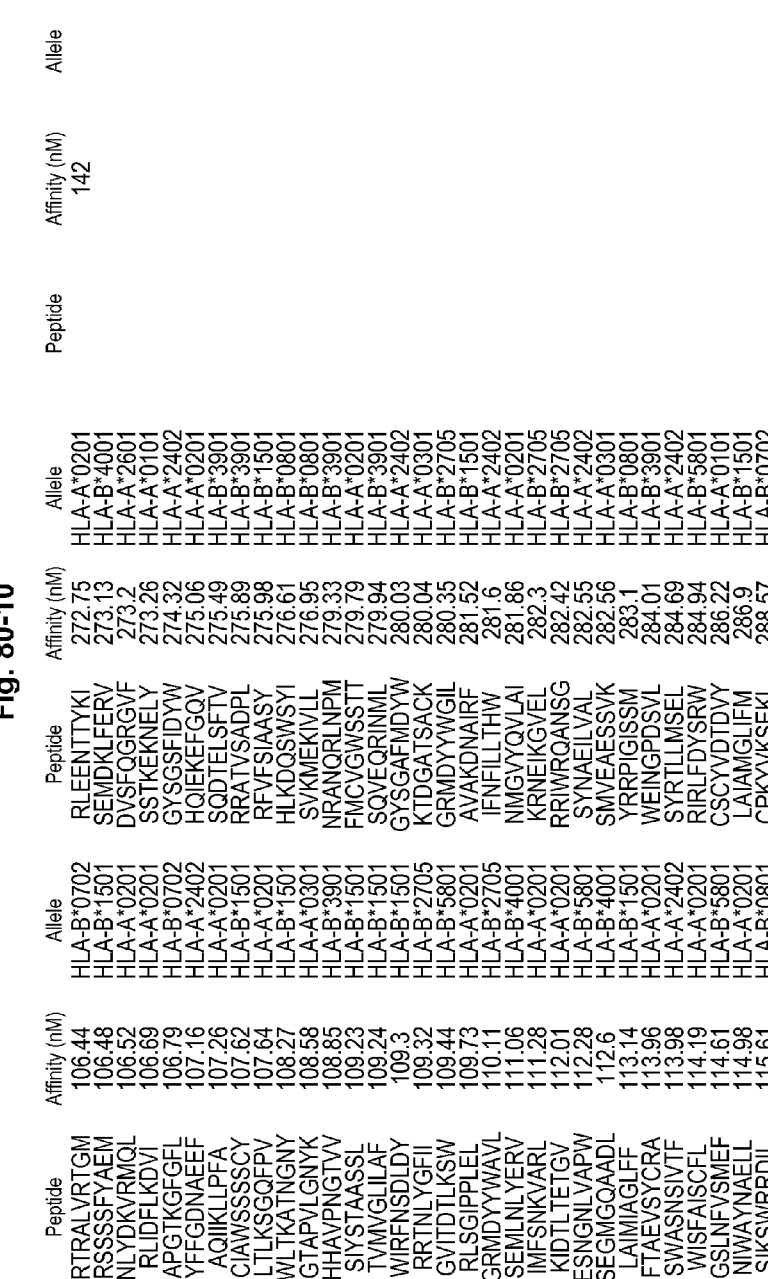
Figures 1, 81:
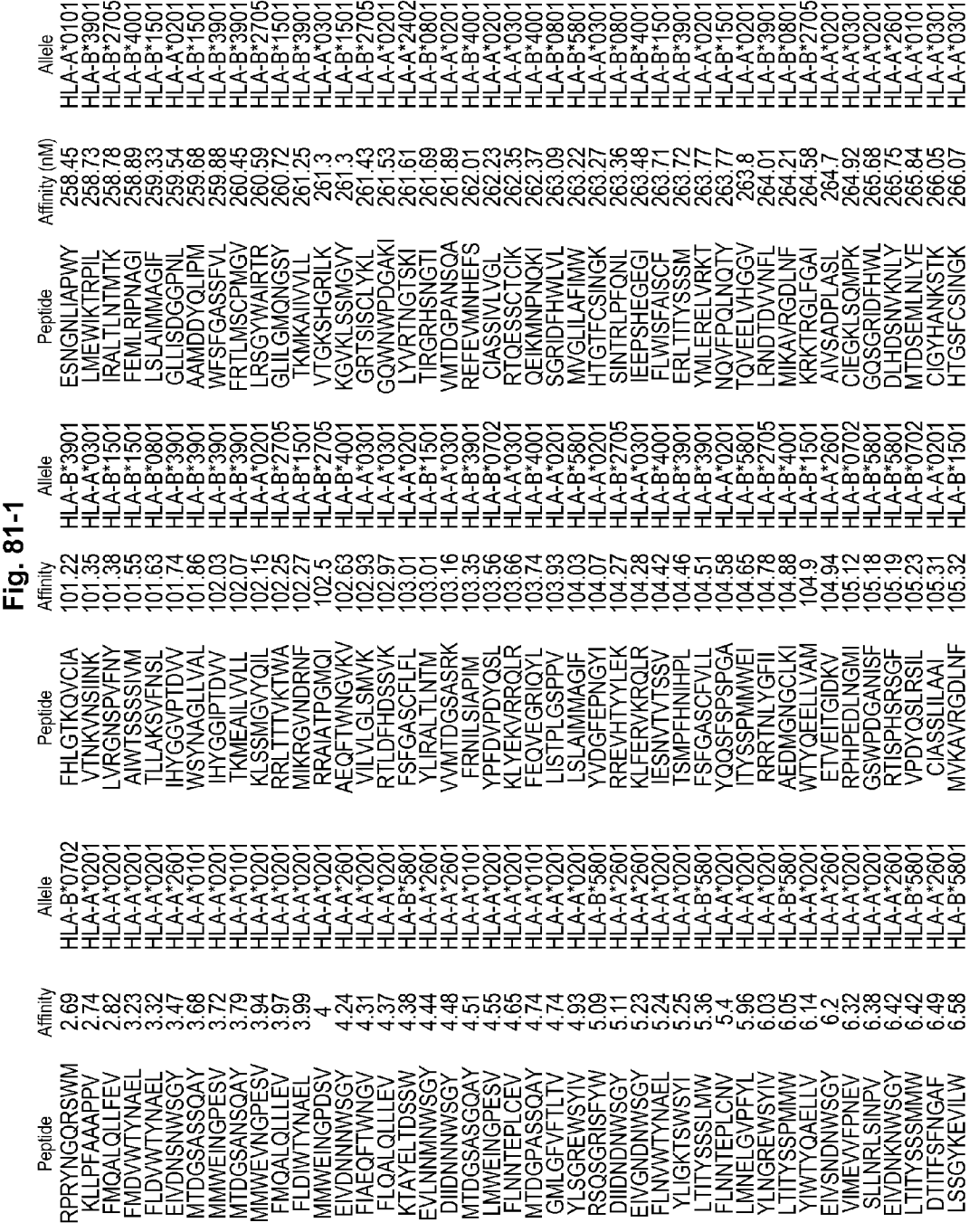
Figures 2, 81:
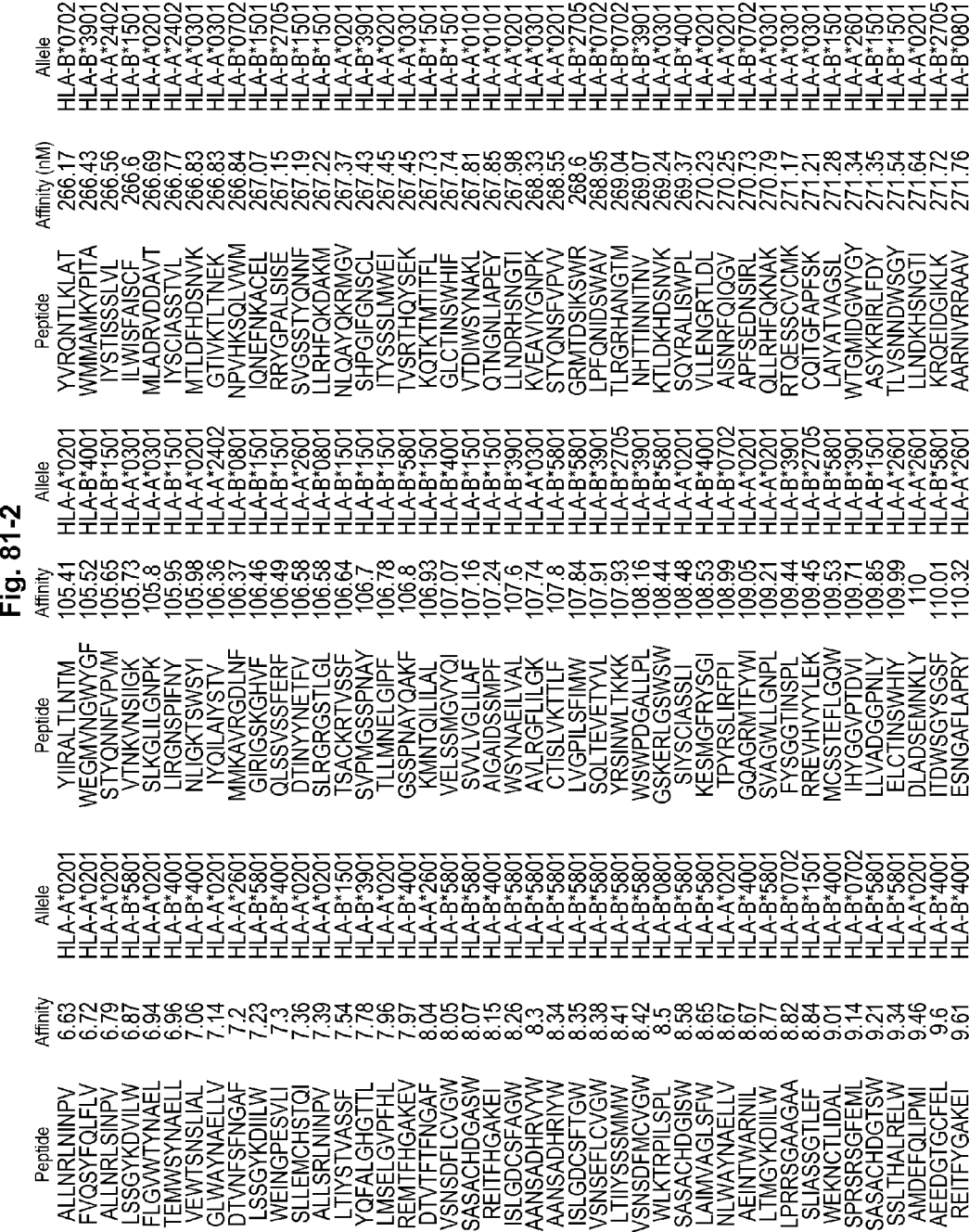
Figures 3, 81:
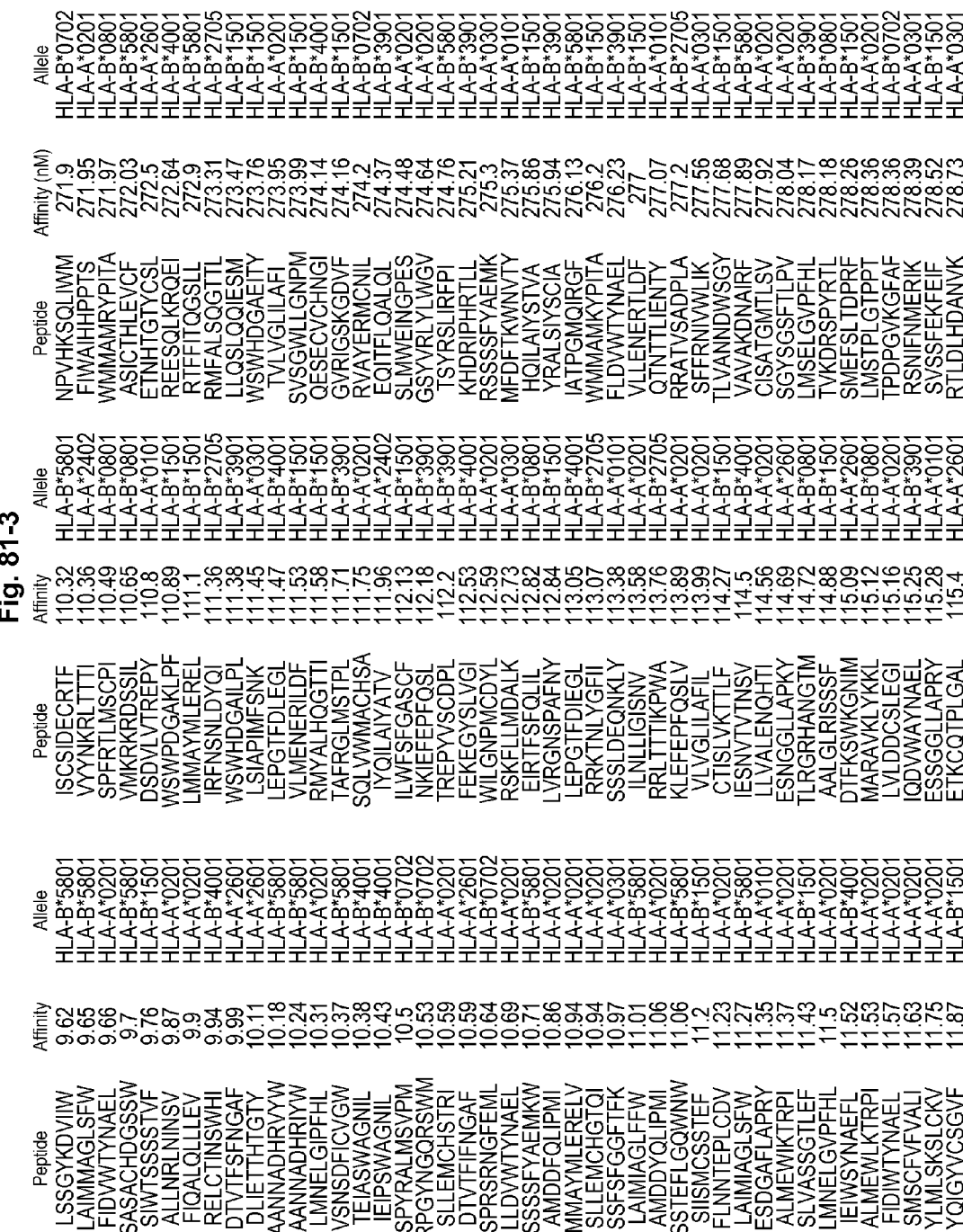
Figures 4, 81:
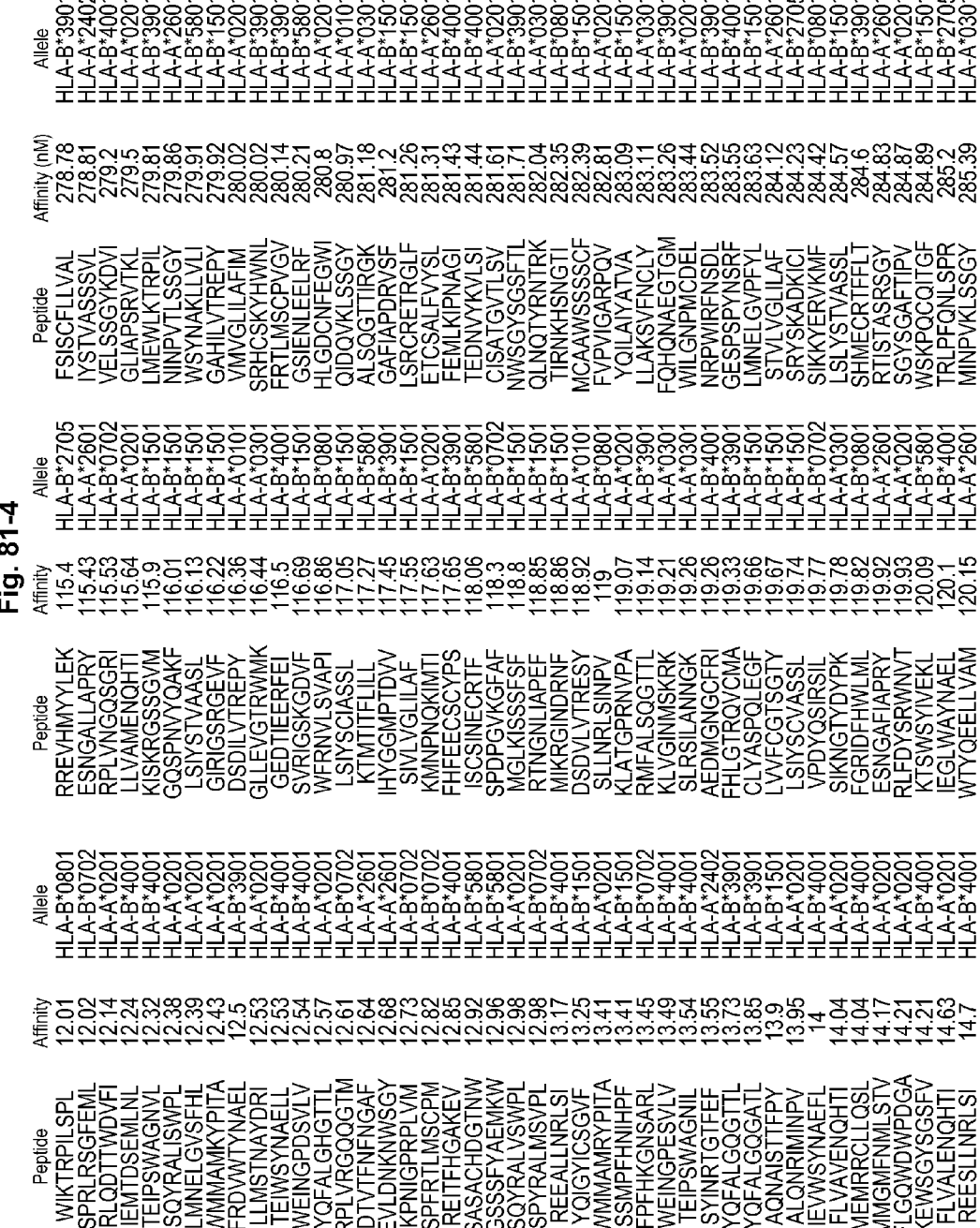
Figures 5, 81:
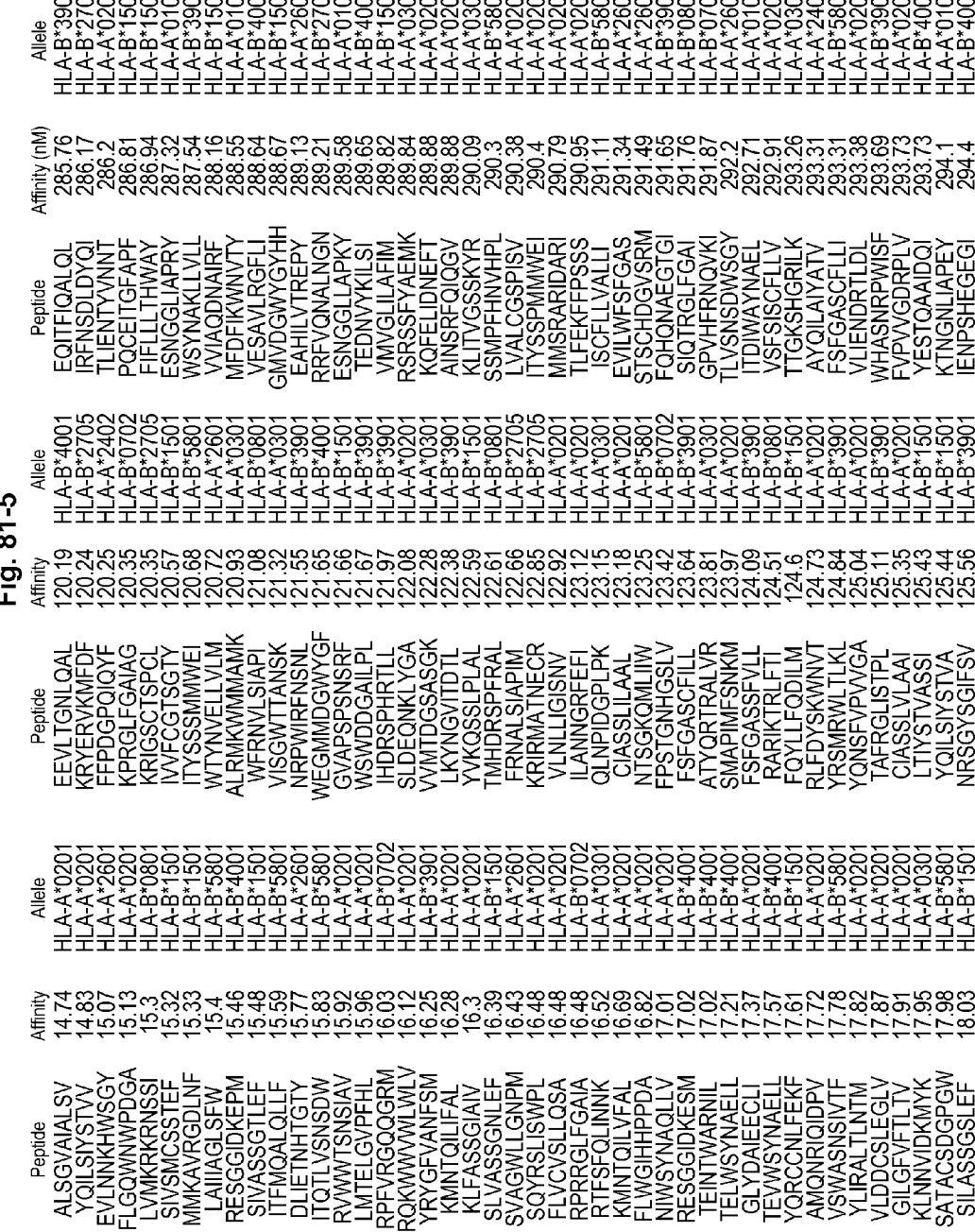
Figures 6, 81:
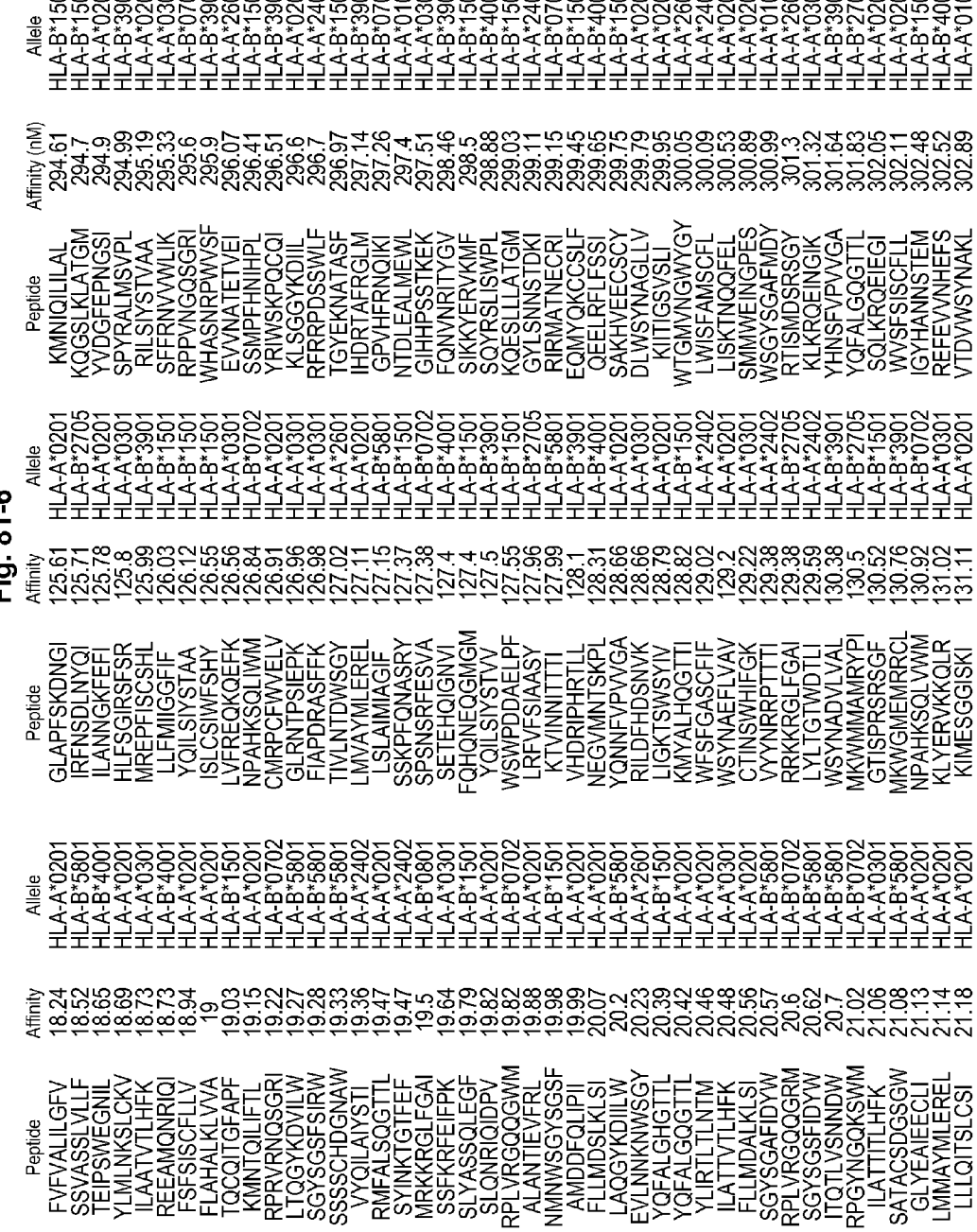
Figures 7, 81:
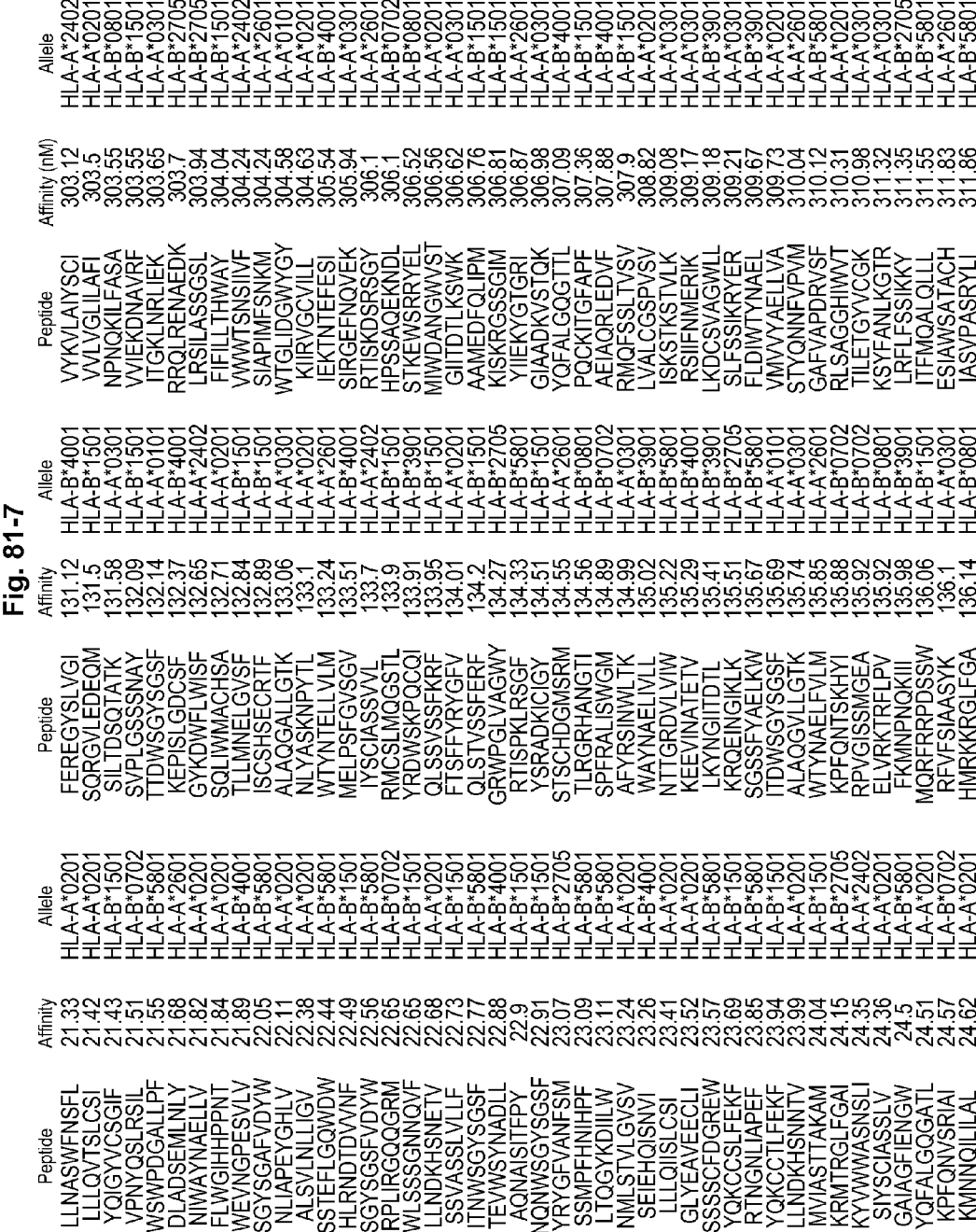
Figures 8, 81:
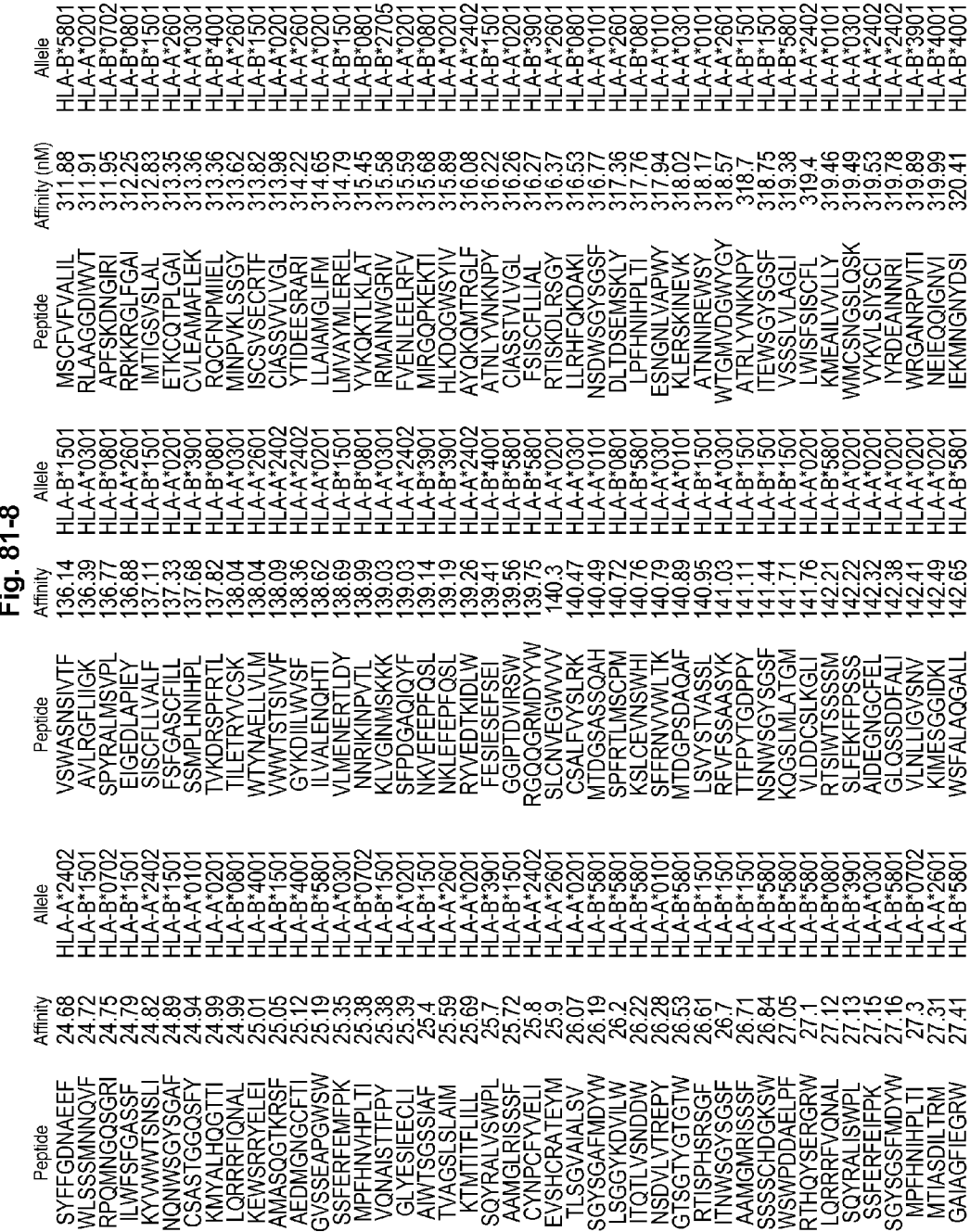
Figures 9, 81:
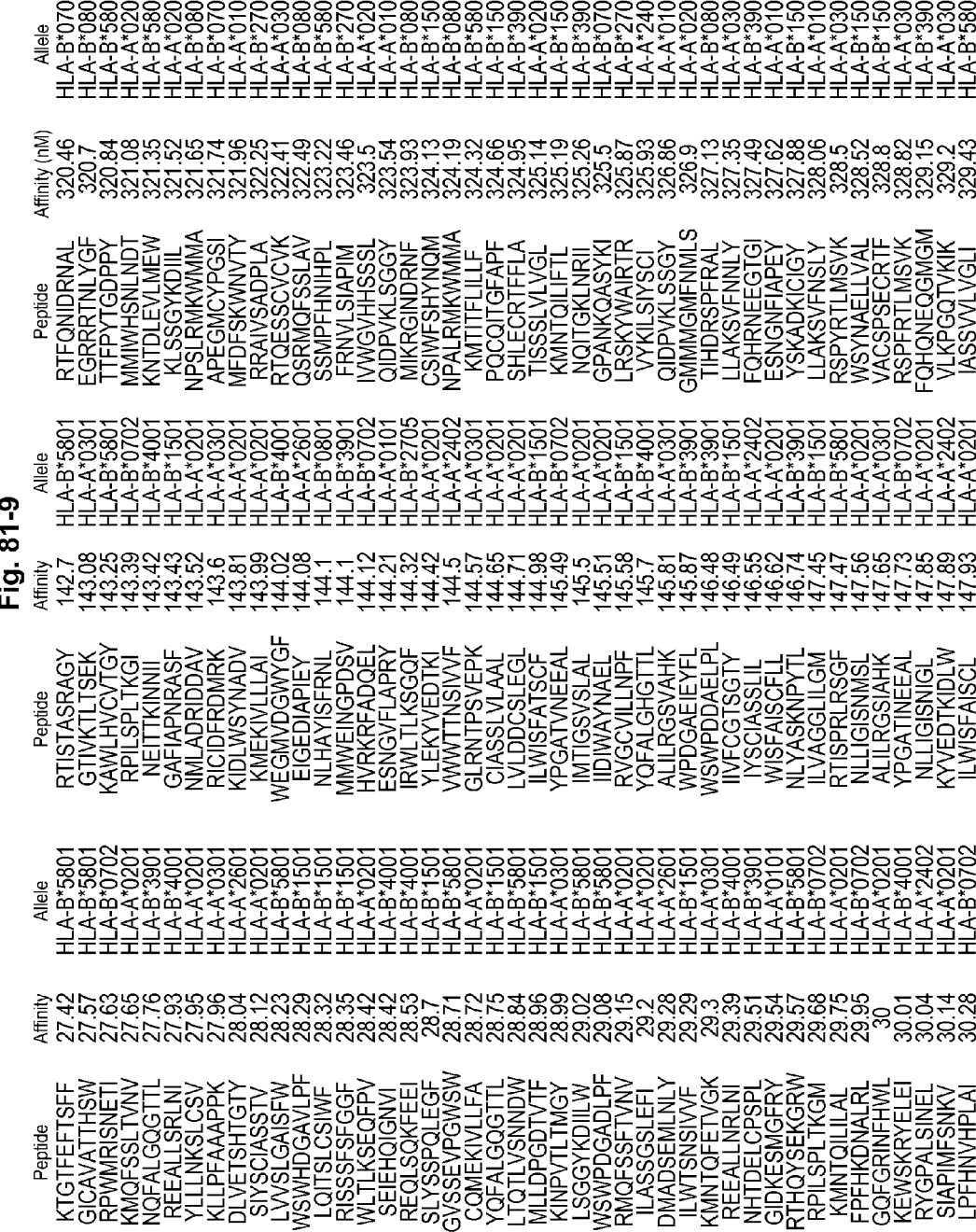
Figures 12, 81:
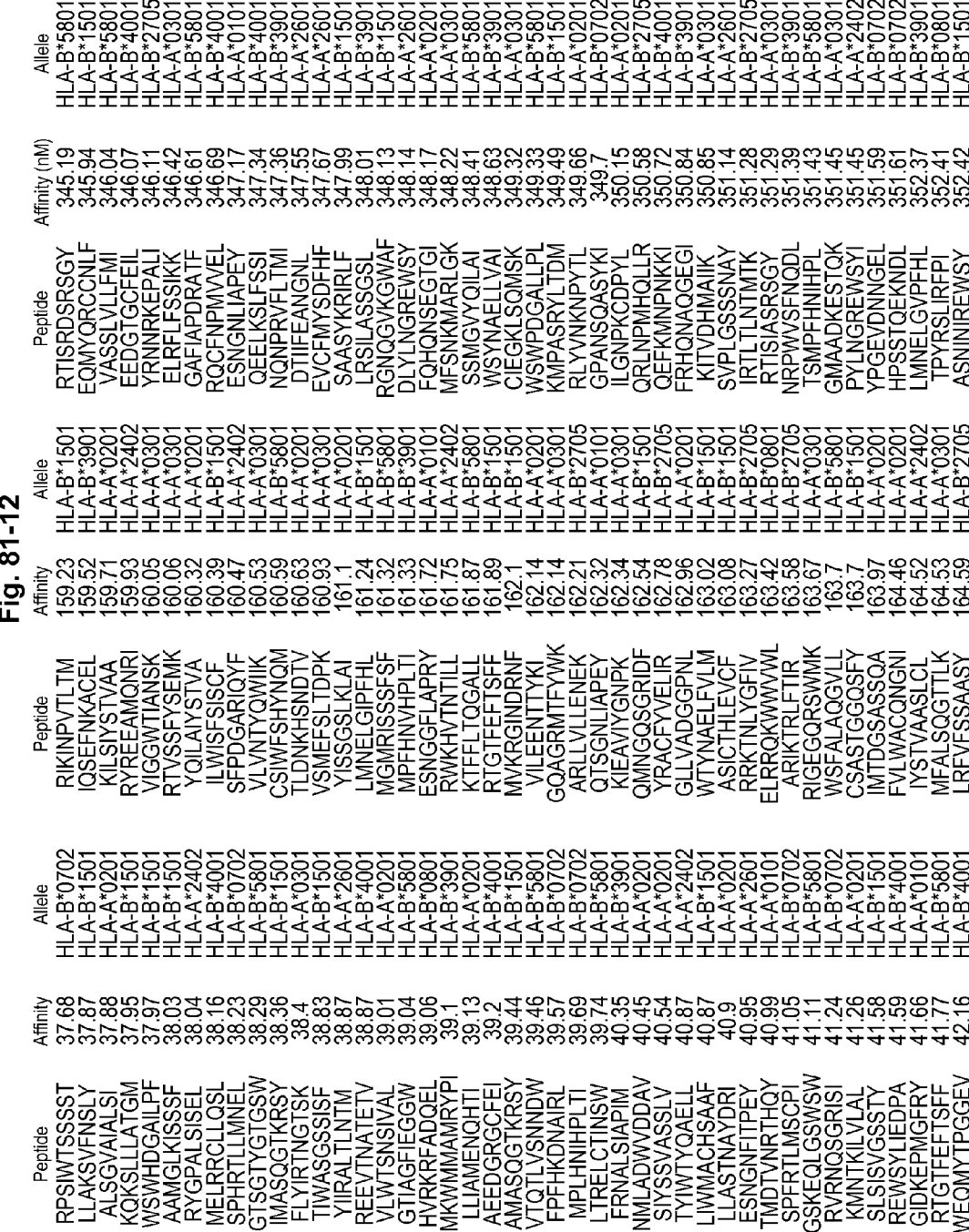
Figures 13, 81:
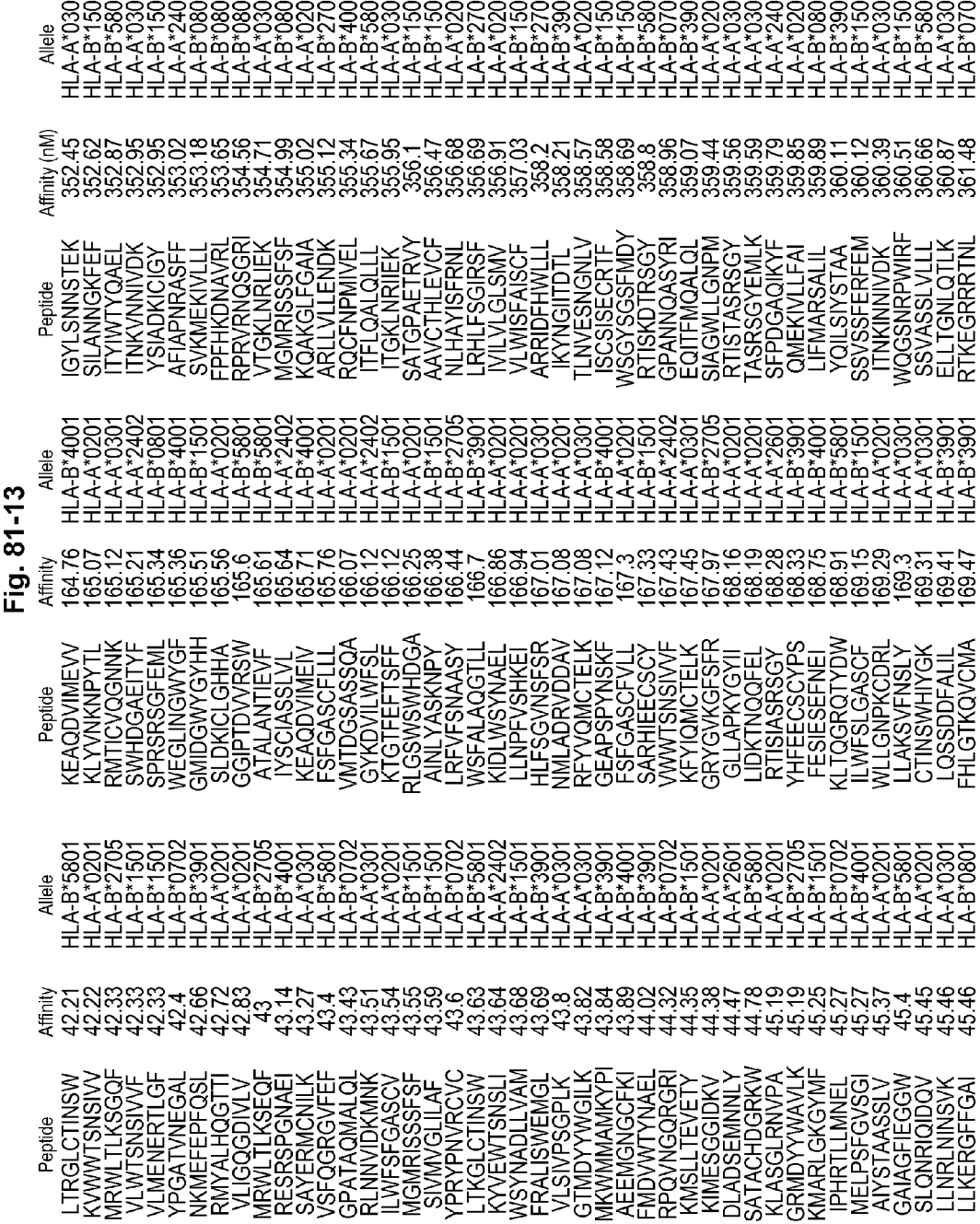
Figures 14, 81:
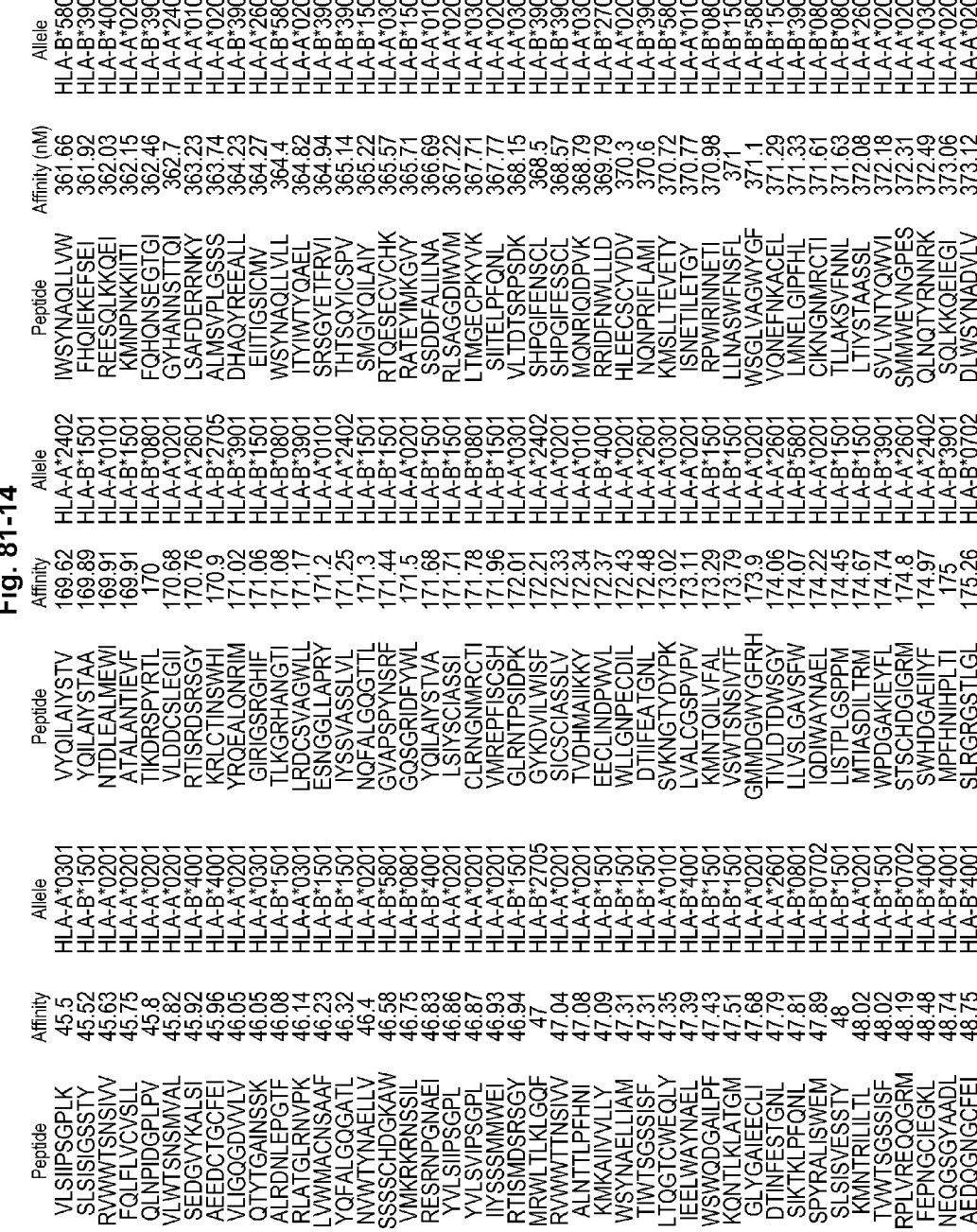
Figures 15, 81:
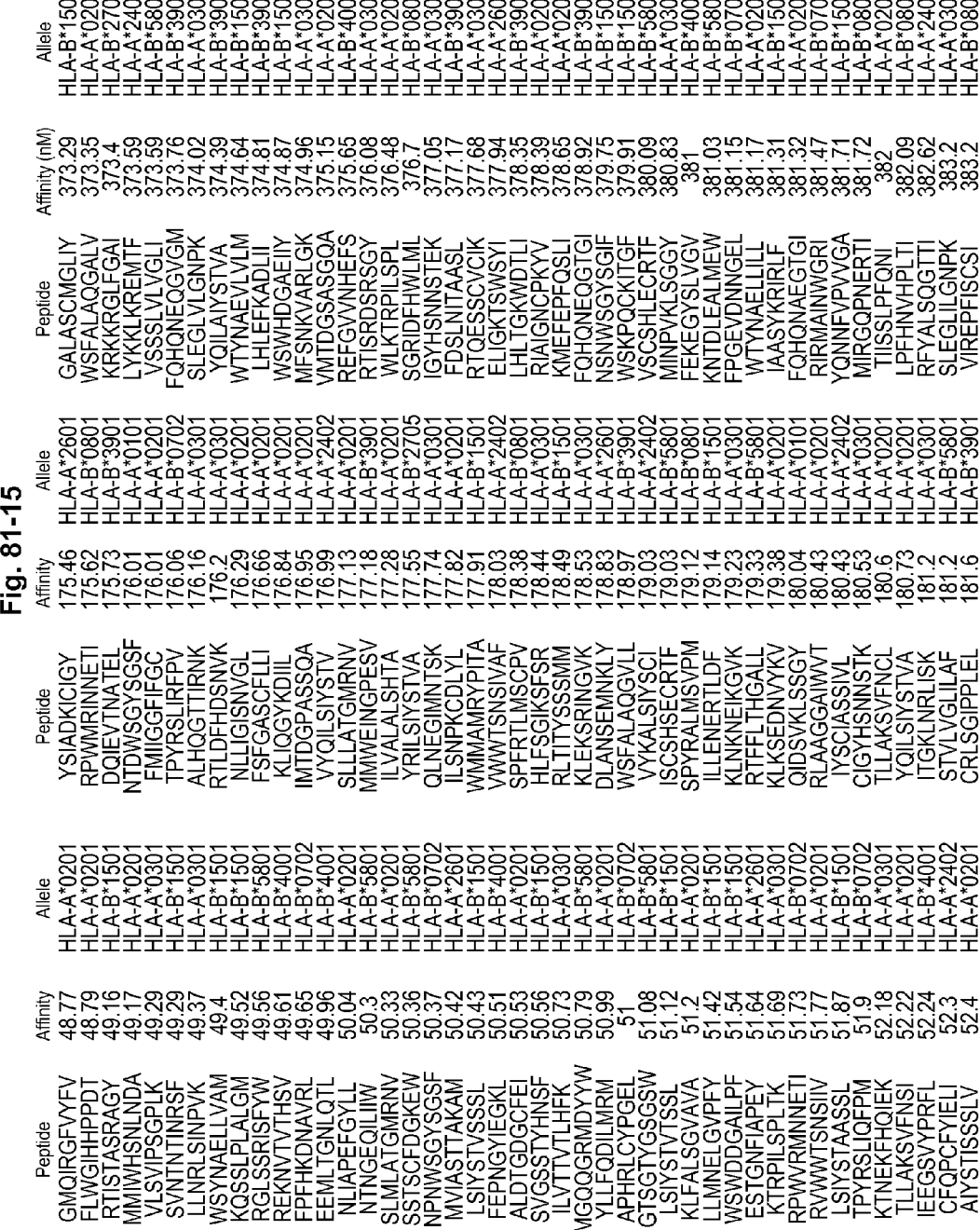
Figures 16, 81:
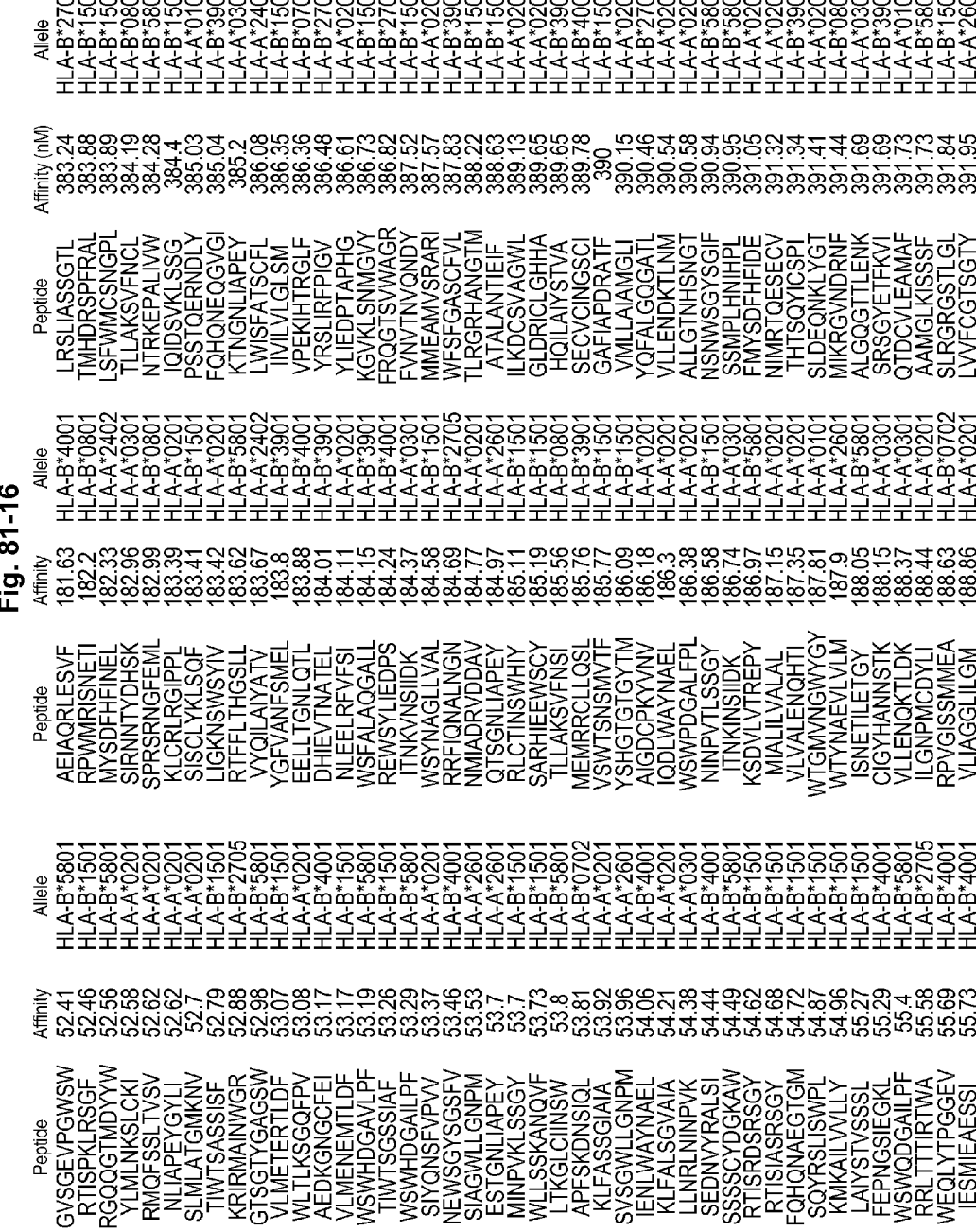
Figures 17, 81:
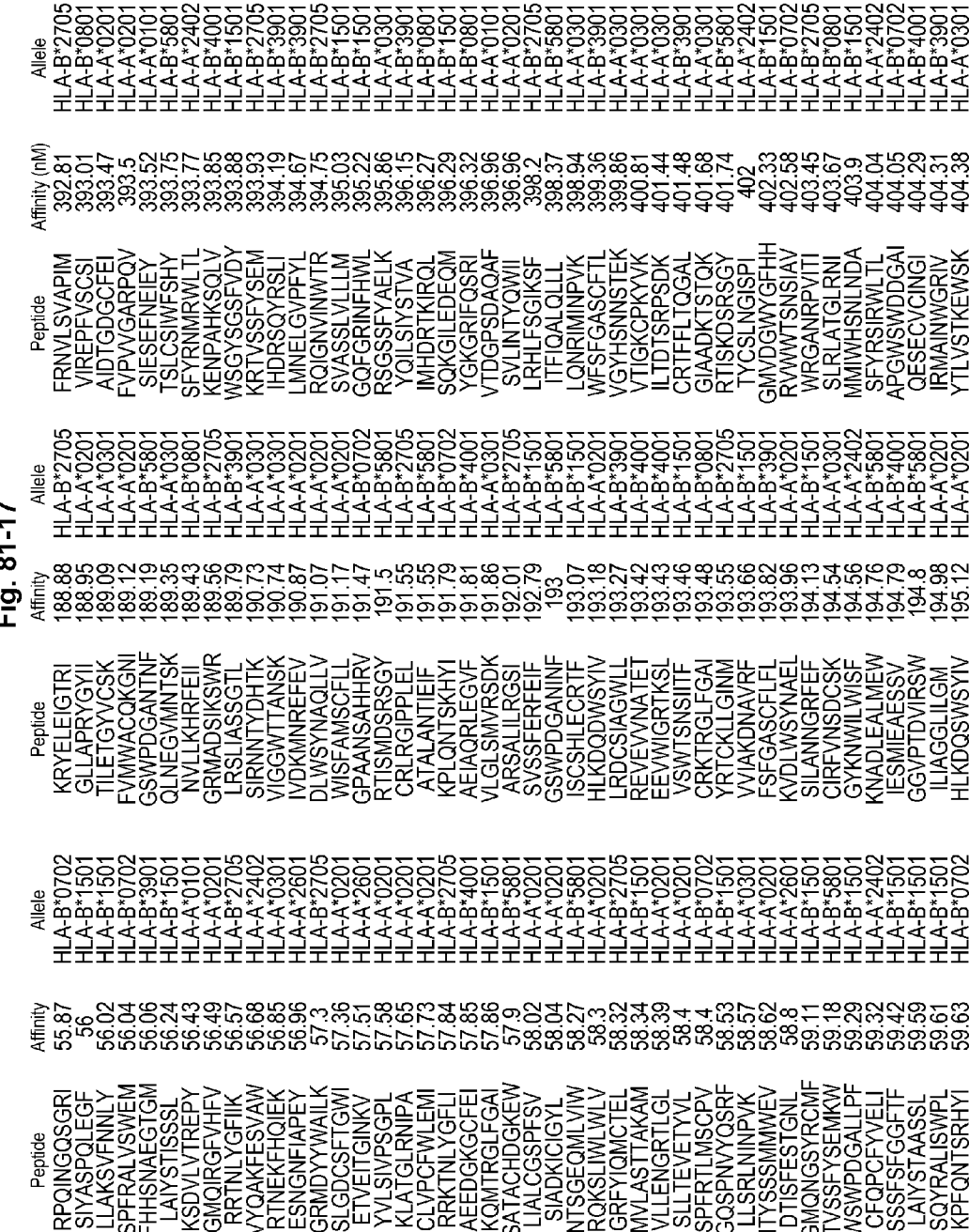
Figures 18, 81:
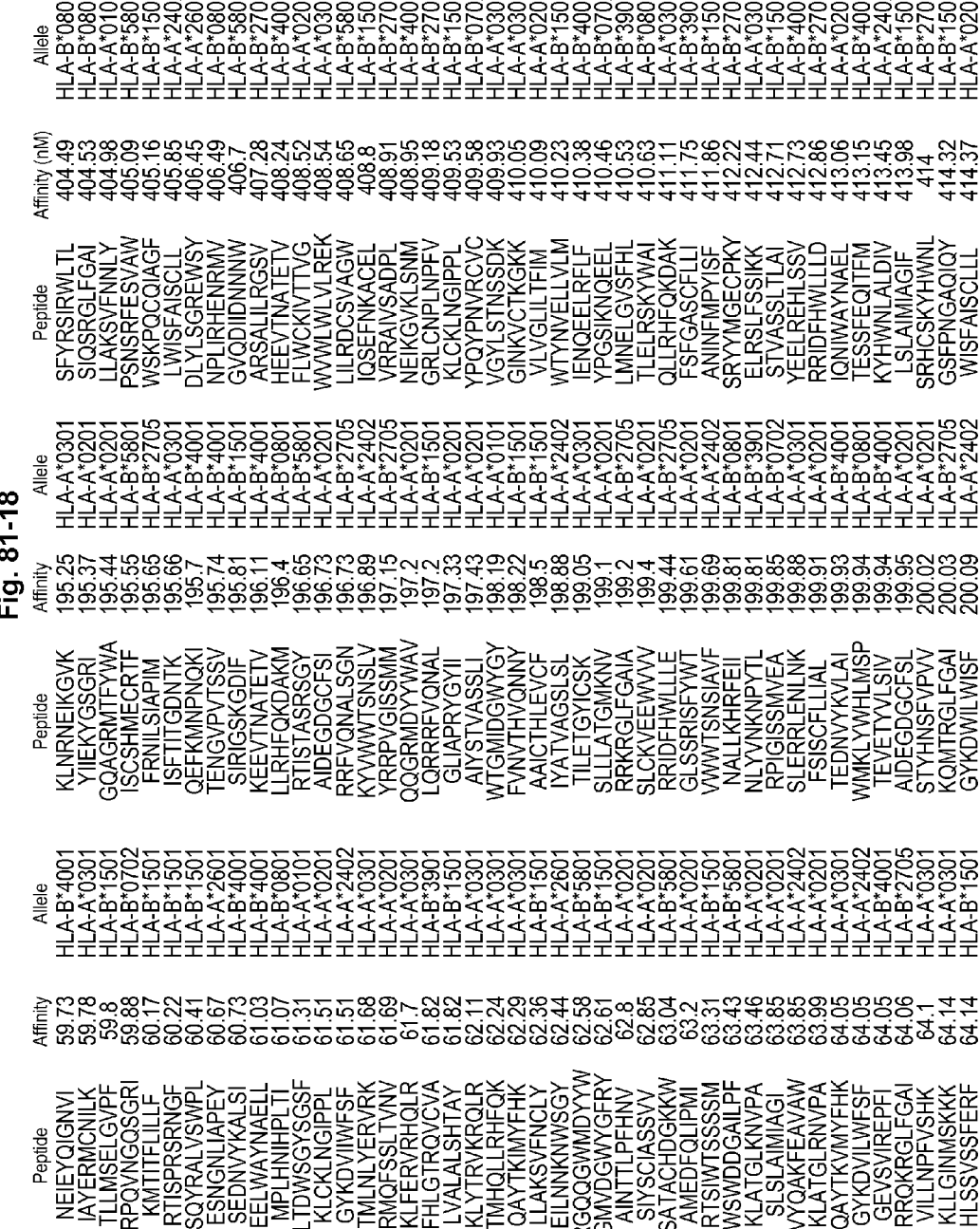
Figures 19, 81:
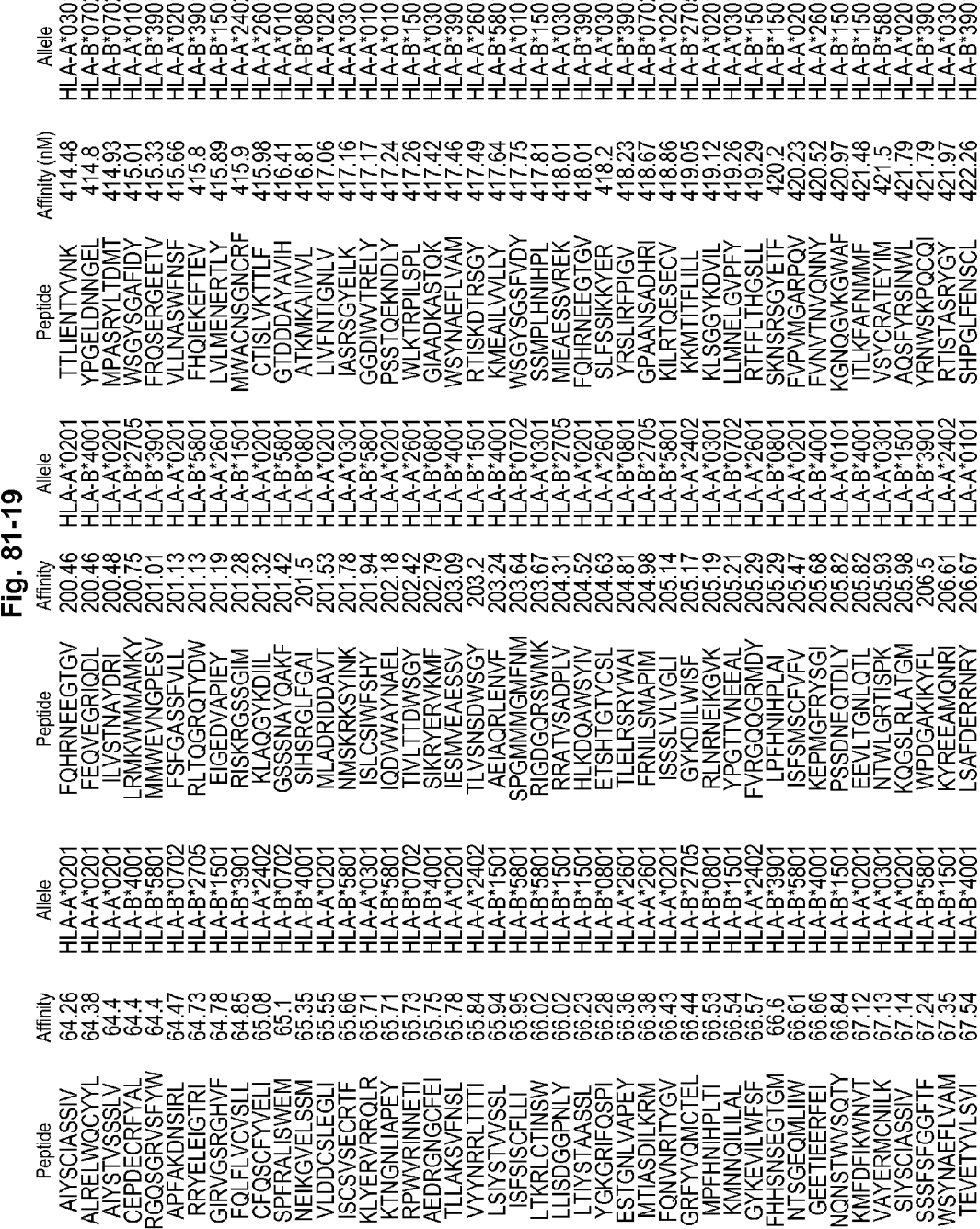
Figures 20, 81:
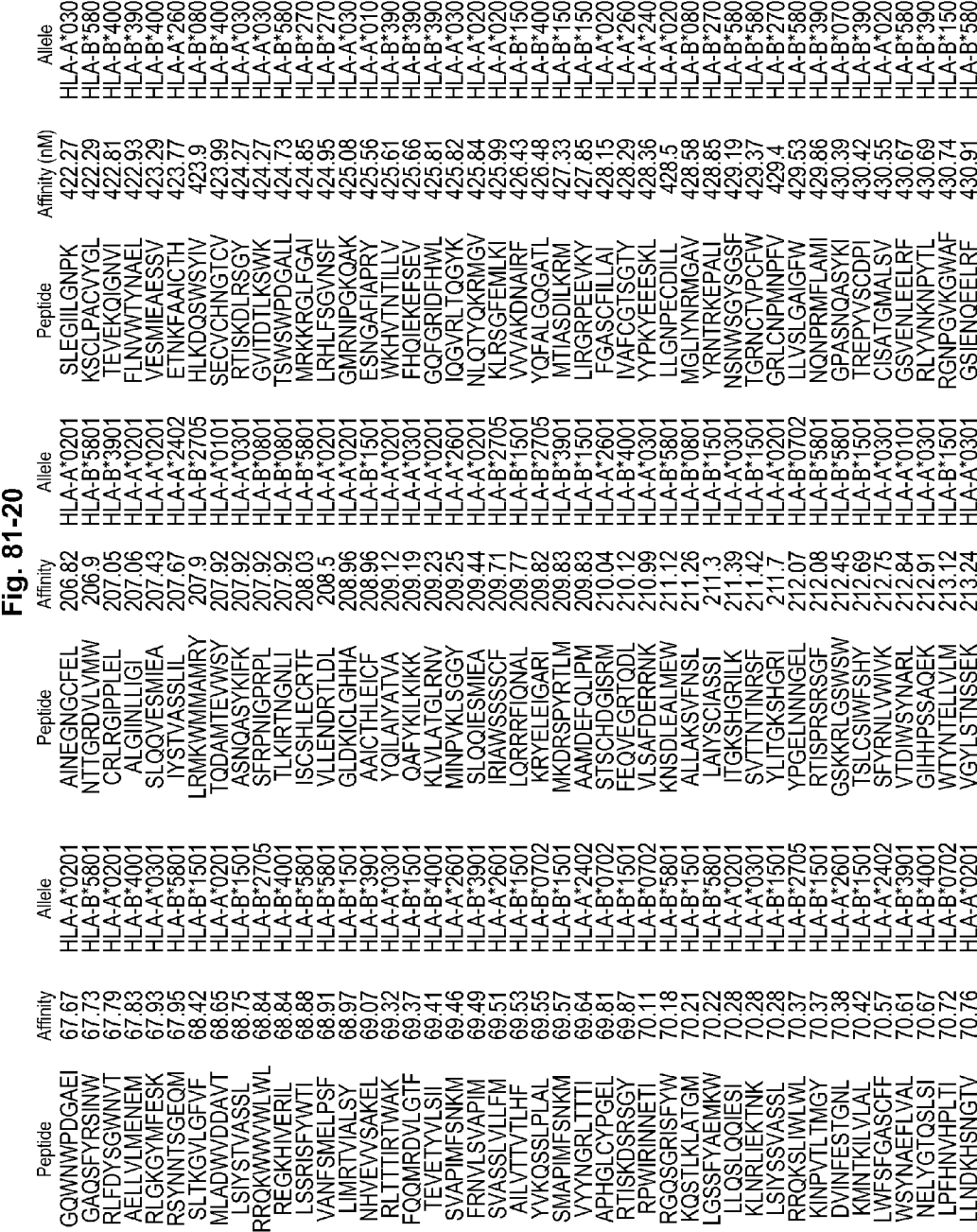
Figures 21, 81:
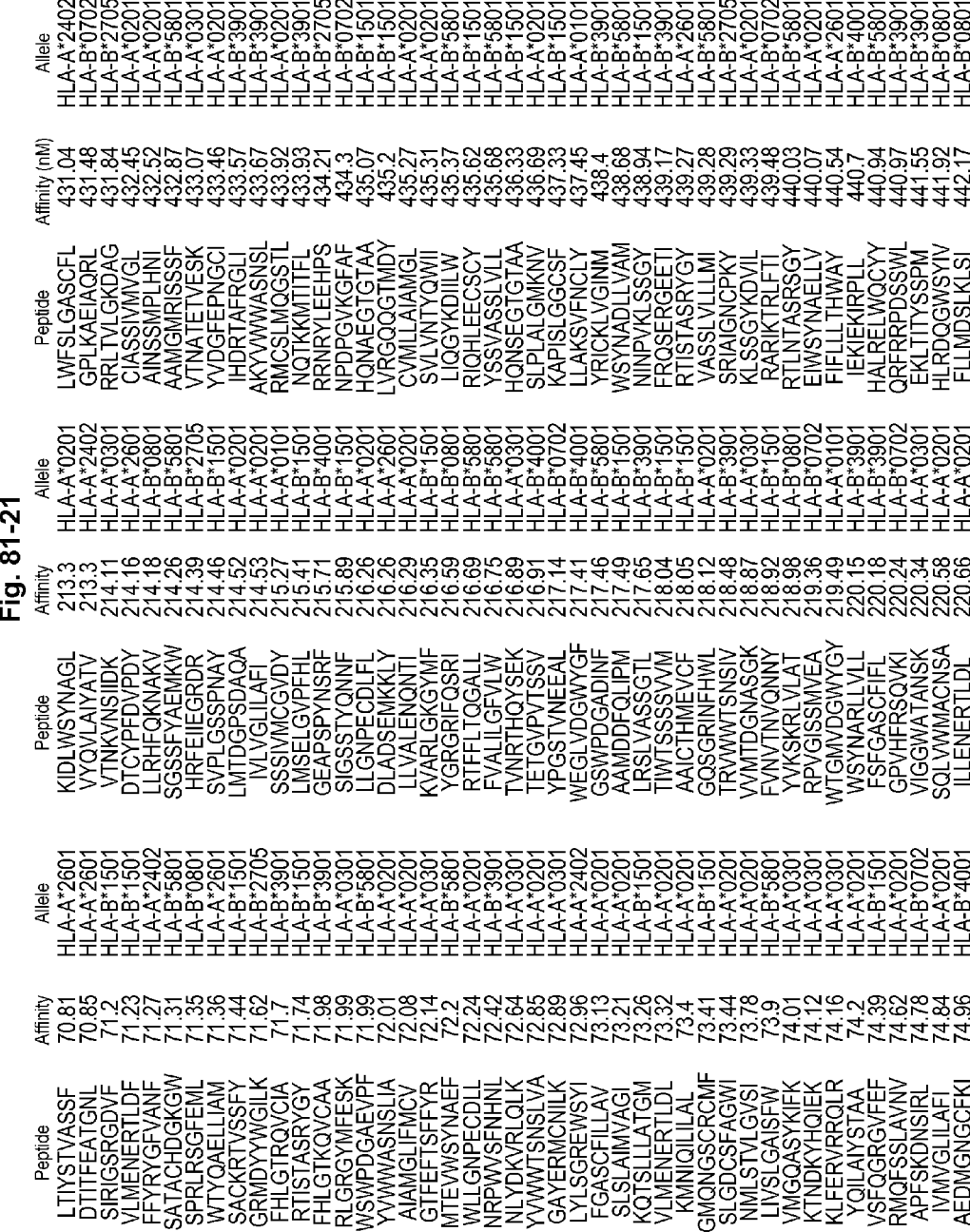
Figures 22, 81:
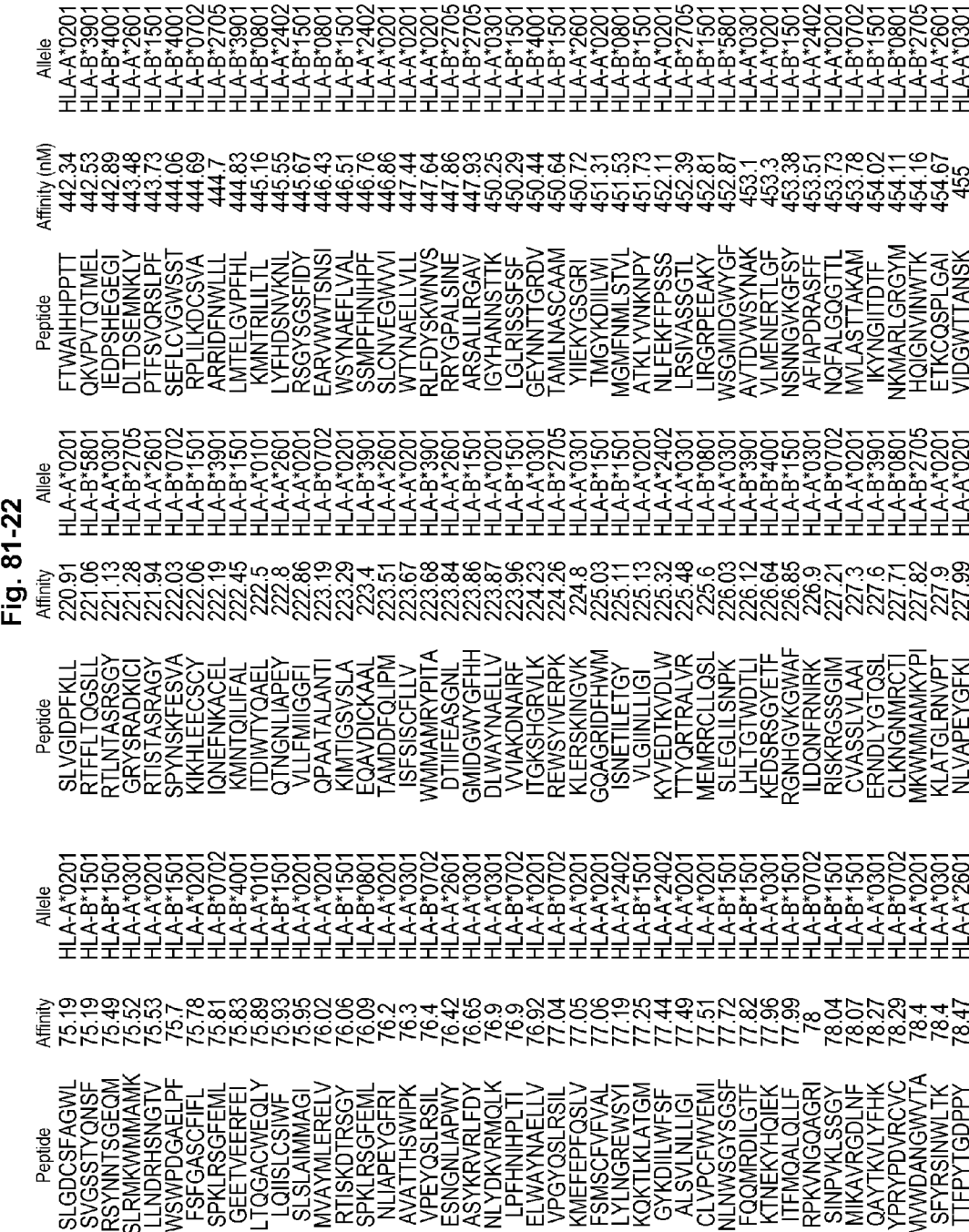
Figures 24, 81:
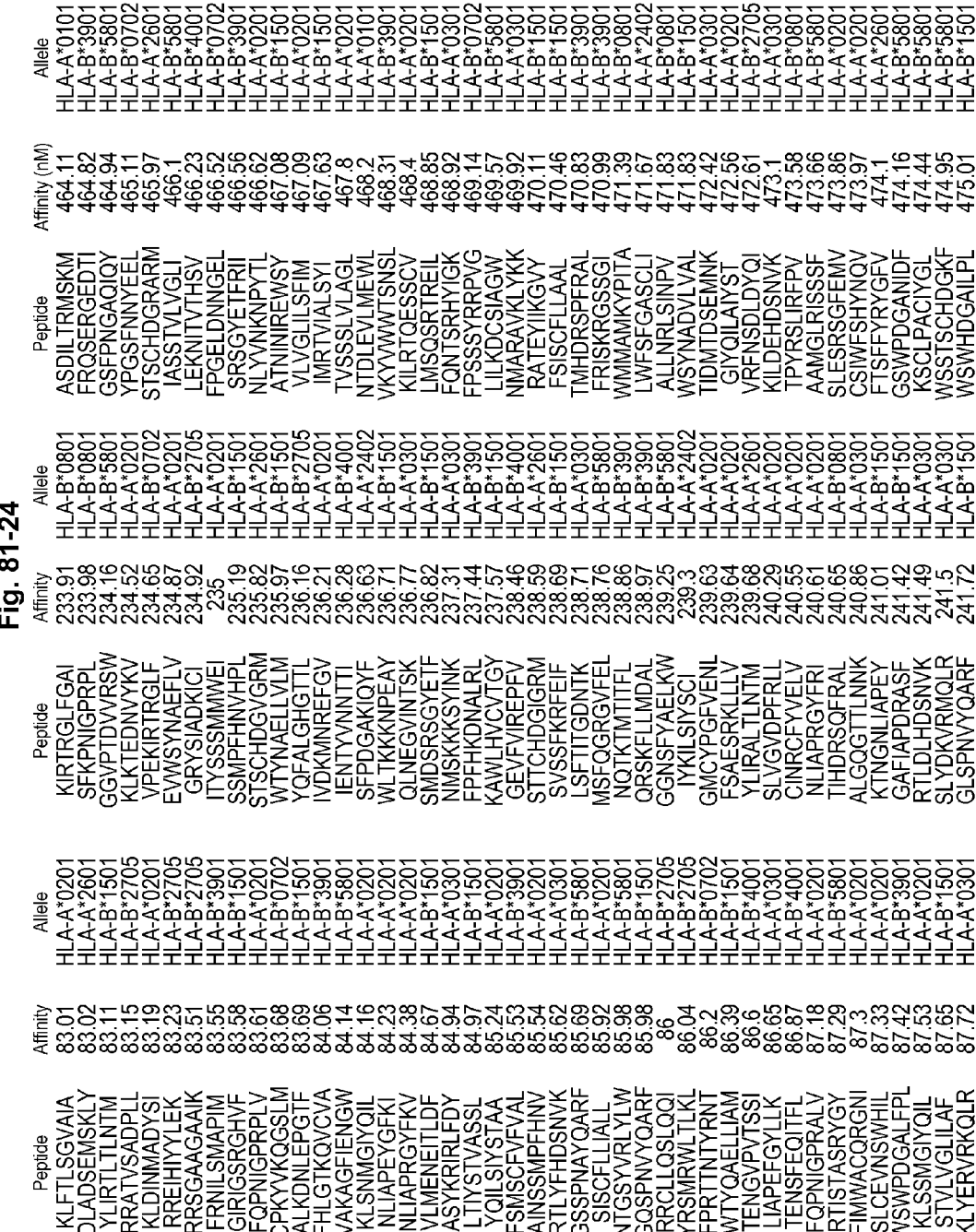
Figures 26, 81:
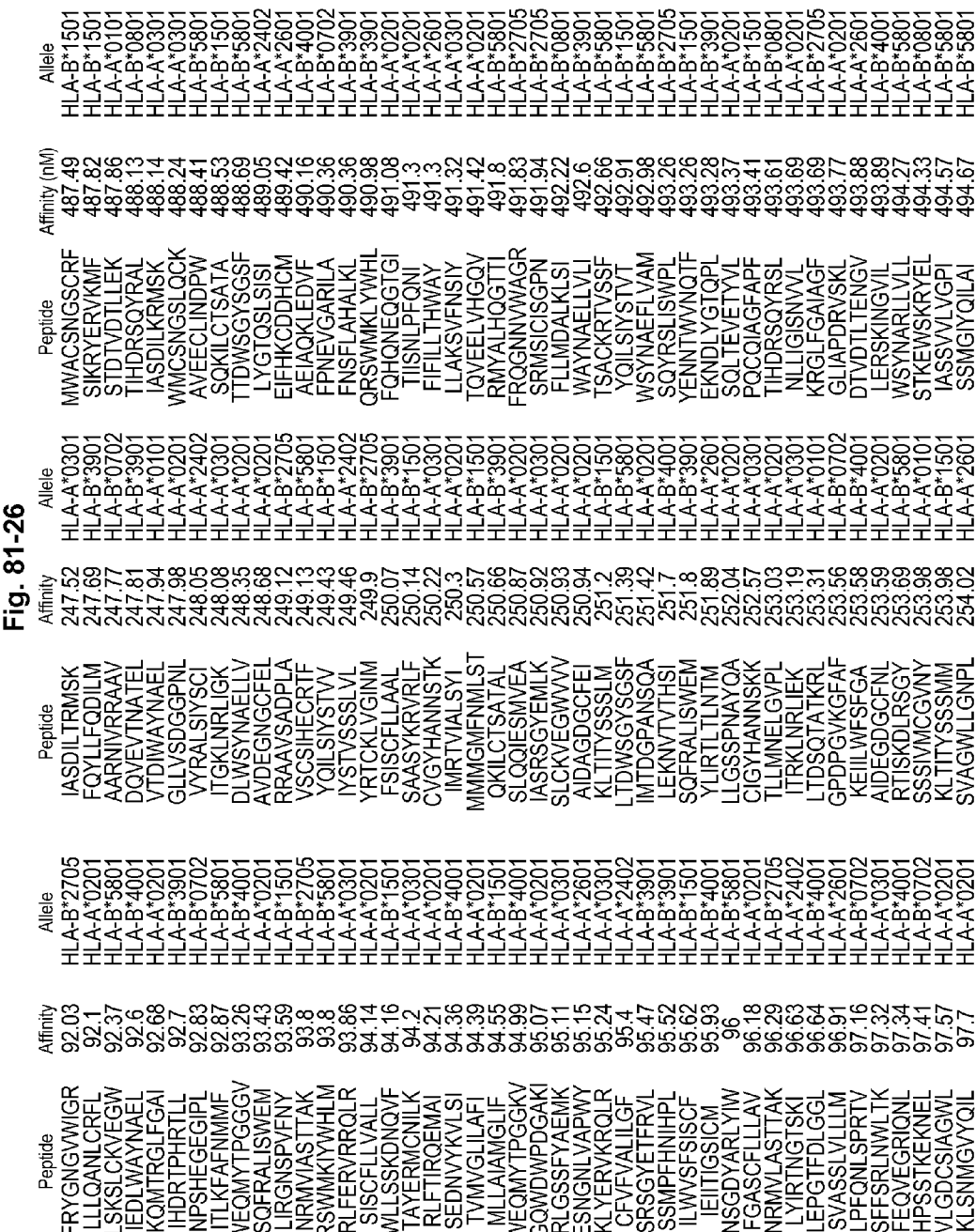

Using the conservation thresholds defined in the Materials and Methods (Example 1), each protein was examined for conservation of blocks. The number and sequences of 8-mer, 9-mer, 10-mer and 11-mer peptides required to "cover 99% of the block" (i.e. to achieve a cumulative fraction of polypeptides in the MSA, by adding together each unique peptide's frequency within the polypeptides in the MSA, of 99%) for each position in the proteome (i.e. starting position of each block) are shown in FIGS. 72-75, for 8-mers, 9-mers, 10-mers and 11-mers, respectively. The peptides from blocks identified as conserved were assembled in peptide strings for 8-mers, 9-mers, 10-mers and 11-mers (FIG. 76). Another set of strings was generated with only up to 5 strings per data set, as shown in FIG. 78, whereas the strings shown in FIG. 76 contain all of the strings needed to cover all of the epitopes found. The strings shown in FIG. 77 omit a total of 6510 epitopes (out of 111016~5.87%) due to variability which prevents them from being inserted in any of the 5 strings.

Sequence and Epitope Data

Binding affinity was predicted for each peptide in blocks of conserved 8-mer, 9-mer, 10-mer, 11-mer influenza virus peptides using NetMHC 3.2 software, as described in the Materials and Methods section (Example 1), above. The sequences of the peptides from the conserved blocks and the binding affinity ($IC_{50}$) (nM) to MHC class I molecules (indicated allele) is shown in FIGS. 78-81.

FIG. 82 shows the number of required peptides to fulfill 99% coverage for each of the found blocks.

FIG. 83 shows all of the epitopes found in the entire analysis. The number of blocks found are summarized below:

Summary

| Blocksize | Number of blocks |
|---|---|
| 8 | 29829 |
| 9 | 28590 |
| 10 | 27203 |
| 11 | 25394 |
| Total | 111016 |

A number of embodiments of the invention have been described. Nevertheless, it will be understood that various modifications may be made without departing from the spirit and scope of the invention. Accordingly, other embodiments are within the scope of the following claims.

SEQUENCE LISTING (544030 sequences)

SEQ ID NO: 1 - protein, 9 aa, Dengue virus
KTFDTEYQK

SEQ ID NO: 2 - protein, 9 aa, Dengue virus
KTFDSEYVK

SEQ ID NO: 3 - protein, 9 aa, Dengue virus
KTFDTEYPK

SEQ ID NO: 4 - protein, 9 aa, Dengue virus
KTFDSEYIK

SEQ ID NO: 5 - protein, 9 aa, Dengue virus
KTFDTEYTK

SEQ ID NO: 6 - protein, 9 aa, Dengue virus
KTFDSEYAK

SEQ ID NO: 7 - protein, 9 aa, Dengue virus
KTFDTEYIK

SEQ ID NO: 8 - protein, 9 aa, Dengue virus
RTFDTEYQK

SEQ ID NO: 9 - protein, 9 aa, Dengue virus
KTFETEYQK

SEQ ID NO: 10 - protein, 9 aa, Dengue virus
KTFDAEYVK

SEQ ID NO: 11 - protein, 9 aa, Dengue virus
KTFNTEYQK

SEQ ID NO: 12 - protein, 9 aa, Dengue virus
KTFDTEYQR

SEQ ID NO: 13 - protein, 9 aa, Dengue virus
KTFDFEYIK

SEQ ID NO: 14 - protein, 4 aa, Artificial Sequence
  Description of Artificial Sequence: Synthetic peptide
RVKR

SEQ ID NO: 15 - protein, 4 aa, Artificial Sequence
  Description of Artificial Sequence: Synthetic peptide
VRVV

SEQ ID NO: 16 - protein, 8 aa, Dengue virus
MNNQRKKT

SEQ ID NO: 17 - protein, 8 aa, Dengue virus
NNQRKKTA

SEQ ID NO: 18 - protein, 8 aa, Dengue virus
NQRKKTAR

SEQ ID NO: 19 - protein, 8 aa, Dengue virus
QRKKTARP

SEQ ID NO: 20 - protein, 8 aa, Dengue virus
RKKTARPS

SEQ ID NO: 21 - protein, 8 aa, Dengue virus
KKTARPSF

SEQ ID NO: 22 - protein, 8 aa, Dengue virus
KTARPSFN

SEQ ID NO: 23 - protein, 8 aa, Dengue virus
TARPSFNM

SEQ ID NO: 24 - protein, 8 aa, Dengue virus
ARPSFNML

SEQ ID NO: 25 - protein, 8 aa, Dengue virus
RPSFNMLK

SEQ ID NO: 26 - protein, 8 aa, Dengue virus
PSFNMLKR

SEQ ID NO: 27 - protein, 8 aa, Dengue virus
SFNMLKRA

SEQ ID NO: 28 - protein, 8 aa, Dengue virus
FNMLKRAR

SEQ ID NO: 29 - protein, 8 aa, Dengue virus
NMLKRARN

SEQ ID NO: 30 - protein, 8 aa, Dengue virus
MLKRARNR

SEQ ID NO: 31 - protein, 8 aa, Dengue virus
LKRARNRV

SEQ ID NO: 32 - protein, 8 aa, Dengue virus
KRARNRVS

SEQ ID NO: 33 - protein, 8 aa, Dengue virus
RARNRVST

SEQ ID NO: 34 - protein, 8 aa, Dengue virus
ARNRVSTV

SEQ ID NO: 35 - protein, 8 aa, Dengue virus
RNRVSTVS

SEQ ID NO: 36 - protein, 8 aa, Dengue virus
NRVSTVSQ

SEQ ID NO: 37 - protein, 8 aa, Dengue virus
RVSTVSQL

SEQ ID NO: 38 - protein, 8 aa, Dengue virus
VSTVSQLA

SEQ ID NO: 39 - protein, 8 aa, Dengue virus
STVSQLAK

SEQ ID NO: 40 - protein, 8 aa, Dengue virus
TVSQLAKR

SEQ ID NO: 41 - protein, 8 aa, Dengue virus
VSQLAKRF

SEQ ID NO: 42 - protein, 8 aa, Dengue virus
SQLAKRFS

SEQ ID NO: 43 - protein, 8 aa, Dengue virus
QLAKRFSK

SEQ ID NO: 44 - protein, 8 aa, Dengue virus
LAKRFSKG

SEQ ID NO: 45 - protein, 8 aa, Dengue virus
AKRFSKGL

SEQ ID NO: 46 - protein, 8 aa, Dengue virus
KRFSKGLL

SEQ ID NO: 47 - protein, 8 aa, Dengue virus
RFSKGLLS

SEQ ID NO: 48 - protein, 8 aa, Dengue virus
FSKGLLSG

SEQ ID NO: 49 - protein, 8 aa, Dengue virus
SKGLLSGQ

SEQ ID NO: 50 - protein, 8 aa, Dengue virus
KGLLSGQG

SEQ ID NO: 51 - protein, 8 aa, Dengue virus
GLLSGQGP

SEQ ID NO: 52 - protein, 8 aa, Dengue virus
LLSGQGPM

SEQ ID NO: 53 - protein, 8 aa, Dengue virus
LSGQGPMK

SEQ ID NO: 54 - protein, 8 aa, Dengue virus
SGQGPMKL

SEQ ID NO: 55 - protein, 8 aa, Dengue virus
GQGPMKLV

SEQ ID NO: 56 - protein, 8 aa, Dengue virus
QGPMKLVM

SEQ ID NO: 57 - protein, 8 aa, Dengue virus
GPMKLVMA

SEQ ID NO: 58 - protein, 8 aa, Dengue virus
PMKLVMAF

SEQ ID NO: 59 - protein, 8 aa, Dengue virus
MKLVMAFI

SEQ ID NO: 60 - protein, 8 aa, Dengue virus
KLVMAFIA

SEQ ID NO: 61 - protein, 8 aa, Dengue virus
LVMAFIAF

SEQ ID NO: 62 - protein, 8 aa, Dengue virus
VMAFIAFL

SEQ ID NO: 63 - protein, 8 aa, Dengue virus
MAFIAFLR

SEQ ID NO: 64 - protein, 8 aa, Dengue virus
AFIAFLRF

SEQ ID NO: 65 - protein, 8 aa, Dengue virus
FIAFLRFL

SEQ ID NO: 66 - protein, 8 aa, Dengue virus
IAFLRFLA

SEQ ID NO: 67 - protein, 8 aa, Dengue virus
AFLRFLAI

SEQ ID NO: 68 - protein, 8 aa, Dengue virus
FLRFLAIP

SEQ ID NO: 69 - protein, 8 aa, Dengue virus
LRFLAIPP

SEQ ID NO: 70 - protein, 8 aa, Dengue virus
RFLAIPPT

SEQ ID NO: 71 - protein, 8 aa, Dengue virus
FLAIPPTA

SEQ ID NO: 72 - protein, 8 aa, Dengue virus
LAIPPTAG

SEQ ID NO: 73 - protein, 8 aa, Dengue virus
AIPPTAGI

SEQ ID NO: 74 - protein, 8 aa, Dengue virus
IPPTAGIL

SEQ ID NO: 75 - protein, 8 aa, Dengue virus
PPTAGILA

SEQ ID NO: 76 - protein, 8 aa, Dengue virus
PTAGILAR

SEQ ID NO: 77 - protein, 8 aa, Dengue virus
TAGILARW

SEQ ID NO: 78 - protein, 8 aa, Dengue virus
AGILARWG

SEQ ID NO: 79 - protein, 8 aa, Dengue virus
GILARWGS

SEQ ID NO: 80 - protein, 8 aa, Dengue virus
ILARWGSF

SEQ ID NO: 81 - protein, 8 aa, Dengue virus
LARWGSFK

SEQ ID NO: 82 - protein, 8 aa, Dengue virus
ARWGSFKK

SEQ ID NO: 83 - protein, 8 aa, Dengue virus
RWGSFKKN

SEQ ID NO: 84 - protein, 8 aa, Dengue virus
WGSFKKNG

SEQ ID NO: 85 - protein, 8 aa, Dengue virus
GSFKKNGA

SEQ ID NO: 86 - protein, 8 aa, Dengue virus
SFKKNGAI

SEQ ID NO: 87 - protein, 8 aa, Dengue virus
FKKNGAIK

SEQ ID NO: 88 - protein, 8 aa, Dengue virus
KKNGAIKV

SEQ ID NO: 89 - protein, 8 aa, Dengue virus
KNGAIKVL

SEQ ID NO: 90 - protein, 8 aa, Dengue virus
NGAIKVLR

SEQ ID NO: 91 - protein, 8 aa, Dengue virus
GAIKVLRG

SEQ ID NO: 92 - protein, 8 aa, Dengue virus
AIKVLRGF

SEQ ID NO: 93 - protein, 8 aa, Dengue virus
IKVLRGFK

SEQ ID NO: 94 - protein, 8 aa, Dengue virus
KVLRGFKK

SEQ ID NO: 95 - protein, 8 aa, Dengue virus
VLRGFKKE

SEQ ID NO: 96 - protein, 8 aa, Dengue virus
LRGFKKEI

SEQ ID NO: 97 - protein, 8 aa, Dengue virus
RGFKKEIS

SEQ ID NO: 98 - protein, 8 aa, Dengue virus
GFKKEISN

SEQ ID NO: 99 - protein, 8 aa, Dengue virus
FKKEISNM

SEQ ID NO: 100 - protein, 8 aa, Dengue virus
KKEISNML

SEQ ID NO: 101 - protein, 8 aa, Dengue virus
KEISNMLN

SEQ ID NO: 102 - protein, 8 aa, Dengue virus
EISNMLNI

SEQ ID NO: 103 - protein, 8 aa, Dengue virus
MLNIMNRR

SEQ ID NO: 104 - protein, 8 aa, Dengue virus
LNIMNRRK

SEQ ID NO: 105 - protein, 8 aa, Dengue virus
MNRRKRSV

SEQ ID NO: 106 - protein, 8 aa, Dengue virus
NRRKRSVT

SEQ ID NO: 107 - protein, 8 aa, Dengue virus
RRKRSVTM

SEQ ID NO: 108 - protein, 8 aa, Dengue virus
RKRSVTML

SEQ ID NO: 109 - protein, 8 aa, Dengue virus
KRSVTMLL

SEQ ID NO: 110 - protein, 8 aa, Dengue virus
RSVTMLLM

SEQ ID NO: 111 - protein, 8 aa, Dengue virus
SVTMLLML

SEQ ID NO: 112 - protein, 8 aa, Dengue virus
PTALAFHL

SEQ ID NO: 113 - protein, 8 aa, Dengue virus
TALAFHLT

SEQ ID NO: 114 - protein, 8 aa, Dengue virus
ALAFHLTT

SEQ ID NO: 115 - protein, 8 aa, Dengue virus
LAFHLTTR

SEQ ID NO: 116 - protein, 8 aa, Dengue virus
AFHLTTRG

SEQ ID NO: 117 - protein, 8 aa, Dengue virus
FHLTTRGG

SEQ ID NO: 118 - protein, 8 aa, Dengue virus
HLTTRGGE

SEQ ID NO: 119 - protein, 8 aa, Dengue virus
LTTRGGEP

SEQ ID NO: 120 - protein, 8 aa, Dengue virus
TTRGGEPH

SEQ ID NO: 121 - protein, 8 aa, Dengue virus
TRGGEPHM

SEQ ID NO: 122 - protein, 8 aa, Dengue virus
RGGEPHMI

SEQ ID NO: 123 - protein, 8 aa, Dengue virus
GGEPHMIV

SEQ ID NO: 124 - protein, 8 aa, Dengue virus
GEPHMIVS

SEQ ID NO: 125 - protein, 8 aa, Dengue virus
EPHMIVSK

SEQ ID NO: 126 - protein, 8 aa, Dengue virus
PHMIVSKQ

SEQ ID NO: 127 - protein, 8 aa, Dengue virus
HMIVSKQE

SEQ ID NO: 128 - protein, 8 aa, Dengue virus
MIVSKQER

SEQ ID NO: 129 - protein, 8 aa, Dengue virus
IVSKQERG

SEQ ID NO: 130 - protein, 8 aa, Dengue virus
VSKQERGK

SEQ ID NO: 131 - protein, 8 aa, Dengue virus
SKQERGKS

SEQ ID NO: 132 - protein, 8 aa, Dengue virus
KQERGKSL

SEQ ID NO: 133 - protein, 8 aa, Dengue virus
QERGKSLL

SEQ ID NO: 134 - protein, 8 aa, Dengue virus
ERGKSLLF

SEQ ID NO: 135 - protein, 8 aa, Dengue virus
RGKSLLFK

SEQ ID NO: 136 - protein, 8 aa, Dengue virus
GKSLLFKT

SEQ ID NO: 137 - protein, 8 aa, Dengue virus
KSLLFKTS

SEQ ID NO: 138 - protein, 8 aa, Dengue virus
SLLFKTSA

SEQ ID NO: 139 - protein, 8 aa, Dengue virus
LLFKTSAG

SEQ ID NO: 140 - protein, 8 aa, Dengue virus
LFKTSAGV

SEQ ID NO: 141 - protein, 8 aa, Dengue virus
FKTSAGVN

SEQ ID NO: 142 - protein, 8 aa, Dengue virus
KTSAGVNM

SEQ ID NO: 143 - protein, 8 aa, Dengue virus
TSAGVNMC

SEQ ID NO: 144 - protein, 8 aa, Dengue virus
SAGVNMCT

SEQ ID NO: 145 - protein, 8 aa, Dengue virus
AGVNMCTL

SEQ ID NO: 146 - protein, 8 aa, Dengue virus
GVNMCTLI

SEQ ID NO: 147 - protein, 8 aa, Dengue virus
VNMCTLIA

SEQ ID NO: 148 - protein, 8 aa, Dengue virus
NMCTLIAM

SEQ ID NO: 149 - protein, 8 aa, Dengue virus
MCTLIAMD

SEQ ID NO: 150 - protein, 8 aa, Dengue virus
CTLIAMDL

SEQ ID NO: 151 - protein, 8 aa, Dengue virus
TLIAMDLG

SEQ ID NO: 152 - protein, 8 aa, Dengue virus
LIAMDLGE

SEQ ID NO: 153 - protein, 8 aa, Dengue virus
IAMDLGEL

SEQ ID NO: 154 - protein, 8 aa, Dengue virus
AMDLGELC

SEQ ID NO: 155 - protein, 8 aa, Dengue virus
MDLGELCE

SEQ ID NO: 156 - protein, 8 aa, Dengue virus
DLGELCED

SEQ ID NO: 157 - protein, 8 aa, Dengue virus
LGELCEDT

SEQ ID NO: 158 - protein, 8 aa, Dengue virus
GELCEDTM

SEQ ID NO: 159 - protein, 8 aa, Dengue virus
ELCEDTMT

SEQ ID NO: 160 - protein, 8 aa, Dengue virus
LCEDTMTY

SEQ ID NO: 161 - protein, 8 aa, Dengue virus
CEDTMTYK

SEQ ID NO: 162 - protein, 8 aa, Dengue virus
EDTMTYKC

SEQ ID NO: 163 - protein, 8 aa, Dengue virus
DTMTYKCP

SEQ ID NO: 164 - protein, 8 aa, Dengue virus
TMTYKCPR

SEQ ID NO: 165 - protein, 8 aa, Dengue virus
MTYKCPRI

SEQ ID NO: 166 - protein, 8 aa, Dengue virus
TYKCPRIT

SEQ ID NO: 167 - protein, 8 aa, Dengue virus
YKCPRITE

SEQ ID NO: 168 - protein, 8 aa, Dengue virus
KCPRITEA

SEQ ID NO: 169 - protein, 8 aa, Dengue virus
CPRITEAE

SEQ ID NO: 170 - protein, 8 aa, Dengue virus
PRITEAEP

SEQ ID NO: 171 - protein, 8 aa, Dengue virus
RITEAEPD

SEQ ID NO: 172 - protein, 8 aa, Dengue virus
ITEAEPDD

SEQ ID NO: 173 - protein, 8 aa, Dengue virus
TEAEPDDV

SEQ ID NO: 174 - protein, 8 aa, Dengue virus
EAEPDDVD

SEQ ID NO: 175 - protein, 8 aa, Dengue virus
AEPDDVDC

SEQ ID NO: 176 - protein, 8 aa, Dengue virus
EPDDVDCW

SEQ ID NO: 177 - protein, 8 aa, Dengue virus
PDDVDCWC

SEQ ID NO: 178 - protein, 8 aa, Dengue virus
DDVDCWCN

SEQ ID NO: 179 - protein, 8 aa, Dengue virus
DVDCWCNA

SEQ ID NO: 180 - protein, 8 aa, Dengue virus
VDCWCNAT

SEQ ID NO: 181 - protein, 8 aa, Dengue virus
DCWCNATD

SEQ ID NO: 182 - protein, 8 aa, Dengue virus
CWCNATDT

SEQ ID NO: 183 - protein, 8 aa, Dengue virus
WCNATDTW

SEQ ID NO: 184 - protein, 8 aa, Dengue virus
CNATDTWV

SEQ ID NO: 185 - protein, 8 aa, Dengue virus
NATDTWVT

SEQ ID NO: 186 - protein, 8 aa, Dengue virus
ATDTWVTY

SEQ ID NO: 187 - protein, 8 aa, Dengue virus
TDTWVTYG

SEQ ID NO: 188 - protein, 8 aa, Dengue virus
DTWVTYGT

SEQ ID NO: 189 - protein, 8 aa, Dengue virus
TWVTYGTC

SEQ ID NO: 190 - protein, 8 aa, Dengue virus
WVTYGTCS

SEQ ID NO: 191 - protein, 8 aa, Dengue virus
VTYGTCSQ

SEQ ID NO: 192 - protein, 8 aa, Dengue virus
TYGTCSQT

SEQ ID NO: 193 - protein, 8 aa, Dengue virus
YGTCSQTG

SEQ ID NO: 194 - protein, 8 aa, Dengue virus
GTCSQTGE

SEQ ID NO: 195 - protein, 8 aa, Dengue virus
TCSQTGEH

SEQ ID NO: 196 - protein, 8 aa, Dengue virus
CSQTGEHR

SEQ ID NO: 197 - protein, 8 aa, Dengue virus
SQTGEHRR

SEQ ID NO: 198 - protein, 8 aa, Dengue virus
QTGEHRRD

SEQ ID NO: 199 - protein, 8 aa, Dengue virus
TGEHRRDK

SEQ ID NO: 200 - protein, 8 aa, Dengue virus
GEHRRDKR

SEQ ID NO: 201 - protein, 8 aa, Dengue virus
EHRRDKRS

SEQ ID NO: 202 - protein, 8 aa, Dengue virus
HRRDKRSV

SEQ ID NO: 203 - protein, 8 aa, Dengue virus
RRDKRSVA

SEQ ID NO: 204 - protein, 8 aa, Dengue virus
RDKRSVAL

SEQ ID NO: 205 - protein, 8 aa, Dengue virus
DKRSVALA

SEQ ID NO: 206 - protein, 8 aa, Dengue virus
KRSVALAP

SEQ ID NO: 207 - protein, 8 aa, Dengue virus
RSVALAPH

SEQ ID NO: 208 - protein, 8 aa, Dengue virus
SVALAPHV

SEQ ID NO: 209 - protein, 8 aa, Dengue virus
VALAPHVG

SEQ ID NO: 210 - protein, 8 aa, Dengue virus
ALAPHVGL

SEQ ID NO: 211 - protein, 8 aa, Dengue virus
LAPHVGLG

SEQ ID NO: 212 - protein, 8 aa, Dengue virus
APHVGLGL

SEQ ID NO: 213 - protein, 8 aa, Dengue virus
PHVGLGLE

SEQ ID NO: 214 - protein, 8 aa, Dengue virus
HVGLGLET

SEQ ID NO: 215 - protein, 8 aa, Dengue virus
VGLGLETR

SEQ ID NO: 216 - protein, 8 aa, Dengue virus
GLGLETRT

SEQ ID NO: 217 - protein, 8 aa, Dengue virus
LGLETRTE

SEQ ID NO: 218 - protein, 8 aa, Dengue virus
GLETRTET

SEQ ID NO: 219 - protein, 8 aa, Dengue virus
LETRTETW

SEQ ID NO: 220 - protein, 8 aa, Dengue virus
ETRTETWM

SEQ ID NO: 221 - protein, 8 aa, Dengue virus
TRTETWMS

SEQ ID NO: 222 - protein, 8 aa, Dengue virus
RTETWMSS

SEQ ID NO: 223 - protein, 8 aa, Dengue virus
TETWMSSE

SEQ ID NO: 224 - protein, 8 aa, Dengue virus
ETWMSSEG

SEQ ID NO: 225 - protein, 8 aa, Dengue virus
TWMSSEGA

SEQ ID NO: 226 - protein, 8 aa, Dengue virus
WMSSEGAW

SEQ ID NO: 227 - protein, 8 aa, Dengue virus
MSSEGAWK

SEQ ID NO: 228 - protein, 8 aa, Dengue virus
SSEGAWKQ

SEQ ID NO: 229 - protein, 8 aa, Dengue virus
SEGAWKQI

SEQ ID NO: 230 - protein, 8 aa, Dengue virus
EGAWKQIQ

SEQ ID NO: 231 - protein, 8 aa, Dengue virus
GAWKQIQR

SEQ ID NO: 232 - protein, 8 aa, Dengue virus
AWKQIQRV

SEQ ID NO: 233 - protein, 8 aa, Dengue virus
WKQIQRVE

SEQ ID NO: 234 - protein, 8 aa, Dengue virus
KQIQRVET

SEQ ID NO: 235 - protein, 8 aa, Dengue virus
QIQRVETW

SEQ ID NO: 236 - protein, 8 aa, Dengue virus
IQRVETWA

SEQ ID NO: 237 - protein, 8 aa, Dengue virus
QRVETWAL

SEQ ID NO: 238 - protein, 8 aa, Dengue virus
RVETWALR

SEQ ID NO: 239 - protein, 8 aa, Dengue virus
VETWALRH

SEQ ID NO: 240 - protein, 8 aa, Dengue virus
ETWALRHP

SEQ ID NO: 241 - protein, 8 aa, Dengue virus
TWALRHPG

SEQ ID NO: 242 - protein, 8 aa, Dengue virus
WALRHPGF

SEQ ID NO: 243 - protein, 8 aa, Dengue virus
ALRHPGFT

SEQ ID NO: 244 - protein, 8 aa, Dengue virus
LRHPGFTV

SEQ ID NO: 245 - protein, 8 aa, Dengue virus
RHPGFTVI

SEQ ID NO: 246 - protein, 8 aa, Dengue virus
HPGFTVIA

SEQ ID NO: 247 - protein, 8 aa, Dengue virus
PGFTVIAL

SEQ ID NO: 248 - protein, 8 aa, Dengue virus
GFTVIALF

SEQ ID NO: 249 - protein, 8 aa, Dengue virus
FTVIALFL

SEQ ID NO: 250 - protein, 8 aa, Dengue virus
TVIALFLA

SEQ ID NO: 251 - protein, 8 aa, Dengue virus
VIALFLAH

SEQ ID NO: 252 - protein, 8 aa, Dengue virus
ALFLAHAI

SEQ ID NO: 253 - protein, 8 aa, Dengue virus
LFLAHAIG

SEQ ID NO: 254 - protein, 8 aa, Dengue virus
FLAHAIGT

SEQ ID NO: 255 - protein, 8 aa, Dengue virus
LAHAIGTS

SEQ ID NO: 256 - protein, 8 aa, Dengue virus
AHAIGTSI

SEQ ID NO: 257 - protein, 8 aa, Dengue virus
HAIGTSIT

SEQ ID NO: 258 - protein, 8 aa, Dengue virus
AIGTSITQ

SEQ ID NO: 259 - protein, 8 aa, Dengue virus
IGTSITQK

SEQ ID NO: 260 - protein, 8 aa, Dengue virus
GTSITQKG

SEQ ID NO: 261 - protein, 8 aa, Dengue virus
TSITQKGI

SEQ ID NO: 262 - protein, 8 aa, Dengue virus
SITQKGII

SEQ ID NO: 263 - protein, 8 aa, Dengue virus
ITQKGIIF

SEQ ID NO: 264 - protein, 8 aa, Dengue virus
TQKGIIFI

SEQ ID NO: 265 - protein, 8 aa, Dengue virus
QKGIIFIL

SEQ ID NO: 266 - protein, 8 aa, Dengue virus
KGIIFILL

SEQ ID NO: 267 - protein, 8 aa, Dengue virus
GIIFILLM

SEQ ID NO: 268 - protein, 8 aa, Dengue virus
IIFILLML

SEQ ID NO: 269 - protein, 8 aa, Dengue virus
IFILLMLV

SEQ ID NO: 270 - protein, 8 aa, Dengue virus
FILLMLVT

SEQ ID NO: 271 - protein, 8 aa, Dengue virus
ILLMLVTP

SEQ ID NO: 272 - protein, 8 aa, Dengue virus
LLMLVTPS

SEQ ID NO: 273 - protein, 8 aa, Dengue virus
LMLVTPSM

SEQ ID NO: 274 - protein, 8 aa, Dengue virus
MLVTPSMA

SEQ ID NO: 275 - protein, 8 aa, Dengue virus
LVTPSMAM

SEQ ID NO: 276 - protein, 8 aa, Dengue virus
VTPSMAMR

SEQ ID NO: 277 - protein, 8 aa, Dengue virus
TPSMAMRC

SEQ ID NO: 278 - protein, 8 aa, Dengue virus
PSMAMRCV

SEQ ID NO: 279 - protein, 8 aa, Dengue virus
SMAMRCVG

SEQ ID NO: 280 - protein, 8 aa, Dengue virus
MAMRCVGI

SEQ ID NO: 281 - protein, 8 aa, Dengue virus
AMRCVGIG

SEQ ID NO: 282 - protein, 8 aa, Dengue virus
MRCVGIGS

SEQ ID NO: 283 - protein, 8 aa, Dengue virus
RCVGIGSR

SEQ ID NO: 284 - protein, 8 aa, Dengue virus
CVGIGSRD

SEQ ID NO: 285 - protein, 8 aa, Dengue virus
VGIGSRDF

SEQ ID NO: 286 - protein, 8 aa, Dengue virus
GIGSRDFV

SEQ ID NO: 287 - protein, 8 aa, Dengue virus
IGSRDFVE

SEQ ID NO: 288 - protein, 8 aa, Dengue virus
GSRDFVEG

SEQ ID NO: 289 - protein, 8 aa, Dengue virus
SRDFVEGL

SEQ ID NO: 290 - protein, 8 aa, Dengue virus
RDFVEGLS

SEQ ID NO: 291 - protein, 8 aa, Dengue virus
DFVEGLSG

SEQ ID NO: 292 - protein, 8 aa, Dengue virus
FVEGLSGA

SEQ ID NO: 293 - protein, 8 aa, Dengue virus
VEGLSGAT

SEQ ID NO: 294 - protein, 8 aa, Dengue virus
EGLSGATW

SEQ ID NO: 295 - protein, 8 aa, Dengue virus
GLSGATWV

SEQ ID NO: 296 - protein, 8 aa, Dengue virus
LSGATWVD

SEQ ID NO: 297 - protein, 8 aa, Dengue virus
SGATWVDV

SEQ ID NO: 298 - protein, 8 aa, Dengue virus
GATWVDVV

SEQ ID NO: 299 - protein, 8 aa, Dengue virus
ATWVDVVL

SEQ ID NO: 300 - protein, 8 aa, Dengue virus
TWVDVVLE

SEQ ID NO: 301 - protein, 8 aa, Dengue virus
WVDVVLEH

SEQ ID NO: 302 - protein, 8 aa, Dengue virus
VDVVLEHG

SEQ ID NO: 303 - protein, 8 aa, Dengue virus
DVVLEHGS

SEQ ID NO: 304 - protein, 8 aa, Dengue virus
VVLEHGSC

SEQ ID NO: 305 - protein, 8 aa, Dengue virus
VLEHGSCV

SEQ ID NO: 306 - protein, 8 aa, Dengue virus
LEHGSCVT

SEQ ID NO: 307 - protein, 8 aa, Dengue virus
EHGSCVTT

SEQ ID NO: 308 - protein, 8 aa, Dengue virus
HGSCVTTM

SEQ ID NO: 309 - protein, 8 aa, Dengue virus
GSCVTTMA

SEQ ID NO: 310 - protein, 8 aa, Dengue virus
SCVTTMAK

SEQ ID NO: 311 - protein, 8 aa, Dengue virus
CVTTMAKD

SEQ ID NO: 312 - protein, 8 aa, Dengue virus
VTTMAKDK

SEQ ID NO: 313 - protein, 8 aa, Dengue virus
TTMAKDKP

SEQ ID NO: 314 - protein, 8 aa, Dengue virus
TMAKDKPT

SEQ ID NO: 315 - protein, 8 aa, Dengue virus
MAKDKPTL

SEQ ID NO: 316 - protein, 8 aa, Dengue virus
AKDKPTLD

SEQ ID NO: 317 - protein, 8 aa, Dengue virus
KDKPTLDI

SEQ ID NO: 318 - protein, 8 aa, Dengue virus
DKPTLDIE

SEQ ID NO: 319 - protein, 8 aa, Dengue virus
KPTLDIEL

SEQ ID NO: 320 - protein, 8 aa, Dengue virus
PTLDIELL

SEQ ID NO: 321 - protein, 8 aa, Dengue virus
TLDIELLK

SEQ ID NO: 322 - protein, 8 aa, Dengue virus
LDIELLKT

SEQ ID NO: 323 - protein, 8 aa, Dengue virus
DIELLKTE

SEQ ID NO: 324 - protein, 8 aa, Dengue virus
IELLKTEV

SEQ ID NO: 325 - protein, 8 aa, Dengue virus
ELLKTEVT

SEQ ID NO: 326 - protein, 8 aa, Dengue virus
LLKTEVTN

SEQ ID NO: 327 - protein, 8 aa, Dengue virus
LKTEVTNP

SEQ ID NO: 328 - protein, 8 aa, Dengue virus
KTEVTNPA

SEQ ID NO: 329 - protein, 8 aa, Dengue virus
TEVTNPAV

SEQ ID NO: 330 - protein, 8 aa, Dengue virus
EVTNPAVL

SEQ ID NO: 331 - protein, 8 aa, Dengue virus
VTNPAVLR

SEQ ID NO: 332 - protein, 8 aa, Dengue virus
TNPAVLRK

SEQ ID NO: 333 - protein, 8 aa, Dengue virus
NPAVLRKL

SEQ ID NO: 334 - protein, 8 aa, Dengue virus
PAVLRKLC

SEQ ID NO: 335 - protein, 8 aa, Dengue virus
AVLRKLCI

SEQ ID NO: 336 - protein, 8 aa, Dengue virus
VLRKLCIE

SEQ ID NO: 337 - protein, 8 aa, Dengue virus
LRKLCIEA

SEQ ID NO: 338 - protein, 8 aa, Dengue virus
RKLCIEAK

SEQ ID NO: 339 - protein, 8 aa, Dengue virus
KLCIEAKI

SEQ ID NO: 340 - protein, 8 aa, Dengue virus
LCIEAKIS

SEQ ID NO: 341 - protein, 8 aa, Dengue virus
CIEAKISN

SEQ ID NO: 342 - protein, 8 aa, Dengue virus
IEAKISNT

SEQ ID NO: 343 - protein, 8 aa, Dengue virus
EAKISNTT

SEQ ID NO: 344 - protein, 8 aa, Dengue virus
AKISNTTT

SEQ ID NO: 345 - protein, 8 aa, Dengue virus
KISNTTTD

SEQ ID NO: 346 - protein, 8 aa, Dengue virus
ISNTTTDS

SEQ ID NO: 347 - protein, 8 aa, Dengue virus
SNTTTDSR

SEQ ID NO: 348 - protein, 8 aa, Dengue virus
NTTTDSRC

SEQ ID NO: 349 - protein, 8 aa, Dengue virus
TTTDSRCP

SEQ ID NO: 350 - protein, 8 aa, Dengue virus
TTDSRCPT

SEQ ID NO: 351 - protein, 8 aa, Dengue virus
TDSRCPTQ

SEQ ID NO: 352 - protein, 8 aa, Dengue virus
DSRCPTQG

SEQ ID NO: 353 - protein, 8 aa, Dengue virus
SRCPTQGE

SEQ ID NO: 354 - protein, 8 aa, Dengue virus
RCPTQGEA

SEQ ID NO: 355 - protein, 8 aa, Dengue virus
CPTQGEAT

SEQ ID NO: 356 - protein, 8 aa, Dengue virus
PTQGEATL

SEQ ID NO: 357 - protein, 8 aa, Dengue virus
TQGEATLV

SEQ ID NO: 358 - protein, 8 aa, Dengue virus
QGEATLVE

SEQ ID NO: 359 - protein, 8 aa, Dengue virus
GEATLVEE

SEQ ID NO: 360 - protein, 8 aa, Dengue virus
EATLVEEQ

SEQ ID NO: 361 - protein, 8 aa, Dengue virus
ATLVEEQD

SEQ ID NO: 362 - protein, 8 aa, Dengue virus
TLVEEQDA

SEQ ID NO: 363 - protein, 8 aa, Dengue virus
LVEEQDAN

SEQ ID NO: 364 - protein, 8 aa, Dengue virus
VEEQDANF

SEQ ID NO: 365 - protein, 8 aa, Dengue virus
EEQDANFV

SEQ ID NO: 366 - protein, 8 aa, Dengue virus
EQDANFVC

SEQ ID NO: 367 - protein, 8 aa, Dengue virus
QDANFVCR

SEQ ID NO: 368 - protein, 8 aa, Dengue virus
DANFVCRR

SEQ ID NO: 369 - protein, 8 aa, Dengue virus
ANFVCRRT

SEQ ID NO: 370 - protein, 8 aa, Dengue virus
NFVCRRTF

SEQ ID NO: 371 - protein, 8 aa, Dengue virus
FVCRRTFV

SEQ ID NO: 372 - protein, 8 aa, Dengue virus
VCRRTFVD

SEQ ID NO: 373 - protein, 8 aa, Dengue virus
CRRTFVDR

SEQ ID NO: 374 - protein, 8 aa, Dengue virus
RRTFVDRG

SEQ ID NO: 375 - protein, 8 aa, Dengue virus
RTFVDRGW

SEQ ID NO: 376 - protein, 8 aa, Dengue virus
TFVDRGWG

SEQ ID NO: 377 - protein, 8 aa, Dengue virus
FVDRGWGN

SEQ ID NO: 378 - protein, 8 aa, Dengue virus
VDRGWGNG

SEQ ID NO: 379 - protein, 8 aa, Dengue virus
DRGWGNGC

SEQ ID NO: 380 - protein, 8 aa, Dengue virus
RGWGNGCG

SEQ ID NO: 381 - protein, 8 aa, Dengue virus
GWGNGCGL

SEQ ID NO: 382 - protein, 8 aa, Dengue virus
WGNGCGLF

SEQ ID NO: 383 - protein, 8 aa, Dengue virus
GNGCGLFG

SEQ ID NO: 384 - protein, 8 aa, Dengue virus
NGCGLFGK

SEQ ID NO: 385 - protein, 8 aa, Dengue virus
GCGLFGKG

SEQ ID NO: 386 - protein, 8 aa, Dengue virus
CGLFGKGS

SEQ ID NO: 387 - protein, 8 aa, Dengue virus
GLFGKGSL

SEQ ID NO: 388 - protein, 8 aa, Dengue virus
LFGKGSLI

SEQ ID NO: 389 - protein, 8 aa, Dengue virus
FGKGSLIT

SEQ ID NO: 390 - protein, 8 aa, Dengue virus
GKGSLITC

SEQ ID NO: 391 - protein, 8 aa, Dengue virus
KGSLITCA

SEQ ID NO: 392 - protein, 8 aa, Dengue virus
GSLITCAK

SEQ ID NO: 393 - protein, 8 aa, Dengue virus
SLITCAKF

SEQ ID NO: 394 - protein, 8 aa, Dengue virus
LITCAKFK

SEQ ID NO: 395 - protein, 8 aa, Dengue virus
ITCAKFKC

SEQ ID NO: 396 - protein, 8 aa, Dengue virus
TCAKFKCV

SEQ ID NO: 397 - protein, 8 aa, Dengue virus
CAKFKCVT

SEQ ID NO: 398 - protein, 8 aa, Dengue virus
AKFKCVTK

SEQ ID NO: 399 - protein, 8 aa, Dengue virus
KFKCVTKL

SEQ ID NO: 400 - protein, 8 aa, Dengue virus
FKCVTKLE

SEQ ID NO: 401 - protein, 8 aa, Dengue virus
KCVTKLEG

SEQ ID NO: 402 - protein, 8 aa, Dengue virus
CVTKLEGK

SEQ ID NO: 403 - protein, 8 aa, Dengue virus
VTKLEGKI

SEQ ID NO: 404 - protein, 8 aa, Dengue virus
TKLEGKIV

SEQ ID NO: 405 - protein, 8 aa, Dengue virus
KLEGKIVQ

SEQ ID NO: 406 - protein, 8 aa, Dengue virus
LEGKIVQY

SEQ ID NO: 407 - protein, 8 aa, Dengue virus
EGKIVQYE

SEQ ID NO: 408 - protein, 8 aa, Dengue virus
GKIVQYEN

SEQ ID NO: 409 - protein, 8 aa, Dengue virus
KIVQYENL

SEQ ID NO: 410 - protein, 8 aa, Dengue virus
IVQYENLK

SEQ ID NO: 411 - protein, 8 aa, Dengue virus
VQYENLKY

SEQ ID NO: 412 - protein, 8 aa, Dengue virus
QYENLKYS

SEQ ID NO: 413 - protein, 8 aa, Dengue virus
YENLKYSV

SEQ ID NO: 414 - protein, 8 aa, Dengue virus
ENLKYSVI

SEQ ID NO: 415 - protein, 8 aa, Dengue virus
NLKYSVIV

SEQ ID NO: 416 - protein, 8 aa, Dengue virus
LKYSVIVT

SEQ ID NO: 417 - protein, 8 aa, Dengue virus
KYSVIVTV

SEQ ID NO: 418 - protein, 8 aa, Dengue virus
YSVIVTVH

SEQ ID NO: 419 - protein, 8 aa, Dengue virus
SVIVTVHT

SEQ ID NO: 420 - protein, 8 aa, Dengue virus
VIVTVHTG

SEQ ID NO: 421 - protein, 8 aa, Dengue virus
IVTVHTGD

SEQ ID NO: 422 - protein, 8 aa, Dengue virus
VTVHTGDQ

SEQ ID NO: 423 - protein, 8 aa, Dengue virus
TVHTGDQH

SEQ ID NO: 424 - protein, 8 aa, Dengue virus
VHTGDQHQ

SEQ ID NO: 425 - protein, 8 aa, Dengue virus
HTGDQHQV

SEQ ID NO: 426 - protein, 8 aa, Dengue virus
TGDQHQVG

SEQ ID NO: 427 - protein, 8 aa, Dengue virus
GDQHQVGN

SEQ ID NO: 428 - protein, 8 aa, Dengue virus
DQHQVGNE

SEQ ID NO: 429 - protein, 8 aa, Dengue virus
QHQVGNES

SEQ ID NO: 430 - protein, 8 aa, Dengue virus
HQVGNEST

SEQ ID NO: 431 - protein, 8 aa, Dengue virus
QVGNESTE

SEQ ID NO: 432 - protein, 8 aa, Dengue virus
VGNESTEH

SEQ ID NO: 433 - protein, 8 aa, Dengue virus
GNESTEHG

SEQ ID NO: 434 - protein, 8 aa, Dengue virus
NESTEHGT

SEQ ID NO: 435 - protein, 8 aa, Dengue virus
ESTEHGTT

SEQ ID NO: 436 - protein, 8 aa, Dengue virus
STEHGTTA

SEQ ID NO: 437 - protein, 8 aa, Dengue virus
TEHGTTAT

SEQ ID NO: 438 - protein, 8 aa, Dengue virus
EHGTTATI

SEQ ID NO: 439 - protein, 8 aa, Dengue virus
HGTTATIT

SEQ ID NO: 440 - protein, 8 aa, Dengue virus
GTTATITP

SEQ ID NO: 441 - protein, 8 aa, Dengue virus
TTATITPQ

SEQ ID NO: 442 - protein, 8 aa, Dengue virus
TATITPQA

SEQ ID NO: 443 - protein, 8 aa, Dengue virus
ATITPQAP

SEQ ID NO: 444 - protein, 8 aa, Dengue virus
TITPQAPT

SEQ ID NO: 445 - protein, 8 aa, Dengue virus
ITPQAPTT

SEQ ID NO: 446 - protein, 8 aa, Dengue virus
TPQAPTTE

SEQ ID NO: 447 - protein, 8 aa, Dengue virus
PQAPTTEI

SEQ ID NO: 448 - protein, 8 aa, Dengue virus
QAPTTEIQ

SEQ ID NO: 449 - protein, 8 aa, Dengue virus
APTTEIQL

SEQ ID NO: 450 - protein, 8 aa, Dengue virus
PTTEIQLT

SEQ ID NO: 451 - protein, 8 aa, Dengue virus
TTEIQLTD

SEQ ID NO: 452 - protein, 8 aa, Dengue virus
TEIQLTDY

SEQ ID NO: 453 - protein, 8 aa, Dengue virus
EIQLTDYG

SEQ ID NO: 454 - protein, 8 aa, Dengue virus
IQLTDYGA

SEQ ID NO: 455 - protein, 8 aa, Dengue virus
QLTDYGAL

SEQ ID NO: 456 - protein, 8 aa, Dengue virus
LTDYGALT

SEQ ID NO: 457 - protein, 8 aa, Dengue virus
TDYGALTL

SEQ ID NO: 458 - protein, 8 aa, Dengue virus
DYGALTLD

SEQ ID NO: 459 - protein, 8 aa, Dengue virus
YGALTLDC

SEQ ID NO: 460 - protein, 8 aa, Dengue virus
GALTLDCS

SEQ ID NO: 461 - protein, 8 aa, Dengue virus
ALTLDCSP

SEQ ID NO: 462 - protein, 8 aa, Dengue virus
LTLDCSPR

SEQ ID NO: 463 - protein, 8 aa, Dengue virus
TLDCSPRT

SEQ ID NO: 464 - protein, 8 aa, Dengue virus
LDCSPRTG

SEQ ID NO: 465 - protein, 8 aa, Dengue virus
DCSPRTGL

SEQ ID NO: 466 - protein, 8 aa, Dengue virus
CSPRTGLD

SEQ ID NO: 467 - protein, 8 aa, Dengue virus
SPRTGLDF

SEQ ID NO: 468 - protein, 8 aa, Dengue virus
PRTGLDFN

SEQ ID NO: 469 - protein, 8 aa, Dengue virus
RTGLDFNE

SEQ ID NO: 470 - protein, 8 aa, Dengue virus
TGLDFNEM

SEQ ID NO: 471 - protein, 8 aa, Dengue virus
GLDFNEMV

SEQ ID NO: 472 - protein, 8 aa, Dengue virus
LDFNEMVL

SEQ ID NO: 473 - protein, 8 aa, Dengue virus
DFNEMVLL

SEQ ID NO: 474 - protein, 8 aa, Dengue virus
FNEMVLLT

SEQ ID NO: 475 - protein, 8 aa, Dengue virus
NEMVLLTM

SEQ ID NO: 476 - protein, 8 aa, Dengue virus
EMVLLTMK

SEQ ID NO: 477 - protein, 8 aa, Dengue virus
MVLLTMKE

SEQ ID NO: 478 - protein, 8 aa, Dengue virus
VLLTMKEK

SEQ ID NO: 479 - protein, 8 aa, Dengue virus
LLTMKEKS

SEQ ID NO: 480 - protein, 8 aa, Dengue virus
LTMKEKSW

SEQ ID NO: 481 - protein, 8 aa, Dengue virus
TMKEKSWL

SEQ ID NO: 482 - protein, 8 aa, Dengue virus
MKEKSWLV

SEQ ID NO: 483 - protein, 8 aa, Dengue virus
KEKSWLVH

SEQ ID NO: 484 - protein, 8 aa, Dengue virus
EKSWLVHK

SEQ ID NO: 485 - protein, 8 aa, Dengue virus
KSWLVHKQ

SEQ ID NO: 486 - protein, 8 aa, Dengue virus
SWLVHKQW

SEQ ID NO: 487 - protein, 8 aa, Dengue virus
WLVHKQWF

SEQ ID NO: 488 - protein, 8 aa, Dengue virus
LVHKQWFL

SEQ ID NO: 489 - protein, 8 aa, Dengue virus
VHKQWFLD

SEQ ID NO: 490 - protein, 8 aa, Dengue virus
HKQWFLDL

SEQ ID NO: 491 - protein, 8 aa, Dengue virus
KQWFLDLP

SEQ ID NO: 492 - protein, 8 aa, Dengue virus
QWFLDLPL

SEQ ID NO: 493 - protein, 8 aa, Dengue virus
WFLDLPLP

SEQ ID NO: 494 - protein, 8 aa, Dengue virus
FLDLPLPW

SEQ ID NO: 495 - protein, 8 aa, Dengue virus
LDLPLPWT

SEQ ID NO: 496 - protein, 8 aa, Dengue virus
DLPLPWTS

SEQ ID NO: 497 - protein, 8 aa, Dengue virus
LPLPWTSG

SEQ ID NO: 498 - protein, 8 aa, Dengue virus
PLPWTSGA

SEQ ID NO: 499 - protein, 8 aa, Dengue virus
LPWTSGAS

SEQ ID NO: 500 - protein, 8 aa, Dengue virus
PWTSGAST

SEQ ID NO: 501 - protein, 8 aa, Dengue virus
STSQETWN

SEQ ID NO: 502 - protein, 8 aa, Dengue virus
TSQETWNR

SEQ ID NO: 503 - protein, 8 aa, Dengue virus
SQETWNRQ

SEQ ID NO: 504 - protein, 8 aa, Dengue virus
QETWNRQD

SEQ ID NO: 505 - protein, 8 aa, Dengue virus
ETWNRQDL

SEQ ID NO: 506 - protein, 8 aa, Dengue virus
TWNRQDLL

SEQ ID NO: 507 - protein, 8 aa, Dengue virus
WNRQDLLV

SEQ ID NO: 508 - protein, 8 aa, Dengue virus
NRQDLLVT

SEQ ID NO: 509 - protein, 8 aa, Dengue virus
RQDLLVTF

SEQ ID NO: 510 - protein, 8 aa, Dengue virus
QDLLVTFK

SEQ ID NO: 511 - protein, 8 aa, Dengue virus
DLLVTFKT

SEQ ID NO: 512 - protein, 8 aa, Dengue virus
LLVTFKTA

SEQ ID NO: 513 - protein, 8 aa, Dengue virus
LVTFKTAH

SEQ ID NO: 514 - protein, 8 aa, Dengue virus
VTFKTAHA

SEQ ID NO: 515 - protein, 8 aa, Dengue virus
TFKTAHAK

SEQ ID NO: 516 - protein, 8 aa, Dengue virus
FKTAHAKK

SEQ ID NO: 517 - protein, 8 aa, Dengue virus
KTAHAKKQ

SEQ ID NO: 518 - protein, 8 aa, Dengue virus
TAHAKKQE

SEQ ID NO: 519 - protein, 8 aa, Dengue virus
AHAKKQEV

SEQ ID NO: 520 - protein, 8 aa, Dengue virus
HAKKQEVV

SEQ ID NO: 521 - protein, 8 aa, Dengue virus
AKKQEVVV

SEQ ID NO: 522 - protein, 8 aa, Dengue virus
KKQEVVVL

SEQ ID NO: 523 - protein, 8 aa, Dengue virus
KQEVVVLG

SEQ ID NO: 524 - protein, 8 aa, Dengue virus
QEVVVLGS

SEQ ID NO: 525 - protein, 8 aa, Dengue virus
EVVVLGSQ

SEQ ID NO: 526 - protein, 8 aa, Dengue virus
VVVLGSQE

SEQ ID NO: 527 - protein, 8 aa, Dengue virus
VVLGSQEG

SEQ ID NO: 528 - protein, 8 aa, Dengue virus
VLGSQEGA

SEQ ID NO: 529 - protein, 8 aa, Dengue virus
LGSQEGAM

SEQ ID NO: 530 - protein, 8 aa, Dengue virus
GSQEGAMH

SEQ ID NO: 531 - protein, 8 aa, Dengue virus
SQEGAMHT

SEQ ID NO: 532 - protein, 8 aa, Dengue virus
QEGAMHTA

SEQ ID NO: 533 - protein, 8 aa, Dengue virus
EGAMHTAL

SEQ ID NO: 534 - protein, 8 aa, Dengue virus
GAMHTALT

SEQ ID NO: 535 - protein, 8 aa, Dengue virus
AMHTALTG

SEQ ID NO: 536 - protein, 8 aa, Dengue virus
MHTALTGA

SEQ ID NO: 537 - protein, 8 aa, Dengue virus
HTALTGAT

SEQ ID NO: 538 - protein, 8 aa, Dengue virus
TALTGATE

SEQ ID NO: 539 - protein, 8 aa, Dengue virus
ALTGATEI

SEQ ID NO: 540 - protein, 8 aa, Dengue virus
LTGATEIQ

SEQ ID NO: 541 - protein, 8 aa, Dengue virus
TGATEIQT

SEQ ID NO: 542 - protein, 8 aa, Dengue virus
GATEIQTS

SEQ ID NO: 543 - protein, 8 aa, Dengue virus
ATEIQTSG

SEQ ID NO: 544 - protein, 8 aa, Dengue virus
TEIQTSGT

SEQ ID NO: 545 - protein, 8 aa, Dengue virus
EIQTSGTT

SEQ ID NO: 546 - protein, 8 aa, Dengue virus
IQTSGTTT

SEQ ID NO: 547 - protein, 8 aa, Dengue virus
QTSGTTTI

SEQ ID NO: 548 - protein, 8 aa, Dengue virus
TSGTTTIF

SEQ ID NO: 549 - protein, 8 aa, Dengue virus
SGTTTIFA

SEQ ID NO: 550 - protein, 8 aa, Dengue virus
GTTTIFAG

SEQ ID NO: 551 - protein, 8 aa, Dengue virus
TTTIFAGH

SEQ ID NO: 552 - protein, 8 aa, Dengue virus
TTIFAGHL

SEQ ID NO: 553 - protein, 8 aa, Dengue virus
TIFAGHLK

SEQ ID NO: 554 - protein, 8 aa, Dengue virus
IFAGHLKC

SEQ ID NO: 555 - protein, 8 aa, Dengue virus
FAGHLKCR

SEQ ID NO: 556 - protein, 8 aa, Dengue virus
AGHLKCRL

SEQ ID NO: 557 - protein, 8 aa, Dengue virus
GHLKCRLK

SEQ ID NO: 558 - protein, 8 aa, Dengue virus
HLKCRLKM

SEQ ID NO: 559 - protein, 8 aa, Dengue virus
LKCRLKMD

SEQ ID NO: 560 - protein, 8 aa, Dengue virus
KCRLKMDK

SEQ ID NO: 561 - protein, 8 aa, Dengue virus
CRLKMDKL

SEQ ID NO: 562 - protein, 8 aa, Dengue virus
RLKMDKLT

SEQ ID NO: 563 - protein, 8 aa, Dengue virus
LKMDKLTL

SEQ ID NO: 564 - protein, 8 aa, Dengue virus
KMDKLTLK

SEQ ID NO: 565 - protein, 8 aa, Dengue virus
MDKLTLKG

SEQ ID NO: 566 - protein, 8 aa, Dengue virus
DKLTLKGM

SEQ ID NO: 567 - protein, 8 aa, Dengue virus
KLTLKGMS

SEQ ID NO: 568 - protein, 8 aa, Dengue virus
LTLKGMSY

SEQ ID NO: 569 - protein, 8 aa, Dengue virus
TLKGMSYV

SEQ ID NO: 570 - protein, 8 aa, Dengue virus
LKGMSYVM

SEQ ID NO: 571 - protein, 8 aa, Dengue virus
KGMSYVMC

SEQ ID NO: 572 - protein, 8 aa, Dengue virus
GMSYVMCT

SEQ ID NO: 573 - protein, 8 aa, Dengue virus
MSYVMCTG

SEQ ID NO: 574 - protein, 8 aa, Dengue virus
SYVMCTGS

SEQ ID NO: 575 - protein, 8 aa, Dengue virus
YVMCTGSF

SEQ ID NO: 576 - protein, 8 aa, Dengue virus
VMCTGSFK

SEQ ID NO: 577 - protein, 8 aa, Dengue virus
MCTGSFKL

SEQ ID NO: 578 - protein, 8 aa, Dengue virus
CTGSFKLE

SEQ ID NO: 579 - protein, 8 aa, Dengue virus
TGSFKLEK

SEQ ID NO: 580 - protein, 8 aa, Dengue virus
GSFKLEKE

SEQ ID NO: 581 - protein, 8 aa, Dengue virus
SFKLEKEV

SEQ ID NO: 582 - protein, 8 aa, Dengue virus
FKLEKEVA

SEQ ID NO: 583 - protein, 8 aa, Dengue virus
KLEKEVAE

SEQ ID NO: 584 - protein, 8 aa, Dengue virus
LEKEVAET

SEQ ID NO: 585 - protein, 8 aa, Dengue virus
EKEVAETQ

SEQ ID NO: 586 - protein, 8 aa, Dengue virus
KEVAETQH

SEQ ID NO: 587 - protein, 8 aa, Dengue virus
EVAETQHG

SEQ ID NO: 588 - protein, 8 aa, Dengue virus
VAETQHGT

SEQ ID NO: 589 - protein, 8 aa, Dengue virus
AETQHGTV

SEQ ID NO: 590 - protein, 8 aa, Dengue virus
ETQHGTVL

SEQ ID NO: 591 - protein, 8 aa, Dengue virus
TQHGTVLV

SEQ ID NO: 592 - protein, 8 aa, Dengue virus
QHGTVLVQ

SEQ ID NO: 593 - protein, 8 aa, Dengue virus
HGTVLVQI

SEQ ID NO: 594 - protein, 8 aa, Dengue virus
GTVLVQIK

SEQ ID NO: 595 - protein, 8 aa, Dengue virus
TVLVQIKY

SEQ ID NO: 596 - protein, 8 aa, Dengue virus
VLVQIKYE

SEQ ID NO: 597 - protein, 8 aa, Dengue virus
LVQIKYEG

SEQ ID NO: 598 - protein, 8 aa, Dengue virus
VQIKYEGT

SEQ ID NO: 599 - protein, 8 aa, Dengue virus
QIKYEGTD

SEQ ID NO: 600 - protein, 8 aa, Dengue virus
IKYEGTDA

SEQ ID NO: 601 - protein, 8 aa, Dengue virus
KYEGTDAP

SEQ ID NO: 602 - protein, 8 aa, Dengue virus
YEGTDAPC

SEQ ID NO: 603 - protein, 8 aa, Dengue virus
EGTDAPCK

SEQ ID NO: 604 - protein, 8 aa, Dengue virus
GTDAPCKI

SEQ ID NO: 605 - protein, 8 aa, Dengue virus
TDAPCKIP

SEQ ID NO: 606 - protein, 8 aa, Dengue virus
DAPCKIPF

SEQ ID NO: 607 - protein, 8 aa, Dengue virus
APCKIPFS

SEQ ID NO: 608 - protein, 8 aa, Dengue virus
PCKIPFST

SEQ ID NO: 609 - protein, 8 aa, Dengue virus
CKIPFSTQ

SEQ ID NO: 610 - protein, 8 aa, Dengue virus
KIPFSTQD

SEQ ID NO: 611 - protein, 8 aa, Dengue virus
IPFSTQDE

SEQ ID NO: 612 - protein, 8 aa, Dengue virus
QDEKGVTQ

SEQ ID NO: 613 - protein, 8 aa, Dengue virus
DEKGVTQN

SEQ ID NO: 614 - protein, 8 aa, Dengue virus
EKGVTQNG

SEQ ID NO: 615 - protein, 8 aa, Dengue virus
KGVTQNGR

SEQ ID NO: 616 - protein, 8 aa, Dengue virus
GVTQNGRL

SEQ ID NO: 617 - protein, 8 aa, Dengue virus
VTQNGRLI

SEQ ID NO: 618 - protein, 8 aa, Dengue virus
TQNGRLIT

SEQ ID NO: 619 - protein, 8 aa, Dengue virus
QNGRLITA

SEQ ID NO: 620 - protein, 8 aa, Dengue virus
NGRLITAN

SEQ ID NO: 621 - protein, 8 aa, Dengue virus
GRLITANP

SEQ ID NO: 622 - protein, 8 aa, Dengue virus
RLITANPI

SEQ ID NO: 623 - protein, 8 aa, Dengue virus
LITANPIV

SEQ ID NO: 624 - protein, 8 aa, Dengue virus
ITANPIVT

SEQ ID NO: 625 - protein, 8 aa, Dengue virus
TANPIVTD

SEQ ID NO: 626 - protein, 8 aa, Dengue virus
ANPIVTDK

SEQ ID NO: 627 - protein, 8 aa, Dengue virus
NPIVTDKE

SEQ ID NO: 628 - protein, 8 aa, Dengue virus
PIVTDKEK

SEQ ID NO: 629 - protein, 8 aa, Dengue virus
IVTDKEKP

SEQ ID NO: 630 - protein, 8 aa, Dengue virus
VTDKEKPV

SEQ ID NO: 631 - protein, 8 aa, Dengue virus
TDKEKPVN

SEQ ID NO: 632 - protein, 8 aa, Dengue virus
DKEKPVNI

SEQ ID NO: 633 - protein, 8 aa, Dengue virus
KEKPVNIE

SEQ ID NO: 634 - protein, 8 aa, Dengue virus
EKPVNIEA

SEQ ID NO: 635 - protein, 8 aa, Dengue virus
KPVNIEAE

SEQ ID NO: 636 - protein, 8 aa, Dengue virus
PVNIEAEP

SEQ ID NO: 637 - protein, 8 aa, Dengue virus
VNIEAEPP

SEQ ID NO: 638 - protein, 8 aa, Dengue virus
NIEAEPPF

SEQ ID NO: 639 - protein, 8 aa, Dengue virus
IEAEPPFG

SEQ ID NO: 640 - protein, 8 aa, Dengue virus
EAEPPFGE

SEQ ID NO: 641 - protein, 8 aa, Dengue virus
AEPPFGES

SEQ ID NO: 642 - protein, 8 aa, Dengue virus
EPPFGESY

SEQ ID NO: 643 - protein, 8 aa, Dengue virus
PPFGESYI

SEQ ID NO: 644 - protein, 8 aa, Dengue virus
PFGESYIV

SEQ ID NO: 645 - protein, 8 aa, Dengue virus
FGESYIVI

SEQ ID NO: 646 - protein, 8 aa, Dengue virus
GESYIVIG

SEQ ID NO: 647 - protein, 8 aa, Dengue virus
IGAGEKAL

SEQ ID NO: 648 - protein, 8 aa, Dengue virus
GAGEKALK

SEQ ID NO: 649 - protein, 8 aa, Dengue virus
AGEKALKL

SEQ ID NO: 650 - protein, 8 aa, Dengue virus
GEKALKLS

SEQ ID NO: 651 - protein, 8 aa, Dengue virus
EKALKLSW

SEQ ID NO: 652 - protein, 8 aa, Dengue virus
KALKLSWF

SEQ ID NO: 653 - protein, 8 aa, Dengue virus
ALKLSWFK

SEQ ID NO: 654 - protein, 8 aa, Dengue virus
LKLSWFKK

SEQ ID NO: 655 - protein, 8 aa, Dengue virus
KLSWFKKG

SEQ ID NO: 656 - protein, 8 aa, Dengue virus
LSWFKKGS

SEQ ID NO: 657 - protein, 8 aa, Dengue virus
SWFKKGSS

SEQ ID NO: 658 - protein, 8 aa, Dengue virus
WFKKGSSI

SEQ ID NO: 659 - protein, 8 aa, Dengue virus
FKKGSSIG

SEQ ID NO: 660 - protein, 8 aa, Dengue virus
KKGSSIGK

SEQ ID NO: 661 - protein, 8 aa, Dengue virus
KGSSIGKM

SEQ ID NO: 662 - protein, 8 aa, Dengue virus
GSSIGKMF

SEQ ID NO: 663 - protein, 8 aa, Dengue virus
SSIGKMFE

SEQ ID NO: 664 - protein, 8 aa, Dengue virus
SIGKMFEA

SEQ ID NO: 665 - protein, 8 aa, Dengue virus
IGKMFEAT

SEQ ID NO: 666 - protein, 8 aa, Dengue virus
GKMFEATA

SEQ ID NO: 667 - protein, 8 aa, Dengue virus
KMFEATAR

SEQ ID NO: 668 - protein, 8 aa, Dengue virus
MFEATARG

SEQ ID NO: 669 - protein, 8 aa, Dengue virus
FEATARGA

SEQ ID NO: 670 - protein, 8 aa, Dengue virus
EATARGAR

SEQ ID NO: 671 - protein, 8 aa, Dengue virus
ATARGARR

SEQ ID NO: 672 - protein, 8 aa, Dengue virus
TARGARRM

SEQ ID NO: 673 - protein, 8 aa, Dengue virus
ARGARRMA

SEQ ID NO: 674 - protein, 8 aa, Dengue virus
RGARRMAI

SEQ ID NO: 675 - protein, 8 aa, Dengue virus
GARRMAIL

SEQ ID NO: 676 - protein, 8 aa, Dengue virus
ARRMAILG

SEQ ID NO: 677 - protein, 8 aa, Dengue virus
RRMAILGD

SEQ ID NO: 678 - protein, 8 aa, Dengue virus
RMAILGDT

SEQ ID NO: 679 - protein, 8 aa, Dengue virus
MAILGDTA

SEQ ID NO: 680 - protein, 8 aa, Dengue virus
AILGDTAW

SEQ ID NO: 681 - protein, 8 aa, Dengue virus
ILGDTAWD

SEQ ID NO: 682 - protein, 8 aa, Dengue virus
LGDTAWDF

SEQ ID NO: 683 - protein, 8 aa, Dengue virus
GDTAWDFG

SEQ ID NO: 684 - protein, 8 aa, Dengue virus
DTAWDFGS

SEQ ID NO: 685 - protein, 8 aa, Dengue virus
TAWDFGSI

SEQ ID NO: 686 - protein, 8 aa, Dengue virus
AWDFGSIG

SEQ ID NO: 687 - protein, 8 aa, Dengue virus
WDFGSIGG

SEQ ID NO: 688 - protein, 8 aa, Dengue virus
DFGSIGGV

SEQ ID NO: 689 - protein, 8 aa, Dengue virus
FGSIGGVF

SEQ ID NO: 690 - protein, 8 aa, Dengue virus
GSIGGVFT

SEQ ID NO: 691 - protein, 8 aa, Dengue virus
SIGGVFTS

SEQ ID NO: 692 - protein, 8 aa, Dengue virus
GGVFTSVG

SEQ ID NO: 693 - protein, 8 aa, Dengue virus
GVFTSVGK

SEQ ID NO: 694 - protein, 8 aa, Dengue virus
VFTSVGKL

SEQ ID NO: 695 - protein, 8 aa, Dengue virus
FTSVGKLV

SEQ ID NO: 696 - protein, 8 aa, Dengue virus
TSVGKLVH

SEQ ID NO: 697 - protein, 8 aa, Dengue virus
SVGKLVHQ

SEQ ID NO: 698 - protein, 8 aa, Dengue virus
GKLVHQIF

SEQ ID NO: 699 - protein, 8 aa, Dengue virus
KLVHQIFG

SEQ ID NO: 700 - protein, 8 aa, Dengue virus
LVHQIFGT

SEQ ID NO: 701 - protein, 8 aa, Dengue virus
VHQIFGTA

SEQ ID NO: 702 - protein, 8 aa, Dengue virus
HQIFGTAY

SEQ ID NO: 703 - protein, 8 aa, Dengue virus
QIFGTAYG

SEQ ID NO: 704 - protein, 8 aa, Dengue virus
IFGTAYGV

SEQ ID NO: 705 - protein, 8 aa, Dengue virus
FGTAYGVL

SEQ ID NO: 706 - protein, 8 aa, Dengue virus
GTAYGVLF

SEQ ID NO: 707 - protein, 8 aa, Dengue virus
TAYGVLFS

SEQ ID NO: 708 - protein, 8 aa, Dengue virus
AYGVLFSG

SEQ ID NO: 709 - protein, 8 aa, Dengue virus
YGVLFSGV

SEQ ID NO: 710 - protein, 8 aa, Dengue virus
GVLFSGVS

SEQ ID NO: 711 - protein, 8 aa, Dengue virus
VLFSGVSW

SEQ ID NO: 712 - protein, 8 aa, Dengue virus
LFSGVSWT

SEQ ID NO: 713 - protein, 8 aa, Dengue virus
FSGVSWTM

SEQ ID NO: 714 - protein, 8 aa, Dengue virus
SGVSWTMK

SEQ ID NO: 715 - protein, 8 aa, Dengue virus
GVSWTMKI

SEQ ID NO: 716 - protein, 8 aa, Dengue virus
VSWTMKIG

SEQ ID NO: 717 - protein, 8 aa, Dengue virus
SWTMKIGI

SEQ ID NO: 718 - protein, 8 aa, Dengue virus
WTMKIGIG

SEQ ID NO: 719 - protein, 8 aa, Dengue virus
TMKIGIGV

SEQ ID NO: 720 - protein, 8 aa, Dengue virus
MKIGIGVL

SEQ ID NO: 721 - protein, 8 aa, Dengue virus
KIGIGVLL

SEQ ID NO: 722 - protein, 8 aa, Dengue virus
IGIGVLLT

SEQ ID NO: 723 - protein, 8 aa, Dengue virus
GIGVLLTW

SEQ ID NO: 724 - protein, 8 aa, Dengue virus
IGVLLTWL

SEQ ID NO: 725 - protein, 8 aa, Dengue virus
GVLLTWLG

SEQ ID NO: 726 - protein, 8 aa, Dengue virus
VLLTWLGL

SEQ ID NO: 727 - protein, 8 aa, Dengue virus
LLTWLGLN

SEQ ID NO: 728 - protein, 8 aa, Dengue virus
LTWLGLNS

SEQ ID NO: 729 - protein, 8 aa, Dengue virus
TWLGLNSR

SEQ ID NO: 730 - protein, 8 aa, Dengue virus
WLGLNSRS

SEQ ID NO: 731 - protein, 8 aa, Dengue virus
LGLNSRST

SEQ ID NO: 732 - protein, 8 aa, Dengue virus
GLNSRSTS

SEQ ID NO: 733 - protein, 8 aa, Dengue virus
LNSRSTSL

SEQ ID NO: 734 - protein, 8 aa, Dengue virus
NSRSTSLS

SEQ ID NO: 735 - protein, 8 aa, Dengue virus
SRSTSLSM

SEQ ID NO: 736 - protein, 8 aa, Dengue virus
RSTSLSMT

SEQ ID NO: 737 - protein, 8 aa, Dengue virus
STSLSMTC

SEQ ID NO: 738 - protein, 8 aa, Dengue virus
TSLSMTCI

SEQ ID NO: 739 - protein, 8 aa, Dengue virus
SLSMTCIA

SEQ ID NO: 740 - protein, 8 aa, Dengue virus
LSMTCIAV

SEQ ID NO: 741 - protein, 8 aa, Dengue virus
SMTCIAVG

SEQ ID NO: 742 - protein, 8 aa, Dengue virus
MTCIAVGL

SEQ ID NO: 743 - protein, 8 aa, Dengue virus
TCIAVGLV

SEQ ID NO: 744 - protein, 8 aa, Dengue virus
CIAVGLVT

SEQ ID NO: 745 - protein, 8 aa, Dengue virus
IAVGLVTL

SEQ ID NO: 746 - protein, 8 aa, Dengue virus
AVGLVTLY

SEQ ID NO: 747 - protein, 8 aa, Dengue virus
VGLVTLYL

SEQ ID NO: 748 - protein, 8 aa, Dengue virus
GLVTLYLG

SEQ ID NO: 749 - protein, 8 aa, Dengue virus
LVTLYLGV

SEQ ID NO: 750 - protein, 8 aa, Dengue virus
VTLYLGVM

SEQ ID NO: 751 - protein, 8 aa, Dengue virus
TLYLGVMV

SEQ ID NO: 752 - protein, 8 aa, Dengue virus
LYLGVMVQ

SEQ ID NO: 753 - protein, 8 aa, Dengue virus
YLGVMVQA

SEQ ID NO: 754 - protein, 8 aa, Dengue virus
LGVMVQAD

SEQ ID NO: 755 - protein, 8 aa, Dengue virus
GVMVQADS

SEQ ID NO: 756 - protein, 8 aa, Dengue virus
VMVQADSG

SEQ ID NO: 757 - protein, 8 aa, Dengue virus
MVQADSGC

SEQ ID NO: 758 - protein, 8 aa, Dengue virus
VQADSGCV

SEQ ID NO: 759 - protein, 8 aa, Dengue virus
QADSGCVI

SEQ ID NO: 760 - protein, 8 aa, Dengue virus
ADSGCVIN

SEQ ID NO: 761 - protein, 8 aa, Dengue virus
DSGCVINW

SEQ ID NO: 762 - protein, 8 aa, Dengue virus
SGCVINWK

SEQ ID NO: 763 - protein, 8 aa, Dengue virus
GCVINWKG

SEQ ID NO: 764 - protein, 8 aa, Dengue virus
CVINWKGR

SEQ ID NO: 765 - protein, 8 aa, Dengue virus
VINWKGRE

SEQ ID NO: 766 - protein, 8 aa, Dengue virus
INWKGREL

SEQ ID NO: 767 - protein, 8 aa, Dengue virus
NWKGRELK

SEQ ID NO: 768 - protein, 8 aa, Dengue virus
WKGRELKC

SEQ ID NO: 769 - protein, 8 aa, Dengue virus
KGRELKCG

SEQ ID NO: 770 - protein, 8 aa, Dengue virus
GRELKCGS

SEQ ID NO: 771 - protein, 8 aa, Dengue virus
RELKCGSG

SEQ ID NO: 772 - protein, 8 aa, Dengue virus
ELKCGSGI

SEQ ID NO: 773 - protein, 8 aa, Dengue virus
LKCGSGIF

SEQ ID NO: 774 - protein, 8 aa, Dengue virus
KCGSGIFV

SEQ ID NO: 775 - protein, 8 aa, Dengue virus
CGSGIFVT

SEQ ID NO: 776 - protein, 8 aa, Dengue virus
GSGIFVTN

SEQ ID NO: 777 - protein, 8 aa, Dengue virus
SGIFVTNE

SEQ ID NO: 778 - protein, 8 aa, Dengue virus
GIFVTNEV

SEQ ID NO: 779 - protein, 8 aa, Dengue virus
IFVTNEVH

SEQ ID NO: 780 - protein, 8 aa, Dengue virus
FVTNEVHT

SEQ ID NO: 781 - protein, 8 aa, Dengue virus
VTNEVHTW

SEQ ID NO: 782 - protein, 8 aa, Dengue virus
TNEVHTWT

SEQ ID NO: 783 - protein, 8 aa, Dengue virus
NEVHTWTE

SEQ ID NO: 784 - protein, 8 aa, Dengue virus
EVHTWTEQ

SEQ ID NO: 785 - protein, 8 aa, Dengue virus
VHTWTEQY

SEQ ID NO: 786 - protein, 8 aa, Dengue virus
HTWTEQYK

SEQ ID NO: 787 - protein, 8 aa, Dengue virus
TWTEQYKF

SEQ ID NO: 788 - protein, 8 aa, Dengue virus
WTEQYKFQ

SEQ ID NO: 789 - protein, 8 aa, Dengue virus
TEQYKFQA

SEQ ID NO: 790 - protein, 8 aa, Dengue virus
EQYKFQAD

SEQ ID NO: 791 - protein, 8 aa, Dengue virus
QYKFQADS

SEQ ID NO: 792 - protein, 8 aa, Dengue virus
YKFQADSP

SEQ ID NO: 793 - protein, 8 aa, Dengue virus
KFQADSPK

SEQ ID NO: 794 - protein, 8 aa, Dengue virus
FQADSPKR

SEQ ID NO: 795 - protein, 8 aa, Dengue virus
QADSPKRL

SEQ ID NO: 796 - protein, 8 aa, Dengue virus
ADSPKRLS

SEQ ID NO: 797 - protein, 8 aa, Dengue virus
DSPKRLSA

SEQ ID NO: 798 - protein, 8 aa, Dengue virus
SPKRLSAA

SEQ ID NO: 799 - protein, 8 aa, Dengue virus
PKRLSAAI

SEQ ID NO: 800 - protein, 8 aa, Dengue virus
KRLSAAIG

SEQ ID NO: 801 - protein, 8 aa, Dengue virus
RLSAAIGK

SEQ ID NO: 802 - protein, 8 aa, Dengue virus
LSAAIGKA

SEQ ID NO: 803 - protein, 8 aa, Dengue virus
SAAIGKAW

SEQ ID NO: 804 - protein, 8 aa, Dengue virus
AAIGKAWE

SEQ ID NO: 805 - protein, 8 aa, Dengue virus
AIGKAWEE

SEQ ID NO: 806 - protein, 8 aa, Dengue virus
IGKAWEEG

SEQ ID NO: 807 - protein, 8 aa, Dengue virus
GKAWEEGV

SEQ ID NO: 808 - protein, 8 aa, Dengue virus
KAWEEGVC

SEQ ID NO: 809 - protein, 8 aa, Dengue virus
AWEEGVCG

SEQ ID NO: 810 - protein, 8 aa, Dengue virus
WEEGVCGI

SEQ ID NO: 811 - protein, 8 aa, Dengue virus
EEGVCGIR

SEQ ID NO: 812 - protein, 8 aa, Dengue virus
EGVCGIRS

SEQ ID NO: 813 - protein, 8 aa, Dengue virus
GVCGIRSA

SEQ ID NO: 814 - protein, 8 aa, Dengue virus
VCGIRSAT

SEQ ID NO: 815 - protein, 8 aa, Dengue virus
CGIRSATR

SEQ ID NO: 816 - protein, 8 aa, Dengue virus
GIRSATRL

SEQ ID NO: 817 - protein, 8 aa, Dengue virus
IRSATRLE

SEQ ID NO: 818 - protein, 8 aa, Dengue virus
RSATRLEN

SEQ ID NO: 819 - protein, 8 aa, Dengue virus
SATRLENI

SEQ ID NO: 820 - protein, 8 aa, Dengue virus
ATRLENIM

SEQ ID NO: 821 - protein, 8 aa, Dengue virus
TRLENIMW

SEQ ID NO: 822 - protein, 8 aa, Dengue virus
RLENIMWK

SEQ ID NO: 823 - protein, 8 aa, Dengue virus
LENIMWKQ

SEQ ID NO: 824 - protein, 8 aa, Dengue virus
ENIMWKQI

SEQ ID NO: 825 - protein, 8 aa, Dengue virus
NIMWKQIS

SEQ ID NO: 826 - protein, 8 aa, Dengue virus
IMWKQISN

SEQ ID NO: 827 - protein, 8 aa, Dengue virus
MWKQISNE

SEQ ID NO: 828 - protein, 8 aa, Dengue virus
WKQISNEL

SEQ ID NO: 829 - protein, 8 aa, Dengue virus
KQISNELN

SEQ ID NO: 830 - protein, 8 aa, Dengue virus
QISNELNH

SEQ ID NO: 831 - protein, 8 aa, Dengue virus
ISNELNHI

SEQ ID NO: 832 - protein, 8 aa, Dengue virus
SNELNHIL

SEQ ID NO: 833 - protein, 8 aa, Dengue virus
NELNHILL

SEQ ID NO: 834 - protein, 8 aa, Dengue virus
ELNHILLE

SEQ ID NO: 835 - protein, 8 aa, Dengue virus
LNHILLEN

SEQ ID NO: 836 - protein, 8 aa, Dengue virus
NHILLEND

SEQ ID NO: 837 - protein, 8 aa, Dengue virus
HILLENDM

SEQ ID NO: 838 - protein, 8 aa, Dengue virus
ILLENDMK

SEQ ID NO: 839 - protein, 8 aa, Dengue virus
LLENDMKF

SEQ ID NO: 840 - protein, 8 aa, Dengue virus
LENDMKFT

SEQ ID NO: 841 - protein, 8 aa, Dengue virus
ENDMKFTV

SEQ ID NO: 842 - protein, 8 aa, Dengue virus
NDMKFTVV

SEQ ID NO: 843 - protein, 8 aa, Dengue virus
DMKFTVVV

SEQ ID NO: 844 - protein, 8 aa, Dengue virus
MKFTVVVG

SEQ ID NO: 845 - protein, 8 aa, Dengue virus
KFTVVVGD

SEQ ID NO: 846 - protein, 8 aa, Dengue virus
FTVVVGDV

SEQ ID NO: 847 - protein, 8 aa, Dengue virus
GILAQGKK

SEQ ID NO: 848 - protein, 8 aa, Dengue virus
QGKKMIRP

SEQ ID NO: 849 - protein, 8 aa, Dengue virus
GKKMIRPQ

SEQ ID NO: 850 - protein, 8 aa, Dengue virus
KKMIRPQP

SEQ ID NO: 851 - protein, 8 aa, Dengue virus
KMIRPQPM

SEQ ID NO: 852 - protein, 8 aa, Dengue virus
MIRPQPME

SEQ ID NO: 853 - protein, 8 aa, Dengue virus
IRPQPMEY

SEQ ID NO: 854 - protein, 8 aa, Dengue virus
RPQPMEYK

SEQ ID NO: 855 - protein, 8 aa, Dengue virus
PQPMEYKY

SEQ ID NO: 856 - protein, 8 aa, Dengue virus
QPMEYKYS

SEQ ID NO: 857 - protein, 8 aa, Dengue virus
PMEYKYSW

SEQ ID NO: 858 - protein, 8 aa, Dengue virus
MEYKYSWK

SEQ ID NO: 859 - protein, 8 aa, Dengue virus
EYKYSWKS

SEQ ID NO: 860 - protein, 8 aa, Dengue virus
YKYSWKSW

SEQ ID NO: 861 - protein, 8 aa, Dengue virus
KYSWKSWG

SEQ ID NO: 862 - protein, 8 aa, Dengue virus
YSWKSWGK

SEQ ID NO: 863 - protein, 8 aa, Dengue virus
SWKSWGKA

SEQ ID NO: 864 - protein, 8 aa, Dengue virus
WKSWGKAK

SEQ ID NO: 865 - protein, 8 aa, Dengue virus
KSWGKAKI

SEQ ID NO: 866 - protein, 8 aa, Dengue virus
SWGKAKII

SEQ ID NO: 867 - protein, 8 aa, Dengue virus
WGKAKIIG

SEQ ID NO: 868 - protein, 8 aa, Dengue virus
GKAKIIGA

SEQ ID NO: 869 - protein, 8 aa, Dengue virus
KAKIIGAD

SEQ ID NO: 870 - protein, 8 aa, Dengue virus
AKIIGADV

SEQ ID NO: 871 - protein, 8 aa, Dengue virus
KIIGADVQ

SEQ ID NO: 872 - protein, 8 aa, Dengue virus
IIGADVQN

SEQ ID NO: 873 - protein, 8 aa, Dengue virus
QNTTFIID

SEQ ID NO: 874 - protein, 8 aa, Dengue virus
NTTFIIDG

SEQ ID NO: 875 - protein, 8 aa, Dengue virus
TTFIIDGP

SEQ ID NO: 876 - protein, 8 aa, Dengue virus
TFIIDGPN

SEQ ID NO: 877 - protein, 8 aa, Dengue virus
FIIDGPNT

SEQ ID NO: 878 - protein, 8 aa, Dengue virus
IIDGPNTP

SEQ ID NO: 879 - protein, 8 aa, Dengue virus
IDGPNTPE

SEQ ID NO: 880 - protein, 8 aa, Dengue virus
DGPNTPEC

SEQ ID NO: 881 - protein, 8 aa, Dengue virus
GPNTPECP

SEQ ID NO: 882 - protein, 8 aa, Dengue virus
PNTPECPD

SEQ ID NO: 883 - protein, 8 aa, Dengue virus
ECPDDQRA

SEQ ID NO: 884 - protein, 8 aa, Dengue virus
CPDDQRAW

SEQ ID NO: 885 - protein, 8 aa, Dengue virus
PDDQRAWN

SEQ ID NO: 886 - protein, 8 aa, Dengue virus
DDQRAWNI

SEQ ID NO: 887 - protein, 8 aa, Dengue virus
DQRAWNIW

SEQ ID NO: 888 - protein, 8 aa, Dengue virus
QRAWNIWE

SEQ ID NO: 889 - protein, 8 aa, Dengue virus
RAWNIWEV

SEQ ID NO: 890 - protein, 8 aa, Dengue virus
AWNIWEVE

SEQ ID NO: 891 - protein, 8 aa, Dengue virus
WNIWEVED

SEQ ID NO: 892 - protein, 8 aa, Dengue virus
NIWEVEDY

SEQ ID NO: 893 - protein, 8 aa, Dengue virus
IWEVEDYG

SEQ ID NO: 894 - protein, 8 aa, Dengue virus
WEVEDYGF

SEQ ID NO: 895 - protein, 8 aa, Dengue virus
EVEDYGFG

SEQ ID NO: 896 - protein, 8 aa, Dengue virus
VEDYGFGI

SEQ ID NO: 897 - protein, 8 aa, Dengue virus
EDYGFGIF

SEQ ID NO: 898 - protein, 8 aa, Dengue virus
DYGFGIFT

SEQ ID NO: 899 - protein, 8 aa, Dengue virus
YGFGIFTT

SEQ ID NO: 900 - protein, 8 aa, Dengue virus
GFGIFTTN

SEQ ID NO: 901 - protein, 8 aa, Dengue virus
FGIFTTNI

SEQ ID NO: 902 - protein, 8 aa, Dengue virus
GIFTTNIW

SEQ ID NO: 903 - protein, 8 aa, Dengue virus
IFTTNIWL

SEQ ID NO: 904 - protein, 8 aa, Dengue virus
FTTNIWLK

SEQ ID NO: 905 - protein, 8 aa, Dengue virus
TTNIWLKL

SEQ ID NO: 906 - protein, 8 aa, Dengue virus
TNIWLKLR

SEQ ID NO: 907 - protein, 8 aa, Dengue virus
NIWLKLRD

SEQ ID NO: 908 - protein, 8 aa, Dengue virus
IWLKLRDS

SEQ ID NO: 909 - protein, 8 aa, Dengue virus
WLKLRDSY

SEQ ID NO: 910 - protein, 8 aa, Dengue virus
LKLRDSYT

SEQ ID NO: 911 - protein, 8 aa, Dengue virus
KLRDSYTQ

SEQ ID NO: 912 - protein, 8 aa, Dengue virus
RDSYTQVC

SEQ ID NO: 913 - protein, 8 aa, Dengue virus
DSYTQVCD

SEQ ID NO: 914 - protein, 8 aa, Dengue virus
SYTQVCDH

SEQ ID NO: 915 - protein, 8 aa, Dengue virus
YTQVCDHR

SEQ ID NO: 916 - protein, 8 aa, Dengue virus
TQVCDHRL

SEQ ID NO: 917 - protein, 8 aa, Dengue virus
QVCDHRLM

SEQ ID NO: 918 - protein, 8 aa, Dengue virus
VCDHRLMS

SEQ ID NO: 919 - protein, 8 aa, Dengue virus
CDHRLMSA

SEQ ID NO: 920 - protein, 8 aa, Dengue virus
DHRLMSAA

SEQ ID NO: 921 - protein, 8 aa, Dengue virus
HRLMSAAI

SEQ ID NO: 922 - protein, 8 aa, Dengue virus
RLMSAAIK

SEQ ID NO: 923 - protein, 8 aa, Dengue virus
LMSAAIKD

SEQ ID NO: 924 - protein, 8 aa, Dengue virus
MSAAIKDS

SEQ ID NO: 925 - protein, 8 aa, Dengue virus
SAAIKDSK

SEQ ID NO: 926 - protein, 8 aa, Dengue virus
AAIKDSKA

SEQ ID NO: 927 - protein, 8 aa, Dengue virus
AIKDSKAV

SEQ ID NO: 928 - protein, 8 aa, Dengue virus
IKDSKAVH

SEQ ID NO: 929 - protein, 8 aa, Dengue virus
KDSKAVHA

SEQ ID NO: 930 - protein, 8 aa, Dengue virus
DSKAVHAD

SEQ ID NO: 931 - protein, 8 aa, Dengue virus
SKAVHADM

SEQ ID NO: 932 - protein, 8 aa, Dengue virus
KAVHADMG

SEQ ID NO: 933 - protein, 8 aa, Dengue virus
AVHADMGY

SEQ ID NO: 934 - protein, 8 aa, Dengue virus
VHADMGYW

SEQ ID NO: 935 - protein, 8 aa, Dengue virus
HADMGYWI

SEQ ID NO: 936 - protein, 8 aa, Dengue virus
ADMGYWIE

SEQ ID NO: 937 - protein, 8 aa, Dengue virus
DMGYWIES

SEQ ID NO: 938 - protein, 8 aa, Dengue virus
MGYWIESE

SEQ ID NO: 939 - protein, 8 aa, Dengue virus
GYWIESEK

SEQ ID NO: 940 - protein, 8 aa, Dengue virus
YWIESEKN

SEQ ID NO: 941 - protein, 8 aa, Dengue virus
WIESEKNE

SEQ ID NO: 942 - protein, 8 aa, Dengue virus
IESEKNET

SEQ ID NO: 943 - protein, 8 aa, Dengue virus
ESEKNETW

SEQ ID NO: 944 - protein, 8 aa, Dengue virus
SEKNETWK

SEQ ID NO: 945 - protein, 8 aa, Dengue virus
EKNETWKL

SEQ ID NO: 946 - protein, 8 aa, Dengue virus
KNETWKLA

SEQ ID NO: 947 - protein, 8 aa, Dengue virus
NETWKLAR

SEQ ID NO: 948 - protein, 8 aa, Dengue virus
ETWKLARA

SEQ ID NO: 949 - protein, 8 aa, Dengue virus
TWKLARAS

SEQ ID NO: 950 - protein, 8 aa, Dengue virus
WKLARASF

SEQ ID NO: 951 - protein, 8 aa, Dengue virus
KLARASFI

SEQ ID NO: 952 - protein, 8 aa, Dengue virus
LARASFIE

SEQ ID NO: 953 - protein, 8 aa, Dengue virus
ARASFIEV

SEQ ID NO: 954 - protein, 8 aa, Dengue virus
RASFIEVK

SEQ ID NO: 955 - protein, 8 aa, Dengue virus
ASFIEVKT

SEQ ID NO: 956 - protein, 8 aa, Dengue virus
SFIEVKTC

SEQ ID NO: 957 - protein, 8 aa, Dengue virus
FIEVKTCI

SEQ ID NO: 958 - protein, 8 aa, Dengue virus
IEVKTCIW

SEQ ID NO: 959 - protein, 8 aa, Dengue virus
EVKTCIWP

SEQ ID NO: 960 - protein, 8 aa, Dengue virus
VKTCIWPK

SEQ ID NO: 961 - protein, 8 aa, Dengue virus
KTCIWPKS

SEQ ID NO: 962 - protein, 8 aa, Dengue virus
TCIWPKSH

SEQ ID NO: 963 - protein, 8 aa, Dengue virus
CIWPKSHT

SEQ ID NO: 964 - protein, 8 aa, Dengue virus
IWPKSHTL

SEQ ID NO: 965 - protein, 8 aa, Dengue virus
WPKSHTLW

SEQ ID NO: 966 - protein, 8 aa, Dengue virus
PKSHTLWS

SEQ ID NO: 967 - protein, 8 aa, Dengue virus
KSHTLWSN

SEQ ID NO: 968 - protein, 8 aa, Dengue virus
SHTLWSNG

SEQ ID NO: 969 - protein, 8 aa, Dengue virus
HTLWSNGV

SEQ ID NO: 970 - protein, 8 aa, Dengue virus
TLWSNGVL

SEQ ID NO: 971 - protein, 8 aa, Dengue virus
LWSNGVLE

SEQ ID NO: 972 - protein, 8 aa, Dengue virus
WSNGVLES

SEQ ID NO: 973 - protein, 8 aa, Dengue virus
SNGVLESE

SEQ ID NO: 974 - protein, 8 aa, Dengue virus
NGVLESEM

SEQ ID NO: 975 - protein, 8 aa, Dengue virus
GVLESEMI

SEQ ID NO: 976 - protein, 8 aa, Dengue virus
VLESEMII

SEQ ID NO: 977 - protein, 8 aa, Dengue virus
LESEMIIP

SEQ ID NO: 978 - protein, 8 aa, Dengue virus
ESEMIIPK

SEQ ID NO: 979 - protein, 8 aa, Dengue virus
SEMIIPKI

SEQ ID NO: 980 - protein, 8 aa, Dengue virus
EMIIPKIY

SEQ ID NO: 981 - protein, 8 aa, Dengue virus
MIIPKIYG

SEQ ID NO: 982 - protein, 8 aa, Dengue virus
IIPKIYGG

SEQ ID NO: 983 - protein, 8 aa, Dengue virus
IPKIYGGP

SEQ ID NO: 984 - protein, 8 aa, Dengue virus
PKIYGGPI

SEQ ID NO: 985 - protein, 8 aa, Dengue virus
KIYGGPIS

SEQ ID NO: 986 - protein, 8 aa, Dengue virus
IYGGPISQ

SEQ ID NO: 987 - protein, 8 aa, Dengue virus
YGGPISQH

SEQ ID NO: 988 - protein, 8 aa, Dengue virus
GGPISQHN

SEQ ID NO: 989 - protein, 8 aa, Dengue virus
GPISQHNY

SEQ ID NO: 990 - protein, 8 aa, Dengue virus
PISQHNYR

SEQ ID NO: 991 - protein, 8 aa, Dengue virus
ISQHNYRP

SEQ ID NO: 992 - protein, 8 aa, Dengue virus
SQHNYRPG

SEQ ID NO: 993 - protein, 8 aa, Dengue virus
QHNYRPGY

SEQ ID NO: 994 - protein, 8 aa, Dengue virus
HNYRPGYF

SEQ ID NO: 995 - protein, 8 aa, Dengue virus
NYRPGYFT

SEQ ID NO: 996 - protein, 8 aa, Dengue virus
YRPGYFTQ

SEQ ID NO: 997 - protein, 8 aa, Dengue virus
RPGYFTQT

SEQ ID NO: 998 - protein, 8 aa, Dengue virus
PGYFTQTA

SEQ ID NO: 999 - protein, 8 aa, Dengue virus
GYFTQTAG

SEQ ID NO: 1000 - protein, 8 aa, Dengue virus
YFTQTAGP

SEQ ID NO: 1001 - protein, 8 aa, Dengue virus
FTQTAGPW

SEQ ID NO: 1002 - protein, 8 aa, Dengue virus
TQTAGPWH

SEQ ID NO: 1003 - protein, 8 aa, Dengue virus
QTAGPWHL

SEQ ID NO: 1004 - protein, 8 aa, Dengue virus
TAGPWHLG

SEQ ID NO: 1005 - protein, 8 aa, Dengue virus
AGPWHLGK

SEQ ID NO: 1006 - protein, 8 aa, Dengue virus
GPWHLGKL

SEQ ID NO: 1007 - protein, 8 aa, Dengue virus
PWHLGKLE

SEQ ID NO: 1008 - protein, 8 aa, Dengue virus
WHLGKLEL

SEQ ID NO: 1009 - protein, 8 aa, Dengue virus
HLGKLELD

SEQ ID NO: 1010 - protein, 8 aa, Dengue virus
LGKLELDF

SEQ ID NO: 1011 - protein, 8 aa, Dengue virus
GKLELDFD

SEQ ID NO: 1012 - protein, 8 aa, Dengue virus
KLELDFDL

SEQ ID NO: 1013 - protein, 8 aa, Dengue virus
LELDFDLC

SEQ ID NO: 1014 - protein, 8 aa, Dengue virus
ELDFDLCE

SEQ ID NO: 1015 - protein, 8 aa, Dengue virus
LDFDLCEG

SEQ ID NO: 1016 - protein, 8 aa, Dengue virus
DFDLCEGT

SEQ ID NO: 1017 - protein, 8 aa, Dengue virus
FDLCEGTT

SEQ ID NO: 1018 - protein, 8 aa, Dengue virus
DLCEGTTV

SEQ ID NO: 1019 - protein, 8 aa, Dengue virus
LCEGTTVV

SEQ ID NO: 1020 - protein, 8 aa, Dengue virus
CEGTTVVV

SEQ ID NO: 1021 - protein, 8 aa, Dengue virus
EGTTVVVD

SEQ ID NO: 1022 - protein, 8 aa, Dengue virus
GTTVVVDE

SEQ ID NO: 1023 - protein, 8 aa, Dengue virus
TTVVVDEH

SEQ ID NO: 1024 - protein, 8 aa, Dengue virus
TVVVDEHC

SEQ ID NO: 1025 - protein, 8 aa, Dengue virus
VVVDEHCG

SEQ ID NO: 1026 - protein, 8 aa, Dengue virus
VVDEHCGN

SEQ ID NO: 1027 - protein, 8 aa, Dengue virus
VDEHCGNR

SEQ ID NO: 1028 - protein, 8 aa, Dengue virus
DEHCGNRG

SEQ ID NO: 1029 - protein, 8 aa, Dengue virus
EHCGNRGP

SEQ ID NO: 1030 - protein, 8 aa, Dengue virus
HCGNRGPS

SEQ ID NO: 1031 - protein, 8 aa, Dengue virus
CGNRGPSL

SEQ ID NO: 1032 - protein, 8 aa, Dengue virus
GNRGPSLR

SEQ ID NO: 1033 - protein, 8 aa, Dengue virus
NRGPSLRT

SEQ ID NO: 1034 - protein, 8 aa, Dengue virus
RGPSLRTT

SEQ ID NO: 1035 - protein, 8 aa, Dengue virus
GPSLRTTT

SEQ ID NO: 1036 - protein, 8 aa, Dengue virus
PSLRTTTV

SEQ ID NO: 1037 - protein, 8 aa, Dengue virus
SLRTTTVT

SEQ ID NO: 1038 - protein, 8 aa, Dengue virus
LRTTTVTG

SEQ ID NO: 1039 - protein, 8 aa, Dengue virus
RTTTVTGK

SEQ ID NO: 1040 - protein, 8 aa, Dengue virus
TTTVTGKI

SEQ ID NO: 1041 - protein, 8 aa, Dengue virus
TTVTGKII

SEQ ID NO: 1042 - protein, 8 aa, Dengue virus
TVTGKIIH

SEQ ID NO: 1043 - protein, 8 aa, Dengue virus
VTGKIIHE

SEQ ID NO: 1044 - protein, 8 aa, Dengue virus
TGKIIHEW

SEQ ID NO: 1045 - protein, 8 aa, Dengue virus
GKIIHEWC

SEQ ID NO: 1046 - protein, 8 aa, Dengue virus
KIIHEWCC

SEQ ID NO: 1047 - protein, 8 aa, Dengue virus
IIHEWCCR

SEQ ID NO: 1048 - protein, 8 aa, Dengue virus
IHEWCCRS

SEQ ID NO: 1049 - protein, 8 aa, Dengue virus
HEWCCRSC

SEQ ID NO: 1050 - protein, 8 aa, Dengue virus
EWCCRSCT

SEQ ID NO: 1051 - protein, 8 aa, Dengue virus
WCCRSCTL

SEQ ID NO: 1052 - protein, 8 aa, Dengue virus
CCRSCTLP

SEQ ID NO: 1053 - protein, 8 aa, Dengue virus
CRSCTLPP

SEQ ID NO: 1054 - protein, 8 aa, Dengue virus
RSCTLPPL

SEQ ID NO: 1055 - protein, 8 aa, Dengue virus
SCTLPPLR

SEQ ID NO: 1056 - protein, 8 aa, Dengue virus
CTLPPLRF

SEQ ID NO: 1057 - protein, 8 aa, Dengue virus
TLPPLRFR

SEQ ID NO: 1058 - protein, 8 aa, Dengue virus
LPPLRFRG

SEQ ID NO: 1059 - protein, 8 aa, Dengue virus
PPLRFRGE

SEQ ID NO: 1060 - protein, 8 aa, Dengue virus
PLRFRGED

SEQ ID NO: 1061 - protein, 8 aa, Dengue virus
LRFRGEDG

SEQ ID NO: 1062 - protein, 8 aa, Dengue virus
RFRGEDGC

SEQ ID NO: 1063 - protein, 8 aa, Dengue virus
FRGEDGCW

SEQ ID NO: 1064 - protein, 8 aa, Dengue virus
RGEDGCWY

SEQ ID NO: 1065 - protein, 8 aa, Dengue virus
GEDGCWYG

SEQ ID NO: 1066 - protein, 8 aa, Dengue virus
EDGCWYGM

SEQ ID NO: 1067 - protein, 8 aa, Dengue virus
DGCWYGME

SEQ ID NO: 1068 - protein, 8 aa, Dengue virus
GCWYGMEI

SEQ ID NO: 1069 - protein, 8 aa, Dengue virus
CWYGMEIR

SEQ ID NO: 1070 - protein, 8 aa, Dengue virus
WYGMEIRP

SEQ ID NO: 1071 - protein, 8 aa, Dengue virus
YGMEIRPV

SEQ ID NO: 1072 - protein, 8 aa, Dengue virus
GMEIRPVK

SEQ ID NO: 1073 - protein, 8 aa, Dengue virus
MEIRPVKE

SEQ ID NO: 1074 - protein, 8 aa, Dengue virus
EIRPVKEK

SEQ ID NO: 1075 - protein, 8 aa, Dengue virus
IRPVKEKE

SEQ ID NO: 1076 - protein, 8 aa, Dengue virus
RPVKEKEE

SEQ ID NO: 1077 - protein, 8 aa, Dengue virus
PVKEKEEN

SEQ ID NO: 1078 - protein, 8 aa, Dengue virus
VKEKEENL

SEQ ID NO: 1079 - protein, 8 aa, Dengue virus
KEKEENLV

SEQ ID NO: 1080 - protein, 8 aa, Dengue virus
EKEENLVK

SEQ ID NO: 1081 - protein, 8 aa, Dengue virus
KEENLVKS

SEQ ID NO: 1082 - protein, 8 aa, Dengue virus
EENLVKSM

SEQ ID NO: 1083 - protein, 8 aa, Dengue virus
ENLVKSMV

SEQ ID NO: 1084 - protein, 8 aa, Dengue virus
NLVKSMVS

SEQ ID NO: 1085 - protein, 8 aa, Dengue virus
LVKSMVSA

SEQ ID NO: 1086 - protein, 8 aa, Dengue virus
VKSMVSAG

SEQ ID NO: 1087 - protein, 8 aa, Dengue virus
KSMVSAGS

SEQ ID NO: 1088 - protein, 8 aa, Dengue virus
SMVSAGSG

SEQ ID NO: 1089 - protein, 8 aa, Dengue virus
MVSAGSGE

SEQ ID NO: 1090 - protein, 8 aa, Dengue virus
VSAGSGEV

SEQ ID NO: 1091 - protein, 8 aa, Dengue virus
SAGSGEVD

SEQ ID NO: 1092 - protein, 8 aa, Dengue virus
AGSGEVDS

SEQ ID NO: 1093 - protein, 8 aa, Dengue virus
GSGEVDSF

SEQ ID NO: 1094 - protein, 8 aa, Dengue virus
SGEVDSFS

SEQ ID NO: 1095 - protein, 8 aa, Dengue virus
GEVDSFSL

SEQ ID NO: 1096 - protein, 8 aa, Dengue virus
EVDSFSLG

SEQ ID NO: 1097 - protein, 8 aa, Dengue virus
VDSFSLGL

SEQ ID NO: 1098 - protein, 8 aa, Dengue virus
DSFSLGLL

SEQ ID NO: 1099 - protein, 8 aa, Dengue virus
SFSLGLLC

SEQ ID NO: 1100 - protein, 8 aa, Dengue virus
FSLGLLCI

SEQ ID NO: 1101 - protein, 8 aa, Dengue virus
SLGLLCIS

SEQ ID NO: 1102 - protein, 8 aa, Dengue virus
LGLLCISI

SEQ ID NO: 1103 - protein, 8 aa, Dengue virus
SIMIEEVM

SEQ ID NO: 1104 - protein, 8 aa, Dengue virus
IMIEEVMR

SEQ ID NO: 1105 - protein, 8 aa, Dengue virus
MIEEVMRS

SEQ ID NO: 1106 - protein, 8 aa, Dengue virus
IEEVMRSR

SEQ ID NO: 1107 - protein, 8 aa, Dengue virus
EEVMRSRW

SEQ ID NO: 1108 - protein, 8 aa, Dengue virus
EVMRSRWS

SEQ ID NO: 1109 - protein, 8 aa, Dengue virus
VMRSRWSR

SEQ ID NO: 1110 - protein, 8 aa, Dengue virus
MRSRWSRK

SEQ ID NO: 1111 - protein, 8 aa, Dengue virus
RSRWSRKM

SEQ ID NO: 1112 - protein, 8 aa, Dengue virus
SRWSRKML

SEQ ID NO: 1113 - protein, 8 aa, Dengue virus
RWSRKMLM

SEQ ID NO: 1114 - protein, 8 aa, Dengue virus
WSRKMLMT

SEQ ID NO: 1115 - protein, 8 aa, Dengue virus
SRKMLMTG

SEQ ID NO: 1116 - protein, 8 aa, Dengue virus
RKMLMTGT

SEQ ID NO: 1117 - protein, 8 aa, Dengue virus
KMLMTGTL

SEQ ID NO: 1118 - protein, 8 aa, Dengue virus
MLMTGTLA

SEQ ID NO: 1119 - protein, 8 aa, Dengue virus
LMTGTLAV

SEQ ID NO: 1120 - protein, 8 aa, Dengue virus
MTGTLAVF

SEQ ID NO: 1121 - protein, 8 aa, Dengue virus
GTLAVFFL

SEQ ID NO: 1122 - protein, 8 aa, Dengue virus
TLAVFFLL

SEQ ID NO: 1123 - protein, 8 aa, Dengue virus
GQLTWNDL

SEQ ID NO: 1124 - protein, 8 aa, Dengue virus
QLTWNDLI

SEQ ID NO: 1125 - protein, 8 aa, Dengue virus
LTWNDLIR

SEQ ID NO: 1126 - protein, 8 aa, Dengue virus
TWNDLIRL

SEQ ID NO: 1127 - protein, 8 aa, Dengue virus
WNDLIRLC

SEQ ID NO: 1128 - protein, 8 aa, Dengue virus
NDLIRLCI

SEQ ID NO: 1129 - protein, 8 aa, Dengue virus
DLIRLCIM

SEQ ID NO: 1130 - protein, 8 aa, Dengue virus
LIRLCIMV

SEQ ID NO: 1131 - protein, 8 aa, Dengue virus
IRLCIMVG

SEQ ID NO: 1132 - protein, 8 aa, Dengue virus
RLCIMVGA

SEQ ID NO: 1133 - protein, 8 aa, Dengue virus
LCIMVGAN

SEQ ID NO: 1134 - protein, 8 aa, Dengue virus
CIMVGANA

SEQ ID NO: 1135 - protein, 8 aa, Dengue virus
IMVGANAS

SEQ ID NO: 1136 - protein, 8 aa, Dengue virus
MVGANASD

SEQ ID NO: 1137 - protein, 8 aa, Dengue virus
VGANASDR

SEQ ID NO: 1138 - protein, 8 aa, Dengue virus
GANASDRM

SEQ ID NO: 1139 - protein, 8 aa, Dengue virus
ANASDRMG

SEQ ID NO: 1140 - protein, 8 aa, Dengue virus
NASDRMGM

SEQ ID NO: 1141 - protein, 8 aa, Dengue virus
ASDRMGMG

SEQ ID NO: 1142 - protein, 8 aa, Dengue virus
SDRMGMGT

SEQ ID NO: 1143 - protein, 8 aa, Dengue virus
DRMGMGTT

SEQ ID NO: 1144 - protein, 8 aa, Dengue virus
RMGMGTTY

SEQ ID NO: 1145 - protein, 8 aa, Dengue virus
MGMGTTYL

SEQ ID NO: 1146 - protein, 8 aa, Dengue virus
GMGTTYLA

SEQ ID NO: 1147 - protein, 8 aa, Dengue virus
MGTTYLAL

SEQ ID NO: 1148 - protein, 8 aa, Dengue virus
GTTYLALM

SEQ ID NO: 1149 - protein, 8 aa, Dengue virus
TTYLALMA

SEQ ID NO: 1150 - protein, 8 aa, Dengue virus
TYLALMAT

SEQ ID NO: 1151 - protein, 8 aa, Dengue virus
YLALMATF

SEQ ID NO: 1152 - protein, 8 aa, Dengue virus
LALMATFK

SEQ ID NO: 1153 - protein, 8 aa, Dengue virus
ALMATFKM

SEQ ID NO: 1154 - protein, 8 aa, Dengue virus
LMATFKMR

SEQ ID NO: 1155 - protein, 8 aa, Dengue virus
MATFKMRP

SEQ ID NO: 1156 - protein, 8 aa, Dengue virus
ATFKMRPM

SEQ ID NO: 1157 - protein, 8 aa, Dengue virus
TFKMRPMF

SEQ ID NO: 1158 - protein, 8 aa, Dengue virus
FKMRPMFA

SEQ ID NO: 1159 - protein, 8 aa, Dengue virus
KMRPMFAV

SEQ ID NO: 1160 - protein, 8 aa, Dengue virus
MRPMFAVG

SEQ ID NO: 1161 - protein, 8 aa, Dengue virus
RPMFAVGL

SEQ ID NO: 1162 - protein, 8 aa, Dengue virus
PMFAVGLL

SEQ ID NO: 1163 - protein, 8 aa, Dengue virus
MFAVGLLF

SEQ ID NO: 1164 - protein, 8 aa, Dengue virus
FAVGLLFR

SEQ ID NO: 1165 - protein, 8 aa, Dengue virus
AVGLLFRR

SEQ ID NO: 1166 - protein, 8 aa, Dengue virus
VGLLFRRL

SEQ ID NO: 1167 - protein, 8 aa, Dengue virus
GLLFRRLT

SEQ ID NO: 1168 - protein, 8 aa, Dengue virus
LLFRRLTS

SEQ ID NO: 1169 - protein, 8 aa, Dengue virus
LFRRLTSR

SEQ ID NO: 1170 - protein, 8 aa, Dengue virus
FRRLTSRE

SEQ ID NO: 1171 - protein, 8 aa, Dengue virus
RRLTSREV

SEQ ID NO: 1172 - protein, 8 aa, Dengue virus
RLTSREVL

SEQ ID NO: 1173 - protein, 8 aa, Dengue virus
LTSREVLL

SEQ ID NO: 1174 - protein, 8 aa, Dengue virus
TSREVLLL

SEQ ID NO: 1175 - protein, 8 aa, Dengue virus
SREVLLLT

SEQ ID NO: 1176 - protein, 8 aa, Dengue virus
REVLLLTI

SEQ ID NO: 1177 - protein, 8 aa, Dengue virus
EVLLLTIG

SEQ ID NO: 1178 - protein, 8 aa, Dengue virus
VLLLTIGL

SEQ ID NO: 1179 - protein, 8 aa, Dengue virus
LLLTIGLS

SEQ ID NO: 1180 - protein, 8 aa, Dengue virus
LLTIGLSL

SEQ ID NO: 1181 - protein, 8 aa, Dengue virus
LTIGLSLV

SEQ ID NO: 1182 - protein, 8 aa, Dengue virus
TIGLSLVA

SEQ ID NO: 1183 - protein, 8 aa, Dengue virus
IGLSLVAS

SEQ ID NO: 1184 - protein, 8 aa, Dengue virus
GLSLVASV

SEQ ID NO: 1185 - protein, 8 aa, Dengue virus
LSLVASVE

SEQ ID NO: 1186 - protein, 8 aa, Dengue virus
SLVASVEL

SEQ ID NO: 1187 - protein, 8 aa, Dengue virus
LVASVELP

SEQ ID NO: 1188 - protein, 8 aa, Dengue virus
ASVELPNS

SEQ ID NO: 1189 - protein, 8 aa, Dengue virus
SVELPNSL

SEQ ID NO: 1190 - protein, 8 aa, Dengue virus
VELPNSLE

SEQ ID NO: 1191 - protein, 8 aa, Dengue virus
ELPNSLEE

SEQ ID NO: 1192 - protein, 8 aa, Dengue virus
LPNSLEEL

SEQ ID NO: 1193 - protein, 8 aa, Dengue virus
PNSLEELG

SEQ ID NO: 1194 - protein, 8 aa, Dengue virus
NSLEELGD

SEQ ID NO: 1195 - protein, 8 aa, Dengue virus
SLEELGDG

SEQ ID NO: 1196 - protein, 8 aa, Dengue virus
LEELGDGL

SEQ ID NO: 1197 - protein, 8 aa, Dengue virus
EELGDGLA

SEQ ID NO: 1198 - protein, 8 aa, Dengue virus
ELGDGLAM

SEQ ID NO: 1199 - protein, 8 aa, Dengue virus
LGDGLAMG

SEQ ID NO: 1200 - protein, 8 aa, Dengue virus
GDGLAMGI

SEQ ID NO: 1201 - protein, 8 aa, Dengue virus
DGLAMGIM

SEQ ID NO: 1202 - protein, 8 aa, Dengue virus
GLAMGIMI

SEQ ID NO: 1203 - protein, 8 aa, Dengue virus
LAMGIMIL

SEQ ID NO: 1204 - protein, 8 aa, Dengue virus
AMGIMILK

SEQ ID NO: 1205 - protein, 8 aa, Dengue virus
MGIMILKL

SEQ ID NO: 1206 - protein, 8 aa, Dengue virus
GIMILKLL

SEQ ID NO: 1207 - protein, 8 aa, Dengue virus
IMILKLLT

SEQ ID NO: 1208 - protein, 8 aa, Dengue virus
MILKLLTD

SEQ ID NO: 1209 - protein, 8 aa, Dengue virus
ILKLLTDF

SEQ ID NO: 1210 - protein, 8 aa, Dengue virus
LKLLTDFQ

SEQ ID NO: 1211 - protein, 8 aa, Dengue virus
KLLTDFQS

SEQ ID NO: 1212 - protein, 8 aa, Dengue virus
LLTDFQSH

SEQ ID NO: 1213 - protein, 8 aa, Dengue virus
LTDFQSHQ

SEQ ID NO: 1214 - protein, 8 aa, Dengue virus
TDFQSHQL

SEQ ID NO: 1215 - protein, 8 aa, Dengue virus
DFQSHQLW

SEQ ID NO: 1216 - protein, 8 aa, Dengue virus
QLWATLLS

SEQ ID NO: 1217 - protein, 8 aa, Dengue virus
TLLSLTFI

SEQ ID NO: 1218 - protein, 8 aa, Dengue virus
LLSLTFIK

SEQ ID NO: 1219 - protein, 8 aa, Dengue virus
LSLTFIKT

SEQ ID NO: 1220 - protein, 8 aa, Dengue virus
SLHYAWKT

SEQ ID NO: 1221 - protein, 8 aa, Dengue virus
HYAWKTMA

SEQ ID NO: 1222 - protein, 8 aa, Dengue virus
YAWKTMAM

SEQ ID NO: 1223 - protein, 8 aa, Dengue virus
AMVLSIVS

SEQ ID NO: 1224 - protein, 8 aa, Dengue virus
MVLSIVSL

SEQ ID NO: 1225 - protein, 8 aa, Dengue virus
LSIVSLFP

SEQ ID NO: 1226 - protein, 8 aa, Dengue virus
SIVSLFPL

SEQ ID NO: 1227 - protein, 8 aa, Dengue virus
IVSLFPLC

SEQ ID NO: 1228 - protein, 8 aa, Dengue virus
VSLFPLCL

SEQ ID NO: 1229 - protein, 8 aa, Dengue virus
SLFPLCLS

SEQ ID NO: 1230 - protein, 8 aa, Dengue virus
LFPLCLST

SEQ ID NO: 1231 - protein, 8 aa, Dengue virus
FPLCLSTT

SEQ ID NO: 1232 - protein, 8 aa, Dengue virus
PLCLSTTS

SEQ ID NO: 1233 - protein, 8 aa, Dengue virus
LCLSTTSQ

SEQ ID NO: 1234 - protein, 8 aa, Dengue virus
CLSTTSQK

SEQ ID NO: 1235 - protein, 8 aa, Dengue virus
LSTTSQKT

SEQ ID NO: 1236 - protein, 8 aa, Dengue virus
STTSQKTT

SEQ ID NO: 1237 - protein, 8 aa, Dengue virus
TTSQKTTW

SEQ ID NO: 1238 - protein, 8 aa, Dengue virus
TSQKTTWL

SEQ ID NO: 1239 - protein, 8 aa, Dengue virus
SQKTTWLP

SEQ ID NO: 1240 - protein, 8 aa, Dengue virus
QKTTWLPV

SEQ ID NO: 1241 - protein, 8 aa, Dengue virus
KTTWLPVL

SEQ ID NO: 1242 - protein, 8 aa, Dengue virus
TTWLPVLL

SEQ ID NO: 1243 - protein, 8 aa, Dengue virus
TWLPVLLG

SEQ ID NO: 1244 - protein, 8 aa, Dengue virus
WLPVLLGS

SEQ ID NO: 1245 - protein, 8 aa, Dengue virus
LPVLLGSL

SEQ ID NO: 1246 - protein, 8 aa, Dengue virus
PVLLGSLG

SEQ ID NO: 1247 - protein, 8 aa, Dengue virus
VLLGSLGC

SEQ ID NO: 1248 - protein, 8 aa, Dengue virus
LLGSLGCK

SEQ ID NO: 1249 - protein, 8 aa, Dengue virus
LGSLGCKP

SEQ ID NO: 1250 - protein, 8 aa, Dengue virus
GSLGCKPL

SEQ ID NO: 1251 - protein, 8 aa, Dengue virus
SLGCKPLT

SEQ ID NO: 1252 - protein, 8 aa, Dengue virus
LGCKPLTM

SEQ ID NO: 1253 - protein, 8 aa, Dengue virus
GCKPLTMF

SEQ ID NO: 1254 - protein, 8 aa, Dengue virus
CKPLTMFL

SEQ ID NO: 1255 - protein, 8 aa, Dengue virus
KPLTMFLI

SEQ ID NO: 1256 - protein, 8 aa, Dengue virus
PLTMFLIA

SEQ ID NO: 1257 - protein, 8 aa, Dengue virus
LTMFLIAE

SEQ ID NO: 1258 - protein, 8 aa, Dengue virus
IAENKIWG

SEQ ID NO: 1259 - protein, 8 aa, Dengue virus
AENKIWGR

SEQ ID NO: 1260 - protein, 8 aa, Dengue virus
ENKIWGRK

SEQ ID NO: 1261 - protein, 8 aa, Dengue virus
NKIWGRKS

SEQ ID NO: 1262 - protein, 8 aa, Dengue virus
KIWGRKSW

SEQ ID NO: 1263 - protein, 8 aa, Dengue virus
IWGRKSWP

SEQ ID NO: 1264 - protein, 8 aa, Dengue virus
WGRKSWPL

SEQ ID NO: 1265 - protein, 8 aa, Dengue virus
GRKSWPLN

SEQ ID NO: 1266 - protein, 8 aa, Dengue virus
RKSWPLNE

SEQ ID NO: 1267 - protein, 8 aa, Dengue virus
KSWPLNEG

SEQ ID NO: 1268 - protein, 8 aa, Dengue virus
SWPLNEGI

SEQ ID NO: 1269 - protein, 8 aa, Dengue virus
WPLNEGIM

SEQ ID NO: 1270 - protein, 8 aa, Dengue virus
PLNEGIMA

SEQ ID NO: 1271 - protein, 8 aa, Dengue virus
LNEGIMAV

SEQ ID NO: 1272 - protein, 8 aa, Dengue virus
NEGIMAVG

SEQ ID NO: 1273 - protein, 8 aa, Dengue virus
EGIMAVGI

SEQ ID NO: 1274 - protein, 8 aa, Dengue virus
GIMAVGIV

SEQ ID NO: 1275 - protein, 8 aa, Dengue virus
IMAVGIVS

SEQ ID NO: 1276 - protein, 8 aa, Dengue virus
MAVGIVSI

SEQ ID NO: 1277 - protein, 8 aa, Dengue virus
AVGIVSIL

SEQ ID NO: 1278 - protein, 8 aa, Dengue virus
VGIVSILL

SEQ ID NO: 1279 - protein, 8 aa, Dengue virus
GIVSILLS

SEQ ID NO: 1280 - protein, 8 aa, Dengue virus
IVSILLSS

SEQ ID NO: 1281 - protein, 8 aa, Dengue virus
VSILLSSL

SEQ ID NO: 1282 - protein, 8 aa, Dengue virus
SILLSSLL

SEQ ID NO: 1283 - protein, 8 aa, Dengue virus
ILLSSLLK

SEQ ID NO: 1284 - protein, 8 aa, Dengue virus
LLSSLLKN

SEQ ID NO: 1285 - protein, 8 aa, Dengue virus
LSSLLKND

SEQ ID NO: 1286 - protein, 8 aa, Dengue virus
SSLLKNDV

SEQ ID NO: 1287 - protein, 8 aa, Dengue virus
SLLKNDVP

SEQ ID NO: 1288 - protein, 8 aa, Dengue virus
LLKNDVPL

SEQ ID NO: 1289 - protein, 8 aa, Dengue virus
LKNDVPLA

SEQ ID NO: 1290 - protein, 8 aa, Dengue virus
KNDVPLAG

SEQ ID NO: 1291 - protein, 8 aa, Dengue virus
NDVPLAGP

SEQ ID NO: 1292 - protein, 8 aa, Dengue virus
DVPLAGPL

SEQ ID NO: 1293 - protein, 8 aa, Dengue virus
VPLAGPLI

SEQ ID NO: 1294 - protein, 8 aa, Dengue virus
PLAGPLIA

SEQ ID NO: 1295 - protein, 8 aa, Dengue virus
LAGPLIAG

SEQ ID NO: 1296 - protein, 8 aa, Dengue virus
AGPLIAGG

SEQ ID NO: 1297 - protein, 8 aa, Dengue virus
GPLIAGGM

SEQ ID NO: 1298 - protein, 8 aa, Dengue virus
PLIAGGML

SEQ ID NO: 1299 - protein, 8 aa, Dengue virus
LIAGGMLI

SEQ ID NO: 1300 - protein, 8 aa, Dengue virus
IAGGMLIA

SEQ ID NO: 1301 - protein, 8 aa, Dengue virus
AGGMLIAC

SEQ ID NO: 1302 - protein, 8 aa, Dengue virus
GGMLIACY

SEQ ID NO: 1303 - protein, 8 aa, Dengue virus
GMLIACYV

SEQ ID NO: 1304 - protein, 8 aa, Dengue virus
MLIACYVI

SEQ ID NO: 1305 - protein, 8 aa, Dengue virus
LIACYVIS

SEQ ID NO: 1306 - protein, 8 aa, Dengue virus
IACYVISG

SEQ ID NO: 1307 - protein, 8 aa, Dengue virus
ACYVISGS

SEQ ID NO: 1308 - protein, 8 aa, Dengue virus
CYVISGSS

SEQ ID NO: 1309 - protein, 8 aa, Dengue virus
YVISGSSA

SEQ ID NO: 1310 - protein, 8 aa, Dengue virus
VISGSSAD

SEQ ID NO: 1311 - protein, 8 aa, Dengue virus
ISGSSADL

SEQ ID NO: 1312 - protein, 8 aa, Dengue virus
SGSSADLS

SEQ ID NO: 1313 - protein, 8 aa, Dengue virus
GSSADLSL

SEQ ID NO: 1314 - protein, 8 aa, Dengue virus
SSADLSLE

SEQ ID NO: 1315 - protein, 8 aa, Dengue virus
SADLSLEK

SEQ ID NO: 1316 - protein, 8 aa, Dengue virus
ADLSLEKA

SEQ ID NO: 1317 - protein, 8 aa, Dengue virus
DLSLEKAA

SEQ ID NO: 1318 - protein, 8 aa, Dengue virus
LSLEKAAE

SEQ ID NO: 1319 - protein, 8 aa, Dengue virus
SLEKAAEV

SEQ ID NO: 1320 - protein, 8 aa, Dengue virus
LEKAAEVS

SEQ ID NO: 1321 - protein, 8 aa, Dengue virus
EKAAEVSW

SEQ ID NO: 1322 - protein, 8 aa, Dengue virus
KAAEVSWE

SEQ ID NO: 1323 - protein, 8 aa, Dengue virus
AAEVSWEE

SEQ ID NO: 1324 - protein, 8 aa, Dengue virus
AEVSWEEE

SEQ ID NO: 1325 - protein, 8 aa, Dengue virus
EVSWEEEA

SEQ ID NO: 1326 - protein, 8 aa, Dengue virus
VSWEEEAE

SEQ ID NO: 1327 - protein, 8 aa, Dengue virus
SWEEEAEH

SEQ ID NO: 1328 - protein, 8 aa, Dengue virus
WEEEAEHS

SEQ ID NO: 1329 - protein, 8 aa, Dengue virus
EEEAEHSG

SEQ ID NO: 1330 - protein, 8 aa, Dengue virus
EEAEHSGA

SEQ ID NO: 1331 - protein, 8 aa, Dengue virus
EAEHSGAS

SEQ ID NO: 1332 - protein, 8 aa, Dengue virus
AEHSGASH

SEQ ID NO: 1333 - protein, 8 aa, Dengue virus
EHSGASHN

SEQ ID NO: 1334 - protein, 8 aa, Dengue virus
HSGASHNI

SEQ ID NO: 1335 - protein, 8 aa, Dengue virus
SGASHNIL

SEQ ID NO: 1336 - protein, 8 aa, Dengue virus
GASHNILV

SEQ ID NO: 1337 - protein, 8 aa, Dengue virus
ASHNILVE

SEQ ID NO: 1338 - protein, 8 aa, Dengue virus
SHNILVEV

SEQ ID NO: 1339 - protein, 8 aa, Dengue virus
HNILVEVQ

SEQ ID NO: 1340 - protein, 8 aa, Dengue virus
NILVEVQD

SEQ ID NO: 1341 - protein, 8 aa, Dengue virus
ILVEVQDD

SEQ ID NO: 1342 - protein, 8 aa, Dengue virus
LVEVQDDG

SEQ ID NO: 1343 - protein, 8 aa, Dengue virus
VEVQDDGT

SEQ ID NO: 1344 - protein, 8 aa, Dengue virus
EVQDDGTM

SEQ ID NO: 1345 - protein, 8 aa, Dengue virus
VQDDGTMK

SEQ ID NO: 1346 - protein, 8 aa, Dengue virus
QDDGTMKI

SEQ ID NO: 1347 - protein, 8 aa, Dengue virus
DDGTMKIK

SEQ ID NO: 1348 - protein, 8 aa, Dengue virus
DGTMKIKD

SEQ ID NO: 1349 - protein, 8 aa, Dengue virus
GTMKIKDE

SEQ ID NO: 1350 - protein, 8 aa, Dengue virus
TMKIKDEE

SEQ ID NO: 1351 - protein, 8 aa, Dengue virus
MKIKDEER

SEQ ID NO: 1352 - protein, 8 aa, Dengue virus
KIKDEERD

SEQ ID NO: 1353 - protein, 8 aa, Dengue virus
IKDEERDD

SEQ ID NO: 1354 - protein, 8 aa, Dengue virus
KDEERDDT

SEQ ID NO: 1355 - protein, 8 aa, Dengue virus
DEERDDTL

SEQ ID NO: 1356 - protein, 8 aa, Dengue virus
EERDDTLT

SEQ ID NO: 1357 - protein, 8 aa, Dengue virus
ERDDTLTI

SEQ ID NO: 1358 - protein, 8 aa, Dengue virus
RDDTLTIL

SEQ ID NO: 1359 - protein, 8 aa, Dengue virus
DDTLTILL

SEQ ID NO: 1360 - protein, 8 aa, Dengue virus
DTLTILLK

SEQ ID NO: 1361 - protein, 8 aa, Dengue virus
TLTILLKA

SEQ ID NO: 1362 - protein, 8 aa, Dengue virus
LTILLKAT

SEQ ID NO: 1363 - protein, 8 aa, Dengue virus
TILLKATL

SEQ ID NO: 1364 - protein, 8 aa, Dengue virus
ILLKATLL

SEQ ID NO: 1365 - protein, 8 aa, Dengue virus
LLKATLLA

SEQ ID NO: 1366 - protein, 8 aa, Dengue virus
LKATLLAV

SEQ ID NO: 1367 - protein, 8 aa, Dengue virus
KATLLAVS

SEQ ID NO: 1368 - protein, 8 aa, Dengue virus
ATLLAVSG

SEQ ID NO: 1369 - protein, 8 aa, Dengue virus
TLLAVSGV

SEQ ID NO: 1370 - protein, 8 aa, Dengue virus
LLAVSGVY

SEQ ID NO: 1371 - protein, 8 aa, Dengue virus
LAVSGVYP

SEQ ID NO: 1372 - protein, 8 aa, Dengue virus
AVSGVYPL

SEQ ID NO: 1373 - protein, 8 aa, Dengue virus
VSGVYPLS

SEQ ID NO: 1374 - protein, 8 aa, Dengue virus
SGVYPLSI

SEQ ID NO: 1375 - protein, 8 aa, Dengue virus
GVYPLSIP

SEQ ID NO: 1376 - protein, 8 aa, Dengue virus
VYPLSIPA

SEQ ID NO: 1377 - protein, 8 aa, Dengue virus
YPLSIPAT

SEQ ID NO: 1378 - protein, 8 aa, Dengue virus
PLSIPATL

SEQ ID NO: 1379 - protein, 8 aa, Dengue virus
LSIPATLF

SEQ ID NO: 1380 - protein, 8 aa, Dengue virus
SIPATLFV

SEQ ID NO: 1381 - protein, 8 aa, Dengue virus
IPATLFVW

SEQ ID NO: 1382 - protein, 8 aa, Dengue virus
PATLFVWY

SEQ ID NO: 1383 - protein, 8 aa, Dengue virus
ATLFVWYF

SEQ ID NO: 1384 - protein, 8 aa, Dengue virus
TLFVWYFW

SEQ ID NO: 1385 - protein, 8 aa, Dengue virus
LFVWYFWQ

SEQ ID NO: 1386 - protein, 8 aa, Dengue virus
KKKQRSGV

SEQ ID NO: 1387 - protein, 8 aa, Dengue virus
KKQRSGVL

SEQ ID NO: 1388 - protein, 8 aa, Dengue virus
KQRSGVLW

SEQ ID NO: 1389 - protein, 8 aa, Dengue virus
QRSGVLWD

SEQ ID NO: 1390 - protein, 8 aa, Dengue virus
RSGVLWDT

SEQ ID NO: 1391 - protein, 8 aa, Dengue virus
SGVLWDTP

SEQ ID NO: 1392 - protein, 8 aa, Dengue virus
GVLWDTPS

SEQ ID NO: 1393 - protein, 8 aa, Dengue virus
VLWDTPSP

SEQ ID NO: 1394 - protein, 8 aa, Dengue virus
LWDTPSPP

SEQ ID NO: 1395 - protein, 8 aa, Dengue virus
WDTPSPPE

SEQ ID NO: 1396 - protein, 8 aa, Dengue virus
DTPSPPEV

SEQ ID NO: 1397 - protein, 8 aa, Dengue virus
TPSPPEVE

SEQ ID NO: 1398 - protein, 8 aa, Dengue virus
PSPPEVER

SEQ ID NO: 1399 - protein, 8 aa, Dengue virus
SPPEVERA

SEQ ID NO: 1400 - protein, 8 aa, Dengue virus
PPEVERAV

SEQ ID NO: 1401 - protein, 8 aa, Dengue virus
PEVERAVL

SEQ ID NO: 1402 - protein, 8 aa, Dengue virus
EVERAVLD

SEQ ID NO: 1403 - protein, 8 aa, Dengue virus
VERAVLDD

SEQ ID NO: 1404 - protein, 8 aa, Dengue virus
ERAVLDDG

SEQ ID NO: 1405 - protein, 8 aa, Dengue virus
RAVLDDGI

SEQ ID NO: 1406 - protein, 8 aa, Dengue virus
AVLDDGIY

SEQ ID NO: 1407 - protein, 8 aa, Dengue virus
VLDDGIYR

SEQ ID NO: 1408 - protein, 8 aa, Dengue virus
LDDGIYRI

SEQ ID NO: 1409 - protein, 8 aa, Dengue virus
DDGIYRIM

SEQ ID NO: 1410 - protein, 8 aa, Dengue virus
DGIYRIMQ

SEQ ID NO: 1411 - protein, 8 aa, Dengue virus
GIYRIMQR

SEQ ID NO: 1412 - protein, 8 aa, Dengue virus
IYRIMQRG

SEQ ID NO: 1413 - protein, 8 aa, Dengue virus
YRIMQRGL

SEQ ID NO: 1414 - protein, 8 aa, Dengue virus
RIMQRGLL

SEQ ID NO: 1415 - protein, 8 aa, Dengue virus
IMQRGLLG

SEQ ID NO: 1416 - protein, 8 aa, Dengue virus
MQRGLLGR

SEQ ID NO: 1417 - protein, 8 aa, Dengue virus
QRGLLGRS

SEQ ID NO: 1418 - protein, 8 aa, Dengue virus
RGLLGRSQ

SEQ ID NO: 1419 - protein, 8 aa, Dengue virus
GLLGRSQV

SEQ ID NO: 1420 - protein, 8 aa, Dengue virus
LLGRSQVG

SEQ ID NO: 1421 - protein, 8 aa, Dengue virus
LGRSQVGV

SEQ ID NO: 1422 - protein, 8 aa, Dengue virus
GRSQVGVG

SEQ ID NO: 1423 - protein, 8 aa, Dengue virus
RSQVGVGV

SEQ ID NO: 1424 - protein, 8 aa, Dengue virus
SQVGVGVF

SEQ ID NO: 1425 - protein, 8 aa, Dengue virus
QVGVGVFQ

SEQ ID NO: 1426 - protein, 8 aa, Dengue virus
VGVGVFQE

SEQ ID NO: 1427 - protein, 8 aa, Dengue virus
GVGVFQEN

SEQ ID NO: 1428 - protein, 8 aa, Dengue virus
VGVFQENV

SEQ ID NO: 1429 - protein, 8 aa, Dengue virus
GVFQENVF

SEQ ID NO: 1430 - protein, 8 aa, Dengue virus
VFQENVFH

SEQ ID NO: 1431 - protein, 8 aa, Dengue virus
FQENVFHT

SEQ ID NO: 1432 - protein, 8 aa, Dengue virus
QENVFHTM

SEQ ID NO: 1433 - protein, 8 aa, Dengue virus
ENVFHTMW

SEQ ID NO: 1434 - protein, 8 aa, Dengue virus
NVFHTMWH

SEQ ID NO: 1435 - protein, 8 aa, Dengue virus
VFHTMWHV

SEQ ID NO: 1436 - protein, 8 aa, Dengue virus
FHTMWHVT

SEQ ID NO: 1437 - protein, 8 aa, Dengue virus
HTMWHVTR

SEQ ID NO: 1438 - protein, 8 aa, Dengue virus
TMWHVTRG

SEQ ID NO: 1439 - protein, 8 aa, Dengue virus
MWHVTRGA

SEQ ID NO: 1440 - protein, 8 aa, Dengue virus
WHVTRGAV

SEQ ID NO: 1441 - protein, 8 aa, Dengue virus
HVTRGAVL

SEQ ID NO: 1442 - protein, 8 aa, Dengue virus
VTRGAVLM

SEQ ID NO: 1443 - protein, 8 aa, Dengue virus
TRGAVLMY

SEQ ID NO: 1444 - protein, 8 aa, Dengue virus
RGAVLMYQ

SEQ ID NO: 1445 - protein, 8 aa, Dengue virus
GAVLMYQG

SEQ ID NO: 1446 - protein, 8 aa, Dengue virus
AVLMYQGK

SEQ ID NO: 1447 - protein, 8 aa, Dengue virus
VLMYQGKR

SEQ ID NO: 1448 - protein, 8 aa, Dengue virus
LMYQGKRL

SEQ ID NO: 1449 - protein, 8 aa, Dengue virus
MYQGKRLE

SEQ ID NO: 1450 - protein, 8 aa, Dengue virus
YQGKRLEP

SEQ ID NO: 1451 - protein, 8 aa, Dengue virus
QGKRLEPS

SEQ ID NO: 1452 - protein, 8 aa, Dengue virus
GKRLEPSW

SEQ ID NO: 1453 - protein, 8 aa, Dengue virus
KRLEPSWA

SEQ ID NO: 1454 - protein, 8 aa, Dengue virus
RLEPSWAS

SEQ ID NO: 1455 - protein, 8 aa, Dengue virus
LEPSWASV

SEQ ID NO: 1456 - protein, 8 aa, Dengue virus
EPSWASVK

SEQ ID NO: 1457 - protein, 8 aa, Dengue virus
PSWASVKK

SEQ ID NO: 1458 - protein, 8 aa, Dengue virus
SWASVKKD

SEQ ID NO: 1459 - protein, 8 aa, Dengue virus
WASVKKDL

SEQ ID NO: 1460 - protein, 8 aa, Dengue virus
ASVKKDLI

SEQ ID NO: 1461 - protein, 8 aa, Dengue virus
SVKKDLIS

SEQ ID NO: 1462 - protein, 8 aa, Dengue virus
VKKDLISY

SEQ ID NO: 1463 - protein, 8 aa, Dengue virus
KKDLISYG

SEQ ID NO: 1464 - protein, 8 aa, Dengue virus
KDLISYGG

SEQ ID NO: 1465 - protein, 8 aa, Dengue virus
DLISYGGG

SEQ ID NO: 1466 - protein, 8 aa, Dengue virus
LISYGGGW

SEQ ID NO: 1467 - protein, 8 aa, Dengue virus
ISYGGGWR

SEQ ID NO: 1468 - protein, 8 aa, Dengue virus
SYGGGWRL

SEQ ID NO: 1469 - protein, 8 aa, Dengue virus
YGGGWRLQ

SEQ ID NO: 1470 - protein, 8 aa, Dengue virus
GGGWRLQG

SEQ ID NO: 1471 - protein, 8 aa, Dengue virus
GGWRLQGS

SEQ ID NO: 1472 - protein, 8 aa, Dengue virus
GWRLQGSW

SEQ ID NO: 1473 - protein, 8 aa, Dengue virus
WRLQGSWN

SEQ ID NO: 1474 - protein, 8 aa, Dengue virus
QGSWNTGE

SEQ ID NO: 1475 - protein, 8 aa, Dengue virus
GSWNTGEE

SEQ ID NO: 1476 - protein, 8 aa, Dengue virus
SWNTGEEV

SEQ ID NO: 1477 - protein, 8 aa, Dengue virus
WNTGEEVQ

SEQ ID NO: 1478 - protein, 8 aa, Dengue virus
NTGEEVQV

SEQ ID NO: 1479 - protein, 8 aa, Dengue virus
TGEEVQVI

SEQ ID NO: 1480 - protein, 8 aa, Dengue virus
GEEVQVIA

SEQ ID NO: 1481 - protein, 8 aa, Dengue virus
EEVQVIAV

SEQ ID NO: 1482 - protein, 8 aa, Dengue virus
EVQVIAVE

SEQ ID NO: 1483 - protein, 8 aa, Dengue virus
VQVIAVEP

SEQ ID NO: 1484 - protein, 8 aa, Dengue virus
QVIAVEPG

SEQ ID NO: 1485 - protein, 8 aa, Dengue virus
VIAVEPGK

SEQ ID NO: 1486 - protein, 8 aa, Dengue virus
IAVEPGKN

SEQ ID NO: 1487 - protein, 8 aa, Dengue virus
AVEPGKNP

SEQ ID NO: 1488 - protein, 8 aa, Dengue virus
VEPGKNPK

SEQ ID NO: 1489 - protein, 8 aa, Dengue virus
EPGKNPKN

SEQ ID NO: 1490 - protein, 8 aa, Dengue virus
PGKNPKNV

SEQ ID NO: 1491 - protein, 8 aa, Dengue virus
GKNPKNVQ

SEQ ID NO: 1492 - protein, 8 aa, Dengue virus
KNPKNVQT

SEQ ID NO: 1493 - protein, 8 aa, Dengue virus
NPKNVQTA

SEQ ID NO: 1494 - protein, 8 aa, Dengue virus
PKNVQTAP

SEQ ID NO: 1495 - protein, 8 aa, Dengue virus
KNVQTAPG

SEQ ID NO: 1496 - protein, 8 aa, Dengue virus
NVQTAPGT

SEQ ID NO: 1497 - protein, 8 aa, Dengue virus
VQTAPGTF

SEQ ID NO: 1498 - protein, 8 aa, Dengue virus
QTAPGTFK

SEQ ID NO: 1499 - protein, 8 aa, Dengue virus
TAPGTFKT

SEQ ID NO: 1500 - protein, 8 aa, Dengue virus
APGTFKTP

SEQ ID NO: 1501 - protein, 8 aa, Dengue virus
PGTFKTPE

SEQ ID NO: 1502 - protein, 8 aa, Dengue virus
GTFKTPEG

SEQ ID NO: 1503 - protein, 8 aa, Dengue virus
TFKTPEGE

SEQ ID NO: 1504 - protein, 8 aa, Dengue virus
FKTPEGEV

SEQ ID NO: 1505 - protein, 8 aa, Dengue virus
KTPEGEVG

SEQ ID NO: 1506 - protein, 8 aa, Dengue virus
TPEGEVGA

SEQ ID NO: 1507 - protein, 8 aa, Dengue virus
PEGEVGAI

SEQ ID NO: 1508 - protein, 8 aa, Dengue virus
EGEVGAIA

SEQ ID NO: 1509 - protein, 8 aa, Dengue virus
GEVGAIAL

SEQ ID NO: 1510 - protein, 8 aa, Dengue virus
EVGAIALD

SEQ ID NO: 1511 - protein, 8 aa, Dengue virus
VGAIALDF

SEQ ID NO: 1512 - protein, 8 aa, Dengue virus
GAIALDFK

SEQ ID NO: 1513 - protein, 8 aa, Dengue virus
AIALDFKP

SEQ ID NO: 1514 - protein, 8 aa, Dengue virus
IALDFKPG

SEQ ID NO: 1515 - protein, 8 aa, Dengue virus
ALDFKPGT

SEQ ID NO: 1516 - protein, 8 aa, Dengue virus
LDFKPGTS

SEQ ID NO: 1517 - protein, 8 aa, Dengue virus
DFKPGTSG

SEQ ID NO: 1518 - protein, 8 aa, Dengue virus
FKPGTSGS

SEQ ID NO: 1519 - protein, 8 aa, Dengue virus
KPGTSGSP

SEQ ID NO: 1520 - protein, 8 aa, Dengue virus
PGTSGSPI

SEQ ID NO: 1521 - protein, 8 aa, Dengue virus
GTSGSPIV

SEQ ID NO: 1522 - protein, 8 aa, Dengue virus
TSGSPIVN

SEQ ID NO: 1523 - protein, 8 aa, Dengue virus
SGSPIVNR

SEQ ID NO: 1524 - protein, 8 aa, Dengue virus
GSPIVNRE

SEQ ID NO: 1525 - protein, 8 aa, Dengue virus
SPIVNREG

SEQ ID NO: 1526 - protein, 8 aa, Dengue virus
PIVNREGK

SEQ ID NO: 1527 - protein, 8 aa, Dengue virus
IVNREGKI

SEQ ID NO: 1528 - protein, 8 aa, Dengue virus
VNREGKIV

SEQ ID NO: 1529 - protein, 8 aa, Dengue virus
NREGKIVG

SEQ ID NO: 1530 - protein, 8 aa, Dengue virus
REGKIVGL

SEQ ID NO: 1531 - protein, 8 aa, Dengue virus
EGKIVGLY

SEQ ID NO: 1532 - protein, 8 aa, Dengue virus
GKIVGLYG

SEQ ID NO: 1533 - protein, 8 aa, Dengue virus
KIVGLYGN

SEQ ID NO: 1534 - protein, 8 aa, Dengue virus
IVGLYGNG

SEQ ID NO: 1535 - protein, 8 aa, Dengue virus
VGLYGNGV

SEQ ID NO: 1536 - protein, 8 aa, Dengue virus
GLYGNGVV

SEQ ID NO: 1537 - protein, 8 aa, Dengue virus
LYGNGVVT

SEQ ID NO: 1538 - protein, 8 aa, Dengue virus
YGNGVVTT

SEQ ID NO: 1539 - protein, 8 aa, Dengue virus
GNGVVTTS

SEQ ID NO: 1540 - protein, 8 aa, Dengue virus
NGVVTTSG

SEQ ID NO: 1541 - protein, 8 aa, Dengue virus
GVVTTSGT

SEQ ID NO: 1542 - protein, 8 aa, Dengue virus
VVTTSGTY

SEQ ID NO: 1543 - protein, 8 aa, Dengue virus
VTTSGTYV

SEQ ID NO: 1544 - protein, 8 aa, Dengue virus
TTSGTYVS

SEQ ID NO: 1545 - protein, 8 aa, Dengue virus
TSGTYVSA

SEQ ID NO: 1546 - protein, 8 aa, Dengue virus
SGTYVSAI

SEQ ID NO: 1547 - protein, 8 aa, Dengue virus
GTYVSAIA

SEQ ID NO: 1548 - protein, 8 aa, Dengue virus
TYVSAIAQ

SEQ ID NO: 1549 - protein, 8 aa, Dengue virus
YVSAIAQA

SEQ ID NO: 1550 - protein, 8 aa, Dengue virus
VSAIAQAK

SEQ ID NO: 1551 - protein, 8 aa, Dengue virus
SAIAQAKA

SEQ ID NO: 1552 - protein, 8 aa, Dengue virus
AIAQAKAS

SEQ ID NO: 1553 - protein, 8 aa, Dengue virus
IAQAKASQ

SEQ ID NO: 1554 - protein, 8 aa, Dengue virus
AQAKASQE

SEQ ID NO: 1555 - protein, 8 aa, Dengue virus
QAKASQEG

SEQ ID NO: 1556 - protein, 8 aa, Dengue virus
AKASQEGP

SEQ ID NO: 1557 - protein, 8 aa, Dengue virus
KASQEGPL

SEQ ID NO: 1558 - protein, 8 aa, Dengue virus
ASQEGPLP

SEQ ID NO: 1559 - protein, 8 aa, Dengue virus
SQEGPLPE

SEQ ID NO: 1560 - protein, 8 aa, Dengue virus
QEGPLPEI

SEQ ID NO: 1561 - protein, 8 aa, Dengue virus
EGPLPEIE

SEQ ID NO: 1562 - protein, 8 aa, Dengue virus
GPLPEIED

SEQ ID NO: 1563 - protein, 8 aa, Dengue virus
PLPEIEDE

SEQ ID NO: 1564 - protein, 8 aa, Dengue virus
LPEIEDEV

SEQ ID NO: 1565 - protein, 8 aa, Dengue virus
PEIEDEVF

SEQ ID NO: 1566 - protein, 8 aa, Dengue virus
EIEDEVFR

SEQ ID NO: 1567 - protein, 8 aa, Dengue virus
IEDEVFRK

SEQ ID NO: 1568 - protein, 8 aa, Dengue virus
EDEVFRKR

SEQ ID NO: 1569 - protein, 8 aa, Dengue virus
DEVFRKRN

SEQ ID NO: 1570 - protein, 8 aa, Dengue virus
EVFRKRNL

SEQ ID NO: 1571 - protein, 8 aa, Dengue virus
VFRKRNLT

SEQ ID NO: 1572 - protein, 8 aa, Dengue virus
FRKRNLTI

SEQ ID NO: 1573 - protein, 8 aa, Dengue virus
RKRNLTIM

SEQ ID NO: 1574 - protein, 8 aa, Dengue virus
KRNLTIMD

SEQ ID NO: 1575 - protein, 8 aa, Dengue virus
RNLTIMDL

SEQ ID NO: 1576 - protein, 8 aa, Dengue virus
NLTIMDLH

SEQ ID NO: 1577 - protein, 8 aa, Dengue virus
LTIMDLHP

SEQ ID NO: 1578 - protein, 8 aa, Dengue virus
TIMDLHPG

SEQ ID NO: 1579 - protein, 8 aa, Dengue virus
IMDLHPGS

SEQ ID NO: 1580 - protein, 8 aa, Dengue virus
MDLHPGSG

SEQ ID NO: 1581 - protein, 8 aa, Dengue virus
DLHPGSGK

SEQ ID NO: 1582 - protein, 8 aa, Dengue virus
LHPGSGKT

SEQ ID NO: 1583 - protein, 8 aa, Dengue virus
HPGSGKTR

SEQ ID NO: 1584 - protein, 8 aa, Dengue virus
PGSGKTRR

SEQ ID NO: 1585 - protein, 8 aa, Dengue virus
GSGKTRRY

SEQ ID NO: 1586 - protein, 8 aa, Dengue virus
SGKTRRYL

SEQ ID NO: 1587 - protein, 8 aa, Dengue virus
GKTRRYLP

SEQ ID NO: 1588 - protein, 8 aa, Dengue virus
KTRRYLPA

SEQ ID NO: 1589 - protein, 8 aa, Dengue virus
TRRYLPAI

SEQ ID NO: 1590 - protein, 8 aa, Dengue virus
RRYLPAIV

SEQ ID NO: 1591 - protein, 8 aa, Dengue virus
RYLPAIVR

SEQ ID NO: 1592 - protein, 8 aa, Dengue virus
YLPAIVRE

SEQ ID NO: 1593 - protein, 8 aa, Dengue virus
LPAIVREA

SEQ ID NO: 1594 - protein, 8 aa, Dengue virus
PAIVREAI

SEQ ID NO: 1595 - protein, 8 aa, Dengue virus
AIVREAIK

SEQ ID NO: 1596 - protein, 8 aa, Dengue virus
IVREAIKR

SEQ ID NO: 1597 - protein, 8 aa, Dengue virus
VREAIKRK

SEQ ID NO: 1598 - protein, 8 aa, Dengue virus
REAIKRKL

SEQ ID NO: 1599 - protein, 8 aa, Dengue virus
EAIKRKLR

SEQ ID NO: 1600 - protein, 8 aa, Dengue virus
AIKRKLRT

SEQ ID NO: 1601 - protein, 8 aa, Dengue virus
IKRKLRTL

SEQ ID NO: 1602 - protein, 8 aa, Dengue virus
KRKLRTLI

SEQ ID NO: 1603 - protein, 8 aa, Dengue virus
RKLRTLIL

SEQ ID NO: 1604 - protein, 8 aa, Dengue virus
KLRTLILA

SEQ ID NO: 1605 - protein, 8 aa, Dengue virus
LRTLILAP

SEQ ID NO: 1606 - protein, 8 aa, Dengue virus
RTLILAPT

SEQ ID NO: 1607 - protein, 8 aa, Dengue virus
TLILAPTR

SEQ ID NO: 1608 - protein, 8 aa, Dengue virus
LILAPTRV

SEQ ID NO: 1609 - protein, 8 aa, Dengue virus
ILAPTRVV

SEQ ID NO: 1610 - protein, 8 aa, Dengue virus
LAPTRVVA

SEQ ID NO: 1611 - protein, 8 aa, Dengue virus
APTRVVAS

SEQ ID NO: 1612 - protein, 8 aa, Dengue virus
PTRVVASE

SEQ ID NO: 1613 - protein, 8 aa, Dengue virus
TRVVASEM

SEQ ID NO: 1614 - protein, 8 aa, Dengue virus
RVVASEMA

SEQ ID NO: 1615 - protein, 8 aa, Dengue virus
VVASEMAE

SEQ ID NO: 1616 - protein, 8 aa, Dengue virus
VASEMAEA

SEQ ID NO: 1617 - protein, 8 aa, Dengue virus
ASEMAEAL

SEQ ID NO: 1618 - protein, 8 aa, Dengue virus
SEMAEALK

SEQ ID NO: 1619 - protein, 8 aa, Dengue virus
EMAEALKG

SEQ ID NO: 1620 - protein, 8 aa, Dengue virus
MAEALKGM

SEQ ID NO: 1621 - protein, 8 aa, Dengue virus
AEALKGMP

SEQ ID NO: 1622 - protein, 8 aa, Dengue virus
EALKGMPI

SEQ ID NO: 1623 - protein, 8 aa, Dengue virus
ALKGMPIR

SEQ ID NO: 1624 - protein, 8 aa, Dengue virus
LKGMPIRY

SEQ ID NO: 1625 - protein, 8 aa, Dengue virus
KGMPIRYQ

SEQ ID NO: 1626 - protein, 8 aa, Dengue virus
GMPIRYQT

SEQ ID NO: 1627 - protein, 8 aa, Dengue virus
MPIRYQTT

SEQ ID NO: 1628 - protein, 8 aa, Dengue virus
PIRYQTTA

SEQ ID NO: 1629 - protein, 8 aa, Dengue virus
IRYQTTAV

SEQ ID NO: 1630 - protein, 8 aa, Dengue virus
RYQTTAVK

SEQ ID NO: 1631 - protein, 8 aa, Dengue virus
YQTTAVKS

SEQ ID NO: 1632 - protein, 8 aa, Dengue virus
QTTAVKSE

SEQ ID NO: 1633 - protein, 8 aa, Dengue virus
TTAVKSEH

SEQ ID NO: 1634 - protein, 8 aa, Dengue virus
TAVKSEHT

SEQ ID NO: 1635 - protein, 8 aa, Dengue virus
AVKSEHTG

SEQ ID NO: 1636 - protein, 8 aa, Dengue virus
VKSEHTGK

SEQ ID NO: 1637 - protein, 8 aa, Dengue virus
KSEHTGKE

SEQ ID NO: 1638 - protein, 8 aa, Dengue virus
SEHTGKEI

SEQ ID NO: 1639 - protein, 8 aa, Dengue virus
EHTGKEIV

SEQ ID NO: 1640 - protein, 8 aa, Dengue virus
HTGKEIVD

SEQ ID NO: 1641 - protein, 8 aa, Dengue virus
TGKEIVDL

SEQ ID NO: 1642 - protein, 8 aa, Dengue virus
GKEIVDLM

SEQ ID NO: 1643 - protein, 8 aa, Dengue virus
KEIVDLMC

SEQ ID NO: 1644 - protein, 8 aa, Dengue virus
EIVDLMCH

SEQ ID NO: 1645 - protein, 8 aa, Dengue virus
IVDLMCHA

SEQ ID NO: 1646 - protein, 8 aa, Dengue virus
VDLMCHAT

SEQ ID NO: 1647 - protein, 8 aa, Dengue virus
DLMCHATF

SEQ ID NO: 1648 - protein, 8 aa, Dengue virus
LMCHATFT

SEQ ID NO: 1649 - protein, 8 aa, Dengue virus
MCHATFTM

SEQ ID NO: 1650 - protein, 8 aa, Dengue virus
CHATFTMR

SEQ ID NO: 1651 - protein, 8 aa, Dengue virus
HATFTMRL

SEQ ID NO: 1652 - protein, 8 aa, Dengue virus
ATFTMRLL

SEQ ID NO: 1653 - protein, 8 aa, Dengue virus
TFTMRLLS

SEQ ID NO: 1654 - protein, 8 aa, Dengue virus
FTMRLLSP

SEQ ID NO: 1655 - protein, 8 aa, Dengue virus
TMRLLSPV

SEQ ID NO: 1656 - protein, 8 aa, Dengue virus
MRLLSPVR

SEQ ID NO: 1657 - protein, 8 aa, Dengue virus
RLLSPVRV

SEQ ID NO: 1658 - protein, 8 aa, Dengue virus
LLSPVRVP

SEQ ID NO: 1659 - protein, 8 aa, Dengue virus
LSPVRVPN

SEQ ID NO: 1660 - protein, 8 aa, Dengue virus
SPVRVPNY

SEQ ID NO: 1661 - protein, 8 aa, Dengue virus
PVRVPNYN

SEQ ID NO: 1662 - protein, 8 aa, Dengue virus
VRVPNYNM

SEQ ID NO: 1663 - protein, 8 aa, Dengue virus
RVPNYNMI

SEQ ID NO: 1664 - protein, 8 aa, Dengue virus
VPNYNMII

SEQ ID NO: 1665 - protein, 8 aa, Dengue virus
PNYNMIIM

SEQ ID NO: 1666 - protein, 8 aa, Dengue virus
NYNMIIMD

SEQ ID NO: 1667 - protein, 8 aa, Dengue virus
YNMIIMDE

SEQ ID NO: 1668 - protein, 8 aa, Dengue virus
NMIIMDEA

SEQ ID NO: 1669 - protein, 8 aa, Dengue virus
MIIMDEAH

SEQ ID NO: 1670 - protein, 8 aa, Dengue virus
IIMDEAHF

SEQ ID NO: 1671 - protein, 8 aa, Dengue virus
IMDEAHFT

SEQ ID NO: 1672 - protein, 8 aa, Dengue virus
MDEAHFTD

SEQ ID NO: 1673 - protein, 8 aa, Dengue virus
DEAHFTDP

SEQ ID NO: 1674 - protein, 8 aa, Dengue virus
EAHFTDPS

SEQ ID NO: 1675 - protein, 8 aa, Dengue virus
AHFTDPSS

SEQ ID NO: 1676 - protein, 8 aa, Dengue virus
HFTDPSSI

SEQ ID NO: 1677 - protein, 8 aa, Dengue virus
FTDPSSIA

SEQ ID NO: 1678 - protein, 8 aa, Dengue virus
TDPSSIAA

SEQ ID NO: 1679 - protein, 8 aa, Dengue virus
DPSSIAAR

SEQ ID NO: 1680 - protein, 8 aa, Dengue virus
PSSIAARG

SEQ ID NO: 1681 - protein, 8 aa, Dengue virus
SSIAARGY

SEQ ID NO: 1682 - protein, 8 aa, Dengue virus
SIAARGYI

SEQ ID NO: 1683 - protein, 8 aa, Dengue virus
IAARGYIS

SEQ ID NO: 1684 - protein, 8 aa, Dengue virus
AARGYIST

SEQ ID NO: 1685 - protein, 8 aa, Dengue virus
ARGYISTR

SEQ ID NO: 1686 - protein, 8 aa, Dengue virus
RGYISTRV

SEQ ID NO: 1687 - protein, 8 aa, Dengue virus
GYISTRVG

SEQ ID NO: 1688 - protein, 8 aa, Dengue virus
YISTRVGM

SEQ ID NO: 1689 - protein, 8 aa, Dengue virus
ISTRVGMG

SEQ ID NO: 1690 - protein, 8 aa, Dengue virus
STRVGMGE

SEQ ID NO: 1691 - protein, 8 aa, Dengue virus
TRVGMGEA

SEQ ID NO: 1692 - protein, 8 aa, Dengue virus
RVGMGEAA

SEQ ID NO: 1693 - protein, 8 aa, Dengue virus
VGMGEAAA

SEQ ID NO: 1694 - protein, 8 aa, Dengue virus
GMGEAAAI

SEQ ID NO: 1695 - protein, 8 aa, Dengue virus
MGEAAAIF

SEQ ID NO: 1696 - protein, 8 aa, Dengue virus
GEAAAIFM

SEQ ID NO: 1697 - protein, 8 aa, Dengue virus
EAAAIFMT

SEQ ID NO: 1698 - protein, 8 aa, Dengue virus
AAAIFMTA

SEQ ID NO: 1699 - protein, 8 aa, Dengue virus
AAIFMTAT

SEQ ID NO: 1700 - protein, 8 aa, Dengue virus
AIFMTATP

SEQ ID NO: 1701 - protein, 8 aa, Dengue virus
IFMTATPP

SEQ ID NO: 1702 - protein, 8 aa, Dengue virus
FMTATPPG

SEQ ID NO: 1703 - protein, 8 aa, Dengue virus
MTATPPGS

SEQ ID NO: 1704 - protein, 8 aa, Dengue virus
TATPPGSV

SEQ ID NO: 1705 - protein, 8 aa, Dengue virus
ATPPGSVE

SEQ ID NO: 1706 - protein, 8 aa, Dengue virus
TPPGSVEA

SEQ ID NO: 1707 - protein, 8 aa, Dengue virus
PPGSVEAF

SEQ ID NO: 1708 - protein, 8 aa, Dengue virus
PGSVEAFP

SEQ ID NO: 1709 - protein, 8 aa, Dengue virus
GSVEAFPQ

SEQ ID NO: 1710 - protein, 8 aa, Dengue virus
SVEAFPQS

SEQ ID NO: 1711 - protein, 8 aa, Dengue virus
VEAFPQSN

SEQ ID NO: 1712 - protein, 8 aa, Dengue virus
EAFPQSNA

SEQ ID NO: 1713 - protein, 8 aa, Dengue virus
AFPQSNAV

SEQ ID NO: 1714 - protein, 8 aa, Dengue virus
FPQSNAVI

SEQ ID NO: 1715 - protein, 8 aa, Dengue virus
PQSNAVIQ

SEQ ID NO: 1716 - protein, 8 aa, Dengue virus
QSNAVIQD

SEQ ID NO: 1717 - protein, 8 aa, Dengue virus
SNAVIQDE

SEQ ID NO: 1718 - protein, 8 aa, Dengue virus
NAVIQDEE

SEQ ID NO: 1719 - protein, 8 aa, Dengue virus
AVIQDEER

SEQ ID NO: 1720 - protein, 8 aa, Dengue virus
VIQDEERD

SEQ ID NO: 1721 - protein, 8 aa, Dengue virus
IQDEERDI

SEQ ID NO: 1722 - protein, 8 aa, Dengue virus
QDEERDIP

SEQ ID NO: 1723 - protein, 8 aa, Dengue virus
DEERDIPE

SEQ ID NO: 1724 - protein, 8 aa, Dengue virus
EERDIPER

SEQ ID NO: 1725 - protein, 8 aa, Dengue virus
ERDIPERS

SEQ ID NO: 1726 - protein, 8 aa, Dengue virus
RDIPERSW

SEQ ID NO: 1727 - protein, 8 aa, Dengue virus
DIPERSWN

SEQ ID NO: 1728 - protein, 8 aa, Dengue virus
IPERSWNS

SEQ ID NO: 1729 - protein, 8 aa, Dengue virus
PERSWNSG

SEQ ID NO: 1730 - protein, 8 aa, Dengue virus
ERSWNSGY

SEQ ID NO: 1731 - protein, 8 aa, Dengue virus
RSWNSGYE

SEQ ID NO: 1732 - protein, 8 aa, Dengue virus
SWNSGYEW

SEQ ID NO: 1733 - protein, 8 aa, Dengue virus
WNSGYEWI

SEQ ID NO: 1734 - protein, 8 aa, Dengue virus
NSGYEWIT

SEQ ID NO: 1735 - protein, 8 aa, Dengue virus
SGYEWITD

SEQ ID NO: 1736 - protein, 8 aa, Dengue virus
GYEWITDF

SEQ ID NO: 1737 - protein, 8 aa, Dengue virus
YEWITDFP

SEQ ID NO: 1738 - protein, 8 aa, Dengue virus
EWITDFPG

SEQ ID NO: 1739 - protein, 8 aa, Dengue virus
WITDFPGK

SEQ ID NO: 1740 - protein, 8 aa, Dengue virus
ITDFPGKT

SEQ ID NO: 1741 - protein, 8 aa, Dengue virus
TDFPGKTV

SEQ ID NO: 1742 - protein, 8 aa, Dengue virus
DFPGKTVW

SEQ ID NO: 1743 - protein, 8 aa, Dengue virus
FPGKTVWF

SEQ ID NO: 1744 - protein, 8 aa, Dengue virus
PGKTVWFV

SEQ ID NO: 1745 - protein, 8 aa, Dengue virus
GKTVWFVP

SEQ ID NO: 1746 - protein, 8 aa, Dengue virus
KTVWFVPS

SEQ ID NO: 1747 - protein, 8 aa, Dengue virus
TVWFVPSI

SEQ ID NO: 1748 - protein, 8 aa, Dengue virus
VWFVPSIK

SEQ ID NO: 1749 - protein, 8 aa, Dengue virus
WFVPSIKS

SEQ ID NO: 1750 - protein, 8 aa, Dengue virus
FVPSIKSG

SEQ ID NO: 1751 - protein, 8 aa, Dengue virus
VPSIKSGN

SEQ ID NO: 1752 - protein, 8 aa, Dengue virus
PSIKSGND

SEQ ID NO: 1753 - protein, 8 aa, Dengue virus
SIKSGNDI

SEQ ID NO: 1754 - protein, 8 aa, Dengue virus
IKSGNDIA

SEQ ID NO: 1755 - protein, 8 aa, Dengue virus
KSGNDIAN

SEQ ID NO: 1756 - protein, 8 aa, Dengue virus
SGNDIANC

SEQ ID NO: 1757 - protein, 8 aa, Dengue virus
GNDIANCL

SEQ ID NO: 1758 - protein, 8 aa, Dengue virus
NDIANCLR

SEQ ID NO: 1759 - protein, 8 aa, Dengue virus
DIANCLRK

SEQ ID NO: 1760 - protein, 8 aa, Dengue virus
IANCLRKN

SEQ ID NO: 1761 - protein, 8 aa, Dengue virus
ANCLRKNG

SEQ ID NO: 1762 - protein, 8 aa, Dengue virus
NCLRKNGK

SEQ ID NO: 1763 - protein, 8 aa, Dengue virus
CLRKNGKR

SEQ ID NO: 1764 - protein, 8 aa, Dengue virus
LRKNGKRV

SEQ ID NO: 1765 - protein, 8 aa, Dengue virus
RKNGKRVI

SEQ ID NO: 1766 - protein, 8 aa, Dengue virus
KNGKRVIQ

SEQ ID NO: 1767 - protein, 8 aa, Dengue virus
NGKRVIQL

SEQ ID NO: 1768 - protein, 8 aa, Dengue virus
GKRVIQLS

SEQ ID NO: 1769 - protein, 8 aa, Dengue virus
KRVIQLSR

SEQ ID NO: 1770 - protein, 8 aa, Dengue virus
RVIQLSRK

SEQ ID NO: 1771 - protein, 8 aa, Dengue virus
VIQLSRKT

SEQ ID NO: 1772 - protein, 8 aa, Dengue virus
IQLSRKTF

SEQ ID NO: 1773 - protein, 8 aa, Dengue virus
QLSRKTFD

SEQ ID NO: 1774 - protein, 8 aa, Dengue virus
LSRKTFDT

SEQ ID NO: 1775 - protein, 8 aa, Dengue virus
SRKTFDTE

SEQ ID NO: 1776 - protein, 8 aa, Dengue virus
RKTFDTEY

SEQ ID NO: 1777 - protein, 8 aa, Dengue virus
KTFDTEYQ

SEQ ID NO: 1778 - protein, 8 aa, Dengue virus
TFDTEYQK

SEQ ID NO: 1779 - protein, 8 aa, Dengue virus
FDTEYQKT

SEQ ID NO: 1780 - protein, 8 aa, Dengue virus
DTEYQKTK

SEQ ID NO: 1781 - protein, 8 aa, Dengue virus
TEYQKTKN

SEQ ID NO: 1782 - protein, 8 aa, Dengue virus
EYQKTKNN

SEQ ID NO: 1783 - protein, 8 aa, Dengue virus
YQKTKNND

SEQ ID NO: 1784 - protein, 8 aa, Dengue virus
QKTKNNDW

SEQ ID NO: 1785 - protein, 8 aa, Dengue virus
KTKNNDWD

SEQ ID NO: 1786 - protein, 8 aa, Dengue virus
TKNNDWDY

SEQ ID NO: 1787 - protein, 8 aa, Dengue virus
KNNDWDYV

SEQ ID NO: 1788 - protein, 8 aa, Dengue virus
NNDWDYVV

SEQ ID NO: 1789 - protein, 8 aa, Dengue virus
NDWDYVVT

SEQ ID NO: 1790 - protein, 8 aa, Dengue virus
DWDYVVTT

SEQ ID NO: 1791 - protein, 8 aa, Dengue virus
WDYVVTTD

SEQ ID NO: 1792 - protein, 8 aa, Dengue virus
DYVVTTDI

SEQ ID NO: 1793 - protein, 8 aa, Dengue virus
YVVTTDIS

SEQ ID NO: 1794 - protein, 8 aa, Dengue virus
VVTTDISE

SEQ ID NO: 1795 - protein, 8 aa, Dengue virus
VTTDISEM

SEQ ID NO: 1796 - protein, 8 aa, Dengue virus
TTDISEMG

SEQ ID NO: 1797 - protein, 8 aa, Dengue virus
TDISEMGA

SEQ ID NO: 1798 - protein, 8 aa, Dengue virus
DISEMGAN

SEQ ID NO: 1799 - protein, 8 aa, Dengue virus
ISEMGANF

SEQ ID NO: 1800 - protein, 8 aa, Dengue virus
SEMGANFR

SEQ ID NO: 1801 - protein, 8 aa, Dengue virus
EMGANFRA

SEQ ID NO: 1802 - protein, 8 aa, Dengue virus
MGANFRAD

SEQ ID NO: 1803 - protein, 8 aa, Dengue virus
GANFRADR

SEQ ID NO: 1804 - protein, 8 aa, Dengue virus
ANFRADRV

SEQ ID NO: 1805 - protein, 8 aa, Dengue virus
NFRADRVI

SEQ ID NO: 1806 - protein, 8 aa, Dengue virus
FRADRVID

SEQ ID NO: 1807 - protein, 8 aa, Dengue virus
RADRVIDP

SEQ ID NO: 1808 - protein, 8 aa, Dengue virus
ADRVIDPR

SEQ ID NO: 1809 - protein, 8 aa, Dengue virus
DRVIDPRR

SEQ ID NO: 1810 - protein, 8 aa, Dengue virus
RVIDPRRC

SEQ ID NO: 1811 - protein, 8 aa, Dengue virus
VIDPRRCL

SEQ ID NO: 1812 - protein, 8 aa, Dengue virus
IDPRRCLK

SEQ ID NO: 1813 - protein, 8 aa, Dengue virus
DPRRCLKP

SEQ ID NO: 1814 - protein, 8 aa, Dengue virus
PRRCLKPV

SEQ ID NO: 1815 - protein, 8 aa, Dengue virus
RRCLKPVI

SEQ ID NO: 1816 - protein, 8 aa, Dengue virus
RCLKPVIL

SEQ ID NO: 1817 - protein, 8 aa, Dengue virus
CLKPVILK

SEQ ID NO: 1818 - protein, 8 aa, Dengue virus
LKPVILKD

SEQ ID NO: 1819 - protein, 8 aa, Dengue virus
KPVILKDG

SEQ ID NO: 1820 - protein, 8 aa, Dengue virus
PVILKDGP

SEQ ID NO: 1821 - protein, 8 aa, Dengue virus
VILKDGPE

SEQ ID NO: 1822 - protein, 8 aa, Dengue virus
ILKDGPER

SEQ ID NO: 1823 - protein, 8 aa, Dengue virus
LKDGPERV

SEQ ID NO: 1824 - protein, 8 aa, Dengue virus
KDGPERVI

SEQ ID NO: 1825 - protein, 8 aa, Dengue virus
DGPERVIL

SEQ ID NO: 1826 - protein, 8 aa, Dengue virus
GPERVILA

SEQ ID NO: 1827 - protein, 8 aa, Dengue virus
PERVILAG

SEQ ID NO: 1828 - protein, 8 aa, Dengue virus
ERVILAGP

SEQ ID NO: 1829 - protein, 8 aa, Dengue virus
RVILAGPM

SEQ ID NO: 1830 - protein, 8 aa, Dengue virus
VILAGPMP

SEQ ID NO: 1831 - protein, 8 aa, Dengue virus
ILAGPMPV

SEQ ID NO: 1832 - protein, 8 aa, Dengue virus
LAGPMPVT

SEQ ID NO: 1833 - protein, 8 aa, Dengue virus
AGPMPVTV

SEQ ID NO: 1834 - protein, 8 aa, Dengue virus
GPMPVTVA

SEQ ID NO: 1835 - protein, 8 aa, Dengue virus
PMPVTVAS

SEQ ID NO: 1836 - protein, 8 aa, Dengue virus
MPVTVASA

SEQ ID NO: 1837 - protein, 8 aa, Dengue virus
PVTVASAA

SEQ ID NO: 1838 - protein, 8 aa, Dengue virus
VTVASAAQ

SEQ ID NO: 1839 - protein, 8 aa, Dengue virus
TVASAAQR

SEQ ID NO: 1840 - protein, 8 aa, Dengue virus
VASAAQRR

SEQ ID NO: 1841 - protein, 8 aa, Dengue virus
ASAAQRRG

SEQ ID NO: 1842 - protein, 8 aa, Dengue virus
SAAQRRGR

SEQ ID NO: 1843 - protein, 8 aa, Dengue virus
AAQRRGRI

SEQ ID NO: 1844 - protein, 8 aa, Dengue virus
AQRRGRIG

SEQ ID NO: 1845 - protein, 8 aa, Dengue virus
QRRGRIGR

SEQ ID NO: 1846 - protein, 8 aa, Dengue virus
RRGRIGRN

SEQ ID NO: 1847 - protein, 8 aa, Dengue virus
RGRIGRNH

SEQ ID NO: 1848 - protein, 8 aa, Dengue virus
GRIGRNHN

SEQ ID NO: 1849 - protein, 8 aa, Dengue virus
RIGRNHNK

SEQ ID NO: 1850 - protein, 8 aa, Dengue virus
IGRNHNKE

SEQ ID NO: 1851 - protein, 8 aa, Dengue virus
GRNHNKEG

SEQ ID NO: 1852 - protein, 8 aa, Dengue virus
RNHNKEGD

SEQ ID NO: 1853 - protein, 8 aa, Dengue virus
NHNKEGDQ

SEQ ID NO: 1854 - protein, 8 aa, Dengue virus
HNKEGDQY

SEQ ID NO: 1855 - protein, 8 aa, Dengue virus
NKEGDQYI

SEQ ID NO: 1856 - protein, 8 aa, Dengue virus
KEGDQYIY

SEQ ID NO: 1857 - protein, 8 aa, Dengue virus
EGDQYIYM

SEQ ID NO: 1858 - protein, 8 aa, Dengue virus
GDQYIYMG

SEQ ID NO: 1859 - protein, 8 aa, Dengue virus
DQYIYMGQ

SEQ ID NO: 1860 - protein, 8 aa, Dengue virus
QYIYMGQP

SEQ ID NO: 1861 - protein, 8 aa, Dengue virus
YIYMGQPL

SEQ ID NO: 1862 - protein, 8 aa, Dengue virus
IYMGQPLN

SEQ ID NO: 1863 - protein, 8 aa, Dengue virus
YMGQPLNN

SEQ ID NO: 1864 - protein, 8 aa, Dengue virus
MGQPLNND

SEQ ID NO: 1865 - protein, 8 aa, Dengue virus
GQPLNNDE

SEQ ID NO: 1866 - protein, 8 aa, Dengue virus
QPLNNDED

SEQ ID NO: 1867 - protein, 8 aa, Dengue virus
PLNNDEDH

SEQ ID NO: 1868 - protein, 8 aa, Dengue virus
LNNDEDHA

SEQ ID NO: 1869 - protein, 8 aa, Dengue virus
NNDEDHAH

SEQ ID NO: 1870 - protein, 8 aa, Dengue virus
NDEDHAHW

SEQ ID NO: 1871 - protein, 8 aa, Dengue virus
DEDHAHWT

SEQ ID NO: 1872 - protein, 8 aa, Dengue virus
EDHAHWTE

SEQ ID NO: 1873 - protein, 8 aa, Dengue virus
DHAHWTEA

SEQ ID NO: 1874 - protein, 8 aa, Dengue virus
HAHWTEAK

SEQ ID NO: 1875 - protein, 8 aa, Dengue virus
AHWTEAKM

SEQ ID NO: 1876 - protein, 8 aa, Dengue virus
HWTEAKML

SEQ ID NO: 1877 - protein, 8 aa, Dengue virus
WTEAKMLL

SEQ ID NO: 1878 - protein, 8 aa, Dengue virus
TEAKMLLD

SEQ ID NO: 1879 - protein, 8 aa, Dengue virus
EAKMLLDN

SEQ ID NO: 1880 - protein, 8 aa, Dengue virus
AKMLLDNI

SEQ ID NO: 1881 - protein, 8 aa, Dengue virus
KMLLDNIN

SEQ ID NO: 1882 - protein, 8 aa, Dengue virus
MLLDNINT

SEQ ID NO: 1883 - protein, 8 aa, Dengue virus
LLDNINTP

SEQ ID NO: 1884 - protein, 8 aa, Dengue virus
LDNINTPE

SEQ ID NO: 1885 - protein, 8 aa, Dengue virus
DNINTPEG

SEQ ID NO: 1886 - protein, 8 aa, Dengue virus
NINTPEGI

SEQ ID NO: 1887 - protein, 8 aa, Dengue virus
INTPEGII

SEQ ID NO: 1888 - protein, 8 aa, Dengue virus
NTPEGIIP

SEQ ID NO: 1889 - protein, 8 aa, Dengue virus
TPEGIIPA

SEQ ID NO: 1890 - protein, 8 aa, Dengue virus
PEGIIPAL

SEQ ID NO: 1891 - protein, 8 aa, Dengue virus
EGIIPALF

SEQ ID NO: 1892 - protein, 8 aa, Dengue virus
GIIPALFE

SEQ ID NO: 1893 - protein, 8 aa, Dengue virus
IIPALFEP

SEQ ID NO: 1894 - protein, 8 aa, Dengue virus
IPALFEPE

SEQ ID NO: 1895 - protein, 8 aa, Dengue virus
PALFEPER

SEQ ID NO: 1896 - protein, 8 aa, Dengue virus
ALFEPERE

SEQ ID NO: 1897 - protein, 8 aa, Dengue virus
LFEPEREK

SEQ ID NO: 1898 - protein, 8 aa, Dengue virus
FEPEREKS

SEQ ID NO: 1899 - protein, 8 aa, Dengue virus
EPEREKSA

SEQ ID NO: 1900 - protein, 8 aa, Dengue virus
PEREKSAA

SEQ ID NO: 1901 - protein, 8 aa, Dengue virus
EREKSAAI

SEQ ID NO: 1902 - protein, 8 aa, Dengue virus
REKSAAID

SEQ ID NO: 1903 - protein, 8 aa, Dengue virus
EKSAAIDG

SEQ ID NO: 1904 - protein, 8 aa, Dengue virus
KSAAIDGE

SEQ ID NO: 1905 - protein, 8 aa, Dengue virus
SAAIDGEY

SEQ ID NO: 1906 - protein, 8 aa, Dengue virus
AAIDGEYR

SEQ ID NO: 1907 - protein, 8 aa, Dengue virus
AIDGEYRL

SEQ ID NO: 1908 - protein, 8 aa, Dengue virus
IDGEYRLR

SEQ ID NO: 1909 - protein, 8 aa, Dengue virus
DGEYRLRG

SEQ ID NO: 1910 - protein, 8 aa, Dengue virus
GEYRLRGE

SEQ ID NO: 1911 - protein, 8 aa, Dengue virus
EYRLRGEA

SEQ ID NO: 1912 - protein, 8 aa, Dengue virus
YRLRGEAR

SEQ ID NO: 1913 - protein, 8 aa, Dengue virus
RLRGEARK

SEQ ID NO: 1914 - protein, 8 aa, Dengue virus
LRGEARKT

SEQ ID NO: 1915 - protein, 8 aa, Dengue virus
RGEARKTF

SEQ ID NO: 1916 - protein, 8 aa, Dengue virus
GEARKTFV

SEQ ID NO: 1917 - protein, 8 aa, Dengue virus
EARKTFVE

SEQ ID NO: 1918 - protein, 8 aa, Dengue virus
ARKTFVEL

SEQ ID NO: 1919 - protein, 8 aa, Dengue virus
RKTFVELM

SEQ ID NO: 1920 - protein, 8 aa, Dengue virus
KTFVELMR

SEQ ID NO: 1921 - protein, 8 aa, Dengue virus
TFVELMRR

SEQ ID NO: 1922 - protein, 8 aa, Dengue virus
FVELMRRG

SEQ ID NO: 1923 - protein, 8 aa, Dengue virus
VELMRRGD

SEQ ID NO: 1924 - protein, 8 aa, Dengue virus
ELMRRGDL

SEQ ID NO: 1925 - protein, 8 aa, Dengue virus
LMRRGDLP

SEQ ID NO: 1926 - protein, 8 aa, Dengue virus
MRRGDLPV

SEQ ID NO: 1927 - protein, 8 aa, Dengue virus
RRGDLPVW

SEQ ID NO: 1928 - protein, 8 aa, Dengue virus
RGDLPVWL

SEQ ID NO: 1929 - protein, 8 aa, Dengue virus
GDLPVWLS

SEQ ID NO: 1930 - protein, 8 aa, Dengue virus
DLPVWLSY

SEQ ID NO: 1931 - protein, 8 aa, Dengue virus
LPVWLSYK

SEQ ID NO: 1932 - protein, 8 aa, Dengue virus
PVWLSYKV

SEQ ID NO: 1933 - protein, 8 aa, Dengue virus
VWLSYKVA

SEQ ID NO: 1934 - protein, 8 aa, Dengue virus
WLSYKVAS

SEQ ID NO: 1935 - protein, 8 aa, Dengue virus
LSYKVASE

SEQ ID NO: 1936 - protein, 8 aa, Dengue virus
SYKVASEG

SEQ ID NO: 1937 - protein, 8 aa, Dengue virus
YKVASEGF

SEQ ID NO: 1938 - protein, 8 aa, Dengue virus
KVASEGFQ

SEQ ID NO: 1939 - protein, 8 aa, Dengue virus
VASEGFQY

SEQ ID NO: 1940 - protein, 8 aa, Dengue virus
ASEGFQYS

SEQ ID NO: 1941 - protein, 8 aa, Dengue virus
SEGFQYSD

SEQ ID NO: 1942 - protein, 8 aa, Dengue virus
EGFQYSDR

SEQ ID NO: 1943 - protein, 8 aa, Dengue virus
GFQYSDRR

SEQ ID NO: 1944 - protein, 8 aa, Dengue virus
FQYSDRRW

SEQ ID NO: 1945 - protein, 8 aa, Dengue virus
QYSDRRWC

SEQ ID NO: 1946 - protein, 8 aa, Dengue virus
YSDRRWCF

SEQ ID NO: 1947 - protein, 8 aa, Dengue virus
SDRRWCFD

SEQ ID NO: 1948 - protein, 8 aa, Dengue virus
DRRWCFDG

SEQ ID NO: 1949 - protein, 8 aa, Dengue virus
RRWCFDGE

SEQ ID NO: 1950 - protein, 8 aa, Dengue virus
RWCFDGER

SEQ ID NO: 1951 - protein, 8 aa, Dengue virus
WCFDGERN

SEQ ID NO: 1952 - protein, 8 aa, Dengue virus
CFDGERNN

SEQ ID NO: 1953 - protein, 8 aa, Dengue virus
FDGERNNQ

SEQ ID NO: 1954 - protein, 8 aa, Dengue virus
DGERNNQV

SEQ ID NO: 1955 - protein, 8 aa, Dengue virus
GERNNQVL

SEQ ID NO: 1956 - protein, 8 aa, Dengue virus
ERNNQVLE

SEQ ID NO: 1957 - protein, 8 aa, Dengue virus
RNNQVLEE

SEQ ID NO: 1958 - protein, 8 aa, Dengue virus
NNQVLEEN

SEQ ID NO: 1959 - protein, 8 aa, Dengue virus
NQVLEENM

SEQ ID NO: 1960 - protein, 8 aa, Dengue virus
QVLEENMD

SEQ ID NO: 1961 - protein, 8 aa, Dengue virus
VLEENMDV

SEQ ID NO: 1962 - protein, 8 aa, Dengue virus
LEENMDVE

SEQ ID NO: 1963 - protein, 8 aa, Dengue virus
EENMDVEI

SEQ ID NO: 1964 - protein, 8 aa, Dengue virus
ENMDVEIW

SEQ ID NO: 1965 - protein, 8 aa, Dengue virus
NMDVEIWT

SEQ ID NO: 1966 - protein, 8 aa, Dengue virus
MDVEIWTK

SEQ ID NO: 1967 - protein, 8 aa, Dengue virus
DVEIWTKE

SEQ ID NO: 1968 - protein, 8 aa, Dengue virus
VEIWTKEG

SEQ ID NO: 1969 - protein, 8 aa, Dengue virus
ERKKLRPR

SEQ ID NO: 1970 - protein, 8 aa, Dengue virus
RKKLRPRW

SEQ ID NO: 1971 - protein, 8 aa, Dengue virus
KKLRPRWL

SEQ ID NO: 1972 - protein, 8 aa, Dengue virus
KLRPRWLD

SEQ ID NO: 1973 - protein, 8 aa, Dengue virus
LRPRWLDA

SEQ ID NO: 1974 - protein, 8 aa, Dengue virus
RPRWLDAR

SEQ ID NO: 1975 - protein, 8 aa, Dengue virus
PRWLDART

SEQ ID NO: 1976 - protein, 8 aa, Dengue virus
RWLDARTY

SEQ ID NO: 1977 - protein, 8 aa, Dengue virus
WLDARTYS

SEQ ID NO: 1978 - protein, 8 aa, Dengue virus
LDARTYSD

SEQ ID NO: 1979 - protein, 8 aa, Dengue virus
DARTYSDP

SEQ ID NO: 1980 - protein, 8 aa, Dengue virus
ARTYSDPL

SEQ ID NO: 1981 - protein, 8 aa, Dengue virus
RTYSDPLA

SEQ ID NO: 1982 - protein, 8 aa, Dengue virus
TYSDPLAL

SEQ ID NO: 1983 - protein, 8 aa, Dengue virus
YSDPLALR

SEQ ID NO: 1984 - protein, 8 aa, Dengue virus
SDPLALRE

SEQ ID NO: 1985 - protein, 8 aa, Dengue virus
DPLALREF

SEQ ID NO: 1986 - protein, 8 aa, Dengue virus
PLALREFK

SEQ ID NO: 1987 - protein, 8 aa, Dengue virus
LALREFKE

SEQ ID NO: 1988 - protein, 8 aa, Dengue virus
ALREFKEF

SEQ ID NO: 1989 - protein, 8 aa, Dengue virus
LREFKEFA

SEQ ID NO: 1990 - protein, 8 aa, Dengue virus
REFKEFAA

SEQ ID NO: 1991 - protein, 8 aa, Dengue virus
EFKEFAAG

SEQ ID NO: 1992 - protein, 8 aa, Dengue virus
FKEFAAGR

SEQ ID NO: 1993 - protein, 8 aa, Dengue virus
KEFAAGRR

SEQ ID NO: 1994 - protein, 8 aa, Dengue virus
EFAAGRRS

SEQ ID NO: 1995 - protein, 8 aa, Dengue virus
FAAGRRSV

SEQ ID NO: 1996 - protein, 8 aa, Dengue virus
AAGRRSVS

SEQ ID NO: 1997 - protein, 8 aa, Dengue virus
AGRRSVSG

SEQ ID NO: 1998 - protein, 8 aa, Dengue virus
GRRSVSGD

SEQ ID NO: 1999 - protein, 8 aa, Dengue virus
RRSVSGDL

SEQ ID NO: 2000 - protein, 8 aa, Dengue virus
RSVSGDLI

SEQ ID NO: 2001 - protein, 8 aa, Dengue virus
SVSGDLIL

SEQ ID NO: 2002 - protein, 8 aa, Dengue virus
VSGDLILE

SEQ ID NO: 2003 - protein, 8 aa, Dengue virus
SGDLILEI

SEQ ID NO: 2004 - protein, 8 aa, Dengue virus
GDLILEIG

SEQ ID NO: 2005 - protein, 8 aa, Dengue virus
DLILEIGK

SEQ ID NO: 2006 - protein, 8 aa, Dengue virus
LILEIGKL

SEQ ID NO: 2007 - protein, 8 aa, Dengue virus
ILEIGKLP

SEQ ID NO: 2008 - protein, 8 aa, Dengue virus
LEIGKLPQ

SEQ ID NO: 2009 - protein, 8 aa, Dengue virus
EIGKLPQH

SEQ ID NO: 2010 - protein, 8 aa, Dengue virus
IGKLPQHL

SEQ ID NO: 2011 - protein, 8 aa, Dengue virus
GKLPQHLT

SEQ ID NO: 2012 - protein, 8 aa, Dengue virus
KLPQHLTQ

SEQ ID NO: 2013 - protein, 8 aa, Dengue virus
LPQHLTQR

SEQ ID NO: 2014 - protein, 8 aa, Dengue virus
PQHLTQRA

SEQ ID NO: 2015 - protein, 8 aa, Dengue virus
QHLTQRAQ

SEQ ID NO: 2016 - protein, 8 aa, Dengue virus
HLTQRAQN

SEQ ID NO: 2017 - protein, 8 aa, Dengue virus
LTQRAQNA

SEQ ID NO: 2018 - protein, 8 aa, Dengue virus
TQRAQNAL

SEQ ID NO: 2019 - protein, 8 aa, Dengue virus
QRAQNALD

SEQ ID NO: 2020 - protein, 8 aa, Dengue virus
RAQNALDN

SEQ ID NO: 2021 - protein, 8 aa, Dengue virus
AQNALDNL

SEQ ID NO: 2022 - protein, 8 aa, Dengue virus
QNALDNLV

SEQ ID NO: 2023 - protein, 8 aa, Dengue virus
NALDNLVM

SEQ ID NO: 2024 - protein, 8 aa, Dengue virus
ALDNLVML

SEQ ID NO: 2025 - protein, 8 aa, Dengue virus
LDNLVMLH

SEQ ID NO: 2026 - protein, 8 aa, Dengue virus
DNLVMLHN

SEQ ID NO: 2027 - protein, 8 aa, Dengue virus
NLVMLHNS

SEQ ID NO: 2028 - protein, 8 aa, Dengue virus
LVMLHNSE

SEQ ID NO: 2029 - protein, 8 aa, Dengue virus
VMLHNSEQ

SEQ ID NO: 2030 - protein, 8 aa, Dengue virus
MLHNSEQG

SEQ ID NO: 2031 - protein, 8 aa, Dengue virus
LHNSEQGG

SEQ ID NO: 2032 - protein, 8 aa, Dengue virus
HNSEQGGR

SEQ ID NO: 2033 - protein, 8 aa, Dengue virus
NSEQGGRA

SEQ ID NO: 2034 - protein, 8 aa, Dengue virus
SEQGGRAY

SEQ ID NO: 2035 - protein, 8 aa, Dengue virus
EQGGRAYR

SEQ ID NO: 2036 - protein, 8 aa, Dengue virus
QGGRAYRH

SEQ ID NO: 2037 - protein, 8 aa, Dengue virus
GGRAYRHA

SEQ ID NO: 2038 - protein, 8 aa, Dengue virus
GRAYRHAM

SEQ ID NO: 2039 - protein, 8 aa, Dengue virus
RAYRHAME

SEQ ID NO: 2040 - protein, 8 aa, Dengue virus
AYRHAMEE

SEQ ID NO: 2041 - protein, 8 aa, Dengue virus
YRHAMEEL

SEQ ID NO: 2042 - protein, 8 aa, Dengue virus
RHAMEELP

SEQ ID NO: 2043 - protein, 8 aa, Dengue virus
HAMEELPD

SEQ ID NO: 2044 - protein, 8 aa, Dengue virus
AMEELPDT

SEQ ID NO: 2045 - protein, 8 aa, Dengue virus
MEELPDTI

SEQ ID NO: 2046 - protein, 8 aa, Dengue virus
EELPDTIE

SEQ ID NO: 2047 - protein, 8 aa, Dengue virus
ELPDTIET

SEQ ID NO: 2048 - protein, 8 aa, Dengue virus
LPDTIETL

SEQ ID NO: 2049 - protein, 8 aa, Dengue virus
PDTIETLM

SEQ ID NO: 2050 - protein, 8 aa, Dengue virus
DTIETLML

SEQ ID NO: 2051 - protein, 8 aa, Dengue virus
TIETLMLL

SEQ ID NO: 2052 - protein, 8 aa, Dengue virus
IETLMLLA

SEQ ID NO: 2053 - protein, 8 aa, Dengue virus
ETLMLLAL

SEQ ID NO: 2054 - protein, 8 aa, Dengue virus
TLMLLALI

SEQ ID NO: 2055 - protein, 8 aa, Dengue virus
LMLLALIA

SEQ ID NO: 2056 - protein, 8 aa, Dengue virus
MLLALIAV

SEQ ID NO: 2057 - protein, 8 aa, Dengue virus
LLALIAVL

SEQ ID NO: 2058 - protein, 8 aa, Dengue virus
LALIAVLT

SEQ ID NO: 2059 - protein, 8 aa, Dengue virus
ALIAVLTG

SEQ ID NO: 2060 - protein, 8 aa, Dengue virus
LIAVLTGG

SEQ ID NO: 2061 - protein, 8 aa, Dengue virus
IAVLTGGV

SEQ ID NO: 2062 - protein, 8 aa, Dengue virus
AVLTGGVT

SEQ ID NO: 2063 - protein, 8 aa, Dengue virus
VLTGGVTL

SEQ ID NO: 2064 - protein, 8 aa, Dengue virus
LTGGVTLF

SEQ ID NO: 2065 - protein, 8 aa, Dengue virus
TGGVTLFF

SEQ ID NO: 2066 - protein, 8 aa, Dengue virus
GGVTLFFL

SEQ ID NO: 2067 - protein, 8 aa, Dengue virus
GVTLFFLS

SEQ ID NO: 2068 - protein, 8 aa, Dengue virus
VTLFFLSG

SEQ ID NO: 2069 - protein, 8 aa, Dengue virus
TLFFLSGR

SEQ ID NO: 2070 - protein, 8 aa, Dengue virus
LFFLSGRG

SEQ ID NO: 2071 - protein, 8 aa, Dengue virus
FFLSGRGL

SEQ ID NO: 2072 - protein, 8 aa, Dengue virus
FLSGRGLG

SEQ ID NO: 2073 - protein, 8 aa, Dengue virus
LSGRGLGK

SEQ ID NO: 2074 - protein, 8 aa, Dengue virus
SGRGLGKT

SEQ ID NO: 2075 - protein, 8 aa, Dengue virus
GRGLGKTS

SEQ ID NO: 2076 - protein, 8 aa, Dengue virus
RGLGKTSI

SEQ ID NO: 2077 - protein, 8 aa, Dengue virus
GLGKTSIG

SEQ ID NO: 2078 - protein, 8 aa, Dengue virus
LGKTSIGL

SEQ ID NO: 2079 - protein, 8 aa, Dengue virus
GKTSIGLL

SEQ ID NO: 2080 - protein, 8 aa, Dengue virus
KTSIGLLC

SEQ ID NO: 2081 - protein, 8 aa, Dengue virus
TSIGLLCV

SEQ ID NO: 2082 - protein, 8 aa, Dengue virus
SIGLLCVM

SEQ ID NO: 2083 - protein, 8 aa, Dengue virus
IGLLCVMA

SEQ ID NO: 2084 - protein, 8 aa, Dengue virus
GLLCVMAS

SEQ ID NO: 2085 - protein, 8 aa, Dengue virus
LLCVMASS

SEQ ID NO: 2086 - protein, 8 aa, Dengue virus
ASSVLLWM

SEQ ID NO: 2087 - protein, 8 aa, Dengue virus
SSVLLWMA

SEQ ID NO: 2088 - protein, 8 aa, Dengue virus
SVLLWMAS

SEQ ID NO: 2089 - protein, 8 aa, Dengue virus
VLLWMASV

SEQ ID NO: 2090 - protein, 8 aa, Dengue virus
LLWMASVE

SEQ ID NO: 2091 - protein, 8 aa, Dengue virus
LWMASVEP

SEQ ID NO: 2092 - protein, 8 aa, Dengue virus
WMASVEPH

SEQ ID NO: 2093 - protein, 8 aa, Dengue virus
MASVEPHW

SEQ ID NO: 2094 - protein, 8 aa, Dengue virus
ASVEPHWI

SEQ ID NO: 2095 - protein, 8 aa, Dengue virus
SVEPHWIA

SEQ ID NO: 2096 - protein, 8 aa, Dengue virus
VEPHWIAA

SEQ ID NO: 2097 - protein, 8 aa, Dengue virus
EPHWIAAS

SEQ ID NO: 2098 - protein, 8 aa, Dengue virus
PHWIAASI

SEQ ID NO: 2099 - protein, 8 aa, Dengue virus
HWIAASII

SEQ ID NO: 2100 - protein, 8 aa, Dengue virus
WIAASIIL

SEQ ID NO: 2101 - protein, 8 aa, Dengue virus
IAASIILE

SEQ ID NO: 2102 - protein, 8 aa, Dengue virus
AASIILEF

SEQ ID NO: 2103 - protein, 8 aa, Dengue virus
ASIILEFF

SEQ ID NO: 2104 - protein, 8 aa, Dengue virus
SIILEFFL

SEQ ID NO: 2105 - protein, 8 aa, Dengue virus
IILEFFLM

SEQ ID NO: 2106 - protein, 8 aa, Dengue virus
ILEFFLMV

SEQ ID NO: 2107 - protein, 8 aa, Dengue virus
LEFFLMVL

SEQ ID NO: 2108 - protein, 8 aa, Dengue virus
EFFLMVLL

SEQ ID NO: 2109 - protein, 8 aa, Dengue virus
FFLMVLLI

SEQ ID NO: 2110 - protein, 8 aa, Dengue virus
FLMVLLIP

SEQ ID NO: 2111 - protein, 8 aa, Dengue virus
LMVLLIPE

SEQ ID NO: 2112 - protein, 8 aa, Dengue virus
MVLLIPEP

SEQ ID NO: 2113 - protein, 8 aa, Dengue virus
VLLIPEPD

SEQ ID NO: 2114 - protein, 8 aa, Dengue virus
LLIPEPDR

SEQ ID NO: 2115 - protein, 8 aa, Dengue virus
LIPEPDRQ

SEQ ID NO: 2116 - protein, 8 aa, Dengue virus
IPEPDRQR

SEQ ID NO: 2117 - protein, 8 aa, Dengue virus
PEPDRQRT

SEQ ID NO: 2118 - protein, 8 aa, Dengue virus
EPDRQRTP

SEQ ID NO: 2119 - protein, 8 aa, Dengue virus
PDRQRTPQ

SEQ ID NO: 2120 - protein, 8 aa, Dengue virus
DRQRTPQD

SEQ ID NO: 2121 - protein, 8 aa, Dengue virus
RQRTPQDN

SEQ ID NO: 2122 - protein, 8 aa, Dengue virus
QRTPQDNQ

SEQ ID NO: 2123 - protein, 8 aa, Dengue virus
RTPQDNQL

SEQ ID NO: 2124 - protein, 8 aa, Dengue virus
TPQDNQLA

SEQ ID NO: 2125 - protein, 8 aa, Dengue virus
PQDNQLAY

SEQ ID NO: 2126 - protein, 8 aa, Dengue virus
QDNQLAYV

SEQ ID NO: 2127 - protein, 8 aa, Dengue virus
DNQLAYVV

SEQ ID NO: 2128 - protein, 8 aa, Dengue virus
NQLAYVVI

SEQ ID NO: 2129 - protein, 8 aa, Dengue virus
QLAYVVIG

SEQ ID NO: 2130 - protein, 8 aa, Dengue virus
LAYVVIGL

SEQ ID NO: 2131 - protein, 8 aa, Dengue virus
AYVVIGLL

SEQ ID NO: 2132 - protein, 8 aa, Dengue virus
YVVIGLLF

SEQ ID NO: 2133 - protein, 8 aa, Dengue virus
VVIGLLFM

SEQ ID NO: 2134 - protein, 8 aa, Dengue virus
VIGLLFMI

SEQ ID NO: 2135 - protein, 8 aa, Dengue virus
IGLLFMIL

SEQ ID NO: 2136 - protein, 8 aa, Dengue virus
GLLFMILT

SEQ ID NO: 2137 - protein, 8 aa, Dengue virus
LLFMILTV

SEQ ID NO: 2138 - protein, 8 aa, Dengue virus
LFMILTVA

SEQ ID NO: 2139 - protein, 8 aa, Dengue virus
FMILTVAA

SEQ ID NO: 2140 - protein, 8 aa, Dengue virus
MILTVAAN

SEQ ID NO: 2141 - protein, 8 aa, Dengue virus
ILTVAANE

SEQ ID NO: 2142 - protein, 8 aa, Dengue virus
LTVAANEM

SEQ ID NO: 2143 - protein, 8 aa, Dengue virus
TVAANEMG

SEQ ID NO: 2144 - protein, 8 aa, Dengue virus
VAANEMGL

SEQ ID NO: 2145 - protein, 8 aa, Dengue virus
AANEMGLL

SEQ ID NO: 2146 - protein, 8 aa, Dengue virus
ANEMGLLE

SEQ ID NO: 2147 - protein, 8 aa, Dengue virus
NEMGLLET

SEQ ID NO: 2148 - protein, 8 aa, Dengue virus
EMGLLETT

SEQ ID NO: 2149 - protein, 8 aa, Dengue virus
MGLLETTK

SEQ ID NO: 2150 - protein, 8 aa, Dengue virus
GLLETTKK

SEQ ID NO: 2151 - protein, 8 aa, Dengue virus
LLETTKKD

SEQ ID NO: 2152 - protein, 8 aa, Dengue virus
LETTKKDL

SEQ ID NO: 2153 - protein, 8 aa, Dengue virus
ETTKKDLG

SEQ ID NO: 2154 - protein, 8 aa, Dengue virus
TTKKDLGI

SEQ ID NO: 2155 - protein, 8 aa, Dengue virus
TKKDLGIG

SEQ ID NO: 2156 - protein, 8 aa, Dengue virus
KKDLGIGH

SEQ ID NO: 2157 - protein, 8 aa, Dengue virus
KDLGIGHV

SEQ ID NO: 2158 - protein, 8 aa, Dengue virus
DLGIGHVA

SEQ ID NO: 2159 - protein, 8 aa, Dengue virus
HAAMLDVD

SEQ ID NO: 2160 - protein, 8 aa, Dengue virus
AAMLDVDL

SEQ ID NO: 2161 - protein, 8 aa, Dengue virus
AMLDVDLH

SEQ ID NO: 2162 - protein, 8 aa, Dengue virus
MLDVDLHP

SEQ ID NO: 2163 - protein, 8 aa, Dengue virus
LDVDLHPA

SEQ ID NO: 2164 - protein, 8 aa, Dengue virus
DVDLHPAS

SEQ ID NO: 2165 - protein, 8 aa, Dengue virus
VDLHPASA

SEQ ID NO: 2166 - protein, 8 aa, Dengue virus
DLHPASAW

SEQ ID NO: 2167 - protein, 8 aa, Dengue virus
LHPASAWT

SEQ ID NO: 2168 - protein, 8 aa, Dengue virus
HPASAWTL

SEQ ID NO: 2169 - protein, 8 aa, Dengue virus
PASAWTLY

SEQ ID NO: 2170 - protein, 8 aa, Dengue virus
ASAWTLYA

SEQ ID NO: 2171 - protein, 8 aa, Dengue virus
SAWTLYAV

SEQ ID NO: 2172 - protein, 8 aa, Dengue virus
AWTLYAVA

SEQ ID NO: 2173 - protein, 8 aa, Dengue virus
WTLYAVAT

SEQ ID NO: 2174 - protein, 8 aa, Dengue virus
TLYAVATT

SEQ ID NO: 2175 - protein, 8 aa, Dengue virus
LYAVATTI

SEQ ID NO: 2176 - protein, 8 aa, Dengue virus
YAVATTII

SEQ ID NO: 2177 - protein, 8 aa, Dengue virus
AVATTIIT

SEQ ID NO: 2178 - protein, 8 aa, Dengue virus
VATTIITP

SEQ ID NO: 2179 - protein, 8 aa, Dengue virus
ATTIITPM

SEQ ID NO: 2180 - protein, 8 aa, Dengue virus
TTIITPMM

SEQ ID NO: 2181 - protein, 8 aa, Dengue virus
TIITPMMR

SEQ ID NO: 2182 - protein, 8 aa, Dengue virus
IITPMMRH

SEQ ID NO: 2183 - protein, 8 aa, Dengue virus
ITPMMRHT

SEQ ID NO: 2184 - protein, 8 aa, Dengue virus
TPMMRHTI

SEQ ID NO: 2185 - protein, 8 aa, Dengue virus
PMMRHTIE

SEQ ID NO: 2186 - protein, 8 aa, Dengue virus
MMRHTIEN

SEQ ID NO: 2187 - protein, 8 aa, Dengue virus
MRHTIENT

SEQ ID NO: 2188 - protein, 8 aa, Dengue virus
RHTIENTT

SEQ ID NO: 2189 - protein, 8 aa, Dengue virus
HTIENTTA

SEQ ID NO: 2190 - protein, 8 aa, Dengue virus
TIENTTAN

SEQ ID NO: 2191 - protein, 8 aa, Dengue virus
IENTTANI

SEQ ID NO: 2192 - protein, 8 aa, Dengue virus
ENTTANIS

SEQ ID NO: 2193 - protein, 8 aa, Dengue virus
NTTANISL

SEQ ID NO: 2194 - protein, 8 aa, Dengue virus
TTANISLT

SEQ ID NO: 2195 - protein, 8 aa, Dengue virus
TANISLTA

SEQ ID NO: 2196 - protein, 8 aa, Dengue virus
ANISLTAI

SEQ ID NO: 2197 - protein, 8 aa, Dengue virus
NISLTAIA

SEQ ID NO: 2198 - protein, 8 aa, Dengue virus
ISLTAIAN

SEQ ID NO: 2199 - protein, 8 aa, Dengue virus
SLTAIANQ

SEQ ID NO: 2200 - protein, 8 aa, Dengue virus
LTAIANQA

SEQ ID NO: 2201 - protein, 8 aa, Dengue virus
TAIANQAA

SEQ ID NO: 2202 - protein, 8 aa, Dengue virus
AIANQAAI

SEQ ID NO: 2203 - protein, 8 aa, Dengue virus
IANQAAIL

SEQ ID NO: 2204 - protein, 8 aa, Dengue virus
ANQAAILM

SEQ ID NO: 2205 - protein, 8 aa, Dengue virus
NQAAILMG

SEQ ID NO: 2206 - protein, 8 aa, Dengue virus
QAAILMGL

SEQ ID NO: 2207 - protein, 8 aa, Dengue virus
AAILMGLD

SEQ ID NO: 2208 - protein, 8 aa, Dengue virus
AILMGLDK

SEQ ID NO: 2209 - protein, 8 aa, Dengue virus
ILMGLDKG

SEQ ID NO: 2210 - protein, 8 aa, Dengue virus
LMGLDKGW

SEQ ID NO: 2211 - protein, 8 aa, Dengue virus
MGLDKGWP

SEQ ID NO: 2212 - protein, 8 aa, Dengue virus
GLDKGWPI

SEQ ID NO: 2213 - protein, 8 aa, Dengue virus
LDKGWPIS

SEQ ID NO: 2214 - protein, 8 aa, Dengue virus
DKGWPISK

SEQ ID NO: 2215 - protein, 8 aa, Dengue virus
KGWPISKM

SEQ ID NO: 2216 - protein, 8 aa, Dengue virus
GWPISKMD

SEQ ID NO: 2217 - protein, 8 aa, Dengue virus
WPISKMDI

SEQ ID NO: 2218 - protein, 8 aa, Dengue virus
PISKMDIG

SEQ ID NO: 2219 - protein, 8 aa, Dengue virus
ISKMDIGV

SEQ ID NO: 2220 - protein, 8 aa, Dengue virus
SKMDIGVP

SEQ ID NO: 2221 - protein, 8 aa, Dengue virus
KMDIGVPL

SEQ ID NO: 2222 - protein, 8 aa, Dengue virus
MDIGVPLL

SEQ ID NO: 2223 - protein, 8 aa, Dengue virus
DIGVPLLA

SEQ ID NO: 2224 - protein, 8 aa, Dengue virus
IGVPLLAL

SEQ ID NO: 2225 - protein, 8 aa, Dengue virus
GVPLLALG

SEQ ID NO: 2226 - protein, 8 aa, Dengue virus
VPLLALGC

SEQ ID NO: 2227 - protein, 8 aa, Dengue virus
PLLALGCY

SEQ ID NO: 2228 - protein, 8 aa, Dengue virus
LLALGCYS

SEQ ID NO: 2229 - protein, 8 aa, Dengue virus
LALGCYSQ

SEQ ID NO: 2230 - protein, 8 aa, Dengue virus
ALGCYSQV

SEQ ID NO: 2231 - protein, 8 aa, Dengue virus
LGCYSQVN

SEQ ID NO: 2232 - protein, 8 aa, Dengue virus
GCYSQVNP

SEQ ID NO: 2233 - protein, 8 aa, Dengue virus
CYSQVNPL

SEQ ID NO: 2234 - protein, 8 aa, Dengue virus
YSQVNPLT

SEQ ID NO: 2235 - protein, 8 aa, Dengue virus
SQVNPLTL

SEQ ID NO: 2236 - protein, 8 aa, Dengue virus
QVNPLTLT

SEQ ID NO: 2237 - protein, 8 aa, Dengue virus
VNPLTLTA

SEQ ID NO: 2238 - protein, 8 aa, Dengue virus
NPLTLTAA

SEQ ID NO: 2239 - protein, 8 aa, Dengue virus
PLTLTAAV

SEQ ID NO: 2240 - protein, 8 aa, Dengue virus
LTLTAAVL

SEQ ID NO: 2241 - protein, 8 aa, Dengue virus
TLTAAVLM

SEQ ID NO: 2242 - protein, 8 aa, Dengue virus
LTAAVLML

SEQ ID NO: 2243 - protein, 8 aa, Dengue virus
TAAVLMLV

SEQ ID NO: 2244 - protein, 8 aa, Dengue virus
AAVLMLVA

SEQ ID NO: 2245 - protein, 8 aa, Dengue virus
AVLMLVAH

SEQ ID NO: 2246 - protein, 8 aa, Dengue virus
VLMLVAHY

SEQ ID NO: 2247 - protein, 8 aa, Dengue virus
LMLVAHYA

SEQ ID NO: 2248 - protein, 8 aa, Dengue virus
MLVAHYAI

SEQ ID NO: 2249 - protein, 8 aa, Dengue virus
LVAHYAII

SEQ ID NO: 2250 - protein, 8 aa, Dengue virus
VAHYAIIG

SEQ ID NO: 2251 - protein, 8 aa, Dengue virus
AHYAIIGP

SEQ ID NO: 2252 - protein, 8 aa, Dengue virus
HYAIIGPG

SEQ ID NO: 2253 - protein, 8 aa, Dengue virus
YAIIGPGL

SEQ ID NO: 2254 - protein, 8 aa, Dengue virus
AIIGPGLQ

SEQ ID NO: 2255 - protein, 8 aa, Dengue virus
IIGPGLQA

SEQ ID NO: 2256 - protein, 8 aa, Dengue virus
IGPGLQAK

SEQ ID NO: 2257 - protein, 8 aa, Dengue virus
GPGLQAKA

SEQ ID NO: 2258 - protein, 8 aa, Dengue virus
PGLQAKAT

SEQ ID NO: 2259 - protein, 8 aa, Dengue virus
GLQAKATR

SEQ ID NO: 2260 - protein, 8 aa, Dengue virus
LQAKATRE

SEQ ID NO: 2261 - protein, 8 aa, Dengue virus
QAKATREA

SEQ ID NO: 2262 - protein, 8 aa, Dengue virus
AKATREAQ

SEQ ID NO: 2263 - protein, 8 aa, Dengue virus
KATREAQK

SEQ ID NO: 2264 - protein, 8 aa, Dengue virus
ATREAQKR

SEQ ID NO: 2265 - protein, 8 aa, Dengue virus
TREAQKRT

SEQ ID NO: 2266 - protein, 8 aa, Dengue virus
REAQKRTA

SEQ ID NO: 2267 - protein, 8 aa, Dengue virus
EAQKRTAA

SEQ ID NO: 2268 - protein, 8 aa, Dengue virus
AQKRTAAG

SEQ ID NO: 2269 - protein, 8 aa, Dengue virus
QKRTAAGI

SEQ ID NO: 2270 - protein, 8 aa, Dengue virus
KRTAAGIM

SEQ ID NO: 2271 - protein, 8 aa, Dengue virus
RTAAGIMK

SEQ ID NO: 2272 - protein, 8 aa, Dengue virus
TAAGIMKN

SEQ ID NO: 2273 - protein, 8 aa, Dengue virus
AAGIMKNP

SEQ ID NO: 2274 - protein, 8 aa, Dengue virus
AGIMKNPT

SEQ ID NO: 2275 - protein, 8 aa, Dengue virus
GIMKNPTV

SEQ ID NO: 2276 - protein, 8 aa, Dengue virus
IMKNPTVD

SEQ ID NO: 2277 - protein, 8 aa, Dengue virus
MKNPTVDG

SEQ ID NO: 2278 - protein, 8 aa, Dengue virus
KNPTVDGI

SEQ ID NO: 2279 - protein, 8 aa, Dengue virus
NPTVDGIV

SEQ ID NO: 2280 - protein, 8 aa, Dengue virus
PTVDGIVA

SEQ ID NO: 2281 - protein, 8 aa, Dengue virus
TVDGIVAI

SEQ ID NO: 2282 - protein, 8 aa, Dengue virus
VDGIVAID

SEQ ID NO: 2283 - protein, 8 aa, Dengue virus
DGIVAIDL

SEQ ID NO: 2284 - protein, 8 aa, Dengue virus
GIVAIDLD

SEQ ID NO: 2285 - protein, 8 aa, Dengue virus
IVAIDLDP

SEQ ID NO: 2286 - protein, 8 aa, Dengue virus
VAIDLDPV

SEQ ID NO: 2287 - protein, 8 aa, Dengue virus
AIDLDPVV

SEQ ID NO: 2288 - protein, 8 aa, Dengue virus
IDLDPVVY

SEQ ID NO: 2289 - protein, 8 aa, Dengue virus
DLDPVVYD

SEQ ID NO: 2290 - protein, 8 aa, Dengue virus
LDPVVYDA

SEQ ID NO: 2291 - protein, 8 aa, Dengue virus
DPVVYDAK

SEQ ID NO: 2292 - protein, 8 aa, Dengue virus
PVVYDAKF

SEQ ID NO: 2293 - protein, 8 aa, Dengue virus
VVYDAKFE

SEQ ID NO: 2294 - protein, 8 aa, Dengue virus
VYDAKFEK

SEQ ID NO: 2295 - protein, 8 aa, Dengue virus
YDAKFEKQ

SEQ ID NO: 2296 - protein, 8 aa, Dengue virus
DAKFEKQL

SEQ ID NO: 2297 - protein, 8 aa, Dengue virus
AKFEKQLG

SEQ ID NO: 2298 - protein, 8 aa, Dengue virus
KFEKQLGQ

SEQ ID NO: 2299 - protein, 8 aa, Dengue virus
FEKQLGQI

SEQ ID NO: 2300 - protein, 8 aa, Dengue virus
EKQLGQIM

SEQ ID NO: 2301 - protein, 8 aa, Dengue virus
KQLGQIML

SEQ ID NO: 2302 - protein, 8 aa, Dengue virus
QLGQIMLL

SEQ ID NO: 2303 - protein, 8 aa, Dengue virus
LGQIMLLI

SEQ ID NO: 2304 - protein, 8 aa, Dengue virus
GQIMLLIL

SEQ ID NO: 2305 - protein, 8 aa, Dengue virus
QIMLLILC

SEQ ID NO: 2306 - protein, 8 aa, Dengue virus
IMLLILCT

SEQ ID NO: 2307 - protein, 8 aa, Dengue virus
MLLILCTS

SEQ ID NO: 2308 - protein, 8 aa, Dengue virus
LLILCTSQ

SEQ ID NO: 2309 - protein, 8 aa, Dengue virus
LILCTSQI

SEQ ID NO: 2310 - protein, 8 aa, Dengue virus
ILCTSQIL

SEQ ID NO: 2311 - protein, 8 aa, Dengue virus
LCTSQILL

SEQ ID NO: 2312 - protein, 8 aa, Dengue virus
CTSQILLM

SEQ ID NO: 2313 - protein, 8 aa, Dengue virus
TSQILLMR

SEQ ID NO: 2314 - protein, 8 aa, Dengue virus
SQILLMRT

SEQ ID NO: 2315 - protein, 8 aa, Dengue virus
QILLMRTT

SEQ ID NO: 2316 - protein, 8 aa, Dengue virus
ILLMRTTW

SEQ ID NO: 2317 - protein, 8 aa, Dengue virus
LLMRTTWA

SEQ ID NO: 2318 - protein, 8 aa, Dengue virus
LMRTTWAL

SEQ ID NO: 2319 - protein, 8 aa, Dengue virus
MRTTWALC

SEQ ID NO: 2320 - protein, 8 aa, Dengue virus
RTTWALCE

SEQ ID NO: 2321 - protein, 8 aa, Dengue virus
TTWALCES

SEQ ID NO: 2322 - protein, 8 aa, Dengue virus
TWALCESI

SEQ ID NO: 2323 - protein, 8 aa, Dengue virus
WALCESIT

SEQ ID NO: 2324 - protein, 8 aa, Dengue virus
ALCESITL

SEQ ID NO: 2325 - protein, 8 aa, Dengue virus
LCESITLA

SEQ ID NO: 2326 - protein, 8 aa, Dengue virus
CESITLAT

SEQ ID NO: 2327 - protein, 8 aa, Dengue virus
ESITLATG

SEQ ID NO: 2328 - protein, 8 aa, Dengue virus
SITLATGP

SEQ ID NO: 2329 - protein, 8 aa, Dengue virus
ITLATGPL

SEQ ID NO: 2330 - protein, 8 aa, Dengue virus
TLATGPLT

SEQ ID NO: 2331 - protein, 8 aa, Dengue virus
LATGPLTT

SEQ ID NO: 2332 - protein, 8 aa, Dengue virus
ATGPLTTL

SEQ ID NO: 2333 - protein, 8 aa, Dengue virus
TGPLTTLW

SEQ ID NO: 2334 - protein, 8 aa, Dengue virus
GPLTTLWE

SEQ ID NO: 2335 - protein, 8 aa, Dengue virus
PLTTLWEG

SEQ ID NO: 2336 - protein, 8 aa, Dengue virus
LTTLWEGS

SEQ ID NO: 2337 - protein, 8 aa, Dengue virus
TTLWEGSP

SEQ ID NO: 2338 - protein, 8 aa, Dengue virus
TLWEGSPG

SEQ ID NO: 2339 - protein, 8 aa, Dengue virus
LWEGSPGK

SEQ ID NO: 2340 - protein, 8 aa, Dengue virus
WEGSPGKF

SEQ ID NO: 2341 - protein, 8 aa, Dengue virus
EGSPGKFW

SEQ ID NO: 2342 - protein, 8 aa, Dengue virus
GSPGKFWN

SEQ ID NO: 2343 - protein, 8 aa, Dengue virus
SPGKFWNT

SEQ ID NO: 2344 - protein, 8 aa, Dengue virus
PGKFWNTT

SEQ ID NO: 2345 - protein, 8 aa, Dengue virus
GKFWNTTI

SEQ ID NO: 2346 - protein, 8 aa, Dengue virus
KFWNTTIA

SEQ ID NO: 2347 - protein, 8 aa, Dengue virus
FWNTTIAV

SEQ ID NO: 2348 - protein, 8 aa, Dengue virus
WNTTIAVS

SEQ ID NO: 2349 - protein, 8 aa, Dengue virus
NTTIAVSM

SEQ ID NO: 2350 - protein, 8 aa, Dengue virus
TTIAVSMA

SEQ ID NO: 2351 - protein, 8 aa, Dengue virus
TIAVSMAN

SEQ ID NO: 2352 - protein, 8 aa, Dengue virus
IAVSMANI

SEQ ID NO: 2353 - protein, 8 aa, Dengue virus
AVSMANIF

SEQ ID NO: 2354 - protein, 8 aa, Dengue virus
VSMANIFR

SEQ ID NO: 2355 - protein, 8 aa, Dengue virus
SMANIFRG

SEQ ID NO: 2356 - protein, 8 aa, Dengue virus
MANIFRGS

SEQ ID NO: 2357 - protein, 8 aa, Dengue virus
ANIFRGSY

SEQ ID NO: 2358 - protein, 8 aa, Dengue virus
NIFRGSYL

SEQ ID NO: 2359 - protein, 8 aa, Dengue virus
IFRGSYLA

SEQ ID NO: 2360 - protein, 8 aa, Dengue virus
FRGSYLAG

SEQ ID NO: 2361 - protein, 8 aa, Dengue virus
RGSYLAGA

SEQ ID NO: 2362 - protein, 8 aa, Dengue virus
GSYLAGAG

SEQ ID NO: 2363 - protein, 8 aa, Dengue virus
SYLAGAGL

SEQ ID NO: 2364 - protein, 8 aa, Dengue virus
YLAGAGLA

SEQ ID NO: 2365 - protein, 8 aa, Dengue virus
LAGAGLAF

SEQ ID NO: 2366 - protein, 8 aa, Dengue virus
AGAGLAFS

SEQ ID NO: 2367 - protein, 8 aa, Dengue virus
GAGLAFSL

SEQ ID NO: 2368 - protein, 8 aa, Dengue virus
AGLAFSLM

SEQ ID NO: 2369 - protein, 8 aa, Dengue virus
GLAFSLMK

SEQ ID NO: 2370 - protein, 8 aa, Dengue virus
LAFSLMKS

SEQ ID NO: 2371 - protein, 8 aa, Dengue virus
AFSLMKSL

SEQ ID NO: 2372 - protein, 8 aa, Dengue virus
FSLMKSLG

SEQ ID NO: 2373 - protein, 8 aa, Dengue virus
SLMKSLGG

SEQ ID NO: 2374 - protein, 8 aa, Dengue virus
LMKSLGGG

SEQ ID NO: 2375 - protein, 8 aa, Dengue virus
MKSLGGGR

SEQ ID NO: 2376 - protein, 8 aa, Dengue virus
KSLGGGRR

SEQ ID NO: 2377 - protein, 8 aa, Dengue virus
SLGGGRRG

SEQ ID NO: 2378 - protein, 8 aa, Dengue virus
LGGGRRGT

SEQ ID NO: 2379 - protein, 8 aa, Dengue virus
GGGRRGTG

SEQ ID NO: 2380 - protein, 8 aa, Dengue virus
GGRRGTGA

SEQ ID NO: 2381 - protein, 8 aa, Dengue virus
GRRGTGAQ

SEQ ID NO: 2382 - protein, 8 aa, Dengue virus
RRGTGAQG

SEQ ID NO: 2383 - protein, 8 aa, Dengue virus
RGTGAQGE

SEQ ID NO: 2384 - protein, 8 aa, Dengue virus
GTGAQGET

SEQ ID NO: 2385 - protein, 8 aa, Dengue virus
TGAQGETL

SEQ ID NO: 2386 - protein, 8 aa, Dengue virus
GAQGETLG

SEQ ID NO: 2387 - protein, 8 aa, Dengue virus
AQGETLGE

SEQ ID NO: 2388 - protein, 8 aa, Dengue virus
QGETLGEK

SEQ ID NO: 2389 - protein, 8 aa, Dengue virus
GETLGEKW

SEQ ID NO: 2390 - protein, 8 aa, Dengue virus
ETLGEKWK

SEQ ID NO: 2391 - protein, 8 aa, Dengue virus
TLGEKWKR

SEQ ID NO: 2392 - protein, 8 aa, Dengue virus
LGEKWKRQ

SEQ ID NO: 2393 - protein, 8 aa, Dengue virus
GEKWKRQL

SEQ ID NO: 2394 - protein, 8 aa, Dengue virus
EKWKRQLN

SEQ ID NO: 2395 - protein, 8 aa, Dengue virus
KWKRQLNQ

SEQ ID NO: 2396 - protein, 8 aa, Dengue virus
WKRQLNQL

SEQ ID NO: 2397 - protein, 8 aa, Dengue virus
KRQLNQLS

SEQ ID NO: 2398 - protein, 8 aa, Dengue virus
RQLNQLSK

SEQ ID NO: 2399 - protein, 8 aa, Dengue virus
QLNQLSKS

SEQ ID NO: 2400 - protein, 8 aa, Dengue virus
LNQLSKSE

SEQ ID NO: 2401 - protein, 8 aa, Dengue virus
NQLSKSEF

SEQ ID NO: 2402 - protein, 8 aa, Dengue virus
QLSKSEFN

SEQ ID NO: 2403 - protein, 8 aa, Dengue virus
LSKSEFNT

SEQ ID NO: 2404 - protein, 8 aa, Dengue virus
SKSEFNTY

SEQ ID NO: 2405 - protein, 8 aa, Dengue virus
KSEFNTYK

SEQ ID NO: 2406 - protein, 8 aa, Dengue virus
SEFNTYKR

SEQ ID NO: 2407 - protein, 8 aa, Dengue virus
EFNTYKRS

SEQ ID NO: 2408 - protein, 8 aa, Dengue virus
FNTYKRSG

SEQ ID NO: 2409 - protein, 8 aa, Dengue virus
NTYKRSGI

SEQ ID NO: 2410 - protein, 8 aa, Dengue virus
TYKRSGIM

SEQ ID NO: 2411 - protein, 8 aa, Dengue virus
YKRSGIME

SEQ ID NO: 2412 - protein, 8 aa, Dengue virus
KRSGIMEV

SEQ ID NO: 2413 - protein, 8 aa, Dengue virus
RSGIMEVD

SEQ ID NO: 2414 - protein, 8 aa, Dengue virus
SGIMEVDR

SEQ ID NO: 2415 - protein, 8 aa, Dengue virus
GIMEVDRS

SEQ ID NO: 2416 - protein, 8 aa, Dengue virus
IMEVDRSE

SEQ ID NO: 2417 - protein, 8 aa, Dengue virus
MEVDRSEA

SEQ ID NO: 2418 - protein, 8 aa, Dengue virus
EVDRSEAK

SEQ ID NO: 2419 - protein, 8 aa, Dengue virus
VDRSEAKE

SEQ ID NO: 2420 - protein, 8 aa, Dengue virus
DRSEAKEG

SEQ ID NO: 2421 - protein, 8 aa, Dengue virus
RSEAKEGL

SEQ ID NO: 2422 - protein, 8 aa, Dengue virus
SEAKEGLK

SEQ ID NO: 2423 - protein, 8 aa, Dengue virus
EAKEGLKR

SEQ ID NO: 2424 - protein, 8 aa, Dengue virus
AKEGLKRG

SEQ ID NO: 2425 - protein, 8 aa, Dengue virus
KEGLKRGE

SEQ ID NO: 2426 - protein, 8 aa, Dengue virus
EGLKRGET

SEQ ID NO: 2427 - protein, 8 aa, Dengue virus
GLKRGETT

SEQ ID NO: 2428 - protein, 8 aa, Dengue virus
LKRGETTK

SEQ ID NO: 2429 - protein, 8 aa, Dengue virus
KRGETTKH

SEQ ID NO: 2430 - protein, 8 aa, Dengue virus
RGETTKHA

SEQ ID NO: 2431 - protein, 8 aa, Dengue virus
GETTKHAV

SEQ ID NO: 2432 - protein, 8 aa, Dengue virus
ETTKHAVS

SEQ ID NO: 2433 - protein, 8 aa, Dengue virus
TTKHAVSR

SEQ ID NO: 2434 - protein, 8 aa, Dengue virus
TKHAVSRG

SEQ ID NO: 2435 - protein, 8 aa, Dengue virus
KHAVSRGT

SEQ ID NO: 2436 - protein, 8 aa, Dengue virus
HAVSRGTA

SEQ ID NO: 2437 - protein, 8 aa, Dengue virus
AVSRGTAK

SEQ ID NO: 2438 - protein, 8 aa, Dengue virus
VSRGTAKL

SEQ ID NO: 2439 - protein, 8 aa, Dengue virus
SRGTAKLR

SEQ ID NO: 2440 - protein, 8 aa, Dengue virus
RGTAKLRW

SEQ ID NO: 2441 - protein, 8 aa, Dengue virus
GTAKLRWF

SEQ ID NO: 2442 - protein, 8 aa, Dengue virus
TAKLRWFV

SEQ ID NO: 2443 - protein, 8 aa, Dengue virus
AKLRWFVE

SEQ ID NO: 2444 - protein, 8 aa, Dengue virus
KLRWFVER

SEQ ID NO: 2445 - protein, 8 aa, Dengue virus
LRWFVERN

SEQ ID NO: 2446 - protein, 8 aa, Dengue virus
RWFVERNL

SEQ ID NO: 2447 - protein, 8 aa, Dengue virus
WFVERNLV

SEQ ID NO: 2448 - protein, 8 aa, Dengue virus
FVERNLVK

SEQ ID NO: 2449 - protein, 8 aa, Dengue virus
VERNLVKP

SEQ ID NO: 2450 - protein, 8 aa, Dengue virus
ERNLVKPE

SEQ ID NO: 2451 - protein, 8 aa, Dengue virus
RNLVKPEG

SEQ ID NO: 2452 - protein, 8 aa, Dengue virus
NLVKPEGK

SEQ ID NO: 2453 - protein, 8 aa, Dengue virus
LVKPEGKV

SEQ ID NO: 2454 - protein, 8 aa, Dengue virus
VKPEGKVI

SEQ ID NO: 2455 - protein, 8 aa, Dengue virus
KPEGKVID

SEQ ID NO: 2456 - protein, 8 aa, Dengue virus
PEGKVIDL

SEQ ID NO: 2457 - protein, 8 aa, Dengue virus
EGKVIDLG

SEQ ID NO: 2458 - protein, 8 aa, Dengue virus
GKVIDLGC

SEQ ID NO: 2459 - protein, 8 aa, Dengue virus
KVIDLGCG

SEQ ID NO: 2460 - protein, 8 aa, Dengue virus
VIDLGCGR

SEQ ID NO: 2461 - protein, 8 aa, Dengue virus
IDLGCGRG

SEQ ID NO: 2462 - protein, 8 aa, Dengue virus
DLGCGRGG

SEQ ID NO: 2463 - protein, 8 aa, Dengue virus
LGCGRGGW

SEQ ID NO: 2464 - protein, 8 aa, Dengue virus
GCGRGGWS

SEQ ID NO: 2465 - protein, 8 aa, Dengue virus
CGRGGWSY

SEQ ID NO: 2466 - protein, 8 aa, Dengue virus
GRGGWSYY

SEQ ID NO: 2467 - protein, 8 aa, Dengue virus
RGGWSYYC

SEQ ID NO: 2468 - protein, 8 aa, Dengue virus
GGWSYYCA

SEQ ID NO: 2469 - protein, 8 aa, Dengue virus
GWSYYCAG

SEQ ID NO: 2470 - protein, 8 aa, Dengue virus
WSYYCAGL

SEQ ID NO: 2471 - protein, 8 aa, Dengue virus
SYYCAGLK

SEQ ID NO: 2472 - protein, 8 aa, Dengue virus
YYCAGLKK

SEQ ID NO: 2473 - protein, 8 aa, Dengue virus
YCAGLKKV

SEQ ID NO: 2474 - protein, 8 aa, Dengue virus
CAGLKKVT

SEQ ID NO: 2475 - protein, 8 aa, Dengue virus
AGLKKVTE

SEQ ID NO: 2476 - protein, 8 aa, Dengue virus
GLKKVTEV

SEQ ID NO: 2477 - protein, 8 aa, Dengue virus
LKKVTEVK

SEQ ID NO: 2478 - protein, 8 aa, Dengue virus
KKVTEVKG

SEQ ID NO: 2479 - protein, 8 aa, Dengue virus
KVTEVKGY

SEQ ID NO: 2480 - protein, 8 aa, Dengue virus
VTEVKGYT

SEQ ID NO: 2481 - protein, 8 aa, Dengue virus
TEVKGYTK

SEQ ID NO: 2482 - protein, 8 aa, Dengue virus
EVKGYTKG

SEQ ID NO: 2483 - protein, 8 aa, Dengue virus
VKGYTKGG

SEQ ID NO: 2484 - protein, 8 aa, Dengue virus
KGYTKGGP

SEQ ID NO: 2485 - protein, 8 aa, Dengue virus
GYTKGGPG

SEQ ID NO: 2486 - protein, 8 aa, Dengue virus
YTKGGPGH

SEQ ID NO: 2487 - protein, 8 aa, Dengue virus
TKGGPGHE

SEQ ID NO: 2488 - protein, 8 aa, Dengue virus
KGGPGHEE

SEQ ID NO: 2489 - protein, 8 aa, Dengue virus
GGPGHEEP

SEQ ID NO: 2490 - protein, 8 aa, Dengue virus
GPGHEEPI

SEQ ID NO: 2491 - protein, 8 aa, Dengue virus
PGHEEPIP

SEQ ID NO: 2492 - protein, 8 aa, Dengue virus
GHEEPIPM

SEQ ID NO: 2493 - protein, 8 aa, Dengue virus
HEEPIPMA

SEQ ID NO: 2494 - protein, 8 aa, Dengue virus
EEPIPMAT

SEQ ID NO: 2495 - protein, 8 aa, Dengue virus
EPIPMATY

SEQ ID NO: 2496 - protein, 8 aa, Dengue virus
PIPMATYG

SEQ ID NO: 2497 - protein, 8 aa, Dengue virus
IPMATYGW

SEQ ID NO: 2498 - protein, 8 aa, Dengue virus
PMATYGWN

SEQ ID NO: 2499 - protein, 8 aa, Dengue virus
MATYGWNL

SEQ ID NO: 2500 - protein, 8 aa, Dengue virus
ATYGWNLV

SEQ ID NO: 2501 - protein, 8 aa, Dengue virus
TYGWNLVK

SEQ ID NO: 2502 - protein, 8 aa, Dengue virus
YGWNLVKL

SEQ ID NO: 2503 - protein, 8 aa, Dengue virus
GWNLVKLH

SEQ ID NO: 2504 - protein, 8 aa, Dengue virus
WNLVKLHS

SEQ ID NO: 2505 - protein, 8 aa, Dengue virus
NLVKLHSG

SEQ ID NO: 2506 - protein, 8 aa, Dengue virus
LVKLHSGK

SEQ ID NO: 2507 - protein, 8 aa, Dengue virus
VKLHSGKD

SEQ ID NO: 2508 - protein, 8 aa, Dengue virus
KLHSGKDV

SEQ ID NO: 2509 - protein, 8 aa, Dengue virus
LHSGKDVF

SEQ ID NO: 2510 - protein, 8 aa, Dengue virus
HSGKDVFF

SEQ ID NO: 2511 - protein, 8 aa, Dengue virus
SGKDVFFI

SEQ ID NO: 2512 - protein, 8 aa, Dengue virus
GKDVFFIP

SEQ ID NO: 2513 - protein, 8 aa, Dengue virus
KDVFFIPP

SEQ ID NO: 2514 - protein, 8 aa, Dengue virus
DVFFIPPE

SEQ ID NO: 2515 - protein, 8 aa, Dengue virus
VFFIPPEK

SEQ ID NO: 2516 - protein, 8 aa, Dengue virus
FFIPPEKC

SEQ ID NO: 2517 - protein, 8 aa, Dengue virus
FIPPEKCD

SEQ ID NO: 2518 - protein, 8 aa, Dengue virus
IPPEKCDT

SEQ ID NO: 2519 - protein, 8 aa, Dengue virus
PPEKCDTL

SEQ ID NO: 2520 - protein, 8 aa, Dengue virus
PEKCDTLL

SEQ ID NO: 2521 - protein, 8 aa, Dengue virus
EKCDTLLC

SEQ ID NO: 2522 - protein, 8 aa, Dengue virus
KCDTLLCD

SEQ ID NO: 2523 - protein, 8 aa, Dengue virus
CDTLLCDI

SEQ ID NO: 2524 - protein, 8 aa, Dengue virus
DTLLCDIG

SEQ ID NO: 2525 - protein, 8 aa, Dengue virus
TLLCDIGE

SEQ ID NO: 2526 - protein, 8 aa, Dengue virus
LLCDIGES

SEQ ID NO: 2527 - protein, 8 aa, Dengue virus
LCDIGESS

SEQ ID NO: 2528 - protein, 8 aa, Dengue virus
CDIGESSP

SEQ ID NO: 2529 - protein, 8 aa, Dengue virus
DIGESSPN

SEQ ID NO: 2530 - protein, 8 aa, Dengue virus
IGESSPNP

SEQ ID NO: 2531 - protein, 8 aa, Dengue virus
GESSPNPT

SEQ ID NO: 2532 - protein, 8 aa, Dengue virus
ESSPNPTI

SEQ ID NO: 2533 - protein, 8 aa, Dengue virus
SSPNPTIE

SEQ ID NO: 2534 - protein, 8 aa, Dengue virus
SPNPTIEE

SEQ ID NO: 2535 - protein, 8 aa, Dengue virus
PNPTIEEG

SEQ ID NO: 2536 - protein, 8 aa, Dengue virus
NPTIEEGR

SEQ ID NO: 2537 - protein, 8 aa, Dengue virus
PTIEEGRT

SEQ ID NO: 2538 - protein, 8 aa, Dengue virus
TIEEGRTL

SEQ ID NO: 2539 - protein, 8 aa, Dengue virus
IEEGRTLR

SEQ ID NO: 2540 - protein, 8 aa, Dengue virus
EEGRTLRV

SEQ ID NO: 2541 - protein, 8 aa, Dengue virus
EGRTLRVL

SEQ ID NO: 2542 - protein, 8 aa, Dengue virus
GRTLRVLK

SEQ ID NO: 2543 - protein, 8 aa, Dengue virus
RTLRVLKM

SEQ ID NO: 2544 - protein, 8 aa, Dengue virus
TLRVLKMV

SEQ ID NO: 2545 - protein, 8 aa, Dengue virus
LRVLKMVE

SEQ ID NO: 2546 - protein, 8 aa, Dengue virus
RVLKMVEP

SEQ ID NO: 2547 - protein, 8 aa, Dengue virus
VLKMVEPW

SEQ ID NO: 2548 - protein, 8 aa, Dengue virus
LKMVEPWL

SEQ ID NO: 2549 - protein, 8 aa, Dengue virus
KMVEPWLR

SEQ ID NO: 2550 - protein, 8 aa, Dengue virus
MVEPWLRG

SEQ ID NO: 2551 - protein, 8 aa, Dengue virus
VEPWLRGN

SEQ ID NO: 2552 - protein, 8 aa, Dengue virus
QFCIKILN

SEQ ID NO: 2553 - protein, 8 aa, Dengue virus
FCIKILNP

SEQ ID NO: 2554 - protein, 8 aa, Dengue virus
CIKILNPY

SEQ ID NO: 2555 - protein, 8 aa, Dengue virus
IKILNPYM

SEQ ID NO: 2556 - protein, 8 aa, Dengue virus
KILNPYMP

SEQ ID NO: 2557 - protein, 8 aa, Dengue virus
ILNPYMPS

SEQ ID NO: 2558 - protein, 8 aa, Dengue virus
LNPYMPSV

SEQ ID NO: 2559 - protein, 8 aa, Dengue virus
NPYMPSVV

SEQ ID NO: 2560 - protein, 8 aa, Dengue virus
PYMPSVVE

SEQ ID NO: 2561 - protein, 8 aa, Dengue virus
YMPSVVET

SEQ ID NO: 2562 - protein, 8 aa, Dengue virus
MPSVVETL

SEQ ID NO: 2563 - protein, 8 aa, Dengue virus
PSVVETLE

SEQ ID NO: 2564 - protein, 8 aa, Dengue virus
SVVETLEQ

SEQ ID NO: 2565 - protein, 8 aa, Dengue virus
VVETLEQM

SEQ ID NO: 2566 - protein, 8 aa, Dengue virus
VETLEQMQ

SEQ ID NO: 2567 - protein, 8 aa, Dengue virus
ETLEQMQR

SEQ ID NO: 2568 - protein, 8 aa, Dengue virus
TLEQMQRK

SEQ ID NO: 2569 - protein, 8 aa, Dengue virus
LEQMQRKH

SEQ ID NO: 2570 - protein, 8 aa, Dengue virus
EQMQRKHG

SEQ ID NO: 2571 - protein, 8 aa, Dengue virus
QMQRKHGG

SEQ ID NO: 2572 - protein, 8 aa, Dengue virus
MQRKHGGM

SEQ ID NO: 2573 - protein, 8 aa, Dengue virus
QRKHGGML

SEQ ID NO: 2574 - protein, 8 aa, Dengue virus
RKHGGMLV

SEQ ID NO: 2575 - protein, 8 aa, Dengue virus
KHGGMLVR

SEQ ID NO: 2576 - protein, 8 aa, Dengue virus
HGGMLVRN

SEQ ID NO: 2577 - protein, 8 aa, Dengue virus
GGMLVRNP

SEQ ID NO: 2578 - protein, 8 aa, Dengue virus
GMLVRNPL

SEQ ID NO: 2579 - protein, 8 aa, Dengue virus
MLVRNPLS

SEQ ID NO: 2580 - protein, 8 aa, Dengue virus
LVRNPLSR

SEQ ID NO: 2581 - protein, 8 aa, Dengue virus
VRNPLSRN

SEQ ID NO: 2582 - protein, 8 aa, Dengue virus
RNPLSRNS

SEQ ID NO: 2583 - protein, 8 aa, Dengue virus
NPLSRNST

SEQ ID NO: 2584 - protein, 8 aa, Dengue virus
PLSRNSTH

SEQ ID NO: 2585 - protein, 8 aa, Dengue virus
LSRNSTHE

SEQ ID NO: 2586 - protein, 8 aa, Dengue virus
SRNSTHEM

SEQ ID NO: 2587 - protein, 8 aa, Dengue virus
RNSTHEMY

SEQ ID NO: 2588 - protein, 8 aa, Dengue virus
NSTHEMYW

SEQ ID NO: 2589 - protein, 8 aa, Dengue virus
STHEMYWV

SEQ ID NO: 2590 - protein, 8 aa, Dengue virus
THEMYWVS

SEQ ID NO: 2591 - protein, 8 aa, Dengue virus
HEMYWVSC

SEQ ID NO: 2592 - protein, 8 aa, Dengue virus
EMYWVSCG

SEQ ID NO: 2593 - protein, 8 aa, Dengue virus
MYWVSCGT

SEQ ID NO: 2594 - protein, 8 aa, Dengue virus
YWVSCGTG

SEQ ID NO: 2595 - protein, 8 aa, Dengue virus
WVSCGTGN

SEQ ID NO: 2596 - protein, 8 aa, Dengue virus
VSCGTGNI

SEQ ID NO: 2597 - protein, 8 aa, Dengue virus
SCGTGNIV

SEQ ID NO: 2598 - protein, 8 aa, Dengue virus
CGTGNIVS

SEQ ID NO: 2599 - protein, 8 aa, Dengue virus
GTGNIVSA

SEQ ID NO: 2600 - protein, 8 aa, Dengue virus
TGNIVSAV

SEQ ID NO: 2601 - protein, 8 aa, Dengue virus
GNIVSAVN

SEQ ID NO: 2602 - protein, 8 aa, Dengue virus
NIVSAVNM

SEQ ID NO: 2603 - protein, 8 aa, Dengue virus
IVSAVNMT

SEQ ID NO: 2604 - protein, 8 aa, Dengue virus
VSAVNMTS

SEQ ID NO: 2605 - protein, 8 aa, Dengue virus
SAVNMTSR

SEQ ID NO: 2606 - protein, 8 aa, Dengue virus
AVNMTSRM

SEQ ID NO: 2607 - protein, 8 aa, Dengue virus
VNMTSRML

SEQ ID NO: 2608 - protein, 8 aa, Dengue virus
NMTSRMLL

SEQ ID NO: 2609 - protein, 8 aa, Dengue virus
MTSRMLLN

SEQ ID NO: 2610 - protein, 8 aa, Dengue virus
TSRMLLNR

SEQ ID NO: 2611 - protein, 8 aa, Dengue virus
SRMLLNRF

SEQ ID NO: 2612 - protein, 8 aa, Dengue virus
RMLLNRFT

SEQ ID NO: 2613 - protein, 8 aa, Dengue virus
MLLNRFTM

SEQ ID NO: 2614 - protein, 8 aa, Dengue virus
LLNRFTMA

SEQ ID NO: 2615 - protein, 8 aa, Dengue virus
LNRFTMAH

SEQ ID NO: 2616 - protein, 8 aa, Dengue virus
NRFTMAHR

SEQ ID NO: 2617 - protein, 8 aa, Dengue virus
RFTMAHRK

SEQ ID NO: 2618 - protein, 8 aa, Dengue virus
FTMAHRKP

SEQ ID NO: 2619 - protein, 8 aa, Dengue virus
TMAHRKPT

SEQ ID NO: 2620 - protein, 8 aa, Dengue virus
MAHRKPTY

SEQ ID NO: 2621 - protein, 8 aa, Dengue virus
AHRKPTYE

SEQ ID NO: 2622 - protein, 8 aa, Dengue virus
HRKPTYER

SEQ ID NO: 2623 - protein, 8 aa, Dengue virus
RKPTYERD

SEQ ID NO: 2624 - protein, 8 aa, Dengue virus
KPTYERDV

SEQ ID NO: 2625 - protein, 8 aa, Dengue virus
PTYERDVD

SEQ ID NO: 2626 - protein, 8 aa, Dengue virus
TYERDVDL

SEQ ID NO: 2627 - protein, 8 aa, Dengue virus
YERDVDLG

SEQ ID NO: 2628 - protein, 8 aa, Dengue virus
ERDVDLGA

SEQ ID NO: 2629 - protein, 8 aa, Dengue virus
RDVDLGAG

SEQ ID NO: 2630 - protein, 8 aa, Dengue virus
DVDLGAGT

SEQ ID NO: 2631 - protein, 8 aa, Dengue virus
VDLGAGTR

SEQ ID NO: 2632 - protein, 8 aa, Dengue virus
DLGAGTRH

SEQ ID NO: 2633 - protein, 8 aa, Dengue virus
LGAGTRHV

SEQ ID NO: 2634 - protein, 8 aa, Dengue virus
GAGTRHVA

SEQ ID NO: 2635 - protein, 8 aa, Dengue virus
AGTRHVAV

SEQ ID NO: 2636 - protein, 8 aa, Dengue virus
GTRHVAVE

SEQ ID NO: 2637 - protein, 8 aa, Dengue virus
TRHVAVEP

SEQ ID NO: 2638 - protein, 8 aa, Dengue virus
RHVAVEPE

SEQ ID NO: 2639 - protein, 8 aa, Dengue virus
HVAVEPEV

SEQ ID NO: 2640 - protein, 8 aa, Dengue virus
VAVEPEVA

SEQ ID NO: 2641 - protein, 8 aa, Dengue virus
AVEPEVAN

SEQ ID NO: 2642 - protein, 8 aa, Dengue virus
VEPEVANL

SEQ ID NO: 2643 - protein, 8 aa, Dengue virus
EPEVANLD

SEQ ID NO: 2644 - protein, 8 aa, Dengue virus
PEVANLDI

SEQ ID NO: 2645 - protein, 8 aa, Dengue virus
EVANLDII

SEQ ID NO: 2646 - protein, 8 aa, Dengue virus
VANLDIIG

SEQ ID NO: 2647 - protein, 8 aa, Dengue virus
ANLDIIGQ

SEQ ID NO: 2648 - protein, 8 aa, Dengue virus
NLDIIGQR

SEQ ID NO: 2649 - protein, 8 aa, Dengue virus
LDIIGQRI

SEQ ID NO: 2650 - protein, 8 aa, Dengue virus
DIIGQRIE

SEQ ID NO: 2651 - protein, 8 aa, Dengue virus
IIGQRIEN

SEQ ID NO: 2652 - protein, 8 aa, Dengue virus
IGQRIENI

SEQ ID NO: 2653 - protein, 8 aa, Dengue virus
GQRIENIK

SEQ ID NO: 2654 - protein, 8 aa, Dengue virus
QRIENIKH

SEQ ID NO: 2655 - protein, 8 aa, Dengue virus
RIENIKHE

SEQ ID NO: 2656 - protein, 8 aa, Dengue virus
IENIKHEH

SEQ ID NO: 2657 - protein, 8 aa, Dengue virus
ENIKHEHK

SEQ ID NO: 2658 - protein, 8 aa, Dengue virus
NIKHEHKS

SEQ ID NO: 2659 - protein, 8 aa, Dengue virus
IKHEHKST

SEQ ID NO: 2660 - protein, 8 aa, Dengue virus
KHEHKSTW

SEQ ID NO: 2661 - protein, 8 aa, Dengue virus
HEHKSTWH

SEQ ID NO: 2662 - protein, 8 aa, Dengue virus
EHKSTWHY

SEQ ID NO: 2663 - protein, 8 aa, Dengue virus
HKSTWHYD

SEQ ID NO: 2664 - protein, 8 aa, Dengue virus
KSTWHYDE

SEQ ID NO: 2665 - protein, 8 aa, Dengue virus
STWHYDED

SEQ ID NO: 2666 - protein, 8 aa, Dengue virus
TWHYDEDN

SEQ ID NO: 2667 - protein, 8 aa, Dengue virus
WHYDEDNP

SEQ ID NO: 2668 - protein, 8 aa, Dengue virus
HYDEDNPY

SEQ ID NO: 2669 - protein, 8 aa, Dengue virus
YDEDNPYK

SEQ ID NO: 2670 - protein, 8 aa, Dengue virus
DEDNPYKT

SEQ ID NO: 2671 - protein, 8 aa, Dengue virus
EDNPYKTW

SEQ ID NO: 2672 - protein, 8 aa, Dengue virus
DNPYKTWA

SEQ ID NO: 2673 - protein, 8 aa, Dengue virus
NPYKTWAY

SEQ ID NO: 2674 - protein, 8 aa, Dengue virus
PYKTWAYH

SEQ ID NO: 2675 - protein, 8 aa, Dengue virus
YKTWAYHG

SEQ ID NO: 2676 - protein, 8 aa, Dengue virus
KTWAYHGS

SEQ ID NO: 2677 - protein, 8 aa, Dengue virus
TWAYHGSY

SEQ ID NO: 2678 - protein, 8 aa, Dengue virus
WAYHGSYE

SEQ ID NO: 2679 - protein, 8 aa, Dengue virus
AYHGSYEV

SEQ ID NO: 2680 - protein, 8 aa, Dengue virus
YHGSYEVK

SEQ ID NO: 2681 - protein, 8 aa, Dengue virus
HGSYEVKP

SEQ ID NO: 2682 - protein, 8 aa, Dengue virus
GSYEVKPS

SEQ ID NO: 2683 - protein, 8 aa, Dengue virus
SYEVKPSG

SEQ ID NO: 2684 - protein, 8 aa, Dengue virus
YEVKPSGS

SEQ ID NO: 2685 - protein, 8 aa, Dengue virus
EVKPSGSA

SEQ ID NO: 2686 - protein, 8 aa, Dengue virus
VKPSGSAS

SEQ ID NO: 2687 - protein, 8 aa, Dengue virus
KPSGSASS

SEQ ID NO: 2688 - protein, 8 aa, Dengue virus
PSGSASSM

SEQ ID NO: 2689 - protein, 8 aa, Dengue virus
SGSASSMV

SEQ ID NO: 2690 - protein, 8 aa, Dengue virus
GSASSMVN

SEQ ID NO: 2691 - protein, 8 aa, Dengue virus
SASSMVNG

SEQ ID NO: 2692 - protein, 8 aa, Dengue virus
ASSMVNGV

SEQ ID NO: 2693 - protein, 8 aa, Dengue virus
SSMVNGVV

SEQ ID NO: 2694 - protein, 8 aa, Dengue virus
SMVNGVVK

SEQ ID NO: 2695 - protein, 8 aa, Dengue virus
MVNGVVKL

SEQ ID NO: 2696 - protein, 8 aa, Dengue virus
VNGVVKLL

SEQ ID NO: 2697 - protein, 8 aa, Dengue virus
NGVVKLLT

SEQ ID NO: 2698 - protein, 8 aa, Dengue virus
GVVKLLTK

SEQ ID NO: 2699 - protein, 8 aa, Dengue virus
VVKLLTKP

SEQ ID NO: 2700 - protein, 8 aa, Dengue virus
VKLLTKPW

SEQ ID NO: 2701 - protein, 8 aa, Dengue virus
KLLTKPWD

SEQ ID NO: 2702 - protein, 8 aa, Dengue virus
LLTKPWDV

SEQ ID NO: 2703 - protein, 8 aa, Dengue virus
LTKPWDVI

SEQ ID NO: 2704 - protein, 8 aa, Dengue virus
TKPWDVIP

SEQ ID NO: 2705 - protein, 8 aa, Dengue virus
KPWDVIPM

SEQ ID NO: 2706 - protein, 8 aa, Dengue virus
PWDVIPMV

SEQ ID NO: 2707 - protein, 8 aa, Dengue virus
WDVIPMVT

SEQ ID NO: 2708 - protein, 8 aa, Dengue virus
DVIPMVTQ

SEQ ID NO: 2709 - protein, 8 aa, Dengue virus
VIPMVTQI

SEQ ID NO: 2710 - protein, 8 aa, Dengue virus
IPMVTQIA

SEQ ID NO: 2711 - protein, 8 aa, Dengue virus
PMVTQIAM

SEQ ID NO: 2712 - protein, 8 aa, Dengue virus
MVTQIAMT

SEQ ID NO: 2713 - protein, 8 aa, Dengue virus
VTQIAMTD

SEQ ID NO: 2714 - protein, 8 aa, Dengue virus
TQIAMTDT

SEQ ID NO: 2715 - protein, 8 aa, Dengue virus
QIAMTDTT

SEQ ID NO: 2716 - protein, 8 aa, Dengue virus
IAMTDTTP

SEQ ID NO: 2717 - protein, 8 aa, Dengue virus
AMTDTTPF

SEQ ID NO: 2718 - protein, 8 aa, Dengue virus
MTDTTPFG

SEQ ID NO: 2719 - protein, 8 aa, Dengue virus
TDTTPFGQ

SEQ ID NO: 2720 - protein, 8 aa, Dengue virus
DTTPFGQQ

SEQ ID NO: 2721 - protein, 8 aa, Dengue virus
TTPFGQQR

SEQ ID NO: 2722 - protein, 8 aa, Dengue virus
TPFGQQRV

SEQ ID NO: 2723 - protein, 8 aa, Dengue virus
PFGQQRVF

SEQ ID NO: 2724 - protein, 8 aa, Dengue virus
FGQQRVFK

SEQ ID NO: 2725 - protein, 8 aa, Dengue virus
GQQRVFKE

SEQ ID NO: 2726 - protein, 8 aa, Dengue virus
QQRVFKEK

SEQ ID NO: 2727 - protein, 8 aa, Dengue virus
QRVFKEKV

SEQ ID NO: 2728 - protein, 8 aa, Dengue virus
RVFKEKVD

SEQ ID NO: 2729 - protein, 8 aa, Dengue virus
VFKEKVDT

SEQ ID NO: 2730 - protein, 8 aa, Dengue virus
FKEKVDTR

SEQ ID NO: 2731 - protein, 8 aa, Dengue virus
KEKVDTRT

SEQ ID NO: 2732 - protein, 8 aa, Dengue virus
EKVDTRTP

SEQ ID NO: 2733 - protein, 8 aa, Dengue virus
KVDTRTPK

SEQ ID NO: 2734 - protein, 8 aa, Dengue virus
VDTRTPKA

SEQ ID NO: 2735 - protein, 8 aa, Dengue virus
DTRTPKAK

SEQ ID NO: 2736 - protein, 8 aa, Dengue virus
TRTPKAKR

SEQ ID NO: 2737 - protein, 8 aa, Dengue virus
RTPKAKRG

SEQ ID NO: 2738 - protein, 8 aa, Dengue virus
TPKAKRGT

SEQ ID NO: 2739 - protein, 8 aa, Dengue virus
PKAKRGTA

SEQ ID NO: 2740 - protein, 8 aa, Dengue virus
KAKRGTAQ

SEQ ID NO: 2741 - protein, 8 aa, Dengue virus
AKRGTAQI

SEQ ID NO: 2742 - protein, 8 aa, Dengue virus
KRGTAQIM

SEQ ID NO: 2743 - protein, 8 aa, Dengue virus
RGTAQIME

SEQ ID NO: 2744 - protein, 8 aa, Dengue virus
GTAQIMEV

SEQ ID NO: 2745 - protein, 8 aa, Dengue virus
TAQIMEVT

SEQ ID NO: 2746 - protein, 8 aa, Dengue virus
AQIMEVTA

SEQ ID NO: 2747 - protein, 8 aa, Dengue virus
QIMEVTAK

SEQ ID NO: 2748 - protein, 8 aa, Dengue virus
IMEVTAKW

SEQ ID NO: 2749 - protein, 8 aa, Dengue virus
MEVTAKWL

SEQ ID NO: 2750 - protein, 8 aa, Dengue virus
EVTAKWLW

SEQ ID NO: 2751 - protein, 8 aa, Dengue virus
VTAKWLWG

SEQ ID NO: 2752 - protein, 8 aa, Dengue virus
TAKWLWGF

SEQ ID NO: 2753 - protein, 8 aa, Dengue virus
AKWLWGFL

SEQ ID NO: 2754 - protein, 8 aa, Dengue virus
KWLWGFLS

SEQ ID NO: 2755 - protein, 8 aa, Dengue virus
WLWGFLSR

SEQ ID NO: 2756 - protein, 8 aa, Dengue virus
LWGFLSRN

SEQ ID NO: 2757 - protein, 8 aa, Dengue virus
WGFLSRNK

SEQ ID NO: 2758 - protein, 8 aa, Dengue virus
GFLSRNKK

SEQ ID NO: 2759 - protein, 8 aa, Dengue virus
FLSRNKKP

SEQ ID NO: 2760 - protein, 8 aa, Dengue virus
LSRNKKPR

SEQ ID NO: 2761 - protein, 8 aa, Dengue virus
SRNKKPRI

SEQ ID NO: 2762 - protein, 8 aa, Dengue virus
RNKKPRIC

SEQ ID NO: 2763 - protein, 8 aa, Dengue virus
NKKPRICT

SEQ ID NO: 2764 - protein, 8 aa, Dengue virus
KKPRICTR

SEQ ID NO: 2765 - protein, 8 aa, Dengue virus
KPRICTRE

SEQ ID NO: 2766 - protein, 8 aa, Dengue virus
PRICTREE

SEQ ID NO: 2767 - protein, 8 aa, Dengue virus
RICTREEF

SEQ ID NO: 2768 - protein, 8 aa, Dengue virus
ICTREEFT

SEQ ID NO: 2769 - protein, 8 aa, Dengue virus
CTREEFTR

SEQ ID NO: 2770 - protein, 8 aa, Dengue virus
TREEFTRK

SEQ ID NO: 2771 - protein, 8 aa, Dengue virus
REEFTRKV

SEQ ID NO: 2772 - protein, 8 aa, Dengue virus
EEFTRKVR

SEQ ID NO: 2773 - protein, 8 aa, Dengue virus
EFTRKVRS

SEQ ID NO: 2774 - protein, 8 aa, Dengue virus
FTRKVRSN

SEQ ID NO: 2775 - protein, 8 aa, Dengue virus
TRKVRSNA

SEQ ID NO: 2776 - protein, 8 aa, Dengue virus
RKVRSNAA

SEQ ID NO: 2777 - protein, 8 aa, Dengue virus
KVRSNAAI

SEQ ID NO: 2778 - protein, 8 aa, Dengue virus
VRSNAAIG

SEQ ID NO: 2779 - protein, 8 aa, Dengue virus
RSNAAIGA

SEQ ID NO: 2780 - protein, 8 aa, Dengue virus
SNAAIGAV

SEQ ID NO: 2781 - protein, 8 aa, Dengue virus
NAAIGAVF

SEQ ID NO: 2782 - protein, 8 aa, Dengue virus
AAIGAVFV

SEQ ID NO: 2783 - protein, 8 aa, Dengue virus
AIGAVFVD

SEQ ID NO: 2784 - protein, 8 aa, Dengue virus
IGAVFVDE

SEQ ID NO: 2785 - protein, 8 aa, Dengue virus
GAVFVDEN

SEQ ID NO: 2786 - protein, 8 aa, Dengue virus
AVFVDENQ

SEQ ID NO: 2787 - protein, 8 aa, Dengue virus
VFVDENQW

SEQ ID NO: 2788 - protein, 8 aa, Dengue virus
FVDENQWN

SEQ ID NO: 2789 - protein, 8 aa, Dengue virus
VDENQWNS

SEQ ID NO: 2790 - protein, 8 aa, Dengue virus
DENQWNSA

SEQ ID NO: 2791 - protein, 8 aa, Dengue virus
ENQWNSAK

SEQ ID NO: 2792 - protein, 8 aa, Dengue virus
NQWNSAKE

SEQ ID NO: 2793 - protein, 8 aa, Dengue virus
QWNSAKEA

SEQ ID NO: 2794 - protein, 8 aa, Dengue virus
WNSAKEAV

SEQ ID NO: 2795 - protein, 8 aa, Dengue virus
NSAKEAVE

SEQ ID NO: 2796 - protein, 8 aa, Dengue virus
SAKEAVED

SEQ ID NO: 2797 - protein, 8 aa, Dengue virus
AKEAVEDE

SEQ ID NO: 2798 - protein, 8 aa, Dengue virus
KEAVEDER

SEQ ID NO: 2799 - protein, 8 aa, Dengue virus
EAVEDERF

SEQ ID NO: 2800 - protein, 8 aa, Dengue virus
AVEDERFW

SEQ ID NO: 2801 - protein, 8 aa, Dengue virus
VEDERFWD

SEQ ID NO: 2802 - protein, 8 aa, Dengue virus
EDERFWDL

SEQ ID NO: 2803 - protein, 8 aa, Dengue virus
DERFWDLV

SEQ ID NO: 2804 - protein, 8 aa, Dengue virus
LVHREREL

SEQ ID NO: 2805 - protein, 8 aa, Dengue virus
VHRERELH

SEQ ID NO: 2806 - protein, 8 aa, Dengue virus
HRERELHK

SEQ ID NO: 2807 - protein, 8 aa, Dengue virus
RERELHKQ

SEQ ID NO: 2808 - protein, 8 aa, Dengue virus
ERELHKQG

SEQ ID NO: 2809 - protein, 8 aa, Dengue virus
RELHKQGK

SEQ ID NO: 2810 - protein, 8 aa, Dengue virus
ELHKQGKC

SEQ ID NO: 2811 - protein, 8 aa, Dengue virus
LHKQGKCA

SEQ ID NO: 2812 - protein, 8 aa, Dengue virus
HKQGKCAT

SEQ ID NO: 2813 - protein, 8 aa, Dengue virus
KQGKCATC

SEQ ID NO: 2814 - protein, 8 aa, Dengue virus
QGKCATCV

SEQ ID NO: 2815 - protein, 8 aa, Dengue virus
GKCATCVY

SEQ ID NO: 2816 - protein, 8 aa, Dengue virus
KCATCVYN

SEQ ID NO: 2817 - protein, 8 aa, Dengue virus
CATCVYNM

SEQ ID NO: 2818 - protein, 8 aa, Dengue virus
ATCVYNMM

SEQ ID NO: 2819 - protein, 8 aa, Dengue virus
TCVYNMMG

SEQ ID NO: 2820 - protein, 8 aa, Dengue virus
CVYNMMGK

SEQ ID NO: 2821 - protein, 8 aa, Dengue virus
VYNMMGKR

SEQ ID NO: 2822 - protein, 8 aa, Dengue virus
YNMMGKRE

SEQ ID NO: 2823 - protein, 8 aa, Dengue virus
NMMGKREK

SEQ ID NO: 2824 - protein, 8 aa, Dengue virus
MMGKREKK

SEQ ID NO: 2825 - protein, 8 aa, Dengue virus
MGKREKKL

SEQ ID NO: 2826 - protein, 8 aa, Dengue virus
GKREKKLG

SEQ ID NO: 2827 - protein, 8 aa, Dengue virus
KREKKLGE

SEQ ID NO: 2828 - protein, 8 aa, Dengue virus
REKKLGEF

SEQ ID NO: 2829 - protein, 8 aa, Dengue virus
EKKLGEFG

SEQ ID NO: 2830 - protein, 8 aa, Dengue virus
KKLGEFGK

SEQ ID NO: 2831 - protein, 8 aa, Dengue virus
KLGEFGKA

SEQ ID NO: 2832 - protein, 8 aa, Dengue virus
LGEFGKAK

SEQ ID NO: 2833 - protein, 8 aa, Dengue virus
GEFGKAKG

SEQ ID NO: 2834 - protein, 8 aa, Dengue virus
EFGKAKGS

SEQ ID NO: 2835 - protein, 8 aa, Dengue virus
FGKAKGSR

SEQ ID NO: 2836 - protein, 8 aa, Dengue virus
GKAKGSRA

SEQ ID NO: 2837 - protein, 8 aa, Dengue virus
KAKGSRAI

SEQ ID NO: 2838 - protein, 8 aa, Dengue virus
AKGSRAIW

SEQ ID NO: 2839 - protein, 8 aa, Dengue virus
KGSRAIWY

SEQ ID NO: 2840 - protein, 8 aa, Dengue virus
GSRAIWYM

SEQ ID NO: 2841 - protein, 8 aa, Dengue virus
SRAIWYMW

SEQ ID NO: 2842 - protein, 8 aa, Dengue virus
RAIWYMWL

SEQ ID NO: 2843 - protein, 8 aa, Dengue virus
AIWYMWLG

SEQ ID NO: 2844 - protein, 8 aa, Dengue virus
IWYMWLGA

SEQ ID NO: 2845 - protein, 8 aa, Dengue virus
WYMWLGAR

SEQ ID NO: 2846 - protein, 8 aa, Dengue virus
YMWLGARF

SEQ ID NO: 2847 - protein, 8 aa, Dengue virus
MWLGARFL

SEQ ID NO: 2848 - protein, 8 aa, Dengue virus
WLGARFLE

SEQ ID NO: 2849 - protein, 8 aa, Dengue virus
LGARFLEF

SEQ ID NO: 2850 - protein, 8 aa, Dengue virus
GARFLEFE

SEQ ID NO: 2851 - protein, 8 aa, Dengue virus
ARFLEFEA

SEQ ID NO: 2852 - protein, 8 aa, Dengue virus
RFLEFEAL

SEQ ID NO: 2853 - protein, 8 aa, Dengue virus
FLEFEALG

SEQ ID NO: 2854 - protein, 8 aa, Dengue virus
LEFEALGF

SEQ ID NO: 2855 - protein, 8 aa, Dengue virus
EFEALGFM

SEQ ID NO: 2856 - protein, 8 aa, Dengue virus
FEALGFMN

SEQ ID NO: 2857 - protein, 8 aa, Dengue virus
EALGFMNE

SEQ ID NO: 2858 - protein, 8 aa, Dengue virus
ALGFMNED

SEQ ID NO: 2859 - protein, 8 aa, Dengue virus
LGFMNEDH

SEQ ID NO: 2860 - protein, 8 aa, Dengue virus
GFMNEDHW

SEQ ID NO: 2861 - protein, 8 aa, Dengue virus
FMNEDHWF

SEQ ID NO: 2862 - protein, 8 aa, Dengue virus
MNEDHWFS

SEQ ID NO: 2863 - protein, 8 aa, Dengue virus
NEDHWFSR

SEQ ID NO: 2864 - protein, 8 aa, Dengue virus
EDHWFSRE

SEQ ID NO: 2865 - protein, 8 aa, Dengue virus
DHWFSREN

SEQ ID NO: 2866 - protein, 8 aa, Dengue virus
HWFSRENS

SEQ ID NO: 2867 - protein, 8 aa, Dengue virus
WFSRENSL

SEQ ID NO: 2868 - protein, 8 aa, Dengue virus
FSRENSLS

SEQ ID NO: 2869 - protein, 8 aa, Dengue virus
SRENSLSG

SEQ ID NO: 2870 - protein, 8 aa, Dengue virus
RENSLSGV

SEQ ID NO: 2871 - protein, 8 aa, Dengue virus
ENSLSGVE

SEQ ID NO: 2872 - protein, 8 aa, Dengue virus
NSLSGVEG

SEQ ID NO: 2873 - protein, 8 aa, Dengue virus
SLSGVEGE

SEQ ID NO: 2874 - protein, 8 aa, Dengue virus
LSGVEGEG

SEQ ID NO: 2875 - protein, 8 aa, Dengue virus
SGVEGEGL

SEQ ID NO: 2876 - protein, 8 aa, Dengue virus
GVEGEGLH

SEQ ID NO: 2877 - protein, 8 aa, Dengue virus
VEGEGLHK

SEQ ID NO: 2878 - protein, 8 aa, Dengue virus
EGEGLHKL

SEQ ID NO: 2879 - protein, 8 aa, Dengue virus
GEGLHKLG

SEQ ID NO: 2880 - protein, 8 aa, Dengue virus
EGLHKLGY

SEQ ID NO: 2881 - protein, 8 aa, Dengue virus
GLHKLGYI

SEQ ID NO: 2882 - protein, 8 aa, Dengue virus
LHKLGYIL

SEQ ID NO: 2883 - protein, 8 aa, Dengue virus
HKLGYILR

SEQ ID NO: 2884 - protein, 8 aa, Dengue virus
KLGYILRD

SEQ ID NO: 2885 - protein, 8 aa, Dengue virus
LGYILRDI

SEQ ID NO: 2886 - protein, 8 aa, Dengue virus
GYILRDIS

SEQ ID NO: 2887 - protein, 8 aa, Dengue virus
YILRDISK

SEQ ID NO: 2888 - protein, 8 aa, Dengue virus
ILRDISKI

SEQ ID NO: 2889 - protein, 8 aa, Dengue virus
LRDISKIP

SEQ ID NO: 2890 - protein, 8 aa, Dengue virus
RDISKIPG

SEQ ID NO: 2891 - protein, 8 aa, Dengue virus
DISKIPGG

SEQ ID NO: 2892 - protein, 8 aa, Dengue virus
ISKIPGGN

SEQ ID NO: 2893 - protein, 8 aa, Dengue virus
SKIPGGNM

SEQ ID NO: 2894 - protein, 8 aa, Dengue virus
KIPGGNMY

SEQ ID NO: 2895 - protein, 8 aa, Dengue virus
IPGGNMYA

SEQ ID NO: 2896 - protein, 8 aa, Dengue virus
PGGNMYAD

SEQ ID NO: 2897 - protein, 8 aa, Dengue virus
GGNMYADD

SEQ ID NO: 2898 - protein, 8 aa, Dengue virus
GNMYADDT

SEQ ID NO: 2899 - protein, 8 aa, Dengue virus
NMYADDTA

SEQ ID NO: 2900 - protein, 8 aa, Dengue virus
MYADDTAG

SEQ ID NO: 2901 - protein, 8 aa, Dengue virus
YADDTAGW

SEQ ID NO: 2902 - protein, 8 aa, Dengue virus
ADDTAGWD

SEQ ID NO: 2903 - protein, 8 aa, Dengue virus
DDTAGWDT

SEQ ID NO: 2904 - protein, 8 aa, Dengue virus
DTAGWDTR

SEQ ID NO: 2905 - protein, 8 aa, Dengue virus
TAGWDTRI

SEQ ID NO: 2906 - protein, 8 aa, Dengue virus
AGWDTRIT

SEQ ID NO: 2907 - protein, 8 aa, Dengue virus
GWDTRITE

SEQ ID NO: 2908 - protein, 8 aa, Dengue virus
WDTRITED

SEQ ID NO: 2909 - protein, 8 aa, Dengue virus
DTRITEDD

SEQ ID NO: 2910 - protein, 8 aa, Dengue virus
TRITEDDL

SEQ ID NO: 2911 - protein, 8 aa, Dengue virus
RITEDDLQ

SEQ ID NO: 2912 - protein, 8 aa, Dengue virus
ITEDDLQN

SEQ ID NO: 2913 - protein, 8 aa, Dengue virus
TEDDLQNE

SEQ ID NO: 2914 - protein, 8 aa, Dengue virus
EDDLQNEA

SEQ ID NO: 2915 - protein, 8 aa, Dengue virus
DDLQNEAK

SEQ ID NO: 2916 - protein, 8 aa, Dengue virus
DLQNEAKI

SEQ ID NO: 2917 - protein, 8 aa, Dengue virus
LQNEAKIT

SEQ ID NO: 2918 - protein, 8 aa, Dengue virus
QNEAKITD

SEQ ID NO: 2919 - protein, 8 aa, Dengue virus
NEAKITDI

SEQ ID NO: 2920 - protein, 8 aa, Dengue virus
EAKITDIM

SEQ ID NO: 2921 - protein, 8 aa, Dengue virus
AKITDIME

SEQ ID NO: 2922 - protein, 8 aa, Dengue virus
KITDIMEP

SEQ ID NO: 2923 - protein, 8 aa, Dengue virus
ITDIMEPE

SEQ ID NO: 2924 - protein, 8 aa, Dengue virus
TDIMEPEH

SEQ ID NO: 2925 - protein, 8 aa, Dengue virus
DIMEPEHA

SEQ ID NO: 2926 - protein, 8 aa, Dengue virus
IMEPEHAL

SEQ ID NO: 2927 - protein, 8 aa, Dengue virus
MEPEHALL

SEQ ID NO: 2928 - protein, 8 aa, Dengue virus
EPEHALLA

SEQ ID NO: 2929 - protein, 8 aa, Dengue virus
PEHALLAK

SEQ ID NO: 2930 - protein, 8 aa, Dengue virus
EHALLAKS

SEQ ID NO: 2931 - protein, 8 aa, Dengue virus
HALLAKSI

SEQ ID NO: 2932 - protein, 8 aa, Dengue virus
ALLAKSIF

SEQ ID NO: 2933 - protein, 8 aa, Dengue virus
LLAKSIFK

SEQ ID NO: 2934 - protein, 8 aa, Dengue virus
LAKSIFKL

SEQ ID NO: 2935 - protein, 8 aa, Dengue virus
AKSIFKLT

SEQ ID NO: 2936 - protein, 8 aa, Dengue virus
KSIFKLTY

SEQ ID NO: 2937 - protein, 8 aa, Dengue virus
SIFKLTYQ

SEQ ID NO: 2938 - protein, 8 aa, Dengue virus
IFKLTYQN

SEQ ID NO: 2939 - protein, 8 aa, Dengue virus
FKLTYQNK

SEQ ID NO: 2940 - protein, 8 aa, Dengue virus
KLTYQNKV

SEQ ID NO: 2941 - protein, 8 aa, Dengue virus
LTYQNKVV

SEQ ID NO: 2942 - protein, 8 aa, Dengue virus
TYQNKVVR

SEQ ID NO: 2943 - protein, 8 aa, Dengue virus
YQNKVVRV

SEQ ID NO: 2944 - protein, 8 aa, Dengue virus
QNKVVRVQ

SEQ ID NO: 2945 - protein, 8 aa, Dengue virus
NKVVRVQR

SEQ ID NO: 2946 - protein, 8 aa, Dengue virus
KVVRVQRP

SEQ ID NO: 2947 - protein, 8 aa, Dengue virus
VVRVQRPA

SEQ ID NO: 2948 - protein, 8 aa, Dengue virus
VRVQRPAK

SEQ ID NO: 2949 - protein, 8 aa, Dengue virus
RVQRPAKN

SEQ ID NO: 2950 - protein, 8 aa, Dengue virus
VQRPAKNG

SEQ ID NO: 2951 - protein, 8 aa, Dengue virus
QRPAKNGT

SEQ ID NO: 2952 - protein, 8 aa, Dengue virus
RPAKNGTV

SEQ ID NO: 2953 - protein, 8 aa, Dengue virus
PAKNGTVM

SEQ ID NO: 2954 - protein, 8 aa, Dengue virus
AKNGTVMD

SEQ ID NO: 2955 - protein, 8 aa, Dengue virus
KNGTVMDV

SEQ ID NO: 2956 - protein, 8 aa, Dengue virus
NGTVMDVI

SEQ ID NO: 2957 - protein, 8 aa, Dengue virus
GTVMDVIS

SEQ ID NO: 2958 - protein, 8 aa, Dengue virus
TVMDVISR

SEQ ID NO: 2959 - protein, 8 aa, Dengue virus
VMDVISRR

SEQ ID NO: 2960 - protein, 8 aa, Dengue virus
MDVISRRD

SEQ ID NO: 2961 - protein, 8 aa, Dengue virus
DVISRRDQ

SEQ ID NO: 2962 - protein, 8 aa, Dengue virus
VISRRDQR

SEQ ID NO: 2963 - protein, 8 aa, Dengue virus
ISRRDQRG

SEQ ID NO: 2964 - protein, 8 aa, Dengue virus
SRRDQRGS

SEQ ID NO: 2965 - protein, 8 aa, Dengue virus
RRDQRGSG

SEQ ID NO: 2966 - protein, 8 aa, Dengue virus
RDQRGSGQ

SEQ ID NO: 2967 - protein, 8 aa, Dengue virus
DQRGSGQV

SEQ ID NO: 2968 - protein, 8 aa, Dengue virus
QRGSGQVG

SEQ ID NO: 2969 - protein, 8 aa, Dengue virus
RGSGQVGT

SEQ ID NO: 2970 - protein, 8 aa, Dengue virus
GSGQVGTY

SEQ ID NO: 2971 - protein, 8 aa, Dengue virus
SGQVGTYG

SEQ ID NO: 2972 - protein, 8 aa, Dengue virus
GQVGTYGL

SEQ ID NO: 2973 - protein, 8 aa, Dengue virus
QVGTYGLN

SEQ ID NO: 2974 - protein, 8 aa, Dengue virus
VGTYGLNT

SEQ ID NO: 2975 - protein, 8 aa, Dengue virus
GTYGLNTF

SEQ ID NO: 2976 - protein, 8 aa, Dengue virus
TYGLNTFT

SEQ ID NO: 2977 - protein, 8 aa, Dengue virus
YGLNTFTN

SEQ ID NO: 2978 - protein, 8 aa, Dengue virus
GLNTFTNM

SEQ ID NO: 2979 - protein, 8 aa, Dengue virus
LNTFTNME

SEQ ID NO: 2980 - protein, 8 aa, Dengue virus
NTFTNMEA

SEQ ID NO: 2981 - protein, 8 aa, Dengue virus
TFTNMEAQ

SEQ ID NO: 2982 - protein, 8 aa, Dengue virus
FTNMEAQL

SEQ ID NO: 2983 - protein, 8 aa, Dengue virus
TNMEAQLI

SEQ ID NO: 2984 - protein, 8 aa, Dengue virus
NMEAQLIR

SEQ ID NO: 2985 - protein, 8 aa, Dengue virus
MEAQLIRQ

SEQ ID NO: 2986 - protein, 8 aa, Dengue virus
EAQLIRQM

SEQ ID NO: 2987 - protein, 8 aa, Dengue virus
AQLIRQME

SEQ ID NO: 2988 - protein, 8 aa, Dengue virus
QLIRQMES

SEQ ID NO: 2989 - protein, 8 aa, Dengue virus
LIRQMESE

SEQ ID NO: 2990 - protein, 8 aa, Dengue virus
IRQMESEG

SEQ ID NO: 2991 - protein, 8 aa, Dengue virus
RQMESEGI

SEQ ID NO: 2992 - protein, 8 aa, Dengue virus
QMESEGIF

SEQ ID NO: 2993 - protein, 8 aa, Dengue virus
MESEGIFS

SEQ ID NO: 2994 - protein, 8 aa, Dengue virus
ESEGIFSP

SEQ ID NO: 2995 - protein, 8 aa, Dengue virus
ELETPNLA

SEQ ID NO: 2996 - protein, 8 aa, Dengue virus
ERLKRMAI

SEQ ID NO: 2997 - protein, 8 aa, Dengue virus
RLKRMAIS

SEQ ID NO: 2998 - protein, 8 aa, Dengue virus
LKRMAISG

SEQ ID NO: 2999 - protein, 8 aa, Dengue virus
KRMAISGD

SEQ ID NO: 3000 - protein, 8 aa, Dengue virus
RMAISGDD

SEQ ID NO: 3001 - protein, 8 aa, Dengue virus
MAISGDDC

SEQ ID NO: 3002 - protein, 8 aa, Dengue virus
AISGDDCV

SEQ ID NO: 3003 - protein, 8 aa, Dengue virus
ISGDDCVV

SEQ ID NO: 3004 - protein, 8 aa, Dengue virus
SGDDCVVK

SEQ ID NO: 3005 - protein, 8 aa, Dengue virus
GDDCVVKP

SEQ ID NO: 3006 - protein, 8 aa, Dengue virus
DDCVVKPI

SEQ ID NO: 3007 - protein, 8 aa, Dengue virus
DCVVKPID

SEQ ID NO: 3008 - protein, 8 aa, Dengue virus
CVVKPIDD

SEQ ID NO: 3009 - protein, 8 aa, Dengue virus
VVKPIDDR

SEQ ID NO: 3010 - protein, 8 aa, Dengue virus
VKPIDDRF

SEQ ID NO: 3011 - protein, 8 aa, Dengue virus
KPIDDRFA

SEQ ID NO: 3012 - protein, 8 aa, Dengue virus
PIDDRFAT

SEQ ID NO: 3013 - protein, 8 aa, Dengue virus
IDDRFATA

SEQ ID NO: 3014 - protein, 8 aa, Dengue virus
DDRFATAL

SEQ ID NO: 3015 - protein, 8 aa, Dengue virus
DRFATALT

SEQ ID NO: 3016 - protein, 8 aa, Dengue virus
RFATALTA

SEQ ID NO: 3017 - protein, 8 aa, Dengue virus
FATALTAL

SEQ ID NO: 3018 - protein, 8 aa, Dengue virus
ATALTALN

SEQ ID NO: 3019 - protein, 8 aa, Dengue virus
TALTALND

SEQ ID NO: 3020 - protein, 8 aa, Dengue virus
ALTALNDM

SEQ ID NO: 3021 - protein, 8 aa, Dengue virus
LTALNDMG

SEQ ID NO: 3022 - protein, 8 aa, Dengue virus
TALNDMGK

SEQ ID NO: 3023 - protein, 8 aa, Dengue virus
ALNDMGKV

SEQ ID NO: 3024 - protein, 8 aa, Dengue virus
LNDMGKVR

SEQ ID NO: 3025 - protein, 8 aa, Dengue virus
NDMGKVRK

SEQ ID NO: 3026 - protein, 8 aa, Dengue virus
DMGKVRKD

SEQ ID NO: 3027 - protein, 8 aa, Dengue virus
MGKVRKDI

SEQ ID NO: 3028 - protein, 8 aa, Dengue virus
GKVRKDIP

SEQ ID NO: 3029 - protein, 8 aa, Dengue virus
KVRKDIPQ

SEQ ID NO: 3030 - protein, 8 aa, Dengue virus
VRKDIPQW

SEQ ID NO: 3031 - protein, 8 aa, Dengue virus
RKDIPQWE

SEQ ID NO: 3032 - protein, 8 aa, Dengue virus
KDIPQWEP

SEQ ID NO: 3033 - protein, 8 aa, Dengue virus
DIPQWEPS

SEQ ID NO: 3034 - protein, 8 aa, Dengue virus
IPQWEPSK

SEQ ID NO: 3035 - protein, 8 aa, Dengue virus
PQWEPSKG

SEQ ID NO: 3036 - protein, 8 aa, Dengue virus
QWEPSKGW

SEQ ID NO: 3037 - protein, 8 aa, Dengue virus
WEPSKGWN

SEQ ID NO: 3038 - protein, 8 aa, Dengue virus
EPSKGWND

SEQ ID NO: 3039 - protein, 8 aa, Dengue virus
PSKGWNDW

SEQ ID NO: 3040 - protein, 8 aa, Dengue virus
SKGWNDWQ

SEQ ID NO: 3041 - protein, 8 aa, Dengue virus
KGWNDWQQ

SEQ ID NO: 3042 - protein, 8 aa, Dengue virus
GWNDWQQV

SEQ ID NO: 3043 - protein, 8 aa, Dengue virus
WNDWQQVP

SEQ ID NO: 3044 - protein, 8 aa, Dengue virus
NDWQQVPF

SEQ ID NO: 3045 - protein, 8 aa, Dengue virus
DWQQVPFC

SEQ ID NO: 3046 - protein, 8 aa, Dengue virus
WQQVPFCS

SEQ ID NO: 3047 - protein, 8 aa, Dengue virus
QQVPFCSH

SEQ ID NO: 3048 - protein, 8 aa, Dengue virus
QVPFCSHH

SEQ ID NO: 3049 - protein, 8 aa, Dengue virus
VPFCSHHF

SEQ ID NO: 3050 - protein, 8 aa, Dengue virus
PFCSHHFH

SEQ ID NO: 3051 - protein, 8 aa, Dengue virus
FCSHHFHQ

SEQ ID NO: 3052 - protein, 8 aa, Dengue virus
CSHHFHQL

SEQ ID NO: 3053 - protein, 8 aa, Dengue virus
SHHFHQLI

SEQ ID NO: 3054 - protein, 8 aa, Dengue virus
HHFHQLIM

SEQ ID NO: 3055 - protein, 8 aa, Dengue virus
HFHQLIMK

SEQ ID NO: 3056 - protein, 8 aa, Dengue virus
FHQLIMKD

SEQ ID NO: 3057 - protein, 8 aa, Dengue virus
HQLIMKDG

SEQ ID NO: 3058 - protein, 8 aa, Dengue virus
QLIMKDGR

SEQ ID NO: 3059 - protein, 8 aa, Dengue virus
LIMKDGRE

SEQ ID NO: 3060 - protein, 8 aa, Dengue virus
IMKDGREI

SEQ ID NO: 3061 - protein, 8 aa, Dengue virus
MKDGREIV

SEQ ID NO: 3062 - protein, 8 aa, Dengue virus
KDGREIVV

SEQ ID NO: 3063 - protein, 8 aa, Dengue virus
DGREIVVP

SEQ ID NO: 3064 - protein, 8 aa, Dengue virus
GREIVVPC

SEQ ID NO: 3065 - protein, 8 aa, Dengue virus
REIVVPCR

SEQ ID NO: 3066 - protein, 8 aa, Dengue virus
EIVVPCRN

SEQ ID NO: 3067 - protein, 8 aa, Dengue virus
IVVPCRNQ

SEQ ID NO: 3068 - protein, 8 aa, Dengue virus
VVPCRNQD

SEQ ID NO: 3069 - protein, 8 aa, Dengue virus
VPCRNQDE

SEQ ID NO: 3070 - protein, 8 aa, Dengue virus
PCRNQDEL

SEQ ID NO: 3071 - protein, 8 aa, Dengue virus
CRNQDELV

SEQ ID NO: 3072 - protein, 8 aa, Dengue virus
RNQDELVG

SEQ ID NO: 3073 - protein, 8 aa, Dengue virus
NQDELVGR

SEQ ID NO: 3074 - protein, 8 aa, Dengue virus
QDELVGRA

SEQ ID NO: 3075 - protein, 8 aa, Dengue virus
DELVGRAR

SEQ ID NO: 3076 - protein, 8 aa, Dengue virus
ELVGRARV

SEQ ID NO: 3077 - protein, 8 aa, Dengue virus
LVGRARVS

SEQ ID NO: 3078 - protein, 8 aa, Dengue virus
VGRARVSQ

SEQ ID NO: 3079 - protein, 8 aa, Dengue virus
GRARVSQG

SEQ ID NO: 3080 - protein, 8 aa, Dengue virus
RARVSQGA

SEQ ID NO: 3081 - protein, 8 aa, Dengue virus
ARVSQGAG

SEQ ID NO: 3082 - protein, 8 aa, Dengue virus
RVSQGAGW

SEQ ID NO: 3083 - protein, 8 aa, Dengue virus
VSQGAGWS

SEQ ID NO: 3084 - protein, 8 aa, Dengue virus
SQGAGWSL

SEQ ID NO: 3085 - protein, 8 aa, Dengue virus
QGAGWSLR

SEQ ID NO: 3086 - protein, 8 aa, Dengue virus
GAGWSLRE

SEQ ID NO: 3087 - protein, 8 aa, Dengue virus
AGWSLRET

SEQ ID NO: 3088 - protein, 8 aa, Dengue virus
GWSLRETA

SEQ ID NO: 3089 - protein, 8 aa, Dengue virus
WSLRETAC

SEQ ID NO: 3090 - protein, 8 aa, Dengue virus
SLRETACL

SEQ ID NO: 3091 - protein, 8 aa, Dengue virus
LRETACLG

SEQ ID NO: 3092 - protein, 8 aa, Dengue virus
RETACLGK

SEQ ID NO: 3093 - protein, 8 aa, Dengue virus
ETACLGKS

SEQ ID NO: 3094 - protein, 8 aa, Dengue virus
TACLGKSY

SEQ ID NO: 3095 - protein, 8 aa, Dengue virus
ACLGKSYA

SEQ ID NO: 3096 - protein, 8 aa, Dengue virus
CLGKSYAQ

SEQ ID NO: 3097 - protein, 8 aa, Dengue virus
LGKSYAQM

SEQ ID NO: 3098 - protein, 8 aa, Dengue virus
GKSYAQMW

SEQ ID NO: 3099 - protein, 8 aa, Dengue virus
KSYAQMWQ

SEQ ID NO: 3100 - protein, 8 aa, Dengue virus
SYAQMWQL

SEQ ID NO: 3101 - protein, 8 aa, Dengue virus
YAQMWQLM

SEQ ID NO: 3102 - protein, 8 aa, Dengue virus
AQMWQLMY

SEQ ID NO: 3103 - protein, 8 aa, Dengue virus
QMWQLMYF

SEQ ID NO: 3104 - protein, 8 aa, Dengue virus
MWQLMYFH

SEQ ID NO: 3105 - protein, 8 aa, Dengue virus
WQLMYFHR

SEQ ID NO: 3106 - protein, 8 aa, Dengue virus
QLMYFHRR

SEQ ID NO: 3107 - protein, 8 aa, Dengue virus
LMYFHRRD

SEQ ID NO: 3108 - protein, 8 aa, Dengue virus
MYFHRRDL

SEQ ID NO: 3109 - protein, 8 aa, Dengue virus
YFHRRDLR

SEQ ID NO: 3110 - protein, 8 aa, Dengue virus
FHRRDLRL

SEQ ID NO: 3111 - protein, 8 aa, Dengue virus
HRRDLRLA

SEQ ID NO: 3112 - protein, 8 aa, Dengue virus
RRDLRLAA

SEQ ID NO: 3113 - protein, 8 aa, Dengue virus
RDLRLAAN

SEQ ID NO: 3114 - protein, 8 aa, Dengue virus
DLRLAANA

SEQ ID NO: 3115 - protein, 8 aa, Dengue virus
LRLAANAI

SEQ ID NO: 3116 - protein, 8 aa, Dengue virus
RLAANAIC

SEQ ID NO: 3117 - protein, 8 aa, Dengue virus
LAANAICS

SEQ ID NO: 3118 - protein, 8 aa, Dengue virus
AANAICSA

SEQ ID NO: 3119 - protein, 8 aa, Dengue virus
ANAICSAV

SEQ ID NO: 3120 - protein, 8 aa, Dengue virus
NAICSAVP

SEQ ID NO: 3121 - protein, 8 aa, Dengue virus
AICSAVPV

SEQ ID NO: 3122 - protein, 8 aa, Dengue virus
CSAVPVDW

SEQ ID NO: 3123 - protein, 8 aa, Dengue virus
PVDWVPTS

SEQ ID NO: 3124 - protein, 8 aa, Dengue virus
VDWVPTSR

SEQ ID NO: 3125 - protein, 8 aa, Dengue virus
DWVPTSRT

SEQ ID NO: 3126 - protein, 8 aa, Dengue virus
WVPTSRTT

SEQ ID NO: 3127 - protein, 8 aa, Dengue virus
VPTSRTTW

SEQ ID NO: 3128 - protein, 8 aa, Dengue virus
PTSRTTWS

SEQ ID NO: 3129 - protein, 8 aa, Dengue virus
TSRTTWSI

SEQ ID NO: 3130 - protein, 8 aa, Dengue virus
SRTTWSIH

SEQ ID NO: 3131 - protein, 8 aa, Dengue virus
RTTWSIHA

SEQ ID NO: 3132 - protein, 8 aa, Dengue virus
TTWSIHAH

SEQ ID NO: 3133 - protein, 8 aa, Dengue virus
TWSIHAHH

SEQ ID NO: 3134 - protein, 8 aa, Dengue virus
WSIHAHHQ

SEQ ID NO: 3135 - protein, 8 aa, Dengue virus
SIHAHHQW

SEQ ID NO: 3136 - protein, 8 aa, Dengue virus
IHAHHQWM

SEQ ID NO: 3137 - protein, 8 aa, Dengue virus
HAHHQWMT

SEQ ID NO: 3138 - protein, 8 aa, Dengue virus
AHHQWMTT

SEQ ID NO: 3139 - protein, 8 aa, Dengue virus
HHQWMTTE

SEQ ID NO: 3140 - protein, 8 aa, Dengue virus
HQWMTTED

SEQ ID NO: 3141 - protein, 8 aa, Dengue virus
QWMTTEDM

SEQ ID NO: 3142 - protein, 8 aa, Dengue virus
WMTTEDML

SEQ ID NO: 3143 - protein, 8 aa, Dengue virus
MTTEDMLS

SEQ ID NO: 3144 - protein, 8 aa, Dengue virus
TTEDMLSV

SEQ ID NO: 3145 - protein, 8 aa, Dengue virus
TEDMLSVW

SEQ ID NO: 3146 - protein, 8 aa, Dengue virus
EDMLSVWN

SEQ ID NO: 3147 - protein, 8 aa, Dengue virus
DMLSVWNR

SEQ ID NO: 3148 - protein, 8 aa, Dengue virus
MLSVWNRV

SEQ ID NO: 3149 - protein, 8 aa, Dengue virus
LSVWNRVW

SEQ ID NO: 3150 - protein, 8 aa, Dengue virus
SVWNRVWI

SEQ ID NO: 3151 - protein, 8 aa, Dengue virus
VWNRVWIE

SEQ ID NO: 3152 - protein, 8 aa, Dengue virus
WNRVWIEE

SEQ ID NO: 3153 - protein, 8 aa, Dengue virus
NRVWIEEN

SEQ ID NO: 3154 - protein, 8 aa, Dengue virus
RVWIEENP

SEQ ID NO: 3155 - protein, 8 aa, Dengue virus
VWIEENPW

SEQ ID NO: 3156 - protein, 8 aa, Dengue virus
WIEENPWM

SEQ ID NO: 3157 - protein, 8 aa, Dengue virus
IEENPWME

SEQ ID NO: 3158 - protein, 8 aa, Dengue virus
EENPWMED

SEQ ID NO: 3159 - protein, 8 aa, Dengue virus
ENPWMEDK

SEQ ID NO: 3160 - protein, 8 aa, Dengue virus
NPWMEDKT

SEQ ID NO: 3161 - protein, 8 aa, Dengue virus
PWMEDKTH

SEQ ID NO: 3162 - protein, 8 aa, Dengue virus
WMEDKTHI

SEQ ID NO: 3163 - protein, 8 aa, Dengue virus
MEDKTHIS

SEQ ID NO: 3164 - protein, 8 aa, Dengue virus
EDKTHISS

SEQ ID NO: 3165 - protein, 8 aa, Dengue virus
DKTHISSW

SEQ ID NO: 3166 - protein, 8 aa, Dengue virus
KTHISSWG

SEQ ID NO: 3167 - protein, 8 aa, Dengue virus
ISSWGDVP

SEQ ID NO: 3168 - protein, 8 aa, Dengue virus
SSWGDVPY

SEQ ID NO: 3169 - protein, 8 aa, Dengue virus
SWGDVPYL

SEQ ID NO: 3170 - protein, 8 aa, Dengue virus
WGDVPYLG

SEQ ID NO: 3171 - protein, 8 aa, Dengue virus
GDVPYLGK

SEQ ID NO: 3172 - protein, 8 aa, Dengue virus
DVPYLGKR

SEQ ID NO: 3173 - protein, 8 aa, Dengue virus
VPYLGKRE

SEQ ID NO: 3174 - protein, 8 aa, Dengue virus
PYLGKRED

SEQ ID NO: 3175 - protein, 8 aa, Dengue virus
YLGKREDQ

SEQ ID NO: 3176 - protein, 8 aa, Dengue virus
LGKREDQW

SEQ ID NO: 3177 - protein, 8 aa, Dengue virus
GKREDQWC

SEQ ID NO: 3178 - protein, 8 aa, Dengue virus
KREDQWCG

SEQ ID NO: 3179 - protein, 8 aa, Dengue virus
REDQWCGS

SEQ ID NO: 3180 - protein, 8 aa, Dengue virus
EDQWCGSL

SEQ ID NO: 3181 - protein, 8 aa, Dengue virus
DQWCGSLI

SEQ ID NO: 3182 - protein, 8 aa, Dengue virus
QWCGSLIG

SEQ ID NO: 3183 - protein, 8 aa, Dengue virus
WCGSLIGL

SEQ ID NO: 3184 - protein, 8 aa, Dengue virus
CGSLIGLT

SEQ ID NO: 3185 - protein, 8 aa, Dengue virus
GSLIGLTA

SEQ ID NO: 3186 - protein, 8 aa, Dengue virus
SLIGLTAR

SEQ ID NO: 3187 - protein, 8 aa, Dengue virus
LIGLTARA

SEQ ID NO: 3188 - protein, 8 aa, Dengue virus
IGLTARAT

SEQ ID NO: 3189 - protein, 8 aa, Dengue virus
GLTARATW

SEQ ID NO: 3190 - protein, 8 aa, Dengue virus
LTARATWA

SEQ ID NO: 3191 - protein, 8 aa, Dengue virus
TARATWAT

SEQ ID NO: 3192 - protein, 8 aa, Dengue virus
ARATWATN

SEQ ID NO: 3193 - protein, 8 aa, Dengue virus
RATWATNI

SEQ ID NO: 3194 - protein, 8 aa, Dengue virus
ATWATNIQ

SEQ ID NO: 3195 - protein, 8 aa, Dengue virus
TWATNIQV

SEQ ID NO: 3196 - protein, 8 aa, Dengue virus
WATNIQVA

SEQ ID NO: 3197 - protein, 8 aa, Dengue virus
ATNIQVAI

SEQ ID NO: 3198 - protein, 8 aa, Dengue virus
TNIQVAIN

SEQ ID NO: 3199 - protein, 8 aa, Dengue virus
NIQVAINQ

SEQ ID NO: 3200 - protein, 8 aa, Dengue virus
IQVAINQV

SEQ ID NO: 3201 - protein, 8 aa, Dengue virus
QVAINQVR

SEQ ID NO: 3202 - protein, 8 aa, Dengue virus
VAINQVRR

SEQ ID NO: 3203 - protein, 8 aa, Dengue virus
AINQVRRL

SEQ ID NO: 3204 - protein, 8 aa, Dengue virus
INQVRRLI

SEQ ID NO: 3205 - protein, 8 aa, Dengue virus
NQVRRLIG

SEQ ID NO: 3206 - protein, 8 aa, Dengue virus
QVRRLIGN

SEQ ID NO: 3207 - protein, 8 aa, Dengue virus
VRRLIGNE

SEQ ID NO: 3208 - protein, 8 aa, Dengue virus
RRLIGNEN

SEQ ID NO: 3209 - protein, 8 aa, Dengue virus
RLIGNENY

SEQ ID NO: 3210 - protein, 8 aa, Dengue virus
LIGNENYL

SEQ ID NO: 3211 - protein, 8 aa, Dengue virus
IGNENYLD

SEQ ID NO: 3212 - protein, 8 aa, Dengue virus
GNENYLDY

SEQ ID NO: 3213 - protein, 8 aa, Dengue virus
NENYLDYM

SEQ ID NO: 3214 - protein, 8 aa, Dengue virus
ENYLDYMT

SEQ ID NO: 3215 - protein, 8 aa, Dengue virus
NYLDYMTS

SEQ ID NO: 3216 - protein, 8 aa, Dengue virus
YLDYMTSM

SEQ ID NO: 3217 - protein, 8 aa, Dengue virus
LDYMTSMK

SEQ ID NO: 3218 - protein, 8 aa, Dengue virus
DYMTSMKR

SEQ ID NO: 3219 - protein, 8 aa, Dengue virus
YMTSMKRF

SEQ ID NO: 3220 - protein, 8 aa, Dengue virus
MTSMKRFK

SEQ ID NO: 3221 - protein, 8 aa, Dengue virus
TSMKRFKN

SEQ ID NO: 3222 - protein, 8 aa, Dengue virus
SMKRFKNE

SEQ ID NO: 3223 - protein, 8 aa, Dengue virus
MKRFKNES

SEQ ID NO: 3224 - protein, 8 aa, Dengue virus
MINQRKKT

SEQ ID NO: 3225 - protein, 8 aa, Dengue virus
NNQRKKTG

SEQ ID NO: 3226 - protein, 8 aa, Dengue virus
NQRKKTGR

SEQ ID NO: 3227 - protein, 8 aa, Dengue virus
QRKKTGRP

SEQ ID NO: 3228 - protein, 8 aa, Dengue virus
RKKTGRPS

SEQ ID NO: 3229 - protein, 8 aa, Dengue virus
KKTGRPSF

SEQ ID NO: 3230 - protein, 8 aa, Dengue virus
KTGRPSFN

SEQ ID NO: 3231 - protein, 8 aa, Dengue virus
TGRPSFNM

SEQ ID NO: 3232 - protein, 8 aa, Dengue virus
GRPSFNML

SEQ ID NO: 3233 - protein, 8 aa, Dengue virus
QPSFNMLK

SEQ ID NO: 3234 - protein, 8 aa, Dengue virus
ARNRVSTG

SEQ ID NO: 3235 - protein, 8 aa, Dengue virus
RNRVSTGS

SEQ ID NO: 3236 - protein, 8 aa, Dengue virus
NRVSTGSQ

SEQ ID NO: 3237 - protein, 8 aa, Dengue virus
RVSTGSQL

SEQ ID NO: 3238 - protein, 8 aa, Dengue virus
VSTGSQLA

SEQ ID NO: 3239 - protein, 8 aa, Dengue virus
STGSQLAK

SEQ ID NO: 3240 - protein, 8 aa, Dengue virus
TGSQLAKR

SEQ ID NO: 3241 - protein, 8 aa, Dengue virus
GSQLAKRF

SEQ ID NO: 3242 - protein, 8 aa, Dengue virus
SGQGPMKM

SEQ ID NO: 3243 - protein, 8 aa, Dengue virus
GQGPMKMV

SEQ ID NO: 3244 - protein, 8 aa, Dengue virus
QGPMKMVM

SEQ ID NO: 3245 - protein, 8 aa, Dengue virus
GPMKMVMA

SEQ ID NO: 3246 - protein, 8 aa, Dengue virus
PMKMVMAF

SEQ ID NO: 3247 - protein, 8 aa, Dengue virus
MKMVMAFI

SEQ ID NO: 3248 - protein, 8 aa, Dengue virus
KMVMAFIA

SEQ ID NO: 3249 - protein, 8 aa, Dengue virus
MVMAFIAF

SEQ ID NO: 3250 - protein, 8 aa, Dengue virus
AGILARWS

SEQ ID NO: 3251 - protein, 8 aa, Dengue virus
GILARWSS

SEQ ID NO: 3252 - protein, 8 aa, Dengue virus
ILARWSSF

SEQ ID NO: 3253 - protein, 8 aa, Dengue virus
LARWSSFK

SEQ ID NO: 3254 - protein, 8 aa, Dengue virus
ARWSSFKK

SEQ ID NO: 3255 - protein, 8 aa, Dengue virus
RWGSFKKS

SEQ ID NO: 3256 - protein, 8 aa, Dengue virus
WGSFKKSG

SEQ ID NO: 3257 - protein, 8 aa, Dengue virus
GSFKKSGA

SEQ ID NO: 3258 - protein, 8 aa, Dengue virus
SFKKSGAI

SEQ ID NO: 3259 - protein, 8 aa, Dengue virus
FKKSGAIK

SEQ ID NO: 3260 - protein, 8 aa, Dengue virus
KKSGAIKV

SEQ ID NO: 3261 - protein, 8 aa, Dengue virus
KSGAIKVL

SEQ ID NO: 3262 - protein, 8 aa, Dengue virus
SGAIKVLR

SEQ ID NO: 3263 - protein, 8 aa, Dengue virus
GAIRVLRG

SEQ ID NO: 3264 - protein, 8 aa, Dengue virus
KVLRGFKR

SEQ ID NO: 3265 - protein, 8 aa, Dengue virus
VLRGFKRE

SEQ ID NO: 3266 - protein, 8 aa, Dengue virus
LRGFKKEV

SEQ ID NO: 3267 - protein, 8 aa, Dengue virus
RGFKKEVS

SEQ ID NO: 3268 - protein, 8 aa, Dengue virus
GFKKEISS

SEQ ID NO: 3269 - protein, 8 aa, Dengue virus
FKKEISSM

SEQ ID NO: 3270 - protein, 8 aa, Dengue virus
KKEISSML

SEQ ID NO: 3271 - protein, 8 aa, Dengue virus
KEISSMLN

SEQ ID NO: 3272 - protein, 8 aa, Dengue virus
EISSMLNI

SEQ ID NO: 3273 - protein, 8 aa, Dengue virus
MLNTMNRR

SEQ ID NO: 3274 - protein, 8 aa, Dengue virus
LNTMNRRK

SEQ ID NO: 3275 - protein, 8 aa, Dengue virus
MNRRKKSV

SEQ ID NO: 3276 - protein, 8 aa, Dengue virus
NRRKKSVT

SEQ ID NO: 3277 - protein, 8 aa, Dengue virus
RRKKSVTM

SEQ ID NO: 3278 - protein, 8 aa, Dengue virus
RKKSVTML

SEQ ID NO: 3279 - protein, 8 aa, Dengue virus
KKSVTMLL

SEQ ID NO: 3280 - protein, 8 aa, Dengue virus
KSVTMLLM

SEQ ID NO: 3281 - protein, 8 aa, Dengue virus
SVTMFLML

SEQ ID NO: 3282 - protein, 8 aa, Dengue virus
PTVLTFHL

SEQ ID NO: 3283 - protein, 8 aa, Dengue virus
TVLTFHLT

SEQ ID NO: 3284 - protein, 8 aa, Dengue virus
VLTFHLTT

SEQ ID NO: 3285 - protein, 8 aa, Dengue virus
LTFHLTTR

SEQ ID NO: 3286 - protein, 8 aa, Dengue virus
TFHLTTRG

SEQ ID NO: 3287 - protein, 8 aa, Dengue virus
RGGEPHMV

SEQ ID NO: 3288 - protein, 8 aa, Dengue virus
GGEPHMVV

SEQ ID NO: 3289 - protein, 8 aa, Dengue virus
GEPHMIVT

SEQ ID NO: 3290 - protein, 8 aa, Dengue virus
EPHMIVTK

SEQ ID NO: 3291 - protein, 8 aa, Dengue virus
PHMIVTKQ

SEQ ID NO: 3292 - protein, 8 aa, Dengue virus
HMIVTKQE

SEQ ID NO: 3293 - protein, 8 aa, Dengue virus
MIVTKQER

SEQ ID NO: 3294 - protein, 8 aa, Dengue virus
IVTKQERG

SEQ ID NO: 3295 - protein, 8 aa, Dengue virus
VTKQERGK

SEQ ID NO: 3296 - protein, 8 aa, Dengue virus
TKQERGKS

SEQ ID NO: 3297 - protein, 8 aa, Dengue virus
SLLFKTSV

SEQ ID NO: 3298 - protein, 8 aa, Dengue virus
LLFKTSVG

SEQ ID NO: 3299 - protein, 8 aa, Dengue virus
LFKTSVGV

SEQ ID NO: 3300 - protein, 8 aa, Dengue virus
FKTSVGVN

SEQ ID NO: 3301 - protein, 8 aa, Dengue virus
KTSVGVNM

SEQ ID NO: 3302 - protein, 8 aa, Dengue virus
TSVGVNMC

SEQ ID NO: 3303 - protein, 8 aa, Dengue virus
SVGVNMCT

SEQ ID NO: 3304 - protein, 8 aa, Dengue virus
VGVNMCTL

SEQ ID NO: 3305 - protein, 8 aa, Dengue virus
GINMCTLI

SEQ ID NO: 3306 - protein, 8 aa, Dengue virus
INMCTLIA

SEQ ID NO: 3307 - protein, 8 aa, Dengue virus
IAMDLGEF

SEQ ID NO: 3308 - protein, 8 aa, Dengue virus
AMDLGEFC

SEQ ID NO: 3309 - protein, 8 aa, Dengue virus
MDLGEFCE

SEQ ID NO: 3310 - protein, 8 aa, Dengue virus
DLGEFCED

SEQ ID NO: 3311 - protein, 8 aa, Dengue virus
LGEFCEDT

SEQ ID NO: 3312 - protein, 8 aa, Dengue virus
GEFCEDTM

SEQ ID NO: 3313 - protein, 8 aa, Dengue virus
EFCEDTMT

SEQ ID NO: 3314 - protein, 8 aa, Dengue virus
FCEDTMTY

SEQ ID NO: 3315 - protein, 8 aa, Dengue virus
CDDTMTYK

SEQ ID NO: 3316 - protein, 8 aa, Dengue virus
DDTMTYKC

SEQ ID NO: 3317 - protein, 8 aa, Dengue virus
DTITYKCP

SEQ ID NO: 3318 - protein, 8 aa, Dengue virus
TMTYKCPQ

SEQ ID NO: 3319 - protein, 8 aa, Dengue virus
MTYKCPQI

SEQ ID NO: 3320 - protein, 8 aa, Dengue virus
TYKCPQIT

SEQ ID NO: 3321 - protein, 8 aa, Dengue virus
YKCPQITE

SEQ ID NO: 3322 - protein, 8 aa, Dengue virus
KCPRITET

SEQ ID NO: 3323 - protein, 8 aa, Dengue virus
CPRITETE

SEQ ID NO: 3324 - protein, 8 aa, Dengue virus
PRITETEP

SEQ ID NO: 3325 - protein, 8 aa, Dengue virus
RITETEPD

SEQ ID NO: 3326 - protein, 8 aa, Dengue virus
ITETEPDD

SEQ ID NO: 3327 - protein, 8 aa, Dengue virus
TETEPDDV

SEQ ID NO: 3328 - protein, 8 aa, Dengue virus
ETEPDDVD

SEQ ID NO: 3329 - protein, 8 aa, Dengue virus
TEPDDVDC

SEQ ID NO: 3330 - protein, 8 aa, Dengue virus
DVDCWCNT

SEQ ID NO: 3331 - protein, 8 aa, Dengue virus
VDCWCNTT

SEQ ID NO: 3332 - protein, 8 aa, Dengue virus
DCWCNATE

SEQ ID NO: 3333 - protein, 8 aa, Dengue virus
CWCNATET

SEQ ID NO: 3334 - protein, 8 aa, Dengue virus
WCNATETW

SEQ ID NO: 3335 - protein, 8 aa, Dengue virus
CNATETWV

SEQ ID NO: 3336 - protein, 8 aa, Dengue virus
NATETWVT

SEQ ID NO: 3337 - protein, 8 aa, Dengue virus
ATETWVTY

SEQ ID NO: 3338 - protein, 8 aa, Dengue virus
TETWVTYG

SEQ ID NO: 3339 - protein, 8 aa, Dengue virus
ETWVTYGT

SEQ ID NO: 3340 - protein, 8 aa, Dengue virus
GTCTQIGE

SEQ ID NO: 3341 - protein, 8 aa, Dengue virus
TCTQIGEH

SEQ ID NO: 3342 - protein, 8 aa, Dengue virus
CTQIGEHR

SEQ ID NO: 3343 - protein, 8 aa, Dengue virus
TQIGEHRR

SEQ ID NO: 3344 - protein, 8 aa, Dengue virus
QTGEHRRE

SEQ ID NO: 3345 - protein, 8 aa, Dengue virus
TGEHRREK

SEQ ID NO: 3346 - protein, 8 aa, Dengue virus
GEHRREKR

SEQ ID NO: 3347 - protein, 8 aa, Dengue virus
EHRREKRS

SEQ ID NO: 3348 - protein, 8 aa, Dengue virus
HRREKRSV

SEQ ID NO: 3349 - protein, 8 aa, Dengue virus
RREKRSVA

SEQ ID NO: 3350 - protein, 8 aa, Dengue virus
REKRSVAL

SEQ ID NO: 3351 - protein, 8 aa, Dengue virus
EKRSVALA

SEQ ID NO: 3352 - protein, 8 aa, Dengue virus
GLGLETRA

SEQ ID NO: 3353 - protein, 8 aa, Dengue virus
LGLETRAE

SEQ ID NO: 3354 - protein, 8 aa, Dengue virus
GLETRAET

SEQ ID NO: 3355 - protein, 8 aa, Dengue virus
LETRAETW

SEQ ID NO: 3356 - protein, 8 aa, Dengue virus
ETRAETWM

SEQ ID NO: 3357 - protein, 8 aa, Dengue virus
TRAETWMS

SEQ ID NO: 3358 - protein, 8 aa, Dengue virus
RAETWMSS

SEQ ID NO: 3359 - protein, 8 aa, Dengue virus
AETWMSSE

SEQ ID NO: 3360 - protein, 8 aa, Dengue virus
MSSEGAWR

SEQ ID NO: 3361 - protein, 8 aa, Dengue virus
SSEGAWRQ

SEQ ID NO: 3362 - protein, 8 aa, Dengue virus
SEGAWRQI

SEQ ID NO: 3363 - protein, 8 aa, Dengue virus
EGAWRQIQ

SEQ ID NO: 3364 - protein, 8 aa, Dengue virus
GAWKQIQK

SEQ ID NO: 3365 - protein, 8 aa, Dengue virus
AWKQIQKV

SEQ ID NO: 3366 - protein, 8 aa, Dengue virus
WKQIQKVE

SEQ ID NO: 3367 - protein, 8 aa, Dengue virus
KQIQKVET

SEQ ID NO: 3368 - protein, 8 aa, Dengue virus
QIQKVETW

SEQ ID NO: 3369 - protein, 8 aa, Dengue virus
IQKVETWA

SEQ ID NO: 3370 - protein, 8 aa, Dengue virus
QKVETWAL

SEQ ID NO: 3371 - protein, 8 aa, Dengue virus
KVETWALR

SEQ ID NO: 3372 - protein, 8 aa, Dengue virus
RHPGFTVT

SEQ ID NO: 3373 - protein, 8 aa, Dengue virus
HPGFTVTA

SEQ ID NO: 3374 - protein, 8 aa, Dengue virus
PGFTVIAF

SEQ ID NO: 3375 - protein, 8 aa, Dengue virus
GFTVIAFF

SEQ ID NO: 3376 - protein, 8 aa, Dengue virus
FTVIAFFL

SEQ ID NO: 3377 - protein, 8 aa, Dengue virus
TVIAFFLA

SEQ ID NO: 3378 - protein, 8 aa, Dengue virus
VIAFFLAH

SEQ ID NO: 3379 - protein, 8 aa, Dengue virus
AFFLAHAI

SEQ ID NO: 3380 - protein, 8 aa, Dengue virus
FFLAHAIG

SEQ ID NO: 3381 - protein, 8 aa, Dengue virus
FLAHVIGT

SEQ ID NO: 3382 - protein, 8 aa, Dengue virus
LAHVIGTS

SEQ ID NO: 3383 - protein, 8 aa, Dengue virus
AHVIGTSI

SEQ ID NO: 3384 - protein, 8 aa, Dengue virus
HVIGTSIT

SEQ ID NO: 3385 - protein, 8 aa, Dengue virus
VIGTSITQ

SEQ ID NO: 3386 - protein, 8 aa, Dengue virus
IFILLMLA

SEQ ID NO: 3387 - protein, 8 aa, Dengue virus
FILLMLAT

SEQ ID NO: 3388 - protein, 8 aa, Dengue virus
ILLMLATP

SEQ ID NO: 3389 - protein, 8 aa, Dengue virus
LLMLATPS

SEQ ID NO: 3390 - protein, 8 aa, Dengue virus
LMLATPSM

SEQ ID NO: 3391 - protein, 8 aa, Dengue virus
MLATPSMA

SEQ ID NO: 3392 - protein, 8 aa, Dengue virus
MRCVGIGN

SEQ ID NO: 3393 - protein, 8 aa, Dengue virus
RCVGIGNR

SEQ ID NO: 3394 - protein, 8 aa, Dengue virus
CVGIGNRD

SEQ ID NO: 3395 - protein, 8 aa, Dengue virus
VGIGNRDF

SEQ ID NO: 3396 - protein, 8 aa, Dengue virus
GIGNRDFV

SEQ ID NO: 3397 - protein, 8 aa, Dengue virus
IGNRDFVE

SEQ ID NO: 3398 - protein, 8 aa, Dengue virus
GNRDFVEG

SEQ ID NO: 3399 - protein, 8 aa, Dengue virus
NRDFVEGL

SEQ ID NO: 3400 - protein, 8 aa, Dengue virus
CVTTMAKN

SEQ ID NO: 3401 - protein, 8 aa, Dengue virus
VTTMAKNK

SEQ ID NO: 3402 - protein, 8 aa, Dengue virus
TTMAKNKP

SEQ ID NO: 3403 - protein, 8 aa, Dengue virus
TMAKNKPT

SEQ ID NO: 3404 - protein, 8 aa, Dengue virus
MAKNKPTL

SEQ ID NO: 3405 - protein, 8 aa, Dengue virus
AKNKPTLD

SEQ ID NO: 3406 - protein, 8 aa, Dengue virus
KNKPTLDI

SEQ ID NO: 3407 - protein, 8 aa, Dengue virus
NKPTLDIE

SEQ ID NO: 3408 - protein, 8 aa, Dengue virus
LLKTEVTD

SEQ ID NO: 3409 - protein, 8 aa, Dengue virus
LKTEVTDP

SEQ ID NO: 3410 - protein, 8 aa, Dengue virus
KTEVTDPA

SEQ ID NO: 3411 - protein, 8 aa, Dengue virus
TEVTNPAI

SEQ ID NO: 3412 - protein, 8 aa, Dengue virus
EVTNPAIL

SEQ ID NO: 3413 - protein, 8 aa, Dengue virus
VTNPAILR

SEQ ID NO: 3414 - protein, 8 aa, Dengue virus
TNPAILRK

SEQ ID NO: 3415 - protein, 8 aa, Dengue virus
NPAILRKL

SEQ ID NO: 3416 - protein, 8 aa, Dengue virus
PAILRKLC

SEQ ID NO: 3417 - protein, 8 aa, Dengue virus
AILRKLCI

SEQ ID NO: 3418 - protein, 8 aa, Dengue virus
ILRKLCIE

SEQ ID NO: 3419 - protein, 8 aa, Dengue virus
TQGEATLM

SEQ ID NO: 3420 - protein, 8 aa, Dengue virus
QGEATLME

SEQ ID NO: 3421 - protein, 8 aa, Dengue virus
GEATLMEE

SEQ ID NO: 3422 - protein, 8 aa, Dengue virus
EATLMEEQ

SEQ ID NO: 3423 - protein, 8 aa, Dengue virus
ATLMEEQD

SEQ ID NO: 3424 - protein, 8 aa, Dengue virus
TLMEEQDA

SEQ ID NO: 3425 - protein, 8 aa, Dengue virus
LMEEQDAN

SEQ ID NO: 3426 - protein, 8 aa, Dengue virus
MEEQDANF

SEQ ID NO: 3427 - protein, 8 aa, Dengue virus
EEQDTNFV

SEQ ID NO: 3428 - protein, 8 aa, Dengue virus
EQDTNFVC

SEQ ID NO: 3429 - protein, 8 aa, Dengue virus
QDTNFVCR

SEQ ID NO: 3430 - protein, 8 aa, Dengue virus
DTNFVCRR

SEQ ID NO: 3431 - protein, 8 aa, Dengue virus
TNFVCRRT

SEQ ID NO: 3432 - protein, 8 aa, Dengue virus
NFVCRRTL

SEQ ID NO: 3433 - protein, 8 aa, Dengue virus
FVCRRTLV

SEQ ID NO: 3434 - protein, 8 aa, Dengue virus
VCRRTLVD

SEQ ID NO: 3435 - protein, 8 aa, Dengue virus
CRRTLVDR

SEQ ID NO: 3436 - protein, 8 aa, Dengue virus
RRTLVDRG

SEQ ID NO: 3437 - protein, 8 aa, Dengue virus
RTLVDRGW

SEQ ID NO: 3438 - protein, 8 aa, Dengue virus
TLVDRGWG

SEQ ID NO: 3439 - protein, 8 aa, Dengue virus
LVDRGWGN

SEQ ID NO: 3440 - protein, 8 aa, Dengue virus
LFGKGSLL

SEQ ID NO: 3441 - protein, 8 aa, Dengue virus
FGKGSLLT

SEQ ID NO: 3442 - protein, 8 aa, Dengue virus
GKGSLLTC

SEQ ID NO: 3443 - protein, 8 aa, Dengue virus
KGSLLTCA

SEQ ID NO: 3444 - protein, 8 aa, Dengue virus
GSLLTCAK

SEQ ID NO: 3445 - protein, 8 aa, Dengue virus
SLLTCAKF

SEQ ID NO: 3446 - protein, 8 aa, Dengue virus
LLTCAKFK

SEQ ID NO: 3447 - protein, 8 aa, Dengue virus
LTCAKFKC

SEQ ID NO: 3448 - protein, 8 aa, Dengue virus
VTKLEGKT

SEQ ID NO: 3449 - protein, 8 aa, Dengue virus
TKLEGKTV

SEQ ID NO: 3450 - protein, 8 aa, Dengue virus
KLEGKTVQ

SEQ ID NO: 3451 - protein, 8 aa, Dengue virus
LEGKTVQY

SEQ ID NO: 3452 - protein, 8 aa, Dengue virus
EGKTVQYE

SEQ ID NO: 3453 - protein, 8 aa, Dengue virus
GKTVQYEN

SEQ ID NO: 3454 - protein, 8 aa, Dengue virus
KTVQYENL

SEQ ID NO: 3455 - protein, 8 aa, Dengue virus
TVQYENLK

SEQ ID NO: 3456 - protein, 8 aa, Dengue virus
VQHENLKY

SEQ ID NO: 3457 - protein, 8 aa, Dengue virus
QHENLKYS

SEQ ID NO: 3458 - protein, 8 aa, Dengue virus
HENLKYSV

SEQ ID NO: 3459 - protein, 8 aa, Dengue virus
QHQVGNET

SEQ ID NO: 3460 - protein, 8 aa, Dengue virus
HQVGNETT

SEQ ID NO: 3461 - protein, 8 aa, Dengue virus
QVGNETTE

SEQ ID NO: 3462 - protein, 8 aa, Dengue virus
VGNETTEH

SEQ ID NO: 3463 - protein, 8 aa, Dengue virus
GNETTEHG

SEQ ID NO: 3464 - protein, 8 aa, Dengue virus
NETTEHGT

SEQ ID NO: 3465 - protein, 8 aa, Dengue virus
ETTEHGTI

SEQ ID NO: 3466 - protein, 8 aa, Dengue virus
TTEHGTIA

SEQ ID NO: 3467 - protein, 8 aa, Dengue virus
TEHGTIAT

SEQ ID NO: 3468 - protein, 8 aa, Dengue virus
EHGTIATI

SEQ ID NO: 3469 - protein, 8 aa, Dengue virus
HGTIATIT

SEQ ID NO: 3470 - protein, 8 aa, Dengue virus
GTIATITP

SEQ ID NO: 3471 - protein, 8 aa, Dengue virus
TIATITPQ

SEQ ID NO: 3472 - protein, 8 aa, Dengue virus
IATITPQA

SEQ ID NO: 3473 - protein, 8 aa, Dengue virus
TITPQAPS

SEQ ID NO: 3474 - protein, 8 aa, Dengue virus
ITPQAPTS

SEQ ID NO: 3475 - protein, 8 aa, Dengue virus
TPQAPTSE

SEQ ID NO: 3476 - protein, 8 aa, Dengue virus
PQAPTSEI

SEQ ID NO: 3477 - protein, 8 aa, Dengue virus
QAPTSEIQ

SEQ ID NO: 3478 - protein, 8 aa, Dengue virus
APTSEIQL

SEQ ID NO: 3479 - protein, 8 aa, Dengue virus
PTSEIQLT

SEQ ID NO: 3480 - protein, 8 aa, Dengue virus
TSEIQLTD

SEQ ID NO: 3481 - protein, 8 aa, Dengue virus
SEIQLTDY

SEQ ID NO: 3482 - protein, 8 aa, Dengue virus
IQLTDYGT

SEQ ID NO: 3483 - protein, 8 aa, Dengue virus
QLTDYGTL

SEQ ID NO: 3484 - protein, 8 aa, Dengue virus
LTDYGTLT

SEQ ID NO: 3485 - protein, 8 aa, Dengue virus
TDYGTLTL

SEQ ID NO: 3486 - protein, 8 aa, Dengue virus
DYGTLTLD

SEQ ID NO: 3487 - protein, 8 aa, Dengue virus
YGTLTLDC

SEQ ID NO: 3488 - protein, 8 aa, Dengue virus
GTLTLDCS

SEQ ID NO: 3489 - protein, 8 aa, Dengue virus
TLTLDCSP

SEQ ID NO: 3490 - protein, 8 aa, Dengue virus
MVLLTMKK

SEQ ID NO: 3491 - protein, 8 aa, Dengue virus
VLLTMKKK

SEQ ID NO: 3492 - protein, 8 aa, Dengue virus
LLTMKKKS

SEQ ID NO: 3493 - protein, 8 aa, Dengue virus
LTMKKKSW

SEQ ID NO: 3494 - protein, 8 aa, Dengue virus
TMKKKSWL

SEQ ID NO: 3495 - protein, 8 aa, Dengue virus
MKKKSWLV

SEQ ID NO: 3496 - protein, 8 aa, Dengue virus
KKKSWLVH

SEQ ID NO: 3497 - protein, 8 aa, Dengue virus
KKSWLVHK

SEQ ID NO: 3498 - protein, 8 aa, Dengue virus
KAWLVHKQ

SEQ ID NO: 3499 - protein, 8 aa, Dengue virus
LPWTSGAT

SEQ ID NO: 3500 - protein, 8 aa, Dengue virus
PWTSGATT

SEQ ID NO: 3501 - protein, 8 aa, Dengue virus
TTSQETWN

SEQ ID NO: 3502 - protein, 8 aa, Dengue virus
TTQETWNR

SEQ ID NO: 3503 - protein, 8 aa, Dengue virus
SQETWNRK

SEQ ID NO: 3504 - protein, 8 aa, Dengue virus
QETWNRKD

SEQ ID NO: 3505 - protein, 8 aa, Dengue virus
ETWNRKDL

SEQ ID NO: 3506 - protein, 8 aa, Dengue virus
TWNRKDLL

SEQ ID NO: 3507 - protein, 8 aa, Dengue virus
WNRKDLLV

SEQ ID NO: 3508 - protein, 8 aa, Dengue virus
NRKDLLVT

SEQ ID NO: 3509 - protein, 8 aa, Dengue virus
RKDLLVTF

SEQ ID NO: 3510 - protein, 8 aa, Dengue virus
KDLLVTFK

SEQ ID NO: 3511 - protein, 8 aa, Dengue virus
TEIQTTGT

SEQ ID NO: 3512 - protein, 8 aa, Dengue virus
EIQTTGTT

SEQ ID NO: 3513 - protein, 8 aa, Dengue virus
IQTTGTTT

SEQ ID NO: 3514 - protein, 8 aa, Dengue virus
QTTGTTTI

SEQ ID NO: 3515 - protein, 8 aa, Dengue virus
TTGTTTIF

SEQ ID NO: 3516 - protein, 8 aa, Dengue virus
TGTTTIFA

SEQ ID NO: 3517 - protein, 8 aa, Dengue virus
KMDKLTLR

SEQ ID NO: 3518 - protein, 8 aa, Dengue virus
MDKLTLRG

SEQ ID NO: 3519 - protein, 8 aa, Dengue virus
DKLTLKGT

SEQ ID NO: 3520 - protein, 8 aa, Dengue virus
KLTLKGTS

SEQ ID NO: 3521 - protein, 8 aa, Dengue virus
LTLKGTSY

SEQ ID NO: 3522 - protein, 8 aa, Dengue virus
TLKGTSYV

SEQ ID NO: 3523 - protein, 8 aa, Dengue virus
LKGTSYVM

SEQ ID NO: 3524 - protein, 8 aa, Dengue virus
KGTSYVMC

SEQ ID NO: 3525 - protein, 8 aa, Dengue virus
GTSYVMCT

SEQ ID NO: 3526 - protein, 8 aa, Dengue virus
TSYVMCTG

SEQ ID NO: 3527 - protein, 8 aa, Dengue virus
SYVMCTGL

SEQ ID NO: 3528 - protein, 8 aa, Dengue virus
YVMCTGPF

SEQ ID NO: 3529 - protein, 8 aa, Dengue virus
VMCTGLFK

SEQ ID NO: 3530 - protein, 8 aa, Dengue virus
MCTGPFKL

SEQ ID NO: 3531 - protein, 8 aa, Dengue virus
CTGLFKLE

SEQ ID NO: 3532 - protein, 8 aa, Dengue virus
TGPFKLEK

SEQ ID NO: 3533 - protein, 8 aa, Dengue virus
GPFKLEKE

SEQ ID NO: 3534 - protein, 8 aa, Dengue virus
SFKLEKEL

SEQ ID NO: 3535 - protein, 8 aa, Dengue virus
FKLEKELA

SEQ ID NO: 3536 - protein, 8 aa, Dengue virus
KLEKELAE

SEQ ID NO: 3537 - protein, 8 aa, Dengue virus
LEKELAET

SEQ ID NO: 3538 - protein, 8 aa, Dengue virus
EKELAETQ

SEQ ID NO: 3539 - protein, 8 aa, Dengue virus
KELAETQH

SEQ ID NO: 3540 - protein, 8 aa, Dengue virus
ELAETQHG

SEQ ID NO: 3541 - protein, 8 aa, Dengue virus
LAETQHGT

SEQ ID NO: 3542 - protein, 8 aa, Dengue virus
HGTVLVQV

SEQ ID NO: 3543 - protein, 8 aa, Dengue virus
GTVLVQVK

SEQ ID NO: 3544 - protein, 8 aa, Dengue virus
TVLVQVKY

SEQ ID NO: 3545 - protein, 8 aa, Dengue virus
VLVQVKYE

SEQ ID NO: 3546 - protein, 8 aa, Dengue virus
LVQVKYEG

SEQ ID NO: 3547 - protein, 8 aa, Dengue virus
VQVKYEGT

SEQ ID NO: 3548 - protein, 8 aa, Dengue virus
QVKYEGTD

SEQ ID NO: 3549 - protein, 8 aa, Dengue virus
VKYEGTDA

SEQ ID NO: 3550 - protein, 8 aa, Dengue virus
RYEGTDAP

SEQ ID NO: 3551 - protein, 8 aa, Dengue virus
APCKIPFL

SEQ ID NO: 3552 - protein, 8 aa, Dengue virus
PCKIPFLT

SEQ ID NO: 3553 - protein, 8 aa, Dengue virus
CKIPFLTQ

SEQ ID NO: 3554 - protein, 8 aa, Dengue virus
KIPFLTQD

SEQ ID NO: 3555 - protein, 8 aa, Dengue virus
IPFLTQDE

SEQ ID NO: 3556 - protein, 8 aa, Dengue virus
QDEKGVIQ

SEQ ID NO: 3557 - protein, 8 aa, Dengue virus
DEKGVIQN

SEQ ID NO: 3558 - protein, 8 aa, Dengue virus
EKGVIQNG

SEQ ID NO: 3559 - protein, 8 aa, Dengue virus
KGVIQNGR

SEQ ID NO: 3560 - protein, 8 aa, Dengue virus
GVIQNGRL

SEQ ID NO: 3561 - protein, 8 aa, Dengue virus
VIQNGRLI

SEQ ID NO: 3562 - protein, 8 aa, Dengue virus
IQNGRLIT

SEQ ID NO: 3563 - protein, 8 aa, Dengue virus
QNGRLVTA

SEQ ID NO: 3564 - protein, 8 aa, Dengue virus
NGRLVTAN

SEQ ID NO: 3565 - protein, 8 aa, Dengue virus
GRLVTANP

SEQ ID NO: 3566 - protein, 8 aa, Dengue virus
RLVTANPI

SEQ ID NO: 3567 - protein, 8 aa, Dengue virus
LVTANPIV

SEQ ID NO: 3568 - protein, 8 aa, Dengue virus
VTANPIVT

SEQ ID NO: 3569 - protein, 8 aa, Dengue virus
ANPIVTDR

SEQ ID NO: 3570 - protein, 8 aa, Dengue virus
NPIVTDKD

SEQ ID NO: 3571 - protein, 8 aa, Dengue virus
PIVTDKDK

SEQ ID NO: 3572 - protein, 8 aa, Dengue virus
IVTDKDKP

SEQ ID NO: 3573 - protein, 8 aa, Dengue virus
VTDKDKPV

SEQ ID NO: 3574 - protein, 8 aa, Dengue virus
TDKDKPVN

SEQ ID NO: 3575 - protein, 8 aa, Dengue virus
DKDKPVNI

SEQ ID NO: 3576 - protein, 8 aa, Dengue virus
KDKPVNIE

SEQ ID NO: 3577 - protein, 8 aa, Dengue virus
EKPVNIET

SEQ ID NO: 3578 - protein, 8 aa, Dengue virus
KPVNIETE

SEQ ID NO: 3579 - protein, 8 aa, Dengue virus
PVNIETEP

SEQ ID NO: 3580 - protein, 8 aa, Dengue virus
VNIETEPP

SEQ ID NO: 3581 - protein, 8 aa, Dengue virus
NIETEPPF

SEQ ID NO: 3582 - protein, 8 aa, Dengue virus
IETEPPFG

SEQ ID NO: 3583 - protein, 8 aa, Dengue virus
ETEPPFGE

SEQ ID NO: 3584 - protein, 8 aa, Dengue virus
TEPPFGES

SEQ ID NO: 3585 - protein, 8 aa, Dengue virus
PFGESYII

SEQ ID NO: 3586 - protein, 8 aa, Dengue virus
FGESYIVV

SEQ ID NO: 3587 - protein, 8 aa, Dengue virus
GESYIVVG

SEQ ID NO: 3588 - protein, 8 aa, Dengue virus
VGAGEKAL

SEQ ID NO: 3589 - protein, 8 aa, Dengue virus
GVGEKALK

SEQ ID NO: 3590 - protein, 8 aa, Dengue virus
VGEKALKL

SEQ ID NO: 3591 - protein, 8 aa, Dengue virus
GEKTLKLS

SEQ ID NO: 3592 - protein, 8 aa, Dengue virus
EKTLKLSW

SEQ ID NO: 3593 - protein, 8 aa, Dengue virus
KTLKLSWF

SEQ ID NO: 3594 - protein, 8 aa, Dengue virus
TLKLSWFK

SEQ ID NO: 3595 - protein, 8 aa, Dengue virus
LKLSWFKR

SEQ ID NO: 3596 - protein, 8 aa, Dengue virus
KLSWFKRG

SEQ ID NO: 3597 - protein, 8 aa, Dengue virus
LSWFKRGS

SEQ ID NO: 3598 - protein, 8 aa, Dengue virus
SWFKRGSS

SEQ ID NO: 3599 - protein, 8 aa, Dengue virus
WFKRGSSI

SEQ ID NO: 3600 - protein, 8 aa, Dengue virus
FKRGSSIG

SEQ ID NO: 3601 - protein, 8 aa, Dengue virus
KRGSSIGK

SEQ ID NO: 3602 - protein, 8 aa, Dengue virus
RGSSIGKM

SEQ ID NO: 3603 - protein, 8 aa, Dengue virus
GSTIGKMF

SEQ ID NO: 3604 - protein, 8 aa, Dengue virus
STIGKMFE

SEQ ID NO: 3605 - protein, 8 aa, Dengue virus
TIGKMFEA

SEQ ID NO: 3606 - protein, 8 aa, Dengue virus
IGKMFVAT

SEQ ID NO: 3607 - protein, 8 aa, Dengue virus
GKMFVATA

SEQ ID NO: 3608 - protein, 8 aa, Dengue virus
KMFVATAR

SEQ ID NO: 3609 - protein, 8 aa, Dengue virus
TAWDFGSV

SEQ ID NO: 3610 - protein, 8 aa, Dengue virus
AWDFGSVG

SEQ ID NO: 3611 - protein, 8 aa, Dengue virus
WDFGSVGG

SEQ ID NO: 3612 - protein, 8 aa, Dengue virus
DFGSVGGV

SEQ ID NO: 3613 - protein, 8 aa, Dengue virus
FGSVGGVF

SEQ ID NO: 3614 - protein, 8 aa, Dengue virus
GSVGGVFT

SEQ ID NO: 3615 - protein, 8 aa, Dengue virus
SVGGVFTS

SEQ ID NO: 3616 - protein, 8 aa, Dengue virus
GGVFTSIG

SEQ ID NO: 3617 - protein, 8 aa, Dengue virus
GVFTSIGK

SEQ ID NO: 3618 - protein, 8 aa, Dengue virus
VFTSIGKL

SEQ ID NO: 3619 - protein, 8 aa, Dengue virus
FTSVGKLI

SEQ ID NO: 3620 - protein, 8 aa, Dengue virus
TSVGKLIH

SEQ ID NO: 3621 - protein, 8 aa, Dengue virus
SVGKLIHQ

SEQ ID NO: 3622 - protein, 8 aa, Dengue virus
GKLVHQVF

SEQ ID NO: 3623 - protein, 8 aa, Dengue virus
KLVHQVFG

SEQ ID NO: 3624 - protein, 8 aa, Dengue virus
LVHQVFGT

SEQ ID NO: 3625 - protein, 8 aa, Dengue virus
VHQVFGTA

SEQ ID NO: 3626 - protein, 8 aa, Dengue virus
HQVFGTAY

SEQ ID NO: 3627 - protein, 8 aa, Dengue virus
QVFGTAYG

SEQ ID NO: 3628 - protein, 8 aa, Dengue virus
VFGTAYGV

SEQ ID NO: 3629 - protein, 8 aa, Dengue virus
FGAAYGVL

SEQ ID NO: 3630 - protein, 8 aa, Dengue virus
GAAYGVLF

SEQ ID NO: 3631 - protein, 8 aa, Dengue virus
AAYGVLFS

SEQ ID NO: 3632 - protein, 8 aa, Dengue virus
SWTMKIGL

SEQ ID NO: 3633 - protein, 8 aa, Dengue virus
WTMKIGLG

SEQ ID NO: 3634 - protein, 8 aa, Dengue virus
TMKIGIGI

SEQ ID NO: 3635 - protein, 8 aa, Dengue virus
MKIGIGIL

SEQ ID NO: 3636 - protein, 8 aa, Dengue virus
KIGIGILL

SEQ ID NO: 3637 - protein, 8 aa, Dengue virus
IGIGILLT

SEQ ID NO: 3638 - protein, 8 aa, Dengue virus
GIGILLTW

SEQ ID NO: 3639 - protein, 8 aa, Dengue virus
IGILLTWL

SEQ ID NO: 3640 - protein, 8 aa, Dengue virus
GILLTWLG

SEQ ID NO: 3641 - protein, 8 aa, Dengue virus
ILLTWLGL

SEQ ID NO: 3642 - protein, 8 aa, Dengue virus
WLGLNSRN

SEQ ID NO: 3643 - protein, 8 aa, Dengue virus
LGLNSRNT

SEQ ID NO: 3644 - protein, 8 aa, Dengue virus
GLNSRSAS

SEQ ID NO: 3645 - protein, 8 aa, Dengue virus
LNSRSTSF

SEQ ID NO: 3646 - protein, 8 aa, Dengue virus
NSRSTSFS

SEQ ID NO: 3647 - protein, 8 aa, Dengue virus
SRSTSFSM

SEQ ID NO: 3648 - protein, 8 aa, Dengue virus
RSTSFSMT

SEQ ID NO: 3649 - protein, 8 aa, Dengue virus
STSFSMTC

SEQ ID NO: 3650 - protein, 8 aa, Dengue virus
TSFSMTCI

SEQ ID NO: 3651 - protein, 8 aa, Dengue virus
SFSMTCIA

SEQ ID NO: 3652 - protein, 8 aa, Dengue virus
FSMTCIAV

SEQ ID NO: 3653 - protein, 8 aa, Dengue virus
SMTCIVVG

SEQ ID NO: 3654 - protein, 8 aa, Dengue virus
MTCIAVGM

SEQ ID NO: 3655 - protein, 8 aa, Dengue virus
TCIAVGMV

SEQ ID NO: 3656 - protein, 8 aa, Dengue virus
CIAVGMVT

SEQ ID NO: 3657 - protein, 8 aa, Dengue virus
IAVGMVTL

SEQ ID NO: 3658 - protein, 8 aa, Dengue virus
AVGMVTLY

SEQ ID NO: 3659 - protein, 8 aa, Dengue virus
VGMVTLYL

SEQ ID NO: 3660 - protein, 8 aa, Dengue virus
GMVTLYLG

SEQ ID NO: 3661 - protein, 8 aa, Dengue virus
MVTLYLGV

SEQ ID NO: 3662 - protein, 8 aa, Dengue virus
ITLYLGVM

SEQ ID NO: 3663 - protein, 8 aa, Dengue virus
LYLGAMVQ

SEQ ID NO: 3664 - protein, 8 aa, Dengue virus
YLGAMVQA

SEQ ID NO: 3665 - protein, 8 aa, Dengue virus
LGAMVQAD

SEQ ID NO: 3666 - protein, 8 aa, Dengue virus
GAMVQADS

SEQ ID NO: 3667 - protein, 8 aa, Dengue virus
AMVQADSG

SEQ ID NO: 3668 - protein, 8 aa, Dengue virus
QADSGCVV

SEQ ID NO: 3669 - protein, 8 aa, Dengue virus
ADSGCVVN

SEQ ID NO: 3670 - protein, 8 aa, Dengue virus
DSGCVVNW

SEQ ID NO: 3671 - protein, 8 aa, Dengue virus
SGCVVNWK

SEQ ID NO: 3672 - protein, 8 aa, Dengue virus
GCVVNWKG

SEQ ID NO: 3673 - protein, 8 aa, Dengue virus
CVVNWKGR

SEQ ID NO: 3674 - protein, 8 aa, Dengue virus
VVNWKGRE

SEQ ID NO: 3675 - protein, 8 aa, Dengue virus
RLSAAIGR

SEQ ID NO: 3676 - protein, 8 aa, Dengue virus
LSAAIGRA

SEQ ID NO: 3677 - protein, 8 aa, Dengue virus
SAAIGRAW

SEQ ID NO: 3678 - protein, 8 aa, Dengue virus
AAIGRAWE

SEQ ID NO: 3679 - protein, 8 aa, Dengue virus
AIGRAWEE

SEQ ID NO: 3680 - protein, 8 aa, Dengue virus
IGRAWEEG

SEQ ID NO: 3681 - protein, 8 aa, Dengue virus
GRAWEEGV

SEQ ID NO: 3682 - protein, 8 aa, Dengue virus
RAWEEGVC

SEQ ID NO: 3683 - protein, 8 aa, Dengue virus
GVCGIRST

SEQ ID NO: 3684 - protein, 8 aa, Dengue virus
VCGIRSTT

SEQ ID NO: 3685 - protein, 8 aa, Dengue virus
CGIRSTTR

SEQ ID NO: 3686 - protein, 8 aa, Dengue virus
GIRSTTRL

SEQ ID NO: 3687 - protein, 8 aa, Dengue virus
IRSTTRLE

SEQ ID NO: 3688 - protein, 8 aa, Dengue virus
RSTTRLEN

SEQ ID NO: 3689 - protein, 8 aa, Dengue virus
STTRLENI

SEQ ID NO: 3690 - protein, 8 aa, Dengue virus
TTRLENIM

SEQ ID NO: 3691 - protein, 8 aa, Dengue virus
RLENIMWR

SEQ ID NO: 3692 - protein, 8 aa, Dengue virus
LENIMWRQ

SEQ ID NO: 3693 - protein, 8 aa, Dengue virus
ENIMWRQI

SEQ ID NO: 3694 - protein, 8 aa, Dengue virus
NIMWRQIS

SEQ ID NO: 3695 - protein, 8 aa, Dengue virus
IMWRQISN

SEQ ID NO: 3696 - protein, 8 aa, Dengue virus
MWRQISNE

SEQ ID NO: 3697 - protein, 8 aa, Dengue virus
WRQISNEL

SEQ ID NO: 3698 - protein, 8 aa, Dengue virus
RQISNELN

SEQ ID NO: 3699 - protein, 8 aa, Dengue virus
QISNELNY

SEQ ID NO: 3700 - protein, 8 aa, Dengue virus
ISNELNYI

SEQ ID NO: 3701 - protein, 8 aa, Dengue virus
SNELNYIL

SEQ ID NO: 3702 - protein, 8 aa, Dengue virus
NELNYILL

SEQ ID NO: 3703 - protein, 8 aa, Dengue virus
ELNYILLE

SEQ ID NO: 3704 - protein, 8 aa, Dengue virus
LNYILLEN

SEQ ID NO: 3705 - protein, 8 aa, Dengue virus
NHILLENG

SEQ ID NO: 3706 - protein, 8 aa, Dengue virus
HILLENGM

SEQ ID NO: 3707 - protein, 8 aa, Dengue virus
ILLENGMK

SEQ ID NO: 3708 - protein, 8 aa, Dengue virus
LLENDMKL

SEQ ID NO: 3709 - protein, 8 aa, Dengue virus
LENDMKLT

SEQ ID NO: 3710 - protein, 8 aa, Dengue virus
ENDMKLTV

SEQ ID NO: 3711 - protein, 8 aa, Dengue virus
NDMKLTVV

SEQ ID NO: 3712 - protein, 8 aa, Dengue virus
DMKLTVVV

SEQ ID NO: 3713 - protein, 8 aa, Dengue virus
MKLTVVVG

SEQ ID NO: 3714 - protein, 8 aa, Dengue virus
KLTVVVGD

SEQ ID NO: 3715 - protein, 8 aa, Dengue virus
FTVVVGDA

SEQ ID NO: 3716 - protein, 8 aa, Dengue virus
GILGQGKK

SEQ ID NO: 3717 - protein, 8 aa, Dengue virus
QGKKTIRP

SEQ ID NO: 3718 - protein, 8 aa, Dengue virus
GKKTIRPQ

SEQ ID NO: 3719 - protein, 8 aa, Dengue virus
KKTIRPQP

SEQ ID NO: 3720 - protein, 8 aa, Dengue virus
KTIRPQPM

SEQ ID NO: 3721 - protein, 8 aa, Dengue virus
TIRPQPME

SEQ ID NO: 3722 - protein, 8 aa, Dengue virus
IRPQPMEH

SEQ ID NO: 3723 - protein, 8 aa, Dengue virus
RPQPMEHK

SEQ ID NO: 3724 - protein, 8 aa, Dengue virus
PQPMEHKY

SEQ ID NO: 3725 - protein, 8 aa, Dengue virus
QPMEHKYS

SEQ ID NO: 3726 - protein, 8 aa, Dengue virus
PMEHKYSW

SEQ ID NO: 3727 - protein, 8 aa, Dengue virus
MEHKYSWK

SEQ ID NO: 3728 - protein, 8 aa, Dengue virus
EHKYSWKS

SEQ ID NO: 3729 - protein, 8 aa, Dengue virus
HKYSWKSW

SEQ ID NO: 3730 - protein, 8 aa, Dengue virus
RYSWKSWG

SEQ ID NO: 3731 - protein, 8 aa, Dengue virus
YSWKIWGK

SEQ ID NO: 3732 - protein, 8 aa, Dengue virus
SWRSWGKA

SEQ ID NO: 3733 - protein, 8 aa, Dengue virus
WRSWGKAK

SEQ ID NO: 3734 - protein, 8 aa, Dengue virus
KIWGKAKI

SEQ ID NO: 3735 - protein, 8 aa, Dengue virus
IWGKAKII

SEQ ID NO: 3736 - protein, 8 aa, Dengue virus
AKIIGADI

SEQ ID NO: 3737 - protein, 8 aa, Dengue virus
KIIGADIQ

SEQ ID NO: 3738 - protein, 8 aa, Dengue virus
IIGADIQN

SEQ ID NO: 3739 - protein, 8 aa, Dengue virus
QNSTFIID

SEQ ID NO: 3740 - protein, 8 aa, Dengue virus
NSTFIIDG

SEQ ID NO: 3741 - protein, 8 aa, Dengue virus
STFIIDGP

SEQ ID NO: 3742 - protein, 8 aa, Dengue virus
TFIIDGPD

SEQ ID NO: 3743 - protein, 8 aa, Dengue virus
FIIDGPDT

SEQ ID NO: 3744 - protein, 8 aa, Dengue virus
IIDGPDTP

SEQ ID NO: 3745 - protein, 8 aa, Dengue virus
IDGPDTPE

SEQ ID NO: 3746 - protein, 8 aa, Dengue virus
DGPDTPEC

SEQ ID NO: 3747 - protein, 8 aa, Dengue virus
GPDTPECP

SEQ ID NO: 3748 - protein, 8 aa, Dengue virus
PDTPECPD

SEQ ID NO: 3749 - protein, 8 aa, Dengue virus
ECPDNQRA

SEQ ID NO: 3750 - protein, 8 aa, Dengue virus
CPDNQRAW

SEQ ID NO: 3751 - protein, 8 aa, Dengue virus
PDNQRAWN

SEQ ID NO: 3752 - protein, 8 aa, Dengue virus
DNQRAWNI

SEQ ID NO: 3753 - protein, 8 aa, Dengue virus
NQRAWNIW

SEQ ID NO: 3754 - protein, 8 aa, Dengue virus
VEDYGFGV

SEQ ID NO: 3755 - protein, 8 aa, Dengue virus
EDYGFGVF

SEQ ID NO: 3756 - protein, 8 aa, Dengue virus
DYGFGVFT

SEQ ID NO: 3757 - protein, 8 aa, Dengue virus
YGFGVFTT

SEQ ID NO: 3758 - protein, 8 aa, Dengue virus
GFGVFTTN

SEQ ID NO: 3759 - protein, 8 aa, Dengue virus
FGVFTTNI

SEQ ID NO: 3760 - protein, 8 aa, Dengue virus
GVFTTNIW

SEQ ID NO: 3761 - protein, 8 aa, Dengue virus
VFTTNIWL

SEQ ID NO: 3762 - protein, 8 aa, Dengue virus
TTNIWLKM

SEQ ID NO: 3763 - protein, 8 aa, Dengue virus
TNIWLKMR

SEQ ID NO: 3764 - protein, 8 aa, Dengue virus
NIWLKMRD

SEQ ID NO: 3765 - protein, 8 aa, Dengue virus
IWLKMRDS

SEQ ID NO: 3766 - protein, 8 aa, Dengue virus
WLKLRDSH

SEQ ID NO: 3767 - protein, 8 aa, Dengue virus
LKLRDSHT

SEQ ID NO: 3768 - protein, 8 aa, Dengue virus
KLRDSHTQ

SEQ ID NO: 3769 - protein, 8 aa, Dengue virus
RDSYTQMC

SEQ ID NO: 3770 - protein, 8 aa, Dengue virus
DSYTQMCD

SEQ ID NO: 3771 - protein, 8 aa, Dengue virus
SYTQMCDH

SEQ ID NO: 3772 - protein, 8 aa, Dengue virus
YTQMCDHR

SEQ ID NO: 3773 - protein, 8 aa, Dengue virus
TQMCDHRL

SEQ ID NO: 3774 - protein, 8 aa, Dengue virus
QMCDHRLM

SEQ ID NO: 3775 - protein, 8 aa, Dengue virus
MCDHRLMS

SEQ ID NO: 3776 - protein, 8 aa, Dengue virus
GYWIESER

SEQ ID NO: 3777 - protein, 8 aa, Dengue virus
YWIESERN

SEQ ID NO: 3778 - protein, 8 aa, Dengue virus
WIESERNE

SEQ ID NO: 3779 - protein, 8 aa, Dengue virus
IESERNET

SEQ ID NO: 3780 - protein, 8 aa, Dengue virus
ESERNETW

SEQ ID NO: 3781 - protein, 8 aa, Dengue virus
SERNETWK

SEQ ID NO: 3782 - protein, 8 aa, Dengue virus
ERNETWKL

SEQ ID NO: 3783 - protein, 8 aa, Dengue virus
RNETWKLA

SEQ ID NO: 3784 - protein, 8 aa, Dengue virus
NETWKLAK

SEQ ID NO: 3785 - protein, 8 aa, Dengue virus
ETWKLAKA

SEQ ID NO: 3786 - protein, 8 aa, Dengue virus
TWKLAKAS

SEQ ID NO: 3787 - protein, 8 aa, Dengue virus
WKLAKASF

SEQ ID NO: 3788 - protein, 8 aa, Dengue virus
KLAKASFI

SEQ ID NO: 3789 - protein, 8 aa, Dengue virus
LAKASFIE

SEQ ID NO: 3790 - protein, 8 aa, Dengue virus
AKASFIEV

SEQ ID NO: 3791 - protein, 8 aa, Dengue virus
KASFIEVK

SEQ ID NO: 3792 - protein, 8 aa, Dengue virus
FIEVKTCT

SEQ ID NO: 3793 - protein, 8 aa, Dengue virus
IEVKTCTW

SEQ ID NO: 3794 - protein, 8 aa, Dengue virus
EVKTCTWP

SEQ ID NO: 3795 - protein, 8 aa, Dengue virus
VKTCTWPK

SEQ ID NO: 3796 - protein, 8 aa, Dengue virus
KTCTWPKS

SEQ ID NO: 3797 - protein, 8 aa, Dengue virus
TCTWPKSH

SEQ ID NO: 3798 - protein, 8 aa, Dengue virus
CTWPKSHT

SEQ ID NO: 3799 - protein, 8 aa, Dengue virus
TWPKSHTL

SEQ ID NO: 3800 - protein, 8 aa, Dengue virus
GVLESEMV

SEQ ID NO: 3801 - protein, 8 aa, Dengue virus
VLESEMVI

SEQ ID NO: 3802 - protein, 8 aa, Dengue virus
LESEMVIP

SEQ ID NO: 3803 - protein, 8 aa, Dengue virus
ESEMVIPK

SEQ ID NO: 3804 - protein, 8 aa, Dengue virus
SEMVIPKI

SEQ ID NO: 3805 - protein, 8 aa, Dengue virus
EMIIPKIH

SEQ ID NO: 3806 - protein, 8 aa, Dengue virus
MIIPKIHG

SEQ ID NO: 3807 - protein, 8 aa, Dengue virus
IIPKIHGG

SEQ ID NO: 3808 - protein, 8 aa, Dengue virus
IPKIHGGP

SEQ ID NO: 3809 - protein, 8 aa, Dengue virus
PKIHGGPI

SEQ ID NO: 3810 - protein, 8 aa, Dengue virus
KIHGGPIS

SEQ ID NO: 3811 - protein, 8 aa, Dengue virus
IHGGPISQ

SEQ ID NO: 3812 - protein, 8 aa, Dengue virus
HGGPISQH

SEQ ID NO: 3813 - protein, 8 aa, Dengue virus
GGPTSQHN

SEQ ID NO: 3814 - protein, 8 aa, Dengue virus
GPTSQHNY

SEQ ID NO: 3815 - protein, 8 aa, Dengue virus
PTSQHNYR

SEQ ID NO: 3816 - protein, 8 aa, Dengue virus
TSQHNYRP

SEQ ID NO: 3817 - protein, 8 aa, Dengue virus
HNHRPGYF

SEQ ID NO: 3818 - protein, 8 aa, Dengue virus
NHRPGYFT

SEQ ID NO: 3819 - protein, 8 aa, Dengue virus
HRPGYFTQ

SEQ ID NO: 3820 - protein, 8 aa, Dengue virus
RPGYFTQA

SEQ ID NO: 3821 - protein, 8 aa, Dengue virus
PGYFTQAA

SEQ ID NO: 3822 - protein, 8 aa, Dengue virus
GYFTQAAG

SEQ ID NO: 3823 - protein, 8 aa, Dengue virus
YFTQAAGP

SEQ ID NO: 3824 - protein, 8 aa, Dengue virus
FTQAAGPW

SEQ ID NO: 3825 - protein, 8 aa, Dengue virus
TQAAGPWH

SEQ ID NO: 3826 - protein, 8 aa, Dengue virus
QAAGPWHL

SEQ ID NO: 3827 - protein, 8 aa, Dengue virus
AAGPWHLG

SEQ ID NO: 3828 - protein, 8 aa, Dengue virus
GKLELDFN

SEQ ID NO: 3829 - protein, 8 aa, Dengue virus
KLELDFNL

SEQ ID NO: 3830 - protein, 8 aa, Dengue virus
LELDFNLC

SEQ ID NO: 3831 - protein, 8 aa, Dengue virus
ELDFNLCE

SEQ ID NO: 3832 - protein, 8 aa, Dengue virus
LDFNLCEG

SEQ ID NO: 3833 - protein, 8 aa, Dengue virus
DFNLCEGT

SEQ ID NO: 3834 - protein, 8 aa, Dengue virus
FNLCEGTT

SEQ ID NO: 3835 - protein, 8 aa, Dengue virus
NLCEGTTV

SEQ ID NO: 3836 - protein, 8 aa, Dengue virus
FCEGTTVV

SEQ ID NO: 3837 - protein, 8 aa, Dengue virus
VVDEHCGY

SEQ ID NO: 3838 - protein, 8 aa, Dengue virus
VDEHCGYR

SEQ ID NO: 3839 - protein, 8 aa, Dengue virus
DEHCGYRG

SEQ ID NO: 3840 - protein, 8 aa, Dengue virus
EHCGYRGP

SEQ ID NO: 3841 - protein, 8 aa, Dengue virus
HCGSRGPS

SEQ ID NO: 3842 - protein, 8 aa, Dengue virus
CGYRGPSL

SEQ ID NO: 3843 - protein, 8 aa, Dengue virus
GYRGPSLR

SEQ ID NO: 3844 - protein, 8 aa, Dengue virus
YRGPSLRT

SEQ ID NO: 3845 - protein, 8 aa, Dengue virus
TTTVTGKT

SEQ ID NO: 3846 - protein, 8 aa, Dengue virus
TTVTGKTI

SEQ ID NO: 3847 - protein, 8 aa, Dengue virus
TVTGKTIH

SEQ ID NO: 3848 - protein, 8 aa, Dengue virus
VTGKTIHE

SEQ ID NO: 3849 - protein, 8 aa, Dengue virus
TGKTIHEW

SEQ ID NO: 3850 - protein, 8 aa, Dengue virus
GKTIHEWC

SEQ ID NO: 3851 - protein, 8 aa, Dengue virus
KTIHEWCC

SEQ ID NO: 3852 - protein, 8 aa, Dengue virus
TIHEWCCR

SEQ ID NO: 3853 - protein, 8 aa, Dengue virus
TLPPLRFK

SEQ ID NO: 3854 - protein, 8 aa, Dengue virus
LPPLRFKG

SEQ ID NO: 3855 - protein, 8 aa, Dengue virus
PPLRFKGE

SEQ ID NO: 3856 - protein, 8 aa, Dengue virus
PLRFKGED

SEQ ID NO: 3857 - protein, 8 aa, Dengue virus
LRFKGEDG

SEQ ID NO: 3858 - protein, 8 aa, Dengue virus
RFKGEDGC

SEQ ID NO: 3859 - protein, 8 aa, Dengue virus
FKGEDGCW

SEQ ID NO: 3860 - protein, 8 aa, Dengue virus
KGEDGCWY

SEQ ID NO: 3861 - protein, 8 aa, Dengue virus
MEIRPVKD

SEQ ID NO: 3862 - protein, 8 aa, Dengue virus
EIRPVKDK

SEQ ID NO: 3863 - protein, 8 aa, Dengue virus
IRPVKDKE

SEQ ID NO: 3864 - protein, 8 aa, Dengue virus
RPVKDKEE

SEQ ID NO: 3865 - protein, 8 aa, Dengue virus
PVKDKEEN

SEQ ID NO: 3866 - protein, 8 aa, Dengue virus
VKDKEENL

SEQ ID NO: 3867 - protein, 8 aa, Dengue virus
KDKEENLV

SEQ ID NO: 3868 - protein, 8 aa, Dengue virus
EKEENLVR

SEQ ID NO: 3869 - protein, 8 aa, Dengue virus
KEENLVRS

SEQ ID NO: 3870 - protein, 8 aa, Dengue virus
EENLVRSM

SEQ ID NO: 3871 - protein, 8 aa, Dengue virus
ENLVRSMV

SEQ ID NO: 3872 - protein, 8 aa, Dengue virus
NLVRSMVS

SEQ ID NO: 3873 - protein, 8 aa, Dengue virus
LVRSMVSA

SEQ ID NO: 3874 - protein, 8 aa, Dengue virus
VRSMVSAG

SEQ ID NO: 3875 - protein, 8 aa, Dengue virus
RSMVSAGS

SEQ ID NO: 3876 - protein, 8 aa, Dengue virus
SMVSAGLG

SEQ ID NO: 3877 - protein, 8 aa, Dengue virus
MVSAGLGE

SEQ ID NO: 3878 - protein, 8 aa, Dengue virus
VSAGLGEV

SEQ ID NO: 3879 - protein, 8 aa, Dengue virus
SAGLGEVD

SEQ ID NO: 3880 - protein, 8 aa, Dengue virus
AGLGEVDS

SEQ ID NO: 3881 - protein, 8 aa, Dengue virus
GLGEVDSF

SEQ ID NO: 3882 - protein, 8 aa, Dengue virus
LGEVDSFS

SEQ ID NO: 3883 - protein, 8 aa, Dengue virus
VDSFSLGI

SEQ ID NO: 3884 - protein, 8 aa, Dengue virus
DSFSLGIL

SEQ ID NO: 3885 - protein, 8 aa, Dengue virus
SFSLGILC

SEQ ID NO: 3886 - protein, 8 aa, Dengue virus
FSLGILCV

SEQ ID NO: 3887 - protein, 8 aa, Dengue virus
SLGILCVS

SEQ ID NO: 3888 - protein, 8 aa, Dengue virus
LGILCVSI

SEQ ID NO: 3889 - protein, 8 aa, Dengue virus
SILIEEVM

SEQ ID NO: 3890 - protein, 8 aa, Dengue virus
ILIEEVMR

SEQ ID NO: 3891 - protein, 8 aa, Dengue virus
LIEEVMRS

SEQ ID NO: 3892 - protein, 8 aa, Dengue virus
TEEVMRSR

SEQ ID NO: 3893 - protein, 8 aa, Dengue virus
VMRSRWSK

SEQ ID NO: 3894 - protein, 8 aa, Dengue virus
MRSRWSRR

SEQ ID NO: 3895 - protein, 8 aa, Dengue virus
RSRWSRRM

SEQ ID NO: 3896 - protein, 8 aa, Dengue virus
SRWSRRML

SEQ ID NO: 3897 - protein, 8 aa, Dengue virus
RWSRRMLM

SEQ ID NO: 3898 - protein, 8 aa, Dengue virus
WSRRMLMT

SEQ ID NO: 3899 - protein, 8 aa, Dengue virus
SRRMLMTG

SEQ ID NO: 3900 - protein, 8 aa, Dengue virus
RRMLMTGT

SEQ ID NO: 3901 - protein, 8 aa, Dengue virus
RMLMTGTL

SEQ ID NO: 3902 - protein, 8 aa, Dengue virus
MLMTGTLV

SEQ ID NO: 3903 - protein, 8 aa, Dengue virus
LMTGTLVV

SEQ ID NO: 3904 - protein, 8 aa, Dengue virus
MTGTLVVF

SEQ ID NO: 3905 - protein, 8 aa, Dengue virus
GTLAVFLL

SEQ ID NO: 3906 - protein, 8 aa, Dengue virus
TLAVFLLL

SEQ ID NO: 3907 - protein, 8 aa, Dengue virus
GQLTWSDL

SEQ ID NO: 3908 - protein, 8 aa, Dengue virus
QLTWSDLI

SEQ ID NO: 3909 - protein, 8 aa, Dengue virus
LTWSDLIR

SEQ ID NO: 3910 - protein, 8 aa, Dengue virus
TWNDLIRS

SEQ ID NO: 3911 - protein, 8 aa, Dengue virus
WNDLIRSC

SEQ ID NO: 3912 - protein, 8 aa, Dengue virus
NDLIRSCI

SEQ ID NO: 3913 - protein, 8 aa, Dengue virus
DLIRSCIM

SEQ ID NO: 3914 - protein, 8 aa, Dengue virus
LIRSCIMV

SEQ ID NO: 3915 - protein, 8 aa, Dengue virus
IRSCIMVG

SEQ ID NO: 3916 - protein, 8 aa, Dengue virus
RSCIMVGA

SEQ ID NO: 3917 - protein, 8 aa, Dengue virus
SCIMVGAN

SEQ ID NO: 3918 - protein, 8 aa, Dengue virus
CIMVGANV

SEQ ID NO: 3919 - protein, 8 aa, Dengue virus
IMVGANAF

SEQ ID NO: 3920 - protein, 8 aa, Dengue virus
MVGANAFD

SEQ ID NO: 3921 - protein, 8 aa, Dengue virus
VGANASDK

SEQ ID NO: 3922 - protein, 8 aa, Dengue virus
GANASDKM

SEQ ID NO: 3923 - protein, 8 aa, Dengue virus
ANASDKMG

SEQ ID NO: 3924 - protein, 8 aa, Dengue virus
NASDKMGM

SEQ ID NO: 3925 - protein, 8 aa, Dengue virus
ASDKMGMG

SEQ ID NO: 3926 - protein, 8 aa, Dengue virus
SDKMGMGT

SEQ ID NO: 3927 - protein, 8 aa, Dengue virus
DKMGMGTT

SEQ ID NO: 3928 - protein, 8 aa, Dengue virus
KMGMGTTY

SEQ ID NO: 3929 - protein, 8 aa, Dengue virus
MGMGMTYL

SEQ ID NO: 3930 - protein, 8 aa, Dengue virus
GMGMTYLA

SEQ ID NO: 3931 - protein, 8 aa, Dengue virus
MGMTYLAL

SEQ ID NO: 3932 - protein, 8 aa, Dengue virus
GMTYLALM

SEQ ID NO: 3933 - protein, 8 aa, Dengue virus
MTYLALMA

SEQ ID NO: 3934 - protein, 8 aa, Dengue virus
LALMATFR

SEQ ID NO: 3935 - protein, 8 aa, Dengue virus
ALMATFRM

SEQ ID NO: 3936 - protein, 8 aa, Dengue virus
LMATFRMR

SEQ ID NO: 3937 - protein, 8 aa, Dengue virus
MATFRMRP

SEQ ID NO: 3938 - protein, 8 aa, Dengue virus
ATFRMRPM

SEQ ID NO: 3939 - protein, 8 aa, Dengue virus
TFRMRPMF

SEQ ID NO: 3940 - protein, 8 aa, Dengue virus
FRMRPMFA

SEQ ID NO: 3941 - protein, 8 aa, Dengue virus
RMRPMFAV

SEQ ID NO: 3942 - protein, 8 aa, Dengue virus
MRPMLAVG

SEQ ID NO: 3943 - protein, 8 aa, Dengue virus
RPMLAVGL

SEQ ID NO: 3944 - protein, 8 aa, Dengue virus
PMLAVGLL

SEQ ID NO: 3945 - protein, 8 aa, Dengue virus
MLAVGLLF

SEQ ID NO: 3946 - protein, 8 aa, Dengue virus
LAVGLLFR

SEQ ID NO: 3947 - protein, 8 aa, Dengue virus
AVGLLIRR

SEQ ID NO: 3948 - protein, 8 aa, Dengue virus
VGLLIRRL

SEQ ID NO: 3949 - protein, 8 aa, Dengue virus
GLLIRRLT

SEQ ID NO: 3950 - protein, 8 aa, Dengue virus
LLIRRLTS

SEQ ID NO: 3951 - protein, 8 aa, Dengue virus
LIRRLTSR

SEQ ID NO: 3952 - protein, 8 aa, Dengue virus
IRRLTSRE

SEQ ID NO: 3953 - protein, 8 aa, Dengue virus
REVLLLTV

SEQ ID NO: 3954 - protein, 8 aa, Dengue virus
EVLLLTVG

SEQ ID NO: 3955 - protein, 8 aa, Dengue virus
VLLLTVGL

SEQ ID NO: 3956 - protein, 8 aa, Dengue virus
LLLTVGLS

SEQ ID NO: 3957 - protein, 8 aa, Dengue virus
LLTVGLSL

SEQ ID NO: 3958 - protein, 8 aa, Dengue virus
LTVGLSLV

SEQ ID NO: 3959 - protein, 8 aa, Dengue virus
TVGLSLVA

SEQ ID NO: 3960 - protein, 8 aa, Dengue virus
VGLSLVAS

SEQ ID NO: 3961 - protein, 8 aa, Dengue virus
GLSLVAFV

SEQ ID NO: 3962 - protein, 8 aa, Dengue virus
LSLVAFVE

SEQ ID NO: 3963 - protein, 8 aa, Dengue virus
SLVAFVEL

SEQ ID NO: 3964 - protein, 8 aa, Dengue virus
LVAFVELP

SEQ ID NO: 3965 - protein, 8 aa, Dengue virus
ASVELPSS

SEQ ID NO: 3966 - protein, 8 aa, Dengue virus
SVELPSSL

SEQ ID NO: 3967 - protein, 8 aa, Dengue virus
VELPSSLE

SEQ ID NO: 3968 - protein, 8 aa, Dengue virus
ELPSSLEE

SEQ ID NO: 3969 - protein, 8 aa, Dengue virus
LPSSLEEL

SEQ ID NO: 3970 - protein, 8 aa, Dengue virus
PSSLEELG

SEQ ID NO: 3971 - protein, 8 aa, Dengue virus
SSLEELGD

SEQ ID NO: 3972 - protein, 8 aa, Dengue virus
ELGDGLAI

SEQ ID NO: 3973 - protein, 8 aa, Dengue virus
LGDGLAIG

SEQ ID NO: 3974 - protein, 8 aa, Dengue virus
GDGLAIGI

SEQ ID NO: 3975 - protein, 8 aa, Dengue virus
DGLAIGIM

SEQ ID NO: 3976 - protein, 8 aa, Dengue virus
GLAMGIMM

SEQ ID NO: 3977 - protein, 8 aa, Dengue virus
LAMGIMML

SEQ ID NO: 3978 - protein, 8 aa, Dengue virus
AMGIMMLK

SEQ ID NO: 3979 - protein, 8 aa, Dengue virus
MGIMMLKL

SEQ ID NO: 3980 - protein, 8 aa, Dengue virus
GIMMLKLL

SEQ ID NO: 3981 - protein, 8 aa, Dengue virus
IMMLKLLT

SEQ ID NO: 3982 - protein, 8 aa, Dengue virus
MMLKLLTE

SEQ ID NO: 3983 - protein, 8 aa, Dengue virus
MLKLLTEF

SEQ ID NO: 3984 - protein, 8 aa, Dengue virus
LKLLTEFQ

SEQ ID NO: 3985 - protein, 8 aa, Dengue virus
KLLTEFQP

SEQ ID NO: 3986 - protein, 8 aa, Dengue virus
LLTEFQPH

SEQ ID NO: 3987 - protein, 8 aa, Dengue virus
LTEFQPHQ

SEQ ID NO: 3988 - protein, 8 aa, Dengue virus
TEFQPHQL

SEQ ID NO: 3989 - protein, 8 aa, Dengue virus
EFQPHQLW

SEQ ID NO: 3990 - protein, 8 aa, Dengue virus
QLWTTLLS

SEQ ID NO: 3991 - protein, 8 aa, Dengue virus
TLLSLTFV

SEQ ID NO: 3992 - protein, 8 aa, Dengue virus
LLSLTFVK

SEQ ID NO: 3993 - protein, 8 aa, Dengue virus
LSLTFVKT

SEQ ID NO: 3994 - protein, 8 aa, Dengue virus
SLDYAWKT

SEQ ID NO: 3995 - protein, 8 aa, Dengue virus
DYAWKTTA

SEQ ID NO: 3996 - protein, 8 aa, Dengue virus
YAWKTTAM

SEQ ID NO: 3997 - protein, 8 aa, Dengue virus
AMALSIVS

SEQ ID NO: 3998 - protein, 8 aa, Dengue virus
MALSIVSL

SEQ ID NO: 3999 - protein, 8 aa, Dengue virus
LSIVSLLP

SEQ ID NO: 4000 - protein, 8 aa, Dengue virus
SIVSLLPL

SEQ ID NO: 4001 - protein, 8 aa, Dengue virus
IVSLLPLC

SEQ ID NO: 4002 - protein, 8 aa, Dengue virus
VSLLPLCL

SEQ ID NO: 4003 - protein, 8 aa, Dengue virus
SLLPLCLS

SEQ ID NO: 4004 - protein, 8 aa, Dengue virus
LLPLCLST

SEQ ID NO: 4005 - protein, 8 aa, Dengue virus
LPLCLSTT

SEQ ID NO: 4006 - protein, 8 aa, Dengue virus
PLCMSTTS

SEQ ID NO: 4007 - protein, 8 aa, Dengue virus
LCMSTTSQ

SEQ ID NO: 4008 - protein, 8 aa, Dengue virus
LPVLLGSF

SEQ ID NO: 4009 - protein, 8 aa, Dengue virus
PVLLGSFG

SEQ ID NO: 4010 - protein, 8 aa, Dengue virus
VLLGSFGC

SEQ ID NO: 4011 - protein, 8 aa, Dengue virus
LLGSFGCK

SEQ ID NO: 4012 - protein, 8 aa, Dengue virus
LGSFGCKP

SEQ ID NO: 4013 - protein, 8 aa, Dengue virus
GSFGCKPL

SEQ ID NO: 4014 - protein, 8 aa, Dengue virus
SFGCKPLT

SEQ ID NO: 4015 - protein, 8 aa, Dengue virus
FGCKPLTM

SEQ ID NO: 4016 - protein, 8 aa, Dengue virus
GCKPLPMF

SEQ ID NO: 4017 - protein, 8 aa, Dengue virus
CKPLPMFL

SEQ ID NO: 4018 - protein, 8 aa, Dengue virus
KPLPMFLI

SEQ ID NO: 4019 - protein, 8 aa, Dengue virus
PLTMFLIT

SEQ ID NO: 4020 - protein, 8 aa, Dengue virus
LTMFLITE

SEQ ID NO: 4021 - protein, 8 aa, Dengue virus
ITENKIWG

SEQ ID NO: 4022 - protein, 8 aa, Dengue virus
TENKIWGR

SEQ ID NO: 4023 - protein, 8 aa, Dengue virus
ENKIWGRR

SEQ ID NO: 4024 - protein, 8 aa, Dengue virus
NKIWGRRS

SEQ ID NO: 4025 - protein, 8 aa, Dengue virus
KIWGRRSW

SEQ ID NO: 4026 - protein, 8 aa, Dengue virus
IWGRRSWP

SEQ ID NO: 4027 - protein, 8 aa, Dengue virus
WGRRSWPL

SEQ ID NO: 4028 - protein, 8 aa, Dengue virus
GRRSWPLN

SEQ ID NO: 4029 - protein, 8 aa, Dengue virus
RRSWPLNE

SEQ ID NO: 4030 - protein, 8 aa, Dengue virus
RSWPLNEG

SEQ ID NO: 4031 - protein, 8 aa, Dengue virus
SWPINEGI

SEQ ID NO: 4032 - protein, 8 aa, Dengue virus
WPINEGIM

SEQ ID NO: 4033 - protein, 8 aa, Dengue virus
PINEGIMA

SEQ ID NO: 4034 - protein, 8 aa, Dengue virus
LNEGIMAI

SEQ ID NO: 4035 - protein, 8 aa, Dengue virus
NEGIMAIG

SEQ ID NO: 4036 - protein, 8 aa, Dengue virus
EGIMAIGI

SEQ ID NO: 4037 - protein, 8 aa, Dengue virus
GIMAIGIV

SEQ ID NO: 4038 - protein, 8 aa, Dengue virus
IMAIGIVS

SEQ ID NO: 4039 - protein, 8 aa, Dengue virus
MAIGIVSI

SEQ ID NO: 4040 - protein, 8 aa, Dengue virus
AIGIVSIL

SEQ ID NO: 4041 - protein, 8 aa, Dengue virus
IGIVSILL

SEQ ID NO: 4042 - protein, 8 aa, Dengue virus
GVVSILLS

SEQ ID NO: 4043 - protein, 8 aa, Dengue virus
VVSILLSS

SEQ ID NO: 4044 - protein, 8 aa, Dengue virus
VSILLSAL

SEQ ID NO: 4045 - protein, 8 aa, Dengue virus
SILLSALL

SEQ ID NO: 4046 - protein, 8 aa, Dengue virus
ILLSALLK

SEQ ID NO: 4047 - protein, 8 aa, Dengue virus
LLSALLKN

SEQ ID NO: 4048 - protein, 8 aa, Dengue virus
LSALLKND

SEQ ID NO: 4049 - protein, 8 aa, Dengue virus
SALLKNDV

SEQ ID NO: 4050 - protein, 8 aa, Dengue virus
ALLKNDVP

SEQ ID NO: 4051 - protein, 8 aa, Dengue virus
SADLLLEK

SEQ ID NO: 4052 - protein, 8 aa, Dengue virus
ADLLLEKA

SEQ ID NO: 4053 - protein, 8 aa, Dengue virus
DLLLEKAA

SEQ ID NO: 4054 - protein, 8 aa, Dengue virus
LSLEKAAV

SEQ ID NO: 4055 - protein, 8 aa, Dengue virus
SLEKAAVV

SEQ ID NO: 4056 - protein, 8 aa, Dengue virus
LEKAAVVS

SEQ ID NO: 4057 - protein, 8 aa, Dengue virus
EKAAVVSW

SEQ ID NO: 4058 - protein, 8 aa, Dengue virus
KAAVVSWE

SEQ ID NO: 4059 - protein, 8 aa, Dengue virus
AAEVSWEQ

SEQ ID NO: 4060 - protein, 8 aa, Dengue virus
AEVSWEQE

SEQ ID NO: 4061 - protein, 8 aa, Dengue virus
EVSWEQEA

SEQ ID NO: 4062 - protein, 8 aa, Dengue virus
VSWEQEAE

SEQ ID NO: 4063 - protein, 8 aa, Dengue virus
SWEQEAEH

SEQ ID NO: 4064 - protein, 8 aa, Dengue virus
WEQEAEHS

SEQ ID NO: 4065 - protein, 8 aa, Dengue virus
EQEAEHSG

SEQ ID NO: 4066 - protein, 8 aa, Dengue virus
QEAEHSGT

SEQ ID NO: 4067 - protein, 8 aa, Dengue virus
EAEHSGTS

SEQ ID NO: 4068 - protein, 8 aa, Dengue virus
AEHSGTSH

SEQ ID NO: 4069 - protein, 8 aa, Dengue virus
EHSGTSHN

SEQ ID NO: 4070 - protein, 8 aa, Dengue virus
HSGTSHNI

SEQ ID NO: 4071 - protein, 8 aa, Dengue virus
SGTSHNIL

SEQ ID NO: 4072 - protein, 8 aa, Dengue virus
GTSHNILV

SEQ ID NO: 4073 - protein, 8 aa, Dengue virus
TSHNILVE

SEQ ID NO: 4074 - protein, 8 aa, Dengue virus
SHNILVEI

SEQ ID NO: 4075 - protein, 8 aa, Dengue virus
HNILVEIQ

SEQ ID NO: 4076 - protein, 8 aa, Dengue virus
NILVEIQD

SEQ ID NO: 4077 - protein, 8 aa, Dengue virus
ILVEIQDD

SEQ ID NO: 4078 - protein, 8 aa, Dengue virus
LVEIQDDG

SEQ ID NO: 4079 - protein, 8 aa, Dengue virus
VEIQDDGT

SEQ ID NO: 4080 - protein, 8 aa, Dengue virus
EIQDDGTM

SEQ ID NO: 4081 - protein, 8 aa, Dengue virus
IQDDGTMK

SEQ ID NO: 4082 - protein, 8 aa, Dengue virus
IKDEEKDD

SEQ ID NO: 4083 - protein, 8 aa, Dengue virus
KDEEKDDT

SEQ ID NO: 4084 - protein, 8 aa, Dengue virus
DEERDDTI

SEQ ID NO: 4085 - protein, 8 aa, Dengue virus
EERDDTIT

SEQ ID NO: 4086 - protein, 8 aa, Dengue virus
ERDDTITI

SEQ ID NO: 4087 - protein, 8 aa, Dengue virus
RDDTITIL

SEQ ID NO: 4088 - protein, 8 aa, Dengue virus
DDTITILL

SEQ ID NO: 4089 - protein, 8 aa, Dengue virus
DTITILLK

SEQ ID NO: 4090 - protein, 8 aa, Dengue virus
TITILLKA

SEQ ID NO: 4091 - protein, 8 aa, Dengue virus
ITILLKAT

SEQ ID NO: 4092 - protein, 8 aa, Dengue virus
LKATLLAI

SEQ ID NO: 4093 - protein, 8 aa, Dengue virus
KATLLAIS

SEQ ID NO: 4094 - protein, 8 aa, Dengue virus
ATLLAISG

SEQ ID NO: 4095 - protein, 8 aa, Dengue virus
TLLAISGV

SEQ ID NO: 4096 - protein, 8 aa, Dengue virus
LLAISGVY

SEQ ID NO: 4097 - protein, 8 aa, Dengue virus
LAISGVYP

SEQ ID NO: 4098 - protein, 8 aa, Dengue virus
AVSGVYPM

SEQ ID NO: 4099 - protein, 8 aa, Dengue virus
VSGVYPMS

SEQ ID NO: 4100 - protein, 8 aa, Dengue virus
SGVYPMSI

SEQ ID NO: 4101 - protein, 8 aa, Dengue virus
GVYPMSIP

SEQ ID NO: 4102 - protein, 8 aa, Dengue virus
VYPMSIPA

SEQ ID NO: 4103 - protein, 8 aa, Dengue virus
YPMSIPAT

SEQ ID NO: 4104 - protein, 8 aa, Dengue virus
PMSIPATL

SEQ ID NO: 4105 - protein, 8 aa, Dengue virus
MSIPATLF

SEQ ID NO: 4106 - protein, 8 aa, Dengue virus
SIPATLFL

SEQ ID NO: 4107 - protein, 8 aa, Dengue virus
IPATLFLW

SEQ ID NO: 4108 - protein, 8 aa, Dengue virus
PATLFVWH

SEQ ID NO: 4109 - protein, 8 aa, Dengue virus
ATLFVWHF

SEQ ID NO: 4110 - protein, 8 aa, Dengue virus
TLFVWHFW

SEQ ID NO: 4111 - protein, 8 aa, Dengue virus
LFVWHFWQ

SEQ ID NO: 4112 - protein, 8 aa, Dengue virus
WDTPSPPK

SEQ ID NO: 4113 - protein, 8 aa, Dengue virus
DTPSPPKV

SEQ ID NO: 4114 - protein, 8 aa, Dengue virus
TPSPPEVG

SEQ ID NO: 4115 - protein, 8 aa, Dengue virus
PSPPEVGR

SEQ ID NO: 4116 - protein, 8 aa, Dengue virus
SPPEVGRA

SEQ ID NO: 4117 - protein, 8 aa, Dengue virus
PPEVGRAV

SEQ ID NO: 4118 - protein, 8 aa, Dengue virus
PEVGRAVL

SEQ ID NO: 4119 - protein, 8 aa, Dengue virus
EVGRAVLD

SEQ ID NO: 4120 - protein, 8 aa, Dengue virus
VGRAVLDD

SEQ ID NO: 4121 - protein, 8 aa, Dengue virus
GRAVLDDG

SEQ ID NO: 4122 - protein, 8 aa, Dengue virus
KAVLDDGI

SEQ ID NO: 4123 - protein, 8 aa, Dengue virus
DDGIYRIL

SEQ ID NO: 4124 - protein, 8 aa, Dengue virus
DGIYRILQ

SEQ ID NO: 4125 - protein, 8 aa, Dengue virus
GIYRILQR

SEQ ID NO: 4126 - protein, 8 aa, Dengue virus
IYRILQRG

SEQ ID NO: 4127 - protein, 8 aa, Dengue virus
YRILQRGL

SEQ ID NO: 4128 - protein, 8 aa, Dengue virus
RILQRGLL

SEQ ID NO: 4129 - protein, 8 aa, Dengue virus
ILQRGLLG

SEQ ID NO: 4130 - protein, 8 aa, Dengue virus
LQRGLLGR

SEQ ID NO: 4131 - protein, 8 aa, Dengue virus
VGVGVFQD

SEQ ID NO: 4132 - protein, 8 aa, Dengue virus
GVGVFQDG

SEQ ID NO: 4133 - protein, 8 aa, Dengue virus
VGVFQDGV

SEQ ID NO: 4134 - protein, 8 aa, Dengue virus
GVFQDGVF

SEQ ID NO: 4135 - protein, 8 aa, Dengue virus
VFQDGVFH

SEQ ID NO: 4136 - protein, 8 aa, Dengue virus
FQDGVFHT

SEQ ID NO: 4137 - protein, 8 aa, Dengue virus
QDGVFHTM

SEQ ID NO: 4138 - protein, 8 aa, Dengue virus
DGVFHTMW

SEQ ID NO: 4139 - protein, 8 aa, Dengue virus
GVFHTMWH

SEQ ID NO: 4140 - protein, 8 aa, Dengue virus
SYGGGWRF

SEQ ID NO: 4141 - protein, 8 aa, Dengue virus
YGGGWRFQ

SEQ ID NO: 4142 - protein, 8 aa, Dengue virus
GGGWRFQG

SEQ ID NO: 4143 - protein, 8 aa, Dengue virus
GGWRFQGS

SEQ ID NO: 4144 - protein, 8 aa, Dengue virus
GWRFQGSW

SEQ ID NO: 4145 - protein, 8 aa, Dengue virus
WRFQGSWN

SEQ ID NO: 4146 - protein, 8 aa, Dengue virus
RGSWNTGE

SEQ ID NO: 4147 - protein, 8 aa, Dengue virus
GSWNAGEE

SEQ ID NO: 4148 - protein, 8 aa, Dengue virus
SWNAGEEV

SEQ ID NO: 4149 - protein, 8 aa, Dengue virus
WNAGEEVQ

SEQ ID NO: 4150 - protein, 8 aa, Dengue virus
NAGEEVQV

SEQ ID NO: 4151 - protein, 8 aa, Dengue virus
AGEEVQVI

SEQ ID NO: 4152 - protein, 8 aa, Dengue virus
NPKNVQTT

SEQ ID NO: 4153 - protein, 8 aa, Dengue virus
PKNVQTTP

SEQ ID NO: 4154 - protein, 8 aa, Dengue virus
KNVQTTPG

SEQ ID NO: 4155 - protein, 8 aa, Dengue virus
NVQTTPGT

SEQ ID NO: 4156 - protein, 8 aa, Dengue virus
VQTTPGTF

SEQ ID NO: 4157 - protein, 8 aa, Dengue virus
QTTPGTFK

SEQ ID NO: 4158 - protein, 8 aa, Dengue virus
TTPGTFKT

SEQ ID NO: 4159 - protein, 8 aa, Dengue virus
TPGTFKTP

SEQ ID NO: 4160 - protein, 8 aa, Dengue virus
PGTFKTSE

SEQ ID NO: 4161 - protein, 8 aa, Dengue virus
GTFKTSEG

SEQ ID NO: 4162 - protein, 8 aa, Dengue virus
TFKTSEGE

SEQ ID NO: 4163 - protein, 8 aa, Dengue virus
FKTSEGEV

SEQ ID NO: 4164 - protein, 8 aa, Dengue virus
KTSEGEVG

SEQ ID NO: 4165 - protein, 8 aa, Dengue virus
TSEGEVGA

SEQ ID NO: 4166 - protein, 8 aa, Dengue virus
SEGEVGAI

SEQ ID NO: 4167 - protein, 8 aa, Dengue virus
VNREGKVV

SEQ ID NO: 4168 - protein, 8 aa, Dengue virus
NRERKIVG

SEQ ID NO: 4169 - protein, 8 aa, Dengue virus
VSAIAQAR

SEQ ID NO: 4170 - protein, 8 aa, Dengue virus
SAIAQAKT

SEQ ID NO: 4171 - protein, 8 aa, Dengue virus
AIAQAKTS

SEQ ID NO: 4172 - protein, 8 aa, Dengue virus
IAQAKTSQ

SEQ ID NO: 4173 - protein, 8 aa, Dengue virus
AQAKTSQE

SEQ ID NO: 4174 - protein, 8 aa, Dengue virus
QAKTSQEG

SEQ ID NO: 4175 - protein, 8 aa, Dengue virus
AKTSQEGP

SEQ ID NO: 4176 - protein, 8 aa, Dengue virus
KTSQEGPL

SEQ ID NO: 4177 - protein, 8 aa, Dengue virus
TSQEGPLP

SEQ ID NO: 4178 - protein, 8 aa, Dengue virus
GPLPEIEE

SEQ ID NO: 4179 - protein, 8 aa, Dengue virus
PLPEIEEE

SEQ ID NO: 4180 - protein, 8 aa, Dengue virus
LPEIEEEV

SEQ ID NO: 4181 - protein, 8 aa, Dengue virus
PEIEEEVF

SEQ ID NO: 4182 - protein, 8 aa, Dengue virus
EIEDEVFK

SEQ ID NO: 4183 - protein, 8 aa, Dengue virus
IEDEVFKK

SEQ ID NO: 4184 - protein, 8 aa, Dengue virus
EDEVFKKR

SEQ ID NO: 4185 - protein, 8 aa, Dengue virus
DEVFKKRN

SEQ ID NO: 4186 - protein, 8 aa, Dengue virus
EVFKKRNL

SEQ ID NO: 4187 - protein, 8 aa, Dengue virus
VFKKRNLT

SEQ ID NO: 4188 - protein, 8 aa, Dengue virus
FKKRNLTI

SEQ ID NO: 4189 - protein, 8 aa, Dengue virus
KKRNLTIM

SEQ ID NO: 4190 - protein, 8 aa, Dengue virus
TRRYLPAM

SEQ ID NO: 4191 - protein, 8 aa, Dengue virus
RRYLPAMV

SEQ ID NO: 4192 - protein, 8 aa, Dengue virus
RYLPAMVR

SEQ ID NO: 4193 - protein, 8 aa, Dengue virus
YLPAMVRE

SEQ ID NO: 4194 - protein, 8 aa, Dengue virus
LPAMVREA

SEQ ID NO: 4195 - protein, 8 aa, Dengue virus
PAMVREAI

SEQ ID NO: 4196 - protein, 8 aa, Dengue virus
AMVREAIK

SEQ ID NO: 4197 - protein, 8 aa, Dengue virus
MVREAIKR

SEQ ID NO: 4198 - protein, 8 aa, Dengue virus
VREAIKRR

SEQ ID NO: 4199 - protein, 8 aa, Dengue virus
REAIKRRL

SEQ ID NO: 4200 - protein, 8 aa, Dengue virus
EAIKRRLR

SEQ ID NO: 4201 - protein, 8 aa, Dengue virus
AIKRRLRT

SEQ ID NO: 4202 - protein, 8 aa, Dengue virus
IKRRLRTL

SEQ ID NO: 4203 - protein, 8 aa, Dengue virus
KRRLRTLI

SEQ ID NO: 4204 - protein, 8 aa, Dengue virus
RRLRTLIL

SEQ ID NO: 4205 - protein, 8 aa, Dengue virus
RLRTLILA

SEQ ID NO: 4206 - protein, 8 aa, Dengue virus
LRTLVLAP

SEQ ID NO: 4207 - protein, 8 aa, Dengue virus
RTLVLAPT

SEQ ID NO: 4208 - protein, 8 aa, Dengue virus
TLVLAPTR

SEQ ID NO: 4209 - protein, 8 aa, Dengue virus
LVLAPTRV

SEQ ID NO: 4210 - protein, 8 aa, Dengue virus
VLAPTRVV

SEQ ID NO: 4211 - protein, 8 aa, Dengue virus
MAEALKGV

SEQ ID NO: 4212 - protein, 8 aa, Dengue virus
AEALKGVP

SEQ ID NO: 4213 - protein, 8 aa, Dengue virus
EALKGVPI

SEQ ID NO: 4214 - protein, 8 aa, Dengue virus
ALKGVPIR

SEQ ID NO: 4215 - protein, 8 aa, Dengue virus
LKGVPIRY

SEQ ID NO: 4216 - protein, 8 aa, Dengue virus
KGVPIRYQ

SEQ ID NO: 4217 - protein, 8 aa, Dengue virus
GVPIRYQT

SEQ ID NO: 4218 - protein, 8 aa, Dengue virus
VPIRYQTT

SEQ ID NO: 4219 - protein, 8 aa, Dengue virus
VKSEHTGR

SEQ ID NO: 4220 - protein, 8 aa, Dengue virus
KSEHTGRE

SEQ ID NO: 4221 - protein, 8 aa, Dengue virus
SEHTGREI

SEQ ID NO: 4222 - protein, 8 aa, Dengue virus
EHTGREIV

SEQ ID NO: 4223 - protein, 8 aa, Dengue virus
HTGREIVD

SEQ ID NO: 4224 - protein, 8 aa, Dengue virus
TGREIVDL

SEQ ID NO: 4225 - protein, 8 aa, Dengue virus
GREIVDLM

SEQ ID NO: 4226 - protein, 8 aa, Dengue virus
REIVDLMC

SEQ ID NO: 4227 - protein, 8 aa, Dengue virus
EAHFTDPA

SEQ ID NO: 4228 - protein, 8 aa, Dengue virus
AHFTDPAS

SEQ ID NO: 4229 - protein, 8 aa, Dengue virus
HFTDPASI

SEQ ID NO: 4230 - protein, 8 aa, Dengue virus
FTDPASIA

SEQ ID NO: 4231 - protein, 8 aa, Dengue virus
TDPASIAA

SEQ ID NO: 4232 - protein, 8 aa, Dengue virus
DPASIAAR

SEQ ID NO: 4233 - protein, 8 aa, Dengue virus
PASIAARG

SEQ ID NO: 4234 - protein, 8 aa, Dengue virus
ASIAARGY

SEQ ID NO: 4235 - protein, 8 aa, Dengue virus
TATPPGSM

SEQ ID NO: 4236 - protein, 8 aa, Dengue virus
ATPPGSME

SEQ ID NO: 4237 - protein, 8 aa, Dengue virus
TPPGSMEA

SEQ ID NO: 4238 - protein, 8 aa, Dengue virus
PPGSMEAF

SEQ ID NO: 4239 - protein, 8 aa, Dengue virus
PGSMEAFP

SEQ ID NO: 4240 - protein, 8 aa, Dengue virus
GSMEAFPQ

SEQ ID NO: 4241 - protein, 8 aa, Dengue virus
SMEAFPQS

SEQ ID NO: 4242 - protein, 8 aa, Dengue virus
MEAFPQSN

SEQ ID NO: 4243 - protein, 8 aa, Dengue virus
AFPQSNAI

SEQ ID NO: 4244 - protein, 8 aa, Dengue virus
FPQSNAII

SEQ ID NO: 4245 - protein, 8 aa, Dengue virus
PQSNAIIQ

SEQ ID NO: 4246 - protein, 8 aa, Dengue virus
QSNAIIQD

SEQ ID NO: 4247 - protein, 8 aa, Dengue virus
SNAIIQDE

SEQ ID NO: 4248 - protein, 8 aa, Dengue virus
NAIIQDEE

SEQ ID NO: 4249 - protein, 8 aa, Dengue virus
AVIQDEEK

SEQ ID NO: 4250 - protein, 8 aa, Dengue virus
VIQDEEKD

SEQ ID NO: 4251 - protein, 8 aa, Dengue virus
IQDEEKDI

SEQ ID NO: 4252 - protein, 8 aa, Dengue virus
QDEEKDIP

SEQ ID NO: 4253 - protein, 8 aa, Dengue virus
DEEKDIPE

SEQ ID NO: 4254 - protein, 8 aa, Dengue virus
EEKDIPER

SEQ ID NO: 4255 - protein, 8 aa, Dengue virus
EKDIPERS

SEQ ID NO: 4256 - protein, 8 aa, Dengue virus
KDIPERSW

SEQ ID NO: 4257 - protein, 8 aa, Dengue virus
ERSWNSGH

SEQ ID NO: 4258 - protein, 8 aa, Dengue virus
RSWNSGYD

SEQ ID NO: 4259 - protein, 8 aa, Dengue virus
SWNSGYDW

SEQ ID NO: 4260 - protein, 8 aa, Dengue virus
WNSGYDWI

SEQ ID NO: 4261 - protein, 8 aa, Dengue virus
NSGYDWIT

SEQ ID NO: 4262 - protein, 8 aa, Dengue virus
SGYDWITD

SEQ ID NO: 4263 - protein, 8 aa, Dengue virus
GYDWITDF

SEQ ID NO: 4264 - protein, 8 aa, Dengue virus
YDWITDFP

SEQ ID NO: 4265 - protein, 8 aa, Dengue virus
DWITDFPG

SEQ ID NO: 4266 - protein, 8 aa, Dengue virus
WFVPSIKA

SEQ ID NO: 4267 - protein, 8 aa, Dengue virus
FVPSIKAG

SEQ ID NO: 4268 - protein, 8 aa, Dengue virus
VPSIKAGN

SEQ ID NO: 4269 - protein, 8 aa, Dengue virus
PSIKAGND

SEQ ID NO: 4270 - protein, 8 aa, Dengue virus
SIKAGNDI

SEQ ID NO: 4271 - protein, 8 aa, Dengue virus
IKAGNDIA

SEQ ID NO: 4272 - protein, 8 aa, Dengue virus
KAGNDIAN

SEQ ID NO: 4273 - protein, 8 aa, Dengue virus
AGNDIANC

SEQ ID NO: 4274 - protein, 8 aa, Dengue virus
RKNGKRVV

SEQ ID NO: 4275 - protein, 8 aa, Dengue virus
KNGKRVVQ

SEQ ID NO: 4276 - protein, 8 aa, Dengue virus
NGKRVVQL

SEQ ID NO: 4277 - protein, 8 aa, Dengue virus
GKRVVQLS

SEQ ID NO: 4278 - protein, 8 aa, Dengue virus
KRVVQLSR

SEQ ID NO: 4279 - protein, 8 aa, Dengue virus
RVVQLSRK

SEQ ID NO: 4280 - protein, 8 aa, Dengue virus
VVQLSRKT

SEQ ID NO: 4281 - protein, 8 aa, Dengue virus
VQLSRKTF

SEQ ID NO: 4282 - protein, 8 aa, Dengue virus
DTEYQKTR

SEQ ID NO: 4283 - protein, 8 aa, Dengue virus
TEYQKTRN

SEQ ID NO: 4284 - protein, 8 aa, Dengue virus
EYQKTRNN

SEQ ID NO: 4285 - protein, 8 aa, Dengue virus
YQKTRNND

SEQ ID NO: 4286 - protein, 8 aa, Dengue virus
QKTRNNDW

SEQ ID NO: 4287 - protein, 8 aa, Dengue virus
KTRNNDWD

SEQ ID NO: 4288 - protein, 8 aa, Dengue virus
TRNNDWDY

SEQ ID NO: 4289 - protein, 8 aa, Dengue virus
RNNDWDYV

SEQ ID NO: 4290 - protein, 8 aa, Dengue virus
RGRIGRNQ

SEQ ID NO: 4291 - protein, 8 aa, Dengue virus
GRIGRNQN

SEQ ID NO: 4292 - protein, 8 aa, Dengue virus
RIGRNQNK

SEQ ID NO: 4293 - protein, 8 aa, Dengue virus
IGRNQNKE

SEQ ID NO: 4294 - protein, 8 aa, Dengue virus
GRNQNKEG

SEQ ID NO: 4295 - protein, 8 aa, Dengue virus
RNQNKEGD

SEQ ID NO: 4296 - protein, 8 aa, Dengue virus
NQNKEGDQ

SEQ ID NO: 4297 - protein, 8 aa, Dengue virus
QNKEGDQY

SEQ ID NO: 4298 - protein, 8 aa, Dengue virus
NKEGDQYV

SEQ ID NO: 4299 - protein, 8 aa, Dengue virus
KEGDQYVY

SEQ ID NO: 4300 - protein, 8 aa, Dengue virus
EGDQYVYM

SEQ ID NO: 4301 - protein, 8 aa, Dengue virus
GDQYVYMG

SEQ ID NO: 4302 - protein, 8 aa, Dengue virus
DQYVYMGQ

SEQ ID NO: 4303 - protein, 8 aa, Dengue virus
QYVYMGQP

SEQ ID NO: 4304 - protein, 8 aa, Dengue virus
YVYMGQPL

SEQ ID NO: 4305 - protein, 8 aa, Dengue virus
VYMGQPLN

SEQ ID NO: 4306 - protein, 8 aa, Dengue virus
YMGQPLKN

SEQ ID NO: 4307 - protein, 8 aa, Dengue virus
MGQPLKND

SEQ ID NO: 4308 - protein, 8 aa, Dengue virus
GQPLKNDE

SEQ ID NO: 4309 - protein, 8 aa, Dengue virus
QPLKNDED

SEQ ID NO: 4310 - protein, 8 aa, Dengue virus
PLKNDEDH

SEQ ID NO: 4311 - protein, 8 aa, Dengue virus
LKNDEDHA

SEQ ID NO: 4312 - protein, 8 aa, Dengue virus
EREKSAAV

SEQ ID NO: 4313 - protein, 8 aa, Dengue virus
REKSAAVD

SEQ ID NO: 4314 - protein, 8 aa, Dengue virus
EKSAAVDG

SEQ ID NO: 4315 - protein, 8 aa, Dengue virus
KSAAVDGE

SEQ ID NO: 4316 - protein, 8 aa, Dengue virus
SAAVDGEY

SEQ ID NO: 4317 - protein, 8 aa, Dengue virus
AAVDGEYR

SEQ ID NO: 4318 - protein, 8 aa, Dengue virus
AVDGEYRL

SEQ ID NO: 4319 - protein, 8 aa, Dengue virus
VDGEYRLR

SEQ ID NO: 4320 - protein, 8 aa, Dengue virus
DLPVWLSH

SEQ ID NO: 4321 - protein, 8 aa, Dengue virus
LPVWLSHK

SEQ ID NO: 4322 - protein, 8 aa, Dengue virus
PVWLSHKV

SEQ ID NO: 4323 - protein, 8 aa, Dengue virus
VWLSHKVA

SEQ ID NO: 4324 - protein, 8 aa, Dengue virus
WLSHKVAS

SEQ ID NO: 4325 - protein, 8 aa, Dengue virus
LSHKVASE

SEQ ID NO: 4326 - protein, 8 aa, Dengue virus
SHKVASEG

SEQ ID NO: 4327 - protein, 8 aa, Dengue virus
HKVASEGF

SEQ ID NO: 4328 - protein, 8 aa, Dengue virus
AAGRRSIS

SEQ ID NO: 4329 - protein, 8 aa, Dengue virus
AGRRSISG

SEQ ID NO: 4330 - protein, 8 aa, Dengue virus
GRRSISGD

SEQ ID NO: 4331 - protein, 8 aa, Dengue virus
RRSISGDL

SEQ ID NO: 4332 - protein, 8 aa, Dengue virus
RSISGDLI

SEQ ID NO: 4333 - protein, 8 aa, Dengue virus
SVSGDLIS

SEQ ID NO: 4334 - protein, 8 aa, Dengue virus
VSGDLISE

SEQ ID NO: 4335 - protein, 8 aa, Dengue virus
SGDLISEI

SEQ ID NO: 4336 - protein, 8 aa, Dengue virus
GDLISEIG

SEQ ID NO: 4337 - protein, 8 aa, Dengue virus
KLPQHLTL

SEQ ID NO: 4338 - protein, 8 aa, Dengue virus
LPQHLTLR

SEQ ID NO: 4339 - protein, 8 aa, Dengue virus
PQHLTLRA

SEQ ID NO: 4340 - protein, 8 aa, Dengue virus
QHLTLRAQ

SEQ ID NO: 4341 - protein, 8 aa, Dengue virus
HLTLRAQN

SEQ ID NO: 4342 - protein, 8 aa, Dengue virus
LTLRAQNA

SEQ ID NO: 4343 - protein, 8 aa, Dengue virus
TLRAQNAL

SEQ ID NO: 4344 - protein, 8 aa, Dengue virus
LRAQNALD

SEQ ID NO: 4345 - protein, 8 aa, Dengue virus
KAQNALDN

SEQ ID NO: 4346 - protein, 8 aa, Dengue virus
HNSEQGGK

SEQ ID NO: 4347 - protein, 8 aa, Dengue virus
NSEQGGKA

SEQ ID NO: 4348 - protein, 8 aa, Dengue virus
SEQGGKAY

SEQ ID NO: 4349 - protein, 8 aa, Dengue virus
EQGGKAYR

SEQ ID NO: 4350 - protein, 8 aa, Dengue virus
QGGKAYRH

SEQ ID NO: 4351 - protein, 8 aa, Dengue virus
GGKAYRHA

SEQ ID NO: 4352 - protein, 8 aa, Dengue virus
GKAYRHAM

SEQ ID NO: 4353 - protein, 8 aa, Dengue virus
KAYRHAME

SEQ ID NO: 4354 - protein, 8 aa, Dengue virus
AYRHALEE

SEQ ID NO: 4355 - protein, 8 aa, Dengue virus
YRHALEEL

SEQ ID NO: 4356 - protein, 8 aa, Dengue virus
RHALEELP

SEQ ID NO: 4357 - protein, 8 aa, Dengue virus
HALEELPD

SEQ ID NO: 4358 - protein, 8 aa, Dengue virus
ALEELPDT

SEQ ID NO: 4359 - protein, 8 aa, Dengue virus
LEELPDTI

SEQ ID NO: 4360 - protein, 8 aa, Dengue virus
LPDTIETI

SEQ ID NO: 4361 - protein, 8 aa, Dengue virus
PDTIETIM

SEQ ID NO: 4362 - protein, 8 aa, Dengue virus
DTIETIML

SEQ ID NO: 4363 - protein, 8 aa, Dengue virus
TIETIMLL

SEQ ID NO: 4364 - protein, 8 aa, Dengue virus
IETIMLLA

SEQ ID NO: 4365 - protein, 8 aa, Dengue virus
ETIMLLAL

SEQ ID NO: 4366 - protein, 8 aa, Dengue virus
TIMLLALI

SEQ ID NO: 4367 - protein, 8 aa, Dengue virus
IMLLALIA

SEQ ID NO: 4368 - protein, 8 aa, Dengue virus
AVLTGGVM

SEQ ID NO: 4369 - protein, 8 aa, Dengue virus
VLTGGVML

SEQ ID NO: 4370 - protein, 8 aa, Dengue virus
LTGGVMLF

SEQ ID NO: 4371 - protein, 8 aa, Dengue virus
TGGVMLFF

SEQ ID NO: 4372 - protein, 8 aa, Dengue virus
GGVMLFFL

SEQ ID NO: 4373 - protein, 8 aa, Dengue virus
GVMLFFLS

SEQ ID NO: 4374 - protein, 8 aa, Dengue virus
VMLFFLSG

SEQ ID NO: 4375 - protein, 8 aa, Dengue virus
TLFFLSGK

SEQ ID NO: 4376 - protein, 8 aa, Dengue virus
LFFLSGKG

SEQ ID NO: 4377 - protein, 8 aa, Dengue virus
FFLSGKGL

SEQ ID NO: 4378 - protein, 8 aa, Dengue virus
FLSGKGLG

SEQ ID NO: 4379 - protein, 8 aa, Dengue virus
LSGKGLGK

SEQ ID NO: 4380 - protein, 8 aa, Dengue virus
SGKGLGKT

SEQ ID NO: 4381 - protein, 8 aa, Dengue virus
GKGLGKTS

SEQ ID NO: 4382 - protein, 8 aa, Dengue virus
KGLGKTSI

SEQ ID NO: 4383 - protein, 8 aa, Dengue virus
SIGLLCVT

SEQ ID NO: 4384 - protein, 8 aa, Dengue virus
IGLLCVTA

SEQ ID NO: 4385 - protein, 8 aa, Dengue virus
GLLCVTAS

SEQ ID NO: 4386 - protein, 8 aa, Dengue virus
LLCVTASS

SEQ ID NO: 4387 - protein, 8 aa, Dengue virus
ASSALLWM

SEQ ID NO: 4388 - protein, 8 aa, Dengue virus
SSALLWMA

SEQ ID NO: 4389 - protein, 8 aa, Dengue virus
SALLWMAS

SEQ ID NO: 4390 - protein, 8 aa, Dengue virus
ALLWMASV

SEQ ID NO: 4391 - protein, 8 aa, Dengue virus
LLWMANVE

SEQ ID NO: 4392 - protein, 8 aa, Dengue virus
LWMANVEP

SEQ ID NO: 4393 - protein, 8 aa, Dengue virus
WMANVEPH

SEQ ID NO: 4394 - protein, 8 aa, Dengue virus
MANVEPHW

SEQ ID NO: 4395 - protein, 8 aa, Dengue virus
ANVEPHWI

SEQ ID NO: 4396 - protein, 8 aa, Dengue virus
NVEPHWIA

SEQ ID NO: 4397 - protein, 8 aa, Dengue virus
VVIGLLFV

SEQ ID NO: 4398 - protein, 8 aa, Dengue virus
VIGLLFII

SEQ ID NO: 4399 - protein, 8 aa, Dengue virus
IGLLFIIL

SEQ ID NO: 4400 - protein, 8 aa, Dengue virus
GLLFIILT

SEQ ID NO: 4401 - protein, 8 aa, Dengue virus
LLFIILTV

SEQ ID NO: 4402 - protein, 8 aa, Dengue virus
LFIILTVA

SEQ ID NO: 4403 - protein, 8 aa, Dengue virus
FIILTVAA

SEQ ID NO: 4404 - protein, 8 aa, Dengue virus
IILTVAAN

SEQ ID NO: 4405 - protein, 8 aa, Dengue virus
KKDLGIGY

SEQ ID NO: 4406 - protein, 8 aa, Dengue virus
KDLGIGYV

SEQ ID NO: 4407 - protein, 8 aa, Dengue virus
DLGIGYVA

SEQ ID NO: 4408 - protein, 8 aa, Dengue virus
HATMLDVD

SEQ ID NO: 4409 - protein, 8 aa, Dengue virus
ATMLDVDL

SEQ ID NO: 4410 - protein, 8 aa, Dengue virus
TMLDVDLH

SEQ ID NO: 4411 - protein, 8 aa, Dengue virus
MLDVDLRP

SEQ ID NO: 4412 - protein, 8 aa, Dengue virus
LDVDLRPA

SEQ ID NO: 4413 - protein, 8 aa, Dengue virus
DVDLRPAS

SEQ ID NO: 4414 - protein, 8 aa, Dengue virus
VDLRPASA

SEQ ID NO: 4415 - protein, 8 aa, Dengue virus
DLRPASAW

SEQ ID NO: 4416 - protein, 8 aa, Dengue virus
LRPASAWT

SEQ ID NO: 4417 - protein, 8 aa, Dengue virus
RPASAWTL

SEQ ID NO: 4418 - protein, 8 aa, Dengue virus
LYAVATTV

SEQ ID NO: 4419 - protein, 8 aa, Dengue virus
YAVATTVI

SEQ ID NO: 4420 - protein, 8 aa, Dengue virus
AVATTVIT

SEQ ID NO: 4421 - protein, 8 aa, Dengue virus
VATTVITP

SEQ ID NO: 4422 - protein, 8 aa, Dengue virus
ATTVITPM

SEQ ID NO: 4423 - protein, 8 aa, Dengue virus
TTVITPMM

SEQ ID NO: 4424 - protein, 8 aa, Dengue virus
TVITPMMR

SEQ ID NO: 4425 - protein, 8 aa, Dengue virus
VITPMMRH

SEQ ID NO: 4426 - protein, 8 aa, Dengue virus
WPISKMDL

SEQ ID NO: 4427 - protein, 8 aa, Dengue virus
PISKMDLG

SEQ ID NO: 4428 - protein, 8 aa, Dengue virus
ISKMDLGV

SEQ ID NO: 4429 - protein, 8 aa, Dengue virus
QVNPLTLI

SEQ ID NO: 4430 - protein, 8 aa, Dengue virus
VNPLTLIA

SEQ ID NO: 4431 - protein, 8 aa, Dengue virus
NPLTLIAA

SEQ ID NO: 4432 - protein, 8 aa, Dengue virus
PLTLIAAV

SEQ ID NO: 4433 - protein, 8 aa, Dengue virus
LTLIAAVL

SEQ ID NO: 4434 - protein, 8 aa, Dengue virus
TLIAAVLM

SEQ ID NO: 4435 - protein, 8 aa, Dengue virus
LIAAVLML

SEQ ID NO: 4436 - protein, 8 aa, Dengue virus
IAAVLMLV

SEQ ID NO: 4437 - protein, 8 aa, Dengue virus
AAVLMLLA

SEQ ID NO: 4438 - protein, 8 aa, Dengue virus
AVLMLLAH

SEQ ID NO: 4439 - protein, 8 aa, Dengue virus
VLMLLAHY

SEQ ID NO: 4440 - protein, 8 aa, Dengue virus
LMLLAHYA

SEQ ID NO: 4441 - protein, 8 aa, Dengue virus
GIMKNPTI

SEQ ID NO: 4442 - protein, 8 aa, Dengue virus
IMKNPTID

SEQ ID NO: 4443 - protein, 8 aa, Dengue virus
MKNPTIDG

SEQ ID NO: 4444 - protein, 8 aa, Dengue virus
KNPTIDGI

SEQ ID NO: 4445 - protein, 8 aa, Dengue virus
NPTIDGIV

SEQ ID NO: 4446 - protein, 8 aa, Dengue virus
PTIDGIVA

SEQ ID NO: 4447 - protein, 8 aa, Dengue virus
TIDGIVAI

SEQ ID NO: 4448 - protein, 8 aa, Dengue virus
IDGIVAID

SEQ ID NO: 4449 - protein, 8 aa, Dengue virus
DGIVTIDL

SEQ ID NO: 4450 - protein, 8 aa, Dengue virus
GIVTIDLD

SEQ ID NO: 4451 - protein, 8 aa, Dengue virus
IVTIDLDP

SEQ ID NO: 4452 - protein, 8 aa, Dengue virus
VTIDLDPV

SEQ ID NO: 4453 - protein, 8 aa, Dengue virus
TIDLDPVV

SEQ ID NO: 4454 - protein, 8 aa, Dengue virus
LDPVVYDT

SEQ ID NO: 4455 - protein, 8 aa, Dengue virus
DPVVYDTK

SEQ ID NO: 4456 - protein, 8 aa, Dengue virus
PVVYDTKF

SEQ ID NO: 4457 - protein, 8 aa, Dengue virus
VVYDTKFE

SEQ ID NO: 4458 - protein, 8 aa, Dengue virus
VYDTKFEK

SEQ ID NO: 4459 - protein, 8 aa, Dengue virus
YDTKFEKQ

SEQ ID NO: 4460 - protein, 8 aa, Dengue virus
DTKFEKQL

SEQ ID NO: 4461 - protein, 8 aa, Dengue virus
TKFEKQLG

SEQ ID NO: 4462 - protein, 8 aa, Dengue virus
LGQVMLLI

SEQ ID NO: 4463 - protein, 8 aa, Dengue virus
GQVMLLIL

SEQ ID NO: 4464 - protein, 8 aa, Dengue virus
QVMLLILC

SEQ ID NO: 4465 - protein, 8 aa, Dengue virus
VMLLILCT

SEQ ID NO: 4466 - protein, 8 aa, Dengue virus
LSKSEFNI

SEQ ID NO: 4467 - protein, 8 aa, Dengue virus
SKSEFNIY

SEQ ID NO: 4468 - protein, 8 aa, Dengue virus
KSEFNIYK

SEQ ID NO: 4469 - protein, 8 aa, Dengue virus
SEFNIYKR

SEQ ID NO: 4470 - protein, 8 aa, Dengue virus
EFNIYKRS

SEQ ID NO: 4471 - protein, 8 aa, Dengue virus
FNIYKRSG

SEQ ID NO: 4472 - protein, 8 aa, Dengue virus
NIYKRSGI

SEQ ID NO: 4473 - protein, 8 aa, Dengue virus
IYKRSGIM

SEQ ID NO: 4474 - protein, 8 aa, Dengue virus
YKRSGIIE

SEQ ID NO: 4475 - protein, 8 aa, Dengue virus
KRSGIIEV

SEQ ID NO: 4476 - protein, 8 aa, Dengue virus
RSGIIEVD

SEQ ID NO: 4477 - protein, 8 aa, Dengue virus
SGIIEVDR

SEQ ID NO: 4478 - protein, 8 aa, Dengue virus
GIIEVDRS

SEQ ID NO: 4479 - protein, 8 aa, Dengue virus
IIEVDRSE

SEQ ID NO: 4480 - protein, 8 aa, Dengue virus
IEVDRSEA

SEQ ID NO: 4481 - protein, 8 aa, Dengue virus
SEAKEGLR

SEQ ID NO: 4482 - protein, 8 aa, Dengue virus
EAKEGLRR

SEQ ID NO: 4483 - protein, 8 aa, Dengue virus
AKEGLRRG

SEQ ID NO: 4484 - protein, 8 aa, Dengue virus
KEGLRRGE

SEQ ID NO: 4485 - protein, 8 aa, Dengue virus
EGLRRGET

SEQ ID NO: 4486 - protein, 8 aa, Dengue virus
GLRRGETT

SEQ ID NO: 4487 - protein, 8 aa, Dengue virus
LKRGETTR

SEQ ID NO: 4488 - protein, 8 aa, Dengue virus
KRGETTRH

SEQ ID NO: 4489 - protein, 8 aa, Dengue virus
RGETTRHA

SEQ ID NO: 4490 - protein, 8 aa, Dengue virus
GETTRHAV

SEQ ID NO: 4491 - protein, 8 aa, Dengue virus
ETTRHAVS

SEQ ID NO: 4492 - protein, 8 aa, Dengue virus
TTRHAVSR

SEQ ID NO: 4493 - protein, 8 aa, Dengue virus
TRHAVSRG

SEQ ID NO: 4494 - protein, 8 aa, Dengue virus
RHAVSRGT

SEQ ID NO: 4495 - protein, 8 aa, Dengue virus
KGYTKGGA

SEQ ID NO: 4496 - protein, 8 aa, Dengue virus
GYTKGGAG

SEQ ID NO: 4497 - protein, 8 aa, Dengue virus
YTKGGAGH

SEQ ID NO: 4498 - protein, 8 aa, Dengue virus
TKGGAGHE

SEQ ID NO: 4499 - protein, 8 aa, Dengue virus
KGGAGHEE

SEQ ID NO: 4500 - protein, 8 aa, Dengue virus
GGAGHEEP

SEQ ID NO: 4501 - protein, 8 aa, Dengue virus
GPGHEEPV

SEQ ID NO: 4502 - protein, 8 aa, Dengue virus
PGHEEPVP

SEQ ID NO: 4503 - protein, 8 aa, Dengue virus
GHEEPVPM

SEQ ID NO: 4504 - protein, 8 aa, Dengue virus
HEEPVPMA

SEQ ID NO: 4505 - protein, 8 aa, Dengue virus
EEPVPMAT

SEQ ID NO: 4506 - protein, 8 aa, Dengue virus
EPVPMATY

SEQ ID NO: 4507 - protein, 8 aa, Dengue virus
PVPMATYG

SEQ ID NO: 4508 - protein, 8 aa, Dengue virus
VPMATYGW

SEQ ID NO: 4509 - protein, 8 aa, Dengue virus
TYGWNLVR

SEQ ID NO: 4510 - protein, 8 aa, Dengue virus
YGWNLVRL

SEQ ID NO: 4511 - protein, 8 aa, Dengue virus
GWNLVKLY

SEQ ID NO: 4512 - protein, 8 aa, Dengue virus
WNLVKLYS

SEQ ID NO: 4513 - protein, 8 aa, Dengue virus
NLVKLYSG

SEQ ID NO: 4514 - protein, 8 aa, Dengue virus
LVKLYSGK

SEQ ID NO: 4515 - protein, 8 aa, Dengue virus
VKLYSGKD

SEQ ID NO: 4516 - protein, 8 aa, Dengue virus
KLYSGKDV

SEQ ID NO: 4517 - protein, 8 aa, Dengue virus
LYSGKDVF

SEQ ID NO: 4518 - protein, 8 aa, Dengue virus
YSGKDVFF

SEQ ID NO: 4519 - protein, 8 aa, Dengue virus
SGKDVFFT

SEQ ID NO: 4520 - protein, 8 aa, Dengue virus
GKDVFFTP

SEQ ID NO: 4521 - protein, 8 aa, Dengue virus
KDVFFTPP

SEQ ID NO: 4522 - protein, 8 aa, Dengue virus
DVFFTPPE

SEQ ID NO: 4523 - protein, 8 aa, Dengue virus
VFFTPPEK

SEQ ID NO: 4524 - protein, 8 aa, Dengue virus
FFTPPEKC

SEQ ID NO: 4525 - protein, 8 aa, Dengue virus
FTPPEKCD

SEQ ID NO: 4526 - protein, 8 aa, Dengue virus
TPPEKCDT

SEQ ID NO: 4527 - protein, 8 aa, Dengue virus
KMVEPWLK

SEQ ID NO: 4528 - protein, 8 aa, Dengue virus
MVEPWLKG

SEQ ID NO: 4529 - protein, 8 aa, Dengue virus
VEPWLKGN

SEQ ID NO: 4530 - protein, 8 aa, Dengue virus
YMPSVVEA

SEQ ID NO: 4531 - protein, 8 aa, Dengue virus
MPSVVEAL

SEQ ID NO: 4532 - protein, 8 aa, Dengue virus
PSVVEALE

SEQ ID NO: 4533 - protein, 8 aa, Dengue virus
SVVEALEQ

SEQ ID NO: 4534 - protein, 8 aa, Dengue virus
VVEALEQM

SEQ ID NO: 4535 - protein, 8 aa, Dengue virus
VEALEQMQ

SEQ ID NO: 4536 - protein, 8 aa, Dengue virus
EALEQMQR

SEQ ID NO: 4537 - protein, 8 aa, Dengue virus
ALEQMQRK

SEQ ID NO: 4538 - protein, 8 aa, Dengue virus
LEQMQRKY

SEQ ID NO: 4539 - protein, 8 aa, Dengue virus
EQMQRKYG

SEQ ID NO: 4540 - protein, 8 aa, Dengue virus
QMQRKYGG

SEQ ID NO: 4541 - protein, 8 aa, Dengue virus
MQRKYGGM

SEQ ID NO: 4542 - protein, 8 aa, Dengue virus
QRKYGGML

SEQ ID NO: 4543 - protein, 8 aa, Dengue virus
RKYGGMLV

SEQ ID NO: 4544 - protein, 8 aa, Dengue virus
KYGGMLVR

SEQ ID NO: 4545 - protein, 8 aa, Dengue virus
LLNRFTMT

SEQ ID NO: 4546 - protein, 8 aa, Dengue virus
LNRFTMTH

SEQ ID NO: 4547 - protein, 8 aa, Dengue virus
NRFTMTHR

SEQ ID NO: 4548 - protein, 8 aa, Dengue virus
RFTMTHRK

SEQ ID NO: 4549 - protein, 8 aa, Dengue virus
FTMTHRKP

SEQ ID NO: 4550 - protein, 8 aa, Dengue virus
TMTHRKPT

SEQ ID NO: 4551 - protein, 8 aa, Dengue virus
MTHRKPTY

SEQ ID NO: 4552 - protein, 8 aa, Dengue virus
THRKPTYE

SEQ ID NO: 4553 - protein, 8 aa, Dengue virus
HRKPTYEK

SEQ ID NO: 4554 - protein, 8 aa, Dengue virus
RKPTYEKD

SEQ ID NO: 4555 - protein, 8 aa, Dengue virus
KPTYEKDV

SEQ ID NO: 4556 - protein, 8 aa, Dengue virus
PTYEKDVD

SEQ ID NO: 4557 - protein, 8 aa, Dengue virus
TYEKDVDL

SEQ ID NO: 4558 - protein, 8 aa, Dengue virus
YEKDVDLG

SEQ ID NO: 4559 - protein, 8 aa, Dengue virus
ERDVDLGT

SEQ ID NO: 4560 - protein, 8 aa, Dengue virus
RDVDLGTG

SEQ ID NO: 4561 - protein, 8 aa, Dengue virus
DVDLGTGT

SEQ ID NO: 4562 - protein, 8 aa, Dengue virus
VDLGTGTR

SEQ ID NO: 4563 - protein, 8 aa, Dengue virus
DLGTGTRH

SEQ ID NO: 4564 - protein, 8 aa, Dengue virus
LGTGTRHV

SEQ ID NO: 4565 - protein, 8 aa, Dengue virus
GTGTRHVA

SEQ ID NO: 4566 - protein, 8 aa, Dengue virus
TGTRHVAV

SEQ ID NO: 4567 - protein, 8 aa, Dengue virus
GTRHVTVE

SEQ ID NO: 4568 - protein, 8 aa, Dengue virus
TRHVTVEP

SEQ ID NO: 4569 - protein, 8 aa, Dengue virus
RHVTVEPE

SEQ ID NO: 4570 - protein, 8 aa, Dengue virus
HVAVEPEI

SEQ ID NO: 4571 - protein, 8 aa, Dengue virus
VAVEPEIA

SEQ ID NO: 4572 - protein, 8 aa, Dengue virus
AVEPEIAN

SEQ ID NO: 4573 - protein, 8 aa, Dengue virus
VEPEIANL

SEQ ID NO: 4574 - protein, 8 aa, Dengue virus
EPEIANLD

SEQ ID NO: 4575 - protein, 8 aa, Dengue virus
PEIANLDI

SEQ ID NO: 4576 - protein, 8 aa, Dengue virus
EIANLDII

SEQ ID NO: 4577 - protein, 8 aa, Dengue virus
IANLDIIG

SEQ ID NO: 4578 - protein, 8 aa, Dengue virus
ANIDIIGQ

SEQ ID NO: 4579 - protein, 8 aa, Dengue virus
QRIENIKN

SEQ ID NO: 4580 - protein, 8 aa, Dengue virus
RIENIKNE

SEQ ID NO: 4581 - protein, 8 aa, Dengue virus
IENIKNEH

SEQ ID NO: 4582 - protein, 8 aa, Dengue virus
ENIKNEHK

SEQ ID NO: 4583 - protein, 8 aa, Dengue virus
NIKNEHKS

SEQ ID NO: 4584 - protein, 8 aa, Dengue virus
IKNEHKST

SEQ ID NO: 4585 - protein, 8 aa, Dengue virus
KNEHKSTW

SEQ ID NO: 4586 - protein, 8 aa, Dengue virus
NEHKSTWH

SEQ ID NO: 4587 - protein, 8 aa, Dengue virus
SMVNGVVR

SEQ ID NO: 4588 - protein, 8 aa, Dengue virus
MVNGVVRL

SEQ ID NO: 4589 - protein, 8 aa, Dengue virus
VNGVVRLL

SEQ ID NO: 4590 - protein, 8 aa, Dengue virus
NGVVRLLT

SEQ ID NO: 4591 - protein, 8 aa, Dengue virus
GVVRLLTK

SEQ ID NO: 4592 - protein, 8 aa, Dengue virus
VVRLLTKP

SEQ ID NO: 4593 - protein, 8 aa, Dengue virus
VRLLTKPW

SEQ ID NO: 4594 - protein, 8 aa, Dengue virus
RLLTKPWD

SEQ ID NO: 4595 - protein, 8 aa, Dengue virus
KVDTRTPR

SEQ ID NO: 4596 - protein, 8 aa, Dengue virus
VDTRTPRA

SEQ ID NO: 4597 - protein, 8 aa, Dengue virus
DTRTPRAK

SEQ ID NO: 4598 - protein, 8 aa, Dengue virus
TRTPRAKR

SEQ ID NO: 4599 - protein, 8 aa, Dengue virus
RTPRAKRG

SEQ ID NO: 4600 - protein, 8 aa, Dengue virus
TPRAKRGT

SEQ ID NO: 4601 - protein, 8 aa, Dengue virus
PRAKRGTT

SEQ ID NO: 4602 - protein, 8 aa, Dengue virus
RAKRGTTQ

SEQ ID NO: 4603 - protein, 8 aa, Dengue virus
AKRGTTQI

SEQ ID NO: 4604 - protein, 8 aa, Dengue virus
KRGTTQIM

SEQ ID NO: 4605 - protein, 8 aa, Dengue virus
RGTTQIME

SEQ ID NO: 4606 - protein, 8 aa, Dengue virus
GTTQIMEV

SEQ ID NO: 4607 - protein, 8 aa, Dengue virus
TTQIMEVT

SEQ ID NO: 4608 - protein, 8 aa, Dengue virus
TQIMEVTA

SEQ ID NO: 4609 - protein, 8 aa, Dengue virus
QIMEVTAR

SEQ ID NO: 4610 - protein, 8 aa, Dengue virus
IMEVTARW

SEQ ID NO: 4611 - protein, 8 aa, Dengue virus
MEVTARWL

SEQ ID NO: 4612 - protein, 8 aa, Dengue virus
EVTARWLW

SEQ ID NO: 4613 - protein, 8 aa, Dengue virus
VTARWLWG

SEQ ID NO: 4614 - protein, 8 aa, Dengue virus
TARWLWGF

SEQ ID NO: 4615 - protein, 8 aa, Dengue virus
ARWLWGFL

SEQ ID NO: 4616 - protein, 8 aa, Dengue virus
RWLWGFLS

SEQ ID NO: 4617 - protein, 8 aa, Dengue virus
LWSFLSRN

SEQ ID NO: 4618 - protein, 8 aa, Dengue virus
WSFLSRNK

SEQ ID NO: 4619 - protein, 8 aa, Dengue virus
SFLSRNKK

SEQ ID NO: 4620 - protein, 8 aa, Dengue virus
AAIGAVFI

SEQ ID NO: 4621 - protein, 8 aa, Dengue virus
AIGAVFID

SEQ ID NO: 4622 - protein, 8 aa, Dengue virus
IGAVFIDE

SEQ ID NO: 4623 - protein, 8 aa, Dengue virus
GAVFIDEN

SEQ ID NO: 4624 - protein, 8 aa, Dengue virus
AVFIDENQ

SEQ ID NO: 4625 - protein, 8 aa, Dengue virus
VFIDENQW

SEQ ID NO: 4626 - protein, 8 aa, Dengue virus
FIDENQWN

SEQ ID NO: 4627 - protein, 8 aa, Dengue virus
IDENQWNS

SEQ ID NO: 4628 - protein, 8 aa, Dengue virus
AKEAVEDD

SEQ ID NO: 4629 - protein, 8 aa, Dengue virus
KEAVEDDR

SEQ ID NO: 4630 - protein, 8 aa, Dengue virus
EAVEDDRF

SEQ ID NO: 4631 - protein, 8 aa, Dengue virus
AVEDDRFW

SEQ ID NO: 4632 - protein, 8 aa, Dengue virus
VEDDRFWD

SEQ ID NO: 4633 - protein, 8 aa, Dengue virus
EDDRFWDL

SEQ ID NO: 4634 - protein, 8 aa, Dengue virus
DDRFWDLV

SEQ ID NO: 4635 - protein, 8 aa, Dengue virus
LVQKEREL

SEQ ID NO: 4636 - protein, 8 aa, Dengue virus
VQKERELH

SEQ ID NO: 4637 - protein, 8 aa, Dengue virus
QKERELHK

SEQ ID NO: 4638 - protein, 8 aa, Dengue virus
KERELHKQ

SEQ ID NO: 4639 - protein, 8 aa, Dengue virus
WFSRENSF

SEQ ID NO: 4640 - protein, 8 aa, Dengue virus
FSRENSFS

SEQ ID NO: 4641 - protein, 8 aa, Dengue virus
SRENSFSG

SEQ ID NO: 4642 - protein, 8 aa, Dengue virus
RENSFSGV

SEQ ID NO: 4643 - protein, 8 aa, Dengue virus
ENSFSGVE

SEQ ID NO: 4644 - protein, 8 aa, Dengue virus
NSFSGVEG

SEQ ID NO: 4645 - protein, 8 aa, Dengue virus
SFSGVEGE

SEQ ID NO: 4646 - protein, 8 aa, Dengue virus
FSGVEGEG

SEQ ID NO: 4647 - protein, 8 aa, Dengue virus
VEGEGLHR

SEQ ID NO: 4648 - protein, 8 aa, Dengue virus
EGEGLHRL

SEQ ID NO: 4649 - protein, 8 aa, Dengue virus
GEGLHRLG

SEQ ID NO: 4650 - protein, 8 aa, Dengue virus
EGLHRLGY

SEQ ID NO: 4651 - protein, 8 aa, Dengue virus
YILRDISN

SEQ ID NO: 4652 - protein, 8 aa, Dengue virus
ILRDISNI

SEQ ID NO: 4653 - protein, 8 aa, Dengue virus
LRDISNIP

SEQ ID NO: 4654 - protein, 8 aa, Dengue virus
RDISNIPG

SEQ ID NO: 4655 - protein, 8 aa, Dengue virus
DISNIPGG

SEQ ID NO: 4656 - protein, 8 aa, Dengue virus
ISNIPGGN

SEQ ID NO: 4657 - protein, 8 aa, Dengue virus
SNIPGGNM

SEQ ID NO: 4658 - protein, 8 aa, Dengue virus
NIPGGNMY

SEQ ID NO: 4659 - protein, 8 aa, Dengue virus
ISGGNMYA

SEQ ID NO: 4660 - protein, 8 aa, Dengue virus
SGGNMYAD

SEQ ID NO: 4661 - protein, 8 aa, Dengue virus
GGSMYADD

SEQ ID NO: 4662 - protein, 8 aa, Dengue virus
GSMYADDT

SEQ ID NO: 4663 - protein, 8 aa, Dengue virus
SMYADDTA

SEQ ID NO: 4664 - protein, 8 aa, Dengue virus
RVTEDDLQ

SEQ ID NO: 4665 - protein, 8 aa, Dengue virus
VTEDDLQN

SEQ ID NO: 4666 - protein, 8 aa, Dengue virus
DDLQNEAR

SEQ ID NO: 4667 - protein, 8 aa, Dengue virus
DLQNEARI

SEQ ID NO: 4668 - protein, 8 aa, Dengue virus
LQNEARIT

SEQ ID NO: 4669 - protein, 8 aa, Dengue virus
QNEARITD

SEQ ID NO: 4670 - protein, 8 aa, Dengue virus
NEARITDI

SEQ ID NO: 4671 - protein, 8 aa, Dengue virus
EARITDIM

SEQ ID NO: 4672 - protein, 8 aa, Dengue virus
ARITDIME

SEQ ID NO: 4673 - protein, 8 aa, Dengue virus
RITDIMEP

SEQ ID NO: 4674 - protein, 8 aa, Dengue virus
ITEIMEPE

SEQ ID NO: 4675 - protein, 8 aa, Dengue virus
TEIMEPEH

SEQ ID NO: 4676 - protein, 8 aa, Dengue virus
EIMEPEHA

SEQ ID NO: 4677 - protein, 8 aa, Dengue virus
PEHALLAT

SEQ ID NO: 4678 - protein, 8 aa, Dengue virus
EHALLATS

SEQ ID NO: 4679 - protein, 8 aa, Dengue virus
HALLATSI

SEQ ID NO: 4680 - protein, 8 aa, Dengue virus
ALLATSIF

SEQ ID NO: 4681 - protein, 8 aa, Dengue virus
LLATSIFK

SEQ ID NO: 4682 - protein, 8 aa, Dengue virus
LATSIFKL

SEQ ID NO: 4683 - protein, 8 aa, Dengue virus
ATSIFKLT

SEQ ID NO: 4684 - protein, 8 aa, Dengue virus
TSIFKLTY

SEQ ID NO: 4685 - protein, 8 aa, Dengue virus
AIFKLTYQ

SEQ ID NO: 4686 - protein, 8 aa, Dengue virus
VVRVQRPT

SEQ ID NO: 4687 - protein, 8 aa, Dengue virus
VRVQRPAR

SEQ ID NO: 4688 - protein, 8 aa, Dengue virus
RVQRPAKS

SEQ ID NO: 4689 - protein, 8 aa, Dengue virus
VQRPAKSG

SEQ ID NO: 4690 - protein, 8 aa, Dengue virus
QRPAKSGT

SEQ ID NO: 4691 - protein, 8 aa, Dengue virus
RPAKSGTV

SEQ ID NO: 4692 - protein, 8 aa, Dengue virus
PAKSGTVM

SEQ ID NO: 4693 - protein, 8 aa, Dengue virus
AKSGTVMD

SEQ ID NO: 4694 - protein, 8 aa, Dengue virus
KSGTVMDV

SEQ ID NO: 4695 - protein, 8 aa, Dengue virus
SGTVMDVI

SEQ ID NO: 4696 - protein, 8 aa, Dengue virus
LNTFTNMG

SEQ ID NO: 4697 - protein, 8 aa, Dengue virus
NTFTNMEV

SEQ ID NO: 4698 - protein, 8 aa, Dengue virus
TFTNMEVQ

SEQ ID NO: 4699 - protein, 8 aa, Dengue virus
FTNMEVQL

SEQ ID NO: 4700 - protein, 8 aa, Dengue virus
TNMEVQLI

SEQ ID NO: 4701 - protein, 8 aa, Dengue virus
NMEVQLIR

SEQ ID NO: 4702 - protein, 8 aa, Dengue virus
MEVQLIRQ

SEQ ID NO: 4703 - protein, 8 aa, Dengue virus
EVQLIRQM

SEQ ID NO: 4704 - protein, 8 aa, Dengue virus
VQLIRQME

SEQ ID NO: 4705 - protein, 8 aa, Dengue virus
IRQMESEE

SEQ ID NO: 4706 - protein, 8 aa, Dengue virus
RQMESEEI

SEQ ID NO: 4707 - protein, 8 aa, Dengue virus
QMESEEIF

SEQ ID NO: 4708 - protein, 8 aa, Dengue virus
MESEGIFL

SEQ ID NO: 4709 - protein, 8 aa, Dengue virus
ESEGIFLP

SEQ ID NO: 4710 - protein, 8 aa, Dengue virus
ELEIPNLA

SEQ ID NO: 4711 - protein, 8 aa, Dengue virus
ERLRRMAI

SEQ ID NO: 4712 - protein, 8 aa, Dengue virus
RLRRMAIS

SEQ ID NO: 4713 - protein, 8 aa, Dengue virus
LRRMAISG

SEQ ID NO: 4714 - protein, 8 aa, Dengue virus
RRMAISGD

SEQ ID NO: 4715 - protein, 8 aa, Dengue virus
DDCVVKPT

SEQ ID NO: 4716 - protein, 8 aa, Dengue virus
DCVVKPTD

SEQ ID NO: 4717 - protein, 8 aa, Dengue virus
CVVKPTDD

SEQ ID NO: 4718 - protein, 8 aa, Dengue virus
VVKPTDDR

SEQ ID NO: 4719 - protein, 8 aa, Dengue virus
VKPTDDRF

SEQ ID NO: 4720 - protein, 8 aa, Dengue virus
KPTDDRFA

SEQ ID NO: 4721 - protein, 8 aa, Dengue virus
PTDDRFAT

SEQ ID NO: 4722 - protein, 8 aa, Dengue virus
TDDRFATA

SEQ ID NO: 4723 - protein, 8 aa, Dengue virus
DDRFAAAL

SEQ ID NO: 4724 - protein, 8 aa, Dengue virus
DRFATALI

SEQ ID NO: 4725 - protein, 8 aa, Dengue virus
RFATALIA

SEQ ID NO: 4726 - protein, 8 aa, Dengue virus
FATALIAL

SEQ ID NO: 4727 - protein, 8 aa, Dengue virus
ATALIALN

SEQ ID NO: 4728 - protein, 8 aa, Dengue virus
TALIALND

SEQ ID NO: 4729 - protein, 8 aa, Dengue virus
ALIALNDM

SEQ ID NO: 4730 - protein, 8 aa, Dengue virus
LIALNDMG

SEQ ID NO: 4731 - protein, 8 aa, Dengue virus
IALNDMGK

SEQ ID NO: 4732 - protein, 8 aa, Dengue virus
MGKVRKDV

SEQ ID NO: 4733 - protein, 8 aa, Dengue virus
GKVRKDVP

SEQ ID NO: 4734 - protein, 8 aa, Dengue virus
KVRKDVPQ

SEQ ID NO: 4735 - protein, 8 aa, Dengue virus
VRKDVPQW

SEQ ID NO: 4736 - protein, 8 aa, Dengue virus
RKDVPQWE

SEQ ID NO: 4737 - protein, 8 aa, Dengue virus
KDVPQWEP

SEQ ID NO: 4738 - protein, 8 aa, Dengue virus
DVPQWEPS

SEQ ID NO: 4739 - protein, 8 aa, Dengue virus
VPQWEPSK

SEQ ID NO: 4740 - protein, 8 aa, Dengue virus
ANAICSAD

SEQ ID NO: 4741 - protein, 8 aa, Dengue virus
NAICSADP

SEQ ID NO: 4742 - protein, 8 aa, Dengue virus
AICSAVPI

SEQ ID NO: 4743 - protein, 8 aa, Dengue virus
CSAVPVEW

SEQ ID NO: 4744 - protein, 8 aa, Dengue virus
PVDWIPTS

SEQ ID NO: 4745 - protein, 8 aa, Dengue virus
VDWIPTSR

SEQ ID NO: 4746 - protein, 8 aa, Dengue virus
DWIPTSRT

SEQ ID NO: 4747 - protein, 8 aa, Dengue virus
WIPTSRTT

SEQ ID NO: 4748 - protein, 8 aa, Dengue virus
IPTSRTTW

SEQ ID NO: 4749 - protein, 8 aa, Dengue virus
PWMEDKTR

SEQ ID NO: 4750 - protein, 8 aa, Dengue virus
WMEDKTHV

SEQ ID NO: 4751 - protein, 8 aa, Dengue virus
MEDKTHVS

SEQ ID NO: 4752 - protein, 8 aa, Dengue virus
EDKTHVSS

SEQ ID NO: 4753 - protein, 8 aa, Dengue virus
DKTHVSSW

SEQ ID NO: 4754 - protein, 8 aa, Dengue virus
KTHVSSWE

SEQ ID NO: 4755 - protein, 8 aa, Dengue virus
VSSWEEVP

SEQ ID NO: 4756 - protein, 8 aa, Dengue virus
SSWEDVPY

SEQ ID NO: 4757 - protein, 8 aa, Dengue virus
SWEDVPYL

SEQ ID NO: 4758 - protein, 8 aa, Dengue virus
WEDVPYLG

SEQ ID NO: 4759 - protein, 8 aa, Dengue virus
EDVPYLGK

SEQ ID NO: 4760 - protein, 8 aa, Dengue virus
EVPYLGKR

SEQ ID NO: 4761 - protein, 8 aa, Dengue virus
TARATWAS

SEQ ID NO: 4762 - protein, 8 aa, Dengue virus
ARATWASN

SEQ ID NO: 4763 - protein, 8 aa, Dengue virus
RATWASNI

SEQ ID NO: 4764 - protein, 8 aa, Dengue virus
ATWASNIQ

SEQ ID NO: 4765 - protein, 8 aa, Dengue virus
TWASNIQV

SEQ ID NO: 4766 - protein, 8 aa, Dengue virus
WASNIQVA

SEQ ID NO: 4767 - protein, 8 aa, Dengue virus
ASNIQVAI

SEQ ID NO: 4768 - protein, 8 aa, Dengue virus
SNIQVAIN

SEQ ID NO: 4769 - protein, 8 aa, Dengue virus
INQVRRLL

SEQ ID NO: 4770 - protein, 8 aa, Dengue virus
NQVRRLLG

SEQ ID NO: 4771 - protein, 8 aa, Dengue virus
QVRRLLGN

SEQ ID NO: 4772 - protein, 8 aa, Dengue virus
VRRLLGNE

SEQ ID NO: 4773 - protein, 8 aa, Dengue virus
RRLLGNEN

SEQ ID NO: 4774 - protein, 8 aa, Dengue virus
RLLGNENY

SEQ ID NO: 4775 - protein, 8 aa, Dengue virus
LLGNENYL

SEQ ID NO: 4776 - protein, 8 aa, Dengue virus
LGNENYLD

SEQ ID NO: 4777 - protein, 8 aa, Dengue virus
GNENYSDY

SEQ ID NO: 4778 - protein, 8 aa, Dengue virus
NENYSDYM

SEQ ID NO: 4779 - protein, 8 aa, Dengue virus
ENYSDYMT

SEQ ID NO: 4780 - protein, 8 aa, Dengue virus
NYSDYMTS

SEQ ID NO: 4781 - protein, 8 aa, Dengue virus
YSDYMTSM

SEQ ID NO: 4782 - protein, 8 aa, Dengue virus
SDYMTSMK

SEQ ID NO: 4783 - protein, 8 aa, Dengue virus
DYMISMKR

SEQ ID NO: 4784 - protein, 8 aa, Dengue virus
YMISMKRF

SEQ ID NO: 4785 - protein, 8 aa, Dengue virus
MISMKRFK

SEQ ID NO: 4786 - protein, 8 aa, Dengue virus
ISMKRFKN

SEQ ID NO: 4787 - protein, 8 aa, Dengue virus
SMKRFKND

SEQ ID NO: 4788 - protein, 8 aa, Dengue virus
MKRFKNEG

SEQ ID NO: 4789 - protein, 8 aa, Dengue virus
INQRKKTG

SEQ ID NO: 4790 - protein, 8 aa, Dengue virus
NQRKKTGQ

SEQ ID NO: 4791 - protein, 8 aa, Dengue virus
QRKKTGQP

SEQ ID NO: 4792 - protein, 8 aa, Dengue virus
RKKTGQPS

SEQ ID NO: 4793 - protein, 8 aa, Dengue virus
KKTGQPSF

SEQ ID NO: 4794 - protein, 8 aa, Dengue virus
KTGQPSFN

SEQ ID NO: 4795 - protein, 8 aa, Dengue virus
TGQPSFNM

SEQ ID NO: 4796 - protein, 8 aa, Dengue virus
GQPSFNML

SEQ ID NO: 4797 - protein, 8 aa, Dengue virus
SGQGPMKF

SEQ ID NO: 4798 - protein, 8 aa, Dengue virus
GQGPMKFV

SEQ ID NO: 4799 - protein, 8 aa, Dengue virus
QGPMKFVM

SEQ ID NO: 4800 - protein, 8 aa, Dengue virus
GPMKFVMA

SEQ ID NO: 4801 - protein, 8 aa, Dengue virus
PMKFVMAF

SEQ ID NO: 4802 - protein, 8 aa, Dengue virus
MKFVMAFI

SEQ ID NO: 4803 - protein, 8 aa, Dengue virus
KFVMAFIA

SEQ ID NO: 4804 - protein, 8 aa, Dengue virus
FVMAFIAF

SEQ ID NO: 4805 - protein, 8 aa, Dengue virus
RWSSFKKN

SEQ ID NO: 4806 - protein, 8 aa, Dengue virus
WSSFKKNG

SEQ ID NO: 4807 - protein, 8 aa, Dengue virus
SSFKKNGA

SEQ ID NO: 4808 - protein, 8 aa, Dengue virus
LRGFKREI

SEQ ID NO: 4809 - protein, 8 aa, Dengue virus
RGFKREIS

SEQ ID NO: 4810 - protein, 8 aa, Dengue virus
GFKKEVSN

SEQ ID NO: 4811 - protein, 8 aa, Dengue virus
FKKEVSNM

SEQ ID NO: 4812 - protein, 8 aa, Dengue virus
KKEVSNML

SEQ ID NO: 4813 - protein, 8 aa, Dengue virus
KEVSNMLN

SEQ ID NO: 4814 - protein, 8 aa, Dengue virus
EISNMLNT

SEQ ID NO: 4815 - protein, 8 aa, Dengue virus
MLNIINRR

SEQ ID NO: 4816 - protein, 8 aa, Dengue virus
LNIINRRK

SEQ ID NO: 4817 - protein, 8 aa, Dengue virus
INRRKRSV

SEQ ID NO: 4818 - protein, 8 aa, Dengue virus
RRRKSVTM

SEQ ID NO: 4819 - protein, 8 aa, Dengue virus
RKRSVTMF

SEQ ID NO: 4820 - protein, 8 aa, Dengue virus
KRSVTMFL

SEQ ID NO: 4821 - protein, 8 aa, Dengue virus
RSVTMFLM

SEQ ID NO: 4822 - protein, 8 aa, Dengue virus
SVTMILML

SEQ ID NO: 4823 - protein, 8 aa, Dengue virus
PTVLAFHL

SEQ ID NO: 4824 - protein, 8 aa, Dengue virus
TVLAFHLT

SEQ ID NO: 4825 - protein, 8 aa, Dengue virus
VLAFHLTT

SEQ ID NO: 4826 - protein, 8 aa, Dengue virus
GEPHMVVS

SEQ ID NO: 4827 - protein, 8 aa, Dengue virus
EPHMVVSK

SEQ ID NO: 4828 - protein, 8 aa, Dengue virus
PHMVVSKQ

SEQ ID NO: 4829 - protein, 8 aa, Dengue virus
HMVVSKQE

SEQ ID NO: 4830 - protein, 8 aa, Dengue virus
MVVSKQER

SEQ ID NO: 4831 - protein, 8 aa, Dengue virus
VVSKQERG

SEQ ID NO: 4832 - protein, 8 aa, Dengue virus
VGKQERGK

SEQ ID NO: 4833 - protein, 8 aa, Dengue virus
GKQERGKS

SEQ ID NO: 4834 - protein, 8 aa, Dengue virus
SLLFKTST

SEQ ID NO: 4835 - protein, 8 aa, Dengue virus
LLFKTSTG

SEQ ID NO: 4836 - protein, 8 aa, Dengue virus
LFKTSAGI

SEQ ID NO: 4837 - protein, 8 aa, Dengue virus
FKTSAGIN

SEQ ID NO: 4838 - protein, 8 aa, Dengue virus
KTSAGINM

SEQ ID NO: 4839 - protein, 8 aa, Dengue virus
TSAGINMC

SEQ ID NO: 4840 - protein, 8 aa, Dengue virus
SAGINMCT

SEQ ID NO: 4841 - protein, 8 aa, Dengue virus
AGINMCTL

SEQ ID NO: 4842 - protein, 8 aa, Dengue virus
MDLGELCD

SEQ ID NO: 4843 - protein, 8 aa, Dengue virus
DLGELCDD

SEQ ID NO: 4844 - protein, 8 aa, Dengue virus
LGELCDDT

SEQ ID NO: 4845 - protein, 8 aa, Dengue virus
GELCDDTM

SEQ ID NO: 4846 - protein, 8 aa, Dengue virus
ELCDDTMT

SEQ ID NO: 4847 - protein, 8 aa, Dengue virus
LCDDTMTY

SEQ ID NO: 4848 - protein, 8 aa, Dengue virus
CEDTITYK

SEQ ID NO: 4849 - protein, 8 aa, Dengue virus
EDTITYKC

SEQ ID NO: 4850 - protein, 8 aa, Dengue virus
TITYKCPR

SEQ ID NO: 4851 - protein, 8 aa, Dengue virus
ITYKCPRI

SEQ ID NO: 4852 - protein, 8 aa, Dengue virus
YKCPRISE

SEQ ID NO: 4853 - protein, 8 aa, Dengue virus
KCPQITEA

SEQ ID NO: 4854 - protein, 8 aa, Dengue virus
CPQITEAE

SEQ ID NO: 4855 - protein, 8 aa, Dengue virus
PQITEAEP

SEQ ID NO: 4856 - protein, 8 aa, Dengue virus
QITEAEPD

SEQ ID NO: 4857 - protein, 8 aa, Dengue virus
ITEVEPDD

SEQ ID NO: 4858 - protein, 8 aa, Dengue virus
TEVEPDDV

SEQ ID NO: 4859 - protein, 8 aa, Dengue virus
EVEPDDVD

SEQ ID NO: 4860 - protein, 8 aa, Dengue virus
VEPDDVDC

SEQ ID NO: 4861 - protein, 8 aa, Dengue virus
DCWCNTTD

SEQ ID NO: 4862 - protein, 8 aa, Dengue virus
CWCNTTDT

SEQ ID NO: 4863 - protein, 8 aa, Dengue virus
WCNTTDTW

SEQ ID NO: 4864 - protein, 8 aa, Dengue virus
CNTTDTWV

SEQ ID NO: 4865 - protein, 8 aa, Dengue virus
NTTDTWVT

SEQ ID NO: 4866 - protein, 8 aa, Dengue virus
TTDTWVTY

SEQ ID NO: 4867 - protein, 8 aa, Dengue virus
TCSQTGGH

SEQ ID NO: 4868 - protein, 8 aa, Dengue virus
CSQTGGHR

SEQ ID NO: 4869 - protein, 8 aa, Dengue virus
SQTGGHRR

SEQ ID NO: 4870 - protein, 8 aa, Dengue virus
QIGEHRRD

SEQ ID NO: 4871 - protein, 8 aa, Dengue virus
IGEHRRDK

SEQ ID NO: 4872 - protein, 8 aa, Dengue virus
GAWRQIQK

SEQ ID NO: 4873 - protein, 8 aa, Dengue virus
AWRQIQKV

SEQ ID NO: 4874 - protein, 8 aa, Dengue virus
WRQIQKVE

SEQ ID NO: 4875 - protein, 8 aa, Dengue virus
RQIQKVET

SEQ ID NO: 4876 - protein, 8 aa, Dengue virus
IQRVETWV

SEQ ID NO: 4877 - protein, 8 aa, Dengue virus
RHPGFTVM

SEQ ID NO: 4878 - protein, 8 aa, Dengue virus
HPGFTVMA

SEQ ID NO: 4879 - protein, 8 aa, Dengue virus
PGFTVTAL

SEQ ID NO: 4880 - protein, 8 aa, Dengue virus
GFTVTALF

SEQ ID NO: 4881 - protein, 8 aa, Dengue virus
FTVTALFL

SEQ ID NO: 4882 - protein, 8 aa, Dengue virus
TVTALFLA

SEQ ID NO: 4883 - protein, 8 aa, Dengue virus
VTALFLAH

SEQ ID NO: 4884 - protein, 8 aa, Dengue virus
ALFLAHVI

SEQ ID NO: 4885 - protein, 8 aa, Dengue virus
LFLAHVIG

SEQ ID NO: 4886 - protein, 8 aa, Dengue virus
TEVTDPAV

SEQ ID NO: 4887 - protein, 8 aa, Dengue virus
EVTDPAVL

SEQ ID NO: 4888 - protein, 8 aa, Dengue virus
VTDPAVLR

SEQ ID NO: 4889 - protein, 8 aa, Dengue virus
TDPAVLRK

SEQ ID NO: 4890 - protein, 8 aa, Dengue virus
DPAVLRKL

SEQ ID NO: 4891 - protein, 8 aa, Dengue virus
TLVEEQDT

SEQ ID NO: 4892 - protein, 8 aa, Dengue virus
LVEEQDTN

SEQ ID NO: 4893 - protein, 8 aa, Dengue virus
VEEQDTNF

SEQ ID NO: 4894 - protein, 8 aa, Dengue virus
EEQDSNFV

SEQ ID NO: 4895 - protein, 8 aa, Dengue virus
EQDSNFVC

SEQ ID NO: 4896 - protein, 8 aa, Dengue virus
QDSNFVCR

SEQ ID NO: 4897 - protein, 8 aa, Dengue virus
DSNFVCRR

SEQ ID NO: 4898 - protein, 8 aa, Dengue virus
SNFVCRRT

SEQ ID NO: 4899 - protein, 8 aa, Dengue virus
KGSLMTCA

SEQ ID NO: 4900 - protein, 8 aa, Dengue virus
GSLMTCAK

SEQ ID NO: 4901 - protein, 8 aa, Dengue virus
SLMTCAKF

SEQ ID NO: 4902 - protein, 8 aa, Dengue virus
LMTCAKFK

SEQ ID NO: 4903 - protein, 8 aa, Dengue virus
MTCAKFKC

SEQ ID NO: 4904 - protein, 8 aa, Dengue virus
TKLEGKIA

SEQ ID NO: 4905 - protein, 8 aa, Dengue virus
KLEGKIAQ

SEQ ID NO: 4906 - protein, 8 aa, Dengue virus
LEGKIAQY

SEQ ID NO: 4907 - protein, 8 aa, Dengue virus
EGKIAQYE

SEQ ID NO: 4908 - protein, 8 aa, Dengue virus
GKIAQYEN

SEQ ID NO: 4909 - protein, 8 aa, Dengue virus
KIAQYENL

SEQ ID NO: 4910 - protein, 8 aa, Dengue virus
IAQYENLK

SEQ ID NO: 4911 - protein, 8 aa, Dengue virus
QVGNETTD

SEQ ID NO: 4912 - protein, 8 aa, Dengue virus
VGNETTDH

SEQ ID NO: 4913 - protein, 8 aa, Dengue virus
GNETTDHG

SEQ ID NO: 4914 - protein, 8 aa, Dengue virus
NETTDHGT

SEQ ID NO: 4915 - protein, 8 aa, Dengue virus
ETTEHGTT

SEQ ID NO: 4916 - protein, 8 aa, Dengue virus
TTEHGTTA

SEQ ID NO: 4917 - protein, 8 aa, Dengue virus
TDHGTTAT

SEQ ID NO: 4918 - protein, 8 aa, Dengue virus
DHGTTATI

SEQ ID NO: 4919 - protein, 8 aa, Dengue virus
ITPQAPST

SEQ ID NO: 4920 - protein, 8 aa, Dengue virus
TPQAPSTE

SEQ ID NO: 4921 - protein, 8 aa, Dengue virus
PQAPSTEI

SEQ ID NO: 4922 - protein, 8 aa, Dengue virus
QAPSTEIQ

SEQ ID NO: 4923 - protein, 8 aa, Dengue virus
APSTEIQL

SEQ ID NO: 4924 - protein, 8 aa, Dengue virus
PSTEIQLT

SEQ ID NO: 4925 - protein, 8 aa, Dengue virus
STEIQLTD

SEQ ID NO: 4926 - protein, 8 aa, Dengue virus
IQLTDYGV

SEQ ID NO: 4927 - protein, 8 aa, Dengue virus
QLTDYGVL

SEQ ID NO: 4928 - protein, 8 aa, Dengue virus
LTDYGVLT

SEQ ID NO: 4929 - protein, 8 aa, Dengue virus
TDYGVLTL

SEQ ID NO: 4930 - protein, 8 aa, Dengue virus
MVLLTMKG

SEQ ID NO: 4931 - protein, 8 aa, Dengue virus
VLLTMEKK

SEQ ID NO: 4932 - protein, 8 aa, Dengue virus
LLTMKEKA

SEQ ID NO: 4933 - protein, 8 aa, Dengue virus
LTMKEKAW

SEQ ID NO: 4934 - protein, 8 aa, Dengue virus
TMKEKAWL

SEQ ID NO: 4935 - protein, 8 aa, Dengue virus
MKEKAWLV

SEQ ID NO: 4936 - protein, 8 aa, Dengue virus
KEKAWLVH

SEQ ID NO: 4937 - protein, 8 aa, Dengue virus
EKAWLVHK

SEQ ID NO: 4938 - protein, 8 aa, Dengue virus
LPWTSGAL

SEQ ID NO: 4939 - protein, 8 aa, Dengue virus
PWTSGALT

SEQ ID NO: 4940 - protein, 8 aa, Dengue virus
LTSQETWN

SEQ ID NO: 4941 - protein, 8 aa, Dengue virus
TLQETWNR

SEQ ID NO: 4942 - protein, 8 aa, Dengue virus
TQETWNRQ

SEQ ID NO: 4943 - protein, 8 aa, Dengue virus
DKLTLRGM

SEQ ID NO: 4944 - protein, 8 aa, Dengue virus
KLTLRGMS

SEQ ID NO: 4945 - protein, 8 aa, Dengue virus
LTLRGMSY

SEQ ID NO: 4946 - protein, 8 aa, Dengue virus
TLRGMSYV

SEQ ID NO: 4947 - protein, 8 aa, Dengue virus
LRGMSYVM

SEQ ID NO: 4948 - protein, 8 aa, Dengue virus
RGMSYVMC

SEQ ID NO: 4949 - protein, 8 aa, Dengue virus
GISYVMCT

SEQ ID NO: 4950 - protein, 8 aa, Dengue virus
ISYVMCTG

SEQ ID NO: 4951 - protein, 8 aa, Dengue virus
SYVMCTGP

SEQ ID NO: 4952 - protein, 8 aa, Dengue virus
YVMCTGLF

SEQ ID NO: 4953 - protein, 8 aa, Dengue virus
VMCTGPFK

SEQ ID NO: 4954 - protein, 8 aa, Dengue virus
MCTGLFKL

SEQ ID NO: 4955 - protein, 8 aa, Dengue virus
CTGPFKLE

SEQ ID NO: 4956 - protein, 8 aa, Dengue virus
TGLFKLEK

SEQ ID NO: 4957 - protein, 8 aa, Dengue virus
GLFKLEKE

SEQ ID NO: 4958 - protein, 8 aa, Dengue virus
PFKLEKEV

SEQ ID NO: 4959 - protein, 8 aa, Dengue virus
GTVLVQIR

SEQ ID NO: 4960 - protein, 8 aa, Dengue virus
TVLVQIRY

SEQ ID NO: 4961 - protein, 8 aa, Dengue virus
VLVQIRYE

SEQ ID NO: 4962 - protein, 8 aa, Dengue virus
VQIRYEGT

SEQ ID NO: 4963 - protein, 8 aa, Dengue virus
QIRYEGTD

SEQ ID NO: 4964 - protein, 8 aa, Dengue virus
IRYEGTDA

SEQ ID NO: 4965 - protein, 8 aa, Dengue virus
PCKIPFSS

SEQ ID NO: 4966 - protein, 8 aa, Dengue virus
CKIPFSSQ

SEQ ID NO: 4967 - protein, 8 aa, Dengue virus
KIPFSSQD

SEQ ID NO: 4968 - protein, 8 aa, Dengue virus
IPFSSQDE

SEQ ID NO: 4969 - protein, 8 aa, Dengue virus
QDEKGATQ

SEQ ID NO: 4970 - protein, 8 aa, Dengue virus
DEKGATQN

SEQ ID NO: 4971 - protein, 8 aa, Dengue virus
EKGATQNG

SEQ ID NO: 4972 - protein, 8 aa, Dengue virus
KGATQNGR

SEQ ID NO: 4973 - protein, 8 aa, Dengue virus
GATQNGRL

SEQ ID NO: 4974 - protein, 8 aa, Dengue virus
ATQNGRLI

SEQ ID NO: 4975 - protein, 8 aa, Dengue virus
TQNGRLVT

SEQ ID NO: 4976 - protein, 8 aa, Dengue virus
QNGRVITA

SEQ ID NO: 4977 - protein, 8 aa, Dengue virus
NGRVITAN

SEQ ID NO: 4978 - protein, 8 aa, Dengue virus
GRVITANP

SEQ ID NO: 4979 - protein, 8 aa, Dengue virus
RVITANPI

SEQ ID NO: 4980 - protein, 8 aa, Dengue virus
VITANPIV

SEQ ID NO: 4981 - protein, 8 aa, Dengue virus
NPIVTDRE

SEQ ID NO: 4982 - protein, 8 aa, Dengue virus
PIVTDREK

SEQ ID NO: 4983 - protein, 8 aa, Dengue virus
IVTDREKP

SEQ ID NO: 4984 - protein, 8 aa, Dengue virus
VTDREKPV

SEQ ID NO: 4985 - protein, 8 aa, Dengue virus
TDREKPVN

SEQ ID NO: 4986 - protein, 8 aa, Dengue virus
DREKPVNI

SEQ ID NO: 4987 - protein, 8 aa, Dengue virus
REKPVNIE

SEQ ID NO: 4988 - protein, 8 aa, Dengue virus
DKPVNIEA

SEQ ID NO: 4989 - protein, 8 aa, Dengue virus
PFGESYIT

SEQ ID NO: 4990 - protein, 8 aa, Dengue virus
FGESYIII

SEQ ID NO: 4991 - protein, 8 aa, Dengue virus
GESYIIIG

SEQ ID NO: 4992 - protein, 8 aa, Dengue virus
IGVGEKAL

SEQ ID NO: 4993 - protein, 8 aa, Dengue virus
GAGEKTLK

SEQ ID NO: 4994 - protein, 8 aa, Dengue virus
AGEKTLKL

SEQ ID NO: 4995 - protein, 8 aa, Dengue virus
SWFKKGST

SEQ ID NO: 4996 - protein, 8 aa, Dengue virus
WFKKGSTI

SEQ ID NO: 4997 - protein, 8 aa, Dengue virus
FKKGSTIG

SEQ ID NO: 4998 - protein, 8 aa, Dengue virus
KKGSTIGK

SEQ ID NO: 4999 - protein, 8 aa, Dengue virus
KGSTIGKM

SEQ ID NO: 5000 - protein, 8 aa, Dengue virus
SSIGKMFV

SEQ ID NO: 5001 - protein, 8 aa, Dengue virus
NIGKMFEA

SEQ ID NO: 5002 - protein, 8 aa, Dengue virus
DFGSIGGL

SEQ ID NO: 5003 - protein, 8 aa, Dengue virus
FGSIGGLF

SEQ ID NO: 5004 - protein, 8 aa, Dengue virus
GSIGGLFT

SEQ ID NO: 5005 - protein, 8 aa, Dengue virus
SIGGLFTS

SEQ ID NO: 5006 - protein, 8 aa, Dengue virus
GGVFTSMG

SEQ ID NO: 5007 - protein, 8 aa, Dengue virus
GLFTSVGK

SEQ ID NO: 5008 - protein, 8 aa, Dengue virus
LFTSVGKL

SEQ ID NO: 5009 - protein, 8 aa, Dengue virus
FTSIGKLV

SEQ ID NO: 5010 - protein, 8 aa, Dengue virus
TSIGKLVH

SEQ ID NO: 5011 - protein, 8 aa, Dengue virus
SIGKLVHQ

SEQ ID NO: 5012 - protein, 8 aa, Dengue virus
GKLIHQIF

SEQ ID NO: 5013 - protein, 8 aa, Dengue virus
KLIHQIFG

SEQ ID NO: 5014 - protein, 8 aa, Dengue virus
LIHQIFGT

SEQ ID NO: 5015 - protein, 8 aa, Dengue virus
IHQIFGTA

SEQ ID NO: 5016 - protein, 8 aa, Dengue virus
HQVFGAAY

SEQ ID NO: 5017 - protein, 8 aa, Dengue virus
QVFGAAYG

SEQ ID NO: 5018 - protein, 8 aa, Dengue virus
VFGAAYGV

SEQ ID NO: 5019 - protein, 8 aa, Dengue virus
TMKIGLGV

SEQ ID NO: 5020 - protein, 8 aa, Dengue virus
MKIGLGVL

SEQ ID NO: 5021 - protein, 8 aa, Dengue virus
KIGLGVLL

SEQ ID NO: 5022 - protein, 8 aa, Dengue virus
IGLGVLLT

SEQ ID NO: 5023 - protein, 8 aa, Dengue virus
GLGVLLTW

SEQ ID NO: 5024 - protein, 8 aa, Dengue virus
LGVLLTWL

SEQ ID NO: 5025 - protein, 8 aa, Dengue virus
LGLNSRSA

SEQ ID NO: 5026 - protein, 8 aa, Dengue virus
GLNSRNTS

SEQ ID NO: 5027 - protein, 8 aa, Dengue virus
LNSRSASL

SEQ ID NO: 5028 - protein, 8 aa, Dengue virus
NSRSASLS

SEQ ID NO: 5029 - protein, 8 aa, Dengue virus
SRSASLSM

SEQ ID NO: 5030 - protein, 8 aa, Dengue virus
RSASLSMT

SEQ ID NO: 5031 - protein, 8 aa, Dengue virus
SASLSMTC

SEQ ID NO: 5032 - protein, 8 aa, Dengue virus
ASLSMTCI

SEQ ID NO: 5033 - protein, 8 aa, Dengue virus
SLSVMCIA

SEQ ID NO: 5034 - protein, 8 aa, Dengue virus
LSMTCIVV

SEQ ID NO: 5035 - protein, 8 aa, Dengue virus
SVMCIAVG

SEQ ID NO: 5036 - protein, 8 aa, Dengue virus
VMCIAVGM

SEQ ID NO: 5037 - protein, 8 aa, Dengue virus
TCIAVGLI

SEQ ID NO: 5038 - protein, 8 aa, Dengue virus
CIAVGLIT

SEQ ID NO: 5039 - protein, 8 aa, Dengue virus
IAVGLITL

SEQ ID NO: 5040 - protein, 8 aa, Dengue virus
AVGLITLY

SEQ ID NO: 5041 - protein, 8 aa, Dengue virus
VGLITLYL

SEQ ID NO: 5042 - protein, 8 aa, Dengue virus
GLITLYLG

SEQ ID NO: 5043 - protein, 8 aa, Dengue virus
LITLYLGV

SEQ ID NO: 5044 - protein, 8 aa, Dengue virus
GVCGIRSV

SEQ ID NO: 5045 - protein, 8 aa, Dengue virus
VCGIRSVT

SEQ ID NO: 5046 - protein, 8 aa, Dengue virus
CGIRSVTR

SEQ ID NO: 5047 - protein, 8 aa, Dengue virus
GIRSVTRL

SEQ ID NO: 5048 - protein, 8 aa, Dengue virus
IRSVTRLE

SEQ ID NO: 5049 - protein, 8 aa, Dengue virus
RSVTRLEN

SEQ ID NO: 5050 - protein, 8 aa, Dengue virus
SVTRLENI

SEQ ID NO: 5051 - protein, 8 aa, Dengue virus
VTRLENIM

SEQ ID NO: 5052 - protein, 8 aa, Dengue virus
NYILLEND

SEQ ID NO: 5053 - protein, 8 aa, Dengue virus
YILLENDM

SEQ ID NO: 5054 - protein, 8 aa, Dengue virus
ILLENDIK

SEQ ID NO: 5055 - protein, 8 aa, Dengue virus
LLENGMKF

SEQ ID NO: 5056 - protein, 8 aa, Dengue virus
LENGMKFT

SEQ ID NO: 5057 - protein, 8 aa, Dengue virus
ENGMKFTV

SEQ ID NO: 5058 - protein, 8 aa, Dengue virus
NGMKFTVV

SEQ ID NO: 5059 - protein, 8 aa, Dengue virus
GMKFTVVV

SEQ ID NO: 5060 - protein, 8 aa, Dengue virus
IKFTVVVG

SEQ ID NO: 5061 - protein, 8 aa, Dengue virus
KFTVVVGN

SEQ ID NO: 5062 - protein, 8 aa, Dengue virus
LTVVVGDV

SEQ ID NO: 5063 - protein, 8 aa, Dengue virus
GILVQGKK

SEQ ID NO: 5064 - protein, 8 aa, Dengue virus
QGRKMIRP

SEQ ID NO: 5065 - protein, 8 aa, Dengue virus
GRKMIRPQ

SEQ ID NO: 5066 - protein, 8 aa, Dengue virus
KKMVRPQP

SEQ ID NO: 5067 - protein, 8 aa, Dengue virus
KMVRPQPM

SEQ ID NO: 5068 - protein, 8 aa, Dengue virus
MVRPQPME

SEQ ID NO: 5069 - protein, 8 aa, Dengue virus
RPQPMEHR

SEQ ID NO: 5070 - protein, 8 aa, Dengue virus
PQPMEHRY

SEQ ID NO: 5071 - protein, 8 aa, Dengue virus
QPMEHRYS

SEQ ID NO: 5072 - protein, 8 aa, Dengue virus
PMEHRYSW

SEQ ID NO: 5073 - protein, 8 aa, Dengue virus
MEHRYSWK

SEQ ID NO: 5074 - protein, 8 aa, Dengue virus
EHRYSWKS

SEQ ID NO: 5075 - protein, 8 aa, Dengue virus
HRYSWKSW

SEQ ID NO: 5076 - protein, 8 aa, Dengue virus
KYSWRSWG

SEQ ID NO: 5077 - protein, 8 aa, Dengue virus
YSWRSWGK

SEQ ID NO: 5078 - protein, 8 aa, Dengue virus
SWKIWGKA

SEQ ID NO: 5079 - protein, 8 aa, Dengue virus
WKIWGKAK

SEQ ID NO: 5080 - protein, 8 aa, Dengue virus
RSWGKAKI

SEQ ID NO: 5081 - protein, 8 aa, Dengue virus
AKIIGADA

SEQ ID NO: 5082 - protein, 8 aa, Dengue virus
KIIGADAQ

SEQ ID NO: 5083 - protein, 8 aa, Dengue virus
IIGADAQN

SEQ ID NO: 5084 - protein, 8 aa, Dengue virus
QNATFIID

SEQ ID NO: 5085 - protein, 8 aa, Dengue virus
NATFIIDG

SEQ ID NO: 5086 - protein, 8 aa, Dengue virus
ATFIIDGP

SEQ ID NO: 5087 - protein, 8 aa, Dengue virus
GPNTPECS

SEQ ID NO: 5088 - protein, 8 aa, Dengue virus
PNTPECSD

SEQ ID NO: 5089 - protein, 8 aa, Dengue virus
ECPDGQRA

SEQ ID NO: 5090 - protein, 8 aa, Dengue virus
CPDGQRAW

SEQ ID NO: 5091 - protein, 8 aa, Dengue virus
PDGQRAWN

SEQ ID NO: 5092 - protein, 8 aa, Dengue virus
DGQRAWNI

SEQ ID NO: 5093 - protein, 8 aa, Dengue virus
GQRAWNIW

SEQ ID NO: 5094 - protein, 8 aa, Dengue virus
WLKMRDSY

SEQ ID NO: 5095 - protein, 8 aa, Dengue virus
LKMRDSYT

SEQ ID NO: 5096 - protein, 8 aa, Dengue virus
KMRDSYTQ

SEQ ID NO: 5097 - protein, 8 aa, Dengue virus
RDSHTQVC

SEQ ID NO: 5098 - protein, 8 aa, Dengue virus
DSHTQVCD

SEQ ID NO: 5099 - protein, 8 aa, Dengue virus
SHTQVCDH

SEQ ID NO: 5100 - protein, 8 aa, Dengue virus
HTQVCDHR

SEQ ID NO: 5101 - protein, 8 aa, Dengue virus
TQACDHRL

SEQ ID NO: 5102 - protein, 8 aa, Dengue virus
QACDHRLM

SEQ ID NO: 5103 - protein, 8 aa, Dengue virus
ACDHRLMS

SEQ ID NO: 5104 - protein, 8 aa, Dengue virus
KNETWKLT

SEQ ID NO: 5105 - protein, 8 aa, Dengue virus
NETWKLAG

SEQ ID NO: 5106 - protein, 8 aa, Dengue virus
ETWKLAGA

SEQ ID NO: 5107 - protein, 8 aa, Dengue virus
TWKLAGAS

SEQ ID NO: 5108 - protein, 8 aa, Dengue virus
WKLAGASF

SEQ ID NO: 5109 - protein, 8 aa, Dengue virus
KLAGASFI

SEQ ID NO: 5110 - protein, 8 aa, Dengue virus
LAGASFIE

SEQ ID NO: 5111 - protein, 8 aa, Dengue virus
AGASFIEV

SEQ ID NO: 5112 - protein, 8 aa, Dengue virus
FIEVKTCV

SEQ ID NO: 5113 - protein, 8 aa, Dengue virus
IEVKTCVW

SEQ ID NO: 5114 - protein, 8 aa, Dengue virus
EVKTCVWP

SEQ ID NO: 5115 - protein, 8 aa, Dengue virus
VKTCVWPK

SEQ ID NO: 5116 - protein, 8 aa, Dengue virus
KTCVWPKS

SEQ ID NO: 5117 - protein, 8 aa, Dengue virus
TCVWPKSH

SEQ ID NO: 5118 - protein, 8 aa, Dengue virus
CVWPKSHT

SEQ ID NO: 5119 - protein, 8 aa, Dengue virus
VWPKSHTL

SEQ ID NO: 5120 - protein, 8 aa, Dengue virus
SEMIIPKM

SEQ ID NO: 5121 - protein, 8 aa, Dengue virus
EMVIPKIY

SEQ ID NO: 5122 - protein, 8 aa, Dengue virus
MVIPKIYG

SEQ ID NO: 5123 - protein, 8 aa, Dengue virus
VIPKIYGG

SEQ ID NO: 5124 - protein, 8 aa, Dengue virus
IPKMYGGP

SEQ ID NO: 5125 - protein, 8 aa, Dengue virus
PKIYGGPT

SEQ ID NO: 5126 - protein, 8 aa, Dengue virus
KIYGGPTS

SEQ ID NO: 5127 - protein, 8 aa, Dengue virus
IYGGPTSQ

SEQ ID NO: 5128 - protein, 8 aa, Dengue virus
YGGPTSQH

SEQ ID NO: 5129 - protein, 8 aa, Dengue virus
GPISQHNH

SEQ ID NO: 5130 - protein, 8 aa, Dengue virus
PISQHNHR

SEQ ID NO: 5131 - protein, 8 aa, Dengue virus
ISQHNHRP

SEQ ID NO: 5132 - protein, 8 aa, Dengue virus
KLELDFDF

SEQ ID NO: 5133 - protein, 8 aa, Dengue virus
LELDFDFC

SEQ ID NO: 5134 - protein, 8 aa, Dengue virus
ELDFDFCE

SEQ ID NO: 5135 - protein, 8 aa, Dengue virus
LDFDFCEG

SEQ ID NO: 5136 - protein, 8 aa, Dengue virus
DFDFCEGT

SEQ ID NO: 5137 - protein, 8 aa, Dengue virus
FDFCEGTT

SEQ ID NO: 5138 - protein, 8 aa, Dengue virus
DFCEGTTV

SEQ ID NO: 5139 - protein, 8 aa, Dengue virus
VVDEHCGS

SEQ ID NO: 5140 - protein, 8 aa, Dengue virus
VDEHCGSR

SEQ ID NO: 5141 - protein, 8 aa, Dengue virus
DEHCGSRG

SEQ ID NO: 5142 - protein, 8 aa, Dengue virus
EHCGSRGP

SEQ ID NO: 5143 - protein, 8 aa, Dengue virus
HCGYRGPS

SEQ ID NO: 5144 - protein, 8 aa, Dengue virus
CGSRGPSL

SEQ ID NO: 5145 - protein, 8 aa, Dengue virus
GSRGPSLR

SEQ ID NO: 5146 - protein, 8 aa, Dengue virus
SRGPSLRT

SEQ ID NO: 5147 - protein, 8 aa, Dengue virus
DKEENLVK

SEQ ID NO: 5148 - protein, 8 aa, Dengue virus
KSMVSAGL

SEQ ID NO: 5149 - protein, 8 aa, Dengue virus
SGEVDNFS

SEQ ID NO: 5150 - protein, 8 aa, Dengue virus
FSLGILCA

SEQ ID NO: 5151 - protein, 8 aa, Dengue virus
SLGILCAS

SEQ ID NO: 5152 - protein, 8 aa, Dengue virus
LGILCASI

SEQ ID NO: 5153 - protein, 8 aa, Dengue virus
SIIIEEVM

SEQ ID NO: 5154 - protein, 8 aa, Dengue virus
IIIEEVMR

SEQ ID NO: 5155 - protein, 8 aa, Dengue virus
IIEEVMRS

SEQ ID NO: 5156 - protein, 8 aa, Dengue virus
MRSRWSKK

SEQ ID NO: 5157 - protein, 8 aa, Dengue virus
RSRWSKKM

SEQ ID NO: 5158 - protein, 8 aa, Dengue virus
SRWSKKML

SEQ ID NO: 5159 - protein, 8 aa, Dengue virus
RWSKKMLM

SEQ ID NO: 5160 - protein, 8 aa, Dengue virus
WSKKMLMT

SEQ ID NO: 5161 - protein, 8 aa, Dengue virus
SKKMLMTG

SEQ ID NO: 5162 - protein, 8 aa, Dengue virus
KKMLMTGT

SEQ ID NO: 5163 - protein, 8 aa, Dengue virus
KMLMTGIL

SEQ ID NO: 5164 - protein, 8 aa, Dengue virus
MLMTGILA

SEQ ID NO: 5165 - protein, 8 aa, Dengue virus
LMTGILAV

SEQ ID NO: 5166 - protein, 8 aa, Dengue virus
MTGILAVF

SEQ ID NO: 5167 - protein, 8 aa, Dengue virus
GTLVVFLL

SEQ ID NO: 5168 - protein, 8 aa, Dengue virus
TLVVFLLL

SEQ ID NO: 5169 - protein, 8 aa, Dengue virus
QLTWNDLT

SEQ ID NO: 5170 - protein, 8 aa, Dengue virus
LTWNDLTR

SEQ ID NO: 5171 - protein, 8 aa, Dengue virus
TWSDLIRL

SEQ ID NO: 5172 - protein, 8 aa, Dengue virus
WSDLIRLC

SEQ ID NO: 5173 - protein, 8 aa, Dengue virus
SDLIRLCI

SEQ ID NO: 5174 - protein, 8 aa, Dengue virus
DLTRLCIM

SEQ ID NO: 5175 - protein, 8 aa, Dengue virus
LTRLCIMV

SEQ ID NO: 5176 - protein, 8 aa, Dengue virus
TRLCIMVG

SEQ ID NO: 5177 - protein, 8 aa, Dengue virus
IMVGANVS

SEQ ID NO: 5178 - protein, 8 aa, Dengue virus
MVGANVSD

SEQ ID NO: 5179 - protein, 8 aa, Dengue virus
VGANAFDR

SEQ ID NO: 5180 - protein, 8 aa, Dengue virus
GANAFDRM

SEQ ID NO: 5181 - protein, 8 aa, Dengue virus
ANAFDRMG

SEQ ID NO: 5182 - protein, 8 aa, Dengue virus
NAFDRMGM

SEQ ID NO: 5183 - protein, 8 aa, Dengue virus
AFDRMGMG

SEQ ID NO: 5184 - protein, 8 aa, Dengue virus
FDRMGMGT

SEQ ID NO: 5185 - protein, 8 aa, Dengue virus
DNMGMGTT

SEQ ID NO: 5186 - protein, 8 aa, Dengue virus
NMGMGTTY

SEQ ID NO: 5187 - protein, 8 aa, Dengue virus
TTHLALMA

SEQ ID NO: 5188 - protein, 8 aa, Dengue virus
ALMATFKI

SEQ ID NO: 5189 - protein, 8 aa, Dengue virus
LMATFKIR

SEQ ID NO: 5190 - protein, 8 aa, Dengue virus
MATFKIRP

SEQ ID NO: 5191 - protein, 8 aa, Dengue virus
TFKMRPML

SEQ ID NO: 5192 - protein, 8 aa, Dengue virus
FKMRPMLA

SEQ ID NO: 5193 - protein, 8 aa, Dengue virus
KMRPMLAV

SEQ ID NO: 5194 - protein, 8 aa, Dengue virus
IRPMFAVG

SEQ ID NO: 5195 - protein, 8 aa, Dengue virus
MFAVGLLI

SEQ ID NO: 5196 - protein, 8 aa, Dengue virus
FAVGLLIR

SEQ ID NO: 5197 - protein, 8 aa, Dengue virus
AVGLLFRK

SEQ ID NO: 5198 - protein, 8 aa, Dengue virus
VGLLFRKL

SEQ ID NO: 5199 - protein, 8 aa, Dengue virus
GLLFRKLT

SEQ ID NO: 5200 - protein, 8 aa, Dengue virus
LLFRKLTS

SEQ ID NO: 5201 - protein, 8 aa, Dengue virus
LFRKLTSR

SEQ ID NO: 5202 - protein, 8 aa, Dengue virus
FRKLTSRE

SEQ ID NO: 5203 - protein, 8 aa, Dengue virus
IGLSLVAF

SEQ ID NO: 5204 - protein, 8 aa, Dengue virus
LSLMASME

SEQ ID NO: 5205 - protein, 8 aa, Dengue virus
SLVASVEI

SEQ ID NO: 5206 - protein, 8 aa, Dengue virus
LVASAELP

SEQ ID NO: 5207 - protein, 8 aa, Dengue virus
AFVELPNS

SEQ ID NO: 5208 - protein, 8 aa, Dengue virus
FVELPNSL

SEQ ID NO: 5209 - protein, 8 aa, Dengue virus
VELPNSLD

SEQ ID NO: 5210 - protein, 8 aa, Dengue virus
ELPNSLDE

SEQ ID NO: 5211 - protein, 8 aa, Dengue virus
LPNSLDEL

SEQ ID NO: 5212 - protein, 8 aa, Dengue virus
PNSLDELG

SEQ ID NO: 5213 - protein, 8 aa, Dengue virus
NSLDELGD

SEQ ID NO: 5214 - protein, 8 aa, Dengue virus
GLAIGIMM

SEQ ID NO: 5215 - protein, 8 aa, Dengue virus
LAIGIMML

SEQ ID NO: 5216 - protein, 8 aa, Dengue virus
MMLKLLTD

SEQ ID NO: 5217 - protein, 8 aa, Dengue virus
MLKLLTDF

SEQ ID NO: 5218 - protein, 8 aa, Dengue virus
KLLTDFQP

SEQ ID NO: 5219 - protein, 8 aa, Dengue virus
LLTDFQSY

SEQ ID NO: 5220 - protein, 8 aa, Dengue virus
LTDFQSYQ

SEQ ID NO: 5221 - protein, 8 aa, Dengue virus
TDFQSYQL

SEQ ID NO: 5222 - protein, 8 aa, Dengue virus
DFQSYQLW

SEQ ID NO: 5223 - protein, 8 aa, Dengue virus
QLWAALLS

SEQ ID NO: 5224 - protein, 8 aa, Dengue virus
ALLSLTFI

SEQ ID NO: 5225 - protein, 8 aa, Dengue virus
LLSLTFIR

SEQ ID NO: 5226 - protein, 8 aa, Dengue virus
LSLTFIRT

SEQ ID NO: 5227 - protein, 8 aa, Dengue virus
SLDYAWRT

SEQ ID NO: 5228 - protein, 8 aa, Dengue virus
DYAWKTMA

SEQ ID NO: 5229 - protein, 8 aa, Dengue virus
YAWRTMAM

SEQ ID NO: 5230 - protein, 8 aa, Dengue virus
AMILSIVS

SEQ ID NO: 5231 - protein, 8 aa, Dengue virus
MILSIVSL

SEQ ID NO: 5232 - protein, 8 aa, Dengue virus
LSIASLFP

SEQ ID NO: 5233 - protein, 8 aa, Dengue virus
SIASLFPL

SEQ ID NO: 5234 - protein, 8 aa, Dengue virus
VVSLFPLC

SEQ ID NO: 5235 - protein, 8 aa, Dengue virus
ASLFPLCL

SEQ ID NO: 5236 - protein, 8 aa, Dengue virus
SLIPLCLS

SEQ ID NO: 5237 - protein, 8 aa, Dengue virus
LIPLCLST

SEQ ID NO: 5238 - protein, 8 aa, Dengue virus
IPLCLSTT

SEQ ID NO: 5239 - protein, 8 aa, Dengue virus
SLGCKPLP

SEQ ID NO: 5240 - protein, 8 aa, Dengue virus
LGCKPLPM

SEQ ID NO: 5241 - protein, 8 aa, Dengue virus
GCKPLAMF

SEQ ID NO: 5242 - protein, 8 aa, Dengue virus
CKPLAMFL

SEQ ID NO: 5243 - protein, 8 aa, Dengue virus
KPLAMFLI

SEQ ID NO: 5244 - protein, 8 aa, Dengue virus
PLPMFLIT

SEQ ID NO: 5245 - protein, 8 aa, Dengue virus
LPMFLITE

SEQ ID NO: 5246 - protein, 8 aa, Dengue virus
ITETKIWG

SEQ ID NO: 5247 - protein, 8 aa, Dengue virus
TETKIWGR

SEQ ID NO: 5248 - protein, 8 aa, Dengue virus
ETKIWGRK

SEQ ID NO: 5249 - protein, 8 aa, Dengue virus
TKIWGRKS

SEQ ID NO: 5250 - protein, 8 aa, Dengue virus
EIWGRKSW

SEQ ID NO: 5251 - protein, 8 aa, Dengue virus
WGRKSWPI

SEQ ID NO: 5252 - protein, 8 aa, Dengue virus
GRKSWPIN

SEQ ID NO: 5253 - protein, 8 aa, Dengue virus
RKSWPINE

SEQ ID NO: 5254 - protein, 8 aa, Dengue virus
KSWPINEG

SEQ ID NO: 5255 - protein, 8 aa, Dengue virus
INEGIMAV

SEQ ID NO: 5256 - protein, 8 aa, Dengue virus
EGIMAVGV

SEQ ID NO: 5257 - protein, 8 aa, Dengue virus
GIMAVGVV

SEQ ID NO: 5258 - protein, 8 aa, Dengue virus
IMAVGVVS

SEQ ID NO: 5259 - protein, 8 aa, Dengue virus
MAVGVVSI

SEQ ID NO: 5260 - protein, 8 aa, Dengue virus
AVGVVSIL

SEQ ID NO: 5261 - protein, 8 aa, Dengue virus
VGVVSILL

SEQ ID NO: 5262 - protein, 8 aa, Dengue virus
IVSILLSA

SEQ ID NO: 5263 - protein, 8 aa, Dengue virus
ADLSLEKT

SEQ ID NO: 5264 - protein, 8 aa, Dengue virus
LSLEKAAK

SEQ ID NO: 5265 - protein, 8 aa, Dengue virus
SLEKAAKV

SEQ ID NO: 5266 - protein, 8 aa, Dengue virus
LEKAAKVS

SEQ ID NO: 5267 - protein, 8 aa, Dengue virus
EKAAKVSW

SEQ ID NO: 5268 - protein, 8 aa, Dengue virus
KAAKVSWE

SEQ ID NO: 5269 - protein, 8 aa, Dengue virus
AAVVSWEE

SEQ ID NO: 5270 - protein, 8 aa, Dengue virus
AVVSWEEE

SEQ ID NO: 5271 - protein, 8 aa, Dengue virus
VVSWEEEA

SEQ ID NO: 5272 - protein, 8 aa, Dengue virus
VSWEKEAE

SEQ ID NO: 5273 - protein, 8 aa, Dengue virus
EEAEHSGT

SEQ ID NO: 5274 - protein, 8 aa, Dengue virus
SGASHNIS

SEQ ID NO: 5275 - protein, 8 aa, Dengue virus
GASHNISV

SEQ ID NO: 5276 - protein, 8 aa, Dengue virus
ASHNILVV

SEQ ID NO: 5277 - protein, 8 aa, Dengue virus
SHNILVVV

SEQ ID NO: 5278 - protein, 8 aa, Dengue virus
HNILVVVQ

SEQ ID NO: 5279 - protein, 8 aa, Dengue virus
NILVVVQD

SEQ ID NO: 5280 - protein, 8 aa, Dengue virus
ILVVVQDD

SEQ ID NO: 5281 - protein, 8 aa, Dengue virus
LVVVQDDG

SEQ ID NO: 5282 - protein, 8 aa, Dengue virus
VVVQDDGT

SEQ ID NO: 5283 - protein, 8 aa, Dengue virus
VVQDDGTM

SEQ ID NO: 5284 - protein, 8 aa, Dengue virus
DEEKDDTL

SEQ ID NO: 5285 - protein, 8 aa, Dengue virus
EEKDDTLT

SEQ ID NO: 5286 - protein, 8 aa, Dengue virus
EKDDTLTI

SEQ ID NO: 5287 - protein, 8 aa, Dengue virus
KDDTLTIL

SEQ ID NO: 5288 - protein, 8 aa, Dengue virus
TLLAVSGM

SEQ ID NO: 5289 - protein, 8 aa, Dengue virus
LLAVSGMY

SEQ ID NO: 5290 - protein, 8 aa, Dengue virus
LAVSGMYP

SEQ ID NO: 5291 - protein, 8 aa, Dengue virus
AISGVYPM

SEQ ID NO: 5292 - protein, 8 aa, Dengue virus
ISGVYPMS

SEQ ID NO: 5293 - protein, 8 aa, Dengue virus
PATLFLWY

SEQ ID NO: 5294 - protein, 8 aa, Dengue virus
ATLFLWYF

SEQ ID NO: 5295 - protein, 8 aa, Dengue virus
TLFLWYFW

SEQ ID NO: 5296 - protein, 8 aa, Dengue virus
LFLWYFWQ

SEQ ID NO: 5297 - protein, 8 aa, Dengue virus
TPSPPKVE

SEQ ID NO: 5298 - protein, 8 aa, Dengue virus
PSPPEVEK

SEQ ID NO: 5299 - protein, 8 aa, Dengue virus
SPPEVEKA

SEQ ID NO: 5300 - protein, 8 aa, Dengue virus
PPEVEKAV

SEQ ID NO: 5301 - protein, 8 aa, Dengue virus
PEVEKAVL

SEQ ID NO: 5302 - protein, 8 aa, Dengue virus
EVEKAVLD

SEQ ID NO: 5303 - protein, 8 aa, Dengue virus
VEKAVLDD

SEQ ID NO: 5304 - protein, 8 aa, Dengue virus
EKAVLDDG

SEQ ID NO: 5305 - protein, 8 aa, Dengue virus
GVGVFQEG

SEQ ID NO: 5306 - protein, 8 aa, Dengue virus
VGVFQEGV

SEQ ID NO: 5307 - protein, 8 aa, Dengue virus
GVFQEGVF

SEQ ID NO: 5308 - protein, 8 aa, Dengue virus
VFQEGVFH

SEQ ID NO: 5309 - protein, 8 aa, Dengue virus
FQEGVFHT

SEQ ID NO: 5310 - protein, 8 aa, Dengue virus
QEGVFHTM

SEQ ID NO: 5311 - protein, 8 aa, Dengue virus
EGVFHTMW

SEQ ID NO: 5312 - protein, 8 aa, Dengue virus
YGGGWRLR

SEQ ID NO: 5313 - protein, 8 aa, Dengue virus
GGGWRLRG

SEQ ID NO: 5314 - protein, 8 aa, Dengue virus
GGWRLRGS

SEQ ID NO: 5315 - protein, 8 aa, Dengue virus
GWRLRGSW

SEQ ID NO: 5316 - protein, 8 aa, Dengue virus
WRLRGSWN

SEQ ID NO: 5317 - protein, 8 aa, Dengue virus
QGSWNAGE

SEQ ID NO: 5318 - protein, 8 aa, Dengue virus
GLWNTGEE

SEQ ID NO: 5319 - protein, 8 aa, Dengue virus
LWNTGEEV

SEQ ID NO: 5320 - protein, 8 aa, Dengue virus
NPKNVQTM

SEQ ID NO: 5321 - protein, 8 aa, Dengue virus
PKNVQTMP

SEQ ID NO: 5322 - protein, 8 aa, Dengue virus
KNVQTMPG

SEQ ID NO: 5323 - protein, 8 aa, Dengue virus
NVQTMPGT

SEQ ID NO: 5324 - protein, 8 aa, Dengue virus
VQTMPGTF

SEQ ID NO: 5325 - protein, 8 aa, Dengue virus
QTMPGTFK

SEQ ID NO: 5326 - protein, 8 aa, Dengue virus
TMPGTFKT

SEQ ID NO: 5327 - protein, 8 aa, Dengue virus
APGTFKTS

SEQ ID NO: 5328 - protein, 8 aa, Dengue virus
SAIAQARA

SEQ ID NO: 5329 - protein, 8 aa, Dengue virus
AIAQARAS

SEQ ID NO: 5330 - protein, 8 aa, Dengue virus
IAQARASQ

SEQ ID NO: 5331 - protein, 8 aa, Dengue virus
AQARASQE

SEQ ID NO: 5332 - protein, 8 aa, Dengue virus
QARASQEG

SEQ ID NO: 5333 - protein, 8 aa, Dengue virus
ARASQEGP

SEQ ID NO: 5334 - protein, 8 aa, Dengue virus
RASQEGPL

SEQ ID NO: 5335 - protein, 8 aa, Dengue virus
GPLPEIEN

SEQ ID NO: 5336 - protein, 8 aa, Dengue virus
PLPEIENE

SEQ ID NO: 5337 - protein, 8 aa, Dengue virus
LPEIENEV

SEQ ID NO: 5338 - protein, 8 aa, Dengue virus
PEIENEVF

SEQ ID NO: 5339 - protein, 8 aa, Dengue virus
EIEEEVFK

SEQ ID NO: 5340 - protein, 8 aa, Dengue virus
IEEEVFKK

SEQ ID NO: 5341 - protein, 8 aa, Dengue virus
EEEVFKKR

SEQ ID NO: 5342 - protein, 8 aa, Dengue virus
EEVFKKRN

SEQ ID NO: 5343 - protein, 8 aa, Dengue virus
AIVREAIR

SEQ ID NO: 5344 - protein, 8 aa, Dengue virus
IVREAIRR

SEQ ID NO: 5345 - protein, 8 aa, Dengue virus
VREAIRRN

SEQ ID NO: 5346 - protein, 8 aa, Dengue virus
REAIKRKM

SEQ ID NO: 5347 - protein, 8 aa, Dengue virus
EAIKRKMR

SEQ ID NO: 5348 - protein, 8 aa, Dengue virus
AIKRKMRT

SEQ ID NO: 5349 - protein, 8 aa, Dengue virus
IKRKMRTL

SEQ ID NO: 5350 - protein, 8 aa, Dengue virus
KRKLRTLV

SEQ ID NO: 5351 - protein, 8 aa, Dengue virus
RKLRTLVL

SEQ ID NO: 5352 - protein, 8 aa, Dengue virus
KLRTLVLA

SEQ ID NO: 5353 - protein, 8 aa, Dengue virus
AIIQDEER

SEQ ID NO: 5354 - protein, 8 aa, Dengue virus
IIQDEERD

SEQ ID NO: 5355 - protein, 8 aa, Dengue virus
RSWNSGHE

SEQ ID NO: 5356 - protein, 8 aa, Dengue virus
SWNSGHEW

SEQ ID NO: 5357 - protein, 8 aa, Dengue virus
WNSGHEWI

SEQ ID NO: 5358 - protein, 8 aa, Dengue virus
NSGHEWIT

SEQ ID NO: 5359 - protein, 8 aa, Dengue virus
SGHEWITD

SEQ ID NO: 5360 - protein, 8 aa, Dengue virus
GHEWITDF

SEQ ID NO: 5361 - protein, 8 aa, Dengue virus
HEWITDFP

SEQ ID NO: 5362 - protein, 8 aa, Dengue virus
RGRIGRNP

SEQ ID NO: 5363 - protein, 8 aa, Dengue virus
GRIGRNYN

SEQ ID NO: 5364 - protein, 8 aa, Dengue virus
RIGRNYNK

SEQ ID NO: 5365 - protein, 8 aa, Dengue virus
IGRNPNKE

SEQ ID NO: 5366 - protein, 8 aa, Dengue virus
GRNYNKEG

SEQ ID NO: 5367 - protein, 8 aa, Dengue virus
RNPNKEGD

SEQ ID NO: 5368 - protein, 8 aa, Dengue virus
NPNKEGDQ

SEQ ID NO: 5369 - protein, 8 aa, Dengue virus
IYMGQPLK

SEQ ID NO: 5370 - protein, 8 aa, Dengue virus
SISGDLIL

SEQ ID NO: 5371 - protein, 8 aa, Dengue virus
ISGDLILE

SEQ ID NO: 5372 - protein, 8 aa, Dengue virus
LPQHLTQK

SEQ ID NO: 5373 - protein, 8 aa, Dengue virus
PQHLTQKA

SEQ ID NO: 5374 - protein, 8 aa, Dengue virus
QHLTQKAQ

SEQ ID NO: 5375 - protein, 8 aa, Dengue virus
HLTQKAQN

SEQ ID NO: 5376 - protein, 8 aa, Dengue virus
LTQKAQNA

SEQ ID NO: 5377 - protein, 8 aa, Dengue virus
TQKAQNAL

SEQ ID NO: 5378 - protein, 8 aa, Dengue virus
QKAQNALD

SEQ ID NO: 5379 - protein, 8 aa, Dengue virus
GRAYRHAL

SEQ ID NO: 5380 - protein, 8 aa, Dengue virus
RAYRHALE

SEQ ID NO: 5381 - protein, 8 aa, Dengue virus
MLFFLSGK

SEQ ID NO: 5382 - protein, 8 aa, Dengue virus
SIGLLCVI

SEQ ID NO: 5383 - protein, 8 aa, Dengue virus
IGLLCVTS

SEQ ID NO: 5384 - protein, 8 aa, Dengue virus
GLLCVTSS

SEQ ID NO: 5385 - protein, 8 aa, Dengue virus
LLCVTSSS

SEQ ID NO: 5386 - protein, 8 aa, Dengue virus
SSSALLWM

SEQ ID NO: 5387 - protein, 8 aa, Dengue virus
SALLWMAN

SEQ ID NO: 5388 - protein, 8 aa, Dengue virus
ALLWMANV

SEQ ID NO: 5389 - protein, 8 aa, Dengue virus
VVIGLLFI

SEQ ID NO: 5390 - protein, 8 aa, Dengue virus
VIGLLFVI

SEQ ID NO: 5391 - protein, 8 aa, Dengue virus
IGLLFVIL

SEQ ID NO: 5392 - protein, 8 aa, Dengue virus
GLLFVILT

SEQ ID NO: 5393 - protein, 8 aa, Dengue virus
LLFVILTV

SEQ ID NO: 5394 - protein, 8 aa, Dengue virus
LFVILTVA

SEQ ID NO: 5395 - protein, 8 aa, Dengue virus
FVILTVAA

SEQ ID NO: 5396 - protein, 8 aa, Dengue virus
VILTVAAN

SEQ ID NO: 5397 - protein, 8 aa, Dengue virus
KDLGIGHA

SEQ ID NO: 5398 - protein, 8 aa, Dengue virus
DLGIGHAA

SEQ ID NO: 5399 - protein, 8 aa, Dengue virus
HVTMLDVD

SEQ ID NO: 5400 - protein, 8 aa, Dengue virus
VTMLDVDL

SEQ ID NO: 5401 - protein, 8 aa, Dengue virus
TMLDVDLR

SEQ ID NO: 5402 - protein, 8 aa, Dengue virus
LTLTATVL

SEQ ID NO: 5403 - protein, 8 aa, Dengue virus
TLTATVLM

SEQ ID NO: 5404 - protein, 8 aa, Dengue virus
LTATVLML

SEQ ID NO: 5405 - protein, 8 aa, Dengue virus
TAAVLMLL

SEQ ID NO: 5406 - protein, 8 aa, Dengue virus
ATVLMLVA

SEQ ID NO: 5407 - protein, 8 aa, Dengue virus
TVLMLVAH

SEQ ID NO: 5408 - protein, 8 aa, Dengue virus
PTVDGIVT

SEQ ID NO: 5409 - protein, 8 aa, Dengue virus
TVDGIVTI

SEQ ID NO: 5410 - protein, 8 aa, Dengue virus
VDGIVTID

SEQ ID NO: 5411 - protein, 8 aa, Dengue virus
SEFNTYKK

SEQ ID NO: 5412 - protein, 8 aa, Dengue virus
EFNTYKKS

SEQ ID NO: 5413 - protein, 8 aa, Dengue virus
FNTYKKSG

SEQ ID NO: 5414 - protein, 8 aa, Dengue virus
NTYKKSGI

SEQ ID NO: 5415 - protein, 8 aa, Dengue virus
TYKRSGII

SEQ ID NO: 5416 - protein, 8 aa, Dengue virus
YKKSGIME

SEQ ID NO: 5417 - protein, 8 aa, Dengue virus
KKSGIMEV

SEQ ID NO: 5418 - protein, 8 aa, Dengue virus
KSGIMEVD

SEQ ID NO: 5419 - protein, 8 aa, Dengue virus
GIVEVDRS

SEQ ID NO: 5420 - protein, 8 aa, Dengue virus
IVEVDRSE

SEQ ID NO: 5421 - protein, 8 aa, Dengue virus
VEVDRSEA

SEQ ID NO: 5422 - protein, 8 aa, Dengue virus
EGLKRGEI

SEQ ID NO: 5423 - protein, 8 aa, Dengue virus
GLKRGEIT

SEQ ID NO: 5424 - protein, 8 aa, Dengue virus
LRRGETTK

SEQ ID NO: 5425 - protein, 8 aa, Dengue virus
RRGETTKH

SEQ ID NO: 5426 - protein, 8 aa, Dengue virus
RGEITKHA

SEQ ID NO: 5427 - protein, 8 aa, Dengue virus
GEITKHAV

SEQ ID NO: 5428 - protein, 8 aa, Dengue virus
EITKHAVS

SEQ ID NO: 5429 - protein, 8 aa, Dengue virus
ITKHAVSR

SEQ ID NO: 5430 - protein, 8 aa, Dengue virus
GGLGHEEP

SEQ ID NO: 5431 - protein, 8 aa, Dengue virus
GAGHEEPI

SEQ ID NO: 5432 - protein, 8 aa, Dengue virus
AGHEEPIP

SEQ ID NO: 5433 - protein, 8 aa, Dengue virus
GWNLVRLH

SEQ ID NO: 5434 - protein, 8 aa, Dengue virus
WNLVRLHS

SEQ ID NO: 5435 - protein, 8 aa, Dengue virus
NLVRLHSG

SEQ ID NO: 5436 - protein, 8 aa, Dengue virus
LVRLHSGK

SEQ ID NO: 5437 - protein, 8 aa, Dengue virus
VRLHSGKD

SEQ ID NO: 5438 - protein, 8 aa, Dengue virus
RLHSGKDV

SEQ ID NO: 5439 - protein, 8 aa, Dengue virus
SGKDVFFM

SEQ ID NO: 5440 - protein, 8 aa, Dengue virus
GKDVFFMP

SEQ ID NO: 5441 - protein, 8 aa, Dengue virus
KDVFFMPP

SEQ ID NO: 5442 - protein, 8 aa, Dengue virus
DVFFMPPE

SEQ ID NO: 5443 - protein, 8 aa, Dengue virus
VFFMPPEK

SEQ ID NO: 5444 - protein, 8 aa, Dengue virus
FFMPPEKC

SEQ ID NO: 5445 - protein, 8 aa, Dengue virus
FMPPEKCD

SEQ ID NO: 5446 - protein, 8 aa, Dengue virus
MPPEKCDT

SEQ ID NO: 5447 - protein, 8 aa, Dengue virus
SVVETLEH

SEQ ID NO: 5448 - protein, 8 aa, Dengue virus
VVETLERM

SEQ ID NO: 5449 - protein, 8 aa, Dengue virus
VETLEHMQ

SEQ ID NO: 5450 - protein, 8 aa, Dengue virus
ETLERMQR

SEQ ID NO: 5451 - protein, 8 aa, Dengue virus
TLEQMQRR

SEQ ID NO: 5452 - protein, 8 aa, Dengue virus
LEQMQRRH

SEQ ID NO: 5453 - protein, 8 aa, Dengue virus
EQMQRRHG

SEQ ID NO: 5454 - protein, 8 aa, Dengue virus
QMQRRHGG

SEQ ID NO: 5455 - protein, 8 aa, Dengue virus
MAHRKPTF

SEQ ID NO: 5456 - protein, 8 aa, Dengue virus
AHRKPTFE

SEQ ID NO: 5457 - protein, 8 aa, Dengue virus
HRKPTFER

SEQ ID NO: 5458 - protein, 8 aa, Dengue virus
RKPTFERD

SEQ ID NO: 5459 - protein, 8 aa, Dengue virus
KPTFERDV

SEQ ID NO: 5460 - protein, 8 aa, Dengue virus
PTFERDVD

SEQ ID NO: 5461 - protein, 8 aa, Dengue virus
TFERDVDL

SEQ ID NO: 5462 - protein, 8 aa, Dengue virus
FERDVDLG

SEQ ID NO: 5463 - protein, 8 aa, Dengue virus
EKDVDLGA

SEQ ID NO: 5464 - protein, 8 aa, Dengue virus
KDVDLGAG

SEQ ID NO: 5465 - protein, 8 aa, Dengue virus
GAGTRHVT

SEQ ID NO: 5466 - protein, 8 aa, Dengue virus
AGTRHVTV

SEQ ID NO: 5467 - protein, 8 aa, Dengue virus
HVAVEPEE

SEQ ID NO: 5468 - protein, 8 aa, Dengue virus
VAVEPEEA

SEQ ID NO: 5469 - protein, 8 aa, Dengue virus
AVEPEEAN

SEQ ID NO: 5470 - protein, 8 aa, Dengue virus
VEPEEANL

SEQ ID NO: 5471 - protein, 8 aa, Dengue virus
EPEEANLD

SEQ ID NO: 5472 - protein, 8 aa, Dengue virus
PEEANLDI

SEQ ID NO: 5473 - protein, 8 aa, Dengue virus
EEANLDII

SEQ ID NO: 5474 - protein, 8 aa, Dengue virus
EANLDIIG

SEQ ID NO: 5475 - protein, 8 aa, Dengue virus
TRTPKAKQ

SEQ ID NO: 5476 - protein, 8 aa, Dengue virus
RTPKAKQG

SEQ ID NO: 5477 - protein, 8 aa, Dengue virus
TPKAKQGT

SEQ ID NO: 5478 - protein, 8 aa, Dengue virus
PRAKRGTA

SEQ ID NO: 5479 - protein, 8 aa, Dengue virus
RAKRGTAQ

SEQ ID NO: 5480 - protein, 8 aa, Dengue virus
AKRGTVQI

SEQ ID NO: 5481 - protein, 8 aa, Dengue virus
KRGTVQIM

SEQ ID NO: 5482 - protein, 8 aa, Dengue virus
RGTVQIME

SEQ ID NO: 5483 - protein, 8 aa, Dengue virus
GTVQIMEV

SEQ ID NO: 5484 - protein, 8 aa, Dengue virus
TVQIMEVT

SEQ ID NO: 5485 - protein, 8 aa, Dengue virus
VQIMEVTA

SEQ ID NO: 5486 - protein, 8 aa, Dengue virus
QIMEMTAK

SEQ ID NO: 5487 - protein, 8 aa, Dengue virus
IMEMTAKW

SEQ ID NO: 5488 - protein, 8 aa, Dengue virus
MTAKWLWG

SEQ ID NO: 5489 - protein, 8 aa, Dengue virus
TARWLWSF

SEQ ID NO: 5490 - protein, 8 aa, Dengue virus
ARWLWSFL

SEQ ID NO: 5491 - protein, 8 aa, Dengue virus
RWLWSFLS

SEQ ID NO: 5492 - protein, 8 aa, Dengue virus
VEDERFWE

SEQ ID NO: 5493 - protein, 8 aa, Dengue virus
EDERFWEL

SEQ ID NO: 5494 - protein, 8 aa, Dengue virus
DERFWELV

SEQ ID NO: 5495 - protein, 8 aa, Dengue virus
LVRREREL

SEQ ID NO: 5496 - protein, 8 aa, Dengue virus
VRRERELH

SEQ ID NO: 5497 - protein, 8 aa, Dengue virus
RRERELHK

SEQ ID NO: 5498 - protein, 8 aa, Dengue virus
YILRDISR

SEQ ID NO: 5499 - protein, 8 aa, Dengue virus
ILRDISRI

SEQ ID NO: 5500 - protein, 8 aa, Dengue virus
LRDISRIP

SEQ ID NO: 5501 - protein, 8 aa, Dengue virus
RDISRIPG

SEQ ID NO: 5502 - protein, 8 aa, Dengue virus
DISRIPGG

SEQ ID NO: 5503 - protein, 8 aa, Dengue virus
ISRIPGGN

SEQ ID NO: 5504 - protein, 8 aa, Dengue virus
SRIPGGNM

SEQ ID NO: 5505 - protein, 8 aa, Dengue virus
RIPGGNMY

SEQ ID NO: 5506 - protein, 8 aa, Dengue virus
IPGGSMYA

SEQ ID NO: 5507 - protein, 8 aa, Dengue virus
PGGSMYAD

SEQ ID NO: 5508 - protein, 8 aa, Dengue virus
QNEAKITE

SEQ ID NO: 5509 - protein, 8 aa, Dengue virus
NEAKITEI

SEQ ID NO: 5510 - protein, 8 aa, Dengue virus
EAKITEIM

SEQ ID NO: 5511 - protein, 8 aa, Dengue virus
AKITEIME

SEQ ID NO: 5512 - protein, 8 aa, Dengue virus
KITEIMEP

SEQ ID NO: 5513 - protein, 8 aa, Dengue virus
ITDIMEAE

SEQ ID NO: 5514 - protein, 8 aa, Dengue virus
PEHALLAR

SEQ ID NO: 5515 - protein, 8 aa, Dengue virus
EHALLAKA

SEQ ID NO: 5516 - protein, 8 aa, Dengue virus
HALLAKAI

SEQ ID NO: 5517 - protein, 8 aa, Dengue virus
ALLAKAIF

SEQ ID NO: 5518 - protein, 8 aa, Dengue virus
LLAKAIFK

SEQ ID NO: 5519 - protein, 8 aa, Dengue virus
LAKAIFKL

SEQ ID NO: 5520 - protein, 8 aa, Dengue virus
AKAIFKLT

SEQ ID NO: 5521 - protein, 8 aa, Dengue virus
KAIFKLTY

SEQ ID NO: 5522 - protein, 8 aa, Dengue virus
VRVQRPTK

SEQ ID NO: 5523 - protein, 8 aa, Dengue virus
RVQRPARN

SEQ ID NO: 5524 - protein, 8 aa, Dengue virus
VQRPARNG

SEQ ID NO: 5525 - protein, 8 aa, Dengue virus
QRPARNGT

SEQ ID NO: 5526 - protein, 8 aa, Dengue virus
RPARNGTV

SEQ ID NO: 5527 - protein, 8 aa, Dengue virus
PARNGTVM

SEQ ID NO: 5528 - protein, 8 aa, Dengue virus
ARNGTVMD

SEQ ID NO: 5529 - protein, 8 aa, Dengue virus
RNGTVMDV

SEQ ID NO: 5530 - protein, 8 aa, Dengue virus
NTFTNMGA

SEQ ID NO: 5531 - protein, 8 aa, Dengue virus
TFTNMGAQ

SEQ ID NO: 5532 - protein, 8 aa, Dengue virus
FTNMGAQL

SEQ ID NO: 5533 - protein, 8 aa, Dengue virus
TNMGAQLI

SEQ ID NO: 5534 - protein, 8 aa, Dengue virus
NMGAQLIR

SEQ ID NO: 5535 - protein, 8 aa, Dengue virus
MGAQLIRQ

SEQ ID NO: 5536 - protein, 8 aa, Dengue virus
GAQLIRQM

SEQ ID NO: 5537 - protein, 8 aa, Dengue virus
MESEGIFF

SEQ ID NO: 5538 - protein, 8 aa, Dengue virus
ESEEIFSP

SEQ ID NO: 5539 - protein, 8 aa, Dengue virus
ELESPNLA

SEQ ID NO: 5540 - protein, 8 aa, Dengue virus
DDCVVKPV

SEQ ID NO: 5541 - protein, 8 aa, Dengue virus
DCVVKPVD

SEQ ID NO: 5542 - protein, 8 aa, Dengue virus
CVVKPVDD

SEQ ID NO: 5543 - protein, 8 aa, Dengue virus
VVKPVDDR

SEQ ID NO: 5544 - protein, 8 aa, Dengue virus
VKPVDDRF

SEQ ID NO: 5545 - protein, 8 aa, Dengue virus
KPVDDRFA

SEQ ID NO: 5546 - protein, 8 aa, Dengue virus
PVDDRFAT

SEQ ID NO: 5547 - protein, 8 aa, Dengue virus
VDDRFATA

SEQ ID NO: 5548 - protein, 8 aa, Dengue virus
DRFATALS

SEQ ID NO: 5549 - protein, 8 aa, Dengue virus
RFATALSA

SEQ ID NO: 5550 - protein, 8 aa, Dengue virus
FATALSAL

SEQ ID NO: 5551 - protein, 8 aa, Dengue virus
ATALSALN

SEQ ID NO: 5552 - protein, 8 aa, Dengue virus
TALSALND

SEQ ID NO: 5553 - protein, 8 aa, Dengue virus
ALSALNDM

SEQ ID NO: 5554 - protein, 8 aa, Dengue virus
LSALNDMG

SEQ ID NO: 5555 - protein, 8 aa, Dengue virus
SALNDMGK

SEQ ID NO: 5556 - protein, 8 aa, Dengue virus
AICSADPV

SEQ ID NO: 5557 - protein, 8 aa, Dengue virus
CSAVPVNW

SEQ ID NO: 5558 - protein, 8 aa, Dengue virus
PVEWVPTS

SEQ ID NO: 5559 - protein, 8 aa, Dengue virus
VEWVPTSR

SEQ ID NO: 5560 - protein, 8 aa, Dengue virus
EWVPTSRT

SEQ ID NO: 5561 - protein, 8 aa, Dengue virus
WMEDKTRI

SEQ ID NO: 5562 - protein, 8 aa, Dengue virus
MEDKTRIS

SEQ ID NO: 5563 - protein, 8 aa, Dengue virus
EDKTRISS

SEQ ID NO: 5564 - protein, 8 aa, Dengue virus
DKTRISSW

SEQ ID NO: 5565 - protein, 8 aa, Dengue virus
KTHVSSWG

SEQ ID NO: 5566 - protein, 8 aa, Dengue virus
ISSWEDVP

SEQ ID NO: 5567 - protein, 8 aa, Dengue virus
SSWEEVPY

SEQ ID NO: 5568 - protein, 8 aa, Dengue virus
SWEEVPYL

SEQ ID NO: 5569 - protein, 8 aa, Dengue virus
WEEVPYLG

SEQ ID NO: 5570 - protein, 8 aa, Dengue virus
EEVPYLGK

SEQ ID NO: 5571 - protein, 8 aa, Dengue virus
LIGNENYS

SEQ ID NO: 5572 - protein, 8 aa, Dengue virus
IGNENYSD

SEQ ID NO: 5573 - protein, 8 aa, Dengue virus
GNENYLDF

SEQ ID NO: 5574 - protein, 8 aa, Dengue virus
NENYLDFM

SEQ ID NO: 5575 - protein, 8 aa, Dengue virus
ENYLDFMT

SEQ ID NO: 5576 - protein, 8 aa, Dengue virus
NYLDFMTS

SEQ ID NO: 5577 - protein, 8 aa, Dengue virus
YLDFMTSM

SEQ ID NO: 5578 - protein, 8 aa, Dengue virus
LDFMTSMK

SEQ ID NO: 5579 - protein, 8 aa, Dengue virus
DFMTSMKR

SEQ ID NO: 5580 - protein, 8 aa, Dengue virus
FMTSMKRF

SEQ ID NO: 5581 - protein, 8 aa, Dengue virus
MKRFKNEI

SEQ ID NO: 5582 - protein, 8 aa, Dengue virus
GFKREISN

SEQ ID NO: 5583 - protein, 8 aa, Dengue virus
FKREISNM

SEQ ID NO: 5584 - protein, 8 aa, Dengue virus
KREISNML

SEQ ID NO: 5585 - protein, 8 aa, Dengue virus
REISNMLN

SEQ ID NO: 5586 - protein, 8 aa, Dengue virus
EVSNMLNI

SEQ ID NO: 5587 - protein, 8 aa, Dengue virus
MLSIMNRR

SEQ ID NO: 5588 - protein, 8 aa, Dengue virus
LSIMNRRK

SEQ ID NO: 5589 - protein, 8 aa, Dengue virus
RKRSVTMI

SEQ ID NO: 5590 - protein, 8 aa, Dengue virus
KRSVTMIL

SEQ ID NO: 5591 - protein, 8 aa, Dengue virus
RSVTMILM

SEQ ID NO: 5592 - protein, 8 aa, Dengue virus
SATMLLML

SEQ ID NO: 5593 - protein, 8 aa, Dengue virus
PTALTFHL

SEQ ID NO: 5594 - protein, 8 aa, Dengue virus
TALTFHLT

SEQ ID NO: 5595 - protein, 8 aa, Dengue virus
ALTFHLTT

SEQ ID NO: 5596 - protein, 8 aa, Dengue virus
EPHMIVGK

SEQ ID NO: 5597 - protein, 8 aa, Dengue virus
PHMIVGKQ

SEQ ID NO: 5598 - protein, 8 aa, Dengue virus
HMIVGKQE

SEQ ID NO: 5599 - protein, 8 aa, Dengue virus
MIVGKQER

SEQ ID NO: 5600 - protein, 8 aa, Dengue virus
IVGKQERG

SEQ ID NO: 5601 - protein, 8 aa, Dengue virus
LFKTSTGV

SEQ ID NO: 5602 - protein, 8 aa, Dengue virus
FKTSTGVN

SEQ ID NO: 5603 - protein, 8 aa, Dengue virus
KTSTGVNM

SEQ ID NO: 5604 - protein, 8 aa, Dengue virus
TSTGVNMC

SEQ ID NO: 5605 - protein, 8 aa, Dengue virus
STGVNMCT

SEQ ID NO: 5606 - protein, 8 aa, Dengue virus
TGVNMCTL

SEQ ID NO: 5607 - protein, 8 aa, Dengue virus
GELCEDTI

SEQ ID NO: 5608 - protein, 8 aa, Dengue virus
ELCEDTIT

SEQ ID NO: 5609 - protein, 8 aa, Dengue virus
LCEDTITY

SEQ ID NO: 5610 - protein, 8 aa, Dengue virus
KCPRITEV

SEQ ID NO: 5611 - protein, 8 aa, Dengue virus
CPRITEVE

SEQ ID NO: 5612 - protein, 8 aa, Dengue virus
PRITEVEP

SEQ ID NO: 5613 - protein, 8 aa, Dengue virus
RITEVEPD

SEQ ID NO: 5614 - protein, 8 aa, Dengue virus
ISEAEPDD

SEQ ID NO: 5615 - protein, 8 aa, Dengue virus
SEAEPDDV

SEQ ID NO: 5616 - protein, 8 aa, Dengue virus
PGFTVMAL

SEQ ID NO: 5617 - protein, 8 aa, Dengue virus
GFTVMALF

SEQ ID NO: 5618 - protein, 8 aa, Dengue virus
FTVMALFL

SEQ ID NO: 5619 - protein, 8 aa, Dengue virus
TVMALFLA

SEQ ID NO: 5620 - protein, 8 aa, Dengue virus
VMALFLAH

SEQ ID NO: 5621 - protein, 8 aa, Dengue virus
ANPAVLRK

SEQ ID NO: 5622 - protein, 8 aa, Dengue virus
TLVEEQDS

SEQ ID NO: 5623 - protein, 8 aa, Dengue virus
LVEEQDSN

SEQ ID NO: 5624 - protein, 8 aa, Dengue virus
VEEQDSNF

SEQ ID NO: 5625 - protein, 8 aa, Dengue virus
LEGKIVQH

SEQ ID NO: 5626 - protein, 8 aa, Dengue virus
EGKTVQHE

SEQ ID NO: 5627 - protein, 8 aa, Dengue virus
GKTVQHEN

SEQ ID NO: 5628 - protein, 8 aa, Dengue virus
KTVQHENL

SEQ ID NO: 5629 - protein, 8 aa, Dengue virus
TVQHENLK

SEQ ID NO: 5630 - protein, 8 aa, Dengue virus
ESTEHGTI

SEQ ID NO: 5631 - protein, 8 aa, Dengue virus
STEHGTIA

SEQ ID NO: 5632 - protein, 8 aa, Dengue virus
LLTMKGKS

SEQ ID NO: 5633 - protein, 8 aa, Dengue virus
LTMEKKSW

SEQ ID NO: 5634 - protein, 8 aa, Dengue virus
TMKGKSWL

SEQ ID NO: 5635 - protein, 8 aa, Dengue virus
MEKKSWLV

SEQ ID NO: 5636 - protein, 8 aa, Dengue virus
EKKSWLVH

SEQ ID NO: 5637 - protein, 8 aa, Dengue virus
STTQETWN

SEQ ID NO: 5638 - protein, 8 aa, Dengue virus
ASQETWNR

SEQ ID NO: 5639 - protein, 8 aa, Dengue virus
DKLTLKGI

SEQ ID NO: 5640 - protein, 8 aa, Dengue virus
KLTLKGIS

SEQ ID NO: 5641 - protein, 8 aa, Dengue virus
LTLKGISY

SEQ ID NO: 5642 - protein, 8 aa, Dengue virus
TLKGISYV

SEQ ID NO: 5643 - protein, 8 aa, Dengue virus
LKGISYVM

SEQ ID NO: 5644 - protein, 8 aa, Dengue virus
KGISYVMC

SEQ ID NO: 5645 - protein, 8 aa, Dengue virus
VSYVMCTG

SEQ ID NO: 5646 - protein, 8 aa, Dengue virus
PCKIPFSA

SEQ ID NO: 5647 - protein, 8 aa, Dengue virus
CKIPFSAQ

SEQ ID NO: 5648 - protein, 8 aa, Dengue virus
KIPFSAQD

SEQ ID NO: 5649 - protein, 8 aa, Dengue virus
IPFSAQDE

SEQ ID NO: 5650 - protein, 8 aa, Dengue virus
QDGKGVTQ

SEQ ID NO: 5651 - protein, 8 aa, Dengue virus
DERGVTQN

SEQ ID NO: 5652 - protein, 8 aa, Dengue virus
ERGVTQNG

SEQ ID NO: 5653 - protein, 8 aa, Dengue virus
RGVTQNGR

SEQ ID NO: 5654 - protein, 8 aa, Dengue virus
GVTQNGRV

SEQ ID NO: 5655 - protein, 8 aa, Dengue virus
VTQNGRLV

SEQ ID NO: 5656 - protein, 8 aa, Dengue virus
TQNGRVIT

SEQ ID NO: 5657 - protein, 8 aa, Dengue virus
TDKEKPIN

SEQ ID NO: 5658 - protein, 8 aa, Dengue virus
FGESYIIV

SEQ ID NO: 5659 - protein, 8 aa, Dengue virus
GESYIIVG

SEQ ID NO: 5660 - protein, 8 aa, Dengue virus
IGAGEKTL

SEQ ID NO: 5661 - protein, 8 aa, Dengue virus
SWFKKGSN

SEQ ID NO: 5662 - protein, 8 aa, Dengue virus
GGLFTSVG

SEQ ID NO: 5663 - protein, 8 aa, Dengue virus
GVFTSMGK

SEQ ID NO: 5664 - protein, 8 aa, Dengue virus
VFTSAGKL

SEQ ID NO: 5665 - protein, 8 aa, Dengue virus
FTSAGKLV

SEQ ID NO: 5666 - protein, 8 aa, Dengue virus
TSMGKLVH

SEQ ID NO: 5667 - protein, 8 aa, Dengue virus
SAGKLVHQ

SEQ ID NO: 5668 - protein, 8 aa, Dengue virus
GKLIHQVF

SEQ ID NO: 5669 - protein, 8 aa, Dengue virus
KLIHQVFG

SEQ ID NO: 5670 - protein, 8 aa, Dengue virus
LVHQVFGA

SEQ ID NO: 5671 - protein, 8 aa, Dengue virus
VHQVFGAA

SEQ ID NO: 5672 - protein, 8 aa, Dengue virus
LNSRNTSL

SEQ ID NO: 5673 - protein, 8 aa, Dengue virus
NSRNTSLS

SEQ ID NO: 5674 - protein, 8 aa, Dengue virus
SRNTSLSV

SEQ ID NO: 5675 - protein, 8 aa, Dengue virus
RNTSLSVM

SEQ ID NO: 5676 - protein, 8 aa, Dengue virus
NTSLSVMC

SEQ ID NO: 5677 - protein, 8 aa, Dengue virus
TSLSVMCI

SEQ ID NO: 5678 - protein, 8 aa, Dengue virus
SLSMTCIV

SEQ ID NO: 5679 - protein, 8 aa, Dengue virus
LSVMCIAV

SEQ ID NO: 5680 - protein, 8 aa, Dengue virus
MTCIVVGM

SEQ ID NO: 5681 - protein, 8 aa, Dengue virus
MCIAVGMV

SEQ ID NO: 5682 - protein, 8 aa, Dengue virus
CIVVGMVT

SEQ ID NO: 5683 - protein, 8 aa, Dengue virus
IVVGMVTL

SEQ ID NO: 5684 - protein, 8 aa, Dengue virus
HILLENDI

SEQ ID NO: 5685 - protein, 8 aa, Dengue virus
LLENDIKF

SEQ ID NO: 5686 - protein, 8 aa, Dengue virus
LENDIKFT

SEQ ID NO: 5687 - protein, 8 aa, Dengue virus
ENDIKFTV

SEQ ID NO: 5688 - protein, 8 aa, Dengue virus
NDIKFTVV

SEQ ID NO: 5689 - protein, 8 aa, Dengue virus
DIKFTVVV

SEQ ID NO: 5690 - protein, 8 aa, Dengue virus
FTVVVGNA

SEQ ID NO: 5691 - protein, 8 aa, Dengue virus
GILTQGKK

SEQ ID NO: 5692 - protein, 8 aa, Dengue virus
QGKKMVRP

SEQ ID NO: 5693 - protein, 8 aa, Dengue virus
GKKMVRPQ

SEQ ID NO: 5694 - protein, 8 aa, Dengue virus
RKMIRPQP

SEQ ID NO: 5695 - protein, 8 aa, Dengue virus
EYKYSWKI

SEQ ID NO: 5696 - protein, 8 aa, Dengue virus
YKYSWRSW

SEQ ID NO: 5697 - protein, 8 aa, Dengue virus
KYSWKIWG

SEQ ID NO: 5698 - protein, 8 aa, Dengue virus
AKIIGADT

SEQ ID NO: 5699 - protein, 8 aa, Dengue virus
KIIGADTQ

SEQ ID NO: 5700 - protein, 8 aa, Dengue virus
IIGADTQN

SEQ ID NO: 5701 - protein, 8 aa, Dengue virus
PDTPECPN

SEQ ID NO: 5702 - protein, 8 aa, Dengue virus
ECPDEQRA

SEQ ID NO: 5703 - protein, 8 aa, Dengue virus
CPDEQRAW

SEQ ID NO: 5704 - protein, 8 aa, Dengue virus
PDEQRAWN

SEQ ID NO: 5705 - protein, 8 aa, Dengue virus
DEQRAWNI

SEQ ID NO: 5706 - protein, 8 aa, Dengue virus
EQRAWNIW

SEQ ID NO: 5707 - protein, 8 aa, Dengue virus
RDSYTQAC

SEQ ID NO: 5708 - protein, 8 aa, Dengue virus
DSYTQACD

SEQ ID NO: 5709 - protein, 8 aa, Dengue virus
SYTQACDH

SEQ ID NO: 5710 - protein, 8 aa, Dengue virus
YTQACDHR

SEQ ID NO: 5711 - protein, 8 aa, Dengue virus
EMIIPKMY

SEQ ID NO: 5712 - protein, 8 aa, Dengue virus
MIIPKMYG

SEQ ID NO: 5713 - protein, 8 aa, Dengue virus
IIPKMYGG

SEQ ID NO: 5714 - protein, 8 aa, Dengue virus
PKMYGGPI

SEQ ID NO: 5715 - protein, 8 aa, Dengue virus
KMYGGPIS

SEQ ID NO: 5716 - protein, 8 aa, Dengue virus
MYGGPISQ

SEQ ID NO: 5717 - protein, 8 aa, Dengue virus
FSLGLLCT

SEQ ID NO: 5718 - protein, 8 aa, Dengue virus
SLGLLCTS

SEQ ID NO: 5719 - protein, 8 aa, Dengue virus
LGLLCTSI

SEQ ID NO: 5720 - protein, 8 aa, Dengue virus
SIMTEEVM

SEQ ID NO: 5721 - protein, 8 aa, Dengue virus
IMTEEVMR

SEQ ID NO: 5722 - protein, 8 aa, Dengue virus
MTEEVMRS

SEQ ID NO: 5723 - protein, 8 aa, Dengue virus
RKMLMTGI

SEQ ID NO: 5724 - protein, 8 aa, Dengue virus
MTGTLAVL

SEQ ID NO: 5725 - protein, 8 aa, Dengue virus
GILAVFFL

SEQ ID NO: 5726 - protein, 8 aa, Dengue virus
ILAVFFLL

SEQ ID NO: 5727 - protein, 8 aa, Dengue virus
TWNDLTRL

SEQ ID NO: 5728 - protein, 8 aa, Dengue virus
WNDLTRLC

SEQ ID NO: 5729 - protein, 8 aa, Dengue virus
NDLTRLCI

SEQ ID NO: 5730 - protein, 8 aa, Dengue virus
VGANASDN

SEQ ID NO: 5731 - protein, 8 aa, Dengue virus
GANASDNM

SEQ ID NO: 5732 - protein, 8 aa, Dengue virus
ANASDNMG

SEQ ID NO: 5733 - protein, 8 aa, Dengue virus
NASDNMGM

SEQ ID NO: 5734 - protein, 8 aa, Dengue virus
ASDNMGMG

SEQ ID NO: 5735 - protein, 8 aa, Dengue virus
SDNMGMGT

SEQ ID NO: 5736 - protein, 8 aa, Dengue virus
DRMGMGMT

SEQ ID NO: 5737 - protein, 8 aa, Dengue virus
RMGMGMTY

SEQ ID NO: 5738 - protein, 8 aa, Dengue virus
TFKIRPMF

SEQ ID NO: 5739 - protein, 8 aa, Dengue virus
FKIRPMFA

SEQ ID NO: 5740 - protein, 8 aa, Dengue virus
KIRPMFAV

SEQ ID NO: 5741 - protein, 8 aa, Dengue virus
MFAVGLLL

SEQ ID NO: 5742 - protein, 8 aa, Dengue virus
FAVGLLLR

SEQ ID NO: 5743 - protein, 8 aa, Dengue virus
SLMASMEL

SEQ ID NO: 5744 - protein, 8 aa, Dengue virus
LVACVELP

SEQ ID NO: 5745 - protein, 8 aa, Dengue virus
ASAELPNS

SEQ ID NO: 5746 - protein, 8 aa, Dengue virus
SMELPNSL

SEQ ID NO: 5747 - protein, 8 aa, Dengue virus
LLTDFQPH

SEQ ID NO: 5748 - protein, 8 aa, Dengue virus
LTDFQPHQ

SEQ ID NO: 5749 - protein, 8 aa, Dengue virus
TDFQPHQL

SEQ ID NO: 5750 - protein, 8 aa, Dengue virus
DFQPHQLW

SEQ ID NO: 5751 - protein, 8 aa, Dengue virus
QLWITLLS

SEQ ID NO: 5752 - protein, 8 aa, Dengue virus
TLLSFTFI

SEQ ID NO: 5753 - protein, 8 aa, Dengue virus
LLSLTFVR

SEQ ID NO: 5754 - protein, 8 aa, Dengue virus
LSFTFIKT

SEQ ID NO: 5755 - protein, 8 aa, Dengue virus
SVHYAWKT

SEQ ID NO: 5756 - protein, 8 aa, Dengue virus
DYAWRTMA

SEQ ID NO: 5757 - protein, 8 aa, Dengue virus
CAWKTMAM

SEQ ID NO: 5758 - protein, 8 aa, Dengue virus
AMVLSIAS

SEQ ID NO: 5759 - protein, 8 aa, Dengue virus
MVLSIASL

SEQ ID NO: 5760 - protein, 8 aa, Dengue virus
LSVVSLFP

SEQ ID NO: 5761 - protein, 8 aa, Dengue virus
SVVSLFPL

SEQ ID NO: 5762 - protein, 8 aa, Dengue virus
IASLFPLC

SEQ ID NO: 5763 - protein, 8 aa, Dengue virus
VSLIPLCL

SEQ ID NO: 5764 - protein, 8 aa, Dengue virus
SLFPLCMS

SEQ ID NO: 5765 - protein, 8 aa, Dengue virus
LFPLCMST

SEQ ID NO: 5766 - protein, 8 aa, Dengue virus
FPLCMSTT

SEQ ID NO: 5767 - protein, 8 aa, Dengue virus
PLTMFLIV

SEQ ID NO: 5768 - protein, 8 aa, Dengue virus
LAMFLIAE

SEQ ID NO: 5769 - protein, 8 aa, Dengue virus
ITENEIWG

SEQ ID NO: 5770 - protein, 8 aa, Dengue virus
TENEIWGR

SEQ ID NO: 5771 - protein, 8 aa, Dengue virus
ENEIWGRK

SEQ ID NO: 5772 - protein, 8 aa, Dengue virus
NEIWGRKS

SEQ ID NO: 5773 - protein, 8 aa, Dengue virus
LLLEKAAE

SEQ ID NO: 5774 - protein, 8 aa, Dengue virus
LLEKAAEV

SEQ ID NO: 5775 - protein, 8 aa, Dengue virus
LDKAAEVS

SEQ ID NO: 5776 - protein, 8 aa, Dengue virus
AAKVSWEE

SEQ ID NO: 5777 - protein, 8 aa, Dengue virus
AKVSWEEE

SEQ ID NO: 5778 - protein, 8 aa, Dengue virus
KVSWEEEA

SEQ ID NO: 5779 - protein, 8 aa, Dengue virus
QEAEHSGA

SEQ ID NO: 5780 - protein, 8 aa, Dengue virus
ASHNISVE

SEQ ID NO: 5781 - protein, 8 aa, Dengue virus
AVSGMYPL

SEQ ID NO: 5782 - protein, 8 aa, Dengue virus
VSGMYPLS

SEQ ID NO: 5783 - protein, 8 aa, Dengue virus
PSPPKVER

SEQ ID NO: 5784 - protein, 8 aa, Dengue virus
SPPKVERA

SEQ ID NO: 5785 - protein, 8 aa, Dengue virus
PPKVERAV

SEQ ID NO: 5786 - protein, 8 aa, Dengue virus
PKVERAVL

SEQ ID NO: 5787 - protein, 8 aa, Dengue virus
KVERAVLD

SEQ ID NO: 5788 - protein, 8 aa, Dengue virus
VERAVLDN

SEQ ID NO: 5789 - protein, 8 aa, Dengue virus
ERAVLDNG

SEQ ID NO: 5790 - protein, 8 aa, Dengue virus
QGLWNTGE

SEQ ID NO: 5791 - protein, 8 aa, Dengue virus
MPGTFKTP

SEQ ID NO: 5792 - protein, 8 aa, Dengue virus
AIAQTKAS

SEQ ID NO: 5793 - protein, 8 aa, Dengue virus
IAQTKASQ

SEQ ID NO: 5794 - protein, 8 aa, Dengue virus
AQTKASQE

SEQ ID NO: 5795 - protein, 8 aa, Dengue virus
QTKASQEG

SEQ ID NO: 5796 - protein, 8 aa, Dengue virus
TKASQEGP

SEQ ID NO: 5797 - protein, 8 aa, Dengue virus
EIENEVFR

SEQ ID NO: 5798 - protein, 8 aa, Dengue virus
IENEVFRK

SEQ ID NO: 5799 - protein, 8 aa, Dengue virus
ENEVFRKR

SEQ ID NO: 5800 - protein, 8 aa, Dengue virus
NEVFRKRN

SEQ ID NO: 5801 - protein, 8 aa, Dengue virus
VREAMKRK

SEQ ID NO: 5802 - protein, 8 aa, Dengue virus
REAIRRNV

SEQ ID NO: 5803 - protein, 8 aa, Dengue virus
EAIRRNVR

SEQ ID NO: 5804 - protein, 8 aa, Dengue virus
AIRRNVRT

SEQ ID NO: 5805 - protein, 8 aa, Dengue virus
KRRLRTLV

SEQ ID NO: 5806 - protein, 8 aa, Dengue virus
RRLRTLVL

SEQ ID NO: 5807 - protein, 8 aa, Dengue virus
RLRTLVLA

SEQ ID NO: 5808 - protein, 8 aa, Dengue virus
LPQHLTLK

SEQ ID NO: 5809 - protein, 8 aa, Dengue virus
PQHLTLKA

SEQ ID NO: 5810 - protein, 8 aa, Dengue virus
QHLTLKAQ

SEQ ID NO: 5811 - protein, 8 aa, Dengue virus
HLTLKAQN

SEQ ID NO: 5812 - protein, 8 aa, Dengue virus
LTLKAQNA

SEQ ID NO: 5813 - protein, 8 aa, Dengue virus
TLKAQNAL

SEQ ID NO: 5814 - protein, 8 aa, Dengue virus
LKAQNALD

SEQ ID NO: 5815 - protein, 8 aa, Dengue virus
IGLLCVIA

SEQ ID NO: 5816 - protein, 8 aa, Dengue virus
GLLCVMSS

SEQ ID NO: 5817 - protein, 8 aa, Dengue virus
LLCVMSSS

SEQ ID NO: 5818 - protein, 8 aa, Dengue virus
ASSALLWI

SEQ ID NO: 5819 - protein, 8 aa, Dengue virus
ALLWIASV

SEQ ID NO: 5820 - protein, 8 aa, Dengue virus
DLGIGHAV

SEQ ID NO: 5821 - protein, 8 aa, Dengue virus
HATMLDID

SEQ ID NO: 5822 - protein, 8 aa, Dengue virus
ASMLDVDL

SEQ ID NO: 5823 - protein, 8 aa, Dengue virus
TMLDIDLH

SEQ ID NO: 5824 - protein, 8 aa, Dengue virus
TATVLMLV

SEQ ID NO: 5825 - protein, 8 aa, Dengue virus
TYKKSGIM

SEQ ID NO: 5826 - protein, 8 aa, Dengue virus
LKRGEITK

SEQ ID NO: 5827 - protein, 8 aa, Dengue virus
KRGEITKH

SEQ ID NO: 5828 - protein, 8 aa, Dengue virus
GLGHEEPI

SEQ ID NO: 5829 - protein, 8 aa, Dengue virus
LGHEEPIP

SEQ ID NO: 5830 - protein, 8 aa, Dengue virus
KLHSGKDA

SEQ ID NO: 5831 - protein, 8 aa, Dengue virus
SGKDVFFV

SEQ ID NO: 5832 - protein, 8 aa, Dengue virus
GKDVFFVP

SEQ ID NO: 5833 - protein, 8 aa, Dengue virus
KDVFFVPP

SEQ ID NO: 5834 - protein, 8 aa, Dengue virus
DVFFVPPE

SEQ ID NO: 5835 - protein, 8 aa, Dengue virus
VFFVPPEK

SEQ ID NO: 5836 - protein, 8 aa, Dengue virus
FFVPPEKC

SEQ ID NO: 5837 - protein, 8 aa, Dengue virus
FVPPEKCD

SEQ ID NO: 5838 - protein, 8 aa, Dengue virus
VPPEKCDT

SEQ ID NO: 5839 - protein, 8 aa, Dengue virus
TLERMQRK

SEQ ID NO: 5840 - protein, 8 aa, Dengue virus
HVTVEPEV

SEQ ID NO: 5841 - protein, 8 aa, Dengue virus
VTVEPEVA

SEQ ID NO: 5842 - protein, 8 aa, Dengue virus
TVEPEVAN

SEQ ID NO: 5843 - protein, 8 aa, Dengue virus
VEPEVANI

SEQ ID NO: 5844 - protein, 8 aa, Dengue virus
EPEVPNLD

SEQ ID NO: 5845 - protein, 8 aa, Dengue virus
PEVANIDI

SEQ ID NO: 5846 - protein, 8 aa, Dengue virus
EVPNLDII

SEQ ID NO: 5847 - protein, 8 aa, Dengue virus
VPNLDIIG

SEQ ID NO: 5848 - protein, 8 aa, Dengue virus
PKAKRGTV

SEQ ID NO: 5849 - protein, 8 aa, Dengue virus
KAKRGTVQ

SEQ ID NO: 5850 - protein, 8 aa, Dengue virus
AKQGTAQI

SEQ ID NO: 5851 - protein, 8 aa, Dengue virus
KQGTAQIM

SEQ ID NO: 5852 - protein, 8 aa, Dengue virus
QGTAQIME

SEQ ID NO: 5853 - protein, 8 aa, Dengue virus
GTAQIMEM

SEQ ID NO: 5854 - protein, 8 aa, Dengue virus
TAQIMEMT

SEQ ID NO: 5855 - protein, 8 aa, Dengue virus
AQIMEMTA

SEQ ID NO: 5856 - protein, 8 aa, Dengue virus
VEDERFWN

SEQ ID NO: 5857 - protein, 8 aa, Dengue virus
EDERFWNL

SEQ ID NO: 5858 - protein, 8 aa, Dengue virus
DERFWNLV

SEQ ID NO: 5859 - protein, 8 aa, Dengue virus
LVKKEREL

SEQ ID NO: 5860 - protein, 8 aa, Dengue virus
VKKERELH

SEQ ID NO: 5861 - protein, 8 aa, Dengue virus
KKERELHK

SEQ ID NO: 5862 - protein, 8 aa, Dengue virus
ISKISGGN

SEQ ID NO: 5863 - protein, 8 aa, Dengue virus
SKIPGGSM

SEQ ID NO: 5864 - protein, 8 aa, Dengue virus
KISGGNMY

SEQ ID NO: 5865 - protein, 8 aa, Dengue virus
EHALLARS

SEQ ID NO: 5866 - protein, 8 aa, Dengue virus
HALLARSI

SEQ ID NO: 5867 - protein, 8 aa, Dengue virus
ALLARSIF

SEQ ID NO: 5868 - protein, 8 aa, Dengue virus
LLARSIFK

SEQ ID NO: 5869 - protein, 8 aa, Dengue virus
LARSIFKL

SEQ ID NO: 5870 - protein, 8 aa, Dengue virus
ARSIFKLT

SEQ ID NO: 5871 - protein, 8 aa, Dengue virus
RSIFKLTY

SEQ ID NO: 5872 - protein, 8 aa, Dengue virus
RVQRPTKN

SEQ ID NO: 5873 - protein, 8 aa, Dengue virus
VQRPTKNG

SEQ ID NO: 5874 - protein, 8 aa, Dengue virus
QRPTKNGT

SEQ ID NO: 5875 - protein, 8 aa, Dengue virus
RPTKNGTV

SEQ ID NO: 5876 - protein, 8 aa, Dengue virus
PTKNGTVM

SEQ ID NO: 5877 - protein, 8 aa, Dengue virus
TKNGTVMD

SEQ ID NO: 5878 - protein, 8 aa, Dengue virus
MESEEIFS

SEQ ID NO: 5879 - protein, 8 aa, Dengue virus
ESEGIFFP

SEQ ID NO: 5880 - protein, 8 aa, Dengue virus
ELETQNLA

SEQ ID NO: 5881 - protein, 8 aa, Dengue virus
PIDDRFAA

SEQ ID NO: 5882 - protein, 8 aa, Dengue virus
IDDRFAAA

SEQ ID NO: 5883 - protein, 8 aa, Dengue virus
DRFAAALT

SEQ ID NO: 5884 - protein, 8 aa, Dengue virus
RFAAALTA

SEQ ID NO: 5885 - protein, 8 aa, Dengue virus
FAAALTAL

SEQ ID NO: 5886 - protein, 8 aa, Dengue virus
AAALTALN

SEQ ID NO: 5887 - protein, 8 aa, Dengue virus
AALTALND

SEQ ID NO: 5888 - protein, 8 aa, Dengue virus
ANCSAVPV

SEQ ID NO: 5889 - protein, 8 aa, Dengue virus
CSAVPIDW

SEQ ID NO: 5890 - protein, 8 aa, Dengue virus
PVNWVPTS

SEQ ID NO: 5891 - protein, 8 aa, Dengue virus
IDWVPTSR

SEQ ID NO: 5892 - protein, 8 aa, Dengue virus
KTHISSWE

SEQ ID NO: 5893 - protein, 8 aa, Dengue virus
VSSWGDVP

SEQ ID NO: 5894 - protein, 8 aa, Dengue virus
ENYLDYMI

SEQ ID NO: 5895 - protein, 8 aa, Dengue virus
NYLDYMIS

SEQ ID NO: 5896 - protein, 8 aa, Dengue virus
YLDYMISM

SEQ ID NO: 5897 - protein, 8 aa, Dengue virus
LDYMISMK

SEQ ID NO: 5898 - protein, 8 aa, Dengue virus
MKRFKNDS

SEQ ID NO: 5899 - protein, 8 aa, Dengue virus
EISNMLSI

SEQ ID NO: 5900 - protein, 8 aa, Dengue virus
MLNVMNRR

SEQ ID NO: 5901 - protein, 8 aa, Dengue virus
LNVMNRRK

SEQ ID NO: 5902 - protein, 8 aa, Dengue virus
KRSVTTLL

SEQ ID NO: 5903 - protein, 8 aa, Dengue virus
RSATMLLM

SEQ ID NO: 5904 - protein, 8 aa, Dengue virus
KCPRISEA

SEQ ID NO: 5905 - protein, 8 aa, Dengue virus
CPRISEAE

SEQ ID NO: 5906 - protein, 8 aa, Dengue virus
PRISEAEP

SEQ ID NO: 5907 - protein, 8 aa, Dengue virus
RISEAEPD

SEQ ID NO: 5908 - protein, 8 aa, Dengue virus
PGFTMIAL

SEQ ID NO: 5909 - protein, 8 aa, Dengue virus
GFTMIALF

SEQ ID NO: 5910 - protein, 8 aa, Dengue virus
FTMIALFL

SEQ ID NO: 5911 - protein, 8 aa, Dengue virus
TMIALFLA

SEQ ID NO: 5912 - protein, 8 aa, Dengue virus
MIALFLAH

SEQ ID NO: 5913 - protein, 8 aa, Dengue virus
LEGKTVQH

SEQ ID NO: 5914 - protein, 8 aa, Dengue virus
ETTDHGTT

SEQ ID NO: 5915 - protein, 8 aa, Dengue virus
TTDHGTTA

SEQ ID NO: 5916 - protein, 8 aa, Dengue virus
STLQETWN

SEQ ID NO: 5917 - protein, 8 aa, Dengue virus
DKLTLKGV

SEQ ID NO: 5918 - protein, 8 aa, Dengue virus
KLTLKGVS

SEQ ID NO: 5919 - protein, 8 aa, Dengue virus
LTLKGVSY

SEQ ID NO: 5920 - protein, 8 aa, Dengue virus
TLKGVSYV

SEQ ID NO: 5921 - protein, 8 aa, Dengue virus
IPFSTQDG

SEQ ID NO: 5922 - protein, 8 aa, Dengue virus
QDERGVTQ

SEQ ID NO: 5923 - protein, 8 aa, Dengue virus
DGKGVTQN

SEQ ID NO: 5924 - protein, 8 aa, Dengue virus
GKGVTQNG

SEQ ID NO: 5925 - protein, 8 aa, Dengue virus
VTQNGRVI

SEQ ID NO: 5926 - protein, 8 aa, Dengue virus
FGESYITI

SEQ ID NO: 5927 - protein, 8 aa, Dengue virus
GESYITIG

SEQ ID NO: 5928 - protein, 8 aa, Dengue virus
GGVFTSAG

SEQ ID NO: 5929 - protein, 8 aa, Dengue virus
GVFTSAGK

SEQ ID NO: 5930 - protein, 8 aa, Dengue virus
VFTSMGKL

SEQ ID NO: 5931 - protein, 8 aa, Dengue virus
FTSMGKLV

SEQ ID NO: 5932 - protein, 8 aa, Dengue virus
TSAGKLVH

SEQ ID NO: 5933 - protein, 8 aa, Dengue virus
SMGKLVHQ

SEQ ID NO: 5934 - protein, 8 aa, Dengue virus
LIHQVFGT

SEQ ID NO: 5935 - protein, 8 aa, Dengue virus
IHQVFGTA

SEQ ID NO: 5936 - protein, 8 aa, Dengue virus
TCIVVGMV

SEQ ID NO: 5937 - protein, 8 aa, Dengue virus
EYKYSWRS

SEQ ID NO: 5938 - protein, 8 aa, Dengue virus
YKYSWKIW

SEQ ID NO: 5939 - protein, 8 aa, Dengue virus
PNTPECPN

SEQ ID NO: 5940 - protein, 8 aa, Dengue virus
ECSDDQRA

SEQ ID NO: 5941 - protein, 8 aa, Dengue virus
CSDDQRAW

SEQ ID NO: 5942 - protein, 8 aa, Dengue virus
SDDQRAWN

SEQ ID NO: 5943 - protein, 8 aa, Dengue virus
RDSHTQMC

SEQ ID NO: 5944 - protein, 8 aa, Dengue virus
DSHTQMCD

SEQ ID NO: 5945 - protein, 8 aa, Dengue virus
SHTQMCDH

SEQ ID NO: 5946 - protein, 8 aa, Dengue virus
HTQMCDHR

SEQ ID NO: 5947 - protein, 8 aa, Dengue virus
PKIYGGPM

SEQ ID NO: 5948 - protein, 8 aa, Dengue virus
KIYGGPMS

SEQ ID NO: 5949 - protein, 8 aa, Dengue virus
IYGGPMSQ

SEQ ID NO: 5950 - protein, 8 aa, Dengue virus
FSLGLLCV

SEQ ID NO: 5951 - protein, 8 aa, Dengue virus
SLGLLCVS

SEQ ID NO: 5952 - protein, 8 aa, Dengue virus
LGLLCVSI

SEQ ID NO: 5953 - protein, 8 aa, Dengue virus
RKMLMAGT

SEQ ID NO: 5954 - protein, 8 aa, Dengue virus
MAGTLAVF

SEQ ID NO: 5955 - protein, 8 aa, Dengue virus
GTLAVLFL

SEQ ID NO: 5956 - protein, 8 aa, Dengue virus
TLAVLFLL

SEQ ID NO: 5957 - protein, 8 aa, Dengue virus
VGANVSDR

SEQ ID NO: 5958 - protein, 8 aa, Dengue virus
GANVSDRM

SEQ ID NO: 5959 - protein, 8 aa, Dengue virus
ANVSDRMG

SEQ ID NO: 5960 - protein, 8 aa, Dengue virus
NVSDRMGM

SEQ ID NO: 5961 - protein, 8 aa, Dengue virus
VSDRMGMG

SEQ ID NO: 5962 - protein, 8 aa, Dengue virus
SDRMGMGM

SEQ ID NO: 5963 - protein, 8 aa, Dengue virus
RMGMGTTH

SEQ ID NO: 5964 - protein, 8 aa, Dengue virus
ASMELPNS

SEQ ID NO: 5965 - protein, 8 aa, Dengue virus
QLWVTLLS

SEQ ID NO: 5966 - protein, 8 aa, Dengue virus
LLSFTFIK

SEQ ID NO: 5967 - protein, 8 aa, Dengue virus
LSLTFVRT

SEQ ID NO: 5968 - protein, 8 aa, Dengue virus
SLHCAWKT

SEQ ID NO: 5969 - protein, 8 aa, Dengue virus
HCAWKTMA

SEQ ID NO: 5970 - protein, 8 aa, Dengue virus
AMVLSVVS

SEQ ID NO: 5971 - protein, 8 aa, Dengue virus
MVLSVVSL

SEQ ID NO: 5972 - protein, 8 aa, Dengue virus
LSIVSLIP

SEQ ID NO: 5973 - protein, 8 aa, Dengue virus
SIVSLIPL

SEQ ID NO: 5974 - protein, 8 aa, Dengue virus
IVSLIPLC

SEQ ID NO: 5975 - protein, 8 aa, Dengue virus
VSLFPLCM

SEQ ID NO: 5976 - protein, 8 aa, Dengue virus
PLAMFLIA

SEQ ID NO: 5977 - protein, 8 aa, Dengue virus
LTMFLIVE

SEQ ID NO: 5978 - protein, 8 aa, Dengue virus
IVENKIWG

SEQ ID NO: 5979 - protein, 8 aa, Dengue virus
VENKIWGR

SEQ ID NO: 5980 - protein, 8 aa, Dengue virus
SLEKTAEV

SEQ ID NO: 5981 - protein, 8 aa, Dengue virus
AAEVSWEK

SEQ ID NO: 5982 - protein, 8 aa, Dengue virus
EVSWEKEA

SEQ ID NO: 5983 - protein, 8 aa, Dengue virus
KEAEHSGA

SEQ ID NO: 5984 - protein, 8 aa, Dengue virus
AISGVYPL

SEQ ID NO: 5985 - protein, 8 aa, Dengue virus
PPVVERAV

SEQ ID NO: 5986 - protein, 8 aa, Dengue virus
PVVERAVL

SEQ ID NO: 5987 - protein, 8 aa, Dengue virus
VVERAVLD

SEQ ID NO: 5988 - protein, 8 aa, Dengue virus
IGLLCVMS

SEQ ID NO: 5989 - protein, 8 aa, Dengue virus
GLLCVIAS

SEQ ID NO: 5990 - protein, 8 aa, Dengue virus
LLCVIASS

SEQ ID NO: 5991 - protein, 8 aa, Dengue virus
DLGIGHVV

SEQ ID NO: 5992 - protein, 8 aa, Dengue virus
IYKRSGIV

SEQ ID NO: 5993 - protein, 8 aa, Dengue virus
VAVEPEVP

SEQ ID NO: 5994 - protein, 8 aa, Dengue virus
AVEPEVPN

SEQ ID NO: 5995 - protein, 8 aa, Dengue virus
PKAKQGTA

SEQ ID NO: 5996 - protein, 8 aa, Dengue virus
KAKQGTAQ

SEQ ID NO: 5997 - protein, 8 aa, Dengue virus
LVHKEREL

SEQ ID NO: 5998 - protein, 8 aa, Dengue virus
VHKERELH

SEQ ID NO: 5999 - protein, 8 aa, Dengue virus
SKISGGNM

SEQ ID NO: 6000 - protein, 8 aa, Dengue virus
KIPGGSMY

SEQ ID NO: 6001 - protein, 8 aa, Dengue virus
ELETPILA

SEQ ID NO: 6002 - protein, 8 aa, Dengue virus
CSADPVDW

SEQ ID NO: 6003 - protein, 8 aa, Dengue virus
PIDWVPTS

SEQ ID NO: 6004 - protein, 8 aa, Dengue virus
VNWVPTSR

SEQ ID NO: 6005 - protein, 8 aa, Dengue virus
KTRISSWE

SEQ ID NO: 6006 - protein, 8 aa, Dengue virus
VSSWEDVP

SEQ ID NO: 6007 - protein, 9 aa, Dengue virus
MNNQRKKTA

SEQ ID NO: 6008 - protein, 9 aa, Dengue virus
NNQRKKTAR

SEQ ID NO: 6009 - protein, 9 aa, Dengue virus
NQRKKTARP

SEQ ID NO: 6010 - protein, 9 aa, Dengue virus
QRKKTARPS

SEQ ID NO: 6011 - protein, 9 aa, Dengue virus
RKKTARPSF

SEQ ID NO: 6012 - protein, 9 aa, Dengue virus
KKTARPSFN

SEQ ID NO: 6013 - protein, 9 aa, Dengue virus
KTARPSFNM

SEQ ID NO: 6014 - protein, 9 aa, Dengue virus
TARPSFNML

SEQ ID NO: 6015 - protein, 9 aa, Dengue virus
ARPSFNMLK

SEQ ID NO: 6016 - protein, 9 aa, Dengue virus
RPSFNMLKR

SEQ ID NO: 6017 - protein, 9 aa, Dengue virus
PSFNMLKRA

SEQ ID NO: 6018 - protein, 9 aa, Dengue virus
SFNMLKRAR

SEQ ID NO: 6019 - protein, 9 aa, Dengue virus
FNMLKRARN

SEQ ID NO: 6020 - protein, 9 aa, Dengue virus
NMLKRARNR

SEQ ID NO: 6021 - protein, 9 aa, Dengue virus
MLKRARNRV

SEQ ID NO: 6022 - protein, 9 aa, Dengue virus
LKRARNRVS

SEQ ID NO: 6023 - protein, 9 aa, Dengue virus
KRARNRVST

SEQ ID NO: 6024 - protein, 9 aa, Dengue virus
RARNRVSTV

SEQ ID NO: 6025 - protein, 9 aa, Dengue virus
ARNRVSTVS

SEQ ID NO: 6026 - protein, 9 aa, Dengue virus
RNRVSTVSQ

SEQ ID NO: 6027 - protein, 9 aa, Dengue virus
NRVSTVSQL

SEQ ID NO: 6028 - protein, 9 aa, Dengue virus
RVSTVSQLA

SEQ ID NO: 6029 - protein, 9 aa, Dengue virus
VSTVSQLAK

SEQ ID NO: 6030 - protein, 9 aa, Dengue virus
STVSQLAKR

SEQ ID NO: 6031 - protein, 9 aa, Dengue virus
TVSQLAKRF

SEQ ID NO: 6032 - protein, 9 aa, Dengue virus
VSQLAKRFS

SEQ ID NO: 6033 - protein, 9 aa, Dengue virus
SQLAKRFSK

SEQ ID NO: 6034 - protein, 9 aa, Dengue virus
QLAKRFSKG

SEQ ID NO: 6035 - protein, 9 aa, Dengue virus
LAKRFSKGL

SEQ ID NO: 6036 - protein, 9 aa, Dengue virus
AKRFSKGLL

SEQ ID NO: 6037 - protein, 9 aa, Dengue virus
KRFSKGLLS

SEQ ID NO: 6038 - protein, 9 aa, Dengue virus
RFSKGLLSG

SEQ ID NO: 6039 - protein, 9 aa, Dengue virus
FSKGLLSGQ

SEQ ID NO: 6040 - protein, 9 aa, Dengue virus
SKGLLSGQG

SEQ ID NO: 6041 - protein, 9 aa, Dengue virus
KGLLSGQGP

SEQ ID NO: 6042 - protein, 9 aa, Dengue virus
GLLSGQGPM

SEQ ID NO: 6043 - protein, 9 aa, Dengue virus
LLSGQGPMK

SEQ ID NO: 6044 - protein, 9 aa, Dengue virus
LSGQGPMKL

SEQ ID NO: 6045 - protein, 9 aa, Dengue virus
SGQGPMKLV

SEQ ID NO: 6046 - protein, 9 aa, Dengue virus
GQGPMKLVM

SEQ ID NO: 6047 - protein, 9 aa, Dengue virus
QGPMKLVMA

SEQ ID NO: 6048 - protein, 9 aa, Dengue virus
GPMKLVMAF

SEQ ID NO: 6049 - protein, 9 aa, Dengue virus
PMKLVMAFI

SEQ ID NO: 6050 - protein, 9 aa, Dengue virus
MKLVMAFIA

SEQ ID NO: 6051 - protein, 9 aa, Dengue virus
KLVMAFIAF

SEQ ID NO: 6052 - protein, 9 aa, Dengue virus
LVMAFIAFL

SEQ ID NO: 6053 - protein, 9 aa, Dengue virus
VMAFIAFLR

SEQ ID NO: 6054 - protein, 9 aa, Dengue virus
MAFIAFLRF

SEQ ID NO: 6055 - protein, 9 aa, Dengue virus
AFIAFLRFL

SEQ ID NO: 6056 - protein, 9 aa, Dengue virus
FIAFLRFLA

SEQ ID NO: 6057 - protein, 9 aa, Dengue virus
IAFLRFLAI

SEQ ID NO: 6058 - protein, 9 aa, Dengue virus
AFLRFLAIP

SEQ ID NO: 6059 - protein, 9 aa, Dengue virus
FLRFLAIPP

SEQ ID NO: 6060 - protein, 9 aa, Dengue virus
LRFLAIPPT

SEQ ID NO: 6061 - protein, 9 aa, Dengue virus
RFLAIPPTA

SEQ ID NO: 6062 - protein, 9 aa, Dengue virus
FLAIPPTAG

SEQ ID NO: 6063 - protein, 9 aa, Dengue virus
LAIPPTAGI

SEQ ID NO: 6064 - protein, 9 aa, Dengue virus
AIPPTAGIL

SEQ ID NO: 6065 - protein, 9 aa, Dengue virus
IPPTAGILA

SEQ ID NO: 6066 - protein, 9 aa, Dengue virus
PPTAGILAR

SEQ ID NO: 6067 - protein, 9 aa, Dengue virus
PTAGILARW

SEQ ID NO: 6068 - protein, 9 aa, Dengue virus
TAGILARWG

SEQ ID NO: 6069 - protein, 9 aa, Dengue virus
AGILARWGS

SEQ ID NO: 6070 - protein, 9 aa, Dengue virus
GILARWGSF

SEQ ID NO: 6071 - protein, 9 aa, Dengue virus
ILARWGSFK

SEQ ID NO: 6072 - protein, 9 aa, Dengue virus
LARWGSFKK

SEQ ID NO: 6073 - protein, 9 aa, Dengue virus
ARWGSFKKN

SEQ ID NO: 6074 - protein, 9 aa, Dengue virus
RWGSFKKNG

SEQ ID NO: 6075 - protein, 9 aa, Dengue virus
WGSFKKNGA

SEQ ID NO: 6076 - protein, 9 aa, Dengue virus
GSFKKNGAI

SEQ ID NO: 6077 - protein, 9 aa, Dengue virus
SFKKNGAIK

SEQ ID NO: 6078 - protein, 9 aa, Dengue virus
FKKNGAIKV

SEQ ID NO: 6079 - protein, 9 aa, Dengue virus
KKNGAIKVL

SEQ ID NO: 6080 - protein, 9 aa, Dengue virus
KNGAIKVLR

SEQ ID NO: 6081 - protein, 9 aa, Dengue virus
NGAIKVLRG

SEQ ID NO: 6082 - protein, 9 aa, Dengue virus
GAIKVLRGF

SEQ ID NO: 6083 - protein, 9 aa, Dengue virus
AIKVLRGFK

SEQ ID NO: 6084 - protein, 9 aa, Dengue virus
IKVLRGFKK

SEQ ID NO: 6085 - protein, 9 aa, Dengue virus
KVLRGFKKE

SEQ ID NO: 6086 - protein, 9 aa, Dengue virus
VLRGFKKEI

SEQ ID NO: 6087 - protein, 9 aa, Dengue virus
LRGFKKEIS

SEQ ID NO: 6088 - protein, 9 aa, Dengue virus
RGFKKEISN

SEQ ID NO: 6089 - protein, 9 aa, Dengue virus
GFKKEISNM

SEQ ID NO: 6090 - protein, 9 aa, Dengue virus
FKKEISNML

SEQ ID NO: 6091 - protein, 9 aa, Dengue virus
KKEISNMLN

SEQ ID NO: 6092 - protein, 9 aa, Dengue virus
MLNIMNRRK

SEQ ID NO: 6093 - protein, 9 aa, Dengue virus
MNRRKRSVT

SEQ ID NO: 6094 - protein, 9 aa, Dengue virus
NRRKRSVTM

SEQ ID NO: 6095 - protein, 9 aa, Dengue virus
RRKRSVTML

SEQ ID NO: 6096 - protein, 9 aa, Dengue virus
RKRSVTMLL

SEQ ID NO: 6097 - protein, 9 aa, Dengue virus
RSVTMLLML

SEQ ID NO: 6098 - protein, 9 aa, Dengue virus
PTALAFHLT

SEQ ID NO: 6099 - protein, 9 aa, Dengue virus
TALAFHLTT

SEQ ID NO: 6100 - protein, 9 aa, Dengue virus
ALAFHLTTR

SEQ ID NO: 6101 - protein, 9 aa, Dengue virus
LAFHLTTRG

SEQ ID NO: 6102 - protein, 9 aa, Dengue virus
AFHLTTRGG

SEQ ID NO: 6103 - protein, 9 aa, Dengue virus
FHLTTRGGE

SEQ ID NO: 6104 - protein, 9 aa, Dengue virus
HLTTRGGEP

SEQ ID NO: 6105 - protein, 9 aa, Dengue virus
LTTRGGEPH

SEQ ID NO: 6106 - protein, 9 aa, Dengue virus
TTRGGEPHM

SEQ ID NO: 6107 - protein, 9 aa, Dengue virus
TRGGEPHMI

SEQ ID NO: 6108 - protein, 9 aa, Dengue virus
RGGEPHMIV

SEQ ID NO: 6109 - protein, 9 aa, Dengue virus
GGEPHMIVS

SEQ ID NO: 6110 - protein, 9 aa, Dengue virus
GEPHMIVSK

SEQ ID NO: 6111 - protein, 9 aa, Dengue virus
EPHMIVSKQ

SEQ ID NO: 6112 - protein, 9 aa, Dengue virus
PHMIVSKQE

SEQ ID NO: 6113 - protein, 9 aa, Dengue virus
HMIVSKQER

SEQ ID NO: 6114 - protein, 9 aa, Dengue virus
MIVSKQERG

SEQ ID NO: 6115 - protein, 9 aa, Dengue virus
IVSKQERGK

SEQ ID NO: 6116 - protein, 9 aa, Dengue virus
VSKQERGKS

SEQ ID NO: 6117 - protein, 9 aa, Dengue virus
SKQERGKSL

SEQ ID NO: 6118 - protein, 9 aa, Dengue virus
KQERGKSLL

SEQ ID NO: 6119 - protein, 9 aa, Dengue virus
QERGKSLLF

SEQ ID NO: 6120 - protein, 9 aa, Dengue virus
ERGKSLLFK

SEQ ID NO: 6121 - protein, 9 aa, Dengue virus
RGKSLLFKT

SEQ ID NO: 6122 - protein, 9 aa, Dengue virus
GKSLLFKTS

SEQ ID NO: 6123 - protein, 9 aa, Dengue virus
KSLLFKTSA

SEQ ID NO: 6124 - protein, 9 aa, Dengue virus
SLLFKTSAG

SEQ ID NO: 6125 - protein, 9 aa, Dengue virus
LLFKTSAGV

SEQ ID NO: 6126 - protein, 9 aa, Dengue virus
LFKTSAGVN

SEQ ID NO: 6127 - protein, 9 aa, Dengue virus
FKTSAGVNM

SEQ ID NO: 6128 - protein, 9 aa, Dengue virus
KTSAGVNMC

SEQ ID NO: 6129 - protein, 9 aa, Dengue virus
TSAGVNMCT

SEQ ID NO: 6130 - protein, 9 aa, Dengue virus
SAGVNMCTL

SEQ ID NO: 6131 - protein, 9 aa, Dengue virus
AGVNMCTLI

SEQ ID NO: 6132 - protein, 9 aa, Dengue virus
GVNMCTLIA

SEQ ID NO: 6133 - protein, 9 aa, Dengue virus
VNMCTLIAM

SEQ ID NO: 6134 - protein, 9 aa, Dengue virus
NMCTLIAMD

SEQ ID NO: 6135 - protein, 9 aa, Dengue virus
MCTLIAMDL

SEQ ID NO: 6136 - protein, 9 aa, Dengue virus
CTLIAMDLG

SEQ ID NO: 6137 - protein, 9 aa, Dengue virus
TLIAMDLGE

SEQ ID NO: 6138 - protein, 9 aa, Dengue virus
LIAMDLGEL

SEQ ID NO: 6139 - protein, 9 aa, Dengue virus
IAMDLGELC

SEQ ID NO: 6140 - protein, 9 aa, Dengue virus
AMDLGELCE

SEQ ID NO: 6141 - protein, 9 aa, Dengue virus
MDLGELCED

SEQ ID NO: 6142 - protein, 9 aa, Dengue virus
DLGELCEDT

SEQ ID NO: 6143 - protein, 9 aa, Dengue virus
LGELCEDTM

SEQ ID NO: 6144 - protein, 9 aa, Dengue virus
GELCEDTMT

SEQ ID NO: 6145 - protein, 9 aa, Dengue virus
ELCEDTMTY

SEQ ID NO: 6146 - protein, 9 aa, Dengue virus
LCEDTMTYK

SEQ ID NO: 6147 - protein, 9 aa, Dengue virus
CEDTMTYKC

SEQ ID NO: 6148 - protein, 9 aa, Dengue virus
EDTMTYKCP

SEQ ID NO: 6149 - protein, 9 aa, Dengue virus
DTMTYKCPR

SEQ ID NO: 6150 - protein, 9 aa, Dengue virus
TMTYKCPRI

SEQ ID NO: 6151 - protein, 9 aa, Dengue virus
MTYKCPRIT

SEQ ID NO: 6152 - protein, 9 aa, Dengue virus
TYKCPRITE

SEQ ID NO: 6153 - protein, 9 aa, Dengue virus
YKCPRITEA

SEQ ID NO: 6154 - protein, 9 aa, Dengue virus
KCPRITEAE

SEQ ID NO: 6155 - protein, 9 aa, Dengue virus
CPRITEAEP

SEQ ID NO: 6156 - protein, 9 aa, Dengue virus
PRITEAEPD

SEQ ID NO: 6157 - protein, 9 aa, Dengue virus
RITEAEPDD

SEQ ID NO: 6158 - protein, 9 aa, Dengue virus
ITEAEPDDV

SEQ ID NO: 6159 - protein, 9 aa, Dengue virus
TEAEPDDVD

SEQ ID NO: 6160 - protein, 9 aa, Dengue virus
EAEPDDVDC

SEQ ID NO: 6161 - protein, 9 aa, Dengue virus
AEPDDVDCW

SEQ ID NO: 6162 - protein, 9 aa, Dengue virus
EPDDVDCWC

SEQ ID NO: 6163 - protein, 9 aa, Dengue virus
PDDVDCWCN

SEQ ID NO: 6164 - protein, 9 aa, Dengue virus
DDVDCWCNA

SEQ ID NO: 6165 - protein, 9 aa, Dengue virus
DVDCWCNAT

SEQ ID NO: 6166 - protein, 9 aa, Dengue virus
VDCWCNATD

SEQ ID NO: 6167 - protein, 9 aa, Dengue virus
DCWCNATDT

SEQ ID NO: 6168 - protein, 9 aa, Dengue virus
CWCNATDTW

SEQ ID NO: 6169 - protein, 9 aa, Dengue virus
WCNATDTWV

SEQ ID NO: 6170 - protein, 9 aa, Dengue virus
CNATDTWVT

SEQ ID NO: 6171 - protein, 9 aa, Dengue virus
NATDTWVTY

SEQ ID NO: 6172 - protein, 9 aa, Dengue virus
ATDTWVTYG

SEQ ID NO: 6173 - protein, 9 aa, Dengue virus
TDTWVTYGT

SEQ ID NO: 6174 - protein, 9 aa, Dengue virus
DTWVTYGTC

SEQ ID NO: 6175 - protein, 9 aa, Dengue virus
TWVTYGTCS

SEQ ID NO: 6176 - protein, 9 aa, Dengue virus
WVTYGTCSQ

SEQ ID NO: 6177 - protein, 9 aa, Dengue virus
VTYGTCSQT

SEQ ID NO: 6178 - protein, 9 aa, Dengue virus
TYGTCSQTG

SEQ ID NO: 6179 - protein, 9 aa, Dengue virus
YGTCSQTGE

SEQ ID NO: 6180 - protein, 9 aa, Dengue virus
GTCSQTGEH

SEQ ID NO: 6181 - protein, 9 aa, Dengue virus
TCSQTGEHR

SEQ ID NO: 6182 - protein, 9 aa, Dengue virus
CSQTGEHRR

SEQ ID NO: 6183 - protein, 9 aa, Dengue virus
SQTGEHRRD

SEQ ID NO: 6184 - protein, 9 aa, Dengue virus
QTGEHRRDK

SEQ ID NO: 6185 - protein, 9 aa, Dengue virus
TGEHRRDKR

SEQ ID NO: 6186 - protein, 9 aa, Dengue virus
GEHRRDKRS

SEQ ID NO: 6187 - protein, 9 aa, Dengue virus
EHRRDKRSV

SEQ ID NO: 6188 - protein, 9 aa, Dengue virus
HRRDKRSVA

SEQ ID NO: 6189 - protein, 9 aa, Dengue virus
RRDKRSVAL

SEQ ID NO: 6190 - protein, 9 aa, Dengue virus
RDKRSVALA

SEQ ID NO: 6191 - protein, 9 aa, Dengue virus
DKRSVALAP

SEQ ID NO: 6192 - protein, 9 aa, Dengue virus
KRSVALAPH

SEQ ID NO: 6193 - protein, 9 aa, Dengue virus
RSVALAPHV

SEQ ID NO: 6194 - protein, 9 aa, Dengue virus
SVALAPHVG

SEQ ID NO: 6195 - protein, 9 aa, Dengue virus
VALAPHVGL

SEQ ID NO: 6196 - protein, 9 aa, Dengue virus
ALAPHVGLG

SEQ ID NO: 6197 - protein, 9 aa, Dengue virus
LAPHVGLGL

SEQ ID NO: 6198 - protein, 9 aa, Dengue virus
APHVGLGLE

SEQ ID NO: 6199 - protein, 9 aa, Dengue virus
PHVGLGLET

SEQ ID NO: 6200 - protein, 9 aa, Dengue virus
HVGLGLETR

SEQ ID NO: 6201 - protein, 9 aa, Dengue virus
VGLGLETRT

SEQ ID NO: 6202 - protein, 9 aa, Dengue virus
GLGLETRTE

SEQ ID NO: 6203 - protein, 9 aa, Dengue virus
LGLETRTET

SEQ ID NO: 6204 - protein, 9 aa, Dengue virus
GLETRTETW

SEQ ID NO: 6205 - protein, 9 aa, Dengue virus
LETRTETWM

SEQ ID NO: 6206 - protein, 9 aa, Dengue virus
ETRTETWMS

SEQ ID NO: 6207 - protein, 9 aa, Dengue virus
TRTETWMSS

SEQ ID NO: 6208 - protein, 9 aa, Dengue virus
RTETWMSSE

SEQ ID NO: 6209 - protein, 9 aa, Dengue virus
TETWMSSEG

SEQ ID NO: 6210 - protein, 9 aa, Dengue virus
ETWMSSEGA

SEQ ID NO: 6211 - protein, 9 aa, Dengue virus
TWMSSEGAW

SEQ ID NO: 6212 - protein, 9 aa, Dengue virus
WMSSEGAWK

SEQ ID NO: 6213 - protein, 9 aa, Dengue virus
MSSEGAWKQ

SEQ ID NO: 6214 - protein, 9 aa, Dengue virus
SSEGAWKQI

SEQ ID NO: 6215 - protein, 9 aa, Dengue virus
SEGAWKQIQ

SEQ ID NO: 6216 - protein, 9 aa, Dengue virus
EGAWKQIQR

SEQ ID NO: 6217 - protein, 9 aa, Dengue virus
GAWKQIQRV

SEQ ID NO: 6218 - protein, 9 aa, Dengue virus
AWKQIQRVE

SEQ ID NO: 6219 - protein, 9 aa, Dengue virus
WKQIQRVET

SEQ ID NO: 6220 - protein, 9 aa, Dengue virus
KQIQRVETW

SEQ ID NO: 6221 - protein, 9 aa, Dengue virus
QIQRVETWA

SEQ ID NO: 6222 - protein, 9 aa, Dengue virus
IQRVETWAL

SEQ ID NO: 6223 - protein, 9 aa, Dengue virus
QRVETWALR

SEQ ID NO: 6224 - protein, 9 aa, Dengue virus
RVETWALRH

SEQ ID NO: 6225 - protein, 9 aa, Dengue virus
VETWALRHP

SEQ ID NO: 6226 - protein, 9 aa, Dengue virus
ETWALRHPG

SEQ ID NO: 6227 - protein, 9 aa, Dengue virus
TWALRHPGF

SEQ ID NO: 6228 - protein, 9 aa, Dengue virus
WALRHPGFT

SEQ ID NO: 6229 - protein, 9 aa, Dengue virus
ALRHPGFTV

SEQ ID NO: 6230 - protein, 9 aa, Dengue virus
LRHPGFTVI

SEQ ID NO: 6231 - protein, 9 aa, Dengue virus
RHPGFTVIA

SEQ ID NO: 6232 - protein, 9 aa, Dengue virus
HPGFTVIAL

SEQ ID NO: 6233 - protein, 9 aa, Dengue virus
PGFTVIALF

SEQ ID NO: 6234 - protein, 9 aa, Dengue virus
GFTVIALFL

SEQ ID NO: 6235 - protein, 9 aa, Dengue virus
FTVIALFLA

SEQ ID NO: 6236 - protein, 9 aa, Dengue virus
ALFLAHAIG

SEQ ID NO: 6237 - protein, 9 aa, Dengue virus
LFLAHAIGT

SEQ ID NO: 6238 - protein, 9 aa, Dengue virus
FLAHAIGTS

SEQ ID NO: 6239 - protein, 9 aa, Dengue virus
LAHAIGTSI

SEQ ID NO: 6240 - protein, 9 aa, Dengue virus
AHAIGTSIT

SEQ ID NO: 6241 - protein, 9 aa, Dengue virus
HAIGTSITQ

SEQ ID NO: 6242 - protein, 9 aa, Dengue virus
AIGTSITQK

SEQ ID NO: 6243 - protein, 9 aa, Dengue virus
IGTSITQKG

SEQ ID NO: 6244 - protein, 9 aa, Dengue virus
GTSITQKGI

SEQ ID NO: 6245 - protein, 9 aa, Dengue virus
TSITQKGII

SEQ ID NO: 6246 - protein, 9 aa, Dengue virus
SITQKGIIF

SEQ ID NO: 6247 - protein, 9 aa, Dengue virus
ITQKGIIFI

SEQ ID NO: 6248 - protein, 9 aa, Dengue virus
TQKGIIFIL

SEQ ID NO: 6249 - protein, 9 aa, Dengue virus
QKGIIFILL

SEQ ID NO: 6250 - protein, 9 aa, Dengue virus
KGIIFILLM

SEQ ID NO: 6251 - protein, 9 aa, Dengue virus
GIIFILLML

SEQ ID NO: 6252 - protein, 9 aa, Dengue virus
IIFILLMLV

SEQ ID NO: 6253 - protein, 9 aa, Dengue virus
IFILLMLVT

SEQ ID NO: 6254 - protein, 9 aa, Dengue virus
FILLMLVTP

SEQ ID NO: 6255 - protein, 9 aa, Dengue virus
ILLMLVTPS

SEQ ID NO: 6256 - protein, 9 aa, Dengue virus
LLMLVTPSM

SEQ ID NO: 6257 - protein, 9 aa, Dengue virus
LMLVTPSMA

SEQ ID NO: 6258 - protein, 9 aa, Dengue virus
MLVTPSMAM

SEQ ID NO: 6259 - protein, 9 aa, Dengue virus
LVTPSMAMR

SEQ ID NO: 6260 - protein, 9 aa, Dengue virus
VTPSMAMRC

SEQ ID NO: 6261 - protein, 9 aa, Dengue virus
TPSMAMRCV

SEQ ID NO: 6262 - protein, 9 aa, Dengue virus
PSMAMRCVG

SEQ ID NO: 6263 - protein, 9 aa, Dengue virus
SMAMRCVGI

SEQ ID NO: 6264 - protein, 9 aa, Dengue virus
MAMRCVGIG

SEQ ID NO: 6265 - protein, 9 aa, Dengue virus
AMRCVGIGS

SEQ ID NO: 6266 - protein, 9 aa, Dengue virus
MRCVGIGSR

SEQ ID NO: 6267 - protein, 9 aa, Dengue virus
RCVGIGSRD

SEQ ID NO: 6268 - protein, 9 aa, Dengue virus
CVGIGSRDF

SEQ ID NO: 6269 - protein, 9 aa, Dengue virus
VGIGSRDFV

SEQ ID NO: 6270 - protein, 9 aa, Dengue virus
GIGSRDFVE

SEQ ID NO: 6271 - protein, 9 aa, Dengue virus
IGSRDFVEG

SEQ ID NO: 6272 - protein, 9 aa, Dengue virus
GSRDFVEGL

SEQ ID NO: 6273 - protein, 9 aa, Dengue virus
SRDFVEGLS

SEQ ID NO: 6274 - protein, 9 aa, Dengue virus
RDFVEGLSG

SEQ ID NO: 6275 - protein, 9 aa, Dengue virus
DFVEGLSGA

SEQ ID NO: 6276 - protein, 9 aa, Dengue virus
FVEGLSGAT

SEQ ID NO: 6277 - protein, 9 aa, Dengue virus
VEGLSGATW

SEQ ID NO: 6278 - protein, 9 aa, Dengue virus
EGLSGATWV

SEQ ID NO: 6279 - protein, 9 aa, Dengue virus
GLSGATWVD

SEQ ID NO: 6280 - protein, 9 aa, Dengue virus
LSGATWVDV

SEQ ID NO: 6281 - protein, 9 aa, Dengue virus
SGATWVDVV

SEQ ID NO: 6282 - protein, 9 aa, Dengue virus
GATWVDVVL

SEQ ID NO: 6283 - protein, 9 aa, Dengue virus
ATWVDVVLE

SEQ ID NO: 6284 - protein, 9 aa, Dengue virus
TWVDVVLEH

SEQ ID NO: 6285 - protein, 9 aa, Dengue virus
WVDVVLEHG

SEQ ID NO: 6286 - protein, 9 aa, Dengue virus
VDVVLEHGS

SEQ ID NO: 6287 - protein, 9 aa, Dengue virus
DVVLEHGSC

SEQ ID NO: 6288 - protein, 9 aa, Dengue virus
VVLEHGSCV

SEQ ID NO: 6289 - protein, 9 aa, Dengue virus
VLEHGSCVT

SEQ ID NO: 6290 - protein, 9 aa, Dengue virus
LEHGSCVTT

SEQ ID NO: 6291 - protein, 9 aa, Dengue virus
EHGSCVTTM

SEQ ID NO: 6292 - protein, 9 aa, Dengue virus
HGSCVTTMA

SEQ ID NO: 6293 - protein, 9 aa, Dengue virus
GSCVTTMAK

SEQ ID NO: 6294 - protein, 9 aa, Dengue virus
SCVTTMAKD

SEQ ID NO: 6295 - protein, 9 aa, Dengue virus
CVTTMAKDK

SEQ ID NO: 6296 - protein, 9 aa, Dengue virus
VTTMAKDKP

SEQ ID NO: 6297 - protein, 9 aa, Dengue virus
TTMAKDKPT

SEQ ID NO: 6298 - protein, 9 aa, Dengue virus
TMAKDKPTL

SEQ ID NO: 6299 - protein, 9 aa, Dengue virus
MAKDKPTLD

SEQ ID NO: 6300 - protein, 9 aa, Dengue virus
AKDKPTLDI

SEQ ID NO: 6301 - protein, 9 aa, Dengue virus
KDKPTLDIE

SEQ ID NO: 6302 - protein, 9 aa, Dengue virus
DKPTLDIEL

SEQ ID NO: 6303 - protein, 9 aa, Dengue virus
KPTLDIELL

SEQ ID NO: 6304 - protein, 9 aa, Dengue virus
PTLDIELLK

SEQ ID NO: 6305 - protein, 9 aa, Dengue virus
TLDIELLKT

SEQ ID NO: 6306 - protein, 9 aa, Dengue virus
LDIELLKTE

SEQ ID NO: 6307 - protein, 9 aa, Dengue virus
DIELLKTEV

SEQ ID NO: 6308 - protein, 9 aa, Dengue virus
IELLKTEVT

SEQ ID NO: 6309 - protein, 9 aa, Dengue virus
ELLKTEVTN

SEQ ID NO: 6310 - protein, 9 aa, Dengue virus
LLKTEVTNP

SEQ ID NO: 6311 - protein, 9 aa, Dengue virus
LKTEVTNPA

SEQ ID NO: 6312 - protein, 9 aa, Dengue virus
KTEVTNPAV

SEQ ID NO: 6313 - protein, 9 aa, Dengue virus
TEVTNPAVL

SEQ ID NO: 6314 - protein, 9 aa, Dengue virus
EVTNPAVLR

SEQ ID NO: 6315 - protein, 9 aa, Dengue virus
VTNPAVLRK

SEQ ID NO: 6316 - protein, 9 aa, Dengue virus
TNPAVLRKL

SEQ ID NO: 6317 - protein, 9 aa, Dengue virus
NPAVLRKLC

SEQ ID NO: 6318 - protein, 9 aa, Dengue virus
PAVLRKLCI

SEQ ID NO: 6319 - protein, 9 aa, Dengue virus
AVLRKLCIE

SEQ ID NO: 6320 - protein, 9 aa, Dengue virus
VLRKLCIEA

SEQ ID NO: 6321 - protein, 9 aa, Dengue virus
LRKLCIEAK

SEQ ID NO: 6322 - protein, 9 aa, Dengue virus
RKLCIEAKI

SEQ ID NO: 6323 - protein, 9 aa, Dengue virus
KLCIEAKIS

SEQ ID NO: 6324 - protein, 9 aa, Dengue virus
LCIEAKISN

SEQ ID NO: 6325 - protein, 9 aa, Dengue virus
CIEAKISNT

SEQ ID NO: 6326 - protein, 9 aa, Dengue virus
IEAKISNTT

SEQ ID NO: 6327 - protein, 9 aa, Dengue virus
EAKISNTTT

SEQ ID NO: 6328 - protein, 9 aa, Dengue virus
AKISNTTTD

SEQ ID NO: 6329 - protein, 9 aa, Dengue virus
KISNTTTDS

SEQ ID NO: 6330 - protein, 9 aa, Dengue virus
ISNTTTDSR

SEQ ID NO: 6331 - protein, 9 aa, Dengue virus
SNTTTDSRC

SEQ ID NO: 6332 - protein, 9 aa, Dengue virus
NTTTDSRCP

SEQ ID NO: 6333 - protein, 9 aa, Dengue virus
TTTDSRCPT

SEQ ID NO: 6334 - protein, 9 aa, Dengue virus
TTDSRCPTQ

SEQ ID NO: 6335 - protein, 9 aa, Dengue virus
TDSRCPTQG

SEQ ID NO: 6336 - protein, 9 aa, Dengue virus
DSRCPTQGE

SEQ ID NO: 6337 - protein, 9 aa, Dengue virus
SRCPTQGEA

SEQ ID NO: 6338 - protein, 9 aa, Dengue virus
RCPTQGEAT

SEQ ID NO: 6339 - protein, 9 aa, Dengue virus
CPTQGEATL

SEQ ID NO: 6340 - protein, 9 aa, Dengue virus
PTQGEATLV

SEQ ID NO: 6341 - protein, 9 aa, Dengue virus
TQGEATLVE

SEQ ID NO: 6342 - protein, 9 aa, Dengue virus
QGEATLVEE

SEQ ID NO: 6343 - protein, 9 aa, Dengue virus
GEATLVEEQ

SEQ ID NO: 6344 - protein, 9 aa, Dengue virus
EATLVEEQD

SEQ ID NO: 6345 - protein, 9 aa, Dengue virus
ATLVEEQDA

SEQ ID NO: 6346 - protein, 9 aa, Dengue virus
TLVEEQDAN

SEQ ID NO: 6347 - protein, 9 aa, Dengue virus
LVEEQDANF

SEQ ID NO: 6348 - protein, 9 aa, Dengue virus
VEEQDANFV

SEQ ID NO: 6349 - protein, 9 aa, Dengue virus
EEQDANFVC

SEQ ID NO: 6350 - protein, 9 aa, Dengue virus
EQDANFVCR

SEQ ID NO: 6351 - protein, 9 aa, Dengue virus
QDANFVCRR

SEQ ID NO: 6352 - protein, 9 aa, Dengue virus
DANFVCRRT

SEQ ID NO: 6353 - protein, 9 aa, Dengue virus
ANFVCRRTF

SEQ ID NO: 6354 - protein, 9 aa, Dengue virus
NFVCRRTFV

SEQ ID NO: 6355 - protein, 9 aa, Dengue virus
FVCRRTFVD

SEQ ID NO: 6356 - protein, 9 aa, Dengue virus
VCRRTFVDR

SEQ ID NO: 6357 - protein, 9 aa, Dengue virus
CRRTFVDRG

SEQ ID NO: 6358 - protein, 9 aa, Dengue virus
RRTFVDRGW

SEQ ID NO: 6359 - protein, 9 aa, Dengue virus
RTFVDRGWG

SEQ ID NO: 6360 - protein, 9 aa, Dengue virus
TFVDRGWGN

SEQ ID NO: 6361 - protein, 9 aa, Dengue virus
FVDRGWGNG

SEQ ID NO: 6362 - protein, 9 aa, Dengue virus
VDRGWGNGC

SEQ ID NO: 6363 - protein, 9 aa, Dengue virus
DRGWGNGCG

SEQ ID NO: 6364 - protein, 9 aa, Dengue virus
RGWGNGCGL

SEQ ID NO: 6365 - protein, 9 aa, Dengue virus
GWGNGCGLF

SEQ ID NO: 6366 - protein, 9 aa, Dengue virus
WGNGCGLFG

SEQ ID NO: 6367 - protein, 9 aa, Dengue virus
GNGCGLFGK

SEQ ID NO: 6368 - protein, 9 aa, Dengue virus
NGCGLFGKG

SEQ ID NO: 6369 - protein, 9 aa, Dengue virus
GCGLFGKGS

SEQ ID NO: 6370 - protein, 9 aa, Dengue virus
CGLFGKGSL

SEQ ID NO: 6371 - protein, 9 aa, Dengue virus
GLFGKGSLI

SEQ ID NO: 6372 - protein, 9 aa, Dengue virus
LFGKGSLIT

SEQ ID NO: 6373 - protein, 9 aa, Dengue virus
FGKGSLITC

SEQ ID NO: 6374 - protein, 9 aa, Dengue virus
GKGSLITCA

SEQ ID NO: 6375 - protein, 9 aa, Dengue virus
KGSLITCAK

SEQ ID NO: 6376 - protein, 9 aa, Dengue virus
GSLITCAKF

SEQ ID NO: 6377 - protein, 9 aa, Dengue virus
SLITCAKFK

SEQ ID NO: 6378 - protein, 9 aa, Dengue virus
LITCAKFKC

SEQ ID NO: 6379 - protein, 9 aa, Dengue virus
ITCAKFKCV

SEQ ID NO: 6380 - protein, 9 aa, Dengue virus
TCAKFKCVT

SEQ ID NO: 6381 - protein, 9 aa, Dengue virus
CAKFKCVTK

SEQ ID NO: 6382 - protein, 9 aa, Dengue virus
AKFKCVTKL

SEQ ID NO: 6383 - protein, 9 aa, Dengue virus
KFKCVTKLE

SEQ ID NO: 6384 - protein, 9 aa, Dengue virus
FKCVTKLEG

SEQ ID NO: 6385 - protein, 9 aa, Dengue virus
KCVTKLEGK

SEQ ID NO: 6386 - protein, 9 aa, Dengue virus
CVTKLEGKI

SEQ ID NO: 6387 - protein, 9 aa, Dengue virus
VTKLEGKIV

SEQ ID NO: 6388 - protein, 9 aa, Dengue virus
TKLEGKIVQ

SEQ ID NO: 6389 - protein, 9 aa, Dengue virus
KLEGKIVQY

SEQ ID NO: 6390 - protein, 9 aa, Dengue virus
LEGKIVQYE

SEQ ID NO: 6391 - protein, 9 aa, Dengue virus
EGKIVQYEN

SEQ ID NO: 6392 - protein, 9 aa, Dengue virus
GKIVQYENL

SEQ ID NO: 6393 - protein, 9 aa, Dengue virus
KIVQYENLK

SEQ ID NO: 6394 - protein, 9 aa, Dengue virus
IVQYENLKY

SEQ ID NO: 6395 - protein, 9 aa, Dengue virus
VQYENLKYS

SEQ ID NO: 6396 - protein, 9 aa, Dengue virus
QYENLKYSV

SEQ ID NO: 6397 - protein, 9 aa, Dengue virus
YENLKYSVI

SEQ ID NO: 6398 - protein, 9 aa, Dengue virus
ENLKYSVIV

SEQ ID NO: 6399 - protein, 9 aa, Dengue virus
NLKYSVIVT

SEQ ID NO: 6400 - protein, 9 aa, Dengue virus
LKYSVIVTV

SEQ ID NO: 6401 - protein, 9 aa, Dengue virus
KYSVIVTVH

SEQ ID NO: 6402 - protein, 9 aa, Dengue virus
YSVIVTVHT

SEQ ID NO: 6403 - protein, 9 aa, Dengue virus
SVIVTVHTG

SEQ ID NO: 6404 - protein, 9 aa, Dengue virus
VIVTVHTGD

SEQ ID NO: 6405 - protein, 9 aa, Dengue virus
IVTVHTGDQ

SEQ ID NO: 6406 - protein, 9 aa, Dengue virus
VTVHTGDQH

SEQ ID NO: 6407 - protein, 9 aa, Dengue virus
TVHTGDQHQ

SEQ ID NO: 6408 - protein, 9 aa, Dengue virus
VHTGDQHQV

SEQ ID NO: 6409 - protein, 9 aa, Dengue virus
HTGDQHQVG

SEQ ID NO: 6410 - protein, 9 aa, Dengue virus
TGDQHQVGN

SEQ ID NO: 6411 - protein, 9 aa, Dengue virus
GDQHQVGNE

SEQ ID NO: 6412 - protein, 9 aa, Dengue virus
DQHQVGNES

SEQ ID NO: 6413 - protein, 9 aa, Dengue virus
QHQVGNEST

SEQ ID NO: 6414 - protein, 9 aa, Dengue virus
HQVGNESTE

SEQ ID NO: 6415 - protein, 9 aa, Dengue virus
QVGNESTEH

SEQ ID NO: 6416 - protein, 9 aa, Dengue virus
VGNESTEHG

SEQ ID NO: 6417 - protein, 9 aa, Dengue virus
GNESTEHGT

SEQ ID NO: 6418 - protein, 9 aa, Dengue virus
NESTEHGTT

SEQ ID NO: 6419 - protein, 9 aa, Dengue virus
ESTEHGTTA

SEQ ID NO: 6420 - protein, 9 aa, Dengue virus
STEHGTTAT

SEQ ID NO: 6421 - protein, 9 aa, Dengue virus
TEHGTTATI

SEQ ID NO: 6422 - protein, 9 aa, Dengue virus
EHGTTATIT

SEQ ID NO: 6423 - protein, 9 aa, Dengue virus
HGTTATITP

SEQ ID NO: 6424 - protein, 9 aa, Dengue virus
GTTATITPQ

SEQ ID NO: 6425 - protein, 9 aa, Dengue virus
TTATITPQA

SEQ ID NO: 6426 - protein, 9 aa, Dengue virus
TATITPQAP

SEQ ID NO: 6427 - protein, 9 aa, Dengue virus
ATITPQAPT

SEQ ID NO: 6428 - protein, 9 aa, Dengue virus
TITPQAPTT

SEQ ID NO: 6429 - protein, 9 aa, Dengue virus
ITPQAPTTE

SEQ ID NO: 6430 - protein, 9 aa, Dengue virus
TPQAPTTEI

SEQ ID NO: 6431 - protein, 9 aa, Dengue virus
PQAPTTEIQ

SEQ ID NO: 6432 - protein, 9 aa, Dengue virus
QAPTTEIQL

SEQ ID NO: 6433 - protein, 9 aa, Dengue virus
APTTEIQLT

SEQ ID NO: 6434 - protein, 9 aa, Dengue virus
PTTEIQLTD

SEQ ID NO: 6435 - protein, 9 aa, Dengue virus
TTEIQLTDY

SEQ ID NO: 6436 - protein, 9 aa, Dengue virus
TEIQLTDYG

SEQ ID NO: 6437 - protein, 9 aa, Dengue virus
EIQLTDYGA

SEQ ID NO: 6438 - protein, 9 aa, Dengue virus
IQLTDYGAL

SEQ ID NO: 6439 - protein, 9 aa, Dengue virus
QLTDYGALT

SEQ ID NO: 6440 - protein, 9 aa, Dengue virus
LTDYGALTL

SEQ ID NO: 6441 - protein, 9 aa, Dengue virus
TDYGALTLD

SEQ ID NO: 6442 - protein, 9 aa, Dengue virus
DYGALTLDC

SEQ ID NO: 6443 - protein, 9 aa, Dengue virus
YGALTLDCS

SEQ ID NO: 6444 - protein, 9 aa, Dengue virus
GALTLDCSP

SEQ ID NO: 6445 - protein, 9 aa, Dengue virus
ALTLDCSPR

SEQ ID NO: 6446 - protein, 9 aa, Dengue virus
LTLDCSPRT

SEQ ID NO: 6447 - protein, 9 aa, Dengue virus
TLDCSPRTG

SEQ ID NO: 6448 - protein, 9 aa, Dengue virus
LDCSPRTGL

SEQ ID NO: 6449 - protein, 9 aa, Dengue virus
DCSPRTGLD

SEQ ID NO: 6450 - protein, 9 aa, Dengue virus
CSPRTGLDF

SEQ ID NO: 6451 - protein, 9 aa, Dengue virus
SPRTGLDFN

SEQ ID NO: 6452 - protein, 9 aa, Dengue virus
PRTGLDFNE

SEQ ID NO: 6453 - protein, 9 aa, Dengue virus
RTGLDFNEM

SEQ ID NO: 6454 - protein, 9 aa, Dengue virus
TGLDFNEMV

SEQ ID NO: 6455 - protein, 9 aa, Dengue virus
GLDFNEMVL

SEQ ID NO: 6456 - protein, 9 aa, Dengue virus
LDFNEMVLL

SEQ ID NO: 6457 - protein, 9 aa, Dengue virus
DFNEMVLLT

SEQ ID NO: 6458 - protein, 9 aa, Dengue virus
FNEMVLLTM

SEQ ID NO: 6459 - protein, 9 aa, Dengue virus
NEMVLLTMK

SEQ ID NO: 6460 - protein, 9 aa, Dengue virus
EMVLLTMKE

SEQ ID NO: 6461 - protein, 9 aa, Dengue virus
MVLLTMKEK

SEQ ID NO: 6462 - protein, 9 aa, Dengue virus
VLLTMKEKS

SEQ ID NO: 6463 - protein, 9 aa, Dengue virus
LLTMKEKSW

SEQ ID NO: 6464 - protein, 9 aa, Dengue virus
LTMKEKSWL

SEQ ID NO: 6465 - protein, 9 aa, Dengue virus
TMKEKSWLV

SEQ ID NO: 6466 - protein, 9 aa, Dengue virus
MKEKSWLVH

SEQ ID NO: 6467 - protein, 9 aa, Dengue virus
KEKSWLVHK

SEQ ID NO: 6468 - protein, 9 aa, Dengue virus
EKSWLVHKQ

SEQ ID NO: 6469 - protein, 9 aa, Dengue virus
KSWLVHKQW

SEQ ID NO: 6470 - protein, 9 aa, Dengue virus
SWLVHKQWF

SEQ ID NO: 6471 - protein, 9 aa, Dengue virus
WLVHKQWFL

SEQ ID NO: 6472 - protein, 9 aa, Dengue virus
LVHKQWFLD

SEQ ID NO: 6473 - protein, 9 aa, Dengue virus
VHKQWFLDL

SEQ ID NO: 6474 - protein, 9 aa, Dengue virus
HKQWFLDLP

SEQ ID NO: 6475 - protein, 9 aa, Dengue virus
KQWFLDLPL

SEQ ID NO: 6476 - protein, 9 aa, Dengue virus
QWFLDLPLP

SEQ ID NO: 6477 - protein, 9 aa, Dengue virus
WFLDLPLPW

SEQ ID NO: 6478 - protein, 9 aa, Dengue virus
FLDLPLPWT

SEQ ID NO: 6479 - protein, 9 aa, Dengue virus
LDLPLPWTS

SEQ ID NO: 6480 - protein, 9 aa, Dengue virus
DLPLPWTSG

SEQ ID NO: 6481 - protein, 9 aa, Dengue virus
LPLPWTSGA

SEQ ID NO: 6482 - protein, 9 aa, Dengue virus
PLPWTSGAS

SEQ ID NO: 6483 - protein, 9 aa, Dengue virus
LPWTSGAST

SEQ ID NO: 6484 - protein, 9 aa, Dengue virus
TSQETWNRQ

SEQ ID NO: 6485 - protein, 9 aa, Dengue virus
SQETWNRQD

SEQ ID NO: 6486 - protein, 9 aa, Dengue virus
QETWNRQDL

SEQ ID NO: 6487 - protein, 9 aa, Dengue virus
ETWNRQDLL

SEQ ID NO: 6488 - protein, 9 aa, Dengue virus
TWNRQDLLV

SEQ ID NO: 6489 - protein, 9 aa, Dengue virus
WNRQDLLVT

SEQ ID NO: 6490 - protein, 9 aa, Dengue virus
NRQDLLVTF

SEQ ID NO: 6491 - protein, 9 aa, Dengue virus
RQDLLVTFK

SEQ ID NO: 6492 - protein, 9 aa, Dengue virus
QDLLVTFKT

SEQ ID NO: 6493 - protein, 9 aa, Dengue virus
DLLVTFKTA

SEQ ID NO: 6494 - protein, 9 aa, Dengue virus
LLVTFKTAH

SEQ ID NO: 6495 - protein, 9 aa, Dengue virus
LVTFKTAHA

SEQ ID NO: 6496 - protein, 9 aa, Dengue virus
VTFKTAHAK

SEQ ID NO: 6497 - protein, 9 aa, Dengue virus
TFKTAHAKK

SEQ ID NO: 6498 - protein, 9 aa, Dengue virus
FKTAHAKKQ

SEQ ID NO: 6499 - protein, 9 aa, Dengue virus
KTAHAKKQE

SEQ ID NO: 6500 - protein, 9 aa, Dengue virus
TAHAKKQEV

SEQ ID NO: 6501 - protein, 9 aa, Dengue virus
AHAKKQEVV

SEQ ID NO: 6502 - protein, 9 aa, Dengue virus
HAKKQEVVV

SEQ ID NO: 6503 - protein, 9 aa, Dengue virus
AKKQEVVVL

SEQ ID NO: 6504 - protein, 9 aa, Dengue virus
KKQEVVVLG

SEQ ID NO: 6505 - protein, 9 aa, Dengue virus
KQEVVVLGS

SEQ ID NO: 6506 - protein, 9 aa, Dengue virus
QEVVVLGSQ

SEQ ID NO: 6507 - protein, 9 aa, Dengue virus
EVVVLGSQE

SEQ ID NO: 6508 - protein, 9 aa, Dengue virus
VVVLGSQEG

SEQ ID NO: 6509 - protein, 9 aa, Dengue virus
VVLGSQEGA

SEQ ID NO: 6510 - protein, 9 aa, Dengue virus
VLGSQEGAM

SEQ ID NO: 6511 - protein, 9 aa, Dengue virus
LGSQEGAMH

SEQ ID NO: 6512 - protein, 9 aa, Dengue virus
GSQEGAMHT

SEQ ID NO: 6513 - protein, 9 aa, Dengue virus
SQEGAMHTA

SEQ ID NO: 6514 - protein, 9 aa, Dengue virus
QEGAMHTAL

SEQ ID NO: 6515 - protein, 9 aa, Dengue virus
EGAMHTALT

SEQ ID NO: 6516 - protein, 9 aa, Dengue virus
GAMHTALTG

SEQ ID NO: 6517 - protein, 9 aa, Dengue virus
AMHTALTGA

SEQ ID NO: 6518 - protein, 9 aa, Dengue virus
MHTALTGAT

SEQ ID NO: 6519 - protein, 9 aa, Dengue virus
HTALTGATE

SEQ ID NO: 6520 - protein, 9 aa, Dengue virus
TALTGATEI

SEQ ID NO: 6521 - protein, 9 aa, Dengue virus
ALTGATEIQ

SEQ ID NO: 6522 - protein, 9 aa, Dengue virus
LTGATEIQT

SEQ ID NO: 6523 - protein, 9 aa, Dengue virus
TGATEIQTS

SEQ ID NO: 6524 - protein, 9 aa, Dengue virus
GATEIQTSG

SEQ ID NO: 6525 - protein, 9 aa, Dengue virus
ATEIQTSGT

SEQ ID NO: 6526 - protein, 9 aa, Dengue virus
TEIQTSGTT

SEQ ID NO: 6527 - protein, 9 aa, Dengue virus
EIQTSGTTT

SEQ ID NO: 6528 - protein, 9 aa, Dengue virus
IQTSGTTTI

SEQ ID NO: 6529 - protein, 9 aa, Dengue virus
QTSGTTTIF

SEQ ID NO: 6530 - protein, 9 aa, Dengue virus
TSGTTTIFA

SEQ ID NO: 6531 - protein, 9 aa, Dengue virus
SGTTTIFAG

SEQ ID NO: 6532 - protein, 9 aa, Dengue virus
GTTTIFAGH

SEQ ID NO: 6533 - protein, 9 aa, Dengue virus
TTTIFAGHL

SEQ ID NO: 6534 - protein, 9 aa, Dengue virus
TTIFAGHLK

SEQ ID NO: 6535 - protein, 9 aa, Dengue virus
TIFAGHLKC

SEQ ID NO: 6536 - protein, 9 aa, Dengue virus
IFAGHLKCR

SEQ ID NO: 6537 - protein, 9 aa, Dengue virus
FAGHLKCRL

SEQ ID NO: 6538 - protein, 9 aa, Dengue virus
AGHLKCRLK

SEQ ID NO: 6539 - protein, 9 aa, Dengue virus
GHLKCRLKM

SEQ ID NO: 6540 - protein, 9 aa, Dengue virus
HLKCRLKMD

SEQ ID NO: 6541 - protein, 9 aa, Dengue virus
LKCRLKMDK

SEQ ID NO: 6542 - protein, 9 aa, Dengue virus
KCRLKMDKL

SEQ ID NO: 6543 - protein, 9 aa, Dengue virus
CRLKMDKLT

SEQ ID NO: 6544 - protein, 9 aa, Dengue virus
RLKMDKLTL

SEQ ID NO: 6545 - protein, 9 aa, Dengue virus
LKMDKLTLK

SEQ ID NO: 6546 - protein, 9 aa, Dengue virus
KMDKLTLKG

SEQ ID NO: 6547 - protein, 9 aa, Dengue virus
MDKLTLKGM

SEQ ID NO: 6548 - protein, 9 aa, Dengue virus
DKLTLKGMS

SEQ ID NO: 6549 - protein, 9 aa, Dengue virus
KLTLKGMSY

SEQ ID NO: 6550 - protein, 9 aa, Dengue virus
LTLKGMSYV

SEQ ID NO: 6551 - protein, 9 aa, Dengue virus
TLKGMSYVM

SEQ ID NO: 6552 - protein, 9 aa, Dengue virus
LKGMSYVMC

SEQ ID NO: 6553 - protein, 9 aa, Dengue virus
KGMSYVMCT

SEQ ID NO: 6554 - protein, 9 aa, Dengue virus
GMSYVMCTG

SEQ ID NO: 6555 - protein, 9 aa, Dengue virus
SYVMCTGSF

SEQ ID NO: 6556 - protein, 9 aa, Dengue virus
YVMCTGSFK

SEQ ID NO: 6557 - protein, 9 aa, Dengue virus
VMCTGSFKL

SEQ ID NO: 6558 - protein, 9 aa, Dengue virus
MCTGSFKLE

SEQ ID NO: 6559 - protein, 9 aa, Dengue virus
CTGSFKLEK

SEQ ID NO: 6560 - protein, 9 aa, Dengue virus
TGSFKLEKE

SEQ ID NO: 6561 - protein, 9 aa, Dengue virus
GSFKLEKEV

SEQ ID NO: 6562 - protein, 9 aa, Dengue virus
SFKLEKEVA

SEQ ID NO: 6563 - protein, 9 aa, Dengue virus
FKLEKEVAE

SEQ ID NO: 6564 - protein, 9 aa, Dengue virus
KLEKEVAET

SEQ ID NO: 6565 - protein, 9 aa, Dengue virus
LEKEVAETQ

SEQ ID NO: 6566 - protein, 9 aa, Dengue virus
EKEVAETQH

SEQ ID NO: 6567 - protein, 9 aa, Dengue virus
KEVAETQHG

SEQ ID NO: 6568 - protein, 9 aa, Dengue virus
EVAETQHGT

SEQ ID NO: 6569 - protein, 9 aa, Dengue virus
VAETQHGTV

SEQ ID NO: 6570 - protein, 9 aa, Dengue virus
AETQHGTVL

SEQ ID NO: 6571 - protein, 9 aa, Dengue virus
ETQHGTVLV

SEQ ID NO: 6572 - protein, 9 aa, Dengue virus
TQHGTVLVQ

SEQ ID NO: 6573 - protein, 9 aa, Dengue virus
QHGTVLVQI

SEQ ID NO: 6574 - protein, 9 aa, Dengue virus
HGTVLVQIK

SEQ ID NO: 6575 - protein, 9 aa, Dengue virus
GTVLVQIKY

SEQ ID NO: 6576 - protein, 9 aa, Dengue virus
TVLVQIKYE

SEQ ID NO: 6577 - protein, 9 aa, Dengue virus
VLVQIKYEG

SEQ ID NO: 6578 - protein, 9 aa, Dengue virus
LVQIKYEGT

SEQ ID NO: 6579 - protein, 9 aa, Dengue virus
VQIKYEGTD

SEQ ID NO: 6580 - protein, 9 aa, Dengue virus
QIKYEGTDA

SEQ ID NO: 6581 - protein, 9 aa, Dengue virus
IKYEGTDAP

SEQ ID NO: 6582 - protein, 9 aa, Dengue virus
KYEGTDAPC

SEQ ID NO: 6583 - protein, 9 aa, Dengue virus
YEGTDAPCK

SEQ ID NO: 6584 - protein, 9 aa, Dengue virus
EGTDAPCKI

SEQ ID NO: 6585 - protein, 9 aa, Dengue virus
GTDAPCKIP

SEQ ID NO: 6586 - protein, 9 aa, Dengue virus
TDAPCKIPF

SEQ ID NO: 6587 - protein, 9 aa, Dengue virus
DAPCKIPFS

SEQ ID NO: 6588 - protein, 9 aa, Dengue virus
APCKIPFST

SEQ ID NO: 6589 - protein, 9 aa, Dengue virus
PCKIPFSTQ

SEQ ID NO: 6590 - protein, 9 aa, Dengue virus
CKIPFSTQD

SEQ ID NO: 6591 - protein, 9 aa, Dengue virus
KIPFSTQDE

SEQ ID NO: 6592 - protein, 9 aa, Dengue virus
QDEKGVTQN

SEQ ID NO: 6593 - protein, 9 aa, Dengue virus
DEKGVTQNG

SEQ ID NO: 6594 - protein, 9 aa, Dengue virus
EKGVTQNGR

SEQ ID NO: 6595 - protein, 9 aa, Dengue virus
KGVTQNGRL

SEQ ID NO: 6596 - protein, 9 aa, Dengue virus
GVTQNGRLI

SEQ ID NO: 6597 - protein, 9 aa, Dengue virus
VTQNGRLIT

SEQ ID NO: 6598 - protein, 9 aa, Dengue virus
TQNGRLITA

SEQ ID NO: 6599 - protein, 9 aa, Dengue virus
QNGRLITAN

SEQ ID NO: 6600 - protein, 9 aa, Dengue virus
NGRLITANP

SEQ ID NO: 6601 - protein, 9 aa, Dengue virus
GRLITANPI

SEQ ID NO: 6602 - protein, 9 aa, Dengue virus
RLITANPIV

SEQ ID NO: 6603 - protein, 9 aa, Dengue virus
LITANPIVT

SEQ ID NO: 6604 - protein, 9 aa, Dengue virus
ITANPIVTD

SEQ ID NO: 6605 - protein, 9 aa, Dengue virus
TANPIVTDK

SEQ ID NO: 6606 - protein, 9 aa, Dengue virus
ANPIVTDKE

SEQ ID NO: 6607 - protein, 9 aa, Dengue virus
NPIVTDKEK

SEQ ID NO: 6608 - protein, 9 aa, Dengue virus
PIVTDKEKP

SEQ ID NO: 6609 - protein, 9 aa, Dengue virus
IVTDKEKPV

SEQ ID NO: 6610 - protein, 9 aa, Dengue virus
VTDKEKPVN

SEQ ID NO: 6611 - protein, 9 aa, Dengue virus
TDKEKPVNI

SEQ ID NO: 6612 - protein, 9 aa, Dengue virus
DKEKPVNIE

SEQ ID NO: 6613 - protein, 9 aa, Dengue virus
KEKPVNIEA

SEQ ID NO: 6614 - protein, 9 aa, Dengue virus
EKPVNIEAE

SEQ ID NO: 6615 - protein, 9 aa, Dengue virus
KPVNIEAEP

SEQ ID NO: 6616 - protein, 9 aa, Dengue virus
PVNIEAEPP

SEQ ID NO: 6617 - protein, 9 aa, Dengue virus
VNIEAEPPF

SEQ ID NO: 6618 - protein, 9 aa, Dengue virus
NIEAEPPFG

SEQ ID NO: 6619 - protein, 9 aa, Dengue virus
IEAEPPFGE

SEQ ID NO: 6620 - protein, 9 aa, Dengue virus
EAEPPFGES

SEQ ID NO: 6621 - protein, 9 aa, Dengue virus
AEPPFGESY

SEQ ID NO: 6622 - protein, 9 aa, Dengue virus
EPPFGESYI

SEQ ID NO: 6623 - protein, 9 aa, Dengue virus
PPFGESYIV

SEQ ID NO: 6624 - protein, 9 aa, Dengue virus
PFGESYIVI

SEQ ID NO: 6625 - protein, 9 aa, Dengue virus
FGESYIVIG

SEQ ID NO: 6626 - protein, 9 aa, Dengue virus
IGAGEKALK

SEQ ID NO: 6627 - protein, 9 aa, Dengue virus
GAGEKALKL

SEQ ID NO: 6628 - protein, 9 aa, Dengue virus
AGEKALKLS

SEQ ID NO: 6629 - protein, 9 aa, Dengue virus
GEKALKLSW

SEQ ID NO: 6630 - protein, 9 aa, Dengue virus
EKALKLSWF

SEQ ID NO: 6631 - protein, 9 aa, Dengue virus
KALKLSWFK

SEQ ID NO: 6632 - protein, 9 aa, Dengue virus
ALKLSWFKK

SEQ ID NO: 6633 - protein, 9 aa, Dengue virus
LKLSWFKKG

SEQ ID NO: 6634 - protein, 9 aa, Dengue virus
KLSWFKKGS

SEQ ID NO: 6635 - protein, 9 aa, Dengue virus
LSWFKKGSS

SEQ ID NO: 6636 - protein, 9 aa, Dengue virus
SWFKKGSSI

SEQ ID NO: 6637 - protein, 9 aa, Dengue virus
WFKKGSSIG

SEQ ID NO: 6638 - protein, 9 aa, Dengue virus
FKKGSSIGK

SEQ ID NO: 6639 - protein, 9 aa, Dengue virus
KKGSSIGKM

SEQ ID NO: 6640 - protein, 9 aa, Dengue virus
KGSSIGKMF

SEQ ID NO: 6641 - protein, 9 aa, Dengue virus
GSSIGKMFE

SEQ ID NO: 6642 - protein, 9 aa, Dengue virus
SSIGKMFEA

SEQ ID NO: 6643 - protein, 9 aa, Dengue virus
SIGKMFEAT

SEQ ID NO: 6644 - protein, 9 aa, Dengue virus
IGKMFEATA

SEQ ID NO: 6645 - protein, 9 aa, Dengue virus
GKMFEATAR

SEQ ID NO: 6646 - protein, 9 aa, Dengue virus
KMFEATARG

SEQ ID NO: 6647 - protein, 9 aa, Dengue virus
MFEATARGA

SEQ ID NO: 6648 - protein, 9 aa, Dengue virus
FEATARGAR

SEQ ID NO: 6649 - protein, 9 aa, Dengue virus
EATARGARR

SEQ ID NO: 6650 - protein, 9 aa, Dengue virus
ATARGARRM

SEQ ID NO: 6651 - protein, 9 aa, Dengue virus
TARGARRMA

SEQ ID NO: 6652 - protein, 9 aa, Dengue virus
ARGARRMAI

SEQ ID NO: 6653 - protein, 9 aa, Dengue virus
RGARRMAIL

SEQ ID NO: 6654 - protein, 9 aa, Dengue virus
GARRMAILG

SEQ ID NO: 6655 - protein, 9 aa, Dengue virus
ARRMAILGD

SEQ ID NO: 6656 - protein, 9 aa, Dengue virus
RRMAILGDT

SEQ ID NO: 6657 - protein, 9 aa, Dengue virus
RMAILGDTA

SEQ ID NO: 6658 - protein, 9 aa, Dengue virus
MAILGDTAW

SEQ ID NO: 6659 - protein, 9 aa, Dengue virus
AILGDTAWD

SEQ ID NO: 6660 - protein, 9 aa, Dengue virus
ILGDTAWDF

SEQ ID NO: 6661 - protein, 9 aa, Dengue virus
LGDTAWDFG

SEQ ID NO: 6662 - protein, 9 aa, Dengue virus
GDTAWDFGS

SEQ ID NO: 6663 - protein, 9 aa, Dengue virus
DTAWDFGSI

SEQ ID NO: 6664 - protein, 9 aa, Dengue virus
TAWDFGSIG

SEQ ID NO: 6665 - protein, 9 aa, Dengue virus
AWDFGSIGG

SEQ ID NO: 6666 - protein, 9 aa, Dengue virus
WDFGSIGGV

SEQ ID NO: 6667 - protein, 9 aa, Dengue virus
DFGSIGGVF

SEQ ID NO: 6668 - protein, 9 aa, Dengue virus
FGSIGGVFT

SEQ ID NO: 6669 - protein, 9 aa, Dengue virus
GSIGGVFTS

SEQ ID NO: 6670 - protein, 9 aa, Dengue virus
GGVFTSVGK

SEQ ID NO: 6671 - protein, 9 aa, Dengue virus
GVFTSVGKL

SEQ ID NO: 6672 - protein, 9 aa, Dengue virus
FTSVGKLVH

SEQ ID NO: 6673 - protein, 9 aa, Dengue virus
TSVGKLVHQ

SEQ ID NO: 6674 - protein, 9 aa, Dengue virus
GKLVHQIFG

SEQ ID NO: 6675 - protein, 9 aa, Dengue virus
KLVHQIFGT

SEQ ID NO: 6676 - protein, 9 aa, Dengue virus
LVHQIFGTA

SEQ ID NO: 6677 - protein, 9 aa, Dengue virus
VHQIFGTAY

SEQ ID NO: 6678 - protein, 9 aa, Dengue virus
HQIFGTAYG

SEQ ID NO: 6679 - protein, 9 aa, Dengue virus
QIFGTAYGV

SEQ ID NO: 6680 - protein, 9 aa, Dengue virus
IFGTAYGVL

SEQ ID NO: 6681 - protein, 9 aa, Dengue virus
FGTAYGVLF

SEQ ID NO: 6682 - protein, 9 aa, Dengue virus
GTAYGVLFS

SEQ ID NO: 6683 - protein, 9 aa, Dengue virus
TAYGVLFSG

SEQ ID NO: 6684 - protein, 9 aa, Dengue virus
AYGVLFSGV

SEQ ID NO: 6685 - protein, 9 aa, Dengue virus
YGVLFSGVS

SEQ ID NO: 6686 - protein, 9 aa, Dengue virus
GVLFSGVSW

SEQ ID NO: 6687 - protein, 9 aa, Dengue virus
VLFSGVSWT

SEQ ID NO: 6688 - protein, 9 aa, Dengue virus
LFSGVSWTM

SEQ ID NO: 6689 - protein, 9 aa, Dengue virus
FSGVSWTMK

SEQ ID NO: 6690 - protein, 9 aa, Dengue virus
SGVSWTMKI

SEQ ID NO: 6691 - protein, 9 aa, Dengue virus
GVSWTMKIG

SEQ ID NO: 6692 - protein, 9 aa, Dengue virus
VSWTMKIGI

SEQ ID NO: 6693 - protein, 9 aa, Dengue virus
SWTMKIGIG

SEQ ID NO: 6694 - protein, 9 aa, Dengue virus
WTMKIGIGV

SEQ ID NO: 6695 - protein, 9 aa, Dengue virus
TMKIGIGVL

SEQ ID NO: 6696 - protein, 9 aa, Dengue virus
MKIGIGVLL

SEQ ID NO: 6697 - protein, 9 aa, Dengue virus
KIGIGVLLT

SEQ ID NO: 6698 - protein, 9 aa, Dengue virus
IGIGVLLTW

SEQ ID NO: 6699 - protein, 9 aa, Dengue virus
GIGVLLTWL

SEQ ID NO: 6700 - protein, 9 aa, Dengue virus
IGVLLTWLG

SEQ ID NO: 6701 - protein, 9 aa, Dengue virus
GVLLTWLGL

SEQ ID NO: 6702 - protein, 9 aa, Dengue virus
VLLTWLGLN

SEQ ID NO: 6703 - protein, 9 aa, Dengue virus
LLTWLGLNS

SEQ ID NO: 6704 - protein, 9 aa, Dengue virus
LTWLGLNSR

SEQ ID NO: 6705 - protein, 9 aa, Dengue virus
TWLGLNSRS

SEQ ID NO: 6706 - protein, 9 aa, Dengue virus
WLGLNSRST

SEQ ID NO: 6707 - protein, 9 aa, Dengue virus
LGLNSRSTS

SEQ ID NO: 6708 - protein, 9 aa, Dengue virus
GLNSRSTSL

SEQ ID NO: 6709 - protein, 9 aa, Dengue virus
LNSRSTSLS

SEQ ID NO: 6710 - protein, 9 aa, Dengue virus
NSRSTSLSM

SEQ ID NO: 6711 - protein, 9 aa, Dengue virus
SRSTSLSMT

SEQ ID NO: 6712 - protein, 9 aa, Dengue virus
RSTSLSMTC

SEQ ID NO: 6713 - protein, 9 aa, Dengue virus
STSLSMTCI

SEQ ID NO: 6714 - protein, 9 aa, Dengue virus
TSLSMTCIA

SEQ ID NO: 6715 - protein, 9 aa, Dengue virus
SLSMTCIAV

SEQ ID NO: 6716 - protein, 9 aa, Dengue virus
LSMTCIAVG

SEQ ID NO: 6717 - protein, 9 aa, Dengue virus
SMTCIAVGL

SEQ ID NO: 6718 - protein, 9 aa, Dengue virus
MTCIAVGLV

SEQ ID NO: 6719 - protein, 9 aa, Dengue virus
TCIAVGLVT

SEQ ID NO: 6720 - protein, 9 aa, Dengue virus
CIAVGLVTL

SEQ ID NO: 6721 - protein, 9 aa, Dengue virus
IAVGLVTLY

SEQ ID NO: 6722 - protein, 9 aa, Dengue virus
AVGLVTLYL

SEQ ID NO: 6723 - protein, 9 aa, Dengue virus
VGLVTLYLG

SEQ ID NO: 6724 - protein, 9 aa, Dengue virus
GLVTLYLGV

SEQ ID NO: 6725 - protein, 9 aa, Dengue virus
LVTLYLGVM

SEQ ID NO: 6726 - protein, 9 aa, Dengue virus
VTLYLGVMV

SEQ ID NO: 6727 - protein, 9 aa, Dengue virus
TLYLGVMVQ

SEQ ID NO: 6728 - protein, 9 aa, Dengue virus
LYLGVMVQA

SEQ ID NO: 6729 - protein, 9 aa, Dengue virus
YLGVMVQAD

SEQ ID NO: 6730 - protein, 9 aa, Dengue virus
LGVMVQADS

SEQ ID NO: 6731 - protein, 9 aa, Dengue virus
GVMVQADSG

SEQ ID NO: 6732 - protein, 9 aa, Dengue virus
VMVQADSGC

SEQ ID NO: 6733 - protein, 9 aa, Dengue virus
MVQADSGCV

SEQ ID NO: 6734 - protein, 9 aa, Dengue virus
VQADSGCVI

SEQ ID NO: 6735 - protein, 9 aa, Dengue virus
QADSGCVIN

SEQ ID NO: 6736 - protein, 9 aa, Dengue virus
ADSGCVINW

SEQ ID NO: 6737 - protein, 9 aa, Dengue virus
DSGCVINWK

SEQ ID NO: 6738 - protein, 9 aa, Dengue virus
SGCVINWKG

SEQ ID NO: 6739 - protein, 9 aa, Dengue virus
GCVINWKGR

SEQ ID NO: 6740 - protein, 9 aa, Dengue virus
CVINWKGRE

SEQ ID NO: 6741 - protein, 9 aa, Dengue virus
VINWKGREL

SEQ ID NO: 6742 - protein, 9 aa, Dengue virus
INWKGRELK

SEQ ID NO: 6743 - protein, 9 aa, Dengue virus
NWKGRELKC

SEQ ID NO: 6744 - protein, 9 aa, Dengue virus
WKGRELKCG

SEQ ID NO: 6745 - protein, 9 aa, Dengue virus
KGRELKCGS

SEQ ID NO: 6746 - protein, 9 aa, Dengue virus
GRELKCGSG

SEQ ID NO: 6747 - protein, 9 aa, Dengue virus
RELKCGSGI

SEQ ID NO: 6748 - protein, 9 aa, Dengue virus
ELKCGSGIF

SEQ ID NO: 6749 - protein, 9 aa, Dengue virus
LKCGSGIFV

SEQ ID NO: 6750 - protein, 9 aa, Dengue virus
KCGSGIFVT

SEQ ID NO: 6751 - protein, 9 aa, Dengue virus
CGSGIFVTN

SEQ ID NO: 6752 - protein, 9 aa, Dengue virus
GSGIFVTNE

SEQ ID NO: 6753 - protein, 9 aa, Dengue virus
SGIFVTNEV

SEQ ID NO: 6754 - protein, 9 aa, Dengue virus
GIFVTNEVH

SEQ ID NO: 6755 - protein, 9 aa, Dengue virus
IFVTNEVHT

SEQ ID NO: 6756 - protein, 9 aa, Dengue virus
FVTNEVHTW

SEQ ID NO: 6757 - protein, 9 aa, Dengue virus
VTNEVHTWT

SEQ ID NO: 6758 - protein, 9 aa, Dengue virus
TNEVHTWTE

SEQ ID NO: 6759 - protein, 9 aa, Dengue virus
NEVHTWTEQ

SEQ ID NO: 6760 - protein, 9 aa, Dengue virus
EVHTWTEQY

SEQ ID NO: 6761 - protein, 9 aa, Dengue virus
VHTWTEQYK

SEQ ID NO: 6762 - protein, 9 aa, Dengue virus
HTWTEQYKF

SEQ ID NO: 6763 - protein, 9 aa, Dengue virus
TWTEQYKFQ

SEQ ID NO: 6764 - protein, 9 aa, Dengue virus
WTEQYKFQA

SEQ ID NO: 6765 - protein, 9 aa, Dengue virus
TEQYKFQAD

SEQ ID NO: 6766 - protein, 9 aa, Dengue virus
EQYKFQADS

SEQ ID NO: 6767 - protein, 9 aa, Dengue virus
QYKFQADSP

SEQ ID NO: 6768 - protein, 9 aa, Dengue virus
YKFQADSPK

SEQ ID NO: 6769 - protein, 9 aa, Dengue virus
KFQADSPKR

SEQ ID NO: 6770 - protein, 9 aa, Dengue virus
FQADSPKRL

SEQ ID NO: 6771 - protein, 9 aa, Dengue virus
QADSPKRLS

SEQ ID NO: 6772 - protein, 9 aa, Dengue virus
ADSPKRLSA

SEQ ID NO: 6773 - protein, 9 aa, Dengue virus
DSPKRLSAA

SEQ ID NO: 6774 - protein, 9 aa, Dengue virus
SPKRLSAAI

SEQ ID NO: 6775 - protein, 9 aa, Dengue virus
PKRLSAAIG

SEQ ID NO: 6776 - protein, 9 aa, Dengue virus
KRLSAAIGK

SEQ ID NO: 6777 - protein, 9 aa, Dengue virus
RLSAAIGKA

SEQ ID NO: 6778 - protein, 9 aa, Dengue virus
LSAAIGKAW

SEQ ID NO: 6779 - protein, 9 aa, Dengue virus
SAAIGKAWE

SEQ ID NO: 6780 - protein, 9 aa, Dengue virus
AAIGKAWEE

(The sequence listing continues in the following parts.)

What is claimed is:

1. A method for identifying at least one peptide block in a plurality of homologous polypeptides as being conserved and as comprising one or more peptides suitable for use in an immunogenic composition and manufacturing any one or more of the peptides from the identified at least one peptide block, the method comprising:

(a) identifying at least one peptide block within a multiple sequence alignment (MSA) of a plurality of homologous polypeptides, each peptide being the same length as the other peptides within the same peptide block, wherein the peptides within each of the at least one peptide block are 8-11 amino acids in length and, wherein each of the at least one peptide block is a region of homology found within the MSA, and wherein each of the at least one peptide block includes a peptide from each of the polypeptides in the MSA and comprises at least two unique peptides;

(b) for each of the at least one peptide block, determining a minimum required number of unique peptides within the peptide block such that the cumulative fraction of polypeptides in the MSA comprising one or more of the unique peptides is at least 95%;

(c) identifying at least one peptide block as conserved and as comprising one or more peptides suitable for use in an immunogenic composition if the minimum required number of unique peptides determined in step (b) is between 2 and 7; and (d) manufacturing any one or more of the peptides from the at least one peptide block identified as conserved and as comprising one or more peptides suitable for use in an immunogenic composition in step (c).

2. The method of claim 1, wherein the plurality of polypeptides in the MSA comprises subsets of homologous polypeptides, each subset being derived from a different species; and wherein at least one peptide block is further identified in step (c) as conserved if the unique peptides used to determine the minimum required number in step (b) also represent a cumulative fraction of at least 99% of the homologous polypeptides in each subset of homologous polypeptides in the MSA.

3. The method of claim 2, wherein the plurality of species comprises different serotypes of a virus.

4. The method of claim 3, wherein the virus is dengue virus.

5. The method of claim 3, wherein the serotypes are selected from one or more of dengue virus (DENV)-1, DENV-2, DENV-3, and DENV-4.

6. The method of claim 3, wherein the serotypes comprise DENV-1, DENV-2, DENV-3 and DENV-4.

7. The method of claim 1, wherein the cumulative fraction of homologous polypeptides in the MSA comprising one or more of the unique peptides is at least 97% or at least 99%.

8. The method of claim 1, wherein the minimum required number of unique peptides determined in step (b) is between 2 and 6.

9. The method of claim 1, wherein the polypeptides in the MSA are derived from a virus.

10. The method of claim 9, wherein the virus is from a family selected from the group consisting of: Retroviridae, Picornaviridae, Caliciviridae, Togaviridae, Flaviridae, Coronaviridae, Rhabdoviridae, Filoviridae, Paramyxoviridae, Orthomyxoviridae, Bunyaviridae, Arena viridae, Reoviridae, Birnaviridae, Hepadnaviridae, Parvoviridae, Papovaviridae, Adenoviridae, Herperviridae, Poxyiridae, and Iridoviridae.

11. The method of claim 9, wherein the virus is selected from the group consisting of dengue virus (DENV), yellow fever virus (YFV), Japanese encephalitis virus (JEV), West Nile virus (WNV), and Tick-borne encephalitis virus (TBEV).

12. The method of claim 9, wherein the virus is selected from the group consisting of norovirus, influenza virus, and human immunodeficiency virus.

13. The method of claim 1, wherein the minimum required number of unique peptides determined in step (b) is between 2 and 5.

* * * * *

UNITED STATES PATENT AND TRADEMARK OFFICE
CERTIFICATE OF CORRECTION

PATENT NO. : 9,205,144 B2
APPLICATION NO. : 13/507106
DATED : December 8, 2015
INVENTOR(S) : Vladimir Brusic et al.

It is certified that error appears in the above-identified patent and that said Letters Patent is hereby corrected as shown below:

In the claims

Column 50, Line 66 - In Claim 10, delete "Flaviridae," and insert -- Flaviviridae, --, therefor.

Column 51, Line 1 - In Claim 10, delete "Arena viridae," and insert -- Arenaviridae, --, therefor.

Column 51, Line 3 - In Claim 10, delete "Herperviridae, Poxyiridae," and insert -- Herpesviridae, Poxviridae, --, therefor.

Signed and Sealed this
Twelfth Day of April, 2016

Michelle K. Lee
*Director of the United States Patent and Trademark Office*